US008431139B2

(12) United States Patent
Telford et al.

(10) Patent No.: US 8,431,139 B2
(45) Date of Patent: Apr. 30, 2013

(54) **NUCLEIC ACIDS AND PROTEINS FROM *STREPTOCOCCUS* GROUPS A AND B**

(75) Inventors: John Telford, Monteriggioni (IT); Vega Masignani, Siena (IT); Maria Scarselli, Siena (IT); Guido Grandi, Segrate (IT); Herve Tettelin, Rockville, MD (US); Claire Fraser, Clarksville, MD (US)

(73) Assignees: Novartis Vaccines and Diagnostics, Inc., Emeryville, CA (US); J. Craig Venter Institute, Rockville, MD (US)

( * ) Notice: Subject to any disclaimer, the term of this patent is extended or adjusted under 35 U.S.C. 154(b) by 72 days.

(21) Appl. No.: 11/434,203

(22) Filed: May 16, 2006

(65) Prior Publication Data

US 2006/0210582 A1    Sep. 21, 2006

Related U.S. Application Data

(62) Division of application No. 10/415,182, filed as application No. PCT/GB01/04789 on Oct. 29, 2001, now Pat. No. 7,939,087.

(30) Foreign Application Priority Data

Oct. 27, 2000 (GB) .................................. 0026333.5
Nov. 24, 2000 (GB) .................................. 0028727.6
Mar. 7, 2001 (GB) .................................. 0105640.7

(51) Int. Cl.
*A61K 39/09*    (2006.01)
(52) U.S. Cl. ............... 424/244.1; 424/184.1; 424/201.1; 424/203.1; 424/242.1; 435/69.1; 435/69.7; 435/320.1; 530/350
(58) Field of Classification Search .................. None
See application file for complete search history.

(56) References Cited

U.S. PATENT DOCUMENTS

| | | | | |
|---|---|---|---|---|
| 3,676,548 A | * | 7/1972 | Ose .......................... 424/244.1 |
| 4,454,121 A | | 6/1984 | Beachey |
| 5,098,827 A | * | 3/1992 | Boyle et al. .................. 435/7.34 |
| 5,354,846 A | | 10/1994 | Kehoe |
| 5,378,620 A | | 1/1995 | Adams et al. |
| 5,391,712 A | | 2/1995 | Adams et al. |
| 5,445,820 A | | 8/1995 | Seidel et al. |
| 5,585,098 A | * | 12/1996 | Coleman .................... 424/157.1 |
| 5,604,109 A | * | 2/1997 | Fischetti et al. ............. 435/7.34 |
| 5,612,042 A | * | 3/1997 | Jacobs ....................... 424/237.1 |
| 5,700,648 A | | 12/1997 | Kehoe |
| 5,804,198 A | * | 9/1998 | Lindberg et al. ........... 424/242.1 |
| 5,821,088 A | | 10/1998 | Darzins et al. |

(Continued)

FOREIGN PATENT DOCUMENTS

| EP | 0369825 | 5/1990 |
|---|---|---|
| EP | 0613947 | 1/1994 |

(Continued)

OTHER PUBLICATIONS

Amara, A et al, Neuroscience letters (Ireland) Feb. 13, 1995, vol. 185(3) pp. 147-150, Molecular detection of methionine in rat brain using specific antibodies.*

(Continued)

*Primary Examiner* — Albert Navarro
*Assistant Examiner* — Ginny Portner
(74) *Attorney, Agent, or Firm* — Banner & Witcoff, Ltd.

(57) ABSTRACT

The invention provides proteins from group B streptococcus (*Streptococcus agalactiae*) and group A streptococcus (*Streptococcus pyogenes*), including amino acid sequences and the corresponding nucleotide sequences. Data are given to show that the proteins are useful antigens for vaccines, immunogenic compositions, and/or diagnostics. The proteins are also targets for antibiotics.

29 Claims, 95 Drawing Sheets

U.S. PATENT DOCUMENTS

| | | | |
|---|---|---|---|
| 5,846,547 | A | 12/1998 | Cleary |
| 5,919,640 | A * | 7/1999 | Tikkanen et al. ............ 435/7.34 |
| 5,968,763 | A * | 10/1999 | Fischetti et al. ................. 435/23 |
| 6,103,243 | A * | 8/2000 | Russell-Jones et al. . 424/195.11 |
| 6,174,528 | B1 | 1/2001 | Cooper et al. |
| 6,342,223 | B1 * | 1/2002 | Michel et al. .............. 424/190.1 |
| 6,372,222 | B1 | 4/2002 | Michon et al. |
| 6,406,883 | B1 | 6/2002 | Lutticken et al. |
| 6,420,152 | B1 | 7/2002 | Adams et al. |
| 6,426,074 | B1 * | 7/2002 | Michel et al. .............. 424/244.1 |
| 6,579,711 | B1 * | 6/2003 | Gaier et al. ................. 435/253.4 |
| 6,593,093 | B1 * | 7/2003 | Uhl et al. ............................ 435/6 |
| 6,635,623 | B1 * | 10/2003 | Hoogeveen et al. ............. 514/44 |
| 6,669,703 | B2 | 12/2003 | Shue |
| 6,737,521 | B1 | 5/2004 | Fischetti et al. |
| 6,747,437 | B2 * | 6/2004 | Chiu ............................ 320/107 |
| 6,777,547 | B1 | 8/2004 | Podbielski |
| 6,833,356 | B1 | 12/2004 | Koenig et al. |
| 6,936,252 | B2 | 8/2005 | Gilbert et al. |
| 7,033,765 | B1 | 4/2006 | Dime et al. |
| 7,041,814 | B1 | 5/2006 | Weinstock et al. |
| 7,098,182 | B2 * | 8/2006 | Le Page et al. ..................... 514/2 |
| 7,101,692 | B2 | 9/2006 | Schneewind et al. |
| 7,128,918 | B1 | 10/2006 | Hamel et al. |
| 7,128,919 | B2 | 10/2006 | Adderson et al. |
| 7,169,902 | B2 | 1/2007 | Podbielski |
| 7,183,097 | B1 * | 2/2007 | Gerdes et al. ............... 435/252.3 |
| 7,247,308 | B2 | 7/2007 | Martin et al. |
| 7,270,827 | B2 * | 9/2007 | Reddish et al. ............ 424/244.1 |
| 7,348,006 | B2 | 3/2008 | Contorni et al. |
| 7,407,664 | B2 | 8/2008 | Beall et al. |
| 7,438,912 | B2 * | 10/2008 | Meinke et al. .............. 424/165.1 |
| 7,485,710 | B2 * | 2/2009 | Reinscheid et al. .......... 536/23.1 |
| 7,527,801 | B2 * | 5/2009 | Coit et al. ................... 424/216.1 |
| 7,709,009 | B2 * | 5/2010 | Grandi et al. ............... 424/244.1 |
| 7,939,087 | B2 * | 5/2011 | Telford et al. .............. 424/244.1 |
| 7,960,533 | B2 * | 6/2011 | Reinscheid et al. .......... 536/23.7 |
| 8,025,890 | B2 * | 9/2011 | Telford et al. .............. 424/244.1 |
| 8,128,936 | B2 * | 3/2012 | Grandi et al. ............... 424/190.1 |
| 8,137,673 | B2 * | 3/2012 | Telford et al. .............. 424/190.1 |
| 2002/0025516 | A1 | 2/2002 | Black et al. |
| 2002/0045737 | A1 | 4/2002 | Choi et al. |
| 2002/0055168 | A1 * | 5/2002 | Smith ........................ 435/320.1 |
| 2002/0061569 | A1 | 5/2002 | Haselbeck et al. |
| 2002/0086023 | A1 | 7/2002 | Dale |
| 2003/0035805 | A1 * | 2/2003 | Michel et al. .............. 424/184.1 |
| 2003/0109690 | A1 | 6/2003 | Ruben et al. |
| 2003/0157122 | A1 | 8/2003 | Dale |
| 2003/0171337 | A1 | 9/2003 | Aylward et al. |
| 2004/0029129 | A1 | 2/2004 | Wang et al. |
| 2004/0101536 | A1 | 5/2004 | Teti et al. |
| 2004/0219639 | A1 | 11/2004 | Potter et al. |
| 2004/0236072 | A1 | 11/2004 | Olmsted et al. |
| 2005/0019345 | A1 | 1/2005 | Podbielski |
| 2005/0020813 | A1 | 1/2005 | Masignani et al. |
| 2005/0181388 | A1 | 8/2005 | Edwards et al. |
| 2005/0214918 | A1 | 9/2005 | Edwards et al. |
| 2005/0288866 | A1 | 12/2005 | Sachdeva |
| 2006/0039922 | A1 | 2/2006 | Mizzen et al. |
| 2006/0041961 | A1 | 2/2006 | Abad et al. |
| 2006/0073530 | A1 | 4/2006 | Schneewind et al. |
| 2006/0115479 | A1 * | 6/2006 | Reinscheid et al. ........ 424/146.1 |
| 2006/0160121 | A1 | 7/2006 | Mounts et al. |
| 2006/0165716 | A1 | 7/2006 | Telford et al. |
| 2006/0194751 | A1 * | 8/2006 | Meinke et al. ................... 514/44 |
| 2006/0210579 | A1 | 9/2006 | Telford et al. |
| 2006/0210580 | A1 | 9/2006 | Telford et al. |
| 2006/0210581 | A1 | 9/2006 | Telford et al. |
| 2006/0210582 | A1 | 9/2006 | Telford et al. |
| 2006/0258849 | A1 | 11/2006 | Telford et al. |
| 2006/0269541 | A1 * | 11/2006 | Meinke et al. .............. 424/133.1 |
| 2006/0275315 | A1 | 12/2006 | Telford et al. |
| 2007/0036828 | A1 | 2/2007 | Rappuoli et al. |
| 2007/0053924 | A1 | 3/2007 | Tettelin et al. |
| 2007/0065464 | A1 * | 3/2007 | Grandi et al. ............... 424/244.1 |
| 2007/0098737 | A1 | 5/2007 | Dale |
| 2007/0116712 | A1 | 5/2007 | Hamel et al. |
| 2007/0128210 | A1 | 6/2007 | Olmsted et al. |
| 2007/0128211 | A1 | 6/2007 | Olmsted et al. |
| 2007/0128229 | A1 | 6/2007 | Olmsted et al. |
| 2007/0141635 | A1 | 6/2007 | James |
| 2008/0038268 | A1 | 2/2008 | Martin et al. |
| 2008/0213308 | A1 * | 9/2008 | Valiante et al. ............ 424/208.1 |
| 2008/0220010 | A1 | 9/2008 | Telford et al. |
| 2009/0022753 | A1 | 1/2009 | Olmsted et al. |
| 2010/0150943 | A1 * | 6/2010 | Grandi et al. ............... 424/165.1 |

FOREIGN PATENT DOCUMENTS

| | | | |
|---|---|---|---|
| EP | 555438 | | 1/1997 |
| EP | 555439 | | 10/1997 |
| EP | 1770171 | | 4/2007 |
| GB | 2233977 | | 1/1991 |
| WO | WO9305155 | | 3/1993 |
| WO | WO9305156 | | 3/1993 |
| WO | WO 98 01561 | | 1/1998 |
| WO | WO9818931 | | 5/1998 |
| WO | WO9819689 | | 5/1998 |
| WO | WO 98 23631 | | 6/1998 |
| WO | WO9803677 | | 8/1998 |
| WO | WO9913084 | | 3/1999 |
| WO | WO 99 16882 | | 4/1999 |
| WO | WO9926969 | | 6/1999 |
| WO | WO9942588 | | 8/1999 |
| WO | WO9954457 | | 10/1999 |
| WO | 00/06737 | * | 2/2000 |
| WO | WO0006736 | | 2/2000 |
| WO | WO0023456 | | 4/2000 |
| WO | WO0078787 | | 12/2000 |
| WO | WO 01 32882 | | 5/2001 |
| WO | WO0132882 | | 5/2001 |
| WO | WO0212294 | | 2/2002 |
| WO | WO02075507 | | 9/2002 |
| WO | WO02077183 | | 10/2002 |
| WO | WO 02/092818 | | 11/2002 |
| WO | WO02092818 | | 11/2002 |
| WO | WO03068813 | | 8/2003 |
| WO | WO03087353 | | 10/2003 |
| WO | WO 03093306 | | 11/2003 |
| WO | WO2004018646 | | 3/2004 |
| WO | WO2004041157 | | 5/2004 |
| WO | WO2004078907 | | 9/2004 |
| WO | WO2004099242 | | 11/2004 |
| WO | WO2005013666 | | 2/2005 |
| WO | WO 2004/035618 | | 3/2005 |
| WO | WO2005032582 | | 4/2005 |
| WO | PCT/US2005/10954 | | 7/2005 |
| WO | WO2005076010 | | 8/2005 |
| WO | WO2005108419 | | 11/2005 |
| WO | WO2006035311 | | 4/2006 |
| WO | WO2006042027 | | 4/2006 |
| WO | WO2006069200 | | 6/2006 |
| WO | WO2006/078318 | | 7/2006 |
| WO | WO2006078318 | | 7/2006 |
| WO | WO2006082527 | | 8/2006 |
| WO | WO2006082530 | | 8/2006 |
| WO | WO2006130328 | | 12/2006 |
| WO | WO2007018563 | | 2/2007 |
| WO | WO2007039319 | | 4/2007 |
| WO | WO2007052168 | | 5/2007 |
| WO | WO2008020335 | | 2/2008 |
| WO | WO2008108830 | | 9/2008 |
| WO | WO2008003515 | | 10/2008 |

OTHER PUBLICATIONS

Signature Immunologics product listing of anti-amino acid antibodies at immunologics.com, dated Mar. 8, 2008.*

Lachenauer et al, 1996, Infection and Immunity, Oct. 1996, pp. 4255, vol. 64(10), A protective surface protein from Type V Group B Streptococci shares N-terminal sequence homology with the Alpha C-protein.*

Orefici et al, European Journal of Clinical Microbiology and Infectious Diseases, pp. 302-305, vol. 7, 1988, Possible virulence marker for *Streptococcus agalactiae* (Lancefield Group B).*

Rosini, R et al, Molecular Microbiology, vol. 61(1), pp. 126-141, 2006, Identification of novel genomic islands coding for antigenic pilus-like structures in *Streptococcus agalactiae*.*

Weir, Bye. M. Handbook of Experimental Immunology, Immunochemistry, vol. 1, Oxford, Blackwell Scientific, 1986, pp. 8.14 and 8.15.*

Russell-Jones et al, Journal of Experimental Medicine, vol. 160, Nov. 1984, pp. 1476-1484, Indentification of protein antigens of Group B *Streptococcus*, with special reference to the Ibc antigens.*

Lilja, M et al, 1999, International Journal of Pediatric Otorhinolaryngology, where are the receptors for *Streptococcus pylogenes* located on the tonsillar surface epithelium.*

Vanrobaeys, M et al, Microbiology, 1999, vol. 145, pp. 335-342, Ultrastructure of surface components of *Streptococcus gallolyticus* (*S. bovis*) strains of differing virulence isoalted from pigeons.*

Ghuysen et al, Bacterial Cell Wall, New Comprehensive Biochemistry, vol. 27, 1994, pp. cover, library of congress data page and pp. 228-229.*

Michel, James L et al, Infection and Immunity, Jun. 1991, pp. 2023-2028, vol. 59 (6), Cloned Alpha and Beta C-protein Antigens of Group B *Streptococcus* Elicit Protective immunity (describes c-proteins as surface antigens).*

Lancefield, Rebecca C et al, The Journal of Experimental Medicine, vol. 142, 1975, pp. 165-179, multiple mouse protective antibodies detected against Group B Streptococci.*

Sitkiewicz, I et al, PLOS one, Jul. 1, 2009, vol. 4(7, e6114), pp. 1-15, Transcriptome Adaptation of Group B *Streptococcus* to Growth in Human Amniotic Fluid.*

Wagner, B et al, Immunoelecton Microscopic Analysis of Polysaccharide and Protein Surface Antigens of Wild Strains of Group B Streptococci, Zbl. Bakt. Hyg, I, Abt, Orig. A, vol. 253, pp. 331-343, 1982.*

Ghuysen et al, Bacterial Cell Wall, New Comprehensive Biochemistry, vol. 27, 1994, pages cover, library of congress data page and pp. 228-229.*

NCBI Accession No. AAD29767 Hypothetical Protein of *Arabidopsis thaliana*, May 11, 1999.*

Gutekunst et al., "Analysis of RogB-Controlled Virulence Mechanisms and Gene Expression in *Streptococcus agalactiae*," *Inf. Immun. 71*, 5056-64, Sep. 2003.

Lauer et al., "Genome Analysis Reveals Pili in Group B *Streptococcus*," *Science 309*, 105, Jul. 1, 2005.

Maione et al., "Identification of a Universal Group B *Streptococcus* Vaccine by Multiple Genome Screen," *Science 309*, 148-50, Jul. 1, 2005.

Abbas et al., *Cellular and Molecular Immunology*, 4th ed., Chapter 15, pp. 360-62, 2000.

Areschoug et al., "Group B streptococcal surface proteins as targets for protective antibodies: identification of two novel proteins in strains of serotype V.," Inf. Immun. 67(12), 6350-57, Dec. 1999.

Banks et al., "Progress toward characterization of the Group A *Streptococcus* metagenome: Complete genome sequence of a macrolide-resistant serotype M6 strain," *J. Infectious Diseases 190*, 727-38, Aug. 15, 2004.

Barnett & Scott, "Differential recognition of surface proteins in *Streptococcus pyogenes* by two sortase gene homologs," J. Bacteriol. 184, 2181-91, 2002.

Barnett et al., "A Novel Sortase, SrtC2, from *Streptococcus pyogenes* Anchors a Surface Protein Containing a QVPTGV Motif to the Cell Wall," *Journal of Bacteriology*, vol. 186, No. 17, pp. 5865-5875, Sep. 2004.

Beckmann et al., "Identification of Novel Adhesins from Group B Streptococci by Use of Phage Display Reveals that C5a Peptidase Mediates Fibronectin Binding," *Inf. Immun. 70*, 2869-76, Jun. 2002.

Bessen et al., "Genomic Localization of a T Serotype Locus to a Recombinatorial Zone Ending Extracellular Matrix-Binding Proteins in *Streptococcus pyogenes*," Infection and Immunity, vol. 70, No. 3, pp. 1159-1167, Mar. 2002.

Blackburn et al., "The end of the (DNA) line," Nature Structural Biology 7, 847-49, Oct. 2000.

Bork et al., "Powers and pitfalls in sequence analysis: the 70% hurdle," Genome Research 10, 398-400, 2000.

Borovec et al., "Synthesis and assembly of hepatitis A virus-specific proteins in BS-C-1 cells," J. Virol. 67, 3095-301, Jun. 1993.

Bowie et al., "Deciphering the message in protein sequences: tolerance to amino acid substitution," Science 257, 1306-10, 1990.

Brodeur et al., "Identification of group B streptococcal Sip protein, which elicits cross-protective immunity," Inf. Immun. 68(10), 5610-8, Oct. 2000.

Burgess et al., "Possible dissociation of the heparin-binding and mitogenic activities of heparin-binding (acidic fibroblast) growth factor-1 from its receptor-binding activities by site-directed mutagenesis of a single lysine residue," J. Cell Biol. 111, 2129-38, 1990.

Chung et al., "chlorosome protein," NCBI Accession No. 2115394F, Jul. 10, 1992.

Clancy et al., "Cloning and Characterization of a Novel Macrolide Efflux Gene, mreA, from *Streptococcus agalactiae*," Antimicrobial Agents and Chemotherapy 41, 2719-23, 1997.

Collins et al., "Mutation of the principal sigma factor causes loss of virulence in a strain of the *Mycobacterium tuberculosis* complex," Proc. Natl. Acad. Sci. USA 92, 8036-40, 1995.

Dale et al., "New Protective Antigen of Gorup A Streptococci," J. Clin. Invest. 103, 1261-68, May 1999.

Dale et al., "Recombinant, octavalent group A streptococcal M protein vaccine," Vaccine 14, 944-48, 1996.

Dale, "Group A Streptococcal Vaccines," Infectious Disease Clinics of North America 13, 227-43, Mar. 1999.

Dale, "Multivalent group A streptococcal vaccine designed to optimize the immunogenicity of six tandem M protein fragments," Vaccine 17, 193-200, 1999.

Database EMBL, Accession No. AAX13129, *Enterococcus faecalis* genome contig Seq ID No. 192, Mar. 19, 1999.

Database EPO Proteins, EBI Accession No. AX605513, "Sequence 3442 from WO0209818," Feb. 17, 2003.

Database Geneseq, "Group B *Streptococcus* protein sequence Seq ID No. 49," EBI Accession No. GSP:AAY91320, May 30, 2000.

Database Geneseq, "*Streptococcus agalactiae* protein, Seq ID 2382," EBI Accession No. GSP:ADV81242, Feb. 24, 2005.

Database Geneseq, "Fibrinogen-binding polypeptide, Seq ID No. 17," EBI Accession No. GSP: ADS93952, Dec. 2, 2004; revised in 2007.

Database Geneseq, EBI Accession No. GSP: ABP30134, "*Streptococcus* polypeptide Seq ID No. 9444," Jul. 2, 2002.

Database Geneseq, EBI Accession No. GSP: ABP27285, "*Streptococcus* polypeptide Seq ID No. 3746," Jul. 2, 2002; revised in 2007.

Database Genseq, "Protein encoded by Prokaryotic essential gene #319788," Accession No. ABU46451, Jun. 13, 2003.

Database JPO Proteins, "Nucleic acid and protein originating in group B *Streptococcus*," EBI Accession No. JPOP:BD629260, Jul. 17, 2003.

Database SWISSPROT[Online] Oct. 1, 2002, accession No. EBI, Database accession No. Q9PGX9, Hypothetical protein XF0167.

Database UniProt [Online] Mar. 1, 2003, "Cell wall surface anchor family protein," retrieved from EBI accession No. UNIPROT: Q8DYR5, Database accession No. Q8DYR5, 87.2% identity with Seq ID No. 20906.

Database UniProt [Online], Nov. 22, 2005, "Cell wall surface anchor family protein," retrieved from EBI accession No. UNIPROT: Q3D2D6; 100% identity with Seq ID No. 20906; abstract.

De Boever et al., "*Enterococcus faecalis* conjugative plasmid pAM373. Complete nucleotide sequence and genetic analyses of sec phermone response," Mol. Microbiol. 37, 1327-41, 2000.

Dittmer et al., "Treatment of infectious diseases with immunostimulatory oligodeoxynucleotides containing CpG motifs," Curr. Opinion Microbiol. 6, 472-77, Oct. 2003.

Ellis, *Vaccines*, Chapter 29, Plotkin et al., eds., W.B. Saunders Company (Philadelphia), pp. 568-575, 1988.

Examination Report for NZ 560966, Mar. 4, 2009, 2 pages.

Ferretti et al., "Complete genome sequence of an M1 strain of *Streptococcus pyogenes*," Proc. Natl. Acad. Sci. USA 98, 4658-63, Apr. 10, 2001.

Ferretti et al., "Putative surface exclusion protein," GenBank Accession No. Q9A1H3, Oct. 31, 2006.

Glaser et al., "Genome sequence of *Streptococcus agalactiae*, a pathogen causing invasive neonatal disease," Mol. Moicrobiol. 45, 1499-1513, 2002.

Grandi & Zagursky, "The impact of genomics in vaccine discovery: achievements and lessons," Expert. Rev. Vaccines 3, 621-23, 2004.

Grandi, "Genomics and Proteomics in Reverse Vaccines," in *Microbial Proteomics: Functional Biology of Whole Organisms*, Humphery-Smith & Hecker, eds., John Wiley & Sons, chapter 20, 2006.

Greenspan et al., "Defining epitopes: Its not as easy as it seems," Nature Biotechnol. 7, 936-37, 1999.

Gutierrez et al., "insertional Mutagenesis and Recovery of Interrupted Genes of *Streptococcus* mutans by Using Transposon Tn917: Preliminary Characterization of Mutants Displaying Acid Sensitivity and Nutritional Requirements," J. Bacteriol. 178, 4166-75, Jul. 1996.

Guzman et al., "Protective immune response against *Streptococcus pyogenes* in mice after intranasal vaccination with the fibronectin-binding protein Sfbl," J. Infectious Disease 179, 901-06, 1999.

Holmes, "PSMA specific antibodies and their diagnostic and therapeutic use," Exp. Opin. Invest. Drugs 10, 511-10, 2001.

Hong, "unnamed protein product [*Streptococcus pyogenes*]," NCBI Accession No. BAB1603, one page, Oct. 3, 2000.

Horvath et al., "Toward the development of a synthetic group a streptococcal vaccine of high purity and broad protective coverage," J Med Chem. Jul. 29, 2004;47(16):4100-4.

Hughs et al., "Identification of Major Outer surface Proteins of *Streptococcus agalactiae*," Inf. Immun. 70, 1254-59, Mar. 2002.

International Preliminary Examination Report for PCT/GB01/04789 (published as WO 02/34771) dated Feb. 17, 2003.

International Preliminary Examination Report for PCT/GB2003/001882 (published as WO 03/093306) dated Aug. 18, 2004.

International Preliminary Examination Report for PCT/IB2005/036009 (published as WO 06/042027) dated Apr. 11, 2007.

International Preliminary Examination Report for PCT/US2003/029167 (published as WO 04/041157) dated Mar. 5, 2005.

International Preliminary Examination Report for PCT/US2004/024868 (published as WO 05/032582) dated Feb. 6, 2006.

International Preliminary Examination Report for PCT/US2004/030032 (published as WO 05/028618) dated Mar. 16, 2006.

International Search Report for PCT/GB01/04789 (published as WO 02/34771) dated Aug. 27, 2002.

International Search Report for PCT/GB2003/001882 (published as WO 03/093306) dated Nov. 14, 2002.

International Search Report for PCT/IB2005/036009 (published as WO 06/042027) dated Jun. 20, 2006.

International Search Report for PCT/US05/046491 dated Jun. 26, 2007 (published as WO 2006/069200).

International Search Report for PCT/US2003/029167 (published as WO 04/041157) dated Aug. 2, 2004.

International Search Report for PCT/US2004/024868 (published as WO 05/032582) dated Oct. 28, 2005.

International Search Report for PCT/US2004/030032 (published as WO 05/028618) dated Dec. 6, 2005.

International Search Report for PCT/US2005/027239 (published as WO 06/078318) dated Aug. 25, 2008.

International Search Report for PCT/US2007/022838 (published as WO 08/108830) dated Oct. 9, 2008.

Jobling et al., "Analysis of structure and function of the B subunit of cholera toxin by the use of site-directed mutagenesis," Mol. Microbiol. 5, 1755-67, 1991.

Kalman et al., "Comparative genomes of *Chlamydia pneumoniae* and *C. trachomatis*," Nature Genetics 21, 385-89, Apr. 1999.

Kehoe et al., "Nucleotide Sequence of the Streptolysin O (SLO) Gene: Structural Homologies between SLO and Other Membrane-Damaging, Thiol-Activated Toxins," Inf. Immun. 55, 3228-32, Dec. 1987.

Koch et al., "Complexity and expression patterns of the desmosomal adherins," Proc. Natl. Acad. Sci. USA 89, 353-57, Jan. 1992.

Kunst et al., "The complete genome sequence of the Gram positive bacterium *Bacillus subtilis*," NCBI Accession No. CAB14964, Nov. 20, 1997.

Lachenauer et al., "A protective surface protein from the Type V Group B *Streptococcus* shares N-terminal sequence homology with the Alpha C Protein," Inf. Immun. 64, 4255-60, Oct. 1996.

Larsson et al., "Protection against experimental infection with group B *Streptococcus* by immunization with a bivalent protein vaccine," Vaccine 17, 454-58, 1999.

Lazar et al., "Transforming growth factor alpha: mutation of aspartic acid 47 and leucine 48 results in different biological activities," Mol. Cell. Biol. 8, 1247-52, 1988.

Lei et al., "Identification and immunogenicity of group A *Streptococcus* culture supernatant proteins," Inf. Immunity 68, 6807-18, 2000.

Lewis, "Riddle of Biofilm Resistance," *Antimicrobial Agents and Chemotherapy*, vol. 45, No. 4, pp. 999-1007, Apr. 2001.

Lindahl et al., "Surface proteins of *Streptococcus agalactiae* and related proteins in other bacterial pathogens," Clinical Microbiol. Rev. 18(1), 102-07, Jan. 2005.

Madoff et al., "Maternal Immunization of Mice with Group B Streptococcal Type III Polysaccharide-Beta C Protein Conjugate Elicits Protective Antibody to Multiple Serotypes," J. Clinical Invest. 94, 286-92, 1994.

McMillan et al., "Identification and assessment of new vaccine candidates for group A streptococcal infections," Vaccine 22, 2783-90, 2004.

McMillan et al., "Prospecting for new group A streptococcal vaccine candidates," *Indian J. Med. Res.* 119, 121-25, May 2004.

Meinke et al., "*S. pyogenes* hyperimmune system reactive antigen Spy0269," EBI Accession No. ADR83896, Dec. 2, 2004; revised Jun. 15, 2007.

Molling et al., "Naked DNA for vaccine or therapy," J. Mol. Med. 75, 242-46, 1997.

Mora et al., "Group A *Streptococcus* produce pilus-like structures containing protective antigens and Lancefield T antigens," Proc. Natl. Acad. Sci. USA 102, 15641-46, Oct. 25, 2005.

Musser, "The Next Chapter in Reverse Vaccinology," Nat. Biotechnol. 24, 157-58, 2006.

Nakagawa et al., "Genome sequence of an M3 strain of *Streptococcus pyogenes* reveals a large-scale genomic rearrangement in invasive strains and new insights into phage evolution," *Genome Res.* 13, 1042-55, Jun. 2003.

Nakata et al., "MsmR, a specific positive regulator of the *Streptococcus pyogenes* FCT pathogenicity region and cytolysin-mediated translocation system genes," Mol. Microbiol. 57, 786-803, 2005.

Navarre et al., "Surface Proteins of Gram-Positive Bacteria and Mechanisms of Their Targeting to the Cell Wall Envelope," *Microbiology and Molecular Biology Reviews*, vol. 63, No. 1, pp. 174-229, Mar. 1999.

NCBI News, table on p. 4, "Microbial Genomes Available for Blast Search," Jul. 1998.

Olive et al., "Protection of mice from group A streptococcal infection by intranasal immunization with a peptide vaccine that contains a conserved M protein B cell epitope and lacks a T cell autoepitope," Vaccine 20, 2816-25, 2002.

Orefici et al., "Possible virulence marker for *Streptococcus agalactiae* (Lancefiled Group B)," J. Clin. Microbiol. Infectious Diseases 7, 302-05, 1988.

Paoletti et al., "Neonatal mouse protection against infection with multiple group B streptococcal (GBS) serotypes by maternal immunization with a tetravalent GBS polysaccharide-tetanus toxoid conjugate vaccine," Inf. Immun. 62, 3236-43, 1994.

Paoletti, "Surface structure of group B *Streptoccoccus* important in human immunity," in *Gram Positive Pathogens*, Fischetti et al., eds., Chapter 14, pp. 137-153, 2000.

Pournaras et al., "Pheromone responses and high-level aminoglycoside resistance of conjugative plasmids of *Enterococcus faecalis* from Greece," J. Antimicrobial Chemotherapy 46, 1013-16, 2000.

Proft et al., "Identification and Characterization of Novel Superantigens from *Streptococcus pyogenes*," J. Exp. Med. 189, 89-101, Jan. 4, 1999.

Quinn, "The response of rheumatic and non-rheumatic children to streptolysin O concentrate," J. Clin. Invest. 36, 793-802, Jun. 1957.

Ramachandran et al., "Two Distinct Genotypes of *prtF2*, Encoding a Fibronectin Binding Protein, and Evolution of the Gene Family in *Streptococcus pyogenes*," *Journal of Bacteriology*, vol. 186, No. 22, pp. 7601-7609, Nov. 2004.

Rodewald et al., "Neonatal mouse model of group b streptococcal infection," J. Infectious Diseases 166, 635-39, 1992.
Rodriguez-Ortega et al., "Characterization and identification of vaccine candidate proteins through analysis of the group A *Streptococcus* surface proteome," Nature Biotechnol. 24, 191-97, 2006.
Roitt et al., Structure of Antigens, *Immunology*, 4th ed., Mosby, London, pp. 7.7. and 7.8, 1998.
Rudenko et al., "Selection for activation of a new variant surface glycoprotein gene expression site in *Trypanosoma brucei* can result in deletion of the old one," Mol. Biochem. Parisitol. 95, 97-109, 1998; NCBI Accession No. CAD21770.
Rudinger et al., "Characteristics of the amino acids as components of a peptide hormone sequence," in *Peptide Hormones*, Parsons, ed., University Park Press, Jun. 1976, pp. 1-7.
Schneewind et al., "Sequence and Structural Characteristics of the Trypsin-Resistant T6 Surface Protein of Group A Streptococci," *Journal of Bacteriology*, vol. 172, No. 6, pp. 3310-3317, Jun. 1990.
Schneewind, "Structure of the Cell Wall anchor of Surface Proteins in *Staphylococcus aureus*," Science 268, 103-06, Apr. 7, 1995.
Segura et al., "Streptococcus suis and group B Streptococcus differ in their interactions with murine macrophages," FEMS Immunol. Med. Microbiol. 21, 189-95, 1998.
Seizen, "Multi-domain, cell envelope proteases of lactic acid bacteria," Antonie von Leeuwenhoek 76, 139-55, 1999.
Smoot et al., "Genome sequence and comparative microarray analysis of serotype M18 group a *Streptococcus* strains associated with acute rheumatic fever outbreaks," *Proc. Natl. Acad. Sci. USA 99*, 4668-73, Apr. 2, 2002.
Stephenson et al., "The Fap1 fimbrial adhesin is a glycoprotein: antibodies specific for the glycan moiety block the adhesion of *Streptococcus parasanguis* in an in vitro tooth model," *Mol. Microbiol. 43*, 147-57, 2002.
Su et al., "Identification of a Xenopus cDNA that prevents mitotic catastrophe in the fission yeast *Schizosaccharomyces pombe*," Gene 145, 155-56, 1994.
Supplementary Search report for EP 03799822 (corresponding to WO 04/041157) dated Jan. 21, 2008.
Surovov & Ferretti, "Physical and Genetic Chromosomal Map of an M Type 1 Strain of *Streptococcus pyogenes*," J. Bacteriol. 178, 5546-49, Sep. 1996.
Telford et al., Sequence 7466 from WO 02/34771, EBI Accession No. CQ650509, Feb. 2, 2004; modified May 31, 2006.
Telford et al., "*Streptococcus* polypeptide Seq ID No. 9188" of WO 02/34771, EBI Accession No. ABP300006, Jul. 2, 2002; revised Jun. 15, 1007.
Tettelin et al., "Complete genome sequence and comparative genomic analysis of an emerging human pathogen, serotype V *Streptococcus agalactiae*," Proc. Natl. Acad. Sci. USA 99, 12391-96, Sep. 17, 2002.
Tettelin et al., "Complete genome sequence of a virulent isolate of *Streptococcus pneumoniae*," Science 293, 498-506, 2001.
Tettelin et al., Database EMBL, Accession No. AE014193, *Streptococcus agalactiae* 2603V/R section 3 of 100 of the complete genome, Sep. 2, 2002.
Tettelin et al., Swiss-Prot Accession No. Q3DV91 for *Streptococcus agalactiae* strain 18R21, Nov. 22, 2005.
Tighe et al., "Gene vaccination: plasmid DNA is more than just a blueprint," Immunology Today 19, 89-97, Feb. 1998.
Todd, "Antigenic Streptococcal Hemolysin," J. Exp. Med. 55, 267-80, 1932.
Ton-That & Schneewind, "Assembly of pili on the surface of *Corynebacterium diphtheriae*," Mol. Microbiol. 50, 1429-38, 2003.
Ton-That et al., "Sortases and pilin elements involved in pilus assembly of *Corynebacterium diphtheriae*," Mol. Microbiol. 53, 251-61, 2004.
UniProt Accession No. A7CNQ7, Jul. 5, 2004.
UniProt Accession No. Q5XEL1, Nov. 23, 2004.
UniProt Accession No. Q8P318, Oct. 1, 2002.
Vallet et al., "The chaperone/usher pathways of *Pseudomonas aeruginosa*: Identification of fimbrial gene clusters (cup) and their involvement in biofilm formation," *PNAS*, vol. 98, No. 12, pp. 6911-6916, Jun. 2001.
Wang et al., "Protein encoded by prokaryotic essential gene #31978," EBI Accession No. ABU46451, Jun. 19, 2003; revised Jun. 15, 2007.
Watnick et al., "Steps in the development of a *Vibrio cholerae* El Tor biofilm," *Molecular Microbiology*, vol. 34, No. 3, pp. 586-595, 1999.
Wessels et al., "Stimulation of protective antibodies against type 1a and 1b group B streptococci by a type 1a polysaccharide-tetanus toxoid conjugate vaccine," Inf. Immun. 61, 4760-66, 1993.
Woodson et al., "Analysis of a ribose transport operon from *Bacillus subtilis*," Microbiology 140, 1829-38, 1994.
Margarit et al., "Preventing Bacterial Infections with Pilus-Based Vaccines: the Group B *Streptococcus* Paradigm," *J. Infectious Diseases 199*, 108-15, 2009.
Rosini et al., "Identification of novel genomic islands coding for antigenic pilus-like structures in *Streptococcus agalactiae*," Mol. Microbiol. 61, 126-41, 2006.
Basha, "Two-Dimensional Gel Electrophoretic Separation of Proteins," in *Methods for Protein Analysis*, Cherry & Barford, eds., American Oil Chemists' Society, Champaign, IL, p. 70-86, 1988.
Joshi, "Study of Antibody Recognition Pattern of HCV by Western Blot," *Kathmandu University Medical Journal 1*, 256-62, 2003.
Laemmli, "Cleavage of Structural Proteins during the assembly of the Head of Bacteriophage T4," *Nature 227*, 680-85, 1970.
Madoff et al., "Phenotypic Diversity in the Alpha C Protein of Group B Streptococci," *Inf. Immun. 59*, 2638-44, 1991.
Salit et al., "Intra-strain heterogeneity of gonococcal pili is related to opacity colony variance," *J. Exp. Med. 151*, 716-25, 1980.
Jones et al., "A Streptococcal Penicillin-Binding Protein Is Critical for Resisting Innate Airway Defenses in the Neonatal Lung," *J. Immunol. 179*, 3196-202, 2007.
Pritzlaff et al: "*Streptococcus agalactiae* cyl gene clusster, partial sequence", Database Accession No. AF157015, Feb. 4, 2001.
Pritzlaff et al.: "Genetic basis for the beta-haemolytic/cytolytic activity of group B *Streptococcus*"; Mol. Microbiol.; vol. 39, 2001, pp. 236-248.
Spellerberg et al: "*Streptococcus agalactiae* cyl gene cluster, complete sequence", Database Accession No. AF093787, Jul. 31, 2000.
Spellerberg et al: "Identification of genetic determinants for the hemolytic activity of *Streptococcus agalactiae* by ISSI transposition"; J. Bacteriol.; vol. 181, No. 10, May 1999; pp. 212-3219.
Duez et al: "*Enterococcus hirae* mraR, pbp3s, mraY, murD, murG, ftsQ and ftsA genes, mraW, yliC and ftsZ partial genes"; Database Accession No. Y13922, Apr. 18, 2005.
Guttierez et al: "*Streptococcus mutans* ProX (pouABC) gene, partial cds; YlxM (ylxM) gene, complete cds; Ffh (ffh) gene, complete cds, alternatively spliced; SatC (satC) and SatD (satD) gene, complete cds; and SatE (satE) gene, partical cds"; Database Accession No. U88582.
Pucci et al: "*Enterococcus faecalis* strain A24836 cell wall/cell division gene cluster, yllB, yllc, yllD, pdpC, mraY, murD, murG, divlB, ftsA and fitsZ genes, complete cds"; Database Accession No. U94707, Sep. 10, 1997.
Simpson et al: "Xy Iella fastidiosa 9a5c, section 136 of 229 of the complete genome"; Database Accesion No. AE003990, Jun. 4, 2004.
Black et al: "*Streptococcus oneumoniae* polypeptide coding region", Database Accession No. AAV42990, Oct. 4, 2010.
Meehan et al; "Sequence 1 from Patent WO 98 01561"; Database Accession No. A68631, May 6, 1999.
Michel et al: "Cloned alpha and beta C-protein antigens of group B Streptococci elicit protective immunity"; Infection and Immunity; vol. 59, No. 6, Jun. 1991; pp. 2023-2028.
Stalhammar-Carlemalm et al: "The R28 Protein of *Streptococcus pyogenes* is related to several group B streptococcal surface proteins, confer protective immunity and promotes binding to human epithelial cells"; Molecular Microbiol.; vol. 33, No. 1, Jul. 1999, pp. 208-219.
Le Page et al: "Sequence 217 of Patent WO 01 32882"; Database Accession No. AX134653, May 29, 2001.
Ferretti et al: "*Streptococcus pyogenes* M1 GAS strain SF370, Section 87 of 167 of the complete genome" Database Accession No. AE006558, Jun. 1, 2004.

* cited by examiner

FIGURE 87
FIGURE 87A
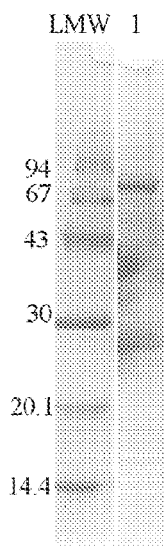
FIGURE 87B
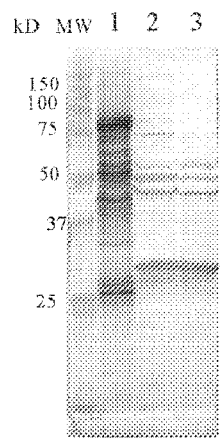
FIGURE 88
FIGURE 88A
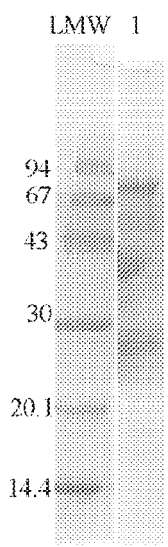
FIGURE 88B
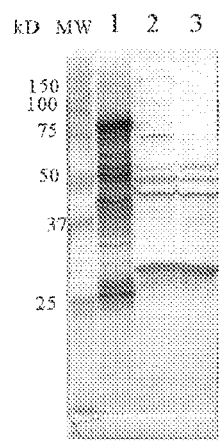

FIGURE 89
FIGURE 89A
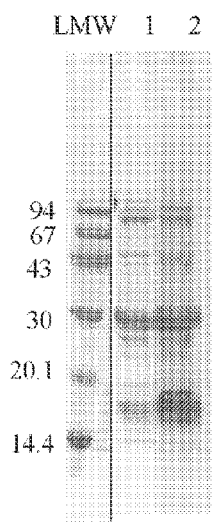
FIGURE 89B
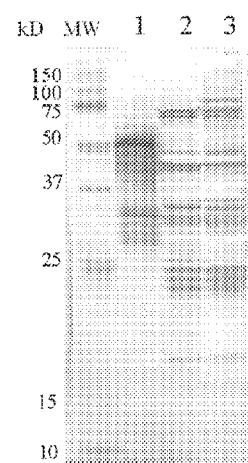

FIGURE 90
FIGURE 90A
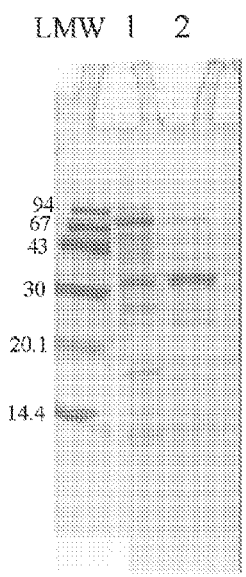
FIGURE 90B
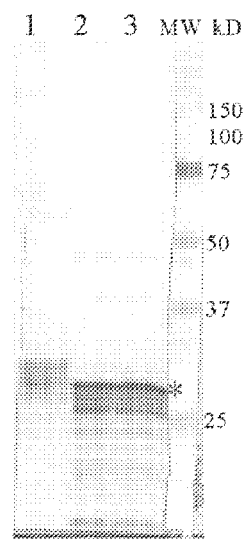
FIGURE 90C
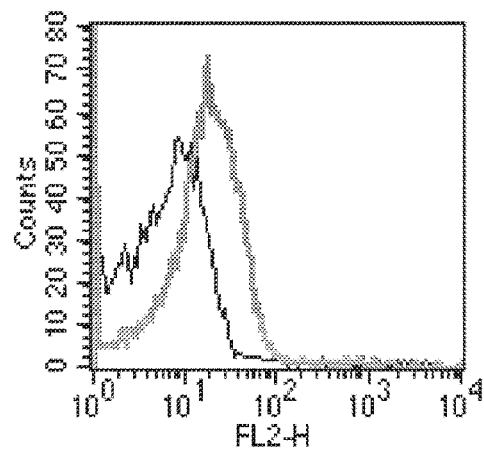

FIGURE 91
FIGURE 91A
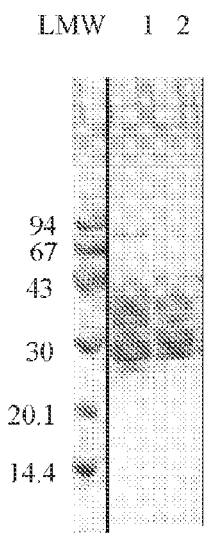
FIGURE 91B
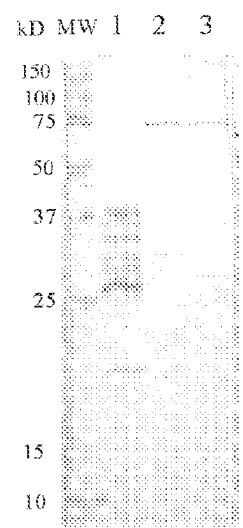
FIGURE 91C
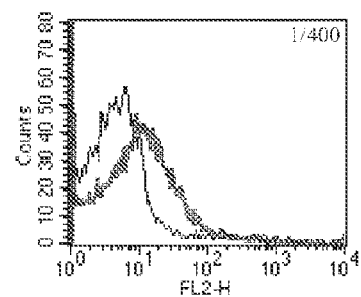

FIGURE 92
FIGURE 92A
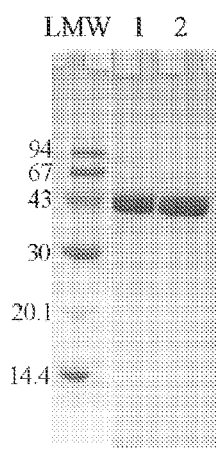
FIGURE 92B
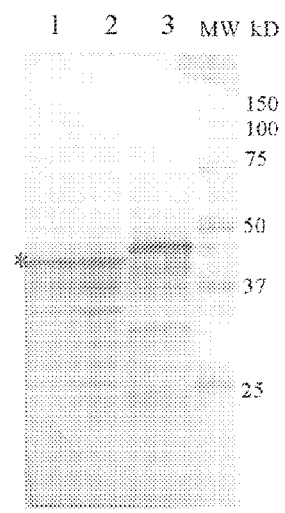
FIGURE 92C
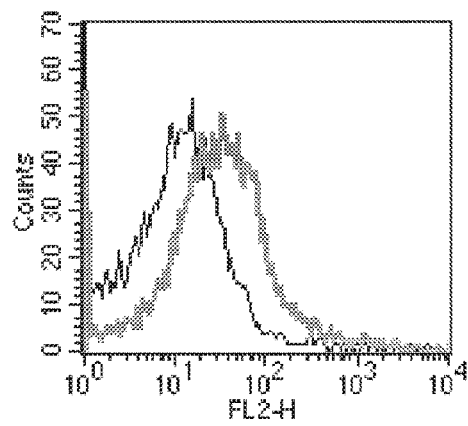

FIGURE 93
FIGURE 93A
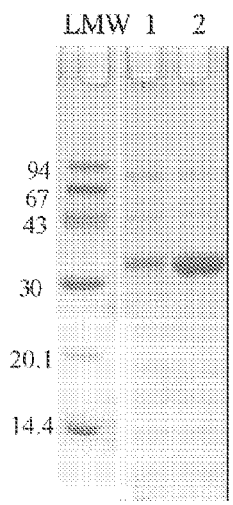
FIGURE 93B
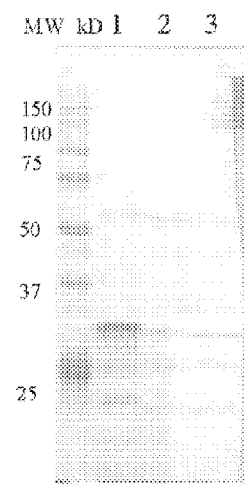
FIGURE 93C
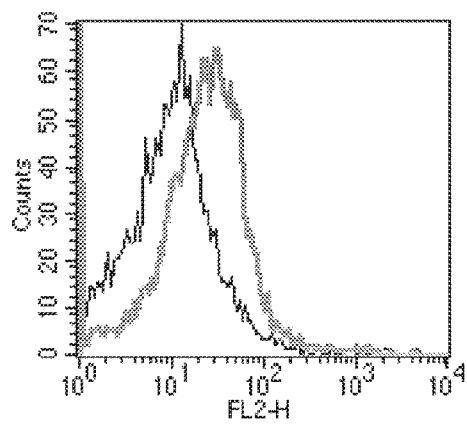

FIGURE 94
FIGURE 94A
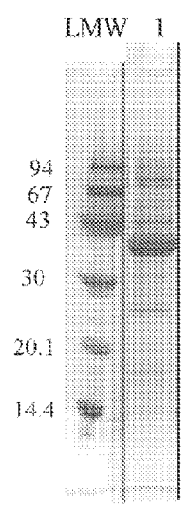
FIGURE 94B
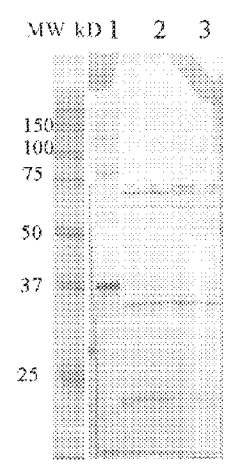
FIGURE 94C
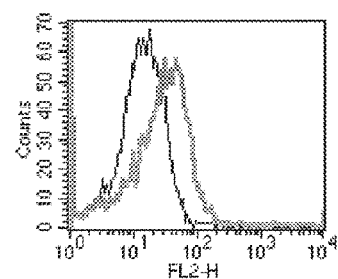

FIGURE 95
FIGURE 95A
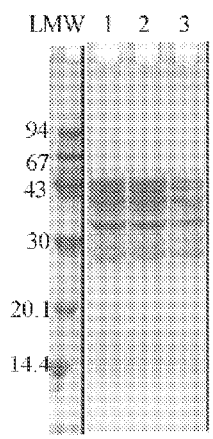
FIGURE 95B
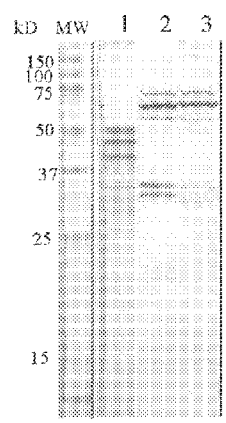
FIGURE 95C
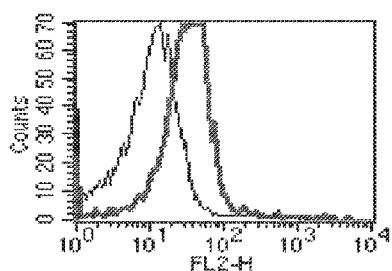

FIGURE 96
FIGURE 96A
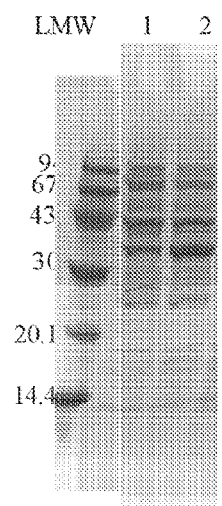
FIGURE 96B
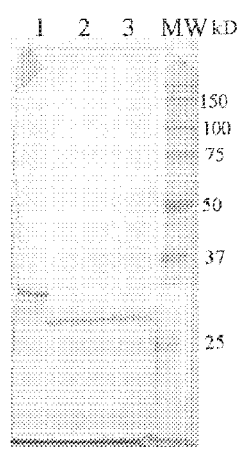
FIGURE 96C
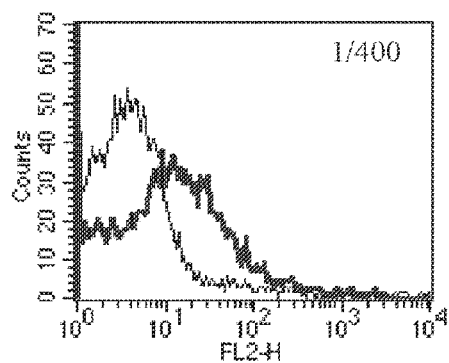

FIGURE 97
FIGURE 97A
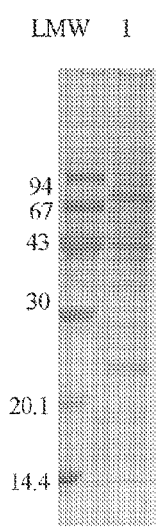
FIGURE 97B
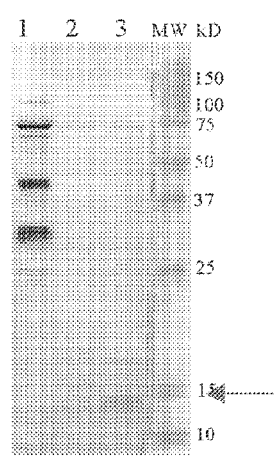
FIGURE 97C
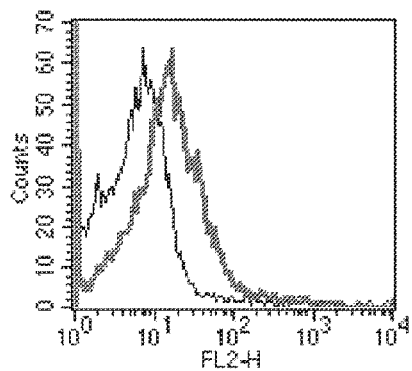

FIGURE 98
FIGURE 98A
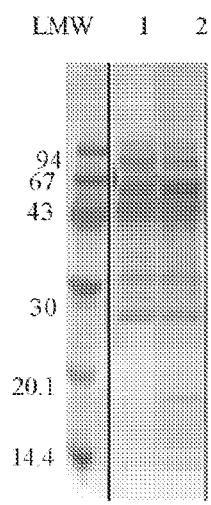
FIGURE 98B
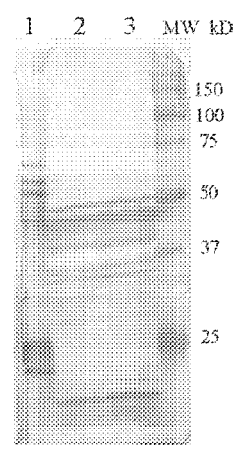
FIGURE 98C
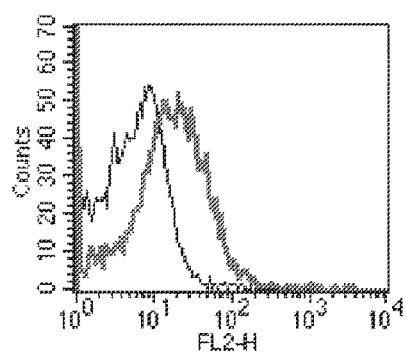

FIGURE 99
FIGURE 99A
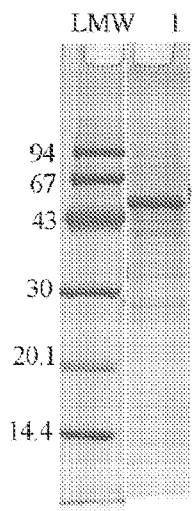
FIGURE 99B
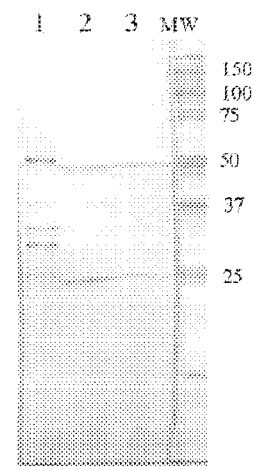
FIGURE 99C
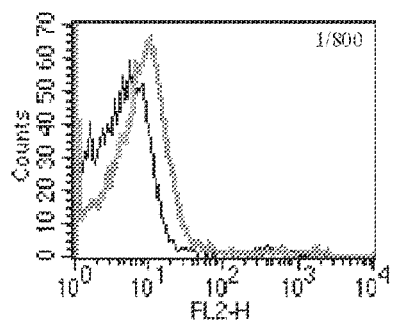

FIGURE 100
FIGURE 100A
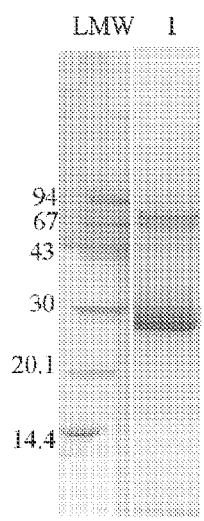
FIGURE 100B
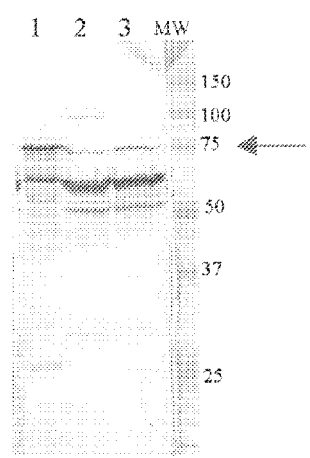
FIGURE 100C
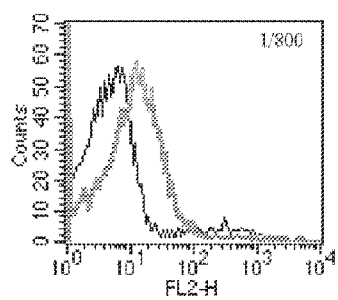

FIGURE 101
FIGURE 101A
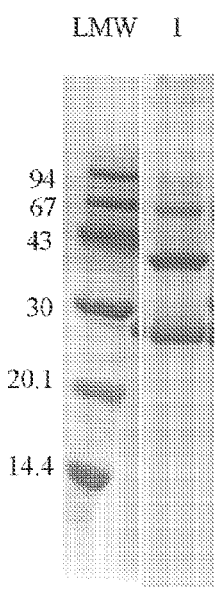
FIGURE 101B
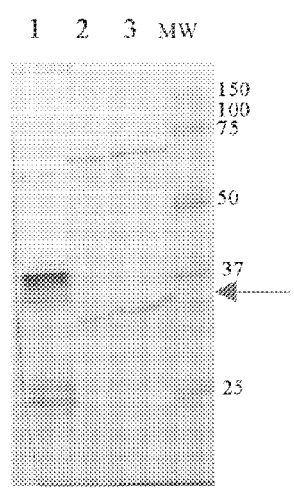
FIGURE 101C
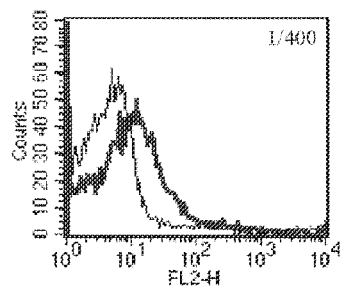

FIGURE 102
FIGURE 102A
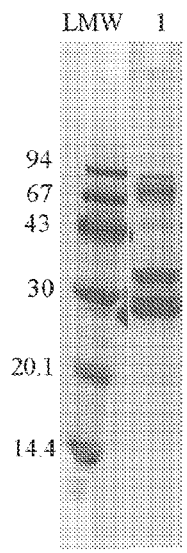
FIGURE 102B
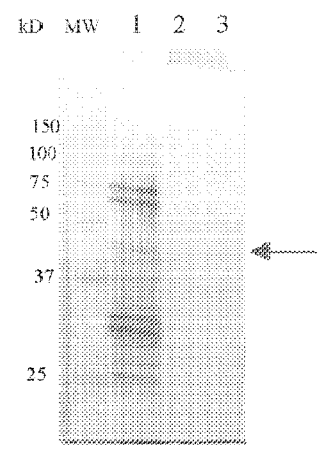
FIGURE 103
FIGURE 103A
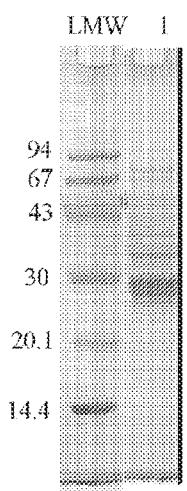
FIGURE 103B
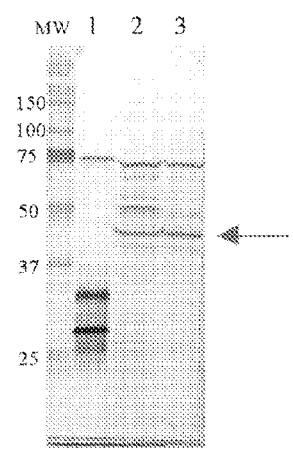

FIGURE 103C
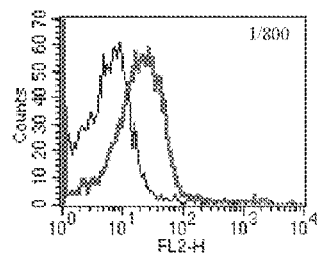
FIGURE 104
FIGURE 104A
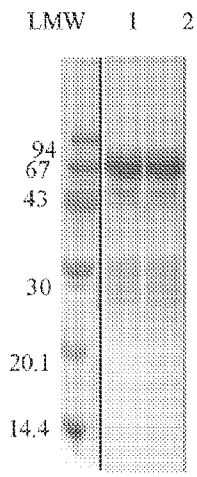
FIGURE 104B
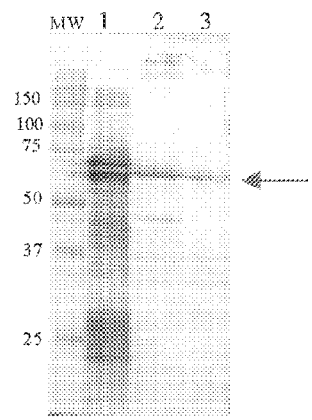
FIGURE 104C
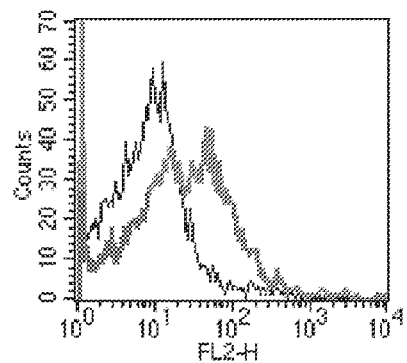

FIGURE 105
FIGURE 105A
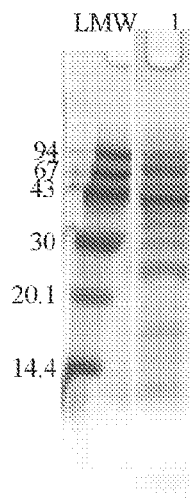
FIGURE 105B
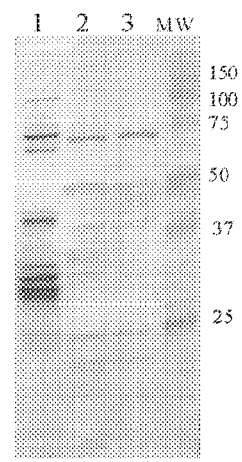
FIGURE 105C
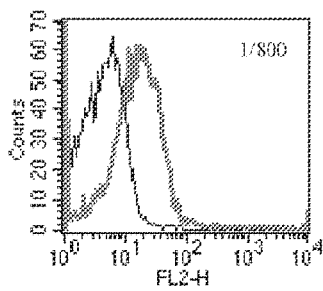

FIGURE 106
FIGURE 106A
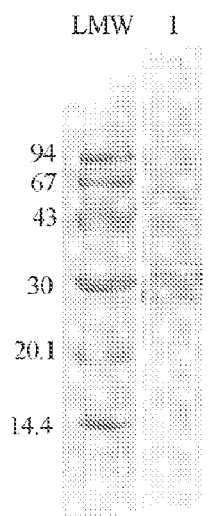
FIGURE 106B
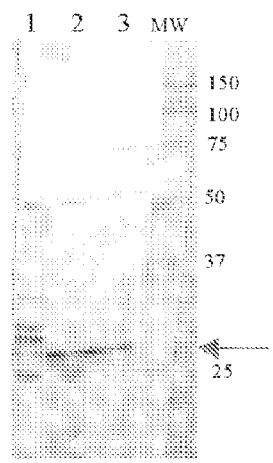
FIGURE 106C
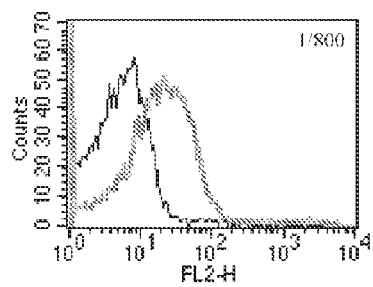

FIGURE 107
FIGURE 107A
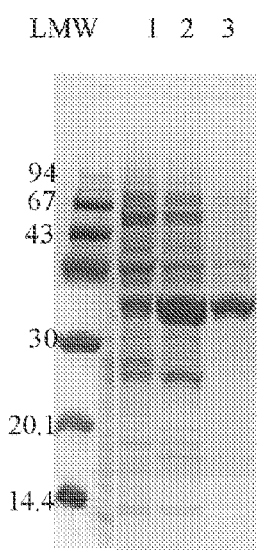
FIGURE 107B
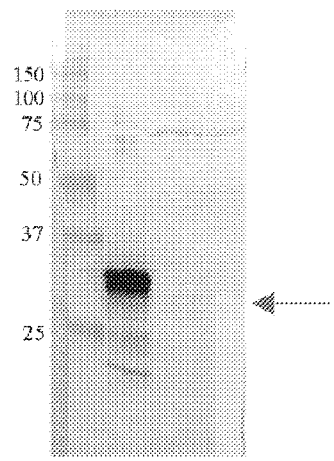
FIGURE 107C
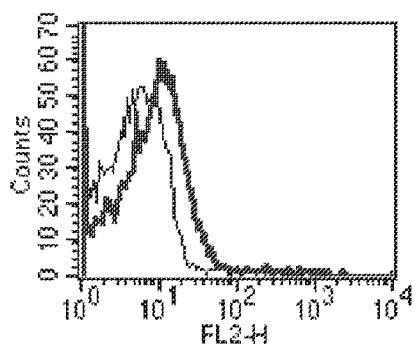

FIGURE 108
FIGURE 108A
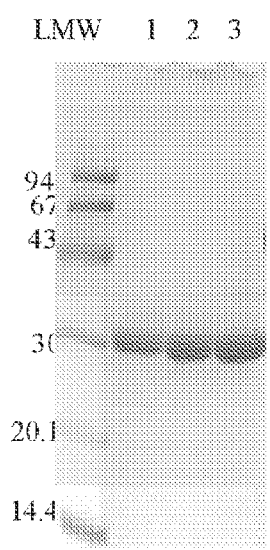
FIGURE 108B
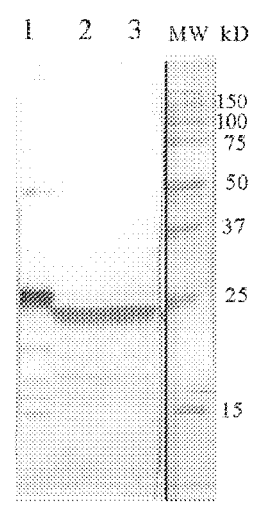
FIGURE 108C
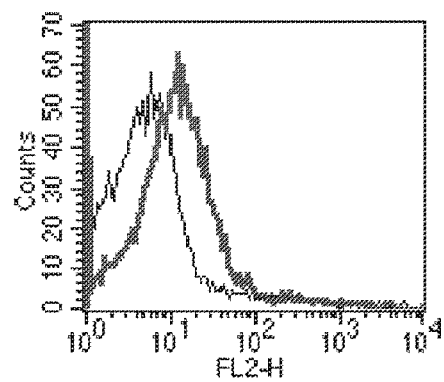

FIGURE 109
FIGURE 109A
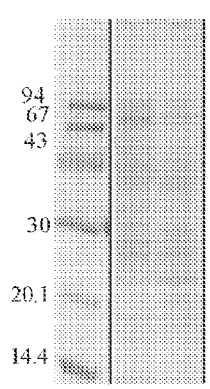
FIGURE 109B
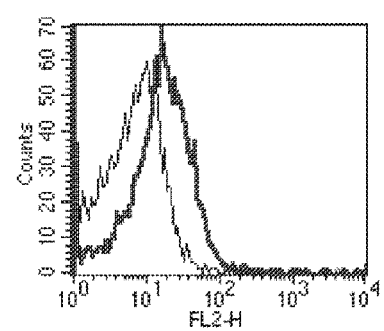
FIGURE 110
FIGURE 110A
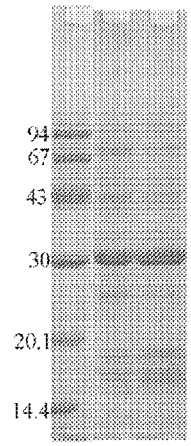
FIGURE 110B
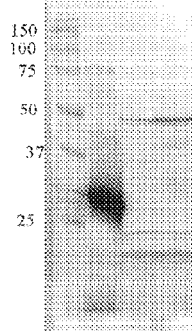

FIGURE 112
FIGURE 112A
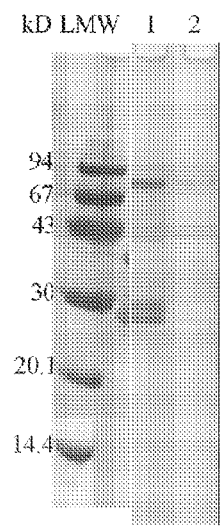
FIGURE 112B
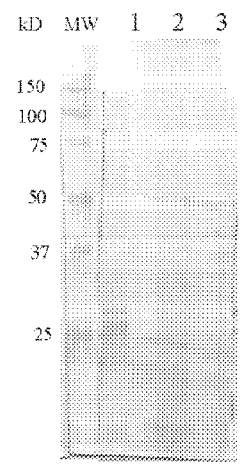
FIGURE 114
FIGURE 114A
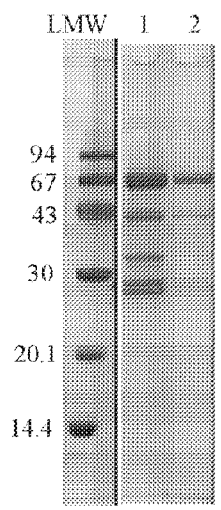
FIGURE 114B
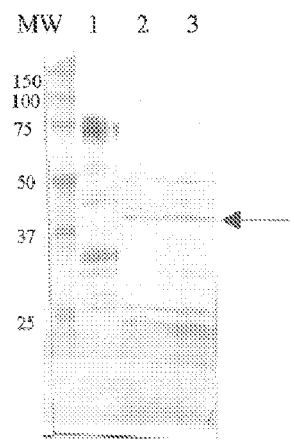

FIGURE 115
FIGURE 115A
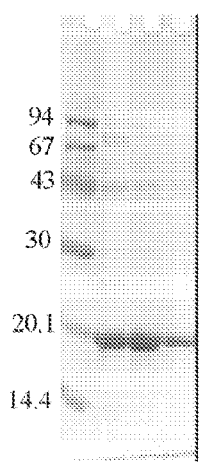
FIGURE 115B
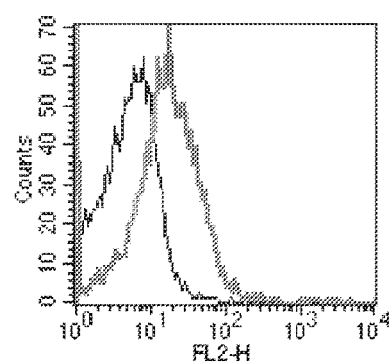
FIGURE 116
FIGURE 116A
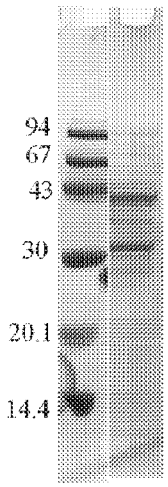

FIGURE 117
FIGURE 117A
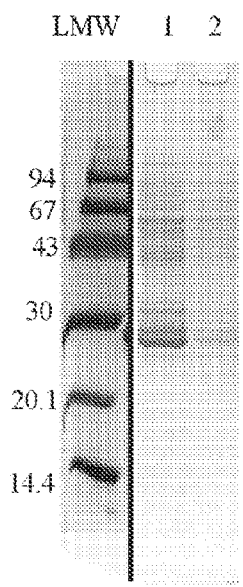
FIGURE 117B
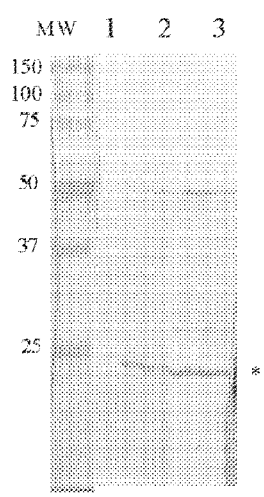
FIGURE 117C
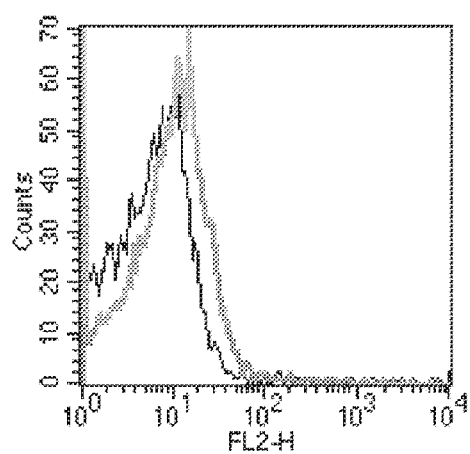

FIGURE 248
FIGURE 248A
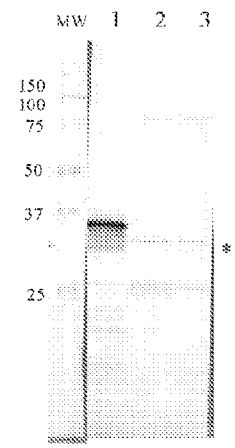
FIGURE 248B
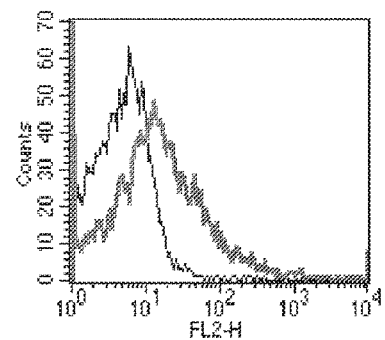
FIGURE 249
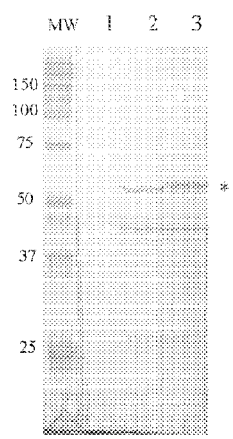
FIGURE 250
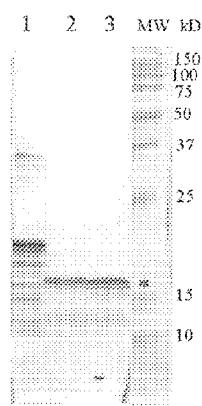
FIGURE 251
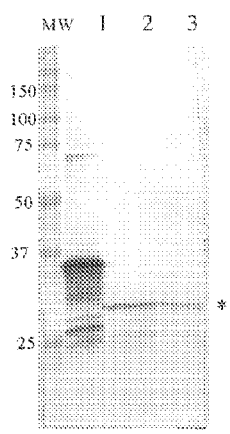

FIGURE 252
FIGURE 252A
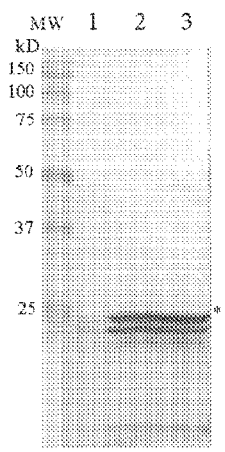
FIGURE 252B
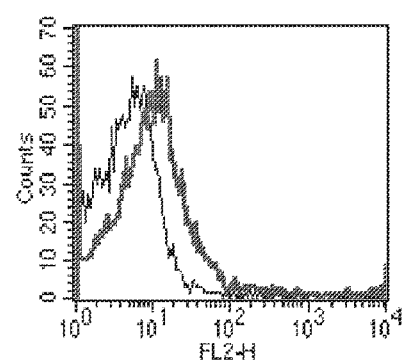
FIGURE 253
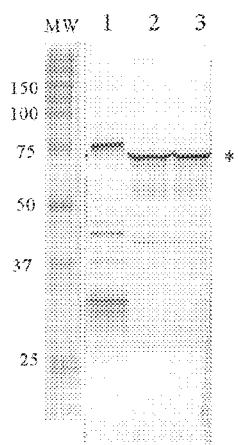

FIGURE 254
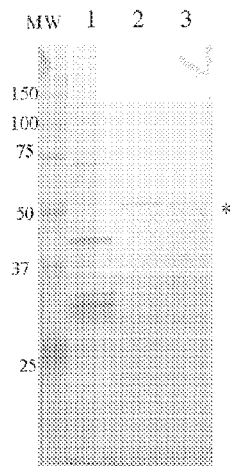
FIGURE 255
FIGURE 255A
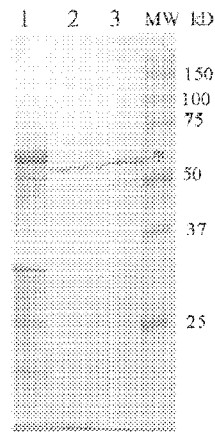
FIGURE 255B
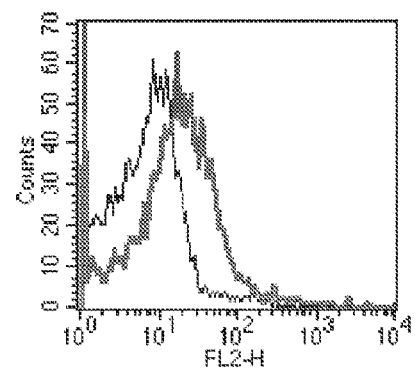

FIGURE 256
FIGURE 256A
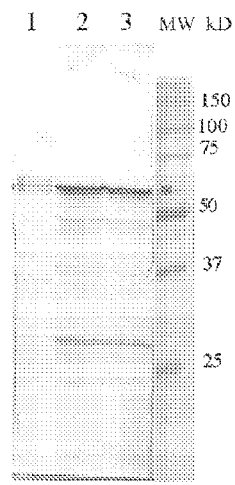
FIGURE 256B
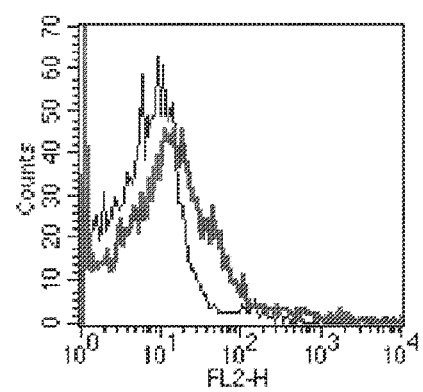
FIGURE 257
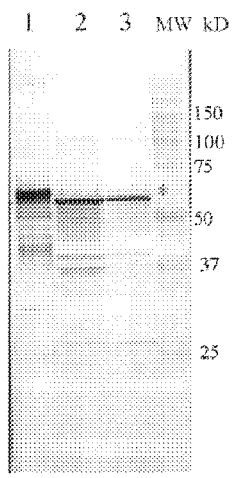
FIGURE 258
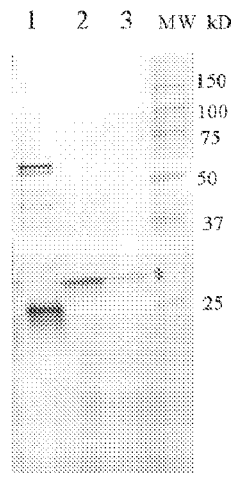

NUCLEIC ACIDS AND PROTEINS FROM *STREPTOCOCCUS* GROUPS A AND B

This application is a division of Ser. No. 10/415,182 filed Oct. 14, 2003. Ser. No. 10/415,182 is a National Stage application of PCT application PCT/GB01/04789, which was filed Oct. 29, 2001 and published in English under PCT Article 21(2) on May 2, 2002. PCT/GB01/04789 claims the benefit of Serial No. GB0026333.5 filed Oct. 27, 2000, Serial No. GB0028727.6 filed Nov. 24, 2000, and Serial No. GB0105640.7 filed Mar. 7, 2001. Each of these applications and all the other documents cited herein are incorporated by reference in their entireties.

This application incorporates by reference the contents of a 21 MB text file created Oct. 15, 2008 named "11434203_substitute_sequence_listing.txt," which is the sequence listing for this application.

TECHNICAL FIELD

This invention relates to nucleic acid and proteins from the bacteria *Streptococcus agalactiae* (GBS) and *Streptococcus pyogenes* (GAS).

BACKGROUND ART

Once thought to infect only cows, the Gram-positive bacterium *Streptococcus agalactiae* (or "group B streptococcus", abbreviated to "GBS") is now known to cause serious disease, bacteremia and meningitis, in immunocompromised individuals and in neonates. There are two types of neonatal infection. The first (early onset, usually within 5 days of birth) is manifested by bacteremia and pneumonia. It is contracted vertically as a baby passes through the birth canal. GBS colonises the vagina of about 25% of young women, and approximately 1% of infants born via a vaginal birth to colonised mothers will become infected. Mortality is between 50-70%. The second is a meningitis that occurs 10 to 60 days after birth. If pregnant women are vaccinated with type III capsule so that the infants are passively immunised, the incidence of the late onset meningitis is reduced but is not entirely eliminated.

The "B" in "GBS" refers to the Lancefield classification, which is based on the antigenicity of a carbohydrate which is soluble in dilute acid and called the C carbohydrate. Lancefield identified 13 types of C carbohydrate, designated A to O, that could be serologically differentiated. The organisms that most commonly infect humans are found in groups A, B, D, and G. Within group B, strains can be divided into 8 serotypes (Ia, Ib, Ia/c, II, III, IV, V, and VI) based on the structure of their polysaccharide capsule.

Group A streptococcus ("GAS", *S. pyogenes*) is a frequent human pathogen, estimated to be present in between 5-15% of normal individuals without signs of disease. When host defences are compromised, or when the organism is able to exert its virulence, or when it is introduced to vulnerable tissues or hosts, however, an acute infection occurs. Diseases include puerperal fever, scarlet fever, erysipelas, pharyngitis, impetigo, necrotising fasciitis, myositis and streptococcal toxic shock syndrome.

*S. pyogenes* is typically treated using antibiotics. Although *S. agalactiae* is inhibited by antibiotics, however, it is not killed by penicillin as easily as GAS. Prophylactic vaccination is thus preferable.

Current GBS vaccines are based on polysaccharide antigens, although these suffer from poor immunogenicity. Anti-idiotypic approaches have also been used (e.g. WO99/54457). There remains a need, however, for effective adult vaccines against *S. agalactiae* infection. There also remains a need for vaccines against *S. pyogenes* infection.

It is an object of the invention to provide proteins which can be used in the development of such vaccines. The proteins may also be useful for diagnostic purposes, and as targets for antibiotics.

BRIEF DESCRIPTION OF DRAWINGS

FIGS. 87 to 118 and 247 to 319 show protein characterization data for various proteins of the invention.

DETAILED DESCRIPTION

Figure 1:
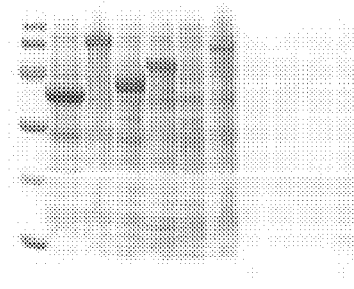
FIGS. 1 to 85, 119 to 188, 238, and 239 show SDS-PAGE analysis of total cell extracts from cultures of recombinant *E. coli* expressing GBS proteins of the invention. Lane 1 in each gel (except for FIG. 185) contains molecular weight markers. These are 94, 67, 43, 30, 20.1, and 14.4 kDa (except for FIGS. 7, 8, 10, 11, 13, 14, 15, and 119-170, which use 250, 150, 100, 75, 50, 37, 25, 15 & 10 kDa).

The invention provides proteins comprising the *S. agalactiae* amino acid sequences disclosed in the examples, and proteins comprising the *S. pyogenes* amino acid sequences disclosed in the examples. These amino acid sequences are the even SEQ ID NOS: between 1 and 10960.

It also provides proteins comprising amino acid sequences having sequence identity to the *S. agalactiae* amino acid sequences disclosed in the examples, and proteins comprising amino acid sequences having sequence identity to the *S. pyogenes* amino acid sequences disclosed in the examples. Depending on the particular sequence, the degree of sequence identity is preferably greater than 50% (e.g. 60%, 70%, 80%, 90%, 95%, 99% or more). These proteins include homologs, orthologs, allelic variants and functional mutants. Typically, 50% identity or more between two proteins is considered to be an indication of functional equivalence. Identity between proteins is preferably determined by the Smith-Waterman homology search algorithm as implemented in the MPSRCH program (Oxford Molecular), using an affine gap search with parameters gap open penalty=12 and gap extension penalty=1.

Preferred proteins of the invention are GBS1 to GBS689 (see Table IV).

The invention further provides proteins comprising fragments of the *S. agalactiae* amino acid sequences disclosed in the examples, and proteins comprising fragments of the *S. pyogenes* amino acid sequences disclosed in the examples. The fragments should comprise at least n consecutive amino acids from the sequences and, depending on the particular sequence, n is 7 or more (e.g. 8, 10, 12, 14, 16, 18, 20, 30, 40, 50, 60, 70, 80, 90, 100 or more). Preferably the fragments comprise one or more epitopes from the sequence. Other preferred fragments are (a) the N-terminal signal peptides of the proteins disclosed in the examples, (b) the proteins disclosed in the examples, but without their N-terminal signal peptides, (c) fragments common to the related GAS and GBS proteins disclosed in the examples, and (d) the proteins disclosed in the examples, but without their N-terminal amino acid residue.

The proteins of the invention can, of course, be prepared by various means (e.g. recombinant expression, purification from GAS or GBS, chemical synthesis etc.) and in various forms (e.g. native, fusions, glycosylated, non-glycosylated etc.). They are preferably prepared in substantially pure form (i.e. substantially free from other streptococcal or host cell proteins) or substantially isolated form. Proteins of the invention are preferably streptococcal proteins.

According to a further aspect, the invention provides antibodies which bind to these proteins. These may be polyclonal or monoclonal and may be produced by any suitable means (e.g. by recombinant expression). To increase compatibility with the human immune system, the antibodies may be chimeric or humanised (e.g. Breedveld (2000) *Lancet* 355(9205):735-740; Gorman & Clark (1990) *Semin. Immunol.* 2:457-466), or fully human antibodies may be used. The antibodies may include a detectable label (e.g. for diagnostic assays).

According to a further aspect, the invention provides nucleic acid comprising the *S. agalactiae* nucleotide sequences disclosed in the examples, and nucleic acid comprising the *S. pyogenes* nucleotide sequences disclosed in the examples. These nucleic acid sequences are the odd SEQ ID NOS: between 1 and 10966.

In addition, the invention provides nucleic acid comprising nucleotide sequences having sequence identity to the *S. agalactiae* nucleotide sequences disclosed in the examples, and nucleic acid comprising nucleotide sequences having sequence identity to the *S. pyogenes* nucleotide sequences disclosed in the examples. Identity between sequences is preferably determined by the Smith-Waterman homology search algorithm as described above.

Furthermore, the invention provides nucleic acid which can hybridise to the *S. agalactiae* nucleic acid disclosed in the examples, and nucleic acid which can hybridise to the *S. pyogenes* nucleic acid disclosed in the examples preferably under 'high stringency' conditions (e.g. 65° C. in 0.1×SSC, 0.5% SDS solution).

Nucleic acid comprising fragments of these sequences are also provided. These should comprise at least n consecutive nucleotides from the *S. agalactiae* or *S. pyogenes* sequences and, depending on the particular sequence, n is 10 or more (e.g. 12, 14, 15, 18, 20, 25, 30, 35, 40, 50, 60, 70, 80, 90, 100, 150, 200 or more). The fragments may comprise sequences which are common to the related GAS and GBS sequences disclosed in the examples.

According to a further aspect, the invention provides nucleic acid encoding the proteins and protein fragments of the invention.

The invention also provides: nucleic acid comprising nucleotide sequence SEQ ID NO:10967; nucleic acid comprising nucleotide sequences having sequence identity to SEQ ID NO:10967; nucleic acid which can hybridise to SEQ ID NO:10967 (preferably under 'high stringency' conditions); nucleic acid comprising a fragment of at least n consecutive nucleotides from SEQ ID NO:10967, wherein n is 10 or more e.g. 12, 14, 15, 18, 20, 25, 30, 35, 40, 50, 60, 70, 80, 90, 100, 150, 200, 250, 300, 350, 400, 450, 500, 600, 700, 800, 900, 1000, 1500, 2000, 3000, 4000, 5000, 10000, 100000, 1000000 or more.

Nucleic acids of the invention can be used in hybridisation reactions (e.g. Northern or Southern blots, or in nucleic acid microarrays or 'gene chips') and amplification reactions (e.g. PCR, SDA, SSSR, LCR, TMA, NASBA etc.) and other nucleic acid techniques.

It should also be appreciated that the invention provides nucleic acid comprising sequences complementary to those described above (e.g. for antisense or probing, or for use as primers).

Nucleic acid according to the invention can, of course, be prepared in many ways (e.g. by chemical synthesis, from genomic or cDNA libraries, from the organism itself etc.) and can take various forms (e.g. single stranded, double stranded, vectors, primers, probes, labelled etc.). The nucleic acid is preferably in substantially isolated form.

Nucleic acid according to the invention may be labelled e.g. with a radioactive or fluorescent label. This is particularly useful where the nucleic acid is to be used in nucleic acid detection techniques e.g. where the nucleic acid is a primer or as a probe for use in techniques such as PCR, LCR, TMA, NASBA etc.

In addition, the term "nucleic acid" includes DNA and RNA, and also their analogues, such as those containing modified backbones, and also peptide nucleic acids (PNA) etc.

According to a further aspect, the invention provides vectors comprising nucleotide sequences of the invention (e.g. cloning or expression vectors) and host cells transformed with such vectors.

According to a further aspect, the invention provides compositions comprising protein, antibody, and/or nucleic acid according to the invention. These compositions may be suitable as immunogenic compositions, for instance, or as diagnostic reagents, or as vaccines.

The invention also provides nucleic acid, protein, or antibody according to the invention for use as medicaments (e.g. as immunogenic compositions or as vaccines) or as diagnostic reagents. It also provides the use of nucleic acid, protein, or antibody according to the invention in the manufacture of: (i) a medicament for treating or preventing disease and/or infection caused by streptococcus; (ii) a diagnostic reagent for detecting the presence of streptococcus or of antibodies raised against streptococcus; and/or (iii) a reagent which can raise antibodies against streptococcus. Said streptococcus may be any species, group or strain, but is preferably *S. agalactiae*, especially serotype III or V, or *S. pyogenes*. Said disease may be bacteremia, meningitis, puerperal fever, scarlet fever, erysipelas, pharyngitis, impetigo, necrotising fasciitis, myositis or toxic shock syndrome.

The invention also provides a method of treating a patient, comprising administering to the patient a therapeutically effective amount of nucleic acid, protein, and/or antibody of the invention. The patient may either be at risk from the disease themselves or may be a pregnant woman ('maternal immunisation' e.g. Glezen & Alpers (1999) *Clin. Infect. Dis.* 28:219-224).

Administration of protein antigens is a preferred method of treatment for inducing immunity.

Administration of antibodies of the invention is another preferred method of treatment. This method of passive immunisation is particularly useful for newborn children or for pregnant women. This method will typically use monoclonal antibodies, which will be humanised or fully human.

The invention also provides a kit comprising primers (e.g. PCR primers) for amplifying a template sequence contained within a *Streptococcus* (e.g. *S. pyogenes* or *S. agalactiae*) nucleic acid sequence, the kit comprising a first primer and a second primer, wherein the first primer is substantially complementary to said template sequence and the second primer is substantially complementary to a complement of said template sequence, wherein the parts of said primers which have substantial complementarity define the termini of the template sequence to be amplified. The first primer and/or the second primer may include a detectable label (e.g. a fluorescent label).

The invention also provides a kit comprising first and second single-stranded oligonucleotides which allow amplification of a *Streptococcus* template nucleic acid sequence contained in a single- or double-stranded nucleic acid (or mixture thereof), wherein: (a) the first oligonucleotide comprises a primer sequence which is substantially complementary to said template nucleic acid sequence; (b) the second oligonucleotide comprises a primer sequence which is substantially complementary to the complement of said template nucleic acid sequence; (c) the first oligonucleotide and/or the second oligonucleotide comprise(s) sequence which is not complementary to said template nucleic acid; and (d) said primer sequences define the termini of the template sequence to be amplified. The non-complementary sequence(s) of feature (c) are preferably upstream of (i.e. 5' to) the primer sequences. One or both of these (c) sequences may comprise a restriction site (e.g. EP-B-0509612) or a promoter sequence (e.g. EP-B-0505012). The first oligonucleotide and/or the second oligonucleotide may include a detectable label (e.g. a fluorescent label).

The template sequence may be any part of a genome sequence (e.g. SEQ ID NO:10967). For example, it could be a rRNA gene (e.g. Turenne et al. (2000) *J. Clin. Microbiol.* 38:513-520; SEQ ID NOS: 12018-12024 herein) or a protein-coding gene. The template sequence is preferably specific to GBS.

The invention also provides a computer-readable medium (e.g. a floppy disk, a hard disk, a CD-ROM, a DVD etc.) and/or a computer database containing one or more of the sequences in the sequence listing. The medium preferably contains SEQ ID NO:10967.

The invention also provides a hybrid protein represented by the formula $NH_2$-A-[-X-L-]$_n$-B—COOH, wherein X is a protein of the invention, L is an optional linker amino acid sequence, A is an optional N-terminal amino acid sequence, B is an optional C-terminal amino acid sequence, and n is an integer greater than 1. The value of n is between 2 and x, and the value of x is typically 3, 4, 5, 6, 7, 8, 9 or 10. Preferably n is 2, 3 or 4; it is more preferably 2 or 3; most preferably, n=2. For each n instances, —X— may be the same or different. For each n instances of [—X-L-], linker amino acid sequence -L- may be present or absent. For instance, when n=2 the hybrid may be $NH_2$—$X_1$-$L_1$-$X_2$-$L_2$-COOH, $NH_2$—$X_1$—$X_2$—COOH, $NH_2$—$X_1$-$L_1$-$X_2$—COOH, $NH_2$—$X_1$—$X_2$-$L_2$-COOH, etc. Linker amino acid sequence(s) -L- will typically be short (e.g. 20 or fewer amino acids i.e. 19, 18, 17, 16, 15, 14, 13, 12, 11, 10, 9, 8, 7, 6, 5, 4, 3, 2, 1). Examples include short peptide sequences which facilitate cloning, poly-glycine linkers (i.e. $Gly_n$ where n=2, 3, 4, 5, 6, 7, 8, 9, 10 or more), and histidine tags (i.e. $His_n$ where n=3, 4, 5, 6, 7, 8, 9, 10 or more). Other suitable linker amino acid sequences will be apparent to those skilled in the art. -A- and —B— are optional sequences which will typically be short (e.g. 40 or fewer amino acids i.e. 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include leader sequences to direct protein trafficking, or short peptide sequences which facilitate cloning or purification (e.g. histidine tags i.e. $His_n$ where n=3, 4, 5, 6, 7, 8, 9, 10 or more). Other suitable N-terminal and C-terminal amino acid sequences will be apparent to those skilled in the art. In some embodiments, each X will be a GBS sequence; in others, mixtures of GAS and GBS will be used.

According to further aspects, the invention provides various processes.

A process for producing proteins of the invention is provided, comprising the step of culturing a host cell of to the invention under conditions which induce protein expression.

A process for producing protein or nucleic acid of the invention is provided, wherein the protein or nucleic acid is synthesised in part or in whole using chemical means.

A process for detecting polynucleotides of the invention is provided, comprising the steps of: (a) contacting a nucleic probe according to the invention with a biological sample under hybridising conditions to form duplexes; and (b) detecting said duplexes.

A process for detecting *Streptococcus* in a biological sample (e.g. blood) is also provided, comprising the step of contacting nucleic acid according to the invention with the biological sample under hybridising conditions. The process may involve nucleic acid amplification (e.g. PCR, SDA, SSSR, LCR, TMA, NASBA etc.) or hybridisation (e.g. microarrays, blots, hybridisation with a probe in solution etc.). PCR detection of *Streptococcus* in clinical samples, in particular *S. pyogenes*, has been reported [see e.g. Louie et al. (2000) *CMAJ* 163:301-309; Louie et al. (1998) *J. Clin. Microbiol.* 36:1769-1771]. Clinical assays based on nucleic acid are described in general in Tang et al. (1997) *Clin. Chem.* 43:2021-2038.

A process for detecting proteins of the invention is provided, comprising the steps of: (a) contacting an antibody of the invention with a biological sample under conditions suitable for the formation of an antibody-antigen complexes; and (b) detecting said complexes.

A process for identifying an amino acid sequence is provided, comprising the step of searching for putative open reading frames or protein-coding regions within a genome sequence of *S. agalactiae*. This will typically involve in silico searching the sequence for an initiation codon and for an in-frame termination codon in the downstream sequence. The region between these initiation and termination codons is a putative protein-coding sequence. Typically, all six possible reading frames will be searched. Suitable software for such analysis includes ORFFINDER (NCBI), GENEMARK [Borodovsky & McIninch (1993) *Computers Chem.* 17:122-133], GLIMMER [Salzberg et al. (1998) *Nucleic Acids Res.* 26:544-548; Salzberg et al. (1999) *Genomics* 59:24-31; Delcher et al. (1999) *Nucleic Acids Res.* 27:4636-4641], or other software which uses Markov models [e.g. Shmatkov et al. (1999) *Bioinformatics* 15:874-876]. The invention also provides a protein comprising the identified amino acid sequence. These proteins can then expressed using conventional techniques.

The invention also provides a process for determining whether a test compound binds to a protein of the invention. If a test compound binds to a protein of the invention and this binding inhibits the life cycle of the GBS bacterium, then the test compound can be used as an antibiotic or as a lead compound for the design of antibiotics. The process will typically comprise the steps of contacting a test compound with a protein of the invention, and determining whether the test compound binds to said protein. Preferred proteins of the invention for use in these processes are enzymes (e.g. tRNA synthetases), membrane transporters and ribosomal proteins. Suitable test compounds include proteins, polypeptides, carbohydrates, lipids, nucleic acids (e.g. DNA, RNA, and modified forms thereof), as well as small organic compounds (e.g. MW between 200 and 2000 Da). The test compounds may be provided individually, but will typically be part of a library (e.g. a combinatorial library). Methods for detecting a binding interaction include NMR, filter-binding assays, gel-retardation assays, displacement assays, surface plasmon resonance, reverse two-hybrid etc. A compound which binds to a protein of the invention can be tested for antibiotic activity by contacting the compound with GBS bacteria and then monitoring for inhibition of growth. The invention also provides a compound identified using these methods.

The invention also provides a composition comprising a protein or the invention and one or more of the following antigens:

a protein antigen from *Helicobacter pylori* such as VacA, CagA, NAP, HopX, HopY [e.g WO98/04702] and/or urease.

a protein antigen from *N. meningitidis* serogroup B, such as those in WO99/24578, WO99/36544, WO99/57280, WO00/22430, Tettelin et al. (2000) *Science* 287:1809-1815, Pizza et al. (2000) *Science* 287:1816-1820 and WO96/29412, with protein '287' and derivatives being particularly preferred.

an outer-membrane vesicle (OMV) preparation from *N. meningitidis* serogroup B, such as those disclosed in WO01/52885; Bjune et al. (1991) *Lancet* 338(8775): 1093-1096; Fukasawa et al (1999) *Vaccine* 17:2951-2958; Rosenqvist et al. (1998) *Dev. Biol. Stand.* 92:323-333 etc.

a saccharide antigen from *N. meningitidis* serogroup A, C, W135 and/or Y, such as the oligosaccharide disclosed in Costantino et al. (1992) *Vaccine* 10:691-698 from serogroup C [see also Costantino et al. (1999) *Vaccine* 17:1251-1263].

a saccharide antigen from *Streptococcus pneumoniae* [e.g. Watson (2000) *Pediatr Infect Dis J* 19:331-332; Rubin (2000) *Pediatr Clin North Am* 47:269-285, v; Jedrzejas (2001) *Microbiol Mol Biol Rev* 65:187-207].

an antigen from hepatitis A virus, such as inactivated virus [e.g. Bell (2000) *Pediatr Infect Dis J* 19:1187-1188; Iwarson (1995) *APMIS* 103:321-326].

an antigen from hepatitis B virus, such as the surface and/or core antigens [e.g. Gerlich et al. (1990) *Vaccine* 8 Suppl: S63-68 & 79-80].

an antigen from hepatitis C virus [e.g. Hsu et al. (1999) *Clin Liver Dis* 3:901-915].

an antigen from *Bordetella pertussis*, such as pertussis holotoxin (PT) and filamentous haemagglutinin (FHA) from *B. pertussis*, optionally also in combination with pertactin and/or agglutinogens 2 and 3 [e.g. Gustafsson et al. (1996) *N. Engl. J. Med.* 334:349-355; Rappuoli et al. (1991) *TIBTECH* 9:232-238].

a diphtheria antigen, such as a diphtheria toxoid [e.g. chapter 3 of *Vaccines* (1988) eds. Plotkin & Mortimer. ISBN 0-7216-1946-0] e.g. the $CRM_{197}$ mutant [e.g. Del Guidice et al. (1998) *Molecular Aspects of Medicine* 19:1-70].

a tetanus antigen, such as a tetanus toxoid [e.g. chapter 4 of Plotkin & Mortimer].

a saccharide antigen from *Haemophilus influenzae* B.

an antigen from *N gonorrhoeae* [e.g. WO99/24578, WO99/36544, WO99/57280].

an antigen from *Chlamydia pneumoniae* [e.g. PCT/IB01/01445; Kalman et al. (1999) *Nature Genetics* 21:385-389; Read et al. (2000) *Nucleic Acids Res* 28:1397-406; Shirai et al. (2000) *J. Infect. Dis.* 181(Suppl 3):S524-S527; WO99/27105; WO00/27994; WO00/37494].

an antigen from *Chlamydia trachomatis* [e.g. WO99/28475].

an antigen from *Porphyromonas gingivalis* [e.g. Ross et al. (2001) *Vaccine* 19:4135-4142].

polio antigen(s) [e.g. Sutter et al. (2000) *Pediatr Clin North Am* 47:287-308; Zimmerman & Spann (1999) *Am Fam Physician* 59:113-118, 125-126] such as IPV or OPV.

rabies antigen(s) [e.g. Dreesen (1997) *Vaccine* 15 Suppl: S2-6] such as lyophilised inactivated virus [e.g. *MMWR Morb Mortal Wkly Rep* 1998 Jan. 16; 47(1):12, 19; RabAvert™].

measles, mumps and/or rubella antigens [e.g. chapters 9, 10 & 11 of Plotkin & Mortimer].

influenza antigen(s) [e.g. chapter 19 of Plotkin & Mortimer], such as the haemagglutinin and/or neuraminidase surface proteins.

an antigen from *Moraxella catarrhalis* [e.g. McMichael (2000) *Vaccine* 19 Suppl 1:S101-107].

an antigen from *Staphylococcus aureus* [e.g. Kuroda et al. (2001) *Lancet* 357(9264):1225-1240; see also pages 1218-1219].

Where a saccharide or carbohydrate antigen is included, it is preferably conjugated to a carrier protein in order to enhance immunogenicity [e.g. Ramsay et al. (2001) *Lancet* 357(9251):195-196; Lindberg (1999) *Vaccine* 17 Suppl 2:S28-36; *Conjugate Vaccines* (eds. Cruse et al.) ISBN 3805549326, particularly vol. 10:48-114 etc.]. Preferred carrier proteins are bacterial toxins or toxoids, such as diphtheria or tetanus toxoids. The $CRM_{197}$ diphtheria toxoid is particularly preferred. Other suitable carrier proteins include the *N. meningitidis* outer membrane protein [e.g. EP-0372501], synthetic peptides [e.g. EP-0378881, EP-0427347], heat shock proteins [e.g. WO93/17712], pertussis proteins [e.g. WO98/58668; EP-0471177], protein D from *H. influenzae* [e.g WO00/56360], toxin A or B from *C. difficile* [e.g. WO00/61761], etc. Any suitable conjugation reaction can be used, with any suitable linker where necessary.

Toxic protein antigens may be detoxified where necessary (e.g. detoxification of pertussis toxin by chemical and/or genetic means).

Where a diphtheria antigen is included in the composition it is preferred also to include tetanus antigen and pertussis antigens. Similarly, where a tetanus antigen is included it is preferred also to include diphtheria and pertussis antigens. Similarly, where a pertussis antigen is included it is preferred also to include diphtheria and tetanus antigens.

Antigens are preferably adsorbed to an aluminium salt.

Antigens in the composition will typically be present at a concentration of at least 1 µg/ml each. In general, the concentration of any given antigen will be sufficient to elicit an immune response against that antigen.

The invention also provides compositions comprising two or more proteins of the present invention. The two or more proteins may comprise GBS sequences or may comprise GAS and GBS sequences.

A summary of standard techniques and procedures which may be employed to perform the invention (e.g. to utilise the disclosed sequences for vaccination or diagnostic purposes) follows. This summary is not a limitation on the invention but, rather, gives examples that may be used, but are not required.

General

The practice of the present invention will employ, unless otherwise indicated, conventional techniques of molecular biology, microbiology, recombinant DNA, and immunology, which are within the skill of the art. Such techniques are explained fully in the literature eg. Sambrook *Molecular Cloning; A Laboratory Manual, Second Edition* (1989); *DNA Cloning, Volumes I and II* (D. N Glover ed. 1985); *Oligonucleotide Synthesis* (M. J. Gait ed, 1984); *Nucleic Acid Hybridization* (B. D. Hames & S. J. Higgins eds. 1984); *Transcription and Translation* (B. D. Hames & S. J. Higgins eds. 1984); *Animal Cell Culture* (R. I. Freshney ed. 1986); *Immobilized Cells and Enzymes* (IRL Press, 1986); B. Perbal, *A Practical Guide to Molecular Cloning* (1984); the *Methods in Enzymology* series (Academic Press, Inc.), especially volumes 154 & 155; *Gene Transfer Vectors for Mammalian Cells* (J. H. Miller and M. P. Calos eds. 1987, Cold Spring Harbor Laboratory); Mayer and Walker, eds. (1987), *Immunochemical Methods in Cell and Molecular Biology* (Academic Press, London); Scopes, (1987) *Protein Purification: Principles and Practice*, Second Edition (Springer-Verlag, N.Y.), and *Handbook of Experimental Immunology, Volumes I-IV* (D. M. Weir and C. C. Blackwell eds 1986).

Standard abbreviations for nucleotides and amino acids are used in this specification.

DEFINITIONS

A composition containing X is "substantially free of" Y when at least 85% by weight of the total X+Y in the composition is X. Preferably, X comprises at least about 90% by weight of the total of X+Y in the composition, more preferably at least about 95% or even 99% by weight.

The term "comprising" means "including" as well as "consisting" e.g. a composition "comprising" X may consist exclusively of X or may include something additional e.g. X+Y.

The term "heterologous" refers to two biological components that are not found together in nature. The components may be host cells, genes, or regulatory regions, such as promoters. Although the heterologous components are not found together in nature, they can function together, as when a promoter heterologous to a gene is operably linked to the gene. Another example is where a streptococcus sequence is heterologous to a mouse host cell. A further examples would be two epitopes from the same or different proteins which have been assembled in a single protein in an arrangement not found in nature.

An "origin of replication" is a polynucleotide sequence that initiates and regulates replication of polynucleotides, such as an expression vector. The origin of replication behaves as an autonomous unit of polynucleotide replication within a cell, capable of replication under its own control. An origin of replication may be needed for a vector to replicate in a particular host cell. With certain origins of replication, an expression vector can be reproduced at a high copy number in the presence of the appropriate proteins within the cell. Examples of origins are the autonomously replicating sequences, which are effective in yeast; and the viral T-antigen, effective in COS-7 cells.

A "mutant" sequence is defined as DNA, RNA or amino acid sequence differing from but having sequence identity with the native or disclosed sequence. Depending on the particular sequence, the degree of sequence identity between the native or disclosed sequence and the mutant sequence is preferably greater than 50% (eg. 60%, 70%, 80%, 90%, 95%, 99% or more, calculated using the Smith-Waterman algorithm as described above). As used herein, an "allelic variant" of a nucleic acid molecule, or region, for which nucleic acid sequence is provided herein is a nucleic acid molecule, or region, that occurs essentially at the same locus in the genome of another or second isolate, and that, due to natural variation caused by, for example, mutation or recombination, has a similar but not identical nucleic acid sequence. A coding region allelic variant typically encodes a protein having similar activity to that of the protein encoded by the gene to which it is being compared. An allelic variant can also comprise an alteration in the 5' or 3' untranslated regions of the gene, such as in regulatory control regions (eg. see U.S. Pat. No. 5,753,235).

Expression Systems

The streptococcus nucleotide sequences can be expressed in a variety of different expression systems; for example those used with mammalian cells, baculoviruses, plants, bacteria, and yeast.

i. Mammalian Systems

Mammalian expression systems are known in the art. A mammalian promoter is any DNA sequence capable of binding mammalian RNA polymerase and initiating the downstream (3') transcription of a coding sequence (eg. structural gene) into mRNA. A promoter will have a transcription initiating region, which is usually placed proximal to the 5' end of the coding sequence, and a TATA box, usually located 25-30 base pairs (bp) upstream of the transcription initiation site. The TATA box is thought to direct RNA polymerase II to begin RNA synthesis at the correct site. A mammalian promoter will also contain an upstream promoter element, usually located within 100 to 200 bp upstream of the TATA box. An upstream promoter element determines the rate at which transcription is initiated and can act in either orientation [Sambrook et al. (1989) "Expression of Cloned Genes in Mammalian Cells." In *Molecular Cloning: A Laboratory Manual,* 2nd ed.].

Mammalian viral genes are often highly expressed and have a broad host range; therefore sequences encoding mammalian viral genes provide particularly useful promoter sequences. Examples include the SV40 early promoter, mouse mammary tumor virus LTR promoter, adenovirus major late promoter (Ad MLP), and herpes simplex virus promoter. In addition, sequences derived from non-viral genes, such as the murine metallotheionin gene, also provide useful promoter sequences. Expression may be either constitutive or regulated (inducible), depending on the promoter can be induced with glucocorticoid in hormone-responsive cells.

The presence of an enhancer element (enhancer), combined with the promoter elements described above, will usually increase expression levels. An enhancer is a regulatory DNA sequence that can stimulate transcription up to 1000-fold when linked to homologous or heterologous promoters, with synthesis beginning at the normal RNA start site. Enhancers are also active when they are placed upstream or downstream from the transcription initiation site, in either normal or flipped orientation, or at a distance of more than 1000 nucleotides from the promoter [Maniatis et al. (1987) *Science* 236:1237; Alberts et al. (1989) *Molecular Biology of the Cell,* 2nd ed.]. Enhancer elements derived from viruses may be particularly useful, because they usually have a broader host range. Examples include the SV40 early gene enhancer [Dijkema et al (1985) *EMBO J.* 4:761] and the enhancer/promoters derived from the long terminal repeat (LTR) of the Rous Sarcoma Virus [Gorman et al. (1982b) *Proc. Natl. Acad. Sci.* 79:6777] and from human cytomegalovirus [Boshart et al. (1985) *Cell* 41:521]. Additionally, some enhancers are regulatable and become active only in the presence of an inducer, such as a hormone or metal ion [Sassone-Corsi and Borelli (1986) *Trends Genet.* 2:215; Maniatis et al. (1987) *Science* 236:1237].

A DNA molecule may be expressed intracellularly in mammalian cells. A promoter sequence may be directly linked with the DNA molecule, in which case the first amino acid at the N-terminus of the recombinant protein will always be a methionine, which is encoded by the ATG start codon. If desired, the N-terminus may be cleaved from the protein by in vitro incubation with cyanogen bromide.

Alternatively, foreign proteins can also be secreted from the cell into the growth media by creating chimeric DNA molecules that encode a fusion protein comprised of a leader sequence fragment that provides for secretion of the foreign protein in mammalian cells. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell. The adenovirus tripartite leader is an example of a leader sequence that provides for secretion of a foreign protein in mammalian cells.

Usually, transcription termination and polyadenylation sequences recognized by mammalian cells are regulatory regions located 3' to the translation stop codon and thus, together with the promoter elements, flank the coding sequence. The 3' terminus of the mature mRNA is formed by site-specific post-transcriptional cleavage and polyadenylation [Birmstiel et al. (1985) *Cell* 41:349; Proudfoot and Whitelaw (1988) "Termination and 3' end processing of eukaryotic RNA. In *Transcription and splicing* (ed. B. D. Hames and D. M. Glover); Proudfoot (1989) *Trends Biochem. Sci.* 14:105]. These sequences direct the transcription of an mRNA which can be translated into the polypeptide encoded by the DNA. Examples of transcription terminater/polyadenylation signals include those derived from SV40 [Sambrook et al (1989) "Expression of cloned genes in cultured mammalian cells." *In Molecular Cloning: A Laboratory Manual]*.

Usually, the above described components, comprising a promoter, polyadenylation signal, and transcription termination sequence are put together into expression constructs. Enhancers, introns with functional splice donor and acceptor sites, and leader sequences may also be included in an expression construct, if desired. Expression constructs are often maintained in a replicon, such as an extrachromosomal element (eg. plasmids) capable of stable maintenance in a host, such as mammalian cells or bacteria. Mammalian replication systems include those derived from animal viruses, which require trans-acting factors to replicate. For example, plasmids containing the replication systems of papovaviruses, such as SV40 [Gluzman (1981) *Cell* 23:175] or polyomavirus, replicate to extremely high copy number in the presence of the appropriate viral T antigen. Additional examples of mammalian replicons include those derived from bovine papillomavirus and Epstein-Barr virus. Additionally, the replicon may have two replication systems, thus allowing it to be maintained, for example, in mammalian cells for expression and in a prokaryotic host for cloning and amplification. Examples of such mammalian-bacteria shuttle vectors include pMT2 [Kaufman et al. (1989) *Mol. Cell. Biol.* 9:946] and pHEBO [Shimizu et al. (1986) *Mol. Cell. Biol.* 6:1074].

The transformation procedure used depends upon the host to be transformed. Methods for introduction of heterologous polynucleotides into mammalian cells are known in the art and include dextran-mediated transfection, calcium phosphate precipitation, polybrene mediated transfection, protoplast fusion, electroporation, encapsulation of the polynucleotide(s) in liposomes, and direct microinjection of the DNA into nuclei.

Mammalian cell lines available as hosts for expression are known in the art and include many immortalized cell lines available from the American Type Culture Collection (ATCC), including but not limited to, Chinese hamster ovary (CHO) cells, HeLa cells, baby hamster kidney (BHK) cells, monkey kidney cells (COS), human hepatocellular carcinoma cells (eg. Hep G2), and a number of other cell lines.

ii. Baculovirus Systems

The polynucleotide encoding the protein can also be inserted into a suitable insect expression vector, and is operably linked to the control elements within that vector. Vector construction employs techniques which are known in the art. Generally, the components of the expression system include a transfer vector, usually a bacterial plasmid, which contains both a fragment of the baculovirus genome, and a convenient restriction site for insertion of the heterologous gene or genes to be expressed; a wild type baculovirus with a sequence homologous to the baculovirus-specific fragment in the transfer vector (this allows for the homologous recombination of the heterologous gene in to the baculovirus genome); and appropriate insect host cells and growth media.

After inserting the DNA sequence encoding the protein into the transfer vector, the vector and the wild type viral genome are transfected into an insect host cell where the vector and viral genome are allowed to recombine. The packaged recombinant virus is expressed and recombinant plaques are identified and purified. Materials and methods for baculovirus/insect cell expression systems are commercially available in kit form from, inter alia, Invitrogen, San Diego Calif. ("MaxBac" kit). These techniques are generally known to those skilled in the art and fully described in Summers and Smith, *Texas Agricultural Experiment Station Bulletin No. 1555* (1987) (hereinafter "Summers and Smith").

Prior to inserting the DNA sequence encoding the protein into the baculovirus genome, the above described components, comprising a promoter, leader (if desired), coding sequence, and transcription termination sequence, are usually assembled into an intermediate transplacement construct (transfer vector). This may contain a single gene and operably linked regulatory elements; multiple genes, each with its owned set of operably linked regulatory elements; or multiple genes, regulated by the same set of regulatory elements. Intermediate transplacement constructs are often maintained in a replicon, such as an extra-chromosomal element (e.g. plasmids) capable of stable maintenance in a host, such as a bacterium. The replicon will have a replication system, thus allowing it to be maintained in a suitable host for cloning and amplification.

Currently, the most commonly used transfer vector for introducing foreign genes into AcNPV is pAc373. Many other vectors, known to those of skill in the art, have also been designed. These include, for example, pVL985 (which alters the polyhedrin start codon from ATG to ATT, and which introduces a BamHI cloning site 32 basepairs downstream from the ATT; see Luckow and Summers, *Virology* (1989) 17:31.

The plasmid usually also contains the polyhedrin polyadenylation signal (Miller et al. (1988) *Ann. Rev. Microbiol.*, 42:177) and a prokaryotic ampicillin-resistance (amp) gene and origin of replication for selection and propagation in *E. coli.*

Baculovirus transfer vectors usually contain a baculovirus promoter. A baculovirus promoter is any DNA sequence capable of binding a baculovirus RNA polymerase and initiating the downstream (5' to 3') transcription of a coding sequence (eg. structural gene) into mRNA. A promoter will have a transcription initiation region which is usually placed proximal to the 5' end of the coding sequence. This transcription initiation region usually includes an RNA polymerase binding site and a transcription initiation site. A baculovirus transfer vector may also have a second domain called an enhancer, which, if present, is usually distal to the structural gene. Expression may be either regulated or constitutive.

Structural genes, abundantly transcribed at late times in a viral infection cycle, provide particularly useful promoter sequences. Examples include sequences derived from the gene encoding the viral polyhedron protein, Friesen et al., (1986) "The Regulation of Baculovirus Gene Expression," in: *The Molecular Biology of Baculoviruses* (ed. Walter Doerfler); EPO Publ. Nos. 127 839 and 155 476; and the gene encoding the p10 protein, Vlak et al., (1988), *J. Gen. Virol.* 69:765.

DNA encoding suitable signal sequences can be derived from genes for secreted insect or baculovirus proteins, such as the baculovirus polyhedrin gene (Carbonell et al. (1988) *Gene,* 73:409). Alternatively, since the signals for mammalian cell posttranslational modifications (such as signal peptide cleavage, proteolytic cleavage, and phosphorylation) appear to be recognized by insect cells, and the signals required for secretion and nuclear accumulation also appear to be conserved between the invertebrate cells and vertebrate cells, leaders of non-insect origin, such as those derived from genes encoding human α-interferon, Maeda et al., (1985), *Nature* 315:592; human gastrin-releasing peptide, Lebacq-Verheyden et al., (1988), *Molec. Cell. Biol.* 8:3129; human IL-2, Smith et al., (1985) *Proc. Nat'l Acad. Sci. USA,* 82:8404; mouse IL-3, (Miyajima et al., (1987) *Gene* 58:273; and human glucocerebrosidase, Martin et al. (1988) *DNA,* 7:99, can also be used to provide for secretion in insects.

A recombinant polypeptide or polyprotein may be expressed intracellularly or, if it is expressed with the proper regulatory sequences, it can be secreted. Good intracellular expression of nonfused foreign proteins usually requires heterologous genes that ideally have a short leader sequence containing suitable translation initiation signals preceding an ATG start signal. If desired, methionine at the N-terminus may be cleaved from the mature protein by in vitro incubation with cyanogen bromide.

Alternatively, recombinant polyproteins or proteins which are not naturally secreted can be secreted from the insect cell by creating chimeric DNA molecules that encode a fusion protein comprised of a leader sequence fragment that provides for secretion of the foreign protein in insects. The leader sequence fragment usually encodes a signal peptide comprised of hydrophobic amino acids which direct the translocation of the protein into the endoplasmic reticulum.

After insertion of the DNA sequence and/or the gene encoding the expression product precursor of the protein, an insect cell host is co-transformed with the heterologous DNA of the transfer vector and the genomic DNA of wild type baculovirus—usually by co-transfection. The promoter and transcription termination sequence of the construct will usually comprise a 2-5 kb section of the baculovirus genome. Methods for introducing heterologous DNA into the desired site in the baculovirus virus are known in the art. (See Summers and Smith supra; Ju et al. (1987); Smith et al., *Mol. Cell. Biol.* (1983) 3:2156; and Luckow and Summers (1989)). For example, the insertion can be into a gene such as the polyhedrin gene, by homologous double crossover recombination; insertion can also be into a restriction enzyme site engineered into the desired baculovirus gene. Miller et al., (1989), *Bioessays* 4:91. The DNA sequence, when cloned in place of the polyhedrin gene in the expression vector, is flanked both 5' and 3' by polyhedrin-specific sequences and is positioned downstream of the polyhedrin promoter.

The newly formed baculovirus expression vector is subsequently packaged into an infectious recombinant baculovirus. Homologous recombination occurs at low frequency (between about 1% and about 5%); thus, the majority of the virus produced after cotransfection is still wild-type virus. Therefore, a method is necessary to identify recombinant viruses. An advantage of the expression system is a visual screen allowing recombinant viruses to be distinguished. The polyhedrin protein, which is produced by the native virus, is produced at very high levels in the nuclei of infected cells at late times after viral infection. Accumulated polyhedrin protein forms occlusion bodies that also contain embedded particles. These occlusion bodies, up to 15 μm in size, are highly refractile, giving them a bright shiny appearance that is readily visualized under the light microscope. Cells infected with recombinant viruses lack occlusion bodies. To distinguish recombinant virus from wild-type virus, the transfection supernatant is plaqued onto a monolayer of insect cells by techniques known to those skilled in the art. Namely, the plaques are screened under the light microscope for the presence (indicative of wild-type virus) or absence (indicative of recombinant virus) of occlusion bodies. "Current Protocols in Microbiology" Vol. 2 (Ausubel et al. eds) at 16.8 (Supp. 10, 1990); Summers and Smith, supra; Miller et al. (1989).

Recombinant baculovirus expression vectors have been developed for infection into several insect cells. For example, recombinant baculoviruses have been developed for, inter alia: *Aedes aegypti, Autographa californica, Bombyx mori, Drosophila melanogaster, Spodoptera frugiperda,* and *Trichoplusia ni* (WO 89/046699; Carbonell et al., (1985) *J. Virol.* 56:153; Wright (1986) *Nature* 321:718; Smith et al., (1983) *Mol. Cell. Biol.* 3:2156; and see generally, Fraser, et al. (1989) *In Vitro Cell. Dev. Biol.* 25:225).

Cells and cell culture media are commercially available for both direct and fusion expression of heterologous polypeptides in a baculovirus/expression system; cell culture technology is generally known to those skilled in the art. See, eg. Summers and Smith supra.

The modified insect cells may then be grown in an appropriate nutrient medium, which allows for stable maintenance of the plasmid(s) present in the modified insect host. Where the expression product gene is under inducible control, the host may be grown to high density, and expression induced. Alternatively, where expression is constitutive, the product will be continuously expressed into the medium and the nutrient medium must be continuously circulated, while removing the product of interest and augmenting depleted nutrients. The product may be purified by such techniques as chromatography, eg. HPLC, affinity chromatography, ion exchange chromatography, etc.; electrophoresis; density gradient centrifugation; solvent extraction, etc. As appropriate, the product may be further purified, as required, so as to remove substantially any insect proteins which are also present in the medium, so as to provide a product which is at least substantially free of host debris, eg. proteins, lipids and polysaccharides.

In order to obtain protein expression, recombinant host cells derived from the transformants are incubated under conditions which allow expression of the recombinant protein encoding sequence. These conditions will vary, dependent upon the host cell selected. However, the conditions are readily ascertainable to those of ordinary skill in the art, based upon what is known in the art.

iii. Plant Systems

There are many plant cell culture and whole plant genetic expression systems known in the art. Exemplary plant cellular genetic expression systems include those described in patents, such as: U.S. Pat. Nos. 5,693,506; 5,659,122; and 5,608,143. Additional examples of genetic expression in plant cell culture has been described by Zenk, *Phytochemistry* 30:3861-

3863 (1991). Descriptions of plant protein signal peptides may be found in addition to the references described above in Vaulcombe et al., *Mol. Gen. Genet.* 209:33-40 (1987); Chandler et al., *Plant Molecular Biology* 3:407-418 (1984); Rogers, *J. Biol. Chem.* 260:3731-3738 (1985); Rothstein et al., *Gene* 55:353-356 (1987); Whittier et al., *Nucleic Acids Research* 15:2515-2535 (1987); Wirsel et al., *Molecular Microbiology* 3:3-14 (1989); Yu et al., *Gene* 122:247-253 (1992). A description of the regulation of plant gene expression by the phytohormone, gibberellic acid and secreted enzymes induced by gibberellic acid can be found in R. L. Jones and J. MacMillin, Gibberellins: in: *Advanced Plant Physiology*, Malcolm B. Wilkins, ed., 1984 Pitman Publishing Limited, London, pp. 21-52. References that describe other metabolically-regulated genes: Sheen, *Plant Cell*, 2:1027-1038(1990); Maas et al., *EMBO J.* 9:3447-3452 (1990); Benkel and Hickey, *Proc. Natl. Acad. Sci.* 84:1337-1339 (1987).

Typically, using techniques known in the art, a desired polynucleotide sequence is inserted into an expression cassette comprising genetic regulatory elements designed for operation in plants. The expression cassette is inserted into a desired expression vector with companion sequences upstream and downstream from the expression cassette suitable for expression in a plant host. The companion sequences will be of plasmid or viral origin and provide necessary characteristics to the vector to permit the vectors to move DNA from an original cloning host, such as bacteria, to the desired plant host. The basic bacterial/plant vector construct will preferably provide a broad host range prokaryote replication origin; a prokaryote selectable marker; and, for *Agrobacterium* transformations, T DNA sequences for *Agrobacterium*-mediated transfer to plant chromosomes. Where the heterologous gene is not readily amenable to detection, the construct will preferably also have a selectable marker gene suitable for determining if a plant cell has been transformed. A general review of suitable markers, for example for the members of the grass family, is found in Wilmink and Dons, 1993, *Plant Mol. Biol. Reptr*, 11(2):165-185.

Sequences suitable for permitting integration of the heterologous sequence into the plant genome are also recommended. These might include transposon sequences and the like for homologous recombination as well as Ti sequences which permit random insertion of a heterologous expression cassette into a plant genome. Suitable prokaryote selectable markers include resistance toward antibiotics such as ampicillin or tetracycline. Other DNA sequences encoding additional functions may also be present in the vector, as is known in the art.

The nucleic acid molecules of the subject invention may be included into an expression cassette for expression of the protein(s) of interest. Usually, there will be only one expression cassette, although two or more are feasible. The recombinant expression cassette will contain in addition to the heterologous protein encoding sequence the following elements, a promoter region, plant 5' untranslated sequences, initiation codon depending upon whether or not the structural gene comes equipped with one, and a transcription and translation termination sequence. Unique restriction enzyme sites at the 5' and 3' ends of the cassette allow for easy insertion into a pre-existing vector.

A heterologous coding sequence may be for any protein relating to the present invention. The sequence encoding the protein of interest will encode a signal peptide which allows processing and translocation of the protein, as appropriate, and will usually lack any sequence which might result in the binding of the desired protein of the invention to a membrane. Since, for the most part, the transcriptional initiation region will be for a gene which is expressed and translocated during germination, by employing the signal peptide which provides for translocation, one may also provide for translocation of the protein of interest. In this way, the protein(s) of interest will be translocated from the cells in which they are expressed and may be efficiently harvested. Typically secretion in seeds are across the aleurone or scutellar epithelium layer into the endosperm of the seed. While it is not required that the protein be secreted from the cells in which the protein is produced, this facilitates the isolation and purification of the recombinant protein.

Since the ultimate expression of the desired gene product will be in a eucaryotic cell it is desirable to determine whether any portion of the cloned gene contains sequences which will be processed out as introns by the host's splicosome machinery. If so, site-directed mutagenesis of the "intron" region may be conducted to prevent losing a portion of the genetic message as a false intron code, Reed and Maniatis, *Cell* 41:95-105, 1985.

The vector can be microinjected directly into plant cells by use of micropipettes to mechanically transfer the recombinant DNA. Crossway, *Mol. Gen. Genet,* 202:179-185, 1985. The genetic material may also be transferred into the plant cell by using polyethylene glycol, Krens, et al., *Nature*, 296, 72-74, 1982. Another method of introduction of nucleic acid segments is high velocity ballistic penetration by small particles with the nucleic acid either within the matrix of small beads or particles, or on the surface, Klein, et al., *Nature,* 327, 70-73, 1987 and Knudsen and Muller, 1991, *Planta,* 185:330-336 teaching particle bombardment of barley endosperm to create transgenic barley. Yet another method of introduction would be fusion of protoplasts with other entities, either minicells, cells, lysosomes or other fusible lipid-surfaced bodies, Fraley, et al., *Proc. Natl. Acad. Sci. USA,* 79, 1859-1863, 1982.

The vector may also be introduced into the plant cells by electroporation. (Fromm et al., *Proc. Natl Acad. Sci. USA* 82:5824, 1985). In this technique, plant protoplasts are electroporated in the presence of plasmids containing the gene construct. Electrical impulses of high field strength reversibly permeabilize biomembranes allowing the introduction of the plasmids. Electroporated plant protoplasts reform the cell wall, divide, and form plant callus.

All plants from which protoplasts can be isolated and cultured to give whole regenerated plants can be transformed by the present invention so that whole plants are recovered which contain the transferred gene. It is known that practically all plants can be regenerated from cultured cells or tissues, including but not limited to all major species of sugarcane, sugar beet, cotton, fruit and other trees, legumes and vegetables. Some suitable plants include, for example, species from the genera *Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersion, Nicotiana, Solanum, Petunia, Digitalis, Majorana, Cichorium, Helianthus, Lactuca, Bromus, Asparagus, Antirrhinum, Hererocallis, Nemesia, Pelargonium, Panicum, Pennisetum, Ranunculus, Senecio, Salpiglossis, Cucumis, Browaalia, Glycine, Lolium, Zea, Triticum, Sorghum,* and *Datura.*

Means for regeneration vary from species to species of plants, but generally a suspension of transformed protoplasts containing copies of the heterologous gene is first provided. Callus tissue is formed and shoots may be induced from callus and subsequently rooted. Alternatively, embryo formation can be induced from the protoplast suspension. These embryos germinate as natural embryos to form plants. The culture media will generally contain various amino acids and hormones, such as auxin and cytokinins. It is also advantageous to add glutamic acid and proline to the medium, especially for such species as corn and alfalfa. Shoots and roots normally develop simultaneously. Efficient regeneration will depend on the medium, on the genotype, and on the history of the culture. If these three variables are controlled, then regeneration is fully reproducible and repeatable.

In some plant cell culture systems, the desired protein of the invention may be excreted or alternatively, the protein may be extracted from the whole plant. Where the desired protein of the invention is secreted into the medium, it may be collected. Alternatively, the embryos and embryoless-half seeds or other plant tissue may be mechanically disrupted to release any secreted protein between cells and tissues. The mixture may be suspended in a buffer solution to retrieve soluble proteins. Conventional protein isolation and purification methods will be then used to purify the recombinant protein. Parameters of time, temperature pH, oxygen, and volumes will be adjusted through routine methods to optimize expression and recovery of heterologous protein.

iv. Bacterial Systems

Bacterial expression techniques are known in the art. A bacterial promoter is any DNA sequence capable of binding bacterial RNA polymerase and initiating the downstream (3') transcription of a coding sequence (eg. structural gene) into mRNA. A promoter will have a transcription initiation region which is usually placed proximal to the 5' end of the coding sequence. This transcription initiation region usually includes an RNA polymerase binding site and a transcription initiation site. A bacterial promoter may also have a second domain called an operator, that may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence. An example of a gene activator protein is the catabolite activator protein (CAP), which helps initiate transcription of the lac operon in *Escherichia coli* (*E. coli*) [Raibaud et al. (1984) *Annu. Rev. Genet.* 18:173]. Regulated expression may therefore be either positive or negative, thereby either enhancing or reducing transcription.

Sequences encoding metabolic pathway enzymes provide particularly useful promoter sequences. Examples include promoter sequences derived from sugar metabolizing enzymes, such as galactose, lactose (lac) [Chang et al. (1977) *Nature* 198:1056], and maltose. Additional examples include promoter sequences derived from biosynthetic enzymes such as tryptophan (trp) [Goeddel et al. (1980) *Nuc. Acids Res.* 8:4057; Yelverton et al. (1981) *Nucl. Acids Res.* 9:731; U.S. Pat. No. 4,738,921; EP-A-0036776 and EP-A-0121775]. The g-laotamase (bla) promoter system [Weissmann (1981) "The cloning of interferon and other mistakes." In *Interferon* 3 (ed. I. Gresser)], bacteriophage lambda PL [Shimatake et al. (1981) *Nature* 292:128] and T5 [U.S. Pat. No. 4,689,406] promoter systems also provide useful promoter sequences.

In addition, synthetic promoters which do not occur in nature also function as bacterial promoters. For example, transcription activation sequences of one bacterial or bacteriophage promoter may be joined with the operon sequences of another bacterial or bacteriophage promoter, creating a synthetic hybrid promoter [U.S. Pat. No. 4,551,433]. For example, the tac promoter is a hybrid trp-lac promoter comprised of both trp promoter and lac operon sequences that is regulated by the lac repressor [Amann et al. (1983) *Gene* 25:167; de Boer et al. (1983) *Proc. Natl. Acad. Sci.* 80:21]. Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system [Studier et al. (1986) *J. Mol. Biol.* 189:113; Tabor et al. (1985) *Proc Natl. Acad. Sci.* 82:1074]. In addition, a hybrid promoter can also be comprised of a bacteriophage promoter and an *E. coli* operator region (EPO-A-0 267 851).

In addition to a functioning promoter sequence, an efficient ribosome binding site is also useful for the expression of foreign genes in prokaryotes. In *E. coli*, the ribosome binding site is called the Shine-Dalgarno (SD) sequence and includes an initiation codon (ATG) and a sequence 3-9 nucleotides in length located 3-11 nucleotides upstream of the initiation codon [Shine et al. (1975) *Nature* 254:34]. The SD sequence is thought to promote binding of mRNA to the ribosome by the pairing of bases between the SD sequence and the 3' and of *E. coli* 16S rRNA [Steitz et al. (1979) "Genetic signals and nucleotide sequences in messenger RNA." In *Biological Regulation and Development: Gene Expression* (ed. R. F. Goldberger)]. To express eukaryotic genes and prokaryotic genes with weak ribosome-binding site [Sambrook et al. (1989) "Expression of cloned genes in *Escherichia coli*." In *Molecular Cloning: A Laboratory Manual*].

A DNA molecule may be expressed intracellularly. A promoter sequence may be directly linked with the DNA molecule, in which case the first amino acid at the N-terminus will always be a methionine, which is encoded by the ATG start codon. If desired, methionine at the N-terminus may be cleaved from the protein by in vitro incubation with cyanogen bromide or by either in vivo on in vitro incubation with a bacterial methionine N-terminal peptidase (EP-A-0 219 237).

Fusion proteins provide an alternative to direct expression. Usually, a DNA sequence encoding the N-terminal portion of an endogenous bacterial protein, or other stable protein, is fused to the 5' end of heterologous coding sequences. Upon expression, this construct will provide a fusion of the two amino acid sequences. For example, the bacteriophage lambda cell gene can be linked at the 5' terminus of a foreign gene and expressed in bacteria. The resulting fusion protein preferably retains a site for a processing enzyme (factor Xa) to cleave the bacteriophage protein from the foreign gene [Nagai et al. (1984) *Nature* 309:810]. Fusion proteins can also be made with sequences from the lacZ [Jia et al. (1987) *Gene* 60:197], trpE [Allen et al. (1987) *J. Biotechnol.* 5:93; Makoff et al. (1989) *J. Gen. Microbiol.* 135:11], and Chey [EP-A-0 324 647] genes. The DNA sequence at the junction of the two amino acid sequences may or may not encode a cleavable site. Another example is a ubiquitin fusion protein. Such a fusion protein is made with the ubiquitin region that preferably retains a site for a processing enzyme (eg. ubiquitin specific processing-protease) to cleave the ubiquitin from the foreign protein. Through this method, native foreign protein can be isolated [Miller et al. (1989) *Bio/Technology* 7:698].

Alternatively, foreign proteins can also be secreted from the cell by creating chimeric DNA molecules that encode a fusion protein comprised of a signal peptide sequence fragment that provides for secretion of the foreign protein in bacteria [U.S. Pat. No. 4,336,336]. The signal sequence fragment usually encodes a signal peptide comprised of hydrophobic amino acids which direct the secretion of the protein from the cell. The protein is either secreted into the growth media (gram-positive bacteria) or into the periplasmic space, located between the inner and outer membrane of the cell (gram-negative bacteria). Preferably there are processing sites, which can be cleaved either in vivo or in vitro encoded between the signal peptide fragment and the foreign gene.

DNA encoding suitable signal sequences can be derived from genes for secreted bacterial proteins, such as the *E. coli* outer membrane protein gene (ompA) [Masui et al. (1983), in: *Experimental Manipulation of Gene Expression*; Ghrayeb et al. (1984) *EMBO J.* 3:2437] and the *E. coli* alkaline phosphatase signal sequence (phoA) [Oka et al. (1985) *Proc. Natl. Acad. Sci.* 82:7212]. As an additional example, the signal sequence of the alpha-amylase gene from various *Bacillus* strains can be used to secrete heterologous proteins from *B. subtilis* [Palva et al. (1982) *Proc. Natl. Acad. Sci. USA* 79:5582; EP-A-0 244 042].

Usually, transcription termination sequences recognized by bacteria are regulatory regions located 3' to the translation stop codon, and thus together with the promoter flank the coding sequence. These sequences direct the transcription of an mRNA which can be translated into the polypeptide encoded by the DNA. Transcription termination sequences frequently include DNA sequences of about 50 nucleotides capable of forming stem loop structures that aid in terminating transcription. Examples include transcription termination sequences derived from genes with strong promoters, such as the trp gene in *E. coli* as well as other biosynthetic genes.

Usually, the above described components, comprising a promoter, signal sequence (if desired), coding sequence of interest, and transcription termination sequence, are put together into expression constructs. Expression constructs are often maintained in a replicon, such as an extrachromosomal element (eg. plasmids) capable of stable maintenance in a host, such as bacteria. The replicon will have a replication system, thus allowing it to be maintained in a prokaryotic host either for expression or for cloning and amplification. In addition, a replicon may be either a high or low copy number plasmid. A high copy number plasmid will generally have a copy number ranging from about 5 to about 200, and usually about 10 to about 150. A host containing a high copy number plasmid will preferably contain at least about 10, and more preferably at least about 20 plasmids. Either a high or low copy number vector may be selected, depending upon the effect of the vector and the foreign protein on the host.

Alternatively, the expression constructs can be integrated into the bacterial genome with an integrating vector. Integrating vectors usually contain at least one sequence homologous to the bacterial chromosome that allows the vector to integrate. Integrations appear to result from recombinations between homologous DNA in the vector and the bacterial chromosome. For example, integrating vectors constructed with DNA from various *Bacillus* strains integrate into the *Bacillus* chromosome (EP-A-0 127 328). Integrating vectors may also be comprised of bacteriophage or transposon sequences.

Usually, extrachromosomal and integrating expression constructs may contain selectable markers to allow for the selection of bacterial strains that have been transformed. Selectable markers can be expressed in the bacterial host and may include genes which render bacteria resistant to drugs such as ampicillin, chloramphenicol, erythromycin, kanamycin (neomycin), and tetracycline [Davies et al. (1978) *Annu. Rev. Microbiol.* 32:469]. Selectable markers may also include biosynthetic genes, such as those in the histidine, tryptophan, and leucine biosynthetic pathways.

Alternatively, some of the above described components can be put together in transformation vectors. Transformation vectors are usually comprised of a selectable market that is either maintained in a replicon or developed into an integrating vector, as described above.

Expression and transformation vectors, either extra-chromosomal replicons or integrating vectors, have been developed for transformation into many bacteria. For example, expression vectors have been developed for, inter alia, the following bacteria: *Bacillus subtilis* [Palva et al. (1982) *Proc. Natl Acad. Sci. USA* 79:5582; EP-A-0 036 259 and EP-A-0 063 953; WO 84/04541], *Escherichia coli* [Shimatake et al. (1981) *Nature* 292:128; Amann et al. (1985) *Gene* 40:183; Studier et al. (1986) *J. Mol. Biol.* 189:113; EP-A-0 036 776, EP-A-0 136 829 and EP-A-0 136 907], *Streptococcus cremoris* [Powell et al. (1988) *Appl. Environ. Microbiol.* 54:655]; *Streptococcus lividans* [Powell et al. (1988) *Appl. Environ. Microbiol.* 54:655], *Streptomyces lividans* [U.S. Pat. No. 4,745,056].

Methods of introducing exogenous DNA into bacterial hosts are well-known in the art, and usually include either the transformation of bacteria treated with $CaCl_2$ or other agents, such as divalent cations and DMSO. DNA can also be introduced into bacterial cells by electroporation. Transformation procedures usually vary with the bacterial species to be transformed. See eg. [Masson et al. (1989) *FEMS Microbiol. Lett.* 60:273; Palva et al. (1982) *Proc. Natl. Acad. Sci. USA* 79:5582; EP-A-0 036 259 and EP-A-0 063 953; WO 84/04541, *Bacillus*], [Miller et al. (1988) *Proc. Natl. Acad. Sci.* 85:856; Wang et al. (1990) *J. Bacteriol.* 172:949, *Campylobacter*], [Cohen et al. (1973) *Proc. Natl. Acad. Sci.* 69:2110; Dower et al. (1988) *Nucleic Acids Res.* 16:6127; Kushner (1978) "An improved method for transformation of *Escherichia coli* with ColE 1-derived plasmids. In *Genetic Engineering: Proceedings of the International Symposium on Genetic Engineering* (eds. H. W. Boyer and S. Nicosia); Mandel et al. (1970) *J. Mol. Biol.* 53:159; Taketo (1988) *Biochim. Biophys. Acta* 949:318; *Escherichia*], [Chassy et al. (1987) *FEMS Microbiol. Lett.* 44:173 *Lactobacillus*]; [Fiedler et al. (1988) *Anal. Biochem* 170:38, *Pseudomonas*]; [Augustin et al. (1990) *FEMS Microbiol. Lett.* 66:203, *Staphylococcus*], [Barany et al. (1980) *J. Bacteriol.* 144:698; Harlander (1987) "Transformation of *Streptococcus lactis* by electroporation, in: *Streptococcal Genetics* (ed. J. Ferretti and R. Curtiss III); Perry et al. (1981) *Infect. Immun.* 32:1295; Powell et al. (1988) *Appl. Environ. Microbiol.* 54:655; Somkuti et al. (1987) *Proc. 4th Evr. Cong. Biotechnology* 1:412, *Streptococcus*].

v. Yeast Expression

Yeast expression systems are also known to one of ordinary skill in the art. A yeast promoter is any DNA sequence capable of binding yeast RNA polymerase and initiating the downstream (3') transcription of a coding sequence (eg. structural gene) into mRNA. A promoter will have a transcription initiation region which is usually placed proximal to the 5' end of the coding sequence. This transcription initiation region usually includes an RNA polymerase binding site (the "TATA Box") and a transcription initiation site. A yeast promoter may also have a second domain called an upstream activator sequence (UAS), which, if present, is usually distal to the structural gene. The UAS permits regulated (inducible) expression. Constitutive expression occurs in the absence of a UAS. Regulated expression may be either positive or negative, thereby either enhancing or reducing transcription.

Yeast is a fermenting organism with an active metabolic pathway, therefore sequences encoding enzymes in the metabolic pathway provide particularly useful promoter sequences. Examples include alcohol dehydrogenase (ADH) (EP-A-0 284 044), enolase, glucokinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (EPO-A-0 329 203). The yeast PHO5 gene, encoding acid phosphatase, also provides useful promoter sequences [Myanohara et al. (1983) Proc. Natl. Acad. Sci. USA 80:1].

In addition, synthetic promoters which do not occur in nature also function as yeast promoters. For example, UAS sequences of one yeast promoter may be joined with the transcription activation region of another yeast promoter, creating a synthetic hybrid promoter. Examples of such hybrid promoters include the ADH regulatory sequence linked to the GAP transcription activation region (U.S. Pat. Nos. 4,876,197 and 4,880,734). Other examples of hybrid promoters include promoters which consist of the regulatory sequences of either the ADH2, GAL4, GAL10, OR PHO5 genes, combined with the transcriptional activation region of a glycolytic enzyme gene such as GAP or PyK (EP-A-0 164 556). Furthermore, a yeast promoter can include naturally occurring promoters of non-yeast origin that have the ability to bind yeast RNA polymerase and initiate transcription. Examples of such promoters include, inter alia, [Cohen et al. (1980) Proc. Natl. Acad. Sci. USA 77:1078; Henikoff et al. (1981) Nature 283:835; Hollenberg et al. (1981) Curr. Topics Microbiol. Immunol. 96:119; Hollenberg et al. (1979) "The Expression of Bacterial Antibiotic Resistance Genes in the Yeast Saccharomyces cerevisiae," in: Plasmids of Medical, Environmental and Commercial Importance (eds. K. N. Timmis and A. Puhler); Mercerau-Puigalon et al. (1980) Gene 11:163; Panthier et al. (1980) Curr. Genet. 2:109;].

A DNA molecule may be expressed intracellularly in yeast. A promoter sequence may be directly linked with the DNA molecule, in which case the first amino acid at the N-terminus of the recombinant protein will always be a methionine, which is encoded by the ATG start codon. If desired, methionine at the N-terminus may be cleaved from the protein by in vitro incubation with cyanogen bromide.

Fusion proteins provide an alternative for yeast expression systems, as well as in mammalian, baculovirus, and bacterial expression systems. Usually, a DNA sequence encoding the N-terminal portion of an endogenous yeast protein, or other stable protein, is fused to the 5' end of heterologous coding sequences. Upon expression, this construct will provide a fusion of the two amino acid sequences. For example, the yeast or human superoxide dismutase (SOD) gene, can be linked at the 5' terminus of a foreign gene and expressed in yeast. The DNA sequence at the junction of the two amino acid sequences may or may not encode a cleavable site. See eg. EP-A-0 196 056. Another example is a ubiquitin fusion protein. Such a fusion protein is made with the ubiquitin region that preferably retains a site for a processing enzyme (eg. ubiquitin-specific processing protease) to cleave the ubiquitin from the foreign protein. Through this method, therefore, native foreign protein can be isolated (eg. WO88/024066).

Alternatively, foreign proteins can also be secreted from the cell into the growth media by creating chimeric DNA molecules that encode a fusion protein comprised of a leader sequence fragment that provide for secretion in yeast of the foreign protein. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell.

DNA encoding suitable signal sequences can be derived from genes for secreted yeast proteins, such as the yeast invertase gene (EP-A-0 012 873; JPO. 62,096,086) and the A-factor gene (U.S. Pat. No. 4,588,684). Alternatively, leaders of non-yeast origin, such as an interferon leader, exist that also provide for secretion in yeast (EP-A-0 060 057).

A preferred class of secretion leaders are those that employ a fragment of the yeast alpha-factor gene, which contains both a "pre" signal sequence, and a "pro" region. The types of alpha-factor fragments that can be employed include the full-length pre-pro alpha factor leader (about 83 amino acid residues) as well as truncated alpha-factor leaders (usually about 25 to about 50 amino acid residues) (U.S. Pat. Nos. 4,546,083 and 4,870,008; EP-A-0 324 274). Additional leaders employing an alpha-factor leader fragment that provides for secretion include hybrid alpha-factor leaders made with a presequence of a first yeast, but a pro-region from a second yeast alphafactor. (eg. see WO 89/02463.)

Usually, transcription termination sequences recognized by yeast are regulatory regions located 3' to the translation stop codon, and thus together with the promoter flank the coding sequence. These sequences direct the transcription of an mRNA which can be translated into the polypeptide encoded by the DNA. Examples of transcription terminator sequence and other yeast-recognized termination sequences, such as those coding for glycolytic enzymes.

Usually, the above described components, comprising a promoter, leader (if desired), coding sequence of interest, and transcription termination sequence, are put together into expression constructs. Expression constructs are often maintained in a replicon, such as an extrachromosomal element (eg. plasmids) capable of stable maintenance in a host, such as yeast or bacteria. The replicon may have two replication systems, thus allowing it to be maintained, for example, in yeast for expression and in a prokaryotic host for cloning and amplification. Examples of such yeast-bacteria shuttle vectors include YEp24 [Botstein et al. (1979) Gene 8:17-24], pCl/1 [Brake et al. (1984) Proc. Natl. Acad. Sci USA 81:4642-4646], and YRp17 [Stinchcomb et al. (1982) J. Mol. Biol. 158:157]. In addition, a replicon may be either a high or low copy number plasmid. A high copy number plasmid will generally have a copy number ranging from about 5 to about 200, and usually about 10 to about 150. A host containing a high copy number plasmid will preferably have at least about 10, and more preferably at least about 20. Enter a high or low copy number vector may be selected, depending upon the effect of the vector and the foreign protein on the host. See eg. Brake et al., supra.

Alternatively, the expression constructs can be integrated into the yeast genome with an integrating vector. Integrating vectors usually contain at least one sequence homologous to a yeast chromosome that allows the vector to integrate, and preferably contain two homologous sequences flanking the expression construct. Integrations appear to result from recombinations between homologous DNA in the vector and the yeast chromosome [Orr-Weaver et al. (1983) Methods in Enzymol. 101:228-245]. An integrating vector may be directed to a specific locus in yeast by selecting the appropriate homologous sequence for inclusion in the vector. See Orr-Weaver et al., supra. One or more expression construct may integrate, possibly affecting levels of recombinant protein produced [Rine et al. (1983) Proc. Natl. Acad. Sci. USA 80:6750]. The chromosomal sequences included in the vector can occur either as a single segment in the vector, which results in the integration of the entire vector, or two segments homologous to adjacent segments in the chromosome and flanking the expression construct in the vector, which can result in the stable integration of only the expression construct.

Usually, extrachromosomal and integrating expression constructs may contain selectable markers to allow for the selection of yeast strains that have been transformed. Selectable markers may include biosynthetic genes that can be expressed in the yeast host, such as ADE2, HIS4, LEU2, TRP1, and ALG7, and the G418 resistance gene, which confer resistance in yeast cells to tunicamycin and G418, respectively. In addition, a suitable selectable marker may also provide yeast with the ability to grow in the presence of toxic compounds, such as metal. For example, the presence of CUP1 allows yeast to grow in the presence of copper ions [Butt et al. (1987) Microbiol, Rev. 51:351].

Alternatively, some of the above described components can be put together into transformation vectors. Transformation vectors are usually comprised of a selectable marker that is either maintained in a replicon or developed into an integrating vector, as described above.

Expression and transformation vectors, either extrachromosomal replicons or integrating vectors, have been developed for transformation into many yeasts. For example, expression vectors have been developed for, inter alia, the following yeasts: Candida albicans [Kurtz, et al. (1986) Mol. Cell. Biol. 6:142], Candida maltosa [Kunze, et al. (1985) J. Basic Microbiol. 25:141], Hansenula polymorpha [Gleeson, et al. (1986) J. Gen. Microbiol. 132:3459; Roggenkamp et al. (1986) Mol. Gen. Genet. 202:302], Kluyveromyces fragilis [Das, et al. (1984) J. Bacteriol. 158:1165], Kluyveromyces lactis [De Louvencourt et al. (1983) J. Bacteriol. 154:737; Van den Berg et al. (1990) Bio/Technology 8:135], Pichia guillerimondii [Kunze et al. (1985) J. Basic Microbiol. 25:141], Pichia pastoris [Cregg, et al. (1985) Mol. Cell. Biol. 5:3376; U.S. Pat. Nos. 4,837,148 and 4,929,555], Saccharomyces cerevisiae [Hinnen et al. (1978) Proc. Natl. Acad. Sci. USA 75:1929; Ito et al. (1983) J. Bacteriol. 153:163], Schizosaccharomyces pombe [Beach and Nurse (1981) Nature 300:706], and Yarrowia lipolytica [Davidow, et al. (1985) Curr. Genet. 10:380471 Gaillardin, et al. (1985) Curr. Genet. 10:49].

Methods of introducing exogenous DNA into yeast hosts are well-known in the art, and usually include either the transformation of spheroplasts or of intact yeast cells treated with alkali cations. Transformation procedures usually vary with the yeast species to be transformed. See eg. [Kurtz et al. (1986) Mol. Cell. Biol. 6:142; Kunze et al. (1985) J. Basic Microbiol. 25:141; Candida]; [Gleeson et al. (1986) J. Gen. Microbiol. 132:3459; Roggenkamp et al. (1986) Mol. Gen. Genet. 202:302; Hansenula]; [Das et al. (1984) J. Bacteriol. 158:1165; De Louvencourt et al. (1983) J. Bacteriol. 154: 1165; Van den Berg et al. (1990) Bio/Technology 8:135; Kluyveromyces]; [Cregg et al. (1985) Mol. Cell. Biol. 5:3376; Kunze et al. (1985) J. Basic Microbiol. 25:141; U.S. Pat. Nos. 4,837,148 and 4,929,555; Pichia]; [Hinnen et al. (1978) Proc. Natl. Acad. Sci. USA 75; 1929; Ito et al. (1983) J Bacteriol. 153:163 Saccharomyces]; [Beach and Nurse (1981) Nature 300:706; Schizosaccharomyces]; [Davidow et al. (1985) Curr. Genet. 10:39; Gaillardin et al. (1985) Curr. Genet. 10:49; Yarrowia].

Antibodies

As used herein, the term "antibody" refers to a polypeptide or group of polypeptides composed of at least one antibody combining site. An "antibody combining site" is the three-dimensional binding space with an internal surface shape and charge distribution complementary to the features of an epitope of an antigen, which allows a binding of the antibody with the antigen. "Antibody" includes, for example, vertebrate antibodies, hybrid antibodies, chimeric antibodies, humanised antibodies, altered antibodies, univalent antibodies, Fab proteins, and single domain antibodies.

Antibodies against the proteins of the invention are useful for affinity chromatography, immunoassays, and distinguishing/identifying streptococcus proteins.

Antibodies to the proteins of the invention, both polyclonal and monoclonal, may be prepared by conventional methods. In general, the protein is first used to immunize a suitable animal, preferably a mouse, rat, rabbit or goat. Rabbits and goats are preferred for the preparation of polyclonal sera due to the volume of serum obtainable, and the availability of labeled anti-rabbit and anti-goat antibodies. Immunization is generally performed by mixing or emulsifying the protein in saline, preferably in an adjuvant such as Freund's complete adjuvant, and injecting the mixture or emulsion parenterally (generally subcutaneously or intramuscularly). A dose of 50-200 μg/injection is typically sufficient. Immunization is generally boosted 2-6 weeks later with one or more injections of the protein in saline, preferably using Freund's incomplete adjuvant. One may alternatively generate antibodies by in vitro immunization using methods known in the art, which for the purposes of this invention is considered equivalent to in vivo immunization. Polyclonal antisera is obtained by bleeding the immunized animal into a glass or plastic container, incubating the blood at 25° C. for one hour, followed by incubating at 4° C. for 2-18 hours. The serum is recovered by centrifugation (eg. 1,000 g for 10 minutes). About 20-50 ml per bleed may be obtained from rabbits.

Monoclonal antibodies are prepared using the standard method of Kohler & Milstein [Nature (1975) 256:495-96], or a modification thereof. Typically, a mouse or rat is immunized as described above. However, rather than bleeding the animal to extract serum, the spleen (and optionally several large lymph nodes) is removed and dissociated into single cells. If desired, the spleen cells may be screened (after removal of nonspecifically adherent cells) by applying a cell suspension to a plate or well coated with the protein antigen. B-cells expressing membrane-bound immunoglobulin specific for the antigen bind to the plate, and are not rinsed away with the rest of the suspension. Resulting B-cells, or all dissociated spleen cells, are then induced to fuse with myeloma cells to form hybridomas, and are cultured in a selective medium (eg. hypoxanthine, aminopterin, thymidine medium, "HAT"). The resulting hybridomas are plated by limiting dilution, and are assayed for production of antibodies which bind specifically to the immunizing antigen (and which do not bind to unrelated antigens). The selected MAb-secreting hybridomas are then cultured either in vitro (eg. in tissue culture bottles or hollow fiber reactors), or in vivo (as ascites in mice).

If desired, the antibodies (whether polyclonal or monoclonal) may be labeled using conventional techniques. Suitable labels include fluorophores, chromophores, radioactive atoms (particularly $^{32}P$ and $^{125}I$), electron-dense reagents, enzymes, and ligands having specific binding partners. Enzymes are typically detected by their activity. For example, horseradish peroxidase is usually detected by its ability to convert 3,3',5,5'-tetramethylbenzidine (TMB) to a blue pigment, quantifiable with a spectrophotometer. "Specific binding partner" refers to a protein capable of binding a ligand molecule with high specificity, as for example in the case of an antigen and a monoclonal antibody specific therefor. Other specific binding partners include biotin and avidin or streptavidin, IgG and protein A, and the numerous receptor-ligand couples known in the art. It should be understood that the above description is not meant to categorize the various labels into distinct classes, as the same label may serve in several different modes. For example, $^{125}$I may serve as a radioactive label or as an electron-dense reagent. HRP may serve as enzyme or as antigen for a MAb. Further, one may combine various labels for desired effect. For example, MAbs and avidin also require labels in the practice of this invention: thus, one might label a MAb with biotin, and detect its presence with avidin labeled with $^{125}$I, or with an anti-biotin MAb labeled with HRP. Other permutations and possibilities will be readily apparent to those of ordinary skill in the art, and are considered as equivalents within the scope of the instant invention.

Pharmaceutical Compositions

Pharmaceutical compositions can comprise either polypeptides, antibodies, or nucleic acid of the invention. The pharmaceutical compositions will comprise a therapeutically effective amount of either polypeptides, antibodies, or polynucleotides of the claimed invention.

The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature. The precise effective amount for a subject will depend upon the subject's size and health, the nature and extent of the condition, and the therapeutics or combination of therapeutics selected for administration. Thus, it is not useful to specify an exact effective amount in advance. However, the effective amount for a given situation can be determined by routine experimentation and is within the judgement of the clinician.

For purposes of the present invention, an effective dose will be from about 0.01 mg/kg to 50 mg/kg or 0.05 mg/kg to about 10 mg/kg of the molecule of the invention in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which may be administered without undue toxicity. Suitable carriers may be large, slowly metabolized macromolecules such as proteins, polysaccharides, polylactic acids, polyglycolic acids, polymeric amino acids, amino acid copolymers, and inactive virus particles. Such carriers are well known to those of ordinary skill in the art.

Pharmaceutically acceptable salts can be used therein, for example, mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in Remington's Pharmaceutical Sciences (Mack Pub. Co., N.J. 1991).

Pharmaceutically acceptable carriers in therapeutic compositions may contain liquids such as water, saline, glycerol and ethanol. Additionally, auxiliary substances, such as wetting or emulsifying agents, pH buffering substances, and the like, may be present in such vehicles. Typically, the therapeutic compositions are prepared as injectables, either as liquid solutions or suspensions; solid forms suitable for solution in, or suspension in, liquid vehicles prior to injection may also be prepared. Liposomes are included within the definition of a pharmaceutically acceptable carrier.

Delivery Methods

Once formulated, the compositions of the invention can be administered directly to the subject. The subjects to be treated can be animals; in particular, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal or transcutaneous applications (eg. see WO98/20734), needles, and gene guns or hyposprays. Dosage treatment may be a single dose schedule or a multiple dose schedule.

Vaccines

Vaccines according to the invention may either be prophylactic (ie. to prevent infection) or therapeutic (ie. to treat disease after infection).

Such vaccines comprise immunising antigen(s), immunogen(s), polypeptide(s), protein(s) or nucleic acid, usually in combination with "pharmaceutically acceptable carriers," which include any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, lipid aggregates (such as oil droplets or liposomes), and inactive virus particles. Such carriers are well known to those of ordinary skill in the art. Additionally, these carriers may function as immunostimulating agents ("adjuvants"). Furthermore, the antigen or immunogen may be conjugated to a bacterial toxoid, such as a toxoid from diphtheria, tetanus, cholera, *H. pylori*, etc. pathogens.

Preferred adjuvants to enhance effectiveness of the composition include, but are not limited to: (1) oil-in-water emulsion formulations (with or without other specific immunostimulating agents such as muramyl peptides (see below) or bacterial cell wall components), such as for example (a) MF59™ (WO90/14837; Chapter 10 in *Vaccine Design—the subunit and adjuvant approach* (1995) ed. Powell & Newman), containing 5% squalene, 0.5% TWEEN® 80 (polyoxyethylene sorbitan monooleate), and 0.5% SPAN® 85 (sorbitan trioleate) (optionally containing MTP-PE) formulated into submicron particles using a microfluidizer, (b) SAF, containing 10% squalene, 0.4% TWEEN® 80, 5% pluronic-blocked polymer L121, and thr-MDP either microfluidized into a submicron emulsion or vortexed to generate a larger particle size emulsion, and (c) RIBI™ adjuvant system (RAS), (Ribi Immunochem, Hamilton, Mont.) containing 2% squalene, 0.2% TWEEN® 80, and one or more bacterial cell wall components from the group consisting of monophosphorylipid A (MPL), trehalose dimycolate (TDM), and cell wall skeleton (CWS), preferably MPL+CWS (DETOX™); (2) saponin adjuvants, such as QS21 or STIMULON™ (Cambridge Bioscience, Worcester, Mass.) may be used or particles generated therefrom such as ISCOMs (immunostimulating complexes), which ISCOMS may be devoid of additional detergent e.g. WO00/07621; (3) Complete Freund's Adjuvant (CFA) and Incomplete Freund's Adjuvant (IFA); (4) cytokines, such as interleukins (e.g. IL-1, IL-2, IL-4, IL-5, IL-6, IL-7, IL-12 (WO99/44636), etc.), interferons (e.g. gamma interferon), macrophage colony stimulating factor (M-CSF), tumor necrosis factor (TNF), etc.; (5) monophosphoryl lipid A (MPL) or 3-O-deacylated MPL (3dMPL)

e.g. GB-2220221, EP-A-0689454; (6) combinations of 3dMPL with, for example, QS21 and/or oil-in-water emulsions e.g. EP-A-0835318, EP-A-0735898, EP-A-0761231; (7) oligonucleotides comprising CpG motifs [Krieg *Vaccine* 2000, 19, 618-622; Krieg *Curr Opin Mol Ther* 2001 3:15-24; Roman et al., *Nat. Med.*, 1997, 3, 849-854; Weiner et al., *PNAS USA*, 1997, 94, 10833-10837; Davis et al., *J. Immunol.*, 1998, 160, 870-876; Chu et al., *J. Exp. Med.*, 1997, 186, 1623-1631; Lipford et al., *Eur. J. Immunol.*, 1997, 27, 2340-2344; Moldoveanu et al., *Vaccine*, 1988, 16, 1216-1224; Krieg et al., *Nature*, 1995, 374, 546-549; Klinman et al., *PNAS USA*, 1996, 93, 2879-2883; Ballas et al., *J. Immunol.*, 1996, 157, 1840-1845; Cowdery et al., *J. Immunol.*, 1996, 156, 4570-4575; Halpern et al., *Cell. Immunol.*, 1996, 167, 72-78; Yamamoto et al., *Jpn. J. Cancer Res.*, 1988, 79, 866-873; Stacey et al., *J. Immunol.*, 1996, 157, 2116-2122; Messina et al., *J. Immunol.*, 1991, 147, 1759-1764; Yi et al., *J. Immunol.*, 1996, 157, 4918-4925; Yi et al., *J. Immunol.*, 1996, 157, 5394-5402; Yi et al., *J. Immunol.*, 1998, 160, 4755-4761; and Yi et al., *J. Immunol.*, 1998, 160, 5898-5906; International patent applications WO96/02555, WO98/16247, WO98/18810, WO98/40100, WO98/55495, WO98/37919 and WO98/52581] i.e. containing at least one CG dinucleotide, with 5-methylcytosine optionally being used in place of cytosine; (8) a polyoxyethylene ether or a polyoxyethylene ester e.g. WO99/52549; (9) a polyoxyethylene sorbitan ester surfactant in combination with an octoxynol (e.g. WO01/21207) or a polyoxyethylene alkyl ether or ester surfactant in combination with at least one additional non-ionic surfactant such as an octoxynol (e.g. WO01/21152); (10) an immunostimulatory oligonucleotide (e.g. a CpG oligonucleotide) and a saponin e.g. WO00/62800; (11) an immunostimulant and a particle of metal salt e.g. WO00/23105; (12) a saponin and an oil-in-water emulsion e.g. WO99/11241; (13) a saponin (e.g. QS21)+3dMPL+IL-12 (optionally +a sterol) e.g. WO98/57659; (14) aluminium salts, preferably hydroxide or phosphate, but any other suitable salt may also be used (e.g. hydroxyphosphate, oxyhydroxide, orthophosphate, sulphate etc. [e.g. see chapters 8 & 9 of Powell & Newman]). Mixtures of different aluminium salts may also be used. The salt may take any suitable form (e.g. gel, crystalline, amorphous etc.); (15) other substances that act as immunostimulating agents to enhance the efficacy of the composition. Aluminium salts and/or MF59™ are preferred.

As mentioned above, muramyl peptides include, but are not limited to, N-acetyl-muramyl-L-threonyl-D-isoglutamine (thr-MDP), N-acetyl-normuramyl-L-alanyl-D-isoglutamine (nor-MDP), N-acetylmuramyl-L-alanyl-D-isoglutaminyl-L-alanine-2-(1'-2'-dipalmitoyl-sn-glycero-3-hydroxyphos-phoryloxy)-ethylamine (MTP-PE), etc.

The immunogenic compositions (eg the immunising antigen/immunogen/polypeptide/protein/nucleic acid, pharmaceutically acceptable carrier, and adjuvant) typically will contain diluents, such as water, saline, glycerol, ethanol, etc. Additionally, auxiliary substances, such as wetting or emulsifying agents, pH buffering substances, and the like, may be present in such vehicles.

Typically, the immunogenic compositions are prepared as injectables, either as liquid solutions or suspensions; solid forms suitable for solution in, or suspension in, liquid vehicles prior to injection may also be prepared. The preparation also may be emulsified or encapsulated in liposomes for enhanced adjuvant effect, as discussed above under pharmaceutically acceptable carriers.

Immunogenic compositions used as vaccines comprise an immunologically effective amount of the antigenic or immunogenic polypeptides, as well as any other of the above-mentioned components, as needed. By "immunologically effective amount", it is meant that the administration of that amount to an individual, either in a single dose or as part of a series, is effective for treatment or prevention. This amount varies depending upon the health and physical condition of the individual to be treated, the taxonomic group of individual to be treated (eg. nonhuman primate, primate, etc.), the capacity of the individual's immune system to synthesize antibodies, the degree of protection desired, the formulation of the vaccine, the treating doctor's assessment of the medical situation, and other relevant factors. It is expected that the amount will fall in a relatively broad range that can be determined through routine trials.

The immunogenic compositions are conventionally administered parenterally, eg. by injection, either subcutaneously, intramuscularly, or transdermally/transcutaneously (eg. WO98/20734). Additional formulations suitable for other modes of administration include oral and pulmonary formulations, suppositories, and transdermal applications. Dosage treatment may be a single dose schedule or a multiple dose schedule. The vaccine may be administered in conjunction with other immunoregulatory agents.

As an alternative to protein-based vaccines, DNA vaccination may be used [eg. Robinson & Torres (1997) *Seminars in Immunol* 9:271-283; Donnelly et al. (1997) *Annu Rev Immunol* 15:617-648; later herein].

Gene Delivery Vehicles

Gene therapy vehicles for delivery of constructs including a coding sequence of a therapeutic of the invention, to be delivered to the mammal for expression in the mammal, can be administered either locally or systemically. These constructs can utilize viral or non-viral vector approaches in in vivo or ex vivo modality. Expression of such coding sequence can be induced using endogenous mammalian or heterologous promoters. Expression of the coding sequence in vivo can be either constitutive or regulated.

The invention includes gene delivery vehicles capable of expressing the contemplated nucleic acid sequences. The gene delivery vehicle is preferably a viral vector and, more preferably, a retroviral, adenoviral, adeno-associated viral (AAV), herpes viral, or alphavirus vector. The viral vector can also be an astrovirus, coronavirus, orthomyxovirus, papovavirus, paramyxovirus, parvovirus, picornavirus, poxvirus, or togavirus viral vector. See generally, Jolly (1994) *Cancer Gene Therapy* 1:51-64; Kimura (1994) *Human Gene Therapy* 5:845-852; Connelly (1995) *Human Gene Therapy* 6:185-193; and Kaplitt (1994) *Nature Genetics* 6:148-153.

Retroviral vectors are well known in the art and we contemplate that any retroviral gene therapy vector is employable in the invention, including B, C and D type retroviruses, xenotropic retroviruses (for example, NZB-X1, NZB-X2 and NZB9-1 (see O'Neill (1985) *J. Virol.* 53:160) polytropic retroviruses eg. MCF and MCF-MLV (see Kelly (1983) *J. Virol.* 45:291), spumaviruses and lentiviruses. See RNA Tumor Viruses, Second Edition, Cold Spring Harbor Laboratory, 1985.

Portions of the retroviral gene therapy vector may be derived from different retroviruses. For example, retrovector LTRs may be derived from a Murine Sarcoma Virus, a tRNA binding site from a Rous Sarcoma Virus, a packaging signal from a Murine Leukemia Virus, and an origin of second strand synthesis from an Avian Leukosis Virus.

These recombinant retroviral vectors may be used to generate transduction competent retroviral vector particles by introducing them into appropriate packaging cell lines (see U.S. Pat. No. 5,591,624). Retrovirus vectors can be constructed for site-specific integration into host cell DNA by incorporation of a chimeric integrase enzyme into the retroviral particle (see WO96/37626). It is preferable that the recombinant viral vector is a replication defective recombinant virus.

Packaging cell lines suitable for use with the above-described retrovirus vectors are well known in the art, are readily prepared (see WO95/30763 and WO92/05266), and can be used to create producer cell lines (also termed vector cell lines or "VCLs") for the production of recombinant vector particles. Preferably, the packaging cell lines are made from human parent cells (eg. HT1080 cells) or mink parent cell lines, which eliminates inactivation in human serum.

Preferred retroviruses for the construction of retroviral gene therapy vectors include Avian Leukosis Virus, Bovine Leukemia, Virus, Murine Leukemia Virus, Mink-Cell Focus-Inducing Virus, Murine Sarcoma Virus, Reticuloendotheliosis Virus and Rous Sarcoma Virus. Particularly preferred Murine Leukemia Viruses include 4070A and 1504A (Hartley and Rowe (1976) *J Virol* 19:19-25), Abelson (ATCC No. VR-999), Friend (ATCC No. VR-245), Graffi, Gross (ATCC Nol VR-590), Kirsten, Harvey Sarcoma Virus and Rauscher (ATCC No. VR-998) and Moloney Murine Leukemia Virus (ATCC No. VR-190). Such retroviruses may be obtained from depositories or collections such as the American Type Culture Collection ("ATCC") in Rockville, Md. or isolated from known sources using commonly available techniques.

Exemplary known retroviral gene therapy vectors employable in this invention include those described in patent applications GB2200651, EP0415731, EP0345242, EP0334301, WO89/02468; WO89/05349, WO89/09271, WO90/02806, WO90/07936, WO94/03622, W093/25698, WO93/25234, WO93/11230, WO93/10218, WO91/02805, WO91/02825, WO95/07994, U.S. Pat. Nos. 5,219,740, 4,405,712, 4,861, 719, 4,980,289, 4,777,127, 5,591,624. See also Vile (1993) *Cancer Res* 53:3860-3864; Vile (1993) *Cancer Res* 53:962-967; Ram (1993) *Cancer Res* 53 (1993) 83-88; Takamiya (1992) *J Neurosci Res* 33:493-503; Baba (1993) *J Neurosurg* 79:729-735; Mann (1983) *Cell* 33:153; Cane (1984) *Proc Natl Acad Sci* 81:6349; and Miller (1990) *Human Gene Therapy* 1.

Human adenoviral gene therapy vectors are also known in the art and employable in this invention. See, for example, Berkner (1988) *Biotechniques* 6:616 and Rosenfeld (1991) *Science* 252:431, and WO93/07283, WO93/06223, and WO93/07282. Exemplary known adenoviral gene therapy vectors employable in this invention include those described in the above referenced documents and in WO94/12649, WO93/03769, WO93/19191, WO94/28938, WO95/11984, WO95/00655, WO95/27071, WO95/29993, WO95/34671, WO96/05320, WO94/08026, WO94/11506, WO93/06223, WO94/24299, WO95/14102, WO95/24297, W095/02697, WO94/28152, WO94/24299, WO95/09241, WO95/25807, WO95/05835, WO94/18922 and WO95/09654. Alternatively, administration of DNA linked to killed adenovirus as described in Curiel (1992) *Hum. Gene Ther.* 3:147-154 may be employed. The gene delivery vehicles of the invention also include adenovirus associated virus (AAV) vectors. Leading and preferred examples of such vectors for use in this invention are the AAV-2 based vectors disclosed in Srivastava, WO93/09239. Most preferred AAV vectors comprise the two AAV inverted terminal repeats in which the native D-sequences are modified by substitution of nucleotides, such that at least 5 native nucleotides and up to 18 native nucleotides, preferably at least 10 native nucleotides up to 18 native nucleotides, most preferably 10 native nucleotides are retained and the remaining nucleotides of the D-sequence are deleted or replaced with non-native nucleotides. The native D-sequences of the AAV inverted terminal repeats are sequences of 20 consecutive nucleotides in each AAV inverted terminal repeat (ie. there is one sequence at each end) which are not involved in HP formation. The non-native replacement nucleotide may be any nucleotide other than the nucleotide found in the native D-sequence in the same position. Other employable exemplary AAV vectors are pWP-19, pWN-1, both of which are disclosed in Nahreini (1993) *Gene* 124:257-262. Another example of such an AAV vector is psub201 (see Samulski (1987) *J. Virol.* 61:3096). Another exemplary AAV vector is the Double-D ITR vector. Construction of the Double-D ITR vector is disclosed in U.S. Pat. No. 5,478,745. Still other vectors are those disclosed in Carter U.S. Pat. No. 4,797,368 and Muzyczka U.S. Pat. No. 5,139,941, Chartejee U.S. Pat. No. 5,474,935, and Kotin WO94/288157. Yet a further example of an AAV vector employable in this invention is SSV9AFABTKneo, which contains the AFP enhancer and albumin promoter and directs expression predominantly in the liver. Its structure and construction are disclosed in Su (1996) *Human Gene Therapy* 7:463-470. Additional AAV gene therapy vectors are described in U.S. Pat. Nos. 5,354, 678, 5,173,414, 5,139,941, and 5,252,479.

The gene therapy vectors of the invention also include herpes vectors. Leading and preferred examples are herpes simplex virus vectors containing a sequence encoding a thymidine kinase polypeptide such as those disclosed in U.S. Pat. No. 5,288,641 and EP0176170 (Roizman). Additional exemplary herpes simplex virus vectors include HFEM/ICP6-LacZ disclosed in WO95/04139 (Wistar Institute), pHSVlac described in Geller (1988) *Science* 241:1667-1669 and in WO90/09441 and WO92/07945, HSV Us3::pgC-lacZ described in Fink (1992) *Human Gene Therapy* 3:11-19 and HSV 7134, 2 RH 105 and GAL4 described in EP 0453242 (Breakefield), and those deposited with the ATCC with accession numbers VR-977 and VR-260.

Also contemplated are alpha virus gene therapy vectors that can be employed in this invention. Preferred alpha virus vectors are Sindbis viruses vectors. Togaviruses, Semliki Forest virus (ATCC VR-67; ATCC VR-1247), Middleberg virus (ATCC VR-370), Ross River virus (ATCC VR-373; ATCC VR-1246), Venezuelan equine encephalitis virus (ATCC VR923; ATCC VR-1250; ATCC VR-1249; ATCC VR-532), and those described in U.S. Pat. Nos. 5,091,309, 5,217,879, and WO92/10578. More particularly, those alpha virus vectors described in U.S. Ser. No. 08/405,627, filed Mar. 15, 1995, WO94/21792, WO92/10578, WO95/07994, U.S. Pat. Nos. 5,091,309 and 5,217,879 are employable. Such alpha viruses may be obtained from depositories or collections such as the ATCC in Rockville, Md. or isolated from known sources using commonly available techniques. Preferably, alphavirus vectors with reduced cytotoxicity are used (see U.S. Ser. No. 08/679,640).

DNA vector systems such as eukaryotic layered expression systems are also useful for expressing the nucleic acids of the invention. See WO95/07994 for a detailed description of eukaryotic layered expression systems. Preferably, the eukaryotic layered expression systems of the invention are derived from alphavirus vectors and most preferably from Sindbis viral vectors.

Other viral vectors suitable for use in the present invention include those derived from poliovirus, for example ATCC VR-58 and those described in Evans, *Nature* 339 (1989) 385 and Sabin (1973) *J. Biol. Standardization* 1:115; rhinovirus, for example ATCC VR-1110 and those described in Arnold (1990) *J Cell Biochem* L401; pox viruses such as canary pox virus or vaccinia virus, for example ATCC VR-111 and ATCC VR-2010 and those described in Fisher-Hoch (1989) *Proc*

*Natl Acad Sci* 86:317; Flexner (1989) *Ann NY Acad Sci* 569: 86, Flexner (1990) *Vaccine* 8:17; in U.S. Pat. Nos. 4,603,112 and 4,769,330 and WO89/01973; SV40 virus, for example ATCC VR-305 and those described in Mulligan (1979) *Nature* 277:108 and Madzak (1992) *J Gen Virol* 73:1533; influenza virus, for example ATCC VR-797 and recombinant influenza viruses made employing reverse genetics techniques as described in U.S. Pat. No. 5,166,057 and in Enami (1990) *Proc Natl Acad Sci* 87:3802-3805; Enami & Palese (1991) *J Virol* 65:2711-2713 and Luytjes (1989) *Cell* 59:110, (see also McMichael (1983) *NEJ Med* 309:13, and Yap (1978) *Nature* 273:238 and *Nature* (1979) 277:108); human immunodeficiency virus as described in EP-0386882 and in Buchschacher (1992) *J. Virol.* 66:2731; measles virus, for example ATCC VR-67 and VR-1247 and those described in EP-0440219; Aura virus, for example ATCC VR-368; Bebaru virus, for example ATCC VR-600 and ATCC VR-1240; Cabassou virus, for example ATCC VR-922; Chikungunya virus, for example ATCC VR-64 and ATCC VR-1241; Fort Morgan Virus, for example ATCC VR-924; Getah virus, for example ATCC VR-369 and ATCC VR-1243; Kyzylagach virus, for example ATCC VR-927; Mayaro virus, for example ATCC VR-66; Mucambo virus, for example ATCC VR-580 and ATCC VR-1244; Ndumu virus, for example ATCC VR-371; Pixuna virus, for example ATCC VR-372 and ATCC VR-1245; Tonate virus, for example ATCC VR-925; Triniti virus, for example ATCC VR-469; Una virus, for example ATCC VR-374; Whataroa virus, for example ATCC VR-926; Y-62-33 virus, for example ATCC VR-375; O'Nyong virus, Eastern encephalitis virus, for example ATCC VR-65 and ATCC VR-1242; Western encephalitis virus, for example ATCC VR-70, ATCC VR-1251, ATCC VR-622 and ATCC VR-1252; and coronavirus, for example ATCC VR-740 and those described in Hamre (1966) *Proc Soc Exp Biol Med* 121:190.

Delivery of the compositions of this invention into cells is not limited to the above mentioned viral vectors. Other delivery methods and media may be employed such as, for example, nucleic acid expression vectors, polycationic condensed DNA linked or unlinked to killed adenovirus alone, for example see U.S. Ser. No. 08/366,787, filed Dec. 30, 1994 and Curiel (1992) *Hum Gene Ther* 3:147-154 ligand linked DNA, for example see Wu (1989) *J Biol Chem* 264:16985-16987, eucaryotic cell delivery vehicles cells, for example see U.S. Ser. No. 08/240,030, filed May 9, 1994, and U.S. Ser. No. 08/404,796, deposition of photopolymerized hydrogel materials, hand-held gene transfer particle gun, as described in U.S. Pat. No. 5,149,655, ionizing radiation as described in U.S. Pat. No. 5,206,152 and in WO92/11033, nucleic charge neutralization or fusion with cell membranes. Additional approaches are described in Philip (1994) *Mol Cell Biol* 14:2411-2418 and in Woffendin (1994) *Proc Natl Acad Sci* 91:1581-1585.

Particle mediated gene transfer may be employed, for example see U.S. Ser. No. 60/023,867. Briefly, the sequence can be inserted into conventional vectors that contain conventional control sequences for high level expression, and then incubated with synthetic gene transfer molecules such as polymeric DNA-binding cations like polylysine, protamine, and albumin, linked to cell targeting ligands such as asialoorosomucoid, as described in Wu & Wu (1987) *J. Biol. Chem.* 262:4429-4432, insulin as described in Hucked (1990) *Biochem Pharmacol* 40:253-263, galactose as described in Plank (1992) *Bioconjugate Chem* 3:533-539, lactose or transferrin.

Naked DNA may also be employed. Exemplary naked DNA introduction methods are described in WO 90/11092 and U.S. Pat. No. 5,580,859. Uptake efficiency may be improved using biodegradable latex beads. DNA coated latex beads are efficiently transported into cells after endocytosis initiation by the beads. The method may be improved further by treatment of the beads to increase hydrophobicity and thereby facilitate disruption of the endosome and release of the DNA into the cytoplasm.

Liposomes that can act as gene delivery vehicles are described in U.S. Pat. No. 5,422,120, WO95/13796, WO94/23697, WO91/14445 and EP-524,968. As described in U.S. Ser. No. 60/023,867, on non-viral delivery, the nucleic acid sequences encoding a polypeptide can be inserted into conventional vectors that contain conventional control sequences for high level expression, and then be incubated with synthetic gene transfer molecules such as polymeric DNA-binding cations like polylysine, protamine, and albumin, linked to cell targeting ligands such as asialoorosomucoid, insulin, galactose, lactose, or transferrin. Other delivery systems include the use of liposomes to encapsulate DNA comprising the gene under the control of a variety of tissue-specific or ubiquitously-active promoters. Further non-viral delivery suitable for use includes mechanical delivery systems such as the approach described in Woffendin et al (1994) *Proc. Natl. Acad. Sci. USA* 91(24): 11581-11585. Moreover, the coding sequence and the product of expression of such can be delivered through deposition of photopolymerized hydrogel materials. Other conventional methods for gene delivery that can be used for delivery of the coding sequence include, for example, use of hand-held gene transfer particle gun, as described in U.S. Pat. No. 5,149,655; use of ionizing radiation for activating transferred gene, as described in U.S. Pat. No. 5,206,152 and WO92/11033

Exemplary liposome and polycationic gene delivery vehicles are those described in U.S. Pat. Nos. 5,422,120 and 4,762,915; in WO 95/13796; WO94/23697; and WO91/14445; in EP-0524968; and in Stryer, Biochemistry, pages 236-240 (1975) W. H. Freeman, San Francisco; Szoka (1980) *Biochem Biophys Acta* 600:1; Bayer (1979) *Biochem Biophys Acta* 550:464; Rivnay (1987) *Meth Enzymol* 149:119; Wang (1987) *Proc Natl Acad Sci* 84:7851; Plant (1989) *Anal Biochem* 176:420.

A polynucleotide composition can comprises therapeutically effective amount of a gene therapy vehicle, as the term is defined above. For purposes of the present invention, an effective dose will be from about 0.01 mg/kg to 50 mg/kg or 0.05 mg/kg to about 10 mg/kg of the DNA constructs in the individual to which it is administered.

Delivery Methods

Once formulated, the polynucleotide compositions of the invention can be administered (1) directly to the subject; (2) delivered ex vivo, to cells derived from the subject; or (3) in vitro for expression of recombinant proteins. The subjects to be treated can be mammals or birds. Also, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal or transcutaneous applications (eg. see WO98/20734), needles, and gene guns or hyposprays. Dosage treatment may be a single dose schedule or a multiple dose schedule.

Methods for the ex vivo delivery and reimplantation of transformed cells into a subject are known in the art and described in eg. WO93/14778. Examples of cells useful in ex vivo applications include, for example, stem cells, particularly hematopoetic, lymph cells, macrophages, dendritic cells, or tumor cells.

Generally, delivery of nucleic acids for both ex vivo and in vitro applications can be accomplished by the following procedures, for example, dextran-mediated transfection, calcium phosphate precipitation, polybrene mediated transfection, protoplast fusion, electroporation, encapsulation of the polynucleotide(s) in liposomes, and direct microinjection of the DNA into nuclei, all well known in the art.

Polynucleotide and Polypeptide Pharmaceutical Compositions

In addition to the pharmaceutically acceptable carriers and salts described above, the following additional agents can be used with polynucleotide and/or polypeptide compositions.

A. Polypeptides

One example are polypeptides which include, without limitation: asioloorosomucoid (ASOR); transferrin; asialoglycoproteins; antibodies; antibody fragments; ferritin; interleukins; interferons, granulocyte, macrophage colony stimulating factor (GM-CSF), granulocyte colony stimulating factor (G-CSF), macrophage colony stimulating factor (M-CSF), stem cell factor and erythropoietin. Viral antigens, such as envelope proteins, can also be used. Also, proteins from other invasive organisms, such as the 17 amino acid peptide from the circumsporozoite protein of plasmodium falciparum known as RII.

B. Hormones, Vitamins, Etc.

Other groups that can be included are, for example: hormones, steroids, androgens, estrogens, thyroid hormone, or vitamins, folic acid.

C. Polyalkalenes, Polysaccharides, Etc.

Also, polyalkylene glycol can be included with the desired polynucleotides/polypeptides. In a preferred embodiment, the polyalkylene glycol is polyethlylene glycol. In addition, mono-, di-, or polysaccharides can be included. In a preferred embodiment of this aspect, the polysaccharide is dextran or DEAE-dextran. Also, chitosan and poly(lactide-co-glycolide)

D. Lipids, and Liposomes

The desired polynucleotide/polypeptide can also be encapsulated in lipids or packaged in liposomes prior to delivery to the subject or to cells derived therefrom.

Lipid encapsulation is generally accomplished using liposomes which are able to stably bind or entrap and retain nucleic acid. The ratio of condensed polynucleotide to lipid preparation can vary but will generally be around 1:1 (mg DNA:micromoles lipid), or more of lipid. For a review of the use of liposomes as carriers for delivery of nucleic acids, see, Hug and Sleight (1991) Biochim. Biophys. Acta. 1097:1-17; Straubinger (1983) Meth. Enzymol. 101:512-527.

Liposomal preparations for use in the present invention include cationic (positively charged), anionic (negatively charged) and neutral preparations. Cationic liposomes have been shown to mediate intracellular delivery of plasmid DNA (Felgner (1987) Proc. Natl. Acad. Sci. USA 84:7413-7416); mRNA (Malone (1989) Proc. Natl. Acad. Sci. USA 86:6077-6081); and purified transcription factors (Debs (1990) J. Biol. Chem. 265:10189-10192), in functional form.

Cationic liposomes are readily available. For example, N[1-2,3-dioleyloxy)propyl]-N,N,N-triethyl-ammonium (DOTMA) liposomes are available under the trademark Lipofectin, from GIBCO BRL, Grand Island, N.Y. (See, also, Felgner supra). Other commercially available liposomes include transfectace (DDAB/DOPE) and DOTAP/DOPE (Boerhinger). Other cationic liposomes can be prepared from readily available materials using techniques well known in the art. See, eg. Szoka (1978 Proc. Natl. Acad. Sci. USA 75:4194-4198; WO90/11092 for a description of the synthesis of DOTAP (1,2-bis(oleoyloxy)-3-(trimethylammonio) propane) liposomes.

Similarly, anionic and neutral liposomes are readily available, such as from Avanti Polar Lipids (Birmingham, Ala.), or can be easily prepared using readily available materials. Such materials include phosphatidyl choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

The liposomes can comprise multilammelar vesicles (MLVs), small unilamellar vesicles (SUVs), or large unilamellar vesicles (LUVs). The various liposome-nucleic acid complexes are prepared using methods known in the art. See eg. Straubinger (1983) Meth. Immunol. 101:512-527; Szoka (1978) Proc. Natl. Acad. Sci. USA 75:4194-4198; Papahadjopoulos (1975) Biochim. Biophys. Acta 394:483; Wilson (1979) Cell 17:77); Deamer & Bangham (1976) Biochim. Biophys. Acta 443:629; Ostro (1977) Biochem. Biophys. Res. Commun. 76:836; Fraley (1979) Proc. Natl. Acad. Sci. USA 76:3348); Enoch & Strittmatter (1979) Proc. Natl. Acad. Sci. USA 76:145; Fraley (1980) J. Biol. Chem. (1980) 255:10431; Szoka & Papahadjopoulos (1978) Proc. Natl. Acad. Sci. USA 75:145; and Schaefer-Ridder (1982) Science 215:166.

E. Lipoproteins

In addition, lipoproteins can be included with the polynucleotide/polypeptide to be delivered. Examples of lipoproteins to be utilized include: chylomicrons, HDL, IDL, LDL, and VLDL. Mutants, fragments, or fusions of these proteins can also be used. Also, modifications of naturally occurring lipoproteins can be used, such as acetylated LDL. These lipoproteins can target the delivery of polynucleotides to cells expressing lipoprotein receptors. Preferably, if lipoproteins are including with the polynucleotide to be delivered, no other targeting ligand is included in the composition.

Naturally occurring lipoproteins comprise a lipid and a protein portion. The protein portion are known as apoproteins. At the present, apoproteins A, B, C, D, and E have been isolated and identified. At least two of these contain several proteins, designated by Roman numerals, AI, AII, AIV; CI, CII, CIII.

A lipoprotein can comprise more than one apoprotein. For example, naturally occurring chylomicrons comprises of A, B, C & E, over time these lipoproteins lose A and acquire C & E. VLDL comprises A, B, C & E apoproteins, LDL comprises apoprotein B; and HDL comprises apoproteins A, C, & E.

The amino acid of these apoproteins are known and are described in, for example, Breslow (1985) Annu Rev. Biochem 54:699; Law (1986) Adv. Exp Med. Biol. 151:162; Chen (1986) J Biol Chem 261:12918; Kane (1980) Proc Natl Acad Sci USA 77:2465; and Utermann (1984) Hum Genet 65:232.

Lipoproteins contain a variety of lipids including, triglycerides, cholesterol (free and esters), and phospholipids. The composition of the lipids varies in naturally occurring lipoproteins. For example, chylomicrons comprise mainly triglycerides. A more detailed description of the lipid content of naturally occurring lipoproteins can be found, for example, in Meth. Enzymol. 128 (1986). The composition of the lipids are chosen to aid in conformation of the apoprotein for receptor binding activity. The composition of lipids can also be chosen to facilitate hydrophobic interaction and association with the polynucleotide binding molecule.

Naturally occurring lipoproteins can be isolated from serum by ultracentrifugation, for instance. Such methods are described in *Meth. Enzymol.* (supra); Pitas (1980) *J. Biochem.* 255:5454-5460 and Mahey (1979) *J Clin. Invest* 64:743-750. Lipoproteins can also be produced by in vitro or recombinant methods by expression of the apoprotein genes in a desired host cell. See, for example, Atkinson (1986) *Annu Rev Biophys Chem* 15:403 and Radding (1958) *Biochim Biophys Acta* 30: 443. Lipoproteins can also be purchased from commercial suppliers, such as Biomedical Technologies, Inc., Stoughton, Mass., USA. Further description of lipoproteins can be found in WO98/06437.

F. Polycationic Agents

Polycationic agents can be included, with or without lipoprotein, in a composition with the desired polynucleotide/polypeptide to be delivered.

Polycationic agents, typically, exhibit a net positive charge at physiological relevant pH and are capable of neutralizing the electrical charge of nucleic acids to facilitate delivery to a desired location. These agents have both in vitro, ex vivo, and in vivo applications. Polycationic agents can be used to deliver nucleic acids to a living subject either intramuscularly, subcutaneously, etc.

The following are examples of useful polypeptides as polycationic agents: polylysine, polyarginine, polyornithine, and protamine. Other examples include histones, protamines, human serum albumin, DNA binding proteins, non-histone chromosomal proteins, coat proteins from DNA viruses, such as (X174, transcriptional factors also contain domains that bind DNA and therefore may be useful as nucleic aid condensing agents. Briefly, transcriptional factors such as C/CEBP, c-jun, c-fos, AP-1, AP-2, AP-3, CPF, Prot-1, Sp-1, Oct-1, Oct-2, CREP, and TFIID contain basic domains that bind DNA sequences.

Organic polycationic agents include: spermine, spermidine, and purtrescine.

The dimensions and of the physical properties of a polycationic agent can be extrapolated from the list above, to construct other polypeptide polycationic agents or to produce synthetic polycationic agents.

Synthetic polycationic agents which are useful include, for example, DEAE-dextran, polybrene. Lipofectin™, and LIPOFECTAMINE™ are monomers that form polycationic complexes when combined with polynucleotides/polypeptides.

Immunodiagnostic Assays

Streptococcus antigens of the invention can be used in immunoassays to detect antibody levels (or, conversely, anti-streptococcus antibodies can be used to detect antigen levels). Immunoassays based on well defined, recombinant antigens can be developed to replace invasive diagnostics methods. Antibodies to streptococcus proteins within biological samples, including for example, blood or serum samples, can be detected. Design of the immunoassays is subject to a great deal of variation, and a variety of these are known in the art. Protocols for the immunoassay may be based, for example, upon competition, or direct reaction, or sandwich type assays. Protocols may also, for example, use solid supports, or may be by immunoprecipitation. Most assays involve the use of labeled antibody or polypeptide; the labels may be, for example, fluorescent, chemiluminescent, radioactive, or dye molecules. Assays which amplify the signals from the probe are also known; examples of which are assays which utilize biotin and avidin, and enzyme-labeled and mediated immunoassays, such as ELISA assays.

Kits suitable for immunodiagnosis and containing the appropriate labeled reagents are constructed by packaging the appropriate materials, including the compositions of the invention, in suitable containers, along with the remaining reagents and materials (for example, suitable buffers, salt solutions, etc.) required for the conduct of the assay, as well as suitable set of assay instructions.

Nucleic Acid Hybridisation

"Hybridization" refers to the association of two nucleic acid sequences to one another by hydrogen bonding. Typically, one sequence will be fixed to a solid support and the other will be free in solution. Then, the two sequences will be placed in contact with one another under conditions that favor hydrogen bonding. Factors that affect this bonding include: the type and volume of solvent; reaction temperature; time of hybridization; agitation; agents to block the non-specific attachment of the liquid phase sequence to the solid support (Denhardt's reagent or BLOTTO); concentration of the sequences; use of compounds to increase the rate of association of sequences (dextran sulfate or polyethylene glycol); and the stringency of the washing conditions following hybridization. See Sambrook et al. [supra] Volume 2, chapter 9, pages 9.47 to 9.57.

"Stringency" refers to conditions in a hybridization reaction that favor association of very similar sequences over sequences that differ. For example, the combination of temperature and salt concentration should be chosen that is approximately 120 to 200° C. below the calculated Tm of the hybrid under study. The temperature and salt conditions can often be determined empirically in preliminary experiments in which samples of genomic DNA immobilized on filters are hybridized to the sequence of interest and then washed under conditions of different stringencies. See Sambrook et al. at page 9.50.

Variables to consider when performing, for example, a Southern blot are (1) the complexity of the DNA being blotted and (2) the homology between the probe and the sequences being detected. The total amount of the fragment(s) to be studied can vary a magnitude of 10, from 0.1 to 1 µg for a plasmid or phage digest to $10^{-9}$ to $10^{-8}$ g for a single copy gene in a highly complex eukaryotic genome. For lower complexity polynucleotides, substantially shorter blotting, hybridization, and exposure times, a smaller amount of starting polynucleotides, and lower specific activity of probes can be used. For example, a single-copy yeast gene can be detected with an exposure time of only 1 hour starting with 1 µg of yeast DNA, blotting for two hours, and hybridizing for 4-8 hours with a probe of $10^8$ cpm/µg. For a single-copy mammalian gene a conservative approach would start with 10 µg of DNA, blot overnight, and hybridize overnight in the presence of 10% dextran sulfate using a probe of greater than $10^8$ cpm/µg, resulting in an exposure time of ~24 hours.

Several factors can affect the melting temperature (Tm) of a DNA-DNA hybrid between the probe and the fragment of interest, and consequently, the appropriate conditions for hybridization and washing. In many cases the probe is not 100% homologous to the fragment. Other commonly encountered variables include the length and total G+C content of the hybridizing sequences and the ionic strength and formamide content of the hybridization buffer. The effects of all of these factors can be approximated by a single equation:

$$Tm=81+16.6(\log_{10} Ci)+0.4[\%(G+C)]-0.6(\% \text{ formamide})-600/n-1.5(\% \text{ mismatch}).$$

where Ci is the salt concentration (monovalent ions) and n is the length of the hybrid in base pairs (slightly modified from Meinkoth & Wahl (1984) *Anal. Biochem.* 138: 267-284).

In designing a hybridization experiment, some factors affecting nucleic acid hybridization can be conveniently altered. The temperature of the hybridization and washes and the salt concentration during the washes are the simplest to adjust. As the temperature of the hybridization increases (ie. stringency), it becomes less likely for hybridization to occur between strands that are nonhomologous, and as a result, background decreases. If the radiolabeled probe is not completely homologous with the immobilized fragment (as is frequently the case in gene family and interspecies hybridization experiments), the hybridization temperature must be reduced, and background will increase. The temperature of the washes affects the intensity of the hybridizing band and the degree of background in a similar manner. The stringency of the washes is also increased with decreasing salt concentrations.

In general, convenient hybridization temperatures in the presence of 50% formamide are 42° C. for a probe with is 95% to 100% homologous to the target fragment, 37° C. for 90% to 95% homology, and 32° C. for 85% to 90% homology. For lower homologies, formamide content should be lowered and temperature adjusted accordingly, using the equation above. If the homology between the probe and the target fragment are not known, the simplest approach is to start with both hybridization and wash conditions which are nonstringent. If non-specific bands or high background are observed after autoradiography, the filter can be washed at high stringency and reexposed. If the time required for exposure makes this approach impractical, several hybridization and/or washing stringencies should be tested in parallel.

Nucleic Acid Probe Assays

Methods such as PCR, branched DNA probe assays, or blotting techniques utilizing nucleic acid probes according to the invention can determine the presence of cDNA or mRNA. A probe is said to "hybridize" with a sequence of the invention if it can form a duplex or double stranded complex, which is stable enough to be detected.

The nucleic acid probes will hybridize to the streptococcus nucleotide sequences of the invention (including both sense and antisense strands). Though many different nucleotide sequences will encode the amino acid sequence, the native streptococcus sequence is preferred because it is the actual sequence present in cells. mRNA represents a coding sequence and so a probe should be complementary to the coding sequence; single-stranded cDNA is complementary to mRNA, and so a cDNA probe should be complementary to the non-coding sequence.

The probe sequence need not be identical to the streptococcus sequence (or its complement)—some variation in the sequence and length can lead to increased assay sensitivity if the nucleic acid probe can form a duplex with target nucleotides, which can be detected. Also, the nucleic acid probe can include additional nucleotides to stabilize the formed duplex. Additional streptococcus sequence may also be helpful as a label to detect the formed duplex. For example, a non-complementary nucleotide sequence may be attached to the 5' end of the probe, with the remainder of the probe sequence being complementary to a streptococcus sequence. Alternatively, non-complementary bases or longer sequences can be interspersed into the probe, provided that the probe sequence has sufficient complementarity with the a streptococcus sequence in order to hybridize therewith and thereby form a duplex which can be detected.

The exact length and sequence of the probe will depend on the hybridization conditions (e.g. temperature, salt condition etc.). For example, for diagnostic applications, depending on the complexity of the analyte sequence, the nucleic acid probe typically contains at least 10-20 nucleotides, preferably 15-25, and more preferably at least 30 nucleotides, although it may be shorter than this. Short primers generally require cooler temperatures to form sufficiently stable hybrid complexes with the template.

Probes may be produced by synthetic procedures, such as the triester method of Matteucci et al. [*J. Am. Chem. Soc.* (1981) 103:3185], or according to Urdea et al. [*Proc. Natl. Acad. Sci. USA* (1983) 80: 7461], or using commercially available automated oligonucleotide synthesizers.

The chemical nature of the probe can be selected according to preference. For certain applications, DNA or RNA are appropriate. For other applications, modifications may be incorporated eg. backbone modifications, such as phosphorothioates or methylphosphonates, can be used to increase in vivo half-life, alter RNA affinity, increase nuclease resistance etc. [eg. see Agrawal & Iyer (1995) *Curr Opin Biotechnol* 6:12-19; Agrawal (1996) *TIBTECH* 14:376-387]; analogues such as peptide nucleic acids may also be used [eg. see Corey (1997) *TIBTECH* 15:224-229; Buchardt et al. (1993) *TIBTECH* 11:384-386].

Alternatively, the polymerase chain reaction (PCR) is another well-known means for detecting small amounts of target nucleic acid. The assay is described in Mullis et al. [*Meth. Enzymol.* (1987) 155:335-350] & U.S. Pat. Nos. 4,683,195 & 4,683,202. Two "primer" nucleotides hybridize with the target nucleic acids and are used to prime the reaction. The primers can comprise sequence that does not hybridize to the sequence of the amplification target (or its complement) to aid with duplex stability or, for example, to incorporate a convenient restriction site. Typically, such sequence will flank the desired streptococcus sequence.

A thermostable polymerase creates copies of target nucleic acids from the primers using the original target nucleic acids as a template. After a threshold amount of target nucleic acids are generated by the polymerase, they can be detected by more traditional methods, such as Southern blots. When using the Southern blot method, the labelled probe will hybridize to the streptococcus sequence (or its complement).

Also, mRNA or cDNA can be detected by traditional blotting techniques described in Sambrook et al [supra]. mRNA, or cDNA generated from mRNA using a polymerase enzyme, can be purified and separated using gel electrophoresis. The nucleic acids on the gel are then blotted onto a solid support, such as nitrocellulose. The solid support is exposed to a labelled probe and then washed to remove any unhybridized probe. Next, the duplexes containing the labeled probe are detected. Typically, the probe is labelled with a radioactive moiety.

EXAMPLES

The following examples describe nucleic acid sequences which have been identified in *Streptococcus*, along with their inferred translation products. The examples are generally in the following format:

a nucleotide sequence which has been identified in *Streptococcus* the inferred translation product of this sequence a computer analysis (e.g. PSORT output) of the translation product, indicating antigenicity Most examples describe nucleotide sequences from *S. agalactiae*. The specific strain which was sequenced was from serotype V, and is a clinical strain isolated in Italy which expresses the R antigen (ISS/Rome/Italy collection, strain. 2603 V/R). For several of these examples, the corresponding sequences from *S. pyogenes* are also given. Where GBS and GAS show homology in this way, there is conservation between species which suggests an essential function and also gives good cross-species reactivity.

In contrast, several examples describe nucleotide sequences from GAS for which no homolog in GBS has been identified. This lack of homology gives molecules which are useful for distinguishing GAS from GBS and for making GAS-specific products. The same is true for GBS sequences which lack GAS homologs e.g. these are useful for making GBS-specific products.

The examples typically include details of homology to sequences in the public databases. Proteins that are similar in sequence are generally similar in both structure and function, and the homology often indicates a common evolutionary origin. Comparison with sequences of proteins of known function is widely used as a guide for the assignment of putative protein function to a new sequence and has proved particularly useful in whole-genome analyses.

Various tests can be used to assess the in vivo immunogenicity of the proteins identified in the examples. For example, the proteins can be expressed recombinantly and used to screen patient sera by immunoblot. A positive reaction between the protein and patient serum indicates that the patient has previously mounted an immune response to the protein in question i.e. the protein is an immunogen. This method can also be used to identify immunodominant proteins. The mouse model used in the examples can also be used.

The recombinant protein can also be conveniently used to prepare antibodies e.g. in a mouse. These can be used for direct confirmation that a protein is located on the cell-surface. Labelled antibody (e.g. fluorescent labelling for FACS) can be incubated with intact bacteria and the presence of label on the bacterial surface confirms the location of the protein.

For many GBS proteins, the following data are given:

SDS-PAGE analysis of total recombinant *E. coli* cell extracts for GBS protein expression SDS-PAGE analysis after the protein purification Western-blot analysis of GBS total cell extract using antisera raised against recombinant proteins FACS and ELISA analysis against GBS using antisera raise against recombinant proteins Results of the in vivo passive protection assay Details of experimental techniques used are presented below:

Sequence Analysis

Open reading frames (ORFs) within nucleotide sequences were predicted using the GLIMMER program [Salzberg et al. (1998) *Nucleic Acids Res* 26:544-8]. Where necessary, start codons were modified and corrected manually on the basis of the presence of ribosome-binding sites and promoter regions on the upstream DNA sequence.

ORFs were then screened against the non-redundant protein databases using the programs BLASTp [Altschul et al. (1990) *J. Mol. Biol.* 215:403-410] and PRAZE, a modification of the Smith-Waterman algorithm [Smith & Waterman (1981) *J Mol Biol* 147:195-7; see Fleischmann et al (1995) *Science* 269:496-512].

Leader peptides within the ORFs were located using three different approaches: (i) PSORT [Nakai (1991) *Bull. Inst. Chem. Res., Kyoto Univ.* 69:269-291; Horton & Nakai (1996) *Intellig. Syst. Mol. Biol.* 4:109-115; Horton & Nakai (1997) *Intellig. Syst. Mol. Biol.* 5:147-152]; (ii) SignalP [Nielsen & Krogh (1998) in *Proceedings of the Sixth International Conference on Intelligent Systems for Molecular Biology* (ISMB 6), AAAI Press, Menlo Park, Calif., pp. 122-130; Nielsen et al. (1999) *Protein Engineering* 12:3-9; Nielsen et al. (1997). *Int. J. Neural Sys.* 8:581-599]; and (iii) visual inspection of the ORF sequences. Where a signal sequences is given a "possible site" value, the value represents the C-terminus residue of the signal peptide e.g. a "possible site" of 26 means that the signal sequence consists of amino acids 1-26.

Lipoprotein-specific signal peptides were located using three different approaches: (i) PSORT [see above]; (ii) the "prokaryotic membrane lipoprotein lipid attachment site" PROSITE motif [Hoffman et al. (1999) *Nucleic Acids Res.* 27:215-219; Bucher & Bairoch (1994) in *Proceedings 2nd International Conference on Intelligent Systems for Molecular Biology* (ISMB-94), AAAI Press, pages 53-61]; and (iii) the FINDPATTERNS program available in the GCG Wisconsin Package, using the pattern (M, L, V) x{9, 35}LxxCx.

Transmembrane domains were located using two approaches: (i) PSORT [see above]; (ii) TopPred [von Heijne (1992) *J. Mol. Biol.* 225:487-494].

LPXTG motifs, characteristic of cell-wall attached proteins in Gram-positive bacteria [Fischetti et al. (1990) *Mol Microbiol* 4:1603-5] were located with FINDPATTERNS using the pattern (L, I, V, M, Y, F)Px(T, A, S, G) (G, N, S, T, A, L).

RGD motifs, characteristic of cell-adhesion molecules [D'Souza et al. (1991) *Trends Biochem Sci* 16:246-50] were located using FINDPATTERNS.

Enzymes belonging to the glycolytic pathway were also selected as antigens, because these have been found experimentally expressed on the surface of *Streptococci* [e.g. Pancholi & Fischetti (1992) *J Exp Med* 176:415-26; Pancholi & Fischetti (1998) *J Biol Chem* 273:14503-15].

Cloning, Expression and Purification of Proteins

GBS genes were cloned to facilitate expression in *E. coli* as two different types of fusion proteins:

a) proteins having a hexa-histidine tag at the amino-terminus (His-gbs)

b) proteins having a GST fusion partner at the amino-terminus (Gst-gbs)

Cloning was performed using the Gateway™ technology (Life Technologies), which is based on the site-specific recombination reactions that mediate integration and excision of phage lambda into and from the *E. coli* genome. A single cloning experiment included the following steps:

1—Amplification of GBS chromosomal DNA to obtain a PCR product coding for a single ORF flanked by attB recombination sites.

2—Insertion of the PCR product into a pDONR vector (containing attP sites) through a BP reaction (attB×attP sites). This reaction gives a so called 'pEntry' vector, which now contains attL sites flanking the insert.

3—Insertion of the GBS gene into *E. coli* expression vectors (pDestination vectors, containing attR sites) through a LR reaction between pEntry and pDestination plasmids (attL×attR sites).

A) Chromosomal DNA Preparation

For chromosomal DNA preparation, GBS strain 2603 V/R (Istituto Superiore Sanità, Rome) was grown to exponential phase in 2 litres TH Broth (Difco) at 37° C., harvested by centrifugation, and dissolved in 40 ml TES (50 mM Tris pH 8, 5 mM EDTA pH 8, 20% sucrose). After addition of 2.5 ml lysozyme solution (25 mg/ml in TES) and 0.5 ml mutanolysin (Sigma M-9901, 25000 U/ml in $H_2O$), the suspension was incubated at 37° C. for 1 hour. 1 ml RNase (20 mg/ml) and 0.1 ml proteinase K (20 mg/ml) were added and incubation was continued for 30 min. at 37° C.

Cell lysis was obtained by adding 5 ml sarkosyl solution (10% N-laurylsarcosine in 250 mM EDTA pH 8.0), and incubating 1 hour at 37° C. with frequent inversion. After sequential extraction with phenol, phenol-chloroform and chloroform, DNA was precipitated with 0.3M sodium acetate pH 5.2 and 2 volumes of absolute ethanol. The DNA pellet was rinsed with 70% ethanol and dissolved in TE buffer (10 mM Tris-HCl, 1 mM EDTA, pH 8). DNA concentration was evaluated by $OD_{260}$.

B) Oligonucleotide Design

Synthetic oligonucleotide primers were designed on the basis of the coding sequence of each ORF. The aim was to express the protein's extracellular region. Accordingly, predicted signal peptides were omitted (by deducing the 5' end amplification primer sequence immediately downstream from the predicted leader sequence) and C-terminal cell-wall anchoring regions were removed (e.g. LPXTG motifs and downstream amino acids). Where additional nucleotides have been deleted, this is indicated by the suffix 'd' (e.g. 'GBS352d'). Conversely, a suffix 'L' refers to expression without these deletions. Deletions of C- or N-terminal residues were also sometimes made, as indicated by a 'C' or 'N' suffix.

The amino acid sequences of the expressed GBS proteins (including 'd' and 'L' forms etc.) are definitively defined by the sequences of the oligonucleotide primers.

5' tails of forward primers and 3' tails of reverse primers included attB 1 and attB2 sites respectively:

Forward primers: 5'-GGGGACAAGTTTGTA-CAAAAAAGCAGGCTCT-ORF in frame-3' (nucleotides 1-31 of SEQ ID NO:11027; the TCT sequence preceding the ORF was omitted when the ORF's first coding triplet began with T).

Reverse primers: 5'-GGGGACCACTTTGTACAA-GAAAGCTGGGTT-ORF reverse complement-3' (nucleotides 1-30 of SEQ ID NO:11552).

The primers for GBS59 are thus:

```
Fwd: GGGGACAAGTTTGTACAAAAAAGCAGG    (SEQ ID NO: 11027)
     CTCTGATGAAGCAACAACTAA

Rev: GGGGACCACTTTGTACAAGAAAGCTGG    (SEQ ID NO: 11552)
     GTTTGTTACCTTTTTATTTTCT
```

The number of nucleotides which hybridized to the sequence to be amplified depended on the melting temperature of the primers, which was determined as described by Breslauer et al. [*PNAS USA* (1986) 83:3746-50]. The average melting temperature of the selected oligos was 50-55° C. for the hybridizing region and 80-85° C. for the whole oligos.

C) Amplification

The standard PCR protocol was as follows: 50 ng genomic DNA were used as template in the presence of 0.5 μM each primer, 200 μM each dNTP, 1.5 mM $MgCl_2$, 1× buffer minus $Mg^{++}$ (Gibco-BRL) and 2 units of Taq DNA polymerase (Platinum Taq, Gibco-BRL) in a final volume of 100 μl. Each sample underwent a double-step of amplification: 5 cycles performed using as the hybridizing temperature 50° C., followed by 25 cycles at 68° C.

The standard cycles were as follows:
Denaturation: 94° C., 2 min
5 cycles: Denaturation: 94° C., 30 seconds
Hybridization: 50° C., 50 seconds
Elongation: 72° C., 1 min. or 2 min. and 40 sec.
25 cycles: Denaturation: 94° C., 30 seconds
Hybridization: 68° C., 50 seconds
Elongation: 72° C., 1 min. or 2 min. and 40 sec.
Elongation time was 1 minute for ORFs shorter than 2000 bp and 2:40 minutes for ORFs longer than 2000 bp. Amplifications were performed using a Gene Amp PCR system 9600 (Perkin Elmer).

To check amplification results, 2 μl of each PCR product were loaded onto 1-1.5 agarose gel and the size of amplified fragments was compared with DNA molecular weight standards (DNA marker IX Roche, 1 kb DNA ladder Biolabs).

Single band PCR products were purified by PEG precipitation: 300 μl of TE buffer and 200 μl of 30% PEG 8000/30 mM $MgCl_2$ were added to 100 μl PCR reaction. After vortexing, the DNA was centrifuged for 20 min at 10000 g, washed with 1 vol. 70% ethanol and the pellet dissolved in 30 μl TE. PCR products smaller than 350 bp were purified using a PCR purification Kit (Qiagen) and eluted with 30 μl of the provided elution buffer.

In order to evaluate the yield, 2 μl of the purified DNA were subjected to agarose gel electrophoresis and compared to titrated molecular weight standards.

D) Cloning of PCR Products into Expression Vectors

Cloning was performed following the GATEWAY™ technology's "one-tube protocol", which consists of a two step reaction (BP and LR) for direct insertion of PCR products into expression vectors.

BP reaction (attB×attP sites): The reaction allowed insertion of the PCR product into a pDONR vector. The pDONR™ 201 vector we used contains the killer toxin gene ccdB between attP1 and attP2 sites to minimize background colonies lacking the PCR insert, and a selectable marker gene for kanamycin resistance. The reaction resulted in a so called pEntry vector, in which the GBS gene was located between attL1 and attL2 sites.

60 fmol of PCR product and 100 ng of pDONR™ 201 vector were incubated with 2.5 μl of BP CLONASE™ in a final volume of 12.5 μl for 4 hours at 25° C.

Figure 86A:
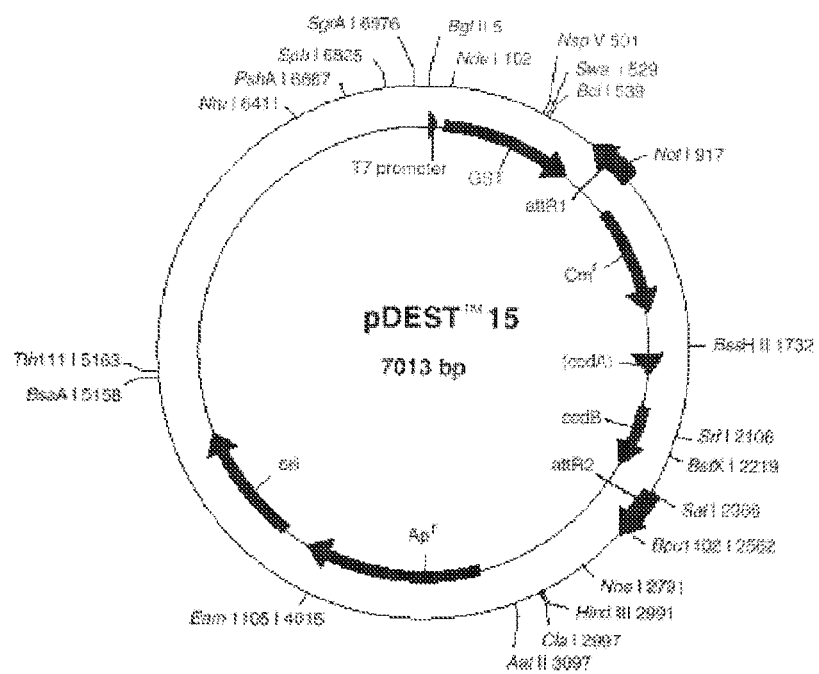
FIG. 86A shows the pDEST15 vector.
Figure 86B:
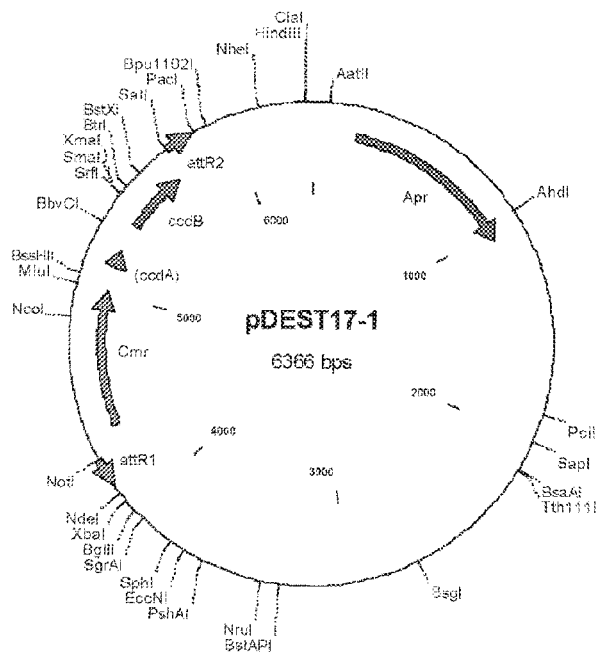
FIG. 86B shows the pDEST17-1 vector.

LR reaction (attL×attR sites): The reaction allowed the insertion of the GBS gene, now present in the pEntry vector, into *E. coli* expression vectors (pDestination vectors, containing attR sites). Two pDestination vectors were used (pDEST15 for N-terminal GST fusions—FIG. 86; and pDEST17-1 for N-terminal His-tagged fusions—FIG. 87). Both allow transcription of the ORF fusion coding mRNA under T7 RNA polymerase promoter [Studier et al (1990) *Meth. Enzymol* 185: 60ff].

To 5 μl of BP reaction were added 0.25 μl of 0.75 M NaCl, 100 ng of destination vector and 1.5 μl of LR CLONASE™. The reaction was incubated at 25° C. for 2 hours and stopped with 1 μl of 1 mg/ml proteinase K solution at 37° C. for 15 min.

1 μl of the completed reaction was used to transform 50 μl electrocompetent BL21-SI™ cells (0.1 cm, 200 ohms, 25 μF). BL21-SI cells contain an integrated T7 RNA polymerase gene under the control of the salt-inducible prU promoter [Gowrishankar (1985) *J. Bacteriol.* 164:434ff]. After electroporation cells were diluted in 1 ml SOC medium (20 g/l bacto-tryptone, 5 g/l yeast extract, 0.58 g/l NaCl, 0.186 g/l KCl, 20 mM glucose, 10 mM $MgCl_2$) and incubated at 37° C. for 1 hour. 200 μl cells were plated onto LBON plates (Luria Broth medium without NaCl) containing 100 μg/ml ampicillin. Plates were then incubated for 16 hours at 37° C.

Entry clones: In order to allow the future preparation of Gateway compatible pEntry plasmids containing genes which might turn out of interest after immunological assays, 2.5 μl of BP reaction were incubated for 15 min in the presence of 3 μl 0.15 mg/ml proteinase K solution and then kept at −20° C. The reaction was in this way available to transform *E. coli* competent cells so as to produce Entry clones for future introduction of the genes in other Destination vectors.

E) Protein Expression

Single colonies derived from the transformation of LR reactions were inoculated as small-scale cultures in 3 ml LBON 100 μg/ml ampicillin for overnight growth at 25° C. 50-200 μl of the culture was inoculated in 3 ml LBON/Amp to an initial OD600 of 0.1. The cultures were grown at 37° C. until OD600 0.4-0.6 and recombinant protein expression was induced by adding NaCl to a final concentration of 0.3 M. After 2 hour incubation the final OD was checked and the cultures were cooled on ice. 0.5 $OD_{600}$ of cells were harvested by centrifugation. The cell pellet was suspended in 50 μl of protein Loading Sample Buffer (50 mM TRIS-HCl pH 6.8, 0.5% w/v SDS, 2.5% v/v glycerin, 0.05% w/v Bromophenol Blue, 100 mM DTT) and incubated at 100° C. for 5 min. 10 μl of sample was analyzed by SDS-PAGE and Coomassie Blue staining to verify the presence of induced protein band.

F) Purification of the Recombinant Proteins

Single colonies were inoculated in 25 ml LBON 100 μg/ml ampicillin and grown at 25° C. overnight. The overnight culture was inoculated in 500 ml LBON/amp and grown under shaking at 25° C. until $OD_{600}$ values of 0.4-0.6. Protein expression was then induced by adding NaCl to a final concentration of 0.3 M. After 3 hours incubation at 25° C. the final $OD_{600}$ was checked and the cultures were cooled on ice. After centrifugation at 6000 rpm (JA10 rotor, Beckman) for 20 min., the cell pellet was processed for purification or frozen at −20° C.

Proteins were purified in 1 of 3 ways depending on the fusion partner and the protein's solubility:

Purification of Soluble His-Tagged Proteins from *E. Coli*
1. Transfer pellets from −20° C. to ice bath and reconstitute each pellet with 10 ml B-PER™ solution (Bacterial-Protein Extraction Reagent, Pierce cat. 78266), 10 μl of a 100 mM $MgCl_2$ solution, 50 μl of DNAse I (Sigma D-4263, 100 Kunits in PBS) and 100 μl of 100 mg/ml lysozyme in PBS (Sigma L-7651, final concentration 1 mg/ml).
2. Transfer resuspended pellets in 50 ml centrifuge tubes and leave at room temperature for 30-40 minutes, vortexing 3-4 times.
3. Centrifuge 15-20 minutes at about 30-40000×g.
4. Prepare Poly-Prep (Bio-Rad) columns containing 1 ml of Fast Flow Ni-activated Chelating Sepharose (Pharmacia). Equilibrate with 50 mM phosphate buffer, 300 mM NaCl, pH 8.0.
5. Store the pellet at −20° C., and load the supernatant on to the columns.
6. Discard the flow through.
7. Wash with 10 ml 20 mM imidazole buffer, 50 mM phosphate, 300 mM NaCl, pH 8.0.
8. Elute the proteins bound to the columns with 4.5 ml (1.5 ml+1.5 ml+1.5 ml) 250 mM imidazole buffer, 50 mM phosphate, 300 mM NaCl, pH 8.0 and collect three fractions of ~1.5 ml each. Add to each tube 15 μl DTT 200 mM (final concentration 2 mM).
9. Measure the protein concentration of the collected fractions with the Bradford method and analyse the proteins by SDS-PAGE.
10. Store the collected fractions at +4° C. while waiting for the results of the SDS-PAGE analysis.
11. For immunisation prepare 4-5 aliquots of 20-100 μg each in 0.5 ml in 40% glycerol. The dilution buffer is the above elution buffer, plus 2 mM DTT. Store the aliquots at −20° C. until immunisation.

Purification of His-Tagged Proteins from Inclusion Bodies
1. Bacteria are collected from 500 ml cultures by centrifugation. If required store bacterial pellets at −20° C. Transfer the pellets from −20° C. to room temperature and reconstitute each pellet with 10 ml B-PER™ solution, 10 μl of a 100 mM $MgCl_2$ solution (final 1 mM), 50 μl of DNAse I equivalent to 100 Kunits units in PBS and 100 μl of a 100 mg/ml lysozyme (Sigma L-7651) solution in PBS (equivalent to 10 mg, final concentration 1 mg/ml).
2. Transfer the resuspended pellets in 50 ml centrifuge tubes and let at room temperature for 30-40 minutes, vortexing 3-4 times.
3. Centrifuge 15 minutes at 30-4000×g and collect the pellets.
4. Dissolve the pellets with 50 mM TRIS-HCl, 1 mM TCEP {Tris(2-carboxyethyl)-phosphine hydrochloride, Pierce}, 6M guanidine hydrochloride, pH 8.5. Stir for ~10 min. with a magnetic bar.
5. Centrifuge as described above, and collect the supernatant.
6. Prepare Poly-Prep (Bio-Rad) columns containing 1 ml of Fast Flow Ni-activated Chelating Sepharose (Pharmacia). Wash the columns twice with 5 ml of $H_2O$ and equilibrate with 50 mM TRIS-HCl, 1 mM TCEP, 6M guanidine hydrochloride, pH 8.5.
7. Load the supernatants from step 5 onto the columns, and wash with 5 ml of 50 mM TRIS-HCl buffer, 1 mM TCEP, 6M urea, pH 8.5
8. Wash the columns with 10 ml of 20 mM imidazole, 50 mM TRIS-HCl, 6M urea, 1 mM TCEP, pH 8.5. Collect and set aside the first 5 ml for possible further controls.
9. Elute proteins bound to columns with 4.5 ml buffer containing 250 mM imidazole, 50 mM TRIS-HCl, 6M urea, 1 mM TCEP, pH 8.5. Add the elution buffer in three 1.5 ml aliquots, and collect the corresponding three fractions. Add to each fraction 15 μl DTT (final concentration 2 mM).
10. Measure eluted protein concentration with Bradford method and analyse proteins by SDS-PAGE.
11. Dialyse overnight the selected fraction against 50 mM Na phosphate buffer, pH 8.8, containing 10% glycerol, 0.5 M arginine, 5 mM reduced glutathione, 0.5 mM oxidized glutathione, 2 M urea.
12. Dialyse against 50 mM Na phosphate buffer, pH 8.8, containing 10% glycerol, 0.5 M arginine, 5 mM reduced glutathione, 0.5 mM oxidized glutathione.
13. Clarify the dialysed protein preparation by centrifugation and discard the non-soluble material and measure the protein concentration with the Bradford method.
14. For each protein destined to the immunization prepare 4-5 aliquot of 20-100 μg each in 0.5 ml after having adjusted the glycerol content up to 40%. Store the prepared aliquots at −20° C. until immunization.

Purification of GST-Fusion Proteins from *E. Coli*
1. Bacteria are collected from 500 ml cultures by centrifugation. If required store bacterial pellets at −20° C. Transfer the pellets from −20° C. to room temperature and reconstitute each pellet with 10 ml B-PER™ solution, 10 μl of a 100 mM $MgCl_2$ solution (final 1 mM), 50 μl of DNAse I equivalent to 100 Kunits units in PBS and 100 μl of a 100 mg/ml lysozyme (Sigma L-7651) solution in PBS (equivalent to 10 mg, final concentration 1 mg/ml).
2. Transfer the resuspended pellets in 50 ml centrifuge tubes and let at room temperature for 30-40 minutes, vortexing 3-4 times.
3. Centrifuge 15-20 minutes at about 30-40000×g.
4. Discard centrifugation pellets and load supernatants onto the chromatography columns, as follows.

5. Prepare Poly-Prep (Bio-Rad) columns containing 0.5 ml of Glutathione-Sepharose 4B resin. Wash the columns twice with 1 ml of H$_2$0 and equilibrate with 10 ml PBS, pH 7.4.
6. Load supernatants on to the columns and discard the flow through.
7. Wash the columns with 10 ml PBS, pH 7.4.
8. Elute proteins bound to columns with 4.5 ml of 50 mM TRIS buffer, 10 mM reduced glutathione, pH 8.0, adding 1.5 ml+1.5 ml+1.5 ml and collecting the respective 3 fractions of ~1.5 ml each.
9. Measure protein concentration of the fractions with the Bradford method and analyse the proteins by SDS-PAGE.
10. Store the collected fractions at +4° C. while waiting for the results of the SDS-PAGE analysis.
11. For each protein destined for immunisation prepare 4-5 aliquots of 20-100 µg each in 0.5 ml of 40% glycerol. The dilution buffer is 50 mM TRIS-HCl, 2 mM DTT, pH 8.0. Store the aliquots at −20° C. until immunisation.

FIG. 4

Figure 4:
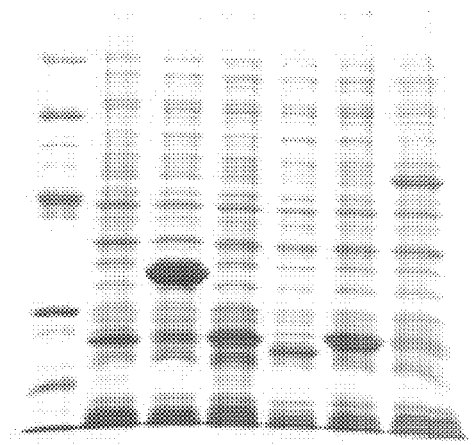

For the experiment shown in FIG. 4, the GBS proteins were fused at the N-terminus to thioredoxin and at C-terminus to a poly-His tail. The plasmid used for cloning is pBAD-DEST49 (Invitrogen Gateway™ technology) and expression is under the control of an L(+)-Arabinose dependent promoter. For the production of these GBS antigens, bacteria are grown on RM medium (6 g/l Na$_2$HPO$_4$, 3 g/l KH$_2$PO$_4$, 0.5 g/l NaCl, 1 g/l NH$_4$Cl, pH7,4, 2% casaminoacids, 0.2% glucose, 1 mM MgCl$_2$) containing 100 µg/ml ampicillin. After incubation at 37° C. until cells reach OD$_{600}$=0.5, protein expression is induced by adding 0.2% (v/v) L(+)Arabinose for 3 hours.

Immunisations with GBS Proteins

The purified proteins were used to immunise groups of four CD-1 mice intraperitoneally. 20 µg of each purified protein was injected in Freund's adjuvant at days 1, 21 & 35. Immune responses were monitored by using samples taken on day 0 & 49. Sera were analysed as pools of sera from each group of mice.

FACScan Bacteria Binding Assay Procedure.

GBS serotype V 2603 V/R strain was plated on TSA blood agar plates and incubated overnight at 37° C. Bacterial colonies were collected from the plates using a sterile dracon swab and inoculated into 100 ml Todd Hewitt Broth. Bacterial growth was monitored every 30 minutes by following OD$_{600}$. Bacteria were grown until OD$_{600}$=0.7-0.8. The culture was centrifuged for 20 minutes at 5000 rpm. The supernatant was discarded and bacteria were washed once with PBS, resuspended in ½ culture volume of PBS containing 0.05% paraformaldehyde, and incubated for 1 hour at 37° C. and then overnight at 4° C.

50 µl bacterial cells (OD$_{600}$ 0.1) were washed once with PBS and resuspended in 20 µl blocking serum (Newborn Calf Serum, Sigma) and incubated for 20 minutes at room temperature. The cells were then incubated with 100 µl diluted sera (1:200) in dilution buffer (20% Newborn Calf Serum 0.1% BSA in PBS) for 1 hour at 4° C. Cells were centrifuged at 500 rpm, the supernatant aspirated and cells washed by adding 200 µl washing buffer (0.1% BSA in PBS). 50 µl R-Phicoerytrin conjugated F(ab)$_2$ goat anti-mouse, diluted 1:100 in dilution buffer, was added to each sample and incubated for 1 hour at 4° C. Cells were spun down by centrifugation at 500 rpm and washed by adding 200 µl of washing buffer. The supernatant was aspirated and cells resuspended in 200 µl PBS. Samples were transferred to FACScan tubes and read. The condition for FACScan setting were: FL2 on; FSC-H threshold: 54; FSC PMT Voltage: E 02; SSC PMT: 516; Amp. Gains 2.63; FL-2 PMT: 728. Compensation values: 0.

Samples were considered as positive if they had a Δ mean values >50 channel values.

Whole Extracts Preparation

GBS serotype III COH1 strain and serotype V 2603 V/R strain cells were grown overnight in Todd Hewitt Broth. 1 ml of the culture was inoculated into 100 ml Todd Hewitt Broth. Bacterial growth was monitored every 30 minutes by following OD$_{600}$. The bacteria were grown until the OD reached 0.7-0.8. The culture was centrifuged for 20 minutes at 5000 rpm. The supernatant was discarded and bacteria were washed once with PBS, resuspended in 2 ml 50 mM Tris-HCl, pH 6.8 adding 400 units of Mutanolysin (Sigma-Aldrich) and incubated 3 hrs at 37° C. After 3 cycles of freeze/thaw, cellular debris were removed by centrifugation at 14000 g for 15 minutes and the protein concentration of the supernatant was measured by the Bio-Rad Protein assay, using BSA as a standard.

Western Blotting

Purified proteins (50 ng) and total cell extracts (25 µg) derived from GBS serotype III COH1 strain and serotype V 2603 V/R strain were loaded on 12% or 15% SDS-PAGE and transferred to a nitrocellulose membrane. The transfer was performed for 1 hours at 100V at 4° C., in transferring buffer (25 mM Tris base, 192 mM glycine, 20% methanol). The membrane was saturated by overnight incubation at 4° C. in saturation buffer (5% skimmed milk, 0.1% Tween 20 in PBS). The membrane was incubated for 1 hour at room temperature with 1:1000 mouse sera diluted in saturation buffer. The membrane was washed twice with washing buffer (3% skimmed milk, 0.1% Tween 20 in PBS) and incubated for 1 hour with a 1:5000 dilution of horseradish peroxidase labelled anti-mouse Ig (Bio-Rad). The membrane was washed twice with 0.1% Tween 20 in PBS and developed with the Opti-4CN Substrate Kit (Bio-Rad). The reaction was stopped by adding water.

Unless otherwise indicated, lanes 1, 2 and 3 of blots in the drawings are: (1) the purified protein; (2) GBS-III extracts; and (3) GBS-V extracts. Molecular weight markers are also shown.

In Vivo Passive Protection Assay in Neonatal Sepsis Mouse Model

The immune sera collected from the CD1 immunized mice were tested in a mouse neonatal sepsis model to verify their protective efficacy in mice challenged with GBS serotype III. Newborn Balb/C littermates were randomly divided in two groups within 24 hrs from birth and injected subcutaneously with 25 µl of diluted sera (1:15) from immunized CD1 adult mice. One group received preimmune sera, the other received immune sera. Four hours later all pups were challenged with a 75% lethal dose of the GBS serotype III COH1 strain. The challenge dose obtained diluting a mid log phase culture was administered subcutaneously in 25 µl of saline. The number of pups surviving GBS infection was assessed every 12 hours for 4 days. Results are in Table III.

Example 1

A DNA sequence (GBSx1402) was identified in *S. agalactiae* <SEQ ID 1> which encodes the amino acid sequence <SEQ ID 2>. Analysis of this protein sequence reveals the following:

```
Possible site: 27
>>> Seems to have an uncleavable N-term signal seq
INTEGRAL    Likelihood = -0.48   Transmembrane 169-185 (169-185)
----- Final Results -----
   bacterial membrane --- Certainty = 0.1192 (Affirmative) <succ>
      bacterial outside--- Certainty = 0.0000 (Not Clear) <succ>
         bacterial cytoplasm --- Certainty = 0.0000 (Not Clear) <succ>
```

The protein has homology with the following sequences in the GENPEPT database.

```
>GP:CPB88235 GB:AL353012 hypothetical serine-rich repeat protein
[Schizosaccharomyces pombe]
Identities = 41/152 (26%), Positives = 75/152 (48%), Gaps = 4/152 (2%)
Query:   22 SSIGYADTSDKNTDTSVVTTTLSEEKRSDELDQSSTGSSSENESSSSSEPETNPSTNPPT    81
            SS   +++S +++D+S ++    E  S+  D SS+ SSSE+ESSS     ++ S++   +
Sbjct:  132 SSDSESESSSEDSDSSSSSDSESESSSEGSDSSSSSSSESESSSEDNDSSSSSSDSES   191

Query:   82 TEPSQPSPSEENKPDGRTKTE---IGNNKDISSGTKVLISEDSIKNFSKASSDQEEVDRD  138
               S+ S S   +  D  +++     ++  SS     SED+   + S + S+ E     D
Sbjct:  192 ESSSEDSDSSSSSDSESESSSEGSDSSSSSSSESESSSEDNDSSSSSDSESESSSED   251

Query:  139 ESSSSKANDGK-KGHSKPKKELPKTGDSHSDT                             169
            SSS ++D + +  SK       + DS  D+
Sbjct:  252 SDSSSSSSDSESESSSKDSDSSSNSSDSEDDS                             283
```

There is also homology to SEQ ID 1984.

A related GBS gene <SEQ ID 8785> and protein <SEQ ID 8786> were also identified. Analysis of this protein sequence reveals the following:

```
Lipop: Possible site: -1    Crend: 5
McG: Discrim Score: 6.72
GvH: Signal Score (-7.5) : -4.34
Possible site: 27
>>> Seems to have an uncleavable N-term signal seq
ALOM program count: 1  value: -0.48  threshold: 0.0
INTEGRAL    Likelihood = -0.48   Transmembrane 169-185 (169-185)
PERIPHERAL  Likelihood = 0.16   7
modified ALOM score: 0.60
*** Reasoning Step: 3
----- Final Results -----
   bacterial membrane --- Certainty = 0.1192 (Affirmative) <succ>
      bacterial outside --- Certainty = 0.0000 (Not Clear) <succ>
         bacterial cytoplasm --- Certainty = 0.0000 (Not Clear) <succ>
LPXTG motif: 159-163
```

Figure 9:
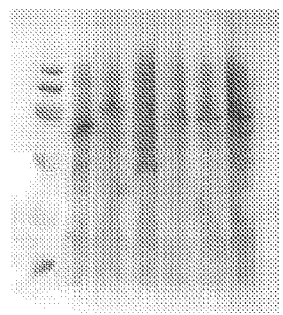
Figure 12:
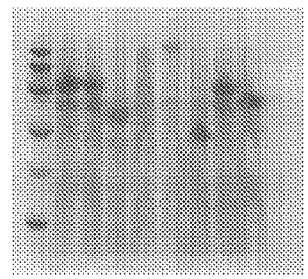

SEQ ID 2 (GBS4) was expressed in *E. coli* as a GST-fusion product. SDS-PAGE analysis of total cell extract is shown in FIG. 9 (lane 3; MW 43.1 kDa) and FIG. 63 (lane 4; MW 50 kDa). It was also expressed in *E. coli* as a His-fusion product. SDS-PAGE analysis of total cell extract is shown in FIG. 12 (lane 7; MW 30 kDa), FIG. 63 (lane 3; MW 30 kDa) and in FIG. 178 (lane 3; MW 30 kDa).

Figure 190:
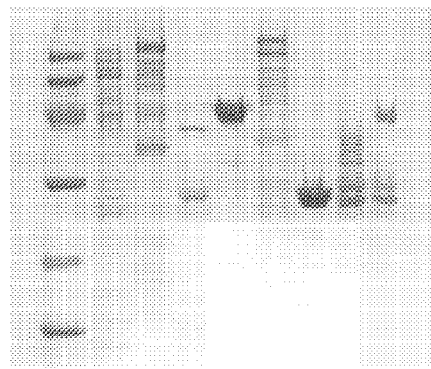
Figure 209:
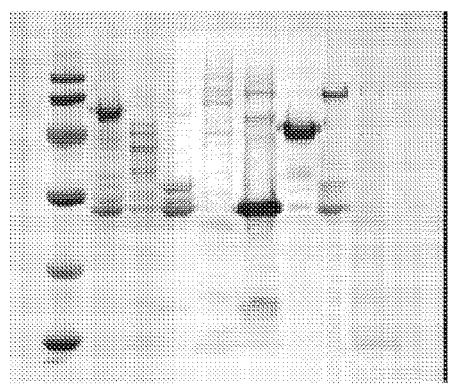

GBS4-GST was purified as shown in FIG. 190 (lane 6) and FIG. 209 (lane 8).

Figure 191:
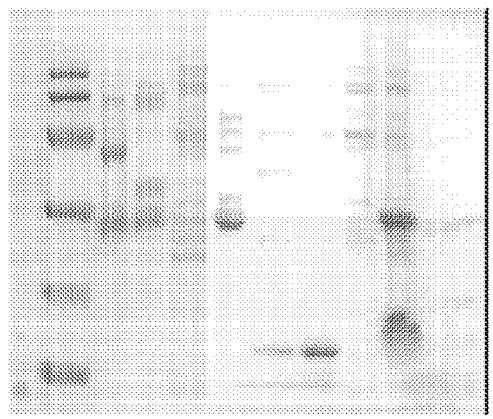

Purified GBS4-His is shown in FIGS. 89A, 191 (lane 10), 209 (lane 7) and 228 (lanes 9 & 10).

The purified GBS4-His fusion product was used to immunise mice (lane 2 product; 201 g/mouse). The resulting antiserum was used for Western blot (FIG. 89B), FACS, and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 2

A DNA sequence (GBSx1100) was identified in *S. agalactiae* <SEQ ID 3> which encodes the amino acid sequence <SEQ ID 4>. This protein is predicted to be aggregation promoting protein. Analysis of this protein sequence reveals the following:

```
Possible site: 33
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>
```

The protein has homology with the following sequences in the GENPEPT database.

```
>GP:CAA69725 GB:Y08498 aggregation promoting protein [Lactobacillus gasseri]
Identities = 56/103 (54%), Positives = 69/103 (66%), Gaps = 5/103 (4%)
Query:   82 TASQAEAKSQPT-----IENSMNSSSNLSSSDSAAKEEIARRESNGSYTAQNGQYYGRYQ  136
            T S A A+ Q T       + + + N S S++AAK  +A RES G Y+A NGQY G+YQ
Sbjct:  195 TYSYASAQKQTTQVAQKTQTTTSYTLNASGSEAAAKAWMAGRESGGPYSAGNGQYIGKYQ  254

Query:  137 LSQSYLNGDLSPENQEKVADNYVVSRYGSWSAALSFWNSNGWY                  179
            LS SYL GD S  NQE+VADNYV SRYGSW+ A  FW +NGWY
Sbjct:  255 LSASYLGGDYSAANQERVADNYVKSRYGSWTGAQKFWQTNGWY                  297
```

No corresponding DNA sequence was identified in *S. pyogenes*.

A related GBS gene <SEQ ID 8709> and protein <SEQ ID 8710> were also identified. Analysis of this protein sequence reveals the following:

Lipop: Possible site: −1  Crend: 9
McG: Discrim Score: 2.59
GvH: Signal Score (−7.5): −0.42
Possible site: 33
>>> Seems to have a cleavable N-term signal seq.
ALOM program  count: 0 value: 6.79  threshold: 0.0
PERIPHERAL  Likelihood = 6.79  59
modified ALOM score: −1.86
*** Reasoning Step: 3
----- Final Results -----
  bacterial outside --- Certainty = 0.3000 (Affirmative) <succ>
  bacterial membrane --- Certainty = 0.0000 (Not Clear) <succ>
  bacterial cytoplasm --- Certainty = 0.0000 (Not Clear) <succ>

The protein has homology with the following sequences in the databases:

```
57.5/71.3% over 92aa
 Lactobacillus gasseri
 EGAD|154417| aggregation promoting protein Insert characterized
 GP|1619598|emb|CAA69725.1| |Y08498 aggregation promoting protein Insert characterized
ORF01056(547-837 of 1137)
EGAD|154417|164788(205-297 of 297) aggregation promoting protein {Lactobacillus
gasseri}GP|1619598|emb|CAA69725.1| |Y08498 aggregation
promoting protein {Lactobacillus gasseri}
% Match = 14.6
% Identity = 57.4 % Similarity = 71.3
Matches = 54 Mismatches = 26 Conservative Sub.s = 13

507       537       567       597       627       657       687       717
SLNSISNADVISIGDVLKLDNSTASQAEAKSQPTIENSMNSSSNLSSSDSAAKEEIARRESNGSYTAQNGQYYGRYQLSQ
 ::        :| |              :|     |:|       ::|:|       |::|||    :|  ||||  :|||
NVQRTYSAPVQQRTYSYASAQKQTTQVAQKTQTTTSYTLNASG----SEAAAKAWMAGRESGGPYSAGNGQYIGKYQLSA
            200       210       220       230       240       250

747       777       807       837       867       897       927       957
SYLNGDLSPENQEKVADNYVVSRYGSWSAALSFWNSNGWY**KLIKQRDLLKIKSLCNIFNIYSIAR*QIKYNIGNMNKR
||| ||  |   |||:||||||  ||||||: |   || :||||
SYLGGDYSAANQERVADNYVKSRYGSWTGAQKFWQTNGWY
            270       280       290
```

A related GBS gene <SEQ ID 8711> and protein <SEQ ID 8712> were also identified. Analysis of this protein sequence reveals the following:

Lipop: Possible site: −1  Crend: 9
McG: Discrim Score: 2.59
GvH: Signal Score (−7.5): −0.42
Possible site: 33
>>> Seems to have a cleavable N-term signal seq.
ALOM program  count: 0 value: 6.79  threshold: 0.0
PERIPHERAL  Likelihood = 6.79  59
modified ALOM score: −1.86
*** Reasoning Step: 3
----- Final Results -----
  bacterial outside --- Certainty = 0.3000 (Affirmative) <succ>
  bacterial membrane --- Certainty = 0.0000 (Not Clear) <succ>
  bacterial cytoplasm --- Certainty = 0.0000 (Not Clear) <succ>

The protein has homology with the following sequences in the databases:

```
44.0/62.0% over 115aa
 Bacillus subtilis
 EGAD|108478| hypothetical protein Insert characterized OMNI|NT01BS1100 p60-related
protein Insert characterized
 GP|2226145|emb|CAA74437.1| |Y14079 hypothetical protein Insert characterized
 GP|2633272|emb|CAB12776.1| |Z99109 similar to cell wall-binding protein Insert
characterized
 PIR|B69825|B69825 cell wall-binding protein homolog yhdD - Insert characterized
ORF01746(340-633 of 954)
EGAD|108478|BS0936(57-172 of 488) hypothetical protein {Bacillus subtilis}OMNI|NT01BS1100
p60-related proteinGP|2226145|emb|CAA74437.1| |Y14079 hypothetical protein {Bacillus
subtilis}GP|2633272|emb|CAB12776.1| |Z99109 similar to cell wall-binding protein {Bacillus
subtilis}PIR|B69825|B69825 cell wall-binding protein homolog yhdD - Bacillus subtilis
% Match = 9.0
% Identity = 44.0 % Similarity = 62.0
```

-continued

```
Matches = 44 Mismatches = 35 Conservative Sub.s = 18

120       150       180       210       240       270       300       330
       *DQFMVLAFSFI*CEKLNNFT*RKLKIVFWRPFLY*FTIYLISSKAKQLVIFTRYDSTRINKRAYIMSITSVKKSK

MKKKLAAGLTASAIVGTTLVVTPAEAATIKVKSGDSLWKLAQTYNTSVAALTS
                                                 10        20        30        40        50

360       390                435       465       495       525
       PFKLGVAGLLVGASLALPLSVSAAS---------------YTVKSGDTLSAIAKNHKTTVQELVSLNSISNADVISIGDV
         |    |:| :| :|  | | |:  |              ||||||:| || |||||| ||:|:|:| |
       ANHLSTTVLSIGQTLTIPGSKSSTSSSTSSSTTMKSGSSVYTVKSGDSLWLIANEFKMTVQELKKLNGLS-SDLIRAGQK
                  70        80        90       100       110       120       130

543       573       603       633       663       693       723       753
       LKLD----NSTASQAEALSQPTIENSMNSSSNLSSSDSAAKEEIASS*IKXVVILHRMDNIMEDINCLNLT*MATYLLKI
        ||:     :|::|   ::   | :|   ||||  ||| |::    :       |:     :      :   :
       LKVSGTVSSSSSSKKSNSNKSSSSSSKSSSNKSSSSSSSTGTYKVQLGDSLWKIANKVNMSIAELKVLNNLKSDTIYVN
                  150       160       170       180       190       200       210
```

Figure 30:
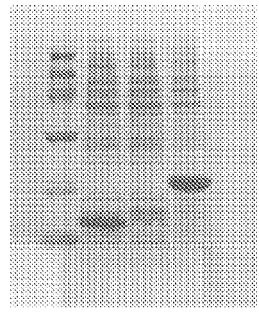

SEQ ID 8712 (GBS166) was expressed in *E. coli* as a His-fusion product. SDS-PAGE analysis of total cell extract is shown in FIG. 30 (lane 2; MW 13.1 kDa).

Figure 315:
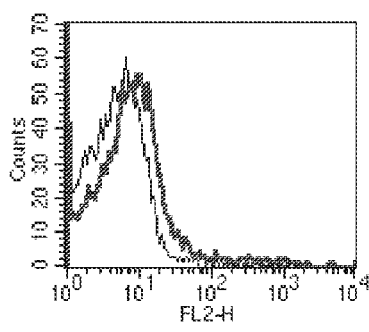

The GBS166-His fusion product was purified (FIG. 200, lane 10) and used to immunise mice. The resulting antiserum was used for FACS (FIG. 315), which confirmed that the protein is immunoaccessible on GBS bacteria.

Figure 10:
Figure 66:
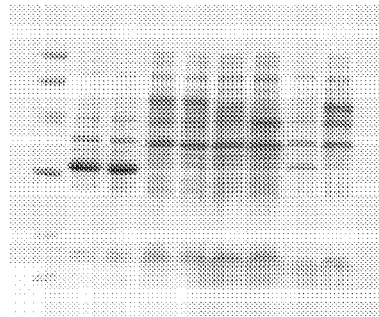
Figure 185:
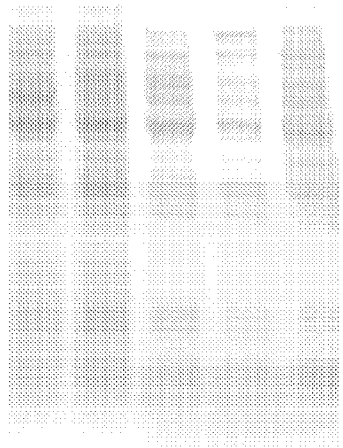

SEQ ID 4 (GBS15) was expressed in *E. coli* as a GST-fusion product. SDS-PAGE analysis of total cell extract is shown in FIG. 9 (lane 5; MW 44.8 kDa), FIG. 63 (lane 5; MW 44.8 kDa) and FIG. 66 (lane 7; MW 45 kDa). It was also expressed in *E. coli* as a His-fusion product. SDS-PAGE analysis of total cell extract is shown in FIG. 10 (lane 4; MW 22.3 kDa). It was also expressed as GBS15L, with SDS-PAGE analysis of total cell extract is shown in FIG. 185 (lane 1; MW 50 kDa).

Figure 210:
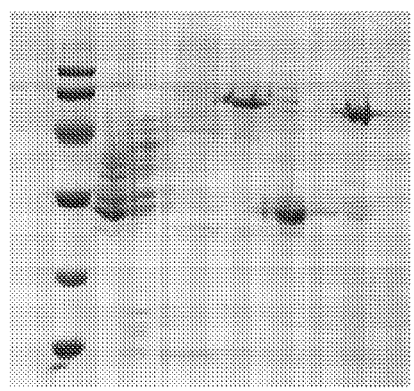
Figure 245:
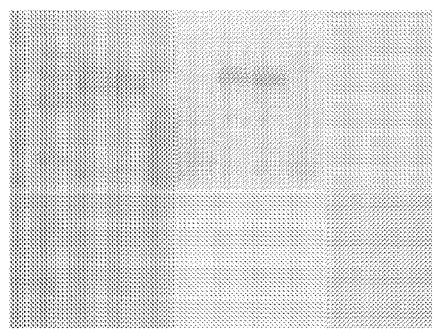

Purified GBS15-GST is shown in FIG. 91A, FIG. 190 (lane 9), FIG. 210 (lane 4) and FIG. 245 (lanes 4 & 5).

The purified GBS15-GST fusion product was used to immunise mice (lane 1+2 products; 20 μg/mouse). The resulting antiserum was used for Western blot (FIG. 91B), FACS (FIG. 91C), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 3

A DNA sequence (GBSx0091) was identified in *S. agalactiae* <SEQ ID 303> which encodes the amino acid sequence <SEQ ID 304>. Analysis of this protein sequence reveals the following:

Possible site: 32
>>> Seems to have no N-terminal signal sequence
INTEGRAL    Likelihood = −9.66    Transmembrane 22-38 (15-41)
----- Final Results -----
   bacterial membrane --- Certainty = 0.4864 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database:

```
>GP:CAA72096 GB:Y11213 hypothetical protein [Streptococcus thermophilus]
Identities = 149/274 (54%), Positives = 208/274 (75%), Gaps = 9/274 (3%)
Query:   23 FLVSLLLSFGIFSLIIPKSNP--KLTKKDFLTKKVIPLNYVALGDSLTEGVGDTTSQGGF   80
            F +  LL  GI   IIP S+   K++ K    KK   + YVA+GDSLT+GVGD+++QGGF
Sbjct:    5 FFLLFLLFVGILIFIIPSSHQSSKISDKIRSVKKE-KVTYVAIGDSLTQGVGDSSNQGGF   63

Query:   81 VPLLSESLHNRYSYQVTSVNYGVSGNTSQQILKRMTTDPQIEKDLEKADLLTLTVGGNDV  140
            VP+LS++L  +  +QVT  NYG++GNTS QILKRM     I++DL+KA L+TLTVGGNDV
Sbjct:   64 VPVLSQALESDFNWQVTPRNYGIAGNTSNQILKRMQEKKDIKRDLKKAKLMTLTVGGNDV  123

Query:  141 LAVIRKELSHLSLNSFEKPAEAYKERLKEILAKARQDNPKLPIYVLGIYNPFYLNFPQLT  200
            + VI+  +++L++N+F K A  Y++RL++I+  AR++N  LPIY++GIYNPFYLNFP++T
Sbjct:  124 IHVIKDNITNLNVNTFSKAAVDYQKRLRQIIELARKENKTLPIYIIGIYNPFYLNFPEMT  183

Query:  201 KMQTVIDNWNKATKEVVDASENVYFVPINDRLYKGINGKEGITES------SNSQASITN  254
            +MQT++DNWN++T+EV     +NVYFVP+ND LYKGINGK G+T S          + S       N
Sbjct:  184 EMQTIVDNWNRSTEEVSKEYDNVYFVPVNDLLYKGINGKGGVTSSDETSQPTKSSQDSLN  243

Query:  255 DALFTGDHFHPNNIGYQIMSNAVMEKINETRKNW                           288
            DALF  DHFHPNN GYQIMS+A++++IN+T+K W
Sbjct:  244 DALFEEDHFHPNNTGYQIMSDAILKRINQTKKEW                           277
```

A related DNA sequence was identified in *S. pyogenes* <SEQ ID 305> which encodes the amino acid sequence <SEQ ID 306>. Analysis of this protein sequence reveals the following:

```
Possible site: 39
>>> Seems to have an uncleavable N-term signal seq
INTEGRAL    Likelihood = -12.05    Transmembrane 18-34 (10-37)
----- Final Results -----
    bacterial membrane --- Certainty = 0.5819 (Affirmative) <succ>
        bacterial outside --- Certainty = 0.0000 (Not Clear) <succ>
            bacterial cytoplasm --- Certainty = 0.0000 (Not Clear) <succ>
```

A related sequence was also identified in GAS <SEQ ID 9123> which encodes the amino acid sequence <SEQ ID 9124>. Analysis of this protein sequence reveals the following:

```
Possible site: 33
>>> Seems to have an uncleavable N-term signal seq
INTEGRAL    Likelihood = -12.05    Transmembrane 12-28
----- Final Results -----
    bacterial membrane --- Certainty = 0.5819 (Affirmative) <succ>
        bacterial outside --- Certainty = 0.0000 (Not Clear) <succ>
            bacterial cytoplasm --- Certainty = 0.0000 (Not Clear) <succ>
```

Lipop: Possible site: -1 Crend: 4
SRCFLG: 0
McG: Length of UR: 24
Peak Value of UR: 3.02
Net Charge of CR: 3
McG: Discrim Score: 12.27
GvH: Signal Score (-7.5): -3.44
Possible site: 22
>>> Seems to have an uncleavable N-term signal seq
Amino Acid Composition: calculated from 1
ALOM program          count: 1 value: -9.66  threshold: 0.0
INTEGRAL              Likelihood = -9.66   Transmembrane 12-28 (5-31)
PERIPHERAL            Likelihood = 1.96    118
modified ALOM score: 2.43
icml HYPID: 7 CFP: 0.486
*** Reasoning Step: 3
----- Final Results -----
    bacterial membrane --- Certainty = 0.4864 (Affirmative) <succ>
        bacterial outside --- Certainty = 0.0000 (Not Clear) <succ>
            bacterial cytoplasm --- Certainty = 0.0000 (Not Clear) <succ>

An alignment of the GAS and GBS proteins is shown below:

Identities = 178/282 (63%), Positives = 218/282 (77%)
Query:    5 LLLWFVMNKKKILTGLSFFLVSLLLSFGIFSLIIPKSNPKLTKKDFLTKKVIPLNYVALG    64
            L LWFVMN + + +G+ FF++SL L+F + ++IIPKSN +L K DFL K+ + + YVA+G
Sbjct:    1 LRLWFVMNNRHLFSGIFFFVISLCLAFLLLNIIIPKSNSRLKKSDFLKKEQVAIQYVAIG    60

Query:   65 DSLTEGVGDTTSQGGFVPLLSESLHNRYSYQVTSVNYGVSGNTSQQILKRMTTDPQIEKD   124
            DSLTEGVGD T QGGFVPLL+   L    +  V    NYGVSG+TSQQIL  RM    QI+
Sbjct:   61 DSLTEGVGDLTHQGGFVPLLTNDLSEYFKANVNHQNYGVSGDTSQQILDRMIKQKQIQLS   120

Query:  125 LEKADLLTLTVGGNDVLAVIRKELSHLSLNSFEKPAEAYKERLKEILAKARQDNPKLPIY   184
            L+KAD++TLTVGGNDV+AVIRK L+ L ++SF KPA    Y++RL++I+   AR+DN LPI+
Sbjct:  121 LKKADIMTLTVGGNDVMAVIRKNLADLQVSSFRKPARQYQKRLRQIIELARKDNKDLPIF   180

Query:  185 VLGIYNPFYLNFPQLTKMQTVIDNWNKATKEVVDASENVYFVPINDRLYKGINGKEGITE   244
            +LGIYNPFYLN P+LT MQ VID+WN TKEVV   + VYFVPIND LYKGING+EGI
Sbjct:  181 ILGIYNPFYLNEPELTDMQKVIDDWNTKTKEVVGEYDRVYFVPINDLLYKGINGQEGIVH   240

Query:  245 SSNSQASITNDALFTGDHFHPNNIGYQIMSNAVMEKINETRK                   286
            SS  Q +I NDALFTGDHFHPNN GYQIMSNAVMEKI + K
Sbjct:  241 SSGDQTTIVNDALFTGDHFHPNNTGYQIMSNAVMEKIKKHEK                   282
```

A related GBS gene <SEQ ID 5> and protein <SEQ ID 6> were also identified. Analysis of this protein sequence reveals the following:

The protein has homology with the following sequences in the databases:

```
56.0/80.3% over 272aa
GP|1850894| hypothetical protein Insert characterized
ORF02006(367-1164 of 1467)
GP|1850894|emb|CAA72096.1| |Y11213(5-277 of 280) hypothetical protein {Streptococcus
thermophilus}
% Match = 30.8
% Identity = 56.0 % Similarity = 80.2
Matches = 150 Mismatches = 49 Conservative Sub.s = 65

141       171       201       231       261       291       321       351
AV*RPSANG*IILLKVPKHEKLLKLASPTVVKLIWLITLEKN*LF*VLLYPF*KLAQSSKLILVRMHLLLWFVMNKKKIL
```

```
381        411        435        465        495        525        555        585
TGLSFFLVSLLLSFGIFSLIIPKSN--PKLTKKDFLTKKVIPLNYVALGDSLTEGVGDTTSQGGFVPLLSESLHNRYSYQ
 ::  |:: :||    ||: :|||  |:     |:: |     ||   : |||:|||||:||||:::|||||||:||::|  : :::|
SFAGFFLLFLLFVGILIFIIPSSHQSSKISDKIRSVKK-EKVTYVAIGDSLTQGVGDSSNQGGFVPVLSQALESDFNWQ
         10         20         30         40         50         60         70

615        645        675        705        735        765        795        825
VTSVNYGVSGNTSQQILKRMTTDPQIEKDLEKADLLTLTVGGNDVLAVIRKELSHLSLNSFEKPAEAYKERLKEILAKAR
||   |||::||||   ||||||       |::||:||  |:||||||||||:  ||:      :::|::|:|  |   |   |::||::|:    ||
VTPRNYGIAGNTSNQILKRMQEKKDIKRDLKAKLMTLTVGGNDVIHVIKDNITNLNVNTFSKAAVDYQKRLRQIIELAR
         90        100        110        120        130        140        150

855        885        915        945        975       1005                   1044
QDNPKLPIYVLGIYNPFYLNFPQLTKMQTVIDNWNKATKEVVDASENVYFVPINDRLYKGINGKEGIT-------ESSNS
::|   ||||::|||||||||||||::|:|||::||||::|:||    :|||||||:|| |||||||||  |:|            : :|
KENKTLPIYIIGIYNPFYLNFPEMTEMQTIVDNWNRSTEEVSKEYDNVYFVPVNDLLYKGINGKGGVTSSDETSQPTKSS
        170        180        190        200        210        220        230

1074       1104       1134       1164       1194       1224       1254       1284
QASITNDALFTGDHFHPNNIGYQIMSNAVMEKINETRKNWP*FKFLEMGISLIVGN*PFLHSSDCKSLNSST*A*YRKNF
|  |:  ||||||  ||||||||  |||||||:|::::||:|:|  |
QDSL-NDALFEEDHFHPNNTGYQIMSDAILKRINQTKKEWSGE
        250        260        270        280
```

Figure 36:
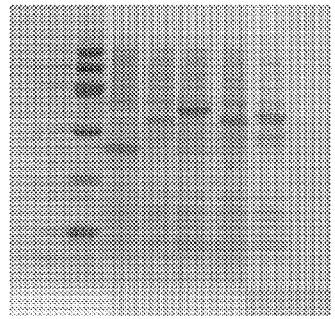

SEQ ID 6 (GBS103) was expressed in *E. coli* as a His-fusion product. SDS-PAGE analysis of total cell extract is shown in FIG. 36 (lane 4; MW 32 kDa).

The GBS103-His fusion product was purified (FIG. 107A; see also FIG. 201, lane 9) and used to immunise mice (lane 2+3 product; 18.5 μg/mouse). The resulting antiserum was used for Western blot (FIG. 107B), FACS (FIG. 107C) and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 4

A DNA sequence (GBSx1316) was identified in *S. agalactiae* <SEQ ID 3837> which encodes the amino acid sequence <SEQ ID 3838>. Analysis of this protein sequence reveals the following:

Possible site: 23
>>> Seems to have no N-terminal signal sequence
INTEGRAL   Likelihood = –4.30   Transmembrane 1058-1074 (1056-1075)
----- Final Results -----
   bacterial membrane --- Certainty = 0.2720 (Affirmative) <succ>
     bacterial outside --- Certainty = 0.0000 (Not Clear) <succ>
        bacterial cytoplasm --- Certainty = 0.0000 (Not Clear) <succ>

The protein has no significant homology with any sequences in the GENPEPT database.

No corresponding DNA sequence was identified in *S. pyogenes*.

A related GBS gene <SEQ ID 7> and protein <SEQ ID 8> were also identified. Analysis of this protein sequence reveals the following:

Lipop: Possible site: –1   Crend: 10
McG: Discrim Score: –13.26
GvH: Signal Score (–7.5): –5.76

Possible site: 41
>>> Seems to have no N-terminal signal sequence
ALOM program    count: 1 value: –4.30   threshold: 0.0
INTEGRAL        Likelihood = –4.30     Transmembrane 489-505 (487-506)
PERIPHERAL      Likelihood = 3.71      97
modified ALOM score: 1.36
*** Reasoning Step: 3
----- Final Results -----
   bacterial membrane --- Certainty = 0.2720 (Affirmative) <succ>
     bacterial outside --- Certainty = 0.0000 (Not Clear) <succ>
        bacterial cytoplasm --- Certainty = 0.0000 (Not Clear) <succ>
LPXTG motif: 478-482

Figure 24:
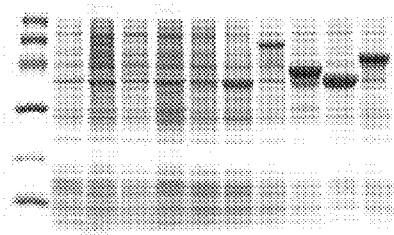
Figure 31:
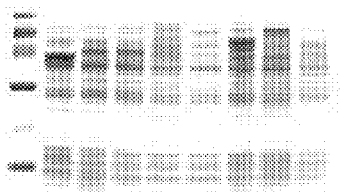

SEQ ID 8 (GBS195) was expressed in *E. coli* as a His-fusion product. SDS-PAGE analysis of total cell extract is shown in FIG. 24 (lane 8). It was also expressed in *E. coli* as a GST-fusion product. SDS-PAGE analysis of total cell extract is shown in FIG. 31 (lane 5).

Figure 175:

GBS195C was expressed in *E. coli* as a GST-fusion product. SDS-PAGE analysis of total cell extract is shown in FIG. 175 (lane 6 & 7; MW 81 kDa).

Figure 83:
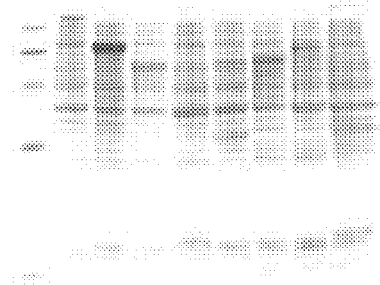

GBS195L was expressed in *E. coli* as a His-fusion product. SDS-PAGE analysis of total cell extract is shown in FIG. 83 (lane 2; MW 123 kDa).

GBS195LN was expressed in *E. coli* as a His-fusion product. SDS-PAGE analysis of total cell extract is shown in FIG. 83 (lane 3; MW 66 kDa).

Figure 198:
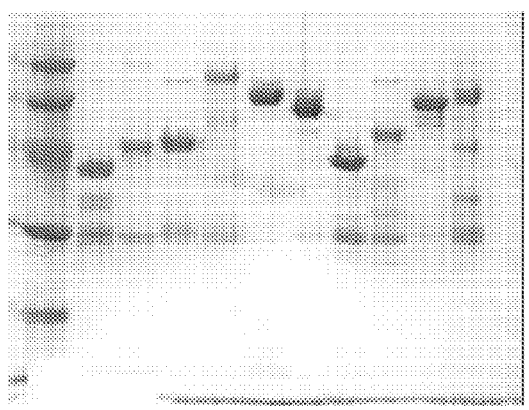
Figure 222:
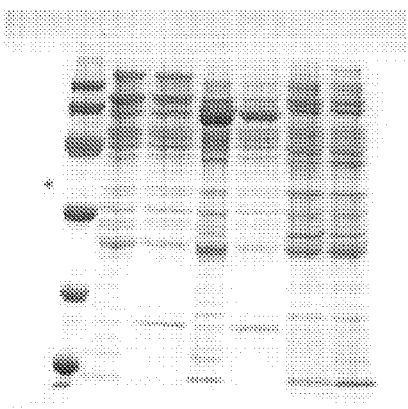

GBS195-GST was purified as shown in FIG. 198, lane 5. GBS195-His was purified as shown in FIG. 222, lane 4-5. GBS195N-His was purified as shown in FIG. 222, lane 6-7.

The GBS195-GST fusion product was purified (FIG. 87A) and used to immunise mice (lane 1 product; 13.6n/mouse). The resulting antiserum was used for Western blot (FIG. 87B), FACS, and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 5

A DNA sequence (GBSx0002) was identified in *S. agalactiae* <SEQ ID 4043> which encodes the amino acid sequence <SEQ ID 4044>. This protein is predicted to be lipoprotein MtsA. Analysis of this protein sequence reveals the following:

```
Possible site: 19
>>> Seems to have no N-terminal signal sequence
----- Final Results -----
    bacterial cytoplasm --- Certainty = 0.3361 (Affirmative) <succ>
       bacterial membrane --- Certainty = 0.0000 (Not Clear) <succ>
          bacterial outside --- Certainty = 0.0000 (Not Clear) <succ>
```

A related GBS nucleic acid sequence <SEQ ID 9403> which encodes amino acid sequence <SEQ ID 9404> was also identified.

A related DNA sequence was identified in *S. pyogenes* <SEQ ID 3177> which encodes the amino acid sequence <SEQ ID 3178>. Analysis of this protein sequence reveals the following:

```
Possible site: 13
>>> Seems to have no N-terminal signal sequence
----- Final Results -----
    bacterial cytoplasm --- Certainty = 0.2412 (Affirmative) <succ>
       bacterial membrane --- Certainty = 0.0000 (Not Clear) <succ>
          bacterial outside --- Certainty = 0.0000 (Not Clear) <succ>
```

An alignment of the GAS and GBS proteins is shown below:

```
Identities = 146/168 (86%), Positives = 161/168 (94%)
Query:   1 MNLENGIIYSKNIAKQLIARDPKNKATYEKNRDAYVAKLEKLDKEAKSKFNAIPANKKLI    60
           +NLENGIIYSKNIAKQLIAKDPKNK TYEKN  AYVAKLEKLDKEAKSKF+AI  NKKLI
Sbjct: 107 LNLENGIIYSKNIAKQLIAKDPKNKETYEKNLKAYVAKLEKLDKEAKSKFDAIAENKKLI   166

Query:  61 VTSEGCFKYFSKAYGVPSAYIWEINTEEEGTPDQITSLVKKLKQVRPSALFVESSVDKRP   120
           VTSEGCFKYFSKAYGVPSAYIWEINTEEEGTPDQI+SL++KLK ++PSALFVESSVD+RP
Sbjct: 167 VTSEGCFKYFSKAYGVPSAYIWEINTEEEGTPDQISSLIEKLKVIKPSALFVESSVDRRP   226

Query: 121 MKSVSRESGIPIYAEIFTDSTAKKGQKGDSYYAMMKNNLDKIAEGLAK              168
           M++VS++SGIPIY+EIFTDSIAKKG+ GDSYYAMMKWNLDKI+EGLAK
Sbjct: 227 METVSKDSGIPIYSEIFTDSIAKKGKPGDSYYAMMKWNLDKISEGLAK              274
```

Figure 164:
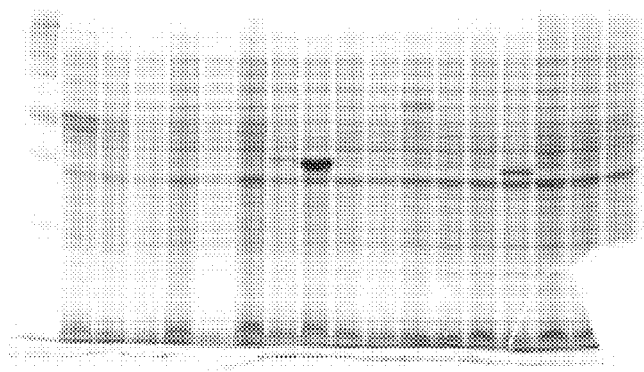
Figure 242:
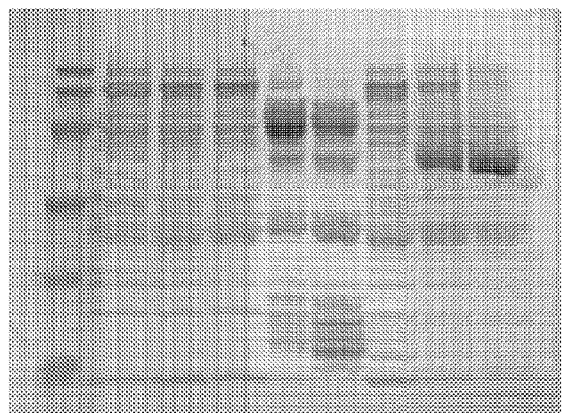

SEQ ID 9404 (GBS679) was expressed in *E. coli* as a His-fusion product. SDS-PAGE analysis of total cell extract is shown in FIG. 164 (lane 7-9; MW 36 kDa) and in FIG. 188 (lane 8; MW 36 kDa). Purified protein is shown in FIG. 242, lanes 9 & 10.

Based on this analysis, it was predicted that these proteins and their epitopes could be useful antigens for vaccines or diagnostics.

Example 6

A DNA sequence (GBSx0003) was identified in *S. agalactiae* <SEQ ID 8485> which encodes the amino acid sequence <SEQ ID 8486>. This protein is predicted to be ATP-binding protein MtsB. Analysis of this protein sequence reveals the following:

```
Possible site: 55
>>> Seems to have no N-terminal signal sequence
----- Final Results -----
    bacterial cytoplasm --- Certainty = 0.2097 (Affirmative) <succ>
       bacterial membrane --- Certainty = 0.0000 (Not Clear) <succ>
          bacterial outside --- Certainty = 0.0000 (Not Clear) <succ>
```

A related DNA sequence was identified in *S. pyogenes* <SEQ ID 8765> which encodes the amino acid sequence <SEQ ID 8766>. Analysis of this protein sequence reveals the following:

```
Possible site: 29
>>> Seems to have no N-terminal signal sequence
----- Final Results -----
    bacterial cytoplasm --- Certainty = 0.1929 (Affirmative) <succ>
       bacterial membrane --- Certainty = 0.0000 (Not Clear) <succ>
          bacterial outside --- Certainty = 0.0000 (Not Clear) <succ>
```

An alignment of the GAS and GBS proteins is shown below:

```
Identities = 143/238 (60%), Positives = 186/238 (78%), Gaps = 2/238 (0%)
Query:   1 MIISKHLSVSYDNNL-VLEDINLRLEGSGIIGILGPNGAGKSTLMKALLGLVDSTGESGI    59
           MI + +L V+YD N   LE IN+ +EG  I+GI+GPNGAGKST MKA+L L+D  G   +
Sbjct:  10 MITTNNLCVTYDGNSNALEAINVTIEGPSIVGIIGPNGAGKSTFMKAILNLIDYQGHVTV    69

Query:  60 GG-DLLPLMGRVAYVEQKTNIDYQFPITVGECVSLGLYKERGLFKRLSKIDWEKVSRVID   118
            G D   L    VAYVEQ++ IDY FPITV ECV+LG Y + GLF+R+ K  +E+V +V+
Sbjct:  70 DGKDGRKLGHTVAYVEQRSMIDYNFPITVKECVALGTYSKLGLFRRVGKKQFEQVDKVLK   129

Query: 119 QVGLRGFENRPINALSGGQFQRMLMARCLVQEADYIFLDEPFVGIDSISEQIIVNLLKKL   178
           QVGL  F +RPI +LSGGQFQRML+ARCL+QE+DYIFLDEPFVGIDS+SE+IIV+LLK+L
Sbjct: 130 QVGLEDFGHRPIKSLSGGQFQRMLVARCLIQESDYIFLDEPFVGIDSVSEKIIVDLLKEL   189

Query: 179 SKAGKLILVVHHDLSKVDHYFDQVIILNRHLIACGPIDQAFTRENLSAAYGDAILLGQ     236
            +AGK IL+VHHDLSKV+HYFD+++ILN+HL+A G + + FT + LS AYG+ ++LG+
Sbjct: 190 KMAGKTILIVHHDLSKVEHYFDKLMILNKHLVAYGNVCEVFTVDTLSKAYGNHLILGK     247
```

Based on this analysis, it was predicted that these proteins and their epitopes could be useful antigens for vaccines or diagnostics.

Example 7

A DNA sequence (GBSx0004) was identified in *S. agalactiae* <SEQ ID 9> which encodes the amino acid sequence <SEQ ID 10>. Analysis of this protein sequence reveals the following:

---

Possible site: 28
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 8

A DNA sequence (GBSx0005) was identified in *S. agalactiae* <SEQ ID 11> which encodes the amino acid sequence <SEQ ID 12>. This protein is predicted to be integral membrane protein MtsC (znuB). Analysis of this protein sequence reveals the following:

---

Lipop: Possible site: −1    Crend: 6
McG: Discrim Score: 3.77
GvH: Signal Score (−7.5): −0.47
Possible site: 45
>>> Seems to have a cleavable N-term signal seq.
INTEGRAL    Likelihood = −10.83    Transmembrane 138-154 (134-162)
INTEGRAL    Likelihood = −7.96    Transmembrane 60-76 (50-86)
INTEGRAL    Likelihood = −6.95    Transmembrane 95-111 (93-118)
INTEGRAL    Likelihood = −5.79    Transmembrane 180-196 (174-216)
INTEGRAL    Likelihood = −4.35    Transmembrane 198-214 (197-216)
INTEGRAL    Likelihood = −4.30    Transmembrane 250-266 (246-268)
INTEGRAL    Likelihood = −3.93    Transmembrane 222-238 (221-241)
PERIPHERAL    Likelihood = 5.94    116
modified ALOM score: 2.67
*** Reasoning Step: 3
----- Final Results -----
    bacterial membrane --- Certainty = 0.5331 (Affirmative) <succ>
    bacterial outside --- Certainty = 0.0000 (Not Clear) <succ>
    bacterial cytoplasm --- Certainty = 0.0000 (Not Clear) <succ>

---

A related DNA sequence was identified in *S. pyogenes* <SEQ ID 13> which encodes the amino acid sequence <SEQ ID 14>. Analysis of this protein sequence reveals the following:

---

Possible site: 45
>>> Seems to have a cleavable N-term signal seq.
INTEGRAL    Likelihood = −11.25    Transmembrane 138-154 (134-163)
INTEGRAL    Likelihood = −9.08    Transmembrane 66-82 (50-86)
INTEGRAL    Likelihood = −6.79    Transmembrane 95-111 (93-118)
INTEGRAL    Likelihood = −5.63    Transmembrane 180-196 (176-216)
INTEGRAL    Likelihood = −4.73    Transmembrane 221-237 (218-241)
INTEGRAL    Likelihood = −4.35    Transmembrane 250-266 (246-268)
INTEGRAL    Likelihood = −4.35    Transmembrane 198-214 (197-216)
INTEGRAL    Likelihood = −2.81    Transmembrane 48-64 (47-64)
----- Final Results -----
    bacterial membrane --- Certainty = 0.5501 (Affirmative) <succ>
    bacterial outside --- Certainty = 0.0000 (Not Clear) <succ>
    bacterial cytoplasm --- Certainty = 0.0000 (Not Clear) <succ>

---

An alignment of the GAS and GBS proteins is shown below:

```
Identities = 224/275 (81%), Positives = 255/275 (92%)
Query:   1  MFTKFFEGLLTYHFLQNAFITAIVIGIVAGAVGCFIILRSMSLMGDAISHAVLPGVAISF    60
            M  KFFEGL++YHFLQNA ITA+VIGIV+GAVGCFIILRSMSLMGDAISHAVLPGVA+SF
Sbjct:   1  MSMKFFEGLMSYHFLQNALITAVVIGIVSGAVGCFIILRSMSLMGDAISHAVLPGVALSF    60

Query:  61  ILGINFFIGAIVFGLLSSIIITYIKENSVIKGDTAIGITFSSFLALGIILIGLANSTTDL   120
            ILG+NFFIGAI+FGLL+S+IITYIKENSVIKGDTAIGITFSSFLALG+ILIG+ANS+TDL
Sbjct:  61  ILGVNFFIGAIIFGLLASVIITYIKENSVIKGDTAIGITFSSFLALGVILIGVANSSTDL   120

Query: 121  FHILFGNILAVQDSDKYMTIIVGLIVLTLITIFFKELLLTSFDPVLAKSMGMRVSFYHYL   180
            FHILFGNILAVQDSDK++TI V + VL +I++FFKELLLTSFDP+LAKSMG++V+ YHYL
Sbjct: 121  FHILFGNILAVQDSDKWITIGVSIFVLVVISLFFKELLLTSFDPILAKSMGVKVNAYHYL   180

Query: 181  LMILLTLVAVTAMQSVGTILIVALLITPAATAYLYVKSLRTMLFLSSALGAVASVLGLYI   240
            LM+LLTLVAVTAMQSVGTILIVALLITPAATAYL  SL+ ML +SS LGA+ASVLGLY+
Sbjct: 181  LMVLLTLVAVTAMQSVGTILIVALLITPAATAYLYANSLKVMLVMSSLLGALASVLGLYL   240

Query: 241  GYTFNIAAGSSIVLTSTFMLLAFLFSPKQSLFKK                           275
            GYTFN+AAGSSIVLTS  MFL++F  SPKQ   K+
Sbjct: 241  GYTFNVAAGSSIVLTSAMMFLISFFVSPKQGYLKR                           275
```

Example 9

A DNA sequence (GBSx0006) was identified in *S. agalactiae* <SEQ ID 15> which encodes the amino acid sequence <SEQ ID 16>. Analysis of this protein sequence reveals the following:

---

Possible site: 38
>>> Seems to have no N-terminal signal sequence
----- Final Results -----
   bacterial cytoplasm --- Certainty = 0.1280 (Affirmative) <succ>
     bacterial membrane --- Certainty = 0.0000 (Not Clear) <succ>
      bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 10

A DNA sequence (GBSx0007) was identified in *S. agalactiae* <SEQ ID 17> which encodes the amino acid sequence <SEQ ID 18>. This protein is predicted to be peptidyl-prolyl cis-trans isomerase 10 (rotamase). Analysis of this protein sequence reveals the following:

---

Lipop Possible site: 19 Crend: 2
McG: Discrim Score: 5.27
GvH: Signal Score (27.5): −4.14
Possible site: 19
>>> May be a lipoprotein
ALOM program    count: 0 value: 9.34 threshold: 0.0
PERIPHERAL          Likelihood = 9.34         89
modified ALOM score: −2.37
*** Reasoning Step: 3
----- Final Results -----
   bacterial membrane --- Certainty = 0.0000 (Not Clear) <succ>
     bacterial outside --- Certainty = 0.0000 (Not Clear) <succ>
      bacterial cytoplasm --- Certainty = 0.0000 (Not Clear) <succ>

---

The protein has homology with the following sequences in the GENPEPT database:

```
>GP:CAA19257 GB:AL023704 putative Cyclophilin-type peptidyl-prolyl
cis-trans isomerase protein [Schizosaccharomyces pombe]
Identities = 88/224 (39%), Positives = 123/224 (54%), Gaps = 46/224 (20%)
Query:  50 NKKTKQALKADKKAFPQLDKAVAKNEAQ----------VLIKTSKGDINIKLFPKYAPL  98
              N  TK  L +D+  + +      V  NE +            +I T++GDI+IKL+P+ AP
Sbjct: 419 NMSTKFTL-SDRDVYNEQVLPVTNNEGRQENGNILLGKAAIIHTTQGDISIKLYPEEAPK 477

Query:  99 AVENFLTHAKEGYYNGLSFHRVIKDFMIQSGDPNGDGTGGKSIWNSKDKKKDSGNGFVNE 158
              AV+NF THA+ GYY+    FHR+IK+FMIQ GDP GDGTGG+SIW      KKD    F +E
Sbjct: 478 AVQNFTTHAENGYYDNTIFHRIIKNFMIQGGDPLGDGTGGESIW-----KKD----FEDE 528

Query: 159 ISPYLYNIRG-SLAMANAGADTNGSQFFINQSQQDHSKQLSDKKVPKVIIKAYSEGGNPS 217
              ISP L + R   +++MAN+G +TNGSQFFI                              P
Sbjct: 529 ISPNLKHDRPFTVSMANSGPNTNGSQFFITTDL----------------------TPW 564

Query: 218 LDGGYTVFGQVISGMETVDKIASVEVTKSDQPKEKITITSIKVI                261
              LDG +T+F +  +G++ V +I    E   K D+P E    I +I ++
Sbjct: 565 LDGKHTIFARAYAGLDVVHRIEQGETDKYDRPLEPTKIINISIV                608
```

A related DNA sequence was identified in *S. pyogenes* <SEQ ID 19> which encodes the amino acid sequence <SEQ ID 20>. Analysis of this protein sequence reveals the following:

---

Possible site: 19
>>> May be a lipoprotein
----- Final Results -----
   bacterial membrane --- Certainty = 0.0000 (Not Clear) <succ>
     bacterial outside --- Certainty = 0.0000 (Not Clear) <succ>
      bacterial cytoplasm --- Certainty = 0.0000 (Not Clear) <succ>

---

The protein has homology with the following sequences in the databases:

```
>GP:CAB88542 GB:AL353818 putative protein [Arabidopsis thaliana]
Identities = 83/186 (44%), Positives = 104/186 (55%), Gaps = 34/186 (18%)
Query:  78 VVMRTSQGDITLKLFPKYAPLAVENFLTHAKKGYYDNLTFHRVINDFMIQSGDPKGDGTG 137
              V+M T+  GDI +KL+P+  P  VENF TH + GYYDN  FHRVI  FMIQ+GDP GDGTG
Sbjct: 476 VIMHTTLGDIHMKLYPEECPKTVENFITHCRNGYYDNLFHRVIRGFMIQTGDPLGDGTG 535

Query: 138 GESIWKGKDPKKDAGNGFVNEISPFLYHIRG-ALAMANAGANTNGSQFYINQNKKNQSKG 196
              G+SIW          G F +E     L H R    L+MANAG NTNGSQF+I
Sbjct: 536 GQSIW--------GREFEDEFHKSLRHDRPFTLSMANAGPNTNGSQFFITT-------- 578
```

```
Query: 197 LSSTNYPKPIISAYEHGGNPSLDGGYTVFGQVIDGMDVVDKIAATSINQNDKPEQDITIT 256
                           P LD +TVFG+V+ GMDVV  I     ++ND+P QD+ I
Sbjct: 579 ---------------VATPWLDNKHTVFGRVVKGMDVVQGIEKVKTDKNDRPYQDVKIL 622

Query: 257 SIDIVK                                                    262
           ++ + K
Sbjct: 623 NVTVPK                                                    628
```

An alignment of the GAS and GBS proteins is shown below:

```
Identities = 172/267 (64%), Positives = 221/267 (82%)
Query:   1 MKKITYLGLACVSILTLSGCESIERSLKGDRYVDQKLAENSSKEATEQLNKKTKQALKAD  60
           MKK++ L L  +S+L LS CES++R++KGD+Y+D+K A+  S+ A++   +  ++ALKAD
Sbjct:   1 MKKLLSLSLVAISLLNLSACESVDRAIKGDKYIDEKTAKEESEAASKAYEESIQKALKAD  60

Query:  61 KKAFPQLDKAVAKNEAQVLIKTSKGDINIKLFPKYAPLAVENFLTHAKEGYYNGLSFHRV 120
              FPQL K V K EA+V+++TS+GDI +KLFPKYAPLAVENFLTHAK+GYY+ L+FHRV
Sbjct:  61 ASQFPQLTKEVGKEEAKVVMRTSQGDITLKLFPKYAPLAVENFLTHAKKGYYDNLTFHRV 120

Query: 121 IKDFMIQSGDPNGDGTGGKSIWNSKDKKKDSGNGFVNEISPYLYNIRGSLAMANAGADTN 180
           I DFMIQSGDP GDGTGG+SIW  KD KKD+GNGFVNEISP+LY+IRG+LAMANAGA+TN
Sbjct: 121 INDFMIQSGDPKGDGTGGESIWKGKDPKKDAGNGFVNEISPFLYHIRGALAMANAGANTN 180

Query: 181 GSQFFINQSQQDHSKQLSDKKVPKVIIKAYSEGGNPSLDGGYTVFGQVISGMETVDKIAS 240
           GSQF+INQ++++ SK LS    PK II AY  GGNPSLDGGYTVFGQVI GM+ VDKIA+
Sbjct: 181 GSQFYINQNKKNQSKGLSSTNYPKPIISAYEHGGNPSLDGGYTVFGQVIDGMDVVDKIAA 240

Query: 241 VEVTKSDQPKEKITITSIKVIKDYKFK                                 267
           +  ++D+P++ ITITSI ++KDY+FK
Sbjct: 241 TSINQNDKPEQDITITSIDIVKDYRFK                                 267
```

Figure 51:
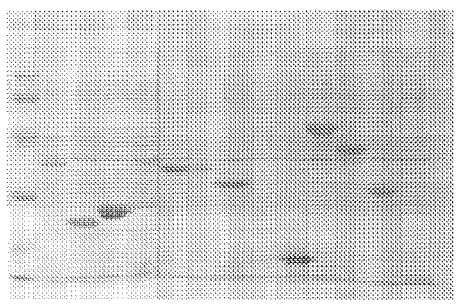

SEQ ID 18 (GBS205) was expressed in *E. coli* as a His-fusion product. SDS-PAGE analysis of total cell extract is shown in FIG. 51 (lane 13; MW 31 kDa).

Figure 206:
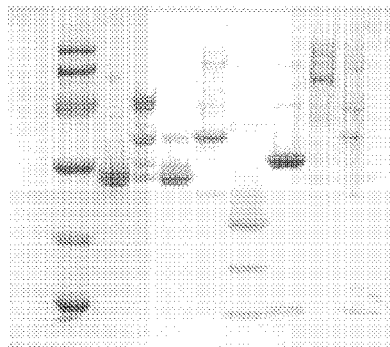

GBS205-His was purified as shown in FIG. 206, lane 8.

Based on this analysis, it was predicted that these proteins and their epitopes could be useful antigens for vaccines or diagnostics.

Example 11

A DNA sequence (GBSx0008) was identified in *S. agalactiae* <SEQ ID 21> which encodes the amino acid sequence <SEQ ID 22>. This protein is predicted to be sporulation protein SpoIIIE (ftsK). Analysis of this protein sequence reveals the following:

Lipop Possible site: –1 Crend: 10
McG: Discrim Score: –22.83
GvH: Signal Score (–7.5): –7.13

Possible site: 39
>>> Seems to have no N-terminal signal sequence
ALOM program   count: 5 value: –9.24 threshold: 0.0
INTEGRAL    Likelihood = –9.24   Transmembrane 36-52 (27-60)
INTEGRAL    Likelihood = –9.18   Transmembrane 162-178 (154-188)
INTEGRAL    Likelihood = –4.04   Transmembrane 597-613 (595-615)
INTEGRAL    Likelihood = –3.77   Transmembrane 63-79 (58-83)
INTEGRAL    Likelihood = –2.60   Transmembrane 90-106 (88-108)
PERIPHERAL  Likelihood = 1.32    136
modified ALOM score: 2.35
*** Reasoning Step: 3
----- Final Results -----
    bacterial membrane --- Certainty = 0.4694 (Affirmative) <succ>
       bacterial outside --- Certainty = 0.0000 (Not Clear) <succ>
       bacterial cytoplasm --- Certainty = 0.0000 (Not Clear) <succ>

A related GBS nucleic acid sequence <SEQ ID 10035> which encodes amino acid sequence <SEQ ID 10036> was also identified.

The protein has homology with the following sequences in the GENPEPT database:

```
>GP: CAB13553 GB: Z99112 DNA translocase [Bacillus subtilis]
Identities = 352/822 (42%), Positives = 508/822 (60%), Gaps = 70/822 (8%)
Query:  14 KTRRPTKAEIERQRAIQRMITALVLTIILFFGIIRLGIFGITVYNVIRFMVGSLAYLFIA  73
           K +R ++ + +Q I+ + L+   I   I++LG+ G T   + RF G      L +
Sbjct:   3 KKKRKSRKKQAKQLNIKYELNGLLCIAISIIAILQLGVVGQTFIYLFRFFAGEWFILCLL  62

Query:  74 ATLIYLYFFKWLRKKDSLV----AGFLIASLGLLIEWHAYLFS----MPILKDKEILRST 125
           L+      W +K  SL+       AG     +L+ H  LF       ++  ++R+T
Sbjct:  63 GLLVLGVSLFWKKKTPSLLTRRKAGLYCIIASILLLSHVQLFKNLTHKGSIESASVVRNT 122

Query: 126 ARLIVSDLMQFKITVFAGGGMLGALIYKPIAFLFSNIGAYMIGVLFIILGLFLMSSLEVY 185
             L + D+    +      GGGM+GAL++       FLF++ G+ ++ ++ I++G+ L++    +
Sbjct: 123 WELFLMDMNGSSASPDLGGGMIGALLFAASHFLFASTGSQIMAIVMILIGMILVTGRSLQ 182
```

-continued

```
Query: 186 DIVE--------FIR----AFKN--KVAEKHEQNKKERFAKREMKKAIAEQERIERQKAE 231
            + ++        FI+    AF + K  + +Q+ K+  A  ++K  +++++E +  +
Sbjct: 183 ETLKKWMSPIGRFIKEQWLAFIDDMKSFKSNMQSSKKTKAPSKKQKPARKKQQMEPEPPD 242

Query: 232 EEAYLASVNVDPETGEILEDQAEDNLDDALPPEVSETSTPVFEP-EILAYETSPQNDPLP 290
            EE   +V+  + I+   ++ N ++    P + + +  PV +P + +  ET   Q + +
Sbjct: 243 EEGDYETVSPLIHSEPIISSFSDRNEEEE-SPVIEKRAEPVSKPLQDIQPETGDQ-ETVS 300

Query: 291 VEPTIYLEDYDSPIPNMRENDEEMVYDLDDDVDDSDIENVDFTPKTTLVYKLPTIDLFAP 350
              P + E                         +EN D         Y++P++DL A
Sbjct: 301 APPMTFTE---------------------------LENKD--------YEMPSLDLLAD 324

Query: 351 DKPKNQSKEKDLVRKNIRVLEETFRSFGIDVKVERAEIGPSVTKYEIKPAVGVRVNRISN 410
              K   Q +K + +N R LE TF+SFG+  KV +  +GP+VTKYE+  P VGV+V++I N
Sbjct: 325 PKHTGQQADKKNIYENARKLERTFQSFGVKAKVTQVHLGPAVTKYEVYPDVGVKVSKIVN 384

Query: 411 LSDDLALALAAKDVRIETPIPGKSLIGIEVPNSEIATVSFRELWEQS-DANPENLLEVPL 469
            LSDDLALALAAKD+RIE PIPGKS IGIEVPN+E+A VS +E+ E   +  P+ + + L
Sbjct: 385 LSDDLALALAAKDIRIEAPIPGKSAIGIEVPNAEVAMVSLKEVLESKLNDRPDANVLIGL 444

Query: 470 GKAVNGNARSFNLARMPHLLVAGSTGSGKSVAVNGIISSILMKARPDQVKFMMIDPKMVE 529
            G+  ++G A     L +MPHLLVAG+TGSGKSV VNGII+SILM+A+P +VK MMIDPKMVE
Sbjct: 445 GRNISGEAVLAELNKMPHLLVAGATGSGKSVCVNGIITSILMRAKPHEVKMMMIDPKMVE 504

Query: 530 LSVYNDIPHLLIPVVTNPRKASKALQKVVDEMENRYELFSKIGVRNIAGYNTKVEEFNAS 589
            L+VYN IPHLL PVVT+P+KAS+AL+KVV+EME RYELFS  G RNI GYN ++  N
Sbjct: 505 LNVYNGIPHLLAPVVTDPKKASQALKKVVNEMERRYELFSHTGTRNIEGYNDYIKRANNE 564

Query: 590 SEQKQIPLPLIVVIVDELADLMMVASKEVEDAIIRLGQKARAAGIHMILATQRPSVDVIS 649
                KQ LP IVVIVDELADLMMVAS  +VED+I RL Q  ARAAGIH+I+ATQRPSVDVI+
Sbjct: 565 EGAKQPELPYIVVIVDELADLMMVASSDVEDSITRLSQMARAAGIHLIIATQRPSVDVIT 624

Query: 650 GLIKANVPSRIAFAVSSGTDSRTILDENGAEKLLGRGDMLFKPIDENHPVRLQGSFISDD 709
            G+IKAN+PSRIAF+VSS TDSRTILD  GAEKLLGRGDMLF P+  N PVR+QG+F SDD
Sbjct: 625 GVIKANIPSRIAFSVSSQTDSRTILDMGGAEKLLGRGDMLFLPVGANKPVRVQGAFLSDD 684

Query: 710 DVERIVGFIKDQAEADYDDAFDPGEVSETDNGSGGGGGVPESDPLFEEAKGLVLETQKAS 769
             +VE++V +  + Q +A Y     P E +ET +          +D L++EA L++  Q AS
Sbjct: 685 EVEKVVDHVITQQKAQYQEEMIPEETTETHS--------EVTDELYDEAVELIVGMQTAS 736

Query: 770 ASMIQRRLSVGFNRATRLMEELEAAGVIGPAEGTKPRKVLMT 811
             SM+QRR  +G+ RA RL++ +E   GV+GP  EG+KPR+VL++
Sbjct: 737 VSMLQRRFRIGYTRAARLIDAMEERGVVGPYEGSKPREVLLS 778
```

46.5/66.5% over 775aa
OMNI|NT01BS1964| sporulation protein SpoIIIE Insert
characterized

---

```
46.5/66.5% over 775aa
 OMNI|NT01BS1964(6-781 of 790) sporulation protein SpoIIIE Insert characterized
ORF01349(340-2733 of 3048)
OMNI|NT01BS1964(6-781 of 790) sporulation protein SpoIIIE
% Match = 29.6
% Identity = 46.4 % Similarity = 66.5
Matches = 352 Mismatches = 243 Conservative Sub.s = 152

90        120       150       180       210       240       270       300
TLN*LATT*S*YTDTG*TKINNFFHTYSLIKLLR*LYFIINF*IIYKSK**TYWGTC*NYDRIV*HELIEKVRNKYFT*N 330       360       390       420       450       480       510       540
MVFMANKKKTKGKKTRRPTKAEIERQRAIQRMITALVLTIILFFGIIRLGIFGITVYNVIRFMVGSLAYLFIAATLIYLY
                |:| ::  :   :|   |:  :   |:     |   |::||: || |   :|| |   |:   |:
            VMSVAKKKRKSRKKQAKQLNIKYELNGLLCIAISIIAILQLGVVGQTFIYLFRFFAGEWFILCLLGLLVLGV
                10        20        30        40        50        60        70
```

```
         570       588       618       648       666       696       726       756
         FFKWLRKKDSLV----AGFLIASLGLLIEWHAYLFSMPILK----DKEILRSTARLIVSDLMQFKITVFAGGGMLGALIY
         :|  :  ||:    ||:    :|:  |  ||    |   ::|:|   |  :|:     :   ||||:|||::
         SLFWKKKTPSLLTRRKAGLYCIIASILLLSHVQLFKNLTHKGSIESASVVRNTWELFLMDMNGSSASPDLGGGMIGALLF
                    90        100       110       120       130       140       150

786       816       846                     894           924       954
         KPIAFLFSNIGAYMIGVLFIILGLFLMSSLEVYDIVE--------FIR----AF--KNKVAEKHEQNKKERFAKREMKKA
         |||::  |::  |::  :  |::|     :  :     :      |||         :  |: |    |:  |    : :|
         AASHFLFASTGSQIMAIVMILIGMILVTGRSLQETLKKWMSPIGRFIKEQWLAFIDDMKSFKSNMQSSKKTKAPSKKQKP
         170       180       190       200       210       220       230

984       1014      1044      1074      1104      1134      1164      1194
         IAEQERIERQKAEEEAYLASVNVDPETGEILEDQAEDNLDDALPPEVSETSTPVFEPEILAYETSPQNDPLPVEPTIYLE
         ::::::|  :   :||     :|:       :  |:       ::  |  ::    |  :  :  ||  :|
         ARKKQQMEPEPPDEEGDYETVSPLIHSEPIISSFSDRN-EEEESPVIEKRAEPVSKP-----------------------
         250       260       270       280

1224      1254      1281              1326      1356      1386      1416
         DYDSPIPNMRENDEEMVYDLDD-DVDDSDIENVDFTPKT-----TLVYKLPTIDLFAPDKPKNQSKEKDLVRKNIRVLEE
                |  |   |||    ||    |                |::|::||:|   |   :|  |   |  : ||  :
         ------------------LQDIQPETGDQETVSAPPMTFTELENKDYEMPSLDLLADPKHTGQQADKKNIYENARKLER
                             290       300       310       320       330       340

1446      1476      1506      1536      1566      1596      1626      1656
         TFRSFGIDVKVERAEIGPSVTKYEIKPAVGVRVNRISNLSDDLALALAAKDVRIETPIPGKSLIGIEVPNSEIATVSFRE
         ||:|||   ||    :||:||||:   |  ||:::|  ||||||||||||:|||  ||||||  ||||||||::|   ||::|
         TFQSFGVKAKVTQVHLGPAVTKYEVYPDVGVKVSKIVNLSDDLALALAAKDIRIEAPIPGKSAIGIEVPNAEVAMVSLKE
         360       370       380       390       400       410       420

1683      1713      1743      1773      1803      1833      1863      1893
         LWEQS-DANPENLLEVPLGKAVNGNARSFNLARMPHLLVAGSTGSGKSVAVNGIISSILMKARPDQVKFMMIDPKMVELS
         :|   :  |:    :   :: || ::|   |  |:|||||||:|||||||  ||||:|||:|:|   :|| ||||||||||:
         VLESKLNDRPDANVLIGLGRNISGEAVLAELNKMPHLLVAGATGSGKSVCVNGIITSILMRAKPHEVKMMMIDPKMVELN
         440       450       460       470       480       490       500

1923      1953      1983      2013      2043      2073      2103      2133
         VYNDIPHLLIPVVTNPRKASKALQKVVDEMENRYELFSKIGVRNIAGYNTKVEEFNASSEQKQIPLPLIVVIVDELADLM
         |||  |||||  |||:|||| |||||:|  ||||||   :|||||  ::  ||  ||  ||  |||||||||||||||||
         VYNGIPHLLAPVVTDPKKASQALKKVVNEMERRYELFSHTGTRNIEGYNDYIKRANNEEGAKQPELPYIVVIVDELADLM
         520       530       540       550       560       570       580

2163      2193      2223      2253      2283      2313      2343      2373
         MVASKEVEDAIIRLGQKARAAGIHMILATQRPSVDVISGLIKANVPSRIAFAVSSGTDSRTILDENGAEKLLGRGDMLFK
         ||||  :|||:|  ||   ||||||:|:|||||||||:|||||:|||||:|||||:|||||||||||  |||||||||||||
         MVASSDVEDSITRLSQMARAAGIHLIIATQRPSVDVITGVIKANIPSRIAFSVSSQTDSRTILDMGGAEKLLGRGDMLFL
         600       610       620       630       640       650       660

2403      2433      2463      2493      2523      2553      2583      2613
         PIDENHPVRLQGSFISDDDVERIVGFIKDQAEADYDDAFDPGEVSETDNGSGGGGGVPESDPLFEEAKGLVLETQKASAS
         |:  |   |||:|:|:|||::    :   |:|  |  | :||                 :| |::||  |::   ||| |
         PVGANKPVRVQGAFLSDDEVEKVVDHVITQQKAQYQEEMIPEETTET-------HSEVTDELYDEAVELIVGMQTASVS
         680       690       700       710              720       730       740

2643      2673      2703      2733      2763      2793      2823      2853
         MIQRRLSVGFNRATRLMEELEAAGVIGPAEGTKPRKVLMTPTPSE*EKTNLTRNCRISFLCYNEANR*RRRLRMHIETVI
         |:|||  :|:    || ||    ||:::    || ||:  :||:|:||
         MLQRRFRIGYTRAARLIDAMEERGVVGPYEGSKPREVLLSKEKYDELSS
         760       770       780       790
```

A related DNA sequence was identified in *S. pyogenes* <SEQ ID 23> which encodes the amino acid sequence <SEQ ID 24>. Analysis of this protein sequence reveals the following:

Possible site: 51

>>> Seems to have no N-terminal signal sequence

INTEGRAL  Likelihood = -9.45  Transmembrane 31-47 (25-55)
INTEGRAL  Likelihood = -7.17  Transmembrane 160-176 (153-183)
INTEGRAL  Likelihood = -4.99  Transmembrane 93-109 (86-111)
INTEGRAL  Likelihood = -4.04  Transmembrane 586-602 (584-604)
INTEGRAL  Likelihood = -1.22  Transmembrane 64-80 (64-80)

----- Final Results ----- bacterial membrane --- Certainty = 0.4779 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the databases:

```
!GB: Z99112 DNA translocase [Bacillus subtilis] 601 e-170
Identities = 354/816 (43%), Positives = 499/816 (60%), Gaps = 69/816 (8%)
Query:   11 APKKRLTKAEVEKQRAIKRMILSVLMALLLIFAMLRLGVFGVTTYNMIRFLVGSLAYPFM    70
            A KKR ++ +  KQ  IK + +L   + I A+L+LGV G T   + RF  G        +
Sbjct:    2 AKKKRKSRKKQAKQLNIKYELNGLLCIAISIIAILQLGVVGQTFIYLFRFFAGEWFILCL   61

Query:   71 FAWLIYLFCFKWLRQKDGMI----AGVVIAFLGLLVEWHAFLFA----MPRMLDQDIFLG  122
            L+       W ++   ++    AG+     +L+ H LF        +     +
Sbjct:   62 LGLLVLGVSLFWKKKTPSLLTRRKAGLYCIIASILLLSHVQLFKNLTHKGSIESASVVRN  121

Query:  123 TARLITRDLLALRVTEFVGGGMLGALLYKPIAFLFSNIGSYFIGFLFILLGLFLMTPWDI  182
            T   L   D+    +  +GGGM+GALL+     FLF++ GS + +  IL+G+ L+T   +
Sbjct:  122 TWELFLMDMNGSSASPDLGGGMIGALLFAASHFLFASTGSQIMAIVMILIGMILVTGRSL  181

Query:  183 YD--------VSHFVKEA----VDKLAVAYQENKEKRFIKREEHRLQAEKEALEKQAQEE  230
            +          +   F+KE      +D +   +++ N +     K+ +     +K A +KQ  E
Sbjct:  182 QETLKKWMSPIGRFIKEQWLAFIDDMK-SFKSNMQSS--KKTKAPSKKQKPARKKQMEP  238

Query:  231 EKRLAELTVDPETGEIVEDSQSQVSYDLAEDMT-KEPEILAYDSHLKDDETSLFDQ----  285
            E           E G+             Y+     +  EP I ++     +++E+ +  ++
Sbjct:  239 EP-------PDEEGD----------YETVSPLIHSEPIISSFSDRNEEEESPVIEKRAEP  281

Query:  286 --EDLAYAHEEIGAYDSLSALASSEDEMDMDEPVEVDFTPKTHLLYKLPTIDLFAPDKPK  343
              + L     E G   +++SA   + E++    +                Y++P++DL A  K
Sbjct:  282 VSKPLQDIQPETGDQETVSAPPMTFTELENKD-------------YEMPSLDLLADPKHT  328

Query:  344 NQSKEKNLVRKNIKVLEDTFQSFGIDVKVERAEIGPSVTKYEIKPAVGVRVNRISNLADD  403
            Q  +K  + +N  + LE TFQSFG+  KV   +GP+VTKYE+ P VGV+V++I NL+DD
Sbjct:  329 GQQADKKNIYENARKLERTFQSFGVKAKVTQVHLGPAVTKYEVYPDVGVKVSKIVNLSDD  388

Query:  404 LALALAAKDVRIEAPIPGKSLIGIEVPNSEIATVSFRELWEQS-DANPENLLEVPLGKAV  462
            LALALAAKD+RIEAPIPGKS IGIEVPN+E+A VS +E+ E   + P+ +  + LG+ +
Sbjct:  389 LALALAAKDIRIEAPIPGKSAIGIEVPNAEVAMVSLKEVLESKLNDRPDANVLIGLGRNI  448

Query:  463 NGNARSFNLARMPHLLVAGSTGSGKSVAVNGIISSILMKARPDQVKFMMIDPKMVELSVY  522
            +G A     L +MPHLLVAG+TGSGKSV VNGII+SILM+A+P +VK MMIDPKMVEL+VY
Sbjct:  449 SGEAVLAELNKMPHLLVAGATGSGKSVCVNGIITSILMRAKPHEVKMMMIDPKMVELNVY  508

Query:  523 NDIPHLLIPVVTNPRKASKALQKVVDEMENRYELFSKIGVRNIAGYNTKVEEFNASSEQK  582
            N IPHLL PVVT+P+KAS+AL+KVV+EME RYELFS  G RNI GYN   ++  N      K
Sbjct:  509 NGIPHLLAPVVTDPKKASQALKKVVNEMERRYELFSHTGTRNIEGYNDYIKRANNEEGAK  568

Query:  583 QIPLPLIVVIVDELADLMMVASKEVEDAIIRLGQKARAAGIHMILATQRPSVDVISGLIK  642
            Q LP  IVVIVDELADLMMVAS +VED+I RL Q ARAAGIH+I+ATQRPSVDVI+G+IK
Sbjct:  569 QPELPYIVVIVDELADLMMVASSDVEDSITRLSQMARAAGIHLIIATQRPSVDVITGVIK  628

Query:  643 ANVPSRMAFAVSSGTDSRTILDENGAEKLLGRGDMLFKPIDENHPVRLQGSFISDDDVER  702
            AN+PSR+AF+VSS TDSRTILD  GAEKLLGRGDMLF P+   N PVR+QG+F SDD+VE+
Sbjct:  629 ANIPSRIAFSVSSQTDSRTILDMGGAEKLLGRGDMLFLPVGANKPVRVQGAFLSDDEVEK  688

Query:  703 IVNFIKDQTEADYDDAFDPGEVSDNDPGFSGNGGAAEGDPLFEEAKALVLETQKASASMI  762
            +V+ +  Q +A Y +  P E ++       +      D L++EA  L++  Q AS SM+
Sbjct:  689 VVDHVITQQKAQYQEEMIPEETTETHSEVT--------DELYDEAVELIVGMQTASVSML  740

Query:  763 QRRLSVGFNRATRLMDELEFAGVIGPAEGTKPRKVL                          798
            QRR  +G+  RA RL+D +EE GV+GP EG+KPR+VL
Sbjct:  741 QRRFRIGYTRAARLIDAMEERGVVGPYEGSKPREVL                          776
```

An alignment of the GAS and GBS proteins is shown below:

```
Identities = 620/818 (75%), Positives = 701/818 (84%), Gaps = 25/818 (3%)
Query:    1 MVFMANKKKTKGKKTRRPTKAEIERQRAIQRMITALVLTIILFFGIIRLGIFGITVYNVI   60
            MV   +KK+  KK R TKAE+E QRAI+RMI ++++  ++L F ++RLG FG+T YN+I
```

-continued

```
Sbjct:    1 MVKRNQRKKSAPKK--RLTKAEVEKQRAIKRMILSVLMALLLIFAMLRLGVFGVTTYNMI      58

Query:   61 RFMVGSLAYLFIAATLIYLYFFKWLRKKDSLVAGFLIASLGLLIEWHAYLFSMPILKDKE    120
            RF+VGSLAY F+ A LIYL+ FKWLR+KD ++AG +IA LGLL+EWHA+LF+MP + D++
Sbjct:   59 RFLVGSLAYPFMFAWLIYLFCFKWLRQKDGMIAGVVIAFLGLLVEWHAFLFAMPRMLDQD    118

Query:  121 ILRSTARLIVSDLMQFKITVFAGGGMLGALIYKPIAFLFSNIGAYMIGVLFIILGLFLMS    180
            I    TARLI  DL+  ++T F GGGMLGAL+YKPIAFLFSNIG+Y IG LFI+LGLFLM+
Sbjct:  119 IFLGTARLITRDLLALRVTEFVGGGMLGALLYKPIAFLFSNIGSYFIGFLFILLGLFLMT    178

Query:  181 SLEVYDIVEFIRAFKNKVAEKHEQNKKERFAKREMKKAIAEQERIERQKAEEEAYLASVN    240
            ++YD+  F++   +K+A  +++NK++RF KRE +  AE+E +E+Q  EEE  LA +
Sbjct:  179 PWDIYDVSHFVKEAVDKLAVAYQENKEKRFIKREEHRLQAEKEALEKQAQEEEKRLAELT    238

Query:  241 VDPETGEILEDQAEDNLDDALPPEVSETSTPVFEPEILAYETSPQNDPLPV---EPTIYL    297
            VDPETGEI+ED       + +++E  T   EPEILAY++  ++D  +    E    Y
Sbjct:  239 VDPETGEIVEDSQSQ-----VSYDLAEDMTK--EPEILAYDSHLKDDETSLFDQEDLAYA    291

Query:  298 ED----YDSPIPNMRENDEEMVYDLDDDVDDSDIENVDFTPKTTLVYKLPTIDLFAPDKP    353
               +    YDS +  +   +++EM  D+D+ V+       VDFTPKT L+YKLPTIDLFAPDKP
Sbjct:  292 HEEIGAYDS-LSALASSEDEM--DMDEPVE------VDFTPKTHLLYKLPTIDLFAPDKP    342

Query:  354 KNQSKEKDLVRKNIRVLEETFRSFGIDVKVERAEIGPSVTKYEIKPAVGVRVNRISNLSD    413
            KNQSKEK+LVRKNI+VLE+TF+SFGIDVKVERAEIGPSVTKYEIKPAVGVRVNRISNL+D
Sbjct:  343 KNQSKEKNLVRKNIKVLEDTFQSFGIDVKVERAEIGPSVTKYEIKPAVGVRVNRISNLAD    402

Query:  414 DLALALAAKDVRIETPIPGKSLIGIEVPNSEIATVSFRELWEQSDANPENLLEVPLGKAV    473
            DLALALAAKDVRIE PIPGKSLIGIEVPNSEIATVSFRELWEQSDANPENLLEVPLGKAV
Sbjct:  403 DLALALAAKDVRIEAPIPGKSLIGIEVPNSEIATVSFRELWEQSDANPENLLEVPLGKAV    462

Query:  474 NGNARSFNLARMPHLLVAGSTGSGKSVAVNGIISSILMKARPDQVKFMMIDPKMVELSVY    533
            NGNARSFNLARMPHLLVAGSTGSGKSVAVNGIISSILMKARPDQVKFMMIDPKMVELSVY
Sbjct:  463 NGNARSFNLARMPHLLVAGSTGSGKSVAVNGIISSILMKARPDQVKFMMIDPKMVELSVY    522

Query:  534 NDIPHLLIPVVTNPRKASKALQKVVDEMENRYELFSKIGVRNIAGYNTKVEEFNASSEQK    593
            NDIPHLLIPVVTNPRKASKALQKVVDEMENRYELFSKIGVRNIAGYNTKVEEFNASSEQK
Sbjct:  523 NDIPHLLIPVVTNPRKASKALQKVVDEMENRYELFSKIGVRNIAGYNTKVEEFNASSEQK    582

Query:  594 QIPLPLIVVIVDELADLMMVASKEVEDAIIRLGQKARAAGIHMILATQRPSVDVISGLIK    653
            QIPLPLIVVIVDELADLMMVASKEVEDAIIRLGQKARAAGIHMILATQRPSVDVISGLIK
Sbjct:  583 QIPLPLIVVIVDELADLMMVASKEVEDAIIRLGQKARAAGIHMILATQRPSVDVISGLIK    642

Query:  654 ANVPSRIAFAVSSGTDSRTILDENGAEKLLGRGDMLFKPIDENHPVRLQGSFISDDDVER    713
            ANVPSR+AFAVSSGTDSRTILDENGAEKLLGRGDMLFKPIDENHPVRLQGSFISDDDVER
Sbjct:  643 ANVPSRMAFAVSSGTDSRTILDENGAEKLLGRGDMLFKPIDENHPVRLQGSFISDDDVER    702

Query:  714 IVGFIKDQAEADYDDAFDPGEVSETDNGSGGGGGVPESDPLFEEAKGLVLETQKASASMI    773
            IV FIKDQ EADYDDAFDPGEVS+ D G  G GG   E DPLFEEAK LVLETQKASASMI
Sbjct:  703 IVNFIKDQTEADYDDAFDPGEVSDNDPGFSGNGGAAEGDPLFEEAKALVLETQKASASMI    762

Query:  774 QRRLSVGFNRATRLMEELEAAGVIGPAEGTKPRKVLMT                         811
            QRRLSVGFNRATRLM+ELE AGVIGPAEGTKPRKVL T
Sbjct:  763 QRRLSVGFNRATRLMDELEEAGVIGPAEGTKPRKVLQT                         800
```

Figure 147:
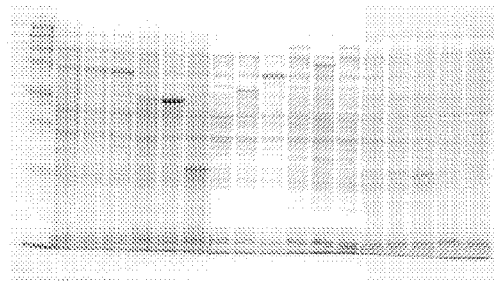

SEQ ID 22 (GBS272d) was expressed in *E. coli* as a GST-fusion product. SDS-PAGE analysis of total cell extract is shown in FIG. 147 (lane 9; MW 55 kDa+lane 10; MW 70 kDa). It was also expressed in *E. coli* as a His-fusion product. SDS-PAGE analysis of total cell extract is shown in FIG. 147 (lane 11 & 13; MW 85 kDa+lane 12; MW 74 kDa).

Based on this analysis, it was predicted that these proteins and their epitopes could be useful antigens for vaccines or diagnostics.

Example 12

A DNA sequence (GBSx0009) was identified in *S. agalactiae* <SEQ ID 25> which encodes the amino acid sequence <SEQ ID 26>. This protein is predicted to be para-aminobenzoate synthetase (pabB) (pabB). Analysis of this protein sequence reveals the following:

Possible site: 61
>>> Seems to have no N-terminal signal sequence
----- Final Results -----
    bacterial cytoplasm --- Certainty = 0.4073 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database:

```
>GP: AAD07357 GB: AE000547 para-aminobenzoate synthetase (pabB)
[Helicobacter pylori 26695]
Identities = 204/580 (35%), Positives = 325/580 (55%), Gaps = 50/580 (8%)
Query:  16 YRFKNPTKELIADTLEQVLEVIKEVDYYQSQNYYVVGYLSYEASAAF-DSHFKVSQQKLA           74
           ++++    K+L A  L ++   +  +    +   Y+V GYL YEA  AF D +F+       L Sbjct:   6 FKYQKSVKKLTATNLNELKNALDFISQNRGNGYFV-GYLLYEARLAFLDENFQSQTPFLY            64

Query:  75 GEHLAY---FTVHKDCENEAFPLSYENVRLADNWTANVSEQEYQEAIANIKGQIRQGNTY          131
            E       +++   E+  +P +       +++ ++ Y +    +K +++ G+TY Sbjct:  65 FEQFLERKKYSLEPLKEHAFYPKIH----------SSLDQKTYFKQFKAVKERLKNGDTY          114

Query: 132 QVNYTLELSQQLCSDPFSVYERLMVEQGAGYNAYIAYDDKRILSVSPELFFKKK--DEVL          189
           QVN T++L    + P   V++ ++    Q    + A+I  +     +LS SPELFF+ +  D  +

Sbjct: 115 QVNLTMDLFLDTKAKPKRVFKEVVHNQNTPFKAFIENEFGSVLSFSPELFFELEFLDTAI          174

Query: 190 T--TRPMKGTSARKPTYQEDVAERDWLANDPKNRSENMMIVDLLRNDMGRICDVGTVKVK          247
               T+PMKGT AR         D    R +L ND KNRSEN+MIVDLLRND+ R+       +VKV Sbjct: 175 KIITKPMKGTIARSKNPLIDEKNRLFLQNDDKNRSENVMIVDLLRNDLSRLALKNSVKVN          234

Query: 248 KLCQVEQYATVWQMTSTIEGVLSPEVTLMSIFQALYPCGSITGAPKISTMAIINELEKRP          307
           +L ++     +V+QM S  IE   L  + +L   IF+AL+PCGS+TG PKI TM II   LEKRP Sbjct: 235 QLFEIISLPSVYQMISEIEAKLPLKTSLFEIFKALFPCGSVTGCPKIKTMQIIESLEKRP          294

Query: 308 RGIYCGTIGLCMPDGQAIFNVPIRTVQMKGQQ--AYYGVGGGITWESQTDSEYEETRQKS          365
           RG+YCG IG+  + +A+F+VPIRT++ +   +   GVG   G+T++S+     EYEE+ KS Sbjct: 295 RGVYCGAIGM-VEEKKALFSVPIRTLEKRVHENFLHLGVGSGVTYKSKAPKEYEESFLKS          353

Query: 366 -AVLTRVNPKFQLITTGRV--TENKLLFSQQ--HVERLVESASYFAYSFDKSKFERELKK          420
            V+ ++   +F+++ T ++      + KL  + +  H ERL+ S   YF  + +D++    + EL Sbjct: 354 FFVMPKI--EFEIVETMKIIKKDQKLEINNKNAHKERLMNSTRYFNFKYDENLLDFEL--          409

Query: 421 YLHQLDEKDYRLKIMLDKTGKVTFEVKQLVNLSKKFLTAEVVVQDYPI-KLSPFTYFKTS          479
                   EK+  L+++L+K GK+   E K  L           L           + E+ + +  PI  K  + F Y  KT+

Sbjct: 410 ------EKEGVLRVLLNKKGKLIKEYKTLEPLK----SLEIRLSEAPIDKRNDFLYHKTT          459

Query: 480 YRPHIIEGQN--------EKIFVSPEGLLLETSIGNIVLEKNGRFLTPDLSEGGLNGIYR          531
           Y P     + +              ++IF + +   L E +   N+VLE  + R  LTP   S G  LNG Sbjct: 460 YAPFYQKARALIKKGVMFDEIFYNQDLELTEGARSNLVLEIHNRLLTPYFSAGALNGTGV          519

Query: 532 RHLLKNQKVIEAPLTLKDLESADAIYACNAVRGLYPLNLK                               571
              LLK   V   APL L+DL+ A   IY    NA+  GL    +  +K Sbjct: 520 VGLLKKGLVGHAPLKLQDLQKASKIYCINALYGLVEVKIK                              559
```

A related DNA sequence was identified in *S. pyogenes* <SEQ ID 27> which encodes the amino acid sequence <SEQ ID 28>. Analysis of this protein sequence reveals the following:

Possible site: 31
>>> Seems to have no N-terminal signal sequence

----- Final Results -----
    bacterial cytoplasm --- Certainty = 0.2669 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below:

```
Identities = 303/572 (52%), Positives = 406/572 (70%), Gaps = 1/572 (0%)
Query:   1 MHIETVIDFKELGKRYRFKNPTKELIADTLEQVLEVIKEVDYYQSQNYYVVGYLSYEASA           60
           MH +T+IDFKELG+RY F  P  EL+A +L+QV  VI++V +YQ    YYVVGYLSYEA+A
```

```
-continued
Sbjct:    3 MHRKTIIDFKELGQRYLFDEPLVELVAKSLDQVGPVIEKVQHYQQLGYYVVGYLSYEAAA        62

Query:   61 AFDSHFKVSQQKLAGEHLAYFTVHKDCENEAFPLSYENVRLADNWTANVSEQEYQEAIAN       120
            FD+  +    +L  E+LAYFTVHK C+ +  PL Y+++ + + W +    ++ YQ+AI
Sbjct:   63 FFDNALQTHNDRLGNEYLAYFTVHKTCQKKDLPLDYDSITIPNQWVSATQKEAYQKAIET       122

Query:  121 IKGQIRQGNTYQVNYTLELSQQL-CSDPFSVYERLMVEQGAGYNAYIAYDDKRILSVSPE       179
            I   +++QGNTYQVNYTL+L+Q+L  +D   ++Y +L+VEQ AGYNAYIA+D+  ++S SPE
Sbjct:  123 IHREMQQGNTYQVNYTLQLTQELNAADSLAIYNKLVVEQAAGYNAYIAHDEFAVISASPE       182

Query:  180 LFFKKKDEVLTTRPMKGTSARKPTYQEDVAERDWLANDPKNRSENMMIVDLLRNDMGRIC       239
            LFFK++    LTTRPMKGT+ R       D   E DWL  D KNRSENMMIVDLLRNDMG+IC
Sbjct:  183 LFFKQEGNRLTTRPMKGTTKRGVNSWLDQQEHDWLQADGKNRSENMMIVDLLRNDMGKIC       242

Query:  240 DVGTVKVKKLCQVEQYATVWQMTSTIEGVLSPEVTLMSIFQALYPCGSITGAPKISTMAI       299
              G+V+V  +LC+VE+Y+TVWQMTSTI  G  L  +   L+ I  +AL+PCGSITGAPK+STMAI
Sbjct:  243 QTGSVRVDRLCEVERYSTVWQMTSTIVGDLKADCDLIDILKALFPCGSITGAPKVSTMAI       302

Query:  300 INELEKRPRGIYCGTIGLCMPDGQAIFNVPIRTVQMKGQQAYYGVGGGITWESQTDSEYE       359
            I  LE +PRGIYCG+IG+C+PDG+  FNVPIRT+Q+   QA  YGVGGGITW+S+ +  EYE
Sbjct:  303 ITSLEPKPRGIYCGSIGICLPDGRRFFNVPIRTIQLSHNQATYGVGGGITWQSKWEDEYE       362

Query:  360 ETRQKSAVLTRVNPKFQLITTGRVTENKLLFSQQHVERLVESASYFAYSFDKSKFERELK       419
            E  QK+A L R    F L TT +V   K+ F +QH+ RL E+A+YFAY +++    +++L
Sbjct:  363 EVHQKTAFLYRHKQIFDLKTTAKVEHKKIAFLEQHLNRLKEAATYFAYPYNEKALQKQLS       422

Query:  420 KYLHQLDEKDYRLKIMLDKTGKVTFEVKQLVNLSKKFLTAEVVVQDYPIKLSPFTYFKTS       479
            YL   +     YRL I L K GK++   + L  LS  FLTA++ +Q  +   SPFTYFKTS
Sbjct:  423 TYLENKNNAAYRLMIRLSKDGKISLSDQPLEPLSADFLTAQLSLQKKDVTASPFTYFKTS       482

Query:  480 YRPHIIEGQNEKIFVSPEGLLLETSIGNIVLEKNGRFLTPDLSEGGLNGIYRRHLLKNQK       539
            YRPHI +    E++F +  G LLETSIGN+ ++       TP ++ G L G++R+ LL     +
Sbjct:  483 YRPHIEQKSYEQLFYNQAGQLLETSIGNLFVQLGQTLYTPPVAVGILPGLFRQELLATGQ       542

Query:  540 VIEAPLTLKDLESADAIYACNAVRGLYPLNLK                                  571
            E    +TL DL+  A AI+  NAVRGLYPLNL+
Sbjct:  543 AQEKEVTLADLKEASAIFGGNAVRGLYPLNLE                                  574
```

Based on this analysis, it was predicted that these proteins and their epitopes could be useful antigens for vaccines or diagnostics.

Example 13

A DNA sequence (GBSx0010) was identified in *S. agalactiae* <SEQ ID 29> which encodes the amino acid sequence <SEQ ID 30>. Analysis of this protein sequence reveals the following:

---
Possible site: 20
>>> Seems to have no N-terminal signal sequence
----- Final Results -----
   bacterial cytoplasm --- Certainty = 0.1564 (Affirmative) <succ>
   bacterial membrane --- Certainty = 0.0000 (Not Clear) <succ>
   bacterial outside --- Certainty = 0.0000 (Not Clear) <succ>
---

A related DNA sequence was identified in *S. pyogenes* <SEQ ID 31> which encodes the amino acid sequence <SEQ ID 32>. Analysis of this protein sequence reveals the following:

---
Possible site: 13
>>> Seems to have no N-terminal signal sequence
----- Final Results -----
   bacterial cytoplasm --- Certainty = 0.5335 (Affirmative) <succ>
   bacterial membrane --- Certainty = 0.0000 (Not Clear) <succ>
   bacterial outside --- Certainty = 0.0000 (Not Clear) <succ>
---

An alignment of the GAS and GBS proteins is shown below:

```
                 Identities = 220/267 (82%), Positives = 243/267 (90%)
         Query:  10 LLLEITKIARATYYYQLKKLNKPNDKAIKSDIQSIYDEHRGNYGYRRIYLELRNRGFVI        69
                    +LLEI   ++R+TYYYQ+K+L +  +KD   +K   I+  IYDEH+GNYGYRRI++ELRNRGFV+
         Sbjct:   1 MLLEILDLSRSTYYYQVKRLAQGDKDIELKHVIREIYDEHKGNYGYRRIHMELRNRGFVV        60
```

```
-continued
Query:  70 NHKRVQGLMKSMGLTARIRRKRKYASYKGEVGKKADNLIQRQFEGSKPYEKCYTDVTEFA      129
           NHK+VQ LMK MGL ARIRRKRKY+SYKGEVGKKADNLI+R FEGSKPYEKCYTDVTE A
Sbjct:  61 NHKKVQRLMKVMGLAARIRRKRKYSSYKGEVGKKADNLIKRHFEGSKPYEKCYTDVTELA      120

Query: 130 LPEGKLYLSPVLDGYNSEIIDFTLSRSPDLKQVQTMLERAFPAASYSETILHSDQGWQYQ      189
           LPEGKLYLSPVLDGYNSEIIDFTLSRSP+LKQVQTMLE+ FPA SYS TILHSDQGWQYQ
Sbjct: 121 LPEGKLYLSPVLDGYNSEIIDFTLSRSPNLKQVQTMLEKTFPADSYSGTILHSDQGWQYQ      180

Query: 190 HKSYHQFLEDKGIRPSMSRKGNSPDNGMMESFFGILKSEMFYGLEKSYKSLDDLEQAITD      249
           H+SYH FLE KGI  SMSRKGNSPDNGMMESFFGILKSEMFYGLE +Y+SLD LE+AITD
Sbjct: 181 HQSYHDFLESKGILASMSRKGNSPDNGMMESFFGILKSEMFYGLETTYQSLDKLEEAITD      240

Query: 250 YIFYYNNKRIKAKLKGLSPVQYRTKSF                                       276
           YIFYYNNKRIKAKLKG SPVQYRTKSF
Sbjct: 241 YIFYYNNKRIKAKLKGFSPVQYRTKSF                                       267
```

Based on this analysis, it was predicted that these proteins and their epitopes could be useful antigens for vaccines or diagnostics.

Example 14

A DNA sequence (GBSx0011; GBSx2234) was identified in *S. agalactiae* <SEQ ID 33> which encodes the amino acid sequence <SEQ ID 34>. Analysis of this protein sequence reveals the following:

---
Possible site: 27
>>> Seems to have no N-terminal signal sequence
----- Final Results -----
    bacterial cytoplasm --- Certainty = 0.3578 (Affirmative) <succ>
      bacterial membrane --- Certainty = 0.0000 (Not Clear) <succ>
        bacterial outside --- Certainty = 0.0000 (Not Clear) <succ>
---

A related DNA sequence was identified in *S. pyogenes* <SEQ ID 35> which encodes the amino acid sequence <SEQ ID 36>. Analysis of this protein sequence reveals the following:

---
Possible site: 25
>>> Seems to have no N-terminal signal sequence
----- Final Results -----
    bacterial cytoplasm --- Certainty = 0.3869 (Affirmative) <succ>
      bacterial membrane --- Certainty = 0.0000 (Not Clear) <succ>
        bacterial outside --- Certainty = 0.0000 (Not Clear) <succ>
---

An alignment of the GAS and GBS proteins is shown below:

```
Identities = 107/170 (62%), Positives = 134/170 (77%)
Query:   1 MKLSYEDKLEIYELRKIGMSWSQISQRYDVRISNLKYMIKLMDRYGVEIVEKGRNEYYPP       60
           MK + E K++IYELR++G S   IS+++D+  S+LKYMI+L+DRYGV  IV+K +N YY P
Sbjct:   1 MKFNQETKVKIYELRQMGESIKSISKKFDMAESDLKYMIRLIDRYGVTIVQKCKNHYYSP       60

Query:  61 ELKQEMIDKVLIHGCSQLSVSLDYALSNCSILTNWLSQFKKNGYTIVEKTRGRPSKMGRK      120
           ELKQE+I+KVLI G SQ    SLDYAL   S+L+ W++Q+KKNGYTI+EK RGRPSKMGRK
Sbjct:  61 ELKQEIINKVLIDGQSQKQTSLDYALPTSSMLSRWIAQYKKNGYTILEKPRGRPSKMGRK      120

Query: 121 RKKTWEEMTELERLQEENERLRTENAFLKKLRDLRLRDEALQSERQKQLE                170
           RKK   EEMTE+ERLQ+E E  R ENA LKKLR+ RLRDEA   E+QK +
Sbjct: 121 RKKNLEEMTEVERLQKELEYPRAENAVLKKLREYRLRDEAKLKEQQKSFK                170
```

Based on this analysis, it was predicted that these proteins and their epitopes could be useful antigens for vaccines or diagnostics.

Example 15

A DNA sequence (GBSx0012) was identified in *S. agalactiae* <SEQ ID 37> which encodes the amino acid sequence <SEQ ID 38>. This protein is predicted to be oxyR protein. Analysis of this protein sequence reveals the following:

---
Possible site: 22
>>> Seems to have no N-terminal signal sequence
----- Final Results -----
    bacterial cytoplasm --- Certainty = 0.1323 (Affirmative) <succ>
      bacterial membrane --- Certainty = 0.0000 (Not Clear) <succ>
        bacterial outside --- Certainty = 0.0000 (Not Clear) <succ>
---

A related GBS nucleic acid sequence <SEQ ID 10033> which encodes amino acid sequence <SEQ ID 10034> was also identified.

The protein has homology with the following sequences in the GENPEPT database:

```
>GP: CAA91664 GB: Z67753 former trsE (rbcR homolog) [Odontella sinensis]
Identities = 72/259 (27%), Positives = 127/259 (48%), Gaps = 7/259 (2%)
Query:   5 QKLMYLESIELYSNITKAAAHLFISQPYLSKVIKQLENELEIKLIQSQGHQTFLTYAGQR      64
           Q+L  L++I   + T+AA  LF+SQP LSK IK LE+ L I L+ + +   LT AG+

Sbjct:   8 QQLRILKAIATEKSFTRAAEVLFVSQPSLSKQIKTLESRLNISLLNRENNIVSLTQAGKL     67

Query:  65 YLFYLKEIDMIERQMAKELYLIRSDKKGEITLGINSGLASSILANVLPKFNLEHPEISVK    124
           +L Y + I   +   +L +++  +G + +G + + + ++  VL  F   HP+I+++

Sbjct:  68 FLEYSERILALCEESCRVLNDLKTGDRGNLIVGASQTIGTYLMPRVLALFAQNHPQINIE    127

Query: 125 LLENNQNISEQLVASGDIDLAV--GMAPILYKDGIASTTIYRDELFLMIPTTSQLYNAEK    182
           + ++     + V GDID+AV  G P  + +        DEL L+IP +    +K Sbjct: 128 VHVDSTRKIAKRVLEGDIDIAVVGGNIPEEIEKNLKVEDFVNDELILIIPKSHPFALKKK    187

Query: 183 RGQIIPFEYPISVLD-NEPLILTPLEYGIGKTIAQFYELHHMSLNQMITTSTVPTAASLS    241
           +      Y ++ +  N   + L    I    IA F     + Q+ +   + TA SL Sbjct: 188 KKINKDDLYHLNFITLNSNSTIRKLIDNILIQIA-FEPKQFNIIMQLNSIEAIKTAVSL-    245

Query: 242 LSGMGATFVPQTLIHRYLD                                            260
           G+GA FV  + I + ++

Sbjct: 246 --GLGAAFVSSSAIEKEIE                                            262
```

A related DNA sequence was identified in *S. pyogenes* <SEQ ID 39> which encodes the amino acid sequence <SEQ ID 40>. Analysis of this protein sequence reveals the following:

Possible site: 30
>>> Seems to have no N-terminal signal sequence
INTEGRAL     Likelihood = -1.28     Transmembrane 109-125 (109-126)

-continued

INTEGRAL     Likelihood = -0.27     Transmembrane 146-162 (146-162)
----- Final Results -----
  bacterial membrane --- Certainty = 0.1510 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP: AAC22434 GB: U32761 transcriptional regulator
[Haemophilus influenzae Rd]
Identities = 157/303 (51%), Positives = 221/303 (72%)
Query:   2 IRQGESYLDIKQIRYFIAIVENHFNLSQAAELLYVSQPTLSMMINDFEKRENVKLFKRKR     61
           + +G   +DI+ +RYF++IV+N FNLS+A++ LYVSQP LSMMI +FE REN+++FKR Sbjct:   9 VLRGVKMMDIRHLRYFVSIVDNDFNLSRASQNLYVSQPALSMMITEFENRENIQIFKRAS     68

Query:  62 GRIIGLTYLGDNYYKDAQKVLSLYDDMFLKLHDHSKGLKGSINIGIPPLILSVVFSEVMP    121
           G+IIGLT+ G+NYY+DA++V+  Y+DM   L+      KG+I IGIPPL+LS VFS V+P Sbjct:  69 GKIIGLTFAGENYYRDAKEVIKRYNDMRTNLYKSKDCKKGTITIGIPPLVLSAVFSSVLP    128

Query: 122 KLILENPGIQFNVKEIGAYQLKNELLVGNVDVAVLLSPTGIADNLVETYEIQRSELSVCL    181
           +LIL+NP I F +KEIGAY LK+ELL+  VD+AVLL P  I+ N++++ EI  SEL++ L Sbjct: 129 HLILKNPDINFIIKEIGAYALKSELLLDKVDLAVLLYPERISKNIIDSIEIHSSELALFL    188

Query: 182 SPRHRLASKKVIQWEDLTDEQLALFDPSFMVHHLVLEACERHQVRPNIILTSSSWDFMLN    241
           SP+H LA K+ I W DL +++A+FD +FM+HH + EA ER+   P+I+L SS WDF+L+

Sbjct: 189 SPKHVLAKKQQITWADLHQQKMAIFDQTFMIHHHLKEAFERNNCYPDIVLDSSCWDFLLS    248

Query: 242 STKINHNVLTICPKPITELYQLKDIKCIPMERPISWRVVLTRLRKKSYSEIEAYIMDDLL    301
           + K N +LTI P P+ ELY  K+  C  +E P+ W+V L R RK  Y+ +E YI D LL Sbjct: 249 AVKTNKELLTILPLPMAELYHSKEFLCRKIESPVPWKVTLCRQRKTVYTHLEEYIFDKLL    308

Query: 302 QSF                                                            304
           ++F Sbjct: 309 EAF                                                            311
```

An alignment of the GAS and GBS proteins is shown below:

```
Identities = 61/227 (26%), Positives = 111/227 (48%), Gaps = 10/227 (4%)
Query:   9 YLESIELYSNITKAAAHLFISQPYLSKVIKQLENELEIKLIQ-SQGHQTFLTYAGQRYLF      67
           ++  +E + N+++AA  L++SQP LS +I    E    +KL +  +G    LTY G  Y Sbjct:  17 FIATVENHENLSQAAELLYVSQPTLSMMINDFEKRENVKLFKRKRGRIIGLTYLGDNYYK      76

Query:  68 YLKEIDMIERQMAKELYLIRSDKKGEITLGINSGLASSILANVLPKFNLEHPEISVKLLE     127
           +++  +    M  +L+       KG I +GI    + S + + V+PK  LE+P I   + E Sbjct:  77 DAQKVLSLYDDMFLKLHDHSKGLKGSINIGIPPLILSVVFSEVMPKLILENPGIQFNVKE     136

Query: 128 NNQNISEQLVASGDIDLAVGMAPILYKDGIAST-TIYRDELFLMIPTTSQLYNAEKRGQI     186
                +  + G++D+AV ++P     D +  T  I R EL + +      +L  A K+   +

Sbjct: 137 IGAYQLENELLVGNVDVAVLLSPTGIADNLVETYEIQRSELSVCLSPRHRL--ASKK--V     192

Query: 187 IPFEYPISVLDNEPLILTPLEYGIGKTIAQFYELHHMSLNQMITTST                 233
           I +E     L +E L L      + +      + E H +    N ++T+S+

Sbjct: 193 IQWE----DLTDEQLALFDPSFMVHHLVLEACERHQVRPNIILTSSS                 235
```

Based on this analysis, it was predicted that these proteins and their epitopes could be useful antigens for vaccines or diagnostics.

Example 16

A DNA sequence (GBSx0013) was identified in *S. agalactiae* <SEQ ID 41> which encodes the amino acid sequence <SEQ ID 42>. This protein is predicted to be aminoacylase (cpsA). Analysis of this protein sequence reveals the following:

Possible site: 43
>>> Seems to have no N-terminal signal sequence
INTEGRAL   Likelihood = −0.75   Transmembrane 385-401 (385-401)
----- Final Results -----
  bacterial membrane --- Certainty = 0.1298 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database:

```
>GP: AAF36227 GB: AF168363 aminoacylase [Lactococcus lactis]
Identities = 201/395 (50%), Positives = 274/395 (68%), Gaps = 5/395 (1%)
Query:   6 LRHQLFEKLDQKCDQMVAIRRYLHENPELSFKETKTAAYISDFYKGKDCHVQTQFGGMNG       65
           L + L    L Q  ++M+ IRR+LH+ PE+SF+E +T  YI  FYK  DC +    G  G Sbjct:   3 LLNNLLTSLTQYENEMIQIRRHLHQYPEISFQEKETFKYIMGFYKELDCEPKLIGKGF-G       61

Query:  66 VVVDIYGDKATDKPIKHIALRADFDALPIQEETGLSFASKTAGVMHACGHDAHTAYLLIL     125
           ++VDI G K+      K +ALRADFDAL I E+   LSF S    GVMHACGHDAHTAYL++L Sbjct:  62 IIVDIEGGKSG----KTLALRADFDALAIFEDNDLSFKSVNPGVMHACGHDAHTAYLMVL     117

Query: 126 AESLIELKSEFSGHIRILHQPAEEVPPGGAKAMIEAGCLDGIDAVLGIHVMSTMEEGTVQ     185
           A   L+++K E  G +RI+HQPAEEV PGGAK+MI+AG LDG+D  ++G+HVM+T++  G +

Sbjct: 118 ARELVKIKQELPGRVRIVHQPAEEVSPGGAKSMIKAGALDGVDNMIGVHVMTTIKTGVIA     177

Query: 186 YHAGPIQTGRATFKVILQGKGGHGSMPHRANDTIVAASSFVMAAQTIVSRRVNPFDTAVV     245
            YH    QTGR+ F +  ++G GGH SMP   +ND IVAAS FV    QT++SRR++PFD      V Sbjct: 178 YHNKETQTGRSNFTITIKGNGGHASMPQLSNDAIVAASYFVTELQTVISRRIDPFDMGTV     237

Query: 246 TIGSFDGKGSANVIKDSVTLEGDVRVMSEETRGVVEEEFKRILDGIAQTYGVSYQLDYQN     305
           TIGSFDG GS N  I+D V  L+GDVR+M  E TR V+ ++  K+I   G+    T+GV    +DY +

Sbjct: 238 TIGSFDGAGSFNAIQDKVLLKGDVRMMKETTRKVIRDQVKQIAKGVGVTEGVEVIVDYDD     297

Query: 306 DYPVLVNNSEVTQKVANSLKSVAIKEILDVIDCDPQTPSEDFAYYAQTIPACFFYVGAHE     365
           +YPVL N+    +T  V +SLK     I E+   +++D    PQ  PSEDF YY Q +P+  FFY+GA Sbjct: 298 NYPVLFNSENLTHFVVDSLKDQNISEVNNIVDLGPQNPSEDFSYYGQVVPSTFFYIGAQP     357

Query: 366 EGQPYYPHHHPKFQIAESSLMVSAKSMATAALAML                              400
           E      YPHH P F++  E  S++++AK++AT       +    L Sbjct: 358 EDGGNYPHHSPLFKMNEKSILIAAKAVATVTINYL                              392
```

No corresponding DNA sequence was identified in *S. pyogenes*.

Based on this analysis, it was predicted that this protein and its epitopes, could be useful antigens for vaccines or diagnostics.

Example 17

A DNA sequence (GBSx0014) was identified in *S. agalactiae* <SEQ ID 43> which encodes the amino acid sequence The protein has homology with the following sequences in the GENPEPT database:

```
>GP: CAB02058 GB: Z79702 hypothetical protein Rv2333c
[Mycobacterium tuberculosis]
Identities = 118/405 (29%), Positives = 199/405 (49%), Gaps = 9/405 (2%)
Query:  13 KLLVGIVLAVLSFWLFAQS-ILNMG-PDVQSSLGISSGAMDIGVSSTALFSGLFIVVTGG      70
             +LL I    + F +F   + I+N+  PD+Q S  +    +   V+S +L    +FI+

Sbjct:   5 QLLTLIATGLGLFMIFLDALIVNVALPDIQRSFAVGEDGLQWVVASYSLGMAVFIMSAAT      64

Query:  71 LADKLGRVKFTFIGLCLNIIGSLLIVLANGAVLFIMGRIFQGLAAAFIMPSTMALVKTYY     130
             LAD  GR ++   IG+ L  +GS+      LA    +   R  QGL AA +   +++ALV    +

Sbjct:  65 LADLDGRRRWYLIGVSLFTLGSIACGLAPSIAVLTTARGAQGLGAAAVSVTSLALVSAAF     124

Query: 131 -DGKDRQRAVSFWSIGSWGGSGLCSYFGGAVASTLGWRYVFIFSI-IASVVSFLLILGTP     188
              +  K++  RA+   W+   +  G+        GG +      GWR +F  ++ +  ++V  FL +

Sbjct: 125 PEAKEKARAIGIWTAIASIGTTTGPTLGGLLVDQWGWRSIFYVNLPMGALVLFLTLCYVE     184

Query: 189 ESKNVGQKTHFDYLGLIIFIISMLSLNIGISMAQEHGLMNVIPLSLFTVMLIGFVLFYYV     248
             ES N   +    FD  G ++FI+++ +L    +    + G  +V   +   +G   LF ++

Sbjct: 185 ESCN-ERARRFDLSGQLLFIVAVGALVYAVIEGPQIGWTSVQTIVMLWTAAVGCALFVWL     243

Query: 249 ETRKSNSFIDFHLFENRFY-LGATISNFLLNAVAGTLIVINTYMQQGRQLTPKVAGEMSL     307
             E R SN +D  LF +  Y L      + AV G L++     ++Q  R   TP V G M L Sbjct: 244 ERRSSNPMMDLTLFRDTSYALAIATICTVFFAVYGMLLLTTQFLQNVRGYTPSVTGLMIL     303

Query: 308 GYLVCVLIAIRVGEKILQRFGARKPMLLGAMSTFVGIFLMTLVNIQGPLYLVLVFVGYAL     367
               + V I    +   ++ R GAR P+L G    +G+ ++         LV  VG  L Sbjct: 304 PFSAAVAIVSPLVGHLVGRIGARVPILAGLCMLMLGLLMLIFSEHRSS---ALVLVGLGL     360

Query: 368 FGTGLGIYATPSTDTAISSIPNEKVGSASGIYKMASSLGGAIGVA                 412
               G+G+ +   TP T   A++++P E+ G ASGI       ++G  IG A Sbjct: 361 CGSGVALCLTPITTVAMTAVPAERAGMASGIMSAQRAIGSTIGFA                 405
```

<SEQ ID 44>. This protein is predicted to be drug transporter. Analysis of this protein sequence reveals the following:

Lipop: Possible site: –1 Crend: 8
McG: Discrim Score: 6.19
GvH: Signal Score (–7.5): –0.899999
Possible site: 31
>>> Seems to have a cleavable N-term signal seq.
ALOM program    count: 11 value: –12.15 threshold: 0.0
INTEGRAL    Likelihood = –12.15    Transmembrane 169-185 (166-190)
INTEGRAL    Likelihood = –8.86    Transmembrane 229-245 (224-250)
INTEGRAL    Likelihood = –8.65    Transmembrane 82-98 (78-111)
INTEGRAL    Likelihood = –8.60    Transmembrane 436-452 (428-457)
INTEGRAL    Likelihood = –7.48    Transmembrane 202-218 (198-222)
INTEGRAL    Likelihood = –4.99    Transmembrane 334-350 (332-352)
INTEGRAL    Likelihood = –4.88    Transmembrane 358-374 (354-376)
INTEGRAL    Likelihood = –4.09    Transmembrane 301-317 (301-317)
INTEGRAL    Likelihood = –2.81    Transmembrane 102-118 (101-119)
INTEGRAL    Likelihood = –2.71    Transmembrane 52-68 (50-70)
INTEGRAL    Likelihood = –1.70    Transmembrane 271-287 (270-288)
PERIPHERAL    Likelihood = 0.32    401
modified ALOM score: 2.93
*** Reasoning Step: 3
----- Final Results -----
    bacterial membrane --- Certainty = 0.5861 (Affirmative) <succ>
    bacterial outside --- Certainty = 0.0000 (Not Clear) <succ>
    bacterial cytoplasm --- Certainty = 0.0000 (Not Clear) <succ>

A related DNA sequence was identified in *S. pyogenes* <SEQ ID 45> which encodes the amino acid sequence <SEQ ID 46>. Analysis of this protein sequence reveals the following:

Possible site: 61
>>> Seems to have an uncleavable N-term signal seq
INTEGRAL    Likelihood = –8.28    Transmembrane 169-185 (165-189)
INTEGRAL    Likelihood = –8.23    Transmembrane 12-28 (11-32)
INTEGRAL    Likelihood = –8.17    Transmembrane 429-445 (423-450)
INTEGRAL    Likelihood = –6.64    Transmembrane 203-219 (200-222)
INTEGRAL    Likelihood = –5.41    Transmembrane 227-243 (225-245)
INTEGRAL    Likelihood = –3.72    Transmembrane 82-98 (80-99)
INTEGRAL    Likelihood = –3.72    Transmembrane 136-152 (135-155)
INTEGRAL    Likelihood = –2.92    Transmembrane 302-318 (299-319)
INTEGRAL    Likelihood = –2.55    Transmembrane 261-277 (261-277)
INTEGRAL    Likelihood = –2.07    Transmembrane 331-347 (331-347)
INTEGRAL    Likelihood = –1.06    Transmembrane 56-72 (56-72)
INTEGRAL    Likelihood = –0.96    Transmembrane 351-367 (351-368)
INTEGRAL    Likelihood = –0.37    Transmembrane 104-120 (103-120)
----- Final Results -----
    bacterial membrane --- Certainty = 0.4312 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GB: AJ250422 ORFC [Oenococcus oeni] 271 1e-71
Identities = 152/445 (34%), Positives = 248/445 (55%), Gaps = 7/445 (1%)
Query:   1 MSHHQQTVSKQTIMAIIAIALIGFSGILSETSMNVTFPTLMSVYQLPLNSLQWMTTIYLL      60
           M    Q VS   +AI+ +A + F G+L ETSMNVTFPTLM  + + LN +QW+TT YLL
Sbjct:   1 MQKDNQPVSLHVKLAILGLAGLAFCGVLIETSMNVTFPTLMQQFSISLNKVQWLTTAYLL      60

Query:  61 AVAIMMTTSATLKKNVRERPLFFMATGLFTFGTILAVLTQSFAIMLLARIFQGIGTGLVM     120
           VA ++ +A ++K    + +FF A LF   G I + L  +F I+L+ R+ Q + TGL +
Sbjct:  61 LVAATISIAAFIEKRFIFKKIFFWAGLLFIIGVICSALAPNFLILLIGRLIQALSTGLAI     120

Query: 121 PQMFNIILERVPMHKVGLFMGFAGLIISLAPAFGPTYGGFMISHFSWQWIFICILPVPLI     180
           P +   I++++P  K G +M    ++   P+ GPTYGG +    SW+ IF +LP+ LI
Sbjct: 121 PLLITEIMQQIPQKKQGSYMELVEWLLLWQPSLGPTYGGVITQDLSWRLIFWFVLPIGLI     180

Query: 181 AGILAYYYLEDSPVSEKVPFDWLAFIALSISLTSALLAITSLE-NGSVNLYYLGLFILSF     239
           A ++   ++E     K+PF W  FI+L ++L S  +A+ +     G ++  + G   +++
Sbjct: 181 AWLIGLSFIEQKSSPSKIPFAWKQFISLILALLSITVAVNNAGIYGWTSIKFYGFLLIAV     240

Query: 240 IL---FLYKNLTAKQPFLDIRILKIPSLTFGLIPFFVFQLINLGINFLTPNFIVMEKIAN     296
           IL   F+ +  ++Q + I I K      L+ +F+ Q I L + FL PN+ +
Sbjct: 241 ILLIVFIKLSTNSRQALISISIFKKWEFVCPLLIYFLIQFIQLSLTFLLPNYAQLILKKG     300

Query: 297 SSQAGMVLLPGTLLGALLAPAFGKLYDQKGARLSLYLGNALFSLSLIIMTLQTRHFMLLP     356
           +G++LL G+L+ A+L P  G++ D    ++ L +G      S I  T+ R+ +
Sbjct: 301 VMISGIMLLCGSLISAILQPLTGRMLDSFSVKIPLVIGAFFLITSTISFTIFQRYLSVFL     360

Query: 357 FTLLYILFTFGRNMGFNNSLATAIRELPAEKNADATAIFQMMQQFAGALGTAMAS-LIAN     415
           LY+++   G + FNNSL A+++LP +   +D  A+F   +QQ+AG+LGT++AS L+AN
Sbjct: 361 IAALYVIYMIGFSFVFNNSLTYALQKLPLKLISDGNAVFNTLQQYAGSLGTSVASALLAN     420

Query: 416 SQAEFTSGVQSVYLLFTIFALLDFI                                         440
                 T G  QS Y       +L+FI
Sbjct: 421 GIG--TDGKQSNYTGSRHIFILNFI                                         443
```

An alignment of the GAS and GBS proteins is shown below:

```
Identities = 91/369 (24%), Positives = 160/369 (42%), Gaps = 14/369 (3%)
Query:  82 FIGLCLNIIGSLLIVLANGAVLFIMGRIFQGLAAAFIMPSTMALVKTYYDGKDRQRAVSF     141
           F+   L   G++L VL     + ++ RIFQG+    +MP    ++              + F
Sbjct:  83 FMATGLFTFGTILAVLTQSFAIMLLARIFQGIGTGLVMPQMFNIILERVPMHKVGLFMGF     142

Query: 142 WSIGSWGGSGLCSYFGGAVASTLGWRYVFIFSIIASVVSFLLILGTPESKNVGQKTHFDY     201
               +       +GG + S   W+++FI +    +++ +L         E     V +K   FD+
Sbjct: 143 AGLIISLAPAFGPTYGGFMISHFSWQWIFICILPVPLIAGILAYYYLEDSPVSEKVPFDW     202

Query: 202 LGLIIFIISMLSLNIGISMAQEHGLMNVIPLSLFTVMLIGFVLFYYVETRKSNSFIDFHL     261
           L  I    IS+ S  + I+ +   E+G +N+   L LF    ++ F+LF Y        F+D +
Sbjct: 203 LAFIALSISLTSALLAIT-SLENGSVNLYYLGLF---ILSFILFLYKNLTAKQPFLDIRI     258

Query: 262 FENRFYLGATISNFLLNAV-AGTLIVINTYMQQGRQLTPKVAGEMSL-GYLVCVLIAIRV     319
           +         I   F+ +   + G   +   ++ +        AG + L G L+  L+A
Sbjct: 259 LKIPSLTFGLIPFFVFQLINLGINFLTPNFIVMEKIANSSQAGMVLLPGTLLGALLAPAF     318

Query: 320 GEKILQRFGARKPMLLGAMSTFVGIFLMTLVNIQGPLYLVLVF-VGYALFGTGLGIYATP     378
             G K+ + +GAR   + LG     + ++MTL Q      +++L F + Y LF    G +
Sbjct: 319 G-KLYDQKGARLSLYLGNALFSLSLIIMTL---QTRHFMLLPFTLLYILFTFGRNMGFNN     374

Query: 379 STDTAISSIPNEKVGSASGIYKMASSLGGAIGVATSIAIYHAFSGNADFHKAALCGLILN     438
           S   TAI +P EK    A+ I++M       GA+G A +  I ++     A+F          +L
```

```
Sbjct:  375 SLATAIRELPAEKNADATAIFQMMQQFAGALGTAMASLIANS---QAEFTSGVQSVYLLF      431

Query:  439 LVFCSLSIL                                                       447
            +F  L  +
Sbjct:  432 TIFALLDFI                                                       440
```

Based on this analysis, it was predicted that these proteins and their epitopes could be useful antigens for vaccines or diagnostics.

Example 18

A DNA sequence (GBSx0015) was identified in *S. agalactiae* <SEQ ID 47> which encodes the amino acid sequence <SEQ ID 48>. This protein is predicted to be transposase. Analysis of this protein sequence reveals the following:

Possible site: 45
>>> Seems to have no N-terminal signal sequence
----- Final Results -----
bacterial cytoplasm --- Certainty = 0.3116 (Affirmative) <succ>
bacterial membrane --- Certainty = 0.0000 (Not Clear) <succ>
bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 19

A DNA sequence (GBSx0016) was identified in *S. agalactiae* <SEQ ID 49> which encodes the amino acid sequence <SEQ ID 50>. This protein is predicted to be L11 protein (rplK). Analysis of this protein sequence reveals the following:

Possible site: 21
>>> Seems to have no N-terminal signal sequence
----- Final Results -----
bacterial cytoplasm --- Certainty = 0.1859 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database:

```
>GP: CAA53739 GB: X76134 L11 protein [Staphylococcus carnosus]
Identities = 117/139 (84%), Positives = 129/139 (92%)
Query:    1 MAKKVEKLVKLQIPAGKATPAPPVGPALGQAGINIMGFTKEFNARTADQAGMIIPVVISV      60
            MAKKVEK+VKLQIPAGKA PAPPVGPALGQAG+NIMGF KEFNART +QAG+IIPV ISV
Sbjct:    1 MAKKVEKVVKLQIPAGKANPAPPVGPALGQAGVNIMGFCKEFNARTQEQAGLIIPVEISV      60

Query:   61 YEDKSFDFITKTPPAAVLLKKAAGVEKGSGEPNKTKVATITRAQVQEIAETKMPDLNAAN     120
            YED+SF FITKTPPA VLLKKAAGVEKGSGEPNK KVAT+T+ QV+EIA+TKMPDLNAA+
Sbjct:   61 YEDRSFTFITKTPPAPVLLKKAAGVEKGSGEPNKNKVATVTKDQVREIAQTKMPDLNAAD     120

Query:  121 LESAMRMIEGTARSMGFTV                                             139
            E+AMR+IEGTARSMG TV
Sbjct:  121 EEAAMRIIEGTARSMGITV                                             139
```

A related DNA sequence was identified in *S. pyogenes* <SEQ ID 51> which encodes the amino acid sequence <SEQ ID 52>. Analysis of this protein sequence reveals the following:

Possible site: 45
>>> Seems to have no N-terminal signal sequence
----- Final Results -----
bacterial cytoplasm --- Certainty = 0.4276 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below:

```
Identities = 136/141
Query:    1 MAKKVEKLVKLQIPAGKATPAPPVGPALGQAGINIMGFTKEFNARTADQAGMIIPVVISV      60
            MAKKVEKLVKLQIPAGKATPAPPVGPALGQAGINIMGFTKEFNARTADQAGMIIPVVISV
Sbjct:   25 MAKKVEKLVKLQIPAGKATPAPPVGPALGQAGINIMGFTKEFNARTADQAGMIIPVVISV      84
```

-continued
```
Query:  61 YEDKSEDFITKTPPAAVLLKKAAGVEKGSGEPNKTKVATITRAQVQEIAETKMPDLNAAN    120
           YEDKSFDFITKTPPAAVLLKKAAGVEKGSG PN TKVAT+TRAQVQEIAETKMPDLNAAN Sbjct:  85 YEDKSFDFITKTPPAAVLLKKAAGVEKGSGTPNTTKVATVTRAQVQEIAETKMPDLNAAN    144

Query: 121 LESAMRMIEGTARSMGFTVTD                                          141
           +E+AERMIEGTARSMGFTVTD Sbjct: 145 IEAAMRMIEGTARSMGFTVTD                                          165
```

Based on this analysis, it was predicted that these proteins and their epitopes could be useful antigens for vaccines or diagnostics.

Example 20

A DNA sequence (GBSx0017) was identified in *S. agalactiae* <SEQ ID 53> which encodes the amino acid sequence <SEQ ID 54>. This protein is predicted to be ribosomal protein L1 (rplA). Analysis of this protein sequence reveals the following:

Possible site: 30
>>> Seems to have no N-terminal signal sequence
----- Final Results -----
    bacterial cytoplasm --- Certainty = 0.2285 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database:

A related DNA sequence was identified in *S. pyogenes* <SEQ ID 55> which encodes the amino acid sequence <SEQ ID 56>. Analysis of this protein sequence reveals the following:

Possible site: 22
>>> Seems to have no N-terminal signal sequence
----- Final Results -----
    bacterial cytoplasm --- Certainty = 0.2309 (Affirmative) <succ>
    bacterial membrane --- Certainty = 0.0000 (Not Clear) <succ>
    bacterial outside --- Certainty = 0.0000 (Not Clear) <succ>

```
>GP: CAB11879 GB: Z99104 ribosomal protein L1 (BL1) [Bacillus subtilis]
Identities = 144/228 (63%), Positives = 177/228 (77%)
Query:   1 MAKKSKNLRAALEKIDSTKAYSVEEAVALAKETNFAKFDATVEVSYNLNIDVKKADQQIR    60
           MAKK K     A + +D +KAY V  EAVAL K+TN AKFDATVEV++ L +D  K QQIR Sbjct:   1 MAKKGKKYVEAAKLVDHSKAYDVSEAVALVKKTNTAKFDATVEVAFRLGVDPSKNHQQIR    60

Query:  61 GAMVLPAGTGKTSRVLVFARGAKAEEEAKAAGADFVGEDDLVAKIQGGWLDFDVVIATPDM   120
           GA+VLP GTGKT RVLVFA+G KA+E+ AAGADFVG+ D + KIQ GW DFDV++ATPDM Sbjct:  61 GAVVLPNGTGKTQRVLVFAKGEKAKEAEAAGADFVGDTDYINKIQQGWFDFDVIVATPDM   120

Query: 121 MALVGRLGRVLGPRNLMPNPKTGTVTMDVAKAVEESKGGKITYRADKAGNVQALIGKVSF   180
           M   VG++GRVLGP+ LMPNPKTGTVT +V KA+ E K GK+ YR DKAGN+    IGKVSF Sbjct: 121 MGEVKIGRVLGPKGLMPNPKTGTVTFEVEKAIGEIKAGKVEYRVDKAGNIHVPIGKVSF   180

Query: 181 DDAKLVDNFKAFNDVIVKAKPATAKGTYITNLSITTTQGVGIKVDPNS              228
           +D KLV+NF     D I+KAKPA AKG Y+ N+++T+T G G+KVD ++

Sbjct: 181 EDEKLVENFTTMYDTILKAKPAAAKGVYVKNVAVTSTMGPGVKVDSST              228
```

An alignment of the GAS and GBS proteins is shown below:

```
Identities = 208/229 (90%), Positives = 220/229 (95%)
Query:   1 MAKKSKNLRAALEKIDSTKAYSVEEAVALAKETNFAKFDATVEVSYNLNIDVKKADQQIR    60
           MAKKSK +RAALEK+DSTKAYSVEEAVAL KETNFAKFDA+VEV+YNLNIDV+KADQQIR Sbjct:   1 MAKKSKQMRAALEKVDSTKAYSVEEAVALVEETNFAKFDASVEVAYNLNIDVRKADQQIR    60

Query:  61 GAMVLPAGTGKTSRVLVFARGAKAREEAKAAGADFVGEDDLVAKIQGGWLDFDVVIATPDM   120
           GAMVLP GTGKT RVLVFARGAKAEEEAKAAGADFVGEDDLVAKI GGWLDFDVVIATPDM Sbjct:  61 GAMVLPNGTGKTQRVIVFARGAKAEEEAKAAGADFVGEDDLVAKINGGWLDFDVVIATPDM   120
```

```
-continued
Query: 121 MALVGRLGRVLGPRNLMPNPKTGTVTMDVAKAVEESKGGKITYRADKAGNVQALIGKVSF    180
            MA+VGRLGRVLGPRNLMPNPKTGTVTMDVAKAVEESKGGKITYRADKAGNVQALIGKVSF Sbjct: 121 MAIVGRLGRVLGPRNLMPNPKTGTVTMDVAKAVEESKGGKITYRADKAGNVQALIGKVSF    180

Query: 181 DDAKLVDNFKAFNDVIVKAKPATAKGTYITNLSITTTQGVGIKVDPNSL    229
            D  KLV+NFKAF+DV+ KAKPATAKGTY+ N+SIT+TQGVGIKVDPNSL Sbjct: 181 DADKLVENFKAFHDVMAKAKPATAKGTYMANVSITSTQGVGIKVDPNSL    229
```

Based on this analysis, it was predicted that these proteins and their epitopes could be useful antigens for vaccines or diagnostics.

Example 21

A DNA sequence (GBSx0018) was identified in *S. agalactiae* <SEQ ID 57> which encodes the amino acid sequence <SEQ ID 58>. Analysis of this protein sequence reveals the following:

Possible site: 25
>>> May be a lipoprotein
----- Final Results ----- bacterial membrane --- Certainty = 0.0000 (Not Clear) <succ>
bacterial outside --- Certainty = 0.0000 (Not Clear) <succ>
bacterial cytoplasm --- Certainty = 0.0000 (Not Clear) <succ>

A related GBS nucleic acid sequence <SEQ ID 10029> which encodes amino acid sequence <SEQ ID 10030> was also identified.

The protein has homology with the following sequences in the GENPEPT database:

```
>GP: BAB04286 GB: AP001509 nickel transport system (nickel-binding
protein) [Bacillus halodurans]
Identities = 209/541 (38%), Positives = 324/541 (59%), Gaps = 14/541 (2%)
Query:   5 RRNILLSITCLLMVTLTACHSQDS----KSHKLNSDK-LTLAWGEDFGDVNPHRYNPDQF    59
           R+ ILL + L+   L  C +S        + N++K +T +W  D G +NPH YNP Q
Sbjct:   6 RKLILLFVISLISSILVGCAESESGTVSNEGEENTEKSITFSWPRDIGPMNPHVYNPSQL    65

Query:  60 VIQDMVYEGLVRYGDNGKIEPALAKSWSISQDGKTYTFKLRNA-KYSDGSNFNAANVKRN    118
            Q M+YE LV Y + G+++P LA SW+IS+DGK YTFKLR   ++SDG+ FNA  VK+N
Sbjct:  66 FAQSMIYEPLVSYTEGGELQPHLADSWTISEDGKEYTFKLREGVQFSDGTPFNAEIVKKN    125

Query: 119 FDSIFSKSNRGNHNWFNLTNQLENYRALNQSTFEIKLKQAYSATLYDLSMIRPIRFLSDS    178
            FD+   S+   H+W + N LE   +++ TF++ LK+ Y   L DL+++RP+RFL ++
Sbjct: 126 FDTWIEHSSL--HSWLGVMNVLEKTEVVDEFTFKMVLKEPYYPALQDLAVVRPVRFLGEA    183

Query: 179 AFPKGDDTTKKNVKKPIGTGQWVVSKKQNEYITFKRNENYWGKKPKLKEVTVKVIPDAQ    238
            FP   DT++  +K+PIGTG W++    KQ+EY  F RN NYWG+ PK+ +VTVK+IPDA+
Sbjct: 184 GFPDDGDTSQ-GIKEPIGTGPWMLSDYKQDEYAVFTRNPNYWGESPKIDKVTVKIIPDAE    242

Query: 239 TRALAFESGDVDLIYGNGIIGLDTFAQYTKDKKYVTAISQPMSTRLLLLNAKESIFQDKK    298
            TR LAFESG++DLI+G G+I +D F Q  + +Y T +S+P+ TR LLLN      D +
Sbjct: 243 TRVLAFESGELDLIFGEGVISMDAFNQLKESGQYGTDLSEPVGTRSLLLNTSNEKLADLR    302

Query: 299 VRQAMNHAIDKVSIAKNTFRGTEKPADTIFSKSTSHSDAKLNPYSYNVDKANQLLDQAGW    358
            VR A++H +K ++ +      G E+ AD I S +  ++D + P Y+V++AN  LD+AGW
Sbjct: 303 VRLALHHGFNKQAMVEGVTLGLEEKADNILSTNFPYTDIDVEPIEYDVEQANAYLDEAGW    362

Query: 359 KMGKDK-VREKDGKTLTLRLPYIATKATDKDLVTYFQGEWRKIGINVSLIAMEEDDYWAN    417
            ++    K VREK+G+ L L L Y  T    K +   Q EW  IG+ + + +E
Sbjct: 363 ELPAGKTVREKNGEQLELELIYDKTDPLQKAMAETMQAEWAAIGVKLDITGLELTTQIQR    422

Query: 418 AKKGNFDMMLTYSWGAPWDPHAWMSALTAKADHGHPENIALENLATKTEMDRLIKSALVD    477
            +  G+FD+   Y++GAP+DPH++++ + A+A  G E  A  NL+ K E+D  ++   L
Sbjct: 423 RRAGDFDVDFWYNYGAPYDPHSFIN-VVAEAGWGVAE--AHSNLSMKEELDEQVRATLAS    479

Query: 478 PKEENVDRDYKKVLELLHDEAVYIPLTYQSVISVYRKGDFKTMRFAPEENSFPLRYIEKNN    538
              E    Y  +L L +++V++P++ Y     VY++  +     F   + P I+ +N
Sbjct: 480 TDETERQELYGSILNTLQEQSVFVPISYIKKTVVYQE-NVNEFIFPANRDEHPFNGIDVSN    539
```

A related DNA sequence was identified in *S. pyogenes* <SEQ ID 59> which encodes the amino acid sequence <SEQ ID 60>. Analysis of this protein sequence reveals the following:

Possible site: 24
>>> May be a lipoprotein
----- Final Results -----
   bacterial membrane --- Certainty = 0.0000 (Not Clear) <succ>
    bacterial outside --- Certainty = 0.0000 (Not Clear) <succ>
     bacterial cytoplasm --- Certainty = 0.0000 (Not Clear) <succ>

An alignment of the GAS and GBS proteins is shown below:

```
Identities = 131/497 (26%), Positives = 220/497 (43%), Gaps = 55/497 (11%)
Query:    8 ILLSITCLLMVTLTACHSQDSKSHKLN-----SDKLTLAWGEDFGDVNPHRYNP-DQFVI      61
            I L +T L++V   AC Q ++ +         D+L ++ G      PH ++P D++ +
Sbjct:   13 ITLFLTGLILV---ACQQQKPQTKERQRKQRPKDELVVSMGAKL----PHEFDPKDRYGV     65

Query:   62 QD---MVYEGLVRYGDNGKIEPALAKSWSISQDGKTYTFKLRNA-KYSDGSNFNAANVKR    117
            +    + +  L++     I+  LAK++ +S+DG T++F L +   K+S+G    A +VK
Sbjct:   66 HNEGNITHSTLLKRSPELDIKGELAKTYHLSEDGLTWSFDLHDDFKFSNGEPVTADDVKF    125

Query:  118 NFDSIFSKSNRGNHNWFNLTNQLENYRALNQSTFEIKLKQAYSATLYDLSMIRPIRFLSD    177
            +D +    + +    ++LT ++N  + ++   I L +A+S     L+ I PI
Sbjct:  126 TYDML-----KADGKAWDLTF-IKNVEVVGKNQVNIHLTEAHSTFTAQLTEI-PI-----    173

Query:  178 SAFPKG--DDTTKKNVKKPIGTGQWVVKSKKQNEYITFKRNENYWGKKPKLKEVTVKVIP    235
                PK   +D  K N   PIG+G ++VK  K  E   F RN + GKKP K+ T  V+
Sbjct:  174 --VPKKHYNDKYKSN---PIGSGPYMVKEYKAGEQAIFVRNPYWHGKKPYFKKWT-WVLL    227

Query:  236 DAQTRALAFESGDVDLIYGNGIIGLDTFAQYTK----DKKYVTAISQPMSTRLLLLNAKE    291
            D  T  A ESGDVD+IY   + D    T+       V  +S P  + ++ ++ +
Sbjct:  228 DENTALAALESGDVDMIYATPELA-DKKVKGTRLLDIPSNDVRGLSLPYVKKGVITDSPD    286

Query:  292 ------SIFQDKKVRQAMNHAIDKVSIAKNTFRGTEKPADTIFSKSTSHSDAKLNPYSYN    345
                  + D +R+A+ +++ +      G KPA +I K T  + K
Sbjct:  287 GYPVGNDVTSDPAIRKALTIGLNRQKVLDTVLNGYGKPAYSIIDK-TPFWNPKTAIKDNK    345

Query:  346 VDKANQLLDQAGWKMGKDKVREKDGKTLTLRLPYIATKATDKDLVTYFQGEWRKIGINVS    405
            V KA QLL +AGWK   D R+K         L Y      +L    + + +GI +
Sbjct:  346 VAKAKQLLTKAGWKEQADGSRKKGDLDAAFDLYYPTNDQLRANLAVEVAEQAKALGITIK    405

Query:  406 LIAMEEDDYWANAKKGNFDMMLTYSWGAPWDPHAWMSALTAKADHGHPENIALENLATKT    465
            L A   W      +D  L Y+ G      + S   +A G    NI    N  T
Sbjct:  406 LKASN----WDEMATKSHDSALLYAGGRHHAQQFYESHHPSLAGKGW-TNITFYNNPTVT    460

Query:  466 E-MDRLIKSALVDPKEE                                               481
            + +D+ + S+ +D    E
Sbjct:  461 KYLDKAMTSSDLDKANE                                               477
```

A related GBS gene <SEQ ID 8469> and protein <SEQ ID 8470> were also identified. Analysis of this protein sequence reveals the following:

Lipop: Possible site: 22    Crend: 5
McG: Discrim Score: 7.69
GvH: Signal Score (−7.5): −3.34
Possible site: 25
>>> May be a lipoprotein
ALOM program count: 0    value: 7.21    threshold: 0.0
PERIPHERAL    Likelihood = 7.21    273
modified ALOM score: −1.94
*** Reasoning Step: 3
----- Final Results -----
   bacterial membrane --- Certainty = 0.0000 (Not Clear) <succ>
    bacterial outside --- Certainty = 0.0000 (Not Clear) <succ>
     bacterial cytoplasm --- Certainty = 0.0000 (Not Clear) <succ>

The protein has homology with the following sequences in the databases:

```
Escherichia coli
 EGAD|8250| nickel-binding periplasmic protein precursor Insert characterized
OMNI|NT01EC4139 oligopeptide transporter putative substrate binding
 domain, putative Insert characterized
  SP|P33590|NIKA_ECOLI NICKEL-BINDING PERIPLASMIC PROTEIN PRECURSOR. Edit characterized
  GP|404845|emb|CAA51659.1| |X73143 NikA Insert characterized
  GP|466612|gb|AAB18451.1| |U00039 nikA Insert characterized
  GP|1789887|gb|AAC76501.1| |AE000423 periplasmic binding protein for nickel Insert
characterized
  PIR|S39594|S39594 nickel-binding periplasmic protein precursor - Escheri Insert
characterized
ORF02080(391-1905 of 2223)
EGAD|8250|EC3476(21-520 of 524) nickel-binding periplasmic protein precursor {Escherichia
coli}OMNI|NT01EC4139 oligopeptide transporter putative substrate binding domain,
putativeSP|P33590|NIKA_ECOLI NICKEL-BINDING PERIPLASMIC PROTEIN
PRECURSOR.GP|404845|emb|CAA51659.1| |X73143 NikA {Escherichia
coli}GP|466612|gb|AAB18451.1| |U00039 nikA {Escherichia
coli}GP|1789887|gb|AAC76501.1| |AE000423 periplasmic binding protein for nickel {Escherichia
coli}PIR|S39594|S39594 nickel-binding periplasmic protein precursor - Escheri
% Match = 26.9
% Identity = 41.3 % Similarity = 63.7
Matches = 208 Mismatches = 175 Conservative Sub.s = 113

147       177       207       237       267       297       327       357
SP*IIDTYTLSQSVYSHNFLLRRMQNQYNVGNTSSVDYHKLXX*LIXXXCLKK*LTKLKRKLVKMRRNILLSITCLLMVT

MLSTLRRTL 387       417       447       477       507       537       567       597
LTACHSQDSKSHKLNSDKLTLAWGEDFGDVNPHRYNPDQFVIQDMVYEGLVRYGDNGKIEPALAKSWSISQDGKTYTFKL
  :         |     |::|  :  :||: |    :|     |  ||||  ||:|  |  | |||:|:|||:|  |
FALLACASFIVHAAAPDEITTAWPVNVGPLNPHLYTPNQMFAQSMVYEPLVKYQADGSVIPWLAKSWTHSEDGKTWTFTL
           20        30        40        50        60        70        80

624       654       684       714       744       774       804       834
RN-AKYSDGSNFNAANVKRNFDSIFSKSNRGNHNWFNLTNQLENYRALNQSTFEIKLKQAYSATLYDLSMIRPIRFLSDS
|:  |:|  :    |:|    ||  ::: || |  |:  ||: :||:: ::|  || ||   |:|:  || ||:: |
RDDVKFSNGEPFDAEAAAENFRAVL--DNRQRHAWLELANQIVDVKALSKTELQITLKSAYYPFLQELALPRPFRFIAPS
           100       110       120       130       140       150       160

864       894       924       954       984       1014      1044      1071
AFPKGDDTTKKNVKKPIGTGQWVVKSKKQNEYITFKRNENYWGKKPKLKEVTVKVIPDAQTRALAFESGDVDLIYGN-GI
  |   :  |    :|||||   |:::   | |:|  |||||||:|| :|::| |||| ||||||||| :|:|:|||   |:
QF--KNHETMNGIKAPIGTGPWILQESKLNQYDVFVRNENYWGEKPAIKKITFNVIPDPTTRAVAFETGDIDLLYGNEGL
       180       190       200       210       220       230       240

1101      1131      1161      1191      1221      1251      1281      1311
IGLDTFAQYTKDKKYVTAISQPMSTRLLLLNAKESIFQDKKVRQAMNHAIDKVSIAKNTFRGTEKPADTIFSKSTSHSDA
: |||||::::: | |  :|||: |:| ||   :   ||:|:|::::| |:   |  | ||:: |||:| |    :::
LPLDTFARFSQNPAYHTQLSQPIETVMLALNTAKAPTNELAVREALNYAVNKKSLIDNALYGTQQVADTLFAPSVPYANL
       260       270       280       290       300       310       320

1341      1371      1395      1425      1455      1485      1515      1545
KLNPYSYNVDKANQLLDQAGWKM--GKDKVREKDGKTLTLRLPYIATKATDKDLVTYFQGEWRKIGINVSLIAMEEDDYW
 |  |: ||  |:|||  ::|||   |||  :|||:|: :| | |||| |  | :|:||  :|||| :|:
GLKPSQYDPQKAKALLEKAGWTLPAGKD-IREKNGQPLRIELSFIGTDALSKSMAEIIQADMRQIGADVSLIGEEESSIY
       340       350       360       370       380       390       400

1575      1605      1635      1665      1695      1725      1755      1785
ANAKKGNFDMMLTYSWGAPWDPHAWMSALTAKADHGHPENIALENLATKTEMDRLIKSALVDPKEENVDRDYKKVLELLH
|  :  |  |::  :||||||:|||| ::|      |  |:|  |  |  :|  :|  |  |  |     |
ARQRDGRFGMIFHRTWGAPYDPHAFLSSM---RVPSHADFQAQQGLADKPLIDKEIGEVLATHDETQRQALYRDILTRLH
       420       430       440       450       460       470       480

1815      1845      1875      1905      1935      1965      1995      2025
DEAVYIPLTYQSVISVYRKGDFKTMRFAPEENSFPLRYIEKNNVSK*FDHQKNIVSFFGIVFHITSNIYSYQTINS*FSR
|||||:|::| :| ::  |   |  :||   |:   |:
DEAVYLPISYISMMVV-SKPELGNIPYAPIATEIPFEQIKPVKP
               500       510       520
```

There is also homology to SEQ ID 318. An alignment of the GAS and GBS sequences follows:

```
Identities = 44/186 (23%), Positives = 78/186 (41%), Gaps = 27/186 (14%)
Query:  65 VITQMV-DGLLENDEYGNLVPSLAKDWKVSKDGLTYTYTLRDGVSWYTADGEEYAPVTAE     123
           VI  MV +GL+    + G + P+LAK W +S+DG TYT+ LR+     +DG  +     +
Sbjct:  57 VIQDMVYEGLVRYGDNGKIEPALAKSWSISQDGKTYTFKLRNA---KYSDGSNFNAANVK     113

Query: 124 DFVTGLKHAVDDKSDALYVVEDSIKNLKAYQNGEVDFKEVGVKALDDKTVQYTLNKPESY     183
             +    +   + +  +++ ++N         +AL+  T +   L    ++Y
Sbjct: 114 RNFDSIFSKSNRGNHNWFNLTNQLEN---------------YRALNQSTFEIKLK--QAY     156

Query: 184 WNSKTTYSVLFPVNAKFLKS----KGKDFGTTDPSSILVNGAYFLSAFTSKSSMEFHKNE     239
              S T Y +     +FL    KG D   +   + G +++      + F +NE
Sbjct: 157 --SATLYDLSMIRPIRFLSDSAFPKGDDTTKKNVKKPIGTGQWVVKSKKQNEYITFKRNE     214

Query: 240 NYWDAK                                                         245
           NYW  K
Sbjct: 215 NYWGKK                                                         220
```

Figure 35:
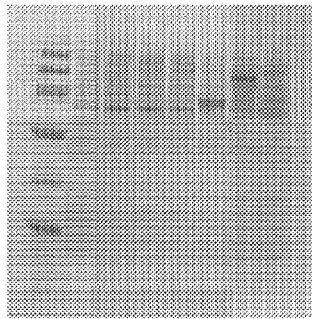
Figure 41:
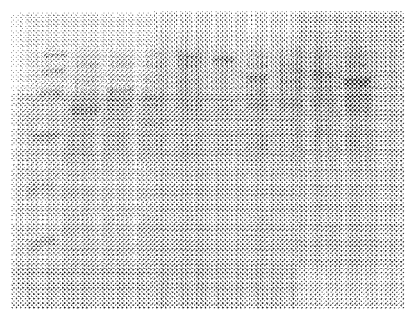

SEQ ID 8470 (GBS186) was expressed in *E. coli* as a His-fusion product. SDS-PAGE analysis of total cell extract is shown in FIG. 35 (lane 7; MW 60 kDa). It was also expressed in *E. coli* as a GST-fusion product. SDS-PAGE analysis of total cell extract is shown in FIG. 41 (lane 6; MW 85.7 kDa).

Figure 202:
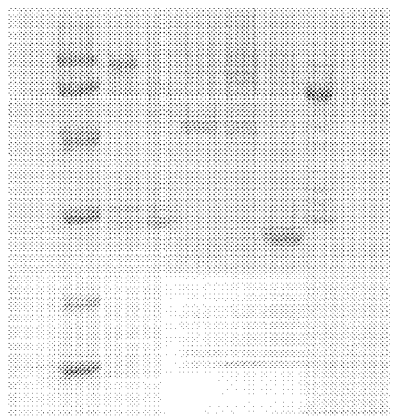

GBS186-GST was purified as shown in FIG. 202, lane 4.

Based on this analysis, it was predicted that these proteins and their epitopes could be useful antigens for vaccines or diagnostics.

Example 22

A DNA sequence (GBSx0019) was identified in *S. agalactiae* <SEQ ID 61> which encodes the amino acid sequence <SEQ ID 62>. Analysis of this protein sequence reveals the following:

Possible site: 37
>>> Seems to have a cleavable N-term signal seq.
INTEGRAL    Likelihood = −5.95    Transmembrane 101-117 (99-123)
INTEGRAL    Likelihood = −4.73    Transmembrane 276-292 (275-293)
INTEGRAL    Likelihood = −1.12    Transmembrane 232-248 (232-248)
INTEGRAL    Likelihood = −0.96    Transmembrane 151-167 (150-169)
----- Final Results -----
    bacterial membrane --- Certainty = 0.3378 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database:

```
>GP: BAB04287 GB: AP001509 nickel transport system (permease)
[Bacillus halodurans]
Identities = 119/304 (39%), Positives = 174/304 (57%)
Query:   5 SSIIKKILSAFLALFFISLLTFILIKLSTVNSAENYLRLSKISVSPEALKEAEHYLGLDK     64
           S I K+I +    + F   + F+ I+LS V+ AE YL  + I  + E L E  H  GLD+
Sbjct:   3 SYIAKRIFAVIPIVLFAIFIMFVFIRLSPVDPAEAYLTAANIHPTEELLAEKRHEFGLDQ     62

Query:  65 PLWKQYWLWFQKALTGDFGYSYVLRLPVLDLVLQRFLATLFLGTSAFLLIVTISTPLGVW    124
           P+  QY    K    DFG+SYV   PV D V R   ATL L  S+  L V IS PLG
Sbjct:  63 PMAVQYVQTIVKVFQLDFGHSYVTNQPVWDEVTARMPATLQLAVSSIFLAVLISIPLGFL    122

Query: 125 AGLHESARSDHLIRFLSFSSVSMPNFWVAYLLMLLFSAKLNLLPVSGGNDLQSLILPSIT    184
            + +++++  D   R LS+   S+P FW+ YLL+   FS KLNL PV G        L+LP++T
Sbjct: 123 SAIYKNSLIDRFSRLLSYLGASIPQFWLGYLLIFFFSVKLNLFPVEGRGSWAHLVLPTVT    182

Query: 185 LSFSTVGQYIALIRKAISQENRSLNVENARLRGVKERYIVTHHLLRNALPAIMTALSLTW    244
           LS + +  Y  L+R ++ ++ +    V  AR RG+KE+ I+  H+L+ A+  ++T L  +
Sbjct: 183 LSLALIAIYTRLLRASVLEQMQESYVLYARTRGIKEKVIMVKHVLKLAISPVITGLGMNV    242

Query: 245 VYLLTGSIIVEEIFSWNGIGRLFVTSLRTSDLPVIQACMLIFGTLFLANNFMTQCFMNWV    304
            LLTG+IIVE++FSW G GR FV ++    D+PVIQ +L+  LF+ N +     +
```

```
Sbjct: 243 GKLLTGTIIVEQVFSWPGFGRYFVDAIFNRDIPVIQCYVLLAACLFIVCNLIVDLVQLAM    302

Query: 305 DPRL                                                          308
           DPR+

Sbjct: 303 DPRI                                                          306
```

A related DNA sequence was identified in *S. pyogenes* <SEQ ID 63> which encodes the amino acid sequence <SEQ ID 64>. Analysis of this protein sequence reveals the following:

```
Possible site: 40
>>> Seems to have an uncleavable N-term signal seq
INTEGRAL     Likelihood = -7.27    Transmembrane 290-306 (287-313)
INTEGRAL     Likelihood = -6.37    Transmembrane 12-28 (4-33)
INTEGRAL     Likelihood = -5.89    Transmembrane 105-121 (100-128)
INTEGRAL     Likelihood = -5.26    Transmembrane 145-161 (142-172)
INTEGRAL     Likelihood = -2.39    Transmembrane 191-207 (190-208)
----- Final Results -----
    bacterial membrane --- Certainty = 0.3909 (Affirmative) <succ>
      bacterial outside --- Certainty = 0.0000 (Not Clear) <succ>
        bacterial cytoplasm --- Certainty = 0.0000 (Not Clear) <succ>
```

An alignment of the GAS and GBS proteins is shown below:

```
Identities = 102/324 (31%), Positives = 167/324 (51%), Gaps = 28/324 (8%)
Query:   7 IIKKILSAFLALFFISLLTFILIKLSTVN---SAENYLRLSKISVSPEALKEAEHYLGLD      63
           II KI+     +F +S+LTF+L+K S V+     ++ NY     S++P   K   H+ GLD Sbjct:   8 IIWKIIRCVTLIFGVSVLTFVLLKQSPVDPVMASVNY----DTSLTPAQYKAIAHHYGLD     63

Query:  64 KPLWKQYWLWFQKALTGDFGYSYVLRLPVLDLVLQRFLATLFLGTSAFLLIVTISTPLGV    123
           KP    QY++W +  + GD G S V R PV D++  R  A+  L   +++L   I   LG Sbjct:  64 KPALVQYFIWLKNVIQGDLGTSLVYRQPVSDIIRSRAGASFILMGLSWILSGLIGFILGT    123

Query: 124 WAGLHESARSDHLIRFLSFSSVSMPNFWVAYLLMLLFSAKLNLLPVSGGNDL--------    175
             +  H+    D ++R+ S+  +S+P FW+   + +L+FS +L    P+     +  +

Sbjct: 124 LSAFHQGKLLDRVVRWFSYLQISVPTFWIGLIFLLIFSVQLGWFPIGISSPIGTLSQDIT    183

Query: 176 -----QSLILPSITLSFSTVGQYIALIRKAISQENRSLNVENARLRGVKERYIVTHHLLR    230
                + L+LP    TLS  +      R +      S   V  AR RG +  I   HH LR Sbjct: 184 LADRVKHLMLPVFTLSILGIANVTLHTRTKMMSVLSSEYVLFARARGETQWQIFKHHCLR    243

Query: 231 NALPAIMTALSLTWVY---LLTGSIIVEEIFSWNGIGRLFVTSLRTSDLPVIQACMLIFG    287
           N   AI+ A++L + Y   L   GS++ E++FS+ G+G     +  SD P++ A ++I G Sbjct: 244 N---AIVPAITLHFSYFGELFGGSVLAEQVFSYPGLGSTLTEAGLKSDTPLLLAIVMI-G    299

Query: 288 TLFL-ANNFMTQCFMNWVDPRLRK                                      310
           TLF+ A N +      +  ++P+LR+

Sbjct: 300 TLFVFAGNLIADILNSIINPQLRR                                      323
```

Based on this analysis, it was predicted that these proteins and their epitopes could be useful antigens for vaccines or diagnostics.

Example 23

A DNA sequence (GBSx0020) was identified in *S. agalactiae* <SEQ ID 65> which encodes the amino acid sequence <SEQ ID 66>. This protein is predicted to be nickel transport system (permease). Analysis of this protein sequence reveals the following:

```
Possible site: 14
>>> Seems to have a cleavable N-term signal seq.
INTEGRAL    Likelihood = -7.64   Transmembrane 57-73 (51-80)
INTEGRAL    Likelihood = -6.85   Transmembrane 173-189 (169-194)
INTEGRAL    Likelihood = -5.79   Transmembrane 94-110 (86-112)
INTEGRAL    Likelihood = -1.44   Transmembrane 221-237 (221-238)
INTEGRAL    Likelihood = -1.33   Transmembrane 118-134 (118-134)
----- Final Results -----
    bacterial membrane --- Certainty = 0.4057 (Affirmative) <succ>
        bacterial outside --- Certainty = 0.0000 (Not Clear) <succ>
            bacterial cytoplasm --- Certainty = 0.0000 (Not Clear) <succ>
```

The protein has homology with the following sequences in the GENPEPT database:

```
>GP: BAB04288 GB: AP001509 nickel transport system (permease)
[Bacillus halodurans]
Identities = 103/239 (43%), Positives = 157/239 (65%)
Query:    6 AIFAPILSSFDPQYVDLSQKLLAPNNVHLLGTDQLGRDVLSRLLYGARYSLFLAIIISLL    65
            AI AP ++   DP  V+L+  KLL P+   +  LGTDQLGR  LSRLL+GAR  SL   A +I +

Sbjct:   29 AILAPWIAPHDPIQVNLALKLLPPSWEYPLGTDQLGRCNLSRLLFGARVSLGFATLIFIS    88

Query:   66 ELTIGMFVGLIVGWYQGKLENLFLWIANIILAFPSFLLSLATVGILGHGLGNLIFAIVFV   125
            L  IG+  VG I G+    G ++++  +       ++AFP+ +L L   VG+ G  GL   ++  A+V V Sbjct:   89 SLGIGLLVGAIAGYRGGWIDSVLMRFCEGVMAFPNLVLVLGLVGLFGPGLWQVVLALVMV   148

Query:  126 EWVYYAKLMTNLVKSAKKEPYVINAQIMGLSVWHILRKHIFPFVYQPILVMVLMNIGNII   185
            +WVYYA++  +++  S  K++  ++       A+I G S W  I+R+HI  P  V   PI+V+   +  +G    I Sbjct:  149 QWVYYARMFRSMIVSLKEQNFITAARISGSSPWKIIRRHIIPNVLPPIVVIGTLEMGWAI   208

Query:  186 LMISGFSFLGIGVQPNVTEWGMMLHDARGYFRTATWMMLSPGIAIFLTVFSFNTLGDAI    244
            +  IS  SFLG+G+QP      EWG M+H+ + +  R+     +ML  PGI  I  L  V  +FN  LG+++

Sbjct:  209 MDISALSFLGLGIQPPTPEWGAMIHEGKSFIRSHPELMLYPGIMILLVVMTFNVLGESL   267
```

A related DNA sequence was identified in *S. pyogenes* <SEQ ID 67> which encodes the amino acid sequence <SEQ ID 68>. Analysis of this protein sequence reveals the following:

```
Possible site: 39
>>> Seems to have an uncleavable N-term signal seq
INTEGRAL    Likelihood = -7.80   Transmembrane 182-198 (180-204)
INTEGRAL    Likelihood = -7.38   Transmembrane 77-93 (69-98)
INTEGRAL    Likelihood = -7.06   Transmembrane 112-128 (104-132)
INTEGRAL    Likelihood = -6.16   Transmembrane 8-24 (7-31)
INTEGRAL    Likelihood = -5.10   Transmembrane 239-255 (235-258)
----- Final Results -----
    bacterial membrane --- Certainty = 0.4121 (Affirmative) <succ>
        bacterial outside --- Certainty = 0.0000 (Not Clear) <succ>
            bacterial cytoplasm --- Certainty = 0.0000 (Not Clear) <succ>
```

An alignment of the GAS and GBS proteins is shown below:

```
Identities = 61/246 (24%), Positives = 127/246 (50%), Gaps = 1/246 (0%)
Query:    2 LVISAIFAPILSSFDPQYVDLSQKLLAPNNVHLLGTDQLGRDVLSRLLYGARYSLFLAII    61
            L++S +   +      P   + + + LAP+  HL GTD LGRD+  R + G  +SL + ++

Sbjct:   19 LILSILALNLYFYRTPLETNAALRNLAPSLNHLFGTDGLGRDMFVRTIKGLYFSLQVGLL    78

Query:   62 ISLLELTIGMFVGLIVGWYQGKLENLFLWIANIILAFPSFLLSLATVGILGHGLGNLIFA   121
            +L+ + +      G++ G        ++ + W+ ++  +   P  +        ++G G    +I A Sbjct:   79 GALMGVFLATVFGVLAGLGNSLIDKIIAWLVDLFIGMPHLIFMILISFVVGKGAQGVIIA   138

Query:  122 IVFVEWVYYAKLMTNLVKSAKEEPYVINAQIMGLSVWHILRKHIFPFVYQPILVMVLMNI   181
                   W     A+L+  N V     K + +V  ++ MG  + ++I+R HI  P +    I +   ++
```

```
-continued
Sbjct: 139 TAVTHWPSLARLIRNEVYDLKNKAFVQLSKSMGKTPYYIVRHHILPLIASQIFIGFILLF      198

Query: 182 GNIILMISGFSFLGIGVQPNVTEWGMMLHDARGYFRTAT-WMMLSPGIAIFLTVFSFNTL       240
           ++IL  +  +FLG G+         G++L +A  +      W+++ PG+ + L V +F+T+

Sbjct: 199 PHVILHEASMTFLGFGLSAEQPSVGIILSEAAKHISLGNWWLVIFPGLYLILVVNAFDTI      258

Query: 241 GDAIDK                                                           246
           G+++ K Sbjct: 259 GESLKK                                                           264
```

A related GBS gene <SEQ ID 8473> and protein <SEQ ID 8474> were also identified. Analysis of this protein sequence reveals the following:

Lipop: Possible site: −1  Crend: 0
McG: Discrim Score: 7.56

```
ORF02082(292-1053 of 1365)
EGAD|89511|HP0300(23-283 of 285) dipeptide ABC transporter, permease protein (dppC)
{Helicobacter pylori} OMNI|HP0300 dipeptide ABC transporter, permease protein (dppC)
GP|2313398|gb|AAD07369.1| |AE000548 dipeptide ABC transporter, permease protein (dppC)
{Helicobacter pylori 26695} PIR|D64557|D64557 dipeptide ABC transporter, permease protein -
Helicobacter pylori (strain 26695)
% Match = 20.5
% Identity = 43.4  % Similarity = 63.3
Matches = 111 Mismatches = 92 Conservative Sub.s = 51

30        60        90       120       150       180       210       240
P*KCLTCDNDST*LDLGLLINRINYC*RNFFMEWNRTFICDQSKNFRSSSNTSLYANFWNLIFS**FYDTVFYELG*SSV

MESFR 270       300       330       360          402       432       462
TKVKGEIISKRIYFSSSLLVLLVISAIFAPILSSFDPQYVDLSQKLLAP------NNVHLLGTDQLGRDVLSRLLYGARY
                   :::||||  ||||||:|:  ||   :   :|| |      |  :|||||  ||||:|||| :||||
EFIQQFKKNKAAVVGAWIVLLLVICAIFAPLLAPHDPYVQNAQDRLLKPIWEHGGNAKYLLGTDDLGRDILSRLIYGARI
                    20        30        40        50        60        70        80

492       522       552       582       612       642       672       702
SLFLAIIISLLELTIGMFVGLIVGWYQGKLENLFLWIANIILAFPPSFLLSLATVGILGHGLGNLIFAIVFVEWVYYAKLM
|| : |:    :   :  :|||  |::  ||  ::  | |:|:|:||   |   :||   | |   |  ||    :|::
SLTIGIVSMGIAVFFGTILGLIAGYFGGKTDAIIMRIMDIMFALPSILLIVIVVAVLGPSLTNAMLAIGFVGIPGFARLV
                   100       110       120       130       140       150       160

732       762       792       822       852       882       912       942
TNLVKSAKKEPYVINAQIMGLSVWHILRKHIFPPFVYQPILVMVLMNIGNIILMISGFSFLGIGVQPNVTEWGMMLHDARG
 :  |   |:: ||| ::| |    ::       :: ||||   |   :|  :|||||:|| ||| ||  ::
RSSVLGEKEKEYVIASKINGSSHLRLMCKVIFPNCIIPLIVQTTMGFASTVLEAAALSFLGLGAQPPKPEWGAMLMNSMQ
                   180       190       200       210       220       230       240

972      1002      1032      1059      1089      1119      1149
YFRTATWMMLSPGIAIFLTVFSFNTLGDAI-DKKDWKRQWNS*K*ENCHYR*ERSLY*EILVVK*IWENR*LLLVRVV
|  || ||::  ||: |||||| ||| |  | | | |
YIATAPWMLVFPGVMIFLTVMSFNLVGDGIMDALDPKRTS
                   260       270       280
```

-continued

GvH: Signal Score (−7.5): −1.15
Possible site: 14
>>> Seems to have a cleavable N-term signal seq.
ALOM program count: 5  value: −7.64  threshold: 0.0
INTEGRAL    Likelihood = −7.64   Transmembrane 57-73 (51-80)
INTEGRAL    Likelihood = −6.85   Transmembrane 173-189 (169-194)
INTEGRAL    Likelihood = −5.79   Transmembrane 94-110 (86-112)
INTEGRAL    Likelihood = −1.44   Transmembrane 221-237 (221-238)
INTEGRAL    Likelihood = −1.33   Transmembrane 118-134 (118-134)
PERIPHERAL  Likelihood = 4.72    145
modified ALOM score: 2.03

-continued

*** Reasoning Step: 3
----- Final Results -----
  bacterial membrane --- Certainty = 0.4057 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

Based on this analysis, it was predicted that these proteins and their epitopes could be useful antigens for vaccines or diagnostics.

Example 24

A DNA sequence (GBSx0021) was identified in *S. agalactiae* <SEQ ID 69> which encodes the amino acid sequence <SEQ ID 70>. This protein is predicted to be peptide ABC transporter, ATP-binding protein. Analysis of this protein sequence reveals the following:

Possible site: 60
>>> Seems to have no N-terminal signal sequence
INTEGRAL    Likelihood = −0.32    Transmembrane 161-177 (161-177)
----- Final Results -----
   bacterial membrane --- Certainty = 0.1128 (Affirmative) <succ>
    bacterial outside --- Certainty = 0.0000 (Not Clear) <succ>
     bacterial cytoplasm --- Certainty = 0.0000 (Not Clear) <succ>

A related GBS nucleic acid sequence <SEQ ID 10027> which encodes amino acid sequence <SEQ ID 10028> was also identified.

The protein has homology with the following sequences in the GENPEPT database:

Possible site: 55
>>> Seems to have no N-terminal signal sequence
INTEGRAL    Likelihood = −2.50    Transmembrane 168-184 (167-184)
INTEGRAL    Likelihood = −1.70    Transmembrane 211-227 (211-227)
----- Final Results -----
   bacterial membrane --- Certainty = 0.1999 (Affirmative) <succ>
    bacterial outside --- Certainty = 0.0000 (Not Clear) <succ>
     bacterial cytoplasm --- Certainty = 0.0000 (Not Clear) <succ>

```
>GP: AAF73561 GB: AE002315 peptide ABC transporter, ATP-binding
protein [Chlamydia muridarum]
Identities = 86/253 (33%), Positives = 154/253 (59%), Gaps = 2/253 (0%)
Query:    1 METTMEQLEIRKLSLQIGEVPVLRDFSCKIDMGESLTIIGESGSGKTLLAKLLVGHIPQG         60
            M   T+  ++E   ++++       ++    S   I    +SL ++GE+GSGKT  ++K  ++G  +P
Sbjct:    1 MSKTLLKIENLVVAIKESNQRLVNHLSLTIKQRQSLALVGENGSGKTTVSKAILGFLPDN        60

Query:   61 MTVR-GNIFFKGVDLGKLTVKQWQKLRGRDIAYLVQNPMSMFNPFQKIEAHILETILSHE         119
            ++  G  IF+  G  D+  +L+  K++Q  +RG+  I+  +  QN M      P  ++     I+ET+   H
Sbjct:   61 CCIQSGKIFYSGTDITRLSRKEFQSIRGKKISTIFQNAMGTLTPSMRVGTQIIETLRHHF        120

Query:  120 KCSKRVALSKALEWMKRLNLDDAISLLKKYPFELSGGMLQRIMLATILSLDPQVIILDEP         179
                SK  A +KA E +  ++++        L+ YPFELSGGM QR+ +A   L+ +P++II DEP
Sbjct:  121 VMSKEEAFAKARELLVSVHIESPDRCLQLYPFELSGGMCQRVSIAIALATNPELIIADEP        180

Query:  180 TSAVDCHNCSTISAILQEL-QNNGKTLITVTHDYQLARDLGGQLLVISEGEVVEQGQTQA         238
            ++A+D   + + +  +L+++ QNN     L+  +TH+   L    +L  ++ ++I  GE+VEQG
Sbjct:  181 STALDSISQAQVLRVLKQIHQNNNTALLLITHNLALVSELCEEMAIIHHGEIVEQGPVHE        240

Query:  239 ILSNPQHNYTKAL                                                    251
            +L +P H YT+ L
Sbjct:  241 LLRSPSHPYTQKL                                                   253
```

A related DNA sequence was identified in *S. pyogenes* <SEQ ID 71> which encodes the amino acid sequence <SEQ ID 72>. Analysis of this protein sequence reveals the following:

An alignment of the GAS and GBS proteins is shown below:

```
Identities = 87/232 (37%), Positives = 138/232 (58%), Gaps = 3/232 (1%)
Query:   23 LRDFSCKIDMGESLTIIGESGSGKTLLAKLLVGHIPQ-GMTVRGNIFFKGVDLGKL-TVK         80
            +R+ S ++   GE L  +GESGSGK++L K    G +      G    G+I ++G +L   L T K
Sbjct:   28 IRNVSLELVEGEVLAFVGESGSGKSVLTKTFTGMLESNGRIANGSIVYRGQELTDLKTNK        87

Query:   81 QWQKLRGRDIAYLVQNPMSMFNPFQKIEAHILETILSHEKCSKRVALSKALEWMKRLNLD         140
            +W K+RG   IA +  Q+PM+  +P + I  + I E I+  H+K S      A  AL++M ++ +
Sbjct:   88 EWAKIRGSKIATIFQDPMTSLSPIKTIGSQITEVIIKHQKVSHAKAKEMALDYMNKVGIP        147

Query:  141 DAISLLKKYPFELSGGMLQRIMLATILSLDPQVIILDEPTSAVDCHNCSTISAILQELQN         200
            +A     + YPFE SGGM QRI++A   L+  P   ++I DEPT+A+D        +  I    +L+  LQ
Sbjct:  148 NAKKRFEDYPFEYSGGMRQRIVIAIALACRPDILICDEPTTALDVTIQAQIVELLKSLQR        207

Query:  201 NGK-TLITVTHDYQLARDLGGQLLVISEGEVVEQGQTQAILSNPQHNYTKAL             251
                T+I +THD  +       +  ++ V+   GE+VE G    + I   +P+H YT  +L
Sbjct:  208 EYHFTIIFITHDLGVVASIADKVAVMYAGEIVEFGTVEEIFYDPRHPYTWSL            259
```

Based on this analysis, it was predicted that these proteins and their epitopes could be useful antigens for vaccines or diagnostics.

Example 25

A DNA sequence (GBSx0022) was identified in *S. agalactiae* <SEQ ID 73> which encodes the amino acid sequence <SEQ ID 74>. This protein is predicted to be peptide ABC transporter, ATP-binding protein. Analysis of this protein sequence reveals the following:

```
Possible site: 50
>>> Seems to have an uncleavable N-term signal seq
----- Final Results -----
   bacterial membrane --- Certainty = 0.0000 (Not Clear) <succ>
   bacterial outside --- Certainty = 0.0000 (Not Clear) <succ>
   bacterial cytoplasm --- Certainty = 0.0000 (Not Clear) <succ>
```

A related GBS nucleic acid sequence <SEQ ID 10025> which encodes amino acid sequence <SEQ ID 10026> was also identified.

The protein has homology with the following sequences in the GENPEPT database:

A related DNA sequence was identified in *S. pyogenes* <SEQ ID 75> which encodes the amino acid sequence <SEQ ID 76>. Analysis of this protein sequence reveals the following:

```
Possible site: 60
>>> Seems to have no N-terminal signal sequence
----- Final Results -----
   bacterial cytoplasm --- Certainty = 0.3195 (Affirmative) <succ>
   bacterial membrane --- Certainty = 0.0000 (Not Clear) <succ>
   bacterial outside --- Certainty = 0.0000 (Not Clear) <succ>
```

```
>GP: BAB05797 GB: AP001514 oligopeptide ABC transporter (ATP-binding
protein) [Bacillus halodurans]
Identities = 82/199 (41%), Positives = 130/199 (65%), Gaps = 2/199 (1%)
Query:  19 RQEVLKDCHFHLKRGEIIGIMGKSGSGKSSLARLIIGLDSPTCGSIYFQG-KIYTPKDGK        77
            +Q++L    F  + GE +GI+G+SGSGKS+L RL++G++  P  G IYF+G K+
Sbjct:  21 KQKILNHISFECRHGECLGIIGESGSGKSTLGRLLLGIEKPDRGHIYFEGNKVEERSVRS       80

Query:  78 AQIILVFQDALSSVNPYFSIEEILNEAFYGKKTT-FELCQILEAVGLDGTYLKYKARQLS       136
             I  VFQD  SS+NP+F++E  + E    GKK    ++  +L+ VGL  +Y K    +LS
Sbjct:  81 GNISAVFQDYTSSINPFFTVETAIMEPLKGKKAAKSKVDYLLKQVGLHPSYKKKYPHELS       140

Query: 137 GGQLQRVCIARALLLKPKIIIFDESLSGLDPVTQIKMLRLLQKIKRRYELSFIMISHDPK       196
            GG++QRVCIARA+  +PK I+ DE++S LD   Q ++L LL ++KR Y++S++ I+HD +
Sbjct: 141 GGEVQRVCIARAISTEPKCIVLDEAISSLDVSIQTQVLDLLIELKRIYQMSYLFITHDIQ       200

Query: 197 ICQAICNRVFLIKNGYLVE                                             215
            IC+R+ + ++G + E
Sbjct: 201 AAAYICDRIMIFRHGQIEE                                             219
```

An alignment of the GAS and GBS proteins is shown below:

```
Identities = 91/238 (38%), Positives = 137/238 (57%), Gaps = 21/238 (8%)
Query:   1 MKEIFLMLVCNHVGKTFGRQ----EVLKDCHFHLKRGEIIGIMGKSGSGKSSLARLIIGL        56
            M E  + L +H+  TF ++      E +KD  H+ +G+I GI+G SG+GKS+L R+I  L
Sbjct:   1 MNEAIIQL--DHIDITFRQKKRVIEAVKDVTVHINQGDIYGIVGYSGAGKSTLVRVINLL        58

Query:  57 DSPTCGSI-------YFQGKIYTPKDGKAQ----IILVFQ--DALSSVNPYFSIEEILNE       103
            +PT G I        + QGKI    D  Q    I ++FQ + ++         ++   L
Sbjct:  59 QAPTNGKITVDGDVTFDQGKIQLSADALRQKRRDIGMIFQHFNLMAQKTAKENVAFALRH       118

Query: 104 AFYGK-KTTFELCQILEAVGLDGTYLKYKARQLSGGQLQRVCIARALLLKPKIIIFDESL       162
             +  K +    ++ ++LE VGL    Y A QLSGGQ QRV  IARAL    PKI+I DE+
Sbjct: 119 SSLSKTEKEHKVIELLELVGLSERADNYPA-QLSGGQKQRVAIARALANDPKILISDEAT       177

Query: 163 SGLDPVTQIKMLRLLQKIKRRYELSFIMISHDPKICQAICNRVFLIKNGYLVEDNEFL       220
```

```
        S LDP T  ++L LLQ++ R+   L+ +MI+H+  +I + ICNRV +++NG L+E+    L
Sbjct: 178 SALDPKTTKQILALLQELNRKLGLTIVMITHEMQIVKDICNRVAVMQNGVLIEEGSVL            235
```

Based on this analysis, it was predicted that these proteins and their epitopes could be useful antigens for vaccines or diagnostics.

Example 26

A DNA sequence (GBSx0023) was identified in *S. agalactiae* <SEQ ID 77> which encodes the amino acid sequence <SEQ ID 78>. This protein is predicted to be UMP kinase (pyrH). Analysis of this protein sequence reveals the following:

Possible site: 18
>>> Seems to have no N-terminal signal sequence
----- Final Results -----
  bacterial cytoplasm --- Certainty = 0.1935 (Affirmative) <succ>
  bacterial membrane --- Certainty = 0.0000 (Not Clear) <succ>
  bacterial outside --- Certainty = 0.0000 (Not Clear) <succ>

A related DNA sequence was identified in *S. pyogenes* <SEQ ID 79> which encodes the amino acid sequence <SEQ ID 80>. Analysis of this protein sequence reveals the following:

Possible site: 18
>>> Seems to have no N-terminal signal sequence
----- Final Results -----
  bacterial cytoplasm --- Certainty = 0.1955 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database:

```
>GP: CAB13524 GB: Z99112 uridylate kinase [Bacillus subtilis]
Identities = 143/238 (60%), Positives = 193/238 (81%)
Query:   2 EPKYQRILIKLSGEALAGDKGVGIDIPTVQSIAKEIAEVHNSGVQIALVIGGGNLWRGEP       61
           +PKY+RI++KLSGEALAG++G GI+    +QSIAK++ E+     V++A+V+GGGN    +

Sbjct:   3 KPKYKRIVLKLSGEALAGEQGNGINPTVIQSIAKQVKEIAELEVEVAVVVGGGNYGAEKT      62

Query:  62 AAEAGMDRVQADYTGMLGTVMNALVMADSLQQYGVDTRVQTAIPMQTVAEPYVRGRALRH     121
           ++ GMDR ADY GML TVMN+L + DSL+  G+ +RVQT+I M+ VAEPY+R +A+RH Sbjct:  63 GSDLGMDRATADYMGMLATVMNSLALQDSLETLGIQSRVQTSIEMRQVAEPYIRRKAIRH     122

Query: 122 LEKNRIVVFGAGIGSPYFSTDTTAALRAAEIEAEAILMAKNGVDGVYNADPKKDANAVKF     181
           LEK R+V+F AG G+PYFSTDTTAALRAAEIEA+ ILMAKN VDGVYNADP+KD +AVK+

Sbjct: 123 LEKKRVVIFAAGTGNPYFSTDTTAALRAAEIEADVILMAKNNVDGVYNADPRKDESAVKY     182

Query: 182 DELTHVEVIKRGLKIMDATASTISMDNDIDLVVFNMNETGNIKRVVLGEQIGTTVSNK      239
           + L++++V+K GL++MD+TAS++ MDNDI L+VF++ E GNIKR V+GE IGT V  K Sbjct: 183 ESLSYLDVLKDGLEVMDSTASSLCMDNDIPLIVFSIMEEGNIKRAVIGESIGTIVRGK      240
```

An alignment of the GAS and GBS proteins is shown below:

```
Identities = 224/242 (92%), Positives = 233/242 (95%)
Query:   1 MEPKYQRILIKLSGEALAGDKGVGIDIPTVQSIAKEIAEVHNSGVQIALVIGGGNLWRGE       60
           +EPKYQRILIKLSGEALAG+KGVGIDIPTVQ+IAKEIAEVH SGVQIALVIGGGNLWRGE Sbjct:   1 VEPKYQRILIKLSGEALAGEKGVGIDIPTVQAIAKEIAEVHVSGVQIALVIGGGNLWRGE       60

Query:  61 PAAEAGMDRVQADYTGMLGTVMNALVMADSLQQYGVDTRVQTAIPMQTVAEPYVRGRALR      120
           PAA+AGMDRVQADYTGMLGTVMNALVMADSLQ YGVDTRVQTAIPMQ VAEPY+RGRALR Sbjct:  61 PAADAGMDRVQADYTGMLGTVMNALVMADSLQHYGVDTRVQTAIPMQNVAEPYIRGRALR      120

Query: 121 HLEKNRIVVEGAGIGSPYFSTDTTAALRAAEIEAEAILMAKNGVDGVYNADPKKDANAVK      180
           HLEKNRIVVFGAGIGSPYFSTDTTAALRAAEIEA+AILMAKNGVDGVYNADPKKDANAVK Sbjct: 121 HLEKNRIVVFGAGIGSPYFSTDTTAALRAAEIEADAILMAKNGVDGVYNADPKKDANAVK      180
```

```
Query: 181 FDELTHVEVIKRGLKIMDATASTISMDNDIDLVVFNMNETGNIKRVVLGEQIGTTVSNKA    240
            FDELTH EVIKRGLKIMDATAST+SMDNDIDLVVFNMNE GNI+RVV GE IGTTVSNK
Sbjct: 181 FDELTHGEVIKRGLKIMDATASTLSMDNDIDLVVFNMNEAGNIQRVVFGEHIGTTVSNKV    240

Query: 241 SE    242
            +
Sbjct: 241 CD    242
```

Based on this analysis, it was predicted that these proteins and their epitopes could be useful antigens for vaccines or diagnostics.

Example 27

A DNA sequence (GBSx0024) was identified in *S. agalactiae* <SEQ ID 81> which encodes the amino acid sequence <SEQ ID 82>. Analysis of this protein sequence reveals the following:

Possible site: 22
>>> Seems to have no N-terminal signal sequence
----- Final Results -----
   bacterial cytoplasm --- Certainty = 0.3712 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 28

A DNA sequence (GBSx0025) was identified in *S. agalactiae* <SEQ ID 83> which encodes the amino acid sequence <SEQ ID 84>. This protein is predicted to be ribosome recycling factor (frr). Analysis of this protein sequence reveals the following:

Possible site: 34
>>> Seems to have no N-terminal signal sequence
----- Final Results -----
   bacterial cytoplasm --- Certainty = 0.1522 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database:

```
>GP: BAB06143 GB: AP001515 ribosome recycling factor [Bacillus halodurans]
Identities = 112/185 (60%), Positives = 149/185 (80%)
Query:    1 MTKEIVTKAQERFEQSHQSLSREFAGIRAGRANASLLDRIQVEYYGAPTPLNQLASITVP    60
            M+KE++  A++R  ++ ++L RE A +RAGRAN ++LDRI VEYYGA TPLNQLA+I+VP
Sbjct:    1 MSKEVLNDAEQRMTKATEALGRELAKLRAGRANPAMLDRITVEYYGAETPLNQLATISVP    60

Query:   61 EARVLLISPFDKSSIKDIERAINESDLGINPANDGSVIRLVIPALTEETRRDLAKEVKKV    120
            EAR+L+I PFDKSSI DIERAI +SDLG+ P+NDG+VIR+ IP LTEE RRDL K VKK
Sbjct:   61 EARLLVIQPFDKSSISDIERAIQKSDLGLTPSNDGTVIRITIPPLTEERRRDLTKLVKKS    120

Query:  121 GENAKIAIRNIRRDAMDEAKKQEKNKEITEDDLKSLEKDIQKATDDAVKHIDEMTANKEK    180
             E  AK+A+RNIRRDA D+ KK++K+ E+TEDDL+ + +D+QK TD  ++ ID+    KEK
Sbjct:  121 AEEAKVAVRNIRRDANDDLKKRQKDGELTEDDLRRVTEDVQKLIDKYIEQIDQKAEAKEK    180

Query:  181 ELLEV    185
            E++EV
Sbjct:  181 EIMEV    185
```

A related DNA sequence was identified in *S. pyogenes* <SEQ ID 85> which encodes the amino acid sequence <SEQ ID 86>. Analysis of this protein sequence reveals the following:

Possible site: 21
>>> Seems to have no N-terminal signal sequence
----- Final Results -----
   bacterial cytoplasm --- Certainty = 0.4462 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below:

```
Identities = 160/185 (86%), Positives = 171/185 (91%)
Query:    1 MTKEIVTKAQERFEQSHQSLSREFAGIRAGRANASLLDRIQVEYYGAPTPLNQLASITVP    60
```

```
                  M    I+   A+ERF QSHQSLSRE+A IRAGRANASLLDRIQV+YYGAPTPLNQLASITVP

Sbjct:    1 MANAIIETAKERFAQSHQSLSREYASIRAGRANASLLDRIQVDYYGAPTPLNQLASITVP            60

Query:   61 EARVLLISPFDKSSIKDIERAINESDLGINPANDGSVIRLVIPALTEETRRDLAKEVKKV           120
            EARVLLISPFDKSSIKDIERA+N SDLGI PANDGSVIRLVIPALTEETR++LAKEVKKV Sbjct:   61 EARVLLISPFDKSSIKDIERALNASDLGITPANDGSVIRLVIPALTEETRKELAKEVKKV           120

Query:  121 GENAKIAIRNIRRDAMDEAKKQEKNKEITEDDLKSLEKDIQKATDDAVEHIDEMTANKEK           180
            GENAKIAIRNIRRDAMD+AKKQEK KEITED+LK+LEKDIQKATDDA+K ID MTA KEK Sbjct:  121 GENAKIAIRNIRRDAMDDAKKQEKAKEITEDELKTLEKDIQKATDDAIKEIDRMTAEKEK           180

Query:  181 ELLEV                                                                 185
            ELL V Sbjct:  181 ELLSV                                                                 185
```

Based on this analysis, it was predicted that these proteins and their epitopes could be useful antigens for vaccines or diagnostics.

Example 29

A DNA sequence (GBSx0026) was identified in *S. agalactiae* <SEQ ID 87> which encodes the amino acid sequence <SEQ ID 88>. Analysis of this protein sequence reveals the following:

Possible site: 44
>>> Seems to have no N-terminal signal sequence
----- Final Results -----
   bacterial cytoplasm --- Certainty = 0.1356 (Affirmative) <succ>
      bacterial membrane --- Certainty = 0.0000 (Not Clear) <succ>
         bacterial outside --- Certainty = 0.0000 (Not Clear) <succ>

A related GBS nucleic acid sequence <SEQ ID 10023> which encodes amino acid sequence <SEQ ID 10024> was also identified.

The protein has homology with the following sequences in the GENPEPT database:

A related DNA sequence was identified in *S. pyogenes* <SEQ ID 89> which encodes the amino acid sequence <SEQ ID 90>. Analysis of this protein sequence reveals the following:

Possible site: 51
>>> Seems to have no N-terminal signal sequence
----- Final Results -----
   bacterial cytoplasm --- Certainty = 0.0811 (Affirmative) <succ>
      bacterial membrane --- Certainty = 0.0000 (Not Clear) <succ>
         bacterial outside --- Certainty = 0.0000 (Not Clear) <succ>

An alignment of the GAS and GBS proteins is shown below:

```
>GP: CAB12943 GB: Z99109 yitL [Bacillus subtilis]
Identities = 107/269 (39%), Positives = 155/269 (56%), Gaps = 6/269 (2%)
Query:   42 LVTDENKDF-YFIQKDGFTFALSKSEGEHHIGEM--VKGFAYTDMQQKARLTTKETFATR            98
            L  D    DF YF+      T  L  SE      I +   V+ F YD Q++    T K      +

Sbjct:   25 LSIDHQTDFGYFLTDGEDTILLHNSEMTEDIEDRDEVEVFIYVDQQERLAATMKIPIISA            84

Query:   99 DHYGWGTVTEVRKDLGVFLDTGLPDKQVVVSLDVLPELKELWPKKGDRLYVCLDVDKKDR           158
            D YGW  V +    +D+GVF+D GL  K  +V+ +  LP   +++WP+KGD+LY   L V   + R Sbjct:   85 DEYGWVEVVDKVEDMGVFVDVGL-SKDALVATEHLPPYEDVWPQKGDKLYCMLKVTNRGR           143

Query:  159 LWALPADPEVFQRMATPAYNNMQNQNWPAIVYRLKLSGTFVYLPENNMLGFIHPSERYSE           218
            ++A PA  ++   + T A ++  N+        VYRL  SG+FV + ++ +     FIHPSER  E Sbjct:  144 MFAKPAPEDIISELFTDASEDLMNKELTGTVYRLIASGSFV-ITDDGIRCFIHPSERKEE           202

Query:  219 PRLGQVLDARVIGFREVDRTLNLSLKPRSFEMLENDAQMILTYLESNGGFMTLNDKSSPE           278
            PRLG  + RVI  +E D ++NLSL PR + +   DA+ ILTY+     G M +DKS   P+

Sbjct:  203 PRLGSRVTGRVIQVKE-DGSVNLSLLPRKQDAMSVDAECILTYMRMRNGAMPYSDKSQPD           261

Query:  279 EIKATFGISKGQFKKALGGLMKAKKIKQD                                         307
            +I+  F +SK  FK+ALG LMK   K+ Q+

Sbjct:  262 DIRERFNMSKAAFKRALGHLMKNGKVYQE                                         290
```

```
Identities = 235/284 (82%), Positives = 265/284 (92%)
Query:  31 MNTLLATVITGLVTDENKDFYFIQKDGFTFALSKSEGEHHIGEMVKGFAYTDMQQKARLT         90
           MN LLATVITGL+ +EN + YFI K+GFTF LSK+EGE   IG+MV GFAYTD++QKARLT Sbjct:   1 MNDLLATVITGLIKEENANDYFIHKEGFTFTLSKAEGERQIGDMVTGFAYTDIEQKARLT         60

Query:  91 TKETFATRDHYGWGTVTEVRKDLGVFLDTGLPDKQVVVSLDVLPELKELWPKKGDRLYVC        150
           TKE  +TR  YGWG VTEVR+DLGVF+DTG+P+K++VVSLDVLPE+KELWPKKGD+LY+

Sbjct:  61 TKEIRSTRTSYGWGEVTEVRRDLGVFVDTGIPNKEIVVSLDVLPEMKELWPKKGDKLYIR        120

Query: 151 LDVDKKDRLWALPADPEVFQRMATPAYNNMQNQNWPAIVYRLKLSGTFVYLPENNMLGFI        210
           LDVDKKDR+W  LPA+PEVFQ+MA+PAYNNMQNQ+WPAIVYRLKL+GTFVYLPENNMLGFI Sbjct: 121 LDVDKKDRIWGLPAEPEVFQKMASPAYNNMQNQHWPAIVYRLKLTGTFVYLPENNMLGFI        180

Query: 211 HPSERYSEPRLGQVLDARVIGFREVDRTLNLSLKPRSFEMLENDAQMILTYLESNGGFMT        270
           H SERY+EPRLGQVLDARVIGFREVDRTLNLSLKPRSFEMLENDAQMI+TYLE+NGGFMT Sbjct: 181 HSSERYAEPRLGQVLDARVIGFREVDRTLNLSLKPRSFEMLENDAQMIVTYLEANGGFMT        240

Query: 271 LNDKSSPEEIKATFGISKGQFKKALGGLMKAKKIKQDQLGTELL                        314
           LNDKSSPEEIKA+FGISKGQFKKALGGLMKAK+IKQD  GTEL+

Sbjct: 241 LNDKSSPEEIKASFGISKGQFKKALGGLMKAKRIKQDATGTELI                        284
```

Based on this analysis, it was predicted that these proteins and their epitopes could be useful antigens for vaccines or diagnostics.

Example 30

A DNA sequence (GBSx0028) was identified in *S. agalactiae* <SEQ ID 91> which encodes the amino acid sequence <SEQ ID 92>. This protein is predicted to be peptide methionine sulfoxide reductase (msrA). Analysis of this protein sequence reveals the following:

Possible site: 33
>>> Seems to have no N-terminal signal sequence
----- Final Results -----
   bacterial cytoplasm --- Certainty = 0.0866 (Affirmative) <succ>
   bacterial membrane --- Certainty = 0.0000 (Not Clear) <succ>
   bacterial outside --- Certainty = 0.0000 (Not Clear) <succ>

A related GBS nucleic acid sequence <SEQ ID 10021> which encodes amino acid sequence <SEQ ID 10022> was also identified.

The protein has homology with the following sequences in the GENPEPT database:

A related DNA sequence was identified in *S. pyogenes* <SEQ ID 93> which encodes the amino acid sequence <SEQ ID 94>. Analysis of this protein sequence reveals the following:

Possible site: 17
>>> Seems to have no N-terminal signal sequence
----- Final Results -----
   bacterial cytoplasm --- Certainty = 0.0084 (Affirmative) <succ>
   bacterial membrane --- Certainty = 0.0000 (Not Clear) <succ>
   bacterial outside --- Certainty = 0.0000 (Not Clear) <succ>

RGD motif: 89-91

The protein has homology with the following sequences in the databases:

```
>GP: BAB05167 GB: AP001512 peptide methionine sulfoxide reductase
[Bacillus halodurans]
Identities = 102/173 (58%), Positives = 126/173 (71%), Gaps = 2/173 (1%)
Query:  14 ENDMERAIFAGGCFWCMVQPFEELDGIESVLSGYTGGHVENPTYKEVCSKTTGHTEAVEI         73
           E+     A FAGGCFWCMV PFEE  GI  V+SGYTGGH ENPTYKEVCS+TTGH EAV+I Sbjct:   3 ESKWALATFAGGCFWCMVSPFEEEPGIHQVVSGYTGGHTENPTYKEVCSETTGHYEAVQI         62

Query:  74 IFNPEKISYADLVELYWAQTDPTDAFGQFEDRGDNYRPVIFYENEEQRQIAQKSKDKLQA        133
             F+PE   Y  L+E+YW Q DPTD  GQF  DRGD+YR  IFY +E+Q+Q A   SK KL+

Sbjct:  63 SFDPEVFPYEKLLEIYWTQIDPTDPGGQFHDRGDSYRTAIFYHDEQKQAADASKQKLEE        122

Query: 134 SGRFDRPIVTSIEPADTFYPAEDYHQAFYRTNPARYAL--SSARRHAFLEENW              184
           SG+F+  PIVT I PA  FYPAE+YHQ +++ NP  Y +      + R AF++++W Sbjct: 123 SGKFNAPIVTRILPAKPFYPAEEYHQKYHKKNPFHYKMYRHGSGREAFIKQHW             175
```

```
>GP: BAB05167 GB: AP001512 peptide methionine sulfoxide reductase
[Bacillus halodurans]
Identities = 98/168 (58%), Positives = 125/168 (74%), Gaps = 4/168 (2%)
Query:    4 AIFAGGCFWCMVQPFEEQAGILSVRSGYTGGHLPNPSYEQVCAKTTGHTEAVEIIFDPKQ    63
            A FAGGCFWCMV PFEE+ GI  V SGYTGGH  NP+Y++VC++TTGH EAV+I FDP+

Sbjct:    9 ATFAGGCFWCMVSPFEEEPGIHQVVSGYTGGHTENPTYKEVCSETTGHYEAVQISFDPEV    68

Query:   64 IAYKDLVELYWTQTDPTDAFGQFEDRGDNYRPVIYYTTERQKEIAEQSKANLQASGRFDQ   123
            Y+ L+E+YWTQ DPTD  GQF DRGD+YR  I+Y  E+QK+ A+ SK  L+ SG+F+

Sbjct:   69 FPYEKLLEIYWTQIDPTDPGGQFHDRGDSYRTAIFYHDEQQKQAADASKQKLEESGKFNA   128

Query:  124 PIVTTIEPAEPFYLAEDYHQGFYKKNP---KRYAQSSAIRHQFLEENW              168
            PIVT I PA+PFY AE+YHQ ++KKNP   K Y   S  R  F++++W Sbjct:  129 PIVTRILPAKPFYPAEEYHQKYHKKNPFHYKMYRHGSG-REAFIKQHW              175
```

An alignment of the GAS and GBS proteins is shown below:

```
Identities = 130/168 (77%), Positives = 148/168 (87%)
Query:   17 MERAIFAGGCFWCMVQPFEELDGIESVLSGYTGGHVENPTYKEVCSKTTGHTEAVEIIFN    76
            MERAIFAGGCFWCMVQPFEE  GI SV SGYTGGH+ NP+Y++VC+KTTGHTEAVEIIF+

Sbjct:    1 MERAIFAGGCFWCMVQPFEEQAGILSVRSGYTGGHLPNPSYEQVCAKTTGHTEAVEIIFD    60

Query:   77 PEKISYADLVELYWAQTDPTDAFGQFEDRGDNYRPVIFYENEEQRQIAQKSKDKLQASGR   136
            P++I+Y DLVELYW QTDPTDAFGQFEDRGDNYRPVI+Y  E Q++IA++SK  LQASGR Sbjct:   61 PKQIAYKDLVELYWTQTDPTDAFGQFEDRGDNYRPVIYYTTERQKEIAEQSKANLQASGR   120

Query:  137 FDRPIVTSIEPADTFYPAEDYHQAFYRTNPARYALSSARRHAFLEENW              184
            FD+PIVT+IEPA+ FY AEDYHQ FY+ NP RYA SSA RH FLEENW Sbjct:  121 FDQPIVTTIEPAEPFYLAEDYHQGFYKKNPKRYAQSSAIRHQFLEENW              168
```

Based on this analysis, it was predicted that these proteins and their epitopes could be useful antigens for vaccines or diagnostics.

Example 31

A DNA sequence (GBSx0029) was identified in *S. agalactiae* <SEQ ID 95> which encodes the amino acid sequence <SEQ ID 96>. Analysis of this protein sequence reveals the following:

Possible site: 55
>>> Seems to have no N-terminal signal sequence
----- Final Results -----
    bacterial cytoplasm --- Certainty = 0.2727 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database:

```
>GP: CAB13859 GB: Z99114 yozE [Bacillus subtilis]
Identities = 24/66 (36%), Positives = 42/66 (63%)
Query:    3 KSFYSWLMTQRNPKSNEPVAILADYAFDETTFPKHSSDFETVSRYLEDEASFSFNLTDFD    62
            KSFY +L+  R+PK  + ++  A+ A+++ +FPK S+D+  +S YLE  A +    + FD Sbjct:    2 KSFYHYLLKYRHPKPKDSISEFANQAYEDHSFPKTSTDYHEISSYLELNADYLHTMATFD    61

Query:   63 DIWEDY    68
            + W+ Y

Sbjct:   62 EAWDQY    67
```

A related DNA sequence was identified in *S. pyogenes* <SEQ ID 97> which encodes the amino acid sequence <SEQ ID 98>. Analysis of this protein sequence reveals the following:

Possible site: 57
>>> Seems to have no N-terminal signal sequence
----- Final Results -----
    bacterial cytoplasm --- Certainty = 0.2571 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below:

```
Identities = 59/71 (83%), Positives = 65/71 (91%)
Query:   1 MRKSFYSWLMTQRNPKSNEPVAILADYAFDETTFPKHSSDFETVSRYLEDEASFSFNLTD    60
           MRKSFYSWLMTQRNPKSNEPVAILAD FD+TTFPKH++DFE +SRYLED+ASFSFNL Sbjct:   3 MRKSFYSWLMTQRNPKSNEPVAILADLVFDDTTFPKHTNDFELISRYLEDQASFSFNLGQ    62

Query:  61 FDDIWEDYLNH                                                   71
           FD+IWEDYL H Sbjct:  63 FDEIWEDYLAH                                                   73
```

Based on this analysis, it was predicted that these proteins and their epitopes could be useful antigens for vaccines or diagnostics.

Example 32

A DNA sequence (GBSx0030) was identified in *S. agalactiae* <SEQ ID 99> which encodes the amino acid sequence <SEQ ID 100>. This protein is predicted to be antigen, 67 kDa (myosin-crossreactive). Analysis of this protein sequence reveals the following:

Possible site: 14
>>> Seems to have no N-terminal signal sequence
INTEGRAL    Likelihood = –4.57    Transmembrane 28-44 (26-45)
----- Final Results -----
  bacterial membrane --- Certainty = 0.2826 (Affirmative) <succ>
  bacterial outside --- Certainty = 0.0000 (Not Clear) <succ>
  bacterial cytoplasm --- Certainty = 0.0000 (Not Clear) <succ>

A related DNA sequence was identified in *S. pyogenes* <SEQ ID 101> which encodes the amino acid sequence <SEQ ID 102>. Analysis of this protein sequence reveals the following:

Possible site: 26
>>> Seems to have an uncleavable N-term signal seq
INTEGRAL    Likelihood = –4.62    Transmembrane 40-56 (38-57)
----- Final Results -----
  bacterial membrane --- Certainty = 0.2848 (Affirmative) <succ>
  bacterial outside --- Certainty = 0.0000 (Not Clear) <succ>
  bacterial cytoplasm --- Certainty = 0.0000 (Not Clear) <succ>

A related sequence was also identified in GAS <SEQ ID 9109> which encodes the amino acid sequence <SEQ ID 9110>. Analysis of this protein sequence reveals the following:

Possible cleavage site: 50
>>> Seems to have no N-terminal signal sequence
----- Final Results -----
  bacterial membrane --- Certainty = 0.285 (Affirmative) <succ>
  bacterial outside --- Certainty = 0.000 (Not Clear) <succ>
  bacterial cytoplasm --- Certainty = 0.000 (Not Clear) <succ>

An alignment of the GAS and GBS proteins is shown below:

```
Identities = 477/590 (80%), Positives = 542/590 (91%)
Query:    3 MRYTNGNFEAFARPRKPEGVDKKSAYIVGSGLAGLAAAVFLIRDGQMDGQRIHIFEELPL    62
            M YT+GN+EAFA PRKPEGVD+KSAYIVG+GLAGLAAAVFLIRDG M G+RIH+FEELPL Sbjct:   15 MYYTSGNYEAFATPRKPEGVDQKSAYIVGTGLAGLAAAVFLIRDGHMAGERIHLFEELPL    74

Query:   63 SGGSLDGVKRPDIGFVTRGGREMENHFECMWDMYRSIPSLEVPDASYLDEFYWLDKDDPN   122
            +GGSLDG+++P +GFVTRGGREMENHFECMWDMYRSIPSLE+P ASYLDEFYWLDKDDPN Sbjct:   75 AGGSLDGIEKPHLGFVTRGGREMENHFECMWDMYRSIPSLEIPGASYLDEFYWLDKDDPN   134

Query:  123 SSNCRLIHKQGNRLESDGDFTLGTHSKELVKLVMETEESLGAKTIEEVFSKEFFESNFWT   182
            SSNCRLIHK+GNR++ DG +TLG  SKEL+ L+M+TEESLG +TIEE FS++FF+SNFW Sbjct:  135 SSNCRLIHKRGNRVDDDGQYTLGKQSKELIHLIMKTEESLGDQTIEEFFSEDFFKSNFWV   194

Query:  183 YWGTMFAFEKWHSAIEMRRYAMRFIHHIGGLPDFTSLKFNKYNQYDSMVKPIISYLESHN   242
            YW TMFAFEKWHSA+EMRRYAMRFIHHI GLPDFTSLKFNKYNQYDSMVKPII+YLESH+

Sbjct:  195 YWATMFAFEKWHSAVEMRRYAMRFIHHIDGLPDFTSLKFNKYNQYDSMVKPIIAYLESHD   254

Query:  243 VDVQFDSKVTNISVDFKNGQKLAKAIHLTVGGEAKTIDLTPNDFVFVTNGSITESTNYGS   302
            VD+QFD+KVT+I V+    G+K+AK IH+TV GEAK I+LTP+D VFVTNGSITES+ YGS Sbjct:  255 VDIQFDTKVTDIQVEQTAGKKVAKTIHMTVSGEAKAIELTPDDLVFVTNGSITESSTYGS   314

Query:  303 HDTVAKPNTDLGGSWNLWENLAAQSDEFGHPKVFYKDIPKESWFVSATATIKDPAIEPYI   362
            H  VAKP   LGGSWNLWENLAAQSD+FGHPKVFY+D+P ESWFVSATATIK PAIEPYI Sbjct:  315 HHEVAKPTKALGGSWNLWENLAAQSDDFGHPKVFYQDLPAESWFVSATATIKHPAIEPYI   374

Query:  363 ERLTHRDLHDGKVNTGGIVTVTDSNWMMSFAIHRQPHFKEQKENETIVWIYGLYSNVEGN   422
            ERLTHRDLHDGKVNTGGI+T+TDSNWMMSFAIHRQPHFKEQKENET VWIYGLYSN EGN
```

```
Sbjct: 375 ERLTHRDLHDGKVNTGGIITITDSNWMMSFAIHRQPHFKEQKENETTVWIYGLYSNSEGN    434

Query: 423 YIKKPIEECTGREITEEWLYHLGVPEMKIHDLSDKQYVSTVPVYMPYITSYFMPRVKGDR    482
           Y+ K IEECTG+EITEEWLYHLGVP  KI DL+ + Y++TVPVYMPYITSYFMPRVKGDR Sbjct: 435 YVHKKIEECTGQEITEEWLYHLGVPVDKIKDLASQDYINTVPVYMPYITSYFMPRVKGDR    494

Query: 483 PDVIPQGSVNLAFIGNFAESPSRDTVFTTEYSIRTAMEAVYTELNIERGVPEVFNSAFDI    542
           P VIP GSVNLAFIGNFAESPSRDTVFTTEYSIRTAMEAVY+FLN+ERG+PEVFNSA+DI Sbjct: 495 PKVIPDGSVNLAFIGNFAESPSRDTVFTTEYSIRTAMEAVYSFLNVERGIPEVFNSAYDI    554

Query: 543 RVLLQSLYYLNDKKSVEDMDLPIPALMRKVGMKKIRGTYLEELLREAHLL           592
           R LL++ YYLNDKK+++DMDLPIPAL+ K+G KKI+ T++EELL++A+L+

Sbjct: 555 RELLKAFYYLNDKKAIKDMDLPIPALIEKIGHKKIKDTFIEELLKDANLM           604
```

A related GBS gene <SEQ ID 8475> and protein <SEQ ID 8476> were also identified. Analysis of this protein sequence reveals the following:

---

Lipop: Possible site: −1 Crend: 10
McG: Discrim Score: −19.82
GvH: Signal Score (−7.5): −1.16
Possible site: 14
>>> Seems to have no N-terminal signal sequence
ALOM program   count: 1 value: −4.57 threshold: 0.0
INTEGRAL       Likelihood = −4.57   Transmembrane 26-42 (26-45)
PERIPHERAL     Likelihood = 6.79    378
modified ALOM score: 1.41
*** Reasoning Step: 3
----- Final Results -----
    bacterial membrane --- Certainty = 0.2826 (Affirmative) <succ>
       bacterial outside --- Certainty = 0.0000 (Not Clear) <succ>
       bacterial cytoplasm --- Certainty = 0.0000 (Not Clear) <succ>

---

Figure 18:
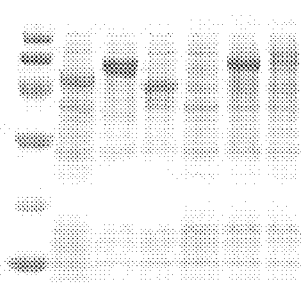

SEQ ID 8476 (GBS90) was expressed in *E. coli* as a His-fusion product. SDS-PAGE analysis of total cell extract is shown in FIG. 18 (lane 6; MW 68.5 kDa).

The GBS90-His fusion product was purified (FIG. 194, lane 11) and used to immunise mice. The resulting antiserum was used for Western blot (FIG. 256A), FACS (FIG. 256B), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 33

A DNA sequence (GBSx0031) was identified in *S. agalactiae* <SEQ ID 103> which encodes the amino acid sequence <SEQ ID 104>. This protein is predicted to be phoh-like protein (phoH). Analysis of this protein sequence reveals the following:

---

Possible site: 38
>>> Seems to have no N-terminal signal sequence
----- Final Results -----
    bacterial cytoplasm --- Certainty = 0.2339 (Affirmative) <succ>
    bacterial membrane --- Certainty = 0.0000 (Not Clear) <succ>
    bacterial outside --- Certainty = 0.0000 (Not Clear) <succ>

---

The protein has homology with the following sequences in the GENPEPT database:

```
>GP: CAB14476 GB: Z99117 phosphate starvation-induced protein
[Bacillus subtilis]
Identities = 191/305 (62%), Positives = 241/305 (78%), Gaps = 1/305 (0%)
Query:  27 LQHPDDMMSLFGSNERHLKLIEENLDVIIHARTERVQVLGDSEEAVETARLTIEALLVLV     86
           L++PD+ +SLFG+ +  LKL+E++L++ I  R E + V GD +E+ + A    + +LL L+
Sbjct:  12 LKNPDEALSLFGNQDSFLKLMEKDLNLNIITRGETIYVSGD-DESFQIADRLLGSLLALI    70

Query:  87 NRGMTVNTSDVVTALSMAQNGSIDKFVALYEEEIIKDSYGKPIRVKTLGQKIYVDSVKNH    146
            +G+ ++  DV+ A+  MA+     ++ F ++YEEEI K++ GK IRVKT+GQ+ YV ++K +
Sbjct:  71 RKGIEISERDVIYAIKMAKKNELEYFESMYEEEITKNAKGKSIRVKTMGQREYVAAMKRN    130

Query: 147 DVVFGIGPAGTGKTFLAVTLAVTALKRGQVKRIILTRPAVEAGESLGFLPGDLKEKVDPY    206
            D+VFGIGPAGTGKT+LAV  AV ALK G  +K+ IILTRPAVEAGESLGFLPGDLKEKVDPY
Sbjct: 131 DLVFGIGPAGTGKTYLAVVKAVHALKNGHIKKIILTRPAVEAGESLGFLPGDLKEKVDPY    190

Query: 207 LRPVYDALYQILGKEQTSRLMEREIIEIAPLAYMRGRTLDDAFVILDEAQNTTIMQMKMF    266
            LRP+YDAL+ +LG + T  RLMER IIEIAPLAYMRGRTLDDA+VILDEAQNTT   QMKMF
Sbjct: 191 LRPLYDALHDVLGADHTERLMERGIIEIAPLAYMRGRTLDDAYVILDEAQNTTPAQMKMF    250

Query: 267 LTRLGFNSKMIVNGDVSQIDLPKNVKSGLIDAVEKLRNIKKIDFIHLSAKDVVRHPVVAE    326
            LTRLGF+SKMI+ GDVSQIDLPK VKSGL  A E L+ I    I  L   DVVRHP+VA+
Sbjct: 251 LTRLGFSSKMIITGDVSQIDLPKGVKSGLAVAKEMLKGIDGISMIELDQTDVVRHPLVAK    310
```

```
Query: 327 IINAY 331
            II AY
Sbjct: 311 IIEAY 315
```

A related DNA sequence was identified in *S. pyogenes* <SEQ ID 105> which encodes the amino acid sequence <SEQ ID 106>. Analysis of this protein sequence reveals the following:

```
Possible site: 42
>>> Seems to have no N-terminal signal sequence
INTEGRAL     Likelihood = –0.85    Transmembrane 54-70 (54-70)
----- Final Results -----
   bacterial membrane --- Certainty = 0.1341 (Affirmative) <succ>
   bacterial outside --- Certainty = 0.0000 (Not Clear) <succ>
      bacterial cytoplasm --- Certainty = 0.0000 (Not Clear) <succ>
```

An alignment of the GAS and GBS proteins is shown below:

```
Identities = 274/322 (85%), Positives = 298/322 (92%)
Query:  18 LQEYSIEITLQHPDDMMSLFGSNERHLKLIEENLDVIIHARTERVQVLGDSEEAVETARL   77
           LQEYSI+ITL HPDD+++LFGSNERHLKLIE +L VI+HARTERVQV+GD EEAVE ARL
Sbjct:   1 LQEYSIDITLTHPDDVLALFGSNERHLKLIEAHLGVIVHARTERVQVIGDDEEAVELARL   60

Query:  78 TIEALLVLVNRGMTVNTSDVVTALSMAQNGSIDKFVALYEEEIIKDSYGKPIRVKTLGQK  137
           TI+ALLVLV RGM VNTSDVVTALSMA++ ID+F+ALYEEEIIKD+YGK IRVKTLGQK
Sbjct:  61 TIKALLVLVGRGMVVNTSDVVTALSMAESHQIDQFMALYEEEIIKDNYGKAIRVKTLGQK  120

Query: 138 IYVDSVKNHDVVFGIGPAGTGKTFLAVTLAVTALKRGQVKRIILTRPAVEAGESLGFLPG  197
           YVDSVK HDVVFG+GPAGTGKTFLAVTLAVTALKRGQVKRIILTRPAVEAGESLGFLPG
Sbjct: 121 TYVDSVFRHDVVFGVGPAGTGKTFLAVTLAVTALKRGQVERIILTRPAVEAGESLGFLPG  180

Query: 198 DLKEKVDPYLRPVYDALYQILGKEQTSRLMEREIIEIAPLAYMRGRTLDDAFVILDEAQN  257
           DLKEKVDPYLRPVYDALY ILGKEQT+RLMER++IEIAPLAYMRGRTLDDAFVILDEAQN
Sbjct: 181 DLKEKVDPYLRPVYDALYHILGKEQTTRLMERDVIEIAPLAYMRGRTLDDAFVILDEAQN  240

Query: 258 TTIMQMKMFLTRLGFNSKMIVNGDVSQIDLPKNVKSGLIDAVEKLRNIKKIDFIHLSAKD  317
           TTIMQMKMFLTRLGFNSKMIVNGD SQIDLP+NVKSGLIDA +KL+ IK+IDF++ SAKD
Sbjct: 241 TTIMQMKMFLTRLGFNSKMIVNGDTSQIDLPRNVKSGLIDATQKLQGIKQIDFVYFSAKD  300

Query: 318 VVRHPVVAEIINAYSDSESSHK  339
           VVRHPVVA+II AY S K
Sbjct: 301 VVRHPVVADIIKAYETSSEEMK  322
```

Based on this analysis, it was predicted that these proteins and their epitopes could be useful antigens for vaccines or diagnostics.

Example 34

A DNA sequence (GBSx0032) was identified in *S. agalactiae* <SEQ ID 107> which encodes the amino acid sequence <SEQ ID 108>. Analysis of this protein sequence reveals the following:

```
Possible site: 30
>>> Seems to have no N-terminal signal sequence
----- Final Results -----
   bacterial cytoplasm --- Certainty = 0.0275 (Affirmative) <succ>
   bacterial membrane --- Certainty = 0.0000 (Not Clear) <succ>
   bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 35

A DNA sequence (GBSx0033) was identified in *S. agalactiae* <SEQ ID 109> which encodes the amino acid sequence <SEQ ID 110>. This protein is predicted to be MutT/nudix family protein. Analysis of this protein sequence reveals the following:

```
Possible site: 46
>>> Seems to have no N-terminal signal sequence
----- Final Results -----
   bacterial cytoplasm --- Certainty = 0.2383 (Affirmative) <succ>
      bacterial membrane --- Certainty = 0.0000 (Not Clear) <succ>
      bacterial outside --- Certainty = 0.0000 (Not Clear) <succ>
```

The protein has homology with the following sequences in the GENPEPT database:

```
>GP: AAF09597 GB: AE001864 MutT/nudix family protein
[Deinococcus radiodurans]
Identities = 49/136 (36%), Positives = 69/136 (50%), Gaps = 8/136 (5%)
Query:   5 YISYIRSKVGHETIFLTYSGGILTDGKGRVLLQLRADKNSWGIIGGCMELGESSVDTLKR    64
           Y+S +R+ GH +     +L D GRVLLQ R D   WGI+GG +E GE  +     R
Sbjct:   6 YLSELRAVWGHRALPAAGVSVLLQDETGRVLLQRRGDDGQWGILGGGLEPGEDFLIAAHR    65

Query:  65 EFFEETGLRVEPIRLLNVY------TNFQDSYPNGDKAQTVGFIYEVSCPKPVNIEGFHN   118
           E  EETGLR   +R L +         F  YPNGD+   VG   E + P     +    +
Sbjct:  66 ELLEETGLRCPNLRPLPLSEGLVSGPQFWHRYPNGDEVYLVGLRTEGTVPAAALTDACPD   125

Query: 119 E--ETLQLDYFSKEDV                                              132
           +   ETL+L +F+ +D+
Sbjct: 126 DGGETLELRWFALDDL                                              141
```

A related DNA sequence was identified in *S. pyogenes* <SEQ ID 111> which encodes the amino acid sequence <SEQ ID 112>. Analysis of this protein sequence reveals the following:

Possible site: 61
>>> Seems to have no N-terminal signal sequence
----- Final Results -----
    bacterial cytoplasm --- Certainty = 0.4375 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below:

```
Identities = 93/157 (59%), Positives = 123/157 (78%)
Query:    1 MKQDYISYIRSKVGHETIFLTYSGGILTDGKGRVLLQLRADKNSWGIIGGCMELGESSVD    60
            M QDYISYIRSKVGH+ I L ++GGILT+  G+VL+QLR DK +W I GG MELGESS++
Sbjct:   16 MPQDYISYIRSKVGHDKIILNFAGGILTNDDGKVLMQLRGDKKTWTIPGGTMELGESSLE    75

Query:   61 TLKREFFEETGLRVEPIRLLNVYTNFQDSYPNGDKAQTVGFIYEVSCPKPVNIEGFHNEE   120
            T KREF EETG+ VE +RLLNVYT+F++  YPNGD  QT+ FIYE++    + I+ FHNEE
Sbjct:   76 TCKREFLEETGIEVEAVRLLNVYTHFEEVYPNGDAVQTIVFIYELTAVSDMAIDNFHNEE   135

Query:  121 TLQLDYFSKEDVKNITIVNEQHQLILDEYFSQTFQMG                         157
            TL+L +FS E++  +  V+ +H+L+L+EYFS +F MG
Sbjct:  136 TLKLQFFSHEEIAELESVSAKHRLMLEEYFSDSFAMG                         172
```

Based on this analysis, it was predicted that these proteins and their epitopes could be useful antigens for vaccines or diagnostics.

Example 36

A DNA sequence (GBSx0034) was identified in *S. agalactiae* <SEQ ID 113> which encodes the amino acid sequence <SEQ ID 114>. Analysis of this protein sequence reveals the following:

Possible site: 13
>>> Seems to have no N-terminal signal sequence
----- Final Results -----
    bacterial cytoplasm --- Certainty = 0.3690 (Affirmative) <succ>
      bacterial membrane --- Certainty = 0.0000 (Not Clear) <succ>
        bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 37

A DNA sequence (GBSx0035) was identified in *S. agalactiae* <SEQ ID 115> which encodes the amino acid sequence <SEQ ID 116>. Analysis of this protein sequence reveals the following:

Possible site: 25
>>> Seems to have a cleavable N-term signal seq.
----- Final Results -----
    bacterial outside --- Certainty = 0.3000 (Affirmative) <succ>
      bacterial membrane --- Certainty = 0.0000 (Not Clear) <succ>
        bacterial cytoplasm --- Certainty = 0.0000 (Not Clear) <succ>

The protein has homology with the following sequences in the GENPEPT database:

```
>GP: AAG05249 GB: AE004612 hypothetical protein [Pseudomonas aeruginosa]
Identities = 70/254 (27%), Positives = 127/254 (49%), Gaps = 2/254 (0%)
Query:   2 KITLHGVAETLLITLYIRAKDAMAKHPILNDQKSLAIVEQIEYDFDKFDNSEASFYATLA         61
            +ITL G +TLLITLY +A D+     IL+D+ +   V QI++DF +   + + A Sbjct:   5 RITLTGEKQTLLITLYAKALDSRLDDSILHDRFAEEAVRQIDFDFSRVALGKGNERALAM        64

Query:  62 RIRVMDREIKKFIRENPNSQILSIGCGLDTRFERVD-NGQIRWYNLDLPEVMEIRKLFFE        120
            R    D+  ++F+  +P  Q+L++GCGLD+R  RVD   ++ W++LD PEVM++R+   +

Sbjct:  65 RSHYFDQACREFLGRHPEGQVLNLGCGLDSRIYRVDPPAELPWFDLDYPEVMDLRERLYP        124

Query: 121 EHERVTNIAKSALDETWTREVNPQNAPFLIVSEGVLMFLKEDDVETFLHILTNSFSQFMA        180
             + ++D+   +   P+   P L+++EG++ +L+E  V   +   L  +

Sbjct: 125 PRAGAYRALRHSVDDDGWLQGVPRERPALVLAEGLMPYLRESQVRRLVERLVDHLGSGEL        184

Query: 181 QFDLCHKEMINKGKQHDTVKYMDTEFQFGITDGHEIVDLDPKLKQINLINFTDEMSKFEL        240
            FD   + I  + + ++  +  +  + I D E+      PL+ I  +    D       +L Sbjct: 185 LFDGYGRLGIMLLRLYPPLRETGAQVHWSIDDPRELERWHPALRFIEEVTDYDPQDVAKL        244

Query: 241 -GTLRSLLPTIRKF                                                 253
             + R +LP       F Sbjct: 245 PQSSRLMLPIYNGF                                                 258
```

No corresponding DNA sequence was identified in *S. pyogenes*.

A related GBS gene <SEQ ID 8477> and protein <SEQ ID 8478> were also identified. Analysis of this protein sequence reveals the following:

Lipop: Possible site: −1 Crend: 9
McG: Discrim Score: 0.37
GvH: Signal Score (−7.5): −0.97
Possible site: 25
>>> Seems to have a cleavable N-term signal seq.

ALOM program    count: 0 value: 4.35 threshold: 0.0
PERIPHERAL              Likelihood = 4.35                143
modified ALOM score: −1.37
*** Reasoning Step: 3
----- Final Results -----
  bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>

The protein has homology with the following sequences in the databases:

```
27.6/51.6% over 253aa
 Pseudomonas aeruginosa
 GP|9947849| hypothetical protein Insert characterized
ORF02096(304-1059 of 1404)
GP|9947849|gb|AAG05249.1|AE004612_3|AE004612(5-258 of 275) hypothetical protein
{Pseudomonas aeruginosa}
% Match = 11.6
% Identity = 27.6 % Similarity = 51.6
Matches = 70 Mismatches = 121 Conservative Sub.s = 61

255       285       315       345       375       405       435       465
E*YT*RNPVLEIQISK*NSIKESR*MKITLHGVAETLLITLYIRAKDAMAKHPILNDQKSLAIVEQIEYDFDKFDNSEAS
                      :|||  |  :|||||||| :|  |:      ||:|:  |  ||::||    :  :
                       MPGHRITLTGEKQTLLITLYAKALDSRLDDSILHDRFAEEAVRQIDFDFSRVALGKGN
                                    10        20        30        40        50

495       525       555       585       612       642       672       702
FYATLARXRVMDREIKKFIRENPNSQILSIGCGLDTRFERVDN-GQIRWYNLDLPEVMEIRKLFFEEHERVTNIAKSALD
   |  |   |:  ::|:   :|   |::|::||||||:|  |||    ::  |::||  |||::|:  ::         : ::|
ERALAMRSHYFDQACREFLGRHPEGQVLNLGCGLDSRIYRVDPPEALPWFDLDYPEVMDLRERLYPPPAGAYRALRHSVD
                70        80        90       100       110       120       130

732       762       792       822       852       882       912       942
ETWTREVNPQNAPFLIVSEGVLMFLKEDDVETFLHILTNSFSQFMAQFDLCHKEMINKGKQHDTVKYMDTEFQFGITDGH
:     |:  | |:::||::  :|   |     |   :: ||     :    ::            ||    :  : ::
DDGWLQGVPRERPALVLAEGLMPYLRESQVRRLVERLVDHLGSGELLFDGYGRLGIMLLRLYPPLRETGAQVHWSIDDPR
       150       160       170       180       190       200       210

972      1002      1029      1059      1089      1119      1149      1179
EIVDLDPKLKQINLINFTDEMSKFELG-TLRSLLPTIRKFNNCLGVYEYKASEKK*QKSIYIKRHSKCKFVIICIAFVAL
|:  ||:| |  :  |     |  :|  :|  :|||      |  :
ELERWHPALRFIEEVTDYDPQDVAKLPQSSRLMLPIYNGFAFLRRMGRLIRYRWPRV
       230       240       250       260       270
```

SEQ ID 8478 (GBS176) was expressed in *E. coli* as a His-fusion product. SDS-PAGE analysis of total cell extract is shown in FIG. 36 (lane 5 & 6; MW 30 kDa). It was also expressed in *E. coli* as a GST-fusion product. SDS-PAGE analysis of total cell extract is shown in FIG. 41 (lane 7; MW 55.4 kDa).

```
>GP: AAC38046 GB: AF000954 No definition line found [Streptococcus mutans]
Identities = 140/164 (850), Positives = 157/164 (95%)
    Query:     1 MYVEMIDETGQVSEDIKKQTLDLLEFAAQKTGKENKEMAVTFVTNERSHELNLEYRDTDR      60
                 MY+EMIDET QVSE IK QTLD+LEFAAQKTGKE+KEMAVTFVTNERSHELNL+YRDT+R Sbjct:     1 MYIEMIDETNQVSEGIKNQTLDILEFAAQKTGKEDKEMAVTFVTNERSHELNLKYRDTNR      60

Query:    61 PTDVISLEYKPEVDISFDEEDLAENPELAEMLEDFDSYIGELFISIDKAKEQAEEYGHSY     120
                 PTDVISLEYKPE  +SFDEEDLA++P+LAE+L +FD+YIGELFIS+DKA+EQA+EYGHS+

Sbjct:    61 PTDVISLEYKPESSLSFDEEDLADDPDLAEVLTEFDAYIGELFISVDKAREQAQEYGHSF     120

Query:   121 EREMGFLAVHGFLHINGYDHYTPEEEKEMFSLQEEILTAYGLKR                    164
                 EREMGFLAVHGFLHINGYDHYTP+EEKEMFSLQEEIL AYGLKR Sbjct:   121 EREMGFLAVHGFLHINGYDHYTPQEEKEMFSLQEEILDAYGLKR                    164
```

The GBS176-GST fusion product was purified (FIG. 117A; see also FIG. 202, lane 5) and used to immunise mice (lane 1+2 product; 13.5 µg/mouse). The resulting antiserum was used for Western blot (FIG. 117B), FACS (FIG. 117C), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 38

A DNA sequence (GBSx0036) was identified in *S. agalactiae* <SEQ ID 117> which encodes the amino acid sequence <SEQ ID 118>. Analysis of this protein sequence reveals the following:

Possible site: 32
>>> Seems to have no N-terminal signal sequence
----- Final Results -----
  bacterial cytoplasm --- Certainty = 0.3712 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 10019> which encodes amino acid sequence <SEQ ID 10020> was also identified.

The protein has homology with the following sequences in the GENPEPT database:

A related DNA sequence was identified in *S. pyogenes* <SEQ ID 119> which encodes the amino acid sequence <SEQ ID 120>. Analysis of this protein sequence reveals the following:

Possible site: 49
>>> Seems to have no N-terminal signal sequence
----- Final Results -----
  bacterial cytoplasm --- Certainty = 0.1145 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below:

```
Identities = 138/165 (83%), Positives = 153/165 (92%)
    Query:     1 MYVEMIDETGQVSEDIKKQTLDLLEFAAQKTGKENKEMAVTFVTNERSHELNLEYRDTDR      60
                 MY+EMIDETGQVS++I +QTLDLL FAAQKTGKE KEM+VTFVTNERSHELNLEYRDTDR Sbjct:    18 MYIEMIDETGQVSQEIMEQTLDLLNFAAQKTGKEEKEMSVTFVTNERSHELNLEYRDTDR      77

Query:    61 PTDVISLEYKPEVDISFDEEDLAENPELAEMLEDFDSYIGELFISIDKAKEQAEEYGHSY     120
                 PTDVISLEYKPE  I F +EDLA +P LAEM+ +FD+YIGELFISIDKA+EQ++EYGHS+

Sbjct:    78 PTDVISLEYKPETPILFSQEDLAADPSLAEMMAEFDAYIGELFISIDKAREQSQEYGHSF     137

Query:   121 EREMGFLAVHGFLHINGYDHYTPEEEKEMFSLQEEILTAYGLKRQ                   165
                 EREMGFLAVHGFLHINGYDHYT EEEKEMF+LQEEILTAYGL RQ Sbjct:   138 EREMGFLAVHGFLHINGYDHYTLEEEKEMFTLQEEILTAYGLTRQ                   182
```

Based on this analysis, it was predicted that these proteins and their epitopes could be useful antigens for vaccines or diagnostics.

Example 39

A DNA sequence (GBSx0038) was identified in *S. agalactiae* <SEQ ID 121> which encodes the amino acid sequence <SEQ ID 122>. This protein is predicted to be phosphoglycerate dehydrogenase (serA) (serA). Analysis of this protein sequence reveals the following:

```
Possible site: 59
>>> Seems to have no N-terminal signal sequence
----- Final Results -----
    bacterial cytoplasm --- Certainty = 0.2817 (Affirmative) <succ>
    bacterial membrane --- Certainty = 0.0000 (Not Clear) <succ>
      bacterial outside --- Certainty = 0.0000 (Not Clear) <succ>
```

The protein has homology with the following sequences in the GENPEPT database:

```
>GP: AAB99020 GB: U67544 phosphoglycerate dehydrogenase (serA)
[Methanococcus jannaschii]
Identities = 82/232 (35%), Positives = 132/232 (56%), Gaps = 14/232 (6%)
Query:   3 ENPDAYIIRSQNLHNQDF---PSNLKAIARAGAGTNNIPIEEASAQGIVVFNTPGANANA           59
           ++ D  ++RS     +D       LK I RAG G +NI +E A+ +GI+V N P A++ +
Sbjct:  40 KDADVLVVRSGTKVTRDVIEKAEKLKVIGRAGVGVDNIDVEAATEKGIIVVNAPDASSIS          99

Query:  60 VKEAVIAALLLSARDYLGANRWVNTLTGTDIPKQIEAGKKAFAGNEIAGKKLGVIGLGAI          119
           V E +  +L +AR         N   T   K+ E  +K F G E+ GK LGVIGLG I
Sbjct: 100 VAELTMGLMLAAAR---------NIPQATASLKRGEWDRKRFKGIELYGKTLGVIGLGRI          150

Query: 120 GARIANDARRLGMTVLGYDPYVSIETAWNISSHVQRVKEIKDIFETCDYITIHVPLTNET          179
           G ++    A+  GM ++GYDPY+  E A ++    V+ V +I ++  +  D+IT+HVPLT +T
Sbjct: 151 GQQVVKRAKAFGMNIIGYDPYIPKEVAESMG--VELVDDINELCKRADFITLHVPLTPKT          208

Query: 180 KHTFDAKAFSIMKKGTTIINFARAELVNNQELFEAIETGVVKRYITDFGDKE              231
           +H   + ++MKK    I+N AR  L++ +  L+EA++ G ++     D  ++E
Sbjct: 209 RHIIGREQIALMKKNAIIVNCARGGLIDEKALYEALKEGKIRAAALDVFEEE             260
```

A related DNA sequence was identified in *S. pyogenes* <SEQ ID 123> which encodes the amino acid sequence <SEQ ID 124>. Analysis of this protein sequence reveals the following:

```
Possible site: 52
>>> Seems to have no N-terminal signal sequence
----- Final Results -----
    bacterial cytoplasm --- Certainty = 0.2384 (Affirmative) <succ>
    bacterial membrane --- Certainty = 0.0000 (Not Clear) <succ>
      bacterial outside --- Certainty = 0.0000 (Not Clear) <succ>
```

An alignment of the GAS and GBS proteins is shown below:

Based on this analysis, it was predicted that these proteins and their epitopes could be useful antigens for vaccines or diagnostics.

Example 40

A DNA sequence (GBSx0039) was identified in *S. agalactiae* <SEQ ID 125> which encodes the amino acid sequence <SEQ ID 126>. This protein is predicted to be alpha-glycerophosphate oxidase. Analysis of this protein sequence reveals the following:

```
Possible site: 50
>>> Seems to have no N-terminal signal sequence
----- Final Results -----
    bacterial cytoplasm --- Certainty = 0.2067 (Affirmative) <succ>
    bacterial membrane --- Certainty = 0.0000 (Not Clear) <succ>
      bacterial outside --- Certainty = 0.0000 (Not Clear) <succ>
```

The protein has homology with the following sequences in the GENPEPT database:

```
Identities = 52/198 (26%), Positives = 93/198 (46%), Gaps = 14/198 (7%)
Query:  24 LKAIARAGAGTNNIPIEEASAQGIVVFNTPGANANAVKEAVIAALLLSARDYLGANRWVN          83
           +K IA+ A  +  ++ A+  I++ N P +  ++ E  +  +L  R
Sbjct:  70 IKQIAQHSASVDMYNLDLATENDIIITNVPSYSPESIAEFTVTIVLNLIRHV--------          121

Query:  84 TLTGTDIPKQIEAGKKAFAGNEIAGKKLGVIGLGAIGARIANDARRLGMTVLGYDPYVSI          143
           L      ++ KQ        G +    + +IG G IG A +   G V+GYD Y S
Sbjct: 122 ELIRENVKKQNFTWGLPIRGRVLGDMTVAIIGTGRIGLATAKIFKGFGCKVVGYDIYQS-          180

Query: 144 ETAWNISSHVQRVKE-IKDIFETCDYITIHVPLTNETKHTFDAKAFSIMKKGTTIINFAR          202
           + A + + +  V+E IKD   D +++H+P T E   H F++ F   KKG ++N AR
Sbjct: 181 DAAKAVLDYKESVFEAIKD----ADLVSLHMPPTAENTHLFNSDLFKSFKKGAILMNMAR          236

Query: 203 AELVNNQELFEAIETGVV                                              220
           ++   Q+L +A++ G++
Sbjct: 237 GAVIETQDLLDALDAGLL                                              254
```

```
>GP: AAC34740 GB: U94770 alpha-glycerophosphate oxidase
[Streptococcus pneumoniae]
Identities = 24/49 (48%), Positives = 37/49 (74%)
Query:   1 MLFMRDNLDSLIQPVIDEMAKHYQWSDQDKTFYEEELHETLKDNDLAAL          49
           MLFMRD+LDS+++PV+DEM + Y W++++K  Y ++    L +NDLA L Sbjct: 558 MLFMRDSLDSIVEPVLDEMGRFYDWTEEEKATYRADVEAALANNDLAEL          606
```

A related DNA sequence was identified in *S. pyogenes* <SEQ ID 127> which encodes the amino acid sequence <SEQ ID 128>. Analysis of this protein sequence reveals the following:

Possible site: 40
>>> Seems to have no N-terminal signal sequence

INTEGRAL    Likelihood = –1.81    Transmembrane 20-36 (20-36)
----- Final Results -----
  bacterial membrane --- Certainty = 0.1723 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP: AAC34740 GB: U94770 alpha-glycerophosphate oxidase
[Streptococcus pneumoniae]
Identities = 462/607 (76%), Positives = 539/607 (88%)
Query:   1 MEFSRETRRLALQKMQERDLDLLIIGGGITGAGVALQAAASGLDTGLIEMQDFAQGTSSR          60
           MEFS++TR L+++KMQER LDLLIIGGGITGAGVALQAAASGL+TGLIEMQDFA+GTSSR Sbjct:   1 MEFSKKTRELSIKKMQERTLDLLIIGGGITGAGVALQAAASGLETGLIEMQDFAEGTSSR          60

Query:  61 STKLVHGGLRYLKQFDVEVVSDTVSERAVVQQIAPHIPKPDPMLLPVYDEPGSTFSMFRL         120
           STKLVHGGLRYLKQFDVEVVSDTVSERAVVQQIAPHIPKPDPMLLPVYDE G+TFS+FRL Sbjct:  61 STKLVHGGLRYLKQFDVEVVSDTVSERAVVQQIAPHIPKPDPMLLPVYDEDGATFSLFRL         120

Query: 121 KVAMDLYDLLAGVSNTPAANKVLTKEEVLKREPDLKQEGLLGGGVYLDFRNNDARLVIEN         180
           KVAMDLYDLLAGVSNTP ANKVL+K++VL+R+P+LK+EGL+GGGVYLDFRNNDARLVIEN Sbjct: 121 KVAMDLYDLLAGVSNTPTANKVLSKDQVLERQPNLKKEGLVGGGVYLDFRNNDARLVIEN         180

Query: 181 IKRANRDGALIASHVKAEDFLLDDNGKIIGVKARDLLSDQEIIIKAKLVINTTGPWSDEI         240
           IKRAN+DGALIA+HVKAE FL D++GKI GV ARDLL+DQ   IKA+LVINTTGPWSD++

Sbjct: 181 IKRANQDGALIANHVKAEGFLFDESGKITGVVARDLLTDQVFEIKARLVINTTGPWSDKV         240

Query: 241 RQFSHKGQPIHQMRPTKGVHLVVDRQKLPVSQPVYVDTGLNDGRMVFVLPREEKTYFGTT         300
             R  S+KG    QMRPTKGVHLVVD  K+ VSQPVY DTGL DGRMVFVLPRE KTYFGTT Sbjct: 241 RNLSNKGTQFSQMRPTKGVHLVVDSSKIKVSQPVYFDTGLGDGRMVFVLPRENKTYFGTT         300

Query: 301 DTDYTGDLEHPQVTQEDVDYLLGVVNNRFPNANVTIDDIESSWAGLRPLLSGNSASDYNG         360
           DTDYTGDLEHP+VTQEDVDYLLG+VNNRFP +N+TIDDIESSWAGLRPL++GNSASDYNG Sbjct: 301 DTDYTGDLEHPKVTQEDVDYLLGIVNNRFPESNITIDDIESSWAGLRPLIAGNSASDYNG         360

Query: 361 GNSGKVSDDSFDHLVDTVKAYINHEDSREAVEKAIKQVETSTSEKELDPSAVSRGSSFER         420
           GN+G +SD+SFD+L+ TV++Y++ E +RE VE A+ ++E+STSEK LDPSAVSRGSS +R Sbjct: 361 GNNGTISDESFDNLIATVESYLSKEKTREDVESAVSKLESSTSEKHLDPSAVSRGSSLDR         420

Query: 421 DENGLFTLAGGKITDYRKMAEGALTGIIQILKEEFGKSFKLINSKTYPVSGGEINPANVD         480
           D+NGL TLAGGKITDYRKMAEGA+   ++ ILK EF +SFKLINSKTYPVSGGE NPANVD Sbjct: 421 DDNGLLTLAGGKITDYRKMAEGAMERVVDILKAEFDRSFKLINSKTYPVSGGELNPANVD         480

Query: 481 SEIEAYAQLGTLSGLSMDDARYLANLYGSNAPKVFALTRQLTAAEGLSLAETLSLHYAMD         540
           SEIEA+AQLG    GL  +A YLANLYGSNAPKVFAL   L A  GLSLA+TLSLHYAM Sbjct: 481 SEIEAFAQLGVSRGLDSKEAHYLANLYGSNAPKVFALAHSLEQAPGLSLADTLSLHYAMR         540

Query: 541 YEMALKPTDYFLRRTNHLLFMRDSLDALIDPVINEMAKHFEWSDQERVAQEDDLRRVIAD         600
           +E+AL P D+ LRRTNH+LFMRDSLD++++PV++EM + ++W+++E+   D+   +A+

Sbjct: 541 NELALSPVDFLLRRTNHMLFMRDSLDSIVEPVLDEMGRFYDWTEEEKATYRADVEAALAN         600

Query: 601 NDLSALK                                                          607
           NDL+ LK Sbjct: 601 NDLAELK                                                          607
```

An alignment of the GAS and GBS proteins is shown below:

```
Identities = 29/49 (59%), Positives = 41/49 (83%)
Query:    1 MLFMRDNLDSLIQPVIDEMAKHYQWSDQDKTFYEEELHETLKDNDLAAL           49
            +LFMRD+LD+LI PVI+EMAKH++WSDQ++    E++L    + DNDL+AL Sbjct:  558 LLFMRDSLDALIDPVINEMAKHFEWSDQERVAQEDDLRRVIADNDLSAL         606
```

Based on this analysis, it was predicted that these proteins and their epitopes could be useful antigens for vaccines or diagnostics.

Example 41

A DNA sequence (GBSx0040) was identified in *S. agalactiae* <SEQ ID 129> which encodes the amino acid sequence <SEQ ID 130>. Analysis of this protein sequence reveals the following:

---

Possible site: 40
>>> Seems to have no N-terminal signal sequence
----- Final Results -----
    bacterial cytoplasm --- Certainty = 0.1011 (Affirmative) <succ>
    bacterial membrane --- Certainty = 0.0000 (Not Clear) <succ>
    bacterial outside --- Certainty = 0.0000 (Not Clear) <succ>

---

The protein has homology with the following sequences in the GENPEPT database:

```
>GP: BAB06309 GB: AP001516 unknown conserved protein
[Bacillus halodurans]
Identities = 70/160 (43%), Positives = 106/160 (65%), Gaps = 3/160 (1%)
Query:    5 TRPTTDKVKGAIFNMIGPFFEGGRVLDLFSGSGSLAIEAISRGMDQAVLVEKDRRAQVVI      64
            TRPTTDKVK AIFNMIGPFF+GG  LDL+ GSG L IEA+SRG+++ + V++ +RA    I Sbjct:   21 TRPTTDKVKEAIFNMIGPFFDGGIGLDLYGGSGGLGIEALSRGVERMIFVDQQKRAIETI     80

Query:   65 QENIAMTKSPEQFQLLKMEANRALEQLTGQ---FDLVLLDPPYAKEEIVKQIQIMDSKGL    121
            ++N++        + ++ + +A RAL+ LT +    F  V LDPPYAK+ I + I+   + GL Sbjct:   81 KQNLSHCGLEGRAEVYRNDAKRALQVLTKRGIVFAYVFLDPPYAKQTIKNDLAILANHGL    140

Query:  122 LGDDIMIACETDKSVDLPEEIASFGIWKQKIYGISKVTVY                       161
            L +  ++ CE D+    LP++I      K++ YG + +T+Y Sbjct:  141 LEEGGVVVCEHDRDTMLPDQIEYAVKHKEETYGDTMITIY                      180
```

A related DNA sequence was identified in *S. pyogenes* <SEQ ID 131> which encodes the amino acid sequence <SEQ ID 132>. Analysis of this protein sequence reveals the following:

---

Possible site: 58
>>> Seems to have no N-terminal signal sequence
----- Final Results -----
    bacterial cytoplasm --- Certainty = 0.3814 (Affirmative) <succ>
    bacterial membrane --- Certainty = 0.0000 (Not Clear) <succ>
    bacterial outside --- Certainty = 0.0000 (Not Clear) <succ>

---

An alignment of the GAS and GBS proteins is shown below:

```
Identities = 111/160 (69%), Positives = 136/160 (84%)
Query:    3 RTTRPTTDKVKGAIFNMIGPFFEGGRVLDLFSGSGSLAIEAISRGMDQAVLVEKDRRAQV     62
            +  TRPT+DKV+GAIFNMIGP+F GGRVLDLF+GSG LAIEA+SRGM  AVLVEK+R+AQ Sbjct:   19 KITRPTSDKVRGAIFNMIGPYFNGGRVLDLFAGSGGLAIEAVSRGMSAAVLVEKNRKAQA     78

Query:   63 VIQENIAMTKSPEQFQLLKMEANRALEQLTGQFDLVLLDPPYAKEEIVKQIQIMDSKGLL    122
             +IQ+NI MTK+   +F LLKMEA RA++ LTG+FDLV LDPPYAKE IV  I+ + +K LL Sbjct:   79 IIQDNIIMTKAENRFTLLKMEAERAIDCLTGRFDLVFLDPPYAKETIVATIEALAAKNLL    138

Query:  123 GDDIMIACETDKSVDLPEEIASFGIWKQKIYGISKVTVYV                      162
             + +M+ CETDK+V LP+EIA+  GIWK+KIYGISKVTVYV Sbjct:  139 SEQVMVVCETDKTVLLPKEIATLGIWKEKIYGISKVTVYV                      178
```

Based on this analysis, it was predicted that these proteins and their epitopes could be useful antigens for vaccines or diagnostics.

Example 42

A DNA sequence (GBSx0041) was identified in *S. agalactiae* <SEQ ID 133> which encodes the amino acid sequence <SEQ ID 134>. This protein is predicted to be lipopolysaccharide core biosynthesis protein kdtB (kdtB). Analysis of this protein sequence reveals the following:

```
Possible site: 17
>>> Seems to have no N-terminal signal sequence
----- Final Results -----
    bacterial cytoplasm --- Certainty = 0.1937 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database:

```
>GP: BAB13272 GB: AP001119 lipopolysaccharide core biosynthesis
protein kdtB [Buchnera sp. APS]
Identities = 56/149 (37%), Positives = 94/149 (62%)
Query:   1 MTKKALFTGSFDPVTNGHLDIIERASYLFDHVYIGLFYNLEKQGYFSIECRKKMLEEAIR      60
           M K A++ G+FDP+T GHLDII RA+ +FD + I +  N  K+  F+++ R ++ +

Sbjct:   1 MNKTAIYPGTFDPITYGHLDIITRATKIFDSITIAISNNFTKKPIFNLKERIELTRKVTL      60

Query:  61 QFKNVSVLVAQDRLAVDLAREVGAKYFVRGLRNSQDFDYEANLEFFNKQLADDIETVYLS     120
              KNV ++ + L +LA++  A   +RG+R    DFDYE  L    NKQ+ D+++++L Sbjct:  61 HLKNVKKILGFNDLLANLAKKEKANILIRGVRTIFDFDYEIKLAAINKQIYPDLDSIFLL     120

Query: 121 TSPSLSPISSSRIRELIHFKASVKPFVPK                                   149
             +S  +S ISSS ++E+    +K   +KP++PK Sbjct: 121 SSKEVSFISSSFVKEIAKYKGDIKPYLPK                                   149
```

A related DNA sequence was identified in *S. pyogenes* <SEQ ID 135> which encodes the amino acid sequence <SEQ ID 136>. Analysis of this protein sequence reveals the following:

```
Possible site: 61
>>> Seems to have no N-terminal signal sequence
----- Final Results -----
    bacterial cytoplasm --- Certainty = 0.1862 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below:

```
Identities = 88/161 (54%), Positives = 124/161 (76%)
Query:   1  MTKKALFTGSFDPVTNGHLDIIERASYLFDHVYIGLFYNLEKQGYFSIECRKKMLEEAIR      60
            +TK  L+TGSFDPVTNGHLDI++RAS LFD +Y+G+F N  K+ YF +E RK ML +A+

Sbjct:   2  LTKIGLYTGSFDPVTNGHLDIVKRASGLFDQIYVGIFDNPTKKSYFKLEVRKAMLTQALA      61

Query:  61  QFKNVSVLVAQDRLAVDLAREVGAKYFVRGLRNSQDFDYEANLEFFNKQLADDIETVYLS     120
             F NV V+ + +RLA+D+A+E+    + +RGLRN+ DF+YE NLE+FN  LA +IETVYL Sbjct:  62  DFTNVIVVVTSHERLAIDVAKELRVTHLIRGLRNATDFEYEENLEYFNHLLAPNIETVYLI     121

Query: 121  TSPSLSPISSSRIRELIHFKASVKPFVPKSVVREVEKMSEE                       161
             +       +SSSR+RELIHF++S++   VP+SV+  +VEKM+E+

Sbjct: 122  SRNKWQALSSSRVRELIHFQSSLEGLVPQSVIAQVEKMNEK                       162
```

Based on this analysis, it was predicted that these proteins and their epitopes could be useful antigens for vaccines or diagnostics.

Example 43

A DNA sequence (GBSx0042) was identified in *S. agalactiae* <SEQ ID 137> which encodes the amino acid sequence <SEQ ID 138>. Analysis of this protein sequence reveals the following:

```
Possible site: 15
>>> Seems to have no N-terminal signal sequence
----- Final Results -----
    bacterial cytoplasm --- Certainty = 0.1126 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 44

A DNA sequence (GBSx0043) was identified in *S. agalactiae* <SEQ ID 139> which encodes the amino acid sequence <SEQ ID 140>. Analysis of this protein sequence reveals the following:

Possible site: 25
>>> Seems to have an uncleavable N-term signal seq
INTEGRAL    Likelihood = −11.04    Transmembrane 20-36 (12-43)
----- Final Results -----
 bacterial membrane --- Certainty = 0.5416 (Affirmative) <succ>
 bacterial outside --- Certainty = 0.0000 (Not Clear) <succ>
 bacterial cytoplasm --- Certainty = 0.0000 (Not Clear) <succ>

The protein has homology with the following sequences in the GENPEPT database:

```
>GP: CAB13378 GB: Z99111 ylbL [Bacillus subtilis]
Identities = 124/344 (36%), Positives = 199/344 (57%), Gaps = 21/344 (6%)
Query:   20 WIIGFAFLLLVLASLVVRLPYYLEMPGGAYDIRSVLKVNKKADKAKGSYNFVAVSVSQAT         79
            W++     L+ VL+    ++LPYY+   PG A ++ S++KV      + KGS + + V V   A
Sbjct:    9 WMLVILILIAVLS--FIKLPYYITKPGEATELASLIKVEGGYPE-KGSLSLMTVKVGPAN         65

Query:   80 PAQVLYAWLTPFTEL----SSKEETTGGFSNDDYLRINQFYMETSQNESIYQALKLANKQ        135
            P    ++A + P+ E+       S KEE     G S+ +Y++         M++SQ ++    A + A K+
Sbjct:   66 PFTYVWAKMHPYYEIVPDESIKEE---GESDKEYMKRQLQMMKSSQENAVIAAYQKAGKK        122

Query:  136 VSLTYKGVYVLNLAKNSTFKDRLHLADTVTGVNGKSFKNSSQLIKYVAALHLGDKVKVQY        195
            VS ++ G+Y  ++ +N    K ++ + D +      +GK+++++ +LI Y+++     GDKV ++
Sbjct:  123 VSYSFNGIYASSVVENMPAKGKIEVGDKIISADGKNYQSAEKLIDYISSKKAGDKVTLKI        182

Query:  196 TSQGKKKESVGKVIKLSNGKNGIGIGLTDHTE--VLSDVPVDFNTEGVGGPSAGLMFTLA        253
            + K+K      + +   + +     GIG++ +T+ V   +    +DF   E +GGPSAGLM +L
Sbjct:  183 EREEKEKRVTLTLKQFPDEPDRAGIGVSLYTDRNVKVEPDIDFEIENIGGPSAGLMMSLE        242

Query:  254 IYDQLVKEDLRKGRKIAGTGTIEQNGHVGDIGGAGLKVVSAAKKGMDIFFVPNNPIDKNA        313
             IY+QL K D   KG    IAGTGTI+ +G  VG   IGG     KVV+A K G DIFF  PN         N
Sbjct:  243 IYNQLTKPDETKGYDIAGTGTIDVDGKVGPIGGIDQKVVAADKAGKDIFFAPNQNGASN-        301

Query:  314 KKGKTKVQTNYQEAKAAAKRLGTKMKIVPVQNVQQAIDYLKKTK                        357
               ++Y+ A    AK + +  MKIVPV +Q AIDYL K K
Sbjct:  302 --------SDYKNAVKTAKDIDSNMKIVPVDTMQDAIDYLNKLK                        337
```

A related DNA sequence was identified in *S. pyogenes* <SEQ ID 141> which encodes the amino acid sequence <SEQ ID 142>. Analysis of this protein sequence reveals the following:

Possible site: 23
>>> Seems to have an uncleavable N-term signal seq
INTEGRAL    Likelihood = −10.24    Transmembrane 10-26 (6-34)
----- Final Results -----
 bacterial membrane --- Certainty = 0.5097 (Affirmative) <succ>
 bacterial outside --- Certainty = 0.0000 (Not Clear) <succ>
 bacterial cytoplasm --- Certainty = 0.0000 (Not Clear) <succ>

The protein has homology with the following sequences in the databases:

```
>GP: CAB13378 GB: Z99111 ylbL [Bacillus subtilis]
Identities = 132/348 (37%), Positives = 198/348 (55%), Gaps = 16/348 (4%)
Query:    1 MKRLKKIKWWLVGLLALISLLLALFFPLPYYIEMPGGAYDIRTVLQVNGKEDKRKGAYQF         60
            M  R K    W LV +L LI++L    F   LPYYI   PG A  ++ ++++V G      + KG+
Sbjct:    1 MLRKKHFSWMLV-ILILIAVLS--FIKLPYYITKPGEATELASLIKVEGGYPE-KGSLSL         56

Query:   61 VAVGISRASLAQLLYAWLTPFTEISTAEDTTG-GYSDADFLRINQFYMETSQNAAIYQAL        119
            + V + A+     ++A + P+ EI    E      G SD ++++         M++SQ A+   A
Sbjct:   57 MTVKVGPANPFTYVWAKMHPYYEIVPDESIKEEGESDKEYMKRQLQMMKSSQENAVIAAY        116

Query:  120 SLAGKPVTLDYKGVYVLDVNNESTFKGTLHLADTVTGVNGKQFTSSAELIDYVSHLKLGD        179
              AGK V+   + G+Y   V      KG ++ + D +     +GK + S+   +LIDY+S    K GD
Sbjct:  117 QKAGKKVSYSFNGIYASSVVENMPAKGKIEVGDKIISADGKNYQSAEKLIDYISSKKAGD        176

Query:  180 EVTVQFTSDNKPKKGVGRIIKLKN--GKNGIGIALTDHTSVNSEDTVIFSTKGVGGPSAG        237
            +VT++    + K K+      + + +        + GIG++L          +V E    + F + +GGPSAG
```

```
-continued
Sbjct: 177 KVTLKIEREEKEKRVTLTLKQFPDEPDRAGIGVSLYTDRNVRVEPDIDFEIENIGGPSAG    236

Query: 238 LMFTLDIYDQITKEDLRKGRTIAGTGTIGKDGEVGDIGGAGLKVVAAAEAGADIFFVPNN    297
           LM +L+IY+Q+TK D  KG  IAGTGTI  DG+VG IGG    KVVAA +AG DIFF PN
Sbjct: 237 LMMSLEIYNQLTKPDETKGYDIAGTGTIDVDGKVGPIGGIDQKVVAADKAGKDIFFAPNQ    296

Query: 298 PVDKEIKKVNPNAISNYEEAKRAAKRLKTKMKIVPVTTVQEALVYLRK    345
                      N + S+Y+ A + AK + + MKIVPV T+Q+A+ YL K
Sbjct: 297 ---------NGASNSDYKNAVKTAKDIDSNMKIVPVDTMQDAIDYLNK    335
```

An alignment of the GAS and GBS proteins is shown below:

```
Identities = 229/339 (67%), Positives = 276/339 (80%)
Query:  17 LKWWIIGFAFLLLVLASLVVRLPYYLEMPGGAYDIRSVLKVNKKADKAKGSYNFVAVSVS    76
           +KWW++G   L+ +L +L    LPYY+EMPGGAYDIR+VL+VN K DK  KG+Y FVAV +S
Sbjct:   7 IKWWLVGLLALISLLLALFFPLPYYIEMPGGAYDIRTVLQVNGKEDKRKGAYQFVAVGIS    66

Query:  77 QATPAQVLYAWLTPFTELSSKEETTGGFSNDDYLRINQFYMETSQNESIYQALKLANKQV    136
           +A+  AQ+LYAWLTPFTE+S+ E+TTGG+S+ D+LRINQFYMETSQN +IYQAL LA K V
Sbjct:  67 RASLAQLLYAWLTPFTEISTAEDTTGGYSDADFLRINQFYMETSQNAAIYQALSLAGKPV    126

Query: 137 SLTYKGVYVLNLAKNSTFKDRLHLADTVTGVNGKSFKNSSQLIKYVAALHLGDKVKVQYT    196
           +L YKGVYVL++    STFK  LHLADTVTGVNGK F +S++LI YV+ L GD+V VQ+T
Sbjct: 127 TLDYKGVYVLDVNNESTFKGTLHLADTVTGVNGKQFTSSAELIDYVSHLKLGDEVTVQFT    186

Query: 197 SQGKKKESVGKVIKLSNGKNGIGIGLTDHTEVLSDVPVDFNTEGVGGPSAGLMFTLAIYD    256
           S   K K+ VG++IKL NGKNGIGI LTDHT V S+   V F+T+GVGGPSAGLMFTL IYD
Sbjct: 187 SDNKPKKGVGRIIKLKNGKNGIGIALTDHTSVNSEDTVIFSTKGVGGPSAGLMFTLDIYD    246

Query: 257 QLVKEDLRKGRKIAGTGTIEQNGHVGDIGGAGLKVVSAAKKGMDIFFVPNNPIDKNAKKG    316
           Q+ KEDLRKGR IAGTGTI ++G VGDIGGAGLKVV+AA+ G   DIFFVPNNP+DK KK G
Sbjct: 247 QITKEDLRKGRTIAGTGTIGKDGEVGDIGGAGLKVVAAAEAGADIFFVPNNPVDKEIKKV    306

Query: 317 KTKVQTNYQEAKAAAKRLGTKMKIVPVQNVQQAIDYLKK    355
               +NY+EAK AAKRL TKMKIVPV  VQ+A+ YL+K
Sbjct: 307 NPNAISNYEEAKRAAKRLKTKMKIVPVTTVQEALVYLRK    345
```

A related GBS gene <SEQ ID 8479> and protein <SEQ ID 8480> were also identified. Analysis of this protein sequence reveals the following:

Lipop: Possible site: −1 Crend: 10
McG: Discrim Score: 8.26
GvH: Signal Score (−7.5): −4.04
Possible site: 25
>>> Seems to have an uncleavable N-term signal seq
ALOM program count: 1 value: −11.04 threshold: 0.0

-continued

INTEGRAL     Likelihood = −11.04   Transmembrane 20-36 (12-43)
PERIPHERAL   Likelihood = 4.51      70
modified ALOM score: 2.71
*** Reasoning Step: 3
----- Final Results -----
   bacterial membrane --- Certainty = 0.5416 (Affirmative) <succ>
    bacterial outside --- Certainty = 0.0000 (Not Clear) <succ>
     bacterial cytoplasm --- Certainty = 0.0000 (Not Clear) <succ>

The protein has homology with the following sequences in the databases:

```
GP|5531383| putative secreted protein {Streptomyces coelicolor A3(2)} Insert characterized
 PIR|T36157|T36157 probable secreted protein - Streptomyces coelicolor Insert
characterized
ORF01344(361-1362 of 1671)
GP|5531383|emb|CAB51015.1| |AL096852(13-247 of 259) putative secreted protein
{Streptomyces coelicolor A3(2)} PIR|T36157|T36157 probable secreted protein - Streptomyces
coelicolor
% Match = 7.1
% Identity = 38.4 % Similarity = 57.6
Matches = 58 Mismatches = 61 Conservative Sub.s = 29
```

-continued

```
312       342       372       402       432       462       492
EKWRK*VKNRDPKRKHKSLLGLLKWWIIGFAFLLLVLASLVVRLPYYLEMPGGAYDIRSVLKVNKKADKAKGSYNFV~~~
               |    : |:    : |:    :|    ||: :  ||   |:
              MLSRLTRPQFLAVCGLPVVALLATALFAPLPFSVAQPGLTADV--------------------~~~
              10        20        30        40

924       954       984                                                 1002
~KKKESVGKVIKLSNGKNGIGIGLTDHTEVLS-----------------------~~~-----------------DVPV
 :|         ||::                                                        || |
~-------------------LGKNRGAEVITISGAPTHATSGQLRMTTIEA~~~~KESQDSATTAALRYLRMDKGDVDV
                    50        60        70              130       140

1032      1062      1092      1122      1152      1182      1212      1242
DFNTEGVGGPSAGLMFTLAIYDQLVKEDLRKGRKIAGTGTIEQNGHVGDIGGAGLKVVSAAKKGMDIFFVPNNPIDKNAK
 :   |  ||||||||:|    |   |:    || |:   :|||||   |  ||  :|  ||   :|  :  | :|:||
KLRLEDVGGPSAGLLFSLGIVDKLGAGDLTGGKVVAGTGTITDGGKVGAVGGVPLKTQAARRDGATVFLVPK--------
 160       170       180       190       200       210

1272      1302      1332      1362      1392      1422      1452      1482
KGKTKVQTNYQEAKAAAKRLGTKMKIVPVQNVQQAIDYLKKTK*TQRVRASARLFCFATFDYQSAKMIV*QSL*EYYI*M
          |         |    |   ::::||   :: |:|  ||           :        :
---------AECSDAQAELPKGLRLIPVTTLEGAVDSLKALESGKGDVPAC
         220       230       240       250
```

SEQ ID 8480 (GBS39) was expressed in *E. coli* as a GST-fusion product. SDS-PAGE analysis of total cell extract is shown in FIG. 12 (lane 9; MW 65.2 kDa) and FIG. 15 (lane 3; MW 40 kDa).

Based on this analysis, it was predicted that these proteins and their epitopes could be useful antigens for vaccines or diagnostics.

Example 45

A DNA sequence (GBSx0044) was identified in *S. agalactiae* <SEQ ID 143> which encodes the amino acid sequence <SEQ ID 144>. This protein is predicted to be UDP-sugar hydrolase. Analysis of this protein sequence reveals the following:

Possible site: 17

>>> Seems to have no N-terminal signal sequence

----- Final Results ----- bacterial cytoplasm --- Certainty = 0.3908 (Affirmative) <succ> bacterial membrane --- Certainty = 0.0000 (Not Clear) <succ> bacterial outside --- Certainty = 0.0000 (Not Clear) <succ>

The protein has homology with the following sequences in the GENPEPT database:

```
>GP:CAB15227 GB:Z99120 similar to hypothetical proteins [Bacillus subtilis]
Identities = 114/280 (40%), Positives = 173/280 (61%), Gaps = 9/280 (3%)

Query:    1  MTELIRILHLNDLHSHFENFPKVKRFFH----DNQAQPIETISLDLGDNIDKSHPLTEAS   56
             M E +R+ H NDLHSHFEN+PK+  +      ++Q+    ET+  D+GD++D+    +TEA+
Sbjct:    1  MKEKLRLYHTNDLHSHFENWPKIVDYIEQKRKEHQSDGEETLVFDIGDHLDRFQFVTEAT   60

Query:   57  SGKANVQLMNELGIELATIGNNEGVGLSKKDLDQVYKDSDFTVIVGNLKD-NIIEPSWAK  115
             GKANV L+N L I+ A IGNNEG+ L  ++L  +Y  ++F VIV NL D N   PSWA
Sbjct:   61  FGKANVDLLNRLHIDGAAIGNNEGITLPHEELAALYDHAEFPVIVSNLFDKNGNRPSWAV  120

Query:  116  PYIIYETQQGTKLAFLAYTFPYYKTYEPNGWTIEDPIDCLKCHLQINEIK-EANCRILMS  174
             PY I   + G +AFL T PYY Y+  GWT+ D ++ +K     I E+K +A+   +L+S
Sbjct:  121  PYHIKSLKNGMSIAFLGVTVPYYPVYDKLGWTVTDALESIK--ETILEVKGQADIIVLLS  178

Query:  175  HLGIRFDTRIAQEFSEIDLIIGAHTHHLFEEGELINGTYLAAAGKYGRFVGSIDITFDNH  234
             HLGI  D  +A+     EID+I+  +HTHHL E+G+++NG   LA+A KYG +VG ++IT D+
Sbjct:  179  HLGILDDQAVAEAVPEIDVILESHTHHLLEDGQVVNGVLLASAEKYGHYVGCVEITVDS-  237

Query:  235  TLKDILISTCDTKQLTGYPSDSDWLRRLSQKVKNSLEKKV                     274
              + I  T  ++ +  +S +  + +    E+K+
Sbjct:  238  VQRSINSKTASVQNMAEWTGESAETKAFLNEKEREAEEKL                     277
```

No corresponding DNA sequence was identified in *S. pyogenes*.

Based on this analysis, it was predicted that this protein and its epitopes, could be useful antigens for vaccines or diagnostics.

Example 46

A DNA sequence (GBSx0045) was identified in *S. agalactiae* <SEQ ID 145> which encodes the amino acid sequence <SEQ ID 146>. This protein is predicted to be UDP-sugar hydrolase. Analysis of this protein sequence reveals the following:

---

Possible site: 44
>>> Seems to have no N-terminal signal sequence
INTEGRAL      Likelihood = −0.48      Transmembrane 5-21 (5-21)
----- Final Results -----
   bacterial membrane --- Certainty = 0.1192 (Affirmative) <succ>
    bacterial outside --- Certainty = 0.0000 (Not Clear) <succ>
     bacterial cytoplasm --- Certainty = 0.0000 (Not Clear) <succ>

---

A related GBS nucleic acid sequence <SEQ ID 9605> which encodes amino acid sequence <SEQ ID 9606> was also identified.

The protein has homology with the following sequences in the GENPEPT database:

```
>GP:CAB15227 GB:Z99120 similar to hypothetical proteins [Bacillus subtilis]
Identities = 29/137 (21%), Positives = 71/137 (51%), Gaps = 13/137 (9%)
Query:   3 AMLFYAGADVAIINSGLIVQPFEKD-FSRKNLHESLPHQMRLAKLTVSSQELLEIYETIY   61
           A+    D++++NSG+I+ P +    ++ +LH   PH +    + ++ +EL E     ++
Sbjct: 305 ALKEWCETDISMVNSGVILGPLKAGPVTKLDLHRICPHPINPVAVRLTGEELKETI--VH  362

Query:  62 QQGQFLAQQKIHGMGFRGKCFGEVLHSGFDYKN----------GKIVYNEKDIDAKEEVI  111
           + + Q +I G+GFRG+  G+++++G + +           +I  N +DI+   ++
Sbjct: 363 AASEQMEQLRIKGLGFRGEVMGKMVYAGVEVETKRLDDGITHVTRITLNGEDIEKHKQYS  422

Query: 112 LVIVDQYYFASYFECLK                                            128
           + ++D +     F  ++
Sbjct: 423 VAVLDMFTLGKLFPLIR                                            439
```

No corresponding DNA sequence was identified in *S. pyogenes*.

Based on this analysis, it was predicted that this protein and its epitopes, could be useful antigens for vaccines or diagnostics.

Example 47

A DNA sequence (GBSx0046) was identified in *S. agalactiae* <SEQ ID 147> which encodes the amino acid sequence <SEQ ID 148>. This protein is predicted to be unnamed protein product. Analysis of this protein sequence reveals the following:

---

Possible site: 29
>>> Seems to have no N-terminal signal sequence
----- Final Results -----
   bacterial cytoplasm --- Certainty = 0.3567 (Affirmative) <succ>
    bacterial membrane --- Certainty = 0.0000 (Not Clear) <succ>
     bacterial outside --- Certainty = 0.0000 (Not Clear) <succ>

---

The protein differs from AX026665 at the C-terminus:

```
Query: 181    SAKQHFVIRKK    191
              SAKQH +  +K
Sbjct: 181    SAKQHLLFVRK    191
```

A related DNA sequence was identified in *S. pyogenes* <SEQ ID 149> which encodes the amino acid sequence <SEQ ID 150>. Analysis of this protein sequence reveals the following:

---

Possible site: 37
>>> Seems to have no N-terminal signal sequence

-continued

----- Final Results -----
   bacterial cytoplasm --- Certainty = 0.3974 (Affirmative) <succ>
    bacterial membrane --- Certainty = 0.0000 (Not Clear) <succ>
     bacterial outside --- Certainty = 0.0000 (Not Clear) <succ>

---

An alignment of the GAS and GBS proteins is shown below:

```
Identities = 110/205 (53%), Positives = 147/205 (71%), Gaps = 15/205 (7%)
Query:   1 MRKEVTPEMLNYNKYPGPQFIHFENIVKSDDIEFQLVINEKSAFDVTVFGQRFSEILLKY   60
           M+KE++PEM NYNK+PGP+FIHFE  VK++ I+  L+ + K+AFD T FGQR++E+LLKY
Sbjct:   9 MKKEISPEMYNYNKFPGPKFIHFEEQVKAEGIDLLLLEDVKNAFDTTSFGQRYTEVLLKY   68

Query:  61 DFIVGDWGNEQLRLRGFYKDASTIRKNSRISRLEDYIKEYCNFGCAYFVLENPNPRDIKF  120
           D+IVGDWGNEQLRL+GFYKD+   I+K +RISRLEDYIKE+CNFGCAYFVLEN +P+DIKF
Sbjct:  69 DYIVGDWGNEQLRLKGFYKDSDDIKKTNRISRLEDYIKEFCNFGCAYFVLENLHPQDIKF  128

Query: 121 DDERPHKRRKS------RSKSQSSKSQTRNNRSQSNA--------NAHFTSKKRKDTKRR  166
           ++ER  +R+KS      R K   S Q   +S+S           N  FTS+KR+   +
Sbjct: 129 EEERQPRRKKSPKSKSNRRKPNYSNQQPATPKSKSKRASKEKQPENQAFTSQKRRSNTKH  188

Query: 167 QERHIKEEQDKEMTSAKQHFVIRKK                                    191
           +E+  K Q ++ +    HF+IRKK
Sbjct: 189 KEKS-KRNQTSQLNTKISHFIIRKK                                    212
```

Based on this analysis, it was predicted that these proteins and their epitopes could be useful antigens for vaccines or diagnostics.

Example 48

A DNA sequence (GBSx0047) was identified in *S. agalactiae* <SEQ ID 151> which encodes the amino acid sequence <SEQ ID 152>. Analysis of this protein sequence reveals the following:

Possible site: 32
>>> Seems to have no N-terminal signal sequence
----- Final Results -----
    bacterial cytoplasm --- Certainty = 0.3627 (Affirmative) <succ>
    bacterial membrane --- Certainty = 0.0000 (Not Clear) <succ>
    bacterial outside --- Certainty = 0.0000 (Not Clear) <succ>

A related GBS nucleic acid sequence <SEQ ID 9607> which encodes amino acid sequence <SEQ ID 9608> was also identified.

The protein has homology with the following sequences in the GENPEPT database:

```
>GP:BAB06225 GB:AP001515 unknown conserved protein [Bacillus halodurans]
Identities = 205/349 (58%), Positives = 258/349 (73%), Gaps = 5/349 (1%)
Query:  18  PSIYSLTRDELIAWAIEHGEKKFRASQINDWLYKKRVQSFDEMTNISKDFIALLNENFVV   77
            PSIY+L  +EL  W  E GE KFRA+QI++WLY+KRV+ F EMTN+SKD  A L ++F +
Sbjct:  17  PSIYTLQFEELEMWLKEQGEPKFRATQIFEWLYEKRVKQFQEMTNLSKDLRAKLEKHFNL   76

Query:  78  NPLKQRIVQESADGTVKYLFELPDGMLIETVLMRQHYGLSVCVTTQVGCNIGCTFCASGL  137
            + LK    Q+S+DGT+K+LFEL DG  IETV+MR +YG SVCVTTQVGC +GCTFCAS L
Sbjct:  77  TTLKTVTKQQSSDGTIKFLFELHDGYSIETVVMRHNYGNSVCVTTQVGCRLGCTFCASTL  136

Query: 138  IKKQRDLNNGEITAQIMLVQKYFDERGQGERVSHIVVMGIGEPFDNYTNVLKFLRTVNDD  197
             +R+L  GEI AQ++   Q+   DE    QGERV  IVVMGIGEPFDNY  ++  FL+TVN D
Sbjct: 137  GGLKRNLEAGEIVAQVVEAQRAMDE--QGERVGSIVVMGIGEPFDNYQALMPFLKTVNHD  194

Query: 198  NGLAIGARHITVSTSGLAHKIREFANEGVQVNLAVSLHAPNNDLRSSIMRINRSFPLEKL  257
              GL  IGARHITVSTSG+  KI +FA+EG+Q+N A+SLHAPN +LRS +M +NR++PL KL
Sbjct: 195  KGLNIGARHITVSTSGVVPKIYQFADEGLQINFAISLHAPNTELRSKLMPVNRAWPLPKL  254

Query: 258  FAAIEYYIETTNRRVTFEYIMLNGVNDTPENAQELADLTKKIRKLSYVNLIPYNPVSEHD  317
              AI YYI+ T RRVTFEY +  G ND  E+A+ELADL K I+   +VNLIP N V E D
Sbjct: 255  MDAIRYYIDKTGRRVTFEYGLFGGENDQVEHAEELADLIKDIK--CHVNLIPVNYVPERD  312

Query: 318  QYSRSPKERVEAFYDVLKKNGVNCVVRQEHGTDIDAACGQLRSNTMKRD             366
              Y R+P++++ AF   LK+ GVN  +R+E G DIDAACGQLR    K +
Sbjct: 313  -YVRTPRDQIFAFERTLKERGVNVTIRREQGHDIDAACGQLRAKERKEE             360
```

A related DNA sequence was identified in *S. pyogenes* <SEQ ID 153> which encodes the amino acid sequence <SEQ ID 154>. Analysis of this protein sequence reveals the following:

Possible site: 17
>>> Seems to have no N-terminal signal sequence
----- Final Results -----
    bacterial cytoplasm --- Certainty = 0.2320 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below:

```
Identities = 316/353 (89%), Positives = 339/353 (95%)
Query:  17  KPSIYSLTRDELIAWAIEHGEKKFRASQIWDWLYKKRVQSFDEMTNISKDFIALLNENFV   76
            KPSIYSLTRDELIAWA+E G+K+FRA+QIWDWLYKKRVQSF+EMTNISKDF+++LN++F
Sbjct:   2  KPSIYSLTRDELIAWAVERGQKQFRATQIWDWLYKKRVQSFEEMTNISKDFVSILNDSFC   61

Query:  77  VNPLKQRIVQESADGTVKYLFELPDGMLIETVLMRQHYGLSVCVTTQVGCNIGCTFCASG  136
            VNPLKQR+VQESADGTVKYLFELPDGMLIETVLMRQHYG SVCVTTQVGCNIGCTFCASG
Sbjct:  62  VNPLKQRVVQESADGTVKYLFELPDGMLIETVLMRQHYGHSVCVTTQVGCNIGCTFCASG  121

Query: 137  LIKKQRDLNNGEITAQIMLVQKYFDERGQGERVSHIVVMGIGEPFDNYTNVLKFLRTVND  196
            LIKKQRDLN+GEITAQIMLVQKYFD+R QGERVSH+VVMGIGEPFDNY NV+ FLR +ND
Sbjct: 122  LIKKQRDLNSGEITAQIMLVQKYFDDRKQGERVSHVVVMGIGEPFDNYKNVMCFLRVIND  181

Query: 197  DNGLAIGARHITVSTSGLAHKIREFANEGVQVNLAVSLHAPNNDLRSSIMRINRSFPLEK  256
            DNGLAIGARHITVSTSGLAHKIR+FANEGVQVNLAVSLHAPNNDLRSSIMR+NRSFPLEK
```

```
                                  -continued
Sbjct: 182  DNGLAIGARHITVSTSGLAHKIRDFANEGVQVNLAVSLHAPNNDLRSSIMRVNRSFPLEK  241

Query: 257  LFAAIEYYIETTNRRVTFEYIMLNGVNDTPENAQELADLTKKIRKLSYVNLIPYNPVSEH  316
            LF+AIEYYIE TNRRVTFEYIMLN VND+ + AQELADLTK IRKLSYVNLIPYNPVSEH
Sbjct: 242  LFSAIEYYIEKTNRRVTFEYIMLNEVNDSIKQAQELADLTKTIRKLSYVNLIPYNPVSEH  301

Query: 317  DQYSRSPKERVEAFYDVLKKNGVNCVVRQEHGTDIDAACGQLRSNTMKRDRQK         369
            DQYSRSPKERV AFYDVLKKNGVNCVVRQEHGTDIDAACGQLRS TMK+DR+K
Sbjct: 302  DQYSRSPKERVLAFYDVLKKNGVNCVVRQEHGTDIDAACGQLRSKTMKKDREK         354
```

Based on this analysis, it was predicted that these proteins and their epitopes could be useful antigens for vaccines or diagnostics.

Example 49

A DNA sequence (GBSx0048) was identified in *S. agalactiae* <SEQ ID 155> which encodes the amino acid sequence <SEQ ID 156>. This protein is predicted to be VanZF. Analysis of this protein sequence reveals the following:

```
Possible site: 47
>>> Seems to have an uncleavable N-term signal seq
INTEGRAL    Likelihood = -9.61    Transmembrane 86-102 (77-106)
INTEGRAL    Likelihood = -8.60    Transmembrane 19-35 (15-42)
INTEGRAL    Likelihood = -5.15    Transmembrane 113-129 (109-134)
----- Final Results -----
   bacterial membrane --- Certainty = 0.4843 (Affirmative) <succ>
      bacterial outside --- Certainty = 0.0000 (Not Clear) <succ>
      bacterial cytoplasm --- Certainty = 0.0000 (Not Clear) <succ>
```

The protein has homology with the following sequences in the GENPEPT database:

```
>GP:AAF36806 GB:AF155139 VanZF [Paenibacillus popilliae]
Identities = 45/154 (29%), Positives = 68/154 (43%), Gaps = 36/154 (23%)
Query:  17  RRFVWMLVIIYCLIIVRMCFGPQIMIEGVSTPNVQRFGRIVAL-------LVPFNSFRSL   69
            R F+W+ V ++ L +V M G              NV  GR  L       L+PF+S
Sbjct:  36  RHFLWVYVFLFYLALVYMMTG---------IGNVWVGRYETLIRVSEINLLPFSS----   82

Query:  70  DQLTSFKEIFWVIGQNVVNILLLFPLIIGLLSLKPSLRKYKSVILLAFLMSIFIECTQVV   129
            + +T++         ++NI+L  PL   L ++ P  R   K+     F  S+ IE TQ++
Sbjct:  83  EGVTTY----------ILNIILFMPLGFLLPTIWPQFRTIKNTACTGFFFSLAIELTQLL   132

Query: 130  LDILIDANRVFEIDDLWTNTLGGPFALWTYRNIK                            163
              +R+ +IDDL  NTLG      YR K
Sbjct: 133  ------NHRITDIDDLLMNTLGAIIGYLLYRAFK                            160
```

No corresponding DNA sequence was identified in *S. pyogenes*.

Based on this analysis, it was predicted that this protein and its epitopes, could be useful antigens for vaccines or diagnostics.

Example 50

A DNA sequence (GBSx0049) was identified in *S. agalactiae* <SEQ ID 157> which encodes the amino acid sequence <SEQ ID 158>. This protein is predicted to be multidrug resistance-like ATP-binding protein mdl. Analysis of this protein sequence reveals the following:

```
Possible site: 30
>>> Seems to have no N-terminal signal sequence
INTEGRAL    Likelihood = -6.79    Transmembrane 18-34 (17-36)
INTEGRAL    Likelihood = -5.15    Transmembrane 247-263 (242-268)
INTEGRAL    Likelihood = -2.81    Transmembrane 160-176 (158-176)
INTEGRAL    Likelihood = -2.71    Transmembrane 141-157 (134-158)
INTEGRAL    Likelihood = -1.12    Transmembrane 56-72 (56-73)
INTEGRAL    Likelihood = -0.69    Transmembrane 278-294 (277-294)
----- Final Results -----
   bacterial membrane --- Certainty = 0.3718 (Affirmative) <succ>
      bacterial outside --- Certainty = 0.0000 (Not Clear) <succ>
      bacterial cytoplasm --- Certainty = 0.0000 (Not Clear) <succ>
```

The protein has homology with the following sequences in the GENPEPT database:

```
>GP:BAB06055 ABC transporter (ATP-binding protein) [Bacillus halodurans]
Identities = 284/575 (49%), Positives = 406/575 (70%), Gaps = 2/575 (0%)
Query:   1  MSIIKNLWWFFKEEKKRYLIGILSLSLVAVLNLIPPKIMGSVIDAITTGKLTRPQLLWNL    60
            M +   +LWWFFK+EKK Y  GI+ L++V++L L+PP+++G ++D I  G LT P LL  +
Sbjct:   1  MKVFVDLWWFFKQEKKSYGFGIVMLAIVSLLTLVPPRVVGIIVDHIYEGTLTMPVLLQWI    60

Query:  61  LGLVLSALAMYGLRYIWRMYILGTSYKLGQVVRYRLFEHFTKMSPSFYQKYRTGDLMAHA   120
            L    AL +Y  RY+WR+ I G S +L +++R +L+ HFT M+   FYQK+RTGDLMAHA
Sbjct:  61  GVLAALALIVYVARYLWRVMIFGASLRLARLLRNQLYTHFTNMAAPFYQKHRTGDLMAHA   120

Query: 121  TNDINSLTRLAGGGVMSAVDASITALVTLITMFFTISWQMTLIAVIPLPLMALATSKLGR   180
            TNDI ++     AG GV++  VD+          ++TM  TISW++TLI+++P+PLMAL TS  G
Sbjct: 121  TNDIRAIQATAGQGVLTLVDSLTMGGFVILTMAITISWELTLISLLPMPLMALLTSYYGS   180

Query: 181  KTHETFKESQAAFSELNNKVQESVSGVKVTKSFGYQEQEIASFQEVNQMTFVKNMRTMTY   240
             H+  F    +QAAFS  LN+KVQESV +GV+VTK+FG +EQ+I  +F++ +        KN+
```

```
                        -continued
Sbjct: 181  LLHKRFHHAQAAFSSLNDKVQESVTGVRVTKAFGQEEQDIEAFRKQSDDVVKKNVAVARV  240

Query: 241  DVMFDPLVLLFIGASYVLTLAMGAFMISKGQVTVGDLVTFVTYLDMLVWPLMAIGFLFNM  300
            D +FDP L +G SY L +  GA +   Q+T+G L +F  YL +L+WP++A GFLFN+
Sbjct: 241  DALFDPTISLIVGLSYFLAIVFGARFVIAEQLTIGQLTSFTIYLGLLIWPMLAFGFLFNI  300

Query: 301  VQRGSVSYNRINSLLEQESDITDPLNPIRPVVNGTLRYDIDFFRYDN--EETLADIHFTL  358
            V+RG  SYNR++ LL+ + +ITD   I    G +   ID F Y N  E  LAD+ F L
Sbjct: 301  VERGRASYNRVSQLLQAKQEITDSRARIHVPPTGHVDVAIDQFVYPNQKEPALADVQFEL  360

Query: 359  EKGQTLGLVGQTGSGKTSLIKLLLREHDVTQGKITLNKHDIRDYRLSELRQLIGYVPQDQ  418
             +G+TLG+VG+TG+GKT+L++LL RE+D+ QG I L+    I Y L L+   G VPQD
Sbjct: 361  SEGETLGIVGKTGAGKTTLLRLLQREYDIKQGTIILDGRPIEHYTLDALKAAFGTVPQDH  420

Query: 419  FLFATSILENVRFGNPTLSINAVKKATKLAHVYDDIKQMPAGFETLIGEKGVSLSGGQKQ  478
            FLF+ +I +N+ F  P  +I+ + +  ++LAH++DDI Q   G++T++GE+GV+LSGGQKQ
Sbjct: 421  FLFSATIADNIAFAKPDATISEIIQVSQLAHIHDDIIQFEQGYDTVVGERGVTLSGGQKQ  480

Query: 479  RIAMSRAMILDPDILILDDSLSAVDAKTEHAIIENLKTNRQGKSTIISAHRLSAVVRADL  538
            R++++RA++ +P+ILILDDSLSAVDAKTE AI+  +L+   R+GK+TII+AHRLSA+  HAD
Sbjct: 481  RVSIARALLANPNILILDDSLSAVDAKTEEAILSSLRAERKGKTTIITAHRLSAIKHADH  540

Query: 539  ILVMQDGRVIERGQHQELLNKGGWYAETYASQQLE                          573
            ILVM DGR++ERG H+ L+  GGWY   Y  QQLE
Sbjct: 541  ILVMDDGRIVERGTHETLMEAGGWYRNMYERQQLE                          575
```

There is also homology to SEQ ID 8.

A related DNA sequence was identified in *S. pyogenes* <SEQ ID 159> which encodes the amino acid sequence <SEQ ID 160>. Analysis of this protein sequence reveals the following:

---

Possible site: 23
>>> Seems to have an uncleavable N-term signal seq
INTEGRAL    Likelihood = −7.75    Transmembrane 176-192 (173-197)
INTEGRAL    Likelihood = −4.78    Transmembrane 267-283 (265-285)

-continued

INTEGRAL    Likelihood = −4.09    Transmembrane 18-34 (15-40)
INTEGRAL    Likelihood = −2.13    Transmembrane 151-167 (150-169)
INTEGRAL    Likelihood = −0.69    Transmembrane 85-101 (85-101)
----- Final Results -----
   bacterial membrane --- Certainty = 0.4100 (Affirmative) <succ>
   bacterial outside --- Certainty = 0.0000 (Not Clear) <succ>
   bacterial cytoplasm --- Certainty = 0.0000 (Not Clear) <succ>

---

An alignment of the GAS and GBS proteins is shown below:

```
Identities = 172/609 (28%), Positives = 315/609 (51%), Gaps = 58/609 (9%)
Query:   1  MSIIKNLWWFFKEEKKRYLIGILSLSLVAVLNLIPPKIMGSVIDAITTGKLTRPQLLWNL   60
            M  + W++FK + + +++ L  L + P  +G +  + GK+ +    +  +
Sbjct:   2  MKTARFFWFYFYKRYRFSFTVIAVAVILATYLQVKAPVFLGESLTEL--GKIGQAYYVAKM   59

Query:  61  LGLV-----LSAL--AMYGLRYIWRMYILGT---SYKLGQVV-------RYRLFEHFTKM  103
            G       LSA   M+ L  +  +L     S+ L +VV        R  LF     ++
Sbjct:  60  SGQTHFSPDLSAFNAVMFKLLMTYFFTVLANLIYSFLLTRVVSHSTNRMRKGLFGKLERL  119

Query: 104  SPSFYQKYRTGDLMAHATNDINSLTRLAGGGVMSAVDASITALVTLITMFFTISWQM---  160
            + +F+ +++ G++++  T+D+++         + ++++ S+  +VT I ++   + W M
Sbjct: 120  TVAFFDRHKDGEILSRFTSDLDN--------IQNSLNQSLIQVVTNIALYIGLVWMMFRQ  171

Query: 161  ------TLIAVIPLPLMALATS-KLGRKTHETFKESQAAFSELNNKVQESVSGVKVTKSF  213
                    IA  P+  L+  L +  +L RK      Q   S LN  + E++SG K
Sbjct: 172  DSRLALLTIASTPVALIFLVINIRLARKYTNI---QQQEVSALNAFMDETISGQKAIIVQ  228

Query: 214  GYQEQEIASF----QEVNQMTFVKNMRT------MTYDVMFDPLVLLFIGASYVLT-LAM  262
            G QE + +F    + V Q TF + + +      M   + +++F+G++ VL+  +M
Sbjct: 229  GVQEDTMTAFLKHNERVRQATFKRRLFSGQLFPVMNGMSLINTAIVIFVGSTIVLSDKSM  288

Query: 263  GAFMISKGQVTVGDLVTFVTYLDMLVWPLMAIGFLFNMVQRGSVSYNRINSLLEQESDIT  322
             A        +G  +VTFV Y     P+M I   +Q    +RI  + ++   ++
Sbjct: 289  PA------AAALGLVVTFVQYSQQYYQPMMQIASSWGELQLAFTGAHRIQEMFDETEEVR  342

Query: 323  DPLNPIRPVVNGTLRYD-IDFFRYDNEETLADIHFTLEKGQTLGLVGQTGSGKTSLIKLL  381
             P  +  +  + +DF     ++ L+D+    KG+  +VG TGSGKT+++   L+
Sbjct: 343  PQNAPAFTSLKEAVAINHVDFGYLPGQKVLSDVSIVAPKGKMIAVVGPTGSGKTTIMNLI  402

Query: 382  LREHDVTQGKITLNKHDIRDYRLSELRQLIGYVPQDQFLFATSILENVRFGNPTLSINAV  441
             R +DV  G  IT +   DIRDY L  LRQ +G V Q+   LF+ +I +N+RFG  T+S + V
Sbjct: 403  NRFYDVDAGSITFDGRDIRDYDLDSLRQKVGIVLQESVLFSGTITDNIRFGDQTISQDMV  462

Query: 442  KKATKLAHVYDDIKQMPAGFETLIGEKGVSLSGGQKQRIAMSRAMILDPDILILDDSLSA  501
             + A  +  H++D I  +P G+ T + +    S GQKQ I+++R  ++ DP++LILD++  S
Sbjct: 463  ETAARATHIHDFIMSLPKGYNTYVSDDDNVFSTGQKQLISIARTLLTDPEVLILDEATSN  522
```

```
Query: 502  VDAKTEHAIIENLKTNRQGKSTIISAHRLSAVVHADLILVMQDGRVIERGQHQELLNKGG  561
            VD  TE I   ++     G+++ + AHRL  +++AD I+V++DG+VIE+G H ELL++ G
Sbjct: 523  VDTVTESKIQRAMEAIVAGRTSFVIAHRLKTILNADHIIVLKDGKVIEQGNHHELLHQKG  582

Query: 562  WYAETYASQ  570
            +YAE Y +Q
Sbjct: 583  FYAELYHNQ  591
```

Based on this analysis, it was predicted that these proteins and their epitopes could be useful antigens for vaccines or diagnostics.

Example 51

A DNA sequence (GBSx0050) was identified in *S. agalactiae* <SEQ ID 161> which encodes the amino acid sequence bacterial membrane --- Certainty = 0.4461 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the GENPEPT database:

```
>GP:BAB06054 ABC transporter (ATP-binding protein) [Bacillus halodurans]
Identities = 278/582 (47%), Positives = 398/582 (67%), Gaps = 6/582 (1%)
Query:   1  MMKSNQWQVFKRLISYLRPYKWFTVLALSLLLLITVVKNIIPLIASHFIDHYLT-NVNQT   59
            +     Q  VFKRL+SY    YK  ++A  LL + T  + + P+I   FID YLT    T
Sbjct:   9  LSSKEQRTVFKRLLSYAAHYKGQLMVAFLLLFIATGAQLLGPIIVKIFIDDYLTPRYFPT   68

Query:  60  AVLILVG--YYSMYVLQTLIQYFGNLFFARVSYSIVRDIRRDAFANMERLGMSYFDRTPA  117
             VL L+G   Y    +++    +I Y+     F +V+ SIV+ +R D F++++RLG+S+FD+TPA
Sbjct:  69  DVLFLLGAGYLVLHLTAVIIDYYQLFLFQKVALSIVQRLRIDVFSSVQRLGLSFFDQTPA  128

Query: 118  GSIVSRITNDTEAISDMFSGILSSFISAIFIFTVTLYTMLMLDIKLTGLVALLLPVIFIL  177
            G +VSRITNDTE+I +++  +L++F+  I        M  L++ L      +LLP+IF L
Sbjct: 129  GGLVSRITNDTESIKELYVTVLATFVQNIIFLIGIFAAMFYLNVTLAIYCLVLLPLIFAL  188

Query: 178  VNVYRKKSVTVIAKTRSLLSDINSKLSESIEGIRIVQAFGQEERLKTEFEEINKEHVVYA  237
            +  VYRK S      A       LS +N  +++ESI+G+ I+Q F QE R++ EF   IN EH +
Sbjct: 189  MQVYRKYSSRFYADMSEKLSLLNGRINESIQGMAIIQMFRQERRMKEFSAINDEHFLAG  248

Query: 238  NRSMALDSLFLRPAMSLLKLLAYAVLMAYFGFTGVEGGLTAGLMYAFIQYVNRLFDPLIE  297
            +SM LD L LRPA+  +L  +LA    ++++YFG    +    G++YAF+  Y++R F+P+  +
Sbjct: 249  MKSMKLDGLLLRPAVDVLSILALMLILSYFGIMSMDTAVEIGVVYAFVNYLDRFFEPVNQ  308

Query: 298  VTQNFSTLQTSMVSAGRVFDLIDETGFEPSQKNTE--AFVREGNIEFKNVSFSYDGKKQI  355
            +      S    Q ++VSAGRVF L+D       P ++   E  A + EGN+EF+NVSFSYDGK   +
Sbjct: 309  MMMRLSMFQQAIVSAGRVFKLMDHRELAPDREGNEHPAIIGEGNVEFRNVSFSYDGKTNV  368

Query: 356  LDNVSFSVKKGETIAFVGATGSGKSSIINVFMRFYEFQSGQVLLDGKDIRDYSQEQLRKN  415
            L  N+SF+VKKGET+A VG TGSGK+SIINV MRFY  Q G++L+DGK  +    +LR
Sbjct: 369  LKNISFTVKKGETVALVGHTGSGKTSIINVLMRFYPLQDGEILIDGKPLTSFENNELRAK  428

Query: 416  IGLVLQDPFLYHGTIKSNIKMY-QDITDQEVQDAAEFVDADQFIQKLPDKYDAAVSERGS  474
            +GLVLQDPFLY GTI SNI++Y Q I+D  ++ AA FV AD F I++L   Y+  V+ERG+
Sbjct: 429  VGLVLQDPFLYTGTIASNIRLYDQAISDDRIKRAASFVRADGFIERLSHGYETKVTERGA  488

Query: 475  SFSTGQRQLLAFARTVASKPKILILDEATANIDSETEQIVQDSLAKMRQGRTTIAIAHRL  534
            +FS+GQRQLL+FART+    +P  ILILDEATA++D+ETE+ +Q++L +M+QGRTTIAIAHRL
Sbjct: 489  TFSSGQRQLLSFARTMVREPAILILDEATASVDTETEEAIQEALERMKQGRTTIAIAHRL  548

Query: 535  STIQDANCIYVLDRGKIIESGNHESLLDLKGTYYRMYQLQAG  576
            STI+DA+ I VL +G+I+E G H+ L+   KG Y +MY LQ G
Sbjct: 549  STIKDADQILVLHQGEIVERGTHDELIAKKGLYQKMYVLQKG  590
```

<SEQ ID 162>. This protein is predicted to be mdlB (ATP-bindingprot). Analysis of this protein sequence reveals the following:

There is also homology to SEQ ID 160.

A related GBS gene <SEQ ID 8481> and protein <SEQ ID 8482> were also identified. Analysis of this protein sequence reveals the following:

Possible site: 39
>>> Seems to have no N-terminal signal sequence
| INTEGRAL | Likelihood = −8.65 | Transmembrane 164-180 (155-183) |
| INTEGRAL | Likelihood = −5.15 | Transmembrane 25-41 (21-46) |
| INTEGRAL | Likelihood = −4.88 | Transmembrane 143-159 (133-163) |
| INTEGRAL | Likelihood = −1.49 | Transmembrane 251-267 (251-270) |
| INTEGRAL | Likelihood = −1.33 | Transmembrane 61-77 (61-77) |
----- Final Results -----

Lipop: Possible site: −1   Crend: 10
McG: Discrim Score: −4.63
GvH: Signal Score (−7.5): −5.85
Possible site: 39
>>> Seems to have no N-terminal signal sequence
ALOM program   count: 5 value: −8.65 threshold: 0.0

-continued

| | | | |
|---|---|---|---|
| INTEGRAL | Likelihood = −8.65 | Transmembrane 164-180 (155-183) | |
| INTEGRAL | Likelihood = −5.15 | Transmembrane 25-41 (21-46) | |
| INTEGRAL | Likelihood = −4.88 | Transmembrane 143-159 (133-163) | |
| INTEGRAL | Likelihood = −1.49 | Transmembrane 251-267 (251-270) | 5 |
| INTEGRAL | Likelihood = −1.33 | Transmembrane 61-77 (61-77) | |
| PERIPHERAL | Likelihood = 3.02 | 483 | | modified ALOM score: 2.23
*** Reasoning Step: 3

----- Final Results -----
  bacterial membrane --- Certainty = 0.4461 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
ORF01277(322-2028 of 2340)
EGAD|108578|BS0971(2-667 of 673) hypothetical protein {Bacillus subtilis} OMNI|NT01BS1137
conserved hypothetical protein GP|2226165|emb|CAA74449.1||Y14080 hypothetical protein
{Bacillus subtilis} GP|2633307|emb|CAB12811.1||Z99109 similar to ABC transporter (ATP-
binding protein) {Bacillus subtilis} PIR|H69828|H69828 ABC transporter (ATP-binding
protein) homolog yheH - Bacillus subtilis
% Match = 28.5
% Identity = 40.8 % Similarity = 69.1
Matches = 234 Mismatches = 171 Conservative Sub.s = 162

162       192       222       252       282       312       342       372
         RLLFQHIDYQLLCTQTLS*LCKTAESSSEVSIKSC*IKVVGMLKRMPHSN*KWRKHLMKSNQWQVFKRLISYLRPYKWFT
                                                                       ::  |    |    |   | : :
                                                                       MKIGKTLWRYALLYRKLL
                                                                       10

402       432       462                                                    480
         VLALSLLLLTTVVKNIIPLIASHFIDHYLTNVNQT------------------------------------------A
         : |: || :    :   |:|    || ::   : |
         ITAVLLLLTVAVGAELTGPFIGKKMIDDHILGIEKTWYEAAEKDKNAVQFHGVSYV~~~~AAEKLTKQELFQFYQPEIKGM
          30        40        50        60        70                                 140

510       540       570       600       630       660       690       720
         VLILVGYYSMYVLQTLIQYFGNLFFARVSYSIVRDIRRDAFANMERLGMSYFDRTPAGSIVSRITNDTEAISDMFSGILS
         ||::    |   : |:   : ||    :  ::     :    |:: :|: |:::::: :  |||    |||   :|:||||||||||   |:: :||
         VLLICLYGGLLVFSVFFQYGQHYLLQMSANRIIQKMRQDVFSHIQKMPIRYFDNLPAGKVVARITNDTEAIRDLYVTVLS
          160       170       180       190       200       210       220

750       777       807       837       867       897       927       957
         SFISAIFIFTVTLYTML-MLDIKLTGLVALLLPVIFILVNVYRKKSVTVIAKTRSLLSDINSKLSESIEGIRIVQAFGQE
         :|:::  |:     ::|||:||      ::|:|::         ||:  |: :||    ||||:|:::|||:: |::||
         TFVTS-GIYMFGIFTALFLLDVKLAFVCLAIVPIIWLWSVIYRRYASYYNQKIRSINSDINAKMNESIQGMTIIQAFRHQ
          240       250       260       270       280       290       300

987       1017      1047      1077      1107      1131      1161      1191
         ERLKTEFEEINKEHVVYANRSMALDSLFLRPAMSLLKLLAYAVLMAYFGFTGVK--GGLTAGLMYAFIQYVNRLFDPLIE
         :         ||||:|: |  : ||  : |:||       :::::  ||:   |: ||       | :: ||:|||  |:|||| |:
         KETMREFEELNESHFYFQNRMLNLNSLMSHNLVNVIRNLAFVCLIWHFGGASLNAAGIVSIGVLYAFVDYLNRLFQPITG
          320       330       340       350       360       370       380

1221      1251      1281      1311      1341      1371      1401      1431
         VTQNFSTLQTSMVSAGRVFDLIDETGFEPSQKNTEAFVREGNIEFKNVSFSYDGKKQILDNVSFSVKKGETIAFVGATGS
         :   || |: :  ||||||||:::|   |  :  :        |  | :||::|||:|    :::|   ::||:   :||||||:|| |||
         IVNQFSKLELARVSAGRVFELLEEKNTEEAGEPAKERAL-GRVEFRDVSFAYQEGEEVLKHISFTAQKGETVALVGHTGS
          400       410       420       430       440       450       460

1461      1491      1521      1551      1581      1611      1638      1668
         GKSSIINVFMRFYEFQSGQVLLDGKDIRDYSQEQLRKNIGLVLQDPFLYHGTIKSNIKMYQD-ITDQEVQDAAEFVDADQ
         |||||:|::  |||:  | |  ||:||| |   :  |:::: ::|:||||||:  ||| ||:  :   :|::|:::|    | |:
         GKSSILNLLFRFYDAQKGDVLIDGKSIYNMSRQELRSHMGIVLQDPYLFSGTIGSNVSLDDERMTEEEIKNALRQVGAEP
          480       490       500       510       520       530       540

1698      1728      1758      1788      1818      1848      1878      1908
         FIQKLPDKYDAAVSERGSSFSTGQRQLLAFARTVASKPKILILDEATANIDSETEQIVQDSLAKMRQGRTTIAIAHRLST
         :::|||     :   |  |:|::::|:|||:::    |   | |||||||||:||||   ::|   ::|||| |||||||
         LLKKLPKGINEPVIEKGSTLSSGERQLISFARALAFDPAILILDEATAHIDTETEAVIQKALDVVKQGRTTFVIAHRLST
          560       570       580       590       600       610       620

1938      1968      1998      2028      2058      2088      2118      2148
         IQDANCIYVLDRGKIIESGNHESLLDLKGTYYRMYQKQAGMMEV*KI*TIQKA*SVRFRGWSSYSSKPFLYFTISV**GQ
         |::|:  |  |||:| |||| ||||| |:   |: || ||::||  |  |
         IRNADQILVLDKGEIVERGNHEELMALEGQYYQMYELGKGQHSIA
          640       650       660       670
```

There is also homology to SEQ IDs 330, 4634 and 5788.

Based on this analysis, it was predicted that these proteins and their epitopes could be useful antigens for vaccines or diagnostics.

Example 52

A DNA sequence (GBSx0051) was identified in *S. agalactiae* <SEQ ID 163> which encodes the amino acid sequence <SEQ ID 164>. Analysis of this protein sequence reveals the following:

Possible site: 25
>>> Seems to have no N-terminal signal sequence
----- Final Results -----
    bacterial cytoplasm --- Certainty = 0.0635 (Affirmative) <succ>
    bacterial membrane --- Certainty = 0.0000 (Not Clear) <succ>
    bacterial outside --- Certainty = 0.0000 (Not Clear) <succ>

A related GBS nucleic acid sequence <SEQ ID 9609> which encodes amino acid sequence <SEQ ID 9610> was also identified.

The protein has homology with the following sequences in the GENPEPT database:

```
>GP:AAA25224 GB:M87483 anthranilate synthase beta subunit
[Lactococcus lactis]
Identities = 101/191 (52%), Positives = 133/191 (68%), Gaps = 4/191 (2%)
Query:  14 MLLLVDNYDSFTYNLKQYLSVYKEVFVIKNDVPNLFLLAESAEAIVLSPGPGHPKDAGKM    73
            M+L++DNYDSFTYNL QY+ V  +V V+KND  +L  +AE A+A++ SPGPG P DAGKM
Sbjct:   1 MILIIDNYDSFTYNLVQYVGVLTDVAVVENDDDSLGNMAEKADALIFSPGPGWPADAGKM    60

Query:  74 VELINQFIGKKPILGICLGHQALAECLGGRLNLANHVMHGKQSWVTINDHTSLFKGIDSP   133
            LI QF G+KPILGICLG QA+ E   GG+L LA+ VMHGK S V      +F  + S
Sbjct:  61 ETLIQQFAGQKPILGICLGFQAIVEVFGGKLRLAHQVMHGKNSQVRQTSGNLIFNHLPSK   120

Query: 134 TQVMRYHSLVVTD---LPENIAVIARSNEDNEIMAFHCPSLKVYAMQFHPESIGSIDGMK   190
            VMRYHS+V+ +   LP+  A+ A + +D EIMA     ++Y +QFHPESIG++DGM
Sbjct: 121 FLVMRYHSIVMDEAVALPD-FAITAVATDDGEIMAIENEKEQIYGLQFHPESIGTLDGMT   179

Query: 191 MIENFLTLIND                                                   201
            MIENF+  +N+
Sbjct: 180 MIENFVNQVNE                                                   190
```

A related DNA sequence was identified in *S. pyogenes* <SEQ ID 165> which encodes the amino acid sequence <SEQ ID 166>. Analysis of this protein sequence reveals the following:

Possible site: 57
>>> Seems to have no N-terminal signal sequence
----- Final Results -----
    bacterial cytoplasm --- Certainty = 0.3183 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below:

```
Identities = 104/186 (55%), Positives = 131/186 (69%)
Query:  14 MLLLVDNYDSFTYNLKQYLSVYKEVFVIKNDVPNLFLLAESAEAIVLSPGPGHPKDAGKM    73
            M+LL+DNYDSFTYNL QYLS + E  V+ N  PNL+ +A+ A A+VLSPGPG PK+A +M
Sbjct:   1 MILLIDNYDSFTYNLAQYLSEFDETIVLYNQDPNLYDMAKKANALVLSPGPGWPKEANQM    60

Query:  74 VELINQFIGKKPILGICLGHQALAECLGGRLNLANHVMHGKQSWVTINDHTSLFKGIDSP   133
            +LI  F   KPILG+CLGHQA+AE LGG L LA  VMHG+QS        SLF+ +
Sbjct:  61 PKLIQDFYQTKPILGVCLGHQAIAETLGGTLRLAKRVMHGRQSTIETQGPASLFRSLPQE   120

Query: 134 TQVMRYHSLVVTDLPENIAVIARSNEDNEIMAFHCPSLKVYAMQFHPESIGSIDGMKMIE   193
            VMRYHS+VV  LP+  +V AR  +D EIMAF   +L ++ +QFHPESIG+ DGM MI
Sbjct: 121 ITVMRYHSIVVDQLPKGFSVTARDCDDQEIMAFEHHTLPLFGLQFHPESIGTPDGMTMIA   180

Query: 194 NFLTLI                                                        199
            NF+  I
Sbjct: 181 NFIAAI                                                        186
```

Based on this analysis, it was predicted that these proteins and their epitopes could be useful antigens for vaccines or diagnostics.

Example 53

A DNA sequence (GBSx0052) was identified in *S. agalactiae* <SEQ ID 167> which encodes the amino acid sequence <SEQ ID 168>. Analysis of this protein sequence reveals the following:

```
Possible site: 58
>>> Seems to have a cleavable N-term signal seq.
INTEGRAL    Likelihood = -8.17   Transmembrane 117-133 (108-140)
INTEGRAL    Likelihood = -1.70   Transmembrane 150-166 (150-166)
----- Final Results -----
    bacterial membrane --- Certainty = 0.4270 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the GENPEPT database:

```
>GP:CAB12877 GB:Z99109 similar to biotin biosynthesis [Bacillus subtilis]
Identities = 70/168 (41%), Positives = 106/168 (62%)
Query:    8  YIALMVALLIVLGFIPGIPLGFIPVPIVLQNLGVMLAGALLGSRKGFLAVAIFLLLVAIG   67
             +IA+   AL+ VLGF+P + L F PVPI LQ LGVMLAG++L  +   FL+  +FLLLVA G
Sbjct:    9  HIAIFTALMAVLGFMPPLFLSFTPVPITLQTLGVMLAGSILRPKSAFLSQLVFLLLVAFG   68

Query:   68  APFLPGGRSGLVTLFGPTAGYLLTYPFAAFFIGLGLEKVKTTKLWVQFLIIWIFGVLLID  127
             AP LPGGR G    FGP+AG+L+ YP A++ I L   +++   +   F    +FG++ I
Sbjct:   69  APLLPGGRGGFGVFFGPSAGFLIAYPLASWLISLAANRLRKVTVLRLFFTHIVFGIIFIY  128

Query:  128  ICGSIVLSFQTSLPLTKSLFSNLIFIPGDTLKASICLIIYRKFANRLT             175
             + G  V +F   + L+++ F +L ++PGD +KA++      +  K    L+
Sbjct:  129  LLGIPVQAFIMHIDLSQAAFMSLAYVPGDLIKAAVSAFLAIKITQALS             176
```

A related DNA sequence was identified in *S. pyogenes* <SEQ ID 169> which encodes the amino acid sequence <SEQ ID 170>. Analysis of this protein sequence reveals the following:

```
Possible site: 51
>>> Seems to have an uncleavable N-term signal seq
INTEGRAL    Likelihood = -10.03  Transmembrane 113-129 (109-139)
INTEGRAL    Likelihood = -8.97   Transmembrane 55-71 (52-76)
INTEGRAL    Likelihood = -7.54   Transmembrane 10-26 (6-38)
INTEGRAL    Likelihood = -5.79   Transmembrane 86-102 (81-105)
INTEGRAL    Likelihood = -2.87   Transmembrane 33-49 (28-51)
INTEGRAL    Likelihood = -1.97   Transmembrane 150-166 (150-168)
----- Final Results -----
    bacterial membrane --- Certainty = 0.5012 (Affirmative) <succ>
      bacterial outside --- Certainty = 0.0000 (Not Clear) <succ>
        bacterial cytoplasm --- Certainty = 0.0000 (Not Clear) <succ>
```

An alignment of the GAS and GBS proteins is shown below:

```
Identities = 80/168 (47%), Positives = 108/168 (63%), Gaps = 1/168 (0%)
Query:    3  TRTTTYIALMVALLIVLGFIPGIPLGFIPVPIVLQNLGVMLAGALLGSRKGFLAVAIFLL   62
             T+      +A+M  L+I+LGFIP IPLGFIPVPIVLQNLGVMLAG +LG +KG L+V +F L
Sbjct:    4  TKELVIWAMMTTLIIILGFIPAIPLGFIPVPIVLQNLGVMLAGLMLGGKKGTLSVFLF-L   62

Query:   63  LVAIGAPFLPGGRSGLVTLFGPTAGYLLTYPFAAFFIGLGLEKVKTTKLWVQFLIIWIFG  122
             ++ +   P   G R+ +  L GP+AGY++   Y        L    +    + FL + I G
Sbjct:   63  VIGLFLPVFSGSRTTIPVLMGPSAGYVIAYLLVPIVFSLLYRNWFSKSTPLAFLALLISG  122

Query:  123  VLLIDICGSIVLSFQTSLPLTKSLFSNLIFIPGDTLKASICLIIYRKF             170
             V+L+D+  G+I LS   T + L    SL SNL+FIPGDT+KA I   II  K+
Sbjct:  123  VVLVDVLGAIWLSAYTGMSLVTSLLSNLVFIPGDTIKAIIATIIAVKY             170
```

Based on this analysis, it was predicted that these proteins and their epitopes could be useful antigens for vaccines or diagnostics.

Example 54

A DNA sequence (GBSx0053) was identified in *S. agalactiae* <SEQ ID 171> which encodes the amino acid sequence <SEQ ID 172>. Analysis of this protein sequence reveals the following:

Possible site: 17
>>> Seems to have no N-terminal signal sequence
----- Final Results -----
    bacterial cytoplasm --- Certainty = 0.3914 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 55

A DNA sequence (GBSx0054) was identified in *S. agalactiae* <SEQ ID 173> which encodes the amino acid sequence <SEQ ID 174>. Analysis of this protein sequence reveals the following:

Possible site: 15
>>> Seems to have no N-terminal signal sequence
----- Final Results -----
    bacterial cytoplasm --- Certainty = 0.1864 (Affirmative) <succ>
    bacterial membrane --- Certainty = 0.0000 (Not Clear) <succ>
    bacterial outside --- Certainty = 0.0000 (Not Clear) <succ>

A related GBS nucleic acid sequence <SEQ ID 9611> which encodes amino acid sequence <SEQ ID 9612> was also identified.

The protein has homology with the following sequences in the GENPEPT database:

```
>GP:BAB05467 GB:AP001513 biotin synthase [Bacillus halodurans]
Identities = 133/316 (42%), Positives = 201/316 (63%), Gaps = 2/316 (0%)
Query:  17  NYIHLADEILSGKTSISYEQALEILNS-DENWWEIYAAALYLKNQVSRNNIRLNVLLSAK   75
            N+I LA E++ GK  IS  +AL ILNS D+    +  A  ++      ++LN++++AK
Sbjct:   2  NWIQLAQEVIEGKR-ISENEALAILNSPDDELLLLLQGAFTIRQTYYGKKVKLNMIMNAK   60

Query:  76  QGLCAENCGYCSQSKESTADIDKFGLLPQNVILKQAIVAHQNGASVFCIAMSGTKPSKRE  135
              G C ENCGYCSQS  S A ID + ++ +   IL+ A  AH+      +CI  SG  P+ R+
Sbjct:  61  SGFCPENCGYCSQSSISKAPIDAYPMVNKETILEGARRAHELNVGTYCIVASGRGPTNRD  120

Query: 136  IEQLCQVIPEIKKSLPLEICLTAGFLDREQLHQLKQAGIDRINHNLNTPEENYPNIATTH  195
            I+ + + +  EIK +  L+IC   G L  EQ  QLK AG+DR NHN+NT   ++   I T+H
Sbjct: 121  IDHVTEAVREIKDTYGLKICACLGILKPEQAEQLKAAGVDRYNHNVNTSARHHDQITTSH  180

Query: 196  SFKDRCDTLERIHNEDIDVCSGFICGMGESDEGLITLAFRLKELDPYSIPVNFLLAVEGT  255
            +++DR +T+E + +     I  CSG I GM E+ E ++ +AF+L+ELD  SIPVNFL A++GT
Sbjct: 181  TYEDRVNTVEVVKHSGISPCSGVIVGMKETKEDVVDMAFQLRELDADSIPVNFLHAIDGT  240

Query: 256  PLGKYNYLTPIKCLKIMAMLRFVFPFKELRLSAGREVHFENFESLVTLLLVDSTFLGNYLT  315
            PL     + LTPI  CLK++++  R+V  P  KE+R+S  GREV+  ++   + L     +S  F+G+YLT
Sbjct: 241  PLQGVHELTPIYCLKVLSLFRYVCPTKEIRISGGREVNLKSLQPLGLYAANSIFIGDYLT  300

Query: 316  EGGRNQHTDIEFLEKL                                             331
             G+ +    D + L+ L
Sbjct: 301  TAGQEETADHQILKDL                                             316
```

No corresponding DNA sequence was identified in *S. pyogenes*.

Based on this analysis, it was predicted that this protein and its epitopes, could be useful antigens for vaccines or diagnostics.

Example 56

A DNA sequence (GBSx0055) was identified in *S. agalactiae* <SEQ ID 175> which encodes the amino acid sequence <SEQ ID 176>. Analysis of this protein sequence reveals the following:

Possible site: 24
>>> Seems to have no N-terminal signal sequence
----- Final Results -----
    bacterial cytoplasm --- Certainty = 0.3440 (Affirmative) <succ>
    bacterial membrane --- Certainty = 0.0000 (Not Clear) <succ>
    bacterial outside --- Certainty = 0.0000 (Not Clear) <succ>

A related GBS nucleic acid sequence <SEQ ID 9613> which encodes amino acid sequence <SEQ ID 9614> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 57

A DNA sequence (GBSx0056) was identified in *S. agalactiae* <SEQ ID 177> which encodes the amino acid sequence <SEQ ID 178>. Analysis of this protein sequence reveals the following:

Possible site: 15
>>> Seems to have no N-terminal signal sequence
----- Final Results -----
    bacterial cytoplasm --- Certainty = 0.1985 (Affirmative) <succ>

-continued

```
bacterial membrane --- Certainty = 0.0000 (Not Clear) <succ>
bacterial outside --- Certainty = 0.0000 (Not Clear) <succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 58

A DNA sequence (GBSx0057) was identified in S. agalactiae <SEQ ID 179> which encodes the amino acid sequence <SEQ ID 180>. Analysis of this protein sequence reveals the following:

```
Possible site: 32
>>> Seems to have no N-terminal signal sequence
INTEGRAL     Likelihood = −0.11    Transmembrane 347-363 (347-363)
----- Final Results -----
   bacterial membrane --- Certainty = 0.1044 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the GENPEPT database:

```
>GP:CAC11722 GB:AL445064 acetyl-CoA acetyltransferase related protein
[Themoplasma acidophilum]
Identities = 113/388 (29%), Positives = 181/388 (46%), Gaps = 31/388 (7%)
Query:   4  RDVYIGFGLRTPIGIKGKQFKHYR-PELLGAHLLNQIKKIESESNID-----SIICGNTV    57
            RDV+I    RT IG  G+ F   + P+L GA     IK +   E+++D     +I GN +
Sbjct:   2  RDVFIVAAKRTAIGKFGRSFSKLKAPQLGGA----AIKAVMDEAHVDPASVEEVIMGNVI    57

Query:  58  --GTGGNIGRLMTLFSDYESYIPVQTIDMQCASSSSALFFGYLKISTGINEKVLVGGIES   115
              G G N          + +    T+++ CAS   A+       +I+ G   + V+ GG+ES
Sbjct:  58  QAGNGQNPAGQAAFHGGLPNSVLKYTVNVVCASGMLAVESAAREIALGERDLVIAGGMES   117

Query: 116  SSLQPMR-----RYAKEDNRNGEYTVAQ-FSPDSYAETVMLE----GAQRVCQKYGERRE   165
            S   P      R+ +   + Y +      D    E       A+R  +K+G  RE
Sbjct: 118  MSNAPFLLPADLRWGPKHLLHKNYKIDDAMLTDGLLDAFYFEHMGVSAERTSRKFGITRE   177

Query: 166  MLDKLAFLSHKRALTAKQGGYLEEVILPMEGM-RDQGVRKLKETFFQKLPRLMENSPLLT   224
            M D+ +   S++RA+ A + G    + I+    EG+   D+G+RK        +LP  +   + +LT
Sbjct: 178  MADEYSVQSYERAIRATESGEFADEIVQFEGLDHDEGIRKTTMEDLARLPPAFDKNGILT   237

Query: 225  IGNVCLMHDAAAFLTLQSQKT--EFRIVHIVEVAG------DPKLSPELVHTATEKLLTE   276
            GN   + D + L + S+K    E+ +  I   + G             DP    E      AT KLL +
Sbjct: 238  AGNSAQLSDGGSALMIASEKAINEYGLKPIARITGYEQASLDPLDFVEAPIPATRKLLEK   297

Query: 277  THTKISDYDAIEWNEPFAAIDALFNHYYPEEREKFNIFGGTLAYGHPYACSGIINILHLM   336
                H  I  YD +E  NE  F+   +    +    + E+FN+ GG +A GHP     SG    I+ LM
Sbjct: 298  QHKSIDYYDLVEHNEAFSIASVIVRNELKIDNERFNVNGGAVAIGHPIGNSGARIIVTLM   357

Query: 337  QALKYKNKPMGLTAIAGAGGVGMAISIE                                  364
            ALK+++    GL +   GG    +++E
Sbjct: 358  NALKHRHLKTGLATLCHGGGGAHTLTLE                                  385
```

A related DNA sequence was identified in S. pyogenes <SEQ ID 181> which encodes the amino acid sequence <SEQ ID 182>. Analysis of this protein sequence reveals the following:

```
Possible site: 22
>>> Seems to have no N-terminal signal sequence
INTEGRAL     Likelihood = −1.28    Transmembrane 345-361 (345-361)
----- Final Results -----
   bacterial membrane --- Certainty = 0.1510 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP:BAB03328 GB:AB035449 acetyl-CoA c-acetyltransferase [Staphylococcus aureus]
Identities = 115/382 (30%), Positives = 184/382 (48%), Gaps = 29/382 (7%)
Query:   1  MTDVYIAAGLRTPIGLVGKQFAKEQPEILGAKLINALQNKYPV---PIDQVICGNTVGTG    57
            M    I A  RT  G  G    +PE L     L  + KYP     ID V+ GN VG G
Sbjct:   1  MNQAVIVAAKRTAFGKYGGTLKHLEPEQLLKPLFQHFKEKYPEVISKIDDVVLGNVVGNG    60
```

-continued

```
Query:  58  GNIGRLMTLYSHLGESVSALTVDMQCASAGAALSVGYAKIKAGMASNLLVGGIESSS---  114
            GNI R   L + L +S+  +T+D QC S     ++      I+AG    + GG+ES+S
Sbjct:  61  GNIARKALLEAGLKDSIPGVTIDRQCGSGLESVQYACRMIQAGAGKVYIAGGVESTSRAP  120

Query: 115  ---LQPESVYASADWRQGAYKVAQFSPDSISPFAMIEGAERVAREHGFTKEYLNHWTLRS  171
               +P SVY +A       Y+ A F+P+   P +MI+GAE VA++    ++E + + RS
Sbjct: 121  WKIKRPHSVYETA--LPEFYERASFAPEMSDP-SMIQGAENVAKMYDVSRELQDEFAYRS  177

Query: 172  HQKASYCQEQALLADLILDLSGA-----SDQGIRPRLSSKVLSKVPPILGEGHVISAANA  226
            HQ +  +  ++ IL ++      +D+ ++ +       + P++ +G  ++AAN+
Sbjct: 178  HQLTAENVKNGNISQEILPITVKGEIFNTDESLKSHIPKDNFGRFKPVI-KGGTVTAANS  236

Query: 227  CLTHDAAAFLQLSSQPSAFKL--------IDVVEVAGDPQRSPLMVIKASQVLLEKHGLG  278
            C+ +D A  L + + A++L         D V V D   + + A   LL+++  L
Sbjct: 237  CMKNDGAVLLLIMEKDMAYELGFEHGLLFKDGVTVGVDSNFPGIGPVPAISNLLKRNQLT  296

Query: 279  MADMTAIEWNEAFAVIDGLFETHYPDLLDRYNIFGGALAYGHPYGASAAIIILHLMRALE  338
            + ++  IE NEAF+         +      + NI+GGALA GHPYGAS A ++  L   +
Sbjct: 297  IENIEVIEINEAFSAQVVACQQALNISNTQLNIWGGALASGHPYGASGAQLVTRLFYMFD  356

Query: 339  IKNGRYGIAAIAAAGGQGFAVL                                       360
              +      IA++   GG  G A L
Sbjct: 357  KET---MIASMGIGGGLGNAAL                                       375
```

An alignment of the GAS and GBS proteins is shown below:

```
Identities = 182/362 (50%), Positives = 243/362 (66%), Gaps = 2/362 (0%)
Query:   5  DVYIGFGLRTPIGIKGKQFKHYRPELLGAHLLNQIKKIESESNIDSIICGNTVGTGGNIG   64
            DVYI   GLRTPIG+ GKQF    +PE+LGA L+N ++  +    ID +ICGNTVGTGGNIG
Sbjct:   3  DVYIAAGLRTPIGLVGKQFAKEQPEILGAKLINALQN-KYPVPIDQVICGNTVGTGGNIG   61

Query:  65  RLMTLFSDYESYIPVQTIDMQCASSSALFFGYLKISTGINEKVLVGGIESSSLQPMRRY   124
            RLMTL+S    +   T+DMQCAS+ +AL  GY KI  G+    +LVGGIESSSLQP   Y
Sbjct:  62  RLMTLYSHLGESVSALTVDMQCASAGAALSVGYAKIKAGMASNLLVGGIESSSLQPESVY   121

Query: 125  AKEDNRNGEYTVAQFSPDSYAETVMLEGAQRVCQKYGFRREMLDKLAFLSHKRALTAKQG   184
            A   D R G Y VAQFSPDS +   M+EGA+RV +++GF +E L+      SH++A   ++
Sbjct: 122  ASADWRQGAYKVAQFSPDSISPFAMIEGAERVAREHGFTKEYLNHWTLRSHQKASYCQEQ   181

Query: 185  GYLEEVILPMEGMRDQGVR-KLKETFFQKLPRLMENSPLLTIGNVCLMHDAAAFLTLQSQ   243
               L ++IL + G  DQG+R +L     K+P ++      +++  N CL HDAAAFL L SQ
Sbjct: 182  ALLADLILDLSGASDQGIRPRLSSKVLSKVPPILGEGHVISAANACLTHDAAAFLQLSSQ   241

Query: 244  KTEFRIVHIVEVAGDPKLSPELVHTATEKLLTETHTKISDYDAIEWNEPFAAIDALFNHY   303
             + F+++ +VEVAGDP+  SP +V  A++ LL +     ++D  AIEWNE FA  ID LF +
Sbjct: 242  PSAFKLIDVVEVAGDPQRSPLMVIKASQVLLEKHGLGMADMTAIEWNEAFAVIDGLFETH   301

Query: 304  YPEEREKFNIFGGTLAYGHPYACSGII-                                365
            NILHLMQALKYKNKPMGLTAIAGAGGVGMAISIEY
            YP+  +++NIFGG LAYGHPY  S   I  ILHLM+AL+ KN    G+ AIA AGG G A+ ++Y
Sbjct: 302  YPDLLDRYNIFGGALAYGHPYGASAAII-                                363
            ILHLMRALEIKNGRYGIAAIAAAGGQGFAVLLKY
```

Based on this analysis, it was predicted that these proteins and their epitopes could be useful antigens for vaccines or diagnostics.

Example 59

A DNA sequence (GBSx0058) was identified in *S. agalactiae* <SEQ ID 183> which encodes the amino acid sequence <SEQ ID 184>. Analysis of this protein sequence reveals the following:

---

Possible site: 13
>>> Seems to have no N-terminal signal sequence
INTEGRAL    Likelihood = –3.82    Transmembrane 149-165 (148-165)
----- Final Results -----
  bacterial membrane --- Certainty = 0.2529 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the GENPEPT database:

```
>GP:CAB12876 GB:Z99109 similar to long-chain fatty-acid-CoA ligase
[Bacillus subtilis]
Identities = 90/382 (23%), Positives = 158/382 (40%), Gaps = 24/382 (6%)
Query:  47  ISTHSLLNQLVRFVSKLCQKALPIICKPNLTHNEISRLEKEV--QYAPQLADFGVLSSGT   104
            IS    L+   L  F +KL      P++     N     +IS         P+    +SG+
Sbjct:  95  ISNADLVVTLAFFKNKLTDSQTPVVLLDNCMA-DISEAAADPLPTIDPEHPFYMGFTSGS   153

Query: 105  TADAKLLWRSFTSWSDFFSIQNAYFSVTSNSKLFIQGDFSFTGNLNLALSLLLLGGTLVV   164
            T     K    RS   SW +  F+        FS++S+ K+ I G      +  L   A+S L LGGT+  +
Sbjct: 154  TGKPKAFTRSHRSWMESFTCTETDFSISSDDKVLIPGALMSSHFLYGAVSTLFLGGTVCL   213

Query: 165  TQKNSVKYWQTLWEKTGVTHLYLLPSYLKLVEQYSKETALDNKTIITSSQYVSDSLLEGL   224
            +K S      +     +  ++ LY +P+      + +           K I + + + ++S    + L
Sbjct: 214  LKKFSPAKAKEWLCRESISVLYTVPTMTDALARIEGFPDSPVKIISSGADWPAES-KKKL   272

Query: 225  YRKHPKVSVKIFYGASELNYVSWYDGRDIRDKPQYVGEIVPNVAVRIKE----------   273
                 P + +   FYG SEL++V++ D +     KP    G       NV + I +
Sbjct: 273  AAAWPHLKLYDFYGTSELSFVTFSSPEDSKRKPHSAGRPFHNVRIEIRNAGGERCQPGEI   332

Query: 274  GRIFVKTPYSICG-----LSSEYCAGDYGELID--GKLYLFGRGGDWCNQSGIKLYLPRL   326
            G+IFVK+P       G           E+    D    +D  G LY+ GR       G+  ++    +
Sbjct: 333  GKIFVKSPMRFSGYVNGSTPDEWMTVDDMGYVDEEGFLYISGRENGMIVYGGLNIFPEEI   392

Query: 327  IEKIKTCPYIKDAVAFTKESQSHGQESHCCIVLIENQMQQECLKWLSEHFEKKYGFKHYH   386
              +    CP ++ A      + G+ +     V++ N  +      W   +         K +
Sbjct: 393  ERVLLACPEVESAAVVGIPDEYWGEIA--VAVILGNANARTLKAWCKQKLASYKIPKKKV   450

Query: 387  IVSKIPLMPSGKIDYQQLKRQL   408
            +P     SGKI  ++K+ L
Sbjct: 451  FADSLPETSSGKIARSRVKKWL   472
```

A related DNA sequence was identified in *S. pyogenes* <SEQ ID 185> which encodes the amino acid sequence <SEQ ID 186>. Analysis of this protein sequence reveals the following:

-continued bacterial cytoplasm --- Certainty = 0.2487 (Affirmative) <succ>
bacterial membrane --- Certainty = 0.0000 (Not Clear) <succ>
bacterial outside --- Certainty = 0.0000 (Not Clear) <succ>

Possible site: 52
>>> Seems to have no N-terminal signal sequence
----- Final Results -----

An alignment of the GAS and GBS proteins is shown below:

```
Identities = 154/413 (37%), Positives = 235/413 (56%), Gaps = 9/413 (2%)
Query:   1  MLESLKTIVKTNSDKKLFDGD-LQVSYGEFYNLVR-QDMASQDNRKHVISTHSLLNQLVR    58
            ML  L+    K  +KK       D + ++Y E +  V  +D    +D+ ++IS       LNQL+
Sbjct:   1  MLTKLEYWAKQCPNKKAIVADQISLTYQELWQAVLIKDQTIKDSVPYIISHSRYLNQLLS    60

Query:  59  FVSKLCQKALPIICKPNLT---HNEISRLEKEVQYAPQLADFGVLSSGTTADAKLLWRSF   115
            F+   L + + PII    PN++        +I  ++ E+      + ADF VLSSGTT   AKL WR
Sbjct:  61  FLRGLKEGSCPIILHPNISGTFQQQIKHVDGELL---KKADFAVLSSGTIGKAKLFWRRL   117

Query: 116  TSWSDFFSIQNAYFSVTSNSKLFIQGDFSFTGNLNLALSLLLLGGTLVVTQKMSVKYWQT   175
            ++W+   F    QN  F +T NS  LF+  G FSFTGNLNLAL+  L   GG LV++QK S+K W +
Sbjct: 118  STWTRLFDYQNKVFGMTGNSCLFLHGSFSFTGNLNLALAQLWAGGCLVLSQKLSLKTWLS   177

Query: 176  LWEKTGVTHLYLLPSYLKLVEQYSKETALDNKTIITSSQYVSDSLLEGLYRKHPKVSVKI   235
            LW+     V+HLYLLP+YL +      Y  +  +      ++TSSQ +S  LL     Y+K P++  + I
Sbjct: 178  LWQAKKVSHLYLLPTYLNRLLPYLTKNNMTATHLLTSSQMISQELLRHYYKKFPQLEIVI   237

Query: 236  FYGASELNYVSWYDGRDIRDKPQYVGEIVPNVAVRIKEGRIFVKTPYSICGLSSEYCAGD   295
            FYGASEL++++W  +GR          VG+  P+V++   K+   IFV+TPYS+ G+S   Y     D
Sbjct: 238  FYGASELSFITWCNGRAAVKINGLVGQPFPDVSISFKDKEIFVETPYSVEGMSQPYSVSD   297

Query: 296  YGELIDGKLYLFGRGGDWCNQSGIKLYLPRLIEKIKTCPYIKDAVAFTKESQSHGQESHC   355
             G++       L L GR  DW NQ  G+K +LP L+E       P  +K+A A    K +         +
Sbjct: 298  LGKMSPAGLILEGRQDDWVNQRGVKCHLPSLVELAHQAPNVKEAHAL-KIGKGENETLIL   356

Query: 356  CIVLIENQMQQECLKWLSEHFEKKYGFKHYHIVSKIPLMPSGKIDYQQLKRQL           408
            +VL +        +L+ +           K+Y ++    +PL  +GKI + + L    ++
Sbjct: 357  VLVLTKKDCLAPIKDFLALYLNSGQLPKYYLVIDCLPLKDNGKINREVLLNKI           409
```

Based on this analysis, it was predicted that these proteins and their epitopes could be useful antigens for vaccines or diagnostics.

Example 60

A DNA sequence (GBSx0059) was identified in *S. agalactiae* <SEQ ID 187> which encodes the amino acid sequence <SEQ ID 188>. This protein is predicted to be endonuclease III (pdg). Analysis of this protein sequence reveals the following:

Possible site: 46
>>> Seems to have no N-terminal signal sequence
INTEGRAL    Likelihood = −0.00    Transmembrane 25-41 (25-41)
----- Final Results -----
    bacterial membrane --- Certainty = 0.1001 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database:

```
>GP:BAB05417 GB:AP001512 endonuclease III (DNA repair) [Bacillus halodurans]
Identities = 95/202 (47%), Positives = 134/202 (66%)
Query: 1    MLSKAKSRYIIREIIKLFPDAKPSLDFTNVFELLVAVMLSAQTTDAAVNKVTPALFERFP    60
            ML+K +++ + I  ++PDA+  L  +N FELL+AV+LSAQ TDA VNKVTP LF ++
Sbjct: 1    MLIKKQTQEALAVIADMYPDAECELTHSNPFELLIAVVLSAQCTDALVNKVTPRLFAKYK   60

Query: 61   NPLVLAQADPKEIEPYISKIGLYRNKARFLNQCAKQLIEHFDGKVPRTRQELESLAGVGR  120
            P        +E+E  I  IGLYRNKA+ + +  + L+E +  G+VP+ R EL  LAGVGR
Sbjct: 61   TPEDYIAVPLEELEQDIRSIGLYRNKAKNIKKLCQSLLEQYGGEVPQDRDELVKLAGVGR  120

Query: 121  KTANVVMSVGFGIPAFAVDTHVTRICKHHQICKQSASPLEIEKRVMEVLPPEEWLAAHQS  180
            KTANVV  SV FG+PA AVDTHV R+ K    IC+   +  ++E+ +M+ +P +EW  +H
Sbjct: 121  KTANVVASVAFGVPAIAVDTHVERVSKRLGICRWKDNVTQVEQTLMKKIPMDEWSISHHR  180

Query: 181  MIYFGRAICHPKNPKCDQYPQL                                       202
            +I+FGR  C  +NP+CD  P L
Sbjct: 181  LIFFGRYHCKAQNPQCDICPLL                                       202
```

A related DNA sequence was identified in *S. pyogenes* <SEQ ID 189> which encodes the amino acid sequence <SEQ ID 190>. Analysis of this protein sequence reveals the following:

Possible site: 44
>>> Seems to have a cleavable N-term signal seq.
----- Final Results -----
    bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>

An alignment of the GAS and GBS proteins is shown below:

```
Identities = 91/199 (45%), Positives = 133/199 (66%)
Query: 2    LSKAKSRYIIREIIKLFPDAKPSLDFTNVFELLVAVMLSAQTTDAAVNKVTPALFERFPN   61
            + KA+  ++  I  ++FP+AK  LD+   F+LL+AV+LSAQTTD AVNKVTP L++ +P
Sbjct: 3    IGKARLAKVLTIIGQMFPEAKGELDWETPFQLLIAVILSAQTTDKAVNKVTPGLWQSYPE   62

Query: 62   PLVLAQADPKEIEPYISKIGLYRNKARFLNQCAKQLIEHFDGKVPRTRQELESLAGVGRK  121
            LA A+ ++E +  IGLY+NKA+ + + A+ + + F G+VP+T +ELESL GVGRK
Sbjct: 63   IEDLAFAELSDVENALRTIGLYKNKAKNIIKTAQAIRDDFKGQVPKTHKELESLPGVGRK  122

Query: 122  TANVVMSVGFGIPAFAVDTHVTRICKHHQICKQSASPLEIEKRVMEVLPPEEWLAAHQSM  181
            TANVV++  +G+PA AVDTHV R+ K   I    A    +IE +M  +P ++W+  H  +
Sbjct: 123  TANVVLAEVYGVPAIAVDTHVARVSKRLNISSPDADVKQIEADLMAKIPKKDWIITHHRL  182

Query: 182  IYFGRAICHPKNPKCDQYP                                          200
            I+FGR  C   K PKC+  P
Sbjct: 183  IFFGRYHCLAKKPKCEICP                                          201
```

Based on this analysis, it was predicted that these proteins and their epitopes could be useful antigens for vaccines or diagnostics.

Example 61

A DNA sequence (GBSx0060) was identified in *S. agalactiae* <SEQ ID 191> which encodes the amino acid sequence <SEQ ID 192>. Analysis of this protein sequence reveals the following:

Possible site: 51
>>> Seems to have no N-terminal signal sequence
----- Final Results -----
   bacterial cytoplasm --- Certainty = 0.2264 (Affirmative) <succ>
      bacterial membrane --- Certainty = 0.0000 (Not Clear) <succ>
         bacterial outside --- Certainty = 0.0000 (Not Clear) <succ>

The protein has homology with the following sequences in the GENPEPT database:

```
>GP:BAA96473 GB:AB036428 hypothetical 8.3 kDa protein [Streptococcus mutans]
Identities = 53/67 (79%), Positives = 62/67 (92%)
Query: 1   MKVLFDVQNLLKKFGIYVYIGKRLYDIEVMKIELQRLYDNGLISRDDYLKAELILRREHR  60
           MK L+DVQ LLK+FGI+VY+GKRLYDIE+MKIEL+RLYDNGLIS+ DYL AELILRREHR
Sbjct: 1   MKTLYDVQRLLKQFGIFVYLGKRLYDIEMMKIELERLYDNGLISKSDYLHAELILRREHR  60

Query: 61  LELEKEN                                                      67
           +E E+EN
Sbjct: 61  IEKEREN                                                      67
```

A related DNA sequence was identified in *S. pyogenes* <SEQ ID 193> which encodes the amino acid sequence <SEQ ID 194>. Analysis of this protein sequence reveals the following:

Possible site: 57
>>> Seems to have no N-terminal signal sequence
----- Final Results -----
   bacterial cytoplasm --- Certainty = 0.1962 (Affirmative) <succ>
      bacterial membrane --- Certainty = 0.0000 (Not Clear) <succ>
         bacterial outside --- Certainty = 0.0000 (Not Clear) <succ>

An alignment of the GAS and GBS proteins is shown below:

```
Identities = 53/66 (80%), Positives = 60/66 (90%)
Query: 1   MKVLEDVQNLLKKFGIYVYIGKRLYDIEVMKIELQRLYDNGLISRDDYLKAELILRREHR  60
           MK L+DVQ LLK FGI+VY+GKRLYDIE+MKIELQRLYD+GL+ + DYL AELILRREHR
Sbjct: 7   MKTLYDVQQLLKNFGIFVYLGKRLYDIEMMKIELQRLYDSGLLDKRDYLNAELILRREHR  66

Query: 61  LELEKE                                                       66
           LELEKE
Sbjct: 67  LELEKE                                                       72
```

Based on this analysis, it was predicted that these proteins and their epitopes could be useful antigens for vaccines or diagnostics.

Example 62

A DNA sequence (GBSx0061) was identified in *S. agalactiae* <SEQ ID 195> which encodes the amino acid sequence <SEQ ID 196>. Analysis of this protein sequence reveals the following:

Possible site: 31
>>> Seems to have no N-terminal signal sequence
INTEGRAL    Likelihood = –0.06    Transmembrane 133-149 (133-150)
----- Final Results -----
    bacterial membrane --- Certainty = 0.1022 (Affirmative) <succ>
    bacterial outside --- Certainty = 0.0000 (Not Clear) <succ>
    bacterial cytoplasm --- Certainty = 0.0000 (Not Clear) <succ>

Possible site: 23
>>> Seems to have no N-terminal signal sequence
----- Final Results -----
    bacterial cytoplasm --- Certainty = 0.1060 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database:

```
>GP:BAB05144 GB:AP001512 glucose kinase [Bacillus halodurans]
Identities = 145/315 (46%), Positives = 209/315 (66%), Gaps = 2/315 (0%)
Query:   6   LGIDLGGTTIKFGILTLEGEVQEKWAIETNTLENGRHIVSDIVESLKHRLSLYGLTKDDF    65
             +G+D+GGTTIK   LT  GE+ +KW I TN  + G  I ++I ++L  RLS +  +K D
Sbjct:   7   VGVDVGGTTIKMAFLTTAGEIVDKWEIPTNKQDGGALITTNIADALDKRLSGHHKSKSDL   66

Query:  66   LGIGMGSPGAVDRTSKTVTGAFNLNWADTQEVGSVIEKEVGIPFFIDNDANVAALGERWV   125
             +GIG+G+PG ++  +    A N+ W D  +   +E+E  +P  +DNDAN+AALGE W
Sbjct:  67   IGIGLGAPGFIEMDTGFIYHAVNIGWRDFP-LKDKLEEETKLPVIVDNDANIAALGEMWK   125

Query: 126   GAGANNPDVVFVTLGTGVGGGVIADGNLIHGVAGAGGEIGHMIVDPENGFTCTCGNKGCL   185
             GAG      +++ +TLGTGVGGG++A+GN++HGV G  GEIGH+ V PE G  C CG  GCL
Sbjct: 126   GAGDGAKNMLLITLGTGVGGGIVANGNILHGVNGMAGEIGHITVIPEGGAPCNCGKTGCL   185

Query: 186   ETVASATGVVRVARQLAEQYEGSSAIKAAIDNGDTVTSKDIFIAAEDGDKFANSVVERVS   245
             ETVASATG+ R+A +   +++  S +     D    +T+KD+F AA+D   FA SVV+ ++
Sbjct: 186   ETVASATGIARIATEGVTEHK-ESQLALDYDKHGVLTAKDVFSAADASDAFALSVVDHIA   244

Query: 246   RYLGLAAANISNILNPDSVVIGGGVSAAGEFLRSRVEKYFVTFAFPQVKKSTKIKIAELG   305
               YLG A  AN++N LNP+ +VIGGGVS AG+ L    ++++F  +A P+V   +  +IA LG
Sbjct: 245   YYLGFAIANLANALNPEKIVIGGGVSKAGDTLLKPIKQHFEAYALPRVADGAEFRIATLG   304

Query: 306   NDAGIIGAASLANQQ                                               320
             NDAG+IG   L  QQ
Sbjct: 305   NDAGVIGGGWLVKQQ                                               319
```

A related DNA sequence was identified in *S. pyogenes* <SEQ ID 197> which encodes the amino acid sequence <SEQ ID 198>. Analysis of this protein sequence reveals the following:

An alignment of the GAS and GBS proteins is shown below:

```
Identities = 270/319 (84%), Positives = 292/319 (90%)
Query:   1   MSKKLLGIDLGGTTIKFGILTLEGEVQEKWAIETNTLENGRHIVSDIVESLKHRLSLYGL    60
             MS+KLLGIDLGGTTIKFGILT  GEVQEKWAIETN LE G+HIV DI+S+KHRL  LYGL
Sbjct:   1   MSQKLLGIDLGGTTIKFGILTAAGEVQEKWAIETNILEGGKHIVPDIIASIKHRLDLYGL    60

Query:  61   TKDDFLGIGMGSPGAVDRTSKTVTGAFNLNWADTQEVGSVIEKEVGIPFFIDNDANVAAL   120
             +   DF+GIGMGSPGAVDR + TVTGAFNLNW +TQEVGSV+EKE+GIPF IDNDANVAAL
Sbjct:  61   SSADFVGIGMGSPGAVDRDTNTVTGAFNLNWKETQEVGSVVEKELGIPFAIDNDANVAAL   120

Query: 121   GERWVGAGANNPDVVFVTLGTGVGGGVIADGNLIHGVAGAGGEIGHMIVDPENGFTCTCG   180
             GERWVGAG NNPDVVF+TLGTGVGGG+IADGNLIHGVAGAGGEIGHMIV+PENGF CTCG
Sbjct: 121   GERWVGAGENNPDVVFMTLGTGVGGGIIADGNLIHGVAGAGGEIGHMIVEPENGFACTCG   180

Query: 181   NKGCLETVASATGVVRVARQLAEQYEGSSAIKAAIDNGDTVTSKDIFIAAEDGDKFANSV   240
             + GCLETVASATGVV+VAR LAE YEG SAIKAAIDNG+ VTSKDIF AAE GD FA+SV
Sbjct: 181   SHGCLETVASATGVVKVARLLAEAYEGSAIKAAIDNGEVTSKDIFMAAEAGDSFADSV   240

Query: 241   VERVSRYLGLAAANISNILNPDSVVIGGGVSAAGEFLRSRVEKYFVTFAFPQVKKSTKIK   300
             VE+V   YLGLA+ANISNILNPDSVVIGGGVSAAGEFLRSR+EKYFVTF FPQV+ STKIK
Sbjct: 241   VEKVGYYLGLASANISNILNPDSVVIGGGVSAAGEFLRSRIEKYFVTFTFPQVRYSTKIK   300

Query: 301   IAELGNDAGIIGAASLANQ                                           319
             IAELGNDAGIIGAASLA Q
Sbjct: 301   IAELGNDAGIIGAASLARQ                                           319
```

Based on this analysis, it was predicted that these proteins and their epitopes could be useful antigens for vaccines or diagnostics.

Example 63

A DNA sequence (GBSx0062) was identified in *S. agalactiae* <SEQ ID 199> which encodes the amino acid sequence <SEQ ID 200>. Analysis of this protein sequence reveals the following:

```
Possible site: 19
>>> Seems to have a cleavable N-term signal seq.
----- Final Results -----
   bacterial outside --- Certainty = 0.3000 (Affirmative) <succ>
   bacterial membrane --- Certainty = 0.0000 (Not Clear) <succ>
   bacterial cytoplasm --- Certainty = 0.0000 (Not Clear) <succ>
```

The protein has homology with the following sequences in the GENPEPT database:

```
>GP:CAB14385 GB:Z99116 similar to hypothetical proteins [Bacillus subtilis]
Identities = 51/124 (41%), Positives = 71/124 (57%), Gaps = 1/124 (0%)
Query:  3    MSVILIIVILLAFVAWASWNYWRVRRAAKFLDNESFQKEMSRGQLIDIREAGAFHRKHIL   62
             MS +++++I AF+ +   +Y  +R  K L  E F+    + QLID+RE    F    HIL
Sbjct:  1    MSNMIVLIIFPAFIIYMIASYVYQQRIMKTLTEEEFRAGYRKAQLIDVREPNEFEGGHIL   60

Query: 63    GARNIPASQFKVALSALRKDKPVLLYDASRGQSIPRIVLLLRKEGFNQLYVLKDGFNYWT  122
             GARNIP SQ K   + +R DKPV LY +   +S  R     LRK G  ++Y LK GF  W
Sbjct: 61    GARNIPLSQLKQRKNEIRTDKPVYLYCQNSVRS-GRAAQTLRKNGCTEIYNLKGGFKKWG  119

Query: 123   GRVK                                                          126
             G++K
Sbjct: 120   GKIK                                                          123
```

A related DNA sequence was identified in *S. pyogenes* <SEQ ID 201> which encodes the amino acid sequence <SEQ ID 202>. Analysis of this protein sequence reveals the following:

```
Possible site: 30
>>> Seems to have an uncleavable N-term signal seq
INTEGRAL     Likelihood = -4.41     Transmembrane 4-20 (1-22)
----- Final Results -----
   bacterial membrane --- Certainty = 0.2763 (Affirmative) <succ>
   bacterial outside --- Certainty = 0.0000 (Not Clear) <succ>
   bacterial cytoplasm --- Certainty = 0.0000 (Not Clear) <succ>
```

The protein has homology with the following sequences in the databases:

```
>GP:BAB06532 GB:AP001516 unknown conserved protein [Bacillus halodurans]
Identities = 46/120 (38%), Positives = 64/120 (53%)
Query:  8    LWLLLVGIVGYYTWNYFSFRKMAKQVDNETFKDVMRQGQLIDLREPAAFRTKHILGARNF   67
             +WL+L+ ++ Y +      K  K+  E F   R+ QLID+REP + + HILGARN
Sbjct:  5    VWLVLLALLVYVLFKRLYTPKYLKTLTQEEFIQGYRKAQLIDVREPREYDSGHILGARNI   64

Query: 68    PAQQFDAAIKGLRKDKPVLIYENMRPQYRVPAVKKLKKAGFEDVYVLKDGIDYWDGKVKQ  127
             P  Q    +K +R D+PV +Y      + R  A KK      G EDV  LK G   W GK+K+

Sbjct: 65    PLSQLKQRLKEVRTDQPVYLYCQSGARSRQAAAILKKKHGVEDVNHLKGGFRKWTGKIKK  124
```

An alignment of the GAS and GBS proteins is shown below:

```
Identities = 63/126 (50%), Positives = 85/126 (67%)
Query:  1    MDMSVILIIVILLAFVAWASWNYWRVRRAAKFLDNESFQKEMSRGQLIDIREAGAFHRKH   60
             M   +++ ++L+  V + +WNY+  R+ AK +DNE+F+   M +GQLID+RE  AF  KH
Sbjct:  1    MSPITLILWLLLVGIVGYYTWNYFSFRKMAKQVDNETFKDVMRQGQLIDLREPAAFRTKH   60

Query: 61    ILGARNIPASQFKVALSALRKDKPVLLYDASRGQSIPRIVLLLRKEGFNQLYVLKDGFNY  120
             ILGARN PA QF  A+   LRKDKPVL+Y+  R Q       V  L+K GF +YVLKDG +Y
Sbjct: 61    ILGARNFPAQQFDAAIKGLRKDKPVLIYENMRPQYRVPAVKKLKKAGFEDVYVLKDGIDY  120
```

```
Query:  121  WTGRVK  126
             W G+VK
Sbjct:  121  WDGKVK  126
```

A related GBS gene <SEQ ID 8483> and protein <SEQ ID 8484> were also identified. Analysis of this protein sequence reveals the following:

```
Lipop: Possible site: -1    Crend: 1
McG: Discrim Score: 17.55
GvH: Signal Score (-7.5): 3.36
Possible site: 17
>>> Seems to have a cleavable N-term signal seq.
ALOM program      count: 0 value: 8.86       threshold: 0.0
PERIPHERAL        Likelihood = 8.86          99
modified ALOM score: -2.27
*** Reasoning Step: 3
----- Final Results -----
    bacterial outside --- Certainty = 0.3000 (Affirmative) <succ>
        bacterial membrane --- Certainty = 0.0000 (Not Clear) <succ>
```

The protein has homology with the following sequences in the databases:

```
40.4/56.5% over 122aa
Bacillus subtilis
EGAD|45852| hypothetical 14.6 kd protein in gcvt-spoiiiaa intergenic region Insert
characterized
SP|P54510|YQHL_BACSU HYPOTHETICAL 14.6 KDA PROTEIN IN GCVT-SPOIIIAA INTERGENIC REGION.
Insert characterized
GP|1303893|dbj|BAA12549.1||D84432 YqhL Insert characterized
GP|2634888|emb|CAB14385.1||Z99116 similar to hypothetical proteins Insert characterized
PIR|C69959|C69959 glpE protein homolog yqhL - Insert characterized
ORF00659(307-678 of 978)
EGAD|45852|BS2449(1-123 of 126) hypothetical 14.6 kd protein in gcvt-spoiiiaa
intergenic region {Bacillus subtilis}SP|P54510|YQHL_
BACSU HYPOTHETICAL 14.6 KDA PROTEIN IN GCVT-SPOIIIAA INTERGENIC
REGION.GP|1303893|dbj|BAA12549.1||D84432 YqhL {Bacillus subtilis}GP|
2634888|emb|CAB14385.1||Z99116 similar to hypothetical proteins {Bacillus
subtilis}PIR|C69959|C69959 glpE protein homolog yqhL - Bacillus subtilis
% Match = 13.3
% Identity = 40.3 % Similarity = 56.5
Matches = 50 Mismatches = 53 Conservative Sub.s = 20

108       138       168       198       228       258       288       318
NISNILNPDSVVIGWRCLSSR*IFT*SR*EILCHICFPTS*KVN*N*DC*TR**CWYYWCSKLSQSTSKLRR*GMDMSVI
                                                                            || :
                                                                            MSNM 348       378       408       438       468       498       528       558
LIIVILLAFVAWASWNYWRVRRAAKFLDNESFQKEMSRGQLIDIREAGAFHRKHILGARNIPASQFKVALSALRKDKPVL
::::|:  ||:  :   :|    :|   |   |   |:    : ||||:||    |   ||||||||| ||:|   : :|  ||||
IVLIIFPAFIIYMIASYVYQQRIMKTLTEEEFRAGYRKAQLIDVREPNEFEGGHILGARNIPLSQLKQRKNEIRTDKPVY
         20        30        40        50        60        70        80

588       618       648       678       708       738       768       798
LYDASRGQSIPRIVLLLRKEGFNQLYVLKDGFNYWTGRVK*YTKERVTINNSLHFL*K*IKLKKVENKWHK**NDEKFSY
||       |       |||  |    ::|  || ||    | |::|
LY-CQNSVRSGRAAQTLRKNGCTEIYNLKGGFKKWGGKIKAKK
          100       110       120
```

Figure 3:
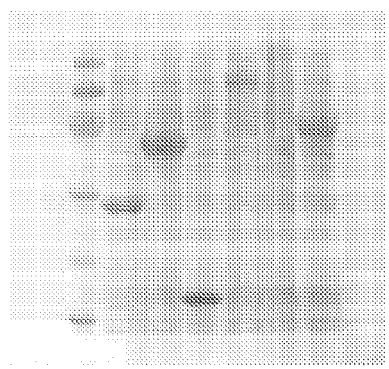

SEQ ID 8484 (GBS13) was expressed in *E. coli* as a His-fusion product. SDS-PAGE analysis of total cell extract is shown in FIG. 3 (lane 4; MW 16 kDa). It was also expressed in *E. coli* as a GST-fusion product. SDS-PAGE analysis of total cell extract is shown in FIG. 9 (lane 2; MW 40.5 kDa).

The GST-fusion protein was purified as shown in FIG. 190, lane 5.

Based on this analysis, it was predicted that these proteins and their epitopes could be useful antigens for vaccines or diagnostics.

Example 64

A DNA sequence (GBSx0063) was identified in *S. agalactiae* <SEQ ID 203> which encodes the amino acid sequence <SEQ ID 204>. This protein is predicted to be regulatory protein TypA (typA). Analysis of this protein sequence reveals the following:

```
Possible site: 36
>>> Seems to have no N-terminal signal sequence
----- Final Results -----
    bacterial cytoplasm --- Certainty = 0.1738 (Affirmative) <succ>
```

-continued

```
    bacterial membrane --- Certainty = 0.0000 (Not Clear) <succ>
        bacterial outside --- Certainty = 0.0000 (Not Clear) <succ>
```

The protein has homology with the following sequences in the GENPEPT database:

```
>GP:CAB13350 GB:Z99111 similar to GTP-binding elongation factor [Bacillus subtilis]
Identities = 455/609 (74%), Positives = 534/609 (86%), Gaps = 2/609 (0%)
Query: 4     LRTDIRNVAIIAHVDHGKTTLVDELLKQSHTLDERKELEERAMDSNDIEKERGITILAKN   63
             LR D+RN+AIIAHVDHGKTTLVD+LL Q+ T    +++ ERAMDSND+E+ERGITILAKN
Sbjct: 3     LRNDLRNIAIIAHVDHGKTTLVDQLLHQAGTFRANEQVAERAMDSNDLERERGITILAKN   62

Query: 64    TAVAYNDVRINIMDTPGHADFGGEVERIMKMVDGVVLVVDAYEGTMPQTRFVLKKALEQN  123
             TA+ Y D RINI+DTPGHADFGGEVERIMKMVDGVVLVVDAYEG MPQTRFVLKKALEQN
Sbjct: 63    TAINYKDTRINILDTPGHADFGGEVERIMKMVDGVVLVVDAYEGCMPQTRFVLKKALEQN  122

Query: 124   LIPIVVVNKIDKPSARPSEVVDEVLELFIELGADDDQLDFPVVYASAINGTSSMSDDPSD  183
             L P+VVVNKID+ ARP EV+DEVL+LFIEL A+++QL+FPVVYASAINGT+S+  DP
Sbjct: 123   LNPVVVVNKIDRDFARPEEVIDEVLDLFIELDANEEQLEFPVVYASAINGTASL--DPKQ  180

Query: 184   QEKTMAPIFDTIIDHIPAPVDNSEEPLQFQVSLLDYNDFVGRIGIGRVFRGTVKVGDQVT  243
             Q++ M  +++TII H+PAPVDN+EEPLQFQV+LLDYND+VGRIGIGRVFRGT+KVG QV+
Sbjct: 181   QDENMEALYETIIKHVPAPVDNAEEPLQFQVALLDYNDYVGRIGIGRVFRGTMKVGQQVS  240

Query: 244   LSKLDGTTKNFRVTKLFGFFGLERKEIQEAKAGDLIAVSGMEDIFVGETVTPTDAIEPLP  303
             L KLDGT K+FRVTK+FGF GL+R EI+EAKAGDL+AVSGMEDI VGETV P D  +PLP
Sbjct: 241   LMKLDGTAKSFRVTKIFGFQGLKRVEIEEAKAGDLVAVSGMEDINVGETVCPVDHQDPLP  300

Query: 304   VLRIDEPTLQMTFLVNNSPFAGREGKWITSRKVEERLLAELQTDVSLRVDPTDSPDKWTV  363
             VLRIDEPTLQMTF+VNNSPFAGREGK++T+RK+EERL ++LQTDVSLRV+PT SPD W V
Sbjct: 301   VLRIDEPTLQMTFVVNNSPFAGREGKYVTARKIEERLQSQLQTDVSLRVEPTASPDAWVV  360

Query: 364   SGRGELHLSILIETMRREGYELQVSRPEVIIKEIDGVQCEPFERVQIDTPEEYQGAIIQS  423
             SGRGELHLSILIE MRREGYELQVS+PEVIIKEIDGV+CEP ERVQID PEE+ G++++S
Sbjct: 361   SGRGELHLSILIENMRREGYELQVSKPEVIIKEIDGVRCEPVERVQIDVPEEHTGSVMES  420

Query: 424   LSERKGDMLDMQMVGNGQTRLIFLIPARGLIGYSTEFLSMTRGYGIMNHTFDQYLPVVQG  483
             +  RKG+M+DM   GNGQ RLIF +P+RGLIGYSTEFLS+TRG+GI+NHTFD Y P+  G
Sbjct: 421   MGARKGEMVDMINNGNGQVRLIFTVPSRGLIGYSTEFLSLTRGFGILNHTFDSYQPMQAG  480

Query: 484   EIGGRHRGALVSIENGKATTYSIMRIEERGTIFVNPGIEVYEGMIVGENERDNDLGVNIT  543
             ++GGR +G LVS+ENGKAT+Y I   IE+RG IFV PG EVYEGMIVGE++RDNDL VN++
Sbjct: 481   QVGGRRQGVLVSMENGKATSYGIQGIEDRGVIFVEPGTEVYEGMIVGEHNRDNDLVVNVS  540

Query: 544   TAKQMTNVRSATKDQTAVIKTPRILTLEESLEFLADDEYMEVTPESIRLRKQILNKAARD  603
              KQ TNVRSATKDQT  IK  RI++LEESLE+L +DEY EVTPESIRLRK+ILNK  R+
Sbjct: 541   KMKQQTNVRSATKDQTTTIKKARIMSLEESLEYLNEDEYCEVTPESIRLRKKILNKNERE  600

Query: 604   KANKKKKSA  612
             KA KKKK+A
Sbjct: 601   KAAKKKKTA  609
```

A related DNA sequence was identified in *S. pyogenes* <SEQ ID 205> which encodes the amino acid sequence <SEQ ID 206>. Analysis of this protein sequence reveals the following:

Possible site: 36
>>> Seems to have no N-terminal signal sequence

----- Final Results -----
bacterial cytoplasm --- Certainty = 0.1738 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below:

```
Identities = 594/613 (960), Positives = 607/613 (98%)
Query:    1MTNLRTDIRNVAIIAHVDHGKTTLVDELLKQSHTLDERKELEERAMDSNDIEKERGITIL  60
           MTNLR DIRNVAIIAHVDHGKTTLVDELLKQSHTLDERKEL+ERAMDSND+EKERGITIL
Sbjct:    1MTNLRNDIRNVAIIAHVDHGKTTLVDELLKQSHTLDERKELQERAMDSNDLEKERGITIL  60

Query:   61AKNTAVAYNDVRINIMDTPGHADFGGEVERIMKMVDGVVLVVDAYEGTMPQTRFVLKKAL 120
           AKNTAVAYNDVRINIMDTPGHADEGGEVERIMKMVDGVVLVVDAYEGTMPQTRFVLKKAL
Sbjct:   61AKNTAVAYNDVRINIMDTPGHADFGGEVERIMKMVDGVVLVVDAYEGTMPQTRFVLKKAL 120

Query:  121EQNLIPIVVVNKIDKPSARPSEVVDEVLELFIELGADDDQLDFPVVYASAINGTSSMSDD 180
           EQNLIPIVVVNKIDKPSARP+EVVDEVLELFIELGADD+QL+FPVVYASAINGTSS+SDD
Sbjct:  121EQNLIPIVVVNKIDKPSARPAEVVDEVLELFIELGADDEQLEFPVVYASAINGTSSLSDD 180

Query:  181PSDQEKTMAPIFDTIIDHIPAPVDNSEEPLQFQVSLLDYNDFVGRIGIGRVFRGTVKVGD 240
           P+DQE TMAPIFDTIIDHIPAPVDNS+EPLQFQVSLLDYNDFVGRIGIGRVFRGTVKVGD
Sbjct:  181PADQEHTMAPIFDTIIDHIPAPVDNSDEPLQFQVSLLDYNDFVGRIGIGRVERGTVKVGD 240

Query:  241QVTLSKLDGTTKNFRVTKLFGFFGLERKEIQEAKAGDLIAVSGMEDIFVGETVTPTDAIE 300
           QVTLSKLDGTTKNFRVTKLFGFFGLER+EIQEAKAGDLIAVSGMEDIFVGET+TPTD +E
Sbjct:  241QVTLSKLDGTTKNFRVTKLFGFFGLERREIQEAKAGDLIAVSGMEDIFVGETITPTDCVE 300
```

```
Query:  301 PLPVLRIDEPTLQMTFLVNNSPFAGREGKWITSRKVEERLLAELQTDVSLRVDPTDSPDK 360
            LP+LRIDEPTLQMTFLVNNSPFAGREGKWITSRKVEERLLAELQTDVSLRVDPTDSPDK
Sbjct:  301 ALPILRIDEPTLQMTFLVNNSPFAGREGKWITSRKVEERLLAELQTDVSLRVDPTDSPDK 360

Query:  361 WTVSGRGELHLSILIETMRREGYELQVSRPEVIIKEIDGVQCEPFERVQIDTPEEYQGAI 420
            WTVSGRGELHLSILIETMRREGYELQVSRPEVIIKEIDGV+CEPFERVQIDTPEEYQGAI
Sbjct:  361 WTVSGRGELHLSILIETMRREGYELQVSRPEVIIKEIDGVKCEPFERVQIDTPEEYQGAI 420

Query:  421 IQSLSERKGDMLDMQMVGNGQTRLIFLIPARGLIGYSTEFLSMTRGYGIMNHTFDQYLPV 480
            IQSLSERKGDMLDMQMVGNGQTRLIFLIPARGLIGYSTEFLSMTRGYGIMNHTFDQYLPV
Sbjct:  421 IQSLSERKGDMLDMQMVGNGQTRLIFLIPARGLIGYSTEFLSMTRGYGIMNHTFDQYLPV 480

Query:  481 VQGEIGGRHRGALVSIENGKATTYSIMRIEERGTIFVNPGIEVYEGMIVGENSRDNDLGV 540
            VQGEIGGRHRGALVSIENGKATTYSIMRIEERGTIFVNPG EVYEGMIVGENSRDNDLGV
Sbjct:  481 VQGEIGGRHRGALVSIENGKATTYSIMRIEERGTIFVNPGTEVYEGMIVGENSRDNDLGV 540

Query:  541 NITTAKQMTNVRSATKDQTAVIKTPRILTLEESLEFLADDEYMEVTPESIRLRKQILNKA 600
            NITTAKQMTNVRSATKDQTAVIKTPRILTLEESLEFL DDEYMEVTPESIRLRKQILNKA
Sbjct:  541 NITTAKQMTNVRSATKDQTAVIKTPRILTLEESLEFLNDDEYMEVTPESIRLRKQILNKA 600

Query:  601 ARDKANKKKKSAE 613
            ARDKANKKKKSAE
Sbjct:  601 ARDKANKKKKSAE 613
```

Based on this analysis, it was predicted that these proteins and their epitopes could be useful antigens for vaccines or diagnostics.

Example 65

A DNA sequence (GBSx0065) was identified in *S. agalactiae* <SEQ ID 207> which encodes the amino acid sequence <SEQ ID 208>. This protein is predicted to be D-glutamic acid adding enzyme MurD (murD). Analysis of this protein sequence reveals the following:

---

RGD motif 441-443
Possible site: 29
>>> Seems to have no N-terminal signal sequence

---

----- Final Results -----
bacterial membrane --- Certainty = 0.0000 (Not Clear) <succ>
bacterial outside --- Certainty = 0.0000 (Not Clear) <succ>
bacterial cytoplasm --- Certainty = 0.0000 (Not Clear) <succ>

---

A related GBS nucleic acid sequence <SEQ ID 9615> which encodes amino acid sequence <SEQ ID 9616> was also identified.

The protein has homology with the following sequences in the GENPEPT database:

```
>GP:AAC95449 GB:AF068902 D-glutamic acid enzyme MurD [Streptococcus pneumoniae]
Identities = 341/449 (75%), Positives = 394/449 (86%)
Query:    5 MKTITTFENKKVLVLGLARSGEAAARLLAKLGAIVTVNDGKPFDENPTAQSLLEEGIKVV   64
            MK I  F+NKKVLVLGLA+SGE+AARLL KLGAIVTVNDGKPF++NP AQ LLEEGIKV+
Sbjct:    1 MKVIDQFKNKKVLVLGLAKSGESAARLLDKLGAIVTVNDGKPFEDNPAAQCLLEEGIKVI   60

Query:   65 CGSHPLELLDEDFCYMIKNPGIPYNNPMVKKALEKQIPVLTEVELAYLVSESQLIGITGS  124
            G HPLELLDE+F M+KNPGIPY+NPM++KAL K IPVLTEVELAYL+SE+ +IGITGS
Sbjct:   61 TGGHPLELLDEEFALMVKNPGIPYSNPMIEKALAKGIPVLTEVELAYLISEAPIIGITGS  120

Query:  125 NGKTTTTTMIAEVLNAGGQRGLLAGNIGFPASEVVQAANDKDTLVMELSSFQLMGVKEFR  184
            NGKTTTTTMI EVL A GQ GLL+GNIG+PAS+V Q A DK+TLVMELSSFQLMGV+EF
Sbjct:  121 NGKTTTTTMIGEVLTAAGQHGLLSGNIGYPASQVAQIATDKNTLVMELSSFQLMGVQEFH  180

Query:  185 PHIAVITNLMPTHLDYHGSFEDYVAAKWNIQNQMSSSDFLVLNFNQGISKELAKTTKATI  244
            P IAVITNLMPTH+DYHG FE+YVAAKWNIQN+M+++DFLVLNFNQ + K+LA  T+AT+
Sbjct:  181 PEIAVITNLMPTHIDYHGLFEEYVAAKWNIQNKMTAADFLVLNFNQDLVKDLASKTEATV  240

Query:  245 VPFSTTEKVDGAYVQDKQLFYKGENIMSVDDIGVPGSHNVENALATIAVAKLAGISNQVI  304
            VPFST EKVDGAY++D QL+++GE +M+ ++IGVPGSHNVENALATIAVAKL G+ NQ I
Sbjct:  241 VPFSTLEKVDGAYLEDGQLYFRGEVVMAANEIGVPGSHNVENALATIAVAKLRGVDNQTI  300

Query:  305 RETLSNFGGVKHRLQSLGKVHGISFYNDSKSTNILATQKALSGFDNTKVILIAGGLDRGN  364
            +ETLS FGGVKHRLQ +  G+ FYNDSKSTNILATQKALSGFDN+KV+LIAGGLDRGN
Sbjct:  301 KETLSAFGGVKHRLQFVDDIKGVKFYNDSKSTNILATQKALSGFDNSKVVLIAGGLDRGN  360

Query:  365 EFDELIPDITGLKHMVVLGESASRVKRAAQKAGVTYSDALDVRDAVHKAYEVAQQGDVIL  424
            EFDEL+PDITGLK  MV+LG+SA RVKRAA KAGV Y +A D+ DA  KAYE+A QGDV+L
Sbjct:  361 EFDELVPDITGLKKMVILGQSAERVKRAADKAGVAYVEATDIADATRKAYELATQGDVVL  420

Query:  425 LSPANASWDMYKNFEVRGDEFIDTFESLR        453
            LSPANASWDMY NFEVRGD FIDT   L+
Sbjct:  421 LSPANASWDMNANFEVRGDLFIDTVAELK        449
```

A related DNA sequence was identified in *S. pyogenes* <SEQ ID 209> which encodes the amino acid sequence <SEQ ID 210>. Analysis of this protein sequence reveals the following:

Possible site: 25
>>> Seems to have a cleavable N-term signal seq.
----- Final Results -----
   bacterial outside --- Certainty = 0.3000 (Affirmative) <succ>
     bacterial membrane --- Certainty = 0.0000 (Not Clear) <succ>
     bacterial cytoplasm --- Certainty = 0.0000 (Not Clear) <succ>

RGD motif: 436-438

An alignment of the GAS and GBS proteins is shown below:

```
Identities = 329/451 (72%), Positives = 397/451 (87%)
Query:    5 MKTITTFENKKVLVLGLARSGEAAARLLAKLGAIVTVNDGKPFDENPTAQSLLEEGIKVV 64
            MK I+ F+NKK+L+LGLA+SGEAAA+LL KLGA+VTVND KPFD+NP AQ+LLEEGIKV+
Sbjct:    1 MKVISNFQNKKILILGLAKSGEAAAKLLTKLGALVTVNDSKPFDQNPAAQALLEEGIKVI 60

Query:   65 CGSHPLELLDEDFCYMIKNPGIPYNNPMVKKALEKQIPVLTEVELAYLVSESQLIGITGS 124
            CGSHP+ELLDE+F YM+KNPGIPY+NPMVK+AL K+IP+LTEVELAY VSE+ +IGITGS
Sbjct:   61 CGSHPVELLDENFEYMVKNPGIPYDNPMVKRALAKEIPILTEVELAYFVSEAPIIGITGS 120

Query:  125 NGKTTITTMIAEVLNAGGQRGLLAGNIGFPASEVVQAANDKDTLVMELSSFQLMGVKEFR 184
            NGKTTTTTMIA+VLNAGGQ  LL+GNIG+PAS+VVQ A   DTLVMELSSFQL+GV  FR
Sbjct:  121 NGKTTTTTMIADVLNAGGQSALLSGNIGYPASKVVQKAIAGDTLVMELSSFQLVGVNAFR 180

Query:  185 PHIAVITNLMPTHLDYHGSFEDYVAAKWNIQNQMSSSDFLVLNFNQGISKELAKTTKATI 244
            PHIAVITNLMPTHLDYHGSFEDYVAAKW IQ QM+ SD+L+LN NQ IS  LAKTTKAT+
Sbjct:  181 PHIAVITNLMPTHLDYHGSFEDYVAAKWMIQAQMTESDYLILNANQEISATLAKTTKATV 240

Query:  245 VPFSTTEKVDGAYVQDKQLFYKGENIMSVDDIGVPGSHNVENALATIAVAKLAGISNQVI 304
            +PFST + VDGAY++D  L++K + I++  D+GVPGSHN+ENALATIAVAKL+GI++ +I
Sbjct:  241 IPFSTQKVVDGAYLKDGILYFKEQAIIAATDLGVPGSHNIENALATIAVAKLSGIADDII 300

Query:  305 RETLSNFGGVKHRLQSLGKVHGISFYNDSKSTNILATQKALSGFDNTKVILIAGGLDRGN 364
            + LS+FGGVKHRLQ +G++  I+FYNDSKSTNILATQKALSGFDN+++ILIAGGLDRGN
Sbjct:  301 AQCLSHFGGVKHRLQRVGQIKDITFYNDSKSTNILATQKALSGFDNSRLILIAGGLDRGN 360

Query:  365 EFDELIPDITGLKHMVVLGESASRVKRAAQKAGVTYSDALDVRDAVHKAYEVAQQGDVIL 424
            EFD+L+PD+ GLK M++LGESA R+KRAA KA V+Y +A +V +A  A+++AQ GD IL
Sbjct:  361 EFDDLVPDLLGLKQMIILGESAERMKRAANKAEVSYLEARNVAEATELAFKLAQTGDTIL 420

Query:  425 LSPANASWDMYKNFEVRGDEFIDTFESLRGE                             455
            LSPANASWDMY NFEVRGDEF+ TF+ LRG+
Sbjct:  421 LSPANASWDMYPNFEVRGDEFLATFDCLRGD                             451
```

Figure 56:
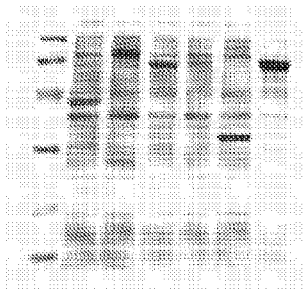

SEQ ID 208 (GBS305) was expressed in *E. coli* as a His-fusion product. SDS-PAGE analysis of total cell extract is shown in FIG. 51 (lane 11; MW 53.7 kDa). It was also expressed in *E. coli* as a GST-fusion product. SDS-PAGE analysis of total cell extract is shown in FIG. 56 (lane 3; MW 79 kDa).

Figure 270:
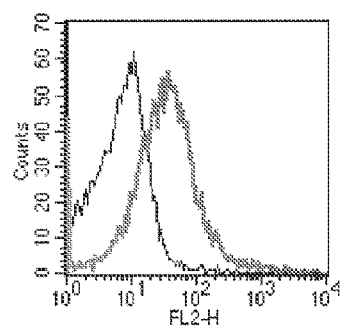

The GBS305-GST fusion product was purified (FIG. 207, lane 8) and used to immunise mice. The resulting antiserum was used for FACS (FIG. 270), which confirmed that the protein is immunoaccessible on GBS bacteria.

Based on this analysis, it was predicted that these proteins and their epitopes could be useful antigens for vaccines or diagnostics.

Example 66

A DNA sequence (GBSx0066) was identified in *S. agalactiae* <SEQ ID 211> which encodes the amino acid sequence <SEQ ID 212>. Analysis of this protein sequence reveals the following:

RGD motif 285-287
Possible site: 60
>>> Seems to have no N-terminal signal sequence
INTEGRAL    Likelihood = −1.65    Transmembrane 74-90 (73-93)
----- Final Results -----
   bacterial membrane --- Certainty = 0.1659 (Affirmative) <succ>
     bacterial outside --- Certainty = 0.0000 (Not Clear) <succ>
     bacterial cytoplasm --- Certainty = 0.0000 (Not Clear) <succ>

A related DNA sequence was identified in *S. pyogenes* <SEQ ID 213> which encodes the amino acid sequence <SEQ ID 214>. Analysis of this protein sequence reveals the following:

Possible site: 37
>>> Seems to have no N-terminal signal sequence
INTEGRAL    Likelihood = −1.33    Transmembrane 81-97 (80-100)
INTEGRAL    Likelihood = −0.16    Transmembrane 272-288 (271-288)
----- Final Results -----
   bacterial membrane --- Certainty = 0.1532 (Affirmative) <succ>
     bacterial outside --- Certainty = 0.0000 (Not Clear) <succ>
     bacterial cytoplasm --- Certainty = 0.0000 (Not Clear) <succ>

A related sequence was also identified in GAS <SEQ ID 9141> which encodes the amino acid sequence <SEQ ID 9142>. Analysis of this protein sequence reveals the following:

Possible site: 37
>>> Seems to have no N-terminal signal sequence
INTEGRAL    Likelihood = −1.33    Transmembrane 74-90
INTEGRAL    Likelihood = −0.16    Transmembrane 265-281
----- Final Results -----
   bacterial membrane --- Certainty = 0.1532 (Affirmative) <succ>

```
bacterial outside --- Certainty = 0.0000 (Not Clear) <succ>
    bacterial cytoplasm --- Certainty = 0.0000 (Not Clear) <succ>
RGD motif: 286-288
```

An alignment of the GAS and GBS proteins is shown below:

```
Identities = 249/358 (69%), Positives = 293/358 (81%), Gaps = 1/358 (0%)
Query:    1 MGKKIVFTGGGTVGHVTLNLILIPKFIKDGWEVHYIGDKNGIEHEQINQSGLDITFHSIA   60
            M KKI+FTGGGTVGHVTLNLILIPKFIKDGWEVHYIGDKNGIEH +I +SGLD+TFH+IA
Sbjct:    8 MPKKILFTGGGTVGHVTLNLILIPKFIKDGWEVHYIGDKNGIEHTEIEKSGLDVTFHAIA   67

Query:   61 TGKLRRYFSWQNMLDVFKVGVGVLQSIAIIAKLRPQALFSKGGFVSVPPVVAARLLKVPV  120
            TGKLRRYFSWQN+ DVFKV +G+LQS+ I+AKLRPQALFSKGGFVSVPPVVAA+LL  PV
Sbjct:   68 TGKLRRYFSWQNLADVFKVALGLLQSLFIVAKLRPQALFSKGGFVSVPPVVAAKLLGKPV  127

Query:  121 FVHESDLSMGLANKIAYKFATIMYTTFEQSKDLIKTKHIGAVTKVM-DCKKSFENTDLTS  179
            F+HESD SMGLANKIAYKFAT MYTTFEQ   L K KH+GAVTKV  D  + E+T L +
Sbjct:  128 FIHESDRSMGLANKIAYKFATTMYTTFEQEDQLSKVKHLGAVTKVFKDANQMPESTQLEA  187

Query:  180 IKEAFDPNLKTLLFIGGSAGAKVFNDFITQTPELEEKYNVINISGDSSLNRLKKNLYRVD  239
            +KE F  +LKTLLFIGGSAGA VFN FI+   PEL+++YN+INI+GD  LN L  +LYRVD
Sbjct:  188 VKEYFSRDLKTLLFIGGSAGAHVFNQFISDHPELKQRYNIINITGDPHLNELSSHLYRVD  247

Query:  240 YVTDLYQPLMNLADVVVTRGGSNTIFELVAMKKLHLIIPLGREASRGDQLENAAYFEEKG  299
            YVTDLYQPLM +AD+VVTRGGSNT+FEL+AM KLHLI+PLG+EASRGDQLENA YFE++G
Sbjct:  248 YVTDLYQPLMAMADLVVTRGGSNTLFELLAMAKLHLIVPLGKEASRGDQLENATYFEKRG  307

Query:  300 YALQLPESELNINTLEKQINLLISNSESYEKNMSQSSEIKSQDEFYQLLIDDMAKVTK   357
            YA QL E +L ++  ++ + L +   YE  M  + EI+S D FY LL D++   K
Sbjct:  308 YAKQLQEPDLTLHNFDQAMADLFEHQADYEATMLATKEIQSPDFFYDLLRADISSAIK   365
```

SEQ ID 212 (GBS306) was expressed in *E. coli* as a His-fusion product. SDS-PAGE analysis of total cell extract is shown in FIG. 51 (lane 12; MW 43 kDa). It was also expressed in *E. coli* as a GST-fusion product. SDS-PAGE analysis of total cell extract is shown in FIG. 56 (lane 4; MW 68 kDa).

Figure 207:
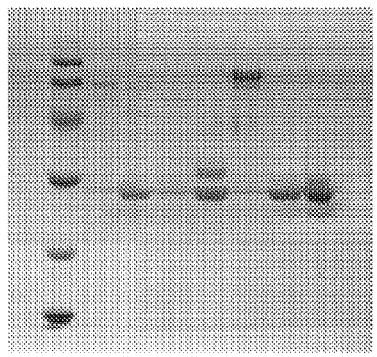

GBS306-GST was purified as shown in FIG. 207, lane 9.

Based on this analysis, it was predicted that these proteins and their epitopes could be useful antigens for vaccines or diagnostics.

Example 67

A DNA sequence (GBSx0067) was identified in *S. agalactiae* <SEQ ID 215> which encodes the amino acid sequence <SEQ ID 216>. This protein is predicted to be cell division protein DivIB. Analysis of this protein sequence reveals the following:

```
Possible site: 58
>>> Seems to have no N-terminal signal sequence
INTEGRAL    Likelihood = -14.33   Transmembrane 103-119 (96-124)
----- Final Results -----
    bacterial membrane --- Certainty = 0.6731 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database:

```
>GP:AAC95451 GB:AF068902 cell division protein DivIB [Streptococcus pneumoniae]
Identities = 119/396 (30%), Positives = 214/396 (53%), Gaps = 38/396 (9%)
Query:    3 KKKSDTPEKEEVV-LTEWQKRNLEFLKKRKEDEE---EQKRINEKLRLDKRS-----KLN   53
            KK  D     EE+ L+EWQKRN E+LKK+ E+E      E+K   + R+ + S     K +
Sbjct:    5 KKNEDKEILEELKELSEWQKRNQEYLKKKAEEEAALAEEKEKERQARMGEESEKSEDKQD   64

Query:   54 ISSPEEPQNTTKIKKLHFPKIS------------RPKIEKKQKKEKIVNSLAKTNR----   97
            S  + +++  K+    K++            P+ ++K++++K ++  A   +
Sbjct:   65 QESETDQEDSESAKEESEEKVASSEADKEKEEKEEPESKEKEEQDKKLSKKATKEKPAKA  124

Query:   98 -------IRTAPIFVVAFLVILVSVFLLTPFSKQKTITVSGNQHTPDDILIEKTNIQKND  150
                   +R  I  + L+++VS +LL+P++  K I V G    T D + + IQ +D
Sbjct:  125 KIPGIHILRAFTILFPSLLLLIVSAYLLSPYATMKDIRVEGTVQTTADDIRQASGIQDSD  184

Query:  151 YFFSLIFKHKAIEQRLAAEDVWVKTAQMTYQFPNKFHIQVQENKIIAYAHTKQGYQPVLE  210
            Y +L+   E+++ + + WV++AQ+ YQFP KF  I+V+E   I+AY  + + P+L
Sbjct:  185 YTINLLLDKAKYEKQIKS-NYWVESAQLVYQFPTKFTIKVKEYDIVAYYISGENHYPILS  243

Query:  211 TGK-KADPVNSSELPKHFLTINLDKEDSIKLLIKDLKALDPDLISEIQVISLADSKTTPD  269
            +G+ +   V+ + LP+ +L++  +    + IK+ ++L  + P+   + IQ + LA SK T D
Sbjct:  244 SGQLETSSVSLNSLPETYLSVLFNDSEQIKVFVSELAQISPELKAAIQKVELAPSKVTSD  303
```

```
                              -continued
Query:  270 LLLLDMHDGNSIRIPLSKFKERLPFYKQIKKNLKEPSIVDMEVGVYTTTNTIESTPVKAE  329
            L+ L M+D + + +PLS+  ++LP+Y +IK  L EPS+VDME G+Y+ T   +      E
Sbjct:  304 LIRLTMNDSDEVLVPLSEMSKKLPYYSKIKPQLSEPSVVDMEAGIYSYTVADKLIMEVEE  363

Query:  330 DTKNKSTDKTQTQNGQVAENSQGQTNNSNTNQQGQQ                          365
               K ++ + + Q    E  + Q   SN NQ  Q+
Sbjct:  364 KAKQEAKEAEKKQE----EEQKKQEEESNRNQTTQR                          395
```

A related DNA sequence was identified in *S. pyogenes* <SEQ ID 217> which encodes the amino acid sequence <SEQ ID 218>. Analysis of this protein sequence reveals the following:

---

Possible site: 59
>>> Seems to have no N-terminal signal sequence
INTEGRAL     Likelihood = −9.45    Transmembrane 106-122 (102-125)
----- Final Results -----
   bacterial membrane --- Certainty = 0.4779 (Affirmative) <succ>
   bacterial outside --- Certainty = 0.0000 (Not Clear) <succ>
   bacterial cytoplasm --- Certainty = 0.0000 (Not Clear) <succ>

---

An alignment of the GAS and GBS proteins is shown below:

```
Identities = 152/381 (39%), Positives = 232/381 (59%), Gaps = 14/381 (3%)
Query:    4 KKSDTPEKEEVVLTEWQKRNLEFLKKRKEDEEEQKRINEKLRLDKRSKLNISSPEEP---  60
            K    +    +++VLTEWQKRN+EFLKK+K+  EE+K++ EKL  DK+++     +  E
Sbjct:    3 KDKEKQSDDKLVLTEWQKRNIEFLKKKKQQAEEEKKLKEKLLSDKKAQQQAQNASEAVEL  62

Query:   61 --QNTTKIKKLHFPKISRPKIEKK--QKKEKIVNSLAKTNRIRTAPIFVVAFLVILVSVF  116
              T     +++     S+PK  KK  Q  KEK    +A        ++ P+ + A L++ VS+F
Sbjct:   63 KTDEKTDSQEIESETTSKPKKTKKVRQPKEKSATQIAFQ---KSLPVLLGALLLMAVSIF  119

Query:  117 LLTPFSKQKTITVSGNQHTPDDILIEKTNIQKNDYFFSLIFKHKAIEQRLAAEDVWVKTA  176
            ++TP+SK+K  +V GN  T   D LI+ + ++ +DY+ +L+       E+ +    WVK+
Sbjct:  120 MITPYSKKKEFSVRGNHQTNLDELIKASKVKASDYWLTLLTSPGQYERPILRTIPWVKSV  179

Query:  177 QMTYQFPNKFHIQVQENKIIAYAHTKQGYQPVLETGKKADPVNSSELPKHFLTINLDKED  236
            ++YQFPN F   V E +IIAYA  + G+QP+LE GK+ D V +SELPK FL  +NL E
Sbjct:  180 HLSYQFPNHFLFNVIEFEIIAYAQVENGFQPILENGKRVDKVRASELPKSFLILNLKDEK  239

Query:  237 SIKLLIKDLKALDPDLISEIQVISLADSKTTPDLLLLDMHDGNSIRIPLSKFKERLPFYK  296
            +I+ L+K L   L+   I+ +SLA+SKTT DLLL++MHDGN +R+P S+     +LP+Y+
Sbjct:  240 AIQQLVKQLTTLPKKLVKNIKSVSLANSKTTADLLLIEMHDGNVVRVPQSQLTLKLPYYQ  299

Query:  297 QIKKNLKEPSIVDMEVGVYTTTNTIESTPVKAEDTKNKSTDKTQTQNGQVAENSQGQTNN  356
            ++KKNL+  SIVDMEVG+YTTT  IE+ P    +  DK   + G+      Q QT+N
Sbjct:  300 KLKKNLENDSIVDMEVGIYTTTQEIENQPEVPLTPEQNAADKEGDKPGE----HQEQTDN  355

Query:  357 SNTNQQGQQIATEQAPNPQNV                                         377
                +   Q  +  P+P+ V
Sbjct:  356 DSETPANQSSPQQTPPSPETV                                         376
```

Figure 17:
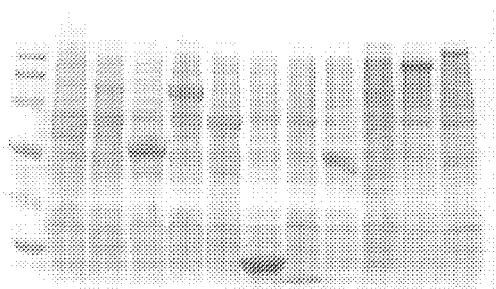

SEQ ID 216 (GBS85) was expressed in *E. coli* as a His-fusion product. SDS-PAGE analysis of total cell extract is shown in FIG. 17 (lane 10; MW 45.2 kDa).

The GBS85-His fusion product was purified (FIG. 105A; see also FIG. 193, lane 5) and used to immunise mice (lane 1 product; 20 µg/mouse). The resulting antiserum was used for Western blot (FIG. 105B), FACS (FIG. 105C), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 68

A DNA sequence (GBSx0068) was identified in *S. agalactiae* <SEQ ID 219> which encodes the amino acid sequence <SEQ ID 220>. This protein is predicted to be cell division protein FtsA (ftsA). Analysis of this protein sequence reveals the following:

---

Possible site: 56
>>> Seems to have an uncleavable N-term signal seq
INTEGRAL     Likelihood = −3.19    Transmembrane 322-338 (321-338)
----- Final Results -----
   bacterial membrane --- Certainty = 0.2275 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the GENPEPT database:

```
>GP:AAC95439 GB:AF068901 cell division protein FtsA [Streptococcus pneumoniae]
    Identities = 292/457 (63%), Positives = 366/457 (79%), Gaps = 1/457 (0%)
```

```
Query:    1 MARNGFFTGLDIGTSSIKVLVAEFIANEMNVIGVSNVPSSGVKDGIIIDIEAAATAIKEA     60
            MAR GFFTGLDIGTSS+KVLVAE   E+NVIGVSN S GVKDGII+DI+AAATAIK A
Sbjct:    1 MAREGFFTGLDIGTSSVKVLVAEQRNGELNVIGVSNAKSGVKDGIIVDIDAAATAIKSA     60

Query:   61 VKQAEEKAGITIDKINVGLPANLLQIEPTQGMIPVPNESKEIKDEDVESVVKSALTKSIT    120
            + QAEEKAG+I   +NVGLP NLLQ+EPTQGMIPV +++KEI D+DVE+VVKSALTKS+T
Sbjct:   61 ISQAEEKAGISIKSVNVGLPGNLLQVEPTQGMIPVTSDTKEITDQDVENVVKSALTKSMT    120

Query:  121 PEREVISLIPLEFIVDGFQGIRDPRGMMGIRLEMRGLIYTGPTTILHNLRKTVERAGIKV    180
            P+REVI+ IP EFIVDGFQGIRDPRGMMG+RLEMRGL+YTGP TILHNLRKTVERAG++V
Sbjct:  121 PDREVITFIPEEFIVDGFQGIRDPRGMMGVRLEMRGLLYTGPRTILHNLRKTVERAGVQV    180

Query:  181 EHVVIAPLALAKSVLNEGEREFGATVIDMGGGQTTVASMRNQELQYTNIYSEGSDYVTKD    240
            E+V+I+PLA+ +SVLNEGEREFGATVIDMG GQTTVA++RNQELQ+T+I  EG DYVTKD
Sbjct:  181 ENVIISPLAMVQSVLNEGEREFGATVIDMGAGQTTVATIRNQELQFTHILQEGGDYVTKD    240

Query:  241 ISKVLRTTVEIAEALKFNFGQANVEEASTSDTVQVNVVGNEEPVEITESYLSQIISGRIR    300
            ISKVL+T+ ++AE LK N+G+A     AS   +T QV V+G  E VE+TE+YLS+IIS RI+
Sbjct:  241 ISKVLKTSRKLAEGLKLNYGEAYPPLAS-KETFQVEVIGEVEAVEVTEAYLSEIISARIK    299

Query:  301 QILEHVKQDLGRGRLLDLPGGIILVGGGAIMPGVVEVAQQIFGTRVKLHVPNQVGIRNPM    360
             ILE +KQ+L R RLLDLPGGI+L+GG AI+PG+VE+AQ++FG RVKL+VPNQVGIRNP
Sbjct:  300 HILEQIKQELDRRRLLDLPGGIVLIGGNAILPGMVELAQEVFGVRVKLYVPNQVGIRNPA    359

Query:  361 FANVISIVDYVGMMSEVDIIAQHAVTGDEMLRHKPVDFDYKEKTNTMSTMPYSEPLTSSM    420
            FA+VIS+ ++ G ++EV+++AQ A+ G+  L H+P+ F      +              +
Sbjct:  360 FAHVISLSEFAGQLTEVNLLAQGAIKGENDLSHQPISFGGMLQKTAQFVQSTPVQPAPAP    419

Query:  421 EDSNLEPIRARENAQEPTEPKANIGERIRGIFGSMFD                         457
            E   + P     +Q+ ++ K   +R RG+ GSMFD
Sbjct:  420 EVEPVAPTEPMADFQQASQNKPKLADRFRGLIGSMFD                         456
```

A related DNA sequence was identified in *S. pyogenes* <SEQ ID 221> which encodes the amino acid sequence <SEQ ID 222>. Analysis of this protein sequence reveals the following:

Possible site: 55
>>> Seems to have no N-terminal signal sequence

INTEGRAL    Likelihood = −3.35    Transmembrane 313-329 (312-329)
----- Final Results -----
  bacterial membrane --- Certainty = 0.2338 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP:AAC95439 GB:AF068901 cell division protein FtsA [Streptococcus pneumoniae]
Identities = 299/448 (66%), Positives = 368/448 (81%), Gaps = 4/448 (0%)
Query:    1 LDIGTSSIKVLVAEFISGEMNVIGVSNVPSTGVKDGIIIDIEAAATAIKTAVEQAEEKAG     60
            LDIGTSS+KVLVAE  +GE+NVIGVSN S GVKDGII+DI+AAATAIK+A+ QAEEKAG
Sbjct:   10 LDIGISSVKVLVAEQRNGELNVIGVSNAKSGVKDGIIVDIDAAATAIKSAISQAEEKAG     69

Query:   61 MTIEKVNVGLPANLLQIEPTQGMIPVPSESKEIKDEDVDSVVKSALTKSITPEREVISLV    120
            ++I+ VNVGLP NLLQ+EPTQGMIPV S++KEI D+DV++VVKSALTKS+TP+REVI+ +
Sbjct:   70 ISIKSVNVGLPGNLLQVEPTQGMIPVTSDTKEITDQDVENVVKSALTKSMTPDREVITFI    129

Query:  121 PEEFIVDGFQGIRDPRGMMGIRLEMRGLIYTGPSTILHNLRKTVERAGIKVENIIISPLA    180
            PEEFIVDGFQGIRDPRGMMG+RLEMRGL+YTGP TILHNLRKTVERAG++VEN+IISPLA
Sbjct:  130 PEEFIVDGFQGIRDPRGMMGVRLEMRGLLYTGPRTILHNLRKTVERAGVQVENVIISPLA    189

Query:  181 MAKTILNEGEREFGATVIDMGGGQTTVASMRAQELQYTNIYAEGGEYITKDISKVLKTSL    240
            M +++LNEGEREFGATVIDMG GQTTVA++R QELQ+T+I   EGG+Y+TKDISKVLKTS
Sbjct:  190 MVQSVLNEGEREFGATVIDMGAGQTTVATIRNQELQFTHILQEGGDYVTKDISKVLKTSR    249

Query:  241 AIAEALKFNFGQAEISEASITETVKVDVVGSEEPVEVTERYLSEIISARIRHILDRVKQD    300
            +AE LK N+G+A   S  AS  ET +V+V+G  E  VEVTE YLSEIISARI+HIL+++KQ+
Sbjct:  250 KLAEGLKLNYGEAYPPLAS-KETFQVEVIGEVEAVEVTEAYLSEIISARIKHILEQIKQE    308

Query:  301 LERGRLLDLPGGIVLIGGGAIMPGVVEIAQEIFGVTVKLHVPNQVGIRNPMFSNVISLVE    360
            L+R RLLDLPGGIVLIGG AI+PG+VE+AQE+FGV VKL+VPNQVGIRNP F++VISL E
Sbjct:  309 LDRRRLLDLPGGIVLIGGNAILPGMVELAQEVFGVRVKLYVPNQVGIRNPAFAHVISLSE    368

Query:  361 YVGMMSEVDVLAQTAVSGEELLRRKPIDFSGQESYLPDYDDSRRPESTIGYEQQ---ASQ    417
            + G ++EV++LAQ A+ GE  L  +PI F G    + S  +           E +   ++
Sbjct:  369 FAGQLTEVNLLAQGAIKGENDLSHQPISFGGMLQKTAQFVQSTPVQPAPAPEVEPVAPTE    428

Query:  418 TAYDSQVPSDPKQKISERVRGIFGSMFD                                  445
               D Q  S    K K+++R RG+ GSMFD
Sbjct:  429 PMADFQQASQNKPKLADRFRGLIGSMFD                                  456
```

An alignment of the GAS and GBS proteins is shown below:

```
Identities = 349/456 (76%), Positives = 402/456 (87%), Gaps = 19/456 (4%)
Query:   10 LDIGTSSIKVLVAEFIANEMNVIGVSNVPSSGVKDGIIIDIEAAATAIKEAVKQAEEKAG  69
            LDIGTSSIKVLVAEFI+ EMNVIGVSNVPS+GVKDGIIIDIEAAATAIK AV+QAEEKAG
Sbjct:    1 LDIGTSSIKVLVAEFISGEMNVIGVSNVPSTGVKDGIIIDIEAAATAIKTAVEQAEEKAG  60

Query:   70 ITIDKINVGLPANLLQIEPTQGMIPVPNESKEIKDEDVESVVKSALTKSITPEREVISLI 129
            +TI+K+NVGLPANLLQIEPTQGMIPVP+ESKEIKDEDV+SVVKSALTKSITPEREVISL+
Sbjct:   61 MTIEKVNVGLPANLLQIEPTQGMIPVPSESKEIKDEDVDSVVKSALTKSITPEREVISLV 120

Query:  130 PLEFIVDGFQGIRDPRGMMGIRLEMRGLIYTGPTTILHNLRKTVERAGIKVEHVVIAPLA 189
            P EFIVDGFQGIRDPRGMMGIRLEMRGLIYTGP+TILHNLRKTVERAGIKVE+++I+PLA
Sbjct:  121 PEEFIVDGFQGIRDPRGMMGIRLEMRGLIYTGPSTILHNLRKTVERAGIKVENIIISPLA 180

Query:  190 LAKSVLNEGEREFGATVIDMGGGQTTVASMRNQELQYTNIYSEGSDYVTKDISKVLRTTV 249
            +AK++LNEGEREFGATVIDMGGGQTTVASMR QELQYTNIY+EG +Y+TKDISKVL+T++
Sbjct:  181 MAKTILNEGEREFGATVIDMGGGQTTVASMRAQELQYTNIYAEGGEYITKDISKVLKTSL 240

Query:  250 EIAEALKFNFGQANVEEASTSDTVQVNVVGNEEPVEITESYLSQIISGRIRQILEHVKQD 309
            IAEALKFNFGQA + EAS ++TV+V+VVG+EEPVE+TE YLS+IIS RIR IL+ VKQD
Sbjct:  241 AIAEALKFNEGQAEISEASITETVKVDVVGSEEPVEVTERYLSEIISARIRHILDRVKQD 300

Query:  310 LGRGRLLDLPGGIILVGGGAIMPGVVEVAQQIFGTRVKLHVPNQVGIRNPMFANVISIVD 369
            L RGRLLDLPGGI+L+GGGAIMPGVVE+AQ+IFG  VKLHVPNQVGIRNPMF+NVIS+V+
Sbjct:  301 LERGRLLDLPGGIVLIGGGAIMPGVVEIAQEIFGVTVKLHVPNQVGIRNPMFSNVISLVE 360

Query:  370 YVGMMSEVDIIAQHAVTGDEMLRHKPVDF--------DYKEKTNTMSTMPYSEPLTSSME 421
            YVGMMSEVD++AQ AV+G+E+LR KP+DF        DY +    ST+ Y +  + +
Sbjct:  361 YVGMMSEVDVLAQTAVSGEELLRRKPIDFSGQESYLPDYDDSRRPESTIGYEQQASQTAY 420

Query:  422 DSNLEPIRARENAQEPTEPKANIGERIRGIFGSMFD                         457
            DS            Q P++PK  I ER+RGIFGSMFD
Sbjct:  421 DS-----------QVPSDPKQKISERVRGIFGSMFD                         445
```

Figure 20:
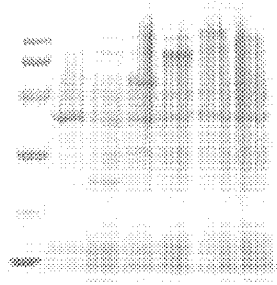

SEQ ID 220 (GBS73) was expressed in *E. coli* as a His-fusion product. SDS-PAGE analysis of total cell extract is shown in FIG. 17 (lane 5; MW 47.8 kDa). It was also expressed in *E. coli* as a GST-fusion product. SDS-PAGE analysis of total cell extract is shown in FIG. 20 (lane 5; MW 70.1 kDa).

Figure 197:
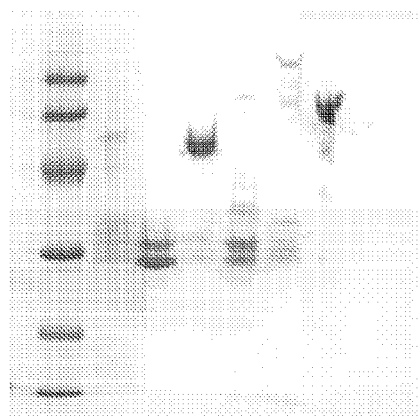

GBS73-GST was purified as shown in FIG. 197, lane 7.

The GBS73-His fusion product was purified (FIG. 103A) and used to immunise mice (lane 1 product; 20 μg/mouse). The resulting antiserum was used for Western blot (FIG. 103B), FACS (FIG. 103C) and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 69

A DNA sequence (GBSx0069) was identified in *S. agalactiae* <SEQ ID 223> which encodes the amino acid sequence <SEQ ID 224>. This protein is predicted to be cell division protein FtsZ (ftsz). Analysis of this protein sequence reveals the following:

Possible site: 56
>>> Seems to have a cleavable N-term signal seq.
INTEGRAL    Likelihood = –1.97    Transmembrane 117-133 (117-133)
----- Final Results -----
  bacterial membrane --- Certainty = 0.1786 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database:

```
>GP:AAC95440 GB:AF068901 cell division protein FtsZ [Streptococcus pneumoniae]
Identities = 327/426 (76%), Positives = 363/426 (84%), Gaps = 7/426 (1%)
Query:     1 MVFSFDTASVQGAVIKVIGVGGGGGNAINRMIDEGVAGVEFIAANTDIQALSSSKAETVI  60
             M FSFDTA+ QGAVIKVIGVGGGGGNAINRM+DEGV GVEFIAANTD+QALSS+KAETVI
Sbjct:     1 MTFSFDTAAAQGAVIKVIGVGGGGGNAINRMVDEGVTGVEFIAANTDVQALSSTKAETVI  60

Query:    61 QLGPKLTRGLGAGGQPEVGRKAAEESEEVLTEALTGADMVFITAGMGGGSGTGAAPVIAR 120
             QLGPKLTRGLGAGGQPEVGRKAAEESEE LTEA++GADMVFITAGMGGGSGTGAAPVIAR
Sbjct:    61 QLGPKLTRGLGAGGQPEVGRKAAEESEETLTEAISGADMVFITAGMGGGSGTGAAPVIAR 120

Query:   121 IAKSLGALTVAVITRPFGFEGNKRSNFAIEGIQELREQVDTLLIISNNNLLEIVDKKTPL 180
             IAK LGALTV V+TRPFGFEG+KR  FA+EGI +LRE VDTLLIISNNNLLEIVDKKTPL
Sbjct:   121 IAKDLGALTVGVVTRPFGFEGSKRGQFAVEGINQLREHVDTLLIISNNNLLEIVDKKTPL 180

Query:   181 LEALSEADNVLRQGVQGITDLITNPGLINLDFADVKTVMANKGNALMGIGIGSGEERITE 240
             LEALSEADNVLRQGVQGITDLITNPGLINLDFADVKTVMANKGNALMGIGIGSGEER+ E
Sbjct:   181 LEALSEADNVLRQGVQGITDLITNPGLINLDFADVKTVMANKGNALMGIGIGSGEERVVE 240

Query:   241 AARKAIYSPLLETTIDGAEDVIVNVTGGMDMTLTEAEEASEIVSQAAGKGVNIWLGTSID 300
             AARKAIYSPLLETTIDGAEDVIVNVTGG+D+TL EAEEAS+IV+QAAG+GVNIWLGTSID
```

-continued
```
Sbjct:  241 AARKAIYSPLLETTIDGAEDVIVNVTGGLDLTLIEAEEASQIVNQAAGQGVNIWLGTSID  300

Query:  301 MDMKDEIRVTVVATGVRKDKTNQVSGFTTSAPTNQAPSERQSTSNSNFDRRGNFDMTESR  360
            M+DEIRVTVVATGVR+D+ +V    + TN   + + + S+  FDR   +FDM E+
Sbjct:  301 ESMRDEIRVTVVATGVRQDRVEKVVAPQARSATNYRETVKPAHSH-GFDR--HFDMAETA  357

Query:  361 EMPTQQNQPHAQNQQQSSAFGNWDLRRDNISRPTEGELDSKLSMSTFSENDDMDDELETP  420
            E+P Q   P        Q+SAFG+WDLRR++I R T+  +             D  +DEL+TP
Sbjct:  358 ELPKQ--NPRRLEPTQASAFGDWDLRRESIVRTTDSVVSPVERFEAPISQD--EDELDTP  413

Query:  421 PFFKNR                                                      426
            PFFKNR
Sbjct:  414 PFFKNR                                                      419
```

A related DNA sequence was identified in *S. pyogenes* <SEQ ID 225> which encodes the amino acid sequence <SEQ ID 226>. Analysis of this protein sequence reveals the following:

---

Possible site: 56
>>> Seems to have a cleavable N-term signal seq.
INTEGRAL    Likelihood = −1.81    Transmembrane 117-133 (117-133)
----- Final Results -----
  bacterial membrane --- Certainty = 0.1723 (Affirmative) <succ>
    bacterial outside --- Certainty = 0.0000 (Not Clear) <succ>
      bacterial cytoplasm --- Certainty = 0.0000 (Not Clear) <succ>

---

An alignment of the GAS and GBS proteins is shown below:

```
Identities = 372/439 (84%), Positives = 391/439 (88%), Gaps = 13/439 (2%)
Query:   1 MVFSFDTASVQGAVIKVIGVGGGGGNAINRMIDEGVAGVEFIAANTDIQALSSSKAETVI  60
           M FSFDTAS+QGA+IKVIGVGGGGGNAINRMIDEGVAGVEFIAANTDIQALSSSKAETVI
Sbjct:   1 MAFSPDTASIQGAIIKVIGVGGGGGNAINRMIDEGVAGVEFIAANTDIQALSSSKAETVI  60

Query:  61 QLGPKLTRGLGAGGGQPEVGRKAAEESEEVLTEALTGADMVFITAGMGGGSGTGAAPVIAR 120
           QLGPKLTRGLGAGGGQPEVGRKAAEESEE+LTEALTGADMVFITAGMGGGSGTGAAPVIAR
Sbjct:  61 QLGPKLTRGLGAGGGQPEVGRKAAEESEEILTEALTGADMVFITAGMGGGSGTGAAPVIAR 120

Query: 121 IAKSLGALTVAVITRPFGFEGNKRSNFAIEGIQELREQVDTLLIISNNNLLEIVDKKTPL 180
           IAKSLGALTVAV+TRPFGFEGNKR NFAIEGI+ELREQVDTLLIISNNNLLEIVDKKTPL
Sbjct: 121 IAKSLGALTVAVVTRPFGFEGNKRGNFAIEGIEELREQVDTLLIISNNNLLEIVDKKTPL 180

Query: 181 LEALSEADNVLRQGVQGITDLITNPGLINLDFADVKTVMANKGNALMGIGIGSGEERITE 240
           LEALSEADNVLRQGVQGITDLIT+PGLINLDFADVKTVMANKGNALMGIGIGSGEERI E
Sbjct: 181 LEALSEADNVLRQGVQGITDLITSPGLINLDFADVKTVMANKGNALMGIGIGSGEERIVE 240

Query: 241 AARKAIYSPLLETTIDGAEDVIVNVTGGMDMTLTEAEEASEIVSQAAGKGVNIWLGTSID 300
           AARKAIYSPLLETTIDGA+DVIVNVTGG+DMTLTEAFEASEIV QAAG+GVNIWLGTSID
Sbjct: 241 AARKAIYSPLLETTIDGAQDVIVNVTGGLDMTLTEAEEASEIVGQAAGQGVNIWLGTSID 300

Query: 301 MDMKDEIRVTVVATGVRKDKTNQVSGF---TTSAPTN--------QAPSERQSTSNSNFD 349
           MKD+IRVTVVATGVR++K  QVSGF    T    TN        A  +  +     FD
Sbjct: 301 DTMKDDIRVTVVATGVRQEKAEQVSGFRQPRTFTQTNAQQVAGAQYASDQAKQSVQPGFD 360

Query: 350 RRGN--FDMTESREMPTQQNQPHAQNQQQSSAFGNWDLRRDNISRPTEGELDSKLSMSTF 407
           RR N  FDM ESRE+P+ Q       NQ Q SAFGNWDLRRDNISRPTEGELD+ L+MSTF
Sbjct: 361 RRSNFDFDMGESREIPSAQKVISNHNQNQGSAFGNWDLRRDNISRPTEGELDNHLNMSTF 420

Query: 408 SENDDMDDELETPPFFKNR                                         426
           S NDD DDELETPPFFKNR
Sbjct: 421 SENDDMDDELETPPFFKNR                                         439
```

Figure 28:
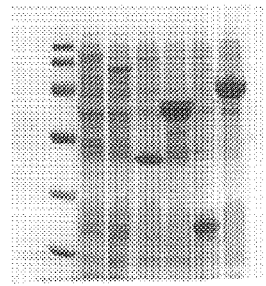
Figure 34:
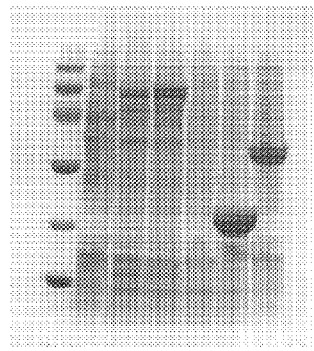

SEQ ID 224 (GBS163) was expressed in *E. coli* as a His-fusion product. SDS-PAGE analysis of total cell extract is shown in FIG. 28 (lane 7; MW 44 kDa). It was also expressed in *E. coli* as a GST-fusion product. SDS-PAGE analysis of total cell extract is shown in FIG. 34 (lane 4; MW 69 kDa).

The GBS163-GST fusion product was purified (FIG. 114A; see also FIG. 198, lane 11) and used to immunise mice (lane 1 product; 20 μg/mouse). The resulting antiserum was used for Western blot (FIG. 114B), FACS and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 70

A DNA sequence (GBSx0070) was identified in *S. agalactiae* <SEQ ID 227> which encodes the amino acid sequence <SEQ ID 228>. Analysis of this protein sequence reveals the following:

---

Possible site: 21
>>> Seems to have no N-terminal signal sequence
----- Final Results -----
  bacterial cytoplasm --- Certainty = 0.2750 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database:

```
>GP:AAC95441 GB:AF068901 YlmE [Streptococcus pneumoniae]
Identities = 140/223 (62%), Positives = 177/223 (78%)
Query:    2 MNLQENKTAIFDNVSKLALKAGRAHESVHIVAVTKYVNCQTTEALIRTGVNHIGENRVDK 61
            MN++EN    +F  V++ +L A R   SV ++AVTKYV+   T EAL+  GV+HIGENRVDK
Sbjct:    1 MNVKENTELVFREVAEASLSAHRESGSVSVIAVTKYVDVPTAEALLPLGVHHIGENRVDK 60

Query:   62 FLEKYQALKDEKLTWHLIGSLQRRKVKDVINYVDYFHALDSVKLAAEIQKHAQKLIKCFL 121
            FLEKY+ALKD  +TWHLIG+LQRRKVKDVI YVDYFHALDSVKLA EIQK + ++IKCFL
Sbjct:   61 FLEKYEALKDRDVTWHLIGTLQRRKVKDVIQYVDYFHALDSVKLAGEIQKRSDRVIKCFL 120

Query:  122 QVNISREDSKHGFTIEQIDDALNLISRYDKIELIGIMTMAPLKATKEEISSIFEETESLR 181
            QVNIS+E+SKHGF+ E++ + L  ++R DKIE +G+MTMAP +A+ E++  IF+  + L+
Sbjct:  121 QVNISKEESKHGFSREELLEILPELARLDKIEYVGLMTMAPFEASSEQLKEIFKAAQDLQ 180

Query:  182 KRLQARNIERMPFTELSMGMSRDYDIAIQNGSTFVRIGTSFFK               224
            + +Q + I  MP TELSMGMSRDY  AIQ GSTFVRIGTSFFK
Sbjct:  181 REIQEKQIPNMPMTELSMGMSRDYKEAIQFGSTFVRIGTSFFK               223
```

A related DNA sequence was identified in *S. pyogenes* <SEQ ID 229> which encodes the amino acid sequence <SEQ ID 230>. Analysis of this protein sequence reveals the following:

Possible site: 20
>>> Seems to have no N-terminal signal sequence
----- Final Results -----
   bacterial cytoplasm --- Certainty = 0.2451 (Affirmative) <succ>
    bacterial membrane --- Certainty = 0.0000 (Not Clear) <succ>
     bacterial outside --- Certainty = 0.0000 (Not Clear) <succ>

An alignment of the GAS and GBS proteins is shown below:

```
Identities = 133/222 (59%), Positives = 164/222 (72%)
Query:    2 MNLQENKTAIFDNVSKLALKAGRAHESVHIVAVTKYVNCQTTEALIRTGVNHIGENRVDK 61
            M+L  NK  IF+ +      A R ++SV ++AVTKYV+     LI  G+ HI ENRVDK
Sbjct:    1 MDLLTNKKKIFETIRLSTEAANRTNDSVSVIAVTKYVDSTIAGQLIEAGIEHIAENRVDK 60

Query:   62 FLEKYQALKDEKLTWHLIGSLQRRKVKDVINYVDYFHALDSVKLAAEIQKHAQKLIKCFL 121
            FLEKY ALK   + WHLIG+LQRRKVK+VINYVDYFHALDSV+LA EI K A   +KCFL
Sbjct:   61 FLEKYDALKYMPVKWHLIGTLQRRKVKEVINYVDYFHALDSVRLALEINKRADHPVKCFL 120

Query:  122 QVNISREDSKHGFTIEQIDDALNLISRYDKIELIGIMTMAPLKATKEEISSIFEETESLR 181
            QVNIS+E+SKHGF I +ID+A+  I + +KI+L+G+MTMAP  A+KE I +IF +   LR
Sbjct:  121 QVNISKEESKHGFNISEIDEAIGEIGKMEKIQLVGLMTMAPANASKESIITIFRQANQLR 180

Query:  182 KRLQARNIERMPFTELSMGMSRDYDIAIQNGSTFVRIGTSFF                223
            K LQ +  +  MPFTELSMGMS DY IAIQ GSTF+RIG +FF
Sbjct:  181 KNLQLKKRKNMPFTELSMGMSNDYPIAIQEGSTFIRIGRAFF                222
```

Based on this analysis, it was predicted that these proteins and their epitopes could be useful antigens for vaccines or diagnostics.

Example 71

A DNA sequence (GBSx0071) was identified in *S. agalactiae* <SEQ ID 231> which encodes the amino acid sequence <SEQ ID 232>. This protein is predicted to be YlmF. Analysis of this protein sequence reveals the following:

Possible site: 58
>>> Seems to have no N-terminal signal sequence
----- Final Results -----
   bacterial cytoplasm --- Certainty = 0.2194 (Affirmative) <succ>
    bacterial membrane --- Certainty = 0.0000 (Not Clear) <succ>
     bacterial outside --- Certainty = 0.0000 (Not Clear) <succ>

A related GBS nucleic acid sequence <SEQ ID 9617> which encodes amino acid sequence <SEQ ID 9618> was also identified.

The protein has homology with the following sequences in the GENPEPT database:

```
>GP:AAC95442 GB:AF068901 YlmF [Streptococcus pneumoniae]
Identities = 86/200 (43%), Positives = 120/200 (60%), Gaps = 25/200 (12%)
Query:    5 MALKDRFDKIISYFDTDDVSENEVHEVQERTSVQRDSRAATAQEASQRSHMTNSAEEEMI 64
            M+LKDRFD+ I YF T+D  + +E    +RD  T+ +SQ  +  +  +
Sbjct:    1 MSLKDRFDRFIDYF-TEDEDSSLPYE-------KRDEPVFTSVNSSQEPALPMNQPSQSA 52

Query:   65 GSRPRTYTYDPNRQERQRVQRDNAYQQATPRVQNKDSVRQQREQVTIALKYPRKYEDAQE 124
            G++  T        RQ+    + N  Q+AT              ++V I ++YPRKYEDA E
Sbjct:   53 GTKENNITRLHARQQ----ELANQSQRAT-------------DKVIIDVRYPRKYEDATE 95
```

```
                                   -continued
Query: 125 IVDLLIVNECVLIDFQYMLDAQARRCLDYIDGASRVLYGSLQKVGSSMFLLTPANVMVDI 184
           IVDLL  NE +LIDFQYM +  QARRCLDY+DGA   VL G+L+KV S+M+LLTP NV+V++
Sbjct:  96 IVDLLAGNESILIDFQYMTEVQARRCLDYLDGACHVLAGNLKKVASTMYLLTPVNVIVNV 155

Query: 185 EEMNIPKTGQETSFDFDMKR                                         204
           E++  +P   Q+  F FDMKR
Sbjct: 156 EDIRLPDEDQQGEFGFDMKR                                         175
```

A related DNA sequence was identified in *S. pyogenes* <SEQ ID 233> which encodes the amino acid sequence <SEQ ID 234>. Analysis of this protein sequence reveals the following:

---

Possible site: 49
>>> Seems to have no N-terminal signal sequence
INTEGRAL      Likelihood = −0.64    Transmembrane 142-158 (142-158)
----- Final Results -----
  bacterial membrane --- Certainty = 0.1256 (Affirmative) <succ>
     bacterial outside --- Certainty = 0.0000 (Not Clear) <succ>
       bacterial cytoplasm --- Certainty = 0.0000 (Not Clear) <succ>

---

The protein has homology with the following sequences in the databases:

```
>GP:AAC95442 GB:AF068901 YlmF [Streptococcus pneumoniae]
Identities = 82/219 (37%), Positives = 113/219 (51%), Gaps = 46/219 (21%)
Query:   5 MAFKDTFNKMISYFDTDEVNEVEEDVAASTDNVIP--RSQQSVRASSHPKQEPRNNHVQQ 62
           M+ KD F++ I YF  DE             D+ +P  + V S  + QEP       Q
Sbjct:   1 MSLKDRFDRFIDYFTEDE-----------DSSLPYEKRDEPVFTSVNSSQEPALPMNQP 48

Query:  63 DHQARSQEQTRSQMHPKHGTSERYYQQSQPKEGHEMVDRRKRMSTSSIANRREQYQQSTC 122
           A ++E    +++H +                                    +AN    Q
Sbjct:  49 SQSAGTKENNITRLHARQ-------------------------QELAN-----QSQRA 76

Query: 123 SDQTTIALKYPRKYEDAQEIVDLLIVNECVLIDFQFMLDAQARRCLDFIDGASKVLYGSL 182
           +D+  I  ++YPRKYEDA EIVDLL  NE +LIDFQ+M +  QARRCLD++DGA   VL G+L
Sbjct:  77 TDKVIIDVRYPRKYEDATEIVDLLAGNESILIDFQYMTEVQARRCLDYLDGACHVLAGNL 136

Query: 183 QKVGSSMYLLAPSNVSVNIEEMTIPHTTQDIGFDFDMKR                      221
           +KV S+MYLL P NV VN+E++ +P    Q    F FDMKR
Sbjct: 137 KKVASTMYLLTPVNVIVNVEDIRLPDEDQQGEFGFDMKR                      175
```

An alignment of the GAS and GBS proteins is shown below:

```
Identities = 118/222 (53%), Positives = 145/222(65%), Gaps = 17/222 (7%)
Query:   1 MEGNMALKDRFDKIISYFDTDDVSENEVHEVQERTSV----QRDSRAATAQEAS------  50
           ME  MA KD F+K+ISYFDTD+V+E E       +V    Q+   RA++  +
Sbjct:   1 MENKMAFKDTENKMISYFDTDEVNEVEEDVAASTDNVIPRSQQSVRASSHPKQEPRNNHV  60

Query:  51 QRSHMTNSAEEEMIGSRPRTYTYDPNRQERQRVQR----DNAYQQATPRVQNKDSVRQQR 106
           Q+ H   S E+       P+  T +   Q+ Q +      D   + +T  + N+    QQ
Sbjct:  61 QQDHQARSQEQTRSQMHPKHGTSERYYQQSQPKEGHEMVDRRKRMSTSSIANRREQYQQS 120

Query: 107 ---EQVTIALKYPRKYEDAQEIVDLLIVNECVLIDFQYMLDAQARRCLDYIDGASRVLYG 163
              +Q TIALKYPRKYEDAQEIVDLLIVNECVLIDFQ+MLDAQARRCLD+IDGAS+VLYG
Sbjct: 121 TCSDQTTIALKYPRKYEDAQEIVDLLIVNECVLIDFQFMLDAQARRCLDFIDGASKVLYG 180

Query: 164 SLQKVGSSMFLLTPANVMVDIEEMNIPKTGQETSFDFDMKRR                   205
           SLQKVGSSM+LL P+NV V+IEEM IP T Q+   FDFDMKRR
Sbjct: 181 SLQKVGSSMYLLAPSNVSVNIEEMTIPHTTQDIGFDFDMKRR                   222
```

Based on this analysis, it was predicted that these proteins and their epitopes could be useful antigens for vaccines or diagnostics.

Example 72

A DNA sequence (GBSx0072) was identified in *S. agalactiae* <SEQ ID 235> which encodes the amino acid sequence <SEQ ID 236>. This protein is predicted to be YlmH. Analysis of this protein sequence reveals the following:

---

Possible site: 35
>>> Seems to have no N-terminal signal sequence
----- Final Results ----- bacterial cytoplasm --- Certainty = 0.3956 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database:

```
>GP: AAC95444 GB: AF068901 YlmH [Streptococcus pneumoniae]
Identities = 101/255 (39%), Positives = 161/255 (62%)
Query:   6 IYQHFRPEEYAFIHKIDHLAQYVENTYSFITTEFLNPREFKILESVLERRGSHYYTSGQY        65
           IYQHF  E+  F+ K    + VE++Y+    T F+NP + K+L+ + +   G    +SG++
Sbjct:   5 IYQHFSIEDRPFLDKGMEWIKKVEDSYAPFLTPFINPHQEKLLKILAKTYGLACSSSGEF        64

Query:  66 FQTEYVKVIIAPEYYQLDMADFNLSLIEIKYNAKFNHLTHAKIMGTLLNYLGVKRSILGD       125
           +EYV+V++ P+Y+Q + +DF +SL EI Y+ KF HLTHAKI+GT++N LG++R + GD
Sbjct:  65 VSSEYVRVLLYPDYFQPEFSDFEISLQEIVYSNKFEHLTHAKILGTVINQLGIERKLFGD       124

Query: 126 ILVEEGCAQVLVDSQMTNHLVHSVTKIGTASVQLAEVPLSKLLTPKQDIQKLTVIASSLR       185
           ILV+E  AQ++++ Q         + KIG    V L E P ++ +    + ++L +  SS R
Sbjct: 125 ILVDEERAQIMINQQFLLLFQDGLKKIGRIPVSLEERPFTEKIDKLEQYRELDLSVSSFR       184

Query: 186 LDKILATILKISRTQSTKLIEADKVKVNYATVNRVSEQLVEGDLISVRGYGRFTLNHNLG       245
           LD +L+ +LK+SR Q+ +LIE    V+VNY   V++      +   GDLISVR +GR  L  + G
Sbjct: 185 LDVLLSNVLKLSRNQANQLIEKKLVQVNYHVVDKSDYTVQVGDLISVRKFGRLRLLQDKG       244

Query: 246 LTKNQKYKLEVDKMI                                                 260
           TK +K  K+  V ++
Sbjct: 245 QTKKEKKKITVQLLL                                                 259
```

A related DNA sequence was identified in *S. pyogenes* <SEQ ID 237> which encodes the amino acid sequence <SEQ ID 238>. Analysis of this protein sequence reveals the following:

Possible site: 56
>>> Seems to have no N-terminal signal sequence

INTEGRAL    Likelihood = −0.69    Transmembrane 46-62 (46-62)
----- Final Results -----
bacterial membrane --- Certainty = 0.1277 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the databases:

```
>GP: AAC95444 GB: AF068901 YlmH [Streptococcus pneumoniae]
Identities = 110/257 (42%), Positives = 161/257 (61%)
Query:    7 IYQHFHQEEYPFIDRMSDMINRVEDYYLLEVTEFLNPREVMILKSLIALTDLKMFVSTDY       66
            IYQHF  E+ PF+D+  + I +VED Y   +T F+NP +  +LK L    L     S ++
Sbjct:    5 IYQHFSIEDRPFLDKGMEWIKKVEDSYAPFLTPFINPHQEKLLKILAKTYGLACSSSGEF       64

Query:   67 YPSEYGRVIIAPGYYDLEQSDFQIALVEISYQAKFNQLTHSQILGTLINELGVKRNLFGD      126
               SEY RV++ P Y+  E  SDF+I+L EI Y   KF   LTH++ILGT+IN+LG++R  LFGD
Sbjct:   65 VSSEYVRVLLYPDYFQPEFSDFEISLQEIVYSNKFEHLTHAKILGTVINQLGIERKLFGD      124

Query:  127 VFVEMGYAQLMIKRELLDYFLGTITKIAKTSVKLREVNFDQLIRSIDNSQTLDILVSSFR      186
               + V+   AQ+MI ++ L  F   + KI +    V L E   F + I  ++   + LD+ VSSFR
Sbjct:  125 ILVDEERAQIMINQQFLLLFQDGLKKIGRIPVSLEERPFTEKIDKLEQYRELDLSVSSFR      184

Query:  187 LDGVVATILKKSRTQVIALIEANKIKVNYRVANKASDNLVIGDMVSIRGHGRFTLLADNG      246
               LD +++ +LK SR Q    LIE   ++VNY V +K+    + +GD++S+R  GR  LL D G
Sbjct:  185 LDVLLSNVLKLSRNQANQLIEKKLVQVNYHVVDKSDYTVQVGDLISVRKFGRLRLLQDKG      244

Query:  247 VTKHGKQKITLSKMIHK                                               263
```

```
                TK  K+KIT+   ++ K

Sbjct: 245 QTKKEKKKITVQLLLSK                                        261
```

An alignment of the GAS and GBS proteins is shown below:

```
Identities = 123/256 (48%), Positives = 177/256 (69%)
Query:   6 IYQHFRPEEYAFIHKIDHLAQYVENTYSFITTEFLNPREFKILESVLERRGSHYYTSGQY   65
           IYQHF  EEY FI ++  +   VE+ Y   TEFLNPRE  IL+S++     + S  Y
Sbjct:   7 IYQHFHQEEYPFIDRMSDMINRVEDYYLLEVTEFLNPREVMILKSLIALTDLKMFVSTDY   66

Query:  66 FQTEYVKVIIAPEYYQLDMADFNLSLIEIKYNAKENHLTHAKIMGTLLNYLGVKRSILGD  125
           + +EY +VIIAP YY L+ +DF ++L+EI Y AKFN LTH++I+GTL+N LGVKR++ GD
Sbjct:  67 YPSEYGRVIIAPGYYDLEQSDFQIALVEISYQAKFNQLTHSQILGTLINELGVKRNLFGD  126

Query: 126 ILVEEGCAQVLVDSQMTNHLVHSVTKIGTASVQLAEVPLSKLLTPKQDIQKLTVIASSLR  185
           + VE G AQ+++  ++ ++ + ++TKI    SV+L EV    +L+    + Q L ++ SS R
Sbjct: 127 VFVEMGYAQLMIKRELLDYFLGTITKIAKTSVKLREVNFDQLIRSIDNSQTLDILVSSFR  186

Query: 186 LDKILATILKISRTQSTKLIEADKVKVNYATVNRVSEQLVEGDLISVRGYGRFTLNHNLG  245
           LD ++ATILK SRTQ   LIEA+K+KVNY   N+ S+ LV GD++S+RG+GRFTL  + G
Sbjct: 187 LDGVVATILKKSRTQVIALIEANKIKVNYRVANKASDNLVIGDMVSIRGHGRFTLLADNG  246

Query: 246 LTKNQKYKLEVDKMIH                                             261
           +TK+ K  K+ +  KMIH
Sbjct: 247 VTKHGKQKITLSKMIH                                             262
```

Based on this analysis, it was predicted that these proteins and their epitopes could be useful antigens for vaccines or diagnostics.

Example 73

A DNA sequence (GBSx0073) was identified in *S. agalactiae* <SEQ ID 239> which encodes the amino acid sequence <SEQ ID 240>. This protein is predicted to be cell division protein DivIVA (septumplacement). Analysis of this protein sequence reveals the following:

Possible site: 14
>>> Seems to have no N-terminal signal sequence
----- Final Results -----
    bacterial cytoplasm --- Certainty = 0.5418 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database:

```
>GP: AAC95445 GB: AF068901 cell division protein DivIVA
[Streptococcus pneumoniae]
Identities = 132/227 (58%), Positives = 179/227 (78%), Gaps = 2/227 (0%)
Query:   1 MPLTALEIKDKTFSSKFRGYSEEEVNEFLEIVVDDYEDLIRRNREQEQYIKDLEEKIAYF   60
           MP+T+LEIKDKTF ++FRG+  EEV+EFL+IVV DYEDL+R N ++   IK LEE+++YF
Sbjct:   1 MPITSLEIKDKTFGTRFRGFDPEEVDEFLDIVVRDYEDLVRANHDKNLRIKSLEERLSYF   60

Query:  61 NEMKESLSQSVILAQETAERVKISAQDEASNLMGKATFDAQHLIDEAKLKANQILRDATD  120
           +E+K+SLSQSV++AQ+TAERVK +A + ++N++ +A  DAQ L++EAK KAN+ILR ATD
```

-continued

```
Sbjct:   61 DEIKDSLSQSVLIAQDTAERVKQAAHERSNNIIHQAEQDAQRLLEEAKYKANEILRQATD       120

Query:  121 DAKRVAIETEDLKRQSRVFHQRLLSELEGQLKLANSSAWEELLKPTAIYLQNSDASFKEV       180
            +AK+VA+ETE+LK +SRVFHQRL S +E QL +  SS WE++L+PTA YLQ SD +FKEV Sbjct:  121 NAKKVAVETEELKNKSRVFHQRLKSTIESQLAIVESSDWEDILRPTATYLQTSDEAFKEV       180

Query:  181 VEKVLDEDDALPVVDDTESFDATRQFSPDEMEELQRRVEESNKQLEE                   227
            V +VL E    P+  + E  D TRQFS   EM ELQ R+E ++K+L E Sbjct:  181 VSEVLGEPIPAPI--EEEPIDMTRQFSQAEMAELQARIEVADKELSE                   225
```

A related DNA sequence was identified in *S. pyogenes* <SEQ ID 241> which encodes the amino acid sequence <SEQ ID 242>. Analysis of this protein sequence reveals the following:

Possible site: 14
>>> Seems to have no N-terminal signal sequence
----- Final Results -----
   bacterial cytoplasm --- Certainty = 0.6272 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below:

```
Identities = 180/254 (70%), Positives = 217/254 (84%), Gaps = 2/254 (0%)
Query:    1 MPLTALEIKDKTFSSKFRGYSEEEVNEFLEIVVDDYEDLIRRNREQEQYIKDLEEKIAYF        60
            M LT LEIKDKTF +KFRGY EEEVNEFL+IVVDDYE L+R+NR+ E   IKDLEEK++YF Sbjct:    1 MALTTLEIKDKTFKTKFRGYCEEEVNEFLDIVVDDYEALVRKNRDNEARIKDLEEKLSYF        60

Query:   61 NEMKESLSQSVILAQETAERVKISAQDEASNLMGKATFDAQHLIDEAKLKANQILRDATD       120
            +EMKESLSQSVILAQETAE+VK +A   EA+NL+  KAT+DAQHL+DE+K KANQ+LRDATD Sbjct:   61 DEMKESLSQSVILAQETAEKVKATANAEATNLVSKATYDAQHLLDESKAKANQMLRDATD       120

Query:  121 DAKRVAIETEDLKRQSRVFHQRLLSELEGQLKLANSSAWEELLKPTAIYLQNSDASFKEV       180
            +AKRVAIETE+LKRQ+RVFHQRL+S +E QL L+NS   W+ELL+PTAIYLQNSD +FKEV Sbjct:  121 EAKRVAIETEELKRQTRVFHQRLISSIESQLSLSNSPEWDELLQPTAIYLQNSDDAFKEV       180

Query:  181 VEKVLDEDDALPVVDDTESFDATRQFSPDEMEELQRRVEESNKQLEESGLLDTNNFQMEE       240
            V+ VL+ED  +P  DD+ SFDATRQF+P+E+EELQRRV+ESNK+LE    L  ++    E Sbjct:  181 VKTVLNED--IPESDDSASFDATRQFTPEELEELQRRVDESNKELEAYQLDSQSDSTTEP       238

Query:  241 PINLGETQTFKLNI                                                    254
            +NL ETQTFKLNI Sbjct:  239 EVNLSETQTFKLNI                                                    252
```

Based on this analysis, it was predicted that these proteins and their epitopes could be useful antigens for vaccines or diagnostics.

Example 74

A DNA sequence (GBSx0074) was identified in *S. agalactiae* <SEQ ID 243> which encodes the amino acid sequence <SEQ ID 244>. Analysis of this protein sequence reveals the following:

Possible site: 61
>>> Seems to have no N-terminal signal sequence
INTEGRAL    Likelihood = -0.43    Transmembrane 841-857 (841-857)
----- Final Results -----
   bacterial membrane --- Certainty = 0.1171 (Affirmative) <succ>
     bacterial outside --- Certainty = 0.0000 (Not Clear) <succ>
   bacterial cytoplasm --- Certainty = 0.0000 (Not Clear) <succ>

The protein has homology with the following sequences in the GENPEPT database:

>GP: AAC95446 GB: AF068901 isoleucine-tRNA synthetase
[*Streptococcus pneumoniae*]
Identities = 730/929 (78%), Positives = 822/929 (87%), Gaps = 1/929 (0%)

```
Query:   1 MKLKETLNLGQTAFPMRAGLPNKEPQWQEAWDQADIYKKRQALNEGKPAFHLHDGPPYAN         60
           MKLK+TLNLG+T FPMRAGLP KEP WQ+ W  A +Y++RQ LN+GKP F LHDGPPYAN
Sbjct:   1 MKLKDTLNLGKTEFPMRAGLPTKEPVWQKEWEDAKLYQRRQELNQGKPHFTLHDGPPYAN         60

Query:  61 GNIHVGHALNKISKDIIVRSKSMSGFRAPYVPGWDTHGLPIEQVLAKKGVKRKEMDLAEY        120
           GNIHVGHA+NKISKDIIVRSKSMSGF AP++PGWDTHGLPIEQVL+K+GVKRKEMDL EY
Sbjct:  61 GNIHVGHAMNKISKDIIVRSKSMSGFYAPFIPGWDTHGLPIEQVLSKQGVKRKEMDLVEY        120

Query: 121 LEMCRDYALSQVDKQRDDFKRLGVSADWENPYITLTPDYEADQVRVFGAMADKGYIYRGA        180
           L++CR+YALSQVDKQR+DFKRLGVS DWENPY+TLTPDYEA Q+RVFG MA+KGYIYRGA
Sbjct: 121 LKLCREYALSQVDKQREDFKRLGVSGDWENPYVTLTPDYEAAQIRVFGEMANKGYIYRGA        180

Query: 181 KPVYWSWSSESALAEAEIEYHDIDSTSLYYANKVKDGKGILDTDTYIVVWTTTPFTVTAS        240
           KPVYWSWSSESALAEAEIEYHD+ STSLYYANKVKDGKG+LDTDTYIVVWTTTPFT+TAS
Sbjct: 181 KPVYWSWSSESALAEAEIEYHDLVSTSLYYANKVKDGKGVLDTDTYIVVWTTTPFTITAS        240

Query: 241 RGLTVGPDMEYVVVVPVGSERKYLLAEVLVDSLAAKFGWENFEIVTHHTGKELNHIVTEH        300
           RGLTVG D++YV+V PVG  RK+++A  L+ SL+ KFGW + +++  + G+ELNHIVTEH
Sbjct: 241 RGLTVGADIDYVLVQPVGEARKFVVAAELLTSLSEKFGWADVQVLETYRGQELNHIVTEH        300

Query: 301 PWDTEVEELVILGDHVTTDSGTGIVHTAPGFGEDDYNVGIANGLDVVVTVDSRGLMMENA        360
           PWDT VEELVILGDHVTTDSGTGIVHTAPGFGEDDYNVGIAN L+V VTVD RG+MM+NA
Sbjct: 301 PWDTAVEELVILGDHVTTDSGTGIVHTAPGFGEDDYNVGIANNLEVAVTVDERGIMMKNA        360

Query: 361 GPDFEGQFYDKVTPLVKEKLGDLLLASEVINHSYPFDWRTKKPIIWRAVPQWFASVSKFR        420
           GP+FEGQFY+KV P V EKLG+LLLA E I+HSYPFDWRTKKPIIWRAVPQWFASVSKFR
Sbjct: 361 GPEFEGQFYEKVVPTVIEKLGNLLLAQEEISHSYPFDWRTKKPIIWRAVPQWFASVSKFR        420

Query: 421 QEILDEIEKTNFQPEWGKKRLYNMIRDRGDWVISRQRAWGVPLPIFYAEDGTAIMTKEVT        480
           QEILDEIEK   F EWGK RLYNMIRDRGDWVISRQR WGVPLPIFYAEDGTAIM  E  
Sbjct: 421 QEILDEIEKVKFHSEWGKVRLYNMIRDRGDWVISRQRTWGVPLPIFYAEDGTAIMVAETI        480

Query: 481 DHVADLFAEYGSIVWWQRDAKDLLPAGYTHPGSPNGLFEKETDIMDVWFDSGSSWNGVMN        540
           +HVA LF ++GS +WW+RDAKDLLP G+THPGSPNG F+KETDIMDVWFDSGSSWNGV+
Sbjct: 481 EHVAQLFEKHGSSIWWERDAKDLLPEGFTHPGSPNGEFKKETDIMDVWFDSGSSWNGVVV        540

Query: 541 ARENLSYPADLYLEGSDQYRGWFNSSLITSVAVNGHAPYKAVLSQGFVLDGKGEKMSKSL        600
            R   L+YPADLYLEGSDQYRGWFNSSLITSVA +G APYK +LSQGF LDGKGEKMSKSL
Sbjct: 541 NRPELTYPADLYLEGSDQYRGWENSSLITSVANHGVAPYKQILSQGFALDGKGEKMSKSL        600

Query: 601 GNTILPSDVEKQFGAEILRLWVTSVDSSNDVRISMDILKQTSETYRKIRNTLRFLIANTS        660
           GNTI PSDVEKQFGAEILRLWVTSVDSSNDVRISMDIL Q SETYRKIRNTLRFLIANTS
Sbjct: 601 GNTIAPSDVEKQFGAEILRLWVTSVDSSNDVRISMDILSQVSETYRKIRNTLRFLIANTS        660

Query: 661 DFNPKQDAVAYENLGAVDRYMTIKFNQVVDTINKAYAAYDFMAIYKAVVNFVTVDLSAFY        720
           DFNP QD VAY+ L +VD+YMTI+FNQ+V TI  AYA ++F+ IYKA VNF+ VDLSAFY
Sbjct: 661 DFNPAQDTVAYDELRSVDKYMTIRFNQLVKTIRDAYADFEFLTIYKALVNFINVDLSAFY        720

Query: 721 LDFAKDVVYIEAANSPERRRMQTVFYDILVKLTKLLTPILPHTAEEIWSYLEHEEEEFVQ        780
           LDFAKDVVYIE A S ERR MQTVFYDILVK+TKLLTPILPHTAEEIWSYLE E E+FVQ
Sbjct: 721 LDFAEDVVYIEGAKSLERRQMQTVFYDILVKITKLLTPILPHTAEEIWSYLEFETEDFVQ        780

Query: 781 LAEMPVAQTFSGQEEILEEWSAFMTLRTQAQKALEEARNAKVIGKSLEAHLTIYASQEVK        840
           L+E+P  QTF+ QEEIL+ W+AFM  R QAQKALEEARNAKVIGKSLEAHLT+Y ++ VK
Sbjct: 781 LSELPEVQTFANQEEILDTWAAFMDFRGQAQKALEEARNAKVIGKSLEAHLTVYPNEVVK        840

Query: 841 TLLTALNSDIALLMIVSQLTIADEADKPADSVSFEGVAFTVEHAEGEVCERSRRIDPTTK        900
           TLL A+NS++A L+IVS+LTIA+E   P ++ SFE VAFTVE A GEVC+R RRIDPTT
```

```
Sbjct:  841 TLLEAVNSNVAQLLIVSELTIAEE-PAPEAALSFEDVAFTVERAAGEVCDRCRRIDPTTA        899

Query:  901 MRSYGVAVCDASAAIIEQYYPEAVAQGFE                                     929
            RSY   +CD  A+I+E+ + +AVA+GFE
Sbjct:  900 ERSYQAVICDHCASIVEENFADAVAEGFE                                     928
```

A related DNA sequence was identified in *S. pyogenes* <SEQ ID 245> which encodes the amino acid sequence <SEQ ID 246>. Analysis of this protein sequence reveals the following:

Possible site: 61
>>> Seems to have no N-terminal signal sequence

-continued

INTEGRAL    Likelihood = −1.70    Transmembrane 849-865 (848-867)
----- Final Results -----
  bacterial membrane --- Certainty = 0.1680 (Affirmative) <succ>
  bacterial outside --- Certainty = 0.0000 (Not Clear) <succ>
  bacterial cytoplasm --- Certainty = 0.0000 (Not Clear) <succ>

An alignment of the GAS and GBS proteins is shown below:

```
Identities = 798/929 (85%), Positives = 857/929 (91%)
Query:    1 MKLKETLNLGQTAFPMRAGLPNKEPQWQEAWDQADIYKKRQALNEGKPAFHLHDGPPYAN      60
            MKLKETLNLG+TAFPMRAGLPNKEPQWQ AW+QA++YKKRQ LN GKPAFHLHDGPPYAN
Sbjct:    1 MKLEETLNLGKTAFPMRAGLPNKEPQWQAAWEQAELYKKRQELNAGKPAFHLHDGPPYAN      60

Query:   61 GNIHVGHALNKISKDIIVRSKSMSGFRAPYVPGWDTHGLPIEQVLAKKGVKRKEMDLAEY     120
            GNIHVGHALNKISKDIIVRSKSMSGF+APYVPGWDTHGLPIEQVLAK+G+KRKEMDLAEY
Sbjct:   61 GNIHVGHALNKISKDIIVRSKSMSGFQAPYVPGWDTHGLPIEQVLAKQGIKRKEMDLAEY     120

Query:  121 LEMCRDYALSQVDKQRDDFKRLGVSADWENPYITLTPDYEADQVRVEGAMADKGYIYRGA     180
            LEMCR YALSQVDKQRDDFKRLGVSADWENPY+TL P +EADQ+RVFGAMA+KGYIYRGA
Sbjct:  121 LEMCRQYALSQVDKQRDDFKRLGVSADWENPYVTLDPQFEADQIRVFGAMAEKGYIYRGA     180

Query:  181 KPVYWSWSSESALAEAEIEYHDIDSTSLYYANKVKDGKGILDTDTYIVVWTTTPFTVTAS     240
            KPVYWSWSSESALAEAEIEYHDIDSTSLYYANKVKDGKGILDT+TYIVVWTTTPFTVTAS
Sbjct:  181 KPVYWSWSSESALAEAEIEYHDIDSTSLYYANKVKDGKGILDTNTYIVVWTTTPFTVTAS     240

Query:  241 RGLTVGPDMEYVVVVPVGSERKYLLAEVLVDSLAAKFGWENFEIVTHHTGKELNHIVTEH     300
            RGLTVGPDM+Y+VV P GS+R+Y++AE L+DSLA KFGWE+FE +  H G +L +IVTEH
Sbjct:  241 RGLTVGPDMDYLVVKPAGSDRQYVVAEGLLDSLAGKFGWESFETLASHKGADLEYIVTEH     300

Query:  301 PWDTEVEELVILGDHVTTDSGTGIVHTAPGFGEDDYNVGIANGLDVVVTVDSRGLMMENA     360
            PWDT+VEELVILGDHVT +SGTGIVHTAPGFGEDDYNVG    L+V VTVD RGLMMENA
Sbjct:  301 PWDTDVEELVILGDHVTLESGTGIVHTAPGFGEDDYNVGTKYKLEVAVTVDERGLMMENA     360

Query:  361 GPDFEGQFYDKVTPLVKEKLGDLLLASEVINHSYPFDWRTKKPIIWRAVPQWFASVSKFR     420
            GPDF GQFY+KVTP+V +KLGDLLLA EVINHSYPFDWRTKKPIIWRAVPQWFASVS FR
Sbjct:  361 GPDFHGQFYNKVTPIVIDKLGDLLLAQEVINHSYPFDWRTKKPIIWRAVPQWFASVSDFR     420

Query:  421 QEILDEIEKTNFQPEWGKKRLYNMIRDRGDWVISRQRAWGVPLPIFYAEDGTAIMTKEVT     480
            Q+ILDEIEKT F P WG+ RLYNMIRDRGDWVISRQRAWGVPLPIFYAEDGTAIMTKEVT
Sbjct:  421 QDILDEIEKTTFHPSWGETRLYNMIRDRGDWVISRQRAWGVPLPIFYAEDGTAIMTKEVT     480

Query:  481 DHVADLFAEYGSIVWWQRDAKDLLPAGYTHPGSPNGLFEKETDIMDVWFDSGSSWNGVMN     540
            DHVADLF E GSI+WWQ++AKDLLP G+THPGSPNG F KETDIMDVWFDSGSSWNGVMN
Sbjct:  481 DHVADLFQENGSIIWWQKEAKDLLPEGFTHPGSPNGEFTKETDIMDVWFDSGSSWNGVMN     540

Query:  541 ARENLSYPADLYLEGSDQYRGWFNSSLITSVAVNGHAPYKAVLSQGFVLDGKGEKMSKSL     600
            +ENLSYPADLYLEGSDQYRGWFNSSLITSVAVNGHAPYKA+LSQGFVLDGKGEKMSKS
Sbjct:  541 TKENLSYPADLYLEGSDQYRGWFNSSLITSVAVNGHAPYKAILSQGFVLDGKGEKMSKSK     600

Query:  601 GNTILPSDVEKQFGAEILRLWVTSVDSSNDVRISMDILKQTSETYRKIRNTLRFLIANTS     660
            GN I P+DV KQ+GA+ILRLWV SVD+ NDVR+SM+IL Q SETYRKIRNTLRFLIANTS
Sbjct:  601 GNIISPNDVAKQYGADILRLWVASVDTDNDVRVSMEILGQVSETYRKIRNTLRFLIANTS     660

Query:  661 DFNPKQDAVAYENLGAVDRYMTIKFNQVVDTINKAYAAYDFMAIYKAVVNFVTVDLSAFY     720
            DFNP  D VAY +LG VD+YMTI FNQ+V TI A Y  YDFMAIYKAVVNFVTVDLSAFY
```

-continued

```
Sbjct: 661 DFNPATDTVAYADLGTVDKYMTIVFNQLVATITDAYERYDFMAIYKAVVNFVTVDLSAFY         720

Query: 721 LDFAKDVVYIEAANSPERRRMQTVFYDILVKLTKLLTPILPHTAEEIWSYLEHEEEEFVQ         780
           LDFAKDVVYIEAANS ERRRMQTVFYDILVK+TKLLTPILPHT EEIWSYLEHE E FVQ Sbjct: 721 LDFAKDVVYIEAANSLERRRMQTVFYDILVKITKLLTPILPHTTEEIWSYLEHESEAFVQ         780

Query: 781 LAEMPVAQTFSGQEEILEEWSAFMTLRTQAQKALEEARNAKVIGKSLEAHLTIYASQEVK         840
           LAEMPVA+TFS QE+ILE WSAFMTLRTQAQKALEEARNAK+IGKSLEAHLTIYAS+EVK Sbjct: 781 LAEMPVAETFSAQEDILEAWSAFMTLRTQAQKALEEARNAKIIGKSLEAHLTIYASEEVK         840

Query: 841 TLLTALNSDIALLMIVSQLTIADEADKPADSVSFEGVAFTVEHAEGEVCERSRRIDPTTK         900
           TLLTAL+SDIALL+IVSQLTIAD AD PAD+V+FEGVAF VEHA GEVCERSRRIDPTT+

Sbjct: 841 TLLTALDSDIALLLIVSQLTIADLADAPADAVAFEGVAFIVEHAIGEVCERSRRIDPTTR         900

Query: 901 MRSYGVAVCDASAAIIEQYYPEAVAQGFE                                       929
           MRSY  VCD SA IIE+ +PEAVA+GFE Sbjct: 901 MRSYNAFVCDHSAKIIEENFPEAVAEGFE                                       929
```

Based on this analysis, it was predicted that these proteins and their epitopes could be useful antigens for vaccines or diagnostics.

Example 75

A DNA sequence (GBSx0075) was identified in *S. agalactiae* <SEQ ID 247> which encodes the amino acid sequence <SEQ ID 248>. Analysis of this protein sequence reveals the following:

Possible site: 39
>>> Seems to have no N-terminal signal sequence
----- Final Results -----
  bacterial cytoplasm --- Certainty = 0.3425 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

A related DNA sequence was identified in *S. pyogenes* <SEQ ID 249> which encodes the amino acid sequence <SEQ ID 250>. Analysis of this protein sequence reveals the following:

Possible site: 32
>>> Seems to have no N-terminal signal sequence
----- Final Results -----
  bacterial cytoplasm --- Certainty = 0.3467 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below:

```
Identities = 77/99 (77%), Positives = 89/99 (89%)
Query:  1 MRLINTTSSHPELVRNQLQNTDAKLVEVYSAGNTDVVETKAPKHYELLISNKYRAIKDEE        60
          MRLINTTSSHPEL++NQL+NTDA LVEVYSAGNTDV+FT+APKHYELLISNKYRAIK++E Sbjct:  1 MRLINTTSSHPELIKNQLKNTDAYLVEVYSAGNTDVIFTQAPKHYELLISNKYRAIKEDE        60

Query: 61 LEAIREFFLKRKIDQSIIQEQMKSLHTAKLIEISYPTT                             99
          L+ IREFFLKRKID I+I Q K+LHT  LIEIS+ T+

Sbjct: 61 LDIIREFFLKRKIDPKIVIPGQSKTLHTNNLIEISFQTS                            99
```

Based on this analysis, it was predicted that these proteins and their epitopes could be useful antigens for vaccines or diagnostics.

Example 76

A DNA sequence (GBSx0076) was identified in *S. agalactiae* <SEQ ID 251> which encodes the amino acid sequence <SEQ ID 252>. This protein is predicted to be AP4A hydrolase. Analysis of this protein sequence reveals the following:

Possible site: 42
>>> Seems to have no N-terminal signal sequence

```
----- Final Results -----
    bacterial cytoplasm --- Certainty = 0.1714 (Affirmative) <succ>
      bacterial membrane --- Certainty = 0.0000 (Not Clear) <succ>
        bacterial outside --- Certainty = 0.0000 (Not Clear) <succ>
```

The protein has homology with the following sequences in the GENPEPT database:

```
>GP: AAC06510 GB: AE000676 AP4A hydrolase [Aquifex aeolicus]
Identities = 30/101 (29%), Positives = 48/101 (46%), Gaps = 2/101 (1%)
Query: 32  KIILVQAPNGAWFLPGGEIEENENHLEALTRELIEELGYSATIGHYYGQADEYFYSRHRD         91
           +++L++ P+  W  P G IE  E    E   RE+ EE G    I  Y G+    Y+Y+   +
Sbjct: 16  EVLLIKTPSNVWSFPKGNIEPGEKPEETAVREVWEETGVKGEILDYIGEI-HYWYTLKGE         74

Query: 92  TYYYNPAYIYEVTAYHKDQAPLEDENHLAWFPIQEAKEKLK                           132
           +    Y Y +    + P  +      +FPI+EAK+ LK
Sbjct: 75  RIFKTVKY-YLMKYKEGEPRPSWEVEDAKFFPIKEAKKLLK                           114
```

A related DNA sequence was identified in S. pyogenes <SEQ ID 253> which encodes the amino acid sequence <SEQ ID 254>. Analysis of this protein sequence reveals the following:

```
Possible site: 47
>>> Seems to have no N-terminal signal sequence
----- Final Results -----
    bacterial cytoplasm --- Certainty = 0.1954 (Affirmative) <succ>
      bacterial membrane --- Certainty = 0.0000 (Not Clear) <succ>
        bacterial outside --- Certainty = 0.0000 (Not Clear) <succ>
```

An alignment of the GAS and GBS proteins is shown below:

```
Identities = 102/149 (68%), Positives = 118/149 (78%)
Query:    1 MTNPTFGEKIDNVNYRSRFGVYAIIPNPTHDKIILVQAPNGAWFLPGGEIEENENHLEAL          60
            M  PTFG K  +  +Y +R+GVYAIIPN    KIILVQAPNG+WFLPGGEIE   E   L+AL
Sbjct:    1 MMIPTFGHKNAHKDYVTRYGVYAIIPNHEQTKIILVQAPNGSWFLPGGEIEAGEGQLQAL          60

Query:   61 TRELIEELGYSATIGHYYGQADEYFYSRHRDTYYYNPAYIYEVTAYHKDQAPLEDFNHLA        120
            RELIEELG+SATIG YYGQADEYFYSRHRDT++Y+PAY+YEVTA+       PLEDFN+L
Sbjct:   61 ERELIEELGFSATIGSYYGQADEYFYSRHRDTHFYHPAYLYEVTAFQAVSKPLEDFNNLG        120

Query:  121 WFPIQEAKEKLKRGSHRWGVQAWEKNHHS                                    149
            WF   EA   KLKR SH+WGV+ W+K HHS
Sbjct:  121 WFSPIEAIAKLKRESHQWGVKEWQKKHHS                                    149
```

Based on this analysis, it was predicted that these proteins and their epitopes could be useful antigens for vaccines or diagnostics.

Example 77

A DNA sequence (GBSx0077) was identified in S. agalactiae <SEQ ID 255> which encodes the amino acid sequence <SEQ ID 256>. This protein is predicted to be ClpE (clpB-1). Analysis of this protein sequence reveals the following:

Possible site: 54
>>> Seems to have no N-terminal signal sequence
----- Final Results -----
   bacterial cytoplasm --- Certainty = 0.2882 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database:

```
>GP: AAD01782 GB: AF023421 ClpE [Lactococcus lactis]
Identities = 560/752 (74%), Positives = 647/752 (85%), Gaps = 12/752 (1%)
Query:    1 MLCQNCKLNESTIHLYTNVNGKQKQVDLCQNCYQIIKTDPNNPLFSGLNHVS-HAPGGIN    59
            MLCQNC +NE+TIHLYT+VNG++KQ+DLCQNCYQI+K+       LF  N  +  ++   N Sbjct:    1 MLCQNCNINEATIHLYTSVNGQKKQIDLCQNCYQIMKSGGQEALFGAGNASNGNSDEPFN    60

Query:   60 PFFDDFFGDLNNFRAFNGQDLPNTPPTQSGGNRGGGNGNGRNNNRNQTATPSQAKGILEE   119
            PF +D F  L  + FNG     TPPTQ+GG  G  N  R          Q KG+LEE Sbjct:   61 PF-NDIFSALQG-QDFNGAASNQTPPTQTGGRGPRGPQNPR---------AKQPKGMLEE   109

Query:  120 FGINVTEIARHGDIDPVIGRDSEIIRVIEILNRRTKNNPVLIGEPGVGKTAVVEGLAQKI   179
            FGIN+TE AR G+IDPVIGRD EI RVIEILNRRTKNNPVLIGEPGVGKTAVVEGLAQKI Sbjct:  110 FGINITESARRGEIDPVIGRDEEIKRVIEILNRRTKNNPVLIGEPGVGKTAVVEGLAQKI   169

Query:  180 VDGNVPHKLQGKQVIRLDVVSLVQGTGIRGQFEERMQKLMEEIRQRQDVILFIDEIHEIV   239
            VDG+VP KLQ K+VIRLDVVSLVQGTGIRGQFEERMQKLM+EIR+R DVI+FIDEIHEIV Sbjct:  170 VDGDVPQKLQNKEVIRLDVVSLVQGTGIRGQFEERMQKLMDEIRKRNDVIMFIDEIHEIV   229

Query:  240 GAGTAGEGSMDAGNILKPALARGELQLVGATTLNEYRIIEKDAALERRMQPVKVDEPSVE   299
            GAG+AG+G+MDAGNILKPALARGELQLVGATTLNEYRIIEKDAALERRMQPVKVDEPSV+

Sbjct:  230 GAGSAGDGNMDAGNILKPALARGELQLVGATTLNEYRIIEKDAALERRMQPVKVDEPSVD   289

Query:  300 ETITILKGIQKKYEDYHHVKYNNDAIEAAAVLSNRYIQDRFLPDKAIDLLDEAGSKMNLT   359
            ETITIL+GIQ +YEDYHHVKY ++AIEAAA LSNRYIQDRFLPDKAIDLLDE+GSK NLT Sbjct:  290 ETITILRGIQARYEDYHHVKYTDEAIEAAAHLSNRYIQDRFLPDKAIDLLDESGSKKNLT   349

Query:  360 LNFVDPKEIDQRLIEAENLKAQATREEDYERAAYFRDQIAKYKEMQQQKVDDQDTPIITE   419
            L FVDP++I++R+  +AE+ K +AT  ED+E+AA+FRDQI+K +E+Q+Q+V D+D P+ITE Sbjct:  350 LKFVDPEDINRRIADAESKENEATKAEDFEKAAHFRDQISKLRELQKQEVTDEDMPVITE   409

Query:  420 KTIEHIIEEKTNIPVGDLKEKEQSQLINLADDLKQHVIGQDDAVVKIAKAIRRNRVGLGS   479
            K IE I+E+KT IPVGDLKEKEQ+QLINLADDLK HVIGQD AV KI+KAIRR+RVGLG Sbjct:  410 KDIEQIVEQKTQIPVGDLKEKEQTQLINLADDLKAHVIGQDEAVDKISKAIRRSRVGLGK   469

Query:  480 PNRPIGSFLFVGPTGVGKTELSKQLAIELFGSADSMIRFDMSEYMEKHAVAKLVGAPPGY   539
            PNRPIG FLFVGPTGVGKTEL+KQLA ELFGS++SMIRFDMSEYMEKH+VAKL+GAPPGY Sbjct:  470 PNRPIGFFLFVGPTGVGKTELAKQLAKELFGSSESMIRFDMSEYMEKHSVAKLIGAPPGY   529

Query:  540 VGYEEAGQLTEKVRRNPYSLILLDEIEKAHPDVMHMFLQVLDDGRLTDGQGRTVSFKDTI   599
            VGYEEAGQLTE+VRRNPYSLILLDEIEKAHPDVMHMFLQ+L+DGRLTD QGRTVSFKD++

Sbjct:  530 VGYEEAGQLTERVRRNPYSLILLDEIEKAHPDVMHMFLQILEDGRLTDAQGRTVSFKDSL   589

Query:  600 IIMTSNAGSGKTEASVGFGASREGRTNSVLGQLGNFFSPEFMNRFDGIIEFKALDKENLL   659
            IIMTSNAG+GK EASVGFGA+REGRT SVLGQLG+FFSPEFMNRFDGIIEF AL KENLL Sbjct:  590 IIMTSNAGTGKVEASVGFGAAREGRTKSVLGQLGDFFSPEFMNRFDGIIEFSALSKENLL   649

Query:  660 NIVDIMLSDVNARLAINGIHLDVTDKVKEKLVDLGYDPKMGARPLRRTIQEHIEDAITDY   719
              IVD+ML +VN ++  N IHL VT   KEKLVDLGY+P MGARPLRR IQE+IED+I D+

Sbjct:  650 KIVDLMLDEVNEQIGRNDIHLSVTQAAKEKLVDLGYNPMGARPLRRIIQENIEDSIADF   709

Query:  720 YLENPSEKELRAIMTSNGNIIIKSSKKTEEST                            751
             Y+E+P  K+L A +   +I    +++T E+T Sbjct:  710 YIEHPEYKQLVADLIDDKIVISNQTQETAETT                            741
```

A related DNA sequence was identified in *S. pyogenes* <SEQ ID 257> which encodes the amino acid sequence <SEQ ID 258>. Analysis of this protein sequence reveals the following:

Possible site: 43
>>> Seems to have no N-terminal signal sequence
----- Final Results ----- bacterial cytoplasm --- Certainty = 0.3104 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below:

```
Identities = 640/751 (85%), Positives = 691/751 (91%), Gaps = 7/751 (0%)
Query:   1 MLCQNCKLNESTIHLYTNVNGKQKQVDLCQNCYQIIKTDPNNPLFSGLNHVSHAPG-GIN      59
           MLCQNC LNESTIHLYT+VNGKQ+QVDLCQNCYQI+K+DP N + +GL      A     +
Sbjct:   1 MLCQNCNLNESTIHLYTSVNGKQRQVDLCQNCYQIMKSDPANSILNGLTPGYRAQDRSTS     60

Query:  60 PFFDDFFGDLNNFRAFNGQDLPNTPPTQSGGNRGGGNGNGRNNNRNQTATPS----QAKG    115
           PFFDDFFGDLNNFRAF   +LPNTPPTQ+G N  GG    G N N  + A P      QAKG
Sbjct:  61 PFFDDFFGDLNNFRAFG--NLPNTPPTQAGQNGNGGGRYGGNYNGQRPAQPQTPNQQAKG    118

Query: 116 ILEEFGINVTEIARHGDIDPVIGRDSEIIRVIEILNRRTKNNPVLIGEPGVGKTAVVEGL    175
           +LEEFGINVT+IAR+G+IDPVIGRD EI RVIEILNRRTKNNPVLIGEPGVGKTAVVEGL
Sbjct: 119 LLEEFGINVTDIARNGNIDPVIGRDEEITRVIEILNRRTKNNPVLIGEPGVGKTAVVEGL    178

Query: 176 AQKIVDGNVPHKLQGKQVIRLDVVSLVQGTGIRGQFEERMQKLMEEIRQRQDVILFIDEI    235
           AQKI+DG VP KLQGKQVIRLDVVSLVQGTGIRGQFEERMQKLMEEIR R+DVILFIDEI
Sbjct: 179 AQKIIDGTVPQKLQGKQVIRLDVVSLVQGTGIRGQFEERMQKLMEEIRNRKDVILFIDEI    238

Query: 236 HEIVGAGTAGEGSMDAGNILKPALARGELQLVGATTLNEYRIIEKDAALERRMQPVKVDE    295
           HEIVGAG+AG+G+MDAGNILKPALARGELQLVGATTLNEYRIIEKDAALERRMQPVKVDE
Sbjct: 239 HEIVGAGSAGDGNMDAGNILKPALARGELQLVGATTLNEYRIIEKDAALERRMQPVKVDE    298

Query: 296 PSVEETITILKGIQKKYEDYHHVKYNNDAIEAAAVLSNRYIQDRFLPDKAIDLLDEAGSK    355
           PSVEETITILKGIQ  KYEDYHHVKY+  AIEAAA LSNRYIQDRFLPDKAIDLLDEAGSK
Sbjct: 299 PSVEETITILKGIQPKYEDYHHVKYSPAAIEAAAHLSNRYIQDRFLPDKAIDLLDEAGSK    358

Query: 356 MNLTLNFVDPKEIDQRLIEAENLKAQATREEDYERAAYFRDQIAKYKEMQQQKVDDQDTP    415
           MNLTLNFVDPKEID+RLIEAENLKAQATR+EDYERAAYFRDQI KYKEMQ QKVD+QD P
Sbjct: 359 MNLTLNFVDPKEIDKRLIEAENLKAQATRDEDYERAAYFRDQITKYKEMQAQKVDEQDIP    418

Query: 416 IITEKTIEHIIEEKTNIPVGDLKEKEQSQLINLADDLKQHVIGQDDAVVKIAKAIRRNRV    475
           IITEKTIE I+E+KTNIPVGDLKEKEQSQL+NLA+DLK HVIGQDDAV KIAKAIRRNRV
Sbjct: 419 IITEKTIEAIVEQKTNIPVGDLKEKEQSQLVNLANDLKAHVIGQDDAVDKLAKAIRRNRV    478

Query: 476 GLGSPNRPIGSFLFVGPTGVGKTELSKQLAIELFGSADSMIRFDMSEYMEKHAVAKLVGA    535
           GLG+PNRPIGSFLFVGPTGVGKTELSKQLAIELFGS ++MIRFDMSEYMEKHAVAKLVGA
Sbjct: 479 GLGTPNRPIGSFLFVGPTGVGKTELSKQLAIELFGSTNNMIRFDMSEYMEKHAVAKLVGA    538

Query: 536 PPGYVGYEEAGQLTEKVRRNPYSLILLDEIEKAHPDVMHMFLQVLDDGRLTDGQGRTVSF    595
           PPGY+GYEEAGQLTE+VRRNPYSLILLDE+EKAHPDVMHMFLQVLDDGRLTDGQGRTVSF
Sbjct: 539 PPGYIGYEEAGQLTEQVRRNPYSLILLDEVEKAHPDVMHMFLQVLDDGRLTDGQGRTVSF    598

Query: 596 KDTIIIMTSNAGSGKTEASVGFGASREGRTNSVLGQLGNFFSPEFMNRFDGIIEFKALDK    655
           KDTIIIMTSNAG+GK+EASVGFGA+REGRT+SVLG+L NFFSPEFMNRFDGIIEFKAL K
Sbjct: 599 KDTIIIMTSNAGTGKSEASVGFGAAREGRTSSVLGELSNFFSPEFMNRFDGIIEFKALSK    658

Query: 656 ENLLNIVDIMLSDVNARLAINGIHLDVTDKVKEKLVDLGYDPKMGARPLRRTIQEHIEDA    715
           E+LL+IVD+ML DVN RL  NGIHLDVT KVKEKLVDLGYDPKMGARPLRRTIQ++IEDA
Sbjct: 659 EHLLHIVDLMLEDVNERLGYNGIHLDVTQKVKEKLVDLGYDPKMGARPLRRTIQDYIEDA    718

Query: 716 ITDYYLENPSEKELRAIMTSNGNIIIKSSKK                               746
           ITDYYLE+P+EK+LRA+MT++ NI IK+ K+
Sbjct: 719 ITDYYLEHPTEKQLRALMTNSENITIKAVKE                               749
```

Based on this analysis, it was predicted that these proteins and their epitopes could be useful antigens for vaccines or diagnostics.

Example 78

A DNA sequence (GBSx0078) was identified in *S. agalactiae* <SEQ ID 259> which encodes the amino acid sequence <SEQ ID 260>. This protein is predicted to be glutamine ABC transporter, permease protein (glnP). Analysis of this protein sequence reveals the following:

```
Possible site: 61
>>> Seems to have an uncleavable N-term signal seq
INTEGRAL      Likelihood = -9.92    Transmembrane 27-43 (15-46)
INTEGRAL      Likelihood = -2.50    Transmembrane 200-216 (196-217)
----- Final Results -----
   bacterial membrane --- Certainty = 0.4970 (Affirmative) <succ>
      bacterial outside --- Certainty = 0.0000 (Not Clear) <succ>
         bacterial cytoplasm --- Certainty = 0.0000 (Not Clear) <succ>
```

A related GBS nucleic acid sequence <SEQ ID 9619> which encodes amino acid sequence <SEQ ID 9620> was also identified.

The protein has homology with the following sequences in the GENPEPT database:

```
>GP: AAB91000 GB: AE001090 glutamine ABC transporter, permease protein
(glnP) [Archaeoglobus fulgidus]
Identities = 92/209 (44%), Positives = 129/209 (61%), Gaps = 10/209 (4%)
Query:   17 YGVMVTIMISTCVVFFGTIIGVLIALVKRTNLHFLTILANFYVWVFRGTPMVVQIMIAFA        76
            +G   VT+ ++    +FFG IIG +  L + +       ++  YV V RGTP++VQI+I +

Sbjct:   21 FGASVTLKLTLISIFFGLIIGTIAGLGRVSKNPLPFAISTAYVEVIRGTPLLVQILIVYF        80

Query:   77 WMHFNNLPTISFGVLDLDFTRLLPGIIIISLNSGAYISEIVRAGIEAVPSGQIEAAYSLG       136
               LP I  +             GII +S+ SGAYI+EIVRAGIE++P GQ+EAA SLG Sbjct:   81 -----GLPAIGINLQPEP-----AGIIALSICSGAYIAEIVRAGIESIPIGQMEAARSLG       130

Query:  137 IRPKNTLRYVILPQAFKNILPALGNEFITIIKDSALLQTIGVMELWNGAQSVVTATYSPV       196
             +      +RYVI PQAF+NILPALGNEFI ++KDS+LL   I  ++EL    + +V  T++

Sbjct:  131 MTYLQAMRYVIFPQAFRNILPALGNEFIALLKDSSLLSVISIVELTRVGRQIVNTTFNAW       190

Query:  197 APLLFAAFYYLMLTTILSALLKQMEKYLG                                   225
               P  L   A +YLM+T   LS L+    +K  LG Sbjct:  191 TPFLGVALFYLMMTIPLSRLVAYSQKKLG                                   219
```

A related DNA sequence was identified in *S. pyogenes* <SEQ ID 261> which encodes the amino acid sequence <SEQ ID 262>. Analysis of this protein sequence reveals the following:

```
Possible site:30
>>> Seems to have an uncleavable N-term signal seq
INTEGRAL      Likelihood = -9.08    Transmembrane 25-41 (11-44)
INTEGRAL      Likelihood = -1.91    Transmembrane 202-218 (201-218)
----- Final Results -----
   bacterial membrane --- Certainty = 0.4630 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the databases:

```
>GP: AAB91000 GB: AE001090 glutamine ABC transporter, permease protein
(glnP) [Archaeoglobus fulgidus]
Identities = 91/209 (43%), Positives = 138/209 (65%), Gaps = 12/209 (5%)
Query:  15 YGVLVTIMISVSVVFFGTLIGVLVTLIKRSHVKPLTWVVNL-YVWIFRGTPMVVQIMIAF    73
           +G  VT+ +++  +FFG +IG +  L + S    PL + ++  YV + RGTP++VQI+I +
Sbjct:  21 FGASVTLKLTLISIFFGLIIGTIAGLGRVSK-NPLPFAISTAYVEVIRGTPLLVQILIVY    79

Query:  74 AWMHFNNMPTIGFGVLDLDFSRLLPGIIIISLNSGAYISEIVRAGIEAVPKGQLEAAYSL   133
                  +P IG       ++     GII +S+ SGAYI+EIVRAGIE++P GQ+EAA SL
Sbjct:  80 F-----GLPAIG-----INLQPEPAGIIALSICSGAYIAEIVRAGIESIPIGQMEAARSL   129

Query: 134 GIRPQNAMRYVILPQAFKNILPALGNEFITIIKDSALLQTIGVMELWNGAQSVVTATYSP   193
           G+       AMRYVI PQAF+NILPALGNEFI ++KDS+LL   I ++EL    + +V T++
Sbjct: 130 GMTYLQAMRYVIFPQAFRNILPALGNEFIALLKDSSLLSVISIVELTRVGRQIVNTTFNA   189

Query: 194 ISPLLVAAFYYLMVTTVMAQLLAVLERHM                                222
           +P L  A  +YLM+T  +++L+A   ++ +
Sbjct: 190 WTPFLGVALFYLMMTIPLSRLVAYSQKKL                                218
```

An alignment of the GAS and GBS proteins is shown below:

```
Identities = 180/225 (80%), Positives = 208/225 (92%)
Query:   3 MNFSFLPQYWSYFNYGVMVTIMISTCVVFFGTIIGVLIALVKRTNLHFLTILANFYVWVF    62
           M+ SFLP+YW+YFNYGV+VTIMIS  VVFFGT+IGVL+ L+KR+++  LT + N YVW+F
Sbjct:   1 MDLSFLPKYWAYFNYGVLVTIMISVSVVFFGTLIGVLVTLIKRSHVKPLTWVVNLYVWIF    60

Query:  63 RGTPMVVQIMIAFAWMHFNNLPTISFGVLDLDFTRLLPGIIIISLNSGAYISEIVRAGIE   122
           RGTPMVVQIMIAFAWMHFNN+PTI FGVLDLDF+RLLPGIIIISLNSGAYISEIVRAGIE
Sbjct:  61 RGTPMVVQIMIAFAWMHFNNMPTIGFGVLDLDFSRLLPGIIIISLNSGAYISEIVRAGIE   120

Query: 123 AVPSGQIEAAYSLGIRPKNTLRYVILPQAFKNILPALGNEFITIIKDSALLQTIGVMELW   182
           AVP GQ+EAAYSLGIRP+N +RYVILPQAFKNILPALGNEFITIIKDSALLQTIGVMELW
Sbjct: 121 AVPKGQLEAAYSLGIRPQNAMRYVILPQAFKNILPALGNEFITIIKDSALLQTIGVMELW   180

Query: 183 NGAQSVVTATYSPVAPLLFAAFYYLMLTTILSALLKQMEKYLGKG                227
           NGAQSVVTATYSP++PLL AAFYYLM+TT+++ LL  +E+++ +G
Sbjct: 181 NGAQSVVTATYSPISPLLVAAFYYLMVTTVMAQLLAVLERHMAQG                225
```

Based on this analysis, it was predicted that these proteins and their epitopes could be useful antigens for vaccines or diagnostics.

Example 79

A DNA sequence (GBSx0079) was identified in *S. agalactiae* <SEQ ID 263> which encodes the amino acid sequence <SEQ ID 264>. This protein is predicted to be phosphomannomutase (manB). Analysis of this protein sequence reveals the following:

---
Possible site:60
>>> Seems to have no N-terminal signal sequence

---
----- Final Results -----
  bacterial cytoplasm --- Certainty = 0.5400 (Affirmative) <succ>
  bacterial membrane --- Certainty = 0.0000 (Not Clear) <succ>
  bacterial outside --- Certainty = 0.0000 (Not Clear) <succ>
---

A related GBS nucleic acid sequence <SEQ ID 9621> which encodes amino acid sequence <SEQ ID 9622> was also identified.

The protein has homology with the following sequences in the GENPEPT database:

```
>GP: BAB04825 GB: AP001510 phosphomannomutase [Bacillus halodurans]
Identities = 239/548 (43%), Positives = 344/548 (62%), Gaps = 14/548 (2%)
Query:   4 MNYKEIYQEWLENDSLGKDIKSDLEAIKGDESEIQDRFYKTLEFGTAGLRGKLGAGTNRM    63
           M++++ Y++W  + L  ++K  LEAI GDE +++D FYK LEFGT G+RG++G G NRM
Sbjct:   1 MSWRQRYEKWKGFNELELELKQSLEAIGGDEQQLEDCFYKNLEFGTGGMRGEIGPGPNRM    60

Query:  64 NTYMVGKAAQALANTIIDHGPEAIARGIAVSYDVRYQSKEFAELTCSIMAANGIKSYIYK   123
           NTY + KA++ A +++  G    A+G+  ++YD R++S EFA       +GIK+Y+++
Sbjct:  61 NTYTIRKASEGFARYLLEQGEHVKAQGVVIAYDSRHKSPEFAREAALTIGKHGIKAYLFE   120

Query: 124 GIRPTPMCSYAIRALGCVSGVMITASHNPQAYNGYKAYNKEGSQILDDIADQIANHMDAI   183
           +RPTP   S+A+R LG   G++ITASHNP  YNG+K Y  +G Q+  + A+++    ++ I
Sbjct: 121 ELRPTPELSFAVRKLGAAGGIVITASHNPPEYNGFKVYGSDGCQLPPEPANRLVKFVNEI   180
```

```
                                  -continued
Query:  184 TDYQQIKQIPFEEALASGSASYIDESIEEAYKKEVLGLTINDTNID---KSVRVVYTPLN  240
              D   I      E   +G+    I E ++ AY + +   + +N    ++     K VR+V+TPL+
Sbjct:  181 EDELVIPVGDERELKENGTLEMIGEEVDVAYHEALKTIIVNPELLEASAKDVRIVFTPLH  240

Query:  241 GVGNLPVREVLRRRGFENVYVVPEQEMPDPDFTTVGYPNPEVPKAFAYSESLGKSVDADI  300
              G  NLPVR VL    GFENV VV EQE+PDP F+TV  PNPE   AFA +   GK +AD+
Sbjct:  241 GTANLPVRRVLEAVGFENVTVVKEQELPDPQFSTVKAPNPEEHAAFALAIEYGKKTEADV  300

Query:  301 LLATDPDCDRVALEVKDSKGEYIFLNGNKIGALLSYYIFSQRCALGNLPHHPVLVKSIVT  360
              L+ATDPD DRV + V++    GEYI L GN+ G L+ +Y+ SQ+      G LP + + +K+IVT
Sbjct:  301 LIATDPDADRVGAVQNQAGEYIVLTGNQTGGLMLHYLLSQKKEKGQLPVNGIALKTIVT  360

Query:  361 GDLSKVIADKYNIETVETLTGFKNICGKANEYDISKDKTYLFGYEESIGFCYGTFVRDKD  420
              +   + IA+ + I  V+TLTGFK   I  K  EY+ S +   +LFGYEES G+   G FVRDKD
Sbjct:  361 SEFGRAIAEDFGIPMVDTLTGFKFIGEKIKEYEQSGEHQFLFGYEESYGYLIGDFVRDKD  420

Query:  421 AVSASMMVVEMTAYYKERGQTLLDVLQTIYDKFGYYNERQFSLELEGAEGQERISRIMED  480
              AV  A ++   EMTAYYK RG TL D L   ++D++GYY E    S+ L+G  G E+I  ++
Sbjct:  421 AVQACLLAAEMTAYYKSRGMTLYDGLLELFDRYGYYREGLTSITLKGKVGVEKIQHVLSQ  480

Query:  481 FRQDPILQVGEMTLENSIDFKDGYK-----------DFPKQNCLKYYFNEGSWYALRPSG  529
              FRQ  P   QV +  +     D++     K               P   N LKY  +GSW+ LRPSG
Sbjct:  481 FRQSPPKQVNDQQVVVIEDYQTKEKVSVKERTVEAITLPTSNVLKYMLEDGSWFCLRPSG  540

Query:  530 TEPKIKCY                                                     537
              TEPK+K Y
Sbjct:  541 TEPKLKIY                                                     548
```

A related DNA sequence was identified in *S. pyogenes* <SEQ ID 265> which encodes the amino acid sequence <SEQ ID 266>. Analysis of this protein sequence reveals the following:

Possible site: 35
>>> Seems to have no N-terminal signal sequence

```
----- Final Results -----
    bacterial cytoplasm --- Certainty = 0.5497 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below:

```
Identities = 470/564 (83%), Positives = 517/564 (91%)
Query:    1 MSHMNYKEIYQEWLENDSLGKDIKSDLEAIKGDESEIQDRFYKTLEFGTAGLRGKLGAGT   60
              MS+M Y E+YQEWL N+ L  DIK+DL AIK +E+EIQDRFYKTLEFGTAGLRGKLGAGT
Sbjct:    1 MSNMTYNEVYQEWLHNNDLSDDIKADLAAIKDNEAEIQDRFYKTLEFGTAGLRGKLGAGT   60

Query:   61 NRMNTYNVGKAAQALANTIIDHGPEAIARGIAVSYDVRYQSKEFAELTCSIMAANGIKSY  120
              NRMNTY+VGKAAQALANTIIDHGPEA+  +GIAVSYDVRYQS+ FAELTCSIMAANGIK+Y
Sbjct:   61 NRMNTYMVGKAAQALANTIIDHGPEAVKKGIAVSYDVRYQSRTFAELTCSIMAANGIKAY  120

Query:  121 IYKGIRPTPMCSYAIRALGCVSGVMITASHNPQAYNGYKAYWKEGSQILDDIADQIANHM  180
              +YKGIRPTPMCSYAIRALGC+SGVMITASHNPQAYNGYKAYW+EGSQILDDIADQIA HM
Sbjct:  121 LYKGIRPTPMCSYAIRALGCISGVMITASHNPQAYNGYKAYWQEGSQILDDIADQIAQHM  180

Query:  181 DAITDYQQIKQIPFEEALASGSASYIDESIEEAYKKEVLGLTINDTNIDKSVRVVYTPLN  240
              A+T  YQ+IKQ PFE+AL SG  +YIDESIEEAYKKEVLGLTINDT+IDKSVRVVYTPLN
Sbjct:  181 AALTQYQEIKQMPFEKALDSGLVTYIDESIEEAYKKEVLGLTINDTDIDKSVRVVYTPLN  240

Query:  241 GVGNLPVREVLRRRGFENVYVVPEQEMPDPDFTTVGYPNPEVPKAFAYSESLGKSVDADI  300
              GVGNLPVREVLRRRGFENVYVVPEQEMPDPDFTTVGYPNPEVPK FAYSE LGK+VDADI
Sbjct:  241 GVGNLPVREVLRRRGFENVYVVPEQEMPDPDFTTVGYPNPEVPKTFAYSEKLGKAVDADI  300

Query:  301 LLATDPDCDRVALEVKDSKGEYIFLNGNKIGALLSYYIFSQRCALGNLPHHPVLVKSIVT  360
              L+ATDPDCDRVALEVK++  G+Y+FLNGNKIGALLSYYIFSQR  LGNLP  +PVLVKSIVT
Sbjct:  301 LIATDPDCDRVALEVKNAVGDYVFLNGNKIGALLSYYIFSQRFDLGNLPANPVLVKSIVT  360

Query:  361 GDLSKVIADKYNIETVETLTGFKNICGKANEYDISKDKTYLFGYEESIGFCYGTFVRDKD  420
              GDLS+ IA  Y IETVETLTGFKNICGKANEYD++K K YLFGYEESIGFCYGTFVRDKD
Sbjct:  361 GDLSRAIASHYGIETVETLTGFKNICGKANEYDVTKQKNYLFGYEESIGFCYGTFVRDKD  420

Query:  421 AVSASMMVVEMTAYYKERGQTLLDVLQTIYDKFGYYNERQFSLELEGAEGQERISRIMED  480
              AVSASMM+VEM AYYK++GQ LLDVLQTIY  FGYYNERQ +LELEG EGQ+RI+RIMED
Sbjct:  421 AVSASMMIVEMAAYYKKKGQNLLDVLQTIYATFGYYNERQIALELEGIEGQKRIARIMED  480

Query:  481 FRQDPILQVGEMTLENSIDFKDGYKDFPKQNCLKYYFNEGSWYALRPSGTEPKIKCYLYT  540
              FRQ PI   V EM L+  +IDF DGY+DFPKQNCLK+Y ++GSWYALRPSGTEPKIK YLYT
Sbjct:  481 FRQTPIASVAEMALDKTIDFIDGYQDFPKQNCLKFYLDDGSWYALRPSGTEPKIKFYLYT  540

Query:  541 IGCTEADSLSKLNAIESACRAKMN                                     564
```

```
              IG T+ +S +KL+AIE+ACR K+N
Sbjct:  541   IGQTQENSATKLDAIEAACRTKIN                          564
```

Based on this analysis, it was predicted that these proteins and their epitopes could be useful antigens for vaccines or diagnostics.

Example 80

A DNA sequence (GBSx0080) was identified in *S. agalactiae* <SEQ ID 267> which encodes the amino acid sequence <SEQ ID 268>. This protein is predicted to be methylenetetrahydrofolate dehydrogenase (folD). Analysis of this protein sequence reveals the following:

Possible site: 48
>>> Seems to have no N-terminal signal sequence
----- Final Results -----
   bacterial cytoplasm --- Certainty = 0.4672 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database:

```
>GP: AAC44512 GB: U58210 tetrahydrofolate dehydrogenase/cyclohydrolase
[Streptococcus thermophilus]
Identities = 209/282 (74%), Positives = 248/282 (87%)
Query:    1 MTELIDGKALSQKMQAELGRKVERLKEQHGIIPGLAVILVGDNPASQVYVRNKERSALEA   60
            M  ++DGKAL+  MQ +L  KV RLKE+ I+PGL  VI+VG+NPASQNYVRNKER+A +A
Sbjct:    1 MAIIMDGKALAVNMQEQLQEKVARLKEKEWIVPGLVVIMVGENPASQNYVRNKERAAKKA   60

Query:   61 GFKSETLRLSESISQEELIDIIHQYNEDKSIHGILVQLPLPQHINDKKIILAIDPKKDVD  120
            GF S+T+ LSESIS+EELI++I +YN++    HGILVQLPLP HIN+ +I+LAIDPKKDVD
Sbjct:   61 GFHSKTVNLSESISEEELIEVIEKYNQNPLFHGILVQLPLPNHINEMRILLAIDPKKDVD  120

Query:  121 GFHPMNTGHLWSGRPMMVPCTPAGIMEMFREYHVDLEGKHAVIIGRSNIVGKPMAQLLLD  180
            GFHPMNTG+LW+GRP MVPCTPAGIME+ REY+V+LEGK AVIIGRSNIVGKPMAQLLL+
Sbjct:  121 GFHPMNTGNLWNGRPQMVPCTPAGIMEILREYNVELEGKTAVIIGRSNIVGKPMAQLLLE  180

Query:  181 KNATVTLTHSRTRNLSEVTKEADILIVAIGQGHFVTKDFVKEGAVVIDVGMNRDENGKLI  240
            KNATVTLTHSRT +L++V  +AD+LIVAIG+  FVT++FVKEGAVVIDVG+NRDE GKL
Sbjct:  181 KNATVTLTHSRTPHLAKVCNKADVLIVAIGRAKFVTEEFVKEGAVVIDVGINRDEEGKLC  240

Query:  241 GDVVFEQVAEVASMITPVPGGVGPMTITMLLEQTYQAALRSV                   282
            GDV F+QV E SMITPVPGGVGPMTITML+EQTYQAALRS+
Sbjct:  241 GDVDFDQVKEKVSMITPVPGGVGPMTITMLMEQTYQAALRSL                   282
```

A related DNA sequence was identified in *S. pyogenes* <SEQ ID 269> which encodes the amino acid sequence <SEQ ID 270>. Analysis of this protein sequence reveals the following:

Possible site: 22
>>> Seems to have no N-terminal signal sequence
----- Final Results -----
   bacterial cytoplasm --- Certainty = 0.3368 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below:

```
Identities = 230/281 (81%), Positives = 257/281 (90%)

Query:    1 MTELIDGKALSQKMQAELGRKVERLKEQHGIIPGLAVILVGDNPASQVYVRNKERSALEA   60
            MTELIDGKAL+QKMQ EL   KV  LK++ GI+PGLAVILVGD+PASQVYVRNKER+AL
Sbjct:    3 MTELIDGKALAQKMQQELAAKVNNLKQKKGIVPGLAVILVGDDPASQVYVRNKERAALTV  62

Query:   61 GFKSETLRLSESISQEELIDIIHQYNEDKSIHGILVQLPLPQHINDKKIILAIDPKKDVD  120
            GFKSET+RLSE I QEELI +I +YN D +IHGILVQLPLP HINDKKIILAIDPKKDVD
Sbjct:   63 GFKSETVRLSEFICQEELIAVIERYNADNTIHGILVQLPLPNHINDKKIILAIDPKKDVD 122

Query:  121 GFHPMNTGHLWSGRPMMVPCTPAGIMEMFREYHVDLEGKHAVIIGRSNIVGKPMAQLLLD  180
            GFHPMNTGHLWSGRP+MVPCTP+GIME+ REY+V+LEGKHAVIIGRSNIVGKPMAQLLLD
Sbjct:  123 GFHPMNTGHLWSGRPLMVPCTPSGIMELLREYNVNLEGKHAVIIGRSNIVGKPMAQLLLD 182

Query:  181 KNATVTLTHSRTRNLSEVTKEADILIVAIGQGHFVTKDFVKEGAVVIDVGMNRDENGKLI  240
            KNATVTLTHSRTR L EV + AD+LIVAIGQGHF+TK ++K+GA+VIDVGMNRD+NGKLI
Sbjct:  183 KNATVTLTHSRTRQLEEVCRCADVLIVAIGQGHFITKQYIKDGAIVIDVGMNRDDNGKLI 242

Query:  241 GDVVFEQVAEVASMITPVPGGVGPMTITMLLEQTYQAALRS                    281
            GDV F++VAEVA+ ITPVPGGVGPMTI MLLEQTYQ+ALRS
Sbjct:  243 GDVAFDEVAEVAAKITPVPGGVGPMTIAMLLEQTYQSALRS                    283
```

Based on this analysis, it was predicted that these proteins and their epitopes could be useful antigens for vaccines or diagnostics.

Example 81

A DNA sequence (GBSx0081) was identified in *S. agalactiae* <SEQ ID 271> which encodes the amino acid sequence <SEQ ID 272>. Analysis of this protein sequence reveals the following:

```
Possible site: 39
>>> Seems to have no N-terminal signal sequence
INTEGRAL     Likelihood = -3.24    Transmembrane 39-55 (38-58)
----- Final Results -----
``` bacterial membrane --- Certainty = 0.2296 (Affirmative) <succ>
bacterial outside --- Certainty = 0.0000 (Not Clear) <succ>
bacterial cytoplasm --- Certainty = 0.0000 (Not Clear) <succ>

A related GBS nucleic acid sequence <SEQ ID 9623> which encodes amino acid sequence <SEQ ID 9624> was also identified.

The protein has homology with the following sequences in the GENPEPT database:

```
>GP: AAC44613 GB: U58210 orf1091 [Streptococcus thermophilus]
Identities = 149/277 (53%), Positives = 191/277 (68%)
Query:    1 MIVGEQEARALIKPRPKSSHKGDYGSVLLIGGFYPYGGAIIMAALACVKTGAGLVTVATQ   60
            M V +   R +I+PR + SHKG YG VLL+GG YPYGGAIIMAA+ACV +GAGLVTVAT
Sbjct:    1 MKVDDDLVRQVIRPRLRGSHKGSYGRVLLVGGLYPYGGAIIMAAIACVNSGAGLVTVATD  60

Query:   61 SCNIPSLHSQLPEVMAFDSDDYKWLEKSIVQSDVIVIGPGLGVSESSRKILNQTMEKIQS  120
               NI +LH+ LPE MAFD + +    + +DVI+IG GLG  E++   L   + I+S
Sbjct:   61 RENIIALHAHLPEAMAFDLRETERFLDKLRAADVILIGSGLGEEETADWALELVLANIRS 120

Query:  121 HQSVILDGSALTLLSEGAFPQTKAKNLVLTPHQKEWERLSGIAVSQQTKENTQTALKSFP  180
            +Q++++DGSAL LL++         +L+LTPHQKEWERLSG+A+S+Q+  NTQ AL+ F
Sbjct:  121 NQNLVVDGSALNLLAKKNQSSLPKCHLILTPHQKEWERLSGLAISEQSVSNTQRALEEFQ 180

Query:  181 KGTILVAKSSHTRIFQDLDEKEIIVGGPYQATGGMGDTLCGMIAGMLAQFKEASPLDKVS  240
            GTILVAKS   T ++Q +   + VGGPYQATGGMGDTL GM+AG LAQF         V
Sbjct:  181 SGTILVAKSHKTAVYQGAEVTHLEVGGPYQATGGMGDTLAGMVAGFLAQFASTDSYKAVI 240

Query:  241 VGVYLHSAIAQGLSKEAYVVLPTTISDEIPKEMARLS                        277
            V +LHSAIA +++ AYVVLPT IS  IP  M +LS
Sbjct:  241 VATWLHSAIADNIAENAYVVLPTRISKAIPSWMKKLS                        277
```

No corresponding DNA sequence was identified in *S. pyogenes*.

Figure 79:
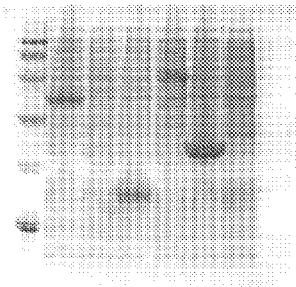
Figure 171:
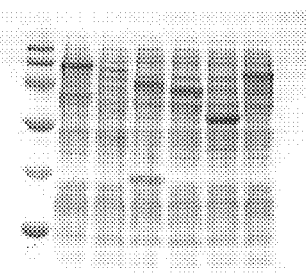

SEQ ID 272 (GBS413) was expressed in *E. coli* as a His-fusion product. SDS-PAGE analysis of total cell extract is shown in FIG. 79 (lane 2; MW 34.2 kDa). It was also expressed in *E. coli* as a GST-fusion product. SDS-PAGE analysis of total cell extract is shown in FIG. 171 (lane 7; MW 59 kDa).

Figure 218:
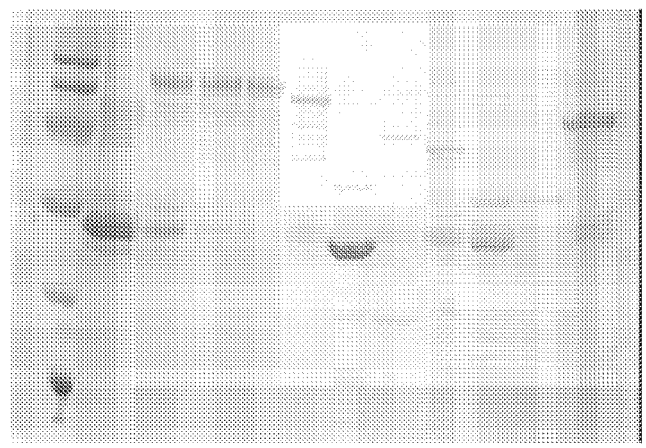

GBS413-GST was purified as shown in FIG. 218, lane 12.

Based on this analysis, it was predicted that these proteins and their epitopes could be useful antigens for vaccines or diagnostics.

Example 82

A DNA sequence (GBSx0082) was identified in *S. agalactiae* <SEQ ID 273> which encodes the amino acid sequence <SEQ ID 274>. This protein is predicted to be Exonuclease VII large subunit (xseA). Analysis of this protein sequence reveals the following:

```
Possible site: 36
>>> Seems to have no N-terminal signal sequence
----- Final Results -----
    bacterial cytoplasm --- Certainty = 0.3172 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database:

```
>GP: CAB14361 GB: Z99116 similar to exodeoxyribonuclease VII (large
subunit) [Bacillus subtilis]

Identities = 193/446 (43%), Positives = 283/446 (63%), Gaps = 10/446 (2%)
Query:     4 YLSVSTLTKYLKLKFDKDPYLERVYLTGQVSNFR-RRPNHQYFSLKDDKSVIQATMWSGH   62
             Y++VS LTKY+K KFD DP+LE +++ G++SN +      H YF+LK+ K  +Q+ M++
Sbjct:     6 YVTVSALTKYIKRKFDVDPHLENIWIKGELSNVKIHTRGHIYFTLKERKGRMQSVMFARQ   65

Query:    63 FKKLGFELEEGMKVNVVGRVQLYEPSGSYSIIVEKAEPDGIGALAIQFEQLKKKLSQAGY  122
             ++L F+ E GMKV V G +  +YEPSG+Y +   ++ +PDG+GAL  +E+LKKKL+   G
Sbjct:    66 SERLPFKPENGMKVLVRGGISVYEPSGNYQLYAKEMQPDGVGALYLAYEELKKKLAGEGL  125

Query:   123 FDDRHKQLIPQFVRKIGVVTSPSGAVIRDIITTVSRRFPGVEILLFPTKVQGEGAAQEIA  182
             FDDR+K+ IP F   IGVVTSP+GA +RD+ITT+ RR+P V++++ P  VQGE A++ I
Sbjct:   126 FDDRYKKQIPAFPATIGVVTSPTGAAVRDVITTLKRRYPLVKVIVLPALVQGENASRSIV  185

Query:   183 QTIALANEKKDLDLLIVGRGGGSIEDLWAFNEECVVEAIFESRLPVISSVGHETDTTLAD  242
               I   ANEK+  D+LIVGRGGGSIE+LWAFNEE V  AIF S +P+IS+VGHETD T++D
Sbjct:   186 TRIEEANEKEICDVLIVGRGGGSIEELWAFNEEIVARAIFASNIPIISAVGHETDFTISD  245

Query:   243 FVADRRAATPTAAAELATPVTKIDILSWITERENRMYQSSLRLIRTKEERLQKSKQSVIF  302
             FVAD RAATPT AAE+A P T  D++    E  RM ++   +  ++ R+Q  + S  F
Sbjct:   246 FVADIRAATPTGAAEIAVPHT-TDLIERTKTAEVRMTRAMQQHLGQEKGRIQTLQSSYAF  304

Query:   303 RQPERLYDGFLQKLD----NLNQQLTYSMRDKLQTVRQKQGLLHQKLQGIDLKQRIHIYQ  358
             R P+RLY     Q+ D       QLT + K + ++   L        LKQ    YQ
Sbjct:   305 RFPKRLYAQKEQQFDLAYQQFQAQLTALLDRKSRQLERETYRLEALHPHEQLKQARTRYQ  364

Query:   359 ERVVQSRRLLSSTMTSQYDSKLARFEKAQDALISLDSSRIVARGYAIIEKNHTLVSTTNG  418
             E+  Q R+      M Q      ++F+    L +L   +++ RGY++  K  L+ + +
Sbjct:   365 EQTNQLRK----NMNIQMKQLHSQFQTVLGKLNALSPLQVMERGYSLAYKEDKLIKSVSQ  420

Query:   419 INEGDHLQVKMQDGLLEVEVKDVRQE                                   444
             I E D L++K++DG+L  EV + R E
Sbjct:   421 IEEQDRLEIKLKDGVLTCEVLEKRGE                                   446
```

A related DNA sequence was identified in *S. pyogenes* <SEQ ID 275> which encodes the amino acid sequence <SEQ ID 276>. Analysis of this protein sequence reveals the following:

```
Possible site: 61
>>> Seems to have no N-terminal signal sequence
----- Final Results -----
   bacterial cytoplasm --- Certainty = 0.3275 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below:

```
Identities = 321/446 (71%), Positives = 386/446 (85%)
Query:    1 MSDYLSVSTLTKYLKLKFDKDPYLERVYLTGQVSNFRRRPNHQYFSLKDDKSVIQATMWS    60
            M+DYL+V+ LTKYLKLKFD+DPYLERVYLTGQVSNFR+RP HQYFSLKD+ +VIQATMW+
Sbjct:    6 MADYLTVTHLTKYLKLKFDRDPYLERVYLTGQVSNFRKRPTHQYFSLKDESAVIQATMWA   65

Query:   61 GHFKKLGFELEEGMKVNVVGRVQLYEPSGSYSIIVEKAEPDGIGALAIQFEQLKKKLSQA  120
            G +KKLGF+LEEGMK+NV+GRVQLYEPSGSYSI++EKAEPDGIGALA+QFEQLKKKL+
Sbjct:   66 GVYKKLGFDLEEGMKINVIGRVQLYEPSGSYSIVIEKAEPDGIGALALQFEQLKKKLTAE  125

Query:  121 GYFDDRHKQLIPQFVRKIGVVTSPSGAVIRDIITTVSRRFPGVEILLFPTKVQGEGAAQE  180
            GYF+ +HKQ +PQFV KIGV+TSPSGAVIRDIITTVSRRFPGVEILLFPTKVQG+GAAQE
Sbjct:  126 GYFEQKHKQPLPQFVSKIGVITSPSGAVIRDIITTVSRRFPGVEILLFPTKVQGDGAAQE  185

Query:  181 IAQTIALANEKKDLDLLIVGRGGGSIEDLWAFNEECVVEAIFESRLPVISSVGHETDTTL  240
            +   I   AN+++DLDLLIVGRGGGSIEDLWAFNEE VV+AIFES+LPVISSVGHETDTTL
Sbjct:  186 VVANIRRANQREDLDLLIVGRGGGSIEDLWAFNEEIVVQAIFESQLPVISSVGHETDTTL  245

Query:  241 ADFVADRRAATPTAAAELATPVTKIDILSWITERENRMYQSSLRLIRTKEERLQKSKQSV  300
            ADFVADRRAATPTAAAELATP+TK D++SWI ER+NR YQ+ LR I+ ++E + K  QSV
Sbjct:  246 ADFVADRRAATPTAAAELATPITKTDLMSWIVERQNRSYQACLRRIKQRQEWVDKLSQSV  305

Query:  301 IFRQPERLYDGFLQKLDNLNQQLTYSMRDKLQTVRQKQGLLHQKLQGIDLKQRIHIYQER  360
            IFRQPERLYD +LQK+D L+   +M+D+L + ++ +   L    L   L+ +I  YQ+R
Sbjct:  306 IFRQPERLYDAYLQKIDRLSMTLMNTMKDRLSSAKENKVQLDHALANSQLQTKIERYQDR  365

Query:  361 VVQSRRLLSSTMTSQYDSKLARFEKAQDALISLDSSRIVARGYAIIEKNHTLVSTTNGIN  420
            V  ++RLL + M SQYDS+LARFEKAQDAL+SLD+SRI+ARGYA+IEKN  LV++ + I
Sbjct:  366 VATAKRLLMANMASQYDSQLARFEKAQDALLSLDASRIIARGYAMIEKNQALVASVSQIT  425

Query:  421 EGDHLQVKMQDGLLEVEVKDVRQENI                                    446
            +GD L +KM+DG L+VEVKDV+ ENI
Sbjct:  426 KGDQLTIKMRDGQLDVEVKDVKNENI                                    451
```

Based on this analysis, it was predicted that these proteins and their epitopes could be useful antigens for vaccines or diagnostics.

Example 83

A DNA sequence (GBSx0083) was identified in *S. agalactiae* <SEQ ID 277> which encodes the amino acid sequence <SEQ ID 278>. Analysis of this protein sequence reveals the following:

```
Possible site: 33
>>> Seems to have no N-terminal signal sequence
----- Final Results -----
   bacterial cytoplasm --- Certainty = 0.2913 (Affirmative) <succ>
   bacterial membrane --- Certainty = 0.0000 (Not Clear) <succ>
   bacterial outside --- Certainty = 0.0000 (Not Clear) <succ>
```

The protein has homology with the following sequences in the GENPEPT database:

```
>GP: AAG07429 GB: AE004821 exodeoxyribonuclease VII small subunit
[Pseudomonas aeruginosa]
Identities = 26/66 (39%), Positives = 51/66 (76%), Gaps = 2/66 (3%)
Query:    1 MSDKKT--FEENLQELETIVSRLETGDVALEDAIAEFQKGMLISKELQRTLKEAEETLVK   58
            M+ KKT   FE++L EL+T+V RLE+G+++LE+++  F++G+ +++E Q +L +AE+ +
Sbjct:    1 MARKKTLDFEQSLTELQTLVERLESGELSLEESLGAFEQGIRLTRECQTSLSQAEQKVQI   60

Query:   59 VMQADG                                                       64
            +++ DG
Sbjct:   61 LLERDG                                                       66
```

A related DNA sequence was identified in *S. pyogenes* <SEQ ID 279> which encodes the amino acid sequence <SEQ ID 280>. Analysis of this protein sequence reveals the following:

```
Possible site: 51
>>> Seems to have no N-terminal signal sequence
----- Final Results -----
  bacterial cytoplasm --- Certainty = 0.2796 (Affirmative) <succ>
  bacterial membrane --- Certainty = 0.0000 (Not Clear) <succ>
  bacterial outside --- Certainty = 0.0000 (Not Clear) <succ>
```

An alignment of the GAS and GBS proteins is shown below:

```
Identities = 55/70 (78%), Positives = 65/70 (92%)
Query:   1 MSDKKTFEENLQELETIVSRLETGDVALEDAIAEFQKGMLISKELQRTLKEAEETLVKVM  60
           MS  KTFEENLQ+LETIV++LE GDV LE+AI+EFQKGML+SKELQ+TL+ AE+TLVKVM
Sbjct:   1 MSKTKTFEENLQDLETIVNKLENGDVPLEEAISEFQKGMLLSKELQKTLQAAEKTLVKVM  60

Query:  61 QADGTEVEMD  70
           QADGTEV+MD
Sbjct:  61 QADGTEVDMD  70
```

Based on this analysis, it was predicted that these proteins and their epitopes could be useful antigens for vaccines or diagnostics.

Example 84

A DNA sequence (GBSx0084) was identified in *S. agalactiae* <SEQ ID 281> which encodes the amino acid sequence <SEQ ID 282>. Analysis of this protein sequence reveals the following:

```
Possible site: 58
>>> Seems to have no N-terminal signal sequence
----- Final Results -----
  bacterial cytoplasm --- Certainty = 0.2614 (Affirmative) <succ>
  bacterial membrane --- Certainty = 0.0000 (Not Clear) <succ>
  bacterial outside --- Certainty = 0.0000 (Not Clear) <succ>
```

The protein has homology with the following sequences in the GENPEPT database:

```
>GP: BAA25265 GB: AB003187 farnesyl diphosphate synthase [Micrococcus
luteus]
Identities = 126/258 (48%), Positives = 175/258 (66%), Gaps = 2/258 (0%)
Query:   27 LIKAILYSVDGGGKRIRPRILLEILEGFGVELIDGHYDVAAALEMIHTGSLIHDDLPAMD   86
            L +AI YS+  GGKRIRP ++L  L+  G    DG       ALEMIHT SLIHDDLPAMD
Sbjct:   31 LHEAINYSLSAGGKRIRPLLVLTTLDSLGGNAHDG-LPFGIALEMIHTYSLIHDDLPAMD   89

Query:   87 NDDFRRGRLTNHKKFDEATAVLAGDSLFLDPFDLVVKAGFKADVTVRLIELLSMSAGSFG  146
            NDD+RRG+LTNHK+FDEATA+LAGD+L  D F  ++     A++ + LI LLS ++GS G
Sbjct:   90 NDDYRRGKLTNHKRFDEATAILAGDALLTDAFQCILNTQLNAEIKLSLINLLSTASGSNG  149

Query:  147 MVGGQMLDMKGENKVLSIDDLSLIHINKTGRLLAYPFVAAGILAEKSEEVKGKLHQAGLL  206
            MV GQMLDM+GE+K L++++L  IHI+KTG L+     V+AGI+   ++    +L+  G
Sbjct:  150 MVYGQMLDMQGEHKTLTLNELERIHIHKTGELIRAAIVSAGIIMNFNDAQIEQLNIIGKN  209

Query:  207 IGHAFQVRDDILDVTASFEELGKTPNKDIVAEKTTYPNLLGLDKSQEILDDTLKKAQAIF  266
            +G  FQ++DDILDV   SFE +GKT   D+  +K+TY +LLGL+ S+++L+D L +
Sbjct:  210 VGLMFQIKDDILDVEGSFENIGKTVGSDLNNDKSTYVSLLGLEASKQLLNDKLTETYDAL  269

Query:  267 QNLEKKANFNARKIIDII                                            284
            + L+    N N + +I  I
Sbjct:  270 KTLQ-PINDNLKTLITYI                                            286
```

A related DNA sequence was identified in *S. pyogenes* <SEQ ID 283> which encodes the amino acid sequence <SEQ ID 284>. Analysis of this protein sequence reveals the following:

```
Possible site: 38
>>> Seems to have no N-terminal signal sequence
----- Final Results -----
   bacterial cytoplasm --- Certainty = 0.3887 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below:

```
Identities = 192/289 (66%), Positives = 237/289 (81%)
Query:    2 MVTIEKIDEAIHRYYKQTHSVVSPDLIKAILYSVDGGGKRIRPRILLEILEGFGVELIDG    61
            M + +IDEAI RYYK T + VS +LI AILYSVD GGKRIRP ILLE++EGFGV L +
Sbjct:    1 MDKLARIDEAIRRYYKTTSNGVSEELIDAILYSVDSGGKRIRPLILLEMIEGFGVSLQNA    60

Query:   62 HYDVAAALEMIHTGSLIHDDLPAMDNDDFRRGRLTNHKKFDEATAVLAGDSLFLDPFDLV   121
            H+D+AAALEMIHTGSLIHDDLPAMDNDD+RRGRLTNHK+F EATA+LAGDSLFLDPF L+
Sbjct:   61 HFDLAAALEMIHTGSLIHDDLPAMDNDDYRRGRLTNHKQFGEATAILAGDSLFLDPFGLI   120

Query:  122 VKAGFKADVTVRLIELLSMSAGSFGMVGGQMLDMKGENKVLSIDDLSLIHINKTGRLLAY   181
             +A   ++V V LI+ LS+++G+FGMVGGQMLDMKGEN+ LS+   LSLIH+NKTG+LLA+
Sbjct:  121 AQAELNSEVKVALIQELSLASGTFGMVGGQMLDMKGENQALSLPQLSLIHLNKTGKLLAF   180

Query:  182 PFVAAGILAEKSEEVKGKLHQAGLLIGHAFQVRDDILDVTASFEELGKTPNKDIVAEKTT   241
            PF AA ++ E++  V+ +L QAG+LIGHAFQ+RDDILDVTASFE+LGKTP KD+ AEK T
Sbjct:  181 PFKAAALITEQAMTVRQQLEQAGMLIGHAFQIRDDILDVTASFEDLGKTPKKDLFAEKAT   240

Query:  242 YPNLLGLDKSQEILDDTLKKAQAIFQNLEKKANFNARKIIDIIEGLRLN             290
            YP+LLGL+ S ++L ++L +A  IFQ LE    F + I +IEGLRLN
Sbjct:  241 YPSLLGLEASYQLLTESLDQALTIFQTLESDVGFKPQIITKLIEGLRLN             289
```

Based on this analysis, it was predicted that these proteins and their epitopes could be useful antigens for vaccines or diagnostics.

Example 85

A DNA sequence (GBSx0085) was identified in *S. agalactiae* <SEQ ID 285> which encodes the amino acid sequence <SEQ ID 286>. This protein is predicted to be hemolysin-like protein (tly). Analysis of this protein sequence reveals the following:

```
Possible site: 37
>>> Seems to have no N-terminal signal sequence
INTEGRAL    Likelihood = -0.75    Transmembrane 152-168 (151-168)
----- Final Results -----
   bacterial membrane --- Certainty = 0.1298 (Affirmative) <succ>
   bacterial outside --- Certainty = 0.0000 (Not Clear) <succ>
   bacterial cytoplasm --- Certainty = 0.0000 (Not Clear) <succ>
```

The protein has homology with the following sequences in the GENPEPT database:

```
>GP: BAB06497 GB: AP001516 hemolysin-like protein [Bacillus halodurans]
Identities = 162/270 (60%), Positives = 202/270 (74%), Gaps = 3/270 (1%)
Query:    3 KERVDVLAYKQGLFDTREQAKRGVMAGMVINVINGERYDKPGEKVADDTELKLKGEKLKY    62
            KERVDVL  ++GL +TRE+AKR +MAG+V +    ER DKPG KV   DT L +KGE L Y
Sbjct:    4 KERVDVLLVERGLMETREKAKRSIMAGLVFS--GHERVDKPGLKVDRDTPLSVKGEVLPY    61

Query:   63 VSRGGLKLEKALQVFEISVADKLTIDIGASTGGFTDVMLQSGARLVYAVDVGTNQLVWKL   122
            VSRGGLKLEKA++ F++ + D++ +DIGASTGGFTD  LQ+GA  VYAVDVG NQL WKL
Sbjct:   62 VSRGGLKLEKAIRAFDLHLTDRVVLDIGASTGGFTDCALQNGATFVYAVDVGYNQLAWKL   121

Query:  123 RQDHRVRSMEQYNFRYAQKEDFKEGLPEFASIDVSFISLNLILPALKEILVDGGQVVALI   182
            RQD RV  ME+ NFRY + E  + GLP  A+IDVSFISL LILP LK +L++    VVAL+
Sbjct:  122 RQDERVVVMERTNFRYLKPEVLERGLPNMATIDVSFISLKLILPVLKTMLLENSDVVALV   181

Query:  183 KPQFEAGREQIGKNGIVKDKLVHEKVLTTVTNFTKDYGYTVKHLDFSPIQGGHGNIEFLM   242
            KPQFEAGRE++GK GIV+DK VH+KVL+T+   F    GY V  LDFSPI GG GNIEFL+
Sbjct:  182 KPQFEAGREEVGKKGIVRDKSVHQKVLSTIVEFALKEGYAVGGLDFSPITGGEGNIEFLL   241

Query:  243 HLQKCQDPQNLV-LDQIQDVIEKAHKEFKK                                271
            HL   +D ++ + + + I+D  +E+AH E KK
Sbjct:  242 HLMWRKDKESFISQEMIRDTVERAHLELKK                                271
```

A related DNA sequence was identified in *S. pyogenes* <SEQ ID 287> which encodes the amino acid sequence <SEQ ID 288>. Analysis of this protein sequence reveals the following:

```
Possible site: 37
>>> Seems to have no N-terminal signal sequence
INTEGRAL     Likelihood = -2.92    Transmembrane 150-166 (149-168)
----- Final Results -----
    bacterial membrane --- Certainty = 0.2168 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the databases:

```
>GP: BAB06497 GB: AP001516 hemolysin-like protein [Bacillus halodurans]
Identities = 156/270 (57%), Positives = 196/270 (71%), Gaps = 3/270 (1%)
Query:    3 KERVDVLAYKQGLFETREQAKRGVMAGLVVSVINGQRYDKPGDKIDDGTELKLKGEKLKY    62
            KERVDVL  ++GL ETRE+AKR +MAGLV S    +R DKPG K+D   T L +KGE L Y
Sbjct:    4 KERVDVLLVERGLMETREKAKRSIMAGLVFS--GHERVDKPGLKVDRDTPLSVKGEVLPY   61

Query:   63 VSRGGLKLEKGLHVFGVSVANQIGIDIGASTGGFTDVMLQDGAKLVYAVDVGTNQLVWKL  122
            VSRGGLKLEK +  F + + +++ +DIGASTGGFTD  LQ+GA  VYAVDVG NQL WKL
Sbjct:   62 VSRGGLKLEKAIRAFDLHLTDRVVLDIGASTGGFTDCALQNGATFVYAVDVGYNQLAWKL  121

Query:  123 RQDPRVRSMEQYNFRYAQPEDFNEGQPVFASIDVSFISLSLILPALHNVLSDQGQVIALI  182
            RQD RV  ME+ NFRY +PE    G P  A+IDVSFISL LILP L  +L +   V+AL+
Sbjct:  122 RQDERVVVMERTNFRYLKPEVLERGLPNMATIDVSFISLKLILPVLKTMLLENSDVVALV  181

Query:  183 KPQFEAGREQIGKKGIVKDKQIHEKVIQKVMDFASGYGFTVKGLDFSPIQGGHGNIEFLA  242
            KPQFEAGRE++GKKGIV+DK +H+KV+   +++FA    G+ V GLDFSPI GG GNIEFL
Sbjct:  182 KPQFEAGREEVGKKGIVRDKSVHQKVLSTIVEFALKEGYAVGGLDFSPITGGEGNIEFLL  241

Query:  243 HLAKSQTPET-LAPHLIQKVVAKAHKEFEK                              271
            HL   + E+ ++  +I+  V +AH E +K
Sbjct:  242 HLMWRKDKESFISQEMIRDTVERAHLELKK                              271
```

An alignment of the GAS and GBS proteins is shown below:

```
Identities = 214/275 (77%), Positives = 238/275 (85%)
Query:    1 MAKERVDVLAYKQGLFDTREQAKRGVMAGMVINVINGERYDKPGEKVADDTELKLKGEKL   60
            M KERVDVLAYKQGLF+TREQAKRGVMAG+V++VING+RYDKPG+K+ D TELKLKGEKL
Sbjct:    1 MPKERVDVLAYKQGLFETREQAKRGVMAGLVVSVINGQRYDKPGDKIDDGTELKLKGEKL   60

Query:   61 KYVSRGGLKLEKALQVFEISVADKLTIDIGASTGGFTDVMLQSGARLVYAVDVGTNQLVW  120
            KYVSRGGLKLEK L VF +SVA+++ IDIGASTGGFTDVMLQ GA+LVYAVDVGTNQLVW
Sbjct:   61 KYVSRGGLKLEKGLHVFGVSVANQIGIDIGASTGGFTDVMLQDGAKLVYAVDVGTNQLVW  120

Query:  121 KLRQDHRVRSMEQYNFRYAQKEDFKEGLPEFASIDVSFISLNLILPALKEILVDGGQVVA  180
            KLRQD RVRSMEQYNFRYAQ EDF EG P FASIDVSFISL+LILPAL  +L D GQV+A
Sbjct:  121 KLRQDPRVRSMEQYNFRYAQPEDFNEGQPVFASIDVSFISLSLILPALHNVLSDQGQVIA  180

Query:  181 LIKPQFEAGREQIGKNGIVKDKLVHEKVLTTVTNFTKDYGYTVKHLDFSPIQGGHGNIEF  240
            LIKPQFEAGREQIGK GIVKDK +HEKV+  V +F    YG+TVK LDFSPIQGGHGNIEF
Sbjct:  181 LIKPQFEAGREQIGKKGIVKDKQIHEKVIQKVMDFASGYGFTVKGLDFSPIQGGHGNIEF  240

Query:  241 LMHLQKCQDPQNLVLDQIQDVIEKAHKEFKKNEEE                          275
            L HL K Q P+ L    IQ V+ KAHKEF+K+E+E
Sbjct:  241 LAHLAKSQTPETLAPHLIQKVVAKAHKEFEKHEKE                          275
```

Figure 57:
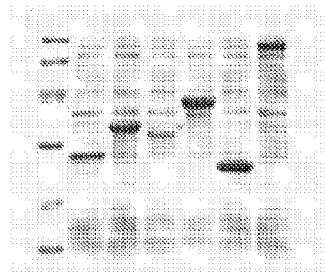
Figure 61:
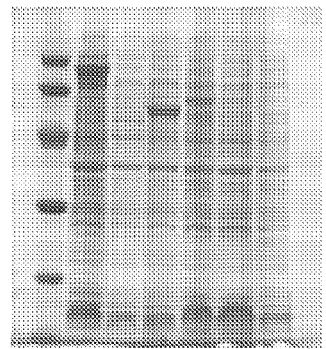

SEQ ID 286 (GBS310) was expressed in *E. coli* as a His-fusion product. SDS-PAGE analysis of total cell extract is shown in FIG. 57 (lane 3; MW 34 kDa). It was also expressed in *E. coli* as a GST-fusion product. SDS-PAGE analysis of total cell extract is shown in FIG. 61 (lane 4; MW 58.8 kDa).

Figure 282:
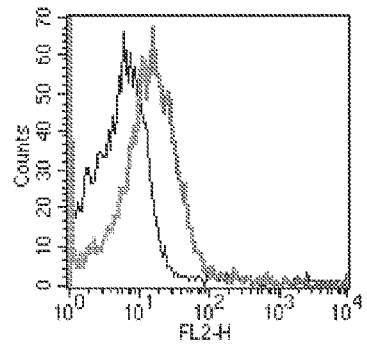

The GBS310-GST fusion product was purified (FIG. 210, lane 10) and used to immunise mice. The resulting antiserum was used for FACS (FIG. 282), which confirmed that the protein is immunoaccessible on GBS bacteria.

Based on this analysis, it was predicted that these proteins and their epitopes could be useful antigens for vaccines or diagnostics.

Example 86

A DNA sequence (GBSx0086) was identified in *S. agalactiae* <SEQ ID 289> which encodes the amino acid sequence <SEQ ID 290>. Analysis of this protein sequence reveals the following:

```
Possible site: 18
>>> Seems to have no N-terminal signal sequence
----- Final Results -----
    bacterial cytoplasm --- Certainty = 0.1966 (Affirmative) <succ>
      bacterial membrane --- Certainty = 0.0000 (Not Clear) <succ>
        bacterial outside --- Certainty = 0.0000 (Not Clear) <succ>
```

The protein has homology with the following sequences in the GENPEPT database:

```
>GP:CAA09426 GB:AJ010954 arginine repressor [Bacillus
stearothermophilus]
Identities = 49/153 (32%), Positives = 84/153 (54%), Gaps = 4/153 (2%)
Query:   1  MKKSERLNLIKQIVLNHAVETQHELLRRLEAYGVTLTQATISRDMNEIGIIKVPSAKGRY    60
            M K +R    I++I++NH +ETQ EL+  L+  G   +TQAT+SRD+ E+ ++KVP A GRY
Sbjct:   1  MNKGQRHIKIREIIMNHEIETQDELVDMLKKAGFNVTQATVSRDIKELQLVKVPMANGRY   60

Query:  61  IYGLSNENDPIFTTAVAKPIKTSILSISDKLLGLEQFININVIPGNSQLIKTFIMSHCQE  120
               Y L  +D  F    + +K +++    KL G    + +  +PGN+   I    + +
Sbjct:  61  KYSL--PSDQRFNP--TQKLKRALMDAFVKLDGSGNLLVLKTLPGNAHAIGVLLDNLDWN  116

Query: 121  HIFSLTADDNSLLLIAKSEADADHIRQSMIAML                            153
                 I      D++ L+I ++   DA+ +    ++ ML
Sbjct: 117  EIVGTICGDDTCLIICRTAEDAEKVSGQLLGML                            149
```

A related DNA sequence was identified in *S. pyogenes* <SEQ ID 291> which encodes the amino acid sequence <SEQ ID 292>. Analysis of this protein sequence reveals the following:

Possible site: 50
>>> Seems to have no N-terminal signal sequence
----- Final Results -----
   bacterial cytoplasm --- Certainty = 0.1717 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below:

```
Identities = 87/154 (56%), Positives = 118/154 (76%), Gaps = 1/154 (0%)
Query:   1  MKKSERLNLIKQIVINHAVETQHELLRRLEAYGVTLTQATISREMNEIGIIKVPSAKGRY    60
            MKKSERL LIK++VL H +ETQH+LLR L  +G+ LTQATISREMNEIGI+K+PS  GRY
Sbjct:  12  MKKSERLELIKKMVLTHPIETQHDLLRLLAEHGLELTQATISREMNEIGIVKIPSGSGRY   71

Query:  61  IYGLSNENDPIFTTAVAKPIKTSILSISDKLLGLEQFININVIPGNSQLIKTFIMSHCQE  120
            IYGLS ++          + IK++IL++SDK  GLEQ + +  V+PGNS+LIK ++++       +
Sbjct:  72  IYGLSQDSGKKIVQG-PRSIKSTILAVSDKTKGLEQHLYLKVVPGNSKLIKRYLLADFSK  130

Query: 121  HIFSLTADDNSLLLIAKSEADADHIRQSMIAMLE                           154
               IFSL ADD+SLLLIAKS ++AD IRQ ++   ++
Sbjct: 131  AIFSLIADDDSLLLIAKSPSEADMIRQEILLWMQ                           164
```

Based on this analysis, it was predicted that these proteins and their epitopes could be useful antigens for vaccines or diagnostics.

Example 87

A DNA sequence (GBSx0088) was identified in *S. agalactiae* <SEQ ID 293> which encodes the amino acid sequence <SEQ ID 294>. Analysis of this protein sequence reveals the following:

Possible site: 15
>>> Seems to have no N-terminal signal sequence
----- Final Results -----
   bacterial cytoplasm --- Certainty = 0.3339 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 88

A DNA sequence (GBSx0089) was identified in *S. agalactiae* <SEQ ID 295> which encodes the amino acid sequence <SEQ ID 296>. This protein is predicted to be DNA repair protein recn (recN). Analysis of this protein sequence reveals the following:

Possible site: 50
>>> Seems to have no N-terminal signal sequence
----- Final Results -----
   bacterial cytoplasm --- Certainty = 0.1651 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database:

```
>GP:CAB14355 GB:Z99116 recN [Bacillus subtilis]
Identities = 244/567 (43%), Positives = 366/567 (64%), Gaps = 18/567 (3%)
Query:   1  MLLEISIKNFAIIEEISLNFETGMTVLTGETGAGKSIIIDAMNMMLGSRASVEVIRHGAN    60
            ML E+SIKNFAIIEE++++FE G+TVLTGETGAGKSIIIDA+++++G R S E +R+G
Sbjct:   1  MLAELSIKNFAIIEELTVSFERGLTVLTGETGAGKSIIIDAISLLVGGRGSSEFVRYGEA    60

Query:  61  KAEIEGFFSVEKNQSLVQLLEENGIELADELII-RREIFQNGRSVSRINGQMVNLSTLKA    119
            KAE+EG F +E    ++ +  E GI+++DE+I+ RR+I  +G+SV R+NG++V +++L+
Sbjct:  61  KAELEGLFLLESGHPVLGVCAEQGIDVSDEMIVMRRDISTSGKSVCRVNGKLVTIASLRE    120

Query: 120  VGHYLVDIYGQHDQEELMKPNMHILMLDEFGNTEFNVIKERYQSLFDAYRQLRKRVLDKQ    179
            +G  L+DI+GQHD + LM+    H+ +LD+F  E    + YQ   Y +L K++
Sbjct: 121  IGRLLLDIHGQHDNQLLMEDENHLQLLDKFAGAEVESALKTYQEGYQRYVkLLKKLKQLS    180

Query: 180  KNEQENKSRIEMLEFQIAEIESVALKSDEDQTLLKQRDKLMNHKNIADTLTNAYLMLDNE    239
            ++EQE    +++++FQ+ EIES L+ +ED+ L ++R ++ N + ++L NAY  L +E
Sbjct: 181  ESEQEMAHCLDLIQFQLEEIESAKLELNEDEQLQEERQQISNFEKIYESLQNAYNALRSE    240

Query: 240  EFSSLSNVRSAMNDLMALEEFDREYKDLSTNLSEAYYVIEEVTKRLGDVIDDLDFDAGLL    299
            +   L  V A   L + +      K +S ++S +YY++E+ T ++ +++D+L+FD    L
Sbjct: 241  Q-GGLDWVGMASAQLEDISDINEPLKKMSESVSNSYYLLEDATFQMRNMLDELEFDPERL    299

Query: 300  QEIENRLDVINTITRKYGGDVNDVLDYFDNITKEYSLLTGSEESSDALEKELKILEHDLI    359
               IE RL+ I  + RKYG  V D+L+Y   I +E   +     +L+KEL  + D+
Sbjct: 300  NYIETRLNEIKQLKRKYGATVEDILEYASKIEEEIDQIENRDSHLQSLKKELDSVGKDVA    359

Query: 360  ESANQLSLERHKLAKQLENEIKQELTELYMEKADFQVQFTKG----------------KF    403
                  A  +S  R   AK+L +EI +EL  LYMEK+ F  +F                +
Sbjct: 360  VEAANVSQIRKTWAKKLADEIHRELKSLYMEKSTFDTEFKVRTASRNEEAPLVNGQPVQL    419

Query: 404  NKEGNEIVEFYISTNPGEGFKPLVKVASGGELSRLMLAIKSAFSRKEDKTSIVFDEVDTG    463
             ++G ++V+F ISTN GE   K L KVASGGELSR+MLAIKS FS ++D TSI+FDEVDTG
Sbjct: 420  TEQGIDLVKFLISTNTGEPLKSLSKVASGGELSRVMLAIKSIFSSQQDVTSIIFDEVDTG    479

Query: 464  VSGRVAQAIAQKIHKIGSHGQVLAISHLAQVIAIADYQYFIEKISSDSSTVSTVRLLSYE    523
            VSGRVAQAIA+KIHK+     QVL I+HL QV A+AD   +I K    D  T + V+ LS +
Sbjct: 480  VSGRVAQAIAEKIHKVSIGSQVLCITHLPQVAAMADTHLYIAKELKDGRTITRVKPLSKQ    539

Query: 524  ERVEEIAKMLAGNNVTDTARTQAKELL                                  550
            E+V EI + +AG  VTD  +  AKELL
Sbjct: 540  EKVAEIERSIAGVEVTDLTKRHAKELL                                  566
```

A related DNA sequence was identified in *S. pyogenes* <SEQ ID 297> which encodes the amino acid sequence <SEQ ID 298>. Analysis of this protein sequence reveals the following:

Possible site: 51
>>> Seems to have no N-terminal signal sequence

----- Final Results -----
bacterial cytoplasm --- Certainty = 0.1215 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below:

```
Identities = 403/550 (73%), Positives = 472/550 (85%)
Query:   1  MLLEISIKNFAIIEEISLNFETGMTVLTGETGAGKSIIIDAMNMMLGSRASVEVIRHGAN    60
            MLLEISIKNFAII+EISLNFE GMTVLTGETGAGKSIIIDAMNMMLG+RAS EVIR GAN
Sbjct:   2  MLLEISIKNFAIIDEISLNFENGMTVLTGETGAGKSIIIDAMNMMLGARASTEVIRRGAN    61

Query:  61  KAEIEGFFSVEKNQSLVQLLEENGIELADELIIRREIFQNGRSVSRINGQMVNLSTLKAV    120
            KAEIEGFFSV+    LV LE +GI + +ELIIRR+IF NGRSVSRINGQMVNL+TLK V
Sbjct:  62  KAEIEGFFSVDATPELVACLESSGIAMEEELIIRRDIFANGRSVSRINGQMVNLATLKQV    121

Query: 121  GHYLVDIYGQHDQEELMKPNMHILMLDEFGNTEFNVIKERYQSLFDAYRQLRKRVLDKQK    180
            G +LVDI+GQHDQEELM+P +H  +LD FG+  F  +KE YQ  +FD Y+ LR++V+DKQK
Sbjct: 122  GQFLVDIHGQHDQEELMRPQLHQQILDAFGDKAFEQLKENYQLIFDRYKSLRRQVIDKQK    181

Query: 181  NEQENKSRIEMLEFQIAEIESVALKSDEDQTLLKQRDKLMNHKNIADTLTNAYLMLDNEE    240
            NE+E+K RI+ML FQIAEIE+ AL   ED L ++RD+LMNHK IADTLTNAY+MLDN++
Sbjct: 182  NEKEHKDRIDMLAFQIAEIEAAALSRGEDDRLNQERDRLMNHKQIADTLTNAYVMLDNDD    241

Query: 241  FSSLSNVRSAMNDLMALEEFDREYKDLSTNLSEAYYVIEEVTKRLGDVIDDLDFDAGLLQ    300
            FSSLSN+RS+MNDL++ +E+FD EYK +ST++SEAYY++EEV+K+L D ID LDFD G LQ
Sbjct: 242  FSSLSNIRSSMNDLLSIEQFDSEYKGMSTSISEAYYILEEVSKQLSDTIDQLDFDGGRLQ    301
```

```
                               -continued
Query:  301  EIENRLDVINTITRKYGGDVNDVLDYFDNITKEYSLLTGSEESSDALEKELKILEHDLIE   360
             EIE RLD++N++TRKYGG+VNDVLDY+DNI KEY LLTG + SS  LE ELK LE   L+
Sbjct:  302  EIEFRLDILNSLTRKYGGNVNDVLDYYDNIVKEYQLLTGDDLSSGDLEAELKSLEKQLVA   361

Query:  361  SANQLSLERHKLAKQLENEIKQELTELYMEKADFQVQFTKGKFNKEGNEIVEFYISTNPG   420
             +A++LS+ RH+LA+QLE EIK EL ELYMEKADF+V FT  KFN++GNE +EFYISTNPG
Sbjct:  362  AASELSVSRHQLAEQLEAEIKAELKELYMEKADFKVHFTTSKFNRDGNESLEFYISTNPG   421

Query:  421  EGFKPLVKVASGGELSRLMLAIKSAFSRKEDKTSIVFDEVDTGVSGRVAQAIAQKIHKIG   480
             EGFKPLVKVASGGELSRLMLAIK+A SRKEDKTSIVFDEVDTGVSGRVAQAIAQKI+KIG
Sbjct:  422  EGFKPLVKVASGGELSRLMLAIKAAISRKEDKTSIVFDEVDTGVSGRVAQAIAQKIYKIG   481

Query:  481  SHGQVLAISHLAQVIAIADYQYFIEKISSDSSTVSTVRLLSYEERVEEIAKMLAGNNVTD   540
              HGQVLAISHL QVIAIADYQYFI K S + STVS VRLL+ EERVEEIA M+AG ++T
Sbjct:  482  RHGQVLAISHLPQVIAIADYQYFISKESKEESTVSKVRLLTPEERVEEIASMIAGTDMTQ   541

Query:  541  TARTQAKELL                                                   550
              A TQA+ELL
Sbjct:  542  AALTQARELL                                                   551
```

Based on this analysis, it was predicted that these proteins and their epitopes could be useful antigens for vaccines or diagnostics.

Example 89

A DNA sequence (GBSx0090) was identified in *S. agalactiae* <SEQ ID 299> which encodes the amino acid sequence <SEQ ID 300>. This protein is predicted to be degV protein. Analysis of this protein sequence reveals the following:

---
Possible site: 38
>>> Seems to have no N-terminal signal sequence
INTEGRAL     Likelihood = −0.96    Transmembrane 246-262 (246-262)
----- Final Results -----
    bacterial membrane --- Certainty = 0.1383 (Affirmative) <succ>
        bacterial outside --- Certainty = 0.0000 (Not Clear) <succ>
        bacterial cytoplasm --- Certainty = 0.0000 (Not Clear) <succ>
---

The protein has homology with the following sequences in the GENPEPT database:

A related DNA sequence was identified in *S. pyogenes* <SEQ ID 301> which encodes the amino acid sequence <SEQ ID 302>. Analysis of this protein sequence reveals the following:

---
Possible site: 37
>>> Seems to have no N-terminal signal sequence
INTEGRAL     Likelihood = −1.54    Transmembrane 180-196 (180-196)
INTEGRAL     Likelihood = −0.16    Transmembrane 21-37 (21-38)
----- Final Results -----
    bacterial membrane --- Certainty = 0.1617 (Affirmative) <succ>
        bacterial outside --- Certainty = 0.0000 (Not Clear) <succ>
        bacterial cytoplasm --- Certainty = 0.0000 (Not Clear) <succ>
---

An alignment of the GAS and GBS proteins is shown below:

```
>GP:BAB07346 GB:AP001519 unknown conserved protein [Bacillus halodurans]
Identities = 93/277 (33%), Positives = 152/277 (54%), Gaps = 4/277 (1%)
Query:    1  MSKIKIVTDSSITIEPELIKELDITVVPLSVMIDGTLYSDNDLKAQGEFLNLMRGSKELP    60
             M+KI IVTDS+  + P+  KEL + VVPLSV+      Y +    +F  ++   ++LP
Sbjct:    1  MTKIAIVTDSTAYLGPKRAKELGVIVVPLSVVFGEEAYQEEVELSSADFYEKLKHEEKLP    60

Query:   61  KTSQPPVGVFAEIYEKLMNEGVEHIIAIHLTHTLSGTIE-ASRQGANIAGADVTVIDSTF   119
               TSQP VG+F  E +E+L  EG E +I+IHL+  +SGT + A    G+ + G +V  DS
Sbjct:   61  TTSQPAVGLFVETFERLAKEGFEVVISIHLSSKISGTYQSALTAGSMVEGIEVIGYDSGI   120

Query:  120  TDQCQKFQVVEAAKLAKEGADLDTILARVEEVRQKSELFIGVSTLENLVKGGRIGRVTGL   179
             + + Q   V EAAKL KEGAD  TI+  ++EV++++     V  L +L +GGR+        +
Sbjct:  121  SCEPQANFVAEAAKLVKEGADPQTIIDHLDEVKKRTNALFVVHDLSHLHRGGRLNAAQLV   180

Query:  180  LSSLLNIKVIMELTNHELVPIVKGR-GLKTFSKWLDNFVESAQTRKIAEIGISYCGKADM   238
             + SLL IK I+    + +VP+ K R    K     +    + F E A +     + ++  + D
Sbjct:  181  VGSLLKIKPILHFEDGSIVPLEKVRTEKKAWARVKELFAEEASSASSVKATVIHANRLDG   240

Query:  239  ANNFREKL--AVLGAPISVLETGSIIQTHTGEDAFAV                         273
             A    +++            +S+      G +I TH GE +   +
Sbjct:  241  AEKLADEIRSQFSHVDVSISHFGPVIGTHLGEGSIGL                         277
```

```
Identities = 197/279 (70%), Positives = 226/279 (80%), Gaps = 1/279 (0%)
Query:   1  MSKIKIVTDSSITIEPELIKELDITVVPLSVMIDGTLYSDNDLKAQGEFLNLMRGSKELP   60
            M IKIVTDSSITIEPELIK LDITVVPLSVMID LYSDNDLK +G FL+LM+ SK LP
Sbjct:   5  MGTIKIVTDSSITIEPELIKALDITVVPLSVMIDSKLYSDNDLKEEGHFLSLMKASKSLP   64

Query:  61  KTSQPPVGVFAEIYEKLMNEGVEHIIAIHLTHTLSGTIEASRQGANIAGADVTVIDSTFT  120
            KTSQPPVG+FAE YE L+ +GV  I+AIHL+  LSGTIEASRQGA IA A VTV+DS FT
Sbjct:  65  KTSQPPVGLFAETYENLVKKGVTDIVAIHLSPALSGTIEASRQGAEIAEAPVTVLDSGFT  124

Query: 121  DQCQKFQVVEAAKLAKEGADLDTILARVEEVRQKSELFIGVSTLENLVKGGRIGRVTGLL  180
            DQ  KFQVVEAAK+AK GA L+ ILA V+ ++ K+EL+IGVSTLENLVKGGRIGRVTG+L
Sbjct: 125  DQAMKFQVVEAARMAKAGASLNEILAAVQAIKSKTELYIGVSTLENLVKGGRIGRVTGVL  184

Query: 181  SSLLNIKVIMELTNHELVPIVKGRGLKTFSKWLDNFVESAQTRKIAEIGISYCGKADMAN  240
            SSLLN+KV+M L N EL  +VKGRG KTF+KWLD+++    R IAEI ISY G+A +A
Sbjct: 185  SSLLNVKVVMALKNDELKTLVKGRGNKTFIKWLDSYLAKNSHRPIAEIAISYAGEASLAL  244

Query: 241  NFREKLAV-LGAPISVLETGSIIQTHTGEDAFAVMVRYE                      278
                +E++A         ISVLETGSIIQTHTGE AFAVMVRYE
Sbjct: 245  TLKERIAAYYNHSISVLETGSIIQTHTGEGAFAVMVRYE                      283
```

Figure 201:
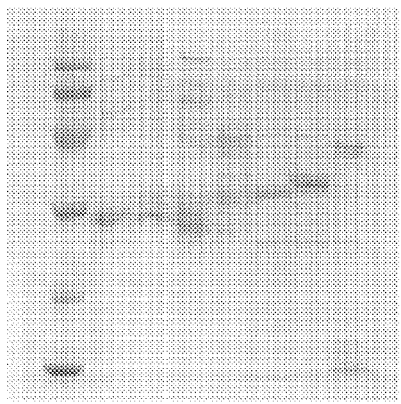

SEQ ID 300 (GBS113) was expressed in *E. coli* as a His-fusion product. Purified protein is shown in FIG. 201, lane 8.

Based on this analysis, it was predicted that these proteins and their epitopes could be useful antigens for vaccines or diagnostics.

Example 90

A DNA sequence (GBSx0092) was identified in *S. agalactiae* <SEQ ID 307> which encodes the amino acid sequence <SEQ ID 308>. Analysis of this protein sequence reveals the following:

Possible site: 28
>>> Seems to have a cleavable N-term signal seq.
----- Final Results -----
  bacterial outside --- Certainty = 0.3000 (Affirmative) <succ>
    bacterial membrane --- Certainty = 0.0000 (Not Clear) <succ>
      bacterial cytoplasm --- Certainty = 0.0000 (Not Clear) <succ>

The protein has homology with the following sequences in the GENPEPT database:

A related DNA sequence was identified in *S. pyogenes* <SEQ ID 309> which encodes the amino acid sequence <SEQ ID 310>. Analysis of this protein sequence reveals the following:

Possible site: 29
>>> Seems to have a cleavable N-term signal seq.
----- Final Results -----
  bacterial outside --- Certainty = 0.3000 (Affirmative) <succ>
  bacterial membrane --- Certainty = 0.0000 (Not Clear) <succ>
  bacterial cytoplasm --- Certainty = 0.0000 (Not Clear) <succ>

The protein has homology with the following sequences in the databases:

```
>GP:CAA72097 GB:Y11213 hypothetical protein [Streptococcus thermophilus]
Identities = 75/185 (40%), Positives = 116/185 (62%), Gaps = 3/185 (1%)
Query:  13  WKWAFLLLLAINLSFTAVIASRLIQVREPNTGKISTGVQDKVKVGTFTTNKSQLNKTIAL   72
            WKW FL LLA+NL+  +V+ R++   E +   + G      K+G ++ +K +L++++
Sbjct:   5  WKWLFLGLLALNLALISVVTVRIMTPVETSPVSLPKGA---TKIGKYSMSKEELDESLRG   61

Query:  73  YLKQYQTKKMNYKIYAASSSILFEGSYQLLGYEVPLYIYFEPYRLTNGAVQLKVTSFSVG  132
            + + Y T KM +K+    +S I+FE SY++LG+ VPLY+YF P    +GAV L+ +  S G
Sbjct:  62  FAQDYSTDKMRFKVKVTNSKIVFESSYKVLGHAVPLYVYFTPLVSESGAVVLQESELSAG  121

Query: 133  TLPLPEKDVLQYIKSSYKLPNFVDIKPKKSVININLQDLKNKEGIYLKATAIDLVNDNFS  192
            TL LP  D L  IK S KLP+++ I  KK  +N+Q +KN +GI  +A + DLVND
Sbjct: 122  TLKLPILDALNMIKRSTKLPDYIVIDSKKGKVILNIQSMKNDKGITARAQSFDLVNDRSE  181

Query: 193  FDIFK                                                        197
            FDI+K
Sbjct: 182  FDIYK                                                        186
```

```
>GP:CAA72097 GB:Y11213 hypothetical protein [Streptococcus thermophilus]
Identities = 73/185 (39%), Positives = 112/185 (60%), Gaps = 3/185 (1%)
Query:   10 WKWSFLCLLAFNTAFLMVIASRLIQVREPESELIAKKPVKNIKIGTFVTIREQLNETVAS   69
            WKW FL LLA N A + V+  R++     E       + K    K   IG +   ++E+L+E++
Sbjct:    5 WKWLFLGLLALNLALISVVTVRIMTPVETSPVSLPKGATK---IGKYSMSKEELDESLRG   61

Query:   70 YLKDYQTEKMSYKFYATSSSILFEGTYQLLGYEVPLYIYFQPHRLENGAVQLQVISFSVG  129
             + +DY T+KM +K     T+S I+FE +Y++LG+ VPLY+YF P   E+GAV LQ    S G
Sbjct:   62 FAQDYSTDKMRFKVKVTNSKIVFESSYKVLGHAVPLYVYFTPLVSESGAVVLQESELSAG  121

Query:  130 TLPLPEKDVLQYLKSSYKLPSFVKVMPNQSAIVVNLQDIQNDAKVYLKAKKIDLFNDEIS  189
            TL LP   D L  +K S KLP ++ +    +   +++N+Q ++ND   +A+  DL  ND
Sbjct:  122 TLKLPILDALNMIKRSTKLPDYIVIDSKKGKVILNIQSMKNDKGITARAQSFDLVNDRSE  181

Query:  190 FNIYK                                                         194
            F+IYK
Sbjct:  182 FDIYK                                                         186
```

An alignment of the GAS and GBS proteins is shown below:

```
Identities = 129/194 (66%), Positives = 155/194 (79%)
Query:    5 KTGRNLNFWKWAFLLLLAINLSFTAVIASRLIQVREPNTGKISTGVQDKVKVGTFTTNKS   64
            K   NLN+WKW+FL LLA N +F  VIASRLIQVREP +  I+       +K+GTF T +
Sbjct:    2 KKKSNLNWWKWSFLCLLAFNTAFLMVIASRLIQVREPESELIAKKPVKNIKIGTFVTTRE   61

Query:   65 QLNKTIALYLKQYQTKKMNYKIYAASSSILFEGSYQLLGYEVPLYIYFEPYRLTNGAVQL  124
            QLN+T+A YLK YQT+KM+YK YA SSSILFEG+YQLLGYEVPLYIYF P+RL NGAVQL
Sbjct:   62 QLNETVASYLKDYQTEKMSYKFYATSSSILFEGTYQLLGYEVPLYIYFQPHRLENGAVQL  121

Query:  125 KVTSFSVGTLPLPEKDVLQYIKSSYKLPNFVDIKPKKSVININLQDLKNKEGIYLKATAI  184
            +V SFSVGTLPLPEKDVLQY+KSSYKLP+FV + P +S I +NLQD++N     +YLKA   I
Sbjct:  122 QVISFSVGTLPLPEKDVLQYLKSSYKLPSFVKVMPNQSAIVVNLQDIQNDAKVYLKAKKI  181

Query:  185 DLVNDNFSFDIFKK                                                198
            DL ND  SF+I+KK
Sbjct:  182 DLFNDEISFNIYKK                                                195
```

Based on this analysis, it was predicted that these proteins and their epitopes could be useful antigens for vaccines or diagnostics.

A related GBS gene <SEQ ID 8487> and protein <SEQ ID 8488> were also identified. Analysis of this protein sequence reveals the following:

---

Lipop: Possible site: –1 Crend: 7
McG: Discrim Score: 7.47
GvH: Signal Score (–7.5): 2.42
Possible site: 28
>>> Seems to have a cleavable N-term signal seq.
ALOM program    count: 0 value: 5.89 threshold: 0.0
PERIPHERAL            Likelihood = 5.89          120
modified ALOM score: –1.68
*** Reasoning Step: 3
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

---

Figure 244:
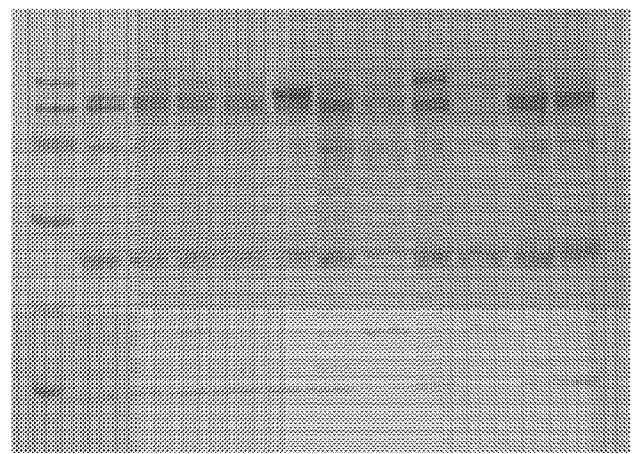

SEQ ID 308 (GBS20) was expressed in *E. coli* as a His-fusion product. SDS-PAGE analysis of total cell extract is shown in FIG. 4 (lane 5; MW 25 kDa) and in FIG. 167 (lane 12-14; MW 37 kDa—thioredoxin fusion). It was also expressed in *E. coli* as a GST-fusion product. SDS-PAGE analysis of total cell extract is shown in FIG. 9 (lane 7; MW 47.6 kDa). Purified Thio-GBS20-His is shown in FIG. 244, lane 12.

Example 91

A DNA sequence (GBSx0093) was identified in *S. agalactiae* <SEQ ID 311> which encodes the amino acid sequence <SEQ ID 312>. This protein is predicted to be histone-like DNA-binding protein. Analysis of this protein sequence reveals the following:

---

Possible site: 40
>>> Seems to have no N-terminal signal sequence
----- Final Results -----
   bacterial cytoplasm --- Certainty = 0.2768 (Affirmative) <succ>
      bacterial membrane --- Certainty = 0.0000 (Not Clear) <succ>
         bacterial outside --- Certainty = 0.0000 (Not Clear) <succ>

---

A related GBS nucleic acid sequence <SEQ ID 9313> which encodes amino acid sequence <SEQ ID 9314> was also identified.

The protein has homology with the following sequences in the GENPEPT database:

```
>GP:AAD40810 GB:L40355 histone-like DNA-binding protein
[Streptococcus mutans]
Identities = 43/47 (91%), Positives = 46/47 (97%)
Query: 1   MANKQDLIAKVAEATELTKKDSAAAVDAVFAAVADYLAEGEKVQLIG  47
           MANKQDLIAKVAEATELTKKDSAAAVDAVF+AV+ YLA+GEKVQLIG
Sbjct: 1   MANKQDLIARVAEATELTKKDSAAAVDAVFSAVSSYLAKGEKVQLIG  47
```

A related DNA sequence was identified in *S. pyogenes* <SEQ ID 313> which encodes the amino acid sequence <SEQ ID 314>. Analysis of this protein sequence reveals the following:

Possible site: 25
>>> Seems to have no N-terminal signal sequence
----- Final Results -----
   bacterial cytoplasm --- Certainty = 0.2834 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below:

```
Identities = 41/47 (87%), Positives = 44/47 (93%)
Query: 1   MANKQDLIAKVAEATELTKKDSAAAVDAVFAAVADYLAEGEKVQLIG   47
           MANKQDLIAKVAEATELTKKDSAAAVDAVF+ +   +LAEGEKVQLIG
Sbjct: 1   MANKQDLIAKVAEATELTKKDSAAAVDAVFSTIEAFLAEGEKVQLIG   47
```

Based on this analysis, it was predicted that these proteins and their epitopes could be useful antigens for vaccines or diagnostics.

Example 92

A DNA sequence (GBSx0094) was identified in *S. agalactiae* <SEQ ID 315> which encodes the amino acid sequence <SEQ ID 316>. Analysis of this protein sequence reveals the following:

Possible site: 54
>>> Seems to have no N-terminal signal sequence
----- Final Results -----
   bacterial cytoplasm --- Certainty = 0.2722 (Affirmative) <succ>
     bacterial membrane --- Certainty = 0.0000 (Not Clear) <succ>
       bacterial outside --- Certainty = 0.0000 (Not Clear) <succ>

A related GBS nucleic acid sequence <SEQ ID 9293> which encodes amino acid sequence <SEQ ID 9294> was also identified. A further related GBS nucleic acid sequence <SEQ ID 10793> which encodes amino acid sequence <SEQ ID 10794> was also identified.

The protein has homology with the following sequences in the GENPEPT database:

```
>GP:AAD17886 GB:AF100456 hyaluronate-associated protein precursor
[Streptococcus equi]
Identities = 303/435 (69%), Positives = 360/435 (82%), Gaps = 1/435 (0%)
Query:   1 MATKVDVSKDGLTYTATLRKGLKWSDGSKLTAKDFVYSWQRLVDPKTASQYAYLAVEGHV    60
           +A KVDVS+DGLTYTATLR GLKWSDGS LTA+DFVYSWQR+VDPKTAS+YAYLA E H+
Sbjct:  87 LAEKVDVSEDGLTYTATLRDGLKWSDGSDLTAEDFVYSWQRMVDPKTASEYAYLATESHL   146

Query:  61 LNADKINEGQEKDLNKLGVKAEGDDKVVITLSSPSPQFIYYLAFTNFMPQKQEVVEKYGK   120
             NA+ IN G+  DL+ LGVKA+G+ KV+ TL+ P+PQF   L+F+NF+PQK+ V+  GK
Sbjct: 147 KNAEDINSGKNPDLDSLGVKADGN-KVIFTLTEPAPQFKSLLSFSNFVPQKESFVKDAGK   205

Query: 121 DYATTSKNTVYSGPYTVEGWNGSNGTFTLKKNKNYWDAKNVKTKEVRIQTVKKPDTAVQM   180
           DY TTS+  +YSGPY V+ WNG++GTF L KNKNYWDAKNVKT+ V +QTVKKPDTAVQM
Sbjct: 206 DYGTTSEKQIYSGPYIVEDWNGTSGTFKLVKNKNYWDAKNVKTETVNVQTVKKPDTAVQM   265

Query: 181 YKRGELDAANISNTSAIYQANKNNKDVTDVLEATTAYMEYNTTGSVKGLDNVKIRRALNL   240
           YK+G+LD ANIS TSAIY ANK +KDV  VLEATTAY+ YN TG+++GL+++KIR+ALNL
Sbjct: 266 YKQGKLDFANISGTSAIYNANKKHKDVVPVLEATTAYIVYNQTGAIEGLNSLKIRQALNL   325

Query: 241 ATNRKGVVQAAVDTGSKPAIAFAPTGLAKTPDGTDLAKYVAPGYEYNKTEAAKLFKEGLA   300
           AT+RKG+V AAVDTGSKPA A  PTGLAK  DGTDL ++VAPGY+Y+  EAAKLFKEGLA
Sbjct: 326 ATDRKGIVSAAVDTGSKPATALVPTGLAKLSDGTDLTEHVAPGYKYDDKEAAKLFKEGLA   385

Query: 301 ESGLTKLKLTITADADAPAAKNSVDYIKSTWEAALPGLTVEEKFVTFKQRLEDSRKQNFD   360
           E G   L +TITADADAPAAK++VDYIK  TWE ALPGLTVEEKFV FKQRLED++ QNF+
Sbjct: 386 ELGKDALTITITADADAPAAKSAVDYIKETWETALPGLTVEEKFVPFKQRLEDTKNQNFE   445

Query: 361 IVVSLWGGDYPEGSTFYGLFKSDSQNNDGKFANKDYDAAYNKAISEDAMKPAESAKDYKE   420
           + V LWGGDYP+GSTFYGLFKS S  N GKF N DYDAAYNKA++ DA+    +A DYK
Sbjct: 446 VAVVLWGGDYPKGSTFYGLFKSGSAYNYGKFTNADYDAAYNKALTTDALNTDAAADDYKA   505

Query: 421 AEKILFEQGAYNPLY                                               435
           AEK L++    YNPLY
Sbjct: 506 AEKALYDNALYNPLY                                               520
```

A related GBS gene <SEQ ID 8489> and protein <SEQ ID 8490> were also identified. Analysis of this protein sequence reveals the following:

Lipop: Possible site: 21 Crend: 4
Sequence Pattern: CGSK
SRCFLG: 0
McG: Length of UR: 19
Peak Value of UR: 2.34
Net Charge of CR: 3
McG: Discrim Score: 5.94
GvH: Signal Score (−7.5): 0.6
Possible site: 20

>>> May be a lipoprotein
Amino Acid Composition: calculated from 22
ALOM program   count: 0 value: 5.14 threshold: 0.0
  PERIPHERAL             Likelihood = 5.14           166
  modified ALOM score: −1.53
*** Reasoning Step: 3
----- Final Results -----
  bacterial membrane --- Certainty = 0.0000 (Not Clear) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP|4336671|gb|AAD17886.1||AF100456 hyaluronate-associated protein
precursor {Streptococcus equi}
Score = 721 bits (1840), Expect = 0.0
Identities = 354/515 (68%), Positives = 417/515 (80%), Gaps = 2/515 (0%)
Query:   1 KNWRRVGVGVLTLASVATLAACGSK-SASQDSNGAINWAIPTEINTLDLSKVTDTYSNLA    59
           K  +R+G+  +TLASVA L ACG+K SAS D    INW PTEI TLD+SK TDTYS LA
Sbjct:   7 KACKRLGLAAVTLASVAALMACGNKQSASTDKKSEINWYTPTEIITLDISKNTDTYSALA    66

Query:  60 IGNSSSNFLRLDKDGKTRPDLATKVDVSKDGLTYTATLRKGLKWSDGSKLTAKDFVYSWQ   119
           IGNS SN LR D  GK +PDLA KVDVS+DGLTYTATLR GLKWSDGS LTA+DFVYSWQ
Sbjct:  67 IGNSGSNLLRADAKGKLQPDLAEKVDVSEDGLTYTATLRDGLKWSDGSDLTAEDFVYSWQ   126

Query: 120 RLVDPKTASQYAYLAVEGHVLNADKINEGQEKDLNKLGVKAEGDDKVVITLSSPSPQFIY   179
           R+VDPKTAS+YAYLA E H+ NA+ IN G+  DL+ LGVKA+G+ KV+ TL+ P+PQF
Sbjct: 127 RMVDPKTASEYAYLATESHLKNAEDINSGKNPDLDSLGVKADGN-KVIFTLTEPAPQFKS   185

Query: 180 YLAFTNFMPQKQEVVEKYGKDYATTSKNTVYSGPYTVEGWNGSNGTFTLKKNKNYWDAKM   239
           L+F+NF+PQK+ V+  GKDY TTS+  +YSGPY V+ WNG++GTF L KNKNYWDAKN
Sbjct: 186 LLSFSNFVPQKESFVKDAGKDYGTTSEKQIYSGPYIVKDWNGTSGTFKLVKNKNYWDAKN   245

Query: 240 VKTKEVRIQTVKKPDTAVQMYKRGELDAANISNTSAIYQANKNNKDVTDVLEATTAYMEY   299
           VKT+ V +QTVKKPDTAVQMYK+G+LD ANIS TSAIY ANK +KDV  VLEATTAY+ Y
```

```
                         -continued
Sbjct: 246  VKTETVNVQTVKKPDTAVQMYKQGKLDFANISGTSAIYNANKKHKDVVPVLEATTAYIVY  305

Query: 300  NTTGSVKGLDNVKIRRALNLATNRKGVVQAAVDTGSKPAIAFAPTGLAKTPDGTDLAKYV  359
            N TG+++GL+++KIR+ALNLAT+RKG+V AAVDTGSKPA A  PTGLAK  DGTDL ++V
Sbjct: 306  NQTGAIEGLNSLKIRQALNLATDRKGIVSAAVDTGSKPATALVPTGLAKLSDGTDLTEHV  365

Query: 360  APGYEYNKTEAAKLFKEGLAESGLTKLKLTITADADAPAAKNSVDYIKSTWEAALPGLTV  419
            APGY+Y+  EAAKLFKEGLAE G   L +TITADADAPAAK++VDYIK TWE ALPGLTV
Sbjct: 366  APGYKYDDKEAAKLFKEGLAELGKDALTITITADADAPAAKSAVDYIKETWETALPGLTV  425

Query: 420  EEKFVTFKQRLEDSRKQNFDIVVSLWGGDYPEGSTFYGLFKSDSQNNDGKFANKDYDAAY  479
            EEKFV FKQRLED++ QNF++ V LWGGDYP+GSTFYGLFKS S  N GKF N DYDAAY
Sbjct: 426  EEKFVPFKQRLEDTKNQNFEVAVVLWGGDYPKGSTFYGLFKSGSAYNYGKFTNADYDAAY  485

Query: 480  NKAISEDAMKPAESAKDYKEAEKILFEQGAYNPLY                          514
            NKA++ DA+    +A DYK AEK L++   YNPLY
Sbjct: 486  NKALTTDALNTDAAADDYKAAEKALYDNALYNPLY                          520
```

A related DNA sequence was identified in *S. pyogenes* <SEQ ID 317> which encodes the amino acid sequence <SEQ ID 318>. Analysis of this protein sequence reveals the following:

Possible site: 24
>>> May be a lipoprotein

-continued

----- Final Results -----
bacterial membrane --- Certainty = 0.0000 (Not Clear) <succ>
bacterial outside --- Certainty = 0.0000 (Not Clear) <succ>
bacterial cytoplasm --- Certainty = 0.0000 (Not Clear) <succ>

An alignment of the GAS and GBS proteins is shown below:

```
Identities = 114/428 (26%), Positives = 185/428 (42%), Gaps = 63/428 (14%)
Query:   7  VSKDGLTYTATLRKGLKW--SDGSK---LTAKDFVYSWQRLVDPKTASQYAYLAVEGHVL   61
            VSKDGLTYT TLR G+ W  +DG +   +TA+DFV   + VD K+ + Y    VE +
Sbjct:  92  VSKDGLTYTYTLRDGVSWYTADGEEYAPVTAEDFVTGLKHAVDDKSDALY---VVEDSIK  148

Query:  62  NADKINEGQEKDLNKLGVKAEGDDKVVITLSSPSPQFIYYLAFTNFMPQKQEVVEKYGKD  121
            N    G E D  ++GVKA D V TL+ P +    ++    P   + ++ GKD
Sbjct: 149  NLKAYQNG-EVDFKEVGVKALDDKTVQYTLNKPESYWNSKTTYSVLFPVNAKFLKSKGKD  207

Query: 122  YATTSKNTV-YSGPYTVEGWNGSNGTFTFLKKNKNYWDAKNVKTKEVRI--QTVKKPDTAV  178
            + TT +++ +G Y +   S +      KN+NYWDAKNV  + V++       P +
Sbjct: 208  FGTTDPSSILVNGAYFLSAFT-SKSSMEFHKNENYWDAKNVGIESVKLTYSDGSDPGSFY  266

Query: 179  QMYKRGELDAANISNTSAIYQANKNN--KDVT-DVLEATTAYMEYNTT------------  223
            + +  +GE  A +        Y++ K N   ++T  +L      ++ +N
Sbjct: 267  KNFDKGEFSVARLYPNDPTYKSAKKNYADNITYGMLTGDIRHLTWNLNRTSFKNTKKDPA  326

Query: 224  ---GSVKGLDNVKIRRALNLATNRKGVVQAAVDTGSKPA----IAFAPT--GLAKTPDGT  274
                K L+N  R+A+  A +R              +K      +   PT    + ++ G+
Sbjct: 327  QQDAGKKALNNKDFRQATQFAFDRASFQAQTAGQDAKTKALRNMLVPPTFVTIGESDEGS  386

Query: 275  DLAKYVAP-GYE------------YNKTEAAKLF---KEGLAESGLT-KLKLTITADAD  316
            ++ K +A G E             YN   +A   F   KE L   G+T  ++L      D
Sbjct: 387  EVEKEMAKLGDEWKDVNLADAQDGFYNPEKAKAEFAKAKEALTAEGVTFPVQLDYPVDQA  446

Query: 317  APAAKNSVDYIKSTWEAALPGLTV-----EEKFVTFKQR---LEDSRKQNFDIVVSLWGG  368
            A       K  + EA+L  V     E  +  T ++          E    +Q++DI+ S WG
Sbjct: 447  NAATVQEAQSFKQSVEASLGKENVIVNVLETETSTHEAQGFYAETPEQQDYDIISSWWGP  506
```

-continued

```
Query: 369 DYPEGSTF                                                 376
            DY + T+
Sbjct: 507 DYQDPRTY                                                 514
```

Figure 137:
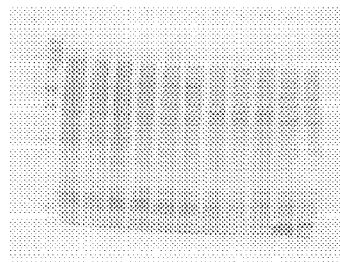
Figure 138:
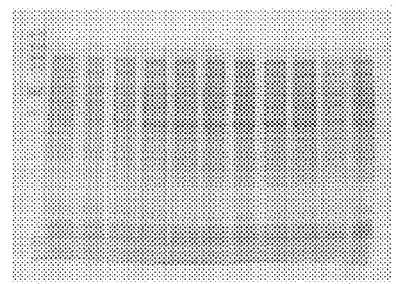
Figure 179:
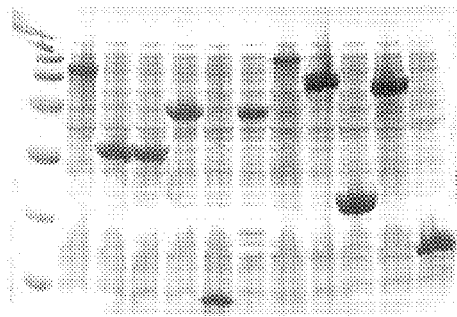
Figure 231:
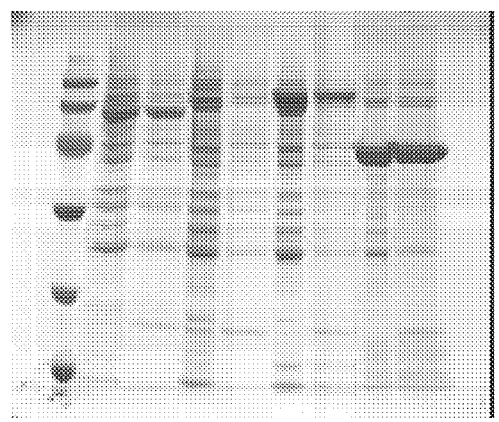

SEQ ID 9294 (GBS663) was expressed in *E. coli* as a GST-fusion product. SDS-PAGE analysis of total cell extract is shown in FIG. 137 (lane 3; MW 89.5 kDa). It was also expressed in *E. coli* as a His-fusion product. SDS-PAGE analysis of total cell extract is shown in FIG. 137 (lane 5-7; MW 64.5 kDa), in FIG. 179 (lane 11; MW 65 kDa) and in FIG. 65 (lane 2; MW 61 kDa). Purified GBS663-His is shown in FIG. 231, lane 3-4. Purified GBS324-His is shown in lane 6 of FIG. 210.

Based on this analysis, it was predicted that these proteins and their epitopes could be useful antigens for vaccines or diagnostics.

Possible site: 37
>>> Seems to have no N-terminal signal sequence
INTEGRAL    Likelihood = −10.77   Transmembrane 293-309 (281-313)
INTEGRAL    Likelihood = −9.77    Transmembrane 21-37 (14-46)
INTEGRAL    Likelihood = −6.32    Transmembrane 115-131 (105-132)
INTEGRAL    Likelihood = −4.88    Transmembrane 144-160 (140-166)
INTEGRAL    Likelihood = −3.03    Transmembrane 238-254 (237-255)
----- Final Results -----
   bacterial membrane --- Certainty = 0.5310 (Affirmative) <succ>
   bacterial outside --- Certainty = 0.0000 (Not Clear) <succ>
      bacterial cytoplasm --- Certainty = 0.0000 (Not Clear) <succ>

Example 93

A DNA sequence (GBSx0095) was identified in *S. agalactiae* <SEQ ID 319> which encodes the amino acid sequence <SEQ ID 320>. This protein is predicted to be transmembrane protein OppB (oppB). Analysis of this protein sequence reveals the following:

A related GBS nucleic acid sequence <SEQ ID 8491> which encodes amino acid sequence <SEQ ID 8492> was also identified.

The protein has homology with the following sequences in the GENPEPT database:

```
>GP:AAF73091 GB:AF103793 transmembrane protein OppB [Listeria monocytogenes]
Identities = 147/304 (48%), Positives = 221/304 (72%), Gaps = 1/304 (0%)
Query:  13 MIKYILKRVAILLVTLWVVITLSFFLMQILPGTPYNNP-KLTEEMIALLNKQYGLDKPVW  71
           M+KY LKRV +L+TL+++ +++F LM+ LPGTPY N   KL++E I + N++YGL+   +
Sbjct:   1 MVKYTLKRVLYMLITLFIIASVTFVLMKFLPGTPYRNQEKLSDEQIHMTNEKYGLNDSIP  60

Query:  72 QQYLTYLWNVLHGDFGTSYQSVNQPVSRMISLRLGVSVHLGVQALVFGVLGGILVGAISA 131
              QY  Y+  ++ GD G S+Q  N+PVS ++S  +G SV L  ++A+ FGV+ GIL+G I+A
Sbjct:  61 VQYFNYMTGLVKGDLGVSFQLDNRPVSEILSALIGPSVQLALEAMAFGVIFGILLGVIAA 120

Query: 132 RHKNDKVDGILSVIATLGISMPSFIIGILLLDYFGFKWNLLPLSGWGTFSQTILPSLALG 191
           ++N  D    + IA LG S+PSF+    +L   G K   P++GWGTF+ TILP+ AL
Sbjct: 121 MYQNRWPDYTSTFIAILGKSVPSFVFATVLQYWLGAKLQIFPVAGWGTFADTILPAFALA 180

Query: 192 LPTLASVSRFFRSEMIETLNSDYVQLARSKGMTIRQVTRKHAYRNSMIPILTLIGPLAAG 251
           +  LA+ +RF R+E+I+   SDYV LA++KG +  +V  KHA RN++IP++T++GPL+
Sbjct: 181 MFPLATAARFMRTELIDVFASDYVLLAKAKGNSRTEVAVKHAIRNALIPLITVLGPLSVA 240

Query: 252 LLTGSALIEQIFSIPGIGQQFVTSIPTKDYPVIMGTTIVYAVMLMVAILITDVVISIVDP 311
           L+TGS +IE I+SIPGIG QFV+SI T DYPVIMGTTI++AVML+  IL+ D++  ++DP
Sbjct: 241 LMTGSLVIENIYSIPGIGSQFVSSIQTNDYPVIMGTTILFAVMLVFVILVVDILYGLIDP 300

Query: 312 RVRL                                                         315
           R+R+
Sbjct: 301 RIRV                                                         304
```

There is also homology to SEQ ID 64.

A related DNA sequence was identified in *S. pyogenes* <SEQ ID 9069> which encodes amino acid sequence <SEQ ID 9070>. Analysis of this protein sequence reveals the following:

```
Possible site: 25
>>> Seems to have an uncleavable N-term signal seq
INTEGRAL    Likelihood = -8.81   Transmembrane 466-482 (463-493)
INTEGRAL    Likelihood = -5.10   Transmembrane 419-435 (418-440)
INTEGRAL    Likelihood = -4.78   Transmembrane 328-344 (322-348)
INTEGRAL    Likelihood = -4.41   Transmembrane 366-382 (365-384)
INTEGRAL    Likelihood = -4.09   Transmembrane 290-306 (287-311)
INTEGRAL    Likelihood = -2.97   Transmembrane 17-33 (13-36)
----- Final Results -----
   bacterial membrane --- Certainty = 0.4524 (Affirmative) <succ>
     bacterial outside --- Certainty = 0.0000 (Not Clear) <succ>
       bacterial cytoplasm --- Certainty = 0.0000 (Not Clear) <succ>
```

An alignment of the GAS and GBS sequences follows:

```
Score = 117 bits (291), Expect = 3e-28
Identities = 61/208 (29%), Positives = 121/208 (57%), Gaps = 4/208 (1%)
Query: 291  IGFFGVMFSYIVGLPLGLFMARFKNTYFDSFSTATMTFMLALPSIAV-IYVVRFLGGMVG  349
            +G    ++F  + G+ +G    AR KN   D    +  T  +++PS  + I ++ + G
Sbjct:  99  LGVQALVFGVLGGILVGAISARHKNDKVDGILSVIATLGISMPSFIIGILLLDYFGFKWN  158

Query: 350  LPDSFPMLGASDPKSYILPALILGILNIPTTVIWFRRYLVDLQASDWVRFARSKGLSESE  409
            L    P+ G           ILP+L LG+ + +    +FR  +++    SD+V+ ARSKG++   +
Sbjct: 159  L---LPLSGWGTFSQTILPSLALGLPTLASVSRFFRSEMIETLNSDYVQLARSKGMTIRQ  215

Query: 410  IYRGHLFKNAMVPIVSGVPASIILAIGGATLTETVFAFPGMGKMLIDSIKSANNSMIVGL  469
            + R H  ++N+M+PI++ +          + G+ L E +F+ PG+G+   + SI + +   +I+G
Sbjct: 216  VTRKHAYRNSMIPILTLIGPLAAGLLTGSALIEQIFSIPGIGQQFVTSIPTKDYPVIMGT  275

Query: 470  TFIFTVLSIVSLLLGDIVMTLVDPRIKL                                 497
            T ++ V+ +V++L+ D+V+++VDPR++L
Sbjct: 276  TIVNAVMLMVAILITDVVISIVDPRVRL                                 303
```

Based on this analysis, it was predicted that these proteins and their epitopes could be useful antigens for vaccines or diagnostics.

Example 94

A DNA sequence (GBSx0096) was identified in *S. agalactiae* <SEQ ID 321> which encodes the amino acid sequence <SEQ ID 322>. This protein is predicted to be transmembrane protein OppC (oppC). Analysis of this protein sequence reveals the following:

```
Possible site: 59
>>> Seems to have no N-terminal signal sequence
INTEGRAL    Likelihood = -11.52   Transmembrane 311-327 (307-333)
INTEGRAL    Likelihood = -7.80    Transmembrane 42-58 (40-65)
INTEGRAL    Likelihood = -7.43    Transmembrane 142-158 (131-165)
INTEGRAL    Likelihood = -4.73    Transmembrane 182-198 (179-214)
INTEGRAL    Likelihood = -3.50    Transmembrane 257-273 (257-276)
----- Final Results -----
   bacterial membrane --- Certainty = 0.5607 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the GENPEPT database:

```
>GP:AAF73092 GB:AF103793 transmembrane protein OppC [Listeria
monocytogenes]

Identities = 157/325 (48%), Positives = 219/325 (67%), Gaps = 4/325 (1%)
Query:  20  EKIEKPALSFMQDAWRRLKKNKLAVVSLYLLALLLTFSLASNLFVTQKDANGFDSKKVTT    79
            EKI +P+L+F+QD+W R++KNK A+VSL +LAL++  ++             ++++T
Sbjct:  22  EKINRPSLTFLQDSWLRIRKNKAALVSLIVLALVIIMAIVGPYLSQNLGPEHNINRQITE    81

Query:  80  YRNLPPKLSS--NLPFWNGSIKYAGNTESTDAYKSQNVPEKVKYALGTDSLGRSVAKRII   137
             +LPPK+   N+PFWNG    G  E  D YK  N+ E   Y LG+D+LGR    RI
Sbjct:  82  NASLPPKVQGFENMPFWNGHQSIGG--EDVDIYKQNNIKEGTYYWLGSDTLGRDQFARIW   139

Query: 138  VGIRISLLVAIAATFIDLIIGVTYGLVSGFAGGRLDTLMQRIVEVISSIPNLVIVTMLGL   197
              G R+SL++A+ A   DL+IGV YGL+SG+ GGR+D  MQR++EVI +IPNLV+V ++ L
Sbjct: 140  AGTRVSLIIAVVAALCDLVIGVANGLISGYVGGRVDNFMQRVLEVIGAIPNLVVVILMML   199

Query: 198  VLGNGITAIIISIAFTGWTSMSRQVRNLTLSYREREFVLAARSLGESPIKIAFKHILPNI   257
            +L  GI +III+IA T W +M+R VR   L  + +EFV+A+ +LGES  KI   KH++PNI
Sbjct: 200  ILEPGIVSIIIAIAMTSWITMARVVRGQVLKRKNQEFVMASMTLGESTPKILIKHLIPNI   259

Query: 258  SGIIIVQIMMTIPSAIMYEAVLSAINLGVKPPTASLGSLISDAQENLQYYPYQVILPALA   317
            SGIII+  IM +IPSAI +EA LS I LG+   P ASLG L++D  +  LQ  PY ++ P +
Sbjct: 260  SGIIIINIMFSIPSAIFFEAFLSFIGLGLPAPAASLGVLVNDGYKTLQVLPYMILYPCIV   319

Query: 318  LVMISLAFILLGDGLRDAFDPKSSD                                     342
            L +I +AF L+ DGLRDAFDPK  D
Sbjct: 320  LCIIMIAFNLIADGLRDAFDPKMRD                                     344
```

A related DNA sequence was identified in *S. pyogenes* <SEQ ID 323> which encodes the amino acid sequence <SEQ ID 324>. Analysis of this protein sequence reveals the following:

Possible site: 59
>>> Seems to have no N-terminal signal sequence
INTEGRAL    Likelihood = -10.30   Transmembrane 43-59 (37-65)
INTEGRAL    Likelihood = -8.49    Transmembrane 111-127 (109-135)
INTEGRAL    Likelihood = -6.26    Transmembrane 279-295 (270-298)
INTEGRAL    Likelihood = -3.88    Transmembrane 172-188 (172-188)
INTEGRAL    Likelihood = -3.61    Transmembrane 145-161 (145-165)
INTEGRAL    Likelihood = -1.49    Transmembrane 223-239 (223-239)
----- Final Results -----
    bacterial membrane --- Certainty = 0.5118 (Affirmative) <succ>
    bacterial outside --- Certainty = 0.0000 (Not Clear) <succ>
    bacterial cytoplasm --- Certainty = 0.0000 (Not Clear) <succ>

An alignment of the GAS and GBS proteins is shown below:

```
Identities = 91/325 (28%), Positives = 156/325 (48%), Gaps = 34/325 (10%)
Query:  16  SSTQEKIEKPALSFMQDAWRRLKKNKLAVVSLYLLALLLTFSLASNLFVTQKDANGFDSK    75
            S   E I+ PA S+ +   +R+    K V L +L  S     +F      +D
Sbjct:  16  SEASEVIDTPAYSYWKSVFRQFFSKKSTVFMLVILVTVLMMSFIYPMFAN------YDFN    69

Query:  76  KVTTYRNLPPKLSSNLPFWNGSIKYAGNTESTDAYKSQNVPEKVKYALGTDSLGRSVAKR   135
             V+    +                        + + +       +Y  GTD  G+S+
Sbjct:  70  DVSNIND-------------------------FSKRYIWPNAEYWFGTDKNGQSLFDG    102

Query: 136  IIVGIRISLLVAIAATFIDLIIGVTYGLVSGFAGGRLDTLMQRIVEVISSIPNLVIVTML   195
            +  G R S+L+++ AT I++ IGV  G + G +        D +M  I  +IS+IP+++I+ +L
Sbjct: 103  VWYGARNSILISVIATLINITIGVVLGAIWGVSKA-FDKVMIEIYNIISNIPSMLIIIVL   161

Query: 196  GLVLGNGITAIIISIAFTGWTSMSRQVRNLTLSYREREFVLAARSLGESPIKIAFKHILP   255
             LG G    +I++    TGW    ++ +R  L  YR+ E+ LA+++LG    KIA K++LP
Sbjct: 162  TYSLGAGFWNLILAFCITGWIGVAYSIRVQILRYRDLEYNLASQTLGTPMYKIAVKNLLP   221

Query: 256  NISGIIIVQIMMTIPSAIMYEAVLSAINLGVKPPTASLGSLISDAQENLQYYPYQVILPA   315
```

```
                  +   +I+   +    +P   +   EA LS    +G+    T SLG   I++    NL    Y    +P
Sbjct:  222  QLVSVIMTMLSQMLPVYVSSEAFLSFFGIGLPTTTPSLGRFIANYSSNLTTNAYLFWIPL  281

Query:  316  LALVMISLAFILLGDGLRDAFDPKS                                     340
             + L+++SL   ++G  L DA DP+S
Sbjct:  282  VTLILVSLPLYIVGQNLADASDPRS                                     306
```

Based on this analysis, it was predicted that these proteins and their epitopes could be useful antigens for vaccines or diagnostics.

Example 95

A DNA sequence (GBSx0097) was identified in *S. agalactiae* <SEQ ID 325> which encodes the amino acid sequence <SEQ ID 326>. This protein is predicted to be ATPase OppD (oppD). Analysis of this protein sequence reveals the following:

---
Possible site: 20
>>> Seems to have no N-terminal signal sequence
   INTEGRAL Likelihood = −0.85 Transmembrane 164 - 180 ( 163- 180)
----- Final Results -----
      bacterial membrane --- Certainty=0.1341 (Affirmative) < succ>
        bacterial outside --- Certainty=0.0000 (Not Clear) < succ>
      bacterial cytoplasm --- Certainty=0.0000 (Not Clear) < succ>
---

The protein has homology with the following sequences in the GENPEPT database:

Example 96

A DNA sequence (GBSx0098) was identified in *S. agalactiae* <SEQ ID 327> which encodes the amino acid sequence <SEQ ID 328>. Analysis of this protein sequence reveals the following:

---
Possible site: 28
>>> Seems to have no N-terminal signal sequence
----- Final Results -----
      bacterial cytoplasm --- Certainty=0.3060 (Affirmative) < succ>
       bacterial membrane --- Certainty=0.0000 (Not Clear) < succ>
        bacterial outside --- Certainty=0.0000 (Not Clear) < succ>
---

The protein has homology with the following sequences in the GENPEPT database:

```
>GP:AAF73093 GB:AF103793 ATPase OppD [Listeria monocytogenes]
Identities = 230/342 (67%), Positives = 283/342 (82%), Gaps = 2/342 (0%)
Query:    4  ETILSVNNLHVDFHTYAGEVKAIRDVNFELKKGETLAIVGESGSGKSVTTRTLIGLNAK-   62
             E +L V +L++ FHTYAGEVKAIR VNF+L KGETLAIVGESGSGKSVTT++++ L   +
Sbjct:    2  EKLLEVKDLNISFHTYAGEVKAIRGVNFDLYKGETLAIVGESGSGKSVTTKSIMPLLPEG   61

Query:   63  NSEI-SGNVQFKGRNLVELSEEEWTKVRGNEISMIFQDPMTSLDPTMKIGMQIAEPMMIH   121
             NSEI SG + F G ++ +    E++   K+RG +I+MIFQDPMTSL+PTM  IG QI+EP++ H
Sbjct:   62  NSEIKSGQILFNGMDIAKAHEKQMQKIRGKDIAMIFQDPMTSLNPTMTIGKQISEPLIKH   121

Query:  122  QKISKKDALKLALELMKDVGIPNAEEHINDYPHQWSGGMRQRAVIAIALAADPEILIADE   181
             QKISK +A K AL L++ VGI NAEE I   YPHQ+SGGMRQR VIAI+LA +P+ILIADE
Sbjct:  122  QKISKHEAHKTALRLLQLVGIANAEERIKQYPHQFSGGMRQRVVIAISLACNPQILIADE   181

Query:  182  PTTALDVTIQAQILNLMKKIQAERDSSIVFITHDLGVVAGMADRVAVMYAGKIVEFGTVD   241
             PTTALDVTIQAQIL+LMK +Q + D+SI+FITHDLGVVA +ADRVAVMY GKIVE GTVD
Sbjct:  182  PTTALDVTIQAQILDLMKDLQKKIDTSIIFITHDLGVVANVADRVAVMYGGKIVEIGTVD   241

Query:  242  EVFYNPQHPYTWGLLNSMPTTDTESGSLESIPGTPPDLLNPPKGDAFAARNEFALDIDHE   301
             E+FYNPQHPYTWGL++SMPT DT+    L   IPGTPPDLL+PPKGDAFAARN++A+ ID E
Sbjct:  242  EIFYNPQHPYTWGLISSMPTLDTDDEELFVIPGTPPDLLHPPKGDAPAARNKYAMQIDLE   301

Query:  302  EEPPYFKVSETHFAATWLLDERSPKVLPPLPIQKRWEKWNEI                    343
             EEPP FKVS+TH+AATWLL   +P+V PP  + +R E++ E+
Sbjct:  302  EEPPLFKVSDTHYAATWLLHPDAPEVTPPDAVLRRQEQFAEL                    343
```

There is also homology to SEQ ID 72.

Figure 64:
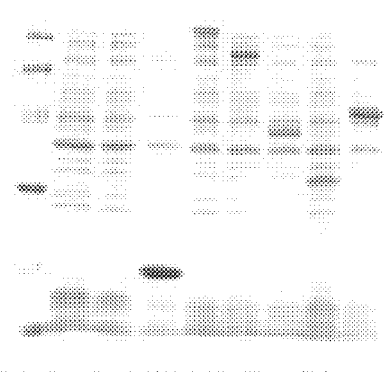
Figure 71:
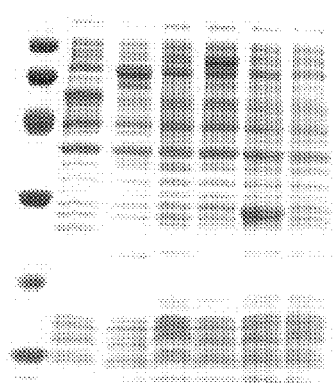

SEQ ID 326 (GBS375) was expressed in *E. coli* as a His-fusion product. SDS-PAGE analysis of total cell extract is shown in FIG. 64 (lane 9; MW 42 kDa). It was also expressed in *E. coli* as a GST-fusion product. SDS-PAGE analysis of total cell extract is shown in FIG. 71 (lane 3; MW 67 kDa).

Figure 215:
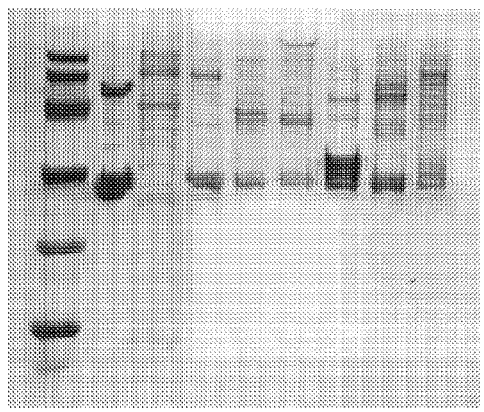

GBS375-GST was purified as shown in FIG. 215, lane 10.

Based on this analysis, it was predicted that this protein and its epitopes, could be useful antigens for vaccines or diagnostics.

```
>GP:AAA62692 GB:M57689 sporulation protein [Bacillus subtilis]
Identities = 195/308 (63%), Positives = 245/308 (79%), Gaps = 4/308 (1%)
Query:   1  MTENRKKLVEVKNVSLTFNKGKANEVRAIDNVSFDIYEGEVEGLVGESGSGKTTVGRSIL   60
            M E  +KL+E+K++    F   +   V+A+D++SFDIY+GE  GLVGESG GK+T GRSI+
Sbjct:   1  MNELTEKLLEIKHLKQHFVTPRGT-VKAVDDLSFDIYKGETLGLVGESGCGKSTTGRSII   59

Query:  61  KLYDISDGEITFNGEVISHLKG-KALHSFRKDAQMIFQDPQASLNGRMKIRDIVAEGLDI  119
            +LY+ +DGE+ FNGE +    K  K L  F +  QMIFQDP ASLN RM + DI+AEGLDI
Sbjct:  60  RLYEATDGEVLFNGENVHGRKSRKKLLEFNRKMQMIFQDPYASLNPRMTVADIIAEGLDI  119

Query: 120  HKLAKSKSDRDSKVQALLDLVGLNKDHLTRYPHEFSGGQRQRIGIARALAVEPKFIIADE  179
            HKLAK+K  +R  +V  LL+ VGLNK+H  RYPHEFSGGQRQRIGIARALAV+P+FIIADE
Sbjct: 120  HKLAKTKKERMQRVHELLETVGLNKEHANRYPHEFSGGQRQRIGIARALAVDPEFIIADE  179

Query: 180  PISALDVSIQAQVVNLMQKLQREQGLTYLFIAHDLSMVKYISDRIGVMHWGKLLEVGTSD  239
            PISALDVSIQAQVVNLM++LQ+E+GLTYLFIAHDLSMVKYISDRIGVM++GKL+E+    +D
Sbjct: 180  PISALDVSIQAQVVNLMKELQKEKGLTYLFIAHDLSMVKYISDRIGVMYFGKLVELAPAD  239

Query: 240  DVYNNPIHPYTKSLLSAIPEPDPESERQRVHQPYNPAIEQ--DGQERQMHEITPGHFVLS  297
            ++Y NP+HPYTKSLLSAIP PDP+ ER RV Q Y+P++ Q   DG+  +   E+ PGHFV+
Sbjct: 240  ELYENPLHPYTKSLLSAIPLPDPDYERNRVRQKYDPSVHQLKDGETMEFREVKPGHFVMC  299

Query: 298  TPQEAEEY                                                      305
            T  E ++
Sbjct: 300  TEAEFKAF                                                      307
```

Possible site: 47
>>> Seems to have no N-terminal signal sequence

----- Final Results -----
bacterial cytoplasm --- Certainty=0.3900 (Affirmative) <succ>
bacterial membrane --- Certainty=0.0000 (Not Clear) <succ>
bacterial outside --- Certainty=0.0000 (Not Clear) <succ>

A related DNA sequence was identified in *S. pyogenes* <SEQ ID 329> which encodes the amino acid sequence <SEQ ID 330>. Analysis of this protein sequence reveals the following:

An alignment of the GAS and GBS proteins is shown below:

```
Identities = 164/306 (53%), Positives = 228/306 (73%), Gaps = 3/306 (0%)
Query:   6  KELVEVKNVSLTFNKGKANEVRAIDNVSFDIYEGEVFGLVGESGSGKTTVGRSILKLYDI   65
            +KLVEVK++  ++F +GK   V A+ N +F I +GE F LVGESGSGKTT+GR+I+ L D
Sbjct:   3  EKLVEVEDLEISFGEGKKKFV-AVKNANFFIKKGETFSLVGESGSGKTTIGRAIIGLNDT   61

Query:  66  SDGEITFNGEVISHLKGKA-LHSFRKDAQMIFQDPQASLNGRMKIRDIVAEGLDIHKLAK  124
            S G+I ++G+VI+   K K+  +     + QMIFQDP  ASLN R  +    I++EGL       L  K
Sbjct:  62  SSGQILYDGKVINGRKSKSEANELIRKIQMIFQDPAASLNERATVDYIISEGLYNFNLFK  121

Query: 125  SKSDRDSKVQALLDLVGLNKDHLTRYPHEFSGGQRQRIGIARALAVEPKFIIADEPISAL  184
            ++  +R   K++  ++ VGL   +HLTRYPHEFSGGQRQRIGIARAL   + P+F+IADEPISAL
Sbjct: 122  TEEERKEKIKNMMAEVGLLSEHLTRYPHEFSGGQRQRIGIARALVMNPEFVIADEPISAL  181

Query: 185  DVSIQAQVVNLMQKLQREQGLTYLFIAHDLSMVKYISDRIGVMHWGKLLEVGTSDDVYNN  244
            DVS++AQV+NL++++Q  E+GLTYLFIAHDLS+V++  ISDRI V+H G  ++EV     +++++NN
Sbjct: 182  DVSVRAQVLNLLKRMQAEKGLTYLFIAHDLSVVRFISDRIAVIHKGVIVEVAETEELFNN  241

Query: 245  PIHPYTKSLLSAIPEPDPESERQRVHQPYMPAIEQDGQER-QMHEITPGHFVLSTPQEAE  303
            PIHPYT+SLLSA+P PDP   ERQ+     Y+P           ++  M EI P HFV +       E E
Sbjct: 242  PIHPYTQSLLSAVPIPDPILERQKELVVYHPDQHDYTLDKPSMVEIKPNHFVWANQAEIE  301

Query: 304  EYKKQI                                                        309
            +Y+K++
Sbjct: 302  KYQKEL                                                        307
```

Example 97

A repeated DNA sequence (GBSx0099) was identified in S. agalactiae <SEQ ID 331> which encodes the amino acid sequence <SEQ ID 332>. Analysis of this protein sequence reveals the following:

---
Possible site: 28
>>> Seems to have no N-terminal signal sequence
----- Final Results -----
   bacterial cytoplasm --- Certainty=0.3021 (Affirmative) <succ>
      bacterial membrane --- Certainty=0.0000 (Not Clear) <succ>
         bacterial outside --- Certainty=0.0000 (Not Clear) <succ>
---

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 98

A repeated DNA sequence (GBSx0100) was identified in S. agalactiae <SEQ ID 333> which encodes the amino acid sequence <SEQ ID 334>. Analysis of this protein sequence reveals the following:

---
Possible site: 24
>>> Seems to have no N-terminal signal sequence
----- Final Results -----
   bacterial cytoplasm --- Certainty=0.0352 (Affirmative) < succ>
      bacterial membrane --- Certainty=0.0000 (Not Clear) < succ>
         bacterial outside --- Certainty=0.0000 (Not Clear) < succ>
---

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 99

A repeated DNA sequence (GBSx0101) was identified in S. agalactiae <SEQ ID 335> which encodes the amino acid sequence <SEQ ID 336>. Analysis of this protein sequence reveals the following:

---
Possible site: 23
>>> Seems to have no N-terminal signal sequence
----- Final Results -----
   bacterial cytoplasm --- Certainty=0.5857 (Affirmative) < succ>
      bacterial membrane --- Certainty=0.0000 (Not Clear) < succ>
         bacterial outside --- Certainty=0.0000 (Not Clear) < succ>
---

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 100

A repeated DNA sequence (GBSx0103) was identified in S. agalactiae <SEQ ID 337> which encodes the amino acid sequence <SEQ ID 338>. Analysis of this protein sequence reveals the following:

---
Possible site: 14
>>> Seems to have no N-terminal signal sequence
----- Final Results -----
   bacterial cytoplasm --- Certainty=0.1472 (Affirmative) < succ>
      bacterial membrane --- Certainty=0.0000 (Not Clear) < succ>
         bacterial outside --- Certainty=0.0000 (Not Clear) < succ>
---

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 101

A repeated DNA sequence (GBSx0104) was identified in S. agalactiae <SEQ ID 339> which encodes the amino acid sequence <SEQ ID 340>. Analysis of this protein sequence reveals the following:

---
Possible site: 13
>>> Seems to have no N-terminal signal sequence
----- Final Results -----
   bacterial cytoplasm --- Certainty=0.0111 (Affirmative) < succ>
      bacterial membrane --- Certainty=0.0000 (Not Clear) < succ>
         bacterial outside --- Certainty=0.0000 (Not Clear) < succ>
---

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 102

A repeated DNA sequence (GBSx0105) was identified in S. agalactiae <SEQ ID 341> which encodes the amino acid sequence <SEQ ID 342>. Analysis of this protein sequence reveals the following:

---
Possible site 20
>>> Seems to have no N-terminal signal sequence
----- Final Results -----
   bacterial cytoplasm --- Certainty=0.5628(Affirmative) < succ>

```
bacterial membrane --- Certainty=0.0000(Not Clear) < succ>
bacterial outside --- Certainty=0.0000(Not Clear) < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 103

A repeated DNA sequence (GBSx0106) was identified in S. agalactiae <SEQ ID 343> which encodes the amino acid sequence <SEQ ID 344>. Analysis of this protein sequence reveals the following:

```
Possible site: 39
>>> Seems to have no N-terminal signal sequence
----- Final Results -----
    bacterial cytoplasm --- Certainty=0.2059 (Affirmative) < succ>
    bacterial membrane --- Certainty=0.0000 (Not Clear) < succ>
    bacterial outside --- Certainty=0.0000 (Not Clear) < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 104

A repeated DNA sequence (GBSx0107) was identified in S. agalactiae <SEQ ID 345> which encodes the amino acid sequence <SEQ ID 346>. Analysis of this protein sequence reveals the following:

```
Possible site: 21
>>> Seems to have no N-terminal signal sequence
----- Final Results -----
    bacterial cytoplasm --- Certainty=0.2045 (Affirmative) < succ>
    bacterial membrane --- Certainty=0.0000 (Not Clear) < succ>
    bacterial outside --- Certainty=0.0000 (Not Clear) < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 105

A DNA sequence (GBSx0108) was identified in S. agalactiae <SEQ ID 347> which encodes the amino acid sequence <SEQ ID 348>. Analysis of this protein sequence reveals the following:

```
Possible site: 36
>>> Seems to have no N-terminal signal sequence
----- Final Results -----
    bacterial cytoplasm --- Certainty=0.3031 (Affirmative) < succ>
    bacterial membrane --- Certainty=0.0000 (Not Clear) < succ>
    bacterial outside --- Certainty=0.0000 (Not Clear) < succ>
```

The protein has homology with the following sequences in the GENPEPT database:

```
>GP:CAB11822 GB:Z99104 similar to hypothetical proteins [Bacillus subtilis]
Identities = 125/282 (44%), Positives = 184/282 (64%)
    Query:   1 MKIFEKAPAKLNLGLDIKGRCDDGYHELAMIMVSIDLNDYVTISELKEDCIVIDSDSSKM  60
               M+I EKAPAK+NL LD+  + DGYHE+ MIM +IDL D + ++EL ED + + S +  +
    Sbjct:   1 MRILEKAPAKINLSLDVTRKRPDGYHEVEMIMTTIDLADRIELTELAEDEVRVSSHNRFV  60

Query:  61 PLNNDNDVFKAADIIKNQYGINKGVHIRLEKSIPVCAGLGGGSTDAAATIRALNRLWNLQ  120
               P +  N ++AA  +IK++Y + KGV I + K IPV AGL GGS+DAAAT+R LNRLWNL
    Sbjct:  61 PDDQRNLAYQAAKLIKDRYNVKKGVSIMITKVIPVAAGLAGGSSDAAATLRGLNRLWNLN  120

Query: 121 MDYDEMVAIGFRIGSDVPYCLGGGCSLVLGKGEIVKPLPTLRPCWIVLVKPDFGISTKSI  180
               + + +  +G +IGSDV +C+ GG +L  G+GE +K + T    CW++L KP  G+ST +
    Sbjct: 121 LSAETLAELGAEIGSDVSFCVYGGTALATGRGEKIKHISTPPHCWVILAKPTIGVSTAEV  180

Query: 181 FRDIDCKSISRVDIDLLKSAILSSDYQLMVKSMGNSLEDITITKNPVISTIKERMLNSGA  240
               +R +    I    D+ +  AI     +Q M   +GN LE +T+   +P ++ IK +M    GA
    Sbjct: 181 YRALKLDGIEHPDVQGMIEAIEEKSFQKMCSRLGNVLESVTLDMHPEVAMIKNQMKRFGA  240

Query: 241 DVALMTGSGPTVFSMCSTEKKADRVFNSMKGFCKEVYKVRLL                   282
               D  LM+GSGPTVF +    E K  R++N ++GFC +VY VR++
    Sbjct: 241 DAVLMSGSGPTVFGLVQYESKVQRIYNGLRGFCDQVYAVRMI                   282
```

A related DNA sequence was identified in S. pyogenes <SEQ ID 349> which encodes the amino acid sequence <SEQ ID 350>. Analysis of this protein sequence reveals the following:

```
Possible site: 44
>>> Seems to have no N-terminal signal sequence
   INTEGRAL Likelihood = -2.87 Transmembrane 28 - 44 ( 27 - 45)
----- Final Results -----
```

```
         bacterial membrane --- Certainty=0.2147 (Affirmative) < succ >
         bacterial outside --- Certainty=0.0000 (Not Clear) < succ >
         bacterial cytoplasm --- Certainty=0.0000 (Not Clear) < succ >
```

An alignment of the GAS and GBS proteins is shown below:

```
Identities = 33/52 (63%), Positives = 38/52 (72%)
Query: 126  MVAIGFKIGSDVPYCLGGGCSLVLGKGEIVKPLPTLRPCWIVLVKPDFGIST   177
            M+ IG  IGSDVPYCL  GC+ V GKGE+V  +  L    W+VLVKPDFGIST
Sbjct:   1  MMDIGIPIGSDVPYCLLSGCAQVTGKGEVVCRILGLLSSWVVLVKPDFGIST    52
```

Based on this analysis, it was predicted that these proteins and their epitopes could be useful antigens for vaccines or diagnostics.

Example 106

A DNA sequence (GBSx0109) was identified in *S. agalactiae* <SEQ ID 351> which encodes the amino acid sequence <SEQ ID 352>. This protein is predicted to be AdcR protein. Analysis of this protein sequence reveals the following:

```
Possible site: 19
>>> Seems to have no N-terminal signal sequence
----- Final Results -----
     bacterial cytoplasm --- Certainty=0.1264 (Affirmative) < succ >
         bacterial membrane --- Certainty=0.0000 (Not Clear) < succ >
         bacterial outside --- Certainty=0.0000 (Not Clear) < succ >
```

The protein has homology with the following sequences in the GENPEPT database:

```
>GP:CAA96184 GB:Z71552 AdcR protein [Streptococcus pneumoniae]
Identities = 77/146 (52%), Positives = 117/146 (79%)
Query:   1  MTVLEQKLDHLVSQILLKAENQHELLFGTCQSDVKLTNTQEHILMLLSQEQLTNSDLAKK    60
            M  L +  ++  +++++L+AENQHE+L G C  S+V LTNTQEHILMLLS+E  LTNS+LA++
Sbjct:   1  MRQLAKDINAFLNEVILQAENQHEILIGHCTSEVALTNTQEHILMLLSEESLTNSELARR    60

Query:  61  LNISQAAVTKAVKSLISQDMLKANKDSKDARITYFELSELAKPIADEHTHHHDNTLGVYG   120
            LN+SQAAVTKA+KSL+ + ML+ +KDSKDAR+ +++L++LA+PIA+EH HHH++TL   Y
Sbjct:  61  LNVSQAAVTKAIKSLVKEGMLETSKDSKDARVIFYQLTDLARPIAEEHHHHHEHTLLTYE   120

Query: 121  RLVNHFSKDEKVVLERFLDLFSRELE                                    146
            ++   F+ +E+ V++RFL     E++
Sbjct: 121  QVATQFTPNEQKVIQRFLTALVGEIK                                    146
```

A related DNA sequence was identified in *S. pyogenes* <SEQ ID 353> which encodes the amino acid sequence <SEQ ID 354>. Analysis of this protein sequence reveals the following:

```
Possible site: 28
>>> Seems to have no N-terminal signal sequence
----- Final Results -----
     bacterial cytoplasm --- Certainty=0.1536 (Affirmative) < succ >
         bacterial membrane --- Certainty=0.0000 (Not Clear) < succ >
         bacterial outside --- Certainty=0.0000 (Not Clear) < succ >
```

An alignment of the GAS and GBS proteins is shown below:

```
Identities = 106/147 (720), Positives = 126/147 (85%)
Query:   1  MTVLEQKLDHLVSQILLKAENQHELLFGTCQSDVKLTNTQEHILMLLSQEQLTNSDLAKK   60
            M +LE+KLD+LV+ ILLKAENQHELLFG CQSDVKLTNTQEHILMLLSQ++LTN+DLAK
Sbjct:   1  MGILEKKLDNLVNTILLKAENQHELLFGACQSDVKLTNTQEHILMLLSQQRLTNTDLAKA   60

Query:  61  LNISQAAVTKAVKSLISQDMLKANKDSKDARITYFELSELAKPIADEHTHHHDNTLGVYG  120
            LNISQAAVTKA+KSL+ QDML   KD+ DAR+TYFEL+ELAKPIA EHTHHHD TL VY
Sbjct:  61  LNISQAAVTKAIKSLVKQDMLAGTKDTVDARVTYFELTELAKPIASEHTHHHDETLNVYN  120

Query: 121  RLVNHFSKDEKVVLERFLDLFSRELEG                                  147
            RL+  FS E ++++F+ +F+ ELEG
Sbjct: 121  RLLQKFSAKELEIVDKFVTVFAEELEG                                  147
```

Based on this analysis, it was predicted that these proteins and their epitopes could be useful antigens for vaccines or diagnostics.

Example 107

A DNA sequence (GBSx0110) was identified in *S. agalactiae* <SEQ ID 355> which encodes the amino acid sequence <SEQ ID 356>. This protein is predicted to be AdcC protein. Analysis of this protein sequence reveals the following:

Possible site: 43
>>> Seems to have no N-terminal signal sequence
----- Final Results -----
   bacterial cytoplasm --- Certainty = 0.1089 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database:

```
>GP:CAA96186 GB:Z71552 AdcC protein [Streptococcus pneumoniae]
Identities = 182/231 (78%), Positives = 206/231 (88%)
Query:   1  MRYITVSGLTFQYDSDPVLEGVNYHLDSGEFVTLTGENGAAKSTLIKATLGILTPKVGTV   60
            MRYITV  L+F YD +PVLE +NY +DSGEFVTLTGENGAAK+TLIKA+LGIL P++G V
Sbjct:   1  MRYITVEDLSFYYDKEPVLEHINYCVDSGEFVTLTGENGAAKTTLIKASLGILQPRIGKV   60

Query:  61  NISKENKEGKKLRIAYLPQQIASFNAGFPSSVYEFVKSGRYPRNGWFRRLTKHDEEHIRV  120
             ISK N +GKKLRIAYLPQQIASFNAGFPS+VYEFVKSGRYPR GWFRRL  HDEEHI+
Sbjct:  61  AISKTNTQGKKLRIAYLPQQIASFNAGFPSTVYEFVKSGRYPRKGWFRRLNAHDEEHIKA  120

Query: 121  SLEAVGMWDNRHKKIGSLSGGQKQRAVIARMFASDPDIFVLDEPTTGMDAGTTEKEYELM  180
            SL++VGMW++R K++GSLSGGQKQRAVIARMFASDPD+F+LDEPTTGMDAG+  +FYELM
Sbjct: 121  SLDSVGMWEHRDKRLGSLSGGQKQRAVIARMFASDPDVFILDEPTTGMDAGSKNEFYELM  180

Query: 181  HHNAHKHGKSVLMITHDPDEVKGYADRNIHLVRNQSLPWRCFNVHTNEMEV           231
            HH+AH HGK+VLMITHDP+EVK YADRNIHLVRNQ  PWRCFNVH N  EV
Sbjct: 181  HHSAHHHGKAVLMITHDPEEVKDYADRNIHLVRNQDSPWRCFNVHENGQEV           231
```

A related DNA sequence was identified in *S. pyogenes* <SEQ ID 357> which encodes the amino acid sequence <SEQ ID 358>. Analysis of this protein sequence reveals the following:

Possible site: 43
>>> Seems to have no N-terminal signal sequence
----- Final Results -----
   bacterial cytoplasm --- Certainty = 0.2722 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below:

```
Identities = 190/232 (81%), Positives = 214/232 (91%)
Query:   1  MRYITVSGLTFQYDSDPVLEGVNYHLDSGEFVTLTGENGAAKSTLIKATLGILTPKVGTV   60
            MRYI+V  L+FQY+S+PVLEG+ YHLDSGEFVT+TGENGAAKSTLIKATLGIL PK G V
Sbjct:   1  MRYISVKNLSFQYESEPVLEGITYHLDSGEFVTMTGENGAAKSTLIKATLGILQPKAGRV   60

Query:  61  NISKENKEGKKLRIAYLPQQIASFNAGFPSSVYEFVKSGRYPRNGWFRRLTKHDEEHIRV  120
            I+K+NK+GK+LRIAYLPQQ+ASFNAGFPS+VYEFVKSGRYPR+GWFR L KHDEEH++
Sbjct:  61  TIAKKNKDGKQLRIAYLPQQVASFNAGFPSTVYEFVKSGRYPRSGWFRHLNKHDEEHVQA  120

Query: 121  SLEAVGMWDNRHKKIGSLSGGQKQRAVIARMFASDPDIFVLDEPTTGMDAGTTEKFYELM  180
            SLEAVGMW+NRHK+IGSLSGGQKQR VIARMFASDPDIFVLDEPTTGMD+GTT+ FYELM
Sbjct: 121  SLEAVGMWENRHKRIGSLSGGQKQRVVIARMFASDPDIFVLDEPTTGMDSGTTDTFYELM  180

Query: 181  HHNAHKHGKSVLMITHDPDEVKGYADRNIHLVRNQSLPWRCFNVHTNEMEVE          232
            HH+AH+HGKSVLMITHDP+EVK YADRNIHLVRNQ LPWRCFN+H   E + E
Sbjct: 181  HHSAHQHGKSVLMITHDPEEVKAYADRNIHLVRNQKLPWRCFNIHEAETDDE          232
```

Based on this analysis, it was predicted that these proteins and their epitopes could be useful antigens for vaccines or diagnostics.

Example 108

A DNA sequence (GBSx0111) was identified in *S. agalactiae* <SEQ ID 359> which encodes the amino acid sequence <SEQ ID 360>. Analysis of this protein sequence reveals the following:

---
Possible site: 36
>>> Seems to have no N-terminal signal sequence
----- Final Results -----
   bacterial cytoplasm --- Certainty = 0.2299 (Affirmative) <succ>
     bacterial membrane --- Certainty = 0.0000 (Not Clear) <succ>
      bacterial outside --- Certainty = 0.0000 (Not Clear) <succ>
---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 109

A DNA sequence (GBSx0112) was identified in *S. agalactiae* <SEQ ID 361> which encodes the amino acid sequence <SEQ ID 362>. This protein is predicted to be AdcB protein (znuB). Analysis of this protein sequence reveals the following:

---
Possible site: 36
>>> Seems to have no N-terminal signal sequence
INTEGRAL    Likelihood = −14.33   Transmembrane 145-161 (136-172)
INTEGRAL    Likelihood = −11.57   Transmembrane 29-45 (20-47)
INTEGRAL    Likelihood = −10.56   Transmembrane 261-277 (255-280)
INTEGRAL    Likelihood = −8.70    Transmembrane 231-247 (227-253)
INTEGRAL    Likelihood = −5.63    Transmembrane 101-117 (99-121)
INTEGRAL    Likelihood = −4.94    Transmembrane 186-202 (183-225)
INTEGRAL    Likelihood = −3.82    Transmembrane 55-71 (54-74)
INTEGRAL    Likelihood = −3.61    Transmembrane 206-222 (203-225)
INTEGRAL    Likelihood = −3.03    Transmembrane 78-94 (75-94)
----- Final Results -----
   bacterial membrane --- Certainty = 0.6731 (Affirmative) <succ>
      bacterial outside --- Certainty = 0.0000 (Not Clear) <succ>
    bacterial cytoplasm --- Certainty = 0.0000 (Not Clear) <succ>
---

A related GBS nucleic acid sequence <SEQ ID 9487> which encodes amino acid sequence <SEQ ID 9488> was also identified.

The protein has homology with the following sequences in the GENPEPT database:

```
>GP:CAA96187 GB:Z71552 AdcB protein [Streptococcus pneumoniae]
Identities = 197/263 (74%), Positives = 236/263 (88%)
Query:  13  LLDMLSYDFMQRALLAVVAISIFAPILGIFLILRRQSLMSDTLSHVSLAGVALGVVLGIS   72
            +L  +LSYDF+QRA LAV+A+S+F+P+LG FLILRRQSLMSDTLSHVSL+GVA G+VLGIS
Sbjct:   1  MLSLLSYDFIQRAFLAVIAMSLFSPVLGTFLILRRQSLMSDTLSHVSLSGVAFGLVLGIS   60

Query:  73  PTWSTIFVVTLAAVVLEYLRTVYKHYMEISTAILMSMGLAISLIVMSKAHNVGNVSLEQY  132
            PT STI +V +AAV LEYLRTVYK +MEI GTAILMS GLA+SLIVMSK +   ++SL+QY
Sbjct:  61  PTVSTIAIVLIAAVFLEYLRTVYKSFMEIGTAILMSTGLAVSLIVMSKGKSSSSMSLDQY  120

Query: 133  LFGSIITIGKEQVIALFVIALITFILTILFIRPMYILTFDEDTAFVDGLPVRTMSILFNV  192
            LFGSI+TI +EQVI+LFVIA +   ILT LF+RPMYILTFDEDTAFVDGLPVRTMSILFN+
Sbjct: 121  LFGSIVTISEEQVISLFVIAAVVLILTFLFLRPMYILTFDEDTAFVDGLPVRTMSILFNM  180

Query: 193  VTGIAIALTIPAAGALLVSTIMVLPASIAMRLGRNFKTVIFLGMLIGFVGMVAGIFLSYY  252
            VTG+AIAL IPAAGALLVSTIMVLPASIA+RLG+NFK+V+ L    IGF+GMVAG+++SYY
Sbjct: 181  VTGVAIALMIPAAGALLVSTIMVLPASIALRLGKNFKSVMLLASAIGFLGMVAGLYISYY  240
```

-continued

```
Query: 253  WETPASATITMIFIGIFLLVSLV                                       275
            ETPASA+IT+IF+ +F+L+SLV
Sbjct: 241  AETPASASITIIFVTVFILISLV                                       263
```

A related DNA sequence was identified in *S. pyogenes* <SEQ ID 393> which encodes the amino acid sequence <SEQ ID 364>. Analysis of this protein sequence reveals the following:

```
Possible site: 18
>>> Seems to have a cleavable N-term signal seq.
INTEGRAL    Likelihood = −14.97   Transmembrane 135-151 (123-162)
INTEGRAL    Likelihood = −9.08    Transmembrane 68-84 (44-86)
INTEGRAL    Likelihood = −6.95    Transmembrane 20-36 (19-37)
INTEGRAL    Likelihood = −6.90    Transmembrane 251-267 (245-270)
INTEGRAL    Likelihood = −6.58    Transmembrane 221-237 (217-243)
INTEGRAL    Likelihood = −6.42    Transmembrane 91-107 (89-111)
INTEGRAL    Likelihood = −4.78    Transmembrane 176-192 (171-215)
INTEGRAL    Likelihood = −3.82    Transmembrane 45-61 (44-67)
INTEGRAL    Likelihood = −3.61    Transmembrane 196-212 (193-215)
----- Final Results -----
    bacterial membrane --- Certainty = 0.6986 (Affirmative) <succ>
       bacterial outside --- Certainty = 0.0000 (Not Clear) <succ>
          bacterial cytoplasm --- Certainty = 0.0000 (Not Clear) <succ>
```

The protein has homology with the following sequences in the databases:

```
>GP:CAA96187 GB:Z71552 AdcB protein [Streptococcus pneumoniae]
Identities = 195/262 (74%), Positives = 239/262 (90%)
Query:   3  MLDILFYDFMQRAVMAVVAISIFAPILGIFLILRRQSLMSDTLSHVSLAGVALGVVLGIS   62
            ML +L YDF+QRA +AV+A+S+F+P+LG FLILRRQSLMSDTLSHVSL+GVA G+VLGIS
Sbjct:   1  MLSLLSYDFIQRAFLAVIAMSLFSPVLGTFLILRRQSLMSDTLSHVSLSGVAFGLVLGIS   60

Query:  63  PTITTIIVVVIAAILLEYLRVVYKHYMEISTAILMSLGLALSLIIMSKSHSSSSMSLEQY  122
            PT++TI +V++AA+ LEYLR VYK +MEI TAILMS GLA+SLI+MSK   SSSSMSL+QY
Sbjct:  61  PTVSTIAIVLIAAVFLEYLRTVYKSFMEIGTAILMSTGLAVSLIVMSKGKSSSSMSLDQY  120

Query: 123  LFGSIITISMEQVVALFAIAAIILILTVLFIRPMYILTFDEDTAFVDGLPVRLMSVLFNI  182
            LFGSI+TIS EQV++LF IAA++LILT LF+RPMYILTFDEDTAFVDGLPVR MS+LFN+
Sbjct: 121  LFGSIVTISEEQVISLFVIAAVVLILTFLFLRPMYILTFDEDTAFVDGLPVRTMSILFNM  180

Query: 183  VTGVAIALTIPAAGALLVSTIMVLPASIAMRLGKNFKTVILLGIVIGFSGMLSGIFLSYF  242
            VTGVAIAL IPAAGALLVSTIMVLPASIA+RLGKNFK+V+LL   IGF GM++G+++SY+
Sbjct: 181  VTGVAIALMIPAAGALLVSTIMVLPASIALRLGKNFKSVMLLASAIGFLGMVAGLYISYY  240

Query: 243  FETPASATITMIFISIFLLVSL                                       264
            ETPASA+IT+IF+++F+L+SL
Sbjct: 241  AETPASASITIIFVTVFILISL                                       262
```

An alignment of the GAS and GBS proteins is shown below:

```
Identities = 223/270 (82%), Positives = 252/270 (92%)
Query:  12  MLLDMLSYDFMQRALLAVVAISIFAPILGIFLILRRQSLMSDTLSHVSLAGVALGVVLGI   71
            ++LD+L YDFMQRA++AVVAISIFAPILGIFLILRRQSLMSDTLSHVSLAGVALGVVLGI
Sbjct:   2  VMLDILFYDFMQRAVMAVVAISIFAPILGIFLILRRQSLMSDTLSHVSLAGVALGVVLGI   61

Query:  72  SPTWSTIFVVTLAAVVLEYLRTVYKHYMEISTAILMSMGLAISLIVMSKAHNVGNVSLEQ  131
            SPT +TI VV LAA++LEYLR VYKHYMEISTAILMS+GLA+SLI+MSK+H+  ++SLEQ
```

```
                                     -continued
Sbjct:  62  SPTITTIIVVVLAAILLEYLRVVYKHYMEISTAILMSLGLALSLIIMSKSHSSSSMSLEQ  121

Query: 132  YLFGSIITIGKEQVIALFVIALITFILTILFIRPMYILTFDEDTAFVDGLPVRTMSILFN  191
            YLFGSIITI EQV+ALF IA I  ILT+LFIRPMYILTFDEDTAFVDGLPVR MS+LFN
Sbjct: 122  YLFGSIITISMEQVVALFAIAAIILILTVLFIRPMYILTFDEDTAFVDGLPVRLMSVLFN  181

Query: 192  VVTGIAIALTIPAAGALLVSTIMVLPASIAMRLGRNFKTVIFLGMLIGFVGMVAGIFLSY  251
            +VTG+AIALTIPAAGALLVSTIMVLPASIAMRLG+NFKTVI LG++IGF GM++GIFLSY
Sbjct: 182  IVTGVAIALTIPAAGALLVSTIMVLPASIAMRLGKNFKTVILLGIVIGFSGMLSGIFLSY  241

Query: 252  YWETPASATITMIFIGIFLLVSLVGLLRKR                               281
            ++ETPASATITMIFI IFLLVSL G+L+KR
Sbjct: 242  FFETPASATITMIFISIFLLVSLGGMLKKR                               271
```

Based on this analysis, it was predicted that these proteins and their epitopes could be useful antigens for vaccines or diagnostics.

Example 110

A DNA sequence (GBSx0113) was identified in *S. agalactiae* <SEQ ID 365> which encodes the amino acid sequence <SEQ ID 366>. This protein is predicted to be streptodornase. Analysis of this protein sequence reveals the following:

Possible site: 59
>>> Seems to have no N-terminal signal sequence
----- Final Results -----
    bacterial cytoplasm --- Certainty = 0.2601 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database:

```
>GP: CAA59264 GB: X84793 streptodornase [Streptococcus pyogenes]
Identities = 58/167 (34%), Positives = 85/167 (50%), Gaps = 30/167 (17%)
Query:   2  TPIYEGNNLVPSRVELQYVGIDKQGKLLEIKLGGGKEQVDEYGVTTVTLENTSPLAKIDY   61
            TP+Y+G+ L+P  V +   D          +DE    TV + N       IDY
Sbjct: 245  TPVYQGSELLPRAVLVSALSSDGF--------------IDE----TVRVFNNVAGFNIDY  286

Query:  62  KTGMLIKEDGKQAEEGEDPNSDADENEAAIE-SASDIEENTNTNTSESDTNNVAPQNRIV  120
            + G L+ E      P ++ D  E  +E +    IE+  +T+T + D  N++ Q + V
Sbjct: 287  QNGGLLTES---------PVTETDNVEENVEDNIETIEDEVDTDTLKKDDENISLQ-KTV  336

Query: 121  YVANKGRSNTYWYSLENI-KNANTANIVQMTEQEALNQHKHHSTTEA              166
            YVA+ G SN YWYS EN+ KN N   +V+M+EQ AL + KHHS  EA
Sbjct: 337  YVASSGLSNVYWYSKENMPKNVNLDKVVEMSEQTALARGKHHSAQEA              383
```

A related DNA sequence was identified in *S. pyogenes* <SEQ ID 367> which encodes the amino acid sequence <SEQ ID 368>. Analysis of this protein sequence reveals the following:

Possible site: 31
>>> Seems to have a cleavable N-term signal seq.
----- Final Results -----

-continued bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>

An alignment of the GAS and GBS proteins is shown below:

```
Identities = 51/90 (56%), Positives = 66/90 (72%), Gaps = 4/90 (4%)
Query:   1  MTPIYEGNNLVPSRVELQYVGIDKQGKLLEIKLGGGKEQVDEYGVTTVTLENTSPLAKID   60
            +TP+Y  N LVP +V LQYVGID+ G LL+IKLG  KE VD +GVT+VTL+N SPLA++D
Sbjct: 182  VTPVYHKNELVPRQVVLQYVGIDENGDLLQIKLGSEKESVDNFGVTSVTLDNVSPLAELD  241

Query:  61  YKTGMLIKEDGKQAEEGEDPNSDADENEAA                                90
            Y+TGM++   D  Q E  ED N +  +E E A
Sbjct: 242  YQTGMML--DSTQNE--EDSNLETEEFEEA                                267
```

Based on this analysis, it was predicted that these proteins and their epitopes could be useful antigens for vaccines or diagnostics.

Example 111

A DNA sequence (GBSx0114) was identified in *S. agalactiae* <SEQ ID 369> which encodes the amino acid sequence <SEQ ID 370>. This protein is predicted to be tyrosyl-tRNA synthetase (tyrS-1). Analysis of this protein sequence reveals the following:

Possible site: 60
>>> Seems to have no N-terminal signal sequence

----- Final Results -----
  bacterial cytoplasm --- Certainty = 0.3618 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database:

Possible site: 37
>>> Seems to have no N-terminal signal sequence
----- Final Results -----
  bacterial cytoplasm --- Certainty = 0.2340 (Affirmative) <succ>
  bacterial membrane --- Certainty = 0.0000 (Not Clear) <succ>
  bacterial outside --- Certainty = 0.0000 (Not Clear) <succ>

```
>GP: AAC00303 GB: AF008220 tyrosine tRNA synthetase [Bacillus subtilis]
Identities = 234/420 (55%), Positives = 311/420 (73%), Gaps = 2/420 (0%)
Query:   2 NIFDELKERGLVFQTTDEDALRKALEEGSVSYYTGYDPTADSLHLGHLVAILTSRRLQLA    61
           N+ ++L  RGL+ Q TDE+ L K L E  +  Y+G+DPTADSLH+GHL+ ILT RR QLA
Sbjct:   3 NLLEDLSFRGLIQQMTDEEGLNKQLNEEKIRLYSGFDPTADSLHIGHLLPILTLRRFQLA    62

Query:  62 GHKPYALVGGATGLIGDPSFKDVERSLQTKKTVVSWGNKIRGQLSNFLEFETGDNKAVLV   121
           GH P ALVGGATGLIGDPS K  ER+L T   V W  KI+ QLS FL+FE  +N AV+
Sbjct:  63 GHHPIALVGGATGLIGDPSGKKAERTLNTADIVSEWSQKIKNQLSRFLDFEAAENPAVIA   122

Query: 122 NNYDWFSNISFIDFLRDVGKYFTVNYMMSKESVKKRIETGISYTEFAYQIMQGYDFYELN   181
           NN+DW   ++ IDFLRDVGK F +NYM++K++V  RIE+GISYTEF+Y I+Q YDF  L
Sbjct: 123 NNFDWIGKMNVIDFLRDVGKNFGINYMLAKDTVSSRIESGISYTEFSYMILQSYDFLNLY   182

Query: 182 KNYNVTLQIGGSDQWGNMTAGTELIRR--KSNGVSHVMTVPLITDSTGKKFGKSEGNAVW   239
           ++ N  LQIGGSDQWGN+TAG ELIR+  +    +T+PL+T + G KFGK+EG A+W
Sbjct: 183 RDKNCKLQIGGSDQWGNITAGLELIRKSEEEGAKAFGLTIPLVTKADGTKFGKTEGGAIW   242

Query: 240 LDADKTSPYEMYQFWLNVMDADAVRFLKIFTFLSLKEIEDIRIQFEEAPHQRLAQKTLAR   299
           LD +KTSPYE YQFW+N  D D V++LK FTFLS +EIE    + E  AP +R AQK LA
Sbjct: 243 LDKEKTSPYEFYQFWINTDDRDVVKYLKYFTFLSKEEIEAYAEKTETAPEKREAQKRLAE   302

Query: 300 EVVTLVHGEKAYKEAVNITEQLFAGNIKGLSVKELKQGLRGVPNYHVQTEDNLNIIDLLV   359
           EV +LVHG +A  ++A+NI++ LF+GNIK LS  +++K G + VP+ V    L+++D+LV
Sbjct: 303 EVTSLVHGREALEQAINISQALFSGNIKELSAQDVKVGFKDVPSMEVDSTQELSLVDVLV   362

Query: 360 TSGVVNSKRQAREDVSNGAIYINGDRIQDLEYTISENDKLENEITVIRRGKKKYFVLNFK   419
             S +   SKRQARED+ NGA+YING+R   ++ YT+S  D++EN+ TV+RRGKKKYF++ +K
Sbjct: 363 QSKLSPSKRQAREDIQNGAVYINGERQTEINYTLSGEDRIENQFTVLRRGKKKYFLVTYK   422
```

A related DNA sequence was identified in *S. pyogenes* <SEQ ID 371> which encodes the amino acid sequence <SEQ ID 372>. Analysis of this protein sequence reveals the following:

An alignment of the GAS and GBS proteins is shown below:

```
Identities = 344/418 (82%), Positives = 377/418 (89%)
Query:   1 MNIFDELKERGLVFQTTDEDALRKALEEGSVSYYTGYDPTADSLHLGHLVAILTSRRLQL    60
           MNIF+ELK RGLVFQTTDE AL KAL EG VSYYTGYDPTADSLHLGHLVAILTSRRLQL
Sbjct:   1 MNIFEELKARGLVFQTTDEQALVKALTEGQVSYYTGYDPTADSLHLGHLVAILTSRRLQL    60

Query:  61 AGHKPYALVGGATGLIGDPSFKDVERSLQTKKTVVSWGNKIRGQLSNFLEFETGDNKAVL   120
           AGHKPYALVGGATGLIGDPSFKD ERSLQTK+TV+ W +KI+GQLS FL+FE GDNKA L
Sbjct:  61 AGHKPYALVGGATGLIGDPSFKDAERSLQTKETVLEWSDKIKGQLSTFLDFENGDNKAEL   120

Query: 121 VNNYDWFSNISFIDFLRDVGKYFTVNYMMSKESVKKRIETGISYTEFAYQIMQGYDFYEL   180
           VNNYDWFS ISFIDFLRDVGKYFTVNYMMSK+SVKKRIETGISYTEFAYQIMQGYDFYEL
Sbjct: 121 VNNYDWFSQISFIDFLRDVGKYFTVNYMMSKDSVKKRIETGISYTEFAYQIMQGYDFYEL   180

Query: 181 NKNYNVTLQIGGSDQWGNMTAGTELIRRKSNGVSHVMTVPLITDSTGKKFGKSEGNAVWL   240
           N +NVTLQIGGSDQWGNMTAGTEL+R+K++    HVMTVPLITDSTGKKFGKSEGNAVWL
Sbjct: 181 NDKHNVTLQIGGSDQWGNMTAGTELLRKKADTGHVMTVPLITDSTGKKFGKSEGNAVWL   240

Query: 241 DADKTSPYEMYQFWLNVMDADAVRFLKIFTFLSLKEIEDIRIQFEEAPHQRLAQKTLARE   300
           DADKTSPYEMYQFWLNVMD DAVRFLKIFTFLSL EI +I  QF   A H+RLAQKTLARE
Sbjct: 241 DADKTSPYEMYQFWLNVMDDDAVRFLKIFTFLSLDEIAEIETQFNAARHERLAQKTLARE   300

Query: 301 VVTLVHGEKAYKEAVNITEQLFAGNIKGLSVKELKQGLRGVPNYHVQTEDNLNIIDLLVT   360
           VVTLVHGE+AYK+A+NITEQLFAGNIK LS  ELKQGL  VPNYHVQ+ DN NI+++LV
Sbjct: 301 VVTLVHGEEAYKQALNITEQLFAGNIKNLSANELKQGLSNVPNYHVQSIDNHNIVEILVA   360

Query: 361 SGVVNSKRQAREDVSNGAIYINGDRIQDLEYTISENDKLENEITVIRRGKKKYFVLNF    418
           + +   SKRQAREDV NGAIYINGDR+QDL+Y +S +DK+++++TVIRRGKKKY VL +
Sbjct: 361 AKISPSKRQAREDVQNGAIYINGDRVQDLDYQLSNDDKIDDQLTVIRRGKKKYAVLTY    418
```

Based on this analysis, it was predicted that these proteins and their epitopes could be useful antigens for vaccines or diagnostics.

Example 112

A DNA sequence (GBSx0115) was identified in *S. agalactiae* <SEQ ID 373> which encodes the amino acid sequence <SEQ ID 374>. Analysis of this protein sequence reveals the following:

Possible site: 53
>>> Seems to have no N-terminal signal sequence

INTEGRAL   Likelihood = −12.21   Transmembrane 36-52 (23-59)
----- Final Results -----
  bacterial membrane --- Certainty = 0.5883 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database:

```
>GP: AAF04736 GB: AF101781 penicillin-binding protein 1b
[Streptococcus pneumoniae]
Identities = 445/769 (57%), Positives = 581/769 (74%), Gaps = 9/769 (1%)
Query:    3 KGNKKLNSSKLGDYTP----LEFGSIFLRI---VKLLSDFIYVIILLFVMLGVGLAVGYL   55
              K K    KG T      L+  +IF  I   +K L + ++V+  L  MLG G+A+GY
Sbjct:   21 KNKKSARPGKKGSSTKKSKTLDKSAIFPAILLSIKALFNLLFVLGFLGGMLGAGIALGYG   80

Query:   56 ASQVDSVKVPSKNSLVTQVNTLTRVSRLTYSDKSQISEIATDLQRTPVAKDAISDNIKKA  115
               + D V+VP    LV QV  ++ +S +TYSD + I+  I +DL RT ++ + IS+N+KKA
Sbjct:   81 VALFDKVRVPQTEELVNQVKDISSISEITYSDGTVIASIESDLLRTSISSEQISENLKKA  140

Query:  116 IIATEDENFNDHKGVVPKAVLRAAAGSVLGFGESSGGSTLTQQLLKQQILGDDPSFKRKS  175
              IIATEDE+F +HKGVVPKAV+RA  G  +G G SSGGSTLTQQL+KQQ++GD P+ RK+
Sbjct:  141 IIATEDEHFKEHKGVVPKAVIRATLGKFVGLGSSSGGSTLTQQLIKQQVVGDAPTLARKA  200

Query:  176 KEIIYALALERYMDKDSILSDYLNVSPFGRNNKGQNIAGIEEAAQGIFGVSAKDLTIPQA  235
                EI+ ALALER M+KD IL+ YLNV+PFGRNNKGQNIAG  +AA+GIFGV A  LT+PQA
Sbjct:  201 AEIVDALALERAMNKDEILTTYLNVAPFGRNNKGQNIAGARQAAEGIFGVDASQLTVPQA  260

Query:  236 AFLAGLPQSPIVYSPYTADAQLKSDKDLSFGIKRQKNVLYNMYRTRALTKDEYKSYKDYD  295
              AFLAGLPQSPI YSPY   +LKSD+DL  G+++R K VLY+MYRT AL+KDEY  YKDYD
Sbjct:  261 AFLAGLPQSPITYSPYENTGELKSDEDLEIGLRRAKAVLYSMYRTGALSKDEYSQYKDYD  320

Query:  296 IKKDFIKPAVATTNHHDYLYYSALSEAQKVMYNYLIKKDNVSEHDLKNDETRATYRHRAI  355
              +K+DF+       T   DYLY++ L+EAQ+ MY+YL ++DNVS  +LKN+ T+  YR  A
Sbjct:  321 LKQDFLPSGTVTGISRDYLYFTTLAEAQERMYDLAQRDNVSAKELENEATQKFYRDLAA  380

Query:  356 EEIQQGGYTIKTTINKSVYQAMQDAAAQYGGLLDDGTGKVQMGNVLTDNSSGAIIGFIGG  415
              +EI+  GGY I  TTI++ ++  AMQ A A YG LLDDGTG+V++GNVL DN +GAI+GF+GG
Sbjct:  381 KEIENGGYKITTTIDQKIHSAMQSAVADYGYLLDDGTGRVEVGNVLMDNQTGAILGFVGG  440

Query:  416 RNYSENQNNHAFDTARSPGSSIKPILPYGIAIDQGMLGSGSVLSNYPTTYSSGEKIMHAD  475
              RNY ENQNNHAFDT RSP S+ KP+L YGIAIDQG++GS ++LSNYPT  +++G  IM+A+
Sbjct:  441 RNYQENQNNHAFDTKRSPASTTKPLLAYGIAIDQGLMGSETILSNYPTNFANGNPIMYAN  500

Query:  476 EEGTAMVNLQESLDISWNIPAFWTYKMLRDRGVDVKNYMEKLDYPIENFGIESLPLGGGI  535
               +GT M+  L E+L+  SWNIPA+WTY+MLR + GVDVK YMEK+ Y I  +GIESLP+GGGI
Sbjct:  501 SKGTGMMTLGEALNYSWNIPAYWTYRMLRENGVDVKGYMEKMGYEIPEYGIESLPMGGGI  560

Query:  536 DTSVAQQTNLYQMIANGGVYHKQYMIESIEDSNGKVIYNHESKPVRVFSKATATILQQLL  595
              +  +VAQ TN YQ +AN GVYH++++I   IE  ++G+V+Y  ++ KPV+V+SKATATI+Q LL
Sbjct:  561 EVTVAQHTNGYQTLANNGVYHQKHVISKIEAADGRVVYEYQDKPVQVYSKATATIMQGLL  620

Query:  596 HGPINSGKTTTFKNRLQGLNSGLAGVDWIGKTGTTNSTSDVWLMLSTPKVTLGGWAGHDN  655
                ++S    TTTFK+  L   LN   LA  DWIGKTGTTN    ++WLMLSTP++TLGGW GHD+
Sbjct:  621 REVLSSRVTTTFKSNLTSLNPTLANADWIGKTGTTNQDENMWLMLSTPRLTLGGWIGHDD  680

Query:  656 NASLAKLTGYNNNANYMAHLVNAINNADGNTFGKSERFRLDDSVIKAKVLKSTGLQPGVV  715
              N SL++   GY+NN+NYMAHLVNAI  A   +G +ERF LD SV+K++VLKSTG +PG V
Sbjct:  681 NHSLSRRAGYSNNSNYMAHLVNAIQQASPSIWG-NERFALDPSVVKSEVLKSTGQKPGKV  739

Query:  716 TVNGRRITVGGESTTSYWA-KNGPGTMTYRFAIGGTDSDYQKAWSTLGG            763
              +V G+ + V G + TSYWA K+G      +YRFAIGG +D+DYQ  AWS++  G
Sbjct:  740 SVEGKEVEVTGSTVTSYWANKSGAPATSYRFAIGGSDADYQNAWSSIVG            788
```

A related DNA sequence was identified in *S. pyogenes* <SEQ ID 375> which encodes the amino acid sequence <SEQ ID 376>. Analysis of this protein sequence reveals the following:

Possible site: 57
>>> Seems to have no N-terminal signal sequence

INTEGRAL    Likelihood = −4.83    Transmembrane 39-55 (32-60)
----- Final Results -----
    bacterial membrane --- Certainty = 0.2932 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP: AAF04736 GB: AF101781 penicillin-binding protein 1b
[Streptococcus pneumoniae]
Identities = 438/739 (59%), Positives = 580/739 (78%), Gaps = 2/739 (0%)
Query:   27 PVLLRTLRLLSNFFYIVIFLFGMMGFGMAFGYLASQIESVKVPSKESLVKQVESLTMISQ   86
            P +L +++ L N  +++ FL GM+G G+A GY  +   + V+VP  E LV QV+ ++ IS+
Sbjct:   48 PAILLSIKALFNLLFVLGFLGGMLGAGIALGYGVALFDKVRVPQTEELVNQVKDISSISE  107

Query:   87 MNYSDNSLISTLDTDLLRTPVANDAISENIKKAIVSTEDEHFQEHKGIVPKAVFRATLAS  146
            + YSD ++I+++++DLLRT ++++ ISEN+KKAI++TEDEHF+EHKG+VPKAV RATL
Sbjct:  108 ITYSDGTVIASIESDLLRTSISSEQISENLKKAIIATEDEHFKEHKGVVPKAVIRATLGK  167

Query:  147 VLGFGEASGGSTLTQQLVKQQVLGDDPTFKRKSKEIVYALALERYMSKDNILCDYLNVSP  206
             +G G +SGGSTLTQQL+KQQV+GD PT  RK+ EIV ALALER M+KD IL  YLNV+P
Sbjct:  168 FVGLGSSSGGSTLTQQLIKQQVVGDAPTLARKAAEIVDALALERAMNKDEILTTYLNVAP  227

Query:  207 FGRNNKGQNIAGVEEAARGIFGVSAKDLTVPQAAFLAGLPQSPIVYSPYLSTGQLKSEKD  266
            FGRNNKGQNIAG  +AA GIFGV A  LTVPQAAFLAGLPQSPI YSPY +TG+LKS++D
Sbjct:  228 FGRNNKGQNIAGARQAAEGIFGVDASQLTVPQAAFLAGLPQSPITYSPYENTGELKSDED  287

Query:  267 MAYGIKRQQNVLFNMYRTGVLSKKEYEDYKAYPIQKDFIQPGSAIVNNHDYLYYTVLADA  326
            +   G++R + VL++MYRTG LSK EY  YK Y +++DF+  G+     + DYLY+T LA+A
Sbjct:  288 LEIGLRRAKAVLYSMYRTGALSKDEYSQYKDYDLKQDFLPSGTVTGISRDYLYFTTLAEA  347

Query:  327 KKAMYSYLIKRDKVSSRDLKNDETKAAYEERALTELQQGGYTITTTINKPIYNAMQTAAA  386
            ++ MY YL +RD VS+++LKN+ T+  Y + A  E++ GGY ITTTI++  I++AMQ+A A
Sbjct:  348 QERMYDYLAQRDNVSAKELKNEATQKFYRDLAAKEIENGGYKITTTIDQKIHSAMQSAVA  407

Query:  387 QFGGLLDDGTGTVQMGNVLTDNATGAVLGFVGGRDYALNQNNHAFNTVRSPGSSIKPIIA  446
            +G LLDDGTG V++GNVL DN TGA+LGFVGGR+Y  NQNNHAF+T RSP S+ KP++A
Sbjct:  408 DYGYLLDDGTGRVEVGNVLMDNQTGAILGFVGGRNYQENQNNHAFDTKRSPASTTKPLLA  467

Query:  447 YGPAIDQGLMGSASVLSNYPTTYSSGQKIMHADSEGTAMMPLQEALNTSWNIPAFWTQKL  506
            YG AIDQGLMGS ++LSNYPT +++G  IM+A+S+GT MM L EALN SWNIPA+WT ++
Sbjct:  468 YGIAIDQGLMGSETILSNYPTNFANGNPIMYANSKGTGMMTLGEALNYSWNIPAYWTYRM  527

Query:  507 LREKGVDVENYMTKMGYKIADYSIESLPLGGGIEVSVAQQTNAYQMLSNNGLYQKQYIVD  566
            LRE GVDV+ YM KMGY+I +Y IESLP+GGGIEV+VAQ TN YQ L+NNG+Y +++++
Sbjct:  528 LRENGVDVKGYMEKMGYEIPEYGIESLPMGGGIEVTVAQHTNGYQTLANNGVYHQKHVIS  587

Query:  567 KITASDGTVVYKHENKPIRIFSAATATILQELLRGPITSGATTTFKNRLAAINPWLANAD  626
            KI A+DG VVY++++KP++++S ATATI+Q LLR  ++S TTTFK+ L ++NP LANAD
Sbjct:  588 KIEAADGRVVYEYQDKPVQVYSKATATIMQGLLREVLSSRVTTTFKSNLTSLNPTLANAD  647

Query:  627 WIGKTGTTENYTDVWLVLSTPKVTLGGWAGHDDNTSLAPLTGYNNNSNYLAYLANAINQA  686
            WIGKTGTT   ++WL+LSTP++TLGGW GHDDN SL+   GY+NNSNY+A+L NAI QA
Sbjct:  648 WIGKTGTTNQDENMWLMLSTPRLTLGGWIGHDDNHSLSRRAGYSNNSNYMAHLVNAIQQA  707

Query:  687 DPNVIGVGQRFNLDPGVIKANVLKSTGLQPGTVNVNGHTFSVGGEMTTSLWSQK-GPGAM  745
            P++  G  +RF LDP V+K+ VLKSTG +PG V+V G    V  G   TS W+ K G  A
Sbjct:  708 SPSIWG-NERFALDPSVVYSEVLKSTGQKPGKVSVEGKEVEVTGSTVTSYWANKSGAPAT  766

Query:  746 TYRFAIGGTDADYQKAWGN                                          764
            +YRFAIGG+DADYQ AW +
Sbjct:  767 SYRFAIGGSDADYQNAWSS                                          785
```

An alignment of the GAS and GBS proteins is shown below:

```
Identities = 531/760 (69%), Positives = 639/760 (83%), saps = 3/760 (0%)
Query:    6 KKLNSSKLGDYTPLEFGSIFLRIVKLLSDFIYVIILLFVMLGVGLAVGYLASQVDSVKVP  65
            K+++  +LG     L+ G + LR ++LLS+F Y++I LF M+G G+A GYLASQ++SVKVP
Sbjct:   13 KRISHQRLG---LLDLGPVLLRTLRLLSNFFYIVIFLFGMMGFGMAFGYLASQIESVKVP  69

Query:   66 SKNSLVTQVNTLTRVSRLTYSDKSQISEIATDLQRTPVAKDAISDNIKKAIIATEDENFN 125
            SK SLV QV +LT +S++ YSD S IS + TDL RTPVA DAIS+NIKKAI++TEDE+F
Sbjct:   70 SKESLVKQVESLTMISQMNYSDNSLISTLDTDLLRTPVANDAISENIKKAIVSTEDEHFQ 129

Query:  126 DHKGVVPKAVLRAAAGSVLGFGESSGGSTLTQQLLKQQILGDDPSFKRKSKEIIYALALE 185
            +HKG+VPKAV RA    SVLGFGE+SGGSTLTQQL+KQQ+LGDDP+FKRKSKEI+YALALE
Sbjct:  130 EHKGIVPKAVFRATLASVLGFGEASGGSTLTQQLVKQQVLGDDPTFKRKSKEIVYALALE 189

Query:  186 RYMDKDSILSDYLNVSPFGRNNKGQNIAGIEEAAQGIFGVSAKDLTIPQAAFLAGLPQSP 245
            RYM KD+IL DYLNVSPFGRNNKGQNIAG+EEAA+GIFGVSAKDLT+PQAAFLAGLPQSP
Sbjct:  190 RYMSKDNILCDYLNVSPFGRNNKGQNIAGVEEAARGIFGVSAKDLTVPQAAFLAGLPQSP 249

Query:  246 IVYSPYTADAQLKSDKDLSFGIKRQKNVLYNMYRTRALTKDEYKSYKDYDIKKDFIKPAV 305
            IVYSPY +  QLKS+KD+++GIKRQ+NVL+NMYRT  L+K EY+ YK Y I+KDFI+P
Sbjct:  250 IVYSPYLSTGQLKSEKDMAYGIKRQQNVLFNMYRTGVLSKKEYEDYKAYPIQKDFIQPGS 309

Query:  306 ATTNHHDYLYYSALSEAQKVMYNYLIKKDNVSEHDLKNDETRATYRHRAIEEIQQGGYTI 365
            A   N+HDYLYY+ L++A+K MY+YLIK+D VS  DLKNDET+A Y  RA+ E+QQGGYTI
Sbjct:  310 AIVNNHDYLYYTVLADAKKAMYSYLIKRDKVSSRDLKNDETKAAYEERALTELQQGGYTI 369

Query:  366 KTTINKSVYQAMQDAAAQYGGLLDDGTGKVQMGNVLTDNSSGAIIGFIGGRNYSENQNNH 425
             TTINK +Y AMQ  AAAQ+GGLLDDGTG VQMGNVLTDN++GA++GF+GGR+Y+ NQNNH
Sbjct:  370 TTTINKPIYNAMQTAAAQFGGLLDDGTGTVQMGNVLTDNATGAVLGFVGGRDYALNQNNH 429

Query:  426 AFDTARSPGSSIKPILPYGIAIDQGMLGSGSVLSNYPTTYSSGEKIMHADEEGTAMVNLQ 485
            AF+T RSPGSSIKPI+ YG AIDQG++GS SVLSNYPTTYSSG+KIMHAD EGTAM+ LQ
Sbjct:  430 AFNTVRSPGSSIKPIIAYGPAIDQGLMGSASVLSNYPTTYSSGQKIMHADSEGTAMMPLQ 489

Query:  486 ESLDISWNIPAFWTYKMLRDRGVDVKNYMEKLDYPIENFGIESLPLGGGIDTSVAQQTNL 545
            E+L+  SWNIPAFWT K+LR++GVDV+NYM K+ Y I ++ IESLPLGGGI+ SVAQQTN
Sbjct:  490 EALNTSWNIPAFWTQKLLREKGVDVENYMTKMGYKIADYSIESLPLGGGIEVSVAQQTNA 549

Query:  546 YQMIANGGVYHKQYMIESIEDSNGKVIYNHESKPVRVFSKATATILQQLLHGPINSGKTT 605
            YQM++N G+Y KQY+++  I   S+G V+Y HE+KP+R+FS ATATILQ+LL GPI SG TT
Sbjct:  550 YQMLSNNGLYQKQYIVDKITASDGTVVYKHENKPIRIFSAATATILQELLRGPITSGATT 609

Query:  606 TFKNRLQGLNSGLAGVDWIGKTGTTNSTSDVWLMLSTPKVTLGGWAGHDNNASLAKLTGY 665
            TFKNRL  +N  LA  DWIGKTGTT + +DVWL+LSTPKVTLGGWAGHD+N SLA LTGY
Sbjct:  610 TFKNRLAAINPWLANADWIGKTGTTENYTDVWLVLSTPKVTLGGWAGHDDNTSLAPLTGY 669

Query:  666 NNNANYMAHLVNAINNADGNTFGKSERFRLDDSVIKAKVLKSTGLQPGVVTVNGRRITVG 725
            NNN+NY+A+L NAIN AD N G   +RF LD  VIKA VLKSTGLQPG V VNG   +VG
Sbjct:  670 NNNSNYLAYLANAINQADPNVIGVGQRFNLDPGVIKANVLKSTGLQPGTVNVNGHTFSVG 729

Query:  726 GESTTSYWAKNGPGTMTYRFAIGGTDSDYQKAWSTLGGKR                     765
            GE TTS W++ GPG MTYRFAIGGTD+DYQKAW     G ++
Sbjct:  730 GEMTTSLWSQKGPGAMTYRFAIGGTDADYQKAWGNFGFRK                     769
```

Figure 120:
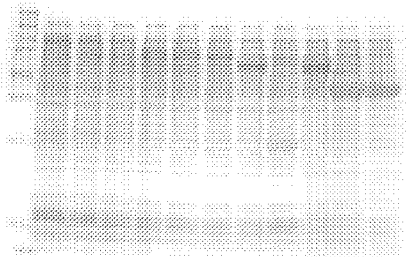

SEQ ID 374 (GBS64d) was expressed in *E. coli* as a GST-fusion product. SDS-PAGE analysis of total cell extract is shown in FIG. 120 (lane 2-4; MW 107 kDa). It was also expressed in *E. coli* as a His-fusion product. SDS-PAGE analysis of total cell extract is shown in FIG. 120 (lane 5-7; MW 82 kDa) and in FIG. 179 (lane 2; MW 82 kDa).

GBS64d-His was purified as shown in FIG. 231, lane 7-8.

Based on this analysis, it was predicted that these proteins and their epitopes could be useful antigens for vaccines or diagnostics.

Example 113

A DNA sequence (GBSx0116) was identified in *S. agalactiae* <SEQ ID 377> which encodes the amino acid sequence <SEQ ID 378>. This protein is predicted to be DNA-dependent RNA polymerase subunit beta (rpoB). Analysis of this protein sequence reveals the following:

---

Possible site: 61
>>> Seems to have no N-terminal signal sequence
----- Final Results -----
    bacterial cytoplasm --- Certainty = 0.3505 (Affirmative) <succ>
    bacterial membrane --- Certainty = 0.0000 (Not Clear) <succ>
    bacterial outside --- Certainty = 0.0000 (Not Clear) <succ>

---

The protein has homology with the following sequences in the GENPEPT database:

```
>GP: CAB56706 GB: Y16468 DNA-dependent RNA polymerase subunit beta
[Listeria monocytogenes]
Identities = 814/1173 (69%), Positives = 978/1173 (82%), Gaps = 17/1173 (1%)
Query:    2 AGHEVQYGKHRTRRSFSRIKEVLDLPNLIEIQTDSFQDFLDAGLKEVFEDVLPISNFTDT   61
```

```
                    +GH+V+YG+HRTRRSF+RI  EVL+LPNLIEIQT S+Q FLD GL+E+F D+ PI +F
Sbjct:     5 SGHDVKYGRHRTRRSFARISEVLELPNLIEIQTASYQWFLDEGLREMFRDISPIEDFAGN   64

Query:    62 MDLEFVGYELKEPKYTLEEARIHDASYSAPIFVTFRLVNKETGEIKTQEVFFGDFPIMTE  121
             + LEF+ Y+L EPKY++EE++ DA+Y+AP+ V  RL+NKETGE+K QEVF GDFP+MTE
Sbjct:    65 LSLEFIDYDLGEPKYSVEESKNRDANYAAPLRVKLRLINKETGEVKDQEVFMGDFPLMTE  124

Query:   122 MGTFIINGGERIIVSQLVRSPGVYFNDKVDKNGKVGYGSTVIPNRGAWLELETDAKDIAY  181
             MGTFIING ER+IVSQLVRSPGVYFN K+DKNGK G+GSTVIPNRGAWLE ETDAKD+ +
Sbjct:   125 MGTFIINGAERVIVSQLVRSPGVYFNGKLDKNGKKGFGSTVIPNRGAWLEYETDAKDVVH  184

Query:   182 TRIDRTRKIPFTTLVRALGFSGDDEIVDIFGDSELVRNTIEKDIHKNPSDSRTDEALKEI  241
               RIDRTRK+P T L+RALGF D EI+D+ GD++ +RNT+EKD N     ++AL EI
Sbjct:   185 VRIDRTRKLPVTVLLRALGFSDQEIIDLIGDNDYLRNTLEKDNTDN-----AEKALLEI  239

Query:   242 YERLRPGEPKTADSSRSLLVARFFDPRRYDLAAVGRYKINKKLNLKTRLLNQTIAENLVD  301
             YERLRPGEP T D++RSLLV +RFFDP+RYDLA+VGRYKINKKL+LK RL NQT+AE LVD
Sbjct:   240 YERLRPGEPPTVDNARSLLVSRFFDPKRYDLASVGRYKINKKLHLKNRLFNQTLAETLVD  299

Query:   302 GETGEILVEAGTVMTRDVIDSIAEHIDGDLNKFVYTPNDYAVVTEPVILQKFKVVAPTDP  361
                ETGEI+  G ++R +D I  +++ +         P D  V+ + V++Q  K+ AP D
Sbjct:   300 PETGEIIASKGDILDRRNLDQIIPNLENGVGFRTLRPTD-GVMEDSVLVQSIKIYAPNDE  358

Query:   362 DRVVTIVGNSNPEDKVRALTPADILAEMSYFLNLAEGIGKVDDIDHLGNRRIRAVGELLA  421
              ++ + I+GN+  E+ V+ +TP+DI++ +SYF NL  G+G DDIDHLGNRR+R+VGELL
Sbjct:   359 EKEINIIGNAYIEENVKHITPSDIISSISYFFNLLHGVGDTDDIDHLGNRRLRSVGELLQ  418

Query:   422 NQFRIGLARMERNVRERMSVQDNEVLTPQQIINIRPVTAAVKEFFGSSQLSQFMDQHNPL  481
             NQFRIGL+RMER VRERMS+QD   +TPQQ+INIRPV A++KEFFGSSQLSQFMDQ NPL
Sbjct:   419 NQFRIGLSRMERVVRERMSIQDMTTITPQQLINIRPVVASIKEFFGSSQLSQFMDQTNPL  478

Query:   482 SELSHKRRLSALGPGGLTRDRAGYEVRDVHYTHYGRMCPIETPEGPNIGLINNLSSFGHL  541
              EL+HKRRLSALGPGGLTR+RAGYEVRDVHY+HYGRMCPIETPEGPNIGLIN+LSSF +
Sbjct:   479 GELTHKRRLSALGPGGLTRERAGYEVRDVHYSHYGRMCPIETPEGPNIGLINSLSSFAKV  538

Query:   542 NKYGFIQTPYRKVDRSTGAVTNEIVWLTADEEDEFTVAQANSKLNEDGTFAEEIVMGRHQ  601
             NK+GFI TPYR+VD  T  VT++I +LTADEED + VAQANSKL+E GTF EE VM R +
Sbjct:   539 NKFGFIETPYRRVDPETNRVTDKIDYLTADEEDNYVVAQANSKLDEQGTFTEEEVMARFR  598

Query:   602 GNNQEFPSSIVDFVDVSPKQVVAVATACIPFLENDDSNRALMGANMQRQAVPLIDPKAPY  661
              N       +D++DVSPKQVV+VATACIPFLENDDSNRALMGANMQRQAVPL+ P+AP+
Sbjct:   599 SENLAVEKERIDYMDVSPKQVVSVATACIPFLENDDSNRALMGANMQRQAVPLMHPEAPF  658

Query:   662 VGTGMEYQAAHDSGAAVIAKHDGRVIFSDAEKVEVRRED--------GSLDVYHVQKFRR  713
             VGTGME+ +A DSGAAV AKHDG V   +A ++ VRR         G +D Y ++KF R
Sbjct:   659 VGTGMEHVSAKDSGAAVTAKHDGIVEHVEAREIWVRRVSLVDGKEVTGGIDKYTLRKFVR  718

Query:   714 SNSGTAYNQRTLVKVGDLVEKGDFIADGPSMENGEMALGQNPVVAYMTWEGYNFEDAVIM  773
             SN GT YNQR  V  GD V KG+ + +GPSM++GE ALG+N +VA MTW GYN+EDA+IM
Sbjct:   719 SNQGTCYNQRPNVAEGDRVVKGEILGNGPSMDSGELALGRNVLVAFMTWDGYNYEDAIIM  778

Query:   774 SERLVKEDVYTSVHLEEFESETRDTKLGPEEITREIPNVGEDSLRDLDEMGIIRIGAEVK  833
             SERLVK+DVYTS+H+EEFESE RDTKLGPEE+TR IPNVGED+LRDLDE GIIR GAEVK
Sbjct:   779 SERLVKDDVYTSIHIEEFESEARDTKLGPEEMTRDIPNVGEDALRDLDERGIIRVGAEVK  838

Query:   834 EGDILVGKVTPKGEKDLSAEERLLHAIFGDKSREVRDTSLRVPHGGDGVVRDVKIFTRAN  893
              + D+LVGKVTPKG  +L+AEERLLHAIFG+K+REVRDTSLRVPHGG G+V DVKIFTR
Sbjct:   839 DNDLLVGKVTPKGVTELTAEERLLHAIFGEKAREVRDTSLRVPHGGGGIVLDVKIFTREA  898

Query:   894 GDELQSGVNMLVRVYIAQKRKIKVGDKMAGRHGNKGVVSRIVPVEDMPYLPDGTPVDIML  953
             GDEL  GVN LVRVYI QKRKI GDKMAGRHGNKGV+SRI+P EDMP++PDGTPVDIML
Sbjct:   899 GDELPPGVNQLVRVYIVQKRKIHEGDKMAGRHGNKGVISRILPEEDMPFMPDGTPVDIML  958

Query:   954 NPLGVPSRMNIGQVMELHLGMAARNLGIHIATPVFDGASSEDLWETVQEAGMDSDAKTVL  1013
             NPLGVPSRMNIGQV+ELHLGMAAR LGIH+ATPVFDGA+ EDW TV+EAGM DAKT+L
Sbjct:   959 NPLGVPSRMNIGQVLELHLGMAARALGIHVATPVFDGANEEDVWSTVEEAGMARDAKTIL  1018

Query:  1014 YDGRTGEPFDNRVSGVMYMIKLHHMVDDKLHARSVGPYSLVTQQPLGGKAQFGGQRFGE  1073
             YDGR+GE FDNR+SGVMYMIKL HMVDDKLHARS GPYSLVTQQPLGGKAQFGGQRFGE
Sbjct:  1019 YDGRSGEAFDNRISGVNYMIKLAHMVDDKLHARSTGPYSLVTQQPLGGKAQFGGQRFGE  1078

Query:  1074 MEVWALEAYGASNVLQEILTYKSDDVTGRLKAYEAITKGKPIPKPGVPESFRVLVKELQS  1133
             MEVWALEAYGA+   LQEILT KSDDV GR+K YEAI KG+ +P+PGVPESF+VL+KELQS
Sbjct:  1079 MEVWALEAYGAAYTLQEILTIKSDDVVGRVKTYEAIVKGESVPEPGVPESFKVLIKELQS  1138

Query:  1134 LGLDMRVLDEDDNEVELRDLDEGEDDDVMHVDD                           1166
             LG+D+++L D+ E+RD+D  DDD + +D
Sbjct:  1139 LGMDVKMLSADEEEIEMRDMD---DDDFTNQND                           1168
```

A related DNA sequence was identified in *S. pyogenes* <SEQ ID 379> which encodes the amino acid sequence <SEQ ID 380>. Analysis of this protein sequence reveals the following:

Possible site: 61
>>> Seems to have no N-terminal signal sequence

----- Final Results -----
bacterial cytoplasm --- Certainty = 0.3392 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below:

```
Identities = 1129/1190 (94%), Positives = 1168/1190 (97%), Gaps = 3/1190 (0%)
Query:     1 MAGHEVQYGKHRTRRSFSRIKEVLDLPNLIEIQTDSFQDFLDAGLKEVFEDVLPISNFTD   60
             +AGHEV+YGKHRTRRSFSRIKEVLDLPNLIEIQTDSFQDFLD+GLKEVFEDVLPISNFTD
Sbjct:     1 LAGHEVRYGKHRTRRSFSRIKEVLDLPNLIEIQTDSFQDFLDSGLKEVFEDVLPISNFTD   60

Query:    61 TMDLEFVGYELKEPKYTLEEARIHDASYSAPIFVTFRLVNKETGEIKTQEVFFGDFPIMT  120
             TM+LEFVGYE KEPKYTLEEARIHDASYSAPIFVTFRLVNKETGEIKTQEVFFGDFPIMT
Sbjct:    61 TMELEFVGYEFKEPKYTLEEARIHDASYSAPIFVTFRLVNKETGEIKTQEVFFGDFPIMT  120

Query:   121 EMGTFIINGGERIIVSQLVRSPGVYFNDKVDKNGKVGYGSTVIPNRGAWLELETDAKDIA  180
             EMGTFIINGGERIIVSQLVRSPGVYFNDKVDKNGKVGYGSTVIPNRGAWLELETD+KDIA
Sbjct:   121 EMGTFIINGGERIIVSQLVRSPGVYFNDKVDKNGKVGYGSTVIPNRGAWLELETDSKDIA  180

Query:   181 YTRIDRTRKIPFTTLVRALGFSGDDEIVDIFGDSELVRNTIEKDIHKNPSDSRTDEALKE  240
             YTRIDRTRKIPFTTLVRALGFSGDDEIVDIFG+S+LVRNTIEKDIHKNPSDSRTDEALKE
Sbjct:   181 YTRIDRTRKIPFTTLVRALGFSGDDEIVDIFGESDLVRNTIEKDIHKNPSDSRTDEALKE  240

Query:   241 IYERLRPGEPKTADSSRSLLVARFFDPRRYDLAAVGRYKINKKLNLKTRLLNQTIAENLV  300
             IYERLRPGEPKTADSSRSLL+ARFFD RRYDLAAVGRYK+NKKLN+KTRLLNQ IAENLV
Sbjct:   241 IYERLRPGEPKTADSSRSLLIARFFDARRYDLAAVGRYKVNKKLNIKTRLLNQIIAENLV  300

Query:   301 DGETGEILVEAGTVMTRDVIDSIAEHIDGDLNKFVYTPNDYAVVTEPVILQKFKVVAPTD  360
             D ETGEILVEAGT MTR VI+SI EH+DGDLNKFVYTPNDYAVVTEPV+LQKFKVV+P D
Sbjct:   301 DAETGEILVEAGTEMTRSVIESIEEHLDGDLNKFVYTPNDYAVVTEPVVLQKFKVVSPID  360

Query:   361 PDRVVTIVGNSNPEDKVRALTPADILAEMSYFLNLAEGIGKVDDIDHLGNRRIRAVGELL  420
             PDRVVTIVGN+NP+DKVRALTPADILAEMSYFLNLAEG+GKVDDIDHLGNRRIRAVGELL
Sbjct:   361 PDRVVTIVGNANPDDKVRALTPADILAEMSYFLNLAEGLGKVDDIDHLGNRRIRAVGELL  420

Query:   421 ANQFRIGLARMERNVRERMSVQDNEVLTPQQIINIRPVTAAVKEFFGSSQLSQFMDQHNP  480
             ANQFRIGLARMERNVRERMSVQDN+VLTPQQIINIRPVTAAVKEFFGSSQLSQFMDQHNP
Sbjct:   421 ANQFRIGLARMERNVRERMSVQDNDVLTPQQIINIRPVTAAVKEFFGSSQLSQFMDQHNP  480

Query:   481 LSELSHKRRLSALGPGGLTRDRAGYEVRDVHYTHYGRMCPIETPEGPNIGLINNLSSFGH  540
             LSELSHKRRLSALGPGGLTRDRAGYEVRDVHYTHYGRMCPIETPEGPNIGLINNLSSFGH
Sbjct:   481 LSELSHKRRLSALGPGGLTRDRAGYEVRDVHYTHYGRMCPIETPEGPNIGLINNLSSFGH  540

Query:   541 LNKYGFIQTPYRKVDRSTGAVTNEIVWLTADEEDEFTVAQANSKLNEDGTFAEEIVMGRH  600
             LNKYGFIQTPYRKVDR+TG VTNEIVWLTADEEDE+TVAQANSKLNEDGTFAEEIVMGRH
Sbjct:   541 LNKYGFIQTPYRKVDRATGTVTNEIVWLTADEEDEYTVAQANSKLNEDGTFAEEIVNGRH  600

Query:   601 QGNNQEFPSSIVDFVDVSPKQVVAVATACIPFLENDDSNRALMGANMQRQAVPLIDPKAP  660
             QGNNQEF +S+VDFVDVSPKQVVAVATACIPFLENDDSNRALMGANMQRQAVPLIDPKAP
Sbjct:   601 QGNNQEFSASVVDFVDVSPKQVVAVATACIPFLENDDSNRALMGANMQRQAVPLIDPKAP  660

Query:   661 YVGTGMEYQAAHDSGAAVIAKHDGRVIFSDAEKVEVRREDGSLDVYHVQKFRRSNSGTAY  720
             YVGTGMEYQAAHDSGAAVIA+ +G+V+FSDAEKVE+RR+DGSLDVYH+ KFRRSNSGTAY
Sbjct:   661 YVGTGMEYQAAHDSGAAVIAQQNGKVVFSDAEKVEIRRQDGSLDVYHITKFRRSNSGTAY  720

Query:   721 NQRTLVKVGDLVEKGDFIADGPSMENGEMALGQNPVVAYMTWEGYNFEDAVIMSERLVKE  780
             NQRTLVKVGD+VEKGDFIADGPSMENGEMALGQNPVVAYMTWEGYNFEDAVIMSERLVKE
Sbjct:   721 NQRTLVKVGDIVEKGDFIADGPSMENGEMALGQNPVVAYMTWEGYNFEDAVIMSERLVKE  780

Query:   781 DVYTSVHLEEFESETRDTKLGPEEITREIPNVGEDSLRDLDEMGIIRIGAEVKEGDILVG  840
             DVYTSVHLEEFESETRDTKLGPEEITREIPNVGE++L+DLDEMGIIRIGAEVKEGDILVG
Sbjct:   781 DVYTSVHLEEFESETRDTKLGPEEITREIPNVGEEALKDLDEMGIIRIGAEVKEGDILVG  840

Query:   841 KVTPKGEKDLSAEERLLHAIFGDKSREVRDTSLRVPHGGDGVVRDVKIFTRANGDELQSG  900
             KVTPKGEKDLSAEERLLHAIFGDKSREVRDTSLRVPHGGDG+VRDVKIFTRANGDELQSG
Sbjct:   841 KVTPKGEKDLSAEERLLHAIFGDKSREVRDTSLRVPHGGDGIVRDVKIFTRANGDELQSG  900

Query:   901 VNMLVRVYIAQKRKIKVGDKMAGRHGNKGVVSRIVPVEDMPYLPDGTPVDIMLNPLGVPS  960
             VNMLVRVYIAQKRKIKVGDKMAGRHGNKGVVSRIVPVEDMPYLPDGTPVDIMLNPLGVPS
Sbjct:   901 VNMLVRVYIAQKRKIKVGDKMAGRHGNKGVVSRIVPVEDMPYLPDGTPVDIMLNPLGVPS  960

Query:   961 RMNIGQVMELHLGMAARNLGIHIATPVFDGASSEDLWETVQEAGMDSDAKTVLYDGRTGE 1020
             RMNIGQVMELHLGMAARNLGIHIATPVFDGASSEDLW+TV+EAGMDSDAKTVLYDGRTGE
Sbjct:   961 RMNIGQVMELHLGMAARNLGIHIATPVFDGASSEDLWDTVREAGMDSDAKTVLYDGRTGE 1020
```

```
Query:  1021  PFDNRVSVGVMYMIKLHHMVDDKLHARSVGPYSLVTQQPLGGKAQFGGQRFGEMEVWALE  1080
              PFDNRVSVGVMYMIKLHHMVDDKLHARSVGPYSLVTQQPLGGKAQFGGQRFGEMEVWALE
Sbjct:  1021  PFDNRVSVGVMYMIKLHHMVDDKLHARSVGPYSLVTQQPLGGKAQFGGQRFGEMEVWALE  1080

Query:  1081  AYGASNVLQEILTYKSDDVTGRLKAYEAITKGKPIPKPGVPESFRVLVKELQSLGLDMRV  1140
              AYGASNVLQEILTYKSDDVTGRLKAYEAITKGKPIPKPGVPESFRVLVKELQSLGLDMRV
Sbjct:  1081  AYGASNVLQEILTYKSDDVTGRLKAYEAITKGKPIPKPGVPESFRVLVKELQSLGLDMRV  1140

Query:  1141  LDEDDNEVELRDLDEGEDDDVMHVDDLEKARVKQEAEEKQAEQVSEVVQE             1190
              LDEDDNEVELRDLDEGEDDD+MHVDDLEKAR KQ E    ++VSE  E
Sbjct:  1141  LDEDDNEVELRDLDEGEDDDIMHVDDLEKAREKQAQE---TQEVSETTDE            1187
```

Based on this analysis, it was predicted that these proteins and their epitopes could be useful antigens for vaccines or diagnostics.

Example 114

A DNA sequence (GBSx0118) was identified in *S. agalactiae* <SEQ ID 381> which encodes the amino acid sequence <SEQ ID 382>. This protein is predicted to be DNA-directed RNA polymerase, beta subunit (rpoC). Analysis of this protein sequence reveals the following:

---

Possible site: 32
>>> Seems to have no N-terminal signal sequence
----- Final Results -----
   bacterial cytoplasm --- Certainty = 0.1892 (Affirmative) <succ>
   bacterial membrane --- Certainty = 0.0000 (Not Clear) <succ>
   bacterial outside --- Certainty = 0.0000 (Not Clear) <succ>

---

A related DNA sequence was identified in *S. pyogenes* <SEQ ID 383> which encodes the amino acid sequence <SEQ ID 384>. Analysis of this protein sequence reveals the following:

---

Possible site: 22
>>> Seems to have no N-terminal signal sequence
----- Final Results -----
   bacterial cytoplasm --- Certainty = 0.2128 (Affirmative) <succ>
   bacterial membrane --- Certainty = 0.0000 (Not Clear) <succ>
   bacterial outside --- Certainty = 0.0000 (Not Clear) <succ>

---

An alignment of the GAS and GBS proteins is shown below:

```
Identities = 1148/1205 (95%), Positives = 1177/1205 (97%)
Query:    11  VVDVNRFKSMQITLASPSKVRSWSYGEVKKPETINYRTLKPEREGLFDEVIFGPTKDWEC   70
              VVDVNRFKSMQITLASPSKVRSWSYGEVKKPETINYRTLKPEREGLFDEVIFGPTKDWEC
Sbjct:     1  VVDVNRFKSMQITLASPSKVRSWSYGEVKKPETINYRTLKPEREGLFDEVIFGPTKDWEC   60

Query:    71  ACGKYKRIRYKGIICDRCGVEVTRAKVRRERMGHIELKAPVSHIWYFKGIPSRMGLTLDM  130
              ACGKYKRIRYKGI+CDRCGVEVTRAKVRRERMGHIELKAPVSHIWYFKGIPSRMGLTLDM
Sbjct:    61  ACGKYKRIRYKGIVCDRCGVEVTRAKVRRERMGHIELKAPVSHIWYFKGIPSRMGLTLDM  120

Query:   131  SPRALEEVIYFAAYVVIDPMDTPLEPKSLLTEREYREKLQEYGYGSFVAKMGAEAIQDLL  190
              SPRALEEVIYFAAYVVIDP DTPLEPKSLLTEREYREKLQEYG+GSFVAKMGAEAIQDLL
Sbjct:   121  SPRALEEVIYFAAYVVIDPKDTPLEPKSLLTEREYREKLQEYGHGSFVAKMGAEAIQDLL  180

Query:   191  KRVDLDAEIAVLKEELKSATGQKRVKAVRRLDVLDAFKKSGNKPEWMVLNILPVIPPDLR  250
              KRVDL AEIA LKEELKSA+GQKR+KAVRRLDVLDAF KSGNKPEWMVLNILPVIPPDLR
Sbjct:   181  KRVDLAAEIAELKEELKSASGQKRIKAVRRLDVLDAFNKSGNKPEWMVLNILPVIPPDLR  240

Query:   251  PMVQLDGGRFAASDLNDLYRRVINRNNRLARLLELNAPGIIVQNEKRMLQEAVDALIDNG  310
              PMVQLDGGRFAASDLNDLYRRVINRNNRLARLLELNAPGIIVQNEKRMLQEAVDALIDNG
Sbjct:   241  PMVQLDGGRFAASDLNDLYRRVINRNNRLARLLELNAPGIIVQNEKRMLQEAVDALIDNG  300

Query:   311  RRGRPITGPGSRPLKSLSHMLKGKQGRFRQNLLGKRVDFSGRSVIAVGPTLKMYQCGVPR  370
              RRGRPITGPGSRPLKSLSHMLKGKQGRFRQNLLGKRVDFSGRSVIAVGPTLKMYQCGVPR
Sbjct:   301  RRGRPITGPGSRPLKSLSHMLKGKQGRFRQNLLGKRVDFSGRSVIAVGPTLKMYQCGVPR  360

Query:   371  EMAIELFKPFVMREIVARDLAGNVKAAKRMVERGDERIWDILEEVIKEHPVLLNRAPTLH  430
              EMAIELFKPFVMREIVA++ AGNVKAAKRMVERGDERIWDILEEVIKEHPVLLNRAPTLH
Sbjct:   361  EMAIELFKPFVMREIVAKEYAGNVKAAKRMVERGDERIWDILEEVIKEHPVLLNRAPTLH  420

Query:   431  RLGIQAFEPVLIDGKALRLHPLVCEAYNADFDGDQMAIHVPLSEEAQAEARLLMLAAEHI  490
              RLGIQAFEPVLIDGKALRLEPLVCEAYNADFDGDQMAIHVPLSEEAQAEARLLMLAAEHI
Sbjct:   421  RLGIQAFEPVLIDGKALRLHPLVCEAYNADFDGDQMAIHVPLSEEAQAEARLLMLAAEHI  480

Query:   491  LNPKDGKPVVTPSQDMVLGNYYLTMEDAGREGEGMIFKDEDEAVMAYQNGYVHLHTRVGI  550
              LNPKDGKPVVTPSQDMVLGNYYLTMEDAGREGEGMIFKD DEAVMAY+NGY HLH+RVGI
Sbjct:   481  LNPKDGKPVVTPSQDMVLGNYYLTMEDAGREGEGMIFKDKDEAVMAYRNGYAHLESRVGI  540

Query:   551  AVDSMPNKPWTEEQKHKIMVTTVGKILFNDIMPEDLPYLIEPNNANLTEKTPDKYFLEPG  610
              AVDSMPNKPW + Q+HKIMVTTVGKILFNDIMPEDLPYL EPNNANLTE TPDKYFLEPG
Sbjct:   541  AVDSMPNKPWKDNQRHKIMVTTVGKILFNDIMPEDLPYLQEPNNANLTEGTPDKYFLEPG  600
```

```
-continued
Query:   611 QDIQAVIDNLEINIPFKKKNLGNIIAETFKRFRTTETSAFLDRLKDLGYYHSTLAGLTVG  670
             QDIQ VID L+IN+PFKKKNLGNIIAETFKRFRTTETSAFLDRLKDLGYYHSTLAGLTVG
Sbjct:   601 QDIQEVIDRLDINVPFKKKNLGNIIAETFKRFRTTETSAFLDRLKDLGYYHSTLAGLTVG  660

Query:   671 IADIPVIDNKAEIIDAAHHRVEDINKAFRRGLMTEEDRYVAVTTTWREAKEALEKRLIET  730
             IADIPVIDNKAEIIDAAHHRVE+INKAFRRGLMT++DRYVAVTTTWREAKEALEKRLIET
Sbjct:   661 IADIPVIDNKAEIIDAAHHRVEEINKAFRRGLMTDDDRYVAVTTTWREAREALEKRLIET  720

Query:   731 QDPKNPIVMMMDSGARGNISNFSQLAGMRGLMAAPNGRIMELPILSNFREGLSVLEMFFS  790
             QDPKNPIVMMMDSGARGNISNFSQLAGMRGLMAAPNGRIMELPILSNFREGLSVLEMFFS
Sbjct:   721 QDPKNPIVMMMDSGARGNISNFSQLAGMRGLMAAPNGRIMELPILSNFREGLSVLEMFFS  780

Query:   791 THGARKGMTDTALKTADSGYLTRRLVDVAQDVIIREDDCGTDRGLTITAITDKGKEVTETL  850
             THGARKGMTDTALKTADSGYLTRRLVDVAQDVIIREDDCGTDRGL I AITDKGKEVTETL
Sbjct:   781 THGARKGMTDTALKTADSGYLTRRLVDVAQDVIIREDDCGTDRGLLIRAITDKGKEVTETL  840

Query:   851 EERLIGRYTKKSIKHPETGEILVGADTLITEDMAAKVVKAGVEEVTIRSVFTCNTRHGVC  910
             EERL GRYT+KS+KHPETGE+L+GAD LITEDMA K+V AGVEEVTIRSVFTC TRHGVC
Sbjct:   841 EERLQGRYTRKSVKHPETGEVLIGADQLITEDMARKIVDAGVEEVTIRSVFTCATRHGVC  900

Query:   911 RHCYGINLATGDAVEVGEAVGTIAAQSIGEPGTQLTMRTFHTGGVASNTDITQGLPRIQE  970
             RHCYGINLATGDAVEVGEAVGTIAAQSIGEPGTQLTMRTFHTGGVASNTDITQGLPRIQE
Sbjct:   901 RHCYGINLATGDAVEVGEAVGTIAAQSIGEPGTQLTMRTFHTGGVASNTDITQGLPRIQE  960

Query:   971 IFEARNPKGEAVITEVKGEVVAIEEDSSTRTKKVFVKGQTGEGEYVVPFTARMKVEVGDE  1030
             IFEARNPKGEAVITEVKG VV IEED+STRTKKV+V+G+TG GEYV+PFTARMKVEVGDE
Sbjct:   961 IFEARNPKGEAVITEVKGNVVEIEEDASTRTKKVYVQGKTGMGEYVIPFTARMKVEVGDE  1020

Query:  1031 VARGAALTEGSIQPKRLLEVRDTLSVETYLLAEVQKVYRSQGVEIGDKHVEVMVRQMLRK  1090
              V RGAALTEGSIQPKRLLEVRDTLSVETYLLAEVQKVYRSQGVEIGDKHVEVMVRQMLRK
Sbjct:  1021 VNRGAALTEGSIQPKRLLEVRDTLSVETYLLAEVQKVYRSQGVEIGDKHVEVMVRQMLRK  1080

Query:  1091 VRVMDPGDTDLLPGTLMDISDFTDANKDIVISGGIPATSRPVLMGITKASLETNSFLSAA  1150
             VRVMDPGDTDLLPGTLMDISDFTDANKDIVISGGIPATSRPVLMGITKASLETNSFLSAA
Sbjct:  1081 VRVMDPGDTDLLPGTLMDISDFTDANKDIVISGGIPATSRPVLMGITKASLETNSFLSAA  1140

Query:  1151 SFQETTRVLTDAAIRGKKDHLLGLKENVIIGKIIPAGTGMARYRNIEPLAVNEVEIIEGT  1210
             SFQETTRVLTDAAIRGKKDHLLGLKENVIIGKIIPAGTGMARYRNIEP A+NE+E+I+ T
Sbjct:  1141 SFQETTRVLTDAAIRGKKDHLLGLKENVIIGKIIPAGTGMARYRNIEPQAMNEIEVIDHT  1200

Query:  1211 PVDAE                                                        1215
               V AE
Sbjct:  1201 EVSAE                                                        1205
```

Based on this analysis, it was predicted that these proteins and their epitopes could be useful antigens for vaccines or diagnostics.

Example 115

A DNA sequence (GBSx0120) was identified in *S. agalactiae* <SEQ ID 385> which encodes the amino acid sequence <SEQ ID 386>. This protein is predicted to be a DNA binding protein. Analysis of this protein sequence reveals the following:

Possible site: 19
>>> Seems to have no N-terminal signal sequence
----- Final Results -----
  bacterial cytoplasm --- Certainty = 0.4727 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database:

```
>GP:A AC45309 GB: U81957 putative DNA binding protein [Streptococcus gordonii]
      Identities = 42/99 (42%), Positives = 75/99 (75%)
      Query:   1 MYQVVKMFGDWEPWWFIEGWEEDITEIAEYDTLSEALLYFQEEWDRGQEKWPYFQSKSSL   60
                 MY+VV+M+GD+EPWWF++GWE DI +    ++   +AL +++ +W + + ++   ++S+S L
      Sbjct:   1 MYRVVEMYGDFEPWWFLDGWENDIIQEQRFEKYYDALKFYKIQWLKLETEFKEYKSRSDL   60

Query:  61 LATFWSIKEKRWCEECDEYLQQYHSLMLLKEWQEIPKEE                       99
                  + FW+   ++RWCEECD+Y+QQY S++LL++ + IPK +
      Sbjct:  61 MTVFWNENDQRWCEECDDYVQQYRSIILLEDEKVIPKSK                       99
```

A related DNA sequence was identified in *S. pyogenes* <SEQ ID 387> which encodes the amino acid sequence <SEQ ID 388>. Analysis of this protein sequence reveals the following:

```
Possible site: 36
>>> Seems to have no N-terminal signal sequence
----- Final Results -----
   bacterial cytoplasm --- Certainty = 0.4741 (Affirmative) <succ>
      bacterial membrane --- Certainty = 0.0000 (Not Clear) <succ>
         bacterial outside --- Certainty = 0.0000 (Not Clear) <succ>
```

An alignment of the GAS and GBS proteins is shown below:

```
Identities = 61/121 (50%), Positives = 83/121 (68%)

Query:    1  MYQVVKMFGDWEPWWFIEGWEEDITEIAEYDTLSEALLYFQEEWDRGQEKWPYFQSKSSL    60
             MYQV+KM+GDWEPWWFI+GW++DI +   ++     EAL YF +EW R +   +P + S+ +L Sbjct:    1  MYQVIKMYGDWEPWWFIDGWQDDIIDEQQFSDWQEALDYFNQEWQRMKAIFPSYHSQKNL    60

Query:   61  LATFWSIKEKRWCEECDEYLQQYHSLMLLKEWQEIPKEESIERFEVFNKIAELPSACSLNL   121
             LATFW   ++KRWCE+CDE LQQ+HSL+LLK    +P    I   FE N  ++   C LNL Sbjct:   61  LATFWEKEDKRWCEDCDEDLQQFHSLLLLKNKDIVPSNNYIPEFEQRNDSPQVAYLCKLNL   121
```

Based on this analysis, it was predicted that these proteins and their epitopes could be useful antigens for vaccines or diagnostics.

Example 116

A DNA sequence (GBSx0121) was identified in *S. agalactiae* <SEQ ID 389> which encodes the amino acid sequence <SEQ ID 390>. Analysis of this protein sequence reveals the following:

```
Possible site: 18
>>> Seems to have no N-terminal signal sequence
----- Final Results -----
   bacterial cytoplasm --- Certainty = 0.2433 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database:

```
>GP: AAC45310 GB: U81957 putative ABC transporter subunit ComYA
[Streptococcus gordonii]
Identities = 203/319 (63%), Positives = 255/319 (79%), Gaps = 1/319 (0%)
Query:   1 MVQSLAKQVIHQAVEVNAQDIYIIPKGDCYELYMRIDDERRFIDVFEFNRMASLISHFKF   60
           MVQ +A+ ++ QA E  AQDIY +PK DCYELYMRI DERRFI  ++F+++A++ISHFKF
Sbjct:   1 MVQKIAQAIVRQAKEECAQDIYFVPKDDCYELYMRIGDERRFIQTYDFDQLAAVISHFKF   60

Query:  61 VAGMNVGEKRRSQLGSCDYELSEGRLVSLRLSSVGDYRGQESLVIRILYSGHQDLKYWFD  120
           +AGMNVGEKRRSQLGSCDY  + +  S+RLS+VGDYRG ESLVIR+L+    +LK+WF
Sbjct:  61 LAGMNVGEKRRSQLGSCDYRYDD-KETSIRLSTVGDYRGYESLVIRLLHDEETELKFWFT  119

Query: 121 NIKQMKEVLGIRGLYLFSGPVGSGKTTLMYQLASEVFKNKQIITIEDPVEIKNDKMLQLQ  180
           +   +++E   RGLYLFSGPVGSGKTTLM+QLA    FK +Q+++IEDPVEIK + MLQLQ
Sbjct: 120 HFPELREKFKDRGLYLFSGPVGSGKTTLMHQLAQLKFKGQQVMSIEDPVEIKQEDMLQLQ  179

Query: 181 LNEDIGMTYDALIKLSLRHRPDILIIGEIRDQATARAVIRASLTGVMVFSTIHAKSIPGV  240
           LNE IG+TY++LIKLSLRHRPD+LIIGEIRD  TARAV+RASLTG VFSTIHAKSIPGV
Sbjct: 180 LNETIGLTYESLIKLSLRHRPDLLIIGEIRDSETARAVVRASLTGATVFSTIHAKSIPGV  239

Query: 241 YDRLIELGVNYQELENSLKLIAYQRLIGGGSLIDFETGNFKKHSSDKWNRQVDILAEEGH  300
           Y+RL+ELGV+ +EL+   L+ I YQRLIGGG +IDF + N+++H    WN+Q+D L   GH
Sbjct: 240 YERLLELGVSEEELKIVLQGICYQRLIGGGGVIDFASDNYQEHEPTVWNQQIDQLLAAGH  299

Query: 301 ISKKQAQVEKIIPQETTES                                          319
           I   +QA+ EKI  Q+   S
Sbjct: 300 IHPEQAEAEKIRNQQAKTS                                          318
```

A related DNA sequence was identified in *S. pyogenes* <SEQ ID 391> which encodes the amino acid sequence <SEQ ID 392>. Analysis of this protein sequence reveals the following:

---
Possible site: 18
>>> Seems to have no N-terminal signal sequence
----- Final Results -----
  bacterial cytoplasm --- Certainty = 0.1846 (Affirmative) <succ>
  bacterial membrane --- Certainty = 0.0000 (Not Clear) <succ>
  bacterial outside --- Certainty = 0.0000 (Not Clear) <succ>

---

An alignment of the GAS and GBS proteins is shown below:

```
Identities = 207/312 (66%), Positives = 257/312 (82%)
Query:   1 MVQSLAKQVIHQAVEVNAQDIYIIPKGDCYELYMRIDDERRFIDVFEFNRMASLISHFKF   60
           MVQ+LAK ++ +A +V+AQDIYI+P+ D Y+L++RI DERR +DV++ +RMA LISHFKF
Sbjct:   1 MVQALAKAILAKAEQVHAQDIYILPRADQYDLFLRIGDERRLVDVYQSDRMAPLISHFKF   60

Query:  61 VAGMNVGEKRRSQLGSCDYELSEGRLVSLRLSSVGDYRGQESLVIRILYSGHQDLKYWFD  120
           VAGM VGEKRR Q+GSCDY+LS+ + +SLRLSSVGDYRGQESLVIR+L+  ++ + YWFD
Sbjct:  61 VAGMIVGEKRRCQVGSCDYKLSKDKQLSLRLSSVGDYRGQESLVIRLLHHQNKSVHYWFD  120

Query: 121 NIKQMKEVLGIRGLYLFSGPVGSGKTTLMYQLASEVFKNKQIITIEDPVEIKNDKMLQLQ  180
             + ++      +G RGLYLF+GPVGSGKTTLMYQL S    Q+I+IEDPVEIKN ++LQLQ
Sbjct: 121 GLTKVANQVGGRGLYLFAGPVGSGKTTLMYQLISNYHQEAQVISIEDPVEIKNHQILQLQ  180

Query: 181 LNEDIGMTYDALIKLSLRHRPDILIIGEIRDQATARAVIRASLTGVMVFSTIHAKSIPGV  240
           +N+DIGMTYD LIKLSLRHRPDIL+IGEIRD   TARAVIRASLTG MVFST+HAKSI GV
Sbjct: 181 VNDDIGMTYDNLIKLSLRHRPDILVIGEIRDSQTARAVIRASLTGAMVFSTVHAKSISGV  240

Query: 241 YDRLIELGVNYQELENSLKLIAYQRLIGGGSLIDFETGNFKKHSSDKWNRQVDILAEEGH  300
           Y RL+ELGV   EL N L LIAYQRL+ GG+LID   F+ +SS WN+Q+D L E GH
Sbjct: 241 YARLLELGVTKAELSNCLALIAYQRLLNGGALIDSTQNEFEYYSSSNWNQQIDQLLEAGH  300

Query: 301 ISKKQAQVEKII                                                 312
           ++  KQA++EKII
Sbjct: 301 LNPKQAKLEKII                                                 312
```

Figure 5:
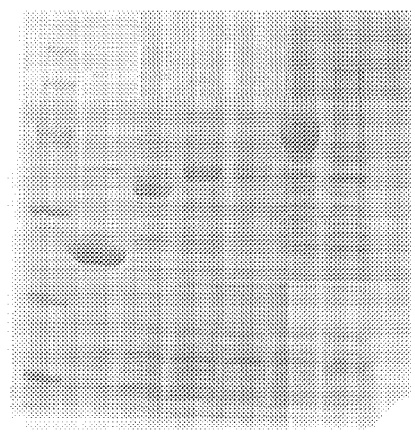
Figure 13:
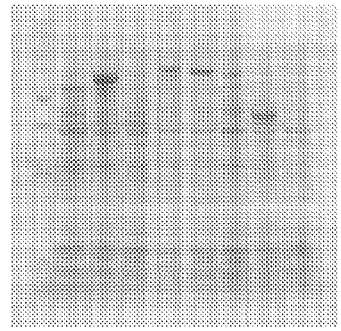

SEQ ID 390 (GBS63) was expressed in *E. coli* as a His-fusion product. SDS-PAGE analysis of total cell extract is shown in FIG. 5 (lane 5; MW 39 kDa). It was also expressed in *E. coli* as a GST-fusion product. SDS-PAGE analysis of total cell extract is shown in FIG. 13 (lane 2; MW 64 kDa).

The GBS63-GST fusion product was purified (FIG. 101A; see also FIG. 191, lane 3) and used to immunise mice (lane 1 product; 20 μg/mouse). The resulting antiserum was used for Western blot (FIG. 101B), FACS (FIG. 101C), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 117

A DNA sequence (GBSx0122) was identified in *S. agalactiae* <SEQ ID 393> which encodes the amino acid sequence <SEQ ID 394>. This protein is predicted to be competence protein (mshG). Analysis of this protein sequence reveals the following:

```
Possible site: 49
>>> Seems to have no N-terminal signal sequence
INTEGRAL    Likelihood = -14.65   Transmembrane 123-139 (113-144)
INTEGRAL    Likelihood = -13.53   Transmembrane 272-288 (264-295)
INTEGRAL    Likelihood = -8.55    Transmembrane 79-95 (75-102)
INTEGRAL    Likelihood = -0.00    Transmembrane 146-162 (146-162)
----- Final Results -----
    bacterial membrane --- Certainty = 0.6859 (Affirmative) <succ>
      bacterial outside --- Certainty = 0.0000 (Not Clear) <succ>
        bacterial cytoplasm --- Certainty = 0.0000 (Not Clear) <succ>
```

A related GBS nucleic acid sequence <SEQ ID 9489> which encodes amino acid sequence <SEQ ID 9490> was also identified.

The protein has homology with the following sequences in the GENPEPT database:

```
Possible site: 43
>>> Seems to have no N-terminal signal sequence
INTEGRAL    Likelihood = -12.52   Transmembrane 317-333 (309-339)
INTEGRAL    Likelihood = -10.14   Transmembrane 123-139 (119-147)
INTEGRAL    Likelihood = -6.95    Transmembrane 164-180 (161-183)
----- Final Results -----
    bacterial membrane --- Certainty = 0.6010 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the databases:

```
>GP: AAC45311 GB: U81957 putative ABC transporter subunit ComYB
[Streptococcus gordonii]
Identities = 161/280 (57%), Positives = 219/280 (77%)
Query:   19 MNKALLEGKDLSKMLGELGFSDTVITQVALADLHGNISRSLLKIESYLANLLLVRKKVIE    78
            M + L  G+   S+++  LGFSD V+TQ++LA+LHGN+S +LLKIE YL NL  V+KK+IE
Sbjct:    1 MRQGLANGQAFSEIMASLGFSDAVVTQLSLAELHGNLSLALLKIEEYLDNLAKVKKKLIE    60

Query:   79 VATYPLILLSFLVLIMIGLRNYLMPQLGENNFATRLITNVPNIFLLLLAVVLIFSLIFYI   138
            VATYP++LL FLVLIMIGLRNYL+PQL   NFAT+LI ++P IFLL + ++L  +  Y+
Sbjct:   61 VATYPMMLLGFLVLIMIGLRNYLLPQLSSQNFATQLIGHLPTIFLLTVLMLLGLTGAIYL   120

Query:  139 IQKRLSRIKVACFLTTIPLVGSYVKLYLTAYYAREWGNLLSQGIELDQIVKVMQNQKSKL   198
            + K   RI V  FL  +P VGS+V++YLTAYYAREWGN++ QG+EL QI ++MQ Q+S L
Sbjct:  121 VFKGQKRIPVYSFLARLPFVGSFVRIYLTAYYAREWGNMIGQGLELSQIFQIMQEQRSVL   180

Query:  199 FREIGYDMEEGFLSGKAFHQKVLDYPFFLTELSLMIEYGQVKAKLGTELDIYADEKWEDF   258
            F+EIG D+ +    +G+ F K+  YPFF  ELSL+IEYG+VK+KLG+EL+IYA + WE+F
Sbjct:  181 FQEIGQDLGQALQNGQEFSDKIASYPFFKKELSLIIEYGEVKSKLGSELEIYALKTWEEF   240

Query:  259 FTKLARATQLIQPVIFIFVALIIVMIYAAMLLPMYQNMEI                     298
            F ++ R    LIQP++F+FVAL+IV++YAAMLLP+YQNME+
Sbjct:  241 FGRVNRTMNLIQPLVFVFVALMIVLLYAAMLLPLYQNMEV                     280
```

A related DNA sequence was identified in *S. pyogenes* <SEQ ID 395> which encodes the amino acid sequence <SEQ ID 396>. Analysis of this protein sequence reveals the following:

```
>GP:AAC45311 GB:U81957 putative ABC transporter subunit ComYB
[Streptococcus gordonii]
Identities = 139/278 (50%), Positives = 207/278 (74%)
Query:   63 MEESLLKGQGLADMLSGLGFSDAILTQISLADRHGNIETTLVAIQHYLNQMARIRRKTVE   122
            M + L  GQ   +++++ LGFSDA++TQ+SLA+ HGN+   L+ I+ YL+ +A++++K +E
Sbjct:    1 MRQGLANGQAFSEIMASLGFSDAVVTQLSLAELHGNLSLALLKIEEYLDNLAKVYEELIE    60

Query:  123 VITYPLILLLFLFVMMLGLRRYLVPQLETQNQITYFLNHFPAFFIGFCSGLILLFGMVWL   182
            V TYP++LL FL ++M+GLR YL+PQL +QN  T  + H P F+     L+ L G ++L
Sbjct:   61 VATYPMMLLGFLVLIMIGLRNYLLPQLSSQNFATQLIGHLPTIFLLTVLMLLGLTGAIYL   120

Query:  183 RWRSQSRLKLYSRLSRYPFLGKLLKQYLTSYYAREWGTLIGQGLDLMTILDIMAIEKSSL   242
            ++ Q R+ +YS L+R PF+G  ++ YLT+YYAREWG +GQGL+L  I  IM  ++S L
Sbjct:  121 VFKGQKRIPVYSFLARLPFVGSFVRIYLTAYYAREWGNMIGQGLELSQIFQIMQEQRSVL   180

Query:  243 MKELAEDIRMSLLEGQAFHIKVATYPFFKKELSLMIEYGEIKSKLGAELEIYAQESWEQF   302
            +E+ +D+  +L  GQ F  K+A+YPFFKKELSL+IEYGE+KSKLG+ELEIYA ++WE+F
Sbjct:  181 FQEIGQDLGQALQNGQEFSDKIASYPFFKKELSLIIEYGEVKSKLGSELEIYALKTWEEF   240

Query:  303 FSQLYQVTQLIQPAIFLVVAVTIVMIYAAILLPIYQNM                        340
            F ++ +     LIQP +F+ VA+ IV++YAA+LLP+YQNM
Sbjct:  241 FGRVNRTMNLIQPLVFVFVALMIVLLYAAMLLPLYQNM                        278
```

An alignment of the GAS and GBS proteins is shown below:

```
Identities = 148/297 (49%), Positives = 209/297 (69%), Gaps = 2/297 (0%)
Query:   1  MVTFLKRSKLLSDCYTDSMNKALLEGKDLSKMLGELGFSDTVITQVALADLHGNISRSLL   60
            ++ FLKRS+LL    Y   M ++LL+G+ L+ ML  LGFSD ++TQ++LAD HGNI  +L+
Sbjct:  45  VIAFLKRSQLLQLDYVLKMEESLLKGQGLADMLSGLGFSDAILTQISLADRHGNIETTLV  104

Query:  61  KIESYLANLLLVRKKVIEVATYPLILLSFLVLIMIGLRNYLMPQLGENNFATRLITNVPN  120
            I+ YL  +  +R+K +EV TYPLILL  FL ++M+GLR YL+PQL    N  T  + + P
Sbjct: 105  AIQHYLNQMARIRRKTVEVITYPLILLLFLFVMMLGLRRYLVPQLETQNQITYFLNHFPA  164

Query: 121  IFL-LLLAVVLIFSLIFYIIQKRLSRIKVACFLTTIPLVGSYVKLYLTAYYAREWGNLLS  179
             F+      ++L+F ++ ++  +   SR+K+     L+   P +G  +K YLT+YYAREWG L+
Sbjct: 165  FFIGFCSGLILLFGMV-WLRWRSQSRLKLYSRLSRYPFLGKLLKQYLTSYYAREWGTLIG  223

Query: 180  QGIELDQIVKVMQNQKSKLFREIGYDMEEGFLSGKAFHQKVLDYPFFLTELSLMIEYGQV  239
            QG++L  I+ +M  +KS L +E+   D+       L G+AFH  KV  YPFF  ELSLMIEYG++
Sbjct: 224  QGLDLMTILDIMAIEKSSLMKELAEDIRMSLLEGQAFHIKVATYPFFKKELSLMIEYGEI  283

Query: 240  KAKLGTELDIYADEKWEDFFTKLARATQLIQPVIFIFVALIIVMIYAAMLLPMYQNM     296
            K+KLG EL+IYA E WE FF++L +   TQLIQP IF+ VA+  IVMIYAA+LLP+YQNM
Sbjct: 284  KSKLGAELEIYAQESWEQFFSQLYQVTQLIQPAIFLVVAVTIVMIYAAILLPIYQNM     340
```

A related GBS gene <SEQ ID 8493> and protein <SEQ ID 8494> were also identified. Analysis of this protein sequence reveals the following:

Lipop: Possible site: –1 Crend: 9
SRCFLG: 0
McG: Length of UR: 2
Peak Value of UR: 1.24
Net Charge of CR: 0
McG: Discrim Score: –8.94
GvH: Signal Score (–7.5): –4.08
Possible site: 31
>>> Seems to have no N-terminal signal sequence
Amino Acid Composition: calculated from 1
ALOM program   count: 4 value: –14.65 threshold: 0.0
INTEGRAL    Likelihood = –14.65   Transmembrane 105-121 (95-126)

-continued

INTEGRAL    Likelihood = –13.53   Transmembrane 254-270 (246-277)
INTEGRAL    Likelihood = –8.55    Transmembrane 61-77 (57-84)
PERIPHERAL  Likelihood = 5.09     14
modified ALOM score: 3.43
icml HYPID: 7 CFP: 0.686
***Reasoning Step: 3
----- Final Results -----
   bacterial membrane --- Certainty = 0.6859 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the databases:

```
57.5/79.7% over 279aa
Streptococcus gordonii
GP|2058545| putative ABC transporter subunit ComYB Insert characterized
ORF00008(355-1194 of 1500)
GP|2058545|gb|AAC45311.1||U81957(1-280 of 282) putative ABC transporter subunit ComYB
{Streptococcus gordonii}
% Match = 33.8
% Identity = 57.5 % Similarity = 79.6
Matches = 161 Mismatches = 57 Conservative Sub.s = 62

144       174       204       234       264       294       324       354
TLRQVILKNTHQTSGIDKWISWLKKDISVRNRHKSKKLSLKKQRKVVQLFNNLFASGFSLTDMVTFLKRSKLLSDCYTDS 384       414       444       474       504       534       564       594
MNKALLEGKDLSKMLGELGFSDTVITQVALADLHGNISRSLLKIESYLANLLLVRKKVIEVATYPLILLSFLVLIMIGLR
|  :   |   |: :|:::   |||||  :||:||:|||||:|    :||||| || ||  |:||:|||||::|| |||||||||
MRQGLANGQAFSEIMASLGFSDAVVTQLSLAELHGNLSLALLKIEEYLDNLAKVKKKLIEVATYPMMLLGFLVLIMIGLR
         10        20        30        40        50        60        70        80

624       654       684       714       744       774       804       834
NYLMPQLGENNFATRLITNVPNIFLLLLAVVLIFSLIFYIIQKRLSRIKVACFLTTIPLVGSYVKLYLTAYYAREWGNLL
|||:|||    ||||:||     |:: ||       |:: |||   |   |||   |  |  ||:||||||||||||||
NYLLPLSSQNFATQLIGHLPTIFLLTVLMLLGLTGAIYLVFKGQKRIPVYSFLARLPFVGSFVRIYLTAYYAREWGNMI
         90       100       110       120       130       140       150       160

864       894       924       954       984      1014      1044      1074
SQGIELDQIVKVMQNQKSKLFREIGYDMEEGFLSGKAFHQKVLDYPFFLTELSLMIEYGQVKAKLGTELDIYADEKWEDF
||:||  ||  ::||  |:| ||:|| :  :  :|   |   : |||| ||||||||:|||:|:|||||| : ||:|
GQGLELSQIFQIMQEQRSVLFQEIGQDLGQALQNGQEFSDKIASYPFFKKELSLIIEYGEVKSKLGSELEIYALKTWEEF
        170       180       190       200       210       220       230       240
```

```
1104      1134      1164      1194      1224      1254      1284      1314
FTKLARATQLIQPVIFIFVALIIVMIYAAMLLPMYQNMEILS*KIYC*NVRIRRLKHLHF*NVM*HWLQSQELY*FIKD*
|  ::  |    ||||::|:||||:||::||||||||:|||||:
FGRVNRTMNLIQPLVFVFVALMIVLLYAAMLLPLYQNMEVHL
       250       260       270       280
```

Figure 11:
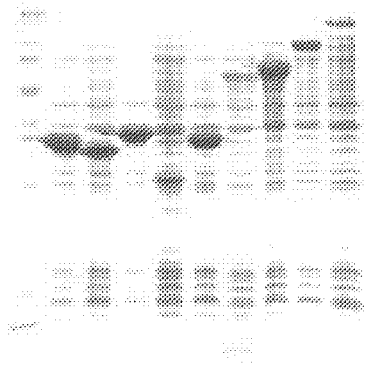
Figure 15:
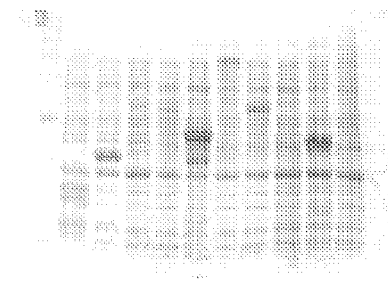

SEQ ID 8494 (GBS49) was expressed in *E. coli* as a His-fusion product. SDS-PAGE analysis of total cell extract is shown in FIG. 11 (lane 5; MW 15 kDa). It was also was expressed in *E. coli* as a GST-fusion product. SDS-PAGE analysis of total cell extract is shown in FIG. 15 (lane 5; MW 60 kDa).

Based on this analysis, it was predicted that these proteins and their epitopes could be useful antigens for vaccines or diagnostics.

Example 118

A DNA sequence (GBSx0123) was identified in *S. agalactiae* <SEQ ID 397> which encodes the amino acid sequence <SEQ ID 398>. This protein is predicted to be ComYD or ComGD. Analysis of this protein sequence reveals the following:

Possible site: 55
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

The protein has homology with the following sequences in the GENPEPT database:

```
>GP:CAA75315 GB:Y15043 homology to ComYD from Streptcoccus gordonii,
and ComGD from Bacillus subtilis [Lactococcus lactis subsp. cremoris]
Identities = 56/138 (40%), Positives = 92/138 (66%), Gaps = 2/138 (1%)
Query:    12  KVKAFTLLECLVALVTITGALLVYQGLTKLLAQQIVVMSSSSQSEWVLLTQQLNAEFEGA    71
              K++AFTLLECLVAL+ I+G++LV   GLT+++ +Q+ +  + S+ +W +    +Q+ +E  GA
Sbjct:    13  KIRAFTLLECLVALLAISGSVLVISGLIRMIEEQMKISQNDSRKDWQIFCEQMRSELSGA    72

Query:    72  HLEYLRQNKLYLRKQDKIVTFGKSNKDDFRKTGYDGRGYQPMVYGLDNCQMSQTKSMVKL   131
              L+ +  QN LY+ K DK + FG     DDFRK+     G+GYQPM+Y L   ++   ++++K+
Sbjct:    73  KLDNVNQNFLYVTK-DKKLRFGLVG-DDFRKSDDKGQGYQPMLYDLKGAKIQAEENLIKI   130

Query:   132  VFYFKDGLKRTFYYDFKE                                            149
                 F +G +R F Y F +
Sbjct:   131  TIDFDNGGERVFIYRFTD                                            148
```

A related DNA sequence was identified in *S. pyogenes* <SEQ ID 399> which encodes the amino acid sequence <SEQ ID 400>. Analysis of this protein sequence reveals the following:

Possible site: 28
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

The protein has homology with the following sequences in the databases:

```
>GP:CAA75315 GB:Y15043 homology to ComYD from Streptcoccus gordonii,
and ComGD from Bacillus subtilis [Lactococcus lactis subsp. cremoris]
Identities = 65/137 (47%), Positives = 84/137 (60%), Gaps = 2/137 (1%)
Query:     8  IKAFTLLEALIALLVISGSLLVYQGLTRTLLKHSHYLARHDQDNWLLFSHQLREELSGAR    67
              I+AFTLLE L+ALL  ISGS+LV   GLTR +  +    +      + +W +F  Q+R ELSGA+
Sbjct:    14  IRAFTLLECLVALLAISGSVLNISGLTRMIEEQMKISQNDSRKDWQIFCEQMRSELSGAK    73

Query:    68  FYKVADNKLYVEKGKKVLAFGQFKSHDFRKSASNGKGYQPMLFGISRSHIHIEQSQICIT   127
              + V  N LYV K KK L FG     DFRKS   G+GYQPML+ +  +  I  E++   I  IT
Sbjct:    74  LDNVNQNFLYVTKDKK-LRFG-LVGDDFRKSDDKGQGYQPMLYDLKGAKIQAEENLIKIT   131

Query:   128  LKWKSGLERTFYYAFQD                                             144
```

-continued

```
           + + +G ER F Y F D
Sbjct: 132 IDFDNGGERVFIYRFTD                                       148
```

An alignment of the GAS and GBS proteins is shown below:

```
Identities = 58/137 (42%), Positives = 88/137 (63%)
Query:  13 VKAFTLLECLVALVTITGALLVYQGLTKLLAQQIVVMSSSSQSEWVLLTQQLNAEFEGAH  72
           +KAFTLLE L+AL+ I+G+LLVYQGLT+ L +    ++   Q  W+L + QL   E   GA
Sbjct:   8 IKAFTLLEALIALLVISGSLLVYQGLTRTLLKHSHYLARHDQDNWLLFSHQLREELSGAR  67

Query:  73 LEYLRQNKLYLRKQDKIVTFGKSNKDDFRKTGYDGRGYQPMVYGLDNCQMSQTKSMVKLV  132
              +  NKLY+ K  K++ FG+     DFRK+  +G+GYQPM++G+     +   +S + +
Sbjct:  68 FYKVADNKLYVEKGKKVLAFGQFKSHDFRKSASNGKGYQPMLFGISRSHIHIEQSQICIT  127

Query: 133 FYFKDGLKRTFYYDFKE                                           149
           +K GL+RTFYY F++
Sbjct: 128 LKWKSGLERTFYYAFQD                                           144
```

A related GBS gene <SEQ ID 8495> and protein <SEQ ID 8496> were also identified. Analysis of this protein sequence reveals the following:

Lipop: Possible site: −1 Crend: 10
McG: Discrim Score: 4.86
GvH: Signal Score (−7.5): −0.22
Possible site: 55
>>> Seems to have a cleavable N-term signal seq.
ALOM program   count: 0 value: 12.47 threshold: 0.0
PERIPHERAL         Likelihood = 12.47         127
modified ALOM score: −2.99
*** Reasoning Step: 3
----- Final Results -----
   bacterial outside --- Certainty = 0.3000 (Affirmative) <succ>
   bacterial membrane --- Certainty = 0.0000 (Not Clear) <succ>
   bacterial cytoplasm --- Certainty = 0.0000 (Not Clear) <succ>

The protein has homology with the following sequences in the databases:

```
GP|3287181| homology to ComYD from Streptococcus gordonii, and ComGD
from Bacillus subtilis
{Lactococcus lactis subsp. cremoris} Insert characterized
ORF00009(334-747 of 1053)
GP|3287181|emb|CAA75315.1||Y15043(13-148 of 150) homology to ComYD from
Streptococcus gordonii, and ComGD from Bacillus subtilis
{Lactococcus lactis subsp. cremoris}
% Match = 15.9
% Identity = 40.6 % Similarity = 68.1
Matches = 56 Mismatches = 42 Conservative Sub.s = 38

177       207       237       267       297       327       357       387
IC**EVGGFFYKIS*SDPVNPTRYFYFCSSYHCYDLCSNAVTNVSKYGDIIMKNLLLKCKDKKVKAFTLLECLVALVTIT
                                              :     :       |::|||||||||: |:
                                              MTMERKFCDLKLKIRAFTLLECLVALLAIS
                                                            10        20        30

417       447       477       507       537       567       597       627
GALLVYQGLTKLLAQQIVVMSSSSQSEWVLLTQQLNAEFEGAHLEYLRQNKLYLRKQDKIVTFGKSNKDDFRKTGYDGRG
|::||   |||::: :|:   :  : :|: :: :|: :|:|| ||  : ||  ||:  ||      |||||:   |:|
GSVLVISGLTRMIEEQMKISQNDSRKDWQIFCEQMRSELSGAKLDNVQNFLYVTK-DKKLRFGLVG-DDFRKSDDKGQG
          40        50        60        70        80        90       100

657       687       717       747       777       807       837       867
YQPMVYGLDNCQMSQTKSMVKLVFYFKDGLKRTFYYDFKEET*SWHPFASYCIGCCIYTRLTVLSSKNIGNRKTVS*PN*
||||:|    ::   :::::|:     |:| :|||||  :
YQPMLYDLKGAKIQAEENLIKITIDFDNGGERVFIYRFTDTK
          120       130       140       150
```

Figure 2:
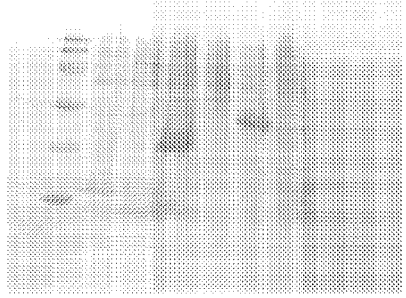
Figure 260:
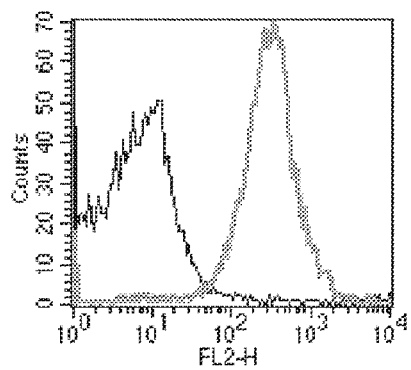

SEQ ID 398 (GBS6) was expressed in *E. coli* as a GST-fusion product. SDS-PAGE analysis of total cell extract is shown in FIG. 1 (lane 2; MW 40 kDa). It was also expressed in *E. coli* as a His-fusion product. SDS-PAGE analysis of total cell extract is shown in FIG. 2 (lane 2; MW 15 kDa). The GBS6-GST fusion product was purified (FIG. 189, lane 2) and used to immunise mice. The resulting antiserum was used for FACS (FIG. 260), which confirmed that the protein is immunoaccessible on GBS bacteria.

Based on this analysis, it was predicted that these proteins and their epitopes could be useful antigens for vaccines or diagnostics.

Example 119

A DNA sequence (GBSx0124) was identified in *S. agalactiae* <SEQ ID 401> which encodes the amino acid sequence <SEQ ID 402>. Analysis of this protein sequence reveals the following:

Possible site: 43
\>>> Seems to have no N-terminal signal sequence
----- Final Results -----
    bacterial cytoplasm --- Certainty = 0.3831 (Affirmative) <succ>
    bacterial membrane --- Certainty = 0.0000 (Not Clear) <succ>
    bacterial outside --- Certainty = 0.0000 (Not Clear) <succ>

Possible site: 57
\>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database:

```
>GP:AAC00317 GB:AF008220 YtxK [Bacillus subtilis]
Identities = 106/329 (32%), Positives = 176/329 (53%), Gaps = 17/329 (5%)
Query:   1 MNFEKIETAYELILENIQTIENQLKTHIYDALIEQNSYYLGSSCDLDMVVVNNQKLRQLD    60
           M + +   YEL+ E   I+N+L+   +AL E    Y    D + + +QK +QL
Sbjct:   1 MQKDHVGAVYELLNEAAIMIKNELQISYIEALAEAGEMYFLEKTD-QLKLPADQKTKQLQ   59

Query:  61 LSQE---------EW-RRTFQFIFIKSAQTEQLQANHQFTPDSIGFILLELLEE-LTSQE  109
           E          EW R+ FQ    +K  + +    N Q TPD+IG   +L+ + +  ++
Sbjct:  60 ALLEKAEFGTYEHEWVRKAFQLAVLKGMK-DISHPNRQMTPDTIGLFISYLVNKFMADKK  118

Query: 110 TVDVLEIGSGTGNLAQTLLNN-SSKELNYMGIEVDDLLIDLSASIAEIIGSSAQFIQEDA  168
           + +L+     GTGNL  T+LN   S K  N  GIE+DD+L+ ++ + A ++       +D+
Sbjct: 119 ELTILDPALGTGNLLFTVLNQLSEKTANSFGIEIDDVLLKIAYAQANLLKKELELFHQDS  178

Query: 169 VRPQILKESDVIISDLPVGYYPNDGIAKRYAVSSSKEHTYAHHLLMEQSLKYLKKDGIAI  228
           + P  +   D +I DLPVGYYPND  A+ + + + + H++AHHL +EQS+K+  K  G
Sbjct: 179 LEPLFIDPVDTVICDLPVGYYPNDEGAEAFELKADEGHSFAHHLFIEQSVKHTKPGGYLF  238

Query: 229 FLAPENLLTSPQSDLLKEWLKGYADVIAVLTLPETIFGSRQNAKSIFVLKKQAEQKP---  285
           F+ P +L  S QS  LK++ K   + A+L LP++IF    +AKSI VL+KQ E
Sbjct: 239 FMIPNHLFESSQSGKLKQFFKDKVHINALLQLPKSIFKDEAHAKSILVLQKQGENTKAPG  298

Query: 286 ETFVYPLTDLQNRENMANFIENFQKWSRE                                314
           +  +  L     N++ M + +   F +W ++
Sbjct: 299 QILLANLPSFSNQKAMLDMMAQFDEWFKK                                327
```

A related DNA sequence was identified in *S. pyogenes* <SEQ ID 403> which encodes the amino acid sequence <SEQ ID 404>. Analysis of this protein sequence reveals the following:

An alignment of the GAS and GBS proteins is shown below:

```
Identities = 223/315 (70%), Positives = 270/315 (84%)

Query:   1 MNFEKIETAYELILENIQTIENQLKTHIYDALIEQNSYYLGSSCDLDMVVVNNQKLRQLD    60
           M FEKIE AY+L+LEN Q IEN LKTHIYDA++EQNS+YLG+    V  N+ KL+ L
Sbjct:  16 MTFEKIEEAYQLLLENCQLIENDLKTHIYDAIVEQNSFYLGAEGASPQVAQNSDKLKALC   75

Query:  61 LSQEEWRRTFQFIFIKSAQTEQLQANHQFTPDSIGFILLFLLEELTSQETVDVLEIGSGT  120
           L++EEWR+ +QF+FIK+AQTEQLQANHQFTPD+IGFILL+LLE+L+     +VLEIGSGT
Sbjct:  76 LTKEEWRKAYQFLFIKAAQTEQLQANHQFTPDAIGFILLYLLEQLSDKDSLEVLEIGSGT  135

Query: 121 GNLAQTLLNNSSKELNYMGIEVDDLLIDLSASIAEIIGSSAQFIQEDAVRPQILKESDVI  180
           GNLAQTLLNN+SK L+Y+GIE+DDLLIDLSASIAEI+ SSA FIQEDAVRPQ+LKESD++
Sbjct: 136 GNLAQTLLNNTSKSLDYVGIELDDLLIDLSASIAEIMDSSAHFIQEDAVRPQLLKESDIV  195

Query: 181 ISDLPVGYYPNDGIAKRYAVSSSKEHTYAHHLLMEQSLKYLKKDGIAIFLAPENLLTSPQ  240
           ISDLPVGYYPND IAKRY V+SS +HTYAHHLLMEQSLKYLKKDG AIFLAP NLLTSPQ
Sbjct: 196 ISDLPVGYYPNDDIAKRYKVASSDKHTYAHHLLMEQSLKYLKKDGFAIFLAPVNLLTSPQ  255

Query: 241 SDLLKEWLKGYADVIAVLTLPETIFGSRQNAKSIFVLKKQAEQKPETFVYPLTDLQNREN  300
           S LLK+WLK YA V+ ++TLP++IFG   NAKSI VL+KQ +   ETFVYP+ DL+ EN
Sbjct: 256 SQLLKQWLKDYAQVVTLITLPDSIFGHPSNAKSIIVLQKQTDHPMETFVYPIRDLKLAEN  315

Query: 301 MANFIENFQKWSREN                                              315
           + +F+ENF+KW   N
Sbjct: 316 IHDFMENFKKWKLSN                                              330
```

Based on this analysis, it was predicted that these proteins and their epitopes could be useful antigens for vaccines or diagnostics.

Example 120

A DNA sequence (GBSx0125) was identified in *S. agalactiae* <SEQ ID 405> which encodes the amino acid sequence <SEQ ID 406>. This protein is predicted to be acetate kinase (ackA-1). Analysis of this protein sequence reveals the following:

Possible site: 15
>>> Seems to have no N-terminal signal sequence
----- Final Results -----
   bacterial cytoplasm --- Certainty = 0.2384 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database:

```
>GP:AAC36857 GB:L17320 acetate kinase [Bacillus subtilis]
Identities = 223/395 (56%), Positives = 293/395 (73%), Gaps = 3/395 (0%)
Query:    1 MSKTIAINAGSSSLKWQLYEMPEEKVVAKGIIERIGLKDSISTVKFDDKKDEQILDIVDH    60
            MSK IAINAGSSSLK+QL+EMP E V+ KG++ERIG+ DS+ T+  + +K+ ++ DI DH
Sbjct:    1 MSKIIAINAGSSSLKFQLFEMPSETVLTKGLVERIGIADSVFTISVNGEKNTEVTDIPDH    60

Query:   61 TQAVKILLEDLTKHGIIKDFNEITGVGHRVVAGGEYFKESALVDDKVVEQVEELSALAPL   120
              AVK+LL   LT+ GIIKD NEI G+GHRVV GGE F +S L+ D+ ++++E++S LAPL
Sbjct:   61 AVAVKMLLNKLTEFGIIKDLNEIDGIGHRVVHGGEKFSDVLLTDETIKEIEDISELAPL   120

Query:  121 HNPAAAAGIRAFREILPDITSVCVFDTAFHTTMQPHTYLYPIPQKYYTDYKVRKYGAHGT   180
            HNPA   GI+AF+E+LP++ +V VFDTAFH TM   +YLY +P +YY  + +RKYG HGT
Sbjct:  121 HNPANIVGIKAFKEVLPNVPAVAVFDTAFHQTMPEQSYLYSLPYEYYEKFGIRKYGFHGT   180

Query:  181 SHQYVAQEAAKQLGRPLEELKLITAHVGNGVSITANYHGQSIDTSMGFTPLAGPMMGTRS   240
            SH+YV + AA+ LGRPL++L+LI+ H+GNG SI A   G+SIDTSMGFTPLAG  MGTRS
Sbjct:  181 SHKYVTERAAELLGRPLKDLRLISCHLGNGASIAAVEGGKSIDTSMGFTPLAGVAMGTRS   240

Query:  241 GDIDPAIIPYLVANDPELEDAAAVVNMLNKQSGLLGVSGTSSDMRDIEAGLQSKDPNAVL   300
            G+IDPA+IPY++    +  D   V+N LNK+SGLLG+SG SSD+RDI   +   +  A
Sbjct:  241 GNIDPALIPYIMEKTGQTAD--EVLNTLNKKSGLLGISGFSSDLRDIVEATKEGNERAET   298

Query:  301 AYNVFIDRIKKFIGQYLAVLNGADAIIFTAGMGENAPLMRQDVIAGLSWFGIELDPE-KN   359
            A  VF  RI K+IG Y A ++G DAIIFTAG+GEN+  +R+ V+ GL + G+   DP  N
Sbjct:  299 ALEVFASRIHKYIGSYAARMSGVDAIIFTAGIGENSVEVRERVLRGLEFMGVYWDPALNN   358

Query:  360 VFGYFGDITKPDSKVKVLVIPTDEELMIARDVERL                           394
            V G    I+ P S VKV++IPTDEE+MIARDV RL
Sbjct:  359 VRGEEAFISYPHSPVKVMIIPTDEEVMIARDVVRL                           393
```

A related DNA sequence was identified in *S. pyogenes* <SEQ ID 407> which encodes the amino acid sequence <SEQ ID 408>. Analysis of this protein sequence reveals the following:

Possible site: 28
>>> Seems to have no N-terminal signal sequence
INTEGRAL    Likelihood = –0.22    Transmembrane 63-79 (63-79)
----- Final Results -----
   bacterial membrane --- Certainty = 0.1086 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the databases:

```
>GP:AAC36857 GB:L17320 acetate kinase [Bacillus subtilis]
Identities = 218/395 (55%), Positives = 293/395 (73%), Gaps = 3/395 (0%)
Query:    1 MSKTIAINAGSSSLKWQLYQMPEEAVLAQGIIERIGLKDSISTVKYDGKKEEQILDIHDH    60
            MSK IAINAGSSSLK+QL++MP E VL +G++ERIG+ DS+ T+   +G+K  ++ DI DH
Sbjct:    1 MSKIIAINAGSSSLKFQLFEMPSETVLTKGLVERIGIADSVFTISVNGEKNTEVTDIPDH    60

Query:   61 TEAVKILLNDLIHFGIIAAYDEITGVGHRVVAGGELFKESVVVNDKVLEQIEELSVLAPL   120
              AVK+LLN L  FGII   +EI G+GHRVV GGE F +SV++  D+ +++IE++S LAPL
Sbjct:   61 AVAVKMLLNKLTEFGIIKDLNEIDGIGHRVVHGGEKFSDVLLTDETIKEIEDISELAPL   120

Query:  121 HNPGAAAGIRAFRDILPDITSVCVFDTSFHTSMAKHTYLYPIPQKYYTDYKVRKYGAHGT   180
            HNP    GI+AF+++LP++ +V VFDT+FH +M + +YLY +P +YY  +  +RKYG HGT
Sbjct:  121 HNPANIVGIKAFKEVLPNVPAVAVFDTAFHQTMPEQSYLYSLPYEYYEKFGIRKYGFHGT   180
```

```
                          -continued
Query: 181  SHKYVAQEAAKMLGRPLEELKLITAHIGNGVSITANYHGKSVDTSMGFTPLAGPMMGTRS  240
            SHKYV + AA++LGRPL++L+LI+ H+GNG SI A   GKS+DTSMGFTPLAG  MGTRS
Sbjct: 181  SHKYVTERAAELLGRPLKDLRLISCHLGNGASIAAVEGGKSIDTSMGFTPLAGVAMGTRS  240

Query: 241  GDIDPAIIPYLIEQDPELKDAADVVNMLNKKSGLSGVSGISSDMRDIEAGLQEDNPDAVL  300
            G+IDPA+IPY++E+  +   D  +V+N LNKKSGL G+SG SSD+RDI    +E N  A
Sbjct: 241  GNIDPALIPYIMEKTGQTAD--EVLNTLNKKSGLLGISGFSSDLRDIVEATKEGNERAET  298

Query: 301  AYNIFIDRIKKCIGQYFAVLNGADALVFTAGMGENAPLMRQDVIGGLTWFGMDIDPE-KN  359
            A  +F  RI K  IG Y A  ++G DA++FTAG+GEN+  +R+ V+ GL + G  +DP   N
Sbjct: 299  ALEVFASRIHKYIGSYAARMSGVDAIIFTAGIGENSVEVRERVLRGLEFMGVYWDPALNN  358

Query: 360  VFGYRGDISTPESKVKVLVISTDEELCIARDVERL                           394
            V G    IS P S VKV++I TDEE+ IARDV RL
Sbjct: 359  VRGEEAFISYPHSPVKVMIIPTDEEVMIARDVVRL                           393
```

An alignment of the GAS and GBS proteins is shown below:

```
Identities = 332/395 (84%), Positives = 365/395 (92%)
Query:   1  MSKTIAINAGSSSLKWQLYEMPEEKVVAKGIIERIGLKDSISTVKFDDKKDEQILDIVDH   60
            MSKTIAINAGSSSLKWQLY+MPEE V+A+GIIERIGLKDSISTVK+D KK+EQILDI DH
Sbjct:   1  MSKTIAINAGSSSLKWQLYQMPEEAVLAQGIIERIGLKDSISTVKYDGKKEEQILDIHDH   60

Query:  61  TQAVKILLEDLTKHGIIKDFNEITGVGHRVVAGGEYFKESALVDDKVVEQVEELSALAPL  120
            T+AVKILL DL   GII  ++EITGVGHRVVAGGE FKES +V+DKV+EQ+EELS LAPL
Sbjct:  61  TEAVKILLNDLIHFGIIAAYDEITGVGHRVVAGGELFKESVVVNDKVLEQIEELSVLAPL  120

Query: 121  HNPAAAAGIRAFREILPDITSVCVFDTAFHTTMQPHTYLYPIPQKYYTDYKVRKYGAHGT  180
            HNP AAAGIRAFR+ILPDITSVCVFDT+FHT+M  HTYLYPIPQKYYTDYKVRKYGAHGT
Sbjct: 121  HNPGAAAGIRAFRDILPDITSVCVFDTSFHTSMAKHTYLYPIPQKYYTDYKVRKYGAHGT  180

Query: 181  SHQYVAQEAAKQLGRPLEELKLITAHVGNGVSITANYHGQSIDTSMGFTPLAGPMMGIRS  240
            SH+YVAQEAAK LGRPLEELKLITAH+GNGVSITANYHG+S+DTSMGFTPLAGPMMGTRS
Sbjct: 181  SHKYVAQEAAKMLGRPLEELKLITAHIGNGVSITANYHGKSVDTSMGFTPLAGPMMGTRS  240

Query: 241  GDIDPAIIPYLVANDPELEDAAAVVNMLNKQSGLLGVSGTSSDMRDIEAGLQSKDPNAVL  300
            GDIDPAIIPYL  DPEL+DAA VVNMLNK+SGL GVSG SSDMRDIEAGLQ  +P+AVL
Sbjct: 241  GDIDPAIIPYLIEQDPELKDAADVVNMLNKKSGLSGVSGISSDMRDIEAGLQEDNPDAVL  300

Query: 301  AYNVFIDRIKKFIGQYLAVLNGADAIIFTAGMGENAPLMRQDVIAGLSWFGIELDPEKNV  360
            AYN+FIDRIKK IGQY AVLNGADA++FTAGMGENAPLMRQDVI GL+WFG+++DPEKNV
Sbjct: 301  AYNIFIDRIKKCIGQYFAVLNGADALVFTAGMGENAPLMRQDVIGGLTWFGMDIDPEKNV  360

Query: 361  FGYFGDITKPDSKVKVLVIPTDEELMIARDVERLK                           395
            FGY GDI+ P+SKVKVLVI TDEEL IARDVERLK
Sbjct: 361  FGYRGDISTPESKVKVLVISTDEELCIARDVERLK                           395
```

Based on this analysis, it was predicted that these proteins and their epitopes could be useful antigens for vaccines or diagnostics.

Example 121

A DNA sequence (GBSx0126) was identified in *S. agalactiae* <SEQ ID 409> which encodes the amino acid sequence <SEQ ID 410>. This protein is predicted to be repressor protein. Analysis of this protein sequence reveals the following:

Possible site: 17
>>> Seems to have an uncleavable N-term signal seq

----- Final Results -----
  bacterial membrane --- Certainty = 0.0000 (Not Clear) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database:

```
>GP:CAB49550 GB:AJ248284 repressor protein, putative [Pyrococcus
abyssi]
Identities = 39/64 (60%), Positives = 49/64 (75%)
Query:   1  MKNSLQKLRKSRKLSQAELAVALGVTRQTIISLEKEKYTASLELAFKIARYFDKQIEEVF   60
            MKK L++ R+   L+Q ELA  LGVTRQTII++EK KY  SL LAFKIAR+F  +IE++F
```

```
-continued
Sbjct:   1 MKNRLREFREKYGLTQEELARILGVTRQTIIAIEKGKYDPSLRLAFKIARFFGVRIEDIF  60

Query:  61 IYTE                                                            64
           IY E
Sbjct:  61 IYEE                                                            64
```

A related DNA sequence was identified in *S. pyogenes* <SEQ ID 411> which encodes the amino acid sequence <SEQ ID 412>. Analysis of this protein sequence reveals the following:

---

Possible site: 40
>>> Seems to have no N-terminal signal sequence
----- Final Results -----
   bacterial cytoplasm --- Certainty = 0.4344 (Affirmative) <succ>
     bacterial membrane --- Certainty = 0.0000 (Not Clear) <succ>
       bacterial outside --- Certainty = 0.0000 (Not Clear) <succ>

---

An alignment of the GAS and GBS proteins is shown below:

```
Identities = 29/66 (43%), Positives = 44/66 (65%)
Query:   1 MKNSLQKLRKSRKLSQAELAVALGVTRQTIISLEKEKYTASLELAFKIARYFDKQIEEVF  60
           +KN L++LR   ++Q E+A   GV+RQTI  +E+ +YT S+ +A KIA+ F + +EEVF
Sbjct:  10 LKNRLKELRARDGINQTEMAKLAGVSRQTISLIERNEYTPSVIIAMKIAKVFQEPVEEVF  69

Query:  61 IYTESE                                                           66
              E E
Sbjct:  70 RLVEVE                                                           75
```

Based on this analysis, it was predicted that these proteins and their epitopes could be useful antigens for vaccines or diagnostics.

Example 122

A DNA sequence (GBSx0127) was identified in *S. agalactiae* <SEQ ID 413> which encodes the amino acid sequence <SEQ ID 414>. Analysis of this protein sequence reveals the following:

---

Possible site: 32
>>> Seems to have an uncleavable N-term signal seq
INTEGRAL    Likelihood = −8.97    Transmembrane 45-61 (41-66)
INTEGRAL    Likelihood = −8.65    Transmembrane 14-30 (11-37)
INTEGRAL    Likelihood = −7.80    Transmembrane 123-139 (118-145)
INTEGRAL    Likelihood = −3.24    Transmembrane 177-193 (177-194)
INTEGRAL    Likelihood = −0.85    Transmembrane 81-97 (81-97)
----- Final Results -----
   bacterial membrane --- Certainty = 0.4588 (Affirmative) <succ>
     bacterial outside --- Certainty = 0.0000 (Not Clear) <succ>
       bacterial cytoplasm --- Certainty = 0.0000 (Not Clear) <succ>

---

A related GBS nucleic acid sequence <SEQ ID 9491> which encodes amino acid sequence <SEQ ID 9492> was also identified.

The protein has homology with the following sequences in the GENPEPT database:

```
>GP:BAA11325 GB:D78257 ORF8 [Enterococcus faecalis]
Identities = 48/120 (40%), Positives = 69/120 (57%), Gaps = 5/120 (4%)
Query: 104  MQGVKDTANQTVIMELTKQLPLALMLIFAIIGAPIMEEIIFRYIIPKELFAKHQKWGFVI  163
            MQG  TAN + +++L   +   L+++  I APIMEEI+FR  I   L  +      +I
Sbjct:   1  MQGHTTTANDSTLIKLFSGVSPVLVVLLLGIAAPIMEEIVFRGGIIGYLVENNALLAILI   60

Query: 164  GTLAFALIHSPSDIGSFIIYAGMGAILSFVYYKTEHLEYSIMIHFINN-----ALAYSVL  218
             + F +IH P++  SF +Y  MG ILS  YYKT+ L  SI IHF+NN      A+AY ++
Sbjct:  61  SSFLFGIIHGPTNFISFGMYFFMGIILSVSYYKTKDLRVSISIHFLNNLFPAIAIAYGLI  120
```

A related DNA sequence was identified in *S. pyogenes* <SEQ ID 415> which encodes the amino acid sequence <SEQ ID 416>. Analysis of this protein sequence reveals the following:

---

Possible site: 24
>>> Seems to have an uncleavable N-term signal seq
INTEGRAL    Likelihood = −11.41    Transmembrane 12-28 (1-30)
INTEGRAL    Likelihood = −9.98     Transmembrane 41-57 (33-64)
INTEGRAL    Likelihood = −8.33     Transmembrane 128-144 (121-151)
INTEGRAL    Likelihood = −7.96     Transmembrane 83-99 (76-103)
INTEGRAL    Likelihood = −3.77     Transmembrane 208-224 (207-230)
INTEGRAL    Likelihood = −2.13     Transmembrane 182-198 (182-199)
----- Final Results -----
    bacterial membrane --- Certainty = 0.5564 (Affirmative) <succ>
    bacterial outside --- Certainty = 0.0000 (Not Clear) <succ>
    bacterial cytoplasm --- Certainty = 0.0000 (Not Clear) <succ>

---

The protein has homology with the following sequences in the databases:

```
>GP:BAA11325 GB:D78257 ORF8 [Enterococcus faecalis]
Identities = 47/120 (39%), Positives = 70/120 (58%), Gaps = 8/120 (6%)

Query: 105  GQQVSANDAAIHTLARLIKGGFPLYTALFVLVIAFIAPIMEELVFRGYPMIDLFKGKSLK  164
            G  +AND+    TL +L G P+   L VL++  APIMEE+VFRG  + L +  +L
Sbjct:   3  GHTTTANDS---TLIKLFSGVSPV---LVVLLLGIAAPIMEEIVFRGGIIGYLVENNAL-   55

Query: 165  VAGLVTSLVFALPHA-TNSVEFIMYSCMGIFLFVAYQRRGNLKDAILLHIFNNLIEVILL  223
            +A L++S +F + H   TN + F MY  MGI L V+Y +   +L+ +I +H  NNL   I +
Sbjct:  56  LAILISSFLFGIIHGPTNFISFGMYFFMGIILSVSYYKTKDLRVSISIHFLNNLFPAIAI  115
```

An alignment of the GAS and GBS proteins is shown below:

Based on this analysis, it was predicted that these proteins and their epitopes could be useful antigens for vaccines or diagnostics.

Example 123

A DNA sequence (GBSx0128) was identified in *S. agalactiae* <SEQ ID 417> which encodes the amino acid sequence <SEQ ID 418>. Analysis of this protein sequence reveals the following:

---

Possible site: 14
>>> Seems to have no N-terminal signal sequence
----- Final Results -----
    bacterial cytoplasm --- Certainty = 0.0826 (Affirmative) <succ>
    bacterial membrane --- Certainty = 0.0000 (Not Clear) <succ>
    bacterial outside --- Certainty = 0.0000 (Not Clear) <succ>

---

The protein has homology with the following sequences in the GENPEPT database:

```
Identities = 72/229 (31%), Positives = 114/229 (49%), Gaps = 24/229 (10%)
Query:  11  KGKILALLIAFLVINQLV-PILAVWLLKNHYQTPFTSILLIGL-------ELLIIALFLY   62
            KG I  L IA L+I +V  +L + LL+ +      P    IG+        +LI+   LY
Sbjct:   2  KGFINYLKIAVLIILAMVFNVLPMILLQKQHDIPMVLNWGIGIFYLVIVGSVLIVLWGLY   61

Query:  63  YAKVKQIIRWKALLTRKALVT---ILLGWLSLRVPQIIGYLIMTM-QGVKDTANQTVIME  118
              AK   I+ + +      LV   + L WL +RV  I+G L+   +  G + +AN    I
Sbjct:  62  QAKQDTFIKQQKM----RLVDWGYLALFWLIIRVIAIVGTLVNQLWSGQQVSANDAAIHT  117

Query: 119  LTKQL----PLALMLIFAIIG--APIMEEIIFRYIIPKELF-AKHQKWGFVIGTLAFALI  171
            L ++     PL  L    +I   APIMEE++FR   +LF  K  K     ++  +L FAL
Sbjct: 118  LARLIKGGFPLYTALFVLVIAFIAPIMEELVFRGFPMIDLFKGKSLKVAGLVTSLVFALP  177

Query: 172  HSPSDIGSFIIYAGMGAILSFVYYKTEHLEYSIMIHFINNALAYSVLIS             220
            H+ + +    FI+Y+ MG  L    Y +   +L+ +I++H  NN +     +L+S
Sbjct: 178  HATNSV-EFIMYSCMGIFLFVAYQRRGNLKDAILLHIFNNLIEVILLMS              225
```

```
>GP:AAC06504 GB:AE000676 pyrroline carboxylate reductase [Aquifex aeolicus]
Identities = 97/259 (37%), Positives = 159/259 (60%), Gaps = 4/259 (1%)

Query:    1  MKIGIIGVGKM--ASAIIQGLKQTQHDIIISGSCLERSKEIAERLDVTYAESHQSLINQA    58
             M++GI+G G M  A A+     K  + +II++       E+ + +A  + + +A    + L + +
Sbjct:    8  MRVGIVGFGNMGQAFALCFSKKLGKENIIVTDKVQEK-RNLATEMGIAFASDVKFLADNS    66

Query:   59  DIIMLGIKPQLFEKVLLPLDITKPII-SMAAGISLARLSQLTRSDLPLIRIMPNINAQIL   117
             D++++ +KP+  ++VL  L    K II S+ AG+S+ ++ ++     D  ++R+MPN+N  +
Sbjct:   67  DVVLVAVKPKDSQEVLQKLKDYKGIILSIMAGVSIEKMEKILGKDKKIVRVMPNVNVAVG   126

Query:  118  QSCTAICYNNHVSDELRQLAKEITDSFGSSFDIAETNFDTFTALAGSSPAYIYLFIEALA   177
                    AI   N ++S+E R    +E+   S G+ + I E   FD FTALAGS PA+++ FI+ALA
Sbjct:  127  SGVMAITDNGNLSEEERSKVEELLLSCGTLYRIEERLFDAFTALAGSGPAFVFSFIDALA   186

Query:  178  KAGVKYGFPKEQALSIVGQTVLASSQNLLQGQNSTSDLIDNICSPGGTTIAGLLDLEKNG   237
                AGV  GF   EQAL I    TV+ S++  L + Q + ++LI  +  SPGGTTI G+    LE+ G
Sbjct:  187  LAGVHQGFSYEQALRIALDTVMGSAKLLKEFQVNPNELIAKVTSPGGTTIEGIKYLEEKG   246

Query:  238  LTHSVISAIDATIEKAKKL                                            256
                +V+   I+  T +KAKKL
Sbjct:  247  FKGTVMECINRTSQKAKKL                                            265
```

A related DNA sequence was identified in S. pyogenes <SEQ ID 419> which encodes the amino acid sequence <SEQ ID 420>. Analysis of this protein sequence reveals the following:

Possible site: 50
>>> Seems to have no N-terminal signal sequence
----- Final Results -----
   bacterial cytoplasm --- Certainty = 0.1043 (Affirmative) <succ>
   bacterial membrane --- Certainty = 0.0000 (Not Clear) <succ>
   bacterial outside --- Certainty = 0.0000 (Not Clear) <succ>

Based on this analysis, it was predicted that these proteins and their epitopes could be useful antigens for vaccines or diagnostics.

Example 124

A DNA sequence (GBSx0129) was identified in S. agalactiae <SEQ ID 421> which encodes the amino acid sequence <SEQ ID 422>. Analysis of this protein sequence reveals the following:

Possible site: 58
>>> Seems to have no N-terminal signal sequence
----- Final Results -----
   bacterial cytoplasm --- Certainty = 0.3405 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below:

```
Identities = 180/256 (70%), Positives = 208/256 (80%)

Query:    1  MKIGIIGVGKMASAIIQGLKQTQHDIIISGSCLERSKEIAERLDVTYAESHQSLINQADI    60
             MKIGIIGVGKMASAII+GLKQT H++IISGS LERSKEIAE+L + YA SHQ LI+Q D+
Sbjct:    1  MKIGIIGVGKMASAIIKGLKQTPHELIISGSSLERSKEIAEQLALPYAMSHQDLIDQVDL    60

Query:   61  IMLGIKPQLFEKVLLPLDITKPIISMAAGISLARLSQLTRSDLPLIRIMPNINAQILQSC   120
             ++LGIKPQLFE VL PL   +PIISMAAGISL RL+      DLPL+RIMPN+NAQILQS
Sbjct:   61  VILGIKPQLFETVLKPLHFKQPIISMAAGISLQRLATFVGQDLPLLRIMPNMNAQILQSS   120

Query:  121  TAICYNNHVSDELRQLAKEITDSFGSSFDIAETNFDTFTALAGSSPAYIYLFIEALAKAG   180
             TA+   N  VS EL+    +++TDSFGS+FDI+E  +FDTFTALAGSSPAYIYLFIEALAKAG
Sbjct:  121  TALIGNALVSQELQARVRDLTDSFGSTFDISEKDFDTFTALAGSSPAYIYLFIEALAKAG   180

Query:  181  VKYGFPKEQALSIVGQTVLASSQNLLQGQNSTSDLIDNICSPGGTTIAGLLDLEKNGLTH   240
             VK G PK +AL IV QTVLAS+ NL     S  D ID ICSPGGTTIAGL++LE+ GLT
Sbjct:  181  VKNGIPKAKALEIVTQTVLASASNLKTSSQSPHDFIDAICSPGGTTIAGLMELERLGLTA   240

Query:  241  SVISAIDATIEKAKKL                                               256
             +V SAID TI+KAK L
Sbjct:  241  TVSSAIDKTIDKAKSL                                               256
```

The protein has homology with the following sequences in the GENPEPT database:

```
>GP:CAA56994 GB:X81089 glutamyl-aminopeptidase [Lactococcus lactis]
Identities = 219/354 (61%), Positives = 273/354 (76%), Gaps = 1/354 (0%)

Query:     3  DLFNKIKTVTELDGIAGYEHNIRNFLRQEITPLVDQVETDGLGGIFGVKNTHETNAPKVM   62
              +LF+K+K +TE+    +G+E  +R++L+   + L  Q E DGLGGIF  K +   NAP++M
Sbjct:     2  ELFDKVKALTEIQATSGFEGPVRDYLKARMVELGYQPEFDGLGGIFVTKASKVENAPRIM   61

Query:    63  VAAHMDEVGFMVSHIQPDGTFRVLEVGGWNPLVVSSQRFTLYTRSGDAIPVISGSVPPHF  122
              VAAHMDEVGFMVS I+ DGTFRV+ +GGWNPLVVS QRFTL+TR+G   IPV++G +PPH
Sbjct:    62  VAAHMDEVGFMVSSIKADGTFRVVPLGGWNPLVVSGQRFTLFTRTGKKIPVVTGGLPPHL  121

Query:   123  LRGQSGGTTLPKISDIVFDGGFTDKNEAESFGIAPGDIIVPKSETILTANQKHIMSKAWD  182
              LRG    +P ISDI+FDG F +  EA  FGIA GD+I+P++ETIL+AN K+I+SKAWD
Sbjct:   122  LRGTGVTPQIPAISDIIFDGAFENAAEAAEFGIAQGDLIIPETETILSANGKNIISKAWD  181

Query:   183  NRYGVLMVTELLKSLKDQSLSNTLIAGANVQEEVGLRGAHVSTTKFNPDIFLAVDCSPAG  242
              NRYG LM+ ELL+  L D+ L   TLI GANVQEEVGLRGA VSTTKFNPD+F AVDCSPA
Sbjct:   182  NRYGCLMILELLEFLADKELPVTLIIGANVQEEVGLRGAKVSTTKFNPDLFFAVDCSPAS  241

Query:   243  DIYG-EQGKIGEGTLIRFYDPGHIMLKDMRDFLLTTAEEAGIKYQYYAANGGTDAGAAHL  301
              D +G + G++GEGT +RF+DPGHIML  M++FLL TA  A +K Q Y A GGTDAGAAHL
Sbjct:   242  DTFGDDNGRLGEGTTLRFFDPGHIMLPGMKNFLLDTANHAKVKTQVYMAKGGTDAGAAHL  301

Query:   302  KNSGIPSTTIGVCARYIHSHQTLYAMDDFLQAQAYLQAIVNKLDRSTVDIIKGY  355
               N G+PSTTIGV ARYIHSHQT++  +DDFLQAQ +L+AI+   L+    V  IK Y
Sbjct:   302  ANGGVPSTTIGVVARYIHSHQTIFNIDDFLQAQTFLRAIITSLNTEKVAEIKNY  355
```

A related DNA sequence was identified in *S. pyogenes* <SEQ ID 423> which encodes the amino acid sequence <SEQ ID 424>. Analysis of this protein sequence reveals the following:

---

Possible site: 55
>>> Seems to have no N-terminal signal sequence
----- Final Results -----
   bacterial cytoplasm --- Certainty = 0.2747 (Affirmative) <succ>
   bacterial membrane --- Certainty = 0.0000 (Not Clear) <succ>
   bacterial outside --- Certainty = 0.0000 (Not Clear) <succ>

---

An alignment of the GAS and GBS proteins is shown below:

Based on this analysis, it was predicted that these proteins and their epitopes could be useful antigens for vaccines or diagnostics.

Example 125

A DNA sequence (GBSx0130) was identified in *S. agalactiae* <SEQ ID 425> which encodes the amino acid sequence <SEQ ID 426>. Analysis of this protein sequence reveals the following:

```
Identities = 276/355 (77%), Positives = 322/355 (89%)

Query:     1  MSDLFNKIKTVTELDGIAGYEHNIRNFLRQEITPLVDQVETDGLGGIFGVKNTHETNAPK   60
              M+DLF+KIK VTELDGIAGYEH++R++LR +ITPLVD+VETDGLGGIFG++++    AP+
Sbjct:     1  MTDLFSKIKEVTELDGIAGYEHSVRDYLRTKITPLVDRVETDGLGGIFGIRDSKAEKAPR   60

Query:    61  VMVAAHMDEVGFMVSHIQPDGTFRVLEVGGWNPLVVSSQRFTLYTRSGDAIPVISGSVPP  120
              ++VAAHMDEVGFMVS I+ DGT RV+ +GGWNPLVVSSQRFTLYTR+G  IP+ISGSVPP
Sbjct:    61  ILVAAHMDEVGFMVSDIKVDGTLRVVGIGGWNPLVVSSQRFTLYTRTGQVIPLISGSVPP  120

Query:   121  HFLRGQSGGTTLPKISDIVFDGGFTDKNEAESFGIAPGDIIVPKSETILTANQKHIMSKA  180
              HFLRG +G   +LP I DIVFDGGFTDK EAE  FGI PGDII+P+SETILTANQK+I+SKA
Sbjct:   121  HFLRGANGSASLPHIEDIVFDGGFTDKAEAERFGITPGDIIIPQSETILTANQKNIISKA  180

Query:   181  WDNRYGVLMVTELLKSLKDQSLSNTLIAGANVQEEVGLRGAHVSTTKFNPDIFLAVDCSP  240
              WDNRYGVLM+TE+L++LK Q L+NTLIAGANVQEEVGLRGAHVSTTKF+P++F AVDCSP
Sbjct:   181  WDNRYGVLMITEMLEALKGQDLNNTLIAGANVQEEVGLRGAHVSTTKFDPELFFAVDCSP  240

Query:   241  AGDIYGEQGKIGEGTLIRFYDPGHIMLKDMRDFLLTTAEEAGIKYQYYAANGGTDAGAAH  300
              AGDIYG   G  IG+GTL+RFYDPGH+MLKDMRDFLLTTAEEAG+  +QYY   GGTDAGAAH
Sbjct:   241  AGDIYGNPGTIGDGTLLRFYDPGHVMLKDMRDFLLTTAEEAGVNFQYYCGKGGTDAGAAH  300

Query:   301  LKNSGIPSTTIGVCARYIHSHQTLYAMDDFLQAQAYLQAIVNKLDRSTVDIIKGY      355
              L+N G+PSTTIGVCARYIHSHQTLYAMDDF++AQA+LQAI+  KLDRSTVD+IK Y
Sbjct:   301  LQNGGVPSTTIGVCARYIHSHQTLYAMDDFVEAQAFLQAIIKKLDRSTVDLIKCY      355
```

```
Possible site: 26
>>> Seems to have no N-terminal signal sequence
----- Final Results -----
   bacterial cytoplasm --- Certainty = 0.1672 (Affirmative) <succ>
      bacterial membrane --- Certainty = 0.0000 (Not Clear) <succ>
         bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 126

A DNA sequence (GBSx0131) was identified in *S. agalactiae* <SEQ ID 427> which encodes the amino acid sequence <SEQ ID 428>. Analysis of this protein sequence reveals the following:

```
Possible site: 31
>>> Seems to have no N-terminal signal sequence
INTEGRAL    Likelihood = -2.28    Transmembrane 18-34 (17-34)
----- Final Results -----
   bacterial membrane --- Certainty = 0.1914 (Affirmative) <succ>
      bacterial outside --- Certainty = 0.0000 (Not Clear) <succ>
         bacterial cytoplasm --- Certainty = 0.0000 (Not Clear) <succ>
```

The protein has no significant homology with any sequences in the GENPEPT database.

A related DNA sequence was identified in *S. pyogenes* <SEQ ID 429> which encodes the amino acid sequence <SEQ ID 430>. Analysis of this protein sequence reveals the following:

```
Possible site: 21
>>> Seems to have an uncleavable N-term signal seq
INTEGRAL    Likelihood = -6.16    Transmembrane 12-28 (8-30)
----- Final Results -----
   bacterial membrane --- Certainty = 0.3463 (Affirmative) <succ>
      bacterial outside --- Certainty = 0.0000 (Not Clear) <succ>
         bacterial cytoplasm --- Certainty = 0.0000 (Not Clear) <succ>
```

The protein has no significant homology with any sequences in the GENPEPT database.

An alignment of the GAS and GBS proteins is shown below:

```
Identities = 30/91 (32%), Positives = 48/91 (51%)

Query:  13   MKNKKILFGTGLAGVGLLAAAGYTLTKKVTDYKRQQITQTLREFFSQMGDIQVFYFNEFE    72
             M  KKI  +G+ G L    G +     D +R+Q+T+ LR FFS +G I+V Y N  +
Sbjct:  4    MSKKKIGMISGIFGFSLAIGLGIVIKDYCQDRQRRQMTRDLRTFFSPLGQIEVLYINPCQ    63

Query:  73   SDIKMTSGGLVLEDGRIFEFIYRQGVLDYVE                               103
                  SGG+V+ +G+ ++F Y    + E
Sbjct:  64   VKQDYISGGVVMSNGKQYQFTYHSRQISFEE                               94
```

A related GBS gene <SEQ ID 8497> and protein <SEQ ID 8498> were also identified. Analysis of this protein sequence reveals the following:

```
Lipop Possible site: -1    Crend: 4
SRCFLG: 0
McG: Length of UR: 21
Peak Value of UR: 2.30
Net Charge of CR: 3
McG: Discrim Score: 6.28
GvH: Signal Score (-7.5): -1.46
Possible site: 19
>>> Seems to have a cleavable N-term signal seq.
Amino Acid Composition: calculated from 20
ALOM program count: 0   value: 22.60   threshold: 0.0
PERIPHERAL     Likelihood = 22.60    29
modified ALOM score: -5.02
*** Reasoning Step: 3
Rule gpol
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>
```

Figure 40:
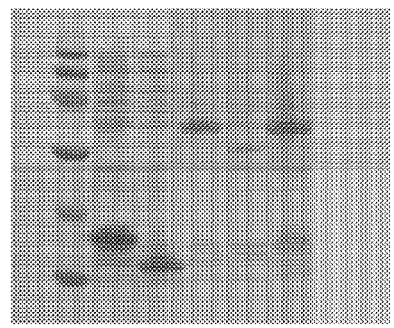
Figure 46:
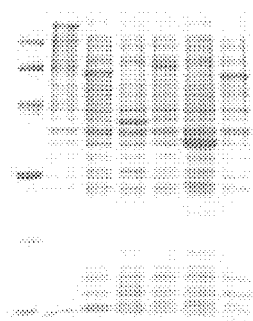

SEQ ID 8498 (GBS214) was expressed in *E. coli* as a His-fusion product. SDS-PAGE analysis of total cell extract is shown in FIG. 40 (lane 3; MW 13.9 kDa). It was also expressed in *E. coli* as a GST-fusion product. SDS-PAGE analysis of total cell extract is shown in FIG. 46 (lane 6; MW 39 kDa).

Based on this analysis, it was predicted that these proteins and their epitopes could be useful antigens for vaccines or diagnostics.

Example 127

A DNA sequence (GBSx0132) was identified in *S. agalactiae* <SEQ ID 431> which encodes the amino acid sequence <SEQ ID 432>. This protein is predicted to be thioredoxin H1 (trxA). Analysis of this protein sequence reveals the following:

```
Possible site: 40
>>> Seems to have no N-terminal signal sequence
----- Final Results -----
   bacterial cytoplasm --- Certainty = 0.2350 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database:

```
>GP:BAB06972 GB:AP001518 thioredoxin H1 [Bacillus halodurans]
Identities = 47/90 (52%), Positives = 66/90 (73%)

Query:  14  IDSTKKVVFFFTADWCPDCQFIYPVMPSIEKDFSDFVFVRVNRDDYIELAQQWNIFGIPS  73
            + + + VVF F+ADWCPDC+ I P +P +E+ + ++ F  VNRDD+IEL Q+ +IFGIPS
Sbjct:  13  VKNQENVVFLFSADWCPDCRVIEPFLPELEQTYDEYQFYYVNRDDFIELCQELDIFGIPS  72

Query:  74  FVVVENGQELGRLVNKNRKTKAEITKFLAE  103
            F+   NG+E R V+K+RKTK EI +FL E
Sbjct:  73  FLFYSNGEERSRFVSKDRKTKEEIERFLTE  102
```

A related DNA sequence was identified in *S. pyogenes* <SEQ ID 433> which encodes the amino acid sequence <SEQ ID 434>. Analysis of this protein sequence reveals the following:

---
Possible site: 35
>>> Seems to have no N-terminal signal sequence
----- Final Results -----
    bacterial cytoplasm --- Certainty = 0.1997 (Affirmative) <succ>
        bacterial membrane --- Certainty = 0.0000 (Not Clear) <succ>
            bacterial outside --- Certainty = 0.0000 (Not Clear) <succ>
---

An alignment of the GAS and GBS proteins is shown below:

```
Identities = 70/102 (68%), Positives = 81/102 (78%)

Query:   1  MILPESYEEIAAYIDSTKKVVFFFTADWCPDCQFIYPVMPSIEKDFSDFVFVRVNRDDYI  60
            MI P SYE +A  I+   K+V FFTADWCPDCQFIYP+MP IE + +D  FV VNRD +I
Sbjct:   1  MIRPTSYESLATLIEKEDKLVLFFTADWCPDCQFIYPIMPEIEAELTDMTFVCVNRDQFI  60

Query:  61  ELAQQWNIFGIPSFVVVENGQELGRLVNKNRKTKAEITKFLA  102
            E+AQ+WNIFGIPSFVV+E GQE+GRLVNK RKTK EI  FLA
Sbjct:  61  EVAQKWNIFGIPSFVVIEKGQEVGRLVNKMRKTKTEIMHFLA  102
```

Based on this analysis, it was predicted that these proteins and their epitopes could be useful antigens for vaccines or diagnostics.

Example 128

A DNA sequence (GBSx0133) was identified in *S. agalactiae* <SEQ ID 435> which encodes the amino acid sequence <SEQ ID 436>. This protein is predicted to be phenylalanyl-tRNA synthetase beta subunit, non-spirochete. Analysis of this protein sequence reveals the following:

---
Possible site: 47
>>> Seems to have no N-terminal signal sequence
----- Final Results -----
    bacterial cytoplasm --- Certainty = 0.1310 (Affirmative) <succ>
        bacterial membrane --- Certainty = 0.0000 (Not Clear) <succ>
            bacterial outside --- Certainty = 0.0000 (Not Clear) <succ>
---

The protein has homology with the following sequences in the GENPEPT database:

```
>GP:AAC00291 GB:AF008220 YtpR [Bacillus subtilis]
Identities = 78/196 (39%), Positives = 125/196 (62%), Gaps = 1/196 (0%)

Query:   5  YNREHVGDTLMVIVKDSQGAKLDVDRRGQVARVYLQDSKETVAWNIFEVSSLIVIEGAGQ  64
            YN+E VGDTL++ ++D   +L  ++ G V +++  ++KET +NIF  SS + I+  G
Sbjct:   5  YNKEGVGDTLLISLQDVTREQLGYEKHGDVVKIFNNETKETTGFNIFNASSYLTIDENGP  64

Query:  65  ITLSDQDIKILNAELLKEGFEDSLVNNIEPTFVVAQIKEIIDHPDSDHLICQAEINDGK   124
            + LS+  ++ +N  L + G E++LV ++ P FVV  ++     HP++D L +C+  + +
Sbjct:  65  VALSETFVQDVNEILNRNGVEETLVVDLSPKFVVGYVESKEKHPNADKLSVCKVNVGE-E  123

Query: 125  TVQIVCGAPNASVGLKTVAALPGAMMPNGSLIFPGKLRGEDSFGMLCSARELALPNAPQV  184
            T+QIVCGAPN   G K V A  GA+MP+G +I   +LRG  S GM+CSA+EL LP+AP
Sbjct: 124  TLQIVCGAPNVDGQKVVVAKVGAVMPSGLVIKDAELRGVPSSGMICSAKELDLPDAPAE  183

Query: 185  RGIIELSDQVIVGESF  200
            +GI+ L    G++F
Sbjct: 184  KGILVLEGDYEAGDAF  199
```

A related DNA sequence was identified in *S. pyogenes* <SEQ ID 437> which encodes the amino acid sequence <SEQ ID 438>. Analysis of this protein sequence reveals the following:

```
Possible site: 47
>>> Seems to have no N-terminal signal sequence
INTEGRAL     Likelihood = –1.49    Transmembrane 90-106 (90-107)
----- Final Results -----
    bacterial membrane --- Certainty = 0.1595 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the databases:

```
>GP:BAB06970 GB:AP001518 phenylalanyl-tRNA synthetase (beta subunit)
[Bacillus halodurans]
Identities = 84/196 (42%), Positives = 124/196 (62%), Gaps = 1/196 (0%)

Query:     5 YNKEQVGDVLMVILQDTKDIKRQVERKGKVARVFAEESGKTLAWNIFEASSLITIEGNGQ    64
             YN++ +GD +++++ + +   R  ER+G V R++    +GKT  +N+F AS      G G
Sbjct:     5 YNEKGIGDTILIVIDEVEPANRAYERQGDVVRIYHLGTGKTTGYNLFHASKYGEFNGQGL    64

Query:    65 IFLTDENLARLNAELAKEGFSERLEPIVGPVFVVGQIVEMVAHPDSDHLNICQVAIGEDQ   124
             + LTD  +A L      K G +  LE  + P FVVG +       HP++D L+IC+V +G D
Sbjct:    65 LELTDSLVATLEQAFQKNGVNWTLEVDLSPKFVVGFVQSKDKHPNADKLSICKVDVGSD-   123

Query:   125 TVQIVAGAPNAALGLKTIVALPGAIMPNGSLIFPGKLRGEESYGMMCSPRELALPNAPQK   184
             T+QIV GAPN   G K +VAL GA+MP+G +I P   LRG   S GM+CS +ELALP+AP++
Sbjct:   124 TLQIVCGAPNVEAGQKVVVALEGAVMPSGLVIKPTSLRGVSSTGMICSAKELALPDAPEE   183

Query:   185 RGIIEFDESAVVGEAF                                             200
             +GI+  D+S  VG +F
Sbjct:   184 KGILVLDDSYEVGTSF                                             199
```

An alignment of the GAS and GBS proteins is shown below:

```
Identities = 133/207 (64%), Positives = 167/207 (80%)

Query:     1 MIFTYNREHVGDTLMVIVKDSQGAKLDVDRRGQVARVYLQDSKETVAWNIFEVSSLIVIE    60
             MIF  YN+E VGD LMVI++D++   K  V+R+G+VARV+ ++S +T+AWNIFE SSLI IE
Sbjct:     1 MIFAYNKEQVGDVLMVILQDTKDIKRQVERKGKVARVFAEESGKTLAWNIFEASSLITIE    60

Query:    61 GAGQITLSDQDIKILNAELLKEGFEDSLVNNIEPTFVVAQIKEIIDHPDSDHLHICQAEI   120
             G GQI L+D+++  LNAEL KEGF + L    + P FVV QI E++ HPDSDHL+ICQ  I
Sbjct:    61 GNGQIFLTDENLARLNAELAKEGFSERLEPIVGPVFVVGQIVEMVAHPDSDHLNICQVAI   120

Query:   121 NDGKTVQIVCGAPNASVGLKTVAALPGAMMPNGSLIFPGKLRGEDSFGMLCSARELALPN   180
             + +TVQIV GAPNA++GLKT+ ALPGA+MPNGSLIFPGKLRGE+S+GM+CS RELALPN
Sbjct:   121 GEDQTVQIVAGAPNAALGLKTIVALPGAIMPNGSLIFPGKLRGEESYGMMCSPRELALPN   180

Query:   181 APQVRGIIELSDQVIVGESFDANKHWK                                  207
             APQ RGIIE +  +VGE+FD  KHWK
Sbjct:   181 APQKRGIIEFDESAVVGEAFDPAKHWK                                  207
```

Based on this analysis, it was predicted that these proteins and their epitopes could be useful antigens for vaccines or diagnostics.

Example 129

A DNA sequence (GBSx0135) was identified in *S. agalactiae* <SEQ ID 439> which encodes the amino acid sequence <SEQ ID 440>. Analysis of this protein sequence reveals the following:

Possible site: 30
>>> Seems to have no N-terminal signal sequence
----- Final Results -----
bacterial cytoplasm --- Certainty = 0.3052 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database:

```
>GP:AAB81904 GB:U92974 unknown [Lactococcus lactis]
Identities = 69/241 (28%), Positives = 117/241 (47%), Gaps = 15/241 (6%)

Query:     7  YKEMLAKPWGKIQYEITFAQL--SHIKNQNVLDFGAGFCLTEQHLAKEN-NVTAIEPNPK    63
              Y E+  KPWG++ Y++ F QL  + K+  +L FG+GF   TE  L ++    VT  EP+ +
Sbjct:    23  YAEVFEKPWGRMFYDLLFPQLLPNLTKDSKILSFGSGFGRTETFLEEQGFEVTGYEPDVE    82

Query:    64  LLYDNQSDNIYKILGSYEALRD-LPDQSFDTIICHNVLEYIDKHNHPAYFDEFSRLLKPN   122
              L         ++ G+++   + + ++ +D I+ HNVLEY+    +       +    LL
Sbjct:    83  KLEMMSDQTFRQLTGTFDDFAETVKNERYDVILIHNVLEYV--LDRKVVLELLLSLLTDG   140

Query:   123  GELSLIKHNITGKILQSVIFSNDTSTAMELLTGEANFKSASFDQGNIYT-----LEELKQ   177
              G LS++KH+  G +++       ++   A+++     EA    AS + G+I       L +
Sbjct:   141  GTLSIVKHSKYGSMIEMAAGRDNPQAALDVYENEA---VASHNHGDILVYDDDWLTDFVA   197

Query:   178  NTNLLVERYQGIRTFYSLQPN-HFKTETGWLNKMLAIELSVADKAPYKDIAFLQHITLKKS   237
              N L ++   GIR FY +  N  K      W    ML +E  VA         +A L H+  KKS
Sbjct:   198  NYKLKLQEKFGIRHFYGISQNAEIKETENWYQPMLKLEQKVAKDQTLYPVARLHHLIFKKS   258
```

No corresponding DNA sequence was identified in *S. pyogenes*.

Based on this analysis, it was predicted that this protein and its epitopes, could be useful antigens for vaccines or diagnostics.

Example 130

A DNA sequence (GBSx0136) was identified in *S. agalactiae* <SEQ ID 441> which encodes the amino acid sequence <SEQ ID 442>. Analysis of this protein sequence reveals the following:

Possible site: 58
>>> Seems to have no N-terminal signal sequence
----- Final Results -----
bacterial cytoplasm --- Certainty = 0.3479 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database:

A related DNA sequence was identified in *S. pyogenes* <SEQ ID 443> which encodes the amino acid sequence <SEQ ID 444>. Analysis of this protein sequence reveals the following:

Possible site: 32
>>> Seems to have no N-terminal signal sequence
----- Final Results -----
bacterial cytoplasm --- Certainty = 0.1817 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below:

```
>GP:AAF74079 GB:AF212845 putative single stranded binding protein
[Lactococcus lactis bacteriophage ul36]
Identities = 64/141 (45%), Positives = 92/141 (64%), Gaps = 10/141 (7%)

Query:     1  MYNKVIMIGRLTAKPEMVKTPTDKSVTRATVAVNRRFKGSNGEREADFINVVMWGRLAET    60
              M N V ++GR+T +PE+  TP +K+V   T+AVNR FK +NGEREADFI  V+WG+ AE
Sbjct:     1  MINNVTLVGRITKEPELRYTPQNKAVATFTLAVNRAFKNANGEREADFISCVIWGKSAEN    60

Query:    61  LASYGTKGSLISIDGELRTRKYE-KDGQTHYITEVLASSFQLLESRAQ---------RAM   110
              LA++  KG LI + G ++TR YE + GQ   YITEV+AS+FQ+LE      Q          +
Sbjct:    61  LANWTHKGQLIGVIGNIQTRNYENQQGQRVYITEVVASNFQVLEKSNQANGERISNPASK   120

Query:   111  RENNVSGDLSDLVLEEEELPF                                          131
              +NN S      + + +++LPF
Sbjct:   121  PQNNDSFGSDPMEISDDDLPF                                          141
```

```
Identities = 102/131 (77%), Positives = 116/131 (87%)

Query:     1  MYNKVIMIGRLTAKPEMVKTPTDKSVTRATVAVNRRFKGSNGEREADFINVVMWGRLAET    60
              MYNKVI IGRL AKPE+VKT TDK V R ++AVNRRFK ++GEREADFI+VV+WG+LAET
Sbjct:     1  MYNKVIAIGRLVAKPELVKTATDKHVARLSLAVNRRFKNASGEREADFISVVVWGKLAET    60

Query:    61  LASYGTKGSLISIDGELRTRKYEKDGQTHYITEVLASSFQLLESRAQRAMRENNVSGDLS   120
              L SY +KGSL+SIDGELRTRKY+KDGQ HY+TEVL  SFQLLESRAQRAMRENNV+ DL
Sbjct:    61  LVSYASKGSLMSIDGELRTRKYDKDGQVHYVTEVLCQSFQLLESRAQRAMRENNVTNDLV   120

Query:   121  DLVLEEEELPF                                                  131
              DLVLEE+ LPF
Sbjct:   121  DLVLEEDTLPF                                                  131
```

Based on this analysis, it was predicted that these proteins and their epitopes could be useful antigens for vaccines or diagnostics.

Example 131

A DNA sequence (GBSx0137) was identified in *S. agalactiae* <SEQ ID 445> which encodes the amino acid sequence <SEQ ID 446>. Analysis of this protein sequence reveals the following:

---

Possible site: 49
>>> Seems to have no N-terminal signal sequence
----- Final Results -----
  bacterial cytoplasm --- Certainty = 0.2235 (Affirmative) <succ>
    bacterial membrane --- Certainty = 0.0000 (Not Clear) <succ>
      bacterial outside --- Certainty = 0.0000 (Not Clear) <succ>

A related GBS nucleic acid sequence <SEQ ID 9493> which encodes amino acid sequence <SEQ ID 9494> was also identified.

The protein has homology with the following sequences in the GENPEPT database:

A related DNA sequence was identified in *S. pyogenes* <SEQ ID 447> which encodes the amino acid sequence <SEQ ID 448>. Analysis of this protein sequence reveals the following:

---

Possible site: 25
>>> Seems to have no N-terminal signal sequence
----- Final Results -----
  bacterial cytoplasm --- Certainty = 0.3706 (Affirmative) <succ>
    bacterial membrane --- Certainty = 0.0000 (Not Clear) <succ>
      bacterial outside --- Certainty = 0.0000 (Not Clear) <succ>

---

```
>GP:CAC13072 GB:AL445503 putative hydrolase [Streptomyces coelicolor]
Identities = 63/179 (35%), Positives = 91/179 (50%), Gaps = 2/179 (1%)

Query:    33  IIFDMDGVIVDSEYTFLDNKTEMLREEGI-DTDVSYQYQYMGTTFEFMWQAMKEEFGLPK    91
              +IFD+DG +VDSE + +    L E G+ D +    Y+G + +       K  +GL
Sbjct:    12  VIFDLDGTLVDSEPHYYEAGRRTLAEYGVPDFSWADHEAYVGISTQETVADWKRRYGLRA    71

Query:    92  TVKEYIAEMNRRRQAIVARDGVRPIKGAQRLIHWLHQHGYRLAVASSSPMVDIKRNLKEL   151
              TV+E +A  NR   + AR  R      ++ +   L   G  +AVAS S     I    L
Sbjct:    72  TVEELLAVKNRHYLGL-ARTSARAYPEMRKFVELLAGEGVPMAVASGSSPEAIAAILART   130

Query:   152  GVTECFEYMVTGEDVSSSKPAPDVFLRAAELLDVDPKVCIVIEDTRNGSLAAKAAGMYC   210
              G+        +V+ ++V+  KPAPDVFL AA  L +P  C+V+ED   G+ AA AAGM C
Sbjct:   131  GLDAHLRTVVSADEVARGKPAPDVFLEAARRLGTEPARCVVLEDAAPGAAAAHAAGMRC   189
```

An alignment of the GAS and GBS proteins is shown below:

```
Identities = 62/202 (30%), Positives = 100/202 (48%), Gaps = 1/202 (0%)

Query:    29  MEKVIIFDMDGVIVDSEYTFLDNKTEMLREEGIDTDVSYQYQYMGTTFEFMWQAMKEEFG    88
              M K IIFDMDGV+ D+E +L + +  + +GI  D      ++G   +  +W+ +  +
Sbjct:     3  MIKGIIFDMDGVLFDTEPFYLRRREDFFKTKGIPIDHLNSKDFIGGNLQELWKELLGKNR    62

Query:    89  LPKTVKEYIAEMNRRRQAIVARDGVRPIKGAQRLIHWLHQHGYRLAVASSSPMVDIKRNL   148
                  VK   +   +QA         I    +   L + G +LAVAS+S    D+    L
Sbjct:    63  DDAIVKAITTDYDAYKQAHKPPYQKLLITEVNSCLEQLEKQGIKLAVASNSKRQDVLLAL   122

Query:   149  KELGVTECFEYMVTGEDVSSSKPAPDVFLRAAELLDVDPKVCIVIEDTRNGSLAAKAAGM   208
```

```
               +   + + FE ++    EDVS   KP PD++ +A + L +    K  +V+ED++ G AAKAA   +
Sbjct:   123   ETTQIKDYFEIILAREDVSRGKPYPDIYNKAVQKLGLQKKQLLVVEDSQKGIAAAKAANL     182

Query:   209   YCFGFANPDYPPQDLSMADKVI                                           230
               F   +  Y   D S AD  I
Sbjct:   183   TVFAITDYRY-GIDQSQADHKI                                           203
```

Based on this analysis, it was predicted that these proteins and their epitopes could be useful antigens for vaccines or diagnostics.

Example 132

A DNA sequence (GBSx0138) was identified in *S. agalactiae* <SEQ ID 449> which encodes the amino acid sequence <SEQ ID 450>. Analysis of this protein sequence reveals the following:

---

Possible site: 20
>>> Seems to have no N-terminal signal sequence
INTEGRAL    Likelihood = −0.22    Transmembrane 16-32 (16-32)
----- Final Results -----
  bacterial membrane --- Certainty = 0.1086 (Affirmative) <succ>
    bacterial outside --- Certainty = 0.0000 (Not Clear) <succ>
      bacterial cytoplasm --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 133

A DNA sequence (GBSx0139) was identified in *S. agalactiae* <SEQ ID 451> which encodes the amino acid sequence <SEQ ID 452>. Analysis of this protein sequence reveals the following:

---

Possible site: 34
>>> Seems to have an uncleavable N-term signal seq
INTEGRAL    Likelihood = −5.04    Transmembrane 28-44 (27-45)
----- Final Results -----
  bacterial membrane --- Certainty = 0.3017 (Affirmative) <succ>
    bacterial outside --- Certainty = 0.0000 (Not Clear) <succ>
      bacterial cytoplasm --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 134

A DNA sequence (GBSx0140) was identified in *S. agalactiae* <SEQ ID 453> which encodes the amino acid sequence <SEQ ID 454>. Analysis of this protein sequence reveals the following:

---

Possible site: 17
>>> Seems to have an uncleavable N-term signal seq
INTEGRAL    Likelihood = −10.72    Transmembrane 38-54 (34-60)
INTEGRAL    Likelihood = −7.70    Transmembrane 4-20 (1-22)
INTEGRAL    Likelihood = −4.99    Transmembrane 153-169 (150-171)
INTEGRAL    Likelihood = −2.55    Transmembrane 179-195 (178-198)
INTEGRAL    Likelihood = −2.39    Transmembrane 93-109 (93-109)
INTEGRAL    Likelihood = −1.17    Transmembrane 116-132 (116-133)
INTEGRAL    Likelihood = −0.43    Transmembrane 344-360 (344-360)
----- Final Results -----
  bacterial membrane --- Certainty = 0.5288 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the GENPEPT database:

```
>GP:CAB14853 GB:Z99118 two-component sensor histidine kinase
[Bacillus subtilis]
Identities = 254/585 (43%), Positives = 371/585 (63%), Gaps = 9/585 (1%)
Query:   2    LMVLLFQRLGIIMILAFLLVNNSYFRQLIEERSK-RETVVLVIIFGLFVIISNITGIEIK    60
              LM+++ +R+GII+IL F+L +     FRQ ++ +     +L+ IF LF  IISN TGIEI+
Sbjct:   4    LMIMMLERVGIIVILGFILAHTKLFRQALQNQDGYKGKAILISIFSLFSIISNYTGIEIQ    63

Query:   61   GDRSLVERPFLTTISHSDSLANTRTLVITTASLVGGPLVGSIVGFIGGVHRFFQGSFSGS   120
              +   +V  ++ TI   S S+ANTR L +     L+GGP VG+ +G + G+HRF   G   +
Sbjct:   64   RNM-IVNEDWVETIDPSGSIANTRILGVEIGGLLGGPFVGAGIGILAGLHRFSLGGSTAL   122

Query:   121  FYIVSSVLVGIVSGKIGDKLKENHLYPSTSQVILISIIAESIQMLFVGIFT-----GWEL   175
                   VSS+L G+++G IG     + +   P+      L+ I    ES+QM+ + +           WEL
Sbjct:   123  SCAVSSILAGVLAGLIGRYFTKRYRMPTPRIAALVGIGMESLQMIIILLMAKPFSDAWEL   182

Query:   176  VKMIVIPMMILNSLGSTLFLAILKTYLSNESQLRAVQTRDVLELTRQTLPYLRQGLTPQS   235
              V  MI  IPM+++N  GS +FL+I++      + E Q RA++T  VL  +  QTLP+ RQGL     S
```

```
-continued
Sbjct: 183   VSMIGIPMILINGTGSFIFLSIIQAIIRKEEQARALETHRVLTIADQTLPFFRQGLNENS   242

Query: 236   ARSVCEIIKRHTNFDAVGLTDRSNVLAHIGVGHDHHIAGQPVKTDLSKSVIFDGEPRIAQ   295
             +SV  II + T  DAV LTD+  +LAH+G G DHHI  + + T LSK VI  G    A
Sbjct: 243   CKSVAAIIHKLTGTDAVSLTDKEKILAHVGAGMDHHIPSKSLITGLSKKVIKTGHIMKAI   302

Query: 296   DKAAISCPDHNCQLNSAIVVPLKINDKTVGALKMYFAGDKTMSEVEENLVLGLAQIFSGQ   355
             +  I C    C L++AIV+PL  N  T+G LKMYF      +S+VEE L  GLA +FS Q
Sbjct: 303   SQEEIECTHAECPLHAAIVLPLTSNGNTIGTLKMYFKSPAGLSQVEEELAEGLAMLFSTQ   362

Query: 356   LAMGITEEQNKLASMAEIKALQAQINPHFFFNAINTISALIRIDSDKARYALMQLSTFFR   415
             L +G  E Q+KL    AEIKALQAQ+NPHF FNAINTISAL R D +K R  L+QLS +FR
Sbjct: 363   LELGEAELQSKLLKDAEIKALQAQVNPHFLFNAINTISALCRTDVEKTRKLLLQLSVYFR   422

Query: 416   TSLQGGQDREVTLEQEKSHVDAYMNVEKLRFPDKYQLSYDI-SAPEKMKLPPFGLQVLVE   474
             ++LQG +    + L +E +H++AY+++E  RFP KY++   +I S    E++++PPF LQVLVE
Sbjct: 423   SNLQGARQLLIPLSKELNHLNAYLSLEQARFPGKYKIELNIDSRLEQIEIPPFVLQVLVE   482

Query: 475   NAVRHAFKERKTDNHILVQIKPDGHYYCVSVSDNGQGISDTIIDKLGQETVAESKGTGTA   534
             NA+RHAF +++     + V +  D       + V+DNG+GI    ++ +LG++        +GTGTA
Sbjct: 483   NALRHAFPKKQDICKVTVCVLSDDASVYMKVADNGRGIPPDVLPELGKKPFPSKEGTGTA   542

Query: 535   LVNLNNRLNLLYGSVSCLHFSSD-KNGTKVWYRIPNRIREDEHEN   578
             L NLN  RL  L+G  + LH SS+    GT+V +++P +   ++   E+
Sbjct: 543   LYNLNQRLIGLFGQQAALHISSEVHKGTEVSFQVPMQQMKEGEEH   587
```

A related DNA sequence was identified in *S. pyogenes* <SEQ ID 455> which encodes the amino acid sequence <SEQ ID 456>. Analysis of this protein sequence reveals the following:

Possible site: 23
>>> Seems to have no N-terminal signal sequence
----- Final Results -----
   bacterial cytoplasm --- Certainty = 0.1771 (Affirmative) <succ>
    bacterial membrane --- Certainty = 0.0000 (Not Clear) <succ>
     bacterial outside --- Certainty = 0.0000 (Not Clear) <succ>

An alignment of the GAS and GBS proteins is shown below:

```
Identities = 75/245 (30%), Positives = 117/245 (47%), Gaps = 22/245 (8%)
Query: 348   LAQIFSGQL-----AMGITEEQNKLASMAEIKALQAQINPHFFFNAINTISALIRI-DSD   401
             LAQ F+ L      M   ++ K        ++AL +QINPHF +N ++TI  +   DS
Sbjct:   4   LAQQFNALLDQIDSLMVAVADKEKAIGQYRLQALASQINPHFLYNTLDTIIWMAEFNDSK    63

Query: 402   KARYALMQLSTFFRTSLQGGQDREVTLEQEKSHVDAYMNVEKLRFPDKYQLSYDISAPE-   460
             +       L+ +FR +L G +  + L  E  HV  Y+ ++K R+ DK  LSY++     +
Sbjct:  64   RVVEVTKSLAKYFRLALNQGNEY-IRLADELDHVSQYLFIQKQRYGDK--LSYEVQGLDV   120

Query: 461   --KMKLPPFGLQVLVENAVRHAFKERKTDNHILVQIKPDGHYYCVSVSDNGQGISDTIID   518
               +P   LQ LVENA+ H  KE          I V +     +  ++V DNG+GI D+ +
Sbjct: 121   YADFVIPKLILQPLVENAIYHGIKEVDRKGMIKVTVSDTAQHLMLTVWDNGKGIEDSSLT   180

Query: 519   KLGQETVAESKGTGTALVNLNNRLNLLYGS--VSCLHFSSDKNGTKVWYRIPNR---IRE   573
              Q  +A     G  L N++ RL L YG      +H  SD+  T++       +P     + +
Sbjct: 181   N-SQSLLARG---GVGLKNVDQRLKLHYGEGYHMTIHSQSDQ-FTEIQLSLPKMHELMAD   235

Query: 574   DEHEN   578
             D  EN
Sbjct: 236   DTQEN   240
```

Figure 124:
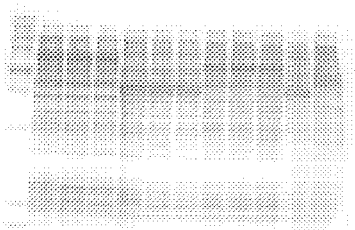
Figure 125:
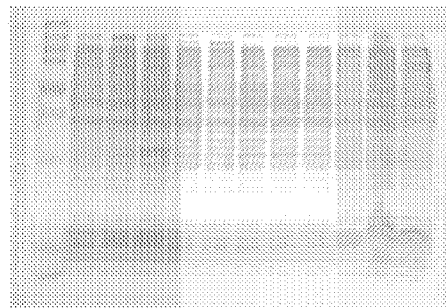
Figure 126:
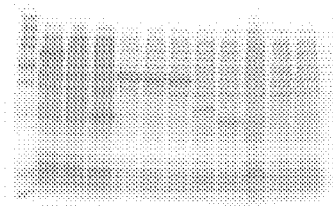
Figure 180:
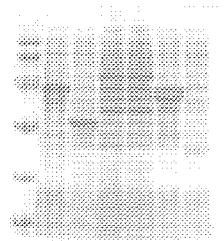

SEQ ID 454 (GBS248d) was expressed in *E. coli* as a GST-fusion product. SDS-PAGE analysis of total cell extract is shown in FIG. 124 (lane 2-4; MW 71 kDa). It was also expressed in *E. coli* as a His-fusion product. SDS-PAGE analysis of total cell extract is shown in FIG. 124 (lane 5-7; MW 46 kDa) and in FIG. 180 (lane 2; MW 46 kDa).

Figure 234:
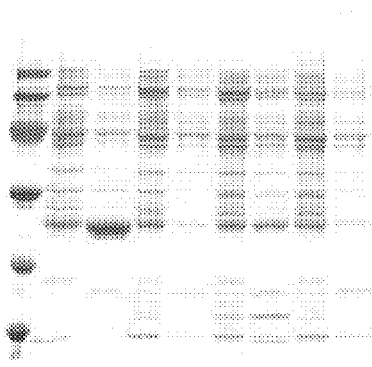

GBS248d-His was purified as shown in FIG. 234, lane 3-4.

Based on this analysis, it was predicted that these proteins and their epitopes could be useful antigens for vaccines or diagnostics.

Example 135

A DNA sequence (GBSx0141) was identified in *S. agalactiae* <SEQ ID 457> which encodes the amino acid sequence <SEQ ID 458>. This protein is predicted to be two-component response regulator (lytT). Analysis of this protein sequence reveals the following:

Possible site: 61
>>> Seems to have no N-terminal signal sequence
----- Final Results -----
   bacterial cytoplasm --- Certainty = 0.3230 (Affirmative) <succ>
    bacterial membrane --- Certainty = 0.0000 (Not Clear) <succ>
     bacterial outside --- Certainty = 0.0000 (Not Clear) <succ>

A related GBS nucleic acid sequence <SEQ ID 9495> which encodes amino acid sequence <SEQ ID 9496> was also identified.

The protein has homology with the following sequences in the GENPEPT database:

Possible site: 18
>>> Seems to have no N-terminal signal sequence

```
>GP:CAB14852 GB:Z99118 two-component response regulator [Bacillus subtilis]
Identities = 105/244 (43%), Positives = 157/244 (64%), Gaps = 6/244 (2%)
Query:   3    MKILILDDEMFARQELSFLVEHSQEVDNPEIFQAEDISEAEKILFRQQIDLIFLDISLSE    62
              +++LI+DDEM AR EL++L+++D        EI +AE+I  A   + Q+ DL+FLD+ LS
Sbjct:   2    LRVLIVDDEMLARDELAYLLKRTN--DEMEINEAENIESAFDQMMDQKPDLLFLDVDLSG    59

Query:  63    ENGFTLANQLSQLAHPPLVVFATAYDNYAVKAFESNAVDYIMKPFEQQRVDMALSKVKKL   122
              ENGF +A +L ++ HPP +VFATAYD  YA+KAFE +A+DY+ KPF+++R+   L K KK+
Sbjct:  60    ENGFDIAKRLKKMKHPPAIVFATAYDQYALKAFEVDALDYLTKPFDEERIQQTLKKYKKV   119

Query: 123    SQLTTASDVEQAIPKKASVELLTLTLSDRSVVVKMQDIVAASVEDGELTVSTVQKTYTIR   182
              ++      VE A          L L++ +  V+V  +DI+A     EDG + V T   +YT+
Sbjct: 120    NR----DIVETEQNSHAGQHKLALSVGESIVIVDTKDIIYAGTEDGHVNVKTFDHSYTVS   175

Query: 183    KTLNWFKSRAVAPYFLQIHRNTVINLEMIEEIQPWFNHTLLLIMSNGEKFPVGRSYLKDL   242
              TL   + +       F+++HR+ V+N E I+EIQPWFN T   LIM +G K PV R+Y K+L
Sbjct: 176    DTLVVIEKKLPDSDFIRVHRSFVVNTEYIKEIQPWFNSTYNLIMKDGSKIPVSRTYAKEL   235

Query: 243    NEHL                                                         246
              + L
Sbjct: 236    KKLL                                                         239
```

A related DNA sequence was identified in S. pyogenes <SEQ ID 459> which encodes the amino acid sequence <SEQ ID 460>. Analysis of this protein sequence reveals the following:

Possible site: 27
>>> Seems to have no N-terminal signal sequence
----- Final Results -----
 bacterial cytoplasm --- Certainty = 0.3818 (Affirmative) <succ>
  bacterial membrane --- Certainty = 0.0000 (Not Clear) <succ>
   bacterial outside --- Certainty = 0.0000 (Not Clear) <succ>

An alignment of the GAS and GBS proteins is shown below:

```
Identities = 44/148 (29%), Positives = 84/148 (56%), Gaps = 5/148 (2%)
Query:   5    ILILDDEMFARQELSFLVEHSQ-EVDNPEIFQAEDISEAEKILFRQQIDLIFLDISLSEE    63
              +LI++DE  RQ + LV+ SQ ++D    +AE+   A  +  ++ D++  DI++  +
Sbjct:   4    LLIVEDEYLVRQGIRSLVDFSQFKIDR--VNEAENGQLAWDLFQKEPYDIVLTDINMPKL    61

Query:  64    NGFTLANQLSQLAHPPLVVFATAYD--NYAVKAFESNAVDYIMKPFEQQRVDMALSKVKK   121
              NG  LA  + Q +      +VF T YD   NYA+ A +   A DY++KPF +  V+  L K++K
Sbjct:  62    NGIQLAELIKQESPQTHLVFLTGYDDFNYALSALKLGADDYLLKPFSKADVEDMLGKLRK   121

Query: 122    LSQLTTASDVEQAIPKKASVELLTLTLS                                 149
              +L+  ++  Q + ++     E+     +  ++
Sbjct: 122    KLELSKKTETIQELVEQPQKEVSAIAMA                                 149
```

Based on this analysis, it was predicted that these proteins and their epitopes could be useful antigens for vaccines or diagnostics.

Example 136

A DNA sequence (GBSx0142) was identified in S. agalactiae <SEQ ID 461> which encodes the amino acid sequence <SEQ ID 462>. Analysis of this protein sequence reveals the following:

-continued

----- Final Results -----
 bacterial cytoplasm --- Certainty = 0.0266 (Affirmative) <succ>
  bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 137

A DNA sequence (GBSx0143) was identified in S. agalactiae <SEQ ID 463> which encodes the amino acid sequence <SEQ ID 464>. Analysis of this protein sequence reveals the following:

Possible site: 37
>>> Seems to have no N-terminal signal sequence
INTEGRAL    Likelihood = −11.89    Transmembrane 104-120 (99-134)
INTEGRAL    Likelihood = −5.89     Transmembrane 47-63 (46-65)
INTEGRAL    Likelihood = −3.29     Transmembrane 22-38 (21-39)

```
INTEGRAL    Likelihood = -2.81    Transmembrane 74-90 (70-92)
----- Final Results -----
   bacterial membrane --- Certainty = 0.5755 (Affirmative) <succ>
      bacterial outside --- Certainty = 0.0000 (Not Clear) <succ>
         bacterial cytoplasm --- Certainty = 0.0000 (Not Clear) <succ>
```

A related GBS nucleic acid sequence <SEQ ID 8499> which encodes amino acid sequence <SEQ ID 8500> was also identified.

The protein has homology with the following sequences in the GENPEPT database:

```
>GP:CAB14851 GB:Z99118 similar to hypothetical proteins from B. subtilis
[Bacillus subtilis]
Identities = 50/110 (45%), Positives = 82/110 (74%), Gaps = 2/110 (1%)
Query:  20  QMSIYAAILLVSQMISMLLPKSLPIPTTVIGLVLMYVLLTAKIIKVEWVDSFGALMISMI   79
            Q  I+A I+LVS MI+ ++P  +PIP +V+GLVL+++LL   K+IK+E V++ G  + S+I
Sbjct:  12  QAFIFAVIMLVSNMIAAIVP--IPIPASVVGLVLLFLLLCLKVIKLEQVETLGTSLTSLI   69

Query:  80  GFMFVPSGISVAANLDILKAEGLQLVAVITISTVVMLVVVAYVARLILAI            129
            GF+FVPSGISV  +L +++  GLQ+V VI ++T+++L        ++LIL++
Sbjct:  70  GFLFVPSGISVMNSLGVMQQYGLQIVLVILLATIILLGATGLFSQLILSL             119
```

No corresponding DNA sequence was identified in *S. pyogenes*.

Based on this analysis, it was predicted that these proteins and their epitopes could be useful antigens for vaccines or diagnostics.

Example 138

A DNA sequence (GBSx0144) was identified in *S. agalactiae* <SEQ ID 465> which encodes the amino acid sequence <SEQ ID 466>. Analysis of this protein sequence reveals the following:

```
Possible site: 44
>>> Seems to have a cleavable N-term signal seq.
INTEGRAL    Likelihood = -12.21    Transmembrane 219-235 (208-241)
INTEGRAL    Likelihood = -11.94    Transmembrane 103-119 (99-133)
INTEGRAL    Likelihood = -5.57     Transmembrane 157-173 (154-175)
INTEGRAL    Likelihood = -1.70     Transmembrane 73-89 (73-89)
----- Final Results -----
   bacterial membrane --- Certainty = 0.5883 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the GENPEPT database:

No corresponding DNA sequence was identified in *S. pyogenes*.

Based on this analysis, it was predicted that these proteins and their epitopes could be useful antigens for vaccines or diagnostics.

Example 139

A DNA sequence (GBSx0145) was identified in *S. agalactiae* <SEQ ID 467> which encodes the amino acid sequence <SEQ ID 468>. Analysis of this protein sequence reveals the following:

```
Possible site: 22
>>> May be a lipoprotein
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>
```

An alignment of the GAS and GBS proteins is shown below:

```
>GP:CAB14850 GB:Z99118 similar to hypothetical proteins [Bacillus subtilis]
Identities = 120/240 (50%), Positives = 159/240 (66%), Gaps = 10/240 (4%)
Query:   1  MELLKTPIFGICFSLILYTIGEHLFKKSKGFFLLQPLFFAMVSGIVILWLMSKGLGTDVK    60
            ME   +P FGI   SL   +IG  LFKK+KGFFL  PLF AMV GI   L         +
Sbjct:   1  MESTMSPYFGIVVSLAAFGIGTFLFKKTKGFFLFTPLFVAMVLGIAFL---------KIG    51

Query:  61  TFYTQAYKPGGDLIFWFLNPATIAFAVPLYKKNDVVKKYWVEILSSLVIGMIVSLILIVA   120
              F    Y    GG++I +FL  PATIAFA+PLYK+ D +KKYW +I++S++ G I S+ ++
Sbjct:  52  GFSYADYNNGGEIIKFFLEPATIAFAIPLYKQRDKLKKYWWQIMASIIAGSICSVTIVYL   111

Query: 121  ISKMVGLSQVGIASMLPQAATTAIALPITAAIGGNTAVTAMACILNAVIIYALGKKLVSF   180
            ++K + L     +  SMLPQAATTAIALP++   IGG + +TA A I NAVI+YALG    +
Sbjct: 112  LAKGIHLDSAVMKSMLPQAATTAIALPLSKGIGGISDITAFAVIFNAVIVYALGALFLKV   171

Query: 181  FHLNDSKIGAGLGLGTSGHTVGAAFALELGELQGAMAAIAVVVIGLVVDLVIPIFSHLIG   240
            F +   + I  GL LGTSGH +G A  +E+GE++  AMA+IAVVV+G+V  LVIP+F  LIG
Sbjct: 172  FKVK-NPISKGLALGTSGHALGVAVGIEMGEVEAAMASIAVVVVGVVTVLVIPVFVQLIG   230
```

```
Identities = 508/542 (93%), Positives = 523/542 (95%)
Query: 1    MTKYLKYISFVALFLASIFLVACQNQNSQTKERTRKQRPKDELVVSMGAKLPHEFDPKDR   60
            ++KYLKY S + LFL   + LVACQ Q   QTKER RKQRPKDELVVSMGAKLPHEFDPKDR
Sbjct: 3    VSKYLKYFSIITLFLTGLILVACQQQKPQTKERQRKQRPKDELVVSMGAKLPHEFDPKDR   62

Query: 61   YGIHNEGNITHSTLLKRSPELDIKGELAKKYKISKDGLTWSFDLNDDFKFSNGEPVTADD  120
            YG+HNEGNITHSTLLKRSPELDIKGELAK Y +S+DGLTWSFDL+DDFKFSNGEPVTADD
Sbjct: 63   YGVHNEGNITHSTLLKRSPELDIKGELAKTYHLSEDGLTWSFDLHDDFKFSNGEPVTADD  122

Query: 121  VKFTYDMLKADGKAWDLTFIKNVEVVGKNQVNIHLTEAHSTFTAQLTEIPIVPKKHYNDK  180
            VKFTYDMLKADGKAWDLTFIKNVEVVGKNQVNIHLTEAHSTFTAQLTEIPIVPKKHYNDK
Sbjct: 123  VKFTYDMLKADGKAWDLTFIKNVEVVGKNQVNIHLTEAHSTFTAQLTEIPIVPKKHYNDK  182

Query: 181  YKSNPIGSGPYMVKEYKAGEQAIFVRNPYWHGKKPYFKKWTWVLLDENTALAALESGDVD  240
            YKSNPIGSGPYMVKEYKAGEQAIFVRNPYWHGKKPYFKKWTWVLLDENTALAALESGDVD
Sbjct: 183  YKSNPIGSGPYMVKEYKAGEQAIFVRNPYWHGKKPYFKKWTWVLLDENTALAALESGDVD  242

Query: 241  MIYATPELASKKVKGTRLLDIASNDVRGLSLPYVKKGVVKNSPDGYPVGNDVTSDPAIRK  300
            MIYATPELA KKVKGTRLLDI SNDVRGLSLPYVKKGV+ +SPDGYPVGNDVTSDPAIRK
Sbjct: 243  MIYATPELADKKVKGTRLLDIPSNDVRGLSLPYVKKGVITDSPDGYPVGNDVTSDPAIRK  302

Query: 301  ALTIGLNRQKVLDTVLNGYGKPAYSIIDRTPFWNPKTAIKDNKVAKAKQLLTKAGWKEQA  360
            ALTIGLNRQKVLDTVLNGYGKPAYSIID+TPFWNPKTAIKDNKVAKAKQLLTKAGWKEQA
Sbjct: 303  ALTIGLNRQKVLDTVLNGYGKPAYSIIDKTPFWNPKTAIKDNKVAKAKQLLTKAGWKEQA  362

Query: 361  DGSRKKGNLKSEFDLYYPTNDQLRANLAVEVAEQAKALGITIKLKASNWDEMATKSHDSA  420
            DGSRKKG+L + FDLYYPTNDQLRANLAVEVAEQAKALGITIKLKASNWDEMATKSHDSA
Sbjct: 363  DGSRKKGDLDAAFDLYYPTNDQLRANLAVEVAEQARALGITIKLKASNWDEMATKSHDSA  422

Query: 421  LLYAGGRHHAQQFYESHYPSLAGKGWTNITFYNNPTVTKYLDKAMTSPDLDKANKYWKLA  480
            LLYAGGRHHAQQFYESH+PSLAGKGWTNITFYNNPTVTKYLDKAMTS DLDKAN+YWKLA
Sbjct: 423  LLYAGGRHHAQQFYESHHPSLAGKGWTNITFYNNPTVTKYLDKAMTSSDLDKANEYWKLA  482

Query: 481  QWDGKTGASTLGDLPNVWLVSLNHTYIGDKRINVGKQGVHSHGHDWSLLTNIAEWTWDES  540
            QWDGKTGASTLGDLPNVWLVSLNHTYIGDKRINVGKQGVHSHGHDWSLLTNIAEWTWDES
Sbjct: 483  QWDGKTGASTLGDLPNVWLVSLNHTYIGDKRINVGKQGVHSHGHDWSLLTNIAEWTWDES  542

Query: 541  AK                                                           542
             K
Sbjct: 543  TK                                                           544
```

There is also homology to SEQ ID 60.

A related GBS gene <SEQ ID 8501> and protein <SEQ ID 8502> were also identified. Analysis of this protein sequence reveals the following:

---

Lipop: Possible site: 22   Crend: 5
McG: Discrim Score: 10.46
GvH: Signal Score (–7.5): –1.29
Possible site: 22
>>> May be a lipoprotein
ALOM program count: 0   value: 7.27   threshold: 0.0
PERIPHERAL         Likelihood = 7.27          386
modified ALOM score: –1.95
*** Reasoning Step: 3
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>

---

SEQ ID 8502 (GBS106) was expressed in *E. coli* as a His-fusion product. SDS-PAGE analysis of total cell extract is shown in FIG. 18 (lane 3; MW 61 kDa).

The GBS106-His fusion product was purified (FIG. 194, lane 2) and used to immunise mice. The resulting antiserum was used for Western blot (FIG. 255A), FACS (FIG. 255B), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 140

A DNA sequence (GBSx0146) was identified in *S. agalactiae* <SEQ ID 469> which encodes the amino acid sequence <SEQ ID 470>. Analysis of this protein sequence reveals the following:

---

Possible site: 41
>>> Seems to have no N-terminal signal sequence
----- Final Results -----
   bacterial cytoplasm --- Certainty = 0.4862 (Affirmative) <succ>
      bacterial membrane --- Certainty = 0.0000 (Not Clear) <succ>
         bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 141

A DNA sequence (GBSx0147) was identified in *S. agalactiae* <SEQ ID 471> which encodes the amino acid sequence <SEQ ID 472>. Analysis of this protein sequence reveals the following:

Possible site: 19
>>> Seems to have no N-terminal signal sequence
INTEGRAL    Likelihood = −7.27    Transmembrane 252-268 (249-275)
INTEGRAL    Likelihood = −5.73    Transmembrane 67-83 (62-90)
INTEGRAL    Likelihood = −5.26    Transmembrane 107-123 (104-134)
INTEGRAL    Likelihood = −3.77    Transmembrane 153-169 (152-170)
----- Final Results -----
    bacterial membrane --- Certainty = 0.3909 (Affirmative) <succ>
    bacterial outside --- Certainty = 0.0000 (Not Clear) <succ>
    bacterial cytoplasm --- Certainty = 0.0000 (Not Clear) <succ>

A related GBS nucleic acid sequence <SEQ ID 9295> which encodes amino acid sequence <SEQ ID 9296> was also identified.

The protein differs from U78968 at the N-terminus:

```
Query:  1  MASVNYDTSLTPVQYKAIAHHYGLDKPAPVQYFIWLKNFIQGHLGTSLVYRQPVIDIIRS  60
           MASVNYDTSLTP QYKAIAHHYGLDKPA VQYFIWLKN IQG LGTSLVYRQPV DIIRS
Sbjct: 39  MASVNYDTSLTPAQYKAIAHHYGLDKPALVQYFIWLKNVIQGDLGTSLVYRQPVSDIIRS  98
```

There is also homology to SEQ ID 64.

A related GBS gene <SEQ ID 8471> and protein <SEQ ID 8472> were also identified. Analysis of this protein sequence reveals the following:

Lipop: Possible site: −1    Crend: 10
McG: Discrim Score: 3.72
GvH: Signal Score (−7.5): −5.37
Possible site: 40
>>> Seems to have an uncleavable N-term signal seq
ALOM program count: 5    value: −7.27    threshold: 0.0
INTEGRAL      Likelihood = −7.27    Transmembrane 290-306 (287-313)
INTEGRAL      Likelihood = −5.89    Transmembrane 12-28 (11-33)
INTEGRAL      Likelihood = −5.73    Transmembrane 105-121 (100-128)
INTEGRAL      Likelihood = −5.26    Transmembrane 145-161 (142-172)
INTEGRAL      Likelihood = −3.77    Transmembrane 191-207 (190-208)
PERIPHERAL    Likelihood = 2.97     245
modified ALOM score: 1.95
*** Reasoning Step: 3
----- Final Results -----
    bacterial membrane --- Certainty = 0.3909 (Affirmative) <succ>
    bacterial outside --- Certainty = 0.0000 (Not Clear) <succ>
    bacterial cytoplasm --- Certainty = 0.0000 (Not Clear) <succ>

Figure 173:
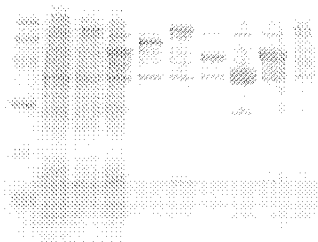

SEQ ID 8472 (GBS436) was expressed in *E. coli* as a GST-fusion product. SDS-PAGE analysis of total cell extract is shown in FIG. 173 (lane 9; MW 54 kDa).

Based on this analysis, it was predicted that these proteins and their epitopes could be useful antigens for vaccines or diagnostics.

Example 142

A DNA sequence (GBSx0148) was identified in *S. agalactiae* <SEQ ID 473> which encodes the amino acid sequence <SEQ ID 474>. This protein is predicted to be transmembrane transport protein DppC (oppC). Analysis of this protein sequence reveals the following:

Possible site: 39
>>> Seems to have a cleavable N-term signal seq.
INTEGRAL    Likelihood = −8.28    Transmembrane 77-93 (68-101)
INTEGRAL    Likelihood = −7.80    Transmembrane 182-198 (180-204)
INTEGRAL    Likelihood = −7.06    Transmembrane 112-128 (104-132)
INTEGRAL    Likelihood = −5.10    Transmembrane 239-255 (235-258)
----- Final Results -----
    bacterial membrane --- Certainty = 0.4312 (Affirmative) <succ>
    bacterial outside --- Certainty = 0.0000 (Not Clear) <succ>
    bacterial cytoplasm --- Certainty = 0.0000 (Not Clear) <succ>

There is homology to SEQ ID 68.

Based on this analysis, it was predicted that this protein and its epitopes, could be useful antigens for vaccines or diagnostics.

Example 143

A DNA sequence (GBSx0149) was identified in *S. agalactiae* <SEQ ID 475> which encodes the amino acid sequence <SEQ ID 476>. This protein is predicted to be ATPase protein DppD. Analysis of this protein sequence reveals the following:

Possible site: 59
>>> Seems to have no N-terminal signal sequence
----- Final Results -----
    bacterial cytoplasm --- Certainty = 0.1957 (Affirmative) <succ>
    bacterial membrane --- Certainty = 0.0000 (Not Clear) <succ>
    bacterial outside --- Certainty = 0.0000 (Not Clear) <succ>

The protein differs from U78968 at the C-terminus:

```
Query: 241    QTEFARSLWRSLPQQEFLKGVTHDLRG    267
              QTEFAR LWR+LPQQ+FLKGVTHDLRG
Sbjct: 241    QTEFARRLWRTLPQQDFLKGVTHDLRG    267
```

A related DNA sequence was identified in *S. pyogenes* <SEQ ID 477> which encodes the amino acid sequence <SEQ ID 478>. Analysis of this protein sequence reveals the following:

Possible site: 59
>>> Seems to have no N-terminal signal sequence
----- Final Results -----
    bacterial cytoplasm --- Certainty = 0.1957 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below:

```
Identities = 255/267 (95%), Positives = 262/267 (97%)
Query:   1  MTETLLSIKDLSITFTQYGRFLKPFQSTPIQALNLEIKKGELLAIIGASGSGKSLLAHAI  60
            MTETLLSIKDLSITFTQYGRFLKPFQSTPIQALNLE+KKGELLAIIGASGSGKSLLAHAI
Sbjct:   1  MTETLLSIKDLSITFTQYGRFLKPFQSTPIQALNLEVKKGELLAIIGASGSGKSLLAHAI  60

Query:  61  MDILPKNASVTGDMIYRGQSLNSKRIKQLRGKDITLIPQSVNYLDPSTKVKHQVRLGISE  120
            MDILPKNA+VTGDMIYRGQSL SKRIKQLRGK++TLIPQSVNYLDPS KVKHQVRLGISE
Sbjct:  61  MDILPKNAAVTGDMIYRGQSLTSKRIKQLRGKEMTLIPQSVNYLDPSMKVKHQVRLGISE  120

Query: 121  NSKATQEGLFQQFGLKESDGDLYPFQLSGGMLRRVLFTTCISDKVSLIIADEPTPGLHPD  180
            N+KATQEGLFQQFGLKESDGDLYPFQLSGGMLRRVLFTTCISD VSLIIADEPTPGLHPD
Sbjct: 121  NAKATQEGLFQQFGLKESDGDLYPFQLSGGMLRRVLFTTCISDTVSLIIADEPTPGLHPD  180

Query: 181  ALQMVLDQLRSFADKGISVIFITHDIVAASQIADRITIFKEGKAIETAPASFFSGNGEQL  240
            ALQMVLDQLRSFADKGISVIFITHDIVAASQIADRITIFKEGKAIETAPASFFSG GEQL
Sbjct: 181  ALQMVLDQLRSFADKGISVIFITHDIVAASQIADRITIFKEGKAIETAPASFFSGGGEQL  240

Query: 241  QTEFARSLWRSLPQQEFLKGVTHDLRG                                  267
            QTEFAR LWR+LPQQ+FLKGVTHDLRG
Sbjct: 241  QTEFARRLWRTLPQQDFLKGVTHDLRG                                  267
```

Based on this analysis, it was predicted that these proteins and their epitopes could be useful antigens for vaccines or diagnostics.

Example 144

A DNA sequence (GBSx0150) was identified in *S. agalactiae* <SEQ ID 479> which encodes the amino acid sequence <SEQ ID 480>. This protein is predicted to be ATPase protein DppE. Analysis of this protein sequence reveals the following:

Possible site: 41
>>> Seems to have no N-terminal signal sequence
----- Final Results -----
    bacterial cytoplasm --- Certainty = 0.3783 (Affirmative) <succ>
      bacterial membrane --- Certainty = 0.0000 (Not Clear) <succ>
        bacterial outside --- Certainty = 0.0000 (Not Clear) <succ>

A related DNA sequence was identified in *S. pyogenes* <SEQ ID 481> which encodes the amino acid sequence <SEQ ID 482>. Analysis of this protein sequence reveals the following:

Possible site: 41
>>> Seems to have no N-terminal signal sequence
----- Final Results -----
    bacterial cytoplasm --- Certainty = 0.3383 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below:

```
Identities = 188/205 (91%), Positives = 197/205 (950)
Query:   1  MTLEAKKLGFYHKKDQWLFKEINLEVAPGQVLGIFGQSGCGKTSLSRVLAGFLHPKSGEV  60
            MTLEAKKLGFYHKKDQWLFKEI+LEVAPGQ+LGIFGQSGCGKTSLSRVLAGFL PKSGEV
Sbjct:   1  MTLEAKKLGFYHKKDQWLFKEIDLEVAPGQILGIFGQSGCGKTSLSRVLAGFLQPKSGEV  60

Query:  61  LVDGSNLPSKAFRPVQLIQQHPEKTMNPLWPMKKSLEEAYYPSRDLLDAFGIQEKWLNRR  120
            LVDGS+LP+KAFRPVQLIQQHPE+TMNPLWPMKKSLEEAYYPS+DL DAFGIQEKWL RR
Sbjct:  61  LVDGSHLPNKAFRPVQLIQQHPEQTMNPLWPMKKSLEEAYYPSQDLRDAFGIQEKWLKRR  120

Query: 121  PSELSGGELQRFSIVRSLHPETKYLIADEMTTMLDSITQASVWKSLLEIVKDRNLGLIVI  180
            PSELSGGELQRFSIVRSLHPETKYLIADEMTTMLDSITQASVWKSLLEIVKDRNLGLI+I
Sbjct: 121  PSELSGGELQRFSIVRSLHPETKYLIADEMTTMLDSITQASVWKSLLEIVKDRNLGLIII  180

Query: 181  SHDFAMLEKLCNQCYMIEENRIVSF                                    205
            SH+F MLEKLC+ CYMIEENR   F
Sbjct: 181  SHEFDMLEKLCDACYMIEENRTQLF                                    205
```

Based on this analysis, it was predicted that these proteins and their epitopes could be useful antigens for vaccines or diagnostics.

Example 145

A DNA sequence (GBSx0151) was identified in *S. agalactiae* <SEQ ID 483> which encodes the amino acid sequence <SEQ ID 484>. This protein is predicted to be PTS system, trehalose-specific IIBC component (treB). Analysis of this protein sequence reveals the following:

Possible site: 59
>>> Seems to have no N-terminal signal sequence
INTEGRAL    Likelihood = −10.14   Transmembrane 468-484 (462-489)
INTEGRAL    Likelihood = −8.23    Transmembrane 279-295 (275-306)
INTEGRAL    Likelihood = −6.05    Transmembrane 112-128 (105-130)
INTEGRAL    Likelihood = −3.35    Transmembrane 204-220 (203-222)
INTEGRAL    Likelihood = −1.75    Transmembrane 255-271 (255-271)
INTEGRAL    Likelihood = −1.54    Transmembrane 327-343 (326-344)
INTEGRAL    Likelihood = −0.37    Transmembrane 422-438 (422-438)
INTEGRAL    Likelihood = −0.06    Transmembrane 304-320 (304-320)

----- Final Results -----
  bacterial membrane --- Certainty = 0.5055 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database:

```
>GP:AAF94072 GB:AE004175 PTS system, trehalose-specific IIBC component
[Vibrio cholerae]
Identities = 225/484 (46%), Positives = 318/484 (65%), Gaps = 28/484 (5%)
Query:   5  KHDAKALLEAIGGKENISAVTHCATRMRFVLNDSSKAKVKVIEELPSVKGTFTNAGQFQV    64
            K D    L+E +GG+ NI++VTHC TR+RFVLN   +A     +E L  VKG FTNAGQFQV
Sbjct:  10  KQDVTRLIELVGGESNIASVTHCLTRLRFVLNQPEQADKAGLEALSMVKGCFTNAGQFQV    69

Query:  65  IIGNDVPIFYNAFVAVSGIEGVSKEAAKSAAQKNQNPLQRVLTMLAEIFTPIIPAIIVGG   124
            +IG +V    Y   +  +G + VSK+ AK AA++N N L+R ++ LAEIF P++PAII GG
Sbjct:  70  VIGTEVDQVYKMLLEQTGKQAVSKDDAKVAARQNMNVLERGISHLAEIFVPLLPAIITGG   129

Query: 125  LILGFRNILDAVPFEFLGQKVVDGVRQVDSSGHPIWNTLVDVSTFWSGVDSFLWLPGEAI   184
            LILGFRN++  +        ++ DG              TL ++S FW+ V +FLWL GEAI
Sbjct: 130  LILGFRNVIGDI-------RMFDG------------KTLTEISQFWASVHAFLWLIGEAI   170

Query: 185  FHFLPVGIVWSVTRKMGTTQILGIVLGICLVSPQLLNAYSVASTSAADIAKNWSWNFGYF   244
            F FLPVG+ WS  +K+G T ILGI LG+ LVSPQL+NAY +                W+FG F
Sbjct: 171  FFFLPVGVCWSTVKKLGGTPILGITLGVTLVSPQLMNAYLIGKEVPE------VWDFGLF   224

Query: 245  TVQKIGYQAQVIPALLAGLSLSYLEIFWRKHIPEVVSMIFVPFLSLVPAIILAHTVLGPI   304
             ++K+GYQAQVIPA+LAG++L+++E   R+  +P  + ++ VPF+S++ +++LAH  +GP
Sbjct: 225  AIEKVGYQAQVIPAILAGVALAFIENNLRRVVPSYLYLVVVPFVSIIVSVVLAHAFIGPF   284

Query: 305  GWTLGKWISAIVLIGLTGPVKWLFGAIFGALYAPFVITGLHHMTNAIDTQLIADTKTHTT   364
            G  +G ++    +TG    +FG +YAP VITG+HH  TNA+D QL+ +           T
Sbjct: 285  GRVIGDGVAFAAKAAMTGDFAVIGSTLFGFMYAPLVITGIHHTTNAVDLQLMQE--LGGT   342

Query: 365  GLWPMIALSNIAQGSAVLAYYFMHRHDEKEAQISLPAAISAYLGVTEPALFGVNVKYIYP   424
             +WP+IALSNIAQ SAV+    + +    + E   IS+PAAISAYLGVTEPA++G+N+KY +P
Sbjct: 343  PIWPLIALSNIAQASAVVGIIIISK-KQGERDISVPAAISAYLGVTEPAMYGINLKYKFP   401

Query: 425  FVAGMIGSSVAGLLATTFNVQANSIGVGGLPGFLSINVKYMGYFFICMAVAIFIPLFLTL   484
            ++ MIGS++A  +  +  V AN IGVGGLPG LSI  ++    ++ M +AI +P  LTL
Sbjct: 402  MLSAMIGSALAAAVCGSAGVMANGIGVGGLPGILSIQPQFWSIYLVAMLIAILVPAALTL   461

Query: 485  FFKK                                                          488
            K
Sbjct: 462  LMYK                                                          465
```

A related DNA sequence was identified in *S. pyogenes* <SEQ ID 485> which encodes the amino acid sequence <SEQ ID 486>. Analysis of this protein sequence reveals the following:

Possible site: 59
>>> Seems to have no N-terminal signal sequence
INTEGRAL    Likelihood = -9.61    Transmembrane 466-482 (457-488)
INTEGRAL    Likelihood = -8.01    Transmembrane 279-295 (275-306)
INTEGRAL    Likelihood = -6.05    Transmembrane 112-128 (105-130)
INTEGRAL    Likelihood = -3.35    Transmembrane 204-220 (203-222)
INTEGRAL    Likelihood = -3.13    Transmembrane 255-271 (255-272)
INTEGRAL    Likelihood = -2.07    Transmembrane 327-343 (325-344)
INTEGRAL    Likelihood = -0.59    TransMembrane 422-438 (422-438)
----- Final Results -----
  bacterial membrane --- Certainty = 0.4843 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP:AAF94072 GB:AE004175 PTS system, trehalose-specific IIBC component
[Vibrio cholerae]
Identities = 231/484 (47%), Positives = 322/484 (65%), Gaps = 28/484 (5%)
Query:   5  EQDAKSLLTAIGGKENIKVVTHCATRMRFVLNDNNKANVKEIEKISVVKGTFTNAGQFQV    64
            +QD   L+  +GG+ NI  VTHC TR+RFVLN     +A+    +E +S+VKG FTNAGQFQV
Sbjct:  10  KQDVTRLIELVGGESNIASVTHCLTRLRFVLNQPEQADKAGLEALSMVKGCFTNAGQFQV    69

Query:  65  IIGNDVPVFYNDFTAVSSIEGVSKEAAKSAAKSNQNALQRVMTMLAEIFTPIIPAIIVGG   124
            +IG +V   Y     +  + + VSK+ AK AA+ N N L+R ++ LAEIF P++PAII GG
Sbjct:  70  VIGTEVDQVYKMLLEQTGKQAVSKDDAKVAARQNMNVLERGISHLAEIFVPLLPAIITGG   129

Query: 125  LILGFRNILESVPFEFLGQQVEKGKLVFDAAGDPVWNTIVRVSPFWSGVNHFLWLPGEAI   184
            LILGFRN++  +           +FD           T+  +S FW+ V+ FLWL GEAI
```

```
                        -continued
Sbjct: 130  LILGFRNVIGDI-------------RMFDG------KTLTEISQFWASVHAFLWLIGEAI  170

Query: 185  FHFLPVGITWSVTRKMGTTQILGIVLGICLVSPQLLNAYAVAGTPAAEIAKNWVWDFGFF  244
            F FLPVG+ WS +K+G T ILGI LG+ LVSPQL+NAY + G    E     VWDFG F
Sbjct: 171  FFFLPVGVCWSTVKKLGGTPILGITLGVILVSPQLMNAYLI-GKEVPE-----VWDFGLF  224

Query: 245  TINRIGYQAQVIPALLAGLSLAYLEIFWRKRIPEVVSMIFVPFLSLIPALILAHTVLGPI  304
            I ++GYQAQVIPA+LAG++LA++E   R+ +P + ++ VPF+S+I +++LAH +GP
Sbjct: 225  AIEKVGYQAQVIPAILAGVALAFIENNLRRVVPSYLYLVVVPFVSIIVSVVLAHAFIGPF  284

Query: 305  GWTIGKGISFVVLAGLTGPVKWLFGAIFGALYAPLVITGLHHMTNAIDTQLIADTATRTT  364
            G  IG G++F  A +TG     +FG +YAPLVITG+HH TNA+D QL+ +       T
Sbjct: 285  GRVIGDGVAFAAKAAMTGDFAVIGSTLFGFMYAPLVITGIHHTTNAVDLQLMQELG--GT  342

Query: 365  GLWPMIALSNIAQGSAVFAYYLMNRHEEREAEISLPAAISAYLGVTEPALFGVNVKYVYP  424
            +WP+IALSNIAQ SAV    ++++ ++ E +IS+PAAISAYLGVTEPA++G+N+KY +P
Sbjct: 343  PIWPLIALSNIAQASAVVGIIIISK-KQGERDISVPAAISAYLGVTEPAMYGINLKYKFP  401

Query: 425  FVAGMIGSGIAGLLSTTFNVQANSIGVGGLPGFMAINVKYMIPFFICMAVAIVVPMFLTF  484
            ++ MIGS +A + + V AN IGVGGLPG ++I ++   + + M +AI+VP  LT
Sbjct: 402  MLSAMIGSALAAAVCGSAGVMANGIGVGGLPGILSIQPQFWSIYLVAMLIAILVPAALTL  461

Query: 485  FFRK                                                         488
             K
Sbjct: 462  LMYK                                                         465
```

An alignment of the GAS and GBS proteins is shown below:

```
Identities = 501/675 (74%), Positives = 573/675 (84%), Gaps = 2/675 (0%)
Query: 1    MEQFKHDAKALLEAIGGKENISAVTHCATRMRFVLNDSSKAKVKVIEELPSVKGTFTNAG   60
            M +F+ DAK+LL AIGGKENI  VTHCATRMRFVLND++KA VK IE++  VKGTFTNAG
Sbjct: 1    MGKFEQDAKSLLTAIGGKENIKVVTHCATRMRFVLNDNNKANVKEIEKISVVKGTFTNAG   60

Query: 61   QFQVIIGNDVPIFYNAFVAVSGIEGVSKEAAKSAAQKNQNPLQRVLTMLAEIFTPIIPAI  120
            QFQVIIGNDVP+FYN F AVS IEGVSKEAAKSAA+ NQN LQRV+TMLAEIFTPIIPAI
Sbjct: 61   QFQVIIGNDVPVFYNDFTAVSSIEGVSKEAAKSAAKSNQNALQRVMTMLAEIFTPIIPAI  120

Query: 121  IVGGLILGFRNILDAVPFEFLGQKVVDGVRQVDSSGHPIWNTLVDVSTFWSGVDSFLWLP  180
            IVGGLILGFRNIL++VPFEFLGQ+V  G    D++G P+WNT+V VS FWSGV+ FLWLP
Sbjct: 121  IVGGLILGFRNILESVPFEFLGQQVEKGKLVFDAAGDPVWNTIVRVSPFWSGVNHFLWLP  180

Query: 181  GEAIFHFLPVGIVWSVTRKMGTTQILGIVLGICLVSPQLLNAYSVASTSAADIAKNWSWN  240
            GEAIFHFLPVGI WSVTRKMGTTQILGIVLGICLVSPQLLNAY+VA T AA+ IAKNW W+
Sbjct: 181  GEAIFHFLPVGITWSVTRKMGTTQILGIVLGICLVSPQLLNAYAVAGTPAAEIAKNWVWD  240

Query: 241  FGYFTVQKIGYQAQVIPALLAGLSLSYLEIFWRKHIPEVVSMIFVPFLSLVPAIILAHTV  300
            FG+FT+ +IGYQAQVIPALLAGLSL+YLEIFWRK IPEVVSMIFVPFLSL+PA+ILAHTV
Sbjct: 241  FGFFTINRIGYQAQVIPALLAGLSLAYLEIFWRKRIPEVVSMIFVPFLSLIPALILAHTV  300

Query: 301  LGPIGWTLGKWISAIVLIGLTGPVKWLFGAIFGALYAPFVITGLHHMTNAIDTQLIADTK  360
            LGPIGWT+GK IS +VL GLTGPVKWLFGAIFGALYAP VITGLHHMTNAIDTQLIADT
Sbjct: 301  LGPIGWTIGKGISFVVLAGLTGPVKWLFGAIFGALYAPLVITGLHHMTNAIDTQLIADTA  360

Query: 361  THTTGLWPMIALSNIAQGSAVLAYYFMHRHDEKEAQISLPAAISAYLGVTEPALFGVNVK  420
            T TTGLWPMIALSNIAQGSAV AYY M+RH+E+EA+ISLPAAISAYLGVTEPALFGVNVK
Sbjct: 361  TRTTGLWPMIALSNIAQGSAVFAYYLMNRHEEREAEISLPAAISAYLGVTEPALFGVNVK  420

Query: 421  YIYPFVAGMIGSSVAGLLATTFNVQANSIGVGGLPGFLSINVKYMGYFFICMAVAIFIPL  480
            Y+YPFVAGMIGS +AGLL+TTFNVQANSIGVGGLPGF++INVKYM  FFICMAVAI +P+
Sbjct: 421  YVYPFVAGMIGSGIAGLLSTTFNVQANSIGVGGLPGFMAINVKYMIPFFICMAVAIVVPM  480

Query: 481  FLTLFFKKSGILTKTEEEKLVPDAVIASTTETKSAKEKAVVSGTKLSVVSPLSGLAKPLD  540
            FLT FF+KS I+TKTE+E +P+ + S    +A K + GT +++SPL+G  K L
Sbjct: 481  FLTFFFRKSHIMTKTEDEAKLPETPV-SDAPVATAPHK-TMQGTVITLTSPLTGEVKALS  538

Query: 541  QASDPVFSQGIMGKGVVIDPSDGELVSPVDATVSVLFPTKHAIGLLTSEGVEFLIHIGMD  600
            +A DPVF+QG+MG+G ++ P++G LV+P DA VSVLFPTKHAI L+T+EG+E L+HIGMD
Sbjct: 539  EAVDPVFAQGVMGQGALLQPTEGVLVAPCDAEVSVLFPTKHAICLVTTEGLELLMHIGMD  598

Query: 601  TVNLEGKGFTSHVAQGDTVKVGDKLITFDIPMIKEEGYIVETPILITNQQEFRPEELIDL  660
            TVNL+G+GF + V QGD VK G  LI FDI  I E GY  ETP+++TNQ  F       L
Sbjct: 599  TVNLDGQGFEALVKQGDQVKAGQTLIQFDIAAISEAGYATETPLVVTNQDVFTVTEGSL  658

Query: 661  PKQIKRGQALMVAKK                                              675
            P+QIK    L VA K
Sbjct: 659  PRQIKVNDKLAVAVK                                              673
```

Based on this analysis, it was predicted that these proteins and their epitopes could be useful antigens for vaccines or diagnostics.

Example 146

A DNA sequence (GBSx0152) was identified in *S. agalactiae* <SEQ ID 487> which encodes the amino acid sequence <SEQ ID 488>. This protein is predicted to be dextran glucosidase DexS (treC). Analysis of this protein sequence reveals the following:

Possible site: 48
>>> Seems to have no N-terminal signal sequence
----- Final Results -----
bacterial cytoplasm --- Certainty = 0.3493 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database:

```
>GP:AAB65079 GB:U35633 dextran glucosidase DexS [Streptococcus suis]
Identities = 383/547 (70%), Positives = 439/547 (80%), Gaps = 13/547 (2%)
Query:   1  MTIDKRKVVYQIYPKSYKDTTGNGVGDLRGIIEKLPYLAELGIDMVWLNPFYPSPQRDNG    60
            MTIDKRKVVYQIYPKSYKDTTGNGVGDLRGIIEKLPYL ELGIDM+WLNPFYPSPQRDNG
Sbjct:   1  MTIDKRKVVYQIYPKSYKDTTGNGVGDLRGIIEKLPYLKELGIDMIWLNPFYPSPQRDNG    60

Query:  61  YDISDYTAINPDFGTMDDFEEMIEVGRQYRIDFMLDMVLNHCSIEHEWFKKALAGDRYYQ   120
            YDISDYTA+NPDFGTM DFEEM+ VG++  I+FMLDMVLNHCS +HEWF+KAL+GD+YYQ
Sbjct:  61  YDISDYTAVNPDFGTMADFEEMVTVGKELGIEFMLDMVLNHCSTDHEWFQKALSGDQYYQ   120

Query: 121  DFFILRDNPTDWVSKFGGNAWAPFGDIGKYYLHLFDITQADLNWRNADVRKELFKVVNFW   180
            DFFILRD PTDWVSKFGGNAWAPFGDIGKYYLHLFD+TQADLNWRN +R+ELFKVVNFW
Sbjct: 121  DFFILRDQPTDWVSKFGGNAWAPFGDIGKYYLHLFDVTQADLNWRNPHIREELFKVVNFW   180

Query: 181  RDKGVKGFRFDVINLIGKDEILENCPINDGKPAYTDRPITHDYLKMLNNASFGQDDSFMT   240
            +DKGVKGFRFDVINLIGKDE  E+CPINDGKPAYTDRPITHDYLKM+NNA+FG + FMT
Sbjct: 181  KDKGVKGFRFDVINLIGKDEAREDCPINDGKPAYTDRPITHDYLKMMNNATFGSEKGFMT   240

Query: 241  VGEMSSTTIANCILYTAPEREELSMAFNFHHLKVDYKDGQKWTIMAFDFPALRDLFHSWG   300
            VGEMS+TTI NCILYTAPER+ELSMAFNFHHLKVDYKDGQKWTIM FDF  L+ LFH+WG
Sbjct: 241  VGEMSATTIENCILYTAPERKELSMAFNFHHLKVDYKDGQKWTIMDFDFEELKHLFHTWG   300

Query: 301  EGMSEGNGWNALFYNNHDQPRALNRFVDVKRFRNEGATMLAASIHLSRGTPYIYMGEEIG   360
            E MS GNGWNALFYNNHDQPRALNRF+DV+ FR EGATMLAASIHLSRG
Sbjct: 301  EEMSVGNGWNALFYNNHDQPRALNRFIDVENFRKEGATMLAASIHLSRGNNLTST-----   355

Query: 361  MLDPDYSSMDDYVDIESLNAYQIMLDEGKSQEEAFSIIRAKSRDNSRVPMQWDDS-----   415
                 +  SS    +    +++    S  +   + R  SR +      P+
Sbjct: 356  WVRRSVSSTLTTIAWTTTWTWSLSMPTRCSWTKVTRLSR-PSRLSRPSPVTIPAPRCNGT   414

Query: 416  --TNAGFSEGAPWLKVGKSYKEINVAKEKTGLIFTFYQELIRLRKQLPIIADGNYKAAFK   473
                T   +  PWLK GKSY+ INV +EKTG IFTFY+     LRK+LP+I++G+YKAA+K
Sbjct: 415  LLTMQASQQATPWLKAGKSYQTINVEQEKTGPIFTFYKRTHPLRKELPLISEGDYKAAYK   474

Query: 474  DNEKVYAFERHLDKEKLLVLNNFFAEKVKIKLPENYLQGQVLLSNYKDVTLDETVTLQPY   533
            D++KVYAFER L+ EKLLVLNNFFAE+V++ L  ++Y GQVL+SNY D  L + + L+PY
Sbjct: 475  DSQKVYAFERLLNDEKLLVLNNFFAEEVELDLADDYAHGQVLISNYPDNKLGKKIILKPY   534

Query: 534  QTLAILV                                                       540
            Q LAI V
Sbjct: 535  QALAIQV                                                       541
```

A related DNA sequence was identified in *S. pyogenes* <SEQ ID 489> which encodes the amino acid sequence <SEQ ID 490>. Analysis of this protein sequence reveals the following:

Possible site: 56
>>> Seems to have no N-terminal signal sequence
----- Final Results -----
bacterial cytoplasm --- Certainty = 0.3631 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below:

```
Identities = 431/539 (79%), Positives = 486/539 (89%)
Query:    1 MTIDKRKVVYQIYPKSYKDTTGNGVGDLRGIIEKLPYLAELGIDMVWLNPFYPSPQRDNG   60
            MTIDK+KVVYQIYPKSYKDTTGNGVGDL GII+KLPYL ELGIDM+WLNPFYPSPQRDNG
```

```
Sbjct:    1 MTIDKKKVVYQIYPKSYKDTTGNGVGDLLGIIDKLPYLQELGIDMIWLNPFYPSPQRDNG       60

Query:   61 YDISDYTAINPDFGTMDDFEEMIEVGRQYRIDFMLDMVLNHCSIEHEWFKKALAGDRYYQ      120
            YD+SDYTA+NPDFGTM DFE +++  ++++I+ MLDMVLNHCS +HEWF+KALAGD YYQ
Sbjct:   61 YDVSDYTAVNPDFGTMADFENLVKAAKEHQIELMLDMVLNHCSTDHEWFQKALAGDPYYQ      120

Query:  121 DFFILRDNPTDWVSKFGGNAWAPFGDTGKYYLHLFDITQADLNWRNADVRKELFKVVNFW      180
            DFFILRD PTDWVSKFGGNAWAPFGDTGKYYLHLFD+TQADLNWRN  VR+EL KVVNFW
Sbjct:  121 DFFILRDQPTDWVSKFGGNAWAPFGDTGKYYLHLFDVTQADLNWRNPHVREELAKVVNFW      180

Query:  181 RDKGVKGFRFDVINLIGKDEILENCPINDGKPAYTDRPITHDYLKMLNNASFGQDDSFMT      240
            RDKGVKGFRFDVINLIGKDE L +CP+NDGKPAYTDRPITH YL  LN ASFGQDDSFMT
Sbjct:  181 RDKGVKGFRFDVINLIGKDEELVDCPVNDGKPAYTDRPITHTYLHDLNQASFGQDDSFMT      240

Query:  241 VGEMSSTTIANCILYTAPEREELSMAFNFHHLKVDYKDGQKWTIMAFDFPALRDLFHSWG      300
            VGEMS+TTI NC+LYTAPEREELSMAFNFHHLKVDY++GQKWTIMAFDF ALRDLFH+WG
Sbjct:  241 VGEMSATTIDNCLLYTAPEREELSMAFNFHHLKVDYENGQKWTIMAFDFAALRDLFHAWG      300

Query:  301 EGMSEGNGWNALFYNNHDQPRALNRFVDVKRFRNEGATMLAASIHLSRGTPYIYMGEEIG      360
            EGMS+GNGWNALFYNNHDQPRALNRFVDV  FRNEGATMLAASIHLSRGTPYIYMGEEIG
Sbjct:  301 EGMSQGNGWNALFYNNHDQPRALNRFVDVTHFRNEGATMLAASIHLSRGTPYIYMGEEIG      360

Query:  361 MLDPDYSSMDDYVDIESLNAYQIMLDEGKSQEEAFSIIRAKSRDNSRVPMQWDDSTNAGF      420
            MLDPD+SMDDYVD+ESLNAY +L   GKS EEAF+II+AKSRDN+R PMQWD S +AGF
Sbjct:  361 MLDPDFSMDDYVDVESLNAYSSLLVSGKSAEEAFAIIKAKSRDNARTPMQWDASEHAGF      420

Query:  421 SEGAPWLKVGKSYKEINVAKEKTGLIFTFYQELIRLRKQLPIIADGNYKAAFKDNEKVYA      480
            + G PWL+VGKSY++INV  EK G IF FYQ LI LRK+LPIIA+G+Y+AAFKD++ VYA
Sbjct:  421 TTGKPWLEVGKSYRDINVETEKEGRIFPFYQRLIALRKELPIIAEGDYRAAFKDSQAVYA      480

Query:  481 FERHLDKEKLLVLNNFFAEKVKIKLPENYLQGQVLLSNYKDVTLDETVTLQPYQTLAIL      539
            FERHL  + LLVLN+F+A++V+++LP  Y  GQVL+SNY+ V++ E V L+PYQTLAIL
Sbjct:  481 FERHLGDQCLLVLNHFYADEVELELPPRYQHGQVLISNYEKVSICEKVILKPYQTLAIL      539
```

Based on this analysis, it was predicted that these proteins and their epitopes could be useful antigens for vaccines or diagnostics.

Example 147

A DNA sequence (GBSx0153) was identified in *S. agalactiae* <SEQ ID 491> which encodes the amino acid sequence <SEQ ID 492>. Analysis of this protein sequence reveals the following:

---

Possible site: 29
>>> Seems to have an uncleavable N-term signal seq
INTEGRAL      Likelihood = –3.03      Transmembrane 8-24 (8-25)
----- Final Results -----
    bacterial membrane --- Certainty = 0.2211 (Affirmative) <succ>
    bacterial outside --- Certainty = 0.0000 (Not Clear) <succ>
        bacterial cytoplasm --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 148

A DNA sequence (GBSx0154) was identified in *S. agalactiae* <SEQ ID 493> which encodes the amino acid sequence <SEQ ID 494>. Analysis of this protein sequence reveals the following:

---

Possible site: 57
>>> Seems to have a cleavable N-term signal seq.
----- Final Results -----
    bacterial outside --- Certainty = 0.3000 (Affirmative) <succ>
        bacterial membrane --- Certainty = 0.0000 (Not Clear) <succ>
        bacterial cytoplasm --- Certainty = 0.0000 (Not Clear) <succ>

---

The protein has homology with the following sequences in the GENPEPT database:

```
>GP: BAB03939 GB: AP001507 unknown conserved protein [Bacillus halodurans]
Identities = 190/639 (29%), Positives = 331/639 (51%), Gaps = 34/639 (5%)
Query:   6 TVVIMLVFLARKNLSLYELTVQTKFSIKVIIEQINYLNSFLAKNHLPAIAHSAGRYQLLG    65
           T ++  + AR L + ELT +   S + +    + +NS+L + L A+ +       L+
Sbjct:   8 TFILTQLLHARSYLPIQELTQKLNVSRRTVYNDLEKINSWLEEQGLKAV-YKVRSQGLIL   66

Query:  66 DEKEHDKI---VSLLEAEQFYLTQEERVCLIYLYSFCRREFVSNVHYQDFLKVSKNTTLS  122
           DE+  ++I   + L++ + + +ER   ++Y   R E+   H  D    VS+NTT+
Sbjct:  67 DERAKEEIPTKLRSLKSWHYEYSAQERKAWVVIYLLTRLEPLFLEHLMDRTGVSRNTTID  126

Query: 123 DIKMLRSKLAKRGISLTYTRAKGYSLVGDEMDKHQVAFQMITQLLE--------SPIGFW  174
           DIK L+ +L    ++L + R  GY++ GDE DK +    ++Q L          SPI +
Sbjct: 127 DIKCLKDELNNFHLALEFERKDGYTISGDETDKRKALVYYLSQALPQQNWETELSPIRIF  186

Query: 175 SLNYILSSWKFALSYEKLEKTVEYFYESFQLSPIQ---DRLEKSLYFIILILCRYQRSVD  231
           + +   F + E+L+K +   ES ++ IQ   D L         +L + R  +
Sbjct: 187 LRTKRDNGRIFTI--EELQKVYDVISESEKVLKIQYTDDVLHSLSLRFLLFMKRVAKG--  242

Query: 232 RVLQGSPIVSEQLK-----ELTTIIVTNLSQDISLSKPLDQKEKDYITLILSGCF-----  281
           +  ++ P+  + LK     E  ++  L Q   + P D++     T   ILS
Sbjct: 243 KFIKVHPLEKQVLKGTKEYEAAKVMSFKLEQAFGVHYP-DEEVLYLTTHILSSKINYANG  301

Query: 282 EGEGTKDDDFFEALAKAIVDEMETVSLLNFSNKEELLQGLKRHIIPAYFRLKYGLTGDSG  341
           E  E   K+       + ++V++ +   + +  F    KE L + L   HI  PA++R+KYGL  ++
Sbjct: 302 EIESRKESQELTHIVTSMVNDFQKYACVVFEEKELLEKNLFFHIKPAFYRIKYGLEVENN  361

Query: 342 YTQNIKEHYSDLFLLVKKALRPLEEQVGL-IPDSEISYFVIHFGGYLRQSGGTQSMSYKA  400
            ++IK  Y  +LFLL +K +  LE   VG  + D+E+++ +HF G++R+  G    +   KA
Sbjct: 362 IAESIKTSYPELFLLTRKVVHYLERYVGKSVNDNEVAFITMHFVGWMRREGTIPTKRKKA  421

Query: 401 LILCPNGVSSSLVIKEKLRGLFPQIHFHRVSKIEQLKLIDNQTYDMVFSTIFVETKKPNY  460
           LI+C NGV +S  +K +L GLFP +  +    I + +      ++ +T   E    P +
Sbjct: 422 LIVCANGVGTSQFLKNQLEGLFPAVDIIKTCSIREYEKTPVEVDFIISTTSIPEKNVPIF  481

Query: 461 LVSLMMT-AEQVQQLKELVISDFPKACLDDFQLDQLIATIKKYAHVHCEEELKLALRTMV  519
           +V+ ++T  E+ + LK + ++          +   ++  L+   IK++ +V  E+ L      LR
Sbjct: 482 IVNPILTETEKERLLKSVHVALDELGAMKGYSIEGLMDVIKRHGNVDDEKALYQDLRRFF  541

Query: 520 KQD--ILRKDVRPLLHQLITEETYQTSSEQMNWKEAIRLAAKPLLASGKITESYPEAMIE  577
            Q     I  K +P  L+QL+TE+   Q   +  +W+EAI+LAAKPLL  G +TESY + MI+
Sbjct: 542 TQPTPIGPKQEKPDLNQLLTEDMIQLREQVTHWQEAIQLAAKPLLLKGMVTESYVKKMIK  601

Query: 578 KVEEFGPFINLGKGIAIPHARPEDGVNSVGMSMLVLEQP                       616
           +E+FGP++ +      AIPHA+PEDGV  +GMS+L L++P
Sbjct: 602 NIEKFGPYMIIAPHFAIPHAKPEDGVRQLGMSLLWLKKP                       640
```

A related DNA sequence was identified in *S. pyogenes* <SEQ ID 495> which encodes the amino acid sequence <SEQ ID 496>. Analysis of this protein sequence reveals the following:

Possible site: 57 or 61
>>> Seems to have no N-terminal signal sequence

-continued

INTEGRAL   Likelihood = –0.64   Transmembrane 123-139 (123-139)
----- Final Results -----
  bacterial membrane --- Certainty = 0.1256 (Affirmative) <succ>
  bacterial outside --- Certainty = 0.0000 (Not Clear) <succ>
  bacterial cytoplasm --- Certainty = 0.0000 (Not Clear) <succ>

An alignment of the GAS and GBS proteins is shown below:

```
Identities = 187/624 (29%), Positives = 327/624 (51%), Gaps = 20/624 (3%)
Query:    1 MVDNKTVVIMLVFLARKNLSLYELTVQTKFSIKVIIEQINYLNSFLAKNHLPAIAHSAGR   60
            M+ ++ +    +F  K  SL       K S + I+  I  +N  L+    LP IA
Sbjct:   35 MLSHELIRNYQLFSKYKGHSLEAFESILKASKRHILADIAKINDTLSLYQLPLIALDR--   92

Query:   61 YQLL--GDEKEHDKIVSLLEAEQFYLTQEERVCLIYLYSFCRREFVSNVHYQDFLKVSKN  118
              QL+   D  ED + +L      YL Q+ER+ +I +Y     +EF+S  H +  L++S+N
```

-continued

```
Sbjct:  93 -QLVYPPDLTEKDLLNRMLPTLDDYLFQDERLDMIIYIMMAKEFISINHLESLLRLSRN      151

Query: 119 TTLSDIKMLRSKLAKRGISLTYTRAKGYSLVGDEMDKHQVAFQMITQLLESPIGFWSLNY      178
           + ++D+ ++R ++     ++L Y R  GY   G+ +    ++     ++ LL+    G W   +Y Sbjct: 152 SVIADLNLVRDRVQAFQVTLAYNRQDGYFFEGEPLALRRLLESAVSSLLQVTSGPWVFSY      211

Query: 179 ILSSWKFALSYEKLEKTVEYFYESFQLSPIQDRLEKSLYFIILILCR-YQRSVD-RVLQG      236
           +L           + +   T+E        L+ I ++L   +YF  L+  R + R+V  +

Sbjct: 212 LLHELGLPDQKKVMAATLEELSRENHLTFISEKLRDLIYFFCLLAHRPFSRNVRAEAVDT      271

Query: 237 SPIVSEQLKELTTIIVTNLSQDISLSKPLDQKEKDYITLILSGCFEG--EGTKDDDFFEA      294
              P+ S   ++ +      ++ N           P    +EK +    L GC +G  E           ++

Sbjct: 272 FPLASPAVETMVDQLLVNF--------PSLTEEKYLVQSRLLGCIQGDLELVFQQPIYDI      323

Query: 295 LAKAIVDEMETVSLLNFSNKEELLQGLKRHIIPAYFRLKYGLTGDSGYTQNIKEHYSDLF      354
           + + I++ +   + L+ ++    EL Q L   H++PAY+RL Y  +     + IK+ Y   LF Sbjct: 324 MEE-IINSVAVNTGLSITDTPELRQNLYSHLLPAYYRLYYDINLTNPLKEQIKQDYESLF      382

Query: 355 LLVKKALRPLEEQVGL-IPDSEISYFVIHFGGYLRQSGGTQSMSYKALILCPNGVSSSLV      413
           L VK++L  PLE+Q+G  + + E++YF IHFG +L+       S     AL +CPNG+SSSL+

Sbjct: 383 YLVKRSLSPLEKQLGKSVNEDEVAYFTIHFGRWLQAPKKRPSNQLVALSVCPNGISSSLM      442

Query: 414 IKEKLRGLFPQIHFHRVSKIEQLKLIDNQTYDMVFSTIFVETKKPNYLVSLMMTAEQVQQ      473
           ++   L+ LFPQ+ F R+ +++++KL+D  ++D++FST+  + KP   Y+      +M      +

Sbjct: 443 LEATLKELFPQLQFIRIHQLDKIKLLDPASFDLIFSTVAFDCAKPVYVTQALMGPVEKMM      502

Query: 474 LKELVISDFPKACLDDFQLDQLIATIKKYAHVHCEEELKLAL-RTMVKQDILRKDVRPLL      532
           LK++V  DF    + F LD L++ I K+    + +E L    L R ++   +      L Sbjct: 503 LKKMVCDDFHLPLSEQFALDDLLSIIHKHTTITNKEGLVSDLSRYLIGNHLTIEKGGLGL      562

Query: 533 HQLITEETYQTSSEQMNWKEAIRLAAKPLLASGKITESYPEAMIEKVEEFGPFINLGKGI      592
           L+T +  + +       +W+ EAIRLAA+PLL      I   SY +  MI+ V  E G +I L      +

Sbjct: 563 LDLLTADFIRQADAVSDWQEAIRLAAQPLLEHQMIETSYIDGMIDSVNELGAYIVLAPKV      622

Query: 593 AIPHARPEDGVNSVGMSMLVLEQP                                         616
           A+PHA  PE G    +GMS+L L++P Sbjct: 623 AVPHAAPEKGTRQLGMSLLQLKEP                                         646
```

Based on this analysis, it was predicted that these proteins and their epitopes could be useful antigens for vaccines or diagnostics.

Example 149

A DNA sequence (GBSx0155) was identified in *S. agalactiae* <SEQ ID 497> which encodes the amino acid sequence <SEQ ID 498>. Analysis of this protein sequence reveals the following:

---

Possible site: 22
>>> Seems to have no N-terminal signal sequence
----- Final Results -----
  bacterial cytoplasm --- Certainty = 0.3665 (Affirmative) <succ>
    bacterial membrane --- Certainty = 0.0000 (Not Clear) <succ>
    bacterial outside --- Certainty = 0.0000 (Not Clear) <succ>

---

The protein has no significant homology with any sequences in the GENPEPT database.

A related DNA sequence was identified in *S. pyogenes* <SEQ ID 499> which encodes the amino acid sequence <SEQ ID 500>. Analysis of this protein sequence reveals the following:

---

Possible site: 22
>>> Seems to have no N-terminal signal sequence
----- Final Results -----
  bacterial cytoplasm --- Certainty = 0.3665 (Affirmative) <succ>
    bacterial membrane --- Certainty = 0.0000 (Not Clear) <succ>
    bacterial outside --- Certainty = 0.0000 (Not Clear) <succ>

---

An alignment of the GAS and GBS proteins is shown below:

```
Identities = 33/35 (94%), Positives = 35/35 (99%)
Query:  1  MEKEAKQIIDLKRNLFKIDVRAQKDEEKVFMRTAW  35
           +EKEAKQ+IDLKRNLFKIDVRAQKDEEKVFMRTAW
Sbjct:  1  LEKEAKQMIDLKRNLFKIDVRAQKDEEKVFMRTAW  35
```

Based on this analysis, it was predicted that these proteins and their epitopes could be useful antigens for vaccines or diagnostics.

Example 150

A repeated DNA sequence (GBSx0156) was identified in *S. agalactiae* <SEQ ID 501> which encodes the amino acid sequence <SEQ ID 502>. This protein is predicted to be a repeat-associated protein in rhsc-phrb intergenic region. Analysis of this protein sequence reveals the following:

```
Possible site: 44
>>> Seems to have no N-terminal signal sequence
INTEGRAL    Likelihood = -4.57    Transmembrane 29-45 (28-48)
----- Final Results -----
  bacterial membrane --- Certainty = 0.2826 (Affirmative) <succ>
    bacterial outside --- Certainty = 0.0000 (Not Clear) <succ>
      bacterial cytoplasm --- Certainty = 0.0000 (Not Clear) <succ>
```

A closely-related DNA sequence was identified in *S. agalactiae* <SEQ ID 1035> which encodes the amino acid sequence <SEQ ID 1036>. Further related GBS sequences are: <SEQ ID 9067>, <SEQ ID 9068>, <SEQ ID 9497>, <SEQ ID 9498>, <SEQ ID 9733>, <SEQ ID 9734>

A related repeated DNA sequence was identified in *S. pyogenes* <SEQ ID 503> which encodes the amino acid sequence <SEQ ID 504>. Analysis of this protein sequence reveals the following:

```
Lipop Possible site: -1    Crend: 5
McG: Discrim Score: -7.73
GvH: Signal Score (-7.5): -3.88
Possible site: 44
>>> Seems to have no N-terminal signal sequence
ALOM program count: 1    value: -4.57    threshold: 0.0
INTEGRAL      Likelihood = -4.57    Transmembrane 26-42 (25-45)
PERIPHERAL    Likelihood = 2.12     334
modified ALOM score: 1.41
*** Reasoning Step: 3
----- Final Results -----
  bacterial membrane --- Certainty = 0.2826 (Affirmative) <succ>
    bacterial outside --- Certainty = 0.0000 (Not Clear) <succ>
      bacterial cytoplasm --- Certainty = 0.0000 (Not Clear) <succ>
```

A related DNA sequence was identified in *S. pyogenes* <SEQ ID 7071> which encodes the amino acid sequence <SEQ ID 7072>. An alignment of the GAS and GBS sequences follows:

```
Score = 767 bits (1960), Expect = 0.0
Identities = 375/377 (99%), Positives = 375/377 (99%)
Query:    4 MIDFIISIDDCAVELDSRQSWKIRSPLSTILFLVFVCQLAGIETWKEMEDFIEMNEPLFA       63
            MIDFIISIDDCAVELDSRQSWKIR PLSTILFLVFVCQLAGIETWKEMEDFIEMNEPLFA Sbjct:    1 MIDFIISIDDCAVELDSRQSWKIRYPLSTILFLVFVCQLAGIETWKEMEDFIEMNEPLFA       60

Query:   64 TYVDLSEGCSSHDTLERVISLVNSDRLKELKVQFEQSLTSLDAVHQLISVDGKTIRGNRG      123
            TYVDLSEGC SHDTLERVISLVNSDRLKELKVQFEQSLTSLDAVHQLISVDGKTIRGNRG Sbjct:   61 TYVDLSEGCPSHDTLERVISLVNSDRLKELKVQFEQSLTSLDAVHQLISVDGKTIRGNRG      120

Query:  124 KNQKPVHIVTAYDGGHHLSLGQVAVEEKSNEIVAIPQLLRTIDIRKSIVTIDAMGTQTAI      183
            KNQKPVHIVTAYDGGHHLSLGQVAVEEKSNEIVAIPQLLRTIDIRKSIVTIDAMGTQTAI Sbjct:  121 KNQKPVHIVTAYDGGHHLSLGQVAVEEKSNEIVAIPQLLRTIDIRKSIVTIDAMGTQTAI      180

Query:  184 VDTIIKGKADYCLAVKGNQETLYDDIALYFSDVNLLEELQENAQYYQTVEKSRGQIEVRE      243
            VDTIIKGKADYCLAVKGNQETLYDDIALYFSDVNLLEELQENAQYYQTVEKSRGQIEVRE Sbjct:  181 VDTIIKGKADYCLAVKGNQETLYDDIALYFSDVNLLEELQENAQYYQTVEKSRGQIEVRE      240

Query:  244 YWVSSDIKWLCQNHPKWHKLRGIGMTRNTIDKDGQLSQENRYFIFSFKPDVLTFANCVRG      303
            YWVSSDIKWLCQNHPKWHKLRGIGMTRNTIDKDGQLSQENRYFIFSFKPDVLTFANCVRG Sbjct:  241 YWVSSDIKWLCQNHPKWHKLRGIGMTRNTIDKDGQLSQENRYFIFSFKPDVLTFANCVRG      300

Query:  304 HWQIESMHWLLDVVYHEDHHQTLDKRAAFNLNLIRKMCLYFLKVMVFPKKDLSYRRKQRY      363
            HWQIESMHWLLDVVYHEDHHQTLDKRAAFNLNLIRKMCLYFLKVMVFPKKDLSYRRKQRY Sbjct:  301 HWQIESMHWLLDVVYHEDHHQTLDKRAAFNLNLIRKMCLYFLKVMVFPKKDLSYRRKQRY      360

Query:  364 ISVHLEDYLVQLFGERG                                               380
            ISVHLEDYLVQLFGERG Sbjct:  361 ISVHLEDYLVQLFGERG                                               377
```

A further related DNA sequence was identified in *S. pyogenes* <SEQ ID 9087> which encodes the amino acid sequence <SEQ ID 9088>. A further related DNA sequence was identified in *S. pyogenes* <SEQ ID 9089> which encodes the amino acid sequence <SEQ ID 9090>. The GAS and GBS proteins are 100% identical.

There is also homology to SEQ IDs 7018 and 8548.

SEQ ID 8548 (GBS318) was expressed in *E. coli* as a GST-fusion product. SDS-PAGE analysis of total cell extract is shown in FIG. 46 (lane 5; MW 70 kDa).

Figure 203:
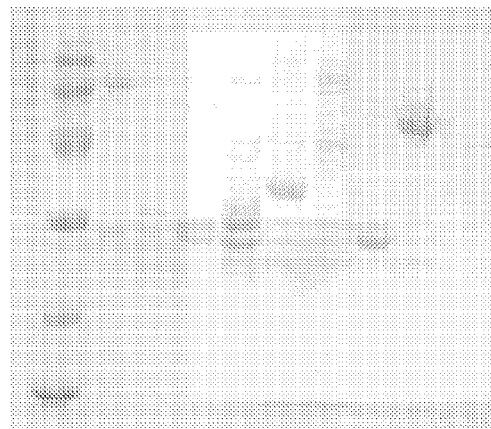

GBS318-GST was purified as shown in FIG. 203, lane 3.

```
Possible site: 44
>>> Seems to have no N-terminal signal sequence
INTEGRAL    Likelihood = -4.57    Transmembrane 29-45 (28-48)
----- Final Results -----
  bacterial membrane --- Certainty = 0.2826 (Affirmative) <succ>
    bacterial outside --- Certainty = 0.0000 (Not Clear) <succ>
      bacterial cytoplasm --- Certainty = 0.0000 (Not Clear) <succ>
```

A related GBS gene <SEQ ID 8547> and protein <SEQ ID 8548> were also identified. Analysis of this protein sequence reveals the following:

Example 151

A DNA sequence (GBSx0157) was identified in *S. agalactiae* <SEQ ID 505> which encodes the amino acid sequence <SEQ ID 506>. Analysis of this protein sequence reveals the following:

Possible site: 34
>>> Seems to have an uncleavable N-term signal seq
----- Final Results -----
   bacterial membrane --- Certainty = 0.0000 (Not Clear) <succ>
   bacterial outside --- Certainty = 0.0000 (Not Clear) <succ>
   bacterial cytoplasm --- Certainty = 0.0000 (Not Clear) <succ>

A related DNA sequence was identified in *S. pyogenes* <SEQ ID 509> which encodes the amino acid sequence <SEQ ID 510>. Analysis of this protein sequence reveals the following:

Possible site: 49
>>> Seems to have an uncleavable N-term signal seq
----- Final Results -----
   bacterial membrane --- Certainty = 0.0000 (Not Clear) <succ>
   bacterial outside --- Certainty = 0.0000 (Not Clear) <succ>
   bacterial cytoplasm --- Certainty = 0.0000 (Not Clear) <succ>

An alignment of the GAS and GBS proteins is shown below:

```
Identities = 27/90 (20%), Positives = 51/90 (56%), Gaps = 1/90 (1%)
Query:   1 MLRIGTACGSGLGSSFMVQMNIESILKDLGVSDVEVEHYDLGGADPSAADVWIVGRDLED      60
             M++I  T CG+G+GSS +++M +E+I    LG+ DV+ E  D     AD+++  ++ +D
Sbjct:   8 MIKIVTVCGNGIGSSLLLRMKVEAIASSLGI-DVDAESCDSNAAVGKGADLFVTVKEFKD     66

Query:  61 SAGHLGDVRILNSIIDMDELRELVTGICQE                                    90
               V I+ S  +  ++ E +  + +E
Sbjct:  67 IFPEDAKVCIVKSYTNRKKIEEDLVPVLKE                                    96
```

The protein has no significant homology with any sequences in the GENPEPT database, but there is homology to SEQ ID 496.

Based on this analysis, it was predicted that this protein and its epitopes, could be useful antigens for vaccines or diagnostics.

Example 152

A repeated DNA sequence (GBSx0158) was identified in *S. agalactiae* <SEQ ID 507> which encodes the amino acid sequence <SEQ ID 508>. Analysis of this protein sequence reveals the following:

Possible site: 48
>>> Seems to have no N-terminal signal sequence
----- Final Results -----
   bacterial cytoplasm --- Certainty = 0.1054 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database:

Based on this analysis, it was predicted that these proteins and their epitopes could be useful antigens for vaccines or diagnostics.

Example 153

A DNA sequence (GBSx0159) was identified in *S. agalactiae* <SEQ ID 511> which encodes the amino acid sequence <SEQ ID 512>. Analysis of this protein sequence reveals the following:

Possible site: 20
>>> Seems to have an uncleavable N-term signal seq
----- Final Results -----
   bacterial membrane --- Certainty = 0.0000 (Not Clear) <succ>
   bacterial outside --- Certainty = 0.0000 (Not Clear) <succ>
   bacterial cytoplasm --- Certainty = 0.0000 (Not Clear) <succ>

The protein has no significant homology with any sequences in the GENPEPT database.

No corresponding DNA sequence was identified in *S. pyogenes*.

```
>GP: BAB03941 GB: AP001507 unknown conserved protein [Bacillus halodurans]
Identities = 26/82 (31%), Positives = 52/82 (62%), Gaps = 2/82 (2%)
Query:   2 LRIGTACGSGLGSSFMVQMNIESILKDLGVSDVEVEHYDLGGADPSAADVWIVGRDLEDS     61
             ++I    CG G G+S +++MN+E++L   LG++   +V++ D+ A    +D  I  ++L +S
Sbjct:   1 MKILCVCGLGQGTSLILKMNVETVLSQLGIA-ADVDNTDVSSASSEQSDFIITSKELAES     59

Query:  62 -AGHLGDVRILNSIIDMDELRE                                            82
             A H     + I+N+  DM+E+++
Sbjct:  60 LASHPSKIVIVNNYFDMEEIKQ                                            81
```

Example 154

A DNA sequence (GBSx0160) was identified in *S. agalactiae* <SEQ ID 513> which encodes the amino acid sequence <SEQ ID 514>. This protein is predicted to be sgaT. Analysis of this protein sequence reveals the following:

```
Possible site: 16
>>> Seems to have a cleavable N-term signal seq.
INTEGRAL    Likelihood = -14.97   Transmembrane 424-440 (411-447)
INTEGRAL    Likelihood = -8.86    Transmembrane 224-240 (221-248)
INTEGRAL    Likelihood = -7.27    Transmembrane 134-150 (124-167)
INTEGRAL    Likelihood = -7.11    Transmembrane 321-337 (314-349)
INTEGRAL    Likelihood = -6.64    Transmembrane 379-395 (370-397)
INTEGRAL    Likelihood = -6.21    Transmembrane 96-112 (94-115)
INTEGRAL    Likelihood = -6.05    Transmembrane 267-283 (257-289)
INTEGRAL    Likelihood = -3.13    Transmembrane 18-34 (17-35)
INTEGRAL    Likelihood = -2.55    Transmembrane 151-167 (151-167)
INTEGRAL    Likelihood = -0.32    Transmembrane 42-58 (42-58)
----- Final Results -----
    bacterial membrane --- Certainty = 0.6986 (Affirmative) <succ>
    bacterial outside --- Certainty = 0.0000 (Not Clear) <succ>
        bacterial cytoplasm --- Certainty = 0.0000 (Not Clear) <succ>
```

The protein has homology with the following sequences in the GENPEPT database:

```
>GP: CAB52363 GB: AL109747 putative integral membrane protein
[Streptomyces coelicolor A3(2)]
Identities = 202/453 (44%), Positives = 292/453 (63%), Gaps = 22/453 (4%)
Query:   7 FLVN-IASTPAILVALIAIIGLVLQKKGVPDIVKGGIKTFVGFLVVSGGTGIVQNSLNPF      65
           FLVN I  S PA L+ +I  +GL    KK V    V G IK +G  L+V  G G+V +SL+P
Sbjct:  10 FLVNEILSQPAYLIGIITAVGLAALKKSVGQTVGGAIKATLGLLLVGAGAGLVSSSLDPL      69

Query:  66 GKMFEHAFHLVGVVPNNEAIVAVALTKYGSATALIMLAGMIFNILIARFTKFKYIFLTGH     125
           G+M +       GV+P NEAIV +A   +G+   A +M+ G + ++ +ARFT   +Y+FLTGH
Sbjct:  70 GRMIQGTTGTHGVIPTNEAIVGIAQSEFGARVAWLMILGFLVSLALARFTPLRYVFLTGH     129

Query: 126 HTLYMACMIAVIFAVAGFTSFSLILFGGLALGIIMSVSPAFVQKYMIQLTGNDKVALGHF     185
           H L+MA ++ ++ A AG  S   +++L GG+ +GI++   PAF    +   ++TGND  +A+GHF
Sbjct: 130 HMLFMATLLTIVMATAGQGSVAVVLGGGVLVGILLVALPAFAHPWTKKVTGNDTLAIGHF     189

Query: 186 GSLGYWLSGFIGGIVGDKSKSTEDIKFPKSLSFLRDSTVSITISMAIIYLIVAV------     239
           G+ GY +SG  G +VG  S+STE++K P+ L  FLRDS V+   +SM +IYL++++
Sbjct: 190 GTAGYIVSGATGQLVGKNSRSTEEMKLPEGLRFLRDSMVATALSMVLIYLVMSLLFLAKV     249

Query: 240 --------FAGEAYIAKEISNGVNGLVYALQLAGQFAAGVFVILAGVRLILGEIVPAFKG     291
                   FAG        ++  N  L+ ++       QF  GV VIL GVR  ILGE+VPAF+G
Sbjct: 250 GQDAAFKAFAGSG--GDPAADVGNYLMQSVMQGLQFGIGVAVILFGVRTILGELVPAFQG     307

Query: 292 ISEKLVPNSKPALDCPIVYPYAPNAVLIGFISSFVGGLVSMIVMI-----VTGTTVILPG     346
           I+ ++ +VP +KPALD PIV+PYA NAVLIGFI SF+GGL      +I         G  ++LPG
Sbjct: 308 IAGRVVPGAKPALDAPIVFPYAQNAVLIGFIFSFLGGLTGLAALIWVFNPAFGLALVLPG     367

Query: 347 VVPHFFCGATAGVIGNASGGVRGATIGAFVQGILISFLPIFLMPVLGGLGFKGSTFSDAD     406
           +VPHFF G   AGV GNA+GG RGA +G+F+  G+LI+FLP L+       LG  G   +TF DAD
Sbjct: 368 LVPHFFTGGAAGVYGNATGGRRGAAVGSFLNGLLITFLPAILLKALGSFGEANTTFGDAD     427

Query: 407 FGLTGIILGALNHVGGAIAIVIGIVVILIGLFG                             439
           FG   G  +LG++    + G    ++   ++  L+ L G
Sbjct: 428 FGWFGAVLGSIGKLDGTAGLIGMLIFGLLILAG                             460
```

A related DNA sequence was identified in *S. pyogenes* <SEQ ID 515> which encodes the amino acid sequence <SEQ ID 516>. Analysis of this protein sequence reveals the following:

```
Possible site: 34
>>> Seems to have a cleavable N-term signal seq.
INTEGRAL    Likelihood = -8.33   Transmembrane 330-346 (315-353)
INTEGRAL    Likelihood = -8.17   Transmembrane 227-243 (221-246)
INTEGRAL    Likelihood = -4.62   Transmembrane 127-143 (126-145)
INTEGRAL    Likelihood = -4.25   Transmembrane 269-285 (266-291)
INTEGRAL    Likelihood = -3.77   Transmembrane 43-59 (41-62)
INTEGRAL    Likelihood = -3.66   Transmembrane 98-114 (91-116)
INTEGRAL    Likelihood = -2.76   Transmembrane 146-162 (145-163)
INTEGRAL    Likelihood = -1.59   Transmembrane 308-324 (308-324)
----- Final Results -----
    bacterial membrane --- Certainty = 0.4333 (Affirmative) <succ>
    bacterial outside --- Certainty = 0.0000 (Not Clear) <succ>
        bacterial cytoplasm --- Certainty = 0.0000 (Not Clear) <succ>
```

The protein has homology with the following sequences in the databases:

\>GP: CAB52363 GB: AL109747 putative integral membrane protein
[*Streptomyces* coelicolor A3(2)]
Identities = 162/387 (41%), Positives = 245/387 (62%), Gaps = 17/387 (4%)

```
Query:   8 IRDILKEPAFLMGLIAFAGLVALKTPAHKVLTGTLGPILGYLMLVAGAGVIVTNLDPLAK     67
             + +IL +PA+L+G+I   GL ALK    + + G +   LG L++ AGAG++ ++LDPL +
Sbjct:  12 VNEILSQPAYLIGIITAVGLAALKKSVGQTVGGAIKATLGLLLVGAGAGLVSSSLDPLGR     71

Query:  68 LIEHGFSITGVVPNNEAVTSVAQKILGVETMSILVVGLLLNLAFARFTRFKYIFLTGHHS    127
             +I+      GV+P NEA+  +AQ   G     ++++G L++LA ARFT   +Y+FLTGHH
Sbjct:  72 MIQGTTGTHGVIPTNEAIVGIAQSEFGARVAWLMILGFLVSLALARFTPLRYVFLTGHHM    131

Query: 128 FFMACLLSAVLGAVGFKGSLLIIL-DGFLLGAWSAISPAIGQQYTLKVTDGDEIAMGHFG    186
             FMA LL+ V+  G +GS+ ++L  G L+G     PA     +T KVT  D +A+GHFG
Sbjct: 132 LFMATLLTIVMATAG-QGSVAVVLGGGVLVGILLVALPAFAHPWTKKVTGNDTLAIGHFG    190

Query: 187 SLGYYLSAWVGSKVGKDSKDTEDLQISEKWSFLRNTTISTGLIMVIFYLVAT---VASVL    243
             + GY +S  G  VGK+S+ TE++++ E    FLR++ ++T L MV+ YLV +    +A V
Sbjct: 191 TAGYIVSGATGQLVGKNSRSTEEMKLPEGLRFLRDSMVATALSMVLIYLVMSLLFLAKVG    250

Query: 244 RNASVAEELAAGQNP-------FIFAIKSGLTFAVGVAIVYAGVRMILADLIPAFQGIAN    296
             ++A+       +G +P        + ++  GL F +GVA++   GVR IL +L+PAFQGIA
Sbjct: 251 QDAAFKAFAGSGGDPAADVGNYLMQSVMQGLQFGIGVAVILFGVRTILGELVPAFQGIAG    310

Query: 297 KLIPNAIPAVDCAVFFPYAPTAVIIGFASSFVGGLLGMLIL-----GVAGGVLIIPGMVP    351
             +++P A PA+D + FPYA  AV+IGF SF+GGL G+ L         G  L++PG+VP
Sbjct: 311 RVVPGAKPALDAPIVFPYAQNAVLIGFIFSFLGGLTGLAALIWVFNPAFGLALVLPGLVP    370

Query: 352 HFFCGATAEIFGNSTGGRRGAMIGASL    378
             HFF G  A ++GN+TGGRRGA +G+ L
Sbjct: 371 HFFTGGAAGVYGNATGGRRGAAVGSFL    397
```

An alignment of the GAS and GBS proteins is shown below:

Identities = 174/376 (46%), Positives = 258/376 (68%), Gaps = 2/376 (0%)

```
Query:   1 MKGLLDFLVNIASTPAILVALIAIIGLVLQKKGVPDIVKGGIKTFVGFLVVSGGTGIVQN     60
             M+ LL F+ +I   PA L+ LIA  GLV K      ++ G   +G+L++   G G++
Sbjct:   1 MEALLSFIRDILKEPAFLMGLIAFAGLVALKTPAHKVLTGTLGPILGYLMLVAGAGVIVT     60

Query:  61 SLNPFGKMFEHAFHLVGVVPNNEAIVAVALTKYGSATALIMLAGMIFNILIARFTKFKYI    120
             +L+P  K+ EH F + GVVPNNEA+ +VA    G  T  I++ G++ N+  ARFT+FKYI
Sbjct:  61 NLDPLAKLIEHGFSITGVVPNNEAVTSVAQKILGVETMSILVVGLLLNLAFARFTRFKYI    120

Query: 121 FLTGHHTLYMACMIAVIFAVAGFTSFSLILFGGLALGIIMSVSPAFVQKYMIQLTGNDKV    180
             FLTGHH+ +MAC+++ +   GF   LI+ G L G  ++SPA Q+Y +++T D++
Sbjct: 121 FLTGHHSFFMACLLSAVLGAVGFKGSLLIILDGFLLGAWSAISPAIGQQYTLKVTDGDEI    180

Query: 181 ALGHFGSLGYWLSGFIGGIVGDKSKSTEDIKFPKSLSFLRDSTVSITISMAIIYLI--VA    238
             A+GHFGSLGY+LS ++G  VG  SK TED+ +   SFLR++T+S  + M I YL+  VA
Sbjct: 181 AMGHFGSLGYYLSAWVGSKVGKDSKDTEDLQISEKWSFLRNTTISTGLIMVIFYLVATVA    240

Query: 239 VFAGEAYIAKEISNGVNGLVYALQLAGQFAAGVFVILAGVRLILGEIVPAFKGISEKLVP    298
                A +A+E++ G N  ++A++    FA GV ++  AGVR+IL  +++PAF+GI+ KL+P
Sbjct: 241 SVLRNASVAEELAAGQNPFIFAIKSGLTFAVGVAIVYAGVRMILADLIPAFQGIANKLIP    300

Query: 299 NSKPALDCPIVYPYAPNAVLIGFISSFVGGLVSMIVMIVTGTTVILPGVVPHFFCGATAG    358
             N+ PA+DC + PYAP AV+IGF SSFVGGL+ M+++ V G  +I+PG+VPHFFCGATA
Sbjct: 301 NAIPAVDCAVFFPYAPTAVIIGFASSFVGGLLGMLILGVAGGVLIIPGMVPHFFCGATAE    360

Query: 359 VIGNASGGVRGATIGA    374
             +  GN++GG RGA IGA
Sbjct: 361 IFGNSTGGRRGAMIGA    376
```

Based on this analysis, it was predicted that these proteins and their epitopes could be useful antigens for vaccines or diagnostics.

Example 155

A DNA sequence (GBSx0161) was identified in *S. agalactiae* <SEQ ID 517> which encodes the amino acid sequence <SEQ ID 518>. This protein is predicted to be transketolase, N-terminal subunit (tkt). Analysis of this protein sequence reveals the following:

Possible site: 45
>>> Seems to have no N-terminal signal sequence
----- Final Results -----
    bacterial cytoplasm --- Certainty = 0.3680 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database:

```
>GP: AAB98676 GB: U67515 transketolase' [Methanococcus jannaschii]
Identities = 106/269 (39%), Positives = 158/269 (58%), Gaps = 4/269 (1%)
Query:  11 LRRFATEIRLNTLETLNHLGFGHYGGSLSIVEALAVLYGDIMDINPEKFKESDRDYMVLS        70
           L + A ++R N ++ +    GH GGSLS  + + LY    +M+ +P+   + DRD   VLS
Sbjct:  10 LEKIARKVRYNIVKMVGLAKSGHPGGSLSATDIIVALYFKLMNYSPDNPYKKDRDRFVLS        69

Query:  71 KGHAGPALYSTLYLKGFFDKTFLHSLNTNGTKLPSHPDRNLTPGIDVTTGSLGQGISIAT       130
           KGHA PALY+ L  G  ++ L  L    KL    HP  + TPG+++ TGSLGQG S  A
Sbjct:  70 KGHAAPALYAVLSELGIIEEEELWKLRRLEGKLQGHPSMD-TPGVEICTGSLGQGFSAAV       128

Query: 131 GIAYAQKIENSSYYTYTIVGDGELNEGQCWEAIQFAAHHQLHHLIVFVDDNKKQLDGLTA       190
           G+A    +++ + Y Y ++GDGE   EG   WEA   AAH++L +LI F+D NK Q+DG T
Sbjct: 129 GMALGCRLDKLNNYVYVLLGDGECQEGIVWEAAMAAAHYKLDNLIAFIDRNKLQIDGCTE       188

Query: 191 DICNPGDFVAKFEAFGFDAVRVKGDDIEAIDKAIKTFQDSNSVRPKCIVLDSIKGQGVKE       250
           D+ +  GD   AKFEAFG+D   + G + E I   ++  +   + +PK I+  ++KG+GV
Sbjct: 189 DVMSLGDIKAKFEAFGWDVFEIDGHNFEEIINTVEKAKSMKNGKPKMIIAYTVKGKGVSF       248

Query: 251 LEELASNHHLRPDLQQKTMLERALISLRE                                   279
           +E   + H  P+ +Q   L++AL   L E
Sbjct: 249 MENNVAFHGKAPNEEQ---LKQALEELSE                                   274
```

A related DNA sequence was identified in *S. pyogenes* <SEQ ID 519> which encodes the amino acid sequence <SEQ ID 520>. Analysis of this protein sequence reveals the following:

Possible site: 26
>>> Seems to have an uncleavable N-term signal seq
INTEGRAL    Likelihood = −0.75    Transmembrane 58-74 (57-74)
----- Final Results -----
    bacterial membrane --- Certainty = 0.1298 (Affirmative) <succ>
    bacterial outside --- Certainty = 0.0000 (Not Clear) <succ>
    bacterial cytoplasm --- Certainty = 0.0000 (Not Clear) <succ>

A related sequence was also identified in GAS <SEQ ID 9165> which encodes the amino acid sequence <SEQ ID 9166>. Analysis of this protein sequence reveals the following:

Possible site: 54
>>> Seems to have an uncleavable N-term signal seq
INTEGRAL    Likelihood = −0.75    Transmembrane 40-56 (39-56)
----- Final Results -----
    bacterial membrane --- Certainty = 0.130 (Affirmative) <succ>
    bacterial outside --- Certainty = 0.0000 (Not Clear) <succ>
    bacterial cytoplasm --- Certainty = 0.0000 (Not Clear) <succ>

An alignment of the GAS and GBS proteins is shown below:

```
Identities = 82/246 (33%), Positives = 129/246 (52%), Gaps = 15/246 (6%)
Query:  18 IRLNTLETLNHLGFGHYGGSLSIVEALAVLYGDIMDINPEKFKE-SDRDYMVLSKGHAGP        76
           +R   +++ +    GH G +       VL+    M+INP+  +  S+RD  +LS GH
Sbjct:  82 VRTLSMDAIQAANSGHPGLPMGAAPMAYVLWNHFMNINPKTSRNWSNRDRFILSAGHGSA       141

Query:  77 ALYSTLYLKGF-FDKTFLHSLNTNGTKLPSHPDRNLTPGIDVTTGSLGQGISIATGIAYA       135
             LYS  L+L G+         L +     G+K P HP+ N T G++ TTG LGQGI+ A G+A A
```

```
Sbjct: 142 MLYSLLHLAGYDLSVEDLKNFRQWGSKTPGHPEVNHTDGVEATTGPLGQGIANAVGMAMA    201

Query: 136 QK----------IENSSYYTYTIVGDGELNEGQCWEAIQFAAHHQLHHLIVFVDDNKKQL    185
              +         + +YT+ + GDG+L EG   EA   A H +L L++  D N     L Sbjct: 202 EAHLAAKFNKPGFDIVDHYTFALNGDGDLMEGVSQEAASMAGHLKLGKLVLLYDSNDISL    261

Query: 186 DGLTADICNPGDFVAKFEAFGFDAVRVK-GDDIEAIDKAIKTFQDSNSVRPKCIVLDSIK    244
              DG T+ +    D   +FEA+G+  + VK G+D+E I   AI+  + + + +P  I + +I Sbjct: 262 DGPTS-MAFTEDVKGRFEAYGWQHILVKDGNDLEEIAAAIEAAK-AETEKPTIIEVKTII    319

Query: 245 GQGVKE    250
              G G ++

Sbjct: 320 GFGAEK    325
```

Based on this analysis, it was predicted that these proteins and their epitopes could be useful antigens for vaccines or diagnostics.

Example 156

A DNA sequence (GBSx0162) was identified in *S. agalactiae* <SEQ ID 521> which encodes the amino acid sequence <SEQ ID 522>. Analysis of this protein sequence reveals the following:

---

Possible site: 43
>>> Seems to have no N-terminal signal sequence
INTEGRAL    Likelihood = –0.27    Transmembrane 53-69 (53-69)
----- Final Results -----
  bacterial membrane --- Certainty = 0.1107 (Affirmative) <succ>
    bacterial outside --- Certainty = 0.0000 (Not Clear) <succ>
      bacterial cytoplasm --- Certainty = 0.0000 (Not Clear) <succ>

---

A related GBS nucleic acid sequence <SEQ ID 9499> which encodes amino acid sequence <SEQ ID 9500> was also identified.

The protein has homology with the following sequences in the GENPEPT database:

There is also homology to SEQ ID 520.

Based on this analysis, it was predicted that these proteins and their epitopes could be useful antigens for vaccines or diagnostics.

Example 157

A DNA sequence (GBSx0163) was identified in *S. agalactiae* <SEQ ID 523> which encodes the amino acid sequence <SEQ ID 524>. Analysis of this protein sequence reveals the following:

---

Possible site: 24
>>> Seems to have no N-terminal signal sequence
----- Final Results -----
  bacterial cytoplasm --- Certainty = 0.2517 (Affirmative) <succ>
    bacterial membrane --- Certainty = 0.0000 (Not Clear) <succ>
      bacterial outside --- Certainty = 0.0000 (Not Clear) <succ>

---

The protein has no significant homology with any sequences in the GENPEPT database.

No corresponding DNA sequence was identified in *S. pyogenes*.

```
>GP: AAB98674 GB: U67515 transketolase" [Methanococcus jannaschii]
Identities = 100/301 (33%), Positives = 171/301 (56%), Gaps = 7/301 (2%)
Query:   6 KEMRLVYRDFLLQANQENKQITVLEADLSSSMSTNALASEFGKRYINLGIMEAEMVGLAA    65
             K MR  Y + L++ ++   + + VL+ADLS S  T A   EF +R+ N G+ E  M+G+AA Sbjct:   9 KGMRKGYGETLIELGKKYENLVVLDADLSGSTQTAMFAKEFPERFFNAGVAEQNMIGMAA    68

Query:  66 GLAIKGYKPYLHTFGPFASRRVFDQVFLSLGYSQLSATIIGSDAGISAEMNGGTHMPFEE   125
             GLA  G  + +F  FAS R ++ +     + Y +L+  I+ + AGI+     +G +H    E+

Sbjct:  69 GLATTGKIVFASSFSMFASGRAWEIIRNLVAYPKLNVKIVATHAGITVGEDGASHQMCED   128

Query: 126 LGLLRLIPKATIFEVSDDIQFEAILKQTLSIDGLKYIRTIRKAPTAVYEGRE----DFSK   181
             + ++R IP   +D  +++           G  Y+R R+    +YE  E    +   K Sbjct: 129 IAIMRAIPNMVVIAPTDYYHTKNVIRTIAEYKGPVYVRMPRRDTEIIYENEEEATFEIGK   188

Query: 182 GFIQLRQGKDITLVASGIMVSRAIEAADYLKELGIEASVIDLFKIKPLPEELKPLLIDQS   241
             G I L  G+D+T++A+G V  A+ A + LKE GI A ++++    IKP+  EE+      D Sbjct: 189 GKI-LVDGEDLTIIATGEEVPEALRAGEILKENGISAEIVEMATIKPIDEEIIKKSKD-F   246

Query: 242 IVTIENHNRIGGIGSALCEWL-SMEKDTTVSRMGIDERFGQVGQMEYLLEEYGLAVKDIVQ   301
             +VT+E+H+  IGG+G A+ E + S    +   +  R+GI++  FG+ G+  + LL+ YGL   + I +

Sbjct: 247 VVTVEDHSIIGGLGGAVAEVIASNGLNKKLLRIGINDVFGRSGKADELLKYYGLDGESIAK   307
```

Example 158

A DNA sequence (GBSx0164) was identified in *S. agalactiae* <SEQ ID 525> which encodes the amino acid sequence <SEQ ID 526>. Analysis of this protein sequence reveals the following:

```
Possible site: 35
>>> Seems to have no N-terminal signal sequence
INTEGRAL    Likelihood = -6.42   Transmembrane 119-135 (114-145)
INTEGRAL    Likelihood = -5.10   Transmembrane 33-49 (32-50)
INTEGRAL    Likelihood = -4.30   Transmembrane 94-110 (94-111)
INTEGRAL    Likelihood = -3.66   Transmembrane 67-83 (60-83)
----- Final Results -----
   bacterial membrane --- Certainty = 0.3569 (Affirmative) <succ>
   bacterial outside --- Certainty = 0.0000 (Not Clear) <succ>
     bacterial cytoplasm --- Certainty = 0.0000 (Not Clear) <succ>
```

No corresponding DNA sequence was identified in *S. pyogenes*.

A related GBS gene <SEQ ID 8503> and protein <SEQ ID 8504> were also identified. Analysis of this protein sequence reveals the following:

```
Lipop: Possible site: -1    Crend: 4
SRCFLG: 0
McG: Length of UR: 22
Peak Value of UR: 2.96
Net Charge of CR: 2
McG: Discrim Score: 10.55
GvH: Signal Score (-7.5) : -4.31
Possible site: 22
>>> Seems to have an uncleavable N-term signal seq
Amino Acid Composition: calculated from 1
ALOM ptogram count: 6  value: -6.42  threshold: 0.0
INTEGRAL    Likelihood = -6.42   Transmembrane 154-170 (149-180)
INTEGRAL    Likelihood = -5.10   Transmembrane 68-84 (67-85)
INTEGRAL    Likelihood = -5.04   Transmembrane 6-22 (2-24)
INTEGRAL    Likelihood = -4.30   Transmembrane 129-145 (129-146)
INTEGRAL    Likelihood = -3.66   Transmembrane 102-118 (95-118)
INTEGRAL    Likelihood = -3.56   Transmembrane 29-45 (29-46)
PERIPHERAL  Likelihood = 0.79    285
modified ALOM score: 1.78
icml HYPID: 7    CFP: 0.357
*** Reasoning Step: 3
----- Final Results -----
   bacterial membrane --- Certainty = 0.3569 (Affirmative) <succ>
      bacterial outside --- Certainty = 0.0000 (Not Clear) <succ>
        bacterial cytoplasm --- Certainty = 0.0000 (Not Clear) <succ>
```

Based on this analysis, it was predicted that this protein and its epitopes, could be useful antigens for vaccines or diagnostics.

The protein has homology with the following sequences in the databases:

```
ORF01868(391-1575 of 1938)
GP|9946413|gb|AAG03934.1|AE004491_1|AE004491(5-434 of 434) hypothetical protein
{Pseudomonas aeruginosa}
% Match = 8.1
% Identity = 26.1 % Similarity = 48.6
Matches = 105 Mismatches = 192 Conservative Sub.s = 91

171       201       231       261       291       321       351       381
       DTTVSRMGIDERFGQVGQMEYLLEEYGLAVKDIVQHCKSIYKS*QKGNIGVAFLLFSEIFKFCISILWYFILTKNKGVVV

M
       411       441       471       480       507       537       567       597
       MRAWKGIVLILSSIVVTLVAWQNAGLSEFVV-------PGLALTSL-SLTFLLSTKFRILESYFQGIENMYFYHKVMAVF
         |   :   |::   ||     |  |   :||     |:|  :|   ||    ||  |:  ||  :  ||   ||    ::
       KLLWGVLAAALAAWGLTLAVDPPASLDIWVVRKQAILLTGVASFALMSLIMLLAVRPVWLEKPLDGLDRMYRLHKWAGIL
            20        30        40        50        60        70        80

627       657               687       717       747       777
       SMILLLLHKIGLGQGGHGSEF------------------AKTIGSAGLYLFLSIVFVAYFGNFLKYEIWRFIHRFVYL
       :::|  |||  :      |       :                 ||  :|    :::    ::|    |  :|||::|: : |
       AIVLGLLHYLLELAGPWLAGIVGKPVKGPRVETFLDVFRGSAKELGEWSAWILGGMLLVTLW-QRFPYHLWRYVHKALAL
            100       110       120       130       140       150       160

807       837       867       897       924       951       981      1011
       AYILGLVHTFMILGDRILGNTLLSLIVLGYAVIGVISGFYIIFLYSRM-RFRR-VGYVQKVTHLNHDTTEIEIAMKRPYR
         |::    |:  ::|       :    :|     |::|      ::    |: ||  |  |  |    |:   ::   :
       VYLVLAFHS-VVLAPASYWSQPAGWLVAACALLGSACA--LLSLSGRIGRTRRHAGVVTAVERHGESLLEVTCRLQGDWS
               170       180       190       200       210       220       230

1041      1071      1101      1125      1155      1185      1215      1242
       YDYGQFTFFKIYQAGFESAAHPFSISGGHDRV--IFLTVKASGDYTKSIYKQLKVGTKIALDRAYGHMLFDKD-KKEQVW
       :  |||   |         ||||:|:         : :::||  ||||: :   |:||   ::   ||    |        |||
       HRAGQFAF---LTCDRLEGAHPFTIASADRGCGEVRFSIKALGDYTRRLQDNLEVGARVEVEGPYGCFDFRRGLAGRQVW
                  250       260       270       280       290       300       310

1272      1293      1323      1353      1383      1413      1443      1461
       IAGGIGITPFISFI---RENSILTKRVDFFYTFSNQDNLIYQDMLESYAKANPNFKLHLNNSSLKGRLDFSQ----SVFE
       :|  ||||:|||:::    :         |::|   |     ::   |    :|  ||:   |   :|:    :|        |
       VAAGIGVTPFIAWLESLQAAPESAPSVELHYCVRNSQEALFAGRLRELCEHLPSVTLHIRYSDEQGKPQAAQLGVLKSAE
                  330       340       350       360       370       380       390
```

-continued

```
1488      1518      1548      1575      1605      1635      1665      1695
GQ-PTIFMCGPTSMTSTYAKVFRQKDAKSRLVY-EGFSFRDSWLSIFLLKTFDKVYSNLIK*EGL*DKPTFSWF*ECQS*
|: |::: |||    :    : :|::    || : | | |
GRWPSVWFCGPQGLADSLRRDLRRQGMPLRLFHQEAFRMR
             410       420       430
```

Based on this analysis, it was predicted that these proteins and their epitopes could be useful antigens for vaccines or diagnostics.

Example 159

A DNA sequence (GBSx0165) was identified in *S. agalactiae* <SEQ ID 527> which encodes the amino acid sequence <SEQ ID 528>. This protein is predicted to be 30S ribosomal protein S15 (rpsO). Analysis of this protein sequence reveals the following:

```
Identities = 88/89 (98%), Positives = 88/89 (98%)
Query:  1  MAISKEKKNEIIAQYARHEGDTGSVEVQVAVLTWEINHLNDHIKQHKKDHATYRGLMKKI    60
           MAISKEKKNEIIAQYARHEGDTGSVEVQVAVLTWEINHLN HIKQHKKDHATYRGLMKKI
Sbjct:  1  MAISKEKKNEIIAQYARHEGDTGSVEVQVAVLTWEINHLNSHIKQHKKDHATYRGLMKKI    60

Query: 61  GHRRNLLAYLRRTDVNRYRELIQSLGLRR                                 89
           GHRRNLLAYLRRTDVNRYRELIQSLGLRR
Sbjct: 61  GHRRNLLAYLRRTDVNRYRELIQSLGLRR                                 89
```

Possible site: 24
>>> Seems to have no N-terminal signal sequence
----- Final Results -----
 bacterial cytoplasm --- Certainty = 0.4074 (Affirmative) <succ>
 bacterial membrane --- Certainty = 0.0000 (Not Clear) <succ>
 bacterial outside --- Certainty = 0.0000 (Not Clear) <succ>

The protein has homology with the following sequences in the GENPEPT database:

```
>GP: CAB13541 GB: Z99112 ribosomal protein S15 (BS18) [Bacillus subtilis]
Identities = 55/89 (61%), Positives = 71/89 (78%)
Query:  1  MAISKEKKNEIIAQYARHEGDTGSVEVQVAVLTWEINHLNDHIKQHKKDHATYRGLMKKI    60
           MAI++E+KN++I ++  HE DTGS EVQ+A+LT  IN+LN+H++ HKKDH + RGL+K +
Sbjct:  1  MAITQERKNQLINEFKTHESDTGSPEVQIAILTDSINNLNEHLRTHKKDHHSRRGLLKMV    60

Query: 61  GHRRNLLAYLRRTDVNRYRELIQSLGLRR                                 89
           G RRNLL YLR  DV RYRELI  LGLRR
Sbjct: 61  GKRRNLLTYLRNKDVTRYRELINKLGLRR                                 89
```

A related DNA sequence was identified in *S. pyogenes* <SEQ ID 529> which encodes the amino acid sequence <SEQ ID 530>. Analysis of this protein sequence reveals the following:

Possible site: 41
>>> Seems to have no N-terminal signal sequence
----- Final Results -----
 bacterial cytoplasm --- Certainty = 0.3746 (Affirmative) <succ>
 bacterial membrane --- Certainty = 0.0000 (Not Clear) <succ>
 bacterial outside --- Certainty = 0.0000 (Not Clear) <succ>

An alignment of the GAS and GBS proteins is shown below:

Based on this analysis, it was predicted that these proteins and their epitopes could be useful antigens for vaccines or diagnostics.

Example 160

A DNA sequence (GBSx0166) was identified in *S. agalactiae* <SEQ ID 531> which encodes the amino acid sequence <SEQ ID 532>. This protein is predicted to be polyribonucleotide nucleotidyltransferase (pnp). Analysis of this protein sequence reveals the following:

Possible site: 46
>>> Seems to have no N-terminal signal sequence
INTEGRAL    Likelihood = −0.64    Transmembrane 448-464 (448-464)
----- Final Results -----
 bacterial membrane --- Certainty = 0.1256 (Affirmative) <succ>
 bacterial outside --- Certainty = 0.0000 (Not Clear) <succ>
 bacterial cytoplasm --- Certainty = 0.0000 (Not Clear) <succ>

A related GBS nucleic acid sequence <SEQ ID 9501> which encodes amino acid sequence <SEQ ID 9502> was also identified.

The protein has homology with the following sequences in the GENPEPT database:

```
>GP: AAC43595 GB: U29668 polynucleotide phosphorylase [Bacillus subtilis]
Identities = 428/694 (61%), Positives = 532/694 (75%), Gaps = 4/694 (0%)
Query:   7 KQVFEMIFAGKKLVVETGQVAKQANGSVVVRYGDSTVLTAAVMSKKMSTGDFFPLQVNYE  66
           K VF + +AG+ L VETGQ+AKQANG+V++RYGD+ VL+ A  SK+    DFFPL VNYE
Sbjct:   5 KHVFTIDWAGRTLTVETGQLAKQANGAVMIRYGDTAVLSTATASKEPKPLDFFPLTVNYE  64

Query:  67 EKMYAAGKFPGGFNKREGRPSTDATLTARLIDRPIRPMFAEGFRNEVQVINTVLSFDENA 126
           E++YA GK PGGF KREGRPS  A L +RLIDRPIRP+FA+GFRNEVQVI+ V+S D+N
Sbjct:  65 ERLYAVGKIPGGFIKREGRPSEKAVLASRLIDRPIRPLFADGFRNEVQVISIVMSVDQNC 124

Query: 127 SAPMAAMFGSSLALSISDIPFNGPIAGVQVAYVDGNFIINPTAQEQEASALELTVAGTKE 186
           S+ MAAMFGSSLALS+SDIPF GPIAGV V  +D  FIINPT  + E S + L VAGTK+
Sbjct: 125 SSEMAAMFGSSLALSVSDIPFEGPIAGVTVGRIDDQFIINPTVDQLEKSDINLVVAGTKD 184

Query: 187 AINMVESGAKELSEEIMLEALLKGHEAVCELIAFQEEIVTAIGKEKAEVELLQVDPELQA 246
           AINMVE+GA E+ EEIMLEA++ GHE +  LIAFQEEIV A+GKEK+E++L ++D EL
Sbjct: 185 AINMVEAGADEVPEEIMLEAIMFGHEEIKRLIAFQEEIVAAVGKEKSEIKLFEIDEELNE 244

Query: 247 EIIATHNIALQAAVQVEEKKAREAATEAVKEVVIGEYEARYAEHEEYDRIMRDVAEILEQ 306
           ++ A     L  A+QV EK ARE A   VK  V+ ++E    EH+E    ++ V +IL +
Sbjct: 245 KVKALAEEDLLKAIQVHEKHAREDAINEVKHAVVAKFEDE--EHDE--DTIKQVKQILSK 300

Query: 307 MEHAEVRRLITEDKIRPDGRRVDEIRPLDAEIDFLPQVHGSGLFTRGQTQALSVLTLAPM 366
           +     EVRRLITE+K+RPDGR VD+IRPL +E+   LP+ HGSGLFTRGQTQALSV TL  +
Sbjct: 301 LVKNEVRRLITEEKVRPDGRGVDQIRPLSSEVGLLPRTHGSGLFTRGQTQALSVCTLGAL 360

Query: 367 GEAQIIDGLTPEYKKRFMHHYNFPQYSVGETGRYGAAGRREIGHGALGERALEQVLPRLE 426
           G+ QI+DGL  E  KRFMHHYNFPQ+SVGETG     GRREIGHGALGERALE V+P  +
Sbjct: 361 GDVQILDGLGVEESKRFMHHYNFPQFSVGETGPMRGPGRREIGHGALGERALEPVIPSEK 420

Query: 427 EPYAIRLVAEVLESNGSSSQASICAGTLALMAGGVPIKAPVAGIAMGLISDGTNYTVLT 486
           +FPY +RLV+EVLESNGS+SQASICA TLA+M  GVPIKAPVAGIAMGL+  G +YTVLT
Sbjct: 421 DFPYTVRLVSEVLESNGSTSQASICASTLAMMDAGVPIKAPVAGIAMGLVKSGEHYTVLT 480

Query: 487 DIQGLEDHFGDMDFKVAGTREGITALQMDIKIEGITPQILEEALAQAKKARFEILDVLHG 546
           DIQG+ED  GDMDFKVAGT +G+TALQMDIKIEG++ +ILEEAL QAKK R EIL+ +
Sbjct: 481 DIQGMEDALGDMDFKVAGTEKGVTALQMDIKIEGLSREILEEALQQAKKGRMEILNSMLA 540

Query: 547 AIAEPRPQLAPTAPKIDMIKIDVDKIKVVIGKGGETIDKIIAETGVKIDIDEEGNVSIFS 606
           ++E R +L+   APKI + I+ DKI+ VIG G+ I+KII ETGVKIDI+++G + S
Sbjct: 541 TLSESRKELSRYAPKILTMTINPDKIRDVIGPSGKQINKIIEETGVKIDIEQDGTIFISS 600

Query: 607 SDQAAIDRTKDIIASLVREAKVGEVYHAKVVRIEKFGAFVNLFDKTDALVHISEIAWTRT 666
           +D++  + K II  LVRE +VG++Y  KV RIEKFGAFV +F   D LVHISE+A R
Sbjct: 601 TDESGNQKAKKIIEDLVREVEVGQLYLGKVKRIEKFGAFVEIFSGKDGLVHISELALERV 660

Query: 667 ANVADVLEIGEEVDVKVIKDDKGRVDASMKALL                            700
           V DV++IG+E+ VKV +ID +GRV+ S KA+L
Sbjct: 661 GKVEDVVKIGDEILVKVTEIDKQGRVNLSRKAVL                           694
```

A related DNA sequence was identified in *S. pyogenes* <SEQ ID 533> which encodes the amino acid sequence <SEQ ID 534>. Analysis of this protein sequence reveals the following:

Possible site: 28
>>> Seems to have no N-terminal signal sequence

-continued

INTEGRAL    Likelihood = –0.64    Transmembrane 444-460 (444-460)
----- Final Results -----
    bacterial membrane --- Certainty = 0.1256 (Affirmative) <succ>
    bacterial outside --- Certainty = 0.0000 (Not Clear) <succ>
    bacterial cytoplasm --- Certainty = 0.0000 (Not Clear) <succ>

An alignment of the GAS and GBS proteins is shown below:

```
Identities = 631/708 (89%), Positives = 664/708 (93%), Gaps = 2/708 (0%)
Query:   5 MSKQVFEMIFAGKKLVVETGQVAKQANGSVVVRYGDSTVLTAAVMSKKMSTGDFFPLQVN  64
           MSKQ F  FAGK LVVE GQVAKQANG+ VVRYGDSTVLTAAVMSKKM+TGDFFPLQVN
Sbjct:   1 MSKQTFTTTFAGKPLVVEVGQVAKQANGATVVRYGDSTVLTAAVMSKKMATGDFFPLQVN  60

Query:  65 YEEKMYAAGKFPGGFNKREGRPSTDATLTARLIDRPIRPMFAEGFRNEVQVINTVLSFDE 124
           YEEKMYAAGKFPGGF KREGRPSTDATLTARLIDRPIRPMFAEGFRNEVQVINTVLS+DE
Sbjct:  61 YEEKMYAAGKFPGGFMKREGRPSTDATLTARLIDRPIRPMFAEGFRNEVQVINTVLSYDE 120

Query: 125 NASAPMAAMFGSSLALSISDIPFNGPIAGVQVAYVDGNFIINPTAQEQEASALELTVAGT 184
           NASAPMAAMFGSSLALSISDIPFNGPIAGVQV Y+DG FIINP  ++ EAS LELTVAG+
Sbjct: 121 NASAPMAAMFGSSLALSISDIPFNGPIAGVQVGYIDGEFIINPDKEQMEASLLELTVAGS 180

Query: 185 KEAINMVESGAKELSEEIMLEALLKGHEAVCELIAFQEEIVTAIGKEKAEVELLQVDPEL 244
           KEAINMVESGAKELSE+IMLEALLKGH+A+ ELIAFQE+IV   GKEKAEVELLQVD +L
Sbjct: 181 KEAINMVESGAKELSEDIMLEALLKGHQAIQELIAFQEQIVAVVGKEKAEVELLQVDVDL 240
```

-continued

```
Query:  245 QAEIIATHNIALQAAVQVEEKKAREAATEAVKEVVIGEYEARYAEHEEYDRIMRDVAEIL  304
            QA+I+A +N  LQ AVQVEEKKAREAATEAVKE+V  EYE RYAE E    IMRDVAEIL
Sbjct:  241 QADIVAKYNAQLQKAVQVEEKKAREAATEAVYEMVKAEYEERYAEDENLATIMRDVAEIL  300

Query:  305 EQMEHAEVRRLITEDKIRPDGRRVDEIRPLDAEIDFLPQVHGSGLFTRGQTQALSVLTLA  364
            EQMEHAEVRRLITEDKIRPDGR++DEIRPLDA +DFLP+VHGSGLFTRGQTQALSVLTLA
Sbjct:  301 EQMEHAEVRRLITEDKIRPDGRKIDEIRPLDAVVDFLPKVHGSGLFTRGQTQALSVLTLA  360

Query:  365 PMGEAQIIDGLTPEYKKRFMHHYNFPQYSVGETGRYGAAGRREIGHGALGERALEQVLPR  424
            PMGE QIIDGL PEYKKRF+HHYNFPQYSVGETGRYGAAGRREIGHGALGERALEQVLP
Sbjct:  361 PMGETQIIDGLAPEYKKRFLHHYNFPQYSVGETGRYGAAGRREIGHGALGERALEQVLPS  420

Query:  425 LEEFPYAIRLVAEVLESNGSSSQASICAGTLALMAGGVPIKAPVAGIAMGLISDGTNYTV  484
            LEEFPYAIRLVAEVLESNGSSSQASICAGTLALMAGGVPIKAPVAGIAMGLISDGTNYTV
Sbjct:  421 LEEFPYAIRLVAEVLESNGSSSQASICAGTLALMAGGVPIKAPVAGIAMGLISDGTNYTV  480

Query:  485 LTDIQGLEDHFGDMDFKVAGTREGITALQMDIKIEGITPQILEEALAQAKKARFEILDVL  544
            LTDIQGLEDHFGDMDFKVAGTREGITALQMDIKI GITPQILEEALAQAKKARFEILDV+
Sbjct:  481 LTDIQGLEDHFGDMDFKVAGTREGITALQMDIKIAGITPQILEEALAQAKKARFEILDVI  540

Query:  545 HGAIAEPRPQLAPTAPKIDMIKIDVDKIKVVIGKGGETIDKIIAETGVKIDIDEEGNVSI  604
               IAEPRP+LAPTAPKID IKIDVDKIKVVIGKGGETIDKIIAETGVKIDID+EGNVSI
Sbjct:  541 EATIAEPRPELAPTAPKIDTIKIDVDKIKVVIGKGGETIDKIIAETGVKIDIDDEGNVSI  600

Query:  605 FSSDQAAIDRTKDIIASLVREAKVGEVYHAKVVRIEKFGAFVNLFDKTDALVHISEIAWT  664
            +SSDQAAIDRTK+IIA LVREAKVGEVYHAKVVRIEKFGAFVNLFDKTDALVHISEIAWT
Sbjct:  601 YSSDQAAIDRTKEIIAGLVREAKVGEVYHAEVVRIEKFGAFVNLFDKTDALVHISEIAWT  660

Query:  665 RTANVADVLEIGEEVDVKVIKDDKGRVDASMKALLPRPPKADNPKKE              712
            RT NV+DVLE+GE+VDVKVIKID+KGRVDASMKAL+PRPPK +  KKE
Sbjct:  661 RTTNVSDVLEVGEDVDVKVIKIDEKGRVDASMKALIPRPPKPE--KKE              706
```

Based on this analysis, it was predicted that these proteins and their epitopes could be useful antigens for vaccines or diagnostics.

Example 161

A DNA sequence (GBSx0167) was identified in *S. agalactiae* <SEQ ID 535> which encodes the amino acid sequence <SEQ ID 536>. Analysis of this protein sequence reveals the following:

---

Possible site: 39
>>> Seems to have no N-terminal signal sequence
----- Final Results -----
  bacterial cytoplasm --- Certainty = 0.1293 (Affirmative) <succ>
    bacterial membrane --- Certainty = 0.0000 (Not Clear) <succ>
    bacterial outside --- Certainty = 0.0000 (Not Clear) <succ>

---

The protein has no significant homology with any sequences in the GENPEPT database.

A related DNA sequence was identified in *S. pyogenes* <SEQ ID 537> which encodes the amino acid sequence <SEQ ID 538>. Analysis of this protein sequence reveals the following:

---

Possible site: 38
>>> Seems to have no N-terminal signal sequence
INTEGRAL    Likelihood = -0.43    Transmembrane 83-99 (83-99)
----- Final Results -----
  bacterial membrane --- Certainty = 0.1171 (Affirmative) <succ>
    bacterial outside --- Certainty = 0.0000 (Not Clear) <succ>
    bacterial cytoplasm --- Certainty = 0.0000 (Not Clear) <succ>

---

The protein has no significant homology with any sequences in the GENPEPT database.

An alignment of the GAS and GBS proteins is shown below:

```
Identities = 172/248 (69%), Positives = 211/248 (84%)
Query:    1 MTSTNELDIRLRAFINAPDNFLDSIGLVNALHHSTVWASKEPYAIQVDGQEVVPVFTDIT   60
            MT +NELDIRLRAFINAPDNFLDS+ LVNA H+  VWA+KEPY I+V+G +V PVFTD
Sbjct:    1 MTKSNELDIRLRAFINAPDNFLDSLALVNAFHNFPVWAAKEPYVIEVEGVKVTPVFTDKE   60

Query:   61 DLNHFKEEQESARDMFWESRRSLDVLDEAISHGLAGLVYNLKKEGDFGNSTIFYCEDMVQ  120
            D+  FKEEQ+SA+  +W  R +L VL+E I+ G AGL++NLKK+GDFGNSTIF   DM+Q
Sbjct:   61 DMARFKEEQKSAQSQYWLERSALAVLEEVITSGAAGLIFNLKKKGDFGNSTIFKSSDMIQ  120

Query:  121 FMNNYTTILNQLLNEDNIVADIMDKTYLVPAFVHPREEGSFDRLFPTMSTPEGKSYVPVF  180
            FMN+YTT+LN L++DN+ AD M+K YLVPAFV+P++   +DRLFPTMSTPEGKSYVP F
Sbjct:  121 FMNHYTTVLNTLMSDDNVAADTMEKVYLVPAFVYPKDNNHYDRLFPTMSTPEGKSYVPAF  180

Query:  181 SNLLSFEKWYNHNDFGGAFRKAQGVILAWTIDDIYKPRNGENEIDDTFGVAINPFDEQQV  240
            SNL SF KWYN +DFGG FRKA+GVIL WTIDDIY+PRNGENE+D+TFGVAINPFD+QQ+
Sbjct:  181 SNLQSFAKWYNQDDFGGLFRKAEGVILTWTIDDIYQPRNGENELDETFGVAINPFDDQQI  240

Query:  241 LVDWSDVE                                                     248
            LVDWS+++
Sbjct:  241 LVDWSELD                                                     248
```

Based on this analysis, it was predicted that these proteins and their epitopes could be useful antigens for vaccines or diagnostics.

Example 162

A DNA sequence (GBSx0168) was identified in *S. agalactiae* <SEQ ID 539> which encodes the amino acid sequence <SEQ ID 540>. This protein is predicted to be serine acetyltransferase (cysE). Analysis of this protein sequence reveals the following:

```
Possible site: 39
>>> Seems to have no N-terminal signal sequence
INTEGRAL     Likelihood = -2.02    Transmembrane 150-166 (147-168)
----- Final Results -----
   bacterial membrane --- Certainty = 0.1808 (Affirmative) <succ>
      bacterial outside --- Certainty = 0.0000 (Not Clear) <succ>
         bacterial cytoplasm --- Certainty = 0.0000 (Not Clear) <succ>
```

A related GBS nucleic acid sequence <SEQ ID 9503> which encodes amino acid sequence <SEQ ID 9504> was also identified.

The protein has homology with the following sequences in the GENPEPT database:

```
>GP: CAB71304 GB: AJ130879 serine acetyltransferase [Clostridium
sticklandii]
Identities = 92/169 (54%), Positives = 125/169 (73%)

Query:     9 KESIAIVKEQDPAARSSLEVILTYPGIKALAAHRLSHFLWNHNFKLLARMHSQFWRFWTQ   68
             KE+I + +E+DPAA+ ++ +++  PGI A+  HR++H L+N    +AR+ SQ  RF T
Sbjct:    20 KETIEVAREKDPAAKGAINILVNTPGIHAIMFHRVAHSLYNRKHFFIARLISQISRFLTG   79

Query:    69 IEIHPGATISEGVFIDHGSGLVIGETAIVEKGAMLYHGVTLGGTGKDKGKRHPTIRKGAL  128
             IEIHPGA I    FIDHG G+VIGETA +    ML+H VTLGGTGKDKGKRHPT+    +
Sbjct:    80 IEIHPGAQIGRRFFIDHGMGVVIGETAEIGDDVMLFHQVTLGGTGKDKGKRHPTVENNVI  139

Query:   129 ISAHSQIIGPIEVGENAKVGAAAVVLADVPADVTVVGVPAKVVRVHGQK            177
             ISA   +++GPI +GEN+K+GA AVVL D+P + T VG+PAKVVR++G+K
Sbjct:   140 ISAGVKVLGPIVIGENSKIGANAVVLHDIPKNATAVGIPAKVVRLNGEK            188
```

A related DNA sequence was identified in *S. pyogenes* <SEQ ID 541> which encodes the amino acid sequence <SEQ ID 542>. Analysis of this protein sequence reveals the following:

```
Possible site: 35
>>> Seems to have no N-terminal signal sequence
----- Final Results -----
   bacterial cytoplasm --- Certainty = 0.0141 (Affirmative) <succ>
      bacterial membrane --- Certainty = 0.0000 (Not Clear) <succ>
         bacterial outside --- Certainty = 0.0000 (Not Clear) <succ>
```

An alignment of the GAS and GBS proteins is shown below:

```
Identities = 162/193 (83%), Positives = 178/193 (91%)
Query:     5 MGWWKESIAIVKEQDPAARSSLEVILTYPGIKALAARRLSHFLWNHNFKLLARMHSQFWR   64
             MGWWKESIAIVK DPAAR+SLEVILTYPGIKALAAHRLSHFLW H+FKLLARMHSQFWR
Sbjct:     1 MGWWKESIAIVKALDPAARNSLEVILTYPGIKALAAHRLSHFLWRHHFKLLARMHSQFWR   60

Query:    65 FWTQIEIHPGATISEGVFIDHGSGLVIGETAIVEKGAMLYHGVTLGGTGKDKGKRHPTIR  124
             FWTQIEIHPGA I+ GVFIDHG+GLVIGETAIVEKG MLYHGVTLGGTGKD GKRHPT+R
Sbjct:    61 FWTQIEIHPGAQIAPGVFIDHGAGLVIGETAIVEKGVMLYHGVTLGGTGKDCGKRHPTVR  120

Query:   125 KGALISAHSQIIGPIEVGENAKVGAAAVVLADVPADVTVVGVPAKVVRVHGQKDDLQIRS  184
             +GALISAH+Q+IGPI++G NAKVGAAAVVL+DVP DVTVVGVPAK+VRVHGQKD+ QI+S
Sbjct:   121 QGALISAHAQVIGPIDIGANAKVGAAAVVLSDVPEDVTVVGVPAKIVRVHGQKDNRQIQS  180

Query:   185 IEHDREESYYSSK                                                197
             ++  RE SY  SK
Sbjct:   181 LQKQREVSYQLSK                                                193
```

Based on this analysis, it was predicted that these proteins and their epitopes could be useful antigens for vaccines or diagnostics.

Example 163

A DNA sequence (GBSx0169) was identified in *S. agalactiae* <SEQ ID 543> which encodes the amino acid sequence <SEQ ID 544>. Analysis of this protein sequence reveals the following:

---
Possible site: 29
>>> May be a lipoprotein
INTEGRAL    Likelihood = −5.89    Transmembrane 32-48 (29-49)
----- Final Results -----
    bacterial membrane --- Certainty = 0.3357 (Affirmative) <succ>
        bacterial outside --- Certainty = 0.0000 (Not Clear) <succ>
        bacterial cytoplasm --- Certainty = 0.0000 (Not Clear) <succ>
---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 164

A DNA sequence (GBSx0170) was identified in *S. agalactiae* <SEQ ID 545> which encodes the amino acid sequence <SEQ ID 546>. This protein is predicted to be cysteinyl-tRNA synthetase (cysS). Analysis of this protein sequence reveals the following:

---
Possible site: 46
>>> Seems to have no N-terminal signal sequence
----- Final Results -----
    bacterial cytoplasm --- Certainty = 0.2227 (Affirmative) <succ>
        bacterial membrane --- Certainty = 0.0000 (Not Clear) <succ>
        bacterial outside --- Certainty = 0.0000 (Not Clear) <succ>
---

The protein has homology with the following sequences in the GENPEPT database:

```
>GP: CAB11870 GB: Z99104 cysteinyl-tRNA synthetase [Bacillus subtilis]
Identities = 246/465 (52%), Positives = 322/465 (68%), Gaps = 23/465 (4%)
Query:     2 IKIYDTMTRSLQDFIPLNEGKVNMYVCGPTVYNYIHIGNARSVVAFDTIRRYFEYCGYQV   61
             I +Y+T+TR  + F+PL EGKV MYVCGPTVYNYIHIGNAR   +DT+R Y EY GY V
Sbjct:     3 ITLYNTLTRQKETFVPLEEGKVKMYVCGPTVYNYIHIGNARPAIVYDTVRNYLEYKGYDV   62

Query:    62 NYISNFTDVDDKIIKGAAEAGMDTKSFSDKFISAFMEDVAALGVKPATKNPRVIDYMDEI  121
             +Y+SNFTDVDDK+IK A E G D   S++FI A+ EDV ALG + A  +PRV++ MD I
Sbjct:    63 QYVSNFTDVDDKLIKAANELGEDVPTISERFIKAYFEDVGALGCRKADLHPRVMENMDAI  122

Query:   122 IDFVKVLVDKEFAYEANGDVYFRVSKSHHYAKLANKTLEDLEIGASGRVDGEGEIKENPL  181
             I+FV  LV K +AYE+ GDVYF+        Y KL+ +++++L  GA  RV GE  KE+ L
Sbjct:   123 IEFVDQLVKKGYAYESEGDVYFKTRAFEGYGKLSQQSIDELRSGARIRV---GEKKEDAL  179

Query:   182 DFALWKSAKSGEVSWESPWGKGRPGWHIECSVMATEILGDTIDIHGGGADLEFPHHTNEI  241
             DFALWK+AK GE+SW+SPWGKGRPGWHIECS M  + LGD IDIH GG DL FPHH NEI
Sbjct:   180 DFALWKAAKEGEISWDSPWGKGRPGWHIECSAMVKKYLGDQIDIHAGGQDLTFPHHENEI  239

Query:   242 AQSEAKTGKTFANYWMHNGFVNVDNEKMSKSLGNFITVHDMLKSVDGQVIRFFLATQQYR  301
             AQSEA TGKTFA YW+HNG++N+DNEKMSKSLGNF+ VHD++K  D Q++RFF+ +  YR
Sbjct:   240 AQSEALTGKTFAKYWLHNGYINIDNEKMSKSLGNFVLVHDIIKQHDPQLLRFFMLSVHYR  299

Query:   302 KPVNFTEKAVHDAEVNLKYLKNTF-----------NLPIQENANDEELEQFVKAFQGAMD  350
              P+N++E+ + +    LK +              NL  ++  E++E+  KAF+  MD
Sbjct:   300 HPINYSEELLENTKSAFSRLKTAYSNLQHRLNSSTNLTEDDDQWLEKVEEHRKAFEEEMD  359

Query:   351 DDFNTANGITVIFEMAKWIN--------SGHYTSRVKETFAELLEIFGI-VFQEEVLDAD  401
             DDFNTAN  I+V+F++AK  N         + H +    E F  ++ G  ++E+LD +
Sbjct:   360 DDFNTANAISVLFDLAKHANYYLQKDHTADHVITAFIEMFDRIVSVLGFSLGEQELLDQE  419
```

```
Query:  402 IESLIEQRQEARANRDFATADRIRDELAKQGIKLLDTKDGVRWTR         446
            IE LIE+R EAR NRDFA +D+IRD+L     I L DT  G RW R
Sbjct:  420 IEDLIEKRNEARRNRDFALSDQTRDQLKSMNIILEDTAQGTRWKR         464
```

A related DNA sequence was identified in *S. pyogenes* <SEQ ID 547> which encodes the amino acid sequence <SEQ ID 548>. Analysis of this protein sequence reveals the following:

Possible site: 46
>>> Seems to have no N-terminal signal sequence
----- Final Results -----
  bacterial cytoplasm --- Certainty = 0.1765 (Affirmative) <succ>
  bacterial membrane --- Certainty = 0.0000 (Not Clear) <succ>
  bacterial outside --- Certainty = 0.0000 (Not Clear) <succ>

Possible site: 53
>>> Seems to have no N-terminal signal sequence
----- Final Results -----
  bacterial cytoplasm --- Certainty = 0.0259 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below:

```
Identities = 357/447 (79%), Positives = 401/447 (88%)
Query:    1 MIKIYDTMTRSLQDFIPLNEGKVNMYVCGPTVYNYIHIGNARSVVAFDTIRRYFEYCGYQ    60
            MIKIYDTMTRSL+ F+PL E  VN+YVCGPTVYNYIHIGNARS VAFDTIRRYFEY GYQ
Sbjct:    1 MIKIYDTMTRSLRKFVPLTENTVNIYVCGPTVYNYIHIGNARSAVAFDTIRRYFEYTGYQ    60

Query:   61 VNYISNFTDVDDKIIKGAAEAGMDTKSFSDKFISAFMEDVAALGVKPATKNPRVIDYMDE   120
            VNYISNFTDVDDKIIK A +AG+   K  SD+FI+AF+ED  ALGVKPAT+NPRV DY+ E
Sbjct:   61 VNYISNFTDVDDKIIKAATQAGVSPKELSDRFIAAFIEDTKALGVKPATQNPRVMDYIAE   120

Query:  121 IIDFVKVLVDKEFAYEANGDVYFRVSKSHHYAKLANKTLEDLEIGASGRVDGEGEIKENP   180
            II FV+ L++K+FAYEA+GDVYFRV KS HYAKLANKTL +LE+GASGR D E  +KENP
Sbjct:  121 IISFVESLIEKDFAYEADGDVYFRVEKSEHYAKLANKTLSELEVGASGRTDAETALKENP   180

Query:  181 LDFALWKSAKSGEVSWESPWGKGRPGWHIECSVMATEILGDTIDIHGGGADLEFPHHTNE   240
            LDFALWKSAK+GEVSW+SPWG GRPGWHIECSVMATEILGDTIDIHGGGADLEFPHHTNE
Sbjct:  181 LDFALWKSAKAGEVSWDSPWGFGRPGWHIECSVMATEILGDTIDIHGGGADLEFPHHTNE   240

Query:  241 IAQSEAKTGKTFANYWMHNGFVNVDNEKMSKSLGNFITVHDMLKSVDGQVIRFFLATQQY   300
            IAQSEAKTGKTFANYWMHNGFV VDNEKMSKSLGNF+TVHDML++VDGQV+RFFLATQQY
Sbjct:  241 IAQSEAKTGKTFANYWMHNGFVTVDNEKMSKSLGNFVTVHDMLQTVDGQVLRFFLATQQY   300

Query:  301 RKPVNFTEKAVHDAEVNLKYLKNTFNLPIQENANDEELEQFVKAFQGAMDDDFNTANGIT   360
            RKP+NFTEK +HDAE+NLKYLKNT   P+  E A+++EL+QFV AFQ  AMDDDFNTANGIT
Sbjct:  301 RKPINFTEKTIHDAEINLKYLKNTLQQPLTETADEQELKQEVIAFQDAMDDDFNTANGIT   360

Query:  361 VIFEMAKWINSGHYTSRVKETFAELLEIEGIVFQEEVLDADIESLIEQRQEARANRDFAT   420
            V+F+MAKWINSG YT   VK  F ++L +FGI+F+EEVL+ DIE+LI +RQEARANRDFAT
Sbjct:  361 VVEDMAKWINSGSYTEPVKSAFEKMLAVEGIIFEEEVLEVDIEALIAKRQEARANRDFAT   420

Query:  421 ADRIRDELAKQGIKLLDTKDGVRWTRD                                  447
            AD IRD+LA QGIKLLDTKDGVRW RD
Sbjct:  421 ADAIRDQLAVQGIKLLDTKDGVRWLRD                                  447
```

Based on this analysis, it was predicted that these proteins and their epitopes could be useful antigens for vaccines or diagnostics.

Example 165

A DNA sequence (GBSx0171) was identified in *S. agalactiae* <SEQ ID 549> which encodes the amino acid sequence <SEQ ID 550>. Analysis of this protein sequence reveals the following:

A related GBS nucleic acid sequence <SEQ ID 9505> which encodes amino acid sequence <SEQ ID 9506> was also identified.

The protein has homology with the following sequences in the GENPEPT database:

```
>GP: CAB11871 GB: Z99104 similar to hypothetical proteins [Bacillus subtilis]
Identities = 58/122 (47%), Positives = 87/122 (70%)
Query:    3 DVRLINGIALAFEGDAVYSLYIRRHLIMQGFTKPNQLHRKATQYVSANAQALLINAMLEE    62
            D + +NG+ALA+ GDA++ +Y+R HL+ QGFTKPN LH+K+++ VSA +QA ++    +
Sbjct:    9 DSKQLNGLALAYIGDAIFEVYVRHHLLKQGFTKPNDLHKKSSRIVSAKSQAEILFFLQNQ    68
```

```
Query:  63 NILTDEEQLIYKRGRNANSHTKAKNADIITYRMSTGFEALMGYLDMTGQIKRLETLIQWC  122
           +  T+EE+ + KRGRNA S T  KN D+ TYR ST FEAL+GYL +  + +RL   L+
Sbjct:  69 SFFTEEEEAVLKRGRNAKSGTTPKNTDVQTYRSTAFEALLGYLFLEKKEERLSQLVAEA  128

Query: 123 IE  124
           I+
Sbjct: 129 IQ  130
```

A related DNA sequence was identified in *S. pyogenes* <SEQ ID 551> which encodes the amino acid sequence <SEQ ID 552>. Analysis of this protein sequence reveals the following:

Possible site: 56
>>> Seems to have no N-terminal signal sequence
----- Final Results -----
   bacterial membrane --- Certainty = 0.0000 (Not Clear) <succ>
    bacterial outside --- Certainty = 0.0000 (Not Clear) <succ>
      bacterial cytoplasm --- Certainty = 0.0000 (Not Clear) <succ>

An alignment of the GAS and GBS proteins is shown below:

```
Identities = 99/127 (77%), Positives = 111/127 (86%)
Query:    2 IDVRLINGIALAFEGDAVYSLYIRRHLIMQGFTKPNQLHRKATQYVSANAQALLINAMLE   61
            +DV LINGIALAFEGDAVYS Y+RRHLI QG TKP+QLHR AT+YVSA AQA LI AMLE
Sbjct:    5 VDVNLINGIALAFEGDAVYSYYVRRHLIFQGKTKPSQLHRLATRYVSAKAQANLIQAMLE   64

Query:   62 ENILTDEEQLIYKRGRNANSHTKAKNADIITYRMSTGFEALMGYLDMTGQIKRLETLIQW  121
            +LT++E+ IYKRGRN NSHTKAKNADIITYRMSTGFEA+MGYLDM GQ +RLE LI+W
Sbjct:   65 AQLLTEKEEDIYKRGRNTNSHTKAKNADIITYRMSTGFEAIMGYLDMMGQKERLEELIRW  124

Query:  122 CIETIEK  128
            CIE +EK
Sbjct:  125 CIEYVEK  131
```

Based on this analysis, it was predicted that these proteins and their epitopes could be useful antigens for vaccines or diagnostics.

Example 166

A DNA sequence (GBSx0172) was identified in *S. agalactiae* <SEQ ID 553> which encodes the amino acid sequence <SEQ ID 554>. This protein is predicted to be spoU rRNA methylase family protein. Analysis of this protein sequence reveals the following:

Possible site: 30
>>> Seems to have no N-terminal signal sequence
----- Final Results -----
   bacterial cytoplasm --- Certainty = 0.1478 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database:

```
>GP: CAB11872 GB: Z99104 similar to hypothetical proteins [Bacillus subtilis]
Identities = 113/244 (46%), Positives = 163/244 (66%), Gaps = 6/244 (2%)
Query:    11 ESSDLVYGLHAVTESLRANTG-NKLYLQDDLRGKNVDKVKALATEKKVSISWTPKKTLSD      69
             + D V G +AV E+L+++    KL++ ++     +V  LA ++ ++I + P+K L
Sbjct:     3 QQHDYVIGKNAVIETLKSDRKLYKLWMAENTVKGQAQQVIELAKKQGITIQYVPRKKLDQ      62

Query:    70 MTNGGVHQGFVLKVSEFAYADLSEIMTKAENE-ENPLILILDGLTDPHNLGSILRTADAT     128
             M  G  HQG V +V+ + YA+L ++   AE + E P  LILD L DPHNLGSI+RTADA
Sbjct:    63 MVTGQ-HQGVVAQVAAYEYAELDDLYKAAEEKNEQPFFLILDELEDPHNLGSIMRTADAV     121

Query:   129 NVTGIIIPKHRSVGVTPVVSKTSTGAVEHVPIARVTNLSQTLDTLKDKEFWIFGTDMNGT     188
                GI+IPK R+VG+T  V+K STGA+EH+P+ARVTNL++TL+ +K++  W+ GTD +
Sbjct:   122 GAHGIVIPKRRAVGLTTTVAKASTGAIEHIPVARVTNLARTLEEMKERGIWVVGTDASAR     181

Query:   189 PSHKWNTKGK--LALVIGNEGKGISHNIKKQVDEMITIPMNGHVQSLNASVAAAILMYEV     246
                + N G    LALVIG+EGKG+   +K++ D +I +PM G V SLNASVAA +LMYEV
Sbjct:   182 EDFR-NMDGNMPLALVIGSEGKGMGRLVKEKCDFLIKLPMAGKVTSLNASVAAGLLMYEV     240

Query:   247 FRNR                                                            250
             +R R
Sbjct:   241 YRKR                                                            244
```

A related DNA sequence was identified in *S. pyogenes* <SEQ ID 555> which encodes the amino acid sequence <SEQ ID 556>. Analysis of this protein sequence reveals the following:

Possible site: 36
>>> Seems to have no N-terminal signal sequence
----- Final Results -----
    bacterial cytoplasm --- Certainty = 0.1037 (Affirmative) <succ>
        bacterial membrane --- Certainty = 0.0000 (Not Clear) <succ>
        bacterial outside --- Certainty = 0.0000 (Not Clear) <succ>

An alignment of the GAS and GBS proteins is shown below:

```
Identities = 206/248 (83%), Positives = 225/248 (90%), Gaps = 1/248 (0%)
Query:     3 MKDKQFKEESSDLVYGLHAVTESLRANTGNKLYLQDDLRGKNVDKVKALATEKKVSISWT      62
             M+DK    E++D+VYG+HAVTESL+ANTGNKLY+Q+DLRGK VD +K+LAT+KKV+ISWT
Sbjct:    10 MEDKD-TIETNDIVYGVHAVTESLQANTGNKLYIQEDLRGKKVDNIKSLATQKKVAISWT      68

Query:    63 PKKTLSDMTNGGVHQGFVLKVSEFAYADLSEIMTKAENEENPLILILDGLTDPHNLGSIL     122
             PKKTLS MT+G VHQGFVL+VS FAY D+ EI+   AE E NPLILILDGLTDPHNLGSIL
Sbjct:    69 PKKTLSQMTDGAVHQGFVLRVSAFAYTDVDEILEIAEQEANPLILILDGLTDPHNLGSIL     128

Query:   123 RTADATNVTGIIIPKHRSVGVTPVVSKTSTGAVEHVPIARVTNLSQTLDTLKDKEFWIFG     182
             RTADATNV G+IIPKHRSVGVTPVVSKTSTGAVEH+PIARVTNLSQTLD LK + FWIFG
Sbjct:   129 RTADATNVCGVIIPKHRSVGVTPVVSKTSTGAVEHIPIARVTNLSQTLDKLKARGFWIFG     188

Query:   183 TDMNGTPSHKWNTKGKLALVIGNEGKGISHNIKKQVDEMITIPMNGHVQSLNASVAAAIL     242
             TDMNGTPS  WNT GKLALVIGNEGKGIS NIKKQVDEMITIPMNGHVQSLNASVAAAIL
Sbjct:   189 TDMNGTPSDCWNTNGKLALVIGNEGKGISTNIKKQVDEMITIPMNGHVQSLNASVAAAIL     248

Query:   243 MYEVFRNR                                                        250
             MYEVFRNR
Sbjct:   249 MYEVFRNR                                                        256
```

Based on this analysis, it was predicted that these proteins and their epitopes could be useful antigens for vaccines or diagnostics.

Example 167

A DNA sequence (GBSx0173) was identified in *S. agalactiae* <SEQ ID 557> which encodes the amino acid sequence <SEQ ID 558>. Analysis of this protein sequence reveals the following:

Possible site: 18
>>> Seems to have no N-terminal signal sequence
----- Final Results -----
    bacterial cytoplasm --- Certainty = 0.2187 (Affirmative) <succ>
        bacterial membrane --- Certainty = 0.0000 (Not Clear) <succ>
        bacterial outside --- Certainty = 0.0000 (Not Clear) <succ>

The protein has homology with the following sequences in the GENPEPT database:

```
>GP: CAB11873 GB: Z99104 similar to hypothetical proteins [Bacillus subtilis]
Identities = 67/147 (45%), Positives = 94/147 (63%), Gaps = 2/147 (1%)
Query:    6 ILLVDGYNMIAFWKDIRQLFKSNRLEEAREVLLRKLNHYAHFEHIDIICVFDAQYVPGVR    65
            ILLVDGYNMI W  + L K+N  EEAR+VL++K+ Y +   +I VFDA V G+
Sbjct:    3 ILLVDGYNMIGAWPQLKDL-KANSFEEARDVLIQKMAEYQSYTGNRVIVVFDAHLVKGLE    61

Query:   66 QRYDQYKISVIFTEEDETADSYIERAAAELNQSVLNLVSVATSDLNEQWTIFSQGALRVS   125
            ++   +++ VIFT+E+ETAD  IE+ A  LN ++   + VATSD  EQW IF QGALR S
Sbjct:   62 KKQTNHRVEVIFTKENETADERIEKLAQALN-NIATQIHVATSDYTEQWAIFGQGALRKS   120

Query:  126 ARELEQRVATVKSDLDKMSSQIDLSTP                                   152
            AREL + V T++  +++   +I    P
Sbjct:  121 ARELLREVETIERRIERRVRKITSEKP                                   147
```

A related DNA sequence was identified in *S. pyogenes* <SEQ ID 559> which encodes the amino acid sequence <SEQ ID 560>. Analysis of this protein sequence reveals the following:

Possible site: 46
>>> Seems to have no N-terminal signal sequence
----- Final Results -----
  bacterial cytoplasm --- Certainty = 0.2465 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below:

```
Identities = 130/167 (77%), Positives = 149/167 (88%), Gaps = 1/167 (0%)
Query:    3 KHSILLVDGYNMIAFWKDTRQLFKSNRLEEAREVLLRKLNHYAHFEHIDIICVFDAQYVP    62
            K  ILLVDGYNMIAFW+ TRQLFK+N+L++AR  LL KLNHYAHFE+I+IICVFDAQYVP
Sbjct:    2 KKRILLVDGYNMIAFWQSTRQLFKTNQLDQARNTLLTKLNHYAHFENINIICVFDAQYVP    61

Query:   63 GVRQRYDQYKISVIFTEEDETADSYIERAAAELNQSVLNLVSVATSDLNEQWTIFSQGAL   122
            G+RQRYDQY ISV+FTEEDETADSYIER AAELN +  +++V VATSDLNEQWTIFSQGAL
Sbjct:   62 GLRQRYDQYYISVVFTEEDETADSYIERMAAELN-TAIHMVEVATSDLNEQWTIFSQGAL   120

Query:  123 RVSARELEQRVATVKSDLDKMSSQIDLSTPKLRPWNDEQLGKLKDFL               169
            RV+ARELEQRV TVK+DLDKMS  IDL TPKLRP++  QL +LKDF+
Sbjct:  121 RVIARELEQRVHTVKADLDKMSRDIDLKTPKLRPFDQGQLIQLKDFM               167
```

Based on this analysis, it was predicted that these proteins and their epitopes could be useful antigens for vaccines or diagnostics.

Example 168

A DNA sequence (GBSx0174) was identified in *S. agalactiae* <SEQ ID 561> which encodes the amino acid sequence <SEQ ID 562>. Analysis of this protein sequence reveals the following:

Possible site: 58
>>> Seems to have no N-terminal signal sequence
----- Final Results -----
  bacterial cytoplasm --- Certainty = 0.4889 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database:

```
>GP: CAB12951 GB: Z99109 yitS [Bacillus subtilis]
Identities = 100/284 (35%), Positives = 157/284 (55%), Gaps = 6/284 (2%)
Query:    1 MTFKILTDSTSDLDEKWAQEHNVDIIGLTIELDGKTYETVGDEKITSDPLLERMQEGAKP    60
            MT  ++ DS +DL   + +E  +  I L + L  K +E         I +D + EMQ G  P
Sbjct:    1 MTVHLIADSATDLPRSYFEEKGIGFIPLRVSLGDKEFEDA--VTIHADQIFEAMQNGETP   58

Query:   61 TTSQINVGQFEEVFSTYAENDHALLYLALSSHLSGTYQSATIAREMVLDKYPDAQIEIVD  120
            TSQ +     + VF   YAE      LY+A SS LSGTYQ+A +     V +++PD  + ++D
Sbjct:   59 KTSQASPQTIKNVFLQYAETGDPALYIAFSSGLSGTYQTAVMIANEVKEEFPDFDLRVID  118

Query:  121 TMAASCGEGVLAMLATKERQEGKSLEEVKQKIESLLPKLNTYFLVDDLNHLMRSGRLSKG  180
              +  AS G G+    A        G +++E++    +++     +L    F VDDL +L R GR+SK
Sbjct:  119 SKCASLGYGLAVRHAADLCINGNTIQEIETSVKNECSQLEHIFTVDDLTYLARGGRISKT  178

Query:  181 AAIIGSVAKIKPLLKLDSEGKLVPFAKTRGRKKGIK---EIVTQATKTLSYSTLIIAYSG  237
            +A +G +  IKPLL+++ +GKLVP  K RG+KK  K    E++ +         S  T+ I+Y+
Sbjct:  179 SAFVGGLLNIKPLLQME-DGKLVPLEKIRGQKKLFKRIIELMKERGDDWSNQTVGISYAA  237

Query:  238 EKDSAQVMKEQLLADERIEEVIIRPLGPVISAHVGSGALALFSL                281
            K+  A   MK  +    +  +E+I+  P+     I +H G G LA+F L
Sbjct:  238 NKEKATDMKHLIEEAFKPKEIIMHPISSAIGSHAGPGTLAIFFL                281
```

A related DNA sequence was identified in *S. pyogenes* <SEQ ID 563> which encodes the amino acid sequence <SEQ ID 564>. Analysis of this protein sequence reveals the following:

Possible site: 18
>>> Seems to have no N-terminal signal sequence
----- Final Results -----
   bacterial cytoplasm --- Certainty = 0.3247 (Affirmative) <succ>
     bacterial membrane --- Certainty = 0.0000 (Not Clear) <succ>
     bacterial outside --- Certainty = 0.0000 (Not Clear) <succ>

An alignment of the GAS and GBS proteins is shown below:

```
Identities = 167/286 (58%), Positives = 227/286 (78%)
Query:    1 MTFKILTDSTSDLDEKWAQEHNVDIIGLTIELDGKTYETVGDEKITSDPLLERMQEGAKP    60
            MTF  I+TDST+DL++  WA++H++   +IGLTI    DG+  YETVG   +I+SD+LL++M+  G+  P
Sbjct:    1 MTFTIMTDSTADLNQTWAEDRDIVLIGLTILCDGEVYETVGPNRISSDYLLKKMKAGSHP   60

Query:   61 TTSQINVGQFEEVFSTYAENDHALLYLALSSHLSGTYQSATIAREMVLDKYPDAQIEIVD  120
             TSQINVG+FE+VF    +A N+   ALLYLA SS LSGTYQSA +AR++V +  YPDA   IEIVD
Sbjct:   61 QTSQINVGEFEKVFREHARNNKALLYLAFSSVLSGTYQSALMARDLVREDYPDAVIEIVD  120

Query:  121 TMAASCGEGVLAMLATKERQEGKSLEEVKQKIESLLPKLNTYFLVDDLNHLMRSGRLSKG  180
            T+AA+ GEG L  +LA  + R   GK+L  E  K   +E+++P+L  TYFLVDDL HLMR GRLSKG
Sbjct:  121 TLAAAGGEGYLTILAAEEARDSGKNLLETKDIVEAVIPRLRTYFLVDDLFHLMRGGRLSKG  180

Query:  181 AAIIGSVAKIKPLLKLDSEGKLVPFAKTRGRKKGIKEIVTQATKTLSYSTLIIAYSGEKD  240
            +A +GS+A  IKPLL  +D  EGKLVP AK RGR+K  IKE+V  Q    K  ++ ST+I++Y+  ++
Sbjct:  181 SAFLGSLASIKPLLWIDEEGKLVPIAKIRGRQKAIKEMVAQVEKDIADSTVIVSYTSDQG  240

Query:  241 SAQVMKEQLLADERIEEVIIRPLGPVISAHVGSGALALFSLGEENR               286
            SA+   ++E+LLA  E I  +V++  PLGPVISAHVG    LA+F  +G+ +R
Sbjct:  241 SAEKLREELLAHENISDVLMMPLGPVISAHVGPNTLAVFVIGQNSR              286
```

Based on this analysis, it was predicted that these proteins and their epitopes could be useful antigens for vaccines or diagnostics.

Example 169

A DNA sequence (GBSx0175) was identified in *S. agalactiae* <SEQ ID 565> which encodes the amino acid sequence <SEQ ID 566>. Analysis of this protein sequence reveals the following:

Possible site: 56
>>> Seems to have no N-terminal signal sequence
INTEGRAL    Likelihood = −8.76    Transmembrane 43-59 (40-62)
----- Final Results -----
   bacterial membrane --- Certainty = 0.4503 (Affirmative) <succ>
     bacterial outside --- Certainty = 0.0000 (Not Clear) <succ>
     bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 170

A DNA sequence (GBSx0176) was identified in *S. agalactiae* <SEQ ID 567> which encodes the amino acid sequence <SEQ ID 568>. This protein is predicted to be ribosomal protein L13 (rplM). Analysis of this protein sequence reveals the following:

```
Possible site: 55
>>> Seems to have no N-terminal signal sequence
----- Final Results -----
    bacterial cytoplasm --- Certainty = 0.3426 (Affirmative) <succ>
      bacterial membrane --- Certainty = 0.0000 (Not Clear) <succ>
        bacterial outside --- Certainty = 0.0000 (Not Clear) <succ>
```

A related GBS nucleic acid sequence <SEQ ID 9507> which encodes amino acid sequence <SEQ ID 9508> was also identified.

The protein has homology with the following sequences in the GENPEPT database:

```
>GP: BAB03887 GB: AP001507 ribosomal protein L13 [Bacillus halodurans]
Identities = 89/144 (61%), Positives = 113/144 (77%)
Query:    36 KTTFMAKPGQVERKWYVVDAADVPLGRLSAVVASVLRGKNKPTFTPHTDTGDFVIVINAE    95
             +TT+MAKP +VERKWYVVDA   LGRL++ VAS+LRGK+KPT+TPH DTGD VI+INAE
Sbjct:     2 RTTYMAKPNEVERKWYVVDAEGQTLGRLASEVASILRGKHKPTYTPHVDTGDHVIIINAE    61

Query:    96 KVKLTGKKASDKIYYTHSMYPGGLKQISAGELRSKNAVRLIEKSVKGMLPHNTLGRAQGM   155
             K+ LTG K  DKIYY HS +PGGLK+   A ++R+    +++E ++KGMLP NTLGR QGM
Sbjct:    62 KIHLTGNKLQDKIYYRHSGHPGGLKETRAADMRANKPEKMLELAIKGMLPKNTLGRKQGM   121

Query:   156 KLKVFVGGEHTHAAQQPEVLDISG                                      179
             KL V+ G EH H AQ+PEV ++ G
Sbjct:   122 KLHVYAGSEHKHQAQKPEVYELRG                                      145
```

A related DNA sequence was identified in *S. pyogenes* <SEQ ID 569> which encodes the amino acid sequence <SEQ ID 570>. Analysis of this protein sequence reveals the following:

```
Possible site: 57
>>> Seems to have no N-terminal signal sequence
----- Final Results -----
    bacterial cytoplasm --- Certainty = 0.4249 (Affirmative) <succ>
      bacterial membrane --- Certainty = 0.0000 (Not Clear) <succ>
        bacterial outside --- Certainty = 0.0000 (Not Clear) <succ>
```

An alignment of the GAS and GBS proteins is shown below:

```
Identities = 167/184 (90%), Positives = 171/184 (92%), Gaps = 4/184 (2%)

Query:     1 MFTPFVRPRNLSNTLVDRNIHT--CKQ-KRIRIGEIMNKTTFMAKPGQVERKWYVVDAAD    57
             +FTPF RPRNL NT D  H   CKQ  RIRIGEIMNKTTFMAKPGQVERKWYVVDAAD
Sbjct:     1 LFTPFERPRNLPNTF-DGTEHPSPCKQILRIRIGEIMNKTTFMAKPGQVERKWYVVDAAD    59

Query:    58 VPLGRLSAVVASVLRGKNKPTFTPHTDTGDFVIVINAEKVKLTGKKASDKIYYTHSMYPG   117
             VPLGRLSAVVASVLRGKNKPTFTPHTDTGDFVIVINAEKVELTGKKA+DK+YYTHSMYPG
Sbjct:    60 VPLGRLSAVVASVLRGKNKPTFTPHTDTGDFVIVINAEKVKLTGKKATDKVYYTHSMYPG   119

Query:   118 GLKQISAGELRSKNAVRLIEKSVKGMLPHNTLGRAQGMKLKVFVGGEHTHAAQQPEVLDI   177
             GLK I+AGELRSKNAVRLIEKSVKGMLPHNTLGRAQGMKLKVFVGGEHTHAAQQPEVLDI
Sbjct:   120 GLKSITAGELRSKNAVRLIEKSVKGMLPHNTLGRAQGMKLKVFVGGEHTHAAQQPEVLDI   179

Query:   178 SGLI                                                          181
             SGLI
Sbjct:   180 SGLI                                                          183
```

Based on this analysis, it was predicted that these proteins and their epitopes could be useful antigens for vaccines or diagnostics.

Example 171

A DNA sequence (GBSx0177) was identified in *S. agalactiae* <SEQ ID 571> which encodes the amino acid sequence <SEQ ID 572>. This protein is predicted to be 30S ribosomal protein S9 (rpsI). Analysis of this protein sequence reveals the following:

```
Possible site: 53
>>> Seems to have no N-terminal signal sequence
----- Final Results -----
    bacterial cytoplasm --- Certainty = 0.1761 (Affirmative) <succ>
      bacterial membrane --- Certainty = 0.0000 (Not Clear) <succ>
        bacterial outside --- Certainty = 0.0000 (Not Clear) <succ>
```

The protein has homology with the following sequences in the GENPEPT database:

```
>GP: CAB11926 GB: Z99104 ribosomal protein S9 [Bacillus subtilis]
Identities = 88/130 (67%), Positives = 105/130 (80%)
Query:     1 MAQAQYAGTGRRKNAVARVRLVPGTGKITINKKDVEEYIPHADLRLVINQPFAVTSTQGS    60
             MAQ QY GTGRRK++VARVRLVPG G+I +N +++ E+IP A L   I QP  +T T G+
Sbjct:     1 MAQVQYYGTGRRKSSVARVRLVPGEGRIVVNNREISEHIPSAALIEDIKQPLTLTETAGT    60

Query:    61 YDVFVNVVGGGYAGQSGAIRHGISRALLEVDPDFRDSLKRAGLLTRDARMVERKKPGLKK   120
             YDV VNV GGG +GQ+GAIRHGI+RALLE DP++FR +LKRAGLLTRDARM ERKK GLK
Sbjct:    61 YDVLVNVHGGGLSGQAGAIRHGIARALLEADPEYRTTLKRAGLLTRDARMKERKKYGLKG   120

Query:   121 ARKASQFSKR                                                    130
             AR+A QFSKR
Sbjct:   121 ARRAPQFSKR                                                    130
```

A related DNA sequence was identified in *S. pyogenes* <SEQ ID 573> which encodes the amino acid sequence <SEQ ID 574>. Analysis of this protein sequence reveals the following:

Possible site: 56
>>> Seems to have no N-terminal signal sequence
----- Final Results -----
   bacterial cytoplasm --- Certainty = 0.1865 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below:

```
Identities = 124/130 (95%), Positives = 129/130 (98%)
Query:     1 MAQAQYAGTGRRKNAVARVRLVPGTGKITINKKDVEEYIPHADLRLVINQPFAVTSTQGS    60
             MAQAQYAGTGRRKNAVARVRLVPGTGKIT+NKKDVEEYIPHADLRL+INQPFAVTST+GS
Sbjct:     1 MAQAQYAGTGRRKNAVARVRLVPGTGKITVNKKDVEEYIPHADLRLIINQPFAVTSTEGS    60

Query:    61 YDVFVNVVGGGYAGQSGAIRHGISRALLEVDPDFRDSLKRAGLLTRDARMVERKKPGLKK   120
             YDVFVNVVGGGY GQSGAIRHGI+RALL+VDPDFRDSLKRAGLLTRDARMVERKKPGLKK
Sbjct:    61 YDVFVNVVGGGYGGQSGAIREGIARALLQVDPDFRDSLKRAGLLTRDARMVERKKPGLKK   120

Query:   121 ARKASQFSKR                                                    130
             ARKASQFSKR
Sbjct:   121 ARKASQFSKR                                                    130
```

Based on this analysis, it was predicted that these proteins and their epitopes could be useful antigens for vaccines or diagnostics.

Example 172

A DNA sequence (GBSx0178) was identified in *S. agalactiae* <SEQ ID 575> which encodes the amino acid sequence <SEQ ID 576>. This protein is predicted to be recombinase (b1345). Analysis of this protein sequence reveals the following:

Possible site: 43
>>> Seems to have no N-terminal signal sequence
----- Final Results -----
   bacterial cytoplasm --- Certainty = 0.1939 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database:

```
>GP: AAG29618 GB: AF217235 integrase-like protein [Staphylococcus
aureus]
Identities = 127/386 (32%), Positives = 205/386 (52%), Gaps = 18/386 (4%)
Query:     3 IHKYPSKKAKNGYLYFVKIYMVKD---SQRADHIKRGFRTRKEAKDYEARLIYLKASGKL    59
             I KY K     Y++    Y+ D    ++     +RGF+T +EAK  EA+L   +
Sbjct:     2 IKKYKKKDGSTAYMFVA--YLGTDPITGKQKRTTRRGFKTEREAKIAEAKL---QTEVSQ    56

Query:    60 EEFIKPTHKTYNEIFEKWYQAYQDMVEPTTASRTLDMFRLHILPVMGDLPISKISPLDCQ   119
             F+     T+ E++E W + YQ+ V  +T  R L +F    IL    D+PI KI+   CQ
Sbjct:    57 NGFLNNDITTFKEVYELWLEQYQNTVRESTYQRVLTLFDTAILEHFQDVPIKKITVPYCQ   116

Query:   120 NFITDKAKTFKNIKQIKSYTGKVFDFAIKMKLLKHNPMAEIIMPKRKKTRIE---NYWTV   176
             I    K  +IK I+ YT   VF  +A+  +K++     NP A     P++K+ + +   Y++
```

```
-continued
Sbjct:  117  KVINKWNKKYSDIKAIRIYTSNVFKYAVSLKIIVDNPFAHTKAPRKKEAQQDASTKYYSS    176

Query:  177  QELQEFLAIVLQEEPYKHYALFRLLAYSGLRKGELYALKWADIDFQTETLSVDKSLGR-L    235
             EL++FL   V   E+    +YA+FR LA++G R+GEL AL W DIDF +T+S++K+   R
Sbjct:  177  DELKQFLTFV--EDDPLYYAIFRTLAFTGFRRGELMALTWNDIDFTKQTISINKTCARGA    234

Query:  236  DGQAIEKGTKNDFSVRKIKLDSETISILQEWKSISQKEKAQLAVAPLSIEQDFLFTYCTR    295
             + + + +   K    S R I +D +T S+L+ W++   + E   +      S +   +FT
Sbjct:  235  NYKLVIQEPKTKSSHRTISIDDKTASVLKSWRTHQRVESLKYG-HNTSDKHQHVFTTVRD    293

Query:  296  SGSIEPLHADYINNVLSRIIRKHGLKKISPHGFRHTHATLMIEIGVDPVNTAKRLGHASS    355
             +   +PL+ ++ N   L   I   K+    K+I  HGFRHTH +L+  E G+         RLGH
Sbjct:  294  N---KPLYPEHCNKALDLICEKNSFKRIKVHGFRHTHCSLLFEAGLSIQEVQDRLGHGDI    350

Query:  356  QMTLDTYSHSTTTGEDRSVKQFADYL                                     381
             + T+D Y+H T     D+   +FA Y+
Sbjct:  351  KTTMDIYAHVTEKQRDQVADKFAKYI                                     376
```

A related DNA sequence was identified in *S. pyogenes* <SEQ ID 577> which encodes the amino acid sequence <SEQ ID 578>. Analysis of this protein sequence reveals the following:

---

Possible site: 39
>>> Seems to have no N-terminal signal sequence
----- Final Results -----
bacterial cytoplasm --- Certainty = 0.3445 (Affirmative) <succ>
bacterial membrane --- Certainty = 0.0000 (Not Clear) <succ>
bacterial outside --- Certainty = 0.0000 (Not Clear) <succ>

---

An alignment of the GAS and GBS proteins is shown below:

Based on this analysis, it was predicted that these proteins and their epitopes could be useful antigens for vaccines or diagnostics.

Example 173

A DNA sequence (GBSx0179) was identified in *S. agalactiae* <SEQ ID 579> which encodes the amino acid sequence <SEQ ID 580>. Analysis of this protein sequence reveals the following:

---

Possible site: 61
>>> Seems to have no N-terminal signal sequence

---

```
Identities = 109/386 (28%), Positives = 185/386 (47%), Gaps = 28/386 (7%)

Query:    3  IHKYPSKKAKNGYL-YFVKIYMVKDSQRADHIKRGF--RTRKEA--KDYEARLIYLKASG    57
             I K      K KNG + Y     IY+   D      +K      RTRKE    K    A+  +L
Sbjct:    6  IMKITEHKKKNGTIVYRASIYLGIDQMTGKRVKTSITGRTRKEVNQKAKHAQFDFLSNGS    65

Query:   58  KLEEFIKPTHKTYNEIFEKWYQAYQDMVEPTTASRTLDMFRLHILPVMGDLPISKISPLD   117
             ++    K    KT+ E+     W + Y+   V+P T    T+       HI+P +G++ +   KI+  D
Sbjct:   66  TIKR--KVVIKTFKELSHLWLETYKLTVKPQTYDATVTRLNRHIMPTLGNMKVDKITASD   123

Query:  118  CQNFITDKAKTFKNIKQIKSYTGKVFDFAIKMKLLKHNPMAEIIMPKRK---KTRIENYW   174
              Q  I     +K + N   ++S   KV    + + L+ +N     +II+P+++       K +++ +
Sbjct:  124  IQMLINRLSKYYVNYTAVRSVIRKVLQQGVLLGLIDYNSARDIILPRKQPNAKKKVK-FI   182

Query:  175  TVQELQEFLAIVLQEEPYKHY------ALFRLLAYSGLRKGELYALKWADIDFQTETLSV   228
              +L+ FL    L+    +K Y        L++LL  +GLR GE   AL+W DID +   T+++
Sbjct:  183  DPSDLKSFLE-HLETSQHKRYNLYFDAVLYQLLLSTGLRIGEACALEWGDIDLENGTIAI   241

Query:  229  DKSLGRLDGQAIEKGTKNDFSVRKIKLDSETISILQEWKSISQKEKAQLAVAPLSIEQDF   288
             +K+  +            K     R I +D +T   L+     + Q   + QL       +       +
Sbjct:  242  NKTYNK--NLKFLSTAKTQSGNRVISVDKKTLRSLK----LYQMRQRQLFNEVGARVSEV   295

Query:  289  LFTYCTRSGSIEPLHADYINNVLSRIIRKHGLKKISPHGFRHTHATLMIEIGVDPVNTAK   348
             +F    TR   +    +A      + L     ++ G+++     H  FRHTHA+L++    G+
Sbjct:  296  VFATPTR----KYFNASVRQSALDTRCKEAGIERFTFHAFRHTHASLLLNAGISYKELQY   351

Query:  349  RLGHASSQMTLDTYSHSTTTGEDRSV                                     374
             RLGHA+   MTLDTY H +    E   +V
Sbjct:  352  RLGHANISMTLDTYGHLSKGKEKEAV                                     377
```

```
----- Final Results -----
    bacterial cytoplasm --- Certainty = 0.2477 (Affirmative) <succ>
       bacterial membrane --- Certainty = 0.0000 (Not Clear) <succ>
          bacterial outside --- Certainty = 0.0000 (Not Clear) <succ>
```

The protein has homology with the following sequences in the GENPEPT database:

```
>GP: AAF63067 GB: AF158600 putative DNA binding protein
[Streptococcus thermophilus bacteriophage Sfi11]
Identities = 32/70 (45%), Positives = 46/70 (65%), Gaps = 3/70 (4%)
Query:    3 NRLKELRKDKGLTQADLAKVINTNQSQYGKYENGKTSLSIENSKILADFFGVSIPYLLGL  62
            NRL  LR+ + +T+ +LA+ I  ++    K E+G + +S   +K LADFFGVS+ YLLGL
Sbjct:    2 NRLYLLRESRKITRVELAEKIGVSKLTVLKLEHGTSKISRREAKKLADFFGVSVGYLLGL  61

Query:   63 D---NNSKIA                                                   69
            D   N+S IA
Sbjct:   62 DTTENDSLIA                                                   71
```

A related DNA sequence was identified in S. pyogenes <SEQ ID 581> which encodes the amino acid sequence <SEQ ID 582>. Analysis of this protein sequence reveals the following:

```
Possible site: 30
>>> Seems to have no N-terminal signal sequence
----- Final Results -----
    bacterial cytoplasm --- Certainty = 0.0680 (Affirmative) <succ>
       bacterial membrane --- Certainty = 0.0000 (Not Clear) <succ>
          bacterial outside --- Certainty = 0.0000 (Not Clear) <succ>
```

An alignment of the GAS and GBS proteins is shown below:

```
Identities = 21/61 (34%), Positives = 34/61 (55%)
Query:    1 MYNRLKELRKDKGLTQADLAKVINTNQSQYGKYENGKTSLSIENSKILADFFGVSIPYLL  60
            MY R++ LR+D   TQ  +A +++ + + Y K E G+ +L  +        + VSI YLL
Sbjct:    1 MYPRIRNLREDNDFTQKFVANLLSFSHANYAKIERGEVALMADVLVQFYKLYNVSIDYLL  60

Query:   61 G                                                            61
            G
Sbjct:   61 G                                                            61
```

Based on this analysis, it was predicted that these proteins and their epitopes could be useful antigens for vaccines or diagnostics.

Example 174

A DNA sequence (GBSx0180) was identified in S. agalactiae <SEQ ID 583> which encodes the amino acid sequence <SEQ ID 584>. Analysis of this protein sequence reveals the following:

```
Possible site: 29
>>> Seems to have no N-terminal signal sequence
----- Final Results -----
    bacterial cytoplasm --- Certainty = 0.5278 (Affirmative) <succ>
       bacterial membrane --- Certainty = 0.0000 (Not Clear) <succ>
          bacterial outside --- Certainty = 0.0000 (Not Clear) <succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 175

A DNA sequence (GBSx0181) was identified in S. agalactiae <SEQ ID 585> which encodes the amino acid sequence <SEQ ID 586>. Analysis of this protein sequence reveals the following:

```
Possible site: 60
>>> Seems to have no N-terminal signal sequence
----- Final Results -----
    bacterial cytoplasm --- Certainty = 0.3762 (Affirmative) <succ>
       bacterial membrane --- Certainty = 0.0000 (Not Clear) <succ>
          bacterial outside --- Certainty = 0.0000 (Not Clear) <succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 176

A DNA sequence (GBSx0182) was identified in S. agalactiae <SEQ ID 587> which encodes the amino acid sequence <SEQ ID 588>. Analysis of this protein sequence reveals the following:

```
Possible site: 59
>>> Seems to have no N-terminal signal sequence
INTEGRAL     Likelihood = -9.66    Transmembrane 40-56 (33-65)
INTEGRAL     Likelihood = -5.79    Transmembrane 62-78 (59-81)
----- Final Results -----
    bacterial membrane --- Certainty = 0.4864 (Affirmative) <succ>
       bacterial outside --- Certainty = 0.0000 (Not Clear) <succ>
          bacterial cytoplasm --- Certainty = 0.0000 (Not Clear) <succ>
```

No corresponding DNA sequence was identified in *S. pyogenes*.

A related GBS gene <SEQ ID 8505> and protein <SEQ ID 8506> were also identified. Analysis of this protein sequence reveals the following:

---

Lipop: Possible site: −1 Crend: 7
McG: Discrim Score: −16.96
GvH: Signal Score (−7.5): −2.95
Possible site: 57
\>>> Seems to have no N-terminal signal sequence
ALOM program count: 2 value: −9.66 threshold: 0.0
INTEGRAL    Likelihood = −9.66    Transmembrane 33-49 (26-58)
INTEGRAL    Likelihood = −5.79    Transmembrane 55-71 (52-74)
PERIPHERAL  Likelihood = 10.87    14
modified ALOM score: 2.43
*** Reasoning Step: 3
----- Final Results -----
   bacterial membrane --- Certainty = 0.4864 (Affirmative) <succ>
      bacterial outside --- Certainty = 0.0000 (Not Clear) <succ>
         bacterial cytoplasm --- Certainty = 0.0000 (Not Clear) <succ>

---

Based on this analysis, it was predicted that this protein and its epitopes, could be useful antigens for vaccines or diagnostics.

Example 178

A DNA sequence (GBSx0184) was identified in *S. agalactiae* <SEQ ID 591> which encodes the amino acid sequence <SEQ ID 592>. Analysis of this protein sequence reveals the following:

---

Possible site: 44
\>>> Seems to have no N-terminal signal sequence
----- Final Results -----
   bacterial cytoplasm --- Certainty = 0.3482 (Affirmative) <succ>
      bacterial membrane --- Certainty = 0.0000 (Not Clear) <succ>
         bacterial outside --- Certainty = 0.0000 (Not Clear) <succ>

---

A related GBS nucleic acid sequence <SEQ ID 9509> which encodes amino acid sequence <SEQ ID 9510> was also identified.

The protein has homology with the following sequences in the GENPEPT database:

```
>GP: CAA30291 GB: X07371 RepM protein (AA 1-314) [Staphylococcus
aureus]
Identities = 89/283 (31%), Positives = 145/283 (50%), Gaps = 26/283 (9%)
Query:   67 KVSLDNITMTAYIKSKKYLAMKQLIETHLAITVQTAMTDMFRATTGDGIHVVLHMNYDKQ  126
            K+S D +T+      +    +    I +   +    F+A      +   +++ YDK
Sbjct:   42 KLSFDAMTIVGNLNKNSAKKLSDFMSLDPQIRLWDILQTKFKAKA---LQEKVYIEYDKV   98

Query:  127 KGQDRKARPFRLEFNPNKLRLVDSEII---DTIIPFLEDISISRADLAFDLFEVDCSEF-  182
            K     R  R+EFNPNKL    E++     II ++ED    +R DLAFD FE D S++
Sbjct:   99 KADTWDRRNMRVEFNPNKL--THDEMLWLKHNIIDYMEDDGFTRLDLAFD-FEDDLSDYY  155

Query:  183 -VLEKKGRPTATKEFRSSTGTLETKYLGAPRSEKQVRLYNKKKEQLQNGTDKDKDFASQF  241
             + EK + T     F  +TG  ETKY G+  S + +R+YNKKKE+ +N    D D +++
Sbjct:  156 ALSEKALKRTV---FFGTTGKAETKYFGSRDSNRFIRIYNKKKERKENA---DVDVSAE-  208

Query:  242 KHWWRLEFQLRSRSIDEIFEVI-DTIIFKP--FNLKGLSIETQIYLTALIHDKNIWKKLH  298
             H WR+E +L+    +D      D  I KP    L+ L   + +YL  L+H+++ W +LH
Sbjct:  209 -HLWRVEIELKRDMVDYWNNCFNDLHILKPAWATLESLKEQAMVYL--LLHEESKWGELH  265

Query:  299 RNTRARYKKILETHQTSDTDYLGLLKDLLKHERPRLENQLAYY                  341
            RN+R +YK+I++  + S D  L+K L    L+ Q+ ++
Sbjct:  266 RNSRRKYKQIIQ--EISSIDLTDLMKSTLTDNEENLQKQINFW                  306
```

Based on this analysis, it was predicted that these proteins and their epitopes could be useful antigens for vaccines or diagnostics.

Example 177

A DNA sequence (GBSx0183) was identified in *S. agalactiae* <SEQ ID 589> which encodes the amino acid sequence <SEQ ID 590>. Analysis of this protein sequence reveals the following:

---

Possible site: 31
\>>> Seems to have no N-terminal signal sequence
----- Final Results -----
   bacterial cytoplasm --- Certainty = 0.3276 (Affirmative) <succ>
      bacterial membrane --- Certainty = 0.0000 (Not Clear) <succ>
         bacterial outside --- Certainty = 0.0000 (Not Clear) <succ>

---

The protein has no significant homology with any sequences in the GENPEPT database.

No corresponding DNA sequence was identified in *S. pyogenes*.

No corresponding DNA sequence was identified in *S. pyogenes*.

Based on this analysis, it was predicted that these proteins and their epitopes could be useful antigens for vaccines or diagnostics.

Example 179

A DNA sequence (GBSx0185) was identified in *S. agalactiae* <SEQ ID 593> which encodes the amino acid sequence <SEQ ID 594>. Analysis of this protein sequence reveals the following:

---

Possible site: 32
\>>> Seems to have no N-terminal signal sequence
INTEGRAL    Likelihood = −15.55   Transmembrane 137-153 (133-157)
----- Final Results -----
   bacterial membrane--- Certainty = 0.7220 (Affirmative) <succ>
      bacterial outside --- Certainty = 0.0000 (Not Clear) <succ>
         bacterial cytoplasm --- Certainty = 0.0000 (Not Clear) <succ>

A related GBS nucleic acid sequence <SEQ ID 9511> which encodes amino acid sequence <SEQ ID 9512> was also identified.

The protein has no significant homology with any sequences in the GENPEPT database.

No corresponding DNA sequence was identified in S. pyogenes.

A related GBS gene <SEQ ID 8507> and protein <SEQ ID 8508> were also identified. Analysis of this protein sequence reveals the following:

---

Lipop: Possible site: −1 Crend: 2
McG: Discrim Score: −16.84
GvH: Signal Score (−7.5): −5.3
Possible site: 32
>>> Seems to have no N-terminal signal sequence
ALOM program count: 1 value: −15.55 threshold: 0.0
INTEGRAL    Likelihood = −15.55   Transmembrane 137-153 (133-157)
PERIPHERAL  Likelihood = 10.93    60
modified ALOM score: 3.61
*** Reasoning Step: 3
----- Final Results -----
   bacterial membrane --- Certainty = 0.7220 (Affirmative) <succ>
      bacterial outside --- Certainty = 0.0000 (Not Clear) <succ>
         bacterial cytoplasm --- Certainty = 0.0000 (Not Clear) <succ>

---

Figure 76:
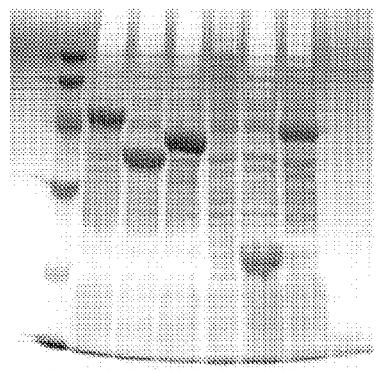

The protein has homology with the following sequences in the databases:

SEQ ID 8508 (GBS405) was expressed in E. coli as a GST-fusion product. SDS-PAGE analysis of total cell extract is shown in FIG. 171 (lane 4; MW 46 kDa—2 bands) and in FIG. 177 (lane 7; MW 46 kDa). It was also expressed in E. coli as a His-fusion product. SDS-PAGE analysis of total cell extract is shown in FIG. 76 (lane 5; MW 21 kDa).

GBS405-GST was purified as shown in FIG. 218, lane 8.

Based on this analysis, it was predicted that these proteins and their epitopes could be useful antigens for vaccines or diagnostics.

Example 180

A DNA sequence (GBSx0186) was identified in S. agalactiae <SEQ ID 595> which encodes the amino acid sequence <SEQ ID 596>. Analysis of this protein sequence reveals the following:

---

Possible site: 18
>>> Seems to have no N-terminal signal sequence
----- Final Results -----
   bacterial cytoplasm --- Certainty = 0.3406 (Affirmative) <succ>
      bacterial membrane --- Certainty = 0.0000 (Not Clear) <succ>
         bacterial outside --- Certainty = 0.0000 (Not Clear) <succ>

---

The protein has homology with the following sequences in the GENPEPT database:

---

```
ORF01844(292-702 of 1074)

EGAD|124517|132830(149-295 of 435) apolipoprotein A-IV {Mus musculus}

GP|191889|gb|AAA37216.1||M64250 apolipoprotein A-IV {Mus musculus castaneus}

% Match = 4.6

% Identity = 30.0 % Similarity = 54.6

Matches = 39 Mismatches = 53 Conservative Sub.s = 32

201       231       261       291       321       351       381       411
        NSSNIRY*LFRFAERLVEA*KTKTRKSARLLWG*DRQK*LSTLLLKIQYYQGVTRSKMRIKDYADSLGVSSQSIYKRIRS
                    : |:|       : |  :  ||:  |:|   |    :   ::
        LRDRMMPHANKVTQTFGENMQKLQEHLKPYAVDLQDQINTQTQEMKLQLTPYIQRMQTTIKENVDNLHTSMMPLATNLKD
           120       130       140       150       160       170       180

435       462       492       522       552       570
        P--KYKERLKGHLY-RDNQKVENLDLIGIKILEDYHFENDVIELEKTLGD----IQEEFEQEKKGMQY------------
        :  |||||  | |:    :|          ::  :| ::|         :||:: :: :|: :
        KFNRNMEELKGHLTPRANELKATID------------QNLEDLRRSLAPLTVGVQEKLNHQMEGLAFQMKKNAEELQTK
           200       210                  220       230       240       250

615       645       672       702       732       762       792       822
        ---RIDRLADKLTPLLEDNQNLVQKNYE-LLNYVRSLERQKLLLIIALAVMVITLLVAIWLAIF*WQLSDNAKRPTKGTA
        :||:|   |  ||:||  |: |  |      :: |  ||
        VSAKIDQLQKNLAPLVEDVQSKVKGNTEGLQKSLKDLNRQLEQQVEEFRRTVEPMGEMFNKALVQQLEQFRQQLGPNSGE
           270       280       290       300       310       320       330
```

```
>GP: CAA33713 GB: X15669 pre protein (AA 1-494) [Streptococcus
agalactiae]
Identities = 171/402 (42%), Positives = 250/402 (61%), Gaps = 46/402 (11%)
Query:    1 MSYVVARMAKYKSGQLTAIYNHNERIFKNHSNKEIDVEKSHLNYELTNRDQAQNYHKQIK    60
            MSY+VARM K K+G L    + HNER+F+ HSNK+I+   +SHLNYELT+RD++ +Y KQIK
Sbjct:    1 MSYMVARMQKMKAGNLGGAFKHNERVFETHSNKDINPSRSHLNYELTDRDRSVSYEKQIK    60

Query:   61 EHINENRLSTRGVRKDAILCNEWIITSDKTFEDSLDEKQTREFFETAKDYFAEKYGDANI   120
            +++NEN++S R +RKDA+LC+EWIITSDK FF+ LDE+QTR FFETAK+YFAE YG++NI
Sbjct:   61 DYVNENKVSNRAIRKDAVLCDEWIITSDKDFFEKLDEEQTRTFFETAKNYFAENYGESNI   120

Query:  121 AYARVHLDESTPHMHLGIVPMKNGKLSSKALFGNKEKLVAIQDELPKYLNEHGFNLQRGE   180
            AYA VHLDESTPHMH+G+VP +NGKLSSKA+F  ++E+L   IQ++LP+Y+++HGF L+RG+
Sbjct:  121 AYASVHLDESTPHMHMGVVPFENGKLSSKAMF-DREELKHIQEDLPRYMSDHGFELERGK   179

Query:  181 IGSKKKHLETAEFKEKQRLLDNADRKLADKHEELKALDDKISNV-NDTIA----------   229
            + S+ KH    AEFK    ++    +L +K+    +D++   + NDT A
Sbjct:  180 LNSEAKHKTVAEFKRAMADME-LKEELLEKYHAPPFVDERTGELNNDTEAFWHEKEFADM   238

Query:  230 -DKESRLKEL---EAKEWDAVGDLKQYELEKQSLAESIEDIKDIELLQLDRIQKEDLVKQ   285
             + +S ++E    E   +W    KQY+ E + L  S + ++D      D    E+L+ +
Sbjct:  239 FEVQSPIRETTNQEKMDWLR----KQYQEELKKLESSKKPLED------DLSHLEELLDK   288

Query:  286 SFDGKLKMDKETYNRLFQTASKHASSNAELKRDLVKAQSQNNHLSRELLNHRKTAEKNIK   345
              +K+D E         AS+ AS      +L KA+   N L    NH K+ E   I+
Sbjct:  289 KTKEYIKIDSE--------ASERAS-------ELSKAEGYINTLE----NHSKSLEAKIE   329

Query:  346 LSQENRKLKDKVKMLDEQVKILNKSLSVWKEKAKEFMPKQVY                    387
            + +        +K K     + K LN+S     +   K F+ K+ Y
Sbjct:  330 CLESDNLQLEKQKATKLEAKALNESELRELKPKKNFLGKEHY                    371
```

A related DNA sequence was identified in *S. pyogenes* <SEQ ID 597> which encodes the amino acid sequence <SEQ ID 598>. Analysis of this protein sequence reveals the following:

LPXTG motif: 2025-2030
Possible site: 52
>>> Seems to have no N-terminal signal sequence
INTEGRAL    Likelihood = -10.08    Transmembrane 2034-2050

(2030-2053)
INTEGRAL    Likelihood = -6.05    Transmembrane 21-37 (20-39)
----- Final Results -----
bacterial membrane --- Certainty = 0.5034 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the databases:

```
>GP: AAD03320 GB: AF067776 extracellular matrix binding protein
[Abiotrophia defective]
Identities = 362/1396 (25%), Positives = 591/1396 (41%), Gaps = 87/1396 (6%)
Query:  636 KAEVKLKEAHEATKQAIEKDPWLSPEQKKAQKEKAKARLDEGLKALKAADSLEILKVTEE   695
            +A+ +   A +A    AI+ +   L+ E+K A+K K +A + L   A      K T
Sbjct:  636 EAKNAVNNAAKAKNTAIDNNNNLTAEEKAAEKAKVEAAKNATLAGIDQA------KTTAA   689

Query:  696 AFVDKEKNPDSIPNQHKAGTADQARKQALDSLDKEVQKELESIDNDNTLTTDEKAAAKKK   755
               + K   I    +      A   AL+    +    ++ I      LT +EK A    +
Sbjct:  690 RNAAQNKGTTDINAVNPVPVAKPAANAALE---QAAVNKINEISQRPDLTREEKQAFMDQ   746

Query:  756 VNDAYDVAKQTAMEANSYEDLTTIKDEFLS---NLPHKQGTPLKDQQSDAIAELEKKQQE   812
            V  A D A    A  + +T+ +D+ L+   NLP   TP   +A+ +  +
Sbjct:  747 VRTARDAAMAKVASAANNQAVTSARDQGLNAVNNLP----TPAA-KYPEALGHVRQAADA   801

Query:  813 IEKAIEGDKTLPRDEKEKQIADSKERLKSDTQKVKDAKNADAIKKAFEEGKVNIPQAHIP   872
             +AI + L +E+    +     +    + KA +G I
Sbjct:  802 KRQAIRDNANLTAEEQADALRQVDAAQTAEEAAINQNHTNATLAKADSDGVKAI------   855

Query:  873 GDLN---KDKEKLLAELKQKADDTEKAIDVDKTLTEDEKKEQKVKTKAELEKAKTDVKNT   929
            D+N  + K    L+Q A    +AI+ +  LT++EK +     L  AKT V+
Sbjct:  856 NDINPQPRSKPAANQALEQVAAAKRQAINNNQLTDEEKAQAIQQVDQALANAKTQVQAA   915

Query:  930 QTREELDKKVPELKKAIEDTHVKGNLEGVKNKAIEDLKKAHTETVAKINGDDTLDKATKE   989
            +++        AI + + +G     K +AI ++  A     ++ G + L        +
Sbjct:  916 NDNNGVNQAKTAGTTAINNINPQGTQ---KAQAIAAIEAAEQAKRLELQGRNDLTTEERN   972

Query:  990 AQVKEADKALAAGKDAITKADDADKVSTAVTEHTPKIKAAHKTGDLKKAQVDANTALDKA   1049
            + +       A KDA+ +A   V+ A        +I+   + T    +K  DA  A+D+A
Sbjct:  973 NALADLTAKAQAAKDAVNQARNNTGVAGARDNGVAQIQGINPTAVVKP---DARNAIDQA   1029

Query: 1050 AEKERGEINKDATLTTEDKAKQLKEVETALTKAKDNVKAAKTADAAINDARDKGVATIDAV   1109
             A  + E  + LT E+KA  +K+V+ A   AK  + A     +N+A ++G A I A+
```

-continued

```
Sbjct: 1030 ARDKEAEFQANTKLTDEEKAAAIKKVQDAARDAKAAIDRAGSNGDVNNAVNQGKAAIQAI 1089

Query: 1110 HKAGQDLGARKSGQVAKLEEAAKATKDKISADPTLTSKEKEEQSKAVDAELKKAIEAVNA 1169
              + K    A ++ AA A K  I+A+  LT +EK    K V+ E  KA AV+A
Sbjct: 1090 KALDDSQPSAKDTAKAAIQNAADAKKAAITANNALTQEEKAAAIKQVEDEAAKAQAAVDA 1149

Query: 1170 ADTADKVDDALGEGVTDIKNQHKSGDSIDARREAHGKELDRVAQETKGAIEKDPTLTTEE 1229
              + +   VD A +G+ I +      ++   +    +D+ A + K I  D TLT EE
Sbjct: 1150 SRSKADVDRAKDQGLQKISDV----PAVQPPKLNAIAAVDQAATDKKAVINNDTTLTQEE 1205

Query: 1230 KAKQVKDVDAAKERGMAKLNEAKDADALDKAYGEGVTDIKNQHKSGDPVDARRGLHNKSI 1289
              K  ++ VD +    +N+A +      +G  I N ++    A +           ++
Sbjct: 1206 KEAAIRKVDEEEAAKARQAINDATSNADVAAKQAQGTQAINNVPQT----PAAKNAAKAAV 1261

Query: 1290 DEVAQATKDAITADTTLTEAEKETQRGNVDKEATKAKEELAKAKDADALDKAYGDGVTSI 1349
              ++ A A K AI D  LT EK+     VD+E KA++ + A   +      +G +I
Sbjct: 1262 EQAADAKKQAIENDPNLTRQEKDAAIAKVDQETNKARQAIDAATTNADVTAKQNEGTQAI 1321

Query: 1350 KNQHKSGKGLDVRKDEHKKALEAVAKRVTAEIEADPTLTPEVREQQKAEVQKELELATDK 1409
              ++ K    K  + K A+ A+  + IE DP LT E ++ KA+V  E   A +
Sbjct: 1322 NAVPQTPKA----KTDAKNAVTQAAEDKKSAIENDPNLTREEKDAAKAKVDAEATKAKNA 1377

Query: 1410 IAEAKDADEADKAYGDGVTAIENAHVIGKGIEARKDLAKKDLAEAAAKTKALIIEDKTLT 1469
              I  A  D+      +G AI  + + +  +A+ D AK  ++AA + K  I D  LT
Sbjct: 1378 IDAATSNDDETAKQNEGTQAI---NAVPQTPKAKTD-ARNAVTQAADRKKDAIENDPNLT 1433

Query: 1470 DDQRKEQLLGVDTEYAKGIENIDAAKDAAGVDKAYSDGVRDILAQYKEGQNLNDRRNAAK 1529
              +++       VD E K + IDAA   A V   ++G + I    +       + AK
Sbjct: 1434 REEKVAAKAKVDAEAKKAKDAIDAATSNADVTAKQNEGTKAI----NDVPQTPTAKTDAK 1489

Query: 1530 EFLLKEADKVTKLINDDPTLTHDQKVDQINKVEQAKLDAIKSVDDAQTADAINDALGKGI 1589
              + + AD    I DP LT ++K     KV+   A ++D A +     +G
Sbjct: 1490 NAVTQAADAKKDAIEKDPNLTREEKDAAKAKVDAEAKKAKDAIDAATSNADVTAKQNEGT 1549

Query: 1590 ENINNQYQHGDGVDVRKATAKGDLEKEAAKVKALIAKDPTLTQADKDKQTAAVDAAKNTA 1649
              + IN+ Q         K AK + + A K I KDP LT+ +KD   A VDA    A
Sbjct: 1550 KAINDVPQ----TPTAKTDAKNAVTQAAADKKDAIEKDPNLTREEKDAAKAKVDAEAKKA 1605

Query: 1650 IAAVDKATTTEGINQELGKGITAINKAYRPGEGVKARKEAAKADLEKEAAKVKALITNDP 1709
                A+D AT+  +  + G AIN +        K  AK + +A   K  I ND
Sbjct: 1606 KDAIDAATSNADVTAQKDAGKNAINAVPQ----TPTAKTDAKNAVTQAADAKKDAIENDA 1661

Query: 1710 TLTKADK-AKQTEAVAKALKAAIAAVDKATTAEGINQELGKGITAINKAYRPGEGVKARK 1768
              LT+ +K A + +  A + + A+A KA A+D AT+    +  + +G AIN +       K
Sbjct: 1662 NLTREEKDAAKAKVDAEATKAK-NAIDAATSNADVTAKQNEGTKAINDVPQ----TPTAK 1716

Query: 1769 EAAKADLEREAAKVREAIANDPTLTKADK-AKQTEAVAKALKAAIAAVDKATTAEGINQE 1827
                AK     +++ A  + AI NDP LT+ +K A + +   A + +A+A KA  A+D AT+    + +
Sbjct: 1717 TDAKNAVDQAATDKKSAIENDPALTREEKDAAKAKVDAEATKAK-NAIDAATSNADVTAQ 1775

Query: 1828 LGKGITAINKAYRPGEGVEAHKEAAKANLEKVAKETKALISGDRYLSETEKAVQKQAVEQ 1887
                G  AIN +         K AK +++ A + KA I D    L+   EK    K V+
Sbjct: 1776 KDAGKNAINAVPQ----TPTAKTDAKNAVDQAATDKKAAIENDPALTREEKDAAKAKVDA 1831

Query: 1888 ALAKALGQVEAAKTVEAVKLAENLGTVAIRSAYVAGLAKDTDQATAALNEAKQAAIEALK 1947
              KA  ++AA +   V  ++ G         KD  A      AK  A A+
Sbjct: 1832 EAKKAKDAIDAATSNADVTAQKDAG-------------KDAINAVPQTPTAKTDAKNAVD 1878

Query: 1948 QAAAETLAKITTDAKLTEAQKAEQSENVSLALKTAIATVRSAQSIASVKEAKDKGITAIR 2007
              QAA + + I D  LT +K      V  KA  + +AS V   + G AI
Sbjct: 1879 QAATDKKSAIENDPALTREEKDAVKAKVDAEAKKAKDAIDAATSNADVTAKQTEGTQAIN 1938

Query: 2008 AAYVPNKAVAKSSSAN 2023
              A  VP   AK+ + N
Sbjct: 1939 A--VPQTPTAKTDAKN 1952
```

An alignment of the GAS and GBS proteins is shown below:

```
Identities = 77/396 (19%), Positives = 157/396 (39%), Gaps = 48/396 (12%)
Query:  42 LNYELTNRDQAQNYHKQIKEHINENRLSTRGVRKDAILCNEWIITSDKTFFDSLDEKQTR 101
             L++E+ +  ++QN K+I + +         D      E +I  K  +++ EK T
Sbjct: 338 LDFEILH-PRSQNVSKKISKQVEAKPF-------DPASYKEKVIAKLKPVYEATSEKITN 389

Query: 102 EFF--ETAKDYFAEKYGDANIAYARVHLDESTPHMHLGIVPMKNGKLSSKALFG--NKEK 157
             + +  E AKD  +K + I+         G V +     +A+     NK
Sbjct: 390 DAWLDENAKDLQKQKLEEQYIS---------------GKVAISEAGTKQEAIDAAYNKYS 434
```

```
-continued
Query:   158 LVAIQDELPKYLNEHGFNLQRGEIGSKKKHLETAEFKEKQRLLDN---ADRKLADKHEEL   214
              D LP   +   N+   +    ++  ++T +   K    D     K   K E L
Sbjct:   435 SQTDPDSLPSQYKQG--NKENEQEKGRQDLIQTRDLTLKAIQEDKWLTEQEKTIQKEEAL   492

Query:   215 KALDDKISNVNDTIADKESRLKELEAKEWDAVGDLKQYE----------LEKQSLAESTE   264
              KA +   I +VN T++ ++ + + +   K   + K+Y              EK+  A    E
Sbjct:   493 KAFETGIESVNQTVSLEQLKQRLIVYKASEKDSEKKEYPESIPNQHIPGKEKEVKAAKQE   552

Query:   265 DIKDIELLQLDRIQKEDLVKQSFDGKLKMDKETYNRLFQTASKHASSNAELKRDLVKAQS   324
              ++K +     L++I ++ +       +     E   +   Q A K A +   +L+ DL       S
Sbjct:   553 ELKKLHDTTLEKINQDKWLTPDQQAEQLKQAEVTFKKGQEAIKSAQTLTQLETDLADYVS   612

Query:   325 QNNHLSRELLNHRKTAEKNIKLSQENRKLKDKVKMLDEQVK----ILNKSLSVWKEKAKE   380
              +N        + +   K+   K+   +++       KLK+    +      + ++          KEKAK
Sbjct:   613 ENEGKGNSIPDKYKSGNKDDLVNKAEVKLKEAHEATKQAIEKDPWLSPEQKKAQKEKAKA   672

Query:   381 FMPKQVYRETLSIINTLNPIGLAKTAIRQVKKMVDS                          416
              + + +   + L   ++L  + + + A      +K  DS
Sbjct:   673 RLDEGL--KALKAADSLEILKVTEEAFVDKEKNPDS                          706
```

Based on this analysis, it was predicted that these proteins and their epitopes could be useful antigens for vaccines or diagnostics.

Example 181

A DNA sequence (GBSx0187) was identified in *S. agalactiae* <SEQ ID 599> which encodes the amino acid sequence <SEQ ID 600>. Analysis of this protein sequence reveals the following:

Possible site: 42
>>> Seems to have no N-terminal signal sequence
----- Final Results -----
  bacterial cytoplasm --- Certainty = 0.2544 (Affirmative) <succ>
  bacterial membrane --- Certainty = 0.0000 (Not Clear) <succ>
  bacterial outside --- Certainty = 0.0000 (Not Clear) <succ>

The protein has no significant homology with any sequences in the GENPEPT database.

No corresponding DNA sequence was identified in *S. pyogenes*.

Example 182

A DNA sequence (GBSx0188) was identified in *S. agalactiae* <SEQ ID 601> which encodes the amino acid sequence <SEQ ID 602>. Analysis of this protein sequence reveals the following:

Possible site: 57
>>> Seems to have no N-terminal signal sequence
----- Final Results -----
  bacterial cytoplasm --- Certainty = 0.2045 (Affirmative) <succ>
  bacterial membrane --- Certainty = 0.0000 (Not Clear) <succ>
  bacterial outside --- Certainty = 0.0000 (Not Clear) <succ>

The protein has no significant homology with any sequences in the GENPEPT database.

A related DNA sequence was identified in *S. pyogenes* <SEQ ID 603> which encodes the amino acid sequence <SEQ ID 604>. Analysis of this protein sequence reveals the following:

Possible site: 57
>>> Seems to have no N-terminal signal sequence
----- Final Results -----
  bacterial cytoplasm --- Certainty = 0.2045 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below:

```
Identities = 102/111 (910), Positives = 107/111 (95%)
Query:   1 MDYKKYQIIYAPDVLEKLKEIRDYISQNYSSTSGQHKMEQIISDIEKLEVFPEVGFDADE   60
            +DYKKYQIIYAPDVLEKLKEIRDYISQNYSSTSGQ KMEQIISDIEKLEVFPEVGFDADE
Sbjct:   1 LDYKKYQIIYAPDVLEKLKEIRDYISQNYSSTSGQRKMEQIISDIEKLEVFPEVGFDADE   60

Query:  61 KYGSKISKYHSTRGYTLSKDYIVLYHIEEEENRVVIDYLLPTRSDYMKLFK            111
           KYGSKI  YHST+GYTLSKDYIVLYHIE EENR+VIDYLLPT+SDY+KLFK
Sbjct:  61 KYGSKIIHYHSTKGYTLSKDYIVLYHIEGEENRIVIDYLLPTQSDYIKLFK            111
```

Based on this analysis, it was predicted that these proteins and their epitopes could be useful antigens for vaccines or diagnostics.

Example 183

A DNA sequence (GBSx0189) was identified in *S. agalactiae* <SEQ ID 605> which encodes the amino acid sequence <SEQ ID 606>. Analysis of this protein sequence reveals the following:

Possible site: 13
>>> Seems to have no N-terminal signal sequence
----- Final Results ----- bacterial cytoplasm --- Certainty = 0.1621 (Affirmative) <succ>
bacterial membrane --- Certainty = 0.0000 (Not Clear) <succ>
bacterial outside --- Certainty = 0.0000 (Not Clear) <succ>

The protein has no significant homology with any sequences in the GENPEPT database.

A related DNA sequence was identified in *S. pyogenes* <SEQ ID 607> which encodes the amino acid sequence <SEQ ID 608>. Analysis of this protein sequence reveals the following:

```
Identities = 91/95 (95%), Positives = 93/95 (97%)
Query:  1 MVTAEKNRAVTFQANKELVSEAMTVLNKKNLTLSSALRLFLQNVVVTNEVDLLTEEELEK  60
          M T +KNRAVTFQANKELVSEAMTVLNKKNLTLSSALRLFLQNVVVTNEVDLLTEEELEK
Sbjct:  1 MTTVKKNRAVTFQANKELVSEAMTVLNKKNLTLSSALRLFLQNVVVTNEVDLLTEEELEK  60

Query: 61 EKLFKQFQAEINKNIEDVRQGKFYTSEEVRSELGL                          95
          EKLFKQFQAEINKNIEDVRQGKFYTSEEVR+ELGL
Sbjct: 61 EKLFKQFQAEINKNIEDVRQGKFYTSEEVRAELGL                          95
```

Based on this analysis, it was predicted that these proteins and their epitopes could be useful antigens for vaccines or diagnostics.

Example 184

A DNA sequence (GBSx0190) was identified in *S. agalactiae* <SEQ ID 609> which encodes the amino acid sequence <SEQ ID 610>. Analysis of this protein sequence reveals the following:

Possible site: 56
>>> Seems to have no N-terminal signal sequence
----- Final Results -----
bacterial cytoplasm --- Certainty = 0.4568 (Affirmative) <succ>
bacterial membrane --- Certainty = 0.0000 (Not Clear) <succ>
bacterial outside --- Certainty = 0.0000 (Not Clear) <succ>

A related GBS nucleic acid sequence <SEQ ID 9513> which encodes amino acid sequence <SEQ ID 9514> was also identified.

The protein has homology with the following sequences in the GENPEPT database:
>GP:CAA46375 GB:X65276 ORFA1 [*Clostridium acetobutylicum*]
Identities=36/91 (39%), Positives=51/91 (55%)

```
>GP: CAA46375 GB: X65276 ORFA1 [Clostridium acetobutylicum]
Identities = 36/91 (39%), Positives = 51/91 (55%)

Query:  2 MSQIKLTPEELRISAQKYTTGSQSITDVLTVLTQEQAVIDENWDGTAFDSFEAQFNELSP  61
          M+QI +TPEEL+  AQ Y    + I  + +    + I E W G AF ++  Q+N+L
Sbjct:  1 MAQISVTPEELKSQAQVYIQSKEEIDQAIQKVNSMNSTIAEEWKGQAFQAYLEQYNQLHQ  60

Query: 62 KITQFAQLLEDINQQLLKVADVVEQTDSDIA                              92
          + QF  LLE +NQQL K AD V + D+  A
Sbjct: 61 TVVQFENLLESVNQQLNKYADTVAERDAQDA                              91
```

No corresponding DNA sequence was identified in *S. pyogenes*.

Based on this analysis, it was predicted that these proteins and their epitopes could be useful antigens for vaccines or diagnostics.

Possible site: 22
>>> Seems to have no N-terminal signal sequence
----- Final Results -----
bacterial cytoplasm --- Certainty = 0.1596 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below:

Example 185

A DNA sequence (GBSx0191) was identified in *S. agalactiae* <SEQ ID 611> which encodes the amino acid sequence <SEQ ID 612>. Analysis of this protein sequence reveals the following:

Possible site: 21
>>> Seems to have no N-terminal signal sequence
----- Final Results -----
bacterial cytoplasm --- Certainty = 0.4523 (Affirmative) <succ>
bacterial membrane --- Certainty = 0.0000 (Not Clear) <succ>
bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 186

A DNA sequence (GBSx0192) was identified in *S. agalactiae* <SEQ ID 613> which encodes the amino acid sequence <SEQ ID 614>. Analysis of this protein sequence reveals the following:

```
Possible site: 44
>>> Seems to have no N-terminal signal sequence
----- Final Results -----
   bacterial cytoplasm --- Certainty = 0.5339 (Affirmative) <succ>
   bacterial membrane --- Certainty = 0.0000 (Not Clear) <succ>
   bacterial outside --- Certainty = 0.0000 (Not Clear) <succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 187

A DNA sequence (GBSx0193) was identified in S. agalactiae <SEQ ID 615> which encodes the amino acid sequence <SEQ ID 616>. This protein is predicted to be chromosome assembly protein. Analysis of this protein sequence reveals the following:

```
Possible site: 61
>>> Seems to have no N-terminal signal sequence
----- Final Results -----
   bacterial cytoplasm --- Certainty = 0.4620 (Affirmative) <succ>
   bacterial membrane --- Certainty = 0.0000 (Not Clear) <succ>
   bacterial outside --- Certainty = 0.0000 (Not Clear) <succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 188

A DNA sequence (GBSx0194) was identified in S. agalactiae <SEQ ID 617> which encodes the amino acid sequence <SEQ ID 618>. Analysis of this protein sequence reveals the following:

```
Possible site: 46
>>> Seems to have no N-terminal signal sequence
----- Final Results -----
   bacterial cytoplasm --- Certainty = 0.4511 (Affirmative) <succ>
   bacterial membrane --- Certainty = 0.0000 (Not Clear) <succ>
   bacterial outside --- Certainty = 0.0000 (Not Clear) <succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 189

A DNA sequence (GBSx0195) was identified in S. agalactiae <SEQ ID 619> which encodes the amino acid sequence <SEQ ID 620>. Analysis of this protein sequence reveals the following:

```
Possible site: 20
>>> Seems to have no N-terminal signal sequence
----- Final Results -----
   bacterial cytoplasm --- Certainty = 0.5249 (Affirmative) <succ>
   bacterial membrane --- Certainty = 0.0000 (Not Clear) <succ>
   bacterial outside --- Certainty = 0.0000 (Not Clear) <succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 190

A DNA sequence (GBSx0196) was identified in S. agalactiae <SEQ ID 621> which encodes the amino acid sequence <SEQ ID 622>. Analysis of this protein sequence reveals the following:

```
Possible site: 14
>>> Seems to have no N-terminal signal sequence
----- Final Results -----
   bacterial cytoplasm --- Certainty = 0.3642 (Affirmative) <succ>
   bacterial membrane --- Certainty = 0.0000 (Not Clear) <succ>
   bacterial outside --- Certainty = 0.0000 (Not Clear) <succ>
```

A related GBS nucleic acid sequence <SEQ ID 9515> which encodes amino acid sequence <SEQ ID 9516> was also identified.

The protein has no significant homology with any sequences in the GENPEPT database.

No corresponding DNA sequence was identified in S. pyogenes.

Based on this analysis, it was predicted that these proteins and their epitopes could be useful antigens for vaccines or diagnostics.

Example 191

A DNA sequence (GBSx0197) was identified in S. agalactiae <SEQ ID 623> which encodes the amino acid sequence <SEQ ID 624>. Analysis of this protein sequence reveals the following:

```
Possible site: 15
>>> Seems to have no N-terminal signal sequence
----- Final Results -----
   bacterial cytoplasm --- Certainty = 0.3098 (Affirmative) <succ>
   bacterial membrane --- Certainty = 0.0000 (Not Clear) <succ>
   bacterial outside --- Certainty = 0.0000 (Not Clear) <succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 192

A DNA sequence (GBSx0198) was identified in *S. agalactiae* <SEQ ID 625> which encodes the amino acid sequence <SEQ ID 626>. This protein is predicted to be rgg protein. Analysis of this protein sequence reveals the following:

```
Possible site: 59
>>> Seems to have no N-terminal signal sequence
----- Final Results -----
   bacterial cytoplasm --- Certainty = 0.3177 (Affirmative) <succ>
    bacterial membrane --- Certainty = 0.0000 (Not Clear) <succ>
     bacterial outside --- Certainty = 0.0000 (Not Clear) <succ>
```

The protein has homology with the following sequences in the GENPEPT database:

```
>GP:AAA26968 GB:M89776 rgg [Streptococcus gordonii]
Identities = 74/277 (26%), Positives = 142/277 (50%)

Query:   7    IFREFRLNRQFSLKQVASNELSVSQLSRFERGESDLSLTKFLGALEAIDLSISEFMDRVN   66
              I +   R ++   SLK+VA+  ++SV+QLSR+ERG S L++   F    L  + +S++EF      +
Sbjct:  10    ILKIIRESKNMSLKEVAAGDISVAQLSRYERGISSLTVDSFYSCLRNMSVSLAEFQYVYH   69

Query:  67    KYQKSDQISLMSQMAQYHYQRDVAGLEKMISVEEGKLKKDSSDIRCRLNIVLFRGMICEC  126
              Y+++D + L ++++     + ++  LE +++  E   ++           +LN ++ R  +   C
Sbjct:  70    NYREADDVVLSQKLSEAQRENNIVKLESILAGSEAMAQEFPEKKNYKLNTIVIRATLTSC  129

Query: 127    DSSRKMSEEDLCFLSDYLFQKDSWEISDYILIGNLYRYYNTRHICQLVKEVINQKEYYRD  186
              +   ++S+ D+ FL+DYLF  + W  +  L  N          +     E+IN+ ++Y +
Sbjct: 130    NPDYQVSKGDIEFLTDYLFSVEEWGRYELWLFTNSVNLLTLETLETFASEMINRTQFYNN  189

Query: 187    IYTNRNVVEATLLNVVETLIERRALEEATFFLEKVEALLNNERNAYHRIILLYEKGFLAY  246
              +  NR +  LLNVV   IE    L+ A  FL  ++      E + Y R+++ Y K    +Y
Sbjct: 190    LPENRRRIIKMLLNVVSACIENNHLQVAMKFLNYIDNTKIPETDLYDRVLIKYHKALYSY  249

Query: 247    AKGDSRGIQSMKQAIFCFQAIGSKHHVENFQEHFNRV                         283
              G+          ++Q +   F+ + S           +E  F R+
Sbjct: 250    KVGNPHARHDIEQCLSTFEYLDSFGVARKLKEQFERI                         286
```

A related DNA sequence was identified in *S. pyogenes* <SEQ ID 627> which encodes the amino acid sequence <SEQ ID 628>. Analysis of this protein sequence reveals the following:

```
Possible site: 29
>>> Seems to have no N-terminal signal sequence
----- Final Results -----
   bacterial cytoplasm --- Certainty = 0.3792 (Affirmative) <succ>
    bacterial membrane --- Certainty = 0.0000 (Not Clear) <succ>
     bacterial outside --- Certainty = 0.0000 (Not Clear) <succ>
```

An alignment of the GAS and GBS proteins is shown below:

```
Identities = 79/275 (28%), Positives = 146/275 (52%), Gaps = 11/275 (4%)
Query:   9  REFRLNRQFSLKQVASNELSVSQLSRFERGESDLSLTKFLGALEAIDLSISEFMDRVNKY   68
            R R  +Q S+  +A   LS SQ+SRFERGES+++ ++ L  L+ ++++I EF+   +K
Sbjct:  15  RRLRKGKQVSISFLADEYLSKSQISRFERGESEITCSRLLNLLDKLNITIDEFVSAHSKT   74

Query:  69  QKSDQISLMSQMAQYHYQRDVAGLEKMISVEEGKLKKDSSDIRCRLNIVLERGMICECDS  128
              +   +L+SQ  + + +++V  L K++    +    KD   R  +  +LF       DS
Sbjct:  75  H-THFFTLLSQARKCYAEKNVVKLTKLL---KDYAHKDYE--RTMIKAILF-----SIDS  123

Query: 129  SRKMSEEDLCFLSDYLFQKDSWEISDYILIGNLYRYYNTRHICQLVKEVINQKEYYRDIY  188
            S   S+E+L  L+DYLF+  + W    + IL+GN  R+ N    +  L KE++       Y
Sbjct: 124  SIAPSQEELTRLTDYLFKVEQWGYYEIILLGNCSRFMNYNTLFLLTKEMVASFAYSEQNK  183

Query: 189  TNRNVVEATLLNVVETLIERRALEEATFFLEKVEALLNNERNAYHRIILLYEKGFLAYAK  248
            TN+ +V    +N +     I+     E + + + K++ LL +E N Y + + LY  G+        +
Sbjct: 184  TNKMLVTQLSINCLIISIDHSCFEHSRYLINKIDLLLRDELNFYEKTVFLYVHGYYKLKQ  243

Query: 249  GDSRGIQSMKQAIFCFQAIGSKHHVENFQEHFNRV                          283
             +  G +  M+QA+  F+  +G            +++EH+  ++
Sbjct: 244  EEMSGEEDMRQALQIFKYLGEDSLYYSYKEHYRQI                          278
```

Based on this analysis, it was predicted that these proteins and their epitopes could be useful antigens for vaccines or diagnostics.

Example 193

A DNA sequence (GBSx0199) was identified in *S. agalactiae* <SEQ ID 629> which encodes the amino acid sequence <SEQ ID 630>. This protein is predicted to be permease. Analysis of this protein sequence reveals the following:

Possible site: 15
>>> Seems to have no N-terminal signal sequence

| INTEGRAL | Likelihood = −8.07 | Transmembrane 217-233 (215-238) |
| INTEGRAL | Likelihood = −7.96 | Transmembrane 163-179 (158-185) |
| INTEGRAL | Likelihood = −7.75 | Transmembrane 71-87 (69-91) |
| INTEGRAL | Likelihood = −7.22 | Transmembrane 369-385 (356-389) |
| INTEGRAL | Likelihood = −5.15 | Transmembrane 279-295 (275-299) |
| INTEGRAL | Likelihood = −4.88 | Transmembrane 252-268 (250-270) |
| INTEGRAL | Likelihood = −4.78 | Transmembrane 140-156 (139-157) |
| INTEGRAL | Likelihood = −3.56 | Transmembrane 343-359 (340-367) |
| INTEGRAL | Likelihood = −3.13 | Transmembrane 40-56 (39-56) |
| INTEGRAL | Likelihood = −2.28 | Transmembrane 94-110 (92-112) |

----- Final Results -----
bacterial membrane --- Certainty = 0.4227 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the GENPEPT database:

```
>GP:AAD36408 GB:AE001788 permease, putative [Thermotoga maritima]
Identities = 97/396 (24%), Positives = 194/396 (48%), Gaps = 15/396 (3%)
Query:   1  MNINGIKLLSSRAVSKLGDVFYDYGNSTWIASMGGLGQKILGIYQIVELLVSIVLNPFGG   60
            MN N +       S   VS +G  Y    + W+ S  G  + + G++ I   L +I+++PF G
Sbjct:   1  MNRNLLLFASGSFVSLIGTRIYQVALAWWLYSKTGSSEYV-GLFMISSFLPAIIVSPFAG   59

Query:  61  ALADRFQRRKILLITDAICAIM---CFLLSFIGDDKVMVYGLIVANAILAVSNAFSSPAY  117
             + DR  R+ ++++ D   +    ++  FL+  +   +   +  L++     +++V ++F +PA
Sbjct:  60  TVVDRHSRRNMMVVMDILRGVLFMYLFLMEYFSELTMAL--LLIVTVLVSVFDSFFNPAV  117

Query: 118  KSYIPEIVDKADIITYNANLETIVQIISVSSPVLGFLIFNNFGIRITLIVDAITFLISFL  177
             S +P++V K +++  N+    +   +  +    P LG L+       G+    +++++++FLIS +
Sbjct: 118  DSLLPDLVRKENLVRANSLYRLLKNLSKILGPALGSLLLKVVGLAGVILINSLSFLISGI  177

Query: 178  FLYAIKVERVQLSKQEKVAIKNILADIADGFTYIKKEKEIMFFLIIAALLNTFLAMFNYL  237
            F      IKVE    L K  K      +N+    DI         YI+   + I+   +++ A++N F       + L
Sbjct: 178  FEMFIKVEEKHLKKVSKE--RNMWQDIKSALLYIRSVRFILVTILVIAIMNFFTGSMHVL  235

Query: 238  LP-FTNSLLKTSGAYATILSISAIGSIIGALIARKI--KSSINSMLSMLVFSSLGVIVMG  294
            LP   + L  K+   Y  T++S+   +G +I  +   I   ++S+  ++       LV    L V V
Sbjct: 236  LPEHVSKLGKSEWVYGTLMSMLSFGGLIVTFLMATIRTRASVKTLGLNLVGYGLAVFVFA  295

Query: 295  FPSLFELPIWIPYSGSFLFNSLLTMFNIHFFSQVQIRVDEAYMGRVMSTIFTIAIMFMPI  354
                    W+ ++   FL       T+FNI+    + +Q+ + E    G++  S I  ++      +P+
Sbjct: 296  MTGNH----WLMFAMYFLIGIFQTLFNINVITLLQLAIPEEMRGKIFSLISAVSFSLLPV  351

Query: 355  GTLFMTIFSFALSNVSFIVIGCAIAILGGLGFSYSK                         390
                 F    S ++           +    I GG+  S  +
Sbjct: 352  SYGFFGFLSSYVATAHIFITTSMALIAGGVLISLQR                         387
```

A related DNA sequence was identified in *S. pyogenes* <SEQ ID 631> which encodes the amino acid sequence <SEQ ID 632>. Analysis of this protein sequence reveals the following:

Possible site: 45
>>> Seems to have no N-terminal signal sequence

-continued

| | | |
|---|---|---|
| INTEGRAL | Likelihood = −8.17 | Transmembrane 172-188 (161-194) |
| INTEGRAL | Likelihood = −8.07 | Transmembrane 220-236 (218-242) |
| INTEGRAL | Likelihood = −7.22 | Transmembrane 311-327 (303-329) |
| INTEGRAL | Likelihood = −5.26 | Transmembrane 98-114 (96-118) |
| INTEGRAL | Likelihood = −4.99 | Transmembrane 347-363 (342-370) |
| INTEGRAL | Likelihood = −4.62 | Transmembrane 154-170 (151-171) |
| INTEGRAL | Likelihood = −4.25 | Transmembrane 284-300 (281-306) |
| INTEGRAL | Likelihood = −3.66 | Transmembrane 378-394 (378-396) |
| INTEGRAL | Likelihood = −3.56 | Transmembrane 74-90 (73-92) |
| INTEGRAL | Likelihood = −2.39 | Transmembrane 50-66 (49-66) |

----- Final Results -----
   bacterial membrane --- Certainty = 0.4270 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the databases:

Based on this analysis, it was predicted that these proteins and their epitopes could be useful antigens for vaccines or diagnostics.

Example 194

A DNA sequence (GBSx0200) was identified in *S. agalactiae* <SEQ ID 633> which encodes the amino acid sequence <SEQ ID 634>. This protein is predicted to be membrane permease OpuCD. Analysis of this protein sequence reveals the following:

Possible site: 46
>>> Seems to have an uncleavable N-term signal seq

```
>GP:AAD36408 GB:AE001788 permease, putative [Thermotoga maritima]
Identities = 85/345 (24%), Positives = 171/345 (48%), Gaps = 8/345 (2%)
Query:  40  SLSLVAVYQSLESVIGVLFNLFGGVIADSFKRKKIIITTNILCGTACLVLSFLTKEQWLV   99
                S  V ++     +  ++ F G + D    R+ +++  +IL G    + L  +       L
Sbjct:  36  SSEYVGLFMISSFLPAIIVSPFAGTVVDRHSRRNMMVVMDILRGVLFMYLFLMEYFSELT   95

Query: 100  YAIVL-TNVILAFMSAFSSPSYKAFTKEIVKKDSISQLNSLLETTSTVIKVTVPMVAIFL  158
                A++L  V+++    +F +P+  +     ++V+K+++  + NSL      + K+  P  +   L
Sbjct:  96  MALLLIVTVLVSVFDSFFNPAVDSLLPDLVRKENLVRANSLYRLLKNLSKILGPALGSLL  155

Query: 159  YKLLGIHGVLLLDGLSFLIAALLISFILPVNDEVVIKEKVTIREIFNDLKIGFKYVYSHK  218
                K++G+ GV+L++  LSFLI+ + +    FI     +E   +K+       R ++ D+K      Y+  S  +
Sbjct: 156  LKVVGLAGVILINSLSFLISGIFEMFIKV--EEKHLKKVSKERNMWQDIKSALLYIRSVR  213

Query: 219  SIFIITVLSALVNFFLAAYNLLLPYSNQMFGEISTGLYGTFLTAEAIGGFIGAILSGFVN  278
                 I  +  ++ A++NFF   + ++LLP          G+ S  +YGT ++   + GG I     L   +
Sbjct: 214  FILVTILVIAIMNFFTGSMHVLLPEHVSKLGK-SEWVYGTLMSMLSFGGLIVTFLMATIR  272

Query: 279  KELSSMRLILFLSLSGLMLMLAPPFYIMFHNAIILALSPALFSLFLSIFNIQFFSLVQKD  338
                    S   L L    GL + +     + M  N  ++      L   +F ++FNI    +L+Q
Sbjct: 273  TRASVKTLGLNLVGYGLAVFV----FAMTGNHWLMFAMYFLIGIFQTLFNINVITLLQLA  328

Query: 339  VDNDFLGRVFGIIFTITILFMPIGTGFFSVALNPNNSFNLFIIGS               383
                 +  +  G++F +I ++     +P+    GFF     +  + ++FI  S
Sbjct: 329  IPEEMRGKIFSLISAVSFSLLPVSYGFFGFLSSYVATAHIFITTS              373
```

An alignment of the GAS and GBS proteins is shown below:

```
Identities = 136/379 (35%), Positives = 229/379 (59%), Gaps = 6/379 (1%)
Query:   8  LLSSRAVSKLGDVFYDYGNSTWIASMGGLGQKILGIYQIVELLVSIVLNPFGGALADRFQ   67
                L+ S+ +  ++GDV +D+ N+T++A +         ++ +YQ +E ++  ++ N FGG +AD F+
Sbjct:  11  LVYSKVIYRIGDVMFDFANNTFLAGLNPASLSLVAVYQSLESVIGVLFNLFGGVIADSFK   70

Query:  68  RRKILLITDAICAIMCFLLSFIGDDKVMVYGLIVANAILAVSNAFSSPAYKSYIPEIVDK  127
                R+KI++  T+  +C    C +LSF+   ++  +VY +++   N  ILA     +AFSSP+YK++    EIV K
Sbjct:  71  RKKIIITTNILCGTACLVLSFLTKEQWLVYAIVLTNVILAFMSAFSSPSYKAFTKEIVKK  130

Query: 128  ADIITYNANLETIVQIISVSSPVLGFLIFMNFGIRITLIVDAITFLISFLFLYAIKVERV  187
                   I     N+ LET    +I V+ P++       ++     GI      L++D ++FLI+ L  + I
Sbjct: 131  DSISQLNSLLETTSTVIKVTVPMVAIFLYKLLGIHGVLLLDGLSFLIAALLISFILPVND  190

Query: 188  QLSKQEKVAIKNILADIADGFTYIKKEKEIMFFLIIAALLNTFLAMFNYLLPFTNSLLK-  246
                  ++    +EKV I+  I   D+   GF Y+    K I        +++AL+N  FLA  +N  LLP++N  +
Sbjct: 191  EVVIKEKVTIREIFNDLKIGFKYVYSHKSIFIITVLSALVNFFLAAYNLLLPYSNQMFGE  250

Query: 247  -TSGAYATILSISAIGSIIGALIARKIKSSINSMLSMLVFSSLGVIVMGFPS---LFELP  302
                  ++G Y T L+    AIG   IGA+++          ++SM  +L  S   G+++M  P        +F
Sbjct: 251  ISTGLYGTFLTAEAIGGFIGAILSGFVNKELSSMRLILFLSLSGLMLMLAPPFYIMFHNA  310

Query: 303  IWIPYSGSFLFNSLLTMFNIHFFSQVQIRVDEAYMGRVMSTIFTIAIMFMPIGTLFMTIF  362
                I +    S  + LF+   L++FNI FFS VQ       VD     ++GRV       IFTI  I+FMPIGT F  ++
Sbjct: 311  IILALSPA-LFSLFLSIFNIQFFSLVQKDVDNDFLGRVFGIIFTITILFMPIGTGFFSVA  369

Query: 363  SFALSNVSFIVIGCAIAIL                                          381
                 ++ +    +IG  I  L
Sbjct: 370  LNPNNSFNLFIIGSCITTL                                          388
```

-continued

| INTEGRAL | Likelihood = −5.68 | Transmembrane 91-107 (88-110) |
| INTEGRAL | Likelihood = −4.30 | Transmembrane 15-31 (9-37) |
| INTEGRAL | Likelihood = −3.72 | Transmembrane 72-88 (72-88) |
| INTEGRAL | Likelihood = −3.19 | Transmembrane 124-140 (123-142) |

----- Final Results -----
   bacterial membrane --- Certainty = 0.3272 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 8509> which encodes amino acid sequence <SEQ ID 8510> was also identified. Analysis of this protein sequence reveals the following:

Lipop: Possible site: −1   Crend: 1
McG: Discrim Score: −10.69
GvH: Signal Score (−7.5): −3.79
Possible site: 39
>>> Seems to have no N-terminal signal sequence
ALOM program  count: 5 value: −9.02  threshold: 0.0

| INTEGRAL | Likelihood = −9.02 | Transmembrane 35-51 (25-53) |
| INTEGRAL | Likelihood = −5.68 | Transmembrane 151-167 (148-170) |
| INTEGRAL | Likelihood = −4.30 | Transmembrane 75-91 (69-97) |
| INTEGRAL | Likelihood = −3.72 | Transmembrane 132-148 (132-148) |
| INTEGRAL | Likelihood = −3.19 | Transmembrane 184-200 (183-202) |
| PERIPHERAL | Likelihood = 2.17 | 58 | modified ALOM score: 2.30
*** Reasoning Step: 3
----- Final Results -----
   bacterial membrane --- Certainty = 0.4609 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the GENPEPT database:

```
>GP:AAF91342 GB:AF249729 membrane permease OpuCD [Listeria monocytogenes]
Identities = 104/154 (6790, Positives = 133/154 (85%)
Query:   3    IANVIQTIPSLAMISIIMLGLGLGIKTVVATVFLYSLLPIITNTYTGIRNVDSDLLDAAK   62
              IAN+IQTIP+LAM++++ML +GLG  TVV ++FLYSLLPI+ NTYTGIRNVD  LL++ K
Sbjct:  60    IANIIQTIPALAMLAVLMLIMGLGTNTVVLSLFLYSLLPILKNTYTGIRNVDGALLESGK  119

Query:  63    GMGMTKRQRLFMVELPLSISVIMAGLRNALVVAIGITAIGAFVGGGGLGDIIIRGTNATN  122
               MGMTK Q L ++E+PL++SVIMAG+RNALV+AIG+ AIG FVG GGLGDII+RGTNATN
Sbjct: 120    AMGMTKWQVLRLIEMPLALSVIMAGIRNALVIAIGVAAIGTFVGAGGLGDIIVRGTNATN  179

Query: 123    GGAIILAGSLPTALMAIFSDLILGGIQRMLEPRK                           156
              G AIILAG++PTA+MAI +D++LG ++R L P K
Sbjct: 180    GTAIILAGAIPTAVMAILADVLLGWVERTLNPVK                           213
```

A related DNA sequence was identified in *S. pyogenes* <SEQ ID 635> which encodes the amino acid sequence <SEQ ID 636>. Analysis of this protein sequence reveals the following:

Possible site: 49
>>> Seems to have no N-terminal signal sequence

| INTEGRAL | Likelihood = −9.24 | Transmembrane 39-55 (31-59) |
| INTEGRAL | Likelihood = −7.17 | Transmembrane 190-206 (188-211) |
| INTEGRAL | Likelihood = −4.62 | Transmembrane 93-109 (75-110) |
| INTEGRAL | Likelihood = −3.66 | Transmembrane 76-92 (75-92) |
| INTEGRAL | Likelihood = −2.87 | Transmembrane 221-237 (220-237) |
| INTEGRAL | Likelihood = −2.44 | Transmembrane 168-184 (165-184) |

----- Final Results -----
   bacterial membrane --- Certainty = 0.4694 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the databases:

```
>GP:AAD45530 GB:AF162656 choline transporter [Streptococcus pneumoniae]
Identities = 344/508 (67%), Positives = 425/508 (82%), Gaps = 2/508 (0%)
Query:  13    MPSLFVTFQNRFNEWLAALGEHLQISLLSLMIALLIGVPLAALLSRSKRWSDIMLQVTGV   72
              M +L  TFQ+RF++WL AL +HLQ+SLL+L++A+L+ +PLA  L    ++ +D +LQ+ G+
Sbjct:   1    MTNLIATFQDRFSDWLTALSQHLQLSLLTLLLAILLAIPLAVFLRYHEKLADWVLQIAGI   60

Query:  73    FQTIPSLALLGLFIPLMGIGTLPAVTALVIYAIFPILQNTITGLNGIDPSLVEAGIAFGM  132
              FQTIPSLALLGLFIPLMGIGTLPA+TALVIYAIFPILQNTITGL GIDP+L EAGIAFGM
Sbjct:  61    FQTIPSLALLGLFIPLMGIGTLPALTALVIYAIFPILQNTITGLKGIDPNLQEAGIAFGM  120

Query: 133    TKWERLKTFEIPIAMPVIMSGVRTSAVMIIGTATLASLIGAGGLGSFILLGIDRNNANLI  192
              T+WERLK FEIP+AMPVIMSG+RT+AV+IIGTATLA+LIGAGGLGSFILLGIDRNNA+LI
Sbjct: 121    TRWERLKKFEIPLAMPVIMSGIRTAAVLIIGTATLAALIGAGGLGSFILLGIDRNNASLI  180

Query: 193    LIGAISSALLAIIFNSLLQYLEKASLRRIMISFGITLLALLASYTPMALSQFSKGKDTVV  252
```

-continued

```
                LIGA+SSA+LAI FN LL+ +EKA LR I    F +  L L  SY+P  L Q  K K+ +V
Sbjct:  181     LIGALSSAVLAIAFNFLLKVMEKAKLRTIFSGFALVALLLGLSYSPALLVQ--KEKENLV  238

Query:  253     IAGKLGAEPDILINLYKELIEDQSDISVELKSNFGKTSFLYEALKSGDIDMYPEFTGTIT   312
                IAGK+G EP+IL N+YK LIE+ + ++  +K NFGKTSFLYEALK GDID+YPEFTGT+T
Sbjct:  239     IAGKIGPEPEILANMYKLLIEENTSMTATVKPNFGKTSFLYEALKKGDIDIYPEFTGTVT   298

Query:  313     SSLLRDKPPLSNDPKQVYEDAKKGIAKQDKLTLLKPFAYQNTYAVAMPEKLAKEYQIETI   372
                 SLL+   P +S++P+QVY+ A+ GIAKQD L  LKP +YQNTYAVA+P+K+A+EY ++TI
Sbjct:  299     ESLLQPSPKVSHEPEQVYQVARDGIAKQDHLAYLKPMSYQNTYAVAVPKKIAQEYGLKTI   358

Query:  373     SDLKAHADTLKAGFTLEFKDRADGYKGMQSQYGLQLSVATMEPALRYQAIQSGDIQVTDA   432
                SDLK     LKAGFTLEF DR DG KG+QS YGL L+VAT+EPALRYQAIQSGDIQ+TDA
Sbjct:  359     SDLKKVEGQLKAGFTLEFNDREDGNKGLQSMYGLNLNVATIEPALRYQAIQSGDIQITDA   418

Query:  433     YSTDAEITKYHLKVLKDDKQLEPPYQGAPLMKTSLLTKHPELKGILNQLAGKITEKEMQD   492
                YSTDAE+ +Y L+VL+DDKQLEPPYQGAPLMK +LL  KHPEL+ +LN LAGKITE +M
Sbjct:  419     YSTDAELERYDLQVLEDDKQLEPPYQGAPLMKEALLKKHPELERVLNTLAGKITESQMSQ   478

Query:  493     MNYEVSVKGADANKVARDYLLKTGLIQK                                  520
                +NY+V V+G  A +VA+++L + GL++K
Sbjct:  479     LNYQVGVEGKSAKQVAKEFLQEQGLLKK                                  506
```

An alignment of the GAS and GBS proteins is shown below:

```
Identities = 53/148 (35%), Positives = 93/148 (62%), Gaps = 1/148 (0%)
Query:   3      IANVIQTIPSLAMISIIMLGLGLGIKTVVATVFLYSLLPIITNTYTGIRNVDSDLLDAAK    62
                +  V QTIPSLA++ + +  +G+G    V + +Y++ PI+ NT TG+  +D   L++A
Sbjct:  69      VTGVFQTIPSLALLGLFIPLMGIGTLPAVTALVIYAIFPILQNTITGLNGIDPSLVEAGI   128

Query:  63      GMGMTKRQRLFMVELPLSISVIMAGLRNALVVAIGITAIGAFVGGGGLGDIIIRGINATN   122
                GMTK +RL   E+P++ +VIM+G+R +  V+IG   + +G GGLG  I+ G +   N
Sbjct: 129      AFGMTKWERLKTFEIPIAMPVIMSGVRTSAVMIIGTATLASLIGAGGLGSFILLGIDRNN   188

Query: 123      GGAIILAGSLPTALMAIFSDLILGGIQR                                  150
                 +IL G++  +AL+AI  + +L  +++
Sbjct: 189      AN-LILIGAISSALLAIIFNSLLQYLEK                                  215
```

Based on this analysis, it was predicted that these proteins and their epitopes could be useful antigens for vaccines or diagnostics.

Example 195

A DNA sequence (GBSx0201) was identified in *S. agalactiae* <SEQ ID 637> which encodes the amino acid sequence <SEQ ID 638>. This protein is predicted to be choline transporter-related. Analysis of this protein sequence reveals the following:

---

Possible site: 44

\>\>\> May be a lipoprotein

INTEGRAL    Likelihood = −3.03    Transmembrane 306-322 (306-327)

----- Final Results ----- bacterial membrane --- Certainty = 0.2211 (Affirmative) <succ> bacterial outside --- Certainty = 0.0000 (Not Clear) <succ> bacterial cytoplasm --- Certainty = 0.0000 (Not Clear) <succ>

---

A related GBS nucleic acid sequence <SEQ ID 9517> which encodes amino acid sequence <SEQ ID 9518> was also identified.

The protein has homology with the following sequences in the GENPEPT database:

```
>GP:CAB15386 GB:299121 glycine betaine/carnitine/choline ABC transporter
(osmoprotectant-binding protein) [Bacillus subtilis]
Identities = 168/303 (55%), Positives = 224/303 (73%), Gaps = 1/303 (0%)
Query:   2   LKKSHFLQIFTLCLALLTISGCQLTDTKKSGHTTIKVAAQSSTESSIMANIITELIHHEL    61
             + K  +L  F L   +L + GC L   +   TIK+ AQS TES I+AN+I +LI H+
Sbjct:   1   MTKIKWLGAFALVFVML-LGGCSLPGLGGASDDTIKIGAQSMTESEIVANMIAQLIEHDT    59

Query:  62   GYNTTLISNLGSSTVTHQALLRGDADIAATRYTGTDITGTLGLKAVKDPKEASKIVKTEF   121
                NT L+ NLGS+ V HQA+L GD DI+ATRY+GTD+T TLG +A KDPK+A  IV+ EF
Sbjct:  60   DLNTALVKNLGSNYVQHQAMLGGDIDISATRYSGTDLTSTLGKEAEKDPKKALNIVQNEF   119

Query: 122   QKRYNQTWYPTYGFSDTYAFMVTKEFARQNKITKISDLKKLSTTMKAGVDSSWMNREGDG   181
             QKR++  W+ +YGF +TYAF VTK+FA +  I  +SDLKK ++  K GVD++W+ R+GDG
Sbjct: 120   QKRFSYKWFDSYGFDNTYAFTVTKKFAEKEHINTVSDLKKNASQYKLGVDNAWLKRKGDG   179

Query: 182   YTDFAKTYGFEFSHIYPMQIGLVYDAVESNKMQSVLGYSTDGRISSYDLEILRDDKKFFP   241
              Y  F  TYGFEF   YPMQIGLVYDAV++ KM +VL YSTDGRI +YDL+IL+DDK+FFP
Sbjct: 180   YKGFVSTYGFEFGTTYPMQIGLVYDAVKNGKMDAVLAYSTDGRIKAYDLKILKDDKRFFP   239

Query: 242   PYEASMVVNNSIIKKDPKLKKLLHRLDGKINLKTMQNLNYMVDDKLLEPSVVAKQFLEKN   301
             PY+   S V+    ++K+ P+L+  ++++L G+I+  +TMQ LNY VD KL EPSVVAK+FLEK+
Sbjct: 240   PYDCSPVIPEKVLKEHPELEGVINKLIGQIDTETMQELNYEVDGKLKEPSVVAKEFLEKH   299

Query: 302   HYF   304
             HYF
Sbjct: 300   HYF   302
```

Based on this analysis, it was predicted that these proteins and their epitopes could be useful antigens for vaccines or diagnostics.

A related GBS gene <SEQ ID 8511> and protein <SEQ ID 8512> were also identified. Analysis of this protein sequence reveals the following:

Lipop: Possible site: 22   Crend: 5
McG: Discrim Score: 10.26
GvH: Signal Score (–7.5): –4.19

-continued

Possible site: 44
>>> May be a lipoprotein
ALOM program            count: 0 value: 8.65    threshold: 0.0
PERIPHERAL              Likelihood = 8.65       66
modified ALOM score: –2.23
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
56.3/75.4% over 287aa
Bacillus subtilis
EGAD|109208| glycine betaine/carnitine/choline ABC Insert characterized
SP|O32243|OPCC_BACSU GLYCINE BETAINE/CARNITINE/CHOLINE-BINDING PROTEIN PRECURSOR
(OSMOPROTECTANT-BINDING PROTEIN). Insert characterized
GP|2635894|emb|CAB15386.1||Z99121 glycine betaine/carnitine/choline ABC transporter
(osmoprotectant-binding protein) Insert characterized
PIR|E69670|E69670 glycine betaine/carnitine/choline ABC transporter (osmoprotec) opuCC -
Insert characterized
ORF01181(349-1212 of 1524)
EGAD|109208|BS3376(15-302 of 303) glycine betaine/carnitine/choline ABC {Bacillus
subtilis} SP|O32243|OPCC_BACSU GLYCINE BETAINE/CARNITINE/CHOLINE-BINDING PROTEIN PRECURSOR
(OSMOPROTECTANT-BINDING PROTEIN). GP|2635894|emb|CAB15386.1||Z99121 glycine
betaine/carnitine/choline ABC transporter (osmoprotectant-binding protein) {Bacillus
subtilis} PIR|E69670|E69670 glycine betaine/carnitine/choline ABC transporter (osmoprotec)
opuCC - Bacillus subtilis
% Match = 33.5
% Identity = 56.2 % Similarity = 75.3
Matches = 162 Mismatches = 71 Conservative Sub.s = 55

162       192       222       252       282       312       342       372
    VVVFFLIVF*QCLIFIFSVRYKSGSMKRIWGVXXN*LXXITGNSSNAQNNKKGGLDMLKKSHFLQIFTLCLALLTISGCQ
                                                                        :  ::  :  ||
                                                                       MTKIKWLGAFALVFVMLLGGCS
                                                                        10              20

402       432       462       492       522       552       582       612
    LTDTKKSGHTTIKVAAQSSTESSIMANIITELIHHELGYNTTLISNLGSSTVTHQALLRGDADIAATRYTGTDITGTLGL
    |     :   ||| : |||  ||  |:|:| :||   |  || |: ||||  | ||:| ||  |:|||||:|||:|  |||
    LPGLGGASDDTIKIGAQSMTESEIVANMIAQLIEHDTDLNTALVKNLGSNYVQHQAMLGGDIDISATRYSGTDLTSTLGK
               40        50        60        70        80        90        100
```

```
642       672       702       732       762       792       822       852
KAVKDPKEASKIVKTEXQKRYNQTWYPTYGFSDTYAFMVTKEFARQNKITKISDLKKLSTTMKAGVDSSWMNREGDGYTD
:|  ||||:|  ||:  |  |||::  |:  :|||  :||||  |||:||  :   |   :|||||  ::  |  |||::|:  |:||||
EAEKDPKKALNIVQNEFQKRFSYKWFDSYGFDNTYAFTVTKKFAEKEHINTVSDLKKNASQYKLGVDNAWLKRKGDGYKG
            120       130       140       150       160       170       180

882       912       942       972       1002      1032      1062      1092
FAKTYGFEFSHIYPMQIGLVYDAVESNKMQSVLGYSTDGRISSYDLEILRDDKKFFPPYEASMVVNNSIIKKDPKLKKLL
|   ||||||   ||||||||||||::  ||  ::||  ||||||:  |||::|  ||  |:|:   :::
FVSTYGFEFGTTYPMQIGLVYDAVKNGKMDAVLAYSTDGRIKAYDLKILKDDKRFFPPYDCSPVIPEKVLKEHPELEGVI
            200       210       220       230       240       250       260

1122      1152      1182      1212      1242      1272      1302      1332
HRLDGKINLKTMQNLNYMVDDKLLEPSVVAKQFLEKNHYFRGDK*MKQMNTFQQFIYYFQHNGSYILEQFIHHFLISVYG
::|  |:|:  :|||  |||  ||  ||  ||||||||:|||||  |||
NKLIGQIDTETMQELNYEVDGKLKEPSVVAKEFLEKHHYFD
            280       290       300
```

Figure 14:
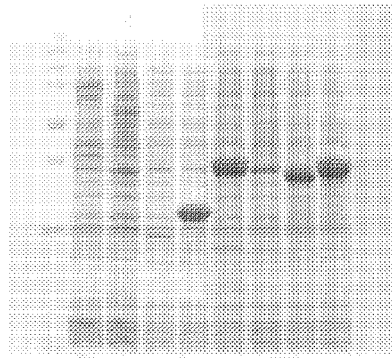

SEQ ID 8512 (GBS23) was expressed in *E. coli* as a His-fusion product. SDS-PAGE analysis of total cell extract is shown in FIG. 14 (lane 8; MW 35 kDa).

The GBS23-His fusion product was purified (FIG. 194, lane 9) and used to immunise mice. The resulting antiserum was used for Western blot (FIG. 251). These tests confirm that the protein is immunoaccessible on GBS bacteria.

Example 196

A DNA sequence (GBSx0202) was identified in *S. agalactiae* <SEQ ID 639> which encodes the amino acid sequence <SEQ ID 640>. This protein is predicted to be membrane permease OpuCB (opuBB). Analysis of this protein sequence reveals the following:

```
Possible site: 34
>>> Seems to have no N-terminal signal sequence
INTEGRAL    Likelihood = -9.66    Transmembrane 25-41 (18-45)
INTEGRAL    Likelihood = -7.96    Transmembrane 182-198 (174-202)
INTEGRAL    Likelihood = -4.83    Transmembrane 61-77 (57-95)
INTEGRAL    Likelihood = -4.09    Transmembrane 78-94 (78-95)
INTEGRAL    Likelihood = -1.22    Transmembrane 134-150 (134-150)
----- Final Results -----
    bacterial membrane --- Certainty = 0.4864 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database:

A related GBS gene <SEQ ID 8513> and protein <SEQ ID 8514> were also identified. Analysis of this protein sequence reveals the following:

Lipop: Possible site: -1    Crend: 0

McG: Discrim Score: -9.08

GvH: Signal Score (-7.5): -1.86

Possible site: 37

>>> Seems to have no N-terminal signal sequence

ALOM program   count: 5 value: -8.60   threshold: 0.0

INTEGRAL    Likelihood = -8.60    Transmembrane 25-41 (18-45)
INTEGRAL    Likelihood = -7.96    Transmembrane 182-198 (174-202)
INTEGRAL    Likelihood = -4.83    Transmembrane 61-77 (57-95)
INTEGRAL    Likelihood = -4.09    Transmembrane 78-94 (78-95)
INTEGRAL    Likelihood = -1.22    Transmembrane 134-150 (134-150)
PERIPHERAL  Likelihood = 2.70     156 modified ALOM score: 2.22

*** Reasoning Step: 3

----- Final Results ----- bacterial membrane --- Certainty = 0.4439 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:AAF91340 GB:AF249729 membrane permease OpuCB [Listeria monocytogenes]
Identities = 121/208 (58%), Positives = 160/208 (76%)
Query:  1    MVNFLSQYGMQILVKTWEQVYISFFAIALGIAIAVPLGVVLTRFPKVAKIIIAIASMLQT   60
             +V F  + G  +LV+TW+ ++IS  A+ LGIA+AVP G++LTR PKVA  +I + S+LQT
Sbjct:  4    IVTFFQENGHNLLVQTWQHLFISLSAVILGIAVAVPTGILLTRSPKVANFVIGVVSVLQT   63

Query:  61   IPSLALLALMIPLFGIGKIPAIVALFIYSLLPILRNTYIGMNNVNPTLKDCAKGMGMKPI  120
             +PSLA+LA +IP  G+G +PAI+ALFIY+LLPILRNT+IG+  V+  L +   +GMGM
Sbjct:  64   VPSLAILAFIIPFLGVGTLPAIIALFIYALLPILRNTFIGVRGVDKNLIESGRGMGMTNW  123

Query: 121   QSIFQVELPLATPIIMAGIRLSTIYVIAWATLASYIGAGGLGDLIFSGLNLFQSKLILGG  180
             Q I   VE+P +   +IMAGIRLS +YVIAWATLASYIGAGGLGD IF+GLNL++    LILGG
Sbjct: 124   QLIVNVEIPNSISVVIMAGIRLSAVYVIAWATLASYIGAGGLGDFIFNGLNLYRPDLILGG  183

Query: 181   TIPVIILSLIIDYLLGLLETALTPRTTR                                  208
                IPV IL+L++++LG  LE  LTP+  R
Sbjct: 184   AIPVTILALVVEFALGKLEYRLTPKAIR                                  211
```

```
ORF01825(301-927 of 1233)
GP|9651976|gb|AAF91340.1|AF249729_2|AF249729(4-212 of 218) membrane permease OpuCB
{Listeria monocytogenes}
% Match = 30.2
% Identity = 57.9 % Similarity = 79.9
Matches = 121 Mismatches = 42 Conservative Sub.s = 46

117       147       177       207       237       267       297       327
       STCF*YLKTY*FLCYGRRLT*KYC*AYFKTWFKIRSSC*P*E*LKGHCYSCIPS*YVIRYYLGRY*NGGSIMVNFLSQYG
                                                                       :|  |: : |
                                                                       MDAIVTFFQENG
                                                                              10

357       387       417       447       477       507       537       567
       MQILVKTWEQVYISFFAIALGIAIAVPXGVVLTRFPKVAKIIIAIASMLQTIPSLALLALMIPLFGIGKIPAIVALFIYS
       :||:||::::||: |:  ||||:|||  |::||| ||||   :|  : |:|||:|||||:||::||::|:|  :|||:||||||:
       HNLLVQTWQHLFISLSAVILGIAVAVPTGILLTRSPKVANFVIGVVSVLQTVPSLAILAFIIPFLGVGTLPAIIALFIYA
              30        40        50        60        70        80        90

597       627       657       687       717       747       777       807
       LLPILRNTYIGMNNVNPTLKDCAKGMGMKPIQSIFQVELPLATPIIMAGIRLSTIYVIAWATLASYIGAGGLGDLIFSGL
       ||||||||:||:  |: |  :  :|||| ||  | | ||:| :  :||||||||||||||||||||||||||||||||||:||:|
       LLPILRNTFIGVRGVDKNLIESGRGMGMTNWQLIVNVEIPNSISVIMAGIRLSAVYVIAWATLASYIGAGGLGDFIFNGL
             110       120       130       140       150       160       170

837       867       897       927       957       987      1017      1047
       NFLQSKLILGGTIPVIILSLIIDYLLGLLETALTPRTTRREA*ICLKNRTFYRYLHFA*PS*RFLVVN*PILKSLVIPQL
       ||::  |||||  |||  ||:|::::  ||  ||   |||:   |
       NLYRPDLILGGAIPVTILALVVEFALGKLEYRLTPKAIREAREGGE
                       190       200       210
```

Based on this analysis, it was predicted that these proteins and their epitopes could be useful antigens for vaccines or diagnostics.

Possible site: 46
>>> Seems to have no N-terminal signal sequence
----- Final Results -----
  bacterial cytoplasm --- Certainty = 0.3531 (Affirmative) <succ>
  bacterial membrane --- Certainty = 0.0000 (Not Clear) <succ>
  bacterial outside --- Certainty = 0.0000 (Not Clear) <succ>

Example 197

A DNA sequence (GBSx0203) was identified in *S. agalactiae* <SEQ ID 641> which encodes the amino acid sequence <SEQ ID 642>. Analysis of this protein sequence reveals the following:

The protein has homology with the following sequences in the GENPEPT database:

```
>GP:AAF91339 GB:AF249729 ATPase OpuCA [Listeria monocytogenes]
Identities = 230/380 (60%), Positives = 298/380 (77%), Gaps = 4/380 (1%)
Query:   6   IIEYQNINKVY-GENVAVEDINLKIYPGDFVCFIGTSGSGKTTLMRMVNHMLKPTNGTLL   64
             +++++++ K Y G   AV D+ L I  G+FVCFIG SG GKTT M+M+N +++PT G+
Sbjct:   1   MLKFEHVTKTYKGGKKAVNDLTLNIDKGEFVCFIGPSGCGKTTTMKMINRLIEPTEGKIF   60

Query:  65   FKGKDISTINPIELRRRIGYVIQNIGLMPHMTIYENIVLVPKLLKWSEEAKRAKARELIK   124
                 KDI   +P++LRR IGYVIQ IGLMPHMTI ENIVLVPKLLKWSEE K+ +A+ELIK
Sbjct:  61   INDKDIMAEDPVELRRSIGYVIQQIGLMPHMTIRENIVLVPKLLKWSEEKKQERAKELIK   120

Query: 125   LVELPEEYLDRYPSELSGGQQQRIGVIRALAADQDIILMDEPFGALDPITREGIQDLVKS   184
             LV+LPEE+LDRYP ELSGGQQQRIGV+RALAA+Q++ILMDEPFGALDPITR+  +Q+  K+
Sbjct: 121   LVDLPEEFLDRYPYELSGGQQQRIGVLRALAAEQNLILMDEPFGALDPITRDSLQEEFKN   180

Query: 185   LQEEMGKTIILVTHDMDEALKLATKIIVMDNGKMVQEGTPNDLLHHPATSFVEQMIGEER   244
             LQ+E+GKTII VTHDMDEA+KLA +I++M +G++VQ  TP+++L +PA SFVE  IG++R
Sbjct: 181   LQKELGKTIIFVTHDMDEAIKLADRIVIMKDGEIVQFDTPDEILRNPANSFVEDFIGKDR   240

Query: 245   LLHAQADITPVKQIMLNNPVSITAEKTLTEAITLMRQKRVDSLLVTDNGKLI-GFIDLES   303
             L+ A+ D+T V QIM  NPVSITA+K+L  AIT+M++KRVD+LLV D G ++ GFID+E
Sbjct: 241   LIEAKPDVTQVAQIMNTNPVSITADKSLQAAITVMKEKRVDTLLVVDEGNVLKGFIDVEQ   300

Query: 304   LSSKYKKDRLVSDILKHTDFYVMEDDLLRNTAERILKLGLKYAPVVDHENNLKGIVTRAS   363
             +     +    V DI++    FYV ED LLR+T +RILK G KY PVVD +  L GIVTRAS
Sbjct: 301   IDLNRRTATSVMDIIEKNVEYVYEDTLLRDTVQRILKRGYKYIPVVDKDKRLVGIVTRAS   360

Query: 364   LVDMLYDIIWGDTE--TEDQ   381
             LVD++YD IWG E    TE+Q
Sbjct: 361   LVDIVYDSIWGTLEDATENQ   380
```

A related DNA sequence was identified in *S. pyogenes* <SEQ ID 643> which encodes the amino acid sequence <SEQ ID 644>. Analysis of this protein sequence reveals the following:

Possible site: 39
>>> Seems to have no N-terminal signal sequence
----- Final Results -----
　　bacterial cytoplasm --- Certainty = 0.3619 (Affirmative) <succ>
　　　　bacterial membrane --- Certainty = 0.0000 (Not Clear) <succ>
　　　　　　bacterial outside --- Certainty = 0.0000 (Not Clear) <succ>

An alignment of the GAS and GBS proteins is shown below:

```
Identities = 102/237 (43%), Positives = 165/237 (69%), Gaps = 1/237 (0%)
Query:   6  IIEYQNINKVYGENVAVEDINLKIYPGDFVCFIGTSGSGKTTLMRMVNHMLKPTNGTLLF   65
            +I + N++K +G+   +++   +I   +F   +G SGSGKTTL++M+N +++P++G +L
Sbjct:   1  MIRFNNVSKTFGQTKVLQEQTFQINDREFFVLVGPSGSGKTTLLKMINCLIEPSSGDILL   60

Query:  66  KGKDISTINPIELRRRIGYVIQNIGLMPHMTIYENIVLVPKLLKWSEEAKRAKARELIKL  125
                 + ++  E+R  IGYV+Q I L P++T+ ENI ++P++ +WS E  R K   EL+
Sbjct:  61  NNVPQTELDLREMRLSIGYVLQQIALFPNLTVAENIAIIPEMKQWSAEEIRQKTEELLDK  120

Query: 126  VELP-EEYLDRYPSELSGGQQQRIGVIRALAADQDIILMDEPFGALDPITREGIQDLVKS  184
            V LP ++YLDRYPS+LSGG+QQRIG++RA+ +    I+LMDEPF ALDPI+R+ +Q+L+ S
Sbjct: 121  VGLPARDYLDRYPSDLSGGEQQRIGIVRAIISHPKILLMDEPFSALDPISRKQLQELMLS  180

Query: 185  LQEEMGKTIILVTHDMDEALKLATKIIVMDNGKMVQEGTPNDLLHHPATSFVEQMIG      241
            L +E    TI+ VTHD+DEA+KL  ++ +++ G++VQ   P  +  HPA +FV  + G
Sbjct: 181  LHKEFDMTIVIVTHDIDEAIKLGDRVAILNEGEIVQLDRPEMIKTHPANAFVVNLFG      237
```

Based on this analysis, it was predicted that these proteins and their epitopes could be useful antigens for vaccines or diagnostics.

Example 198

A repeated DNA sequence (GBSx0212) was identified in *S. agalactiae* <SEQ ID 645> which encodes the amino acid sequence <SEQ ID 646>. Analysis of this protein sequence reveals the following:

Possible site: 24
>>> Seems to have no N-terminal signal sequence
----- Final Results -----
　　bacterial cytoplasm --- Certainty = 0.4736 (Affirmative) <succ>
　　　　bacterial membrane --- Certainty = 0.0000 (Not Clear) <succ>
　　　　　　bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 199

A DNA sequence (GBSx0213) was identified in *S. agalactiae* <SEQ ID 647> which encodes the amino acid sequence <SEQ ID 648>. Analysis of this protein sequence reveals the following:

Possible site: 38
>>> Seems to have no N-terminal signal sequence
INTEGRAL　　　Likelihood = −1.06　　Transmembrane 18-34 (18-34)
----- Final Results -----
　　bacterial membrane --- Certainty = 0.1426 (Affirmative) <succ>
　　　　bacterial outside --- Certainty = 0.0000 (Not Clear) <succ>
　　　　　　bacterial cytoplasm --- Certainty = 0.0000 (Not Clear) <succ>

No corresponding DNA sequence was identified in *S. pyogenes*.

A related GBS gene <SEQ ID 8515> and protein <SEQ ID 8516> were also identified. Analysis of this protein sequence reveals the following:

Lipop: Possible site: 20　　Crend: 5
Sequence Pattern: CQMN
SRCFLG: 0
McG: Length of UR: 19
Peak Value of UR: 2.60
Net Charge of CR: 3
McG: Discrim Score: 7.77
GvH: Signal Score (−7.5): −4.89
Possible site: 25
>>> May be a lipoprotein
Amino Acid Composition: calculated from 21
ALUM program　　　count: 0 value: 13.21　　threshold: 0.0
PERIPHERAL　　　Likelihood = 13.21　　　　115
modified ALOM score: −3.14
*** Reasoning Step: 3
----- Final Results -----
　　bacterial membrane --- Certainty = 0.0000 (Not Clear) <succ>
　　　　bacterial outside --- Certainty = 0.0000 (Not Clear) <succ>
　　　　　　bacterial cytoplasm --- Certainty = 0.0000 (Not Clear) <succ>

The protein has homology with the following sequences in the databases:

```
ORF01527(346-465 of 1095)
EGAD|7398|7198(2-41 of 47) lysis protein for colicin e9 precursor {Escherichia coli}
EGAD|41475|43808 lysis protein { } SP|P13344|LYS5_ECOLI LYSIS PROTEIN FOR COLICIN E5
PRECURSOR. GP|40543|emb|CAA33861.1|X15857 lysis protein (AA 1-47) {Enterobacteriaceae}
GP|144373|gb|AAA98053.1|M30445 colicin release protein {Plasmid ColE5-099}
PIR|JQ0330|JQ0330 colicin E5 lysis protein precursor - Escherichia coli plasmid ColE5-099
% Match = 3.7
% Identity = 35.0 % Similarity = 52.5
Matches = 14 Mismatches = 19 Conservative Sub.s = 7

135       165       195       225       255       285       315       345
YIYFFHCRRIYIIININY*FN*GI*NIQMIFCLHVKTKTIKIRENFVILKLIL*CW*IIVNFIIYLIYKIYILRKENMMR

M 375       405       435       465       495       525       555       585
KYIKWLIPISIFGMILGGCQMNSEHKIQSNEVKNSKQSEVKKDKKMTKKEQLAYLKEHEQEIIDYVKLHNNQIESVQFDW
   |  |:| :  :  :||   ||  |   | :|    |     |   :|:
KKITWIILLLLAAIILAACQANYIHDVQGGTVSPSSAELTGLATQ
              20        30        40
```

Figure 74:
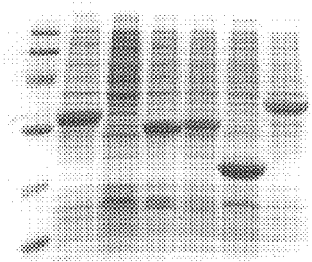

SEQ ID 8516 (GBS389) was expressed in *E. coli* as a His-fusion product. SDS-PAGE analysis of total cell extract is shown in FIG. 74 (lane 6; MW 18 kDa).

Figure 313:
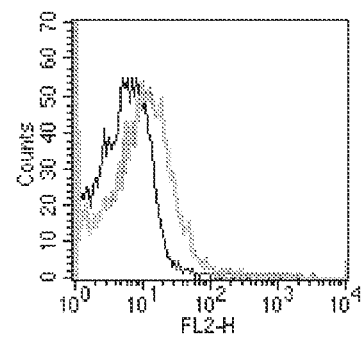

The GBS389-His fusion product was purified (FIG. 214, lane 4) and used to immunise mice. The resulting antiserum was used for FACS (FIG. 313), which confirmed that the protein is immunoaccessible on GBS bacteria.

Based on this analysis, it was predicted that these proteins and their epitopes could be useful antigens for vaccines or diagnostics.

Example 200

A DNA sequence (GBSx0214) was identified in *S. agalactiae* <SEQ ID 649> which encodes the amino acid sequence <SEQ ID 650>. Analysis of this protein sequence reveals the following:

Possible site: 19
>>> Seems to have no N-terminal signal sequence
----- Final Results -----
   bacterial cytoplasm --- Certainty = 0.3766 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 201

A DNA sequence (GBSx0215) was identified in *S. agalactiae* <SEQ ID 651> which encodes the amino acid sequence <SEQ ID 652>. Analysis of this protein sequence reveals the following:

Possible site: 46
>>> Seems to have no N-terminal signal sequence
----- Final Results -----
   bacterial cytoplasm --- Certainty = 0.3882 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 202

A DNA sequence (GBSx0216) was identified in *S. agalactiae* <SEQ ID 653> which encodes the amino acid sequence <SEQ ID 654>. This protein is predicted to be lectin, alpha subunit precursor. Analysis of this protein sequence reveals the following:

Possible site: 47
>>> Seems to have no N-terminal signal sequence
----- Final Results -----
   bacterial cytoplasm --- Certainty = 0.0653 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 203

A DNA sequence (GBSx0217) was identified in *S. agalactiae* <SEQ ID 655> which encodes the amino acid sequence <SEQ ID 656>. Analysis of this protein sequence reveals the following:

Possible site: 41
>>> Seems to have no N-terminal signal sequence
----- Final Results -----
   bacterial cytoplasm --- Certainty = 0.6569 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 204

A DNA sequence (GBSx0218) was identified in *S. agalactiae* <SEQ ID 657> which encodes the amino acid sequence <SEQ ID 658>. Analysis of this protein sequence reveals the following:

Possible site: 27
>>> Seems to have no N-terminal signal sequence
----- Final Results -----
   bacterial cytoplasm --- Certainty = 0.5736 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 205

A DNA sequence (GBSx0219) was identified in *S. agalactiae* <SEQ ID 659> which encodes the amino acid sequence <SEQ ID 660>. Analysis of this protein sequence reveals the following:

Possible site: 52
>>> Seems to have an uncleavable N-term signal seq
INTEGRAL    Likelihood = −13.11    Transmembrane 146-162 (138-170)
INTEGRAL    Likelihood = −12.90    Transmembrane 13-29 (9-32)
INTEGRAL    Likelihood = −9.50     Transmembrane 108-124 (104-129)
INTEGRAL    Likelihood = −7.75     Transmembrane 40-56 (33-61)
INTEGRAL    Likelihood = −6.64     Transmembrane 177-193 (170-195)
INTEGRAL    Likelihood = −3.35     Transmembrane 77-93 (77-97)

----- Final Results -----
   bacterial membrane --- Certainty = 0.6243 (Affirmative) <succ>
   bacterial outside --- Certainty = 0.0000 (Not Clear) <succ>
   bacterial cytoplasm --- Certainty = 0.0000 (Not Clear) <succ>

A related GBS nucleic acid sequence <SEQ ID 8517> which encodes amino acid sequence <SEQ ID 8518> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

Example 206

A DNA sequence (GBSx0220) was identified in *S. agalactiae* <SEQ ID 661> which encodes the amino acid sequence <SEQ ID 662>. Analysis of this protein sequence reveals the following:

Possible site: 37
>>> Seems to have no N-terminal signal sequence
----- Final Results -----
   bacterial cytoplasm --- Certainty = 0.2374 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database:

```
>GP:AAB89623 GB:AE000990 repressor protein [Archaeoglobus fulgidus]
Identities = 34/62 (54%), Positives = 46/62 (73%)
Query:  11 LKQVREDIGMTQQELAIRIGVRRETIGHLENNRYNPSLEMALKIVKIFDMKIEDIFQLRK 70
            +K+ R    MTQ+ELA R+GVRRETI  LE  +YNPSL++A KI ++F+ KIEDIF   +
Sbjct:   5 IKEFRAKFNMTQEELAKRVGVRRETIVFLEKGKYNPSLKLAYKIARVFNAKIEDIFIFDE 64

Query:  71 ED                                                            72
            E+
Sbjct:  65 EE                                                            66
```

There is also homology to SEQ ID 412.

Based on this analysis, it was predicted that this protein and its epitopes, could be useful antigens for vaccines or diagnostics.

Example 207

A DNA sequence (GBSx0221) was identified in *S. agalactiae* <SEQ ID 663> which encodes the amino acid sequence <SEQ ID 664>. Analysis of this protein sequence reveals the following:

Possible site: 36
>>> Seems to have no N-terminal signal sequence
----- Final Results -----
   bacterial cytoplasm --- Certainty = 0.3794 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database:

```
>GP:CAB61817 GB:AL133236 putative acetyl transferase [Streptomyces
coelicolor A3(2)]
Identities = 30/97 (30%), Positives = 52/97 (52%), Gaps = 1/97 (1%)
Query: 82    VGMLNIVTLARADMQWGELGYVFHNQFWSNGYAFESILALLNSTYEKLGFHHIEAQITPG  141
             VGM ++    +    Q GE+ Y+ H + W  G    E   +LL+  +++ G H I A     P
Sbjct: 72    VGMGDLHVRSHTQRQ-GEISYIVHPRVWGQGIGTEIGRSLLSLGFDRWGLHRIRATCDPR  130

Query: 142   NERSEKLVRRLGLTYETTRKDFSFENGKWTDKLIYSI                         178
             N+ S +++ +LG+TYE  +   ++       W D L++SI
Sbjct: 131   NQASSRVLTKLGMTYEGRHRHTAWIRDGWRDSLVFSI                         167
```

No corresponding DNA sequence was identified in *S. pyogenes*.

Based on this analysis, it was predicted that this protein and its epitopes, could be useful antigens for vaccines or diagnostics.

Example 208

A DNA sequence (GBSx0222) was identified in *S. agalactiae* <SEQ ID 665> which encodes the amino acid sequence <SEQ ID 666>. This protein is predicted to be p20 protein. Analysis of this protein sequence reveals the following:

Possible site: 44
>>> Seems to have no N-terminal signal sequence
----- Final Results -----
    bacterial cytoplasm --- Certainty = 0.1044 (Affirmative) <succ>
      bacterial membrane --- Certainty = 0.0000 (Not Clear) <succ>
        bacterial outside --- Certainty = 0.0000 (Not Clear) <succ>

The protein has homology with the following sequences in the GENPEPT database:

```
>GP:CAA30415 GB:X07542 P20 (AA 1-178) [Bacillus licheniformis]
Identities = 56/175 (32%), Positives = 94/175 (53%), Gaps = 6/175 (3%)
Query: 16    TVLTERLRLQPVELTNVNDFLEFSSDSETVFYMQRYKANTVEEAQVVLA---NVCMKSPL   72
             T+ TERL L+ +EL + +   ++ SD E   YM       V +A+ ++      ++ ++
Sbjct: 3     TLYTERLTLRKMELEDADVLCQYWSDPEVTKYMNITPFTDVSQARDMIQMINDLSLEGQA   62

Query: 73    GIYAMIEKESQKMIGIIELEIRDEFS--AEFGYILNKNYNGKGYMTEACSKLMSIGFEHL  130
             +++I KE+ ++IG   + D+ +   AE GY L +N+ GKG+ +EA   KL+   GF    L
Sbjct: 63    NRFSIIVKETDEVIGTCGFNMIDQENGRAEIGYDLGRNHWGKGFASEAVQKLIDYGFTSL  122

Query: 131   DLERIYARFDINNKKSGNVMERIGMKKEGELRHLAKNPKGEWKTRAYYSILKEEY       185
             +L RI A+ +  N  S  ++   +     +KEG LR    K   KG           +S+LK EY
Sbjct: 123   NLNRIEAKVEPENTPSIKLLNSLSFQKEGLLRDYEK-AKGRLIDVYMFSLLKREY       176
```

Based on this analysis, it was predicted that this protein and its epitopes, could be useful antigens for vaccines or diagnostics.

Example 209

A DNA sequence (GBSx0223) was identified in *S. agalactiae* <SEQ ID 669> which encodes the amino acid sequence <SEQ ID 670>. Analysis of this protein sequence reveals the following:

Possible site: 51
>>> Seems to have no N-terminal signal sequence
----- Final Results -----
    bacterial cytoplasm --- Certainty = 0.5180 (Affirmative) <succ>
      bacterial membrane --- Certainty = 0.0000 (Not Clear) <succ>
        bacterial outside --- Certainty = 0.0000 (Not Clear) <succ>

The protein has homology with the following sequences in the GENPEPT database:

```
>GP: CAA87001 GB: Z46902 unknown [Saccharomyces cerevisiae]
Identities = 105/224 (46%), Positives = 148/224 (65%), Gaps = 3/224 (1%)
Query:     1 MGDVVENFTEGKNPKIDTLNGKTVRIEKINPD-HFEDLFQVYGELSTEDSLTYISFSKFN    59
             +G  VE +T     P+   L G T R+E ++ + H  +LF Y E   +   TY+    F
Sbjct:    11 VGADVEGWTTRAFPEKVVLKGNTCRLEPLDRERHGSELFSAYSEAG-QKLWTYLPAGPFT    69

Query:    60 SKNEFDVFFQTLLKSEDPYYLAIVDNNTGKVLGTFSLMRIDTKNRVVEMGWVVYSSKLKQ   119
             + E+  F + L +++D     AI++  T + +GT  L+RID  N   +E+G+VV+S +L++
Sbjct:    70 NLEEYLEFIKELNETKDTVPFAIINKETERAVGTLCLIRIDEANGSLEVGYVVFSPELQK   129

Query:   120 TRIATEAQYLVMKYVFEELCYRRYEWKCDSLNAPSNNSAKRLGFTFEGTFRQAVVYKGRN   179
             T IATEAQ+L+MKYVF++L YRRYEWKCDSLN PS  +A RLGF +EGTFRQ VVYKGR
Sbjct:   130 TIIATEAQFLLMKYVFDDLQYRRYEWKCDSLNGPSRRAAMRLGFKYEGTFRQVVVYKGRT   189

Query:   180 RDTNWYSILDKEWPEKKTRFEKWLDDSNFAVNGYQIRSLSSIEQ                  223
             RDT W+SI+DKEW      + FE+WLD +NF  NG Q R +++I +
Sbjct:   190 RDTQWFSIIDKEWLRIRKTFEEWLDKTNFE-NGKQKRGIAAIRE                  232
```

No corresponding DNA sequence was identified in *S. pyogenes*.

Based on this analysis, it was predicted that this protein and its epitopes, could be useful antigens for vaccines or diagnostics.

Example 210

A DNA sequence (GBSx0224) was identified in *S. agalactiae* <SEQ ID 671> which encodes the amino acid sequence <SEQ ID 672>. Analysis of this protein sequence reveals the following:

---

Possible site: 39
>>> Seems to have no N-terminal signal sequence
INTEGRAL     Likelihood = −12.15     Transmembrane 25-41 (20-49)
----- Final Results -----
    bacterial membrane --- Certainty = 0.5861 (Affirmative) <succ>
        bacterial outside --- Certainty = 0.0000 (Not Clear) <succ>
            bacterial cytoplasm --- Certainty = 0.0000 (Not Clear) <succ>

---

The protein has no significant homology with any sequences in the GENPEPT database.

No corresponding DNA sequence was identified in *S. pyogenes*.

A related GBS gene <SEQ ID 8519> and protein <SEQ ID 8520> were also identified. Analysis of this protein sequence reveals the following:

---

Lipop: Possible site: −1    Crend: 10
McG: Discrim Score: −3.31
GvH: Signal Score (−7.5): −4.44
Possible site: 39
>>> Seems to have no N-terminal signal sequence
ALOM program    count: 1 value: −12.15 threshold: 0.0
INTEGRAL     Likelihood = −12.15  Transmembrane 25-41 (20-49)
PERIPHERAL   Likelihood = 11.94    59
modified ALOM score: 2.93
*** Reasoning Step: 3
----- Final Results -----
    bacterial membrane --- Certainty = 0.5861 (Affirmative) <succ>
        bacterial outside --- Certainty = 0.0000 (Not Clear) <succ>
            bacterial cytoplasm --- Certainty = 0.0000 (Not Clear) <succ>

---

SEQ ID 672 (GBS43) was expressed in *E. coli* as a His-fusion product. SDS-PAGE analysis of total cell extract is shown in FIG. 5 (lane 4; MW 34 kDa). It was also expressed in *E. coli* as a GST-fusion product. SDS-PAGE analysis of total cell extract is shown in FIG. 13 (lane 9; MW 58 kDa) and in FIG. 15 (lane 4; MW 59 kDa).

Based on this analysis, it was predicted that these proteins and their epitopes could be useful antigens for vaccines or diagnostics.

Example 211

A DNA sequence (GBSx0225) was identified in *S. agalactiae* <SEQ ID 673> which encodes the amino acid sequence <SEQ ID 674>. Analysis of this protein sequence reveals the following:

---

Possible site: 32
>>> May be a lipoprotein
----- Final Results -----
    bacterial membrane --- Certainty = 0.0000 (Not Clear) <succ>
        bacterial outside --- Certainty = 0.0000 (Not Clear) <succ>
            bacterial cytoplasm --- Certainty = 0.0000 (Not Clear) <succ>

---

A related GBS nucleic acid sequence <SEQ ID 9519> which encodes amino acid sequence <SEQ ID 9520> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

Example 212

A DNA sequence (GBSx0226) was identified in *S. agalactiae* <SEQ ID 675> which encodes the amino acid sequence <SEQ ID 676>. Analysis of this protein sequence reveals the following:

---

Possible site: 44
>>> Seems to have no N-terminal signal sequence
INTEGRAL     Likelihood = −1.54     Transmembrane 165-181 (164-181)
INTEGRAL     Likelihood = −0.85     Transmembrane 67-83 (67-84)
----- Final Results -----
    bacterial membrane --- Certainty = 0.1617 (Affirmative) <succ>
        bacterial outside --- Certainty = 0.0000 (Not Clear) <succ>
            bacterial cytoplasm --- Certainty = 0.0000 (Not Clear) <succ>

---

The protein has homology with the following sequences in the GENPEPT database:

```
>GP: CAA82211 GB: Z28353 similar to a B. subtilis gene (GB:
BACHEMEHY_5) [Clostridium pasteurianum]
Identities = 40/185 (21%), Positives = 87/185 (46%), Gaps = 6/185 (3%)
Query:   18 MPKGKQKVILSAIELFASQGFHGTSTAQLAKNAEVSQATIYKYFETKDKLLVFILELIVQ   77
             M K K   + SAI++F++ G++G +  ++A NA V++ T+Y +F++K+++  +I+E  V
Sbjct:    1 MNKTKDNIFYSAIKVFSNNGYNGATMDEIASNAGVAKGTLYYHFKSKEEIFKYIIEEGVN   60

Query:   78 TIGRPFFTELSTFSTKEELIHFFVQDRFKFIEKNNDLIKILMQELLINSETSTIFTKLIN  137
             +              T  E +    + +   I KN D  K++  +L               ++
Sbjct:   61 LMKNEIDEATDKEKTALEKLKAVCRVQLNLIYKNRDFFKVIASQLWGKELRQLELRDIMR  120

Query:  138 STDPNITKIFNCLSEGNSL---NKMEILRAVIGQFITFFIQLY-ILNIKPENLEEELKQI  193
             +   +I +         E  S+   N + +  A +G   +   + LY ++N + +N+    ++ +
Sbjct:  121 NYVVHIEEFVKDAMEAGSIKKGNSLFVAYAFLGTLCS--VSLYEVINAENDNINNTIENL  178

Query:  194 EKQIL                                                         198
                 IL
Sbjct:  179 MNYIL                                                         183
```

No corresponding DNA sequence was identified in S. pyogenes.

Based on this analysis, it was predicted that this protein and its epitopes, could be useful antigens for vaccines or diagnostics.

Example 213

A DNA sequence (GBSx0227) was identified in S. agalactiae <SEQ ID 677> which encodes the amino acid sequence <SEQ ID 678>. Analysis of this protein sequence reveals the following:

Possible site: 24
>>> Seems to have no N-terminal signal sequence
----- Final Results -----
  bacterial cytoplasm --- Certainty = 0.2389 (Affirmative) <succ>
  bacterial membrane --- Certainty = 0.0000 (Not Clear) <succ>
  bacterial outside --- Certainty = 0.0000 (Not Clear) <succ>

Possible site: 43
>>> Seems to have no N-terminal signal sequence
INTEGRAL    Likelihood = −13.32   Transmembrane 341-357 (333-361)
INTEGRAL    Likelihood = −10.93   Transmembrane 253-269 (238-277)
INTEGRAL    Likelihood = −10.77   Transmembrane 172-188 (166-196)
INTEGRAL    Likelihood = −8.01    Transmembrane 225-241 (215-251)
INTEGRAL    Likelihood = −7.01    Transmembrane 21-37 (18-42)
INTEGRAL    Likelihood = −2.66    Transmembrane 285-301 (283-301)
----- Final Results -----
  bacterial membrane --- Certainty = 0.6328 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database:

```
>GP: CAB42664 GB: AL049819 putative integral membrane protein
[Streptomyces coelicolor A3(2)]
Identities = 60/156 (38%), Positives = 101/156 (64%), Gaps = 1/156 (0%)
Query:  176 LMGFMVFFFVFLISGMALLKERTSGTLDRLLATPVKRSDIVFGYMLSYGILAIIQTIVIV  235
             L+G          +FL++ +A L+ERTSGTL+RLLA P+ + D++ GY L++G LAI+Q+ +
Sbjct:   77 LLGIFPLITMFLVTSIATLRERTSGTLERLLAMPLGKGDLIAGYALAFGALAIVQSALAT  136

Query:  236 LSTIWLLDIQVVGSIFSVIIVNFILALVALSLGILMSTLAKSEFQMMQFIPLIIMPQLFF  295
             +W L + V GS +  +++V   + AL+   +LG+ +S  A SEFQ +QF+P +I PQL
Sbjct:  137 GLAVWFLGLDVTGSPWLLLLVALLDALLGTALGLFVSAFAASEFQAVQFMPAVIFPQLLL  196

Query:  296 SGII-PLENMASWAQTVGKILPLSYSGDALTKIIMY                          330
             G+   P +NM    + V   +LP+SY+ D + +++ +
Sbjct:  197 CGLFTPRDNMHPALEAVSDVLPMSYAVDGMNEVLRH                          232
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 214

A DNA sequence (GBSx0228) was identified in S. agalactiae <SEQ ID 679> which encodes the amino acid sequence <SEQ ID 680>. Analysis of this protein sequence reveals the following:

There is also homology to a DNA sequence which was identified in S. pyogenes <SEQ ID 681> which encodes the amino acid sequence <SEQ ID 682>. Analysis of this protein sequence reveals the following:

Possible site: 39
>>> Seems to have no N-terminal signal sequence
INTEGRAL    Likelihood = −11.41   Transmembrane 263-279 (246-284)
INTEGRAL    Likelihood = −7.70    Transmembrane 231-247 (224-258)
INTEGRAL    Likelihood = −4.99    Transmembrane 20-36 (18-39)
INTEGRAL    Likelihood = −3.72    Transmembrane 349-365 (345-368)
INTEGRAL    Likelihood = −3.45    Transmembrane 187-203 (182-204)
----- Final Results -----

-continued bacterial membrane --- Certainty = 0.5564 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the databases:

```
>GP: CAB12662 GB: Z99108 similar to ABC transporter (ATP-binding
protein) [Bacillus subtilis]
Identities = 92/369 (24%), Positives = 180/369 (47%), Gaps = 25/369 (6%)
Query:    12 IKRKKTSYVTFFLMPILTTLLALSLSFSNNNQAKIGILDKDNSQISKQFIAQLKQNKKYD    71
              I +K  +Y+  F  P+L T +   S+    N+++ ++ I+D+D++  +S+ +I QLK +
Sbjct:    15 IFKKPQNYLIMFAAPLLLTFVFGSMLSGNDDKVRLAIVDQDDTILSQHYIRQLKAHDDMY    74

Query:    72 IFTKIKKEHIDHYLQDKSLEAVLTIDKGFSDKVLQGKSQKLNIRSIANSEITEWVKAQTN   131
              +F  +        L+ K  ++ I + F  ++ +GK +L  R         VK
Sbjct:    75 VFENMSESKASEKLKQKKIAGIIVISRSFQTQLEKGKHPELIFRHGPELSEAPMVKQYAE   134

Query:   132 YLLENYNIIGDVALGNEDTFNR---------ILQKNQQLNYDVKQVTLTDRSRSKAVSST   182
                    L     NI   A     T            +K++ +   V + TL+D+     S T
Sbjct:   135 SALATLNIQVTAAKTASQTAGENWKAAYKTVFAKKHEDIVPAVTRQTLSDKKEGAEASDT   194

Query:   183 TT---GFLLILMLGSTSVIYSGILADKSSQLYHRLMLSNLSRFR----YMLSYVCVGFVA   235
                +   GF ++ ++ +       IL  + + ++ RL+ +++SR       Y+LS+  +G++
Sbjct:   195 ASRAAGFSILFVMLTMMGAAGTILEARKNGVWSRLLTASVSRAEIGAGYVLSFFVIGWIQ   254

Query:   236 FTIQIVIMLSLLKVFNISFFVPTSLLLIIFFLFSLLAIGFGLLIGAITQNSQQSSQLANL   295
              F I   ++LS   +F I++  P ++++++  LF L  +G GL+I A   +Q       NL
Sbjct:   255 FGI---LLLSTHWLFGINWGNPAAVIVLVS-LFLLTVVGIGLMIAANVRTPEQQLAFGNL   310

Query:   296 IVMPTSMLAGCLWPLSITPSYMQAIGKLLPQNWVLSAIA-IFQSGGTLSQAWPYLLALMG   354
              +V+ T M++G  WP+ I P +MQ+I + LPQ W +S + I   +G    ++    +L + G
Sbjct:   311 FVIATCMVSGMYWPIDIEPKFMQSIAEFLPQKWAMSGLTEIIANGARVTD----ILGICG   366

Query:   355 TALALISFS                                                      363
              LA  + +
Sbjct:   367 ILLAFAAIT                                                      375
```

An alignment of the GAS and GBS proteins is shown below:

```
Identities = 92/375 (24%), Positives = 164/375 (43%), Gaps = 66/375 (17%)
Query:    11 IKELF----RDKRTLAMMFLAPILIMFLMNVMFSANSNTKVKIGTINVNTKVVSNLDNIK    66
              IK LF    R K +    FL PIL   L+ +  S ++N + KIG ++ +    +S
Sbjct:     5 IKTLFVKIKRKKTSYVTFFLMPILTT-LLALSLSFSNNNQAKIGILDKDNSQISK-----    58

Query:    67 HIQVRSFKFNSSAKKALKSNKIDALISEDNKSYTVFYANTDSSKTTLT-RQAFKTAVNTM   125
                      +F +   LK NK   + ++    K +   Y       S +  LT  + F  V
Sbjct:    59 -------QFIAQ----LKQNKKYDIFTKIKKEHIDHYLQDKSLEAVLTIDKGFSDKVLQG   107

Query:   126 NSKELISQVKILANKNPKLAQSLQTRSKYIKEKYNY------GNKNT-----------GF   168
              +S++L      I +  N ++ + ++ ++ Y+ E YN         GN++T              +
Sbjct:   108 KSQKL----NIRSIANSEITEWVKAQTNYLLENYNIIGDVALGNEDTFNRILQKNQQLNY   163

Query:   169 FAKMIPIL------------MGFMVFFFVFLISGM--ALLKERTSGTLDRLLATPVKRSD   214
              K + +             GF++       +  S +    +L +++S   RL+ + + R
Sbjct:   164 DVKQVTLTDRSRSKAVSSTTTGFLLILMLGSTSVIYSGILADKSSQLYHRLMLSNLSR--   221

Query:   215 IVFGYMLSY---GILAIIQTIVIVLSTIWLLDIQVVGSIFSVIIVNFILALVALSLGILM   271
                F YMLSY     G +A       IVI+LS + + +I       ++I+ F+ +L+A+   G+L+
Sbjct:   222 --FRYMLSYVCVGFVAFTIQIVIMLSLLKVFNISFFVPTSLLLIIFFLFSLLAIGFGLLI   279

Query:   272 STLAKSEFQMMQFIPLIIMPQLFFSGII-PLENMASWAQTVGKILPLSYSGDALTKIIMY   330
              +  ++      Q Q     LI+MP   +G + PL       S+   +GK+LP ++            A+   I
Sbjct:   280 GAITQNSQQSSQLANLIVMPTSMLAGCLWPLSITPSYMQAIGKLLPQNWVLSAIA-IFQS   338

Query:   331 GQGLPNVSSNLLVLL                                                345
               G  L        LL L+
Sbjct:   339 GGTLSQAWPYLLALM                                                353
```

A further related DNA sequence was identified in *S. pyogenes* <SEQ ID 9081> which encodes the amino acid sequence <SEQ ID 9082>. Analysis of this protein sequence reveals the following:

```
Possible site: 38
>>> Seems to have an uncleavable N-term signal seq
INTEGRAL    Likelihood = -12.52   Transmembrane 21-37 (17-43)
INTEGRAL    Likelihood = -10.30   Transmembrane 351-367 (346-371)
INTEGRAL    Likelihood = -5.36    Transmembrane 262-278 (260-285)
INTEGRAL    Likelihood = -2.60    Transmembrane 288-304 (288-305)
INTEGRAL    Likelihood = -1.81    Transmembrane 229-245 (229-246)
----- Final Results -----
   bacterial membrane --- Certainty = 0.6010 (Affirmative) <succ>
      bacterial outside --- Certainty = 0.0000 (Not Clear) <succ>
         bacterial cytoplasm --- Certainty = 0.0000 (Not Clear) <succ>
```

An alignment of the GAS and GBS sequences follows:

```
Score = 62.5 bits (149), Expect = 9e-12
Identities = 72/382 (18%), Positives = 166/382 (42%), Gaps = 32/382 (8%)
Query:   1  MVLFHLIKKESLQIFRNRTALLMMVIFPILMIVILSFAFKSSFNTATTVPKLTIRYQLEG   60
            M +   +K    ++FR++   L MM + PIL++ +++   F ++ NT    +  + +  ++
Sbjct:   1  MRIIAITEKVIKELFRDKRTLAMMFLAPILIMFLMNVMFSANSNTKVKIGTINVNTKVVS   60

Query:  61  EKTDYQKNFLAFLKVLNQKLHLETKPSNSLEKDRQRVSEGALTAVLEVKKNQTIKVITNN  120
                           L+    H++  +       ++ +        + A++   + N++   V   N
Sbjct:  61  N--------------LDNIKHIQVRSFKFNSSAKKALKSNKIDALIS-EDNKSYTVFYAN  105

Query: 121  INQQNADLINMLVKNYVDNAKTYDSIAALY------PQQLNHIRKRSVDYVKVSSIQTSK  174
             +       L      K V+   + + I+ +             P+      ++ RS   Y+K     + +
Sbjct: 106  TDSSKTTLTRQAFKTAVNTMNSKELISQVKILANKNPKLAQSLQTRS-KYIKE---KYNY  161

Query: 175  GMTSADYYA----ISMFTMITFYSMMSAMNLVLSDRQQRITNRIHLTGVSPSFLVFGKLI  230
            G  +   ++A      I M  M+ F+  + +       +L +R          +R+    T  V   S  +VFG ++
Sbjct: 162  GNKNTGFFAKMIPILMGFMVFFFVFLISGMALLKERTSGTLDRLLATPVKRSDIVFGYML  221

Query: 231  GAMLATTVQLSLLYIFTRFVLRVNWGTNEWMLIGITASLVYLSVAIGIGLGISIKNEAFL  290
                 +    +Q  ++ +  T  ++L +       +  +I  +     L   +++++GI  +      K+E   +
Sbjct: 222  SYGILAIIQTIVIVLSTIWLLDIQVVGSIFSVIIVNFILALVALSLGILMSTLAKSEFQM  281

Query: 291  TVASNTIIPIFAFLGGSYVPLTTLHSSIINQLSNISPIKWVNDSLFYLIFGGQYNP-IPV  349
                       II    F    G  +PL   +S   +     I P+ +   D+L   +I   GQ   P +
Sbjct: 282  MQFIPLIIMPQLFFSG-IIPLENM-ASWAQTVGKILPLSYSGDALTKIIMYGQGLPNVSS  339

Query: 350  TLIVNISIGTIFIILALIGMRK                                       371
            L+V +      I    I  I  + G+++
Sbjct: 340  NLLVLLLFLIILTIANIFGLKR                                       361
```

Based on this analysis, it was predicted that these proteins and their epitopes could be useful antigens for vaccines or diagnostics.

Example 215

A DNA sequence (GBSx0229) was identified in *S. agalactiae* <SEQ ID 683> which encodes the amino acid sequence <SEQ ID 684>. This protein is predicted to be CG1718 gene product (b0794). Analysis of this protein sequence reveals the following:

```
Possible site: 61
>>> Seems to have no N-terminal signal sequence
INTEGRAL    Likelihood = -1.17    Transmembrane 118-134 (117-134)
----- Final Results -----
   bacterial membrane --- Certainty = 0.1468 (Affirmative) <succ>
      bacterial outside --- Certainty = 0.0000 (Not Clear) <succ>
         bacterial cytoplasm --- Certainty = 0.0000 (Not Clear) <succ>
```

A related GBS nucleic acid sequence <SEQ ID 8521> which encodes amino acid sequence <SEQ ID 8522> was also identified. Analysis of this protein sequence reveals the following:

```
Lipop: Possible site: -1    Crend: 8
McG: Discrim Score: -10.96
GvH: Signal Score (-7.5): -4.84
Possible site: 15
>>> Seems to have no N-terminal signal sequence
ALOM program  count: 1 value: -1.17 threshold: 0.0
INTEGRAL    Likelihood = -1.17    Transmembrane 142-158 (141-158)
PERIPHERAL  Likelihood = 4.98     197
modified ALOM score: 0.73
*** Reasoning Step: 3
----- Final Results -----
   bacterial membrane --- Certainty = 0.1468 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the GENPEPT database:

```
>GP: AAF50837 GB: AE003568 CG1718 gene product [Drosophila melanogaster]
Identities = 80/204 (39%), Positives = 123/204 (60%), Gaps = 3/204 (1%)
Query:     7 EIIGLIGPSGAGKSTLIKTMLGMEKADKGTALV--LDTQMPDRNILNQIGYMAQSDALYE   64
               E  GL+G +GAGK+T  K M G E+    GA V L +      +I   IGY  Q DAL +
Sbjct:  1394 ECFGLLGVNGAGKTTIFKMMTGDERISSGAAYVQGLSLESNMNSIYKMIGYCPQFDALLD 1453

Query:    65 SLTGLENLLFFGKMKGIQKTELKQQITHISKVVDLENQLDKFVSGYSGGMKRRLSLAIAL  124
               LTG  E L  F  ++G+Q++  ++Q    ++K      +DK    YSGG KR+LS AIA+
Sbjct:  1454 DLTGREVLRIFCMLRGVQESRIRQLSEDLAKSFGFMKHIDKQTHAYSGGNKRKLSTAIAV 1513

Query:   125 LGNPTVLILDEPTVGIDPSLRRKIWQELINIKDEGHSIFITTHVMDEAE-LTSKVALLLR  183
               +G+P+V+ LDEPT G+DP+ RR++W  +  I+D G SI +T+H M+E E L +++A+++
Sbjct:  1514 IGSPSVIYLDEPTTGMDPAARRQLWNMVCRIRDSGKSIVLTSHSMEECEALCTRLAIMVN 1573

Query:   184 GNIIAFDTPLHLKKQFNVSTIEEV                                     207
               G     +  HLK +F+  I ++
Sbjct:  1574 GEFKCIGSTQHLKNKFSKGLILKI                                    1597

Identities = 73/216 (33%), Positives = 128/216 (58%), Gaps = 9/216 (4%)
Query:     1 MEVFKGEIIGLIGPSGAGKSTLIKTMLGMEKADKGTALV--LDTQMPDRNILNQIGYMAQ   58
               M +F+ EI  L+G +GAGK+T I  + GM      GTA++  D +        +G  Q
Sbjct:   536 MNMFEDEITVLLGHNGAGKTTTISMLTGMFPPTSGTAIINGSDIRTNIEGARMSLGICPQ  595

Query:    59 SDALYESLTGLENLLFFGKMKGIQKTELKQQITHISKVVDLENQLDKFVSGYSGGMKRRL  118
                 + L++ ++   ++ FF +MKG++    ++Q++    K+++LE++ +     S SGGMKR+L
Sbjct:   596 HNVLFDEMSVSNHIRFFSRMGLRGKAVEQEVAKYLKMIELEDKANVASSKLSGGMKRKL  655

Query:   119 SLAIALLGNPTVLILDEPTVGIDPSLRRKIWQELINIKDEGHSIFITTHVMDEAE-LTSK  177
               S+   AL G+  V++ DEP+ G+DPS RR++W +L+    G ++ +TTH MDEA+ L  +
Sbjct:   656 SVCCALCGDTKVVLCDEPSSGMDPSARRQLW-DLLQQEKVGRTLLLTTHFMDEADVLGDR  714

Query:   178 VALLLRGNIIAFDTPLHLKKQFN-----VSTIEEVF                         208
               +A++  G +    T  LKKQ+       VS ++ +F
Sbjct:   715 IAIMCDGELKCQGTSFFLKKQYGSGYRLVSGVQNLF                         750
```

A related DNA sequence was identified in *S. pyogenes* <SEQ ID 685> which encodes the amino acid sequence <SEQ ID 686>. Analysis of this protein sequence reveals the following:

Possible site: 59
>>> Seems to have no N-terminal signal sequence

```
INTEGRAL    Likelihood = 0.43    Transmembrane 49-65 (49-65)
----- Final Results -----
    bacterial membrane --- Certainty = 0.1171 (Affirmative) <succ>
    bacterial outside  --- Certainty = 0.0000 (Not Clear)   <succ>
    bacterial cytoplasm --- Certainty = 0.0000 (Not Clear)  <succ>
```

The protein has homology with the following sequences in the databases:

```
>GP: CAB12660 GB: Z99108 similar to ABC transporter (ATP-binding
protein) [Bacillus subtilis]
Identities = 151/316 (47%), Positives = 202/316 (63%), Gaps = 18/316 (5%)
Query:     4 VQLTNVVKSYKNGKKA-VNDVSLSIEAGNIYGLLGPNGAGKSTLINLILGLIPLSSGKIT   62
               +Q  N+ K+Y  GKK   V + S ++  G  +GLLGPNGAGKST I++I GL+P  SG IT
Sbjct:     2 LQAENIKKAY--GKKTIVKGISFSLKKGESFGLLGPNGAGKSTTISMISGLVPHDSGNIT   59

Query:    63 VLGQS-QKTIRKISSQIGYVPQDIAVYPDLTAYENVELFGSLYGLKGAQLKKQVLKSLEF  121
                V G    K  +K   +IG VPQ+IA+YP LTA+EN+  +G +YGL   + KK+  + LE+
Sbjct:    60 VGGYVIGKETAKAKQKIGIVPQEIALYPTLTAHENLMFWGKMYGLTHDEAKKRAAEVLEY  119

Query:   122 VGLHSQAKQFPSQFSGGMKRRLNIACALVHSPKLIIFDEPTVGIDPQSRNHILESIRLLN  181
               VGL +AK       FSGGMKRR+NI   AL+H P+L+I DEPTVGIDPQSRNHILE+++ LN
Sbjct:   120 VGLTERAKDKIETFSGGMKRRINIGAALMHKPELLIMDEPTVGIDPQSRNHILETVKQLN  179

Query:   182 KEGATVIYTTHYMEEVEALCDYIFIMDHGQVIEEGPKFELEKRYVANLANQIIVTLTDSR  241
               + G TVIYT+HYMEEVE  LCD I  I+D G++I  G K +L +R    Q+ V+  +
Sbjct:   180 ETGMTVIYTSHYMEEVEFLCDRIGIIDQGEMIAIGTKTDLCSRLGGDTIIQLTVSGINEA  239

Query:   242 HL----ELADKPDWSLIEDGEKLMLKIDNSD------MTSVVHQLTQANITFSEIRIINHL  291
                L     LA  D ++ E   L LKID S        +TS++ + T  +I       ++
Sbjct:   240 FLVAIRSLAHVNDVTVHE----LELKIDISAAHHEKVVTSLLAEATAHHINLLSLQVQEP  295

Query:   292 NLEEIFLHLTGKKLRD                                              307
               NLE +FL+LTG+ LRD
Sbjct:   296 NLERLFLNLTGRTLRD                                              311
```

An alignment of the GAS and GBS proteins is shown below:

```
Identities = 81/211 (38%), Positives = 125/211 (58%), Gaps = 2/211 (0%)
Query:    1 MEVFKGEIIGLIGPSGAGKSTLIKTMLGMEKADKGTALVL-DTQMPDRNILNQIGYMAQS    59
            + +   G I GL+GP+GAGKSTLI  +LG+      G   VL +Q   R I +QIGY+ Q
Sbjct:   25 LSIEAGNIYGLLGPNGAGKSTLINLILGLIPLSSGKITVLGQSQKTIRKISSQIGYVPQD   84

Query:   60 DALYESLTGLENLLFFGKMKGIQKTELKQQITHISKVVDLENQLDKFVSGYSGGMKRRLS   119
              A+Y  LT   EN+   FG +  G++    +LK+Q+      + V L +Q  +F S +SGGMKRRL+
Sbjct:   85 IAVYPDLTAYENVELFGSLYGLKGAQLKKQVLKSLEFVGLHSQAKQFPSQFSGGMKRRLN   144

Query:  120 LAIALLGNPTVLILDEPTVGIDPSLRRKIWQELINIKDEGHSIFITTHVMDEAE-LTSKV   178
             +A  AL+ +P ++I DEPTVGIDP    R  I + +    + EG ++   TTH M+E  E  L    +
Sbjct:  145 IACALVHSPKLIIFDEPTVGIDPQSRNHILESIRLLNKEGATVIYTTHYMEEVEALCDYI   204

Query:  179 ALLLRGNIIAFDTPLHLKKQFNVSTIEEVFL                             209
             ++   G +I         L+K++  +     ++ +
Sbjct:  205 FIMDHGQVIEEGPKFELEKRYVANLANQIIV                             235
```

SEQ ID 8522 (GBS391) was expressed in *E. coli* as a His-fusion product. SDS-PAGE analysis of total cell extract is shown in FIG. 74 (lane 7; MW 30 kDa). It was also expressed in *E. coli* as a GST-fusion product. SDS-PAGE analysis of total cell extract is shown in FIG. 83 (lane 4; MW 55 kDa).

Figure 217:
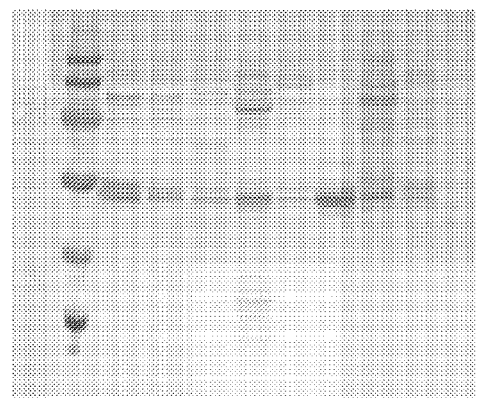

GBS391-GST was purified as shown in FIG. 217, lane 3.

Based on this analysis, it was predicted that these proteins and their epitopes could be useful antigens for vaccines or diagnostics.

Example 216

A DNA sequence (GBSx0230) was identified in *S. agalactiae* <SEQ ID 687> which encodes the amino acid sequence <SEQ ID 688>. Analysis of this protein sequence reveals the following:

---

Possible site: 13
>>> Seems to have no N-terminal signal sequence
----- Final Results -----
   bacterial cytoplasm --- Certainty = 0.6732 (Affirmative) <succ>

--- bacterial membrane --- Certainty = 0.0000 (Not Clear) <succ>
bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 217

A repeated DNA sequence (GBSx0231) was identified in *S. agalactiae* <SEQ ID 689> which encodes the amino acid sequence <SEQ ID 690>. This protein is predicted to be ISL2 protein. Analysis of this protein sequence reveals the following:

---

Possible site: 58
>>> Seems to have an uncleavable N-term signal seq
----- Final Results -----
   bacterial membrane --- Certainty = 0.0000 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the GENPEPT database:

```
>GP: CAC18596 GB: AJ278419 IS1381 transposase [Streptococcus pneumoniae]
Identities = 111/129 (86%), Positives = 117/129 (90%)
Query:    1 MKAQAIVTSQGRIVSLDIAVNYCHDMKLFKMSRRNIGQAAKILADSGYQGIMKMYSQAQT    60
              MK QAIVTSQGRIVSLDI VNYCHDMKLFKMSRRNIGQA KILADSGYQG+MK+Y QAQT
Sbjct:    1 MKTQAIVTSQGRIVSLDITVNYCHDMKLFKMSRRNIGQAGKILADSGYQGLMKIYPQAQT    60

Query:   61 PRKSSKLKPLTLEDKTYNHTLSKERIKVENIFAKVKTFKIFSTTYRNRRKRFGLRMNLIA   120
              RKSSKLKPLT+EDK  NH LSKER KVENIFAKVKTFK+FSTTYR+ RKRFGLRMNL A
Sbjct:   61 SRKSSKLKPLTVEDKACNHALSKERSKVENIFAKVKTFKMFSTTYRSHRKRFGLRMNLSA   120

Query:  121 GMINRELGF                                                    129
              G+IN ELGF
Sbjct:  121 GIINHELGF                                                    129
```

No corresponding DNA sequence was identified in *S. pyogenes*.

Based on this analysis, it was predicted that this protein and its epitopes, could be useful antigens for vaccines or diagnostics.

Example 218

A repeated DNA sequence (GBSx0232) was identified in *S. agalactiae* <SEQ ID 691> which encodes the amino acid sequence <SEQ ID 692>. This protein is predicted to be ISL2 protein. Analysis of this protein sequence reveals the following:

```
Possible site: 41
>>> Seems to have no N-terminal signal sequence
----- Final Results -----
   bacterial cytoplasm --- Certainty = 0.3996 (Affirmative) <succ>
      bacterial membrane --- Certainty = 0.0000 (Affirmative) <succ>
         bacterial outside --- Certainty = 0.0000 (Affirmative) <succ>
```

The protein has homology with the following sequences in the GENPEPT database:

```
>GP: CAC18595 GB: AJ278419 IS1381 transposase [Streptococcus pneumoniae]
Identities = 110/125 (88%), Positives = 119/125 (95%)
Query:    1 MNYEASKQLTDVRFKRLVGVQRTTFEEMLAVLKTAYQRKHAKGGRTPKLSLEDLLMATLQ    60
            MNYEASKQLTD RFKRLVGVQRTTFEEMLAVLKTAYQ KRAKGGR PKLSLEDLLMATLQ
Sbjct:    1 MNYEASKQLTDARFKRLVGVQRTTFEEMLAVLKTAYQLKHAKGGRKPKLSLEDLLMATLQ    60

Query:   61 YMREYRTYEQIAADFGIHESNLIRRSQWVESTLIQSGFTISKTHLSAEDTVIVDATEVKI   120
            Y+REYRTYE+IAADFG+HESNL+RRSQWVE TL+QSG TIS+T LS+EDTV++DATEVKI
Sbjct:   61 YVREYRTYEEIAADEGVHESNLLRRSQWVEVTLVQSGVTISRTPLSSEDTVMIDATEVKI   120

Query:  121 NRPKK    125
            NRPKK
Sbjct:  121 NRPKK    125
```

No corresponding DNA sequence was identified in *S. pyogenes*.

Based on this analysis, it was predicted that this protein and its epitopes, could be useful antigens for vaccines or diagnostics.

Example 219

A DNA sequence (GBSx0233) was identified in *S. agalactiae* <SEQ ID 693> which encodes the amino acid sequence <SEQ ID 694>. Analysis of this protein sequence reveals the following:

```
Possible site: 57
>>> Seems to have no N-terminal signal sequence
INTEGRAL    Likelihood = -10.40    Transmembrane 130-146 (123-156)
INTEGRAL    Likelihood = -7.86     Transmembrane 169-185 (167-191)
INTEGRAL    Likelihood = -6.90     Transmembrane 100-116 (95-118)
INTEGRAL    Likelihood = -5.52     Transmembrane 199-215 (189-216)
```

```
----- Final Results -----
   bacterial membrane --- Certainty = 0.5161 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the GENPEPT database:

```
>GP: BAB04126 GB: AP001508 unknown conserved protein in others
[Bacillus halodurans]
Identities = 47/207 (22%), Positives = 95/207 (45%), Gaps = 14/207 (6%)
Query:    7 LQKENTLLEGRIDNSNNQTYTDMIVYLRGA-SISPYHQELIRNDIVNMLLEAQERQASLV    65
            L K+N       +   N + Y D+++Y+R A S S      E +  ++++ LLEAQ +  S
Sbjct:    6 LIKDNNEKRKLLTEENLKVYEDLLLYIRLAHSKSEQETEELLTELLDHLLEAQAKGKSAK    65

Query:   66 SVFGEDRHDFINQVIKSTPKISKKEE-TLQRWDLAILLLTIQMIIFLGGYLITEALQQSV   124
            +VFG++    + +++I  PK+  KE   L + L++    T+  ++F G Y +       V
Sbjct:   66 AVFGDNPKQYADEIIGEIPKMVTKERFGLFAYGLSMFFATV--LVFSGIYRMLRYYVFQV   123

Query:  125 PDLIPITLLDVLFAIFISIIAVKIADTIIYATYNFDK----SKEKKYFFRYIFLILSLII   180
            + +     +    A+  +I ++ IA    ++  + + +           K F  +I + +I
Sbjct:  124 GEAVSEVYVGT--ALITTIASIVIAWMFVFVVFQYFRWSCFRTINKVFEFFILWLGGMIP   181

Query:  181 AYILIGKYYHLP----FINIPLWIYLI   203
            +      Y   P    I  IP+++Y +
Sbjct:  182 FALFFALLYFTPNVGRMIEIPVYLYFV   208
```

No corresponding DNA sequence was identified in *S. pyogenes*.

Based on this analysis, it was predicted that this protein and its epitopes, could be useful antigens for vaccines or diagnostics.

Example 220

A DNA sequence (GBSx0234) was identified in *S. agalactiae* <SEQ ID 695> which encodes the amino acid sequence <SEQ ID 696>. This protein is predicted to be minor extracellular protease epr precursor (epr). Analysis of this protein sequence reveals the following:

```
Possible site: 31
>>> Seems to have an uncleavable N-term signal seq
INTEGRAL    Likelihood = -10.72    Transmembrane 10-26 (5-33)
```

----- Final Results -----
    bacterial membrane --- Certainty = 0.5288 (Affirmative) <succ>
      bacterial outside --- Certainty = 0.0000 (Not Clear) <succ>
        bacterial cytoplasm --- Certainty = 0.0000 (Not Clear) <succ>

A related GBS nucleic acid sequence <SEQ ID 8523> which encodes amino acid sequence <SEQ ID 8524> was also identified. Analysis of this protein sequence reveals the following:

Lipop Possible site: −1   Crend: 8
McG: Discrim Score:12.11
GvH: Signal Score (−7.5): −4.02
Possible site: 29
>>> Seems to have an uncleavable N-term signal seq
ALOM program         count: 1 value: −10.72 threshold: 0.0
INTEGRAL             Likelihood = −10.72   Transmembrane 8-24 (5-33)
PERIPHERAL           Likelihood = 13.74    219
modified ALOM score: 2.64
*** Reasoning Step: 3
----- Final Results -----
    bacterial membrane --- Certainty = 0.5288 (Affirmative) <succ>
      bacterial outside --- Certainty = 0.0000 (Not Clear) <succ>
        bacterial cytoplasm --- Certainty = 0.0000 (Not Clear) <succ>

The protein has homology with the following sequences in the GENPEPT database:

```
!GB: Z99123 extracellular serine protease [Bacillus s . . .
>GP: CAB15866 GB: Z99123 extracellular serine protease [Bacillus subtilis]
Identities = 44/150 (29%), Positives = 80/150 (53%), Gaps = 14/150 (9%)
Query:   37 QMDTVESSVNHVSDSQLTEAQDMLDKFEKKPSEKLLKDVELALNKLSNSSKKEALQKRFK   96
            ++D V+S  N       + +A+D + K EK +++ +  + A+NKL N + K+ LQKR
Sbjct:  428 RLDKVQSYRN------VKDAKDKVAKAEKYKTQQTVDTAQTAINKLPNGTDKKNLQKRLD  481

Query:   97 KAKDKYLKDEADKKATKDATDLVEILEQAPSEENVLKAEAAVNKLTVKESKEALQKRIDT  156
            + K +Y+         A+K A D V   E++ + +V A++A+ KL    K +LQKR++
Sbjct:  482 QVK-RYI-------ASKQAKDKVAKAEKSKKKTDVDSAQSAIGKLPASSEKTSLQKRLNK  533

Query:  157 VKTQYGLIGNQTPSSSVAETTEQGTANPAS                               186
            VK+     Q+ S++ ++T+   A  S
Sbjct:  534 VKSTNLKTAQQSVSAAEKKSTDANAAKAQS                               563

Identities = 39/124 (31%), Positives = 64/124 (51%), Gaps = 2/124 (1%)
Query:   35 TTQMDTVESSVNHVSDSQLTEAQDMLDKFEKKPSEKLLKDVELALNKLSNSSKKEALQKR   94
            +++  +++  +N V  + L    AQ  +   EKK ++   + A+N+L     K  ALQKR
Sbjct:  521 SSEKTSLQKRLNKVKSTNLKTAQQSVSAAEKKSTDANAAKAQSAVNQLQAGKDKTALQKR  580

Query:   95 FKKAKDKYLKDEADKKATKDATDLVEILEQAPSEENVLKAEAAVNKLTVKESKEALQKRI  154
                K K K    EA K  T  A   V+   E+  ++++    A++AVN+L    K  LQKR+
Sbjct:  581 LDKVKKKVAAAEAKKVETAKAK--VEKAEKDKTKKSKTSAQSAVNQLKASNEKTKLQKRL  638

Query:  155 DTVK                                                         158
            + VK
Sbjct:  639 NAVK                                                         642
```

A related DNA sequence was identified in *S. pyogenes* <SEQ ID 697> which encodes the amino acid sequence <SEQ ID 698>. Analysis of this protein sequence reveals the following:

Possible site: 41
>>> Seems to have no N-terminal signal sequence
INTEGRAL       Likelihood = 4.99       Transmembrane 24-40 (23-43)
----- Final Results -----
    bacterial membrane --- Certainty = 0.2996 (Affirmative) <succ>
      bacterial outside --- Certainty = 0.0000 (Not Clear) <succ>
        bacterial cytoplasm --- Certainty = 0.0000 (Not Clear) <succ>

The protein has homology with the following sequences in the databases:

```
>GP: CAB15866 GB: Z99123 extracellular serine protease [Bacillus subtilis]
Identities = 43/130 (33%), Positives = 71/130 (540), Gaps = 8/130 (6%)
Query:   41 GSHPQTQDKVA---KHSKSAASLLKKAVKAVNDADRLATAAAIQEAQKAVDKLAESSKKK   97
            G  P  +K +    + +K  ++ LK A ++V+ A++ +T A    +AQ AV++L     K
Sbjct:  516 GKLPASSEKTSLQKRLNKVKSTNLKTAQQSVSAAEKKSTDANAAKAQSAVNQLQAGKDKT  575

Query:   98 TLQEQLN-----VAKAKQEQEDAATQAVKAAEETLNQNLKDIAQKAVNDLSNKGKKAALQ  152
            LQ++L+       VA A+ ++ + A   VK AE+  +   K  AQ AVN L    +K  LQ
Sbjct:  576 ALQKRLDKVKKKVAAAEAKKVETAKAKVKKAEKDKTKKSKTSAQSAVNQLKASNEKTKLQ  635
```

```
-continued
Query:  153 SRLDAILPAK                                                   162
            RL+A+ P K
Sbjct:  636 KRLNAVKPKK                                                   645

Identities = 31/105 (29%), Positives = 53/105 (49%), Gaps = 1/105 (0%)
Query:   54 SKSAASLLKKAVKAVNDADRLATAAAIQEAQKAVDKLAESSKKKTLQEQLNVAKAKQEQE  113
            +++  S    A +AV A++        I +A++ + +L  S  K  L ++L+ ++ +  +
Sbjct:  380 AQATDSAYAAAEQAVKKAEQTKAQIDINKARELISQLPNSDAKTALHKRLDKVQSYRNVK  439

Query:  114 DAATQAVKAAEETLNQNLKDIAQKAVNDLSNKGKKAALQSRLDAI                158
            DA  +  KA E+   Q   D AQ A+N L N    K   LQ RLD +
Sbjct:  440 DAKDKVAKA-EKYKTQQTVDTAQTAINKLPNGTDKKNLQKRLDQV                483
```

An alignment of the GAS and GBS proteins is shown below:

No corresponding DNA sequence was identified in *S. pyogenes*.

```
Identities = 61/233 (26%), Positives = 115/233 (49%), Gaps = 13/233 (5%)
Query:    2 SMKIDKKELLALIASIILLIFASVTFFLFKDHGTTQMDTVESSVNHVSDSQLTEAQDMLD   61
            SM  +KE L  + S++ +       + +F  H  TQ    + S +  + S L +A   ++
Sbjct:   12 SMTKSQKEALYWMLSVLTITLIGGSCLIFGSHPQTQDKVAKHSKS--AASLLKKAVKAVN   69

Query:   62 KFEKKPSEKLLKDVELALNKLSNSSKKEALQKRFKKAKDKYLKDEADKKATKDATDLVEI  121
            ++   +   +++ +  A++KL+  SSKK+ LQ++    AK K +++A       AT V+
Sbjct:   70 DADRLATAAAIQEAQKAVDKLAESSKKKTLQEQLNVAKAKQEQEDA-------ATQAVKA  122

Query:  122 LEQAPSEENVLKAEAAVNKLTVKESKEALQKRIDTVKTQYGLIGNQTPSSSVAETTEQGT  181
            E+  ++       A+ AVN L+ K  K ALQ R+D +       +I ++ P   S   E T+
Sbjct:  123 AEETLNQNLKDIAQKAVNDLSNKGKKAALQSRLDAILPAKPII-DEFPRQS-GEITDNSY  180

Query:  182 ANPASQDTSSYVNQNVAPTYE-QPQANNTPVTPGVNNTVP-TPGTGTVPATNG         232
              P   D S    + + +PT +       +++ + VTP ++    P   P T + P+ +G
Sbjct:  181 WTPFPGDVSDTYDNSQSPTLDPSSESSASDVTPQPSHPDPIPPQTSSEPSDSG         233
```

Figure 52:
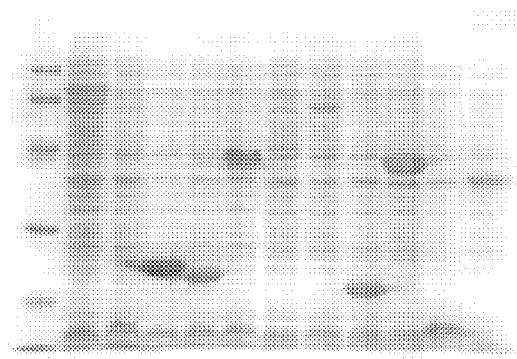

SEQ ID 8524 (GBS278) was expressed in *E. coli* as a His-fusion product. SDS-PAGE analysis of total cell extract is shown in FIG. 52 (lane 6; MW 40 kDa).

Figure 305:
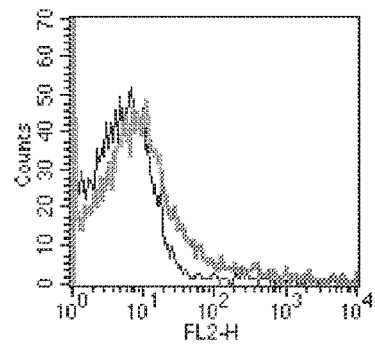

The GBS278-His fusion product was purified (FIG. 206, lane 10) and used to immunise mice. The resulting antiserum was used for FACS (FIG. 305), which confirmed that the protein is immunoaccessible on GBS bacteria.

Based on this analysis, it was predicted that these proteins and their epitopes could be useful antigens for vaccines or diagnostics.

Example 221

A DNA sequence (GBSx0235) was identified in *S. agalactiae* <SEQ ID 699> which encodes the amino acid sequence <SEQ ID 700>. Analysis of this protein sequence reveals the following:

Possible site: 53
>>> Seems to have no N-terminal signal sequence
----- Final Results -----
  bacterial cytoplasm --- Certainty = 0.1466 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

Based on this analysis, it was predicted that this protein and its epitopes, could be useful antigens for vaccines or diagnostics.

Example 222

A DNA sequence (GBSx0236) was identified in *S. agalactiae* <SEQ ID 701> which encodes the amino acid sequence <SEQ ID 702>. This protein is predicted to be N-acetylglucosamine-6-phosphate deacetylase (nagA). Analysis of this protein sequence reveals the following:

Possible site: 15
>>> Seems to have no N-terminal signal sequence
----- Final Results -----
  bacterial cytoplasm --- Certainty = 0.4607 (Affirmative) <succ>
    bacterial membrane --- Certainty = 0.0000 (Not Clear) <succ>
      bacterial outside --- Certainty = 0.0000 (Not Clear) <succ>

A related GBS nucleic acid sequence <SEQ ID 9297> which encodes amino acid sequence <SEQ ID 9298> was also identified.

The protein has homology with the following sequences in the GENPEPT database:

```
>GP:AAG21688 GB:AY007718 N-acetylglucosamine-6-phosphate deacetylase
[Lactococcus lactis subsp. cremoris]
Identities = 113/178 (63%), Positives = 135/178 (75%)
Query:  131 GIYFEGPYFTEEYKGAQNPIYMRNPNLEEFAQWQKAAKGLITKIALAPEREGVEEFVSAI  190
            GI+FEGP+FTEE KGAQNP YMR+  + E   WQ+AA G++ KI LAPEREG E+F+
Sbjct:    1 GIFFEGPFFTEEKKGAQNPKYMRDAKMWELEDWQEAAHGMLKKIGLAPEREGSEDFIRKA   60
```

```
                              -continued
Query:  191  TKQGVTVALGHSNGTYKEAKKAVKAGASVWVHAYNGMRGLTHREPGMVGAVYNLPNTYAE  250
             T+ GV +ALGHSN TYK+A   V+AGASVWVH +NGM G+TH+EPGMVGA+ N PNTYAE
Sbjct:   61  TESGVVIALGHSNATYKQAVAGVQAGASVWVHTFNGMSGMTHQEPGMVGAILNTPNTYAE  120

Query:  251  LICDGHHVDPVACDILMTQKGHNHVALITDCMAAGGAPDGDYMLGELPVVVSNGTARL    308
             LICDGHHV P A +I++  KG +HV LITD M A G PDG YMLGE  V V +G A L
Sbjct:  121  LICDGHHVRPEAAEIVVKMKGADHVVLITDSMRAAGLPDGPYMLGEYEVEVRDGAAWL    178
```

A related DNA sequence was identified in *S. pyogenes* <SEQ ID 703> which encodes the amino acid sequence <SEQ ID 704>. Analysis of this protein sequence reveals the following:

Possible site: 40
>>> Seems to have no N-terminal signal sequence
----- Final Results -----
   bacterial cytoplasm --- Certainty = 0.3114 (Affirmative) <succ>
     bacterial membrane --- Certainty = 0.0000 (Not Clear) <succ>
       bacterial outside --- Certainty = 0.0000 (Not Clear) <succ>

Possible site: 25
>>> Seems to have no N-terminal signal sequence
----- Final Results -----
   bacterial cytoplasm --- Certainty = 0.3709 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below:

```
Identities = 227/300 (75%), Positives = 262/300 (86%)
Query:    9  MTKYIKADRFFYADHVKENGYLEIKDNHFGKWIENISGQEEILDYSGYQIAPGLVDTHIH   68
             MT Y+KAD F+Y     V+  GYL + D  FG+W E +     +I+DY+GYQIAPGLVDTHIH
Sbjct:    1  MTCYLKADCFYYPTEVRPAGYLSLHDGVFGEWTEIVPADAQIIDYTGYQIAPGLVDTHIH   60

Query:   69  GFAGADVMDCDSEGILRMSAGLLSTGVTSFLPTTLTSDTKRLEEASKSVAAVAGKEQGAK  128
             G+AGADVMD  ++GI +MS GLL+TGVTSFLPTTLTS  ++LE+ S ++A+VA + +GAK
Sbjct:   61  GYAGADVMDNSAQGIHQMSEGLLATGVTSFLPTTLTSTFEQLEKVSGTIASVADQVKGAK  120

Query:  129  IQGIYFEGPYFTEEYKGAQNPIYMRNPNLEEFAQWQKAAKGLITKIALAPEREGVEEFVS  188
             IQGIYFEGPYFTEEYKGAQNP YM+  P LEEF  WQKAAKGLI KIALAPER+GV+EFVS
Sbjct:  121  IQGIYFEGPYFTEEYKGAQNPSYMKTPRLEEFDAWQKAAKGLIKKIALAPERDGVKEFVS  180

Query:  189  AITKQGVTVALGHSNGTYKEAKKAVKAGASVWVHAYNGMRGLTHREPGMVGAVYNLPNTY  248
             A+TKQGVTVALGHSNGTY+EAK+AV+AGASVWVHAYNGMRGLTHREPGMVGAVYNLPNTY
Sbjct:  181  AVTKQGVTVALGHSNGTYQEAKEAVQAGASVWVHAYNGMEGLTHREPGMVGAVYNLPNTY  240

Query:  249  AELICDGHHVDPVACDILMTQKGHNHVALITDCMAAGGAPDGDYMLGELPVVVSNGTARL  308
             AELICDGHHV P+ACDILM QKGH+HVA+ITDCM AGG+PDGDY LGE  VVV+NGTARL
Sbjct:  241  AELICDGHHVSPIACDILMQQKGHDHVAMITDCMRAGGSPDGDYLLGEFSVVVANGTARL  300
```

Based on this analysis, it was predicted that these proteins and their epitopes could be useful antigens for vaccines or diagnostics.

Example 223

A DNA sequence (GBSx0237) was identified in *S. agalactiae* <SEQ ID 705> which encodes the amino acid sequence <SEQ ID 706>. Analysis of this protein sequence reveals the following:

A related GBS nucleic acid sequence <SEQ ID 9307> which encodes amino acid sequence <SEQ ID 9308> was also identified.

The protein has homology with the following sequences in the GENPEPT database:

```
>GP:CAB16112 GB:Z99124 yyaQ [Bacillus subtilis]
Identities = 40/110 (36%), Positives = 62/110 (56%), Gaps = 12/110 (10%)
Query:  121  IAKTFEDSVDYPFAKHPQYASYRVSG--KWYALLFPLKMGKLENVPAQLSED---EVEVL  175
             + + +   S DYP+ K+P YAS R +   KWY L+ +          +P +L  D   E+++L
Sbjct:   11  VREKYGTSPDYPWEKYPNYASLRHTSNKKWYGLIMNV-------LPEKLGLDGHGEIDIL   63

Query:  176  NIKVNPQDMEILLQKEGIYPSYHMSKKTWVSIVLDNTLSDIEIFKLVSDS            225
             N+K  P+    + L   E I P YHM K+  W+SIVL+  T   + EI+ L+    S
Sbjct:   64  NLKCPPEISDRLRNGENILPGYHMDKEHWISIVLERTDPEGEIYNLIEQS           113
```

A related DNA sequence was identified in *S. pyogenes* <SEQ ID 707> which encodes the amino acid sequence <SEQ ID 708>. Analysis of this protein sequence reveals the following:

Possible site: 22
>>> Seems to have no N-terminal signal sequence
----- Final Results -----
   bacterial cytoplasm --- Certainty = 0.2541 (Affirmative) <succ>
      bacterial membrane --- Certainty = 0.0000 (Not Clear) <succ>
      bacterial outside --- Certainty = 0.0000 (Not Clear) <succ>

An alignment of the GAS and GBS proteins is shown below:

```
Identities = 114/247 (46%), Positives = 169/247 (68%), Gaps = 1/247 (0%)
Query:   7 MSIESDFFRKKRFIFSSLEEFGFIKSDQEYIYCQTFMDNDFKAIITISLDGKIAGKVIDS    66
           MS+ +D+F ++   I    L  +GF K D  Y Y + FM+ +F+A + I    G I   +VID
Sbjct:   1 MSLATDYFSRQTPIVEKLMAYGFEKRDNGYFYNERFMEGEFEAQLRIDEAGNIWDRVIDC    60

Query:  67 ALEEEYLPLRAANYNGSFVGEVRSAYMAILGDISDSCCKDLLFTKDQSNRLAEKIAKTFE   126
           LEE+YLPL+ A + G++ G+VR+AY+ +L   +S +C +      F    Q+NRLA+ I K +
Sbjct:  61 DLEEDYLPLQQAAWQGTYTGQVRAAYLELLERLSVACFEATPFQSMQANRLAKHITKEWS   120

Query: 127 DSVDYPFAKHPQYASYRVSGKWYALLFPLKMGKLENVPAQLSEDEVEVLNIKVNPQDMEI   186
           D +DYPF KHP  A+YRV GKWYA++F L    KL+ +P +L       EV+ +KVNP+
Sbjct: 121 DPMDYPFEKHPDLATYRVGGKWYAMIFSLLADKLDQIPERLVGQTCEVMTVKVNPKAFPQ   180

Query: 187 LLQKEGIYPSYHMSKKTWVSIVLDNTLSDIEIFKLVSDSRKLVSHNKKSN-SEPEFWIIP   245
           LLQ+EGIYP+YHMSKK W+SI+LD+ ++D +++ LV+ SR+LV+ N   SN + P++W+IP
Sbjct: 181 LLQQEGIYPAYHMSKKNWISIILDDKVTDDKLWTLVTQSRQLVNPNGLSNPNGPDYWVIP   240

Query: 246 ANPKFYD                                                        252
           AN K+YD
Sbjct: 241 ANLKYYD                                                        247
```

Based on this analysis, it was predicted that these proteins and their epitopes could be useful antigens for vaccines or diagnostics.

Example 224

A DNA sequence (GBSx0238) was identified in *S. agalactiae* <SEQ ID 709> which encodes the amino acid sequence <SEQ ID 710>. This protein is predicted to be transposase for insertion sequence element is 905. Analysis of this protein sequence reveals the following:

Possible site: 61
>>> Seems to have no N-terminal signal sequence
----- Final Results -----
   bacterial cytoplasm --- Certainty = 0.1824 (Affirmative) <succ>
      bacterial membrane --- Certainty = 0.0000 (Not Clear) <succ>
      bacterial outside --- Certainty = 0.0000 (Not Clear) <succ>

A related GBS nucleic acid sequence <SEQ ID 9601> which encodes amino acid sequence <SEQ ID 9602> was also identified.

A related GBS nucleic acid sequence <SEQ ID 9595> which encodes amino acid sequence <SEQ ID 9596> was also identified.

The protein has homology with the following sequences in the GENPEPT database:

```
>GP:AAA25167 GB:L20851 transposase [Lactococcus lactis]
Identities = 325/391 (83%), Positives = 365/391 (93%)
Query:  12 MTQFTTELLNFLAQKQDIDEFFRSSLETAMNDLLQVELSAFLGYEPYDKAGYNTGNSRNG    71
           MTQFTTELLNFLAQKQDIDEFFR+SLETAMNDLLQ ELSAFLGYEPYDK GYN+GNSRNG
Sbjct:   1 MTQFTTELLNFLAQKQDIDEFFRTSLETAMNDLLQAELSAFLGYEPYDKVGYNSGNSRNG    60

Query:  72 AYTRRFETKYGVVNLLIPRDRNGEFSPALIPSYGRRDNHLEEMVIKLYRTGVTTREISDI   131
           +Y+R+FETKYG V L IPRDRNG FSPAL+P+YGRRD+HLEEMVIKLY+TGVTIREISDI
Sbjct:  61 SYSRQFETKYGTVQLSIPRDRNGNFSPALLPAYGRRDDHLEEMVIKLYQTGVTTREISDI   120

Query: 132 IERMYGHHYSPATVSNISKATQENVASFHERSLEANYTVLYLDGTYLPLRRGTVSKECIH   191
           IERMYGHHYSPAT+SNISKATQENVA+FHERSLEANY+VL+LDGTYLPLRRGTVSKECIH
Sbjct: 121 IERMYGHHYSPATISNISKATQENVATFHERSLEANYSVLFLDGTYLPLRRGTVSKECIH   180

Query: 192 IALGVTSYGHKAILGYDIAPNENNASWSDLLERFKGQGVQQVSLVVSDGFNGLDQLIQQA   251
           IALG+T  G KA+LGY+IAPNENNASWS LL++ +  QG+QQVSLVV+DGF GL+Q+I QA
Sbjct: 181 IALGITPEGQKAVLGYEIAPNENNASWSTLLDKLQNQGIQQVSLVVTDGFKGLEQIISQA   240

Query: 252 FPMAKQQRCLVHIGRNIASKVKRADRALILEQFKTIYRAINVEEAKQALDSFINEWKPHY   311
           +P+AKQQRCL+HI RN+ASKVKRADRA+ILEQFKTIYRA N+E A QAL++FI EWKP Y
Sbjct: 241 YPLAKQQRCLIHISRNLASKVKRADRAVILEQFKTIYRAENLEMAVQALENFIAEWKPKY   300

Query: 312 KKVIETLESIENLLIFYEFPHQIWGSIYSTNLIESLNKEIKRQTKKKVVFPNEESLERYL   371
           +KV+E+LE+ +NLL FY+FP+QIW SIYSTNLIESLNKEIKRQTKKKV+FPNEE+LERYL
Sbjct: 301 RKVMESLENTDNLLTFYQFPYQIWHSIYSTNLIESLNKEIKRQTKKKVLFPNEEALERYL   360
```

```
Query:  372  VTLFSDYNFKQGQRIHKGFGQCTDTLESLFD                                402
             VTLF DYNFKQ QRIHKGFGQC DTLESLFD
Sbjct:  361  VTLFEDYNFKQSQRIHKGFGQCADTLESLFD                                391
```

A related DNA sequence was identified in *S. pyogenes* <SEQ ID 711> which encodes the amino acid sequence <SEQ ID 712>. Analysis of this protein sequence reveals the following:

```
Possible site: 15
>>> Seems to have no N-terminal signal sequence
----- Final Results -----
   bacterial cytoplasm --- Certainty=0.3054 (Affirmative) < succ>
    bacterial membrane --- Certainty=0.0000 (Not Clear) < succ>
     bacterial outside --- Certainty=0.0000 (Not Clear) < succ>
```

An alignment of the GAS and GBS proteins is shown below:

```
Identities = 111/128 (86%), Positives = 122/128 (94%)
Query:   12  MTQFTTELLNFLAQKQDIDEFFRSSLETAMNDLLQVELSAFLGYEPYDKAGYNTGNSRNG    71
             MTQFTTELLNFLAQKQDIDEFFRSSLE AMNDLLQVELSAFLGYEPY+K GYNTGNSRNG
Sbjct:    1  MTQFTTELLNFLAQKQDIDEFFRSSLEIAMNDLLQVELSAFLGYEPYEKEGYNTGNSRNG    60

Query:   72  AYTRRFETKYGVVNLLIPRDRNGEFSPALIPSYGRRDNHLEEMVIKLYRTGVTTREISDI   131
               Y+R+FETKYG+VNL+IPRDRNGEFSP L+PSY RR++HLEE+VIKLY+TGVTTREISDI
Sbjct:   61  TYSRQFETKYGLVNLIIPRDRNGEFSPVLLPSYARREDHLEEIVIKLYQTGVTTREISDI   120

Query:  132  IERMYGHH                                                      139
             I+RMYG H
Sbjct:  121  IKRMYGDH                                                      128
```

Based on this analysis, it was predicted that these proteins and their epitopes could be useful antigens for vaccines or diagnostics.

Example 225

A DNA sequence (GBSx0239) was identified in *S. agalactiae* <SEQ ID 713> which encodes the amino acid sequence <SEQ ID 714>. Analysis of this protein sequence reveals the following:

```
Possible site: 32
>>> Seems to have no N-terminal signal sequence
    INTEGRAL Likelihood =-12.42 Transmembrane 268 - 284 ( 260 - 286)
    INTEGRAL Likelihood = -6.32 Transmembrane 232 - 248 ( 231 - 254)
----- Final Results -----
    bacterial membrane --- Certainty=0.5967 (Affirmative) < succ>
     bacterial outside --- Certainty=0.0000 (Not Clear) < succ>
   bacterial cytoplasm --- Certainty=0.0000 (Not Clear) < succ>
```

The protein has homology with the following sequences in the GENPEPT database:

```
>GP:AAD40365 GB:AF036485 hypothetical protein [Plasmid pNZ4000]
Identities = 69/283 (24%), Positives = 133/283 (46%), Gaps = 9/283 (3%)
Query:   11  INVDDLSLQEERF-LPSELLAYARDENESS-FVRDIEGHLALVYQLLDTQGHVDDVRHVP    68
             IN ++ +  E+++ +   +++ Y  D +ES+ +V DI      L      L       D +R++
Sbjct:   19  INAEERATLEDQYGIDEDIIEYVTDNDESTNYVYDINEDDQLFIFLAPYALDKDALRYIT    78

Query:   69  RVIPVTLFLKEDGLFVLANHKNINLVKKALNRV---EKVDSPKHLLLSLVTAFSKQYFDV   125
              +  P  +L+  LF  N   I  V  AL     +V S    +L +        +  +
Sbjct:   79  Q--PFGMLLHKGVLFTF-NQSGIPEVNTALYSALDNPEVKSVDAFILETLFTVVVSFIPI   135

Query:  126  LDTISEERDKLINDLRKRPNKSNLARLANLQSGTVHLMMGTKQNFEMLTDLQNIEQDKEN   185
             I+++R+ L    L ++      S+L  L+ LQ        L    +N    L    L
Sbjct:  136  SRAITKKRNYLDKMLNRKTKNSDLVSLSYLQQTLTFLSSAVQTNLSELDRLPKTHFGVGA   195

Query:  186  TRNEKMQLQDAIIEARQLSNMCSLNSQVFQELS-SYNNVLSNNLNDNVTTLTIISIGISI   244
             +++      +D  IE Q+ M  + +QV    +  + N++ +NNLND + LTI S+ +++
Sbjct:  196  DQDKIDLFEDVQIEGEQVQRMFEIETQVVDRIDHTLNSLANNNLNDTMKFLTIWSLTMAV   255

Query:  245  IAMVTSFYGMNVKLPFDSVDAVWVLIILITTIITIMLSIVMYI                  287
             +++   FYGMNVKLP  +    W+L + I+ ++ + + I+++
Sbjct:  256  PTIISGFYGMNVKLPLAGMQYAWMLTLGISVVLIVAMLIMLKV                  298
```

Figure 172:
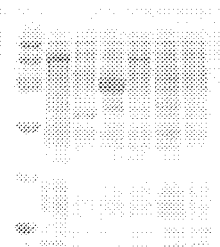

SEQ ID 714 (GBS422) was expressed in *E. coli* as a GST-fusion product. SDS-PAGE analysis of total cell extract is shown in FIG. 172 (lane 7; MW 60 kDa).

Figure 219:
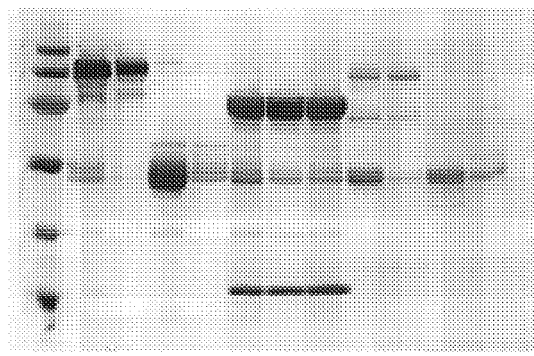

GBS422-GST was purified as shown in FIG. 219, lane 12.

Based on this analysis, it was predicted that these proteins and their epitopes could be useful antigens for vaccines or diagnostics.

Example 226

A DNA sequence (GBSx0240) was identified in *S. agalactiae* <SEQ ID 717> which encodes the amino acid sequence <SEQ ID 718>. Analysis of this protein sequence reveals the following:

Possible site: 45
>>> Seems to have no N-terminal signal sequence
----- Final Results -----
 bacterial cytoplasm --- Certainty=0.0783 (Affirmative) < succ>
  bacterial membrane --- Certainty=0.0000 (Not Clear) < succ>
   bacterial outside --- Certainty=0.0000 (Not Clear) < succ>

The protein has homology with the following sequences in the GENPEPT database:

```
>GP:CAB61731 GB:AL133220 putative oxidoreductase. [Streptomyces
coelicolor A3(2)]
Identities = 100/306 (32%), Positives = 152/306 (48%), Gaps = 3/306 (0%)
Query:   3  KVRYGVVSTAKVAPRFIEGVRLAGNGEVVAVSSRTLESAQAFANKYHLPKAYDKLEDMLA   62
            KVR+G+++T  +A RF  +    + EVVAV+SRT  SA+ FA ++ +P+AY    E +
Sbjct:   8  KVRWGILATGGMAARFTADLVDLPDAEVVAVASRTEASAKTFAERFGIPRAYGGWETLAR  67

Query:  63  DESIDVIYVATINQDHYKVAKAALLAGKHVLVEKPFTLTYDQANELFALAESCNLFLMEA  122
            DE +DV+YVAT +   H    A   L AG++VL EKPFTL   +A EL ALA    +FLMEA
Sbjct:  68  DEDVDVVYVATPHSAHRTAAGLCLEAGRNVLCEKPFTLNAREAAELVALARENGVFLMEA  127

Query: 123  QKSVFIPMTQVIKKLLASGEIGEVISISSTTAYPN-IDHVTWFRELELGGGTVHFMAPYA  181
                  P+ +  +K+L+A G IGEV S+ +          R+     GGG +  +  Y
Sbjct: 128  MWMYCNPLVRRLKELVADGAIGEVRSLQADFGLAGPFPAAHRLRDPAQGGGALLDLGVYP  187

Query: 182  LSYLQYLFDATITHASGTATFPKGQSDSQSKLLLQLSNGVLVDIFLTTRLNLPHEMITYG  241
            +S+ Q L   T + A   + D Q+ LL   N L I +        P+   I G
Sbjct: 188  VSFAQLLLGEP-TDVAARAVLSEEGVDLQTGALLSYGNDALASIHCSITGGTPNSASITG  246

Query: 242  TEGRLIIPH-FWKTTHAKLVRNDTSARTIQVDMVSDFEKEAYHVSQMILEGQRVSHIMTP  300
            +EGR+ +P+ F+    H  L R      + D       +  H ++ ++    R     +P
Sbjct: 247  SEGRIDVPNGFFFPDHFVLHRTGRDPQEFRADPADGPRESLRHEAEEVMRALRAGETESP  306

Query: 301  QLTLSG                                                       306
             + L G
Sbjct: 307  LVPLDG                                                       312
```

Based on this analysis, it was predicted that this protein and its epitopes, could be useful antigens for vaccines or diagnostics.

Example 227

A DNA sequence (GBSx0241) was identified in *S. agalactiae* <SEQ ID 721> which encodes the amino acid sequence <SEQ ID 722>. This protein is predicted to be valyl-tRNA synthetase (valS). Analysis of this protein sequence reveals the following:

Possible site: 36
>>> Seems to have no N-terminal signal sequence
INTEGRAL Likelihood = −0.00 Transmembrane 794 - 810 ( 794 - 810)
----- Final Results -----
  bacterial membrane --- Certainty=0.1001(Affirmative) < succ>
    bacterial outside --- Certainty=0.0000(Not Clear) < succ>
  bacterial cytoplasm ---Certainty=0.0000(Not Clear) < succ>

The protein has homology with the following sequences in the GENPEPT database:

```
>GP:AAA57558 GB:L08854 valyl-tRNA synthetase [Lactobacillus casei]
Identities = 543/881 (61%), Positives = 679/881 (76%), Gaps = 12/881 (1%)
Query:   5 LSPKYNPAEVEEGRYQTWLDQDVFKPSGDTEAKPYSIVIPPPNVTGKLHLGHAWDTTLQD   64
             L+PKY+   VEEGRYQ WLD+DVFKPSGD +AKPYSIVIPPPNVTGKLH+GHAWDTTLQD
Sbjct:  27 LAPKYDHKAVEEGRYQEWLDEDVFKPSGDKKAKPYSIVIPPPNVTGKLHMGHAWDTTLQD   86

Query:  65 IIIRQKRMQGFDTLWLPGMDHAGIATQAKVEERLREQGISRYDLGREKELDKVWEWKDEY  124
             I+IRQKR++GFDTLWLPGMDHAGIATQAKVE +LR++GISRYDLGREKF+ KVWEWKDE+
Sbjct:  87 IVIRQKRIEGFDTLWLPGMDHAGIATQAKVEAKLRKEGISRYDLGREKFVQKVWEWKDEF  146

Query: 125 AATIKSQWGKMGLSVDYSRERFTLDEGLSKAVRKVFVDLYNKGWIYRGEFIINWDPAART  184
             A TI  QW KMGLS+DYSRERFTLD+GL++AVR+VFVDLYN+G IYRGE+I+NWDP ART
Sbjct: 147 AFTIHGQWAKMGLSLDYSRERFTLDKGLNQAVRRVEVDLYNQGLIYRGEYIVNWDPQART  206

Query: 185 ALSDIEVIHKDVEGAFYHMNYMLEDGSRALEVATTRPETMFGDVAVAVNPEDARYKDLIG  244
             ALSDIEVIHKD +GAFYH+ Y   DGS +E+ATTRPETM GD AVAV+P D RYKD++G
Sbjct: 207 ALSDIEVIHKDDKGAFYHVKYPEADGSGYIEIATTRPETMMGDTAVAVHPGDERYKDMVG  266

Query: 245 QNVILPIINKPIPIVADEHADPEFGTGVVKITPAHDPNDFAVGQRHNLPQVNVMNDDGTM  304
               +ILP+ N+ IPI+ D + DPEFGTG VKITPAHDPNDF VG RH+L ++N MNDDGTM
Sbjct: 267 TELILPLANRKIPIIEDAYVDPEFGTGAVKITPAHDPNDFQVGNRHDLKRINTMNDDGTM  326

Query: 305 NELADEFNGMDRFEARKAVVAKLESLGNLVKIKKTTHSVGHSERTGVVVEPRLSTQWFVK  364
             NE A ++ GMDRFEARKA+VA L+  G L+K++   HSVGHSERTGV VE RLSTQWFVK
Sbjct: 327 NENAGKYQGMDRFEARKAMVADLDKAGLLLKVEPIVHSVGHSERTGVQVEARLSTQWFVK  386

Query: 365 MDQLAKNAI-ANQDTEDKVEFYPPRFNDTFMSWMENVHDWVISRQLWWGHQIPAWYN-VN  422
             M  LA+ AI A Q+ + KV F P RF  T++ WMEN+HDWVISRQLWWGHQIPAWYN
Sbjct: 387 MKPLAEAAIKAQQEPDKKVTFVPERFEHTYLQWMENIHDWVISRQLWWGHQIPAWYNKQT  446

Query: 423 GEMYVGEDAPEG-DGWTQDEDVIDTWESSALWPFSTMGWPDTEAADFKRYFPTSTLVTGY  481
             GE YVG +AP+  + W QD DVLDTWFSSALWPFSTMGWP+T+A D+KRY PT TLVTGY
Sbjct: 447 GETYVGMEAPKDIENWKQDPDVLDTWFSSALWPFSTMGWPNTDAPDYKRYYPTDTLVTGY  506

Query: 482 DIIFFWVSRMIFQSLEFTGRQPFSNVLIHGLIRDEEGRKMSKSLGNGIDPMDVIEKYGAD  541
             DII FWV+RMIFQ L FT ++PF    LIHGL+RDE+GRKMSKSLGNGIDPMDVIEKYGAD
Sbjct: 507 DIIPFWVARMIFQGLHETHQRPFQYTLIHGLMRDEQGRKMSKSLGNGIDPMDVIEKYGAD  566

Query: 542 ALRWFLSNGSAPGQDVRFSYEKMDASWNFINKIWNISRYILMNNEGLTLDQARENVEKVV  601
             ALRWFL G+ PGQD RFSY++++A+WNFINKIWNISR+++MN   L   Q    +
Sbjct: 567 ALRWFLITGNKPGQDTRFSYKQVEAAWNFINKIWNISRFVMMNLGDLDTPQQPD------  620

Query: 602 NSQVGNVTDRWILHNLNETVGKVTENFDKFEFGVAGHILYNFIWEEFANWYVELTKEVLY  661
                   +++D+W+    LNET+ +V +   +FEFG  G LYNF W    A+WYVE++KEVLY
Sbjct: 621 -PSTFDLSDKWLFAQLNETIKQVMDLSARFEFGEMGRTLYNFTWNVLADWYVEMSKEVLY  679

Query: 662 SDNEDEKVITRSVLLYTLDQILRLLHPIMPFVTEEIF--GQYAEGSIVLASYPQVNATFE  719
                 D+E K    R L Y LDQILRLLHP+MPFV +++     +  SIV ASYP N  FE
Sbjct: 680 GDDEQAKAAKRVNLAYALDQILRLLHPVMPFVHGKLWLALPHTGKSIVTASYPVANTAFE  739

Query: 720 NQTAHKGVESLKDLIRSVRNSRAEVNVAPSKPITILVKTSDSELESFFKDNSNYIKRFTN  779
             N  A    ++++ LIR VR  R E      + ILVK +D L+  F+ N ++I RF N
Sbjct: 740 NADATSAMDAIIALIRGVRGIRKEAGAPLKTKVDILVKLTDPALKPIFEQNFDFIDRFVN  799

Query: 780 PETLEISSAIATPELAMSSVITGAEIFLPLADLLNVEEELARLEKELAKWQKELDMVGKK  839
             +   + + +A P++A S+VITGA IF+PL +L++++EE A+L K+  K ++E+  + KK
Sbjct: 800 SKAFTVGTDVAEPKMAGSAVITGATIFVPLNELIDLDEEKAKLTKDAKKLEQEIARIDKK  859

Query: 840 LSNERFVANAKPEVVQKEKDKQTDYQTKYDATIARIEEMKK                    880
             L+N+ F++ A   VV +++ K++D++ +   +T  R+E++++
Sbjct: 860 LNNQGFLSKAPEAVVAEQRTKRSDFEDQLTSTKQRLEQLQR                    900
```

A related DNA sequence was identified in *S. pyogenes* <SEQ ID 723> which encodes the amino acid sequence <SEQ ID 724>. Analysis of this protein sequence reveals the following:

----- Final Results -----
bacterial cytoplasm --- Certainty=0.5062 (Affirmative) <succ>
bacterial membrane --- Certainty=0.0000 (Not Clear) <succ>
bacterial outside --- Certainty=0.0000 (Not Clear) <succ>

Possible site: 61
>>> Seems to have no N-terminal signal sequence

An alignment of the GAS and GBS proteins is shown below:

```
                Identities = 782/878 (89%), Positives = 818/878 (93%)
                Query:   4 ELSPKYNPAEVEEGRYQTWLDQDVFKPSGDTEAKPYSIVIPPPNVTGKLHLGHANDTTLQ   63
                             ELSPKYNPAEVE GRYQ WLD DVFKPSGD +AKPYSIVIPPPNVTGKLHLGHAWDTTLQ
                Sbjct:   3 ELSPKYNPAEVEAGRYQKWLDADVFKPSGDQKAKPYSIVIPPPNVTGKLHLGHAWDTTLQ   62
```

-continued

```
Query:   64 DIIIRQKRMQGFDTLWLPGMDHAGIATQAKVEERLREQGISRYDLGREKFLDKVWEWKDE 123
            DIIIRQKRMQGFDTLWLPGMDHAGIATQAKVEERLREQGISRYDLGR+KFLDKVWEWKDE
Sbjct:   63 DIIIRQKRMQGFDTLWLPGMDHAGIATQAKVEERLREQGISRYDLGRDKFLDKVWEWKDE 122

Query:  124 YAATIKSQWGKMGLSVDYSRERFTLDEGLSKAVRKVFVDLYNKGWIYRGEFIINWDPAAR 183
            YA TIK QWGKMGLSVDYSRERFTLDEGLSKAVRKVFVDLY KGWIYRGEFIINWDPAAR
Sbjct:  123 YATTIKEQWGKMGLSVDYSRERFTLDEGLSKAVRKVFVDLYKKGWIYRGEFIINWDPAAR 182

Query:  184 TALSDIEVIHKDVEGAFYHMNYMLEDGSRALEVATTRPETMFGDVAVAVNPEDARYKDLI 243
            TALSDIEVIHKDVEGAFYHMNYMLEDGSRAL+VATTRPETMFGDVAVAVNPED RYKDLI
Sbjct:  183 TALSDIEVIHKDVEGAFYHMNYMLEDGSRALQVATTRPETMFGDVAVAVNPEDPRYKDLI 242

Query:  244 GQNVILPIINKPIPIVADEHADPEFGTGVVKITPAHDPNDFAVGQRHNLPQVNVMNDDGT 303
            G+NVILPI+NK IPIV DEHADPEFGTGVVKITPAHDPNDF VGQRHNLPQVNVMNDDGT
Sbjct:  243 GKNVILPIVNKLIPIVGDEHADPEFGTGVVKITPAHDPNDFEVGQRHNLPQVNVMNDDGT 302

Query:  304 MNELADEFNGMDRFEARKAVVAKLESLGNLVKIKKTTHSVGHSERTGVVVEPRLSTQWFV 363
            MNELA +F GMDRFEAR+A VARLE LG LV I+K  HSVGHSER+G VVEPRLSTQWFV
Sbjct:  303 MNELAGDFAGMDRFEARQATVAKLEELGALVNIEKRVHSVGHSERSGAVVEPRLSTQWFV 362

Query:  364 KMDQLAKNAIANQDTEDKVEFYPPRFNDTFMSWMENVHDWVISRQLWWGHQIPAWYNVNG 423
            KMD+LAK A+ NQ+T+D+V+FYPPRFNDTF+ WMENVHDWVISRQLWWGHQIPAWYN  G
Sbjct:  363 KMDELAKQAMDNQETDDRVDFYPPRFNDTFLQWMENVHDWVISRQLWWGHQIPAWYNAEG 422

Query:  424 EMYVGEDAPEGDGWTQDEDVLDTWFSSALWPFSTMGWPDTEAADFKRYFPTSTLVTGYDI 483
            E+YVGE+APEGD WTQDEDVLDTWFSSALWPFSTMGWPDT+  DFKRYFPTSTLVTGYDI
Sbjct:  423 EIYVGEEAPEGDDWTQDEDVLDTWFSSALWPFSTMGWPDTDVEDFKRYFPTSTLVTGYDI 482

Query:  484 IFFWVSRMIFQSLEFTGRQPFSNVLIHGLIRDEEGRKMSKSLGNGIDPMDVIEKYGADAL 543
            IFFWVSRMIFQSLEFTGRQPF NVLIHGLIRDEEGRKMSKSLGNGIDPMDVIEKYGAD+L
Sbjct:  483 IFFWVSRMIFQSLEFTGRQPFQNVLIHGLIRDEEGRKMSKSLGNGIDPMDVIEKYGADSL 542

Query:  544 RWFLSNGSAPGQDVRFSYEKMDASWNFINKIWNISRYILMNNEGLTLDQARENVEKVVNS 603
            RWFLSNGSAPGQDVRFSYEKMDASWNFINKIWNISRYILMNNEGLTL+ A  NV KV  S
Sbjct:  543 RWFLSNGSAPGQDVRFSYEKMDASWNFINKIWNISRYILMNNEGLTLEDAESNVAKVAAS 602

Query:  604 QVGNVTDRWILHNLNETVGKVTENFDKFEFGVAGHILYNFIWEEFANWYVELTKEVLYSD 663
            + GNVTD+WILHNLNET+ KVTENFDKFEFGVAGHILYNFIWEEFANWYVELTKEVLYSD
Sbjct:  603 EAGNVTDQWILHNLNETIAKVTENFDKFEFGVAGHILYNFIWEEFANWYVELTKEVLYSD 662

Query:  664 NEDEKVITRSVLLYTLDQILRLLHPIMPFVTEEIFGQYAEGSIVLASYPQVNATFENQTA 723
            NE EKVITRSVLLYTLD+ILRLLHPIMPFVTEEI+ QYA+GSIV    YP V   FEN+ A
Sbjct:  663 NEAEKVITRSVLLYTLDKILRLLHPIMPFVTEEIYAQYAQGSIVTVDYPVVRPAFENEAA 722

Query:  724 HKGVESLKDLIRSVRNSRAEVNVAPSKPITILVKTSDSELESFFKDNSNYIKRFTNPETL 783
            HKGVESLKDLIR+VRN+RAEVNVAPSKPITILVKT+DSELE FF  N NYIK FTNPE L
Sbjct:  723 HKGVESLKDLIRAVRNARAEVNVAPSKPITILVKTADSELEDFFNSNINYIKCFTNPEKL 782

Query:  784 EISSAIATPELAMSSVITGAEIFLPLADLLNVEEELARLEKELAKWQKELDMVGKKLSNE 843
            EISSAIA PELAM+S+ITGAEI+LPLADLLNVEEELARL+KELAKWQKELDNVGKKL NE
Sbjct:  783 EISSAIAAPELAMTSIITGAEIYLPLADLLNVEEELARLDKELAKWQKELDMVGKKLGNE 842

Query:  844 RFVANAKPEVVQKEKDKQTDYQTKYDATIARIEEMKKL                       881
            RFVANAKPEVVQKEKDKQ DYQ KYDAT  RI EMKK+
Sbjct:  843 RFVANAKPEVVQKEKDKQADYQAKYDATQERIAEMKKI                       880
```

Based on this analysis, it was predicted that these proteins and their epitopes could be useful antigens for vaccines or diagnostics.

Example 228

A DNA sequence (GBSx0242) was identified in *S. agalactiae* <SEQ ID 725> which encodes the amino acid sequence <SEQ ID 726>. Analysis of this protein sequence reveals the following:

---

Possible site: 30
>>> Seems to have no N-terminal signal sequence
----- Final Results -----
   bacterial cytoplasm --- Certainty=0.0669 (Affirmative) < succ>
     bacterial membrane --- Certainty=0.0000 (Not Clear) < succ>
       bacterial outside --- Certainty=0.0000 (Not Clear) < succ>

---

The protein has no significant homology with any sequences in the GENPEPT database.

A related DNA sequence was identified in *S. pyogenes* <SEQ ID 727> which encodes the amino acid sequence <SEQ ID 728>. Analysis of this protein sequence reveals the following:

---

Possible site: 57
>>> Seems to have a cleavable N-term signal seq.
----- Final Results -----
   bacterial outside --- Certainty=0.3000(Affirmative) <succ>
   bacterial membrane --- Certainty=0.0000(Not Clear) <succ>
   bacterial cytoplasm --- Certainty=0.0000(Not Clear) <succ>

---

The protein has no significant homology with any sequences in the GENPEPT database.

An alignment of the GAS and GBS proteins is shown below:

```
Identities = 148/191 (77%), Positives = 165/191 (85%)
Query:   14  GEKKKMNIIIIGAQASGKMTIGQEIAKQTGMTLFHNHDSIDPVLRFMPWSPDSIALTESI   73
             G + KMN+IIIGAQASGKMTIGQE+A+QTGMTLFHNHDSIDFVLRFMPWS +S AL E I
Sbjct:    3  GAETKMNLIIIGAQASGKMTIGQEVARQTGMTLFHNHDSIDFVLRFMPWSQESTALIERI   62

Query:   74  RFKFFETFAKTGQEMIFTIVIDFNDSRDVVFLEKIQIVFQSHNQEVLFVELETELSERLK  133
             RF FFETFAKTGQ+MIFTIVIDFND  DV  LEKIQ VFQS++QEVLFVEL+T++ ERLK
Sbjct:   63  RFAFFETFAKTGQDMIFTIVIDFNDPNDVAMLEKIQAVFQSYDQEVLFVELKTDIEERLK  122

Query:  134  RNRTENRLKHKPSKRDIKWSESDICSTMDYAIFNPEVAPEALTYYHKINNTCLTATETAY  193
             RNRTENRLKHKP KR+I+WSE DI STM YA+FNPE  P+ LT+Y KINNT LTA ETA
Sbjct:  123  RNRTENRLKHKPLKRNIEWSEQDIQSTMAYAVFNPEEPPKTLTHYQKINNTQLTAAETAQ  182

Query:  194  LIIQKINQIKE                                                  204
             LIIQK+  IKE
Sbjct:  183  LIIQKMTHIKE                                                  193
```

Based on this analysis, it was predicted that these proteins and their epitopes could be useful antigens for vaccines or diagnostics.

Example 229

A DNA sequence (GBSx0243) was identified in *S. agalactiae* <SEQ ID 729> which encodes the amino acid sequence <SEQ ID 730>. Analysis of this protein sequence reveals the following:

Possible site: 49
>>> Seems to have no N-terminal signal sequence
----- Final Results -----
 bacterial cytoplasm --- Certainty=0.3614 (Affirmative) <succ>
  bacterial membrane --- Certainty=0.0000 (Not Clear) <succ>
   bacterial outside --- Certainty=0.0000 (Not Clear) <succ>

The protein has homology with the following sequences in the GENPEPT database:

```
>GP:BAB04556 GB:AP001510 unknown conserved protein [Bacillus halodurans]
Identities = 60/189 (31%), Positives = 102/189 (53%), Gaps = 3/189 (1%)
Query:    7  EIVDNQLPVVETNRLLLRQRKLEDAKEIFEFVKLDEVSYPAGFPAVKSLEEEITYIQEIY   66
             E +  LP +ET RL LR+  +DA  I+++   ++V+   +  +S+++   ++       +
Sbjct:    4  EDIYGDLPTLETERLRLRKFYKDDAAAIYDYASNEQVTKYVLWETHQSIKDSEAFLA--F   61

Query:   67  PTNLEKEKLPSGYAITLKGDDKVIGSVDFNH-RHEDDIFEIGYLLHPDYWGQGIVPEAAS  125
               N   EK S +AI LK ++++IG+VDF   + +D  E+GY+L   YWGQGI+ EA +
Sbjct:   62  ALNKYDEKDVSPWAIELKRNERMIGTVDFVWWKPKDKTAELGYVLSEPYWGQGIMTEAVN  121

Query:  126  ALVEIGFTLLGLHKIELGCYDYNKQSQAVARKLGFTLEANIRDRRDAQGKRCGDMRFGLL  185
             ALVE GF  + L +I+  C+  N S  V  K G   E   R        +G     + ++
Sbjct:  122  ALVEFGFNNMELERIQAKCFAENISSARVMEKAGLIYEGTHRRAIYVKGAHRDFKVYAII  181

Query:  186  RSEWEKKRR                                                   194
             R ++E+K +
Sbjct:  182  REDYEQKHQ                                                   190
```

A related DNA sequence was identified in *S. pyogenes* <SEQ ID 731> which encodes the amino acid sequence <SEQ ID 732>. Analysis of this protein sequence reveals the following:

Possible site: 30
>>> Seems to have no N-terminal signal sequence
----- Final Results -----
 bacterial cytoplasm --- Certainty=0.1864(Affirmative) <succ>
  bacterial membrane --- Certainty=0.0000 (Not Clear) <succ>
   bacterial outside --- Certainty=0.0000 (Not Clear) <succ>

An alignment of the GAS and GBS proteins is shown below:

```
Identities = 50/58 (86%), Positives = 56/58 (96%)
Query:  137  LHKIELGCYDYNKQSQAVARKLGFTLEANIRDRRDAQGKRCGDMRFGLLRSEWEKKRR   194
             LHKIELGCYDYNKQSQAVARKLGFTLEAN RDR+D QG+RCGDMRFGLLRSEWE++++
Sbjct:    1  LHKIELGCYDYNKQSQAVARKLGFTLEANARDRKDVQGRRCGDMRFGLLRSEWEEQKQ    58
```

Example 230

A DNA sequence (GBSx0244) was identified in *S. agalactiae* <SEQ ID 733> which encodes the amino acid sequence <SEQ ID 734>. This protein is predicted to be ribosomal-protein-alanine N-acetyltransferase. Analysis of this protein sequence reveals the following:

Possible site: 54
>>> Seems to have no N-terminal signal sequence
----- Final Results -----
    bacterial cytoplasm --- Certainty=0.4066 (Affirmative) < succ>
        bacterial membrane --- Certainty=0.0000 (Not Clear) < succ>
            bacterial outside --- Certainty=0.0000 (Not Clear) < succ>

A related GBS nucleic acid sequence <SEQ ID 9599> which encodes amino acid sequence <SEQ ID 9600> was also identified.

The protein has homology with the following sequences in the GENPEPT database:

```
>GP:BAB04418 GB:AP001509 ribosomal-protein-alanine
N-acetyltransferase [Bacillus halodurans]
Identities = 63/185 (34%), Positives = 95/185 (51%), Gaps = 11/185 (5%)
Query:   53 KALPKLETDRLILRQRTVGDVPAMFDYVCLEEVAYPAGLSPIASLEDEYDYFENRYYQNL  112
            K  P LET RLILR+ T D  ++ Y+ +EV   GL P +LED     E  +Y+++
Sbjct:    6 KRFPILETKRLILRKITTDDARSILSYLSDKEVMKYFGLEPFQTLEDALG--EIAWYESI   63

Query:  113 EKAKLPSGYGITVKGSDRIIGSCAFN-----HRHEDDVFEICYLLHPDYWGHGYMTEAVA  167
              +    +GIT+KG D +IGSC F+       H   + FE+ L   YWG G  +EA+
Sbjct:   64 LHEQTGIRWGITLKGQDEVIGSCGFHQWVPKHHRAEIGFELSKL----YWGQGIASEAIR  119

Query:  168 ALIEVGFTLLNLHKIEIRCYDYNKQSRAVAEKLGFTLEATIRDRKDNQDNRCVNLIYGLL  227
            A+I+ GF  L L +I+     N  S+R+ EK GF E  +R +             +Y LL
Sbjct:  120 AVIQYGFEHLELQRIQALIEPPNIPSQRLVEKQGFISEGLLRSYEYTCGKFDDLYMYSLL  179

Query:  228 RSEWE                                                        232
            +  +++
Sbjct:  180 KRDFD                                                        184
```

There is also homology to SEQ ID 732:

```
Identities = 39/54 (72%), Positives = 44/54 (81%)
Query:  179 LHKIEIRCYDYNKQSRRVAEKLGFTLEATIRDRKDNQDNRCVNLIYGLLRSEWE  232
            LHKIE+ CYDYNKQS+ VA KLGFTLEA  RDRKD Q  RC ++ +GLLRSEWE
Sbjct:    1 LHKIELGCYDYNKQSQAVARKLGFTLEANARDRKDVQGRRCGDMRFGLLRSEWE   54
```

Based on this analysis, it was predicted that these proteins and their epitopes could be useful antigens for vaccines or diagnostics.

Example 231

A DNA sequence (GBSx0245) was identified in *S. agalactiae* <SEQ ID 735> which encodes the amino acid sequence <SEQ ID 736>. Analysis of this protein sequence reveals the following:

Possible site: 51
>>> Seems to have no N-terminal signal sequence
----- Final Results -----
    bacterial cytoplasm --- Certainty=0.2719 (Affirmative) <succ>
        bacterial membrane --- Certainty=0.0000 (Not Clear) <succ>
            bacterial outside --- Certainty=0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 232

A DNA sequence (GBSx0246) was identified in *S. agalactiae* <SEQ ID 737> which encodes the amino acid sequence <SEQ ID 738>. Analysis of this protein sequence reveals the following:

Possible site: 53
>>> Seems to have no N-terminal signal sequence
----- Final Results -----
    bacterial cytoplasm --- Certainty=0.3250 (Affirmative) <succ>
        bacterial membrane --- Certainty=0.0000 (Not Clear) <succ>
            bacterial outside --- Certainty=0.0000 (Not Clear) <succ>

A related GBS nucleic acid sequence <SEQ ID 9597> which encodes amino acid sequence <SEQ ID 9598> was also identified.

The protein has no significant homology with any sequences in the GENPEPT database.

A related DNA sequence was identified in *S. pyogenes* <SEQ ID 739> which encodes the amino acid sequence <SEQ ID 740>. Analysis of this protein sequence reveals the following:

Possible site: 38
>>> Seems to have no N-terminal signal sequence
----- Final Results -----
    bacterial cytoplasm --- Certainty=0.3293 (Affirmative) <succ>
        bacterial membrane --- Certainty=0.0000 (Not Clear) <succ>
            bacterial outside --- Certainty=0.0000 (Not Clear) <succ>

An alignment of the GAS and GBS proteins is shown below:

```
Identities = 24/55 (43%), Positives = 38/55 (68%)
Query: 56  LLEGLTANKQDVLKEAGLVSLEAFAKVSEADVLALKGIGPAAIKQLVDNGVVFAK    110
           ++ G+ ++  + L   G+ S +AF + +E D+LALKGIGPA +K+LV+NG   F K
Sbjct: 77  VVAGIRSDLVETLYAEGIHSAQAFKEWTEKDLLALKGIGPATVKKLVENGASFKK    131
```

Based on this analysis, it was predicted that these proteins and their epitopes could be useful antigens for vaccines or diagnostics.

Example 233

A DNA sequence (GBSx0247) was identified in *S. agalactiae* <SEQ ID 741> which encodes the amino acid sequence <SEQ ID 742>. Analysis of this protein sequence reveals the following:

Possible site: 25
>>> Seems to have no N-terminal signal sequence
----- Final Results -----
    bacterial cytoplasm --- Certainty=0.2901 (Affirmative) <succ>
        bacterial membrane --- Certainty=0.0000 (Not Clear) <succ>
            bacterial outside --- Certainty=0.0000 (Not Clear) <succ>

The protein has no significant homology with any sequences in the GENPEPT database.

A related DNA sequence was identified in *S. pyogenes* <SEQ ID 743> which encodes the amino acid sequence <SEQ ID 744>. Analysis of this protein sequence reveals the following:

Possible site: 27
>>> Seems to have no N-terminal signal sequence
----- Final Results -----
    bacterial cytoplasm --- Certainty=0.2536 (Affirmative) < succ>
        bacterial membrane --- Certainty=0.0000 (Not Clear) < succ>
            bacterial outside --- Certainty=0.0000 (Not Clear) < succ>

An alignment of the GAS and GBS proteins is shown below:

```
Identities = 57/84 (67%), Positives = 73/84 (86%)
Query:  1  MSYEQEFLKDFEEWLQSQISINQMAMDSAKKVLEEDKDERAADAYIRYESKLDAYRFLQG    60
           MSYE+EFLKDFE+W+++QI +NQ+AM ++++V +ED DERA DA+IRYESKLDAY FL G
Sbjct:  1  MSYEKEFLKDFEDWVKTQIQVNQLAMATSQEVAQEDGDERAKDAFIRYESKLDAYEFLLG    60

Query: 61  KFNNYHNQKSFHDLPDGLFGQRHY    84
           KF+NY N K+FHD+PD LFG RHY
Sbjct: 61  KFDNYKNGKAFHDIPDELFGARHY    84
```

Based on this analysis, it was predicted that these proteins and their epitopes could be useful antigens for vaccines or diagnostics.

Example 234

A DNA sequence (GBSx0248) was identified in *S. agalactiae* <SEQ ID 745> which encodes the amino acid sequence <SEQ ID 746>. This protein is predicted to be methyltransferase. Analysis of this protein sequence reveals the following:

Possible site: 61
>>> Seems to have no N-terminal signal sequence
----- Final Results -----
    bacterial cytoplasm --- Certainty = 0.2469 (Affirmative) <succ>
        bacterial membrane --- Certainty = 0.0000 (Not Clear) <succ>
            bacterial outside --- Certainty = 0.0000 (Not Clear) <succ>

A related DNA sequence was identified in *S. pyogenes* <SEQ ID 747> which encodes the amino acid sequence <SEQ ID 748>. Analysis of this protein sequence reveals the following:

Possible site: 35
>>> Seems to have no N-terminal signal sequence
----- Final Results -----
    bacterial cytoplasm --- Certainty = 0.3352 (Affirmative) <succ>
        bacterial membrane --- Certainty = 0.0000 (Not Clear) <succ>
            bacterial outside --- Certainty = 0.0000 (Not Clear) <succ>

An alignment of the GAS and GBS proteins is shown below:

```
Identities = 26/60 (43%), Positives = 37/60 (61%)
Query: 23 LKNERCPHPKLINVLERKLEIILGDQKHILEKDSLISLSPQETHHLRAIENSKFLQIELD    82
          +  E  P  K+I VLE +L   L DQK +L ++SLI++  Q+ HHL A  + K LQ+ LD
Sbjct: 42 ISQETSPRDKVILVLEGQLIFDLEDQKQVLTQESLIAIPAQKVHHLEAKTDCELLQVLLD    101
```

Based on this analysis, it was predicted that these proteins and their epitopes could be useful antigens for vaccines or diagnostics.

Example 235

A DNA sequence (GBSx0249) was identified in *S. agalactiae* <SEQ ID 749> which encodes the amino acid sequence <SEQ ID 750>. This protein is predicted to be integrase (codV). Analysis of this protein sequence reveals the following:

Possible site: 59
>>> Seems to have no N-terminal signal sequence
----- Final Results -----
    bacterial cytoplasm --- Certainty = 0.3842 (Affirmative) <succ>
        bacterial membrane --- Certainty = 0.0000 (Not Clear) <succ>
        bacterial outside --- Certainty = 0.0000 (Not Clear) <succ>

No corresponding DNA sequence was identified in *S. pyogenes*.

Based on this analysis, it was predicted that this protein and its epitopes, could be useful antigens for vaccines or diagnostics.

Example 236

A DNA sequence (GBSx0250) was identified in *S. agalactiae* <SEQ ID 751> which encodes the amino acid sequence <SEQ ID 752>. Analysis of this protein sequence reveals the following:

Possible site: 22
>>> May be a lipoprotein
----- Final Results -----
    bacterial membrane --- Certainty = 0.0000 (Not Clear) <succ>
        bacterial outside --- Certainty = 0.0000 (Not Clear) <succ>
        bacterial cytoplasm --- Certainty = 0.0000 (Not Clear) <succ>

The protein has no significant homology with any sequences in the GENPEPT database.

No corresponding DNA sequence was identified in *S. pyogenes*.

Figure 23:
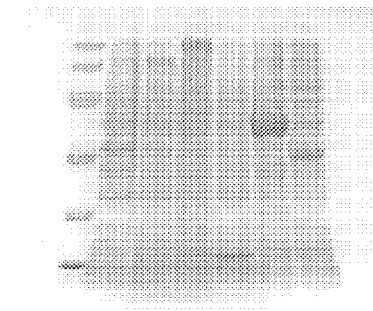
Figure 32:
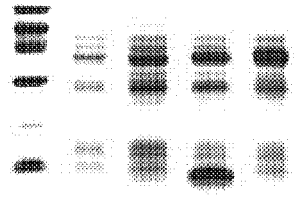

SEQ ID 752 (GBS128) was expressed in *E. coli* as a His-fusion product. SDS-PAGE analysis of total cell extract is shown in FIG. 23 (lane 5; MW 15 kDa). It was also expressed in *E. coli* as a GST-fusion product. SDS-PAGE analysis of total cell extract is shown in FIG. 32 (lane 4; 2 bands).

Figure 288:
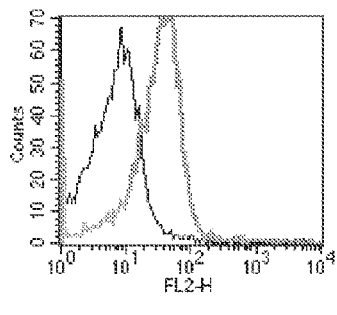

The GBS128-GST fusion product was purified (FIG. 198, lane 2) and used to immunise mice. The resulting antiserum was used for FACS (FIG. 288), which confirmed that the protein is immunoaccessible on GBS bacteria.

Based on this analysis, it was predicted that this protein and its epitopes, could be useful antigens for vaccines or diagnostics.

Example 237

A DNA sequence (GBSx0251) was identified in *S. agalactiae* <SEQ ID 753> which encodes the amino acid sequence <SEQ ID 754>. Analysis of this protein sequence reveals the following:

Possible site: 30
>>> Seems to have no N-terminal signal sequence
----- Final Results -----
    bacterial cytoplasm --- Certainty = 0.2940 (Affirmative) <succ>
        bacterial membrane --- Certainty = 0.0000 (Not Clear) <succ>
        bacterial outside --- Certainty = 0.0000 (Not Clear) <succ>

The protein has no significant homology with any sequences in the GENPEPT database.

A related DNA sequence was identified in *S. pyogenes* <SEQ ID 755> which encodes the amino acid sequence <SEQ ID 756>. Analysis of this protein sequence reveals the following:

Possible site: 42
>>> Seems to have no N-terminal signal sequence
----- Final Results -----
    bacterial cytoplasm --- Certainty = 0.2518 (Affirmative) <succ>
        bacterial membrane --- Certainty = 0.0000 (Not Clear) <succ>
        bacterial outside --- Certainty = 0.0000 (Not Clear) <succ>

An alignment of the GAS and GBS proteins is shown below:

```
Identities = 30/90 (33%), Positives = 49/90 (54%), Gaps = 10/90 (11%)

Query:  3 TVAVRVDDQLKDDATELFQSLGLDMSTAVKMFLIQSVKTQSIPFEIK--------NKSSV   54
          T+ +RVDD +K  A ++ + LG+ MSTA+ MFL Q + T  IPF++         N   +

Sbjct: 15 TLNLRVDDSVKSAADDILKRLGIPMSTAIDMFLNQIILTGGIPFDVSLPEAPQRVNVDYM   74

Query: 55 SDEEFQNLVETKLKGIRVKASDPESVNAFF                                84
          S E+F + + T  +    K  +P+ V  F+

Sbjct: 75 SQEKFYDKLITSFED--AKTCNPQDVGKFY                                102
```

Based on this analysis, it was predicted that these proteins and their epitopes could be useful antigens for vaccines or diagnostics.

Example 238

A DNA sequence (GBSx0252) was identified in *S. agalactiae* <SEQ ID 757> which encodes the amino acid sequence <SEQ ID 758>. This protein is predicted to be surface protein Rib. Analysis of this protein sequence reveals the following:

```
Possible site: 24
>>> Seems to have no N-terminal signal sequence
INTEGRAL     Likelihood = -2.81    Transmembrane 370-386 (368-388)
----- Final Results -----
   bacterial membrane --- Certainty = 0.2126 (Affirmative) <succ>
   bacterial outside --- Certainty = 0.0000 (Not Clear) <succ>
      bacterial cytoplasm --- Certainty = 0.0000 (Not Clear) <succ>
```

A related GBS nucleic acid sequence <SEQ ID 9593> which encodes amino acid sequence <SEQ ID 9594> was also identified. A related GBS nucleic acid sequence <SEQ ID 10773> which encodes amino acid sequence <SEQ ID 10774> was also identified.

A related DNA sequence was identified in *S. pyogenes* <SEQ ID 759> which encodes the amino acid sequence <SEQ ID 760>. Analysis of this protein sequence reveals the following:

```
Possible site: 37
>>> Seems to have a cleavable N-term signal seq.
INTEGRAL     Likelihood = -4.57    Transmembrane 354-370 (353-371)
----- Final Results -----
   bacterial membrane --- Certainty = 0.2826 (Affirmative) <succ>
      bacterial outside --- Certainty = 0.0000 (Not Clear) <succ>
         bacterial cytoplasm --- Certainty = 0.0000 (Not Clear) <succ>
LPXTG motif: 344-348
```

An alignment of the GAS and GBS proteins is shown below:

Based on this analysis, it was predicted that these proteins and their epitopes could be useful antigens for vaccines or diagnostics.

Example 239

A DNA sequence (GBSx0253) was identified in *S. agalactiae* <SEQ ID 761> which encodes the amino acid sequence <SEQ ID 762>. This protein is predicted to be surface protein Rib. Analysis of this protein sequence reveals the following:

```
Possible site: 49
>>> Seems to have no N-terminal signal sequence
----- Final Results -----
   bacterial cytoplasm --- Certainty = 0.5289 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. pyogenes*.

Based on this analysis, it was predicted that this protein and its epitopes, could be useful antigens for vaccines or diagnostics.

Example 240

A DNA sequence (GBSx0254) was identified in *S. agalactiae* <SEQ ID 763> which encodes the amino acid sequence <SEQ ID 764>. This protein is predicted to be surface protein Rib. Analysis of this protein sequence reveals the following:

```
Possible site: 53
>>> Seems to have no N-terminal signal sequence
INTEGRAL     Likelihood = -1.06    Transmembrane 39-55 (39-55)
----- Final Results -----
   bacterial membrane --- Certainty = 0.1426 (Affirmative) <succ>
      bacterial outside --- Certainty = 0.0000 (Not Clear) <succ>
         bacterial cytoplasm --- Certainty = 0.0000 (Not Clear) <succ>
```

```
Identities = 64/277 (23%), Positives = 99/277 (35%), Gaps = 31/277 (11%)
Query:  126 SIGNLPDLPKGTTVAFETPVDTATPGDKPAKVVVTYPDGSKDTVDVTVKVVDPRTDADKN        185
            ++ +LP    + TT   E PV        + V         + D+ + T    P   A Sbjct:  121 AVKDLPASTESTTQPVEAPVQETQASASDSMVTGDSTSVTTDSPEETPSSESPVAPALSE        180

Query:  186 DPAGKDQQVNVGETPKAEDSIGNLPDLPKGTTVAFETPVDTATPGDKPAKVVVTYPDGSK        245
               PA   Q    E P   S    P    T A  ETP + A P       P    +    S+

Sbjct:  181 APA----QPAESEEPSVAASSEETPS--PSTPAAPETPEEPAAPSPSPESEEPSVAAPSE        234

Query:  246 DTVDVTVKVVDPRTDADKNDPAGKDQQVNVGETPKAEDSIGNLPDLPKGTTVAFETPVDT        305
            +T           P    A  + PA  ++       T  +         P   P  +    +TP Sbjct:  235 ETPSPET----PEEPAAPSQPAESEESSVAATTSPS-------PSTPAESET--QTPPAV        281

Query:  306 ATPGDKPAKVVVTYPDGSKDTVDVTVKVVDPRTDADK----------NDPAGKDQQVNGK        355
                 DKP+      P   S    + TV+      +  +DK              N    +  + +

Sbjct:  282 TKDSDKPSSAAEK-PAASSLVSEQTVQQPTSKRSSDKKEEQEQSYSPNRSLSRQVRAHES        340

Query:  356 GNKLPATGENATPFFNVVALTIMSSVGLLSVSKKKED                              392
                 G   LP+TGE  A  P F  +    +T+MS   G  L  V+K++++

Sbjct:  341 GKYLPSTGEKAQPLF-IATMTLMSLFGSLLVTKRQKE                              376
```

A related GBS nucleic acid sequence <SEQ ID 9591> which encodes amino acid sequence <SEQ ID 9592> was also identified.

```
The protein differs significantly from U58333 in several places:
Query: 157 TKPDGQVDIVNVSLTIYNSSALRDKIDEVKK---------KAED-----PKWDEGSRDK        201
            T PDG  D V+V++ + +    DK D    K          KAED     P   +G+

Sbjct: 683 TYPDGSKDTVDVTVKVVDPRTDADKNDPAGKDQQVNVGETPKAEDSIGNLPDLPKGTTVA      742

Query: 202 VLISLDDIKTDIDNNPK---TQSDIANKITEVTNLEKILVPRIPDADKNDPAGKDQQVNV       258
            +D   T  D    K    T D +   +VT   K++ PR  DADKNDPAGKDQQVNV Sbjct: 743 FETPVDTA-TPGDKPAKVVVTYPDGSKDTVDVT--VKVVDPRT-DADKNDPAGKDQQVNV      798

Query: 157 TKPDGQVDIVNVSLTIYNSSALRDKIDEVKK---------KAED-----PKWDEGSRDK        201
            T PDG  D V+V++ + +    DK D    K          KAED     P   +G+

Sbjct: 841 TYPDGSKDTVDVTVKVVDPRTDADKNDPAGKDQQVNVGETPKAEDSIGNLPDLPKGTTVA      900

Query: 202 VLISLDDIKTDIDNNPK---TQSDIANKITEVTNLEKILVPRIPDADKNDPAGKDQQVNV       258
            +D   T  D    K    T D +   +VT   K++ PR  DADKNDPAGKDQQVNV Sbjct: 901 FETPVDTA-TPGDKPAKVVVTYPDGSKDTVDVT--VKVVDPRT-DADKNDPAGKDQQVNV      956

Query: 157 TKPDGQVDIVNVSLTIYNSSALRDKIDEVKK---------KAED-----PKWDEGSRDK        201
            T PDG  D V+V++ + +    DK D    K          KAED     P   +G+

Sbjct: 288 TYPDGSKDTVDVTVKVVDPRTDADKNDPAGKDQQVNVGETPKAEDSIGNLPDLPKGTTVA      347

Query: 202 VLISLDDIKTDIDNNPK---TQSDIANKITEVTNLEKILVPRIPDADKNDPAGKDQQVNV       258
            +D   T  D    K    T D+      +VT   K++ PR  DADKNDPAGKDQQVNV Sbjct: 348 FETPVDTA-TPGDKPAKVVVTYPDGSKDTVDVT--VKVVDPRT-DADKNDPAGKDQQVNV      403

Query: 157 TKPDGQVDIVNVSLTIYNSSALRDKIDEVKK---------KAED-----PKWDEGSRDK        201
            T PDG  D V+V++ + +    DK D    K          KAED     P   +G+

Sbjct: 604 TYPDGSKDTVDVTVKVVDPRTDADKNDPAGKDQQVNVGETPKAEDSIGNLPDLPKGTTVA      663

Query: 202 VLISLDDIKTDIDNNPK---TQSDIANKITEVTNLEKILVPRIPDADKNDPAGKDQQVNV       258
            +D   T  D    K    T D +   +VT   K++ PR  DADKNDPAGKDQQVNV Sbjct: 664 FETPVDTA-TPGDKPAKVVVTYPDGSKDTVDVT--VKVVDPRT-DADKNDPAGKDQQVNV      719

Query: 157 TKPDGQVDIVNVSLTIYNSSALRDKIDEVKK---------KAED-----PKWDEGSRDK        201
            T PDG  D V+V++ + +    DK D    K          KAED     P   +G+

Sbjct: 446 TYPDGSKDTVDVTVKVVDPRTDADKNDPAGKDQQVNVGETPKAEDSIGNLPDLPKGTTVA      505

Query: 202 VLISLDDIKTDIDNNPK---TQSDIANKITEVTNLEKILVPRIPDADKNDPAGKDQQVNV       258
            +D   T  D    K    T D +   +VT   K++ PR  DADKNDPAGKDQQVNV Sbjct: 506 FETPVDTA-TPGDKPAKVVVTYPDGSKDTVDVT--VKVVDPRT-DADKNDPAGKDQQVNV      561

Query: 157 TKPDGQVDIVNVSLTIYNSSALRDKIDEVKK---------KAED-----PKWDEGSRDK        201
            T PDG  D V+V++ + +    DK D    K          KAED     P   +G+

Sbjct: 920 TYPDGSKDTVDVTVKVVDPRTDADKNDPAGKDQQVNVGETPKAEDSIGNLPDLPKGTTVA      979

Query: 202 VLISLDDIKTDIDNNPK---TQSDIANKITEVTNLEKILVPRIPDADKNDPAGKDQQVNV       258
            +D   T  D    K    T D +   +VT   K++ PR  DADKNDPAGKDQQVNV Sbjct: 980 FETPVDTA-TPGDKPAKVVVTYPDGSKDTVDVT--VKVVDPRT-DADKNDPAGKDQQVNV     1035
```

No corresponding DNA sequence was identified in *S. pyogenes*.

Based on this analysis, it was predicted that these proteins and their epitopes could be useful antigens for vaccines or diagnostics.

Example 241

A DNA sequence (GBSx0255) was identified in *S. agalactiae* <SEQ ID 765> which encodes the amino acid sequence <SEQ ID 766>. This protein is predicted to be ara-C-like activator. Analysis of this protein sequence reveals the following:

```
Possible site: 30
>>> Seems to have no N-terminal signal sequence
INTEGRAL    Likelihood = -0.37    Transmembrane 8-24 (8-25)
----- Final Results -----
  bacterial membrane --- Certainty = 0.1150 (Affirmative) <succ>
    bacterial outside --- Certainty = 0.0000 (Not Clear) <succ>
    bacterial cytoplasm --- Certainty = 0.0000 (Not Clear) <succ>
```

A related GBS nucleic acid sequence <SEQ ID 9589> which encodes amino acid sequence <SEQ ID 9590> was also identified.

There is homology to SEQ ID 460.

Based on this analysis, it was predicted that these proteins and their epitopes could be useful antigens for vaccines or diagnostics.

Example 242

A DNA sequence (GBSx0256) was identified in *S. agalactiae* <SEQ ID 767> which encodes the amino acid sequence <SEQ ID 768>. Analysis of this protein sequence reveals the following:

Possible site: 53
>>> Seems to have no N-terminal signal sequence
----- Final Results -----
   bacterial cytoplasm --- Certainty = 0.1200 (Affirmative) <succ>
      bacterial membrane --- Certainty = 0.0000 (Not Clear) <succ>
         bacterial outside --- Certainty = 0.0000 (Not Clear) <succ>

A related GBS nucleic acid sequence <SEQ ID 9587> which encodes amino acid sequence <SEQ ID 9588> was also identified.

A related DNA sequence was identified in *S. pyogenes* <SEQ ID 769> which encodes the amino acid sequence <SEQ ID 770>. Analysis of this protein sequence reveals the following:

Possible site: 50
>>> Seems to have no N-terminal signal sequence
----- Final Results -----
   bacterial cytoplasm --- Certainty = 0.0679 (Affirmative) <succ>
      bacterial membrane --- Certainty = 0.0000 (Not Clear) <succ>
         bacterial outside --- Certainty = 0.0000 (Not Clear) <succ>

An alignment of the GAS and GBS proteins is shown below:

```
Identities = 135/176 (76%), Positives = 161/176 (90%)
Query:   1 MSYMVKDRQIQKTKVAIYNAFISLLQENDYSKITVQDVIGLANVGRSTFYSHYESKEVLL     60
           +S M KDRQI+KTK AIY+AFI+LLQ+ +YSKITV+D+I LANVGRSTFY+HYESKE+LL
Sbjct:   1 VSDMTKDRQIKKTKTAIYSAFIALLQKKEYSKITVRDMITLANVGRSTFYAHYESKEMLL     60

Query:  61 KELCEDLFHHLFKQGRDVTFEEYLVHILKHFEQNQDSIATLLLSDDPYFLLRFRSELEHD    120
           KELCE+LFHHLF+Q R+VTFE+YLVHILKHFEQN+DSIATLLLS+DPYFLLRF++ELEHD
Sbjct:  61 KELCEELFHHLFROKRNVTFEDYLVHILKHFEQNKDSIATLLLSNDPYFLLRFKNELEHD    120

Query: 121 VYPRLREEYITKVDIPEDFLKQFLLSSFIETLKWWLHQRQKMTVEDLLKYYLTMVE       176
           VYP LR +YI K  IPE FLKQF+LSSFIETLKWWLHQRQ+M+  +LLKYYL +++
Sbjct: 121 VYPNLRCKYIDKTTIPEVFLKQFVLSSFIETLKWWLHQRQRMSANELLKYYLELIK       176
```

Based on this analysis, it was predicted that these proteins and their epitopes could be useful antigens for vaccines or diagnostics.

Example 243

A DNA sequence (GBSx0257) was identified in *S. agalactiae* <SEQ ID 771> which encodes the amino acid sequence <SEQ ID 772>. Analysis of this protein sequence reveals the following:

Possible site: 29
>>> Seems to have no N-terminal signal sequence
----- Final Results -----
   bacterial cytoplasm --- Certainty = 0.3573 (Affirmative) <succ>
      bacterial membrane --- Certainty = 0.0000 (Not Clear) <succ>
         bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 244

A DNA sequence (GBSx0258) was identified in *S. agalactiae* <SEQ ID 773> which encodes the amino acid sequence <SEQ ID 774>. Analysis of this protein sequence reveals the following:

Possible site: 35
>>> Seems to have a cleavable N-term signal seq.
INTEGRAL    Likelihood = −10.19   Transmembrane 112-128 (107-131)
INTEGRAL    Likelihood = −8.07    Transmembrane 77-93 (71-97)
INTEGRAL    Likelihood = −6.10    Transmembrane 144-160 (138-165)
INTEGRAL    Likelihood = −3.03    Transmembrane 165-181 (164-182)
----- Final Results -----
   bacterial membrane --- Certainty = 0.5076 (Affirmative) <succ>
      bacterial outside --- Certainty = 0.0000 (Not Clear) <succ>
         bacterial cytoplasm --- Certainty = 0.0000 (Not Clear) <succ>

A related DNA sequence was identified in *S. pyogenes* <SEQ ID 775> which encodes the amino acid sequence <SEQ ID 776>. Analysis of this protein sequence reveals the following:

Possible site: 35
>>> Seems to have an uncleavable N-term signal seq
INTEGRAL    Likelihood = −9.13    Transmembrane 112-128 (107-130)
INTEGRAL    Likelihood = −5.89    Transmembrane 144-160 (138-163)
INTEGRAL    Likelihood = −5.47    Transmembrane 7-23 (6-29)
INTEGRAL    Likelihood = −3.50    Transmembrane 77-93 (74-94)
INTEGRAL    Likelihood = −2.07    Transmembrane 166-182 (165-183)
----- Final Results -----
   bacterial membrane --- Certainty = 0.4652 (Affirmative) <succ>
      bacterial outside --- Certainty = 0.0000 (Not Clear) <succ>
         bacterial cytoplasm --- Certainty = 0.0000 (Not Clear) <succ>

An alignment of the GAS and GBS proteins is shown below:

```
Identities = 212/287 (73%), Positives = 245/287 (84%)
Query:    1 MTSNKKVAIAFILNISFSVLEFIFGSLFFSGAILADAVHDFGDAIAIGISATLEKKSKKD    60
            M ++KKV I FILN+SFS++EFIFG+LFFSGAILADAVHDFGDAIAIGISA LE+K+ K Sbjct:    1 MPASKKVTIIFILNLSFSLIEFIFGTLFFSGAILADAVHDFGDAIAIGISAILERKAVKK    60

Query:   61 EDTIFSLGYKRFSLLGALITSLILISGSILVMIENIPKLWHPTPVNYHGMFILAVIAIII   120
            E   FSLGYKRFSLLGAL T+LILISGS+LVMIE IPKLWHPT VNY GMF+LA+ AIII Sbjct:   61 ESPNFSLGYKRFSLLGALTTNLILISGSLLVMIETIPKLWHPTIVNYDGMFVLAIFAIII   120

Query:  121 NGLASFILHSGQSKHEEILSLHFLEDILGWLAIIVISLILNWKPLYILDPLLSVAISTFI   180
            NG ASFI+HS Q+K+EEILSLHFLEDILGWLAII++SLIL WKP YILDPLLS+AI++FI Sbjct:  121 NGFASFIIHSNQTKNEEILSLHFLEDILGWLAIIILSLILKWKPWYILDPLLSIAIASFI   180

Query:  181 LSKALPKLLSTLKLFLDGVPDSIDYAALHDELKGLSQVRSINQLNIWSMDGIDNRAIIHC   240
            LSKALPKL++T  +FLDGVPDSIDY  LH EL  L  + S+NQLN+WSMDGID+RA IHC Sbjct:  181 LSKALPKLVATANIFLDGVPDSIDYCTLHHELSQLPHIVSVNQLNVWSMDGIDHRATIHC   240

Query:  241 CLNQLISEKDCKRAIRTICQHYKINDVTVEIDYSLREHQNHCKPLKN              287
            CL +  +EK CK++IR ICQ Y IN VTVEID SL EHQ+HC  L +

Sbjct:  241 CLRESTTEKHCKKSIRLICQRYNINSVTVEIDTSLNEHQHHCSSLSS              287
```

Based on this analysis, it was predicted that these proteins and their epitopes could be useful antigens for vaccines or diagnostics.

Example 245

A DNA sequence (GBSx0259) was identified in *S. agalactiae* <SEQ ID 777> which encodes the amino acid sequence <SEQ ID 778>. Analysis of this protein sequence reveals the following:

Possible site: 48
>>> Seems to have no N-terminal signal sequence
INTEGRAL    Likelihood = −1.22    Transmembrane 221-237 (221-237)
----- Final Results -----
  bacterial membrane --- Certainty = 0.1489 (Affirmative) <succ>
    bacterial outside --- Certainty = 0.0000 (Not Clear) <succ>
  bacterial cytoplasm --- Certainty = 0.0000 (Not Clear) <succ>

There is also homology to SEQ ID 780.

Based on this analysis, it was predicted that this protein and its epitopes, could be useful antigens for vaccines or diagnostics.

Example 246

A DNA sequence (GBSx0260) was identified in *S. agalactiae* <SEQ ID 781> which encodes the amino acid sequence <SEQ ID 782>. Analysis of this protein sequence reveals the following:

Possible site: 13
>>> Seems to have no N-terminal signal sequence
INTEGRAL    Likelihood = −2.50    Transmembrane 2-18 (1-18)
----- Final Results -----
  bacterial membrane --- Certainty = 0.1999 (Affirmative) <succ>
    bacterial outside --- Certainty = 0.0000 (Not Clear) <succ>
  bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 247

A DNA sequence (GBSx0261) was identified in *S. agalactiae* <SEQ ID 783> which encodes the amino acid sequence <SEQ ID 784>. This protein is predicted to be dehydrogenase (Zn-dependent). Analysis of this protein sequence reveals the following:

Possible site: 15
>>> Seems to have no N-terminal signal sequence
INTEGRAL    Likelihood = −3.77    Transmembrane 171-187 (170-187)
----- Final Results -----
  bacterial membrane --- Certainty = 0.2508 (Affirmative) <succ>
    bacterial outside --- Certainty = 0.0000 (Not Clear) <succ>
  bacterial cytoplasm --- Certainty = 0.0000 (Not Clear) <succ>

The protein has homology with the following sequences in the GENPEPT database:

```
>GP: AAG20655 GB: AE005134 alcohol dehydrogenase; Adh2 [Halobacterium
sp. NRC-1]
Identities = 169/348 (48%), Positives = 232/348 (66%), Gaps = 9/348 (2%)
Query:    1 MKVATFIEPGKMVITDTPKPVIEQETDAVIKIVRACVCGSDLWWYRGISKRESGSFAGHE    60
            M+ A +  PG++ + + PKP IE    DAVI++     VCGSDLW+YRG S RE+GS  GHE
```

```
Sbjct:   1 MRAAVYQGPGEIAVEEVPKPDIESPEDAVIRVTHTAVCGSDLWFYRGDSDREAGSRVGHE      60

Query:  61 AIGIVEEVGTKVTDVSKGDFVIVPFTHGCGQCPSCKAGFDGNCTNHQA---AENVGYQGQ     117
           +GIVEEVG  VT V+ GD VI PF   CG+C C+ G   +C   ++     N G QG+

Sbjct:  61 PMGIVEEVGDDVTSVAPGDRVIAPFAISCGECEFCRQGLYTSCVEDESWGSEANGGGQGE    120

Query: 118 YLRYTNANWALVKIPGQPSDYDNETLNSLLTLSDVMATGYHAAATAEVKEGDTVVVMGDG     177
           Y++   A+  LV++P + +D D + L SLL L+DVM TG+HAA +A V EGDT VV+GDG Sbjct: 121 YVKCPFADGTLVRVPDRYAD-DEDVLESLLPLTDVMGTGHHAAVSAGVGEGDTAVVVGDG    179

Query: 178 AVGLCGVIAAKMLGANRIIAMSRHKDRQELALTFGATDIVEERGDEAVKRVLDLTNQAGA     237
           AVGLCGV+AA+ LGA RIIAM  H+DR ELA  FGATD +   RGD+A++R  DLT+ GA Sbjct: 180 AVGLCGVLAAQRLGAERIIAMGHHEDRLELAAEFGATDTISARGDDAIERARDLTH-GGA    238

Query: 238 DAVLECVGTEQSVDTATQIARPGAVIGRVGIP---QNPDMNTNNLFWKNIGLRGGIASVT     294
           + V+ECVG   ++D+A  IARPG +G VG+P   ++  ++     +F NI +RGG+A V Sbjct: 239 NHVMECVGAASAMDSAIAIARPGGTVGYVGVPYGVEDGGLDVFTMFSDNITIRGGVAPVR    298

Query: 295 TFDKSVLLDAVLTHKINPGLVFTKSFVLDDIQKAYEAMDKRDAIKSLV               342
           + + ++ D  VL   ++P  +FTK+   LD + + Y  AMD R+AIK LV Sbjct: 299 AYAEELMAD-VLQGTLDPSPIFTKTVDLDGVPEGYAAMDDREAIKVLV               345
```

There is also homology to SEQ ID 786.

A related sequence was also identified in GAS <SEQ ID 9145> which encodes the amino acid sequence <SEQ ID 9146>. Analysis of this protein sequence reveals the following:

---

Possible site:23
>>> Seems to have no N-terminal signal sequence
INTEGRAL       Likelihood = −5.41        Transmembrane 170-186
----- Final Results -----
  bacterial membrane --- Certainty = 0.3166 (Affirmative) <succ>
  bacterial outside --- Certainty = 0.0000 (Not Clear) <succ>
  bacterial cytoplasm --- Certainty = 0.0000 (Not Clear) <succ>

---

An alignment of the GAS and GBS proteins is shown below:

Based on this analysis, it was predicted that these proteins and their epitopes could be useful antigens for vaccines or diagnostics.

Example 248

A DNA sequence (GBSx0262) was identified in *S. agalactiae* <SEQ ID 787> which encodes the amino acid sequence <SEQ ID 788>. Analysis of this protein sequence reveals the following:

---

Possible site: 31
>>> Seems to have no N-terminal signal sequence
----- Final Results -----

---

```
Identities = 121/353 (34%), Positives = 182/353 (51%), Gaps = 16/353 (4%)
Query:   1 MKVATFIEPGKMVITDTPKPVIEQETDAVIKIVRACVCGSDLWWYRG-ISKRESGSFAGH      59
           MK AT++  G + +D PKPVI + TDA++++V+  +CG+DL     G +  + G+  GH Sbjct:  15 MKAATYLSTGNLQLIDKPKPVIIKPTDAIVQLVKTTICGTDLHILGGDVPACKEGTILGH      74

Query:  60 EAIGIVEEVGTKVTDVSKGDFVIVPFTHGCGQCPSCKAGFDGNCTNHQAAKN---VGYQG     116
           E IGIV+EVG  VT+  GD VI+    C   C  CK G  +C +         G Q Sbjct:  75 EGIGIVKEVGDAVTNFKIGDKVIISCVTSCHTCYYCKRGLSSHCQDGGWILGHLINGTQA    134

Query: 117 QYLRYTNANWALVKIPGQPSDYDNETLNSLLTLSDVMATGYH-AAATAEVKEGDTVVVMG     175
           +Y+    +A+ +L    P    D        +L+ LSD++  T Y       + VK GD V ++G Sbjct: 135 EYVHIPHADGSLYHAPDTIDD------EALVMLSDILPTSYEIGVLPSHVKPGDNVCIVG    188

Query: 176 DGAVGLCGVIAAKMLGANRIIAMSRHKDRQELALTFGATDIVEERGDEAVKRVL-DLTNQ     234
            G VGL ++ +       II +   ++R E A TFGAT +      E VK ++ D+TN Sbjct: 189 AGPVGLAALLTVQFFSPANIIMVDLSQNRLEAAKTFGATHTICSGSSEEVKAIIDDITNG    248

Query: 235 AGADAVLECVGTEQSVDTATQIARPGAVIGRVGIPQNP-DMNTNNLFWKNIGLRGGIASV     293
            G D +ECVG   + D    +I  G I  VG+     P D N + L+ KNI L  G+ +

Sbjct: 249 RGVDISMECVGYPATFDICQKIISVGGHIANVGVHGKPVDFNLDELWIKNITLNTGLVNA    308

Query: 294 TTFDKSVLLDAVLTHKINPGLVFTKSFVLDDIQKAYEAMDKRDAIKSL-VIVD          345
           T + +LL+ + T KI+      + T  F L +++KAYE      A +L VI+D Sbjct: 309 NTTE--MLLNVLKTGKIDATRLITHHFKLSEVEKAYETFKHAGANNALKVIID          359
```

-continued bacterial cytoplasm --- Certainty = 0.2169 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database:

```
>GP: AAD36075 GB: AE001762 hypothetical protein [Thermotoga maritima]
Identities = 55/128 (42%), Positives = 72/128 (55%), Gaps = 8/128 (6%)
Query:    8 IFPKGEKNPYGEFFIGQSYLAALAKSPDG--NVSVGNVTFEAGCRNNWHVHLDGYQILLV      65
            IF +G K    +FF G  ++  L    +G  N  V +V FE G R +WH H   G  QIL+V
Sbjct:    5 IFERGSKGS-SDFFTGNVWVKMLVTDENGVFNTQVYDVVFEPGARTHWHSHPGG-QILIV      62

Query:   66 TEGSGWYQEEGKEAVSLKPGDVIVTDKGVRHWHGAKKDSEFAHIAITA----GKSEFYEA     121
            T G G+YQE GK A LK GDV+ V      HWHGA   D E   HI I+       G  +E+   +
Sbjct:   63 TRGKGFYQERGKPARILKKGDVVEIPPNVVHWHGAAPDEELVHIGISTQVHLGPAEWLGS     122

Query:  122 VSDEEYSR                                                        129
            V++EEY +
Sbjct:  123 VTEEEYRK                                                        130
```

No corresponding DNA sequence was identified in S. pyogenes.

Based on this analysis, it was predicted that this protein and its epitopes, could be useful antigens for vaccines or diagnostics.

Example 249

A DNA sequence (GBSx0263) was identified in S. agalactiae <SEQ ID 789> which encodes the amino acid sequence <SEQ ID 790>. This protein is predicted to be gamma-carboxymuconolactone decarboxylase. Analysis of this protein sequence reveals the following:

Possible site: 49
>>> Seems to have no N-terminal signal sequence
----- Final Results -----
bacterial cytoplasm --- Certainty = 0.4089 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database:

```
>GP: CAA20070 GB: AL031155 3-oxoadipate enol-lactone
hydrolase/4-carboxymuconolactone decarboxylase
[Streptomyces coelicolor A3(2)]
Identities = 33/93 (35%), Positives = 59/93 (62%), Gaps = 1/93 (1%)
Query:   11 QLEEFAPEFARYNDDILFGEVWAKEDHLTDKTRSIITISALISGGNLEQLEHHLQFAKQN      70
            Q  +EF+ +F  +      +GE+W  +    L  ++RS +T++AL++GG+L++L  HL+  A  +N
Sbjct:  349 QADEFSGDFQEFLTRYAWGEIWDRPG-LDRRSRSCVILTALVAGGHLDELAPHLRAALRN     407

Query:   71 GVTKEEIADIITHLAFYVGWPKAWSAFNKAKEI                              103
            G+T    EI +++   A Y G P A  AF   A+++
Sbjct:  408 GLTPGEIKEVLLQAAVYCGVPAANGAFRVAQQV                              440
```

No corresponding DNA sequence was identified in S. pyogenes.

Based on this analysis, it was predicted that this protein and its epitopes, could be useful antigens for vaccines or diagnostics.

Example 250

A DNA sequence (GBSx0265) was identified in S. agalactiae <SEQ ID 791> which encodes the amino acid sequence <SEQ ID 792>. Analysis of this protein sequence reveals the following:

Possible site: 44
>>> Seems to have no N-terminal signal sequence
----- Final Results -----
bacterial cytoplasm --- Certainty = 0.5529 (Affirmative) <succ>
bacterial membrane --- Certainty = 0.0000 (Not Clear) <succ>
bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 251

A DNA sequence (GBSx0266) was identified in S. agalactiae <SEQ ID 793> which encodes the amino acid sequence <SEQ ID 794>. This protein is predicted to be probable transcriptional regulator. Analysis of this protein sequence reveals the following:

Possible site: 58
>>> Seems to have an uncleavable N-term signal seq
----- Final Results ----- bacterial membrane --- Certainty = 0.0000 (NotClear) <succ>
bacterial outside --- Certainty = 0.0000 (NotClear) <succ>
bacterial cytoplasm --- Certainty = 0.0000 (NotClear) <succ>

A related GBS nucleic acid sequence <SEQ ID 9585> which encodes amino acid sequence <SEQ ID 9586> was also identified.

The protein has homology with the following sequences in the GENPEPT database:

```
>GP: AAG08263 GB: AE004901 probable transcriptional regulator
[Pseudomonas aeruginosa]

Identities = 36/148 (24%), Positives = 68/148 (45%), Gaps = 22/148 (14%)
Query:    5 QIVEKPAMILAG------------------VTLENVKSNQEGIQQAIGICKTQPDFRFD     45
            +IVE+PA  + G                  +  E+  + +   + + GIC  QP+  F Sbjct:  123 RIVERPAFSVVGMEYFGSAPGDTIGQLWERFIPREHEIAGKHDPEVSYGICAQQPNGEFH    182

Query:   46 YSATYQVETSVQAPKGLEIIRIPSATYAVISVKGPMPSSLQETWRKIIQGFFQENNLKPA    105
            Y A ++V+      P+G+   ++P+  YAV + KG  P   + E+++ I     E  L+P Sbjct:  183 YVAGFEVQEGWPVPEGMVRFQVPAQKYAVFTHKGTAP-QIAESFQAIYSHLLAERGLEPK    241

Query:  106 NSPNLEIYSSQH--PQDTDYQMEIWLAI    131
            + E Y  +    P D + Q+++++ I Sbjct:  242 AGVDFEYYDQRFRGPLDPNSQVDLYIPI    269
```

No corresponding DNA sequence was identified in *S. pyogenes*.

Based on this analysis, it was predicted that these proteins and their epitopes could be useful antigens for vaccines or diagnostics.

Example 252

A DNA sequence (GBSx0267) was identified in *S. agalactiae* <SEQ ID 795> which encodes the amino acid sequence <SEQ ID 796>. Analysis of this protein sequence reveals the following:

Possible site: 24
>>> Seems to have no N-terminal signal sequence
----- Final Results -----
bacterial cytoplasm --- Certainty = 0.0887 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database:

```
>GP: AAB84919 GB: AE000825 conserved protein [Methanothermobacter
thermoautotrophicus]
Identities = 42/130 (32%), Positives = 71/130 (54%), Gaps = 3/130 (2%)
Query:   1 MITQEMKEIINSQLAMVATVDAKGQPNIGPKRSMRLWDDKTFIYNENTDGQTRINIEDNG      60
           M+T EM + I  +L  VAT D +G PN+ P     R  D++T +   +N    +T  N+ +N Sbjct:   1 MMTPEMMDAIEKELVFVATADEEGTPNVVPIGFARPLDERTILIADNYMKKTIRNLHENP      60

Query:  61 KIEIAFVDRERLLGYRFVGTAEIQTEGTYYEAAKKWAEGRMG--VPKAVGIIHVERIFNL     118
           +I +       R   Y+F GT EI   G Y++    +WA+   M      PK+  ++ VE I+++

Sbjct:  61 RIAL-IPQNARECPYQFKGTVEIFKSGKYFDMVVEWAQNVMTELEPKSAILMTVEEIYSV     119

Query: 119 QSGANAGKEI                                                       128
            + G   AG+++

Sbjct: 120 KPGPEAGEKV                                                       129
```

A related DNA sequence was identified in *S. pyogenes* <SEQ ID 797> which encodes the amino acid sequence <SEQ ID 798>. Analysis of this protein sequence reveals the following:

Possible site: 24
>>> Seems to have no N-terminal signal sequence
----- Final Results -----
   bacterial cytoplasm --- Certainty = 0.0789 (Affirmative) <succ>
      bacterial membrane --- Certainty = 0.0000 (Not Clear) <succ>
         bacterial outside --- Certainty = 0.0000 (Not Clear) <succ>

An alignment of the GAS and GBS proteins is shown below:

```
Identities = 123/128 (96%), Positives = 127/128 (99%)
Query:   1 MITQEMKEIINSQLAMVATVDAKGQPNIGPKRSMRLWDDKTFIYNENTDGQTRINIEDNG      60
           MITQEMK++IN+QLAMVATVDAKGQPNIGPKRSMRLWDDKTFIYNENTDGQTRINIEDNG Sbjct:   1 MITQEMKDLINNQLAMVATVDAKGQPNIGPKRSMRLWDDKTFIYNENTDGQTRINIEDNG      60

Query:  61 KIEIAFVDRERLLGYRFVGTAEIQTEGTYYEAAKKWAEGRMGVPKAVGIIHVERIFNLQS     120
           KIEIAFVDRERLLGYRFVGTAEIQTEG YYEAAKKWA+GRMGVPKAVGIIHVERIFNLQS Sbjct:  61 KIEIAFVDRERLLGYRFVGTAEIQTEGAYYEAAKKWAQGRMGVPKAVGIIHVERIFNLQS     120

Query: 121 GANAGKEI                                                         128
           GANAGKEI Sbjct: 121 GANAGKEI                                                         128
```

Based on this analysis, it was predicted that these proteins and their epitopes could be useful antigens for vaccines or diagnostics.

Example 253

A DNA sequence (GBSx0268) was identified in *S. agalactiae* <SEQ ID 799> which encodes the amino acid sequence <SEQ ID 800>. Analysis of this protein sequence reveals the following:

Possible site: 22
>>> Seems to have a cleavable N-term signal seq.
INTEGRAL    Likelihood = –5.47    Transmembrane 1028 -1044
                                        (1027 -1048)
----- Final Results -----
   bacterial membrane --- Certainty = 0.3187 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the GENPEPT database:

```
!GB:AF054892  surface antigen BspA [Bacteroides forsy...
!GB:AF054892  surface antigen BspA [Bacteroides forsy...
!GB:AF054892  surface antigen BspA [Bacteroides forsy...
!GB:AF054892  surface antigen BspA [Bacteroides forsy...
!GB:AF054892  surface antigen BspA [Bacteroides forsy...
>GP:AAC82625  GB:AF054892 surface antigen BspA [Bacteroides forsythus]
Identities = 143/566 (25%), Positives = 243/566 (42%), Gaps = 52/566 (9%)

Query:   95  VPKAKPEVTQEASNSSNDASKVEVPKQDTASKKETLETSTWEAKDFVTRGDTLVG----F   150
             +P +    + A     + ++P  TA + L  T         +    T +G   F
Sbjct:  120  IPNSVTTIGEWAFKGCSGLKSITLPNSLTAIGQSALSGCTGLTSITIPNSVTTIGEWAFF   179

Query:  151  SKSGINKLSQTSHLVLPSHAA--DGTQLTQVASFAFTPDKKTAIAEYTSRLGENGKPSRL   208
               SG+  ++  + L    +A       LT +      PD  TIE   + G +G S
Sbjct:  180  GCSGLTSITFPNSLTAIGESAFYGCGALTSIT----LPDALTTIGESAFK-GCSGLKSIT   234

Query:  209  DIDQKEIIDEGEIFNAYQLTKLTIPNGYKSIGQDAFVDNKNIAEVNLPESLETISDYAFA   268
              +      I E  ++   LT +T+P+    +IG+ AF     +   P SL TI + AF
Sbjct:  235  FPNSLTTIGESAFYDCGALTSITLPDALTTIGRSAFYGCSGLKSITLPNSLTTIGESAFY   294

Query:  269  HM-SLKQVKLPDNLKVIGELAFFDNQIGGKLYLPRHLIKLAERAFKSNRIQTVEFLGSKL   327
              + SL + +P+++  IG  AF+       + LP  L   ERAF +  T    + +++
Sbjct:  295  NCGSLTSITIPNSVTTIGRSAFYGCSGLKSITLPDGLTTIEERAFYNCGVLTSITIPNSV   354

Query:  328  KVIGEASFQD-NNLRNVMLPDGLEKIESEAFTGNPGDEHYNNQVVLRTRTGQNPHQLATE   386
              IGE++F  + L+++ LPDGL  IE  AF          N     L +T N       E
Sbjct:  355  ATIGESAFYGCSGLKSITLPDGLTTIEWGAFY---------NCGALTSITIPNSVSTIGE   405

Query:  387  NTYVNPDKSLWRATPDMDYTKWLEEDFTYQKNSVTGFS---NKGLQKVRRNKNLEIPKQH   443
              + +     +L   T     D    ++  D  +++  +++G      G + V    K   ++ K+
Sbjct:  406  SAFYGCG-ALKDVTVAWDTPIDIQRD-VFRELTLSGIRLHVPAGKKTVYEAK--DVWKEF   461

Query:  444  NGITITEIGDNAFRNVDFQSKTLRKYDLEEIKLPSTIRKIGAFAFQSNNLKSFEASEDLE   503
              N +   + G   +ND  +KTL +         P T+ +  FA   ++ L
Sbjct:  462  NIVEDDDFGGLQW-NYDAATKTLTITN----PTPDTPKPMPNFATPNDQLW---------   507

Query:  504  EIKEGAFMNNRIGTLDLKDKLIKIGDAAFH-INHIYAIVLPESVQEIGRSAFRQNGALHL   562
                   GAF    I + + D +  +GD AF  +  + +I LP+SV  IG+SAF       L
Sbjct:  508  ----GAFQKE-IQKITIGDGVTSVGDFAFSGCDALKSITLPKSVTTIGQSAFSGCWDLRS   562

Query:  563  MFIGNKVKTIGEMAFLSNKLESVNLSEQKQLKTIEVQAFS-DNALSEVVLPPNLQTIREE   621
             + + +  V TIGE AF  + LE +++  K + I + F   +L+ + LP  L  I ++
Sbjct:  563  LTLPDGVNTIGEKAFY-DCLELTSITIPKSVTAIGQETFHYCVSLTSLTLPDALTAIGKK   621

Query:  622  AF-KRNHLKEVKGSSTLSQITFNAFD                                    646
             AF   N L  V    +++ I  NAFD
Sbjct:  622  AFYSCNALTSVTFPKSITTIGENAFD                                    647

Identities = 109/407 (26%), Positives = 175/407 (42%), Gaps = 48/407 (11%)

Query:  222  FNAYQLTKLTIPNGYKSIGQDAFVDNKNIAEVNLPESLETISDYAFAHMS-LKQVKLPDN   280
             F+    LT +T+PN   +IG  AF    +  + +P S+ TI ++AF    S LK  LP++
Sbjct:   87  FSDCALTSVTLPNSLTAIGDHAFKGCSGLTSITIPNSVTTIGEWAFKGCSGLKSITLPNS   146

Query:  281  LKVIGELAFFDNQIGGKLYLPRHLIKLAERAFKSNRIQTVEFLGSKLKVIGEASFQD-NN   339
             L  IG+ A      + +P  + + E AF        T     + L IGE++F  + N
Sbjct:  147  LTAIGQSALSGCTGLTSITIPNSVTTIGEWAFFGCSGLTSITFPNSLTAIGESAFYGCGA   206

Query:  340  LRNVMLPDGLEKIESEAFTGNPGDEHYNNQVVLRTRTGQNPHQLATENTYVNPDKSLWRA   399
             L ++ LPD L  I   AF G G         L++ T  N     E+ + +
Sbjct:  207  LTSITLPDALTTIGESAFKGCSG---------LKSITFPNSLTTIGESAFYDCGALTSIT   257

Query:  400  TPDMDYTKWLEEDFTYQKNSVTGFSNKGLQKVRRNKNLEIPKQHNGITITEIGDNAFRNV   459
              PD                  ++T         K++  P      ++T IG++AF N
Sbjct:  258  LPD----------------ALTTIGRSAFYGCSGLKSITFPN-----SLTTIGESAFYNC   296

Query:  460  DFQSKTLRKYDLEEIKLPSTIRKIGAFAFQS-NNLKSFEASEDLEEIKEGAFMNNRIGT-   517
                        L  I +P+++  IG  AF +  LKS    + L  I+E AF N  + T
Sbjct:  297  G---------SLTSITIPNSVTTIGRSAFYGCSGLKSITLPDGLTTIEERAFYNCGVLTS   347

Query:  518  LDLKDKLIKIGDAAFH-INHIYAIVLPESVQEIGRSAFRQNGALHLMFIGNKVKTIGEMA   576
               + + +  IG++AF+ +   + +I LP+ +  I  +AF    GAL + + N V TIGE A
Sbjct:  348  ITIPNSVATIGESAFYGCSGLKSITLPDGLTTIEWGAFYNCGALTSITIPNSVSTIGESA   407

Query:  577  FLS-NKLESVNLSEQKQLKTIEVQAFSDNALSEVVL--PPNLQTIRE               620
             F    L+ V ++     + I+    F + LS + L  P +T+ E
Sbjct:  408  FYGCGALKDVTVAWDTPI-DIQRDVFRELTLSGIRLHVPAGKKTVYE                453

Identities = 111/465 (23%), Positives = 185/465 (38%), Gaps = 56/465 (12%)
```

-continued

```
Query:   141 VTRGDTLVGFSKSGINKLSQTSHLVLPSHAADGTQLTQVASFAF----------TPDKKT    190
             +T  D L  +S    S    + P+      LT +  AF          PD  T
Sbjct:   210 ITLPDALTTIGESAFKGCSGLKSITFPN------SLTTIGESAFYDCGALTSITLPDALT    263

Query:   191 AIAEYTSRLGENGKPSRLDIDQKEIIDEGEIFNAYQLTKLTIPNGYKSIGQDAFVDNKNI    250
              I    ++  G +G   S    +   I E  +N   LT +TIPN  +IG+ AF    +
Sbjct:   264 TIGR-SAFYGCSGLKSITFPNSLTTIGESAFYNCGSLTSITIPNSVTTIGRSAFYGCSGL    322

Query:   251 AEVNLPESLETISDYAFAHMS-LKQVKLPDNLKVIGELAFFDNQIGGKLYLPRHLIKLAE    309
              + LP+  L TI + AF +  L  + +P+++ IGE AF+      + LP L  +
Sbjct:   323 KSITLPDGLTTIEERAFYNCGVLTSITIPNSVATIGESAFYGCSGLKSITLPDGLTTIEW    382

Query:   310 RAFKSNRIQTVEFLGSKLKVIGEASFQD-NNLRNVMLP-DGLEKIESEAF-----TGNPG    362
              AF +    T  + + IGE++F    L++V + D   I+  +F      +G
Sbjct:   383 GAFYNCGALTSITIPNSVSTIGESAFYGCGALKDVTVAWDTPIDIQRDVFRELTLSGIRL    442

Query:   363 DEHYNNQVVLRTRTGQNPHQLATEN-------TYVNPDKSLWRATPDMDYTKWLEEDFTY    415
              + V  +      +  + ++       Y   K+L   P D  K+  +F
Sbjct:   443 HVPAGKKTVYEAKDVWKEFNIVEDDDFGGLQWNYDAATKTLTITNPTPDTPKPM-PNFAT    501

Query:   416 QKNSVTGFSNKGLQKVRRNKNLEIPKQHNGITITEIGDNAFRNVDFQSKTLRKYDLEEIK    475
              +  +  G  K  +QK+              G  +T +GD AF  D         L+  I
Sbjct:   502 PNDQLWGAFQKEIQKIT-----------IGDGVTSVGDFAFSGCD---------ALKSIT    541

Query:   476 LPSTIRKIGAFAFQSN-NLKSFEASEDLEEIKEGAFMN-NRIGTLDLKDKLIKIGDAAFH    533
             LP ++  IG AF   +L+S    + +   I E AF +   + ++   +   IG   FH
Sbjct:   542 LPKSVTTIGQSAFSGCWDLRSLTLPDGVNTIGEKAFYDCLELTSITIPKSVTAIGQETFH    601

Query:   534 -INHIYAIVLPESVQEIGRSAFRQNGALHLMFIGNKVKTIGEMAF    577
              + +++ LP+++ IG+ AF    AL  +      + TIGE AF
Sbjct:   602 YCVSLTSLTLPDALTAIGKKAFYSCNALTSVTFPKSITTIGENAF    646

Identities = 98/351 (27%), Positives = 152/351 (42%), Gaps = 53/351 (15%)

Query:   315 NRIQTVEFLGSKLKVIGEASFQDNNLRNVMLPDGLEKIESEAFTGNPGDEHYNNQVVLRT    374
              ++IQTV  +G + +G +F D  L +V LP+ L I   AF  G  G          L +
Sbjct:    68 SKIQTVT-IGDGVTSVGNNAFSDCALTSVTLPNSLTAIGDHAFKGCSG---------LTS    117

Query:   375 RTGQNPHQLATENTYVNPDKSLWRATPDMDYTKWLEEDFTYQKNSVTGFSNKGLQKVRRN    434
                T   P+ +  T  +    S   ++               NS+T        L
Sbjct:   118 IT--IPNSVTTIGEWAFKGCSGLKSIT--------------LPNSLTAIGQSALSGCTGL    161

Query:   435 KNLEIPKQHNGITITEIGDNAF------RNVDFQSKTLRKYD--------LEEIKLPSTI    480
              ++ IP    +++T IG+ AF        ++  F  +           L   I LP +
Sbjct:   162 TSITIPN-----SVTTIGEWAFFGCSGLTSITFPNSLTAIGESAFYGCGALTSITLPDAL    216

Query:   481 RKIGAFAFQS-NNLKSFEASEDLEEIKEGAFMN-NRIGTLDLKDKLIKIGDAAFH-INHI    537
                IG AF+  + LKS       L  I E AF +   + ++ L D L  IG +AF+ + +
Sbjct:   217 TTIGESAFKGCSGLKSITFPNSLTTIGESAFYDCGALTSITLPDALTTIGRSAFYGCSGL    276

Query:   538 YAIVLPESVQEIGRSAFRQNGALHLMFIGNKVKTIGEMAFLS-NKLESVNLSEQKQLKTI    596
              +I  P S+  IG SAF   G+L  + I N V TIG  AF    +L+S  L +     L TI
Sbjct:   277 KSITFPNSLTTIGESAFYNCGSLTSITIPNSVTTIGRSAFYGCSGLKSITLPD--GLTTI    334

Query:   597 EVQAFSD-NALSEVVLPPNLQTIREEAFKR-NHLKEVKGSSTLSQITFNAF    645
             E +AF +  L+ + +P ++ TI E AF +  +LK +     L+ I + AF
Sbjct:   335 EERAFYNCGVLTSITIPNSVATIGESAFYGCSGLKSITLPDGLTTIEWGAF    385

Identities = 78/282 (27%), Positives = 123/282 (42%), Gaps = 46/282 (16%)

Query:   111 NDASKVEVPKQDTASKKETLETSTWEARDFVTRGDTLVGFSKSGINKLSQTSHLVLPS--    168
             N+AS  E+P     SK +T            VT GD  +    +    + TS +LP+
Sbjct:    56 NNAS--EIPWHSLQSKIQT-----------VTIGDGVTSVGNNAFSDCALTS-VTLPNSL    101

Query:   169 -----HAADG----------TQLTQVASFAFT----------PDKKTAIAEYTSRLGENG    203
                  HA  G          T +  +AF            P+ TAI +  ++  G  G
Sbjct:   102 TAIGDHAFKGCSGLTSITIPNSVTTIGEWAFKGCSGLKSITLPNSLTAIGQ-SALSGCTG    160

Query:   204 KPSRLDIDQKEIIDEGEIFNAYQLTKLTIPNGYKSIGQDAFVDNKNIAEVNLPESLETIS    263
              S    +   I E  F    LT +T PN  +IG+ AF    +   LP++L TI
Sbjct:   161 LTSITIPNSVTTIGEWAFFGCSGLTSITFPNSLTAIGESAFYGCGALTSITLPDALTTIG    220

Query:   264 DYAFAHMS-LKQVKLPDNLKVIGELAFFDNQIGGKLYLPRHLIKLAERAFKS-NRIQTVE    321
              + AF    S LK + +P++L IGE AF+D      + LP L  + AF  + ++++
Sbjct:   221 ESAFKGCSGLKSITFPNSLTTIGESAFYDCGALTSITLPDALTTIGRSAFYGCSGLKSIT    280

Query:   322 FLGSKLKVIGEASFQD-NNLRNVMLPDGLEKIESEAFTGNPG    362
             F  S L  IGE++F +  +L  + +P+ +  I   AF G  G
Sbjct:   281 FPNS-LTTIGESAFYNCGSLTSITIPNSVTTIGRSAFYGCSG    321
```

```
Identities = 43/144 (29%), Positives = 70/144 (47%), Gaps = 4/144 (2%)

Query:  220 EIFNAYQ--LTKLTIPNGYKSIGQDAFVDNKNIAEVNLPESLETISDYAFAHM-SLKQVK    276
            +++ A+Q  + K+TI +G  S+G AF      + LP+S+ TI    AF+   L+ +
Sbjct:  505 QLWGAFQKEIQKITIGDGVTSVGDFAFSGCDALKSITLPKSVTTIGQSAFSGCWDLRSLT    564

Query:  277 LPDNLKVIGELAFFDNQIGGKLYLPRHLIKLAERAFKSNRIQTVEFLGSKLKVIGEASFQ    336
            LPD +  IGE AF+D    + +P+ +  + +  F      T    L    IG+ +F
Sbjct:  565 LPDGVNTIGEKAFYDCLELTSITIPKSVTAIGQETFHYCVSLTSLTLPDALTAIGKKAFY    624

Query:  337 D-NNLRNVMLPDGLEKIESEAFTG                                       359
              N L +V P  + I   AF G
Sbjct:  625 SCNALTSVTFPKSITTIGENAFDG                                       648

Identities = 43/134 (32%), Positives = 66/134 (49%), Gaps = 12/134 (8%)

Query:  511 MNNRIGTLDLKDKLIKIGDAAFHINHIYAIVLPESVQEIGRSAFRQNGALHLMFIGNKVK    570
            + ++I T+ D +  +G+ AF      L ++ LP S+  IG  AF+     L  + N V
Sbjct:   66 LQSKIQTVTIGDGVTSVGNNAFSDCALTSVTLPNSLTAIGDHAFKGCSGLTSITIPNSVT    125

Query:  571 TIGEMAFLS-NKLESVNLSEQKQLKTIEVQAFSD-NALSEVVLPPNLQTIREEAFKRNHL    628
            TIGE AF    + L+S+ L      L  I   AS        L+ + +P ++ TI E AF
Sbjct:  126 TIGEWAFKGCSGLKSITL--PNSLTAIGQSALSGCTGLTSITIPNSVTTIGEWAF-----    178

Query:  629 KEVKGSSTLSQITF                                                 642
                  G  S L+ ITF
Sbjct:  179 ---FGCSGLTSITF                                                 189
```

A related DNA sequence was identified in *S. pyogenes* <SEQ ID 801> which encodes the amino acid sequence <SEQ ID 802>. Analysis of this protein sequence reveals the following:

Possible site: 21
>>> Seems to have a cleavable N-term signal seq.
INTEGRAL   Likelihood = −2.44   Transmembrane 984-1000 (984-1001)

----- Final Results -----
bacterial membrane --- Certainty = 0.1977 (Affirmative) <succ>
bacterial outside --- Certainty = 0.0000 (Not Clear) <succ>
bacterial cytoplasm --- Certainty = 0.0000 (Not Clear) <succ>

LPXTG motif: 975-979

An alignment of the GAS and GBS proteins is shown below:

```
Identities = 751/1050 (71%), Positives = 861/1050 (81%), Gaps = 45/1050 (4%)

Query:    3 KKHLKTLALALTTVSVVTYSQEVYGLEREESVKQEQTQSA-SEDDWFEEDNERKTNVSKE     61
            KKHLKT+AL LTTVSVVT++QEV+ L +E  +KQ Q  S+ S  D E     + K +++
Sbjct:    2 KKHLKTVALTLTTVSVVTHNQEVFSLVKEPILKQTQASSSISGADYAESSGKSKLKINET    61

Query:   62 NSTVDETVSDLFSDGNSNNSSSKTESVVSDPKQVPKAKPEVTQEASNSSNDASKVEVPKQ    121
            + VD+TV+DLFSD +    K         +Q  KA  E TE+         S++E K+
Sbjct:   62 SGPVDDTVTDLFSDKRTTPEKIKDNLAKGPREQELKAVTENT-ESEKQITSGSQLEQSKE    120

Query:  122 DTASKKETLETSTWEAKDFVTRGDTLVGFSKSGINKLSQTSHLVLPSHAADGTQLTQVAS    181
             +  K    TS WE   DF+T+G+TLVG SKSG+ KLSQT HLVLPS AADGTQL QVAS
Sbjct:  121 SLSLNKTVPSTSNWEICDFITKGNTLVGLSKSGVEKLSQTDHLVLPSQAADGTQLIQVAS    180

Query:  182 FAFTPDKKTAIAEYTSRLGENGKPSRLDIDQKEIIDEGEIFNAYQLTKLTIPNGYKSIGQ    241
            FAFTPDKKTAIAEYTSR GENG+ S+LD+D KEII+EGE+FN+Y L K+TIP GYK IGQ
Sbjct:  181 FAFTPDKKTAIAEYTSRAGENGEISQLDVDGKEIINEGEVFNSYLLKKVTIPTGYKHIGQ    240

Query:  242 DAFVDNKNIAEVNLPESLETISDYAFAHMSLKQVKLPDNLKVIGELAFFDNQIGGKLYLP    301
            DAFVDNKNIAEVNLPESLETISDYAFAH++LKQ+ LPDNLK IGELAFFDNQI GKL LP
Sbjct:  241 DAFVDNKNIAEVNLPESLETISDYAFAHLALKQIDLPDNLKAIGELAFFDNQITGKLSLP    300

Query:  302 RHLIKLAERAFKSNRIQTVEFLGSKLKVIGEASFQDNNLRNVMLPDGLEKIESEAFTGNP    361
            R L++LAERAFKSN I+T+EF G+ LKVIGEASFQDN+L  +MLPDGLEKIESEAFTGNP
Sbjct:  301 RQLMRLAERAFKSNHIKTIEFRGNSLKVIGEASFQDNDLSQLMLPDGLEKIESEAFTGNP    360

Query:  362 GDEHYNNQVVLRTRTGQNPHQLATENTYVNPDKSLWRATPDMDYTKWLEEDFTYQKNSVT    421
            GD+HYNN+VVL T++G+NP  LATENTYVNPDKSLW+  P+++YTKWLEEDFTYQKNSVT
Sbjct:  361 GDDHYNNRVVLWTKSGKNPSGLATENTYVNPDKSLWQESPEIDYTKWLEEDFTYQKNSVT    420

Query:  422 GFSNKGLQKVRRNKNLEIPKQHNGITITEIGDNAFRNVDFQSKTLRKYDLEEIKLPSTIR    481
            GFSNKGLQKV+RNKNLEIPKQHNG+TITEIGDNAFRNVDFQ KTLRKYDLEE+KLPSTIR
Sbjct:  421 GFSNKGLQKVKRNKNLEIPKQHNGVTITEIGDNAFRNVDFQNKTLRKYDLEEVKLPSTIR    480

Query:  482 KIGAFAFQSNNLKSFEASEDLEEIKEGAFMNNRIGTLDLKDKLIKIGDAAFHINHIYAIV    541
            KIGAFAFQSNNLKSFEAS+DLEEIKEGAFMNNRI TL+LKDKL+ IGDAAFHINHIYAIV
Sbjct:  481 KIGAFAFQSNNLKSFEASDDLEEIKEGAFMNNRIETLELKDKLVTIGDAAFHINHIYAIV    540
```

```
-continued

Query:    542  LPESVQEIGRSAFRQNGALHLMFIGNKVKTIGEMAFLSNKLESVNLSEQKQLKTIEVQAF   601
               LPESVQEIGRSAFRQNGA +L+F+G+KVKT+GEMAFLSN+LE ++LSEQKQL  I VQAF
Sbjct:    541  LPESVQEIGRSAFRQNGANNLIFMGSKVKTLGEMAFLSNRLEHLDLSEQKQLTEIPVQAF   600

Query:    602  SDNALSEVVLPPNLQTIREEAFKRNHLKEVKGSSTLSQITFNAFDQNDGDKRFGKKVVVR   661
               SDNAL  EV+LP +L+TIREEAFK+NHLK+++ +S LS I FNA D NDGD++F  KVVV+
Sbjct:    601  SDNALKEVLLPASLKTIREEAFKKNHLKQLEVASALSHIAFNALDDNDGDEQFDNKVVVK   660

Query:    662  THNNSHMLADGERFIIDPDKLSSTMVDLEKVLKIIEGLDYSTLRQTTQTQFREMTTAGKA   721
               TH+NS+ LADGE FI+DPDKLSST+VDLEK+LK+IEGLDYSTLRQTTQTQFR+MTTAGKA
Sbjct:    661  THHNSYALADGEHFIVDPDKLSSTIVDLEKILKLIEGLDYSTLRQTTQTQFRDMTTAGKA   720

Query:    722  LLSKSNLRQGEKQKFLQEAQFFLGRVDLDKAIAKAEKALVTKKATKNGHLLERSINKAVL   781
               LLSKSNLRQGEKQKFLQEAQFFLGRVDLDKAIAKAEKALVTKKATKNG LLERSINKAVL
Sbjct:    721  LLSKSNLRQGEKQKFLQEAQFFLGRVDLDKAIAKAEKALVTKKATKNGQLLERSINKAVL   780

Query:    782  AYNNSAIKKANVKRLEKELDLLTDLVEGKGPLAQATMVQGVYLLKTPLPLPEYYIGLNVY   841
               AYNNSAIKKANVKRLEKELDLLT LVEGKGPLAQATMVQGVYLLKTPLPLPEYYIGLNVY
Sbjct:    781  AYNNSAIKKANVKRLEKELDLLTGLVEGKGPLAQATMVQGVYLLKTPLPLPEYYIGLNVY   840

Query:    842  FDKSGKLIYALDMSDTIGEGQKDAYGNPILNVDEDNEGYHTLAVATLADYEGLYIKDILN   901
               FDKSGKLIYALDMSDTIGEGQKDAYGNPILNVDEDNEGYH LAVATLADYEGL IK ILN
Sbjct:    841  FDKSGKLIYALDMSDTIGEGQKDAYGNPILNVDEDNEGYHALAVATLADYEGLDIKTILN   900

Query:    902  SSLDKIKAIRQIPLAKYHRLGIFQAIRNAAAEADRLLPKTPKGYLNEVPNYRKKQVEKNL   961
               S L ++ +IRQ+P A YHR GIFQAI+NAAAEA++LLPK
Sbjct:    901  SKLSQLTSIRQVPTAAYHRAGIFQAIQNAAAEAEQLLPK---------------------   939

Query:    962  KPVDYKTPIFNKALPNEKVDGDRAAKGHNINAETNNSVAVTPIRSEQQLHKSQSDVNLPQ   1021
                                ++++   + N++           ++S   + ++       LP+
Sbjct:    940  ----------------PGTHSEKSSSSESANSKDRG------LQSNPKTNRGRHSAILPR   977

Query:    1022 TSSKNNFIYEILGYVSLCLLFLVTAGKKGK                               1051
                T SK +F+Y ILGY S+ LL L+TA KK K
Sbjct:    978  TGSKGSFVYGILGYTSVALLSLITAIKKKK                               1007
```

SEQ ID 800 (GBS97) was expressed in *E. coli* as a His-fusion product. SDS-PAGE analysis of total cell extract is shown in FIG. 17 (lane 12; MW 113.4 kDa).

Figure 193:
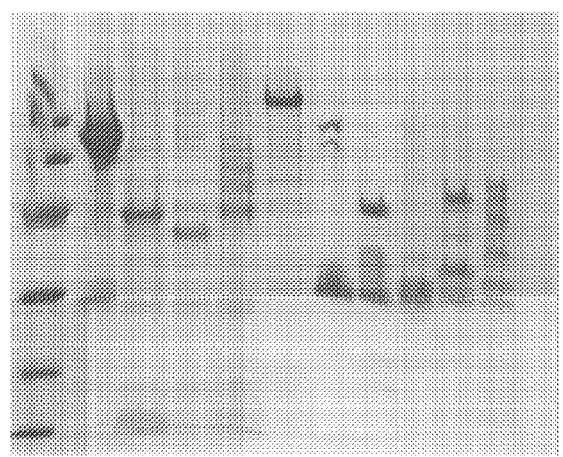

GBS97-His was purified as shown in FIG. 193, lane 6.

Based on this analysis, it was predicted that these proteins and their epitopes could be useful antigens for vaccines or diagnostics.

Example 254

A DNA sequence (GBSx0269) was identified in *S. agalactiae* <SEQ ID 803> which encodes the amino acid sequence <SEQ ID 804>. This protein is predicted to be ribonucleoside-diphosphate reductase alpha chain (nrdE). Analysis of this protein sequence reveals the following:

Possible site: 48
>>> Seems to have no N-terminal signal sequence
----- Final Results -----
  bacterial cytoplasm --- Certainty = 0.4274 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database:

```
>GP:AAB96160 GB:AE000050 ribonucleoside-diphosphate reductase alpha
chain-MPN324(new), 513(Himmelreich et al., 1996)
[Mycoplasma pneumoniae]
Identities = 476/725 (65%), Positives = 586/725 (80%), Gaps = 20/725 (2%)

Query:    2    TQSD--AYLSLNAKTRFRDRTGNYHFTSDKEAVEQYMIEHVEPNTMVFTSLIEKLDYLVS   59
               TQ D  +Y+SLNA T+       F D  AVE Y+ EHV+P T VF S  E+LD+LV
Sbjct:    12   TQEDLESYISLNAYTKVYG-----DFKMDLHAVEAYIQEHVKPKTKVFHSTKERLDFLVK   66

Query:    60   NNYYESDLLKQYNLEFICQIFEHAYAKKFAFLNFMGALKFYNAYALKTEDNRYYLEHYED   119
               N+YY+  +++   Y+ E    +I   AYA +F + NFMGA KFYNAYALKT D ++YLE+YED
Sbjct:    67   NDYYDENIINMYSFEQFEEITRKAYAYRFRYANFMGAFKFYNAYALKTFDGKWYLENYED   126

Query:    120  RVVMNALFLAAGDEKAAYDLVDDMLANRFQPATPTFLNAGKKRRGEYISCYLLRIEDNME   179
               RVVMN LFLA G+      L+  ++ NRFQPATPTFLNAG+K+RGE++SCYLLRIEDNME
Sbjct:    127  RVVMNVLFLANGNYNKALKLLKQIITNRFQPATPTFLNAGRKKRGEFVSCYLLRIEDNME   186

Query:    180  SISRAISTSLQLSKRGGGVALCLTNLREFGAPIKGIKNQATGIVPVMKLLEDSFSYANQL   239
               SI RAI+T+LQLSKR GGVAL LTN+RE GAPIK I+NQ++GI+P+MKLLEDSFSYANQL
Sbjct:    187  SIGRAITTTLQLSKRDGGVALLLTNIRESGAPIKKIENQSSGIIPIMKLLEDSFSYANQL   246

Query:    240  GQRQGAGAVYLHAHHPEVLTFLDTKRENADEKIRIKSLSLGLVIPDITFELAKANKDMAL   299
               GQRQGAGAVYLHAHHP+V+  FLDTKRENADEKIRIKSLSLGLVIPDITF LAK N++MAL
Sbjct:    247  GQRQGAGAVYLHAHHPDVMQFLDTKRENADEKIRIKSLSLGLVIPDITFTLAKNNEEMAL   306
```

-continued

```
Query:  300  FSPYDIERVYGKPMSDISITEEYETLLANADIRKTFISARKLFQTIAELHFESGYPYILF  359
             FSPYD+   YGKP+SDIS+TE Y  LLAN  I+KTFI+ARK FQT+AELHFESGYPYILF
Sbjct:  307  FSPYDVYEEYGKPLSDISVTEMYYELLANQRIKKTFINARKFFQTVAELHFESGYPYILF  366

Query:  360  EDTVNAKNPHKKEGRIVMSNLCSEIAQVNTASQFSEDLTFTKVGHDVCCNLGSINIARAM  419
             +DTVN +N H     RIVMSNLCSEI Q +T S+F  DL F KVG+D+ CNLGS+NIA+AM
Sbjct:  367  DDTVNRRNAH--PNRIVMSNLCSEIVQPSTPSEFHHDLAFKKVGNDISCNLGSLNIAKAM  424

Query:  420  DQAADFEKLIANSIRALDRVSRTSDLDSAPSIKKGNAANHAVGLGAMNLHGFLATNHIYY  479
             +   +F +L+   +I +LD VSR S+L++APSI+KGN+ NHA+GLGAMNLHGFLATN IYY
Sbjct:  425  ESGPEFSELVKLAIESLDLVSRVSNLETAPSIQKGNSENHALGLGAMNLHGFLATNQIYY  484

Query:  480  DSQEAIDFTDCFFYAMAYYAFKASNHLAKEKGTFEGFSESSYADGSYFYQY--TEQNF-E  536
             +S EAIDFT+ FFY +AY+AFKAS+ LA EKG F+ F +    +ADGSYF +    E +F
Sbjct:  485  NSPEAIDFTNIFFYTVAYHAFKASSELALEKGKFKNFENTKFADGSYFDKYIKVEPDFWT  544

Query:  537  PKTQRVKNLLAEYGLTLPSQEDWRKLVQSIKEIGLANAHLLAVAPTGSISYLSSCTPSLQ  596
             PKT+RVK L  +Y + +P++E+W++L   +I++ GLAN+HLLA+APTGSISYLSSCTPSLQ
Sbjct:  545  PKTERVKALFQKYQVEIPTRENWKELALNIQKNGLANSHLLAIAPTGSISYLSSCTPSLQ  604

Query:  597  PVVSPVEVRKEGALGRVYVPAYKIDADNYVYYKKGAYEVGSEAIINIAAAAQKHIDQAIS  656
             PVVSPVEVRKEG  LGR+YVPAY+++  D+Y +YK GAYE+G  E IINIAAAAQ+H+DQAIS
Sbjct:  605  PVVSPVEVRKEGRLGRIYVPAYQLNKDSYPFYKDGAYELGPEPIINIAAAAQQHVDQAIS  664

Query:  657  LTLFMTDQATTRDLNKAYIQAFKQKCASIYYVRVRQDILEGSESYDDMLDDFTSSDLEDC  716
             LTLFMTD+ATTRDLNKAYI  AFK+ C+SIYYVRVRQ++LE SE +         +  ++ C
Sbjct:  665  LTLFMTDKATTRDLNKAYIYAFKKGCSSIYYVRVRQEVLEDSEDH--------TIQMQQC  716

Query:  717  QSCMI  721
             ++C+I
Sbjct:  717  EACVI  721
```

A related DNA sequence was identified in *S. pyogenes* <SEQ ID 805> which encodes the amino acid sequence <SEQ ID 806>. Analysis of this protein sequence reveals the following:

Possible site: 47
>>> Seems to have no N-terminal signal sequence

----- Final Results -----
bacterial cytoplasm --- Certainty = 0.1843 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the databases:

```
>GP:AAC82625 GB:AF054892 surface antigen BspA [Bacteroides forsythus]
Identities = 124/451 (27%), Positives = 202/451 (44%), Gaps = 65/451 (14%)

Query:  221  FNSYLLKKVTIPTGYKHIGQDAFVDNKNIAEVNLPESLETISDYAFAHLA-LKQIDLPDN  279
             F+   L  VT+P   IG  AF  + + +P S+ TI ++AF   + LK I LP++
Sbjct:   87  FSDCALTSVTLPNSLTAIGDHAFKGCSGLTSITIPNSVTTIGEWAFKGCSGLKSITLPNS  146

Query:  280  LKAIGELAFFDNQITGKLSLPRQLMRLAERA-FKSNHIKTIEFRGNSLKVIGEASFQD-N  337
             L AIG+ A       +++P +   E AF + + +I F NSL  IGE++F
Sbjct:  147  LTAIGQSALSGCTGLTSITIPNSVTTIGEWAFFGCSGLTSITF-PNSLTAIGESAFYGCG  205

Query:  338  DLSQLMLPDGLEKIESEAFTGNPGDDHYNNRVVLWTKSGKNPSGLATENTYVNPDKSLWQ  397
             L++ + LPD L  I  AF  G   G              KS  P+ L T         +S +
Sbjct:  206  ALTSITLPDALTTIGESAFKGCSG-----------LKSITFPNSLTTIG------ESAFY  248

Query:  398  ESPEIDYTKWLEEDFTYQKNSVTGFSNKGLQKVKRNKNLEIPKQHNGVTITEIGDNAFRN  457
              +        +    T +++ G S GL       K++  P      ++T IG++AF N
Sbjct:  249  DCGALTSITLPDALTTIGRSAFYGCS--GL------KSITFPN-----SLTTIGESAFYN  295

Query:  458  VDFQNKTLRKYDLEEVKLPSTIRKIGAFAFQS-NNLKSFEASDDLEEIKEGAFMNNRIET  516
                         L + +P+++  IG AF   + LKS    D L  I+E AF N   + T
Sbjct:  296  CG---------SLTSITIPNSVTTIGRSAFYGCSGLKSITLPDGLTTIEERAFYNCGVLT  346

Query:  517  -LELKDKLVTIGDAAFH-INHIYAIVLPESVQEIGRSAFRQNGANNLIFMGSKVKTLGEM  574
              + + +  TIG++AF+   + +I LP++   I   AF      GA   I + +V T+GE
Sbjct:  347  SITIPNSVATIGESAFYGCSGLKSITLPDGLTTIEWGAFYNCGALTSITIPNSVSTIGES  406

Query:  575  AFLS-NRLEHLDLSEQKQLTEIPVQAFSDNALKEVLL--PASLKTIREEAFKKNHLKQLE  631
             AF   L+ + ++    + +I   F + L  +L  PA KT+ E     K+  K+
Sbjct:  407  AFYGCGALKDVTVAWDTPI-DIQRDVFRELTLSGIRLHVPAGKKTVYE---AKDVWKE--  460

Query:  632  VASALSHIAFNALDDND-GDEQFDNKVVVKT  661
                    FN ++D+D  G  Q++    KT
Sbjct:  461  ---------FNIVEDDDFGGLQWNYDAATKT  482
```

An alignment of the GAS and GBS proteins is shown below:

```
Identities = 534/726 (73%), Positives = 614/726 (84%), Gaps = 5/726 (0%)

Query:     1  MTQSDA-YLSLNAKTRFRDRTGNYHFTSDKEAVEQYMIEHVEPNTMVFTSLIEKLDYLVS    59
              M+Q++A YLSLNA TRF+   G+YHF SDKEAV +Y+ EHV PN M F SL +KL YL++
Sbjct:     1  MSQTNASYLSLNALTRFKKPDGSYHFDSDKEAVRRYLEEHVSPNQMAFNSLEDKLAYLIN   60

Query:    60  NNYYESDLLKQYNLEFICQIFEHAYAKKFAFLNFMGALKFYNAYALKTEDNRYYLEHYED  119
                 YYE  +   Y  + I + F +AY + + FLN MGA+KFY +YALKT D + YLE +ED
Sbjct:    61  EGYYEQAIFDAYPNDLIKEAFHYAYQQGYRFLNLMGAMKEYQSYALKTLDGKQYLETFED  120

Query:   120  RVVMNALFLAAGDEKAAYDLVDDMLANRFQPATPTFLNAGKKRRGEYISCYLLRIEDNME  179
              R VMNALFLA GD+   +D++D +L  RFQPATPTFLNAGKKRRGEYISCYLLR+EDNME
Sbjct:   121  RAVMNALFLADGDQTFVFDVIDAILHRRFQPATPTFLNAGKKRRGEYISCYLLRVEDNME  180

Query:   180  SISRAISTSLQLSKRGGGVALCLTNLREFGAPIKGIKNQATGIVPVMKLLEDSFSYANQL  239
              SISRAISTSLQLSKRGGGVALCLTNLRE GAPIKGI+NQATGIVPVMKLLEDSFSYANQL
Sbjct:   181  SISRAISTSLQLSKRGGGVALCLTNLREIGAPIKGIENQATGIVPVMKLLEDSFSYANQL  240

Query:   240  GQRQGAGAVYLHAHHPEVLTFLDTKRENADEKIRIKSLSLGLVIPDITFELAKANKDMAL  299
              GQRQGAGAVYLHAHHPEVLTFLDTKRENADEKIRIKSL+LGLVIPDITF+LAK NKDMAL
Sbjct:   241  GQRQGAGAVYLHAHHPEVLIFLDTKRENADEKIRIKSLALGLVIPDITFQLAKENKDMAL  300

Query:   300  FSPYDIERVYGKPMSDISITEEYETLLANADIRKTFISARKLFQTIAELHFESGYPYILF  359
              FSPYDI+R YGK MSDISITEEY+ LLAN  I+KT+ISARK FQ IAELHFESGYPY+LF
Sbjct:   301  FSPYDIKRAYGKDMSDISITEEYDKLLANPAIKKTYISARKFFQLIAELHFESGYPYLLF  360

Query:   360  EDTVNAKNPHKKEGRIVMSNLCSEIAQVNTASQFSEDLTFTKVGHDVCCNLGSINIARAM  419
              +DTVN +NPH K+GRIVMSNLCSEIAQV+T S F EDL+F  +G D+CCNLGSINIA+AM
Sbjct:   361  DDTVNKRNPHAKKGRIVMSNLCSEIAQVSTPSTFKEDLSFETIGEDICCNLGSINIAQAM  420

Query:   420  DQAADFEKLIANSIRALDRVSRTSDLDSAPSIKKGNAANHAVGLGAMNLHGFLATNHIYY  479
                A  FE+LI  SIRALDRVSR SDL+ APS++ GNAANHAVGLGAMNLHGFLATNHIYY
Sbjct:   421  ADAPHFEQLITTSIRALDRVSRVSDLNCAPSVETGNAANHAVGLGAMNLHGFLATNHIYY  480

Query:   480  DSQEAIDFTDCFFYAMAYYAFKASNHLAKEKGTFEGFSESSYADGSYFYQYTEQNFEPKT  539
              D++EA+DFTD FF+AMAYYAFKAS  LAKEKG F GFS S+Y+DG+YF +Y +++ +P+T
Sbjct:   481  DTKEAVDFTDLFFHAMAYYAFKASCQLAKEKGAFAGFSLSTYSDGTYFAKYLQEDAKPQT  540

Query:   540  QRVKNLLAEYGLTLPSQEDWRKLVQSIKEIGLANAHLLAVAPTGSISYLSSCTPSLQPVV  599
              +V  LL +YG TLP+  DW+ LV  IK+ GLANAHLLAVAPTGSISYLSSCTPSLQPVV
Sbjct:   541  AKVATLLQDYGFTLPTVADWQALVADIKQFGLANAHLLAVAPTGSISYLSSCTPSLQPVV  600

Query:   600  SPVEVRKEGALGRVYVPAYKIDADNYVYYKKGAYEVGSEAIINIAAAAQKHIDQAISLTL  659
              +PVEVRKEG+LGR+YVPAY+ID  NY YY++GAYEVG +AII++ AAAQKH+DQAISLTL
Sbjct:   601  APVEVRKEGSLGRIYVPAYQIDQANYAYYERGAYEVGPKAIIDVVAAAQKHVDQAISLIL  660

Query:   660  FMTDQATTRDLNKAYIQAFKQKCASIYYVRVRQDILEGSESYDD----MLDDFTSSDLED  715
              FMTDQATTRDLN++YIQAFKQ CASIYYVRVRQD+L GSE YD+    +         +
Sbjct:   661  FMTDQATTRDLNRSYIQAFKQNCASIYYVRVRQDVLAGSEQYDEDSLVTAPGASDETTTE  720

Query:   716  CQSCMI  721
              CQSCMI
Sbjct:   721  CQSCMI  726
```

Based on this analysis, it was predicted that these proteins and their epitopes could be useful antigens for vaccines or diagnostics.

Example 255

A DNA sequence (GBSx0270) was identified in *S. agalactiae* <SEQ ID 807> which encodes the amino acid sequence <SEQ ID 808>. This protein is predicted to be nrdI protein (nrdI). Analysis of this protein sequence reveals the following:

Possible site: 54

>>> Seems to have no N-terminal signal sequence

----- Final Results ----- bacterial cytoplasm --- Certainty = 0.2952 (Affirmative) <succ> bacterial membrane --- Certainty = 0.0000 (Not Clear) <succ> bacterial outside --- Certainty = 0.0000 (Not Clear) <succ>

The protein has homology with the following sequences in the GENPEPT database:

```
>GP:AAC71451 GB:U39702 nrdI protein (nrdI) [Mycoplasma genitalium]
Identities = 77/127 (60%), Positives = 104/127 (81%), Gaps = 1/127 (0%)

Query:     7  VVYFSSKSNNTHRFVQKLACSNQRIPSD-GSSILVTEDYILIVPTYAGGGDDTKGAVPKQ    65
              +VYFSS SNNTHRF++KL   ++RIP D   SI V+ +Y+LI PTY+GGG+  +GAVPKQ
Sbjct:    22  IVYFSSISNNTHRFIEKLGFQHKRIPVDITQSITVSNEYVLICPTYSGGGNQVEGAVPKQ    81

Query:    66  VVQFLNVRQNREHCQGVISSGNTNFGDTYAIAGPIIARKLNVPLLHQFELLGTQEDVTRV   125
              V+QFLN + NRE C+GVI+SGMTNFGDT+ +AG +I++KLNVPLL+QFELLGT+ DV +
Sbjct:    82  VIQFLNNKHNRELCRGVIASGNTNFGDTFCLAGTVISKKLNVPLLYQFELLGTKNDVEQT   141

Query:   126  KELLCQF                                                       132
              ++++  F
Sbjct:   142  QKIIANF                                                       148
```

A related DNA sequence was identified in *S. pyogenes* <SEQ ID 809> which encodes the amino acid sequence <SEQ ID 810>. Analysis of this protein sequence reveals the following:

Possible site: 54
>>> Seems to have no N-terminal signal sequence
----- Final Results -----
  bacterial cytoplasm --- Certainty = 0.0089 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below:

```
Identities = 84/125 (67%), Positives = 100/125 (79%)

Query:     7  VVYFSSKSNNTHRFVQKLACSNQRIPSDGSSILVTEDYILIVPTYAGGGDDTKGAVPKQV    66
              +VYFSSKSNNTHRFVQKL   QRIP D   + V+  Y+LIVPTYA GG D KGAV KQV
Sbjct:     6  IVYFSSKSNNTHRFVQKLGLPAQRIPVDNRPLEVSTHYLLIVPTYAAGGSDAKGAVSKQV    65

Query:    67  VQFLNVRQNREHCQGVISSGNTNFGDTYAIAGPIIARKLNVPLLHQFELLGTQEDVTRVK   126
              ++FLN    NR+HC+GVISSGNTNFGDT+A+AGPII++KL VPLLHQFELLGT  DV +V+
Sbjct:    66  IRFLNNPNNRKHCKGVISSGNTNFGDTFALAGPIISQKLQVPLLHQFELLGTATDVKKVQ   125

Query:   127  ELLCQ                                                         131
              +  +
Sbjct:   126  AIFAR                                                         130
```

Based on this analysis, it was predicted that these proteins and their epitopes could be useful antigens for vaccines or diagnostics.

Example 256

A DNA sequence (GBSx0271) was identified in *S. agalactiae* <SEQ ID 811> which encodes the amino acid sequence <SEQ ID 812>. This protein is predicted to be ribonucleoside-diphosphate reductase beta chain (nrdF). Analysis of this protein sequence reveals the following:

Possible site: 27
>>> Seems to have no N-terminal signal sequence
----- Final Results -----
  bacterial cytoplasm --- Certainty = 0.3889 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database:

```
>GP:AAB96162 GB:AE000050 ribonucleoside-diphosphate reductase beta
chain [Mycoplasma pneumoniae]
Identities = 261/335 (77%), Positives = 301/335 (88%)

Query:     2  QSYYDRSQSPLDYALSEKAFPMRSVNWNKLNDDKDLEVWNRVTQNFWLPEKIPVSNDLNS    61
              + Y+  S SPL+YA  +   +RSVNWN ++D+KDLEVWNR+TQNFWLPEKIPVSND+ S
Sbjct:     5  KKYFLESVSPLEYAQKKFQGNLRSVNWNLVDDEKDLEVWNRITQNFWLPEKIPVSNDIPS    64

Query:    62  WRTLDADWQQLITRTFTGLTLLDSVQATVGDIAQIKHSQTDHEQVIYANFAFMVAIHARS   121
              W+ L  +WQ LIT+TFTGLTLLD++QAT+GDI QI ++ TDHEQVIYANFAFMV +HARS
Sbjct:    65  WKQLSKEWQDLITKTFTGLTLLDTIQATIGDIKQIDYALTDHEQVIYANFAFMVGVHARS   124

Query:   122  YGTIFSTLCTSQQIEEAHEWVVDTESLQARSRILIPFYTGDDPLKSKVAAMMPGFLLYG   181
              YGTIFSTLCTS+QI EAHEWVV TESLQ R++ LIP+YTG DPLKSKVAAA+MPGFLLYG
```

```
                        -continued
Sbjct:  125  YGTIFSTLCTSEQITEAHEWVVKTESLQKRAKALIPYYTGKDPLKSKVAAALMPGFLLYG   184

Query:  182  GFYLPFYLSARGKLPNTSDIIRLILRDKVIHNYYSGYKYQQKVAKLSVEKQAEMKTFVFD   241
             GFYLPFYLS+R +LPNTSDIIRLILRDKVIHNYYSGYK+Q+KV K+S EKQAEMK FVFD
Sbjct:  185  GFYLPFYLSSRKQLPNTSDIIRLILRDKVIHNYYSGYKFQRKVEKMSKEKQAEMKRFVFD   244

Query:  242  LLYQLIDLEKAYLYELYDGFDLAEDAIRFSIYNAGKFLQNLGYDSPFTEEETRISPEVFA   301
             L+Y+LI+LEKAYL ELY+GF + EDAI+FSIYNAGKFLQNLGYDSPFTEEETRI PE+FA
Sbjct:  245  LMYELIELEKAYLKELYEGFGIVEDAIKFSIYNAGKFLQNLGYDSPFTEEETRIKPEIFA   304

Query:  302  QLSARADENHDFFSGNGSSYIMGITEETLDEDWEF                           336
             QLSARADENHDFFSGNGSSY+MGI+EET D+DW+F
Sbjct:  305  QLSARADENHDFFSGNGSSYVMGISEETEDKDWDF                           339
```

A related DNA sequence was identified in *S. pyogenes* <SEQ ID 813> which encodes the amino acid sequence <SEQ ID 814>. Analysis of this protein sequence reveals the following:

---

Possible site: 18
>>> Seems to have no N-terminal signal sequence
----- Final Results -----
    bacterial cytoplasm --- Certainty = 0.3779 (Affirmative) <succ>
        bacterial membrane --- Certainty = 0.0000 (Not Clear) <succ>
            bacterial outside --- Certainty = 0.0000 (Not Clear) <succ>

---

An alignment of the GAS and GBS proteins is shown below:

```
Identities = 292/335 (87%), Positives = 318/335 (94%)

Query:    2  QSYYDRSQSPLDYALSEKAFPMRSVNWNKLNDDKDLEVWNRVTQNFWLPEKIPVSNDLNS    61
             Q YY+RSQSP++YALSE    +RS+NWN LNDDKDLEVWNRVTQNFWLPEK+PVSNDLNS
Sbjct:    3  QHYYERSQSPIEYALSETQKQLRSINWNYLNDDKDLEVWNRVTQNFWLPEKVPVSNDLNS    62

Query:   62  WRTLDADWQQLITRTFTGLTLLDSVQATVGDIAQIKHSQTDHEQVIYANFAFMVAIHARS   121
             WR+L  DWQQLITRT+TGLTLLD+VQATVGD+AQI+HSQTDHEQVIY NFAFMV IHARS
Sbjct:   63  WRSLGEDWQQLITRTYTGLTLLDTVQATVGDVAQIQHSQTDHEQVIYTNFAFMVGIHARS   122

Query:  122  YGTIFSTLCTSQQIEEAHEWVVDTESLQARSRILIPPYTGDDPLKSKVAAAMMPGFLLYG   181
             YGTIFSTLC+S+QIEEAHEWVV T+SLQ R+R+LIP+YTGDDPLKSKVAAAMMPGFLLYG
Sbjct:  123  YGTIFSTLCSSEQIEEAHEWVVSTQSLQDRARVLIPYYTGDDPLKSKVAAAMMPGFLLYG   182

Query:  182  GFYLPFYLSARGKLPNTSDIIRLILRDKVIHNYYSGYKYQQKVAKLSVEKQAEMKTFVFD   241
             GFYLPFYLSARGK+PNTSDIIRLILRDKVIHNYYSGYKYQQKVA+LS EKQAEMK FVFD
Sbjct:  183  GFYLPFYLSARGKMPNTSDIIRLILRDKVIHNYYSGYKYQQKVARLSPEKQAEMKAFVFD   242

Query:  242  LLYQLIDLEKAYLYELYDGFDLAEDAIRFSIYNAGKFLQNLGYDSPFTEEETRISPEVFA   301
             LLY+LIDLEKAYL ELY GFDLAEDAIRFS+YNAGKFLQNLGY+SPFT+EETR+SPEVFA
Sbjct:  243  LLYELIDLEKAYLRELYAGFDLAEDAIRFSLYNAGKFLQNLGYESPFTDEETRVSPEVFA   302

Query:  302  QLSARADENHDFFSGNGSSYIMGITEETLDEDWEF                           336
             QLSARADENHDFFSGNGSSY+MGITEET D+DWEF
Sbjct:  303  QLSARADENHDFFSGNGSSYVMGITEETTDDDWEF                           337
```

Based on this analysis, it was predicted that these proteins and their epitopes could be useful antigens for vaccines or diagnostics.

Example 257

A DNA sequence (GBSx0272) was identified in *S. agalactiae* <SEQ ID 815> which encodes the amino acid sequence <SEQ ID 816>. This protein is predicted to be rhamnosyltransferase. Analysis of this protein sequence reveals the following:

---

Possible site: 55
>>> Seems to have no N-terminal signal sequence
----- Final Results -----
    bacterial cytoplasm --- Certainty = 0.1741 (Affirmative) <succ>
        bacterial membrane --- Certainty = 0.0000 (Not Clear) <succ>
            bacterial outside --- Certainty = 0.0000 (Not Clear) <succ>

---

A related GBS nucleic acid sequence <SEQ ID 9583> which encodes amino acid sequence <SEQ ID 9584> was also identified.

The protein has homology with the following sequences in the GENPEPT database:

```
>GP:BAA32090 GB:AB010970 rhamnosyltransferase [Streptococcus mutans]
Identities = 104/309 (33%), Positives = 173/309 (55%), Gaps = 21/309 (6%)

Query:   11  QINICLATYNGQKYLRQQLDSIIQQGYTDWICLIRDDGSTDDTVAIIKEYVNRDSRFIFI    70
             ++NI ++TYNGQ+++ QQ+ SI +Q + +W  LIRDDGS+D T  II ++   D+R FI
Sbjct:    2  KVNILMSTYNGQEFIAQQIQSIQKQTFENWNLLIRDDGSSDGTPKIIADFAKSDARIRFI    61
```

```
Query:    71  NSNDDRKLGSHRSFYELVNYKKADFYVFSDQDDVWKENRLERYLEEAEKFNQELPLLVYS   130
              N++      G  ++FY L+ Y+KAD+Y FSDQDDVW   +LE  L   EK N ++PL+VY+
Sbjct:    62  NADKRENFGVIKNFYTLLKYEKADYYFFSDQDDVWLPQKLELTLASVEKENNQIPLMVYT   121

Query:   131  NWTSVDEKLTVL-------KEHNPATVIQEQIAFNQINGMVIMMNHELAKLWE--YRQIG   181
              + T VD  L VL       + H+  T + E++  N + G  +M+NH LAK W+  Y  +
Sbjct:   122  DLTVVDRDLQVLHDSMIKTQSHHANTSLLEELTENTVTGGTMMVNHCLAKQWKQCYDDLI   181

Query:   182  AHDSYVGTLAYAVGNVAYISDSTVLWRRQ----VGAES----LNNYGRQYG-VATFWQMI   232
                HD Y+  LA ++G + Y+ ++T L+R+    +GA +    L N+ R +  V +W ++
Sbjct:   182  MHDWYLALLAASLGKLIYLDETTELYRQHESNVLGARTWSKRLKNWLRPHRLVKKYWWLV   241

Query:   233  NTSFDRASLIFAQVSDKMSLERKLFFSRFIELKNANLMRRIYLLSKLKLRRKSLKETVAM   292
              +S  +AS +   +    K      ++ L + + RI  L +    +       T
Sbjct:   242  TSSQQQASHL---LELDLPAANKAIIRAYVTLLDQSFLNRIKWLKQYGFAKNRAFHTFVF   298

Query:   293  TILLLTGYG                                                    301
              L++T +G
Sbjct:   299  KTLIITKFG                                                    307
```

Based on this analysis, it was predicted that these proteins and their epitopes could be useful antigens for vaccines or diagnostics.

Example 258

A DNA sequence (GBSx0273) was identified in *S. agalactiae* <SEQ ID 819> which encodes the amino acid sequence <SEQ ID 820>. Analysis of this protein sequence reveals the following:

Possible site: 36
>>> Seems to have no N-terminal signal sequence
INTEGRAL   Likelihood = −4.19   Transmembrane 1213-1229 (1211-1230)
----- Final Results -----
  bacterial membrane--- Certainty = 0.2678 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 9581> which encodes amino acid sequence <SEQ ID 9582> was also identified.

There is also homology to SEQ ID 822.

A related GBS gene <SEQ ID 8525> and protein <SEQ ID 8526> were also identified. Analysis of this protein sequence reveals the following:

Lipop: Possible site: −1   Crend: 7
SRCFLG: 0
McG: Length of UR: 3
Peak Value of UR: 2.28
Net Charge of CR: 4
McG: Discrim Score: 1.29
GvH: Signal Score (−7.5) : 2.84
Possible site: 30
>>> Seems to have a cleavable N-term signal seq.
Amino Acid Composition: calculated from 31
ALOM program count: 0   value: 1.16   threshold: 0.0
PERIPHERAL             Likelihood = 1.16          344
modified ALOM score: −0.73

*** Reasoning Step: 3
----- Final Results -----
  bacterial outside --- Certainty = 0.3000 (Affirmative) <succ>
    bacterial membrane --- Certainty = 0.0000 (Not Clear) <succ>
      bacterial cytoplasm --- Certainty = 0.0000 (Not Clear) <succ>
LPXTG motif: 1197-1201

Figure 29:
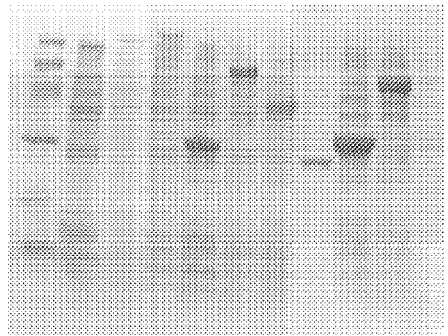

SEQ ID 8526 (GBS147) was expressed in *E. coli* as a His-fusion product. SDS-PAGE analysis of total cell extract is shown in FIG. 29 (lane 4; MW 132 kDa).

Figure 286:
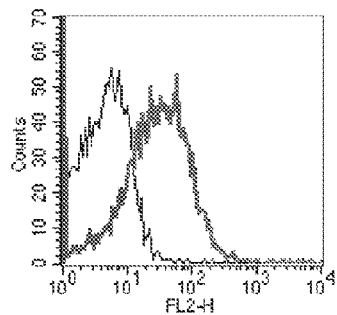

The GBS147-His fusion product was purified (FIG. 200, lane 5) and used to immunise mice. The resulting antiserum was used for FACS (FIG. 286), which confirmed that the protein is immunoaccessible on GBS bacteria.

Based on this analysis, it was predicted that these proteins and their epitopes could be useful antigens for vaccines or diagnostics.

Example 259

A DNA sequence (GBSx0274) was identified in *S. agalactiae* <SEQ ID 823> which encodes the amino acid sequence <SEQ ID 824>. This protein is predicted to be Acetyltransferase (GNAT) family. Analysis of this protein sequence reveals the following:

Possible site: 57
>>> Seems to have no N-terminal signal sequence
----- Final Results -----
  bacterial cytoplasm --- Certainty = 0.2781 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database:

```
>GP:AAG03505 GB:AE004449 conserved hypothetical protein [Pseudomonas aeruginosa]
Identities = 66/143 (46%), Positives = 94/143 (65%), Gaps = 5/143 (3%)

Query:     2  WNVKTFDNLTTHELFQIYKLRVSVFVVEQDCPYQEVDDEDLI--CLHGMNWVDGQLAAYY     59
              W   K   +LT  EL+ + +LR  VFVVEQ CPYQEVD  DL+    H M W DGQL AY
Sbjct:     5  WTCKHHADLTLKELYALLQLRTEVFVVEQKCPYQEVDGLDLVGDTHHLMAWRDGQLLAYL    64

Query:    60  RLIP---EDDKVHLGRVIVNPDFRKKGLGNQLVEYAIKFSEANYPNKPIYAQAQAYLQDF   116
              RL+      + +V +GRV+ +     R +GLG+QL+E A++ +E  + +  P+Y  AQA+LQ +
Sbjct:    65  RLLDPVRHEGQVVIGRVVSSSAARGQGLGHQLMERALQAAERLWLDTPVYLSAQAHLQAY   124

Query:   117  YQSFGFQPVSDIYLEDNIPHLDM                                      139
              Y  +GF  V+++YLED+IPH+ M
Sbjct:   125  YGRYGFVAVTEVYLEDDIPHIGM                                      147
```

No corresponding DNA sequence was identified in *S. pyogenes*.

Based on this analysis, it was predicted that this protein and its epitopes, could be useful antigens for vaccines or diagnostics.

Example 260

A DNA sequence (GBSx0275) was identified in *S. agalactiae* <SEQ ID 825> which encodes the amino acid sequence <SEQ ID 826>. Analysis of this protein sequence reveals the following:

---

Possible site: 37
>>> Seems to have no N-terminal signal sequence
----- Final Results -----
  bacterial cytoplasm --- Certainty = 0.2010 (Affirmative) <succ>
  bacterial membrane --- Certainty = 0.0000 (Not Clear) <succ>
  bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 261

A DNA sequence (GBSx0276) was identified in *S. agalactiae* <SEQ ID 827> which encodes the amino acid sequence <SEQ ID 828>. Analysis of this protein sequence reveals the following:

---

Possible site: 39
>>> Seems to have no N-terminal signal sequence
----- Final Results -----
  bacterial cytoplasm --- Certainty = 0.2935 (Affirmative) <succ>
  bacterial membrane --- Certainty = 0.0000 (Not Clear) <succ>
  bacterial outside --- Certainty = 0.0000 (Not Clear) <succ>

---

The protein has homology with the following sequences in the GENPEPT database:

```
>GP:CAB12631 GB:Z99108 similar to RNA methyltransferase [Bacillus subtilis]
Identities = 217/448 (48%), Positives = 298/448 (66%), Gaps = 4/448 (0%)

Query:     7  QRIPLKIKRMGINGEGIGFYKKTLIFVPGALKGEEVFCQISSVRRNFAEAKLLKINKKSK    66
              Q  PL IKR+GINGEG+G++KK ++FVPGAL GEEV   Q + V+  F+E ++ KI K S+
Sbjct:    16  QTFPLTIKRLGINGEGVGYFKKKVVFVPGALPGEEVVVQATKVQPKFSEGRIKKIRKASE    75

Query:    67  NRVEPPCSIYKECGGCQIMHLQYDKQLEFKTDVIRQALMKFKPEGYENYEIRKTIGMSEP   126
              +RV PPC +Y++CGGCQ+ HL Y +QL  K D++ Q+L +         EN EI++TIGM  P
Sbjct:    76  HRVAPPCPVYEQCGGCQLQHLAYSQQLREKRDIVIQSLERHTKFKVENMEIKETIGMDNP   135

Query:   127  EHYRAKLQFQV-RSFGGNVKAGLYAQGTHRLIDIKDCLVQDSLTQEMINRVAELLGKYKL   185
              +YR K QFQ+ RS  G++ AGLY   +H  ++ IKDC+VQ   T +    V  +L + +
Sbjct:   136  WNYRNKSQFQIGRSQSGSIIAGLYGLDSHDIVPIKDCIVQHPATNKTTGIVRRILEDFNV   195

Query:   186  PIYNERKIAG-VRTVMIRRAQASGEVQLIFITSKRL--DFDDVVIELVREFPELKTVAVN   242
              +YNERK   G VRT++ R    +GEVQ++ +T+K      +++V + +  PE+K++  N
Sbjct:   196  SVYNERKRKGDVRTIVTRVGFETGEVQVVLVTAKETLPHKEEIVKAIQKRLPEVKSIIQN   255

Query:   243  INASKTSDIYGQITEVIWGQESINEEVLDYGFSLSPRAFYQLNPKQTQILYSEAVKALDV   302
              +N +KTS I+G+ T+ +  G+   I E + D  F LS RAF+QLNP+QT   LY E  KA +
Sbjct:   256  VNGAKTSVIFGEKTKQLAGKTVIQEVLGDVSFELSARAFFQLNPEQTVKLYDEVKKAAQL   315

Query:   303  KEDDDLIDAYCGVGTIGLAFAGKVKSVRGMDIIPEAIQDAKENALYMGFTNTHYEAGKAE   362
              +  ++DAYCGVGTIG+   A     K VRGMD+I E+I DAK+NA    G N Y  G AE
Sbjct:   316  TGKEKVVDAYCGVGTIGMWVADGAKEVRGMDVIKESIDDAKKNAKKHGMANATYVTGTAE   375

Query:   363  DIIPRWYSEGFRANALIVDPPRTGLDDKLLNTILKMPPEKMVYVSCNTSTLARDLVTLTK   422
              +P+W   EGFR + +IVDPPRTG D      L+TI K+ P++   VYVSCN  STLA+DL TL+K
Sbjct:   376  HWLPKWTKEGFRPDVVIVDPPRTGCDSTFLDTIKKVKPKRFVYVSCNPSTLAKDLQTLSK   435

Query:   423  VYHVHYIQSVDMFPHTARTEAVVKLQRK                                 450
              Y V YIQ VDMFP TA  EAV +L  K
Sbjct:   436  DYRVDYIQPVDMFPQTAHVEAVARLVAK                                 463
```

A related DNA sequence was identified in *S. pyogenes* <SEQ ID 829> which encodes the amino acid sequence <SEQ ID 830>. Analysis of this protein sequence reveals the following:

```
Possible site: 56
>>> Seems to have no N-terminal signal sequence
----- Final Results -----
   bacterial cytoplasm --- Certainty = 0.2980 (Affirmative) <succ>
    bacterial membrane --- Certainty = 0.0000 (Not Clear) <succ>
     bacterial outside --- Certainty = 0.0000 (Not Clear) <succ>
```

An alignment of the GAS and GBS proteins is shown below:

```
Identities = 327/450 (72%), Positives = 397/450 (87%)

Query:    1  MNVVLKQRIPLKIKRMGINGEGIGFYKKTLIFVPGALKGEEVFCQISSVRRNFAEAKLLK   60
             M V +KQ+IPLKIKRMGINGEGIGFY+KTL+FVPGALKGE++FCQI++V+RNFAEAKLL
Sbjct:    1  MVVKVKQKIPLKIKRMGINGEGIGFYQKTLVFVPGALKGEDIFCQITAVKRNFAEAKLLT   60

Query:   61  INKKSKNRVEPPCSIYKECGGCQIMHLQYDKQLEFKTDVIRQALMKFKPEGYENYEIRKT  120
             +NK SKNRV+P CS+Y+ CGGCQIMHL Y KQL+FK DVIRQAL KFKP GYE +EIR T
Sbjct:   61  VNKASKNRVKPACSVYETCGGCQIMHLAYPKQLDFKDDVIRQALKKFKPTGYEQFEIRPT  120

Query:  121  IGMSEPEHYRAKLQFQVRSFGGNVKAGLYAQGTHRLIDIKDCLVQDSLTQEMINRVAELL  180
             +GM +P+HYRAELQFQ+RSFGG VKAGL++QG+HRL+ I +CLVQD LTQ++IN++ +L+
Sbjct:  121  LGMKKPDHYRAKLQFQLRSFGGTVKAGLFSQGSHRLVPIDNCLVQDQLTQDIINKITQLV  180

Query:  181  GKYKLPIYNERKIAGVRTVMIRRAQASGEVQLIFITSKRLDFDDVVIELVREFPELKTVA  240
              KYKLPIYNERKIAG+RT+M+R+AQAS +VQ+I ++SK +    + + EL + FP++KTVA
Sbjct:  181  DKYKLPIYNERKIAGIRTIMVRKAQASDQVQIIVVSSKEVRLANFIGELTKAFPQVKTVA  240

Query:  241  VNINASKTSDIYGQITEVIWGQESINEEVLDYGFSLSPRAFYQLNPKQTQILYSEAVKAL  300
             +N N SK+S+IYG  TE++WGQE+I+EEVLDYGF+LSPRAFYQLNP+QT++LY E VKAL
Sbjct:  241  LNSNRSKSSEIYGDETEILWGQEAIHEEVLDYGFALSPRAFYQLNPQQTEVLYGEVVKAL  300

Query:  301  DVKEDDDLIDAYCGVGTIGLAFAGKVKSVRGMDIIPEAIQDAKENALYMGFTNTHYEAGK  360
             DV   D +IDAYCGVG+IG AFAGKVKSVRGMDIIPEAI+DA++NA  MGF N +YEAGK
Sbjct:  301  DVGSEDHIIDAYCGVGSIGFAFAGKVKSVRGMDIIPEAIEDAQKNAKAMGFDNAYYEAGK  360

Query:  361  AEDIIPRWYSEGFRANALIVDPPRTGLDDKLLNTILKMPPEKMVYVSCNTSTLARDLVTL  420
             AEDII +WY +G+RA+A+ IVDPPRTGLDDKLL TIL    P++MVYVSCNTSTLARDLV L
Sbjct:  361  AEDIISKWYKQGYRADAVIVDPPRTGLDDKLLKTILHYQPKQMVYVSCNTSTLARDLVQL  420

Query:  421  TKVYHVHYIQSVDMFPHTARTEAVVKLQRK                                450
             TKVY VHYIQSVDME HTARTEAVVKLQ++
Sbjct:  421  TKVYDVHYIQSVDMFPHTARTEAVVKLQKR                                450
```

Based on this analysis, it was predicted that these proteins and their epitopes could be useful antigens for vaccines or diagnostics.

Example 262

A DNA sequence (GBSx0277) was identified in *S. agalactiae* <SEQ ID 831> which encodes the amino acid sequence <SEQ ID 832>. Analysis of this protein sequence reveals the following:

```
Possible site: 45
>>> Seems to have no N-terminal signal sequence
----- Final Results -----
   bacterial cytoplasm --- Certainty = 0.3505 (Affirmative) <succ>
    bacterial membrane --- Certainty = 0.0000 (Not Clear) <succ>
     bacterial outside --- Certainty = 0.0000 (Not Clear) <succ>
```

The protein has homology with the following sequences in the GENPEPT database:

```
>GP:BAB04643 GB:AP001510 unknown conserved protein in B. subtilis
[Bacillus halodurans]
Identities = 74/263 (28%), Positives = 141/263 (53%), Gaps = 9/263 (3%)

Query:    3  ITKIEKKKR---LYTLEL-DNTENLY---ITEDTIVHFMLSKGMIINAEKLENIKKFAQL   55
             IT+IE +KR    Y + + N +++Y    + E ++   L KG+ I+AE+++ I    ++
Sbjct:    4  ITRIEVQKRNNERYNIFIHQNGQDVYAFSVDEQVLIKQGLRKGLDIDAEQMKQILYEDEV   63

Query:   56  SYGKNLGLYYISFKQRTEKEVIKYLQQHDIDSKIIPQIIDNLKSENWINDKNYVQSFIQQ  115
                NL L+Y+S++ R+  EV  YL++ D +  II ++  L +  ++D + ++FIQ
Sbjct:   64  QKTFNLALHYLSYRMRSVHEVRTYLKKKDREEPIIEHVLHRLTEQRLLDDHAFAEAFIQT  123
```

```
Query:   116  NLNTGDKGPYVIKQKLLQKGIKSKIIESELQAINFQDLASKISQKLYKKYQNKLPLKAL-   174
              T  KGP  +KQ+L +KG+  K IE L    ++++   ++    L K+          +L
Sbjct:   124  KRATTSKGPLKLKQELAEKGVSEKTIEGALTTFSYEEQVEQVKAWLEKQKGRTFKGSSLA   183

Query:   175  -KDKLMQSLTTKGFDYQIVHTVIQNLEIEKDQELEEDLIYKELDKQYQKLSKKHDQYELK   233
              K KL + L  KG+   ++       ++ I++++E E + +    +K  +K + K   +EL+
Sbjct:   184  WKQKLSRQLLAKGYTSPVIEEAFADVPIKQEEEEWEALKAFGEKAMRKYAGKKTGWELQ   243

Query:   234  QRIINALMRKGYQYEDIKSALRE                                        256
              Q++   AL RKG+   E I+   L +
Sbjct:   244  QKVKQALYRKGFSLEMIERYLND                                        266
```

A related DNA sequence was identified in *S. pyogenes* <SEQ ID 833> which encodes the amino acid sequence <SEQ ID 834>. Analysis of this protein sequence reveals the following:

---

Possible site: 58
>>> Seems to have no N-terminal signal sequence
----- Final Results -----
  bacterial cytoplasm --- Certainty = 0.2388 (Affirmative) <succ>
  bacterial membrane --- Certainty = 0.0000 (Not Clear) <succ>
  bacterial outside --- Certainty = 0.0000 (Not Clear) <succ>

---

An alignment of the GAS and GBS proteins is shown below:

```
Identities = 146/258 (56%), Positives = 190/258 (73%)

Query:     1  MKITKIEKKKRLYTLELDNTENLYITEDTIVHFMLSKGMIINAEKLENIKKFAQLSYGKN    60
              MKITKIEKKKRLY +ELDN E+LY+TEDTIV FMLSK  +++ ++LE++K FAQLSYGKN
Sbjct:     1  MKITKIEKKKRLYLIELDNDESLYVTEDTIVRFMLSKDKVLDNDQLEDMKHFAQLSYGKN    60

Query:    61  LGLYYISFKQRTEKEVIKYLQQHDIDSKIIPQIIDNLKSENWINDKNYVQSFIQQNLNTG   120
              L LY++SF+QR+ K+V  YL++H+I+   II  II   L+E  WI+D    ++I+QN  G
Sbjct:    61  LALYFLSFQQRSNKQVADYLRKHEIEEHIIADIITQLQEEQWIDDTKLADTYIRQNQLNG   120

Query:   121  DKGPYVIKQKLLQKGIKSKIIESELQAINFQDLASKISQKLYKKYQNKLPLKALKDKLMQ   180
              DKGP V+KQKLLQKGI  S  I+   L   +F  LA  K+SQKL+ KYQ  KLP KALKDK+ Q
Sbjct:   121  DKGPQVLKQKLLQKGIASHDIDPILSQTDFSQLAQKVSQKLFDKYQEKLPPKALKDKITQ   180

Query:   181  SLTTKGFDYQIVHTVIQNLEIEKDQELEEDLIYKELDKQYQKLSKKHDQYELKQRIINAL   240
              +L TKGF Y +   + +L  ++D +  EDL+  KELDKQY+KLS+K+D Y LKQ++  AL
Sbjct:   181  ALLTKGFSYDLAKHSLNHLNFDQDNQEIEDLLDKELDKQYRKLSRKYDGYTLKQKLYQAL   240

Query:   241  MRKGYQYEDIKSALREYL                                             258
                RKGY +DI   LR YL
Sbjct:   241  YRKGYNSDDINCKLRNYL                                             258
```

Based on this analysis, it was predicted that these proteins and their epitopes could be useful antigens for vaccines or diagnostics.

Example 263

A DNA sequence (GBSx0278) was identified in *S. agalactiae* <SEQ ID 835> which encodes the amino acid sequence <SEQ ID 836>. Analysis of this protein sequence reveals the following:

---

Possible site: 33
>>> Seems to have no N-terminal signal sequence
----- Final Results -----
  bacterial cytoplasm --- Certainty = 0.3912 (Affirmative) <succ>
  bacterial membrane --- Certainty = 0.0000 (Not Clear) <succ>
  bacterial outside --- Certainty = 0.0000 (Not Clear) <succ>

---

The protein has homology with the following sequences in the GENPEPT database:

```
>GP: BAB04659 GB: AP001510 unknown conserved protein in B. subtilis
[Bacillus halodurans]
Identities = 96/175 (54%), Positives = 122/175 (68%)
Query:     1  MRLPKEGDFITIQSYKHDGSLHRTWRDTMVLKTTENALIGVNDHTLVTENDGRRWVTREP    60
              M  PK G  I  IQSYKH+GS+HR W +T+VLK T   +IG ND  LV E+DGR W TREP
Sbjct:     1  MNFPKVGSKIQIQSYKHNGSIHRIWEETIVLKGTSKVVIGGNDRILVKESDGRHWRTREP    60

Query:    61  AIVYFHKKYWFNIIAMIRETGVSYYCNLASPYILDPEALKYIDYDLDVKVFADGEKRLLD   120
              AI YF  + WFN I MIR  G+ +YCNL +P+   D  EALKYIDYDLD+KVF D    +LLD
Sbjct:    61  AICYFDSEQWFNTIGMIRADGIYFYCNLGTPFTWDEEALKYIDYDLDIKVFPDMTFKLLD   120
```

```
Query:   121  VDEYEQHKAQMNYPTDIDYILKENVKILVEWINENKGPFSSSYINIWYKRYLELK    175
              DEY  H+   M YP +ID IL+ +V  LV WI++ KGPF+   ++  WY+R+L+ +
Sbjct:   121  EDEYAMHRKMMKYPPEIDRILQRSVDELVSWIHQRKGPFAPQFVESWYERFLQYR    175
```

A related DNA sequence was identified in *S. pyogenes* <SEQ ID 837> which encodes the amino acid sequence <SEQ ID 838>. Analysis of this protein sequence reveals the following:

```
Possible site: 33
>>> Seems to have no N-terminal signal sequence
----- Final Results -----
   bacterial cytoplasm --- Certainty = 0.3912 (Affirmative) <succ>
     bacterial membrane --- Certainty = 0.0000 (Not Clear) <succ>
        bacterial outside --- Certainty = 0.0000 (Not Clear) <succ>
```

An alignment of the GAS and GBS proteins is shown below:

```
Identities = 155/177 (87%), Positives = 165/177 (92%)

Query:     1  MRLPKEGDFITIQSYKHDGSLHRTNRDTMVLKTTENALIGVNDHTLVTENDGRRWVTREP   60
              M+LPKEGDFITIQSYKHDGSLHRTWRDTMVLKTTENALIGVNDHTLVTE+DGRRWVTREP
Sbjct:     1  MKLPKEGDFITIQSYKHDGSLHRTWRDTMVLKTTENALIGVNDHTLVTESDGRRWVTREP   60

Query:    61  AIVYFHKKYWFNIIAMIRETGVSYYCNLASPYILDPEALKYIDYDLDVKVFADGEKRLLD  120
              AIVYFHKKYWFNIIAMIR+ GVSYYCNLASPY++D EALKYIDYDLDVKVFADGEKRLLD
Sbjct:    61  AIVYFHKKYWFNIIAMIRDNGVSYYCNLASPYMMDTEALKYIDYDLDVKVFADGEKRLLD  120

Query:   121  VDEYEQHKAQMNYPTDIDYILKENVKILVEWINENKGPFSSSYINIWYKRYLELKKR     177
              VDEYE HK +M Y  D+D+ILKENVKILV+WIN  KGPFS +YI IWYKRYLELK R
Sbjct:   121  VDEYEIHKKEMQYSADMDFILKENVKILVDWINHEKGPFSKAYITIWYKRYLELKNR    177
```

Based on this analysis, it was predicted that these proteins and their epitopes could be useful antigens for vaccines or diagnostics.

Example 264

A DNA sequence (GBSx0288) was identified in *S. agalactiae* <SEQ ID 839> which encodes the amino acid sequence <SEQ ID 840>. This protein is predicted to be jag protein. Analysis of this protein sequence reveals the following:

```
Possible site: 49
>>> Seems to have no N-terminal signal sequence
----- Final Results -----
   bacterial cytoplasm --- Certainty = 0.1666 (Affirmative) <succ>
     bacterial membrane --- Certainty = 0.0000 (Not Clear) <succ>
        bacterial outside --- Certainty = 0.0000 (Not Clear) <succ>
```

The protein has homology with the following sequences in the GENPEPT database:

```
>GP: BAB07782 GB: AP001520 spoIIIJ-associated protein [Bacillus halodurans]
Identities = 54/198 (27%), Positives = 98/198 (49%), Gaps = 6/198 (3%)
Query:  100 DVVEEYIEEVDETLEKEDVSQPELPKIDDKNVVTTSEAIEKIDLLPNIEVAAAQVTKYVE 159
            + VE+ I E+  T E+    + E PK       ++ + A+ ++ + P+      +  ++E
Sbjct:   13 EAVEQAIIELGTTRERITYTVVEEPKSGLFGILGSKPAVIEVVVKPD---PVDRAKAFLE  69

Query:  160 NIIYEMDLDA--TIETTTSKRQINLQIETPEAGRIIGYHGKVLKSLQLLAQNYLHDRFSK 217
            ++ EMD++    TIE    +    N+ E  + G +IG  G+ L SLQ L       +   +
Sbjct:   70 ELLQEMDMEVEVTIEKDPATVLFNISGEQ-DLGTLIGKRGQTLDSLQYLVNLVANKEEGE 128

Query:  218 SFSVSINVHDYVEHRTETLIDFSKKIARRVLETNEPYHMDPMSNSERKTVHKTIATIEGV 277
              + ++  +Y    R E L+  ++++A + L T  P  ++PMS   ERK +H   +   V
Sbjct:  129 FIRIKLDAENYRARRKEALVQLAERLASKALRTKRPVSLEPMSAHERKIIHTALQELGDV 188

Query:  278 ESYSEGNDPNRFVVVTKK                                           295
            E+YSEG   R VV+   K
Sbjct:  189 ETYSEGQGIGRHVVIAPK                                           206
```

A related DNA sequence was identified in *S. pyogenes* <SEQ ID 841> which encodes the amino acid sequence <SEQ ID 842>. Analysis of this protein sequence reveals the following:

<SEQ ID 844>. This protein is predicted to be 60 kd inner-membrane protein (yidC). Analysis of this protein sequence reveals the following:

Possible site: 27
>>> Seems to have no N-terminal signal sequence
----- Final Results -----
    bacterial cytoplasm --- Certainty = 0.3721 (Affirmative) <succ>
    bacterial membrane --- Certainty = 0.0000 (Not Clear) <succ>
    bacterial outside --- Certainty = 0.0000 (Not Clear) <succ>

Possible site: 42
>>> May be a lipoprotein
INTEGRAL    Likelihood = −7.38    Transmembrane 54-70 (52-75)
INTEGRAL    Likelihood = −5.20    Transmembrane 193-209 (192-211)
INTEGRAL    Likelihood = −3.61    Transmembrane 125-141 (124-144)
INTEGRAL    Likelihood = −2.44    Transmembrane 168-184 (167-184)
----- Final Results -----
    bacterial membrane --- Certainty = 0.3951 (Affirmative) <succ>

An alignment of the GAS and GBS proteins is shown below:

```
Identities = 176/302 (58%), Positives = 223/302 (73%), Gaps = 32/302 (10%)
Query:   23 MVLFTGATVEEAIEKGLQELNISRLRAHIKVVSREKKGFLGFGKKPAKVEIEGITDEVTD  82
            MVLFTG TVEEAIE GLQEL +SRL+AHIKV+S+EKKGFLGEGKKPA+V+IEGI+D+
Sbjct:    1 MVLFTGKTVEEAIETGLQELGLSRLKAHIKVISKEKKGFLGFGKKPAQVDIEGISDKTVY  60

Query:   83 INESVALKNI------KNVPS--SVDVVEEYIEEVDETLEKEDVSQPELPKIDDK----- 129
             +  A ++      +N P+  S DV  E I+  + LE ED      L    D
Sbjct:   61 KADKKATRGVPEDINRQNTPAVNSADVEPEEIKAT-QRLEAEDTKVVPLMSEDSPAQTPS 119

Query:  130 ---NVVTTSEA------IEKIDL---------LPNIEVAAAQVTKYVENIIYEMDLDATI 171
               VT ++A      +E+ ++        +IE AA +V+ YV  IIYEMD++AT+
Sbjct:  120 NLAETVTETKAQQPSIPVEESEVPQDAGNDGFSKDIEKAAQEVSDYVTKIIYEMDIEATV 179

Query:  172 ETTTSKRQINLQIETPEAGRIIGYHGKVLKSLQLLAQNYLHDRFSKSFSVSINVHDYVEH 231
            ET+ ++RQINLQIETPEAGR+IGYHGKVLKSLQLLAQN+LHDR+SK+FSVS+NVHDYVEH
Sbjct:  180 ETSNNRRQINLQIETPEAGRVIGYHGKVLKSLQLLAQNFLHDRYSKNFSVSLNVHDYVEH 239

Query:  232 RTETLIDFSKKIARRVLETNEPYHMDPMSNSERKTVHKTIATIEGVESYSEGNDPNRFVV 291
            RTETLIDF++K+A+RVLE+ + Y MDPMSNSERK VHKT+++IEGV+SYSEGNDPNR+VV
Sbjct:  240 RTETLIDFTQKVAKRVLESGQDYTMDPMSNSERKIVHKTVSSIEGVDSYSEGNDPNRYVV 299

Query:  292 VT                                                           293
            V+
Sbjct:  300 VS                                                           301
```

Based on this analysis, it was predicted that these proteins and their epitopes could be useful antigens for vaccines or diagnostics.

Example 265

A DNA sequence (GBSx0290) was identified in *S. agalactiae* <SEQ ID 843> which encodes the amino acid sequence -continued bacterial outside --- Certainty = 0.0000 (Not Clear) <succ>
    bacterial cytoplasm --- Certainty = 0.0000 (Not Clear) <succ>

The protein has homology with the following sequences in the GENPEPT database:

```
>GP: CAA78595 GB: Z14225 SpoIIIJ [Bacillus subtilis]
Identities = 79/243 (32%), Positives = 142/243 (57%), Gaps = 5/243 (2%)
Query:    1 MKKKLKTFSLILLTGSLLVACG--RGEVSSHSATLWEQ-IVYAFAKSIQWLS--FNHSIG  55
```

```
                    MK+++        ++     LL     C    +    +++ S     W++  +VY   ++  I  +++        +  G
Sbjct:     1 MKRRIGLLLSMVGVFMLLAGCSSVKEPITADSPHFWDKYVVYPLSELITYVAKLTGDNYG    60

Query:    56 LGIILFTLIIRAIMMPLYNMQMKSSQKMQEIQPRLKELQKKYPGKDPDNRLKLNDEMQSM   115
             L IIL T++IR +++PL   Q++SS+ MQ +QP +++L++KY  KD   + KL  E  ++
Sbjct:    61 LSIILVTILIRLLILPLMIKQLRSSKAMQALQPEMQKLKEKYSSKDQKTQQKLQQETMAL   120

Query:   116 YKAEGVNPYASVLPLLIQLPVLWALFQALTRVSFLKVGTFLSLELSQPDPYYILPVLAAL   175
             ++  GVNP A   P+LIQ+P+L    + A+ R +    +FL  +L + DPYYILP++A +
Sbjct:   121 FQKHGVNPLAGCFPILIQMPILIGFYHAIMRTQAISEHSFLWFDLGEKDPYYILPIVAGV   180

Query:   176 FTFLSTWLTNKAAVEKNIALTLMTYVMPFIILVTSFNFASGVVLYWTVSNAFQVFQILLL   235
                 TF+      L        ++N  + +M ++MP +I+V + NF + + LYW V N F + Q   L+
Sbjct:   181 ATFVQQKLMMAGNAQQNPQMAMMLWIMPIMIIVFAINFPAALSLYWVVGNLFMIAQTFLI   240

Query:   236 NNP                                                            238
                 P
Sbjct:   241 KGP                                                            243
```

A related GBS sequence was identified <SEQ ID 10783> which encodes amino acid sequence <SEQ ID 10784>.

A related DNA sequence was identified in *S. pyogenes* <SEQ ID 845> which encodes the amino acid sequence <SEQ ID 846>. Analysis of this protein sequence reveals the following:

```
Possible site: 49
>>> May be a lipoprotein
INTEGRAL    Likelihood = -6.32    Transmembrane 198-214 (197-220)
INTEGRAL    Likelihood = -5.52    Transmembrane 59-75 (57-80)
INTEGRAL    Likelihood = -4.25    Transmembrane 130-146 (129-150)
INTEGRAL    Likelihood = -2.28    Transmembrane 173-189 (170-189)
----- Final Results -----
   bacterial membrane --- Certainty = 0.3527 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP: BAA05234 GB: D26185 stage III sporulation [Bacillus subtilis]
Identities = 90/249 (36%), Positives = 150/249 (60%), Gaps = 6/249 (2%)
Query:    16 IVPLVLLLVACG--RGEVTAQSSSGWDQ-LVYLFARAIQWLS--FDGSIGVGIILFTLTI    70
             +V + +LL  C  +  +TA S   WD+ +VY +   I +++        + G+ IIL T+ I
Sbjct:    13 MVGVFMLLAGCSSVKEPITADSPHFWDKYVVYPLSELITYVAKLTGDNYGLSIILVTILI    72

Query:    71 RLMLMPLFNMQIKSSQKMQDIQPELRELQRKYAGKDTQTRMKLAEESQALYKKYGVNPYA   130
             RL+++PL   Q++SS+ MQ +QPE+++L+ KY  KD +T+ KL +E+ AL++K+GVNP A
Sbjct:    73 RLLILPLMIKQLRSSKAMQALQPEMQKLKEKYSSKDQTQQKLQQETMALFQKHGVNPLA   132

Query:   131 SLLPLLIQMPVMIALFQALTRVSFLKTGTFLWVELAQHDHLYLLPVLAAVFTFLSTWLTN   190
                 P+LIQMP++I + A+ R  +   +FLW +L + D   Y+LP++A V TF+         L
Sbjct:   133 GCFPILIQMPILIGFYHAIMRTQAISEHSFLWFDLGEKDPYYILPIVAGVATFVQQKLMM   192

Query:   191 LAAKEKNVMMTVMIYVMPLMIFFMGFNLASGVVLYWTVSNAFQVQLLLLNNP-FKIIAE   249
                 ++N  M +M+++MP+MI          N + + LYW V N F + Q  L+  P K     E
Sbjct:   193 AGNAQQNPQMAMMLWIMPIMIIVFAINFPAALSLYWVVGNLFMIAQTFLIKGPDIKKNPE   252

Query:   250 RQRLANEEK                                                      258
             Q+  ++K
Sbjct:   253 PQKAGGKKK                                                      261
```

An alignment of the GAS and GBS proteins is shown below:

```
Identities = 172/270 (63%), Positives = 217/270 (79%), Gaps = 1/270 (0%)
Query:     1 MKKKLKTFSLILLTGSLLVACGRGEVSSHSATLWEQIVYAFAKSIQWLSFNHSIGLGIIL    60
             +KK +K   ++  L  LLVACGRGEV++ S++ W+Q+VY FA++IQWLSF+ SIG+GIIL
Sbjct:     7 VKKNIKIARIVPLV-LLLVACGRGEVTAQSSSGWDQLVYLFARAIQWLSFDGSIGVGIIL    65
```

```
Query:   61 FTLIIRAIMMPLYNMQMKSSQKMQEIQPRLKELQKKYPGKDPDNRLKLNDEMQSMYKAEG  120
            FTL  IR ++MPL+NMQ+KSSQKMQ+IQP L+ELQ+KY GKD    R+KL +E Q++YK  G
Sbjct:   66 FTLTIRLMLMPLFNMQIKSSQKMQDIQPELRELQRKYAGKDTQTRMKLAEESQALYKKYG  125

Query:  121 VNPYASVLPLLIQLPVLWALFQALTRVSFLKVGTFLSLELSQPDPYYILPVLAALFTFLS  180
            VNPYAS+LPLLIQ+PV+ ALFQALTRVSFLK GTFL +EL+Q D  Y+LPVLAA+FTFLS
Sbjct:  126 VNPYASLLPLLIQMPVMIALFQALTRVSFLKTGTFLWVELAQHDHLYLLPVLAAVFTFLS  185

Query:  181 TWLTNKAAVEKNIALTLMTYVMPFIILVTSFNFASGVVLYWTVSNAFQVFQILLLNNPYK  240
            TWLTN AA EKN+ +T+M YVMP +I    FN ASGVVLYWTVSNAFQV Q+LLLNNP+K
Sbjct:  186 TWLTNLAAKEKNVMMTVMIYVMPLMIFFMGFNLASGVVLYWTVSNAFQVVQLLLLNNPFK  245

Query:  241 IIKVREEAVRVAHEKEQRVKRAKRKASKKR                              270
            II  R+        E+  R +RA++KA K++
Sbjct:  246 IIAERQRLANEEKERRLRERRARKKAMKRK                              275
```

Based on this analysis, it was predicted that this protein and its epitopes, could be useful antigens for vaccines or diagnostics.

A related GBS gene <SEQ ID 8527> and protein <SEQ ID 8528> were also identified. Analysis of this protein sequence reveals the following:

Lipop: Possible site: 20   Crend: 5
McG: Discrim Score: 4.90
GvH: Signal Score (-7.5): -0.39
Possible site: 42
>>> May be a lipoprotein
ALOM program  count: 4 value: -7.38  threshold: 0.0
INTEGRAL    Likelihood = -7.38   Transmembrane 54-70 (52-75)
INTEGRAL    Likelihood = -5.20   Transmembrane 193-209 (192-211)
INTEGRAL    Likelihood = -3.61   Transmembrane 125-141 (124-144)
INTEGRAL    Likelihood = -2.44   Transmembrane 168-184 (167-184)
PERIPHERAL  Likelihood = 2.54    217
modified ALUM score: 1.98
*** Reasoning Step: 3
----- Final Results -----
  bacterial membrane --- Certainty = 0.3951 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
32.8/62.3% over 242aa
Bacillus subtilis
EGAD|17722| stage III sporulation protein j precursor Insert characterized
OMNI|NT01BS4782 -identity Insert characterized
SP|Q01625|SP3J_BACSU STAGE III SPORULATION PROTEIN J PRECURSOR. Edit characterized
GP|40023|emb|CAA44401.1||X62539 unnamed protein product Insert characterized
GP|467388|dbj|BAA05234.1||D26185 stage III sporulation Insert characterized
GP|2636651|emb|CAB16141.1||Z99124 alternate gene name: spo0J87 Insert characterized
PIR|I40437|I40437 stage III sporulation protein spoIIIJ - Insert characterized
ORF02221(301-1014 of 1413)
EGAD|17722| S4098(3-245 of 261) stage III sporulation protein j precursor { acillus
subtilis}OMNI|NT01 S4782 -identitySP|Q01625|SP3J_ ACSU STAGE III SPORULATION PROTEIN J
PRECURSOR.GP|40023|emb|CAA44401.1||X62539 unnamed protein product { acillus
subtilis}GP|467388|dbj| AA05234.1||D26185 stage III sporulation { acillus
subtilis}GP|2636651|emb|CA 16141.1||Z99124 alternate gene name: spo0J87 { acillus
subtilis}PIR|I40437|I40437 stage III sporulation protein spoIIIJ - acillus subtilis
% Match = 17.0
% Identity = 32.8 % Similarity = 62.2
Matches = 79 Mismatches = 88 Conservative Sub.s = 71

219       249       279       309       339       393        420
DFVVIARKGVEELDYQALEKNLIHVLKIAGLI*KGIKLKKKLKTFSLILLTGSLLVACG--RGEVSSHSATLWEQ-IVYA
         : ||::  :   ::       ||  |  :::  :  :|::  :||
                                MLLKRRIGLLLSMVGVFMLLAGCSSVKEPITADSPHFWDKYVVYP
                                        10        20        30        40

474       504       534       564       594       624       654
FAKSIQWLS--FNHSIGLGIILFTLIIRAIMMPLYNMQMKSSQKMQEIQPRLKELQKKYPGKDPDNRLKLNDEMQSMYKA
 :::  |    :::   :  ||  |||  :: | :: ||  |:    |:||::  ||||   ||   ||   |  | :::
LSELITYVAKLTGDNYGLSIILVTILIRLLILPLMIKQLRSSKAMQALQPEMQKLKEKYSSKDQKTQQKLQQETMALFQK
        60        70        80        90       100       110       120

684       714       744       774       804       834       864       894
EGVNPYASVLPLLIQLPVLWALFQALTRVSFLKVGTFLSLELSQPDPYYILPVLAALFTFLSTWLTNKAAVEKNIALTLM
 ||||   |:|:|||:|:    :  :|:  |    :  :||   :  ||||||::|:||||:::  | ::|   ::|
HGVNPLAGCFPILIQMPILIGFYHAIMRTQAISEHSFLWFDLGEKDPYYILPIVAGVATFVQQKLMMAGNAQQNPQMAMM
       140       150       160       170       180       190       200
```

```
924         954         984        1014        1044        1074        1104        1134
TYVMPFIILVTSFNFASGVVLYWTVSNAFQVFQILLLNNPYKIIKVREEAVRVAHEKEQRVKRAKRKASKKRK*ENHGII
 ::||  :|:|  :  ||  :  |||  |  |  |  :  |  :|:      |                :           :
LWIMPIMIIVFAINFPAALSLYWVVGNLFMIAQTFLIKGPDIKKNPEPQKAGGKKK
         220         230         240         250         260
```

Example 266

A DNA sequence (GBSx0291) was identified in *S. agalactiae* <SEQ ID 847> which encodes the amino acid sequence <SEQ ID 848>. Analysis of this protein sequence reveals the following:

Possible site: 46
>>> Seems to have no N-terminal signal sequence
----- Final Results -----
    bacterial cytoplasm --- Certainty = 0.3778 (Affirmative) <succ>
      bacterial membrane --- Certainty = 0.0000 (Not Clear) <succ>
        bacterial outside --- Certainty = 0.0000 (Not Clear) <succ>

A related GBS nucleic acid sequence <SEQ ID 9579> which encodes amino acid sequence <SEQ ID 9580> was also identified.

The protein has homology with the following sequences in the GENPEPT database:

Based on this analysis, it was predicted that these proteins and their epitopes could be useful antigens for vaccines or diagnostics.

Example 267

A DNA sequence (GBSx0292) was identified in *S. agalactiae* <SEQ ID 851> which encodes the amino acid sequence <SEQ ID 852>. This protein is predicted to be glycerol-3-phosphate dehydrogenase, NAD-dependent (gpsA). Analysis of this protein sequence reveals the following:

Possible site: 33
>>> Seems to have no N-terminal signal sequence
----- Final Results -----
    bacterial cytoplasm --- Certainty = 0.1429 (Affirmative) <succ>
      bacterial membrane --- Certainty = 0.0000 (Not Clear) <succ>
        bacterial outside --- Certainty = 0.0000 (Not Clear) <succ>

A related GBS nucleic acid sequence <SEQ ID 8529> which encodes amino acid sequence <SEQ ID 8530> was also identified. There is a signal peptide at residues 1-19. The protein has homology with the following sequences in the GENPEPT database:

```
>GP: CAA44400 GB: X62539 homologous to E. coli rnpA [Bacillus subtilis]
Identities = 52/109 (47%), Positives = 77/109 (69%), Gaps = 1/109 (0%)
Query:  21 LKKTYRVKSDKDFQMIFSRGKNVANRKFVIYYLEK-EQKHFRVGISVSKKLGNAVVRNAI  79
           LKK  R+K  ++DFQ  +F   G  +VANR+FV+Y L++ E      RVG+SVSKK+GNAV+RN  I
Sbjct:   4 LKKRNRLKKNEDFQKVFKHGTSVANRQFVLYTLDQPENDELRVGLSVSKKIGNAVMRNRI  63

Query:  80 KRKIRHVLLSQKTALQDYDFVVIARKGVEELDYQALEKNLIHVLKIAGL            128
           KR IR    L  +K   L++  D+++IARK     +L  Y+    +K+L H+   +   L
Sbjct:  64 KRLIRQAFLEEKERLKEKDYIIIARKPASQLTYEETKKSLQHLFRKSSL            112
```

A related DNA sequence was identified in *S. pyogenes* <SEQ ID 849> which encodes the amino acid sequence <SEQ ID 850>. Analysis of this protein sequence reveals the following:

Possible site: 24
>>> Seems to have no N-terminal signal sequence
----- Final Results -----
    bacterial cytoplasm --- Certainty = 0.3820 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below:

```
Identities = 73/109 (66%), Positives = 88/109 (79%)
Query:  21 LKKTYRVKSDKDFQMIFSRGKNVANRKFVIYYLEKEQKHFRVGISVSKKLGNAVVRNAIK  80
           LKKTYRVK +KDFQ  IF   GK+ ANRKFVIY+L +  Q HFRVGISV KK+GNAV RNA+K
Sbjct:   1 LKKTYRVKREKDFQAIFKDGKSTANRKFVIYHLNRGQDHFRVGISVGKKIGNAVTRNAVK  60

Query:  81 RKIRHVLLSQKTALQDYDFVVIARKGVEELDYQALEKNLIHVLKIAGLI            129
           RKIRHV+++    L+  DFVVIARKGV  L+YQ L++NL HVLK+A L+
Sbjct:  61 RKIRHVIMALGHQLKSEDFVVIARKGVHSLEYQELQQNLHHVLKLAQLL            109
```

```
>GP: AAA86746 GB: U32164 NAD(P)H-dependent dihydroxyacetone-phosphate
reductase [Bacillus subtilis]
Identities = 177/333 (53%), Positives = 241/333 (72%)
Query:    18 QKIAVLGPGSWGTALAQVLNDNGHEVRLWGNVVEQIEEINTNHTNQRYFKDITLDSKIKA   77
             +K+ +LG GSWGTALA VL DNG+EV +W +   + I +IN  H N+ Y  ++ L + IK
Sbjct:     2 KKVTMLGAGSWGTALALVLTDNGNEVCVWAHRADLIHQINELHENKDYLPNVKLSTSIKG   61

Query:    78 YTNLEEAINNVDSILFVVPTKVTRLVAKQVANLLKHKVVLMHASKGLEPGTHERLSTILE  137
             T+++EA+++ D I+  VPTK  R V +Q      + K V +H SKG+EP +  R+S I+E
Sbjct:    62 TTDMKEAVSDADVIIVAVPTKAIREVLRQAVPFITKKAVFVHVSKGIEPDSLLRISEIME  121

Query:   138 EEISEQYRSDIVVVSGPSHAEEAIVRDITLITAASKDIEAAKYVQKLFSNHYFRLYTNTD  197
             E+    R DIVV+SGPSHAEE +R  T +TA+SK + AA+ VQ LF NH  FR+YTN D
Sbjct:   122 IELPSDVRRDIVVLSGPSHAEEVGLRHATTVTASSKSMRAAEEVQDLFINHNFRVYTNPD  181

Query:   198 VVGVETAGALKNIIAVGAGALHGLGYGDNAKAAIITRGLAEITRLGVQLGADPLTFSGLS  257
             ++GVE  GALKNIIA+ AG   GLGYGDNAKAA+ITRGLAEI RLG ++G +PLTFSGL+
Sbjct:   182 IIGVEIGGALKNIIALAAGITDGLGYGDNAKAALITRGLAEIARLGTKMGGNPLTFSGLT  241

Query:   258 GVGDLIVTGTSVHSRNWRAGDALGRGEKLEDIEKNMGMVIEGISTTKVAYEIAQNLNVYM  317
             GVGDLIVT TSVHSRNWRAG+ LG+G KLED+ + MGMV+EG+ TTK AY++++  +V M
Sbjct:   242 GVGDLIVTCTSVHSRNWRAGNLLGKGYKLEDVLEEMGMVVEGVRTTKAAYQLSKKYDVKM  301

Query:   318 PITEAIYKSIYEGANIKDSILDMMSNEFRSENE                            350
             PITEA+++ ++ G  ++ ++  +M+       E E
Sbjct:   302 PITEALHQVLFNGQKVETAVESLMARGKTHEME                            334
```

A related DNA sequence was identified in *S. pyogenes* <SEQ ID 853> which encodes the amino acid sequence <SEQ ID 854>. Analysis of this protein sequence reveals the following:

Possible site: 19
>>> Seems to have no N-terminal signal sequence
----- Final Results -----
  bacterial cytoplasm --- Certainty = 0.0882 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below:

```
Identities = 287/338 (840), Positives = 316/338 (92%)
Query:    15 MTKQKIAVLGPGSWGTALAQVLNDNGHEVRLWGNVVEQIEEINTNHTNQRYFKDITLDSK   74
             MTKQK+A+LGPGSWGTAL+QVLNDNGH+VRLWGN+  +QIEEINT HTN+ YFKDI LD
Sbjct:     1 MTKQKVAILGPGSWGTALSQVLNDNGHDVRLWGNIPDQIEEINTKHTNRHYFKDIVLDKN   60

Query:    75 IKAYTNLEEAINNVDSILFVVPTKVTRLVAKQVANLLKHKVVLMHASKGLEPGTHERLST  134
             I A  +L +A+++VD++LFVVPTKVTRLVA+QVA +L HKVV+MHASKGLEP THERLST
Sbjct:    61 ITATLDLGQALSDVDAVLFVVPTKVTRLVARQVAAILDHKVVVMHASKGLEPETHERLST  120

Query:   135 ILEEEISEQYRSDIVVVSGPSHAEEAIVRDITLITAASKDIEAAKYVQKLFSNHYFRLYT  194
             ILEEEI   +RS++VVVSGPSHAEE IVRDITLITAASKDIEAAKYVQ LFSNHYFRLYT
Sbjct:   121 ILEEEIPAHFRSEVVVVSGPSHAEETIVRDITLITAASKDIEAAKYVQSLFSNHYFRLYT  180

Query:   195 NTDVVGVETAGALKNIIAVGAGALHGLGYGDNAKAAIITRGLAEITRLGVQLGADPLTFS  254
             NTDV+GVETAGALKNIIAVGAGALHGLGYGDNAKAA+ITRGLAEITRLGV+LGADPLT+S
Sbjct:   181 NTDVIGVETAGALKNIIAVGAGALHGLGYGDNAKAAVITRGLAEITRLGVKLGADPLTYS  240

Query:   255 GLSGVGDLIVTGTSVHSRNWRAGDALGRGEKLEDIEKNMGMVIEGISTTKVAYEIAQNLN  314
             GLSGVGDLIVTGTSVHSRNWRAG ALGRGEKLEDIE+NMGMVIEGI+TTKVAYEIAQ+L
Sbjct:   241 GLSGVGDLIVTGTSVHSRNWRAGAALGRGEKLEDIERNMGMVIEGIATTKVAYEIAQDLG  300

Query:   315 VYMPITEAIYKSIYEGANIKDSILDMMSNEFRSENEWH                       352
             VYMPIT AIYKSIYEGA+IK+SIL MMSNEFRSENEWH
Sbjct:   301 VYMPITTAIYKSIYEGADIKESILGMMSNEFRSENEWH                       338
```

Figure 59:
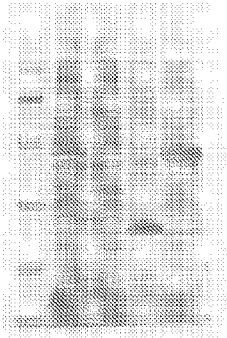
Figure 77:
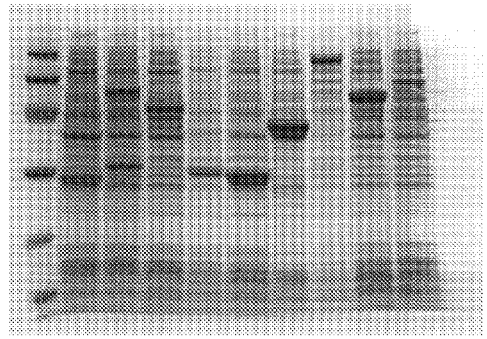

SEQ ID 8530 (GBS291) was expressed in *E. coli* as a His-fusion product. SDS-PAGE analysis of total cell extract is shown in FIG. 59 (lane 5; MW 38.9 kDa). It was also expressed in *E. coli* as a GST-fusion product. SDS-PAGE analysis of total cell extract is shown in FIG. 77 (lane 2; MW 64 kDa).

Figure 226:
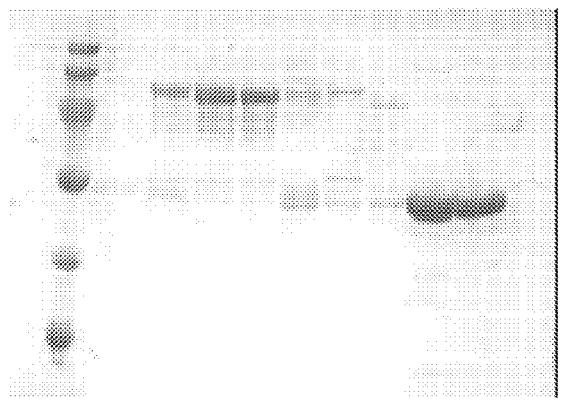

GBS291-GST was purified as shown in FIG. 226, lane 10-11.

Based on this analysis, it was predicted that these proteins and their epitopes could be useful antigens for vaccines or diagnostics.

Example 268

A DNA sequence (GBSx0293) was identified in *S. agalactiae* <SEQ ID 855> which encodes the amino acid sequence <SEQ ID 856>. This protein is predicted to be glucose-1-phosphate uridylyltransferase (gtaB). Analysis of this protein sequence reveals the following:

Possible site: 25
>>> Seems to have a cleavable N-term signal seq.
----- Final Results -----
  bacterial outside --- Certainty = 0.3000 (Affirmative) <succ>

```
    bacterial membrane --- Certainty = 0.0000 (Not Clear) <succ>
    bacterial cytoplasm --- Certainty = 0.0000 (Not Clear) <succ>
```

The protein has homology with the following sequences in the GENPEPT database:

```
>GP: BAA28714 GB: AB001562 glucose-1-phosphate uridylyltransferase
[Streptococcus mutans]
Identities = 263/296 (88%), Positives = 285/296 (95%)
Query:    2 KVRKAVIPAAGLGTRFLPATKALAKEMLPIVDKPTIQFIVEEALKSGIEDILVVTGKSKR   61
            KVRKAVIPAAGLGTRFLPATKALAKEMLPIVDKPTIQFIVEEALKSGIEDILVVTGKSKR
Sbjct:    5 KVRKAVIPAAGLGTRFLPATKALAKEMLPIVDKPTIQFIVEEALKSGIEDILVVTGKSKR   64

Query:   62 SIEDHFDSNFELEYNLKEKGKNELLKLVDETTGIRLHFIRQSHPRGLGDAVLQAKAFVGN  121
            SIEDHFDSNFELEYNL++KGK +LLKLV++TT I LHFIRQSHPRGLGDAVLQAKAFVGN
Sbjct:   65 SIEDHFDSNFELEYNLEQKGKTDLLKLVNDTTAINLHFIRQSHPRGLGDAVLQAKAFVGN  124

Query:  122 EPFVVMLGDDLMDITNNKVIPLTKQLINDFEATHASTIAVMEVPHEDVSAYGVIAPQGEG  181
            EPFVVMLGDDLMDIT++K IPLT+QL+ND+E THASTIAVMEVPHEDVSAYGVIAPQGEG
Sbjct:  125 EPFVVMLGDDLMDITDDKAIPLTRQLMNDYEETHASTIAVMEVPHEDVSAYGVIAPQGEG  184

Query:  182 VNGLYSVNTFVEKPSPEEAPSNLAIIGRYLLTPEIFNILETQKPGAGNEIQLTDAIDTLN  241
            V+GLYSV+TFVEKP+P+EAPSNLAIIGRYLLTPEIF ILETQ+PGAGNE+QLTDAIDTLN
Sbjct:  185 VSGLYSVDTFVEKPAPKEAPSNLAIIGRYLLTPEIFTILETQEPGAGNEVQLTDAIDTLN  244

Query:  242 KTQRVFARKFTGDRYDVGDKFGFMKTSIDYALQHPQVKDDLKKYIIDLGKSLEKTS      297
            KTQRVFAR+F G RYDVGDKFGFMKTSIDYAL+HPQVK+DLK YII+LGK L++ S
Sbjct:  245 KTQRVFAREFKGKRYDVGDKFGFMKTSIDYALKHPQVKEDLKAYIIELGKKLDQKS      300
```

A related DNA sequence was identified in *S. pyogenes* <SEQ ID 857> which encodes the amino acid sequence <SEQ ID 858>. Analysis of this protein sequence reveals the following:

```
Possible site: 26
>>> Seems to have a cleavable N-term signal seq.
----- Final Results -----
    bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>
```

An alignment of the GAS and GBS proteins is shown below:

```
Identities = 257/295 (87%), Positives = 277/295 (93%)

Query:    2 KVRKAVIPAAGLGTRFLPATKALAKEMLPIVDKPTIQFIVEEALKSGIEDILVVTGKSKR   61
            KVRKA+IPAAGLGTRFLPATKALAKEMLPIVDKPTIQFIVEEALKSGIE+ILVVTGK+KR
Sbjct:    3 KVRKAIIPAAGLGTRFLPATKALAKEMLPIVDKPTIQFIVEEALKSGIEEILVVTGKAKR   62

Query:   62 SIEDHFDSNFELEYNLKEKGKNELLKLVDETTGIRLHFIRQSHPRGLGDAVLQAKAFVGN  121
            SIEDHFDSNFELEYNL+ KGKNELLKLVDETT I LHFIRQSHPRGLGDAVLQAKAFVGN
Sbjct:   63 SIEDHFDSNFELEYNLQAKGKNELLKLVDETTAINLHFIRQSHPRGLGDAVLQAKAFVGN  122

Query:  122 EPFVVMLGDDLMDITNNKVIPLTKQLINDFEATHASTIAVMEVPHEDVSAYGVIAPQGEG  181
            EPFVVMLGDDLMDITN   PLTKQL+ D++ THASTIAVM+VPHEDVS+YGVIAPQG+
Sbjct:  123 EPFVVMLGDDLMDITNASAKPLTKQLMEDYDKTHASTIAVMKVPHEDVSSYGVIAPQGKA  182

Query:  182 VNGLYSVNTFVEKPSPEEAPSNLAIIGRYLLTPEIFNILETQKPGAGNEIQLTDAIDTLN  241
            V GLYSV+TFVEKP PE+APS+LAIIGRYLLTPEIF ILE Q PGAGNE+QLTDAIDTLN
Sbjct:  183 VKGLYSVDTFVEKPQPEDAPSDLAIIGRYLLTPEIFGILERQTPGAGNEVQLTDAIDTLN  242

Query:  242 KTQRVFARKFTGDRYDVGDKFGFMKTSIDYALQHPQVKDDLKKYIIDLGKSLEKT       296
            KTQRVFAR+F G+RYDVGDKFGFMKTSIDYAL+HPQVK+DLK YII LGK+LEK+
Sbjct:  243 KTQRVFAREFKGNRYDVGDKFGFMKTSIDYALERPQVKEDLKNYIIKLGKALEKS       297
```

Based on this analysis, it was predicted that these proteins and their epitopes could be useful antigens for vaccines or diagnostics.

Example 269

A DNA sequence (GBSx0294) was identified in *S. agalactiae* <SEQ ID 859> which encodes the amino acid sequence <SEQ ID 860>. Analysis of this protein sequence reveals the following:

```
Possible site: 42
>>> Seems to have no N-terminal signal sequence
INTEGRAL    Likelihood = -4.94    Transmembrane 28-44 (27-45)
----- Final Results -----
    bacterial membrane --- Certainty = 0.2975 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database:

```
>GP: CAB15143 GB: Z99120 similar to ABC transporter (lipoprotein)
[Bacillus subtilis]
Identities = 148/346 (42%), Positives = 222/346 (63%), Gaps = 16/346 (4%)
Query:   31 LTLLSLSVTLTACGNRSDKSAN---KSDIKVAMVTNQGGVDDKSFNQSAWEGLQKWGKK    87
            ++L+  +    L ACGN    S +    K+   VAMVT+ GGVDDKSFNQSAWEG+Q +GK+
Sbjct:    1 MSLVIAAGTILGACGNSEKSSGSGEGKNKFSVAMVTDVGGVDDKSFNQSAWEGIQAFGKE   60

Query:   88 KGLTKG-NGFDYFQSSNESDHANNLDTAASSGYNLIFGIGFGLHDTIEKVSENNKDVKYV  146
               GL KG NG+DY QS +++D+   NL+  A     ++LI+G+G+ + D+I ++++  K+  +
Sbjct:   61 NGLKKGKNGYDYLQSKSDADYTTNLNKLARENFDLIYGVGYLMEDSISEIADQRKNTNFA  120

Query:  147 IVDDIIKGKENVASVTFADNEAAYLAGVAAAKTTKTKTVGFIGGMEGVVVKRFEAGFKAG  206
             I+D ++  K+NVAS+TF + E  ++L GVAAA ++K+   +GF+GGME   ++K+FE GF+AG
Sbjct:  121 IIDAVVD-KDNVASITFKEQEGSFLVGVAAALSSKSGKIGFVGGMESELIKKFEVGFRAG  179

Query:  207 VKSIDPAIKVAVSYAGSFTDAAKGKTIAATQYATGVDVIYQAAGGTGAGIFSEAKTENET  266
            V++++P   V V  YAG F  A    GK   A +  Y +GVDVIY +AG TG G+F+EAK
Sbjct:  180 VQAVNPKAVVEVKYAGGFDKADVGKATAESMYKSGVDVIYHSAGATGTGVFTEAK---NL  236

Query:  267 RKESNK--VWVIGVDRDQSQEGNYVSKDGKKANFVLASTIKEVGKSLQSVAELTEKKQYP  324
             +KE   K   VWVIGVD+DQ   EG      +G   N  L S +K+V  ++ V +       ++P
Sbjct:  237 KKEDPKRDVWVIGVDKDQYAEGQV---EGTDDNVTLTSMVKKVDTVVEDVTKKASDGKFP  293

Query:  325 GGKVTVFGLKDSGVDI--KEHQLSSEGSVAVKKAKEDIVSGKIQVP              368
            GG+    +GL   GV I    + LS +     AV K K+ I+ G +++P
Sbjct:  294 GGETLTYGLDQDGVGISPSKQNLSDDVIKAVDKWKKKIIDG-LEIP              338
```

There is also homology to SEQ ID 862.

A related GBS gene <SEQ ID 8531> and protein <SEQ ID 8532> were also identified. Analysis of this protein sequence reveals the following:

Lipop: Possible site: 20    Crend: 3
Sequence Pattern: CGNR
SRCFLG: 0
McG: Length of UR: 19
Peak Value of UR: 2.31
Net Charge of CR: 2
McG: Discrim Score: 5.09
GvH: Signal Score (-7.5): -3.29
Possible site: 19

>>> May be a lipoprotein
Amino Acid Composition: calculated from 21
ALOM program       count: 0 value: 5.20        threshold: 0.0
PERIPHERAL         Likelihood = 5.20           90
modified ALOM score: -1.54
*** Reasoning Step: 3
----- Final Results -----
  bacterial membrane --- Certainty = 0.0000 (Not Clear) <succ>
    bacterial outside --- Certainty = 0.0000 (Not Clear) <succ>
      bacterial cytoplasm --- Certainty = 0.0000 (Not Clear) <succ>

The protein has homology with the following sequences in the databases:

```
52.8/73.9% over 239aa
Listeria monocytogenes
SP|Q48754| CD4+ T CELL-STIMULATING ANTIGEN PRECURSOR. Insert characterized
GP|7240601|gb|AAB35725.2||S80336 CD4+ T cell-stimulating antigen Insert characterized
ORF02225(385-1086 of 1710)
SP|Q48754|TCSA_LISMO(8-247 of 268) CD4+ T CELL-STIMULATING ANTIGEN
PRECURSOR.GP|7240601|gb|AAB35725.2||S80336 CD4+ T cell-stimulating antigen
{Listeria monocytogenes}
% Match = 21.7
% Identity = 52.7 % Similarity = 73.8
Matches = 125 Mismatches = 59 Conservative Sub.s = 50

294       324       354       384       414       444       465       489
            NFLWEK*NKVC*MIFLCYDRNLFLCDYNLLGGSFSVNRKIIGLTLLSLSVTLTLTACGNRSD---KSANKS--DIKVAMVT
                                        : |:::   | : |   |||: ||       |  :||    |   |||||
                                        MKKRTFALALSMIIASGVILGACGSSDDKKSSDDKSSKDFTVAMVT
                                        10        20        30        40

519       549       579       606       636       666       696       726
            NQGGVDDKSFNQSAWEGLQKWGKKKGLTKG-NGFDYFQSSNESDHANNLDTAASSGYNLIFGIGFGLHDTIEKVSENNKD
            : ||||:||||||||||||:||    :  ||  :|::|::|:   ||:||   |   ||:|||    | || ||:||:
            DTGGVDDRSFNQSAWEGLQKFGKANDMEKGTDGYNYLQSASEADYKTNLNTAVRSDYDLIYGIGYKLKDAIEEVSKQKPK
                    60        70        80        90       100       110       120
```

```
756       786       816       846       876       906       936       966
VKYVIVDDIIKGKENVASVTFADNEAAYLAGVAAAKTTKTKTVGFIGGMEGVVVKRFEAGFKAGVKSIDPAIKVAVSYAG
 ::  ||||  |  ::||  |:  |  ||  :||  ||  |   ||||   |||:||::|  |:  ||||||  ||||:::|   ::  |  ||
NQFAIVDDTIDDRDNVVSIGFKDNDGSYLVGVVAGLTTKTNKVGFVGGVKGTVIDRFEAGFTAGVKAVNPNAQIDVQYAN
          140       150       160       170       180       190       200

996       1026      1056      1086      1116      1146      1176      1206
SFTDAAKGKTIAATQYATGVDVIYQAAGGTGAGIFSEAKTENETRKESNKVWVIGVDRDQSQEGNYVSKDGKKANFVLAS
 |   |  ||:  ||::  |::|||||::|||||||  |:|:|||    :       :                  :
DFAKADKGQQIASSMYSSGVDVIFHAAGGTGNGVFAEAKNLKKKDLQMVPYGNSKLGCFGG
          220       230       240       250       260
```

A related GBS nucleic acid sequence <SEQ ID 10947> which encodes amino acid sequence <SEQ ID 10948> was also identified.

Figure 38:
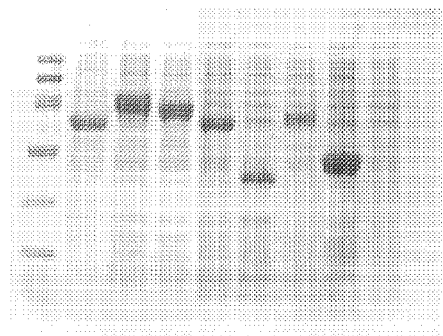

SEQ ID 8532 (GBS108) was expressed in *E. coli* as a His-fusion product. SDS-PAGE analysis of total cell extract is shown in FIG. 38 (lane 7; MW 39.6 kDa). It was also expressed in *E. coli* as a GST-fusion product. SDS-PAGE analysis of total cell extract is shown in FIG. 41 (lane 9; MW 64.6 kDa).

Figure 273:
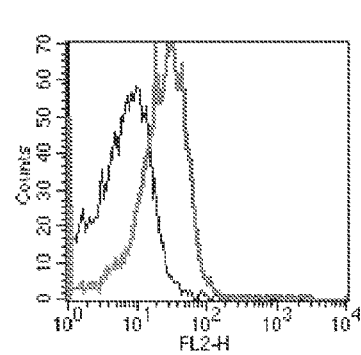

The GBS108-GST fusion product was purified (FIG. 202, lane 9) and used to immunise mice. The resulting antiserum was used for FACS (FIG. 273), which confirmed that the protein is immunoaccessible on GBS bacteria.

Based on this analysis, it was predicted that these proteins and their epitopes could be useful antigens for vaccines or diagnostics.

Example 270

A DNA sequence (GBSx0295) was identified in *S. agalactiae* <SEQ ID 863> which encodes the amino acid sequence <SEQ ID 864>. Analysis of this protein sequence reveals the following:

Possible site: 35
>>> Seems to have a cleavable N-term signal seq.
INTEGRAL    Likelihood = −12.74    Transmembrane 206-222 (197-224)
INTEGRAL    Likelihood = −3.72     Transmembrane 174-190 (171-194)
INTEGRAL    Likelihood = −3.19     Transmembrane 98-114 (98-116)
INTEGRAL    Likelihood = −1.54     Transmembrane 120-136 (120-139)
INTEGRAL    Likelihood = −0.90     Transmembrane 157-173 (157-173)
----- Final Results -----
   bacterial membrane --- Certainty = 0.6095 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database:

```
>GP: CAB90755 GB: AJ400707 hypothetical protein [Streptococcus uberis]
Identities = 126/218 (57%), Positives = 166/218 (75%)

Query:    8  KEYPTTVLLVSLTTLVFLLMQLTYGSQAESSQVIFQFGGIQGDYLKAYPTNLWRLISPIF   67
             KE P T   +S+T L+F++MQ+ YGS A+S QV+FQFGG+ G  +K+ P+ LWRL++PIF
Sbjct:    5  KEKPVTFFFLSVTILLFIVMQVFYGSWAKSPQVVFQFGGMFGLVVKSMPSQLWRLVTPIF   64

Query:   68  VHIGWEHFLLNGLALYFVGQMGESIWGSLRFLILYILSGLMGNIFTLFFTPHVVAAGAST  127
             +HIGWEHFL+N L LYFVGQ+ ESIWGS  FL+LY+LSG+MGN+ TLFFTPHVVAAGAST
Sbjct:   65  IHIGWEHFLINSLTLYFVGQLAESIWGSRFFLLLYVLSGIMGNVLTLFFTPHVVAAGAST  124

Query:  128  SLFGVFSAIAIAGYFGKNPYLKQVGKSYQVMILLNLFFNIFTPGVSLAGHVGGLVGGVLV  187
             SLFG+F+AI + GYFG N  LK +GKSYQ +I+LNL  N+F P V + GH+GG +GG L
Sbjct:  125  SLFGLFAAIVVVGYFGHNQLLKSIGKSYQTLIILNLVMNLFMPNVGIVGHLGGALGGALA  184

Query:  188  AIFLTKQNGSLLFKTWQSILALMIFIIVSISLIGLSLV                       225
             A+FL    + LF   Q   AL+ ++ +++ LI LSL+
Sbjct:  185  AVFLPTLLDAELFTKKQKTSALLSYLTLALVLITLSLM                       222
```

A related DNA sequence was identified in *S. pyogenes* <SEQ ID 865> which encodes the amino acid sequence <SEQ ID 866>. Analysis of this protein sequence reveals the following:

```
Possible site: 43
>>> Seems to have no N-terminal signal sequence
INTEGRAL    Likelihood = -9.92    Transmembrane 214-230 (212-232)
INTEGRAL    Likelihood = -5.36    Transmembrane 135-151 (128-153)
INTEGRAL    Likelihood = -1.81    Transmembrane 101-117 (100-117)
INTEGRAL    Likelihood = -1.44    Transmembrane 183-199 (182-199)
INTEGRAL    Likelihood = -0.53    Transmembrane 166-182 (166-182)
----- Final Results -----
    bacterial membrane --- Certainty = 0.4970 (Affirmative) <succ>
       bacterial outside --- Certainty = 0.0000 (Not Clear) <succ>
         bacterial cytoplasm --- Certainty = 0.0000 (Not Clear) <succ>
```

The protein has homology with the following sequences in the databases:

```
>GP: CAB90755 GB: AJ400707 hypothetical protein [Streptococcus uberis]
Identities = 72/128 (56%), Positives = 94/128 (73%)
Query:  106 FLLLYVLSGVMGNAFTFWLTPETVAAGASTSLFGLFAAIVVLSFLGKNQALKDLGKSYQT  165
            FLLLYVLSG+MGN  T + TP  VAAGASTSLFGLFAAIVV+ + G NQ LK +GKSYQT
Sbjct:   95 FLLLYVLSGIMGNVLTLFFTPHVVAAGASTSLFGLFAAIVVVGYFGHNQLLKSIGKSYQT  154

Query:  166 LIVVNLLMNLFMPNVSMAGHIGGVVGGALLSIVFPTKMRVITVKKTKRMLALVSYGIILV  225
            LI++NL+MNLFMPNV + GH+GG +GGAL ++   PT +      K ++  AL+SY  + +
Sbjct:  155 LIILNLVMNLFMPNVGIVGHLGGALGGALAAVFLPTLLDAELFTKKQKTSALLSYLTLAL  214

Query:  226 GVLVLGFL  233
            ++ L  +
Sbjct:  215 VLITLSLM  222
```

An alignment of the GAS and GBS proteins is shown below:

```
Identities = 63/132 (47%), Positives = 92/132 (68%)
Query:   94 GSLRFLILYILSGLMGNIFTLFFTPHVVAAGASTSLFGVFSAIAIAGYFGKNPYLKQVGK  153
            G   FL+LY+LSG+MGN FT + TP  VAAGASTSLFG+F+AI +   + GKN  LK +GK
Sbjct:  102 GLTPFLLLYVLSGVMGNAFTFWLTPETVAAGASTSLFGLFAAIVVLSFLGKNQALKDLGK  161

Query:  154 SYQVMILLNLFFNIFTPGVSLAGHVGGLVGGVLVAIFLTKQNGSLLFKTWQSILALMIFI  213
            SYQ +I++NL  N+F P  VS+AGH+GG +VGG L++I    +     K   +LAL+  +
Sbjct:  162 SYQTLIVVNLLMNLFMPNVSMAGHIGGVVGGALLSIVFPTKMRVITVKKTKRMLALVSYG  221

Query:  214 IVSISLIGLSLV  225
            I+ +  ++ L  +
Sbjct:  222 IILVGVLVLGFL  233
```

A further corresponding DNA sequence was identified in *S. pyogenes* <SEQ ID 9083> which encodes the amino acid sequence <SEQ ID 9084>. Analysis of this protein sequence reveals the following:

```
Possible site: 52
>>> Seems to have an uncleavable N-term signal seq
INTEGRAL    Likelihood = -7.70    Transmembrane 12-28 (7-30)
----- Final Results -----
    bacterial membrane --- Certainty = 0.4079 (Affirmative) <succ>
       bacterial outside --- Certainty = 0.0000 (Not Clear) <succ>
         bacterial cytoplasm --- Certainty = 0.0000 (Not Clear) <succ>
```

An alignment of the GAS and GBS sequences follows:

```
Score = 74.5 bits (180), Expect = 5e-16
Identities = 37/96 (38%), Positives = 48/96 (49%)
Query:   1 MTQLLKRYPXXXXXXXXXXXXXXXAMQVVYGHLATGAQAIYQVGGMFGLLVKAMPDQLWRL   60
           M + K YP              MQ+ YG A  +Q I+Q GG+ G  +KA P  LWRL
Sbjct:   3 MKKFAKEYPTTVLLVSLTTLVFLLMQLTYGSQAESSQVIFQFGGIQGDYLKAYPTNLWRL   62

Query:  61 VTPXXXXXXXXXXXVNGLTLYFVGQIVEDLWGSRLF                           96
           ++P          +NGL LYFVGQ+ E +WGS F
Sbjct:  63 ISPIFVHIGWEHFLLNGLALYFVGQMGESIWGSLRF                           98
```

Based on this analysis, it was predicted that these proteins and their epitopes could be useful antigens for vaccines or diagnostics.

Example 271

A DNA sequence (GBSx0296) was identified in *S. agalactiae* <SEQ ID 867> which encodes the amino acid sequence <SEQ ID 868>. Analysis of this protein sequence reveals the following:

Possible site: 22
>>> Seems to have no N-terminal signal sequence
----- Final Results -----
    bacterial cytoplasm --- Certainty = 0.2055 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database:

```
>GP: BAA28715 GB: AB001562 hypothetical protein [Streptococcus mutans]
Identities = 96/173 (55%), Positives = 129/173 (74%)
Query:   1 MEKKLLRKEVLITLKSQPQAYKSEVDCKLLEAFIKTKAYQNSCVIATYLSFDYEYNTQLL   60
           M KK  R +V+ LK Q +A K    D +LLE  I+ +AYQ + VIATYL+F +E++T LL
Sbjct:   1 MMKKDYRTQVIEDLKKQDKAKKVLRDEQLLEELIQLEAYQKAHVIATYLAFPPFEFDTSLL   60

Query:  61 IKQALCDGKRVLVPKTYPKGKMIFVDYQKDNLRTTPFGLLEPVNDRAVEKASIDLIHVPG  120
           I+QA  D K ++VPKTYP+ KMIFV Y+   +L+ T FGL EP ++ A+EK++IDLIHVPG
Sbjct:  61 IEQAQRDNKSIVVPKTYPQRKMIFVVYDEADLQITKEGLKEPRSEEALEKSAIDLIHVPG  120

Query: 121 LIFNNKGFRIGYGAGYFDRYLSDFEGDTISTIYRCQRQDFVEEKHDVAVKEVL         173
           L FNN+G+RIG+GAGY+D+YL+DF+GDT+STIY  Q+  F     D+ VKEVL
Sbjct: 121 LAFNNEGYRIGFGAGYYDQYLADFQGDTVSTIYSFQQFTFEPSFFDIPVKEVL         173
```

A related GBS nucleic acid sequence <SEQ ID 10925> which encodes amino acid sequence <SEQ ID 10926> was also identified.

No corresponding DNA sequence was identified in *S. pyogenes*.

Based on this analysis, it was predicted that these proteins and their epitopes could be useful antigens for vaccines or diagnostics.

Example 272

A DNA sequence (GBSx0297) was identified in *S. agalactiae* <SEQ ID 869> which encodes the amino acid sequence <SEQ ID 870>. Analysis of this protein sequence reveals the following:

Possible site: 43
>>> Seems to have no N-terminal signal sequence
INTEGRAL    Likelihood = −1.44    Transmembrane 161-177 (161-177)
INTEGRAL    Likelihood = −0.22    Transmembrane 29-45 (28-45)
----- Final Results -----
    bacterial membrane --- Certainty = 0.1574 (Affirmative) <succ>
    bacterial outside --- Certainty = 0.0000 (Not Clear) <succ>
    bacterial cytoplasm --- Certainty = 0.0000 (Not Clear) <succ>

A related GBS nucleic acid sequence <SEQ ID 9305> which encodes amino acid sequence <SEQ ID 9306> was also identified.

The protein has homology with the following sequences in the GENPEPT database:

```
>GP: AAD33517 GB: AF132127 glucose-6-phosphate isomerase
[Streptococcus mutans]
Identities = 344/401 (85%), Positives = 374/401 (92%)
Query:   1 MDLPENYDKEEFSRIQKAAEKIKSDSEVLVVIGIGGSYLGAKAAIDFLNNHFANLQTAEE   60
           ++LP+NYDKEEF+RI+KAAEKIKSDSEVLVVIGIGGSYLGA+AAIDFLN+ F NL+   EE
Sbjct:  49 LNLPQNYDKEEFARIKKAAEKIKSDSEVLVVIGIGGSYLGARAAIDFLNSSFVNLENKEE  108

Query:  61 RKAPQILYAGNSISSTYLADLVEYVQDKEFSVNVISKSGTTTEPAIAFRVFKELLVKKYG  120
           RKAPQILYAGNSISS YLADLV+YV DK+FSVNVISKSGTTTEPAIAFRVFK+LLVKKYG
Sbjct: 109 RKAPQILYAGNSISSNYLADLVDYVADKDFSVNVISKSGTTTEPAIAFRVFKDLLVKKYG  168

Query: 121 QEEANKRIYATTDKVKGAVKVEADANNWETFVVPDNVGGRFSVLTAVGLLPIAASGADIT  180
           QEEAN+RIYATTD+VKGAVKVEADAN WETFVVPD+VGGRF+VLTAVGLLPIAASGAD+
Sbjct: 169 QEEANQRIYATTDRVKGAVKVEADANGWETFVVPDSVGGRFTVLTAVGLLPIAASGADLD  228
```

```
Query:   181 ALMEGANAARKDLSSDKISENIAYQYAAVRNVLYRKGYITEILANYEPSLQYFGEWWKQL  240
             LM GA AAR+D SS ++SEN AYQYAA+RN+LYRKGY+TE+LANYEPSLQYF EWWKQL
Sbjct:   229 QLMAGAEEAARQDYSSAELSENEAYQYAAIRNILYRKGYVTEVLANYEPSLQYFSEWWKQL  288

Query:   241 AGESEGKDQKGIYPTSANFSTDLHSLGQFIQEGYRNLFETVVRVEKPRKNVTIPELTEDL   300
             AGESEGKDQKGIYPTSANFSTDLHSLGQFIQEG RNLFETV+RVEK RKN+ +PE  EDL
Sbjct:   289 AGESEGKDQKGIYPTSANFSTDLHSLGQFIQEGNRNLFETVIRVEKARKNILVPEAAEDL  348

Query:   301 DGLGYLQGKDVDFVNKKATDGVLLAHTDGGVPNMFVTLPTQDAYTLGYTIYFFELAIGLS  360
             DGL YLQGKDVDFVNKKATDGVLLAHTDGGVPN F+T+P QD +TLGY IYFFELAIGLS
Sbjct:   349 DGLAYLQGKDVDFVNKKATDGVLLAHTDGGVPNTFLTIPEQDEFTLGYVIYFFELAIGLS  408

Query:   361 GYLNSVNPFDQPGVEAYKRNMFALLGKPGFEELSAELNARL                    401
             GYLN VNPFDQPGVEAYK+NMFALLGKPGFEEL AELNARL
Sbjct:   409 GYLNGVNPFDQPGVEAYKKNMFALLGKPGFEELGAELNARL                    449
```

A related DNA sequence was identified in *S. pyogenes* <SEQ ID 871> which encodes the amino acid sequence <SEQ ID 872>. Analysis of this protein sequence reveals the following:

```
Possible site: 31
>>> Seems to have no N-terminal signal sequence
INTEGRAL    Likelihood = -1.44    Transmembrane 209-225 (209-225)
INTEGRAL    Likelihood = -0.22    Transmembrane 77-93 (76-93)
----- Final Results -----
   bacterial membrane --- Certainty = 0.1574 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP: AAD33517 GB: AF132127 glucose-6-phosphate isomerase
[Streptococcus mutans]
Identities = 369/449 (820), Positives = 408/449 (90.%)
Query:     1 MSHITFDYSKVLESFAGQHEIDFLQGQVTEADKLLREGTGPGSDFLGWLDLPENYDKDEF   60
             M+HI FDYSKVL F   HE+D++Q QVT AD+ LR+GTGPG++  GWL+LP+NYDK EF
Sbjct:     1 MTHIKFDYSKVLGKFLASHELDYIQMQVTAADEALRKGTGPGAEMTGWLNLPQNYDKEEF   60

Query:    61 ARILTAAEKIKADSEVLVVIGIGGSYLGAKAAIDFLNHHFANLQTAKERKAPQILYAGNS  120
             ARI  AAEKIK+DSEVLVVIGIGGSYLGA+AAIDFLN   F NL+  +ERKAPQILYAGNS
Sbjct:    61 ARIKEAAEKIKSDSEVLVVIGIGGSYLGARAAIDFLNSSFVNLENKEERKAPQILYAGNS  120

Query:   121 ISSTYLADLVEYVQDKEFSVNVISKSGTTTEPAIAFRVFKELLVKKYGQEEANKRIYATT  180
             ISS YLADLV+YV DK+FSVNVISKSGTTTEPAIAFRVFK+LLVKKYGQEEAN+RIYATT
Sbjct:   121 ISSNYLADLVDYVADKDFSVNVISKSGTTTEPAIAFRVFKDLLVKKYGQEEANQRIYATT  180

Query:   181 DKVKGAVKVEADANNWETFVVPDNVGGRFSVLTAVGLLPIAASGADITALMEGANAARKD  240
             D+VKGAVKVEADAN WETFVVPD+VGGRF+VLTAVGLLPIAASGAD+  LM GA AAR+D
Sbjct:   181 DRVKGAVKVEADANGWETFVVPDSVGGRFTVLTAVGLLPIAASGADLDQLMAGAEAARQD  240

Query:   241 LSSDKISENIAYQYAAVRNVLYRKGYITEILANYEPSLQYFGEWWKQLAGESEGKDQKGI  300
                SS ++SEN AYQYAA+RN+LYRKGY+TE+LANYEPSLQYF EWWKQLAGESEGKDQKGI
Sbjct:   241 YSSAELSENEAYQYAAIRNILYRKGYVTEVLANYEPSLQYFSEWWKQLAGESEGKDQKGI  300

Query:   301 YPTSANFSTDLHSLGQFIQEGYRNLFETVIRVDNPRKNVIIPELAEDLDGLGYLQGKDVD  360
             YPTSANFSTDLHSLGQFIQEG RNLFETVIRV+  RKN+++PE AEDLDGL YLQGKDVD
Sbjct:   301 YPTSANFSTDLHSLGQFIQEGNRNLFETVIRVEKARKNILVPEAAEDLDGLAYLQGKDVD  360

Query:   361 FVNKKATDGVLLAHTDGGVFNMFVTLPAQDEFTLGYTIYFFELAIAVSGYMNAVNPFDQP  420
             FVNKKATDGVLLAHTDGGVPN F+T+P QDEFTLGY IYFFELAI +SGY+N VNPFDQP
Sbjct:   361 FVNKKATDGVLLAHTDGGVPNTFLTIPEQDEFTLGYVIYFFELAIGLSGYLNGVNPFDQP  420

Query:   421 GVEAYKRNMFALLGKPGFEALSAELNARL                                449
             GVEAYK+NMFALLGKPGFE L AELNARL
Sbjct:   421 GVEAYKKNMFALLGKPGFEELGAELNARL                                449
```

The protein has homology with the following sequences in the databases:

```
>GP: CAB90755 GB: AJ400707 hypothetical protein [Streptococcus
uberis]
Identities = 58/91 (63%), Positives = 69/91 (75%)
Query:   6 KRYPITIFLLGLTGLIFIAMQVVYGHLATGAQAIYQVGGMFGLLVKAMPDQLWRLVTPIF  65
           K  P+T F L +T L+FI MQV YG A    Q ++Q GGMFGL+VK+MP QLWRLVTPIF
Sbjct:   5 KEKPVTFFFLSVTILLFIVMQVFYGSWAKSPQVVFQFGGMFGLVVKSMPSQLWRLVTPIF  64

Query:  66 IHIGFGHFFVNGLTLYFVGQIVEDLWGSRLF                              96
           IHIG+ HF +N LTLYFVGQ+ E +WGSR F
Sbjct:  65 IHIGWEHFLINSLTLYFVGQLAESIWGSRFF                              95
```

An alignment of the GAS and GBS proteins is shown below:

```
Identities = 380/401 (94%), Positives = 392/401 (96%)
Query:   1 MDLPENYDKEEFSRIQKAAEKIKSDSEVLVVIGIGGSYLGAKAAIDFLNNHFANLQTAEE   60
           +DLPENYDK+EF+RI   AAEKIK+DSEVLVVIGIGGSYLGAKAAIDFLN+HFANLQTA+E
Sbjct:  49 LDLPENYDKDEFARILTAAEKIKADSEVLVVIGIGGSYLGAKAAIDFLNHFANLQTAKE   108

Query:  61 RKAPQILYAGNSISSTYLADLVEYVQDKEFSVNVISKSGTTTEPATAFRVFKELLVKKYG  120
           RKAPQILYAGNSISSTYLADLVEYVQDKEFSVNVISKSGTTTEPAIAFRVFKELLVKKYG
Sbjct: 109 RKAPQILYAGNSISSTYLADLVEYVQDKEFSVNVISKSGTTTEPAIAFRVFKELLVKKYG  168

Query: 121 QEEANKRIYATTDKVKGAVKVEADANNWETFVVPDNVGGRFSVLTAVGLLPIAASGADIT  180
           QEEANKRIYATTDKVKGAVKVEADANNWETFVVPDNVGGRFSVLTAVGLLPIAASGADIT
Sbjct: 169 QEEANKRIYATTDKVKGAVKVEADANNWETFVVPDNVGGRFSVLTAVGLLPIAASGADIT  228

Query: 181 ALMEGANAARKDLSSDKISENIAYQYAAVRNVLYRKGYITEILANYEPSLQYFGEWWKQL  240
           ALMEGANAARKDLSSDKISENIAYQYAAVRNVLYRKGYITEILANYEPSLQYFGEWWKQL
Sbjct: 229 ALMEGANAARKDLSSDKISENIAYQYAAVRNVLYRKGYITEILANYEPSLQYFGEWWKQL  288

Query: 241 AGESEGKDQKGIYPTSANFSTDLHSLGQFIQEGYRNLFETVVRVEKPRKNVTIPELTEDL  300
           AGESEGKDQKGIYPTSANFSTDLHSLGQFIQEGYRNLFETV+RV+ PRKNV IPEL EDL
Sbjct: 289 AGESEGKDQKGIYPTSANFSTDLHSLGQFIQEGYRNLFETVIRVDNPRKNVIIPELAEDL  348

Query: 301 DGLGYLQGKDVDFVNKKATDGVLLAHTDGGVPNMFVTLPTQDAYTLGYTIYFFELAIGLS  360
           DGLGYLQGKDVDFVNKKATDGVLLAHTDGGVPNMFVTLP QD +TLGYTIYFFELAI +S
Sbjct: 349 DGLGYLQGKDVDFVNKKATDGVLLAHTDGGVPNMFVTLPAQDEFTLGYTIYFFELAIAVS  408

Query: 361 GYLNSVNPFDQPGVEAYKRNMFALLGKPGFEELSAELNARL                    401
           GY+N+VNPFDQPGVEAYKRNMFALLGKPGFE LSAELNARL
Sbjct: 409 GYMNAVNPFDQPGVEAYKRNMFALLGKPGFEALSAELNARL                    449
```

Based on this analysis, it was predicted that these proteins and their epitopes could be useful antigens for vaccines or diagnostics.

Example 273

A DNA sequence (GBSx0298) was identified in *S. agalactiae* <SEQ ID 873> which encodes the amino acid sequence <SEQ ID 874>. Analysis of this protein sequence reveals the following:

---

Possible site: 38
>>> Seems to have no N-terminal signal sequence
INTEGRAL    Likelihood = −2.66    Transmembrane 654-670 (653-671)
INTEGRAL    Likelihood = −1.65    Transmembrane 113-129 (113-129)
----- Final Results -----
  bacterial membrane --- Certainty = 0.2062 (Affirmative) <succ>
    bacterial outside --- Certainty = 0.0000 (Not Clear) <succ>
      bacterial cytoplasm --- Certainty = 0.0000 (Not Clear) <succ>

---

A related GBS nucleic acid sequence <SEQ ID 9463> which encodes amino acid sequence <SEQ ID 9464> was also identified.

The protein has homology with the following sequences in the GENPEPT database:

```
>GP: AAA81906 GB: U04863 alcohol dehydrogenase 2 [Entamoeba
histolytica]
Identities = 536/864 (62%), Positives = 663/864 (76%), Gaps = 3/864 (0%)
Query:  20 ETTDVALAIDTLVQNGLKALDEMR--QLNQEQVDYIVAKASVAALDAHGELALHAVEETG   77
           +T   V   I+ LV+   AL E   +  QE++DYIV KASVAALD H  LA  AVEETG
Sbjct:   5 QTMTVDEHINQLVRKAQVALKEYLKPEYTQEKIDYIVKKASVAALDQHCALAAAAVEETG   64

Query:  78 RGVFEDKATKNLFACEHVVNNMRHTKTVGVIEEDDVTGLTLIAEPVGVVCGITPTTNPTS  137
           RG+FEDKATKN+FACEHV + MRH KTVG+I  D + G+T IAEPVGVVCG+TP TNPTS
Sbjct:  65 RGIFEDKATKNIFACEHVTHEMRHAKTVGIINVDPLYGITEIAEPVGVVCGVTPVTNPTS  124

Query: 138 TAIFKSLISLKTRNPIIFAFHPSAQESSAHAARIVRDAAIAAGAPENCVQWIEQPSIDAT  197
           TAIFKSLIS+KTRNPI+F+FHPSA + S   AA+IVRDAAIAAGAPENC+QWIE   I+A+
Sbjct: 125 TAIFKSLISIKTRNPIVFSFHPSALKCSIMAAKIVRDAAIAAGAPENCIQWIEFGGIEAS  184

Query: 198 NALMNHDGIATILATGGNAMVKAAYSCGKPALGVGAGNVPAYVEKSANIRQAAHDIVMSK  257
           N LMNH G+ATILATGGNAMVKAAYS GKPALGVGAGNVP Y+EK+ NI+QAA+D+VMSK
Sbjct: 185 NKLMNHPGVATILATGGNAMVKAAYSSGKPALGVGAGNVPTYIEKTCNIKQAANDVVMSK  244

Query: 258 SFDNGMVCASEQAVIIDKEIYKEFVEEEKSYHTYFVNKKEKALLEEFCFGAKANSKNCAG  317
           SFDNGM+CASEQA IIDKEIY + VEE K+   YF+N++EKA LE+F FG   A S +
Sbjct: 245 SFDNGMICASEQAAIIDKEIYDQVVEEMKTLGAYFINEEEKAKLEKFMFGVNAYSADVNN  304

Query: 318 AKLNPNIVGKSAVWIAEQAGFTVPEGTNILAAECTEVSEKEPLTREKLSPVIAVLKAEST  377
           A+LNP   G S  W AEQ G  VPE  NI+ A C EV    EPLTREKLSPV+A+LKAE+T
Sbjct: 305 ARLNPKCPGMSPQWFAEQVGIKVPEDCNIICAVCKEVGPNEPLTREKLSPVLAILKAENT  364

Query: 378 EDGVEKARQMVEFNGLGHSAAIHTKDADLAREFGTRIRAIRVIWNSPSTFGGIGDVYNAF  437
           +DG++KA  MVEFNG GHSAAIH+ D  + ++  ++A R++ N+PS+ GGIG +YN
Sbjct: 365 QDGIDKAEAMVEFNGRGHSAAIHSNDKAVVEKYALTMKACRILHNTPSSQGGIGSIYNYI  424

Query: 438 LPSLTLGCGSYGRNSVGDNVSAINLLNIKKVGRRRNNMQWFKVPSKTYFERDSIQYLQKC  497
              PS TLGCGSYG NSV  NV+  NLLNIK++  RRNN+QWF+VP K +FE  SI+YL +
Sbjct: 425 WPSFTLGCGSYGGNSVSANVTYHNLLNIKRLADRRNNLQWFRVPPKIFFEPHSIRYLAEL  484

Query: 498 RDVERVMIVTDHAMVELGFLDRIIEQLDLRRNKVVYQIFAEVEPDPDITTVMKGTDLMRT  557
           +++ ++ IV+D M +LG++DR+++ L  R N+V  +IF +VEPDP I  TV KG  +M T
Sbjct: 485 KELSKIFIVSDRMMYKLGYVDRVMDVLKRRSNEVEIEIFIDVEPDPSIQTVQKGLAVMNT  544

Query: 558 FKPDTIIALGGGSPMDAAKVMWLFYEQPEVDFHDLVQKFMDIRKRAFKFPELGKKTKFVA  617
           F PD IIA+GGGS MDAAK+MWL YE PE DF  + QKF+D+RKRAFKFP +GKK + +
Sbjct: 545 FGPDNIIAIGGGSAMDAAKINWLLYEHPEADFFAMKQKFIDLRKRAFKFPTMGKKARLIC  604

Query: 618 IPTTSGTGSEVTPFAVISDKANNRKYPIADYSLTPTVAIVDPALVMTVPGFIAADTGMDV  677
           IPTTSGTGSEVTPFAVISD     +KYP+ADYSLTP+VAIVDP  M++P   ADTG+DV
Sbjct: 605 IPTTSGTGSEVTPFAVISDHETGKKYPLADYSLTPSVAIVDPMFTMSLPKRAIADTGLDV  664

Query: 678 LTHATEAYVSQMANDYTDGLALQAIKIVFDYLERSVKDADFEAREKMHNASTMAGMAFAN  737
           L HATEAYVS MAN+YTDGLA +A+K+VF+ L +S    + D EAREKMHNA+T+AGMAFA+
Sbjct: 665 LVHATEAYVSVMANEYTDGLAREAVKLVFENLLKSY-NGDLEAREKMHNAATIAGMAFAS  723

Query: 738 AFLGISHSMAHKIGAQFHTVHGRTNAILLPYVIRYNGTRPAKTATWPKYNYYRADEKYQD  797
           AFLG+ HSMAHK+GA FH  HGR  A+LLP+VIRYNG +P K A WPKYN+Y+AD++Y +
Sbjct: 724 AFLGMDHSMAHKVGAAFHLPHGRCVAVLLPHVIRYNGQKPRKLAMWPKYNFYKADQRYME  783

Query: 798 IAKLLGLPAATPEEAVESYAKAVYDLGTRLGIKMNFRDQGIDEKEWKEKSRELAFLAYED  857
           +A+++GL   TP E VE++AKA  +L           F+   IDE W K  E+A LA+ED
Sbjct: 784 LAQMVGLKCNTPAEGVEAFAKACEELMKATETITGFKKANIDEAAWMSKVPEMALLAFED  843

Query: 858 QCSPANPRLPMVDHMQEIIEDAYY                                     881
           QCSPANPR+PMV  M++I++ AYY
Sbjct: 844 QCSPANPRVPMVKDMEKILKAAYY                                     867
```

A related DNA sequence was identified in *S. pyogenes* <SEQ ID 875> which encodes the amino acid sequence <SEQ ID 876>. Analysis of this protein sequence reveals the following:

Possible site: 55
>>> Seems to have no N-terminal signal sequence
INTEGRAL    Likelihood = −3.66    Transmembrane 643-659 (642-660)
INTEGRAL    Likelihood = −1.81    Transmembrane 102-118 (102-118)
----- Final Results -----
  bacterial membrane --- Certainty = 0.2466 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP: AAA81906 GB: U04863 alcohol dehydrogenase 2 [Entamoeba
histolytica]
```

-continued

```
Identities = 535/870 (61%), Positives = 669/870 (76%), Gaps = 3/870 (0%)
Query:    6 NTVETTSVSVTIDALVQKGLAALEEMRKLD--QEQVDYIVAKASVAALDAHGELAKHAYE   63
            +T +T +V   I+ LV+K    AL+E K +  QE++DYIV KASVAALD H  LA   A E
Sbjct:    2 STQQTMTVDEHINQLVRKAQVALKEYLKPEYTQEKIDYIVKKASVAALDQHCALAAAAVE   61

Query:   64 ETGRGVFEDKATKHLFACEHVVNNMRHQKTVGIIEEDDVTGLTLIAEPVGVICGITPTTN  123
            ETGRG+FEDKATK++FACEHV + MRH KTVGII  D + G+T IAEPVGV+CG+TP TN
Sbjct:   62 ETGRGIFEDKATKNIFACEHVTHEMRHAKTVGIINVDPLYGITEIAEPVGVVCGVTPVTN  121

Query:  124 PTSTAIFKSLISLKTRNPIIFAFHPSAQESSAHAARIVRDAAIAAGAPENCVQWVETPSL  183
            PTSTAIFKSLIS+KTRNPI+F+FHPSA + S   AA+IVRDAAIAAGAPENC+QW+E    +
Sbjct:  122 PTSTAIFKSLISIKTRNPIVFSFHPSALKCSIMAAKIVRDAAIAAGAPENCIQWIEFGGI  181

Query:  184 EATNALMNHDGIATILATGGNAMVKAAYSCGKPALGVGAGNVPAYVEKSANIRQAAHDIV  243
            EA+N LMNH G+ATILATGGNAMVKAAYS GKPALGVGAGNVP Y+EK+ NI+QAA+D+V
Sbjct:  182 EASNKLMNHPGVATILATGGNAMVKAAYSSGKPALGVGAGNVPTYIEKTCNIKQAANDVV  241

Query:  244 MSKSFDNGMVCASEQAVIIDKEIYDDFVAEFKSYHTYFVNKKEKALLEEFCFGAKANSKN  303
            MSKSFDNGM+CASEQA IIDKEIYD  V E K+   YF+N++EKA LE+F FG A S +
Sbjct:  242 MSKSFDNGMICASEQAAIIDKEIYDQVVEEMKTLGAYFINEEEKAKLEKFMFGVNAYSAD  301

Query:  304 CAGAKLNPNIVGKPATWIAEQAGFTVPEGTNILAAECKEVSENEPLTREKLSPVIAVLKS  363
                 A+LNP    G     W AEQ G  VPE NI+ A CKEV  NEPLTREKLSPV+A+LK+
Sbjct:  302 VNNARLNPKCPGMSPQWFAEQVGIKVPEDCNIICAVCKEVGPNEPLTREKLSPVLAILKA  361

Query:  364 ESREDGVEKARQMVEFNGLGHSAAIHTADAELAKEFGTRIRAIRVIWNSPSTFGGIGDVY  423
            E+ +DG++KA  MVEFNG GHSAAIH+ D  + +++    ++A R++ N+PS+ GGIG +Y
Sbjct:  362 ENTQDGIDKAEAMVEFNGRGHSAAIHSNDKAVVEKYALTMKACRILHNTPSSQGGIGSIY  421

Query:  424 NAFLPSLTLGCGSYGRNAVGDNVSAINLLNIKKVGRRRNNMQWFKVPSKTYFERDSIQYL  483
            N     PS TLGCGSYG N+V  NV+  NLLNIK++   RRNN+QWF+VP K +FE  SI+YL
Sbjct:  422 NYIWPSFTLGCGSYGGNSVSANVTYHNLLNIKRLADRRNNLQWFRVPPKIFFEPHSIRYL  481

Query:  484 QKCRDVERVMIVTDHAMVELGFLDRIIEQLDLRRNKVVYQIFAEVEPDPDITTVMKGTEL  543
            + +++ ++   IV+D  M +LG++DR+++   L  R N+V   +IF +VEPDP I  TV KG  +
Sbjct:  482 AELKELSKIFIVSDRMMYKLGYVDRVMDVLKRRSNEVEIEIFIDVEPDPSIQTVQKGLAV  541

Query:  544 MRTFKPDTIIALGGGSPMDAAKVMWLFYEQPEVDFHDLVQKFMDIRKRAFKPELGKKTK  603
            M TF PD  IIA+GGGS MDAAK+MWL YE PE DF  + QKF+D+RKRAFKFP +GKK +
Sbjct:  542 MNTFGPDNIIAIGGGSAMDAAKIMWLLYEHPEADFFAMKQKFIDLRKRAFKFPTMGKKAR  601

Query:  604 FVAIPTTSGTGSEVTPFAVISDKANNRKYPIADYSLTPTVAIVDPALVLTVPGFIAADTG  663
             +  IPTTSGTGSEVTPFAVISD    +KYP+ADYSLTP+VAIVDP    +++P     ADTG
Sbjct:  602 LICIPTTSGTGSEVTPFAVISDHETGKKYPLADYSLTPSVAIVDPMFTMSLPKRAIADTG  661

Query:  664 MDVLTHATEAYVSQMANDFTDGLALQAIKIVFDNLEKSVKTADFEAREKMHNASTMAGMA  723
            +DVL HATEAYVS MAN++TDGLA  +A+K+VF+NL KS     D EAREKMHNA+T+AGMA
Sbjct:  662 LDVLVHATEAYVSVMANEYTDGLAREAVKLVFENLLKSY-NGDLEAREKMHNAATIAGMA  720

Query:  724 FANAFLGISHSMAHKIGAQFHTVHGRTNAILLPYVIRYNGTRPAKTATWPKYNYYRADEK  783
            FA+AFLG+ HSMAHK+GA FH  HGR  A+LLP+VIRYNG +P K A WPKYN+Y+AD++
Sbjct:  721 FASAFLGMDHSMAHKVGAAFHLPHGRCVAVLLPHVIRYNGQPRKLAMWPKYNFYKADQR  780

Query:  784 YQDIAKLLGLPASTPEEAVESYAKAVYDLGCRVGIQMNFKAQGIDENEWKEHSRELAYLA  843
            Y  ++A+++GL +TP E VE++AKA  +L        FK   IDE  W    E+A LA
Sbjct:  781 YMELAQMVGLKCNTPAEGVEAFAKACEELMKATETITGFKKANIDEAAWMSKVPEMALLA  840

Query:  844 YEDQCSPANPRLPMVDHMQEIIEDAYYGYA                              873
            +EDQCSPANPR+PMV  M++I++  AYY  A
Sbjct:  841 FEDQCSPANPRVPMVKDMEKILKAAYYPIA                              870
```

An alignment of the GAS and GBS proteins is shown below:

```
Identities = 827/880 (93%), Positives = 852/880 (950)
Query:   12 MTEKTKAVETTDVALAIDTLVQNGLKALDEMRQLNQEQVDYIVAKASVAALDAHGELALH   71
            MTE    VETT V++ ID LVQ GL AL+EMR+L+QEQVDYIVAKASVAALDAHGELA H
Sbjct:    1 MTEGHNTVETTSVSVTIDALVQKGLAALEEMRKLDQEQVDYIVAKASVAALDAHGELAKH   60

Query:   72 AVEETGRGVFEDKATKNLFACEHVVNNMRHTKTVGVIEEDDVTGLTLIAEPVGVVCGITP  131
            A EETGRGVFEDKATK+LFACEHVVNNMRH KTVG+IEEDDVTGLTLIAEPVGV+CGITP
Sbjct:   61 AYEETGRGVFEDKATKHLFACEHVVNNMRHQKTVGIIEEDDVTGLTLIAEPVGVICGITP  120

Query:  132 TTNPTSTAIFKSLISLKTRNPIIFAFHPSAQESSAHAARIVRDAAIAAGAPENCVQWIEQ  191
            TTNPTSTAIFKSLISLKTRNPIIFAFHPSAQESSAHAARIVRDAAIAAGAPENCVQW+E
Sbjct:  121 TTNPTSTAIFKSLISLKTRNPIIFAFHPSAQESSAHAARIVRDAAIAAGAPENCVQWVET  180
```

-continued

```
Query:    192 PSIDATNALMNHDGIATILATGGNAMVKAAYSCGKPALGVGAGNVPAYVEKSANIRQAAH  251
              PS++ATNALMNHDGIATILATGGNAMVKAAYSCGKPALGVGAGNVPAYVEKSANIRQAAH
Sbjct:    181 PSLEATNALMNHDGIATILATGGNAMVKAAYSCGKPALGVGAGNVPAYVEKSANIRQAAH  240

Query:    252 DIVMSKSFDNGMVCASEQAVIIDKEIYKEFVEEFKSYHTYFVNKKEKALLEEFCFGAKAN  311
              DIVMSKSFDNGMVCASEQAVIIDKEIY +FV EFKSYHTYFVNKKEKALLEEFCFGAKAN
Sbjct:    241 DIVMSKSFDNGMVCASEQAVIIDKEIYDDFVAEFKSYHTYFVNKKEKALLEEFCFGAKAN  300

Query:    312 SKNCAGAKLNPNIVGKSAVWIAEQAGFTVPEGTNILAAECTEVSEKEPLTREKLSPVIAV  371
              SKNCAGAKLNPNIVGK A WIAEQAGFTVPEGTNILAAEC EVSE EPLTREKLSPVIAV
Sbjct:    301 SKNCAGAKLNPNIVGKPATWIAEQAGFTVPEGTNILAAECKEVSENEPLTREKLSPVIAV  360

Query:    372 LKAESTEDGVEKARQMVEFNGLGHSAAIHTKDADLAREFGTRIRAIRVIWNSPSTFGGIG  431
              LK+ES EDGVEKARQMVEFNGLGHSAAIHT DA+LA+EFGTRIRAIRVIWNSPSTFGGIG
Sbjct:    361 LKSESREDGVEKARQMVEFNGLGHSAAIHTADAELAKEFGTRIRAIRVIWNSPSTFGGIG  420

Query:    432 DVYNAFLPSLTLGCGSYGRNSVGDNVSAINLLNIKKVGRRRNNMQWFKVPSKTYFERDSI  491
              DVYNAFLPSLTLGCGSYGRN+VGDNVSAINLLNIKKVGRRRNNMQWFKVPSKTYFERDSI
Sbjct:    421 DVYNAFLPSLTLGCGSYGRNAVGDNVSAINLLNIKKVGRRRNNMQWFKVPSKTYFERDSI  480

Query:    492 QYLQKCRDVERVMIVTDHAMVELGFLDRIIEQLDLRRNKVVYQIFAEVEPDPDITTVMKG  551
              QYLQKCRDVERVMIVTDHAMVELGFLDRIIEQLDLRRNKVVYQIFAEVEPDPDITTVMKG
Sbjct:    481 QYLQKCRDVERVMIVTDHAMVELGFLDRIIEQLDLRRNKVVYQIFAEVEPDPDITTVMKG  540

Query:    552 TDLMRTFKPDTIIALGGGSPMDAAKVMWLFYEQPEVDFHDLVQKFMDIRKRAFKFPELGK  611
              T+LMRTFKPDTIIALGGGSPMDAAKVMWLFYEQPEVDFHDLVQKFMDIRKRAFKFPELGK
Sbjct:    541 TELMRTFKPDTIIALGGGSPMDAAKVMWLFYEQPEVDFHDLVQKFMDIRKRAFKFPELGK  600

Query:    612 KTKFVAIPTTSGTGSEVTPFAVISDKANNRKYPIADYSLTPTVAIVDPALVMTVPGFIAA  671
              KTKFVAIPTTSGTGSEVTPFAVISDKANNRKYPIADYSLTPTVAIVDPALV+TVPGFIAA
Sbjct:    601 KTKFVAIPTTSGTGSEVTPFAVISDKANNRKYPIADYSLTPTVAIVDPALVLTVPGFIAA  660

Query:    672 DTGMDVLTHATEAYVSQMANDYTDGLALQAIKIVFDYLERSVKDADFEAREKMHNASTMA  731
              DTGMDVLTHATEAYVSQMAND+TDGLALQAIKIVFD LE+SVK ADFEAREKMHNASTMA
Sbjct:    661 DTGMDVLTHATEAYVSQMANDFTDGLALQAIKIVFDNLEKSVKTADFEAREKMHNASTMA  720

Query:    732 GMAFANAFLGISHSMAHKIGAQFHTVHGRTNAILLPYVIRYNGTRPAKTATWPKYNYYRA  791
              GMAFANAFLGISHSMAHKIGAQFHTVHGRTNAILLPYVIRYNGTRPAKTATWPKYNYYRA
Sbjct:    721 GMAFANAFLGISHSMAHKIGAQFHTVHGRTNAILLPYVIRYNGTRPAKTATWPKYNYYRA  780

Query:    792 DEKYQDIAKLLGLPAATPEEAVESYAKAVYDLGTRLGIKMNFRDQGIDEKEWKEKSRELA  851
              DEKYQDIAKLLGLPA+TPEEAVESYAKAVYDLG R+GI+MNF+ QGIDE EWKE SRELA
Sbjct:    781 DEKYQDIAKLLGLPASTPEEAVESYAKAVYDLGCRVGIQMNFKAQGIDENEWKEHSRELA  840

Query:    852 FLAYEDQCSPANPRLPMVDHMQEIIEDAYYGYEERPGRRK                     891
              +LAYEDQCSPANPRLPMVDHMQEIIEDAYYGY ERPGRRK
Sbjct:    841 YLAYEDQCSPANPRLPMVDHMQEIIEDAYYGYAERPGRRK                     880
```

A related GBS gene <SEQ ID 8533> and protein <SEQ ID 8534> were also identified. Analysis of this protein sequence reveals the following:

---

Lipop: Possible site: −1   Crend: 10
McG: Discrim Score: −4.68
GvH: Signal Score (−7.5): −2.48
Possible site: 21
>>> Seems to have no N-terminal signal sequence
ALOM program   count: 1 value: −2.66 threshold: 0.0
INTEGRAL         Likelihood = −2.66    Transmembrane 100-116 (99-117)
PERIPHERAL    Likelihood = 3.61      173
modified ALOM score: 1.03
*** Reasoning Step: 3
----- Final Results -----
   bacterial membrane --- Certainty = 0.2062 (Affirmative) <succ>
    bacterial outside --- Certainty = 0.0000 (Not Clear) <succ>
      bacterial cytoplasm --- Certainty = 0.0000 (Not Clear) <succ>

---

SEQ ID 8534 (GBS432) was expressed in *E. coli* as a GST-fusion product. SDS-PAGE analysis of total cell extract is shown in FIG. 173 (lane 5; MW 66 kDa). It was also expressed in *E. coli* as a His-fusion product. SDS-PAGE analysis of total cell extract is shown in FIG. 77 (lane 7; MW 41 kDa).

Figure 223:
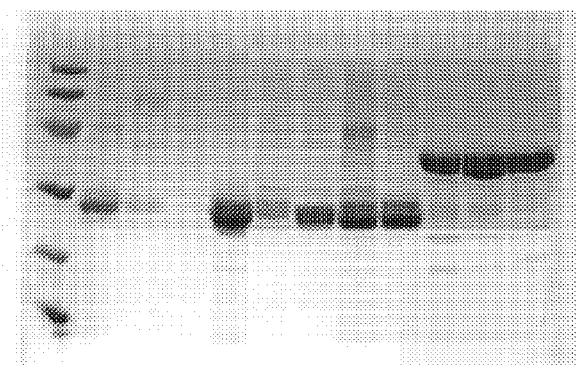

GBS432-GST was purified as shown in FIG. 223, lane 9.

Based on this analysis, it was predicted that these proteins and their epitopes could be useful antigens for vaccines or diagnostics.

Example 274

A DNA sequence (GBSx0299) was identified in *S. agalactiae* <SEQ ID 877> which encodes the amino acid sequence <SEQ ID 878>. Analysis of this protein sequence reveals the following:

---

Possible site: 21
>>> Seems to have no N-terminal signal sequence
----- Final Results -----
   bacterial cytoplasm --- Certainty = 0.3444 (Affirmative) <succ>
    bacterial membrane --- Certainty = 0.0000 (Not Clear) <succ>
      bacterial outside --- Certainty = 0.0000 (Not Clear) <succ>

---

The protein has no significant homology with any sequences in the GENPEPT database, but there is homology to SEQ ID 880.

Based on this analysis, it was predicted that this protein and its epitopes, could be useful antigens for vaccines or diagnostics.

Example 275

A DNA sequence (GBSx0300) was identified in *S. agalactiae* <SEQ ID 881> which encodes the amino acid sequence <SEQ ID 882>. Analysis of this protein sequence reveals the following:

```
Possible site: 26
>>> Seems to have a cleavable N-term signal seq.
INTEGRAL    Likelihood = -8.39    Transmembrane 74-90 (69-94)
INTEGRAL    Likelihood = -5.31    Transmembrane 168-184 (163-186)
INTEGRAL    Likelihood = -4.83    Transmembrane 34-50 (29-52)
INTEGRAL    Likelihood = -0.75    Transmembrane 202-218 (202-219)
----- Final Results -----
    bacterial membrane --- Certainty = 0.4354 (Affirmative) <succ>
    bacterial outside --- Certainty = 0.0000 (Not Clear) <succ>
        bacterial cytoplasm --- Certainty = 0.0000 (Not Clear) <succ>
```

```
Possible site: 46
>>> Seems to have an uncleavable N-term signal seq
INTEGRAL    Likelihood = -10.83   Transmembrane 325-341 (313-346)
INTEGRAL    Likelihood = -9.29    Transmembrane 237-253 (234-258)
INTEGRAL    Likelihood = -7.91    Transmembrane 166-182 (162-188)
INTEGRAL    Likelihood = -6.10    Transmembrane 72-88 (68-92)
INTEGRAL    Likelihood = -4.09    Transmembrane 264-280 (260-281)
INTEGRAL    Likelihood = -2.87    Transmembrane 371-387 (370-390)
INTEGRAL    Likelihood = -2.66    Transmembrane 34-50 (32-50)
INTEGRAL    Likelihood = -1.91    Transmembrane 3-19 (3-19)
INTEGRAL    Likelihood = -0.85    Transmembrane 136-152 (136-154)
----- Final Results -----
    bacterial membrane --- Certainty = 0.5331 (Affirmative) <succ>
    bacterial outside --- Certainty = 0.0000 (Not Clear) <succ>
        bacterial cytoplasm --- Certainty = 0.0000 (Not Clear) <succ>
```

The protein has homology with the following sequences in the GENPEPT database:

```
>GP: CAA17305 GB: AL021926 hypothetical protein Rv0111 [Mycobacterium
tuberculosis]
Identities = 70/218 (32%), Positives = 104/218 (47%), Gaps = 12/218 (5%)
Query:     9 VRITGLLLVLLYHFFKNSFPGGFVGVDIFFTFSGFLITALLIDEFSKTKKIDFVSFCRRR       68
             +R  + LVL H        GGF+GVD FF  SGFLIT+LL+DE  +T +ID    F  RR
Sbjct:    39 LRAIAVALVLASHGGIPGMGGGFIGVDAFFVLSGFLITSLLLDELGRTGRIDLSGFWIRR      98

Query:    69 FYRIFPPLVLMVLVTIPFVFLVKSDFRASIGSQIMTALGFTSNFYEILTGGNYESQFI-P     127
             R+  P LVLMVL     L     + S  +A  +T+N+  +     +Y  +Q    P
Sbjct:    99 ARRLLPALVLMVLTVSAARALFPDQALTGLRSDAIAAFLWTANWRFVAQNTDYFTQGAPP     158

Query:   128 HLFVHTWSLSIEVHFYVLWGL----TVWLLSKRSKDQKQLRGTLFLISMGIFGVSFLTMF     183
               HTWSL +E  +YV+W L      LL+ R++ ++  R T+  +    F ++ L
Sbjct:   159 SPLQHTWSLGVEEQYYVVWPLLLIGATLLLAARAR-RRCRRATVGGVRFAAFLIASLGTM     217

Query:   184 VRAFFVDNFST------IYFSTLSHIFPFFLGAMVATI                          215
                 A    F++      IYF T +     +G+  A +
Sbjct:   218 ASATAAVAFTSAATRDRIYFGTDTRAQALLIGSAAAAL                          255
```

A related DNA sequence was identified in *S. pyogenes* <SEQ ID 879> which encodes the amino acid sequence <SEQ ID 880>. Analysis of this protein sequence reveals the following:

An alignment of the GAS and GBS proteins is shown below:

```
Identities = 167/226 (73%), Positives = 195/226 (85%)

Query:     1 MRIKWFSLVRITGLLLVLLYHFFKNSFPGGFVGVDIFFTFSGFLITALLIDEFSKTKKID      60
             MRIKWFS VR+TGLLLVLLYHFFKN FPGGF+GVDIFFTFSG+LITALLIDE++K + ID
Sbjct:     1 MRIKWFSFVRVTGLLLVLLYHFFKNVFPGGFIGVDIFFTFSGYLITALLIDEYTKKESID     60

Query:    61 FVSFCRRRFYRIFPPLVLMVLVTIPFVFLVKSDFRASIGSQIMTALGFTSNFYEILTGGN    120
              +  F +RRFYRI PPLVLM+L+TIPF FL+K DF A+IGSQI   LGFT+N YEILTG +
Sbjct:    61 IIGFLKRRFYRIVPPLVLMILLTIPFTFLIKKDFIANIGSQITAVLGFTTNIYEILTGSS    120

Query:   121 YESQFIPHLFVHTWSLSIEVHFYVLWGLTVWLLSKRSKDQKQLRGTLFLISMGIFGVSFL    180
             YESQFIPHLFVHTWSL+IEVHFY+ WG+ VWLL++R + QKQLRG LFLIS+GIF +SFL
Sbjct:   121 YESQFIPHLFVHTWSLAIEVHFYLFWGVFVWLLARRKETQKQLRGLLFLISLGIFAISFL    180

Query:   181 TMFVRAFFVDNFSTIYFSTLSHIFPFFLGAMVATISGIREITGRFK                 226
             +MF+R+F   NFS  IYFS+LSH FPFFLGAM ATI+GI E T RF+
Sbjct:   181 SMFIRSFMTSNFSLIYFSSLSHSFPFFLGAMFATITGINETTVRFQ                 226
```

Based on this analysis, it was predicted that these proteins and their epitopes could be useful antigens for vaccines or diagnostics.

Example 276

A DNA sequence (GBSx0302) was identified in *S. agalactiae* <SEQ ID 883> which encodes the amino acid sequence <SEQ ID 884>. Analysis of this protein sequence reveals the following:

Possible site: 38
>>> Seems to have a cleavable N-term signal seq.

-continued

```
----- Final Results -----
  bacterial outside --- Certainty = 0.3000 (Affirmative) <succ>
  bacterial membrane --- Certainty = 0.0000 (Not Clear) <succ>
  bacterial cytoplasm --- Certainty = 0.0000 (Not Clear) <succ>
```

The protein has homology with the following sequences in the GENPEPT database:

```
!GB: AE004818 hypothetical protein [Pseudomonas aerug . . .
!GB: AE004818 hypothetical protein [Pseudomonas aerug . . .
!GB: AE004818 hypothetical protein [Pseudomonas aerug . . .
!GB: AE004818 hypothetical protein [Pseudomonas aerug . . .
!GB: AE004818 hypothetical protein [Pseudomonas aerug . . .
>GP: AAG07403 GB: AE004818 hypothetical protein [Pseudomonas aeruginosa]
Identities = 33/80 (41%), Positives = 50/80 (62%)
Query:   45 KYVGSIVNHHMTGKGKLTYENGDYYKGDFVNGVFEGKGTFVSVHGWSYTGDFKKGQPDGQ 104
            +Y G +V+  + G+G+L Y+NG +Y G F +G+  G GT+     G  Y+G F  G DGQ
Sbjct:   39 RYRGELVDGRLEGQGRLDYDNGAWYAGRFEHGLLHGHGTWQGADGSRYSGGFAAGLFDGQ  98

Query:  105 GRLNAKNKKVYKGTFKQGIY                                         124
            GRL    +  VY+G F+QG++
Sbjct:   99 GRLAMADGSVYQGGFRQGLF                                         118

Identities = 31/91 (34%), Positives = 46/91 (50%), Gaps = 2/91 (2%)
Query:   34 QGVFSYDGGKIKYVGSIVNHHMTGKGKLTYENGDYYKGDFVNGVFEGKGTFVSVHGWSYT  93
            QG   YD G   Y G  +  +G G       +G  Y G F  G+F+G+G       G  Y
Sbjct:   52 QGRLDYDNGAW-YAGRFEHGLLHGHGTWQGADGSRYSGGFAAGLFDGQGRLAMADGSVYQ 110

Query:   94 GDFKKGQPDGQGRLNAKNKKVYKGTFKQGIY                              124
            G F++G  DG+G L   +  + Y+G F++G+Y
Sbjct:  111 GGFRQGLFDGEGSLEQQGTR-YRGGFRKGLY                              140

Identities = 31/91 (34%), Positives = 42/91 (46%), Gaps = 1/91 (1%)
Query:   32 SSQGVFSYDGGKIKYVGSIVNHHMTGKGKLTYENGDYYKGDFVNGVFEGKGTFVSVHGWS  91
            S QG        G +Y GS       + G+G +    G+ Y G F +G   GKG +    G
Sbjct:  141 SGQGTLDGSDGS-RYQGSFRQGRLEGEGSFSDSQGNQYAGTFRDGQLNGKGRWSGPDGDR 199

Query:   92 YTGDFKKGQPDGQGRLNAKNKKVYKGTFKQG                              122
            Y G FK   Q  GQGR + +  V+ G F +G
Sbjct:  200 YVGQFKDNQFHGQGRYESASGDVWIGRFSEG                              230

Identities = 31/91 (34%), Positives = 45/91 (49%), Gaps = 4/91 (4%)
Query:   34 QGVFSYDGGK----IKYVGSIVNHHMTGKGKLTYENGDYYKGDFVNGVFEGKGTFVSVHG  89
            QG+F    +G      +Y G      +G+G L    +G  Y+G F  G  EG+G+F    G
Sbjct:  115 QGLFDGEGSLEQQGTRYRGGFRKGLYSGQGTLDGSDGSRYQGSFRQGRLEGEGSFSDSQG 174

Query:   90 WSYTGDFKKGQPDGQGRLNAKNKKVYKGTFK                              120
              Y G F+ GQ +G+GR +  +     Y G FK
Sbjct:  175 NQYAGTFRDGQLNGKGRWSGPDGDRYVGQFK                              205

Identities = 28/87 (32%), Positives = 45/87 (51%), Gaps = 1/87 (1%)
Query:   34 QGVFSYDGGKIKYVGSIVNHHMTGKGKLTYENGDYYKGDFVNGVFEGKGTFVSVHGWSYT  93
            +G FS     G  +Y G+ +  +   GKG+ +  +GD Y G F + F G+G  +S  G +
Sbjct:  166 EGSFSDSQGN-QYAGTFRDGQLNGKGRWSGPDGDRYVGQFKDNQFHGQGRYESASGDVWI 224

Query:   94 GDFKKGQPDGQGRLNAKNKKVYKGTFK                                  120
            G F +G  +G G L  +       Y+G F+
Sbjct:  225 GRFSEGALNGPGELLGADGSRYRGGFQ                                  251

Identities = 28/89 (31%), Positives = 43/89 (47%), Gaps = 2/89 (2%)
Query:   34 QGVFSYDGGKIKYVGSIVNHHMTGKGKLTYENGDYYKGDFVNGVFEGKGTFVSVHGWSYT  93
            QG +    G + Y G          G+G L   + G  Y+G F  G++ G+GT      G  Y
Sbjct:   98 QGRLAMADGSV-YQGGFRQGLFDGEGSLE-QQGTRYRGGFRKGLYSGQGTLDGSDGSRYQ 155

Query:   94 GDFKKGQPDGQGRLNAKNKKVYKGTFKQG                                122
            G F++G+ +G+G  +            Y GTF+  G
Sbjct:  156 GSFRQGRLEGEGSFSDSQGNQYAGTFRDG                                184

Identities = 25/80 (310), Positives = 37/80 (46%)
Query:   45 KYVGSIVNHHMTGKGKLTYENGDYYKGDFVNGVFEGKGTFVSVHGWSYTGDFKKGQPDGQ 104
            +YVG     ++    G+G+      +GD  G F  G    G  G  Y G F+   GQ
Sbjct:  199 RYVGQFKDNQFHGQGRYESASGDVWIGRFSEGALNGPGELLGADGSRYRGGFQFWRFHGQ 258
```

```
Query:  105  GRLNAKNKKVYKGTFKQGIY                                      124
             G L  +   Y+G F  G Y
Sbjct:  259  GLLEQLDGTRYEGGFAAGAY                                      278
```

A related DNA sequence was identified in *S. pyogenes* <SEQ ID 885> which encodes the amino acid sequence <SEQ ID 886>. Analysis of this protein sequence reveals the following:

---

Possible site: 35
>>> Seems to have an uncleavable N-term signal seq
INTEGRAL    Likelihood = −13.16    Transmembrane 20-36 (12-41)
Final Results
   bacterial membrane --- Certainty = 0.6265 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the databases:

```
>GP: BAA16606 GB: D90899 hypothetical protein [Synechocystis sp.]
Identities = 37/89 (41%), Positives = 49/89 (54%), Gaps = 6/89 (6%)
Query:   48  KGRMHYT------GYVINHKMNGEGKLVYPNGDIYEGTFKDGLFEGKGTFTAKTGWLYNG  101
             KG   YT      G V+  ++NG GK  Y NGD YEGT K+G  +G+G F    G  Y G
Sbjct:  141  KGTFIYTNGDRCSGTVVQGELNGSGKCEYNNGDQYEGTLKNGQPDGEGIFRFAAGGEYEG  200

Query:  102  EFHKGQANGKGVLKAKNNKVYKGIFKQGI                                130
             EF   G+ +G+G        N    ++G FKQG+
Sbjct:  201  EFQSGEFSGQGTRIFANGNRFQGQFKQGL                                229
```

An alignment of the GAS and GBS proteins is shown below:

```
Identities = 68/126 (53%), Positives = 93/126 (72%)
Query:    1  MKNFKITRTHLEILSLIIIVVFGLSVFTLTTSSQGVFSYDGGKIKYVGSIVNHHMTGKGK   60
             +K + ITR  LEI+S+I+V  +SVF++   S++    +YD G++ Y G ++NH M G+GK
Sbjct:    8  VKKWSITRAKLEIVSVIVILVCAISVFSVRISNKTSLTYDKGRMHYTGYVINHKMNGEGK   67

Query:   61  LTYENGDYYKGDFVNGVFEGKGTFVSVHGWSYTGDFKKGQPDGQGRLNAKNKKVYKGTFK  120
             L Y NGD Y+G F +G+FEGKGTF +   GW Y G+F KGQ +G+G L AKN KVYKG FK
Sbjct:   68  LVYPNGDIYEGTFKDGLFEGKGTFTAKTGWLYNGEFHKGQANGKGVLKAKNNKVYKGIFK  127

Query:  121  QGIYQK                                                       126
             QGI+QK
Sbjct:  128  QGIFQK                                                       133
```

Figure 19:
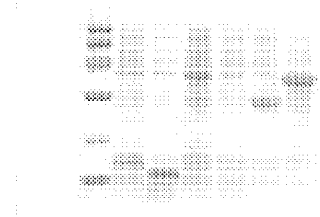
Figure 22:
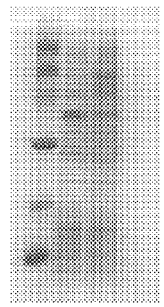

SEQ ID 884 (GBS139) was expressed in *E. coli* as a His-fusion product. SDS-PAGE analysis of total cell extract is shown in FIG. 19 (lane 3; MW 13 kDa). It was also expressed in *E. coli* as a GST-fusion product. SDS-PAGE analysis of total cell extract is shown in FIG. 22 (lane 2; MW 38.2 kDa), in FIG. 24 (lane 7; MW 38 kDa) and in FIG. 33 (lane 7; MW 38.2 kDa).

Figure 287:
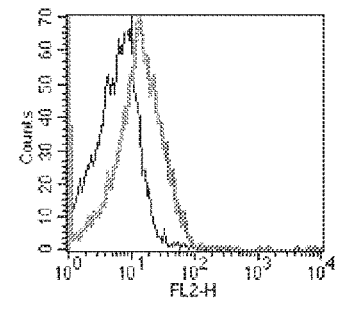

The GBS139-GST fusion product was purified (FIG. 200, lane 2) and used to immunise mice. The resulting antiserum was used for FACS (FIG. 287), which confirmed that the protein is immunoaccessible on GBS bacteria.

Based on this analysis, it was predicted that these proteins and their epitopes could be useful antigens for vaccines or diagnostics.

Example 277

A DNA sequence (GBSx0303) was identified in *S. agalactiae* <SEQ ID 887> which encodes the amino acid sequence <SEQ ID 888>. This protein is predicted to be holliday junction dna helicase ruvb (ruvB). Analysis of this protein sequence reveals the following:

---

Possible site 59
>>> Seems to have no N-terminal signal sequence
----- Final Results -----
   bacterial cytoplasm --- Certainty = 0.4386 (Affirmative) <succ>
   bacterial membrane --- Certainty = 0.0000 (Not Clear) <succ>
   bacterial outside --- Certainty = 0.0000 (Not Clear) <succ>

---

The protein has homology with the following sequences in the GENPEPT database:

```
>GP: CAB75331 GB: Y15896 RuvB protein [Bacillus subtilis]
Identities = 196/322 (60%), Positives = 254/322 08%)
Query:    3  RFLDSDAMGDEELVERTLRPQYLREYIGQDKVKDQLKIFIEAAKLRDESLDHVLLFGPPG   62
             R+  S+A   E  ++E++LRPQ L +YIGQ KVK+ L++FI+AAK+R E+LDHVLL+GPPG
Sbjct:    4  RLVSSEADNHESVIEQSLRPQNLAQYIGQHKVKENLRVFIDAAKMRQETLDHVLLYGPPG   63

Query:   63  LGKTTMAFVIANELGVNLKQTSGPAIEKSGDLVAILNDLEPGDVLFIDEIHRMPMAVEEV  122
             LGKTT+A  ++ANE+GV L+ TSGPAIE+ GDL AIL  LEPGDVLFIDEIHR+  ++EEV
Sbjct:   64  LGKTTLASIVANEMGVELRTTSGPAIERPGDLAAILTALEPGDVLFIDEIHRLHRSIEEV  123
```

```
Query:  123  LYSAMEDFYIDIMIGAGETSRSVHLDLPPFTLIGATTRAGMLSNPLRARFGITGHMEYYE  182
             LY AMEDF +DI+IG G ++RSV LDLPPFTL+GATTR G+L+ PLR RFG+   +EYY
Sbjct:  124  LYPAMEDFCLDIVIGKGPSARSVRLDLPPFTLVGATTRVGLLTAPLRDRFGVMSRLEYYT  183

Query:  183  ENDLTEIIERTADIFEMKITYEAASELARRSRGTPRIANRLLKRVRDYAQIMGDGLIDDN  242
             + +L +I+ RTAD+FE++I    +A E+ARRSRGTPR+ANRLL+RVRD+AQ++GD  I ++
Sbjct:  184  QEELADIVTRTADVFEVEIDKPSALEIARRSRGTPRVANRLLRRVRDFAQVLGDSRITED  243

Query:  243  ITDKALTMLDVDHEGLDYVDQKILRTMIEMYNGGPVGLGTLSVNIAEERDTVEDMYEPYL  302
             I+  AL  L VD   GLD++D K+L  MIE +NGGPVGL T+S  I EE  T+ED+YEPYL
Sbjct:  244  ISQNALERLQVDRLGLDHIDHKLLMGMIEKFNGGPVGLDTISATIGEESHTIEDVYEPYL  303

Query:  303  IQKGFIMRTRTGRVATVKAYEH                                       324
             +Q GFI RT  GR+ T   Y H
Sbjct:  304  LQIGFIQRTPRGRIVTPAVYHH                                       325
```

A related GBS nucleic acid sequence <SEQ ID 10943> which encodes amino acid sequence <SEQ ID 10944> was also identified.

A related DNA sequence was identified in *S. pyogenes* <SEQ ID 889> which encodes the amino acid sequence <SEQ ID 890>. Analysis of this protein sequence reveals the following:

Possible site: 26
>>> Seems to have no N-terminal signal sequence
----- Final Results -----
   bacterial cytoplasm --- Certainty = 0.0686 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below:

```
Identities = 282/327(86), Positives = 306/327 (93)
Query:    1  MTRFLDSDAMGDEELVERTLRPQYLREYIGQDKVKDQLKIFIEAAKLRDESLDHVLLFGP  60
             M R LD++ MG+EE  +RTLRPQYL EYIGQDKVK+Q  IFIEAAK RDESLDHVLLFGP
Sbjct:   25  MARILDNNVMGNEEFSDRTLRPQYLHEYIGQDKVKEQFAIFIEAAKRRDESLDHVLLFGP  84

Query:   61  PGLGKTTMAFVIANELGVNLKQTSGPAIEKSGDLVAILNDLEPGDVLFIDEIHRMPMAVE  120
             PGLGKTTMAFVIANELGVNLKQTSGPA+EK+GDLVAILN+LEPGD+LFIDEIHRMPM+VE
Sbjct:   85  PGLGKTTMAFVIANELGVNLKQTSGPAVEKAGDLVAILNELEPGDILFIDEIHRMPMSVE  144

Query:  121  EVLYSAMEDFYIDIMIGAGETSRSVHLDLPPFTLIGATTRAGMLSNPLRARFGITGHMEY  180
             EVLYSAMEDFYIDIMIGAG+TSRS+HLDLPPFTLIGATTRAGMLSNPLRARFGITGHMEY
Sbjct:  145  EVLYSAMEDFYIDIMIGAGDTSRSIHLDLPPFTLIGATTRAGMLSNPLRARFGITGHMEY  204

Query:  181  YEENDLTEIIERTADIFEMKITYEAASELARRSRGTPRIANRLLKRVRDYAQIMGDGLID  240
             Y+E  DLTEI+ERTA IFE+KI +EAA +LA RSRGTPRIANRLLKRVRDYAQI+GDG+I
Sbjct:  205  YQEKDLTEIVERTATIFEIKIDHEAARKLACRSRGTPRIANRLLKRVRDYAQIIGDGIIT  264

Query:  241  DNITDKALTMLDVDHEGLDYVDQKILRTMIEMYNGGPVGLGTLSVNIAEERDTVEDMYEP  300
             +  ITD+ALTMLDVD   EGLDY+DQKILRTMIEMY GGPVGLGTLSVNIAEER+TVE+MYEP
Sbjct:  265  AQITDRALTMLDVDREGLDYIDQKILRTMIEMYQGGPVGLGTLSVNIAEERNTVEEMYEP  324

Query:  301  YLIQKGFIMRTRTGRVATVKAYEHLGY                                  327
             YLIQKGF+MRTRTGRVAT KAY HLGY
Sbjct:  325  YLIQKGFLMRTRTGRVATQKAYRHLGY                                  351
```

Based on this analysis, it was predicted that these proteins and their epitopes could be useful antigens for vaccines or diagnostics.

Example 278

A DNA sequence (GBSx0304) was identified in *S. agalactiae* <SEQ ID 891> which encodes the amino acid sequence <SEQ ID 892>. Analysis of this protein sequence reveals the following:

Possible site: 43
>>> Seems to have no N-terminal signal sequence
INTEGRAL    Likelihood = –2.87    Transmembrane 157-173 (157-174)
INTEGRAL    Likelihood = –1.49    Transmembrane 205-221 (205-222)
----- Final Results -----
   bacterial membrane --- Certainty = 0.2147 (Affirmative) <succ>
   bacterial outside --- Certainty = 0.0000 (Not Clear) <succ>
   bacterial cytoplasm --- Certainty = 0.0000 (Not Clear) <succ>

The protein has no significant homology with any sequences in the GENPEPT database.

A related DNA sequence was identified in *S. pyogenes* <SEQ ID 893> which encodes the amino acid sequence <SEQ ID 894>. Analysis of this protein sequence reveals the following:

Possible site: 56
>>> Seems to have no N-terminal signal sequence
----- Final Results -----
   bacterial cytoplasm --- Certainty = 0.3097 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below:

```
Identities = 130/303 (42%), Positives = 202/303 (65%)
Query:   1  MLKHFGSKVRNLRVTRNITREDFCGDETELSVRQLARIESGQSIPNLTKAHYIAKQLNVK   60
            ML+HFG KV+ LR+ + I+RED CGDE+ELSVRQLARIE GQSIP+L+K  +IAK LNV
Sbjct:   1  MLEHFGGKVKVLRLEKRISREDLCGDESELSVRQLARIELGQSIPSLSKVIFIAKALNVS  60

Query:  61  LDILTGGESLELPKRYKELKYLILRIPTYADAERLKLRECQFDHIFEEFYDNLPEDECLA  120
            +  LT G  LELPKRYKELKYLILR PTY D  +L++RE QFD IFE++YD LPE+E +
Sbjct:  61  VGYLTDGADLELPKRYKELKYLILRTPTYMDDGKLQVREEQFDEIFEDYYDKLPEEEKII  120

Query: 121  IDSLQAKFEVYQTGDINFGVEVLCECFDKVKYKEKYTLNDLIIIDLFLTCAVVSKFNNRA  180
            ID LQA +  + + NFG+++L E F+++K K ++  NDLI+++L+L   +   + +
Sbjct: 121  IDCLQATLDTLLSENTNFGIDLLQEYFNQIKTKVRFRQNDLILLELYLAYLDIEGMDGQY  180

Query: 181  FTKEVFQTICKTLISQNHKLTAEDLFWFNHVLLNCVFVGLCLNSEECLAEMLEVSRQTMV  240
                K  + ++    L  Q +    ++LF  N ++++   + L  N  +L +  +E+S++  M
Sbjct: 181  SDKIFYDSLLDNLSEQFEQFELDELFIVNKIIIDISSLSLKNNRLDNLEKAIEMSQKIMA  240

Query: 241  STHDFHKMPLYFMYQWKYFITIDNDIKSAENAYQQSIMFSKMIDDKHLIKKLELEWQEDI  300
                  D+++MP+  + +WKYF+     DI   AE ++ ++  +F++M  D++L   KL   EW++D+
Sbjct: 241  KIQDWNRMPILKLIEWKYFLIKQKDIIKAEQSFMKACLFAQMTADQYLENKLIQEWEKDV  300

Query: 301  TGH  303
                 +
Sbjct: 301  KSY  303
```

SEQ ID 892 (GBS319) was expressed in *E. coli* as a His-fusion product. SDS-PAGE analysis of total cell extract is shown in FIG. 40 (lane 4; MW 37 kDa). It was also expressed in *E. coli* as a GST-fusion product. SDS-PAGE analysis of total cell extract is shown in FIG. 46 (lane 7; MW 62 kDa).

Based on this analysis, it was predicted that these proteins and their epitopes could be useful antigens for vaccines or diagnostics.

Example 279

A DNA sequence (GBSx0305) was identified in *S. agalactiae* <SEQ ID 895> which encodes the amino acid sequence <SEQ ID 896>. This protein is predicted to be adenylosuccinate lyase (purB). Analysis of this protein sequence reveals the following:

Possible site: 35

\>>> Seems to have no N-terminal signal sequence

----- Final Results ----- bacterial cytoplasm --- Certainty = 0.3358 (Affirmative) <succ> bacterial membrane --- Certainty = 0.0000 (Not Clear) <succ> bacterial outside --- Certainty = 0.0000 (Not Clear) <succ>

The protein has homology with the following sequences in the GENPEPT database:

```
>GP: BAB04344 GB: AP001509 adenylosuccinate lyase [Bacillus halodurans]
Identities = 326/430 (75%), Positives = 366/430 (84%)
Query:   1  MIERYSRPEMAAIWTEENKYRAWLEVEILADEAWAELGEIPKEDVAKIREKADFDIDRIL  60
            MIERY+RPEM AIWTEEN+Y+AWLEVEI+A EAWAELGEIPKEDV KIRE A FD++RIL
Sbjct:   1  MIERYTRPEMGAIWTEENRYQAWLEVEIVACEAWAELGEIPKEDVKKIREHASFDVERIL  60

Query:  61  EIEQDTRHDVVAFTRAVSETLGEERKWVHYGLTSTDVVDTAYGYLYKQANDIIRRDLENF  120
            EIEQ+TRHDVVAFTRAVSETLGEERKWVHYGLTSTDVVDTA  YL KQAN+II  DL  F
Sbjct:  61  EIEQETRHDVVAFTRAVSETLGEERKWVHYGLTSTDVVDTALSYLLKQANEIIEADLVRF  120

Query: 121  TNIVADKAKEHKFTIMMGRTHGVHAEPTTFGLKLATWYSEMKRNIERFEHAAAGVEAGKI  180
            +I+ +KA EHK+T+MMGRTHGVHAEPTTFGLKLA WY EMKRN+ERF  AA GV  GK+
Sbjct: 121  LDILKEKALEHKYTVMMGRTHGVHAEPTTFGLKLALWYEEMKRNLERFRLAAEGVRVGKL  180

Query: 181  SGAVGNFANIPPFVEQYVCDKLGIRPQEISTQVLPRDLHAEYFAVLASIATSIERMATEI  240
            SGAVG +ANI PFVEQYVC+KLG+    ISTQ L RD HAEY A LA IATSIE+ A EI
Sbjct: 181  SGAVGTYANIDPFVEQYVCEKLGLERAPISTQTLQRDRHAEYMATLALIATSIEKFAVEI  240

Query: 241  RGLQKSEQREVEEFFAKGQKGSSAMPHKRNPIGSENMTGLARVIRGHMVTAYENVALWHE  300
            RGLQKSE REVEE+FAKGQKGSSAMPHKRNPIGSENMTG+ARV+RGHM+ AYENV LWHE
Sbjct: 241  RGLQKSETREVEEYFAKGQKGSSAMPHKRNPIGSENMTGIARVVRGHMLAAYENVPLWHE  300

Query: 301  RDISHSSAERIITPDTTILIDYMLNRFGNIVKNLTVFPENMMRNMESTFGLIYSQRVMLK  360
            RDISHSSAERII PD TI I+YMLNRFGNIVKNLTVFPENM RNM  T+GLIYSQRV+L
Sbjct: 301  RDISHSSAERIILPDATIAINYMLNRFGNIVKNLTVFPENMKRNMTRTYGLIYSQRVLLS  360

Query: 361  LIEKGMTREEAYDLVQPKTAYSWDNQVDFKPLLEEDTKVTSCLTQEEIDELFNPIYYTKR  420
            LI+KGM REEAYDLVQPK   +W+  V F+ L+E++  ++TS L+ EEI+  F+  ++ K
Sbjct: 361  LIDKGMVREEAYDLVQPKAMEAWEKGVQFRELVEQEERITSVLSPEEIEACFDYNHHLKH  420

Query: 421  VDDIFERLGL  430
            VD IFERLGL
Sbjct: 421  VDTIFERLGL  430
```

A related DNA sequence was identified in *S. pyogenes* <SEQ ID 897> which encodes the amino acid sequence <SEQ ID 898>. Analysis of this protein sequence reveals the following:

Possible site: 35
>>> Seems to have no N-terminal signal sequence
----- Final Results -----
   bacterial cytoplasm --- Certainty = 0.3358 (Affirmative) <succ>
   bacterial membrane --- Certainty = 0.0000 (Not Clear) <succ>
   bacterial outside --- Certainty = 0.0000 (Not Clear) <succ>

Possible site: 45
>>> Seems to have no N-terminal signal sequence
INTEGRAL   Likelihood = −16.24   Transmembrane 145-161 (119-167)
INTEGRAL   Likelihood = −9.98   Transmembrane 125-141 (119-144)
INTEGRAL   Likelihood = −9.29   Transmembrane 28-44 (23-51)
INTEGRAL   Likelihood = −7.01   Transmembrane 196-212 (193-220)
INTEGRAL   Likelihood = −6.21   Transmembrane 96-112 (88-116)
INTEGRAL   Likelihood = −5.79   Transmembrane 249-265 (246-266)
INTEGRAL   Likelihood = −2.87   Transmembrane 222-238 (222-238)
INTEGRAL   Likelihood = −2.28   Transmembrane 279-295 (278-295)
----- Final Results -----
   bacterial membrane --- Certainty = 0.7496 (Affirmative) <succ>
   bacterial outside --- Certainty = 0.0000 (Not Clear) <succ>
   bacterial cytoplasm --- Certainty = 0.0000 (Not Clear) <succ>

An alignment of the GAS and GBS proteins is shown below:

The protein has homology with the following sequences in the GENPEPT database:

```
Identities = 422/430 (98%), Positives = 428/430 (99%)
Query:    1 MIERYSRPEMAAIWTEENKYRAWLEVEILADEAWAELGEIPKEDVAKIREKADFDIDRIL   60
            M+ERYSRPEMAAIWTEENKY AWLEVEILADEAWAELGEIPKEDVAKIREKADFDIDRIL
Sbjct:    1 MLERYSRPEMAAIWTEENKYHAWLEVEILADEAWAELGEIPKEDVAKIREKADFDIDRIL   60

Query:   61 EIEQDTRHDVVAFTRAVSETLGERRKWVHYGLTSTDVVDTAYGYLYKQANDIIRRDLENF  120
            EIEQDTRHDVVAFTRAVSETLGE RKWVHYGLTSTDVVDTAYGYLYKQANDIIRRDLENF
Sbjct:   61 EIEQDTRHDVVAFTRAVSETLGEERKWVHYGLTSTDVVDTAYGYLYKQANDIIRRDLENF  120

Query:  121 TNIVADKAKEHKFTIMMGRTHGVHAEPTTFGLKLATWYSEMKRNIERFEHAAAGVEAGKI  180
            TNIVADKA+EHK TIMMGRTHGVHAEPTTFGLKLATWYSEMKRNIERFEHAAAGVEAGKI
Sbjct:  121 TNIVADKAREHKMTIMMGRTHGVHAEPTTFGLKLATWYSEMKRNIERFEHAAAGVEAGKI  180

Query:  181 SGAVGNFANIPPFVEQYVCDKLGIRPQEISTQVLPRDLHAEYFAVLASIATSIERMATEI  240
            SGAVGNFANIPPFVE+YVCDKLGIRPQEISTQVLPRDLHAEYFAVLASIATSIERMATEI
Sbjct:  181 SGAVGNFANIPPFVEEYVCDKLGIRPQEISTQVLPRDLHAEYFAVLASIATSIERMATEI  240

Query:  241 RGLQKSEQREVEEFFAKGQKGSSAMPHKRNPIGSENMTGLARVIRGHMVTAYENVALWHE  300
            RGLQKSEQREVEEFFAKGQKGSSAMPHKRNPIGSENMTGLARVIRGHMVTAYENV+LWHE
Sbjct:  241 RGLQKSEQREVEEFFAKGQKGSSAMPHKRNPIGSENMTGLARVIRGHMVTAYENVSLWHE  300

Query:  301 RDISHSSAERIITPDTTILIDYMLNRFGNIVKNLTVFPENMMRNMESTFGLIYSQRVMLK  360
            RDISHSSAERIITPDTTILIDYMLNRFGNIVKNLTVFPENMMRNMESTFGLIYSQRVMLK
Sbjct:  301 RDISHSSAERIITPDTTILIDYMLNRFGNIVKNLTVFPENMMRNMESTFGLIYSQRVMLK  360

Query:  361 LIEKGMTREEAYDLVQPKTAYSWDNQVDFKPLLEEDTKVTSCLTQEEIDELFNPIYYTKR  420
            LIEKGMTREEAYDLVQPKTAYSWDNQVDFKPLLEEDTKVTSCLTQEEIDELFNPIYYTKR
Sbjct:  361 LIEKGMTREEAYDLVQPKTAYSWDNQVDFKPLLEEDTKVTSCLTQEEIDELFNPIYYTKR  420

Query:  421 VDDIFERLGL                                                    430
            VDDIF+RLG+
Sbjct:  421 VDDIFKRLGI                                                    430
```

Based on this analysis, it was predicted that these proteins and their epitopes could be useful antigens for vaccines or diagnostics.

Example 280

A DNA sequence (GBSx0306) was identified in *S. agalactiae* <SEQ ID 899> which encodes the amino acid sequence <SEQ ID 900>. Analysis of this protein sequence reveals the following:

```
>GP: BAB13498 GB: AB028634 RNA polymerase [Flammulina velutipes]
Identities = 83/336 (24%), Positives = 150/336 (43%), Gaps = 40/336 (11%)
Query:  152 ILLLIAFVSIGKNR-VYNFVQNLNYFEEVIWNYFEENPVKIKEKSLIIK-----FLLTIS  205
            IL L     SI NR + ++ N    ++  N+F+ + +K   K L+I       F++ +S
Sbjct:  133 ILFLYLIYSILINRFILKWLDNSGIIYKININWFKNHMIKHINKMLVINIKFFNPIIKLS  192

Query:  206 FVFVIDFAMVRL-----LNFNIKFSTILACSAILLAWLYQN----------KSVTEPFL  249
            + +I +++ L     +NF+I+  I     I       ++          S+    F
Sbjct:  193 IITIIGISIMELFGIFGINFDIRIIIINYLKTINSGKIHLTIINMDQYSVLENSIHTIFY  252

Query:  250 LKKLVIYFIFFIATLIGNLKN-ELSILETPLLFISIFFTMDRIIALSKEMRDLI--ISKS  306
```

```
                  +  L+I+ IF    L  N+KN + +I     +L+I IF     I    ++DL+ ++K
Sbjct:  253 INLLIIFLIFISLILYRNVKNIDTNIKRWIILYILIFLINIIFIFNHIYIKDLMDNLNKY  312

Query:  307 ILFYYDHENIKPSILLSEIKEIKYLENVDIGE---LELVRQMVIRLRLELEEEFLILSDI  363
            IL Y D    I  S+ L    ++K L+ ++I +     V+ + I+ ++E      L + I
Sbjct:  313 ILDYMDLHIIVNSLFLFNKFDVK-LKRINIYKSYSTVTVKDLEIKSKIEERSNELDIKLI  371

Query:  364 YMKNG-YEKYIQFVQGNVYFINLE--LDKIPNYTNLKLILESIFD----HNNQKIFIPKL  416
              K G  YE YI  ++ N+  ++ E   L     P Y N    +E + +       F+ K+
Sbjct:  372 IAKYGSYENYINSIE-NINIVDEEFILKNYPEYINDSKFIEFLMELEPLFRDHTEFVKKI  430

Query:  417 YEEYIYILISLGEVEKAKEIL---KEVSDYLTEESL                          449
             YE       L  +    K+IL    KE+ DY+ + +L
Sbjct:  431 YENLNSTNEKLEFLLANKDILSENKEIFDYVLQLNL                          466
```

No corresponding DNA sequence was identified in *S. pyogenes*.

Based on this analysis, it was predicted that this protein and its epitopes, could be useful antigens for vaccines or diagnostics.

Example 281

A DNA sequence (GBSx0308) was identified in *S. agalactiae* <SEQ ID 901> which encodes the amino acid sequence <SEQ ID 902>. Analysis of this protein sequence reveals the following:

---

Possible site: 37
>>> Seems to have no N-terminal signal sequence
----- Final Results -----
    bacterial cytoplasm --- Certainty = 0.3307 (Affirmative) <succ>
    bacterial membrane --- Certainty = 0.0000 (Not Clear) <succ>
    bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 282

A DNA sequence (GBSx0309) was identified in *S. agalactiae* <SEQ ID 903> which encodes the amino acid sequence <SEQ ID 904>. This protein is predicted to be purK (purK). Analysis of this protein sequence reveals the following:

---

Possible site: 34
>>> Seems to have no N-terminal signal sequence
----- Final Results -----
    bacterial cytoplasm --- Certainty = 0.0334 (Affirmative) <succ>
    bacterial membrane --- Certainty = 0.0000 (Not Clear) <succ>
    bacterial outside --- Certainty = 0.0000 (Not Clear) <succ>

---

A related GBS nucleic acid sequence <SEQ ID 9461> which encodes amino acid sequence <SEQ ID 9462> was also identified.

The protein has homology with the following sequences in the GENPEPT database:

```
>GP: CAA04376 GB: AJ000883 purK [Lactococcus lactis]
Identities = 208/347 (59%), Positives = 258/347 (73%), Gaps = 3/347 (0%)
Query:   14 NSFKTIGIIGGGQLGQMMAIAAIYMGHKVITLDPASDCPASRVS-EVIVAPYDDVEALGT   72
            N+ +TIGIIGGGQLGQMMAIAA YMGHKVITLDP +C A++VS E+IVAPYDDVE L
Sbjct:    4 NTKQTIGIIGGGQLGQMMAIAAQYMGHKVITLDPNPNCSAAKVSDELIVAPYDDVENLLR   63

Query:   73 LAARCDVLTYEFENVDADGLDAVVSAGQLPQGTDLLRISQNRIFEKDFLANKAGVTVAPY  132
            LA  CDV+TYEFENV A  L +     ++PQG  LL I+QNR FEK+FL N+A V VAP+
Sbjct:   64 LAYACDVITYEFENVSAKALHEIEGCVRIPQGIRLLEITQNRRFEKEFLTNEAKVNVAPW  123

Query:  133 KVVTSSLDLEGLDLTKTYVLKTATGGYDGHGQKVIRSAEDLPEAQQLANSAQCVLEEFVN  192
            ++V S+ L    +T+  VLKT TGGYDGHGQ V+ + E L   A+ L    ++CVLE+F++
Sbjct:  124 QLVDSAEKLPET-VTRKQVLKTTTGGYDGHGQVVLNTDEKLSAAKSLTELSECVLEDFIS  182

Query:  193 FDLEISVIVSGNGQDVTVFPVQENIHRNNILSKTIVPARISDQLADKAKEMAVQIAKKLQ  252
            F+ EISVI+SGNG + VFP+ EN HR NIL +TI PARIS  + A ++A IA+KL+
Sbjct:  183 FEREISVIISGNGHEYVVFPLAENEHRENILHQTISPARISAEITENAYKIATSIAEKLE  242

Query:  253 LSGTLCVEMFATAD-DIIVNEIAPRPHNSGHYSIEACDFSQFDTHILGVLGAPLPPIKLH  311
            LSG LCVEMF TAD  I VNE+APRPHNSGH++IEACDF+QFD HI G+LG  LP  KL
Sbjct:  243 LSGVLCVEMFLTADGQIYVNELAPRPHNSGHFTIEACDFNQFDLHIKGILGEDLPEPKLL  302

Query:  312 APAVMFNVLGQHVQQAIDHVAQNPSAHLHMYGKLEAKHNRKMGHVTV                358
            PA+M NVLGQHV+        ++   H H YGK +AKHNRKMGHVT+
Sbjct:  303 KPAIMLNVLGQHVEAVKKLNHEHADWHQHDYGKADAKHNRKMGHVTI                349
```

A related DNA sequence was identified in *S. pyogenes* <SEQ ID 905> which encodes the amino acid sequence <SEQ ID 906>. Analysis of this protein sequence reveals the following:

```
Possible site: 34
>>> Seems to have no N-terminal signal sequence
----- Final Results -----
   bacterial cytoplasm --- Certainty = 0.0334 (Affirmative) <succ>
     bacterial membrane --- Certainty = 0.0000 (Not Clear) <succ>
       bacterial outside --- Certainty = 0.0000 (Not Clear) <succ>
```

An alignment of the GAS and GBS proteins is shown below:

```
Identities = 344/369 (93%), Positives = 353/369 (95%)
Query:     1 MRNKEKSQRSQAMNSFKTIGIIGGGQLGQMMAIAAIYMGHKVITLDPASDCPASRVSEVI    60
             MRNKEKSQRSQ +NSFKTIGIIGGGQLGQMMAIAAIYMGHKVITLDPASD PASRVSEVI
Sbjct:     1 MRNKEKSQRSQVVNSFKTIGIIGGGQLGQMMAIAAIYMGHKVITLDPASDSPASRVSEVI    60

Query:    61 VAPYDDVEALGTLAARCDVLTYEFENVDADGLDAVVSAGQLPQGTDLLRISQNRIFEKDF   120
             VAPYDDVEALG LAARCDVLTYEFENVDADGLDAVVSA QLPQGTDLLRISQNRI EKDF
Sbjct:    61 VAPYDDVEALGQLAARCDVLTYEFENVDADGLDAVVSACQLPQGTDLLRISQNRIVEKDF   120

Query:   121 LANKAGVTVAPYKVVTSSLDLEGLDLTKTYVLKTATGGYDGHGQKVIRSAEDLPEAQQLA   180
             LANKAGVTVAPYKVVTSSLDL GLDLTKTYVLKT TGGYDGHGQK+IRSAEDLPEAQQLA
Sbjct:   121 LANKAGVTVAPYKVVTSSLDLGGLDLTKTYVLKTETGGYDGHGQKIIRSAEDLPEAQQLA   180

Query:   181 NSAQCVLEEFVNFDLEISVIVSGNGQDVTVFPVQENIHRNNILSKTIVPARISDQLADKA   240
             NSAQCVLEEFVNFDLEISVIVSGNG+DVTVFPVQENIHRNNILSKTIVPARISDQLADKA
Sbjct:   181 NSAQCVLEEFVNFDLEISVIVSGNGKDVTVFPVQENIHRNNILSKTIVPARISDQLADKA   240

Query:   241 KEMAVQIAKKLQLSGTLCVEMFATADDIIVNEIAPRPHNSGHYSIEACDFSQFDTHILGV   300
             K+ AVQIAKKLQLSGTLCVEMF TADDIIVNEIAPRPHNSG YSIEACDFSQFDTHILGV
Sbjct:   241 KKTAVQIAKKLQLSGTLCVEMFTTADDIIVNEIAPRPHNSGRYSIEACDFSQFDTHILGV   300

Query:   301 LGAPLPPIKLHAPAVMFNVLGQHVQQAIDHVAQNPSAHLHMYGKLEAKHNRKMGHVTVFS   360
             LGAPLP I+LHAPAVM NVLGQHVQQA D+VA+NPSAHLHMYGKLEAKHNRKMGHVTVF+
Sbjct:   301 LGAPLPQIQLHAPAVMLNVLGQHVQQATDYVAKNPSAHLHMYGKLEAKHNRKMGHVTVFA   360

Query:   361 DVPDEVEEF   369
             DEV+EF
Sbjct:   361 KDADEVKEF   369
```

Based on this analysis, it was predicted that these proteins and their epitopes could be useful antigens for vaccines or diagnostics.

Example 283

A DNA sequence (GBSx0310) was identified in *S. agalactiae* <SEQ ID 907> which encodes the amino acid sequence <SEQ ID 908>. This protein is predicted to be phosphoribosylaminoimidazole carboxylase catalytic subunit (purE). Analysis of this protein sequence reveals the following:

```
Possible site: 45
>>> Seems to have no N-terminal signal sequence
----- Final Results -----
   bacterial cytoplasm --- Certainty = 0.3572 (Affirmative) <succ>
     bacterial membrane --- Certainty = 0.0000 (Not Clear) <succ>
       bacterial outside --- Certainty = 0.0000 (Not Clear) <succ>
```

The protein has homology with the following sequences in the GENPEPT database:

```
>GP: CAB12462 GB: Z99107 phosphoribosylaminoimidazole carboxylase I
[Bacillus subtilis]

Identities = 106/162 (65%), Positives = 128/162 (78%)
Query:    33 MQPIISIIMGSKSDWTTMQKTAEVLDNFGIAYEKKVVSAHRTPDLMFKHAEEARGRGIKI    92
             MQP++ IIMGS SDW TM+    ++LD   + YEKKVVSAHRTPD MF++AE AR RGIK+
Sbjct:     1 MQPLVGIIMGSTSDWETMKHACDILDELNVPYEKKVVSAHRTPDFMFEYAETARERGIKV    60

Query:    93 IIAGAGGAAHLPGMVAAKTTLPVIGVPVKSRALSGLDSLYSIVQMPGGVPVATMAIGEAG   152
             IIAGAGGAAHLPGM AAKTTLPVIGVPV+S+AL+G+DSL SIVQMPGGVPVAT +IG+AG
Sbjct:    61 IIAGAGGAAHLPGMTAAKTTLPVIGVPVQSKALNGMDSLLSIVQMPGGVPVATTSIGKAG   120

Query:   153 ATNAALTALRILSIEDQNLADALAHFHEEQGKIAEESSNELI                    194
             A NA L A +ILS D++LA L   E   + ESS++L+
Sbjct:   121 AVNAGLLAAQILSAFDEDLARKLDERRENTKQTVLESSDQLV                    162
```

A related DNA sequence was identified in *S. pyogenes* <SEQ ID 909> which encodes the amino acid sequence <SEQ ID 910>. Analysis of this protein sequence reveals the following:

```
Possible site: 57
>>> Seems to have no N-terminal signal sequence
INTEGRAL     Likelihood = –3.08    Transmembrane 36-52 (34-52)
----- Final Results -----
    bacterial membrane --- Certainty = 0.2232 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the databases:

```
>GP: CAA04375 GB: AJ000883 purE [Lactococcus lactis]
Identities = 105/158 (66%), Positives = 131/158 (82%)
Query:   46 ISIIMGSKSDWATMQKTAEVLDNFGIAYEKKVVSAHRTPDLMFKHAEEARGRGIKIIIAG  105
            ++IIMG  SDWATM++TA++LD+FG+AYEKKVVSAHRTP LM + + +AR RG K+IIAG
Sbjct:    4 VAIIMGCSSDWATMKETAKILDDFGLAYEKKVVSAHRTPALMAEFSSQARERGYKVIIAG   63

Query:  106 AGGAAHLPGMVAAKTTLPVIGVPVKSRALSGLDSLYSIVQMPGGVPVATMAIGEAGATNA  165
            AGGAAHLPGMV+A+T +PVIGVP+KSRALSGLDSLYSIVQMP GVPVATMAIGEAGA NA
Sbjct:   64 AGGAAHLPGMVSAQTLVPVIGVPIKSRALSGLDSLYSIVQMPAGVPVATMAIGEAGAKNA  123

Query:  166 ALTALRILSIEDQNLADALAHFHEEQGKIAEESSGELI                       203
            AL AL++L+  ++NL   L +       ++ EES+  L+
Sbjct:  124 ALFALQLLANTNENLIQKLLVYRAAAQEMVEESNKALL                       161
```

An alignment of the GAS and GBS proteins is shown below:

```
Identities = 162/169 (95%), Positives = 164/169 (96%), Gaps = 1/169 (0%)
Query:   27 PLYLNIMQ-PIISIIMGSKSDWTTMQKTAEVLDNFGIAYEKKVVSAHRTPDLMFKHAEEA   85
            PL + IM+ PIISIIMGSKSDW TMQKTAEVLDNFGIAYEKKVVSAHRTPDLMFKHAEEA
Sbjct:   35 PLCILIMKTPIISIIMGSKSDWATMQKTAEVLDNFGIAYEKKVVSAHRTPDLMFKHAEEA   94

Query:   86 RGRGIKIIIAGAGGAAHLPGMVAAKTTLPVIGVPVKSRALSGLDSLYSIVQMPGGVPVAT  145
            RGRGIKIIIAGAGGAAHLPGMVAAKTTLPVIGVPVKSRALSGLDSLYSIVQMPGGVPVAT
Sbjct:   95 RGRGIKIIIAGAGGAAHLPGMVAAKTTLPVIGVPVKSRALSGLDSLYSIVQMPGGVPVAT  154

Query:  146 MAIGEAGATNAALTALRILSIEDQNLADALAHFHEEQGKIAEESSNELI            194
            MAIGEAGATNAALTALRILSIEDQNLADALAHFHEEQGKIAEESS ELI
Sbjct:  155 MAIGEAGATNAALTALRILSIEDQNLADALAHFHEEQGKIAEESSGELI            203
```

Based on this analysis, it was predicted that these proteins and their epitopes could be useful antigens for vaccines or diagnostics.

Example 284

A DNA sequence (GBSx0311) was identified in *S. agalactiae* <SEQ ID 911> which encodes the amino acid sequence <SEQ ID 912>. This protein is predicted to be phosphoribosylglycinamide synthetase (purD). Analysis of this protein sequence reveals the following:

```
Possible site: 16
>>> Seems to have no N-terminal signal sequence
----- Final Results -----
    bacterial cytoplasm --- Certainty = 0.1966 (Affirmative) <succ>
      bacterial membrane --- Certainty = 0.0000 (Not Clear) <succ>
        bacterial outside --- Certainty = 0.0000 (Not Clear) <succ>
```

The protein has homology with the following sequences in the GENPEPT database:

```
>GP: CAA04374 GB: AJ000883 purD [Lactococcus lactis]
Identities = 236/419 (56%), Positives = 298/419 (70%), Gaps = 7/419 (1%)
Query:    1 MKLLVVGSGGREHAIAKKLLASKDVDQVFVAPGNDGMTLDGLDLVNIGISEHSRLIDFVK   60
            MK+LV+GSGGREHA+AKK + S  V++VFVAPGN GM  DG+ +V+I    + +L+ F +
Sbjct:    1 MKILVIGSGGREHALAKKFMESPQVEEVFVAPGNSGMEKDGIQIVHISELSNDKLVKFAQ   60

Query:   61 ENEIAWTLIGPDDALAAGIVDGFNSAGLRAFGPTKAAAELEWSKDFAKEIMVKYNVPTAA  120
                I   T +GP+ AL   G+VD F   A L   FGP K AAELE SKDFAK IM KY VPTA
```

```
Sbjct:  61 NQNIGLTFVGPETALMNGVVDAFIKAELPIFGPNKMAAELEGSKDFAKSIMKKYGVPTAD 120

Query: 121 YGTFSDFEKAKAYIEEQGAPIVVKADGLALGKVVVAETVEQAVEAAQEMLLDNKFGDSG 180
            Y TF   E A AY++E+G P+V+KADGLA GKGV VA  +E A  A  ++      F  S
Sbjct: 121 YATFDSLEPALAYLDEKGVPLVIKADGLAAGKGVTVAFDIETAKSALADI-----FSGSQ 175

Query: 181 ARVVIEEFLDGEEFSLFAFANGDKFYIMPTAQDHKRAYDGDKGLNTGGMGAYAPVPHLPQ 240
            +VVIEEFLDGEEFSLF+F +   K Y MP AQDHKRA+D DKG NTGGMGAY+PV H+  +
Sbjct: 176 GKVVIEEFLDGEEFSLFSFIHDGKIYPMPIAQDHKRAFDEDKGPNTGGMGAYSPVLHISK 235

Query: 241 SVVDTAVETIVKPVLEGMIAEGRPYLGVLYAGLILTADGPKVIEFNSRFGDPETQIILPR 300
            VV+ A+E +VKP + GMI EG+ + GVLYAGLILT DG K IEFN+RFGDPETQ++LPR
Sbjct: 236 EVVNEALEKVVKPTVAGMIEEGKSFTGVLYAGLILTEDGVKTIEFNARFGDPETQVVLPR 295

Query: 301 LTSDFAQNIDDIMMGIEPYITWQKDGVTLGVVASEGYPLDYEKGVPLPEKTDGDIITYY 360
            L SD AQ I DI+ G EP + W + GVTLGVVVA+EGYP    + G+ LPE +G +  YY
Sbjct: 296 LKSDLAQAIIDILAGNEPTLEWLESGVTLGVVAAEGYPSQAKLGLILPEIPEG-LNVYY 354

Query: 361 AGAKFAENSKALLSNGGRVYMLVTTEDSVKAGDKIYTQLAQQDTTGLFYRNDIGSKAI 419
            AG       EN++ L+S+GGRVY++    T + VK+ Q  +Y +L + +    G FYR+DIGS+AI
Sbjct: 355 AGVSKNENNQ-LISSGGRVYLVSETGEDVKSTQKLLYEKLDKLENDGFFYRHDIGSRAI 412
```

A related DNA sequence was identified in *S. pyogenes* <SEQ ID 913> which encodes the amino acid sequence <SEQ ID 914>. Analysis of this protein sequence reveals the following:

```
Possible site: 35
>>> Seems to have no N-terminal signal sequence
INTEGRAL      Likelihood = -0.80       Transmembrane 5-21 (5-21)
----- Final Results -----
   bacterial membrane --- Certainty = 0.1319 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the databases:

```
>GP: CAA04374 GB: AJ000883 purD [Lactococcus lactis]
Identities = 236/419 (56%), Positives = 301/419 (71%), Gaps = 7/419 (1%)
Query:  50 LKLLVVGSGGREHAIAKKLLASKGVDQVFVAPGNDGMTLDGLDLVNIVVSEHSRLIAFAK 109
           +K+LV+GSGGREHA+AKK +  S  V++VFVAPGN GM  DG+ +V+I     + +L+ FA+
Sbjct:   1 MKILVIGSGGREHALAKKFMESPQVEEVFVAPGNSGMEKDGIQIVHISELSNDKLVKFAQ  60

Query: 110 ENEISWAFIGPDDALAAGIVDDFNSAGLRAFGPTKAAAELEWSKDFAKEIMVKYNVPTAA 169
               I    F+GP+ AL   G+VD F   A L   FGP K AAELE SKDFAK IM KY VPTA
Sbjct:  61 NQNIGLTFVGPETALMNGVVDAFIKAELPIFGPNKMAAELEGSKDFAKSIMKKYGVPTAD 120

Query: 170 YGTFSDFEKAKAYIEEQGAPIVVKADGLALGKVVVAETVEQAVEAAQEMLLDNKFGDSG 229
            Y TF   E A AY++E+G P+V+KADGLA GKGV VA  +E A  A  ++      F  S
Sbjct: 121 YATFDSLEPALAYLDEKGVPLVIKADGLAAGKGVTVAFDIETAKSALADI-----FSGSQ 175

Query: 230 ARVVIEEFLDGEEFSLFAFANGDKFYIMPTAQDHKRAFDGDKGPNTGGMGAYAPVPHLPQ 289
            +VVIEEFLDGEEFSLF+F +   K Y MP AQDHKRAFD DKGPNTGGMGAY+PV H+  +
Sbjct: 176 GKVVIEEFLDGEEFSLFSFIHDGKIYPMPIAQDHKRAFDEDKGPNTGGMGAYSPVLHISK 235

Query: 290 SVVDTAVEMIVRPVLEGMVAEGRPYLGVLYVGLILTADGPKVIEFNSREGDPETQIILPR 349
            VV+ A+E +V+P + GM+ EG+ + GVLY GLILT DG K IEFN+RFGDPETQ++LPR
Sbjct: 236 EVVNEALEKVVKPTVAGMIEEGKSFTGVLYAGLILTEDGVKTIEFNARFGDPETQVVLPR 295

Query: 350 LTSDFAQNIDDIMMGIEPYITWQKDGVTLGVVASEGYPFDYEKGVPLPEKTDGDIITYY 409
            L SD AQ I DI+ G EP + W + GVTLGVVVA+EGYP    + G+ LPE +G +  YY
Sbjct: 296 LKSDLAQAIIDILAGNEPTLEWLESGVTLGVVAAEGYPSQAKLGLILPEIPEG-LNVYY 354

Query: 410 AGVKFSENSELLLSNGGRVYMLVTTEDSVKAGDKIYTQLAQQDTTGLFYRNDIGSKAI 468
            AGV   +EN++ L+S+GGRVY++    T + VK+ Q  +Y +L + +    G FYR+DIGS+AI
Sbjct: 355 AGVSKNENNQ-LISSGGRVYLVSETGEDVKSTQKLLYEKLDKLENDGFFYRHDIGSRAI 412
```

An alignment of the GAS and GBS proteins is shown below:

```
Identities = 399/421 (94%), Positives = 408/421 (96%)
Query:   1 MKLLVVGSGGREHAIAKKLLASKDVDQVFVAPGNDGMTLDGLDLVNIGISEHSRLIDFVK   60
           +KLLVVGSGGREHAIAKKLLASK VDQVFVAPGNDGMTLDGLDLVNI +SEHSRLI F K
Sbjct:  50 LKLLVVGSGGREHAIAKKLLASKGVDQVFVAPGNDGMTLDGLDLVNIVVSEHSRLIAFAK  109

Query:  61 ENEIAWTLIGPDDALAAGIVDGFNSAGLRAFGPTKAAAELEWSKDFAKEIMVKYNVPTAA  120
           ENEI+W   IGPDDALAAGIVD FNSAGLRAFGPTKAAAELEWSKDFAKEIMVKYNVPTAA
Sbjct: 110 ENEISWAFIGPDDALAAGIVDDFNSAGLRAFGPTKAAAELEWSKDFAKEIMVKYNVPTAA  169

Query: 121 YGTFSDFEKAKAYIEEQGAPIVVKADGLALGKGVVVAETVEQAVEAAQEMLLDNKFGDSG  180
           YGTFSDFE+AKAYIEEQGAPIVVKADGLALGKGVVVAETVEQAVEAAQEMLLDNKFGDSG
Sbjct: 170 YGTFSDFENAKAYIEEQGAPIVVKADGLALGKGVVVAETVEQAVEAAQEMLLDNKFGDSG  229

Query: 181 ARVVIEEFLDGEEFSLFAFANGDKFYIMPTAQDHKRAYDGDKGLNTGGMGAYAPVPHLPQ  240
           ARVVIEEFLDGEEFSLFAFANGDKFYIMPTAQDHKRA+DGDKG NTGGMGAYAPVPHLPQ
Sbjct: 230 ARVVIEEFLDGEEFSLFAFANGDKFYIMPTAQDHKRAFDGDKGPNTGGMGAYAPVPHLPQ  289

Query: 241 SVVDTAVETIVKPVLEGMIAEGRPYLGVLYAGLILTADGPKVIEFNSRFGDPETQIILPR  300
           SVVDTAVE IV+PVLEGM+AEGRPYLGVLY GLILTADGPKVIEFNSRFGDPETQIILPR
Sbjct: 290 SVVDTAVEMIVRPVLEGMVAEGRPYLGVLYVGLILTADGPKVIEFNSRFGDPETQIILPR  349

Query: 301 LTSDFAQNIDDIMMGIEPYITWQKDGVTLGVVVASEGYPLDYEKGVPLPEKTDGDIITYY  360
           LTSDFAQNIDDIMMGIEPYITWQKDGVTLGVVVASEGYP DYEKGVPLPEKTDGDIITYY
Sbjct: 350 LTSDFAQNIDDIMMGIEPYITWQKDGVTLGVVVASEGYPFDYEKGVPLPEKTDGDIITYY  409

Query: 361 AGAKFAENSKALLSNGGRVYMLVTTEDSVKAGQDKIYTQLAQQDTTGLFYRNDIGSKAIKE 421
           AG KF+ENS+ LLSNGGRVYMLVTTEDSVKAGQDKIYTQLAQQDTTGLFYRNDIGSKAI+E
Sbjct: 410 AGVKFSENSELLLSNGGRVYMLVTTEDSVKAGQDKIYTQLAQQDTTGLFYRNDIGSKAIRE 470
```

Based on this analysis, it was predicted that these proteins and their epitopes could be useful antigens for vaccines or diagnostics.

Example 285

A DNA sequence (GBSx0312) was identified in *S. agalactiae* <SEQ ID 915> which encodes the amino acid sequence <SEQ ID 916>. Analysis of this protein sequence reveals the following:

Possible site: 36
>>> Seems to have no N-terminal signal sequence
INTEGRAL    Likelihood = −1.28    Transmembrane 235-251 (235-251)
----- Final Results -----
  bacterial membrane --- Certainty = 0.1510 (Affirmative) <succ>
    bacterial outside--- Certainty = 0.0000 (Not Clear) <succ>
      bacterial cytoplasm --- Certainty = 0.0000 (Not Clear) <succ>

The protein has homology with the following sequences in the GENPEPT database:

A related DNA sequence was identified in *S. pyogenes* <SEQ ID 917> which encodes the amino acid sequence <SEQ ID 918>. Analysis of this protein sequence reveals the following:

Possible site: 60
>>> Seems to have no N-terminal signal sequence
INTEGRAL    Likelihood = −4.88    Transmembrane 243-259 (242-261)
----- Final Results -----
  bacterial membrane --- Certainty = 0.2954 (Affirmative) <succ>
    bacterial outside --- Certainty = 0.0000 (Not Clear) <succ>
      bacterial cytoplasm --- Certainty = 0.0000 (Not Clear) <succ>

A related sequence was also identified <SEQ ID 9093> which encodes the amino acid sequence <SEQ ID 9094>. Analysis of this protein sequence reveals the following:

```
>GP:AAA23257 GB:M81878 unknown [Clostridium perfringens]
Identities = 66/258 (25%), Positives = 119/258 (45%), Gaps = 9/258 (3%)
Query:   1 MTIYDQIESALDLMTDLEREIACYFMGQPISKDALASTIVTKQLHISQAALTRFAKKCGF   60
           M I +Q+E+       T E+ + Y      +   + +I+ K+  + +A +TRF KK GF
Sbjct:   1 MGILEQLENPKFKATKSEKTLIEYIKSDLDNIIYKSISIIAKESGVGEATITRFTKKLGF   60

Query:  61 KGYREFVFEYLKS-HETISQQLYGLQNDNTKKVFMNYQEMISKSADI-------IDEEQL112
           G+++F       K    +  + L    + V     +M+   S +I         ID + +
Sbjct:  61 NGFQDFKVTLAKEISNKKNTSIINLHVHRDESVTETANKMLKSSINILEQTVKQIDLDLM120

Query: 113 LEVSHMIEQADRVYFYGKGSSSLVAKEFKIRLMRLGVICEALDDTDSFSWTNSIVNDRCL172
             +   +I   A RVYF G G S + A +    + MR+G      + D+ + +    +SI  ND +
Sbjct: 121 CKCRDLIMNAKRVYFIGIGYSGIAATDINYKFMRIGFTTVPVTDSHTMVIMSSITNDDDV180

Query: 173 VIAFSLSGNTNSVIGALKIASCHGAKTVLFTK-QPHTIDYAFDKIIQVASARHLDYGNRI231
           ++A S SG T  VI  +K A +G K + T+     +   D +   SA +        I
Sbjct: 181 IVAISNSGTTKEVIKTVKQAKENGTKIITLTEDSDNPLRKLSDYELTYTSAETIFETGSI240

Query: 232 SPQIPMLIMVDIIYAQFL                                         249
           S +IP + ++D++Y + +
Sbjct: 241 SSKIPQIFLLDLLYTEVI                                         258
```

```
Possible cleavage site: 56
>>> Seems to have no N-terminal signal sequence
INTEGRAL    Likelihood = –4.88   Transmembrane 239-255 (238-257)
----- Final Results -----
   bacterial membrane --- Certainty = 0.295 (Affirmative) <succ>
      bacterial outside --- Certainty = 0.000 (Not Clear) <succ>
         bacterial cytoplasm --- Certainty = 0.000 (Not Clear) <succ>
```

An alignment of the GAS and GBS proteins is shown below:

```
Identities = 138/263 (52%), Positives = 189/263 (71%), Gaps = 2/263 (0%)
Query:    6 QIESALDLMTDLEREIACYFMGQPISKDALASTIVTKQLHISQAALTRFAKKCGFKGYRE 65
            +IE++L+ MT LE+ IA +F+    ++    L ++ + K+LHISQAALTRFAKKCGF GYR
Sbjct:   14 KIEASLEHMTSLEKGIAHFFITTDLTPQELTASEIVKRLHISQAALTRFAKKCGFTGYRA 73

Query:   66 FVFEYLKSHETISQQLYGLQNDNTKKVFMNYQEMISKSADIIDEEQLLEVSHMIEQADRV 125
            F F+YL S +    +  + TK+V M+Y  +I+K+ ++++EE+LL ++ +I+ ++RV
Sbjct:   74 FAFDYLHSLQESQETFQSIHLELTKRVLMDYDALINKTYELVNEEKLLNLAKLIDSSERV 133

Query:  126 YFYGKGSSSLVAKEFKIRLMRLGVICEALDDTDSFSWTNSIVNDRCLVIAFSLSGNTNSV 185
            YF+GKGSS LVA+E K+R MRLG+IC+A   DTD F+W NS+VN+ CLV   FSLSG TNSV
Sbjct:  134 YFFGKGSSGLVAREMKLRFMRLGLICDAYSDTDGFTWANSLVNENCLVFGFSLSGKTNSV 193

Query:  186 IGALKIASCHGAKTVLFTKQPHT-IDYAFDKIIQVASARHLDYGNRISPQIPMLIMVDII 244
            I AL  AS  GAKTVL T    T  D + D II V+S   L YGNR+SPQ  P+LIM+DII
Sbjct:  194 ITALHQASQRGAKTVLLTTDNQTEFDDSLD-IIPVSSTHQLHYGNRVSPQFPLLIMMDII 252

Query:  245 YAQFLDINKIEKERIFRETIIQR                                     267
            YA  L I+K  KE+IF+ TII +
Sbjct:  253 YAYVLAIDKPHKEKIFKNTIIDK                                     275
```

Figure 85:
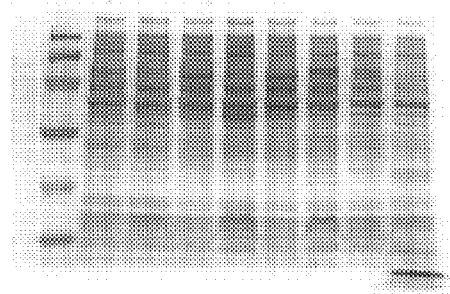
Figure 160:
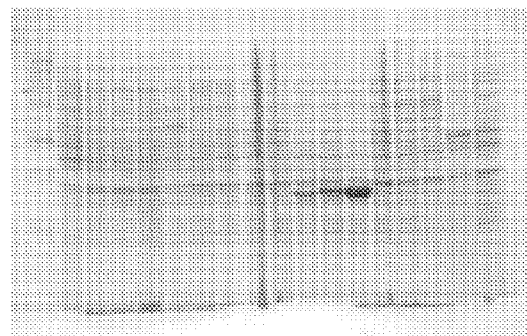

SEQ ID 916 (GBS320) was expressed in *E. coli* as a His-fusion product. SDS-PAGE analysis of total cell extract is shown in FIG. 40 (lane 5; MW 33 kDa). It was also expressed in *E. coli* as a GST-fusion product. SDS-PAGE analysis of total cell extract is shown in FIG. 85 (lane 7; MW 58 kDa) and in FIG. 160 (lane 7 & 8; MW 58 kDa).

Figure 224:
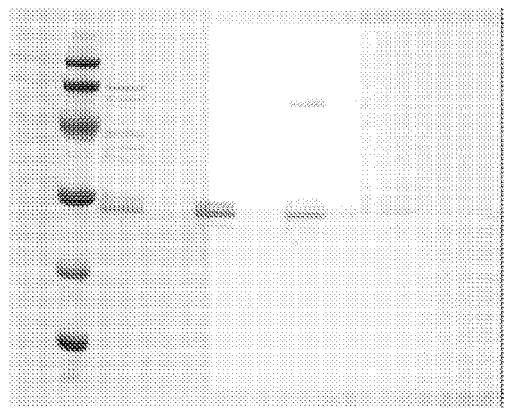

GBS320-GST was purified as shown in FIG. 224, lane 3-4.

Based on this analysis, it was predicted that these proteins and their epitopes could be useful antigens for vaccines or diagnostics.

Example 286

A DNA sequence (GBSx0313) was identified in *S. agalactiae* <SEQ ID 919> which encodes the amino acid sequence <SEQ ID 920>. This protein is predicted to be xylan esterase 1 (cephalosporin-C). Analysis of this protein sequence reveals the following:

```
Possible site: 54
>>> Seems to have no N-terminal signal sequence
----- Final Results -----
   bacterial cytoplasm --- Certainty = 0.4981 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database:

```
>GP:AAB68821 GB:AF001926 xylan esterase 1 [Thermoanaerobacterium sp.
'JW/SL YS485']
Identities = 133/299 (44%), Positives = 188/299 (62%), Gaps = 1/299 (0%)
Query:    5 MSLDDMREYLGQDQIPEDFDDFWKKQTMKYQG-NIEYRLDKKDFNITFAQAYDLHFKGSN 63
            M L +REY G + PEDFD++W +    + + +   L + F ++FA+ YDL+F G
Sbjct:    6 MPLQKLREYTGTNPCPEDFDEYWNRALDEMRSVDPKIELKESSFQVSFAECYDLYFTGVR 65

Query:   64 NSIVYAKCLFPKTNKPYPVVFYFHGYQNQSPDWSDQLNYVAAGYGVVSMDVRGQAGQSQD 123
            + ++AK + PKT    +P +  FHGY + S DW+D+LNYVAAG+ VV+MDVRGQ GQSQD
Sbjct:   66 GARIHAKYIKPKTEGKHPALIRFHGYSSNSGDWNDKLNYVAAGFTVVAMDVRGQGGQSQD 125

Query:  124 KGHFDGITVKGQIVRGMISGPNHLFYKDIYLDVFQLIDIIATLESVDSNQLYSYGWSQGG 183
            G   G T+ G I+RG+     +++ ++  I+LD   QL  I+    VD +++  G SQGG
Sbjct:  126 VGGVTGNTLNGHIIRGLDDDADNMLFRHIFLDTAQLAGIVMNMPEVDEDRVGVMGPSQGG 185

Query:  184 ALALIAAALNPKIVKTVAVYPFLSDFRRVLDLGGVSEPYDELFRYFKYSDPFHKTENNVL 243
            L+L  AAL P++  K V+ YPFLSD++RV DL       Y E+   YF+  DP H+ EN V
Sbjct:  186 GLSLACAALEPRVRKVVSEYPFLSDYKRVWDLDLAKNAYQEITDYFRLFDPRHERENEVF 245

Query:  244 KTLAYIDVKNFAHRISCPVVLLTALKDDICPPSTQFAIFNRLTSTKKHLLLPDYGHDPM 302
             L YIDVKN A RI     V++  L D +CPPST FA +N + S K   + PDYGH+PM
Sbjct:  246 TKLGYIDVKNLAKRIKGDVLMCVGLMDQVCPPSTVFAAYNNIQSKKDIKVYPDYGHEPM 304
```

No corresponding DNA sequence was identified in *S. pyogenes*.

Based on this analysis, it was predicted that this protein and its epitopes, could be useful antigens for vaccines or diagnostics.

Example 287

A DNA sequence (GBSx0314) was identified in *S. agalactiae* <SEQ ID 921> which encodes the amino acid sequence <SEQ ID 922>. Analysis of this protein sequence reveals the following:

---

Possible site: 35
>>> Seems to have no N-terminal signal sequence
INTEGRAL    Likelihood = −5.73    Transmembrane 128-144 (126-145)
----- Final Results -----
  bacterial membrane --- Certainty = 0.3293 (Affirmative) <succ>
  bacterial outside --- Certainty = 0.0000 (Not Clear) <succ>
  bacterial cytoplasm --- Certainty = 0.0000 (Not Clear) <succ>

---

The protein has homology with the following sequences in the GENPEPT database:

```
>GP:AAA23256 GB:M81878 unknown [Clostridium perfringens]
Identities = 78/160 (48%), Positives = 110/160 (68%)
Query: 131 CLTIGTGIGGCLIIDKTVFHGFSNSACEVGYMHLSDGDFQDLASTTALIADVAKAHGDEI 190
           CLTIGTGIGG LIID  V HGFSNSA E+GYM ++  + QD+AS +AL+ +VA   G E
Sbjct:  18 CLTIGTGIGGALIIDGKVLHGESNSAGEIGYMMVNGENIQDIASASALVKNVALRKGVEP 77

Query: 191 SRWDGRRIFQEAKKGNEKCIASIDRMINYLGQGIANMVYVVNPEKVVLGGGIMAQKDYLQ 250
           S  DGR +   + G+  C    ++++ + L   GI+N+VY++NPE VVLGGGIMA+++  +
Sbjct:  78 SSIDGRYVLDNYENGDLICKEEVEKLADNLALGISNIVYLINPEVVVLGGGIMAREEVFR 137

Query: 251 DKLSESLKRNLVTSLAEKTAIVFAQHENQAGMLGAYYHFK                    290
           +   SL++ L+ S+   T I FA+ +N AGM GAYY+FK
Sbjct: 138 PLIENSLRKYLIESVYNNTKIAFAKLKNTAGMKGAYYNFK                    177
```

A related DNA sequence was identified in *S. pyogenes* <SEQ ID 923> which encodes the amino acid sequence <SEQ ID 924>. Analysis of this protein sequence reveals the following:

---

Possible site: 22
>>> Seems to have no N-terminal signal sequence
INTEGRAL    Likelihood = −4.30    Transmembrane 128-144 (127-145)
INTEGRAL    Likelihood = −0.11    Transmembrane 227-243 (227-243)
----- Final Results -----
  bacterial membrane --- Certainty = 0.2720 (Affirmative) <succ>
  bacterial outside --- Certainty = 0.0000 (Not Clear) <succ>
  bacterial cytoplasm --- Certainty = 0.0000 (Not Clear) <succ>

---

The protein has homology with the following sequences in the databases:

```
>GP:BAB04516 GB:AP001509 glucose kinase [Bacillus halodurans]
Identities = 97/291 (33%), Positives = 155/291 (52%), Gaps = 14/291 (4%)
Query:   5 LAIDIGGTAIKYGLISETGDLLEKEEMATEAYKGGPSILEKVKGLVKTYQDQMDLAGVAI 64
           + ID+GGT IK  L+S+ G+++  +E  TEA +G   ++ K+  L +   D    AG+ I
Sbjct:   3 VGIDLGGTKIKAALVSDAGEIISVQECPTEAAQGPEEVMNKMMSLTEKVTDHQPFAGIGI 62

Query:  65 SSAGMVNPDEGEIFYAGPQIPNYAGTQFKKEIEETFGLPCEVENDVNCAGLAEAISGSAK 124
            + G ++   EG I  + P +P +         +E F  P +++ND N A  LAEA+ GS +
Sbjct:  63 GAPGPLSSTEGTIL-SPPNLPGWDHIHLVDRFQEQFQCPVKLDNDANVAALAEALLGSGQ 121

Query: 125 DYPVALCLTIGTGIGGCLLFNSQVFHGSSHSACEVG----------YLHLSDGQFQDLAS 174
           +      LTI TGIGG + +  +HG+S  A E+G            + +L+ G  + LAS
Sbjct: 122 GFTSVFYLTISTGIGGGYVLDGSIVHGASDYAGEIGNMIVQPNGYQHANLNPGSLEGLAS 181

Query: 175 TTALVQEVVLAYGDDISQWDGRRIFEQAKAGDAICIAAISKQVDYLGQGIANICYVVNPN 234
           TA+ +       +G  +    R +F+Q + GD      + +DYL  GIANI + +NP+
Sbjct: 182 GTAIGRMARERFG---VEGGTREVEDQIRRGDHDMQRLVEEAMDYLAIGIANIAHTINPD 238

Query: 235 VVVLGGGIMAQKDYLADKLKTALDSYLVSSLAKKTQLKFASHGNNAGILGA          285
            V VLGGG+M   D +   +K  + YL    LA+ T   + A G ++G+LGA
Sbjct: 239 VFVLGGGVMNADDLILPIVKEKVSRYLYPGLAQSTTIVKAKLGGDSGVLGA          289
```

An alignment of the GAS and GBS proteins is shown below:

```
Identities = 192/292 (65%), Positives = 237/292 (80%)
Query:    1 MTRTVAIDIGGTMIKHGIVDNLGCIVEASELATEAYKGGPGILQKVCQIIDNYLAEGSID 60
            M   +AIDIGGT IK+G++   G ++E E+ATEAYKGGP IL+KV  ++  Y  +  +
Sbjct:    1 MKHYLAIDIGGTAIKYGLISETGDLLEKEEMATEAYKGGPSILEKVKGLVKTYQDQMDLA 60

Query:   61 GIAISSAGMVDPDEGCIFYSGPQIPNYAGTQFKKVLEDTYQVRTEIENDVNCAGLAEAVS 120
            G+AISSAGMV+PDEG IFY+GPQIPNYAGTQFKK +E+T+ +   E+ENDVNCAGLAEA+S
Sbjct:   61 GVAISSAGMVNPDEGEIFYAGPQIPNYAGTQFKKEIEETFGLPCEVENDVNCAGLAEAIS 120

Query:  121 GSAKDSSIALCLTIGTGIGGCLIIDKTVFHGFSNSACEVGYMHLSDGDFQDLASTTALIA 180
            GSAKD  +ALCLTIGTGIGGCL+  + VFHG S+SACEVGY+HLSDG FQDLASTTAL+
Sbjct:  121 GSAKDYPVALCLTIGTGIGGCLLFNSQVFHGSSHSACEVGYLHLSDGQFQDLASTTALVQ 180

Query:  181 DVAKAHGDEISRWDGRRIFQEAKKGNEKCIASIDRMINYLGQGIANMVYVVNPEKVVLGG 240
            +V  A+GD+IS+WDGRRIF++AK G+  CIA+I + ++YLGQGIAN+ YVVNP  VVLGG
Sbjct:  181 EVVLAYGDDISQWDGRRIFEQAKAGDAICIAAISKQVDYLGQGIANICYVVNPNVVLGG 240

Query:  241 GIMAQKDYLQDKLSESLKRNLVTSLAEKTAIVFAQHENQAGMLGAYYHFKNR        292
            GIMAQKDYL DKL  +L   LV+SLA+KT + FA H N AG+LGAYYHFK +
Sbjct:  241 GIMAQKDYLADKLKTALDSYLVSSLAKKTQLKFASHGNNAGILGAYYHFKQK        292
```

Figure 60:
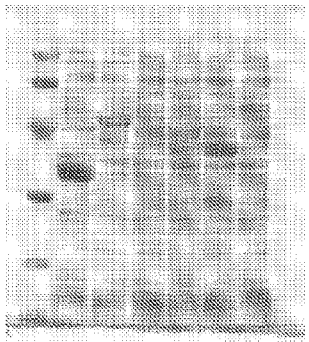
Figure 67:
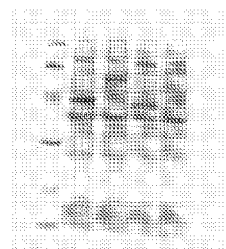

SEQ ID 922 (GBS331) was expressed in *E. coli* as a His-fusion product. SDS-PAGE analysis of total cell extract is shown in FIG. 60 (lane 2; MW 35.9 kDa). It was also expressed in *E. coli* as a GST-fusion product. SDS-PAGE analysis of total cell extract is shown in FIG. 67 (lane 3; MW 61 kDa).

Figure 309:
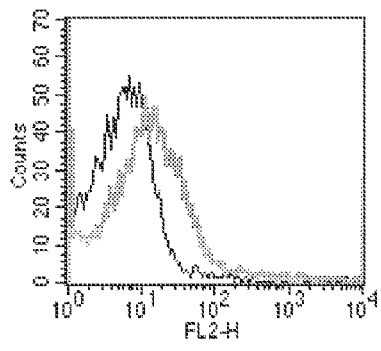

The GBS331-GST fusion product was purified (FIG. 209, lane 3) and used to immunise mice. The resulting antiserum was used for FACS (FIG. 309), which confirmed that the protein is immunoaccessible on GBS bacteria.

Based on this analysis, it was predicted that these proteins and their epitopes could be useful antigens for vaccines or diagnostics.

Example 288

A DNA sequence (GBSx0315) was identified in *S. agalactiae* <SEQ ID 925> which encodes the amino acid sequence <SEQ ID 926>. This protein is predicted to be a acylneuraminate lyase (nanA). Analysis of this protein sequence reveals the following:

```
Possible site: 18
>>> Seems to have no N-terminal signal sequence
----- Final Results -----
   bacterial cytoplasm --- Certainty = 0.0894 (Affirmative) <succ>
   bacterial membrane --- Certainty = 0.0000 (Not Clear) <succ>
     bacterial outside --- Certainty = 0.0000 (Not Clear) <succ>
```

The protein has homology with the following sequences in the GENPEPT database:

```
>GP:CAA69950 GB:Y08695 putative acylneuraminate lyase [Clostridium
tertium]
Identities = 162/225 (72%), Positives = 191/225 (84%)
Query:    1 MKDLQKYQGIIPAFYACYDDKGDICPERVKALTNYFIDKGVQGLYVNGSSGECIYQSVAD 60
            M++L+KY+GIIPAFYACYDD+G I PER +  T Y IDKGV+GLYV GSSGECIYQS +
Sbjct:    1 MRNLEKYKGIIPAFYACYDDEGKISPERTQMFTQYLIDKGVKGLYVCGSSGECIYQSKEE 60

Query:   61 RKLVLENVMSVAKGKLTVIAHVACNNTKDSVELAMHAEAIGVDAIAAIPPIYFRLPEYAI 120
            RK+ LENVM VAKGK+T+IAHV CNNT+DS ELA HAE+IGVDAIA+IPPIYF LP+Y+I
Sbjct:   61 RKITLENVMKVAKGKITIIAHVGCNNTRDSEELAEHAESIGVDAIASIPPIYFHLPDYSI 120

Query:  121 ADYWNTISQAAPQTDFIIYNIPQLAGVALTSDLYRKMLQNPQVIGVKNSSMPVQDIQNFV 180
            A+YWN IS AAP TDFIIYNIPQLAGV L  +LY++ML+NP+VIGVKNSSMPVQDIQ F
Sbjct:  121 AEYWNDISNAAPNTDFITYNIPQLAGVGLGINLYKQMLKNPRVIGVKNSSMPVQDIQMFK 180

Query:  181 AIGGENHIVFNGPDEQFLGGRLMGAAAGIGGTYGVMPELYLTLNQ              225
              I G+  +VFNGPDEQF+ GR+MGA   GIGGTY VMPEL+L   ++
Sbjct:  181 DISGDESVVFNGPDEQFVAGRIMGADGGIGGTYAVMPELFLAADK              225
```

A related DNA sequence was identified in *S. pyogenes* <SEQ ID 927> which encodes the amino acid sequence <SEQ ID 928>. Analysis of this protein sequence reveals the following:

```
Possible site: 15
>>> Seems to have no N-terminal signal sequence
----- Final Results -----
  bacterial cytoplasm --- Certainty = 0.0981 (Affirmative) <succ>
   bacterial membrane --- Certainty = 0.0000 (Not Clear)   <succ>
    bacterial outside --- Certainty = 0.0000 (Not Clear)   <succ>
```

An alignment of the GAS and GBS proteins is shown below:

```
Identities = 238/304 (78%), Positives = 263/304 (86%)
Query:    1 MKDLQKYQGIIPAFYACYDDKGDICPERVKALTNYFIDKGVQGLYVNGSSGECIYQSVAD 60
            M DL KYQGIIPAFYACYDD+G+I PERV+ALT Y+IDKGVQGLY+NGSSGECIYQSV D
Sbjct:    1 MTDLTKYQGIIPAFYACYDDQGNISPERVRALTQYYIDKGVQGLYINGSSGECIYQSVFD 60

Query:   61 RKLVLENVMSVAKGKLTVIAHVACNNTKDSVELAMHAEAIGVDAIAAIPPIYFRLPEYAI 120
            R+LVLENVM+VAKGKLT+I HVACNNTKDS+ELA H+E +GVDAIAAIPPIYFRLPEYA+
Sbjct:   61 RQLVLENVMAVAKGKLTIINHVACNNTKDSIELAAHSERLGVDAIAAIPPIYFRLPEYAV 120

Query:  121 ADYWNTISQAAPQTDFIIYNIPQLAGVALTSDLYRKMLQNPQVIGVKNSSMPVQDIQNFV 180
            ADYWN IS AAP TDFIIYNIPQLAGVALT  LY+ ML N +VIGVKNSSMPVQDIQ F
Sbjct:  121 ADYWNAISSAAPHTDFIIYNIPQLAGVALTPSLYKTMLANKRVIGVKNSSMPVQDIQTFC 180

Query:  181 AIGGENHIVFNGPDEQFLGGRLMGAAAGIGGTYGVMPELYLTLNQLIVDKDLEKARELQF 240
            AIGG++HIVFNGPDEQFLGGRLMGAAAGIGGTYG MPEL+L LNQLI DKDLEKA+ LQ+
Sbjct:  181 AIGGDDHIVFNGPDEQFLGGRLMGAAAGIGGTYGAMPELFLRLNQLIADKDLEKAKALQY 240

Query:  241 TINDIITKLCSGHGNMYAVIKAVLEINEQLTIGSVRLPLASVTEEDKPIIKEAAEMIRHA 300
            TIN+II  L S HGNMY VIK VL INE L IGSVR PLA + EED+ I + AA +I  A
Sbjct:  241 TINEIIGVLVSAHGNMYGVIKEVLRINEGLDIGSVRSPLAELVEEDRVICQRAAALINQA 300

Query:  301 KKQF 304
            K+ F
Sbjct:  301 KETF 304
```

Based on this analysis, it was predicted that these proteins and their epitopes could be useful antigens for vaccines or diagnostics.

Example 289

A DNA sequence (GBSx0317) was identified in *S. agalactiae* <SEQ ID 929> which encodes the amino acid sequence <SEQ ID 930>. Analysis of this protein sequence reveals the following:

```
Possible site: 46
>>> Seems to have an uncleavable N-term signal seq
  INTEGRAL    Likelihood = –9.45    Transmembrane 82-98 (79-111)
  INTEGRAL    Likelihood = –6.85    Transmembrane 24-40 (21-52)
  INTEGRAL    Likelihood = –5.26    Transmembrane 180-196 (172-200)
  INTEGRAL    Likelihood = –5.10    Transmembrane 160-176 (158-179)
  INTEGRAL    Likelihood = –4.35    Transmembrane 110-126 (106-130)
----- Final Results -----
   bacterial membrane --- Certainty = 0.4779 (Affirmative) <succ>
    bacterial outside --- Certainty = 0.0000 (Not Clear)   <succ>
  bacterial cytoplasm --- Certainty = 0.0000 (Not Clear)   <succ>
```

The protein has homology with the following sequences in the GENPEPT database:

```
>GP:BAB05827 GB:AP001514 unknown conserved protein in B. subtilis
[Bacillus halodurans]
Identities = 40/148 (27%), Positives = 74/148 (49%), Gaps = 4/148 (2%)
Query:   14 VNNPFMQGCNVVFDLALLNLLFMI-TCLPLVTIG--AAKISLYRTLWQKLEGD-QTNLLI 69
            +++ F Q C+ ++ LA +NLL++   T L LV +G  A    +++ L +    G+    +
Sbjct:    6 MSSRFYQTCDWIWKLAYINLLWLSGTLLGLVVLGFLPATTAMFTVLRKWFTGNPDVAITR 65

Query:   70 LYIKHLKKEWFQGMLLGLVELSILVVIIFDLTILHYQIGFIVSFLKITCYAFLLLTVMTS 129
            + +   K  E+ +  LLG V L      ++ F+   L    G +   L +  YAFL+L ++T
Sbjct:   66 TFFQAYKNEFLKINLLGAVLLLGAYILYFNYMYLGTVEGTVHMVLSLGWYAFLILYIITL 125

Query:  130 IYLFPMAARYEMSLLDTVKKSFIMACLN 157
             Y+ P     Y + L  +K + I+  +N
Sbjct:  126 FYIIPAYVHYNLKLFQYIKTALIIGFVN 153
```

A related DNA sequence was identified in *S. pyogenes* <SEQ ID 931> which encodes the amino acid sequence <SEQ ID 932>. Analysis of this protein sequence reveals the following:

Possible site: 24
>>> Seems to have no N-terminal signal sequence
INTEGRAL    Likelihood = −14.86   Transmembrane 117-133 (108-139)
INTEGRAL    Likelihood = −7.48    Transmembrane 30-46 (21-54)
INTEGRAL    Likelihood = −6.90    Transmembrane 88-104 (83-105)
INTEGRAL    Likelihood = −6.26    Transmembrane 165-181 (151-187)
INTEGRAL    Likelihood = −5.89    Transmembrane 189-205 (182-207)
----- Final Results -----
    bacterial membrane --- Certainty = 0.6944 (Affirmative) <succ>
        bacterial outside --- Certainty = 0.0000 (Not Clear) <succ>
            bacterial cytoplasm --- Certainty = 0.0000 (Not Clear) <succ>

A related GBS gene <SEQ ID 8535> and protein <SEQ ID 8536> were also identified. Analysis of this protein sequence reveals the following:

Lipop: Possible site: −1    Crend: 2
McG: Discrim Score: 3.27
GvH: Signal Score (−7.5) : −4.23
Possible site: 46
>>> Seems to have an uncleavable N-term signal seq
ALOM program count: 5   value: −9.45   threshold: 0.0
INTEGRAL    Likelihood = −9.45    Transmembrane 82-98 (79-111)
INTEGRAL    Likelihood = −6.85    Transmembrane 24-40 (21-52)
INTEGRAL    Likelihood = −5.26    Transmembrane 180-196 (172-200)
INTEGRAL    Likelihood = −5.10    Transmembrane 160-176 (158-179)
INTEGRAL    Likelihood = −4.35    Transmembrane 110-126 (106-130)
PERIPHERAL  Likelihood = 5.89     142
modified ALOM score: 2.39
*** Reasoning Step: 3
----- Final Results -----
    bacterial membrane --- Certainty = 0.4779 (Affirmative) <succ>
        bacterial outside --- Certainty = 0.0000 (Not Clear) <succ>
            bacterial cytoplasm --- Certainty = 0.0000 (Not Clear) <succ>

The protein has homology with the following sequences in the databases:

```
>GP:BAB05582 GB:AP001513 unknown conserved protein in bacilli
[Bacillus halodurans]

Identities = 59/194 (30%), Positives = 93/194 (47%), Gaps = 11/194 (5%)
Query:  17 SKWMRASAALFDLLVFNLLFVL-SCLPLLTIGV--AKMALYASLLDWREGQVS-QLVTTY  72
           +K M+   +  L+  NLL++L S +  +GV  A   +L+A       W + +   L  TY
Sbjct:   8 TKIMKLFEWIMRLVYLNLLWLLFSFIGGIILGVMPATASLFAVFRKWYQKEDDFPLFQTY  67

Query:  73 SSHFKYYFKSGLRLGLIELGIMTICLLDLFLIRNQSGLVFQGFKVLCVAVLFLVVILFLY 132
           + FK   FK   +GL +  I   I LD+ L+   S + Q     A+ F+ ++    LY
Sbjct:  68 LNEFKRSFKIANLVGLTLVLIGGILYLDVLLLLGTSHWIGQLLLMGVGALSFIYLVTLLY 127

Query: 133 AYPQAVKRDLSLSTLFKRSFLLAGLFFPWSFAFLAFICLTIFSLQL----SLLTLFGGVS 188
           +P  V   DLS    FK SFLL G+  P+   L  I L++  +L     LL LF   S
Sbjct: 128 IFPTLVHFDLSYKQYFKHSFLL-GVLQPFR-TLLLMITLSLSALLFLTFPILLPLF-AAS 184

Query: 189 LLAIIGISSLTYLY                                               202
           +A + S  + Y
Sbjct: 185 FMAALTMWSFLFGY                                               198
```

An alignment of the GAS and GBS proteins is shown below:

```
Identities = 68/210 (32%), Positives = 117/210 (55%)
Query:   3 KANQLIAAIFDVNNPFMQGCNVVFDLALLNLLFMITCLPLVTIGAAKISLYRTLWQKLEG  62
           K    L+ ++F +++  +M+     +FDL + NLLF+++CLPL+TIG AK++LY  +L     EG
Sbjct:   4 KKQGLLHSLFKLDSKWMRASAALFDLLVFNLLFVLSCLPLLTIGVAKMALYASLLDWREG   63

Query:  63 DQTNLLILYIKHLKKEWFQGMLLGLVELSILVVIIFDLTILHYQIGFIVSFLKITCYAFL 122
            + L+   Y  H K     G+   LGL+EL I+ +  + DL ++    Q G +     K+ C A L
Sbjct:  64 QVSQLVTTYSSHFKYYFKSGLRLGLIELGIMTICLLDLFLIRNQSGLVFQGFKVLCVAVL 123

Query: 123 LLTVMTSIYLFPMAARYEMSLLDTVKKSFIMACLNLKWTGVLMFLLIMTWFIMVQSSLLF 182
           L V+  +Y +P A   ++SL        K+SF++A L    W+    +  +T F + S L
Sbjct: 124 FLVVILFLYAYPQAVKRDLSLSTLFKRSFLLAGLFFPWSFAFLAFICLTIFSLQLSLLTL 183

Query: 183 MLTVSAIFIFAYTAFAYFKIIILQKQFAYF                               212
              VS + I    ++  Y   +II++      F
Sbjct: 184 FGGVSLLAIIGISSLTYLYLIIMESLLRRF                               213
```

The protein has homology with the following sequences in the databases:

No corresponding DNA sequence was identified in *S. pyogenes*.

```
ORF00072(364-828 of 1260)
EGAD|108353|BS3003(14-171 of 222) hypothetical protein {Bacillus subtilis}
OMNI|NT01BS3507 conserved hypothetical protein GP|2635493|emb|CAB14987.1| |Z99119 similar to
hypothetical proteins from B. subtilis {Bacillus subtilis}
GP|2293197|gb|AAC00275.1| |AF008220 YteU {Bacillus subtilis} PIR|D69991|D69991 conserved
hypothetical protein yteU - Bacillus subtilis
% Match = 5.9
% Identity = 26.6 % Similarity = 50.6
Matches = 42 Mismatches = 74 Conservative Sub.s = 38

270       300       330       360       390       417       441       471
IMSKKGY*KC*WRKKYREYIVKKANQLIAAIFDVNNPFMQGCNVVFDLALLNLLFMI-TCLPLVTIG--AAKISLYRTLW
                                 |  :  :|  |||::  |||    |    |    :|:  :
                        MEHDGSLGRMLRFCEWIMRFAYTNLLWLFFTLLGLGVFGIMPATAALFAVMR
                                 10        20        30        40        50

498       528       558       588       618       648       678       708
QKLEG-DQTNLLILYIKHLKKEWFQGMLLGLVELSILVVIIFDLTILHYQIGFIVSFLKITCYAFLLLTVMTSIYLFPMA
:  ::|   |    :|  | |:|:  |||     |  |:|  ||:|   |  |:       |  ||      |:||:
KWIQGQDNVPVLKTFWQEYKGEFFRSNLLGAVLALIGVIIYIDLALI-YPSHFLLHILRFAIMIFGPLFVSMLFYVFPLL
          70        80        90       100       110       120       130

738       768       798       828       858       888       918       948
ARYEMSLLDTVKKSFIMACLNLKWTGVLMFLLIMTWFIMVQSSLLFMLTVSAIFIFAYTAFAYFKIIILQKQFAYFSKQQ
 ::       ||  |::::    |::|    ::  |  :   :|::
VHFDWKKRLYVKFSLLLLSVAYLQYTLTMLALTVALFFLLAYLPGIVPFFSVSLISYCHMRIVYAVLLKVEQHGGEPQRKS
         150       160       170       180       190       200       210
```

Based on this analysis, it was predicted that these proteins and their epitopes could be useful antigens for vaccines or diagnostics.

Based on this analysis, it was predicted that this protein and its epitopes, could be useful antigens for vaccines or diagnostics.

Example 290

A DNA sequence (GBSx0318) was identified in *S. agalactiae* <SEQ ID 933> which encodes the amino acid sequence <SEQ ID 934>. Analysis of this protein sequence reveals the following:

Example 291

A DNA sequence (GBSx0319) was identified in *S. agalactiae* <SEQ ID 935> which encodes the amino acid sequence <SEQ ID 936>. This protein is predicted to be sugar ABC transporter, permease protein (araQ). Analysis of this protein sequence reveals the following:

```
Possible site: 51
>>> Seems to have no N-terminal signal sequence
----- Final Results -----
    bacterial cytoplasm --- Certainty = 0.1827 (Affirmative) <succ>
      bacterial membrane --- Certainty = 0.0000 (Not Clear) <succ>
        bacterial outside --- Certainty = 0.0000 (Not Clear) <succ>
```

```
Possible site: 35
>>> Seems to have a cleavable N-term signal seq.
INTEGRAL    Likelihood = –7.38    Transmembrane 245-261 (239-265)
INTEGRAL    Likelihood = –3.72    Transmembrane 140-156 (139-158)
INTEGRAL    Likelihood = –3.61    Transmembrane 76-92 (71-94)
INTEGRAL    Likelihood = –2.81    Transmembrane 112-128 (107-128)
INTEGRAL    Likelihood = –1.59    Transmembrane 188-204 (186-204)
----- Final Results -----
```

The protein has homology with the following sequences in the GENPEPT database:

```
>GP:AAC44392 GB:U43526 ORF-1 [Streptococcus pneumoniae]
Identities = 48/151 (31%), Positives = 66/151 (42%), Gaps = 5/151 (3%)
Query:   1 MIYDHLLNLTHYKDINPNLDLAIDYLLSHDLRNLDIGTYHISPEVILMVQSNQLSES-FD 59
           MI   + L  Y  +NP+    ID+L    L NL  G+  I    +        L++
Sbjct:   1 MIITKISRLGTYVGVNPHFATLIDFLEKTGLENLTEGSIAIDGNRLFGNCFTYLADGQAG 60

Query:  60 HIFEYHKKYLDIHYVIEGHEVIKLGKGDKVEV-EEY--LGDIGFIKCSEETSFDLRDNYI 116
              FE H+KYLDIH V+E  E + +     + V V +EY    DI      E    LR
Sbjct:  61 AFFETHQKYLDIHLVLENEEAMAVTSPENVSVTQEYDEEKDIELYTGKVEQLVHLRAGEC 120

Query: 117 AFFFPEEAHQPNGMGSLGNYVKKGVLKVLMA                             147
           FPE+ HQP  +       VKK V KV ++
Sbjct: 121 LITFPEDLHQPK-VRINDEPVKKVVFKVAIS                             150
``` bacterial membrane --- Certainty = 0.3951 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the GENPEPT database:

```
>GP:AAD35515 GB:AE001721 sugar ABC transporter, permease protein
[Thermotoga maritime]

Identities = 94/262 (35%), Positives = 158/262 (59%), Gaps = 1/262 (0%)
Query:   15 LILCLLTVLFIFPFYWIMTGAFKSQPDTIIIPPQWWPKAPTLENFKALTVQNPALRWLWN  74
            + +  + V+F+ P ++ +  +FK    +   PP +PK P+LE + +    L +L N
Sbjct:    9 IFIVFMLVVFMLPVFYAVVSSFKPMSEIYSYPPTIFPKKPSLEGYINVIKEYDLLTYLRN  68

Query:   75 SVFISIMTMFLVCCTSSMAGYVLAKKRFYGQKILFSLFIAAMALPKQVVLVPLVRIINFM 134
            ++F++ +  +     S M GY LAK +F+G + + S+F   M +  QV++VPL  +I  +
Sbjct:   69 TLFVATVATVITVLVSVMTGYGLAKGKFWGIRPVNSMFTMTMFVSAQVIMVPLFVVIRSL 128

Query:  135 GIHDTLWAVILPLVGWPFGVFLMKQFSENIPTELLESAKIDGCGEIRTFINVAFPIVKPG 194
            G+ ++LW +I+P V  P G+F+  Q+ ++IP ELLESAKIDG  E + F   FP+ KP
Sbjct:  129 GLINSLWGLIIPAVYTPTGMFMAVQYMKDIPDELLESAKIDGANEWQIFWRIVFPLSKPL 188

Query:  195 FAALAIFTFINTWNDYFMQLVMLTSRNNLTISLGVATMQAEM-ATNYGLIMAGAALAAVP 253
            AALAIF+F   WND+ + L+++  RN   T+ L +AT+Q E     + I+A  + L  +P
Sbjct:  189 VAALAIFSFTWRWNDFVLPLLVVNRRNLYTLQLALATIQEEYGGAEWNTILAFSTLTIIP 248

Query:  254 IVTVFLVFQKSFTQGITMGAVK 275
            +  +FL+FQ+ F +GI  G +K
Sbjct:  249 TLIIFLLFQRLFMKGIMAGGLK 270
```

A related DNA sequence was identified in *S. pyogenes* <SEQ ID 937> which encodes the amino acid sequence <SEQ ID 938>. Analysis of this protein sequence reveals the following:

Possible site: 40
>>> Seems to have a cleavable N-term signal seq.

| INTEGRAL | Likelihood = −6.37 | Transmembrane 245-261 (240-265) |
| INTEGRAL | Likelihood = −5.15 | Transmembrane 140-156 (139-158) |
| INTEGRAL | Likelihood = −2.97 | Transmembrane 111-127 (107-128) |
| INTEGRAL | Likelihood = −2.87 | Transmembrane 76-92 (75-93) |
| INTEGRAL | Likelihood = −1.59 | Transmembrane 188-204 (186-204) |

----- Final Results -----
bacterial membrane --- Certainty = 0.3548 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the databases:

```
>GP:CAB59597 GB:AL132662 probable sugar transport inner membrane
protein [Streptomyces coelicolor A3(2)]
Identities = 88/262 (33%), Positives = 147/262 (55%)
Query:   15 VMLCVLTILFIFPFYWIMTGAFKAQADTIMIPPQWWPKAPTIENFKALVVQNPALKWLWN  74
            ++L  L ++F  P W++  +  + A+      PP WP    ++ ++       +W  N
Sbjct:   38 LLLAPLALVFAVPLVWLVLSSVMSNAEINRFPPALWPSGIDLGGYRYVLGNAMFPRWFVN  97

Query:   75 SVFISVATMFLVCGTSSLAGYALAKKRFYGQRLLFSIFIAAMALPKQVVLVPLVRIVNFM 134
            S+ +S  T+       SLAGYA A+ RF G R+L  + +A MA+P Q+ ++P  ++  +
Sbjct:   98 SLIVSAVTVAANLVFGSLAGYAFARMRFAGSRVLMGLMLATMAVPFQLTMIPTFLVMKKL 157

Query:  135 GIHDTLAAVILPLVGWPFGVFLMKQFSENIPTELLESAKIDGCGEIRTFFNVAFPIVKPG 194
            G+ DTL A+I+P +  PF VFL++QF  ++P EL E+A IDGC +R  + + P+ +P
Sbjct:  158 GLIDTLGALIVPSLVTPFAVFLLRQFFLSLPRELEEAAWIDGCSRLRVLWRIVLPLSRPA 217

Query:  195 FAALAIFTFINTWNDYFMQLVMLTSRENLTISLGVATMQAEMATNYGLIMAGAAMAAVPI 254
             A +A+ TF+  TWND  L+ +      T+ LG+ T Q + +    +MAG   +P+
Sbjct:  218 LATAVLTFLTTWNDLTWPLIAINHDTQYTLQLGLTTFQGQHHTQWAAVMAGNVITVLPV 277

Query:  255 VTVFLVFQKSFTQGITMGAVKG 276
             +   FL  QK+F Q IT   +KG
Sbjct:  278 LLAFLGAQKTFIQSITSSGLKG 299
```

An alignment of the GAS and GBS proteins is shown below:

```
Identities = 245/276 (88%), Positives = 262/276 (94%)
Query:    1 MKKKTFSAYNFLTALILCLLTVLFIFPFYWIMTGAFKSQPDTIIIPPQWWPKAPTLENFK 60
            M KK  +A + LT ++LC+LT+LFIFPFYWIMTGAFK+Q DTI+IPPQWWPKAPT+ENFK
Sbjct:    1 MTKKKLTASDILTTVMLCVLTILFIFPFYWIMTGAFKAQADTIMIPPQWWPKAPTIENFK 60

Query:   61 ALTVQNPALRWLWNSVFISIMTMFLVCCTSSMAGYVLAKKRFYGQKILFSLFIAAMALPK 120
            AL VQNPAL+WLWNSVFIS+ TMFLVC TSS+AGY LAKKRFYGQ++LFS+FIAAMALPK
Sbjct:   61 ALVVQNPALKWLWNSVFISVATMFLVCGTSSLAGYALAKKRFYGQRLLFSIFIAAMALPK 120

Query:  121 QVVLVPLVRIINFMGIHDTLWAVILPLVGWPFGVFLMKQFSENIPTELLESAKIDGCGEI 180
            QVVLVPLVRI+NFMGIHDTL AVILPLVGWPFGVFLMKQFSENIPTELLESAKIDGCGEI
Sbjct:  121 QVVLVPLVRIVNFMGIHDTLAAVILPLVGWPFGVFLMKQFSENIPTELLESAKIDGCGEI 180

Query:  181 RTFINVAFPIVKPGFAALAIFTFINTWNDYFMQLVMLTSRNNLTISLGVATMQAEMATNY 240
            RTF NVAFPIVKPGFAALAIFTFINTWNDYFMQLVMLTSR NLTISLGVATMQAEMATNY
Sbjct:  181 RTFFNVAFPIVKPGFAALAIFTFINTWNDYFMQLVMLTSRENLTISLGVATMQAEMATNY 240

Query:  241 GLIMAGAALAAVPIVTVFLVFQKSFTQGITMGAVKG                        276
            GLIMAGAA+AAVPIVTVFLVFQKSFTQGITMGAVKG
Sbjct:  241 GLIMAGAAMAAVPIVTVFLVFQKSFTQGITMGAVKG                        276
```

Based on this analysis, it was predicted that these proteins and their epitopes could be useful antigens for vaccines or diagnostics.

Example 292

A DNA sequence (GBSx0320) was identified in *S. agalactiae* <SEQ ID 939> which encodes the amino acid sequence <SEQ ID 940>. Analysis of this protein sequence reveals the following:

---

Possible site: 31
>>> Seems to have a cleavable N-term signal seq.
INTEGRAL    Likelihood = −10.83   Transmembrane 74-90 (64-96)
INTEGRAL    Likelihood = −6.37    Transmembrane 108-124 (107-126)
INTEGRAL    Likelihood = −5.84    Transmembrane 270-286 (265-290)
INTEGRAL    Likelihood = −5.20    Transmembrane 161-177 (156-182)
INTEGRAL    Likelihood = −0.16    Transmembrane 219-235 (219-235)
----- Final Results -----
    bacterial membrane --- Certainty = 0.5331 (Affirmative) <succ>
    bacterial outside --- Certainty = 0.0000 (Not Clear) <succ>
    bacterial cytoplasm --- Certainty = 0.0000 (Not Clear) <succ>

---

The protein has homology with the following sequences in the GENPEPT database:

```
>GP:BAB05584 GB:AP001513 sugar transport system (permease) (binding
protein dependent transporter) [Bacillus halodurans]
Identities = 106/289 (36%), Positives = 168/289 (57%), Gaps = 6/289 (2%)

Query:    9 RETMIAYAFLAPILLFFLIFVFAPMVMGFVTSFFNYSM-TQFTFIGLANYNRMF-HDSIF  66
            +E     Y F+AP ++ F IF   PM+      SF ++  +  + G  NY R+F  D +F
Sbjct:   25 KEYFWGYLFIAPPIIGFAIFALGPMLYSIYVSFTDFDLYNEPVWTGADNYYRLFVTDDLF  84

Query:   67 MKSLINTVIIVIGSVPVVVFFSLFVAANTYEKNVFSRSFYRCVFFLPVVTGSVAVTVVWK 126
            +K++ NT    +G +P+ +  SL +A    +K V   +R FFLP V+ VA+T++W+
Sbjct:   85 RKTVFNTFYAALG-IPIGMAVSLGIAVALNQK-VKGIALFRTAFFLPAVSSVVAITLLWR 142

Query:  127 WIYDPMSGILNYILKSGHVIEQNISWLGDKHWALLAIIIILLTTSVGQPIILYIAAMGNI 186
            WI++   G+LN +L   +V       WL D+ WA+ A+II +   +G +ILY+AA+   +
Sbjct:  143 WIFNADFGLLNIMLN--YVGIHGPGWLSDEKWAMPAMIIQGVWGGLGINMILYLAALQGV 200

Query:  187 DNSLCEAARVDGANEMQVFWQIKWPSLLPTTLYIAVITTINSFQCFALIQLLTSGGPNYS 246
            + +L EAA +DG N  Q F   I   PS+ PTT +I + +TI + Q F     ++T GGPNYS
Sbjct:  201 NPALYEAADIDGGNAWQKFIHITVPSISPTTFFILITSTIGALQDFQRFMIMTEGGPNYS 260

Query:  247 TSTLMYYLYEKAFKLSEYGYANTMGVFLAVMIALISFAQFKILGNDVEY            295
            T+T++++YYL+  AF+   E GYA+ M   L  ++I +I+    FK+    V Y
Sbjct:  261 TTTVVYYLFLNAFRYMEMGYASAMAWVLGIIILIITIINFKLAKKWVHY            309
```

A related DNA sequence was identified in *S. pyogenes* <SEQ ID 941> which encodes the amino acid sequence <SEQ ID 942>. Analysis of this protein sequence reveals the following:

---

Possible site: 13
>>> Seems to have no N-terminal signal sequence
INTEGRAL    Likelihood = −12.74   Transmembrane 55-71 (44-78)
INTEGRAL    Likelihood = −10.83   Transmembrane 109-125 (98-130)
INTEGRAL    Likelihood = −6.21    Transmembrane 304-320 (299-324)
INTEGRAL    Likelihood = −6.00    Transmembrane 142-158 (141-160)
INTEGRAL    Likelihood = −5.04    Transmembrane 196-212 (190-216)
INTEGRAL    Likelihood = −0.16    Transmembrane 253-269 (253-269)
----- Final Results -----
    bacterial membrane --- Certainty = 0.6095 (Affirmative) <succ>
    bacterial outside --- Certainty = 0.0000 (Not Clear) <succ>
    bacterial cytoplasm --- Certainty = 0.0000 (Not Clear) <succ>

---

The protein has homology with the following sequences in the databases:

```
>GP:BAB05584 GB:AP001513 sugar transport system (permease) (binding
protein dependent transporter) [Bacillus halodurans]
Identities = 113/310 (36%), Positives = 176/310 (56%), Gaps = 9/310 (2%)

Query:  25 KVEQKKEVFQVNVNKLKMR---ETLISYAFLAPVLVFFVIFVLIPMIMGFVTSFFNYSM-    80
            +VE +E     K K R   E    Y F+AP ++ F IF L PM+    SF ++ +
Sbjct:   4 EVETPRETKTTKARKQKRRLNKEYFWGYLFIAPPIIGFAIFALGPMLYSIYVSFTDFDLY    63

Query:  81 TEFTFVGFANYARMF-QDPIFMKSLINTLIIVIGSVPVVVFFSLFVAAKTYDKNVVARSF   139
            E  + G  NY R+F  D +F K++ NT      +G +P+ +  SL +A     K V  +
Sbjct:  64 NEPVWTGADNYYRLFVTDDLFRKTVFNTFYAALG-IPIGMAVSLGIAVALNQK-VKGIAL   121

Query: 140 YRAVFFLPVVTGSVAVTVVWKWIYDPMSGILNYVLKYAHVIEQNISWLGDKHWALLAIIV   199
            +R   FFLP V+   VA+T++W+WI++    G+LN +L Y +     WL D+ WA+ A+I+
Sbjct: 122 FRTAFFLPAVSSVVAITLLWRWIFNADFGLLNIMLNYVGI--HGPGWLSDEKWAMPAMII   179

Query: 200 ILLTTSVGQPIILYIAAMGNIDNSLVEAARVDGATEFQVFWNIKWPSLLPTTLYIAVITT   259
                +   +G  +ILY+AA+  ++ +L EAA +DG    +Q F +I   PS+ PTT +I + +T
Sbjct: 180 QGVWGGLGINMILYLAALQGVNPALYEAADIDGGNAWQKFIHITVPSISPTTFFILITST   239

Query: 260 INSFQCFALIQLLTSGGPNYSTSTLMYYLYEKAFKLSEYGYANTMGVFLAVMIAIISFAQ   319
             I + Q F    ++T GGPNYST+T++YYL+  AF+   E GYA+ M   L ++I II+
Sbjct: 240 IGALQDFQRFMIMTEGGPNYSTTTVVYYLFLNAFRYMEMGYASAMAWVLGIIILIITIIN   299

Query: 320 FKILGNDVEY                                                     329
            FK+    V Y
Sbjct: 300 FKLAKKWVHY                                                     309
```

An alignment of the GAS and GBS proteins is shown below:

```
Identities = 263/295 (89%), Positives = 278/295 (94%)

Query:   1 MRTNKLKMRETMIAYAFLAPILLFFLIFVFAPMVMGFVTSFFNYSMTQFTFIGLANYNRM    60
            + NKLKMRET+I+YAFLAP+L+FF+IFV  PM+MGFVTSFFNYSMT+FTF+G ANY RM
Sbjct:  35 VNVNKLKMRETLISYAFLAPVLVFFVIFVLIPMIMGFVTSFFNYSMTEFTFVGFANYARM    94

Query:  61 FHDSIFMKSLINTVIIVIGSVPVVVFFSLFVAANTYEKNVFSRSFYRCVFFLPVVTGSVA   120
            F D IFMKSLINT+IIVIGSVPVVVFFSLFVAA TY+KNV +RSFYR VFFLPVVTGSVA
Sbjct:  95 FQDPIFMKSLINTLIIVIGSVPVVVFFSLFVAAKTYDKNVVARSFYRAVFFLPVVTGSVA   154

Query: 121 VTVVWKWIYDPMSGILNYILKSGHVIEQNISWLGDKHWALLAIIIILLTTSVGQPIILYI   180
            VTVVWKWIYDPMSGILNY+LK  HVIEQNISWLGDKHWALLAII+ILLTTSVGQPIILYI
Sbjct: 155 VTVVWKWIYDPMSGILNYVLKYAHVIEQNISWLGDKHWALLAIIVILLTTSVGQPIILYI   214

Query: 181 AAMGNIDNSLCEAARVDGANEMQVFWQIKWPSLLPTTLYIAVITTINSFQCFALIQLLTS   240
            AAMGNIDNSL EAARVDGA E QVFW IKWPSLLPTTLYIAVITTINSFQCFALIQLLTS
Sbjct: 215 AAMGNIDNSLVEAARVDGATEFQVFWNIKWPSLLPTTLYIAVITTINSFQCFALIQLLTS   274

Query: 241 GGPNYSTSTLMYYLYEKAFKLSEYGYANTMGVFLAVMIALISFAQFKILGNDVEY        295
            GGPNYSTSTLMYYLYEKAFKLSEYGYANTMGVFLAVMIA+ISFAQFKILGNDVEY
Sbjct: 275 GGPNYSTSTLMYYLYEKAFKLSEYGYANTMGVFLAVMIAIISFAQFKILGNDVEY        329
```

Based on this analysis, it was predicted that these proteins and their epitopes could be useful antigens for vaccines or diagnostics.

Possible site: 31
>>> Seems to have a cleavable N-term signal seq.
----- Final Results -----
   bacterial outside --- Certainty = 0.3000 (Affirmative) <succ>
   bacterial membrane --- Certainty = 0.0000 (Not Clear) <succ>
   bacterial cytoplasm --- Certainty = 0.0000 (Not Clear) <succ>

Example 293

A DNA sequence (GBSx0321) was identified in *S. agalactiae* <SEQ ID 943> which encodes the amino acid sequence <SEQ ID 944>. Analysis of this protein sequence reveals the following:

The protein has homology with the following sequences in the GENPEPT database:

```
>GP:CAB12516 GB:Z99107 similar to sugar-binding protein [Bacillus subtilis]
Identities = 54/187 (28%), Positives = 90/187 (47%), Gaps = 14/187 (7%)

Query:  19 MFACVDSSQSVMAAEKD-KVEITWWAFPTFTQEKAKDGVGTYEKKVIKAFEKKNPNIKVK    77
            MF+  + +   ++D  + I WW       D    Y KVI+ +EKKNP++ ++
Sbjct:   1 MFSGCSAGEEASGKKEDVTLRIAWWG-----GQPRHD----YTTKVIELYEKKNPHVHIE    51

Query:  78 LETIDFTSGPEKITTAIEAGTAPDVLFDAPGRIIQYGKNGKLADLNDLFTDQFIKDVN--   135
            E  ++ +K+    AG  PDV+     + QYGK +L DL   D  I DV+
Sbjct:  52 AEFANWDDYWKKLAPMSAAGQLPDVIQMDTAYLAQYGKKNQLEDLTPYTKDGTI-DVSSI   110
```

-continued

```
Query: 136  NKNIIQASKSGDKAYMYPISSAPFYMAFNKKMLKDAGVLKLVKEGWTTSDFEKVLKALKN  195
            ++N++    K   +K Y + +        + N+ +LK AGV   + +E WT  D+EK+    L+
Sbjct: 111  DENMLSGGKIDNKLYGFTLGVNVLSVIANEDLLKKAGV-SINQENWTWEDYEKLAYDLQE  169

Query: 196  KGYTPGS                                                      202
            K    GS
Sbjct: 170  KAGVYGS                                                      176
```

A related DNA sequence was identified in *S. pyogenes* <SEQ ID 945> which encodes the amino acid sequence <SEQ ID 946>. Analysis of this protein sequence reveals the following:

---

Possible site: 20
>>> May be a lipoprotein
----- Final Results -----
　　bacterial membrane --- Certainty = 0.0000 (Not Clear) <succ>
　　　bacterial outside --- Certainty = 0.0000 (Not Clear) <succ>
　　　　bacterial cytoplasm --- Certainty = 0.0000 (Not Clear) <succ>

---

The protein has homology with the following sequences in the databases:

```
!GB:Z99107 similar to sugar-binding protein [Bacillu... 82 2e-14

>GP:CAB12516 GB:Z99107 similar to sugar-binding protein [Bacillus subtilis]

Identities = 105/446 (23%), Positives = 176/446 (38%), Gaps = 71/446 (15%)

Query:  24  GKSQKEAGASKSDTAKTEITWWAFPVFTQEKAEDGVGTYEKKLIAAFEKANPEIKVKLET   83
            G S  E  + K  +    I WW         + D    Y  K+I  +EK NP + ++ E
Sbjct:   4  GCSAGEEASGKKEDVTLRIAWWG-----GQPRHD----YTTKVIELYEKKNPHVHIEAEF   54

Query:  84  IDFTSGPEKITTAIEAGTAPDVLFDAPGRIIQYGKNGKLADLNDLFTEEFTKDVN--NDK  141
            ++    +K+      AG  PDV+     +  QYGK +L DL   +T++ T DV+    ++
Sbjct:  55  ANWDDYWKKLAPMSAAGQLPDVIQMDTAYLAQYGKKNQLEDLTP-YTKDGTIDVSSIDEN  113

Query: 142  LIQASKAGDTAYMYPISSAPFYMALNKKMLKDAGVLDLVKEGWTTDDFEKVLKALKDK--  199
            ++    K  + Y + +        + N+ +LK AGV  + +E WT +D+EK+   L++K
Sbjct: 114  MLSGGKIDNKLYGFTLGVNVLSVIANEDLLKKAGV-SINQENWTWEDYEKLAYDLQEKAG  172

Query: 200  -----GYNPGSFFANGQGGDQGPRAFFANLYSSHITDDKV---------------TKYTT  239
                 G +P    F     +G R +  +       DD++               T   T
Sbjct: 173  VYGSNGMHPPDIFFPYYLRTKGERFYKEDGTGLAYQDDQLFVDYFERQLRLVKAKTSPTP  232

Query: 240  DDANSIKAMTKISNWIKDGLMMNGSQYDGSADIQNFANGQTSFTILWAPAQPGIQAKLLE  299
            D++  IK M       +D ++ G    SA   N++N  F            A+L +
Sbjct: 233  DESAQIKGM-------EDDFIVKGK----SAITWNYSNQYLGF------------ARLTD  269

Query: 300  ASKVDYLEIPFPSDDGKPELEYLVNGFAVFNNKDEQKVAASKTFIQFIADDKEWGPKNVV  359
            +      YL   P  + L    +         E K A+K FI F  +++E   + +
Sbjct: 270  SPLSLYLP---PEQMQEKALTLKPSMLFSIPKSSEHKKEAAK-FINFFVNNEE-ANQLIK  324

Query: 360  RTGAFPVRTSYGDLYKDKRMEK---IAEWTKFYSPYYNTID-----GFAEMRTLWFPMVQ  411
                  PV     D   K K  E+    I E+ +   S    + D         G AE+   L
Sbjct: 325  GERGVPVSDKVADAIKPKLNEEETNIVEYVETASKNISKADPPEPVGSAEVIKLLKDTSD  384

Query: 412  AVSNGDEKPEDALKAFTEKANKTIKK                                   437
             +        PE  A  K F  +KAN+  +++
Sbjct: 385  QILYQKVSPEKAAKTFRKKANEILER                                   410
```

An alignment of the GAS and GBS proteins is shown below:

```
Identities = 352/438 (80%), Positives = 384/438 (87%), Gaps = 4/438 (0%)

Query:   1  MSIKKSVIGFCLGAAALSMFACVDSSQSVMAAEKD---KVEITWWAFPTFTQEKAKDGVG   57
            M++KK     LGA+ L + AC   SQ    A K   K EITWWAFP FTQEKA+DGVG
Sbjct:   1  MNMKKLASLAMLGASVLGLAACGGKSQKEAGASKSDTAKTEITWWAFPVFTQEKAEDGVG   60

Query:  58  TYEKKVIKAFEKKNPNIKVKLETIDFTSGPEKITTAIEAGTAPDVLFDAPGRIIQYGKNG  117
            TYEKK+I AFEK NP IKVKLETIDFTSGPEKITTAIEAGTAPDVLFDAPGRIIQYGKNG
Sbjct:  61  TYEKKLIAAFEKANPEIKVKLETIDFTSGPEKITTAIEAGTAPDVLFDAPGRIIQYGKNG  120

Query: 118  KLADLNDLFTDQFIKDVNNKNIIQASKSGDKAYMYPISSAPFYMAFNKKMLKDAGVLKLV  177
            KLADLNDLFT++F KDVNN +IQASK+GD AYMYPISSAPFYMA NKKMLKDAGVL LV
Sbjct: 121  KLADLNDLFTEEFTKDVNNDKLIQASKAGDTAYMYPISSAPFYMALNKKMLKDAGVLDLV  180

Query: 178  KEGWTTSDFEKVLKALKNKGYTPGSFFANGQGGDQGPRAFFANLYSAPITDKEVTKYTTD  237
            KEGWTT DFEKVLKALK+KGY PGSFFANGQGGDQGPRAFFANLYS+ ITD +VTKYTTD
Sbjct: 181  KEGWTTDDFEKVLKALKDKGYNPGSFFANGQGGDQGPRAFFANLYSSHITDDKVTKYTTD  240

Query: 238  TKNSVKSMKKIVEWIKKGYLMNGSQYDGSADIQNFANGQTAFTILWAPAQPKTQAKLLES  297
              NS+K+M KI   WIK G +MNGSQYDGSADIQNFANGQT+FTILWAPAQP  QAKLLE+
Sbjct: 241  DANSIKAMTKISNWIKDGLMMNGSQYDGSADIQNFANGQTSFTILWAPAQPGIQAKLLEA  300

Query: 298  SKVDYLEVPFPSEDGKPDLEYLVNGFAVFNNKDENKVKASKKFITFIADDKKWGPKDVIR  357
            SKVDYLE+PFPS+DGKP+LEYLVNGFAVFNNKDE KV ASK FI FIADDK+WGPK+V+R
Sbjct: 301  SKVDYLEIPFPSDDGKPELEYLVNGFAVFNNKDEQKVAASKTFIQFIADDKEWGPKNVVR  360

Query: 358  TGAFPVRTSFGDLYKGDKRMMKISKWTQYYSPYYNTIDGFSEMRTLWFPMVQSVSNGDEK  417
            TGAFPVRTS+GDLYK DKRM KI++WT++YSPYYNTIDGF+EMRTLWFPMVQ+VSNGDEK
Sbjct: 361  TGAFPVRTSYGDLYK-DKRMEKIAEWTKFYSPYYNTIDGFAEMRTLWFPMVQAVSNGDEK  419

Query: 418  PADALKDFTQKANDTIKK                                           435
            P DALK FT+KAN TIKK
Sbjct: 420  PEDALKAFTEKANKTIKK                                           437
```

A related GBS gene <SEQ ID 8537> and protein <SEQ ID 8538> were also identified. Analysis of this protein sequence reveals the following:

Lipop: Possible site: −1    Crend: 4
McG: Discrim Score: 5.05
GvH: Signal Score (−7.5) : 4.69
Possible site: 31
>>> Seems to have a cleavable N-term signal seq.
ALOM program count: 0    value: 7.69    threshold: 0.0

PERIPHERAL          Likelihood = 7.69          90
modified ALOM score: −2.04
*** Reasoning Step: 3
----- Final Results -----
  bacterial outside --- Certainty = 0.3000 (Affirmative) <succ>
  bacterial membrane --- Certainty = 0.0000 (Not Clear) <succ>
  bacterial cytoplasm --- Certainty = 0.0000 (Not Clear) <succ>

The protein has homology with the following sequences in the databases:

```
28.8/48.4% over 409aa
 Bacillus subtilis
  EGAD|107689| hypothetical protein Insert characterized
  GP|2633010|emb|CAB12516.1| |Z99107 similar to sugar-binding protein Insert characterized
  PIR|F69796|F69796 sugar-binding protein homolog yesO - Insert characterized
 ORF01146(355-1605 of 1914)
 EGAD|107689|BS0697(1-410 of 412) hypothetical protein {Bacillus
 subtilis}GP|2633010|emb|CAB12516.1| |Z99107 similar to sugar-binding
 protein {Bacillus subtilis}PIR|F69796|F69796 sugar-binding protein homolog yesO -
 Bacillus subtilis
 % Match = 5.4
 % Identity = 28.8  % Similarity = 48.3
 Matches = 69 Mismatches = 116 Conservative Sub.s = 47

318       348       378                 435       465       495       525
         RGIVMSIKKSVIGFCLGAAALSMFACVDSSQSVMAAEKD-KVEITWWAFPTFTQEKAKDGVGTYEKKVIKAFEKKNPNIK
             ||:   :  :        ::|   : |  ||             |   |||: :|||||::
                          MFSGCSAGEEASGKKEDVTLRIAWW---------GGQPRHDYTTKVIELYEKKNPHVH
                          10        20        30        40

555       585       615       645       675       705       732       762
         VKLETIDFTSGPEKITTAIEAGTAPDVLFDAPGRIIQYGKNGKLADLNDLFTDQFIKDVN-NKNIIQASKSGDKAYMYPI
         ::|   ::     :|:     ||   |||:      : ||||  :|   |   |   :  : :|::    :|   | :
         IEAEFANWDDYWKKLAPMSAAGQLPDVIQMDTAYLAQYGKKNQLEDLTPYTKDGTIDVSSIDENMLSGGKIDNKLYGFTL
                   60        70        80        90        100       110       120
```

```
792       822       852       882       912       942       972
SSAPFYMAFNKKMLKDAGVLKLVKEGWTTSDFEKVLKALKNKGYTPGSFFANGQGGDQGPRAFFANLYSA----------
 : :    |: :||  ||| : :|  ||  |:|| :     |: |     |  : ||     : |  ||
GVNVLSVIANEDLLKKAGV-SINQENWTWEDYEKLAYDLQEK---AGVYGSNGM---HPPDIFFPYYLRTKGERFYKEDG
          140       150       160       170          180      190       200

990       1020      1050      1080
-----------------~~~~--------------------PITDKEVTKYTTDTKNSVKSMKKIVEWIKKGYLMNGSQYDGSA~~~
                                         |:  || |   || : :    |
TGLAYQDDQL~~~~NIVEYVETASKNISKADPPEPVGSAEVIKLLKDTSDQILYQKV----------------------~~~
          350       360       370       380       390

1515      1545      1575      1605      1635      1665      1695      1725
FSEMRTLWFPMVQSVSNGDEKPADALKDFTQKANDTIKKAAK*LRRLLFYGQSHIGIEEEFLVKLRCKGEYRMRTNKLK
                                 |   |  |  :|||:  :::
-------------------SPEKAAKTFRKKANEILERNN
```

SEQ ID 944 (GBS16) was expressed in *E. coli* as a Hisfusion product. SDS-PAGE analysis of total cell extract is shown in FIG. 3 (lane 9; MW 49 kDa).

The GBS16-His fusion product was purified (FIG. 92A; see also FIG. 189, lane 9) and used to immunise mice (lane 1+2 product; 20 μg/mouse). The resulting antiserum was used for Western blot (FIG. 92B), FACS (FIG. 92C), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 294

A DNA sequence (GBSx0322) was identified in *S. agalactiae* <SEQ ID 947> which encodes the amino acid sequence <SEQ ID 948>. Analysis of this protein sequence reveals the following:

Possible site: 49
>>> Seems to have no N-terminal signal sequence
----- Final Results -----
    bacterial membrane --- Certainty = 0.0000 (Not Clear) <succ>
       bacterial outside --- Certainty = 0.0000 (Not Clear) <succ>
        bacterial cytoplasm --- Certainty = 0.0000 (Not Clear) <succ>

A related GBS nucleic acid sequence <SEQ ID 9459> which encodes amino acid sequence <SEQ ID 9460> was also identified.

The protein has homology with the following sequences in the GENPEPT database:

```
>GP:AAC66999 GB:AE001166 conserved hypothetical protein [Borrelia burgdorferi]
Identities = 107/225 (47%), Positives = 147/225 (64%), Gaps = 6/225 (2%)

Query:  12 QIKNGIIVSCQALPGEPLYTESGGVMPLLALAAQEAGAVGIRANSVRDIKEIQEVTNLPI  71
           +IK G+IVSCQAL  EPL+  S  +M  +ALAA+  GA+GIRAN V DI +I+   +LPI
Sbjct:   6 KIKRGLIVSCQALENEPLH--SSFIMSKMALAAKIGGAIGIRANGVNDISQIKLEVDLPI  63

Query:  72 IGIIKREYPPQEPFITATMTEVDQLASLDIAVIALDCTLRERHDGLSVVEFIQKIKRKYP 131
           IGIIK+ Y  + FIT TM E+D+L +   +IALD T R R DG+ + +F + IK+KYP
Sbjct:  64 IGIIKKNYNNCDVFITPTMKEIDELCNEGVDIIALDATFRNRPDGVLLDDFFENIKKKYP 123

Query: 132 EQLLMADISTFEEGKNAFEAGVDFVGTTLSGYTDYSR--QEEGPDIELLNKLCQAGI--D 187
           +Q LMADIS+ +E  NA + G DF+GTTL GYT +         D   L  L + +
Sbjct: 124 KQCLMADISSLDEAINADKLGFDFIGTTLYGYTKNTNGLNIADNDFNFLRTLLNSNLKST 183

Query: 188 VIAEGKIHTPKQANEINHIGVAGIVVGGAITRPKEIAERFISGLS               232
           +I EGKI TP +A +    +GV +VVGGAITRP EI ++F+    ++
Sbjct: 184 LIVEGKIDTPLKAQKCFEMGVDLVVVGGAITRPAEITKKFVEKIN                228
```

A related DNA sequence was identified in *S. pyogenes* <SEQ ID 949> which encodes the amino acid sequence <SEQ ID 950>. Analysis of this protein sequence reveals the following:

Possible site: 44
>>> Seems to have no N-terminal signal sequence
INTEGRAL    Likelihood = −1.49    Transmembrane 175-191 (175-192)
----- Final Results -----
    bacterial membrane --- Certainty = 0.1595 (Affirmative) <succ>
    bacterial outside --- certainty = 0.0000 (Not Clear) <succ>
    bacterial cytoplasm --- Certainty = 0.0000 (Not Clear) <succ>

The protein has homology with the following sequences in the databases:

```
>GP:AAD28762 GB:AF130859 putative N-acetylmannosamine-6-P epimerase [Clostridium
perfringens]
Identities = 113/225 (50%), Positives = 148/225 (65%), Gaps = 5/225 (2%)

Query:   10    LMEQLKGGIIVSCQALPGEPLYSETGGIMPLMAKAAQEAGAVGIRANSVRDIKEIQAITD    69
               +++ +KG +IVSCQAL  EPL+S    IM  MA AA++ GA  IRA  + DI EI+ +T
Sbjct:    1    MLDVVKGNLIVSCQALSDEPLHSSF--IMGRMAIAAKQGGAAAIRAQGIDDINEIKEVTK    58

Query:   70    LPIIGIIKKDYPPQEPFITATMTEVDQLAALNIAVIAMDCTKRDRHDGLDIASFIRQVKE   129
               LPIIGIIK++Y    E +IT TM EVD+L   + +I +D TKR R +G +I    +  +
Sbjct:   59    LPIIGIIKRNYDDSEIYITPTMKEVDELLKTDCEMIGLDATKRKRPNGENIKDLVDAIHA   118

Query:  130    KYPNQLLMADISTFDEGLVAHQAGIDFVGTTLSGYTPYSRQEAGPDVALIEALCK-AGIA   188
               K   +L MADIST +EG+ A + G D V TTLSGYTPYS+Q    D  L+E L K    I
Sbjct:  119    K--GRLAMADISTLEEGIEAEKLGFDCVSTTLSGYTPYSKQSNSVDFELLEELVKTVKIP   176

Query:  189    VIAEGKIHSPEEAKKINDLGVAGIVVGGAITRPKEIAERFIEALK                233
               VI EG+I++PEE KK  DLG    VVGGAITRP++I +RF  +LK
Sbjct:  177    VICEGRINTPEELKKALDLGAYSAVVGGAITRPQQITKRFTDILK                221
```

An alignment of the GAS and GBS proteins is shown below:

```
Identities = 172/227 (75%), Positives = 202/227 (88%)

Query:    5    SKEAFKKQIKNGIIVSCQALPGEPLYTESGGVMPLLALAAQEAGAVGIRANSVRDIKEIQ    64
               +KE    +Q+K GIIVSCQALPGEPLY+E+GG+MPL+A AAQEAGAVGIRANSVRDIKEIQ
Sbjct:    6    TKEKLMEQLKGGIIVSCQALPGEPLYSETGGIMPLMAKAAQEAGAVGIRANSVRDIKEIQ    65

Query:   65    EVTNLPIIGIIKREYPPQEPFITATMTEVDQLASLDIAVIALDCTLRERHDGLSVVEFIQ   124
                +T+LPIIGIIK++YPPQEPFITATMTEVDQLA+L+IAVIA+DCT R+RHDGL +  FI+
Sbjct:   66    AITDLPIIGIIKKDYPPQEPFITATMTEVDQLAALNIAVIAMDCTKRDRHDGLDIASFIR   125

Query:  125    KIKRKYPEQLLMADISTFEEGKNAFEAGVDFVGTTLSGYTDYSRQEEGPDIELLNKLCQA   184
               ++K KYP QLLMADISTF+EG  A +AG+DFVGTTLSGYT YSRQE GPD+ +L  LC+A
Sbjct:  126    QVKEKYPNQLLMADISTFDEGLVAHQAGIDFVGTTLSGYTPYSRQEAGPDVALIEALCKA   185

Query:  185    GIDVIAEGKIHTPKQANEINHIGVAGIVVGGAITRPKEIAERFISGL                231
               GI VIAEGKIH+P++A +IN +GVAGIVVGGAITRPKEIAERFI  L
Sbjct:  186    GIAVIAEGKIHSPEEAKKINDLGVAGIVVGGAITRPKEIAERFIEAL                232
```

Based on this analysis, it was predicted that these proteins and their epitopes could be useful antigens for vaccines or diagnostics.

Example 295

A DNA sequence (GBSx0323) was identified in *S. agalactiae* <SEQ ID 951> which encodes the amino acid sequence <SEQ ID 952>. This protein is predicted to be group B streptococcal surface immunogenic protein. Analysis of this protein sequence reveals the following:

Possible site: 25
>>> Seems to have a cleavable N-term signal seq.
----- Final Results -----
    bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>

A related DNA sequence was identified in *S. pyogenes* <SEQ ID 953> which encodes the amino acid sequence <SEQ ID 954>. Analysis of this protein sequence reveals the following:

Possible site: 25
>>> Seems to have a cleavable N-term signal seq.
----- Final Results -----
    bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>

An alignment of the GAS and GBS proteins is shown below:

```
Identities = 182/437 (41%), Positives = 240/437 (54%), Gaps = 53/437 (12%)

Query:   1   MKMNKKVLLTSTMAASLLSVASVQAQETDTTWTARTVSEVKADLVKQDNKSSYTVKYGDT    60
             M + KK L +++A SL+ +A+ QAQE    WT R+V+E+K++LV  DN  +YTVKYGDT
Sbjct:   1   MIITKKSLFVTSVALSLVPLATAQAQE----WTPRSVTEIKSELVLVDNVFTYTVKYGDT    56

Query:  61   LSVISEAMSIDMNVLAKINNIADINLIYPETTLTVTYDQKSHTATSMKIETPATNAAGQT   120
             LS I+EAM ID++VL  IN+IA+I+LI+P+T LT   Y+Q    AT++ ++ PA++ A  +
Sbjct:  57   LSTIAEAMGIDVHVLGDINHIANIDLIFPDTILTANYNQHGQ-ATNLTVQAPASSPASVS   115

Query: 121   TATVDLKTNQVSVADQKVSLNTISEGMTP-EAATTIVSPMKTYSSAPALKSKEVLAQEQA   179
                     Q S  Q      ++   TP +  TT  +   K  SS  A   S E+ +
Sbjct: 116   HVPSSEPLPQASATSQPTV--PMAPPATPSDVPTTPFASAKPDSSVTA--SSELTSSTND   171

Query: 180   VSQAAANEQVSPAPVKSITSEVPAAKEEVKPTQTSVSQSTTVSPASVAAETPAPVAKVAP   239
             VS     ++E    V       P A E     T V   T +S A  +A  P P   +
Sbjct: 172   VSTELSSESQKQPEVPQEAVPTPKAAE-----TTEVEPKTDISEAPTSANRPVPNESASE   226

Query: 240   VRTVAAPRVASVKVVTPKVETGASPEHVSAPAVP---VTTTSPATDSKLQATEVKSVPVA   296
                + AAP           + A E   SAPA         TTS AT + L
Sbjct: 227   EVSSAAP-----------AQAPAEKEETSAPAAQKAVADTTSVATSNGL-----------   264

Query: 297   QKAPTATPVAQPASTTNAVAAHPENAGLQPHVAAYKEKVASTYGVNEFSTYRAGDPGDHG   356
                AP              A +P NAGLQP  AA+KE+VAS +G+   FS YR GDPGDHG
Sbjct: 265   SYAPNH------------AYNPMNAGLQPQTAAFKEEVASAFGITSFSGYRPGDPGDHG   311

Query: 357   KGLAVDFIVGTNQALGNKVAQYSTQNMAANNISYVIWQQKFYSNTNSIYGPANTWNAMPD   416
             KGLA+DF+V  N ALG++VAQY+  +MA     ISYVIW+Q+FY+    SIYGPA TWN MPD
Sbjct: 312   KGLAIDFMVPENSALGDQVAQYAIDHMAERGISYVIWKQRFYAPFASIYGPAYTWNPMPD   371

Query: 417   RGGVTANHYDHVHVSFN                                             433
             RG +T NHYDHVHVSFN
Sbjct: 372   RGSITENHYDHVHVSFN                                             388
```

A related GBS gene <SEQ ID 8539> and protein <SEQ ID 8540> were also identified. Analysis of this protein sequence reveals the following:

Lipop: Possible site: −1   Crend: 3
SRCFLG: 0
McG: Length of UR: 20
Peak Value of UR: 1.96
Net Charge of CR: 2
McG: Discrim Score: 2.95
GvH: Signal Score (−7.5): 3.84
Possible site: 23
>>> Seems to have a cleavable N-term signal seq.
Amino Acid Composition: calculated from 24
ALOM program count: 0   value: 4.29   threshold: 0.0
PERIPHERAL          Likelihood = 4.29     58
modified ALOM score: −1.36
*** Reasoning Step: 3
Rule gpol
----- Final Results -----
   bacterial outside --- Certainty = 0.3000 (Affirmative) <succ>
     bacterial membrane --- Certainty = 0.0000 (Not Clear) <succ>
        bacterial cytoplasm --- Certainty = 0.0000 (Not Clear) <succ>

Figure 267:
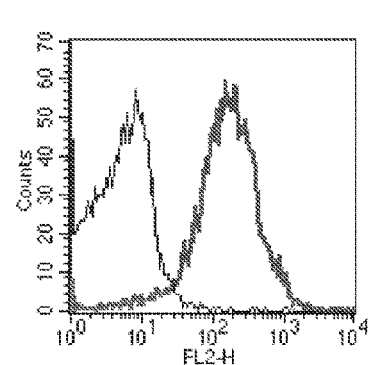

SEQ ID 8540 (GBS322) was expressed in *E. coli* as a His-fusion product. SDS-PAGE analysis of total cell extract is shown in FIG. 77 (lane 9; MW 52 kDa). The GBS322-His fusion product was purified (FIG. 214, lane 10) and used to immunise mice. The resulting antiserum was used for FACS (FIG. 267), which confirmed that the protein is immunoaccessible on GBS bacteria.

Based on this analysis, it was predicted that these proteins and their epitopes could be useful antigens for vaccines or diagnostics.

Example 296

A DNA sequence (GBSx0324) was identified in *S. agalactiae* <SEQ ID 955> which encodes the amino acid sequence <SEQ ID 956>. Analysis of this protein sequence reveals the following:

Possible site: 23
>>> Seems to have an uncleavable N-term signal seq
INTEGRAL       Likelihood = −1.86       Transmembrane 5-21 (4-21)
----- Final Results -----
   bacterial membrane --- Certainty = 0.1744 (Affirmative) <succ>
     bacterial outside --- Certainty = 0.0000 (Not Clear) <succ>
        bacterial cytoplasm --- Certainty = 0.0000 (Not Clear) <succ>

The protein has homology with the following sequences in the GENPEPT database:

```
>GP:AAC46072 GB:U50357 zoocin A endopeptidase [Streptococcus zooepidemicus]
Identities = 163/274 (59%), Positives = 196/274 (71%), Gaps = 11/274 (4%)

Query:  25   VLADTYVRPIDNGRITTGFNGYPGHCGVDYAVPTGTIIRAVADGTVKFAGAGANFSWMTD    84
             V A TY RP+D G ITTGFNGYPGH GVDYAVP GT +RAVA+GTVKFAG GAN  WM
Sbjct:  21   VSAATYTRPLDTGNITTGFNGYPGHVGVDYAVPVGTPVRAVANGTVKFAGNGANHPWMLW    80

Query:  85   LAGNCVMIQHADGMHSGYAHMSRVVARTGEKVKQGDIIGYVGATGMATGPHLHFEFLPAN   144
             +AGNCV+IQHADGMH+GYAH+S++       T    VKQG IIGY GATG TGPHLHFE LPAN
Sbjct:  81   MAGNCVLIQHADGMHTGYAHLSKISVSTDSTVKQGQIIGYTGATGQVTGPHLHFEMLPAN   140
```

-continued

```
Query:  145  PNFQNGFHGRINPTSLIANVATFSGKTQASAPSIKPLQSAPVQNQSSKLKVYRVDELQKV  204
             PN+QNGF GRI+PT  IAN   F+G T          + P N    LK+Y+VD+LQK+
Sbjct:  141  PNWQNGFSGRIDPTGYIANAPVFNGTTPTE-------PTTPTTN----LKIYKVDDLQKI  189

Query:  205  NGVWLVENNTLTPTGFDWNDNGIPASEIDEVDANGNLTADQVLQKGGYFIFNPKTLKTVE  264
             NG+W V+NN L PT F W DNGI A ++ EV +NG  T+DQVLQKGGYF+ NP  +K+V
Sbjct:  190  NGIWQVRNNILVPTDFTWVDNGIAADDVIEVTSNGTRTSDQVLQKGGYFVINPNNVKSVG  249

Query:  265  KPIQGTAGLTWAKTRFANGSSVWLRVDNSQELLY                            298
             P++G+ GL+WA+  F  G +VWL   +  LLY
Sbjct:  250  TPMKGSGGLSWAQVNFTTGGNVWLNTTSKDNLLY                            283
```

No corresponding DNA sequence was identified in S. pyogenes.

The protein has homology with the following sequences in the databases:

```
GP|2804351|gb|AAC46072.1| |U50357(21-283 of 285) zoocin A endopeptidase {Streptococcus
zooepidemicus}
% Match = 34.2
% Identity = 61.3 % Similarity = 74.4
Matches = 163 Mismatches = 65 Conservative Sub.s = 35

144       174       204       234       264       294       324       354
         VV*VFLS*LRYTTILKTFLFIKPPKYSSR*VLFLIF*FKFSNKLIASV*ALHYINSIWRFFLNKWLVKASSLVVLGGMV

MKRIFFAFLSLCLF
                                                                                      10

384       414       444       474       504       534       564       594
         LSAGSRVLADTYVRPIDNGRITTGFNGYPGHCGVDYAVPTGTIIRAVADGTVKFAGAGANFSWMTDLAGNCVMIQHADGM
         :   |  ||  ||::|  |||||||||||  ||||||   || :|||| :||||||||  ||    : ||||| :||||||||
         IFGTQTVSAATYTRPLDTGNITTGFNGYPGHVGVDYAVPVGTPVRAVANGTVKFAGNGANHPWMLWMAGNCVLIQHADGM
                    30        40        50        60        70        80        90

624       654       684       714       744       774       804       834
         HSGYAHMSRVVARTGEKVKQGDIIGYVGATGMATGPHLHFEFLPANPNFQNGFHGRINPTSLIANVATFSGKTQASAPSI
         |:||||:|::    |    ||||  ||||  |||| ||||||||||| ||||||:||||   |||:||   |||   |:|  |
         HTGYAHLSKISVSTDSTVKQGQIIGYTGATGQVTGPHLHFEMLPANPNWQNGFSGRIDPTGYIANAPVFNGTT-------
                   110       120       130       140       150       160

864       894       924       954       984       1014      1044      1074
         KPLQSAPVQNQSSKLKVYRVDELQKVNGVWLVKNNTLTPTGFDWNDNGIPASEIDEVDANGNLTADQVLQKGGYFIFNPK
          |  : |    ::  ||:|:|:|||:||:  |  |:|| |:||   |:||  |  : ||  |:||||||||||||: ||
         -P--TEP-TTPTTNLKIYKVDDLQKINGIWQVRNNILVPTDFTWVDNGIAADDVIEVTSNGTRTSDQVLQKGGYFVINPN
                   180       190       200       210       220       230       240

1104      1134      1164      1194      1224      1254      1284      1314
         TLKTVEKPIQGTAGLTWAKTRFANGSSVWLRVDNSQELLYK*FEVLIHCFK*QLCY*LSTISLNRLKIIL*SSKV*YYSL
          :|:|   |:::|: ||:||:     |   |:|||    :        |||
         NVKSVGTPMKGSGGLSWAQVNFTTGGNVWLNTTSKDNLLYGK
                   260       270       280
```

A related GBS gene <SEQ ID 8541> and protein <SEQ ID 8542> were also identified. Analysis of this protein sequence reveals the following:

Lipop: Possible site: −1 Crend: 6
McG: Discrim Score: 6.63
GVH: Signal Score (−7.5): −2.97
Possible site: 23
>>> Seems to have an uncleavable N-term signal seq
ALOM program count: 1 value: −1.86 threshold: 0.0
INTEGRAL        Likelihood = −1.86    Transmembrane 5-21 (4-21)
PERIPHERAL      Likelihood = 5.57     50
modified ALOM score: 0.87
*** Reasoning Step: 3
----- Final Results -----
  bacterial membrane --- Certainty = 0.1744 (Affirmative) <succ>
   bacterial outside --- Certainty = 0.0000 (Not Clear) <succ>
     bacterial cytoplasm --- Certainty = 0.0000 (Not Clear) <succ>

SEQ ID 8542 (GBS36) was expressed in E. coli as a His-fusion product. SDS-PAGE analysis of total cell extract is shown in FIG. 11 (lane 4; MW 34.1 kDa).

Figure 192:
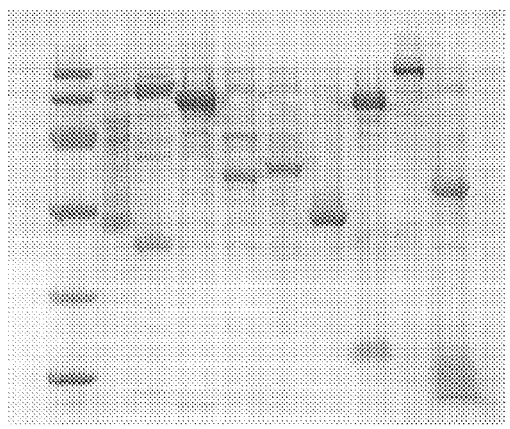

GBS36-His was purified as shown in FIG. 192, lane 7.

Based on this analysis, it was predicted that these proteins and their epitopes could be useful antigens for vaccines or diagnostics.

Example 297

A DNA sequence (GBSx0325) was identified in S. agalactiae <SEQ ID 957> which encodes the amino acid sequence <SEQ ID 958>. This protein is predicted to be phosphoribosylaminoimidazolecarboxamide formyltransferase/IMP cyclohyd. Analysis of this protein sequence reveals the following:

Possible site: 48
>>> Seems to have no N-terminal signal sequence
----- Final Results -----
  bacterial cytoplasm --- Certainty = 0.2815 (Affirmative) <succ>
  bacterial membrane --- Certainty = 0.0000 (Not Clear) <succ>
  bacterial outside --- Certainty = 0.0000 (Not Clear) <succ>

Possible site: 48
>>> Seems to have no N-terminal signal sequence
----- Final Results -----
  bacterial cytoplasm --- Certainty = 0.2932 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database:

An alignment of the GAS and GBS proteins is shown below:

```
>GP:BAB04352 GB:AP001509 phosphoribosylaminoimidazolecarboxamide
formyltransferase/IMP cyclohydrolase [Bacillus halodurans]
Identities = 310/515 (60%), Positives = 390/515 (75%), Gaps = 4/515 (0%)

Query:    1  MTKRALISVSDKSGIIDFAKELKNLGWDIISTGGTKVALDDAGVETIAIDDVTGFPEMMD   60
             M +RAL+SVS+K GI+ FAK L    +I+STGGTK AL +AG+    I DVTGFPE++D
Sbjct:    1  MKRRALVSVSNKEGIVPFAKALVEHEVEIVSTGGTKRALQEAGIPVTGISDVTGFPEILD  60

Query:   61  GRVKTLHPNIHGGLLARRDADSHLQAAKDNNIELIDLVVVNLYPFKETILRPDVTYDLAV  120
             GRVKTLHPNIHGGLLA R+ D HL   +++I  ID VVVNLYPF++TI +P+ T+  A+
Sbjct:   61  GRVKTLHPNIHGGLLAMRERDEHLAQLNEHHIRPIDFVVVNLYPFQQTIAKPEATFADAI  120

Query:  121  ENIDIGGPSMLRSAAKNHASVTVVVDSADYATVLGELADASQTTFKTRQRLAAKAFRHTA  180
             ENIDIGGPSMLR+AAKNH  VTVVVD  DY TVL ELAD     +T++RLAAK FRHTA
Sbjct:  121  ENIDIGGPSMLRAAAKNHQHVTVVVDPVDYETVLKELADQGNVATETKRRLAAKVFRHTA  180

Query:  181  AYDALIAEYFTAQVGEAKPEKLTITYDLKQAMRYGENPQQDADFYQKALPTDYSIASAKQ  240
             AYDA+IAEY T  VGE  PE LT+T++ KQ +RYGENP Q A FYQK L   SIA AKQ
Sbjct:  181  AYDAMIAEYLTDAVGEESPESLTVTFEKKQDLRYGENPHQKATFYQKPLGAKASIAHAKQ  240

Query:  241  LNGKELSFNNIRDADAAIRIIRDFKDSPTVVALKHMNPCGIGQADDIETAWDYAYEADPV  300
             L+GKELS+NNI DADAA+ I+++FK+ P  VA+KHMNPCG+G  + I+ A+D AYEADPV
Sbjct:  241  LHGKELSYNNINDADAALSIVKEFKE-PAAVAVKHMNPCGVGTGETIKEAFDKAYEADPV  299

Query:  301  SIFGGIVVLNREVDAATAEKMHPIFLEIIIAPSYSEEALAILTNKKKNLRILELPFDAQA  360
             SIFGGI+ LNREVD  TA+ +  IFLEIIIAPS+SEEAL +LT+ KKNLR+L LP + +
Sbjct:  300  SIFGGIIALNREVDVETAKTLKEIFLEIIIAPSFSEEALDVLTS-KKNLRLLTLPLNEE-  357

Query:  361  ASEVEAEYTGVVGGLLVQNQDVVAENPSDWQVVTDRQPTEQEATALEFAWKAIKYVKSNG  420
             ++ E   T + GG LVQ +D    ++ ++ T R+PTE E  AL+ AW+ +K+VKSN
Sbjct:  358  -NQAEKRITSIHGGALVQEEDTYGFEEAEIKIPTKREPTEAEWEALKLAWRVVKHVKSNA  416

Query:  421  IIITNDHMTLGLGAGQTNRVGSVKIAIEQAKDHLDGAVLASDAFFPFADNIEEIAAAGIK  480
             I++ + MT+G+GAGQ NRVG+ KIAIEQA +   G+V+ SDAFFP  D +E   AGI
Sbjct:  417  IVLADGQMTVGVGAGQMNRVGAAKIAIEQAGEKAAGSVMGSDAFFPMGDTVELAAKAGIT  476

Query:  481  AIIQPGGSVRDQESIDAANKHGLTMIFTGVRHFRH                          515
             AIIQPGGS+RD+ESI A+KHG+ M+FTGVRHF+H
Sbjct:  477  AIIQPGGSIRDEESIENADKHGIAMVFTGVRHFKH                          511
```

A related DNA sequence was identified in *S. pyogenes* <SEQ ID 959> which encodes the amino acid sequence <SEQ ID 960>. Analysis of this protein sequence reveals the following:

```
Identities = 500/515 (97%), Positives = 507/515 (98%)

Query:    1  MTKRALISVSDKSGIIDFAKELKNLGWDIISTGGTKVALDDAGVETIAIDDVTGFPEMMD   60
             MTKRALISVSDKSGI+DFAKELKNLGWDIISTGGTKV LDDAGVETIAIDDVT FPEMMD
Sbjct:    1  MTKRALISVSDKSGIVDFAKELKNLGWDIISTGGTKVTLDDAGVETIAIDDVTRFPEMMD  60

Query:   61  GRVKTLHPNIHGGLLARRDADSHLQAAKDNNIELIDLVVVNLYPFKETILRPDVTYDLAV  120
             GRVKTLHPNIHGGLLARRDADSHLQAAKDNNIELIDLVVVNLYPFKETILRPD+TYDLAV
Sbjct:   61  GRVKTLHPNIHGGLLARRDADSHLQAAKDNNIELIDLVVVNLYPFKETILRPDITYDLAV  120

Query:  121  ENIDIGGPSMLRSAAKNHASVTVVVDSADYATVLGELADASQTTFKTRQRLAAKAFRHTA  180
             ENIDIGGPSMLRSAAKNHASVTVVVD ADYATVLGELADA QTTF+TRQRLAAK FRHTA
Sbjct:  121  ENIDIGGPSMLRSAAKNHASVTVVVDPADYATVLGELADAGQTTFETRQRLAAKVFRHTA  180

Query:  181  AYDALIAEYFTAQVGEAKPEKLTITYDLKQAMRYGENPQQDADFYQKALPTDYSIASAKQ  240
             AYDALIAEYFT QVGEAKPEKLTITYDLKQAMRYGENPQQDADFYQKALPTDYSIASAKQ
Sbjct:  181  AYDALIAEYFTTQVGEAKPEKLTITYDLKQAMRYGENPQQDADFYQKALPTDYSIASAKQ  240
```

```
-continued
Query:   241  LNGKELSFNNIRDADAAIRIIRDFKDSPTVVALKHMNPCGIGQADDIETAWDYAYEADPV   300
              LNGKELSFNNIRDADAAIRIIRDFKD PTVVALKHMNPCGIGQADDIETAWDY Y+ADPV
Sbjct:   241  LNGKELSFNNIRDADAAIRIIRDFKDRPTVVALKHMNPCGIGQADDIETAWDYTYKADPV   300

Query:   301  SIFGGIVVLNREVDAATAEKMHPIFLEIIIAPSYSEEALAILTNKKKNLRILELPFDAQA   360
              SIFGGI+VLNREVDAATA+KMHPIFLEIIIAPSYSEEALAILTNKKKNLRILELPFDAQA
Sbjct:   301  SIFGGIIVLNREVDAATAKKMHPIFLEIIIAPSYSEEALAILTNKKKNLRILELPFDAQA   360

Query:   361  ASEVEAEYTGVVGGLLVQNQDVVAENPSDWQVVTDRQPTEQEATALEFAWKAIKYVKSNG   420
              ASEVEAEYTGVVGGLLVQNQDVVAENPSDWQVVTDRQPTEQEATALEFAWKAIKYVKSNG
Sbjct:   361  ASEVEAEYTGVVGGLLVQNQDVVAENPSDWQVVTDRQPTEQEATALEFAWKAIKYVKSNG   420

Query:   421  IIITNDHMTLGLGAGQTNRVGSVKIAIEQAKDHLDGAVLASDAFFPFADNIEEIAAAGIK   480
              IIITNDHMTLGLGAGQTNRVGSVKIAIEQAKDHLDGAVLASDAFFPFADNIEEIAAAGIK
Sbjct:   421  IIITNDHMTLGLGAGQTNRVGSVKIAIEQAKDHLDGAVLASDAFFPFADNIEEIAAAGIK   480

Query:   481  AIIQPGGSVRDQESIDAANKHGLTMIFTGVRHFRH                          515
              AIIQPGGSVRDQ+SIDAANKHGLTMIFTGVRHFRH
Sbjct:   481  AIIQPGGSVRDQDSIDAANKHGLTMIFTGVRHFRH                          515
```

Based on this analysis, it was predicted that these proteins and their epitopes could be useful antigens for vaccines or diagnostics.

Example 298

A DNA sequence (GBSx0326) was identified in S. agalactiae <SEQ ID 961> which encodes the amino acid sequence <SEQ ID 962>. This protein is predicted to be similar to antibiotic resistance protein. Analysis of this protein sequence reveals the following:

---
Possible site: 46
>>> Seems to have no N-terminal signal sequence
----- Final Results -----
   bacterial cytoplasm --- Certainty = 0.1842 (Affirmative) <succ>
   bacterial membrane --- Certainty = 0.0000 (Not Clear) <succ>
   bacterial outside --- Certainty = 0.0000 (Not Clear) <succ>
---

The protein has homology with the following sequences in the GENPEPT database:

```
>GP:CAB12342 GB:Z99106 similar to antibiotic resistance protein
[Bacillus subtilis]
Identities = 65/263 (24%), Positives = 117/263 (43%), Gaps = 34/263 (12%)

Query:     5  KNLEIVESIFGD-WDETIIWSCV-QGIMGEVFVDSLDQPKSSLAKLGRKSSFGFLAGQPT    62
              K    ++++F D +  T ++S + Q I G V+ D     PKS   +G +S   F+AG
Sbjct:    10  KKYSSLKTMFDDKYCPTFVYSILDQTIPGAVYADDQTFPKSFF--IGTESGIYFIAGDQG   67

Query:    63  ----------LFLLEVCSGEDIILVPQHKGWSDLIESTYGQNAHSFKRYATKKDTLFERS   112
                        + +V S +    L       W +++   + +R A           +
Sbjct:    68  NRDFHDFIAGYYEEQVKSSKRFTLFSSSDTWDSVLKPILKDDLNQMRRAAFSY-----QP   122

Query:   113  RLEKFVTQLPNGFELRAIDEKV------YNSCLEKEWSQDLVANYATYQYYKKQGIGYVV   166
              + K  QLP G L+ IDE +        +NS    +E+      +  + +  +G + V
Sbjct:   123  KSFKKTLQLPKGLVLKRIDEDIISHSTAFNSAYYEEY-------WNSVSQFASKGFGFAV   175

Query:   167  YYQGNIIAGASSYSTYKNGIEIEVDTHPDFRRRGLATIVAAQLILTCLDKGIYPSWDAH-   225
              +   ++++  +S     N   E+++ T   ++R  GLA  VA + I   C++ GI PSWD
Sbjct:   176  LHGNHVVSECTSIFLGHNRAEMDIYTLEEYRGLGLAYCVANRFIAFCMENGIVPSWDCDI   235

Query:   226  -TRTSLNLSEKLGYEFSHEYIAY                                      247
                +S+ L+ KLG++    EY Y
Sbjct:   236  CNNSSIALAAKLGFKTVTEYTIY                                      258
```

No corresponding DNA sequence was identified in £pyogenes.

Based on this analysis, it was predicted that this protein and its epitopes, could be useful antigens for vaccines or diagnostics.

Example 299

A DNA sequence (GBSx0328) was identified in S. agalactiae <SEQ ID 963> which encodes the amino acid sequence <SEQ ID 964>. This protein is predicted to be phosphoribosylglycinamide formyltransferase homolog (purN). Analysis of this protein sequence reveals the following:

---
Possible site: 48
>>> Seems to have no N-terminal signal sequence
----- Final Results -----
   bacterial cytoplasm --- Certainty = 0.0736 (Affirmative) <succ>
   bacterial membrane --- Certainty = 0.0000 (Not Clear) <succ>
   bacterial outside --- Certainty = 0.0000 (Not Clear) <succ>
---

A related DNA sequence was identified in S. pyogenes <SEQ ID 965> which encodes the amino acid sequence <SEQ ID 966>. Analysis of this protein sequence reveals the following:

---
Possible site: 48
>>> Seems to have no N-terminal signal sequence
INTEGRAL    Likelihood = -0.53    Transmembrane 75-91 (75-91)

```
----- Final Results -----
    bacterial membrane --- Certainty = 0.1213 (Affirmative) <succ>
    bacterial outside --- Certainty = 0.0000 (Not Clear) <succ>
        bacterial cytoplasm --- Certainty = 0.0000 (Not Clear) <succ>
```

The protein has homology with the following sequences in the databases:

```
>GP:CAA04374 GB:AJ000883 purD [Lactococcus lactis]
Identities = 236/419 (56%), Positives = 301/419 (71%), Gaps = 7/419 (1%)

Query:   50  LKLLVVGSGGREHAIAKKLLASKGVDQVFVAPGNDGMTLDGLDLVNIVVSEHSRLIAFAK   109
             +K+LV+GSGGREHA+AKK + S   V++VFVAPGN GM  DG+ +V+I    + +L+ FA+
Sbjct:    1  MKILVIGSGGREHALAKKFMESPQVEEVFVAPGNSGMEKDGIQIVHISELSNDKLVKFAQ    60

Query:  110  ENEISWAFIGPDDALAAGIVDDFNSAGLRAFGPTKAAAELEWSKDFAKEIMVKYNVPTAA   169
                I   F+GP+ AL   G+VD F   A L    FGP K AAELE  SKDFAK  IM  KY VPTA
Sbjct:   61  NQNIGLTFVGPETALMNGVVDAFIKAELPIFGPNKMAAELEGSKDFAKSIMKKYGVPTAD   120

Query:  170  YGTFSDFEKAKAYIEEQGAPIVVKADGLALGKGVVVAETVEQAVEAAQEMLLDNKFGDSG   229
             Y TF     E A  AY++E+G  P+V+KADGLA  GKGV  VA  +E  A  A  ++     F  S
Sbjct:  121  YATFDSLEPALAYLDEKGVPLVIKADGLAAGKGVTVAFDIETAKSALADI-----FSGSQ   175

Query:  230  ARVVIEEFLDGEEFSLFAFANGDKFYIMPTAQDHKRAFDGDKGPNTGGMGAYAPVPHLPQ   289
              +VVIEEFLDGEEFSLF+F +    K Y MP AQDHKRAFD DKGPNTGGMGAY+PV H+ +
Sbjct:  176  GKVVIEEFLDGEEFSLFSFIHDGKIYPMPIAQDHKRAFDEDKGPNTGGMGAYSPVLHISK   235

Query:  290  SVVDTAVEMIVRPVLEGMVAEGRPYLGVLYVGLILTADGPKVIEFNSRFGDPETQIILPR   349
                VV+ A+E +V+P + GM+ EG+  + GVLY GLILT DG K  IEFN+RFGDPETQ++LPR
Sbjct:  236  EVVNEALEKVVKPTVAGMIEEGKSFTGVLYAGLILTEDGVKTIEFNARFGDPETQVVLPR   295

Query:  350  LTSDFAQNIDDIMMGIEPYITWQKDGVTLGVVVASEGYPFDYEKGVPLPEKTDGDIITYY   409
             L  SD  AQ  I  DI+  G EP + W +  GVTLGVVVA+EGYP        + G+ LPE  +G +   YY
Sbjct:  296  LKSDLAQAIIDILAGNEPTLEWLESGVTLGVVVAAEGYPSQAKLGLILPEIPEG-LNVYY   354

Query:  410  AGVKFSENSELLLSNGGRVYMLVTTEDSVKAGQDKIYTQLAQQDTTGLFYRNDIGSKAI   468
             AGV   +EN++ L+S+GGRVY++    T +  VK+ Q   +Y +L + +    G FYR+DIGS+AI
Sbjct:  355  AGVSKNENNQ-LISSGGRVYLVSETGEDVKSTQKLLYEKLDKLENDGFFYRHDIGSRAI   412
```

An alignment of the GAS and GBS proteins is shown below:

```
Identities = 172/182 (94%), Positives = 176/182 (96%)
Query:   1 MKIAVFASGNGSNFQVIAEQFQVSFVFSDHRDAYVLERAQNLAIPSFAFELKEFENKAAY    60
           MKIAVFASGNGSNFQVIAEQF VSFVFSDHRDAYVLERAQNLAIPSFAFELKEFENK AY
Sbjct:   1 MKIAVFASGNGSNFQVIAEQFPVSFVFSDHRDAYVLERAQNLAIPSFAFELKEFENKVAY    60

Query:  61 EQAVVDLLDKHEIDLVCLAGYMKIVGETLLSAYEGRIINIHPTYLPEFPGAHGIKDAWEA   120
           EQA+VDLLDKHEIDLVCLAGYMKIVGETLL  AYE RIINIHP YLPEFPGAHGI+DAWEA
Sbjct:  61 EQAIVDLLDKHEIDLVCLAGYMKIVGETLLLAYERRIINIHPAYLPEFPGAHGIEDAWEA   120

Query: 121 GVDQSGVTIHWVDSGVDTGQVIQQVHVPRLADDSLESFETRIHETEYQLYPAVLDSLGIK   180
           GVDQSGVTIHWVDSGVDTGQVIQQV VPRLADDSLESFETRIHETEYQLYPAVLDSLG++
Sbjct: 121 GVDQSGVTIHWVDSGVDTGQVIQQVRVPRLADDSLESFETRIHETEYQLYPAVLDSLGVE   180

Query: 181 RK                                                            182
           RK
Sbjct: 181 RK                                                            182
```

Based on this analysis, it was predicted that these proteins and their epitopes could be useful antigens for vaccines or diagnostics.

Example 300

A DNA sequence (GBSx0329) was identified in *S. agalactiae* <SEQ ID 967> which encodes the amino acid sequence <SEQ ID 968>. Analysis of this protein sequence reveals the following:

Possible site: 52
>>> Seems to have no N-terminal signal sequence
INTEGRAL     Likelihood = −0.59   Transmembrane 121-137 (121-137)
----- Final Results -----
   bacterial membrane --- Certainty = 0.1235 (Affirmative) <succ>
      bacterial outside --- Certainty = 0.0000 (Not Clear) <succ>
         bacterial cytoplasm --- Certainty = 0.0000 (Not Clear) <succ>

Possible site: 38
>>> Seems to have no N-terminal signal sequence
----- Final Results -----
   bacterial cytoplasm --- Certainty = 0.3236 (Affirmative) <succ>
      bacterial membrane --- Certainty = 0.0000 (Not Clear) <succ>
         bacterial outside --- Certainty = 0.0000 (Not Clear) <succ>

The protein has homology with the following sequences in the GENPEPT database:

An alignment of the GAS and GBS proteins is shown below:

```
>GP: AAC16901 GB: AF016634 phosphoribosylformylglycinamide
cyclo-ligase [Lactococcus lactis subsp. cremoris]
Identities = 253/338 (74%), Positives = 288/338 (84%), Gaps = 4/338 (1%)
Query:    4 KNAYAQSGVDVEAGYEVVERIKKHVARTERAGVMGALGGFGGMFDLSQTGVKEPVLISGT        63
            +NAYA+SGVDVEAGYEVV RIKKHVA+TER GV+GALGGFGG FDLS  VKEPVLISGT
Sbjct:    5 ENAYAKSGVDVEAGYEVVSRIKKHVAKTERLGVLGALGGFGGSFDLSVLDVKEPVLISGT        64

Query:   64 DGVGTKLMLAIKYDKHDTIGQDCVAMCVNDIIAAGAEPLYFLDYVATGKNEPAKLEQVVA       123
            DGVGTKLMLAI+ DKHDTIG DCVAMCVNDIIAAGAEPLYFLDY+ATGKN P KLEQVVA
Sbjct:   65 DGVGTKLMLAIRADKHDTIGIDCVAMCVNDIIAAGAEPLYFLDYIATGKNIPEKLEQVVA       124

Query:  124 GVAEGCVQASAALIGGETAEMPGMYGEDDYDLAGFAVGVAEKSQIIDGSK-VKEGDILLG       182
            GVAEGC+QA AALIGGETAEMPGMY EDDYDLAGFAVGVAEKSQ+IDG K V+ GD+LLG
Sbjct:  125 GVAEGCLQAGAALIGGETAEMPGMYDEDDYDLAGFAVGVAEKSQLIDGEKDVEAGDVLLG       184

Query:  183 LASSGIHSNGYSLVRRVFADYTGDEVLPELEGKQLKDVLLEPTRIYVKAALPLIKEELVN       242
            LASSGIHSNGYSLVR+VFAD+  +E LPEL+ + L D LL PT+IYVK LPLIK+  +
Sbjct:  185 LASSGIHSNGYSLVRKVFADFDLNESLPELD-QSLIDTLLTPTKIYVKELLPLIKQNKIK       243

Query:  243 GIAHITGGGFIENVPRMFADDLAAEIDEDKVPVLPIFKALEKYGDIKHEEMFEIFNMGVG       302
            GIAHITGGGF EN/PRMF + L+AEI E    VLPIFKALEKYG IKHEEM+EIFNMG+G
Sbjct:  244 GIAHITGGGFHENLPRMFGNSLSAEIVEGSWDVLPIFKALEKYGSIKHEEMYEIFNMGIG       303

Query:  303 LMLDVNPENVDRVKELLDEPVYEIGRIIKKADDSVVIK                          340
            +++ V PEN   +K+ L+   +EIG+++ + +  VVIK
Sbjct:  304 MVIAVAPENAAALKKELN--AFEIGQMVNRQEAPVVIK                          339
```

A related DNA sequence was identified in *S. pyogenes* <SEQ ID 969> which encodes the amino acid sequence <SEQ ID 970>. Analysis of this protein sequence reveals the following:

```
Identities = 321/340 (94%), Positives = 332/340 (97%)
Query:    1 MSEKNAYAQSGVDVEAGYEVVERIKKHVARTERAGVMGALGGFGGMFDLSQTGVKEPVLI        60
            MSEKNAYA+SGVDVEAGYEVVERIKKHVARTERAGVMGALGGFGGMFDLS+TGVKEPVL+
Sbjct:    1 MSEKNAYAKSGVDVEAGYEVVERIKKHVARTERAGVMGALGGFGGMFDLSKTGVKEPVLV        60

Query:   61 SGTDGVGTKLMLAIKYDKHDTIGQDCVAMCVNDIIAAGAEPLYFLDYVATGKNEPAKLEQ       120
            SGTDGVGTKLMLAIKYDKHDTIGQDCVAMCVNDIIAAGAEPLYFLDY+ATGKN P KLE+
Sbjct:   61 SGTDGVGTKLMLAIKYDKHDTIGQDCVAMCVNDIIAAGAEPLYFLDYIATGKNNPVKLEE       120

Query:  121 VVAGVAEGCVQASAALIGGETAEMPGMYGEDDYDLAGFAVGVAEKSQIIDGSKVKEGDIL       180
            VV+GVAEGCVQA AALIGGETAEMPGMYG+DDYDLAGFAVGVAEKSQIIDGSKVKEGDIL
Sbjct:  121 VVSGVAEGCVQAGAALIGGETAEMPGMYGQDDYDLAGFAVGVAEKSQIIDGSKVKEGDIL       180

Query:  181 LGLASSGIHSNGYSLVRRVFADYTGDEVLPELEGKQLKDVLLEPTRIYVKAALPLIKEEL       240
            LGLASSGIHSNGYSLVRRVFADYTG E+LPELEGKQLKDVLLEPTRIYVKAALPLIKEEL
Sbjct:  181 LGLASSGIHSNGYSLVRRVFADYTGKELLPELEGKQLKDVLLEPTRIYVKAALPLIKEEL       240

Query:  241 VNGIAHITGGGFIENVPRMFADDLAAEIDEDKVPVLPIFKALEKYGDIKHEEMFEIFNMG       300
            V GI HITGGGFIEN+PRMFADDLAAEIDEDKVPVLPIFKALEKYGDIKHEEMFEIFNMG
Sbjct:  241 VKGIGHITGGGFIENIPRMFADDLAAEIDEDKVPVLPIFKALEKYGDIKHEEMFEIFNMG       300
```

```
                                  -continued
Query:  301 VGLMLDVNPENVDRVKELLDEPVYEIGRIIKKADDSVVIK                         340
            VGLML V+PENV+RVKELLDEPVYEIGRIIKKAD SVVIK Sbjct:  301 VGLMLAVSPENVNRVKELLDEPVYEIGRIIKKADASVVIK                         340
```

Based on this analysis, it was predicted that these proteins and their epitopes could be useful antigens for vaccines or diagnostics.

Example 301

A DNA sequence (GBSx0330) was identified in *S. agalactiae* <SEQ ID 971> which encodes the amino acid sequence <SEQ ID 972>. This protein is predicted to be phosphoribosylpyrophosphate amidotransferase (purF). Analysis of this protein sequence reveals the following:

---

Possible site: 25
>>> Seems to have no N-terminal signal sequence
----- Final Results -----
   bacterial cytoplasm --- Certainty = 0.1112 (Affirmative) <succ>
   bacterial membrane --- Certainty = 0.0000 (Not Clear) <succ>
   bacterial outside --- Certainty = 0.0000 (Not Clear) <succ>

---

The protein has homology with the following sequences in the GENPEPT database:

A related DNA sequence was identified in *S. pyogenes* <SEQ ID 973> which encodes the amino acid sequence <SEQ ID 974>. Analysis of this protein sequence reveals the following:

---

Possible site: 21
>>> Seems to have no N-terminal signal sequence
----- Final Results -----
   bacterial cytoplasm --- Certainty = 0.0610 (Affirmative) <succ>
   bacterial membrane --- Certainty = 0.0000 (Not Clear) <succ>
   bacterial outside --- Certainty = 0.0000 (Not Clear) <succ>

---

An alignment of the GAS and GBS proteins is shown below:

```
>GP: AAD12627 GB: U64311 phosphoribosylpyrophosphate amidotransferase
[Lactococcus lactis]
Identities = 340/470 (72%), Positives = 404/470 (85%), Gaps = 6/470 (1%)
Query:    3 YEVKSLNEECGVFGIWGYPQAAQVTYFGLHSLQHRGQEGAGIISNDNGKLYGYRNVGLLS          62
            +E K+LNEECG+FG+WG+P AA++TYFGLH+LQHRGQEGAGI+ N+NGKL  +R +GL++

Sbjct:   37 FEAKTLNEECGLFGVWGHPDAARLTYFGLHALQHRGQEGAGILVNNNGKLNRHRGLGLVT         96

Query:   63 EVFKNQSELDNLTGNAAIGHVRYATAGSADIRNIQPFLYKFHDGQFALCHNGNLTNAISS        122
            EVF+++ +L+ LTG++AIGHVRYATAGSA+I NIQPF ++FHDG   L HNGNLTNA S Sbjct:   97 EVFRHEKDLEELTGSSAIGHVRYATAGSANINNIQPFQFEFHDGSLGLAHNGNLTNAQSL        156

Query:  123 RKELEKQGAIFNASSDTEILMHLIRRSHNPSFMGKVKEALSTVKGGFAYLLMTEDKLIAA        182
            R ELEK GAIF+++SDTEILMHLIRRSH+P FMG+VKEAL+TVKGGFAYL+MTE+ ++AA Sbjct:  157 RCELEKSGAIFSSNSDTEILMHLIRRSHHPEFMGRVKEALNTVKGGFAYLIMTENSIVAA        216

Query:  183 LDPNAFRPLSIGQMQNGAWVISSETCAFEVVGAKWVRDVEPGEVILIDDSGIQCDRYTDE        242
            LDPN FRPLSIG+M NGA V++SETCAF+VVGA W++DV+PGE+ I+D GI  D++TD Sbjct:  217 LDPNGFRPLSIGKMSNGALVVASETCAFDVVGATWIQDVQPGEIIEINDDGIHVDQFTDS        276

Query:  243 TQLAICSMEYVYFARPDSTIHGVNVHTARKNMGKRLAQEFKQDADIVIGVPNSSLSAAMG        302
            T + ICSMEY+YFARPDS I GVNVHTARK  GK LAQE K DADIVIGVPNSSLSAA G Sbjct:  277 INMTICSMEYIYFARPDSNIAGVNVHTARKRSGKILAQEAKIDADIVIGVPNSSLSAASG        336

Query:  303 FAEESGLPNEMGLVKNQYTQRTFIQPTQELREQGVRMKLSAVSGVVKGKRVVMIDDSIVR        362
            +AEESGLP EMGL+KNQY  RTFIQPTQELREQGVRMKLSAV GVV+GKRV+M+DDSIVR Sbjct:  337 YAEESGLPYEMGLIKNQYVARTFIQPTQELREQGVRMKLSAVRGVVEGKRVIMVDDSIVR        396

Query:  363 GTTSRRIVGLLREAGATEVHVAIASPELKYPCFYGIDIQTRRELISANHAVDEVCDIIGA        422
            GTTSRRIV LL++AGA EVHVAIASP LKYPCFYGIDIQ R ELI+A H  DE+ + IGA Sbjct:  397 GTTSRRIVKLLKDAGAAEVHVAIASPALKYPCFYGIDIQDRDELIAATHTTDEIREAIGA        456

Query:  423 DSLTYLSIDGLIKSIGLETKAPNGGLCVAYFDGHYPTPLYDYEEEYLRSL                   472
            DSLTYLS   GL+++IG        +  LC++YFDG YPTPLYDYE +YL SL Sbjct:  457 DSLTYLSQSGLVEAIG------HDKLCLSYFDGEYPTPLYDYEADYLESL                   500
```

```
Identities = 473/484 (97%), Positives = 481/484 (98%)
Query:   1 MTYEVKSLNEECGVFGIWGYPQAAQVTYFGLHSLQHRGQEGAGIISNDNGKLYGYRNVGL      60
           MTYEVKSLNEECGVFGIWG+PQAAQVTYFGLHSLQHRGQEGAGI+SNDNGKLYGYRNVGL
Sbjct:  20 MTYEVKSLNEECGVFGIWGHPQAAQVTYFGLHSLQHRGQEGAGIVSNDNGKLYGYRNVGL      79

Query:  61 LSEVFKNQSELDNLTGNAAIGHVRYATAGSADIRNIQPFLYKFHDGQFALCHNGNLTNAI     120
           LSEVFKNQSELDNLTGNAAIGHVRYATAGSADIRNIQPFLYKFHDGQFALCHNGNLTNAI
Sbjct:  80 LSEVFKNQSELDNLTGNAAIGHVRYATAGSADIRNIQPFLYKFHDGQFALCHNGNLTNAI     139

Query: 121 SSRKELEKQGAIFNASSDTEILMHLIRRSHNPSFMGKVKEALSTVKGGFAYLLMTEDKLI     180
           S RKELEKQGAIFNASSDTEILMHLIRRSHN SFMGKVKEAL+TVKGGFAYLLMTE+KLI
Sbjct: 140 SLRKELEKQGAIFNASSDTEILMHLIRRSHNSSFMGKVKEALNTVKGGFAYLLMTENKLI     199

Query: 181 AALDPNAFRPLSIGQMQNGAWVISSETCAFEVVGAKWVRDVEPGEVILIDDSGIQCDRYT     240
           AALDPNAFRPLSIGQMQNGAWVISSETCAFEVVGAKWVRDVEPGEVILIDD GIQCDRYT
Sbjct: 200 AALDPNAFRPLSIGQMQNGAWVISSETCAFEVVGAKWVRDVEPGEVILIDDRGIQCDRYT     259

Query: 241 DETQLAICSMEYVYFARPDSTIHGVNVHTARKNMGKRLAQEFKQDADIVIGVPNSSLSAA     300
           DETQLAICSMEYVYFARPDSTIHGVNVHTARKNMGKRLAQEFKQDADIVIGVPNSSLSAA
Sbjct: 260 DETQLAICSMEYVYFARPDSTIHGVNVHTARKNMGKRLAQEFKQDADIVIGVPNSSLSAA     319

Query: 301 MGFAEESGLPNEMGLVKNQYTQRTFIQPTQELREQGVRMKLSAVSGVVKGKRVVMIDDSI     360
           MGFAEESGLPNEMGLVKNQYTQRTFIQPTQELREQGVRMKLSAVSGVVKGKRVVMIDDSI
Sbjct: 320 MGFAEESGLPNEMGLVKNQYTQRTFIQPTQELREQGVRMKLSAVSGVVKGKRVVMIDDSI     379

Query: 361 VRGTTSRRIVGLLREAGATEVHVAIASPELKYPCFYGIDIQTRRELISANHAVDEVCDII     420
           VRGTTSRRIVGLLREAGA+EVHVAIASPELKYPCFYGIDIQTRRELISANH+VDEVCDII
Sbjct: 380 VRGTTSRRIVGLLREAGASEVHVAIASPELKYPCFYGIDIQTRRELISANHSVDEVCDII     439

Query: 421 GADSLTYLSIDGLIKSIGLETKAPNGGLCVAYFDGHYPTPLYDYEEEYLRSLEEKTSFYI     480
           GADSLTYLS+DGLI+SIGLETKAPNGGLCVAYFDGHYPTPLYDYEEEYLRSLEEKTSFYI
Sbjct: 440 GADSLTYLSLDGLIESIGLETKAPNGGLCVAYFDGHYPTPLYDYEEEYLRSLEEKTSFYI     499

Query: 481 QKVK                                                             484
           QKVK
Sbjct: 500 QKVK                                                             503
```

Based on this analysis, it was predicted that these proteins and their epitopes could be useful antigens for vaccines or diagnostics.

Example 302

A DNA sequence (GBSx0331) was identified in *S. agalactiae* <SEQ ID 975> which encodes the amino acid sequence <SEQ ID 976>. Analysis of this protein sequence reveals the following:

Possible site: 28
>>> Seems to have no N-terminal signal sequence
----- Final Results -----
   bacterial cytoplasm --- Certainty = 0.4797 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 303

A DNA sequence (GBSx0332) was identified in *S. agalactiae* <SEQ ID 977> which encodes the amino acid sequence <SEQ ID 978>. Analysis of this protein sequence reveals the following:

Possible site: 13
>>> Seems to have no N-terminal signal sequence
----- Final Results -----
   bacterial cytoplasm --- Certainty = 0.3489 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 304

A DNA sequence (GBSx0333) was identified in *S. agalactiae* <SEQ ID 979> which encodes the amino acid sequence <SEQ ID 980>. Analysis of this protein sequence reveals the following:

Possible site: 14
>>> Seems to have no N-terminal signal sequence

----- Final Results -----
  bacterial cytoplasm --- Certainty = 0.1690 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database:

```
>GP: CAC12194 GB: AL445066 phosphoribosylformylglycinamidine synthase
related protein [Thermoplasma acidophilum]
Identities = 199/746 (26%), Positives = 329/746 (43%), Gaps = 103/746 (13%)
Query:  202 ADD--FAAYKAEQGLAMEVDDLLFIQDYFKSIGRVPTETELKVLDTYWSDHCRHTTFETE      259
            ADD   A     GLA+ +D++  ++ YF+ +GR P + E+  +    WS+HC + + +
Sbjct:   11 ADDARLKAISKRLGLALSLDEMKAVRSYFERLGRDPIDAEIHAVAQSWSEHCSYKSSKYY     70

Query:  260 LKNIDFSASKFQKQLQATYDKYIAMRDELGRSEKPQTLMDMATIEGRYERANGRLDDMEV      319
            LK       K+    L+  Y   +AM D+ G
Sbjct:   71 LK-------KYLGSLKTDYT-ILAMEDDAG-----------------------------     92

Query:  320 SDEINACSVEIEVDVDGVKEPWLLMFKNETHNHPTEIEPFGGAATCIGGAIRDPLSGRSY      379
                         VD  DG  +  + K E+HNHP+ +EP+GGAAT IGG +RD L   +
Sbjct:   93 -----------VVDEDG---EYAYVLKMESHNHPSAVEPYGGAATGIGGIVRDVLCMGAQ    138

Query:  380 VYQAMRISGAGDITTPIAETRAGKLPQQVISKTAAHGYSSYGNQIGLATTYVREYFHPGF      439
                 +     GD+++   E  G L  +I       G   YGN+IG+        YF  +
Sbjct:  139 PVALIDSLFLGDVSSDRYE---GLLSPRYIEGGVVGGIRDYGNRIGIPNVAGSLYFDKLY    195

Query:  440 VAKRMELGAVVGAAPKENVVREKP-EAGDVVVLLGGKTGRDGVGGATGSSKVQTVESVET      498
             + +    VG  ++ +VR K  + GDV+VL+GGKTGRDG+  G     +S     + ++
Sbjct:  196 NSNPLVNAGCVGIVRRDRIVRSKYKPGDVLVLMGGKTGRDGIHGVNEAFTTLG-KVTKS     254

Query:  499 AGAEVQKGNAIEERKIQRLFRDGNVTRLIKKSNDFGAGGVCVAIGELAD----GLEIDLD     554
              +  +Q GN I E+ + +   + N    LI+     D  GG+   A E+      G EI LD
Sbjct:  255 SRLAIQLGNPIVEQPMIKAVLEANDAGLIRAMKDLGGGGLSSAATEMVYAGGFGAEITLD    314

Query:  555 KVPLKYQGLNGTEIAISESQERMSVVVGPSDVDAFIAACNKENIDAVVVATVTEKPNLVM     614
             +  LK   ++G EI  ISESQERM + +    P DV+         K N+D  V+   VT      + +
Sbjct:  315 DIKLKESNMSGWEIWISESQERMLMECYPEDVEKIRQIAEKWNLDESVIGQVTADRRIRV    374

Query:  615 TWNGETIVDLERCFLDTNGV-RVVVDAKVVDKDLTVPEARTTSAETLEADMLKVLSDLNH     673
              +    I+D++   FLD + V  +     K  V+K  +TVP+      E L + +    ++ LN
Sbjct:  375 YYKKRKIIDMDIEFLDDSPVYQRPYRIKEVEKSVTVPQ----EPEDLNSFVRDFMARLNT    430

Query:  674 ASQKGLQTIFDSSVGRSTVNHPIGGR-YQITPTESSVQKLPVQYGVTTTASVMAQGYNPY     732
             ++      +    +D +V   ST+  P  GR  + T      +++V K P++  +        V+  G P
Sbjct:  431 CARFNVVRQYDHTVRGSTIVTPFVGRPNKETHADATVIK-PLENSM--RGLVLTSGSRPN    487

Query:  733 IAEWSPYHGAAYAVIEATARLVATGADWSRARFSYQEYFERMDKQAERFGQPVSALLGSI     792
             +          PY G      + EA   +++TG       R                ++ E  GQ V ++
Sbjct:  488 MVSVDPYAGTLLLTLAEAYKNILSTG---GRPHSVVDALNFGNPEREEIMGQFVESVRAIG    544

Query:  793 EAQIQFGLPSIGGKDSMSGTFEELTVPPTLVAFGVTTADS-RKVLSPEFKAAGENIY---     848
             +      +   GLP +  G  S    + +   + PT       V    D   R+      +  K +G   IY
Sbjct:  545 DFCRKMGLPVVAGNVSFYNEYRKTDIMPTPTIMMVGLIDDVRRSRTTYMKGSGNAIYLIG    604

Query:  849 --------------YIPGQAISEDIDFDLIKANF--SQFEAIQAQHKITAASAVKYGG       890
                            Y  G         + D+D       +F  S+ + +   H  +++          GG
Sbjct:  605 EPCDNLTGSEYSRMHGYTDGFLPAPDLDELTRIRDFLSSKADMILSSHDVSS------GG    658

Query:  891 VLESLALMTFGNRIGASVEIAELDSS                                   916
             +   +L+ M+FG+ IG   V+I+ +  ++
Sbjct:  659 LFAALSEMSFGSGIGFHVDISNVSAA                                   684
```

A related DNA sequence was identified in *S. pyogenes* <SEQ ID 981> which encodes the amino acid sequence <SEQ ID 982>. Analysis of this protein sequence reveals the following:

Possible site: 51
>>> Seems to have no N-terminal signal sequence

----- Final Results -----
bacterial cytoplasm --- Certainty = 0.1415 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below:

```
Identities = 1219/1256 (97%), Positives = 1226/1256 (97%)
Query:    11 SSYFRVAPLSDLVSYMNKRIFVEKKADFGIKSASLVKELTHNLQLASLKDLRIVQVYDVF    70
             SSYF VAPLSDLVSYMNKRIFVEKKADFGIKSASLVKELTHNLQL SLK LRIVQVYDVF
Sbjct:     2 SSYFPVAPLSDLVSYMNKRIFVEKKADFGIKSASLVKELTHNLQLTSLKALRIVQVYDVF    61

Query:    71 NLAEDLLARAEKHIFSEQVTDRLLTEAEITAELDKVAFFAIEALPGQFDQRAASSQEALL   130
             NLAEDLLARAEKHIFSEQVTD LLTE EITAELDKVAFFAIEALPGQFDQRAASSQEALL
Sbjct:    62 NLAEDLLARAEKHIFSEQVTDCLLTETEITAELDKVAFFAIEALPGQFDQRAASSQEALL   121

Query:   131 LLGSDSQVKVNTAQLYLVNKDIAEAELEAVKNYLLNPVDSRFKDITLPLEVQAFSVSDKT   190
             L GSDSQVKVNTAQLYLVNKDI EAELEAVKNYLLNPVDSRFKDITLPLE QAFSVSDKT
Sbjct:   122 LFGSDSQVKVNTAQLYLVNKDITEAELEAVKNYLLNPVDSRFKDITLPLEEQAFSVSDKT   181

Query:   191 ISNLDFFETYQADDFAAYKAEQGLAMEVDDLLFIQDYEKSIGRVPTETELKVLDTYWSDH   250
             I NLDFFETYQADDFA YKAEQGLAMEVDDLLFIQ+YFKSIG VPTETELKVLDTYWSDH
Sbjct:   182 IPNLDFFETYQADDFATYKAEQGLAMEVDDLLFIQNYFKSIGCVPTETELKVLDTYWSDH   241

Query:   251 CRHTTFETELKNIDFSASKFQKQLQATYDKYIAMRDELGRSEKPQTLMDMATIFGRYERA   310
             CRHTTFETELKNIDFSASKFQKQLQ TYDKYIAMRDELGRSEKPQTLMDMATIFGRYERA
Sbjct:   242 CRHTTFETELKNIDFSASKFQKQLQTTYDKYIAMRDELGRSEKPQTLMDMATIFGRYERA   301

Query:   311 NGRLDDMEVSDEINACSVEIEVDVDGVKEPWLLMFKNETHNHPTEIEPFGGAATCIGGAI   370
             NGRLDDMEVSDEINACSVEIEVDVDGVKEPWLLMFKNETHNHPTEIEPFGGAATCIGGAI
Sbjct:   302 NGRLDDMEVSDEINACSVEIEVDVDGVKEPWLLMFKNETHNHPTEIEPFGGAATCIGGAI   361

Query:   371 RDPLSGRSYVYQAMRISGAGDITTPIAETRAGKLPQQVISKTAAHGYSSYGNQIGLATTY   430
             RDPLSGRSYVYQAMRISGAGDITTPIAETRAGKLPQQVISKTAAHGYSSYGNQIGLATTY
Sbjct:   362 RDPLSGRSYVYQAMRISGAGDITTPIAETRAGKLPQQVISKTAAHGYSSYGNQIGLATTY   421

Query:   431 VREYFHPGFVAKRMELGAVVGAAPKENVVREKPEAGDVVVLLGGKTGRDGVGGATGSSKV   490
             VREYFHPGFVAKRMELGAVVGAAPKENVVREKPEAGDVV+LLGGKTGRDGVGGATGSSKV
Sbjct:   422 VREYFHPGFVAKRMELGAVVGAAPKENVVREKPEAGDVVILLGGKTGRDGVGGATGSSKV   481

Query:   491 QTVESVETAGAEVQKGNAIEERKIQRLFRDGNVTRLIKKSNDFGAGGVCVAIGELADGLE   550
             QTVESVETAGAEVQKGNAIEERKIQRLFRDGNVTRLIKKSNDFGAGGVCVAIGELADGLE
Sbjct:   482 QTVESVETAGAEVQKGNAIEERKIQRLFRDGNVTRLIKKSNDFGAGGVCVAIGELADGLE   541

Query:   551 IDLDKVPLKYQGLNGTEIAISESQERMSVVVGPSDVDAFIAACNKENIDAVVVATVTEKP   610
             IDLDKVPLKYQGLNGTEIAISESQERMSVVV P+DVDAFIAACNKENIDAVVVATVTEKP
Sbjct:   542 IDLDKVPLKYQGLNGTEIAISESQERMSVVVRPNDVDAFIAACNKENIDAVVVATVTEKP   601

Query:   611 NLVMTWNGETIVDLERCFLDTNGVRVVVDAKVVDKDLTVPEARTTSAETLEADMLKVLSD   670
             NLVMTWNGE IVDLER FLDTNGVRVVVDAKVVDKDLTVPEARTTSAETLEAD LKVLSD
Sbjct:   602 NLVMTWNGEIIVDLERRFLDTNGVRVVVDAKVVDKDLTVPEARTTSAETLEADTLKVLSD   661

Query:   671 LNHASQKGLQTIFDSSVGRSTVNHPIGGRYQITPTESSVQKLPVQYGVTTTASVMAQGYN   730
             LNHASQKGLQTIFDSSVGRSTVNHPIGGRYQITPTESSVQKLPVQ GVTTTASVMAQGYN
Sbjct:   662 LNHASQKGLQTIFDSSVGRSTVNHPIGGRYQITPTESSVQKLPVQHGVTTTASVMAQGYN   721

Query:   731 PYIAEWSPYHGAAYAVIEATARLVATGADWSRARFSYQEYFERMDKQAERFGQPVSALLG   790
             PYIAEWSPYHGAAYAVIEATARLVATGADWSRARFSYQEYFERMDKQAERFGQPVSALLG
Sbjct:   722 PYIAEWSPYHGAAYAVIEATARLVATGADWSRARFSYQEYFERMDKQAERFGQPVSALLG   781

Query:   791 SIEAQIQFGLPSIGGKDSMSGTFEELTVPPTLVAFGVTTADSRKVLSPEFKAAGENIYYI   850
             SIEAQIQ GLPSIGGKDSMSGTFE+LTVPPTLVAFGVTTADSRKVLSPEFKAAGENIYYI
```

-continued

```
Sbjct:  782  SIEAQIQLGLPSIGGKDSMSGTFEDLTVPPTLVAFGVTTADSRKVLSPEFKAAGENIYYI      841

Query:  851  PGQAISEDIDFDLIKANFSQFEAIQAQHKITAASAVKYGGVLESLALMTFGNRIGASVEI      910
             PGQAISEDIDFDLIK NFSQFEAIQAQHKITAASA KYGGVLESLALMTFGNRIGASVEI
Sbjct:  842  PGQAISEDIDFDLIKDNFSQFEAIQAQHKITAASAAKYGGVLESLALMTFGNRIGASVEI      901

Query:  911  AELDSSLTAQLGGFVFTSVEEIADVVKIGQTQADFTVTVNGNDLAGASLLSAFEGKLEEV      970
             AELDSSLTAQLGGFVFTS EEIAD VKIGQTQADFTVTVNGNDLAGASLL+AFEGKLEEV
Sbjct:  902  AELDSSLTAQLGGFVFTSAEEIADAVKIGQTQADFTVTVNGNDLAGASLLAAFEGKLEEV      961

Query:  971  YPTEFEQVDAIEEVPAVVSDVVIKAKEIIEKPVVYIPVFPGTNSEYDSAKAFEQVGASVN     1030
             YPTEFEQ D +EEVPAVVSD VIKAKE IEKPVVYIPVFPGTNSEYDSAKAFEQVGASVN
Sbjct:  962  YPTEFEQTDVLEEVPAVVSDTVIKAKETIEKPVVYIPVFPGTNSEYDSAKAFEQVGASVN     1021

Query: 1031  LVPFVTLNEAAIAESVDTMVANIAKANIIFFAGGFSAADEPDGSAKFIVNILLNEKVRAA     1090
             LVPFVTLNE AIAESVDTMVANIAKANIIFFAGGFSAADEPDGSAKFIVNILLNEKVRAA
Sbjct: 1022  LVPFVTLNEVAIAESVDTMVANIAKANIIFFAGGFSAADEPDGSAKFIVNILLNEKVRAA     1081

Query: 1091  IDSFIEKGGLIIGICNGFQALVKSGLLPYGNFEEAGETSPTLFYNDANQHVAKMVETRIA     1150
             IDSFIEKGGLIIGICNGFQALVKSGLLPYGNFEEAGETSPTLFYNDANQHVAKMVETRIA
Sbjct: 1082  IDSFIEKGGLIIGICNGFQALVKSGLLPYGNFEEAGETSPTLFYNDANQHVAKMVETRIA     1141

Query: 1151  NTNSPWLAGVEVGDIHVIPVSHGEGKFVVSASEFAELRDNGQIWSQYVDFDGQPSMDSKY     1210
             NTNSPWLAGVEVGDIH IPVSHGEGK VVSASEFAELRDNGQIWSQYVDFDGQPSNDSKY
Sbjct: 1142  NTNSPWLAGVEVGDIHAIPVSHGEGKLVVSASEFAELRDNGQIWSQYVDFDGQPSMDSKY     1201

Query: 1211  NPNGSVNAIEGITSKNGQIIGKMGHSERWEDGLFQNIPGNKDQKLFESAVKYFTGK          1266
             NPNGSVNAIEGITSKNGQIIGKMGHSERWEDGLFQNIPGNKDQ LF SAVKYFTGK
Sbjct: 1202  NPNGSVNAIEGITSKNGQIIGKMGHSERWEDGLFQNIPGNKDQILFASAVEYFTGK          1257
```

Based on this analysis, it was predicted that these proteins and their epitopes could be useful antigens for vaccines or diagnostics.

Example 305

A DNA sequence (GBSx0334) was identified in *S. agalactiae* <SEQ ID 983> which encodes the amino acid sequence <SEQ ID 984>. This protein is predicted to be phosphoribosylaminoimidazole-succinocarboxamide synthase (purC). Analysis of this protein sequence reveals the following:

Possible site: 41
>>> Seems to have no N-terminal signal sequence
----- Final Results -----
bacterial cytoplasm --- Certainty = 0.4783 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database:

```
>GP: AAA03540 GB: L15190 SAICAR synthetase [Streptococcus pneumoniae]
Identities = 183/231 (79%), Positives = 203/231 (87%)
Query:    1  MTNQLIYTGKAKDIYSTKDENVIRTVYKDQATMLNGARKETIDGKGALNNQISSLIFEKL       60
             M+ QLIY+GKAKDIY+T+DEN+I + YKDQAT  NG +KE I GKG LNNQISS IFEKL
Sbjct:    1  MSKQLIYSGKAKDIYTTEDENLIISTYKDQATAFNGVKKEQIAGKGVLNNQISSFIFEKL       60

Query:   61  NMAGVVTHYIEQISKNEQLNKKVDIIPLEVVLRNVTAGSFSKRFGVEEGHVLETPIVEFY      120
             N AGV TH++E++S  EQLNKKV IIPLEVVLRN TAGSFSKRFGV+EG  LETPIVEFY
Sbjct:   61  NAAGVATHFVEKLSDTEQLNKKVKIIPLEVVLRNYTAGSFSKRFGVDEGIALETPIVEFY      120

Query:  121  YKNDNLNDPFINDEHVKFLGIVNDEEIAYLKGETRHINELLKDWFAQIGLNLIDFKLEFG      180
             YKND+L+DPFINDEHVKFL I +D++IAYLK E R INELLK WFA+IGL LIDFKLEFG
Sbjct:  121  YKNDDLDDPFINDEHVKFLQIADDQQIAYLKEEARRINELLKVWFAEIGLKLIDFKLEFG      180

Query:  181  FDKDGKIILADEFSPDNCRLWDADGNHMDKDVERRDLGSLTDVYQVVLEKL               231
             FDKDGKIILADEFSPDNCRLWDADGNHMDKDVFRR LG LTDVY++V EKL
Sbjct:  181  FDKDGKIILADEFSPDNCRLWDADGNHMDKDVFRRGLGELTDVYEIVWEKL               231
```

A related DNA sequence was identified in *S. pyogenes* <SEQ ID 985> which encodes the amino acid sequence <SEQ ID 986>. Analysis of this protein sequence reveals the following:

```
Possible site: 51
>>> Seems to have no N-terminal signal sequence
----- Final Results -----
   bacterial cytoplasm --- Certainty = 0.3935 (Affirmative) <succ>
    bacterial membrane --- Certainty = 0.0000 (Not Clear) <succ>
     bacterial outside --- Certainty = 0.0000 (Not Clear) <succ>
```

An alignment of the GAS and GBS proteins is shown below:

```
Identities = 221/234 (94%), Positives = 228/234 (96%)
Query:    1 MTNQLIYTGKAKDIYSTKDENVIRTVYKDQATMLNGARKETIDGKGALNNQISSLIFEKL      60
            +TNQLIY GKAKDIYSTKDENVIRTVYKDQATMLNGARKETIDGKGALNNQISSLIFEKL Sbjct:   11 VTNQLIYKGKAKDIYSTKDENVIRTVYKDQATMLNGARKETIDGKGALNNQISSLIFEKL      70

Query:   61 NMAGVVTHYIEQISKNEQLNKKVDIIPLEVVLRNVTAGSFSKRFGVEEGHVLETPIVEFY     120
            N AGVVTHYIEQISKNEQLNKKVDIIPLEVVLRNVTAGSFSKRFGVEEGHVLETPIVEFY Sbjct:   71 NKAGVVTHYIEQISKNEQLNKKVDIIPLEVVLRNVTAGSFSKRFGVEEGHVLETPIVEFY     130

Query:  121 YKNDNLNDPFINDEHVKFLGIVNDEEIAYLKGETRHINELLKDWFAQIGLNLIDFKLEFG     180
            YKND+L+DPFINDEHVKFLGIVNDEEIAYLKGETR INELLK WFAQIGLNLIDFKLEFG Sbjct:  131 YKNDDLDDPFINDEHVKFLGIVNDEEIAYLKGETRRINELLKGWFAQIGLNLIDFKLEFG     190

Query:  181 FDKDGKIILADEFSPDNCRLWDADGNHMDKDVERRDLGSLTDVYQVVLEKLIAL          234
            FD++G  IILADEFSPDNCRLWD +GNHMDKDVFRRDLG+LTDVYQVVLEKLIAL Sbjct:  191 FDQEGTIILADEFSPDNCRLWDKNGNHMDKDVERRDLGNLTDVYQVVLEKLIAL          244
```

Based on this analysis, it was predicted that these proteins and their epitopes could be useful antigens for vaccines or diagnostics.

Example 306

A DNA sequence (GBSx0335) was identified in *S. agalactiae* <SEQ ID 987> which encodes the amino acid sequence <SEQ ID 988>. Analysis of this protein sequence reveals the following:

```
Possible site: 13
>>> Seems to have no N-terminal signal sequence
----- Final Results -----
   bacterial cytoplasm --- Certainty = 0.2779 (Affirmative) <succ>
    bacterial membrane --- Certainty = 0.0000 (Not Clear) <succ>
     bacterial outside --- Certainty = 0.0000 (Not Clear) <succ>
```

A related GBS nucleic acid sequence <SEQ ID 9457> which encodes amino acid sequence <SEQ ID 9458> was also identified.

The protein has homology with the following sequences in the GENPEPT database:

```
>GP: AAC35700 GB: AF041468 acyl carrier protein [Guillardia theta]
Identities = 27/75 (36%), Positives = 52/75 (69%)
Query: 12 MSRDEVFEKMLELLRQQLGDPQLDITPESSLHDDLAIDSIALTEFIINLEDVFHLEIPDE     71
          M+  E+FEK+ ++ +QLG +  +T +++  +DL  DS+   E ++ +E+ F++EIPD+

Sbjct:  1 MNEQEIFEKVQTIISEQLGVDKSQVTKDANFANDLGADSLDTVELVMAIEEAFNIEIPDD     60

Query: 72 AVEHMSSVQQLLDYI                                                86
          A E +S++QQ +D+I Sbjct: 61 AAEQISNLQQAVDFI                                                75
```

A related DNA sequence was identified in *S. pyogenes* <SEQ ID 989> which encodes the amino acid sequence <SEQ ID 990>. Analysis of this protein sequence reveals the following:

```
Possible site: 24
>>> Seems to have no N-terminal signal sequence
----- Final Results -----
``` bacterial cytoplasm --- Certainty = 0.1917 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below:

```
Identities = 36/77 (46%), Positives = 57/77 (73%)
Query:  12 MSRDEVFEKMLELLRQQLGDPQLDITPESSLHDDLAIDSIALTEFIINLEDVFHLEIPDE     71
           M+R E+FE+++ L+++Q    + IT ++ L +DLA+DSI L EFIIN+ED FH+ IPDE
Sbjct:   1 MTRQEIFERLINLIQKQRSYLSVAITEQTHLKNDLAVDSIELVEFIINVEDEFHIAIPDE     60

Query:  72 AVEHMSSVQQLLDYIIE     88
           VE M ++ +LDY+++
Sbjct:  61 DVEDMVFMRDILDYLVQ     77
```

Based on this analysis, it was predicted that these proteins and their epitopes could be useful antigens for vaccines or diagnostics.

Example 307

A DNA sequence (GBSx0336) was identified in *S. agalactiae* <SEQ ID 991> which encodes the amino acid sequence <SEQ ID 992>. This protein is predicted to be fatty acid/phospholipid synthesis protein (plsX). Analysis of this protein sequence reveals the following:

Possible site: 21
>>> Seems to have no N-terminal signal sequence
INTEGRAL    Likelihood = −0.64    Transmembrane 101-117 (101-117)
----- Final Results ----- bacterial membrane --- Certainty = 0.1256 (Affirmative) <succ>
bacterial outside --- Certainty = 0.0000 (Not Clear) <succ>
bacterial cytoplasm --- Certainty = 0.0000 (Not Clear) <succ>

A related GBS nucleic acid sequence <SEQ ID 9455> which encodes amino acid sequence <SEQ ID 9456> was also identified.

The protein has homology with the following sequences in the GENPEPT database:

```
>GP: CAB13462 GB: Z99112 alternate gene name: ylpD [Bacillus subtilis]
Identities = 174/329 (52%), Positives = 238/329 (71%), Gaps = 2/329 (0%)
Query:    8 KIAIDAMGGDYAPKAIVEGVNQAISDFSDIEVQLYGDQKKIEKYLTVT-ERVSIIHTEEK     66
            +IA+DAMGGD+APKA+++GV + I  F D+ + L GD+   IE +LT T +R++++H +E
Sbjct:    2 RIAVDAMGGDHAPKAVIDGVIKGIEAFDDLHITLVGDKTTIESHLTTTSDRITVLHADEV     61

Query:   67 INSDDEPAKAVRRKKQSSMVLGAKAVKDGVAQAFISAGNTGALLAAGLFVVGRIKGVDRP    126
            I   DEP +AVRRKK SSMVL A+ V +    A A ISAGNTGAL+ AGLF+VGRIKG+DRP
Sbjct:   62 IEPTDEPVRAVRRKKNSSMVLMAQEVAENRADACISAGNTGALMTAGLFIVGRIKGIDRP    121

Query:  127 GLMSTMPTLDGVGFDMLDLGANAENTASHLHQYAILGSFYAKNVRGIEVPRVGLLNNGTE    186
            L   T+PT+ G GF +LD+GAN +    HL QYAI+GS Y++ VRG+  PRVGLLN GTE
Sbjct:  122 ALAPTLPTVSGDGFLLLDVGANVDAKPEHLVQYAIMGSVYSQQVRGVTSPRVGLLNVGTE    181

Query:  187 ETKGDSLHKEAYELLAAEPSINFIGNIEARDLMSSVADVVVTDGFTGNAVLKTMEGTAMS    246
            + KG+ L K+ +++L       +INFIGN+EARDL+  VADVVVTDGFTGN LKT+EG+A+S
Sbjct:  182 DKKGNELTKQTFQILKETANINFIGNVEARDLLDDVADVVVTDGFTGNVTLKTLEGSALS    241

Query:  247 IMGSLKSSIKSGGVKAKLGALLLKDSLYQLKDSMDYSSAGGAVLFGLKAPIVKCHGSSDS    306
            I   ++  + +   + +KL A +LK  L ++K  M+YS+ GGA LFGLKAP++K HGSSDS
Sbjct:  242 IFKMMR-DVMTSTLTSKLAAAVLKPKLKEMKMKMEYSNYGGASLFGLKAPVIKAHGSSDS    300

Query:  307 KAVYSTLKQVRTMLETQVVDQLVDAFTDE     335
            AV+    ++Q R M+   V  + +E
Sbjct:  301 NAVFHAIRQAREMVSQNVAALIQEEVKEE     329
```

A related DNA sequence was identified in *S. pyogenes* <SEQ ID 993> which encodes the amino acid sequence <SEQ ID 994>. Analysis of this protein sequence reveals the following:

Possible site: 36
>>> Seems to have no N-terminal signal sequence

-continued

```
INTEGRAL    Likelihood = -2.07    Transmembrane 121-137 (120-138)
----- Final Results -----
    bacterial membrane --- Certainty = 0.1829 (Affirmative) <succ>
        bacterial outside --- Certainty = 0.0000 (Not Clear) <succ>
            bacterial cytoplasm --- Certainty = 0.0000 (Not Clear) <succ>
```

A related sequence was also identified in GAS <SEQ ID 9127> which encodes the amino acid sequence <SEQ ID 9128>. Analysis of this protein sequence reveals the following:

```
Possible cleavage site: 16
>>> Seems to have no N-terminal signal sequence
INTEGRAL    Likelihood = -2.07    Transmembrane 95-111 (94-112)
----- Final Results -----
    bacterial membrane --- Certainty = 0.183 (Affirmative) <succ>
        bacterial outside --- Certainty = 0.000 (Not Clear) <succ>
            bacterial cytoplasm --- Certainty = 0.000 (Not Clear) <succ>
```

An alignment of the GAS and GBS proteins is shown below:

```
Identities = 254/330 (769%), Positives = 290/330 (86%)
Query:    6 MKKIAIDAMGGDYAPKAIVEGVNQAISDFSDIEVQLYGDQKKIEKYLTVTERVSIIHTEE          65
            MK+IAIDAMGGD APKAIVEGVNQAI  FSDIE+QLYGDQ KI  YL  ++RV+IIHT+E Sbjct:   27 MKRIAIDAMGGDNAPKAIVEGVNQAIEAFSDIEIQLYGDQTKINSYLIQSDRVAIIHTDE          86

Query:   66 KINSDDEPAKAVRRKKQSSMVLGAKAVKDGVAQAFISAGNTGALLAAGLFVVGRIKGVDR         125
            KI SDDEPAKAVRRKK++SMVL AKAVK+G A A ISAGNTGALLA GLFVVGRIKGVDR Sbjct:   87 KIMSDDEPAKAVRRKKKASMVLAAKAVKEGKADAIISAGNTGALLAVGLFVVGRIKGVDR         146

Query:  126 PGLMSTMPTLDGVGFDMLDLGANAENTASHLHQYAILGSFYAKNVRGIEVPRVGLLNNGT         185
            PGL+ST+PT+ G+GFDMLDLGANAENTA HLHQYAILGSFYAKNVRGI  PRVGLLNNGT Sbjct:  147 PGLLSTIPTVTGLGFDMLDLGANAENTAKHLHQYAILGSFYAKNVRGIANPRVGLLNNGT         206

Query:  186 EETKGDSLHKEAYELLAAEPSINFIGNIEARDLMSSVADVVVTDGFTGNAVLKTMEGTAM         245
            EETKGD L K  YELL A+ +I+F+GN+EAR+LMS VADV+V+DGFTGNAVLK++EGTA+

Sbjct:  207 EETKGDPLRKATYELLTADNTISFVGNVEARELMSGVADVIVSDGFTGNAVLKSIEGTAI         266

Query:  246 SIMGSLKSSIKSGGVKAKLGALLLKDSLYQLKDSMDYSSAGGAVLFGLKAPIVKCHGSSD         305
            SIMG LK  I SGG+ K K+GA LLK SLY++K  ++DYSSAGGAVLFGLKAP+VK HGSSD Sbjct:  267 SIMGQLKQIINSGGIKTKIGASLLKSSLYEMKKTLDYSSAGGAVLFGLKAPVVKSHGSSD         326

Query:  306 SKAVYSTLKQVRTMLETQVVDQLVDAFTDE                                       335
            KA++ST+KQVRTML+T VV QLV+ F  E Sbjct:  327 VKAIFSTIKQVRTMLDTNVVGQLVEEFAKE                                       356
```

Based on this analysis, it was predicted that these proteins and their epitopes could be useful antigens for vaccines or diagnostics.

Example 308

A DNA sequence (GBSx0337) was identified in *S. agalactiae* <SEQ ID 995> which encodes the amino acid sequence <SEQ ID 996>. Analysis of this protein sequence reveals the following:

```
Possible site: 27
>>> Seems to have no N-terminal signal sequence
----- Final Results -----
```

```
    bacterial cytoplasm --- Certainty = 0.4668 (Affirmative) <succ>
        bacterial membrane --- Certainty = 0.0000 (Not Clear) <succ>
            bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 309

A DNA sequence (GBSx0338) was identified in *S. agalactiae* <SEQ ID 997> which encodes the amino acid sequence <SEQ ID 998>. Analysis of this protein sequence reveals the following:

```
Possible site: 32
>>> Seems to have no N-terminal signal sequence
INTEGRAL    Likelihood = -12.84    Transmembrane 61-77 (55-82)
INTEGRAL    Likelihood = -10.14    Transmembrane 26-42 (19-51)
INTEGRAL    Likelihood = -9.77     Transmembrane 192-208 (186-211)
INTEGRAL    Likelihood = -5.79     Transmembrane 267-283 (262-286)
INTEGRAL    Likelihood = -3.77     Transmembrane 100-116 (99-116)
----- Final Results -----
    bacterial membrane --- Certainty = 0.6137 (Affirmative) <succ>
        bacterial outside --- Certainty = 0.0000 (Not Clear) <succ>
            bacterial cytoplasm --- Certainty = 0.0000 (Not Clear) <succ>
```

A related GBS nucleic acid sequence <SEQ ID 9453> which encodes amino acid sequence <SEQ ID 9454> was also identified.

The protein has homology with the following sequences in the GENPEPT database:

```
>GP: CAA22372 GB: AL034446 putative transmembrane protein
[Streptomyces coelicolor A3(2)]
Identities = 47/154 (30%), Positives = 69/154 (44%), Gaps = 12/154 (7%)
Query:  120 SGFVEISSSNSFSFGPFFFLFLAYFIQSLTEEILFRGYVMTTVTKFKGSFAGVLCNSMLF      179
            SG+ E+   S          F+A   + TEE++FRG +   + + G++  +    ++F Sbjct:  118 SGYYEVDGLGSVQGAIGLVGFMA--AAAATEEVVFRGVLFRIIEEHIGTYLALGLTGLVF      175

Query:  180 SFIHFRN-----YGITAIALFNLFLLGIIFSILFNMTKNILFVTGVHTTWNFTMGCVLGN      234
            +H  N     +G  AIA+   F+L    ++      T+N+     GVH  WNF  G V Sbjct:  176 GLMHLLNEDATLWGALAIAIEAGFMLAAAYAA----TRNLWLTIGVHFGWNFAAGGVFST      231

Query:  235 KVSGGDSPVSLFRITENSSFALWNGGDFGFEGGV                            268
             VSG     L   T  S    L  GGDFG EG V Sbjct:  232 VVSGNGDSEGLLDAT-MSGPKLLTGGDFGPEGSV                            264
```

No corresponding DNA sequence was identified in *S. pyogenes*.

Based on this analysis, it was predicted that these proteins and their epitopes could be useful antigens for vaccines or diagnostics.

Example 310

A DNA sequence (GBSx0339) was identified in *S. agalactiae* <SEQ ID 999> which encodes the amino acid sequence <SEQ ID 1000>. Analysis of this protein sequence reveals the following:

Possible site: 55
>>> Seems to have no N-terminal signal sequence
----- Final Results -----
  bacterial cytoplasm --- Certainty = 0.2665 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 9451> which encodes amino acid sequence <SEQ ID 9452> was also identified.

The protein has homology with the following sequences in the GENPEPT database:

A related DNA sequence was identified in *S. pyogenes* <SEQ ID 1001> which encodes the amino acid sequence <SEQ ID 1002>. Analysis of this protein sequence reveals the following:

Possible site: 46
>>> Seems to have no N-terminal signal sequence
----- Final Results -----
  bacterial cytoplasm --- Certainty = 0.1566 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below:

```
>GP: BAB05088 GB: AP001511 unknown conserved protein
[Bacillus halodurans]
Identities = 81/242 (33%), Positives = 124/242 (50%), Gaps = 3/242 (1%)
Query:    8 GLVLYNRNYREDDKLVKIFTETEGKRMFFVKHAS--KSKFNAVLQPLTIAHFILKINDNG      65
            G+V+   +Y E +K+V +FT   GK    + A   KS+  AV Q  T     + + N G Sbjct:    7 GIVIRTVDYGESNKIVTVFTREYGKIALMARGAKRPKSRLTAVTQLFTYGMMMFQKNA-G      65

Query:   66 LSYIDDYKEVLAFQETNSDLFKLSYASYITSLADVAISDNVADAQLFIFLKKTLELIEDG     125
            L +    + + +F+E  +DLF+ SY SY+T L +     D   +  LF  L +T+  + +G Sbjct:   66 LGTLTQGEIIQSFREVRNDLFRASYVSYVTDLTNKLTEDEKRNPYLFELLYQTIHYMNEG     125

Query:  126 LDYEILTNIFEVQLLERFGVALNFHDCVFCHRVGLPFDFSHKYSGLLCPNHYYKDERRNH     185
            +D ++LT  IFEV++       G+     CV C   +P  FS K +G LC     KD Sbjct:  126 MDPDVLTRIFEVKMFTVAGIKPELDQCVSCRSTDVPVGFSIKEAGFLCKRCIEKDPHAYK     185

Query:  186 LDPNMLYLINRFQSIQFDDLQTISVKPEMKLKIRQFLDMIYDEYVGIHLKSKKFIDDLSSWG     247
             +   + L+ F           L TIS+KPE K ++    +    YDEY G+HLKS++F+D L S G Sbjct:  186 ITAQVAKLLRLFYHFDLQRLGTISLKPETKATLKTIIHQYYDEYSGLHLKSRRFLDQLESMG     247
```

```
Identities = 159/251 (63%), Positives = 210/251 (83%)
Query:   1 MRVSQTYGLVLYNRNYREDDKLVKIFTETEGKRMFFVKHASKSKFNAVLQPLTIAHFILK    60
           M+++++ G+VL+NRNYREDDKLVKIFTE  GK+MFFVKH S+SK ++++QPLTIA FI K
Sbjct:   1 MQLTESLGIVLFNRNYREDDKLVKIFTEVAGKQMFFVKHISRSKMSSIIQPLTIADFIFK    60

Query:  61 INDNGLSYIDDYKEVLAFQETNSDLFKLSYASYITSLADVAISDNVADAQLFIFLKKTLE   120
           +ND GLSY+ DY  V  ++  N+D+F+L+YASY+ +LAD AI+DN +D+ LF FLKKTL+
Sbjct:  61 LNDTGLSYVVDYSNVNTYRYINNDIFRLAYASYVLALADAAIADNESDSHLFTFLKKTLD   120

Query: 121 LIEDGLDYEILTNIFEVQLLERFGVALNFHDCVFCHRVGLPFDFSHKYSGLLCPNHYYKD   180
           L+E+GLDYEILTNIFE+Q+L+RFG++LNFH+C  CHR  LP DFSH++S +LC  HYYKD
Sbjct: 121 LMEEGLDYEILTNIFEIQILDRFGISLNFHECAICHRTDLPLDFSHRFSAVLCSEHYYKD   180

Query: 181 ERRNHLDPNMLYLINRFQSIQFDDLQTISVKPEMKLKIRQFLDMIYDEYVGIHLKSKKFI   240
           RRNHLDPN++YL++RFQ I FDDL+TIS+  ++K K+RQF+D +Y +YVGI LKSK FI
Sbjct: 181 NRRNHLDPNVIYLLSRFQKITFDDLRTISLNKDIKKKLRQFIDELYHDYVGIKLKSKTFI   240

Query: 241 DDLSSWGSIMK                                                   251
           D+L   WG IMK
Sbjct: 241 DNLVKWGDIMK                                                   251
```

Based on this analysis, it was predicted that these proteins and their epitopes could be useful antigens for vaccines or diagnostics.

Example 311

A DNA sequence (GBSx0340) was identified in *S. agalactiae* <SEQ ID 1003> which encodes the amino acid sequence <SEQ ID 1004>. This protein is predicted to be aromatic amino acid aminotransferase (patA). Analysis of this protein sequence reveals the following:

Possible site: 14
>>> Seems to have no N-terminal signal sequence

INTEGRAL    Likelihood = −3.13    Transmembrane 141-157 (140-159)
----- Final Results -----
  bacterial membrane --- Certainty = 0.2253 (Affirmative) <succ>
  bacterial outside --- Certainty = 0.0000 (Not Clear) <succ>
  bacterial cytoplasm --- Certainty = 0.0000 (Not Clear) <succ>

A related GBS nucleic acid sequence <SEQ ID 9449> which encodes amino acid sequence <SEQ ID 9450> was also identified.

The protein has homology with the following sequences in the GENPEPT database:

```
>GP: AAF06954 GB: AF146529 aromatic amino acid aminotransferase
[Lactococcus lactis subsp. cremoris]
Identities = 261/391 (66%), Positives = 323/391 (81%)
Query:  38 MTLEKRFNKYLDRIEVSLIRQFDQSISDIPGMVKLTLGEPDFTTPDHVKEAAKSAIDANQ    97
           M L K+FN  LD+IE+SLIRQFDQ +S IP ++KLTLGEPDF TP+HVK+A  +AI+ NQ
Sbjct:   1 MDLLKKFNPNLDKIEISLIRQFDQQVSSIPDIIKLTLGEPDFYTPEHVKQAGIAAIENNQ    60

Query:  98 SYYTGMSGLLALRQAAADFAKDKYNLTYNPDCEILVTIGATEALSASLIAILEAGDVVLL   157
           S+YTGM+GLL LRQAA++F   KY L+Y  + EILVT+G TEA+S+ L++IL AGD VL+
Sbjct:  61 SHYTGMAGLLELRQAASEFLLKKYGLSYAAEDEILVTVGVTEAISSVLLSILVAGDEVLI   120

Query: 158 PAPAYPGYEPIVNLVGADIVEIDTRENDFRLTPEMLETAIIQQGEKLKAVLLNYPTNPTG   217
           PAPAYPGYEP++ L G  +VEIDTR NDF LTPEML+ AII++   K+KAV+LNYP NPTG
Sbjct: 121 PAPAYPGYEPLITLAGGSLVEIDTRANDFVLTPEMLDQAIIEREGKVKAVILNYPANPTG   180

Query: 218 ITYSRQEIAALAEVLKKYDIFVISDEVYSELTYTGQQHVSIAEYLPNQTILINGLSKSHA   277
           +TY+R++I  LAEVLKK+++FVI+DEVYSEL YT Q HVSIAEY P QTI++NGLSKSHA
Sbjct: 181 VTYNREQIKDLAEVLKKHEVFVIADEVYSELNYTDQPHVSIAEYAPEQTIVLNGLSKSHA   240

Query: 278 MTGWRVGLVYAPEAFIAQIIKSHQYMVTAASTISQFAGVEALSVGKNDTLPMRQGYIKRR   337
           MTGWR+GL++A    +AQIIK+HQY+VT+AST SQFA +EAL  G +D LPM++ Y+KRR
Sbjct: 241 MTGWRIGLIFAARELVAQIIKTHQYLVTSASTQSQFAAIEALKNGADDALPMKKEYLKRR   300

Query: 338 DYIIDKMSKLGFKIIKPSGAFYIFAKIPDSYPQDSFKFCQDFAYQQAVAIIPGVAFGKYG   397
           DYII+KMS LGFKII+P GAFYIFAKIP   QDSFKF  DFA + AVAIIPG+A GKYG
Sbjct: 301 DYIIEKMSALGFKIIEPDGAFYIFAKIPADLEQDSFKFAVDFAKENAVAIIPGIANGQYG   360
```

```
Query: 398 EGYIRLSYAASMEVIETAMARLKVFMESYEG                                    428
            EG++RLSYAASM+VIE AMARL  ++    G Sbjct: 361 EGFVRLSYAASMDVIEQAMARLTDYVTKKRG                                    391
```

There is also homology to SEQ ID 1006.

SEQ ID 1004 (GBS332) was expressed in *E. coli* as a His-fusion product. SDS-PAGE analysis of total cell extract is shown in FIG. 60 (lane 3; MW 50.7 kDa). It was also expressed in *E. coli* as a GST-fusion product. SDS-PAGE analysis of total cell extract is shown in FIG. 67 (lane 4; MW 76 kDa).

Based on this analysis, it was predicted that these proteins and their epitopes could be useful antigens for vaccines or diagnostics.

Example 312

A DNA sequence (GBSx0341) was identified in *S. agalactiae* <SEQ ID 1007> which encodes the amino acid sequence <SEQ ID 1008>. This protein is predicted to be ribose-phosphate pyrophosphokinase (prsA). Analysis of this protein sequence reveals the following:

---

Possible site: 22
>>> Seems to have no N-terminal signal sequence
----- Final Results -----
   bacterial cytoplasm --- Certainty = 0.3118 (Affirmative) <succ>
    bacterial membrane --- Certainty = 0.0000 (Not Clear) <succ>
     bacterial outside --- Certainty = 0.0000 (Not Clear) <succ>

---

A related GBS nucleic acid sequence <SEQ ID 9447> which encodes amino acid sequence <SEQ ID 9448> was also identified.

The protein has homology with the following sequences in the GENPEPT database:

```
>GP: AAA62181 GB: M92842 prs [Listeria monocytogenes]

Identities = 209/312 (66%), Positives = 266/312 (84%), Gaps = 3/312 (0%)

Query:  10 LKLFALSSNKELAKKVSQTIGIPLGQSTVRQFSDGEIQVNIEESIRGHHVFILQSTSSPV     69
           LK+F+L+SN+ELA+++++ +GI LG+S+V FSDGEIQ+NIEESIRG HV+++QSTS+PV Sbjct:  10 LKIFSLNSNRELAEEIAKEVGIELGKSSVTHFSDGEIQINIEESIRGCHVYVIQSTSNPV     69

Query:  70 NDNLMEILIMVDALKRASAESVSVVMPYYGYARQDRKARSREPITSKLVANMLEVAGVDR    129
           N NLME+LIM+DALKRASA ++++VMPYYGYARQDRKARSREPIT+KLVAN++E AG  R Sbjct:  70 NQNLMELLIMIDALKRASAATINIVMPYYGYARQDRKARSREPITAKLVANLIETAGATR    129

Query: 130 LLTVDLHAAQIQGFFDIPVDHLMGAPLIADYFDRQGLVGDDVVVVSPDHGGVTRARKLAQ    189
           ++T+D+HA QIQGFFDIP+DHL   L++DYF + L GDD+VVVSPDHGGVTRARK+A Sbjct: 130 MITLDMHAPQIQGFFDIPIDHLNAVRLLSDYFSERHL-GDDLVVVSPDHGGVTRARKMAD    188

Query: 190 CLKTPIAIIDKRRSVTXMNISEVMNIIGNIKGKKCILIDDMIDTAGTICHAADALAEAGA    249
              LK PIAIIDKRR  + N +EVMNI+GN++GK CI+DD+IDTAGTI  AA AL EAGA Sbjct: 189 RLKAPIAIIDKRR--PRPNVAEVMNIVGNVEGKVCIIIDDIIDTAGTITLAARALREAGA    246

Query: 250 TAVYASCTHPVLSGPALDNIQNSAIEKLIVLDTIYLPEERLIDKIEQISIAELIGEAIIR    309
           T VYA C+HPVLSGPA+  I+ S IEKL+V ++I LPEE+ IDK+EQ+S+A L+GEAI+R Sbjct: 247 TKVYACCSHPVLSGPAMKRIEESPIEKLVVTNSIALPEEKWIDKMEQLSVAALLGEAIVR    306

Query: 310 IHEKRPLSPLFE                                                  321
           +HE   +S LFE Sbjct: 307 VHENASVSSLFE                                                  318
```

A related DNA sequence was identified in *S. pyogenes* <SEQ ID 1009> which encodes the amino acid sequence <SEQ ID 1010>. Analysis of this protein sequence reveals the following:

```
Possible site: 22
>>> Seems to have no N-terminal signal sequence
----- Final Results -----
    bacterial cytoplasm --- Certainty = 0.2685 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below:

<SEQ ID 1012>. This protein is predicted to be a secreted protein. Analysis of this protein sequence reveals the following:

```
Possible site: 20
>>> Seems to have no N-terminal signal sequence
----- Final Results -----
    bacterial cytoplasm --- Certainty = 0.3751 (Affirmative) <succ>
    bacterial membrane --- Certainty = 0.0000 (Not Clear) <succ>
    bacterial outside --- Certainty = 0.0000 (Not Clear) <succ>
```

```
Identities = 298/322 (92%), Positives = 311/322 (96%)
Query: 1   MEEIMSYSNLKLFALSSNKELAKKVSQTIGIPLGQSTVRQFSDGEIQVNIEESIRGHHVF     60
           +EE MSYS+LKLFALSSNKELA+KV+   +GI LG+STVRQFSDGEIQVNIEESIRGHHVF
Sbjct: 1   LEEKMSYSDLKLFALSSNKELAEKVASAMGIQLGKSTVRQFSDGEIQVNIEESIRGHHVF     60

Query: 61  ILQSTSSPVNDNLMEILIMVDALKRASAESVSVVMPYYGYARQDRKARSREPITSKLVAN    120
           ILQSTSSPVNDNLMEILIMVDALKRASAE +SVVMPYYGYARQDRKARSREPITSKLVAN
Sbjct: 61  ILQSTSSPVNDNLMEILIMVDALKRASAEKISVVMPYYGYARQDRKARSREPITSKLVAN    120

Query: 121 MLEVAGVDRLLTVDLHAAQIQGFFDIPVDHLMGAPLIADYFDRQGLVGDDVVVVSPDHGG    180
           MLEVAGVDRLLTVDLHAAQIQGFFDIPVDHLMGAPLIADYFDR GLVG+DVVVVSPDHGG
Sbjct: 121 MLEVAGVDRLLTVDLHAAQIQGFFDIPVDHLMGAPLIADYFDRHGLVGEDVVVVSPDHGG    180

Query: 181 VTRARKLAQCLKTPIAIIDKRRSVTKMNTSEVMNIIGNIKGKKCILIDDMIDTAGTICHA    240
           VTRARKLAQ L+TPIAIIDKRRSV KMNTSEVMNIIGN+ GKKCILIDDMIDTAGTICHA
Sbjct: 181 VTRARKLAQFLQTPIAIIDKRRSVDKMNTSEVMNIIGNVSGKKCILIDDMIDTAGTICHA    240

Query: 241 ADALAEAGATAVYASCTHPVLSGPALDNIQNSAIEKLIVLDTIYLPEERLIDKIEQISIA    300
           ADALAEAGATAVYASCTHPVLSGPALDNIQ SAIEKLIVLDTIYLP+ERLIDKIEQISIA
Sbjct: 241 ADALAFAGATAVYASCTHPVLSGPALDNIQRSAIEKLIVLDTIYLPKERLIDKIEQISIA    300

Query: 301 ELIGEAIIRIHEKRPLSPLFEM                                        322
           +L+ EAIIRIHEKRPLSPLFEM
Sbjct: 301 DLVAEAIIRIHEKRPLSPLFEM                                        322
```

Based on this analysis, it was predicted that these proteins and their epitopes could be useful antigens for vaccines or diagnostics.

A related GBS nucleic acid sequence <SEQ ID 9277> which encodes amino acid sequence <SEQ ID 9278> was also identified.

Example 313

A DNA sequence (GBSx0342) was identified in *S. agalactiae* <SEQ ID 1011> which encodes the amino acid sequence The protein has homology with the following sequences in the GENPEPT database:

```
>GP: AAD00288 GB: U78607 putative secreted protein
[Streptococcus mutans]
Identities = 111/157 (70%), Positives = 130/157 (82%), Gaps = 1/157 (0%)
Query:   1 MTAIKGQVGALESQQSELEAQNAQLEAVSQQLGQEIQTLSNKIVARNESLKKQVRSAQKG     60
           +   I+GQV AL++QQ+EL+A+N +LEA S  LGQ+IQTLS+KIVARNESLK+Q RSAQK
Sbjct:  55 LITIQGQVSALQTQQAELQAENQRLEAQSATLGQQIQTLSSKIVARNESLKQQARSAQKS    114

Query:  61 NL-TNYINTILNSKSVSDAVNRVVAIREVVSANEKMLAQQEADKAALEAKQIENQNAINT    119
           N  T+YIN I+NSKSVSDA+NRV AIREVVSANEKML QQE DKAA+E KQ ENQ AINT
Sbjct: 115 NAATSYINAIINSKSVSDAINRVSAIREVVSANEKMLQQQEQDKAAVEQKQQENQAAINT    174

Query: 120 VAANKQAIENNKAALATQRAQLEAAQLELSAQLTTVQ                         156
           VAAN++ I  N  AL TQ+AQLEAAQL L A+LTT Q
Sbjct: 175 VAANQETIAQNTNALNTQQAQLEAAQLNLQAELTTAQ                         211
```

There is also homology to SEQ ID 1014.

A related GBS gene <SEQ ID 8543> and protein <SEQ ID 8544> were also identified. Analysis of this protein sequence reveals the following:

```
Lipop: Possible site: -1   Crend: 3
McG: Discrim Score: 8.29
GvH: Signal Score (-7.5): 0.8
    Possible site: 49
    >>> Seems to have a cleavable N-term signal seq.
ALOM program count: 0 value: 6.74 threshold: 0.0
PERIPHERAL      Likelihood = 6.74        400
modified ALOM score: -1.85
*** Reasoning Step: 3
----- Final Results -----
    bacterial outside --- Certainty = 0.3000 (Affirmative) <succ>
        bacterial membrane --- Certainty = 0.0000 (Not Clear) <succ>
            bacterial cytoplasm --- Certainty = 0.0000 (Not Clear)
```

The protein has homology with the following sequences in the databases:

SEQ ID 8544 (GBS65) was expressed in *E. coli* as a His-fusion product. SDS-PAGE analysis of total cell extract is shown in FIG. 5 (lane 6; MW 47.5 kDa). It was also expressed in *E. coli* as a GST-fusion product. SDS-PAGE analysis of total cell extract is shown in FIG. 13 (lane 3; MW 72 kDa) and in FIG. 175 (lane 2 & 3; MW 72 kDa).

The GBS65-GST fusion product was purified (FIG. 102A; see also FIG. 191, lane 4) and used to immunise mice (lane 1 product; 20 μg/mouse). The resulting antiserum was used for Western blot (FIG. 102B), FACS, and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

```
32.8/56.3% over 439aa
Lactococcus lactis
GP|512521| usp 45 Insert characterized
PIR|JN0097|JN0097 secreted 45K protein precursor - Insert characterized
ORF00094(301-1563 of 1941)
GP|512521|emb|CAA01320.1||A17083(1-440 of 461) usp 45 {Lactococcus
lactis}PIR|JN0097|JN0097 secreted
45K protein precursor - Lactococcus lactis
% Match = 16.5
% Identity = 32.8 % Similarity = 56.3
Matches = 141 Mismatches = 178 Conservative Sub.s = 101

93         123         153         183         213         243         273         303
RKYYNFKSNYTLFLFLF*FHYGVIILIE*IEEGYRFLDLIMVHLEIVDFKYKCNNDVI*FREFFGKIFNVLS*RSSLIKM
                                                                               |
                                                                               M 333              387         417         447         477         507         537
KKRILSAVLVSGVTLGTAA--VTVNADDFDSKIAATDSVINTLSGQQAAAQNQVTAIKGQVGALESQQSELEAQNAQLEA
|| :|::||:|:|  ||     |||   :| ||   |:::     :|:|| ||  :::  :|  :|:  :|:  |::|:
KKKIISAILMSTVILSAAAPLSGVYAD-TNSDIAKQDATISSAQSAKAQAQAQVDSLQSKVDSLQQKQTSTKAQIAKIES
        20        30         40         50         60         70        80

567         597         627         654         684         714         744         774
VSQQLGQEIQTLSNKIVARNESLKKQVRSAQ-KGNLTNYINTILNSKSVSDAVNRVVAIREVVSANEKMLAQQEADKAAL
 :: :| ||:|  :         |:||| ||   :|||::   :::||::  :|  || |  |||||||||  ||||  |
EAKALNAQIATLNESIKERTKTLEAQARSAQVNSSATNYMDAVVNSKSLTDVIQKVTAIATVSSANKQMLEQQEKEQKEL
        90        100         110         120         130         140        150        160

804         834         864         894         924         954         984         1014
EAKQIENQNAINTVAANKQAIENNKAALATQRAQLEAAQLELSAQLTTVQNEKASLIQAKAQAEEAARKAAEAQAAAEAK
 |  :    |   :    |::::     | :|:|:| ||   | :| ||::   :| || ::|| ||::|  |||  ||:
SQKSETVKKNYNQFVSLSQSLDSQAQELTSQQAELKVATLNYQATIATAQDKKQALLDEKAAAEKAAQEAAKKQAAYEAQ
        170         180         190         200         210         220        230        240

1044         1065         1095         1125         1155         1185         1215
AQAEAKAQAESVA---KAQAAAQVESATAPTETVQTQPRTEIKPSNLTATSSATTVATTTATATNEPKVTQPSVVTKA--
 : |:|||   | ||    ||::  : :|   |     :  ::|::::|::::::::::::: |        :|  :
QKEAAQAQAASTAATAKAVEAATSSASASSSQAPQVSTSTDNTTSNASASNSSNSSSNSSSSSSSSSSSSSSSSSSSNAGG
        250         260         270         280         290         300        310        320

1266         1296         1326         1347         1374         1401         1455
-VEAPKAVVSSTPRAVSKPVVRSYDSSNTYPMGQCT---WGA-KSMASWVGNYW-GNANQWGASARAAG--YSVGTTPRV
 :  :  :::          :|       |  |||| ||    | ||  :||  | ||:| | | || :|  |:  || |
NTNSGTSTGNTGGTTTGGSGINSSPIGNPYAGGGCTDYVWQYFAAQGIYIRNIMPGNGGQWASNGPAQGVLHVVGAAPGV
        330         340         350         360         370         380        390        400

1503         1533         1563         1593         1623         1653         1683
GAVAVWP----YDGGGYGHVAVVTSVANNSSIQVMESNYAGNMSIGNYRGSFNPSASGSVYYIYPN**ILRRSFVVSFLF
 | :       |     ||||:|:: :: :|   |                                |:
IASSFSADFVGYANSPYGHVAIVKSVNSDGTITIKEGGYGTTWWGHERTVSASGVTFLMPN
        410         420         430         440         450        460
```

Example 314

A DNA sequence (GBSx0343) was identified in *S. agalactiae* <SEQ ID 1015> which encodes the amino acid sequence <SEQ ID 1016>. Analysis of this protein sequence reveals the following:

```
Possible site: 18
>>> Seems to have no N-terminal signal sequence
----- Final Results -----
    bacterial cytoplasm --- Certainty = 0.1184 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 315

A DNA sequence (GBSx0344) was identified in *S. agalactiae* <SEQ ID 1017> which encodes the amino acid sequence <SEQ ID 1018>. Analysis of this protein sequence reveals the following:

```
Possible site: 23
>>> Seems to have no N-terminal signal sequence
----- Final Results -----
    bacterial cytoplasm --- Certainty = 0.4736 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 316

A DNA sequence (GBSx0345) was identified in *S. agalactiae* <SEQ ID 1019> which encodes the amino acid sequence <SEQ ID 1020>. This protein is predicted to be elongation factor Tu (tufA). Analysis of this protein sequence reveals the following:

```
Possible site: 43
>>> Seems to have no N-terminal signal sequence
----- Final Results -----
    bacterial cytoplasm --- Certainty = 0.3012 (Affirmative) <succ>
    bacterial membrane --- Certainty = 0.0000 (Not Clear) <succ>
    bacterial outside --- Certainty = 0.0000 (Not Clear) <succ>
```

A related GBS nucleic acid sequence <SEQ ID 9737> which encodes amino acid sequence <SEQ ID 9738> was also identified.

The protein has homology with the following sequences in the GENPEPT database:

```
>GP: BAB03851 GB: AP001507 translation elongation factor Tu (EF-Tu)
[Bacillus halodurans]
Identities = 302/397 (76%), Positives = 350/397 (88%), Gaps = 2/397 (0%)
Query:    7 MAKEKYDRSKPHVNIGTIGHVDHGKTTLTAAITTVLARRLPTSVNQPKDYASIDAAPEER      66
            MAKEK+DRSK H NIGTIGHVDHGKTTLTAAITTVLA+R     V      Y +ID APEER
Sbjct:    1 MAKEKFDRSKTHANIGTIGHVDHGKTTLTAAITTVLAKRSGKGVAMA--YDAIDGAPEER      58

Query:   67 ERGITINTAHVEYETEKRHYAHIDAPGHADYVKNMITGAAQMDGAILVVASTDGPMPQTR     126
            ERGITI+TAHVEYET+ RHYAH+D PGHADYVKNMITGAAQMDG ILVV++ DGPMPQTR
Sbjct:   59 ERGITISTAHNEYETDNRHYAHVDCPGHADYVKNMITGAAQMDGGILVVSAADGPMPQTR     118

Query:  127 EHILLSRQVGVKHLIVFMNKVDLVDDEELLELVEMEIRDLLSEYDFPGDDLPVIQGSALK     186
            EHILLSRQVGV +L+VF+NK D+VDDEELLELVEME+RDLLSEYDFPGDD+PVI+GSALK
Sbjct:  119 EHILLSRQVGVPYLVVFLNKCDMVDDEELLELVEMEVRDLLSEYDFPGDDVPVIRGSALK     178

Query:  187 ALEGDEKYEDIIMELMSTVDEYIPEPERDTDKPLLLPVEDVFSITGRGTVASGRIDRGTV     246
            ALEGD ++E+ I+ELM+ VD+YIP PERDT+KP ++PVEDVFSITGRGTVA+GR++RG +
Sbjct:  179 ALEGDAEWEEKIIELMAAVDDYIPTPERDTEKPFMMPVEDVFSITGRGTVATGRVERGQL     238

Query:  247 RVNDEVEIVGIKEDIQKAVVTGVEMFRKQLDEGLAGDNVGVLLRGVQRDEIERGQVLAKP     306
              V DEVEI+G++E+  +K  VTGVEMFRK LD   AGDN+G LLRGV R+E++RGQVLAKP
Sbjct:  239 NVGDEVETIGLEEEAKKTTVTGVEMFRKLLDYAEAGDNIGALLRGVSREEVQRGQVLAKP     298

Query:  307 GSINPHTRFKGEVYILSKEEGGRHTPFFNNYRPQFYFRTTDVTGSIELPAGTEMVMPGDN     366
            G+I PHT FK EVY+LSKEEGGRHTPFF+NYRPQFYFRTTDVTG I+LP G EMVMPGDN
Sbjct:  299 GTITPHTNFKAEVYVLSKEEGGRHTPFFSNYRPQFYFRTTDVTGIIQLPDGVEMVMPGDN     358

Query:  367 VTIEVELIHPIAVEQGTTFSIREGGRTVGSGIVSEIE                         403
            V + VELI PIA+E+GT FSIREGGRTVG+G+V+ I+
Sbjct:  359 VEMTVELIAPIAIEEGTKFSIREGGRTVGAGVVASIQ                         395
```

A related DNA sequence was identified in *S. pyogenes* <SEQ ID 1021> which encodes the amino acid sequence <SEQ ID 1022>. Analysis of this protein sequence reveals the following:

Possible site: 19
>>> Seems to have no N-terminal signal sequence

----- Final Results -----
bacterial cytoplasm --- Certainty = 0.1367 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below:

```
Identities = 386/404 (95%), Positives = 396/404 (97%)

Query:    1 MEAFPKMAKEKYDRSKPHVNIGTIGHVDHGKTTLTAAITTVLARRLPTSVNQPKDYASID       60
            +EAFPKMAKEKYDRSKPHVNIGTIGHVDHGKTTLTAAITTVLARRLP+SVNQPKDYASID Sbjct:   12 LEAFPKMAKEKYDRSKPHVNIGTIGHVDHGKTTLTAAITTVLARRLPSSVNQPKDYASID       71

Query:   61 AAPEERERGITINTARVEYETEKRHYAHIDAPGHADYVKNMITGAAQMDGAILVVASTDG      120
            AAPEERERGITINTARVEYET  RHYAHIDAPGHADYVKNMITGAAQMDGAILVVASTDG Sbjct:   72 AAPEERERGITINTABVEYETATRHYAHIDAPGHADYVKNMITGAAQMDGAILVVASTDG      131

Query:  121 PMPQTREHILLSRQVGVKHLIVFMNKVDLVDDEELLELVEMEIRDLLSEYDFPGDDLPVI      180
            PMPQTREHILLSRQVGVKHLIVFMNKVDLVDDEELLELVEMEIRDLLSEYDFPGDDLPVI Sbjct:  132 PMPQTREHILLSRQVGVKHLIVFMNKVDLVDDEELLELVEMEIRDLLSEYDFPGDDLPVI      191

Query:  181 QGSALKALEGDEKYEDIIMELMSTVDEYIPEPERDTDKPLLLPVEDVFSITGRGTVASGR      240
            QGSALKALEGD K+EDIIMELM TVD YIPEPERDTDKPLLLPVEDVFSITGRGTVASGR Sbjct:  192 QGSALKALEGDTKFEDIIMELMDTVDSYIPEPERDTDKPLLLPVEDVFSITGRGTVASGR      251

Query:  241 IDRGTVRVNDEVEIVGIKEDIQKAVVTGVEMFRKQLDEGLAGDNVGVLLRGVQRDEIERG      300
            IDRGTVRVNDE+EIVGIKE+ +KAVVTGVEMFRKQLDEGLAGDNVG+LLRGVQRDEIERG Sbjct:  252 IDRGTVRVNDEIEIVGIKEETKKAVVTGVEMFRKQLDEGLAGDNVGILLRGVQRDEIERG      311

Query:  301 QVLAKPGSINPHTRFKGEVYILSKEEGGRHTPFFNNYRPQFYFRTTDVTGSIELPAGTEM      360
            QV+AKP SINPHT+FKGEVYILSK+EGGRHTPFFNNYRPQFYFRTTDVTGSIELPAGTEM Sbjct:  312 QVIAKPSSINPHTKFKGEVYILSKDEGGRHTPFFNNYRPQFYFRTTDVTGSIELPAGTEM      371

Query:  361 VMPGDNVTIEVELIHPIAVEQGTTFSIREGGRTVGSGIVSEIEA                    404
            VMPGDNVTI VELIHPIAVEQGTTFSIREGGRTVGSGIVSEIEA Sbjct:  372 VMPGDNVTINVELIHPIAVEQGTTFSIREGGRTVGSGIVSEIEA                    415
```

Example 317

A DNA sequence (GBSx0346) was identified in *S. agalactiae* <SEQ ID 1023> which encodes the amino acid sequence <SEQ ID 1024>. Analysis of this protein sequence reveals the following:

```
Possible site: 36
>>> Seems to have a cleavable N-term signal seq.
INTEGRAL      Likelihood = -0.64    Transmembrane 90-106 (90-106)
----- Final Results -----
    bacterial membrane--- Certainty = 0.1256 (Affirmative) <succ>
      bacterial outside --- Certainty = 0.0000 (Not Clear) <succ>
        bacterial cytoplasm --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

Example 318

A DNA sequence (GBSx0347) was identified in *S. agalactiae* <SEQ ID 1025> which encodes the amino acid sequence <SEQ ID 1026>. This protein is predicted to be ftsW. Analysis of this protein sequence reveals the following:

```
Possible site: 38
>>> Seems to have no N-terminal signal sequence
INTEGRAL      Likelihood = -11.15   Transmembrane  44-60   (35-70)
INTEGRAL      Likelihood =  -4.73   Transmembrane  76-92   (74-98)
INTEGRAL      Likelihood =  -3.88   Transmembrane 117-133 (113-134)
----- Final Results -----
    bacterial membrane --- Certainty = 0.5458 (Affirmative) <succ>
      bacterial outside ---Certainty = 0.0000 (Not Clear) <succ>
        bacterial cytoplasm --- Certainty = 0.0000 (Not Clear) <succ>
```

Based on this analysis, it was predicted that this protein and its epitopes, could be useful antigens for vaccines or diagnostics.

The protein has homology with the following sequences in the GENPEPT database:

```
>GP: AAP39929 GB: U58049 putative cell division protein ftsW

[Enterococcus hirae]

Identities = 78/159 (49%), Positives = 107/159 (67%), Gaps = 4/159 (2%)

Query:    1 MANSXYAMSNGGWFGRGLGNSIEKLGYLPEATTDFVFSIVIEELGVIGAGFILALVFFLI         60
            M+NS YA+ NGG FGRG+GNSI K GYLPE+ TDF+FS++ EE G+IGA  +L L+F L
Sbjct:  240 MSNSYYALYNGGLFGRGMGNSITKKGYLPESETDFIFSVIAEEFGLIGALLVLFLLFLLC        299

Query:   61 LRIMHVGIKAKDPFNSMIALGIGAMLLMQVFVNIGGISGLIPSTGVTFPFLSQGGNSLLV        120
             +RI     K K+   ++I +G+G  +L+Q  +NIG I GLIP TGV  PF+S GG S L+
Sbjct:  300 MRIFQKSTKQKNQQANLILIGVGTWILVQTSINIGSILGLIPMTGVPLPFVSYGGTSYLI        359

Query:  121 LSVAIGFVLNIDANEKKELIMKEAEEQYKPQEKNEKIIN                            159
            LS AIG  LNI + +  KE    + ++  + Q K  K++N
Sbjct:  360 LSFAIGLALNISSRQVRE----KNKQVERLQLKKPKLLN                           394
```

A related DNA sequence was identified in *S. pyogenes* <SEQ ID 1027> which encodes the amino acid sequence <SEQ ID 1028>. Analysis of this protein sequence reveals the following:

```
Possible site: 51
>>> Seems to have no N-terminal signal sequence
INTEGRAL    Likelihood = -10.93   Transmembrane 312-328 (303-338)
INTEGRAL    Likelihood = -8.23    Transmembrane  22-38  (17-47)
INTEGRAL    Likelihood = -6.85    Transmembrane 192-208 (187-211)
INTEGRAL    Likelihood = -5.10    Transmembrane 218-234 (212-236)
INTEGRAL    Likelihood = -4.83    Transmembrane  86-102 (85-107)
INTEGRAL    Likelihood = -3.72    Transmembrane 385-401 (383-402)
INTEGRAL    Likelihood = -3.45    Transmembrane  61-77  (61-79)
INTEGRAL    Likelihood = -2.39    Transmembrane 344-360 (344-360)
----- Final Results -----
    bacterial membrane --- Certainty = 0.5373 (Affirmative) <succ>
    bacterial outside  --- Certainty = 0.0000 (Not Clear)  <succ>
    bacterial cytoplasm --- Certainty = 0.0000 (Not Clear) <succ>
```

The protein has homology with the following sequences in the databases:

```
>GP: CAB59721 GB: AJ250603 FtsW protein [Enterococcus faecium]
Identities = 131/397 (32%), Positives = 223/397 (55%), Gaps = 23/397 (5%)
Query:   15 KRHLLNYSILLPYLILSVIGLIMVYSTTSVSLIQAHANPFKSVINQGVFWIISLVAITFI    74
            KR   +++ IL PYL LS+IGL+ VYS +S  L+QA N    ++ Q +F  +S    I Sbjct:    3 KRKKIDWWILGPYLTLSMIGLLEVYSASSYRLLQADENTKSLLLRQLIFIFLSWGVIFLA    62

Query:   75 YKLKLNFLTNTRVLTVVMLGEAFLLIIAR--FFTTAIKGAHGWIVIGPVSFQPAEYLKII   132
            +KL++L + ++       F LI+ R   F   + GA   WI +  + FQP+E   +

Sbjct:   63 RSIKLHYLLHPKIAGYGLALSIFFLILVRVGIFGVTVNGAQRWISLFGIQFQPSELANLF   122

Query:  133 MVWYLALTFAKIQKNISLYDYQALTRRKWWPTQWNOLRDWRVYSLLMVLLVAAQPDLGNA   192
            +++YL+    F                     P +  +L+   + ++ + LL+  QP +  A Sbjct:  123 LIFYLSWFFRDGNN----------------PPK--NLKKPFLITVSITLLILFQPKIAGA   164

Query:  193 SIIVLTAIIMFSISGIGYRWFSAILVMITGLSTVFLGTIAVIGVERVAKIP-VFGYVAKR   251
            +I+   A ++F + + ++       ++V + L    G +   +G +    +P +F + +R Sbjct:  165 LMILSIANVIFWAAAVPFKKGIYLIVTFSALLIGAAGGVLYLGNK--GWLPQMFNHAYER   222

Query:  252 FSAFFNPFHDLTDSGHQLANSYYAMSNGGWFGQGLGNSIEKRGYLPEAQTDFVFSVVIEE   311
            +     +PF D    +G+Q+  +S+YA+ NGG +G+GLGNSI K+GYLPE +TDF+FS++ EE Sbjct:  223 IATLRDPFIDSHGAGYQMTHSFYALYNGGIWGRGLGNSITKKGYLPETETDFIFSIITEE   282

Query:  312 LGLIGAGFILALVFFLILRIMNVGIKAKNPFNAMMALGVGGMMLMQVFVNIGGISGLIPS   371
            LGLIGA  +L L+F L +RI + +   KN    +   LG G ++  +Q    +N+G I+GL+P Sbjct:  283 LGLIGALCVLFLLFSLCMRIFCLSSRCKNQQAGLFLLGFGTLLFVQTIMNVGSIAGLMPM   342

Query:  372 TGVTFPPFLSQGGNSLLVLSVAVGFVLNIDASEKRDDI   408
            TGV  PF+S  GG S  L+LS+ +G   LNI + +  +++

Sbjct:  343 TGVPLPFVSYGGTSYLILSLGIGITLNISSKIQAEEL   379
```

An alignment of the GAS and GBS proteins is shown below:

```
Identities = 130/166 (78%), Positives = 152/166 (91%), Gaps = 2/166 (1%)
Query:    1 MANSXYAMSNGGWFGRGLGNSIEKLGYLPEATTDFVFSIVIEELGVIGAGFILALVFFLI    60
            +ANS YAMSNGGWFG+GLGNSIEK GYLPEA TDFVFS+VIEELG+IGAGFILALVFFLI Sbjct:  269 LANSYYAMSNGGWFGQGLGNSIEKRGYLPEAQTDFVFSVVIEELGLIGAGFILALVFFLI   328

Query:    1 LRIMHVGIKAKDPFNSMIALGIGAMLLMQVFVNIGGISGLIPSTGVTFPPFLSQGGNSLLV   120
            LRIM+VGIKAK+PFN+M+ALG+G M+LMQVFVNIGGISGLIPSTGVTFPPFLSQGGNSLLV Sbjct:  329 LRIMNVGIKAKNPFNAMMALGVGGMMLMQVFVNIGGISGLIPSTGVTFPPFLSQGGNSLLV   388

Query:  121 LSVAIGFVLNIDANEKKELIMKEAEEQYK--PQEKNEKIINLDAFK   164
            LSVA+GFVLNIDA+EK++ I KEAE  Y+    +++N K++N+  F+

Sbjct:  389 LSVAVGFVLNIDASEKRDDIFKEAELSYRKDTRKENSKVVNIKQFQ   434
```

Based on this analysis, it was predicted that these proteins and their epitopes could be useful antigens for vaccines or diagnostics.

Example 319

A DNA sequence (GBSx0348) was identified in *S. agalactiae* <SEQ ID 1029> which encodes the amino acid sequence <SEQ ID 1030>. This protein is predicted to be probable cell division protein ftsw (ftsW). Analysis of this protein sequence reveals the following:

```
Possible site: 34
>>> Seems to have an uncleavable N-term signal seq
INTEGRAL    Likelihood = -9.77   Transmembrane  12-28    (7-37)
INTEGRAL    Likelihood = -7.22   Transmembrane  76-92    (74-97)
INTEGRAL    Likelihood = -6.53   Transmembrane 182-198 (178-201)
INTEGRAL    Likelihood = -4.62   Transmembrane  51-67   (46-69)
INTEGRAL    Likelihood = -2.87   Transmembrane 202-218 (202-218)
----- Final Results -----
    bacterial membrane --- Certainty = 0.4906 (Affirmative) <succ>
    bacterial outside --- Certainty = 0.0000 (Not Clear) <succ>
       bacterial cytoplasm --- Certainty = 0.0000 (Not Clear) <succ>
```

A related GBS nucleic acid sequence <SEQ ID 9327> which encodes amino acid sequence <SEQ ID 9328> was also identified.

The protein has homology with the following sequences in the GENPEPT database:

There is also homology to SEQ ID 1028.

A related GBS gene <SEQ ID 8545> and protein <SEQ ID 8546> were also identified. Analysis of this protein sequence reveals the following:

```
Lipop: Possible site: -1    Crend: 6
McG: Discrim Score: 15.18
GvH: Signal Score (-7.5): -3.58
Possible site: 34
>>> Seems to have an uncleavable N-term signal seq
ALOM program count: 5 value: -9.77 threshold: 0.0
INTEGRAL    Likelihood = -9.77   Transmembrane  12-28    (7-37)
INTEGRAL    Likelihood = -7.22   Transmembrane  76-92    (74-97)
INTEGRAL    Likelihood = -6.69   Transmembrane 210-226 (201-227)
INTEGRAL    Likelihood = -6.53   Transmembrane 182-198 (178-201)
INTEGRAL    Likelihood = -4.62   Transmembrane  51-67   (46-69)
PERIPHERAL  Likelihood = 1.32    116
modified ALOM score: 2.45
*** Reasoning Step: 3
----- Final Results -----
    bacterial membrane --- Certainty = 0.4906 (Affirmative) <succ>
    bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP: CAA44490 GB: X62621 ORF2 N-terminal [Lactococcus lactis]
Identities = 82/199 (41%), Positives = 122/199 (61%), Gaps = 9/199 (4%)
Query:    1 MKIDKRHLLNYSILIPYLILSILGLIVIYSTTSATLIQLGANPFRSVINQGVFWAVSLVA            60
            M ++K + LNYSILIPYLIL+ +G+++I+STT     +Q G NP++ VINQ  F  +S++
Sbjct:    1 MNLNKNNFLNYSILIPYLILAGIGIVMIFSTTVPDQLQKGLNPYKLVINQTAFVLLSIIM            60

Query:   61 IIFIYKLKLNFLKNSKVLTMAVLVEVFLLLIARF------FTQEVNGAHGWIVIGPI-SF         113
              I  IY+LKL  LKN K++ + +++ + L+ R          T  VNGA GWI I  I +
Sbjct:   61 IAVIYRLKLRALKNRKMIGIIMVILILSLIFCRIMPSSFALTAPVNGARGWIHIPGIGTV         120

Query:  114 QPAEYLKVIIVWYLAFTFARRQKKIEIYDYQALTKGRWLPRSLSDLKDWRFYSLFMIGLV         173
              QPAE+ KV I+WYLA  F+ +Q++IE  D   + KG+ L + L     WR    + ++ +
Sbjct:  121 QPAEFAKVFIIWYLASVFSTKQEEIEKNDINEIFKGKTLTQKL--FGGWRLPVVAILLVD         178

Query:  174 IAQPDLGNGSIIVLTVIIM                                              192
              +  PDLGN  II    +IM
Sbjct:  179 LIMPDLGNTMIIGAVALIM                                              197
```

```
ORF02700(301-876 of 1377)
EGAD|8615|8419(1-197 of 198) hypothetical protein in rpmg 3'region, fragment
{Lactococcus lactis} SP|P27174|YRG2_LACLA HYPOTHETICAL PROTEIN IN RPMG 3'REGION (ORF2)
(FRAGMENT). GP|44069|emb|CAA44490.1||X62621 ORF2 N-terminal {Lactococcus lactis}
PIR|PC1134|PC1134 hypothetical protein 198 (rmpG 3' region) - Lactococcus lactis (fragment)
% Match = 15.1
% Identity = 42.3 % Similarity = 64.9
Matches = 82 Mismatches = 64 Conservative Sub.s = 44

87        117       147       177       207       237       267       297
          KA*I*Y*I**L*LVILFLLPFFINFL*IYLTGLND*NVPSNISN*SFIFVISIVGGYXX*LIXXXIMHNGNFLKY*RK*Y 327       357       387       417       447       477       507       537
          NMKIDKRHLLNYSILIPYLILSILGLIVIYSTTSATLIQLGANPFRSVINQGVFWAVSLVAIIFIYKLKLNFLKNSKVLT
          | ::|  ::|||||||||||: :|:::|:|||    :|  | ||:: ||||    |  :|:: |  ||:|||  ||| |::
          MNLNKNNFLNYSILIPYLILAGIGIVMIFSTTVPDQLQKGLNPYKLVINQTAFVLLSIIMIAVIYRLKLRALKNRKMIG
          10        20        30        40        50        60        70
```

```
567       585       609       636       666       696       726       756
MAVLVEVFLLLIARF----FT--QEVNGAHGWIVIGPI-SFQPAEYLKVIIVWYLAFTFARRQKKIEIYDYQALTKGRWL
: ::: ::  |:  |         |         ||||  |||  |   |  :  ||||:  ||  :|:||||    |:  :|::||    |    :  ||: |
IIMVILILSLIFCRIMPSSFALTAPVNGARGWIHIPGIGTVQPAEFAKVFIIWYLASVFSTKQEEIEKNDINEIFKGKTL
         90        100       110       120       130       140       150

786       816       846       876       906       936       966       996
PRSLSDLKDWRFYSLFMIGLVIAQPDLGNGSIIVLTVIIMYCISGIGYRWFSALLGLIVVGSTLFIGTIAVVGVETMAKV
:  |   :  ||:  : ::  : :    |||||   ||      :||
TQKL--FGGWRLPVVAILLVDLIMPDLGNTMIIGAVALIMI
         170       180       190
```

Based on this analysis, it was predicted that these proteins and their epitopes could be useful antigens for vaccines or diagnostics.

Example 320

A DNA sequence (GBSx0349) was identified in *S. agalactiae* <SEQ ID 1031> which encodes the amino acid sequence <SEQ ID 1032>. Analysis of this protein sequence reveals the following:

---

Possible site: 22
>>> Seems to have no N-terminal signal sequence
----- Final Results -----
    bacterial cytoplasm --- Certainty = 0.3665 (Affirmative) <succ>
    bacterial membrane --- Certainty = 0.0000 (Not Clear) <succ>
    bacterial outside --- Certainty = 0.0000 (Not Clear) <succ>

---

The protein has no significant homology with any sequences in the GENPEPT database.

A related DNA sequence was identified in *S. pyogenes* <SEQ ID 1033> which encodes the amino acid sequence <SEQ ID 1034>. Analysis of this protein sequence reveals the following:

---

Possible site: 54
>>> Seems to have no N-terminal signal sequence
----- Final Results -----
    bacterial cytoplasm --- Certainty = 0.2373 (Affirmative) <succ>
    bacterial membrane --- Certainty = 0.0000 (Not Clear) <succ>
    bacterial outside --- Certainty = 0.0000 (Not Clear) <succ>

---

An alignment of the GAS and GBS proteins is shown below:

```
Identities = 35/41 (85%), Positives = 37/41 (89%)

Query: 1 MEKEAKQIIDLKRNLFKIDVRAQKDEEKVFMRTACCYSPFY        41

+EKEAKQ+IDLKRNLFKIDVRAQKDEEKVFMRTAC  S  Y

Sbjct: 1 LEKEAKQMIDLKRNLFKIDVRAQKDEEKVFMRTACRQSRVY        41
```

Based on this analysis, it was predicted that these proteins and their epitopes could be useful antigens for vaccines or diagnostics.

Example 321

A DNA sequence (GBSx0351) was identified in *S. agalactiae* <SEQ ID 1037> which encodes the amino acid sequence <SEQ ID 1038>. Analysis of this protein sequence reveals the following:

---

Possible site: 49
>>> Seems to have no N-terminal signal sequence
INTEGRAL    Likelihood = −1.65    Transmembrane 78-94  (78-95)
INTEGRAL    Likelihood = −1.33    Transmembrane 421-437 (420-437)
----- Final Results -----
    bacterial membrane --- Certainty = 0.1659 (Affirmative) <succ>
    bacterial outside --- Certainty = 0.0000 (Not Clear) <succ>
    bacterial cytoplasm --- Certainty = 0.0000 (Not Clear) <succ>

---

The protein has homology with the following sequences in the GENPEPT database:

```
>GP: CAA00827 GB: A09073 phosphoenol pyruvate carboxylase
[Corynebacterium glutamicum]
Identities = 335/958 (34%), Positives = 539/958 (55%), Gaps = 80/958 (8%)
Query:  22 EIITEEVGLLKQLLDEATQKLIGSESFDKIE--KIVSLSLTD---DYTGLKETISALSNE        76
            + + +++  L Q+L E   + GE ++ +E ++S +        + L+      ++

Sbjct:   3 DFLRDDIRFLGQILGEVIAEQEGQEVYELVEQARLTSFDIAKGNAEMDSLVQVFDGITPA        62

Query:  77 EMVIVSRYFSILPLLINISEDVDLAYEINYKNNLNQDYLGKLST----TIDVV-------       125
            +   ++R FS  LL N++ED+       Y  L+  L    T    T+D Sbjct:  63 KATPIARAFSHFALLANLAEDL-------YDEELREQALDAGDTPPDSTLDATWLKLNEG       115

Query: 126 -AGHENAKDILEHVNVVPVLTAHPTQVQRKTVLELTSKIHDLLRKYRDVKAGIVNQ----       180
             G E  D+L +  V PVLTAHPT+ +R+TV +   I   +R+    +++

Sbjct: 116 NVGAEAVADVLRNAEVAPVLTAHPTETRRRTVFDAQKWITTHMRERHALQSAEPTARTQS       175

Query: 181 --EKWYADLRRYIGIIMQTDTIREKKLKVKNEITNVMEYYNRSLIKAVTKLTAEYKALAA       238
              ++    ++RR I I+ QT  IR +  ++++EI  + YY SL++ + ++   +

Sbjct: 176 KLDEIEKNIRRRITILWQTALIRVARPRIEDEIEVGLRYYKLSLLEEIPRINRDVAVELR       235

Query: 239 KK---GIHLENPKPLTM-GMWIGGDRDGNPFVTAETLRLSAMVQSEVIINHYIEQLNELY       294
            ++   G+ L  KP+   G WIGGD DGNP+VIAET+ S   +E ++ +Y  QL+  L Sbjct: 236 EREGEGVPL---KPVVKPGSWIGGDHDGNPYVTAETVEYSTHRAAETVLKYYARQLHSLE       292

Query: 295 RNMSLSINLTEVSPELVTLANQSQDNSVYRENEPYRKAFNFIQDKLVQTLLNLKVGSSPK       354
            +SLS + +V+P+L+ LA+   ++    R +EPYR+A + +++ T Sbjct: 293 HELSLSDRMNKVTPQLLALADAGHNDVPSRVDEPYRRAVHGVRGRILAT-----------       341

Query: 355 EKEVSRQESSDIVGRYIKSHIAQVASDIQTEELPAYATAEEFKQDLLLVKQSLVQYGQDS       414
                  +++++G              +   +     YA+ EEF  D L + SL +

Sbjct: 342 --------TAELIGE--------DAVEGVWFKVFTPYASPEEFLNDALTIDHSLRESKDVL       386

Query: 415 LVDGELACLIQAVDIFGFYLATIDMRQDSSINEACVAELLKSANIVDDYSSLSEEEKCQL       474
             + D  L+ LI A++ FGF L  +D+RQ+S   E + EL + A + +Y LSE EK ++

Sbjct: 387 IADDRLSVLISAIESFGENLYALDLRQNSESYEDVLTELFERAQVTANYRELSEAEKLEV       446

Query: 475 LLKELTEDPRTLSSTHAPKSELLQKELAIFQTARELKDQLGEDIINQHIISHTESVSDMF       534
            LLKEL      +         SE+ +EL IF+TA E  + G ++  IIS   SV+D+

Sbjct: 447 LLKELRSPRPLIPHGSDEYSEVTDRELGIFRTASEAVKKEGPRMVPHCIISMASSVTDVL       506

Query: 535 ELAIMLKEVGLIDAN----QARIQIVPLFETIEDLDNERDIMTQYLHYELVKKWIATNNN       590
            E  ++LKE GLI AN      +  + +PLFETIEDL   +  I+ +    +L + ++   +N Sbjct: 507 EPMVLLKEFGLIAANGDNPRGTVDVIPLFETIEDLQAGAGILDELWKIDLYRNYLLQRDN       566

Query: 591 YQEIMLGYSDSNKDGGYLSSGWILYKAQNELTKIGEENGIKITFFHGRGGTVGRGGGPSY       650
             QE+MLGYSDSNKDGGY S+ W LY A+ +L ++      G+K+   FHGRGGTVGRGGGPSY Sbjct: 567 VQEVMLGYSDSNKDGGYFSANWALYDAELQLVELCRSAGVKLRLFHGRGGTVGRGGGPSY       626

Query: 651 EAITSQPFGSIKDRIRLTEQGEIIENKYGNQDAAYYNLEMLISASIDRMVTRMITNPNEI       710
            +AI +QP G+++  +R+TEQGEII  KYGN + A  NLE L+SA+++      +  +E+

Sbjct: 627 DAILAQPRGAVQGSVRITEQGEIISAKYGNPETARRNLEALVSAILE----ASLLDVSEL       682

Query: 711 DNFRETMDGIVSESNAV----YRNLVFDNPYFYDFFEASPIKEVSSLNIGSRPAARKTI       766
             + +   D I+SE ++     Y +LV +  F DYF +++P++E+ SLNIGSRP++RK T Sbjct: 683 TDHQRAYD-IMSEISELSLKKYASLVHEDQGFIDYFTQSTPLQEIGSLNIGSRPSSRKQT       741

Query: 767 TEISGLRAIPWVFSWSQNRIMFPGWYGVGSAFKHFI---EQDEANLAKLQTMYQKWPFFN       823
            + +   LRAIPWV SWSQ+R+M PGW+GVG+A +  +I    EQ   +A+LQT+ + WPFF Sbjct: 742 SSVEDLRAIPWVLSWSQSRVMLPGWEGVGIALEQWIGEGEQATQRIAELQTLNESWPFFT       801

Query: 824 SLLSNVDMVLSKSNMNIALQYAQLAGSKEVRD-VFNIILNEWQLTKDMILAIEQHDNLLE       882
             S+L N+ +V+SK+ + A  YA L    EV + V+++I+ E+ LTK M  I   D+LL+
```

-continued

```
Sbjct: 802 SVLDNMAQVMSKAELRLANLYADLIPDTEVAERVYSVIREEYFLIKKMFCVITGSDDLLD      861

Query: 883 ENPMLHASLDYRLPYFNVLNYVQIELIKRLRSNQLDEDYEKLIHITINGIATGLRNSG       940
           +NP+L  S+  R PY   LN +Q+E+++R R        E    + I +T+NG++T LRNSG Sbjct: 862 DNPLLARSVQRRYPYLLPLNVIQVEMMRRYRKGDQSEQVSRNIQLTMNGLSTALRNSG      919
```

A related GBS nucleic acid sequence <SEQ ID 10961> which encodes amino acid sequence <SEQ ID 10962> was also identified.

A related DNA sequence was identified in *S. pyogenes* <SEQ ID 1039> which encodes the amino acid sequence <SEQ ID 1040>. Analysis of this protein sequence reveals the following:

Possible site: 40
>>> Seems to have no N-terminal signal sequence

-continued

----- Final Results -----
bacterial cytoplasm --- Certainty = 0.1613 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below:

```
Identities = 659/927 (71%), Positives = 779/927 (83%), Gaps = 11/927 (1%)
Query:  14 KLESSSNKEIITEEVGLLKQLLDEATQKLIGSESFDKIEKIVSLSLTDDYTGLKETISAL        73
           KLESS+N++II EEV LLK++L+ T+++IG  ++F  IE I+ LS   DY  L++ ++ +

Sbjct:   5 KLESSNNQDIIABEVALLKEMLENITRRMIGDDAFTVIESIMVLSEKQDYIELEKVVANI        64

Query:  74 SNEEMVIVSRYFSILPLLINISEDVDLAYEINYKNNLNQDYLGKLSTTIDVVAGHENAKD       133
           SN+EM ++SRYFSILPLLINISEDVDLAYEINY+NN + DYLGKL+ TI   +AG +N KD Sbjct:  65 SNQEMEVISRYFSILPLLINISEDVDLAYEINYQNNTDIDYLGKLALTIKDLAGKDNGKD       124

Query: 134 ILEHVNVVPVLTARPTQVQRKTVLELTSKIHDLLRKYRDVKAGIVNQEKWYADLRRYIGI       193
           ILE VNVVPVLTAHPTQVQRKT+LELT+ IH LLRKYRD KAG++N EKW  +L RYI +

Sbjct: 125 ILEQVNVVPVLTAHPTQVQRKTILELTTHIHKLLRKYRDAKAGVINLEKWRWRLYRYIEM       184

Query: 194 IMQTDTIREKKLKVKNEITNVMEYYNRSLIKAVTKLTAEYKALAAKKGIHLENPKPLTMG       253
           IMQTD  IREKKL+VKNEI NVM+YY+ SLI+AVTKLT EYK LA K G+ L+NPKP+TMG Sbjct: 185 IMQTDIIREKELQVKNEIKNVMQYYDGSLIQAVTKLTTEYKNLAQKHGLELDNPKPITMG       244

Query: 254 MWIGGDRDGNPFVTAETLRLSAMVQSEVIINHYIEQLNELYRNMSLSINLIEVSPELVYL       313
           MWIGGDRDGNPFVTAETL LSA VQSEVI+N+YI++L  LYR SLS   L + + E+  L Sbjct: 245 MWIGGDRDGNPFVTAETLCLSATVQSEVILNYYIDELAALYRTFSLSSTLVQPNSEVERL       304

Query: 314 ANQSQDNSVYRENEPYRKAFNFIQDKLVQTLLNLKVGSSPKEKFVSRQESSDIVGRYIKS       373
           A+ SQD S+YR NEPYR+AF++IQ +L QT + L      +   + SS +          S Sbjct: 305 ASLSQDQSIYRGNEPYRRAFHYIQSRLKQTQIQLT------NQPAASMSSSVGLNTSAWS       358

Query: 374 HIAQVASDIQTEELPAYATAEEFKQDLLLVKQSLVQYGQDSLVDGELACLIQAVDIFGFY       433
              A + + I       AY +  +FK DL  ++QSL++   G    +L++G+L  ++QAVDIFGF+

Sbjct: 359 SPASLENPIL------AYDSPVDFKADLKAIEQSLLDNGNSALIEGDLREVMQAVDIFGFF       413

Query: 434 LATIDMRQDSSINEACVAELLKSANIVDDYSSLSEEEKCQLLLKELTEDPRILSSTHAPK       493
           LA+IDMRQDSS+ EACVAELLK ANIVDDYSSLSE EKC +LL++L E+PRTLSS      K Sbjct: 414 LASIDMRQDSSVQEACVAELLKGANIVDDYSSLSETEKCDVLLQQLMEEPRTLSSAAVAK       473

Query: 494 SELLQKELAIFQTARELKDQLGEDIINQHIISHTESVSDMFELAIMLKEVGLIDANQARI       553
           S+LL+KELAI+ TARELKD+LGE++I QHIISHTESVSDMFELAIMLKEVGL+D  +AR+

Sbjct: 474 SDLLEKELAIYTTARELKDKLGEEVIKQHIISHTESVSDMFELAIMLKEVGLVDQQRARV       533

Query: 554 QIVPLFETIEDLDNSRDIMTQYLHYELVKKWIATNNNYQEIMLGYSDSNKDGGYLSSGWT       613
           QIVPLFETIEDLDN+RDIM   YL +++VK WIATN NYQEIMLGYSDSNKDGGYL+SGWT Sbjct: 534 QIVPLFETIEDLDNARDIMAAYLSHDIVKSWIATNRNYQEIMLGYSDSNKDGGYLASGWT       593

Query: 614 LYKAQNELTKIGEENGIKITFFHGRGGTVGRGGGPSYEAITSQPFGSIKDRIRLTEQGEI       673
           LYKAQNELT IGEE+G+ KITFFHGRGGTVGRGGGPSY+AITSQPFGSIKDRIRLTEQGEI
```

-continued

```
Sbjct:  594  LYKAQNELTAIGEEHGVKITFFHGRGGTVGRGGGPSYDAITSQPFGSIKDRIRLTEQGEI    653

Query:  674  IENKYGNQDAAYYNLEMLISASIDRMVTRMITNPNEIDNFRETMDGIVSESNAVYRNLVF    733
             IENKYGN+D AYY+LEMLISASI+RMVT+MIT+PNEID+FRE MD IV++SN +YR LVF
Sbjct:  654  IENKYGNKDVAYYHLEMLISASINRMVTQMITDPNEIDSFREIMDSIVADSNIIYRKLVF    713

Query:  734  DNPYFYDYFFEASPIKEVSSLNIGSRPAARKTITEISGLRAIPWVFSWSQNRIMFPGWYG    793
             DNP+FYDYFFEASPIKEVSSLNIGSRPAARKTITEI+GLRAIPWVFSWSQNRIMFPGWYG
Sbjct:  714  DNPHFYDYFFEASPIKEVSSLNIGSRPAARKTITEITGLRAIPWVFSWSQNRIMFPGWYG    773

Query:  794  VGSAFKHFIEQDEANLAKLQTMYQKWPFFNSLLSNVDMVLSKSNMNIALQYAQLAGSKEV    853
             VGSAFK +I++ + NL +LQ MYQ WPFF+SLLSNVDMVLSKSNMNIA QYAQLA ++V
Sbjct:  774  VGSAFKRYIDRAQGNLERLQHMYQTWPFFHSLLSNVDMVLSKSNMNIAFQYAQLAERQDV    833

Query:  854  RDVFNIILNEWQLTKDMILAIEQHDNLLEENPMLHASLDYRLPYFNVLNYVQIELIKRLR    913
             RDVF   IL+EWQLTK++ILAI+ HD+LLE+NP L  SL  RLPYFNVLNY+QIELIKR R
Sbjct:  834  RDVFYEILDEWQLTKNVILAIQDHDDLLEDNPSLKHSLKSRLPYFNVLNYIQIELIKRWR    893

Query:  914  SNQLDEDYEKLIHITINGIANGLRNSG                                    940
             +NQLDE+ EKLIH TINGIATGLRNSG
Sbjct:  894  NNQLDENDEKLIHTTINGIATGLRNSG                                    920
```

Based on this analysis, it was predicted that these proteins and their epitopes could be useful antigens for vaccines or diagnostics.

Example 322

A DNA sequence (GBSx0352) was identified in *S. agalactiae* <SEQ ID 1041> which encodes the amino acid sequence <SEQ ID 1042>. This protein is predicted to be *Bacillus licheniformis* Pz-peptidase homologue (pepF). Analysis of this protein sequence reveals the following:

Possible site: 61
>>> Seems to have no N-terminal signal sequence
----- Final Results -----
    bacterial cytoplasm --- Certainty = 0.3012 (Affirmative) <succ>
    bacterial membrane --- Certainty = 0.0000 (Not Clear) <succ>
    bacterial outside --- Certainty = 0.0000 (Not Clear) <succ>

A related DNA sequence was identified in *S. pyogenes* <SEQ ID 1043> which encodes the amino acid sequence <SEQ ID 1044>. Analysis of this protein sequence reveals the following:

Possible site: 55
>>> Seems to have no N-terminal signal sequence
----- Final Results -----
    bacterial cytoplasm --- Certainty = 0.3137 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below:

```
Identities = 512/593 (86%), Positives = 564/593 (94%)
Query:    1  MKLKKRSEFPENELWDLTALYKDRQDFLLAIEKALEDIKVFKKNYEGKLNCVEDFTSALM     60
             M+LKKRSEFPENELWDLTALYKDRQDFLLAIEKAL+DI +FK+NYEG+L   V+DFT AL+
Sbjct:   26  MELKKRSEFPENELWDLTALYKDRQDFLLAIEKALQDIDLFKRNYEGRLTSVDDFTQALI     85

Query:   61  EIEHIYIQMSHIDTYAFMPQTTDFSNEEFAQISQAGSDFATKANVLLSFFNTALANADIK    120
             EIEHIYIQMSHI TYAFMPQTTDFS+E FAQI+QAG DF TKA+V LSFF+TALANAD+
Sbjct:   86  EIEHIYIQMSHIGTYAFMPQTTDFSDESFAQIAQAGDDFMTKASVALSFFDTALANADLD    145

Query:  121  ILDSLENNPHFKATIRQAKIQKQHLLSPEVEKALTNLNEVLNTPYDIYTKMRAGDFDMED    180
              +LD+LE NP+F A IR AKIQK+HLLSP+VEKAL NL EV+N PYDIYTKMRAGDFDM+D
Sbjct:  146  VLDTLEKNPYFSAAIRMAKIQKEHLLSPDVEKALANLREVINAPYDIYTKMRAGDFDMDD    205

Query:  181  FEVDGKTYKNSFVTYENYFQNHENAEIREKSFRSFSKGLRKHQNAAAAAYLARVKSEKLI    240
             FEVDGKTYKNSFV+YEN++QNHENAEIREK+FRSFSKGLRKHQN AAAAYLAKVKSEKL+
Sbjct:  206  FEVDGKTYKNSFVSYENFYQNHENAEIREKAFRSFSKGLRKHQNTAAAAYLAKVKSEKLL    265

Query:  241  ADMRGYDSVFDYLLSEQEVDRSMFDRQIDLIMDEFGPVAQRFLKHIADVNGIEKMTFADW    300
             ADM+GY SVFDYLL+EQEVDRS+FDRQIDLIM EFGPVAQ+FLKH+A VNG+EKMTFADW
Sbjct:  266  ADMKGYASVFDYLLAEQEVDRSLFDRQIDLIMTEFGPVAQKFLKHVAQVNGLEKMTFADW    325
```

```
-continued

Query: 301 KLDIDNELNPEVSINDAYDLVMKSVAPLGKEYSQEVERYQKERWVDFAANANKDSGGYAA      360
            KLDIDN+LNPEVSI+ AYDLVMKS+APLG+EY++E+ERYQ ERWVDFAANANKDSGGYAA Sbjct: 326 KLDIDNDLNPEVSIDGAYDLVMKSLAPLGQEYTKEIERYQTERWVDFAANANKDSGGYAA      385

Query: 361 DPYKVHPYVLMSWTGRMSDVYTLIHEIGHSGQFIFSDNHQSFFNTHMSTYYVEAPSTFNE      420
            DPYKVHPYVLMSWTGRMSDVYTLIHEIGHSGQFIFSDNHQS+FNTHMSTYYVEAPSTFNE Sbjct: 386 DPYKVHPYVLMSWTGRMSDVYTLIHEIGHSGQFIFSDNHQSYFNTHMSTYYVEAPSTFNE      445

Query: 421 LLLSDYLENQFDTARQKRFALAHRLTDTYFHNFITHLLEAAFQRKVYTLIEEGGTFGAEQ      480
            L+LSDYLE+QFD  RQKRFALAHRLTDTYFHNFITHLLEAAFQRKVYTLIEEGGTFGA+Q Sbjct: 446 LMLSDYLEHQFDDPRQKRFALAHRLTDTYFHNFITHLLEAAFQRKVYTLIEEGGTFGADQ      505

Query: 481 LNAIMKEVLTQFWGDAIEIDDDAALTWMRQAHYYMGLYSYTYSAGLVISTAGYLNLKNNP      540
            LNA+MKEVLT FWGDA++IDDDAALTWMRQAHYYMGLYSYTYSAGLVISTAGYLNLK+NP Sbjct: 506 LNAMMKEVLTDFWGDAVDIDDDAALTWMRQAHYYMGLYSYTYSAGLVISTAGYLNLKHNP      565

Query: 541 NGAKEWLAFLKSGGSRTPLETALLISADISTDKPLRDTINFLSNTVDQIINYS          593
            NGAKEWL FLKSGGSRTPL+TA+LI ADI+T+KPLRDTI FLS+TVDQII+Y+

Sbjct: 566 NGAKEWLDFLKSGGSRTPLDTAMLIGADIATEKPLRDTIQFLSDTVDQIISYT          618
```

Based on this analysis, it was predicted that these proteins and their epitopes could be useful antigens for vaccines or diagnostics.

Example 323

A DNA sequence (GBSx0353) was identified in *S. agalactiae* <SEQ ID 1045> which encodes the amino acid sequence <SEQ ID 1046>. Analysis of this protein sequence reveals the following:

Possible site: 19
>>> May be a lipoprotein
----- Final Results -----
bacterial membrane --- Certainty = 0.0000 (Not Clear) <succ>
bacterial outside --- Certainty = 0.0000 (Not Clear) <succ>
bacterial cytoplasm --- Certainty = 0.0000 (Not Clear) <succ>

The protein has no significant homology with any sequences in the GENPEPT database.

A related DNA sequence was identified in *S. pyogenes* <SEQ ID 1047> which encodes the amino acid sequence <SEQ ID 1048>. Analysis of this protein sequence reveals the following:

Possible site: 19
>>> May be a lipoprotein
----- Final Results -----
bacterial membrane --- Certainty = 0.0000 (Not Clear) <succ>
bacterial outside --- Certainty = 0.0000 (Not Clear) <succ>
bacterial cytoplasm --- Certainty = 0.0000 (Not Clear) <succ>

The protein has no significant homology with any sequences in the GENPEPT database.

An alignment of the GAS and GBS proteins is shown below:

```
Identities = 72/127 (56%), Positives = 85/127 (66%)

Query:    1 MKKYIKLFLLTVFATTLVACGQPSTSNKTTTSSTLEVGKVELVVKEDTNVLSEKVVYHKG    60
            + K   K   L + A LVAC Q +   +TT S       V LVVKEDTN + EKV + KG
Sbjct:    1 VNKRFKTGFLALVAMLLVACSQGTKQIQTTPSVPKADHHVRLVVKEDTNTVDEKVSFGKG    60

Query:   61 DTVLDVLKANYKVKEKDGFITSIDGISQDETKGLYWMFKVNNKLAPKAANQIKVKKNDKI   120
            DTVL+VLK NY+VKEKDGFIT+IDGI QD      YW+FKVN K+A K A+QI VK  D I
Sbjct:   61 DTVLEVLKDNYEVNEKDGFITAIDGIEQDTKANKYWLFKVNGKMADKGADQITVKDGDSI   120

Query:  121 EFYQEVY                                                       127
            EFYQEV+
Sbjct:  121 EFYQEVF                                                       127
```

SEQ ID 1046 (GBS185) was expressed in *E. coli* as a His-fusion product. SDS-PAGE analysis of total cell extract is shown in FIG. 28 (lane 6; MW 15.7 kDa).

Figure 199:
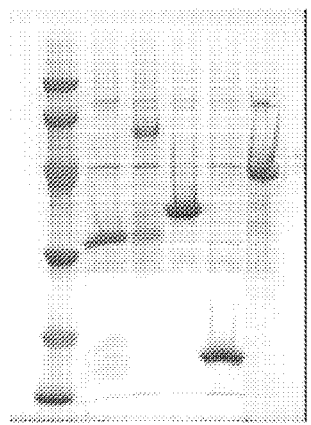

GBS185-His was purified as shown in FIG. 199, lane 8.

Based on this analysis, it was predicted that these proteins and their epitopes could be useful antigens for vaccines or diagnostics.

Example 324

A DNA sequence (GBSx0354) was identified in *S. agalactiae* <SEQ ID 1049> which encodes the amino acid sequence <SEQ ID 1050>. Analysis of this protein sequence reveals the following:

Possible site: 28
>>> Seems to have a cleavable N-term signal seq.

-continued

| | | | |
|---|---|---|---|
| INTEGRAL | Likelihood = −4.46 | Transmembrane 75-91 | (67-94) |
| INTEGRAL | Likelihood = −4.41 | Transmembrane 33-49 | (30-49) |
| INTEGRAL | Likelihood = −2.60 | Transmembrane 53-69 | (52-70) |
| INTEGRAL | Likelihood = −1.38 | Transmembrane 108-124 | (106-124) |
| INTEGRAL | Likelihood = −0.06 | Transmembrane 149-165 | (149-165) |

----- Final Results -----
   bacterial membrane --- Certainty = 0.2784 (Affirmative) <succ>
     bacterial outside --- Certainty = 0.0000 (Not Clear) <succ>
       bacterial cytoplasm --- Certainty = 0.0000 (Not Clear) <succ>

A related GBS nucleic acid sequence <SEQ ID 9731> which encodes amino acid sequence <SEQ ID 9732> was also identified. A further related GBS nucleic acid sequence <SEQ ID 10929> which encodes amino acid sequence <SEQ ID 10930> was also identified.

The protein has no significant homology with any sequences in the GENPEPT database.

A related DNA sequence was identified in *S. pyogenes* <SEQ ID 1051> which encodes the amino acid sequence <SEQ ID 1052>. Analysis of this protein sequence reveals the following:

Possible site: 48
>>> Seems to have a cleavable N-term signal seq.

| | | | |
|---|---|---|---|
| INTEGRAL | Likelihood = −7.96 | Transmembrane 50-66 | (49-71) |
| INTEGRAL | Likelihood = −5.73 | Transmembrane 101-117 | (99-124) |
| INTEGRAL | Likelihood = −4.41 | Transmembrane 141-157 | (139-159) |
| INTEGRAL | Likelihood = −4.25 | Transmembrane 73-89 | (67-92) |

----- Final Results -----
   bacterial membrane --- Certainty = 0.4185 (Affirmative) <succ>
     bacterial outside --- Certainty = 0.0000 (Not Clear) <succ>
       bacterial cytoplasm --- Certainty = 0.0000 (Not Clear) <succ>

The protein has no significant homology with any sequences in the GENPEPT database.

An alignment of the GAS and GBS proteins is shown below:

```
Identities = 82/163 (50%), Positives = 120/163 (73%), Gaps = 3/163 (1%)

Query:    10 LTRVAILSALCVVLRYAFAPLPNIQPITAIFLITVVLFDLKEGVATVTITMLVSSFLMGF  69
             ++R+AI+SALCVVLR  F+ LPN+QP+TA   L  ++ F L E V  + + +  +S+FL+GF
Sbjct:     6 MSRIAIMSALCVVLRMVFSSLPNVQPVTAFLLSYLLYFGLAEAVLVMMLCLFLSAFLLGF  65

Query:    70 GPWVFLQIISFTLILCLWKFLIYPLTKAVCFGKITEVVLQTFFAGGLGVVYGVIIDTCFA 129
             GPWVF Q+   F L+L LW+F++YPL++    F  K  ++    Q F    G++YGV+IDTCFA
Sbjct:    66 GPWVFWQVTCFVLVLLLWRFVLYPLSQQ--FPKY-QLGCQAFLVALCGLLYGVLIDTCFA 122

Query:   130 WLYHMPWWTYVLAGLSFNMAHALSTCLFYPLLLPILRRFRNEK                 172
             +LY MPWW+YVLAG+ FN+AHALST +F+P+++ + RR    E+
Sbjct:   123 YLYSMPWWSYVLAGMPFNIABALSTLVFFPVVMMLFRRLIGEQ                 165
```

A related GBS gene <SEQ ID 8549> and protein <SEQ ID 8550> were also identified. Analysis of this protein sequence reveals the following:

Lipop: Possible site: −1   Crend: 10
McG: Discrim Score: 6.79
GvH: Signal Score (−7.5): −0.91
Possible site: 28
>>> Seems to have a cleavable N-term signal seq.
ALOM program count: 3 value: −4.46 threshold: 0.0

| | | | |
|---|---|---|---|
| INTEGRAL | Likelihood = −4.46 | Transmembrane 35-51 | (29-54) |
| INTEGRAL | Likelihood = −1.38 | Transmembrane 68-84 | (66-84) |
| INTEGRAL | Likelihood = −0.06 | Transmembrane 109-125 | (109-125) |
| PERIPHERAL | Likelihood = 7.53 | 88 | | modified ALOM score: 1.39
*** Reasoning Step: 3

----- Final Results -----
   bacterial membrane --- Certainty = 0.2784 (Affirmative) <succ>
     bacterial outside --- Certainty = 0.0000 (Not Clear) <succ>
       bacterial cytoplasm --- Certainty = 0.0000 (Not Clear) <succ>

The protein has homology with the following sequences in the databases:

ORF01220(421-552 of 1002)
GP|9950155|gb|AAG07353.1|AE004814_8|AE004814(16-56 of 69) hypothetical protein {*Pseudomonas aeruginosa*}
% Match = 3.2
% Identity = 39.5 % Similarity = 60.5
Matches = 17 Mismatches = 15 Conservative Sub.s = 9

```
222       252       282       312       342       372       402       432
STLTKLTRVAILSALCVVLRYAFAPLPNIQPITAIFLITVVLFDLKEGVATVTITMLVSSFLMGFGPWVFLQIISFTLIL
                                                                         |:::
                                                                      MDPELFEEWMMTGLVTVLI
                                                                            10

462       492       522       552       582       612       642       672
CLWKFLIYPLTKAVCFGKITEVVLQTFFAGGLGVVYGVIIDTCFAWLYHMPWWTYVLAGLSFNMAHALSTCLFYPLLLPI
: |:::  | |     ||     :|     ||| ||||  | ||
LFMAFIVWDLAKKSKAGKFGTLIL--FFALGLGV-LGFIIKGLVIGSLEGAGM
       30        40        50        60
```

Based on this analysis, it was predicted that these proteins and their epitopes could be useful antigens for vaccines or diagnostics.

Example 325

A DNA sequence (GBSx0355) was identified in *S. agalactiae* <SEQ ID 1053> which encodes the amino acid sequence <SEQ ID 1054>. This protein is predicted to be endolysin. Analysis of this protein sequence reveals the following:

Possible site: 28
>>> Seems to have a cleavable N-term signal seq.
----- Final Results -----
  bacterial outside --- Certainty = 0.3000 (Affirmative) <succ>
  bacterial membrane --- Certainty = 0.0000 (Not Clear) <succ>
  bacterial cytoplasm --- Certainty = 0.0000 (Not Clear) <succ>

<SEQ ID 1056>. Analysis of this protein sequence reveals the following:

Possible site: 31
>>> Seems to have an uncleavable N-term signal seq
INTEGRAL    Likelihood = -16.98    Transmembrane 8-24 (3-28)
----- Final Results -----
  bacterial membrane --- Certainty = 0.7793 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database:

```
>GP: CAA72266 GB: Y11477 endolysin [Bacteriophage Bastille]
Identities = 64/210 (30%), Positives = 95/210 (44%), Gaps = 15/210 (7%)

Query:    66 KPIIDVSGWQLPKEIDYDTLSKNISGVVIRVFGGSKISKTNNAAYTTGIDKSFKTHIKEF 125
             K I+D+S    +ID+DT   +S + R   G + +  +N      +D+ +KT +
Sbjct:    12 KTIVDISHHNA--DIDFDTAKNYVSMFIARTGDGHRYN--SNGELQGVVDRKYKTFVANM  67

Query:   126 QKRNIPVAVYSYALGSSVEEMKEEAQIFYKNAAPYKPTFYWIDVEEETMSNMNKGVQAFR 185
             + R IP   Y +    S V   K+EA+ F+ N      T + D E T  NM + +Q F
Sbjct:    68 KARGIPFGNYMPURFSGVABAKQEAEFFW-NYGDKDATVWVCDAEVSTAPNMKECIQVFI 126

Query:   186 KELKRLGAKNVGIYIGTYFMTEQGISVKGFDAVWIPTYGSDSGYYEAAPQTELKYDLHQY 245
              LK  LGAK VG+YIG +   E G     D   WIP YG+   +           DL Q+
Sbjct:   127 DRLKELGAKKVGLYIGHHKYQEFGGKDVNCDFTWIPRYGNKPAF---------ACDLWQW 177

Query:   246 TSQGYLPGFNQPLDLNQIAVNKDKKKTYEK                               275
             T  G + G  + D+N +  +K        EK
Sbjct:   178 TEYGNIAGIGK-CDINVLYGDKPMSFFTEK                               206
```

A related DNA sequence was identified in *S. pyogenes* <SEQ ID 1055> which encodes the amino acid sequence An alignment of the GAS and GBS proteins is shown below:

```
Identities = 198/278 (71%), Positives = 235/278 (84%)

Query:     1 MRRRIKPIVVAVFFSLFGLLLIIGHLHSTNTLKKELVEAKKTIPSVKASKVPQKSTSSKD  60
             MRR+IKPIVV VFF L  ++LIIG   + +   +KE+ +AK  IP   ++      K+++S+
Sbjct:     1 MRRKIKPIVVLVFFILLAMVLIIGKRQANHAKQKEVEDAKSHIPIATSNPGKAKTSTSET  60

Query:    61 KEFVLKPIIDVSGWQLPKEIDYDTLSKNISGVVIRVFGGSKISKTNNAAYTTGIDKSFKT 120
             ++F+L  PI+DVSGWQLP+EIDYDTLS++ISG ++RV+GGS+I+   NNAA+TTGIDKSFKT
Sbjct:    61 EDFILNPIVDVSGWQLPEEIDYDTLSRHISGAIVRVYGGSQITAHNNAAFTTGIDKSFKT 120

Query:   121 HIKEFQKRNIPVAVYSYALGSSVKEMKEEAQIFYKNAAPYKPTFYWIDVEEETMSNMNKG 180
             HIKEFQKRN+PVAVYSYALG S KEMKEEA+ FYKNAAPY PT+YWIDVEE TM +MNKG
```

-continued
```
Sbjct:  121 HIKEFQKRNVPVAVYSYALGRSTKEMKEEARAFYKNAAPYMPTYYWIDVEEATMKDMNKG 180

Query:  181 VQAFRKELKRLGAENVGIYIGTYFMTEQGISVKGFDAVWIPTYGSDSGYYEAAPQTELKY 240
            V AFR+ELK+LGA+NVG+YIGTYFM EQ IS KGFD+VWIPTYGSDSGYYEAAP T L Y
Sbjct:  181 VTAFREELKKLGAENVGLYIGTYFMAEQDISTKGFDSVWIPTYGSDSGYYEAAPNTTLDY 240

Query:  241 DLHQYTSQGYLPGFNQPLDLNQIAVNKDKKKTYEKLFG                       278
            DLHQYTSQGLY GFN  LDLNQIAV KD KKT+EKLFG
Sbjct:  241 DLHQYTSQGYLSGFNNALDLNQIAVTKDTKKTFEKLFG                       278
```

A related GBS gene <SEQ ID 8551> and protein <SEQ ID 8552> were also identified. Analysis of this protein sequence reveals the following:

---

Lipop Possible site: −1    Crend: 5
McG: Discrim Score: 13.20
GvH: Signal Score (−7.5): −0.72
Possible site: 28
>>> Seems to have a cleavable N-term signal seq.
ALOM program count: 0 value: 7.05 threshold: 0.0
PERIPHERAL    Likelihood = 7.05      196
modified ALOM score: −1.91
\*\*\* Reasoning Step: 3
----- Final Results -----
    bacterial outside --- Certainty = 0.3000 (Affirmative) <succ>
        bacterial membrane --- Certainty = 0.0000 (Not Clear) <succ>
        bacterial cytoplasm --- Certainty = 0.0000 (Not Clear) <succ>

---

The protein has homology with the following sequences in the databases:

Based on this analysis, it was predicted that these proteins and their epitopes could be useful antigens for vaccines or diagnostics.

Example 326

A DNA sequence (GBSx0356) was identified in *S. agalactiae* <SEQ ID 1057> which encodes the amino acid sequence <SEQ ID 1058>. Analysis of this protein sequence reveals the following:

---

Possible site: 41
>>> Seems to have no N-terminal signal sequence
INTEGRAL    Likelihood = −1.44    Transmembrane 183-199 (183-200)
----- Final Results -----
    bacterial membrane --- Certainty = 0.1574 (Affirmative) <succ>
        bacterial outside --- Certainty = 0.0000 (Not Clear) <succ>
        bacterial cytoplasm --- Certainty = 0.0000 (Not Clear) <succ>

---

```
32.4/47.3% over 194aa
Bacteriophage Bastille
GP|1865711| endolysin Insert characterized
ORF01218(496-1125 of 1446)
GP|1865711|emb|CAA72266.1||Y11477(12-206 of 364) endolysin (Bacteriophage Bastille)
% Match = 7.9
% Identity = 32.3 % Similarity = 47.3
Matches = 65 Mismatches = 100 Conservative Sub.s = 30

315       345       375       405       435       465       495       525
         VTISIMRRRIKPIVVAVFFSLFGLLLIIGHLHSTNTLKKELVEAKKTIPSVKASKVPQKSTSSKDKEFVLKPIIDVSGWQ
                                                                :|       | |:|:|   :
                                                                MALEANKYPKEKTIVDIS--H
                                                                         10

555       585       615       645       675       705       735       765
         LPKEIDYDTLSKNISGVVIRVFGGSKISKTNNAAYTTGIDKSFKTHIKEFQKRNIPVAVYSYALGSSVKEMKEEAQIFYK
            :||:||  :||    :  |      :|       :|: :||  :   : ||  |:   |   |:||: |:
         HNADIDFDT-AKNYVSMFIARTGDGHRYNSN-GELQGVVDRKYKTFVANMKARGIPFGNYMFNRFSGVASAKQEAEFFW-
                 30        40        50        60        70        80        90

795       825       855       885       915       945       975       1005
         NAAPYKPTFYWIDVEEETMSNMNKGVQAFRKELKRLGAKNVGIYIGTYFMTEQGISVKGFDAVWIPTYGSDSGYYEAAPQ
         |   |:   |   |  :||    ||  |||  ||:|||  ||  |   |   | |||| ||                :
         NYGDKDATVWVCDAEVSTAPNMKECIQVFIDRLKELGAKKVGLYIGHHKYQEFGGKDVNCDFTWIPRYG---------NK
                 110       120       130       140       150       160

1035      1065      1095      1125      1155      1185      1215      1245
         TELKYDLHQYTSQGYLPGYNQPLDLNQIAVNKDKKKTYEKLFGKVKE*KLLLTVAFLINYLLFNSSIERIFWVGFFLSVV
          :  ||  |:|  |: |  :  |:|  :|       || |   ||            :   |:   :    :  : :
         PAFACDLWQWTEYGNIAGIGK-CDINVLYGDKPMSFFTEKEGAKETLVPALNKVVTYEVGTNLIPEIQDKLAFLGYEARI
                 180       190       200       210       220       230       240
```

SEQ ID 8552 (GBS206) was expressed in *E. coli* as a His-fusion product. SDS-PAGE analysis of total cell extract is shown in FIG. 51 (lane 6; MW 31.7 kDa).

GBS206-His was purified as shown in FIG. 206, lane 6.

A related GBS nucleic acid sequence <SEQ ID 9729> which encodes amino acid sequence <SEQ ID 9730> was also identified.

The protein has homology with the following sequences in the GENPEPT database:

```
>GP: AAG20117 GB: AE005090 NADH dehydrogenase/oxidoreductase-like
protein; NolA [Halobacterium sp. NRC-1]
Identities = 38/156 (24%), Positives = 83/156 (52%), Gaps = 13/156 (8%)

Query:   19 TMEILIAGGSGFLGKQIIKAALTKGHKVAYLSRHEGKGDIFKDPRLTYIRGDITEADKIH   78
             +M++L+ GG+GF+G + +    +GH V  +R     + D +T I GD+T  + +
Sbjct:    8 SMDVLVTGGTGFIGTHLCRELDDRGHDVTAFAREPADAALPAD--VTRIVGDVTVKETVA  65

Query:   79 LEDRTFDILIDCIGA---IKPNQLD----ELNVKATQKAVALCHKNQIPKLVYISA----  127
             D +++ +     KP+ D     ++++ T+ VA  +  + ++ +SA
Sbjct:   66 NAIDGHDAVVNLVALSPLFKPSGGDSRHLDVHLGGTENVVAAASEAGVEYILOLSALDAD  125

Query:  128 NSGYSAYIKSKRKAEQIIKASGLDYLFVRPGLMYGE                          163
             +G +AY+++K +AE+ +++S L +  VRP +++G+
Sbjct:  126 PTGPTAYLRAKGRAEEAVRSSDLHHTIVRPSVVFGD                          161
```

No corresponding DNA sequence was identified in *S. pyogenes*.

A related GBS gene <SEQ ID 8553> and protein <SEQ ID 8554> were also identified. Analysis of this protein sequence reveals the following:

Lipop Possible site: −1    Crend: 5
McG: Discrim Score: −7.99
GvH: Signal Score (−7.5): −6.34
Possible site: 41
>>> Seems to have no N-terminal signal sequence
ALOM program count: 1 value: −1.44  threshold: 0.0

-continued

INTEGRAL     Likelihood = −1.44   Transmembrane 183-199 (183-200)
PERIPHERAL   Likelihood = 4.29    20
modified ALOM score: 0.79
*** Reasoning Step: 3
----- Final Results -----
    bacterial membrane --- Certainty = 0.1574 (Affirmative) <succ>
    bacterial outside --- Certainty = 0.0000 (Not Clear) <succ>
    bacterial cytoplasm --- Certainty = 0.0000 (Not Clear) <succ>
RGD motif 68-70

The protein has homology with the following sequences in the databases:

```
32.5/54.4% over 274aa
Schizosaccharomyces pombe
GP|3395590|hypothetical protein Insert characterized
PIR|T41177|T41177 hypothetical protein SPCC1840.09-fission yeast Insert
characterized
ORF01216 (358-990 of 1272)
GP|3395590|emb|CAA20132.1||AL031179 (1-275 of 276) hypothetical protein
{Schizosaccharomyces pombe} PIR|T41177|T41177 hypothetical protein SPCC1840.09-
fission yeast (Schizosaccharomyces pombe)
% Match = 7.3
% Identity = 32.4 % Similarity = 54.3
Matches = 71 Mismatches = 88 Conservative Sub.s = 48
         144       174       204       234       264       294       324       354
         *L**ISTDS*K*A*IPFQGIMIINIATVLEGMLN*KFYK*LNMKCPDVMT*NHTVVRY*TITLTRHIKISINLQNEGEG 384       414       444       474       504       534       564
         TMEILIAGGSGFLGKQIIKAALTKGHKVAYLSRHEGKGDIFKDPRLTYIRGDITEADKIHLEDRTFDILIDCIGAI----
         |:|:: ||||||  | |  |:  |::  :||   |   |:|   |:    :|     :  :|   :
         MKIVVLGGSGFLGHNICKLAIAKGYEVVSVSRRGAGGKHNKEPWMDDVEWETLDAQK--DPNSLLPVLRDASAVVNSVG
              10        20        30        40        50        60        70

585       615                 648       678
         --------------------------------------KPNQLDELNVKATQKAV---------ALCHKNQIPKLVYIS
                                               || :  :   | | |:|:             :  :|    |:|
         ILMENNYKKILQNPRGPVSHLINSLSSNMFKTGQNPLAPKPEEAKQSKNKVTFEAINRDLAIETAKIAAKANVPVYCYVS
                     90        100       110       120       130       140       150

699       726       753       783       810       840       846       876
         ANS---GYSA-YIKSKRKAE-QIIKASGLDYLFVRPGLMYG-EERPLSIFQAKCIKLFSHL--------PFLGIVVQKVF
         |::    |   |||:||::| | |   |::|||:|  ::|: :||::     : |  |           |||  :  :
         AHAAAPGLDPRYIKTKREAEREISKISNLRSIFLRPGFMYNFNDRPFTGALASLFTVSSSINRATSGALNFLGTASAEPL
              170       180       190       200       210       220       230

930       960       990       1020      1050      1080      1110
         PTK-VVIVA-EAIVTTLRKKPTQKILSIEELNNK*FIKKATVNSSFYSFTFPKSFS*VFFLSLLTAI*FKSSG*LXPGR*
         |::  | |||   ||   :: :| | |:   :      :|  | |:|
         PSEEVALAALEAISDPSVKGPVE-ISELKSMAHK-FKQKSL
              250       260       270
```

Figure 55:
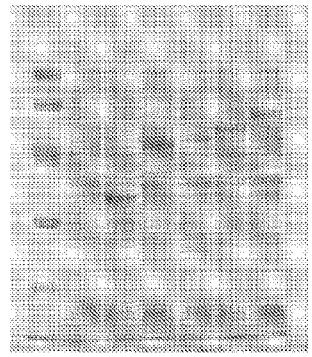

SEQ ID 8554 (GBS303) was expressed in *E. coli* as a His-fusion product. SDS-PAGE analysis of total cell extract is shown in FIG. 51 (lane 5; MW 28.3 kDa). It was also expressed in *E. coli* as a GST-fusion product. SDS-PAGE analysis of total cell extract is shown in FIG. 55 (lane 5; MW 53.2 kDa).

Figure 275:
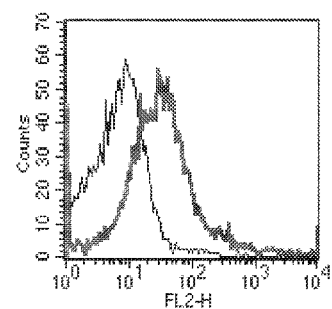

The GBS303-GST fusion product was purified (FIG. 207, lane 6) and used to immunise mice. The resulting antiserum was used for FACS (FIG. 275), which confirmed that the protein is immunoaccessible on GBS bacteria.

Based on this analysis, it was predicted that these proteins and their epitopes could be useful antigens for vaccines or diagnostics.

Possible site: 30
>>> Seems to have no N-terminal signal sequence
----- Final Results -----
   bacterial cytoplasm --- Certainty = 0.2651 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below:

```
Identities = 114/157 (72%), Positives = 139/157 (87%)

Query:     1 MSKKNKIKKTLVDQILDKAKIEHDSLQLDALQGDLPNGIQKQDIFKTLALIGDKTGPIIG 60
             M+KK K+KKTLV+QILDKA I H  L+L+AL+GD P+ +Q  DI+KTLAL GD+TGP+IG
Sbjct:     1 MAKKTKLKKTLVEQILDKANIAHQGLKLNALEGDFPDDLQPSDIYKTLALTGDQTGPLIG 60

Query:    61 ILPLTEHLSEKKLAKISGNKKVQMIPQKDLQKITGYIHGANNPIGIRQKHNYPIFIDTIA 120
             I+PLTEHLSEK+LAK+SGNKKV M+PQKDLQK TGYIHGANNP+GIRQKH+YPIFID  A
Sbjct:    61 IIPLTEHLSEKQLAKVSGNKKVSMVPQKDLQKTIGYIHGANNPVGIRQKHSYPIFIDQTA 120

Query:   121 LEKQELIVSAGEIGRSIRINSEVLADFVNAKFADIKE                       157
             LEK ++IVSAGE+GRSI+I+S+ LADFV A FAD+K+
Sbjct:   121 LEKGQIIVSAGEVGRSIKISSQALADFVGASFADLKK                       157
```

Example 327

A DNA sequence (GBSx0357) was identified in *S. agalactiae* <SEQ ID 1059> which encodes the amino acid sequence <SEQ ID 1060>. Analysis of this protein sequence reveals the following:

Possible site: 49
>>> Seems to have no N-terminal signal sequence
----- Final Results -----
   bacterial cytoplasm --- Certainty = 0.2850 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database:

```
>GP: AAC36853 GB: L23802 regulatory protein [Enterococcus faecalis]
Identities = 61/164 (37%), Positives = 96/164 (58%), Gaps = 13/164 (7%)

Query:     1 MSKKNKIKKTLVDQILDKAKIEH---------DSLQLDALQGDLPNGIQKQDIFKTLALI 51
             M+KK   +KT  +++++ K+ +          D L  +++   + GI+K  IFKTL  +
Sbjct:     1 MAKKKTQQKTNAMRMVEQHKVPYKEYEFAWSEDHLSAESVAESL--GIEKGRIFKTLVTV 58

Query:    52 GDKTGPIIGILPLTEHLSEKKLAKISGNKKVQMIPQKDLQKITGYIHGANNPIGIRQKHN 111
             G+KTGP++  ++P  + L  KKLAK SGNKKV+M+  KDL+  TGYI G  +P G+    K
Sbjct:    59 GNKTGPVVAVIPGNQELDLKKLAKASGNKKVEMLHLKDLEATTGYIRGGCSPTGM--KKQ 116

Query:   112 YPIFIDTIALEKQELIVSAGEIGRSIRINSEVLADFVNAKFADI                155
             +P ++  A +    +IVSAG+ G  I +  E +      N +FA+I
Sbjct:   117 FPTYLAEEAQQYSAIIVSAGKRGMQIELAPEAILSLTNGQFAEI                160
```

A related DNA sequence was identified in *S. pyogenes* <SEQ ID 1061> which encodes the amino acid sequence <SEQ ID 1062>. Analysis of this protein sequence reveals the following:

Based on this analysis, it was predicted that these proteins and their epitopes could be useful antigens for vaccines or diagnostics.

Example 328

A DNA sequence (GBSx0358) was identified in *S. agalactiae* <SEQ ID 1063> which encodes the amino acid sequence <SEQ ID 1064>. Analysis of this protein sequence reveals the following:

Possible site: 28
>>> Seems to have no N-terminal signal sequence
----- Final Results -----
   bacterial cytoplasm --- Certainty = 0.4719 (Affirmative) <succ>

-continued bacterial membrane --- Certainty = 0.0000 (Not Clear) <succ>
   bacterial outside --- Certainty = 0.0000 (Not Clear) <succ>

Figure 169:
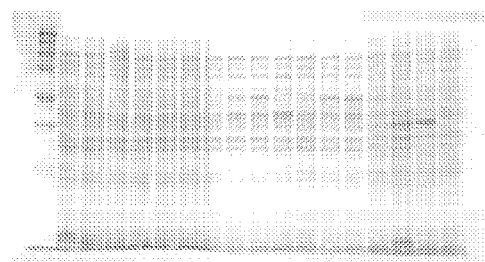
Figure 239:
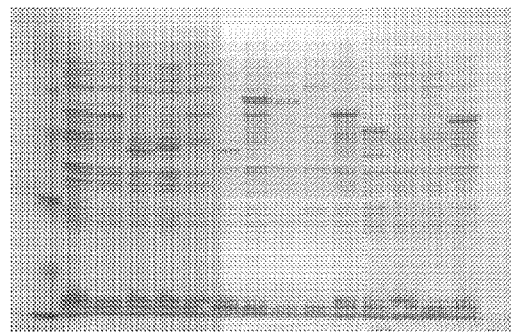

A related GBS nucleic acid sequence <SEQ ID 8555> which encodes amino acid sequence <SEQ ID 8556> was also identified. This protein belongs to the glycolysis/gluconeogenesis pathway, and such proteins have been experimentally detected as surface-exposed in Streptococci. The protein has homology with the following sequences in the GENPEPT database:

SEQ ID 8556 (GBS314) was expressed in *E. coli* as a His-fusion product. SDS-PAGE analysis of total cell extract is shown in FIG. 51 (lane 4; MW 27.2 kDa), in FIG. 169 (lane 15-17; MW 41.6 kDa) and in FIG. 239 (lane 4; MW 41.61 kDa). It was also expressed in *E. coli* as a GST-fusion product. SDS-PAGE analysis of total cell extract is shown in FIG. 55 (lane 4; MW 52.1 kDa).

```
>GP: AAD36444 GB: AE001791 phosphoglycerate mutase [Thermotoga maritime]
Identities = 65/191 (34%), Positives = 93/191 (48%), Gaps = 13/191 (6%)

Query:     5 MKFYLVRHGKTQWNLEGRFQGANGDSPLLEEAIEELEELGQYLSSIHFDAVYSSDLGRAR   64
             MK YL+RHG+T WN +G +QG   D PL E    E+  +L   L  +  DA+YSS L R+
Sbjct:     1 MKLYLIRHGETIWNEKGLWQGVT-DVPLNERGREQARKLANSLKRV--DAIYSSPLKRSL  57

Query:    65 DTVNILNDANSCPKEIHYTPQLREWALGTLEGCKIATMQAIYPRQMTAFYQNPLQFKHDM 124
             +T   +  A    KEI      LRE +     G +        YP +   +   +P        M
Sbjct:    58 ETAEEI--ARRFEKEIIVEEDLRECEISLWNGLTVEEAIREYPVEFKKWSSDP---NFGM 112

Query:   125 FGAESLYQTTHRVESFLRSLASK----NYDKVLIVGHGANLTASIRSLLGYQYGSLHYKD 180
                G ES+    +RV    +  + S+       + V+IV H   +L A I   +LG       LH
Sbjct:   113 EGLESMRNVQNRVNKAIMKIVSQEKLNGSENVVIVSHSLSLRAFICWILGLPL-YLHRNF 171

Query:   181 KLDNASLTIIE                                                 191
             KLDNASL+++E
Sbjct:   172 KLDNASLSVVE                                                 182
```

A related DNA sequence was identified in *S. pyogenes* <SEQ ID 1065> which encodes the amino acid sequence <SEQ ID 1066>. Analysis of this protein sequence reveals the following:

---
Possible site: 24
>>> Seems to have no N-terminal signal sequence
----- Final Results -----
  bacterial cytoplasm --- Certainty = 0.3628 (Affirmative) <succ>
    bacterial membrane --- Certainty = 0.0000 (Not Clear) <succ>
      bacterial outside --- Certainty = 0.0000 (Not Clear) <succ>
---

An alignment of the GAS and GBS proteins is shown below:

Based on this analysis, it was predicted that these proteins and their epitopes could be useful antigens for vaccines or diagnostics.

Example 329

A DNA sequence (GBSx0359) was identified in *S. agalactiae* <SEQ ID 1067> which encodes the amino acid sequence <SEQ ID 1068>. Analysis of this protein sequence reveals the following:

---
Possible site: 56
>>> Seems to have no N-terminal signal sequence
----- Final Results -----
  bacterial cytoplasm --- Certainty = 0.3014 (Affirmative) <succ>
    bacterial membrane --- Certainty = 0.0000 (Not Clear) <succ>
      bacterial outside --- Certainty = 0.0000 (Not Clear) <succ>
---

The protein has homology with the following sequences in the GENPEPT database:

```
Identities = 127/205 (61%), Positives = 152/205 (73%)

Query:     5 MKFYLVRHGKTQWNLEGRFQGANGDSPLLEEAIEELEELGQYLSSIHFDAVYSSDLGRAR   64
             MK Y VRHGKT WNLEGRFQGA GDSPLLEEA +E+   LG+ +L + FDAVY+SDL RA
Sbjct:     1 MKLYFVRHGKTLWNLEGRFQGAGGDSPLLEEAKDEIHLLGKELAKVAFDAVYTSDLQRAM  60

Query:    65 DTVNILNDANSCPKEIHYTPQLREWALGTLEGCKIATMQAIYPRQMTAFYQNPLQFKHDM 124
              T  I+ DA      ++++T QLREW LG LEG KIATM QIYP+QM AF +N  QFK D
Sbjct:    61 ATAAIILDAFDQQPKLYHTDQLREWRLGKLEGAKIATMAAIYPQQMLAFRENLAQFKPDQ 120

Query:   125 FGAESLYQTTHRVESFLRSLASKNYDKVLIVGHGANLTASIRSLLGYQYGSLHYKDKLDN 184
             F AES+YQTT RV    ++S    K+Y VLIVGHGANLTA+IRSLLG++    L  K LDN
Sbjct:   121 FEAESIYQTTQRVCHLIQSFKDKHYQNVLIVGHGANLTATIRSLLGFEPALLLAKGGLDN 180

Query:   185 ASLTIIETHDFKDFNCLTWNDKSYL                                   209
             ASLTI+ET D+   ++CL WNDKS+L
Sbjct:   181 ASLTILETKDYLTYDCLIWNDKSFL                                   205
```

>GP: CAB12562 GB: Z99108 similar to hypothetical proteins [Bacillus subtilis]
Identities = 69/232 (29%), Positives = 108/232 (45%), Gaps = 9/232 (3%)

```
Query:     4 SIVFDVDDTIYDQQAPYRIAVEKCFPDFDMSAINQAYIRFRHYSDIGFPRVMAGEWTTEY    63
             +++FDVDDTI D QA   +A+    F D ++   N    +++  +    G+ T +
Sbjct:     6 TLLFDVDDTILDFQAAEALALRLLFEDQNIPLTNDMKAQYKTINQGLWRAFEEGKMTRDE    65

Query:    64 FRFWRCKETLLEFGYREIDEATGIYFQEIYEHELENITMLDEMRMTLDFLKSKNVPMGII   123
                R    L E+GY      EA G   ++ Y  LE    L+      +   + I+
Sbjct:    66 VVNTRFSALLKEYGY----EADGALLEQKYRRFLEEGHQLIDGAFDLISNLQQQFDLYIV   121

Query:   124 TNGPTEHQLKKVKKLGLYDYVDPKRVIVSQATGFQKPEKEIFNLAAEQF-DMNPSTTLYV   182
             TNG +  Q K+++  GL+ +    K + VS+ TGFQKP KE FN    E+     TL +
Sbjct:   122 TNGVSHTQYKRLRDSGLFPFF--KDIFVSEDTGFQKPMKEYFNYVFERIPQFSAEHTLII   179

Query:   183 GDSYDNDIMGAFNGGWHSMWFNHRGRSLKPGIKPVYDVAIDNFEQLFGAVKV          234
             GDS   DI G   G +W N    +   P I P  Y+  I    E+L+  + +
Sbjct:   180 GDSLTADIKGGQLAGLDTCWMNPDMKPNVPEIIPTYE--IRKLEELYHILNI          229
```

A related DNA sequence was identified in *S. pyogenes* <SEQ ID 1069> which encodes the amino acid sequence <SEQ ID 1070>. Analysis of this protein sequence reveals the following:

Possible site: 56
>>> Seems to have no N-terminal signal sequence
----- Final Results -----
   bacterial cytoplasm --- Certainty = 0.3216 (Affirmative) <succ>
     bacterial membrane --- Certainty = 0.0000 (Not Clear) <succ>
       bacterial outside --- Certainty = 0.0000 (Not Clear) <succ>

Possible site: 34
>>> Seems to have no N-terminal signal sequence
----- Final Results -----
   bacterial cytoplasm --- Certainty = 0.2451 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below:

```
Identities = 276/300 (92%), Positives = 292/300 (97%)

Query:     1 MITSIVFDVDDTIYDQQAPYRIAVEKCFPDFDMSAINQAYIRFRHYSDIGFPRVMAGEWT    60
             MIT+IVFDVDDTIYDQQAPYRIA+EKCFPDFDMS +NQAYIRFRHYSD+GFPRVMAGEWT
Sbjct:     1 MITAIVFDVDDTIYDQQAPYRIAMEKCFPDFDMSVMNQAYIRFRHYSDVGFPRVMAGEWT    60

Query:    61 TEYFRFWRCKETLLEFGYREIDEATGIYFQEIYEHELENITMLDEMRMTLDFLKSKNVPM   120
             TEYFRFWRCKETLLEFGYREIDEA G++FQE+YEHLELNITMLDEMRMTLDFLKSKNVPM
Sbjct:    61 TEYFRFWRCKETLLEFGYREIDEAAGVHFQEVYEHELENITMLDEMRMTLDFLKSKNVPM   120

Query:   121 GIITNGPTEHQLKKVKKLGLYDYVDPKRVIVSQATGFQKPEKEIFNLAAEQFDMNPSTTL   180
             GIITNGPTEHQLKKV+KLGLYDY+D KRVIVSQATGFQKPEKEIFNLAAEQFDMNP TTL
Sbjct:   121 GIITNGPTEHQLKKVRKLGLYDYIDAKRVIVSQATGFQKPEKEIFNLAAEQFDMNPQTTL   180

Query:   181 YVGDSYDNDIMGAFNGGWHSMWFNHRGRSLKPGIKPVYDVAIDNFEQLFGAVKVLFDLPD   240
             YVGDSYDNDIMGAFNGGWHSMWFNHRGR LKPG KPVYDVAIDNFEQLFGAVKVLFDLPD
Sbjct:   181 YVGDSYDNDIMGAFNGGWHSMWFNHRGRQLKPGTKPVYDVAIDNFEQLFGAVKVLFDLPD   240

Query:   241 NKFIFDINDKSNPVLEMGLNNGLMMAAERLLESNMSVDKVVILLRLTAKQEKVLRMKYAR   300
             NKFIFD+NDK NP+L+MG+NNGLMMAAERLLESNMS+DKVVILLRLT +QEKVLR+KYAR
Sbjct:   241 NKFIFDVNDKKNPILQMGINNGLMMAAERLLESNMSIDKVVILLRLTKQQEKVLRLKYAR   300
```

Based on this analysis, it was predicted that these proteins and their epitopes could be useful antigens for vaccines or diagnostics.

Example 330

A DNA sequence (GBSx0360) was identified in *S. agalactiae* <SEQ ID 1071> which encodes the amino acid sequence <SEQ ID 1072>. Analysis of this protein sequence reveals the following:

A related GBS nucleic acid sequence <SEQ ID 9727> which encodes amino acid sequence <SEQ ID 9728> was also identified.

The protein has homology with the following sequences in the GENPEPT database:

>GP: CAB11858 GB: Z99104 lysyl-tRNA synthetase [Bacillus subtilis]
Identities = 318/490 (64%), Positives = 390/490 (78%), Gaps = 1/490 (0%)

```
Query:    44 EELNDQQIVRREKMAALTEQGIDPFGKRFERTATSGQLNEKYADKSKEDLHDIEETATIA 103
             EELNDQ  VRR+KM  L + GIDPFG RFERT  S ++    Y D +KE+L +     TIA
Sbjct:     9 EELNDQLQVRRDKMNQLRDNGIDPFGARFERTHQSQEVISAYQDLTKEELEEKAIEVTIA  68

Query:   104 GRLMTKRGKGKVGFAHIQDREGQIQIYVRKDSVGEENYEIFKKADLGDFLGVEGQVMRTD 163
             GR+MTKRGKGK GFAH+QD EGQIQIYVRKDSVG++ YEIFK +DLGD +GV G+V +T+
Sbjct:    69 GRMMTKRGKGKAGFAHLQDLEGQIQIYVRKDSVGDDQYEIFKSSDLGDLIGVTGKVFKTN 128

Query:   164 MGELSIKATHITHLSKALRPLPEKFHGLTDIETIYRKRHLDLISNRDSFDRFVTRSKIIS 223
             +GELS+KAT    L+KALRPLP+K+HGL D+E  YR+R+LDLI N DS   F+TRSKII
Sbjct:   129 VGELSVKATSFELLTKALRPLPDKYHGLKDVEQRYRQRYLDLIVNPDSKHTFITRSKIIQ 188

Query:   224 EIRREMDSNGFLEVETPVLHNEAGGASARPFITHHNAQDIDMVLRIATELHLERLIVGGM 283
             +RR++D +G+LEVETP +H+  GGASARPFITHHNA DI + +RIA ELHLKRLIVGG+
Sbjct:   189 AMRRYLDDHGYLEVETPTMHSIPGGASARPFITHHNALDIPLYMRIAIELHLKRLIVGGL 248

Query:   284 ERVYEIGRIFRNEGMDATHNPEFTSIEAYQAYADYQDIMDLTEGIIQHVTKTVKGDGPIN 343
             E+VYEIGR+FRNEG+    HNPEFT IE Y+AYADY+DIM LTE ++ H+ + V G    I
Sbjct:   249 EKVYEIGRVERNEGVSTRHNPEFTMIELYEAYADYKDIMSLTENLVAHIAQEVLGTTTIQ 308

Query:   344 YQGTEIKINEPFKRVHMVDAVKEITGIDFWKEMTLEEAQALAQEKNVPLEKHFTTVGHII 403
             Y     +I  +    +KR+HMVDAVKE  TG+DFW+E+T+E+A+    A+E   V  + K     TVGHII
Sbjct:   309 YGEEQIDLKPEWKRIHMVDAVKEATGVDFWEEVTVEQAREYAKEHEVEI-KDSMTVGHII 367

Query:   404 NAFFEEFVEDTLIQPTFVFGHPVEVSPLAKENDTDPRFTDRFELFIMTKEYANAFTELND 463
             N FFE+ +E+TLIQPTF++GHPVE+SPLAKKN  DPRFTDRFELFI+ +E+ANAFTELND
Sbjct:   368 NEFFEQKIEETLIQPTFIYGHPVEISPLAKKNPEDPRFTDRFELFIVGREHANAFTELND 427

Query:   464 PIDQLSRFEAQASAKELGDDEATGVDYDYVEALEYGMPPTGGLGIGIDRLCMLLTDTTTI 523
             PIDQ  RFEAQ   +E G+DEA  +D D+VEALEYGMPPTGGLGIGIDRL MLLT+   +I
Sbjct:   428 PIDQRERFEAQLKEREAGNDEAHLMDEDFVEALEYGMPPTGGLGIGIDRLVMLLTNAPSI 487

Query:   524 RDVLLFPTMK                                                  533
             RDVLLFP M+
Sbjct:   488 RDVLLFPQMR                                                  497
```

A related DNA sequence was identified in *S. pyogenes* <SEQ ID 1073> which encodes the amino acid sequence <SEQ ID 1074>. Analysis of this protein sequence reveals the following:

Possible site: 45

>>> Seems to have no N-terminal signal sequence

----- Final Results ----- bacterial cytoplasm --- Certainty = 0.4694 (Affirmative) <succ> bacterial membrane --- Certainty = 0.0000 (Not Clear) <succ> bacterial outside --- Certainty = 0.0000 (Not Clear) <succ>

An alignment of the GAS and GBS proteins is shown below:

```
Identities = 439/500 (87%), Positives = 474/500 (94%)

Query:    34 LEEIMSNQHIEELNDQQIVRREKMAALTEQGIDPFGKRFERTATSGQLNEKYADKSKEDL  93
             LEE MSNQHIEELNDQQIVRREKM AL EQGIDPFGKRF+RTA S +L EKYADK+KE+L
Sbjct:     1 LEENMSNQHIEELNDQQIVRREKMTALAEQGIDPFGKRFDRTANSAELKEKYADKTKEEL  60

Query:    94 HDIEETATIAGRLMTKRGKGKVGFAHIQDREGQIQIYVRKDSVGEENYEIFKKADLGDFL 153
             H++ ETA +AGRLMTKRGKGKVGFAH+QDREGQIQ+YVRKDSVGE+NYEIFKKADLGDF+
Sbjct:    61 HELNETAIVAGRLMTKRGKGKVGFAHLQDREGQIQLYVRKDSVGEDNYEIFKKADLGDFI 120

Query:   154 GVEGQVMRTDMGELSIKATHITHLSKALRPLPEKFHGLTDIETIYRKRHLDLLSNRDSFD 213
             GVEG+VMRTDMGELSIKAT +THLSK+LRPLPEKFHGLTDIETIYRKRHLDLISNR+SFD
Sbjct:   121 GVEGEVMRTDMGELSIKATKLTHLSKSLRPLPEKFHGLTDIETIYRKRHLDLISNRESFD 180

Query:   214 RFVTRSKIISEIRRFMDSNGFLEVETPVLHNEAGGASARPFITHHNAQDIDMVLRIATEL 273
             RFVTRSK+ISEIRR++D     FLEVETPVLHNEAGGA+ARPF+THHNAQ+IDMVLRIATEL
Sbjct:   181 RFVTRSKMISEIRRYLDGLDFLEVETPVLHNEAGGAAARPFVTHHNAQNIDMVLRIATEL 240

Query:   274 HLKRLIVGGMERVYEIGRIFRNEGMDATHNPEFTSIEAYQAYADYQDIMDLTEGIIQHVT 333
             HLKRLIVGGMERVYEIGRIFRNEGMDATHNPEFTSIE YQAYADY DIM+LTEGIIQH
Sbjct:   241 HLKRLIVGGMERVYEIGRIFRNEGMDATHNPEFTSIEVYQAYADYLDIMNLTEGIIQHAA 300

Query:   334 KTVKGDGPINYQGTEIKINEPFKRVHMVDAVKEITGIDFWKEMTLEEAQALAQEKNVPLE 393
             K V+GDGPI+YQGTEI+INEPFKRVHMVDA+KE+TG DFW EMT+EEA ALA+EK VPLE
Sbjct:   301 KAVRGDGPIDYQGTEIRINEPFKRVHMVDAIKEVTGADFWPEMTVEEAIALAKEKQVPLE 360
```

```
Query:    394  KHFITVGHIINAFFEEFVEDTLIQPTFVFGHPVEVSPLAKKNDTDPRFTDRFELFIMTKE  453
               KHF +VGHIINAFFEEFVE+TL+QPTFVFGHPVEVSPLAKKN D RFTDRFELFIMTKE
Sbjct:    361  KHFISVGHIINAFFEEFVEETLVQPTFVFGHPVEVSPLAKKNPEDTRFTDRFELFIMTKE  420

Query:    454  YANAFTELNDPIDQLSRFEAQASAKELGDDEATGVDYDYVEALEYGMPPTGGLGIGIDRL  513
               YANAFTELNDPIDQLSRFEAQA AKELGDDEATG+DYD+VEALEYGMPPTGGLGIGIDRL
Sbjct:    421  YANAFTELNDPIDQLSRFEAQAQAKELGDDEATGIDYDFVEALEYGMPPTGGLGIGIDRL  480

Query:    514  CMLLTDTTTIRDVLLFPTMK                                         533
               CMLLT+TTTIRDVLLFPTMK
Sbjct:    481  CMLLTNTTTIRDVLLFPTMK                                         500
```

Based on this analysis, it was predicted that these proteins and their epitopes could be useful antigens for vaccines or diagnostics.

Example 331

A DNA sequence (GBSx0361) was identified in *S. agalactiae* <SEQ ID 1075> which encodes the amino acid sequence <SEQ ID 1076>. This protein is predicted to be 6,7-dimethyl-8-ribityllumazine synthase (ribH). Analysis of this protein sequence reveals the following:

```
Possible site: 34
>>> Seems to have no N-terminal signal sequence
----- Final Results -----
   bacterial cytoplasm --- Certainty = 0.1042 (Affirmative) <succ>
   bacterial membrane --- Certainty = 0.0000 (Not Clear) <succ>
   bacterial outside --- Certainty = 0.0000 (Not Clear) <succ>
```

The protein has homology with the following sequences in the GENPEPT database:

```
>GP: CAB14257 GB: Z99116 riboflavin synthase (beta subunit) [Bacillus subtilis]
Identities = 103/151 (68%), Positives = 120/151 (79%)

Query:      1  MTIIEGQLVANEMKIGIVVSRFNELITSKLLSGAVDGLLRHGVSEEDIDIVWVPGAFEIP   60
               M II+G LV +KIGIVV FRN+ ITSKLLSGA D LLRHGV  DID+ WVPGAFEIP
Sbjct:      1  MNIIQGNLVGTGLKIGIVVGRFNDFITSKLLSGAEDALLRHGVDTNDIDVAWVPGAFEIP   60

Query:     61  YMARKMALYKDYDAIICLGVVIKGSTDHYDYVCNEVTKGIGHLNSQSDIPHIFGVLTTDN  120
               + A+KMA  K YDAII LG VI+G+T HYDYVCNE  KGI    + + +P IFG++TT+N
Sbjct:     61  FAAERMAETKKYDAIITLGTVIRGATTHYDYVCNEAAKGIAQAANTTGVPVIFGIVTTEN  120

Query:    121  IEQAIERAGTKAGNKGYDCALSAIEMVNLDK                              151
               IEQAIERAGTKAGNKG DCA+SAIEM NL++
Sbjct:    121  IEQAIERAGTKAGNKGVDCAVSAIEMANLNR                              151
```

No corresponding DNA sequence was identified in *S. pyogenes*.

Based on this analysis, it was predicted that this protein and its epitopes, could be useful antigens for vaccines or diagnostics.

Example 332

A DNA sequence (GBSx0362) was identified in *S. agalactiae* <SEQ ID 1077> which encodes the amino acid sequence <SEQ ID 1078>. This protein is predicted to be GTP cyclohydrolase ii (ribA/B). Analysis of this protein sequence reveals the following:

```
Possible site: 20
>>> Seems to have no N-terminal signal sequence
----- Final Results -----
   bacterial cytoplasm --- Certainty = 0.1918 (Affirmative) <succ>
   bacterial membrane --- Certainty = 0.0000 (Not Clear) <succ>
   bacterial outside --- Certainty = 0.0000 (Not Clear) <succ>
```

A related GBS nucleic acid sequence <SEQ ID 9725> which encodes amino acid sequence <SEQ ID 9726> was also identified.

The protein has homology with the following sequences in the GENPEPT database:

```
>GP: AAA86524 GB: U27202 GTP cyclohydrase II/
3,4-dihydroxy-2-butanone-4-phosphate synthase
[Actinobacillus pleuropneumoniae]
Identities = 230/395 (58%), Positives = 307/395 (77%)

Query:     19  FSPIKKLLQDIKSGKMVVLMDDENRENEGDLICAAEMVTKESINFMAKFGKGLICLPLSN   78
               FS ++  ++ I+ GK++++ DDE+RENEGD ICAAE  T E+INFMA +GKGLIC P+S
Sbjct:      6  FSKVEDAIEAIRQGKIILVTDDEDRENEGDFICAAEFATPENINFMATYGKGLICTPIST   65

Query:     79  YYAEKLELAQMASHNTDNHETAFTISIDHLSTSTGISAEDRALTAKMVANDSSKAKDFRR  138
                       A+KL   M + N DNHETAFT+S+DH+ T TGISA +R++TA  + +D++KA DFRR
Sbjct:     66  EIAKKLNFHPMVAVNQDNHETAFTVSVDHIDTGTGISAFERSITAMKIVDDNAKATDFRR  125

Query:    139  PGHLFPLLAKEGGVLARNGHTEATVDLCRLAGLKECGLCCEIMAEDGSMMRKDELLAFAQ  198
               PGH+FPL+AKEGGVL RNGHTEATVDL RLAGLK  GLCCEIMA+DG+MM  +L  FA
```

```
-continued
Sbjct:  126 PGHMFPLIAREGGVLVRNGHTEATVDLARLAGLKHAGLCCEIMADDGTMMTMPDLQKFAV 185

Query:  199 KHDLAIATIKQLQDYRRQEEGGVVREIEIQLPTQFGHFTAYGYSEVVANKEHVALVKGDI 258
            +H++    TI+QLQ+YRR+ +  V +   +++PT++G F A+ + EV++ KEHVALVKGD+
Sbjct:  186 EHNMPFITIQQLQEYRRKHDSLVKQISVVKMPTKYGEFMAHSFVEVISGKEHVALVKGDL 245

Query:  259 SSGEDVLCRLHSECLTGDVFHSLRCDCGEQLANALQQIEAEGRGVLLYMRQEGRGIGLIN 318
            +  GE VL R+HSECLTGD F S RCDCG+Q A A+ QIE EGRGV+LY+RQEGRGIGLIN
Sbjct:  246 TDGEQVLARIHSECLTGDAFGSQRCDCGQQFAAAMTQIEQEGRGVILYLRQEGRGIGLIN 305

Query:  319 KLKAYHLQEEGLDTLEANLALGFEGDERDYGVSAQLLKDLGINSINLLTNNPDKIQQLEA 378
            KL+AY LQ++G+DT+EAN+ALGF+ DER+Y + AQ+ + LG+ SI LLTNNP KI+ L+
Sbjct:  306 KLRAYELQDKGMDTVEANVALGFKEDEREYYIGAQMFQQLGVKSIRLLTNNPAKIEGLKE 365

Query:  379 EGICVKNRVPLQVAVTAYDLNYLKTKKEKMGHLLD                         413
            +G+ +  R P+ V      D++YLK K+ KMGH+ +
Sbjct:  366 QGLNIVAREPIIVEPNKNDIDYLKVKQIKMGHMFN                         400
```

No corresponding DNA sequence was identified in *S. pyogenes*.

Based on this analysis, it was predicted that these proteins and their epitopes could be useful antigens for vaccines or diagnostics.

No corresponding DNA sequence was identified in *S. pyogenes*.

Based on this analysis, it was predicted that these proteins and their epitopes could be useful antigens for vaccines or diagnostics.

Example 333

A DNA sequence (GBSx0363) was identified in *S. agalactiae* <SEQ ID 1079> which encodes the amino acid sequence <SEQ ID 1080>. This protein is predicted to be riboflavin synthase alpha chain (ribE). Analysis of this protein sequence reveals the following:

Possible site: 59
>>> Seems to have no N-terminal signal sequence
----- Final Results -----
    bacterial cytoplasm --- Certainty = 0.3517 (Affirmative) <succ>
      bacterial membrane --- Certainty = 0.0000 (Not Clear) <succ>
        bacterial outside --- Certainty = 0.0000 (Not Clear) <succ>

A related GBS nucleic acid sequence <SEQ ID 9723> which encodes amino acid sequence <SEQ ID 9724> was also identified.

The protein has homology with the following sequences in the GENPEPT database:

Example 334

A DNA sequence (GBSx0364) was identified in *S. agalactiae* <SEQ ID 1081> which encodes the amino acid sequence <SEQ ID 1082>. This protein is predicted to be riboflavin-specific deaminase (ribD). Analysis of this protein sequence reveals the following:

Possible site: 30
>>> Seems to have no N-terminal signal sequence
INTEGRAL    Likelihood = −1.01    Transmembrane 307-323 (307-323)
----- Final Results -----
    bacterial membrane --- Certainty = 0.1404 (Affirmative) <succ>
      bacterial outside --- Certainty = 0.0000 (Not Clear) <succ>
        bacterial cytoplasm --- Certainty = 0.0000 (Not Clear) <succ>

The protein has homology with the following sequences in the GENPEPT database:

```
>GP: BAB05274 GB: AP001512 riboflavin synthase alpha subunit [Bacillus halodurans]
Identities = 98/216 (45%), Positives = 147/216 (67%), Gaps = 2/216 (0%)
Query:    1 MFTGIIEEMGQVSRIRNGIKSQQLSIDAPKLVPLLRKGDSVAVNGVCLTVLDKSETAFIA  60
            MFTGIIE++G + I+   ++ ++I + K+V  ++ GDS+AVNGVCLTV    ++T F
Sbjct:    1 MFTGIIEDVGTIDAIQQTGEAIVMTITSKKIVSDVQLGDSIAVNGVCLTVTSFTDTQFTV  60

Query:   61 DVMPESMMRTSLAALRLHSKVNLELALRSDSRLGGHFVLGHVDGVGKIEKIQKDDIAVRF 120
            D+MPE++   TSL  L     S+VNLE A+ ++  R GGH V GHVDG+G I K ++ D AV +
Sbjct:   61 DLMPETVRATSLRLLSKGSRVNLERAMVANGRFGGHIVSGHVDGIGTIRKKERKDNAVYY 120

Query:  121 SIDAPPSIMSYIIEKGSVALDGISLTVVSFTEHSFEVSVIPHTMAQTNLSLKKVGDLLNI 180
            +I+   S+  Y+I KGSVA+DG SLT+   ++ +F +S+IPHTM +T + LKK GD++NI
Sbjct:  121 TIEVSSSLRRYMIHKGSVAVDGTSLTIFDVSDKTFTISIIPHTMEETIIGLKKAGDIVNI 180

Query:  181 EVDVLGKYAEKFLAPTNRTNHTSSVMDWSFLSENGY                         216
            E D++GKY E+F+       N   + +FL+E+GY
Sbjct:  181 ECDLIGKYIEQFVQQGKPVNEGG--LTKAFLTEHGY                         214
```

```
>GP: AAA86522 GB: U27202 riboflavin-specific deaminase [Actinobacillus
pleuropneumoniae]
Identities = 182/353 (51%), Positives = 259/353 (72%)
Query:   6 DYMALALKEAEKGMGFVAPNPLVGAVIVKDDRIISKGYHKRFGDLHAERQAIKNADEDIS  65
           DYM  A+  A++G+G+  PNPLVG VIVK+  I+++GYH++ G  HAER A+ +  ED+S
Sbjct:  51 DYMRRAIALAKQGLGWTNPNPLVGCVIVKNGEIVAEGYHEKIGGWHAERNAVLHCKEDLS 110

Query:  66 GSTLYVTLEPCCHVGKQPPCTEALIKSGIKKVVVGSLDPNPLVSGKGIALLRKEGLNVEV 125
           G+T YVTLEPCCH G+ PPC++ LI+ GIKKV +GS DPNPLV+G+G   LR+ G+ V
Sbjct: 111 GATAYVTLEPCCHHGRTPPCSDLLIERGIKKVFIGSSDPNPLVAGRGANQLRQAGVEVVE 170

Query: 126 GILREECDALNERFIFHMTYKQPFVYLKYAMTLDGKIATKTGDSKWISNEHSRQSVQKLR 185
           G+L+EECDALN  F  ++   K+P+V +KYAMT DGKIAT +G+SKWI+ E +R   VQ+ R
Sbjct: 171 GLLKEECDALNPIFFHYIQTKRPYVLMKYAMTADGKIATGSGESKWITGESARARVQQTR 230

Query: 186 QKCSAIMVGINTVLADNPRLTCRIPKGEALVRIVCDSQLKIPLDSYLVKSAKTIPTWIAT 245
            + SAIMVG++TVLADNP L  R+P +   VRIVCDSQL+ PLD  LV++AK   T IAT
Sbjct: 231 HQYSAIMVGVDTVLADNPMLNSRMPNAKQPVRIVCDSQLRTPLDCQLVQTAKEYRTVIAT 290

Query: 246 CSDNLAQQQTLKEMGCRLIKVPRKDGKLDLKVLMTILGQEGIDSLLIEGGSSLHFSALKA 305
            SD+L  + +  + +G  ++     ++ ++DL+ L+  LG+  IDSLL+EGGSSL FSAL++
Sbjct: 291 VSDDLQKIEQFRPLGVDVLVCKARNKRVDLQDLLQKLGEMQIDSLLLEGGSSLNFSALES 350

Query: 306 GIVNRLIVFIAPKIIGGLKAKTAISGEGLDWLNQAFRVKDIELSRMDSDVVIE         358
           GIVNR+ +IAPK++GG +AKT I GEG+  ++QA ++K       +  D++++
Sbjct: 351 GIVNRVHCYIAPKLVGGKQAKTPIGGEGIQQIDQAVKLKLKSTELIGEDILLD         403
```

A related DNA sequence was identified in *S. pyogenes* <SEQ ID 1083> which encodes the amino acid sequence <SEQ ID 1084>. Analysis of this protein sequence reveals the following:

```
Possible site: 25
>>> Seems to have no N-terminal signal sequence
INTEGRAL    Likelihood = -1.17    Transmembrane 88-104 (88-105)
----- Final Results -----
   bacterial membrane --- Certainty = 0.1468 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the databases:

Based on this analysis, it was predicted that these proteins and their epitopes could be useful antigens for vaccines or diagnostics.

Example 335

A DNA sequence (GBSx0365) was identified in *S. agalactiae* <SEQ ID 1085> which encodes the amino acid sequence <SEQ ID 1086>. This protein is predicted to be Nramp metal ion transporter. Analysis of this protein sequence reveals the following:

```
>GP: CAB11794 GB: Z99104 similar to hypothetical proteins [Bacillus subtilis]
Identities = 71/161 (44%), Positives = 109/161 (67%)
Query:  13 LEEQTYFMQEALKEAEKSLQKAEIPIGCVIVKDGEIIGRGHNAREESNQAIMHAEMMAIN  72
           + +     +M+EA+KEA+K+ +K E+PIG V+V +GEII R HN RE    ++I HAEM+ I+
Sbjct:   1 MTQDELYMKEAIKEAKKAEEKGEVPIGAVLVINGEIIARAHNLRETEQRSIAHAEMLVID  60

Query:  73 EANAHEGNWRLLDTTLFVTIEPCVMCSGAIGLARIPHVIYGASNQKFGGVDSLYQILTDE 132
           EA    G WRL    TL+VT+EPC MC+GA+ L+R+  V++GA + K G    +L  +L +E
Sbjct:  61 EACKALGTWRLEGATLYVTLEPCPMCAGAVVLSRVEKVVFGAFDPKGGCSGTLMNLLQEE 120

Query: 133 RLNHRVQVERGLLAADCANIMQTFFRQGRERKKIAKHLIKE                    173
           R NH+ +V  G+L  +C ++  FFR+ R++KK A+ +  E
Sbjct: 121 RFNHQAEVVSGVLEEECGGMLSAFFRELRKKKKAARKNLSE                    161
```

An alignment of the GAS and GBS proteins is shown below:

```
Identities = 48/146 (32%), Positives = 71/146 (47%), Gaps = 21/146 (14%)
Query:   7 YMALALKEAEKGMGFVAPNPLVGAVIVKDDRIISKGYHKRFGD----LHAERQAIKNADE  62
           +M  ALKEAEK +  A  P +G VIVKD  II +G++ R       +HAE AI   A+
Sbjct:  19 FMQEALKEAEKSLQ-KAEIP-IGCVIVKDGEIIGRGHNAREESNQAIMHAEMMAINEANA  76

Query:  63 D-----ISGSTLYVTLEPCCHVGKQPPCTEALIKSGIKKVVVGSLDPNPLVSGKGIALLR 117
           +         +TL+VT+EPC       C+ A+  + I  V+ G+ +             +L
Sbjct:  77 HEGNWRLLDTTLFVTIEPCV------MCSGAIGLARIPHVIYGASNQKFGGVDSLYQILT 130

Query: 118 KEGLN----VEVGILREECDALNERF                                   139
            E LN    VE G+L  +C  + + F
Sbjct: 131 DERLNHRVQVERGLLAADCANIMQTF                                   156
```

```
Possible site: 43
>>> Seems to have no N-terminal signal sequence
INTEGRAL    Likelihood = -11.89    Transmembrane 169-185 (160-191)
INTEGRAL    Likelihood = -11.09    Transmembrane 140-156 (128-165)
INTEGRAL    Likelihood = -6.85     Transmembrane 359-375 (354-379)
INTEGRAL    Likelihood = -6.48     Transmembrane 269-285 (263-287)
INTEGRAL    Likelihood = -6.16     Transmembrane 426-442 (423-445)
INTEGRAL    Likelihood = -5.57     Transmembrane 62-78 (58-80)
INTEGRAL    Likelihood = -4.94     Transmembrane 107-123 (103-127)
INTEGRAL    Likelihood = -4.46     Transmembrane 391-407 (389-408)
INTEGRAL    Likelihood = -4.35     Transmembrane 310-326 (307-328)
----- Final Results -----
     bacterial membrane --- Certainty = 0.5755 (Affirmative) <succ>
     bacterial outside --- Certainty = 0.0000 (Not Clear) <succ>
     bacterial cytoplasm --- Certainty = 0.0000 (Not Clear) <succ>
```

The protein has homology with the following sequences in the GENPEPT database:
>GP:AAF83825 GB:AE003939 manganese transport protein [*Xylella fastidiosa*]

```
>GP: AAF83825 GB: AE003939 manganese transport protein [Xylella
fastidiosa]
Identities = 192/436 (44%), Positives = 274/436 (62%), Gaps = 14/436 (3%)
Query:    10 SLSEVNQSVEVPHNSSFWNTLRAFLGPGALVAVGYMDPGNWITSVIGGATYRYLLLFVVL   69
             SL E++ SV V      +   L AFLGPG +V+VGYMDPGNW T + GG+ + Y+LL V+L
Sbjct:    39 SLGEMHASVAVSRRGHWGFRLLAFLGPGYMVSVGYMDPGNWATGLAGGSRFGYMLLSVIL   98

Query:    70 VSSLMAMQLQQMAGKLGIVTRQDLAQATASRLPKPLRYLLFIIIELALIATDLAEVIGSA  129
             +S++MA+ LQ +A +LGI +    DLAQA   +R +        L+++ ELA+IA DLAEVIG+A
Sbjct:    99 LSNVMAIVLQALAARLGIASDMDLAQACRARYSRGTTLALWVVCELAIIACDLAEVIGTA  158

Query:   130 IALHLLFGWPLLLSIMITILDVFLLLLLMKLGVQKIEAFVSVLILTILIIFTYLVVLSQP  189
             IAL+LL G P++    ++IT +DV L+LLLM  G +  +EAFV   L+L I    F    +VL+P
Sbjct:   159 IALNLLLGVPIIWGVVITAVDVVLVLLLMHRGFRALEAFVIALLLVIFGCFVVQIVLAAP  218

Query:   190 DLDAMFKGFLPHHELFNISHEGKNSPLTLALGIIGATVMPHNLYLHSSLSQTRRVDYHNK  249
                L  +  GF+P  ++              L LA+GI+GATVMPHNLYLHSS+  QTR
Sbjct:   219 PLQEVLGGFVPRWQVV-----ADPQALYLAIGIVGATVMPHNLYLHSSIVQTRAYP-RTP  272

Query:   250 SSIKKAVRFMTLDSNIQLSLAFVVNSLLLVLGASLFYG-HANDISAFSQMYLALSDKTIT  308
             +   + A+R+      DS + L LA  +N+  +L+L A++F+    H  D+       Q Y  L+
Sbjct:   273 VGRRSALRWAVADSTLALMLALFINASILILAAAVFHAQHHFDVEEIEQAYQLLAPVLGV  332

Query:   309 GAVASSFLSTLFAVALLASGQNSTITGTLTGQIVMEGFLHFKLPQWLIRLCTRLLTLLPI  368
             G    A    TLFA   ALLASG NST+T TL GQIVMEGFL   +L   WL R+   TR L  ++P+
Sbjct:   333 GVAA-----TLFATALLASGINSTVTATLAGQIVMEGFLRLRLRPWLRRVLTRGLAIVPV  387

Query:   369 FVIALLVGGEENTLDQLIVYSQVFLSLALPFSIFPLIYFTSQKSIMGEHANAKWNTYLAY  428
                 V+  L G E        +L++ SQV LS+ LPF++   PL+        +  +MG       +W    +A+
Sbjct:   388 IVVVALYG--EQGTGRLLLLSQVILSMQLPFAVIPLLRCVADRKVMGALVAPRWLMVVAW  445

Query:   429 LVAIILTLLNLKLIMD                                              444
             L+A  ++    +LN+KL+ D
Sbjct:   446 LIAGVIVVLNVKLLGD                                              461
```

No corresponding DNA sequence was identified in *S. pyogenes*.

Based on this analysis, it was predicted that this protein and its epitopes, could be useful antigens for vaccines or diagnostics.

Example 336

A DNA sequence (GBSx0366) was identified in *S. agalactiae* <SEQ ID 1087> which encodes the amino acid sequence <SEQ ID 1088>. Analysis of this protein sequence reveals the following:

```
Possible site: 54
>>> Seems to have a cleavable N-term signal seq.
INTEGRAL    Likelihood = -14.12    Transmembrane 113-129 (98-132)
INTEGRAL    Likelihood = -12.15    Transmembrane 228-244 (220-249)
INTEGRAL    Likelihood = -10.83    Transmembrane 175-191 (167-195)
INTEGRAL    Likelihood = -5.04     Transmembrane 57-73 (55-75)
INTEGRAL    Likelihood = -3.93     Transmembrane 146-162 (142-166)
INTEGRAL    Likelihood = -1.38     Transmembrane 199-215 (199-215)
INTEGRAL    Likelihood = -0.32     Transmembrane 82-98 (82-98)
----- Final Results -----
     bacterial membrane --- Certainty = 0.6647 (Affirmative) <succ>
     bacterial outside --- Certainty = 0.0000 (Not Clear) <succ>
     bacterial cytoplasm --- Certainty = 0.0000 (Not Clear) <succ>
```

The protein has homology with the following sequences in the GENPEPT database:

```
>GP: AAF11325 GB: AE002018 hypothetical protein [Deinococcus radiodurans]
Identities = 63/215 (29%), Positives = 108/215 (49%), Gaps = 13/215 (6%)
Query:    11 LLLVFILTIIVNYLSATGFLTGNSQKSLSDRYQTLLTPAPLAFSIWSVIYL-LTFLVILR   69
             LL    +LT++VNYLS    L GNS  +SDR         TPA L F++W  I+L L     + +
Sbjct:    10 LLAATVLTLVVNYLSNALPLFGNSNAEVSDRLPNAFTPAGLTFTVWGPIFLGLLVYAVYQ   69

Query:    70 AIFSKSQSYQDNFASIFPYFLGLLLVNNIWTVFFTSNLIGLSTIIIFAYCILLV-IIIKI  128
             A+ ++     + D      +P+ LG LL N  W + F S   IGLS +I+ A   +LV + + +
Sbjct:    70 ALPAQRGARLDRL--FWPFLLGNLL-NVAWLLAFQSLNIGLSVVIMLALLAVLVRLYLSV  126
```

```
                                          -continued
Query:  129 LS---KNKSKLLLRITFGIHAGWLLVASLVNLAVYLVKI----DFNYPLPKVYIAIIALI  181
              S   +    + L++    ++  W+ VA++ N+  +LV      F      V+ A++ ++
Sbjct:  127 RSLPPQGAERWTLQLPVSLYLAWISVATIANITAFLVSAGVTQSFLGIAGPVWSALLLVV  186

Query:  182 FITVLSLYLARVLQNAYLILSVFWAWLMVFKAHLE                           216
              +    +L R    A+  + + WA+  V+ A  E
Sbjct:  187 AAAIGVFFLWRFRDYAFAAV-LLWAFYGVYVARPE                           220
```

No corresponding DNA sequence was identified in *S. pyogenes*.

Based on this analysis, it was predicted that this protein and its epitopes, could be useful antigens for vaccines or diagnostics.

Example 337

A DNA sequence (GBSx0367) was identified in *S. agalactiae* <SEQ ID 1089> which encodes the amino acid sequence <SEQ ID 1090>. Analysis of this protein sequence reveals the following:

Possible site: 36
>>> Seems to have no N-terminal signal sequence
----- Final Results -----
bacterial cytoplasm --- Certainty = 0.3401 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database:

```
>GP: AAC65352 GB: AE001215 T. pallidum predicted coding region
TP0352 [Treponema pallidum]
Identities = 28/64 (43%), Positives = 41/64 (63%)
Query:   3 EFTFEIVEKLLVLSENEKGWTKELNRVSFNGAPAKFDLRTWSPDHTKMGKGITLSNEEFK  62
           +F +E+       LS +   GW+ EL   +S+NG  P K+D+R WSPD +KMGKG+TL+   E
Sbjct:  12 DFHYEVTRNWGTLSTSGNGWSLELKSISWNGRPEKYDIRAWSPDKSKMGKGVTLTRAEIV  71

Query:  63 VILD                                                          66
             + D
Sbjct:  72 ALRD                                                          75
```

A related DNA sequence was identified in *S. pyogenes* <SEQ ID 1091> which encodes the amino acid sequence <SEQ ID 1092>. Analysis of this protein sequence reveals the following:

Possible site: 36
>>> Seems to have no N-terminal signal sequence
----- Final Results -----
bacterial cytoplasm --- Certainty = 0.4021 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below:

```
Identities = 59/70 (84%), Positives = 64/70 (91%)
Query:   1 MSEFTFEIVEKLLVLSENEKGWTKELNRVSFNGAPAKFDLRTWSPDHTKMGKGITLSNEE  60
           M+EFTF I E LL LSEN+KGWTKELNRVSFNGA AK+D+RTWSPDHTKMGKGITL+NEE
Sbjct:   1 MAEFTFNIEEHLLTLSENDKGWTKELNRVSFNGAEAKWDIRTWSPDHTKMGKGITLTNEE  60

Query:  61 FKVILDAFRK                                                    70
           FK ILDAFRK
Sbjct:  61 FKTILDAFRK                                                    70
```

Based on this analysis, it was predicted that these proteins and their epitopes could be useful antigens for vaccines or diagnostics.

Example 338

A DNA sequence (GBSx0368) was identified in *S. agalactiae* <SEQ ID 1093> which encodes the amino acid sequence <SEQ ID 1094>. Analysis of this protein sequence reveals the following:

Possible site: 61
>>> Seems to have no N-terminal signal sequence
INTEGRAL Likelihood = −2.66 Transmembrane 92-108 (92-110)
----- Final Results -----
bacterial membrane --- Certainty = 0.2062 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the GENPEPT database:

```
>GP: CAB14676 GB: Z99117 similar to protease [Bacillus subtilis]
Identities = 201/407 (49%), Positives = 277/407 (67%), Gaps = 2/407 (0%)
Query:    4 VKKRPEVLSPAGTLEKLKVAIDYGADAVFVGGQAYGLRSRAGNFSMEELQEGINYAHARD    63
            + K+PE+L+PAG LEKLK+A+ YGADAVF+GGQ YGLRS A NF++EE+ EG+ +A
Sbjct:   18 ITKKPELLAPAGNLEKLKIAVHYGADAVFIGGQEYGLRSNADNFTIEEIAEGVEFAKKYG    77

Query:   64 AKVYVAANMVTHEGNELGAGPWFRELRDMGLDAVIVSDPALIVICATEAPGLEIHLSTQA   123
            AK+YV  N+  H  N G    + + L D +  +IV+DP +I  C    AP +E+HLSTQ
Sbjct:   78 AKIYVTTNIFAHNENMDGLEDYLKALGDANVAGIIVADPLIIETCRRVAPNVEVHLSTQQ   137

Query:  124 SSTNYETFEFWKEMGLTRVVLAREVTMAELAEIRKRTDVEIFAFVHGAMCISYSGRCVLS   183
            S +N++  +FWKE GL RVVLARE +   E+ E++++ D+EIE+F+HGAMCI+YSGRCVLS
Sbjct:  138 SLSNWKAVQFWKEEGLDRVVLARETSALEIREMKEKVDIEIESFIHGAMCIAYSGRCVLS   197

Query:  184 NHMSHRDANRGGCSQSCRWKYDLYDMPFGQERQSLKGEIPEPFSMSAVDMCMIEHIPDMI   243
            NHM+ RD+NRGGC QSCRW YDLY    G     +L GE   PF+MS  D+ +IE IP MI
Sbjct:  198 NHMTARDSNRGGCCQSCRWDYDLYQTD-GANAVALYGEEDAPFAMSPKDLKLIESIPKMI   256

Query:  244 ENGVDSLKIEGRMKSIHYVSTVTNCYKAAVDAYMESPEAFEAIKEDLIDELWKVAQRELA   303
            E G+DSLKIEGRMKSIHYV+TV + Y+  +DAY   PE F  I+++ ++EL K A R+ A
Sbjct:  257 EMGIDSLKIEGRMKSIHYVATVVSVYRKVIDAYCADPENF-VIQKEWLEELDKCANRDTA   315

Query:  304 TGFYYHTPTENEQLFGARRKIPQYKFVGEVVSFDNAKMEATIRQRNVIMEGDRVEFYGPG   363
            T F+   TP  EQ+FG  K   Y FVG V+++D      T++QRN   +GD VEF+GP
Sbjct:  316 TAFFEGTPGYEEQMFGEHAKKTTYDFVGLVLNYDEDTQMVTLQQRNFFKKGDEVEFFGPE   375

Query:  364 FRHFECFIDGLRDAEGNKIDRAPNPMELLTITLPNPVKKGDMIRACK               410
            +F   I+ + D +GN++D A +P++++     L    +M+R  K
Sbjct:  376 IENFTHTIETIWDEDGNELDAARHPLQIVKFKLDKKIYPSNMMRKGK                422
```

A related DNA sequence was identified in *S. pyogenes* <SEQ ID 1095> which encodes the amino acid sequence <SEQ ID 1096>. Analysis of this protein sequence reveals the following:

Possible site: 61
>>> Seems to have no N-terminal signal sequence

-continued

INTEGRAL   Likelihood = –2.66   Transmembrane 92-108 (92-110)
----- Final Results -----
  bacterial membrane --- Certainty = 0.2062 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP: BAB04993 GB: AP001511 protease [Bacillus halodurans]
Identities = 201/403 (49%), Positives = 280/403 (68%), Gaps = 4/403 (0%)
Query:    6 KRPEVLSPAGTLEKLKVAIDYGADAVFVGGQAYGLRSRAGNFSMEELQEGIDYAHARGAK    65
            K+PE+L+PAG+LEKLKVAI YGADAV++GGQ +GLRS A NFS+EE++EG+++A+  GAK
Sbjct:   17 KKPELLAPAGSLEKLKVAIHYGADAVYIGGQEFGLRSNADNFSIEEMREGVEFANKYGAK    76

Query:   66 VYVAANMVTHEGNEIGAGEWFRQLRDMGLDAVIVSDPALIVICSTEAPGLEIHLSTQASS   125
            VYV  N+  H  N G E+    L+++G+  +IV+DP +I  C    AP +E+HLSTQ S
Sbjct:   77 VYVTTNIYAHNENMDGLEEYLSALQEVGVTGIIVADPLIIETCKRVAPKVEVHLSTQQSL   136

Query:  126 TNYETFEFWKAMGLTRVVLAREVNMAELAEIRKRTDVEIEAFVHGAMCISYSGRCVLSNH   185
            +N+   +FWK GL RVVLAREV + E+ E++K  D+EIE FVHGAMCISYSGRCVLSNH
Sbjct:  137 SNWLAVKFWKEEGLHRVVLAREVGLEEMLEMKKHVDIEIETFVHGAMCISYSGRCVLSNH   196

Query:  186 MSHRDANRGGCSQSCRWKYDLYDMPFGGE-RRSLKGEIPEDYSMSSVDMCMIDHIPDLIE   244
            M+ RD+NRGGC QSCRW YDLY+   E     +G++P  Y+MS  D+ +I  IP LIE
Sbjct:  197 MTARDSNRGGCCQSCRWDYDLYEQQDSAEIPLFAEGDVP--YTMSPKDLNLIQAIPQLIE   254

Query:  245 NGVDSLKIEGRMKSIHYVSTVTNCYKAAVGAYMESPEAFYAIKEELIDELWKVAQRELAT   304
            G+DSLK+EGRMKSIHYV+TVT+ Y+   +AY   P+ F IK E ++EL K A R+ A
Sbjct:  255 AGIDSLKVEGRMKSIHYVATVTSVYRKVIDAYCSDPDNF-KIKREWLEELEKCANRDFAP   313

Query:  305 GFYYGIPTENEQLFGARRKIPQYKFVGEVVAFDSASMTATIRQRNVIMEGDRIECYGPGF   364
            F+ G PT  EQ++G  K  +Y FVG V+  +         T++QRN   +GD +E +GP
Sbjct:  314 QFFEGTPTYKEQMYGIHPKRTKYDFVGLVLDYNEKTGIVTLQQRNHFKQGDEVEFFGPEI   373

Query:  365 RHFETVVKDLHDADGQKIDRAPNPMELLTISLPREVKPGDMIR                   407
            F   V+ + D DG ++D A +P++++      + ++V P +M+R
Sbjct:  374 NRFTQTVEKIWDEDGNELDAARHPLQIVKFKVDQKVYPQNMMR                   416
```

An alignment of the GAS and GBS proteins is shown below:

```
Identities = 386/427 (90%), Positives = 404/427 (94%)
Query:     1 MSNVKKRPEVLSPAGTLEKLKVAIDYGADAVFVGGQAYGLRSRAGNFSMEELQEGINYAH    60
             MS++KKRPEVLSPAGTLEKLKVAIDYGADAVFVGGQAYGLRSRAGNFSMEELQEGI+YAH
Sbjct:     1 MSHMKKRPEVLSPAGTLEKLKVAIDYGADAVFVGGQAYGLRSRAGNFSMEELQEGIDYAH    60

Query:    61 ARDAKVYVAANMVTHEGNELGAGPWFRELRDMGLDAVIVSDPALIVICATEAPGLEIHLS   120
             AR AKVYVAANMVTHEGNE+GAG WFR+LRDMGLDAVIVSDPALIVIC+TEAPGLEIHLS
Sbjct:    61 ARGAKVYVAANMVTHEGNEIGAGEWFRQLRDMGLDAVIVSDPALIVICSTEAPGLEIHLS   120

Query:   121 TQASSTNYETFEFWKEMGLTRVVLAREVTMAELAEIRKRTDVEIEAFVHGAMCISYSGRC   180
             TQASSTNYETFEFWK MGLTRVVLAREV MAELAEIRKRTDVEIEAFVHGAMCISYSGRC
Sbjct:   121 TQASSTNYETFEFWKAMGLTRVVLAREVNMAELAEIRKRTDVEIEAFVHGAMCISYSGRC   180

Query:   181 VLSNHMSHRDANRGGCSQSCRWKYDLYDMPFGQERQSLKGEIPEPFSMSAVDMCMIEHIP   240
             VLSNHMSHRDANRGGCSQSCRWKYDLYDMPFG ER+SLKGEIPE +SMS+VDMCMI+HIP
Sbjct:   181 VLSNHMSHRDANRGGCSQSCRWKYDLYDMPFGGERRSLKGEIPEDYSMSSVDMCMIDHIP   240

Query:   241 DMIENGVDSLKIEGRMKSIHYVSTVTNCYKAAVDAYMESPEAFEAIKEDLIDELWKVAQR   300
             D+IENGVDSLKIEGRMKSIHYVSTVTNCYKAAV AYMESPEAF AIKE+LIDELWKVAQR
Sbjct:   241 DLIENGVDSLKIEGRMKSIHYVSTVTNCYKAAVGAYMESPEAFYAIKEELIDELWKVAQR   300

Query:   301 ELATGFYYHTPTENEQLFGARRKIPQYKFVGEVVSFDNAKMEATIRQRNVIMEGDRVEFY   360
             ELATGFYY  PTENEQLFGARRKIPQYKFVGEVV+FD+A M ATIRQRNVIMEGDR+E Y
Sbjct:   301 ELATGFYYGIPTENEQLFGARRKIPQYKFVGEVVAFDSASMTATIRQRNVIMEGDRIECY   360

Query:   361 GPGFRHFECFIDGLRDAEGNKIDRAPNPMELLTITLPNPVKKGDMIRACKEGLVNLYQND   420
             GPGFRHFE +  L DA+G KIDRAPNPMELLTI+LP  VK GDMIRACKEGLVNLYQ D
Sbjct:   361 GPGFRHFETVVKDLHDADGQKIDRAPNPMELLTISLPREVKPGDMIRACKEGLVNLYQKD   420

Query:   421 GTSKTVR                                                        427
             GTSKTVR
Sbjct:   421 GTSKTVR                                                        427
```

Figure 69:
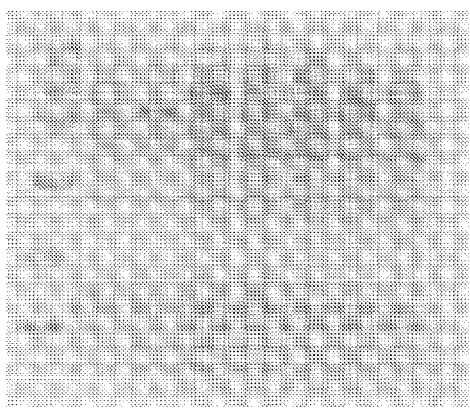
Figure 72:
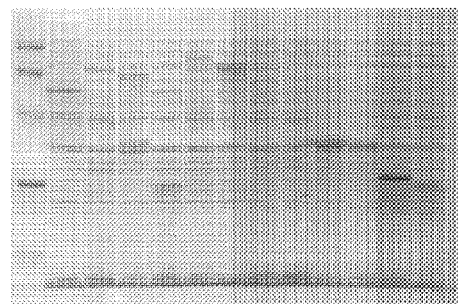

SEQ ID 1094 (GBS385) was expressed in *E. coli* as a His-fusion product. SDS-PAGE analysis of total cell extract is shown in FIG. 69 (lane 3; MW 50 kDa). It was also expressed in *E. coli* as a GST-fusion product. SDS-PAGE analysis of total cell extract is shown in FIG. 72 (lane 7; MW 75.7 kDa).

Figure 312:
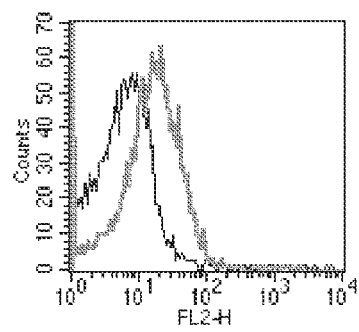

The GBS385-GST fusion product was purified (FIG. 213, lane 7) and used to immunise mice. The resulting antiserum was used for FACS (FIG. 312), which confirmed that the protein is immunoaccessible on GBS bacteria.

Based on this analysis, it was predicted that these proteins and their epitopes could be useful antigens for vaccines or diagnostics.

Example 339

A DNA sequence (GBSx0369) was identified in *S. agalactiae* <SEQ ID 1097> which encodes the amino acid sequence <SEQ ID 1098>. This protein is predicted to be collagenase. Analysis of this protein sequence reveals the following:

---

Possible site: 43

>>> Seems to have no N-terminal signal sequence

----- Final Results ----- bacterial cytoplasm --- Certainty = 0.2208 (Affirmative) <succ> bacterial membrane --- Certainty = 0.0000 (Not Clear) <succ> bacterial outside --- Certainty = 0.0000 (Not Clear) <succ>

---

The protein has homology with the following sequences in the GENPEPT database:

```
>GP: CAB14677 GB: Z99117 similar to protease [Bacillus subtilis]
Identities = 92/304 (30%), Positives = 161/304 (52%), Gaps = 5/304 (1%)
Query:     1 MEKIILTATAESIEQVKQLLAIGIDRIYVGEENYGLRLPHSFSDDELREIAKLVHDAGKE    60
             M+K  L T S   + L+ G     VGE+ YGLRL  FS +++ + ++ H  G +
Sbjct:     1 MKKPELLVTPTSTADILPLIQAGATAFLVGEQRYGLRLAGEFSREDVTKAVEIAHKEGAK    60

Query:    61 LTVACNALMHQEMMDNIKPFLELMKEINVDYLVVGDAGVFYINKRDGYNFKLIYDTSVFV   120
             + VA NA+ H ++   +L  + E  VD  V GD V   +    + KL + T
Sbjct:    61 VYVAVNAIFHNDKVGELGEYLAFLAEAGVDAAVFGDPAVLMAARESAPDLKLHWSTETTG   120

Query:   121 TSSRQVNFWGQHGAVETVLAREIPSEELFKMSENLEFPAEILVYGASVIHHSKRPLLQNY   180
             T+      N+WG+ GA  +VLARE+  +  ++ EN E    EI V+G + +  SKR L+ NY
Sbjct:   121 TNYYTCNYWGRKGAARSVLARELNMDSIVEIKENAEVEIEIQVHGMTCMFQSKRSLIGNY   180

Query:   181 YNF---THITDEKTRERGLFLAEPGDPESHYSIYEDKHGTHIFINNDINMMTKVTELVEH   237
              + +        + K +E G+FL +  + ++ Y I+ED++GTHI    ND+ ++ ++ EL++
Sbjct:   181 FEYQGKVMDIERKKKESGMFLHDK-ERDNKYPIFEDENGTHIMSPNDVCIIDELEELIDA   239

Query:   238 HFTHWKLDGIYCPGDNFVAIAEIFVETARL-IENGTFTQDQAFLFDERIRKLHPKGRGLD   296
                 +K+DG+      + + + +++ E L  +EN   +  +    + ERI   P R +D
Sbjct:   240 GIDSFKIDGVLKMPEYLIEVTKMYREAIDLCVENRDEYEAKKEDWIERIESIQPVNRKID   299
```

```
Query:  297  TGFY                                                         300
             TGF+
Sbjct:  300  TGFF                                                         303
```

A related GBS nucleic acid sequence <SEQ ID 10949> which encodes amino acid sequence <SEQ ID 10950> was also identified.

A related DNA sequence was identified in *S. pyogenes* <SEQ ID 1099> which encodes the amino acid sequence <SEQ ID 1100>. Analysis of this protein sequence reveals the following:

Possible site: 31
>>> Seems to have no N-terminal signal sequence
----- Final Results -----
  bacterial cytoplasm --- Certainty = 0.1716 (Affirmative) <succ>
  bacterial membrane --- Certainty = 0.0000 (Not Clear) <succ>
  bacterial outside --- Certainty = 0.0000 (Not Clear) <succ>

<SEQ ID 1102>. This protein is predicted to be cDNA EST yk542c12.5 comes from this gene. Analysis of this protein sequence reveals the following:

Possible site: 16
>>> Seems to have a cleavable N-term signal seq.
----- Final Results -----
  bacterial outside --- Certainty = 0.3000 (Affirmative) <succ>
  bacterial membrane --- Certainty = 0.0000 (Not Clear) <succ>
  bacterial cytoplasm --- Certainty = 0.0000 (Not Clear) <succ>

An alignment of the GAS and GBS proteins is shown below:

The protein has homology with the following sequences in the GENPEPT database:

```
Identities = 245/308 (79%), Positives = 273/308 (88%)
Query:    1  MEKIILTATAESIEQVKQLLAIGIDRIYVGEENYGLRLPHSFSDDELREIAKLVHDAGKE   60
             MEKII+TATAESIEQVK LLA G+DRIYVGE NYGLRLPH+FS DELR+IAKLVHDAGKE
Sbjct:    1  MEKIIITATAESIEQVKALLAAGVDRIYVGEANYGLRLPHNFSYDELRQIAKLVHDAGKE   60

Query:   61  LTVACNALMHQEMMDNIKPFLELMKEINVDYLVVGDAGVFYINKRDGYNFKLIYDTSVFV  120
             LTVACNALMHQ+MMD IKPFL+LM EI VDYLVVGDAGVFY+NKRDGYNFKLIYDTSVFV
Sbjct:   61  LTVACNALMHQDMMDQIKPFLDLMIEIAVDYLVVGDAGVFYVNKRDGYNFKLIYDTSVFV  120

Query:  121  TSSRQVNFWGQHGAVETVLAREIPSEELFKMSENLEFPAEILVYGASVIHHSKRPLLQNY  180
             TSSRQVNFWGQHGAVE+VLAREIPS ELF ++ENLEFPAE+LVYGASVIHHSKRPLL+NY
Sbjct:  121  TSSRQVNFWGQHGAVESVLAREIPSAELFTLAENLEFPAEVLVYGASVIHHSKRPLLENY  180

Query:  181  YNFTHITDEKTRERGLFLAEPGDPESHYSIYEDKHGTHIFINNDINMMTKVTELVEHHFT  240
             Y+FT I DE +RERGLFLAEPGD  SHYSIYED HGTHIFINNDI+MM+K+ EL  H  T
Sbjct:  181  YHFTKIDDEVSRERGLFLAEPGDASSHYSIYEDNHGTHIFINNDIDMMSKLGELYAHGLT  240

Query:  241  HWKLDGIYCPGDNFVAIAEIFVETARLIENGTFTQDQAFLFDERIRKLHPKGRGLDTGFY  300
             HWKLDGIYCPGD+FVAI ++F++   L+E G FTQ++A   D+ +   HP GRGLDTGFY
Sbjct:  241  HWKLDGIYCPGDDFVAITKLFIQAKTLLEAGQFTQEEAEKLDQAVHAHHPAGRGLDTGFY  300

Query:  301  DFDPSTVK                                                     308
             +FDP TVK
Sbjct:  301  EFDPKTVK                                                     308
```

Based on this analysis, it was predicted that these proteins and their epitopes could be useful antigens for vaccines or diagnostics.

Example 340

A DNA sequence (GBSx0371) was identified in *S. agalactiae* <SEQ ID 1101> which encodes the amino acid sequence

```
>GP: AAD15622 GB: U75480 unknown [Streptococcus mutans]
Identities = 69/152 (45%), Positives = 101/152 (66%), Gaps = 12/152 (7%)
Query:    1  MSKLFKTLVISAASGAAAAYFLTTKKGKELRKNAEKFYGEYKENPEEYHQIAKDKASEYS   60
             MSK  KT +I A +GAAAAYFL+T KGK+ +K    + + +YKENP+EYHQ A DK +EY
Sbjct:    1  MSKFLKTAIIGAGTGAAAAYFLSTDKGKQFKKKIHQTFTDYKENPKEYHQYAADKVNEYK   60

Query:   61  NLAVDTFKDYKGKFESGELTTEDIVSAVKEKSGEVVDFANDFVNQAKSKFSDEDTAKKED  120
             ++AV +FKDYK KFE+GELT ++I+S+VKEK+    FAN  ++Q K      T +K +
Sbjct:   61  DVAVHSFKDYKDKFETGELTKDNIISSVKEKASQAGKFANSKLSQVKDHLA--QTVEKAE  118

Query:  121  KAP---------ETKVEDIVIDYKENTEDKE                              142
             +           + +V+DIVIDY+    K+
Sbjct:  119  ASTNDAGIPLGEMKAQVDDIVIDYQAEEKTKK                             150
```

A related DNA sequence was identified in *S. pyogenes* <SEQ ID 1103> which encodes the amino acid sequence <SEQ ID 1104>. Analysis of this protein sequence reveals the following:

Possible site: 26
>>> Seems to have no N-terminal signal sequence
INTEGRAL     Likelihood = −1.81    Transmembrane 15-31 (14-31)
----- Final Results -----
    bacterial membrane --- Certainty = 0.1723 (Affirmative) <succ>
        bacterial outside --- Certainty = 0.0000 (Not Clear) <succ>
            bacterial cytoplasm --- Certainty = 0.0000 (Not Clear) <succ>

A related sequence was also identified in GAS <SEQ ID 9117> which encodes the amino acid sequence <SEQ ID 9118>. Analysis of this protein sequence reveals the following:

Possible cleavage site: 19
>>> Seems to have a cleavable N-term signal seq.
----- Final Results -----
    bacterial outside --- Certainty = 0.300 (Affirmative) <succ>
        bacterial membrane --- Certainty = 0.000 (Not Clear) <succ>
            bacterial cytoplasm --- Certainty = 0.000 (Not Clear) <succ>

An alignment of the GAS and GBS proteins is shown below:

```
Identities = 69/140 (49%), Positives = 91/140 (64%), Gaps = 8/140 (5%)
Query:    1 MSKLFKTLVISAASGAAAAYFLTTKKGKELRKNAEKFYGEYKENPEEYHQIAKDKASEYS   60
            M+K FK LVI A SG AAAYFL+T+KGK L+  AEK Y  YKE+P++YHQ AK+K SEYS
Sbjct:    8 MNKSFKNLVIGAVSGVAAAYFLSTEKGKALKNRAEKAYQAYKESPDDYHQFAKEKGSEYS   67

Query:   61 NLAVDTFKDYKGKFESGELTTEDIVSAVKEKSGEVVDFANDFVNQAKSKFSD-EDTAKKE  119
            +LA DTF D K K  SG+LT ED++  +K+K+         FV + K   ++ E   K++
Sbjct:   68 HLARDTFYDVKDKLASGDLTKEDMLDLLKDKT-------TAFVQKTKETLAEVEAKEKQD  120

Query:  120 DKAPETKVEDIVIDYKENTE                                          139
            D   +   EDI+IDY E  E
Sbjct:  121 DVIIDLNEEDIIIDYTEQDE                                          140
```

SEQ ID 1102 (GBS164) was expressed in *E. coli* as a His-fusion product. SDS-PAGE analysis of total cell extract is shown in FIG. 30 (lane 4; MW 17.4 kDa).

The GBS164-His fusion product was purified (FIG. 115A; see also FIG. 200, lane 4) and used to immunise mice (lane 1+2+3 product; 20 µg/mouse). The resulting antiserum was used for Western blot, FACS (FIG. 115B), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 341

A DNA sequence (GBSx0372) was identified in *S. agalactiae* <SEQ ID 1105> which encodes the amino acid sequence <SEQ ID 1106>. Analysis of this protein sequence reveals the following:

Possible site: 19
>>> Seems to have an uncleavable N-term signal seq
INTEGRAL     Likelihood = −16.93    Transmembrane 6-22 (1-31)
----- Final Results -----
    bacterial membrane --- Certainty = 0.7771 (Affirmative) <succ>
        bacterial outside --- Certainty = 0.0000 (Not Clear) <succ>
            bacterial cytoplasm --- Certainty = 0.0000 (Not Clear) <succ>

The protein has homology with the following sequences in the GENPEPT database:

```
>GP:AAD15621 GB:U75480 unknown [Streptococcus mutans]
Identities = 88/129 (68%), Positives = 112/129 (86%)
Query:    1 MIEIAVLIIAIAFVVLVLGILFVLKKVSETIEETKQTIKVLTSDVNVTLYQTNEILAKAN   60
            M EIA+LI+AIAF VLV+ ++ +L+K+S+T++E++QT+K+LTSDVNVTLYQTNE+LAKAN
Sbjct:    1 MWEIALLIVAIAFAVLVIYLILLLRKISDTVDESRQTLKILTSDVNVTLYQTNELLAKAN   60

Query:   61 VLVDDVNGKVSTIDPLFVAIADLSESVSDLNLQARHIGQKASSATSSVTKAGSALAIGKA  120
            VLV+DVNGKV TIDPLF AIADLS SVSDLN QAR+ G+K   +T++V KAG+A   GK
Sbjct:   61 VLVEDVNGKVETIDPLFTAIADLSVSVSDLNRQARYFGKKTRKSTANVGKAGAAYTFGKV  120

Query:  121 ASKIFRKKG                                                     129
            ASK+FRKKG
Sbjct:  121 ASKLFRKKG                                                     129
```

A related DNA sequence was identified in *S. pyogenes* <SEQ ID 1107> which encodes the amino acid sequence <SEQ ID 1108>. Analysis of this protein sequence reveals the following:

```
Possible site: 16
>>> Seems to have a cleavable N-term signal seq.
INTEGRAL    Likelihood = -0.85    Transmembrane 18-34 (17-34)
----- Final Results -----
    bacterial membrane --- Certainty = 0.1341 (Affirmative) <succ>
        bacterial outside --- Certainty = 0.0000 (Not Clear) <succ>
            bacterial cytoplasm --- Certainty = 0.0000 (Not Clear) <succ>
```

The protein has homology with the following sequences in the databases:

```
>GP:AAD15621 GB:U75480 unknown [Streptococcus mutans]
Identities = 83/128 (64%), Positives = 110/128 (85%)
Query:     6  ISLMIIALAFVALVIFLIIVLKKVSETIDEAKKTISVLTSDVNVTLHQTNDILAKANILV   65
              I+L+I+A+AF  LVI+LI++L+K+S+T+DE+++T+ +LTSDVNVTL+QTN++LAKAN+LV
Sbjct:     4  IALLIVAIAFAVLVIYLILLLRKISDTVDESRQTLKILTSDVNVTLYQTNELLAKANVLV   63

Query:    66  EDVNGKVATIDPLFVAIADLSESLSDLNSQARHFGQKATNATGNVSKAGKLALVGKVASK  125
              EDVNGKV TIDPLF AIADLS S+SDLN QAR+FG+K    +T NV KAG    GKVASK
Sbjct:    64  EDVNGKVETIDPLFTAIADLSVSVSDLNRQARYFGKKTRKSTANVGKAGAAYTFGKVASK  123

Query:   126  VFGKKGEK                                                     133
              +F KKG++
Sbjct:   124  LFRKKGKQ                                                     131
```

An alignment of the GAS and GBS proteins is shown below:

```
Identities = 92/131 (70%), Positives = 116/131 (88%)
Query:     1  MIEIAVLIIAIAFVVLVLGILFVLKKVSETIEETKQTIKVLTSDVNVTLYQTNEILAKAN   60
              ++ I+++IIA+AFV LV+ ++ VLKKVSETI+E K+TI VLTSDVNVTL+QTN+ILAKAN
Sbjct:     3  LVGISLMITALAFVALVIFLIIVLKKVSETIDEAKKTISVLTSDVNVTLHQTNDILAKAN   62

Query:    61  VLVDDVNGKVSTIDELFVAIADLSESVSDLNLQARHIGQKASSATSSVTKAGSALAIGKA  120
              +LV+DVNGKV+TIDPLFVAIADLSES+SDLN QARH GQKA++AT +V+KAG    +GK
Sbjct:    63  ILVEDVNGKVATIDELFVAIADLSESLSDIESQARHFGQKATNATGNVSKAGKLALVGKV  122

Query:   121  ASKIFRKKGDK                                                  131
              ASK+F KKG+K
Sbjct:   123  ASKVFGKKGEK                                                  133
```

Based on this analysis, it was predicted that these proteins and their epitopes could be useful antigens for vaccines or diagnostics.

Example 342

A DNA sequence (GBSx0373) was identified in *S. agalactiae* <SEQ ID 1109> which encodes the amino acid sequence <SEQ ID 1110>. Analysis of this protein sequence reveals the following:

```
Possible site: 13
>>> Seems to have no N-terminal signal sequence
----- Final Results -----
    bacterial cytoplasm --- Certainty = 0.0462 (Affirmative) <succ>
        bacterial membrane --- Certainty = 0.0000 (Not Clear) <succ>
            bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 343

A DNA sequence (GBSx0374) was identified in *S. agalactiae* <SEQ ID 1111> which encodes the amino acid sequence <SEQ ID 1112>. This protein is predicted to be prolipoprotein diacylglyceryl transferase (lgt). Analysis of this protein sequence reveals the following:

```
Possible site: 29
>>> Seems to have an uncleavable N-term signal seq
INTEGRAL    Likelihood = -8.39    Transmembrane 231-247 (225-251)
INTEGRAL    Likelihood = -7.64    Transmembrane 89-105 (87-107)
INTEGRAL    Likelihood = -5.20    Transmembrane 18-34 (13-36)
INTEGRAL    Likelihood = -1.86    Transmembrane 46-62 (46-64)
----- Final Results -----
    bacterial membrane --- Certainty = 0.4354 (Affirmative) <succ>
        bacterial outside --- Certainty = 0.0000 (Not Clear) <succ>
            bacterial cytoplasm --- Certainty = 0.0000 (Not Clear) <succ>
```

A related GBS nucleic acid sequence <SEQ ID 9721> which encodes amino acid sequence <SEQ ID 9722> was also identified.

The protein has homology with the following sequences in the GENPEPT database:

```
>GP:AAC80171 GB:U75480 putative prolipoprotein diacylglycerol transferase
[Streptococcus mutans] (ver 3)
Identities = 184/257 (71%), Positives = 226/257 (87%)
Query:    2 MINPVAIRLGPFSIRWYAICIVSGMLLAVYLAMKEAPRKNIKSDDILDFILMAPPLSIVG     61
            MINP+AI+LGP +IRWY+ICIV+G++LAVYL ++EAP+KNIKSDD+LDFIL+AFPL+IVG
Sbjct:    1 MINPIAIKLGPLTIRWYSICIVTGLILAVYLTIREAPKKNIKSDDVLDFILIAFPLAIVG     60

Query:   62 ARIYYVIFEWAYYSKHPVEIIAIWNGGIAIYGGLITGAILLVIFSYRRLINPIDFLDIAA    121
            AR+YYVIF+W YY K+P EI  IW+GGIAIYGGL+TGA++L IFSY R+I PIDFLD+AA
Sbjct:   61 ARLYYVIFDWDYYLKNPSEIPVIWHGGIAIYGGLLTGALVLFIFSYYRMIKPIDFLDVAA    120

Query:  122 PGVMIAQAIGRWGNFINQEAYGRAVKNLNYVPNFIKNQMYIDGAYRVPTFLYESLWNFLG    181
            PGVM+AQ+IGRWGNF+NQEAYG+ V  LNY+P+FI+ QMYIDG YR PTFLYESLWN LG
Sbjct:  121 PGVMLAQSIGRWGNFVNQEAYGKIVTQLNYLPDFIRKQMYIDGHYRTPTFLYESLWNLLG    180

Query:  182 FVIIMSIRHRPRTLKQGEVACFYLVWYGCGRFIIEGMRTDSLYLAGLRVSQWLSVILVII    241
            F+IIM +R RP  LK+GEVA FYL+WYG GRF+IEGMRTDSL A LRVSQWLSV+LV++
Sbjct:  181 FIIIMILRRRPNLLKEGEVAFFYLIWYGSGRFVIEGMRIDSLMFASLRVSQWLSVLLVVV    240

Query:  242 GIVMIIYRRREQHISYY                                             258
            G+++++ RRR   I YY
Sbjct:  241 GVILMVIRRRNHAIPYY                                             257
```

A related DNA sequence was identified in *S. pyogenes* <SEQ ID 1113> which encodes the amino acid sequence <SEQ ID 1114>. Analysis of this protein sequence reveals the following:

Possible site: 28
>>> Seems to have an uncleavable N-term signal seq
INTEGRAL    Likelihood = −7.01    Transmembrane 229-245 (222-249)
INTEGRAL    Likelihood = −6.90    Transmembrane 45-61 (40-68)

-continued

INTEGRAL    Likelihood = −4.41    Transmembrane 17-33 (11-35)
INTEGRAL    Likelihood = −4.14    Transmembrane 87-103 (86-106)
INTEGRAL    Likelihood = −0.27    Transmembrane 170-186 (170-186)
----- Final Results -----
    bacterial membrane --- Certainty = 0.3803 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:AAC80171 GB:U75480 putative prolipoprotein diacylglycerol transferase
[Streptococcus mutans] (ver 3)
Identities = 176/258 (68%), Positives = 217/258 (83%)
Query:    1 MINPIALKCGPLAIHWYALCILSGLVLAVYLASKEAPKKGISSDAIFDFILIAFPLAIVG     60
            MINPIA+K GPL I WY++CI++GL+LAVYL +EAPKK I SD + DFILIAFPLAIVG
Sbjct:    1 MINPIAIKLGPLTIRWYSICIVTGLILAVYLTIREAPKKNIKSDDVLDFILIAFPLAIVG     60

Query:   61 ARIYYVIFEWSYYVKHLDEIIAIWNGGIAIYGGLITGALVLLAYCYNKVLNPIHFLDIAA    120
            AR+YYVIF+W YY+K+  EI  IW+GGIAIYGGL+TGALVL  + Y +++ PI FLD+AA
Sbjct:   61 ARLYYVIFDWDYYLKNPSEIPVIWHGGIAIYGGLLTGALVLFIFSYYRMIKPIDFLDVAA    120

Query:  121 PSVMVAQAIGRWGNFINQEAYGKAVSQLNYLPSFIQKQMFIEGSYRIPTFLYESLWNLLG    180
            P VM+AQ+IGRWGNF+NQEAYGK V+QLNYLP FI+KQM+I+G YR PTFLYESLWNLLG
Sbjct:  121 PGVMLAQSIGRWGNFVNQEAYGKTVTQLNYLPDFIRKQMYIDGHYRTPTFLYESLWNLLG    180

Query:  181 FVIIMMWRRKPKSLLDGEIFAFYLIWYGSGRLVIEGMRTDSLMFLGIRISQYVSALLIII    240
            F+IIM+ RR+P  L +GE+ FYLIWYGSGR VIEGMRTDSLMF +R+SQ++S LL+++
Sbjct:  181 FIIIMILRRRPNLLKEGEVAFFYLIWYGSGRFVIEGMRTDSLMFASLRVSQWLSVLLVVV    240

Query:  241 GLIFVIKRRRQKGISYYQ                                            258
            G+I ++ RRR   I YYQ
Sbjct:  241 GVILMVIRRRNHAIPYYQ                                            258
```

An alignment of the GAS and GBS proteins is shown below:

```
Identities = 176/257 (68%), Positives = 221/257 (85%)
Query:    2 MINPVAIRLGPFSIRWYAICIVSGMLLAVYLAMKEAPRKNIKSDDILDFILMAFPLSIVG     61
            MINP+A++ GP +I WYA+CI+SG++LAVYLA KEAP+K I SD I DFIL+AFPL+IVG
Sbjct:    1 MINPIALKCGPLAIHWYALCILSGLVLAVYLASKEAPKKGISSDAIFDFILIAFPLAIVG     60

Query:   62 ARIYYVIFEWAYYSKHPVEIIAIWNGGIAIYGGLITGAILLVIFSYRRLINPIDFLDIAA    121
            ARIYYVIFEW+YY KH  EIIAIWNGGIAIYGGLITGA++L+ + Y +++NPI FLDIAA
Sbjct:   61 ARIYYVIFEWSYYVKHLDEIIAIWNGGIAIYGGLITGALVLLAYCYNKVLNPIHFLDIAA    120

Query:  122 PGVMIAQAIGRWGNFINQEAYGRAVKNLNYVPNFIKNQMYIDGAYRVPTFLYESLWNFLG    181
            P VM+AQAIGRWGNFINQEAYG+AV  LNY+P+FI+ QM+I+G+YR PTFLYESLWN LG
Sbjct:  121 PSVMVAQAIGRWGNFINQEAYGKAVSQLNYLPSFIQKQMFIEGSYRIPTFLYESLWNLLG    180
```

```
                              -continued
Query:  182  FVIIMSIRHRPRTLKQGEVACFYLVWYGCGRFIIEGMRTDSLYLAGLRVSQWLSVILVII  241
             FVIIM  R +P++L  GE+   FYL+WYG GR +IEGMRTDSL   G+R+SQ++S +L+II
Sbjct:  181  FVIIMMWRRKPKSLLDGEIFAFYLIWYGSGRLVIEGMRTDSLMFLGIRISQYVSALLIII  240

Query:  242  GIVMIIYRRREQHISYY                                             258
             G++ +I RRR++ ISYY
Sbjct:  241  GLIFVIKRRRQKGISYY                                             257
```

A related GBS gene <SEQ ID 8557> and protein <SEQ ID 8558> were also identified. Analysis of this protein sequence reveals the following:

---

Lipop: Possible site: −1          Crend: 0
McG: Discrim Score: 2.45
GvH: Signal Score (−7.5): −2.9
Possible site: 39
>>> Seems to have an uncleavable N-term signal seq
ALOM program        count: 3              value: −8.39     threshold: 0.0
INTEGRAL            Likelihood = −8.39    Transmembrane 209-225 (203-229)
INTEGRAL            Likelihood = −7.64    Transmembrane 67-83 (65-85)
INTEGRAL            Likelihood = −1.86    Transmembrane 24-40 (24-42)
PERIPHERAL          Likelihood = 0.79     92
modified ALOM score: 2.18

*** Reasoning Step: 3
----- Final Results -----
   bacterial membrane --- Certainty = 0.4354 (Affirmative) <succ>
     bacterial outside --- Certainty = 0.0000 (Not Clear) <succ>
       bacterial cytoplasm --- Certainty = 0.0000 (Not Clear) <succ>

---

The protein has homology with the following sequences in the databases:

---

```
ORF01400(238-1008 of 1308)
SP|P72482|LGT_STRMU(1-257 of 259) PROLIPOPROTEIN DIACYLGLYCERYL TRANSFERASE
(EC 2.4.99.-). GP|4583534|gb|AAC80171.3||U75480 putative prolipoprotein
diacylglycerol transferase
{Streptococcus mutans} PIR|T11569|T11569 prolipoprotein diacylglyceryl
transferase (EC 2.4.99.-)-Streptococcus mutans
% Match = 46.9
% Identity = 71.6 % Similarity = 89.5
Matches = 184 Mismatches = 27 Conservative Sub.s = 46

198         228         258         288         318         348         378         408
WGLMLPRLLRIV*HI*LVRTRSMMINPVAIRLGPFSIRWYAICIVSGMLLAVYLAMKEAPRKNIKSDDILDFILMAFPLS
                        ||||:||:|||::|||||:||||:|::|||||  ::|||:|||||||||||||:||||:
                        MINPIAIKLGPLTIRWYSICIVTGLILAVYLTIREAPKKNIKSDDVLDFILIAFPLA
                                 10        20        30        40        50

438         468         498         528         558         588         618         648
IVGARIYYVIFEWAYYSKHPVEIIAIWNGGIAIYGGLITGAILLVIFSYRRLINPIDFLDIAAPGVMIAQAIGRWGNFIN
|||||:||||||:|  ||  |:|  ||  ||:|||||||||||:|||::|  ||||  :|  ||||||:|||||:||||:|
IVGARLYYVIFDWDYYLKNPSEIPVIWHGGIAIYGGLLTGALVLFIFSYYRMIKPIDFLDVAAPGVMLAQSIGREGNFVN
            70        80        90       100       110       120       130

678         708         738         768         798         828         858         888
QEAYGRAVKNLNYVPNFIKNQMYIDGAYRVPTFLYESLWNFLGFVIIMSIRHRPRTLKQGEVACFYLVWYGCGRFIIEGM
|||||:  |   |||:|:|: |||||| ||  ||||||||||||:|||:|||   :|  ||:||||  |||:||| |:|||
QEAYGKTVTQLNYLPDFIRKQMYIDGHYRTPTFLYESLWNLLGFIIIMLRRRPNLLKEGEVAFFYKIWYGSGRFVIEGM
            150       160       170       180       190       200       210

918         948         978        1008        1038        1068        1098        1128
RTDSLYLAGLRVSQWLSVILVIIGIVMIIYRRREQHISYY*TEEVL**KLLY*LLPLRLLF*F*EYFSF*KKYQKRLRKP
|||||  :|  |||||||||:||::|:::::   |||   :   |   |||
RTDSLMFASLRVSQWLSVLLVVVGVILMVIRRRNHAIPYYQC
            230       240       250
```

---

Based on this analysis, it was predicted that these proteins and their epitopes could be useful antigens for vaccines or diagnostics.

Example 344

A DNA sequence (GBSx0375) was identified in *S. agalactiae* <SEQ ID 1115> which encodes the amino acid sequence <SEQ ID 1116>. Analysis of this protein sequence reveals the following:

```
Possible site: 31
>>> Seems to have no N-terminal signal sequence
----- Final Results -----
   bacterial cytoplasm --- Certainty = 0.2817 (Affirmative) <succ>
   bacterial membrane --- Certainty = 0.0000 (Not Clear) <succ>
     bacterial outside --- Certainty = 0.0000 (Not Clear) <succ>
```

The protein has homology with the following sequences in the GENPEPT database:

A related DNA sequence was identified in *S. pyogenes* <SEQ ID 1117> which encodes the amino acid sequence <SEQ ID 1118>. Analysis of this protein sequence reveals the following:

```
Possible site: 13
>>> Seems to have no N-terminal signal sequence
----- Final Results -----
   bacterial cytoplasm --- Certainty = 0.2391 (Affirmative) <succ>
   bacterial membrane --- Certainty = 0.0000 (Not Clear) <succ>
     bacterial outside --- Certainty = 0.0000 (Not Clear) <succ>
```

```
>GP:BAA77782 GB:AB027460 Hpr kinase [Streptococcus bovis]
Identities = 264/309 (85%), Positives = 292/309 (94%)
Query:   1 MAVTVQMLVDELKLNVIYGDEHLLSKRITTADISRPGLEMTGYFDYYAPERLQLVGMKEW  60
           M+VTV+MLVD++KL+VINGD+ LLSK ITT+DISRPGLEMTGYFDYY+PERLQL+GMKEW
Sbjct:   1 MSVTVKMLVDKVKLDVIYGDDDLLSKEITTSDISRPGLEMTGYFDYYSPERLQLLGMKEW  60

Query:  61 SYLMAMTGHNRYQVLREMFQKETPAIVVARDLEIPEEMYEAAKDTGIAILQSKAPTSRLS 120
           SYL  MT HNR  VLREM + ETPAI+VAR+L IPEEM  AAK+ GIAILQS  PTSRLS
Sbjct:  61 SYLTKMTSHNRRHVLREMIKPETPAIIVARNLAIPEEMISAAKEKGIAILQSHVPISRLS 120

Query: 121 GEVSWYLDSCLAERTSVHGVLMDIYGMGVLIQGDSGIGKSETGLELVKRGHRLVADDRVD 180
           GE+SWYLDSCLAERTSVHGVLMDIYGMGVLIQGDSGIGKSETGLELVKAGHRLVADDRVD
Sbjct: 121 GEMSWYLDSCLAERTSVHGVLMDIYGMGVLIQGDSGIGKSETGLELVKAGHRLVADDRVD 180

Query: 181 VYAKDEETLWGEPAEILRHLLEIRGVGIIDIMSLYGASAVKDSSQVQLAIYLENFETGKV 240
           V+AKDEETLWGEPAEILRHLLEIRGVGIID+MSLYGASAVEDSSQVQLAIYLEN+E+GKV
Sbjct: 181 VFAKDEETLWGEPAEILRHLLEIRGVGIIDVMSLYGASAVRDSSQVQLAIYLENYESGKV 240

Query: 241 FDRLGNGNEEIELSGVKVPRIRIPVKTGRNVSVVIEAAAMNHRAKQMGPDATQTFEDRLT 300
           FDRLGNGNEE+ELSGVK+PR+RIPV+TGRN+SVVIEAAAMN+RAKQMGFDAT+TFE+RLT
Sbjct: 241 FDRLGNGNEELELSGVKIPRLRIPVQTGRNMSVVIEAAAMNYRAKQMGFDATKTFEERLT 300

Query: 301 HLISQNEVN                                                   309
           LI++NE N
Sbjct: 301 QLITKNEGN                                                   309
```

An alignment of the GAS and GBS proteins is shown below:

```
Identities = 255/309 (82%),Positives = 288/309 (92%)
Query:   1 MAVTVQMLVDRLKLNVIYGDEHLLSKRITTADISRPGLEMTGYFDYYAPERLQLVGMKEW  60
           M VTV+MLV ++KL+V+Y  ++LLSK ITT+DISRPGLEMTGYFDYYAPERLQL GMKEW
Sbjct:  32 MTVTVEMLVQKVKLDVVYATDNLLSKEITTSDISRPGLEMTGYFDYYAPERLQLFGMKEW  91

Query:  61 SYLMAMTGHNRYQVLREMFQKETPAIVVARDLEIPEEMYEAAKDTGIAILQSKAPTSRLS 120
           SYL  MT HNRY VL+EMF+K+TPA+VV+R+L IP+EM +AAK+ GI++L S+  TSRL+
Sbjct:  92 SYLTQMTSHNRYSVLKEMFKKDTPAVVVSRNLAIPKEMVQAAKEEGISLLSSRVSTSRLA 151

Query: 121 GEVSWYLDSCLAERTSVHGVLMDIYGMGVLIQGDSGIGKSETGLELVKRGHRLVADDRVD 180
           GE+S++LD+ LAERTSVHGVLMDIYGMGVLIQGDSGIGKSETGLELVKAGHRLVADDRVD
Sbjct: 152 GEMSYFLDASLAERTSVHGVLMDIYGMGVLIQGDSGIGKSETGLELVKRGHRLVADDRVD 211

Query: 181 VYAKDEETLWGEPAEILRHLLEIRGVGIIDIMSLYGASAVKDSSQVQLAIYLENFETGKV 240
           VYAKDEETLWGEPAEILRHLLEIRGVGIID+MSLYGASAVKDSSQVQLAIYLENFE GKV
Sbjct: 212 VYAKDEETLWGEPAEILRHLLEIRGVGIIDVMSLYGASAVKDSSQVQLAIYLENFEAGKV 271

Query: 241 FDRLGNGNEEIELSGVKVPRIRIPVKTGRNVSVVIEAAAMNHRAKQMGFDATQTFEDRLT 300
           FDRLGNGNEEI   SGV++PRIRIPVKTGRNVSVVIEAAAMNHRAK+MGFDAT+TFEDRLT
Sbjct: 272 FDRLGNGNEEITFSGVRIPRIRIPVKTGRNVSVVIEAAAMNHRAKEMGFDATKTFEDRLT 331

Query: 301 HLISQNEVN                                                   309
           LI++NEV+
Sbjct: 332 QLITKNEVS                                                   340
```

Based on this analysis, it was predicted that these proteins and their epitopes could be useful antigens for vaccines or diagnostics.

```
>GP:AAC67275 GB:AF017113 Yv1C [Bacillus subtilis]
Identities = 21/63 (33%), Positives = 36/63 (56%), Gaps = 2/63 (3%)
Query:   3  SSFYKQRKGKLVCGVVAGLADKYNWDLALSRVLIALILYFTKF--GLLLYILLAVFLPYK  60
            +  Y+  K K + GV+ GLA+ +NWD +L RV+  ++   T      LL+YI+   +P +
Sbjct:   2  NKLYRSEKNKKIAGVIGGLAEYFNWDASLLRVITVILAIMTSVLPVLLIYIIWIFIVPSE  61

Query:  61  EDI                                                          63
            D+
Sbjct:  62  RDM                                                          64
```

Example 345

A DNA sequence (GBSx0376) was identified in *S. agalactiae* <SEQ ID 1119> which encodes the amino acid sequence <SEQ ID 1120>. Analysis of this protein sequence reveals the following:

---

Possible site: 28
>>> Seems to have no N-terminal signal sequence
----- Final Results -----
    bacterial cytoplasm --- Certainty = 0.1836 (Affirmative) <succ>
      bacterial membrane --- Certainty = 0.0000 (Not Clear) <succ>
        bacterial outside --- Certainty = 0.0000 (Not Clear) <succ>

---

A related GBS nucleic acid sequence <SEQ ID 9719> which encodes amino acid sequence <SEQ ID 9720> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

Example 346

A DNA sequence (GBSx0377) was identified in *S. agalactiae* <SEQ ID 1121> which encodes the amino acid sequence <SEQ ID 1122>. Analysis of this protein sequence reveals the following:

---

Possible site: 37
>>> Seems to have an uncleavable N-term signal seq
INTEGRAL    Likelihood = −4.88    Transmembrane 35-51 (31-59)
----- Final Results -----
    bacterial membrane --- Certainty = 0.2954 (Affirmative) <succ>
      bacterial outside --- Certainty = 0.0000 (Not Clear) <succ>
        bacterial cytoplasm --- Certainty = 0.0000 (Not Clear) <succ>

---

The protein has homology with the following sequences in the GENPEPT database:

A related DNA sequence was identified in *S. pyogenes* <SEQ ID 1123> which encodes the amino acid sequence <SEQ ID 1124>. Analysis of this protein sequence reveals the following:

---

Possible site: 32
>>> Seems to have an uncleavable N-term signal seq
INTEGRAL    Likelihood = −5.26    Transmembrane 39-55 (31-61)
----- Final Results -----
    bacterial membrane --- Certainty = 0.3102 (Affirmative) <succ>
      bacterial outside --- Certainty = 0.0000 (Not Clear) <succ>
        bacterial cytoplasm --- Certainty = 0.0000 (Not Clear) <succ>

---

An alignment of the GAS and GBS proteins is shown below:

```
Identities = 60/90 (66%), Positives = 77/90 (84%), Gaps = 3/90 (3%)
Query:   1  MKSSFYKQRKGKLVCGVVAGLADKYNWDLALSRVLIALILYFTKFGLLLYILLAVFLPYK  60
            +++  FYKQRK +LV GV+AGLADKY WDLAL+RVL AL++Y T FG+LLYILLA+FLPYK
Sbjct:   1  VETKFYKQRKNRLVAGVIAGLADKYGWDLALARVLAALLIYGTGFGVLLYILLAIFLPYK  60

Query:  61  EDIIETR-RQGPRRRKDAEPV--DDDGWFW                               87
            ED++E R  +GPRRRKDA+ +   ++DGWFW
Sbjct:  61  EDLLEERYGRGPRRRKDADVLNEEEDGWFW                               90
```

Based on this analysis, it was predicted that these proteins and their epitopes could be useful antigens for vaccines or diagnostics.

Example 347

A DNA sequence (GBSx0378) was identified in *S. agalactiae* <SEQ ID 1125> which encodes the amino acid sequence <SEQ ID 1126>. Analysis of this protein sequence reveals the following:

---

Possible site: 19
>>> Seems to have no N-terminal signal sequence
----- Final Results -----
    bacterial cytoplasm --- Certainty = 0.3577 (Affirmative) <succ>
      bacterial membrane --- Certainty = 0.0000 (Not Clear) <succ>
        bacterial outside --- Certainty = 0.0000 (Not Clear) <succ>

---

A related GBS nucleic acid sequence <SEQ ID 9717> which encodes amino acid sequence <SEQ ID 9718> was also identified.

The protein has homology with the following sequences in the GENPEPT database:

```
>GP:BAB04250 GB:AP001508 unknown conserved protein [Bacillus halodurans]
Identities = 379/729 (51%), Positives = 515/729 (69%), Gaps = 25/729 (3%)
Query:  29 ENLNITQIAIDLGIKASQIEKVLELTDEGNTIPFIARYRKEMTGNLDEVQIKSIIDLDKS  88
            E  I  +A +L +K + I++V++L EGNT+PFIARYRKE+TG +DEV+I+ + +
Sbjct:   8 EEHTIKTLAKELSLKPNYIKQVIQLLHEGNTVPFIARYRKELTGGMDEVKIREVSEKWTY  67

Query:  89 MTALSDRKTTVLAKIEEQGKLIQELKKAIEEATKLADVEELYLPYKEKRRIKATIAREAG 148
              L +RK V+   +EEQGKLT E KK +E+A KL +VE+LY PYK+KRRT+AT+A+E G
Sbjct:  68 ANQLHERKEEVIRLVEEQGKLIDEWKKTVEQAQKLQEVEDLYRPYKQKRRTRATVAKEKG 127

Query: 149 LFPLARLI--LQNKDNLEEEAQNYLTDGFETTT--KALSGAVDILIEAFSEDNKLRSWTY 204
           L PLA  + L    + +EA+ YL+   E T     L GA DI+ E  ++D   LR
Sbjct: 128 LEPLAEWLFSLPRDGDPLQEAEVYLSVEHELTKVEDVLQGAQDIIAEWIADDADLRKRIR 187

Query: 205 NEIWNYSSITAVVKDESLDEKQVFKIYYDFSEKISKLHGYQVLALNRGEKMGVLKVNFEH 264
            + +    S+ A VK E LDEK V+++YYD+ E +  L  ++ LALNRGEK  VL+V
Sbjct: 188 SLGEKEGSVIAKVKKEELDEKGVYEMYYDYEEPVRTLVPHRTLALNRGEKEDVLRVTIRF 247

Query: 265 NLEKMERF----FAVRFKETS-QYIDDLIVQTVKKKIVPAMERRIRTELSEGAEDGAISL 319
            ++++         F  RF  +  Y+  I    K+ I P++ER IR EL+E AE+ AI +
Sbjct: 248 PVDRIIEMSEKTFIRREGSPAVPYVKAAIEDGYKRLIEPSIEREIRHELTEKAEEQAIHI 307

Query: 320 FSENLRNLLLVSPLKGKMVLGFDPAFRTGAKLAVVDQTGKLMTTQVIYPVPPANQAKIEQ 379
           F+ENLR+LLL  P+KGK+VLG DPA+RTG KLA+VD+TGK++  QVIYP PP N+  +
Sbjct: 308 FAENLRSLLLQPPIKGKVVLGLDPAYRTGCKLAIVDETGKVLDIQVIYPTPPKNE--VAA 365

Query: 380 SKIELAKLIKEFNIEIIAIGNGTASRESEAFVAEVLQDFPD-VSYVIVNESGASVYSASE 438
           +K + +  KLI ++ +E+IAIGNGTASRESE F+A++++D P   + Y+IVNE+GASVYSASE
Sbjct: 366 AKKIVKKLIADYGVEMIAIGNGTASRESEQFIADLIKDLPQTITYLIVNEAGASVYSASE 425

Query: 439 LARHEFPDLIVEKRSAISIARRLQDPLAELVKIDPKSIGVGQYQHDVSQKKLAENLDFVV 498
            + R EFPDL VE+RSA+SIARRLQDPLAELVKIDPKS+GVGQYQHDVSQK+L E+L FVV
Sbjct: 426 IGREEFPDLQVEERSAVSIARRLQDPLAELVKIDPKSVGVGQYQHDVSQKRLNESLTFVV 485

Query: 499 ETVVNQVGVNVNTASPALLAHVSGLNKTISENIVKYREENGQIKSRAEIKKVPRLGAKAF 558
           ETVVNQVGVNVNTASP+LL +V+GL+KT+++NIVK REE G+  +RA++K +PRLGAK +
Sbjct: 486 ETVVNQVGVNVNTASPSLLQYVAGLSKTVAKNIVKKREEAGRFTARAQLKDIPRLGAKTY 545

Query: 559 EQAAGFLRIPNAKNELDNTGVHPESYEAVKKLLDQLTIKELD---DLAKEKLQNLDLIAT 615
           EQ  GFLRI +  N LD T +HPESY+    KLL ++      D  +  K+KLQ LD+ A
Sbjct: 546 EQCIGFLRIMDGDNLLDATAIHPESYKVTDKLLSEVGATAADVGIEDLKKKLQALDVSAM 605

Query: 616 AESIGVGQETLKDIIEDLLKPGRDLRDDFEAPVLRHDVLDVSDLKVGQELQGTVRNVVDF 675
           A ++ VG  TLKD+I+ L++P RD RD+    P+L+ DVL + DL  G ELQGTVRNVVDF
Sbjct: 606 AATLDVGVPILKDMIDALIRPTRDPRDEVAKPLLKQDVLQLEDLLPGMELQGTVRNVVDF 665

Query: 676 GAFVDIGVHEDGLIHQSRLIKRKRDKKTRKMPPLQHPSKYLSVGDIVTVWVVEVDAERSR 735
           G FVDIGV +DGL+H S+L  R           ++HP + ++VG+IVTVWV +VD ++ R
Sbjct: 666 GVFVDIGVKQDGLVHISKLANRY----------IKHPLEVVTVGEIVTVWVEDVDIKKGR 715

Query: 736 IGLSLIKPD                                                    744
           I L++++P+
Sbjct: 716 IALTMLRPE                                                    724
```

A related DNA sequence was identified in *S. pyogenes* <SEQ ID 1127> which encodes the amino acid sequence <SEQ ID 1128>. Analysis of this protein sequence reveals the following:

Possible site: 25
>>> Seems to have no N-terminal signal sequence

----- Final Results -----
bacterial cytoplasm --- Certainty = 0.2207 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below:

```
Identities = 532/716 (74%), Positives = 619/716 (860), Gaps = 10/716 (1%)
Query:  28 MENLNITQIAIDLGIKASQIEKVLELTDEGNTIPFIARYRKEMTGNLDEVQIKSIIDLDK  87
           MEN N  IA L +  QIE+VL LT +GNTIPFIARYRKE+TGNLDEV IKSIID DK
Sbjct:   1 MENNNHNIAEALSVSLHQIEQVLALTAQGNTIPFIARYRKEVTGNLDEVVIKSIIDMDK  60

Query:  88 SMTALSDRKTTVLAKIEEQGKLTQELKKAIEEATKLADVEELYLPYKEKRRIKATIAREA 147
           S+T L++RK T+LAKIEEQGKLT +L+ +IE   KLAD+EELYLPYKEKRRTKATIAREA
Sbjct:  61 SLTTLNERKATILAKIEEQGKLTDQLRTSIEATEKLADLEELYLPYKEKRRIKATIAREA 120

Query: 148 GLFPLARLILQNKDNLEEEAQNYLTDGFETTIKALSGAVDILIEAFSEDNKLRSWTYNEI 207
           GLFPLARLILQN   NLE A+ +++T+GF +  +AL+GAVDIL+EA SED KLRSWTYNEI
Sbjct: 121 GLFPLARLILQNAQNLETAAEPFVTEGFASPQEALAGAVDILVEAMSEDAKLRSWTYNEI 180
```

```
-continued

Query:  208  WNYSSITAVVKDESLDEKQVFKIYYDFSEKISKLHGYQVLALNRGEKMGVLKVNFEHNLE  267
             W YS + + +KDE LDEK+VF+IYYDFS+++S + GY+ LALNRGEK+G+LKV+FEHNLE
Sbjct:  181  WQYSRLVSTLKDEQLDEKKVFQIYYDFSDQVSNMQGYRTLALNRGEKLGILKVSFEHNLE  240

Query:  268  KMFRFFAVRFKETSQYIDDLIVQTVKKKIVPAMERRIRTELSEGAEDGAISLFSENLRNL  327
             KM RFF+VRFKET+ YI+++I QT+KKKIVPAMERR+R+ELS+ AEDGAI LFSENLR+L
Sbjct:  241  KMQRFFSVREKETNPYIEEVINQTIKKKIVPAMERRVRSELSDAAEDGAIHLFSENLRHL  300

Query:  328  LLVSPLKGKMVLGFDPAFRTGAKLAVVDQTGKLMTTQVIYPVPPANQAKIEQSKIELAKL  387
             LLVSPLKGKMVLGFDPAFRTGAKLA+VDQTGKL+TTQVIYPV PA+Q KI+ +K  L +L
Sbjct:  301  LLVSPLKGKMVLGFDPAFRTGAKLAIVDQTGKLLTTQVIYPVAPASQTKIQAAKETLTQL  360

Query:  388  IKEFNIEIIAIGNGTASRESEAFVAEVLQDFPDVSYVIVNESGASVYSASELARHEFPDL  447
             I+ + I+IIAIGNGTASRESEAFVA+VL+DFP+ SYVIVNESGASVYSASELARHEFPDL
Sbjct:  361  IETYQIDIIAIGNGTASRESEAFVADVLKDFPNTSYVIVNESGASVYSASELARHEFPDL  420

Query:  448  TVEKRSAISIARRLQDPLAELVKIDPKSIGVGQYQHDVSQKKLAENLDFVVETVVNQVGV  507
             TVEKRSAISIARRLQDPLAELVKIDPKSIGVGQYQHDVSQKKL+ENL FVV+TVVNQVGV
Sbjct:  421  TVEKRSAISIARRLQDPLAELVKIDPKSIGVGQYQHDVSQKKLSENLGFVVDTVVNQVGV  480

Query:  508  NVNTASPALLAHVSGLNKTISENIVKYREENGQIKSRAEIKKVPRLGAKAFEQAAGFLRI  567
             NVNTASP+LLAHVSGLNKTISENIVKYREENG + SRA+IKKVPRLGAKAFEQAAGFLRI
Sbjct:  481  NVNTASPSLLAHVSGLNKTISENIVKYREENGALTSRADIKKVPRLGAKAFEQAAGFLRI  540

Query:  568  PNAKNFLDNIGVHPESYEAVKKLLDQLTIKELDDLAKEKLQNLDLIATAESIGVGQETLK  627
             P AKN LDNTGVHPESY AVK+L   L I++LDD AK  L  + +   AE++ +GQETLK
Sbjct:  541  PGAKNILDNTGVHPESYPAVKELFKVLGIQDLDDAAKATLAAVQVPQMAETLAIGQETLK  600

Query:  628  DIIEDLLKPGRDLRDDFEAPVLRHDVLDVSDLKVGQELQGTVRNVVDFGAFVDIGVHEDG  687
             DII DLLKPGRDLRDDFEAP+LR D+LD+ DL++GQ+L GTVRNVVDFGAFVDIGVHEDG
Sbjct:  601  DIIADLLKPGRDLRDDFEAPILRQDILDLKDLEIGQKLEGTVRNVVDFGAFVDIGVHEDG  660

Query:  688  LIHQSRLIKRKRDKKTRKMPPLQHPSKYLSVGDIVTVWVVEVDAERSRIGLSLIKP     743
             LIH S + K          + HPS+ +SVGD+VTVWV ++D +R ++ LSL+ P
Sbjct:  661  LIHISEMSKTF----------VNHPSQVVSVGDLVTVWVSKIDLDRHKVNLSLLPP     706
```

Based on this analysis, it was predicted that these proteins and their epitopes could be useful antigens for vaccines or diagnostics.

Example 348

A DNA sequence (GBSx0379) was identified in *S. agalactiae* <SEQ ID 1129> which encodes the amino acid sequence <SEQ ID 1130>. This protein is predicted to be N5,N10-methylenetetrahydromethanopterin reductase homolog. Analysis of this protein sequence reveals the following:

```
Possible site: 60
>>> Seems to have no N-terminal signal sequence
----- Final Results -----
   bacterial cytoplasm --- Certainty = 0.4864 (Affirmative) <succ>
   bacterial membrane --- Certainty = 0.0000 (Not Clear) <succ>
   bacterial outside --- Certainty = 0.0000 (Not Clear) <succ>
```

The protein has homology with the following sequences in the GENPEPT database:

```
GP:AAB94650 GB:U96107 N5, N10-methylenetetrahydromethanopterin reductase
homolog [Staphylococcus carnosus]
Identities = 164/300 (54%), Positives = 217/300 (71%), Gaps = 1/300 (0%)
Query:   45  VYGIGEHHREDFAVSAPEIVLAAGAVRTNNIRLSSAVTILSSNDPIRVYQQFSTIDALSN  104
             +YG+GEHHR D+AVS P  VLAA A T  I+LSSAVT+LSS+DP+ VY++F+T+DA+SN
Sbjct:    1  MYGLGEHHRSDYAVSDPVTVLAAAASLTQRIKLSSAVTVLSSDDPVCVYERFATLDAVSN   60

Query:  105  GRAEIMAGRGSFIESFPLFGYDLADYDDLFNEKMDMLLAINSATNLDWKGHLTQTVNERP  164
             GRAEIM GRGSFIESFPLFGYDL DYD LF EK+++L  IN    +W+G +     +
Sbjct:   61  GRAEIMVGRGSFIESFPLFGYDLDDYDRLFVEKLELLKEINQHEVVTWEGTMRPAIKGLG  120

Query:  165  IYPRALQRQLPIWVATGGNVDSTIRIAEQGLPIVYATIGGNPKAFRQLVHIYKEVGSRNG  224
             +YPRA+Q ++PIW+ATGG +S+IR  AE GLPI YA IGGNPK F++ + IY+ V    G
Sbjct:  121  VYPRAVQDEIPIWLATGGTPESSIRAAEFGLPITYAIIGGNPKRFKRNIAIYRAVAESRG  180

Query:  225  HKPEQLKVAAHSWGWIEEDNQTAIDRYFFPTKQTVDNIAKGRPHWSEMTKEQYLRSVGPE  284
             +   + VA HSWG+I ++ A   ++ PTK   + IAK R +W   T+  + R + E
Sbjct:  181  YDLADMPVAVHSWGYIADTDEQAQREFYEPTKVHHEIIARER-NWPPYTEAHFQREISDE  239

Query:  285  GAIFVGSPEVVAHKIIGLVEALELDRFMLHLPVGSMPHKDVLNAIKLYGKEVAPIVRKYF  344
             GA+FVGSPE  VA K+I ++E L L+RFMLH+PVGSMPH+ ++ AIKLYGK V PI    YF
Sbjct:  240  GAMFVGSPETVARKMIKVIEELGLNREMLHIPVGSMPHERIMKAIKLYGKRVKPIIEDYF  299
```

No corresponding DNA sequence was identified in *S. pyogenes*.

Based on this analysis, it was predicted that this protein and its epitopes, could be useful antigens for vaccines or diagnostics.

Example 349

A DNA sequence (GBSx0380) was identified in *S. agalactiae* <SEQ ID 1131> which encodes the amino acid sequence <SEQ ID 1132>. Analysis of this protein sequence reveals the following:

---

Possible site: 22
>>> Seems to have no N-terminal signal sequence
----- Final Results -----
  bacterial cytoplasm --- Certainty = 0.1310 (Affirmative) <succ>
    bacterial membrane --- Certainty = 0.0000 (Not Clear) <succ>
      bacterial outside --- Certainty = 0.0000 (Not Clear) <succ>

---

A related GBS nucleic acid sequence <SEQ ID 9715> which encodes amino acid sequence <SEQ ID 9716> was also identified.

The protein has no significant homology with any sequences in the GENPEPT database.

A related DNA sequence was identified in *S. pyogenes* <SEQ ID 1133> which encodes the amino acid sequence <SEQ ID 1134>. Analysis of this protein sequence reveals the following:

---

Possible site: 25
>>> Seems to have no N-terminal signal sequence
----- Final Results -----
  bacterial cytoplasm --- Certainty = 0.0915 (Affirmative) <succ>
    bacterial membrane --- Certainty = 0.0000 (Not Clear) <succ>
      bacterial outside --- Certainty = 0.0000 (Not Clear) <succ>

---

An alignment of the GAS and GBS proteins is shown below:

```
Identities = 20/40 (50%), Positives = 27/40 (67%), Gaps = 3/40 (7%)
Query:  4   MAITHKRQDDLESMFASFAKVP---KPKKVDSDSKPEQKD           40
            MAITHK+ D+LE M A FA +P    KP +V++D K   K+
Sbjct:  1   MAITHKKNDELEKMLAGFASIPSFDKPLEVNTDGKLATKE           40
```

Based on this analysis, it was predicted that these proteins and their epitopes could be useful antigens for vaccines or diagnostics.

Example 350

A DNA sequence (GBSx0381) was identified in *S. agalactiae* <SEQ ID 1135> which encodes the amino acid sequence <SEQ ID 1136>. Analysis of this protein sequence reveals the following:

---

Possible site: 56
>>> Seems to have no N-terminal signal sequence
----- Final Results -----
  bacterial cytoplasm --- Certainty = 0.1453 (Affirmative) <succ>
    bacterial membrane --- Certainty = 0.0000 (Not Clear) <succ>
      bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 351

A DNA sequence (GBSx0382) was identified in *S. agalactiae* <SEQ ID 1137> which encodes the amino acid sequence <SEQ ID 1138>. Analysis of this protein sequence reveals the following:

---

Possible site: 37
>>> Seems to have an uncleavable N-term signal seq
INTEGRAL    Likelihood = -11.15   Transmembrane 216-232 (210-240)
INTEGRAL    Likelihood = -9.18    Transmembrane 15-31 (10-39)
INTEGRAL    Likelihood = -9.02    Transmembrane 283-299 (276-299)
INTEGRAL    Likelihood = -8.76    Transmembrane 128-144 (119-150)
INTEGRAL    Likelihood = -4.62    Transmembrane 243-259 (237-265)
INTEGRAL    Likelihood = -2.44    Transmembrane 65-81 (65-81)
INTEGRAL    Likelihood = -2.44    Transmembrane 94-110 (93-111)
----- Final Results -----
  bacterial membrane --- Certainty = 0.5458 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the GENPEPT database:

```
>GP:CAB12119 GB:Z99105 ycgR [Bacillus subtilis]
Identities = 141/283 (49%), Positives = 198/283 (69%), Gaps = 3/283 (1%)
Query:  10   SVLQWFAIFISIIIEALPFVLLGTILSGIIEVFITPDIVNKFLPKNKFLRVLFGTFVGFV   69
             S LQ  +IFISI+IEA+PF+L+G ILSGII++F++ +++ + +PKN+FL VLFG   G +
Sbjct:   6   SFLQLNSIFISILIEAIPFILIGVILSGIIQMFVSEEMIARIMPKNRFLAVLFGALAGVL   65

Query:  70   FPSCECGIIPIINRFLEKKVPSYTAVPFLATAPIINPIVLFATYSAFGNSIRFLILRFVG   129
             FP+CECGIIPI  R L K VP +   V F+ TAPIINPIVLF+TY AFGN    + R
Sbjct:  66   FPACECGIIPITRRLLLKGVPLHAGVAFMLTAPIINPIVLFSTYIAFGNRWSVVFYRGGL   125
```

-continued

```
Query:  130  ATIVAIALGVMLAFLVDDNILKEDAKPTHFHDYSDKKWYQKIFLALAHAIDEFFDTGRYL  189
             A   V++ +GV+L++    DN L +  +P H H +    QK+    L HAIDEFF  G+YL
Sbjct:  126  ALAVSLIIGVILSYQFKDNQLLKPDEPGHHHHHHGTL-LQKLGGTLRHAIDEFFSVGKYL  184

Query:  190  VFGTLIASAMQIYLPTRVLTTIGHSPITAILVMMLLAFILSLCSEADAFIGASLLSTFGI  249
             + G   IA+AMQ Y+ T  L   IG +  +++ LVMM LAF+LSLCSE DAFI +S   STF +
Sbjct:  185  IIGAFIAAAMQTYVKTSTLLAIGQNDVSSSLVMMGLAFVLSLCSEVDAFIASSFSSTFSL  244

Query:  250  APVMAFLLIGPMIDIKNLMMMVNSFKTRFIVQFISVSSLIIII                   292
             ++AFL+ G M+DIKNL+MM+ +FK RF+   F+ ++ +++I+
Sbjct:  245  GSLIAFLVFGAMVDIKNLLMMLAAFKKRFV--FLLITYIVVIV                   285
```

A related DNA sequence was identified in *S. pyogenes* <SEQ ID 1139> which encodes the amino acid sequence <SEQ ID 1140>. Analysis of this protein sequence reveals the following:

```
Possible site: 25
>>> Seems to have an uncleavable N-term signal seq
INTEGRAL    Likelihood = -9.92    Transmembrane 216-232 (211-237)
INTEGRAL    Likelihood = -9.45    Transmembrane 283-299 (276-299)
INTEGRAL    Likelihood = -8.76    Transmembrane 128-144 (119-150)
INTEGRAL    Likelihood = -7.80    Transmembrane 15-31 (10-39)
INTEGRAL    Likelihood = -5.47    Transmembrane 243-259 (237-265)
INTEGRAL    Likelihood = -2.44    Transmembrane 65-81 (65-81)
INTEGRAL    Likelihood = -2.44    Transmembrane 94-110 (93-111)
----- Final Results -----
   bacterial membrane --- Certainty = 0.4970 (Affirmative) <succ>
   bacterial outside --- Certainty = 0.0000 (Not Clear) <succ>
     bacterial cytoplasm --- Certainty = 0.0000 (Not Clear) <succ>
```

The protein has homology with the following sequences in the databases:

```
>GP:CAB12119 GB:Z99105 ycgR [Bacillus subtilis]
Identities = 143/288 (49%), Positives = 196/288 (67%), Gaps = 1/288 (0%)

Query:   10  SVLQWFAIFMSIIIEALPFVLLGTILSGCIEVFVTPELVQKYLPKQKCLRILFGTFVGFV   69
             S LQ  +IF+SI+IEA+PF+L+G ILSG I++FV+ E++ + +PK + L +LFG    G +
Sbjct:    6  SFLQLNSIFISILIEAIPFILIGVILSGIIQMFVSEEMIARIMPKNRFLAVLFGALAGVL   65

Query:   70  FPSCECGIIPIINRFLEKKVPSYTAVPFLATAPIINPIVLFATYSAFGNSLRFLILRLVG  129
             FP+CECGIIPI   R L K VP +   V F+ TAPIINPIVLF+TY AFGN    +  R
Sbjct:   66  FPACECGIIPITRRLLLKGVPLHAGVAFMLTAPIINPIVLFSTYIAFGNRWSVVFYRGGL  125

Query:  130  AALVAITLGVMLAFIVDDNILKDNAQPVHFHDYSHESLPKRIYLALVHAIDEFFDTGRYL  189
             A   V++ +GV+L++    DN L     +P H H + +L +++     L HAIDEFF  G+YL
Sbjct:  126  ALAVSLIIGVILSYQFKDNQLLKPDEPGH-HHHHHGTLLQKLGGTLRHAIDEFFSVGKYL  184

Query:  190  VFGTLIASAMQIYVPIRVLTTIGHNPLTAILIMMLMAFILSLCSEADAFIGASLLSTFGV  249
             + G   IA+AMQ  YV T  L   IG N +++ L+MM +AF+LSLCSE DAFI +S   STF +
Sbjct:  185  IIGAFIAAAMQTYVKTSTLLAIGQNDVSSSLVMMGLAFVLSLCSEVDAFIASSFSSTFSL  244

Query:  250  APVLAFLLIGPMVDIKNLMMMVKAFKGRFIVQFIGVSVLMIAVYCLLV              297
             ++AFL+ G MVDIKNL+MM+ AFK RF+    I   V+++       LLV
Sbjct:  245  GSLIAFLVFGAMVDIKNLLMMLAAFKKRFVFLLITYIVVIVLAGSLLV              292
```

An alignment of the GAS and GBS proteins is shown below:

```
Identities = 248/300 (82%), Positives = 278/300 (92%)

Query:    1  MDIFNQLPDSVLQWFAIFISIIIEALPFVLLGTILSGIIEVFITPDIVNKFLPKNKFLRV   60
             M +F+ LP SVLQWFAIF+SIIIEALPFVLLGTILSG IEVF+TP++V K+LPK K LR+
Sbjct:    1  MSLFSNLPPSVLQWFAIFMSIIIEALPFVLLGTILSGCIEVFVTPELVQKYLPKQKCLRI   60

Query:   61  LFGTFVGFVFPSCECGIIPIINRFLEKKVPSYTAVPFLATAPIINPIVLFATYSAFGNSI  120
             LFGTFVGFVFPSCECGIIPIINRFLEKKVPSYTAVPFLATAPIINPIVLFATYSAFGNS+
Sbjct:   61  LFGTFVGFVFPSCECGIIPIINRFLEKKVPSYTAVPFLATAPIINPIVLFATYSAFGNSL  120
```

-continued
```
Query:   121   RFLILRFVGATIVAIALGVMLAFLVDDNILKEDAKPTHFHDYSDKKWYQKIFLALAHAID      180
               RFLILR VGA +VAI LGVMLAF+VDDNILK++A+P HFHDYS +    ++I+LAL HAID
Sbjct:   121   RFLILRLVGAALVAITLGVMLAFIVDDNILKDNAQPVHFHDYSHESLPKRIYLALVHAID      180

Query:   181   EFFDTGRYLVFGTLIASAMQIYLPTRVLTTIGHSPITAILVMMLLAFILSLCSEADAFIG      240
               EFFDTGRYLVFGTLIASAMQIY+PTRVLTTIGH+P+TAIL+MML+AFILSLCSEADAFIG
Sbjct:   181   EFFDTGRYLVFGTLIASAMQIYVPTRVLTTIGHNPLTAILIMMLMAFILSLCSEADAFIG      240

Query:   241   ASLLSTFGIAPVMAFLLIGPMIDIKNLMMMVNSFKTRFIVQFISVSSLIIIIYCLFVGVI      300
               ASLLSTFG+APV+AFLLIGPM+DIKNLMMMV +FK RFIVQFI VS L+I +YCL VGV+
Sbjct:   241   ASLLSTFGVAPVLAFLLIGPMVDIKNLMMMVKAFKGRFIVQFIGVSVLMIAVYCLLVGVL      300
```

Based on this analysis, it was predicted that these proteins and their epitopes could be useful antigens for vaccines or diagnostics.

Example 352

A DNA sequence (GBSx0383) was identified in *S. agalactiae* <SEQ ID 1141> which encodes the amino acid sequence <SEQ ID 1142>. Analysis of this protein sequence reveals the following:

Possible site: 13
>>> Seems to have no N-terminal signal sequence
----- Final Results -----
    bacterial cytoplasm --- Certainty = 0.4703 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 353

A DNA sequence (GBSx0384) was identified in *S. agalactiae* <SEQ ID 1143> which encodes the amino acid sequence <SEQ ID 1144>. Analysis of this protein sequence reveals the following:

Possible site: 50
>>> Seems to have an uncleavable N-term signal seq
INTEGRAL    Likelihood = −8.44    Transmembrane 45-61 (39-65)
INTEGRAL    Likelihood = −8.12    Transmembrane 83-99 (77-101)
INTEGRAL    Likelihood = −0.00    Transmembrane 2-18 (1-19)
----- Final Results -----
    bacterial membrane --- Certainty = 0.4376 (Affirmative) <succ>
    bacterial outside --- Certainty = 0.0000 (Not Clear) <succ>
    bacterial cytoplasm --- Certainty = 0.0000 (Not Clear) <succ>

A related GBS nucleic acid sequence <SEQ ID 8559> which encodes amino acid sequence <SEQ ID 8560> was also identified. Analysis of this protein sequence reveals the following:

Lipop Possible site: −1    Crend: 2
SRCFLG: 0
McG: Length of UR: 8
Peak Value of UR: 2.23
Net Charge of CR: 1
McG: Discrim Score: 0.46
GvH: Signal Score (−7.5): −3.54
Possible site: 42
>>> Seems to have an uncleavable N-term signal seq
Amino Acid Composition: calculated from 1
ALOM program count: 2 value: −8.44 threshold: 0.0
INTEGRAL    Likelihood = −8.44    Transmembrane 37-53 (31-57)
INTEGRAL    Likelihood = −8.12    Transmembrane 75-91 (69-93)
PERIPHERAL  Likelihood = 2.76     200
modified ALOM score: 2.19
icml HYPID: 7 CFP: 0.438
*** Reasoning Step: 3
----- Final Results -----
    bacterial membrane --- Certainty = 0.4376 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database:

```
>GP:CAB12118 GB:Z99105 ycgQ [Bacillus subtilis]
Identities = 100/290 (34%), Positives = 159/290 (54%), Gaps = 25/290 (8%)

Query:     9   MIRFLILAGYFELSMYLKLSGKLNQYINTHYTYLAYISMVLSFILAIVQLIIWVKNMKMH       68
                   M R L+L G+       +L  SG L +YIN  Y YL++I++ L   IL  VQ  +++K+ +
    Sbjct:     1   MFRLLVLMGFTFFFYHLASGNLTKYINMKYAYLSFIAIFLLAILTAVQAYLFIKSPEKS       60

Query:    69   SHLHGKIA----------KSTSP--------MILVFPVLGLLVPTVSLDSTTVSAKGYN      110
                   H H       +    P       ++ +FP++ G+  P  +LDS+ V  KG++
    Sbjct:    61   GHHHDHDCGCGHDHEHDHEQNKPFYQRYLIYVVFLFPLVSGIFFPIATLDSSIVKTKGFS      120

Query:   111   FPLAAGSTGTVSQDGTRVQYLKPDTSTYFTSSAYEKEMQKELKKYKGSGTLTITTENYME      170
```

```
                F  A    S       SQ         QYL+PD  S  Y+     +Y+K+M++     KY      +++T  +++++
Sbjct:  121     FK-AMESGDHYSQ----TQYLRPDASLYYAQDSYDKQMKQLFNKYSSKKEISLTDDDFLK       175

Query:  171     VMELIYLYPEQFMDRQIQYTGFVY-NEPKHEGYQFIFRFGIIHCIADSGVYGLLTT-GNQ       228
                 ME  IY YP +F+ R I++ GF Y      ++    F+ RFGIIHCIADSGVYG+L
Sbjct:  176     GMETIYNYPGEFLGRTIEFHGFAYKGNAINKNQLFVLRFGIIHCIADSGVYGMLVEFPKD       235

Query:  229     KSYPDNTWVTVRGTIKSEYNQLLQQNLPVLHIEESRQVSKANNPYVYRVF                 278
                  D+ W+ ++GT+ SEY Q  +  LPV+ + +    + K ++PYVYR F
Sbjct:  236     MDIKDDEWIHIKGTLASEYYQPFKSTLPVVKVTDWNTIKKPDDPYVYRGF                 285
```

A related DNA sequence was identified in *S. pyogenes* <SEQ ID 1145> which encodes the amino acid sequence <SEQ ID 1146>. Analysis of this protein sequence reveals the following:

---

Possible site: 60
>>> Seems to have an uncleavable N-term signal seq
INTEGRAL      Likelihood = –8.33    Transmembrane 83-99 (74-101)
INTEGRAL      Likelihood = –6.21    Transmembrane 42-58 (39-62)
----- Final Results -----
    bacterial membrane --- Certainty = 0.4333 (Affirmative) <succ>
        bacterial outside --- Certainty = 0.0000 (Not Clear) <succ>
            bacterial cytoplasm --- Certainty = 0.0000 (Not Clear) <succ>

---

A related sequence was also identified in GAS <SEQ ID 9115> which encodes the amino acid sequence <SEQ ID 9116>. Analysis of this protein sequence reveals the following:

---

Possible cleavage site: 54
>>> Seems to have an uncleavable N-term signal seq
INTEGRAL      Likelihood = –8.33    Transmembrane 75-91 (66-93)
INTEGRAL      Likelihood = –6.21    Transmembrane 34-50 (31-54)
PERIPHERAL    Likelihood = 2.76
----- Final Results -----
    bacterial membrane --- Certainty = 0.433 (Affirmative) <succ>
        bacterial outside --- Certainty = 0.000 (Not Clear) <succ>
            bacterial cytoplasm --- Certainty = 0.000 (Not Clear) <succ>

---

Figure 146:
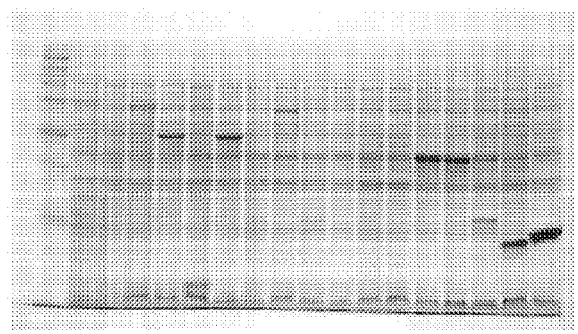

An alignment of the GAS and GBS proteins is shown below:

SEQ ID 8560 (GBS235d) was expressed in *E. coli* as a GST-fusion product. SDS-PAGE analysis of total cell extract is shown in FIG. 146 (lane 14 & 15; MW 48.5 kDa). It was also expressed in *E. coli* as a His-fusion product. SDS-PAGE analysis of total cell extract is shown in FIG. 146 (lane 17 & 18; MW 23.4 kDa), in FIG. 150 (lane 15; MW 23 kDa) and in FIG. 182 (lane 5; MW 23 kDa).

Figure 235:
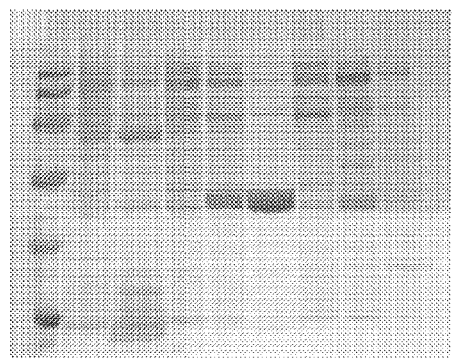

GBS235d-His was purified as shown in FIG. 235, lane 6-7.

Based on this analysis, it was predicted that these proteins and their epitopes could be useful antigens for vaccines or diagnostics.

Example 354

A DNA sequence (GBSx0385) was identified in *S. agalactiae* <SEQ ID 1147> which encodes the amino acid sequence <SEQ ID 1148>. This protein is predicted to be signal recognition particle (ftsY). Analysis of this protein sequence reveals the following:

---

Possible site: 57
>>> Seems to have no N-terminal signal sequence
----- Final Results -----
    bacterial cytoplasm --- Certainty = 0.3301 (Affirmative) <succ>
        bacterial membrane --- Certainty = 0.0000 (Not Clear) <succ>
            bacterial outside --- Certainty = 0.0000 (Not Clear) <succ>

---

The protein has homology with the following sequences in the GENPEPT database:

```
Identities = 208/279 (74%), Positives = 244/279 (86%), Gaps = 1/279 (0%)

Query:    1     MFICGGNIMIRFLILAGYFELSMYLKLSGKLNQYINTHYTYLAYISMVLSFILAIVQLII       60
                +F CGG +MIRFLILAGYFEL+MYL+LSGKL+QYIN  Y+YLAYISM+LSFILA+VQL
Sbjct:    1     LFTCGGALMIRFLILAGYFELTMYLQLSGKLDQYINVRYSYLAYISMILSFILALVQLYT       60

Query:   61     WVKNMKMHSHLHGKIAKSTSPMILVFPVLVGLLVPTVSLDSTTVSAKGYNFPLAAGSTGT       120
                W+KN+K+HSHL GKIA+ TSP ILVFPVL+GLLVPTV+LDSTTVSAKGY FPLAAG++ T
Sbjct:   61     WMKNIKVHSHLTGKIARLTSPFILVFPVLIGLLVPTVTLDSTTVSAKGYTFPLAAGASKT       120

Query:  121     -VSQDGTRVQYLKPDTSTYFTSSAYEKEMQKELKKYKGSGTLTITTENYMEVMELIYLYP       179
                 VS DGT +QYLKPDTS YFT SAY+KEM++EL KYKG   +TITTENYMEVMELIYLYP
Sbjct:  121     GVSDDGTTIQYLKPDTSLYFTKSAYQKEMRQELHKYKGKKPVTITTENYMEVMELIYLYP       180

Query:  180     EQFMDRQIQYTGFVYNEPKHEGYQFIFRFGIIHCIADSGVYGLLTTGNQKSYPDNTWVTV       239
                ++F+DR IQYTGFVYNEP H+ YQF+FRFGIIHCIADSGVYGLLTTGNQ SYP+NTW+TV
Sbjct:  181     DEFLDRDIQYTGFVYNEPGHDNYQFLFRFGIIHCIADSGVYGLLTTGNQTSYPNNTWLTV       240

Query:  240     RGTIKSEYNQLLQQNLPVLHIEESRQVSKANNPYVYRVF                            278
                +G +   EY++ L+Q+LPVL + E   Q   + NNPYVYRVF
Sbjct:  241     KGRLHMEYDKNLEQHLPVLQLAEVHQTKEPNNPYVYRVF                            279
```

```
>GP:BAB06205 GB:AP001515 signal recognition particle (docking protein)
[Bacillus halodurans]
Identities = 175/304 (57%), Positives = 227/304 (74%)

Query:   233 EKYNRSLKKTRTGESARLNAFLSNFRRVDEEFFEELEEMLILSDVGVNVATQLTEDLRYE    292
             EK+   L+KTR F+ ++N +  +R VDE+FFEELEE+LI +DVGV      L E+L+ E
Sbjct:    20 EKFKAGLEKTRDSFAGKMNDLVYKYRSVDEDFFEELEEILIGADVGVTTVMDLVEELKDE     79

Query:   293 AKLENAKKSEDLKRVIVEKLVEIYEKDGIYNEAINFQEGLTVMLFVGVNGVGKTTSIGKL    352
             + +N K S+D++ +I EKL E+ EK+G  E       GL+V+L VGVNGVGKTTSIGKL
Sbjct:    80 VRRQNIKDSKDIQPIISEKLAELLEKEGGETEVNLQPAGLSVILVVGVNGVGKTTSIGKL    139

Query:   353 AHQYKSQGKKVMLVAADTFRAGAVAQLVEWGRRVDVPVVTGEEKADPASVVFDGMEKAVA    412
             AH YK QGKKV+L A DTFRAGA+ QL  WG R  V V+   E +DPA+V+FD ++ A +
Sbjct:   140 AHMYKQQGKKVILAAGDTFRAGAIEQLEVWGERAGVDVIKQSEGSDPAAVMFDAIQAAKS    199

Query:   413 QGVDVLLIDTAGRLQNKENLMAELEKIGRIIKRVVPDAPHETLLALDASTGQNALSQAKE    472
              +  D+L+ DTAGRLQNK NLM ELEK+ R+I R +P APHE L+ALDA+TGQNA+SQAK
Sbjct:   200 READILICDTAGRLQNKVNLMKELEKVKRVISREIPGAPHEVLIALDATTGQNAMSQAKT    259

Query:   473 FSKITPLTGLILTKIDGTAKGGVVLAIRQELDIPVKFIGFGEKIDDIGEFNSEDFMRGLL    532
             F + T +TG+ILTK+DGTAKGG+VLAIR ELDIPVKF+G GEKIDD+  F+SE F+ GL
Sbjct:   260 FKETTDVTGIILTKLDGTAKGGIVLAIRHELDIPVKFVGLGEKIDDLQPFDSEQFVYGLF    319

Query:   533 EGIL                                                          536
             + ++
Sbjct:   320 KDMV                                                          323
```

A related DNA sequence was identified in *S. pyogenes* <SEQ ID 1149> which encodes the amino acid sequence <SEQ ID 1150>. Analysis of this protein sequence reveals the following:

Possible site: 60
>>> Seems to have no N-terminal signal sequence

-continued

----- Final Results -----
bacterial cytoplasm --- Certainty = 0.4384 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below:

```
Identities = 339/549 (61%), Positives = 404/549 (72%), Gaps = 46/549 (8%)

Query:     1 MGLFDRLFGHKKKDKEPEIEASESVVLEDEDSVIDKEEGSNFSKESTLNRTSEVPVAEDD     60
             MGLFDRLFG K+  K  E + E+++ E      KEE S  + E       ++  + +
Sbjct:     1 MGLFDRLFGKKETPKVAEEKLEENLLTE----TTQKEELSEKANEQ-----DKIEAVQQE     51

Query:    61 SFLELERDTALSESHQPVTSEIHPLESEDTDEIPVKEDDSFLELEDRAKTKVADTSEVEN    120
             ++   + A S  P   ++ L  E+T             D +     DT+E
Sbjct:    52 ---DVSSEGAGSVENGPEAASVNALVEEETG--------------DNSNHPSEDTNEF--     92

Query:   121 VVPDSTTLSDNVSAKSEASFSDKEQLSDSQASDQFSETPLQEEMS--SGKTEVQTESEDT    178
                 D T L    VS  S+++ S+ + L D   +QF    Q + S  S   E    S++
Sbjct:    93 -AADKTDLK--VSELSQSTASEPKDLVDQPVVEQFPTKQAQADASNDSANEEAVDTSKEQ    149

Query:   179 SAADAFLADYYAKRKAIEKEISSNSLST---------DESEFSEAQEVLSQSQA--DTIK    227
             S++     + DYY ++ A+EK +     +T           E++  S + E  SQ++A  DTI
Sbjct:   150 SSSQQVMEDYYRRKAALEKSLQEKAAATVPVMPEEVPQENQASTSAEA-SQNKATHDTIP    208

Query:   228 AESQEEKYNRSLKKTRTGFSARLNAFLSNFRRVDEEFFEELEEMLILSDVGVNVATQLTE    287
             E+ +EKY RSLKKTRTGFSARLN+F +NFRRVDEEFFE+LEEMLILSDVGV+VAT LTE
Sbjct:   209 -ETDQEKYKRSLKKTRTGFSARLNSFFANFRRVDEEFFEDLEEMLILSDVGVHVATTLTE    267

Query:   288 DLRYEAKLENAKKSEDLKRVIVEKLVEIYEKDGIYNEAINFQEGLTVMLFVGVNGVGKTT    347
             +LRYEAKLENAKK + LKRVIVEKLV+IYEKDG YNEAIN+Q+GLTVMLFVGVNGVGKTT
Sbjct:   268 ELRYEAKLENAKKPDALKRVIVEKLVDIYEKDGRYNEAINYQDGLTVMLFVGVNGVGKTT    327

Query:   348 SIGKLAHQYKSQGKKVMLVAADTFRAGAVAQLVEWGRRVDVPVVTGEEKADPASVVFDGM    407
             SIGKLA++YK +GKKVMLVAADTFRAGAVAQLVEWGRRVDVPV+TG EKADPASVVFDGM
Sbjct:   328 SIGKLAYRYKQEGKKVMLVAADTFRAGAVAQLVEWGRRVDVPVITGPEKADPASVVFDGM    387

Query:   408 EKAVAQGVDVLLIDTAGRLQNKENLMAELEKIGRIIKRVVPDAPHETLLALDASTGQNAL    467
             EKAVA+GVD+LLIDTAGRLQNKENLMAELEK+GRIIKRV+PDAPHETLLALDASTGQNAL
Sbjct:   388 EKAVAKGVDILLIDTAGRLQNKENLMAELEKMGRIIKRVLPDAPHETLLALDASTGQNAL    447

Query:   468 SQAKEFSKITPLTGLILTKIDGTAKGGVVLAIRQELDIPVKFIGFGEKIDDIGEFNSEDF    527
             SQAKEFSKITPLTGLILTKIDGTAKGGVVLAIRQELDIPVKFIGFGEK+DDIGEF+SEDF
Sbjct:   448 SQAKEFSKITPLTGLILTKIDGTAKGGVVLAIRQELDIPVKFIGFGEKVDDIGEFHSEDF    507
```

```
Query:  528  MRGLLEGIL                                                536
             M+GLLEGIL
Sbjct:  508  MKGLLEGIL                                                516
```

Based on this analysis, it was predicted that these proteins and their epitopes could be useful antigens for vaccines or diagnostics.

Example 355

A DNA sequence (GBSx0386) was identified in *S. agalactiae* <SEQ ID 1151> which encodes the amino acid sequence <SEQ ID 1152>. Analysis of this protein sequence reveals the following:

Possible site: 52
>>> Seems to have no N-terminal signal sequence
----- Final Results -----
    bacterial cytoplasm --- Certainty = 0.3592 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database:

A related DNA sequence was identified in *S. pyogenes* <SEQ ID 1153> which encodes the amino acid sequence <SEQ ID 1154>. Analysis of this protein sequence reveals the following:

Possible site: 32
>>> Seems to have no N-terminal signal sequence
----- Final Results -----
    bacterial cytoplasm --- Certainty = 0.3502 (Affirmative) <succ>
    bacterial membrane --- Certainty = 0.0000 (Not Clear) <succ>
    bacterial outside --- Certainty = 0.0000 (Not Clear) <succ>

```
>GP:AAA62048 GB:L10328 f270 [Escherichia coli]
Identities = 101/273 (36%), Positives = 160/273 (57%), Gaps = 10/273 (3%)

Query:    4  IKILALDLDGTLFTTDKKVSEENKVALKAAREKGIKVVITTGRPLKAIGNLLEDLELVSD   63
             IK++A+D+DGTL   D  +S   K A+ AAR +G+ VV+TTGRP   + N L++L +
Sbjct:    3  IKLIAIDMDGTLLLPDHTISPAVKNAIAAARARGVNVVLTTGRPYAGVHNYLKELHMEQP   62

Query:   64  EDYSITFNGGLVQQNT-GKILAKTAMTRQEVEDIHEELYQVGLPTDILSEGTVYS----I  118
             DY IT+NG LVQ+  G  +A+TA++  +    +  +VG    L   T+Y+    I
Sbjct:   63  GDYCITYNGALVQKAADGSTVAQTALSYDDYRXLEKLSREVGSHFHALDRTTLYTANRDI  122

Query:  119  ANKGHHSQYHLANPLLEFIEVDDLEQVPKDVVYNKIVSVIDATYLDQQIAKLPDRLKVDY  178
             +     H +    PL+ F E     E++ +  + K++ + +   LDQ IA++P +K   Y
Sbjct:  123  SYYTVHESFVATIPLV-FCEA---EKMDPNTQFLKVMMIDEPAILDQAIARIPQXVKEKY  178

Query:  179  EMFKSRDIILELMPKGVHKAVGLELLTKHLGLDSSQVMAMGDEANDLSMLEWAGLGVAMA  238
              + KS    LE++ K V+K  G++ L   LG+   ++MA+GD+ ND++M+E+AG+GVAM
Sbjct:  179  TVLKSAPYFLEILDKRVNKGTGVKSLADVLGIKPEEIMAIGDQENDIAMIEYAGVGVAMD  238

Query:  239  NGIPEAKAIAKATTICNNDESGVAEAIGKYILS                            271
             N IP  K +A  T  +N E GVA AI KY+L+
Sbjct:  239  NAIPSVKEVANFVT-KSNLEDGVAFAIEKYVLN                            270
```

An alignment of the GAS and GBS proteins is shown below:

```
Identities = 180/273 (65%), Positives = 218/273 (78%), Gaps = 1/273 (0%)

Query:    3  DIKILALDLDGTLFTTDKKVSEENKVALKAAREKGIKVVITTGRPLKAIGNLLEDLELVS   62
             +I+ILALDLDGTL+ T+K V++ NK AL AAREKG+KVVITTGRPLKAIGNLLE+L+L+
Sbjct:    2  NIRILALDLDGTLYNTEKIVTDANKKALAAAREKGVKVVITTGRPLKAIGNLLEELDLLD   61

Query:   63  DEDYSITFNGGLVQQNTGKILAKTAMTRQEVEDIHEELYQVGLPTDILSEGTVYSIANK-  121
             +DYSITFNGGLVQ+NTG++L K++++   +V I + L  VGLPTDI+S G VYSI +K
Sbjct:   62  HDDYSITFNGGLVQRNTGEVLDKSSLSFDQVCQIQQALEAVGLPTDIISGGDVYSIPSKD  121

Query:  122  GHHSQYHLANPLLEFIEVDDLEQVPKDVVYNKIVSVIDATYLDQQIAKLPDRLKVDYEMF  181
             G HSQYHLANPLL FIEV  ++PKD+ YNKIV+V D   +LDQQI KL   L  D+E F
Sbjct:  122  GRHSQYHLANPLLTFIEVTSVAELPKDITYNKIVTVTDPDFLDQQIIKLSPSLFEDFEAF  181

Query:  182  KSRDIILELMPKGVHKAVGLELLTKHLGLDSSQVMAMGDEANDLSMLEWAGLGVAMANGI  241
             KSRDII E+MPKG+ KA GL LL +HLGLD+  VMAMGDEAND +MLEWAGLGVAMANG+
```

```
                        -continued
Sbjct:  182  KSRDIIFEIMPKGIDKAFGLNLLCQHLGLDARHVMAMGDEANDFAMLEWAGLGVAMANGV  241

Query:  242  PEAKAIAKATTICNNDESGVAEAIGKYILSEEN                             274
             AKA A A T   NDESGVAEA+ +IL EE+
Sbjct:  242  SGAKADADAVTTLTNDESGVAEAVKTFILEEES                             274
```

Based on this analysis, it was predicted that these proteins and their epitopes could be useful antigens for vaccines or diagnostics.

Example 356

A DNA sequence (GBSx0387) was identified in *S. agalactiae* <SEQ ID 1155> which encodes the amino acid sequence <SEQ ID 1156>. Analysis of this protein sequence reveals the following:

```
Possible site: 49
>>> Seems to have no N-terminal signal sequence
----- Final Results -----
   bacterial cytoplasm --- Certainty = 0.4648 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database:

```
>GP:BAA35556 GB:D90723 Hypothetical 30.2 kd protein in idh-deoR
intergenic region. [Escherichia coli]
Identities = 91/264 (34%), Positives = 146/264 (54%), Gaps = 4/264 (1%)

Query:    2  IKLVATDMDGTFLDENGTYDKKRLANVLKKFKEQGIVFTAASGRSLLSLEQLFADFRDQM    61
             IKL+A DMDGTFL +  TY+++R      ++ K QGI F  ASG      L    F +  +++
Sbjct:    4  IKLIAVDMDGTFLSDQKTYNRERFMAQYQQMKAQGIRFVVASGNQYYQLISFFPEIANEI    63

Query:   62  AFIAENGSAAVLFNRLAYEQHLSREQYLDIIDHLSKSPYMENNEYVLSGKDGAYILSDAN   121
             AF+AENG    V    +   +    LS++ +   +++HL    P +     E +   GK+ AY L    +
Sbjct:   64  AFVAENGGWVVSEGKDVFNGELSKDAFATVVEHLLTRPEV---EIIACGKNSAYTLKKYD   120

Query:  122  PDYIEFITHYYDNLQKVSHFEDVDDIIFKVTANFTEETVRQAEEWVNQAI-PYATAVTTG   180
                         YY   L+ V +F++++DI  FK     N ++E + Q ++ +++AI       +V TG
Sbjct:  121  DAMKTVAEMYYHRLEYVDNFDNLEDIFFKFGLNLSDELIPQVQKALHEAIGDIMVSVHTG   180

Query:  181  FKSIDIILSSVNKRNGLEHLCEQYGIRAEEVLSFGDNINDLEMLEWSGKAIATENARPEV   240
               SID+I+   V+K NGL   L + +GI    EV+ FGD   ND+EML    +G + A ENA    V
Sbjct:  181  NGSIDLIIPGVHKANGLRQLQKLWGIDDSEVVVFGDGGNDIEMLRQAGFSFAMENAGSAV   240

Query:  241  KEIADCIIGHHNNQAVMAYLESMV                                       264
               A     G +N + V+   ++ ++
Sbjct:  241  VAAAKYRAGSNNREGVLDVIDKVL                                       264
```

A related DNA sequence was identified in *S. pyogenes* <SEQ ID 1157> which encodes the amino acid sequence <SEQ ID 1158>. Analysis of this protein sequence reveals the following:

```
Possible site: 49
>>> Seems to have no N-terminal signal sequence
----- Final Results -----
   bacterial cytoplasm --- Certainty = 0.3401 (Affirmative) <succ>
      bacterial membrane --- Certainty = 0.0000 (Not Clear) <succ>
         bacterial outside --- Certainty = 0.0000 (Not Clear) <succ>
```

An alignment of the GAS and GBS proteins is shown below:

```
Identities = 138/265 (52%), Positives = 193/265 (72%), Gaps = 1/265 (0%)

Query:    1  MIKLVATDMDGTFLDENGTYDKKRLANVLKKFKEQGIVFTAASGRSLLSLEQLFADFRDQ    60
             MIKL+ATDMDGTFL E+GTY++++LA +L K  E+GI+F  +SGRSLL+++QLF F DQ
Sbjct:    1  MIKLIATDMDGTFLAEDGTYNQEQLAALLPKLAEKGILFAVSSGRSLLAIDQLFEPFLDQ    60

Query:   61  MAFIAENGSAAVLFNRLAYEQHLSREQYLDIIDHLSKSPYMENNEYVLSGKDGAYILSDA   120
             +A IAENGS    + +  +++EQY ++   + +P+     V SG+ AYIL  A
Sbjct:   61  IAVIAENGSVVQYRGEILFADMMTKEQYTEVAKKILANPHYVETGMVFSGQKAAYILKGA   120

Query:  121  NPDYIEFITHYYDNLQKVSHFEDVD-DIIFKVTANFTEETVRQAEEWVNQAIPYATAVTT   179
             + +YI+   HYY N++ ++ FED++ D IFKV+ NFT  TV +  +W+NQA+PYATAVTT
Sbjct:  121  SEEYIQKTKHYYANVKVINGFEDMENDAIFKVSTNFTGHTVLEGSDWLNQALPYATAVTT   180

Query:  180  GFKSIDIILSSVNKRNGLEHLCEQYGIRAEEVLSFGDNINDLEMLEWSGKAIATENARPE   239
             GF SIDIIL  VNK G+EHLC+  GI+  E ++FGDN ND +MLE++G+AIATENARPE
Sbjct:  181  GFDSIDIILKEVNKGEGMEHLCQALGIKKAETIAFGDNFNDYQMLEFAGRAIATENARPE   240

Query:  240  VKEIADCIIGHHNNQAVMAYLESMV                                    264
             +K I+D +IGH N+ AV+ YL+ +V
Sbjct:  241  IKVISDQVIGHCNDGAVLTYLKGLV                                    265
```

Based on this analysis, it was predicted that these proteins and their epitopes could be useful antigens for vaccines or diagnostics.

Example 357

A DNA sequence (GBSx0388) was identified in *S. agalactiae* <SEQ ID 1159> which encodes the amino acid sequence <SEQ ID 1160>. Analysis of this protein sequence reveals the following:

Possible site: 18
>>> Seems to have no N-terminal signal sequence
----- Final Results -----
   bacterial cytoplasm --- Certainty = 0.2428 (Affirmative) <succ>
      bacterial membrane --- Certainty = 0.0000 (Not Clear) <succ>
         bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 358

A DNA sequence (GBSx0389) was identified in *S. agalactiae* <SEQ ID 1161> which encodes the amino acid sequence <SEQ ID 1162>. This protein is predicted to be p115 protein (smc). Analysis of this protein sequence reveals the following:

Possible site: 55
>>> Seems to have no N-terminal signal sequence
INTEGRAL      Likelihood = –4.99      Transmembrane 1092-1108
                                      (1088-1110)
----- Final Results -----
   bacterial membrane --- Certainty = 0.2996 (Affirmative) <succ>
      bacterial outside --- Certainty = 0.0000 (Not Clear) <succ>
         bacterial cytoplasm --- Certainty = 0.0000 (Not Clear) <succ>

A related GBS nucleic acid sequence <SEQ ID 9713> which encodes amino acid sequence <SEQ ID 9714> was also identified.

The protein has homology with the following sequences in the GENPEPT database:

```
>GP:CAB13467 GB:Z99112 chromosome segregation SMC protein homolg
[Bacillus subtilis]
Identities = 458/1193 (38%), Positives = 728/1193 (60%), Gaps = 27/1193 (2%)

Query:    1  MFLKEIEMQGFKSFADKTKVEFDQGVTAVVGPNGSGKSNITESLRWALGESSAKSLRGGK    60
             MFLK +++ GFKSFA++  V+F +GVTAVVGPNGSGKSNIT+++RW LGE SA+SLRGGK
Sbjct:    1  MELKRLDVIGFKSFAERISVDFVKGVTAVVGPNGSGKSNITDAIRWVLGEQSARSLRGGK    60

Query:   61  MPDVIFAGTENRKPLNYAQVSVTLDNSDHFIENIADEVRVERRIFRNGDSEYLIDGRKVR   120
             M D+IFAG+++RK LN A+V++TLDN DHF+       EV V RR++R+G+SE+LI+ + R
Sbjct:   61  MEDIIFAGSDSRKRLNLAEVTLTLDNDDHFLPIDFHEVSVTRRVYRSGESEFLINNQPCR   120

Query:  121  LRDIHDLFMDTGLGRDSFSIISQGRVEAIFNSKPEERRAIFEEAAGVLKYKTRKKETQSK   180
             L+DI DLFMD+GLG+++FSIISQG+VE I +SK E+RR+IFEEAAGVLKYKTRKK+ ++K
Sbjct:  121  LKDIIDLFMDSGLGKEAFSIISQGKVEEILSSKAEDRRSIFEEAAGVLKYKTRKKKAENK   180

Query:  181  LEQTQGNLDRLEDIIYELDMQVQPLEKQASIAKRFLVLDEERQGLHLSILIEDILQHQSD   240
             L +TQ NL+R+EDI++EL+ QV+PL+  QASIAK  +L    +E + + +++   DI +
Sbjct:  181  LFETQDNLNRVEDILHELEGQVEPLKIQASIARDYLEKKKELEHVEIALTAYDIEKLHGK   240

Query:  241  LTTVEEKLLTVRKELATYYQQRQSLEDENQSLKQKRHHLSEEIEAKQLALLDVTKLKSDL   300
             +T++ EK+   ++E          + E +  + K    L E+      Q LL ++    L
Sbjct:  241  WSTLKEKVQMAKEEELAESSAISAKEAKIEDTRDKIQALDESVNELQQVLLVTSEELEKL   300
```

-continued

```
Query:    301 ERQIDLIRLESNQKAEKKEEAGQRLAELEIKAKDCSDQITQKNIELTTLSEKIAQIRSEI  360
              E + ++++      + +E+ + + + + K      ++++++     TL  ++ Q+R+++
Sbjct:    301 EGRKEVLKERKKNAVQNQEQLEEAIVQFQQKETVLKEELSKQEAVFETLQAEVKQLRAQV  360

Query:    361 VSTESSLERFSTNPDQIIEKLREDFVTLMQEEADTSNALTALLADIENQKASQAKSQEI   420
              + +L +N  ++ IE+L+ D+  L+  +A    N L  LL D  +Q   +  +  +
Sbjct:    361 KEKQQALSLHNENVEEKIEQLKSDYFELLNSQASIRNEL-QLLDDQMSQSAVTLQRLADN  419

Query:    421 QEVSKNLEVLKSNAKVALE-RFEAAKKNVRQLLSHYQDLGQTLQNLEGEYKNQQSILFDH  479
              E           S  K A E F  ++ +   + Y+D+     + + +Y+   +S L+
Sbjct:    420 NEKHLQERHDISARKAACETEFARIEQEIHSQVGAYRDMQTKYEQKKRQYEKNESALYQA  479

Query:    480 LDEIKSKQARISSLESILKNHSNFYAGVKSVLQAKDQLGGIIGAVSEHLSFDKHYQTALE  539
                 ++  +++    LE++   +S FY GVK VL+AK++LGGI GAV E +S ++ Y+TA+E
Sbjct:    480 YQYVQQARSKKDMLETMQGDFSGFYQGVKEVLKAKERLGGIRGAVLELISTEQKYETAIE  539

Query:    540 IALGGSSQHIIVEDESAAKRSIAFLKKNRQGRATFLPLTTIKPRELAQHYLSKLQSSQGF  599
              IALG S+QH++ +DE +A+++I +LK+N  GRATFLPL+ I+ R+L                F
Sbjct:    540 IALGASAQHVVTDDEQSARKAIQYLKQNSFGRATFLPLSVIRDRQLQSRDAETAARHSSF  599

Query:    600 LGIASELVTYDQRLSNIFKNNLGLTAIFDTVDNANVAARQLNYQVRLVTLDGTELRPGGS  659
              LG+ASELVT+D    ++ +N LG   I + +  AN  A+ L ++ R+VTL+G  + PGGS
Sbjct:    600 LGVASELVTFDPAYRSVIQNLLGTVLITEDLKGANELAKLLGHRYRIVTLEGDVVNPGGS  659

Query:    660 YSGGANRQNNTVFI--KPELDNLKKELKQAQSKQLIQEKEVATLLEQLKEKQETLAQLKN  717
              +GGA ++ N   +        EL+++ K L + + K    + E+EV TL   +++ ++ LA L+
Sbjct:    660 MTGGAVKKKNNSLLGRSRELEDVTKRLAEMEEKTALLEQEVKTLKHSIQDMEKKLADLRE  719

Query:    718 DGEQARLEEQRADIEYQQLSEKLADLNKLYNGLQLSSGALEQTTSENE--KNRLEKELEQ  775
                GE   RL++Q   + +L    ++N        AL ++   E +  K  +LE+EL
Sbjct:    720 TGEGLRLKQQDVKGQLYELQVAEKNINTHLELYDQEKSALSESDEERKVRKRKLEEELSA  779

Query:    776 FAIKKEELTTSIAQIKEDKDSIQEKVNNLTTLLSEAQLEERDLLNEQKFERANCTRL---  832
              +  K ++L    I ++ + K +       +L+  L+E ++          K E   N  RL
Sbjct:    780 VSEKMKQLEEDIDRLTKQKQTQSSTKESLSNELTELKIAAAKKEQACKGEEDNLARLKKE  839

Query:    833 ----EITLSEIKRDISNLQTLLSHQDSQLDKEELPRIEKQLLQVNNRRENDEEKLVSLRF  888
                      E+ L  E K D+S L + +S    S       E++L +  + ND+ K + L
Sbjct:    840 LTETELALKEAKEDLSFLTSEMSSSTSG---------EEKLEEAAKHKLNDKTKTIELIA  890

Query:    889 ELEDCEAALDDLAASLAKEGQKNESLIRQQAQL----ESQCEQLSQQLMIFSRQLSEDYQ  944
                 D    L     + +E ++  + L +Q+      L        E +  ++   +L   +E+Y
Sbjct:    891 LRRDQRIKLQHGLDTYERELKEMKRLYKQKTTLLKDEEVKLGRMEVELDNLLQYLREEYS  950

Query:    945 MTLDEAKVKANVLEDILMAREQLKSLQAKIKALGPVNIDAIAQFEEVHERLTFLNTQRDD  1004
              ++ + + AK K   + D     AR+++K ++     I+ LG VN+ +I +FE V+ER  FL+ Q++D
Sbjct:    951 LSFEGAKEKYQLETDPEEARKRVELIKLAIEELGTVNLGSIDEFERVNERYKFLSEQKED  1010

Query:   1005 LVHAKNLLLETITDMDDEVKTRFKSTFEAIRHSFKETFVQMFGGGSADLILTE-GDLLSA  1063
              L  AKN  L +   I  +MD+E+   RF   TF   IR    F   + F +FGGG A+L LT+    DLL +
Sbjct:   1011 LTEAKNTLFQVIEEMDEEMTKRFNDTFVQIRSHFDQVFRSLFGGGRAELRLTDPNDLLHS  1070

Query:   1064 GVDISVQPPGKKIQSLNLMSGGEKALSALALLFAIIRVKTIPFVILDEVEAALDEANVKR  1123
              GV+I   QPPGKK+Q+LNL+SGGE+AL+A+ ALLF+I++V+   +PF +LDEVEAALDEANV R
Sbjct:   1071 GVEIIAQPPGKKLQNLNLLSGGERALTAIALLFSILKVRPVPFCVLDEVEAALDEANVFR  1130

Query:   1124 FGDYLNRFDKSSQFIVVTHRKGTMSAADSIYGVTMQESGVSKIVSVKLKEAQE         1176
              F   YL ++    +QFIV+THRKGTM    AD  +YGVTMQESGVSK++SVKL+E +E
Sbjct:   1131 FAQYLKKYSSDTQFIVITHRKGTMEEADVLYGVTMQESGVSKVISVKLEETKE          1183
```

A related DNA sequence was identified in *S. pyogenes* <SEQ ID 1163> which encodes the amino acid sequence <SEQ ID 1164>. Analysis of this protein sequence reveals the following:

Possible site: 15
>>> Seems to have no N-terminal signal sequence
INTEGRAL    Likelihood = –4.99    Transmembrane 1092-1108

-continued (1088-1110)

----- Final Results -----
bacterial membrane --- Certainty = 0.2996 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the databases:

>GP:CAB13467 GB:Z99112 chromosome segregation SMC protein homolg
[Bacillus subtilis]
Identities = 441/1192 (36%), Positives = 729/1192 (60%), Gaps = 25/1192 (2%)

```
Query:    1 MFLKEIELEGFKSFADKTKIEFDKGVTAVVGPNGSGKSNITESLRWALGESSAKNLRGGK    60
            MFLK +++ GFKSFA++  ++F KGVTAVVGPNGSGKSNIT+++RW LGE SA++LRGGK
Sbjct:    1 MFLKRLDVIGFKSFAERISVDFVKGVTAVVGPNGSGKSNITDAIRWVLGEQSARSLRGGK    60

Query:   61 MPDVIFAGTQNRNPLNYAKVAVVLDNSDHFIKTAKKEIRVERHIYRNGDSDYLIDGRKVR   120
            M D+IFAG+ +R  LN A+V + LDN DHF+      E+ V R +YR+G+S++LI+ + R
Sbjct:   61 MEDIIFAGSDSRKRLNLAEVTLTLDNDDHFLPIDFHEVSVTRRVYRSGESEFLINNQPCR   120

Query:  121 LRDIHDLFMDTGLGRDSFSIISQGRVEEIFNSKPEERRAIFEEAAGVLKYKTRKKETQIK   180
            L+DI DLFMD+GLG+++FSIISQG+VEEI +SK E+RR+IFEEAAGVLKYKTR+K + K
Sbjct:  121 LKDIIDLFMDSGLGKEAFSIISQGKVEEILSSKAEDRRSIFEEAAGVLKYKTRKKKAENK   180

Query:  181 LNQTQDNLDRLEDIIYELDTQLAPLEKQAKVAKQFLELDANRKQLQLDILVKDIDIAQER   240
            L +TQDNL+R+EDI++EL+ Q+ PL+ QA +AK +LE     + +++   DI+      +
Sbjct:  181 LFETQDNLNRVEDILHELEGQVEPLKIQASIAKDYLEKKKELEHVEIALTAYDIEKLHGK   240

Query:  241 QTKDTEALAALQQDLASYYAKRQSMEEDYQKFKQKKQVLSQESDQTQTTLLELTKLIADL   300
            +    E+    +++  +   +    +E    + + +KQ L +    +  LL  ++   L
Sbjct:  241 WSTLKEKVQMAKEEELAESSAISAKEAKIEDTRDKIQALDESVNELQQVLLVTSEELEKL   300

Query:  301 EKQIELVKLESGQEAEKKAEAKKHLEQLQEQLDGFQAEEKQCTEQLLH-------IDQQL   353
            E + E++K      E+K  A ++ EQL+E +   FQ +E  +        +     ++
Sbjct:  301 EGRKEVLK-------ERKKNAVQNQEQLEEAIVQFQQKETVLKEELSKQEAVFETLQAEV   353

Query:  354 CDVKQQLNELSNALERFSSDPDQLMETLREEFVLLMQKEAALSNQLTALKAHLDKEKQAR   413
               ++ Q+ E   AL    +  + +++ +E L+ ++  L+   +A++ N+L   L   + +
Sbjct:  354 KQLRAQVKEKQQALSLHNENVEEKIEQLKSDYFELLNSQASIRNELQLLDDQMSQSAVTL   413

Query:  414 QHKAQEYQLLVTKLDQLNDESQKAQAHYKAQKEQVEMLLQNYQEGDKRVQELERDYQLNQ   473
            Q   A  + ++     ++    ++    +        ++++ +  + Y++  + ++ R Y+ N+
Sbjct:  414 QRLADNNEKHLQERHDISARKAACETEFARIEQEIHSQVGAYRDMQTKYEQKRQYEKNE   473

Query:  474 ERLFDLLDQKKGKEARKASLESIQKSHSQFYAGVRAVLQSQKKLGGIIGAVSEHLSFDSD   533
                  L+    +  ++K  LE++Q   S FY GV+ VL+++++LGGI GAV E +S +
Sbjct:  474 SALYQAYQYVQQARSKKDMLETMQGDFSGFYQGVKEVLKAKERLGGIRGAVLELISTEQK   533

Query:  534 YQTALEVALGANSQHIIVTDEAAAKRAIAYLKKNRQGRATFLPLTTIKARSLSEHYHRQL   593
            Y+TA+E+ALGA++QH++  DE +A++AI YLK+N GRATFLPL+ I+ R L
Sbjct:  534 YETAIEIALGASAQHVVTDDEQSARKAIQYLKQNSFGRATFLPLSVIRDRQLQSRDAETA   593

Query:  594 ATCEGYLGTAESLIRYDDSLAIIQNLLSSTAIFETIDQANIAARLLGYKVRIVTLDGTE   653
            A    +LG A  L+ +D + ++IQNLL +  I E + AN A+LLG++ RIVTL+G
Sbjct:  594 ARHSSFLGVASELVTFDPAYRSVIQNLLGTVLITEDLKGANELAKLLGHRYRIVTLEGDV   653

Query:  654 LRPGGSFSGGANRQSNTTFI--KPELEQISEELTRLVEQLKITEKEVAALQSDLIAKKEE   711
            + PGGS +GGA ++ N +       ELE +++ L + E+ + E+EV L+ +    +++
Sbjct:  654 VNPGGSMTGGAVKKKNNSLLGRSRELEDVTERLAEMEEKTALLEQEVKTLKHSIQDMEKK   713

Query:  712 LTQQLKLAGDQARLAEQ--RAQMAYQQLQEKQEDSKALLAALDQSQTTHSDESLLAEQARI   769
            L  L+  G+ RL +Q    + Q+ + EK  +  L  ++S + SDE    + ++
Sbjct:  714 LADLRETGEGLRLKQQDVKGQLYELQVAEKNINTHLELYDQEKSALSESDEERKVRKRKL   773

Query:  770 EEALTAIAKKKNALTCDIDDIKENKDLIRQKTQNIHQALSQARLQERDLLNEKKFEQANQ   829
            EE L+A++++K   L  DID + +K         +++ L++ ++          K E+ N
Sbjct:  774 EEELSAVSEKMKQLEEDIDRLTKQKQTQSSTKESLSNELTELKIAAAKKEQACKGEEDNL   833

Query:  830 SRLRTQLKQCQQNILKLESILNNNVSQDSIQRLPQWQKQLQDATEHKSGAQKRLVQLRFE   889
            +RL+ +L +  +    + + +            +++L++A +HK      S + +   +L
Sbjct:  834 ARLKKELTETELALKEAKEDLSFLTSEMSSS--TSGEEKLEEAAKHKLNDKTKTIELIAL   891

Query:  890 IEDYEARLEETAEKITKESEKNDTFIRRQTKL----ETHLEQVANRLRAYAKSLSEDFQM   945
              D  +L+ +   +E ++      +++T L      E L ++   L   + L E++ +
Sbjct:  892 RRDQRIKLQHGLDTYERELKEMERLYKQTTLLKDEEVKLGRMEVELDNLLQYLREEYSL   951

Query:  946 TLADAKEVTNSIDHLESAKEKLHHLQKTIRALGPINSDAINQYEEVHERLTFLTSQKTDL  1005
             +  AKE         E A++++    ++ I LG +N +I+++E V+ER   FL + QK DL
Sbjct:  952 SFEGAKEKYQLETDPEEARKRVKLIKLAIEELGTVNLGSIDEFERVNERYKFLSEQKEDL  1011

Query: 1006 TKAKNLLLETINSMDSEVKARFKVTFEAIQKSFKETFTQMFGGGSADLVLTE-TDLLSAG  1064
            T+AKN L + I  MD E+  RF  TF I+   F +  F +FGGG A+L LT+  DLL +G
Sbjct: 1012 TEAKNTLFQVIEEMDEEMTKRFNDTFVQIRSHFDQVFRSLFGGGRAELRLTDPNDLLHSG  1071

Query: 1065 IEISVQPPGKKIQSLNLMSGGEKALSALALLFAIIRVKTIPFVILDEVEAALDEANVKRF  1124
            +EI  QPPGKK+Q+LNL+SGGE+AL+A+ALLF+I+++V++   PF +LDEVEAALDEANV RF
Sbjct: 1072 VEIIAQPPGKKLQNLNLLSGGERALTAIALLFSILKVRPVPFCVLDEVEAALDEANVFRF  1131

Query: 1125 GDFLNRFKDKSQFIVVTHRKGTMAAADSIYGITMQESGVSKIVSVKLKEAQE          1176
             +L ++  D+QFIV+THRKGTM   AD +YG+TMQESGVSK++SVKL+E +E
Sbjct: 1132 AQYLKKYSSDTQFIVITHRKGTMEEADVLYGVTMQESGVSKVISVKLEETKE          1183
```

An alignment of the GAS and GBS proteins is shown below:

```
Identities = 732/1179 (62%), Positives = 911/1179 (77%)

Query:        1 MFLKEIEMQGFKSFADKTKVEFDQGVTAVVGPNGSGKSNITESLRWALGESSAKSLRGGK    60
                MFLKEIE++GFKSFADKTK+EFD+GVTAVVGPNGSGKSNITESLRWALGESSAK+LRGGK
Sbjct:        1 MFLKEIELEGFKSFADKTKIEFDKGVTAVVGPNGSGKSNITESLRWALGESSAKNLRGGK    60

Query:       61 MPDVIFAGTENRKPLNYAQVSVTLDNSDHFIENIADEVRVERRIFRNGDSEYLIDGRKVR   120
                MPDVIFAGT+NR PLNYA+V+V LDNSDHFI+    E+RVER I+RNGDS+YLIDGRKVR
Sbjct:       61 MPDVIFAGTQNRNPLNYAKVAVVLDNSDHFIKTAKKEIRVERHIYRNGDSDYLIDGRKVR   120

Query:      121 LRDIHDLFMDTGLGRDSFSIISQGRVEAIFNSKPEERRAIFEEAAGVLKYKTRKKETQSK   180
                LRDIHDLFMDTGLGRDSFSIISQGRVE IFNSKPEERRAIFEEAAGVLKYKTRKKETQ K
Sbjct:      121 LRDIHDLFMDTGLGRDSFSIISQGRVEEIFNSKPEERRAIFEEAAGVLKYKTRKKETQIK   180

Query:      181 LEQTQGNLDRLEDIIYELDMQVQPLEKQASIAKRFLVLDEERQGLHLSILIEDILQHQSD   240
                L QTQ NLDRLEDIIYELD Q+ PLEKQA +AK+FL LD  R+ L L IL++DI   Q
Sbjct:      181 LNQTQDNLDRLEDIIYELDTQLAPLEKQAKVAKQFLELDANRKQLQLDILVKDIDIAQER   240

Query:      241 LTTVEEKLLTVRKELATYYQQRQSLEDENQSLKQRHHLSEEIEAKQLALLDVTKLKSDL    300
                  T  E L  ++++LA+YY +RQS+E++  Q  KQK+  LS+E +   Q  LL++TKL +DL
Sbjct:      241 QTKDTEALAALQQDLASYYAKRQSMEEDYQKFKQKKQVLSQESDQTQTTLLELTKLIADL   300

Query:      301 ERQIDLIRLESNQKAEKKEEAGQRLAELEIKAKDCSDQITQKNIELTTLSEKIAQIRSEI   360
                E+QI+L++LES Q+AEKK EA + L +L+ +        +    Q    +L + +++  ++ ++
Sbjct:      301 EKQIELVKLESGQEAEKKAEAKKHLEQLQEQLDGFQAEEKQCTEQLLHIDQQLCDVKQQL   360

Query:      361 VSTESSLERFSTNPDQIIEKLREDFVTLMQEEADTSNALTALLADIENQKQASQAKSQEI   420
                  ++LERFS++PDQ++E LRE+FV LMQ+EA  SN LTAL A ++ +KQA Q K+QE
Sbjct:      361 NELSNALERFSSDPDQLMETLREEFVLLMQKEAALSNQLTALKAHLDKEKQARQHKAQEY   420

Query:      421 QEVSKNLEVLKSNAKVALERFEAAKKNVRQLLSHYQDLGQTLQNLEGEYKNQQSILFDHL   480
                Q +    L+  L    ++ A      ++A K+ V  LL +YQ+    +Q LE +Y+    Q   LFD L
Sbjct:      421 QLLVTKLDQLNDESQKAQAHYKAQKEQVEMLLQNYQEGDKRVQELERDYQLNQERLFDLL   480

Query:      481 DEIKSKQARISSLESILKNHSNFYAGVKSVLQAKDQLGGIIGAVSEHLSFDKHYQTALEI   540
                D+ K K+AR +SLESI K+HS FYAGV++VLQ++ +LGGIIGAVSEHLSFD  YQTALE+
Sbjct:      481 DQKKGKEARKASLESIQKSHSQFYAGVRAVLQSQKKLGGIIGAVSEHLSFDSDYQTALEV   540

Query:      541 ALGGSSQHIIVEDESAAKRSIAFLKKNRQGRATFLPLTTIKPRELAQHYLSKLQSSQGFL   600
                ALG +SQHIIV DE+AAKR+IA+LKKNRQGRATFLPLTTIK R L++HY  +L + +G+L
Sbjct:      541 ALGANSQHIIVTDEAAAKRAIAYLKKNRQGRATFLPLTTIKARSLSEHYHRQLATCEGYL   600

Query:      601 GIASELVTYDQRLSNIFKNNLGLTAIFDTVDNAVAARQLNYQVRLVTLDGTELRPGGSY   660
                G A  L+ YD  LS I +N L  TAIF+T+D AN+AAR L Y+VR+VTLDGTELRPGGS+
Sbjct:      601 GTAESLIRYDDSLSAIIQNLLSSTAIFETIDQANIAARLLGYKVRIVTLDGTELRPGGSF   660

Query:      661 SGGANRQNNTVFIKPELDNLKKELKQAQSKQLIQEKEVATLLEQLKEKQETLAQLKNDGE   720
                SGGANRQ+NT FIKPEL+ + +EL +   + I EKEVA L   L K+E L QLK  G+
Sbjct:      661 SGGANRQSNITFIKPELEQISEELTRLVEQLKITEKEVAALQSDLIAKKEELTQLKLAGD   720

Query:      721 QARLEEQRADIEYQQLSEKLADLNKLYNGLQLSSGALEQTTSENEKNRLEKELEQFAIKK   780
                QARL EQRA + YQQL EK D   L  S      + E+ R+E+ L   A KK
Sbjct:      721 QARLAEQRAQMAYQQLQEKQEDSKALLAALDQSQTTHSDESLLAEQARIEEALTAIAKKK   780

Query:      781 EELTTSIAQIKEDKDSIQEKVNNLTTLLSEAQLEERDLLNEQKFERANCTRLEITLSEIK   840
                      LT  I  IKE+KD I++K N+   LS+A+L+ERDLLNE+KFE AN +RL  L + +
Sbjct:      781 NALTCDIDDIKENKDLIRQKTQNIHQALSQARLQERDLLNEKKFEQANQSRLRTQLKQCQ   840

Query:      841 RDISNLQTLLSHQDSQLDKEELPRIEKQLLQVNNRRENDEEKLVSLRFELEDCEAALDDL   900
                ++I  L+++L++  SQ +   +  LP+ +KQL          +++LV LRFE+ED EA L++
Sbjct:      841 QNILKLESILNNNVSQDSIQRLPQWKQLQDATEHKSGAQKRLVQLRFEIEDYEARLEET   900

Query:      901 AASLAKEGQKNESLIRQQAQLESQCEQLSQQLMIFSRQLSEDYQMTLDEAKVKANVLEDI   960
                A  + KE +KN++ IR+Q  +LE+   EQ++   +L  +++ LSED+QMTL AK   N ++  +
Sbjct:      901 AEKITKESEKNDTFIRRQTKLETHLEQVANRLRAYAKSLSEDFQMTLADAKEVTNSIDHL   960

Query:      961 LMAREQLKSLQAKIKALGPVNIDAIAQFEEVHERLTFLNTQRDDLVHAKNLLLETITDMD  1020
                    A+E+L  LQ   I+ALGP+N DAI Q+EEVHERLTFL +Q+ DL  AKNLLLETI  MD
Sbjct:      961 ESAKEKLHHLQKTIRALGPINSDAINQYEEVHERLTFLTSQKTDLTKAKNLLLETINSMD  1020

Query:     1021 DEVKTRFKSTFEAIRHSFKETFVQMFGGGSADLILTEGDLLSAGVDISVQPPGKKIQSLN  1080
                  EVK RFK TFEAI+ SFKETF QMFGGGSADL+LTE DLLSAG++ISVQPPGKKIQSLN
Sbjct:     1021 SEVKARFKVTFEAIQKSFKETFTQMFGGGSADLVLTETDLLSAGIEISVQPPGKKIQSLN  1080

Query:     1081 LMSGGEKALSALALLFAIIRVKTIPFVILDEVEAALDEANVKRFGDYLNRFDKSSQFIVV  1140
                LMSGGEKALSALALLFAIIRVKTIPFVILDEVEAALDEANVKRFGD+LNRFDK SQFIVV
Sbjct:     1081 LMSGGEKALSALALLFAIIRVKTIPFVILDEVEAALDEANVKRFGDFLNRFDKDSQFIVV  1140
```

```
                                        -continued
Query:  1141  THRKGTMSAADSIYGVTMQESGVSKIVSVKLKEAQEMTN              1179
              THRKGTM+AADSIYG+TMQESGVSKIVSVKLKEAQEMTN
Sbjct:  1141  THRKGTMAAADSIYGITMQESGVSKIVSVKLKEAQEMTN              1179
```

SEQ ID 1162 (GBS199) was expressed in *E. coli* as a GST-fusion product. SDS-PAGE analysis of total cell extract is shown in FIG. 52 (lane 2; MW 75 kDa).

Figure 208:
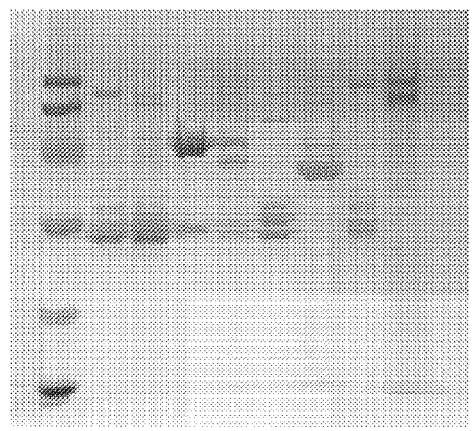

GBS199-GST was purified as shown in FIG. 208, lane 3.

Based on this analysis, it was predicted that these proteins and their epitopes could be useful antigens for vaccines or diagnostics.

Example 359

A DNA sequence (GBSx0390) was identified in *S. agalactiae* <SEQ ID 1165> which encodes the amino acid sequence <SEQ ID 1166>. This protein is predicted to be ribonuclease III (rnc). Analysis of this protein sequence reveals the following:

---

Possible site: 46
>>> Seems to have no N-terminal signal sequence
----- Final Results -----
   bacterial cytoplasm --- Certainty = 0.3372 (Affirmative) <succ>
      bacterial membrane --- Certainty = 0.0000 (Not Clear) <succ>
         bacterial outside --- Certainty = 0.0000 (Not Clear) <succ>

---

A related GBS nucleic acid sequence <SEQ ID 9711> which encodes amino acid sequence <SEQ ID 9712> was also identified.

The protein has homology with the following sequences in the GENPEPT database:

```
>GP:CAB13466 GB:Z99112 ribonuclease III [Bacillus subtilis]
Identities = 115/230 (50%), Positives = 154/230 (66%), Gaps = 1/230 (0%)

Query:   13  KKMKELRSKLEKDYGIVFANQELLDTAFTHTSYANEHRLLNISHNERLEFLGDAVLQLLI    72
             KK+++ +    E+   + F N++LL  AFTH+SY NEHR      NERLEFLGDAVL+L I
Sbjct:   15  KKVEQFKEFQER-ISVHFQNEKLLYQAFTHSSYVNEHRKKPYEDNERLEFLGDAVLELTI    73

Query:   73  SQYLFTKYPQKAEGDLSKLRSMIVREESLAGFSRLCGFDHYIKLGKGEEKSGGRNRDTIL   132
             S++LF KYP +EGDL+KLR+ IV E SL    +  F   + LGKGEE +GGR R   +L
Sbjct:   74  SRFLFAKYPAMSEGDLTKLRAAIVCEPSLVSLAHELSFGDLVLLGKGEEMTGGRKRPALL   133

Query:  133  GDLFEAFLGALLLDKGVEVVHAFVNKVMIPHVEKGTYERVKDYKTSLQELLQSHGDVKID   192
                D+FEAF+GAL LD+G+E V +F+    + P +  G +  V D+K+ LQE +Q  G    ++
Sbjct:  134  ADVFEAFIGALYLDQGLEPVESFLKVYVFPKINDGAFSHVMDFKSQLQEYVQRDGKGSLE   193

Query:  193  YQVTNESGPAHAKEFEVTVSVNQENLSQGIGRSKKAAEQDAAKNALATLQ            242
             Y+++NE GPAH +EFE  VS+  E L  G GRSKK AEQ AA+ ALA LQ
Sbjct:  194  YKISNEKGPAHNREFEAIVSLKGEPLGVGNGRSKKEAEQHAAQEALAKLQ            243
```

A related DNA sequence was identified in *S. pyogenes* <SEQ ID 1167> which encodes the amino acid sequence <SEQ ID 1168>. Analysis of this protein sequence reveals the following:

---

Possible site: 32
>>> Seems to have no N-terminal signal sequence
----- Final Results -----
   bacterial cytoplasm --- Certainty = 0.1414 (Affirmative) <succ>
      bacterial membrane --- Certainty = 0.0000 (Not Clear) <succ>
         bacterial outside --- Certainty = 0.0000 (Not Clear) <succ>

---

An alignment of the GAS and GBS proteins is shown below:

```
Identities = 170/227 (74%), Positives = 192/227 (83%)

Query:    15  MKELRSKLEKDYGIVFANQELLDTAFTHTSYANEHRLLNISHNERLEFLGDAVLQLLISQ      74
              MK+L   L   + I F +  LL+TAFTHTSYANEHRLLN+SHNERLEFLGDAVLQL+IS+
Sbjct:     1  MKQLEELLSTSFDIQFNDLTLLETAFTHTSYANEHRLLNVSHNERLEFLGDAVLQLIISE      60

Query:    75  YLFTKYPQKAEGDLSKLRSMIVREESLAGFSRLCGFDHYIKLGKGEEKSGGRNRDTILGD     134
              YLF KYP+K EGD+SKLRSMIVREESLAGFSR C FD YIKLGKGEEKSGGR RDTILGD
Sbjct:    61  YLFAKYPKKTEGDMSKLRSMIVREESLAGFSRFCSFDAYIKLGKGEEKSGGRRRDTILGD     120

Query:   135  LFEAFLGALLLDKGVEVVHAFVNKVMIPHVEKGTYERVKDYKTSLQELLQSHGDVKIDYQ     194
              LFEAFLGALLLDKG++ V   F+ +VMIP VEKG +ERVKDYKT LQE LQ+ GDV.IDYQ
Sbjct:   121  LFEAFLGALLLDKGIDAVRRFLKQVMIPQVEKGNFERVKDYKTCLQEFLQTKGDVAIDYQ     180

Query:   195  VTNESGPAHAKEFEVTVSVNQENLSQGIGRSKKAAEQDAAKNALATL                 241
              V +E GPAHAK+FEV++ VN    LS+G+G+SKK AEQDAAKNALA L
Sbjct:   181  VISEKGPAHAKQFEVSIVVNGAVLSKGLGKSKKLAEQDAAKNALAQL                 227
```

Based on this analysis, it was predicted that these proteins and their epitopes could be useful antigens for vaccines or diagnostics.

Example 360

A DNA sequence (GBSx0391) was identified in *S. agalactiae* <SEQ ID 1169> which encodes the amino acid sequence <SEQ ID 1170>. Analysis of this protein sequence reveals the following:

Possible site: 43
>>> Seems to have a cleavable N-term signal seq.
INTEGRAL    Likelihood = –4.19    Transmembrane 100-116 (99-117)
INTEGRAL    Likelihood = –2.44    Transmembrane 81-97 (81-97)
----- Final Results -----
    bacterial membrane --- Certainty = 0.2678 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database:

```
>GP:CAC12789 GB:AJ279090 hypothetical protein [Staphylococcus
carnosus]

Identities = 50/114 (43%), Positives = 72/114 (62%)

Query:     3  KIFYISLGFISLGIGIAGIVLPVVPTTPLVLLSAFCFSRSSEKFDIWLRQTKVYKYYAAD      62
              K    ++LG I  GIG  GIV+P++PTTP +LL+A CFSRSS+KF+ WL  TK++   Y
Sbjct:     2  KYVLMTLGLIFAGIGFVGIVVPLLPTTPFLLLAAICFSRSSKKFNRWLVNTKIHDEYVES     61

Query:    63  FVESRSIAPARKKSMIWQIYILMGISIYFAPLMWLKLGLLIGTIVGTYVLFYVV          116
              F   +     +K  ++ +YILMGISI+      +++++ LLI   V T VLF V
Sbjct:    62  FKRDKGFTLKKKFKLLTSLYILMGISIFIIDNLYIRITLLIMLFVQTVVLFTFV          115
```

No corresponding DNA sequence was identified in *S. pyogenes*.

Based on this analysis, it was predicted that this protein and its epitopes, could be useful antigens for vaccines or diagnostics.

Example 361

A DNA sequence (GBSx0392) was identified in *S. agalactiae* <SEQ ID 1171> which encodes the amino acid sequence <SEQ ID 1172>. Analysis of this protein sequence reveals the following:

Possible site: 45
>>> Seems to have no N-terminal signal sequence
----- Final Results -----
    bacterial cytoplasm --- Certainty = 0.1908 (Affirmative) <succ>
    bacterial membrane --- Certainty = 0.0000 (Not Clear) <succ>
    bacterial outside --- Certainty = 0.0000 (Not Clear) <succ>

A related DNA sequence was identified in *S. pyogenes* <SEQ ID 1173> which encodes the amino acid sequence <SEQ ID 1174>. Analysis of this protein sequence reveals the following:

Possible site: 45
>>> Seems to have no N-terminal signal sequence
----- Final Results -----
    bacterial cytoplasm --- Certainty = 0.1610 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below:

```
Identities = 225/269 (83%), Positives = 248/269 (91%)
Query:   1  MSEIGFKYSILASGSTGNCFYIETPQKRLLIDAGLTGKKVTSLLAEINRKPEDLDAILVT   60
            M+E GFKYSILASGSTGNCFY+ETP+KRLLIDAGLTGKK+TSLLAEI+RKPEDLDAIL+T
Sbjct:   1  MNESGFKYSILASGSTGNCFYLETPKKRLLIDAGLTGKKITSLLAEIDRKPEDLDAILIT   60

Query:  61  HEHSDHIKGVGVLARKYHLDIYANEQTWKVMDERNMLGKVDVSQKHVFGRGKTLTFGDLD  120
            HEHSDHIKGVGV+ARKYHLDIYANE+TW++MDE NMLGK+D SQKH+F R K LTFGD+D
Sbjct:  61  HEHSDHIKGVGVMARKYHLDIYANEKTWQLMDECNMLGKLDASQKHIFQRDKVLTFGDVD  120

Query: 121  IESFGVSHDAVDPQFYRMMKDDKSFVMLTDTGYVSDRMAGLIENADGYLIESNHDIEILR  180
            IESFGVSHDA+DPQFYR+MKD+KSFVMLTDTGYVSDRM G+IENADGYLIESNHDIEILR
Sbjct: 121  IESFGVSHDAIDPQFYRIMKDNKSFVMLTDTGYVSDRMTGIIENADGYLIESNHDIEILR  180

Query: 181  SGSYPWTLKQRILSDKGHLSNEDGSETMIRTIGNRTKHIYLGHLSKENNIKELAHMTMEN  240
            SGSYPW+LKQRILSD GHLSNEDG+  MIR++G  TK IYLGHLSKENNIKELAHMTM N
Sbjct: 181  SGSYPWSLKQRILSDLGHLSNEDGAGAMIRSLGYNTKKIYLGHLSKENNIKELAHMTMVN  240

Query: 241  NLMRADFGVGTDFSVHDTSPDSATPLTRI                                269
              L  AD  VGTDF+VHDTSPD+A PLT I
Sbjct: 241  QLAMADLAVGTDFTVHDTSPDTACPLTDI                                269
```

Based on this analysis, it was predicted that these proteins and their epitopes could be useful antigens for vaccines or diagnostics.

Example 362

A DNA sequence (GBSx0393) was identified in *S. agalactiae* <SEQ ID 1175> which encodes the amino acid sequence <SEQ ID 1176>. Analysis of this protein sequence reveals the following:

Possible site: 26
>>> Seems to have an uncleavable N-term signal seq
INTEGRAL    Likelihood = –11.94    Transmembrane 15-31 (5-34)
----- Final Results -----
   bacterial membrane --- Certainty = 0.5776 (Affirmative) <succ>
     bacterial outside --- Certainty = 0.0000 (Not Clear) <succ>
      bacterial cytoplasm --- Certainty = 0.0000 (Not Clear) <succ>

A related DNA sequence was identified in *S. pyogenes* <SEQ ID 1177> which encodes the amino acid sequence <SEQ ID 1178>. Analysis of this protein sequence reveals the following:

Possible site: 26
>>> Seems to have a cleavable N-term signal seq.
----- Final Results -----
   bacterial outside --- Certainty = 0.3000 (Affirmative) <succ>
   bacterial membrane --- Certainty = 0.0000 (Not Clear) <succ>
   bacterial cytoplasm --- Certainty = 0.0000 (Not Clear) <succ>

An alignment of the GAS and GBS proteins is shown below:

```
Identities = 335/443 (75%), Positives = 392/443 (87%)
Query:   7  NIRSFELALLELLVFVAVYFVYLAVRDFKMSKNIRLLNWKVRDLIAGNYSDSILIQGDAD   66
            N+ +FELA+L LLVFVA YF++LAVRD++ ++ IR+++ K+RDLI G Y+D I  + D +
Sbjct:   8  NLSTFELAILILLVFVAFYFIHLAVRDYRNARIIRMMSHKIRDLINGRYTDIIDEKADIE   67

Query:  67  LVELGESLNDLSDVFRMAHDNLEQEKNRLASILTYMTDGVLATDRSGKIVMINETAQQQF  126
            L+EL + LNDLSDVFR+ H+NL QEKNRLASIL YM+DGVLATDRSGKI+MINETA++Q
Sbjct:  68  LMELSDQLNDLSDVFRLTHENLAQEKNRLASILAYMSDGVLATDRSGKIIMINETARKQL  127

Query: 127  NLAYDEALSMNIVDMLGSGSPYSFQDLVSKTPEVVLNRRDENGEFVTLRIRFALNRRESG  186
            NL+ +EAL  NI D+L   + Y+++DLVSKTP V +N R++ GEFV+LR+RFALNRRESG
Sbjct: 128  NLSKEEALKKNITDLLEGDTSYTYRDLVSKTPVVTVNSRNDMGEFVSLRLRFALNRRESG  187

Query: 187  FISGLVAVSHDATEQEKEERERRLFVSNVSHELRTPLTSVKSYLEALDEGALNEEVAPSF  246
            FISGLV V HD TEQEKEERERRLFVSNVSHELRTPLTSVKSYLEALDEGAL E++APSF
Sbjct: 188  FISGLVVVLHDTTEQEKEERERRLFVSNVSHELRTPLTSVKSYLEALDEGALKEDIAPSF  247

Query: 247  IKVSLDETNRMMRMISDLLSLSRIDNEVTHLDVEMTNFTAFMTSILNRFDQIRNQKTVTG  306
            IKVSLDETNRMMRMISDLL+LSRIDN+VT L VEMTNFTAF+TSILNRFD ++NQ T TG
Sbjct: 248  IKVSLDETNRMMRMISDLLNLSRIDNQVTQLAVEMTNFTAFITSILNRFDLVKNQHTGTG  307

Query: 307  KVYEIVRDYPLKSIWVEIDTDKMTQVIDNILNNAVKYSPDGGKITVNLRTTKTQMILSIS  366
            KVYEIVRDYP+ S+W+EID DKMTQVI+NILNNA+KYSPDGGKITV ++TT TQ+I+SIS
Sbjct: 308  KVYEIVRDYPITSVWIEIDNDKMTQVIENILNNAIKYSPDGGKITVRMKTIDTQLIISIS  367

Query: 367  DQGLGIPKKDLPLIFDRFYRVDKARSRKQGGTGLGLSIAKEIVKQHKGFIWAKSEYGKGS  426
            DQGLGIPK DLPLIFDRFYRVDKARSR QGGTGLGL+IAKEI+KQH GFIWAKS+YGKGS
Sbjct: 368  DQGLGIPKTDLPLIFDRFYRVDKARSRAQGGTGLGLAIAKEIIKQHHGFIWAKSDYGKGS  427

Query: 427  TFTIVLPYDKDAVTYEEWEDVED                                      449
            TFTIVLPY+KDA   YEEWE+ D
Sbjct: 428  TFTIVLPYEKDAAIYEEWEEDVD                                      450
```

A related GBS gene <SEQ ID 8561> and protein <SEQ ID 8562> were also identified. Analysis of this protein sequence reveals the following:

```
Lipop: Possible site: -1    Crend: 8
McG: Discrim Score: 8.59
GvH: Signal Score (-7.5): -3.38
Possible site: 26
>>> Seems to have an uncleavable N-term signal seq
ALOM program    count: 1 value: -11.94  threshold: 0.0
INTEGRAL        Likelihood = -11.94     Transmembrane 15-31 (5-34)
PERIPHERAL      Likelihood = 8.27       178
modified ALOM score: 2.89
*** Reasoning Step: 3
----- Final Results -----
    bacterial membrane --- Certainty = 0.5776 (Affirmative) <succ>
        bacterial outside --- Certainty = 0.0000 (Not Clear) <succ>
            bacterial cytoplasm --- Certainty = 0.0000 (Not Clear) <succ>
```

Figure 238:
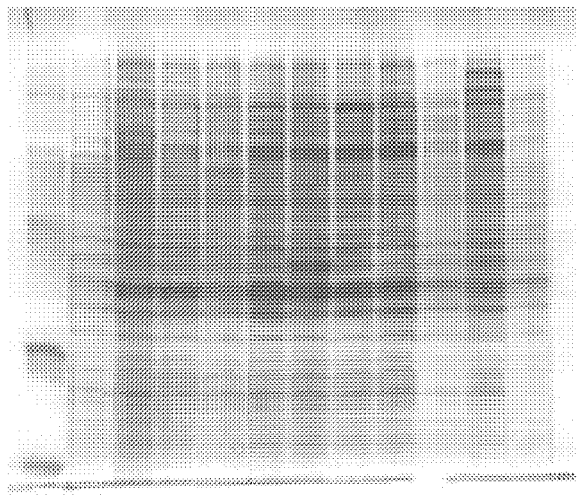

The protein has homology with the following sequences in the databases:

SEQ ID 1176 (GBS41) was expressed in *E. coli* as a His-fusion product. SDS-PAGE analysis of total cell extract is shown in FIG. 4 (lane 7; MW 50 kDa), in FIG. 168 (lane 2-4; MW 65 kDa—thioredoxin fusion) and in FIG. 238 (lane 4; MW 65 kDa). It was also expressed in *E. coli* as a GST-fusion product. SDS-PAGE analysis of total cell extract is shown in FIG. 13 (lane 7; MW 75 kDa).

Purified Thio-GBS41-His is shown in FIG. 244, lane 10.

Based on this analysis, it was predicted that these proteins and their epitopes could be useful antigens for vaccines or diagnostics.

Example 363

A DNA sequence (GBSx0394) was identified in *S. agalactiae* <SEQ ID 1179> which encodes the amino acid sequence <SEQ ID 1180>. This protein is predicted to be VicR protein (regX3). Analysis of this protein sequence reveals the following:

```
67.5/83.5% over 439aa
Streptococcus pneumoniae
GP|5830524|histidine kinase Insert characterized
ORF01458(331-1647 of 1947)
GP|5830524|emb|CAB54569.1||AJ006392(10-449 of 449) histidine kinase
{Streptococcus pneumoniae}
% Match = 45.6
% Identity = 67.5 % Similarity = 83.4
Matches = 297 Mismatches = 70 Conservative Sub.s = 70

126       156       186       216       246       276       306       336
ITSPFSDTYRTSHDTRTFIGNSLGI*LFWRCPYS*CDGETFT*KD*RYSWSSRIYFDSTWCRXIT*SLMNNSAANIRSFE
                                                                               |
                                                                      MLDLLKQTIFT
                                                                               10

366       396       426       450       480       510       540       570
LALLFLLVFVAVYFVYLAVRDFKMSKNIRL--LNWKVRDLIAGNYSDSILIQGDADLVELGESLNDLSDVFRMAHDNLEQ
 ::|:|:::    :|    :      ||:|   :| |:|||||:||   :||  ::    :||||:|  |: ::||||
RDFIFILILLGFILVVTLLLLENRRDNIQLKQVNQKVKDLIAGDYSKVLDMQGGSEITNITNNLNDLSEVIRLTQENLEQ
        30        40        50        60        70        80        90

600       630       660       690       720       750       780       810
EKNRLASILTYMTDGVLATDRSGKIVMINETAQQQFNLAYDEALSMNIVDMLGSGSPYSFQDLVSKTPEVVLNRRDENGE
|   ||  |||  |||||||:|  |:|:|||:|::|:   |   :  : :::  |        |:|:::||||:  |  |||
ESKRLNSILFYMTDGVLATNRRGQIIMINDTAKKQLGLVKEDVLNRSILELLKIEENYELRDLITQSPELLLDSQDINGE
       110       120       130       140       150       160       170

840       870       900       930       960       990      1020      1050
FVTLRIRFALNRRESGFISGLVAVSHDATEQEKEERERRLFVSNVSHELRTPLTSVKSYLEALDEGALNEEVAPSFIKVS
 ::  ||:||||  |||||||||||:|||:|||||||||||||||||||||||||||||||||||||| |  |||||||
YLNLRVRFALIRRESGFISGLVAVLHDTTEQEKEERERRLFVSNVSHELRTPLTSVKSYLEALDEGALCETVAPDFIKVS
                 190       200       210       220       230       240       250

1080      1110      1140      1170      1200      1230      1260      1290
LDETNRMMRMISDLLSLSRIDNEVTHLDVEMTNFTAFMTSILNRFDQIRNQKTVTGKVYEIVRDYPLKSIWVEIDTDKMT
||||||||||::|||  ||||||  ||||:|||||| |  |||||:|  |         |  ||:||||: |||:|||||||||
LDETNRMMRMVTDLLHLSRIDNATSHLDVELINFTAFITFILNRFDKMKGQ--EKEKKYELVRDYPINSIWMEIDTDKMT
                 270       280       290       300       310       320

1320      1350      1380      1410      1440      1470      1500      1530
QVIDNILNNAVKYSPDGGKITVNLRTTKTQMILSISDQGLGIPKKDLPLIFDRFYRVDKARSRKQGGTGLGLSIAKEIVK
||:||||||||:||||||||||| ::||:  |||||||:|||||||:||| |||||||||||||:|||||||||||||||:|
QVVDNILNNAIKYSPDGGKITVRMKTTEDQMILSISDHGLGIPKQDLPRIFDRFYRVDRARSRAQGGTGLGLSIAKEIIK
       340       350       360       370       380       390       400

1560      1590      1620      1647      1677      1707      1737      1767
QHKGFIWAKSEYGKGSTFTIVLPYDKDAVTYEEWED-VED*NMSEIGFKYSILASGSTGNCFYIETPQKRLLIDAGLTGK
|||||||||||||||||||||||||||||      |    |||  |||
QHKGFIWAKSEYGKGSTFTIVLPYDKDAVKEEVWEDEVED
       420       430       440
```

```
Possible site:60
>>> Seems to have no N-terminal signal sequence
----- Final Results -----
    bacterial cytoplasm --- Certainty = 0.2754 (Affirmative) <succ>
        bacterial membrane --- Certainty = 0.0000 (Not Clear) <succ>
            bacterial outside --- Certainty = 0.0000 (Not Clear) <succ>
```

A related DNA sequence was identified in *S. pyogenes* <SEQ ID 1181> which encodes the amino acid sequence <SEQ ID 1182>. Analysis of this protein sequence reveals the following:

```
Possible site: 60
>>> Seems to have no N-terminal signal sequence
----- Final Results -----
    bacterial cytoplasm --- Certainty = 0.2754 (Affirmative) <succ>
        bacterial membrane --- Certainty = 0.0000 (Not Clear) <succ>
            bacterial outside --- Certainty = 0.0000 (Not Clear) <succ>
```

An alignment of the GAS and GBS proteins is shown below:

```
Identities = 205/236 (86%), Positives = 221/236 (92%)
Query:    1  MKKILIVDDEKPISDIIKFNLTKEGYETATAFDGREALVQYAEFQPDLIILDLMLPELDG    60
             MKKILIVDDEKPISDIIKFNLTKEGY+  TAFDGREA+  + E +PDLIILDLMLPELDG
Sbjct:    1  MKKILIVDDEKPISDIIKFNLTKEGYDIVTAFDGREAVTIFEEEKPDLIILDLMLPELDG    60

Query:   61  LEVAKEVRKTSHIPIIMLSARDSEFDKVIGLEIGADDYVTKPFSNRELLARVKAHLRRTE   120
             LEVAKE+RKTSH+PIIMLSAKDSEFDKVIGLEIGADDYVTKPFSNRELLARVKAHLRRTE
Sbjct:   61  LEVAKEIRKTSHVPIIMLSAKDSEFDKVIGLEIGADDYVTKPFSNRELLARVKAHLRRTE   120

Query:  121  NIETAVAEESAQNASSDITIGELQILPDAFIAKKRGEEIELTHREFELLHHLATHIGQVM   180
               IETAVAEE+A + + ++TIG LQILPDAF+AKK G+E+ELTHREFELLHHLA H+GQVM
Sbjct:  121  TIETAVAEENASSGTQELTIGNLQILPDAFVAKKHGQEVELTHREFELLHHLANHMGQVM   180

Query:  181  TREHLLETVWGYDYFGDVRTVDVTVRRLREKIEDTPGRPEYILTRRGVGYYMKSYE       236
             TREHLLE VWGYDYFGDVRTVDVTVRRLREKIEDTP RPEYILTRRGVGYYMKSY+
Sbjct:  181  TREHLLEIVWGYDYFGDVRTVDVTVRRLREKIEDTPSRPEYILTRRGVGYYMKSYD       236
```

Based on this analysis, it was predicted that these proteins and their epitopes could be useful antigens for vaccines or diagnostics.

Example 364

A DNA sequence (GBSx0395) was identified in *S. agalactiae* <SEQ ID 1183> which encodes the amino acid sequence <SEQ ID 1184>. This protein is predicted to be amino acid ABC transporter, ATP-binding protein. Analysis of this protein sequence reveals the following:

```
Possible site: 43
>>> Seems to have no N-terminal signal sequence
----- Final Results -----
    bacterial cytoplasm --- Certainty = 0.3791 (Affirmative) <succ>
        bacterial membrane --- Certainty = 0.0000 (Not Clear) <succ>
            bacterial outside --- Certainty = 0.0000 (Not Clear) <succ>
```

The protein has homology with the following sequences in the GENPEPT database:

```
>GP:CAB14701 GB:Z99118 glutamine ABC transporter (ATP-binding
protein) [Bacillus subtilis]
Identities = 149/244 (61%), Positives = 200/244 (81%), Gaps = 2/244 (0%)
Query:   3 LISYKNVNKYYGDYHALRQINLEIEPGQVVVLLGPSGSGKSTLIRTMNALESIDDGSLVV   62
           +I+++NVNK+YGD+H L+QINL+IE G+VVV++GPSGSGKSTL+R +N LESI++G L V
Sbjct:   1 MITFQNVNKHYGDFHVLKQINLQIEKGEVVVIIGPSGSGKSTLLRCINRLESINEGVLTV   60

Query:  63 NGHELANISSKELVNLRKEVGMVFQHFNLYPHKTVLENITLAPIKVLKQSKKEAMEIAEK  122
           NG  + N     ++   +R+  +GMVFQHF+LYPHKTVL+NI LAP+KVL+QS ++A E A
Sbjct:  61 NGTAI-NDRKTDINQVRQNIGMVFQHFHLYPHKTVLQNIMLAPVKVLRQSPEQAKETARY  119

Query: 123 YLKFVNMWERKDSYPSMLSGGQKQRIAIARGLAMHPKLLLFDEPTSALDPETIGDVLSVM  182
           YL+ V +  ++ D+YPS LSGGQ+QR+AIARGLAM P+++LFDEPTSALDPE IG+VL VM
Sbjct: 120 YLEKVGIPDKADAYPSQLSGGQQQRVAIARGLAMKPEVMLFDEPTSALDPEMIGEVLDVM  179

Query: 183 QKLANDGMNMVVVTHEMGFAREVADRIIFMADGEILVDTTDVQDFFDNPREPRAKQFLSN  242
           + LA +GM MVVVTHEMGFA+EVADRI+F+ +G+IL +      +F+ NP+E RA+ FLS
Sbjct: 180 KTLAKEGMTMVVVTHEMGFAKEVADRIVFIDEGKILEEAVPA-EFYANPKEERARLFLSR  238

Query: 243 IINH                                                         246
           I+NH
Sbjct: 239 ILNH                                                         242
```

A related DNA sequence was identified in *S. pyogenes* <SEQ ID 1185> which encodes the amino acid sequence <SEQ ID 1186>. Analysis of this protein sequence reveals the following:

---
Possible site: 51
>>> Seems to have no N-terminal signal sequence
----- Final Results -----
  bacterial cytoplasm --- Certainty = 0.3763 (Affirmative) <succ>
    bacterial membrane --- Certainty = 0.0000 (Not Clear) <succ>
    bacterial outside --- Certainty = 0.0000 (Not Clear) <succ>
---

An alignment of the GAS and GBS proteins is shown below:

```
Identities = 131/243 (53%), Positives = 179/243 (72%), Gaps = 2/243 (0%)
Query:   2 SLISYKNVNKYYGDYHALRQINLEIEPGQVVVLLGPSGSGKSTLIRTMNALESIDDGSLV   61
           ++IS K+++KYYG   L+ I+L+I PG+VVV++GPSGSGKSTL+RTMN LE   G +
Sbjct:   5 AIISIKDLHKYYGHNEVLKGIDLDIMPGEVVVIIGPSGSGKSTLLRTMNLLEVPTKGQIR   64

Query:  62 VNGHELANISSKELVNLRKEVGMVFQHFNLYPHKTVLENITLAPIKVLKQSKKEAMEIAE  121
              G ++ +     ++ ++R+++GMVFQ FNL+P+ T+LENITL+PIK    +K EA + A
Sbjct:  65 FEGIDITD-KKNDIFSMREKMGMVFQQFNLFPNMTILENITLSPIKTKGMAKAEADKTAL  123

Query: 122 KYLKFVNMWERKDSYPSMLSGGQKQRIAIARGLAMHPKLLLFDEPTSALDPETIGDVLSV  181
            L    V + E+   +YP+ LSGGQ+QRIAIARGLAM P +LLFDEPTSALDPE +G+VL+V
Sbjct: 124 SLLDKVGLSEKAKAYPASLSGGQQQRIAIARGLAMDPDVLLFDEPTSALDPEMVGEVLAV  183

Query: 182 MQKLANDGMNMVVVTHEMGFAREVADRIIFMADGEILVDTTDVQDFFDNPREPRAKQFLS  241
           MQ LA  GM MV+VTHEMGFA+EVADR++FM DG ++V+      FD  +E R K FLS
Sbjct: 184 MQDLAKSGMTMVIVTHEMGFAKEVADRVMFM-DGGVIVEEGSPNQLFDLTKEERTKDFLS  242

Query: 242 NII                                                          244
           ++
Sbjct: 243 RVL                                                          245
```

Based on this analysis, it was predicted that these proteins and their epitopes could be useful antigens for vaccines or diagnostics.

Example 365

A DNA sequence (GBSx0396) was identified in *S. agalactiae* <SEQ ID 1187> which encodes the amino acid sequence <SEQ ID 1188>. This protein is predicted to be glutamine-binding. Analysis of this protein sequence reveals the following:

---
Possible site: 27
>>> Seems to have a cleavable N-term signal seq.
----- Final Results -----
  bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>
---

The protein has homology with the following sequences in the GENPEPT database:

```
>GP:CAB73178 GB:AL139076 probable ABC-type amino-acid transporter
periplasmic solute-binding protein [Campylobacter jejuni]
Identities = 99/240 (41%), Positives = 141/240 (58%), Gaps = 3/240 (1%)
Query:   1  MLRRKRLTFYLLSCIFIFLLFYPNSTSANQLSEIKKSGVLKVGVKQDVPNFGYYNAETNQ  60
            M+ RK L   +  +  +F  + +  +L  IK  G L VGVK DVP++    +  T +
Sbjct:   1  MVFRKSLLKLAVFALGACVAFSNANAAEGKLESIKSKGQLIVGVKNDVPHYALLDQATGE  60

Query:  61  YEGMEIDIAKKIAKSL---GVKPVFVPTTAQTREPLMDNGQIDILIATYTITPERKANYN 117
            +G E+D+AK +AKS+       K    V   A+TR PL+DNG +D +IAT+TITPERK  YN
Sbjct:  61  IKGFEVDVAKLLAKSILGDDKKIKLVAVNAKTRGPLLDNGSVDAVIATFTITPERKRIYN 120

Query: 118  ISKAYYHDEIGFLVRKNSHIKTIKELDGKHIGVAQGATTKVNLEKYAKEHKLKFSYAQLG 177
            S+ YY D IG LV K      K++ ++ G +IGVAQ ATTK  + + AK+  +    +++
Sbjct: 121  FSEPYYQDAIGLLVLKEKKYKSLADMKGANIGVAQAATTKKAIGEAAKKIGIDVKFSEFP 180

Query: 178  SFPELAISLYANRIDAFSVDKSILSGYLSPHTTILKEGFNTQEYGIATSKQDKVLIPYVN 237
            +P +  +L  A  R+DAFSVDKSIL GY+    + IL + F  Q YGI T K D     YV+
Sbjct: 181  DYPSIKAALDAKRVDAFSVDKSILLGYVDDKSEILPDSFEPQSYGIVTKKDDPAFAKYVD 240
```

A related DNA sequence was identified in *S. pyogenes* <SEQ ID 1189> which encodes the amino acid sequence <SEQ ID 1190>. Analysis of this protein sequence reveals the following:

---

Possible site: 30
>>> Seems to have no N-terminal signal sequence
INTEGRAL    Likelihood = −6.16    Transmembrane 17-33 (15-35)
----- Final Results -----
  bacterial membrane --- Certainty = 0.3463 (Affirmative) <succ>
    bacterial outside --- Certainty = 0.0000 (Not Clear) <succ>
      bacterial cytoplasm --- Certainty = 0.0000 (Not Clear) <succ>

---

A related sequence was also identified in GAS <SEQ ID 9097> which encodes the amino acid sequence <SEQ ID 9098>. Analysis of this protein sequence reveals the following:

---

>>> May be a lipoprotein
----- Final Results -----
  bacterial membrane --- Certainty = 0.000 (Not Clear) <succ>
    bacterial outside --- Certainty = 0.000 (Not Clear) <succ>
      bacterial cytoplasm --- Certainty = 0.000 (Not Clear) <succ>

---

An alignment of the GAS and GBS proteins is shown below:

SEQ ID 1188 (GBS136) was expressed in *E. coli* as a His-fusion product. SDS-PAGE analysis of total cell extract is shown in FIG. 29 (lane 5; MW 29.9 kDa).

Figure 284:
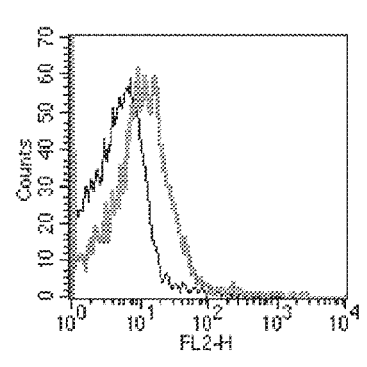

The GBS136-His fusion product was purified (FIG. 200, lane 6) and used to immunise mice. The resulting antiserum was used for FACS (FIG. 284), which confirmed that the protein is immunoaccessible on GBS bacteria.

Based on this analysis, it was predicted that these proteins and their epitopes could be useful antigens for vaccines or diagnostics.

Example 366

A DNA sequence (GBSx0397) was identified in *S. agalactiae* <SEQ ID 1191> which encodes the amino acid sequence <SEQ ID 1192>. This protein is predicted to be integral membrane. Analysis of this protein sequence reveals the following:

---

Possible site: 55
>>> Seems to have no N-terminal signal sequence
INTEGRAL    Likelihood = −9.34    Transmembrane 32-48 (27-55)
INTEGRAL    Likelihood = −5.04    Transmembrane 200-216 (196-219)
INTEGRAL    Likelihood = −3.13    Transmembrane 93-109 (93-113)
INTEGRAL    Likelihood = −2.02    Transmembrane 74-90 (74-92)
----- Final Results -----

---

```
Identities = 66/251 (26%), Positives = 111/251 (43%), Gaps = 27/251 (10%)
Query:  23  PNSTSANQLSEIKKSGVLKVGVKQDVPNFGYYNAETNQYEGMEIDIAKKIAKSLGVKPVF  82
            P+ +  +      IK+ GVLKV         +YN + N+  G E+D+ K+I  K L +K  F
Sbjct:  34  PHQSQKSSWDTIKEKGVLKVATPGTYQPTSFYN-DNNELVGYEVDMVKEIGKRLNIKVKF  92

Query:  83  VPTTAQTREPLMDNGQIDILIATYTITPERKANYNISKAYYHDEIGFLVR----KNSHIK 138
            V T      +D+G++DI +   + ITP+R+  YNIS  Y +   G +VR        N   K
Sbjct:  93  VETGFDQAFTSVDSGRVDISLNNFDITPKRQKKYNISTPYKYGVGGMIVRADGSSNIAKK 152

Query: 139  TIKELDGKHIGVAQGATTKVNLEKYAKEHKLKFSYAQLGSFPELAISLYANRI------- 191
            + +  GK     A G      +K          A+L ++  +  +Y N +
Sbjct: 153  DLSDWKGKKAAGASGTEYMKVAQKQG---------AELVTYDNVTGDVYLNDVANGRTDF 203

Query: 192  --DAFSVDKSILSGYLSPHTTILKE----GFNTQEYGIATSKQDKVLIPYVNKLLVSWEK 245
              + +   K +  LS + + +        +N  E GI  +K+D  L  ++ ++         K
Sbjct: 204  IPNDYPAQKLFVDYMLSQNPNLNVKMSDVQYNPTEQGIVMNKKDDSLKKKIDAVIKDMIK 263

Query: 246  DGSLKHIYQKF                                                 256
            DGSLK  I + +
Sbjct: 264  DGSLKKISETY                                                 274
``` bacterial membrane --- Certainty = 0.4736 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the GENPEPT database:

```
>GP:CAB73177 GB:AL139076 putative ABC-type amino-acid transporter
permease protein [Campylobacter jejuni]
Identities = 112/226 (49%), Positives = 160/226 (70%), Gaps = 3/226 (1%)
Query:   5 NISPFAISRWGAFFNHFDLFFKGFLYTLGISFGALLLALILGILSGGLSTSKSKVGKLIS    64
           +ISPFA+ ++     ++ D F  GF+YTL +S  ALL+A I G + G ++TS+ K+ +  +
Sbjct:  25 SISPFAVWKFLDALDNKDAFINGFIYTLEVSILALLIATIFGTIGGVMATSRFKIIRAYT    84

Query:  65 RIYVEVFQNTPLLVQMVFVYYGLAIISNGHVMISAFFTAVLCVGLYHGAYISEVIRSGIE   124
           RIYVE+FQN PL++Q+ F++Y L ++      + +    F   VL VG YHGAY+SEV+RSGI
Sbjct:  85 RIYVELFQNVPLVIQIFFLFYALPVLG---IRLDIFTIGVLGVGAYHGAYVSEVVRSGIL   141

Query: 125 AVPKGQTEAALAQGFTANQTMQLIILPQAVRTILPPMTNQVVNLIKNTSTVAIISGADIM   184
           AVP+GQ EA+ +QGFT  Q M+ II+PQ +R ILPPMTNQ+VNLIKNTS + I+ GA++M
Sbjct: 142 AVPRGQFEASASQGFTYIQQMRYIIVPQTIRIILPPMTNQMVNLIKNTSVLLIVGGAELM   201

Query: 185 FVAKAWAYDTTNYIPAFAGAAIFYFVICFPLASWARKQEELNKKTY                230
              A ++A D  NY PA+  AA+ YF+IC+PLA +A+  E   KK +
Sbjct: 202 HSADSYAADYGNYAPAYIFAAVLYFIICYPLAYFAKAYENKLKKAH                247
```

A related DNA sequence was identified in *S. pyogenes* <SEQ ID 1193> which encodes the amino acid sequence <SEQ ID 1194>. Analysis of this protein sequence reveals the following:

Possible site; 28
>>> Seems to have a cleavable N-term signal seq.
INTEGRAL    Likelihood = -6.26    Transmembrane 307-323 (303-327)
INTEGRAL    Likelihood = -5.89    Transmembrane 485-501 (479-502)
INTEGRAL    Likelihood = -1.12    Transmembrane 375-391 (375-391)
----- Final Results -----
bacterial membrane --- Certainty = 0.3506 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the databases:

```
>GP:BAA17584 GB:D90907 glutamine-binding periplasmic protein
[Synechocystis sp.]
Identities = 146/532 (27%), Positives = 244/532 (45%), Gaps = 59/532 (11%)
Query:   6 YMKKLILSCLVALALLFGGMSRAQANQYLRVGMEAAYAPFNWTQDDASNGAVPIEGTSQY    65
           Y    L L  L+A+A+    +      + Q + V  E + PF T           E T Q
Sbjct:  16 YYLLLALGVLLAIAIPLLPAFSQVSRQTIIVATEPTFPPFEMTD----------EATGQL    65

Query:  66 ANGYDVQVAKKVAKAMNKELLVVKTSWTGLIPALTSGKIDMIAAGMSPTKERRNEISFSN   125
              G+DV + + + +A   + +     + G+IPAL S   +  + ++ T ER   +SFS+
Sbjct:  66 T-GFDVDLIQAIGEAAQVTVDIQGYPFDGIIPALQSNTVGAAISAITITPERAQSVSFSS   124

Query: 126 SSYTSQPVLVVTANGKYADATSLKDFSGAKVTAQQGVWHVNLLTQLKGAKLQTPMGDFSQ   185
           + S    VL +                +LKD   G ++      G       + T + GAK+  T        +
Sbjct: 125 PYFKS--VLAIAVQDGNDTIKNLKDLEGKRLAVAIGTTGAMVATNVPGAKV-TNFDSITS   181

Query: 186 MRQALTSGVIDAYISERPEAMTAEAADSRLKMITLKKGFAVAESDAAIAVGMKKNDDRMA   245
             Q L +G   DA I++RP   + A   D+ L+ + +            +E      IA+ +       +
Sbjct: 182 ALQELVNGNADAVINDRPVLLYA-IKDAGLRNVKISADVG-SEDYYGIAMPLAPPGE---   236

Query: 246 TVNQVLEGFSQTDRMALDDMVTKQPVEKKAEDAKASFLGQMWAIFKGN-----------   294
           +NQ  E  +Q          ++++        EK     + FL  +     G
Sbjct: 237 -INQTREVLNQ-GLFQIIENGTYNAIYEKWFGEKNPPFLPLVAPSLVGKVGTAQSLTERS   294

Query: 295 ------------WKQFLRGTMTLLISMVGTITGLFIGLLIGIFRTAPKAKHKVAALGQK   342
                       ++       +G+ +T+L++        GL G  + I  +                K
Sbjct: 295 QANPNDNFLITLFRNLFKGSILTVLLTAFSVFFGLIGGTGVAIALISDI----------K   344

Query: 343 LFGWLLTIYIEIFRGTPMIVQSMVIYYGTAQAF-----GISIDRTLAAIFIVSINTGAYM   397
             +    IY+E FRGTPM+VQ +IY+G     F        GI+IDR  AAI  +S+N  AY+
Sbjct: 345 PLQLIFRIYVEFFRGTPMLVQLFIIYFGLPALFKEIGLGITIDRFPAAIIALSLNVAAYL   404

Query: 398 SEIVRGGIFAVDKGQFKAATALGFTHGQTMRKIVLPQVVRNILPATGNEFVINIKDTSVL   457
           +EI+RGGI ++D+GQ++A  +LG +  QTM++++  PQ  R  ILP  GNEF+   IKDTS+
Sbjct: 405 AEIIRGGIQSIDQGQWEACESLGMSPWQTMKEVIFPQAFRRILPPLGNEFITLIKDTSLT   464
```

```
                            -continued
Query:  458  NVISVVELYFSGNTVATQTYQYFQTFTIIAIIYFVLTFTVTRILRYIERRFD        509
             VI   EL+  G   +   TY+ F+ +  +A++Y +LT    + + +++E   D
Sbjct:  465  AVIGFQELFREGQLIVATTYRAFEVYIAVALVYLLLTTISSFVFKWLENYMD        516
```

An alignment of the GAS and GBS proteins is shown below:

```
Identities = 82/210 (39%), Positives = 113/210 (53%), Gaps = 12/210 (5%)
Query:   14  WGAFFNHFDLFFKGFLYTLGISFGALLLALILGILSGGLSTS---KSKVGKL-------I    63
             W F  ++  F +G   TL IS   +  L +G+L G    T+    K KV L          +
Sbjct:  288  WAIFKGNWKQFLRGTGMTLLISMVGTITGLFIGLLIGIFRTAPKAKHKVAALGQKLFGWL  347

Query:   64  SRIYVEVFQNTPLLVQMVFVYYGLAIISNGHVMISAFFTAVLCVGLYHGAYISEVIRSGI  123
              IY+E+F+ TP++VQ +  +YYG A       + I     A+  V +   GAY+SE++R GI
Sbjct:  348  LTIYIEIFRGTPMIVQSMVIYYGTAQAFG--ISIDRTLAAIFIVSINTGAYMSEIVRGGI  405

Query:  124  EAVPKGQTEAALAQGFTANQTMQLIILPQAVRTILPPMTNQVVNLIKNTSTVAIISGADI  183
              AV KGQ +AA A GFT   QTM+  I+LPQ VR  ILP    N+  V   IK+TS + +IS  ++
Sbjct:  406  FAVDKGQFKAATALGFTHGQTMRKIVLPQVVRNILPATGNEFVINIKDTSVLNVISVVEL  465

Query:  184  MFVAKAWAYDTTNYIPAFAGAAIFYFVICF                               213
              F     A T Y   F    AI YFV+ F
Sbjct:  466  YFSGNTVATQTYQYFQTFTIIAIIYFVLTF                               495
```

Based on this analysis, it was predicted that these proteins and their epitopes could be useful antigens for vaccines or diagnostics.

Example 367

A DNA sequence (GBSx0398) was identified in *S. agalactiae* <SEQ ID 1195> which encodes the amino acid sequence <SEQ ID 1196>. This protein is predicted to be amino acid ABC transporter, permease protein. Analysis of this protein sequence reveals the following:

---

Possible site: 39
>>> Seems to have an uncleavable N-term signal seq
INTEGRAL    Likelihood = −6.95    Transmembrane 25-41 (16-42)
INTEGRAL    Likelihood = −3.61    Transmembrane 66-82 (65-86)
INTEGRAL    Likelihood = −2.44    Transmembrane 184-200 (182-201)
INTEGRAL    Likelihood = −0.59    Transmembrane 119-135 (119-135)
----- Final Results -----
   bacterial membrane --- Certainty = 0.3781 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the GENPEPT database:

A related DNA sequence was identified in *S. pyogenes* <SEQ ID 1197> which encodes the amino acid sequence <SEQ ID 1198>. Analysis of this protein sequence reveals the following:

---

Possible site: 20
>>> Seems to have a cleavable N-term signal seq.
INTEGRAL    Likelihood = −10.51   Transmembrane 529-545 (517-551)
INTEGRAL    Likelihood = −10.30   Transmembrane 697-713 (693-719)
INTEGRAL    Likelihood = −4.41    Transmembrane 560-576 (555-585)
INTEGRAL    Likelihood = −0.32    Transmembrane 662-678 (662-678)
----- Final Results -----
   bacterial membrane --- Certainty = 0.5203 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the databases:

```
>GP:CAB14704 GB:Z99118 glutamine ABC transporter (integral membrane
protein) [Bacillus subtilis]
Identities = 84/206 (40%), Positives = 129/206 (61%), Gaps = 6/206 (2%)
Query:   10  ILFLLQGFGLTLYISFISILLSMFFGTLLAIMRNSKNPIWKLIASIYIEFVRNVPNLLWI   69
             + FL   GF +TLY++FISI+LS FFG +    +R +K P+    + ++ +E +RN+P LL I
Sbjct:   12  LAFLWDGFLVTLYVAFISIILSFFFGLIAGTLRYAKVPVLSQLIAVLVETIRNLPLLLII   71

Query:   70  FIIFLVF-----QMKSVSAGITSFTIFTSAALAEIIRGGLNGVDKGQTEAGLSQGFTYLQ  124
             F  F          +++   +A IT+ TIF SA L+EIIR GL    +DKGQ EA  S G +Y Q
Sbjct:   72  FFTFFALPEIGIKLEITAAAITALTIFESAMLSEIIRSGLKSIDKGQIEAARSSGLSYTQ  131

Query:  125  VFIIIIFPQAFRKMLPAIISQFVTVIKDTSLLYSVIAIQEIFGKSQILMGRYFEAGQVFT  184
             + +   PQA R+M+P I+SQF++++KDTSL    VIA+  E+   +QI+ G+    +     F
Sbjct:  132  TLFFIVMPQALRRMVPPIVSQFISLLKDTSLAV-VIALPELIHNAQIINGQSADGSYFFP  190

Query:  185  LYAIITAVYFITNFIISSFSRKLSKR                                    210
             ++ +    +YF  N+  +S  +R+L  R
Sbjct:  191  IFLLAALMYFAVNYSLSLAARRLEVR                                    216
```

```
>GP:BAA17584 GB:D90907 glutamine-binding periplasmic protein
[Synechocystis sp.]
Identities = 153/475 (32%), Positives = 251/475 (52%), Gaps = 27/475 (5%)
Query: 273 IVSDSSFAPFEFQN-GKGKYVGIDIELIKAIAKQQGFKIEIANPGFDAALNAVQSSQADG 331
           + ++ +F PFE +   G+  G D++LI+AI +      ++I   FD  + A+QS+
Sbjct:  46 VATEPTFPPFEMTDEATGQLTGFDVDLIQAIGEAAQVTVDIQGYPFDGIIPALQSNTVGA 105

Query: 332 VIAGATITDARKAIFDFSDPYYTSNIILAVKAGKN-IKNYEDLDRKTVGARNGTSSYSWL 390
           I+ TIT R     FS PY+ S + +AV+ G + IKN +DL+ K +   GT+  + +
Sbjct: 106 AISAITITPERAQSVSFSSPYFKSVLAIAVQDGNDTIKNLKDLEGKRLAVAIGTTG-AMV 164

Query: 391 KENAPKYGYNVKAFDDGSSMYDSLNSGSVDAIMDDEAVLKYAISQG--RRFETPLEGIST 448
                N P  G V  FD +S    L +G+ DA+++D  VL YAI    R +   + S
Sbjct: 165 ATNVP--GAKVTNFDSITSALQELVNGNADAVINDRPVLLYAIKDAGLRNVKISADVGSE 222

Query: 449 GEVGFAVKKGTNPELI---EMFNNGLAALKKSGQYDDIIDKYLDSKKA-----ATPSEKG 500
            G A+    E+    E+ N GL + ++G Y+ I +K+   K            PS  G
Sbjct: 223 DYYGIAMPLAPPGEINQTREVLNQGLFQIIENGTYNAIYEKWFGEKNPPFLPLVAPSLVG 282

Query: 501 -----------ADESTISGLLSNNYKQLLAGLGTTLSLTLISFAIAIIIGIIFGMMAVSP 549
                      + +    L ++ L G  T+ LT S   +I G   + +S
Sbjct: 283 KVGTAQSLTERSQANPNDNFLITLFRNLFKGSILTVLLTAFSVFFGLIGGTGVAIALISD 342

Query: 550 TKSLRLISTVFVDVVRGIPLMIVAAFIFWGVPNLIESMIGHQSPINDFLAATIALSLNGG 609
            K L+LI ++V+ RG P+++   I++G+P L + G   I+ F AA IALSLN
Sbjct: 343 IKPLQLIFRIYVEFFRGTPMLVQLFIIYFGLPALFKEI-GLGITIDRFPAAIIALSLNVA 401

Query: 610 AYIAEIVRGGIEAVPAGQMEASRSLGLSYGTTMRKVILPQAVKLMLPNFINQFVISLKDT 669
           AY+AEI+RGGI+++ GQ EA  SLG+S   TM++VI PQA + +LP    N+F+  +KDT
Sbjct: 402 AYLAEIIRGGIQSIDQGQWEACESLGMSPWQTMKEVIFPQAFRRILPPIGNEFITLIKDT 461

Query: 670 TIVSAIGLVELFQTGKIIIARNYQSFRMYAILAIIYLIMIILLTRLAKRLEKRLN      724
           ++ +  IG  ELF+ G++I+A  Y++F +Y  +A++YL++  + + + K LE  ++
Sbjct: 462 SLTAVIGFQELFREGQLIVATTYRAFEVYIAVALVYLLLITISSFVFKWLENYMD      516

Identities = 68/247 (27%), Positives = 106/247 (42%), Gaps = 11/247 (4%)
Query:   7 VLLLAIMSIFLTCNIASAETIAIVSDTAYAPFEFKD--SDQIYKGIDVDIINEVAKRQSW  64
           VLL  + +     + S +TI +++  + PFE D  + Q+  G DVD+I + +
Sbjct:  24 VLLAIAIPLLPAFSQVSRQTIIVATEPTFPPFEMTDEATGQL-TGFDVDLIQAIGEAAQV  82

Query:  65 DFSMSFPGFDAAVNAVQSGQASALMAGTTITNARKKVFHFSEPYYDTKIVIATRKAN-AI 123
            +    FD  A+QS     A ++  TIT R +    FS PY+ + + IA + N I
Sbjct:  83 TVDIQGYPFDGIIPALQSNTVGAAISAITITPERAQSVSFSSPYFKSVLAIAVQDGNDTI 142

Query: 124 KKYSDLKGKTVGVKNGTAAQAFLNNYKKKYDYTVKTFDTGDLMYNSLSAGSIAAVMDDEA 183
           K   DL+GK +  V   GT          N       V  FD+    L  G+  AV++D
Sbjct: 143 KNLKDLEGKRLAVAIGTTGAMVATNVP---GAKVTNFDSITSALQELVNGNADAVINDRP 199

Query: 184 VIQYAIS----QNQDIAINMKGEPIGSFGFAVKKGSGYDYLVNDFNTALKAMKADGTYQA 239
           V+ YAI    +N  I+ ++   E       +  +     N L +  +GTY A
Sbjct: 200 VLLYAIKDAGLRNVKISADVGSEDYYGIAMPLAPPGEINQTREVLNQGLFQIIENGTYNA 259

Query: 240 IMTKWLG                                                      246
           I  KW G
Sbjct: 260 IYEKWFG                                                      266
```

An alignment of the GAS and GBS proteins is shown below:

```
Identities = 68/210 (32%), Positives = 113/210 (53%), Gaps = 16/210 (7%)
Query:  13 LLQGFGLTLYISFISILLSMFFGTLLAIMRNSKNPIWKLIASIYIEFVRNVPNLLWIFII   72
           LL G G TL ++ IS  +++  G +  +M  S       +LI++++++ VR +P ++     I
Sbjct: 517 LLAGLGTTLSLTLISFAIAIIIGIIFGMMAVSPTKSLRLISTVFVDVVRGIPLMIVAAFI  576

Query:  73 F-----LVFQMKSVSAGITSFTIFT-------SAALAEIIRGGLNGVDKGQTEAGLSQGF 120
           F     L+  M    + I  F    T       A +AEI+RGG+   V GQ EA   S G
Sbjct: 577 FWGVPNLIESMTGHQSPINDFLAATIALSLNGGAYIAEIVRGGIEAVPAGQMEASRSLGL 636

Query: 121 TYLQVFIIIIFPQAFRKMLPAIISQFVTVIKDTSLLYSVIAIQEIFGKSQILMGRYFEAG 180
           +Y      +I PQA + MLP  I+QFV +KDT+++ S I + E+F   +I++ R +
Sbjct: 637 SYGTTMRKVILPQAMYLMLPNFINQFVISLKDTTIV-SAIGLVELFQTGKIIIARNY--- 692

Query: 181 QVFTLYAIITAVYFITNFIISSFSRKLSKR                               210
           Q F +YAI+  +Y I   +++  ++L KR
Sbjct: 693 QSFRMYAILAIIYLIMIILLTRLAKRLEKR                               722
```

Based on this analysis, it was predicted that these proteins and their epitopes could be useful antigens for vaccines or diagnostics.

Example 368

A DNA sequence (GBSx0399) was identified in *S. agalactiae* <SEQ ID 1199> which encodes the amino acid sequence <SEQ ID 1200>. Analysis of this protein sequence reveals the following:

```
Possible site: 39
>>> Seems to have an uncleavable N-term signal seq
INTEGRAL    Likelihood = -12.21    Transmembrane 7-23 (1-30)
----- Final Results -----
    bacterial membrane --- Certainty = 0.5883 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the GENPEPT database:

```
>GP:BAB04094 GB:AP001508 unknown conserved protein in B. subtilis
[Bacillus halodurans]
Identities = 43/157 (27%), Positives = 83/157 (52%), Gaps = 9/157 (5%)
Query:  26 YQSQFQKTTNQALAIAYKDAKVAKK--DVIHQKIDKEFENFRGSYEIEFNTKSAEYSYHV    83
            +Q++        N+ L +A         ++ + +  + +K+ +N R  YEIE      EY + +
Sbjct:  38 HQAESVSADNEGLTLAEASDIALERAGNGVVTEAEKDRDNGRVVYEIEVKNDDDEYDFKI    97

Query:  84 DVKTGQILERDMDNNGFSKSTSQSSSSSSQKSHKISQEEAKKIAFKDANIEESEVSNLKI   143
            D +TG+IL+   +   SK      SSS   ++   IS +EAK+IA K+ +      ++ ++++
Sbjct:  98 DQQTGEILKEKQEQRKGSKPREGHSSSKGSEA-VISMDEAKEIALKEVS---GKIDDIEL   153

Query: 144 KEEIENGKSVYDIDF-VDLKNKNEVDYQIDAETGKII                         179
              E ENG  VY+++    D  + ++V   +DA TG ++
Sbjct: 154 --ERENGSLVYEVEIESDHYDDDDVTVYVDAMTGNVL                         188
```

A related DNA sequence was identified in *S. pyogenes* <SEQ ID 1201> which encodes the amino acid sequence <SEQ ID 1202>. Analysis of this protein sequence reveals the following:

```
Possible site: 57
>>> Seems to have no N-terminal signal sequence
INTEGRAL    Likelihood = -5.15    Transmembrane 42-58 (41-60)
----- Final Results -----
    bacterial membrane --- Certainty = 0.3060 (Affirmative) <succ>
      bacterial outside --- Certainty = 0.0000 (Not Clear) <succ>
        bacterial cytoplasm --- Certainty = 0.0000 (Not Clear) <succ>
```

The protein has no significant homology with any sequences in the GENPEPT database.

An alignment of the GAS and GBS proteins is shown below:

```
Identities = 37/96 (38%), Positives = 63/96 (65%), Gaps = 5/96 (5%)
Query:  94 DMDNNGFSKSTSQSSSSSSQKSHKISQEEAKKIAFKDANIEESEVSNLKIKEEIENGKSV   153
            DMD+          +Q  +S + K    K+S+++AK IA KDA++ E++    L + ++ E+GK+V
Sbjct:  59 DMDDKD-DHMDNQPKTSQTSKKVKLSEDKAKSIALKDASVTEADAQMLSVTQDNEDGKAV   117

Query: 154 YDIDFVDLKNKN-EVDYQIDAEIGKIIERSRDHMND                          188
            Y+I+F   +NK+ E  Y IDA +G  I+E+S + +ND
Sbjct: 118 YEIEF---QNKDQEYSYTIDANSGDIVEKSSEPIND                          150

Identities = 23/62 (37%), Positives = 37/62 (59%)
Query:  35 NQALAIAYKDAKVAKKDVIHQKIDKEFENFRGSYEIEFNTKSAEYSYHVDVKTGQILERD    94
            ++A +IA KDA V + D     +  ++ E+ +   YEIEF   K  EYSY +D   +G I+E+
Sbjct:  85 DKAKSIALKDASVTEADAQMLSVTQDNEDGKAVYEIEFQNKDQEYSYTIDANSGDIVEKS   144

Query:  95 MD                                                             96
            +
Sbjct: 145 SE                                                            146
```

A related GBS gene <SEQ ID 8563> and protein <SEQ ID 8564> were also identified. Analysis of this protein sequence reveals the following:

Lipop: Possible site: -1   Crend: 9
McG: Discrim Score: 14.45
GvH: Signal Score (-7.5): -5.92

-continued

```
Possible site: 39
>>> Seems to have an uncleavable N-term signal seq
ALOM program    count: 1 value: -8.92   threshold: 0.0
INTEGRAL        Likelihood = -8.92      Transmembrane 7-23 (2-28)
PERIPHERAL      Likelihood = 10.93      37
modified ALOM score: 2.28
*** Reasoning Step: 3
----- Final Results -----
    bacterial membrane --- Certainty = 0.4567 (Affirmative) <succ>
        bacterial outside --- Certainty = 0.0000 (Not Clear) <succ>
            bacterial cytoplasm --- Certainty = 0.0000 (Not Clear) <succ>
```

The protein has homology with the following sequences in the databases:

```
Possible site: 53
>>> Seems to have no N-terminal signal sequence
----- Final Results -----
    bacterial cytoplasm --- Certainty = 0.1499 (Affirmative) <succ>
        bacterial membrane --- Certainty = 0.0000 (Not Clear) <succ>
            bacterial outside --- Certainty = 0.0000 (Not Clear) <succ>
```

A related GBS nucleic acid sequence <SEQ ID 9709> which encodes amino acid sequence <SEQ ID 9710> was also identified.

The protein has no significant homology with any sequences in the GENPEPT database.

```
26.1/59.2% over 140aa
Bacillus subtilis
EGAD|107494|hypothetical protein Insert characterized
GP|2632048|emb|CAA05607.1||AJ002571 YkoJ Insert characterized
GP|2633682|emb|CAB13185.1||Z99110 similar to hypothetical proteins from
B. subtilis
Insert characterized
PIR|F69859|F69859 conserved hypothetical protein ykoJ-Insert characterized
ORF00925(379-852 of 1164)
EGAD|107494|BS1329(29-169 of 170) hypothetical protein {Bacillus subtilis}
GP|2632048|emb|CAA05607.1||AJ002571 YkoJ {Bacillus subtilis}
GP|2633682|emb|CAB13185.1||Z99110 similar to hypothetical proteins from
B. subtilis
{Bacillus subtilis} PIR|F69859|F69859 conserved hypothetical protein ykoJ-
Bacillus subtilis
% Match = 6.2
% Identity = 26.1 % Similarity = 59.2
Matches = 37 Mismatches = 52 Conservative Sub.s = 47

297       327       357       387       417       447       468       498
NIIE**KEGCCMIKKNKVFLEVLLVLVVILEGGVLFYQSQFQKTTNQALAIAYKDAKVAKKDVIH---QKIDKEFENFRG
              |  :|   |                 :: :: :::  |:  ::|:    | |:   : ||::: | :
        MLKKKWMVGLLAGCLAAGGFSYNAFATENNENRQASSKTDALTEQEAEAIAKTVVDGTVEDIDRDLYNGKE
            10        20        30        40        50        60        70

528       558       588       618       648       672       702       732
SYEIEFNTKSAEYSYHVDVKTGQILERDMDNNGFSKSTSQSSSSSSQKSHK--ISQEEAKKIAFKDANIEESEVSNLKIK
||:|   :  :|   :||:  |  |   |     :                 :|: :  |::|||::||:|       |:  |:
VYEVEIEKEGEDYDVYVDIHTKQALNDPL---------------KEKAEQVAITKEEAEEIALKQTG---GTVTESKLD
         90        100                            110       120       130

762       792       822       852       882       912       942       972
EEIENGKSVYDIDFVDLKNKNEVDYQIDAETGKIIERSRDHMND*FK*DIKKRRSKRPSF*LLSSLLPTF*KFT*KT*DD
|:  :|    :|::: :     |      |:::|   |:  |:||:: |
ED--DGAYIYEME-IQTKQGTETEFEISAKDGRIIKQEIDD
          140       150       160       170
```

Figure 16:
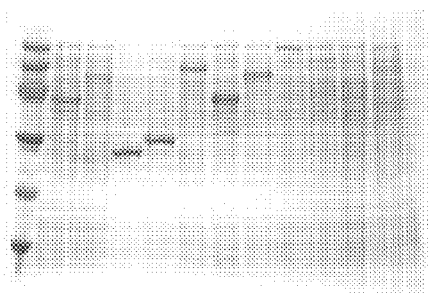

SEQ ID 8564 (GBS37) was expressed in *E. coli* as a His-fusion product. SDS-PAGE analysis of total cell extract is shown in FIG. 14 (lane 4; MW 22 kDa). It was also expressed in *E. coli* as a GST-fusion product. SDS-PAGE analysis of total cell extract is shown in FIG. 16 (lane 10; MW 47 kDa).

Based on this analysis, it was predicted that these proteins and their epitopes could be useful antigens for vaccines or diagnostics.

Example 369

A DNA sequence (GBSx0400) was identified in *S. agalactiae* <SEQ ID 1203> which encodes the amino acid sequence <SEQ ID 1204>. Analysis of this protein sequence reveals the following:

A related DNA sequence was identified in *S. pyogenes* <SEQ ID 1205> which encodes the amino acid sequence <SEQ ID 1206>. Analysis of this protein sequence reveals the following:

```
Possible site: 42
>>> Seems to have no N-terminal signal sequence
----- Final Results -----
    bacterial cytoplasm --- Certainty = 0.2808 (Affirmative) <succ>
        bacterial membrane --- Certainty = 0.0000 (Not Clear) <succ>
            bacterial outside --- Certainty = 0.0000 (Not Clear) <succ>
```

An alignment of the GAS and GBS proteins is shown below:

```
Identities = 128/297 (43%), Positives = 180/297 (60%), Gaps = 9/297 (3%)
Query:  54  IDDIKVGSPIFKYFWT-SLSLQAPLKALEFVLEQAKMPTELSGELSETQYLVAQFSDELA  112
            I D ++GSP F  W     Q+  + L F+L+  +MP ELSG+L ETQ L+ +F    L
Sbjct:  46  IIDNRLGSPTFWVIWPIEKENQSAKQLLTFLLDLVEMPFELSGQLHETQTLLTRFHPSLL  105

Query: 113  PHDDFWIALSQVIYDSFPGNSLAEDTVLNRKLHQFRYLISSQQAQYVRRYFKDVGMTDRD  172
            P   FW  L+ ++  +FPG +L++    L ++LHQFRY+ISSQQAQ +R ++K + MTD
Sbjct: 106  PDHMFWKELASLVDQAFPGKTLSQAGELEKRLHQFRYVISSQQAQSIRNHYKMIEMTDAQ  165

Query: 173  ALVNYL-----SCL-REPDSIAYYESARLHNKRRRNGEIFGFPDDEPVINSKLLISFHTE  226
            AL  +L     CL R+        +SARLHNK R          FP  E   N K+L+ FHTE
Sbjct: 166  ALALFLRSKKGPCLWRQAPDYTLMDSARLHNKLRFEDNKVIFPSQEVSYNIKVLLWFHTE  225

Query: 227  FIIDDKGNFLNEIDAEVITRNGIINGASFNYAFKNNTRHKELDVDPVK-LDPKFRNDMTR  285
            F +D  G FLNE+DAEV+T  GI+NGASFNY   +   RH +LDVDP+   DP+FR D  +
Sbjct: 226  FTLDSTGFFLNEVDAEVVTEKGIVNGASFNYG-TDGPRHWDLDVDPISHHDPQFRRDTLK  284

Query: 286  GYRSPNLSRRKWFFFKEEDYDCSYFNKKGYYAFGRRSAKQSVDKQVKYLKKAVQKMR    342
            G+RSP    R+WF +++D+  SYFN KG +A+  +S+    V K  K+ +  ++
Sbjct: 285  GFRSPKRVFRQWFRAQKDDFMFSYFNAKGLFAYHNKSSFARVKKSAKQFKRQIHPIK    341
```

Based on this analysis, it was predicted that these proteins and their epitopes could be useful antigens for vaccines or diagnostics.

Example 370

A DNA sequence (GBSx0401) was identified in *S. agalactiae* <SEQ ID 1207> which encodes the amino acid sequence <SEQ ID 1208>. This protein is predicted to be similar to two-component response regulator [YcbM] (ompr-likeprotei). Analysis of this protein sequence reveals the following:

Possible site: 31
>>> Seems to have no N-terminal signal sequence
----- Final Results -----
bacterial cytoplasm --- Certainty = 0.3129 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database:

```
>GP:CAA55264 GB:X78502 gtcR [Brevibacillus brevis]
Identities = 99/228 (43%), Positives = 149/228 (64%), Gaps = 3/228 (1%)

Query:   2  RTVLVVQGDDETIELLRSYLEGALYKVVMASDGEEAFSLFQQHQIDLAIIDITLPKIDGY   61
            +T+L+   + E IELL+ +LE   Y+++ A DGE+A++   +QH +DLAIIDI +P +DG+
Sbjct:   3  KTILIADDEPEIIELLKLFLERESYRIIEAYDGEQAWNYIRQHPVDLAIIDIMMPALDGF   62

Query:  62  ELTRLIRQDSQIPIIMLAAKTTDMDRILGLNIGADDFITKPFNSLEVLARINSQLRRYYE  121
            +L + +   + ++P+I+L+AK  D D+ILGL +GADDFI+KPFN LE +ARI +QLRR +E
Sbjct:  63  QLIKRLTNEYKLPVIILSAKNRDSDKILGLGLGADDFISKPFNPLEAVARIQAQLRRAFE  122

Query: 122  FNSLAKP--KNQFIKIGELELDEEHVELTKNGKHIKLTATEFKILHILMS-SPGRIYTKT  178
            FN       +   Q   +G L L         +  +  +T E+++L+ M S    I+TK
Sbjct: 123  FNEPEEKAISTQSTTVGRLTLLHTACVVYRGDETYSVTPLEYRLLNTFMQCSRTSIFTKQ  182

Query: 179  QLYEKINGRYLEGDETTIMVHISNIRDKIEDDSKYPKYIKTLRGVGYK              226
            QL+E+        D+ TIMV IS +RDKIED + P YIKT+RG+GYK
Sbjct: 183  QLFEQAWSETYWEDDNTIMVQISRLRDKIEDQPRQPVYIKTVRGLGYK              230
```

There is also homology to SEQ ID 1182:

```
Identities = 87/230 (37%), Positives = 144/230 (61%), Gaps = 5/230 (2%)
Query:   1 MRTVLVVQGDDETIELLRSYLEGALYKVVMASDGEEAFSLFQQHQIDLAIIDITLPKIDG   60
           M+ +L+V +    ++++ L    Y +V A DG EA ++F++ + DL I+D+ LP++DG
Sbjct:   1 MKKILIVDDEKPISDIIKFNLTKEGYDIVTAFDGREAVTIFEEEKPDLIILDLMLPELDG   60

Query:  61 YELTRLIRQDSQIPIIMLAAKTTDMDRILGLNIGADDFITKPFNSLEVLARINSQLRRYY  120
           E+ + IR+ S +PIIML+AK ++ D+++GL IGADD++TKPF++ E+LAR+ + LRR
Sbjct:  61 LEVAKEIRKTSHVPIIMLSAKDSEFDKVIGLEIGADDYVTKPFSNRELLARVKAHLRRTE  120

Query: 121 EFNSLAKPKN-----QFIKIGELELDEEHVELTKNGKHIKLTATEFKILHILMSSPGRIY  175
                 +N       Q + IG L++ +        K+G+ ++LT  EF++LH L +  G++
Sbjct: 121 TIETAVAEENASSGTQELTIGNLQILPDAFVAKKHGQEVELTHREFELLHHLANHMGQVM  180

Query: 176 TKTQLYEKINGRYLEGDETTIMVHISNIRDKIEDDSKYPKYIKTLRGVGY           225
           T+  L E + G    GD  T+ V +  +R+KIED     P+YI T RGVGY
Sbjct: 181 TREHLLEIVWGYDYFGDVRTVDVTVRRLREKIEDTPSRPEYILTRRGVGY           230
```

Based on this analysis, it was predicted that this protein and its epitopes, could be useful antigens for vaccines or diagnostics.

Example 371

A DNA sequence (GBSx0402) was identified in *S. agalactiae* <SEQ ID 1209> which encodes the amino acid sequence <SEQ ID 1210>. This protein is predicted to be threonyl-tRNA synthetase 1 (thrS). Analysis of this protein sequence reveals the following:

```
Possible site: 32
>>> Seems to have no N-terminal signal sequence
----- Final Results -----
  bacterial cytoplasm --- Certainty = 0.2353 (Affirmative) <succ>
  bacterial membrane --- Certainty = 0.0000 (Not Clear) <succ>
  bacterial outside --- Certainty = 0.0000 (Not Clear) <succ>
```

The protein has homology with the following sequences in the GENPEPT database:

```
>GP:BAB06860 GB:AP001517 threonyl-tRNA synthetase 1 [Bacillus halodurans]
Identities = 413/638 (64%), Positives = 506/638 (78%), Gaps = 7/638 (1%)
Query:   1 MIKITFPDGAIREFESGITTFEIAQSISNSLAKKALAGKFNGQLIDTTRAIEEDGSIEIV   60
           MI ITFPDGA++EF  G TT EIA SIS  L KKALAG +G L+D    IE+DG+I
Sbjct:   4 MINITFPDGAVKEFPKGTTTAEIAGSISPGLKKKALAGMLDGTLLDLNTPIEQDGTITIV   63

Query:  61 TPDHEDALGVLRHSAAHLFAQAAKRLFPD--LCLGVGPAIQDGFYYDTDNKSGQISNDDL  118
           TP+ ++AL VLRHS AH+ AQA KRLF D   + LGVGP I+ GFYYD D       ++ +DL
Sbjct:  64 TPESDEALEVLRHSTAHVMAQALKRLFKDRNVKLGVGPVIEGGFYYDVDMDES-LTPEDL  122

Query: 119 PRIEEEMKKIVKENHPCIREEISKEEALELFKD--DPYKVELISEHAEDG-LIVYRQGEF  175
           P+IE+EMKKI+ EN P  R  +S+EEAL +++    DPYK+ELI++  ED  +T+Y QGEF
Sbjct: 123 PKIEKEMKKIIGENLPIERVVVSREEALARYEEVGDPYKIELINDLPEDETITIYEQGEF  182

Query: 176 VDLCRGPHVPSTGRIQVFHLLNVAGAYWRGNSDNAMMQRVYGTAWFDKKDLKAYLKRREE  235
            DLCRG HVPSTG+++ F LLN+AGAYWRG+S N M+QR+YGTA+F K DL  +L+ EE
Sbjct: 183 FDLCRGVHVPSIGKLEFKLLNLAGAYWRGDSSNKMLQRIYGTAFFKKADLDEHLRLLEE  242

Query: 236 AKERDHRKLGKELDLFMVNPEVGQGLPFWLPNGATIRRELERYIVDKEIASGYQHVYTPP  295
           AKERDHRKLGKEL +F ++ +VGQGLP WLP GATIRR +ERYIVDKE   GYQRVYTP
Sbjct: 243 AKERDHRKLGKELGIFALSQKVGQGLPLWLPKGATIRRIIERYIVDKEEKLGYQHVYTPV  302

Query: 296 MASVEFYKTSGHWDHYREDMFATMDMGDGEEFVLRPMNCPHHIEVYKHHVHSYRELPIRI  355
           +AS E YKTSGHWDHY++DMFPTM+M + EE VLRPMNCPHH+ VYK  + SYR+LP+RI
Sbjct: 303 LASSELYKTSGHWDHYKDDMFPTMEM-ENEELVLRPMNCPHHMMVYKTEMRSYRQLPLRI  361

Query: 356 AELGMMHRYEKSGALTGLQRVREMTLNDAHIFVTPEQIKDEFLKALNLIAEIYEDFNLTD  415
           AELG+MHRYE SGA++GLQRV MTLNDAHIF P+QIKDEF++ + LI +YEDF L +
Sbjct: 362 AELGLMHRYEMSGAVSGLQRVRGMTLNDAHIFCRPDQIKDEFVRVVRLIQAVYEDFGLKN  421

Query: 416 YRFRLSYRDPEDKHKYYDNDEMWENAQAMLKEAMDDFGLDYFEAEGEAAFYGPKLDIQVK  475
           Y FRLSYRDPEDK KY+D+D MW  AQ MLKEAMD+  L+YFEAEGEAAFYGPKLD+QV+
Sbjct: 422 YSFRLSYRDPEDKEKYFDDDNMWNKAQGMLKEAMDELELEYFEAEGEAAFYGPKLDVQVR  481

Query: 476 TALGNEETLSTIQLDFLLPERFDLKYIGADGEEHRPIMIHRGGISTMERFTAILIETYKG  535
           TALG +ETLST+QLDFLLPERFDL Y+G DG+ HRP+++HRG +STMERF A L+E YKG
Sbjct: 482 TALGKDETLSTVQLDFLLPERFDLTYVGEDGQPHRPVVVRRGVVSTMERFVAFLLEEYKG  541

Query: 536 AFPTWLAPQQVSVIPISNEAHIDYAWEVARVLKDRGIRAEVDDRNEKMQYKIRAAQTQKI  595
           AFPTWLAP QV VIP+S EAH++YA  V   L+  GIR E+D+R+EK+ YKIR AQ QKI
Sbjct: 542 AFPTWLAPVQVQVIPVSPEAHLEYAKNVQETLQQAGIRVEIDERDEKIGYKIREAQMQKI  601

Query: 596 PYQLIVGDKEMEEKAVNVRRYGSKATETKSIEEFVESI                       633
           PY L++GDKE+E   VNVR+YG K +   ++EFV +
Sbjct: 602 PYMLVLGDKEVEANGVNVRKYGEKDSSSMGLDEFVRHV                       639
```

A related DNA sequence was identified in *S. pyogenes* <SEQ ID 1211> which encodes the amino acid sequence <SEQ ID 1212>. Analysis of this protein sequence reveals the following:

```
Possible site: 32
>>> Seems to have no N-terminal signal sequence
----- Final Results -----
   bacterial cytoplasm --- Certainty = 0.2566 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below:

```
Identities = 564/644 (87%), Positives = 608/644 (93%)
Query:   1 MIKITFPDGAIREFESGITTFEIAQSISNSLAKKALAGKFNGQLIDTTRAIEEDGSIEIV  60
           MIKITFPDGA+REFESG+TTF+IA+SIS SLAKKALAGKFN QLIDTTRAIEEDGSIEIV
Sbjct:   1 MIKITFPDGAVREFESGVTTEDIAESISKSLAKKALAGKFNDQLIDTTRAIEEDGSIEIV  60

Query:  61 TPDHEDALGVLRHSAAHLFAQAAKRLFPDLCLGVGPAIQDGFYYDTDNKSGQISNDDLPR 120
           TPDH+DA  VLRHSAAHLFAQAAKRLFP+L LGVGPAI +GFYYDTDN  GQISN+DLPR
Sbjct:  61 TPDHKDAYEVLRHSAAHLFAQAAKRLFPNLHLGVGPAIAEGFYYDTDNAEGQISNEDLPR 120

Query: 121 IEEEMKKIVKENHPCIREEISKEEALELFKDDPYKVELISEHAEDGLTVYRQGEFVDLCR 180
           IE EM+KIV EN+PCIREE++KEEALELFKDDPYKVELI+EHA  GLTVYRQGEFVDLCR
Sbjct: 121 IEAEMQKIVTENYPCIREEVTKEEALELFKDDPYKVELINEHAGAGLTVYRQGEFVDLCR 180

Query: 181 GPHVPSTGRIQVFHLLNVAGAYWRGNSDNAMMQRVYGTAWFDKKDLKAYLKRREEAKERD 240
           GPHVPSTGRIQVFHLLNVAGAYWRGNSDN MMQR+YGTAWFDKKDLKAYL R EEAKERD
Sbjct: 181 GPHVPSTGRIQVFHLLNVAGAYWRGNSDNNMMQRIYGTAWFDKKDLKAYLTRLEEAKERD 240

Query: 241 HRKLGKELDLFMVNPEVGQGLPFWLPNGATIRRELERYIVDKEIASGYQHVYIPPMASVE 300
           HRKLGKELDLFM++ EVGQGLPFWLP+GATIRR LERYI DKE+ASGYQHVYTPP+ASVE
Sbjct: 241 HRKLGKELDLEMISQEVGQGLPFWLPDGATIRRTLERYITDKELASGYQHVYTPPLASVE 300

Query: 301 FYKTSGHWDHYREDMFPTMDMGDGEEFVLRPMNCPHHIEVYKHHVHSYRELPIRIAELGM 360
            YKTSGHWDHY+EDMFP MDMGDGEEFVLRPMNCPHHI+VYK+HV SYRELPIRIAELGM
Sbjct: 301 LYKTSGHWDHYQEDMFPVMDMGDGEEFVLRPMNCPHHIQVYKNHVRSYRELPIRIAELGM 360

Query: 361 MHRYEKSGALTGLQRVREMTLNDAHIFVTPEQIKDEFLKALNLIAEIYEDFNLTDYRFRL 420
           MHRYEKSGAL+GLQRVREMTLND HIFVTPEQI++EF +AL LI ++Y DFNLTDYRFRL
Sbjct: 361 MHRYEKSGALSGLQRVREMTLNDGHIFVTPEQIQEEFQRALQLIIDVYADFNLTDYRFRL 420

Query: 421 SYRDPEDKHKYYDNDEMWENAQAMLKEAMDDEGLDYFEAEGEAAFYGPKLDIQVKTALGN 480
           SYRDP D HKYYDNDEMWENAQ+MLK A+D+ G+DYFEAEGEAAFYGPKLDIQVKTALGN
Sbjct: 421 SYRDPNDTHKYYDNDEMWENAQSMLKAALDEMGVDYFEAEGEAAFYGPKLDIQVKTALGN 480

Query: 481 EETLSTIQLDFLLPERFDLKYIGADGEEHRPIMIHRGGISTMERFTAILIETYKGAFPTW 540
           EETLSTIQLDFLLPERFDLKYIGADGEEHRP+MIHRG ISTMERFTAILIETYKGAFPTW
Sbjct: 481 EETLSTIQLDFLLPERFDLKYIGADGEEHRPVMIHRGVISTMERFTAILIETYKGAFPTW 540

Query: 541 LAPQQVSVIPISNEAHIDYAWEVARVLKDRGIRAEVDDRNEKMQYKIRAAQTQKIPYQLI 600
           LAP QV+VIPISNEAHIDYAWEVA+ L+DRG+RA+VDDRNEKMQYKIRA+QT KIPYQLI
Sbjct: 541 LAPHQVTVIPISNEAHIDYAWEVAKTLRDRGVRADVDDRNEKMQYKIRASQTSKIPYQLI 600

Query: 601 VGDKEMEEKAVNVRRYGSKATETKSIEEFVESILADIARKSRPD                644
           VGDKEME+K+VNVRRYGSK T T+S+EEFVE+ILADIARKSRPD
Sbjct: 601 VGDKEMEDKSVNVRRYGSKTTHTESVEEFVENILADIARKSRPD                644
```

Based on this analysis, it was predicted that these proteins and their epitopes could be useful antigens for vaccines or diagnostics.

Example 372

A DNA sequence (GBSx0403) was identified in *S. agalactiae* <SEQ ID 1213> which encodes the amino acid sequence <SEQ ID 1214>. Analysis of this protein sequence reveals the following:

```
Possible site: 16
>>> Seems to have no N-terminal signal sequence
----- Final Results -----
   bacterial cytoplasm --- Certainty = 0.1985 (Affirmative) <succ>
   bacterial membrane --- Certainty = 0.0000 (Not Clear) <succ>
   bacterial outside --- Certainty = 0.0000 (Not Clear) <succ>
```

The protein has homology with the following sequences in the GENPEPT database:

```
GP:CAA72250 GB:Y11463 ORF5 [Streptococcus pneumoniae]
Identities = 189/290 (65%), Positives = 234/290 (80%)
Query:   1  MRIGLFTDTYFPQVSGVSTSIRTLKEGLEKEGHEVYIFTTTDRNVKRFEDPTIIRLPSVP    60
            MRIGLFTDTYFPQVSGV+TSIRTLK  LEK+GH V+IFITTD++V R+ED   IIR+PSVP
Sbjct:   1  MRIGLFTDTYFPQVSGVATSIRTLKTELEKQGHAVFIFTTTDKDVNRYEDWQIIRIPSVP    60

Query:  61  FISFTDRRVVYRGLISAYRIAKDYELDIIHTQTEFSLGLLGKLVAKALRIPVVHTYHTQY   120
            F +F DRR  YRG    A  IAK Y+LDIIHTQTEFSLGLLG  +A+ L+IPV+HTYHTQY
Sbjct:  61  FFAFKDRRFAYRGFSKALEIAKQYQLDIIHTQTEFSLGLLGIWIARELKIPVIHTYHTQY   120

Query: 121  EDYVGYIAKGKLIKPSMVKYIMRTYLSDLDGVICPSRIVLNLLDGYGVKIPKQVIPTGIP   180
            EDYV YIAKG LI+PSMVKY++R +L D+DGVICPS IV +LL   Y VK+ K+VIPTGI
Sbjct: 121  EDYVHYIAKGMLIRPSMVKYLVRGFLHDVDGVICPSEIVRDLLSDYKVKVEKRVIPTGIE   180

Query: 181  VENYRREDISEETIKNLRTELGLADNDTMLLSLSRVSFEKNIQAILMHLSAVVDENPHVK   240
            +  + R +I +E +K LR++LG+ D +  LLSLSR+S+EKNIQA+L+   + V+ E    VK
Sbjct: 181  LAKFERPEIKQENLKELRSKLGIQDGEKTLLSLSRISYEKNIQAVLVAFADVLKEEDKVK   240

Query: 241  LVIVGDGPYLSDLKELVHSLELENSVIFTGMVEHSQVAIYYKACDFFISA            290
            LV+ GDGPYL+DLKE   +LE+++SVIFTGM+  S+ A+YYKA DFFISA
Sbjct: 241  LVVAGDGPYLNDLKEQAQNLEIQDSVIFTGMIAPSETALYYKAADFFISA            290
```

A related DNA sequence was identified in *S. pyogenes* <SEQ ID 1215> which encodes the amino acid sequence <SEQ ID 1216>. Analysis of this protein sequence reveals the following:

---

Possible site: 17
>>> Seems to have no N-terminal signal sequence
----- Final Results -----
   bacterial cytoplasm --- Certainty = 0.1074 (Affirmative) <succ>
   bacterial membrane --- Certainty = 0.0000 (Not Clear) <succ>
   bacterial outside --- Certainty = 0.0000 (Not Clear) <succ>

---

An alignment of the GAS and GBS proteins is shown below:

```
Identities = 309/444 (69%), Positives = 370/444 (82%)
Query:   1  MRIGLFTDTYFPQVSGVSTSIRTLKEGLEKEGHEVYIFITTTDRNVKRFEDPTIIRLPSVP   60
            MRIGLFTDTYFPQVSGV+TSIRTLKE LEKEGHEVYIFTTTDR+VKRFEDPTIIRLPSVP
Sbjct:   1  MRIGLFTDTYFPQVSGVATSIRTLKEELEKEGHEVYIFTTTDRDVKRFEDPTIIRLPSVP   60

Query:  61  FISFTDRRVVYRGLISAYRIAKDYELDIIHTQTEFSLGLLGKLVAKALRIPVVHTYHTQY   120
            F+SFTDRRVVYRGLIS+Y+IAK Y LDIIHTQTEFSLGLLGK++ KALRIPVVHTYHTQY
Sbjct:  61  FVSFTDRRVVYRGLISSYKIAKEYNLDIIHTQTEFSLGLLGKMIGKALRIPVVHTYHTQY   120

Query: 121  EDYVGYIAKGKLIKPSMVKYIMRTYLSDLDGVICPSRIVLNLLDGYGVKIPKQVIPTGIP   180
            EDYV YIA GK+I+PSMVK ++R YL DLDGVICPSRIVLNLL+GY V IPK+VIPTGIP
Sbjct: 121  EDYVSYIANGKIIRPSMVKALLRGYLKDLDGVICPSRIVLNLLEGYEVTIPKRVIPTGIP   180

Query: 181  VENYRREDISEETIKNLRTELGLADNDTMLLSLSRVSFEKNIQAILMHLSAVVDENPHVK   240
            +E Y R+DI+ E + NL+ ELG+A ++TMLLSLSR+S+EKNIQAI+    A++ EN   +K
Sbjct: 181  LEKYIRDDITAEEVTNLKAELGIAGDETMLLSLSRISYEKNIQAIINQMPAILAENAKIK   240

Query: 241  LVIVGDGPYLSDLKELVHSLELENSVIFTGMVEHSQVAIYYKACDFFISASTSETQGLTY   300
            L+IVG+GPYL DLK L  LE++  V FTGMV H +VA+YYKACDFFISASTSETQGLTY
Sbjct: 241  LIIVGNGPYLQDLKHLAMQLEVDKHVTFIGMVPHDKVALYYKACDFFISASTSETQGLTY   300

Query: 301  IESLASGRPIIAQSNPYLDDVISDKMFGTLYKKESDLADAILDAIAETPKMTQEAYEQKL   360
            IESLASG PIIA  NPYLDDV++DKMFGTLY  E+DL DAI+DAI +TP M +       +K
Sbjct: 301  IESLASGTPIIAHGNPYLDDVVTDKMFGTLYYAETDLTDAIIDAILKTPVMDKRLLAKKR   360

Query: 361  YEISAENFSKSVYAFYLDFLISQKASVKEKVSLTIGNKDSHSTLRFVRKAVYLPKKVFTF   420
            YEISA++F KS+Y FYLD LI++ +    +K+SL + +      S+L+ V+ A++LPK+
Sbjct: 361  YEISAQHFGKSIYTFYLDTLIARNSKEAQKLSLYLNHSGKSSSLKLVQGAIHLPKRAAKV   420

Query: 421  TGRASKKVVKAPKRRISSIRDFLD                                      444
            T   S KVVKAP + + +I+DFLD
Sbjct: 421  TAITSVKVVKAPIKLVHAIKDFLD                                      444
```

Based on this analysis, it was predicted that these proteins and their epitopes could be useful antigens for vaccines or diagnostics.

Example 373

A DNA sequence (GBSx0404) was identified in *S. agalactiae* <SEQ ID 1217> which encodes the amino acid sequence <SEQ ID 1218>. This protein is predicted to be lipopolysaccharide biosynthesis protein-related protein. Analysis of this protein sequence reveals the following:

Possible site: 61
>>> Seems to have no N-terminal signal sequence
----- Final Results -----
bacterial cytoplasm --- Certainty = 0.4076 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database:

```
>GP:AAG19110 GB:AE005009 Vng0600c [Halobacterium sp. NRC-1]
Identities = 117/350 (33%), Positives = 178/350 (50%), Gaps = 29/350 (8%)
Query:    1 MKVLLYLEAEEYLKKSGIGRAIKHQEKALQIAGIDYTTNPT-------------------  41
            M+ L YLEA E L+  G+ A   Q  AL+   ++      P
Sbjct:    2 MRALNYLEAAEALR-GGMVTATNQQRAALETTDVEVVETPWRAGDPVRSIGSLAAGGSCF   60

Query:   42 DDFDLVHMNTYGIRSWLLMSKAKKTGKKVIMHGHSTEEDFRNSFIGSNLVSPLFKWYLCR  101
              FD+ H  N   G  S   +   A++T   +++H H T EDF  SF GS+ ++P  + YL
Sbjct:   61 TAFDVAHCNLVGPGSVAVARHARRTDTPLVLHAHLTREDFAQSFRGSSTIAPALEPYLRW  120

Query:  102 FYQKADAIITPTDYSKQLIKAYGIKKPIFVLSNGIDLSRYQRSEKKESAFRHYFHLSKDD  161
            FY +AD ++ P++Y+K +++AY +  PI  LSNG+DL    Q  E   + R  FL  D
Sbjct:  121 FYSQADLVLCPSEYTKDVLRAYPVDAPIRQLSNGVDLESMQGYESFRADTRARFDL--DG  178

Query:  162 KVVMGAGLYFMRKGIDQFVEVAAKMPDIRFIWFGETNKWVIPRKVRQIVTKQHPSNVTFA  221
             VV   G F RKG+   F E+ AK  D  F WFG ++         +     P+NVTF
Sbjct:  179 TVVYAVGEVFERKGLTMFCEL-AKATDHEFAWFGPYDEGPQAGAATRKWVADPPANVTFT  237

Query:  222 GYIKGDVYEGAMSASDAFFFPSREETEGIVVLEALASHQHVVLRDIPVYHGWVTE-DSVE  280
            GY++         A  A D + FP++ E +GI VLEA+A  +  VVLRDIPV+    T+ +
Sbjct:  238 GYMEDK--RAAFGAGDIYLFPAKVENQGIAVLEAMACGKPVVLRDIPVFREFFTDGEDCL  295

Query:  281 LATDVDGFVEKLDKVLSGKSDKIKEGYH---VAESRSIERIAHELASVYQ           327
            + +   + F + +D++         + + G +      AES S++RI  ELAS+Y+
Sbjct:  296 MCSTFEAFRDAIDRLADDPELRTRLGENARETAESHSLDRIGEELASIYE           345
```

A related DNA sequence was identified in *S. pyogenes* <SEQ ID 1219> which encodes the amino acid sequence <SEQ ID 1220>. Analysis of this protein sequence reveals the following:

----- Final Results -----
bacterial cytoplasm --- Certainty = 0.4088 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below:

```
Identities = 236/332 (71%), Positives = 276/332 (83%)
Query:    1 MKVLLYLEAEEYLKKSGIGRAIKHQEKALQIAGIDYTTNPTDDFDLVHMNTYGIRSWLLM   60
            MKVLLYLEAE YL+KSGIGRAIKHQ KAL + G  +TTNP +  +DLVH+NTYG++SWLLM
Sbjct:    1 MKVLLYLEAENYLRKSGIGRAIKHQAKALSLVGQHFTTNPRETYDLVHLNTYGLKSWLLM   60

Query:   61 SKAKKTGKKVIMHGHSTEEDFRNSFIGSNLVSPLFKWYLCRFYQKADAIITPTDYSKQLI  120
             KA+K  GKKVIMHGHSTEEDFRNSFI SNL+SP FK YLC FY KADAIITPT YSK LI
Sbjct:   61 IKAQKAGKKVIMHGHSTEEDFRNSFIFSNLLSPWFKKYLCHFYNKADAIITPTLYSKSLI  120

Query:  121 KAYGIKKPIFVLSNGIDLSRYQRSEKKESAFRHYFHLSKDDKVVMGAGLYFMRKGIDQFV  180
            ++YG+K PIF +SNGIDL +Y      KKE+AFR YF + +  +KVVMGAGL+F+RKGID FV
Sbjct:  121 ESYGVKSPIFAVSNGIDLEQYGADPKKEAAFRRYFDIKEGEKVVMGAGLFFLRKGIDDFV  180

Query:  181 EVAAKMPDIRFIWFGETNKWVIPRKVRQIVTKQHPSNVTFAGYIKGDVYEGAMSASDAFF  240
            +VA  MPD+RFIWFGETNKWVIP +VRQ+V   HP N+ F GYIKGDVYEGAM+ +DAFF
Sbjct:  181 KVAQAMPDVRFIWFGETNKWVIPAQVRQMVNGNHPKNLIFPGYIKGDVYEGAMTGADAFF  240

Query:  241 FPSREETEGIVVLEALASHQHVVLRDIPVYHGWVTEDSVELATDVDGFVEKLDKVLSGKS  300
            FPSREETEGIVVLEALAS QH+VLRDIPVY+GWV   S  ELATD+ GF+E L KV SG S
Sbjct:  241 FPSREETEGIVVLEALASRQHLVLRDIPVYYGWVDQSSAELATDIPGFIEALKKVFSGAS  300

Query:  301 DKIKEGYHVAESRSIERIAHELASVYQKVMEL                              332
            +K++ GY VA+SR +E + H L  VY+KVMEL
Sbjct:  301 NKVEAGYKVAQSRRLETVGHALVDVYKKVMEL                              332
```

Possible site: 61
>>> Seems to have no N-terminal signal sequence

Based on this analysis, it was predicted that these proteins and their epitopes could be useful antigens for vaccines or diagnostics.

Example 374

A DNA sequence (GBSx0405) was identified in *S. agalactiae* <SEQ ID 1221> which encodes the amino acid sequence <SEQ ID 1222>. Analysis of this protein sequence reveals the following:

Possible site: 16
>>> Seems to have no N-terminal signal sequence
----- Final Results -----
   bacterial cytoplasm --- Certainty = 0.5487 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database:

```
>GP:AAC35010 GB:AF055987 intracellular a-amylase [Streptococcus mutans]
Identities = 308/483 (63%), Positives = 378/483 (77%)
Query:   1 MTNELIMQAFEWYLPSDGNHWKKLEESISDLKKLGISKIWLPPAFKGTSSDDVGYGVYDL    60
           MTNE +MQ FEWYLP+DG HW+ L E  S LK +GISK+W+PPAFKGT S+DVGYGVYDL
Sbjct:   1 MTNETMMQYFEWYLPNDGKHWQHLAEDASHLKNIGISKVWMPPAFKGTGSNDVGYGVYDL    60

Query:  61 FDLGEFDQNGTIRTKYGRKEEYLKLIKSLKANGIKPFADIVLNHKANGDHKEKFQVIKVN   120
           +DLGEF+QNGT+RTKYG +E+YL  + +LK   I P +DIVLNHKANGD KE+FQV+KVN
Sbjct:  61 YDLGEFNQNGTVRTKYGSREDYLNAVNALKEQEIMPISDIVLNHKANGDAKERFQVVKVN   120

Query: 121 PENRQEALSEPYEIEGWTGFDFPGRQGEYNDFKWHWYHFTGLDYDAKNNETDIFMIVGDN   180
           P NRQE +SEPYEIEGWT F+FPGRQ  Y+DFKWHWYHFTG+DYDA +NE  I+MI+GDN
Sbjct: 121 PSNRQEKISEPYEIEGWTQFNFPGRQDNYSDFKWHWYHFTGVDYDALHNENGIYMILGDN   180

Query: 181 KGWADDDLIDDENGNFDYLMYNDIDFKHPEVIKNLQDWAKWFIETTGIEGFRLDAVKHID   240
           KGWA  + ID ENGN+DYLMY+DIDFKHPEV ++L+DW  WF+ET+G+ GFRLDA+KHID
Sbjct: 181 KGWASQENIDQENGNYDYLMYDDIDFKHPEVQEHLRDWVAWFLETSGVGGFRLDAIKHID   240

Query: 241 SYFIQTFINDIRTKIKPDLEVFGEYWKSDQTSMKDYLEATQFQFSLVDVTLHMNFFDASH   300
              F+  FI  IR +K DL VFGEYWK   + DYL +  QF L+DV LHM+ F+A
Sbjct: 241 KTFMAQFIRYIREHLKADLYVFGEYWKDSHFDITDYLHSVDLQFDLIDVMLHMSLFEAGQ   300

Query: 301 QNRDFDMRTIFDDSLVIDNPEYAVTFVENHDTQSGQALESRVEDWFKPLAYGLILLRQQG   360
             + DFD+ TI DDSL+ +P++AVTFV+NHD+Q GQALES V +WFKPLAYGLILLRQ+G
Sbjct: 301 KGSDFDLSTILDDSLMKSHPDFAVTFVDNHDSQRGQALESTVAEWFKPLAYGLILLRQEG   360

Query: 361 TPCLFYGDYYGIQGEFGQPSFKEVIDKMAELRQNYVFGKQVDYFTHSNCIGWTCLGDEEH   420
            PC+FYGDYYGI GEF Q SF+ V+DK+  +RQ +V+G +     T NCIGWTCLGDEEH
Sbjct: 361 IPCVFYGDYYGISGEFAQESFQTVLDKLLYIRQYHVYGSKKIILTMPNCIGWTCLGDEEH   420

Query: 421 NSCLAVVLTNGDQGWKHMEVGEIYAGKTFVDYLGNCEQEVVIGDDGWGDFLVESASISAW   480
              +AV+++NG+    K M +GE   K FVDYL NC +EV++ D GWGDF V+ AS+SAW
Sbjct: 421 PDGVAVIISNGEANCKRMNMGEFNRNKVFVDYLNNCTEEVILDDQGWGDFPVQEASLSAW   480

Query: 481 VPK                                                           483
           V K
Sbjct: 481 VNK                                                           483
```

A related DNA sequence was identified in *S. pyogenes* <SEQ ID 1223> which encodes the amino acid sequence <SEQ ID 1224>. Analysis of this protein sequence reveals the following:

Possible site: 30
>>> Seems to have a cleavable N-term signal seq.
----- Final Results -----
   bacterial outside --- Certainty = 0.3000 (Affirmative) <succ>
   bacterial membrane --- Certainty = 0.0000 (Not Clear) <succ>
   bacterial cytoplasm --- Certainty = 0.0000 (Not Clear) <succ>

The protein has homology with the following sequences in the databases:

```
>GP:AAB00845 GB:M57692 alpha-cyclodextrin glycosyltransferase
[Thermoanaerobacterium thermosulfurigenes]
Identities = 356/710 (50%), Positives = 468/710 (65%), Gaps = 16/710 (2%)
Query:   7 KTYKLLTKSAVLLGLISFPLT--VSAADNASVTNKADFSTDTIYQIVTDRFNDGNTSNNG    64
           KT+KL+    + L+ F LT   + AA +  +V+N  ++STD IYQIVTDRF DGNTSNN
Sbjct:   3 KTFKLILVLMLSLTLV-FGLTAPIQAASDTAVSNVVNYSTDVIYQIVTDRFVDGNTSNNP    61

Query:  65 KTDVFDKN--DLKKYHGGDWQGITAKIKDGYLTDMGISAIWISSPVENIDSIDPSN---G   119
                 D++D    LKKY GGDWQGII KI DGYLT MG++AIWIS PVENI ++ P +   G
Sbjct:  62 TGDLYDPTHTSLKKYFGGDWQGIINKINDGYLTGMGVTAIWISQPVENIYAVLPDSTFGG   121

Query: 120 SAAYHGYWAKDFFKTNQHFGTEADFQQLVKVAHQHHIKVVIDFAPNHTSTAEKEGTTFKE   179
```

```
              S +YHGYWA+DF +TN +FG+   DFQ L+   AH H+IKV+IDFAPNHTS A +    T+ E
Sbjct: 122   STSYHGYWARDFKRTNPYFGSFTDFQNLINTAHAHNIKVIIDFAPNHTSPASETDPTYAE  181

Query: 180   DGALYKNGKLVGKFSDDKDKIFNHESWTDFSTYENSIYHSMYGLADLNNINPKVDQYMKE  239
             +G LY NG L+G +++D + F+H   TDFS+YE+ IY +++ LADLN  N  +D Y+K
Sbjct: 182   NGRLYDNGTLLGGYTNDTNGYFHHYGGTDFSSYEDGIYRNLFDLADLNQQNSTIDSYLKS  241

Query: 240   AIDKWLDLGVDGIRVDAVKHMSQGWQKNWLSHIYEKHNVFVFGEWFSGHTDDDYDMTTFA  299
             AI  WLD+G+DGIR+DAVKHM GWQKN++  I    VF FGEWF G  + D + T FA
Sbjct: 242   AIKVWLDMGIDGIRLDAVKHMPFGWQKNFMDSILSYRPVFTFGEWFLGTNEIDVNNTYFA  301

Query: 300   NNSGMGLLDFRFANAIRQLYTGFSTFTMRDFYKVLENRDQVTNEVTDQVTFIDNHDMERF  359
             N SGM LLDFRF+  +RQ++   +T TM      ++++    N + D VTFIDNHDM+RF
Sbjct: 302   NESGMSLLDFRFSQKVRQVFRD-NTDTMYGLDSMIQSTASDYNFINDMVTFIDNHDMRF   360

Query: 360   ATKVANNQTAVNQAYALLLTSRGVPNIYYGTEQYATGDKDPNRGDMPSFNKESQAYKVI   419
                   +   V QA A  LTSRGVP IYYGTEQY TG+ DP NR  M SFN  + AY VI
Sbjct: 361   YN--GGSTRPVEQALAFTLTSRGVPAIYYGTEQYMTGNGDPYNRAMMTSFNTSTTAYNVI  418

Query: 420   SKLAPLRKQNQALAYGTTEQRWISDHVLVFERKFGNHVALVAINRDQTNGYTITNAKTAL  479
              KLAPLRK N A+AYGTT+QRWI++ V  ++ERKFGN+VALVAINR+ +  Y IT   TAL
Sbjct: 419   KKLAPLRKSNPAIAYGTTQQRWINNDVYIYERKFGNNVALVAINRNLSTSYNITGLYTAL  478

Query: 480   PQNSYKDKLEGLLGGQELIVGADGTISSFELGAGQVAVWTYEGEDKTPQLGDVDASVGIA  539
             P +Y D L GLL G + V +DG+++ F L AG+VAVW  Y    +P +G V  ++  A
Sbjct: 479   PAGTYTDVLGGLLNGNSISVASDGSVTPFTLSAGEVAVWQYVSSSNSPLIGHVGPTMTKA  538

Query: 540   GNKITISGQGFGNSKGQVTFGEISAEILSWSDTLITLKVPTVPANYYNISVTTADKQTSN  599
             G  ITI G+GFG + GQV FG +  I+SW DT +  +KVP+V     YNIS+ T+   TSN
Sbjct: 539   GQTITIDRGFGTTSGQVLFGSTAGTIVSWDDTEVKVKVPSVTPGKYNISLKTSSGATSN  598

Query: 600   SYQAFEVLTDKQIPVRLLINDFKTVPGEQLYLMGDVFEMGANDAKNAVGPLFNNTQTIAK  659
             +Y   +LT QI VR ++N+  TV GE +YL G+V E+G  D    A+GP+FN   Q + +
Sbjct: 599   TYNNINILTGNQICVRFVVNNASTVYGENVYLTGNVAELGNWDTSKAIGPMFN--QVVYQ   656

Query: 660   YPNWFFDTHLPINKEIAVKLVKKDSIGNVLWT--SPETYSIKTGHEAQTI            707
             YP W++D  +P   I K +KK+    + W S  TY++ +       I
Sbjct: 657   YPTWYYDVSVPAGTTIQFKFIKKNG-NTITWEGGSNHTYTVPSSSTGTVI            705
```

An alignment of the GAS and GBS proteins is shown below:

```
Identities = 112/509 (22%), Positives = 193/509 (37%), Gaps = 103/509 (20%)
Query:  18   GNHWKKLEESISD--LKKLGISKIWLPPAFKGTSSDDV--------GYGVYDLFDLGEFD    67
             G  W+ +  I D  L  +GIS IW+      + S D         GY  D F  +
Sbjct:  79   GGDWQGIIAKIKDGYLTDMGISAIWISSPVENIDSIDPSNGSAAYHGYWAKDFFKTNQH-  137

Query:  68   QNGTIRTKYGRKEEYLKLIKSLKANGIKPFADIVLNHKANGDHKEKFQVIKVNPENRQEA  127
                       +G + +++ +L+K   + IK    D   NH + + +
Sbjct: 138   --------FGTEADFQQLVKVAHQHHIKVVIDFAPNHTSTAEKE-----------------  173

Query: 128   LSEPYEIEGWTGFDFPGRQGEYNDFKWHWYHFTGLDYDAKNNETDIFMIVGDNKGWADDD  187
                         G  F     Y + K        G   D K+        + +++ W D
Sbjct: 174   -----------GTTFKEDGALYKNGK-----LVGKFSDDKDK-------IFNHESWTDFS  210

Query: 188   LIDDE--NGNFDYLMYNDIDFKHPEVIKNLQDWAKWFIETTGIEGFRLDAVKHIDSYFIQ  245
              ++   + +     N+I+ K  +K   D  KW     G++G R+DAVKH+   + +
Sbjct: 211   TYENSIYHSMYGLADLNNINPKVDQYMKEAID--KWL--DLGVDGIRVDAVKHMSQGWQK  266

Query: 246   TFINDIRTKIKPDLEVFGEYWKSDQTSMKDYLEATQFQFSLVDVTLHMNFFDASHQ-NRD  304
              +++ I    K ++ VFGE W S  T  D + T F +      L    F +A Q  +
Sbjct: 267   NWLSHIYE--KHNVFVFGE-WFSGHTD--DDYDMTTFANNSGMGLLDFRFANAIRQLYTG  321

Query: 305   FDMRTIFDDSLVIDNPEYA-------VTFVENHDTQSGQALESRVEDWFKPLAYGLILLR  357
             F   T+ D  V++N +          VTF++NHD +      +         AY L LL
Sbjct: 322   FSTFTMRDFYKVLENRDQVTNEVTDQVTFIDNHDMERFATKVANNQTAVNQ-AYAL-LLT  379

Query: 358   QQGTPCLFYGDYYGIQGE------FGQPSFK------EVIDKMAELR---QNYVFGKQVD  402
             +G P  ++YG    G+         PSF         +VI K+A LR   Q   +G
Sbjct: 380   SRGVPNIYYGTEQYATGDKDPNNRGDMPSFNKESQAYKVISKLAPLRKQNQALAYGTTEQ  439

Query: 403   YFTHSNCIGWTCLGDEEHNSCLAVVLTNGDQ--GWKHMEVGEIYAGKTFVDYLGNC--EQ  458
              +   + +  + + +   + +A+V  N DQ G+           ++ D L    Q
Sbjct: 440   RWISDHVL----VFERKFGNHVALVAINRDQTNGYTITNAKTALPQNSYKDKLEGLLGGQ  495

Query: 459   EVVIGDDGW-GDFLVESASISAWVPKIEE                                486
             E+++G DG   F + +   ++ W  + E+
Sbjct: 496   ELIVGADGTISSFELGAGQVAVWTYEGED                                524
```

Based on this analysis, it was predicted that these proteins and their epitopes could be useful antigens for vaccines or diagnostics.

Example 375

A DNA sequence (GBSx0406) was identified in *S. agalactiae* <SEQ ID 1225> which encodes the amino acid sequence <SEQ ID 1226>. This protein is predicted to be catabolite control protein A. Analysis of this protein sequence reveals the following:

```
Possible site: 29
>>> Seems to have no N-terminal signal sequence
----- Final Results -----
   bacterial cytoplasm --- Certainty = 0.2154 (Affirmative) <succ>
   bacterial membrane --- Certainty = 0.0000 (Not Clear) <succ>
   bacterial outside --- Certainty = 0.0000 (Not Clear) <succ>
```

A related GBS nucleic acid sequence <SEQ ID 9707> which encodes amino acid sequence <SEQ ID 9708> was also identified.

The protein has homology with the following sequences in the GENPEPT database:

A related DNA sequence was identified in *S. pyogenes* <SEQ ID 1227> which encodes the amino acid sequence <SEQ ID 1228>. Analysis of this protein sequence reveals the following:

```
Possible site: 29
>>> Seems to have no N-terminal signal sequence
----- Final Results -----
   bacterial cytoplasm --- Certainty = 0.2154 (Affirmative) <succ>
   bacterial membrane --- Certainty = 0.0000 (Not Clear) <succ>
   bacterial outside --- Certainty = 0.0000 (Not Clear) <succ>
```

```
>GP:BAA88121 GB:AB028599 catabolite control protein A [Streptococcus
bovis] (ver 3)
Identities = 304/332 (91%), Positives = 320/332 (95%)
Query:   1 MNTDDTITIYDVAREAGVSMATVSRVVNGNKNVKENTRKKVLEVIDRLDYRPNAVARGLA   60
           MNTDDTITIYDVAREAGVSMATVSRVVNGNKNVKENTRKKVLEVIDRLDYRPNAVARGLA
Sbjct:   1 MNTDDTITIYDVAREAGVSMATVSRVVNGNKNVKENTRKKVLEVIDRLDYRPNAVARGLA   60

Query:  61 SKKTTTVGVVIPNIANSYFSILARGIDDIAAMYKYNIVLASSDEDDDKEVNVVNTLFAKQ  120
           SKKTTTVGVVIPNIANSYFSILA+GIDDIAAMYKYNIVLASSDEDDDKEVNVVNTLFAKQ
Sbjct:  61 SKKTTTVGVVIPNIANSYFSILAKGIDDIAAMYKYNIVLASSDEDDDKEVNVVNTLFAKQ  120

Query: 121 VDGIIFMGHHLTEKIRAEFSRSRTPIVLAGTVDLEHQLPSVNIDYKAAAVDVIDILAGNH  180
           VDGIIFMGHHLTEKIRAEFSRSRTP+VLAGTVDLEHQLPSVNIDYKAA  DV+DILA N+
Sbjct: 121 VDGIIFMGHHLTEKIRAEFSRSRTPVVLAGTVDLEHQLPSVNIDYKAAVADVVDILAKNN  180

Query: 181 KDIAFVSGPLIDDINGKVRLAGYKEGLKKNGLNFKEGLVFEANYRYAEGFALAQRVINAG  240
           KDIAFVSGPLIDDINGKVRLAGYKEGL+KN L+FKEGLVFEANY Y +G+ LAQRV+N+G
Sbjct: 181 KDIAFVSGPLIDDINGKVRLAGYKEGLEKNNLSFKEGLVFEANYNYKDGYELAQRVMNSG  240

Query: 241 ATAAYVAEDELAAGLLNGLFEAGKRVPEDFEIITSNDSPIAQYTRPNLTSISQPVYDLGA  300
           ATAAYVAEDELAAGLLNGLF AGK+VPEDFEI+TSNDSPI   YTRPNL+SISQPVYDLGA
Sbjct: 241 ATAAYVAEDELAAGLLNGLFAAGKKVPEDFEILTSNDSPITSYTRPNLSSISQPVYDLGA  300

Query: 301 VSMRMLTKIMHKEELEEKEIVLNHGIVKRGTT                             332
           VSMRMLTKIM+KEELEEKEI+LNHG+  RGTT
Sbjct: 301 VSMRMLTKIMNKEELEEKEIILNHGLKLRGTT                             332
```

An alignment of the GAS and GBS proteins is shown below:

```
Identities = 307/332 (92%), Positives = 320/332 (95%)
Query:   1 MNTDDTITIYDVAREAGVSMATVSRVVNGNKNVKENTRKKVLEVIDRLDYRPNAVARGLA   60
           MNTDD +TIYDVAREAGVSMATVSRVVNGNKNVKENTRKKVLEVIDRLDYRPNAVARGLA
Sbjct:   1 MNTDDPLTIYDVAREAGVSMATVSRVVNGNKNVKENTRKKVLEVIDRLDYRPNAVARGLA   60

Query:  61 SKKTTTVGVVIPNIANSYFSILARGIDDIAAMYKYNIVLASSDEDDDKEVNVVNTLFAKQ  120
           SKKTTTVGVVIPNIANSYFSILA+GIDDIAAMYKYNIVLASSDEDDDKEVNVVNTLFAKQ
Sbjct:  61 SKKTTTVGVVIPNIANSYFSILAKGIDDIAAMYKYNIVLASSDEDDDKEVNVVNTLFAKQ  120

Query: 121 VDGIIFMGHHLTEKIRAEFSRSRTPIVLAGTVDLEHQLPSVNIDYKAAAVDVIDILAGNH  180
           VDGIIFMGHHLTEKIRAEFSRSRTP+VLAGTVDL+HQLPSVNIDY+AA   +V+DILA NH
Sbjct: 121 VDGIIFMGHHLTEKIRAEFSRSRTPVVLAGTVDLDHQLPSVNIDYRAAVSNVVDILAENH  180
```

```
-continued
Query:  181 KDIAFVSGPLIDDINGKVRLAGYKEGLKKNGLNFKEGLVFEANYRYAEGFALAQRVINAG  240
            K IAFVSGPLIDDINGKVRLAGYKEGLK N L+FKEGLVFEANY Y EGF LAQRVIN+G
Sbjct:  181 KCIAFVSGPLIDDINGKVRLAGYKEGLKHNKLDFKEGLVFEANYSYKEGFELAQRVINSG  240

Query:  241 ATANYVAEDELAAGLLNGLFEAGKRVPEDFEIITSNDSPIAQYTRPNLTSISQPVYDLGA  300
            ATAAYVAEDELAAGLLNGLFEAGKRVPEDFEIITSNDSP+ QYTRPNL+SISQPVYDLGA
Sbjct:  241 ATAAYVAEDELAAGLLNGLFEAGKRVPEDFEIITSNDSPVVQYTRPNLSSISQPVYDLGA  300

Query:  301 VSMRMLTKIMHKEELEEKEIVLNHGIVKRGTT  332
            VSMRMLTKIM+KEELEEKEI+LNHGI KRGTT
Sbjct:  301 VSMRMLTKIMNKEELEEKEILLNHGIKKRGTT  332
```

Based on this analysis, it was predicted that these proteins and their epitopes could be useful antigens for vaccines or diagnostics.

Example 376

A DNA sequence (GBSx0407) was identified in *S. agalactiae* <SEQ ID 1229> which encodes the amino acid sequence <SEQ ID 1230>. This protein is predicted to be PepQ (pepQ-2). Analysis of this protein sequence reveals the following:

---
Possible site: 22
>>> Seems to have no N-terminal signal sequence
----- Final Results -----
    bacterial cytoplasm --- Certainty = 0.1118 (Affirmative) <succ>
    bacterial membrane --- Certainty = 0.0000 (Not Clear) <succ>
    bacterial outside --- Certainty = 0.0000 (Not Clear) <succ>
---

The protein has homology with the following sequences in the GENPEPT database:

```
>GP:AAC46293 GB:AF014460 PepQ [Streptococcus mutans]
Identities = 257/359 (71%), Positives = 304/359 (84%)
Query:    1 MSKLNRIRHHLHSVQAELAVFSDPVTVNYLTGFFCDPHERQMFLFVYEDRDPILFVPALE  60
            MSKL +I   L    E AV SDPV++NYLTGF+ DPHER MFLF++ D++ +LF+P L+
Sbjct:    1 MSKLAQIVQKLKKQGIEAAVLSDPVSINYLTGFYSDPHERLMFLFLFADQETLLFLPELD  60

Query:   61 VSRAKQSVPFPVFGYIDSENPWQKIASNLPSFSVSKVLAEFDNLNVTKFQGLQTVFDGHF  120
              RAK +    V GY+D ENP +KI + LP   SK+  EFDNLNVTKF+GL+T+F G F
Sbjct:   61 ALRAKSILDISVTGYLDFENPLEKIKILLPKTNYSKIALEFDNLNVTKFKGLETIFSGQF  120

Query:  121 ENLTPYIQNMRLIKSRDEIEKMLVAGEFADKAVQVGFDNISLNNTETDIIAQIEFEMKKQ  180
             NLTP I  MRLIKS DEI+K+L+AGE ADKAVQ+GFD+ISLN TETDIIAQIEFEMKK
Sbjct:  121 TNLTPLINRMRLIKSADEIQKLLIAGELADKAVQIGFDSISLNATETDIIAQIEFEMKKL  180

Query:  181 GINKMSFDTMVLTGNNAANPHGIPGTNKIENNALLLFDLGVETLGYTSDMTRTVAVGKPD  240
            G++KMSF+TMVLTG+NAANPHG+P ++KIENN LLLFDLGVE+ GY SDMTRTVAVG+PD
Sbjct:  181 GVDKMSFETMVLTGSNAANPHGLPASHKIENNHLLLFDLGVESTGYVSDMTRTVAVGQPD  240

Query:  241 QFKKDIYHLCLEAHQAAIDFIKPGVLASEVDAAARNVIEKAGYGQYFNHRLGHGLGMDVH  300
            QFKKDIY++CLEA   A+DFIKPGV A++VDAAAR+VIEKAGYG YFNHRLGHG+GM +H
Sbjct:  241 QFKKDIYNICLEAQLTALDFIKPGVSAAQVDAAARSVIEKAGYGDYFNHRLGHGIGMLH  300

Query:  301 EFPSIMAGNDMEIQEGMCFSVEPGIYIPDKVGVRIEDCGYVTKTGFEVFTKTPKELLYF  359
            EFPSIMAGNDM ++EGMCFSVEPGIYIP+KVGVRIEDCG+VTK GFEVFT+TPKELLYF
Sbjct:  301 EFPSIMAGNDMLLEEGMCFSVEPGIYIPEKVGVRIEDCGHVTKNGFEVFTQTPKELLYF  359
```

A related DNA sequence was identified in *S. pyogenes* <SEQ ID 1231> which encodes the amino acid sequence <SEQ ID 1232>. Analysis of this protein sequence reveals the following:

---
Possible site: 58
>>> Seems to have no N-terminal signal sequence
INTEGRAL    Likelihood = –0.90    Transmembrane 42-58 (42-59)
----- Final Results -----
    bacterial membrane --- Certainty = 0.1362 (Affirmative) <succ>
    bacterial outside --- Certainty = 0.0000 (Not Clear) <succ>
    bacterial cytoplasm --- Certainty = 0.0000 (Not Clear) <succ>
---

The protein has homology with the following sequences in the databases:

```
>GP:AAC46293 GB:AF014460 PepQ [Streptococcus mutans]
Identities = 264/359 (73%), Positives = 304/359 (84%)
Query:    1 MTKLDQIRLYLDQKGAELAIFSDPVTINYLTGFFCDPHERQLFLFVYHDLAPVLFVPALE  60
            M+KL QI   L ++G E A+ SDPV+INYLTGF+ DPHER +FLF++ D   +LF+P L+
Sbjct:    1 MSKLAQIVQKLKKQGIEAAVLSDPVSINYLTGFYSDPHERLMFLFLFADQETLLFLPELD  60
```

-continued

```
Query:   61 VARASQAISFPVFGYVDSENPWEKIKAVLPNTAAKTIYAEFDHLNVNKFHGLQTIFSGQF 120
             RA +   V GY+D ENP EKIK +LP T    I  EFD+LNV KF GL+TIFSGQF
Sbjct:   61 ALRAKSILDISVTGYLDFENPLEKIKTLLPKTNYSKIALEFDNLVTKFKGLETIFSGQF 120

Query:  121 NNLNPYVQGMRLVKSADEINKMMIAGQFADKAVQVGFDNISLDATETDVIAQIEFEMKKQ 180
              NLTP +   MRL+KSADEI K++IAG+ ADKAVQ+GFD+ISL+ATETD+IAQIEFEMKK
Sbjct:  121 TNLTPLINRMRLIKSADEIQKLLIAGELADKAVQIGFDSISLNATETDIIAQIEFEMKKL 180

Query:  181 GIHKMSFDTMVLTGNNAANPHGIPGTNNIENNALLLFDLGVETLGYTSDMTRIVAVGQPD 240
             G+ KMSF+TMVLTG+NAANPHG+P ++ IENN LLLFDLGVE+ GY SDMTRTVAVGQPD
Sbjct:  181 GVDKMSFETMVLTGSNAANPHGLPASHKIENNHLLLFDLGVESTGYVSDMTRTVAVGQPD 240

Query:  241 QFKIDIYNLCLEAQLAAIDFIKPGVTAAQVDAAARQVIEKAGYGEYFNHRLGHGIGMDVH 300
             QFK DIYN+CLEAQL A+DFIKPGV+AAQVDAAAR VIEKAGYG+YFNHRLGHGIGM +H
Sbjct:  241 QFKKDIYNICLEAQLTALDFIKPGVSAAQVDAAARSVIEKAGYGDYFNHRLGHGIGMGLH 300

Query:  301 EFPSIMAGNDLVLEEGMCFSVEPGIYIPGKVGVRIEDCGHVTKNGFEVFTHTPKELLYF  359
             EFPSIMAGND++LEEGMCFSVEPGIYIP KVGVRIEDCGHVTKNGFEVFT TPKELLYF
Sbjct:  301 EFPSIMAGNDMLLEEGMCFSVEPGIYIPEKVGVRIEDCGHVTKNGFEVFTQTPKELLYF  359
```

An alignment of the GAS and GBS proteins is shown below:

```
Identities = 288/361 (79%), Positives = 325/361 (89%)
Query:    1 MSKLNRIRHHLHSVQAELAVFSDPVTVNYLTGFFCDPHERQMFLFVYEDRDPILFVPALE   60
            M+KL++IR +L      AELA+FSDPVT+NYLTGFFCDPHERQ+FLFVY D  P+LFVPALE
Sbjct:    1 MTKLDQIRLYLDQKGAELAIFSDPVTINYLTGFFCDPHERQLFLFVYHDLAPVLFVPALE   60

Query:   61 VSRAKQSVPFPVFGYIDSENPWQKIASNLPSFSVSKVLAEFDNLNVTKFQGLQTVFDGHF  120
            V+RA Q++ FPVFGY+DSENPW+KI + LP+ +    + AEFD+LNV KF GLQT+F G F
Sbjct:   61 VARASQAISFPVFGYVDSENPWEKIKAVLPNTAAKTIYAEFDHLNVNKFHGLQTIFSGQF  120

Query:  121 ENLTPYIQNMRLIKSRDEIEKMLVAGEFADKAVQVGFDNISLNNTETDIIAQIEFEMKKQ  180
              NLTPY+Q MRL+KS DEI KM++AG+FADKAVQVGFDNISL+ TETD+IAQIEFEMKKQ
Sbjct:  121 NNLTPYVQGMRLVKSADEINKMMIAGQFADKAVQVGFDNISLDATETDVIAQIEFEMKKQ  180

Query:  181 GINKMSFDTMVLTGNNAANPHGIPGTNKIENNALLLFDLGVETLGYTSDMTRTVAVGKPD  240
            GI+KMSFDTMVLTGNNAANPHGIPGTN IENNALLLFDLGVETLGYTSDMTRTVAVG+PD
Sbjct:  181 GIHKMSFDTMVLTGNNAANPHGIPGTNNIENNALLLFDLGVETLGYTSDMTRTVAVGQPD  240

Query:  241 QFKKDIYHLCLEAHQAAIDFIKPGVLASEVDAAARNVIEKAGYGQYFNHRLGHGLGMDVH  300
            QFK DIY+LCLEA  AAIDFIKPGV A++VDAAAR VIEKAGYG+YFNHRLGHG+GMDVH
Sbjct:  241 QFKIDIYNLCLEAQLAAIDFIKPGVTAAQVDAAARQVIEKAGYGEYFNHALGHGIGMDVH  300

Query:  301 EFPSIMAGNDMEIQEGMCFSVEPGIYIPDKVGVRIEDCGYVTKTGFEVFTKTPKELLYFEG 361
            EFPSIMAGND+ ++EGMCFSVEPGIYIP KVGVRIEDCG+VTK GFEVFT TPKELLYFEG
Sbjct:  301 EFPSIMAGNDLVLEEGMCFSVEPGIYIPGKVGVRIEDCGHVTKNGFEVFTHTPKELLYFEG 361
```

Based on this analysis, it was predicted that these proteins and their epitopes could be useful antigens for vaccines or diagnostics.

Example 377

A DNA sequence (GBSx0408) was identified in *S. agalactiae* <SEQ ID 1233> which encodes the amino acid sequence <SEQ ID 1234>. Analysis of this protein sequence reveals the following:

Possible site 14
>>> Seems to have no N-terminal signal sequence
----- Final Results -----
   bacterial cytoplasm --- Certainty = 0.3629 (Affirmative) <succ>
      bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 378

A DNA sequence (GBSx0409) was identified in *S. agalactiae* <SEQ ID 1235> which encodes the amino acid sequence <SEQ ID 1236>. This protein is predicted to be beta-hexosamidase A precursor. Analysis of this protein sequence reveals the following:

Possible site: 47
>>> Seems to have no N-terminal signal sequence
----- Final Results -----
   bacterial cytoplasm --- Certainty = 0.3279 (Affirmative) <succ>
      bacterial membrane --- Certainty = 0.0000 (Not Clear) <succ>
      bacterial outside --- Certainty = 0.0000 (Not Clear) <succ>

The protein has homology with the following sequences in the GENPEPT database:

```
>GP:CAB11942 GB:Z99104 alternate gene name: yzbA-similar to
beta-hexosaminidase [Bacillus subtilis]
Identities = 151/602 (25%), Positives = 268/602 (44%), Gaps = 69/602 (11%)
Query:  26 INEMTLDEKIGQLF------FNMGASRSEEYLTDVLDRYHIAAVRYNRGSSSEIYDQNL-  78
           +N M+LDEK+GQ+        S + LT + D      +Y G   ++ +N+
Sbjct:  39 VNRMSLDEKLGQMLMPDFRNWQKEGESSPQALTKMNDEVASLVEKYQFGGII-LFAENVK  97

Query:  79 -----------ILQIKSKLPMLIAANTEAGGDGAVTDGTKVGDEIKVAATNDPKYAYEMG 127
                       +   K+P++++ + E G    + +GT    + + A       AY+ G
Sbjct:  98 TTKQTVQLTDDYQKASPKIPLMLSIDQEGGIVTRLGEGTNFPGNMALGAARSRINAYQTG 157

Query: 128 RIAGMEASAVGCNASFSPIVDLTRNWRNPIIASRNWGANVDQIISLSKEYMKGIMQYNIV 187
            I G E SA+G N  FSP+VD+  N  NP+I R++ +N +    L    MKG+ + +I
Sbjct: 158 SIIGKELSALGINTDFSPVVDINNNPDNPVIGVRSFSSNRELTSRLGLYTMKGLQRQDIA 217

Query: 188 PFAKHFPGDGIDERDHHLSFASNPMSKEEWMSTFGRIYGELADAGLPGVMAGHIHLPNVE 247
              KHFPG G  + D H        +E      + + DAG   VM H+ P  +
Sbjct: 218 SALKHFPGHGDTDVDSHYGLPLVSHGQERLREVELYPFQKAIDAGADMVMTAHVQFPAFD 277

Query: 248 KEMHPER--DLDDMLPASLNKTLLDELLRGELGYNGAIVTDASHMVGMTASMARRDLLPT 305
            + +     D ++PA+L+K ++ LLR E+G+NG IVTDA +M +     + + +
Sbjct: 278 DTTYKSKLDGSDILVPATLSKKVMTGLLRQEMGFNGVIVTDALNMKAIADHFGQEEAVVM 337

Query: 306 AIEAGCDLFLF---FNDPDED------IQWMKEGYEKGILTEERLHDALRRTLGLKAKLG 356
           A++AG D+ L          E+        IQ +KE  + G + E++++++ R + LK K G
Sbjct: 338 AVKAGVDIALMPASVTSLKEEQKFARVIQALKEAVKNGDIPEQQINNSVERIISLKIKRG 397

Query: 357 LHNYEGRRQELFMPK-DKAMALINTLESQKIADEVADKAVTLVKDKQKDIFPVNPERYRH 415
           + Y R  +    K KA   ++ + +    K      ++A+KAVT++K++Q  + P  P++
Sbjct: 398 M--YPARNSDSTKEKIAKAKKIVGSKQHLKAEKKLAEKAVTVLKNEQHTL-PFKPKKGSR 454

Query: 416 ILLVNVEGYKGGFGAMIAGNKQRASDYMKE------LLEARGHEVTVWESTEERIMKLPQ 469
           IL+V     +      A  +Q  D +K         L       V+++  E+   +K
Sbjct: 455 ILIV------APYEEQTASIEQTIHDLIKRKKIKPVSLSKMNFASQVFKTEHEKQVK--- 505

Query: 470 EERAAAIANVYAQK-QPIANLTEHYDLIINLVDVNAGGTTQRIIWPAAKGTPDQPFYVHE 528
           E     I  Y K P+ N    D +I+ D + +     ++P A       +       H
Sbjct: 506 -EADYIITGSYVVKNDPVVN-----DGVID--DTISDSSKWATVFPRA---VMKAALQHN 554

Query: 529 IPSIVISVQHAFALADMPQVGTYINAYD--------GLPSTISAVVAKLAGESEFTGVSP 580
           P +++S+++ + A+ +    I Y            L   I A V + G+++   G  P
Sbjct: 555 KPFVLMSLRNPYDAANFEEAKALIAVYGFKGYANGRYLQPNIPAGVMAIFGQAKPKGTLP 614

Query: 581 VD                                                         582
           VD
Sbjct: 615 VD                                                         616
```

No corresponding DNA sequence was identified in *S. pyogenes*.

A related GBS gene <SEQ ID 8565> and protein <SEQ ID 8566> were also identified. Analysis of this protein sequence reveals the following homology to a lipoprotein, with homology with the following sequences in the databases:

```
29.5/52.3% over 422aa
Bacillus subtilis
EGAD|120114| hypothetical 70.6 kd protein in feuA 5'region precursor
Insert characterized
SP|P40406|YBBD_BACSU HYPOTHETICAL 70.6 KDA LIPOPROTEIN IN FEUA-SIGW INTERGENIC
REGION PRECURSOR (ORF1). Insert characterized
GP|1944006|dbj|BAA19499.1||AB002150 YbbD Insert characterized
GP|438455|gb|AAA64351.1||L19954 possible N-terminal signal sequence; mature
protein may be membrane-anchored and start at Cys-17. 17.5% identity
over 354-aa overlap with Candida pelliculosa beta-glucosidase.;
putative Insert characterized
GP|2632433|emb Insert characterized
ORF00431(367-1557 of 2388)
EGAD|120114|BS0166(36-458 of 642) hypothetical 70.6 kd protein in feuA 5'region
precursor
{Bacillus subtilis} SP|P40406|YBBD_BACSU HYPOTHETICAL 70.6 KDA
LIPOPROTEIN IN FEUA-SIGW
INTERGENIC REGION PRECURSOR (ORF1). GP|1944006|dbj|BAA19499.1||AB002150 YbbD
{Bacillus subtilis} GP|438455|gb|AAA64351.1||L19954 possible N-terminal
signal sequence; mature protein may be membrane-anchored and start at Cys-17.
17.5% identity over 354-aa overlap with Candida pelliculosa beta-glucosidase.;
putative {Bacillus subtilis}GP|2632433|emb
% Match = 9.6
```

-continued

```
% Identity = 29.5 % Similarity = 52.2
Matches = 119 Mismatches = 183 Conservative Sub.s = 92
      114       144       174       204       234       264       294       324
LMVGDSLGDLAAAEQNGIAFYPVLVGKEVKSWEILREDIGEAFAKGQFEQQRQKESINTFWANLDN**KG*AMTHLVDLT MRPVFPLILSAVLFLSCFFGA
                                                                        10        20

354       384       414       426       456       486                  528
KKPFNLNQEAIEWIEKTINEMTLDEKIGQLFF------NMGASRSEEYLTDVLDRYHIAAVRYNRGS------SSEIYDQ
   :         :     :|  |:||||:||::          |  :  ||  :          :|   |         :  |
RQTEASASKRAIDANQIVNRMSLDEKLGQMLMPDFRNWQKEGESSPQALTKMNDEVASLVKKYQFGGIILFAENVKTTKQ
                40        50        60        70        80        90       100

543       573       603       633       663       693       723       753
NLIL-----QTKSKLPMLIAANTEAGGDGAVTDGTKVGDEIKVAATNDPKYAYEMGRIAGMEASAVGCNASFSPIVDLTR
  : |      :      ||:|::::  :  | |     :  :||           |  :  |  |   ||:|    |  |||:||:
TVQLTDDYQKASPKIPLMLSIDQEGGIVTRLGEGTNFPGNMALGAARSRINAYQTGSIIGKELSALGINTDFSPVVDINN
               120       130       140       150       160       170       180

783       813       843       873       903       933       963       993
NWRNPIIASRNWGANVDQIISLSKEYMKGIMQYNIVPFAKHFPGDGIDERDHHLSFASNPMSKEEWMSTFGRIYGELADA
 |  ||:|   |::  :| :        |       |||:  : :|    |||||    |   |  |           :|            :    ||
NPDNPVIGVRSFSSNRELTSRLGLYTMKGLQRQDIASALKHFPGHGDTDVDSHYGLPLVSHGQERLREVELYPFQKAIDA
               200       210       220       230       240       250       260

1023      1053      1080      1107      1137      1167      1197      1227
GLPGVMAGHIHLPNVEKEMHPER-DLDDML-PASLNKTLLDELLRGELGYNGAIVTDASHMVGMTASMARRDLLPTAIEA
 |        ||      |:::|      :       :    |:|    ||::|    ::       |||   |:|:||  |||||   :|   :          :  :    |::|
GADMVMTAHVQFPAFDDTTYKSKLDGSDILVPATLSKKVMTGLLRQEMGFNGVIVTDALNMKAIADHFGQEEAVVMAVKA
               280       290       300       310       320       330       340

1290      1320      1350      1380      1410      1437
GCDLFLF------FNDPDE---DIQWMKEGYEKGILTEERLHDALRRTLGLKAKLGLHNYEGRRQELFMPK-DKAMALIN
 |  |:|            : :    :    ||  :||    :  |  :  |:::::::   |  :  ||  ||      |    |       |   ||     ::
GVDIALMPASVTSLKEEQKFARVIQALKEAVKNGDIPEQQINNSVERIISLKIKRGM--YPARNSDSTKEKIAKAKKIVG
               360       370       380       390       400       410

1467      1497      1527      1557      1587      1617      1647      1677
TLESQKIADEVADKAVTLVKDKQKDIFPVNPERYRHILLVNVEGYKGGFGAMIAGNKQRASDYMKELLEARGHEVTVWES
  : :    |      ::|::|||||::|::|          :|     |::         ||:|                  :     :                    |                  |:::
SKQHLKAEKKLAEKAVTVLKNEQ-HTLPFKPKKGSRILIVAPYEEQTASIEQTIHDLIKRKKIKPVSLSKMNFASQVFKT
               430       440       450       460       470       480       490
```

SEQ ID 1236 (GBS50) was expressed in *E. coli* as a His-fusion product. SDS-PAGE analysis of total cell extract is shown in FIG. 11 (lane 8; MW 69.2 kDa).

GBS50-His was purified as shown in FIG. 192, lane 5.

Figure 264:
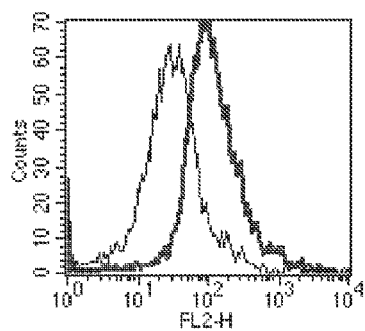

The GBS50-His fusion product was purified (FIG. 192, lane 5) and used to immunise mice. The resulting antiserum was used for FACS (FIG. 264), which confirmed that the protein is immunoaccessible on GBS bacteria.

Based on this analysis, it was predicted that these proteins and their epitopes could be useful antigens for vaccines or diagnostics.

Example 379

A DNA sequence (GBSx0410) was identified in *S. agalactiae* <SEQ ID 1237> which encodes the amino acid sequence <SEQ ID 1238>. Analysis of this protein sequence reveals the following:

Possible site: 20
>>> Seems to have no N-terminal signal sequence
----- Final Results -----
  bacterial cytoplasm --- Certainty = 0.2266 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 380

A DNA sequence (GBSx0411) was identified in *S. agalactiae* <SEQ ID 1239> which encodes the amino acid sequence <SEQ ID 1240>. Analysis of this protein sequence reveals the following:

Possible site: 49
>>> Seems to have no N-terminal signal sequence
----- Final Results -----
  bacterial cytoplasm --- Certainty = 0.2279 (Affirmative) <succ>
    bacterial membrane --- Certainty = 0.0000 (Not Clear) <succ>
      bacterial outside --- Certainty = 0.0000 (Not Clear) <succ>

A related GBS nucleic acid sequence <SEQ ID 9705> which encodes amino acid sequence <SEQ ID 9706> was also identified.

The protein has homology with the following sequences in the GENPEPT database:

```
>GP:AAC21726 GB:U32690 oxidoreductase [Haemophilus influenzae Rd]
Identities = 197/271 (72%), Positives = 229/271 (83%)
Query:  26 NKVVVITGAGGVLCGYMAKEFAKAGAKVALLDLNQEAAQTFADEIVEEGGIAKAYKANVL   85
              NK+++ITGAGGVLC ++AK+ A    A +ALLDLN EAA    A EI + GG AKAYK NVL
Sbjct:  15 NKLIIITGAGGVLCSFLAKQLAYTKANIALLDLNFEAADKVAKEINQSGGKAKAYKTNVL   74

Query:  86 SKENLEEVHQAVLEDLGPTDILVNGAGGNNPKATTDNEFHELDLPSETKTFFELDEAGIS  145
              EN++EV   + D G  DIL+NGAGGNNPKATTDNEFH+ DL     T+TFF+LD++GI
Sbjct:  75 ELENIKEVRNQIETDFGTCDILINGAGGNNPKATTDNEFHQFDLNETTRTFFDLDKSGIE  134

Query: 146 FVFNLNYLGTLLPTQVFAQDMVGREGANIINISSMNAFTPLTKIPAYSGAKAAISNFTQW  205
              FVFNLNYLG+LLPTQVFA+DM+G++GANI INISSMNAFTPLTKIPAYSGAKAAISNFTQW
Sbjct: 135 FVFNLNYLGSLLPTQVFAKDMLGKQGANIINISSMNAFTPLTKIPAYSGAKAAISNFTQW  194

Query: 206 LAVHFSKVGIRCNAIAPGFLVTNQNRSLLFTEDGQPTARAEKILNNTPMGRFGEASELIG  265
              LAV+FSKVGIRCNAIAPGFLV+NQN +LLF  +G+PT RA KIL NTPMGRFGE+ EL+G
Sbjct: 195 LAVYFSKVGIRCNAIAPGFLVSNQNLALLFDTEGKPTDRANKILTNTPMGRFGESEELLG  254

Query: 266 GLFFLADEKSSSFVNGVVLPIDGGFAAYSGV                              296
               L FL DE   S+FVNGVVLP+DGGF+AYSGV
Sbjct: 255 ALLFLIDENYSAFVNGVVLPVDGGFSAYSGV                              285
```

A related DNA sequence was identified in *S. pyogenes* <SEQ ID 1241> which encodes the amino acid sequence <SEQ ID 1242>. Analysis of this protein sequence reveals the following:

---
Possible site: 32
>>> Seems to have no N-terminal signal sequence
----- Final Results -----
   bacterial cytoplasm --- Certainty = 0.0358 (Affirmative) <succ>
      bacterial membrane --- Certainty = 0.0000 (Not Clear) <succ>
         bacterial outside --- Certainty = 0.0000 (Not Clear) <succ>

---

An alignment of the GAS and GBS proteins is shown below:

```
Identities = 77/279 (27%), Positives = 125/279 (44%), Gaps = 19/279 (6%)
Query:  18 MSKTITFTNKVVVITGAGGVLCGYMAKEFAKAGAKVALLDLNQEAAQTFADEIVEEGGIA   77
              M   +  K+ +ITGA  +   +AK +A+AGA +    D+ QE           E G  A
Sbjct:   1 MENMFSLQGKIALITGASYGIGFEIAKAYAQAGATIVFNDIKQELVDKGLAAYRELGIEA   60

Query:  78 KAYKANVLSKENLEEVHQAVLEDLGPTDILVNGAGGNNPKATTDNEFHELDLPSETKTFF  137
              Y +V +  ++++   + +++G  DILVN AG
Sbjct:  61 HGYVCDVTDEAGIQQMVSQIEDEVGAIDILVNNAG-----------------IIRRTPML  103

Query: 138 ELDEAGISFVFNLNYLGTLLPTQVFAQDMVGREGANIINISSMNAFTPLTKIPAYSGAKA  197
              E+       V +++     + ++       M+ +    IINI SM +     + AY+ AK
Sbjct: 104 EMAAEDFRQVIDIDLNAPFIVSKAVLPSMIAKGHGKIINICSMMSELGRETVSAYAAAKG  163

Query: 198 AISNFTQWLAVHFSKVGIRCNAIAPGFLVTNQNRSLLFTE-DGQPTARAEKILNNTPMGR  256
                +    T+ +A  F +    I+CN I PG++ T  Q    L     + DG        + I+   TP   R
Sbjct: 164 GLKMLTKNIASEFGEANIQCNGIGPGYIATPQTAPLRERQADGSRHPFDQFIIAKTPAAR  223

Query: 257 FGEASELIGGLFFLADEKSSSFVNGVVLPIDGGFAAYSG                       295
              +G    +L G     FLA  + +S+FVNG +L +DGG  AY G
Sbjct: 224 WGTTEDLAGPAVFLASD-ASNFVNGHILYVDGGILAYIG                       261
```

Based on this analysis, it was predicted that these proteins and their epitopes could be useful antigens for vaccines or diagnostics.

Example 381

A DNA sequence (GBSx0412) was identified in *S. agalactiae* <SEQ ID 1243> which encodes the amino acid sequence <SEQ ID 1244>. This protein is predicted to be D-mannonate dehydrolase (uxuA). Analysis of this protein sequence reveals the following:

---
Possible site: 42
>>> Seems to have no N-terminal signal sequence
----- Final Results -----
   bacterial cytoplasm --- Certainty = 0.3188 (Affirmative) <succ>
      bacterial membrane --- Certainty = 0.0000 (Not Clear) <succ>
         bacterial outside --- Certainty = 0.0000 (Not Clear) <succ>

---

The protein has homology with the following sequences in the GENPEPT database:

```
>GP:BAB04425 GB:AP001509 D-mannonate dehydrolase [Bacillus halodurans]
Identities = 202/343 (58%), Positives = 261/343 (75%)
Query:   1  MEMSFRWYGEDDPVTLENIGQIPTMKGIVTAIYDVPVGEVWSRERIQQLKEKVEAAGLKI   60
            M ++ RW+G  D V LE I QIP MKGIV+AIYDV VG VW +E+I  LK  +E  GL +
Sbjct:   1  MRLTMRWFGPSDKVKLEYIKQIPGMKGIVSAIYDVAVGGVWPKEKILALKNNIERHGLTL   60

Query:  61  SVIESVPVHEDIKLGRPTRDLLIDNYIQTVKNLAAEGIDTICYNFMPVFDWTRTDLAYQY  120
             VIESVPVHEDIKLG+PTRD   I+NY QT+++LA  GIDT+CYNFMPVFDWTR+ L ++
Sbjct:  61  DVIESVPVHEDIKLGKPIRDRYIENYKQTLRHLAECGIDTVCYNFMPVFDWTRSQLDFKL  120

Query: 121  PDGSTALIFDETVSKKMDPVNGELSLPGWDASYSKEEMKAIMDAYAEIDEEKLWENLTYF  180
             DGS ALI++E V  + +P++GEL LPGWD SY  E +K ++ AY +I EE LW++LTYF
Sbjct: 121  EDGSEALIYEEDVISRTNPLSGELELPGWDTSYENESLKGVLQAYKKISEEDLWDHLTYF  180

Query: 181  IKRIIPEAEAVGVKMAIHPDDPPYSIFGLPRIITGLEAIERFVKLYDSKSNGITLCVGSY  240
            ++ I+P A+ VG+KMAIHPDDPP+SIFGLPRI+T   +ER + LYDS ++GIT+C GS
Sbjct: 181  VQAIMPVADEVGIKMAIHPDDPPWSIFGLPRIVTNKANLERLLSLYDSPNHGITMCSGSL  240

Query: 241  ASDPQNDVLEISRRAFELDRVNFVHARNIKLGDGKSFKESAHPSEYGSIDMYEVIKLCHE  300
             ++   ND+ E+ R     R++F HARNIK    +SF+ESAH SE GS++M  ++K H+
Sbjct: 241  GANEANDLPEMIRHFGGQGRIHFAHARNIKRTGPRSFQESAHLSEAGSVNMVAMLKAYHD  300

Query: 301  FGFEGAIRPDHGRMIWGETGRPGYGLYDRALGATYVSGLYEAV                  343
             GF G  +RPDHGRMIWGE GRPGYGLYDRALGATY++G++EAV
Sbjct: 301  IGFTGPLRPDHGRMIWGEKGRPGYGLYDRALGATYLNGIWEAV                  343
```

No corresponding DNA sequence was identified in *S. pyogenes*.

Based on this analysis, it was predicted that this protein and its epitopes, could be useful antigens for vaccines or diagnostics.

Example 382

A DNA sequence (GBSx0413) was identified in *S. agalactiae* <SEQ ID 1245> which encodes the amino acid sequence <SEQ ID 1246>. Analysis of this protein sequence reveals the following:

---

Possible site: 14
>>> Seems to have no N-terminal signal sequence
----- Final Results -----
    bacterial cytoplasm --- Certainty = 0.2447 (Affirmative) <succ>
    bacterial membrane --- Certainty = 0.0000 (Not Clear) <succ>
    bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 383

A DNA sequence (GBSx0414) was identified in *S. agalactiae* <SEQ ID 1247> which encodes the amino acid sequence <SEQ ID 1248>. This protein is predicted to be uronate isomerase. Analysis of this protein sequence reveals the following:

---

Possible site: 14
>>> Seems to have no N-terminal signal sequence
----- Final Results -----
    bacterial cytoplasm --- Certainty = 0.3066 (Affirmative) <succ>
    bacterial membrane --- Certainty = 0.0000 (Not Clear) <succ>
    bacterial outside --- Certainty = 0.0000 (Not Clear) <succ>

---

The protein has homology with the following sequences in the GENPEPT database:

```
>GP:BAB04424 GB:AP001509 uronate isomerase [Bacillus halodurans]
Identities = 215/465 (46%), Positives = 294/465 (62%), Gaps = 7/465 (1%)
Query:   3  FNTETFMLKNQAAIQLYEE-VKRQPIFDYHCHLDPKDIFEDHIFDNIVDLWLGGDHYKWR   61
            F +E F+L N+    +LY       K  PI DYHCHL P++I+E+  F+N+    WLGGDHYKWR
Sbjct:   4  FLSEDFLLMNEYDRELYYTFAKNMPICDYHCHLSPQEIWENKPFENMTKAWLGGDHYKWR   63

Query:  62  LMRANGISEAEITGPASNLEKFKAFARTLERAYGNPVYHWSAMELKNVFGVNEILTESNA  121
             MR  NG+ E   ITG A +  EKF A+A+T+ +    GNP+YHW+ MELK  F  ++  L E+N
Sbjct:  64  AMRLNGVREEFITGGAPDKEKFLAWAKTVPKTIGNPLYHWTHMELKTYFHFHQPLDETNG  123

Query: 122  EEIYHRLNHFLKEHKISPRRLIADSKVMFIGTTDHPLDTLEWHKKLAADESFKTVVAPTF  181
            E ++    N  L++   +PR LI   S V   IGTTD P D+L +H+KL AD++F   V PTF
Sbjct: 124  ENVWDACNRLLQQEAFTPRALIERSNVRAIGTTDDPTDSLLYHQKLQADDTFHVKVIPTF  183

Query: 182  RPDEAF-IEHRHFVDFITKLGDITQKEITDFSTFIAAMEERIAYFAQNGCRASDISFTEI  240
            RPD A   IE    F D++  KL D+T +  +      F+ A++ER+ +F ++GCR+SD     TE+
Sbjct: 184  RPDGALKIEQDSFADWVAKLSDVTGESLDTLDAFLHALKERLTFFDEHGCRSSDHDMTEV  243

Query: 241  VFEQTDELELNDLFNKVCEGYIPNQSEISKWQTAVFMELCRLYKKYGFVTQVHFGALRNN  300
            +F +   +E E     +F K       + E  K++T    L Y    G+V QVH G  +RNN
```

```
Sbjct: 244  PFVEVNEQEAQHIFRKRLANEGLTKVENEKYKTFLMTWLGKEYAARGWVMQWHIGVMRNN  303

Query: 301  HSTIFEKLGADVGVDSLGD-QVALTVNMNRLLDSLVEKDSLPKMIWYNLNPAYNIAVANT  359
            +S +   KLG D G DS+GD Q+A       +LLD L K+ +LPK I Y +NP  N  +A+
Sbjct: 304  NSRMLHKLGPDTGFDSIGDGQIAHAT--AKLLDLLDKQGALPKTILYCVNPNANYILASM  361

Query: 360  LANFQANELGVASYLQFGAGWWFADTKLGMISQMNALAEQGMLANFIGMLTDSRSFLSYQ  419
            + NF   E GVR +QFG+ WWF D   GM  Q+  LA  G+L+NFIGMLTDSRSFLSY
Sbjct: 362  IGNF--TESGVRGKVQFGSAWWFNDHIDGMRRQLTDLASVGLLSNFIGMLTDSRSFLSYP  419

Query: 420  RHDYFRRILCTYLGEWIEEGEVPEDYQALGSMAKDIAYQNAVNYF                464
            RHDYFRRILC  +G WI+EG++P D +  G + +DI Y N V+YF
Sbjct: 420  RHDYFRRILCQLIGSWIKEGQLPPDMERWGQIVQDICYNNVVDYF                464
```

No corresponding DNA sequence was identified in *S. pyogenes*.

Based on this analysis, it was predicted that this protein and its epitopes, could be useful antigens for vaccines or diagnostics.

Example 384

A DNA sequence (GBSx0415) was identified in *S. agalactiae* <SEQ ID 1249> which encodes the amino acid sequence <SEQ ID 1250>. This protein is predicted to be 2-dehydro-3-deoxyphosphogluconate aldolase/4-hydroxy-2-oxoglutarate al. Analysis of this protein sequence reveals the following:

---

Possible site: 43
>>> Seems to have no N-terminal signal sequence
----- Final Results -----
  bacterial cytoplasm --- Certainty = 0.3883 (Affirmative) <succ>
    bacterial membrane --- Certainty = 0.0000 (Not Clear) <succ>
      bacterial outside --- Certainty = 0.0000 (Not Clear) <succ>

---

A related GBS nucleic acid sequence <SEQ ID 9703> which encodes amino acid sequence <SEQ ID 9704> was also identified.

The protein has homology with the following sequences in the GENPEPT database:

```
>GP:AAD35160 GB:AE001693 2-dehydro-3-deoxyphosphogluconate
aldolase/4-hydroxy-2-oxoglutarate aldolase [Thermotoga maritima]
Identities = 93/199 (46%), Positives = 125/199 (62%), Gaps = 6/199 (3%)

Query:  37  KNNYFFAVIRGKSSEDALEIAKHAILGGIRNIEVTFSTPEASKVIKQLSDDFKNNKEIIV   96
            K +   AV+R  S E+A E A    GG+  IE+TF+ P+A  VIK+LS  F   K  I+
Sbjct:   8  KKHKIVAVLRANSVEEAKEKALAVFEGGVHLIEITFTVPDADTVIKELS--FLKEKGAII   65

Query:  97  GAGTVMTTELAKEAIDAGAKFLVSPHFDSDIANLANENKVYYFPGCATATEIVVARKYKC  156
            GAGTV + E  ++A+++GA+F+VSPH D +I+    E   V+Y PG   T TE+V A K
Sbjct:  66  GAGTVTSVEQCRKAVESGAEFIVSPHLDEEISQFCKEKGVFYMPGVMTPTELVKAMKLGH  125

Query: 157  QIIKLFPGGVVGPGFIKDIHGPIPDVDLMPSGGVSVSNVVEWRKAGAVAVGVGSALSSKV  216
             I+KLFPG VVGP F+K + GP P+V  +P+GGV++ NV EW KAG +AVGVGSAL
Sbjct: 126  TILKLFPGEVVGPQFVKAMKGPFPNVKFVPTGGVNLDNVCEWFKAGVLAVGVGSALVKGT  185

Query: 217  ATEGYDSVTKIAKQFVSAL                                          235
                D V + AK FV +
Sbjct: 186  P----DEVREKAKAFVEKI                                          200
```

A related DNA sequence was identified in *S. pyogenes* <SEQ ID 1251> which encodes the amino acid sequence <SEQ ID 1252>. Analysis of this protein sequence reveals the following:

```
Possible site: 29
>>> Seems to have no N-terminal signal sequence
----- Final Results -----
    bacterial cytoplasm --- Certainty = 0.1039 (Affirmative) <succ>
      bacterial membrane --- Certainty = 0.0000 (Not Clear) <succ>
       bacterial outside --- Certainty = 0.0000 (Not Clear) <succ>
```

An alignment of the GAS and GBS proteins is shown below:

```
Identities = 82/204 (40%), Positives = 132/204 (64%)
Query:   32 MLNQLKNNYFFAVIRGKSSEDALEIAKHAILGGIRNIEVTESTPEASKVIKQLSDDFKNN   91
            +L +LK N     V+RG+SSE+AL   +  +I GGI+ IEVT++ P AS+VI QL++ FK +
Sbjct:    6 ILTKLKANRLVLVVRGESSEEALACSLASIEGGIKTIEVTYTNPFASEVIGQLAERFKED   65

Query:   92 KEIIVGAGTVMTTELAKEAIDAGAKFLVSPHFDSDIANLANENKVYYFPGCATATEIVVA  151
            E+++GAGTV+     A++AI AGA+F+V P+F+  +A + +   + Y PGC T  E+V A
Sbjct:   66 PEVLIGAGTVLDDVTARQAILAGAQFIVGPNFNRAVALICHRYSIPYLPGCMTVNEVVTA  125

Query:  152 RKYKCQIIKLFPGGVVGPGFIKDIHGPIPDVDLMPSGGVSVSNVVEWRKAGAVAVGVGSA  211
            +     ++K+FPG  VG  FI+ I  P+P V++M +GGVS  N+ +W  AG    +G+G
Sbjct:  126 LESGVDMVKIFPGSTVGISFIRAIKSPLPQVEVMVTGGVSSDNLKDWLAAGVDVLGIGGE  185

Query:  212 LSSKVATEGYDSVTKIAKQFVSAL                                     235
            +    + + Y+ +TK A  ++ +L
Sbjct:  186 FNQLASQKQYNLITKKAAHYIKSL                                     209
```

Based on this analysis, it was predicted that these proteins and their epitopes could be useful antigens for vaccines or diagnostics.

Example 385

A DNA sequence (GBSx0416) was identified in *S. agalactiae* <SEQ ID 1253> which encodes the amino acid sequence <SEQ ID 1254>. This protein is predicted to be pyruvate dehydrogenase complex repressor. Analysis of this protein sequence reveals the following:

```
Possible site: 26
>>> Seems to have no N-terminal signal sequence
----- Final Results -----
    bacterial cytoplasm --- Certainty = 0.2827 (Affirmative) <succ>
      bacterial membrane --- Certainty = 0.0000 (Not Clear) <succ>
       bacterial outside --- Certainty = 0.0000 (Not Clear) <succ>
```

The protein has homology with the following sequences in the GENPEPT database:

```
>GP:CAB12044 GB:Z99105 similar to transcriptional regulator (GntR
family) [Bacillus subtilis
]
Identities = 67/225 (29%), Positives = 119/225 (52%), Gaps = 17/225 (7%)
Query:    3 RPLVEQTADRLLHLILEREYPVGAKLPNEYELAEDLDVGRSTIREAVRSLATRNILEVRQ   62
            + L +Q  +R++HL+   +   G KLP E EL + L V R  +REA+ SL T  ++   +
Sbjct:   16 KTLAKQVIERIVHLLSSGQLRAGDKLPTEMELMDILHVSRPVLREALSSLETLGVITRKT   75

Query:   63 GSGTYISSKKGVSEDPLGFSLIKDTDRLTSDLFELRLLLEPRIAELVAYRITDDQLQLLE  122
               GTY + K G+    P    L   TD L + + E R+ LE  +  + A +I +++LQ L+
Sbjct:   76 RGGTYFNDKIGM--QPFSVMLALATDNLPA-IIEARMALELGLVTIAAEKINEEELQRLQ  132

Query:  123 KLVGDIEDAV--HAGDPKHLLLDVEFHSMLAKYSGNIAMDSLLPVINQSIHLINANYTNR  180
            K + DI ++   H G+    D EFH ++A  + N ++ ++     QS+ + +A     ++
Sbjct:  133 KTIDDIANSTDNHYGE-----ADKEFHRIIALSANNPVVEGMI----QSLLITHAKIDSQ  183

Query:  181 ---QMKSDSLEAHREIIKAIREKNPVAAHDAMLMHIMSVRRSALK                222
               + +  ++E H++I  A+ +++P   AH M  H+   VR   LK
Sbjct:  184 IPYRERDVTVEYHKKIYDALAQRDPYKAHYHMYEHLKFVRDKILK                228
```

A related DNA sequence was identified in *S. pyogenes* <SEQ ID 1255> which encodes the amino acid sequence <SEQ ID 1256>. Analysis of this protein sequence reveals the following:

```
Possible site: 54
>>> Seems to have no N-terminal signal sequence
----- Final Results -----
   bacterial cytoplasm --- Certainty = 0.2161 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below:

```
Identities = 24/51 (47%), Positives = 35/51 (68%)
Query:  22 YPVGAKLPNEYELAEDLDVGRSTIREAVRSLATRNILEVRQGSGTYISSKK    72
           +P+G++LP+E  LAE   V R T+R+A+  L     ILE R GSGTY++S +
Sbjct:  30 WPIGSRLPSERHLAEHFTVSRMTLRQAITLLVEEGILERRIGSGTYVASHR    80
```

Based on this analysis, it was predicted that these proteins and their epitopes could be useful antigens for vaccines or diagnostics.

Example 386

A DNA sequence (GBSx0417) was identified in *S. agalactiae* <SEQ ID 1257> which encodes the amino acid sequence <SEQ ID 1258>. Analysis of this protein sequence reveals the following:

```
Possible site: 31
>>> Seems to have no N-terminal signal sequence
```

-continued

```
----- Final Results -----
   bacterial cytoplasm --- Certainty = 0.2178 (Affirmative) <succ>
   bacterial membrane --- Certainty = 0.0000 (Not Clear) <succ>
   bacterial outside --- Certainty = 0.0000 (Not Clear) <succ>
```

A related GBS nucleic acid sequence <SEQ ID 9701> which encodes amino acid sequence <SEQ ID 9702> was also identified.

The protein has homology with the following sequences in the GENPEPT database:

```
>GP:CAA58911 GB:X84105 gluceronidase [synthetic construct]
Identities = 258/602 (42%), Positives = 357/602 (58%), Gaps = 31/602 (5%)
Query:   23 MLYPLLTKTRNTYDLGGIWNFKLGEHNPN-------ELLPSDEVMVIPTSFNDLMVSKEK   75
             ML P+ T TR    L G+W F L  N         L    + +P SFND       +
Sbjct:    1 MLRPVETPTREIKKLDGLWAFSLDRENCGIDQRWWESALQESRAIAVPGSFNDQFADADI   60

Query:   76 RDYIGDFWYEKVIEVPKVSEDEEMVLRFGSVTHQAKIYVDGVLVGEHKGGFTPFEVLVPE  135
             R+Y G+ WY++ + +PK    + +VLRF +VTH  K++V+    V  EH+GG+TPFE  V
Sbjct:   61 RNYAGNVWYQREVFIPKGWAGQRIVLRFDAVTHYGKVWVNNQEVMEHQGGYTPFEADVTP  120

Query:  136 CKYNNEKIKVSICANNVLDYTTLPVGNYSEIIQEDGSIKKKVRENFDFFNYAGVHRPLKL  195
             +  +++++C NN L++ T+P G    I   E+G   KKK       DFFNYAG+HR + L
Sbjct:  121 YVIAGKSVRITVCVNNELNWQTIPPGMV--ITDENG--KKKQSYFHDFFNYAGIHRSVML  176

Query:  196 MIRPKNHIFDITITSRLSDDLQSADLHFLVETNQKVDEVRISVFDEDNKLV--GETKDSR  253
              P     + DIT+ +  ++ D    A + +V  N     +V + + D D ++V  G+
Sbjct:  177 YTTPNTWVDDITVVTHVAQDCNHASVDWQVVAN---GDVSVELRDADQQVVATGQGTSGT  233

Query:  254 LFLSDVHLWEVLNAYLYTARVEIFVDNQLQDVYEENFGLREIEVTNGQFLLNRKPIYFKG  313
             L + + HLW+    YLY  V         +D+Y    G+R + V    QFL+N  KP YF G
Sbjct:  234 LQVVNPHLWQPGEGYLYELCVTAKSQTEC-DIYPLRVGIRSVAVKGEQFLINHKPFYFTG  292

Query:  314 FGKHEDTFINGRGLNEAANLMDLNLLKDMGANSFRTSHYPYSEEMMRLADRMGVLVIDEV  373
             FG+HED  + G+G  +       + D  L+  +GANS+RTSHYPY+EEM+     AD   G++VIDE
Sbjct:  293 FGRHEDADLRGKGFDNVLMVHDHALMDWIGANSYRTSHYPYAEEMLDWADEHGIVVIDET  352

Query:  374 PAVGLFQNFNASLDLS------PKDNGTWNLM--QTKAAHEQAIQELVKRDKNHPSVVMW  425
                AVG     FN SL +         PK+  +    +T+ AH QAI+EL+ RDKNHPSVVMW
Sbjct:  353 AAVG----FNLSLGIGFEAGNKPKELYSEEAVNGETQQAHLQAIKELIARDKNHPSVVMW  408

Query:  426 VVANEPASHEAGAHDYFEPLVKLYKDLDPQKRPVTLVNILMATPDRDQVMDLVDVVCLNR  485
             +ANEP +   GA +YF PL +    + LDP   RP+T VN++                D + DL DV+CLNR
Sbjct:  409 SIANEPDTRPQGAREYFAPLAEATRKLDPT-RPITCVNVMFCDAHTDTISDLFDVLCLNR  467

Query:  486 YYGWYVDHGDLTNAEVGIRKELLEWQDKFPDKPIIITEYGADTLPGLHSTWNIPYTEEFQ  545
             YYGWYV  GDL AE    + KELL WQ+K    +PIIITEYG DTL GLHS +      ++EE+Q
Sbjct:  468 YYGWYVQSGDLETAEKVLEKELLAWQEKL-HQPIIITEYGVDTLAGLHSMYTDMWSEEYQ  526
```

```
Query:  546  CDFYEMSHRVFDGIPNLVGEQVWNFADFETNLMILRVQGNHKGLFSRNRQPKQVVKEFKK  605
             C + +M HRVFD +  +VGEQVWNFADF T+   ILRV GN KG+F+R+R+PK     +K
Sbjct:  527  CAWLDMYHRVFDRVSAVVGEQVWNFADFATSQGILRVGGNKKGIFTRDRKPKSAAFLLQK  586

Query:  606  RW  607
             RW
Sbjct:  587  RW  588
```

A related DNA sequence was identified in *S. pyogenes* <SEQ ID 1259> which encodes the amino acid sequence <SEQ ID 1260>. Analysis of this protein sequence reveals the following:

Possible site: 23
\>\>\> Seems to have no N-terminal signal sequence
INTEGRAL    Likelihood = −4.04    Transmembrane 1131-1147

(1130-1147)
----- Final Results -----
bacterial membrane --- Certainty = 0.2614 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the databases:

```
>GP:AAF97242 GB:AF282987 beta-galactosidase precursor [Streptococcus pneumoniae]
Identities = 303/921 (32%), Positives = 463/921 (49%), Gaps = 86/921 (9%)
Query:    5  QKSSEIVT----RTITKPSRATSNVKQEIDMTPDSKEQTVTGYQYHYIDQ--EGRKQPFN   58
             +K  E VT    +    KP      ++  +         +         ++Q  E RK  FN
Sbjct:   96  KKEDEAVTPKEEKVSAKPEEKAPRIESQASNQEKPLKEDAKAVTNEEVNQMIEDRKVDFN  155

Query:   59  QGWRF-LMADVACAQDPSFDDSNWQVIHLPHDFSLTQPYTRNGEA--ESAYKLGGVGWYR  115
             Q W F L A+    A   P   D S W+ + LP+D+S+    +       A E    GG  WYR
Sbjct:  156  QNWYFKLNANSKEAIKPDADVSTWKKLDLPYDWSIENDFDHESPAQNEGGQLNGGEAWYR  215

Query:  116  HYLVLDEVLAGCHVAITFEGSYMETEIYVNGQFIGKHLNGYQEFTYDISDVVTF-GAENL  174
                      LDE       +V +TF+G  YM++++YVNGQ +G + NGY +F+YDI+  +   G EN+
Sbjct:  216  KTFKLDEKDLKKNVRLTFDGVYMDSQVYVNGQLVGHYPNGYNQFSYDITKYLQKDGRENV  275

Query:  175  LAVRVENKVPSSRWYSGSGLYREVSLSVLPQLHFVADQVAMTLADTAVQEKGQQKVDLRF  234
             +AV    NK  PSSRWYSGSG+YR+V+L V   ++H    +        Q+ G+ + +
Sbjct:  276  IAVHAVNKQPSSRWYSGSGIYRDVTLQVTDKVHVEKNGTTILTPKLEEQQHGKVETHVTS  335

Query:  235  ALNQSIQTCHYQLSLCLWEQSHCSKDKKLLYQETEVPLADLAFQRQYGLT--LSLEELQL  292
              +    +   H ++      E   +        +        L       L  L +E +L
Sbjct:  336  KIVNTDDKDHELVA----EYQIVERGGHAVTGLVRTASRTLKAHESTSLDAILEVERPKL  391

Query:  293  WSP--DNPHLYDLELTLYYQGQVIDCFCLETGFRQLTFMANQGLEVNGRAVKLKGVCLHH  350
             W+    D P LY+L  +Y GQ++D      G+R   +   N+G  +NG +K GV LHH
Sbjct:  392  WTVLNDKPALYELITRVYRDGQLVDAKKDLFGYRYYHWTPNEGFSLNGERIKFHGVSLHH  451

Query:  351  DQGGLGACAYEDALARQLVLLKDMGANTIRSTHNPSSPKLRQLANRLGFFVIEEAFDTWT  410
             D G LGA     A  R+L  +K++MG N+IR+THNP+S + Q+A LG  V EEAFDTW
Sbjct:  452  DHGALGAEENYKAEYRRLKQMKEMGVNSIRTTHNPASEQTLQIAAELGLLVQEEAFDTWY  511

Query:  411  YAKNGNVNDFSNYFHQTIGTENANYLQRVRSPETSWAQYSIEAMVWSAKNDPSVLMWSIG  470
              K      D+ +F +       A    ++          W+ + +  MV  KN+P++ MWSIG
Sbjct:  512  GGK--KPYDYGRFFEKDATHPEARKGEK-------WSDFDLRTMVERGKNNPAIFMWSIG  562

Query:  471  NELMEGFSADVSHYPELTRQMCQWITAIDTSRPITFGDNKLKEADFC-WHEEVSQMATLL  529
             NE+  G +    +H     +++ + I   +D +R +T G +K + +    HE+++
Sbjct:  563  NEI--GEANGDAHSLATVKRLVKVIKDVDKTRYVTMGADKFRFGNGSGGHEKIA-----  614

Query:  530  SQLDHPQGLIGLNYADGKYDRLHEEHSDWLLYGSETVSAITSR-AYYKETKEVLDS---  585
              +LD        +G NY++  +Y  L +H   WL+YGSET SA   +R  +YY+  +++   S
Sbjct:  615  DELD----AVGFNYSE-DNYKALRAKHPKWLIYGSETSSATRTRGSYYRPERELKHSNGP  669

Query:  586  --GYHLTSYDHAKVDWGAFASQAWYDTITRDFV--AGECVWTGFDYLGEPTPWNKIDSGV  641
               Y  + Y + +V WG A+  +W  T  RD    AG+  +WTG DY+GEPTPW+   +
Sbjct:  670  ERNYEQSDYGNDRVGWGKTATASW--TFDRDNAGYAGQFIWTGTDYIGEPTPWHNQNQTP  727

Query:  642  VGLWPSPKNAYFGILDTAGFPKDSYYFYQSQW--AQGQTTLHLLPVWQKD-----QLCFD  694
             V        K++YFGI+DTAG PK  +Y YQSQW   +  + +HLLP W +             D
Sbjct:  728  V------KSSYFGIVDTAGIPKHDFYLYQSQWVSVKKKPMVHLLPHWNWENKELASKVAD  781

Query:  695  EQGLVEVVVYSNAASVQLMFEDEQGNLTDYGRKAFHTYSTPTGHTYQLYQGADAAKNPHE  754
             + G + V   YSNA+SV+L      N      G K F+    T G  TYQ   +GA+A
Sbjct:  782  SEGKIPVRAYSNASSVELFL-----NGKSLGLKTFNKKQTSDGRTYQ--EGANA-----N  829

Query:  755  NLYLTWRVPYQKGLLRAVAYDISGKSIPKTSGRSQVRTYGSVAKLSWKAFEAPIDAPW-E  813
              LYL W+V YQ G L A+A D SGK I      R ++ T G  A+     + IA    +
```

```
                         -continued
Sbjct: 830  ELYLEWKVAYQPGTLEAIARDESGKEI----ARDKITTAGKPAAVRLIKEDHAIAADGKD   885

Query: 814  LLYLDLSLLDSRGELVSHAQDWLQVQVEGPARLLALDNGNPTDHTPYQEP-----LRQAY   868
            L Y+   ++DS+G +V  A + ++ Q+ G  +L+ +DNG       Y+        +R+A+
Sbjct: 886  LTYIYYEIVDSQGNVVPTANNLVRFQLHGQGQLVGVDNGEQASRERYKAQADGSWIRKAF   945

Query: 869  GGKLLAILALTGEAGHIKVTA                                         889
             GK +AI+  T +AG   +TA
Sbjct: 946  NGKGVAIVKSTEQAGKFTLTA                                         966
```

An alignment of the GAS and GBS proteins is shown below:

```
Identities = 98/414 (23%), Positives = 175/414 (41%), Gaps = 64/414 (15%)
Query:  54  LPSDEVMVIPTSFNDLMVSKEKRDYIGDFWYEKVIEVPKVSEDEEMVLRFGSVTHQAKIY   113
            LP D + P+N    S K   +G  WY  + + +V    + + F      + +IY
Sbjct:  86  LPHDFSLTQPYTRNGEAESAYKLGGVG--WYRHYLVLDEVLAGCHVAITFEGSYMETEIY   143

Query: 114  VDGVLVGEHKGGFTPFEVLVPECKYNNEKIKVSICANNVLDYTTLPVGNYSEIIQEDGSI   173
            V+G  +G+H  G+ F   + +      V+  A N+L                  +
Sbjct: 144  VNGQFIGKHLNGYQEFTYDISDV--------VTFGAENLLAVR----------------V   179

Query: 174  KKKVRENFDFFNYAGVHRPLKLMIRPKNHIFDITITSRLSDDL------QSADLHFLVET   227
            + KV +  +++ +G++R + L + P+ H     + L+D       Q  DL F +
Sbjct: 180  ENKVPSS-RWYSGSGLYREVSLSVLPQLHFVADQVAMTLADTAVQEKGQQKVDLRFALNQ   238

Query: 228  NQKVDEVRISVF-------DEDNKLVGETKDS-------------RLFLSDVHLWEVLNA   267
            + +    ++S+          +D KL+  +  +          L L ++ LW    N
Sbjct: 239  SIQTCHYQLSLCLWEQSHCSKDKKLLYQETEVPLADLAFQRQYGLTLSLEELQLWSPDNP   298

Query: 268  YLYTARVEIFVDNQLQDVYEENFGLREIE-VTNGQFLLNRKPIYFKGFGKHEDTFINGRG   326
            +LY    + +   Q+ D +     G R++    + N    +N + +  KG     H D     G
Sbjct: 299  HLYDLELTLYYQGQVIDCFCLETGFRQLTFMANQGLEVNGRAVELKGVCLHHDQGGLGAC   358

Query: 327  LNEAANLMDLNLLKDMGANSFRTSHYPYSEEMMRLADRMGVLVIDEVPAVGLFQ---NFN   383
               E A    L  LLKDMGAN+ R++H  P S ++  +LA+R+G   VI+E     +    N N
Sbjct: 359  AYEDALARQLVLLKDMGANTIRSTHNPSSPKLRQLANRLGFFVIEEAFDTWTYAKNGNVN   418

Query: 384  ASLDLSPKDNGTWN---LMQTKAAH----EQAIQELVKRDKNHPSVVMWVVANE         430
             +   +  GT N   L + ++        + +I+ +V    KN  PSV+MW + NE
Sbjct: 419  DFSNYFHQTIGTENANYLQRVRSPETSWAQYSIEAMVWSARNDPSVLMWSIGNE         472
```

Based on this analysis, it was predicted that these proteins and their epitopes could be useful antigens for vaccines or diagnostics.

Example 387

A DNA sequence (GBSx0418) was identified in *S. agalactiae* <SEQ ID 1261> which encodes the amino acid sequence <SEQ ID 1262>. This protein is predicted to be 2-keto-3-deoxygluconate kinase. Analysis of this protein sequence reveals the following:

---

Possible site: 13
>>> Seems to have no N-terminal signal sequence
INTEGRAL    Likelihood = –0.53    Transmembrane 197-213 (197-213)
----- Final Results -----
  bacterial membrane --- Certainty = 0.1213 (Affirmative) <succ>
    bacterial outside --- Certainty = 0.0000 (Not Clear) <succ>
      bacterial cytoplasm --- Certainty = 0.0000 (Not Clear) <succ>

---

A related GBS nucleic acid sequence <SEQ ID 9699> which encodes amino acid sequence <SEQ ID 9700> was also identified.

The protein has homology with the following sequences in the GENPEPT database:

```
>GP: AAD35161 GB: AE001693 2-keto-3-deoxygluconate kinase
[Thermotoga maritime]
Identities = 115/342 (33%), Positives = 180/342 (52%), Gaps = 16/342 (4%)
Query:  14 KIISLGEVLLRLSPPQYHTLMQANHLKCQFGGSELNVLASLAQLGYHVGLVSALPDNDLG        73
           K+++ GE++LRLSPP + + Q +     +GG+E NV A LAQ+G     V+ LP+N LG Sbjct:   2 KVVTFGEIMLRLSPPDHKRIFQTDSFDVTYGGAEANVAAFLAQMGLDAYFVTKLPNNPLG        61

Query:  74 KMASQFILSQQISPAAIIKKEGRLGIYYYEQGFSVRTNKVIYDRNYSSFWESTLSDYDFT       133
           A+   +    I +    R+GIY+ E G S R +KV+YDR +S+   E+    D+D+

Sbjct:  62 DAAAGHLRKFGVKTDYIARGGNRIGIYFLEIGASQRPSKVVYDRAHSAISEAKREDFDWE       121

Query: 134 SIFKGVDWFHVSGITPALTKDLYEVTRFLMTKAKEGGVKVSIDLNFRESLWSSFQEAREQ       193
            I  G   WFH SGITP L K+L +      + A E GV VS DLN+R LW+   +EA++

Sbjct: 122 KILDGARWFHFSGITPPLGKELPLILEDALKVANEKGVTVSCDLNYRARLWTK-EEAQKV       180

Query: 194 LSPLLGLLDVCFGLEPIYLAGESEDLKDELGLSRPYLDI-------ELLEKITQKIVQEY       246
            + P + +DV       L    ED++  LG+S   LD+            E  KI +++ ++Y Sbjct: 181 MIPFMEYVDV--------LIANEEDIEKVLGISVEGLDLKTGKLNREAYAKIAEEVTRKY       232

Query: 247 GLDYIAFTQREMEYTNQYMLKSYLYHNNMLYQTDKTGVEVLDRVGTGDAFAAGLIHALLE       306
             +   T RE         ++ N   + +++  +  ++DRVG GD+FA  LI+   L Sbjct: 233 NFKTVGITLRESISATVNYWSVMVFENGQPHFSNRYEIHIVDRVGAGDSFAGALIYGSLM       292

Query: 307 KETPQRALEIAMATYKYKHTIQGDINIMTRDDIAYLIEKETN                    348
               Q+  E A A   KHTI GD +++ ++I  L      T+

Sbjct: 293 GFDSQKKAEFAAAASCLKHTIPGDFVVLSIEEIEKLASGATS                    334
```

A related DNA sequence was identified in *S. pyogenes* <SEQ ID 1263> which encodes the amino acid sequence <SEQ ID 1264>. Analysis of this protein sequence reveals the following:

Possible site: 38
>>> Seems to have no N-terminal signal sequence

-continued

----- Final Results -----
bacterial cytoplasm --- Certainty = 0.0708 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below:

```
Identities = 111/319 (34%), Positives = 168/319 (51%), Gaps = 7/319 (2%)
Query:  12 MAKIISLGEVLLRLSPPQYHTLMQANHLKCQFGGSELNVLASLAQLGYHVGLVSALPDND        71
           M+K++ +GE L+R+SP Q+   L   A   +  FGGSE+N+  +L    G    L +ALPDN Sbjct:  14 MSKLLLVGEPLIRVSPNQFQPLTNACEAQLFFGGSEVNIARTLGGFGLEARLFTALPDNP        73

Query:  72 LGKMASQFILSQQISPAAIIKKEGRLGIYYYEQGFSVRTNKVIYDRNYSSFWESTLSDYD       131
           +G     QF+  +   +  +      R+G+YY E GF R ++V YDR   SSF         D Sbjct:  74 VGHAFHQFLKQSGVDMSLTAWQGHRVGLYYLENGFGCRASQVYYDRCGSSFSALDKDSLD       133

Query: 132 FTSIFKGVDWFHVSGITPALTKDLYEVTRFLMTKAKEGGVKVSIDLNFRESLWSSFQEAR       191
            +IF+G+   FH SGI+ AL K    ++    L+ +AK+   +S DLNFR S+   + +A+

Sbjct: 134 LAAIFEGISHFHFSGISLALGKKTQDLIEVLVREAKKRDICISFDLNFRSSM-IAVADAK       192

Query: 192 EQLSPLLGLLDVCFGLEPIYLAGESEDLKDELGLSRPYLDIELLEKITQKIVQEYGLDYI       251
                 S      D+  FG+EP+ L  +  D+  D      R   D   +  +    + Q Y L   I Sbjct: 193 RLFSHFAQYADIIFGMEPLLLDSDDFDMFD-----RKKADTTTIRERLAGLYQRYQLQAI       247

Query: 252 AFTQREMEYTNQYMLKSYLYHNNMLYQTDKTGVEVLDRVGTGDAFAAGLIHALLEKETPQ       311
                T+R +        K+Y Y +   Y++ +       VL RVG+GDAF AGL++  LLE       Q Sbjct: 248 YHTERSNDAQGSNHFKAYY-DRQFYESCEVITPVLQRVGSGDAFVAGLLYQLLEGNEKQ        306

Query: 312 RALEIAMATFKYKHTIQGD                                           330
           R L+ A+AT   K T+  D Sbjct: 307 RNLDFAVATASLKCTVAED                                           325
```

Example 388

A DNA sequence (GBSx0419) was identified in *S. agalactiae* <SEQ ID 1265> which encodes the amino acid sequence <SEQ ID 1266>. Analysis of this protein sequence reveals the following:

```
Possible site: 15
>>> Seems to have an uncleavable N-term signal seq
INTEGRAL    Likelihood = -1.17    Transmembrane 5-21 (5-21)
----- Final Results -----
    bacterial membrane --- Certainty = 0.1468 (Affirmative) <succ>
    bacterial outside --- Certainty = 0.0000 (Not Clear) <succ>
    bacterial cytoplasm --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 389

A DNA sequence (GBSx0420) was identified in *S. agalactiae* <SEQ ID 1267> which encodes the amino acid sequence <SEQ ID 1268>. Analysis of this protein sequence reveals the following:

```
Possible site: 53
>>> Seems to have no N-terminal signal sequence
INTEGRAL    Likelihood = -12.05   Transmembrane 198-214 (191-220)
INTEGRAL    Likelihood = -11.68   Transmembrane 446-462 (437-467)
INTEGRAL    Likelihood = -9.55    Transmembrane 94-110 (91-116)
INTEGRAL    Likelihood = -7.43    Transmembrane 291-307 (283-309)
INTEGRAL    Likelihood = -4.88    Transmembrane 265-281 (257-282)
INTEGRAL    Likelihood = -4.62    Transmembrane 321-337 (318-339)
INTEGRAL    Likelihood = -3.93    Transmembrane 406-422 (405-426)
INTEGRAL    Likelihood = -1.59    Transmembrane 121-137 (121-137)
INTEGRAL    Likelihood = -1.12    Transmembrane 345-361 (345-362)
INTEGRAL    Likelihood = -0.48    Transmembrane 43-59 (43-59)
----- Final Results -----
    bacterial membrane --- Certainty = 0.5819 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database:

```
>GP: CAB13641 GB: Z99113 similar to H+-symporter [Bacillus subtilis]
Identities = 105/452 (23%), Positives = 182/452 (40%), Gaps = 37/452 (8%)
Query:   36 IYLFTFMFVTYFSTGVLGSAAIFVSQIMGYIRIFDGFIDPAIGIMIDKTDTKFGKYRPIL      95
            IY     ++ +F T V G +A    +    +RI D   DP IG ++D+T+++F ++RP L Sbjct:   27 IYATVSTYLLFFYTDVFGLSAAAAGTMFLVVRIIDALADPFIGTIVDRTNSRFARFRPYL      86

Query:   96 IIGNVITALSLIFLLALRGVDENIRFPLFILVLIIHKIGYSMQQTITKAGQTALTNDPKQ     155
            + G   A   +L L    +      ++    I +G S+ T          ALT+

Sbjct:   87 LFG----AFPFVILAILCFTTPDFSDMGKLIYAYITYVGLSLTYTTINVPYGALTS-AMT     141

Query:  156 RPIFNIVDAVMTTSLMTGGQFVVSVFLVPKFGNFTPQFFNVLIFGTILISAILAIV--AI     213
            R     +V          L      +V   F VP +           G L   IL ++    +

Sbjct:  142 RNNQEVVSITSVRMLFANLGGLVVAFFVPLLAAYLSDTSGNESLGWQLTMGILGMIGGCL     201

Query:  214 IGIWAKDRKEFFGLGENTQKTALKDYWKVLKGNKPLQILSIAAALVKFAIQFFGDSV-VM     272
            +       K KE    L ++ +K    D ++   N+PL +LSI    ++ F +      +SV +

Sbjct:  202 LIFCFKSTKERVTLQKSEEKIKFTDIFEQFRVNRPLVVLSIFFIII-FGVNSISNSVGIY     260

Query:  273 VLLFGI----LFGNYALSGQFSLLFIVPGVIINILFSTIARKKGLRFSYVRAIQIGMIGL     328
            + + +        L    Y L G    L I+P   I  L    +KK L +      A+ +  +IGL Sbjct:  261 YVTYNLEREDLVKWYGLIGSLPALVILP--FIPRLHQFLGKKKLLNY----ALLLNIIGL     314

Query:  329 LAFGAVLYVGKPGDLSLTSLNLYTILFIVTNIIARYASQAPASLVLTMGADISDYETSES     388
            LA              L +   N+Y IL V  +IA    S      +   +   +Y   +

Sbjct:  315 LAL-----------LFVPPSNVYLIL--VCRLIAAAGSLTAGGYMWALIPETIEYGEYRT     361

Query:  389 GRYVSGMIGTIFSLTDSIASSFAPMVVGFVLAGIGFSKSFPTIETPLPPDLKMAAISILV     448
            G+ + G+I  I             +    +V G VL    G+              P   M     +

Sbjct:  362 GKRMGGLIYAIIGFFFKFGMALGGVVPGLVLDKFGY-----VANQAQTPAALMGILITTT     416

Query:  449 AIPFIALSIALLLMKFYKLDKEEMVRIQEKIQ                             480
            IP    L +AL+ +  FY LD+++     +   +++

Sbjct:  417 IIPVFLLVLALIDINFYNLDEKKYKNMVRELE                             448
```

No corresponding DNA sequence was identified in *S. pyogenes*.

Based on this analysis, it was predicted that this protein and its epitopes, could be useful antigens for vaccines or diagnostics.

Example 390

A DNA sequence (GBSx0422) was identified in *S. agalactiae* <SEQ ID 1269> which encodes the amino acid sequence <SEQ ID 1270>. Analysis of this protein sequence reveals the following:

```
Possible site: 52
>>> Seems to have no N-terminal signal sequence
----- Final Results -----
    bacterial cytoplasm --- Certainty = 0.3375 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database:

```
>GP: AAB17663 GB: U31175 D-specific D-2-hydroxyacid dehydrogenase
[S. aureus]
Identities = 165/331 (49%), Positives = 231/331 (68%), Gaps = 1/331 (0%)
Query:    1 MMKLKVFNVREEEATLAQDWANRNEVELSMSEGPLTLETVNEVEGFDGIANAQIEPLDDA           60
            M K+  F  R+ E  +A +W  +N+VE++ S+  L+   TV++++ +DG+    Q   L++

Sbjct:    1 MTKIMFFGTRDYEKEMALNWGKKNNVEVTTSKELLSSATVDQLKDYDGVTIMQFGKLEND          60

Query:   61 IYPLLKEMGIKQIAQRSAGVDMYNLELAKQHGIIISNVPSYSPESIAEFTVTIALNLIRK         120
            +YP L+   GIKQIAQR+AG DMY+L+LAK+H I+ISNVPSYSPE+IAE++V+IAL L+R+

Sbjct:   61 VYPKLESYGIKQIAQRTAGFDMYDLDLAKKHNIVISNVPSYSPETIAEYSVSIALQLVRR         120

Query:  121 VELIRANVREQNFSWTLPIRGRVLGNMTVAIIGTGRIGLATAKIFKGFGCRVIGYDIYHN         180
                 I   V+  +F+W    I + +  NMTVAIIGTGRIG ATAKI+ GFG  +  YD Y N Sbjct:  121 FPDIERRVQAHDFTWQAEIMSKPVKNMTVAIIGTGRIGAATAKIYAGFGATITAYDAYPN         180

Query:  181 PMADGILEYVNSVEEAVEEADLVSLHMPPTAENTHLFNLDMFKQFKKGAILMNMARGALV         240
              D   L Y +SV+EA+++AD++SLH+P   E+ HLF+  MF    KKGAIL+N ARGA++

Sbjct:  181 KDLD-FLTYKDSVKEAIKDADIISLHVPANKESYHLFDKAMFDHVKKGAILVNAARGAVI         239

Query:  241 ETKDLLEALDQGLLEGAGIDTYEFEGPYIPKNCQGQDISDKDFLRLINHPKVIYTPHAAY         300
               T DL+ A++ G L GA IDTYE E  Y    +   +DI DK  L LI H +++ TPH A+

Sbjct:  240 NTPDLIAAVNDGILLGAAIDTYENEAAYFTNDWTNKDIDDKTLLELIEHERILVTPHIAF         299

Query:  301 YTDEAVKNLVEGALNACVEVIETGTTTTKVN                                       331
            ++DEAV+NLVEG LNA + VI TGT    T++N Sbjct:  300 FSDEAVQNLVEGGLNAALSVINTGTCETRLN                                       330
```

There is also homology to SEQ ID 124.

Based on this analysis, it was predicted that this protein and its epitopes, could be useful antigens for vaccines or diagnostics.

Example 391

A DNA sequence (GBSx0423) was identified in *S. agalactiae* <SEQ ID 1271> which encodes the amino acid sequence <SEQ ID 1272>. Analysis of this protein sequence reveals the following:

```
Possible site: 40
>>> Seems to have no N-terminal signal sequence
----- Final Results -----
    bacterial cytoplasm --- Certainty = 0.2364 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 392

A DNA sequence (GBSx0424) was identified in *S. agalactiae* <SEQ ID 1273> which encodes the amino acid sequence <SEQ ID 1274>. This protein is predicted to be regulatory protein (pfoS/R). Analysis of this protein sequence reveals the following:

```
Possible site: 37
>>> Seems to have a cleavable N-term signal seq.
INTEGRAL    Likelihood = -12.90    Transmembrane 64-80 (53-89)
----- Final Results -----
    bacterial membrane --- Certainty = 0.6158 (Affirmative) <succ>
    bacterial outside --- Certainty = 0.0000 (Not Clear) <succ>
    bacterial cytoplasm --- Certainty = 0.0000 (Not Clear) <succ>
```

A related GBS nucleic acid sequence <SEQ ID 9325> which encodes amino acid sequence <SEQ ID 9326> was also identified.

The protein has homology with the following sequences in the GENPEPT database:

```
>GP: AAC65034 GB: AE001189 regulatory protein (pfoS/R) [Treponema
pallidum]
Identities = 33/91 (36%), Positives = 55/91 (60%), Gaps = 1/91 (1%)
Query:    1 MANVLAKPKIMLPMISSAAILGILGALFNIQGTPASAGFGISGLIGPINALNLAKGGWSV      60
              M N + P + +P++ +  + G+L  LFN+QGTPASAGFG  GL+GPINA L       V Sbjct:  250 MPNWIRYPILNIPLLLNGLVCGVLAWLENLQGTPASAGFGFIGLVGPINAYRLMAYTPMV     309

Query:   61 MNMLLIIIIFVAAPIILNFIFNYLFIKVLKI                                  91
              +L ++ FV +  +  ++ +++ +  LK+

Sbjct:  310 RAGILFLVYFVLS-FLAAYLIDFILVDRLKL                                 339
```

A related DNA sequence was identified in *S. pyogenes* <SEQ ID 1275> which encodes the amino acid sequence <SEQ ID 1276>. Analysis of this protein sequence reveals the following:

Possible site: 51
>>> Seems to have a cleavable N-term signal seq.
INTEGRAL    Likelihood = −12.31    Transmembrane 141-157 (133-166)
INTEGRAL    Likelihood = −6.00     Transmembrane 92-108 (88-112)
----- Final Results -----
   bacterial membrane --- Certainty = 0.5925 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the databases:

<SEQ ID 1278>. This protein is predicted to be regulatory protein (pfoS/R). Analysis of this protein sequence reveals the following:

Possible site: 48
>>> Seems to have no N-terminal signal sequence
INTEGRAL    Likelihood = −6.58    Transmembrane 148-164 (145-169)
INTEGRAL    Likelihood = −5.26    Transmembrane 33-49 (25-52)
INTEGRAL    Likelihood = −4.73    Transmembrane 70-86 (62-88)
INTEGRAL    Likelihood = −3.45    Transmembrane 124-140 (122-143)
INTEGRAL    Likelihood = −1.33    Transmembrane 96-112 (96-112)
----- Final Results -----
   bacterial membrane --- Certainty = 0.3633 (Affirmative) <succ>
      bacterial outside --- Certainty = 0.0000 (Not Clear) <succ>
         bacterial cytoplasm --- Certainty = 0.0000 (Not Clear) <succ>

```
>GP: AAC65034 GB: AE001189 regulatory protein (pfoS/R) [Treponema
pallidum]
Identities = 63/178 (35%), Positives = 107/178 (59%), Gaps = 10/178 (5%)
Query:    2 IGQGIASLLGLQPILMSLLIAMIFCFLIVSPITTVGIAIAINLSGIGSGAASFG------     55
              +G+ IA+ + LQP+LMS+L++M F   +I+SP+++V + +A+ L+G+  SGAA+ G Sbjct:  164 VGRVIATFIALQPLLMSILLSMSFSLIIISPVSSVAVGIAVGLTGLASGAANIGVSSCAM    223

Query:   56 -LCLAGWAVNSKGTSLAHVLRSPKISMANVLSKPKIMLPMLCSAAVLGVIGAIFNIQGTP    114
               L +      VN  G  LA    + K+ M N +  P + +P+L +   V GV+   +FN+QGTP Sbjct:  224 TLIVGIMRVNKIGVPLAMFAGAMKMLMPNWIRYPILNIPLLLNGLVCGVLAWLFNLQGTP    283

Query:  115 ASAGFGISGLIGPINALNIARGGWCP-VNILLIIIIFVGAPIVLNMIFNYLFIKVLKV      171
              ASAGFG  GL+GPINA  L  + P V  ++ +++      +  + +++ +  LK+

Sbjct:  284 ASAGFGFIGLVGPINAYRLM--AYTPMVRAGILFLVYFVLSFLAAYLIDFILVDRLKL     339
```
45

An alignment of the GAS and GBS proteins is shown below:

```
Identities = 86/101 (85%), Positives = 96/101 (94%)
Query:    1 MANVLAKPKIMLPMISSAAILGILGALFNIQGTPASAGFGISGLIGPINALNLAKGGWSV     60
              MANVL+KPKIMLPM+ SAA+LG++GA+FNIQGTPASAGFGISGLIGPINALNLAKGGW Sbjct:   81 MANVLSKPKIMLPMLCSAAVLGVIGAIFNIQGTPASAGFGISGLIGPINALNLAKGGWCP    140

Query:   61 MNMLLIIIIFVAAPIILNFIFNYLFIKVLKIIDPMDYKLDI                      101
              +N+LLIIIIFV API+LN IFNYLFIKVLK+IDPMDYKLDI Sbjct:  141 VNILLIIIIFVGAPIVLNMIFNYLFIKVLKVIDPMDYKLDI                      181
```

Based on this analysis, it was predicted that these proteins and their epitopes could be useful antigens for vaccines or diagnostics.

Example 393

A DNA sequence (GBSx0426) was identified in *S. agalactiae* <SEQ ID 1277> which encodes the amino acid sequence A related GBS nucleic acid sequence <SEQ ID 9735> which encodes amino acid sequence <SEQ ID 9736> was also identified.

A related GBS nucleic acid sequence <SEQ ID 9697> which encodes amino acid sequence <SEQ ID 9698> was also identified.

The protein has homology with the following sequences in the GENPEPT database:

```
>GP: AAC65034 GB: AE001189 regulatory protein (pfoS/R) [Treponema
pallidum]
Identities = 61/158 (38%), Positives = 92/158 (57%)
Query:   24 KSFIMNVLNGLALGTVIVLIPGAILGELMKALLPMWSGFATLIAATAVATSMMGLVIGIM      83
            + F+M +LNG + G VI L+P AI GEL +AL P+   FA L           +  +IG +

Sbjct:    9 RQFMMKILNGSSAGIVIGLVPPAIAGELFRALAPLSPLFAALYHVVLPIQFSVPALIGTL      68

Query:   84 VGLNFKFNPIQSASLGLAVMFAGGAATFLKGAIMLKGIGDIINMGITAALGVLLIQFLSD     143
            VGL F +  + A+L    + A G  T    GA ++ G GD+IN+ + +AL ++L++   L Sbjct:   69 VGLQFHCSAPEVATLAFVSVIASGNVTLQNGAWLITGIGDVINVMLISALAIILVRALRG     128

Query:  144 KTKSFTLIVIPTVTLLLVGGVGHVLLPYVKMITTMIGQ                          181
            K   S T+I +P +  ++ GGVG    LPYVKMIT  +G+

Sbjct:  129 KLGSLTIIALPVIVAVVAGGVGSFSLPYVKMITLFVGR                          166
```

A related DNA sequence was identified in *S. pyogenes* <SEQ ID 1279> which encodes the amino acid sequence <SEQ ID 1280>. Analysis of this protein sequence reveals the following:

```
Possible site: 48
>>> Seems to have no N-terminal signal sequence
INTEGRAL     Likelihood = –13.06   Transmembrane 314-330 (301-335)
INTEGRAL     Likelihood = –11.30   Transmembrane 185-201 (178-215)
INTEGRAL     Likelihood = –8.01    Transmembrane 22-38 (11-42)
INTEGRAL     Likelihood = –3.29    Transmembrane 266-282 (265-285)
INTEGRAL     Likelihood = –2.66    Transmembrane 141-157 (141-159)
INTEGRAL     Likelihood = –2.13    Transmembrane 53-69 (53-69)
INTEGRAL     Likelihood = –1.33    Transmembrane 114-130 (113-131)
INTEGRAL     Likelihood = –0.80    Transmembrane 206-222 (206-222)
----- Final Results -----
    bacterial membrane --- Certainty = 0.6222 (Affirmative) <succ>
      bacterial outside --- Certainty = 0.0000 (Not Clear) <succ>
     bacterial cytoplasm --- Certainty = 0.0000 (Not Clear) <succ>
```

The protein has homology with the following sequences in the databases:

```
>GP: AAC65034 GB: AE001189 regulatory protein (pfoS/R) [Treponema
pallidum]
Identities = 137/346 (39%), Positives = 217/346 (62%), Gaps = 14/346 (4%)
Query:   12 FMNKVLAGTAIAIVVALIPNAILATFLKPLLP-NMAAAEFLHIVQVFQFFTPIMAGFLIG      70
            FM K+L G++   IV+ L+P AI   + L P +  A    H+V  QF  P + G L+G Sbjct:   11 FMMKILNGSSAGIVIGLVPPAIAGELFRALAPLSPLFAALYHVVLPIQFSVPALIGTLVG      70

Query:   71 QQFKFNPMQQLAVGGAAYIGSGAWAYTEVIQKGVATGTFQLRGIGDLINMMITASLAVLA     130
            Q F  +   +      + I SG           +  G + + GIGD+IN+M+ ++LA++

Sbjct:   71 LQFHCSAPEVATLAFVSVIASG--------NVTLQNGAWLITGIGDVINVMLISALAIIL     122

Query:  131 VKYFGNKFGSLTIILLPITIGTGVGYIGWKFLPYVSYVTTLIGQGINSFTTLQPILMSIL     190
            V+     K GSLTII LP+ +G +G       LPYV  +T  +G+ I +F  LQP+LMSIL Sbjct:  123 VRALRGKLGSLTIIALPVIVAVVAGGVGSFSLPYVKMITLFVGRVIATFIALQPLLMSIL     182

Query:  191 IAVAFSLIIVSPISTVAIGLAIGLNGMAAGAASMGIASTAAVLVWATLKVNKSGVPIAIA     250
            ++++ FSLII+ SP+S+VA+G A+GL  G+A+GAA++G++S A   L+   T++VNK GVP+A+

Sbjct:  183 LSMSFSLIIISPVSSVAVGIAVGLTGLASGAANIGVSSCAMTLIVGTMRVNKIGVPLAMF     242

Query:  251 LGAMKMMMPNFLKHPIMAIPMVFTAAISSLTVPLFNLVGTPASSGFGLVGAVGPIAS--L     308
            GAMKM+MPN++++PI+ IP++   +     LFNL GTPAS+GFG +G VGPI  +   L Sbjct:  243 AGAMKMLMPNWIRYPILNIPLLLNGLVCGVLAWLFNLQGTPASAGFGFIGLVGPINAYRL     302

Query:  309 AGGSSIL---IIILAWIIVPFAVAFAAHKVSKDILKLYKEDIFVFE                  351
              + ++    I+  L + ++ F A+       +  D LKLY+ ++F+ E Sbjct:  303 MAYTPMVRAGILFLVYFVLSFLAAYLIDFILVDRLKLYRRELFIPE                  348
```

An alignment of the GAS and GBS proteins is shown below:

```
Identities = 65/172 (37%), Positives = 95/172 (54%), Gaps = 9/172 (5%)
Query:  19 EKQTTKSFIMNVLNGLALGTVIVLIPGAILGELMKALLPMWSGFATLIAATAVATSMMGL      78
           +K+T  SF+  VL G A+ V+ LIP AIL  +K LLP +  A +    V        +

Sbjct:   5 DKETFSSFMNKVLAGTAIAIVVALIPNAILATFLKPLLPNMAA-AEFLHIVQVFQFFTPI     63

Query:  79 VIGIMVGLNFKFNPIQSASLGLAVMFAGGAATFLK--------GAIMLKGTGDIINMGIT    130
           + G ++G  FKFNP+Q  ++G A       GA + +         G    L+G GD+INM IT Sbjct:  64 MAGFLIGQQFKFNPMQQLAVGGAAYIGSGAWAYTEVIQKGVATGTFQLRGIGDLINMMIT    123

Query: 131 AALGVLLIQFLSDKTKSFTLIVIPTVTLLLVGGVGHVLLPYVKMITTMIGQG             182
           A+L VL +++  +K  S T+I++P      VG +G    LPYV  +TT+IGQG Sbjct: 124 ASLAVLAVKYFGNKFGSLTIILLPITIGTGVGYIGWKFLPYVSYVTTLIGQG             175
```

A related GBS gene <SEQ ID 8567> and protein <SEQ ID 8568> were also identified. Analysis of this protein sequence reveals the following:

Lipop: Possible site: –1    Crend: 10
McG: Discrim Score: –13.49
GvH: Signal Score (–7.5): –5.82
Possible site: 48
>>> Seems to have no N-terminal signal sequence
ALOM program count: 5 value: –6.58 threshold: 0.0
INTEGRAL     Likelihood = –6.58    Transmembrane 148-164 (145-169)
INTEGRAL     Likelihood = –5.26    Transmembrane 33-49 (25-52)
INTEGRAL     Likelihood = –4.73    Transmembrane 70-86 (62-88)
INTEGRAL     Likelihood = –3.45    Transmembrane 124-140 (122-143)
INTEGRAL     Likelihood = –1.33    Transmembrane 96-112 ( 96-112)
PERIPHERAL   Likelihood = 1.85     51
modified ALOM score: 1.82
*** Reasoning Step: 3
----- Final Results -----
    bacterial membrane --- Certainty = 0.3633 (Affirmative) <succ>
      bacterial outside --- Certainty = 0.0000 (Not Clear) <succ>
        bacterial cytoplasm --- Certainty = 0.0000 (Not Clear) <succ>

The protein has homology with the following sequences in the databases:

Based on this analysis, it was predicted that these proteins and their epitopes could be useful antigens for vaccines or diagnostics.

Example 394

A DNA sequence (GBSx0428) was identified in *S. agalactiae* <SEQ ID 1281> which encodes the amino acid sequence <SEQ ID 1282>. This protein is predicted to be cyn operon transcriptional activator. Analysis of this protein sequence reveals the following:

Possible site: 15
>>> Seems to have no N-terminal signal sequence
----- Final Results -----
    bacterial membrane --- Certainty = 0.0000 (Not Clear) <succ>
      bacterial outside --- Certainty = 0.0000 (Not Clear) <succ>
        bacterial cytoplasm --- Certainty = 0.0000 (Not Clear) <succ>

The protein has homology with the following sequences in the GENPEPT database:

```
ORF01226(352-843 of 1218)
EGAD|1138195|TP0038(3-166 of 350) regulatory protein {Treponema pallidum}
OMNI|TP0038 regulatory protein (pfoS/R) GP|3322295|gb|AAC65034.1||AE001189
regulatory protein (pfoS/R) {Treponema pallidum}
PIR|E71373|E71373 probable regulatory protein (pfoS/R)-syphilis spirochete
% Match = 13.6
% Identity = 37.2 % Similarity = 59.1
Matches = 61 Mismatches = 67 Conservative Sub.s = 36

273       303       333       363       393       423       453       483
I*FFPIFLLQIAMI*LI*LVKSQTIIISRRHLMSDVVEKQTTKSFIMNVLNGLALGTVIVLIPGAILGELMKALLPMWSG
                                    :   :  :|:  :|||  :  |  || |:| ||  ||| :|| |:
                                    MHTQSLSPRQFMMKILNGSSAGIVIGLVPPAIAGELFRALAPLSPL
                                    10        20        30        40

513       543       573       603       633       663       693       723
FATLIAATAVATSMMGLVIGIMVGLNFKFNPIQSASLGLAVMFAGGAATFLKGAIMLKGTGDIINMGITAALGVLLIQFL
|| |        : :|| :||| :  :  |:|  :  |   |  ||  |:  || ||:: :|| :  ::|::  |
FAALYHVVLPIQFSVPALIGTLVGLQFHCSAPEVATLAFVSVIASGNVTLQNGAWLITGIGDVINVMLISALAIILVRAL
         60        70        80        90        100       110       120

753       783       813       843       873       903       933       963
SDKTKSFTLIVIPTVTLLLVGGVGHVLLPYVKMITTMIGQGTRRTHENFLFILLCPDINFEKIPF*INDLLSLFLQIIGL
   |  :|:| :|  :   :: ||||   ||||||||  :|:
RGKLGSLTIIALPVIVAVVAGGVGSFSLPYVKMITLFVGRVIATFIALQPLLMSILLSMSFSLIIISPVSSVAVGIAVGL
         140       150       160       170       180       190       200
```

```
>GP: CAB15857 GB: Z99123 alternate gene name: ipa-24d-similar to
transcriptional regulator (LysR family) [Bacillus subtilis]
Identities = 87/282 (30%), Positives = 152/282 (53%), Gaps = 5/282 (1%)
Query:   1 MDIRQLTYFIAVAEAKNYSRAAKSLFVTQPTLSQSIKKLEAELNTILFLQNGRQLALTEA         60
           MDIR LTYF+ VA  K++++A++SL+V+QPT+S+ IK LE EL   LF +NGRQ+ LT+A
Sbjct:   1 MDIRHLTYFLEVARLKSFTKASQSLYVSQPTISKMIKNLEEELGIELFYRNGRQVELTDA         60

Query:  61 GEILYEKGQLLMTNVNQMVTEIQQLNQEKKEGIRVGLTSLFAIQFMKQI-STFMATHSNV        119
           G  +Y + Q ++ +    + +E+  + + KK  +R+GL  +     F  ++    F   + NV
Sbjct:  61 GHSMYVQAQEIIKSFQNLTSELNDIMEVKKGHVRIGLPPMIGSGFFPRVLGDFRENYPNV        120

Query: 120 EVSLIQDGSRKLQELLAKGKIDIGLLSFPSTRNDITIEPLQTSTKGYKVSIVMPKSHPLA        179
             L++DGS K+QE +  G +DIG++  P+  +          T     + +V+  SH LA
Sbjct: 121 TFQLVEDGSIKVQEGVGDGSLDIGVVVLPANEDIFHSFTIVKET----LMLVVHPSHRLA        176

Query: 180 TLPEIELNDLRDYKVASLNEHENLGEMLPRKCRALGFDPHIVFKHNDWEVLIHSLQDLNA        239
             E +L +L+D      E ++L  +  +C   GF PHI+++ + W+ +   +
Sbjct: 177 DEKECQLRELKDEPFIFFREDFVLHNRIMTECIKAGFRPHIIYETSQWDFISEMVSANLG        236

Query: 240 VTILPSEFESISQVQDLCWVPLKDKNNFYPIGIAYRNDTSFS                      281
           + +LP        + +  +PL D     + + I +R D    S
Sbjct: 237 IGLLPERICRGLDPEKVKVIPLVDPVIPWHLAIIWRKDRYLS                      278
```

A related DNA sequence was identified in *S. pyogenes* <SEQ ID 1283> which encodes the amino acid sequence <SEQ ID 1284>. Analysis of this protein sequence reveals the following:

Possible site: 21
>>> Seems to have no N-terminal signal sequence
----- Final Results -----
  bacterial cytoplasm --- Certainty = 0.1101 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below:

```
Identities = 125/160 (78%), Positives = 144/160 (89%)
Query: 135 LAKGKIDIGLLSFPSTRNDITIEPLQTSTKGYKVSIVMPKSHPLATLPEIELNDLRDYKV        194
           L++GKIDIGLLSF S R DITIE LQTSTKGYKVSIV+ K HPLA  P+++L DL+ YK+
Sbjct:   1 LSQGKIDIGLLSFLSIRKDITIELLQTSTKGYKVSIVLLKQHPLAQHPQLKLKDLKGYKI         60

Query: 195 ASLNEHYMLGEMLPRKCRALGFDPHIVFKENDWEVLIHSLQDLNAVTILPSEFESISQVQ        254
           ASLN+HYMLGEMLPRKCRALGF+P IVFKHNDWEVLIHSL DLN +TILPS+FES++QV
Sbjct:  61 ASLNDHYMLGEMLPRKCRALGFEPDIVFKHNDWEVLIHSLHDLNTLTILPSDFESLNQVD        120

Query: 255 DLCWVPLKDKNNFYPIGIAYRNDTSFSPMIEEFLSLLKTN                        294
           +L W+PL+DKNNFYPIGIAYR+D SFSP+IEEFLSLLKTN
Sbjct: 121 NLVWIPLQDKNNFYPIGIAYRDDASFSPVIEEFLSLLKTN                        160
```

Based on this analysis, it was predicted that these proteins and their epitopes could be useful antigens for vaccines or diagnostics.

Example 395

A DNA sequence (GBSx0429) was identified in *S. agalactiae* <SEQ ID 1285> which encodes the amino acid sequence <SEQ ID 1286>. Analysis of this protein sequence reveals the following:

Possible site: 47
>>> Seems to have no N-terminal signal sequence
----- Final Results -----
  bacterial cytoplasm --- Certainty = 0.1833 (Affirmative) <succ>
    bacterial membrane --- Certainty = 0.0000 (Not Clear) <succ>
      bacterial outside --- Certainty = 0.0000 (Not Clear) <succ>

Signal peptide: 1-21

A related GBS nucleic acid sequence <SEQ ID 8569> which encodes amino acid sequence <SEQ ID 8570> was also identified.

The protein has no significant homology with any sequences in the GENPEPT database.

No corresponding DNA sequence was identified in *S. pyogenes*.

SEQ ID 8570 (GBS271) was expressed in *E. coli* as a His-fusion product. SDS-PAGE analysis of total cell extract is shown in FIG. 51 (lane 8; MW 31.3 kDa). It was also expressed in *E. coli* as a GST-fusion product. SDS-PAGE analysis of total cell extract is shown in FIG. 55 (lane 6; MW 56.3 kDa) and in FIG. 62 (lane 10; MW 56.3 kDa).

GBS271-GST was purified as shown in FIG. 210, lane 8.

Based on this analysis, it was predicted that these proteins and their epitopes could be useful antigens for vaccines or diagnostics.

Example 396

A DNA sequence (GBSx0430) was identified in *S. agalactiae* <SEQ ID 1287> which encodes the amino acid sequence <SEQ ID 1288>. Analysis of this protein sequence reveals the following:

```
Possible site: 22
>>> Seems to have an uncleavable N-term signal seq
INTEGRAL    Likelihood = -6.74    Transmembrane 9-25 (5-28)
INTEGRAL    Likelihood = -5.84    Transmembrane 97-113 (92-122)
INTEGRAL    Likelihood = -5.47    Transmembrane 37-53 (35-61)
INTEGRAL    Likelihood = -2.55    Transmembrane 220-236 (220-238)
INTEGRAL    Likelihood = -1.65    Transmembrane 64-80 (63-81)
INTEGRAL    Likelihood = -1.28    Transmembrane 193-209 (192-209)
INTEGRAL    Likelihood = -0.53    Transmembrane 125-141 (125-141)
----- Final Results -----
    bacterial membrane --- Certainty = 0.3697 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database:

```
>GP: AAC73593 GB: AE000155 putative metal resistance protein
[Escherichia coli K12]
Identities = 128/252 (50%), Positives = 186/252 (73%)
Query:    5 NSISLMSLLMASSLVLITLFFSYWQKLNLEKEVIISAIRAVIQLLAVGFLLDYIFGYQNP      64
            ++I+  SL +A  LV++ +   S+ +KL LEK+++ S  RA+IQL+ VG++L YIF    +
Sbjct:   13 HNITNESLALALMLVVVAILISHKEKLALEKDILWSVGRAIIQLIIVGYVLKYIFSVDDA      72

Query:   65 IFTALLMLFMIINASYNAAKRGKGINKGFVISFIAIGSGTIITLSVLIFSGILKFVPNQM     124
            T L++LF+   NA++NA KR K I K F+ SFIAI  G  ITL+VLI SG ++F+P Q+
Sbjct:   73 SLTLLMVLFICFNAAWNAQKRSKYIAKAFISSFIAITVGAGITLAVLILSGSIEFIPMQV     132

Query:  125 IPVGGMIISNSMVAIGLCYKQLLSEFRSKQEEVETKLALGADILPASIDIIRDVIKTGMV     184
            IP+ GMI  N+MVA+GLCY  L     S+Q++++ KL+LGA   AS  +IRD I+  ++
Sbjct:  133 IPIAGMIAGNAMVAVGLCYNNLGQRVISEQQQIQEKLSLGATPKQASAILIRDSIRAALI     192

Query:  185 PTIDSAKTLGIVSLPGMMTGLILAGTSPIQAVKYQMMVTFMLLATTSIASFVATYLAYKI     244
            PT+DSAKT+G+VSLPGMM+GLI AG  P++A+KYQ+MVTFMLL+T S+++ +A YL Y+
Sbjct:  193 PTVDSAKTVGLVSLPGMMSGLIFAGIDPVKAIKYQIMVTFMLLSTASLSTIIACYLTYRK     252

Query:  245 FFNNRKQLVVTK                                                 256
            F+N+R QLVVT+
Sbjct:  253 FYNSRHQLVVTQ                                                 264
```

No corresponding DNA sequence was identified in *S. pyogenes*.

Based on this analysis, it was predicted that this protein and its epitopes, could be useful antigens for vaccines or diagnostics.

Example 397

A DNA sequence (GBSx0431) was identified in *S. agalactiae* <SEQ ID 1289> which encodes the amino acid sequence <SEQ ID 1290>. This protein is predicted to be SUGAR TRANSPORT ATP-BINDING PROTEIN. (b0490). Analysis of this protein sequence reveals the following:

```
Possible site: 56
>>> Seems to have no N-terminal signal sequence
----- Final Results -----
    bacterial cytoplasm --- Certainty = 0.1903 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database:

```
>GP: AAC73592 GB: AE000155 putative ATP-binding component of a
transport system [Escherichia coli K12]
Identities = 95/202 (47%), Positives = 142/202 (70%), Gaps = 2/202 (0%)
Query:    4 LTFKHVDFKTDDKLVLNDINFAIDEGDFVSIVGPSGSGKSTVLKLASGLMSPTAGHIFFD      63
            L  ++V +   D  +LN+INF++  G+F  I GPSG GKST+LK+ + L+SPT+G + F+
Sbjct:    8 LQLQNVGYLAGDAKILNNINFSLRAGEFKLITGPSGCGKSTLLKIVASLISPTSGTLLFE      67

Query:   64 GKDLNQLEPIESRKMISYCFQTPHLFGNTVEDNISFPYHIRHEKVDYRRVDDLFQRFEMD     123
            G+D++  L+P    R+ +SYC QTP LFG+TV DN+ FP+  IR+ + D       +RF +
Sbjct:   68 GEDVSTLKPEIYRQQVSYCAQTPTLFGDTVYDNLIFPWQIRNRQPDPAIFLDFLERFALP     127

Query:  124 QSYLKQDVKKLSGGEKQRIALIRQLLFEPKVLLLDEVTSALDNHNKAIVEKVI-KSLHDK     182
              S L +++ +LSGGEKQRI+LIR L F PKVLLLDE+TSALD  NK  V ++ + ++
Sbjct:  128 DSILTKNIAELSGGEKQRISLIRNLQFMPKVLLLDEITSALDESNKHNVNEMIHRYVREQ     187
```

```
Query: 183 GITILWITHDEEQSRRFANKVL                            204
           I +LW+THD+++    A+KV+

Sbjct: 188 NIAVLWVTHDKDEINH-ADKVI                            208
```

A related DNA sequence was identified in *S. pyogenes* <SEQ ID 1291> which encodes the amino acid sequence <SEQ ID 1292>. Analysis of this protein sequence reveals the following:

```
Possible site: 61
>>> Seems to have no N-terminal signal sequence
----- Final Results -----
   bacterial cytoplasm --- Certainty = 0.2053 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below:

```
Identities = 73/214 (34%), Positives = 133/214 (62%), Gaps = 9/214 (4%)
Query:    4 LTFKHVD--FKTDDKLVLNDINFAIDEGDFVSIVGPSGSGKSTVLKLASGLMSPTAGHIF    61
            +TF +V    F+     VL +INF ++EG F +++G SGSGKST+L + +GL+  ++G I+

Sbjct:    6 ITFNNVSKTFEDSGTQVLKNINFDLEEGKFYTLLGASGSGKSTILNIMAGLLDASSGDIY    65

Query:   62 FDGRDLNQLEPIESRKMISYCFQTPHLFGN-TVEDNISFPYHIR--HEKVDYRRVDDLFQ   118
            DG+ +N L PI  R  I   FQ   LF + TV +N++F    ++   +K    +RV +  +

Sbjct:   66 LDGERINDL-PINKRD-IHTVFQNYALFPHMTVFENVAFALKLKKVDKKEIAKRVKETLK   123

Query:  119 RFEMDQSYLKQDVKKLSGGEKQRIALIRQLLFEPKVLLLDEVTSALDNHNKAIVEKVIKS   178
            ++ + +  + ++KLSGG++QR+A+ R ++ +P+V+LLDE  SALD    + ++ ++

Sbjct:  124 MVQL-EGFENRSIQKLSGGQRQRVAIARAIINQPRVVLLDEPLSALDLKLRTEMQYELRE   182

Query:  179 LHDK-GITILWITHDEEQSRRFANKVLKVVNGSI                           211
            L  + GIT +++THD+E++    ++ +   G I Sbjct:  183 LQQRLGITFVFVTHDQEEALAMSDWIFVMNEGEI                           216
```

Based on this analysis, it was predicted that these proteins and their epitopes could be useful antigens for vaccines or diagnostics.

Example 398

A DNA sequence (GBSx0432) was identified in *S. agalactiae* <SEQ ID 1293> which encodes the amino acid sequence <SEQ ID 1294>. Analysis of this protein sequence reveals the following:

```
Possible site: 32
>>> Seems to have no N-terminal signal sequence
----- Final Results -----
   bacterial cytoplasm --- Certainty = 0.0658 (Affirmative) <succ>
   bacterial membrane --- Certainty = 0.0000 (Not Clear) <succ>
   bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 399

A DNA sequence (GBSx0434) was identified in *S. agalactiae* <SEQ ID 1295> which encodes the amino acid sequence <SEQ ID 1296>. This protein is predicted to be deda protein (dedA). Analysis of this protein sequence reveals the following:

```
Possible site 58
>>> Seems to have no N-terminal signal sequence
INTEGRAL    Likelihood = -12.05   Transmembrane 186-202 (178-208)
INTEGRAL    Likelihood = -8.81    Transmembrane 65-81 (61-89)
INTEGRAL    Likelihood = -7.54    Transmembrane 26-42 (24-47)
INTEGRAL    Likelihood = -0.37    Transmembrane 152-168 (152-168)
----- Final Results -----
   bacterial membrane --- Certainty = 0.5819 (Affirmative) <succ>
   bacterial outside --- Certainty = 0.0000 (Not Clear) <succ>
   bacterial cytoplasm --- Certainty = 0.0000 (Not Clear) <succ>
```

The protein has homology with the following sequences in the GENPEPT database:

```
>GP: AAC75377 GB: AE000320 orf, hypothetical protein [Escherichia coli K12]
   Identities = 91/211 (43%), Positives = 131/211 (61%), Gaps = 7/211 (3%)
   Query:    2 FLIDFILHIDTHIYAMANTVGNWTYLLLFLVIFVETGAVIFPFLPGDSLLFAAGALAANP    61
              FLIDFILHID H+ +    G W Y +LFL++F ETG V+ PFLPGDSLLF AGALA+
```

```
-continued
Sbjct:   6 FLIDFILHIDVHLAELVAEYGVWVYAILFLILFCETGLVVTPFLPGDSLLFVAGALASLE      65

Query:  62 KMSFNIVTFLIIFFIAAFIGDSCNFLIGRTFGYRFIKHP---FFRRFIKEKNIRDAELYF     118
            N+   +++  IAA +GD+ N+ IGR FG +    +P     FRR  +K          ++

Sbjct:  66 TNDLNVHMMVVLMLIAAIVGDAVNYTIGRLFGEKLFSNPNSKIFRRSYLDK----THQFY     121

Query: 119 EKKGTAAIILGRYIPIIRTFVPFVAGISQLPPKVFIKRAFIAALSWSVIATGSGFLFGNI     178
            EK G    IIL R++PI+RTF PFVAG+  + + F    I AL W ++ T +G+ FG I Sbjct: 122 EKHGGKTIILARFVPIVRTFAPFVAGMGHMSYRHFAAYNVIGALLWVLLFTYAGYFFGTI     181

Query: 179 PFVKQHFSLIILGIVFVTLIPVLISGVKSYR                                 209
            P V+ +  L+I+GI+ V+++P +I  ++  R Sbjct: 182 PMVQDNLKLLIVGIIVVSILPGVIEIIRHKR                                 212
```

No corresponding DNA sequence was identified in *S. pyogenes*.

Based on this analysis, it was predicted that this protein and its epitopes, could be useful antigens for vaccines or diagnostics.

Example 400

A DNA sequence (GBSx0435) was identified in *S. agalactiae* <SEQ ID 1297> which encodes the amino acid sequence <SEQ ID 1298>. Analysis of this protein sequence reveals the following:

Possible site: 18
>>> Seems to have no N-terminal signal sequence
----- Final Results -----
   bacterial cytoplasm --- Certainty = 0.3100 (Affirmative) <succ>
     bacterial membrane --- Certainty = 0.0000 (Not Clear) <succ>
       bacterial outside --- Certainty = 0.0000 (Not Clear) <succ> nuclease. Analysis of this protein sequence reveals the following:

Possible site: 51
>>> Seems to have no N-terminal signal sequence
----- Final Results -----
   bacterial cytoplasm --- Certainty = 0.3990 (Affirmative) <succ>
     bacterial membrane --- Certainty = 0.0000 (Not Clear) <succ>
       bacterial outside --- Certainty = 0.0000 (Not Clear) <succ>

A related GBS nucleic acid sequence <SEQ ID 9323> which encodes amino acid sequence <SEQ ID 9324> was also identified.

The protein has homology with the following sequences in the GENPEPT database:

```
>GP: CAA38134 GB: X54225 membrane nuclease [Streptococcus pneumoniae]
Identities = 87/157 (55%), Positives = 110/157 (69%), Gaps = 1/157 (0%)
Query:   1 MLDRTIRQYQNRRDTTLPDANWKPLGWHQVAT-NDHYGHAVDKGHLIAYALAGNFKGWDA      59
           +L +   RQY+NR++T    +W P GWHQV         Y HAVD+GHL+ YAL G   G+DA Sbjct: 116 LLSKATRQYKNRKETGNGSTSWTPPGWHQVKNLKGSYTHAVDRGHLLGYALIGGLDGFDA     175

Query:  60 SVSNPQNVVTQTAHSNQSNQKINRGQNYYESLVRKAVDQNKRVRYRVTPLYRNDTDLVPF     119
           S SNP+N+  QTA +NQ+  + + GQNYYES VRKA+DQNKRVRYRVT  Y ++ DLVP Sbjct: 176 STSNPKNIAVQTAWANQAQAEYSTGQNYYESKVRKALDQNKRVRYRVTLYYASNEDLVPS     235

Query: 120 AMHLEAKSQDGTLEFNVAIPNTQASYTMDYATGEITL                          156
           A  +EAKS DG LEFNV +PN Q    +DY TGE+T+

Sbjct: 236 ASQIEAKSSDGELEFNVLVPNVQKGLQLDYRTGEVTV                          272
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 401

A DNA sequence (GBSx0436) was identified in *S. agalactiae* <SEQ ID 1299> which encodes the amino acid sequence <SEQ ID 1300>. This protein is predicted to be DNA-entry A related DNA sequence was identified in *S. pyogenes* <SEQ ID 1301> which encodes the amino acid sequence <SEQ ID 1302>. Analysis of this protein sequence reveals the following:

Possible site: 42
>>> Seems to have a cleavable N-term signal seq.
----- Final Results -----
   bacterial outside --- Certainty = 0.3000 (Affirmative) <succ>
     bacterial membrane --- Certainty = 0.0000 (Not Clear) <succ>
       bacterial cytoplasm --- Certainty = 0.0000 (Not Clear) <succ>

The protein has homology with the following sequences in the databases:

```
>GP: CAA38134 GB: X54225 membrane nuclease [Streptococcus pneumoniae]
Identities = 89/135 (65%), Positives = 104/135 (76%), Gaps = 1/135 (0%)
Query:  25 SPAGWHRLHHLKGSYDHAVDRGHLLGYALVGGLKGFDASTGNPDNIATQLSWANQANKPY          84
           +P GWH++ +LKGSY HAVDRGHLLGYAL+GGL GFDAST NP NIA Q +WANQA    Y
Sbjct: 138 TPPGWHQVKNLKGSYTHAVDRGHLLGYALIGGLDGFDASTSNPKNIAVQTAWANQAQAEY        197

Query:  85 LTGQNYYEGLVRRALDKGHRVRYRVTLLY-DGDNLLASGSHLEAKSSDDSLTFNVFVPNV       143
           TGQNYYE  VR+ALD+  RVRYRVTL Y   ++L+ S S +EAKSSD  L FNV VPNV
Sbjct: 198 STGQNYYESKVRKALDQNKRVRYRVTLYYASNEDLVPSASQIEAKSSDGELEFNVLVPNV       257

Query: 144 QAGLTADYRTGQIAI                                                   158
           Q GL  DYRTG++ +
Sbjct: 258 QKGLQLDYRTGEVTV                                                   272
```

An alignment of the GAS and GBS proteins is shown below:

```
Identities = 73/135 (54%), Positives = 92/135 (68%), Gaps = 2/135 (1%)
Query:  24 PLGWHQVA-TNDHYGHAVDKGHLIKYALAGNFKGWDASVSNPQNVVTQTAHSNQSNQKIN        82
           P GWH++       Y HAVD+GHL+ YAL G  KG+DAS  NP N+ TQ +  +NQ+N+
Sbjct:  26 PAGWHRLHHLKGSYDHAVDRGHLLGYALVGGLKGFDASTGNPDNIATQLSWANQANKPYL        85

Query:  83 RGQNYYESLVRKAVDQNKRVRYRVTPLYRNDTDLVPFAMHLEAKSQDGTLEFNVAIPNTQ       142
           GQNYYE LVR+A+D+  RVRYRVT LY  D +L+     HLEAKS D +L FNV +PN Q
Sbjct:  86 TGQNYYEGLVRRALDKGHRVRYRVTLLYDGD-NLLASGSHLEAKSSDDSLTFNVFVPNVQ       144

Query: 143 ASYTMDYATGEITLN                                                   157
           A  T DY TG+I +N
Sbjct: 145 AGLTADYRTGQIAIN                                                   159
```

Figure 186:
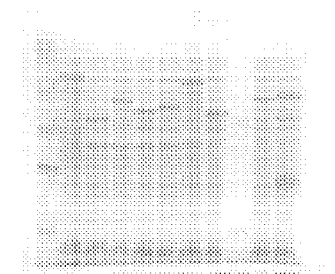

SEQ ID 9324 (GBS656) was expressed in *E. coli* as a GST-fusion product. SDS-PAGE analysis of total cell extract is shown in FIG. 186 (lane 10; MW 57 kDa).

Figure 236:
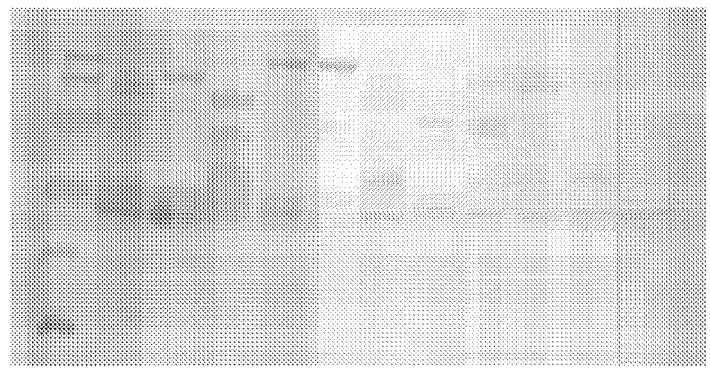

GBS656-GST was purified as shown in FIG. 236, lane 4.

Based on this analysis, it was predicted that these proteins and their epitopes could be useful antigens for vaccines or diagnostics.

Example 402

A DNA sequence (GBSx0437) was identified in *S. agalactiae* <SEQ ID 1303> which encodes the amino acid sequence <SEQ ID 1304>. Analysis of this protein sequence reveals the following:

Possible site: 13
>>> Seems to have a cleavable N-term signal seq.
----- Final Results -----
    bacterial outside --- Certainty = 0.3000 (Affirmative) <succ>
      bacterial membrane --- Certainty = 0.0000 (Not Clear) <succ>
      bacterial cytoplasm --- Certainty = 0.0000 (Not Clear) <succ>

A related GBS nucleic acid sequence <SEQ ID 9321> which encodes amino acid sequence <SEQ ID 9322> was also identified.

The protein has no significant homology with any sequences in the GENPEPT database.

A related DNA sequence was identified in *S. pyogenes* <SEQ ID 1305> which encodes the amino acid sequence <SEQ ID 1306>. Analysis of this protein sequence reveals the following:

Possible site: 47
>>> Seems to have no N-terminal signal sequence
----- Final Results -----
    bacterial cytoplasm --- Certainty = 0.5350 (Affirmative) <succ>
      bacterial membrane --- Certainty = 0.0000 (Not Clear) <succ>
      bacterial outside --- Certainty = 0.0000 (Not Clear) <succ>

An alignment of the GAS and GBS proteins is shown below:

```
Identities = 24/73 (32%), Positives = 37/73 (49%), Gaps = 2/73 (2%)
Query:   1 MFYMKLANRLSLAATIVNEANANSPFGIIIHSDKAENVEWNDFETQFPDLFNSPKKEESP        60
           + YMKLA   L  TI+ E +  SPF I+H+D A N++    E     N     +++P
Sbjct:  80 ILYMKLAKENHLPVTIITETHMTSPFAFILHTDHAINLKETRLEVILKQTKNDQLSKQTP       139
```

```
Query:  61 K--KSLWQHFFSQ                                                71
           +  KS W+ F  +
Sbjct: 140 EKTKSFWKRFLKK                                               152
```

Based on this analysis, it was predicted that these proteins and their epitopes could be useful antigens for vaccines or diagnostics.

Example 403

A DNA sequence (GBSx0438) was identified in *S. agalactiae* <SEQ ID 1307> which encodes the amino acid sequence <SEQ ID 1308>. This protein is predicted to be Isopentenyl-diphosphate delta-isomerase. Analysis of this protein sequence reveals the following:

```
>GP: AAG20030 GB: AE005083 isopentenyl pyrophosphate isomerase; Idi
[Halobacterium sp. NRC-1]
Identities = 24/77 (31%), Positives = 40/77 (51%)
Query:  14 TGLILNRDQNIPQGLFHLVVDVILFHEDGDVLMMKRHPKKKAFPAYFEATAGGSALKGEN   73
           TGL    D +    G+ H    +LF EDG VL+ +R  +K+ +  +++ T     ++G++
Sbjct:  42 TGLANRLDAHTGDGVRHRAFTCLLFDEDGRVLLAQRADRKRLWDTHWDGTVASHPIEGQS  101

Query:  74 AKQAILRELKEETGIVP                                             90
           A  + L EE GI P
Sbjct: 102 QVDATRQRLAEELGIEP                                            118
```

No corresponding DNA sequence was identified in *S. pyogenes*.

Based on this analysis, it was predicted that this protein and its epitopes, could be useful antigens for vaccines or diagnostics.

Possible site: 39
>>> Seems to have no N-terminal signal sequence
----- Final Results -----
  bacterial cytoplasm --- Certainty = 0.1649 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database:

Possible site: 35
>>> Seems to have no N-terminal signal sequence
----- Final Results -----
  bacterial cytoplasm --- Certainty = 0.0613 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database:

```
>GP: CAB50876 GB: AL096844 putative phosphoserine phosphatase
[Streptomyces coelicolor A3(2)]
Identities = 96/193 (49%), Positives = 132/193 (67%)
Query:    5 LLVMDVDSTLIMEEAIDLLAIEAGVKQVAALTDAAMRGELDFEEALKKRVALLKGLPVT   64
            L+VMDVDSTLI +E I+L A  AG   +VA +T AAMRGELDFE++L  RVALL GL  +
Sbjct:  183 LVVMDVDSTLIQDEVIELFAAHAGCEDEVAEVTAAAMRGELDFEQSLHARVALLAGLDAS  242

Query:   65 ILTDILSSIHFTPGAYELIKECHKRQMKVGLVSGGFHETIDILAKQLQVDYVKANRLGVK  124
            ++  + + +  TPGA   LI+    +    +VG+VSGGF + D L +QL +D+ +AN L +
Sbjct:  243 VVDKVRAEVRLTPGARTLIRTLKRLGYQVGVVSGGFTQVTDALQEQLGLDFAQANTLEIV  302

Query:  125 GGFLTGEVEGEIVTKEVKKIKLKEWASENHLDLSQTIAMGDGANDLPMIKSAGVGIAFCA  184
            G  LTG V GEIV +  K   L+ +A+   +  LSQT+A+GDGANDL M+ +AG+G+AF A
Sbjct:  303 DGRLTGRVTGEIVDRAGKARLLRRFAAAAGVPLSQTVAIGDGANDLDMLNAAGLGVAFNA  362

Query:  185 KPIVREEAAYQIN                                                197
            KP+VRE A   +N
Sbjct:  363 KPVVREAAHTAVN                                                375
```

Example 404

A DNA sequence (GBSx0439) was identified in *S. agalactiae* <SEQ ID 1309> which encodes the amino acid sequence <SEQ ID 1310>. This protein is predicted to be phosphoserine phosphatase (serB). Analysis of this protein sequence reveals the following:

No corresponding DNA sequence was identified in *S. pyogenes*.

Based on this analysis, it was predicted that this protein and its epitopes, could be useful antigens for vaccines or diagnostics.

Example 405

A DNA sequence (GBSx0440) was identified in *S. agalactiae* <SEQ ID 1311> which encodes the amino acid sequence <SEQ ID 1312>. Analysis of this protein sequence reveals the following:

Possible site: 23
>>> Seems to have an uncleavable N-term signal seq

INTEGRAL   Likelihood = −17.88   Transmembrane 5-21 (1-29)
----- Final Results -----
  bacterial membrane --- Certainty = 0.8153 (Affirmative) <succ>
  bacterial outside --- Certainty = 0.0000 (Not Clear) <succ>
  bacterial cytoplasm ---Certainty = 0.0000 (Not Clear) <succ>

The protein has homology with the following sequences in the GENPEPT database:

```
>GP: BAB06924 GB: AP001518 unknown conserved protein
[Bacillus halodurans]
Identities = 122/553 (22%), Positives = 265/553 (47%), Gaps = 12/553 (2%)
Query:    7 LLLVAIVLLVIIAYVVGVVIRKANDTLIANLETRKQELVDLPVQEEIEQVKLLHLIGQSQ      66
            +++ ++++L + +V G + RK    + LE  K +++ P+ +EI +VK L + G+++
Sbjct:    3 IVVFSLLVLTVTFFVYGALRRKAFYKRVDKLEDWKNDILQRPIPDEIGKVKGLTMSGETE     62

Query:   67 STFREWNQKWTDLSTNSFKDIDFHLVEAENLNDSFNFVRAKHEIDNVDSQLTIIEEDIVS    126
             F   W   W D+      +++  L + E+  + + F +AK +D ++ +L  IEE +
Sbjct:   63 EKFEVWRSDWDDIVGVILPNVEEQLFDVEDFANKYRFQKAKALLDTIEQRLHSIEEQLKI    122

Query:  127 IREALEVLKEQEEKNSARVTHALDLYETLQKSISEKEDNYGTTMPEIEKQLKNIEAEFSH    186
            + + ++VL + EE+N    +     +L + L K   +  ++    +++L+
Sbjct:  123 MVDDIQVLVQSEEQNRTEIGSVRELQQKLIKEAITRRGSLSSSAKVFDEKLEKANELLQA    182

Query:  187 FVTLNSTGDPIEASEVLNKAEEHTIALGQITEQIPAIVAKLEDDFPDQLDDLETGYRRLL    246
            F     G+ I+ASEVL +A+E    +  + +P +  +L+ + P +L +L+ G R +
Sbjct:  183 FDERTEKGNYIQASEVLEEAKELLGQIEHLLKIVPGLFVELQTNIPAELTNLKNGLRDME    242

Query:  247 EENYHFPEKDIEQRFQEVREAIRSNSDGLVSLDLDRARDENEHIQEKIDKLYDIFEREIA    306
            E  +    I+ + + + E     + L  L+ +    +E   I+E +++++++ E+E+
Sbjct:  243 EAGFFLETFAIDSQMERLEEKRVELLEQLTVLECNGMEEEINFIEESMEQMFELLEKEVE    302

Query:  307 AYKVAHKDSKIIPQFLAHAKSNNEQLGH---EIKRLSAKYILNENESLSLRSETNDLEEI    363
            A    ++ + ++P        E+L H    E ++    Y LEE  +     +L+E+
Sbjct:  303 A---KNEITILLPNLREDLTKTEEKLTHLKEETESVQLSYRLAEEELVFQQKLGKELKEL    359

Query:  364 ETKVLPSVENFGQEASPYTHLQILFERTLKTLTTVEENQMEVFEAVKTIESVETRARQNM    423
                   ++     E      ++   ++ ++ +  + E     + LT +     + E++ ++   E +A++ +
Sbjct:  360 RQQLQVIDEVTEEQKQTFSSVRSMLEEWREGLTACQNKIEQAQESLNSLRKDELKAKEEL    419

Query:  424 DKYVNKLHMIKRFMEKRNLPGIPQDFLSTFFTTSSQIEALINELSRGRIDIEAVSRLNDV    483
            +   KL   KR ++K N+PG+P+   L      ++   I +LS   +++  V+ L D
Sbjct:  420 KQLKEKLLEDKRLVQKSNIPGLPETLLHRLEDGEQKLAQAIAKLSDVPLEMGRVTALVDE    479

Query:  484 TTNAIANLEQATYLVVQDATLTEQLLQYSNRYRSFEQNVQKSFEQALYLFEVEHNYKASF    543
                I     + ++ A L E ++QY NRYRS    V+K    A  LF              +
Sbjct:  480 AQGLIHENSSILHETIEKARLAEHVIQYGNRYRSRSAEVKKRLSNAEEELFRA-----FEY    534

Query:  544 DE-ISYALETVEP                                                   555
            DE I  A++ +EP
Sbjct:  535 DEAIEMAVQAIEP                                                   547
```

A related DNA sequence was identified in *S. pyogenes* <SEQ ID 1313> which encodes the amino acid sequence <SEQ ID 1314>. Analysis of this protein sequence reveals the following:

Possible site: 23
>>> Seems to have an uncleavable N-term signal seq

-continued

INTEGRAL   Likelihood = −18.04   Transmembrane 5-21 (1-29)
----- Final Results -----
  bacterial membrane --- Certainty = 0.8217 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP: BAB06924 GB: AP001518 unknown conserved protein [Bacillus halodurans]
Identities = 131/555 (23%), Positives = 269/555 (47%), Gaps = 16/555 (2%)
Query:    7 LLIVAIVLLVIIAYLVGVIIRKRNDSLITSLEERKQALFALPVNDEIEEVKSLHLIGQSQ       66
            +++ ++++L + ++ G + RK    + LE+ K +   P+ DEI +VK L + G+++

Sbjct:    3 IVVFSLLVLTVTFFVYGALRRKAFYKRVDKLEDWKNDILQRPIPDEIGKVKGLTMSGETE       62

Query:   67 TSFREWNQKWVDLTVNSFADIENHIFEAENLNDTFNFIRAKHEINSVESQLNLVEEDIAS      126
               F    W  D+          ++E  +F+ E+ + + F +AK ++++E +L+ +EE +

Sbjct:   63 EKFEVWRSDWDDIVGVILPNVEEQLFDVEDFANKYRFQKAKALLDTIEQRLHSIEEQLKI      122

Query:  127 IREALNILKEQEEKNSARVTHALDLYEKLQASISENEDNFGSTMPEIDKQMKNIETEFSQ      186
             + + + +L + EE+N +    +L +KL           + S+    D++++

Sbjct:  123 MVDDIQVINQSEEQNRTEIGSVRELQQKLIKEAITRAGSLSSSAKVFDEKLEKANELLQA      182

Query:  187 FVALNSSGDPVEASEVLDRAEEHTIALGQITEQIPAIVAKLEDDFPDQLDDLETGYRRLL      246
            F       G+ ++ASEVL+ A+E    + + +P +  +L+ + P +L +L+ G R +

Sbjct:  183 FDERTEKGNYIQASEVLEEAKELLGQIEHLLKIVPGLFVELQTNIPAELTNLKNGLRDME      242

Query:  247 EENYHFPEKNIEARFQEIRESIRANSSELVTLDLDRAREENTHIQERIDSLYEVFEREIA      306
            E +       I+++ + + E       +L  L+ +   EE    I+E ++ ++E+ E+E Sbjct:  243 EAGFFLETFAIDSQMERLEEKRVELLEQLTVLECNGMEEEINFIEESMEQMFELLEKE--      300

Query:  307 AYKVAAKN--SKMLPRYLEHVKRNNEQ---LKDEIARLSRKYILSETESLTVKAFEKDIK      361
              V AKN +  +LP   E + +   E+     LK+E     Y L+E E  +    K++K Sbjct:  301 ---VEAKNEITILLPNLREDLTKTEEKLTHLKEETESVQLSYRLAEEELVFQQKLGKELK      357

Query:  362 EIEDSTLAVAEQFGLQEKPFSELQVTFERSIKILTNVESGQMDVFAAVKDIEKIESQARH      421
            E+      + E    Q++ FS ++    E   + LT ++         ++ + K E +A+

Sbjct:  358 ELRQQLQVIDEVTEEQKQTFSSVRSMLEEWREGLTACQNKIEQAQESLNSLRKDELKAKE      417

Query:  422 NLDVYVTQLHMIKRYMEKRHLPGIPQDFLSAFFTTSSQLEALMDELSRGRINIEAVSRLS      481
            L      +L    KR ++K ++PG+P+  L              +L   + +LS  + +   V+ L Sbjct:  418 ELKQLKEKLLEDKRLVQKSNIPGLPETLLHRLEDGEQKLAQAIAKLSDVPLEMGRVTALV      477

Query:  482 EVATVAIANLEDLTYQVVQNATLTEQLLQYSNRYRSFEAGVQSSFEHALRLFEVENDYQA      541
             + A   I   + ++ ++ A L E ++QY  NRYRS    A V+      +A LF Sbjct:  478 DEAQGLIHENSSILHETIEKARLAEHVIQYGNRYRSRSAEVKKRLSNAEELFRA-----F      532

Query:  542 SFDE-ISYALETVEP                                                555
            +DE I   A++ +EP Sbjct:  533 EYDEAIEMAVQAIEP                                                547
```

An alignment of the GAS and GBS proteins is shown below:

```
Identities = 429/574 (74%), Positives = 503/574 (86%)
Query:    1 MSSGIILLLVAIVLLVIIAYVVGVVIRKRNDTLIANLETRKQELVDLPVQEEIEQVKLLH       60
            MSSGIILL+VAIVLLVIIAY+VGV+IRKRND+LI +LE RKQ L  LPV +EIE+VK LH Sbjct:    1 MSSGIILLIVAIVLLVIIAYLVGVIIRKRNDSLITSLEERKQALFALPVNDEIEEVKSLH       60

Query:   61 LIGQSQSTFREWNQKWTDLSTNSFKDIDFHLVEAENLNDSFNFVRAKHEIDNVDSQLTII      120
            LIGQSQ++FREWNQKW DL+ NSF DI+ H+ EAENLND+FNF RAKHEI+++V+SQL ++

Sbjct:   61 LIGQSQTSFREWNQKWVDLIVNSFADIENHIFEAENLNDTFNFIRAKHEINSVESQLNLV      120
```

-continued

```
Query: 121 EEDIVSIREALEVLKEQEEKNSARVTHALDLYETLQKSISEKEDNYGTTMPEIEKQLKNI        180
            EEDI SIREAL +LKEQEEKNSARVTHALDLYE LQ SISE EDN+G+TMPEI+KQ+KNI
Sbjct: 121 EEDIASIREALNILKEQEEKNSARVTHALDLYEKLQASISENEDNYGSTMPEIDKQMKNI        180

Query: 181 EAEFSHFVTLNSTGDPIEASEVLNKAEEHTIALGQITEQIPAIVAKLEDDFPDQLDDLET        240
            E EFS FV LNS+GDP+EASEVL++AEEHTIALGQITEQIPAIVAELEDDFPDQLDDLET
Sbjct: 181 ETEFSQFVALNSSGDPVEASEVLDRAEEHTIALGQITEQIPAIVAKLEDDFPDQLDDLET        240

Query: 241 GYRRLLEENYHFPEKDIEQRFQEVREAIRSNSDGLVSLDLDRARDENEHIQEKIDKLYDI        300
            GYRRLLEENYHFPEK+IE RFQE+RE+IR+NS  LV+LDLDRAR+EN HIQE+ID LY++
Sbjct: 241 GYRRLLEENYHFPEKNIEARFQEIRESIRANSSELVTLDLDRAREENTHIQERIDSLYEV        300

Query: 301 FEREIAAYKVAHKDSKIIPQFLAHAKSNNEQLGHEIKRLSAKYILNENESLSLRSFTNDL        360
            FEREIAAYKVA K+SK++P++L H K NNEQL  EI RLS KYIL+E ESL++++F  D+
Sbjct: 301 FEREIAAYKVAAKNSKMLPRYLEHVKRNNEQLKDEIARLSRKYILSETESLTVKAFEKDI        360

Query: 361 EEIETKVLPSVENFGQEASPYTHLQILFERTLKTLTTVEENQMEVFEAVKTIESVETRAR        420
            +EIE    L  E FG +  P++ LQ+ FER++KTLT VE  QM+VF AVK IE +E++AR
Sbjct: 361 KEIEDSTLAVAEQFGLQEKPFSELQVTFERSIKTLTNVESGQMDVFAAVKDIEKIESQAR        420

Query: 421 QNMDKYVNKLHMIKRFMEKRNLPGIPQDFLSTFFTTSSQIEALINELSRGRIDIEAVSRL        480
            +N+D  YV +LHMIKR+MEKR+LPGIPQDFLS FFTTSSQ+EAL++ELSRGRI+IEAVSRL
Sbjct: 421 HNLDVYVTQLHMIKRYMEKRHLPGIPQDFLSAFFTTSSQLEALMDELSRGRINIEAVSRL        480

Query: 481 NDVTIMAIANLEQATYLVVQDATLTEQLLQYSNRYRSFEQNVQKSFEQALYLFEVEHNYK        540
            ++V T AIANLE  TY VVQ+ATLTEQLLQYSNRYRSFE  VQ SFE AL LFEVE++Y+
Sbjct: 481 SEVATVAIANLEDLTYQVVQNATLTEQLLQYSNRYRSFEAGVQSSFEHALRLFEVENDYQ        540

Query: 541 ASFDEISYALETVEPGVTDRFVTSYEKTQERIRF                            574
            ASFDEISYALETVEPGVTDRFV SYEKT+E IRF
Sbjct: 541 ASFDEISYALETVEPGVTDRFVNSYEKTREHIRF                            574
```

Figure 142:
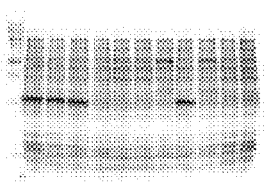

SEQ ID 1312 (GBS642) was expressed in *E. coli* as a GST-fusion product. SDS-PAGE analysis of total cell extract is shown in FIG. 142 (lane 2-4; MW 27 kDa).

Based on this analysis, it was predicted that these proteins and their epitopes could be useful antigens for vaccines or diagnostics.

Possible site: 41
>>> Seems to have no N-terminal signal sequence
----- Final Results -----
   bacterial cytoplasm --- Certainty = 0.2471 (Affirmative) <succ>
   bacterial membrane --- Certainty = 0.0000 (Not Clear) <succ>
   bacterial outside --- Certainty = 0.0000 (Not Clear) <succ>

Example 406

A DNA sequence (GBSx0441) was identified in *S. agalactiae* <SEQ ID 1315> which encodes the amino acid sequence <SEQ ID 1316>. Analysis of this protein sequence reveals the following:

A related GBS nucleic acid sequence <SEQ ID 9671> which encodes amino acid sequence <SEQ ID 9672> was also identified.

The protein has homology with the following sequences in the GENPEPT database:

```
>GP: CAA91553 GB: Z67740 DNA gyrase [Streptococcus pneumoniae]
Identities = 574/650 (88%), Positives = 618/650 (94%), Gaps = 2/650 (0%)
Query:   1 MTEETKNMEQRAQEYDASQIQVLEGLEAVRMRPGMYIGSTSKEGLHHLVWEIVDNSIDEA         60
            MTEE KN++  AQ+YDASQIQVLEGLEAVRMRPGMYIGSTSKEGLHHLVWEIVDNSIDEA
Sbjct:   1 MTEEIKNLQ--AQDYDASQIQVLEGLEAVRMRPGMYIGSTSKEGLHHLVWEIVDNSIDEA         58

Query:  61 LAGFAGHIKVYIEPDNSITVVDDGRGIPVDIQEKTGRPAVETVFTVLHAGGKFGGGGYKV        120
            LAGFA HI+V+IEPD+SITVVDDGRGIPVDIQEKTGRPAVETVFTVLHAGGKFGGGGYKV
Sbjct:  59 LAGFASHIQVFIEPDDSITVVDDGRGIPVDIQEKTGRPAVETVFTVLHAGGKFGGGGYKV        118

Query: 121 SGGLHGVGSSVVNALSTQLDVKVYKNGKVHYQEYQRGVVVNDLEIIGDTDLSGTTVHFTP        180
            SGGLHGVGSSVVNALSTQLDV V+KNGK+HYQEY+RG VV DLE++GDTD +GTTVHFTP
Sbjct: 119 SGGLHGVGSSVVNALSTQLDVHVHKNGKIHYQEYRRGHVVADLEVVGDTDRTGTTVHFTP        178

Query: 181 DPEIFTETTVFDFDKLAKRIQELAFLNRGLRISISDKREGQEVEKEYHYEGGIGSYVEFI        240
            DPEIFTETT+FDFDKL KRIQELAFLNRGL+ISI+DKR+G E   K YHYEGGI SYVE+I
Sbjct: 179 DPEIFTETTIFDFDKLNKRIQELAFLNRGLQISITDKRQGLEQTKHYHYEGGIASYVEYI        238
```

-continued

```
Query: 241 NENKEVIFENPIYTDGELDGISVEVAMQYTTGYQETVMSFANNIHTHEGGTHEQGFRTAL      300
            NENK+VIF+ PIYTDGE+D I+VEVAMQYTTGY E VMSFANNIHTHEGGTHEQGFRTAL Sbjct: 239 NENKDVIFDTPIYTDGEMDDITVEVAMQYTTGYHENVMSFANNIHTHEGGTHEQGFRTAL     298

Query: 301 TRVINDYAKKNKILKENEDNLTGEDVREGLTAVISVKHPNPQFEGQTKTKLGNSEVVKIT      360
            TRVINDYA+KNK+LK+NEDNLTGEDVREGLTAVISVKHPNPQFEGQTKTKLGNSEVVKIT Sbjct: 299 TRVINDYARKNKLLKDNEDNLTGEDVREGLTAVISVKHPNPQFEGQTKTKLGNSEVVKIT     358

Query: 361 NRLFSEAFNRFLLENPQVAKKIVEKGILASKARIAAKRAREVTRKKSGLEISNLPGKLAD      420
            NRLFSEAF+ FL+ENPQ+AK+IVEKGILA+KAR+AAKRAREVTRKKSGLEISNLPGKLAD Sbjct: 359 NRLFSEAFSDFLMENPQIAKRIVEKGILAAKARVAAKRAREVTRKKSGLEISNLPGKLAD     418

Query: 421 CSSNNAEMNELFIVEGDSAGGSAKSGRNREFQAILPIRGKILNVEKATMDKILANEEIRS      480
            CSSNN     ELFIVEGDSAGGSAKSGRNREFQAILPIRGKILNVEKA+MDKILANEEIRS Sbjct: 419 CSSNNPAETELFIVEGDSAGGSAKSGRNREFQAILPIRGKILNVEKASMDKILANEEIRS     478

Query: 481 LFTAMGTGFGADFDVSKVRYQKLVIMTDADVDGAHIRTLLLTLIYRFMRPVLEAGYVYIA      540
            LFTAMGTGFGA+FDVSK RYQKLV+MTDADVDGAHIRTLLLTLIYR+M+P+LEAGYVYIA Sbjct: 479 LFTAMGTGFGAEFDVSKARYQKLVLMTDADVDGAHIRTLLLTLIYRYMKPILEAGYVYIA     538

Query: 541 QPPIYGVKVGSEIKAYIQPGVNQEEELRQALDTYSSGRSKPTVQRYKGLGEMDDHQLWET      600
            QPPIYGVKVGSEIK YIQPG +QE +L++AL   YS GR+KPT+QRYKGLGEMDDHQLWET Sbjct: 539 QPPIYGVKVGSEIKEYIQPGADQEIKLQEALARYSEGRTKPTIQRYKGLGEMDDHQLWET     598

Query: 601 TMDPENRLMARVSVDDAAEADKIFDMLMGDRVEPRREFIEANAVYSNLDI              650
            TMDPE+RLMARVSVDDAAEADKIFDMLMGDRVEPRREFIE NAVYS LD+

Sbjct: 599 TMDPEHRLMARVSVDDAAEADKIFDMLMGDRVEPRREFIEENAVYSTLDV              648
```

A related DNA sequence was identified in *S. pyogenes* <SEQ ID 1317> which encodes the amino acid sequence <SEQ ID 1318>. Analysis of this protein sequence reveals the following:

Possible site: 41
>>> Seems to have no N-terminal signal sequence

----- Final Results -----
bacterial cytoplasm --- Certainty = 0.1698 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below:

```
Identities = 584/650 (89%), Positives = 618/650 (94%)
Query:   1 MTEETKNMEQRAQEYDASQIQVLEGLEAVRMRPGMYIGSTSKEGLHHLVWEIVDNSIDEA    60
           M EE K+ E++ QEYDASQIQVLEGLEAVRMRPGMYIGST/KEGLHHLVWEIVDNSIDEA Sbjct:   1 MIEENKHFEKKMQEYDASQIQVLEGLEAVRMRPGMYIGSTAKEGLHHLVWEIVDNSIDEA    60

Query:  61 LAGFAGHIKVYIEPDNSITVVDDGRGIPVDIQEKTGRPAVETVFTVLHAGGKEGGGGYKV   120
           LAGFA HIKV+IE DNSITVVDDGRGIPVDIQ KTGRPAVETVFTVLHAGGKFGGGGYKV Sbjct:  61 LAGFASHIKVFIEADNSITVVDDGRGIPVDIQAKTGRPAVETVFTVLHAGGKFGGGGYKV   120

Query: 121 SGGLHGVGSSVVNALSTQLDVKVYKNGKVHYQEYQRGVVVNDLEIIGDTDLSGTTVHFTP   180
           SGGLHGVGSSVVNALSTQLDV+VYKNG++HYQE++RG VV DLE+IG TD++GTTVHFTP Sbjct: 121 SGGLHGVGSSVVNALSTQLDVRVYKNGQIHYQEFKRGAVVADLEVIGTTDVTGTTVHFTP   180

Query: 181 DPEIFTETTVFDFDKLAKRIQELAFLNRGLRISISDKREGQEVEKEYHYEGGIGSYVEFI   240
           DPEIFTETT FD+  LAKRIQELAFLNRGL+ISI+DKR G E E+ + YEGGIGSYVEF+

Sbjct: 181 DPEIFTETTQFDYSVLAKRIQELAFLNRGLKISITDKRSGMEQEEHFLYEGGIGSYVEFL   240

Query: 241 NENKEVIFENPIYTDGELDGISVEVAMQYTTGYQETVMSFANNIHTHEGGTHEQGFRTAL   300
           N+ K+VIFE PIYTDGEL+GI+VEVAMQYTT YQETVMSFANNIHTHEGGTHEQGFR AL Sbjct: 241 NDKKDVIFETPIYTDGELEGIAVEVAMQYTTSYQETVMSFANNIHTHEGGTHEQGFRAAL   300

Query: 301 TRVINDYAKKNKILKENEDNLTGEDVREGLTAVISVKHPNPQFEGQTKTKLGNSEVVKIT   360
           TRVINDYAKKNKILKENEDNLTGEDVREGLTAVISVKHPNPQFEGQTKTKLGNSEVVKIT Sbjct: 301 TRVINDYAKKNKILKENEDNLTGEDVREGLTAVISVKHPNPQFEGQTKTKLGNSEVVKIT   360
```

-continued

```
Query: 361 NRLFSEAFNRFLLENPQVAKKIVEKGILASKARIAAKRAREVIRKKSGLEISNLPGKLAD     420
            NRLFSEAF RFLLENPQVA+KIVEKGILASKARIAAKRAREVTRKKSGLEISNLPGKLAD
Sbjct: 361 NRLFSEAFQRFLLENPQVARKIVEKGILASKARIAARRAREVTRKKSGLEISNLPGKLAD     420

Query: 421 CSSNNAEMNELFIVEGDSAGGSAKSGRNREFQAILPIRGKILNVEKATMDKILANEEIRS     480
            CSSN+A   NELFIVEGDSAGGSAKSGRNREFQAILPIRGKILNVEKATMDKILANEEIRS
Sbjct: 421 CSSNDANQNELFIVEGDSAGGSAKSGRNREFQAILPIRGKILNVEKATMDKILANEEIRS     480

Query: 481 LFTAMGTGFGADFDVSKVRYQKLVIMTDADVDGAHIRTLLLTLIYRFMRPVLEAGYVYIA     540
            LFTAMGTGFGADFDVSK RYQKLVIMTDADVDGAHIRTLLLTLIYRFMRPVLEAGYVYIA
Sbjct: 481 LFTAMGIGFGADFDVSKARYQKLVIMTDADVDGAHIRTLLLTLIYRFMRPVLEAGYVYIA     540

Query: 541 QPPIYGVKVGSEIKAYIQPGVNQEEELRQALDTYSSGRSKPIVQRYKGLGEMDDHQLWET     600
            QPPIYGVKVGSEIK YIQPG++QE++L+ AL+ YS GRSKPTVQRYKGLGEMDDHQLWET
Sbjct: 541 QPPIYGVKVGSEIKEYIQPGIDQEDQLKTALEKYSIGRSKPTVQRYKGLGEMDDHQLWET     600

Query: 601 TMDPENRLMARVSVDDAAEADKIFDMLMGDRVEPRREFIEANAVYSNLDI              650
            TMDPENRLMARV+VDDAAEADK+FDMLMGDRVEPRR+FIE NAVYS LDI
Sbjct: 601 TMDPENRLMARVTVDDAAEADKVFDMLMGDRVEPRADFIEENAVYSTLDI              650
```

Based on this analysis, it was predicted that these proteins and their epitopes could be useful antigens for vaccines or diagnostics.

Example 407

A DNA sequence (GBSx0442) was identified in S. agalactiae <SEQ ID 1319> which encodes the amino acid sequence <SEQ ID 1320>. Analysis of this protein sequence reveals the following:

---

Possible site: 26
>>> Seems to have no N-terminal signal sequence
----- Final Results -----
   bacterial cytoplasm --- Certainty = 0.3186 (Affirmative) <succ>
   bacterial membrane --- Certainty = 0.0000 (Not Clear) <succ>
   bacterial outside --- Certainty = 0.0000 (Not Clear) <succ>

---

The protein has homology with the following sequences in the GENPEPT database:

A related DNA sequence was identified in S. pyogenes <SEQ ID 1321> which encodes the amino acid sequence <SEQ ID 1322>. Analysis of this protein sequence reveals the following:

---

Possible site: 59
>>> Seems to have no N-terminal signal sequence
----- Final Results -----
   bacterial cytoplasm --- Certainty = 0.2472 (Affirmative) <succ>
   bacterial membrane --- Certainty = 0.0000 (Not Clear) <succ>
   bacterial outside --- Certainty = 0.0000 (Not Clear) <succ>

---

An alignment of the GAS and GBS proteins is shown below:

```
>GP: CAA91552 GB: Z67740 unidentified [Streptococcus pneumoniae]
Identities = 82/142 (57%), Positives = 105/142 (73%)

Query:  45 LKESTADAIAYFIPEEADFLKEYKANEAKVLETPILFQGAKELLAKIQRQGSRNFLVSHR     104
           LK ST  AI  F P   +FL++YK NEA+ LE PILF+G +LL  I  QG R+FLVSHR
Sbjct:   2 LKVSTPFAIETFAPNLENFLEKYKENEARELEHPILFEGVSDLLEDILNQGGRHFLVSHR     61

Query: 105 DNQVIVILEKTEIIDYFTEVVTADNGFSRKPSPESMLYLKEKYQIDNCLVIGDRDIDKQA     164
           ++QV+ ILEKT I  YFTEVVT+ +GF RKP+PESMLYL+EKYQI + LVIGDR ID +A
Sbjct:  62 NDQVLEILEKTSIAAYFTEVVTSSSGFKRKPNPESMLYLREKYQISSGLVIGDRPIDIEA     121

Query: 165 GESAGFDTLLVDGSKSLMEIIE                                          186
           G++AG DT L    +L ++++
Sbjct: 122 GQAAGLDTHLFTSIVNLRQVLD                                          143
```

```
Identities = 122/185 (65%), Positives = 145/185 (77%)
Query:   1 MNYHDYINDLGGTLLDNYESSTRAFVETLKEFGYQADHDSVYQKLKESTADAIAYFIPEE    60
           MNY DYIWDLGGTLLDNYE ST+AFV+TL  F    DHD+VYQKLKESTA A+A F P E
Sbjct:   4 MNYQDYINDLGGTLLDNYELSTQAFVQTLAFFSLPGDHDAVYQKLKESTAIAVAMFAPNE    63

Query:  61 ADFLKEYKANEAKVLETPILFQGAKELLAKIQRQGSRNFLVSHRDNQVIVILEKTEIIDY   120
           +FL  Y+   EA L  PI   GAKE+L KI   GSRNFL+SHRD QV  +LE+  ++ Y
Sbjct:  64 PEFLHVYRLREADKLAQPIWCLGAKEILGKIATSGSRNFLISHRDCQVNQLLEQAGLLIY   123

Query: 121 FTEVVTADNGFSRKPSPESMLYLKEKYQIDNCLVIGDRDIDKQAGESAGFDTLLVDGSKS   180
           FTEVVTA NGF+RKP+PES+ YLKEKY I++ LVIGDR IDKQAG++AGF+TLLVDG K+
Sbjct: 124 FTEVVTASNGFARKPNPESLFYLKEKYDINSGLVIGDRLIDKQAGQAAGFNTLLVDGRKN   183

Query: 181 LMEII                                                          185
           L+EI+
Sbjct: 184 LLEIV                                                          188
```

Based on this analysis, it was predicted that these proteins and their epitopes could be useful antigens for vaccines or diagnostics.

Example 408

A DNA sequence (GBSx0443) was identified in *S. agalactiae* <SEQ ID 1323> which encodes the amino acid sequence <SEQ ID 1324>. This protein is predicted to be stage V sporulation protein E (rodA). Analysis of this protein sequence reveals the following:

Possible site: 42
>>> Seems to have a cleavable N-term signal seq.
INTEGRAL    Likelihood = −11.15    Transmembrane 206-222 (177-226)
INTEGRAL    Likelihood = −10.14    Transmembrane 58-74 (50-82)
INTEGRAL    Likelihood = −9.34     Transmembrane 182-198 (177-205)
INTEGRAL    Likelihood = −8.55     Transmembrane 158-174 (156-177)
INTEGRAL    Likelihood = −8.12     Transmembrane 300-316 (299-324)
INTEGRAL    Likelihood = −2.66     Transmembrane 86-102 (83-102)
INTEGRAL    Likelihood = −2.34     Transmembrane 338-354 (338-357)
----- Final Results -----
  bacterial membrane --- Certainty = 0.5458 (Affirmative) <succ>
  bacterial outside --- Certainty = 0.0000 (Not Clear) <succ>
  bacterial cytoplasm --- Certainty = 0.0000 (Not Clear) <succ>

A related GBS nucleic acid sequence <SEQ ID 9669> which encodes amino acid sequence <SEQ ID 9670> was also identified.

The protein has homology with the following sequences in the GENPEPT database:

```
>GP: CAB15838 GB: Z99123 alternate gene name: ipa-42d~similar to
cell-division protein [Bacillus subtilis]
Identities = 142/392 (36%), Positives = 237/392 (60%), Gaps = 23/392 (5%)
Query:  10 QKSNYFKGQIDYAVVIPVFFLLMIGLASIYVA-TMNDYPSNIYIAMFQQVSWIIMGCIIA     68
           Q+S +++G  D   +  VFF+  I + SIY A       Y +  +I   QQ+ + ++G +
Sbjct:   7 QQSPFYQG--DLIFIFGVFFI--ISVVSIYAAGQFGQYGNTDWI---QQIVFYLLGAVAI    59

Query:  69 FVVMLFSTEFLWKATPYLYALGLTLMVLPLIFYSPQLFAAT--GAKNWVTIGSVTLFQPS   126
           V++  F   E L K + Y++ +G+  +++    I  SP+  A     GAK+W  IG +T+ QPS
Sbjct:  60 TVLLYFDLEQLEKLSLYIFIIGILSLIILKI--SPESIAPVIKGAKSWFRIGRITI-QPS   116

Query: 127 EFMKISYILMLSRITVSFHQKNRKTFQDDWKLL-GLFGLVTLPVMILLMLQKDLGTALVF   185
           EFMK+  I+ML+ +    + K  +T +DD LL   G+   +PV ++LM  +D GTA +
Sbjct: 117 EFMKVGLIMMLASVIGKANPKGVRTLRDDIHLLLKIAGVAVIPVGLILM--QDAGTAGIC   174

Query: 186 LAILSGLILLSGISWWIILPILSTIVLFIASFLMIFISPNGKEWFYNLGMDTYQINRLSA   245
           + I+  ++   +SGI+W +I  I    +L I+  L++ I  N +       ++G+   YQI R+++
Sbjct: 175 MFIVLVMVFMSGINWKLIAIIAGSGILLISLILLVMI--NFPDVAKSVGIQDYQIKRVTS   232

Query: 246 WIDPFSFAD---SIAYQQTQGMVSIGSGGVTGKGFNILELSVPVRESDMIFTVIAENFGF   302
           W+   +       + ++Q  Q +++IGSGG  G G + L++   VP     +D IF++I E+FGF
Sbjct: 233 WVSASNETQEDSNDSWQVDQAIMAIGSGGILGNGISNLKVYVPESTTDFIFSIIGESFGF   292

Query: 303 IGSAIVLGLYLIIIYRMLRIT--IESNNQFYTFISTGFIMMIVFHVFENIGAAVGILPLT   360
           IG AIV+ ++  +IYR++ +    I    N+F +F   G+    +IV H  F+NIG   +GI+P+T
```

```
Sbjct: 293 IGCAIVVIMFFFLIYRLVVLIDKIHPFNRFASFFCVGYTALIVIHTFQNIGMNIGIMPVT    352

Query: 361 GIPLPFISQGGSSLLSNLIGIGLVLSMSYQNT    392
           GIPL F+S GGSS LS LIG G+V + S Q T
Sbjct: 353 GIPLLFVSYGGSSTLSTLIGFGIVYNASVQLT    384
```

There is also homology to SEQ ID 1028.

Based on this analysis, it was predicted that these proteins and their epitopes could be useful antigens for vaccines or diagnostics.

Example 409

A DNA sequence (GBSx0444) was identified in *S. agalactiae* <SEQ ID 1325> which encodes the amino acid sequence <SEQ ID 1326>. Analysis of this protein sequence reveals the following:

Possible site: 25
>>> Seems to have no N-terminal signal sequence
----- Final Results -----
   bacterial cytoplasm --- Certainty = 0.3195 (Affirmative) <succ>
     bacterial membrane --- Certainty = 0.0000 (Not Clear) <succ>
       bacterial outside --- Certainty = 0.0000 (Not Clear) <succ>

The protein has no significant homology with any sequences in the GENPEPT database.

A related DNA sequence was identified in *S. pyogenes* <SEQ ID 1327> which encodes the amino acid sequence <SEQ ID 1328>. Analysis of this protein sequence reveals the following:

Possible site: 22
>>> Seems to have no N-terminal signal sequence
----- Final Results -----
   bacterial cytoplasm --- Certainty = 0.2735 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below:

```
Identities = 38/55 (69%), Positives = 48/55 (87%)
Query:  8 DEFKEAIDKGYISGNTVAIVRKNGKIFDYVLLHEEVREEEVVTVERVLDVLRKLS  62
          DEFK+AID GYI+G+TVAIVRK+G+IFDYVL HE+V+  EVVT E+V +VL +LS
Sbjct:  5 DEFKQAIDNGYIAGDTVAIVRKDGQIFDYVLPHEKVKNGEVVTKEKVEEVLVELS  59
```

Based on this analysis, it was predicted that these proteins and their epitopes could be useful antigens for vaccines or diagnostics.

Example 410

A DNA sequence (GBSx0445) was identified in *S. agalactiae* <SEQ ID 1329> which encodes the amino acid sequence <SEQ ID 1330>. Analysis of this protein sequence reveals the following:

Possible site: 41
>>> Seems to have no N-terminal signal sequence
----- Final Results -----
   bacterial cytoplasm --- Certainty = 0.4241 (Affirmative) <succ>
     bacterial membrane --- Certainty = 0.0000 (Not Clear) <succ>
       bacterial outside --- Certainty = 0.0000 (Not Clear) <succ>

The protein has no significant homology with any sequences in the GENPEPT database.

A related DNA sequence was identified in *S. pyogenes* <SEQ ID 1331> which encodes the amino acid sequence <SEQ ID 1332>. Analysis of this protein sequence reveals the following:

Possible site: 41
>>> Seems to have no N-terminal signal sequence
----- Final Results -----
   bacterial cytoplasm --- Certainty = 0.4551 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below:

```
Identities = 57/66 (86%), Positives = 63/66 (95%)
Query:   1 MSQEKLKSKLDQAKGGAKEGFGKITGDKELEAKGFIEKTIAKGKELADDAKDAVEGAVDA  60
           MS+EKLKSK++QA GG KEG GK+TGDKELEAKGF+EKTIAKGKELADDAK+AVEGAVDA
```

```
                              -continued
Sbjct:   1  MSEEKLKSKIEQASGGLKEGAGKLTGDKELEAKGFVEKTIAKGKELADDAKEAVEGAVDA  60

Query:  61  VKEKLK                                                        66
            VKEKLK
Sbjct:  61  VKEKLK                                                        66
```

Based on this analysis, it was predicted that these proteins and their epitopes could be useful antigens for vaccines or diagnostics.

Example 411

A DNA sequence (GBSx0447) was identified in *S. agalactiae* <SEQ ID 1333> which encodes the amino acid sequence <SEQ ID 1334>. This protein is predicted to be TnpA (orfB). Analysis of this protein sequence reveals the following:

---

Possible site: 16
>>> Seems to have no N-terminal signal sequence
----- Final Results -----
   bacterial cytoplasm --- Certainty = 0.3961 (Affirmative) <succ>
     bacterial membrane --- Certainty = 0.0000 (Not Clear) <succ>
       bacterial outside --- Certainty = 0.0000 (Not Clear) <succ>

---

A related GBS nucleic acid sequence <SEQ ID 9667> which encodes amino acid sequence <SEQ ID 9668> was also identified.

A related DNA sequence was identified in *S. pyogenes* <SEQ ID 1335> which encodes the amino acid sequence <SEQ ID 1336>. Analysis of this protein sequence reveals the following:

---

Possible site: 55
>>> Seems to have no N-terminal signal sequence
----- Final Results -----
   bacterial cytoplasm --- Certainty = 0.3365 (Affirmative) <succ>
     bacterial membrane --- Certainty = 0.0000 (Not Clear) <succ>
       bacterial outside --- Certainty = 0.0000 (Not Clear) <succ>

---

An alignment of the GAS and GBS proteins is shown below:

```
Identities = 152/160 (95%), Positives = 154/160 (96%)

Query:    1  MKNMALPKMATVKTKTALKKTQKTYPQNLLNQKFNPDKPNQVWSTDFTYISIGYKKYVYL   60
             MKNMALPKMATVK KTALK+TQKTYPQNLLNQKFNPDKPNQVWSTDFTYISIGYKKYVYL
Sbjct:  194  MKNMALPKMATVKPKTALKRTQKTYPQNLLNQKFNPDKPNQVWSTDFTYISIGYKKYVYL  253

Query:   61  CAIIDLYSRKYIAWKLSHRMDAKLACDTLELALNKRKIEGTLLFHSDQGSQFKAREFRKI  120
             CAI+DLYSRK IAWKLSHRMDAKLACDTLELALNKRKIEGTLLFHSDQGSQFKARE RKI
Sbjct:  254  CAILDLYSRKCIAWKLSHRMDAKLACDTLELALNKRKIEGTLLFHSDQGSQFKARELRKI  313

Query:  121  IDDNNIMHSFSKPRYPYDNAVTEAFFKYLKHRQINQKNYQ                     160
             IDDN  IMHSFSKP YPYDNAVTEAFFKYLKHRQINQK YQ
Sbjct:  314  IDDNTIMHSFSKPGYPYDNAVTEAFFKYLKHRQINQKKYQ                     353
```

Based on this analysis, it was predicted that these proteins and their epitopes could be useful antigens for vaccines or diagnostics.

Example 412

A DNA sequence (GBSx0448) was identified in *S. agalactiae* <SEQ ID 1337> which encodes the amino acid sequence <SEQ ID 1338>. Analysis of this protein sequence reveals the following:

---

Possible site: 27
>>> Seems to have no N-terminal signal sequence
----- Final Results -----
   bacterial cytoplasm --- Certainty = 0.1090 (Affirmative) <succ>
     bacterial membrane --- Certainty = 0.0000 (Not Clear) <succ>
       bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 413

A DNA sequence (GBSx0449) was identified in *S. agalactiae* <SEQ ID 1339> which encodes the amino acid sequence <SEQ ID 1340>. This protein is predicted to be histidine kinase (resE). Analysis of this protein sequence reveals the following:

---

Possible site: 40
>>> Seems to have an uncleavable N-term signal seq
INTEGRAL    Likelihood = −11.57   Transmembrane 17-33 (6-38)
INTEGRAL    Likelihood = −4.67    Transmembrane 147-163 (142-166)
----- Final Results ----- bacterial membrane --- Certainty = 0.5628 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the GENPEPT database:

```
>GP:AAD25109 GB:AF140356 VncS [Streptococcus pneumoniae]
Identities = 178/435 (40%), Positives = 281/435 (63%), Gaps = 1/435 (0%)
Query:   1 MKKLKIFPKMFIQIFSILGILIILVHSLFFFIFPKTYLETRKVKIHIMADEISKNMNGKE    60
           MK+ +F K+FI  FSI +L+I +H  +F+FP TYL R+   I   A  I++++ GK+
Sbjct:   1 MKRTGLFAKIFIYTFSIFSVLVICLHLAIYFLFPSTYLSHRQETIGQKATAIAQSLEGKD    60

Query:  61 LKYLDQTLELYSKSSDIKVFIKKNNNKNELQINDNINVNVKSDSNSLIIEEREIKLHDGK   120
           + ++Q L+LYS++SDIK  +K    +++L++ D++ ++   + SL IEERE+K  DG
Sbjct:  61 RQSIEQVLDLYSQTSDIKGTVKGEMTEDKLEVKDSLPLDTRQTTSLFIEEREVKTQDGG   120

Query: 121 KIHLQFVSTADMQKDAKDLSLKFLPYSLSISFLFSIVISLIYAKSIKNNIQEITMVTDKM   180
           + LQF+++ D+QK+A+ +SL+FLPY+L  SFL S++++ IYA++I   I EI  VT +M
Sbjct: 121 TMILQFLASMDLQKEAEQISLQFPYTLLASFLISLLVAYIYARTIVAPILEIKRVTRRM   180

Query: 181 IKLDKETRLKISSNDEIGQLKQQINDLYCALLNTINDLEFKNKEILKLEKLKYDFFKGAS   240
           + LD + RL++ S DEIG LK+QIN LY  LL   I DL   KN+ IL+LEK+K +F +GAS
Sbjct: 181 MDLDSQVRLRVDSKDEIGNLKEQINSLYQHLLTVIADLHEKNEAILQLEKMKVEFLRGAS   240

Query: 241 HELKTPLSSLKILLENMKYNIGKYKDRDFYISECINIVDNLTKNVSQILSFYSIKDLNND   300
           HELKTPL+SLKIL+ENM+ NIG+YKDRD Y+  + IVD L  +V QILS  S+++L +D
Sbjct: 241 HELKTPLASLKILIENMRENIGRYKDRDQYLGVALGIVDELNHHVLQILSLSSSVQELRDD   300

Query: 301 EEYLNVGDTLDEVLEKYSILVNQKKININKELLDYNIYIGKTALNIVFSNLISNAVKYTN   360
           E +++     +++ Y++L  ++++ I+  L     Y+   +  ++ SNLISNA+K++
Sbjct: 301 RETIDLLQMTQNLVKDYALLAKERELQIDNSLTHQQAYLNPSVMKLILSNLISNAIKHSV   360

Query: 361 RNGIINIKIANDWLLIENSYDKNKISKINKILDASFDLKLDNSNGLGLNIVKNILNKYNI   420
             G++ I     L  IENS      + K+ +    + K+  S G+GL +VK++L   +
Sbjct: 361 PGGLVRIGEREGELFIENSCSSEEQEKLAQSFSDNASRKVKGS-GMGLFVVKSLLEHEKL   419

Query: 421 KYEILHGENYFIFKI   435
                Y   EN  F I
Sbjct: 420 AYRFEMEENSLTFFI   434
```

A related DNA sequence was identified in *S. pyogenes* <SEQ ID 1341> which encodes the amino acid sequence <SEQ ID 1342>. Analysis of this protein sequence reveals the following:

Possible site: 37
>>> Seems to have an uncleavable N-term signal seq
INTEGRAL    Likelihood = –11.83   Transmembrane 14-30 (6-35)
INTEGRAL    Likelihood = –2.44    Transmembrane 157-173 (156-174)
----- Final Results -----
bacterial membrane --- Certainty = 0.5734 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the databases:

```
>GP:AAD25109 GB:AF140356 VncS [Streptococcus pneumoniae]
Identities = 123/455 (27%), Positives = 223/455 (48%), Gaps = 23/455 (5%)
Query:   3 LIKKTFLVINGLIIVVVTSILLVLYFAMPIYYTKVKDKEVKCEFDQTSKQIKGKTVTEIR    62
           L K F+   +  V+V  L +YF  P Y  + + +   ++ ++GK    I
Sbjct:   6 LFAKIFIYTFSIFSVLVICLHLAIYFLFPSTYLSHRQETIGQKATAIAQSLEGKDRQSIE    65

Query:  63 DILTKKINKDNIWYSLVDSDNQLLYPSLQLLDGVSESKDSQNVNIVTTFDNSYSNVKVMS   122
           +L       +I ++       L++ D +     D Q ++                +
Sbjct:  66 QVLDLYSQTSDIKGTV---KGEMTEDKLEVKDSLPLDTRQTTSLF----------IEE   111

Query: 123 QKVTLRDGKKMTLLGQSSLQPVTDASKVLLDLYPSLLIFSVTVGSIVAYLYSRTSSRRIL   182
           ++V +DG M L  +S+    +A ++ L   P L+ S   +VAY+Y+RT    IL
Sbjct: 112 REVKTQDGGTMILQFLASMDLQKEAEQISLQFPYTLLASFLISLLVAYIYARTIVAPIL   171

Query: 183 SMSQTAKKMVNLEPNLTCTIHGKDEIAMLASDINRLYASLSTSIKSLQKEYEKASDSERE   242
           + +  ++M++L+ +    +  + KDEI  L    IN LY  L T I  L ++  E    E+
Sbjct: 172 EIKRVTRRMMDLDSQVRLRVDSKDEIGNLKEQINSLYQHLLTVIADLHEKNEAILQLEKM   231
```

-continued

```
Query: 243  KSEFLRMTSHELKTPITSVIGMIDGMLYNVGDFADRDKYLRKCRDVLEGQAQLVQSILSL  302
            K EFLR  SHELKTP+ S+  +I+ M  N+G + DRD+YL    +++    V  ILSL
Sbjct: 232  KVEFLRGASHELKTPLASLKILIENMRENIGRYKDRDQYLGVALGIVDELNHHVLQILSL  291

Query: 303  SKIETLASQNQELFSLKSSLEEEMEVFLVLSELKHLKVTINLEEQFVKANKVYLLKAIKN  362
            S ++ L   ++E    L     ++ + +L++ + L++   +L  Q      N +   + N
Sbjct: 292  SSVQEL-RDDRETIDLLQMTQNLVKDYALLAKERELQIDNSLTHQQAYLNPSVMKLILSN  350

Query: 363  IIDNAFHYTKSGGQVMIQLKDNQLVIKNEAETLLTQQQMKQLFQPFYRPDYSRNRKDGGT  422
            +I NA ++ GG V I  ++ +L I+N      + ++ ++L Q F    + +RK  G+
Sbjct: 351  LISNAIKHSVPGGLVRIGEREGELFIENSC----SSEEQEKLAQSF---SDNASRKVKGS  403

Query: 423  GLGLFITHQILDQHHLAYRFVVLDQRWMVFTIDFP                          457
            G+GLF+   +L+    LAYRF +++   + F IDFP
Sbjct: 404  GMGLFVVKSLLEHEKLAYRF-EMEENSLTFFIDFP                          437
```

An alignment of the GAS and GBS proteins is shown below:

```
Identities = 108/454 (23%), Positives = 220/454 (47%), Gaps = 22/454 (4%)

Query:   4  LKIFPKMFIQIFSILGILIILVHSLFFFIFPKTYLETRKVKIHIMADEISKNMNGKELKY   63
            +++   K F+ I  ++ +++  +  + +F  P Y + +  ++    D+ SK + GK +
Sbjct:   1  VRLIKKTFLVINGLIIVVVTSILLVLYFAMPIYYTKVKDKEVKCEFDQTSKQIKGKTVTE   60

Query:  64  LDQTLELYSKSSDIKVFIKKNNNK-----------NELQINDNINVNVKSDSN--SLII  109
             +   L      +I  +  ++N+           +E + + N+N+    D++  ++ +
Sbjct:  61  IRDILTKKINKDNIWYSLVDSDNQLLYPSLQLLDGVSESKDSQNVNIVTTFDNSYSNVKV  120

Query: 110  EEREIKLHDGKKIHLQFVSTADMQKDAKDLSLKFLPYSLSISFLFSIVISLIYAKSIKNN  169
             +++ L DGKK+ L    S+     DA  + L   P  L  S      +++ +Y+++
Sbjct: 121  MSQKVTLRDGKKMTLLGQSSLQPVTDASKVLLDLYPSLLIFSVTVGSIVAYLYSRTSSRR  180

Query: 170  IQEITMVTDKMIKLDKETRLKISSNDEIGQLKQQINDLYCALLNTINDLEFKNKEILKLE  229
            I  ++    KM+ L+       I   DEI  L    IN LY +L  +I  L+ +  ++      E
Sbjct: 181  ILSMSQTAKKMVNLEPNLTCTIHGKDEIAMLASDINRLYASLSTSIKSLQKEYEKASDSE  240

Query: 230  KLKYDFFKGASHELKTPLSSLKILLENMKYNIGKYKDRDFYISECINIVDNLTKNVSQIL  289
            + K +F +   SHELKTP++S+   +++  M  YN+G + DRD Y+  +C ++++    + V   IL
Sbjct: 241  REKSEFLRMTSHELKTPITSVIGMIDGMLYNVGDFADRDKYLRKCRDVLEGQAQLVQSIL  300

Query: 290  SFYSIKDL-NNDEEYLNVGDTLDEVLEKYSILVNQKKININKELLDYNIYIGKTALNIVF  348
            S     I+ L + ++E ++  +L+E +E +  +L    K + +   L + + K L
Sbjct: 301  SLSKIETLASQNQELFSLKSSLEEEMEVFLVLSELKHLKVTINLEEQFVKANKVYLLKAI  360

Query: 349  SNLISNAVKYTNRNGIINIKIANDWLLIENSYDKNKISKINKILDASF------DLKLDN  402
            +N+I NA  YT  G + I++ ++ L+I+N +      +  KL   F         + D
Sbjct: 361  KNIIDNAFHYTKSGGQVMIQLKDNQLVIKNEAETLLTQQQMKQLFQPFYRPDYSRNRKDG  420

Query: 403  SNGLGLNIVKNILNKYNIKYE-ILHGENYFIFKI                           435
              GLGL I   IL+++++ Y  ++   + +F I
Sbjct: 421  GTGLGLFITHQILDQHHLAYRFVVLDQRWMVFTI                           454
```

Based on this analysis, it was predicted that these proteins and their epitopes could be useful antigens for vaccines or diagnostics.

Example 414

A DNA sequence (GBSx0450) was identified in *S. agalactiae* <SEQ ID 1343> which encodes the amino acid sequence <SEQ ID 1344>. This protein is predicted to be response regulator (regX3). Analysis of this protein sequence reveals the following:

Possible site: 34
>>> Seems to have no N-terminal signal sequence
INTEGRAL    Likelihood = –0.80    Transmembrane 50-66 (50-66)

-continued

----- Final Results -----
bacterial membrane --- Certainty = 0.1319 (Affirmative) <succ>
bacterial outside --- Certainty = 0.0000 (Not Clear) <succ>
bacterial cytoplasm --- Certainty = 0.0000 (Not Clear) <succ>

A related GBS nucleic acid sequence <SEQ ID 9665> which encodes amino acid sequence <SEQ ID 9666> was also identified.

The protein has homology with the following sequences in the GENPEPT database:

```
>GP:AAD25108 GB:AF140356 VncR [Streptococcus pneumoniae]
Identities = 131/218 (60%), Positives = 176/218 (80%), Gaps = 1/218 (0%)
Query:    5  MKILTVEDDKLIREGISEYLSEFGYTVIQAKDGREALSKFNS-DINLVILDIQIPFINGL   63
             MKIL VED+++IREG+S+YL++ GY  I+A DG+EAL +F+S ++ LV+LDIQ+P +NGL
Sbjct:    1  MKILIVEDEEMIREGVSDYLTDCGYETIEAADGQEALEQFSSYEVALVLLDIQMPKLNGL   60

Query:   64  EVLKEIRKKSNLPILILTAFSDEEYKIDAFTNLVDGYVEKPFSLPVLKARIDSLIKKNFG  123
             EVL EIRK S +P+L+LTAF DEEYK+ AF +L DGY+EKPFSL +LK R+D++ K+ +
Sbjct:   61  EVLAEIRKTSQVPVLMLTAFQDEEYKMSAFASLADGYLEKPFSLSLLKVRVDAIFKRYYD  120

Query:  124  HLEKFEYKNLSVNFNSYTAKINDEKIDVNAKELEILKCLLDNDGQVLTRMQIIDYVWKDS  183
                F YK+  V+F SY+A + +++  +NAKELEIL  L+ N+G+ LTR QIID VWK +
Sbjct:  121  TGRIFSYKDTKVDFESYSASLAGQEVPINAKELEILDYLVKNEGRALTRSQIIDAVWKAT  180

Query:  184  EEIPYDRVVDVYIKELRKKLQLDCITTIRNVGYKLERK                       221
             +E+P+DRV+DVYIKELRKKL LDCI T+RNVGYKLERK
Sbjct:       DEVPFDRVIDVYIKELRKKLDLDCILTVRNVGYKLERK                       218
  181
```

A related DNA sequence was identified in *S. pyogenes* <SEQ ID 1345> which encodes the amino acid sequence <SEQ ID 1346>. Analysis of this protein sequence reveals the following:

```
Possible site: 60
>>> Seems to have no N-terminal signal sequence
INTEGRAL      Likelihood = –2.60    Transmembrane 48-64 (48-64)
----- Final Results -----
    bacterial membrane --- Certainty = 0.2041 (Affirmative) <succ>
      bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP:AAF72358 GB:AF192329 VanRB [Enterococcus faecalis]
Identities = 88/215 (40%), Positives = 128/215 (58%), Gaps = 2/215 (0%)
Query:    3  KILVVEDDDTISQVICEFLKANNYDPDCVFDGQAALDKWQTTSYDLIILDIMLPSLSGLE   62
             +IL+VEDDD I   + FL    Y D  DG A  K+    +Y L+ILDIMLP ++G E
Sbjct:    4  RILLVEDDDHICNTVRGFLAEAGYQVDACTDGNEAYTKFYENTYQLVILDIMLPGMNGHE   63

Query:       VLKTIRKTSDVPIIMLTALDDEYTQLVSFNHLISDYVTKPFSPLILIKRIENVLRVSTPD  122
   63
             +L+  R  +D PI+M+TAL D+ Q+ +F+   DYVTKPF   IL+KR+E +LR S
Sbjct:   64  LLREFRAKNDTPILMMTALSDDENQIRAFDAEADDYVTKPFKMQILLKRVEALLRRSGAL  123

Query:  123  EKR-QIGDLLVDETEHSVYWQGTLVKLTKKEYDIIDYLAKRHQKIVTRDQLMDDIWGYS-  180
             K   ++G L +   + +V   GT + LT+KE++I+  L +   +T + ++  IWGY
Sbjct:  124  AKEIRVGRLTLLPEDFTVLCDGTELPLTRKEFEILLLLVQNKGRTLTHEIILSRIWGYDF  183

Query:  181  ELDTRVLDNHIKNLRKKMTGIPLKTITGMGYLLGE                          215
             E D   + HIKNLR K+    +KTI G+GY L E
Sbjct:  184  EGDGSTVHTHIKNLRAKLPENIIKTIRGVGYRLEE                          218
```

An alignment of the GAS and GBS proteins is shown below:

```
Identities = 80/214 (37%), Positives = 126/214 (58%), Gaps = 4/214 (1%)
Query:    6  KILTVEDDKLIREGISEYLSEFGYTVIQAKDGREALSKFNS-DINLVILDIQIPFINGLE   64
             KIL VEDD  I + I E+L    Y       DG+ AL K+ +    +L+ILDI +P ++GLE
Sbjct:    3  KILVVEDDDTISQVICEFLKANNYDPDCVFDGQAALDKWQTTSYDLIILDIMLPSLSGLE   62

Query:   65  VLKEIRKKSNLPILILTAFSDEEYKIDAFTNLVDGYVEKPFSLPVLKARIDSLIKKNFGH  124
             VLK IRK S++PI++LTA DE  ++ +F +L+  YV KPFS  +L  RI+++++++ +
Sbjct:   63  VLKTIRKTSDVPIIMLTALDDEYTQLVSFNHLISDYVTKPFSPLILIKRIENVLRVSTPD  122

Query:  125  LEKFEYKNLSVNFNSYTAKINDEKIDVNAKELEILKCLLDNDGQVLTRMQIIDYVWKDSE  184
              EK  +L V+    ++         + + KE+I+    L    +++TR Q++D +W  SE
Sbjct:  123  -EKRQIGDLLVDETEHSVYWQGTLVKLTKKEYDIIDYLAKRHQKIVTRDQLMDDIWGYSE  181

Query:  185  EIPYDRVVDVYIKELRKKLQLDCITTIRNVGYKL                            218
                 RV+D +IK LRKK+    + TI  +GY L
Sbjct:  182  --LDTRVLDNHIKNLRKKMTGIPLKTITGMGYLL                            213
```

Based on this analysis, it was predicted that these proteins and their epitopes could be useful antigens for vaccines or diagnostics.

Example 415

A DNA sequence (GBSx0451) was identified in *S. agalactiae* <SEQ ID 1347> which encodes the amino acid sequence <SEQ ID 1348>. This protein is predicted to be Vexp3. Analysis of this protein sequence reveals the following:

```
Possible site: 49
>>> Seems to have an uncleavable N-term signal seq
INTEGRAL    Likelihood = -12.68   Transmembrane 423-439 (413-447)
INTEGRAL    Likelihood = -10.67   Transmembrane 16-32 (12-37)
INTEGRAL    Likelihood = -9.77    Transmembrane 303-319 (301-326)
INTEGRAL    Likelihood = -3.13    Transmembrane 343-359 (343-367)
----- Final Results -----
    bacterial membrane --- Certainty = 0.6074 (Affirmative) <succ>
      bacterial outside --- Certainty = 0.0000 (Not Clear) <succ>
        bacterial cytoplasm --- Certainty = 0.0000 (Not Clear) <succ>
```

```
Possible site: 31
>>> Seems to have no N-terminal signal sequence
INTEGRAL    Likelihood = -12.90   Transmembrane 19-35 (16-43)
INTEGRAL    Likelihood = -7.27    Transmembrane 371-387 (359-392)
INTEGRAL    Likelihood = -7.01    Transmembrane 335-351 (326 -357)
INTEGRAL    Likelihood = -6.21    Transmembrane 282-298 (276-308)
----- Final Results -----
    bacterial membrane --- Certainty = 0.6158 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the GENPEPT database:

The protein has homology with the following sequences in the databases:

```
>GP: AAD47594 GB:AF140784 Vexp3 [Streptococcus pneumoniae]
Identities = 280/458 (61%), Positives = 363/458 (79%), Gaps = 3/458 (0%)
Query:    1 MIKNAFAYVTRKSLKSLIIILVILSMATLSIISLSIKDATDRASKETFANITNSFSMEIN    60
            M+ NAFAYVTRK  KS++I L+IL MA+LS++ LSIK AT +AS+ETF NITNSFSM+IN
Sbjct:    1 MLHNAFAYVTRKPFFKSIVIFLIILLMASLSLVGLSIKGATAKASQETFKNITNSFSMQIN    60

Query:   61 RQVNPGTPRGGGNVKGEDIKKISQTNSIDSYVKRINSVADLVDHDIIETQDTLANQSPER  120
            R+VN GTPRG GN+KGEDIKKI++  +I+SYVKRIN++ DL  +D+IET +T  N + +R
Sbjct:   61 RRVNQGTPRGAGNIKGEDIKKITENKAIESYVKRINAIGDLTGYDLIETPETKKNLTADR  120

Query:  121 AKNFKRTVMLTGVNDSAKETKFVSEAYKLVEGKHLENKDKNKILMHKDLAKKNNLKVGDK  180
            AK F ++M+TGVNDS+KE  KFVS +YKLVEG+HL N DK+KIL +HKDLA K+  KVGDK
Sbjct:  121 AKRFGSSLMITGVNDSSKEDKFVSGSYKLVEGEHLTNDDKDKILLHKDLAAKHGWKVGDK  180

Query:  181 IKIKSNLFDADNEKVANETVEVEIKGLFDGHNSGGVSAAQELYENTLITDVHSAAKVYGN  240
            +K+ SN++DADNEK A ETVEV IKGLFDGHN   V+ +QELYENT ITD+H+AAK+YG
Sbjct:  181 VKLDSNIYDADNEKGAKETVEVTIKGINDGHNKSAVTYSQELYENTAITDIHTAAKLYGY  240

Query:  241 TEDTAVYQDATFFVKGDKNLDSVIKDL-GKLDINWREYNLIKSSSNYPALQQSISGIYSI  299
            TEDTA+Y DATFFV  DKNLD V+K+L G    INW+ Y L+KSSSNYPAL+QSISG+Y +
Sbjct:  241 TEDTAIYGDATFFVTADKNLDDVMKELNGISGINWKSYTLVKSSSNYPALEQSISGMYKM  300

Query:  300 SNKLFVGSLIFAGVVVSLLLFLWMNARKKEIAVLLSLGISKLEIFGQFIIEMVFISIPAL  359
            +N LF GSL F+ ++++LLL LW+NAR+KE+ +LLS+G+ +  I GQFI E + I+IPAL
Sbjct:  301 ANLLFWGSLSFSVLLLALLLSLWINARRKEVGILLSIGLKQASILGQFITESILIAIPAL  360

Query:  360 LGSYFLAQYTADKLGNNILNKVTGDIAKQIARQSASSQLGGGAEAEGFNKTLSGLDINV-  418
            + +YFLA YTA +GN +L  VT  +AKQ ++ + +S LGGGAE +GF+KTLS LDI++
Sbjct:  361 VSAYFLANYTARAIGNTVLANVTSGVAKQASKAAQASNLGGGAEVDGFSKTLSSLDISIQ  420

Query:  419 LPKFIIYVVIFMSFVLLVSLILSSIYTLRKNPKELLID                       456
                 FII V+ +  V+LV + L+S   LRK PKELL+D
Sbjct:  421 TSDFIIIFVLALVLVVLV-MALASSNLLRKQPKELLLD                       457
```

A related DNA sequence was identified in *S. pyogenes* <SEQ ID 1349> which encodes the amino acid sequence <SEQ ID 1350>. Analysis of this protein sequence reveals the following:

```
>GP:AAC24912 GB:AF012285 YknZ [Bacillus subtilis]
Identities = 176/408 (43%), Positives = 250/408 (61%), Gaps = 16/408 (3%)
Query:    1 MENWKFALSSIWGHKMRSILTMLGIIIGVAAVVIIMGLGNAMKNSVTSTESSKQKDIQLY   60
            +EN + ALSS+  HKMRSILTMLGIIIGV +V++++ +G  +  + + S     ++LY
Sbjct:    4 LENIRMALSSVLAHKMRSILTMLGIIIGVGSVIVVVAVGQGGEQMLKQSISGPGNTVELY   63

Query:   61 FQEKGEE--EDLYAGLHTHENNHEVKPEWLEQIVKDIDGIDSYYFTNSATSTISYEKKKV  118
            +       EE   + A +     +++K     +K I+GI     + S +   Y +++
```

```
                     -continued
Sbjct:  64 YMPSDEELASNPNAAAESTFTENDIKG------LKGIEGIKQVVASTSESMKARYHEEET 117

Query: 119 DNASIIGVSKDYFNIKNYDIVAGRTLTDNDYSNFSRIILLDTVLADDLFGKGNYKSALNK  178
           D A++ G++  Y N+ +  I +GRT TDND+   +R+ ++   +A +LF K    S L +
Sbjct: 118 D-ATVNGINDGYMNVNSLKIESGRTFTDNDFLAGNRVGIISQKMAKELFDK---TSPLGE  173

Query: 179 VVSLSDKDYVIGVYKTDQTPVSFDGLSGGAVMANTQVASEFGTKEIGSIYIHVNDIQNS   238
           VV ++ +  +IGV K     +SFD LS    V  N  + S FGT +  ++ + V   +
Sbjct: 174 VVWINGQPVEIIGVLKKVTGLLSFD-LSEMYVPFN-MMKSSFGTSDFSNVSLQVESADDI  231

Query: 239 MNLGNQAADMLTNISHIKDGQYAVPDNSKIVEEINSQFSIMTTVIGSIAAISLLVGGIGV  298
             + G +AA  L N +H  + Y V +  +I   I   +IMTT+IGSIA ISLLVGGIGV
Sbjct: 232 KSAGKEAAQ-LVNDNHGTEDSYQVMNMEEIAAGIGKVTAIMTTIIGSIAGISLLVGGIGV  290

Query: 299 MNIMLVSVTERTREIGLRKALGATRLKILSQFLIESVVLTVLGGLIGLLLAQLSVGALGN  358
           MNIMLVSVTERTREIG+RK+LGATR +IL+QFLIESVVLT++GGL+G+ +     AL +
Sbjct: 291 MNIMLVSVTERTREIGIRKSLGATRGQILTQFLIESVVLTLIGGLVGIGIG-YGGAALVS  349

Query: 359 AMTLKGACISLDVALIAVLFSASIGVFFGMLPANKASKLDPIEALRYE              406
           A+   + IS V    VLFS  IGV FGMLPANKA+KLDPIEALRYE
Sbjct: 350 AIAGWPSLISWQVVCGGVLFSMLIGVIEGMLPANKAAKLDPIEALRYE              397
```

An alignment of the GAS and GBS proteins is shown below:

```
Identities = 56/247 (22%), Positives = 101/247 (40%), Gaps = 42/247 (17%)
Query: 147 YKLVEGKHLENKDKNKI--------LMHKDLAKKNNLK--------VGDKIKIKSNLFDA  190
           Y +V G+ L + D +          ++ DL  K N K         + DK  +   ++
Sbjct: 136 YDIVAGRTLTDNDYSNFSRIILLDTVLADDLFGKGNYKSALNKVVSLSDKDYLVIGVYKT  195

Query: 191 DNEKVANETVEVEIKGLFDGHNSGGVSAAQELYENTLITDVHSAAKVYGNTEDTAVYQDA  250
           D    V+           FDG + G V A     NT +       A  +G  E   ++Y
Sbjct: 196 DQTPVS-----------FDGLSGGAVMA------NTQV------ASEFGTKEIGSIYIHV  232

Query: 251 TFFVKGDKNLDSVIKDL--GKLDINWREYNLIKSSSNYPALQQSISGIYSISNKLFVGSL  308
                ++  NL +   D+   I   +Y +  +S      +   S + ++   +    SL
Sbjct: 233 ND-IQNSMNLGNQAADMLTNISHIKDGQYAVPDNSKIVEEINSQFSIMTTVIGSIAAISL  291

Query: 309 IFAGVVVSLLLFLWMNARKKEIAVLLSLGISKLEIFGQFIIEMVFISIPALLGSYFLAQY  368
           +  G+ V  ++ + +  R +EI +  +LG    ++L+I  QF+IE V +++    L    LAQ
Sbjct: 292 LVGGIGVMNIMLVSVTERTREIGLRKALGATRLKILSQFLIESVVLTVLGGLIGLLLAQL  351

Query: 369 TADKLGN                                                       375
           +  LGN
Sbjct: 352 SVGALGN                                                       358
```

Based on this analysis, it was predicted that these proteins and their epitopes could be useful antigens for vaccines or diagnostics.

Example 416

A DNA sequence (GBSx0452) was identified in *S. agalactiae* <SEQ ID 1351> which encodes the amino acid sequence <SEQ ID 1352>. This protein is predicted to be Vexp2 (b0879). Analysis of this protein sequence reveals the following:

Possible site: 16
>>> Seems to have no N-terminal signal sequence

----- Final Results -----
bacterial cytoplasm --- Certainty = 0.3194 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database:

```
>GP:AAD47593 GB:AF140784 Vexp2 [Streptococcus pneumoniae]
Identities = 142/207 (68%), Positives = 169/207 (81%)
Query:   1 MDILEIKNVNYSYANSKEKVLSGVNQKFELGKFYAIVGKSGTGKSTLLSLLAGLDKVQTG   60
           M +L++++V Y Y N+ E VL  +N  FE GKFY+I+G+SG GKSTLLSLLAGLD     G
Sbjct:   1 MTLLQLQDVTYRYKNTAEAVLYQINYNFEPGKFYSIIGESGAGKSTLLSLLAGLDSPVEG   60

Query:  61 KILFKNEDIEKKGYSNHRKNNISLVFQNYNLIDYLSPIENIRLVNKSVDESILFELGLDK  120
            ILF+ EDI KKGYS HR+ ++ISLVFQNYNLIDYLSP+ENIRLVNK   ++ L ELGLD+
Sbjct:  61 SILFQGEDIRKKGYSYHRMHHISLVFQNYNLIDYLSPLENIRLVNKKASKNILLELGLDE  120
```

```
Query: 121 KQIKRNVNKLSGGQQQRVAIARALVSDAPIILADEPTGNLDSVTAGEIINILKELAQDRN 180
            QIKRNV++LSGGQQQRVAIAR+LVS+AP+ILADEPTGNLD  TAG+I+ +LK LAQ
Sbjct: 121 SQIKRNVLQLSGGQQQRVAIARSLVSEAPVILADEPTGNLDPKTAGDIVELLKSLAQKTG 180

Query: 181 KCVIVVTHSKEVADSADIILELSGKKL                                  207
            KCVIVVTHSKEVA ++DI LEL  KKL
Sbjct: 181 KCVIVVTHSKEVAQASDITLELKDKKL                                  207
```

A related DNA sequence was identified in *S. pyogenes* <SEQ ID 1353> which encodes the amino acid sequence <SEQ ID 1354>. Analysis of this protein sequence reveals the following:

---

Possible site: 47
>>> Seems to have no N-terminal signal sequence
----- Final Results -----
   bacterial cytoplasm --- Certainty = 0.2717 (Affirmative) <succ>
    bacterial membrane --- Certainty = 0.0000 (Not Clear) <succ>
     bacterial outside --- Certainty = 0.0000 (Not Clear) <succ>

---

An alignment of the GAS and GBS proteins is shown below:

```
Identities = 83/230 (36%), Positives = 135/230 (58%), Gaps = 13/230 (5%)
Query:   1 MDILEIKNVNYSYANSKEKVLSGVNQKFEL--GKFYAIVGKSGTGKSTLLSLLAGLDKVQ   58
           M +E+K V+ SY   + V +    FE+  G+   I+G SG GKST+L++L G+D V
Sbjct:   5 MAFIELKQVSKSYQIGETTVFANHEVSFEINKGELVVILGASGAGKSTVLNILGGMDTVD   64

Query:  59 TGKILFKNEDIE---KKGYSNHRKNNISLVFQNYNLIDYLSPIENIRLVNKSVDES----  111
           G+++   +DI     K  + +R+N I   VFQ YNL+  L+  EN+ L  + V ++
Sbjct:  65 AGQVIIDGKDIAHYTSKALTQYRRNAIGFVFQFYNLVPNLTAKENVELAVEIVADALDPV  124

Query: 112 -ILFELGLDKKQIKRNVMKLSGGQQQRVAIARALVSDAPIILADEPTGNLDSVTAGEIIN  170
            IL E+GL + +     +LSGG+QQRV+IARAL  +  ++L DEPTG LD  T  +I+
Sbjct: 125 TILKEVGLSHR-LDHFPAQLSGGEQQRVSIARALAKNPKLLLCDEPTGALDYQTGKQILT  183

Query: 171 ILKELAQDRNKCVIVVIHSKEVADSADIILELSGKKLKK--VNKMNLEVE            218
           +L+++AQ +   V++VTH+ +A  AD ++ +   ++ K  +NK    +E
Sbjct: 184 LLQDMAQTKGTIVVIVIHNAAIAPIADRVIFMHDAQVTKTVINKEPASIE            233
```

Based on this analysis, it was predicted that these proteins and their epitopes could be useful antigens for vaccines or diagnostics.

Example 417

A DNA sequence (GBSx0453) was identified in *S. agalactiae* <SEQ ID 1355> which encodes the amino acid sequence <SEQ ID 1356>. Analysis of this protein sequence reveals the following:

---

Possible site: 25
>>> Seems to have an uncleavable N-term signal seq
INTEGRAL    Likelihood = –3.35    Transmembrane 17-33 ( 17-34)
----- Final Results -----
   bacterial membrane --- Certainty = 0.2338 (Affirmative) <succ>
    bacterial outside --- Certainty = 0.0000 (Not Clear) <succ>
     bacterial cytoplasm --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 418

A DNA sequence (GBSx0454) was identified in *S. agalactiae* <SEQ ID 1357> which encodes the amino acid sequence <SEQ ID 1358>. This protein is predicted to be Vexp1. Analysis of this protein sequence reveals the following:

---

Possible site: 56
>>> Seems to have an uncleavable N-term signal seq
INTEGRAL    Likelihood = –11.52    Transmembrane 294-310 (285-312)
INTEGRAL    Likelihood = –10.67    Transmembrane 396-412 (385-417)
INTEGRAL    Likelihood = –8.76    Transmembrane 17-33 (14-38)
INTEGRAL    Likelihood = –4.14    Transmembrane 335-351 (333-357)
----- Final Results -----
   bacterial membrane --- Certainty = 0.5607 (Affirmative) <succ>
    bacterial outside --- Certainty = 0.0000 (Not Clear) <succ>
     bacterial cytoplasm --- Certainty = 0.0000 (Not Clear) <succ>

---

The protein has homology with the following sequences in the GENPEPT database:

```
GP:AAD47592 GB:AF140784 Vexp1 [Streptococcus pneumoniae]
Identities = 165/425 (38%), Positives = 271/425 (62%), Gaps = 4/425 (0%)
Query:    2 IKNAIAYITRKKNRTLIIFAILTIVLSCLYSCLTIMKSSNEIEKALYESSNSSISITK-K   60
            I+ +  AY++RK+ R+ I+F IL ++L+ + +CLT+MKS+  +E  LY+S N+S  K  +
Sbjct:    4 IQRSWAYVSRKRLRSFILFLILLVLLAGISACLTLMKSNKTVESNLYKSLNTSFSIKKIE   63
```

-continued

```
Query:   61 DGKYFNINQFKNIEKIKEVEEKIFQYDGLAKLKDLKVVSGEQSINREDLSDEFKNVVSLE 120
             +G+ F ++   ++ KIK +E    + + +AKLKD + V+GEQS+ R+DLS    N+VSL
Sbjct:   64 NGQTFKLSDLASVSKIKGLENVSPELETVAKLKDKEAVTGEQSVERDDLSAADNNLVSLT 123

Query:  121 ATSNTKRNLLFSSGVFSFKEGKNIEENDKNSILVHEEFAKQNKLKLGDEIDLELLDTEKS 180
             A ++  +++ F+S  F+ KEG+++++ D    IL+HEE AK+N L L D+I L+   +E S
Sbjct:  124 ALEDSSKDVTFTSSAFNLKEGRHLQKGDSKKILIHEELAKKNGLSLHDKIGLDAGQSE-S 182

Query:  181 GKIKSHKFKIIGIFSGKKQETYTGLSSDFSENMVFVDYSTSQEILNKSENNRIANKILMY 240
             GK ++ +F+IIGIFSGKKQE +TGLSSDFSEN VF DY +SQ +L  SE    A +   Y
Sbjct:  183 GKGQTVEFEIIGIFSGKKQEKFTGLSSDFSENQVFTDYESSQTLLGNSEAQVSAARF--Y 240

Query:  241 SGSLESTELALNKLKDFKIDKSKYSIKKDNKAFEESLESVSGIKHIIKINTYSIMLGGIV 300
              + +  +  + ++++  ++    Y ++K+NKAFE+   +SV+  +  + I  Y +++ G
Sbjct:  241 VENPKEMDGLMKQVENLALENQGYQVEKENKAFEQIKDSVATFQTFLTIFLYGMLIAGAG 300

Query:  301 VLSLILILWLRERIYEIGIFLSIGTTKIQIIRQFIFELIFISIPSIISSLFLGNLLLKVI 360
              L L+L LWLRER+YE+GI L++G K  I   QF  E++ +S+ +++ +    GN +    +
Sbjct:  301 ALILVLSLWLRERVYEVGILLALGKGKSSIFLQFCLEVVLVSLGALLPAFVAGNAITTYL 360

Query:  361 VEGFINSENSMIFGGSLINKSSFMLNITTLAESYLILISIIVLSVVMASSLILFKKPKEI 420
              ++  + S +       +L   SS    +I +  AESY+ L+ +   LSV +      + K PKEI
Sbjct:  361 LQTLLASGDQASLQDTLAKASSLSTSILSFAESYVFLVLLSCLSVALCFLFLFRKSPKEI 420

Query:  421 LSKIS                                                       425
             LS IS
Sbjct:  421 LSSIS                                                       425
```

A related DNA sequence was identified in *S. pyogenes* <SEQ ID 1359> which encodes the amino acid sequence <SEQ ID 1360>. Analysis of this protein sequence reveals the following:

---

Possible site: 15
>>> Seems to have an uncleavable N-term signal seq
INTEGRAL    Likelihood = −11.57   Transmembrane 23-39 (16-43)
INTEGRAL    Likelihood = −11.36   Transmembrane 371-387 (362-396)
INTEGRAL    Likelihood = −8.12    Transmembrane 331-347 (324-360)
INTEGRAL    Likelihood = −7.70    Transmembrane 280-296 (277-308)
----- Final Results -----
  bacterial membrane --- Certainty = 0.5628 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the databases:

```
>GP:AAB97962 GB:U96166 ATP-binding cassette transporter-like protein
[Streptococcus cristatus]
Identities = 222/311 (71%), Positives = 278/311 (89%)
Query:   16 MRSILTMLGIIIGIGAIIAIFSIIEGNTENTKRQLIGGSNNTINIVFNKKSSIDPKFPDK 75
             MRS+LTMLGIIIGIGAIIAIFSIIEGNTENTKRQLIGGSNNTI +V++KKS+IDP  P+K
Sbjct:    1 MRSMLTMLGIIIGIGAIIAIFSIIEGNTENTKRQLIGGSNNTIKVVYDKKSAIDPSIPEK 60

Query:   76 SNAKKPDYLPFMAEEELSKIQQVKGVKNALISYGIDDKVYHLGQKSSAKISAITKNVAEV 135
             S A+KP Y+PFM E+ LSKI+++ GVKNAL++YG D+K+Y+L QKSS+K+ A++++VA++
Sbjct:   61 SQAQKPSYIPFMGEDVLSKIKEIPGVKNALMTYGADEKIYYLSQKSSSKVQAVSQSVADI 120

Query:  136 RRMTFIKGSDFSDKDFIDQKQVIYLEKSLYESLFPKDDGLGKFVEVMGNPFRVIGVFESK 195
                ++   ++G  F  + F +Q+QV YLEKSLY++LFPK DG+GK+VEV GNPF+VIGVFES
Sbjct:  121 KQQRLLEGEGFDSEAFKNQEQVAYLEKSLYDTLFPKDGIGKYVEVKGNPFKVIGVFEST 180

Query:  196 EQSGLTSGTEKIAYIPLHQWYNINGVVDATPEITIQTYRADDLKPVAKRVSDMLNQTIPK 255
             EQSGLTSG EK+AYIPL QW+ I    ++ +PE+T+QT++ADDLK VAK+VSD LNQ +P+
Sbjct:  181 EQSGLTSGSEKVAYIPLQQWHRIFDTINVSPEVTVQTHKADDLKKVAKKVSDYLNQQMPQ 240

Query:  256 SDYMFGVMNLKEFERQLDNLNKSNFVLLAGIASISLIVGGIGVMNIMLVSVTERTREIGI 315
             SDYMFGV+NL+EFERQLDNLN+SNFVLLAGIASISL+VGGIGVMNIMLVSVTERTREIGI
Sbjct:  241 SDYMFGVLNLQEFERQLDNLNQSNFVLLAGIASISLLVGGIGVMNIMLVSVTERTREIGI 300

Query:  316 KKALGARRKLI                                                 326
             KKALGARRK++
Sbjct:  301 KKALGARRKIL                                                 311
```

An alignment of the GAS and GBS proteins is shown below:

```
Identities = 79/386 (20%), Positives = 170/386 (43%), Gaps = 38/386 (9%)
Query:    5 AIAYITRKKNRTLIIFAILTIVLSCLYSCLTIMKSSNE-IEKALYESSNSSISITKKDGK  63
            A++  I     K R+++     + I  +  + ++I++   + E   A++ L    SN++I+I
Sbjct:    7 ALSSILSHKMRSILTMLGIIIGIGAIIAIFSIIEGNTENTKRQLIGGSNNTINIV-----  61

Query:   64 YFNINQFKNIEKIKEVEEKIFQYDGLAKLKDLKVVSGEQSINREDLSDEFKNVVSLEATS 123
            FN         K    ++ K F      AK D          E+ +++         KN  +
Sbjct:   62 -FN--------KKSSIDPK-FPDKSNAKKPDYLPFMAEEELSKIQQVKGVKNALISYGID 111

Query:  124 NTKRNLLFSSGVFSFKEGKNIEENDKNSILVHEEFAKQNKLKLGDEIDLELLDTE---- 178
            +     +L   S           KN+ E  + + +   +F+ ++ +      I LE      E
Sbjct:  112 DKVYHLGQKSSAKISAITKNVAEVRRMTFIKGSDFSDKDFIDQKQVIYLEKSLYESLFPK 171

Query:  179 -----KSGKIKSHKFKIIGIFSGKKQETYTGLSSDFSENMVFVDYSTSQEILNKSENNRI 233
                    K  ++   +  F++IG+F   K+Q      +GL+S   +E  +  ++         I   +
Sbjct:  172 DDGLGKFVEVMGNPFRVIGVFESKEQ---SGLTSG-TEKIAYIPLHQWYNINGVVDATPE 227

Query:  234 ANKILMYSGSLESTELALNKLKDFKIDKSKYSIKKDN-KAFEESLESVSGIKHIIK--IM 290
                       + L+       ++  + +   I KS  Y       N K FE    L++++      ++    I
Sbjct:  228 ITIQTYRADDLKPVAERVSDMLNQTIPKSDYMFGVMNLKEFERQLDNLNKSNFVLLAGIA 287

Query:  291 TYSIMLGGIVVLSLILILWLRERIYEIGIFLSIGTTKIQIIRQFIFELIFIS----IPSI 346
                 + S+++GGI V++++L+  + ER  EIGI  ++G  +  I++QF+ E + ++      +  +
Sbjct:  288 SISLIVGGIGVMNIMLVS-VTERTREIGIKKALGARRKLILKQFLIEAVILTLLGGVIGV 346

Query:  347 ISSLFLGNLLLKVIVEGFINSENSMI                                   372
            IS +  G ++ + +    +I S   S++
Sbjct:  347 ISGMVSGLIITRSLEYPYILSLFSVV                                   372
```

A related GBS gene <SEQ ID 8571> and protein <SEQ ID 8572> were also identified. Analysis of this protein sequence reveals the following:

Lipop Possible site: −1  Crend: 10
McG: Discrim Score: 5.59
GvH: Signal Score (−7.5): −5.97
Possible site: 56
>>> Seems to have an uncleavable N-term signal seq
ALOM program count: 4  value: −11.52  threshold: 0.0
INTEGRAL    Likelihood = −11.52   Transmembrane 294-310 (285-312)
INTEGRAL    Likelihood = −10.67   Transmembrane 396-412 (385-417)
INTEGRAL    Likelihood = −8.76    Transmembrane 17-33 (14-38)
INTEGRAL    Likelihood = −4.14    Transmembrane 335-351 (333-357)

PERIPHERAL   Likelihood = 4.51    315
modified ALOM score: 2.80
*** Reasoning Step: 3
----- Final Results -----
  bacterial membrane --- Certainty = 0.5607 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
38.7/67.3% over 421aa
Streptococcus pneumoniae
GP|5712667|Vexp1 Insert characterized
ORF00815(304-1575 of 1875)
GP|5712667|gb|AAD47592.1|AF140784_1|AF140784(4-425 of 425) Vexp1 {Streptococcus
pneumoniae}
% Match = 25.0
% Identity = 38.7 % Similarity = 67.2
Matches = 164 Mismatches = 136 Conservative Sub.s = 121
  48        78        108       138       168       198       228       258
SIEH*VVEDNKTI*T*ELDFVSHSS**VI*DFPLNK*IRNSVTSYINGSIIEIVCQMKXF*WK*F*KH*L*AM*KY*SSG 288       318       348       378       408       438       468       495
CNSCGVKIERSN*EVIKNAIAYITRKKNRTLIIFAILTIVLSCLYSCLTIMKSSNEIEKALYESSNSSISITK-KDGKYF
                    |: : ||::||:  |::|:| ||  ::|: :  :|||:|||:    :|    ||:| |:| || |  ::|:  |
            MNPIQRSWAYVSRKRLRSFILFLILLVLLAGISACLTMKSNKTVESNLYKSLNTSFSIKKIENGQTF
                         10        20        30        40        50        60

525       555       585       615       645       675       705       735
NINQFKNIEKIKEVEEKIFQYDGLAKLKDLKVVSGEQSINREDLSDEFKNVSLEATSNTKRNLLFSSGVFSFKEGKNIE
::  :  : :: |||  :|     :    :  :|||||  : |:|||| |:|||     |:|||  |   : :::  |:|   |::|||||::::
KLSDLASVSKIKGLENVSPELETVAKLKDKEAVTGEQSVERDDLSAADNNLVSLTALEDSSKDVTFTSSAFNLKEGRHLQ
           80        90        100       110       120       130       140
```

-continued

```
     765       795       825       855       885       915       945       975
ENDKNSILVHEEFAKQNKLKLGDEIDLELLDTEKSGKIKSHKFKIIGIFSGKKQETYTGLSSDFSENMVFVDYSTSQEIL
 :|   ||:|||:||:|  |  |  |:|  |:    :|  |||   ::   :|:||||||||||| :||||||||||| || || :|| :|
KGDSKKILIHEELAKKNGLSLHDKIGLDAGQSE-SGKGQTVEFEIIGIFSGKQEKFTGLSSDFSENQVFTDYESSQTLL
         160       170       180       190       200       210       220

1005      1035      1065      1095      1125      1155      1185      1215
NKSENNRIANKILMYSGSLESTELALNKLKDFKIDKSKYSIKKDNKAFEESLESVSGIKHIIKIMTYSIMLGGIVVLSLI
  ||    :    |   : :  : :::::  ::    |  ::|:|||||  :||:    |   |  : |  | |  ::  |   | |:
GNSEA--QVSAARFYVENPKEMDGLMKQVENLALENQGYQVEKENKAFEQIKDSVATFQTFLTIFLYGMLIAGAGALILV
         240       250       260       270       280       290       300

1245      1275      1305      1335      1365      1395      1425      1455
LILWLRERIYEIGIFLSIGTTKIQIIRQFIFELIFISIPSIISSLFLGNLLLKVIVEGFINSENSMIFGGSLINKSSFML
|  ||||||:||:||:|::|  |   |   ||  :|:::::|:  :::  ::   ||  :     :::  ::  |  :   :|    ||:
LSLWLRERVYEVGILLALGKGKSSIFLQFCLEVVLVSLGALLPAFVAGNAITTYLLQTLLASGDQASLQDTLAKASSLST
         320       330       340       350       360       370       380

1485      1515      1545      1575      1605      1635      1665      1695
NITTLAESYLILISIIVLSVVMASSLILFKKPKEILSKIS*EQIMDILEIKNVNYSYANSKEKVLSGVNQKFELGKFYAI
 :|  :: ||||: |: :   ||| :    ::: | |||||| ||
SILSFAESYVFLVLLSCLSVALCFLFLFRKSPKEILSSIS
         400       410       420
```

Based on this analysis, it was predicted that these proteins and their epitopes could be useful antigens for vaccines or diagnostics.

Example 419

A DNA sequence (GBSx0455) was identified in *S. agalactiae* <SEQ ID 1361> which encodes the amino acid sequence <SEQ ID 1362>. Analysis of this protein sequence reveals the following:

Possible site: 42
>>> Seems to have an uncleavable N-term signal seq
INTEGRAL      Likelihood = −5.04    Transmembrane 19-35 (14-42)
----- Final Results -----
  bacterial membrane --- Certainty = 0.3017 (Affirmative) <succ>
    bacterial outside --- Certainty = 0.0000 (Not Clear) <succ>
    bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 420

A DNA sequence (GBSx0456) was identified in *S. agalactiae* <SEQ ID 1363> which encodes the amino acid sequence <SEQ ID 1364>. Analysis of this protein sequence reveals the following:

Possible site: 26
>>> Seems to have an uncleavable N-term signal seq
----- Final Results -----
  bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 421

A DNA sequence (GBSx0457) was identified in *S. agalactiae* <SEQ ID 1365> which encodes the amino acid sequence <SEQ ID 1366>. Analysis of this protein sequence reveals the following:

Possible site: 17
>>> Seems to have a cleavable N-term signal seq.
----- Final Results -----
  bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>

The protein has homology with the following sequences in the GENPEPT database:

```
>GP:AAA74029 GB:U30715 ORFB [Bacillus anthracis]
Identities = 33/76 (43%), Positives = 44/76 (57%), Gaps = 1/76 (1%)
Query:  11 IRRVSHACTKAGDRFYEENILNREFTATAHNQKWCTDVTYLQYGLGAKAYLSAIKDLYNG 70
           ++R         R      EN+LNR F A    N+KW TD+TYL +G        YL +I DLYN
Sbjct:  86 VKRKRRTWINGESRIVVENLLNRNFQANKPNEKWVTDITYLPFGT-EMLYLLSIMDLYNN 144

Query:  71 SIIAYEISHNNEIHLL                                              86
           IIAYEIS+  ++ L+
Sbjct: 145 EIIAYEISNRQDVTLV                                              160
```

Based on this analysis, it was predicted that this protein and its epitopes, could be useful antigens for vaccines or diagnostics.

Example 422

A DNA sequence (GBSx0458) was identified in *S. agalactiae* <SEQ ID 1367> which encodes the amino acid sequence <SEQ ID 1368>. Analysis of this protein sequence reveals the following:

```
Possible site: 27
>>> Seems to have no N-terminal signal sequence
INTEGRAL    Likelihood = –0.69    Transmembrane 10-26 (10-26)
----- Final Results -----
    bacterial membrane --- Certainty = 0.1277 (Affirmative) <succ>
      bacterial outside --- Certainty = 0.0000 (Not Clear) <succ>
        bacterial cytoplasm --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 423

A DNA sequence (GBSx0459) was identified in *S. agalactiae* <SEQ ID 1369> which encodes the amino acid sequence <SEQ ID 1370>. Analysis of this protein sequence reveals the following:

```
Possible site: 47
>>> Seems to have no N-terminal signal sequence
----- Final Results -----
    bacterial cytoplasm --- Certainty = 0.4170 (Affirmative) <succ>
      bacterial membrane --- Certainty = 0.0000 (Not Clear) <succ>
        bacterial outside --- Certainty = 0.0000 (Not Clear) <succ>
```

The protein has homology with the following sequences in the GENPEPT database:

```
>GP:AAA56999 GB:U09558 ORFA, putative Helix-Turn-Helix motif from
amino acid 21 through 42 and from amino acid 78 through
99 [Lactobacillus johnsonii]

Identities = 28/116 (24%), Positives = 59/116 (50%), Gaps = 6/116 (5%)

Query:    3 YSTLAKEQGVQGYLDGKGSLRDICKWYDISSRSVLQKWIKRYTSGEDLKATSRGYSRMKQ 62
            YST  K + V  YL+ + S++ + K Y+I    +++++W+ +    + L A S  +++
Sbjct:    4 YSTELKIEIVSKYLNHEDSIKGLAKQYNIHW-TLIRRWVDK-AKCQGLAALSVKHTKTTY 61

Query:   63 GRQATFEERVEIVNYTIAHGKDYQAAIEKFGVSYQQIYSWVRKLEKNGSQGLVDRR     118
              +  ++ +V Y + H       KF +S  Q+Y+W +K  + G   GL+ ++
Sbjct:   62 SS----DFKLNVVRYYLTHSIGVSKVAAKFNISDSQVYNWAKKFNEEGYAGLLPKQ     113
```

No corresponding DNA sequence was identified in *S. pyogenes*.

Based on this analysis, it was predicted that this protein and its epitopes, could be useful antigens for vaccines or diagnostics.

Example 424

A DNA sequence (GBSx0460) was identified in *S. agalactiae* <SEQ ID 1371> which encodes the amino acid sequence <SEQ ID 1372>. Analysis of this protein sequence reveals the following:

```
Possible site: 23
>>> Seems to have an uncleavable N-term signal seq
INTEGRAL   Likelihood = –0.69   Transmembrane 2-18 (2-19)
----- Final Results -----
    bacterial membrane --- Certainty = 0.1277 (Affirmative) <succ>
      bacterial outside --- Certainty = 0.0000 (Not Clear) <succ>
        bacterial cytoplasm --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 425

A DNA sequence (GBSx0461) was identified in *S. agalactiae* <SEQ ID 1373> which encodes the amino acid sequence <SEQ ID 1374>. This protein is predicted to be integrase (phage-relatedpr). Analysis of this protein sequence reveals the following:

```
Possible site: 28
>>> Seems to have no N-terminal signal sequence
----- Final Results -----
    bacterial membrane --- Certainty = 0.0000 (Not Clear) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the GENPEPT database:

```
>GP:AAC79517 GB:U88974 ORF1 [Streptococcus thermophilus temperate
bacteriophage O1205]
Identities = 104/172 (60%), Positives = 127/172 (73%), Gaps = 11/172 (6%)
Query:  10 QHQSYAALYLIAKTGMRFAECLGLTVNDIDYTNKYLSINKTWDYHFNQRYLPTKNKSSIR  69
           ++ SYAALY+I+KTG+RFAECLGLTV+DI      LS+NKTWDY N  ++PTK KSSIR
Sbjct: 186 EYASYAALYIISKTGIRFAECLGLTVDDIKRDTGMLSVNKTWDYKNNTGFMPTKTKSSIR 245

Query:  70 NIPIDNDTLFFLHEFTKNKNDRLFDKLSNNAVNKTIRKITGREVRVHSLRHTFASY----125
           IP+D++ + F+ +      + RL  LSNNAVNKT+RKI GREVRVHSLRHT+ASY
Sbjct: 246 EIPLDDEFINFIDQLPPTDDGRLLPSLSNNAVNKTLRKIVGREVRVHSLRHTYASYLIAH 305

Query: 126 ---LISISQVLDHENLNITLEVYAHQLQEQKDRNDKLNQRNLGRIWGKIALN         174
              LIS+SQVL HENLNITLEVYAHQLQEQK RND+    + ++W K   N
Sbjct: 306 DIDLISVSQVLGHENLNITLEVYAHQLQEQKSRNDE----KIKQMWTKCGQN         353
```

There is also homology to SEQ ID 578

Based on this analysis, it was predicted that this protein and its epitopes, could be useful antigens for vaccines or diagnostics.

Example 426

A DNA sequence (GBSx0462) was identified in *S. agalactiae* <SEQ ID 1375> which encodes the amino acid sequence <SEQ ID 1376>. Analysis of this protein sequence reveals the following:

---

Possible site: 22
>>> Seems to have no N-terminal signal sequence
----- Final Results -----
    bacterial cytoplasm --- Certainty = 0.3206 (Affirmative) <succ>
    bacterial membrane --- Certainty = 0.0000 (Not Clear) <succ>
    bacterial outside --- Certainty = 0.0000 (Not Clear) <succ>

---

The protein has no significant homology with any sequences in the GENPEPT database, but there is homology to SEQ ID 1328.

Based on this analysis, it was predicted that this protein and its epitopes, could be useful antigens for vaccines or diagnostics.

Example 427

A DNA sequence (GBSx0463) was identified in *S. agalactiae* <SEQ ID 1377> which encodes the amino acid sequence <SEQ ID 1378>. Analysis of this protein sequence reveals the following:

---

Possible site: 45
>>> Seems to have no N-terminal signal sequence
----- Final Results -----
    bacterial cytoplasm --- Certainty = 0.6542 (Affirmative) <succ>
    bacterial membrane --- Certainty = 0.0000 (Not Clear) <succ>
    bacterial outside ---Certainty = 0.0000 (Not Clear) <succ>

---

The protein has homology with the following sequences in the GENPEPT database:

No corresponding DNA sequence was identified in *S. pyogenes*.

Based on this analysis, it was predicted that this protein and its epitopes, could be useful antigens for vaccines or diagnostics.

Example 428

A DNA sequence (GBSx0464) was identified in *S. agalactiae* <SEQ ID 1379> which encodes the amino acid sequence <SEQ ID 1380>. Analysis of this protein sequence reveals the following:

---

Possible site: 41
>>> Seems to have no N-terminal signal sequence
----- Final Results -----
    bacterial cytoplasm --- Certainty = 0.4417 (Affirmative) <succ>
    bacterial membrane --- Certainty = 0.0000 (Not Clear) <succ>
    bacterial outside --- Certainty = 0.0000 (Not Clear) <succ>

---

The protein has no significant homology with any sequences in the GENPEPT database, but there is homology to SEQ ID 1332.

Based on this analysis, it was predicted that this protein and its epitopes, could be useful antigens for vaccines or diagnostics.

Example 429

A DNA sequence (GBSx0465) was identified in *S. agalactiae* <SEQ ID 1381> which encodes the amino acid sequence <SEQ ID 1382>. Analysis of this protein sequence reveals the following:

---

Possible site: 28
>>> Seems to have a cleavable N-term signal seq.
----- Final Results -----
    bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>

---

```
>GP:CAB52541 GB:AJ131519 hypothetical protein [Lactobacillus
bacteriophage phi adh]
Identities = 24/55 (43%), Positives = 36/55 (64%)
Query:  12 MDKELTPQEKANKKWAENNREHRTYLSKRSTARSFINKNATKEDLLELKQLIESK 66
           M K   + KANKKW E N+  + Y++KRSTA+SFI   AT+EDL +++ +   +
Sbjct:   1 MAKITEARAKANKKWDEKNKARKLYINKRSTAKSFILNLATEEDLANIEEYVAER 55
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 430

A DNA sequence (GBSx0466) was identified in *S. agalactiae* <SEQ ID 1383> which encodes the amino acid sequence <SEQ ID 1384>. Analysis of this protein sequence reveals the following:

```
Possible site: 47
>>> Seems to have no N-terminal signal sequence
INTEGRAL   Likelihood = -4.30   Transmembrane 205-221 (202-223)
INTEGRAL   Likelihood = -3.56   Transmembrane 296-312 (294-312)
----- Final Results -----
   bacterial membrane --- Certainty = 0.2720 (Affirmative) <succ>
      bacterial outside --- Certainty = 0.0000 (Not Clear) <succ>
         bacterial cytoplasm --- Certainty = 0.0000 (Not Clear) <succ>
```

A related GBS nucleic acid sequence <SEQ ID 9663> which encodes amino acid sequence <SEQ ID 9664> was also identified.

The protein has no significant homology with any sequences in the GENPEPT database.

No corresponding DNA sequence was identified in *S. pyogenes*.

A related GBS gene <SEQ ID 8573> and protein <SEQ ID 8574> were also identified. Analysis of this protein sequence reveals the following:

```
Lipop: Possible site: -1   Crend: 8
McG: Discrim Score: -8.80
GvH: Signal Score (-7.5): -4.03
Possible site: 47
>>> Seems to have no N-terminal signal sequence
ALOM program   count: 2 value: -4.30 threshold: 0.0
INTEGRAL      Likelihood = -4.30   Transmembrane 205-221 (202-223)
INTEGRAL      Likelihood = -3.56   Transmembrane 296-312 (294-312)
PERIPHERAL    Likelihood = 2.97    20
modified ALOM score: 1.36
*** Reasoning Step: 3
----- Final Results -----
   bacterial membrane --- Certainty = 0.2720 (Affirmative) <succ>
      bacterial outside --- Certainty = 0.0000 (Not Clear) <succ>
         bacterial cytoplasm --- Certainty = 0.0000 (Not Clear) <succ>
```

Figure 281:
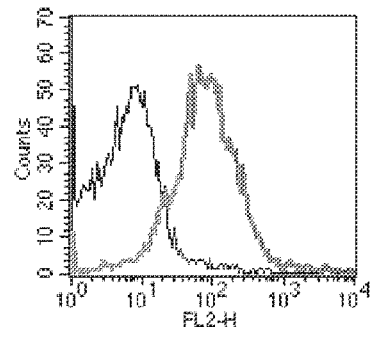

SEQ ID 8574 (GBS366) was expressed in *E. coli* as a GST-fusion product. The purified fusion protein (FIG. 215, lane 5) was used to immunise mice. The resulting antiserum was used for FACS (FIG. 281), which confirmed that the protein is immunoaccessible on GBS bacteria.

Based on this analysis, it was predicted that these proteins and their epitopes could be useful antigens for vaccines or diagnostics.

Example 431

A DNA sequence (GBSx0467) was identified in *S. agalactiae* <SEQ ID 1385> which encodes the amino acid sequence <SEQ ID 1386>. This protein is predicted to be N-acetylmuramoyl-L-alanine amidase. Analysis of this protein sequence reveals the following:

```
Possible site: 31
>>> Seems to have no N-terminal signal sequence
----- Final Results -----
   bacterial cytoplasm --- Certainty = 0.1471 (Affirmative) <succ>
      bacterial membrane --- Certainty = 0.0000 (Not Clear) <succ>
         bacterial outside --- Certainty = 0.0000 (Not Clear) <succ>
```

A related GBS nucleic acid sequence <SEQ ID 8575> which encodes amino acid sequence <SEQ ID 8576> was also identified. This has an RGD motif at residues 81-83.

The protein has homology with the following sequences in the GENPEPT database:

```
>GP:CAB07986 GB:Z93946 N-acetylmuramoyl-L-alanine amidase
[bacteriophage Dp-1]
Identities = 99/140 (70%), Positives = 120/140 (85%)
Query:    10 MVINIEQAIAWMASRKGKVTYSMDYRNGPSSYDCSSSVYFALRSAGASDNGWAVNTEYEH  69
             M ++IE+ +AWM +RKG+V+YSMD+R+GP SYDCSSS+Y+ALRSAGAS  GWAVNTEY H
Sbjct:     1 MGVDIEKGVAWMQARKGRVSYSMDFRDGPDSYDCSSSMYYALRSAGASSAGWAVNTEYMH  60

Query:    70 DWLIKNGYVLIAENTNWNAQRGDIFIWGKRGASAGAFGHTGMFVDPDNIIHCNYGYNSIT 129
             WLI+NGY LI+EN  W+A+RGDIFIWG++GASAGA GHTGMF+D DNIIHCNY Y+ I+
Sbjct:    61 AWLIENGYELISENAPWDAKRGDIFIWGRKGASAGAGGHTGMFIDSDNIIHCNYAYDGIS 120

Query:   130 VNNHDEIWGYNGQPYVYAYR                                         149
             VN+HDE W Y GQPY Y YR
Sbjct:   121 VNDHDERWYYAGQPYYYVYR                                         140
```

A related DNA sequence was identified in *S. pyogenes* <SEQ ID 1387> which encodes the amino acid sequence <SEQ ID 1388>. Analysis of this protein sequence reveals the following:

```
Possible site: 26
>>> Seems to have no N-terminal signal sequence
INTEGRAL   Likelihood = -1.06   Transmembrane 79-95 (77-95)
----- Final Results -----
   bacterial membrane --- Certainty = 0.1426 (Affirmative) <succ>
      bacterial outside --- Certainty = 0.0000 (Not Clear) <succ>
         bacterial cytoplasm --- Certainty = 0.0000 (Not Clear) <succ>
```

An alignment of the GAS and GBS proteins is shown below:

```
Identities = 56/91 (61%), Positives = 68/91 (74%)
Query: 158 KVDNQSVVSKFEKELDVNTPLSNSNMPYYEATISEDYYVESKPDVNSTDKELLVAGTRVR 217
            K+D        F ++LD NT L NSN+PYYEAT+  DYYVESKP+ +S DKE + AGTRVR
Sbjct: 354 KIDKPQSQLTFNQKLDTNTKLDNSNVPYYEATLRTDYYVESKPNASSADKEFIKAGTRVR 413

Query: 218 VYEKVKGWARIGAPQSNQWVEDAYLIDATDM                              248
            VYEKV GW+RI A QS+QWVED YL +AT +
Sbjct: 414 VYEKVNGWSRINASQSDQWVEDKYLSNATQV                              444
```

Figure 44:
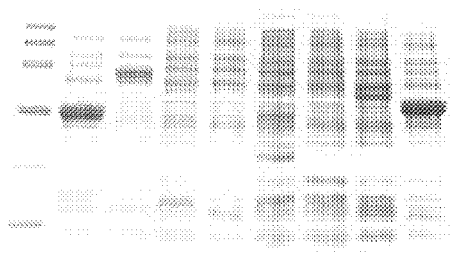
Figure 49:
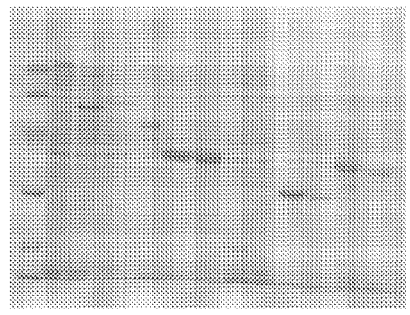

SEQ ID 8576 (GBS301) was expressed in *E. coli* as a His-fusion product. SDS-PAGE analysis of total cell extract is shown in FIG. 44 (lane 9; MW 30 kDa). It was also expressed in *E. coli* as a GST-fusion product. SDS-PAGE analysis of total cell extract is shown in FIG. 49 (lane 3; MW 55 kDa).

Figure 300:
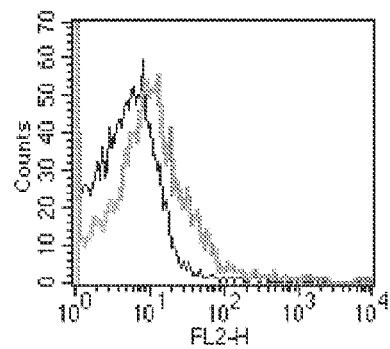

The GBS301-GST fusion product was purified (FIG. 205, lane 4) and used to immunise mice. The resulting antiserum was used for FACS (FIG. 300), which confirmed that the protein is immunoaccessible on GBS bacteria.

Based on this analysis, it was predicted that these proteins and their epitopes could be useful antigens for vaccines or diagnostics.

Example 432

A DNA sequence (GBSx0468) was identified in *S. agalactiae* <SEQ ID 1389> which encodes the amino acid sequence <SEQ ID 1390>. Analysis of this protein sequence reveals the following:

---
Possible site: 53
>>> Seems to have an uncleavable N-term signal seq
INTEGRAL   Likelihood = −6.53   Transmembrane 8-24 (3-25)
----- Final Results -----
    bacterial membrane --- Certainty = 0.3612 (Affirmative) <succ>
    bacterial outside --- Certainty = 0.0000 (Not Clear) <succ>
    bacterial cytoplasm --- Certainty = 0.0000 (Not Clear) <succ>
---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 433

A DNA sequence (GBSx0469) was identified in *S. agalactiae* <SEQ ID 1391> which encodes the amino acid sequence <SEQ ID 1392>. Analysis of this protein sequence reveals the following:

---
Possible site: 34
>>> Seems to have a cleavable N-term signal seq.
----- Final Results -----
    bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>
---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 434

A DNA sequence (GBSx0470) was identified in *S. agalactiae* <SEQ ID 1393> which encodes the amino acid sequence <SEQ ID 1394>. Analysis of this protein sequence reveals the following:

---
Possible site: 36
>>> Seems to have no N-terminal signal sequence
----- Final Results -----
    bacterial cytoplasm --- Certainty = 0.0120 (Affirmative) <succ>
    bacterial membrane --- Certainty = 0.0000 (Not Clear) <succ>
    bacterial outside --- Certainty = 0.0000 (Not Clear) <succ>
---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 435

A DNA sequence (GBSx0471) was identified in *S. agalactiae* <SEQ ID 1395> which encodes the amino acid sequence <SEQ ID 1396>. Analysis of this protein sequence reveals the following:

---
Possible site: 38
>>> Seems to have no N-terminal signal sequence
----- Final Results -----
    bacterial cytoplasm --- Certainty = 0.4757 (Affirmative) <succ>
    bacterial membrane --- Certainty = 0.0000 (Not Clear) <succ>
    bacterial outside --- Certainty = 0.0000 (Not Clear) <succ>
---

A related GBS nucleic acid sequence <SEQ ID 9661> which encodes amino acid sequence <SEQ ID 9662> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

Example 436

A DNA sequence (GBSx0472) was identified in *S. agalactiae* <SEQ ID 1397> which encodes the amino acid sequence <SEQ ID 1398>. This protein is predicted to be a minor structural protein. Analysis of this protein sequence reveals the following:

```
Possible site: 23
>>> Seems to have no N-terminal signal sequence
INTEGRAL    Likelihood = -2.39   Transmembrane 349-365 (347-366)
----- Final Results -----
   bacterial membrane --- Certainty = 0.1956 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the GENPEPT database:

```
>GP:AAF43531 GB:AF145054 ORF39 [Streptococcus thermophilus
bacteriophage 7201]
Identities = 212/666 (31%), Positives = 323/666 (47%), Gaps = 52/666 (7%)
Query:  10 WGNNLTLEILSAWNKP---NIASNTSTVNVQVFL-----KMSSYGYISIGETRPLKITVD  61
           W NN    + W      +I +NTS V +++ L       + Y  +  E    ++
Sbjct:   5 WSNNDRGYRIRLWVDQVGQDIQNNTSQVRLRLSLLNTTTTFAQYSCSAFVEFNGQRLNWS  64

Query:  62 GRAETINVNPSINYGQRKLLFAKDYIVNHNSDGNKPLFNISAYYPIN--FSNYGEATANQ 119
           G    + N +I      L +   V H  DG+  +F + A++  +  +S         NQ
Sbjct:  65 GSPSVLGWNQTIQ------LIDQTITVRHADDGSG-VFGVHAHFNGSGGWSPGNLDIGNQ 117

Query: 120 SISLPKINRLSVSSAISGVLGNAVTITINRYSTSFTHNLKYDFKGSTGTIATGVGTSYLW 179
           I+L   I R S      G +GN V I+I+R     TH L+Y ++   G IA  VGTSY W
Sbjct: 118 QITLTTIPRGSSVRVSDGFIGNQVDISIDRKIGGATHTLRYAWENKQGKIADNVGTSYKW 177

Query: 180 TIPPTFANLLPNELTGTGNLIVETMDGSAKIGETKYTLSITIPNTATYKPKLSSITLSDT 239
           TIP  FAN +PN  +G G + V+T       I       TL+ ++   T    KP  + TL+DT
Sbjct: 178 TIPEDFANDIPNSTSGRGTIYVDTYINGNFIQTQSTTLTASV-ITNNLKPSFTGFTLTDT 236

Query: 240 NTLTSSIVSG-NNFVRIISKVKVDFGSAIGNNGSTITSYNAEIVGKSNSIIGNGSVFDKL 298
           N   +  IV G  +FV I+S VKV F  A    +G+TI  Y AEIVG +NSI  NG V  ++
Sbjct: 237 NPTSQRIVPGQTHFVSIMSLVKVVFNGAQAKSGATIVGYYAEIVGANNSISSNGGVLREV 296

Query: 299 DFFGSA--TIRATVTDSRGLTSEPVDTKINVIDYFLPIVTSAKVVRSQQNPDILQVLPFV 356
                T+R   V DSRG+ S+ V+TK+   + YF P +    +V RS +   DIL +   F
Sbjct: 297 SVNQDTEMTLRGRVQDSRGIWSDWVETKLTFLFYFSPAL-RFEVKRSDKKLDILTIKRFA 355

Query: 357 KIAPIIVGGIQKNQLKMSVSVAPYNTGIYAVDSGAATNTWSTISQMSGAPLNLGGTYDKS 416
           KIAP+  V GIQ+N +K++  S A      + VD+G A   WS+IS+ + +    LG +Y
Sbjct: 356 KIAPLSVNGIQRNVMKLTFSTAKVGWDNYVVDNGQAGGVWSSISEFNASDAKLGNSYPAD 415

Query: 417 KSWLVKISVSDNLMSATPIIQPVASEFVLVTKAPSGVAFGKIWEHGIIDAKGDVYVDGTI 476
           S++V   + D   S T      V ++ V++T     GV  GK  E G  +D  GD       I
Sbjct: 416 TSYVVIGKLEDEFTS-TSFQATVPTDEVIMTYDRQGVGIGKYRERGALDVNGD------I 468

Query: 477 YCGDKAIQQKPLALNNGGSFRHDDTDLNSLQDTGFYCVFRGANRPAGAGPGYVTVVRHET 536
           Y  +  IQQ  L  NNG       ++   N+++D G Y +F  A  P       +   +  H +
Sbjct: 469 YANNSPIQQYQLTNNNGSPKMTNNA--NTIEDPGQYYLFSAA--PGNPSGQWGHLFHHSS 524

Query: 537 ------ANYAYQQFYDRTNKTI-----FTRLLENGVWSGWSEYVKKD--SLQTTGWITIG 583
                 A Q F+   +       ++R++++   W   W E+ + D   +L    TGW     G
Sbjct: 525 YGKGSMYKEAIQIFWSNDGRLFSRHHRWSRIIDD--WEPWKEFARNDNTNLINTGWQPAG 582

Query: 584 -NGFKYKRKGDDIDLMYNFASNGLQRWSVGNMPSGLI--PQELMFAITGWTLAPDKSIHL 640
            +G   YKR GD + +  +NF      G   +  ++P  +    PQ   MF +TGW++   +K   ++
Sbjct: 583 VDGSFYKRVGDVLTIKFNFTGTG-GDFLLASVPPEIFKAPQSYMFVVTGWSVWANKQYNV 641

Query: 641 QINASG                                                       646
           Q+N  G
Sbjct: 642 QVNEGG                                                       647
```

No corresponding DNA sequence was identified in *S. pyogenes*.

Figure 82:
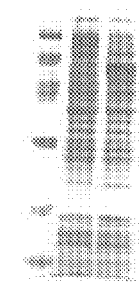

SEQ ID 1398 (GBS365) was expressed in *E. coli* as a GST-fusion product. SDS-PAGE analysis of total cell extract is shown in FIG. 82 (lane 2; MW 102 kDa).

Figure 216:
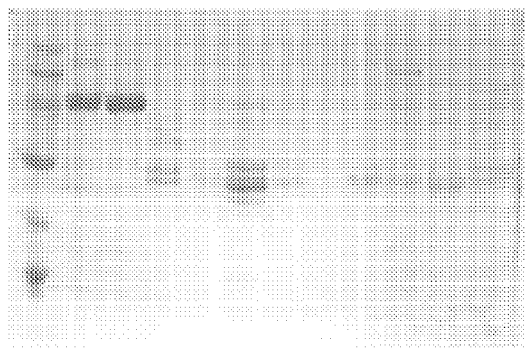

GBS365-GST was purified as shown in FIG. 216, lane 11.

Based on this analysis, it was predicted that this protein and its epitopes, could be useful antigens for vaccines or diagnostics.

Example 437

A DNA sequence (GBSx0473) was identified in *S. agalactiae* <SEQ ID 1399> which encodes the amino acid sequence <SEQ ID 1400>. This protein is predicted to be a minor structural protein. Analysis of this protein sequence reveals the following:

```
Possible site: 59
>>> Seems to have no N-terminal signal sequence
----- Final Results -----
   bacterial cytoplasm --- Certainty = 0.3481 (Affirmative) <succ>
```

-continued

```
      bacterial membrane --- Certainty = 0.0000 (Not Clear) <succ>
         bacterial outside --- Certainty = 0.0000 (Not Clear) <succ>
```

The protein has homology with the following sequences in the GENPEPT database:

```
>GP:AAC34413 GB:AF158600 putative minor structural protein
[Streptococcus thermophilus bacteriophage Sfi11]
Identities = 504/998 (50%), Positives = 675/998 (67%), Gaps = 56/998 (5%)
Query:   1 MLTIHGPDLKPVLFLDNDKQGALNYFNHKWYRKQKTGSSVLEFSVYKKDLLGDSPLSHKY  60
           +LTIH +L+ V ++DN+KQ LN+FN KW R  ++G+SV EFSV+KK + DS +   Y
Sbjct:   2 LLTIHDNNLQKVAYIDNEKQSTLNFFNDKWTRSLESGTSVFEFSVFKKSIKSDSKVEISY  61

Query:  61 HVLNDQAFVSFVHKGKVQLLNIMKIDEDEKQIDCYCENLNLELLNEYCNAYKATKAMSFE 120
           +  LN++AFVSF HKGK  L N+MKI+EDE+ I CYCENL+LELL EY  AYKA+K M+F+
Sbjct:  62 KYLNERAFVSFKHKGKSYLFNVMKIEEDEQIIRCYCENLSLELLLEYRGAYKASKPMTFK 121

Query: 121 EYLVQFDILSWGALTVGTNEVDKKLTLEWTSQETKLARLLSIANNFDAEIEFETKLNFN  180
           EY   + +  + LT+G NEV D+K TLEW  QET LARL+S+A NFDAEIEF+T+L  N
Sbjct: 122 EYFDDWGMGQFAKLTLGVNEVSDQKRTLEWEGQETTLARLISLARNFDAEIEFDTRLKPN 181

Query: 181 HTFKQLIINIYKEYEEGKSYGVDRDKTDVILRYQKNISGIRKTVDKRQIYNAIRPYGKK- 239
             + ++N+YK Y+ GK+ GV R ++DVIL+Y KNI+GI+++VDK QIYN I PYG+K
Sbjct: 182 SQLDEFVLNVYKAYD-GKNQGVGRRRSDVILKYGKNINGIKRSVDKTQIYNMITPYGRKS 240

Query: 240 -TVRGERVISNPVTRKVTKTVGSNRT---YLGGDLKYYGHTIKKANVQAIINYAVQYNIL 295
            T +   + IS+PVT +    V S R    Y GGDL Y GHT+   + VQ I N  VQ N+L
Sbjct: 241 DTKKETKRISDPVTIQNPVVVPSARVEKRYAGGDLTYAGHTLSASLVQTIFNLCVQRNLL 300

Query: 296 PSGIITQLYLESFWGDSTVGKRDNNWAGMSGGAQTRPSGVKVTTGMARPANEGGTYMHYA 355
           PSG+I+QLYLESFWG S V +RDNNW+GM+GGAQTRPSGV VTTG  RPA+EGGTYMHYA
Sbjct: 301 PSGVISQLYLESFWGSSNVARRDNNWSGMTGGAQTRPSGVVVTTGSPRPASEGGTYMHYA 360

Query: 356 SVDDFLKDYTYLLAKQG-----IYNVVGKKNIADYTKGLFRAGGAKYDYAAAGYQSYTNL 410
           SVDDF+KDYTYLLA Q      +Y V GK NI +YTKGLFR GGA YDYAAAGY  Y  L
Sbjct: 361 SVDDFMKDYTYLLADQTSGGRKMYGVKGKQNIEEYTKGLFRIGGALYDYAAAGYNHYTYL 420

Query: 411 MTNIRNGINKVTGNILNTIDKLWQTPVKPITAVNVARRATKTIQA------INEATKLKG 464
           M +IRNGIN+ GNIL+ +D LW+ P  IT N   ++ T+T++A        +NE   LKG
Sbjct: 421 MRDIRNGINRSNGNILDKLDDLWRQPDNQITQPN--KQVTRTVKADRVIAVLNEMQGLKG 478

Query: 465 RRIGSGQCYALSGWYAKKLDGAWIDSSIGGIRGRIGGGMAAALIGTDYNWGAYGWKVDKS 524
           RR+G+GQCYAL+ WY+ KL G + + + G IG GMAAA IGTDY W +GW V +
Sbjct: 479 RRVGNGQCYALAAWYSMKLGGPGLGAGVTGKSGVIGAGMAAAKIGTDYAWDRFGWSVVRP 538

Query: 525 PNAGNLKAGGIYNVRANRGAPFYTTGWGHTGIIKSVSKTRVTVLEQNFVGRMYVVENSYD 584
            +   LK G I N++A     T+ WGH  II S + +VTVLEQN+ GR YVV+NSY
Sbjct: 539 TSVDQLKPGAIANIKAYNSY-LGTSVWGHVSIIISNNGSTVTVLEQNYAGRQYVVQNSYP 597

Query: 585 INSFASGLQTVCYPREIAQGMSVNGATTQQVSGGTQISYEEVVQEAQTESYEEEQIIYID 644
            +++    ++T+CYP E+ +G +V GT   +  ++  E+    + E    + ID
Sbjct: 598 ASAYLGAVETLCYPPELKEGKTVEGRTETVSTPNVEVQKVEIPPIDVEVTTESTAALTID 657

Query: 645 NSIYKEWKDENGKVEYYLKNGFLYAPLSRDRYPSVLTGNETRDNWIRKDMEVETDSQEVL 704
            +   +EW++ENG VE+YL NG LYAP+S++ YPS+LTG E DNWIRKDME++TDS++VL
Sbjct: 658 SKRKQEWRNENGQVEFYLENGSLYAPISKELYPSILTGKENGDNWIRKDMEIDTDSEDVL 717

Query: 705 MSTGLKDLKAHAYPAITYEVDGYVDLELGDVVRIQDDGYEPPLILTARVVEQEISITNPS 764
           +ST L++L+   YPAITYEVDG++DL++GD V+IQD G+ P L+L ARV EQ+IS TNP
Sbjct: 718 ISTALRNLRKFCYPAITYEVDGFLDLDIGDTVKIQDTGFSPMLMLEARVSEQQISFTNPV 777

Query: 765 SNKTKFSNFVEKESQLASDLISDMLRLYDESIPYEIKLATSNGVAFKNGTGESVLTPSLQ 824
            NKT F+NF     +++ L+S M +L +E+IPYE+KL+T NG  FKN TG+SVL +L+
Sbjct: 778 ENKTVFANFQTLQNKVSDSLLSRMTKLAEEAIPYELKLSTDNGTTFKNSTGQSVLKATLE 837

Query: 825 KNGKDYEAVYFYKNGDSLIDIGPSLIVKASDFNHVLNITVEAYLNEELVASTQISFTDTE 884
           KNG+ Y+ ++F+KNGDS+ G  L+VK +DF + L +TVEAYL++ELVAS +I FTD
Sbjct: 838 KNGEVYQPIFFFKNGDSIIGTGNQLVVKPTDFENTLQVTVEAYLDDELVASAEITFTDVS 897

Query: 885 DGADGKDGAPGPQGPPGVNGLQGPKGDQGIQGPAGADGKATYTHIAYALDENGSTGFSVS 944
           DG                QGPKGD G+                L    S G+
Sbjct: 898 DGK-----------------QGPKGDDGVS---------------PINLIIESSNGYQFK 925

Query: 945 DNVGKTYI--GMYVDDNIIDSNDPK-KYKWNLIKGADG                       979
           +N+ T    +Y D+  ID +    Y W+ +  ADG
Sbjct: 926 NNIINTTFTAKLYQDNKEIDKDGTRYAYLWSKV-NADG                       962
```

A related DNA sequence was identified in *S. pyogenes* <SEQ ID 1401> which encodes the amino acid sequence <SEQ ID 1402>. Analysis of this protein sequence reveals the following:

```
Possible site: 37
>>> Seems to have a cleavable N-term signal seq.
INTEGRAL      Likelihood = −3.56    Transmembrane 325-341 (323-343)
----- Final Results -----
    bacterial membrane --- Certainty = 0.2423 (Affirmative) <succ>
       bacterial outside --- Certainty = 0.0000 (Not Clear) <succ>
         bacterial cytoplasm --- Certainty = 0.0000 (Not Clear) <succ>
```

An alignment of the GAS and GBS proteins is shown below:

```
Identities = 23/55 (41%), Positives = 27/55 (48%)
Query: 886 GADGKDGAPGPQGPPGVNGLQGPKGDQGIQGPAGADGKATYTHIAYALDENGSTG      940
           G  GKDGAPG   G PG  G +G +G+ G QGP G  G+     T         G  G
Sbjct: 181 GEAGKDGAPGKDGAPGEKGEKGDRGETGAQGPVGPQGEKGETGAQGPAGPQGEAG      235

Identities = 48/151 (31%), Positives = 58/151 (37%), Gaps = 19/151 (12%)
Query: 852 KASDFNHVLNITVEAYLNE--ELVASTQISFTDTEDGADGKDGAPGPQGPPGVNGLQGPK 909
             K  DF   L      E  E +L+  + I        + G  G   GPQG  G  G QGPK
Sbjct:  82 KEEDFQKELKDFTEKRLKEILDLIGKSGIK---GDRGETGPAGPAGPQGKTGERGAQGPK 138

Query: 910 GD---QGIQGPAGADGKATYTHIAYALDENGSTGFS----VSDNVGKTYIGMYVDDNIID 962
           GD    QGIQG  AG   G+            E G   G +       GK         D
Sbjct: 139 GDRGEQGIQGKAGEKGERGEKGDKGETGERGEKGEAGIQGPQGEAGK-------DGAPGK 191

Query: 963 SNDPKKYKWNLIKGADGARGIQGPAGADGKT      993
             P +      +G  GA+G  GP G  G+T
Sbjct: 192 DGAPGEKGEKGDRGETGAQGPVGPQGEKGET      222

Identities = 25/50 (50%), Positives = 29/50 (58%), Gaps = 9/50 (18%)
Query: 884 EDGADGKDGAPGPQGPPGVNGL---------QGPKGDQGIQGPAGADGKA      924
            +DGA GKDGAPG +G   G            QG KG+ G QGPAG    G+A
Sbjct: 185 KDGAPGKDGAPGEKGEKGDRGETGAQGPVGPQGEKGETGAQGPAGPQGEA      234
```

Figure 122:
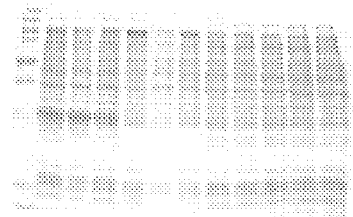
Figure 232:
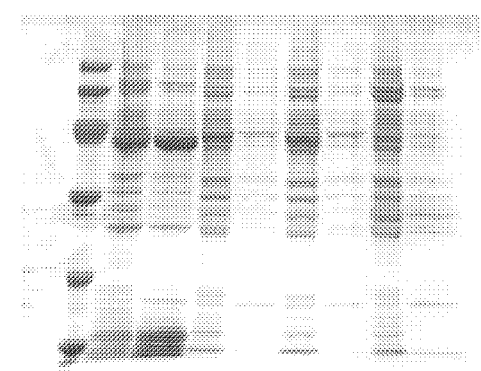
Figure 233:
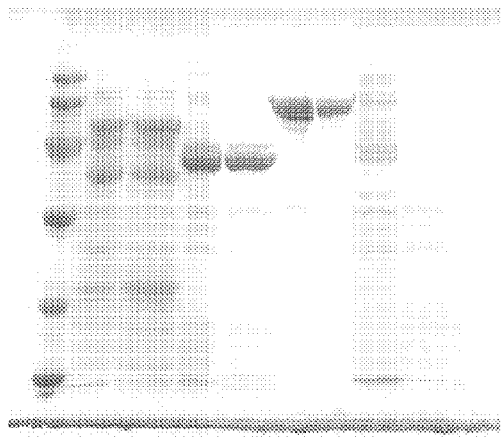

SEQ ID 1400 was expressed in four different forms. SDS-PAGE analysis of total cell extract is shown in FIG. 122 (GBS105dN—lane 5 & 7; MW 102 kDa), FIG. 122 (GBS105dC—lane 8-10; MW 81 kDa), FIG. 179 (GBS105d—lane 8; MW 102 kDa) and in FIG. 181 (GBS105C—lane 2; MW 56 kDa). GBS105dN-His was purified as shown in FIG. 232 (lanes 9 & 10). GBS105dC-His was purified as shown in FIG. 233 (lanes 3 & 4).

Based on this analysis, it was predicted that these proteins and their epitopes could be useful antigens for vaccines or diagnostics.

Example 438

A DNA sequence (GBSx0474) was identified in *S. agalactiae* <SEQ ID 1403> which encodes the amino acid sequence <SEQ ID 1404>. This protein is predicted to be a minor structural protein. Analysis of this protein sequence reveals the following:

```
Possible site: 32
>>> Seems to have no N-terminal signal sequence
----- Final Results -----
    bacterial cytoplasm --- Certainty = 0.2502 (Affirmative) <succ>
       bacterial membrane --- Certainty = 0.0000 (Not Clear) <succ>
          bacterial outside --- Certainty = 0.0000 (Not Clear) <succ>
```

The protein has homology with the following sequences in the GENPEPT database:

```
>GP:AAC34412 GB:AF158600 putative minor structural protein
[Streptococcus thermophilus bacteriophage Sfi11]
Identities = 163/433 (37%), Positives = 244/433 (55%), Gaps = 21/433 (4%)
Query:  80 LSSKKPKMLMFSHIPGRYYLAVQVGDLNFKEIKMNGFGEIT--FIVADAYAHSTSYRRIK 137
           L +KK    L     P RYYLA+  G+++ K I + + E T   F+V  D  AHST+Y+R+
Sbjct:  93 LHTKKAVKLFLPTEPERYYLALVKGEVSLKGIS-DWYDEATIEFLVPDGVAHSTTYKRVT 151

Query: 138 DYTQDGNKMTFKIKNNGTAPAPPIFRIKHLGENGYIGITNETGAFAVGSPEEEDGTIVHR 197
           DY +   KM F I  G+   A+PI  +K    ENGY G+ ++    AF   G+ EE DG I+ +
Sbjct: 152 DYQEKDGKMIFSIDNEGSTDAYPIITLKANAENGYYGLVSDKFAFEAGNIEEADGKIISK 211

Query: 198 NETLFDY-SKAIAQAL-EGAPNVAKLNYMPPTFDSELKRMRLDNILGSGKGGEYVAIGAR 255
               E L+D+   I QA  +GA  NV   N      +       + + N+ G           IG +
Sbjct: 212 AEVLYDFRDDRIPQAFAKGAKNVGITNVIGDLHGT----LEIQNVWGRPH------IGLK 261

Query: 256 GTTPGYGE-HVGTRTFIINPDSNGEY-TLNEHLWWKQIFIATAQDQKGFLKLCVTGENDE 313
                +    + T  I PDS+G        LNE++WW+QIF A +  Q GFLKL V+    +
Sbjct: 262 NPNANINQLQTASLTLDIPPDSSGNVGALNEYIWWRQIFWAGSISQYGFLKLTVSDADGN 321

Query: 314 FLYGIETYKRKNGFETEYNFFALDDDGVGWRFYKQFEFQA-DRNYHNPFSMNRSRAVEIF 372
           FLYG+ET+KR  G E+EYN   A  D  G G+RF KQ+  F A+      HNPF+   R    +I
Sbjct: 322 FLYGVETFKRSLGLESEYNALASDGYG-GFRFLKQWSFLATEYEDHNPFNEPRGWS-DIK 379
```

-continued

```
Query: 373 REEDKFRIYFNGAHHHVTVPSLKGKKSRKIHLAMGTCSDSSKYINYNLFEKVNFEKMGVS 432
            RE+DK   Y+ G ++  T+P +KGKKS KIHL +     S  ++ + F+++ + K   +
Sbjct: 380 REDDKVTFYWWGTYNTFTIPEIKGKKSAKIHLTISNI-PSKSFVTHAYFDQLLYIKINNA 438

Query: 433 HYNNIVNKYQPGDEVIINFENDTVSTKDIDSIQDVVLGSKMISIPPGESELVVHLSSWVA 492
            + +I N+Y G  +IIN E+DT++   ++ ++ ++V GS    IPPGES++ V  S W
Sbjct: 439 FFEDIPNRYIQGSNLIINSEDDTLTLNNLLNLDEIVDGSLWPVIPPGESQIEVVQSPWAK 498

Query: 493 ALPDISIDFEERY                                                505
            P ++I+FEER+
Sbjct: 499 KKPSVTIEFEERW                                                511
```

No corresponding DNA sequence was identified in *S. pyogenes*.

Based on this analysis, it was predicted that this protein and its epitopes, could be useful antigens for vaccines or diagnostics.

Example 439

A DNA sequence (GBSx0475) was identified in *S. agalactiae* <SEQ ID 1405> which encodes the amino acid sequence <SEQ ID 1406>. This protein is predicted to be PblA. Analysis of this protein sequence reveals the following:

Possible site: 57
>>> Seems to have no N-terminal signal sequence
INTEGRAL    Likelihood = −7.11    Transmembrane 427-443 (424-445)
INTEGRAL    Likelihood = −4.99    Transmembrane 449-465 (448-469)
INTEGRAL    Likelihood = −2.71    Transmembrane 41-57 (38-57)
INTEGRAL    Likelihood = −0.37    Transmembrane 361-377 (361-377)
INTEGRAL    Likelihood = −0.22    Transmembrane 324-340 (324-340)
----- Final Results -----
   bacterial membrane --- Certainty = 0.3845 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database:

```
>GP:AAG18638 GB:AY007505 PblA [Streptococcus mitis]
Identities = 233/401 (58%), Positives = 296/401 (73%), Gaps = 17/401 (4%)
Query:   1 MATNLGQAYVQIMPSAKGISGSISKTLDPEASSAGSSAGSLLGGKLIGILGSVIAAAKIG  60
           MAT + QAYVQ++PSA+GI+G I    L+PEAS+AG SAG  LG  L+G++   VIAAA IG
Sbjct:   1 MATEIAQAYVQLIPSARGITGKIQSILNPEASAAGQSAGQSLGSSLVGVMTKVIAAAGIG  60

Query:  61 EMVTKAISSSISEGAALQQSLGGVETLFKSNANLVKKYADEAYKTTGLSANAYMESVTGF 120
              KA S++ISEGAALQQSLGG+ETLFK +A+ VK YA+EAYKTTGLSANAYME+VTGF
Sbjct:  61 ----KAFSAAISEGAALQQSLGGIETLFKGSADKVKGYANEAYKTTGLSANAYMENVTGF 116

Query: 121 SASLLQSLGGDTAKAAKVANMAMIDMADNSNKMGTSMESIQYAYQGFAKQNYTMLDNLKL 180
           SASLLQSLGGDT KAA+ ANMAMIDM+DN+NKMGTSMESIQ AYQGFAKQNYTMLDNLKL
Sbjct: 117 SASLLQSLGGDTNKAAETANMAMIDMSDNANKMGTSMESIQMAYQGFAKQNYTMLDNLKL 176

Query: 181 GYGGTQEEMKRLLSDAQKLTGKKYDISNLSDVYEAIHAIQGKIGITGTTAKEAATTFTGS 240
           GYGGT++EM+RLL DA+KLTG KYDI+NLSDVY AIHAIQ  +  ITGTTAKEA+TF+GS
Sbjct: 177 GYGGTKQEMQRLLADAEKLTGVKYDINNLSDVYSAIHAIQENLDITGTTAKEAASTFSGS 236

Query: 241 FEAMKAASKNLLGKMALGEDIKPSLKALFDTTSNFVLNNFIPMLTNVFKGFGSVISLTFS 300
           FE+MKAA++N+LGK+ALGE+I PSL AL  TTS F+ +NF+PM+ NVF G G V++   S
Sbjct: 237 FESMKAAAQNVLGKLALGENILPSLHALLKTTSTFLFDNFLPMIGNVFSGLGLVLTEGIS 296

Query: 301 ELIPKIVGFMQTSGPSLMQSGISFIISFVNGFLTAYPAFLTVAGKIFTDFVSFVMQSIPG 360
              ++ ++ G        S +  +S + G    + F  +G +     ++ +I G
Sbjct: 297 QIASQLFG-------DAFGSAVFDQLSRITGIFETF--FDMIFGSLSKQDNIDILNTI-G 346

Query: 361 LLQAGATLVLNLIDGILANLPQIATS---AVSVISSFISML                    398
            + AT ++N+ D I     I ++     V ++  F+  L
Sbjct: 347 FSEEAATQIVNIADNIRVTFENIGSAIGDVVGIVGDFVGDL                    387

Identities = 112/386 (29%), Positives = 172/386 (44%), Gaps = 18/386 (4%)
Query: 235 TTFTGSFEAMKAASKNLLGKMA-LGEDIKPSLKA---LFDTTSNFVLNNFIPMLTNVFKG 290
           TT+    E++KA ++   + +  + L E IK +    L   T  V+   FI   N++
Sbjct: 580 TTWNAYVESLKAMWNAVVTFFSDLWESIKEAASTAWTLITTAVMMVVQPFIDGFMNIWNN 639

Query: 291 FGSVISLTFSELIPKIVGFMQTSGPSLMQSGISFIISFVNGFLTAYPAFLTVAGKIFTDF 350
             ++ +  +     G +     S+    I  II  V G     A L++ +    +
Sbjct: 640 ISEGLTQVWEGIKLIFEGAWEFI-KSIFLGAILIIDLVTGNFGQLGADLSLIWEGIKNG 698

Query: 351 VSFVMQSIPGLLQAGATLVLNLIDGILANLPQIATSAVSVISSFISMLQANYPAILKKGF 410
           +S+ + + I            +++  G+ N  + ++     I + SM  + I
Sbjct: 699 ISLIWEGIKTYFSGVVDVIVGYATGVFENFSNVLSTIWEFIKTAASMA---WEWIKSTVS 755

Query: 411 EILSYLVQGIIARLPDIVITVGKL---IAILAGAIASNLPKVLALGVQLLITFVKGILSV 467
            +++ L+QG     + V + L   I  AA S KL LG   +  VG +
Sbjct: 756 NLITGLIQGAQNLWNNFVSFLSGLWENIKSTASAAWSGL-KSLVLG--FINGLVSGAQTA 812
```

```
Query: 468 IGKINETANNIGEK---LINAIKSIDLLSAGRAIMRGFLRGLEDVWGDIQNFVGDIAGWI 524
            + + +++   K    + N IK+I+L  AG+AI+ GFL GL+  W  + NFVG IA WI
Sbjct: 813 WNNMKQAVSDLVTKVTNIFNGIKNINLWEAGKAILNGFLGGLKSAWEGVTNFVGGIANWI 872

Query: 525 KDHKGPISYDRRLLIPAGNAIMQGLHQGLVDKFKPVKNLVNGMAEEIQSSFGNPQLAFDM 584
           +DHKGPI YDR+LLIPAGNAIM  L  GL D FK VK   V GM+ EI    F     L +
Sbjct: 873 RDHKGPIEYDRKLLIPAGNAIMGSLDNGLKDGFKDVKKTVGGMSGEISDVFSGDNLDLNS 932

Query: 585 DTNVNNGFE-RIGTLNKNLSSQVTST                                  609
            +V     E R+    +  L  Q + T
Sbjct: 933 TASVTKNLEARLAMPSAQLEVQESKT                                  958
```

A related DNA sequence was identified in *S. pyogenes* <SEQ ID 1407> which encodes the amino acid sequence <SEQ ID 1408>. Analysis of this protein sequence reveals the following:

Possible site: 55
>>> Seems to have no N-terminal signal sequence
INTEGRAL    Likelihood = −2.76    Transmembrane 458-474 (458-474)
INTEGRAL    Likelihood = −2.60    Transmembrane 483-499 (482-499)
INTEGRAL    Likelihood = −2.02    Transmembrane 429-445 (429-445)
INTEGRAL    Likelihood = −1.28    Transmembrane 397-413 (397-413)
INTEGRAL    Likelihood = −0.53    Transmembrane 739-755 (738-755)
INTEGRAL    Likelihood = −0.27    Transmembrane 356-372 (356-372)
----- Final Results -----
  bacterial membrane --- Certainty = 0.2105 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP:AAB18717 GB:U38906 ORF42 [Bacteriophage r1t]
Identities = 261/579 (45%), Positives = 359/579 (61%), Gaps = 63/579 (10%)
Query: 184 MKRLLSDAEKLPAAMGKKFDLSNYADVVEAIHLVQDNMGIAGVAAEEAKTTFSGSLAAMK 243
           M+RLL+ DA+KL     G+K+D+SN++D+  +AIH +Q   M I G A+EA  TTFSGS +MK
Sbjct:   1 MQRLLTDAQKLT---GQKYDISNFSDITQAIHAIQTEMDITGTTAKEASTTFSGSFDSMK  57

Query: 244 SSFTNVMAGLSLGDDIRPALRGLAETTSNFLFGNFIPMVANIFKGLPSAIGTFIGAAAPI 303
           ++ +NV+  LSLG D++    L   L   TTS FLF NFIPMV NIFK LP AI TF+ AA
Sbjct:  58 AAMSNVLGNLSLGRDLQGPLNALVSTTSTFLFKNFIPMVGNIFKALPGAISTFVSAAGKE 117

Query: 304 ITSQ-------------------------------FQGLMSSLG-ISIDLSPIT 325
           ++SQ                               F L+SS+G  IS + +
Sbjct: 118 LSSQLGNGIGSGFSDFTAKFSSILSPLQGSFQTIVSGLKPVFDSLLSSIGPISTQIMGVF 177

Query: 326 AKFAQIGQNLQ----PVFNGLKTAFSQLPSFFTSIGSAVAPVIDTIISGLARLDFSGFEA 381
           +K   Q+ N+      PV + L  AF QLPS F +I   AV P+IDTI SG+++RLDFSG +A
Sbjct: 178 SKLPQLFSNVISAVIPVISTLSVAFGQLPSLFEAISVAVQPMIDTISSGISRLDFSGIQA 237

Query: 382 LISAILPALQAGFSNFAAIVGPAISGVVDSFVGMWNAAQPLISILSDALMPVFQILGSFL 441
           +ISA++PA+  G +  I+GP+I  +V+SFV MWN+ QPL ++++  ALMP FQ+LG+F+
Sbjct: 238 IISALVPAITTGITTMMGIIGPSIDTLVNSFVKMWNSIQPLATVIAGALMPAFQVLGAFI 297

Query: 442 GGVVKGALMGVSFAFDAVKVAIQLVTPIIDLLVQGLNFVQPVLSVIAEWIGVAIGMFGNL 501
           GGV+KGA++  +S   FD ++V +   +TPII ++        PVL+  +A+W+G AIG F N
Sbjct: 298 GGVLKGAMLALSATFDTIRVVVGFLTPIIAAVLAKFQEFAPVLATVAQWVGTAIGFFANF 357

Query: 502 GTAGQGLSAFIKSAWTNIQTAISTAGTIISTVIDYIKLAFSGAGSAVGVLKNIFSLAWMA 561
             G AG  L   I SAW  I++  + +I +I+  K  F+G GSA G L+++ S AW
Sbjct: 358 GAAGTSLKGLITSAWNGIKSIISSVVSGIGGIINTAKAIFTGLGSAGGALRSMISGAWSG 417

Query: 562 MGDAINVAKGIISSVINGIKSAFSSFS-------SLVSSVGSAVNGVIDSISSTIRG--- 611
            +   I+    G IS   INGIKS FSS        S++S V S  +G+I    SSTI G
Sbjct: 418 IRSIISSVGGSISGTINGIKSFFSSLGGSGNGLRSVMSGVWSGITGIISGASSTISGIID 477

Query: 612 --------LANIDISGAGAAIMNGFLNGLKSAWGAVKSFVSGIANWIAEHKGPISYDRVL 663
                   L NID++GAG A+++GF+ GLKS W A K  FV GIA+WI +HKGPISYDR +
Sbjct: 478 GIKNIFNSLKNIDLAGAGRAVIDGFVGGLKSTWEAGKKFVGGIADWIKDHKGPISYDRKI 537

Query: 664 LKPAGKAIMGGLNTSLIDGFKEVKSNVSGMADDLASTMT                     702
           L PAG+AIMGG N SL++ FK V+ NVSG+A +  S +T
Sbjct: 538 LIPAGQAIMGGFNDSLMENFKAVQKNVSGIAKQIQSAIT                     576
```

An alignment of the GAS and GBS proteins is shown below:

```
Identities = 272/701 (38%), Positives = 371/701 (52%), Gaps = 91/701 (12%)
Query:    1 MATNLGQAYVQIMPSAKGISGSISKTLDPEASSAGSSAGSLLGGKLIGILGSVIAAAKIG   60
            MAT LGQAYVQIMPSA+GISG+ISK LDPEA SAG SAGSL+GG L+ ++G  IAAA IG
Sbjct:    1 MATELGQAYVQIMPSARGISGAISKQLDPEARSAGLSAGSLIGGNLVKMIGGAIAAAGIG   60

Query:   61 EMVTKAISSSISEGAALQQSLGGVETLFKSNANLVKKYADEAYKTTGLSANAYMESVTGF  120
            +M     ISS++S GA LQQS GG++TL+K      VK +A EAYK  G+SAN Y E
Sbjct:   61 KM----ISSALSAGADLQQSFGGIDTLYKGAETAVKGFAKEAYKA-GISANTYAEQAVSM  115

Query:  121 SASLLQSLGGDTAKAAKVANMAMIDMADNSNKMGTSMESIQYAYQGFAKQNYTMLDNLKL  180
                ASL QSLGGD    AAK ANMA++DMADNS KMGT + SIQ AYQGFAKQNYTMLDNL+L
Sbjct:  116 GASLKQSLGGDAVAAKAANMAIMDMADNSAKMGTDITSIQMAYQGFAKQNYTMLDNLRL  175

Query:  181 GYGGTQEEMKRLLSDAQKL---TGKKYDISNLSDVYEAIHAIQGKIGITGTTAKEAATTF  237
            GYGGT+EEMKRLLSDA+KL   GKK+D+SN +DV EAIH +Q   +GI G  A+EA TTF
Sbjct:  176 GYGGTKEEMKRLLSDAEKLPAAMGKKFDLSNYADVVEAIHLVQDNMGIAGVAAEEAKTTF  235

Query:  238 TGSFEAMKAASKNLLGKMALGEDIKPSLKALFDTTSNFVLNNFIPMLTNVFKGFGSVISL  297
            +GS  AMK++  N++   ++LG+DI+P+L+ L +TTSNF+  NFIPM+ N+FKG   S I
Sbjct:  236 SGSLAAMKSSFTNVMAGLSLGDDIRPALRGLAETTSNFLFGNFIPMVANIFKGLPSAIGT  295

Query:  298 TFSELIPKIV----GFMQTSGPSLMQSGISFIISFV--------NGFLTAY---PAFLTV  342
                P  I     GM + GS+  S I+    +         NG TA+     P+F T
Sbjct:  296 FIGAAAPIITSQFQGLMSSLGISIDLSPITAKFAQIGQNLQPVFNGLKTAFSQLPSFFTS  355

Query:  343 AGKIFTDFVSFVMQSIPGL----LQAGATLVLNLIDGILANLPQIATSAVS-VISSFISM  397
               G    +   ++ +  L        +A + +L +    +N   I    A+S V+ SF+ M
Sbjct:  356 IGSAVAPVIDTIISGLARLDFSGFEALISAILPALQAGFSNFAAIVGPAISGVVDSFVGM  415

Query:  398 LQANYPAI------LKKGFEILSYLVQGI---------------------IARLPDIVIT  430
              A  P I      L   F+IL   + G+                       +  + D+++
Sbjct:  416 WNAAQPLISILSDALMPVFQILGSFLGGVVKGALMGVSFAFDAVKVAIQLVTPIIDLLVQ  475

Query:  431 ----VGKLIAILAGAIASNLPKVLALGV--QLLITFVKGILSVIGKINETANNIGEKLIN  484
                V +++++A  I +     LG  Q L  F+K  + I     TA  I    +I+
Sbjct:  476 GLNFVQPVLSVIAEWIGVAIGMFGNLGTAGQGLSAFIKSAWTNIQTAISTAGTIISTVID  535

Query:  485 AIKSI----------------------DLLSAGRAIMRGFLRGLEDVWGDIQNFVGDIA  521
            IK                        D ++  + I+   + G++  +        + V   +
Sbjct:  536 YIKLAFSGAGSAVGVLKNIFSLAWNAMGDAINVAKGIISSVINGIKSAFSSFSSLVSSVG  595

Query:  522 GWIKDHKGPISYDRRLLI-----PAGNAIMQGLHQGLVDKFKPVKNLVGNMAEEIQSSFG  576
                  +    IS   R L         AG AIM  G GL  + VK+ V+G+A I       G
Sbjct:  596 SAVNGVIDSISSTIRGLANIDISGAGAAIMNGFLNGLKSAWGAVKSFVSGIANWIAEHKG  655

Query:  577 NPQLAFDMDTNVNNGFERIGTLNKNLSSQVTSTDNYTSGNA                     617
                +++D        G     +G LN +L        +  SG A
Sbjct:  656 --PISYDRVLLKPAGKAIMGGLNTSLIDGFKEVKSNVSGMA                     694
```

Based on this analysis, it was predicted that these proteins and their epitopes could be useful antigens for vaccines or diagnostics.

Example 440

A DNA sequence (GBSx0477) was identified in *S. agalactiae* <SEQ ID 1409> which encodes the amino acid sequence <SEQ ID 1410>. Analysis of this protein sequence reveals the following:

Possible site: 16
>>> Seems to have no N-terminal signal sequence
----- Final Results -----
  bacterial cytoplasm --- Certainty = 0.2565 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database:

```
>GP: AAG18637 GB: AY007505 unknown [Streptococcus mitis]
Identities = 64/119 (53%), Positives = 87/119 (72%), Gaps = 2/119 (1%)
Query:   1 MLKMDEDALVCDLAETYHIYDYKQLPPLKVAVFSLGLREESRINRVISGNRVSFERRILA    60
           M++ DEDAL+CDLAETY I+DY+QLP  +VAVF+ GLR++SRI   ++ ++V FE  +LA
Sbjct:   1 MIQTDEDALICDLAETYGIFDYRQLPADQVAVFAFGLRDDSRIKLAMTNSKVPFETFLLA    60

Query:  61 GMFDRLGMLIWMKTTDGQKGKNRPEMVSTMF--DNQQKDSEVVSFGSGKDFEETRNNIL   117
           G+ DRL  L+W KTTDGQKG N+P MV+       + K+S+  F SG+DFEE R  IL
Sbjct:  61 GVLDRLSALVWFKTTDGQKGINKPLMVTEELTGKTKAKESKEMIFDSGEDFEEYRQKIL   119
```

A related DNA sequence was identified in *S. pyogenes* <SEQ ID 1411> which encodes the amino acid sequence <SEQ ID 1412>. Analysis of this protein sequence reveals the following:

```
Possible site: 41
>>> Seems to have no N-terminal signal sequence
----- Final Results -----
   bacterial cytoplasm --- Certainty = 0.2905 (Affirmative) <succ>
     bacterial membrane --- Certainty = 0.0000 (Not Clear) <succ>
       bacterial outside --- Certainty = 0.0000 (Not Clear) <succ>
```

An alignment of the GAS and GBS proteins is shown below:

```
Identities = 60/123 (48%), Positives = 82/123 (65%), Gaps = 2/123 (1%)
Query:    1 MLKMDEDALVCDLAETYHIYDYKQLPPLKVAVFSLGLREESRINRVISGNRVSFERRILA    60
            M+  D+DAL CDLAETY IYDY+QLP +VAVF++GLR  SRI   +SG  + +  +LA
Sbjct:    1 MIAKDDDALTCDLAETYGIYDYRQLPAYQVAVFAVGLRSNSRIKMALSGETEALDTVLLA    60

Query:   61 GMFDRLGMLIWMKTTDGQKGKNRPEMV--STMFDNQQKDSEVVSFGSGKDFEETRNNILG   118
            G++D   +L W KT DGQ G+N+P+ V +     QK ++V+SF SG+DFE  R  +LG
Sbjct:   61 GIYDNTNLLFWSKTKDGQSGQNKPKSVVEAISGSKSQKANDVISFVSGEDFENARKQLLG   120

Query:  119 FGG   121
            G
Sbjct:  121 GDG   123
```

Based on this analysis, it was predicted that these proteins and their epitopes could be useful antigens for vaccines or diagnostics.

Example 441

A DNA sequence (GBSx0478) was identified in *S. agalactiae* <SEQ ID 1413> which encodes the amino acid sequence <SEQ ID 1414>. Analysis of this protein sequence reveals the following:

```
Possible site: 36
>>> Seems to have no N-terminal signal sequence
----- Final Results -----
   bacterial cytoplasm --- Certainty = 0.2280 (Affirmative) <succ>
     bacterial membrane --- Certainty = 0.0000 (Not Clear) <succ>
       bacterial outside --- Certainty = 0.0000 (Not Clear) <succ>
```

The protein has homology with the following sequences in the GENPEPT database:

```
>GP: AAG18636 GB: AY007505 unknown [Streptococcus mitis]

Identities = 40/80 (50%), Positives = 62/80 (77%), Gaps = 1/80 (1%)

Query:    3 TSSGFEYKIEESRLKNYELVEALADLESNPLSLPKVLRLLLGDQVESLKNHLRASDGTVS    62
            TS+GF ++I + RL+NYEL+EA++++++NP  LPKV++L+LG++ E LKNH+R +DG V
Sbjct:   24 TSTGFPFEITKERLENYELLEAISEVDTNPAVLPKVVKLMLGNKSEDLKNHVRTADGIVP    83

Query:   63 TEALMEEVKEIFES-GQLKK    81
            + +  E+ EIF S  QLKK
Sbjct:   84 LDKMGAEISEIFSSQNQLKK   103
```

A related DNA sequence was identified in *S. pyogenes* <SEQ ID 1415> which encodes the amino acid sequence <SEQ ID 1416>. Analysis of this protein sequence reveals the following:

Possible site: 56
>>> Seems to have no N-terminal signal sequence
----- Final Results -----
   bacterial cytoplasm --- Certainty = 0.4365 (Affirmative) <succ>
   bacterial membrane --- Certainty = 0.0000 (Not Clear) <succ>
   bacterial outside --- Certainty = 0.0000 (Not Clear) <succ>

Possible site: 44
>>> Seems to have no N-terminal signal sequence
----- Final Results -----
   bacterial cytoplasm --- Certainty = 0.3461 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below:

The protein has homology with the following sequences in the GENPEPT database:

```
Identities = 42/75 (56%), Positives = 60/75 (80%)
Query:   2 KTSSGFEYKIEESRLKNYELVEALADLESNPLSLPKVLRLLLGDQVESLKNHLRASDGTV      61
           KT+SGFEY+I + RLKN+ELVEA+A+ E++P ++ K++ LLLGD  +SLK H+R ++G V Sbjct:   7 KTTSGFEYEIPKKRLKNFELVEAIAEEETDPTAVVKIVNLLLGDAAKSLKEHVRDAEGIV      66

Query:  62 STEALMEEVKEIFES                                                 76
              EA+  E+KEIFES Sbjct:  67 DVEAIGVEIKEIFES                                                 81
```

Based on this analysis, it was predicted that these proteins and their epitopes could be useful antigens for vaccines or diagnostics.

Example 442

A DNA sequence (GBSx0479) was identified in *S. agalactiae* <SEQ ID 1417> which encodes the amino acid sequence <SEQ ID 1418>. This protein is predicted to be Structural protein. Analysis of this protein sequence reveals the following:

```
>GP: AAG18635 GB: AY007505 unknown [Streptococcus mitis]

Identities = 114/183 (62%), Positives = 142/183 (77%)

Query:    2 VANSSNVTTAKPKIGGAIYTAPLGTELPKDTASELNEAFKSLGYISEDGLSNEDKRESEE     61
            +A  +NVTTAKPKIGGA+Y+APLGT LP D  ++L++AF++LGYIS+DG++N +   ESE Sbjct:    1 MATEANVTTAKPKIGGAVYSAPLGTALPTDATTKLDQAFEALGYISDDGMTNSNSPESEN     60

Query:   62 IQAWGGDVVESAQKSKADKFTYTLIEALNIEVLKEIYGKDNVTGDLKTGITVKSNSKPLE    121
            I+AWGG VV S QK  K D F Y LIEALN+  VLKE+YG DNV+GDL +GIT+K+NSK L Sbjct:   61 IKAWGGVVVSSVQKEKTDTFKYMLIEALNLHVLKEVYGPDNVSGDLSSGITIKANSKELP    120

Query:  122 EHCLVIEMILKNNTVKRIVIPKGKVSEVGEIKYVDNEAAGYETTLQAFPDAEGNTHYEYI    181
             HCLVIE +LK   +KRIVIP GKV+ + EI Y D   GY TT+ AFP+A  +THYEYI Sbjct:  121 HHCLVIETVLKGGVLKRIVIPSGKVTAIDEITYNDGSVLGYGTTVTAFPNAADDTHYEYI    180

Query:  182 KGA                                                             184
            KGA Sbjct:  181 KGA                                                             183
```

A related DNA sequence was identified in *S. pyogenes* <SEQ ID 1419> which encodes the amino acid sequence <SEQ ID 1420>. Analysis of this protein sequence reveals the following:

```
Possible site: 13
>>> Seems to have no N-terminal signal sequence
----- Final Results -----
   bacterial cytoplasm --- Certainty = 0.2379 (Affirmative) <succ>
      bacterial membrane --- Certainty = 0.0000 (Not Clear) <succ>
         bacterial outside --- Certainty = 0.0000 (Not Clear) <succ>
```

An alignment of the GAS and GBS proteins is shown below:

```
Identities = 119/182 (65%), Positives = 142/182 (77%)
Query:   4 NSSNVTTAKPKIGGAIYTAPLGTELPKDTASELNEAFKSLGYISEDGLSNEDKRESEEIQ          63
           ++ NVT+AKPK GGAIY+APLGTELPKD  SELN  FK+LGY+SEDG+ NED R SE I+

Sbjct:   6 DTKNVTSAKPKTGGAIYSAPLGTELPKDAKSELNTKFKNLGYVSEDGVVNEDTRSSENIK         65

Query:  64 AWGGDVVESAQKSKADKFTYTLIEALNIEVLKEIYGKDNVTGDLKTGITVKSNSKPLEEH        123
           AWGGD+V + Q  K DKFTY LIE+LN+EVLKE+YG  NVTGDL  GI +KSNSK LE H Sbjct:  66 AWGGDIVGAVQTEKEDKFTYKLIESLNVEVLKEVYGAVNVTGDLSGGIQIKSNSKELEAH        125

Query: 124 CLVIEMILKNNTVKRIVIPKGKVSEVGEIKYVDNEAAGYETTLQAFPDAEGNTHYEYIKG        183
           +V++MI+       +KRIV+P  KV EVGEIKYVD E  GYETTL+ FPD +G+TH EYI Sbjct: 126 VIVVDMIMNGGILKRIVLPNAKVDEVGEIKYVDGEVVGYETTLKCFPDKDGDTHREYIVK        185

Query: 184 AG                                                                 185
           G Sbjct: 186 PG                                                                 187
```

Based on this analysis, it was predicted that these proteins and their epitopes could be useful antigens for vaccines or diagnostics.

Example 443

A DNA sequence (GBSx0480) was identified in *S. agalactiae* <SEQ ID 1421> which encodes the amino acid sequence <SEQ ID 1422>. Analysis of this protein sequence reveals the following:

```
Possible site: 58
>>> Seems to have no N-terminal signal sequence
----- Final Results -----
   bacterial cytoplasm --- Certainty = 0.2214 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database:

```
>GP: AAB18710 GB: U38906 ORF35 [Bacteriophage rlt]
Identities = 52/78 (66%), Positives = 66/78 (83%)
Query:   1 MSKFKFKLNKAGVAELMKSSEMQQVLTTKATAIRERCGDGYAQDIHVGRNRANAMVSAKT          60
           M+K F KLN++GVA +MKS EMQ +L  KA+A+++RCG GY QD+HVG+NRANAMV A+T Sbjct:   1 MAKNLFKLNRSGVASMMKSPEMQAILKEKASAVKQRCGPGYGQDMHVGENRANAMVFAET         60

Query:  61 IKAKKDNSKNNTLLKAVR                                                  78
           +AK+DN KNNT+LKAVR Sbjct:  61 YQAKRDNMKNNTILKAVR                                                  78
```

A related DNA sequence was identified in *S. pyogenes* <SEQ ID 1423> which encodes the amino acid sequence <SEQ ID 1424>. Analysis of this protein sequence reveals the following:

```
Possible site: 54
>>> Seems to have no N-terminal signal sequence
----- Final Results -----
   bacterial cytoplasm --- Certainty = 0.2446 (Affirmative) <succ>
      bacterial membrane --- Certainty = 0.0000 (Not Clear) <succ>
         bacterial outside --- Certainty = 0.0000 (Not Clear) <succ>
```

A related DNA sequence was identified in *S. pyogenes* <SEQ ID 1423> which encodes the amino acid sequence <SEQ ID 1424>. Analysis of this protein sequence reveals the following:

```
Possible site: 54
>>> Seems to have no N-terminal signal sequence
----- Final Results -----
   bacterial cytoplasm --- Certainty = 0.2446 (Affirmative) <succ>
      bacterial membrane --- Certainty = 0.0000 (Not Clear) <succ>
         bacterial outside --- Certainty = 0.0000 (Not Clear) <succ>
```

An alignment of the GAS and GBS proteins is shown below:

A related DNA sequence was identified in *S. pyogenes* <SEQ ID 1423> which encodes the amino acid sequence <SEQ ID 1424>. Analysis of this protein sequence reveals the following:

Possible site: 54
>>> Seems to have no N-terminal signal sequence
----- Final Results -----
    bacterial cytoplasm --- Certainty = 0.2446 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below:

```
Identities = 75/78 (96%), Positives = 76/78 (97%)
Query:  1  MSKFKFKLNKAGVARLMESSEMQQVLTTKATAIRERCGDGYAQDIHVGKNRANAMVSAKT   60
           MSKFKFKLN+AGVAELMKSSEMQQVLTTKATAIRERCGDGY QDIHVGKNRANAMVS KT
Sbjct:  1  MSKFKFKLNRAGVAELMKSSEMQQVLTTKATAIRERCGDGYVQDIHVGKNRANAMVSTKT   60

Query: 61  IKAKKDNSKNNTLLKAVR                                             78
           IKAKKDNSKNNTLLKAVR
Sbjct: 61  IKAKKDNSKNNTLLKAVR                                             78
```

Based on this analysis, it was predicted that these proteins and their epitopes could be useful antigens for vaccines or diagnostics.

Example 444

A DNA sequence (GBSx0481) was identified in *S. agalactiae* <SEQ ID 1425> which encodes the amino acid sequence <SEQ ID 1426>. Analysis of this protein sequence reveals the following:

Possible site: 38
>>> Seems to have no N-terminal signal sequence
----- Final Results -----
    bacterial cytoplasm --- Certainty = 0.2888 (Affirmative) <succ>
      bacterial membrane --- Certainty = 0.0000 (Not Clear) <succ>
        bacterial outside --- Certainty = 0.0000 (Not Clear) <succ>

The protein has homology with the following sequences in the GENPEPT database:

```
>GP: AAB18709 GB: U38906 ORF34 [Bacteriophage rlt]
Identities = 41/59 (69%), Positives = 45/59 (75%)
Query:  1  MTGKKVEYILAIPKGDKHDWEDKEVCFFDKKWRTVGLALEGIEELIPLEWNKKVMVERY   59
           +TGKK  Y LAIPK D HDWE+K+V FF K WRT G  LEGIE LIPL+WNKKV VE Y
Sbjct: 56  LTGKKAIYTLAIPKKDTHDWENKKVRFFGKTWRTFGEPLEGIEGLIPLDWNKKVTVEHY  114
```

A related DNA sequence was identified in *S. pyogenes* <SEQ ID 1427> which encodes the amino acid sequence <SEQ ID 1428>. Analysis of this protein sequence reveals the following:

Possible site: 39
>>> Seems to have no N-terminal signalsequence
----- Final Results -----
    bacterial cytoplasm --- Certainty = 0.2779 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below:

```
Identities = 51/60 (85%), Positives = 57/60 (95%)
Query:   1 MTGKKVEYILAIPKGDKHDWEDKEVCFFDKKWRTVGLALEGIEELIPLEWNKKVMVERYE      60
           +TGKKVEY+LAIPKGD+HDWE+KEV FF KKWRTVG+ LEGIEELIPL+WNKKVMVERYE
Sbjct:  50 LTGKKVEYVLAIPKGDEHDWENKEVRFFGKKWRTVGIPLEGIEELIPLDWNKKVMVERYE     109
```

Based on this analysis, it was predicted that these proteins and their epitopes could be useful antigens for vaccines or diagnostics.

Example 445

A DNA sequence (GBSx0482) was identified in *S. agalactiae* <SEQ ID 1429> which encodes the amino acid sequence <SEQ ID 1430>. Analysis of this protein sequence reveals the following:

Possible site: 25
>>> Seems to have no N-terminal signal sequence
----- Final Results -----
   bacterial cytoplasm --- Certainty = 0.2770 (Affirmative) <succ>
     bacterial membrane --- Certainty = 0.0000 (Not Clear) <succ>
      bacterial outside --- Certainty = 0.0000 (Not Clear) <succ>

The protein has homology with the following sequences in the GENPEPT database:

```
>GP: AAB18708 GB: U38906 ORF33 [Bacteriophage rlt]
Identities = 89/130 (68%), Positives = 106/130 (81%), Gaps = 1/130 (0%)
Query:   1 MTNFATTDDVILLWRQLSVDEIKRAEALLETVSDTLRLEASKVGKNLDEMILETP-YFAT    59
           M  FAT DD+ +LWR L  DE +RAE LLE VSD+LR EA KVG++L  MI E P YFA+
Sbjct:   1 MNPFATVDDLTMLWRPLKGDEKERAEKLLEIVSDSLREEADKVGRDLYAMIAEKPSYFAS    60

Query:  60 VLKSVTVDIVARTLMTATQGEPMSQESQSALGYTWSGTYLVPGGGLFIKDSELKRLGLKK   119
           V+KSVTVDIVARTLMT+T  EPM+Q ++SALGY+ SG+YLVPGGGLFIK+SEL RLGLKK
Sbjct:  61 VVKSVTVDIVARTLMTSTDQEPMTQTTESALGYSVSGSYLVPGGGLFIKNSELSRLGLKK   120

Query: 120 QRYGGIELYG                                                    129
           QR+G I+ YG
Sbjct: 121 QRFGVIDFYG                                                    130
```

A related DNA sequence was identified in *S. pyogenes* <SEQ ID 1431> which encodes the amino acid sequence <SEQ ID 1432>. Analysis of this protein sequence reveals the following:

Possible site: 37
>>> Seems to have no N-terminal signal sequence
----- Final Results -----
   bacterial cytoplasm --- Certainty = 0.2061 (Affirmative) <succ>
     bacterial membrane --- Certainty = 0.0000 (Not Clear) <succ>
      bacterial outside --- Certainty = 0.0000 (Not Clear) <succ>

An alignment of the GAS and GBS proteins is shown below:

```
Identities = 116/138 (84%), Positives = 129/138 (93%)
Query:   3 NFATTDDVILLWRQLSVDEIKRAEALLETVSDTLRLEASKVGKNLDEMILETPYFATVLK    62
           NFATTDDVILLWR LSVDE+KRA ALL+ VSDTLR+EA KVGK+LD+ +++ PYF  V+K
Sbjct:   3 NFATTDDVILLWRPLSVDELKRANALLKVVSDTLRMEADKVGKDLDKTMVDKPYFVNVIK    62

Query:  63 SVTVDIVARTLMTATQGEPMSQESQSALGYTWSGTYLVPGGGLFIKDSELKRLGLKKQRY   122
           SVTVDIVARTLMT+T+GEPM+QESQSALGYTWSGTYLVPGGGLFIKDSELKRLGLKKQRY
Sbjct:  63 SVTVDIVARTLMTSTRGEPMAQESQSALGYTWSGTYLVPGGGLFIKDSELKRLGLKKQRY   122

Query: 123 GGIELYGEIERNNSYFSR                                            140
           GGIELYGEIER+NS FSR
Sbjct: 123 GGIELYGEIERDNSCFSR                                            140
```

Based on this analysis, it was predicted that these proteins and their epitopes could be useful antigens for vaccines or diagnostics.

Example 446

A DNA sequence (GBSx0483) was identified in *S. agalactiae* <SEQ ID 1433> which encodes the amino acid sequence <SEQ ID 1434>. This protein is predicted to be Structural protein. Analysis of this protein sequence reveals the following:

Possible site: 30
>>> Seems to have no N-terminal signal sequence
----- Final Results -----
   bacterial cytoplasm --- Certainty = 0.3015 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database:

A related DNA sequence was identified in *S. pyogenes* <SEQ ID 1435> which encodes the amino acid sequence <SEQ ID 1436>. Analysis of this protein sequence reveals the following:

Possible site: 30
>>> Seems to have no N-terminal signal sequence
----- Final Results -----
   bacterial cytoplasm --- Certainty = 0.2772 (Affirmative) <succ>
   bacterial membrane --- Certainty = 0.0000 (Not Clear) <succ>
   bacterial outside --- Certainty = 0.0000 (Not Clear) <succ>

```
>GP: AAB18706 GB: U38906 Structural protein [Bacteriophage rlt]
Identities = 132/296 (44%), Positives = 189/296 (63%), Gaps = 8/296 (2%)
Query:   5 IKAGTLFKPELVTEIMSKVKGHSTLAKLSGQTPIPFNGVEQFVFNLDGNAQIVGEGEQKL   64
           +  GTLF P LVT+++SKV G S++A+LS Q PIPFNG + F F +D    +V E  +K
Sbjct:   3 LNKGTLFDPTLVTDLISKVAGKSSIARLSAQKPIPFNGEKVFTFTMDSEIDVVAESGKKT  62

Query:  65 GNTAKVTSKIIKPLKFVYQARMTDEFKYASEEKRLNFLKHVADGFAKKMAEAFDIAAIHG  124
           +  +  P+K  Y AR++DEF YAS+E+++N L+ + DGFAKK+A   D+ A HG
Sbjct:  63 HGGVTLAPQTMVPIKVEYGARISDEFMYASDEEKINILQEFNDGFAKKVARGIDLMAFHG 122

Query: 125 LEPRTMTDASFKATNSFDGVVTGNVIKYEADK--IDDN--IDAAVTTIVANGNDVTGIAL  180
           + PR  T ++  TN FD VT    K EA +   D N  I+ AV +      DVTGIA+
Sbjct: 123 VNPRLGTASAVIGTNHFDSKVTQ---KVEAPRGIADPNGAIENAVELLTGVDADVTGIAI 179

Query: 181 SPQAGQDMSKRKDKFDNVMYPEFRFGQRPSNFFNMTLDINKTLTMKGGTAKDDHAIVGDF  240
           +P    ++K+KD  DN ++PE ++G  P    +D+NKT++    T + D AI+GDF
Sbjct: 180 NPSFRSALAKQKDLQDNALFPELKWGATPDTINGLPVDVNKTVSDMSLTQR-DRAIIGDF 238

Query: 241 QNMFKWGYAENIPMEIIEYGDPDGSGRDLKAYNEILLRTEAFIGWGILDEKAFSRV      296
            N  FKWGYA+ +P+E+I+YGDPD SG DLK YN++ +R E F+GWGILD     F+RV
Sbjct: 239 ANGFKWGYAKEVPLEVIQYGDPDNSGLDLKGYNQVYIRAELFLGWGILDATKFARV      294
```

An alignment of the GAS and GBS proteins is shown below:

```
Identities = 133/298 (44%), Positives = 187/298 (62%), Gaps = 2/298 (0%)
Query:   1 MAESIKAGTLFKPELVTEIMSKVKGHSTLAKLSGQTPIPFNGVEQFVFNLDGNAQIVGEG   60
             M       +LF   LV+++++KVKGHS+LAKLS Q PIPFNG ++F F LD +  +V E
Sbjct:   1 MGTETSKASLFDKHLVSDLINKVKGHSSLAKLESQKPIPFNGSKEFTFTLDSDIDVVAEN  60

Query:  61 EQKLGNTAKVTSKIIKPLKFVYQARMTDEFKYASEEKRLNFLKHYADGFAKKMAEAFDIA  120
           +K       I P+K  Y AR++DEF YA+EE++++ LK + +GFAKK+A    D+
Sbjct:  61 GKKTHGGLSLEPVTIVPIKVEYGARLSDEFLYATEEEKIDILKAFNEGFAKKLARGIDLM 120

Query: 121 AIHGLEPRTMTDASFKATNSFDGVVTGNVIKYEADKIDDNIDAAVTTIVANGNDVTGIAL  180
           A+HG+ PRT +      TN FD VT   V  E++  D NI+AAV  I  +  VTG+A+
Sbjct: 121 AMHGINPRTKKASDVIGTNHFDSKVTQVVKFTESEDADANIEAAVNLIQGSEGVVTGLAM 180

Query: 181 SPQAGQDMSK-RKDKFDNVMYPEFRFGQRPSNFFNMILDINKTLTMKGGTAKD-DHAIVG  238
```

```
                        +      ++K      +      MYPE  +G  P +    +    +N T+      A+   D   I+G

Sbjct:  181 DTEFSTALAKVTNGEMGPKMYPELAWGANPDSINGLKSSVNTTVGAGADEAESKDLVIIG           240

Query:  239 DFQNMFKWGYAENIPMEIIEYGDPDGSGRDLKAYNEILLRTEAFIGWGILDEKAFSRV              296
            DF++MFKWGYA+ IPMEII+YGDPD SG+DLK YN+I LR EA+IGWGILD K+F+RV Sbjct:  241 DFESMFKWGYAKQIPMEIIKYGDPDNSGKDLKGYNQIYLRAEAYIGWGILDAKSFARV              298
```

Based on this analysis, it was predicted that these proteins and their epitopes could be useful antigens for vaccines or diagnostics.

Example 447

A DNA sequence (GBSx0484) was identified in *S. agalactiae* <SEQ ID 1437> which encodes the amino acid sequence <SEQ ID 1438>. Analysis of this protein sequence reveals the following:

A related DNA sequence was identified in *S. pyogenes* <SEQ ID 1439> which encodes the amino acid sequence <SEQ ID 1440>. Analysis of this protein sequence reveals the following:

Possible site: 61
>>> Seems to have no N-terminal signal sequence
----- Final Results -----
   bacterial cytoplasm --- Certainty = 0.2224 (Affirmative) <succ>
     bacterial membrane --- Certainty = 0.0000 (Not Clear) <succ>
     bacterial outside --- Certainty = 0.000 (Not Clear) <succ>

Possible site: 59
>>> Seems to have no N-terminal signal sequence
----- Final Results -----
   bacterial cytoplasm --- Certainty = 0.3476 (Affirmative) <succ>
     bacterial membrane --- Certainty = 0.0000 (Not Clear) <succ>
     bacterial outside --- Certainty = 0.0000 (Not Clear) <succ>

A related GBS nucleic acid sequence <SEQ ID 9659> which encodes amino acid sequence <SEQ ID 9660> was also identified.

The protein has homology with the following sequences in the GENPEPT database:

```
>GP: AAB18705 GB: U38906 ORF30 [Bacteriophage rlt]
Identities = 64/158 (40%), Positives = 101/158 (63%), Gaps = 8/158 (5%)
Query:   43 MSEFKVIETQEELDTIVKARIARERE----KYQDYDQLKTRVEELETENSSLQTALNDAK            98
            MSE  + +TQEEL+ I++ R+AR++E    + DYD+LKT++  LE +N++ Q  + ++K Sbjct:    1 MSENNLPKTQEELNQIIETRLARQKETIEANFADYDELKTKIAALEADNTAYQATIEESK            60

Query:   99 SNTDSYTEKITTLENQIAGYEAANLRTKVALQYGLPIDLANRLQGDDEDGLKVDAERLAS           158
            S     + ++      E QI+GY+    L+   +A++ GLP+DLA+RL GDDE+ LK DAER +

Sbjct:   61 S----WEQEKADYEKQISGYKTTQLKQSIAIKAGLPLDLADRLSGDDEESLKADAERFSG          116

Query:  159 FIKPSQPQPPTKSNEPIITDQKEAGWIEMARNLVNKGE                                196
            FIKP   P  P K  EP + D K+  +  ++     L  +GE Sbjct:  117 FIKPKTPPAPLKDVEPNLGDGKDGAYRKLVDGLKTEGE                                154
```

An alignment of the GAS and GBS proteins is shown below:

```
            Identities = 128/149 (85%), Positives = 136/149 (90%)
            Query:   43 MSEFKVIETQEELDTIVKARIAREREKYQDYDQLKTRVEELETENSSLQTALNDAKSNTD  102
                        MSEFKVIETQEELDTIVKARIAREREKYQDYDQLKTRVEELETENSSLQTALNDAKSNTD
            Sbjct:    1 MSEFKVIETQEELDTIVKARIAREREKYQDYDQLKTRVEELETENSSLQTALNDAKSNTD   60

Query:  103 SYTEKITTLENQIAGYEAANLRTKVALQYGLPIDLANRLQGDDEDGLKVDAERLASFIKP  162
                        SYTE+I+TL+NQIA YE ANLRTKVALQYGLPIDLA+RLQGDDEDGLKVDAERLASFIKP
            Sbjct:   61 SYTEEISTLKNQIADYETANLRIKVALQYGLPIDLADRLQGDDEDGLKVDAERLASFIKP  120

Query:  163 SQPQPPTKSNEPIITDQKEAGWIEMARNL                                191
                        SQPQPP KSNEP I   +A +  + L
            Sbjct:  121 SQPQPPAKSNEPNIDSNADANYRALVQGL                                149
```

Based on this analysis, it was predicted that these proteins and their epitopes could be useful antigens for vaccines or diagnostics.

Example 448

A DNA sequence (GBSx0485) was identified in *S. agalactiae* <SEQ ID 1441> which encodes the amino acid sequence <SEQ ID 1442>. Analysis of this protein sequence reveals the following:

Possible site: 56
>>> Seems to have no N-terminal signal sequence
----- Final Results -----
   bacterial cytoplasm --- Certainty = 0.2888 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database:

```
>GP:AAB18704 GB:U38906 ORF29 [Bacteriophage r1t]
Identities = 322/461 (69%), Positives = 383/461 (82%)
Query:    8 KLGNQRPTQSVNLHFAKTLAHEAINYYKKTGLSCYLWQENMLIPMMAINEDNLWVHQKYG    67
            + GNQ PTQSV L F +T    EAI  Y+K+   CY WQ+N+L  +MAI+ED LW HQK+G
Sbjct:    6 RFGNQYPTQSVILPFTETKYQEAIEIYEKSKHECYPWQKNLLKEVMAIDEDGLWTHQKFG    65

Query:   68 YAIPRRNGKTEVVYILELWALHKGLKILHTAHRISTSHSSFEKVKKYLEMSGYVDGEDFI   127
            Y+IPRRNGKTE+VYILELW+L +GL  ILHTAHRISTSHSS+EK+KKYLE SGYV+GEDF
Sbjct:   66 YSIPRRNGKTEIVYILELWSLVQGLSILHTAHRISTSHSSYEKLKKYLEDSGYVEGEDFK   125

Query:  128 SNKAKGQERIEFKSSGSVIQFRTRTSNGGLGEGFDLLIIDEAQEYTAEQESALKYTVTDS   187
            S KAKGQER+E   SG VIQFRTRTS+GGLGEGFD+L+IDEAQEYT EQESALKYTVTDS
Sbjct:  126 SIKAKGQERLELIESGGVIQFRTRTSSGGLGEGFDILVIDEAQEYTTEQESALKYTVTDS   185

Query:  188 DNPMTIMCGTPPTMVSTGTVFESYRKECLKGDRRYSGWAEWSVDEMQPIHDVKSWYVANP   247
            DNPMTIMCGTPPT VS+GTVF +YR   + G  +YSGWAEWSV++++ IHDV++WY +NP
Sbjct:  186 DNPMTIMCGTPPTPVSSGTVFTNYRDNTIAGKAKYSGWAEWSVEDVKDIHDVEAWYNSNP   245

Query:  248 SMGYHLNERKIEAELGEDEIDHNIQRLGYWPSFNQKSVISEKEWAKLKVEQVPELKSKLF   307
            SMGYHLNERKIEAELGED++DHN+QRLGYWP +NQKSVISE+EW  LKV ++P +K KLF
Sbjct:  246 SMGYHLNERKIEAELGEDKLDHNVQRLGYWPKYNQKSVISEQEWNALKVNRLPVIKGKLF   305

Query:  308 VGIKFGQDGNNVSLSIAARASENKVFVEAIDCLSVRNGTQWIINFLKSADIAKVVVDGAS   367
            VGIK+G DG NV++SIA +    KVFVE  IDC S+RNG QWIINFLK AD+ KVV+DG S
Sbjct:  306 VGIKYGNDGANVAMSIAVKTLSGKVFVETIDCQSIRNGNQWIINFLKKADVEKVVIDGQS   365

Query:  368 GQELLAQEMREHGLKKPELPKVAEIITANTMWEQGIMQETICHNDQPSLTAVVTNCEKRQ   427
            GQ +L  EM++  LK+P LP V EII AN++WEQGI Q+  CH+ QPSL+ VVTNC+KR
Sbjct:  366 GQSILTSEMKDFKLKEPILPTVKEIINANSLWEQGIFQKNECHSGQPSLSTVVTNCDKRN   425

Query:  428 IGSNGGFGYKSLYDDRDISLMDSALLAHWICYTTKPKRKQR                     468
            IG++GGFGYKS +DD DISLMDSALLAHW C    KPK+KQ+
Sbjct:  426 IGTSGGFGYKSQFDDMDISLMDSALLAHWACSNNKPKKKQQ                     466
```

A related DNA sequence was identified in *S. pyogenes* <SEQ ID 1443> which encodes the amino acid sequence <SEQ ID 1444>. Analysis of this protein sequence reveals the following:

Possible site: 32
>>> Seems to have no N-terminal signal sequence
----- Final Results -----
   bacterial cytoplasm --- Certainty = 0.3133 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below:

```
Identities = 437/471 (92%), Positives = 459/471 (96%)
Query:    1 MVTKTKAKLGNQRPTQSVNLEFAKTLAHEAINYYKKTGLSCYLWQENMLIPMMAINEDNL    60
            MVTKTK KLGNQRPTQSVN+EFAK+LAHEAINYYKKTGLSCY WQ NMLIP+MAI+E+ L
Sbjct:    6 MVTKTKTKLGNQRPTQSVNLEFAKSLAHEAINYYKKTGLSCYPWQVNMLIPIMAIDENGL    65

Query:   61 WVHQKYGYAIPRRNGKTEVVYILELWALHKGLKILHTAHRISTSHSSFEKVKKYLEMSGY   120
            WVHQKYGYAIPRRNGKTEVVYI++LWALHKGLKILHTAHRISTSH+SFEKVKKYLEMSGY
Sbjct:   66 WVHQKYGYAIPRRNGKTEVVYIVQLWALHKGLKILHTAHRISTSHASFEKVKKYLEMSGY   125

Query:  121 VDGEDFISNKAKGQERIEFKSSGSVIQFRTRTSNGGLGEGFDLLIIDEAQEYTAEQESAL   180
            VDGEDFISNKAKGQERIEFK+SG+VIQFRTRTSNGGLGEGFDLLIIDEAQEYT+EQESAL
Sbjct:  126 VDGEDFISNKAKGQERIEFKASGAVIQFRTRTSNGGLGEGFDLLIIDEAQEYTSEQESAL   185
```

```
-continued
Query: 181  KYTVTDSDNPMTIMCGTPPTMVSTGTVFESYRKECLKGDRRYSGWAEWSVDEMQPIHDVK  240
             KYTVTDSDNPMTIMCGTPPTMVSTGTVFE+YRK+CLKG++RYSGWAEWSV EM   I+DV
Sbjct: 186  KYTVTDSDNPMTIMCGTPPTMVSTGTVFEAYRKDCLKGNKRYSGWAEWSVPEMVKINDVS  245

Query: 241  SWYVANPSMGYHLNERKIEAELGEDEIDHNIQRLGYWPSFNQKSVISEKEWAKLKVEQVP  300
             SWY++NPSMG+HLNERKIEAELGEDEIDHNIQRLGYWPSFNQKSVISEKEWAKLKVEQVP
Sbjct: 246  SWYISNPSMGFHLNERKIEAELGEDEIDHNIQRLGYWPSFNQKSVISEKEWAKLKVEQVP  305

Query: 301  ELKSKLFVGIKFGQDGNNVSLSIAARASENKVFVEAIDCLSVRNGTQWIINFLKSADIAK  360
             ELKSKLFVGIKFGQDGNNVSLSIAAR SENKVFVE IDCLSVRNGTQWIINFLKSADIAK
Sbjct: 306  ELKSKLFVGIKFGQDGNNVSLSIAARTSENKVFVETIDCLSVRNGTQWIINFLKSADIAK  365

Query: 361  VVVDGASGQELLAQEMREHGLKKPELPKVAEIITANTMWEQGIMQETICHNDQPSLTAVV  420
             VV+DGASGQELLAQEM++ GLKKPELPKVAEIITAN MWEQGIMQETICH+DQPSLTAVV
Sbjct: 366  VVIDGASGQELLAQEMKDQGLKKPELPKVAEIITANMMWEQGIMQETICHSDQPSLTAVV  425

Query: 421  TNCEKRQIGSNGGFGYKSLYDDRDISLMDSALLAHWICYTTKPKRKQRTSC           471
             TNCEKRQIGSNGGFGYKSLYDDRDISLMDSALLAHWICYTTKPKRKQRTSC
Sbjct: 426  TNCEKRQIGSNGGFGYKSLYDDRDISLMDSALLAHWICYTTKPKRKQRTSC           476
```

Based on this analysis, it was predicted that these proteins and their epitopes could be useful antigens for vaccines or diagnostics.

Example 449

A DNA sequence (GBSx0486) was identified in S. agalactiae <SEQ ID 1445> which encodes the amino acid sequence <SEQ ID 1446>. Analysis of this protein sequence reveals the following:

Possible site: 32
>>> Seems to have no N-terminal signal sequence
----- Final Results -----
   bacterial cytoplasm --- Certainty = 0.2745 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 450

A DNA sequence (GBSx0487) was identified in S. agalactiae <SEQ ID 1447> which encodes the amino acid sequence <SEQ ID 1448>. Analysis of this protein sequence reveals the following:

Possible site: 32
>>> Seems to have no N-terminal signal sequence
----- Final Results -----
   bacterial cytoplasm --- Certainty = 0.2568 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database:

```
>GP:AAB18703 GB:U38906 ORF28 [Bacteriophage r1t]

Identities = 124/250 (49%), Positives = 164/250 (65%), Gaps = 3/250 (1%)
Query:   2  VDDVLPKLLKSVQQDFEKHFGKSEVVAKAFAELQAKKATYKTVNEFAVEVGRLLSLALAN   61
            ++D+LP LL+ + QDF++     S+ + ++   L+ KKATY   NEF VEVG++LS   L
Sbjct:   1  MEDILPPLLEKINQDFDERAANSKKLKQSMELLKTKKATYIQANEFGVEVGQILSDVLGT   60

Query:  62  SVISDELPDGKMYYNIANRLVNDTLRHNYKLISDYAGDVQQNLNKQAKISLKIQRPPLNQ  121
             V   D LPDGKMY+NIA+RL+N   L+ N+ LIS Y+ DVQ   LN+ A    LK Q P LNQ
Sbjct:  61  HVTVDVLPDGKMYFNIADRLLNSILKKNFDLISGYSTDVQSELNQLAGFKLKSQVPELNQ  120

Query: 122  DKIDGLVNRLASEPVFDDVKWLLDEPIVNFSQSIVDDCIRANADFHFKTGLKPTIERIST  181
            D+IDG+VNR++SE  F+ + WLL EPIV FSQS+VDD ++ N DF  K GLKP I R
Sbjct: 121  DRIDGIVNRISSEDDFEKILWLLKEPIVTFSQSVVDDTLKKNIDFQAKAGLKPKIVRKLV  180

Query: 182  GKCCDWCDRLAGRYVYHEEPKDFYKRHQHCQCVIDYHPK--NGKRQNSWSKKWTKETTDI  239
            GK CDWC  LAG Y Y   P D Y RH+ C+C ++Y P+   + KRQ+ WSK W       D
Sbjct: 181  GKACDWCRNLAGSYDYPNVPSDVYHRHERCRCTVEYDPRDIDKKRQDVWSKNWVDPDKDA  240

Query: 240  -LERRKQMNI                                                   248
             +  RK +N+
Sbjct: 241  KIAERKNLNL                                                   250
```

A related DNA sequence was identified in *S. pyogenes* <SEQ ID 1449> which encodes the amino acid sequence <SEQ ID 1450>. Analysis of this protein sequence reveals the following:

```
Possible site: 32
>>> Seems to have no N-terminal signal sequence
----- Final Results -----
   bacterial cytoplasm --- Certainty = 0.3099 (Affirmative) <succ>
    bacterial membrane --- Certainty = 0.0000 (Not Clear) <succ>
     bacterial outside --- Certainty = 0.0000 (Not Clear) <succ>
```

An alignment of the GAS and GBS proteins is shown below:

```
Identities = 169/261 (64%), Positives = 207/261 (78%), Gaps = 2/261 (0%)
Query:   1  MVDDVLPKLLKSVQQDFEKHFGKSEVVAKAFAELQAKKATYKTVNEFAVEVGRLLSLALA   60
            MVDDVLPKLLKSV+QDFEK+FG+S+VV KAFAELQAKK TYKTVNEFA+EVGRLLSLAL
Sbjct:   1  MVDDVLPKLLKSVRQDFEKYFGESDVVTKAFAELQAKKVTYKTVNEFAIEVGRLLSLALT   60

Query:  61  NSVISDELPDGKMYYNIANRLVNDTLRHNYKLISDYAGDVQQNLNKQAKISLKIQRPPLN  120
              SV  SD+LPDGKMYYNIA RL+++T+  NYKLIS YAGDVQ+ LN+ A+I LK+QRPPLN
Sbjct:  61  GSVSSDKLPDGKMYYNIAKRLLDETMGRNYKLISGYAGDVQRILNENAQIGLKVQRPPLN  120

Query: 121  QDKIDGLVNRLASEPVFDDVKWLLDEPIVNFSQSIVDDCIRANADFHFKTGLKPTIERIS  180
            +DKI+G+VNRL SE  FDDVKWL EPIVNFSQSIVDD I+ANAD  +KTG+ P + R
Sbjct: 121  RDKINGMVNRLDSENTFDDVKWLFGEPIVNFSQSIVDDTIKANADLQYKTGMTPQVVRTE  180

Query: 181  TGKCCDWCDRLAGRYVYHEEPKDFYKRHQHCQCVIDYHPKNGKRQNSWSKKWTK--ETTD  238
            +G CC+WC   + G  Y Y + PKD ++RHQ C+C +DY PKNGK Q++WSK W K  +T +
Sbjct: 181  SGNCCEWCREVVGTYSYPKVPKDVWRRHQRCRCILDYDPKNGKVQSAWSKIWRKKEKTQE  240

Query: 239  ILERRKQMNIDIRDNNRKSDI                                         259
            +ER ++          + K+DI
Sbjct: 241  SIERVEKFKESALVESIKNDI                                         261
```

Based on this analysis, it was predicted that these proteins and their epitopes could be useful antigens for vaccines or diagnostics.

Example 451

A DNA sequence (GBSx0488) was identified in *S. agalactiae* <SEQ ID 1451> which encodes the amino acid sequence <SEQ ID 1452>. This protein is predicted to be Structural protein. Analysis of this protein sequence reveals the following:

```
Possible site: 58
>>> Seems to have no N-terminal signal sequence
INTEGRAL    Likelihood = -1.38    Transmembrane 93-109 (93-110)
----- Final Results -----
   bacterial membrane --- Certainty = 0.1553 (Affirmative) <succ>
    bacterial outside --- Certainty = 0.0000 (Not Clear) <succ>
  bacterial cytoplasm --- Certainty = 0.0000 (Not Clear) <succ>
```

The protein has homology with the following sequences in the GENPEPT database:

```
>GP:AAC39307 GB:AF022773 ORF5 [Lactococcus bacteriophage phi31]
Identities = 271/410 (66%), Positives = 326/410 (79%), Gaps = 2/410 (0%)
Query:   1  MNYMGMGYLQRKLALFKTGVDKRYRYYAMDDRDNTRSIVMPDNVREMYRSVIEWTAKGVD   60
            M  G+GYL+ KL++ K   + RY YAM  D + +P + + YRS++ W AKGVD
Sbjct:   1  MTEKGIGYLRFKLSVHKRRAEMRYEQYAMKHVDRFKGITIPQALSQQYRSILGWCAKGVD   60

Query:  61  SLADRIIFREFANDDFNAWEIFKANNPDIFFDTAIQSALIASCCFVYIMPGKEDSLPKMQ  120
            SLADR+IFREF NDDF   EIF+ NNPDIFFD+A+ SALIASC F+YI  G+ D++ ++Q
Sbjct:  61  SLADRLIFREFENDDFTVNEIFEENNPDIFFDSAVLSALIASCSFIYISKGENDAV-RLQ  119

Query: 121  VIEASKATGILDPTTFLLTEGYAVLESDSNENPTLEAYFTGEKTWYYPKDEKP-YSIDNS  179
            VIEA  ATGI+DP T LLTEGYAVLE D N N  LEA+F  ++T YY +D +    SI N
Sbjct: 120  VIEAVNATGIIDPITGLLTEGYAVLERDENNNVVLEAHFLPDRIDYYYRDSRNNISIANP  179

Query: 180  TGHPLLVPVIHRPDAVRPFGRSRITKAGMYHQKAAKRTLERAEVTAEFYSFPQKYVLGMD  239
            TGHPLLVP+IHRPDAVRPFGRSRIT++GMY Q  AKRTLERA+VTAEFYSFPQKYV G+
Sbjct: 180  TGHPLLVPIIHRPDAVRPFGRSRITRSGMYWQSNAKRTLERADVTAEFYSFPQKYVTGLS  239

Query: 240  PDAEPMEKKRATVSTLLEISKDEDGDKPTVGQFTTASMAPFMDHLKMYASLFAGGSGLTL  299
              DAEPME W++ATVS++L+ +KDEDGDKPT+GQFT  SM+PF + L+  A+ FAG +GLTL
Sbjct: 240  DDAEPMETWKATVSSMLQFTKDEDGDKPTLGQFTQPSMSPFTEQLRTAAAGFAGETGLTL  299

Query: 300  DDLGFPSDNPSSVEAIKAAHENLRAAGRKAQRSFSSGFLNVAYIAVCLRDDFPYLRNQFM  359
            DDLGF SDNPSSVEAIKA+HENLR AGRKAQRS  +G LNVAY+A CLRDD PYLR QF
Sbjct: 300  DDLGFVSDNPSSVEAIKASHENLRLAGRKAQRSLGAGLLNVAYLAACLRDDVPYLREQFS  359
```

```
Query:  360  DTEIKWEPLFEADANMLTLVGDGAIKLNQAIPGFMDADVIRDLTGVKGSD            409
             T+ KWEPLFEADA+ML+L+GDGAIKLNQAIP F++ D IRDLTG+KG++
Sbjct:  360  KTKPKWEPLFEADASMLSLIGDGAIKLNQAIPEFINKDTIRDLTGIKGAE            409
```

A related DNA sequence was identified in *S. pyogenes* <SEQ ID 1453> which encodes the amino acid sequence <SEQ ID 1454>. Analysis of this protein sequence reveals the following:

```
Possible site: 58
>>> Seems to have no N-terminal signal sequence
INTEGRAL     Likelihood = -1.38   Transmembrane 93-109 (93-110)
----- Final Results -----
   bacterial membrane --- Certainty = 0.1553 (Affirmative) <succ>
   bacterial outside --- Certainty = 0.0000 (Not Clear) <succ>
   bacterial cytoplasm --- Certainty = 0.0000 (Not Clear) <succ>
```

An alignment of the GAS and GBS proteins is shown below:

```
Identities = 395/422 (93%), Positives = 407/422 (95%)
Query:    1  MNYMGMGYLQRKLALFKTGVDKRYRYYAMDDRDNTRSIVMPDNVREMYRSVIEWTAKGVD   60
             MNYMGMGYL+RKLALFKTGVDKRYRYYAMDDRD+TRSIVMP+NVREMYRSV+EWTAKGVD
Sbjct:    1  MNYMGMGYLRRKLALFKTGVDKRYRYYAMDDRDDTRSIVMPNNVREMYRSVLEWTAKGVD   60

Query:   61  SLADRIIFREFANDDFNAWEIFKANNPDIFFDTAIQSALIASCCFVYIMPGKEDSLPKMQ  120
             SLADRIIFREF NDDFNAWEIFKANNPDIFFDTAIQSALIASCCFVYIMPG ED LPKMQ
Sbjct:   61  SLADRIIFREFTNDDFNAWEIFKANNPDIFFDTAIQSALIASCCFVYIMPGAEDGLPKMQ  120

Query:  121  VIEASKATGILDPTTFLLTEGYAVLESDSNENPTLEAYFTGEKTWYYPRDEKPYSIDNST  180
             VIEASKATGILDPTTFLLTEGYA+LESDSN NPTLEAYFT +    WYYPK  KPY+I N T
Sbjct:  121  VIEASKATGILDPTTFLLTEGYAILESDSNGNPTLEAYFTDKDIWYYPKKGKPYNIKNPT  180

Query:  181  GHPLLVPVIHRPDAVRPFGRSRITKAGMYHQKAAKRTLERAEVTAEFYSFPQKYVLGMDP  240
             GHPLLVP+IHRPDAVRPFGRSRITKAGMYHQKAAKRTLERAEVTAEFYSFPQKYVLGMDP
Sbjct:  181  GHPLLVPIIHRPDAVRPFGRSRITKAGMYHQKAAKRTLERAEVTAEFYSFPQKYVLGMDP  240

Query:  241  DAEPMEKWRATVSTLLEISKDEDGDKPTVGQFTTASMAPFMDHLKMYASLFAGGSGLTLD  300
             DAEPMEKWRATVSTLLEISKDEDGDKPTVGQFTTASMAPFM+HLKMYASLFAGGSGLTLD
Sbjct:  241  DAEPMEKWRATVSTLLEISKDEDGDKPTVGQFTTASMAPFMEHLKMYASLFAGGSGLTLD  300

Query:  301  DLGFPSDNPSSVEAIKAAHENLRAAGRKAQRSFSSGFLNVAYIAVCLRDDFPYLRNQFMD  360
             DLGFPSDNPSSVE+IKAAHENLRAAGRKAQRSFSSGFLNVAYIAVCLRD+FPYLRNQFMD
Sbjct:  301  DLGFPSDNPSSVESIKAAHENLRAAGRKAQRSFSSGFLNVAYIAVCLRDEFPYLRNQFMD  360

Query:  361  TEIKWEPLFEADANMLTLVGDGAIKLNQAIPGFMDADVIRDLTGVKGSDNPIPKATEVTT  420
             T IKWEPLFEADANMLTLVGDGAIKLNQAIPGFMDADVIRDLTGVKG+D PIP  TEVTT
Sbjct:  361  TVIKWEPLFEADANMLTLVGDGAIKLNQAIPGFMDADVIRDLTGVKGADKPIPAITEVTT  420

Query:  421  DG                                                            422
             DG
Sbjct:  421  DG                                                            422
```

Figure 73:
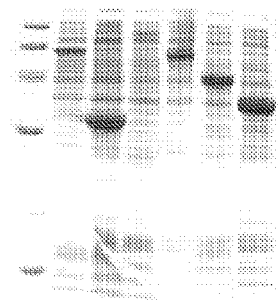
Figure 81:
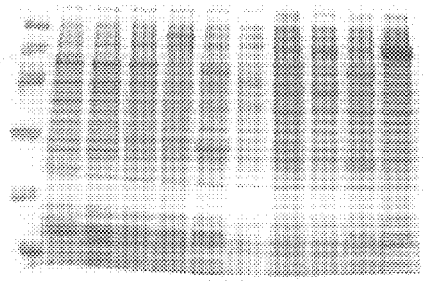

SEQ ID 1452 (GBS364) was expressed in *E. coli* as a His-fusion product. SDS-PAGE analysis of total cell extract is shown in FIG. 73 (lane 6; MW 50 kDa). It was also expressed in *E. coli* as a GST-fusion product. SDS-PAGE analysis of total cell extract is shown in FIG. 81 (lane 11; MW 75 kDa).

GBS364-GST was purified as shown in FIG. 216, lane 10.

Based on this analysis, it was predicted that these proteins and their epitopes could be useful antigens for vaccines or diagnostics.

Example 452

A DNA sequence (GBSx0489) was identified in *S. agalactiae* <SEQ ID 1455> which encodes the amino acid sequence <SEQ ID 1456>. Analysis of this protein sequence reveals the following:

```
Possible site: 16
>>> Seems to have no N-terminal signal sequence
----- Final Results -----
   bacterial cytoplasm --- Certainty = 0.4063 (Affirmative) <succ>
   bacterial membrane --- Certainty = 0.0000 (Not Clear) <succ>
   bacterial outside --- Certainty = 0.0000 (Not Clear) <succ>
```

The protein has no significant homology with any sequences in the GENPEPT database.

A related DNA sequence was identified in *S. pyogenes* <SEQ ID 1457> which encodes the amino acid sequence <SEQ ID 1458>. Analysis of this protein sequence reveals the following:

```
Possible site: 16
>>> Seems to have no N-terminal signal sequence
----- Final Results -----
   bacterial cytoplasm --- Certainty = 0.4120 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below:

```
Identities = 101/118 (85%), Positives = 110/118 (92%)
Query:   1 MKKKCLICKKTFQAKTNRSLYCSEECRKKGIREKQRKLMKQKRADKKKEKIKVLNTNADV   60
           +KKKCLICKK FQAKTNR+LYCSEECRKKG REKQRKLMKQKRA+++KEK KVLN N DV
Sbjct:   1 LKKKCLICKKNFQAKTNRTLYCSEECRKKGNREKQRKLMKQKRAEQRKEKKKVLNPNTDV   60

Query:  61 TEKPKKIRNLVQHYKKLKREILDNESEFGFTGIALVEGIDIHEENFVDLVMQKIKEQQ    118
           TEKPKKIRNL QHYKKLK+EIL NESEFGFTGI L+EGID+HEENFVDLVMQKIKEQ+
Sbjct:  61 TEKPKKIRNLAQHYKKLKKEILANESEFGFTGITLIEGIDVHEENFVDLVMQKIKEQK    118
```

Based on this analysis, it was predicted that these proteins and their epitopes could be useful antigens for vaccines or diagnostics.

Example 453

A DNA sequence (GBSx0490) was identified in *S. agalactiae* <SEQ ID 1459> which encodes the amino acid sequence <SEQ ID 1460>. Analysis of this protein sequence reveals the following:

Possible site: 19
>>> Seems to have no N-terminal signal sequence
----- Final Results -----
   bacterial cytoplasm --- Certainty = 0.0633 (Affirmative) <succ>
      bacterial membrane --- Certainty = 0.0000 (Not Clear) <succ>
         bacterial outside --- Certainty = 0.0000 (Not Clear) <succ>

The protein has homology with the following sequences in the GENPEPT database:

```
>GP:AAC39305 GB:AF022773 ORF3 [Lactococcus bacteriophage phi31]
Identities = 75/109 (68%), Positives = 87/109 (79%), Gaps = 1/109 (0%)
Query:  29 LRADKKGTHRVAFEKNKRRLLKTAHLCGICGRPVDKSLKYPHPLSAAIDHIVPIAKGGHP   88
           LRAD+ G HRVAF+KN++ LLKT + CGICG+P+DK LK P PLS  +DHI+PI KGGHP
Sbjct:   3 LRADRTGAHRVAFDKNRKILLKTQNTCGICGKPIDKRLKAPDPLSPVVDHIIPINKGGHP   62

Query:  89 SSIDNLQLTHWQCNRQKSDKLFINQTAVRATVVGNRNLPQSRDWSSYAS            137
           S++DNLQL HW CNRQKSDKLF N      V+GNRNLPQSRDWSSY S
Sbjct:  63 SANDNLQLAHWTCNRQKSDKLF-NVKQEEPKVLGNRNLPQSRDWSSYVS            110
```

A related DNA sequence was identified in *S. pyogenes* <SEQ ID 1461> which encodes the amino acid sequence <SEQ ID 1462>. Analysis of this protein sequence reveals the following:

Possible site: 49
>>> Seems to have no N-terminal signal sequence
----- Final Results -----
   bacterial cytoplasm --- Certainty = 0.4185 (Affirmative) <succ>
      bacterial membrane --- Certainty = 0.0000 (Not Clear) <succ>
         bacterial outside --- Certainty = 0.0000 (Not Clear) <succ>

An alignment of the GAS and GBS proteins is shown below:

```
Identities = 88/112 (78%), Positives = 102/112 (90%)
Query:  28 KLRADKKGTHRVAFEKNKRRLLKTAHLCGICGRPVDKSLKYPHPLSAAIDHIVPIAKGGH   87
           +LRADKKGTHRVAF++NK++LLK A +CGICG+PVDKSLKYPHPLSAAIDHIVPIAKGGH
Sbjct:   3 QLRADKKGTHRVAFDRNKKKLLKAATVCGICGKPVDKSLKYPHPLSAAIDHIVPIAKGGH   62

Query:  88 PSSIDNLQLTHWQCNRQKSDKLFINQTAVRATVVGNRNLPQSRDWSSYASKE          139
           PS+++NLQLTHWQCNRQKSDKLF NQ +    +GNRNLPQSRDWSS+A K+
Sbjct:  63 PSALENLQLTHWQCNRQKSDKLFANQASNEPKTIGNRNLPQSRDWSSFAFKK          114
```

Based on this analysis, it was predicted that these proteins and their epitopes could be useful antigens for vaccines or diagnostics.

Example 454

A DNA sequence (GBSx0491) was identified in *S. agalactiae* <SEQ ID 1463> which encodes the amino acid sequence <SEQ ID 1464>. Analysis of this protein sequence reveals the following:

Possible site: 33
>>> Seems to have no N-terminal signal sequence
----- Final Results -----
   bacterial cytoplasm --- Certainty = 0.4481 (Affirmative) <succ>
      bacterial membrane --- Certainty = 0.0000 (Not Clear) <succ>
         bacterial outside --- Certainty = 0.0000 (Not Clear) <succ>

Based on this analysis, it was predicted that this protein and its epitopes, could be useful antigens for vaccines or diagnostics.

Example 455

A DNA sequence (GBSx0492) was identified in *S. agalactiae* <SEQ ID 1465> which encodes the amino acid sequence <SEQ ID 1466>. Analysis of this protein sequence reveals the following:

Possible site: 28
>>> Seems to have no N-terminal signal sequence
----- Final Results ----- bacterial cytoplasm --- Certainty = 0.2907 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database:

```
>GP:AAF43508 GB:AF145054 ORF15 [Streptococcus thermophilus
bacteriophage 7201]
Identities = 61/187 (32%), Positives = 90/187 (47%), Gaps = 31/187 (16%)
Query:   1 MNIEEAKKLIDKQSIGKGGVGDIPVVKTHIVKVLLDQIDQPQPEVPRFVADWYEKHKDSL      60
           MN +EA K I K+           +      + L D I    +P VP++VADWYE+HKD
Sbjct:   1 MNRDEAVKKIAKEGY----------ISIEHAEDLYDSIIT-KPVVPQYVADWYEEHKDEF   49

Query:  61 ECDL------YLYHMSIY--DEEVEKDDFYYWMQTSKNPVYTLINMHQFGYTIQKEKLYT     112
           +L       + H++ Y +E       DF W    +KN +  L+NMHQFGY ++KEK YT
Sbjct:  50 YLNLHRVVRDFFEHLNAYYFNENPIDYDFACWYYNTKNAIQILVNMHQFGYEVKKEKRYT    109

Query: 113 VEIPN--PNERQLSFVLMRQLSGNVSIKVMHRDNLDLLKTDNDLQLTESEIRKDFDWAWQ     170
           V I N    E  L++  R+     +      RDN D  +T +     T  E+ ++  + W
Sbjct: 110 VRIRNLDDEETYLNYDKFRE-----TWVFYSRDNTDRFRTIH----THKEL-EEGGFGWV    159

Query: 171 FREEVVE                                                         177
           F  E +E
Sbjct: 160 FDCEGIE                                                         166
```

A related GBS nucleic acid sequence <SEQ ID 10927> which encodes amino acid sequence <SEQ ID 10928> was also identified.

A related DNA sequence was identified in S. pyogenes <SEQ ID 1467> which encodes the amino acid sequence <SEQ ID 1468>. Analysis of this protein sequence reveals the following:

Possible site: 21
>>> Seems to have no N-terminal signal sequence
----- Final Results -----
bacterial cytoplasm --- Certainty = 0.3815 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below:

```
Identities = 70/180 (38%), Positives = 98/180 (53%), Gaps = 30/180 (16%)
Query:   1 MNIEEAKKLIDKQSI-GKGGVGDIPVVKTHIVRVLLDQIDQPQPEVPREVADWYEKHKDS    59
           MNIEEAK+L+D    GK        V+K   V+ ++DQ++QP+PEVP+ VADW E+ K+
Sbjct:   1 MNIEEAKELVDNSKFYGKTS----SVIKAE-VEDIIDQLNQPKPEVPQCVADWIEECKEE   55

Query:  60 LECDLYLYHMSIYDEEVEKDDFYYWMQTSKNPVYTLINMHQFGYTIQKEKLYTVEIPN--   117
              DL L    ++          + W+  S       +        GYT++KEKLYTV++PN
Sbjct:  56 ---DLTL--KGLFSNSDMPAKIEDWIFGSDENCRLMAEAWINGYTVEKEKLYTVDLPNGQ   110

Query: 118 PNERQLSFVLMRQLSGNVSIKVMHRDNLDLLKTDNDLQLTESEIRKDFDWAWQFREEVVE   177
           P   R ++ +    Q                    L T+N ++LTESEIRKDF+WAWQF EEV E
Sbjct: 111 PLVRGINTLYFSQN----------------LATEN-VKLTESEIRKDFEWAWQFAEEVTE   153
```

Based on this analysis, it was predicted that these proteins and their epitopes could be useful antigens for vaccines or diagnostics.

Example 456

A DNA sequence (GBSx0493) was identified in S. agalactiae <SEQ ID 1469> which encodes the amino acid sequence <SEQ ID 1470>. Analysis of this protein sequence reveals the following:

Possible site: 46
>>> Seems to have no N-terminal signal sequence
----- Final Results -----
bacterial cytoplasm --- Certainty = 0.5365 (Affirmative) <succ>
bacterial membrane --- Certainty = 0.0000 (Not Clear) <succ>
bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 457

A DNA sequence (GBSx0494) was identified in S. agalactiae <SEQ ID 1471> which encodes the amino acid sequence <SEQ ID 1472>. Analysis of this protein sequence reveals the following:

Possible site: 50
>>> Seems to have no N-terminal signal sequence
INTEGRAL    Likelihood = −8.55    Transmembrane 34-50 (31-54)
----- Final Results -----
bacterial membrane --- Certainty = 0.4418 (Affirmative) <succ>
bacterial outside --- Certainty = 0.0000 (Not Clear) <succ>
bacterial cytoplasm --- Certainty = 0.0000 (Not Clear) <succ>

A related GBS nucleic acid sequence <SEQ ID 9657> which encodes amino acid sequence <SEQ ID 9658> was also identified.

The protein has no significant homology with any sequences in the GENPEPT database.

A related DNA sequence was identified in *S. pyogenes* <SEQ ID 1473> which encodes the amino acid sequence <SEQ ID 1474>. Analysis of this protein sequence reveals the following:

```
Possible site: 40
>>> Seems to have no N-terminal signal sequence
INTEGRAL      Likelihood = -11.25      Transmembrane 26-42 (20-49)
----- Final Results -----
    bacterial membrane --- Certainty = 0.5501 (Affirmative) <succ>
        bacterial outside --- Certainty = 0.0000 (Not Clear) <succ>
            bacterial cytoplasm --- Certainty = 0.0000 (Not Clear) <succ>
```

The protein has no significant homology with any sequences in the GENPEPT database.

An alignment of the GAS and GBS proteins is shown below:

```
Identities = 56/89 (62%), Positives = 71/89 (78%)
Query:    8 MTEQQMIDCLLYELAKKDKLNIRRNNIITFLSIVLMAISILNVALQDHYKSQITELRTQL  67
            MTE+QMIDCLLYEL KKDK   +++ II  L+++L+ +S L V+L+ +Y+ QI  LRTQL
Sbjct:    1 MTEEQMIDCLLYELVKKDKAIKKKSIIIAALTVMLIVVSGLCVSLKSYYEPQIYGLRTQL  60

Query:   68 SRTQKQLKRASDDRARQTKRIAELTGNGG  96
            SRTQKQLKRAS+   RQTKRIA+LT NGG
Sbjct:   61 SRTQKQLKRASEQNQRQTKRIADLTNNGG  89
```

Based on this analysis, it was predicted that these proteins and their epitopes could be useful antigens for vaccines or diagnostics.

Example 458

A DNA sequence (GBSx0495) was identified in *S. agalactiae* <SEQ ID 1475> which encodes the amino acid sequence <SEQ ID 1476>. Analysis of this protein sequence reveals the following:

```
Possible site: 32
>>> Seems to have no N-terminal signal sequence
----- Final Results -----
    bacterial cytoplasm --- Certainty = 0.2040 (Affirmative) <succ>
        bacterial membrane --- Certainty = 0.0000 (Not Clear) <succ>
            bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 459

A DNA sequence (GBSx0496) was identified in *S. agalactiae* <SEQ ID 1477> which encodes the amino acid sequence <SEQ ID 1478>. Analysis of this protein sequence reveals the following:

```
Possible site: 34
>>> Seems to have no N-terminal signal sequence
----- Final Results -----
    bacterial cytoplasm --- Certainty = 0.3044 (Affirmative) <succ>
```

-continued

```
    bacterial membrane --- Certainty = 0.0000 (Not Clear) <succ>
        bacterial outside --- Certainty = 0.0000 (Not Clear) <succ>
```

The protein has homology with the following sequences in the GENPEPT database:

```
>GP:AAD37108 GB:AF109874 unknown [Bacteriophage Tuc2009]
Identities = 50/143 (34%), Positives = 67/143 (45%), Gaps = 29/143 (20%)
Query:    1 MIPNFRAFNKETKKM-YG-VDGFELSVRKIYRCSLADDEFRCGRLETFHFVEDNEDDYIL   58
            MIP  RA++K+ ++M YG V+ F+ S+    YR             HF    +D
Sbjct:    1 MIPKLRAWDKQDERMSYGEVEYFDDSIN--YRFD-------------HFCTGADEDVEF   44

Query:   59 MQSTGMFDKNGVEIFDGDIVLTTRL-------IDY-TYKNFKGVVKMLEGRWLIDTGKDA  110
            MQSTG+ DKNGVEI++GDI+    +        I Y Y   G    + EG  L    +
Sbjct:   45 MQSTGIKDKNGVEIYEGDILKLHAIFLAPDDKIGYLEYSPKYGYSIICEGNRLY---RQE  101

Query:  111 VGLWTEVDENEAIGNIYQNSELL                                      133
               T    E IGNIY+N ELL
Sbjct:  102 YWASTNKLNYEVIGNIYENPELL                                      124
```

A related DNA sequence was identified in *S. pyogenes* <SEQ ID 1479> which encodes the amino acid sequence <SEQ ID 1480>. Analysis of this protein sequence reveals the following:

```
Possible site: 34
>>> Seems to have no N-terminal signal sequence
```

```
----- Final Results -----
   bacterial cytoplasm --- Certainty = 0.4779 (Affirmative) <succ>
   bacterial membrane --- Certainty = 0.0000 (Not Clear) <succ>
      bacterial outside --- Certainty = 0.0000 (Not Clear) <succ>
```

An alignment of the GAS and GBS proteins is shown below:

```
Identities = 44/52 (84%), Positives = 47/52 (89%)
Query:  1  MIPNFRAFNKETKKMYGVDGFELSVRKIYRCSLADDEFRCGRLETFHFVEDN  52
           MIPNFR FNK+TKKMY +DGF+ S RKIYRCSLADDEFR GRLETFHFVEDN
Sbjct:  1  MIPNFRGFNKKTKKMYSIDGFKSSERKIYRCSLADDEFRSGRLETFHFVEDN  52
```

Based on this analysis, it was predicted that these proteins and their epitopes could be useful antigens for vaccines or diagnostics.

Example 460

A DNA sequence (GBSx0497) was identified in *S. agalactiae* <SEQ ID 1481> which encodes the amino acid sequence <SEQ ID 1482>. Analysis of this protein sequence reveals the following:

Possible site: 57
>>> Seems to have no N-terminal signal sequence

```
----- Final Results -----
   bacterial cytoplasm --- Certainty = 0.3843 (Affirmative) <succ>
   bacterial membrane --- Certainty = 0.0000 (Not Clear) <succ>
      bacterial outside --- Certainty = 0.0000 (Not Clear) <succ>
```

A related GBS nucleic acid sequence <SEQ ID 9655> which encodes amino acid sequence <SEQ ID 9656> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

Example 461

A DNA sequence (GBSx0498) was identified in *S. agalactiae* <SEQ ID 1483> which encodes the amino acid sequence <SEQ ID 1484>. Analysis of this protein sequence reveals the following:

Possible site: 23
>>> Seems to have no N-terminal signal sequence
```
----- Final Results -----
   bacterial cytoplasm --- Certainty = 0.5189 (Affirmative) <succ>
   bacterial membrane --- Certainty = 0.0000 (Not Clear) <succ>
      bacterial outside --- Certainty = 0.0000 (Not Clear) <succ>
```

A related GBS nucleic acid sequence <SEQ ID 9653> which encodes amino acid sequence <SEQ ID 9654> was also identified.

The protein has homology with the following sequences in the GENPEPT database:

```
GP: AAF43503 GB: AF145054 ORF10 [Streptococcus thermophilus
bacteriophage 7201]
Identities = 92/147 (62%), Positives = 121/147 (81%)
Query:   15  IEPKPQTRPKFSKFGTYEDPKMKRWRKEVSGWIEKNYDGPFFDDCIKVEVTFYMKAPKTL   74
             IEPKPQTRP+FSKFGTYEDPKMK WR+E S   IE+ YDG FF    I V+VTFYMKAP ++
Sbjct:    7  IEPKPQTRPRFSKFGTYEDPKMKAWRRECSRLIEQEYDGQFFYGPISVDVTFYMKAPLSV   66

Query:   75  SKEPTQRSKGKTIQIYQNFVRELIWHAKKPDIDNLIKAVFDSISDAGYDRIQKSGIVWSD  134
             SK+PT +++ KT    ++ F+ E +WH++KPDIDNLIKA+FDSIS AGY+++ K GIVW+D
Sbjct:   67  SKKPTPKARAKTWDAFKKFMAERLWHSRKPDIDNLIKALFDSISTAGYNKVDKKGIVWTD  126

Query:  135  DNIVCDLRAKKKYSQNPRIKVRIEEID                                  161
             D+IVC L A+K+YS+NPRI+  I+E++
Sbjct:  127  DSIVCKLSAQKRYSENPRIEFEIKELE                                  153
```

No corresponding DNA sequence was identified in *S. pyogenes*.

Based on this analysis, it was predicted that these proteins and their epitopes could be useful antigens for vaccines or diagnostics.

Example 462

A DNA sequence (GBSx0499) was identified in *S. agalactiae* <SEQ ID 1485> which encodes the amino acid sequence <SEQ ID 1486>. Analysis of this protein sequence reveals the following:

Possible site: 30
>>> Seems to have no N-terminal signal sequence
```
----- Final Results -----
   bacterial cytoplasm --- Certainty = 0.4007 (Affirmative) <succ>
   bacterial membrane --- Certainty = 0.0000 (Not Clear) <succ>
      bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 463

A DNA sequence (GBSx0500) was identified in *S. agalactiae* <SEQ ID 1487> which encodes the amino acid sequence <SEQ ID 1488>. This protein is predicted to be pXO1-07. Analysis of this protein sequence reveals the following:

Possible site: 26
>>> Seems to have no N-terminal signal sequence
----- Final Results -----
    bacterial cytoplasm --- Certainty = 0.3664 (Affirmative) <succ>
      bacterial membrane --- Certainty = 0.0000 (Not Clear) <succ>
        bacterial outside --- Certainty = 0.0000 (Not Clear) <succ>

The protein has homology with the following sequences in the GENPEPT database:

```
>GP: AAC38715 GB: AF030367 maturase-related protein [Streptococcus pneumoniae]
Identities = 146/373 (39%), Positives = 216/373 (57%), Gaps = 18/373 (4%)
Query:   35 LYDKVYRKDILKVAWFYVKRNKGSAGIDDFTIEEIEAYGVQKFLDEIEDQLRNKKYQPKA        94
            L DK+  ++ +   A+  VK NKGSAGID   TIEE++ Y  Q +    ++ ++ +KY+P+
Sbjct:    4 LLDKILSRENMLEAYNQVKSNKGSAGIDGMTIEEMDNYLRQNWR-LTKELIKQRKYKPQP        62

Query:   95 VKRVYIPKANGKKRPLGIPTVRDRVVQTAVKIVIEPIFEADFQEFSYGFRPKRSANQAIR       154
            V +V IPK +G  R LGIPTV DR++Q A+   V+ PI E   F + SYGFRP RS   +AI
Sbjct:   63 VLKVEIPKPDGGIRQLGIPTVMDRMIQQAIVQVMSPICEPHFSDTSYGFRPNRSCEKAIM       122

Query:  155 EIYKYLNYGCEWVIDADLKGYFDTIPHDKLLLLVKERVTDKSIIKLLSLWLEAGIMEDNQ       214
            ++ +YLN G EW++D DL+ +FDT+P D+L+ LV   + D      L+  +L +G++ + Q
Sbjct:  123 KLLEYLNDGYEWIVDIDLEKFFDTVPQDRLMSLVHNIIEDGDTESLIRKYLHSGVIINGQ       182

Query:  215 VRSNILGTPQGGVISPLLANIYLNALDRYWKNNRLEGRGHDAHLIRYADDFVI-LCSNNP       273
               ++GTPQGG +SPLL+NI LN LD+          LE RG     +RYADD VI + S
Sbjct:  183 RYKTLVGTPQGGNLSPLLSNIMLNELDK-----ELEKRG--LRFVRYADDCVITVGSEAA       235

Query:  274 KKYYQYAKQRI--DKLGLTLNEEKTRIVHATEGFDFLGYTLRKSKSHKSGKYKTYYYPSR       331
                 K   Y+  R     +LGL +N KT+I     E    +LG+    KS         +        P +
Sbjct:  236 AKRVMYSVSRFIEKRLGLKVNMTKTKITRPRE-LKYLGFGFWKSSDGWKSR------PHQ       288

Query:  332 KSMKSIKGKVKDVIQTGQHLNLPDVMERLNPMLRGWANYFKAGNSKQHFKSIDNYVIYNL       391
               S++   K K+K + Q      ++L   +E+LN  +RGW NYF  GN  K    SID +    L
Sbjct:  289 DSVRRFKLKLKKLTQRKWSIDLTRRIEQLNLSIRGWINYFSLGNMKSIVASIDERLRTRL       348

Query:  392 TIMLRKKHKKSGK                                                  404
            +++   K+ KK +
Sbjct:  349 RMIIWKQWKKKSR                                                  361
```

No corresponding DNA sequence was identified in *S. pyogenes*.

Based on this analysis, it was predicted that this protein and its epitopes, could be useful antigens for vaccines or diagnostics.

Example 464

A DNA sequence (GBSx0501) was identified in *S. agalactiae* <SEQ ID 1489> which encodes the amino acid sequence <SEQ ID 1490>. Analysis of this protein sequence reveals the following:

Possible site: 27
>>> Seems to have no N-terminal signal sequence
----- Final Results -----
    bacterial cytoplasm --- Certainty = 0.3833 (Affirmative) <succ>
      bacterial membrane --- Certainty = 0.0000 (Not Clear) <succ>
        bacterial outside --- Certainty = 0.0000 (Not Clear) <succ>

A related GBS nucleic acid sequence <SEQ ID 9651> which encodes amino acid sequence <SEQ ID 9652> was also identified.

A further related DNA sequence (GBSx2517) was identified in *S. agalactiae* <SEQ ID 7217> which encodes the amino acid sequence <SEQ ID 7218>. Analysis of this protein sequence reveals the following:

Possible site: 27
>>> Seems to have no N-terminal signal sequence
----- Final Results -----
    bacterial cytoplasm --- Certainty = 0.3833 (Affirmative) <succ>
      bacterial membrane --- Certainty = 0.0000 (Not Clear) <succ>
        bacterial outside --- Certainty = 0.0000 (Not Clear) <succ>

A related DNA sequence was identified in *S. pyogenes* <SEQ ID 1491> which encodes the amino acid sequence <SEQ ID 1492>. Analysis of this protein sequence reveals the following:

Possible site: 27
>>> Seems to have no N-terminal signal sequence
----- Final Results -----
    bacterial cytoplasm --- Certainty = 0.2299 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below:

```
Identities = 113/163 (69%), Positives = 128/163 (78%), Gaps = 25/163 (15%)
Query:    1  MINNIVLVGRMTKDAELRYTPSNQAVATFSLAVNRNFKNQSGEREADFINCVIWRQQAEN     60
             MINN+VLVGAMTKDAELRYTPS  AVATF+LAVNR FK+Q+GEREADFINCVIWRQ AEN
Sbjct:    1  MINNVVLVGAMTKDAELRYTPSQVAVATFTLAVNRTFKSQNGEREADFINCVIWRQPAEN     60

Query:   61  LANWAKKGALVGITGRIQTRNYENQQGQRTYVTEVVAENFQLLESRNSQQ---------Q    111
             LANWAKKGAL+G+TGRIQTRNYENQQGQR+YVTEVVA+NFQ+LESR +++
Sbjct:   61  LANWAKKGALIGVTGRIQTRNYENQQGQRVYVTEVVADNFQMLESRATREGGSTGSFNGG    120

Query:  112  TNQSGNSSNSY----------------FGNANKMDISDDDLPF                    138
              N + +SSNSY                FGN+N MDISDDDLPF
Sbjct:  121  FNNNTSSSNSYSAPAQQTPNFGRDDSPFGNSNPMDISDDDLPF                    163
```

Based on this analysis, it was predicted that these proteins and their epitopes could be useful antigens for vaccines or diagnostics.

Example 465

A DNA sequence (GBSx0502) was identified in *S. agalactiae* <SEQ ID 1493> which encodes the amino acid sequence <SEQ ID 1494>. Analysis of this protein sequence reveals the following:

Possible site: 26
>>> Seems to have an uncleavable N-term signal seq
INTEGRAL    Likelihood = −1.33    Transmembrane 17-33 (17-33)
----- Final Results -----
   bacterial membrane --- Certainty = 0.1532 (Affirmative) <succ>
      bacterial outside --- Certainty = 0.0000 (Not Clear) <succ>
      bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 466

A DNA sequence (GBSx0503) was identified in *S. agalactiae* <SEQ ID 1495> which encodes the amino acid sequence <SEQ ID 1496>. This protein is predicted to be p22 erf-like protein. Analysis of this protein sequence reveals the following:

Possible site: 52
>>> Seems to have no N-terminal signal sequence
----- Final Results -----
   bacterial cytoplasm --- Certainty = 0.2469 (Affirmative) <succ>
      bacterial membrane --- Certainty = 0.0000 (Not Clear) <succ>
      bacterial outside --- Certainty = 0.0000 (Not Clear) <succ>

The protein has homology with the following sequences in the GENPEPT database:

```
>GP: BAA97824 GB: AB044554 orf 17 [Staphylococcus aureus prophage
phiPV83]
Identities = 93/183 (50%), Positives = 120/183 (64%), Gaps = 5/183 (2%)
Query:    1  MRKSESITEYAKAFCKAQLEVKQPLKDKDNPFFKSKYVPLENVTEAITTAFANNGISFSQ     60
             M KSE++ E  KA   + EVKQPLKDK+NPFFKSKYVPLENV EAI  A   +G+S++Q
Sbjct:    1  MNKSETVVEINKAMVAFRKEVKQPLKDKNNPFFKSKYVPLENVVEAIDEAATPHGLSYTQ     60

Query:   61  DPTTNTENGYIDVATLVMHTSGEWVEYGPLSVKPTKNDVQGAGSAITYAKRYALSAIFGI    120
              N  +G + VAT++MH SGE++EY P+ +    KN  QGAGS I+Y KRY+LSAIFGI
Sbjct:   61  W-ALNDVDGRVGVATMLMHESGEYIEYDPVFMNAEKNTPQGAGSLISYLKRYSLSAIFGI    119

Query:  121  TSDQDDDGNEDSKPNNSRQSPKATTKKTQKTGYQTPKISNIQIETYKSDLNDIAKATNQN    180
             TSDQDDDGNE S   NN   +PK  T +TQ    +T I   ++ ++   + K    QN
Sbjct:  120  TSDQDDDGNEASGKNN---NPKQQT-RTQWASSETIGILRKEVISFTKLIKGTDKEAPQN    175

Query:  181  VEE                                                            183
             + E
Sbjct:  176  IVE                                                            178
```

No corresponding DNA sequence was identified in *S. pyogenes*.

Based on this analysis, it was predicted that this protein and its epitopes, could be useful antigens for vaccines or diagnostics.

Example 467

A DNA sequence (GBSx0504) was identified in *S. agalactiae* <SEQ ID 1497> which encodes the amino acid sequence <SEQ ID 1498>. This protein is predicted to be gp157. Analysis of this protein sequence reveals the following:

Possible site: 55
>>> Seems to have no N-terminal signal sequence
----- Final Results -----
   bacterial cytoplasm --- Certainty = 0.3148 (Affirmative) <succ>
      bacterial membrane --- Certainty = 0.0000 (Not Clear) <succ>
      bacterial outside --- Certainty = 0.0000 (Not Clear) <succ>

The protein has homology with the following sequences in the GENPEPT database:

```
>GP: AAD44102 GB: AF115103 orf157 gp [Streptococcus thermophilus
bacteriophage Sfi21]
Identities = 59/160 (36%), Positives = 100/160 (61%), Gaps = 3/160 (1%)
Query:    1 MAYLYELEGIYAQLQSMDLDEETFQDTLDSIDFQSDLENNIEYFVKMLKNVQADAEKYKA    60
            MA LYEL G + ++ +M++D+ET   DTL++ID+ SD EN +E +VK++K+++AD E   K
Sbjct:    1 MATLYELTGQFLEIYNMEIDDETKLDTLEAIDWTSDYENKVEGYVKVIKSLEADIEARKN    60

Query:   61 EKEAFYKKQKQAEAKAEKYKETIRLAMELSQKKKVDAGMFKVSLRRSKKVEILDETKIPL   120
            EK+       K   ++K +K K  + ++M  + + +VD  +FK+     +SK V +++E K+P
Sbjct:   61 EKKRLDGLNKSDQSKIDKLKAALAISMTETGQTRVDTTLFKIGFHKSKAV-VVNEEKLPK   119

Query:  121 DYMQEKIEYKPMKAEISKALKSGIDISGVELIETESLQVK                      160
            +Y  +    YKP K + + LKSG  I G  L E  +L ++
Sbjct:  120 EY--QIATYKPDKKTLKELLKSGKHIEGATLEERRNLNIR                      157
```

No corresponding DNA sequence was identified in *S. pyogenes*.

Based on this analysis, it was predicted that this protein and its epitopes, could be useful antigens for vaccines or diagnostics.

Example 468

A DNA sequence (GBSx0505) was identified in *S. agalactiae* <SEQ ID 1499> which encodes the amino acid sequence <SEQ ID 1500>. This protein is predicted to be tropomyosin 2. Analysis of this protein sequence reveals the following:

Possible site: 26
>>> Seems to have no N-terminal signal sequence
----- Final Results -----
   bacterial cytoplasm --- Certainty = 0.4474 (Affirmative) <succ>
      bacterial membrane --- Certainty = 0.0000 (Not Clear) <succ>
         bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 469

A DNA sequence (GBSx0506) was identified in *S. agalactiae* <SEQ ID 1501> which encodes the amino acid sequence <SEQ ID 1502>. Analysis of this protein sequence reveals the following:

Possible site: 21
>>> Seems to have no N-terminal signal sequence
----- Final Results -----
   bacterial cytoplasm --- Certainty = 0.4114 (Affirmative) <succ>
      bacterial membrane --- Certainty = 0.0000 (Not Clear) <succ>
         bacterial outside --- Certainty = 0.0000 (Not Clear) <succ>

A related GBS nucleic acid sequence <SEQ ID 9649> which encodes amino acid sequence <SEQ ID 9650> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

Example 470

A DNA sequence (GBSx0507) was identified in *S. agalactiae* <SEQ ID 1503> which encodes the amino acid sequence <SEQ ID 1504>. Analysis of this protein sequence reveals the following:

Possible site: 17
>>> Seems to have no N-terminal signal sequence
----- Final Results -----
   bacterial cytoplasm --- Certainty = 0.3799 (Affirmative) <succ>
      bacterial membrane --- Certainty = 0.0000 (Not Clear) <succ>
         bacterial outside --- Certainty = 0.0000 (Not Clear) <succ>

The protein has no significant homology with any sequences in the GENPEPT database.

A related DNA sequence was identified in *S. pyogenes* <SEQ ID 1505> which encodes the amino acid sequence <SEQ ID 1506>. Analysis of this protein sequence reveals the following:

Possible site: 31
>>> Seems to have no N-terminal signal sequence
----- Final Results -----
   bacterial cytoplasm --- Certainty = 0.3775 (Affirmative) <succ>
      bacterial membrane --- Certainty = 0.0000 (Not Clear) <succ>
         bacterial outside --- Certainty = 0.0000 (Not Clear) <succ>

An alignment of the GAS and GBS proteins is shown below:

```
Identities = 43/46 (93%), Positives = 46/46 (99%)
Query:    1 MTKQHRETLIWYRASHQEREKLLDFGLVDKSQYVTLLRQLRKKYAI   46
            MTKQHRETLIWYRASHQERE+LLDFGLVDK++YVTLLRQLRKKYAI
Sbjct:    1 MTKQHRETLIWYRASHQERERLLDFGLVDKARYVTLLRQLRKKYAI   46
```

Based on this analysis, it was predicted that these proteins and their epitopes could be useful antigens for vaccines or diagnostics.

Example 471

A DNA sequence (GBSx0508) was identified in *S. agalactiae* <SEQ ID 1507> which encodes the amino acid sequence <SEQ ID 1508>. Analysis of this protein sequence reveals the following:

Possible site: 61
>>> Seems to have no N-terminal signal sequence
----- Final Results -----
    bacterial cytoplasm --- Certainty = 0.4308 (Affirmative) <succ>
      bacterial membrane --- Certainty = 0.0000 (Not Clear) <succ>
      bacterial outside --- Certainty = 0.0000 (Not Clear) <succ>

The protein has no significant homology with any sequences in the GENPEPT database.

A related DNA sequence was identified in *S. pyogenes* <SEQ ID 1509> which encodes the amino acid sequence <SEQ ID 1510>. Analysis of this protein sequence reveals the following:

Possible site 61
>>> Seems to have no N-terminal signal sequence
----- Final Results -----
    bacterial cytoplasm --- Certainty = 0.4308 (Affirmative) <succ>
      bacterial membrane --- Certainty = 0.0000 (Not Clear) <succ>
      bacterial outside --- Certainty = 0.0000 (Not Clear) <succ>

An alignment of the GAS and GBS proteins is shown below:

```
Identities = 76/77 (98%), Positives = 76/77 (98%)
Query:    1 MDQEIFNFFNKQIKKDFGKTASKETFAKFASYCAEGIEKNGVKPIFNWINLYAFGTGMTT    60
            MDQEIFNFFNKQIKKDFGKTASKETFAKFASYCAEGIEKNGVKPIFNWINLYAFGTGMTT
Sbjct:    1 MDQEIFNFFNKQIKKDFGKTASKETFAKFASYCAEGIEKNGVKPIFNWINLYAFGTGMTT    60

Query:   61 AEADRLRIERYKQENTL                                              77
            AEADRLRIERYKQEN L
Sbjct:   61 AEADRLRIERYKQENAL                                              77
```

Based on this analysis, it was predicted that these proteins and their epitopes could be useful antigens for vaccines or diagnostics.

Example 472

A DNA sequence (GBSx0509) was identified in *S. agalactiae* <SEQ ID 1511> which encodes the amino acid sequence <SEQ ID 1512>. Analysis of this protein sequence reveals the following:

Possible site: 27
>>> Seems to have no N-terminal signal sequence
----- Final Results -----
    bacterial cytoplasm --- Certainty = 0.2706 (Affirmative) <succ>
      bacterial membrane --- Certainty = 0.0000 (Not Clear) <succ>
      bacterial outside --- Certainty = 0.0000 (Not Clear) <succ>

A related DNA sequence was identified in *S. pyogenes* <SEQ ID 1513> which encodes the amino acid sequence <SEQ ID 1514>. Analysis of this protein sequence reveals the following:

Possible site: 23
>>> Seems to have no N-terminal signal sequence
----- Final Results -----
    bacterial cytoplasm --- Certainty = 0.3316 (Affirmative) <succ>
      bacterial membrane --- Certainty = 0.0000 (Not Clear) <succ>
      bacterial outside --- Certainty = 0.0000 (Not Clear) <succ>

An alignment of the GAS and GBS proteins is shown below:

```
Identities = 52/127 (40%), Positives = 75/127 (58%), Gaps = 1/127 (0%)
Query:  160 EDRFVDVVEANLGRGLVKFEFDMINDYLIGQNVSKDLFLEAVEVAVANNVRKFNYIARIL   219
            E  +  +   GR + FE + I  ++    N+ ++   A++ AV NN   + YI +IL
Sbjct:    3 EKKLFENFQLTFGRMISPFEIEDIQKWIHEDNMPIEVVNLALREAVENNKISWKYINKIL    62

Query:  220 DNWINDGIKTPEQAYQAQRDFKAKKANKTMQSQSNVPSWSNPDYKGPDLKEFALGSIDDI   279
            +W   G  T E+      + F   K  +++ + SNVPSWSNPDYK PDL+EFALGS+D I
Sbjct:   63 VDWYKSGDTTVEKVHDRLQRFDDSKKQRSVTT-SNVPSWSNPDYKEPDLEEFALGSMDGI   121

Query:  280 EDGSGDF                                                       286
            EDGSGDF
Sbjct:  122 EDGSGDF                                                       128
```

Based on this analysis, it was predicted that these proteins and their epitopes could be useful antigens for vaccines or diagnostics.

Example 473

A DNA sequence (GBSx0510) was identified in *S. agalactiae* <SEQ ID 1515> which encodes the amino acid sequence <SEQ ID 1516>. Analysis of this protein sequence reveals the following:

---

Possible site: 26
>>> Seems to have an uncleavable N-term signal seq
INTEGRAL    Likelihood = −5.63    Transmembrane 13-29 (11-31)
----- Final Results -----
    bacterial membrane --- Certainty = 0.3251 (Affirmative) <succ>
      bacterial outside --- Certainty = 0.0000 (Not Clear) <succ>
        bacterial cytoplasm --- Certainty = 0.0000 (Not Clear) <succ>

---

A related GBS nucleic acid sequence <SEQ ID 9647> which encodes amino acid sequence <SEQ ID 9648> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

Example 474

A DNA sequence (GBSx0511) was identified in *S. agalactiae* <SEQ ID 1517> which encodes the amino acid sequence <SEQ ID 1518>. Analysis of this protein sequence reveals the following:

---

Possible site: 34
>>> Seems to have no N-terminal signal sequence
----- Final Results -----
    bacterial cytoplasm --- Certainty = 0.5822 (Affirmative) <succ>
      bacterial membrane --- Certainty = 0.0000 (Not Clear) <succ>
        bacterial outside --- Certainty = 0.0000 (Not Clear) <succ>

---

The protein has no significant homology with any sequences in the GENPEPT database.

Example 475

A DNA sequence (GBSx0512) was identified in *S. agalactiae* <SEQ ID 1519> which encodes the amino acid sequence <SEQ ID 1520>. Analysis of this protein sequence reveals the following:

---

Possible site: 13
>>> Seems to have no N-terminal signal sequence
----- Final Results -----
    bacterial cytoplasm --- Certainty = 0.4175 (Affirmative) <succ>
      bacterial membrane --- Certainty = 0.0000 (Not Clear) <succ>
        bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 476

A DNA sequence (GBSx0513) was identified in *S. agalactiae* <SEQ ID 1521> which encodes the amino acid sequence <SEQ ID 1522>. This protein is predicted to be P1-antirepressor homolog. Analysis of this protein sequence reveals the following:

---

Possible site: 37
>>> Seems to have no N-terminal signal sequence
----- Final Results -----
    bacterial cytoplasm --- Certainty = 0.3411 (Affirmative) <succ>
      bacterial membrane --- Certainty = 0.0000 (Not Clear) <succ>
        bacterial outside --- Certainty = 0.0000 (Not Clear) <succ>

---

A related GBS nucleic acid sequence <SEQ ID 9645> which encodes amino acid sequence <SEQ ID 9646> was also identified.

The protein has homology with the following sequences in the GENPEPT database:

```
>GP: AAG31333 GB: AF182207 ORF 169 a [Bacteriophage mv4]
Identities = 88/167 (52%), Positives = 122/167 (720)
Query:  100 MLQRNEKSKQVRKYFIQVEKDFNSPEKIMARALLMADKKITNLTMENNQLQLDLKEAQKQ  159
            M+ +   K K++R+YFIQVEK++NSPE I+ RAL +++ +I   L   +N   L L L+E+ K+
Sbjct:    1 MMSKTAKGKEIRQYFIQVEKNWNSPEMIIQRALEISNARIQELQAQNKSLTLQLEESNKK   60

Query:  160 ARYLDLIIESKGALRVTQIAADYGMSVNKFNKTLLEFGVQHKVNGQWILYKRHMGKGYTD  219
            A YLD+I+ +   L   TQIAADYG S   FN+ L E G+QHKVNGQWILYK +MGKGY
Sbjct:   61 ASYLDIILGTPDLLATTQIAADYGYSARTFNQLLKEVGIQHKVNGQWILYKAYMGKGYVQ  120

Query:  220 SHTFDYQDKNGHTRANVTTTWTQKGRLFLYELLKDNNILPLIEQEDI              266
            S +F ++D+ GH R+  +T WTQKGR  +Y++LK+N  LPLIE++DI
Sbjct:  121 SKSFAFKDRKGHDRSKPSTYWTQKGRKLIYDVLKENGTLPLIERDDI              167
```

No corresponding DNA sequence was identified in *S. pyogenes*.

Based on this analysis, it was predicted that this protein and its epitopes, could be useful antigens for vaccines or diagnostics.

A related DNA sequence was identified in *S. pyogenes* <SEQ ID 1523> which encodes the amino acid sequence <SEQ ID 1524>. Analysis of this protein sequence reveals the following:

Possible site: 19
>>> Seems to have no N-terminal signal sequence
----- Final Results -----
    bacterial cytoplasm --- Certainty = 0.4214 (Affirmative) <succ>
        bacterial membrane --- Certainty = 0.0000 (Not Clear) <succ>
            bacterial outside --- Certainty = 0.0000 (Not Clear) <succ>

An alignment of the GAS and GBS proteins is shown below:

```
Identities = 130/249 (52%), Positives = 163/249 (65%), Gaps = 14/249 (5%)
Query:   19 MNQLINITLNENQEPVVSGRDLHNVLNIKTQYTKWLERMSEYGFEENVDYIAISQKRLTA    78
            MNQLIN+TLNENQEPVVSGRDLH VL IKTQYTKWLERMSEYGF EN D++AISQKRLTA
Sbjct:    1 MNQLINVTLNENQEPVVSGRDLHKVLEIKTQYTKWLERMSEYGFVENEDFMAISQKRLTA    60

Query:   79 QGNRTEYIDHVLKLDMAKEIAMLQRNEKSKQVRKYFIQVEKDFNSPEKIMARALLMADKK   138
            QGN+TEY DHVLKLDMAKEIAMLQRNEKSK+VRKYFIQVEKDFNSPEKIMARALLMADKK
Sbjct:   61 QGNQTEYTDHVLKLDMAKEIAMLQRNEKSKEVRKYFIQVEKDFNSPEKIMARALLMADKK   120

Query:  139 ITNLTMENNQLQLDLKEAQKQARYLDLIIESKGALRVTQIAA-----DYGMSVNKFNKTL   193
            +        ++L+  ++  + +   + D +   S   ++ V ++A        +   +     L
Sbjct:  121 V-------HKLEAQIEADRPKVLFADAVSASHTSILVGELAKLLKQNGVNIGATRLFTWL   173

Query:  194 LEFGVQHKVNGQ-WIL-YKRHMGKGYTDSHTFDYQDKNGHTRANVTTTWTQKGRLFLYEL   251
            + G    K NG+ W +  ++ +  G                       +GH    + T     T KG+  +
Sbjct:  174 RKHGYLIKRNGRDWNMPTQKSVELGLIRVKETSITHSDGHITVSKTPLVTGKGQQYFINK   233

Query:  252 LKDNNILPL                                                    260
            +    LP+
Sbjct:  234 FLNQEYLPV                                                    242
```

Based on this analysis, it was predicted that these proteins and their epitopes could be useful antigens for vaccines or diagnostics.

Example 477

A DNA sequence (GBSx0514) was identified in *S. agalactiae* <SEQ ID 1525> which encodes the amino acid sequence <SEQ ID 1526>. Analysis of this protein sequence reveals the following:

Possible site: 44
>>> Seems to have no N-terminal signal sequence
----- Final Results -----
    bacterial cytoplasm --- Certainty = 0.4205 (Affirmative) <succ>
        bacterial membrane --- Certainty = 0.0000 (Not Clear) <succ>
            bacterial outside --- Certainty = 0.0000 (Not Clear) <succ>

The protein has no significant homology with any sequences in the GENPEPT database.

A related DNA sequence was identified in *S. pyogenes* <SEQ ID 1527> which encodes the amino acid sequence <SEQ ID 1528>. Analysis of this protein sequence reveals the following:

Possible site: 32
>>> Seems to have no N-terminal signal sequence
----- Final Results -----
    bacterial membrane --- Certainty = 0.0000 (Not Clear) <succ>
        bacterial outside --- Certainty = 0.0000 (Not Clear) <succ>
            bacterial cytoplasm --- Certainty = 0.0000 (Not Clear) <succ>

An alignment of the GAS and GBS proteins is shown below:

```
Identities = 21/63 (33%), Positives = 31/63 (48%), Gaps = 1/63 (1%)
Query:    1 MQQFNLKQLREKKGFTQNELADKANVSRSLVVGLETGSYSETSTASLKKLAKALDVKIKD    60
            M+    LK R K +Q  LAD  VSR +  +E G Y+ T    +  + + LD   + D
Sbjct:    1 MKNLKLKAARAGKDLSQQALADLVGVSRQTIAAVEKGDYNPTINLCI-AICRVLDKTLDD    59

Query:   61 LFF                                                          63
            LF+
Sbjct:   60 LFW                                                          62
```

Based on this analysis, it was predicted that these proteins and their epitopes could be useful antigens for vaccines or diagnostics.

Example 478

A DNA sequence (GBSx0515) was identified in *S. agalactiae* <SEQ ID 1529> which encodes the amino acid sequence <SEQ ID 1530>. Analysis of this protein sequence reveals the following:

Possible site: 26
>>> Seems to have no N-terminal signal sequence
----- Final Results -----
    bacterial cytoplasm --- Certainty = 0.0396 (Affirmative) <succ>
        bacterial membrane --- Certainty = 0.0000 (Not Clear) <succ>
            bacterial outside --- Certainty = 0.0000 (Not Clear) <succ>

The protein has homology with the following sequences in the GENPEPT database:

```
>GP: BAA17582 GB: D90907 hypothetical protein [Synechocystis sp.]
Identities = 45/164 (27%), Positives = 79/164 (47%), Gaps = 33/164 (20%)
Query:  102 EEEELRNLFTKLIASSMDKSKNEFNHPSFIEIIKQFDKIDAQNFKIISDLYFKKGFVATG  161
            ++E L+ L+  L+AS++ +S    +  SF+E++KQ D +DA+   ++  L+ +
Sbjct:   97 DDENLQTLWANLLASALTESDRTNSTKSFVEVLKQVDIVDAELLNVLYLLHLRV------  150

Query:  162 TYYTTIIGQDKPLEHIASHVFVDNLEQNDIAIQSSSLTNLERLGLIQINY--KAHVDEKE  219
                         KP E    ++    D+ + N + I  S +L NLERLGL+ I+       VDE+
Sbjct:  151 --------MAKPDEFTYAN---DSRKYNIVQI-SVALNNLERLGLLIIHKYDDTPVDEEA  198

Query:  220 YYNILNNSFITKKNSELKEQNKRVLTNLGMITLTLFGVRFSKTC                 263
               +I    ++  N    K              ++LTLFG+  F +  C
Sbjct:  199 RISIW---YMQDGNRSFKAH----------VSLTLFGIHFMRVC                 229
```

A related DNA sequence was identified in *S. pyogenes* <SEQ ID 1531> which encodes the amino acid sequence <SEQ ID 1532>. Analysis of this protein sequence reveals the following:

---

Possible site: 19
>>> Seems to have no N-terminal signal sequence
----- Final Results -----
    bacterial cytoplasm --- Certainty = 0.0151 (Affirmative) <succ>
      bacterial membrane --- Certainty = 0.0000 (Not Clear) <succ>
      bacterial outside --- Certainty = 0.0000 (Not Clear) <succ>

---

An alignment of the GAS and GBS proteins is shown below:

```
Identities = 64/215 (29%), Positives = 105/215 (48%), Gaps = 23/215 (10%)
Query:   65 QKLAKEIQDVVSKNIE-NLQEPSLSIAGPALEASKFYLEEEELRNLFTKLIASSMDKSKN  123
            +K    EI    SK + +L+EP    I   PA+   S+ YL  E LRN+F + IAS+ ++ K
Sbjct:   72 EKFKNEIDCEFSKIPQTSLKEPVEYILYPAINESEQYLSNETLRNMFARTIASTFNQDKE  131

Query:  124 EFNHPSFIEIIKQFDKIDAQNFKIISDLYFKKGFVAIGTYYTTIIGQDKPLEHI------  177
            +   H +F++IIKQ    +DAQN  +I+          IG      E++
Sbjct:  132 KDLHSAFVQIIKQMTPLDAQNLLLINQ-------EGNNLIANLQIGVHYSKENLSGTVNK  184

Query:  178 ASHVFVDNLEQNDIAIQSSSLTNLERLGLIQINYKAHVDEKEYYNILNNSFITKKNSELK  237
            A+++++  L+ +   I +SS+ NL RLGLI+++Y  +   Y +I    +    SE+
Sbjct:  185 ANNIYLSKLDYSPDII-ASSIDNLTRLGLIKVDYLHYPLDSNYESIKQTTIYKSLESEIN  243

Query:  238 EQNKRVLTNL--------GMITLTLFGVRFSKTCL                          264
              N    +N         G ++LT FG +F    CL
Sbjct:  244 TLNLFKTSNTKYDIKIEKGKVSLTDFGKKFISVCL                          278
```

SEQ ID 1530 (GBS261) was expressed in *E. coli* as a His-fusion product. SDS-PAGE analysis of total cell extract is shown in FIG. 44 (lane 8; MW 31 kDa).

Based on this analysis, it was predicted that these proteins and their epitopes could be useful antigens for vaccines or diagnostics.

Example 479

A DNA sequence (GBSx0516) was identified in *S. agalactiae* <SEQ ID 1533> which encodes the amino acid sequence <SEQ ID 1534>. Analysis of this protein sequence reveals the following:

---

Possible site: 16
>>> Seems to have an uncleavable N-term signal seq
INTEGRAL    Likelihood = −8.55    Transmembrane 3-19 (1-26)
----- Final Results -----
    bacterial membrane --- Certainty = 0.4418 (Affirmative) <succ>
      bacterial outside --- Certainty = 0.0000 (Not Clear) <succ>
      bacterial cytoplasm --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 480

A DNA sequence (GBSx0517) was identified in *S. agalactiae* <SEQ ID 1535> which encodes the amino acid sequence <SEQ ID 1536>. Analysis of this protein sequence reveals the following:

---

Possible site: 47
>>> Seems to have no N-terminal signal sequence
INTEGRAL    Likelihood = −4.99    Transmembrane 35-51 (30-51)
----- Final Results -----
    bacterial membrane --- Certainty = 0.2996 (Affirmative) <succ>
      bacterial outside --- Certainty = 0.0000 (Not Clear) <succ>
      bacterial cytoplasm --- Certainty = 0.0000 (Not Clear) <succ>

---

The protein has no significant homology with any sequences in the GENPEPT database.

A related DNA sequence was identified in *S. pyogenes* <SEQ ID 1537> which encodes the amino acid sequence <SEQ ID 1538>. Analysis of this protein sequence reveals the following:

```
Possible site: 47
>>> Seems to have no N-terminal signal sequence
INTEGRAL    Likelihood = –4.94    Transmembrane 31-47 (30-51)
----- Final Results -----
    bacterial membrane --- Certainty = 0.2975 (Affirmative) <succ>
        bacterial outside --- Certainty = 0.0000 (Not Clear) <succ>
            bacterial cytoplasm --- Certainty = 0.0000 (Not Clear) <succ>
```

An alignment of the GAS and GBS proteins is shown below:

```
Identities = 45/52 (86%), Positives = 48/52 (91%)
Query: 1 MNWKKLMLGDLEHTFTSRDGKEKTS-                             52
         VEFEGGVLPALLVLGGITWLIAWLITK
         MNWKKLM GDLEHTFT+ DGKEKTS+EFEGGVLPALLVLGGI W+IAW-
         ITK
Sbjct: 1 MNWKKLMFGDLEHTFTNHDGKEKTSIEF-                          52
         EGGVLPALLVLGGIAWMIAWFITK
```

Based on this analysis, it was predicted that these proteins and their epitopes could be useful antigens for vaccines or diagnostics.

Example 481

A DNA sequence (GBSx0518) was identified in *S. agalactiae* <SEQ ID 1539> which encodes the amino acid sequence <SEQ ID 1540>. Analysis of this protein sequence reveals the following:

```
Possible site: 35
>>> Seems to have no N-terminal signal sequence
----- Final Results -----
    bacterial cytoplasm --- Certainty = 0.3445 (Affirmative) <succ>
        bacterial membrane --- Certainty = 0.0000 (Not Clear) <succ>
            bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 482

A DNA sequence (GBSx0519) was identified in *S. agalactiae* <SEQ ID 1541> which encodes the amino acid sequence <SEQ ID 1542>. Analysis of this protein sequence reveals the following:

```
Possible site: 37
>>> Seems to have no N-terminal signal sequence
----- Final Results -----
    bacterial cytoplasm --- Certainty = 0.3934 (Affirmative) <succ>
        bacterial membrane --- Certainty = 0.0000 (Not Clear) <succ>
            bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 483

A DNA sequence (GBSx0520) was identified in *S. agalactiae* <SEQ ID 1543> which encodes the amino acid sequence <SEQ ID 1544>. This protein is predicted to be repressor protein. Analysis of this protein sequence reveals the following:

```
Possible site: 61
>>> Seems to have no N-terminal signal sequence
----- Final Results -----
    bacterial cytoplasm --- Certainty = 0.0905 (Affirmative) <succ>
        bacterial membrane --- Certainty = 0.0000 (Not Clear) <succ>
            bacterial outside --- Certainty = 0.0000 (Not Clear) <succ>
```

A related GBS nucleic acid sequence <SEQ ID 9643> which encodes amino acid sequence <SEQ ID 9644> was also identified.

A related DNA sequence was identified in *S. pyogenes* <SEQ ID 1545> which encodes the amino acid sequence <SEQ ID 1546>. Analysis of this protein sequence reveals the following:

```
Possible site: 55
>>> Seems to have no N-terminal signal sequence
----- Final Results -----
    bacterial cytoplasm --- Certainty = 0.3117 (Affirmative) <succ>
        bacterial membrane --- Certainty = 0.0000 (Not Clear) <succ>
            bacterial outside --- Certainty = 0.0000 (Not Clear) <succ>
```

An alignment of the GAS and GBS proteins is shown below:

```
Identities = 175/264 (66%), Positives = 207/264 (78%), Gaps = 19/264 (7%)

Query:    34 LGKYIKKYRDTNNLSMAEFAKESGISKAY--VSILEKNRDPRNGKEIIPSIPIIKKVSDT    91
             LG  I+K R+  N++   E ++  G+ K Y  VS  EKN +    GK++         KK+++
Sbjct:    24 LGDRIRKLREGRNMTQTELSEILGM-KTYTTVSKWEKNENFPKGKDL-------KKLAEI    75

Query:    92 IGISFDDLLNSLDENQIVALNETKTEKNLTSSTLQKITSTSSQLEQPRQEKVLSFANEQL   151
                ++ D LL          L ++K  K    +  +I S  +QLEQPRQEKVL+FANEQL
Sbjct:    76 FNVTSDYLLG---------LTDSKLGKITIQNEQPEIVSIYNQLEQPRQEKVLNFANEQL   126

Query:   152 EEQNKVVSMFDRKVEETENYITDYVEGLVAAGLGAYQEDNLHMEVKLRADDVPDKYDTIA   211
             EEQNK VS+FD+K EETE+YITDYVEGLVAAGLGAYQEDNLHM+VKLR+DDVPD+YDTIA
Sbjct:   127 EEQNKTVSIFDKKSEETEDYITDYVEGLVAAGLGAYQEDNLHMKVKLRSDDVPDEYDTIA   186

Query:   212 KVAGNSMEPLIQDNDLLFVKVSSQVDMNDIGIFQVNGKVFVKKLKRDYDGAWYLQSLNKS   271
             KVAG+SMEPLIQDNDLLF+KVSSQVDMNDIGIFQVNGKNFVKKLKRDYDGAWYLQSLNKS
Sbjct:   187 KVAGDSMEPLIQDNDLLFIKVSSQVDMNDIGIFQVNGKNFVKKLKRDYDGAWYLQSLNKS   246

Query:   272 YEEIYLSENDNIRTIGEVVDIYRE                                      295
             YEEIYLS++D+IRTIGEVVDIYRE
Sbjct:   247 YEEIYLSKDDDIRTIGEVVDIYRE                                      270
```

Based on this analysis, it was predicted that these proteins and their epitopes could be useful antigens for vaccines or diagnostics.

Example 484

A DNA sequence (GBSx0521) was identified in *S. agalactiae* <SEQ ID 1547> which encodes the amino acid sequence <SEQ ID 1548>. Analysis of this protein sequence reveals the following:

```
Possible site: 45
>>> Seems to have no N-terminal signal sequence
----- Final Results -----
   bacterial cytoplasm --- Certainty = 0.3760 (Affirmative) <succ>
   bacterial membrane --- Certainty = 0.0000 (Not Clear) <succ>
   bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 485

A DNA sequence (GBSx0522) was identified in *S. agalactiae* <SEQ ID 1549> which encodes the amino acid sequence <SEQ ID 1550>. This protein is predicted to be integrase (ripX). Analysis of this protein sequence reveals the following:

```
Possible site: 20
>>> Seems to have no N-terminal signal sequence
----- Final Results -----
   bacterial cytoplasm --- Certainty = 0.2719 (Affirmative) <succ>
   bacterial membrane --- Certainty = 0.0000 (Not Clear) <succ>
   bacterial outside --- Certainty = 0.0000 (Not Clear) <succ>
```

The protein has homology with the following sequences in the GENPEPT database:

```
>GP: CAB96616 GB: AJ400629 integrase [Streptococcus pneumoniae
bacteriophage MM1]

Identities = 36/59 (61%), Positives = 48/59 (81%), Gaps = 1/59 (1%)

Query:     2 KIYGDYHTHLFRHSHISFLAEKGIPLNAIMDRVGHSDPKTTLSIYEHTTVNMKE-IINK    59
             KI  +   +H+FRHSHISFLAE G+P+ +IMDRVGHS+ K  TL IYSHTT +M++  ++NK
Sbjct:   312 KIEKNLSSHIFRHSHISFLAESGLPIKSIMDRVGHSNAKMTLEIYSHTTEDMEDKLVNK   370
```

A related DNA sequence was identified in *S. pyogenes* <SEQ ID 1551> which encodes the amino acid sequence <SEQ ID 1552>. Analysis of this protein sequence reveals the following:

Possible site: 20
>>> Seems to have no N-terminal signal sequence
----- Final Results -----
   bacterial cytoplasm --- Certainty = 0.2719 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below:

```
Identities = 63/71 (88%), Positives = 66/71 (92%)

Query:   1 MKIYGDYHTHLFRHSHISFLAEKGIPLNAIMDRVGHSDPKTTLSIYSHTTVNMKEIINKQ 60
           +KIYGDYHTHLFRHSHISFLAEKGIPLNAIMDRVGHSDPKTTLSIYSHTTVNMKEIINKQ Sbjct:   1 LKIYGDYHTHLFRHSHISFLAEKGIPLNAIMDRVGHSDPKTTLSIYSHTTVNMKEIINKQ 60

Query:  61 TAPFVPLLKSE                                                 71
           T PF   +K +

Sbjct:  61 TDPFKTGIKQK                                                 71
```

Based on this analysis, it was predicted that these proteins and their epitopes could be useful antigens for vaccines or diagnostics.

Example 486

A DNA sequence (GBSx0523) was identified in *S. agalactiae* <SEQ ID 1553> which encodes the amino acid sequence <SEQ ID 1554>. This protein is predicted to be 50S ribosomal protein L19 (rp1S). Analysis of this protein sequence reveals the following:

Possible site: 54
>>> Seems to have no N-terminal signal sequence
----- Final Results -----
   bacterial cytoplasm --- Certainty = 0.3331 (Affirmative) <succ>
   bacterial membrane --- Certainty = 0.0000 (Not Clear) <succ>
   bacterial outside --- Certainty = 0.0000 (Not Clear) <succ>

A related GBS nucleic acid sequence <SEQ ID 9641> which encodes amino acid sequence <SEQ ID 9642> was also identified.

The protein has homology with the following sequences in the GENPEPT database:

A related DNA sequence was identified in *S. pyogenes* <SEQ ID 1555> which encodes the amino acid sequence <SEQ ID 1556>. Analysis of this protein sequence reveals the following:

Possible site: 15
>>> Seems to have no N-terminal signal sequence
----- Final Results -----
   bacterial cytoplasm --- Certainty = 0.4849 (Affirmative) <succ>
   bacterial membrane --- Certainty = 0.0000 (Not Clear) <succ>
   bacterial outside --- Certainty = 0.0000 (Not Clear) <succ>

An alignment of the GAS, and GBS proteins is shown below:

```
>GP: AAC01534 GB: U88973 ribosomal protein L19 [Streptococcus thermophilus]

Identities = 110/115 (95%), Positives = 112/115 (96%)

Query:  25 MNPLIQSLTEGQLRSDIPEFRAGDTVRVHAKVVEGTRERIQIFEGVVISRKGQGISEMYT    84
           MNPLIQSLTEGQLR+DIP FR GDTVRVHAKVVEGTRERIQIFEGVVISRKGQGISEMYT Sbjct:   1 MNPLIQSLTEGQLRTDIPSFRPGDTVRVHAKVVEGTRERIQIFEGVVISRKGQGISEMYT    60

Query:  85 VRKISGGIGVERTFPIHTPRVDKIEVVRYGKVRRAKLYYLRALQGKAARIKEIRR       139
           VRKIS GIGVERTFPIHTPRVDKIEVVRYGKVRRAKLYYLRALQGKAARIKEIR+

Sbjct:  61 VRKISSGIGVERTFPIHTPRVDKIEVVRYGKVRRAKLYYLRALQGKAARIKEIRK       115
```

```
Identities = 111/115 (96%), Positives = 113/115 (97%)
Query:   25 MNPLIQSLTEGQLRSDIPEFRAGDTVRVHAKVVEGTRERIQIFEGVVISRKGQGISEMYT   84
            MNPLIQSLTEGQLRSDIP FR GDTVRVHAKVVEGTRERIQIFEGVVISRKGQGISEMYT
Sbjct:    1 MNPLIQSLTEGQLRSDIPNFRPGDTVRVHAKVVEGTRERIQIFEGVVISRKGQGISEMYT   60

Query:   85 VRKISGGIGVERTFPIHTPRVDKIEVVRYGKVRRAKLYYLRALQGKAARIKEIRR        139
            VRKISGGIGVERTFPIHTPRVDKIEV+R+GKVRRAKLYYLRALQGKAARIKEIRR
Sbjct:   61 VRKISGGIGVERTFPIHTPRVDKIEVIRHGKVRRAKLYYLRALQGKAARIKEIRR        115
```

Based on this analysis, it was predicted that these proteins and their epitopes could be useful antigens for vaccines or diagnostics.

Example 487

A DNA sequence (GBSx0524) was identified in *S. agalactiae* <SEQ ID 1557> which encodes the amino acid sequence <SEQ ID 1558>. This protein is predicted to be ISL2 protein. Analysis of this protein sequence reveals the following:

---

Possible site: 58
>>> Seems to have an uncleavable N-term signal seq
----- Final Results -----
    bacterial membrane --- Certainty = 0.0000 (Not Clear) <succ>
        bacterial outside --- Certainty = 0.0000 (Not Clear) <succ>
            bacterial cytoplasm --- Certainty = 0.0000 (Not Clear) <succ>

---

The protein has homology with the following sequences in the GENPEPT database:

```
>GP: CAC18596 GB: AJ278419 IS1381 transposase [Streptococcus pneumoniae]
Identities = 111/129 (86%), Positives = 117/129 (90%)
Query:    1 MKAQAIVTSQGRIVSLDIAVNYCHDMKLFKMSRRNIGQAAKILADSGYQGIMKMYSQAQT   60
            MK QAIVTSQGRIVSLDI VNYCHDMKLFKMSRRNIGQA KILADSGYQG+MK+Y QAQT
Sbjct:    1 MKTQAIVTSQGRIVSLDITVNYCHDMKLFKMSRRNIGQAGKILADSGYQGLMKIYPQAQT   60

Query:   61 PRKSSKLKPLTLEDKTYNHTLSKERIKVENIFAKVKTFKIFSTTYRNRRKRFGLRMNLIA  120
            RKSSKLKPLT+EDK  NH LSKER KVENIFAKVKTFK+FSTTYR+ RKRFGLRMNL A
Sbjct:   61 SRKSSKLKPLTVEDKACNHALSKERSKVENIFAKVKTFKMFSTTYRSHRKRFGLRMNLSA  120

Query:  121 GMINRELGF                                                    129
            G+IN ELGF
Sbjct:  121 GIINHELGF                                                    129
```

Example 488

A DNA sequence (GBSx0526) was identified in *S. agalactiae* <SEQ ID 1559> which encodes the amino acid sequence <SEQ ID 1560>. Analysis of this protein sequence reveals the following:

---

Possible site: 61
>>> Seems to have an uncleavable N-term signal seq
INTEGRAL    Likelihood = −10.99   Transmembrane 81-97 (67-107)
INTEGRAL    Likelihood = −6.32    Transmembrane 8-24 (6-25)
INTEGRAL    Likelihood = −2.76    Transmembrane 120-136 (120-136)
----- Final Results -----
    bacterial membrane--- Certainty = 0.5394 (Affirmative) <succ>
        bacterial outside--- Certainty = 0.0000 (Not Clear) <succ>
            bacterial cytoplasm--- Certainty = 0.0000 (Not Clear) <succ>

---

The protein has homology with the following sequences in the GENPEPT database:

```
>GP: BAB04382 GB: AP001509 unknown conserved protein in others
[Bacillus halodurans]
Identities = 53/150 (35%), Positives = 82/150 (54%), Gaps = 1/150 (0%)
Query:    1 MLNPYKRIFTLGLLATFLLFIFHFGRYSGLGTNLIEASFTNKNLYDYDWLLKLCLTVITL   60
            M N   R F  GL+    L +I      Y+G G +++E SFT +++  Y +L KL  T +T+
Sbjct:  251 MKNHTVRAFVGGLIIVALTYIIGSYDYNGRGLDMLEDSFT-QDVPPYAFLAKLVFTAVTM  309

Query:   61 AAGYQGGEVTPLFAIGASLGVIIAPILGLPVILVAALGYTSVFGSATNTLLGPILIGGEV  120
            G+ GGE  PLF +GA+LG +  + LP+  +AALG   FG   NT +  L+G E+
Sbjct:  310 GMGFVGGEAIPLFFVGATLGNTLHAFIDLPLSFLAALGMIVTFGGGANTPIAAFLLGVEM  369

Query:  121 FGFANTPYFVIVCLVAYSISHAHTIYGAQS                               150
            F     +F + CL +Y  S  H ++ +Q+
Sbjct:  370 FNGKGIEFFFVACLTSYLFSGHHGLWPSQT                               399
```

No corresponding DNA sequence was identified in *S. pyogenes*.

Based on this analysis, it was predicted that this protein and its epitopes, could be useful antigens for vaccines or diagnostics.

A related DNA sequence was identified in *S. pyogenes* <SEQ ID 1561> which encodes the amino acid sequence <SEQ ID 1562>. Analysis of this protein sequence reveals the following:

```
Possible site: 35
>>> Seems to have no N-terminal signal sequence
INTEGRAL    Likelihood = -11.99    Transmembrane 56-72 (53-78)
INTEGRAL    Likelihood = -7.17     Transmembrane 337-353 (327-355)
INTEGRAL    Likelihood = -6.74     Transmembrane 264-280 (260-282)
INTEGRAL    Likelihood = -6.16     Transmembrane 167-183 (161-187)
INTEGRAL    Likelihood = -5.26     Transmembrane 223-239 (217-242)
INTEGRAL    Likelihood = -5.10     Transmembrane 20-36 (19-42)
INTEGRAL    Likelihood = -0.37     Transmembrane 102-118 (102-119)
INTEGRAL    Likelihood = -0.16     Transmembrane 300-316 (300-316)
----- Final Results -----
    bacterial membrane --- Certainty = 0.5798 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the databases:

```
>GP: BAB04382 GB: AP001509 unknown conserved protein in others
[Bacillus halodurans]
Identities = 129/397 (32%), Positives = 210/397 (52%), Gaps = 14/397 (3%)
Query:    20 VLGLVGLALPIGGAVGVVDVIFGKGLLFLSEYRDHHLFLLLPFLALAGLVIVFLYDKLG-    78
             +L  +   + IG  VG  +        L E R++  + +L FL LAGL + +LY K G
Sbjct:     9 LLTWIFFGIMIGAIVGSATALLLTVNDHLGETRENRPWFVL-FLPLAGLALGYLYMKAGT    67

Query:    79 ---KEVRQGMGLVFQVGHGQKNQIPPMLIPLILFSTWVTHLFGASAGREGVAVQIGATIS   135
                E+ +G  LV  +    G K ++   L PL+   T++T LFG S GREG A+Q+G +++
Sbjct:    68 SAGNELYKGNNLVIESVQG-KGKMLLRLGPLVYLGTFMTILFGGSTGREGAAIQMGGSVA   126

Query:   136 HYCRR-FVTSQEAARHLLIMGMAAGFAGLFQTPIAAVVFALEVLLVGTLRYSALLPSLVA   194
              + F       R  LL+ G++AGF   F TPI A +F +E+   +G L++  AL+P LVA
Sbjct:   127 EAVNKLFKVKLIDTRILLMGGISAGFGAAFGTPITAAIFGMEMASLGRLKFEALVPCLVA   186

Query:   195 AYVASWTSHALG-LEKFTIVLEETLTITPLTLVKLIGLGLIFGLVGNSFAYLL-GWFKPY   252
              ++V  +T+    +E         ++ LT  K+I L ++F LV     L G K  Y
Sbjct:   187 SFVGHYTTEKFWHVEHEKPFIIATVPEVSALTFSKVILLAIVFSLVSVLYCQLRHGIHKLS   246

Query:   253 LSQKLPNPYFRIAFIGALLSICL--MIGHVGRYSGLGTNLIAAAFSGQTILTYDWLLKMI   310
              + N    R AF+G L+ + L  +IG     Y+G G +++  +F+ Q + Y +L K++
Sbjct:   247 EKYTMKNHTVR-AFVGGLIIVALTYIIGSYD-YNGRGLDMLEDSFT-QDVPPYAFLAKLV   303

Query:   311 VTVISLSAGFQGGEVTPLFAIGASLGIVLAPYLGLPVLLVAALGYTTVFGSATNTFWAPI   370
              T +++   GF GGE   PLF +GA+LG  L ++  LP+   +AALG    FG    NT   A
Sbjct:   304 FTAVTMGMGFVGGEAIPLFFVGATLGNTLHAFIDLPLSFLAALGMIVTFGGGANTPIAAF   363

Query:   371 FIGIEVFGPENALAYFVTSAAAYMVSHRHSIYSYQKV                         407
              +G+E+F  +    +FV    +Y+ S H ++ Q +
Sbjct:   364 LLGVEMFNGKGIEFFFVACLTSYLFSGHHGLWPSQTI                         400
```

An alignment of the GAS and GBS proteins is shown below:

```
Identities= 91/147 (61%), Positives = 111/147 (74%)
Query:     3 NPYKRIFTLGLLATFLLFIFHFGRYSGLGTNLIEASFTNKNLYDYDWLLKLCLTVITLAA    62
             NPY RI +G L +  L I H GRYSGLGTNLI A+F+ + +  YDWLLK+ +TVI+L+A
Sbjct:   259 NPYFRIAFIGALLSICLMIGHVGRYSGLGTNLIAAAFSGQTILTYDWLLKMIVTVISLSA   318

Query:    63 GYQGGEVTPLFAIGASLGVIIAPILGLPVILVAALGYTSVFGSATNTLLGPILIGGEVFG   122
             G+QGGEVTPLFAIGASLG+++AP LGLPV+LVAALGYT+VFGSATNT   PI IG EVFG
Sbjct:   319 GFQGGEVTPLFAIGASLGIVLAPYLGLPVLLVAALGYTTVFGSATNTFWAPIFIGIEVFG   378

Query:   123 FANTPYFVIVCLVAYSISHAHTIYGAQ                                  149
              N + +    +    AY +SH H+IY Q
Sbjct:   379 PENALAYFVTSAAAYMVSHRHSIYSYQ                                  405
```

Based on this analysis, it was predicted that these proteins and their epitopes could be useful antigens for vaccines or diagnostics.

Example 489

A DNA sequence (GBSx0527) was identified in *S. agalactiae* <SEQ ID 1563> which encodes the amino acid sequence <SEQ ID 1564>. Analysis of this protein sequence reveals the following:

```
Possible site: 27
>>> Seems to have a cleavable N-term signal seq.
INTEGRAL    Likelihood = -8.65    Transmembrane 47-63 (45-70)
INTEGRAL    Likelihood = -5.04    Transmembrane 219-235 (208-237)
INTEGRAL    Likelihood = -3.35    Transmembrane 168-184 (168-187)
INTEGRAL    Likelihood = -0.48    Transmembrane 141-157 (141-157)
----- Final Results -----
    bacterial membrane --- Certainty = 0.4461 (Affirmative) <succ>
    bacterial outside --- Certainty = 0.0000 (Not Clear) <succ>
    bacterial cytoplasm --- Certainty = 0.0000 (Not Clear) <succ>
```

A related GBS nucleic acid sequence <SEQ ID 9317> which encodes amino acid sequence <SEQ ID 9318> was also identified.

The protein has homology with the following sequences in the GENPEPT database:

```
>GP: BAB04382 GB: AP001509 unknown conserved protein in others
[Bacillus halodurans]
Identities = 75/223 (33%), Positives = 119/223 (52%), Gaps = 18/223 (8%)
Query:   17 FSLLIGGVVGAITAVFGRVLLFLTAFRSDYIAYLLPFLSIVGLFIVFVYQKFGGKS----  72
            F ++IG +VG+ TA+    V   L   R +   ++L FL + GL + ++Y  K G    +
Sbjct:   15 FGIMIGAIVGSATALLLTVNDHLGETRENRPWFVL-FLPLAGLALGYLYMKAGTSAGNEL  73

Query:   73 VKGMGLVFEVGHGNEETIPKRLVPLVILTTWLTHLFGGSAGREGVAVQIGATVSHYFQKY 132
               KG  LV E   G  + +   RL PLV L T++T LFGGS GREG A+Q+G +V+    K
Sbjct:   74 YKGNNLVIESVQGKGKML-LRLGPLVYLGTFMTILFGGSTGREGAAIQMGGSVAEAVNKL 132

Query:  133 CRLQNASQLFLVM-GMAAGFAGLFQTPLAATFFAIEVLVVGRLMVSYVLPSLIAALTANF 191
             +++       L+M G++AGF     F TP+ A  F +E+   +GRL    ++P L+A+   ++
Sbjct:  133 FKVKLIDTRILLMGGISAGFGAAFGTPITAAIFGMEMASLGRLKFEALVPCLVASFVGHY 192

Query:  192 VSHSLGLEKFSH------SIATSMALTPDIILKLLVLGLCFGL                 228
             +     EKF H        IAT    ++    K+++L +  F L
Sbjct:  193 TT-----EKFWHVEHEKFIIATVPEVSALTFSKVILLAIVFSL                 230
```

There is also homology to SEQ ID 1562.

A related GBS gene <SEQ ID 8577> and protein <SEQ ID 8578> were also identified. Analysis of this protein sequence reveals the following:

Lipop: Possible site: −1   Crend: 5
McG: Discrim Score: 9.66
GvH: Signal Score (−7.5): −1.12
Possible site: 27
>>> Seems to have a cleavable N-term signal seq.
ALOM program   count: 7 value: −10.99 threshold: 0.0
INTEGRAL   Likelihood = −10.99   Transmembrane 328-344 (314-354)
INTEGRAL   Likelihood = −8.65    Transmembrane 47-63 (45-70)

-continued

INTEGRAL   Likelihood = −6.32   Transmembrane 255-271 (253-272)
INTEGRAL   Likelihood = −4.41   Transmembrane 214-230 (208-238)
INTEGRAL   Likelihood = −3.35   Transmembrane 168-184 (168-187)
INTEGRAL   Likelihood = −2.76   Transmembrane 367-383 (367-383)
INTEGRAL   Likelihood = −0.48   Transmembrane 141-157 (141-157)
PERIPHERAL Likelihood = 0.42    94
modified ALOM score: 2.70
*** Reasoning Step: 3
----- Final Results -----
    bacterial membrane --- Certainty = 0.5394 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
ORF01989(349-1491 of 1794)
GP|4512350|dbj|BAA75315.1||AB011836(15-399 of 424) similar to Bordetella
paraperlussis transposase for insertion sequence element(27%-identity)
{Bacillus halodurans}
PIR|T44296|T44296 hypothetical protein [imported]-Bacillus halodurans
% Match = 15.4
% Identity = 33.4 % Similarity = 54.7
Matches = 129 Mismatches = 167 Conservative Sub.s = 82

222       252       282       312       342       372       402       432
MY*RKSKTINLTM*YEQLSKTL*QNLVFIKRRIL*TVIKRFDNYAQYVLVLGFSLLIGGVVGAITAVFGRVLLFLTAFRS
                                                      |  ::||  :||:  ||::   |     |     |
                                                    MNKTFWLTLLTWIFFGIMIGAIVGSATALLLTVNDHLGETRE
                                                          10        20        30        40

462       492       513       540       570       600       630       660
DYIAYLLPFLSIVGLFIVFVYQKFG---GKSV-KGMGLVFEVGHGNEETIPKRLVPLVILTTWLTHLFGGSAGREGVAVQ
:    ::|  ||  :  ||  ::||   |      |  :  ||     ||     |:|   :    ||  ||| |::|   |||||  |||  |:|
NRPWFVL-FLPLAGLALGYLYMKAGTSAGNELYKGNNLVIESVQG-KGKMLLRLGPLVYLGTFMTILFGGSTGREGAAIQ
             60         70        80        90        100       110       120

690       720       747       777       807       837       867       894
IGATVSHYFQKYCRLQNASQLFLVMG-MAAGFAGLFQTPLAATFFAIEVLVVGRLMVSYVLPSLIAALTANFVSHSL-GL
:|   :|:      |    :::       |:||  ::|||      |||:  |     |:|:   :|||     ::|   |::::     ::   :     :
MGGSVAEAVNKLFKVKLIDTRILLMGGISAGFGAAFGTPITAAIFGMEMASLGRLKFEALVPCLVASFVGHYTTEKFWHV
             130        140       150       160       170       180       190       200

924       954       984       1014      1041      1071      1101      1131
EKFSHSIATSMALTPDIILKLLVLGLCFGLCGNLFAYLLAKA-KLIASSRLLNPYKRIFTLGLLATFLLFIFHFGRYSGL
|      |||    ::       |:::|  :  |     |:  |      ||          :     |    |    ||:    | :        |:|
EHEKFIIATVPEVSALTFSKVILLAIVFSLVSVLYCQLRHGIHKLSEKYTMKNHTVRAFVGGLIIVALTYIIGSYDYNGR
             210        220       230       240       250       260       270       280
```

-continued

```
1161      1191      1221      1251      1281      1311      1341      1371
GTNLIEASFTNKNLYDYDWLLKLCLTVITLAAGYQGGEVTPLFAIGASLGVIIAPILGLPVILVAALGYTSVFGSATNTL
|  :::|  |||  :::    |  :|  ||  :|  :|:    |:   |||   |||  :||:||   :     :  ||: ::||||      ||    ||
GLDMLEDSFT-QDVPPYAFLAKLVFTAVTMGMGFVGGEAIPLFFVGATLGNTLHAFIDLPLSFLAALGMIVTFGGGANTP
         290       300       310       320       330       340       350

1401      1431      1461      1491      1521      1551      1581      1611
LGPILIGGEVFGFANTPYFVIVCLVAYSISHAHTIYGAQSR*LVMSFKRVYQFVERNIPFSFLFS*SL*KWSLSIL*MQK
:     |:|  |:|           :|  :   ||  :|      |    |  ::  :|:
IAAFLLGVEMFNGKGIEFFFVACLTSYLFSGHHGLWPSQTIYEPKSRLYGVRKGETIKRTEEMKE
         370       380       390       400       410       420
```

Based on this analysis, it was predicted that these proteins and their epitopes could be useful antigens for vaccines or diagnostics.

Example 490

A DNA sequence (GBSx0528) was identified in *S. agalactiae* <SEQ ID 1565> which encodes the amino acid sequence <SEQ ID 1566>. Analysis of this protein sequence reveals the following:

Possible site: 33
>>> Seems to have no N-terminal signal sequence
----- Final Results -----
   bacterial cytoplasm --- Certainty = 0.3568 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database:

```
>GP: AAB98234 GB: U67480 chorismate mutase/prephenate dehydratase
(pheA) [Methanococcus jannaschii]
Identities = 26/85 (30%), Positives = 46/85 (53%), Gaps = 1/85 (1%)
Query:  2 ELEEIRQEIDEIDQQLVSLLETRMGLILEVIAFKKKHRLPVLDNNRENEVLNNVLKKVQN   61
          +L EIR++IDEID +++ L+  R   L  +V    K +  +P+ D  RE  + + + K  +
Sbjct:  4 KLAEIRKKIDEIDNKILKLIAERNSLAKDVAEIKNQLGIPINDPEREKYIYDRIRKLCKE   63

Query: 62 HQFDDVIRATFKDIMTE-SRVYQKE                                     85
           H  D+ I      I+ E ++  QK+
Sbjct: 64 HNVDENIGIKIFQILIEHNKALQKQ                                     88
```

A related DNA sequence was identified in *S. pyogenes* <SEQ ID 1567> which encodes the amino acid sequence <SEQ ID 1568>. Analysis of this protein sequence reveals the following:

Possible site: 37
>>> Seems to have no N-terminal signal sequence
Final Results
   bacterial cytoplasm --- Certainty = 0.2356 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below:

```
Identities = 45/91 (49%), Positives = 62/91 (67%)
Query:   1 MELEEIRQEIDEIDQQLVSLLETRMGLILEVIAFKKKHRLPVLDNNRENEVLNNVLKKVQ 60
           M LE+IRQEI+ ID  LV+LLE RM L+ +V A+K  + LPVLD  REN++L+ V   V+
Sbjct:   1 MRLEKIRQEINGIDHHLVALLEKRMALVEQVTAYKLANHLPVLDQARENQILDRVSYLVK 60

Query:  61 NHQFDDVIRATFKDIMTESRVYQKENIVDGD                              91
           +  F+  I  TFK IM+ SR YQ +++  GD
Sbjct:  61 DQAFEPAIHETFKTIMSLSRQYQTQHLTGGD                              91
```

Based on this analysis, it was predicted that these proteins and their epitopes could be useful antigens for vaccines or diagnostics.

Example 491

A DNA sequence (GBSx0529) was identified in *S. agalactiae* <SEQ ID 1569> which encodes the amino acid sequence <SEQ ID 1570>. This protein is predicted to be neuraminidase. Analysis of this protein sequence reveals the following:

Possible site: 19
>>> Seems to have no N-terminal signal sequence
INTEGRAL    Likelihood = –3.35    Transmembrane 28-44 (28-47)
----- Final Results -----
   bacterial membrane --- Certainty = 0.2338 (Affirmative) <succ>
   bacterial outside --- Certainty = 0.0000 (Not Clear) <succ>
      bacterial cytoplasm --- Certainty = 0.0000 (Not Clear) <succ>

A related GBS nucleic acid sequence <SEQ ID 10191> which encodes amino acid sequence <SEQ ID 10192> was also identified.

The protein has homology with the following sequences in the GENPEPT database:

```
>GP: CAA51473 GB: X72967 neuraminidase [Streptococcus pneumoniae]
Identities = 294/504 (58%), Positives = 380/504 (75%), Gaps = 10/504 (1%)
Query: 303 EDIKSYFQYYCHLNHQLKLPKGAILSAKTEVYRGGDFGRKNKDNVFGYRIPSLLKTEKGT 362
           E+++    Q +   + + KLP+GA L+ KT+++  G  G+ NKD +  YRIP+LLKT+KGT
Sbjct: 299 EEVQKRSQLFKRSDLEKKLPEGAALTEKTDIFESGRNGKPNKDGIKSYRIPALLKTDKGT 358

Query: 363 LLVGADERIEQACDWGNIGMVIRRSEDDGVTWGKRETIVNLRNNPRVPLVTSGDYSGSPI 422
           L+ GADER  + DWG+IGMVIRRSED+G TWG R TI NLR+NP+     S    GSP+
Sbjct: 359 LIAGADERRLHSSDWGDIGMVIRRSEDNGKTWGDRVTITNLRDNPKA----SDPSIGSPV 414

Query: 423 NMDMALVQDTSSKTKRIFSIYDMFPEGRGVISIANTPEKEYTQIGGQSYLNLYNNGKKSK 482
           N+DM LVQD   +TKRIFSIYDMFPEG+G+   +++  E+ Y +I G++Y   LY  G+K
Sbjct: 415 NIDMVLVQDP--ETKRIFSIYDMFPEGKGIFGMSSQKEEAYKKIDGKTYQILYREGEKG- 471

Query: 483 VFTIRDKGIVYNFKGKKTDYHVITETTKSDHSNLGDIYKGKQLLGNIYFTKHKTSPFRLA 542
             +TIR+ G VY   GK TDY V+ +   K   +S+ GD+YKG QLLGNIYFT +KTSPFR+A
Sbjct: 472 AYTIRENGTVYTPDGKATDYRVVVDPVKPAYSDKGDLYKGNQLLGNIYFTTNKTSPFRIA 531

Query: 543 KSSYVWMSYSDDDGRTWSSPRDITASLRQKGMKFLGIGPGKGIVLKWGPHAGRIIIPAYS 602
           K SY+WMSYSDDDG+TWS+P+D+T  ++    MKFLG+GPG GIVL+ GPH GRI+IP Y+
Sbjct: 532 KDSYLWMSYSDDDGKTWSAPQDITPMVKADWMKFLGVGPGTGIVLRNGPHKGRILIPVYT 591

Query: 603 TNWKSHLRGSQSSRLIYSDDHGKTWHTGKAVNDNRILSNGEKIHSLTMDNKKEQNTESVP 662
           TN   SHL GSQSSR+IYSDDHGKTWH G+AVNDNR + +G+KIHS TM+N++ QNTES
Sbjct: 592 TNNVSHLNGSQSSRIIYSDDHGKTWHAGEAVNDNRQV-DGQKIHSSTMNNRRAQNTESTV 650

Query: 663 VQLKNGDIKLFMRNLTGNLEVATSKDGGETWQNHVKRYKEVHDAYVQLSAIRFEHDKKEY 722
           VQL NGD+KLFMR LTG+L+VATSKDGG TW+  +KRY +V D YVQ+SAI   H+ KEY
Sbjct: 651 VQLNNGDVKLFMRGLTGDLVATSKDGGVTWEKDIKRYPQVKDVYVQMSAIHTMHEGKEY 710

Query: 723 ILLVNANGPGKKRQDGYARLAQVNRNGSFKWLYHHHIQDGSFAYNSVQQLNNDKFGVLYE 782
           I+L NA GP   KR++G   LA+V NG   WL H+ IQ G FAYNS+Q+L N ++G+LYE
Sbjct: 711 IILSNAGGP--KRENGMVHLARVEENGELTWLKHNPIQKGEFAYNSLQELGNGEYGILYE 768

Query: 783 HREKHQNSFTLNYKVFNWSFLSQN                                    806
           H EK QN++TL+++ FNW FLS++
Sbjct: 769 HTEKGQNAYTLSFRKFNWDFLSKD                                    792
```

No corresponding DNA sequence was identified in *S. pyogenes*.

Based on this analysis, it was predicted that these proteins and their epitopes could be useful antigens for vaccines or diagnostics.

Example 492

A DNA sequence (GBSx0530) was identified in *S. agalactiae* <SEQ ID 1571> which encodes the amino acid sequence <SEQ ID 1572>. This protein is predicted to be unnamed protein product (gatC). Analysis of this protein sequence reveals the following:

```
Possible site: 34
>>> Seems to have an uncleavable N-term signal seq
INTEGRAL    Likelihood = -12.63   Transmembrane 154-170 (149-178)
INTEGRAL    Likelihood = -11.99   Transmembrane 103-119 (98-123)
INTEGRAL    Likelihood = -7.91    Transmembrane 21-37 (14-40)
INTEGRAL    Likelihood = -6.53    Transmembrane 448-464 (444-467)
INTEGRAL    Likelihood = -5.89    Transmembrane 47-63 (45-68)
INTEGRAL    Likelihood = -5.10    Transmembrane 356-372 (352-373)
INTEGRAL    Likelihood = -4.78    Transmembrane 330-346 (328-350)
INTEGRAL    Likelihood = -4.41    Transmembrane 376-392 (375-393)
INTEGRAL    Likelihood = -3.72    Transmembrane 243-259 (235-266)
INTEGRAL    Likelihood = -2.55    Transmembrane 277-293 (275-293)
----- Final Results -----
   bacterial membrane --- Certainty = 0.6052 (Affirmative) <succ>
   bacterial outside --- Certainty = 0.0000 (Not Clear) <succ>
   bacterial cytoplasm --- Certainty = 0.0000 (Not Clear) <succ>
```

A related DNA sequence was identified in *S. pyogenes* <SEQ ID 1573> which encodes the amino acid sequence <SEQ ID 1574>. Analysis of this protein sequence reveals the following:

```
Possible site: 35
>>> Seems to have an uncleavable N-term signal seq
INTEGRAL    Likelihood = -12.31   Transmembrane 154-170 (150-179)
INTEGRAL    Likelihood = -11.68   Transmembrane 104-120 (99-124)
INTEGRAL    Likelihood = -9.82    Transmembrane 447-463 (442-469)
INTEGRAL    Likelihood = -7.91    Transmembrane 22-38 (11-41)
INTEGRAL    Likelihood = -7.11    Transmembrane 377-393 (375-403)
INTEGRAL    Likelihood = -5.89    Transmembrane 48-64 (46-69)
INTEGRAL    Likelihood = -4.78    Transmembrane 331-347 (329-351)
INTEGRAL    Likelihood = -3.88    Transmembrane 357-373 (353-373)
INTEGRAL    Likelihood = -2.55    Transmembrane 278-294 (276-294)
INTEGRAL    Likelihood = -1.22    Transmembrane 240-256 (240-257)
---- Final Results -----
   bacterial membrane --- Certainty = 0.5925 (Affirmative) <succ>
   bacterial outside --- Certainty = 0.0000 (Not Clear) <succ>
   bacterial cytoplasm --- Certainty = 0.0000 (Not Clear) <succ>
```

An alignment of the GAS and GBS proteins is shown below:

```
Identities = 419/482 (86%), Positives = 447/482 (91%)

Query:     1 MQVFLNIVNKFFDPIIHMGSGVVMLIVMTGLAMIFGVKFSKALEGGIKLAIALTGIGAII    60
             MQ FL+I+NK     I +GSGVVMLIVMTGLAMIFGVKF+KALEGGIKLAIALTGIGAII
Sbjct:     2 MQPFLDIINKILGFPIQLGSGVVMLIVMTGLAMIFGVKFTKALEGGIKLAIALTGIGAII    61

Query:    61 GILTGAFSESLQAFVKNTGINLSIIDVGWAPLATITWGSPYTLYFLLIMLIVNIVMIVMK   120
             GILTGAFSESLQAFVKNTGI+L+IIDVGWAPLATITWGSPYTLYFLL+ML+VNIVMIVMK
Sbjct:    62 GILTGAFSESLQAFVKNTGISLNIIDVGWAPLATITWGSPYTLYFLLVMLVVNIVMIVMK   121

Query:   121 KTDTLDVDIFDIWHLSITGLLIMWYAKKNNLPTLLSVIIATVAIIFVGVLKIINSDLMKP   180
             KTDTLDVDIFDIWHLSITGLLIMWYA +N+LP  +S++IATVA+I VGVLKIINSDLMKP
Sbjct:   122 KTDTLDVDIFDIWHLSITGLLIMWYAARNHLPVFVSLLIATVAVILVGVLKIINSDLMKP   181

Query:   181 TFDDLLGTGPTSPMTSTHMNYMMNPIIMVLDKLFDKVFPGLDKYDFDAAKLNKAIGFWGS   240
             TFDDLLGTGP SPMTSTHMNYMMNPIIMVLDK+FDKVFPGLDKYDFDAAKLNK IGFWGS
Sbjct:   182 TFDDLLGTGPQSPMTSTHMNYMMNPIIMVLDKIFDKVFPGLDKYDFDAAKLNKKIGFWGS   241

Query:   241 KFFIGMILGLVIGIMGNPVFSFAALGGWFSLGFTAGACLELFSLIGSWFIAAVEPLSQGI   300
             KFFIGM LG VIGIMG+P F+  ++  WF LGFTAGACLELFSLIGSWFIAAVEPLSQGI
Sbjct:   242 KFFIGMALGFVIGIMGDPHFTVESIKNWFGLGFTAGACLELFSLIGSWFIAAVEPLSQGI   301

Query:   301 TNFANGKMHGRRFNIGLDWPFIAGRAEIWACANILAPIMLVEAILLSKVGNGILPLAGII   360
             TNFAN +MHGRRFNIGLDWPFIAGRAEIWACANILAPIML+EA+LLSKVGNGILPLAGII
Sbjct:   302 TNFANARMHGRRFNIGLDWPFIAGRAEIWACANILAPIMLIEAVLLSKVGNGILPLAGII   361

Query:   361 AMGVTPALLVVTRGRLIRMITFGTLLLPLFLLSGTMIAPFATELAKKVGAFPAGARAGSL   420
             AMG+TPALLVVTRGRLIRMI FG+LLLPLFLLSGTMIAPFATELAKKVGAFPAG  AGSL
Sbjct:   362 AMGMTPALLVVTRGRLIRMIIFGSLLLPLFLLSGTMIAPFATELAKKVGAFPAGTSAGSL   421

Query:   421 ITHSTLEGPMEKIFGYVIGKATTGQLSAIITLIIFATAYLGLFMWYAKQMKRRNAEYAAN   480
             ITHSTLEGPMEKIFGYVIG+ATTGQ+++IITLIIF   YL LF WYA QMK RNAEYA
Sbjct:   422 ITHSTLEGPMEKIFGYVIGQATTGQIASIITLIIFVAIYLSLFAWYANQMKARNAEYAKT   481

Query:   481 QK                                                            482
             K
Sbjct:   482 MK                                                            483
```

A related GBS gene <SEQ ID 8579> and protein <SEQ ID 8580> were also identified. Analysis of this protein sequence reveals the following:

---

Lipop: Possible site: −1   Crend: 9
McG: Discrim Score: 4.31
GvH: Signal Score (−7.5) : −2.64
Possible site: 34
>>> Seems to have an uncleavable N-term signal seq
ALOM program count: 6   value: −12.63   threshold: 0.0
INTEGRAL     Likelihood = −12.63   Transmembrane 154-170 (149-178)
INTEGRAL     Likelihood = −11.99   Transmembrane 103-119 (98-123)
INTEGRAL     Likelihood = −7.91    Transmembrane 21-37 (14-40)
INTEGRAL     Likelihood = −5.89    Transmembrane 47-63 (45-68)
INTEGRAL     Likelihood = −4.88    Transmembrane 243-259 (235-265)
INTEGRAL     Likelihood = −1.22    Transmembrane 268-284 (268-284)
PERIPHERAL   Likelihood = 0.85     127
modified ALOM score: 3.03
*** Reasoning Step: 3
----- Final Results -----
   bacterial membrane --- Certainty = 0.6052 (Affirmative) <succ>
      bacterial outside --- Certainty = 0.0000 (Not Clear) <succ>
         bacterial cytoplasm --- Certainty = 0.0000 (Not Clear) <succ>

---

The protein has homology with the following sequences in the databases:

Based on this analysis, it was predicted that these proteins and their epitopes could be useful antigens for vaccines or diagnostics.

Example 493

A DNA sequence (GBSx0531) was identified in *S. agalactiae* <SEQ ID 1575> which encodes the amino acid sequence <SEQ ID 1576>. Analysis of this protein sequence reveals the following:

---

Possible site: 14
>>> Seems to have no N-terminal signal sequence
----- Final Results -----
   bacterial cytoplasm --- Certainty = 0.0302 (Affirmative) <succ>
      bacterial membrane --- Certainty = 0.0000 (Not Clear) <succ>
         bacterial outside --- Certainty = 0.0000 (Not Clear) <succ>

---

The protein has no significant homology with any sequences in the GENPEPT database.

A related DNA sequence was identified in *S. pyogenes* <SEQ ID 1577> which encodes the amino acid sequence <SEQ ID 1578>. Analysis of this protein sequence reveals the following:

---

```
ORF00838(343-1122 of 1455)
EGAD|91348|EC2092(9-344 of 451) PTS system, galactitol specific IIC component
{Escherichia coli} OMNI|NT01EC2494 PTS system galactitol-specific enzyme IIC
component
SP|P37189|PTKC_ECOLI PTS SYSTEM, GALACTITOL-SPECIFIC IIC COMPONENT (EIIC-GAT)
(GALACTICOL-PERMEASE IIC COMPONENT) (PHOSPHOTRANSFERASE ENZYME II, C COMPONENT).
GP|1736809|dbj|BAA15955.1|D90847 PTS system, Galactitol-specific IIC component
(EIIC-GAT)
(Galactitol-permease IIC component) (Phosphotransferase enzyme II, C component).
{Escherichia coli} GP|17884
% Match = 10.9
% Identity = 29.8  % Similarity = 59.2
Matches = 68  Mismatches = 88  Conservative Sub.s = 67

282       312       342       372       402       432       462       492
LS*HI*NWN*S*RRRNMQVFLNIVNKFFDPIIHMGSGVVMLIVMTGLAMIFGVKFSKALEGGIKLAIALTGIGAIIGILT
                          |: :|    |: :  ||  ::  :|::     :: |: :  | : ||| :||::
                         MFSEVMRYILDLGPTVMLPIVIIFSKILGMKAGDCFKAGLHIGIGFVGIGLVIGLML
                                  10        20        30        40        50

522       552       582       612       642       672       702
GAFSESLQAFVKNTGINLSIIDVGWAPLATITWGSPYTLYFLLIMLIVNIVMIVMKKTDTLDVDIFDIWHLSITGLLIM-
 :    : :|   :|   :|||   :||  |    |   |::|||::|::||::|||: ||  ||||
DSIGPAAKAMAENFDLNLHVVDVGWPGSSPMTWASQIALVAIPIAILVNVAMLLTRMTRVVNVDIWNIWHMTFTGALLHL
         70        80        90       100       110       120       130

747       774       804       834       864       894
----------------------WYAKKN-NLPTLLSVIIATVAIIFVGVLKIINSDLMKPTFDDLLGTGPTSPMTSTH
                      |:|:   |:    |   :    |     ::|
ATGSWMIGMAGVVIHAAFVYKLGDWFARDTRNFFELEGIAIPHGTSAYMG-----------------------------
          150       160       170       180

924       954       984      1014      1044
MNYMMNPIIMVLDKLFDKVFPGLDKYDFDAAKLNKAIGFWGSKFFIGMILGLVIXIM--------------------~~~
          ||  :::  : :|:  ||:::    |     |     :|      |:  |:
------PIAVLVDAIIEKI-PGVNRIKFSADDIQRKFGPFGEPVTVGFVMGLIIGILAGYDVKGVLQLAVKTAAVML~~~
           200       210       220       230       240       250

1092      1122      1152      1182      1212      1242
~~~-------------------GNPVFSFASIRWLVFFFVLQQGACLECGLF*LVSWVQLLO*NHFLRKLLILLMVNAXX*
                      ||  |: |    :    :  ||    :
~VVSASLIFIPLTILIAVCVPGNQVLPFGDLATIGFFVAMAVAVHRGNLFRTLISGVIIMSITLWIATWTIGLHTQLAAN
         320       330       340       350       360       370       380
```

```
Possible site: 14
>>> Seems to have no N-terminal signal sequence
----- Final Results -----
    bacterial cytoplasm --- Certainty = 0.0302 (Affirmative) <succ>
      bacterial membrane --- Certainty = 0.0000 (Not Clear) <succ>
        bacterial outside --- Certainty = 0.0000 (Not Clear) <succ>
```

An alignment of the GAS and GBS proteins is shown below:

```
Identities = 85/100 (85%), Positives = 96/100 (96%)
Query:    1 MIKILAACGAGVNSSHQIKDAIETQLGDRGYNVHCDAVMVKDITEEMVNKYDIFTPIAKT   60
            MIKILAACGAGVNSSHQIKDAIETQ+ DRGY+VHCDAVMVKDITEE+V++YDIFTPIAKT
Sbjct:    1 MIKILAACGAGVNSSHQIKDAIETQMSDRGYDVHCDAVMVKDITEELVSRYDIFTPIAKT   60

Query:   61 DLGFNVPIPVVEAGPILYRIPVMSEPVFTALEQVIKEHNL                      100
            DLGF +PIP+VEAGPILYRIP+MSEPVF  LE+VIKE++L
Sbjct:   61 DLGFEMPIPIVEAGPILYRIPIMSEPVFAELERVIKENHL                      100
```

Based on this analysis, it was predicted that these proteins and their epitopes could be useful antigens for vaccines or diagnostics.

Example 494

A DNA sequence (GBSx0532) was identified in *S. agalactiae* <SEQ ID 1579> which encodes the amino acid sequence <SEQ ID 1580>. This protein is predicted to be GatA. Analysis of this protein sequence reveals the following:

```
Possible site: 15
>>> Seems to have no N-terminal signal sequence
----- Final Results -----
    bacterial cytoplasm --- Certainty = 0.2078 (Affirmative) <succ>
      bacterial membrane --- Certainty = 0.0000 (Not Clear) <succ>
        bacterial outside --- Certainty = 0.0000 (Not Clear) <succ>
```

A related GBS nucleic acid sequence <SEQ ID 10193> which encodes amino acid sequence <SEQ ID 10194> was also identified.

The protein has homology with the following sequences in the GENPEPT database:

```
>GP: AAG09977 GB: AF248038 GatA [Streptococcus agalactiae]

Identities = 39/135 (28%), Positives = 76/135 (55%), Gaps = 9/135 (6%)

Query:   16 QEELFDLVSKALIKQHYVSPNYRQAVKEREREFPTGLKIDLKDGTPIQYVAIPHTETQYC   75
            Q  L +++S+ L+++ YV   + +A+ +RE+++PTGL+++        VAIPHT ++Y
Sbjct:   20 QTNLLEVLSQYLLQKGYVKTEFSKAILQREKDYPTGLQLE------NMAVAIPHTYSEYV   73

Query:   76 LVDRIFYVKNSQPITFKHMINPEEECRVQDFFFIINSRN-SNQSDILSNLITFFITKGNL  134
            L  I+ K +PI+F  M   E+E  +  ++  N  +Q+ +L+ L+T F      +
Sbjct:   74 LKPFIYINKLKEPISFIQM-GTEDEIVMARYVIVLGISNPKDQAGLLAELMTLFSNPKIV  132

Query:  135 DRLHELGDNKEKINH                                               149
            +L E+    KE + +
Sbjct:  133 QQL-EMAQTKEALKN                                               146
```

A related DNA sequence was identified in *S. pyogenes* <SEQ ID 1581> which encodes the amino acid sequence <SEQ ID 1582>. Analysis of this protein sequence reveals the following:

Possible site: 33
>>> Seems to have no N-terminal signal sequence
----- Final Results -----
    bacterial cytoplasm --- Certainty = 0.3130 (Affirmative) <succ>
    bacterial membrane --- Certainty = 0.0000 (Not Clear) <succ>
    bacterial outside --- Certainty = 0.0000 (Not Clear) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below:

The protein has homology with the following sequences in the GENPEPT database:

```
Identities = 102/154 (66%), Positives = 122/154 (78%)
Query:    4 VTQDILFIDAHSQEELFDLVSKALIKQHYVSPNYRQAVREREREFPTGLKIDLKDGTPIQ      63
            V +ILF +A +Q ELFDLV+   L K  YV+  Y QA+ ERE   FPTGLK+DLKDG+ I
Sbjct:    1 VFPNILFTEARTQPELFDLVASHLEKVGYVTQEYHQALVEREAVFPTGLKVDLKDGSDIL     60

Query:   64 YVAIPHTETQYCLVDRIFYVKNSQPITFKHMINPEEECRVQDFFFIINSRNSNQSDILSN     123
            Y AIPHTET+YCLVD++  YV+NSQ +TFKHMMINPEE+C V DFFFIINS+N Q+ ILSN
Sbjct:   61 YAAIPHTETKYCLVDQVVYVRNSQALTFKHMINPEEDCLVTDFFFIINSQNEGQTTILSN     120

Query:  124 LITFFITKGNLDRLHELGDNKEKINHYLIEKGVF                              157
            LITFFITKGNL    L  D+K+ I++YLIEKGVF
Sbjct:  121 LITFFITKGNLSYLASLKDDKQAISNYLIEKGVF                              154
```

Based on this analysis, it was predicted that these proteins and their epitopes could be useful antigens for vaccines or diagnostics.

Example 495

A DNA sequence (GBSx0533) was identified in *S. agalactiae* <SEQ ID 1583> which encodes the amino acid sequence <SEQ ID 1584>. Analysis of this protein sequence reveals the following:

```
>GP: AAA25176 GB: M60447 repressor protein [Lactococcus lactis]
Identities = 139/255 (54%), Positives = 189/255 (73%), Gaps = 6/255 (2%)
Query:    1 MLKRERLQKIIEKVNINGIVTVNEIMEELDVSDMTVRRDLDELDKAGLLIRIHGGAQKVN     60
            M K+ RL+KI++ + I+G +T+ EI++ELD+SDMT RRDLD L+  GLL R HGGAQ ++
Sbjct:    7 MNKKRRLEKILDMLKIDGTITIKEIIDELDISDMTARRDLDALEADGLLTRTHGGAQLLS     66

Query:   61 ASPTPQNYEKSNTEKYDIQTNEKLEIAQFAKQFINDGETIFIGPGTTLEKLATQLLD---     117
                +     EK++ EK  + T EK++IA+ A    I DG+TIFIGPGTTL +LA +L
Sbjct:   67 SK---KPLEKTHIEKKSLNTKEKIDIAKKACSLIKDGDTIFIGPGTTLVQLALELKGRKG     123

Query:  118 FKIRVVTNSLPVFNILNQSSTLDLILVGGEYREITGAFVGSVTINSIKSLNFSKAFVSSN     177
            +KIRV+TNSLPVF ILN S T+DL+L+GGEYREITGAFVGS+    ++K++ F+KAFV +N
Sbjct:  124 YKIRVITNSLPVFLILNDSETIDLLLLGGEYREITGAFVGSMASTNLKAMRFAKAFVRAN     183

Query:  178 GVFEKSIATYDEGEGEIQRIALNNSFEKELLVDSQKFGKYDFYTFYQLDDIDFVLTDHNI     237
            V     SIATY + EG IQ++ALNN+ EKFLLVDS KF +YDF+ FY LD +D ++TD+ I
Sbjct:  184 AVTHNSIATYSDKEGVIQQLALNNAVEKFLLVDSTKFDRYDFFNFYNLDQLDTIITDNQI     243

Query:  238 DNVVKEQYSSFTKIL                                                 252
            +++  E++S +T IL
Sbjct:  244 SPQHLEEFSQYTTIL                                                 258
```

Possible site: 61
>>> Seems to have no N-terminal signal sequence
----- Final Results -----
    bacterial cytoplasm --- Certainty = 0.1429 (Affirmative) <succ>

A related DNA sequence was identified in *S. pyogenes* <SEQ ID 1585> which encodes the amino acid sequence <SEQ ID 1586>. Analysis of this protein sequence reveals the following:

Possible site: 60
>>> Seems to have no N-terminal signal sequence
----- Final Results -----
   bacterial cytoplasm --- Certainty = 0.0740 (Affirmative) <succ>
      bacterial membrane --- Certainty = 0.0000 (Not Clear) <succ>
         bacterial outside --- Certainty = 0.0000 (Not Clear) <succ>

An alignment of the GAS and GBS proteins is shown below:

```
Identities = 161/252 (63%), Positives = 195/252 (76%), Gaps = 3/252 (1%)
Query:    1 MLKRERLQKIIEKVNINGIVTVNEIMEELDVSDMTVRRDLDELDKAGLLIRIHGGAQKVN      60
            MLKRERL KI E VN  GIVTVN+I++ L+VSDMTVRRDLDEL+KAG LIRIHGGAQ +
Sbjct:    1 MLKRERLLKITEIVNEQGIVTVNDIIQTLNVSDMTVRRDLDELEKAGKLIRIHGGAQSIT     60

Query:   61 ASPTPQNYEKSNTEKYDIQTNEKLEIAQFAKQFINDGETIFIGPGTTLEKLATQLLDFKI    120
               P    E+SN EK  +QT EK E+A +A Q +NDGETIFIGPGTTLE   A QL + +I
Sbjct:   61 M---PNKKERSNIEKQTVQTKEKWELASYATQLVNDGETIFIGPGTTLECFAEQLKNRQI    117

Query:  121 RVVTNSLPVFNILNQSSTLDLILVGGEYREITGAFVGSVTINSIKSLNFSKAFVSSNGVF    180
            R+VTNSLPVFNIL  S T+DLIL+GGEYR ITGAFVGS+   +I SL F+KAF+S NG++
Sbjct:  118 RIVTNSLPVFNILQDSETIDLILIGGEYRSITGAFVGSLASQNISSLKFAKAFISCNGIY    177

Query:  181 EKSIATYDEGEGEIQRIALNNSFEKFLLVDSQKFGKYDFYTFYQLDDIDFVLTDHNIDNV    240
            +   IATY E EGEIQ++A NNS EK+LLVD+QKF YDF+  FY L++ID V+TD   I
Sbjct:  178 KNDIATYSETEGEIQKLAFNNSIEKYLLVDNQKFNAYDFFIFYHLNNIDAVVTDSQITED    237

Query:  241 VKEQYSSFTKIL                                                  252
            V E+YS FT++L
Sbjct:  238 VIERYSQFTQLL                                                  249
```

Based on this analysis, it was predicted that these proteins and their epitopes could be useful antigens for vaccines or diagnostics.

Example 496

A DNA sequence (GBSx0534) was identified in *S. agalactiae* <SEQ ID 1587> which encodes the amino acid sequence <SEQ ID 1588>. Analysis of this protein sequence reveals the following:

Possible site: 19
>>> Seems to have no N-terminal signal sequence
----- Final Results -----
   bacterial cytoplasm --- Certainty = 0.3436 (Affirmative) <succ>
      bacterial membrane --- Certainty = 0.0000 (Not Clear) <succ>
         bacterial outside --- Certainty = 0.0000 (Not Clear) <succ>

The protein has homology with the following sequences in the GENPEPT database:

```
>GP: AAD13797 GB: AF062533 unknown [Streptococcus agalactiae]
Identities = 86/371 (23%), Positives = 136/371 (36%), Gaps = 79/371 (21%)
Query:  11 DLSESELKAAQEFLSGKSEANQDKPKTGKTAQEIYEAIEPKAIVKPEDLLFGIAQATDYK       70
           DL++        + L K      D  TG         IEP+  V      L      AT Sbjct: 526 DLTQIAFAEQELMLKDKKHYRYDIVDTG---------IEPRLAVDVSSLPMHAGNATYDT      576

Query:  71 NGTFVIPHKDHYHYVELKWFDEEKDLLADSDKTYSLEDYLATAKYYMMHPEKRPKVEGWG      130
           +FVIPH DH H V  W    +                +AT KY M HPE RP V  W Sbjct: 577 GSSFVIPHIDHIHVVPYSWLTRNQ---------------IATIKYVMQHPEVRPDV--WS      619

Query: 131 KDAEIYKEKDSNKADKPSPAPTDNKSTSNSSDKNLSAAEVFKQAKPEKIVPLDKIAAHMA      190
           K        + + + P+  P D ++   +    SA EV    +K +   + AA Sbjct: 620 KPGH-----EESGSVIPNVTPLDKRAGMPNWQIIHSAEEV------QKALAEGRFAA---      665

Query: 191 YAVGFEDDQLIVPHHDHYHNVPMAWFDKGGLWKAPEGYTLQQLFST--IKYYMEHPNELP      248
                   D   I   D      W D          +G +L+ +  +  +   EL Sbjct: 666 ------PDGYIFDPRDVLAKETFVWKDGSFSIPRADGSSLRTINKSDLSQAEWQQAQELL      719

Query: 249 KEKGWGHDSDHNKGSNKDNKAKNYAPDEEPEDSGKVTHNYGFYDVNKGSDEEEP-EKQED      307
           +K  G  +D +K         P+E+ +             +K ++ ++P E  ++

Sbjct: 720 AKKNAGDATDTDK-----------PEEKQQ-------------ADKSNENQQPSEASKE      754

Query: 308 ESELDEYELGMAQNAKKYGMDRQSFEKQLIQLSNKYSVSFESFNYINGSQVQVTKKDGSK      367
           E E D++      +    YG+DR + E  + QL+ K ++       +       VQ   K+G Sbjct: 755 EKESDDF----IDSLPDYGLDRATLEDHINQLAQKANID-PKYLIFQPEGVQFYNKNGEL      809

Query: 368 VLVDIKTLTEV                                                378
           V DIKTL ++

Sbjct: 810 VTYDIKTLQQI                                                820
```

A related DNA sequence was identified in *S. agalactiae* <SEQ ID 6983> which encodes the amino acid sequence <SEQ ID 6984>. Analysis of this protein sequence reveals the following:

---

Possible site: 26
>>> Seems to have an uncleavable N-term signal seq
----- Final Results -----
   bacterial membrane --- Certainty = 0.0000 (Not Clear) <succ>
    bacterial outside --- Certainty = 0.0000 (Not Clear) <succ>
     bacterial cytoplasm --- Certainty = 0.0000 (Not Clear) <succ>

---

A related GBS gene <SEQ ID 8581> and protein <SEQ ID 8582> were also identified. Analysis of this protein sequence reveals the following:

---

Lipop Possible site: −1   Crend: 2
McG: Discrim Score: 6.06
GvH: Signal Score (−7.5): −5.61
Possible site: 26
>>> Seems to have an uncleavable N-term signal seq
ALOM program     count: 0  value: 2.23  threshold: 0.0

PERIPHERAL     Likelihood = 2.23     6
modified ALOM score: −0.95
*** Reasoning Step: 3
----- Final Results -----
   bacterial membrane --- Certainty = 0.0000 (Not Clear) <succ>
    bacterial outside --- Certainty = 0.0000 (Not Clear) <succ>
     bacterial cytoplasm --- Certainty = 0.0000 (Not Clear) <succ>

---

A related DNA sequence was identified in *S. pyogenes* <SEQ ID 1589> which encodes the amino acid sequence <SEQ ID 1590>. Analysis of this protein sequence reveals the following:

---

Possible site: 26
>>> Seems to have an uncleavable N-term signal seq
----- Final Results -----
   bacterial membrane --- Certainty = 0.0000 (Not Clear) <succ>
    bacterial outside --- Certainty = 0.0000 (Not Clear) <succ>
     bacterial cytoplasm --- Certainty = 0.0000 (Not Clear) <succ>

---

An alignment of the GAS and GBS proteins is shown below.

```
Identities = 808/825 (97%), Positives = 816/825 (97%), Gaps = 3/825 (0%)
Query:   2 KKTYGYIGSVAAILLATHIGSYQLGKHHMGLATKDNQIAYIDDSKGKVKAPKTNKTMDQ       60
           KKTYGYIGSVAAILLATHIGSYQLGKHHMG ATKDNQIAYIDDSKGK KAPKTNKTMDQ Sbjct:   2 KKTYGYIGSVAAILLATHIGSYQLGKHHMGSATKDNQIAYIDDSKGKAKAPKTNKTMDQ       60

Query:  61 ISAEEGISAEQIVVKITDQGYVISHGDHYHFYNGKVPYDAIISEELLMTDPNYHFKQSDV      120
           ISAEEGISAEQIVVKITDQGYV SHGDHYHFYNGKVPYDAIISEELLMTDPNY FKQSDV Sbjct:  61 ISAEEGISAEQIVVKITDQGYVTSHGDHYHFYNGKVPYDAIISEELLMTDPNYRFKQSDV      120
```

-continued

```
Query: 121 INEILDGYVIKVNGNYYVYLKPGSKRKNIRTKQQIAEQVAKGTKEAKEKGLAQVAHLSKE      180
            INEILDGYVIKVNGNYYVYLKPGSKRKNIRTKQQIAEQVAKGTKEAKEKGLAQVAHLSKE Sbjct: 121 INEILDGYVIKVNGNYYVYLKPGSKRKNIRTKQQIAEQVAKGTKEAKEKGLAQVAHLSKE      180

Query: 181 EVAAVNEAKRQGRYTTDDGYIFSPIDIIDDLGDAYLVPHGNHYHYIPKKDLSPSELAAAQ      240
            EVAAVNEA RQGRYTTDDGYIFSPIDIIDDLGDAYLVPHGNHYHYIPKKDLSPSELAAAQ Sbjct: 181 EVAAVNEARRQGRYTTDDGYIFSPIDIIDDLGDAYLVPHGNHYHYIPKKDLSPSELAAAQ      240

Query: 241 AYWSQKQGRGARPSDYRPTPAP--GRRKAPIPDVTPNPGQGHQPDNGGYHPAPPRPNDAS   298
            AYWSQKQGRGARPSDYRPTPAP  GRRKAPIPDVTPNPGQGHQPDNGGYHPAPPRPNDAS Sbjct: 241 AYWSQKQGRGARPSDYRPTPAPAPGRRKAPIPDVTPNPGQGHQPDNGGYHPAPPRPNDAS   300

Query: 299 QNKHQRDEFKGKTFKELLDQLHRLDLKYRHVEEDGLIFEPTQVIKSNAFGYVVPHGDHYH   358
            QNKHQRDEFKGKTFKELLDQLHRLDLKYRHVEEDGLIFEPTQVIKSNAFGYVVPHGDHYH Sbjct: 301 QNKHQRDEFKGKTFKELLDQLHRLDLKYRHVEEDGLIFEPTQVIKSNAFGYVVPHGDHYH   360

Query: 359 IIPRSQLSPLEMELADRYLAGQTDDNDSGSDHSKPSDKEVTHTFLGHRIKAYGKGLDGKP   418
            IIPRSQLSPLEMELADRYLAGQT+D+DSGSDHSKPSDKEVTHTFLGHRIKAYGKGLDGKP Sbjct: 361 IIPRSQLSPLEMELADRYLAGQTEDDDSGSDHSKPSDKEVTHTFLGHRIKAYGKGLDGKP   420

Query: 419 YDTSDAYVFSKESIHSVDKSGVTAKHGDHFHYIGFGELEQYELDEVANWVKAKGQADELV   478
            YDTSDAYVFSKESIHSVDKSGVTAKHGDHFHYIGFGELEQYELDEVANWVKAKGQADEL Sbjct: 421 YDTSDAYVFSKESIHSVDKSGVTAKHGDHFHYIGFGELEQYELDEVANWVKAKGQADELA   480

Query: 479 AALDQEQGKEKPLFDTKKVSRKVTKDGKVGYIMPKDGKDYFYARYQLDLTQIAFAEQELM   538
            AALDQEQGKEKPLFDTKKVSRKVTKDGKVGY+MPKDGKDYFYAR QLDLTQIAFAEQELM Sbjct: 481 AALDQEQGKEKPLFDTKKVSRKVTKDGKVGYMMPKDGKDYFYARDQLDLTQIAFAEQELM   540

Query: 539 LKDKKHYRYDIVDTGIEPRLAVDLSSLPMHAGNATYDTGSSFVIPHIDHIHVVPYSWLTR   598
            LKDKKHYRYDIVDTGIEPRLAVD+SSLPMHAGNATYDTGSSFVIPHIDHIHVVPYSWLTR Sbjct: 541 LKDKKHYRYDIVDTGIEPRLAVDVSSLPMHAGNATYDTGSSFVIPHIDHIHVVPYSWLTR   600

Query: 599 NQIATIKYVMQHPEVRPDVWSKPGHEESGSVIPNVTPLDKRAGMPNWQIIHSAEEVQKAL   658
            +QIATIKYVMQHPEVRPD+WSKPGHEESGSVIPNVTPLDKRAGMPNWQIIHSAEEVQKAL Sbjct: 601 DQIATIKYVMQHPEVRPDIWSKPGHEESGSVIPNVTPLDKRAGMPNWQIIHSAEEVQKAL   660

Query: 659 AEGRFAAPDGYIFDPRDVLAKETFVWKDGSFSIPRADGSSLRTINKSDLSQAEWQQAQEL   718
            AEGRFA PDGYIFDPRDVLAKETFVWKDGSFSIPRADGSSLRTINKSDLSQAEWQQAQEL Sbjct: 661 AEGRFATPDGYIFDPRDVLAKETFVWKDGSFSIPRADGSSLRTINKSDLSQAEWQQAQEL   720

Query: 719 LAKKNAGDATDTDKPEEKQQADKSNENQQPSEASK-EEKESDDFIDSLPDYGLDRATLED   777
            LAKKNAGDATDTDKP+EKQQADKSNENQQPSEASK EEKESDDFIDSLPDYGLDRATLED Sbjct: 721 LAKKNAGDATDTDKPKEKQQADKSNENQQPSEASKEEEKESDDFIDSLPDYGLDRATLED   780

Query: 778 HINQLAQKANIDPKYLIFQPEGVQFYNKNGELVTYDIKILQQINP   822
            HINQLAQKANIDPKYLIFQPEGVQFYNKNGELVTYDIK LQQINP Sbjct: 781 HINQLAQKANIDPKYLIFQPEGVQFYNKNGELVTYDIKTLQQINP   825
```

Figure 148:
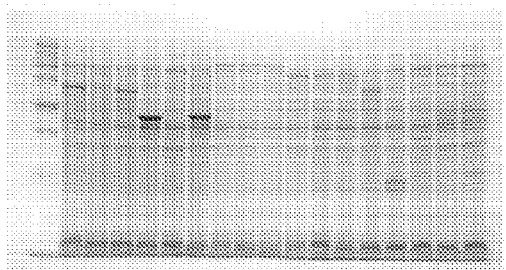
Figure 241:
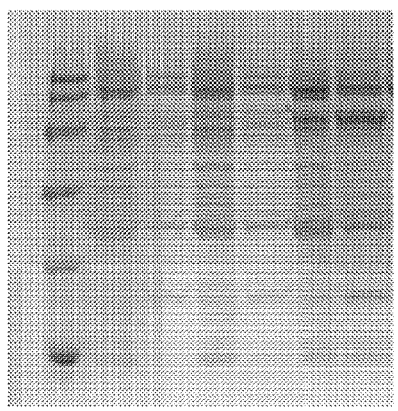

SEQ ID 8582 was expressed in *E. coli* in two different forms. GBS293dNterm was expressed in *E. coli* as a GST-fusion product. SDS-PAGE analysis of total cell extract is shown in FIG. 147 (lane 14; MW 74 kDa+lanes 17 & 18; MW 48.8 kDa). GBS293C was expressed in *E. coli* as a GST-fusion product. SDS-PAGE analysis of total cell extract is shown in FIGS. 148 (lane 2-4; MW 71 kDa+lanes 5 & 7; MW 46 kDa) and 182 (lane 7; MW 46 kDa). Purified GBS293C-His is shown in FIG. 241, lanes 8 & 9.

Based on this analysis, it was predicted that these proteins and their epitopes could be useful antigens for vaccines or diagnostics.

Example 497

A DNA sequence (GBSx0535) was identified in *S. agalactiae* <SEQ ID 1591> which encodes the amino acid sequence <SEQ ID 1592>. Analysis of this protein sequence reveals the following:

Possible site 23
>>> Seems to have a cleavable N-term signal seq.
----- Final Results -----
 bacterial outside --- Certainty = 0.3000 (Affirmative) <succ>
 bacterial membrane --- Certainty = 0.0000 (Not Clear) <succ>
  bacterial cytoplasm --- Certainty = 0.0000 (Not Clear) <succ>

The protein has homology with the following sequences in the GENPEPT database:

```
>GP: AAD13797 GB: AF062533 unknown [Streptococcus agalactiae]
Identities = 213/463 (46%), Positives = 277/463 (59%), Gaps = 41/463 (8%)
Query:    4 KKTV-IISALSVALFGTGVGAYQLGSYNA--QKSDNSVSYVKTDKSDSKAQATAVNKTPD      60
            KKT    I +++  L  T +G+YQLG ++         DN ++Y+  D S   K +A    NKT D Sbjct:    2 KKTYGYIGSVAAILLATHIGSYQLGKHHMGLATKDNQIAYI--DDSKGKVKAPKTNKTMD      59

Query:   61 QISKEEGISAEQIVVKITDDGYVTSHGDHYHYYNGKVPYDAIISEELIMKDPSYVFNKAD     120
            QIS EEGISAEQIVVKITD GYVTSHGDHYH+YNGKVPYDAIISEEL+M DP+Y F ++D Sbjct:   60 QISAEEGISAEQIVVKITDQGYVTSHGDHYHFYNGKVPYDAIISEELLMTDPNYHFKQSD     119

Query:  121 VINEVEDGYIIKVNGKYYLYLKEGSKRTNVRTKEQIQKQREEWSKGGSKGESGKHSSAKT     180
            VINE+  DGY+IKVNG YY+YLK GSKR N+RTK+QI +Q   +K     E+ +    A+

Sbjct:  120 VINEILDGYVIKVNGNYYVYLKPGSKRKNIRTKQQIAEQVAKGTK-----EAKEKGLAQV     174

Query:  181 QALS----ASVREAKASGRYTTDDGYVFSPTDVIDDMGDAFLVPHGDHFHYIPKADLSPS     236
                LS    A+V EAK  GRYTTDDGY+FSPTD+IDD+GDA+LVPHG+H+HYIPK DLSPS Sbjct:  175 AHLSKEEVAAVNEAKRQGRYTTDDGYIFSPTDIIDDLGDAYLVPHGNHYHYIPKKDLSPS     234

Query:  237 ELSAAQAYWNRKTGRSGNSS--KPSNSSSYIHASAPSGNVSTGRHANAPISIPRVTHANH     294
            EL+AAQAYW++K GR    S    +P+ +    A  P    + G+           H Sbjct:  235 ELAAAQAYWSQKQGRGARPSDYRPTPAPGRRKAPIPDVTPNPGQGHQPD------NGGYH     288

Query:  295 WSKPAGNHATAPKHHAPTTKPINKDSALDKMLKRLYAQPLYARHVESDGLVYDPAQVNAF     354
            + P  N A+  KH      +   K     ++L +L+     L  RHVE  DGL+++P QV Sbjct:  289 PAPPRPNDASQNKHQ----RDEFKGKTFKELLDQLHRLDLKYRHVEEDGLIFEPTQVIKS     344

Query:  355 TAIGVSIPHGNHFHFIHYKDMSPLELE-ATRMVAEHRGHHIDALGKKDSTEKPKHISHEP     413
              A G  +PHG+H+H  I    +SPLE+E A R  +A           G+   D  +    S Sbjct:  345 NAFGYVVPHGDHYHIIPRSQLSPLEMELADRYLA----------GQTDDNDSGSDHSKPS     394

Query:  414 NKE-PHTEEEHHAVTPKDQRKGKP---NSQIVYSAQEIEEAKK                  452
            +KE   HT   H               GKP    +  V+S +  I    K Sbjct:  395 DKEVTHTFLGHRIKAYGKGLDGKPYDTSDAYVFSKESIHSVDK                   437
```

There is also homology to SEQ ID 1590.

SEQ ID 1592 (GBS94) was expressed in *E. coli* as a His-fusion product. SDS-PAGE analysis of total cell extract is shown in FIG. 17 (lane 3; MW 52.5 kDa).

Figure 194:
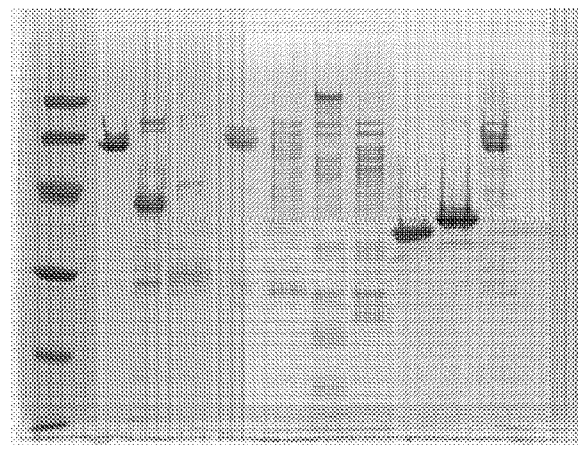

GBS94-His was purified as shown in FIG. 194, lane 8.

Based on this analysis, it was predicted that this protein and its epitopes, could be useful antigens for vaccines or diagnostics.

Example 498

A DNA sequence (GBSx0536) was identified in *S. agalactiae* <SEQ ID 1593> which encodes the amino acid sequence <SEQ ID 1594>. This protein is predicted to be Lmb. Analysis of this protein sequence reveals the following:

Possible site: 24
>>> May be a lipoprotein
----- Final Results -----
  bacterial membrane --- Certainty = 0.0000 (Not Clear) <succ>
    bacterial outside --- Certainty = 0.0000 (Not Clear) <succ>
      bacterial cytoplasm --- Certainty = 0.0000 (Not Clear) <succ>

There is also homology to SEQ IDs 1596 and 5548.

A related GBS gene <SEQ ID 8583> and protein <SEQ ID 8584> were also identified. Analysis of this protein sequence reveals the following:

Lipop: Possible site: 22    Crend: 5
McG: Discrim Score: 13.64
GvH: Signal Score (−7.5): −5.75
Possible site: 24
>>> May be a lipoprotein
ALOM program         count: 0  value: 4.83         threshold: 0.0
PERIPHERAL           Likelihood = 4.83             33
modified ALOM score: −1.47
----- Final Results -----
  bacterial membrane --- Certainty = 0.0000 (Not Clear) <succ>
    bacterial outside --- Certainty = 0.0000 (Not Clear) <succ>
      bacterial cytoplasm --- Certainty = 0.0000 (Not Clear) <succ>

SEQ ID 8584 (GBS22) was expressed in *E. coli* as a His-fusion product. SDS-PAGE analysis of total cell extract is shown in FIG. 14 (lane 6; MW 35 kDa).

The GBS22-His fusion product was purified (FIG. 94A; see also FIG. 193, lane 4) and used to immunise mice (lane 2 product; 20 µg/mouse). The resulting antiserum was used for Western blot (FIG. 94B), FACS (FIG. 94C), and in the in vivo passive protection assay (Table III). These tests confirm that the protein is immunoaccessible on GBS bacteria and that it is an effective protective immunogen.

Figure 183:
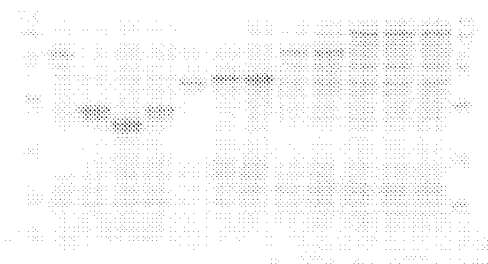

SEQ ID 8584 (GB S22) was expressed in *E. coli* as a His-fusion product. SDS-PAGE analysis of total cell extract is shown in FIG. 183 (lane 7 & 8; MW 35 kDa).

Based on this analysis, it was predicted that these proteins and their epitopes could be useful antigens for vaccines or diagnostics.

Example 499

A DNA sequence (GBSx0537) was identified in *S. agalactiae* <SEQ ID 1597> which encodes the amino acid sequence <SEQ ID 1598>. Analysis of this protein sequence reveals the following:

```
Possible site: 39
>>> Seems to have no N-terminal signal sequence
INTEGRAL     Likelihood = -0.59    Transmembrane 19-35 (19-35)
----- Final Results -----
   bacterial membrane --- Certainty = 0.1235 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the GENPEPT database:

```
>GP: CAA51352 GB: X72832 ORF1 [Streptococcus equisimilis]
Identities = 104/145 (71%), Positives = 126/145 (86%)
Query:   1 MKIIIQRVNQASVSIEDDVVGSIEKGLVLLVGIAPEDTTEDIAYAVRKITSMRIFSDDEG       60
           MK+++QRV +ASVSI+   + G+I +GL+LLVG+ P+D  ED+AYAVRKI +MRIFSD +G Sbjct:   1 MKLVLQRWEASVSIDGKIAGAINQGLLILLVGVGPDDAAEDLAYAVRKIVNMRIFSDADG       60

Query:  61 KMNLSIQDIKGSVLSISQFTLFADTKKGNRPAFTGAADPVKANQFYDIFNQELANHVSVE     120
           KMN SIQDIKGS+LS+SQFTL+ADTKKGNRPAFTGAA P   A+QFYD FN++LA+ V VE Sbjct:  61 KMNQSIQDIKGSILSVSQFTLYADTKKGNRPAFTGAAKPDMASQFYDRFNEQLADFVPVE     120

Query: 121 TGQFGADMQVSLINDGPVTIVLDTK                                         145
           G FGADMQVSLINDGPVTI+LDTK Sbjct: 121 RGVFGADMQVSLINDGPVTIILDTK                                         145
```

A related DNA sequence was identified in *S. pyogenes* <SEQ ID 1599> which encodes the amino acid sequence <SEQ ID 1600>. Analysis of this protein sequence reveals the following:

```
Possible site: 39
>>> Seems to have no N-terminal signal sequence
----- Final Results -----
   bacterial cytoplasm --- Certainty = 0.1430 (Affirmative) <succ>
     bacterial membrane --- Certainty = 0.0000 (Not Clear) <succ>
       bacterial outside --- Certainty = 0.0000 (Not Clear) <succ>
```

An alignment of the GAS and GBS proteins is shown below:

```
Identities = 103/145 (71%), Positives = 124/145 (85%)
Query:   1 MKIIIQRVNQASVSIEDDVVGSIEKGLVLLVGIAPEDTTEDIAYAVRKITSMRIFSDDEG       60
           MK+++QRV +ASVSI+   + G+I +GL+LLVG+ P+D  ED+AYAVRKI +MRIFSD +G Sbjct:   1 MKLVLQRVKEASVSIDGKIAGAINQGLLLLVGVGPDDNAEDLAYAVRKIVNMRIFSDADG       60

Query:  61 KMNLSIQDIKGSVLSISQFTLFADTKKGNRPAFTGAADPVKANQFYDIFNQELANHVSVE     120
           KMN SIQDIKGS+LS+SQFTL+ADTKKGNRPAFTGAA P   A+Q YD FN++LA  V VE Sbjct:  61 KMNQSIQDIKGSILSVSQFTLYADTKKGNRPAFTGAAKPDLASQLYDSFNEQLAEFVPVE     120

Query: 121 TGQFGADMQVSLINDGPVTIVLDTK                                         145
           G FGADMQVSLINDGPVTI+LDTK Sbjct: 121 RGVFGADMQVSLINDGPVTIILDTK                                         145
```

Figure 70:
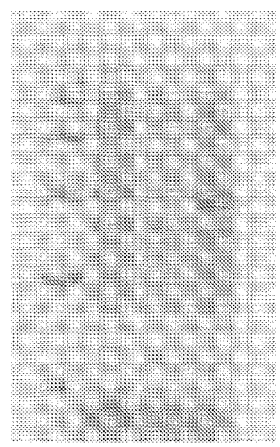

SEQ ID 1598 (GBS368) was expressed in *E. coli* as a His-fusion product. SDS-PAGE analysis of total cell extract is shown in FIG. 64 (lane 4; MW 20 kDa). It was also expressed in *E. coli* as a GST-fusion product. SDS-PAGE analysis of total cell extract is shown in FIG. 70 (lane 4; MW 45 kDa).

GBS368-GST was purified as shown in FIG. 215, lane 6.

Based on this analysis, it was predicted that these proteins and their epitopes could be useful antigens for vaccines or diagnostics.

Example 500

A DNA sequence (GBSx0538) was identified in *S. agalactiae* <SEQ ID 1601> which encodes the amino acid sequence <SEQ ID 1602>. This protein is predicted to be stringent response-like protein (rel) (relA). Analysis of this protein sequence reveals the following:

```
Possible site: 37
>>> Seems to have no N-terminal signal sequence
INTEGRAL     Likelihood = -0.32    Transmembrane 60-76 (60-76)
----- Final Results -----
   bacterial membrane --- Certainty = 0.1128 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the GENPEPT database:

>GP: CAA51353 GB: X72832 stringent response-like protein
[*Streptococcus equisimilis*]
Identities = 647/739 (87%), Positives = 696/739 (93%), Gaps = 1/739 (0%)

```
Query:   1 MVKEINLTGEEVVAITSQYMSETDVAFVKFALNYATAAHYYQARKSGEPYIIHPIQVAGI      60
           M KEINLTGEEVVA+ ++YM+ETD AFVK AL+YATAAH+YQ RKSGEPYI+HPIQVAGI
Sbjct:   1 MAKEINLTGEEVVALAAKYMNETDAAFVKKALDYATAAHFYQVRKSGEPYIVHPIQVAGI      60

Query:  61 LADLHLDAVTVACGFLHDVVEDTEITLDEIETDFGKDVRDIIDGVTKLGKVEYKSHEEQL     120
           LADLHLDAVTVACGFLHDVVEDT+ITLD IE DFGKDVRDI+DGVTKLGKVEYKSHEEQL
Sbjct:  61 LADLHLDAVTVACGFLHDVVEDTDITLDNIEFDFGKDVRDIVDGVTKLGKVEYKSHEEQL     120

Query: 121 AENHRKMLMAMSKDIRVILVKLADRLHNMRTLKHLRKDKQERISRETMEIYAPLAHRLGI     180
           AENHRKMLMAMSKDIRVILVKLADRLHNMRTLKHLRKDKQERISRETMEIYAPLAHRLGI
Sbjct: 121 AENHRKMLMAMSKDIRVILVKLADRLHNMRTLKHLRKDKQERISRETMEIYAPLAHRLGI     180

Query: 181 SRIKWELEDLSFRYLNETEFYKISHMMSEKRREREELVDIIVDKIRSYTEEQGLYGDIYG     240
           SRIKWELEDL/FRYLNETEFYKISHMM/EKRRERE LVD IV KI+SYT EQGL+GD+YG
Sbjct: 181 SRIKWELEDLAFRYLNETEFYKISHMMNEKRREREALVDDIVTKIKSYTTEQGLFGDVYG     240

Query: 241 RPKHIYSIYRKMRDKKKRFDQIYDLIAIRCIMETASDVYAMVGYIHELWRPMPGRFKDYI     300
           RPKHIYSIYRKMRDKKKRFDQI+DLIAIRC+MET SDVYAMVGYIHELWRPMPGRFKDYI
Sbjct: 241 RPKHIYSIYRKMRDKKKRFDQIFDLIAIRCVMETQSDVYAMVGYIHELWRPMPGRFKDYI     300

Query: 301 AAPKANGYQSIHTTVYGPKGPIEIQIRTKEMHQVAEFGVAAHWAYKKGITSKVNQAEQSV     360
           AAPKANGYQSIHTTVYGPKGPIEIQIRTKEMHQVAE+GVAAHWAYKKG+  KVNQAEQ V
Sbjct: 301 AAPKANGYQSIHTTVYGPKGPIEIQIRTKEMHQVAEYGVAAHWAYKKGVRGKVNQAEQKV     360

Query: 361 GMGWIQELVELQDESK-DAKDFVDSVKEDIFTERIYVETPNGAVQELPRESGPIDFAYAI     419
           GM WI+ELVELQD S  DA DFVDSVKEDIF+ERIYVFTP GAVQELP++SGPIDFAYAI
Sbjct: 361 GMNWIKELVELQDASNGDAVDFVDSVKEDIFSERIYVFTPTGAVQELPKDSGPIDFAYAI     420

Query: 420 HTQVGEKATGAKVNGRMVPLTAKLKTGDVVEIITNPNSFGPSRDWIKIVKTNKARNKIRQ     479
           HTQVGEKA GAKVNGRMVPLTAKLKTGDVVEI+TNPNSFGPSRDWIK+VKTNKARNKIRQ
Sbjct: 421 HTQVGEKAIGAKVNGRMVPLTAKLKTGDVVEIVTNPNSFGPSRDWIKLVKTNKARNKIRQ     480

Query: 480 FFKNQDKETSINKGRELLVDYFQEQGYVPNKYLDKKHIEEILPRVSVKSEEALYAAVGFG     539
           FFKNQDKE S+NKGR++LV YFQEQGYV NKYLDKK IE ILP+VSVKSEE LYAAVGFG
Sbjct: 481 FFKNQDKELSVNKGRDMLVSYFQEQGYVANKYLDKKRIEAILPKVSVKSEESLYAAVGFG     540

Query: 540 DLSPISIFNKLTEKERREEERAKAKAEADELINGGEIKTDKRDVLKVKSENGVIIQGASG     599
           D+SP+S+FNKLTEKERREEERAKAKAEA+EL+NGGEIK + +DVLKV+SENGVIIQGASG
Sbjct: 541 DISPVSVFNKLTEKERREEERAKAKAEAEELVNGGEIKHENKDVLKVRSENGVIIQGASG     600

Query: 600 LLMRIAKCCNPVPGDLIEGYITKGRGVAIHRSDCQNLKSQENYEQRLIDVEWDDDGSKKE     659
           LLMRIAKCCNPVPGD IEGYITKGRG+AIHR+DC N+KSQ+ Y++RLI+VEWD D S K+
Sbjct: 601 LLMRIAKCCNPVPGDPIEGYITKGRGIAIHRADCNNIKSQDGYQERLIEVEWDLDNSSKD     660

Query: 660 YMAEIDIYGLNRSGLLNDVLQTLSNATKLVSTVNAQPTKDMKFANIHVSEGISNLAQLTT     719
           Y AEIDIYGLNR GLLNDVLQ LSN+TK +STVNAQPTKDMKFANIHVSFGI NL  LTT
Sbjct: 661 YQAEIDIYGLNRRGLLNDVLQILSNSTKSISTVNAQPTKDMKFANIHVSFGIPNLTHLTT     720

Query: 720 VVDKIKIIPDVYSVKRTNG     738
           VV+KIK +PDVYSVKRTNG
Sbjct: 721 VVEKIKAVPDVYSVKRTNG     739
```

A related DNA sequence was identified in *S. pyogenes* <SEQ ID 1603> which encodes the amino acid sequence <SEQ ID 1604>. Analysis of this protein sequence reveals the following:

Possible site: 41
>>> Seems to have no N-terminal signal sequence

INTEGRAL    Likelihood = −0.32    Transmembrane 64-80 (64-80)
----- Final Results -----
  bacterial membrane --- Certainty = 0.1128 (Affirmative) <succ>
   bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP: CAA51353 GB: X72832 stringent response-like protein
[Streptococcus equisimilis]
Identities = 700/739 (94%), Positives = 721/739 (96%)
Query:    5 MAKIMNVTGEEVIALAATYMTKADVAFVAKALAYATAAHFYQVRKSGEPYIVHPIQVAGI      64
            MAK +N/TGEEV+ALAA YM + D AFV KAL YATAAHFYQVRKSGEPYIVHPIQVAGI Sbjct:    1 MAKEINLTGEEVVALAAKYMNETDAAFVKKALDYATAAHFYQVRKSGEPYIVHPIQVAGI     60

Query:   65 LADLHLDAVTVACGFLHDVVEDTDITLDEIEADFGHDARDIVDGVTKLGEVEYKSHEEQL    124
            LADLHLDAVTVACGFLHDVVEDTDITLD IE DFG D RDIVDGVTKLG+VEYKSHEEQL Sbjct:   61 LADLHLDAVTVACGFLHDVVEDTDITLDNIEFDFGKDVRDIVDGVTKLGKVEYKSHEEQL    120

Query:  125 AENHRKMLMAMSKDIRVILVKLADRLHNMRTLKHLRKDKQERISRETMEIYAPLAHRLGI    184
            AENHRKMLMAMSKDIRVILVKLADRLHNMRTLKHLRKDKQERISRETMEIYAPLAHRLGI Sbjct:  121 AENHRKMLMAMSKDIRVILVKLADRLHNMRTLKHLRKDKQERISRETMEIYAPLAHRLGI    180

Query:  185 SRIKWELEDLAFRYLNETEFYKISHMMKEKRREREALVEAIVSKVKTYTTQQGLFGDVYG    244
            SRIKWELEDLAFRYLNETEFYKISHMM EKRREREALV+ IV+K+K+YTT+QGLFGDVYG Sbjct:  181 SRIKWELEDLAFRYLNETEFYKISHMMNEKRREREALVDDIVTKIKSYTTEQGLFGDVYG    240

Query:  245 RPKHIYSIYRKMRDKKKRFDQIFDLIAIRCVMETQSDVYAMVGYIHELWRPMPGRFKDYI    304
            RPKHIYSIYRKMRDKKKRFDQIFDLIAIRCVMETQSDVYAMVGYIHELWRPMPGRFKDYI Sbjct:  241 RPKHIYSIYRKMRDKKKRFDQIFDLIAIRCVMETQSDVYAMVGYIHELWRPMPGRFKDYI    300

Query:  305 AAPKANGYQSIHTTVYGPKGPIEIQIRTKDMHQVAEYGVAAHWAYKKGVRGKVNQAEQAV    364
            AAPKANGYQSIHTTVYGPKGPIEIQIRTK+MHQVAEYGVAAHWAYKKGVRGKVNQAEQ V Sbjct:  301 AAPKANGYQSIHTTVYGPKGPIEIQIRTKEMHQVAEYGVAAHWAYKKGVRGKVNQAEQKV    360

Query:  365 GMNWIKELVELQDASNGDAVDFVDSVKEDIFSERIYVFTPTGAVQELPKESGPIDFAYAI    424
            GMNWIKELVELQDASNGDAVDFVDSVKEDIFSERIYVFTPTGAVQELPK+SGPIDFAYAI Sbjct:  361 GMNWIKELVELQDASNGDAVDFVDSVKEDIFSERIYVFTPTGAVQELPKDSGPIDFAYAI    420

Query:  425 HTQIGEKATGAKVNGRMVPLTAKLKTGDVVEIITNANSFGPSRDWVKLVKTNKARNKIRQ    484
            HTQ+GEKA GAKVNGRMVPLTAKLKTGDVVEI+TN NSFGPSRDW+KLVKTNKARNKIRQ Sbjct:  421 HTQVGEKAIGAKVNGRMVPLTAKLKTGDVVEIVTNPNSFGPSRDWIKLVKTNKARNKIRQ    480

Query:  485 FFKNQDKELSVNKGRDLLVSYFQEQGYVANKYLDKKRIEAILPKVSVKSEESLYAAVGFG    544
            FFKNQDKELSVNKGRD+LVSYFQEQGYVANKYLDKKRIEAILPKVSVKSEESLYAAVGFG Sbjct:  481 FFKNQDKELSVNKGRDMLVSYFQEQGYVANKYLDKKRIEAILPKVSVKSEESLYAAVGFG    540

Query:  545 DISPISVFNKLTEKERREEERAKAKAEAEELVKGGEVKHENKDVLKVRSENGVIIQGASG    604
            DISP+SVFNKLTEKERREEERAKAKAEAEELV GGE+KHENKDVLKVRSENGVIIQGASG Sbjct:  541 DISPVSVFNKLTEKERREEERAKAKAEAEELVNGGEIKHENKDVLKVRSENGVIIQGASG    600

Query:  605 LLMRIAKCCNPVPGDPIDGYITKGRGIAIHRSDCHNIKSQDGYQERLIEVEWDLDNSSKD    664
            LLMRIAKCCNPVPGDPI+GYITKGRGIAIHR+DC+NIKSQDGYQERLIEVEWDLDNSSKD Sbjct:  601 LLMRIAKCCNPVPGDPIEGYITKGRGIAIHRADCNNIKSQDGYQERLIEVEWDLDNSSKD    660

Query:  665 YQAEIDIYGLNRSGLLNDVLQILSNSTKSISTVNAQPTKDMKFANIHVSFGIPNLTHLTT    724
            YQAEIDIYGLNR GLLNDVLQILSNSTKSISTVNAQPTKDMKFANIHVSFGIPNLTHLTT Sbjct:  661 YQAEIDIYGLNRRGLLNDVLQILSNSTKSISTVNAQPTKDMKFANIHVSFGIPNLTHLTT    720

Query:  725 VVEKIKAVPDVYSVKRTNG                                            743
            VVEKIKAVPDVYSVKRTNG Sbjct:  721 VVEKIKAVPDVYSVKRTNG                                            739
```

An alignment of the GAS and GBS proteins is shown below:

```
Identities = 635/739 (85%), Positives = 691/739 (92%), Gaps = 1/739 (0%)
Query:    1 MVKEINLTGEEVVAITSQYMSETDVAFVKFALNYATAAHYYQARKSGEPYIIHPIQVAGI    60
            M K +N+TGEEV+A+ + YM++ DVAFV  AL YATAAH+YQ RKSGEPYI+HPIQVAGI Sbjct:    5 MAKIMNVTGEEVIALAATYMTKADVAFVAKALAYATAAHFYQVRKSGEPYIVHPIQVAGI    64

Query:   61 LADLHLDAVTVACGFLHDVVEDTEITLDEIETDEGKDVRDIIDGVTKLGKVEYKSHEEQL   120
```

-continued

```
              LADLHLDAVTVACGFLHDVVEDT+ITLDEIE DFG D RDI+DGVTKLG+VEYKSHEEQL
Sbjct:   65 LADLHLDAVTVACGFLHDVVEDTDITLDEIEADFGHDARDIVDGVTKLGEVEYKSHEEQL           124

Query:  121 AENHRKMLMAMSKDIRVILVKLADRLHNMRTLKHLRKDKQERISRETMEIYAPLAHRLGI           180
            AENHRKMLMAMSKDIRVILVKLADRLHNMRTLKHLRKDKQERISRETMEIYAPLAHRLGI
Sbjct:  125 AENHRKMLMAMSKDIRVILVKLADRLHNMRTLKHLRKDKQERISRETMEIYAPLAHRLGI           184

Query:  181 SRIKWELEDLSFRYLNETEFYKISHMMSEKRREREELVDIIVDKIRSYTEEQGLYGDIYG           240
            SRIKWELEDL+FRYLEETEFYKISHMM EKRRERE LV+ IV K+++YT +QGL+GD+YG
Sbjct:  185 SRIKWELEDLAFRYLNETEFYKISHMMKEKRREREALVEAIVSKVKTYTTQQGLFGDVYG           244

Query:  241 RPKHIYSIYRKMRDKKKRFDQIYDLIAIRCIMETASDVYAMVGYIHELWRPMPGRFKDYI           300
            RPKHIYSIYRKMRDKKKRFDQI+DLIAIRC+MET SDVYAMVGYIHELWRPMPGRFKDYI
Sbjct:  245 RPKHIYSIYRKMRDKKKRFDQIFDLIAIRCVMETQSDVYAMVGYIHELWRPMPGRFKDYI           304

Query:  301 AAPKANGYQSIHTTVYGPKGPIEIQIRTKEMHQVAEFGVAAHWAYKKGITSKVNQAEQSV           360
            AAPKANGYQSIHTTVYGPKGPIEIQIRTK+MHQVAE+GVAAHWAYKKG+  KVNQAEQ+V
Sbjct:  305 AAPKANGYQSIHTTVYGPKGPIEIQIRTKDMHQVAEYGVAAHWAYKKGVRGKVNQAEQAV           364

Query:  361 GMGWIQELVELQDESK-DAKDFVDSVKEDIFTERIYVFTPNGAVQELPRESGPIDFAYAI           419
            GM WI+ELVELQD S  DA DFVDSVKEDIF+ERIYVFTP GAVQELP+ESGPIDFAYAI
Sbjct:  365 GMNWIKELVELQDASNGDAVDFVDSVKEDIFSERIYVFTPTGAVQELPKESGPIDFAYAI           424

Query:  420 HTQVGEKATGAKVNGRMVPLTAKLKTGDVVEIITNPNSFGPSRDWIKIVKTNKARNKIRQ           479
            HTQ+GEKATGAKVNGRMVPLTAKLKTGDVVEIITN NSFGPSRDW+K+VKTNKARNKIRQ
Sbjct:  425 HTQIGEKATGAKVNGRMVPLTAKLKTGDVVEIITNANSFGPSRDWVKLVKTNKARNKIRQ           484

Query:  480 FFKNQDKETSINKGRELLVDYFQEQGYVPNKYLDKKHIEEILPRVSVKSEEALYAAVGFG           539
            FFKNQDKE S+NKGR+LLV YFQEQGYV NKYLDKK IE ILP+VSVKSEE+LYAAVGFG
Sbjct:  485 FFKNQDKELSVNKGRDLLVSYFQEQGYVANKYLDKKRIEAILPKVSVKSEESLYAAVGFG           544

Query:  540 DLSPISIFNKLTEKERREEERAKAKAEADELINGGEIKTDKRDVLKVKSENGVIIQGASG           599
            D+SPIS+FNKLTEKERREEERAKAKAEA+EL+ GGE+K + +DVLKV+SENGVIIQGASG
Sbjct:  545 DISPISVFNKLTEKERREEERAKAKAEAEELVKGGEVKHENKDVLKVRSENGVIIQGASG           604

Query:  600 LLMRIAKCCNPVPGDLIEGYITKGRGVAIHRSDCQNLKSQENYEQRLIDVEWDDDGSKKE           659
            LLMRIAKCCNPVPGD I+GYITKGRG+AIHRSDC N+KSQ+ Y++RLI+VEWD D S K+
Sbjct:  605 LLMRIAKCCNPVPGDPIDGYITKGRGIAIHRSDCHNIKSQDGYQERLIEVEWDLDNSSKD           664

Query:  660 YMAEIDIYGLNRSGLLNDVLQTLSNATKLVSTVNAQPTKDMKFANIHVSFGISNLAQLTT           719
            Y AEIDIYGLNRSGLLNDVLQ LSN+TK +STVNAQPTKDMKFANIHVSFGI NL  LTT
Sbjct:  665 YQAEIDIYGLNRSGLLNDVLQILSNSTKSISTVNAQPTKDMKFANIHVSFGIPNLTHLTT           724

Query:  720 VVDKIKIIPDVYSVKRTNG                                                    738
            VV+KIK +PDVYSVKRTNG
Sbjct:  725 VVEKIKAVPDVYSVKRTNG                                                    743
```

Based on this analysis, it was predicted that these proteins and their epitopes could be useful antigens for vaccines or diagnostics.

Example 501

A DNA sequence (GBSx0539) was identified in *S. agalactiae* <SEQ ID 1605> which encodes the amino acid sequence <SEQ ID 1606>. This protein is predicted to be 2',3'-cyclic-nucleotide 2'-phosphodiesterase precursor (cpdB). Analysis of this protein sequence reveals the following:

Possible site: 28
>>> Seems to have a cleavable N-term signal seq.
INTEGRAL    Likelihood = −5.79    Transmembrane 779-795 (778-797)
----- Final Results -----
   bacterial membrane --- Certainty = 0.3314 (Affirmative) <succ>
     bacterial outside --- Certainty = 0.0000 (Not Clear) <succ>
     bacterial cytoplasm --- Certainty = 0.0000 (Not Clear) <succ>

The protein has homology with the following sequences in the GENPEPT database:

```
>GP: CAB12613 GB: Z99108 similar to 2',3'-cyclic-nucleotide
2'-phosphodiesterase [Bacillus subtilis]
Identities = 297/630 (47%), Positives = 419/630 (66%), Gaps = 21/630 (3%)
Query:   102 KVDLRIMSTTDLHTNLVNYDYYQDKESQKIGLAKTAVLIEEAKKENPNTVLVDNGDVIQG           161
             +V L I++TTD+H N+++YDYY DKE+   GLA+TA LI++ +++NPNT+LVDNGD+IQG
```

```
-continued

Sbjct:   42  QVHLSILATTDIHANMMDYDYYSDKETADFGLARTAQLIQKHREQNPNTLLVDNGDLIQG   101

Query:  162  TPLGTYKAIVKP---VAENEEHPMYQAMNALGYDASTLGNHEFNYGLDYLKKIIATANLP   218
             PLG Y    +   ++ + HP+  MNAL YDA TLGNHEFNYGLD+L   I A+ P
Sbjct:  102  NPLGEYAVKYQKDDIISGTKTHPIISVMNALKYDAGTLGNHEFNYGLDFLDGTIKGADFP   161

Query:  219  ILNANVLDEKTHQPVFKTYDIITKTFKDSTGRAVALNIGITGIVPPQILNWDKANLEGKV   278
             I+NANV   + +  + Y I KT  D  G   + +G  G VPPQI+ WDK NLEG+V
Sbjct:  162  IVNANVKT-TSGENRYTPYVINEKTLIDENGNEQKVKVGYIGFVPPQIMTWDKKNLEGQV   220

Query:  279  IVKDSVKAIEEIVPTMRAKGADVILVLSHSGIGDDRYEEGEENVGYQIAS-IKGVDAVVT   337
              V+D V++  E +P M+A+GADVI+ L+H+GI    G EN +  +A+  KG+DA+++
Sbjct:  221  QVQDIVESANETIPKMKAEGADVIIALAHTGIEKQAQSSGAENAVFDLATKTKGIDAIIS   280

Query:  338  GHSHAEFPSGNTGFYEKYTGVDGIN---GKINGTPVTMAGKYGDHLGIIDLGLSYTNGK   394
             GH H  FPS      +Y GV  N    G ING PV M  +G  LG+IDL L   +G
Sbjct:  281  GHQHGLFPSA-------EYAGVAQFNVEKGTINGIPVVMPSSWGKYLGVIDLKLEKADGS   333

Query:  395  WQVSESSAKIRKIDMNSTTADERIIALAKEAHDGTINYVRQQVGTTTAPITSYFALVKDD   454
             W+V++S   I  I  N T+ +E +   ++ H T+ YVR+ VG T A I S+FA VKDD
Sbjct:  334  WKVADSKGSIESIAGNVTSRNETVTNTIQQTHQNTLEYVRKPVGKTEADINSFFAQVKDD   393

Query:  455  PSVQIVNNAQRWYVANELKGTPEANLPLLSAAAPFKAGIRGDATAYTDIPAGPVAIKNVA   514
             PS+QIV +AQ+WY  E+K T   NLP+LSA APFKAG R A  YT+IPAG +AIKNV
Sbjct:  394  PSIQIVTDAQKWYAEKEMKDTEYKNLPILSAGAPFKAGGRNGANYYTNIPAGDLAIKNVG   453

Query:  515  DLYLIDNVTALLKVTGADLREWLEMSAGQFNQIDPNNKAPQNIINTEYRTYNEDVIDGLT   574
             DLYL DN  ++K+TG+++++WLEMSAGQFNQIDP   Q ++N  +R+YNFDVIDG+T
Sbjct:  454  DLYLYDNTVQIVKLTGSEVKDWLEMSAGQFNQIDPAKGGDQALLNENFRSYNFDVIDGVT   513

Query:  575  YKFDITQPNKYNKDGKVVNSQASRVRDLMYNGKPVADKQEFMIVTNNYRASGTFPGAKNA   634
             Y+ D+T+P KYN++GKV+N+ +SR+ L Y GKP+   QEF++VTNNYRASG G +
Sbjct:  514  YQVDVTKPAKYNENGKVINADSSRIINLSYEGKPISPSQEFLVVTNNYRASGG-GGFPHL   572

Query:  635  TMNRLLN---LENRQTIINYIISEKTINPTADNNWGFTESIKDLDLRFQTADKAKNLVTN   691
             T +++++   +ENRQ +++YII +KT+NP ADNNW        +L F+++  AK
Sbjct:  573  TSDKIVHGSAVENRQVLMDYIIEQKTVNPKADNNWSIA-PVSGTNLTFESSLLAKPFADK   631

Query:  692  SKDIQYIASSTKDEGFGDYRFVYTEQEKVD   721
             + D+ Y+ S  +EG+G Y+ + +    D
Sbjct:  632  ADDVAYVGKSA-NEGYGVYKLQFDDDSNPD   660

Identities = 133/567 (23%), Positives = 214/567 (37%), Gaps = 147/567 (25%)
Query:  104  DLRIMSTTDLHTNLVNYDYYQDKESQKIGLAKTAVLIEEAKKENPNTVLVDNGDVIQGTP   163
             DL +M T D H +L +            A+   IE E +  +L+D GDV G
Sbjct:  668  DLTVMHTNDTHAHLDD-------------AARRMTKINEVRSETNHNILLDAGDVFSGD-   713

Query:  164  LGTYKAIVKPVAENEEHPMYQAMNALGYDASTLGNHEFNYG----LDYLKKIIATAN---   216
                  Y  +A+    + MN +GYDA T GNHEF+ G     D+L   AT +
Sbjct:  714  --LYFTKWNGLAD------LKMMNMMGYDAMTFGNHEFDKGPTVLSDFLSGNSATVDPAN   765

Query:  217  --------LPILNANVLDFKTHQPVFKTYDIITKTF----KDSTGRAVALNIGITG--IV   262
                     PI++ANV   +++P K++  +TF      K G   + + G +
Sbjct:  766  RYHFEAPEFPIVSANV--DVSNEPKLKSFVKKPQTFTAGEKKEAGIHPYILLDVDGEKVA   823

Query:  263  PPQILNWDKANLE--GKVIV--------KDSVKAIEEIVPTMRAKGADVILVLSHSGIGD   312
              +   D A    GK IV        +++VKAI+E   +   I+ L+H G
Sbjct:  824  VFGLTTEDTATTSSPGKSIVFNDAFETAQNTVYAIQE------EEKVNKIIALTHIG---   874

Query:  313  DRYEEGEENVGYQIA-SIKGVDAVVTGHSHAEFPSGNTGFYEKYTGVDGINGKINGTP-   370
                     N  ++A  +KG+D ++ GH+H                T VD +   N P
Sbjct:  875  -------HNRDLELAKKVKGIDLIIGGHTH----------------TLVDKMEVVNNEEPT   912

Query:  371  -VTMAGKYGDHLGIIDLGLSYTNGKWQVSESSAKIRKIDMNSTTADERIIALANEAHDGT   429
              V A +YG LG +D+      G Q +S+ +  ID ++   E    AK+  D
```

```
Sbjct:  913  IVAQAKEYGQFLGRVDVAFD-EKGVVQTDKSNLSVLPIDEHTEENPE-----AKQELDQF     966

Query:  430  INYV----RQQVGTTTAPITSYFALVKDDPSVQIVNNAQRWYVANELKGTPEANLPLLSA     485
                N +     ++VG T              +  + QR +V +          + A Sbjct:  967  KNELEDVKNEKVGYT----------------DVALDGQREHVRTKETNLGNFIADGMLA    1009

Query:  486  AAPFKAGTRGDAT----AYTDIPAGPVAIKNVADLYLYDNVTALLKVTGADLREWLEMSA     541
                A    AG R   T        I  G ++  V ++  + N   +  +TG  ++E LE Sbjct: 1010  KAKEAAGARIAITNGGGIRAGIDKGDITLGEVLNVMPFGNTLYVADLTGKQIKEALE---    1066

Query:  542  GQFNQIDPNNKAPQNIINTEYRTYNFDVIDGLTYKFDITQPNKYNKDGKVVNSQASRVRD     601
                    Q + N E       F  + G+ Y F +      NK G       +   V+

Sbjct: 1067  -------------QGLSNVENGGGAFPQVAGIEYTFTLN-----NKPG----HRVLEVKI    1104

Query:  602  LMYNGKPVADKQE--FMIVTNNYRASG                                    626
                  NG   VA    +  + +  TNN+  +G Sbjct: 1105  ESPNGDKVAINTDDTYRVATNNFVGAG                                   1131
```

There is also homology to SEQ ID 1608. A related sequence was also identified in GAS <SEQ ID 9129> which encodes the amino acid sequence <SEQ ID 9130>. Analysis of this protein sequence reveals the following:

---

Possible cleavage site: 27
>>> Seems to have an uncleavable N-term signal seq
INTEGRAL    Likelihood = −4.67    Transmembrane 649-665 (648-666)
INTEGRAL    Likelihood = −2.02    Transmembrane 6-22 (5-22)
PERIPHERAL  Likelihood = 1.85

---

Based on this analysis, it was predicted that these proteins and their epitopes could be useful antigens for vaccines or diagnostics.

A related GBS gene <SEQ ID 8585> and protein <SEQ ID 8586> were also identified. Analysis of this protein sequence reveals the following:

---

Lipop: Possible site: −1    Crend: 7
McG: Discrim Score: 6.68
GvH: Signal Score (−7.5): 0.87
Possible site: 28
>>> Seems to have a cleavable N-term signal seq.
ALOM program count: 1  value: −5.79  threshold: 0.0
INTEGRAL    Likelihood = −5.79    Transmembrane 779-795 (778-797)
PERIPHERAL  Likelihood = 0.53     251
modified ALOM score: 1.66
*** Reasoning Step: 3
----- Final Results -----
    bacterial membrane --- Certainty = 0.3314 (Affirmative) <succ>
      bacterial outside --- Certainty = 0.0000 (Not Clear) <succ>
        bacterial cytoplasm --- Certainty = 0.0000 (Not Clear) <succ>
LPXTG motif: 769-773

---

The protein has homology with the following sequences in the databases:

---

```
ORF01378(298-2337 of 3000)
GP|6782402|emb|CAB70615.1||AJ133440(1-680 of 683) cyclo-nucleotide
phosphodiesterase, putative {Streptococcus dysgalactiae subsp. equisimilis}
% Match = 38.3
% Identity = 59.0 % Similarity = 72.3
Matches = 403 Mismatches = 181 Conservative Sub.s = 91

105       135       165       195       225       255       285       315
LFYHFLT*K*KKLEAQKELXTK*MCLTKLSFINKRLFLV*SLKIIRK*D*LNVFNKL**FL *DNIHVMF*WRRFMSKHY
                                                                          |:| |
                                                                          MMTKGY 345       375       405       435       465       495       525       555
FSKSVFALTVLTATATSGLAVQAEDIVTTPSSTSTKVESTTPTSTIAEEKSNVTSTPTAITDASTATSTNTTTNNONPQP
 |||    |  : ||    |: ||:        |:|   :||  |:     |    |    |    |    | |: : :
MSKSAIFLAMLVAAGSAQLT-KAEETTAVEPLTTT-ANTTTSTAVPAETAPLVADTTPATATADTAVPSPVNSTSSE-MA
         20        30        40        50        60        70        80

585       615       645       675       705       735       765       795
VATEATTSDLKPIEGEKVDLRIMSTTDLHTNLVNYDYYQDKESQKIGLAKTAVLIEEAKKENPNTVLVDNGDVIQGLPLG
 |:    :    |:||:  ||:||||||||:||||||||||:|  :|||||||||| |||||||:||||||||::||||
TASADNATVTAPVEGQSVDVRILSTTDLHSNLVNYDYYQDKEAQSLGLAKTAVLIDAAKKENSNVVLVDNGDILQGTPLA
         100       110       120       130       140       150       160

825       855       885       915       945       975      1005      1035
TYKAIVKPVAENEEHPMYQAMNALGYDASTLGNHEFNYGLDYLKKIIATANLXILNANVLDFKTHQPVFKTYDIITKTFK
||||||  ||  :| ||||  :|  ||||||||||||||||||||||:::|||  |   |||| ||  :| ||||||||
TYKAIVDPVEADEVHPMYAALKALNFDASTLGNHEFNTGLDYLDRVMATAGLPIGNVNVLDAKTGKPKFKPFDIITKTFT
         180       190       200       210       220       230       240
```

```
1065         1095        1125        1155        1185        1215        1243        1273
DSTGRAVALNIGITGIVPPQILNWDKANLEGKVIVKDSVKAIEEIVPTMRAKGADVILVLS TLALEMIDMKKVKKTLAI
  |   | :|  |||||:||||| : :|||||| |||   |||:|:|::|::||:||  |||::|||: ||     | ||  ||| |
DKDGKTVSLKIGITGVVPPQIMSWDKANLTGKVTVKDAVEAVKEVIPTIRAAGADLVLVLA!TLVSVMTSMKSVKKMLVT
          260        270        280         290         300         310          320

1303         1357        1387        1416        1446        1476        1500
KLPASREWMPLLRDTHTL--NFHQVTVLASMKNTLELMVSM KINGTPVTMAGKYGDHLGIIDLGLSYTNGKWQVS--ES
|| |:    |    :  ||     :|:  |:        |   |||  |||| |||||||  |::|||:|:|:   :|
KLLALKVLMQWSQAIHMLISQPYQMAVFTITSKVLMVKRAL!-INGVPVTMGGKYGDHLGLIDLNLTYTNGQWKVNKDQS
          340         350         360         370         380         390         400

1530         1560        1590        1620        1650        1680        1710        1740
SAKIRKIDMNSTTADERIIALAKEAHDGTINYVRQQVGTTTAPITSYFALVKDDPSVQIVXNAQRWYVANELKGTPEANL
  |: |:||    |    |   ||||||||||||: |||||||||||| |||||:|||||:||| ||||||   || ||||||||
RAETRQIDSKSNQVDPTIIALAKEAHDGTVAYVRQQVGTTTAPINSYFALIKDDPSIQIVNNAQRWYAEKELAGTPEANL
          410         420         430         440         450         460         470         480

1770         1800        1830        1860        1887        1917        1947        1977
PLLSAAAPFKAGTRGDATAYTDIPAGPVAIKNVADLYLYDNVTAL-LKVTGADLREWLEMSAGQFNQIDPNNKAPQNIIN
|||||||||||||       |      ::   :: :         :  |   |||||||||:|||||||||||  |||:     ||:::|
PLLSAAAPFKAGYTKMMRQLILIFLLVQSLSKMSLTFTCTTTSLLFLKVTGADLKEWLEMSAGQFNTIDPSKSEPQDLVN
          490         500         510         520         530         540         550         560

2007         2037        2067        2097        2127        2157        2187        2217
TEYRTYNFDVIDGLTYKFDITQPNKYNKDGKVVNSQASRVRDLMYNGKPVADKQEFMIVTNNYRASGTFPGAKNATMNRL
|||||||||||||||::||:||   |||:    |:||    ||||||  |||  |||  :      |||||||  ||||  ||:|
TSYRTYNFDVIDGLTYEFDVTQKNKYDSKGNLVNPDASRVRNLKYMGKDIDPKQEFMVVTNNYRASGNFPGVKNATLNRL
          570         580         590         600         610         620         630         640

2247         2277        2307        2337        2367        2397        2427        2457
LNLENRQTIINYIISEKTINPTADNNWGFTESIKDLDLRFQTADKAKNLVTNSKDIQYIASSTKDEGFGDYRFVYTEQEK
||||||||  ||||| :: |||||||:|||||| |      | ::|| |:|||
LNLENRQAIINYIVAEKTINPSADNNWYFADTIKGLNLRFLKR
          650         660         670         680
```

Figure 196:
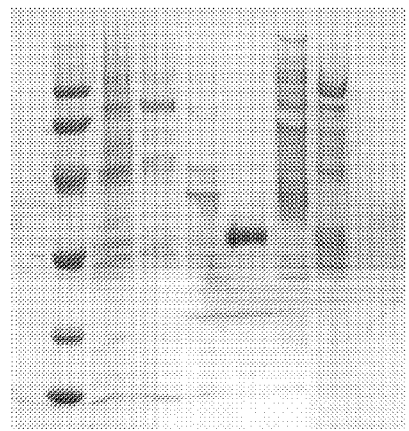

SEQ ID 8586 (GBS53) was expressed in *E. coli* as a His-fusion product. The purified protein is shown in FIG. 196, lane 9.

Example 502

A DNA sequence (GBSx0540) was identified in *S. agalactiae* <SEQ ID 1609> which encodes the amino acid sequence <SEQ ID 1610>. Analysis of this protein sequence reveals the following:

Possible site: 24
>>> Seems to have no N-terminal signal sequence
----- Final Results -----
   bacterial cytoplasm --- Certainty = 0.0296 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 503

A DNA sequence (GBSx0541) was identified in *S. agalactiae* <SEQ ID 1611> which encodes the amino acid sequence <SEQ ID 1612>. Analysis of this protein sequence reveals the following:

Possible site: 18
>>> Seems to have no N-terminal signal sequence
----- Final Results -----
   bacterial cytoplasm --- Certainty = 0.1504 (Affirmative) <succ>
    bacterial membrane --- Certainty = 0.0000 (Not Clear) <succ>
      bacterial outside --- Certainty = 0.0000 (Not Clear) <succ>

A related GBS nucleic acid sequence <SEQ ID 10195> which encodes amino acid sequence <SEQ ID 10196> was also identified.

The protein has homology with the following sequences in the GENPEPT database:

```
>GP: CAB12860 GB: Z99109 similar to glucanase [Bacillus subtilis]
Identities = 212/345 (61%), Positives = 268/345 (77%), Gaps = 1/345 (0%)
Query:  30 SMETTLNYIKTLTSIPSPTGFTQTIMIYIIKELEAFGYSPIRTNKGGVMVSLKGKNDTKH         89
            S+  T+   IK L SIPSPTG T ++   YI    L+ +    +R +KGG++ +L G++ ++H Sbjct:   3 SVRKTMELIKELVSIPSPIGNTYEVINYIESLLKEWKVETVRNHKGGLIATLPGRDTSRH         62

Query:  90 RMITAHLDTLGAMVRAIKPDGRLKIDLIGGYTYNAIEGENCTIHLSKNGKEISGTALIHQ        149
            RM+TAH+DTLGAMV+ IK DGRLKIDLIGG+ YN+IEGE C I   +  +GK   +GT L+HQ Sbjct:  63 RMLTAHVDTLGAMVKEIKADGRLKIDLIGGFRYNSIEGEYCQIETA-SGKMYTGTILMHQ        121
```

```
Query: 150 TSVHVYKDAGTAERNQTNMEIRLDEKVTTADETRALGIQVGDFISFDPRTIITDSGFIKS        209
            TSVHVYKDAG AERNQ NMEIRLDE V   +T  LGI VGDF+SFDPR  IT SGFIKS
Sbjct: 122 TSVHVYKDAGKAERNQENMEIRLDEPVHCRKDTEELGIGVGDFVSFDPRVEITSSGFIKS        181

Query: 210 RYLDDKVSAGILMELLSVYKKEDIQLPYTTHFYFSAFEELGHGANSSIPNETVEYLAVDM        269
            R+LDDK S  +L+ L+   + EDI+LPYTTHF  S   EE+G+G NS+IP ETVEYLAVDM
Sbjct: 182 RHLDDKASVALLLRLIHEIQTEDIELPYTTHFLISNNEEIGYGGNSNIPPETVEYLAVDM        241

Query: 270 GAMGDDQETDEYTVSICVKDASGPYHYELRQHLVSLAENNNIPYKLDIYPYYGSDASAAM        329
            GA+GD Q TDEY+VSICVKDASGPYHY+LR+HLV LAE ++I YKLDIYPYYGSDASAA+
Sbjct: 242 GAIGDGQATDEYSVSICVKDASGPYHYQLRKHLVQLAEKHHIDYKLDIYPYYGSDASAAI        301

Query: 330 RAGAEVKHALLGAGIESSHSYERTHIDSIQATELLVDAYLKSNMV                      374
            ++G ++ H L+G GI++SH++ERTH  S++ T  L+  Y++S MV
Sbjct: 302 KSGHDIVHGLIGPGIDASHAFERTHKSSLRHTAKLLYYVQSPMV                       346
```

There is also homology to SEQ ID 424.

Based on this analysis, it was predicted that these proteins and their epitopes could be useful antigens for vaccines or diagnostics.

Example 504

A DNA sequence (GBSx0542) was identified in *S. agalactiae* <SEQ ID 1613> which encodes the amino acid sequence <SEQ ID 1614>. Analysis of this protein sequence reveals the following:

Possible site: 20
>>> Seems to have no N-terminal signal sequence
----- Final Results -----
  bacterial cytoplasm --- Certainty = 0.3157 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database:

```
>GP: AAF11472 GB: AE002031 conserved hypothetical protein
[Deinococcus radiodurans]
Identities = 55/150 (36%), Positives = 85/150 (56%), Gaps = 2/150 (1%)
Query:   5 LIIIRGNSASGKSTIAKQLQAELGENTLLLSQDYLRREMLGTKDGENTTTIPLLINLLNY         64
           LI++RGNS SGKS++A+ L+  G   + QDYLRR +L  D     I L+   + Y
Sbjct:  23 LIVLRGNSGSGKSSVARALRERFGYGLAWVEQDYLRRVLLREHDVAGGKNIGLIETNVRY        82

Query:  65 GYHNCSYIILEGILRSDWYTPVWKHILKHNPNNTYAYYYDLSFQETVKRHSTRLKSLEFG        124
                S  +LEGIL S   Y P+ + +   H       + +Y+DL F+ETV+RH+TR  ++ +FG
Sbjct:  83 CLSAGSVTVLEGILFSRHYGPMLERL--HADFGGHWFYFDLPFEETVRRHATRPQAADFG        140

Query: 125 EDSLARWWLEKDFLKEIPEKILTKAMSLED                                    154
             +    W+  +D L  + E+++   A SL D
Sbjct: 141 VQDMQAWFQARDVLPFVQEQLIGPASSLAD                                    170
```

No corresponding DNA sequence was identified in *S. pyogenes*.

Example 505

A DNA sequence (GBSx0543) was identified in *S. agalactiae* <SEQ ID 1615> which encodes the amino acid sequence <SEQ ID 1616>. This protein is predicted to be periplasmic-iron-binding protein BitC. Analysis of this protein sequence reveals the following:

Possible site: 29
>>> Seems to have an uncleavable N-term signal seq
INTEGRAL    Likelihood = –11.46    Transmembrane 9-25 (5-30)
----- Final Results -----
  bacterial membrane --- Certainty = 0.5585 (Affirmative) <succ>
  bacterial outside --- Certainty = 0.0000 (Not Clear) <succ>
  bacterial cytoplasm --- Certainty = 0.0000 (Not Clear) <succ>

Based on this analysis, it was predicted that this protein and its epitopes, could be useful antigens for vaccines or diagnostics.

The protein has homology with the following sequences in the GENPEPT database:

```
>GP: AAD18094 GB: U75349 periplasmic-iron-binding protein BitA
[Brachyspira hyodysenteriae] (ver 2)
Identities = 114/331 (34%), Positives = 184/331 (55%), Gaps = 3/331 (0%)
Query:  11 YILLVVSIIFISVFTYSISQPSKLLPPKELVILSPNSQAILTGTIPAFEEKY-GIKVKLI        69
            +I+  + ++ +++F   S   SK      LVI  +     ++    +  F+ K   I V+++
```

```
Sbjct:    4 FIIFCMLMLSMTLFYSCSSGDSK--NANSLVIYCSHPLDLMNTILDDFKAKNPDINVEVV       61

Query:   70 QGGTGQLIDRLSKEGKQLKADIFFGGNYTQFESHKALFESYVSKNVHTVIPDYIHPSDTA      129
            GTG+L+  R+  E      D+ +GG       +S   LFE+Y S N    ++ ++ +
Sbjct:   62 TAGTGELLKRVEAEKMNPLGDVLWGGTLNSVKSKTDLFENYTSTNEANILDEFKNTEGPF      121

Query:  130 TPYTINGSVLIVNNELAKGLTIKSYEDLLQPSLKGKIAFADPNTSSSAFSQLTNILLAKG      189
              T ++    S+L+VN  LA  + I+ YEDLL P LKGKIA ADP+ SSSAF  L N+L A G
Sbjct:  122 TRFSAIPSILMVNTNLAGNIKIEGYEDLLNPELKGKIAAADPSASSSAFEHLVNMLYAMG      181

Query:  190 GYTNPKAWNYVKKLQHNINAIKSSSSSEVYQSVAEGKMIVGLTYEDPSVNLQKSGANVSI      249
                K W+YV+KL  N++    S SS  VY+ VA+G+  VGLTYE+P ++    SG+ V +
Sbjct:  182 KGDPEKGWDYVQKLCANLDGKLLSGSSAVYKGVADGEYTVGLTYEEPGISYMSSGSPVKV      241

Query:  250 VYPTEGTVFVPSSVAIIKNAPSMKEAKLFINFMLSLDVQNAFGQSTSNRPIRKDAQTSNG      309
             +Y  EG   P  V IIK   +++ AK FI++ +SLD QN   +   S R  IR DA  ++
Sbjct:  242 IYMKEGVISKPDGVYIIKGGKNLENAKKFIDYCVSLDAQNMLVEKLSRRSIRSDAVVTDM      301

Query:  310 MKALKDIATLKEDYRYVTKHKGQILKTYNRI                                340
             +K + +I ++ ++    V + + L  +    I
Sbjct:  302 VKPMSEIYSITDNADVVEESRQKWLDKFKDI                                332
```

A related DNA sequence was identified in *S. pyogenes* <SEQ ID 1617> which encodes the amino acid sequence <SEQ ID 1618>. Analysis of this protein sequence reveals the following:

Possible site: 33
>>> Seems to have an uncleavable N-term signal seq
INTEGRAL      Likelihood = -13.16      Transmembrane 9-25 (4-33)
----- Final Results -----
   bacterial membrane --- Certainty = 0.6265 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the databases:

```
>GP:AAB95371 GB:U75349 periplasmic-iron-binding protein BitC
[Brachyspira hyodysenteriae]
Identities = 115/324 (35%), Positives = 177/324 (54%), Gaps = 8/324 (2%)

Query:   15 VIIILAIVNVAMYIF-----SSSKKDSAKELVILTPNSQTILTGTIPAFEEKY-GVKVRL       68
            +++I + ++++IF     S S  S    LVI P+   +   + F+ K  G+ V +
Sbjct:    4 IVLIFTSLLLSVFIFYSCSSSESGAQSGNSLVIYCPHPLEFINPLVDDFKAKNPGINVDI       63

Query:   69 IQGGTGQLIDQL-GRKDKPLNADIFFGGNYTQFESHKDLFESYVSPQVSTVISDYQLPSH      127
            I  GTG+L+ ++     KD PL DI +GG  +   + DLFESY S    +     Y+
Sbjct:   64 IAAGTGELLKRVESEKDNPLG-DILWGGTISMAKPKIDLFESYTSTNEENIAEIYKNTEG      122

Query:  128 RATPYTINGSVLIVNNELARGLHITSYEDLLQPALKGKIAFADPNSSSSAFSQLTNILLA      187
                T T    S+L+VN  LA  + I  YEDLL P LKGKIAFADP++SSS+F  L N+L A
Sbjct:  123 ALTRCTAVPSILMVNTNLAGDIKIEGYEDLLNPELKGKIAFADPSASSSSFEHLVNMLYA      182

Query:  188 KGGYTNADAWAYMKRLLVNMNSIRATSSSEVYQSVAEGKMIVGLTYEDPCINLQKSGANV      247
             G       W Y+ +L  N++    + SS VY+ VA+G+  VGLT+E+    N   +G+ V
Sbjct:  183 IGKGDPEKGWDYVSKLCANLDGKLLSGSSAVYKGVADGEYTVGLTFEEGGANYVSAGSPV      242

Query:  248 SIVYPKEGTVFVPSSVAIIKHAPNMTEAKLFINFMLSRDVQNAFGQSTSNRPIRQDAQTS      307
             +VY KEG +  P  + IIK+A N+  AK F+++  S D Q     +   + R  +R D    S
Sbjct:  243 KLVYMKEGVIIKPDGIYIIKNAKNLENAKKFVDYATSYDAQKTITDKLNRRSVRGDLPPS      302

Query:  308 HDMKALETIATLKEDYAYVTKHKK                                       331
             +++++TI  + +D A V ++K+
Sbjct:  303 AILQSVDTINVITDDEAVVDQNKQ                                       326
```

An alignment of the GAS and GBS proteins is shown below:

```
Identities = 257/345 (74%), Positives = 295/345 (85%), Gaps = 1/345 (0%)

Query:    1 MKEKQSKRLIYILLVVSIIFISVFTYSISQPSKLLPPKELVILSPNSQAILTGTIPAFEE   60
            +K K+    L ++L+++ +  ++V Y S SK    KELVIL+PNSQ ILTGTIPAFEE
Sbjct:    2 LKLKRKWLLSFLLVIIILAIVNVAMYIFSS-SKKDSAKELVILTPNSQTILTGTIPAFEE   60

Query:   61 KYGIKVKLIQGGTGQLIDRLSKEGKQLKADIFFGGNYTQFESHKALFESYVSKNVHTVIP  120
            KYG+KV+LIQGGTGQLID+L ++ K L ADIFFGGNYTQFESHK LFESYVS  V TVI
Sbjct:   61 KYGVKVRLIQGGTGQLIDQLGRKDKPLNADIFFGGNYTQFESHKDLFESYVSPQVSTVIS  120

Query:  121 DYIHPSDTATPYTINGSVLIVNNELAKGLTIKSYEDLLQPSLKGKIAFADPNTSSSAFSQ  180
            DY  PS  ATPYTINGSVLIVNNELA+GL I SYEDLLQP+LKGKIAFADPN+SSSAFSQ
Sbjct:  121 DYQLPSHRATPYTINGSVLIVNNELARGLHITSYEDLLQPALKGKIAFADPNSSSSAFSQ  180

Query:  181 LTNILLAKGGYTNPKAWNYVKKLQHNINAIKSSSSSEVYQSVAEGKMIVGLTYEDPSVNL  240
            LTNILLAKGGYTN  AW Y+K+L  N+N+I+++SSSEVYQSVAEGKMIVGLTYEDP +NL
Sbjct:  181 LTNILLAKGGYTNADAWAYMKRLLVNMNSIRATSSSEVYQSVAEGKMIVGLTYEDPCINL  240

Query:  241 QKSGANVSIVYPTEGTVFVPSSVAIIKNAPSMKEAKLFINFMLSLDVQNAFGQSTSNRPI  300
            QKSGANVSIVYP EGTVFVPSSVAIIK+AP+M EAKLFINFMLS DVQNAFGQSTSNRPI
Sbjct:  241 QKSGANVSIVYPKEGTVFVPSSVAIIKHAPNMTEAKLFINFMLSRDVQNAFGQSTSNRPI  300

Query:  301 RKDAQTSNGMKALKDIATLKEDYRYVTKHKGQILKTYNRIRRNAD                345
            R+DAQTS+ MKAL+ IATLKEDY YVTKHK +I+ TYN++R+ +
Sbjct:  301 RQDAQTSHDMKALETIATLKEDYAYVTKHKKKIVATYNQLRQRLE                345
```

SEQ ID 1616 (GBS263) was expressed in *E. coli* as a GST-fusion product. SDS-PAGE analysis of total cell extract is shown in FIG. 49 (lane 4; MW 63 kDa).

Figure 301:
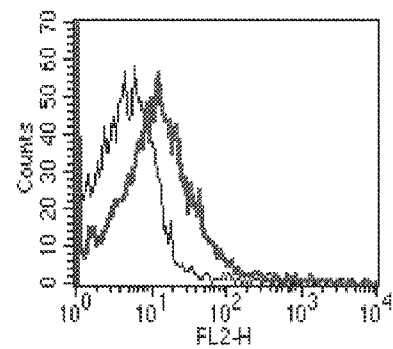

The GBS263-GST fusion product was purified (FIG. 205, lane 5) and used to immunise mice. The resulting antiserum was used for FACS (FIG. 301), which confirmed that the protein is immunoaccessible on GBS bacteria.

Based on this analysis, it was predicted that these proteins and their epitopes could be useful antigens for vaccines or diagnostics.

Example 506

A DNA sequence (GBSx0544) was identified in *S. agalactiae* <SEQ ID 1619> which encodes the amino acid sequence <SEQ ID 1620>. This protein is predicted to be response regulator. Analysis of this protein sequence reveals the following:

Possible site: 37
>>> Seems to have no N-terminal signal sequence
----- Final Results -----
   bacterial cytoplasm --- Certainty = 0.4733 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database:

```
>GP:AAF31452 GB:AF221126 putative response regulator [Streptococcus pneumoniae]
Identities = 85/252 (33%), Positives = 147/252 (57%), Gaps = 17/252 (6%)

Query:    2 YRLLIVEDEHLIRKWLRYAIDYQSLNILVVGEAKDGKEGAQLIQEEQPDIVLSDINMPIM   61
            Y +LIVEDE+L+R+ L   ++ + ++ ++G+A++G++   +LIQ++ PDI+L+DINMP +
Sbjct:    3 YTILIVEDEYLVRQGLTKLVNVAAYDMEIIGQAENGRQAWELIQKQVPDIILTDINMPHL   62

Query:   62 TAFDMFEATKGQSYAK---IILSGYADFPNAQSAIHYGVLEFLTKPLEKQALIDCLKTIM  118
            +    + ++Y +     + L+GY DF  A SA+  GV ++L KP +Q + + L    I
Sbjct:   63 NGIQLASLVR-ETYPQVHLVFLTGYDDFDYALSAVKLGVDDYLLKPFSRQDIEEMLGKIK  121

Query:  119 ARIE-EHKEKHLQEHTELYLPLPQANDQVPEVIKDMLAWIHSHFHGKIVISQLAHDLGYS  177
            +++  E KE+ LQ+     L   +   + +  I+ LA        +  +   LA DLG+S
Sbjct:  122 QKLDKEEKEEQLQD-----LLTNRFEGNMAQKIQSHLA------DSQFSLKSLASDLGFS  170

Query:  178 ESYLYTVTKKHLHITLSDYINQYRINQAIQLMFREPDLMVYQIAEAVGIYDYRYFDRVFK  237
            +YL ++ KK L +    DY+ + R+ QA +L+     DL +Y+IAE VG  D  YF + FK
Sbjct:  171 PTYLSSLIKKELGLPFQDYLVRERVKQA-KLLLLTTDLKIYEIAEKVGFEDMNYFTQRFK  229

Query:  238 KYLGQTVKAFKE                                                 249
            +  G T + FK+
Sbjct:  230 QIAGVTPRQFKK                                                 241
```

A related DNA sequence was identified in *S. pyogenes* <SEQ ID 1621> which encodes the amino acid sequence <SEQ ID 1622>. Analysis of this protein sequence reveals the following:

```
Possible site: 36
>>> Seems to have no N-terminal signal sequence
----- Final Results -----
    bacterial cytoplasm --- Certainty = 0.4239 (Affirmative) <succ>
      bacterial membrane --- Certainty = 0.0000 (Not Clear) <succ>
        bacterial outside --- Certainty = 0.0000 (Not Clear) <succ>
```

An alignment of the GAS and GBS proteins is shown below:

```
Identities = 193/257 (75%), Positives = 226/257 (87%)

Query:    1  MYRLLIVEDEHLIRKWLRYAIDYQSLNILVVGEAKDGKEGAQLIQEEQPDIVLSDINMPI   60
             MY+L+I+EDEH+IRKWLRYAIDY++L+ILV+GEAKDGKEGA LI+E QPDIVL+DINMPI
Sbjct:    1  MYKLVIIEDEHIIRKWLRYAIDYKALDILVIGEAKDGKEGAVLIKESQPDIVLTDINMPI   60

Query:   61  MTAFDMFEATKGQSYAKIILSGYADFPNAQSAIHYGVLEFLTKPLEKQALIDCLKTIMAR  120
             MTAFDMFE TK Q+YAKIILSGYADFPNA+SAIHYGVLEFLTKP+EK AL +CL+TI+A+
Sbjct:   61  MTAFDMFEVTKDQTYAKIILSGYADFPNARSAIHYGVLEFLTKPIEKAALWECLQTIIAK  120

Query:  121  IEEHKEKHLQEHTELYLPLPQANDQVPEVIKDMLAWIHSHFHGKIVISQLARDLGYSESY  180
             IE+ K + +   +Y+PLPQ DQ+PEV+KD+L W+H+HF  KI  S+LAHDLGYSESY
Sbjct:  121  IEKQKGSNQKTDACVYIPLPQMTDQIPEVVKDILEWVHAHFQDKISTSRLAHDLGYSESY  180

Query:  181  LYTVTKKHLHITLSDYINQYRINQAIQLMFREPDLMVYQIAEAVGIYDYRYFDRVFKKYL  240
             +Y   KKHL + LSDYINQYRINQAIQLM +EPDLMVY+IA+AVGIYDYRYFDRVFKKYL
Sbjct:  181  IYQNIKKHLQMPLSDYINQYRINQAIQLMQQEPDLMVYEIAQAVGIYDYRYFDRVFKKYL  240

Query:  241  GQTVKAFKEEHIFKQMD                                            257
             GQTVKAFKEEH  K  D
Sbjct:  241  GQTVKAFKEEHFMKDTD                                            257
```

Based on this analysis, it was predicted that these proteins and their epitopes could be useful antigens for vaccines or diagnostics.

Example 507

A DNA sequence (GBSx0545) was identified in *S. agalactiae* <SEQ ID 1623> which encodes the amino acid sequence <SEQ ID 1624>. Analysis of this protein sequence reveals the following:

```
Possible site: 14
>>> Seems to have no N-terminal signal sequence
----- Final Results -----
    bacterial cytoplasm --- Certainty = 0.2964 (Affirmative) <succ>
      bacterial membrane --- Certainty = 0.0000 (Not Clear) <succ>
        bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 508

A DNA sequence (GBSx0546) was identified in *S. agalactiae* <SEQ ID 1625> which encodes the amino acid sequence <SEQ ID 1626>. This protein is predicted to be two-component sensor histidine kinase. Analysis of this protein sequence reveals the following:

```
Possible site: 45
>>> Seems to have no N-terminal signal sequence
INTEGRAL     Likelihood = -13.80   Transmembrane 266-282 (257-285)
INTEGRAL     Likelihood = -12.90   Transmembrane 29-45 (24-51)
----- Final Results -----
    bacterial membrane --- Certainty = 0.6519 (Affirmative) <succ>
      bacterial outside --- Certainty = 0.0000 (Not Clear) <succ>
        bacterial cytoplasm --- Certainty = 0.0000 (Not Clear) <succ>
```

A related GBS nucleic acid sequence <SEQ ID 10197> which encodes amino acid sequence <SEQ ID 10198> was also identified.

The protein has homology with the following sequences in the GENPEPT database:

```
>GP:BAB05628 GB:A2001513 two-component sensor histidine kinase
[Bacillus halodurans]
Identities = 84/258 (32%), Positives = 138/258 (52%), Gaps = 23/258 (8%)

Query:  298  SSAINQMVLDMDAISRQEKSSIELDSQDEFQYLSVQINQMVSRLKDLHEKTLDLETQKLL  357
             S   INQ+      S   K+ I +D +DE    LSVQ NQMV+ L+ L  +   QK L
```

```
Sbjct:  327  SERINQVA------SGDLKTKIVVDGKDEIGQLSVQFNQMVANLRSLIHQVHETNRQKRL  380

Query:  358  FEK-------RMLEAQFNPHFLYNTLETILITSHYDSQL-TERIVIQLTKLLRYSLSGST  409
              EK        +ML +Q NPHFL+NTLE+I + SH  +    ++V QL KL+R SL   +
Sbjct:  381  LEKSQNEIKLKMLASQINPHFLFNTLESIRMKSHMKGETEIAKVVKQLGKLMRKSLEVTG  440

Query:  410  EAAVLKDDLAIIESYLLINQVRF-EELTYTISVSPELEHMRVPKLFLLPLIENAIKYGLK  468
              L+++L ++  YL I  R+ + L Y + + P+ E + +  L + PL+ENA+ +GL+
Sbjct:  441  HHIPLRNELDMVRCYLEIQTFRYGDRLHYELYIDPQSEMVEILPLIIQPLVENAVIHGLE  500

Query:  469  ERHD-VAINIDIWQDSDGIWFTVSNNGSGISLARQQAIRTMLRSTH----SHHGLINSYR  523
              D   + I   + + + V+++G G+       + +AI+ ML        + GL+N ++
Sbjct:  501  RTEDGGTVTISTIVNGNDLTVIVNDDGCGMDEEKLEAIQNMLHHPQEVDGNKIGLLNVHK  560

Query:  524  RLQYQF---STVLLEFTK                                           538
             RLQ +   S +++E  K
Sbjct:  561  RLQLTYGKTSGLIIESAK                                           578
```

A related DNA sequence was identified in *S. pyogenes* <SEQ ID 1627> which encodes the amino acid sequence <SEQ ID 1628>. Analysis of this protein sequence reveals the following:

```
Possible site: 43
>>> Seems to have no N-terminal signal sequence
INTEGRAL    Likelihood = −10.88   Transmembrane 27-43 (22-49)
INTEGRAL    Likelihood = −9.08    Transmembrane 263-279 (258-282)
----- Final Results -----
   bacterial membrane --- Certainty = 0.5352 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the databases:

```
>GP:BAB05628 GB:AP001513 two-component sensor histidine kinase
[Bacillus halodurans]
Identities = 85/270 (31%), Positives = 139/270 (51%), Gaps = 20/270 (7%)

Query:  276  IFVILQRKSSGLANRIAAKNSRAINQMVRDMSAISRQEKRRIDLESQDEFQYLSDQINQM  335
              + V+L    S L ++ + S  INQ+      S    K +I ++ +DE    LS Q NQM
Sbjct:  307  VAVLLIVHFSWLISKRLSHLSERINQVA------SGDLKTKIVVDGKDEIGQLSVQFNQM  360

Query:  336  VERLQQLHDKTLDLETQKLLFEK-------RMLEAQFNPHFLYNTLETILITSHYDSAL-  387
             V   L+ L + +  QK L EK        +ML +Q NPHFL+NTLE+I + SH
Sbjct:  361  VANLRSLIHQVHETNRQKRLLEKSQNEIKLKMLASQINPHFLFNTLESIRMKSHMKGETE  420

Query:  388  TEKIVIQLTKLLRYSLTDSSKPVLLKDDLSVIESYLVINQVRF-EELQYSINLSPDLDSL  446
              K+V QL KL+R SL +  + L+++L ++  YL I  R+ + L Y + + P + +
Sbjct:  421  IAKVVKQLGKLMRKSLEVTGHHIPLRNELDMVRCYLEIQTFRYGDRLHYELYIDPQSEMV  480

Query:  447  EVPKLFLLPLIENAIKYGLKERHD-VKINIACYYQDDHIIFSVRDNGSGIDAHHQKVIRE  505
             E+  L + PL+ENA+ +GL+  D  + I+    + +   V D+G G+D    + I+
Sbjct:  481  EILPLIIQPLVENAVIHGLERTEDGGTVTISTIVNGNDLTVIVNDDGCGMDEEKLEAIQN  540

Query:  506  QL----EAGESHHGLINSYRRLKYHFSEVS                               531
              L    E   + GL+N ++RL+ + + S
Sbjct:  541  MLHHPQEVDGNKIGLLNVHKRLQLTYGKTS                               570
```

An alignment of the GAS and GBS proteins is shown below:

```
Identities = 369/549 (67%), Positives = 449/549 (81%)

Query:    3  MRGYRMEERFKKRLQDDISKHFSRQSLILSLLLIALFVLFSLAPQQIGLYKDVNSVSYSY   62
             MRG ++EE FKK+LQDDIS+HFS QSL+LSLLLI LF++FSLAPQQ+GLY+D+N+  + Y
Sbjct:    1  MRGEQVEEHFKKQLQDDISRHFSYQSLMLSLLLIGLFIIFSLAPQQLGLYRDINATATRY   60

Query:   63  KQLIQKHDTLLDDLGKNSLKPFVSGHLGSADLSKQYYHLRNHLQSQTELLVFSPNQELLF  122
             +LI K + LLDDLGKNSL PF++ +L +ADLSK Y+HLR+   Q+  ELL+FSP+Q+LLF
Sbjct:   61  HRLISKQEALLDDLGKNSLLPFLNKNLSTADLSKHYFHLRHSSQTSPELLLFSPSQDLLF  120

Query:  123  ASNSHLGNFFSKSIYISEVLDKAKINQRLLKIIVDSEGGHYLALIKPIIVNKKVSGYAFL  182
             ASN HLGN FSKS+YI EVL    + L K +DSE GHYL +I P+I ++ GYAFL
```

-continued

```
Sbjct:  121  ASNPHLGNVFSKSVYIQEVLRATHSPKTLFKDAMDSEDGHYLMIIMPMIDQNQLKGYAFL  180

Query:  183  LMNGKDFLLPTKAINSDLIIADQLNNSFTFTNRDFISSSLDKVDSQFLTRYFSFHDHRAF  242
             +M+GKDFL PTK + S+L+IAD+L+N+FTF+NR+FI+SSLDK++SQ+L  YF F D+RAF
Sbjct:  181  VMSGKDFLHPTKTLTSELVIADKLDNTFTFSNREFIASSLDKINSQYLHHYFVFQDNRAF  240

Query:  243  VVRKVALQDNILLYMYRPLIPVTLVVLFSLVSSVIIFVILRQKSRVLADRIAVKNSSAIN  302
             + RKVALQ + LYMYRPLIP+ V+LFSL+SS +IFVIL++KS  LA+RIA KNS AIN
Sbjct:  241  ITRKVALQGGLWLYMYRPLIPMVSVMLFSLISSAVIFVILQRKSSGLANRIAAKNSRAIN  300

Query:  303  QMVLDMDAISRQEKSSIELDSQDEFQYLSVQINQMVSRLKDLHEKTLDLETQKLLFEKRM  362
             QMV DM AISRQEK  I+L+SQDEFQYLS QINQMV RL+ LH+KTLDLETQKLLFEKRM
Sbjct:  301  QMVRDMSAISRQEKRRIDLESQDEFQYLSDQINQMVERLQQLHDKTLDLETQKLLFEKRM  360

Query:  363  LEAQFNPHFLYNTLETILITSHYDSQLTERIVIQLTKLLRYSLSGSTEAAVLKDDLAIIE  422
             LEAQFMPHFLYNTLETILITSHYDS LTE+IVIQLTKLLRYSL+ S++  +LKDDL++IE
Sbjct:  361  LEAQFNPHFLYNTLETILITSHYDSALTEKIVIQLTKLLRYSLTDSSKPVLLKDDLSVIE  420

Query:  423  SYLLINQVRFEELTYTISVSPELEHMRVPKLFLLPLIENAIKYGLKERHDVAINIDIWQD  482
             SYL+INQVRFEEL Y+I++SP+L+ + VPKLFLLPLIENAIKYGLKERHDV INI   +
Sbjct:  421  SYLVINQVRFEELQYSINLSPDLDSLEVPKLFLLPLIENAIKYGLKERHDVKINIACYYQ  480

Query:  483  SDGIWFTVSNNGSGISLARQQAIRTMLRSTHSHHGLINSYRRLQYQFSTVLLEFTKTDDA  542
              D I F+V +NGSGI    Q+ IR  L +  SHHGLINSYRRL+Y FS V L F + D
Sbjct:  481  DDHIIFSVRDNGSGIDAHHQKVIREQLEAGESHHGLINSYRRLKYHFSEVSLVFDQGDKQ  540

Query:  543  FRVSYIVKE  551
             F VSY VKE
Sbjct:  541  FNVSYHVKE  549
```

A related GBS gene <SEQ ID 8587> and protein <SEQ ID 8588> were also identified. Analysis of this protein sequence reveals the following:

Lipop: Possible site: −1    Crend: 10
McG: Discrim Score: 6.23
GvH: Signal Score (−7.5) : −0.0500002
Possible site: 38
>>> Seems to have a cleavable N-term signal seq.
ALOM program count: 1   value: −13.80   threshold: 0.0

INTEGRAL    Likelihood = −13.80    Transmembrane 259-275 (250-278)
PERIPHERAL  Likelihood = 2.70      404
modified ALOM score: 3.26
*** Reasoning Step: 3
----- Final Results -----
  bacterial membrane --- Certainty = 0.6519 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
33.2/53.9% over 181aa
Streptococcus pneumoniae
GP|5830535| histidine kinase Insert characterized
ORF00032(1309-1848 of 2253)
GP|5830535|emb|CAB54576.1||AJ006396(1-182 of 231) histidine kinase {Streptococcus
pneumoniae}
% Match = 5.9
% Identity = 33.2 % Similarity = 53.8
Matches = 61 Mismatches = 78 Conservative Sub.s = 38
1053       1083       1113       1143       1173       1203       1233       1263
FVVRKVALQDNILLYMYRPLIPVTLVV-
LFSLVSSVIIFVILRQKSRVLADRIAVICNTSSAINQMVLDMDAISRQEKSSIEL 1293       1323       1350       1380       1410       1440              1494
DSQDEFQYLSVQINQMVSRL-KDLHEKTLDLETQKLLFEKRMLEAQFNPHFLYNTLETILITSHYDSQ--LTERIVIQLT
|:  ||  |::|:      ||  :      | |:|| ||||:|||| : :   ||   | :  |: :::
MLDRLEKNIHD-IYQLELSQKDANMRALQAQINPHFMYNTLEFLRMYAVMQSQDELAD-IIYEFS
         10         20         30         40         50         60

1524       1554       1584       1611       1641       1671       1701       1728
KLLRYSLSGSTEAAVLKDDLAIIESYLLINQVRF-EELTYTISVSPELEHMRVPKLFLLPLIENAIKYGLKERH-DVAIN
||| ::|      :||   :|  ::|| |:|  |      ||||:|::|| ||||| ||:|  |:|  |   |
SLLRNNIS-DERETLLKQELEFCRKYSYLCMVRYPKSIAYGFKIDPELENMKIPKFTLQPLVENYFAHGVDHRRTDNVIS
         80         90        100        110        120        130        140

1758       1788       1818       1848       1878       1908       1938       1968
IDIWQDSDGIWFTVSNNGSGISLARQQAIRTMLRSTHSHHGLINSYRRLQYQFSTVLLEFTKTDDAFRVSYIVKE*VMYR
| :   :    | :||  |: :    ||   |   |  |   | | :|       |      |
IKALKQDGFVEILVVDNGRGMSAEKLANIREKLSQRYFEHQASYSDQRQSIGIVNVHERFVLYFGDRYAITIESAEQAGV
        160        170        180        190        200        210        220
```

SEQ ID 8588 (GBS47) was expressed in *E. coli* as a GST-fusion product. SDS-PAGE analysis of total cell extract is shown in FIG. 14 (lane 2; MW 84 kDa). It was also expressed in *E. coli* as a His-fusion product. SDS-PAGE analysis of total cell extract is shown in FIG. 85 (lane 4; MW 59.3 kDa).

Figure 221:
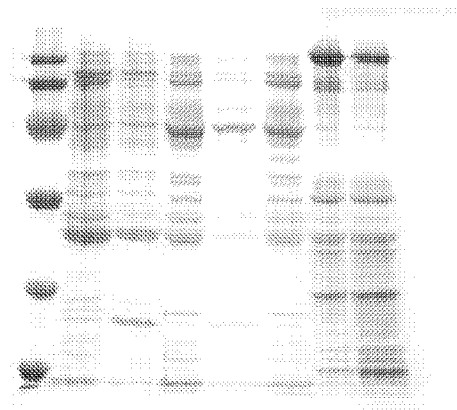

GBS47-His was purified as shown in FIG. 221, lane 4-5.

Based on this analysis, it was predicted that these proteins and their epitopes could be useful antigens for vaccines or diagnostics.

Example 509

A DNA sequence (GBSx0547) was identified in *S. agalactiae* <SEQ ID 1629> which encodes the amino acid sequence <SEQ ID 1630>. This protein is predicted to be phosphotransferase enzyme II, D component. Analysis of this protein sequence reveals the following:

Possible site: 32
>>> Seems to have no N-terminal signal sequence
INTEGRAL    Likelihood = −10.46    Transmembrane 258-274 (252-274)
INTEGRAL    Likelihood = −9.13     Transmembrane 232-248 (227-251)
INTEGRAL    Likelihood = −5.31     Transmembrane 142-158 (140-161)
INTEGRAL    Likelihood = −2.50     Transmembrane 119-135 (118-139)
----- Final Results -----
   bacterial membrane --- Certainty = 0.5182 (Affirmative) <succ>
   bacterial outside --- Certainty = 0.0000 (Not Clear) <succ>
      bacterial cytoplasm --- Certainty = 0.0000 (Not Clear) <succ>

The protein has homology with the following sequences in the GENPEPT database:

```
>GP:AAC74889 GB:AE000276 PTS enzyme IID, mannose-specific
[Escherichia coli K12]
Identities = 94/280 (33%), Positives = 156/280 (55%), Gaps = 13/280 (4%)

Query:     3  SQDNLTKEDRKMLRSVFWRSWTMNASRTGATQYHAVGVIYTLLPVINRFYKTDKD-KAEA    61
              ++ LT+ D  +R VF RS    S   + A+G ++++P I R Y + + +A
Sbjct:    12  TEKKLTQSD---IRGVFLRSNLFQGS-WNFERMQALGFCFSMVPAIRRLYPENNEARKQA   67

Query:    62  LVRHTTWFNATMHINNFIMGLVASMEKKNSEDPDFDASAITAVKASLMGPISGVGDSFFW  121
              + RH  +FN    +  I+G+ ++E++ +   + D  AI  +K  LMGP++GVGD  FW
Sbjct:    68  IRRHLEFFNTQPFVAAPILGVTLALEEQRANGAEIDDGAINGIKVGLMGPLAGVGDPIFW  127

Query:   122  GILRVIAAGIGISLASTGSAMGAVVFLLLYNIPAFLIHYYSLYGGYSVGAGFIKKLYESG  181
              G +R + A +G  +A +GS +G ++F +L+N+        YY + GYS G  +K +   G
Sbjct:   128  GTVRPVFAALGAGIAMSGSLLGPLLFFILFNLVRLATRYYGVAYGYSKGIDIVKDM-GGG  186

Query:   182  GIKIVTKTSSMLGLMMVGSM----TASNVKFKTILTVAAKGAKEAASIQSYLDQLFVGVV  237
              ++ +T+ +S+LGL ++G++      T   N+        G +   ++Q+ LDQL G+V
Sbjct:   187  FLQKLTEGASILGLFVMGALVNKWTHVNIPLVVSRITDQTGKEHVTTVQTILDQLMPGLV  246

Query:   238  PLLVTILAFWLLRKKVNINWIMFGIMVLGI---VLGLLGI                     274
              PLL+T    WLLRKKVN  WI+ G  V+GI     GLLG+
Sbjct:   247  PLLLTFACMWLLRKKVNPLWIIVGFFVIGIAGYACGLLGL                     286
```

A related DNA sequence was identified in *S. pyogenes* <SEQ ID 1631> which encodes the amino acid sequence <SEQ ID 1632>. Analysis of this protein sequence reveals the following:

Possible site: 32
>>> Seems to have no N-terminal signal sequence
INTEGRAL    Likelihood = −9.98     Transmembrane 255-271 (251-274)
INTEGRAL    Likelihood = −7.01     Transmembrane 232-248 (228-250)
INTEGRAL    Likelihood = −5.68     Transmembrane 142-158 (140-161)
INTEGRAL    Likelihood = −2.50     Transmembrane 119-135 (118-139)
----- Final Results -----
   bacterial membrane --- Certainty = 0.4991 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the databases:

```
>GP:AAC74889 GB:AE000276 PTS enzyme IID, mannose-specific [Escherichia coli]
Identities = 94/281 (33%), Positives = 157/281 (55%), Gaps = 13/281 (4%)

Query:     2  TSQDNLTKEDRKMLRSVFWRSWTMNASRTGATQYHAVGVIYTLLPVINRFYKTDKD-KAE    60
              T++ LT+ D  +R VF RS    S   + A+G ++++P I R Y + + +
Sbjct:    11  TTEKKLTQSD---IRGVFLRSNLFQGS-WNFERMQALGFCFSMVPAIRRLYPENNEARKQ   66

Query:    61  ALVRHTTWFNATMHINNFIMGLVASMEKKNSEDPDFDASAITAVKASLMGPISGVGDSFF  120
              A+ RH  +FN    +  I+G+ ++E++ +   + D  AI  +K  LMGP++GVGD  F
```

```
                    -continued
Sbjct:     67  AIRRHLEFFNTQPFVAAPILGVTLALEEQRANGAEIDDGAINGIKVGLMGPLAGVGDPIF  126

Query:    121  WGILRVIAAGIGISLASAGSAMGAVVFLLLYNIPAFIIHYYSLYGGYSVGAGFIKKLYES  180
               WG +R + A +G  +A +GS +G ++F +L+N+        YY + GYS G    +K +
Sbjct:    127  WGTVRPVFAALGAGIAMSGSLLGPLLFFILFNLVRLATRYYGVAYGYSKGIDIVKDM-GG  185

Query:    181  GGIKIVTKTSSMLGLMMVGSM----TASNVKFKTILTVAAKGAKEAASIQDYLDQLFIGI  236
               G ++ +T+ +S+LGL ++G++     T  N+              G +   ++Q LDQL    G+
Sbjct:    186  GFLQKLTEGASILGLFVMGALVNKWTHVNIPLVVSRITDQTGKEHVTTVQTILDQLMPGL  245

Query:    237  VPLMVTLAAFWLLRKKVNIIWIMFGIMFLGI---ILGLLGI                    274
               VPL++T A  WLLRKKVN +WI+ G    +GI       GLLG+
Sbjct:    246  VPLLLTFACMWLLRKKVNPLWIIVGFFVIGIAGYACGLLGL                    286
```

An alignment of the GAS and GBS proteins is shown below:

```
Identities = 263/275 (95%), Positives = 269/275 (97%)

Query:      1  MKSQDNLTKEDRKMLRSVFWRSWTMNASRTGATQYHAVGVIYTLLPVINRFYKTDKDKAE   60
               M SQDNLTKEDRKMLRSVFWRSWTMNASRTGATQYHAVGVIYTLLPVINRFYKTDKDKAE
Sbjct:      1  MTSQDNLTKEDRKMLRSVFWRSWTMNASRTGATQYHAVGVIYTLLPVINRFYKTDKDKAE   60

Query:     61  ALVRHTTWFNATMHINNFIMGLVASMEKKNSEDPDFDASAITAVKASLMGPISGVGDSFF  120
               ALVRHTTWFNATMHINNFIMGLVASMEKKNSEDPDFDASAITAVKASLMGPISGVGDSFF
Sbjct:     61  ALVRHTTWFNATMHINNFIMGLVASMEKKNSEDPDFDASAITAVKASLMGPISGVGDSFF  120

Query:    121  WGILRVIAAGIGISLASTGSAMGAVVFLLLYNIPAFLIHYYSLYGGYSVGAGFIKKLYES  180
               WGILRVIAAGIGISLAS GSAMGAVVFLLLYNIPAF+IHYYSLYGGYSVGAGFIKKLYES
Sbjct:    121  WGILRVIAAGIGISLASAGSAMGAVVFLLLYNIPAFIIHYYSLYGGYSVGAGFIKKLYES  180

Query:    181  GGIKIVTKTSSMLGLMMVGSMTASNVKFKTILTVAAKGAKEAASIQSYLDQLFVGVVPLL  240
               GGIKIVTKTSSMLGLMMVGSMTASNVKFKTILTVAAKGAKEAASIQ YLDQLF+G+VPL+
Sbjct:    181  GGIKIVTKTSSMLGLMMVGSMTASNVKFKTILTVAAKGAKEAASIQDYLDQLFIGIVPLM  240

Query:    241  VTILAFWLLRKKVNINWIMFGIMVLGIVLGLLGIC                          275
               VT+ AFWLLRKKVNI WIMFGIM  LGI+LGLLGIC
Sbjct:    241  VTLAAFWLLRKKVNIIWIMFGIMFLGIILGLLGIC                          275
```

There is also homology to SEQ ID 5236.

A further related DNA sequence was identified in *S. pyogenes* <SEQ ID 9077> which encodes the amino acid sequence <SEQ ID 9078>. An alignment of the GAS and GBS sequences follows:

Possible site: 56
>>> Seems to have an uncleavable N-term signal seq

```
Score = 178 bits (448), Expect = 3e-47
Identities = 83/136 (61%), Positives = 108/136 (79%)

Query:      2  IMEEITIYHNPNCGTSRNVLAMIRHAGIEPTIIEYLQTPPNRETLIELLQSMGISARELL   61
               +ME+I IYHNPNCGTSRNVLA+IRH GIEP II YL+TPP+R  L+ELL  M +SARELL
Sbjct:      1  MMEKIRIYHNPNCGTSRNVLAIIRHCGIEPEIIYYLKTPPSRMELVELLLEMKLSARELL   60

Query:     62  RTNVPEFEAYGLANQAVAEKDIINAMLADPILINRPIVVTRKGVKLCRPSETLLDILPVP  121
               RT+VP +E + L + +V ++++I+AM+ DPILINRPIVVT KG  KLCRP E +L ILPV
Sbjct:     61  RTDVPAYEKFNLESSSVTDEEMIDAMIQDPILINRPIVVTSKGAKLCRPCEAILTILPVK  120

Query:    122  LPSPYIKEDGESVNPI                                             137
                 +   ++KEDG+ +  +
Sbjct:    121  MEKDFVKEDGQIIQSL                                             136
```

Based on this analysis, it was predicted that these proteins and their epitopes could be useful antigens for vaccines or diagnostics.

Example 510

A DNA sequence (GBSx0548) was identified in *S. agalactiae* <SEQ ID 1633> which encodes the amino acid sequence <SEQ ID 1634>. This protein is predicted to be PTS permease for mannose subunit IIPMan. Analysis of this protein sequence reveals the following:

-continued

| INTEGRAL | Likelihood = −8.70 | Transmembrane 144-160 (140-165) |
| INTEGRAL | Likelihood = −8.07 | Transmembrane 220-236 (215-239) |
| INTEGRAL | Likelihood = −7.27 | Transmembrane 95-111 (91-116) |
| INTEGRAL | Likelihood = −3.77 | Transmembrane 2-18 (1-18) |
| INTEGRAL | Likelihood = −1.44 | Transmembrane 180-196 (179-196) |
| INTEGRAL | Likelihood = −1.33 | Transmembrane 32-48 (30-49) |
| INTEGRAL | Likelihood = −0.53 | Transmembrane 198-214 (198-214) |

----- Final Results -----
  bacterial membrane --- Certainty = 0.4482 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database:

```
>GP:AAC44680 GB:U65015 PTS permease for mannose subunit IIPMan [Vibrio furnissii]
Identities = 70/251 (27%), Positives = 132/251 (51%), Gaps = 6/251 (2%)

Query:     2  IMPATMAALAVLICFGGNYLTGQSMMERPLVVGLVTGMLLGDIKVGILMGASLEALFLGN    61
              +  A M L   + G +   G +    RP+V+G + G++LGD+  GIL+G +LE +++G
Sbjct:     5  LFQALMLGLLAFLA-GLDLFNGLTHFHRPVVLGPLVGLILGDLHTGILVGGTLELIWMGL    63

Query:    62  VNIGGVIAAEPVTATAMATTFTIISNIDQKAAMTLAVPIGMLAAFVVMFLKNVFMNIFAP   121
              + G      + T + TTF I +N++    A+ +AVP +     + L +    + +
Sbjct:    64  APLAGAQPPNVIIGTIVGTTFAITTNVEPNVAVGVAVPFAVAVQMGITLLFSAMSAVMSK   123

Query:   122  MVDKAAAANHQGKLVMLHYGTWII--YYLIIASISFIGILVGSGPVNSFVHHIPQNLMNG   179
              + A  A+ +G   + ++   ++  +Y + A   F+ I +G+     + V  +P+ L++G
Sbjct:   124  CDEYAKNADTRGIERVNYFALAVLGSFYFLCA---FLPIYLGADHAGAMVAALPKALIDG   180

Query:   180  LSAAGGLLPAVGFAMLMKLLWTNKLAVFYLLGFVLTAYLKLPAVAVAALGAVICVISSQR   239
              L  AGG++PA+GFA+LMK++  N      +++LGFV  A+L+LP +A+       + +I    R
Sbjct:   181  LGVAGGIMPAIGFAVLMKIMMKNAYIPYFILGFVAAAWLQLPILAIRCAATAMAIIDFMR   240

Query:   240  DIELDAITRGA                                                  250
               E   +    A
Sbjct:   241  KSEPTPVNASA                                                  251
```

A related DNA sequence was identified in *S. pyogenes* <SEQ ID 1635> which encodes the amino acid sequence <SEQ ID 1636>. Analysis of this protein sequence reveals the following:

```
Possible site: 56
>>> Seems to have an uncleavable N-term signal seq
INTEGRAL    Likelihood = -8.70    Transmembrane 144-160 (140-165)
INTEGRAL    Likelihood = -8.07    Transmembrane 220-236 (215-239)
INTEGRAL    Likelihood = -7.27    Transmembrane 95-111 (91-116)
INTEGRAL    Likelihood = -4.62    Transmembrane 2-18 (1-19)
INTEGRAL    Likelihood = -1.44    Transmembrane 180-196 (179-196)
INTEGRAL    Likelihood = -0.96    Transmembrane 32-48 (31-49)
INTEGRAL    Likelihood = -0.53    Transmembrane 198-214 (198-214)
----- Final Results -----
  bacterial membrane --- Certainty = 0.4482 (Affirmative) <succ>
     bacterial outside --- Certainty = 0.0000 (Not Clear) <succ>
        bacterial cytoplasm --- Certainty = 0.0000 (Not Clear) <succ>
```

The protein has homology with the following sequences in the databases:

```
>GP:AAC44680 GB:U65015 PTS permease for mannose subunit IIPMan [Vibrio furnissii]
Identities = 72/251 (28%), Positives = 132/251 (51%), Gaps = 6/251 (2%)

Query:     2  LVPATMAALAVLICFGGNYLTGQSMMERPLVVGLVTGLLLGDMKVGILMGASLEALFLGN    61
              L  A M L   + G +   G +    RP+V+G + GL+LGD+  GIL+G +LE +++G
Sbjct:     5  LFQALMLGLLAFLA-GLDLFNGLTHFHRPVVLGPLVGLILGDLHTGILVGGTLELIWMGL    63

Query:    62  VNIGGVIAAEPVTATAMATTFTIISHIDQKAAMTLAVPIGMLAAFVVMFLKNVFMNIFAP   121
              + G      + T + TTF I ++++    A+ +AVP +     + L +    + +
Sbjct:    64  APLAGAQPPNVIIGTIVGTTFAITTNVEPNVAVGVAVPFAVAVQMGITLLFSAMSAVMSK   123

Query:   122  MVDKAAAANHQGKLVMLHYGTWII--YYLIIASISFIGILVGSGPVNAFVEHIPQNLMNG   179
              + A  A+ +G   + ++   ++  +Y + A   F+ I +G+    A V  +P+ L++G
Sbjct:   124  CDEYAKNADTRGIERVNYFALAVLGSFYFLCA---FLPIYLGADHAGAMVAALPKALIDG   180

Query:   180  LSAAGGLLPAVGFAMLMKLLWTNKLAVFYLLGFVLTAYLKLPAVAVAALGAVICVISSQR   239
              L  AGG++PA+GFA+LMK++  N      +++LGFV  A+L+LP +A+       + +I    R
Sbjct:   181  LGVAGGIMPAIGFAVLMKIMMKNAYIPYFILGFVAAAWLQLPILAIRCAATAMAIIDFMR   240

Query:   240  DLELDAITRGA                                                  250
               E   +    A Sbjct:   241  KSEPTPVNASA                                                  251
```

An alignment of the GAS and GBS proteins is shown below:

Identities = 261/269 (97%), Positives = 268/269 (99%)

```
Query:     1  MIMPATMAALAVLICFGGNYLTGQSMMERPLVVGLVTGMLLGDIKVGILMGASLEALFLG    60
              M++PATMAALAVLICFGGNYLTGQSMMERPLVVGLVTG+LLGD+KVGILMGASLEALFLG
Sbjct:     1  MLVPATMAALAVLICFGGNYLTGQSMMERPLVVGLVTGLLLGDMKVGILMGASLEALFLG    60

Query:    61  NVNIGGVIAAEPVTATAMATTFTIISNIDQKAAMTLAVPIGMLAAFVVMFLKNVFMNIFA   120
              NVNIGGVIAAEPVTATAMATTFTIIS+IDQKAAMTLAVPIGMLAAFVVMFLKNVFMNIFA
Sbjct:    61  NVNIGGVIAAEPVTATAMATTFTIISHIDQKAAMTLAVPIGMLAAFVVMFLKNVFMNIFA   120

Query:   121  PMVDKAAAANHQGKLVMLHYGTWIIYYLIIASISFIGILVGSGPVNSFVHHIPQNLMNGL   180
              PMVDKAAAANHQGKLVMLHYGTWIIYYLIIASISFIGILVGSGPVN+FV HIPQNLMNGL
Sbjct:   121  PMVDKAAAANHQGKLVMLHYGTWITYYLIIASISFIGILVGSGPVNAFVEHIPQNLMNGL   180

Query:   181  SAAGGLLPAVGFAMLMKLLWTNKLAVFYLLGFVLTAYLKLPAVAVAALGAVICVISSQRD   240
              SAAGGLLPAVGFAMLMKLLWTNKLAVFYLLGFVLTAYLKLPAVAVAALGAVICVISSQRD
Sbjct:   181  SAAGGLLPAVGFAMLMKLLWTNKLAVFYLLGFVLTAYLKLPAVAVAALGAVICVISSQRD   240

Query:   241  IELDAITRGAISKQTTFDSKESEEEDFFA                                 269
              +ELDAITRGAISKQTTFDSKESEEEDFFA
Sbjct:   241  LELDAITRGAISKQTTFDSKESEEEDFFA                                 269
```

Based on this analysis, it was predicted that these proteins and their epitopes could be useful antigens for vaccines or diagnostics.

Example 511

A DNA sequence (GBSx0549) was identified in *S. agalactiae* <SEQ ID 1637> which encodes the amino acid sequence <SEQ ID 1638>. This protein is predicted to be pts system, sorbose-specific iib component. Analysis of this protein sequence reveals the following:

Possible site: 36
>>> Seems to have no N-terminal signal sequence
----- Final Results -----
   bacterial cytoplasm --- Certainty = 0.1874 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database:

A related DNA sequence was identified in *S. pyogenes* <SEQ ID 1639> which encodes the amino acid sequence <SEQ ID 1640>. Analysis of this protein sequence reveals the following:

Possible site: 36
>>> Seems to have no N-terminal signal sequence
----- Final Results -----
   bacterial cytoplasm --- Certainty = 0.1874 (Affirmative) <succ>
   bacterial membrane --- Certainty = 0.0000 (Not Clear) <succ>
   bacterial outside --- Certainty = 0.0000 (Not Clear) <succ>

```
>GP:CAA46858 GB:X66059 EIII-B Sor PTS [Klebsiella pneumoniae]
Identities = 49/158 (31%), Positives = 94/158 (59%), Gaps = 8/158 (5%)

Query:     2  ITQIRVDDRLIHGQVAVVWTKELNAPLLVVANDEAAKNEITQMTLKMAVPNGMKLLIRSV    61
              IT  R+DDRLIHGQV  VW+K  NA  +++ ND+   +E+ +  L+ A P GMK+ + S+
Sbjct:     3  ITLARIDDRLIHGQVTTVWSKVANAQRIIICNDDVFNDEVRRTLLRQAAPPGMKVNVVSL    62

Query:    62  EESIALFKDPRATDKRIFVIVNSVKDACTIAKNITDLEAVNVANVGRFDKSDPATKVKLT   121
              E+++A++ +P+  D+ +F + +  D  T+ +     +N+ +       +  K +LT
Sbjct:    63  EKAVAVYHNPQYQDETVFYLFTNPHDVLTMVRQGVQIATLNIGGM-----AWRPGKKQLT   117

Query:   122  SSLLLNTEELEAAKELASL-PDLDVFNQVLPSNTKVNL                        158
              ++ L+ ++++A +EL  L   LD+  +V+ S+   VN+
Sbjct:   118  KAVSLDPQDIQAFRELDKLGVKLDL--RVVASDPSVNI                        153
```

An alignment of the GAS and GBS proteins is shown below:

```
Identities = 145/162 (89%), Positives = 152/162 (93%)
Query:     1  MITQIRVDDRLIHGQVAVVWTKELNAPLLVVANDEAAKNEITQMTLKMAVPNGMKLLIRS    60
              MITQIRVDDRLIHGQVAVVWTKELNAPLLVVANDEAAKNEITQMTLKMAVPNGMKLLIRS
Sbjct:     1  MITQIRVDDRLIHGQVAVVWTKELNAPLLVVANDEAAKNEITQMTLKMAVPNGMKLLIRS    60
```

```
-continued
Query:   61  VEESIALFKDPRATDKRIFVIVNSVKDACTIAKNITDLEAVNVANVGRFDKSDPATKVKL  120
             VE+SI LF DPRA DKRIFVIVNSVKDAC IAK + DLEAVNVANVGRFDKSDPA+KVK+
Sbjct:   61  VEDSIKLFNDPRAKDKRIFVIVNSVKDACAIAKEVPDLEAVNVANVGRFDKSDPASKVKV  120

Query:  121  TSSLLLNTEELEAAKELASLPDLDVFNQVLPSNTKVNLSQLV                    162
             T SLLLN EE+ AAKEL SLP+LDVFNQVLPSNTKV+LSQLV
Sbjct:  121  TPSLLLNPEEMAAAKELVSLPELDVFNQVLPSNTKVHLSQLV                    162
```

Based on this analysis, it was predicted that these proteins and their epitopes could be useful antigens for vaccines or diagnostics.

Example 512

A DNA sequence (GBSx0550) was identified in *S. agalactiae* <SEQ ID 1641> which encodes the amino acid sequence <SEQ ID 1642>. Analysis of this protein sequence reveals the following:

```
Possible site: 46
>>> Seems to have no N-terminal signal sequence
INTEGRAL    Likelihood = -1.22    Transmembrane 87-103 (87-104)
----- Final Results -----
   bacterial membrane --- Certainty = 0.1489 (Affirmative) <succ>
     bacterial outside --- Certainty = 0.0000 (Not Clear) <succ>
    bacterial cytoplasm --- Certainty = 0.0000 (Not Clear) <succ>
```

The protein has no significant homology with any sequences in the GENPEPT database.

A related DNA sequence was identified in *S. pyogenes* <SEQ ID 1643> which encodes the amino acid sequence <SEQ ID 1644>. Analysis of this protein sequence reveals the following:

```
Possible site: 33
>>> Seems to have no N-terminal signal sequence
INTEGRAL    Likelihood = -1.44    Transmembrane 87-103 (87-104)
----- Final Results -----
   bacterial membrane --- Certainty = 0.1574 (Affirmative) <succ>
     bacterial outside --- Certainty = 0.0000 (Not Clear) <succ>
    bacterial cytoplasm --- Certainty = 0.0000 (Not Clear) <succ>
```

The protein has no significant homology with any sequences in the GENPEPT database.

An alignment of the GAS and GBS proteins is shown below:

```
Identities = 115/141 (81%), Positives = 125/141 (88%)

Query:    1  MKRKFLIGSHGKLASGLQSSIDILTGKGQEIQTIDAYIDDSDYTKSIVEFIDEIAPDEQG   60
             MKRKFLIGSHG+LASGLQSSIDIL G GQ ++TIDAY+DDSDYT   I +FI   +A DEQG Sbjct:    1  MKRKFLIGSHGRLASGLQSSIDILAGMGQALETIDAYVDDSDYTSQIDDFIAGVAADEQG   60

Query:   61  LIFTDLLGGSVNQKMATAVMNSGKNNIFLITNSNLATLLSLLFLKPEEELTKEEIVTVIN  120
             LIFTDLLGGSVNQKM TAVMNSGK+NIFLITNSNLATLLSL+FLKP E LTK+EIVTVIN Sbjct:   61  LIFTDLLGGSVNQKMVTAVMNSGKDNIFLITNSNLATLLSLVFLKPGEALTKDEIVTVIN  120

Query:  121  ESQVQLVDLSFKAGSEDDFFD                                         141
             ESQVQLVDL + SEDDFFD
Sbjct:  121  ESQVQLVDLVPETNSEDDFFD                                         141
```

Based on this analysis, it was predicted that these proteins and their epitopes could be useful antigens for vaccines or diagnostics.

Example 513

A DNA sequence (GBSx0551) was identified in *S. agalactiae* <SEQ ID 1645> which encodes the amino acid sequence <SEQ ID 1646>. Analysis of this protein sequence reveals the following:

```
Possible site: 25
>>> Seems to have no N-terminal signal sequence
----- Final Results -----
   bacterial cytoplasm --- Certainty = 0.2469 (Affirmative) <succ>
    bacterial membrane --- Certainty = 0.0000 (Not Clear) <succ>
     bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 514

A DNA sequence (GBSx0552) was identified in *S. agalactiae* <SEQ ID 1647> which encodes the amino acid sequence <SEQ ID 1648>. This protein is predicted to be racemase. Analysis of this protein sequence reveals the following:

```
Possible site: 41
>>> Seems to have no N-terminal signal sequence
INTEGRAL    Likelihood = -8.65    Transmembrane 319-335 (316-339)
INTEGRAL    Likelihood = -6.10    Transmembrane 18-34 (17-37)
INTEGRAL    Likelihood = -5.68    Transmembrane 230-246 (227-248)
INTEGRAL    Likelihood = -3.98    Transmembrane 254-270 (254-271)
INTEGRAL    Likelihood = -3.56    Transmembrane 110-126 (110-129)
INTEGRAL    Likelihood = -3.19    Transmembrane 161-177 (156-177)
INTEGRAL    Likelihood = -1.97    Transmembrane 132-148 (132-153)
```

```
INTEGRAL    Likelihood = −1.33    Transmembrane 286-302 (286-302)
INTEGRAL    Likelihood = −0.59    Transmembrane 53-69 (52-69)
----- Final Results -----
    bacterial membrane --- Certainty = 0.4461 (Affirmative) <succ>
      bacterial outside --- Certainty.0.0000 (Not Clear) <succ>
        bacterial cytoplasm --- Certainty = 0.0000 (Not Clear) <succ>
```

The protein has homology with the following sequences in the GENPEPT database:

```
>GP:AAF71283 GB:AF253562 racemase [Enterococcus faecalis]
Identities = 78/262 (29%), Positives = 129/262 (48%), Gaps = 29/262 (11%)
Query:  13  KQHNTSMISLLQYLFSILVILVHSGRLFS-QDVIHFTFKSFLGRMAVPYFLICTAFFLRG   71
            K + S I   +++ ++L++ +H+  LFS  +  +F F    +  +AVP+F + + FFL
Sbjct:   3  KNESYSGIDYFRFIAALLIVAIHTSPLFSFSETGNFIFTRIVAPVAVPFFFMTSGFFL--   60

Query:  72  RIQQGLCNHSYFRKLIKK----YSMWTIIYLPY----GYFFFESLNIAKIYLLPGFIVAF  123
             I +   CN       IKK    Y +   ++Y+P      GYF  ++L       LP  I
Sbjct:  61  -ISRYTCNAEKLGAFIKKTTLIYGVAILLYIPINVYNGYFKMDNL-------LPNIIKDI  112

Query: 124  LYLGMSHTLWYIPAVILGWVIIQGLLKYVGTRGTFITVVVLYCIGAV-ETYSVFIQSTKF  182
            ++  G  + LWY+PA I+G  I     L+K V  R  F+    +LY IG    ++Y   ++S
Sbjct: 113  VFDGTLYHLWYLPASIIGAAIAWYLVKKVHYRKAFLIASILYIIGLFGDSYYGIVKSVSC  172

Query: 183  YPLMSTYMSIFQT---TRNGLFYTPVYLLAGYLLYDYFNTDLFTKSRGLK-YILFLLLLA  238
                L   Y  IFQ      TRNG+F+  P++ + G  + D  + + +  K   ++ Y LF L+
Sbjct: 173  --LNVFYNLIFQLTDYTRNGIFFAPIFFVLGGYISD--SPNRYRKKNYIRIYSLFCLMFG  228

Query: 239  LENVLIYFN-QGLDKNFFLLAP                                        259
            L +F+ Q  D   + LL P
Sbjct: 229  KTLTLQHFDIQKHDSMYVLLLP                                         250
```

No corresponding DNA sequence was identified in *S. pyogenes*.

A related GBS gene <SEQ ID 8589> and protein <SEQ ID 8590> were also identified. Analysis of this protein sequence reveals the following:

```
Lipop: Possible site: −1   Crend: 7
McG: Discrim Score: 0.23
GvH: Signal Score (−7.5): −5.77
Possible site: 34
>>> Seems to have an uncleavable N-term signal seq
ALOM program count: 3   value: −5.68   threshold: 0.0
```

```
-continued
INTEGRAL    Likelihood = −5.68    Transmembrane 41-57 (38-59)
INTEGRAL    Likelihood = −3.98    Transmembrane 65-81 (65-82)
INTEGRAL    Likelihood = −1.33    Transmembrane 97-113 (97-113)
PERIPHERAL  Likelihood = 5.78    10
modified ALOM score: 1.64
*** Reasoning Step: 3
----- Final Results -----
    bacterial membrane --- Certainty = 0.3272 (Affirmative) <succ>
      bacterial outside --- Certainty = 0.0000 (Not Clear) <succ>
        bacterial cytoplasm --- Certainty = 0.0000 (Not Clear) <succ>
```

A related GBS gene <SEQ ID 8591> and protein <SEQ ID 8592> were also identified. Analysis of, this protein sequence reveals the following:

```
Lipop: Possible site: −1   Crend: 5
McG: Discrim Score: 11.50
GvH: Signal Score (−7.5): −2.69

Possible site: 32
>>> Seems to have an uncleavable N-term signal seq
ALOM program    count: 9  value: −8.65    threshold: 0.0
INTEGRAL        Likelihood = −8.65        Transmembrane 310-326 (307-330)
INTEGRAL        Likelihood = −6.10        Transmembrane 9-25 (8-28)
INTEGRAL        Likelihood = −5.68        Transmembrane 221-237 (218-239)
INTEGRAL        Likelihood = −3.98        Transmembrane 245-261 (245-262)
INTEGRAL        Likelihood = −3.56        Transmembrane 101-117 (101-120)
INTEGRAL        Likelihood = −3.19        Transmembrane 152-168 (147-168)
INTEGRAL        Likelihood = −1.97        Transmembrane 123-139 (123-144)
INTEGRAL        Likelihood = −1.33        Transmembrane 277-293 (277-293)
INTEGRAL        Likelihood = −0.59        Transmembrane 44-60 (43-60)
PERIPHERAL      Likelihood = 5.78         190
modified ALOM score: 2.23

*** Reasoning Step: 3
----- Final Results -----
    bacterial membrane --- Certainty = 0.4461 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the databases:

```
ORF00153(307-1140 of 1632)
GP|7960293|gb|AAF71283.1|AF253562_7|AF253562(2-284 of 711)racemase (Enterococcus
faecalis}
% Match = 8.5
% Identity = 32.7 % Similarity = 54.0
Matches = 91 Mismatches = 113 Conservative Sub.s = 59

150       180       210       240       270       300       330       360
CEISFFIS*YG**GINNNYQIPFKAFQ*LFGIIEIFF*RDWYHSNDNL*KVMLRMKRSQCVDNKQHNTSMISMILLQYLFSI
                                                  |   :  | |   ::::  ::
                                                  MTKNESYSGIDYFRFIAAL
                                                         10

390       417       447       477       507       537       555
LVILVHSGRLFS-QDVIHFTFKSFLGRMAVPYFLICTAFFLRGRIQQGLCNHSYFRKLIKK----YSMWTIIYLP---Y-
|::  :|:  |||   :  ||   :   :|||:|::  :  |||    |   :  ||    :  :|||       |  :  ::|:|    |
LIVAIHTSPLFSFSETGNFIFTRIVAPVAVPFFFMTSGFFL---ISRYTCNAEKLGAFIKKTTLIYGVAILLYIPINVYN
         30        40        50        60        70        80        90

603       633       663       693       723       753       783       810
GYFFFESLNIAKIYLLPGFIVAFLYLGMSHTLWYIPAVILGWVIIQGLLKYVGTRGTFITVVVLYCIGAV-ETYSVFIQS
|||   ::|      ||  |   ::  |   :  |||:||  |:|   |     |:|    |   |:     :|| ||    ::|     ::|
GYFKMDNL-------LPNIIKDIVFDGTLYHLWYLPASIIGAAIAWYLVKKVHYRKAFLIASILYIIGLFGDSYYGIVKS
                110       120       130       140       150       160

840       891       921       951       978      1008      1035
TKFYPLMSTYMSIFQTT---RNGLFYTPVYLLAGYLLDYFNTDLFTKSRGLK-YILFLLLLALENVLIYFN-QGLDKNF
    |    |   |||    |||:|:  |::::   |   :  |      :  |   ::  |  || |::    |    |:|   |    :
--VSCLNVFYNLIFQLTDYTRNGIFFAPIFFVLGGYISDSPNR--YRKKNYIRIYSLFCLMFGKTLTLQHFDIQKHDSMY
        180       190       200       210       220       230       240

1053      1080      1110      1140      1170      1200      1230      1260
FLLAP----LCAVFL-FNWSIRTSLFKEYRLSPLKQLSVYYFFLPPLFIGIVSYCLKSTSLVAHHQGKVIFVVTLALTHA
 || |        |   ::|  |         ||| |  :     |    |  :  |||
VLLLPSVWCLFNLLLHFRGKRRTGL-RTISLDQLYHSSVYDCCNTIVCAELLHLQSLLVENSLVHYIAVCFASVVLAVVI
        260       270       280       290       300       310       320
```

Based on this analysis, it was predicted that these proteins and their epitopes could be useful antigens for vaccines or diagnostics.

Example 515

A DNA sequence (GBSx0553) was identified in S. agalactiae <SEQ ID 1649> which encodes the amino acid sequence <SEQ ID 1650>. Analysis of this protein sequence reveals the following:

Possible site: 43
>>> Seems to have no N-terminal signal sequence
----- Final Results -----
    bacterial cytoplasm --- Certainty = 0.3088 (Affirmative) <succ>
       bacterial membrane --- Certainty = 0.0000 (Not Clear) <succ>
          bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 516

A DNA sequence (GBSx0554) was identified in S. agalactiae <SEQ ID 1651> which encodes the amino acid sequence <SEQ ID 1652>. Analysis of this protein sequence reveals the following:

Possible site: 35
>>> Seems to have no N-terminal signal sequence
----- Final Results -----
    bacterial cytoplasm --- Certainty = 0.1446 (Affirmative) <succ>
       bacterial membrane --- Certainty = 0.0000 (Not Clear) <succ>
          bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 517

A DNA sequence (GBSx0555) was identified in S. agalactiae <SEQ ID 1653> which encodes the amino acid sequence <SEQ ID 1654>. Analysis of this protein sequence reveals the following:

Lipop: Possible site: -1 Crend: 10
McG: Discrim Score: 8.28
GvH: Signal Score (-7.5): -2.11
Possible site: 20
>>> Seems to have a cleavable N-term signal seq.
ALOM program count: 6 value: -8.33 threshold:0.0

```
INTEGRAL      Likelihood = –8.33 Transmembrane 358-374 (354-376)
INTEGRAL      Likelihood = –8.23 Transmembrane 264-280 (257-290)
INTEGRAL      Likelihood = –6.37 Transmembrane 210-226 (206-232)
INTEGRAL      Likelihood = –5.95 Transmembrane 163-179 (160-180)
INTEGRAL      Likelihood = –5.10 Transmembrane 23-39 (21-40)
INTEGRAL      Likelihood = –1.70 Transmembrane 297-313 (296-314)
PERIPHERAL Likelihood = 1.75    322
modified ALOM score: 2.17
*** Reasoning Step: 3
----- Final Results -----
    bacterial membrane --- Certainty = 0.4333 (Affirmative) <succ>
       bacterial outside --- Certainty = 0.0000 (Not Clear) <succ>
        bacterial cytoplasm --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 518

A DNA sequence (GBSx0556) was identified in *S. agalactiae* <SEQ ID 1655> which encodes the amino acid sequence <SEQ ID 1656>. This protein is predicted to be ABC transporter (ATP-bindingprot). Analysis of this protein sequence reveals the following:

```
Possible site: 59
>>> Seems to have no N-terminal signal sequence
----- Final Results -----
    bacterial cytoplasm --- Certainty = 0.1510 (Affirmative) <succ>
     bacterial membrane --- Certainty = 0.0000 (Not Clear) <succ>
       bacterial outside --- Certainty = 0.0000 (Not Clear) <succ>
```

A related GBS nucleic acid sequence <SEQ ID 10199> which encodes amino acid sequence <SEQ ID 10200> was also identified.

The protein has homology with the following sequences in the GENPEPT database:

```
>GP:CAB88481 GB:AL353816 putative ABC transport system ATP-binding
protein [Streptomyces coelicolor A3(2)]
Identities = 104/284 (36%), Positives = 159/284 (55%), Gaps = 18/284 (6%)
Query:   6  TMLLQLDNITKSYGKKIVLNQISYQFTPGLYGLLGANGTGKTTLLNLMSHFTLADSGNIY   65
            T  +    ++  YG+    L+ +S + TPG+ GLLG NG GKTTLL +++       AD G
Sbjct:   2  TPTVSASGLSLHYGRTRALDDVSLRLTPGVTGLLGPNGAGKTTLLRVLATAVPADRGAFT   61

Query:  66  WNGQEQS-----EEFYRHIGFLPQHFRYYDQFTGIAFLNYIATLKGV-DKKKAKQEIPRL  119
            G +           +E  R +G+LPQ     ++   FT    F++Y+A LK + D+++   +E+ R+
Sbjct:  62  VLGHDPGSSRGRQEVRRRLGYLPQTPGFHPDFTAFEFVDYVAILKELADRRERHREVRRV  121

Query: 120  LELVGLGDVGKKISSYSGGMKQRLGIAQALINDPEILILDEPTVGLDPKERVKFRHILS  179
            LE V LG+V  ++I     SGGM+QR+ +A AL+ DP  L+LDEPTVGLDP++R++FR   +++
Sbjct: 122  LEEVDLGEVRGRRIKKLSGGMRQRVALAAALVGDPGFLVLDEPTVGLDPEQRMRFRELIA  181

Query: 180  QLSTNKIIILSTHIVSDVEAVAKEIIVLKNGKFIEHGNTAQLLKTIEGKVWEIT-TEPGL  238
               + ++LSTH   DV +   +IV+  G      G   A+L     G+VW  T   +PG
Sbjct: 182  GAGEGRTVLLSTHQTEDVAMLCHRVIVMAAGAVRFDGTPAELTARAAGRVWSSTEKDPG-  240

Query: 239  SQIPNIAIVNEKVFSDSRVFRVVSDICPSDSAQLVVPTLEDFYI                 282
                     A    + S  FR V D   P   A+      PTLED Y+
Sbjct: 241  ------AKAGWRTGTGS--FRNVGD--PPPGAEPAEPTLEDGYL                 274
```

There is also homology to SEQ ID 686.

Based on this analysis, it was predicted that these proteins and their epitopes could be useful antigens for vaccines or diagnostics.

Example 519

A DNA sequence (GBSx0557) was identified in *S. agalactiae* <SEQ ID 1657> which encodes the amino acid sequence <SEQ ID 1658>. This protein is predicted to be response regulator. Analysis of this protein sequence reveals the following:

```
Possible site: 38
>>> Seems to have no N-terminal signal sequence
----- Final Results -----
    bacterial cytoplasm --- Certainty = 0.3781 (Affirmative) <succ>
     bacterial membrane --- Certainty = 0.0000 (Not Clear) <succ>
       bacterial outside --- Certainty = 0.0000 (Not Clear) <succ>
```

The protein has homology with the following sequences in the GENPEPT database:

```
>GP:CAC10170 GB:AJ278301 response regulator [Streptococcus pneumoniae]
Identities = 136/242 (56%), Positives = 183/242 (75%)
Query:   1 MNIFILEDDFVQQAHFEKIIKEIRVQYNLHFKTVETFAKPVQLLESIYEIGLHNLFFLDI   60
           M IF+LEDDF QQ   E  I+++  ++++   + E F KP QLL  ++E G H LFFLDI
Sbjct:   1 MRIFVLEDDFSQQTRIETTIEKLLKEHHITLSSFEVFGKPDQLLAEVHEKGAHQLFFLDI   60

Query:  61 EIKNDEQMGLEVAKQIRQVDPYAQIVFVTTHSELMPLTFRYQVSALDYIDKGLSQEEFSQ  120
           EI+N+E  GLEVA++IR+ DPYA IVFVTTHSE MPL+FRYQVSALDYIDK LS EEF
Sbjct:  61 EIRNEEMKGLEVARKIREQDPYALIVFVTTHSEFMPLSFRYQVSALDYIDKALSAEEFES  120

Query: 121 RIEEVLLYVDGICNKPLVENSFYFKSRYSQVQLPFNDLLYIETSSRSHRVVLYTEKDRME  180
           RIE  LLY +    +K L E+ FYFKS+++Q Q PF ++ Y+ETS R HRV+LYT+ DR+E
Sbjct: 121 RIETALLYANSQDSKSLAEDCFYFKSKFAQFQYPFKEVYYLETSPRPHRVILYTKTDRLE  180

Query: 181 FTATLGDILKQEPRLFQCHRSFLVNPLNIFKVDRIDRLVYFQNGTTCLVSRNKVRDIVSI  240
           FTA+L  ++ KQEPRL QCHRSFL+NP N+   +D+ ++L++F NG +CL++R KVR++
Sbjct: 181 FTASLEEVFKQEPRLLQCHRSFLINPANVVHLDKKEKLLFFPNGGSCLIARYKVREVSEA  240

Query: 241 VD                                                           242
           ++
Sbjct: 241 IN                                                           242
```

A related DNA sequence was identified in *S. pyogenes* <SEQ ID 1659> which encodes the amino acid sequence <SEQ ID 1660>. Analysis of this protein sequence reveals the following:

Possible site: 44
>>> Seems to have no N-terminal signal sequence
----- Final Results -----
   bacterial cytoplasm --- Certainty = 0.2098 (Affirmative) <succ>
     bacterial membrane --- Certainty = 0.0000 (Not Clear) <succ>
      bacterial outside --- Certainty = 0.0000 (Not Clear) <succ>

An alignment of the GAS and GBS proteins is shown below:

```
Identities = 106/235 (45%), Positives = 159/235 (67%)
Query:   1 MNIFILEDDFVQQAHFEKIIKEIRVQYNLHFKTVETFAKPVQLLESIYEIGLHNLFFLDI   60
           MNIFILEDDF+QQ     E I+  I +  +     +E F+ P +L ESI E G H L+FLDI
Sbjct:   2 MNIFILEDDFIQQTRIESIVVGILKETRIPCNQLEVFSTPQKLFESIQERGDHQLYFLDI   61

Query:  61 EIKNDEQMGLEVAKQIRQVDPYAQIVFVTTHSELMPLTFRYQVSALDYIDKGLSQEEFSQ  120
           EI   + GLE+A   IRQ DP A IVFVTTHSE  P++F+Y+VSALD+IDK   Q++F +
Sbjct:  62 EIGEYTRCGLELAAAIRQKDPNAVIVFVTTHSEFAPISFKYKVSALDFIDKAGGQKQFKE  121

Query: 121 RIEEVLLYVDGICNKPLVENSFYFKSRYSQVQLPFNDLLYIETSSRSHRVVLYTEKDRME  180
           +IEE + Y   + +    ++ F F++ ++++LP+ D+LY   T++  H+V L+T+ +R+E
Sbjct: 122 QIEECIRYTYDMMSSRESKDMFLFETPQTRLKLPYKDILYFATATTPHKVCLWTQTERLE  181

Query: 181 FTATLGDILKQEPRLFQCHRSFLVNPLNIFKVDRIDRLVYFQNGTTCLVSRNKVR       235
           F    L +I     P+LF CHRS+LVN    +  ++D+   +L+YF+NG +C+VSR K++
Sbjct: 182 FYGNLSEIQAVAPKLFLCHRSYLVNLDKVVRIDKSKQLLYFENGDSCMVSRLKMK       236
```

Based on this analysis, it was predicted that these proteins and their epitopes could be useful antigens for vaccines or diagnostics.

Example 520

A DNA sequence (GBSx0558) was identified in *S. agalactiae* <SEQ ID 1661> which encodes the amino acid sequence <SEQ ID 1662>. Analysis of this protein sequence reveals the following:

Possible site: 57
>>> Seems to have no N-terminal signal sequence
----- Final Results -----
   bacterial cytoplasm --- Certainty = 0.2651 (Affirmative) <succ>
     bacterial membrane --- Certainty = 0.0000 (Not Clear) <succ>
      bacterial outside --- Certainty = 0.0000 (Not Clear) <succ>

The protein has no significant homology with any sequences in the GENPEPT database.

A related DNA sequence was identified in *S. pyogenes* <SEQ ID 1663> which encodes the amino acid sequence <SEQ ID 1664>. Analysis of this protein sequence reveals the following:

Possible site: 25
>>> Seems to have no N-terminal signal sequence
----- Final Results -----
   bacterial cytoplasm --- Certainty = 0.0535 (Affirmative) <succ>
     bacterial membrane --- Certainty = 0.0000 (Not Clear) <succ>
      bacterial outside --- Certainty = 0.0000 (Not Clear) <succ>

An alignment of the GAS and GBS proteins is shown below:

```
Identities = 177/269 (65%), Positives = 219/269 (80%)
Query:   6 MAKCLTLNTHSWMEVNALKKLFDLAEHIFREKYDIICLQEVNQSISSPLAKSSPNYHPIE  65
           M K LTLNTHSWM+ N LKKL  LAEHI  EKYDIICLQE+NQ I S LA   P Y +
Sbjct:   1 MTKVLTLNTHSWMQANTLKELVALAEHILAEKYDIICLQEINQLIESELATDLPRYQALS  60

Query:  66 GTPALHQDNFALQLVHYLNLQGLHYHNTWAYNHIGYSKYHEGVAILSLKPLKPEDILVSA 125
           GTP++H+D+FAL L+HYL  +G HY+W+WAYNHIGY  Y EGVAILS +P+    DILVSA
Sbjct:  61 GTPSIHKDHFALLLIHYLQKRGQHYYWSWAYNHIGYDIYQEGVAILSKQPIHVSDILVSA 120

Query: 126 VDDETDYHTRRALVAETTLNDKVVTVVSLHFSWFEKGFAEEWKRLETTLLEVETPLLLMG 185
           +DDETDYHTRR+L+A+TTL+ K V VV++H SWF+KGF  EW++LE  LL +  PLLLMG
Sbjct: 121 MDDETDYHTRRSLIAKTTLDGKEVAVVNVHLSWFDKGFLGEWEKLEKELLTLNCPLLLMG 180

Query: 186 DFNNPTGNQGYELVLNSPLALKDSHQIANHVFGDHTIMADIDGWEGNKKALKVDHIFTSE 245
           DFNNPT   GY++++ SPL L+DSH+ A+HVFGDH+I+ADIDGW+GNK+ALKVDH+FTS+
Sbjct: 181 DFNNPTDQDGYQVMMGSPLDLQDSHKGADHVFGDHSIVADIDGWQGNKEALKVDHVFTSK 240

Query: 246 DLSISSSQVVFEGGEAPVVSDHYGLEITM                               274
           D  I SS++ FEGG+APVVSDHYGLE+T+
Sbjct: 241 DFIIRSSKITFEGGDAPVVSDHYGLEVTL                               269
```

Based on this analysis, it was predicted that these proteins and their epitopes could be useful antigens for vaccines or diagnostics.

Example 521

A DNA sequence (GBSx0559) was identified in *S. agalactiae* <SEQ ID 1665> which encodes the amino acid sequence <SEQ ID 1666>. This protein is predicted to be PTS system, glucose-specific enzyme II, A component (ptsG). Analysis of this protein sequence reveals the following:

Possible site: 37
>>> Seems to have no N-terminal signal sequence
INTEGRAL   Likelihood = −8.07   Transmembrane 193-209 (189-217)

-continued

| INTEGRAL | Likelihood = −7.86 | Transmembrane 28-44 (24-48) |
| INTEGRAL | Likelihood = −6.48 | Transmembrane 431-447 (421-449) |
| INTEGRAL | Likelihood = −2.92 | Transmembrane 153-169 (153-170) |
| INTEGRAL | Likelihood = −2.81 | Transmembrane 93-109 (93-111) |
| INTEGRAL | Likelihood = −2.39 | Transmembrane 370-386 (370-388) |
| INTEGRAL | Likelihood = −2.28 | Transmembrane 68-84 (68-84) |

----- Final Results -----
bacterial membrane --- Certainty = 0.4227 (Affirmative) <succ>
bacterial outside --- Certainty = 0.0000 (Not Clear) <succ>
bacterial cytoplasm --- Certainty = 0.0000 (Not Clear) <succ>

A related GBS nucleic acid sequence <SEQ ID 10201> which encodes amino acid sequence <SEQ ID 10202> was also identified.

The protein has homology with the following sequences in the GENPEPT database:

```
>GP:AAD00281 GB:U78600 putative ptsG protein [Streptococcus mutans]
Identities = 294/409 (71%), Positives = 342/409 (82%), Gaps = 7/409 (1%)
Query: 293 DLINLKGS-NSSQYHHLLTSVTPARFKVGQMIGASGILMGLSYAMYRNVDKDKKLKYKSM 351
           DLI+LKG+ + SQYHHLLTSVTPARFKVGQMIG+SGILMGL+ AMYRNVD DKK KYK M
Sbjct:   3 DLIHLKGAGHMSQYHHLLTSVTPARFKVGQMIGSSGILMGLTLAMYRNVDPDKKEKYKGM  62

Query: 352 FISAAAATFLTGVTEPIEYMFMFAAMPLYLVYAVVQGCAFAMADIVNLRVHSFGNIEFLT 411
           F+SAA A FLTGVTEP+EYMFMFAA+PLYLVYAVVQG AFA AD+++LRVHSFGNIEFLT
Sbjct:  63 FLSAAVAVFLTGVTEPLEYMFMFAALPLYLVYAVVQGLAFASADLIHLRVHSFGNIEFLT 122

Query: 412 RVPMGIKAGLGGDIFNFVWVTLLFAVLMYFIANFMIKKFNLATAGRNGNYDNEEVDNAPS 471
           + PM IKAGL  DI NF+ V+++F V MYFI NFMIKKFNLAT+GRNGNYD  + D +
Sbjct: 123 KTPMAIKAGLAMDIVNFIVVSVVFGVAMYFITNFMIKKFNLATSGRNGNYDTGD-DASDE 181

Query: 472 TAS----GSADANSQVVQVINLLGGRDNIEDVDACMTRLRVTVKDGNSVGSEAAWKKAGA 527
           TAS     G+A+ANSQ+V++INLLGG++NI DVDACMTRLR+TV D   VG EAAWKKAGA
Sbjct: 182 TASNSNAGTANANSQIVKIINLLGGKENISDVDACMIRLRITVTDVAKVGDEAAWKKAGA 241

Query: 528 MGLVLKGNGVQAIYGPKADVLKSDIQDLLDSGTVIPIVDLETGQPVAAAPVTTYKGITEE 587
           MGL++KGNGVQA+YGPKADVLKSDIQDLLDSG  IP  D+     A V ++KG+TEE
Sbjct: 242 MGLIVKGNGVQAVYGPKADVLKSDIQDLLDSGVDIPKTDVTAPEEDKTADV-SFKGVTEE 300

Query: 588 IVSVANGQVEALDVVKDPVFSQKMMGDGFAVEPTDGNIYVPVSGTVTSVFPTKHAFGLLT 647
           + +VA+GQV +  V DPVFSQKMMGDGFAVEP +GNIY PV+G VTSVFPTKHA GLLT
Sbjct: 301 VATVADGQVLPITQVHDPVFSQKMMGDGFAVEPENGNIYSPVAGLVTSVFPTKHALGLLT 360

Query: 648 ESGLEVLVHIGLDTVALDGQPFEVKISSGQKVVAGDLAVVADLEAIKAA            696
           + GLEVLVH+GLDTVAL+G PF K+  GQ+V GDL +VADLEAIK+A
Sbjct: 361 DDGLEVLVHVGLDTVALNGAPFSAKVKDGQRVALGDLLLVADLEAIKSA            409
```

A related DNA sequence was identified in *S. pyogenes* <SEQ ID 1667> which encodes the amino acid sequence <SEQ ID 1668>. Analysis of this protein sequence reveals the following:

Possible site: 33
>>> Seems to have a cleavable N-term signal seq.
INTEGRAL   Likelihood = −13.43   Transmembrane 186-202 (181-213)
INTEGRAL   Likelihood = −6.79    Transmembrane 419-435 (412-442)
INTEGRAL   Likelihood = −5.52    Transmembrane 61-77 (57-82)
INTEGRAL   Likelihood = −3.56    Transmembrane 363-379 (363-381)
INTEGRAL   Likelihood = −1.97    Transmembrane 143-159 (142-160)
INTEGRAL   Likelihood = −0.16    Transmembrane 343-359 (343-359)
----- Final Results -----
    bacterial membrane --- Certainty = 0.6371 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:AAD00281 GB:U78600 putative ptsG protein [Streptococcus mutans]
Identities = 288/407 (70%), Positives = 331/407 (80%), Gaps = 2/407 (0%)
Query: 286  DLVHLKGSD-ASAYSHLMDSVIPARFKVGQMIGATGTLMGVALAMYRNVDADKKHTYKMM  344
            DL+HLKG+    S Y HL+ SVTPARFKVGQMIG++G LMG+ LAMYRNVD DKK  YK M
Sbjct:   3  DLIHLKGAGHMSQYHHLLTSVTPARFKVGQMIGSSGILMGLTLAMYRNVDPDKKEKYKGM   62

Query: 345  VISAAAAVFLTGVTEPLEYLFMFAAMPLYIVYALVQGASFAMADLVNLRVHSFGNIELLT  404
            ++SAA AVFLTGVTEPLEY+FMFAA+PLY+VYA+VQG +FA ADL++LRVHSFGNIE LT
Sbjct:  63  FLSAAVAVFLTGVTEPLEYMFMFAALPLYLVYAVVQGLAFASADLIHLRVHSFGNIEFLT  122

Query: 405  RTPMALKAGLGMDVINFVWVSVLFAVIMYFIADMMIKKMHLATAGRLGNYDA-DILGDRN  463
            +TPMA+KAGL MD++NF+ VSV+F V MYFI + MIKK +LAT+GR GNYD   D    D
Sbjct: 123  KTPMAIKAGLAMDIVNFIVVSVVFGVAMYFITNFMIKKFNLATSGRNGNYDTGDDASDET  182

Query: 464  TQTRPTQVADSNSQVVQIVNLLGGAGNIDDVDACMTRLRVTVKDPAKVGAEDDWKKAGAI  523
                    A++NSQ+V+I+NLLGG  NI DVDACMTRLR+TV D AKVG E  WKKAGA+
Sbjct: 183  ASNSNAGTANANSQIVKIINLLGGKENISDVDACMTRLRITVTDVAKVGDEAAWKKAGAM  242

Query: 524  GLIQKGNGVQAVYGPKADILKSDIQDLLDSGALIPEVNMSQLTSKPTPAKDFKHVTEDVL  583
            GLI KGNGVQAVYGPKAD+LKSDIQDLLDSG  IP+ +++       T    FK VTE+V
Sbjct: 243  GLIVKGNGVQAVYGPKADVLKSDIQDLLDSGVDIPKTDVTAPEEDKTADVSFKGVTEEVA  302

Query: 584  SVADGMVLPITGVKDQVFAAKMMGDGFAVEPTHGNIYAPVAGLVTSVFPTKHAFGLLTDN  643
            +VADG VLPIT V D VF+ KMMGDGFAVEP +GNIY+PVAGLVTSVFPTKHA GLLTD+
Sbjct: 303  TVADGQVLPITQVHDPVFSQKMMGDGFAVEPENGNIYSPVAGLVTSVFPTKHALGLLTDD  362

Query: 644  GLEVLVHVGLDTVALNGVPFSVKVSEGQRVHAGDLLVVADLAAIKSA              690
            GLEVLVHVGLDTVALNG PFS KV +GQRV  GDLL+VADL AIKSA
Sbjct: 363  GLEVLVHVGLDTVALNGAPFSAKVKDGQRVALGDLLLVADLEAIKSA              409
```

An alignment of the GAS and GBS proteins is shown below:

```
Identities = 517/731 (70%), Positives = 606/731 (82%), Gaps = 7/731 (0%)
Query:   8  MKNNVKQLFSFEFWQKFGKALMVVIAVMPAAGLMVSIGNSISLLDPSNVLLGRIANVIAQ   67
            MK + KQLF FEFWQKFGK LMVVIAVMPAAGLM+SIGNSI +++  +   L  + N+IAQ
Sbjct:   1  MKTSFKQLFRFEFWQKFGKCLMVVIAVMPAAGLMISIGNSIPMINHDSAFLASLGNIIAQ   60

Query:  68  IGWGVIGNLHILFALAIGGSWAKERAGGAFAAGLSFILINLITGNFFGVKTDMLADSKAT  127
            IGW VI NLH+LFALAIGGSWAKERAGGAFA+GL+F+LIN ITG F+GV + MLAD +A
Sbjct:  61  IGWAVIVNLHLLFALAIGGSWAKERAGGAFASGLAFVLINRITGAFYGVSSTMLADPEAK  120

Query: 128  VQTVFGATIRVSDYFVNVLGQPALNMGVFVGIISGFVGATAFNKYYNYRKLPDALTFFNG  187
            + ++ G  + V DYF +VL  PALN GVFVGII+GFVGATA+NKYYNYRKLP+ LTFFNG
Sbjct: 121  ITSLLGTQMIVRDYFTSVLESPALNTGVFVGIIAGFVGATAYNKYYNYRKLPEVLTFFNG  180

Query: 188  KRFVPFVVIYRSVIVALILSVFWPVVQSGINGFGKWIASSQDSAPILAPFVYGTLERLLL  247
            KRFVPFVVI RS+ VALIL V WPV+QSGIN FG WIASSQDSAPILAPF+YGTLERLLL
Sbjct: 181  KRFVPFVVILRSIFVALILVVVWPVIQSGINSFGMWIASSQDSAPILAPFLYGTLERLLL  240

Query: 248  PFGLHHMLTIPMNYTQLGGTYTVLTGATKGAQVLGQDPLWLAWVGDLINLKGSNSSQYHH  307
            PFGLHHMLTIPMNYT LGGTY V+TGA  G +V GQDPLWLAWV DL++LKGS++S Y H
Sbjct: 241  PFGLHHMLTIPMNYTALGGTYEVMTGAAAGTKVFGQDPLWLAWVTDLVHLKGSDASAYSH  300

Query: 308  LLTSVTPARFKVGQMIGASGILMGLSYAMYRNVDKDKKLKYKSMFISAAAATFLTGVTEP  367
            L+  SVTPARFKVGQMIGA+G LMG++ AMYRNVD DKK  YK MFISAAAA FLTGVTEP
Sbjct: 301  LMDSVTPARFKVGQMIGATGTLMGVAIAMYRNVDADKKHTYKMMFISAAAAVFLTGVTEP  360

Query: 368  IEYMFMFAAMPLYLVYAVVQGCAFAMADIVNLRVHSFGNIEFLTRVPMGIKAGLGGDIFN  427
            +EY+FMFAAMPLY+VYA+VQG +FAMAD+VNLRVHSFGNIE LTR PM +KAGLG D+ N
Sbjct: 361  LEYLFMFAAMPLYIVYALVQGASFAMADLVNLRVHSFGNIELLTRTPMALKAGLGMDVIN  420
```

```
-continued
Query:  428  FVWVTLLFAVLMYFIANFMIKKFNLATAGRNGNYDNEEVD--NAPSTASGSADANSQVVQ   485
             FVWV++LFAV+MYFIA+ MIKK +LATAGR GNYD + +    N  +  +  AD+NSQVVQ
Sbjct:  421  FVWVSVLFAVIMYFIADMMIKKMHLATAGRLGNYDADILGDRNTQTRPTQVADSNSQVVQ   480

Query:  486  VINLLGGRDNIEDVDACMTRLRVTVKDGNSVGSEAAWKKAGAMGLVLKGNGVQAIYGPKA   545
             ++NLLGG  NI+DVDACMTRLRVTVKD   VG+E  WKKAGA+GL+ KGNGVQA+YGPKA
Sbjct:  481  IVNLLGGAGNIDDVDACMTRLRVTVKDPAKVGAEDDWKKAGAIGLIQKGNGVQAVYGPKA   540

Query:  546  DVLKSDIQDLLDSGTVIPIVDLE--TGQPVAAAPVTTYKGITEEIVSVANGQVEALDVVK   603
             D+LKSDIQDLLDSG +IP V++    T +P      P    +K +TE+++SVA+G V + VK
Sbjct:  541  DILKSDIQDLLDSGALIPEVNMSQLTSKP---TPAKDFKHVTEDVLSVADGMVLPITGVK   597

Query:  604  DPVFSQKMMGDGFAVEPTDGNIYVPVSGTVTSVFPTKHAFGLLTESGLEVLVHIGLDTVA   663
             D VF+ KMMGDGFAVEPT GNIY PV+G VTSVFPTKHAFGLLT++GLEVLVH+GLDTVA
Sbjct:  598  DQVFAAKMMGDGFAVEPTHGNIYAPVAGLVTSVFPTKHAFGLLTDNGLEVLVHVGLDTVA   657

Query:  664  LDGQPFEVKISSGQKVVAGDLAVVADLEAIKAAGKETSVIIVFTNVSDIKTVKLEKSGPQ   723
             L+G PF VK+S GQ+V AGDL VVADL AIK+A +ET +++ FTN ++I+ V L   G Q
Sbjct:  658  LNGVPFSVKVSEGQRVHAGDLLVVADLAAIKSAERETIIVVAFTNTTEIQDVTLTSLGAQ   717

Query:  724  IAKTVVAKVEL                                                  734
             AKT VA VEL
Sbjct:  718  PAKTKVATVEL                                                  728
```

Based on this analysis, it was predicted that these proteins and their epitopes could be useful antigens for vaccines or diagnostics.

Example 522

A DNA sequence (GBSx0560) was identified in *S. agalactiae* <SEQ ID 1669> which encodes the amino acid sequence <SEQ ID 1670>. Analysis of this protein sequence reveals the following:

Possible site: 14
>>> Seems to have no N-terminal signal sequence
----- Final Results -----
   bacterial cytoplasm --- Certainty = 0.2266 (Affirmative) <succ>
      bacterial membrane --- Certainty = 0.0000 (Not Clear) <succ>
         bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 523

A DNA sequence (GBSx0561) was identified in *S. agalactiae* <SEQ ID 1671> which encodes the amino acid sequence <SEQ ID 1672>. This protein is predicted to be alkaline phosphatase synthesis sensor protein phor (hpkA). Analysis of this protein sequence reveals the following:

Possible site: 34
>>> Seems to have an uncleavable N-term signal seq
INTEGRAL   Likelihood = −13.96   Transmembrane 160-176 (148-183)
INTEGRAL   Likelihood = −8.65    Transmembrane 20-36 (13-41)
----- Final Results -----
   bacterial membrane --- Certainty = 0.6583 (Affirmative) <succ>
      bacterial outside --- Certainty = 0.0000 (Not Clear) <succ>
         bacterial cytoplasm --- Certainty = 0.0000 (Not Clear) <succ>

A related GBS nucleic acid sequence <SEQ ID 8595> which encodes amino acid sequence <SEQ ID 8596> was also identified. Analysis of this protein sequence reveals the following:

Lipop: Possible site: −1    Crend: 6
SRCFLG: 0
McG: Length of UR: 26
Peak Value of UR: 3.27
Net Charge of CR: 3
McG: Discrim Score: 14.63
GvH: Signal Score (−7.5): −5.64
Possible site: 26
>>> Seems to have an uncleavable N-term signal seq
Amino Acid Composition: calculated from 1
ALOM program count: 2 value: −13.96 threshold: 0.0
INTEGRAL        Likelihood = −13.96   Transmembrane 152-168
                                      (140-175)
INTEGRAL        Likelihood = −8.65    Transmembrane 12-28
                                      (5-33)
PERIPHERAL      Likelihood = 1.59     135
modified ALOM score:   3.29
icml HYPID: 7          CFP: 0.658
*** Reasoning Step: 3
----- Final Results -----
   bacterial membrane --- Certainty = 0.6583 (Affirmative) <succ>
      bacterial outside --- Certainty = 0.0000 (Not Clear) <succ>
         bacterial cytoplasm --- Certainty = 0.0000 (Not Clear) <succ>

A related GBS gene <SEQ ID 8593> and protein <SEQ ID 8594> were also identified. Analysis of this protein sequence reveals the following:

Lipop: Possible site: −1    Crend: 6
McG: Discrim Score: 14.63
GvH: Signal Score (−7.5): −5.64
Possible site: 26
>>> Seems to have an uncleavable N-term signal seq
ALOM program count: 2 value: −13.96 threshold: 0.0
INTEGRAL        Likelihood = −13.96   Transmembrane 152-168
                                      (140-175)
INTEGRAL        Likelihood = −8.65    Transmembrane 12-28
                                      (5-33)
PERIPHERAL      Likelihood = 1.59     135
modified ALOM score: 3.29
*** Reasoning Step: 3
----- Final Results -----

-continued

```
    bacterial membrane --- Certainty = 0.6583 (Affirmative) <succ>
     bacterial outside --- Certainty = 0.0000 (Not Clear) <succ>
       bacterial cytoplasm --- Certainty = 0.0000 (Not Clear) <succ>
```
5

The protein has homology with the following sequences in the databases:

```
34.9/61.1% over 363aa
Thermotoga maritime
EGAD|131465|sensor histidine kinase HpkA Insert characterized
GP|1575578|gb|AAC44437.1||U67196 histidine protein kinase Insert characterized
GP|4982228|gb|AAD36721.1|AE001807_12|AE001807 sensor histidine kinase HpkA Insert
characterized
PIR|C72228|C72228 sensor histidine kinase HpkA-(strain MSB8) Insert characterized
ORF00680(919-1977 of 2277)
EGAD|1131465|TM1654(48-411 of 412) sensor histidine kinase HpkA {Thermotoga maritima}
GP|1575578|gb|AAC44437.1||U67196 histidine protein kinase {Thermotoga maritima}
GP|4982228|gb|AAD36721.1|AE001807_12|AE001807 sensor histidine kinase HpkA {Thermotoga
maritima} PIR|C72228|C72228 sensor histidine kinase HpkA-Thermotoga maritima (strain
MSB8)
% Match = 13.6
% Identity = 34.8 % Similarity = 61.0
Matches = 125 Mismatches = 134 Conservative Sub.s = 94

720        750        780        810        840        870        900        930
AAQRLNNGTIVRLSVAQQTIFYLLLGMISPLAIIILLAIILSVLIARYIAKKVSEPLNNIDLDHPLSNDSYEEITPLLRR
                          : ::    :|  ||:       |::||    |:     :          |:   |
                         MSVFLFVIVAVLFVLLFLVFKKRLSEYKILIEKLSDMLGEKGVPPLYLFER
                         10         20         30         40         50

960        990        1020       1050       1080       1110       1140       1170
LDSHQAKIQHQKLLLQKRQKEFDTIISKIKEGMILLDDQARIVSINAEALKLFQINDDWHGRFMMEVSRDLTLKDLIDQG
|     :    ::       ::     :  |  ||:: :  |    : :||    : :|   |   :    |    :::::
LKKYVDNLKETISRVEVSRDNFLTILNSLSEPIFILDREGKITFLNEIARELVQGRINPEGRPYYEIFEDYYINEMVEET
           70         80         90         100        110        120        130

1197       1215       1245       1275       1305       1335       1365       1395
LKGKK-KEAN----IGIENNHYRVLVRPTTDNNRVTGLVVLLFDVTDQLQMEQLQREFTANVSHELKTPLHVISGYSELL
:|  : :|      :|  | ||   |  :     :|:|::    |||     |||:|||  |||||:|||  ||:|  | 
IKSEEPQEGTLVTYVGNEKKYFHVKVIPVELKSGDKIFVILFHDVTKERKLDEMRREFIATVSHELRTPLTSIHGYAETL
             150        160        170        180        190        200        210

1452       1482       1512       1539       1569       1599       1629
ANQMVPNEE-VPQFAAKIHKESERLVKLVEDIINLSHLDEQE-KLPQETVNLYDLTQKVLEGLQAKADKKHIQINFNGEE
   : |:|   |:|      |  :|| |: :|: |:::|    ::|   :   |: :   :    :|  |:   :     |:
LEDDLENKELVKRFLKIIEEESARMTRLINDLLDLEKIEESEANFEMKDVDLCEVIEYVYRIIQPIAEENEVDLIVECED
           230        240        250        260        270        280        290

1659       1689       1713            1767       1797       1827       1857
AILRGNPVLLNSLVYNLCDNAITYNH--EKGQVNVTLK--NSPDTITLEVSDTGLGIAEKDKKRIFERFYRVDKSRSKIV
 ::|||    |  :: ||  |||:  |   |||: |  :  ::||  : :|| ||| ||  :::  ||||:||||||:||:  :
VVVRGNKERLIQMLLNLVDNAVKYTSLKEKGEKKVWVRAYDTPDWVVVEVEDTGPGIPKEAQSRIFEKFYRVDKARSRKM
            310        320        330        340        350        360        370

1887       1917       1947       1977       2007       2037       2067       2097
GGTGLGLSIVKSALDFHNGSIKVDSHLGQGTTMTVLLHKQ*KLTNKSLDDII*TFLVIQKKYISKGLQKTNKCYNKTXX*
|||||||:|||: :|   |    |:|: |   |||  |||   |||
CGTGLGLTIVKTIVDKHGGKIEVESEINQGTLMRVLLPKRR
           390        400        410
```

The protein has homology with the following sequences in the GENPEPT database:

```
>GP:BAB06875 GB:AP001517 two-component sensor histidine kinase
involved in phosphate regulation [Bacillus halodurans]
Identities = 176/589 (29%), Positives = 315/589 (52%), Gaps = 47/589 (7%)
Query:    9 MTKKIFRTTLSASLGIVLVTILMIMG------------FLYNYFNHIQREQLRTQTALAS   56
            MTK +R  L+     ++ VT+L++  G            +L N  +  +++E          + + +
Sbjct:    1 MTKFRYRLVLA----VLTVTLLVMAGLGLVIGQIFKNVYLENLTDRLKKETYLAASMVEN   56

Query:   57 QGISF-EGKDYFENLKTS-NVRITWVDNKGQVLYDTQSDAKHMKNHANRQEIKEAIKSGY  114
            + + F E +   E +     + R+T +     G V+ ++ +D   M+NHA+R  E   E ++ G
Sbjct:   57 EAVLFNEVQTLTEEISQKLDARVTIILADGTVVGESAADPAEMENHADRPEFTE-LEEGI  115
```

```
Query: 115  GESTRWSATL-TEKSIYAAQRLN--NGTI--VRLSVAQQTIFYLLLGMISPLAIIILLAI  169
                R+S  T+ TE    YA    N  N TI  VRL+  + +  +    + + L +    +A
Sbjct: 116  ---VRYSTTVETELLFYAVPIQNEANETIGYVRLGLPIEAVNSVNRTLWAILIVSFTIAF  172

Query: 170  ILSVLIARYIAKKVSEPLNNI----------DLDHPLSNDSYEEITPLLRRLDSHQAKIQ  219
             ++ V +   IA ++  P+ +              D     S +S +E+  L R ++        ++
Sbjct: 173  LVIVSVTYRIANQMIRPIESATVVANKLAEGDYQARTSEESRDEVGQLNRSINVLAYNLE  232

Query: 220  HQKLLLQKRQKEFDTIISKIKEGMILLDDQARIVSINAEALKLFQINDD-WHGRFMMEVS  278
                  Q +++  +T+I  +  G+IL++ +   I  IN      +FQ + D W  +    +V
Sbjct: 233  QLTKRHQVQKERLETLIENMGSGLILINTRGDISLINKTCHDIFQEDTDLWLHQLYHDVI  292

Query: 279  RDLTLKDLIDQGLKGKKKEAN-----IGIENNHYRVLVRPTT-DNNRVTGLVVLLFDVTD  332
             +   +  ++     +K++         I +E  H+ V   P     +N ++ G+ ++   D+T+
Sbjct: 293  KHKEIIKIVQDIFLTEKRQRRQVKLPIHLEYRHEDVHGAPIVRENGKLKGIALVFHDITE  352

Query: 333  QLQMEQLQREFTANVSHELKTPLHVISGYSELLANQMVPNEEV-PQFAAKIHKESERLVK  391
                ++EQ++++F ANVSHELKTP+   I G++E L  +   + +E++   QF     I KESERL
Sbjct: 353  LKKLEQVRKDFVANVSHELKTPVTSIKGFTETLLDGAMHDEQLRDQFLHIIWKESERLQS  412

Query: 392  LVEDIINLSHLDEQE-KLPQETVNLYDLTQKVLEGLQAKADKKHIQINENGEEAI-LRGN  449
            L+ D++ LS +++    +L  +   NL+ +   +V+   L+ KA++K  I  I+ +  E +    L G+
Sbjct: 413  LIHDLLELSKIEQNYFQLNWQQTNLFAVVSEVMTLLKGKAEEKGIDISLSAEGSFDLEGD  472

Query: 450  PVLLNSLVYNLCDNAITYNHEKGQVNVTLKNSPDTITLEVSDTGLGIAEKDKKRIFERFY  509
             P  L   +  NL +NAITY       G++++ LK+   D  +  EV+DTG+GI  E  +  RIFERFY
Sbjct: 473  PERLKQIAINLVNNAITYTSNGGRIDLALKDHGDVVEFEVNDTGIGIRESEIPRIFERFY  532

Query: 510  RVDKSRSKIVGGTGLGLSIVKSALDFHNGSIKVDSHLGQGTTMTVLLHK             558
            RVD++RS+  GGTGLGL+IVK   ++  H  G  I V+S   G+GTT  T+   H+
Sbjct: 533  RVDRARSRNSGGTGLGLAIVKHLVEAHQGKILVESEFGKGTTFTIQFHR            581
```

There is also homology to SEQ ID 1178.

SEQ ID 8594 (GBS340) was expressed in *E. coli* as a GST-fusion product. SDS-PAGE analysis of total cell extract is shown in FIG. 173 (lane 10; MW 86 kDa). It was also expressed in *E. coli* as a His-fusion product. SDS-PAGE analysis of total cell extract is shown in FIG. 11 (lane 7; MW 61.5 kDa) and in FIG. 77 (lane 10; MW 62 kDa).

Purified GBS340-GST is shown in FIG. 223, lane 2; purified GBS340-His is shown in FIG. 191, lane 9.

The purified GBS340-GST fusion product was used to immunise mice. The resulting antiserum was used for Western blot (FIG. 254A), FACS (FIG. 254B), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 524

A DNA sequence (GBSx0562) was identified in *S. agalactiae* <SEQ ID 1673> which encodes the amino acid sequence <SEQ ID 1674>. This protein is predicted to be phosphate regulon transcriptional regulatory protein phob (phoB). Analysis of this protein sequence reveals the following:

Possible site: 28

>>> Seems to have no N-terminal signal sequence

----- Final Results ----- bacterial cytoplasm --- Certainty = 0.2617 (Affirmative) <succ> bacterial membrane --- Certainty = 0.0000 (Not Clear) <succ> bacterial outside --- Certainty = 0.0000 (Not Clear) <succ>

A related GBS nucleic acid sequence <SEQ ID 10203> which encodes amino acid sequence <SEQ ID 10204> was also identified.

The protein has homology with the following sequences in the GENPEPT database:

```
>GP:AAC73502 GB:AE000146 positive response regulator for pho
regulon, sensor is PhoR (or CreC) [Escherichia coli K12]
Identities = 98/224 (43%), Positives = 138/224 (60%), Gaps = 2/224 (0%)
    Query:    2  IYCVEDDADIREMMLYTLQMAGFKAQGFSSSELFWEAIQEKVPDLILLDIMLPGDDGLTI   61
                 I   VED+A IREM+ + L+  GF+            +   + E   PDLILLD MLPG  G+
    Sbjct:    5  ILVVEDEAPIREMVCFVLEQNGFQPVEAEDYDSAVNQLNEPWPDLILLDWMLPGGSGIQF   64

Query:   62  LERLRRKHQTEMIPVIMTTAKGSEYDKVKGLDLGADDYLVKPFGMMEMISRIKAVLRRSR  121
                 ++  L+R+   T     IPV+M   TA+G   E  D+V+GL+   GADDY+  KPF      E+++RIKAV+RR
    Sbjct:   65  IKHLKRESMTRDIPVVMLTARGEEEDRVRGLETGADDYITKPFSPKELVARIKAVMRRIS  124

Query:  122  QVDSKAHIIGNLEIDPTNYWVKRGTEKIHLTLKEFELLVLFFRNPNRVFTRQELLDKVW  181
                  +   +   I +       L +DPT++ +  V  G  E + +     EF+LL    F    +P RV++R++LL+  VW
    Sbjct:  125  PMAVEEVIEMQGLSLDPTSHRVMAGEEPLEMGPTEFKLLHFFMTHPERVYSREQLLNHVW  184
```

```
Query:  182  GEQFLGETRTVDVHIGTLRTKLGEDGY--LIATVRGVGYRLEER          223
             G   E RTVDVHI  LR L  G+  ++ TVRG GYR   R
Sbjct:  185  GTNVYVEDRTVDVHIRRLRKALEPGGHDRMVQTVRGTGYRFSTR          228
```

There is also homology to SEQ ID 1182.

Based on this analysis, it was predicted that these proteins and their epitopes could be useful antigens for vaccines or diagnostics.

Example 525

A DNA sequence (GBSx0563) was identified in *S. agalactiae* <SEQ ID 1675> which encodes the amino acid sequence <SEQ ID 1676>. This protein is predicted to be phosphate transport system regulatory protein (phoU). Analysis of this protein sequence reveals the following:

Possible site: 33
>>> Seems to have no N-terminal signal sequence
----- Final Results -----
   bacterial cytoplasm --- Certainty = 0.1188 (Affirmative) <succ>
   bacterial membrane --- Certainty = 0.0000 (Not Clear) <succ>
      bacterial outside --- Certainty = 0.0000 (Not Clear) <succ>

The protein has homology with the following sequences in the GENPEPT database:

```
>GP:AAG08750 GB:AE004948 phosphate uptake regulatory protein PhoU
[Pseudomonas aeruginosa]
Identities = 66/213 (30%), Positives = 119/213 (54%), Gaps = 4/213 (1%)
Query:    2  IRSRFASQLNDLNKEIIFMGALCEDIIGKSLGALTNSNDVYLDDISETYHKIEQMERDIE    61
             I  +F ++L D+    ++ MG L E  +  ++ AL +++       + E   +I QMER+I+
Sbjct:   11  ISQQFNAELEDVRSHLLAMGGLVEKQVNDAVNALIDADSGLAQQVREIDDQINQMERNID    70

Query:   62  ERCLKLLLRQQPVAKDLRRISSALKMVYDMKRIGAQAYEIAEIVSLGHIIQGSGSERD--   119
             E C+++L R+QP A DLR  I S   K V D++RIG +A  ++A         +  S R
Sbjct:   71  EECVRILARRQPAASDLRLIISISKSVIDLERIGDEASKVARRAI--QLCEEGESPRGYV   128

Query:  120  QLNSMSNNVISMLTKSIDAFIYDNEEQAHQVIEQDRTVNQEFDTIKKQLVLYFSVQDVDG   179
             ++  + + V  M+  +++DAF   +  + A   V +  D+TV++E+  T   ++LV Y
Sbjct:  129  EVRHIGSQVQKMVQEALDAFARFDADLALSVAQYDKTVDREYKTALRELVTYMMEDPRAI   188

Query:  180  EYPIDVLMIAKYLERIGDHTVNIAKWVLFSITG                            212
             ++++    + LERIGDH  NIA+ V++ + G
Sbjct:  189  SRVLNIIWALRSLERIGDHARNIAELVIYLVRG                            221
```

There is also homology to SEQ ID 1678.

Based on this analysis, it was predicted that this protein and its epitopes, could be useful antigens for vaccines or diagnostics.

Example 526

A DNA sequence (GBSx0564) was identified in *S. agalactiae* <SEQ ID 1679> which encodes the amino acid sequence <SEQ ID 1680>. This protein is predicted to be ATP-binding cassette protein PstB (pstB-2). Analysis of this protein sequence reveals the following:

Possible site: 52
>>> Seems to have no N-terminal signal sequence
----- Final Results -----
   bacterial cytoplasm --- Certainty = 0.2432 (Affirmative) <succ>
   bacterial membrane --- Certainty = 0.0000 (Not Clear) <succ>
      bacterial outside --- Certainty = 0.0000 (Not Clear) <succ>

A related GBS nucleic acid sequence <SEQ ID 10205> which encodes amino acid sequence <SEQ ID 10206> was also identified.

The protein has homology with the following sequences in the GENPEPT database:

```
>GP:AAD22041 GB:AF118229 ATP-binding cassette protein PstB
[Streptococcus pneumoniae]
Identities = 166/245 (67%), Positives = 211/245 (85%), Gaps = 1/245 (0%)
Query:   10  INNLDLYYGEFHALKDVNLDIEEKEITAFIGPSGCGKSTLLKSINRMNDLVKNCKITGDI    69
             + +LDL+YG+F ALK++++ + E++ITA IGPSGCGKST LK++NRMNDLV +C I G +
Sbjct:    6  VRHLDLFYGDFQALKNISIQLPERQITALIGPSGCGKSTFLKTLNRMNDLVPSCHIEGQV    65

Query:   70  TLEGEDVYR-QLDINQLRKKVGMVFQKPNPFPMSIYDNVAFGPRTHGIHSKAELDDIVER   128
             L+ +D+Y  + ++NQLRK+VGMVFQ+PNPF MSIYDNVA+GPRTHGI   K +LD +VE+
Sbjct:   66  LLDEQDIYSSKFNLNQLRKRVGMVFQQPNPFAMSIYDNVAYGPRTHGIRDKKQLDALVEK   125

Query:  129  SLKQAALWDEVKDRLHKSALGMSGGQQQRLCIARALAIEPDVLLMDEPTSALDPISTAKI   188
             SLK AA+W+EVKD L KSA+ +SGGQQQRLCIARALA+EPD+LLMDEPTSALDPIST KI
Sbjct:  126  SLKGAAIWEEVKDDLKKSAMSLSGGQQQRLCIARALAVEPDILLMDEPTSALDPISTLKI   185

Query:  189  EELVIQLKKNYTIVIVTHNMQQAVRISDKTAFFLMGEVVEYNKTSQLFSLPQDERTENYI   248
             E+L+  QLKK+YTI+IVTHNMQQA RISDKTAFFL GE+ E+   T  +F+ P+D+RTE+YI
Sbjct:  186  EDLIQQLKKDYTIIIVTHNMQQASRISDKTAFFLTGEICEFGDTVDVFTNPKDQRTEDYI   245
```

```
Query: 249  TGRFG                                                 253
            +GRFG
Sbjct: 246  SGRFG                                                 250
```

There is also homology to SEQ ID 1682.

Based on this analysis, it was predicted that these proteins and their epitopes could be useful antigens for vaccines or diagnostics.

Example 527

A DNA sequence (GBSx0565) was identified in *S. agalactiae* <SEQ ID 1683> which encodes the amino acid sequence <SEQ ID 1684>. This protein is predicted to be transmembrane protein PstA (pstA-2). Analysis of this protein sequence reveals the following:

```
Possible site: 38
>>> Seems to have a cleavable N-term signal seq.
INTEGRAL    Likelihood = –13.11   Transmembrane 265-281 (255-286)
INTEGRAL    Likelihood = –8.81    Transmembrane 79-95 (68-100)
INTEGRAL    Likelihood = –4.78    Transmembrane 195-211 (192-213)
INTEGRAL    Likelihood = –4.67    Transmembrane 147-163 (143-164)
INTEGRAL    Likelihood = –2.92    Transmembrane 122-138 (120-138)
INTEGRAL    Likelihood = –0.90    Transmembrane 40-56 (39-56)
----- Final Results -----
    bacterial membrane --- Certainty = 0.6243 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database:

```
>GP:AAD22040 GB:AF118229 transmembrane protein PstA [Streptococcus pneumoniae]
Identities = 135/263 (51%), Positives = 203/263 (76%)
Query:  23  FFLFAIVYLGAILSFATIAFVVIYILVKGLPHVNTGLFANTYNTQNVSLLPAFINTIFII    82
            + L  +VY  + L+F ++    ++ +IL+KGLPH++    LF+WTY ++N+SL+PA I+T+ ++
Sbjct:   4  YLLKLLVYCFSALTFGSLFLIIGFILIKGLPHLSLSLFSWTYTSENISLMPAIISTVILV    63

Query:  83  ALTLLFAVPLGIGGSIYLTEYARRDNPYLKIIRVATETLAGIPSIIYGLFGALFFVKYTH   142
            LL  A+P+GI      YL EY ++D+   +KI+R+A++TL+GIPSI++GLFG LFFV +
Sbjct:  64  FGALLLALPIGIFAGFYLVEYTKKDSLCVKIMRLASDTLSGIPSIVFGLFGMLFFVVFLG   123

Query: 143  LGLSLISGSLTLSIMILPLIMRTTEEALLSVPDSYREGAFALGAGKLRTIFKIVLPSAMS   202
             SL+SG LT  IM+LP+I+R+TEEALLSV DS R+ ++ LGAGKLRT+F+IVLP AM
Sbjct: 124  FQYSLLSGILTSVIMVLPVIIRSTEEALLSVSDSMRQASYGLGAGKLRTVFRIVLPVAMP   183

Query: 203  GIFAGIILAVGRIIGESAALIFTAGTVAKVAHSVFSSSRTLAVHMYAISGEGLYVDQTYA   262
            GI AG+ILA+GRI+GE+AAL++T GT      S+ SS R+LA+HMY +S EGL+V++ YA
Sbjct: 184  GILAGVILAIGRIVGETAALMYTLGTSTNTPSSLMSSGRSLALHMYMLSSEGLHVNEAYA   243

Query: 263  TAVILLLLVIIVNFVSGLVAKRL                                       285
            T VIL++ V+++N +S L++++L
Sbjct: 244  TGVILIITVLMINTLSSLLSRKL                                       266
```

There is also homology to SEQ ID 1686.

Based on this analysis, it was predicted that this protein and its epitopes, could be useful antigens for vaccines or diagnostics.

Example 528

A DNA sequence (GBSx0566) was identified in *S. agalactiae* <SEQ ID 1687> which encodes the amino acid sequence <SEQ ID 1688>. Analysis of this protein sequence reveals the following:

```
Possible site: 39
>>> Seems to have no N-terminal signal sequence
----- Final Results -----
    bacterial cytoplasm --- Certainty = 0.2687 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 529

A DNA sequence (GBSx0567) was identified in *S. agalactiae* <SEQ ID 1689> which encodes the amino acid sequence <SEQ ID 1690>. This protein is predicted to be transmembrane protein PstC (pstC-2). Analysis of this protein sequence reveals the following:

```
Possible site: 23
>>> Seems to have a cleavable N-term signal seq.
INTEGRAL    Likelihood = –10.67   Transmembrane 256-272 (251-279)
INTEGRAL    Likelihood = –8.86    Transmembrane 141-157 (133-162)
```

-continued

```
INTEGRAL    Likelihood = –4.99    Transmembrane 111-127 (109-132)
INTEGRAL    Likelihood = –4.30    Transmembrane 76-92 (72-95)
INTEGRAL    Likelihood = –1.86    Transmembrane 25-41 (24-42)
INTEGRAL    Likelihood = –1.33    Transmembrane 59-75 (59-75)
INTEGRAL    Likelihood = –0.27    Transmembrane 203-219 (202-219)
----- Final Results -----
    bacterial membrane --- Certainty = 0.5267 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database:

```
>GP: AAD22039 GB: AF118229 transmembrane protein PstC [Streptococcus pneumoniae]
Identities = 162/266 (60%), Positives = 212/266 (78%), Gaps = 3/266 (1%)

Query:   15 ITACVSVISAILICLFLFSSGLPAITKIGWGNFIFGKVWHPSN--NIFGIFPMIVGSLYV      72
             ++A V+V++ +LIC F+FS+GLP I   G+  F+ G  W P+W    +GI PMIVGSL +
Sbjct:    1 MSATVAVVAILLICFFIFSNGLPFIANYGFARFLLGSDWSPTNIPASYGILPMIVGSLLI     60

Query:   73 TAGALLLGGPIGILTAVFMAYFCPENIYKPLKSAINLMAGIPSVVYGFFGLVVIVPMIRQ    132
             T GA+++G P GILT+VFM Y+CP+ +Y   LKSAINLMA IPS+VYGFFGL ++VP IR
Sbjct:   61 TLGAIVIGVPTGILTSVFMVYYCPKPVYGFLKSAINLMAAIPSIVYGFFGLQLLVPWIRS    120

Query:  133 YIGGFGMGVLAASILLGIMILPTIVSISESSLRAVPESYYEGGIALGASHERSVFFAVLP    192
             ++G  GM VL AS+LLGIMILPTI+S+SES++R VP++YY G +ALGASHERS+F  +LP
Sbjct:  121 FLGN-GMSVLTASLLLGIMILPTIISLSESAIRTVPKTYYSGSLALGASHERSIFSVILP    179

Query:  193 AAKRGILASVVLGIGRAIGETMAVIMVAGNQAVLPQSLTSGVRTLTTNIVMEMGYSSGLH    252
             AA+  GIL++V+LGIGRA+GETMAVI+VAGNQ ++P   L SG RTLTTNIV+EM Y+SD H
Sbjct:  180 AARSGILSAVILGIGRAVGETMAVILVAGNQPIIPSGLFSGTRTLTTNIVLEMAYASGQH    239

Query:  253 RQALIGTAVVLFIFILMINISFSALQ                                    278
             R+ALT T+ VLF  IL+IN  F+ L+
Sbjct:  240 REALIATSAVLFFLILLINAYFAYLK                                    265
```

There is also homology to SEQ ID 1692.

Based on this analysis, it was predicted that this protein and its epitopes, could be useful antigens for vaccines or diagnostics.

Example 530

A DNA sequence (GBSx0568) was identified in *S. agalactiae* <SEQ ID 1693> which encodes the amino acid sequence <SEQ ID 1694>. This protein is predicted to be probable hemolysin precursor (pstS). Analysis of this protein sequence reveals the following:

---

Possible site: 34
>>> May be a lipoprotein
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>

---

The protein has homology with the following sequences in the GENPEPT database:

```
>GP: AAD22038 GB: AF118229 phosphate binding protein PstS
[Streptococcus pneumoniae]
Identities = 134/295 (45%), Positives = 185/295 (62%), Gaps = 9/295 (3%)

Query:    1 MKKHKMLSLLAVSGLMGIGILAGCSNDSSSSSK---GTINIVSREEGSGTRGAFIELFGI     57
             MK  KLM+L A+ GL G G++A C N S++S +    GTI ++SRE GSGTRGAF E+ GI
Sbjct:    1 MKFKKMLTLAAI-GLSGFGLVA-CGNQSAASKQSASGTIEVISRENGSGTRGAFTEITGI     58

Query:   58 ESKNKKGEKVDHTSDAATVTNSTSVMLTTVSKDPSAIGYSSLGSLNSSVKVLKIDGKNAT    117
                K+   +K+D+T+  A + NST +L+ V + +AIGY SLGSL  SVK L+IDG   A+
Sbjct:   59 LKKDGD-KKIDNTAKTAVIQNSTEGVLSAVQGNANAIGYISLGSLTKSVKALEIDGVKAS    117

Query:  118 VKDIKSGSYKISRPFNIVTKEGKEKEATKDFIDYILSKDGQAVVEKNGYIPL-DNAKAYQ    176
             +   G Y + RPFNIV     K   +DFI +I SK GQ VV  N +I       Y
Sbjct:  118 RDTVLDGEYPLQRPFNIVWSSNLSK-LGQDFISFIHSKQGQQVVTDNKFIEAKTETTEYT    176

Query:  177 AKVSSGKVVIAGSSSVTPVMEKIKEAYHKVNAKVDVEIQQSDSSTGITSAIDGSADIGMA    236
             ++   SGK+ + GS+SV+ +MEK+ EAY K N +V ++I   + SS GIT+  + +ADIGM
Sbjct:  177 SQHLSGKLSVVGSTSVSSLMEKLAEAYKKENPEVTIDITSNGSSAGITAVKEKTADIGMV    236

Query:  237 SRELDKTESSKGVKATVIATDGIAVVVNKKNKVNDLSTKQVKDIFTGKTTSWSDL       291
             SREL   E K +    IA DGIAVVVN NK + +S  ++ D+F+GK T+W +
Sbjct:  237 SREL-TPEEGKSLTHDAIALDGIAVVVNNDNKASQVSMAELADVFSGKLTTWDKI       290
```

There is also homology to SEQ ID 1696.

Based on this analysis, it was predicted that this protein and its epitopes, could be useful antigens for vaccines or diagnostics.

A related GBS gene <SEQ ID 8597> and protein <SEQ ID 8598> were also identified. Analysis of this protein sequence reveals the following:

---

Lipop: Possible site: 23   Crend: 4
McG: Discrim Score: 7.91
GvH: Signal Score (–7.5): –3.72
Possible site: 34
>>> May be a lipoprotein
ALOM program   count: 0 value: 2.44 threshold: 0.0
PERIPHERAL           Likelihood = 2.44           248
modified ALOM score: –0.99
*** Reasoning Step: 3
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>

---

SEQ ID 1694 (GBS24) was expressed in *E. coli* as a His-fusion product. SDS-PAGE analysis of total cell extract is shown in FIG. 14 (lane 9; MW 33 kDa).

GBS24-His was purified as shown in FIG. 194, lane 10.

Example 531

A DNA sequence (GBSx0569) was identified in *S. agalactiae* <SEQ ID 1697> which encodes the amino acid sequence <SEQ ID 1698>. Analysis of this protein sequence reveals the following:

```
Possible site: 30
>>> Seems to have no N-terminal signal sequence
----- Final Results -----
    bacterial cytoplasm --- Certainty = 0.1725 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 532

A DNA sequence (GBSx0570) was identified in *S. agalactiae* <SEQ ID 1699> which encodes the amino acid sequence <SEQ ID 1700>. Analysis of this protein sequence reveals the following:

```
Possible site: 58
>>> Seems to have no N-terminal signal sequence
----- Final Results -----
    bacterial cytoplasm --- Certainty = 0.2741 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database:

```
>GP: BAB05069 GB: AP001511 unknown conserved protein [Bacillus halodurans]
Identities = 119/250 (47%), Positives = 149/250 (59%), Gaps = 9/250 (3%)

Query:   1 MQQYFVNGE--AGAYVTIEDKDTIKHMFNVMRLTEDDQVVLVFDDAIKRLAKVVDSSAHR  58
           MQ+YFV  E    YVTI  D +KH+ VMR+T  D+ L+ D  R      A+
Sbjct:   1 MQRYFVPKEQMTDTYVTITGDD-VKHIIKVMRMTIGDE--LICSDGHGRTVRCEIEKAND  57

Query:  59 FQIL----EELDNNVEMPVQVTIASGFPKGDKLDFVTQKATELGAAAIWGFPADWSVVKW 114
           ++L      E L  N E+P++VITA   PKGDKLD++ QK TELGA A W F A  S+VKW
Sbjct:  58 SEVLARVIEPLIPNTELPIRVTIAQALPKGDKLDYIVQKGTELGAQAFWPFSASRSIVKW 117

Query: 115 DGKKLAKKEDKLAKIALGAAEQSKRNRLPQVRLFEKKADFQAELAGFDKIFIAYEESAKE 174
           D KK  KK ++L KIA   AAEQS R R+P +           E++GF K  +AYEE AKE
Sbjct: 118 DEKKGRKKTERLMKIAKEAAEQSYRERIPSIETPLAFSKLLQEISGFTKTIVAYEEEAKE 177

Query: 175 GELSALAQNLQTVKAGDKLLFIFGPEGGISPKEIAAFEEVGAIKVGLGPRIMRTETAPLY 234
           G L   A L +  GD LL I GPEGG + +EI A +  G    GLGPRI+RTETA LY
Sbjct: 178 GRLMTFAACLNELHHGDSLLVIIGPEGGFTTEEIDAIQRAGGAPAGLGPRILRTETASLY 237

Query: 235 ALSVISYSAE                                                   244
           AL+ ISY  E
Sbjct: 238 ALAAISYHFE                                                   247
```

A related DNA sequence was identified in *S. pyogenes* <SEQ ID 1701> which encodes the amino acid sequence <SEQ ID 1702>. Analysis of this protein sequence reveals the following:

```
Possible site: 56
>>> Seems to have no N-terminal signal sequence
----- Final Results -----
    bacterial cytoplasm --- Certainty = 0.2274 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below:

```
Identities = 173/245 (70%), Positives = 202/245 (81%)

Query:   1 MQQYFVNGEAGAYVTIEDKDTIKHMFNVMALTEDDQVVLVFDDAIKRLAKVVDSSAHRFQ  60
           MQQYF+ G+A   VTI DKDTIKHMF VMRL ++ +VVLVFDD +K LAKV +S AH  +
Sbjct:   1 MQQYFIKGKAEKKVTITDKDTIKHMFQVMRLADEAEVVLVFDDGVKYLAKVTNSMAHELE  60

Query:  61 ILEELDNNVEMPVQVTIASGFPKGDELDFVTQKATELGAAAIWGFPADWSVVKWDGKKLA 120
           I+E L + VE+PV+VTIASGFPKGDKLD + QK TELGA+A+WG+PADWSVVKWDGKKLA
Sbjct:  61 IIEALPDQVELPVKVTIASGFPKGDKLDTIAQKVTELGASALWGYPADWSVVKWDGKKLA 120
```

-continued

```
Query: 121 KKEDKLAKIALGAAEQSKRNRLPQVRLFEKKADFQAELAGFDKIFIAYEESAKEGELSAL 180
            KKEDKLAKI LGAAIQSKRNR+P+V LFE KA+F   L+ FD IFIAYEE+AK G+L+ L
Sbjct: 121 KKEDKLAKIVLGAAEQSKRNRVPEVHLFEHKAEFLKSLSSFDHIFIAYEETAKAGQLATL 180

Query: 181 AQNLQTVKAGDKLLFIFGPEGGISPKEIAAFEEVGAIKVGLGPRIMRTETAPLYALSVIS 240
            A+ ++ VK G K+LFIFGPEGGISP EI  FE   AIKVGLGPRIMR ETAPLYALS +S
Sbjct: 181 AREVKEVKPGAKILFIFGPEGGISPTEITQFEAASAIKVGLGPRIMRAETAPLYALSALS 240

Query: 241 YSAEL                                                       245
            Y+ EL
Sbjct: 241 YALEL                                                       245
```

Based on this analysis, it was predicted that these proteins and their epitopes could be useful antigens for vaccines or diagnostics.

Example 533

A DNA sequence (GBSx0571) was identified in *S. agalactiae* <SEQ ID 1703> which encodes the amino acid sequence <SEQ ID 1704>. Analysis of this protein sequence reveals the following:

---

Possible site: 34
>>> Seems to have no N-terminal signal sequence
INTEGRAL    Likelihood = −2.28    Transmembrane 238-254 (237-254)
----- Final Results -----
    bacterial membrane --- Certainty = 0.1914 (Affirmative) <succ>
        bacterial outside --- Certainty = 0.0000 (Not Clear) <succ>
            bacterial cytoplasm --- Certainty = 0.0000 (Not Clear) <succ>

---

The protein has homology with the following sequences in the GENPEPT database:

```
>GP: BAA82791 GB: AB023064 orf35 [Listeria monocytogenes]
Identities = 138/309 (44%), Positives = 193/309 (61%), Gaps = 5/309 (1%)

Query:   4 WNELTVHVNREAEEAVSNLLIETGSQGVAISDSADYLGQ-EDRFGELYP---EVEQSDMI  59
           W+E+ VH   EA E V+N+L E G+ GV+I D AD+L + ED+FGE+Y    E    D +
Sbjct:   3 WSEVEVHTTNEAVEPVANVLTEFGAAGVSIEDVADFLREREDKFGEIYALRREDYPEDGV  62

Query:  60 AITAYYPDTLDIEAVKADLADRLANFEGFGLATGSVNLDSQELVEEDWADNWKKYYEPAR 119
            I AY+  T +     ++ L N F + G      ++ +E+WA WKKYY P +
Sbjct:  63 IIKAYFLKITEFVEQIPEIEQTLKNLSTFDIPLGKFQFVVNDVDDEEWATAWKKYYHPVQ 122

Query: 120 ITHDLTIVPSWTDYEAKAGEKIIKMDPGMAFGTGTHPTTKMSLFALEQVLRGGETVIDVG 179
           IT +TIVPSW Y  A E II++DPGMAFGTGTHPTT++ + AL   L+ G+ VIDVG
Sbjct: 123 ITDRITIVPSWESYTPSANEIIIELDPGMAFGTGTHPTTQLCIRALSNYLQPGDEVIDVG 182

Query: 180 TGSGVLSIASSLLGAKDIYAYDLDDVAVRVAQENIDMNPGTENIHVAAGDLLKGVQQ-EV 238
           TGSGVLSIAS+ LGAK I A DLD++A R A+ENI +N     I V   +LL+ + + V
Sbjct: 183 TGSGVLSIASAKLGAKSILATDLDEIATRAAEENITLNKTEHIITVKQNNLLQDINKTNV 242

Query: 239 DVIVANILADILIHLTDDAYRLVKDEGYLIMSGIISEKWDMVRESAEKAGFFLETHMVQG 298
           D++VANILA++++   +D Y+ +K  G  I SGII +K  +V E+ + AG  +E    QG
Sbjct: 243 DIVVANILAEVILLFPEDVYKALKPGGVFIASGIIEDKAKVVEEALKNAGLIIEKMEQQG 302

Query: 299 EWNACVFKK                                                   307
           +W A + K+
Sbjct: 303 DWVAIISKR                                                   311
```

A related DNA sequence was identified in *S. pyogenes* <SEQ ID 1705> which encodes the amino acid sequence <SEQ ID 1706>. Analysis of this protein sequence reveals the following:

---

Possible site: 34
>>> Seems to have no N-terminal signal sequence
INTEGRAL    Likelihood = −4.57    Transmembrane 238-254 (237-257)
----- Final Results -----
    bacterial membrane --- Certainty = 0.2826 (Affirmative) <succ>
        bacterial outside --- Certainty = 0.0000 (Not Clear) <succ>
            bacterial cytoplasm --- Certainty = 0.0000 (Not Clear) <succ>

---

The protein has homology with the following sequences in the databases:

```
>GP: BAA82791 GB: AB023064 orf35 [Listeria monocytogenes]
Identities = 139/309 (44%), Positives = 203/309 (64%), Gaps = 5/309 (1%)
```

-continued
```
Query:    4 WQEVTVHVHRDAQEAVSHVLIETGSQGVAIADSADYIGQK-DRFGELYP---DVEQSDMI  59
            W EV VH   +A E V++VL E G+ GV+I D AD++ ++ D+FGE+Y     +    D +
Sbjct:    3 WSEVEVHTTNEAVEPVANVLTEFGAAGVSIEDVADFLREREDKFGEIYALRREDYPEDGV  62

Query:   60 AITAYYPSSTNLADIIATINEQLAELASFGLQVGQVTVDSQELAEEDWADNWKKYYEPAR 119
               I AY+  +T   + I   I +L  L++F + +G+       ++ +E+WA WKKYY P +
Sbjct:   63 IIKAYFLKTTEFVEQIPEIEQTLKNLSTFDIPLGKFQFVVNDVDDEEWATAWKKYYHPVQ 122

Query:  120 ITHDLTIVPSWTDYDASAGEKVIKLDPGMAFGTGTHPTIKMSLFALEQILRGGETVIDVG 179
            IT   +TIVPSW  Y  SA E +I+LDPGMAFGTGTHPTT++ +  AL    L+ G+ VIDVG
Sbjct:  123 ITDRITIVPSWESYTPSANEIIIELDPGMAFGTGTHPTTQLCIRALSNYLQPGDEVIDVG 182

Query:  180 TGSGVLSIASSLLGAKTIYAYDLDDVAVRVAQDNIDLNQGTDNIHVAAGDLLKGVSQ-EA 238
            TGSGVLSIAS+ LGAK+I A DLD++A R A++NI LN+     I V   +LL+ +++
Sbjct:  183 TGSGVLSIASAKLGAKSILATDLDLEIATRAAEENITLNKTEHIITVKQNNLLQDINKTNV 242

Query:  239 DVIVANILADILVLLTDDAYRLVKKEGYLILSGIISEKLDMVLEAAFSAGFFLETHMVQG 298
            D++VANILA++++L  +D Y+ +K  G   I SGII +K  +V EA  +AG  +E    QG
Sbjct:  243 DIVVANILAEVILLFPEDVYKALKPGGVFIASGIIEDKAKVVEEALKNAGLIIEKMEQQG 302

Query:  299 EWNALVFKK                                                   307
            +W A++ K+
Sbjct:  303 DWVAIISKR                                                   311
```

An alignment of the GAS and GBS proteins is shown below:

```
Identities = 259/317 (81%), Positives = 287/317 (89%)

Query:    1 MNTWNELTVHVNREAEEAVSNLLIETGSQGVAISDSADYLGQEDREGELYPEVEQSDMIA  60
            M TW E+TVHV+R+A+EAVS++LIETGSQGVAI+DSADY+GQ+DRFGELYP+VEQSDMIA
Sbjct:    1 METWQEVTVHVHRDAQEAVSHVLIETGSQGVAIADSADYIGQKDREGELYPDVEQSDMIA  60

Query:   61 ITAYYPDTLDIEAVKADLADRLANFEGFGLATGSVNLDSQELVEEDWADNWKKYYEPARI 120
            ITAYYP +  ++ + A + ++LA    FGL  G V +DSQEL EEDWADNWKKYYEPARI
Sbjct:   61 ITAYYPSSTNLADIIATINEQLAELASFGLQVGQVTVDSQELAEEDWADNWKKYYEPARI 120

Query:  121 THDLTIVPSWTDYEAKAGEKIIKMDPGMAFGTGTHPTTKMSLFALEQVLRGGETVIDVGT 180
            THDLTIVPSWTDY+A AGEK+IK+DPGMAFGTGTHPTTKMSLFALEQ+LRGGETVIDVGT
Sbjct:  121 THDLTIVPSWTDYDASAGEKVIKLDPGMAFGTGTHPTTKMSLFALEQILRGGETVIDVGT 180

Query:  181 GSGVLSIASSLLGAKDIYAYDLDDVAVRVAQENIDMNPGTENIHVAAGDLLKGVQQEDV 240
            GSGVLSIASSLLGAK IYAYDLDDVAVRVAQ+NID+N GT+NIHVAAGDLLKGV QE DV
Sbjct:  181 GSGVLSIASSLLGAKTIYAYDLDDVAVRVAQDNIDLNQGTDNIHVAAGDLLKGVSQEADV 240

Query:  241 IVANILADILIHLTDDAYRLVKDEGYLIMSGIISEKWDMVRESAEKAGEFLETHMVQGEW 300
            IVANILADIL+ LTDDAYRLVK EGYLI+SGIISEK DMV E+A  AGFFLETHMVQGEW
Sbjct:  241 IVANILADILVLLTDDAYRLVKKEGYLILSGIISEKLDMVLEAAFSAGEFLETHMVQGEW 300

Query:  301 NACVFKKTDDISGVIGG                                           317
            NA VFKKTDDISGVIGG
Sbjct:  301 NALVFKKTDDISGVIGG                                           317
```

Based on this analysis, it was predicted that these proteins and their epitopes could be useful antigens for vaccines or diagnostics.

Example 534

A DNA sequence (GBSx0572) was identified in *S. agalactiae* <SEQ ID 1707> which encodes the amino acid sequence <SEQ ID 1708>. Analysis of this protein sequence reveals the following:

---

Possible site: 61
>>> Seems to have no N-terminal signal sequence
----- Final Results -----
   bacterial cytoplasm --- Certainty = 0.4198 (Affirmative) <succ>
      bacterial membrane --- Certainty = 0.0000 (Not Clear) <succ>
         bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 535

A DNA sequence (GBSx0573) was identified in *S. agalactiae* <SEQ ID 1709> which encodes the amino acid sequence <SEQ ID 1710>. This protein is predicted to be transcriptional activator tipa. Analysis of this protein sequence reveals the following:

---

Possible site: 33
>>> Seems to have no N-terminal signal sequence
----- Final Results -----
   bacterial cytoplasm --- Certainty = 0.0683 (Affirmative) <succ>
      bacterial membrane --- Certainty = 0.0000 (Not Clear) <succ>
         bacterial outside --- Certainty = 0.0000 (Not Clear) <succ>

The protein has homology with the following sequences in the GENPEPT database:

```
>GP: CAB15677 GB: Z99122 transcriptional regulator [Bacillus subtilis]
Identities = 87/246 (35%), Positives = 139/246 (56%), Gaps = 13/246 (5%)

Query:    4 VKEVSILSGVSVRTLHHYDKIGLFPPTALSEAGYRLYDDEALIRLQEILLFRELEFPLKD   63
            VK+V+ +SGVS+RTLHHYD I L  P+AL++AGYRLY D  L RLQ+IL F+E+ F L +
Sbjct:    5 VKQVAEISGVSIRTLHHYDNIELLNPSALTDAGYRLYSDADLERLQQILFFKEIGFRLDE  64

Query:   64 IKYLLEQAKEERQDLLAQQIKLLEWKRSHLEQVITHAKR--LQEKGDDYMN----FDVYN  117
            IK +L+     +R+  L Q ++L  K+  ++++I    R L    G + MN     F  +
Sbjct:   65 IKEMLDHPNFDRKAALQSQKEILMKKKQRMDEMIQTIDRTLLSVDGGETMNKRDLFAGLS  124

Query:  118 KTELEQLQA----EAKEKWGQTAA--YKEFAQKHASDDFAQISQEMAKIMVQFGQLKTQN  171
            ++E+ Q     E ++ +G+ A  ++     +++DD+  I E    I  +
Sbjct:  125 MKDIEEHQQTYADEVRKLYGKEIAEETEKRTSAYSADDWRTIMAEFDSIYRRIAARMKHG  184

Query:  172 VSDESVQMCVKRLQDYISQNFYTCTNEILAGLGQMYQSDDRFSQSIDKAGGAGTSEFVSQ  231
             D  +Q  V    +D+I Q  Y CT +I   GLG++Y +D+RF+ SI++   G G + F+ +
Sbjct:  185 PDDAEIQAAVGAFRDHICQYHYDCTLDIFRGLGEVYITDERFTDSINQY-GEGLAAFLRE  243

Query:  232 AIAYYC                                                        237
            AI  YC
Sbjct:  244 AIIIYC                                                        249
```

A related DNA sequence was identified in *S. pyogenes* <SEQ ID 1711> which encodes the amino acid sequence <SEQ ID 1712>. Analysis of this protein sequence reveals the following:

---

Possible site: 48
>>> Seems to have no N-terminal signal sequence
INTEGRAL    Likelihood = –8.28    Transmembrane 146-162 (143-167)
INTEGRAL    Likelihood = –2.92    Transmembrane 172-188 (171-190)
----- Final Results -----
  bacterial membrane --- Certainty = 0.4312 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the databases:

```
>GP: CAB15677 GB: Z99122 transcriptional regulator [Bacillus subtilis]
Identities = 40/107 (37%), Positives = 69/107 (64%), Gaps = 6/107 (5%)

Query:    7 YSTGELANLAGVSIRTVQYYDQRGILIPTALTAGGRRLYTDSDLEQLRMICFLRDLGFSI   66
            Y    ++A ++GVSIRT+ +YD   +L P+ALT  G RLY+D+DLE+L+  I F +++GF +
Sbjct:    3 YQVKQVAEISGVSIRTLHHYDNIELLNPSALTDAGYRLYSDADLERLQQILFFKEIGFRL  62

Query:   67 EQIRKVLAEENAAQVLELLLVDHIATAKEDLAAREQQVDIAVKILDR              113
            ++I+++L    N  +   L        + KE L  K+Q++D  ++ +DR
Sbjct:   63 DEIKEMLDHPNFDRKAAL------QSQKEILMKKKQRMDEMIQTIDR              103
```

An alignment of the GAS and GBS proteins is shown below:

```
Identities = 40/133 (30%), Positives = 71/133 (53%), Gaps = 6/133 (4%)

Query:    6 EVSILSGVSVRTLHHYDKIGLFPPTALSEAGYRLYDDEALIRLQEILLFRELEFPLKDIK  65
            E++ L+GVS+RT+ +YD+ G+  PTAL+  G RLY D  L +L+  I   R+L F ++ I+
Sbjct:   11 ELANLAGVSIRTVQYYDQRGILIPTALTAGGRRLYTDSDLEQLRMICFLRDLGFSIEQIR  70

Query:   66 YLL--EQAKEERQDLLAQQIKL----LEWKRSHLEQVITHAKRLQEKGDDYMNFDVYNKT 119
            +L   E A +   +  LL    I      L  K  ++ +     RL+++     ++F +
Sbjct:   71 KVLAEENAAQVLELLLVDHIATAKEDLAAKEQQVDIAVKILDRLRKQDPQSLDFLMDISL 130

Query:  120 ELEQLQAEAKEKW                                                132
            ++  +A  K +W
Sbjct:  131 SMKNQKAWKKLQW                                                143
```

Based on this analysis, it was predicted that these proteins and their epitopes could be useful antigens for vaccines or diagnostics.

Example 536

A DNA sequence (GBSx0575) was identified in *S. agalactiae* <SEQ ID 1713> which encodes the amino acid sequence <SEQ ID 1714>. Analysis of this protein sequence reveals the following:

---

Possible site: 24
>>> Seems to have no N-terminal signal sequence
INTEGRAL    Likelihood = –0.06    Transmembrane 57-73 (57-73)

----- Final Results -----
   bacterial membrane --- Certainty = 0.1022 (Affirmative) <succ>
    bacterial outside --- Certainty = 0.0000 (Not Clear) <succ>
     bacterial cytoplasm --- Certainty = 0.0000 (Not Clear) <succ>

The protein has homology with the following sequences in the GENPEPT database:

```
>GP: CAB14586 GB: Z99117 yrkN [Bacillus subtilis]
Identities = 38/136 (27%), Positives = 60/136 (43%), Gaps = 3/136 (2%)

Query:   2 ITLQKAEASDLEKIIA-IQRASFKAVYEKYHDQYDPYVEEVEQIRWKLVERPDCFYHFVL  60
           + L+ A+ SDL +   +Q A  AV E + D  D +    ++ +    P    + +L
Sbjct:   9 VILELAKESDLPEFQKKLQEAFAIAVIETFGDCEDGPIPSDNDVQ-ESFNAPGAVVYHIL  67

Query:  61 VDETIVGFLRLVIKDEEKRAWLGTAAILPQYQGQGYGSAAMALLEKTYPKLTKWDLCTIA 120
             D   VG  + I  +       L     + P+Y  QG G +A   +E   YP    W+  T
Sbjct:  68 QDGKNVGGAVVRINSQTNHNSLDLFYVSPEYHSQGIGLSAWKAIEAQYPDTVLWETVTPY 127

Query: 121 QEKLMVSFY-EKCGYH                                             135
           EK   ++FY  KCG+H
Sbjct: 128 FEKRNINFYVNKCGFH                                             143
```

No corresponding DNA sequence was identified in *S. pyogenes*.

Based on this analysis, it was predicted that this protein and its epitopes, could be useful antigens for vaccines or diagnostics.

Example 537

A DNA sequence (GBSx0576) was identified in *S. agalactiae* <SEQ ID 1715> which encodes the amino acid sequence <SEQ ID 1716>. This protein is predicted to be Bacterial mutT protein. Analysis of this protein sequence reveals the following:

Possible site: 13
>>> Seems to have no N-terminal signal sequence
----- Final Results -----
   bacterial cytoplasm --- Certainty = 0.2417 (Affirmative) <succ>
    bacterial membrane --- Certainty = 0.0000 (Not Clear) <succ>
     bacterial outside --- Certainty = 0.0000 (Not Clear) <succ>

The protein has homology with the following sequences in the GENPEPT database:

```
>GP: AAG06568 GB: AE004742 hypothetical protein [Pseudomonas aeruginosa]
Identities = 57/131 (43%), Positives = 82/131 (62%)

Query:  10 FSGAKIALFCEGKILTSLRDDFPDLPYAGFWDLPGGGREDNETPLECLFREVDEELSLTL  69
           FSGAK+ALF     ++    RD+ P +P+ G+WD PGGGRE   ETP EC  RE++EE S+ L
Sbjct:   7 FSGAKLALFYGDHLVVYKRDEKPGIPFPGYWDFPGGGREGLETPAECALRELEEEFSIRL  66

Query:  70 TRNHIDWVKTYRGMLKPDKLSVFMVGHISQKEYDSIVLGDEGQDYKLMSIDEFLSHKKVI 129
               I+W +  Y        + F+V  +  +E+++I  GDEGQ ++LM +D +L+H    +
Sbjct:  67 EEPRIEWQRQYPSTSGSAPFAYFLVARLEDREFEAIRFGDEGQYWRLMEVDAYLAHAMAV 126

Query: 130 PQLQERLRDYL                                                  140
           P LQ RL DYL
Sbjct: 127 PYLQSRLGDYL                                                  137
```

No corresponding DNA sequence was identified in *S. pyogenes*.

Based on this analysis, it was predicted that this protein and its epitopes, could be useful antigens for vaccines or diagnostics.

Example 538

A DNA sequence (GBSx0577) was identified in *S. agalactiae* <SEQ ID 1717> which encodes the amino acid sequence <SEQ ID 1718>. Analysis of this protein sequence reveals the following:

Possible site: 46
>>> Seems to have no N-terminal signal sequence
----- Final Results -----
   bacterial cytoplasm --- Certainty = 0.3299 (Affirmative) <succ>
    bacterial membrane --- Certainty = 0.0000 (Not Clear) <succ>
     bacterial outside --- Certainty = 0.0000 (Not Clear) <succ>

The protein has no significant homology with any sequences in the GENPEPT database.

A related DNA sequence was identified in *S. pyogenes* <SEQ ID 1719> which encodes the amino acid sequence <SEQ ID 1720>. Analysis of this protein sequence reveals the following:

Possible site: 41
\>\>\> Seems to have no N-terminal signal sequence
----- Final Results -----
   bacterial cytoplasm --- Certainty = 0.5527 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below:

```
Identities = 111/156 (71%), Positives = 128/156 (81%)

Query:    1 MAKFGELSVLEEELDKHLQYDFAMDWDKKNHTVEVTFILEAQNSSAIETVDDQGETSSED   60
            MA +GLLSVLEEE+EKH QYD+AMDWDKKNH VEVTF+LEAQN  AI+T+DD GE + +D
Sbjct:    1 MATYGELSVLEEEMDKHFQYDYAMDWDKKNHAVEVTFVLEAQNKEAIKTIDDSGEVTQDD   60

Query:   61 IVFEDYVLFYNPVKSRFDAEDYLVTIPYEPKKGLSREFLAYFAETLNEVATEGLSDLMDF  120
            IVFEDYVLFYNP KS+FDA DYLVTIP++ KKG SREFLAYFA+ LN+VA EG SDLMDF
Sbjct:   61 IVFEDYVLFYNPAKSQFDAADYLVTIPFDAKKGESREFLAYFAQFLNDVAIEGHSDLMDF  120

Query:  121 LTDDSIEEFGLSWDTDAFENGRAELKETEFYPYPRY                         156
            L DDS +F L W+  ARE G+  L+E    YPYPRY
Sbjct:  121 LADDSKADFFLEWNAQAFEEGQQGLEEAASYPYPRY                         156
```

Based on this analysis, it was predicted that these proteins and their epitopes could be useful antigens for vaccines or diagnostics.

Example 539

A DNA sequence (GBSx0578) was identified in *S. agalactiae* <SEQ ID 1721> which encodes the amino acid sequence <SEQ ID 1722>. Analysis of this protein sequence reveals the following:

Possible site: 26
\>\>\> Seems to have no N-terminal signal sequence
----- Final Results -----
   bacterial cytoplasm --- Certainty = 0.2846 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database:

```
>GP: CAB51273 GB: AL096872 putative acetyltransferase
[Streptomyces coelicolor A3(2)]
Identities = 35/109 (32%), Positives = 62/109 (56%), Gaps = 1/109 (0%)

Query:   51 VAEVDDKIAGVLDFGPYYPFPAGKHVATF-GILIAEPYQGQGLGKALLKALLTEAKAQGY  109
            VAE+D  + G +  G   P + HV    G+ +A   +G G+G+AL++A + EA+ +G+
Sbjct:   56 VAELDGAVVGYVRLGFPTPLASNTHVRQIRGLAVAGAARGHVGRALVRAAVEEARHEGF  115

Query:  110 IKIAMHVMGNNSRAISLYQKYGFTEEARITKAFFIENHYVDALIFARDL            158
            +I + V+G+N+ A LY+  GF  E   + F ++  YVD ++   + L
Sbjct:  116 RRITLRVLGHNTAARGLYESEGFVVEGVQPEEFHLDGRYVDDVLMGQML            164
```

A related DNA sequence was identified in *S. pyogenes* <SEQ ID 1723> which encodes the amino acid sequence <SEQ ID 1724>. Analysis of this protein sequence reveals the following:

```
Identities = 34/108 (31%), Positives = 59/108 (54%), Gaps = 7/108 (6%)

Query:   35 TESDLEKNLANGMSFFV-----AEVDDKIAGVLDFGPYYPFPAGKHVATFGILIAEPYQG   89
            T +L   L+   + F+      A +D+K+ G+L+         G+  A   +L+A+ Y+G
Sbjct:   43 TPQELSDFLSRSQTSFIDFCLLARLDEKVVGLLNLSGEV-LSQGQAEADVFMLVAKTYRG  101
```

```
Query:   90 QGLGKALLKALLTEAKAQGYIK-IAMHVMGNNSRAISLYQKYGFTEEA        136
            G+G+ LL+  L  A+    YI+ + + V   N++AI LY+KYGF  E+
Sbjct:  102 YGIGQLLLEIALDWAEENPYIESLKLDVQVRNTKAIYLKKYGFRIES        149
```

Based on this analysis, it was predicted that these proteins and their epitopes could be useful antigens for vaccines or diagnostics.

Example 540

A DNA sequence (GBSx0579) was identified in *S. agalactiae* <SEQ ID 1725> which encodes the amino acid sequence <SEQ ID 1726>. Analysis of this protein sequence reveals the following:

Possible site: 46
>>> Seems to have no N-terminal signal sequence
----- Final Results -----
   bacterial cytoplasm --- Certainty = 0.2056 (Affirmative) <succ>
   bacterial membrane --- Certainty = 0.0000 (Not Clear) <succ>
   bacterial outside --- Certainty = 0.0000 (Not Clear) <succ>

A related DNA sequence was identified in *S. pyogenes* <SEQ ID 1727> which encodes the amino acid sequence <SEQ ID 1728>. Analysis of this protein sequence reveals the following:

Possible site: 60
>>> Seems to have no N-terminal signal sequence
----- Final Results -----
   bacterial cytoplasm --- Certainty = 0.2374 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database:

```
>GP: CAB14712 GB: Z99118 similar to hypothetical proteins [Bacillus subtilis]
Identities = 248/417 (59%), Positives = 314/417 (74%), Gaps = 4/417 (0%)
Query:    5 LALRMRPRNINEVIGQQHLVGNGKIIDRMVAANMLSSMILYGPPGIGKTSIASAIAGTTK    64
            LA RMRP  I ++IGQQHLV   KII RMV A  LSSMILYGPPGIGKTSIA+AIAG+T
Sbjct:    4 LAYRMRPTKIEDIIGQQHLVAEDKIIGRMVQAKHLSSMILYGPPGIGKTSIATAIAGSTS    63

Query:   65 YAFRTFNATVDSKKRLQEIAEEAKFSGGLVLLLDEIHRLDKTKQDFLLPLLENGNIIMIG   124
             AFR  NA +++KK ++ +A+EAK SG ++L+LDE+HRLDK KQDFLLP LENG II+IG
Sbjct:   64 IAFRKLNAVINNKKDMEIVAQEAKMSGQVILILDEVHRLDKGKQDFLLPYLENGMIILIG   123

Query:  125 ATTENPFFSVTPAIRSRVQIFELEPLSNEDIKKAIQLAISDKERGF-PFLVTIDDEALDF   183
            ATT NP+ ++  PAIRSR QIFELEPL+ E IK+A++ A+ D+ RG    V+IDD+A++
Sbjct:  124 ATTANPYHAINPAIRSRTQIFELEPLTPELIKQALERALHDEHRGLGTYSVSIDDQAMEH   183

Query:  184 IVTATNGDLRSAYNSLDAVMSTSPNEDGSRHISLETMENSLQCSYITMDKNGDGHYDIL   243
                    GD+RSA N+L+LAV+ST  + DG   HI+LET  E  LQ     + DK+GD  HYD+L
Sbjct:  184 FAHGCGGDVRSALNALELAVLSTKESADGEIHITLETAEECLQKKSFSHDKDGDAHYDVL   243

Query:  244 SALQKSIRGSDVNASLHYAARLVEAGDLPSLARRLTIIAYEDIGLANPEAQIHTVTALEA   303
            SA QKSIRGSD NA+LHY ARL+EAGDL S+ARRL +IAYEDIGLA+P+A     + A++
Sbjct:  244 SAFQKSIRGSDANAALHYLARLIEAGDLESIARRLLVIAYEDIGLASPQAGPRVLNAIQT   303

Query:  304 AQRIGFPEARILIANIVVDLALSPKSNSAYLAMDAALADLRRSGNLPIPRHLRDGHYSGS   363
            A+R+GFPEARI +AN V++L LSPKSNSA LA+D ALAD+R       +P+HL+D HY G+
Sbjct:  304 AERVGFPEARIPLANAVIELCLSPKSNSAILAIDEALADIRAGKIGDVPKHLKDAHYKGA   363

Query:  364 KTLGNARDYKYPHAYPEKWVKQQYLPDKLVGHNYFEANETGKYERALGSNKERIDKL    420
            +  LG    DYKYPH  Y    WV+QQYLPD L       Y++  +TGK+E  AL    K+  DKL
Sbjct:  364 QELGRGIDYKYPHNYDNGWVEQQYLPDPLKNKQYYKPKQTGKFESAL---KQVYDKL    417
```

An alignment of the GAS and GBS proteins is shown below:

```
Identities = 394/422 (93%), Positives = 409/422 (96%)
Query:    1 MADNLALRMRPRNINEVIGQQHLVGNGKIIDRMVAANMLSSMILYGPPGIGKTSIASAIA     60
            M D+LALRMRP+ I+EVIGQ+HLVG GKII RMV AN LSSMILYGPPGIGKTSIASAIA
Sbjct:    1 MPDHLALRMRPKTISEVIGQKHLVGEGKIIRRMVEANRLSSMILYGPPGIGKTSIASAIA     60

Query:   61 GTTKYAFRTFNATVDSKKRLQEIAEEAKFSGGLVLLLDEIHRLDKTKQDFLLPLLENGNI    120
            GTT+YAFRTFNAT+DSKKRLQEIAEEAKFSGGLVLLLDEIHRLDKTKQDFLLPLLENG I
Sbjct:   61 GTTRYAFRTFNATIDSKKRLQEIAEEAKFSGGLVLLLDEIHRLDKTKQDFLLPLLENGTI    120
```

```
                                    -continued
Query:   121 IMIGATTENPFFSVTPAIRSRVQIFELEPLSNEDIKKAIQLAISDKERGFPFLVTIDDEA    180
             IMIGATTENPFFSVTPAIRSRVQIFELEPLSNEDIK AIQLAISDKERGFPFLVTIDDEA
Sbjct:   121 IMIGATTENPFFSVTPAIRSRVQIFELEPLSNEDIKTAIQLAISDKERGFPFLVTIDDEA    180

Query:   181 LDFIVTATNGDLRSAYNSLDLAVMSTSPNEDGSRHISLETMENSLQCSYITMDKNGDGHY    240
             LDFIVTATNGDLRSAYNSLDLAVMSTSPNEDGSRHISLETMENSLQ SYITMDKNGDGHY
Sbjct:   181 LDFIVTATNGDLRSAYNSLDLAVMSTSPNEDGSRHISLETMENSLQRSYITMDKNGDGHY    240

Query:   241 DILSALQKSIRGSDVNASLHYAARLVEAGDLPSLARRLTIIAYEDIGLANPEAQIHTVTA    300
             D+LSALQKSIRGSDVNASLHYAARLVEAGDLPSLARRLTIIAYEDIGLANP+AQ+HTVTA
Sbjct:   241 DVLSALQKSIRGSDVNASLHYAARLVEAGDLPSLARRLTIIAYEDIGLANPDAQVHTVTA    300

Query:   301 LEAAQRIGFPEARILIANIVVDLALSPKSNSAYLAMDAALADLRRSGNLPIPRHLRDGHY    360
             L+AAQRIGFPEARI IAN+V+DLALSPKSNSAYLAMDAALADLR SGNLPIPRHLRDGHY
Sbjct:   301 LDAAQRIGFPEARIPIANVVIDLALSPKSNSAYLAMDAALADLRTSGNLPIPRHLRDGHY    360

Query:   361 SGSKTLGNARDYKYPHAYPEKWVKQQYLPDKLVGHNYFEANETGKYERALGSNKERIDKL    420
             +GSK LGNA+DY YPHAYPEKWVKQQYLPDKLVGH+YFEANETGKYERALGSNKERIDKL
Sbjct:   361 AGSKDLGNAKDYLYPHAYPEKWVKQQYLPDKLVGHHYFEANETGKYERALGSNKERIDKL    420

Query:   421 SD                                                             422
             SD
Sbjct:   421 SD                                                             422
```

Based on this analysis, it was predicted that these proteins and their epitopes could be useful antigens for vaccines or diagnostics.

Example 541

A DNA sequence (GBSx0580) was identified in *S. agalactiae* <SEQ ID 1729> which encodes the amino acid sequence <SEQ ID 1730>. Analysis of this protein sequence reveals the following:

Possible site: 16
>>> Seems to have no N-terminal signal sequence
----- Final Results -----
  bacterial cytoplasm --- Certainty = 0.2991 (Affirmative) <succ>
    bacterial membrane --- Certainty = 0.0000 (Not Clear) <succ>
      bacterial outside --- Certainty = 0.0000 (Not Clear) <succ>

A related GBS nucleic acid sequence <SEQ ID 10207> which encodes amino acid sequence <SEQ ID 10208> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

Example 542

A DNA sequence (GBSx0581) was identified in *S. agalactiae* <SEQ ID 1731> which encodes the amino acid sequence <SEQ ID 1732>. Analysis of this protein sequence reveals the following:

Possible site: 29
>>> Seems to have no N-terminal signal sequence
----- Final Results -----
  bacterial cytoplasm --- Certainty = 0.2402 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 543

A DNA sequence (GBSx0582) was identified in *S. agalactiae* <SEQ ID 1733> which encodes the amino acid sequence <SEQ ID 1734>. Analysis of this protein sequence reveals the following:

Possible site: 49
>>> Seems to have an uncleavable N-term signal seq
INTEGRAL    Likelihood = −10.40    Transmembrane 231-247 (225-250)
INTEGRAL    Likelihood = −9.92     Transmembrane 159-175 (151-179)
INTEGRAL    Likelihood = −9.08     Transmembrane 21-37 (18-43)
INTEGRAL    Likelihood = −9.08     Transmembrane 181-197 (176-201)
INTEGRAL    Likelihood = −3.35     Transmembrane 111-127 (110-130)
INTEGRAL    Likelihood = −2.81     Transmembrane 74-90 (74-93)
----- Final Results -----
  bacterial membrane --- Certainty = 0.5161 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the GENPEPT database:

```
>GP: CAB15891 GB: Z99123 yxlG [Bacillus subtilis]
Identities = 54/203 (26%), Positives = 100/203 (48%), Gaps = 7/203 (3%)
Query:    1 MTGLIPMLKKEWLENSRSHKALALLLISIIFGILGPLTALLMPEIMA--GILPKKLQEAI    58
            M  ++ +L+KEWLE  +S K + L +  +I G+  PLT    MPEI+A  G LP  ++ +
Sbjct:    1 MKVMMALLQKEWLEGWKSGKLIWLPIAMMIVGLTQPLTIYYMPEIIAHGGNLPDGMKISF    60

Query:   59 PDPTYLDSYSQYFKNINQLGLILLVFLFSGSLTQEFTRGTLINLITKGLSKKAIILAKFI   118
             P+  +        N LG+ L++F  GS+  E  +G    ++++ ++    I++K++
Sbjct:   61 TMPSGSEVMVSTLSQFNTLGMALVIFSVMGSVANERNQGVTALIMSRPVTAAHYIVSKWL   120

Query:  119 MMTLIWSISYILGSLTQYAYTLYYFNNHGQHKLIV-YGTSWIFGLLLLSLILFYSVIFRK   177
            + ++I  +S+  G     Y Y  F +  +      G   ++ + +++   L  S IFR
Sbjct:  121 IQSVIGIMSFAAGYGLAYYYVRLLFEDASFSRFAASLGLYALWVIFIVTAGLAGSTIFR-   179

Query:  178 TAGVLIAC---LMTIVAFFISGF                                        197
            + G    AC   L   V+F + F
Sbjct:  180 SVGAAAACGIGLTAAVSFAVHYF                                        202
```

No corresponding DNA sequence was identified in *S. pyogenes*.

Based on this analysis, it was predicted that this protein and its epitopes, could be useful antigens for vaccines or diagnostics.

Example 544

A DNA sequence (GBSx0583) was identified in *S. agalactiae* <SEQ ID 1735> which encodes the amino acid sequence <SEQ ID 1736>. This protein is predicted to be ABC transporter, ATP-binding protein. Analysis of this protein sequence reveals the following:

---
Possible site: 61
>>> Seems to have no N-terminal signal sequence
----- Final Results -----
    bacterial cytoplasm --- Certainty = 0.1344 (Affirmative) <succ>
    bacterial membrane --- Certainty = 0.0000 (Not Clear) <succ>
        bacterial outside --- Certainty = 0.0000 (Not Clear) <succ>
---

The protein has homology with the following sequences in the GENPEPT database:

There is also homology to SEQ ID 686.

Based on this analysis, it was predicted that this protein and its epitopes, could be useful antigens for vaccines or diagnostics.

Example 545

A DNA sequence (GBSx0584) was identified in *S. agalactiae* <SEQ ID 1737> which encodes the amino acid sequence <SEQ ID 1738>. Analysis of this protein sequence reveals the following:

---
Possible site: 32
>>> Seems to have no N-terminal signal sequence
----- Final Results -----
    bacterial cytoplasm --- Certainty = 0.4383 (Affirmative) <succ>
    bacterial membrane --- Certainty = 0.0000 (Not Clear) <succ>
        bacterial outside --- Certainty = 0.0000 (Not Clear) <succ>
---

The protein has homology with the following sequences in the GENPEPT database:

```
>GP: CAB15892 GB: Z99123 similar to ABC transporter (ATP-binding
protein) [Bacillus subtilis]
Identities = 116/303 (38%), Positives = 175/303 (570), Gaps = 18/303 (5%)
Query:    4 ISLQNLSKSFGDQIILNQVSLELEENKIYGFVGPNGAGKTTTIKMILGLLKVDSGTISVM    63
            +S+++L KS+        + VS + EN+    +GPNGAGKTTT++M+ GLL    SGTI ++
Sbjct:    2 LSIESLCKSYRHHEAVKNVSFHVNENECVALLGPNGAGKTTTLQMLAGLLSPTSGTIKLL    61

Query:   64 GNPVTFGQTKSNQVIGYLPDVPEFYDYMTAQEYLQLC---AGLAQNKTSLPIADLLEQVG   120
            G     +   ++IGYLP  P FY +MTA E+L     +GL++ K    I ++LE VG
Sbjct:   62 GE-----KKLDRRLIGYLPQYPAFYSWMTANEFLTFAGRLSGLSKRKCQEKIGEMLEFVG   116

Query:  121 LADN-QQRISTYSRGMKQRLGLAQALIHNPKILICDEPTSALDPQGRQEILSIISQLRGQ   179
            L +   +RI   YS GMKQRLGLAQAL+H PK LI DEP SALDP GR E+L ++ +L+
Sbjct:  117 LHEAAHKRIGGYSGGMKQRLGLAQALLHKPKFLILDEPVSALDPTGRFEVLDMMRELKKH   176

Query:  180 KTVIFSTHILSDVEKVCDQVLILTKSGIH---NLEDLRDKASASVNQLNLLIKVSDNEAQ   236
             V+FSTH+L D E+VCDQV+I+   I   L++L+ +  +V L++ K+         +
Sbjct:  177 MAVLFSTHVLHDAEQVCDQVVIMKNGEISWKGELQELKQQQQTNVFTLSVKEKLEGWLEE   236

Query:  237 KLALRFPLNQKDQYYKVHLELSEANNREQALASFYRYLVEQEITPYFIELLEDSLEDFYL   296
            K  +  +       EL + +    L+          + + +T  E    +SLED YL
Sbjct:  237 KPYVSAIVYKNPS--QAVFELPDIHAGRSLLSD----CIRKGLTVTRFEQKTESLEDVYL   290

Query:  297 EVI                                                            299
            +V+
Sbjct:  291 KVV                                                            293
```

```
>GP: AAB71491 GB: U53767 ORF6 [Bacillus pumilus]
Identities = 25/60 (41%), Positives = 41/60 (67%)
Query:    2 IGDTILFERTRLGMTQEKLSDYLHLTKATISKWENNQAKPDIDYLILMAKLFDMTLDELV    61
            +G  I  +R  L ++QE +++ L +++  ISKWE NQ++P +D LI +A+LFD  + ELV
Sbjct:    4 LGSNISNKRKSLKLSQEYVAEQLGVSRQAISKWETNQSEPSMDNLIRLAELFDSDIKELV    63
```

There is also homology to SEQ ID 1740.

Based on this analysis, it was predicted that this protein and its epitopes, could be useful antigens for vaccines or diagnostics.

Example 546

A DNA sequence (GBSx0585) was identified in *S. agalactiae* <SEQ ID 1741> which encodes the amino acid sequence <SEQ ID 1742>. Analysis of this protein sequence reveals the following:

Possible site: 41
>>> Seems to have no N-terminal signal sequence
----- Final Results -----
    bacterial cytoplasm --- Certainty = 0.4241 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database:

```
>GP: CAB15470 GB: Z99121 yvdC [Bacillus subtilis]
Identities = 59/104 (56%), Positives = 76/104 (72%)

Query:    1 MDITAYQKWVSEFYKKRNWYQYNSFIRSNFLCEEVGELAQAIRKYEIGRDRPDEIEKSNN    60
            M +  +KW+ EFY+KR W +Y  FIR  FL EE GELA+A+R YEIGRDRPDE E S
Sbjct:    1 MQLADAEKWMKEFYEKRGWTEYGPFIRVGFLMEEAGELARAVRAYEIGRDRPDEKESSRA    60

Query:   61 ENLNDIKEELGDVLDNIFILADQYNISLEEIIEAHKNKLEKRFE   104
            E    ++ EE+GDV+ NI  ILAD Y +SLE++++AH+ KL KRFE
Sbjct:   61 EQKQELIEEMGDVIGNIAILADMYGVSLEDVMKAHQEKLTKRFE                104
```

No corresponding DNA sequence was identified in *S. pyogenes*.

Based on this analysis, it was predicted that this protein and its epitopes, could be useful antigens for vaccines or diagnostics.

Example 547

A DNA sequence (GBSx0586) was identified in *S. agalactiae* <SEQ ID 1743> which encodes the amino acid sequence <SEQ ID 1744>. Analysis of this protein sequence reveals the following:

Possible site: 61
>>> Seems to have no N-terminal signal sequence
----- Final Results -----
    bacterial cytoplasm --- Certainty = 0.0453 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database:

```
>GP: BAB06803 GB: AP001517 unknown conserved protein [Bacillus halodurans]
Identities = 87/187 (46%), Positives = 125/187 (66%)

Query:    1 MKITVFCGASNGNNPIYSQKIVELGEWMIKNNHDLVYGGGKVGLMGVIADTVINNGGQAI    60
            MKI VFCG+SNG + +Y +    +LG+ + +      LVYGG  VG+MG +AD+V+  GG+ I
Sbjct:    1 MKIAVFCGSSNGASDVYKEGARQLGKELARRGITLVYGGASVGIMGAVADSVLEAGGEVI    60

Query:   61 GVIPTFLKDREIAHTNLSKLIVVENMPQRKGKMMSLGEAYIALPGGPGTLEEISEVISWS   120
            GV+P FL++ EI+H +L+KLIVVE M +RK KM  L + ++ALPGGPGTLEE  E+ +W+
Sbjct:   61 GVMPRFLEEPEISHPHLTKLIVVETMHERKAKMAELADGFLALPGGPGTLEEFFEIFTWA   120

Query:  121 RIGQNDSPCILYNINGYFNHLESMFDHMVSEGFLSQNDRNNVLFSDDIIEIEKFIKDYQS   180
            +IG +  PC L NIN YF+ L ++  HM +E FL +    R+  L    D I +    Y+
Sbjct:  121 QIGLHQKPCGLLNINHYFDPLVTLLHHMSNEQFLHEKYRSMALVHTDPILLLDQFSTYEP   180

Query:  181 PTIRKYS                                                       187
            PT++ YS
Sbjct:  181 PTVKAYS                                                       187
```

No corresponding DNA sequence was identified in *S. pyogenes*.

Based on this analysis, it was predicted that this protein and its epitopes, could be useful antigens for vaccines or diagnostics.

Example 548

A DNA sequence (GBSx0587) was identified in *S. agalactiae* <SEQ ID 1745> which encodes the amino acid sequence <SEQ ID 1746>. Analysis of this protein sequence reveals the following:

```
>GP: AAF12706 GB: AF066865 integrase [bacteriophage TPW22]
Identities = 106/377 (28%), Positives = 199/377 (52%), Gaps = 31/377 (8%)
Query:    4 ARYRRRGNQNLWAYEIREEGKTVAYNS----GFKTKKLAEAEAEPILQKLRTGSIITKNI   59
            A +R+RG    W + +   Y       G+KTKK AEA A+   ++L   S    +I
Sbjct:    2 ANFRKRGKT--WQFRLSYKDNNGEYKKFEKGGYKTKKEAEAAADEAKKRLNNHSEFDNDI   59

Query:   60 SLPELYQEWLDLKIMPSNRSDVTKKKYLSRKVTLEKLFGDKPISQIRPSEYQRIMNNYGQ  119
            SL + +++W +   P + ++ T + Y       ++K   DKPI++I P+ YQ ++N
Sbjct:   60 SLYDFFEKWAKVYKKP-HVTEATWRTYKRTLNLIDKYIKDKPIAEITPTFYQAVLNKMSL  118

Query:  120 RVSRNFLGRLNTGVKQSLQMAIADKVMIEDFTQNVELFSTVKSQDADSKYLHSEKAYLDL  179
              + L +    +K ++++A+ +KV+ E+F    +  S + ++   + KYLH+++ YL L
Sbjct:  119 LYRQESLDKFYFQIKSAMKIAVHEKVISENFADFTKAKSKLAARPVEEKYLHADE-YLKL  177

Query:  180 INAVKDKFNYKKSVVPYIIYFLLKTGMRYGELIALTWEDIDFDKGIFKTYRRFN-SETSQ  238
            +   ++K  Y    + Y     TGMR+ EL+ LTW +DFDK      R ++ S T+
Sbjct:  178 LAIAEEKMEYTSY---FACYLTAVTGMRFAELLGLTWSHVDFDKKEISIQRTWDYSITNN  234

Query:  239 FVPPKNKTSIRIVPVDNECLEILKNLKIEQNQSNKELGLQNTNNMVFQHFGYPNSVPSTN  298
            F    KN++S R +P+ ++ +++LK   K        KE   +N  + V +      S N
Sbjct:  235 FAETKNESSKRKIPISSKTIKLLKKYK-------KEYWHENKYDRVIYNL-------SNN  280

Query:  299 GTNKVLRGIVQELNIEPIITTKGARHTYGSFLWHRGYDLGIIAKILGHKDISMLIEVYGH  358
            G NK ++ ++    + P       RH++ S+L ++G DL   ++K+LGH+++++ ++VY H
Sbjct:  281 GLNKTIK-VIAGRKVHP----HSLRHSFASYLIYKGIDLLTVSKLLGHENLNVTLKVYAH  335

Query:  359 TLEEKIQEEYNEIKQLW                                            375
            L+E  QE  + I++++
Sbjct:  336 QLKEMEQENNDVIRKIF                                            352
```

Possible site: 16
>>> Seems to have no N-terminal signal sequence
----- Final Results -----
 bacterial cytoplasm --- Certainty = 0.5288 (Affirmative) <succ>
 bacterial membrane --- Certainty = 0.0000 (Not Clear) <succ>
 bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 549

A DNA sequence (GBSx0588) was identified in *S. agalactiae* <SEQ ID 1747> which encodes the amino acid sequence <SEQ ID 1748>. This protein is predicted to be integrase. Analysis of this protein sequence reveals the following:

Possible site:38
>>> Seems to have no N-terminal signal sequence
----- Final Results -----
 bacterial cytoplasm --- Certainty = 0.3685 (Affirmative) <succ>
 bacterial membrane --- Certainty = 0.0000 (Not Clear) <succ>
 bacterial outside --- Certainty = 0.0000 (Not Clear) <succ>

The protein has homology with the following sequences in the GENPEPT database:

There is also homology to SEQ ID 578.

Based on this analysis, it was predicted that this protein and its epitopes, could be useful antigens for vaccines or diagnostics.

Example 550

A DNA sequence (GBSx0589) was identified in *S. agalactiae* <SEQ ID 1749> which encodes the amino acid sequence <SEQ ID 1750>. Analysis of this protein sequence reveals the following:

Possible site: 54
>>> Seems to have no N-terminal signal sequence
----- Final Results -----
 bacterial cytoplasm --- Certainty = 0.2710 (Affirmative) <succ>
 bacterial membrane --- Certainty = 0.0000 (Not Clear) <succ>
 bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 551

A DNA sequence (GBSx0590) was identified in *S. agalactiae* <SEQ ID 1751> which encodes the amino acid sequence <SEQ ID 1752>. Analysis of this protein sequence reveals the following:

```
Possible site: 51
>>> Seems to have no N-terminal signal sequence
----- Final Results -----
   bacterial cytoplasm --- Certainty = 0.2534 (Affirmative) <succ>
   bacterial membrane --- Certainty = 0.0000 (Not Clear) <succ>
     bacterial outside --- Certainty = 0.0000 (Not Clear) <succ>
```

The protein has homology with the following sequences in the GENPEPT database:

```
>GP: BAA06248 GB: D29979 ORF3 [Bacillus stearothermophilus]
Identities = 81/263 (30%), Positives = 135/263 (50%), Gaps = 14/263 (5%)
Query:  65 MGVHVELKGQGCRQYEEFIEGNDNNWTSLVKRLI-DNNSNFTRLDIANDIFDESLNVQRL  123
           MG+HVE+ GQGCR +E      NW  L  RL+ +   N TRLD+A D F     +  L
Sbjct:   1 MGIHVEMTGQGCRLFELH---TSINWYELFYRLVYEYEVNITRLDVAVDDFKGYFKINTL   57

Query: 124 YEYSKKGLCITTARHAEYHEKFVIDSGELVGETVVFGARGNQQWCVYNKLMEQNGKLQTD  183
            +  K     +  A + E  VI+ GE +G T+ FGA   +  +  E+N ++  D
Sbjct:  58 VKKLKDDEVTSRFKKARHIENIVIEGGETIGHTLYFGAPSSD---IQVRFYEKNVQMGMD  114

Query: 184 IDINSWVRAELRCWQEKANLIAHQL-NDMRPLASIYFEAINGHYRFVSPKARDKNKRRRE  242
           ID+  W R E++    ++A+++A  + +D+ PL  I     +  +F + KA DKNK+R
Sbjct: 115 IDV--WNRTEIQLRDDRAHVVAQIIADDVLPLGEIVAGLLRNYIQFRTRKATDKNKKRWP  172

Query: 243 SVRWWQNYINTEEKTRLSIVREKPTLRQSEAWTDKQVSKTIAKVYMAKYEAYGIDQAEVF  302
             R+W N++   + R++     K ++ +   W D QVSK+   +Y   E    ++ + F
Sbjct: 173 LARFWLNFLGDVQPLRIAKQMPKTSIEKKYRWIDSQVSKSFFMIYYCLNE----EEKQRF  228

Query: 303 LQDLLRRGVEKFTDNDEKEIEQY                                      325
           + D+L  G  KT  D + I Q+
Sbjct: 229 IDDVLAEGASKLTKADLQVINQF                                      251
```

No corresponding DNA sequence was identified in *S. pyogenes*.

Based on this analysis, it was predicted that this protein and its epitopes, could be useful antigens for vaccines or diagnostics.

Example 552

A DNA sequence (GBSx0591) was identified in *S. agalactiae* <SEQ ID 1753> which encodes the amino acid sequence <SEQ ID 1754>. Analysis of this protein sequence reveals the following:

```
Possible site: 13
>>> Seems to have no N-terminal signal sequence
----- Final Results -----
   bacterial cytoplasm --- Certainty = 0.2700 (Affirmative) <succ>
   bacterial membrane --- Certainty = 0.0000 (Not Clear) <succ>
     bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 553

A DNA sequence (GBSx0592) was identified in *S. agalactiae* <SEQ ID 1755> which encodes the amino acid sequence <SEQ ID 1756>. Analysis of this protein sequence reveals the following:

```
Possible site: 50
>>> Seems to have no N-terminal signal sequence
----- Final Results -----
   bacterial cytoplasm --- Certainty = 0.3121 (Affirmative) <succ>
```

-continued

```
   bacterial membrane --- Certainty = 0.0000 (Not Clear) <succ>
     bacterial outside --- Certainty = 0.0000 (Not Clear) <succ>
```

The protein has no significant homology with any sequences in the GENPEPT database.

A related DNA sequence was identified in *S. pyogenes* <SEQ ID 1757> which encodes the amino acid sequence <SEQ ID 1758>. Analysis of this protein sequence reveals the following:

```
Possible site: 24
>>> Seems to have no N-terminal signal sequence
----- Final Results -----
   bacterial cytoplasm --- Certainty = 0.2913 (Affirmative) <succ>
   bacterial membrane --- Certainty = 0.0000 (Not Clear) <succ>
     bacterial outside --- Certainty = 0.0000 (Not Clear) <succ>
```

An alignment of the GAS and GBS proteins is shown below:

```
Identities = 19/52 (36%), Positives = 33/52 (62%)
Query:   8 FGPNLTRLRKERGISQVELSNQLQIGKQSISDYEKQKAFPTFANLDKIAEYF  59
           F  NL  L  ++ I Q+++ N+L I K +I+ Y K ++ PT  N+ K+A++F
Sbjct:  15 FSTNLNMLMAKKNIKQIDIHNKLGIPKSTITGYVKGRSLPTAGNVQKLADFF  66
```

Based on this analysis, it was predicted that these proteins and their epitopes could be useful antigens for vaccines or diagnostics.

Example 554

A DNA sequence (GBSx0593) was identified in *S. agalactiae* <SEQ ID 1759> which encodes the amino acid sequence <SEQ ID 1760>. Analysis of this protein sequence reveals the following:

Possible site: 54
>>> Seems to have a cleavable N-term signal seq.
----- Final Results -----
   bacterial outside --- Certainty = 0.3000 (Affirmative) <succ>
     bacterial membrane --- Certainty = 0.0000 (Not Clear) <succ>
       bacterial cytoplasm --- Certainty = 0.0000 (Not Clear) <succ>

Lipop: Possible site: −1   Crend: 8
McG: Discrim Score: 1.55
GvH: Signal Score (−7.5): 0.27
Possible site: 54
>>> Seems to have a cleavable N-term signal seq.
ALOM program   count: 0 value: 2.44 threshold: 0.0
PERIPHERAL          Likelihood = 2.44         214
modified ALOM score: −0.99
\*\*\* Reasoning Step: 3
----- Final Results -----
   bacterial outside --- Certainty = 0.3000 (Affirmative) <succ>
     bacterial membrane --- Certainty = 0.0000 (Not Clear) <succ>
       bacterial cytoplasm --- Certainty = 0.0000 (Not Clear) <succ>

The protein has homology with the following sequences in the GENPEPT database:

```
>GP: AAA98584 GB: L44593 ORF536; putative [Lactococcus phage BK5-T]
Identities = 248/532 (46%), Positives = 359/532 (66%), Gaps = 16/532 (3%)
Query:    1 MNFIEQISENNQFPIIFVGSGITQRYFENAPTWEKLLKDIWLELFDEESYYAK--AFELR   58
            MNFIE I +NNQFPIIFVGSG+T+RYF+N    WE+LL ++W  + +E+++Y +    FE
Sbjct:    1 MNFIENIKDNNQFPIIFVGSGVTKRYFKNGLKWEQLLLELWNLVEEEKAFYTQYHVFENL   60

Query:   59 ERFEN-----NDFDIYTNLASLLEKEVSKAFINGNIQVDNLDLKTAYELNISPFKQLVAN  113
            +  +N     +F+I   +A +LE++++ AF  +  +DNL  L   A+   +ISPF+Q +AN
Sbjct:   61 LKSKNLSKSDKEFEINLMMAGILEEKINNAFYSDELNIDNLTLAQAHTEHISPFRQCIAN  120

Query:  114 RFSNLKIREEKIEEIKQFSQMLSKARIIITTNYDNFIEECLKTINVSVKINVGNKGLFLK  173
            +FSNL  ++   EEI   FS+ML KAR  I+TTNYDNFIEEC    NVS+K+NVGN GLF+K
Sbjct:  121 TFSNLDRKKGFDEEIISFSKMLVKARFIVTTNYDNFIEECFSKRNVSIKVNVGNSGLFVK  180

Query:  174 SSDYGELYKIHGTVDDASTITITKEDYEKNVTKSALINAKILSNLVESPILFLGYSLTDE  233
            S+DYGELYKIHG+V + +TI IT EDY+ N +K AL+NAKILSNL ESPILF+GYSLTD+
Sbjct:  181 SNDYGELYKIHGSVKNPNTICITSEDYKNNESKLALVNAKILSNLTESPILFIGYSLTDK  240

Query:  234 NIRKLLTDFAENSPFDISESAQKIGVVEYLPDSESIETVVSSLPDLSVYYSCLKTDNFTN  293
            NIR+LLT ++EN P++ISE+A +IGVVEY PD   I+ +VS++PDL ++Y+ + TDN+
Sbjct:  241 NIRELLTSYSENLPYEISEAAARIGVVEYTPDKIEIQDIVSNIPDLGIHYTKISTDNYKK  300

Query:  294 IYRLISKINQGFLPSEIAKYENVFRKIIEVKGESKDLKTVLTSYEDLANLTEDEIRSKNI  353
            IY   IS+I  QG+LPSEIAK+E   FRKIIEVKG+ K+L TVLTS+ D++ +   +E+++KNI
Sbjct:  301 IYDEISQIEQGYLPSEIAKFEGAFRKIIEVKGKEKELDTVLTSFIDISKINTEELKNKNI  360

Query:  354 VVAFGDERYIYKFPDFKEYVRSYFLDKETIPQEIVIRFIATQPVASHLPIKKYMFAMSEY  413
            VVAFGD +YIYK P +K+Y+R YF + + + I +  F+ +    +P KK+M +  +
Sbjct:  361 VVAFGDSKYIYKMPTYKDYIREYFSNSMELDTRIALLFLKKRSANYPVPYKKHMGVIESW  420

Query:  414 --ISKDSNKYTENIKKRLSKEEELSLDDFTSSIGVPLL--HSKTLERQTEIVGILE-ADV  468
              I   D  + E++K R+S   E    I  ++    L    + L  + I   ++ ++V
Sbjct:  421 GSIPNDLVQEVESLKTRISNFPESIVRTYSIKANKDLAKKYLPYLNKTSTIEDVMSLSNV  480

Query:  469 PDNVRYNFIATHIKNFPKEELFLLVEKIID----EGIFETSRRRFLKAFDLL          516
            P   + FI   I  F  EEL  + K ID    +GI  T  R+ + ++ ++
Sbjct:  481 PLYNKLRFILFKIDKFKVEELKDFIVKNIDMGEGKGISSTLYRKIVMSYSII          532
```

A related GBS gene <SEQ ID 8599> and protein <SEQ ID 8600> were also identified. Analysis of this protein sequence reveals the following:

The protein has homology with the following sequences in the databases:

```
47.3/69.1% over 531aa
Lactococcus lactis
EGAD|36707| hypothetical protein Insert characterized
GP|928833|gb|AAA98584.1||L44593 ORF536; putative {Lactococcus lactis phage BK5-T}
Insert characterized
PIR|T13261|T13261 hypothetical protein 536-phage BK5-T Insert characterized
ORF00184(301-1848 of 2154)
EGAD|36707|38110(1-532 of 536) hypothetical protein {Lactococcus lactis}
```

```
GP|928833|gb|AAA98584.1||L44593 ORF536; putative {Lactococcus lactis phage BK5-
T}PIR|T13261|T13261 hypothetical protein 536-Lactococcus lactis phage BK5-T
% Match = 32.3
% Identity = 47.2 % Similarity = 69.0
Matches = 247 Mismatches = 155 Conservative Sub.s = 114

126       156       186       216       246       276       306       336
     RMLILKAFYLAKFLKYYC*KK*CGTKRGQLYFRVYGLIIKINKMVSKML**D*QLNKLIINKR*GQELVNFIEQISENNQ
                                                                    :||||  |  :|||
                                                                    MNFIENIKDNNQ
                                                                            10

366       396       426       456       474       495       525       555
     FPIIFVGSGITQRYFENAPTWEKLLKDIWLELFDEESYYAK--AFE--LRER---FENNDFDIYTNLASLLEKEVSKAFI
     ||||||||||:|:|||:|  ||:|| ::|   : :|:::|  :   ||  |::    :|:|   :|  :|:||::::  ||
     FPIIFVGSGVTKRYFKNGLKWEQLLLELWNLVEEEKAFYTQYHVFENLLKSKNLSKSDKEFEINLMMAGILEEKINNAFY
             30         40        50        60        70        80        90

585       615       645       675       705       735       765       795
     NGNIQVDNLDLKTAYELNISPFKQLVANRFSNLKIREEKIEEIKQFSQMLSKARIIITTNYDNFIEECLKTINVSVKINV
     :  : :|||  |  |: :||||:|  :|| ||||    ::   ||| ||:||  |||   |||:|||||||:   |||:|||:
     SDELNIDNLTLAQAHTEHISPFRQCIANTFSNLDRKKGFDEEIISFSKMLVKARFIVTTNYDNFIEECFSKRNVSIKVNV
              110       120       130       140       150       160       170

825       855       885       915       945       975       1005      1035
     GNKGLFLKSSDYGELYKIHGTVDDASTITITKEDYEKNVTKSALINAKILSNLVESPILFLGYSLTDENIRKLLTDFAEN
     ||  |||:||:|||||||||:| :  ||  ||   |||:  |  :|  ||:||||||||   ||||||:||||||||   ::||
     GNSGLFVKSNDYGELYKIHGSVKNPNTICITSEDYKNNESKLALVNAKILSNLTESPILFIGYSLTDKNIRELLTSYSEN
              190       200       210       220       230       240       250

1065      1095      1125      1155      1185      1215      1245      1275
     SPFDISESAQKIGVVEYLPDSESIETVVSSLPDLSVYYSCLKTDNFTNIYRLISKINQGFLPSEIAKYENVFRKIIEVKG
      |::|||:|   :|||||||  ||    |: :||::||| ::|: :   |||:    ||  ||:|  ||:||||||||:|   ||||||||
     LPYEISEAAARIGVVEYTPDKIEIQDIVSNIPDLGIHYTKISTDNYKKIYDEISQIEQGYLPSEIAKFEGAFRKIIEVKG
              270       280       290       300       310       320       330

1305      1335      1365      1395      1425      1455      1485      1515
     ESKDLKTVLTSYEDLANLTEDEIRSKNIVVAFGDERYIYKFPDFKEYVRSYFLDKETIPQEIVIRFIATQPVASHLPIKK
      : |:|  |||||:  |:: :    :|:::||||||||  :||||  | :   :|::|||||||:|       |   |
     KEKELDTVLTSFIDISKINTEELKNKNIVVAFGDSKYIYKMPTYKDYIREYFSNSMELDTRIALLFLKKRSANYPVPYKK
              350       360       370       380       390       400       410

1569      1599      1629           1683      1710      1740
     YMFAMSEY--ISKDSNKYTENIKKRLSKEEELSLDDFTSSIGVPLLHS--KTLERQTEIVGILE-ADVPDNVRYNFIATH
      :|  :   :    |  |  |::|  |:|     |   :  ::     |    | ::  | ::    ::||    :     ||
     HMGVIESWGSIPNDLVQEVESLKTRISNFPESIVRTYSIKANKDLAKKYLPYLNKTSTIEDVMSLSNVPLYNKLRFILFK
              430       440       450       460       470       480       490

1770                1818      1848      1878      1908      1938      1968
     IKNFPKEELFLLVEKIID----EGIFETSRRRFLKAFDLLHY*IKKSQHCYAMRDFFWTTINKRYENNCFYLTSILQYIF
     |  |   |||  ::  |||          :||    |   |:  :  ::   :::        |
     IDKFKVEELKDFIVKNIDMGEGKGISSTYLRKIVMSYSIITEGI
              510       520       530
```

No corresponding DNA sequence was identified in *S. pyogenes*.

Figure 33:
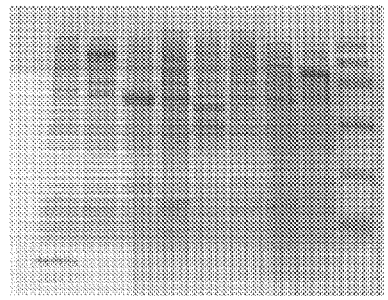

SEQ ID 8600 (GBS142) was expressed in *E. coli* as a His-fusion product. SDS-PAGE analysis of total cell extract is shown in FIG. 18 (lane 5; MW 54 kDa). It was also expressed in *E. coli* as a GST-fusion product. SDS-PAGE analysis of total cell extract is shown in FIG. 33 (lane 6; MW 79.8 kDa).

The GBS142-GST fusion product was purified (FIG. 195, lane 3) and used to immunise mice. The resulting antiserum was used for Western blot (FIG. 249). These tests confirm that the protein is immunoaccessible on GBS bacteria.

Based on this analysis, it was predicted that these proteins and their epitopes could be useful antigens for vaccines or diagnostics.

Example 555

A DNA sequence (GBSx0594) was identified in *S. agalactiae* <SEQ ID 1761> which encodes the amino acid sequence <SEQ ID 1762>. This protein is predicted to be integrase. Analysis of this protein sequence reveals the following:

Possible site: 37

>>> Seems to have no N-terminal signal sequence

----- Final Results ----- bacterial cytoplasm --- Certainty = 0.2933 (Affirmative) <succ> bacterial membrane --- Certainty = 0.0000 (Not Clear) <succ> bacterial outside --- Certainty = 0.0000 (Not Clear) <succ>

The protein has homology with the following sequences in the GENPEPT database:

```
>GP: AAA98585 GB: L44593 integrase [Lactococcus phage BK5-T]
Identities = 124/382 (32%), Positives = 202/382 (52%), Gaps = 21/382 (5%)
Query:   1 MATYRQRGKKKLWDYRIFNEKSELVA-SGSGFKTKREAMNEAMRIE---QQKLLVNSISS  56
           MATY++RGK    W Y I    K  L   +  GF TK +A  EAM IE    ++ +V+ I
Sbjct:   1 MATYQKRGKT--WQYSISRTKQGLPRLTKGGFSTKSDAQAEAMDIESKLKKGFIVDPIKQ 58

Query:  57 DITLYDL-WFEWYSLIIKPSNLAETTKNKYFTRGSVIRKLFGNQKVNKIKHSAYQRKLNT 115
           +I+ Y    W E Y     K + + E T    Y        ++      N   +++I   S+YQR LN
Sbjct:  59 EISEYFKDWMELY----KKNAIDEMTYKGYEQTLKYLKTYMPNVLISEITASSYQRALNK 114

Query: 116 YAEKYTKNHVRRLNSDIKKAIQFAKRDGVLLSDFTDGVVIAGRKFVKDADDKYLHSIFD- 174
           +AE + K     +  ++ ++ +IQ      +G L  DFT     V+ G     K   DK+++   FD
Sbjct: 115 FAETHAKASTKGFHTRVRASIQPLIEEGRLQKDFTTRAVVKGNGNDKAEQDKFVN--FDE 172

Query: 175 YKKVISYLENNLD--YSNSIVYYLLLVLFKTGLRVGEALALTWDDVNFEDLEIKTYR--R 230
           YK+++ Y  N L+   YS+  + +++ +     TG+R  EA   L WDD++F  +    IK    R
Sbjct: 173 YKQLVDYFRNRLNPNYSSPTMLFIISI---TGMRASEAFGLVWDDIDFNNNTIKCRRTWN 229

Query: 231 FSGDKGTFSPPKTKTSIRTIPISQSLALILRDLKDDQQVMLKNLKIVNMNNQIFYDYRYG 290
           +       G F   PKT     IR I I         +L+D ++ Q+ +  ++L  I  +++ +  Y
Sbjct: 230 YRNKVGGFKKPKTDAGIRDIVIDDESMQLLKDFREQQKTLFESLGIKPIHDFVCYHPYRK 289

Query: 291 VSTNSAINKSLKNVLKILNINSKMTATGARHTYGSYLLAKGVDIWVVARLMGHKDITQLL 350
           +  T  SA+   +L +  LK  LNI++ +T   G RHT+ S LL    GVDI   V++ +GH   +
Sbjct: 290 IITLSALQNTLDHALKKLNISTPLTIHGLRHTHASVLLYHGVDIMTVSKRLGHASVAITQ 349

Query: 351 ETYGHVLTEVINKEYETVRSLV                                       372
           +TY H++ E+ NK+ + +   L+
Sbjct: 350 QTYIHIIKELENKDKDKIIELL                                       371
```

There is also homology to SEQ ID 578.

Based on this analysis, it was predicted that this protein and its epitopes, could be useful antigens for vaccines or diagnostics.

Example 556

A DNA sequence (GBSx0595) was identified in *S. agalactiae* <SEQ ID 1763> which encodes the amino acid sequence <SEQ ID 1764>. Analysis of this protein sequence reveals the following:

---
Possible site: 54
>>> Seems to have no N-terminal signal sequence
----- Final Results -----
    bacterial cytoplasm --- Certainty = 0.1603 (Affirmative) <succ>
      bacterial membrane --- Certainty = 0.0000 (Not Clear) <succ>
        bacterial outside --- Certainty = 0.0000 (Not Clear) <succ>
---

A related GBS nucleic acid sequence <SEQ ID 10209> which encodes amino acid sequence <SEQ ID 10210> was also identified.

The protein has homology with the following sequences in the GENPEPT database:

No corresponding DNA sequence was identified in *S. pyogenes*.

Based on this analysis, it was predicted that these proteins and their epitopes could be useful antigens for vaccines or diagnostics.

Example 557

A DNA sequence (GBSx0596) was identified in *S. agalactiae* <SEQ ID 1765> which encodes the amino acid sequence <SEQ ID 1766>. Analysis of this protein sequence reveals the following:

---
Possible site: 14
>>> Seems to have an uncleavable N-term signal seq
INTEGRAL    Likelihood = -3.88    Transmembrane 12-28 (11-29)
----- Final Results -----
    bacterial membrane --- Certainty = 0.2550 (Affirmative) <succ>
      bacterial outside--- Certainty = 0.0000 (Not Clear) <succ>
        bacterial cytoplasm --- Certainty = 0.0000 (Not Clear) <succ>
---

The protein has homology with the following sequences in the GENPEPT database:

```
>GP: BAB07266 GB: AP001519 unknown conserved protein in others
[Bacillus halodurans
]
Identities = 26/71 (36%), Positives = 39/71 (54%), Gaps = 6/71 (8%)

Query:  37 WWDIDNLQELLGIGRSKLINDILLNPDIKKEVDLSINPNGFIVYPKGKGSRYKILATK--  94
           WW + +L+E  G      L  +ILL+P  K  +D  I   GF+ YP+ KG R+    +A+
Sbjct:   4 WWSMQDLKERTGYSEDWLKENILLHPRYKPMLD--IENGGFVYYPEKKGERWCFIASSME 61

Query:  95 --ARKYFEDNF                                                  103
              +KYF+D  F
Sbjct:  62 EFLKKYFKDIF                                                  72
```

```
>GP: AAB99663 GB: U67604 chromosome segretation protein (smc1)
[Methanococcus jannaschii]
Identities = 53/210 (25%), Positives = 95/210 (45%), Gaps = 33/210 (15%)
Query:   20 IFTNVGVLISNSRDNKAIQRELELLEEGQEKLVDEFSKISTNQYDKYV----------LI   69
             +F  +G+L  N     + + + +   + K++DE S I+     K             LI
Sbjct:  133 LFRRLGLLGDNVISQGDLLKIINISPIERRKIIDEISGIAEFDEKKKKAEEELKKARELI  192

Query:   70 Q------SNLSNNIEKNKQELVQKNSYVK--EDTKYIRDEMLIEKKSK-----EEVYNHV  116
             +      S + NN++K K+E        Y+K  E+ K  +  ++++K S       E + N +
Sbjct:  193 EMIDIRISEVENNLKKLKKEKEDAEKYIKLNEELKAAKYALILKKVSYLNVLLENIQNDI  252

Query:  117 KNGDKLIEKMAFANELILKFGEVSRENQMLGLKVNSLEEKIVDLSNQPKNDEISKLRKSI  176
             KN ++L         NE + K  E+  E + L L++N+      I++  N+  N+E+ +L KSI
Sbjct:  253 KNLEEL------KNEFLSKVREIDVEIENLKRLNN----IINELNEKGNEEVLELHKSI  302

Query:  177 SSFERELSRFEDVGYSEAEEIKSTLRRILN                               206
                E E+    + V  S    E+K      I N
Sbjct:  303 KELEVEIENDKKVLDSSINELKKVEVEIEN                               332
```

No corresponding DNA sequence was identified in *S. pyogenes*.

Figure 42:
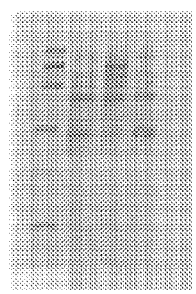
Figure 47:
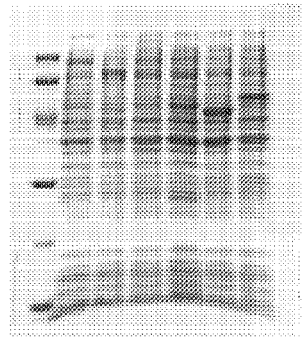

SEQ ID 1766 (GBS315) was expressed in *E. coli* as a His-fusion product. SDS-PAGE analysis of total cell extract is shown in FIG. 42 (lane 4; MW 26.7 kDa) and in FIG. 239 (lane 5; MW 41 kDa). It was also expressed in *E. coli* as a GST-fusion product. SDS-PAGE analysis of total cell extract is shown in FIG. 47 (lane 5; MW 52 kDa).

Based on this analysis, it was predicted that these proteins and their epitopes could be useful antigens for vaccines or diagnostics.

Example 558

A DNA sequence (GBSx0597) was identified in *S. agalactiae* <SEQ ID 1767> which encodes the amino acid sequence <SEQ ID 1768>. This protein is predicted to be surface protein. Analysis of this protein sequence reveals the following:

Possible site: 26
>>> Seems to have a cleavable N-term signal seq.
INTEGRAL    Likelihood = –7.70    Transmembrane 229-245 (226-248)
----- Final Results -----
   bacterial membrane --- Certainty = 0.4079 (Affirmative) <succ>
      bacterial outside --- Certainty = 0.0000 (Not Clear) <succ>
      bacterial cytoplasm --- Certainty = 0.0000 (Not Clear) <succ>

The protein has homology with the following sequences in the GENPEPT database:

```
>GP: CAA47097 GB: X66468 orf iota [Streptococcus pyogenes]
Identities = 90/262 (34%), Positives = 138/262 (52%), Gaps = 26/262 (9%)
Query:    4 VKVLSLITV-SGLFLMAGNLSASADVVISGGDTIMLSGVDAGVSDSIMPPPSSINPV---   59
             +K L+L+T+ S   L++  + + AD    S D +L+ D V     P + ++PV
Sbjct:    1 MKKLALLTLFSTTLLVSAPIVSFADETASSSDINILADDDPVVPVEPTDPTTPVDPVDPV   60

Query:   60 -----------TDTTEPSAPTPSTDPI--TDTTEPSAPTPSTDPI--TDTTEPSAPTPST  104
                        T+ TEP+ PT   T+P    T+ TEP+ PT   T+P    T+ TEP+ PT   T
Sbjct:   61 DPVDPVDPVDPTEPTEPTEPTEPTEPTEPTEPTEPTEPTEPTEPTEPTEPTEPTEPTEPT  120

Query:  105 DQTTGTTDSS-TPSSSTTNPVDGITDNGTKPNAGIDKPSTNKPSDHSESSI--KPVTKPT  161
             + T  T  +  T S T P +         T+P   +      +PS  +E ++    KPV
Sbjct:  121 EPTEPTEPTEPTEPSKPTEPTE--PSKPTEPTEPTEPSKPTEPSKPTEPTVPNKPVDTNP  178

Query:  162 INQPITTVTGDQVIGTQDGKVLVQTPSGTQLK-DAAEVGGNVQKDGTVAIKKSDGKIEVL  220
             I     P+ T TG   ++  +D K  ++Q   GT   K   +A E+G  +VQKDGTV +K  SDGK++VL
Sbjct:  179 IENPVNTDTGVVIVAVEDSKPIIQLADGTTKKVEAKEIGADVQKDGTVTVKGSDGKMKVL  238

Query:  221 PKTGEGKTI-FTIVGLLLIAGA                                       241
             PKTGE   I  +++G L++  G+
Sbjct:  239 PKTGETANIALSVLGSLMVLGS                                       260
```

There is also homology to SEQ ID 760.

Figure 295:
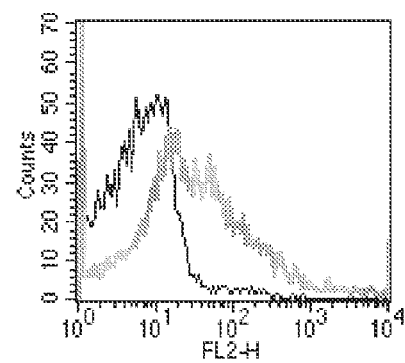

SEQ ID 1768 (GBS141) was expressed in *E. coli* as a His-fusion product. SDS-PAGE analysis of total cell extract is shown in FIG. 19 (lane 4; MW 35 kDa). The GBS141-His fusion product was purified (FIG. 194, lane 3) and used to immunise mice. The resulting antiserum was used for FACS (FIG. 295), which confirmed that the protein is immunoaccessible on GBS bacteria.

Based on this analysis, it was predicted that this protein and its epitopes, could be useful antigens for vaccines or diagnostics.

Example 559

A DNA sequence (GBSx0598) was identified in *S. agalactiae* <SEQ ID 1769> which encodes the amino acid sequence <SEQ ID 1770>. Analysis of this protein sequence reveals the following:

Possible site: 18
>>> Seems to have a cleavable N-term signal seq.
----- Final Results -----
   bacterial outside --- Certainty = 0.3000 (Affirmative) <succ>
   bacterial membrane --- Certainty = 0.0000 (Not Clear) <succ>
   bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

A related GBS gene <SEQ ID 8601> and protein <SEQ ID 8602> were also identified. Analysis of this protein sequence reveals the following:

```
Lipop: Possible site: -1    Crend: 4
McG: Discrim Score: 14.39
GvH: Signal Score (-7.5): -1.23
Possible site: 18
>>> Seems to have a cleavable N-term signal seq.
ALOM program    count: 0 value: 8.96 threshold: 0.0
PERIPHERAL                 Likelihood = 8.96           104
modified ALOM score: -2.29
*** Reasoning Step: 3
----- Final Results -----
    bacterial outside --- Certainty = 0.3000 (Affirmative) <succ>
        bacterial membrane --- Certainty = 0.0000 (Not Clear) <succ>
        bacterial cytoplasm --- Certainty = 0.0000 (Not Clear) <succ>
```

SEQ ID 1770 (GBS17) was expressed in *E. coli* as a His-fusion product. SDS-PAGE analysis of total cell extract is shown in FIG. 4 (lane 2; MW 24 kDa).

Figure 189:
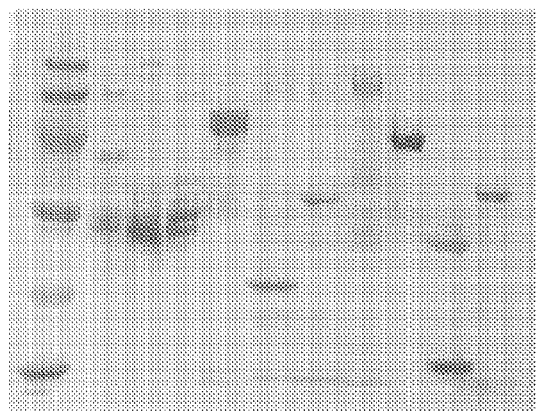
FIGS. 189 to 237 and 240 to 246 show SDS-PAGE analysis of purified GBS proteins of the invention. The left-hand lane contains molecular weight markers. These are 94, 67, 43, 30, 20.1, and 14.4 kDa.

The His-fusion protein was purified as shown in FIG. 189, lane 10.

Example 560

A DNA sequence (GBSx0599) was identified in *S. agalactiae* <SEQ ID 1771> which encodes the amino acid sequence <SEQ ID 1772>. Analysis of this protein sequence reveals the following:

```
Possible site: 23
>>> Seems to have a cleavable N-term signal seq.
----- Final Results -----
    bacterial outside --- Certainty = 0.3000 (Affirmative) <succ>
        bacterial membrane --- Certainty = 0.0000 (Not Clear) <succ>
        bacterial cytoplasm --- Certainty = 0.0000 (Not Clear) <succ>
```

A related GBS gene <SEQ ID 10779> and protein <SEQ ID 10780> were also identified. A further related GBS nucleic acid sequence <SEQ ID 10957> which encodes amino acid sequence <SEQ ID 10958> was also identified.

The protein has no significant homology with any sequences in the GENPEPT database.

No corresponding DNA sequence was identified in *S. pyogenes*.

Figure 129:
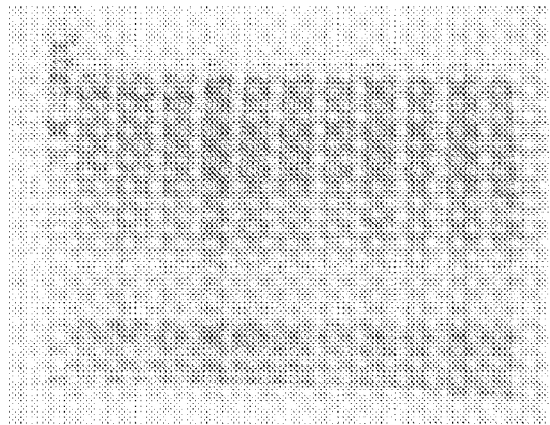

SEQ ID 1772 (GBS643) was expressed in *E. coli* as a GST-fusion product. SDS-PAGE analysis of total cell extract is shown in FIG. 129 (lane 2-4; MW 79 kDa) and in FIG. 186 (lane 2; MW 79 kDa). It was also expressed in *E. coli* as a His-fusion product. SDS-PAGE analysis of total cell extract is shown in FIG. 129 (lane 5-7; MW 54 kDa) and in FIG. 176 (lane 5; MW 54 kDa).

GBS643-GST was purified as shown in FIG. 236, lane 7.

Based on this analysis, it was predicted that these proteins and their epitopes could be useful antigens for vaccines or diagnostics.

Example 561

A DNA sequence (GBSx0600) was identified in *S. agalactiae* <SEQ ID 1773> which encodes the amino acid sequence <SEQ ID 1774>. Analysis of this protein sequence reveals the following:

```
Possible site: 27
>>> Seems to have no N-terminal signal sequence
----- Final Results -----
    bacterial cytoplasm --- Certainty = 0.5815 (Affirmative) <succ>
        bacterial membrane --- Certainty = 0.0000 (Not Clear) <succ>
        bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 562

A DNA sequence (GBSx0601) was identified in *S. agalactiae* <SEQ ID 1775> which encodes the amino acid sequence <SEQ ID 1776>. This protein is predicted to be membrane protein. Analysis of this protein sequence reveals the following:

```
Possible site: 33
>>> Seems to have no N-terminal signal sequence
INTEGRAL    Likelihood = -13.32   Transmembrane 311-327 (282-332)
INTEGRAL    Likelihood = -10.46   Transmembrane 293-309 (282-310)
INTEGRAL    Likelihood = -8.55    Transmembrane 390-406 (388-410)
INTEGRAL    Likelihood = -7.64    Transmembrane 49- 65 (40-69)
INTEGRAL    Likelihood = -5.68    Transmembrane 100-116 (98-122)
INTEGRAL    Likelihood = -4.35    Transmembrane 130-146 (127-148)
INTEGRAL    Likelihood = -3.88    Transmembrane 344-360 (342-363)
----- Final Results -----
    bacterial membrane --- Certainty = 0.6328 (Affirmative) <succ>
        bacterial outside --- Certainty = 0.0000 (Not Clear) <succ>
        bacterial cytoplasm --- Certainty = 0.0000 (Not Clear) <succ>
```

The protein has homology with the following sequences in the GENPEPT database:

```
>GP: CAB70618 GB: AJ243106 membrane protein [Streptococcus thermophilus]
Identities = 234/665 (35%), Positives = 379/665 (56%), Gaps = 59/665 (8%)
Query:   13 FAKVKDVDIFALKAYMEITH-GAETGAQSILLDVFVNFPFFLLNLIVGLFSVILRFFENF    71
            FAK+K VDIF+LK+YME T+ G+  GA   ++ ++FVN  FF+LN +VG FS+++R   E
Sbjct:    5 FAKLKGVDIFSLKSYMEPTNFGSFNGAWVLINELFVNLFFFILNAVVGFFSLLIRILEKI   64

Query:   72 SLYDTYKQTVYHSSQKLWENLSGN--GSYTS-SLLYLLVAISAFSIFISYLFSKGDFSKR  128
            LY TYK  V+H +  +W   +G+  G+ T+ SL+  L+ + AF +F  Y FSKG FS+
Sbjct:   65 DLYATYKTYVFHGASSIWHGFTGSNTGNITNKSLVGTLLLVLAFYLFYQYFFSKGSFSRT  124

Query:  129 LIHLFVVIILGMGYFGTIQSTSGGIYILDTVHQLAGSFSDAVTNLSLDNPSGGKTKITQK  188
            L+H+ +V++L +GYFGT   TSGG+Y+LDTV+ ++     +   + +D        KI +
Sbjct:  125 LLHVCLVLLLALGYFGTVAGTSGGLYLLDTVNNVSKDVTKKIAGIKVDYARDKSIKIGK-  183
```

-continued

```
Query:   189 SSVADNYVMKTSYTAYLFVNTGQLNGKFHNNQTGKEEKFDNEQVLGKYDKSGKFITPKQK 248
             S++D+Y+ +TSY AY+FVNTGQ NGK+ N+Q GKEE FD+ +VLG  DK+G F   K K
Sbjct:   184 -SMSDSYIAETSYKAYVFVNTGQENGKYKNSQDGKEEAFDDSKVLGTSDKNGNFKAVKAK 242

Query:   249 DILNYTDNLGDKATEGEEKNRWLSAVNDYLWIKSGYVILKIFEAVILAVPLILIQLIAFM 308
             +   Y D+LG+ A +  EKNRW+SA+ D+++ +  YVI KI EA +LAVP+ILIQL+  +
Sbjct:   243 ERSKYLDDLGEGANDDGEKNRWVSAMPDFIFTRVFYVIFKIVEAFVLAVPIILIQLLNVV 302

Query:   309 ADVLVIILMFIFPLALLVSFLPRMQDIIFNVLKVMFGAVSFPALAGFLTLIVFYTQTLIA 368
             A +LV+ ++ +FP+ LL+SF+PRMQ+++F VLKVMFG + FPA+    LTL++FY + +I
Sbjct:   303 AQILVLTMILLFPVVLLMSFVPRMQELVFGVLKVMFGGLIFPAITTLLTLLIFYIEKMIE 362

Query:   369 TFVKKKFTDGSLLSGSNFKGQAILFMLLITVFVQGCVFWGIWKYKETFLRLIIGSRASQV 428
             V    F DG L +  +    ++F LL++V  +G +++ IW++K   L+  I+GS+A  V
Sbjct:   363 NIVTNGF-DGVLKTLPSLLLFGLVFKLLVSVVSKGVIYFLIWRFKGQLLQFILGSKARMV 421

Query:   429 -------INQSVDKINEKAENLGITPKSIYERAHDMSSLAMMGAGYGVGIMMNAQ---DN 478
                    +  V K  E A  +    P       A  +  + GAG+G G MMNA+      N
Sbjct:   422 ATDIGTKVEHGVTKSKEVASQV---PTRSLATAQHLGNFTLAGAGFGTGVMMNAKSHFQN 478

Query:   479 WNAFKERQQANLDDGQSKTNDADKYDEANADDTVISKEAELTNEGEYQSELPKEASKRIE 538
             +F   R++ +   +    +      + + +I         ++ P +   K I
Sbjct:   479 AGSFFTRKEPSQPETVMPSGPTEAPITPESPEPIIP-----------PTQTPPDNFKTIG 527

Query:   539 QLGKESSYELSFISEGNSTEEILKNVKSDNHTFQEGDGDTSLTNQDMITNDIENHSNNYT 598
             +     +   +SEG + E                           ++ +    +
Sbjct:   528 EEKPTPPSDSPIMSEGTPSSE--------------------------DEFQTLKEEWM 559

Query:   599 SPLKQRKLNKLEGELSQFNSDVSMTKNHGKNAFEKGFNASKTKEVRKQHNLERQSKVLEE 658
             SP KQ  ++N LE  L   +    +M K  G NAF + +   +  T++  +  +N+ER+ ++  +
Sbjct:   560 SPFKQHRINTLERRLDAYKDPQAMYKAQGSNAFTRAYRKTLTRDDKIRANIERRDRLTQR 619

Query:   659 LEKLR                                                        663
             L +LR
Sbjct:   620 LNQLR                                                        624
```

No corresponding DNA sequence was identified in *S. pyogenes*.

Based on this analysis, it was predicted that this protein and its epitopes, could be useful antigens for vaccines or diagnostics.

Possible site: 28
>>> Seems to have no N-terminal signal sequence
----- Final Results -----
  bacterial cytoplasm --- Certainty = 0.3714 (Affirmative) <succ>
  bacterial membrane --- Certainty = 0.0000 (Not Clear) <succ>
  bacterial outside --- Certainty = 0.0000 (Not Clear) <succ>

Example 563

A DNA sequence (GBSx0602) was identified in *S. agalactiae* <SEQ ID 1777> which encodes the amino acid sequence <SEQ ID 1778>. This protein is predicted to be conjugative protein. Analysis of this protein sequence reveals the following:

The protein has homology with the following sequences in the GENPEPT database:

```
>GP: CAB70617 GB: AJ243106 conjugative protein [Streptococcus thermophilus]
Identities = 515/757 (68%), Positives = 612/757 (80%), Gaps = 1/757 (0%)
Query:     1 MSDFEADLADDVKELGLETLDFTVDTLTHEMEIPYQFDWLIGVDLGKGQYNANIKEFIYN   60
             M DF   LADD +ELG E L +TVD LT EMEIPYQFDW+IGV L K + + A +K+  Y
Sbjct:    78 MRDFSEALADDSRELGEELLLYTVDRLTDEMEIPYQFDWVIGVTLRKQNHGATVKDLAYE  137

Query:    61 QFESIASNFASLAGYEVEVDEDWYKEHSEEELLVYSLLSTLKAKRLTDVDLFYYQRMQFL  120
              F     +  A  GYE +   WY ++  +E   ++   S L+AKRLT+ +LFYYQRMQ+L
Sbjct:   138 SFNEFSEKIAKGLGYEYALSPTWYDDYRSDEFTIFQAFSVLRAKRLTNEELFYYQRMQYL  197

Query:   121 RYVPHTKSEVIANRNMLNVTDTLIKSLEGGFLKLESAYGSSFVSVLPVGRFSTIFNGFHL  180
             RY+PH K EV+ANR+  N+TDTLIK L+GGFL+LES YGSSFV++LPVG+F    FNGFHL
Sbjct:   198 RYIPHYKKEVLANRSQFNITDTLIKVLKGGFLELESPYGSSFVTILPVGKFPVQFNGFHL  257

Query:   181 GELVQRMSFPVELRFKAEFIDKTKLGGTMGRSNTRYDQIMKEAYNTNTVQQDDILMGAYS  240
             GE VQR++FPVELR KAEFID  K+ G MGRSNTRY IM+EA NT+TVQQD+I+MG+ S
Sbjct:   258 GEFVQRLNFPVELRIKAEFIDTNKIKGRMGRSNTRYRNIMEEAENTDTVQQDEIIMGSIS  317

Query:   241 LKDLMKKVGNKEEIIEYGCYLVVAGSSLNQLKQRRYAILSYFDDMKVNVYEASHDTPYLF  300
             LKDLMKKVGNKE+IIEYG YL+V+ SS+NQL+QRR   IL+YFDDM V + EAS D PYLF
Sbjct:   318 LKDLMKKVGNKEDIIEYGAYLIVSASSVNQLRQRRQVILNYFDDMGVEISEASQDGPYLF  377

Query:   301 QALLYGQDLQKTTRKWNHLVTARGFSELMLFTNTQSGNRIGWYIGRVDNRLTAWDSIDEA  360
             QALLYG++LQK TR W H+VTARGFSELM FTNT SGNRIGWYIGRVDN + WDSI +A
Sbjct:   378 QALLYGENLQKKTRTWTHMVTARGFSELMPFTNTSSGNRIGWYIGRVDNWIGRWDSIAKA  437
```

```
-continued
Query:  361 IMGSKNLVLFNATVANKEDVAGKVTKNPHVIITGATGQGKSYLAQMIFLHTAQQNVRVLY  420
             I  SKN+VL+NATV NKED+AGK+TKNPH+IITGATGQGKS+LAQ+IFL  A QNV+ LY
Sbjct:  438 IDSSKNIVLYNATVGNKEDIAGKITKNPHIIITGATGQGKSFLAQIIFLSVALQNVKTLY  497

Query:  421 VDPKRELRQHYLKVVSDPEYARKFPLRKKQIEETNFVTLDSSVKENHGVLDPIVILDKEG  480
            +DPKRELR HY +V++ PE+AR++P RKKQI+  NFVTLDSS+  NHGVLDPIV+LDKE
Sbjct:  498 IDPKRELRNHYQEVINSPEFARRYPERKKQIDNFNFVTLDSSLPSNHGVLDPIVVLDKEQ  557

Query:  481 ASSTAKNMLLYLLKNATEIKLDQTTALTEAISQVIAKREAGEVVGFNQVIEVLIDSESDE  540
            A   AKNML +LL+   ++ +DQ TA+TEAI+ ++ +R AGE VGF  V+E L ++ S E
Sbjct:  558 AVEVAKNMLEFLLQAVDDVTMDQKTAITEAINTIVERRVAGENVGFKHVLETLRNASSSE  617

Query:  541 VQSVGRYFKAIIQNSILELAFSDGDVAGLSYEERVTVLEVADLSLPKDGSDHISDHESNS  600
            + SVGRY +I+ NSILELAFSDG   GL+YE RVT+LEV +L LPKD S  ISDHE NS
Sbjct:  618 IASVGRYLTSIVTNSILELAFSDGTTPGLNYESRVTILEVNNLKLPKDDSTKISDHERNS  677

Query:  601 IALMFALGAFCKHFGERSDDE-TVEIFDEAWVLMQSSEGKAVIKSMRRVGRSKYNVLMLV  659
            IALMFALGAFC HFGER+++E T+E FDEAW+LM+S+EGKAVIK+MRR+GRSK N L L+
Sbjct:  678 IALMFALGAFCTHFGERNENEDTIEFFDEAWILMKSAEGKAVIKNMRRIGRSKNNTLALI  737

Query:  660 SQSVHDAENDDDTTGFGTIFSFYEKSEREDILSHVGLEVTPKNLEWIDNMISGQCLYYDV  719
            +QSVHDAENDDDTTGFGTIF+FYEKSEREDIL HV LEVT  NLEWIDNMISGQCLYYDV
Sbjct:  738 TQSVHDAENDDDTTGFGTIFAFYEKSEREDILRHVNLEVTESNLEWIDNMISGQCLYYDV  797

Query:  720 YGNLNMISIHNIHPDIDPLLKPMKKTVSSHLENKYAS                         756
            YGNLNMIS+HN+  DID LLKPMK TVSS LENKYAS
Sbjct:  798 YGNLNMISVHNLFEDIDMLLKPMKATVSSSLENKYAS                         834
```

No corresponding DNA sequence was identified in *S. pyogenes*.

Based on this analysis, it was predicted that this protein and its epitopes, could be useful antigens for vaccines or diagnostics.

Example 564

A DNA sequence (GBSx0604) was identified in *S. agalactiae* <SEQ ID 1779> which encodes the amino acid sequence <SEQ ID 1780>. This protein is predicted to be ISL2 protein. Analysis of this protein sequence reveals the following:

---
Possible site: 26
>>> Seems to have no N-terminal signal sequence
----- Final Results -----
  bacterial cytoplasm --- Certainty = 0.3469 (Affirmative) <succ>
  bacterial membrane --- Certainty = 0.0000 (Not Clear) <succ>
  bacterial outside --- Certainty = 0.0000 (Not Clear) <succ>
---

The protein has homology with the following sequences in the GENPEPT database:

```
>GP: CAC18595 GB: AJ278419 IS1381 transposase [Streptococcus pneumoniae]
Identities = 110/125 (88%), Positives = 119/125 (95%)
Query:   81 MNYEASKQLTDVRFKRLVGVQRTTFEEMLAVLKTAYQRKHAKGGRTPKLSLEDLLMATLQ  140
            MNYEASKQLTD RFKRLVGVQRTTFEEMLAVLKTAYQ KHAKGGR PKLSLEDLLMATLQ
Sbjct:    1 MNYEASKQLTDARFKRLVGVQRTTFEEMLAVLKTAYQLKHAKGGRKPKLSLEDLLMATLQ   60

Query:  141 YMREYRTYEQIAADEGIHESNLIRRSQWVESTLIQSGFTISKTHLSAEDTVIVDATEVKI  200
            Y+REYRTYE+IAADFG+HESNL+RRSQWVE TL+QSG TIS+T LS+EDTV++DATEVKI
Sbjct:   61 YVREYRTYEEIAADFGVHESNLLRRSQWVEVTLVQSGVTISRTPLSSEDTVMIDATEVKI  120

Query:  201 NRPKK                                                         205
            NRPKK
Sbjct:  121 NRPKK                                                         125
```

No corresponding DNA sequence was identified in *S. pyogenes*.

Based on this analysis, it was predicted that this protein and its epitopes, could be useful antigens for vaccines or diagnostics.

Example 565

A DNA sequence (GBSx0605) was identified in *S. agalactiae* <SEQ ID 1781> which encodes the amino acid sequence <SEQ ID 1782>. Analysis of this protein sequence reveals the following:

---
Possible site: 61
>>> Seems to have no N-terminal signal sequence
INTEGRAL    Likelihood = −12.58    Transmembrane 39-55 (32-66)
----- Final Results -----
  bacterial membrane --- Certainty = 0.6031 (Affirmative) <succ>
  bacterial outside --- Certainty = 0.0000 (Not Clear) <succ>
  bacterial cytoplasm --- Certainty = 0.0000 (Not Clear) <succ>
---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 566

A DNA sequence (GBSx0606) was identified in *S. agalactiae* <SEQ ID 1783> which encodes the amino acid sequence <SEQ ID 1784>. This protein is predicted to be Cag-W. Analysis of this protein sequence reveals the following:

Possible site: 59
>>> Seems to have no N-terminal signal sequence
INTEGRAL    Likelihood = −3.82    Transmembrane 50-66 (49-66)
INTEGRAL    Likelihood = −3.72    Transmembrane 25-41 (23-45)
----- Final Results -----
   bacterial membrane --- Certainty = 0.2529 (Affirmative) <succ>
      bacterial outside --- Certainty = 0.0000 (Not Clear) <succ>
         bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 567

A DNA sequence (GBSx0607) was identified in *S. agalactiae* <SEQ ID 1785> which encodes the amino acid sequence <SEQ ID 1786>. Analysis of this protein sequence reveals the following:

Possible site: 55
>>> Seems to have no N-terminal signal sequence
INTEGRAL    Likelihood = −7.80    Transmembrane 36-52 (32-60)
----- Final Results -----
   bacterial membrane --- Certainty = 0.4121 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the GENPEPT database:

```
>GP: CAB12298 GB: Z99106 similar to transposon protein [Bacillus subtilis]
Identities = 68/339 (20%), Positives = 133/339 (39%), Gaps = 49/339 (14%)
Query:   16 KKEEGGKQPKTKEVKQRTANFIV--YGILGLLFIVGFFGSLRAIGLSNQVQHLKETVIAV   73
            K+ E  ++ K K  + R+     V +  +G L +      L +I  +Q+  +K+
Sbjct:   24 KRIERPEKDKQKVPRDRSKLIAVTLWSCVGSLLFICLLAVLLSINTRSQLNDMKDETNKP   83

Query:   74 EKKSKHKKTDDSLDISRIQYYMNNFVYYYINYS--QDTADQRKTELENY--------YSF  123
            K K     + ++   + +++ F+  Y+N     Q++ ++R    LE+Y          +
Sbjct:   84 TNDDKQK-----ISVTAAENFLSGFINEYMNVKNDQESIEKRMQSLESYMVKQEDNHFED  138

Query:  124 STASMTDDVRKSRTLQTQRLISVEKEKDYYIALMRIGYEV--------------------  163
                       D ++  R L+   L +V++     +   ++ YE
Sbjct:  139 EERFNVDGLKGDRELKGYSLYNVKEGDKNSLFQYKVTYENLYPVEKEVEKEVKDGKKKKK  198

Query:  164 --------DKKSYQMNLAVPFQMQRGLLAIVSQPYTVAEDLYLGKSKAFEKKTLDQVKEL  215
                    +K    QM L +P   +      A+  + PY     +Y  K    K   + E
Sbjct:  199 VKEKVKTNEKYEKQMLLNIPVTNKGDSFAVSAVPYFT--QIYDLKGDIAFKGKEETRDEY  256

Query:  216 SKEQVSSIQKFLPVFFNKYALINKTDLKLLMKTPELMGKGFKVSELDLNNAIYYQEKKHQ  275
            + E+  SI+ FL FF KYA     K ++ +MK PE +       E  +    ++ KK
Sbjct:  257 AGEKKESIESFLQNFFEKYASEKKEEMVYMMKKPEALEGNLLFGE--VQSVKIFETKKGF  314

Query:  276 VVQLSVTFEDLVTGGTRSENFTLYLFKADNGWYVEEMYH                      314
            V  +V F++        +E F+L + +   +YV ++ H
Sbjct:  315 EVFCAVRFKEKENDIPVNEKFSLEITENSGQFYVNKLKH                      353
```

No corresponding DNA sequence was identified in *S. pyogenes*.

Figure 145:
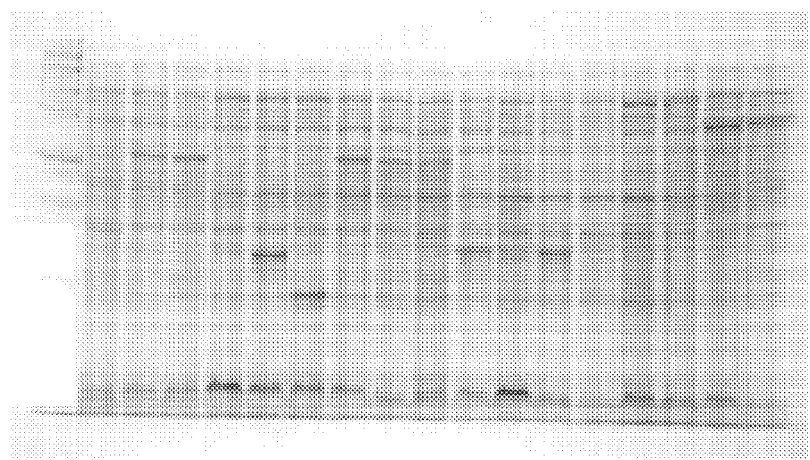

SEQ ID 1786 (GBS333d) was expressed in *E. coli* as a GST-fusion product. SDS-PAGE analysis of total cell extract is shown in FIG. 145 (lane 8-10; MW 58 kDa). It was also expressed in *E. coli* as a His-fusion product. SDS-PAGE analysis of total cell extract is shown in FIG. 145 (lane 11 & 13; MW 33 kDa), in FIG. 182 (lane 2; MW 33 kDa) and in FIG. 185 (lane 3; MW 58 kDa).

GBS333d-GST was purified as shown in FIG. 236, lane 2.

Based on this analysis, it was predicted that this protein and its epitopes, could be useful antigens for vaccines or diagnostics.

Example 568

A DNA sequence (GBSx0608) was identified in *S. agalactiae* <SEQ ID 1787> which encodes the amino acid sequence <SEQ ID 1788>. Analysis of this protein sequence reveals the following:

Possible site: 54
>>> Seems to have no N-terminal signal sequence
----- Final Results -----
   bacterial cytoplasm --- Certainty = 0.4177 (Affirmative) <succ>
      bacterial membrane --- Certainty = 0.0000 (Not Clear) <succ>
         bacterial outside --- Certainty = 0.0000 (Not Clear) <succ>

The protein has homology with the following sequences in the GENPEPT database:

```
>GP: CAB38326 GB: Y17736 hypothetical protein [Streptomyces
coelicolor A3(2)]
Identities = 45/80 (56%), Positives = 56/80 (690)
```

```
Query:   4 FTEEAWKDYVSWQQEDKKILKRINRLIEDIKRDPFEGIGKPEPLKYHYSGAWSRRITEEH    63
           FT   W+DYV W + D+K+ KRINRLI DI RDPF+G+GKPEPLK   SG WSRRI + H
Sbjct:   5 FTSHGWEDYVHWAESDRKVTKRINRLIADIARDPFKGVGKPEPLKGDLSGYWSRRIDDTH    64

Query:  64 RLIYMIEDGEIYFLSFRDHY                                             83
           RL+Y   D ++   +  R HY
Sbjct:  65 RLVYKPTDDQLVIVQARYHY                                             84
```

No corresponding DNA sequence was identified in *S. pyogenes*.

Based on this analysis, it was predicted that this protein and its epitopes, could be useful antigens for vaccines or diagnostics.

Example 569

A DNA sequence (GBSx0609) was identified in *S. agalactiae* <SEQ ID 1789> which encodes the amino acid sequence <SEQ ID 1790>. Analysis of this protein sequence reveals the following:

Possible Site: 53
>>> Seems to have no N-terminal signal sequence
----- Final Results -----
  bacterial cytoplasm --- Certainty = 0.5669 (Affirmative) <succ>
  bacterial membrane --- Certainty = 0.0000 (Not Clear) <succ>
  bacterial, outside --- Certainty = 0.0000 (Not Clear) <succ>

A related GBS nucleic acid sequence <SEQ ID 10211> which encodes amino acid sequence <SEQ ID 10212> was also identified.

The protein has homology with the following sequences in the GENPEPT database:

```
>GP: AAD17306 GB: AF121418 putative Phd protein [Francisella
tularensis subsp. novicida]
Identities = 26/84 (30%), Positives = 45/84 (52%)
Query:    4 MEAIVYSHFRNNLKDYMKKVNDEFEPLIVVNKNPDENIVVLSQDSWESLQETIRLMENDY   63
            M+  + YS FRN L D M +V        P+IV   +  E +V++S + +++ +ET  LM +
Sbjct:    1 MQTVNYSTFRNELSDSMDRVTKNHSPMIVTRGSKKEAVVMMSLEDFKAYEETAYLMRSMN   60
Query:   64 LSHKVINGISQVKEKQVTKHGLIE                                      87
            ++  N I +V+     + LIE
Sbjct:   61 NYKRLQNSIDEVESGLAIQKELIE                                      84
```

No corresponding DNA sequence was identified in *S. pyogenes*.

Based on this analysis, it was predicted that these proteins and their epitopes could be useful antigens for vaccines or diagnostics.

Example 570

A DNA sequence (GBSx0610) was identified in *S. agalactiae* <SEQ ID 1791> which encodes the amino acid sequence <SEQ ID 1792>. Analysis of this protein sequence reveals the following:

Possible site: 55
>>> Seems to have no N-terminal signal sequence
----- Final Results -----
  bacterial cytoplasm --- Certainty = 0.2407 (Affirmative) <succ>
  bacterial membrane --- Certainty = 0.0000 (Not Clear) <succ>
  bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 571

A DNA sequence (GBSx0611) was identified in *S. agalactiae* <SEQ ID 1793> which encodes the amino acid sequence <SEQ ID 1794>. Analysis of this protein sequence reveals the following:

Possible site: 28
>>> Seems to have no N-terminal signal sequence
----- Final Results -----
  bacterial cytoplasm --- Certainty = 0.1274 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 10213> which encodes amino acid sequence <SEQ ID 10214> was also identified.

The protein has homology with the following sequences in the GENPEPT database:

```
>GP: AAB60015 GB: U09422 ORF18 [Enterococcus faecalis]
Identities = 41/140 (29%), Positives = 73/140 (51%), Gaps = 3/140 (2%)
Query:   23 FPVEMSELKLALGLREEDDLEYIIADSDCQL-LKEHDSIEMINQFVELVENVDSELVKAV   81
            FP++   E+K  +GL +E +  EY I D +     + E+ SI  +N+   E+V  +  EL   +
Sbjct:   26 FPIDFEEVKEKIGLNDEYE-EYAIHDYELPFTVDEYTSIGELNRLWEMVSELPEELQSEL   84

Query:   82 HQVIGYTASDFVDYDFNFGDCCLLSDVTTRRELGEYYFDELGVQGVGKEALEMYFDHEAY  141
            ++ + +S    +   +  D  + SD      ++  YY +E G  G     +L+ Y D++AY
Sbjct:   85 SALLTHFSS-IEELSEHQEDIIIHSDCDDMYDVARYYIEETGALGEVPASLQNYIDYQAY  143
```

```
Query:  142  GRDIDLESQGGFSDYGYVEI   161
             GRD+DL      +++G  EI
Sbjct:  144  GRDLDLSGTFISTNHGIFEI   163
```

No corresponding DNA sequence was identified in S. pyogenes.

Based on this analysis, it was predicted that these proteins and their epitopes could be useful antigens for vaccines or diagnostics.

Example 572

A DNA sequence (GBSx0612) was identified in S. agalactiae <SEQ ID 1795> which encodes the amino acid sequence <SEQ ID 1796>. Analysis of this protein sequence reveals the following:

Possible site: 31
>>> Seems to have no N-terminal signal sequence
----- Final Results -----
  bacterial cytoplasm --- Certainty = 0.1366 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 573

A DNA sequence (GBSx0613) was identified in S. agalactiae <SEQ ID 1797> which encodes the amino acid sequence <SEQ ID 1798>. Analysis of this protein sequence reveals the following:

Possible site: 41
>>> Seems to have no N-terminal signal sequence
----- Final Results -----
  bacterial cytoplasm --- Certainty = 0.1484 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 574

A DNA sequence (GBSx0614) was identified in S. agalactiae <SEQ ID 1799> which encodes the amino acid sequence <SEQ ID 1800>. This protein is predicted to be abortive phage resistance protein. Analysis of this protein sequence reveals the following:

Possible site: 58
>>> Seems to have no N-terminal signal sequence
----- Final Results -----
  bacterial cytoplasm --- Certainty = 0.2205 (Affirmative) <succ>
    bacterial membrane --- Certainty = 0.0000 (Not Clear) <succ>
      bacterial outside --- Certainty = 0.0000 (Not Clear) <succ>

A related GBS nucleic acid sequence <SEQ ID 10215> which encodes amino acid sequence <SEQ ID 10216> was also identified.

The protein has homology with the following sequences in the GENPEPT database:

```
>GP: AAB53710 GB: U94520 abortive phage resistance protein
[Lactococcus lactis]
Identities = 131/499 (26%), Positives = 210/499 (41%), Gaps = 97/499 (19%)
Query:    3  MFSKIEFKNFMSFSNLT-----------------FDLLNRGKCKDIIAIYGENGSGKTN   44
             M     F+NF+SF  L+                 D+ N  K   + IYG N SGK++
Sbjct:    1  MLVNFRFENFLSFDKLSTFSMAPGKSRQHMEDLIELDIKNNQKLLKLSTIYGANASGKSS  60

Query:   45  IVEAF---KLLVL-----SLQSMESLNENTRLQSLLKEQTNKE---ENQKTNFGDISEIL   93
             V+A    K L++      L    S N+NT   SL + +    E  E++   ++G  S IL
Sbjct:   61  FVDAIGISKSLIIRGFYNGLVLSNSYNKNTVDNSLNETKFEYEIVIEDKVYSYG-FSVIL  119

Query:   94  DKISFFTTFKGIAKNTHRIASEGNTILKYYFNIEKDNGYYLLEYNENNELVKEELVFKIK  153
             F + +     N  ++           Y    KDN       YN N+E       L    +
Sbjct:  120  SLKKFMSEWLYDITNDEKM---------IYTIDRKDN-----SYNINDEF----LNLDEQ  161

Query:  154  SNKGVHFSITNIDGLSQSLNKTIFKNTIFKDLTEQIEKYWGKHTFLSIFN--NYCLEV--  209
             SN   +  I +   S + N  +F N++    D  + IE      F  +FN  N  LEV
Sbjct:  162  SNNRISIYIDD----SANDNTQLFLNSL-NDGKKTIESKDNSTIFKKVFNWFNNTLEVLG  216
```

```
                                    -continued
Query:  210 ---------------NEEF---INEQVSINFQKVVDEFDKIFIWSGNFRGPFHSTELLLK  251
                           EEF    + + + +N  V+D           N   P    E +L
Sbjct:  217 PGDEARGSIASLTQEEEEFKEDLGKYLELNDTGVIDIVQVPVDNLSNV--PAKLQERILD  274

Query:  252 DISKGKIDKSEKEKLSYTEEIIYKYFSALYIDIKDVKYKQDAQGQEIKYELMIRKNIGGD  311
            +I+   I K +KE+      E I   F+ +     +++   Q+   Q   +EL   K+ G
Sbjct:  275 NITT-DIKKKKKER-----EDIEISFNTILNTSQNIYIIQNNDEQFEYFELKF-KHKNGT  327

Query:  312 LLDVPISLESQGTKNLLDLLKV-FNNVLDGKICIVDEIDSGIHDLLMNSILNDLK--GSV  368
            L    +S ES GT  L++L   V F+N  D K+ ++DEID  +H LL  + +    K   S+
Sbjct:  328 LYS--LSEESDGTVRLIELFSVLFHN--DEKVFVIDEIDRSLHPLLTYNFIESFKKQKSI  383

Query:  369 NGQLIFTTHDTTLL--KELSPSSAYFLNVDIKGNKVIISGNEADKKIGVNNNLEKLYLSG  426
            N QLI TTH+  +L  + L        +F++ + +GN  + S  E  ++   + ++   YL+G
Sbjct:  384 N-QLIVTTHEDYILNFELLRRDEVWFVDKNFEGNSSMFSLEEFKERF--DKDINTSYLNG  440

Query:  427 FFGAVPDPLDIDFSDLFLD                                          445
            +G +P+ L    FS+    D
Sbjct:  441 RYGGIPN-LSCLFSEFAKD                                          458
```

No corresponding DNA sequence was identified in *S. pyogenes*.

Based on this analysis, it was predicted that these proteins and their epitopes could be useful antigens for vaccines or diagnostics.

Example 575

A DNA sequence (GBSx0615) was identified in *S. agalactiae* <SEQ ID 1801> which encodes the amino acid sequence <SEQ ID 1802>. This protein is predicted to be repressor (rstR-1). Analysis of this protein sequence reveals the following:

---

Possible site: 37
>>> Seems to have no N-terminal signal sequence
----- Final Results -----
    bacterial cytoplasm --- Certainty = 0.3724 (Affirmative) <succ>
    bacterial membrane --- Certainty = 0.0000 (Not Clear) <succ>
    bacterial outside --- Certainty = 0.0000 (Not Clear) <succ>

---

The protein has homology with the following sequences in the GENPEPT database:

```
>GP: AAB84427 GB: AF027868 transcription regulator [Bacillus subtilis]
Identities = 31/81 (38%), Positives = 53/81 (65%), Gaps = 2/81 (2%)
Query:   9 QKLKELRKEKKLTQTELASKLNISQKSYSNWESGKAEPTLDNIIKLANILDVTVDYLLGR   68
           Q+L++LRK   KLT +LA K+ I++ SY   +E+     +P LD ++  LA +  DV+VDY+LG
Sbjct:   4 QRLRQLRKAHKLTMEQLAEKIGIAKSSYGGYEAESKKPPLDKLVILARLYDVSVDYILGL   63

Query:  69 SDNFSNTIVLSKNNMKSFSKR                                         89
           +D+     +   + N+K F ++
Sbjct:  64 TDDPDPKV--ERKNLKEFLEK                                         82
```

There is also homology to SEQ ID 1740.

Based on this analysis, it was predicted that this protein and its epitopes, could be useful antigens for vaccines or diagnostics.

Example 576

A DNA sequence (GBSx0616) was identified in *S. agalactiae* <SEQ ID 1803> which encodes the amino acid sequence <SEQ ID 1804>. Analysis of this protein sequence reveals the following:

---

Possible site: 13
>>> Seems to have no N-terminal signal sequence
----- Final Results -----
    bacterial cytoplasm --- Certainty = 0.3607 (Affirmative) <succ>
    bacterial membrane --- Certainty = 0.0000 (Not Clear) <succ>
    bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 577

A DNA sequence (GBSx0617) was identified in *S. agalactiae* <SEQ ID 1805> which encodes the amino acid sequence <SEQ ID 1806>. Analysis of this protein sequence reveals the following:

---

Possible site: 22
>>> Seems to have no N-terminal signal sequence
----- Final Results -----
    bacterial cytoplasm --- Certainty = 0.0564 (Affirmative) <succ>
    bacterial membrane --- Certainty = 0.0000 (Not Clear) <succ>
    bacterial outside --- Certainty = 0.0000 (Not Clear) <succ>

---

A related GBS nucleic acid sequence <SEQ ID 10217> which encodes amino acid sequence <SEQ ID 10218> was also identified.

The protein has homology with the following sequences in the GENPEPT database:

```
>GP: CAB12294 GB: Z99106 similar to transposon protein [Bacillus subtilis]
Identities = 93/348 (26%), Positives = 164/348 (46%), Gaps = 28/348 (8%)
Query:    81 SRLQVMIDYVRITLKDVRDLEFFCRNFLHCAFKEFQPFESKLMNYNHLWKRGDIWIFDFA  140
                S L  M+DY+R++ K   D++      LH +       +S   Y    ++   I +F  A
Sbjct:    26 SPLVSMVDYIRVSFK-THDVDRIIEEVLHLSKDFMTEKQSGFYGYVGTYELDYIKVFYSA   84

Query:   141 DKHETGNFQITVQLSGRGCRQLELLMETEKFTWHDWLSYLRNSYRDDMNVTRFDIAIDEL  200
                        G   + +++SG+GCRQ E  +E  K TW+D   + ++   +   + TRFD+AID+
Sbjct:    85 PDDNRG---VLIEMSGQGCRQFESFLECRKKTWYD---FFQDCMQQGGSFTRFDLAIDD-  137

Query:   201 YLGKDRENEQFHLSDMISKYYRHELDFESLRTWNYIGGGSLNFSDMEEIEQNRQGISLYF  260
                        +   F + +++ K   + E       R   ++   GS + SD        G ++YF
Sbjct:   138 ------KKTYFSIPELLKKAQKGEC-ISRFRKSDF--NGSFDLSD-----GITGGTTIYF  183

Query:   261 GSRQSEMYFNFYEKRYEIAKQEGITVEEALEIFELWNRYEIRLSQSKANAAVDEFISGVP  320
                        GS++SE Y  FYEK YE A++  I +EE +     WNRYE+RL   +A  A+D  +
Sbjct:   184 GSKKSEAYLCFYEKNYEQAEKYNIPLEELGD----WNRYELRLKNERAQVAIDALLKTKD  239

Query:   321 IGEISRGLIVSKIDVYDGKNEY--GSFQADRKWQLMFGGVEPLKFVTKPEAYSIERTLRW  378
                        +   I+  +I + +   D          ++    W   G V   L   KP+      +++  W
Sbjct:   240 LTLIAMQIINNYVRFVDADENITREHWKTSLFWSDFIGDVGRLPLYVKPQKDFYQKSRNW  299

Query:   379 LSDSVSPSLAMIREYDMIVDGDYLQTILNSGEVNERGEKILDSIKASL             426
                        L +S +P++ M+ E D  +     L ++   E+ ++ +K+LD     A +
Sbjct:   300 LRNSCAPTMKMVLEADEHLGKTDLSDMIAEAELADKHKKMLDVYMADV             347
```

No corresponding DNA sequence was identified in *S. pyogenes*.

A related GBS gene <SEQ ID 8603> and protein <SEQ ID 8604> were also identified. Analysis of this protein sequence reveals a RGD motif at residues 131-133.

The protein has homology with the following sequences in the databases:

```
29.4/54.5% over 342aa
Bacillus subtilis
EGAD|1108511| hypothetical protein Insert characterized OMNI|NT01BS0566 conserved
hypothetical protein Insert characterized
GP|1881297|dbj|BAA19324.1||AB001488 SIMILAR TO ORF20 OF ENTEROCOCCUS FAECALIS TRANSPOSON
TN916. Insert characterized
GP|2632787|emb|CAB12294.1||Z99106 similar to transposon protein Insert characterized
PIR|G69774|G69774 transposon-related protein homolog ydcR-Insert characterized
ORF00101(205-1581 of 1887)
EGAD|1108511|BS0487(6-348 of 352) hypothetical protein {Bacillus subtilis} OMNI|NT01BS0566
conserved hypothetical protein GP|1881297|dbj|BAA19324.1||AB001488 SIMILAR TO ORF20 OF
ENTEROCOCCUS FAECALIS TRANSPOSON TN916. {Bacillus subtilis}
GP|2632787|emb|CAB12294.1||Z99106 similar to transposon protein {Bacillus subtilis}
PIR|G69774|G69774 transposon-related protein homolog ydcR-Bacillus subtilis
% Match = 9.7
% Identity = 29.3 % Similarity = 54.4
Matches = 103 Mismatches = 146 Conservative Sub.s = 88

153       183       213       243       273              489       519
GVV*RSENGHAGHSAHTRALQRDLSILKPPFSNRGVRNEKFRILTPKNLYVSRVFR~~~EQGKRKLTLEKYQEIKSHFG
                            :  :||  :||||
                            MDELKQPPHANRGV-------------------------~~----------------
                                        10

567       597       627       657       687       717       747
YLV--ENDS--SRLQVMIDYVRITLKDVRDLEFFCRNFLHCAFKEFQPFESKLMNYNHLWKRGDIWIFDFADKHETGNFQ
 :|   : |::   |  |   |:||:|:::|    |:::    ||  :      :|  :  |     ::    |:|   |        |
VIVKEKNEAVESPLVSMVDYIRVSFK-THDVDRIIEEVLHLSKDFMTEKQSGFYGYVGTYELDYIKVFYSAPDDNRG---
             30        40        50        60        70        80        90

777       807       837       867       897       927       957       987
ITVQLSGRGCRQLELLMETEKFTWHDWLSYLRNSYRDDMNVTRFDIAIDELYLGKDRENEQFHLSDMISKYYRHELDFES
: :::||:||||:|   ::|   ||:|      ::::   :   ||||:|||     |:    |   :  :  :  |   |
VLIEMSGQGCRQFESFLECRKKTWYD---FFQDCMQQGGSFTRFDLAID------DK-KTYFSIPELLKKAQKGEC-ISR
         100       110       120       130             140       150

1017      1047      1077      1107      1137      1167      1197      1227
LRTWNYIGGGSLNFSDMEEIEQNRQGISLYFGSRQSEMYFNFYEKRYEIAKQEGITVEEALEIFELWNRYEIRLSQSKAN
:|   ::    ||:::||        |  ::|||||:|| |: ||||  ||  |:||   :  ||||:||   :|
FRKSDF--NGSFDLSD-----GITGGTTIYFGSKKSEAYLCFYEKNYEQAEKYNIPLEE----LGDWNRYELRLKNERAQ
         170       180       190       200       210       220
```

-continued

```
      1257        1287                1341        1371        1401        1431        1461
AAVDEFISGVPIGEISRGLIVSKIDVYDG-KN-EYGSFQADRKWQLMFGGVEPLKFVTKPEAYSIERTLRWLSDSVSPSL
 :|  ::    :   |:    :|  : :    |   :|      ::        |     | |  |  :   ||:   :::   || :| :|::
VAIDALLKTKDLTLIAMQIINNYVRFVDADENITREHWKTSLFWSDFIGDVGRLPLYVKPQKDFYQKSRNWLRDSCAPTM
           240         250         260         270         280         290         300

1491        1521        1551        1581        1611        1641        1671        1701
AMIREYDMIVDGDYLQTILNSGEVNERGEKILDSIKASLGIL*EVSFVLYSNREFAYCVNRRNNLDKMIDLLVFMIPDRE
 :|  | |   :      |    ::     |:  ::  :|:||    |   :
KMVLEADEHLGKTDLSDMIAEAELADKHKKMLDVYMADVADMVV
           320         330         340         350
```

Figure 167:
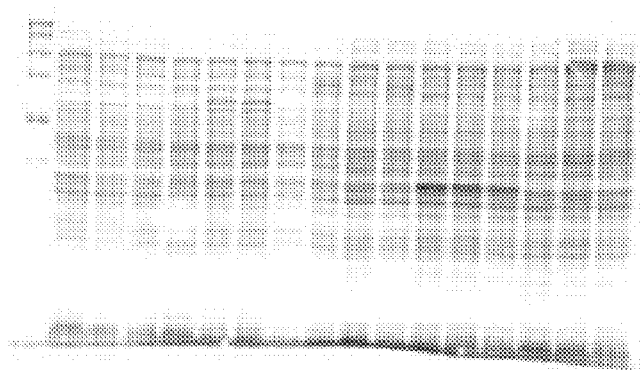

SEQ ID 8604 (GBS294) was expressed in *E. coli* as a His-fusion product. SDS-PAGE analysis of total cell extract is shown in FIG. 167 (lane 6 & 7; MW 65 kDa—thioredoxin fusion), in FIG. 238 (lane 2; MW 65 kDa) and in FIG. 40 (lane 6; MW 37 kDa). It was also expressed in *E. coli* as a GST-fusion product. SDS-PAGE analysis of total cell extract is shown in FIG. 47 (lane 3; MW 76 kDa).

Purified Thio-GBS294-His is shown in FIG. 244, lane 2.

Based on this analysis, it was predicted that these proteins and their epitopes could be useful antigens for vaccines or diagnostics. Example 578

A DNA sequence (GBSx0618) was identified in *S. agalactiae* <SEQ ID 1807> which encodes the amino acid sequence <SEQ ID 1808>. Analysis of this protein sequence reveals the following:

Possible site: 40
>>> Seems to have no N-terminal signal sequence
INTEGRAL   Likelihood = −3.61   Transmembrane 24-40 (20-41)
INTEGRAL   Likelihood = −1.97   Transmembrane 53-69 (52-72)
----- Final Results -----
   bacterial membrane --- Certainty = 0.2444 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database:

```
>GP: AAB60012 GB: U09422 ORF21 [Enterococcus faecalis]
Identities = 136/473 (28%), Positives = 228/473 (47%), Gaps = 40/473 (8%)
Query:     9 RGIKVKPYMRYMSYYL-FSFLFILFLTPVGVYSYYYLDL-------LKMMDKMSM----I    56
             RG +++P  + ++    + L  +FL  VG++    +         L    DK+   +  I
Sbjct:     4 RGKRIRPSGKDLVFHFTIASLLPVFLLVVGLFHVKTIQQINWQDFNLSQADKIDIPYLII   63

Query:    57 SVGTGLFLAFFVSWYLTWFLQEANPLFNKLDRLKRMSKFLYENGYVYEKR-------KKS  109
             S   + +  V++    F  +        +L    ++++K + EN +    ++       K S
Sbjct:    64 SFSVAILICLLVAFV---FKRVRYDTVKQLYHRQKLAKMILENKWYESEQVKTEGFFKDS  120

Query:   110 NKKTKTKYR-FPKVYVKQGKYDLSVSFEMAGGKFQKKFKDIGGELEDTFFMDFMEKTDDP  168
             +TK K    FPK+Y +     + +  E+  GK+Q +      +LE    +  +K
Sbjct:   121 AGRTKEKITYFPKMYYRLKNGLIQIRVEITLGKYQDQLLHLEKKLESGLYCELTDKELKD  180

Query:   169 RFKIYKLAYSAFLSRITVKDVIWNKDKGIKLMDGYYWDFINDPHLLVAGGTGGGKTVLLR  228
             +  Y L Y     SRI++  D +   KD   ++LM    +W++     PH+L+AGGTGGGKT +
Sbjct:   181 SYVEYTLLYDTIASRISI-DEVEAKDGKLRLMKNVWWEYDKLPHMLIAGGTGGGKTYFIL  239

Query:   229 SILRCLAEI-GVCDICDPKRADFVTMSDLSAFEGRIAFEKADIIEKFENAVTIMFARYDF  287
             +++  L    I DPK AD   ++DL +    + + K D++   E      M  R +
Sbjct:   240 TLIEALLHTDSKLYILDPKNAD---LADLGSVMANVYYRKEDLLSCIETFYEEMMKRSE-  295

Query:   288 VRNEMKRLGHKDMKKFYDY-GLEPYFFVCDEYNALMSSLSYQEREIVDNAFTQYILLGRQ  346
                 EMK++ +   K Y Y GL +F + DEY A M   L   +E      V N     Q ++LGRQ
Sbjct:   296 ---EMKQMKNYKTGKNYAYLGLPAHFLIFDEYVAFMEMLGTKENTAVMNKLKQIVMLGRQ  352

Query:   347 VGCNAIIAMQKPSADDLPTKIRSNMMHHISVGRLDDGGYVMMFGDENRNKEFRFIKYLAG  406
              G   I+A Q+P A  L     IR       +++GR+ +  GY MMFG +  + K+F F+K
Sbjct:   353 AGFFLILACQRPDAKYLGDGIRDQFNFRVALGRMSEMGYGMMFGSDVQ-KDF-FLK----  406

Query:   407 RRVYGRGYSAVFGEVAREFYSPLLPKNFSFYDAFEKINRHENPFDPTENQEVS         459
             R+ GRGY V     V  EFY+PL+PK + F +   +K++           T    EV+
Sbjct:   407 -RIKGRGYVDVGTSVISEFYTPLVPKGYDFLEEIKKLSNSRQSTQATCEAEVA         458
```

No corresponding DNA sequence was identified in *S. pyogenes*.

A related GBS gene <SEQ ID 8605> and protein <SEQ ID 8606> were also identified. Analysis of this protein sequence reveals the following:

Lipop Possible site: −1   Crend: 8
McG: Discrim Score: −10.05
GvH: Signal Score (−7.5) : −3.42
Possible site: 40
>>> Seems to have no N-terminal signal sequence
ALOM program    count: 2   value: −3.61   threshold: 0.0

-continued

| | | |
|---|---|---|
| INTEGRAL | Likelihood = −3.61 | Transmembrane 24-40 (20-41) |
| INTEGRAL | Likelihood = −1.97 | Transmembrane 53-69 (52-72) |
| PERIPHERAL | Likelihood = 1.01 | 224 | modified ALOM score: 1.22
*** Reasoning Step: 3
----- Final Results -----
   bacterial membrane --- Certainty = 0.2444 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the databases:

```
29.9/52.7% over 456aa
Enterococcus faecalis
EGAD|17035| hypothetical protein Insert characterized
GP|532554|gb|AAB60012.1||U09422 ORF21 Insert characterized
ORF00100(319-1677 of 2316)
EGAD|17035|17250(2-458 of 461) hypothetical protein {Enterococcus faecalis}
GP|532554|gb|AAB60012.1||U09422 ORF21 {Enterococcus faecalis}
% Match. 11.2
% Identity = 29.9 % Similarity = 52.7
Matches = 135 Mismatches = 199 Conservative Sub.s = 103

207       237       267       297       327       357      384       414
FQVVCLKFLHHHLRKRMLQIMETHQKMKHLKLINKR*RRGNLARLIPQYRGIKVKPYMRYMSYYL-FSFLFILFLTPVGV
                                    : ||  :::|    :  : :::   : |: :||   ||:
                                    MKQRGKRIRPSGKDLVFHFTIASLLPVFLLVVGL
                                             10        20        30

426       453       483       513             570       600
Y------SYYYLDL-LKMMDKMSMISVGTGLFLAFFVSWYLTWFLQEAN-PLFNKLDRLKRMSKFLYENGYVYEKR----
:       : |: |   ||| : :     : :| ::      : :::       :|    :::: | : || : ||
FHVKTIQQINWQDFNLSQADKIDIPYLIISFSVAILICLLVAFVFKRVRYDTVKQLYHRQKLAKMILENKW-YESEQVKT
        50        60        70        80        90        100       110

636       663       693       723       753       783       813       843
----KKSNKKTKTKYR-FPKVYVKQGKYDLSVSFEMAGGKFQKKFKDIGGELEDTFFMDFMEKTDDPRFKIYKLAYSAFL
    | |  :||  |   |||:  :       : :   |:  ||:| ::    :||   :: :: :|     :  ||  |
EGFFKDSAGRTKEKITYFPKMYYRLKNGLIQIRVEITLGKYQDQLLHLEKKLESGLYCELTDKELKDSYVEYTLLYDTIA
        130       140       150       160       170       180       190

873       903       933       963       993       1020      1050      1080
SRITVKDVIWNKDKGIKLMDGYYWDFINDPHLLVAGGTGGGKTVLLRSILRCLAEI-GVCDICDPKRADFVTMSDLSAFE
|||::   |:    ||    ::||    :|:::      ||:|:|||||||||||  :: :::    |    | ||| ||   ::|| :
SRISI-DEVEAKDGKLRLMKNVWWEYDKLPHMLIAGGTGGGKTYFILTLIEALLHTDSKLYILDPKNAD---LADLGSVM
        210       220       230       240       250       260

1110      1140      1170      1200      1227      1257      1287      1317
GRIAFEKADIIEKFENAVTIMFARYDFVRNEMKRLGHKDMKKFYDY-GLEPYFFVCDEYNALMSSLSYQEREIVDNAFTQ
 : : ||::   |       | |       |||:: :     | | ||  :|:: |||  |: |   |:   | | :|
ANVYYRKEDLLSCIETFYEEMMKR----SEEMKQMKNYKTGKNYAYLGLPAHFLIFDEYVAFMEMLGTKENTAVMNKLKQ
        280       290       300       310       320       330       340

1347      1377      1407      1437      1467      1497      1527      1557
YILLGRQVGCNAIIAMQKPSADDLPTKIRSNMMHHISVGRLDDGGYVMMFGDENRNKEFRFIKYLAGRRVYGRGYSAVFG
::|||| |   :|:|:|  |    ||     :::||: : || |||| :   |:|  |:| :| : ||     || |
IVMLGRQAGFFLILACQRPDAKYLGDGIRDQFNFRVALGRMSEMGYGMMFGSD-VQKDF-FLKRIKGR-----GYVDVGT
        360       370       380       390       400       410

1587      1617      1647      1677      1707      1737      1767      1797
EVAREFYSPLLPKNFSFYDAFEKINRHENPFDPTENQEVSKAILKDESLREFVEKTSENELLKGSVGFDFDDEMEEMENM
 |  ||| :|:||   :   : |::          |    ||:
SVISEFYTPLVPKGYDFLEEIKKLSNSRQSTQATCEAEVAGVD
        430       440       450       460
```

SEQ ID 8606 (GBS216) was expressed in *E. coli* as a His-fusion product. SDS-PAGE analysis of total cell extract is shown in FIG. 42 (lane 3; MW 66.6 kDa). It was also expressed in *E. coli* as a GST-fusion product. SDS-PAGE analysis of total cell extract is shown in FIG. 47 (lane 2; MW 91 kDa).

Based on this analysis, it was predicted that these proteins and their epitopes could be useful antigens for vaccines or diagnostics.

Example 579

A DNA sequence (GBSx0619) was identified in *S. agalactiae* <SEQ ID 1809> which encodes the amino acid sequence <SEQ ID 1810>. Analysis of this protein sequence reveals the following:

```
Possible site: 14
>>> Seems to have no N-terminal signal sequence
----- Final Results -----
    bacterial cytoplasm --- Certainty = 0.4095 (Affirmative) <succ>
      bacterial membrane --- Certainty = 0.0000 (Not Clear) <succ>
         bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 580

A DNA sequence (GBSx0620) was identified in *S. agalactiae* <SEQ ID 1811> which encodes the amino acid sequence <SEQ ID 1812>. Analysis of this protein sequence reveals the following:

```
Possible site: 28
>>> Seems to have no N-terminal signal sequence
----- Final Results -----
    bacterial cytoplasm --- Certainty = 0.0944 (Affirmative) <succ>
      bacterial membrane --- Certainty = 0.0000 (Not Clear) <succ>
         bacterial outside --- Certainty = 0.0000 (Not Clear) <succ>
```

A related GBS nucleic acid sequence <SEQ ID 10219> which encodes amino acid sequence <SEQ ID 10220> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 581

A DNA sequence (GBSx0621) was identified in *S. agalactiae* <SEQ ID 1813> which encodes the amino acid sequence <SEQ ID 1814>. Analysis of this protein sequence reveals the following:

```
Possible site: 60
>>> Seems to have no N-terminal signal sequence
INTEGRAL    Likelihood = -4.94    Transmembrane 810-826 (808-830)
----- Final Results -----
    bacterial membrane --- Certainty = 0.2975 (Affirmative) <succ>
         bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database:

```
!GB: D90354 surface protein antigen precursor [Strept...
>GP: BAA14368 GB: D90354 surface protein antigen precursor
[Streptococcus sobrinus]
Identities = 151/408 (37%), Positives = 219/408 (53%), Gaps = 27/408 (6%)
Query:    451 PSKAVIDEAGQSVNGKTVLPNAELNYVAKQDFSQYKGMTASQGKIAKNFVFIDDYKDDAL    510
              P K   +E G  ++GK+VL       Y    D QYKG +++  I K F ++DDY ++AL
Sbjct:   1162 PHKVNKNENGVVIDGKSVLAGTTNYYELTWDLDQYKGDKSAKETIQKGFFYVDDYPEEAL   1221

Query:    511 DGKSMKVNSIKASDGTDVSQL-LEMRHVLSTDTLDEKLQTLIKEAGISPVGEFYMWTAKD    569
              D   ++ + IK +D      +  +  +   S +     +Q  ++K+A I+P G F ++TA D
Sbjct:   1222 D---LRTDLIKLTDANGKAVTGVSVADYASLEAAPAAVQDMLKKANITPKGAFQVFTADD   1278

Query:    570 PQAFYKAYVQKGLDVTYNLSFKVKKEFTK--GQIQNGVAQIDFGNGYTGNIVVNDLTTPE    627
              PQAFY  AYV   G D+T      VK E  K  G  +N     QIDFGNGY  NIV+N++
Sbjct:   1279 PQAFYDAYVVTGTDLTIVTPMTVKAEMGKIGGSYENKAYQIDFGNGYESNIVINNVPQIN   1338

Query:    628 IHKDV---LDKEDGKSINNGTVKLGDEVTYKLEGWVVPTGRSYDLFEYKFVDQLQRTPDL    684
                KDV   +D  D   +++  T++ L     Y+L G ++P   + +LFEY F D   +T D
Sbjct:   1339 PEKDVTLTMDPADSTNVDGQTIALNQVFNYRLIGGIIPADHAEELFEYSFSDDYDQTGDQ   1398

Query:    685 YLRD-KVVAKVDVTLKDGTVIKKGTNLGEYTETVYNKKTGLYELVFKKDFLEKVARSSEF    743
              Y     K  AKVD+TLKDGT+IK GT+L    YTE     ++  G   + FK+DFL V+ S F
Sbjct:   1399 YTGQYKAFAKVDLTLKDGTIIKAGTDLTSYTEAQVDEANGQIVVTFKEDFLRSVSVDSAF   1458

Query:    744 GADDFVVVKRIKAGDVYNTADFFINGNKVKTETVVTHTPE--KPKPVEPQ----------    791
                A+ ++ +KRI G   NT   +NG    + TV T TPE   +P PV+P+
Sbjct:   1459 QAEVYLQMKRIAVGTFANTYVNTVNGITYSSNTVRTSTPEPKQPSPVDPKTTTTVVFQPR   1518

Query:    792 --KATPKAPAKG--LPQTGEASVAPLTALGAIILSA-IGLAGFKKRKE              834
                 KA   AP  G  LP TG++S A L LG + L+A    L G +++++
Sbjct:   1519 QGKAYQPAPPAGAQLPATGDSSNAYLPLLGLVSLTAGFSLLGLRRKQD              1566
```

-continued

```
Identities = 75/242 (30%), Positives = 120/242 (48%), Gaps = 33/242 (13%)
Query:   11 SADQVTTQATTQTVTQNQAETVTSTQLDKAVATAKKAAVAVTTTAAVNHATTTDAQADLA    70
            S+   T+QA     T   + V++++LD+A  +A++A V V+  A VN  T   + D A
Sbjct:   73 SSQAETSQAQAGQKTGAMSVDVSTSELDEAAKSAQEAGVTVSQDATVNKGTVETS--DEA  130

Query:   71 NQTQT-VKDVTAKAQANTQAIKDATAENAKIDAENKAESQRVSQLNAQTKAKID---AEN  126
            NQ +T +KD  +K  A+   I+  T +     A N+AE+ R++Q NA  KA+  +  A N
Sbjct:  131 NQKETEIKDDYSKQAAD---IQKTTEDYKAAVAANQAETDRITQENAAKKAQYEQDLAAN  187

Query:  127 KDAQAKADATNAQLQKDYQAKLAKIKSVEAYNAGVRQRNKDAQA--------------KA  172
            K       +  NAQ + DY+AKLA+ +   A      V+Q N D+QA              +
Sbjct:  188 KAEVERITNENAQAKADYEAKLAQYQKDLA---AVQQANNDSQAAYAAAKEAYDKELARV  244

Query:  173 DATNAQLQKDYQAKLA---LYNQALKAKAEADKQSINNVAFDIKAQ----AKGVDNAEYG  225
              A NA +K+Y+  LA      N+ +KA+  A +Q       D +A+      K  + A+ G
Sbjct:  245 QAANAAAKKEYEEALAANTTKNEQIKAENAAIQQRNAQAKADYEAKLAQYEKDLAAAQSG  304

Query:  226 NS                                                           227
            N+
Sbjct:  305 NA                                                           306

Identities = 63/223 (28%), Positives = 100/223 (44%), Gaps = 31/223 (130)
Query:    2 ITTLQTSQVSADQVTTQATTQTVTQNQAETVTSTQLDKAVATAK----------KAAVA   50
            +   +Q +   +A   +     +A    T+N+       +  +  +  A AK         K    A
Sbjct:  241 LARVQAANAAAKKEYEEALAANTTKNEQIKAENAAIQQRNAQAKADYEAKLAQYEKDLAA  300

Query:   51 VTTTAAVNHATTTDAQADLANQTQTVKDVTAKA-QANTQAIKDATAENAKIDAENKAESQ  109
             +    A N A      +A  + V+    A A QA  QA+     TA+NA+I AEN+A  Q
Sbjct:  301 AQSGNATNEADYQAKKAAYEQELARVQAANAAAKQAYEQALAANTAKNAQITAENEAIQQ  360

Query:  110 RVSQLNAQTKAKIDAENKDAQAKADATNAQLQKDYQAKLA----KIKSVEAYNAGVRQRN  165
            R +Q  A  +AK+    KD  A A + NA  + DYQ  KLA      ++ V+A NA   +Q
Sbjct:  361 RNAQAKANYEAKLAQYQKDL-AAAQSGNAANEADYQEKLAAYEKELARVQAANAAAKQEY  419

Query:  166 KDAQAKADATNAQL--------------QKDYQAKLALYNQAL                 194
             +     +A+A NA++                 +  DY+  KL+  Y  +  L
Sbjct:  420 EQKVQEANAKNAEITEANRAIRERNAKAKTDYELKLSKYQEEL                 462

Identities = 75/243 (30%), Positives = 101/243 (40%), Gaps = 56/243 (23%)
Query:    8 SQVSAD-QVTTQATTQTVTQNQAETVTSTQLDKAVATAKKAAVAVTTTAAVNHATTTDAQ   66
            S+  +AD Q TT+      V   NQAET    TQ + A    A+             A V     T    +AQ
Sbjct:  142 SKQAADIQKTTEDYKAAVAANQAETDRITQ-ENAAKKAQYEQDLAANKAEVERITNENAQ  200

Query:   67 ADL---ANQTQTVKDVTAKAQANT--------------------------------QAIK   91
             A      A    Q   KD+ A  QAN                                       +A+
Sbjct:  201 AKADYEAKLAQYQKDLAAVQQANNDSQAAYAAAKEAYDKELARVQAANAAAKKEYEEALA  260

Query:   92 DATAENAKIDAENKAESQRVSQLNAQTKAKIDAENKDAQAKADATNAQLQKDYQAKLA--  149
              T +N +I AEN A   QR +Q  A  +AK+    KD  A A + NA  + DYQAK  A
Sbjct:  261 ANTTKNEQIKAENAAIQQRNAQAKADYEAKLAQYEKDL-AAAQSGNATNEADYQAKKAAY  319

Query:  150 --KIKSVEAYNAGVRQRNKDAQAKADATNAQL--------------QKDYQAKLALYNQA  193
              ++ V+A NA   +Q   + A A    A NAQ+                + +Y+AKLA Y +
Sbjct:  320 EQELARVQAANAAAKQAYEQALAANTAKNAQITAENEAIQQRNAQAKANYEAKLAQYQKD  379

Query:  194 LKA                                                         196
            L A
Sbjct:  380 LAA                                                         382
```

There is also homology to SEQ ID 598.

Figure 176:
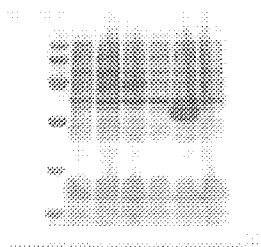

SEQ ID 1814 (GBS191) was expressed in *E. coli* as a His-fusion product. SDS-PAGE analysis of total cell extract is shown in FIG. 176 (lane 2; MW 91 kDa).

Based on this analysis, it was predicted that this protein and its epitopes, could be useful antigens for vaccines or diagnostics.

Possible site: 34
>>> Seems to have no N-terminal signal sequence
----- Final Results -----
bacterial cytoplasm --- Certainty = 0.2935 (Affirmative) <succ>
bacterial membrane --- Certainty = 0.0000 (Not Clear) <succ>
bacterial outside --- Certainty = 0.0000 (Not Clear) <succ>

Example 582

A DNA sequence (GBSx0622) was identified in *S. agalactiae* <SEQ ID 1815> which encodes the amino acid sequence <SEQ ID 1816>. This protein is predicted to be TnpA. Analysis of this protein sequence reveals the following:

A related GBS nucleic acid sequence <SEQ ID 10221> which encodes amino acid sequence <SEQ ID 10222> was also identified.

A related GBS nucleic acid sequence <SEQ ID 9921> which encodes amino acid sequence <SEQ ID 9922> was also identified.

The protein has homology with the following sequences in the GENPEPT database:

```
>GP: AAC82523 GB: AF027768 TnpA [Serratia marcescens]
Identities = 168/385 (43%), Positives = 232/385 (59%), Gaps = 13/385 (3%)
Query:    26 MMFKVEAVGPPERCPECGFD-KLYKHSSRNQLIMDLPIRLKRVGLHLNRRRYKCRECGST    84
             M F+V+ V  P   C ECG   +  +  R+    DLPI  KRV L + RRRY CR C +T
Sbjct:     1 MHFQVD-VPDPIACEECGVQGEFVRFGKRDVPYRDLPIHGKRVTLWVVRRRYTCRACKTT    59

Query:    85 IS------VDEKRSMTKRLLKSIQEQSMSKTFVEVAESVGVDEKTIRNVFKDVALKERE   138
                    VD  R MT RL + ++++S +  + VA   G+DEKT+R++F         R
Sbjct:    60 FRPQLPEMVDGFR-MTLRLHEYVEKESFNHPYTFVAAQTGLDEKTVRDIFNARAEFLGRW   118

Query:   139 YQFETPKWLGIDEIHIIRRPRLVLTNIERRTIYDIKPNRNKETVIQRLSEISDRTYIEYV   198
             ++FETP+ LGIDE+++ +R R +LTNIE RT+ D+    R ++ V   L ++ DR  +E V
Sbjct:   119 HRFETPRILGIDELYLNKRYRCILTNIEERTLLDLLATRRQDVVTNYLMKLKDRQKVEIV   178

Query:   199 TMDMWKPYKDAVNTILPQAKVVVDKFHVVRMANQALDNVRKSLKAHMSQKERRTLMRERF   258
             +MDMW  PY+  AV   +LPQA++VVDKFHVVRMAN AL+ VRK L+  +    + RTL   +R
Sbjct:   179 SMDMWNPYRAAVEAVLPQARIVVDKFHVVRMANDALERVRKGLRKELKPSQSRTLKGDRK   238

Query:   259 ILLKRKHDLNERESFLLDTWLGNLPALKEAYELKEEFYWIWDTPDPDEGHLRYSQWRHRC   318
             ILLKR H++++RE   +++TW G  P L  AYE KE FY IWD   +      +W
Sbjct:   239 ILLKRAHEVSDRERLIMETWTGAFPQLLAAYEHKERFYGIWDATTRLQAEAALDEWI-AT   297

Query:   319 MSSNSKDAYKDLVRAVDNWHVEIFNYF--DKRLTNAYTESINSIIRQVERMGRGYSFDAL   376
             +     K+ +  DLVRAV NW  E    YF   D   +TNAYTESIN + +    R GRGYSF+ +
Sbjct:   298 IPKGQKEVWSDLVRAVGNWREETMTYFETDMPVTNAYTESINRLAKDKNREGRGYSFEVM   357

Query:   377 RAKILFNEKLHKKRKPRFNSSAFNK                                    401
             RA++L+  K HKK+ P    S F K
Sbjct:   358 RARMLYTTK-HKKKAPTAKVSPFYK                                    381
```

No corresponding DNA sequence was identified in *S. pyogenes*.

Based on this analysis, it was predicted that these proteins and their epitopes could be useful antigens for vaccines or diagnostics.

Example 583

A DNA sequence (GBSx0623) was identified in *S. agalactiae* <SEQ ID 1817> which encodes the amino acid sequence <SEQ ID 1818>. This protein is predicted to be mercuric reductase. Analysis of this protein sequence reveals the following:

Possible site: 53
>>> Seems to have no N-terminal signal sequence
----- Final Results -----
  bacterial cytoplasm --- Certainty = 0.2115 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database:

```
>GP: CAA70224 GB: Y09024 mercuric reductase [Bacillus cereus]
Identities = 411/546 (75%), Positives = 483/546 (88%)
Query:     1 MNKFKVNISGMTCTGCEKHVESALEKIGAKNIESSYRRGEAVFELPDDIEVESAIKAIDE    60
             M K++V++ GMTCTGCE+HV  ALE +GA  IE  +RRGEAVFELP+  + VE+A KAI +
Sbjct:     1 MKKYRVDVQGMTCTGCEEHVAVALENMGATGIEVDFRRGEAVFELPNALGVETAKKAISD    60

Query:    61 ANYQAGEIEEVSSLENVALINEDNYDLLIIGSGAAAFSSAIKAIEYGAKVGMIERGTVGG   120
             A YQ G+  EEV S  E V L  NE +YD +IIGSG AAFSSAI+A++YGAKV MIERGT+GG
Sbjct:    61 AKYQPGKAEEVQSQEMVQLGNEGDYDYIIIGSGGAAFSSAIEAVKYGAKVAMIERGTIGG   120

Query:   121 TCVNIGCVPSKTLLRAGEINHLSKDNPFIGLQTSAGEVDLASLITQKDKLVSELRNQKYM   180
             TCVNIGCVPSKTLLRAGEINHL+K+NPF +GL  TSAGEVDLA LI  QK++LV+ELRN KY+
Sbjct:   121 TCVNIGCVPSKTLLRAGEINHLAKNNPFVGLHTSAGEVDLAPLIKQKNELVTELRNSKYV   180

Query:   181 DLIDEYNFDLIKGEAKFVDASTVEVNGTKLSAKRFLIATGASPSLPQISGLEKMDYLTST   240
             DLID+Y F+LI+GEAKFVD  TVEVNG  +SAKRFLIATGASP+ P I GL ++DYLTST
Sbjct:   181 DLIDDYGFELIEGEAKFVDEKTVEVNGAPISAKRFLIATGASPAKPNIPGLNEVDYLTST   240

Query:   241 TLLELKKIPKRLTVIGSGYIGMELGQLFHHLGSEITLMQRSERLLKEYDPEISESVEKAL   300
             +LLELKK+PKRL V+GSGYIGMELGQLFH+LGSE TL+QRSERLLKEYDPEISESVEK+L
Sbjct:   241 SLLELKKVPKRLVVIGSGYIGMELGQLFHNLGSEVTLIQRSERLLKEYDPEISESVEKSL   300

Query:   301 IEQGINLVKGATFERVEQSGEIKRVYVTVNGSREVIESDQLLVATGRKPNTDSLNLSAAG   360
             +EQGINLVKGAT+ER+EQ+G+IK+V+V VNG +  +IE+DQLLVATGR  PNT +LNL AAG
Sbjct:   301 VEQGINLVKGATYERIEQNGDIKKVHVEVNGKKRIIEADQLLVATGRTPNTATLNLRAAG   360

Query:   361 VETGKNNEILINDFGQTSNEKIYAAGDVTLGPQFVYVAAYEGGIITDNAIGGLNKKIDLS   420
             VE G    EI+I+D+ +T+N  +IYAAGDVTLGPQFVYVAAY+GG+     NAIGGLNKK++L
Sbjct:   361 VEIGSRGEIIIDDYSRTTNTRIYAAGDVTLGPQFVYVAAYQGGVAAPNAIGGLNKKLNLE   420
```

```
-continued
Query:   421 VVPAVTFTNPTVATVGLTEEQAKEKGYDVKTSVLPLGAVPRAIVNRETTGVFKLVADAET  480
             VVP VTFT P +ATVGLTE+QAKE GY+VKTSVLPL AVPRA+VNRETTGVFKLVAD++T
Sbjct:   421 VVPGVTFTAPAIATVGLTEQQAKENGYEVKTSVLPLDAVPRALVNRETTGVFKLVADSKT  480

Query:   481 LKVLGVHIVSENAGDVIYAASLAVKFGLTIEDLTETLAPYLTMAEGLKLVALTFDKDISK  540
             +KVLG H+V+ENAGDVIYAA+LAVKFGLT++D+ ETLAPYLTMAEGLKL ALTFDKDISK
Sbjct:   481 MKVLGAHVVAENAGDVIYAATLAVKFGLTVDDIRETLAPYLTMAEGLKLAALTFDKDISK  540

Query:   541 LSCCAG  546
             LSCCAG
Sbjct:   541 LSCCAG  546
```

There is also homology to SEQ ID 1820.

Based on this analysis, it was predicted that this protein and its epitopes, could be useful antigens for vaccines or diagnostics.

Example 584

A DNA sequence (GBSx0624) was identified in *S. agalactiae* <SEQ ID 1821> which encodes the amino acid sequence <SEQ ID 1822>. This protein is predicted to be regulatory protein. Analysis of this protein sequence reveals the following:

Possible site: 36
>>> Seems to have no N-terminal signal sequence
----- Final Results -----
  bacterial cytoplasm --- Certainty = 0.4529 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database:

```
>GP: AAA83973 GB: AF138877 mercury resistance operon negative
regulator MerR1 [Bacillus sp. RC607]
Identities = 84/129 (65%), Positives = 105/129 (81%)
Query:     1 MIYRISEFADKCGVNKETIRYYERKNLLQEPHRTEAGYRIYSYDDVKRVGFIKRIQELGF   60
             M +RI E ADKCGVNKETTRYYER  L+ EP RTE GYR+YS   V R+ FIKR+QELGF
Sbjct:     1 MKFRIGELADKCGVNKETIRYYERLGLIPEPERTEKGYRMYSQQTVDRLHFIKRMQELGF   60

Query:    61 SLSEIYKLLGVVDKDEVRCQDMFEFVSKKQKEVQKQIEDLKRIETMLDDLKQRCPDEKKL  120
             +L+EI KLLGVVD+DE +C+DM++F   K +++Q++IEDLKRIE ML DLK+RCP+ K +
Sbjct:    61 TLNEIDKLLGVVDRDEAKCRDMYDFTILKIEDIQRKIEDLKRIERMLMDLKERCPENKDI  120

Query:   121 HSCPIIETL  129
             + CPIIETL
Sbjct:   121 YECPIIETL  129
```

There is also homology to SEQ ID 1712.

Based on this analysis, it was predicted that this protein and its epitopes, could be useful antigens for vaccines or diagnostics.

Example 585

A DNA sequence (GBSx0625) was identified in *S. agalactiae* <SEQ ID 1823> which encodes the amino acid sequence <SEQ ID 1824>. This protein is predicted to be Nramp metal ion transporter. Analysis of this protein sequence reveals the following:

Possible site: 53
>>> Seems to have no N-terminal signal sequence
INTEGRAL   Likelihood = −13.85   Transmembrane 175-191 (169-201)
INTEGRAL   Likelihood = −11.94   Transmembrane 150-166 (132-173)
INTEGRAL   Likelihood = −9.45    Transmembrane 491-507 (481-509)
INTEGRAL   Likelihood = −8.92    Transmembrane 375-391 (374-396)
INTEGRAL   Likelihood = −8.39    Transmembrane 72-88 (69-93)
INTEGRAL   Likelihood = −7.96    Transmembrane 280-296 (274-299)
INTEGRAL   Likelihood = −7.17    Transmembrane 413-429 (411-431)
INTEGRAL   Likelihood = −6.79    Transmembrane 327-343 (322-346)
INTEGRAL   Likelihood = −3.40    Transmembrane 444-460 (443-462)
INTEGRAL   Likelihood = −3.24    Transmembrane 132-148 (132-149)
INTEGRAL   Likelihood = −0.96    Transmembrane 115-131 (114-131)
----- Final Results -----
  bacterial membrane --- Certainty = 0.6540 (Affirmative) < succ>
  bacterial outside --- Certainty = 0.0000 (Not Clear) < succ>
  bacterial cytoplasm --- Certainty = 0.0000 (Not Clear) < succ>

The protein has homology with the following sequences in the GENPEPT database:

```
>GP:AAF83825 GB:AE003939 manganese transport protein [Xylella
fastidiosa]
Identities = 185/450 (41%), Positives = 278/450 (61%), Gaps = 29/450 (6%)
Query:    16 ANGPSLEEINGTIEVPKDLSFFKTLLAYSGPGALVAVGYMDPGNWSTSITGGQNFQYLLI   75
             ++ PSL E+ +++ V +    +   LLA+ GPG +V+VGYMDPGNW+T + GG  F Y+L+
Sbjct:    35 SDSPSLGEMHASVAVSRRGHWGFRLLAFLGPGYMVSVGYMDPGNWATGLAGGSRFGYMLL   94
```

```
Query:   76 SIILMSSLIAMLLQYMSAKLGIVTQMDLAQAIRARTSKQLGIVLWILTELAIMATDIAEV   135
            S+IL+S+++A++LQ ++A+LGI + MDLAQA RAR S+   + LW++ ELAI+A D+AEV
Sbjct:   95 SVILLSNVMAIVLQALAARLGIASDMDLAQACRARYSRGTTLALWVVCELAIIACDLAEV   154

Query:  136 IGGAIALYLLFHIPLAIAVFITVFDVLLLLLLTKIGFRKIEALVVALILVIFLVFAYQVA   195
            IG AIAL LL +P+   V IT  DV+L+LLL    GFR +EA V+AL+LVIF  F   Q+
Sbjct:  155 IGTAIALNLLLGVPIIWGVVITAVDVVLVLLLMHRGFRALEAFVIALLLVIFGCFVVQIV   214

Query:  196 LSHPIWTDIFKGLVPTSEAFSTSHTVNGQTPLSGALGIIGATVMPHNLYLHSSVVQSRKL   255
            L+ P        ++  G VP +        V     L  A+GI+GATVMPHNLYLHSS+VQ+R
Sbjct:  215 LAAPPLQEVLGGFVPRWQ------VVADPQALYLAIGIVGATVMPHNLYLHSSIVQTRAY   268

Query:  256 DHNNKKDIAR--AIRFSTFDSNIQLTVAFFVNSLLLIMGVAVFKTGSVTDPSFFGLFKAL   313
            +   + R  A+R++  DS + L +A F+N+ +LI+   AVF         D
Sbjct:  269 P---RTPVGRRSALRWAVADSTLALMLALFINASILILAAAVFHAQHHFD----------   315

Query:  314 SNSTIMSNSILAHIASSGILSLLFAIALLASGQNSTITGTLTGQIIMEGFIHMKVPIWFR   373
                 +  +LA +     G+ + LFA ALLASG NST+T TL GQI+MEGF+ +++  W R
Sbjct:  316 VEEIEQAYQLLAPVLGVGVAATLFATALLASGINSTVTATLAGQIVMEGFLRLRLRPWLR   375

Query:  374 RIITRLISVIPVMICVLVTSGRSTVEEHIAINNLMNNSQVFLAFALPFSMLPLLIFTNSK   433
            R++TR ++++PV++ V +    + T         L+   SQV L+   LPF+++PLL        +
Sbjct:  376 RVLTRGLAIVPVIVVVALYGEQGT-------GRLLLLSQVILSMQLPFAVIPLLRCVADR   428

Query:  434 VEMDDDFKNTWIIKILGWLSVIGLIYLNMK                                 463
              M        W++ ++ WL     ++ LN+K
Sbjct:  429 KVMGALVAPRWLM-VVAWLIAGVIVVLNVK                                 457
```

No corresponding DNA sequence was identified in *S. pyogenes*.

Based on this analysis, it was predicted that this protein and its epitopes, could be useful antigens for vaccines or diagnostics.

Example 586

A DNA sequence (GBSx0626) was identified in *S. agalactiae* <SEQ ID 1825> which encodes the amino acid sequence <SEQ ID 1826>. Analysis of this protein sequence reveals the following:

---
Possible site: 20
>>> Seems to have no N-terminal signal sequence
----- Final Results -----
    bacterial cytoplasm --- Certainty = 0.2590 (Affirmative) <succ>
    bacterial membrane --- Certainty = 0.0000 (Not Clear) <succ>
    bacterial outside --- Certainty = 0.0000 (Not Clear) <succ>
---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 587

A DNA sequence (GBSx0627) was identified in *S. agalactiae* <SEQ ID 1827> which encodes the amino acid sequence <SEQ ID 1828>. Analysis of this protein sequence reveals the following:

---
Possible site: 53
>>> Seems to have no N-terminal signal sequence
INTEGRAL    Likelihood = −9.82    Transmembrane 212-228 (204-233)
INTEGRAL    Likelihood = −8.39    Transmembrane 98-114 (94-125)
INTEGRAL    Likelihood = −7.22    Transmembrane 132-148 (122-154)
INTEGRAL    Likelihood = −6.42    Transmembrane 159-175 (155-188)
INTEGRAL    Likelihood = −4.78    Transmembrane 54-70 (51-72)
INTEGRAL    Likelihood = −2.97    Transmembrane 18-34 (15-36)
----- Final Results -----
    bacterial membrane --- Certainty = 0.4927 (Affirmative) <succ>
    bacterial outside --- Certainty = 0.0000 (Not Clear) <succ>
    bacterial cytoplasm --- Certainty = 0.0000 (Not Clear) <succ>
---

The protein has homology with the following sequences in the GENPEPT database:

```
>GP:CAB16051 GB:Z99124 yydJ [Bacillus subtilis]
Identities = 97/239 (40%), Positives = 154/239 (63%), Gaps = 3/239 (1%)
Query:    4 LEFRKSIRGRTLFYIISTVALTYVLGYILPVGIDKIRHLTLGEFYFSTYTVFTQFGFLIF    63
            LEF+KSI + +  + +    ++LGY L VGIDK+  ++T    F+FS+YTV TQFG ++F
Sbjct:    3 LEFKKSISNKVIIILGAMFVFLFLLGYFLLVGIDKVSNVTPEMFFFSSYTVATQFGLMLF    62

Query:   64 GFVIVYFFNKDYSDKCILYHYFSGYHLTKYFYTKLLVLFSEFFIAIIVCNILASLLWGYS   123
            FVI +F N++YS+K IL++    G ++  +FY K+ VLF E F    I  ++ SL++ +
Sbjct:   63 SFVIAFFINREYSNKNILFYKLIGENIYTFFYKKIAVLFLECFAFITLGLLIISLMY-HD   121

Query:  124 LFYFLTTTILFSLVVLQYLLVVSTISILFSNMLVSIGVTIFYWITSIILVAIGG-IFKVS   182
            +F     LFS V+LQY+L++   TIS+L  N+L+SIGV+I  YW+TS+ILVAI          F
Sbjct:  122 FSHFALLLFLFSAVILQYILIIGTISVLCPNILISIGVSIVYWMTSVILVAISNKTFGFI   181
```

-continued
```
Query: 183 AIFDASNSLYKIIGK-LFSHPMTIDLTDFFIIVPYMICLSVISFLIVCLSNRRWLLNGM  240
            A F+A N++Y  I + L S   MT+     D   I+ Y++ + +I+ +++   S  RW+  G+
Sbjct: 182 APFEAGNTMYPRIERVLQSDNMILGSNDVLFIILYLVSIIIINAIVLRFSKTRWIKMGL  240
```

No corresponding DNA sequence was identified in *S. pyogenes*.

Based on this analysis, it was predicted that this protein and its epitopes, could be useful antigens for vaccines or diagnostics.

Example 588

A DNA sequence (GBSx0628) was identified in *S. agalactiae* <SEQ ID 1829> which encodes the amino acid sequence <SEQ ID 1830>. This protein is predicted to be antibiotic epidermin immunity protein F. Analysis of this protein sequence reveals the following:

Possible site: 43
>>> Seems to have no N-terminal signal sequence
----- Final Results -----
   bacterial cytoplasm --- Certainty = 0.2901 (Affirmative) <succ>
     bacterial membrane --- Certainty = 0.0000 (Not Clear) <succ>
       bacterial outside --- Certainty = 0.0000 (Not Clear) <succ>

A related DNA sequence was identified in *S. pyogenes* <SEQ ID 1831> which encodes the amino acid sequence <SEQ ID 1832>. Analysis of this protein sequence reveals the following:

Possible site: 13
>>> Seems to have no N-terminal signal sequence
----- Final Results -----
   bacterial cytoplasm --- Certainty = 0.2760 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database:

```
>GP:CAB16052 GB:Z99124 similar to ABC transporter (ATP-binding
protein) [Bacillus subtilis]
Identities = 100/209 (47%), Positives = 150/209 (70%), Gaps = 4/209 (1%)
Query:   1 MFINNYTLKIGNRILLENTNLDFEEGEINHLLGRNGSGKSQLAKDFIINRGNYFSNDIYE   60
            M I NYTLK+   + LL++T+L F  G+INH++G+NG GKSQLAKDF++N        DI +
Sbjct:   1 MNIANYTLKVKGKTLLQDTDLHESSGKINHVVGKNGVGKSQLAKDFLLNNSKRIGRDIRQ   60

Query:  61 DTLIISSYSNLPSDVT----INDLERTIPWKLSKEIYQLLNINQISKTVKLKQLSDGQKQ  116
            +    +ISS SN+P+DV+      ++ L +      K+   +I   LLN++  I   V  +K LSDGQKQ
Sbjct:  61 NVSLISSSSNIPNDVSKDFLLHFLSKKFDAKMIDKIAYLLNLDNIDGKVLIKNLSDGQKQ  120

Query: 117 KVKLLVLLSLDKHIIILDEITNALDKKSVDEINVFLQNYIQYYPEKIIINISHDINNIRS  176
            K+KLL   L   DK+II+LDEITN+LDKK+V EI++ FL   YIQ   PEKIIINI+HD++++++
Sbjct: 121 KLKLLSFLLEDKNIIVLDEITNSLDKKTVIEIHGFLNKYIQENPEKIIINITHDLSDLKA  180

Query: 177 LKGNYFLIDNQKICKVDTLDDAISWYLGE                                205
            ++G+Y++ ++Q+I +   ++D   I   Y+  E
Sbjct: 181 IEGDYYIFNHQEIQQYHSVDKLIEVYINE                                209
```

An alignment of the GAS and GBS proteins is shown below:

```
Identities = 49/174 (28%), Positives = 82/174 (46%), Gaps = 27/174 (15%)
Query:   3 INNYTLKIGNRILLENTNLDFEEGEINHLLGRNGSGKSQLAK----------DFIINRGN   52
            I N      G R +L N N++    +G++    L+G NG+GKS  + K                II  G
Sbjct:  23 IQNLKKSYGKRTILNNVNMNIPKGKVYALIGPNGAGKSTIMKILTGLVSKTSGSIIFEGR   82

Query:  53 YFS-------NDIYEDTLI---ISSYSNLPSDVTINDL-ERTIPWKLSKEIYQLLNINQI  101
            +S          I E+ +    +S+Y N+      T+  + E TI    L+K      + +  I
Sbjct:  83 EWSRRDLRKIGSIIEEPPLYKNLSAYDNMKVVTTMLGVSESTILPLLNK-----VGLGNI  137

Query: 102 SKTVKLKQLSDGQKQKVKLLVLLSLDKHIIILDEITNALDKKSVDEINVFLQNY        155
            K   +KQ  S G KQ++  + +   L      ++ILDE TN LD    + E+    ++++
Sbjct: 138 DKR-PVKQFSLGMKQRLGIAISLINSPKLLILDEPTNGLDPIGIQELREIIESF        190
```

Based on this analysis, it was predicted that these proteins and their epitopes could be useful antigens for vaccines or diagnostics.

Example 589

A DNA sequence (GBSx0629) was identified in *S. agalactiae* <SEQ ID 1833> which encodes the amino acid sequence <SEQ ID 1834>. This protein is predicted to be aminoglycoside 6-adenylyltransferase. Analysis of this protein sequence reveals the following:

```
Possible site: 33
>>> Seems to have no N-terminal signal sequence
----- Final Results -----
   bacterial cytoplasm --- Certainty = 0.1780 (Affirmative) <succ>
   bacterial membrane --- Certainty = 0.0000 (Not Clear) <succ>
   bacterial outside --- Certainty = 0.0000 (Not Clear) <succ>
```

The protein has homology with the following sequences in the GENPEPT database:

A related GBS gene <SEQ ID 8607> and protein <SEQ ID 8608> were also identified. Analysis of this protein sequence reveals the following:

```
Lipop: Possible site: -1   Crend: 5
McG: Discrim Score: -5.26
GvH: Signal Score (-7.5): -6.14
Possible site: 33
>>> Seems to have no N-terminal signal sequence
ALOM program    count: 0 value: 6.10 threshold: 0.0
PERIPHERAL   Likelihood = 6.10   151
modified ALOM score: -1.72
*** Reasoning Step: 3
----- Final Results -----
   bacterial cytoplasm --- Certainty = 0.1780 (Affirmative) <succ>
   bacterial membrane --- Certainty = 0.0000 (Not Clear) <succ>
   bacterial outside --- Certainty = 0.0000 (Not Clear) <succ>
```

```
>GP:CAA29839 GB:X06627 ORF (str) [Staphylococcus aureus]
Identities = 91/289 (31%), Positives = 146/289 (50%), Gaps = 14/289 (4%)
Query:    1 MRDEQEIYNLVLNIANQDKRIEAVLLNGSRANPNVPKDDFQDYDIVFVTNFIEDIISDTN    60
            MR E+EI NLV  A Q    ++ + L GSR N N+ KD FQDYD  F  + IE    + +
Sbjct:    1 MRTEKEILNLVSEFAYQRSNVKIIALEGSRTNENIKKDKFQDYDFAFFVSDIEYFTHEES   60

Query:   61 YHKKFGDILIMQKPNE---FRNKTEYNCFAYLMQFQDLTRIDLRLIKPEFLEDYLDDA--  115
            +   FG++L +QKP +   F    +Y  ++Y+M F+D  ++D+ LI  +  L Y  D+
Sbjct:   61 WLSLFGELLFIQKPEDMELFPPDLDYG-YSYIMYFKDGIKMDITLINLKDLNRYFSDSDG  119

Query:  116 FSKVLLDKKNKYLDYNFERSSLYETKQLSEDEINKILNEIYWVSTYVVKGIARNDIIYSE  175
               K+L+DK N         S Y  K+ +E E    NE + VSTYV  KG+ R  +I+++
Sbjct:  120 LVKILVDKDNLVTQEIVPDDSNYWLKKPTEREFYDCCNEFWSVSTYVAKGVFRREILFAL  179

Query:  176 FMISNPIKNAFIKLLKQKILIEKELDSLSFGKLDKDILQYITDKD--QLLKIFSNKSLKD  233
            +N ++   ++++    I   + D S GK  K I +Y+TDK+     LL  F      +
Sbjct:  180 DHFNNILRPELLRMISWYIGFNRGFD-FSLGKNYKFINKYLTDKEFNMLLATFEMNGYRK  238

Query:  234 IEANLRFLLDETNQMAKYISINRKLNLNQGEYQSAMKFMNIFLSNSYQN            282
             + +         ++ KY S N+   L      Y +   K    F+ N+Y+N
Sbjct:  239 TYQSFKLCC----ELFKYYS-NKVSCLGNYNYPNYEKNIENFIRNNYEN            282
```

No corresponding DNA sequence was identified in *S. pyogenes*.

The protein has homology with the following sequences in the databases:

```
31.0/53.4% over 281aa
Staphylococcus aureus
EGAD|9462| streptomycin resistance protein Insert characterized
SP|P12055|STR_STAAU STREPTOMYCIN RESISTANCE PROTEIN. Insert characterized
GP|46644|emb|CAA29839.1||X06627 ORF (str) Insert characterized
PIR|S00938|S00938 str protein - plasmid pS194 Insert characterized
ORF00399(301-1146 of 1452)
EGAD|9462|9267(1-282 of 282) streptomycin resistance protein {Staphylococcus aureus}
SP|P12055|STR_STAAU STREPTOMYCIN RESISTANCE PROTEIN. GP|46644|emb|CAA29839.1||X06627 ORF
 (str) {Staphylococcus aureus} PIR|S00938|S00938 str protein - Staphylococcus aureus plasmid
 pS194
% Match = 12.8
% Identity = 31.0 % Similarity = 53.4
Matches = 87 Mismatches = 125 Conservative Sub.s = 63

117       147       177       207       237       267       297       327
      **LMTY*H*TVENIWNHNQLLRKI*N*ILGGRKGMSMLI*VYDYMLREKYKGNIKVLEXTW*YKVK*EVAIMRDEQEIYN
                                                                          || |:|| |
                                                                          MRTEKEILN
```

-continued

```
357       387       417       447       477       507              558
LVLNIANQDKRIEAVLLNGSRANPNVPKDDFQDYDIVFVTNFIEDIISDTNYHKKFGDILIMQKPNEFR---NKTEYNCF
||   |   :: :  |||| | |: || |||||| |  : ||    : ::   |::| :||| :       :|  :
LVSEFAYQRSNVKIIALEGSRTNENIKKDKFQDYDFAFFVSDIEYFTHEESWLSLFGELLFIQKPEDMELFPPDLDYG-Y
           20        30        40        50        60        70        80

588       618                 672       702       732       762       792
AYLMQFQDLTRIDLRLIKPEFLEDYLDDA--FSKVLLDKKNKYLDYNFERSSLYETKQLSEDEINKILNEIYWVSTYVVK
:|:|  |:|   ::|:  ||   |:  |:    |:|:|||         |   | :| |        ||   |||||
SYIMYFKDGIKMDITLINLKDLNRYFSDSDGLVKILVDKDNLVTQEIVPDDSNYWLKKPTEREFYDCCNEFWSVSTYVAK
             100       110       120       130       140       150       160

822       852       882       912       942       966       996       1026
GIARNDIIYSEFMISNPIKNAFIKLLKQKILIEKELDSLSFGKLDKDILQYITDKD--QLLKIFSNKSLKDIEANLRFLL
|:  |  :|:::      :|  ::   :::::    |   : :| :|:||    |  | :|  ||  |  :    ::::
GVFRREILFALDHFNNILRPELLRMISWYIGFNRGFD-FSLGKNYKFINKYLTDKEFNMLLATFEMNGYRKTYQSFKLCC
             180       190       200       210       220       230       240

1056      1086      1116      1146      1176      1206      1236      1266
DETNQMAKYISINRKLNLNQGEYQSAMKFMNIFLSNSYQNFN*YYCVKDNRL*LSKLNYHS*RFSRKIINNFGDK*WDKS
 :    : :|    |     |   :  | : |:  |: |:|:|
ELFKYYSNKVS-----CLGNYNYPNYEKNIENFIRNNYEN
             260       270       280
```

SEQ ID 1834 (GBS46) was expressed in *E. coli* as a His-fusion product. SDS-PAGE analysis of total cell extract is shown in FIG. 11 (lane 6; MW 34.9 kDa). It was also expressed in *E. coli* as a GST-fusion product. SDS-PAGE analysis of total cell extract is shown in FIG. 16 (lane 3; MW 59.8 kDa).

Based on this analysis, it was predicted that these proteins and their epitopes could be useful antigens for vaccines or diagnostics.

Example 590

A DNA sequence (GBSx0630) was identified in *S. agalactiae* <SEQ ID 1835> which encodes the amino acid sequence <SEQ ID 1836>. Analysis of this protein sequence reveals the following:

Possible site: 29
>>> Seems to have no N-terminal signal sequence
----- Final Results -----
  bacterial cytoplasm --- Certainty = 0.1179 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 591

A DNA sequence (GBSx0631) was identified in *S. agalactiae* <SEQ ID 1837> which encodes the amino acid sequence <SEQ ID 1838>. Analysis of this protein sequence reveals the following:

Possible site: 44
>>> Seems to have no N-terminal signal sequence
INTEGRAL   Likelihood = -2.81   Transmembrane 177-193 (177-194)
INTEGRAL   Likelihood = -0.27   Transmembrane 129-145 (129-145)
----- Final Results -----
  bacterial membrane --- Certainty = 0.2126 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 8609> which encodes amino acid sequence <SEQ ID 8610> was also identified. Analysis of this protein sequence reveals the following:

Lipop: Possible site: -1   Crend: 9
McG: Discrim Score: -19.59
GvH: Signal Score (-7.5): -4.49
Possible site: 44
>>> Seems to have no N-terminal signal sequence
ALOM program   count: 2 value: -2.81 threshold: 0.0
INTEGRAL     Likelihood = -2.81   Transmembrane 172-188 (172-189)
INTEGRAL     Likelihood = -0.27   Transmembrane 124-140 (124-140)
PERIPHERAL   Likelihood = 8.01    30
modified ALOM score: 1.06
*** Reasoning Step: 3
----- Final Results -----
  bacterial membrane --- Certainty = 0.2126 (Affirmative) <succ>
    bacterial outside --- Certainty = 0.0000 (Not Clear) <succ>
      bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

Example 592

A DNA sequence (GBSx0632) was identified in *S. agalactiae* <SEQ ID 1839> which encodes the amino acid sequence <SEQ ID 1840>. Analysis of this protein sequence reveals the following:

```
Possible site: 27
  >>> Seems to have an uncleavable N-term signal seq
  ----- Final Results -----
     bacterial membrane --- Certainty = 0.0000 (Not Clear) <succ>
     bacterial outside --- Certainty = 0.0000 (Not Clear) <succ>
        bacterial cytoplasm --- Certainty = 0.0000 (Not Clear) <succ>
```

A related GBS nucleic acid sequence <SEQ ID 10223> which encodes amino acid sequence <SEQ ID 10224> was also identified.

The protein has homology with the following sequences in the GENPEPT database:

```
>GP:CAB49414 GB:AJ248284 hypothetical protein [Pyrococcus abyssi]
Identities = 29/86 (33%), Positives = 52/86 (59%), Gaps = 4/86 (4%)
Query: 14 TYYILLALFE--EAHGYAIMQKVEEMSGGDVRIAAGTMYGAIENLLKQKWIKSIPSD--D    69
          +Y ILL L E  + HGYAI +++EE++ G +  + G +Y  ++ L K K ++    ++
Sbjct: 19 SYLILLILNENEKLHGYAIRKRLEELTDGKLVPSEGALYSILKMLKKYKLVEDYWAEVGG   78

Query: 70 RRRKVYIITETGKEIVELETNRLRKL                                       95
          R R+ Y ITE GKE+++      +R++
Sbjct: 79 RVRRYYQITELGKEVLDEIKEEIREI                                      104
```

No corresponding DNA sequence was identified in *S. pyogenes*.

Based on this analysis, it was predicted that these proteins and their epitopes could be useful antigens for vaccines or diagnostics.

Example 593

A DNA sequence (GBSx0633) was identified in *S. agalactiae* <SEQ ID 1841> which encodes the amino acid sequence <SEQ ID 1842>. Analysis of this protein sequence reveals the following:

```
Possible site: 23
  >>> Seems to have no N-terminal signal sequence
  ----- Final Results -----
     bacterial cytoplasm --- Certainty = 0.0510 (Affirmative) <succ>
     bacterial membrane --- Certainty = 0.0000 (Not Clear) <succ>
     bacterial outside --- Certainty = 0.0000 (Not Clear) <succ>
```

A related GBS nucleic acid sequence <SEQ ID 10225> which encodes amino acid sequence <SEQ ID 10226> was also identified.

The protein has homology with the following sequences in the GENPEPT database:

```
>GP:AAF22299 GB:AF185571 putative N-acetyltransferase Camello 2
[Homo sapiens]

Identities = 32/110 (29%), Positives = 54/110 (49%), Gaps = 4/110 (3%)

Query:  67 IKMAEQDDIFQIENYYQNRKGQ-FWIALENEKVVGSIALLRIDDKTAVLKKFFTYPKYRG   125
           + +A + D+ I    Y +  G   FW+A    EKVVG++  L +DD T    K+   +
Sbjct:  86 VDIALRTDMSDITKSYLSECGSCFWVAESEEKVVGTVGALPVDDPTLREKRLQLFHLSVD   145

Query: 126 NPVR---LGRKLFERFMLFARASKFTRIVLDTPEKEKRSHFFYENQGFKQ             172
           N  R   + + L    + FAR  ++ +VLDT   +  + Y++ GFK+
Sbjct: 146 NEHRGQGIAKALVRTVLQFARDQGYSEVVLDTSNIQLSAMGLYQSLGFKK             195
```

No corresponding DNA sequence was identified in *S. pyogenes*.

Based on this analysis, it was predicted that these proteins and their epitopes could be useful antigens for vaccines or diagnostics.

Example 594

A DNA sequence (GBSx0634) was identified in *S. agalactiae* <SEQ ID 1843> which encodes the amino acid sequence <SEQ ID 1844>. Analysis of this protein sequence reveals the following:

```
Possible site: 47
  >>> Seems to have a cleavable N-term signal seq.
  INTEGRAL  Likelihood = -11.94  Transmembrane 159-175 (151-180)
  INTEGRAL  Likelihood = -11.62  Transmembrane 231-247 (225-251)
  INTEGRAL  Likelihood = -9.98   Transmembrane 182-198 (177-203)
  INTEGRAL  Likelihood = -7.11   Transmembrane 118-134 (106-136)
  INTEGRAL  Likelihood = -1.49   Transmembrane 74-90 (74-93)
  ----- Final Results -----
     bacterial membrane --- Certainty = 0.5776 (Affirmative) <succ>
     bacterial outside --- Certainty = 0.0000 (Not Clear) <succ>
        bacterial cytoplasm --- Certainty = 0.0000 (Not Clear) <succ>
```

A related GBS nucleic acid sequence <SEQ ID 10227> which encodes amino acid sequence <SEQ ID 10228> was also identified.

The protein has homology with the following sequences in the GENPEPT database:

```
>GP:CAB15891 GB:Z99123 yxlG [Bacillus subtilis]
Identities = 42/188 (22%), Positives = 94/188 (49%), Gaps = 4/188 (2%)
Query:   1  MKSLAVMLKKEWMENVRTYKVISILITCSIFGILGPLTALMMPDIMA--GILPKKLQGAI   58
            MK +  +L+KEW+E  ++ K+I + I    I G+  PLT    MP+I+A  G LP ++ +
Sbjct:   1  MKVMMALLQKEWLEGWKSGKLIWLPIAMMIVGLTQPLTIYYMPEIIAHGGNLPDGMKISF   60

Query:  59  PEPTYIDSYIQYFKNMNQLGLVILVFLFSSTLTQEFSKGTLINLVTKGLAKKVIILAKFI  118
              P+  +  +      N LG+ +++F   ++  E ++G   ++++ +      I++K++
Sbjct:  61  TMPSGSEVMVSTLSQFNTLGMALVIFSVMGSVANERNQGVTALIMSRPVTAAHYIVSKWL  120

Query: 119  VITLLWTVSYLLSVVIHFSYTLYYFSNEGSHKLMVYGATWFIGILFI-SLILFFSVLFRK  177
            +  +++  +S+     + + Y   F +     +      + + ++FI +   L  S +FR
Sbjct: 121  IQSVIGIMSFAAGYGLAYYYVRLLFEDASFSRFAASLGLYALWVIFIVTAGLAGSTIFR-  179

Query: 178  TLGGLLGC                                                      185
            ++G     C
Sbjct: 180  SVGAAAAC                                                      187
```

No corresponding DNA sequence was identified in *S. pyogenes*.

Based on this analysis, it was predicted that these proteins and their epitopes could be useful antigens for vaccines or diagnostics.

Example 595

A DNA sequence (GBSx0635) was identified in *S. agalactiae* <SEQ ID 1845> which encodes the amino acid sequence <SEQ ID 1846>. This protein is predicted to be ABC transporter, ATP-binding protein. Analysis of this protein sequence reveals the following:

---

Possible site: 14
>>> Seems to have no N-terminal signal sequence
----- Final Results -----
    bacterial cytoplasm --- Certainty = 0.3431 (Affirmative) <succ>
    bacterial membrane --- Certainty = 0.0000 (Not Clear) <succ>
    bacterial outside --- Certainty = 0.0000 (Not Clear) <succ>

---

A related GBS nucleic acid sequence <SEQ ID 10229> which encodes amino acid sequence <SEQ ID 10230> was also identified.

The protein has homology with the following sequences in the GENPEPT database:

There is also homology to SEQ ID 686.

Based on this analysis, it was predicted that these proteins and their epitopes could be useful antigens for vaccines or diagnostics.

Example 596

A DNA sequence (GBSx0636) was identified in *S. agalactiae* <SEQ ID 1847> which encodes the amino acid sequence <SEQ ID 1848>. Analysis of this protein sequence reveals the following:

---

Possible site: 34
>>> Seems to have no N-terminal signal sequence
----- Final Results -----
    bacterial cytoplasm --- Certainty = 0.4040 (Affirmative) <succ>
    bacterial membrane --- Certainty = 0.0000 (Not Clear) <succ>
    bacterial outside --- Certainty = 0.0000 (Not Clear) <succ>

---

The protein has homology with the following sequences in the GENPEPT database:

```
>GP:CAB12736 GB:Z99108 similar to ABC transporter (ATP-binding
protein) [Bacillus subtilis]
Identities = 105/299 (35%), Positives = 175/299 (58%), Gaps = 11/299 (3%)
Query:   4  ISFQNVTKSFGPKKILNNVSFDLEENMIYGFVGPNGAGKTTTIKMILGLLKFDTGFITIF   63
            +  +NVTK+    + I++++SF E   ++GF+GPNGAGKTTTI+M++GL+K   G + I
Sbjct:   5  LELKNVTKNIRGRTIIDDLSFTIREGEVFGFLGPNGAGKTTTIRMMVGLMKLSKGDVLIC   64

Query:  64  GKKVNFGRTDTNQLIGYLPDVPEYYDYMTALEYLDLCSGLARSKHKLSNKELLRSVGLDD  123
            G+ +        + IG + + PE Y +++  + L   + +    K    E++  VGL D
Sbjct:  65  GQSITKEYAKAIKHIGAIVENPELYKFLSGYKNLQQFARMVKGVTKEKIDEVVELVGLTD  124

Query: 124  N-HQKIATYSRGMKQRLGLAQALVHDPKIIICDEPTSALDPKGRQDILDIISNLRGEK--  180
              H K+ TYS GM+QRLGLAQ L+HDPK++I DEPT+ LDP G ++I D +  L  E+
Sbjct: 125  RIHDKVKTYSLGMRQRLGLAQCLLHDPKVLILDEPTNGLDPAGIREIRDHLKKLTRERGM  184

Query: 181  TVIFSTHILSDVEKICDHVLVLTKCGIYSLEELKGKKSEENYSVRILIKVTKSEAKVLSH  240
             VI S+H+LS++E +CD + +L K + ++ +K +    +EN +     ++   SEA + +
Sbjct: 185  AVIVSSHLLSEMELMCDRIAILQKGKLIDIQNVKDENIDENDTYFFQVE-QPSEAATVLN  243

Query: 241  NYQIEKKDNEYALTLKGSKMDNKADLLAGFYQDLVSLKISPSAIEVIDNSLEELYLEVT  299
              Y +   K N    + L   ++     +L      LV +I    ++VI  SLE+ +LE+T
Sbjct: 244  QYDLLSKTNGVEIKLAKEEVPAVIEL-------LVMQQIRIYEVKVITKSLEDRFLEMT  295
```

```
>GP:AAB71491 GB:U53767 ORF6 [Bacillus pumilus]
Identities = 39/134 (29%), Positives = 71/134 (52%), Gaps = 16/134 (11%)
Query:   2  LGENIYLQRTQIGMTQENLSDYLHLTKTTISKWENNQAKPDIDYLILMANLFDISLDDLV    61
            LG NI  +R  +  ++QE +++ L +++   ISKWE NQ++P +D LI +A LFD  +  +LV
Sbjct:   4  LGSNISNKRKSLKLSQEYVAEQLGVSRQAISKWETNQSEPSMDNLIRLAELFDSDIKELV    63

Query:  62  GYQKTLSDDQRNQLIKDLKIKANVLSERDFFQEVKELSKQFPNDFKTLLIMINM--VLSN    119
                     S +Q ++  KDL+ +              K++  Q     F  +L++I+    +
Sbjct:  64  ------SPEQYSEEQKDLETRIE--------HGQKDIKMQMSAVFGRILMLISFFGYIGA    109

Query: 120  LTNLNDSEMKEWSL                                                133
            L +L+  ++  W L
Sbjct: 110  LFDLSSYQLPIWXL                                                123
```

There is also homology to SEQ ID 1740.

Based on this analysis, it was predicted that this protein and its epitopes, could be useful antigens for vaccines or diagnostics.

Example 597

A DNA sequence (GBSx0637) was identified in *S. agalactiae* <SEQ ID 1849> which encodes the amino acid sequence <SEQ ID 1850>. Analysis of this protein sequence reveals the following:

---
Possible site: 20
>>> Seems to have an uncleavable N-term signal seq
INTEGRAL   Likelihood = −13.59   Transmembrane 152-168 (145-173)
INTEGRAL   Likelihood = −9.71    Transmembrane 7-23 (3-27)
INTEGRAL   Likelihood = −6.95    Transmembrane 125-141 (122-146)
INTEGRAL   Likelihood = −4.51    Transmembrane 85-101 (83-102)
INTEGRAL   Likelihood = −3.35    Transmembrane 55-71 (54-75)
----- Final Results -----
   bacterial membrane --- Certainty = 0.6434 (Affirmative) <succ>
     bacterial outside --- Certainty = 0.0000 (Not Clear) <succ>
       bacterial cytoplasm --- Certainty = 0.0000 (Not Clear) <succ>
---

The protein has homology with the following sequences in the GENPEPT database:

There is also homology to SEQ ID 1852.

A related GBS gene <SEQ ID 8611> and protein <SEQ ID 8612> were also identified. Analysis of this protein sequence reveals the following:

---
Lipop: Possible site: −1   Crend: 3
McG: Discrim Score: 11.91
GvH: Signal Score (−7.5): −4.6
Possible site: 20
>>> Seems to have an uncleavable N-term signal seq
ALOM program   count: 5 value: −13.59   threshold: 0.0
INTEGRAL   Likelihood = −13.59   Transmembrane 152-168 (145-173)
INTEGRAL   Likelihood = −9.71    Transmembrane 7-23 (3-27)
INTEGRAL   Likelihood = −6.95    Transmembrane 125-141 (122-146)
INTEGRAL   Likelihood = −4.51    Transmembrane 85-101 (83-102)
INTEGRAL   Likelihood = −3.35    Transmembrane 55-71 (54-75)
PERIPHERAL Likelihood = 1.16     184
modified ALOM score: 3.22
*** Reasoning Step: 3
----- Final Results -----
   bacterial membrane --- Certainty = 0.6434 (Affirmative) <succ>
     bacterial outside --- Certainty = 0.0000 (Not Clear) <succ>
       bacterial cytoplasm --- Certainty = 0.0000 (Not Clear) <succ>
---

The protein has homology with the following sequences in the databases:

```
>GP:CAA79986 GB:Z21972 ORF2 [Bacillus megaterium]
Identities = 51/186 (27%), Positives = 106/186 (56%), Gaps = 5/186 (2%)
Query:   5  SFFQCVILLVSFLVLTLAVKSQSDMISYLDNITSAFFQSIRNPDLTNLMTIISTVVSPLT    64
            +F   V+ L+ F  +     + S ++ + + +++ S     Q     +P LT++M   + + S +
Sbjct:  10  AFIISVLSLIGFSFMAFTI-SANEYLKFDEDVIS-LVQGWESPLLTDIMKFFTYIGSTAS    67

Query:  65  TSLIALVILGYQY-FLNQRIAVWLFM-LFFGTNALALLLKDIIARHRP-MNQLVFDSGYS    121
             +++LVIL + Y  L  R+ + LF  + G+  L L++K     R RP +++L+   GYS
Sbjct:  68  LIILSLVILFFLYRILKHRLELVLFTAVMVGSPLLNLMVKLFFQRARPDLHRLIDIGGYS    127

Query: 122  FPSGHTISAFLLMILVLVVARQRLRRVLSQVVFVIFALVILASVIFSRLYLENHFLTDIL    181
            FPSGH ++AF L ++  +  +  ++++ ++F+++++ S+   SR+YL  H+ +DI+
Sbjct: 128  FPSGHAMNAFSLYGILTFLLWRHITARWARILLILFSMLMILSIGISRIYLGVHYPSDII    187

Query: 182  GSLLLG                                                        187
                L G
Sbjct: 188  AGYLAG                                                        193
```

---

```
ORF01359(313-864 of 1212)
EGAD|16772|16959(10-194 of 216) hypothetical protein {Bacillus megaterium}
GP|288301|emb|CAA79986.1||Z21972 ORF2 {Bacillus megaterium} PIR|S32217|S32217
hypothetical protein 2 - Bacillus megaterium
% Match = 9.5
% Identity = 28.2 % Similarity = 60.1
Matches = 53 Mismatches = 68 Conservative Sub.s = 60
```

```
      66        96       126       156       186       216       246       276
SFFIEFTHPFLIICNIHYSLRFKYIVAILLY**KFER*LIGKVRIWYFF*FVNSHI*T*KVSAYFKHFLNILNHNV*RFI 306       336       366       396       426       456       486       516
SLLK*GYVVNKKSFFQCVILLVSFLVLTLAVKSQSDMISYLDNITSAFFQSIRNPDLTNLMTIISTVVSPLTTSLIALVI
     :|        |:   |:   |     :  :     |  ::  :  :::    ::    |    :| ||::|    :   :  |    :   :::|||
     MKLKQQLTIAFIISVLSLIGFSFMAFTI-SANEYLKFDEDV-ISLVQGWESPLLTDIMKFFTYIGSTASLIILSLVI
         10        20        30        40        50        60        70

543       570       600       630       657       687       714       744
LGYQY-FLNQRIAVWLFM-LFFGTNALALLLKDIIARHRP-MNQLVFDSGYSFPSGHTISAFLLM-ILVLVVARQRLRRV
 |  :  |    |  :|:  :  ||    :    |:    |  |:: |       |  ||  :::|:    ||||||||   ::||  ||   ||   :::  |:  :
LFFLYRILKHRLELVLFTAVMVGSPLLNLMVKLFFQRARPDLHRLIDIGGYSFPSGHAMNAFSLYGILTFLLWRH-ITAR
       90       100       110       120       130       140       150

774       804       834       864       894       924       954       984
LSQVVFVIFALVILASVIFSRLYLENHFLTDILGSLLLGASSYYGLSAIVSLKELQ*K**LPMNYKRAFLKGSFIIHYFS
 ::::::::|:::::    |:     ||:||    |: :||:          ||      | |
WARILLILFSMLMILSIGISRIYLGVHYPSDIIAGYLAGGCWIAISIWFFQRYQDRRKNKDR
       170       180       190       200       210
```

Based on this analysis, it was predicted that these proteins and their epitopes could be useful antigens for vaccines or diagnostics.

Example 598

A DNA sequence (GBSx0638) was identified in *S. agalactiae* <SEQ ID 1853> which encodes the amino acid sequence <SEQ ID 1854>. Analysis of this protein sequence reveals the following:

```
Possible site: 41
 >>> Seems to have no N-terminal signal sequence
 ----- Final Results -----
      bacterial cytoplasm --- Certainty = 0.4288 (Affirmative) <succ>
      bacterial membrane --- Certainty = 0.0000 (Not Clear) <succ>
       bacterial outside --- Certainty = 0.0000 (Not Clear) <succ>
```

The protein has homology with the following sequences in the GENPEPT database:

```
>GP:CAB15470 GB:Z99121 yvdC [Bacillus subtilis]
Identities = 53/96 (55%), Positives = 70/96 (72%)
Query:   1 MDITDYQKWVSEFYKKRNWYQYNSFIRSNFLSEEVGELAQAIRKYEIGRDRPDETEQTDL  60
           M + D +KW+ EFY+KR W +Y  FIR   FL EE GELA+A+R YEIGRDRPDE E +
Sbjct:   1 MQLADAEKWMKEFYEKRGWTEYGPFIRVGFLMEEAGELARAVRAYEIGRDRPDEKESSRA  60

Query:  61 ENLNDIKEELGDVLDNIFILADQYNISLEEIISAHR                          96
           E   ++ EE+GDV+ NI ILAD Y +SLE+++ AH+
Sbjct:  61 EQKQELIEEMGDVIGNIAILADMYGVSLEDVMKAHQ                          96
```

No corresponding DNA sequence was identified in *S. pyogenes*.

Based on this analysis, it was predicted that this protein and its epitopes, could be useful antigens for vaccines or diagnostics.

Example 599

A DNA sequence (GBSx0639) was identified in *S. agalactiae* <SEQ ID 1855> which encodes the amino acid sequence <SEQ ID 1856>. Analysis of this protein sequence reveals the following:

```
Possible site: 54
 >>> Seems to have no N-terminal signal sequence
 ----- Final Results -----
      bacterial cytoplasm --- Certainty = 0.0635 (Affirmative) <succ>
      bacterial membrane --- Certainty = 0.0000 (Not Clear) <succ>
       bacterial outside --- Certainty = 0.0000 (Not Clear) <succ>
```

The protein has homology with the following sequences in the GENPEPT database:

```
>GP:BAB06803 GB:AP001517 unknown conserved protein [Bacillus halodurans]
Identities = 83/186 (44%), Positives = 117/186 (62%)
Query:   1 MRITIFCGASTGENPVYSEKTVALAQWMAQNKHSLVYGGGKVGLMGVMADTVIANGGYTT  60
           M+I +FCG+S G + VY E    L + +A+    +LVYGG  VG+MG +AD+V+  GG
Sbjct:   1 MKIAVFCGSSNGASDVYKEGARQLGKELARRGITLVYGGASVGIMGAVADSVLEAGGEVI  60

Query:  61 GVIPTFLRDREIAHENLSELIIVNNMPERKAKMMLLGDAFIALPGGPGTLEEISEVISWS  120
           GV+P FL + EI+H +L++LI+V  M ERKAKM  L D F+ALPGGPGTLEE  E+ +W+
Sbjct:  61 GVMPRFLEEPEISHPHLTKLIVVETMHERKAKMAELADGFLALPGGPGTLEEFFEIFTWA  120
```

-continued
```
Query: 121 RIGQNDNPCILYNVNGYFNDLKNMFDHMVGEGFLSLEDRENVLFSDDITEIEDFITNYKV 180
            +IG +  PC L N+N YF+ L  +  HM E FL  + R    L   D   + D  + Y+
Sbjct: 121 QIGLHQKPCGLLNINHYFDPLVTLLHHMSNEQFLHEKYRSMALVHTDPILLLDQFSTYEP 180

Query: 181 PSTRQY                                                       186
            P+ + Y
Sbjct: 181 PTVKAY                                                       186
```

No corresponding DNA sequence was identified in *S. pyogenes*.

Based on this analysis, it was predicted that this protein and its epitopes, could be useful antigens for vaccines or diagnostics.

Example 600

A DNA sequence (GBSx0640) was identified in *S. agalactiae* <SEQ ID 1857> which encodes the amino acid sequence <SEQ ID 1858>. Analysis of this protein sequence reveals the following:

Possible site: 19
>>> Seems to have a cleavable N-term signal seq.
INTEGRAL  Likelihood = −7.86  Transmembrane 222-238 (214-239)
INTEGRAL  Likelihood = −6.69  Transmembrane 39-55 (36-58)
INTEGRAL  Likelihood = −4.25  Transmembrane 266-282 (266-284)
INTEGRAL  Likelihood = −1.28  Transmembrane 166-182 (166-182)
INTEGRAL  Likelihood = −1.01  Transmembrane 190-206 (190-206)
INTEGRAL  Likelihood = −0.96  Transmembrane 70-86 (70-86)
----- Final Results -----
   bacterial membrane --- Certainty = 0.4142 (Affirmative) <succ>

-continued bacterial outside --- Certainty = 0.0000 (Not Clear) <succ>
   bacterial cytoplasm --- Certainty = 0.0000 (Not Clear) <succ>

The protein has homology with the following sequences in the GENPEPT database:

```
>GP:CAB12420 GB:Z99107 ydiL [Bacillus subtilis]

Identities = 40/132 (30%), Positives = 63/132 (47%), Gaps = 8/132 (6%)
Query: 107 ESQNYDATFNI-----LMISYSVVVGPFFEEVLYRGIVLNLL-SKYGKWFAIITSGILFG 160
            ES+N  A  ++      LMI  S +VGP  EE+++R I+   L   K   +FA + S ++FG
Sbjct: 114 ESENTQAILDVIQAVPLMIIVSSIVGPILEEIIFRKIIFGALYEKTNFFFAGLISSVIFG 173

Query: 161 LMHQDISQLLTTSIAGIIMGFI-AYHYSFKVALLLHICNNFIVEIFTQLSTVNELYGTYF 219
            ++H D+  LL +   G    F+ A       V +  H+  N   V +   QL     V
Sbjct: 174 IVHADLKHLLLYTAMGFTFAFLYARTKRIWVPIFAHLMMNTFV-VIMQLEPVRNYLEQQS 232

Query: 220 ENILLILAILFI                                                 231
            + LI+    LF+
Sbjct: 233 TQMQLIIGGLFL                                                 244
```

No corresponding DNA sequence was identified in *S. pyogenes*.

A related GBS gene <SEQ ID 8613> and protein <SEQ ID 8614> were also identified. Analysis of this protein sequence reveals the following:

Lipop: Possible site: −1   Crend: 6
McG: Discrim Score: 12.52
GvH: Signal Score (−7.5): −1.74
Possible site: 19
>>> Seems to have a cleavable N-term signal seq.
ALOM program   count: 2 value: −6.69 threshold: 0.0
INTEGRAL       Likelihood = −6.69   Transmembrane 39-55 (36-58)
INTEGRAL       Likelihood = −0.96   Transmembrane 70-86 (70-86)
PERIPHERAL     Likelihood = 4.56    21
modified ALOM score: 1.84
*** Reasoning Step: 3
----- Final Results -----
   bacterial membrane --- Certainty = 0.3675 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the databases:

```
Query: 10 LIGLILLAQAIVLSLATTLFAEILQNDVWIGIASTLIALLIPCF   53
          L+ L LL ++++LS++       +L   +W+ +A+ L+A ++ CF
Sbjct: 21 LLCLCLLVRSLLLSVSLYSALILLVLILWVTVATPLLAFVVSCF   64
```

Based on this analysis, it was predicted that these proteins and their epitopes could be useful antigens for vaccines or diagnostics.

Example 601

A DNA sequence (GBSx0641) was identified in *S. agalactiae* <SEQ ID 1859> which encodes the amino acid sequence <SEQ ID 1860>. This protein is predicted to be capa protein. Analysis of this protein sequence reveals the following:

Possible site: 50
>>> Seems to have no N-terminal signal sequence
INTEGRAL   Likelihood = –13.80   Transmembrane 27-43 (22-50)
----- Final Results -----
   bacterial membrane --- Certainty = 0.6519 (Affirmative) <succ>
   bacterial outside --- Certainty = 0.0000 (Not Clear) <succ>
   bacterial cytoplasm --- Certainty = 0.0000 (Not Clear) <succ>

A related GBS nucleic acid sequence <SEQ ID 9385> which encodes amino acid sequence <SEQ ID 9386> was also identified.

The protein has homology with the following sequences in the GENPEPT database:

```
>GP:AAF13661 GB:AF188935 pXO2-56 [Bacillus anthracis]
Identities = 68/224 (30%), Positives = 118/224 (52%), Gaps = 10/224 (4%)

Query:     95  FKEVKSWIESADLAIGDYEGTISSE----YPLAGYPL-FNAPNEIATTMKETGYDVVDLA    149
               F+ V  +++++D   G++E  +   E       Y A    + +A E      +KE G+ V++LA
Sbjct:     87  FRHVSPYLKNSDYVSGNFEHPVLLEDKKNYQKADKNIHLSAKEETVKAVKEAGFTVLNLA    146

Query:    150  HNHILDSQLAGAINTVKTFNRLGLDTIGVYLKDRNKEDILIKHVNGIKIAILGYSYGY-N    208
               +NH+ D     G  +T+K F    LD +G      ++ ++I+ ++VNG+++A LG++  +
Sbjct:    147  NNHMTDYGAKGTKDTIKAFKEADLDYVGAGENFKDVKNIVYQNVNGVRVATLGFTDAFVA    206

Query:    209  GMEANVSKSDYEKHMSDLDTKKIKQDIKKAEKEADITIVMPQMGIEYQKKPTTEQVMLYH    268
                G A    +         D+   K+I +      +  AD+ +V     G EY   KP+   Q   L
Sbjct:    207  GAIATKEQPGSLSMNPDVLLKQISKAKDPKKGNADLVVVNTHWGEEYDNKPSPRQEALAK    266

Query:    269  SMIKWGADIIFGGHPHVVEPSEVIKKDGQKKFIIYSMGNFISNQ                 312
               +M+   GADII G HPHV++  +V K+    I   YS+GNF+ +Q
Sbjct:    267  AMVDAGADIIVGHHPHVLQSFDVYKQG----IIFYSLGNFVFDQ                 306
```

A related DNA sequence was identified in *S. pyogenes* <SEQ ID 1861> which encodes the amino acid sequence <SEQ ID 1862>. Analysis of this protein sequence reveals the following:

Possible site: 45
>>> Seems to have no N-terminal signal sequence
INTEGRAL   Likelihood = –12.05   Transmembrane 44-60 (40-68)
----- Final Results -----
   bacterial membrane --- Certainty = 0.5819 (Affirmative) <succ>
   bacterial outside --- Certainty = 0.0000 (Not Clear) <succ>
   bacterial cytoplasm --- Certainty = 0.0000 (Not Clear) <succ>

A related sequence was also identified in GAS <SEQ ID 9119> which encodes the amino acid sequence <SEQ ID 9120>. Analysis of this protein sequence reveals the following:

Possible cleavage site: 31
>>> Seems to have no N-terminal signal sequence
----- Final Results -----
   bacterial membrane --- Certainty = 0.582 (Affirmative) <succ>
   bacterial outside --- Certainty = 0.000 (Not Clear) <succ>
   bacterial cytoplasm --- Certainty = 0.000 (Not Clear) <succ>

An alignment of the GAS and GBS proteins is shown below:

```
Identities = 232/334 (69%), Positives = 273/334 (81%), Gaps = 4/334 (1%)

Query:     24  YQKTLIFCVAVIIAIFILGLSKDLAQSKGQKVANNNT----VKTARVVANGDILLHDVLY    79
               Y+KT+    VA+I+A+ + GL  DL   + ++A   +      VKTARVVANGDIL+HD+LY
Sbjct:     40  YKKTMATVVALIVALLLFGLIYDLLGVQKNELAAQKSAQPKVKTARVVANGDILIHDILY    99

Query:     80  ASARQPDGTYNFTPYFKEVKSWIESADLAIGDYEGTISSEYPLAGYPLFNAPNEIATTMK   139
                SAR+  D TY+FTPYF+  VK WI  ADLAIGDYEGTIS +YPLAGYPLFNAP EIA   +K
Sbjct:    100  MSARKADDTYDFTPYFEYVKDWISGADLAIGDYEGTISPDYPLAGYPLFNAPEEIAGALK   159

Query:    140  ETGYDVVDLAHNHILDSQLAGAINTVKTFNRLGLDTIGVYLKDRNKEDILIKHVNGIKIA   199
                TGYDVVDLAHNHILDSQL GA+NT K F++LG+D+IG+Y KDR+KE   LIK+VNGIKIA
Sbjct:    160  NTGYDVVDLAHNHILDSQLDGALNTKKVFHQLGIDSIGIYDKDRSKESFLIKNVNGIKIA   219

Query:    200  ILGYSYGYNGMEANVSKSDYEKHMSDLDTKKIKQDIKKAEKEADITIVMPQMGIEYQKKP   259
                ILGYSYGYNGMEA +S+ DYEKHMSDLD   KIK++++ AEK+AD+TIVMPQMG EY   +P
Sbjct:    220  ILGYSYGYNGMEATLSQEDYEKHMSDLDEAKIKKELQLAEKKADVTIVMPQMGTEYALEP   279

Query:    260  TTEQVMLYHSMIKWGADIIFGGHPHVVEPSEVIKKDGQKKFIIYSMGNFISNQRLETVDD   319
                T EQ   LYH MI WGAD++ GGHPHV+EPSE + K    QKKFIIYSMGNFISNQRLETVDD
Sbjct:    280  TAEQKELYHKMIDWGADVVLGGHPHVIEPSETVIKGRQKKFIIYSMGNFISNQRLETVDD   339

Query:    320  IWTERGLLMDVTIEKKGQKTVIKKVKAHPTLVEA                            353
                IWTERGLLMD+T  EKK    KT  IK  V+AHPT+V  A
Sbjct:    340  IWTERGLLMDLTFEKKDNKTKIKTVEAHPTMVLA                            373
```

A related GBS gene <SEQ ID 8615> and protein <SEQ ID 8616> were also identified. Analysis of this protein sequence reveals the following:

```
Lipop Possible site: −1    Crend: 7
SRCFLG: 0
McG: Length of UR: 18
Peak Value of UR: 3.83
Net Charge of CR: 2
McG: Discrim Score: 15.36
GvH: Signal Score (−7.5): −1.52
Possible site: 32
>>> Seems to have a cleavable N-term signal seq.
Amino Acid Composition: calculated from 33
ALOM program   count: 0 value: 4.35 threshold: 0.0
PERIPHERAL    Likelihood = 4.35    170
modified ALOM score: −1.37
*** Reasoning Step: 3
Rule gpo1
----- Final Results -----
    bacterial outside --- Certainty = 0.3000 (Affirmative) <succ>
       bacterial membrane --- Certainty = 0.0000 (Not Clear) <succ>
          bacterial cytoplasm --- Certainty = 0.0000 (Not Clear) <succ>
```

The protein has homology with the following sequences in the databases:

```
30.6/53.3% over 230aa
Bacillus anthracis
EGAD|20151| capa protein Insert characterized
SP|P19579|CAPA_BACAN CAPA PROTEIN. Edit characterized
GP|142633|gb|AAA22288.1||M24150 46 Kd encapsulation protein CapA Insert characterized
P A related GBS nucleic acid sequence <SEQ ID 9971> which encodes amino acid sequence <SEQ ID 9972> was also identified.

The protein has homology with the following sequences in the GENPEPT database:

```
>GP:AAC00308 GB:AF008220 YtbJ [Bacillus subtilis]
Identities = 184/354 (51%), Positives = 249/354 (69%)

Query:    11  MQYSEIMIRYGELSTKKKNRMRFINKLKNNMEHVLSIYPDVSVKTDRDRGHVYLNGTDYH   70
              M Y  I+IR+GE+STK KNR  FI +LK N+  VL  YP++   ++RDR  + LNG D
Sbjct:     1  MNYDHILIRFGEISTKGKNRKSFIERLKQNIRLVLKDYPNLKYFSNRDRMTITLNGEDPE   60

Query:    71  EVAESLKEIFGIQAFSPSFKVEKNVDTLVKAVQEIMTSVYKDGMTFKITAKRSDHSFELD  130
              +   LK++FGIQ+FS + K +  +D +    + +   YK G TFK+  KR+   FELD
Sbjct:    61  ALFPHLKQVFGIQSFSLAIKCDSRLDDIKATALKAIKDQYKPGDTFKVATKRAYKQFELD  120

Query:   131  SRALNHTLGDAVFSVLPNIKAQMKQPDINLKVEIRDEAAYISYEDIRGAGGLPVGTSGKG  190
              + +N +G +     +  ++ PDI L++EIR EA +++  D +GAGGLPVG++GK
Sbjct:   121  TNQMNAEIGGHILRNTEGLTVDVRNPDIPLRIEIREEATFLTIRDEKGAGGLPVGSAGKA  180

Query:   191  MLMLSGGIDSPVAGYLALKRGVDIEAVHFASPPYTSPGALKKAHDLTRKLTKFGGNIQFI  250
              MLMLSGG DSPVAG+ A+KRG+ +EAVHF SPPYTS  A +K   DL + L++FGG++
Sbjct:   181  MLMLSGGFDSPVAGFYAMKRGLSVEAVHFFSPPYTSERAKQKVMDLAKCLSRFGGSMTLH  240

Query:   251  EVPFTEIQEEIKAKAPEAYLMTLTRRFMMRITDRIREDRNGLVIINGESLGQVASQTLES  310
                VPFT+ QE I+ +  PE Y MT TRR M++I DRIRE RNGL II GESLGQVASQTLES
Sbjct:   241  IVPFTKTQELIQKQIPENYTMTATRRLMLQIADRIREKRNGLAIITGESLGQVASQTLES  300

Query:   311  MQAINAVTATPIIRPVVTMDKLEIIDIAQKIDTFDISIQPFEDCCTIFAPDRPK       364
              M AINAVT+TPI+RP++ MDK EII+ +++I T++ SIQPFEDCCTIF   +P+
Sbjct:   301  MYAINAVTSTPILRPLIAMDKTEIIEKSREIGTYETSIQPFEDCCTIFTTAKPR       354
```

A related DNA sequence was identified in *S. pyogenes* <SEQ ID 1865> which encodes the amino acid sequence <SEQ ID 1866>. Analysis of this protein sequence reveals the following:

Possible site: 42
>>> Seems to have no N-terminal signal sequence

-continued

```
----- Final Results -----
    bacterial cytoplasm --- Certainty = 0.4897 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below:

```
Identities = 316/404 (78%), Positives = 362/404 (89%)

Query:    11  MQYSEIMIRYGELSTKKKNRMRFINKLKNNMEHVLSIYPDVSVKTDRDRGHVYLNGTDYH   70
              M YSEIM+R+GELSTK KNRMRFINKLKNN++ VL+ +P ++V++DRDR HV LNGTDY
Sbjct:     1  MDYSEIMVRHGELSTKGKNRMRFINKLKNNIQDVLAPFPAITVRSDRDRTHVSLNGTDYQ   60

Query:    71  EVAESLKEIFGIQAFSPSFKVEKNVDTLVKAVQEIMTSVYKDGMTFKITAKRSDHSFELD  130
              + E+LK +FG+QA SP +K EK+V  LV  AVQ+IMTS+Y DG+TFKI  KRSDH FELD
Sbjct:    61  PIVEALKLVFGVQALSPVYKLEKSVPLLVTAVQDIMTSLYRDGLTFKIATKRSDHAFELD  120

Query:   131  SRALNHTLGDAVFSVLPNIKAQMKQPDINLKVEIRDEAAYISYEDIRGAGGLPVGTSGKG  190
              SR LN  LG AVF VLPNI+AQMK PD+ LKVEIRDEAAYISYE+I+GAGGLPVGTSGKG
Sbjct:   121  SRELNSLLGGAVFEVLPNIQAQMKHPDVTLKVEIRDEAAYISYEEIKGAGGLPVGTSGKG  180

Query:   191  MLMLSGGIDSPVAGYLALKRGVDIEAVHFASPPYTSPGALKKAHDLTRKLTKFGGNIQFI  250
              MLMLSGGIDSPVAGYLALKRG+DIE VHFASPPYTSPGAL KA DLTR+LT+FGGNIQFI
Sbjct:   181  MLMLSGGIDSPVAGYLALKRGLDIEVVHFASPPYTSPGALAKAQDLTRRLTRFGGNIQFI  240

Query:   251  EVPFTEIQEEIKAKAPEAYLMTLTRRFMMRITDRIREDRNGLVIINGESLGQVASQTLES  310
              EVPFTEIQEEIK KAPEAYLMTLTRRFMMRITD IRE R GLVI+NGESLGQVASQTLES
Sbjct:   241  EVPFTEIQEEIKNKAPEAYLMTLTRRFMMRITDAIREQRKGLVIVNGESLGQVASQTLES  300

Query:   311  MQAINAVTATPIIRPVVTMDKLEIIDIAQKIDTFDISIQPFEDCCTIFAPDRPKTNPKIK  370
              MQAINAVT+TPIIRPVVTMDKLEII++AQ IDTFDISIQPFEDCCTIFAPDRPKTNPK+
Sbjct:   301  MQAINAVTSTPIIRPVVTMDKLEIIEMAQAIDTFDISIQPFEDCCTIFAPDRPKTNPKLG  360

Query:   371  NTEQYEKRMDVEGLVERAVAGIMVTTIQPQADSDDVDDLIDDLL                 414
              N E+YE+  D++GLV+RAV+GI+VT I P+  +D+V++LID LL
Sbjct:   361  NAEKYEECFDIDGLVQRAVSGIVVTEITPEIVNDEVENLIDALL                 404
```

Based on this analysis, it was predicted that these proteins and their epitopes could be useful antigens for vaccines or diagnostics.

Example 603

A DNA sequence (GBSx0643) was identified in *S. agalactiae* <SEQ ID 1867> which encodes the amino acid sequence <SEQ ID 1868>. This protein is predicted to be nifs protein homolog, fragment. Analysis of this protein sequence reveals the following:

Possible site: 47
>>> Seems to have no N-terminal signal sequence
INTEGRAL   Likelihood = −0.27   Transmembrane 131-147 (131-147)
----- Final Results -----
  bacterial membrane --- Certainty = 0.1107 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database:

A related DNA sequence was identified in *S. pyogenes* <SEQ ID 1869> which encodes the amino acid sequence <SEQ ID 1870>. Analysis of this protein sequence reveals the following:

Possible site: 41
>>> Seems to have no N-terminal signal sequence
----- Final Results -----
  bacterial cytoplasm --- Certainty = 0.3067 (Affirmative) <succ>
  bacterial membrane --- Certainty = 0.0000 (Not Clear) <succ>
  bacterial outside --- Certainty = 0.0000 (Not Clear) <succ>

```
>GP:CAA43493 GB:X61190 nifS-like gene [Lactobacillus delbrueckii]
Identities = 177/353 (50%), Positives = 234/353 (66%), Gaps = 1/353 (0%)

Query:   14 PEVLRTYQEVASKIYGNPSSLHELGTTSSRILEASRKQIASLLELKANEIFFTSGGTEAD    73
            P+ L TY +V +KI+GNPSSLH+LG  +  +LEASRKQ+A LL +  +EI+FTSGGTE++
Sbjct:    3 PKALETYSQVVTKIWGNPSSLHKLGDRAHGLLEASRKQVADLLGVNTDEIYFTSGGTESN    62

Query:   74 NWVIKGLAFEKQHFGNHIIVSDIEHPAVKESAKWLGEYGFEIDYAPVDDKGFVDVEALVK   133
            N  IKG A+ K+ FG HII S +EH +V  +    L   GF +   PVD +G V+ E L
Sbjct:   63 NTAIKGTAWAKREFGKHIITSSVEHASVANTFTELENLGFRVTRLPVDKEGRVNPEDLKA   122

Query:  134 LIKPETILISIMAINNEIGSIQPIKAISDLLSDKPTISFHVDAVQAIGKIPTKDYLTERV   193
             +  +T L+SIM +NNEIG+IQPIK IS++L+D P I FHVD VQA+GK        T RV
Sbjct:  123 ALDKDTTLVSIMGVNNEIGTIQPIKEISEILADYPNIHFHVDNVQALGKGIWDQVFTSRV   182

Query:  194 DFASFSSHKFHGVRGVGFLYIKEGKRISPLLTGGGQETDLRSTTENVAGIAATAKALRMV   253
            D  SFSSHKFHG RG+G LY K G+ + PL  GGGQE  LRS TEN+A IAA AKA R++
Sbjct:  183 DMMSFSSHKFHGPRGIGILYKKRGRMLMPLCEGGGQEKGLRSGTENLAAIAAMAKAARLL   242

Query:  254 MDKEVVAIPKISKMKTIIHDELAKYEDITLFSG-KEDFSPNIITFGIKGVRGEVLVHAFE   312
            + E    +K I    LA   I +FS  K DF+P+I+ F ++G+RGE LVH  E
Sbjct:  243 LTDEKEKADREYAIKEKISKYLAGKPGIHIFSPLKADFAPHILCFALEGIRGETLVHTLE   302

Query:  313 GHDIFISTTSACSSKAGKPAGTLIAMGISTKLAQTAVRISLDDDNDMGQVEQF         365
               DI+ISTTSAC+SK     A TL+AM     +A +AVR+S D+ N + +  ++F
Sbjct:  303 DQDIYISTTSACASKKADEASTLVAMKTPDAIATSAVRLSFDESNTLEEADEF         355
```

An alignment of the GAS and GBS proteins is shown below:

```
Identities = 268/370 (72%), Positives = 322/370 (86%)

Query:    1 MIYFDNSATTIPYPEVLRTYQEVASKIYGNPSSLHELGTTSSRILEASRKQIASLLELKA    60
            MIYFDN+ATTIPY E L+TYQEVA+KIYGNPSSLH+LGT +SRILEASRKQIA LL +K+
Sbjct:    1 MIYFDNAATTIPYGEALKTYQEVATKIYGNPSSLHQLGTNASRILEASRKQIAGLLGVKS    60

Query:   61 NEIFFTSGGTEADNWVIKGLAFEKQHFGNHIIVSDIEHPAVKESAKWLGEYGFEIDYAPV   120
             EIFFTSGGTE+ NW IKG+AFEK  FG HII+S IEHPAV ES KWL    GFE+ YAPV
Sbjct:   61 EEIFFTSGGTESANWAIKGIAFEKNAFGKHIIISAIEHPAVSESVKWLLTQGFEVSYAPV   120

Query:  121 DDKGFVDVEALVKLIKPETILISIMAINNEIGSIQPIKAISDLLSDKPTISFHVDAVQAI   180
              +G VDV AL  +LI+P+TILISIMA+NNE+G+IQPI+AIS+LL+N+PTI+FHVDAVQAI
Sbjct:  121 TTQGVVDVNALAELIRPDTILISIMAVNNEMGAIQPIRAISNLLANQPTITFHVDAVQAI   180

Query:  181 GKIPTKDYLTERVDFASFSSHKFHGVRGVGFLYIKEGKRISPLLTGGGQETDLRSTTENV   240
            GKIP  DY+T RVD ASFS HKFH VRGVGFLY K GKR++PLL+GGGQE +LRSTTENV
```

```
Sbjct:  181   GKIPLCDYMTNRVDLASFSGHKFHSVRGVGFLYKKAGKRLNPLLSGGGQEQELRSTTENV   240

Query:  241   AGIAATAKALRMVMDKEVVAIPKISKMKTIIHDELAKYEDITLFSGKEDFSPNIITFGIK   300
              AGIA+ AKALR+V +K+V  +PK++ M+ +I+   L+ Y D+T+FS +E F+PNI+TFGI+
Sbjct:  241   AGIASMAKALRIVTEKQVSVLPKLTAMRDVIYKSLSAYPDVTVFSAQEGFAPNILTFGIR   300

Query:  301   GVRGEVLVHAFEGHDIFISTTSACSSKAGKPAGTLIAMGISTKLAQTAVRISLDDDNDMG   360
              GVRGEV+VHAFE ++I+ISTTSACSSKAG+PAG+L+AMGI K AQTAVRISLDDDNDMG
Sbjct:  301   GVRGEVIVHAFEKYEIYISTTSACSSKAGEPAGSLVAMGIPVKTAQTAVRISLDDDNDMG   360

Query:  361   QVEQFLTIFK                                                   370
              QVEQFLTIF+
Sbjct:  361   QVEQFLTIFQ                                                   370
```

Based on this analysis, it was predicted that these proteins and their epitopes could be useful antigens for vaccines or diagnostics.

Example 604

A DNA sequence (GBSx0644) was identified in *S. agalactiae* <SEQ ID 1871> which encodes the amino acid sequence <SEQ ID 1872>. Analysis of this protein sequence reveals the following:

Possible site: 29

>>> Seems to have no N-terminal signal sequence

----- Final Results ----- bacterial cytoplasm --- Certainty = 0.1539 (Affirmative) <succ> bacterial membrane --- Certainty = 0.0000 (Not Clear) <succ> bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 605

A DNA sequence (GBSx0645) was identified in *S. agalactiae* <SEQ ID 1873> which encodes the amino acid sequence <SEQ ID 1874>. This protein is predicted to be glutathione reductase (gor). Analysis of this protein sequence reveals the following:

Possible site: 23

>>> Seems to have no N-terminal signal sequence

INTEGRAL Likelihood = −4.25 Transmembrane 170-186 (169-187)

----- Final Results ----- bacterial membrane --- Certainty = 0.2699 (Affirmative) <succ> bacterial outside --- Certainty = 0.0000 (Not Clear) <succ> bacterial cytoplasm --- Certainty = 0.0000 (Not Clear) <succ>

The protein has homology with the following sequences in the GENPEPT database:

```
>GP:BAA76640 GB:AB019579 glutathione reductase (GR) [Streptococcus mutans]
Identities = 274/450 (60%), Positives = 346/450 (76%), Gaps = 1/450 (0%)

Query:    1   MSKQYDYIVIGGGSAGSGTANRAAMYGAKVLLIEGGQVGGTCVNLGCVPKKIMWYGAQVS    60
              M+KQYDYIVIGGGS G  +ANRAAM+GAKV+L EG QVGGTCVN+GCVPKK+MWYGAQV+
Sbjct:    1   MTKQYDYIVIGGGSGGIASANRAAMHGAKVILFEGKQVGGTCVNVGCVPKKVMWYGAQVA    60

Query:   61   ETLHKYSSGYGFEVNNLNFDFTTLKANRDAYVQRSRQSYAANFERNGVEKIDGFARFIDN   120
              ET++ Y++ YGF+V    F F  LK NR AY+ R + SY    F+ NGVE++  +A F+D
Sbjct:   61   ETINNYAADYGFDVTTQTFHFDALKQNRQAYIDRIQDSYERGFDSNGVERVYSYATFVDA   120

Query:  121   HTIEVNGQQYKAPHITIATGGHPLYPDIIGSELGETSDDFFGWETLPDSILIVGAGYIAA   180
              HT+EV G+ Y APHI IATGGH L PDI GSE G TSD FF  + +P    +VGAGYIA
Sbjct:  121   HTVEVAGEHYTAPHILIATGGHALLPDIPGSEYGITSDGFFELDAIPKRTAVVGAGYIAV   180

Query:  181   ELAGVVNELGVETHLAFRKDHILRGFDDMVTSEVMAEMEKSGISLHANHVPKSLKRDEGG   240
              E++GV++ LG ETHL  R+D  LR FD +   ++ EM+K G  LH   VPK + ++
Sbjct:  181   EISGVLHALGGETHLFVRRDRPLRKFDKEIVGTLVDEMKKDGPHLHTFSVPKEVIKNTDN   240

Query:  241   KLIFEAENGKTLVVDRVIWAIGRGPNV-DMGLENTDIVLNDKGYIKADEFENTSVDGVYA   299
              L    ENG+   VD +IWAIGR  N     LE T + L+ +G+I  D FENT+V+G+YA
Sbjct:  241   SLTLILENGEEYTVDTLIWAIGRAANTKGFNLEVTGVTLDSRGFIATDAFENTNVEGLYA   300

Query:  300   IGDVNGKIALTPVAIAAGRRLSERLFNHKDNEKLDYHNVPSVIFTHPVIGTVGLSEAAAI   359
              +GDVNGK+ LTPVA+ AGR+LSERLFNHK   K+DY +V +VIF+HPVIG++GLSE  A+
```

```
Sbjct:  301  LGDVNGKLELTPVAVKAGRQLSERLFNHKPQAKMDYKDVATVIFSHPVIGSIGLSEEVAL  360

Query:  360  EQFGEDNIKVYTSTFTSMYTAVTTNRQAVKNKLITLGKEEKVIGLHGVGYGIDEMIQGFS  419
             +Q+GE+N+ VY STFTSMYTAVT++RQA KMKL+T+G++EK++GLHG+GYG+DEMIQGF+
Sbjct:  361  DQYGEENVTVYRSTFTSMYTAVTSHRQACKMKLVTVGEDEKIVGLHGIGYGVDEMIQGFA  420

Query:  420  VAIKMGATKADFDDTVAIHPTGSEEFVTMR                              449
             VAIKMGATKADFD+TVAIHPTGSEEFVTMR
Sbjct:  421  VAIKMGATKADFDNTVAIHPTGSEEFVTMR                              450
```

A related DNA sequence was identified in *S. pyogenes* <SEQ ID 1875> which encodes the amino acid sequence <SEQ ID 1876>. Analysis of this protein sequence reveals the following:

---

Possible site: 23
>>> Seems to have no N-terminal signal sequence
INTEGRAL    Likelihood = −1.33    Transmembrane 173-189 (173-191)
----- Final Results -----
   bacterial membrane --- Certainty = 0.1532 (Affirmative) <succ>
   bacterial outside --- Certainty = 0.0000 (Not Clear) <succ>
   bacterial cytoplasm --- Certainty = 0.0000 (Not Clear) <succ>

---

An alignment of the GAS and GBS proteins is shown below:

Example 606

A DNA sequence (GBSx0646) was identified in *S. agalactiae* <SEQ ID 1877> which encodes the amino acid sequence <SEQ ID 1878>. Analysis of this protein sequence reveals the following:

---

Possible site: 35
>>> Seems to have no N-terminal signal sequence
----- Final Results -----
   bacterial cytoplasm --- Certainty = 0.3122 (Affirmative) <succ>
   bacterial membrane --- Certainty = 0.0000 (Not Clear) <succ>
   bacterial outside --- Certainty = 0.0000 (Not Clear) <succ>

---

The protein has homology with the following sequences in the GENPEPT database:

```
Identities = 268/446 (60%), Positives = 340/446 (76%), Gaps = 1/446 (0%)

Query:    5  YDYIVIGGGSAGSGTANRAAMYGAKVLLIEGGQVGGTCVNLGCVPKKIMWYGAQVSETLH   64
             YDYIVIGGGSAG  +ANRAAM+GAKVLL EG ++GGTCVNLGCVPKK+MWYGAQV++ L
Sbjct:    8  YDYIVIGGGSAGIASANRAAMHGAKVLLAEGKEIGGTCVNLGCVPKKVMWYGAQVADILG   67

Query:   65  KYSSGYGFEVNNLNFDFTTLKANRDAYVQRSRQSYAANFERNGVEKIDGFARFIDNHTIE  124
             Y+  YGF+    FDF LKANR AY+ R   SY    FE+NGV++I  +A F D HT+E
Sbjct:   68  TYAKDYGFDFKEKAFDFKQLKANRQAYIDRIHASYERGFEQNGVDRIYDYAVFKDAHTVE  127

Query:  125  VNGQQYKAPHITIATGGHPLYPDIIGSELGETSDDFFGWETLPDSILIVGAGYIAAELAG  184
             + GQ Y APHI IATGGHP++PDI G++ G +SD FF  + +P   +VGAGYIA ELAG
Sbjct:  128  IAGQLYTAPHILIATGGHPVFPDIEGAQYGISSDGFFALDEVPKRTAVVGAGYIAVELAG  187

Query:  185  VVNELGVETHLAFRKDHILRGFDDMVTSEVMAEMEKSGISLHANHVPKSLKRDEGGKLIF  244
             V++ LG +T L  R D  LR FD  +  ++ EM +G  LH +     +  ++    L
Sbjct:  188  VLHALGSKTDLFIRHDRPLRSFDKTIVDVLVDEMAVNGPRLHTHAEVAKVVKNTDESLTL  247

Query:  245  EAENGKTLVVDRVIWAIGRGPNVD-MGLENTDIVLNDKGYIKADEFENTSVDGVYAIGDV  303
             ++G+ + VD++IWAIGR PN++   L+ T +LNDKGYI+  D +ENTSV G+YA+GDV
Sbjct:  248  YLKDGQEVEVDQLIWAIGRKPNLEGFSLDKTGVTLNDKGYIETDAYENTSVKGIYAVGDV  307

Query:  304  NGKIALTPVAIAAGRRLSERLFNHKDNEKLDYHNVPSVIFTHPVIGTVGLSEAAAIEQFG  363
             NGK+ALTPVA+AAGRRLSERLFN K +EKLDY NV +VIF+HPVIG+VGLSE AA++Q+G
Sbjct:  308  NGKLALTPVAVAAGRRLSERLFNGKTDEKLDYQNVATVIFSHPVIGSVGLSEEAAVKQYG  367

Query:  364  EDNIKVYTSTFTSMYTAVTTNRQAVKMKLITLGKEEKVIGLHGVGYGIDEMIQGFSVAIK  423
             ++  +K Y S FTSM+TA+T +RQ   MKL+T+G  EK++GLHG+GYG+DEMIQGF+VAIK
Sbjct:  368  QEAVKTYQSRFTSMFTAITNHRQPCLMKLVTVGDTEKIVGLHGIGYGVDEMIQGFAVAIK  427

Query:  424  MGATKADFDDTVAIHPTGSEEFVTMR                                  449
             MGATKADFD+TVAIHPTGSEEFVTMR
Sbjct:  428  MGATKADFDNTVAIHPTGSEEFVTMR                                  453
```

SEQ ID 1874 (GBS417) was expressed in *E. coli* as a His-fusion product. SDS-PAGE analysis of total cell extract is shown in FIG. 79 (lane 5; MW 53 kDa).

GBS417-His was purified as shown in FIG. 216, lane 2.

Based on this analysis, it was predicted that these proteins and their epitopes could be useful antigens for vaccines or diagnostics.

```
>GP:AAC62417 GB:AF084104 hypothetical protein [Bacillus firmus]
Identities = 33/110 (30%), Positives = 66/110 (60%)
```

```
Query:   1  MANVYDLANELERAVRALPEYQAVLTAKSAIESDADAQVLWQDFLATQSKVQEMMQSGQM    60
            M+NVYD A+EL++A+       E+ A+ +    IE+D  A+ + ++F  Q ++Q+    G
Sbjct:   1  MSNVYDKAHELKKAIAESEEFSALKSMHEEIEADEIAKKMLENFRNLQLELQQKQMQGIQ    60

Query:  61  PSQEEQDEMSKLGEKIESNDLLKVYFDQQQRLSVYMSDIEKIVFAPMQDL             110
            ++EE  +  +  E ++ ++L+      + +QRLSV  + DI KI+  P++++
Sbjct:  61  ITEEEAQKAQQQFELVQQHELISKLMEAEQRLSVIIGDINKIITEPLEEI             110
```

A related DNA sequence was identified in *S. pyogenes* <SEQ ID 1879> which encodes the amino acid sequence <SEQ ID 1880>. Analysis of this protein sequence reveals the following:

Possible site: 38
>>> Seems to have no N-terminal signal sequence
----- Final Results -----
    bacterial cytoplasm --- Certainty = 0.4058 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below:

```
Identities = 68/108 (62%), Positives = 86/108 (78%)

Query:   4  VYDLANELERAVRALPEYQAVLTAKSAIESDADAQVLWQDFLATQSKVQEMMQSGQMPSQ   63
            +YD AN+LERAVRALPEYQ VL  K AI++D  A   L+ +F+A Q K+Q MMQSGQMP+
Sbjct:   5  IYDYANQLERAVRALPEYQKVLEVKEAIQADVSASELFDEFVAMQEKIQGMMQSGQMPTA   64

Query:  64  EEQDEMSKLGEKIESNDLLKVYFDQQQRLSVYMSDIEKIVFAPMQDLM              111
            EEQ  + +L +KIE+ND LK YF+ QQ LSVYMSDIE+IVFAP++DL+
Sbjct:  65  EEQTSIQELSQKIEANDQLKAYFEAQQALSVYMSDIERIVFAPLKDLV              112
```

Based on this analysis, it was predicted that these proteins and their epitopes could be useful antigens for vaccines or diagnostics.

<SEQ ID 1882>. This protein is predicted to be chorismate synthase (aroC). Analysis of this protein sequence reveals the following:

Possible site: 15
>>> Seems to have no N-terminal signal sequence
INTEGRAL   Likelihood = −4.67   Transmembrane 343-359 (341-364)
----- Final Results -----
    bacterial membrane --- Certainty = 0.2869 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database:

Example 607

A DNA sequence (GBSx0647) was identified in *S. agalactiae* <SEQ ID 1881> which encodes the amino acid sequence

```
>GP:BAB05375 GB:AP001512 chorismate synthase [Bacillus halodurans]
Identities = 227/381 (59%), Positives = 282/381 (73%), Gaps = 2/381 (0%)

Query:    1  MRYLTAGESHGPSLTAIIEGIPAGLKLSAKDINEDLKRRQGGYGRGNRMKIETDQVIISS   60
             MRYLTAGESHGP LT IIEG PA L+L A DIN DL RRQGG+GRG RM+IE DQV I
Sbjct:    1  MRYLTAGESHGPQLTTIIEGAPAQLELVADDINVDLARRQGGHGRGRRMQIEKDQVQIVG   60

Query:   61  GVRHGKTLGSPITLTVTNKDHSKWLDIMSVEDI--EERLKQKRRIKHPRPGHADLVGGIK  118
             G+RHGKT G+PI L V NKD    W   IM E + +E  + KR+I  PRPGHADL G IK
Sbjct:   61  GIRHGKTTGAPIALVVENKDWKHWTKIMGAEPLTGDEEKEIKRKITRPRPGHADLNGAIK  120

Query:  119  YRFDDLRNALERSSARETTMRVAIGAIAKRILKEIGIEIANHIVVFGGKEITVPDKLTVQ  178
             Y   D+RN LERSSARETT+RVA GA+AK+IL+   GIE+ +H++  GG +          +
Sbjct:  121  YGHRDMRNVLERSSARETTVRVAAGAVAKKILRTFGIEVGSHVLEIGGVKAEKTSYDQLS  180

Query:  179  QIKVLSSQSQVAIVNPSFEQEIKDYIDSVKKAGDTIGGVVETIVGGVPVGLGSYVHWDRK  238
             +K L+  S V  ++     EQE+    ID  K+ GD+IGGVVE IV GVP+GLGS+VH+DRK
Sbjct:  181  NLKELAEASPVRCLDKEAEQEMIAAIDQAKENGDSIGGVVEVIVEGVPIGLGSHVHYDRK  240

Query:  239  LDAKIAQAVVSINAFKGVEFGLGFKSGFLKGSQVMDSISWTKDQGYIRQSNNLGGFEGGM  298
             LDAKIA  AV+SINAFKGVEFG+GF++     GS+V D I+W +++GY R+SNNLGGFEGGM
Sbjct:  241  LDAKIAAAVMSINAFKGVEFGIGFEAASKPGSEVHDEIAWDEERGYYRKSNNLGGFEGGM  300

Query:  299  TNGEPIIVRGVMKPIPTLYKPLMSVDIDTHEPYRATVERSDPTALPAAGVVMEAVVATVL  358
             TNG PI+VRGVMKPIPTLYKPL SVDI T EP+ A++ERSD  A+PAA VV EAVVA  +
```

```
-continued
Sbjct:   301   TNGMPIVVRGVMKPIPTLYKPLQSVDIATKEPFAASIERSDSCAVPAAAVVAEAVVAWEV   360

Query:   359   VTEVLEKFSSDNMYELKEAVK                                          379
               +LE+F +D + E+++ ++
Sbjct:   361   ANALLERFGADQVEEIEKNIR                                          381
```

A related DNA sequence was identified in *S. pyogenes* <SEQ ID 1883> which encodes the amino acid sequence <SEQ ID 1884>. Analysis of this protein sequence reveals the following:

```
Possible site: 15
>>> Seems to have no N-terminal signal sequence
INTEGRAL     Likelihood = –0.75    Transmembrane 342-358 (342-359)
INTEGRAL     Likelihood = –0.16    Transmembrane 155-171 (155-171)
----- Final Results -----
    bacterial membrane --- Certainty = 0.1298 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the databases:

```
>GP:BAB05375 GB:AP001512 chorismate synthase [Bacillus halodurans]

Identities = 213/390 (54%), Positives = 277/390 (70%), Gaps = 2/390 (0%)

Query:     1   LRYLTAGESHGPSLTAIIEGIPAGLTLHPADIDHELQRRQGGYGRGARMSIETDRVQISS   60
               +RYLTAGESHGP LT IIEG PA L L    DI+ +L RRQGG+GRG RM IE D+VQI
Sbjct:     1   MRYLTAGESHGPQLTTIIEGAPAQLELVADDINVDLARRQGGHGRGRRMQIEKDQVQIVG   60

Query:    61   GVRHGKTTGAPITLTVINKDHQKWLDVMAVGDI--EETLKLKRRVKHPRPGHADLVGGIK   118
               G+RHGKTTGAPI L V NKD + W  +M   +  +E  ++KR++  PRPGHADL G IK
Sbjct:    61   GIRHGKTTGAPIALVVENKDWKHWTKIMGAEPLTGDEEKEIKRKITRPRPGHADLNGAIK   120

Query:   119   YHFNDLRDALERSSARETTMRVAVGAVAKRILAELGIDMLHHILIFGGITITIPSKLSFR   178
               Y    D+R+ LERSSARETT+RVA GAVAK+IL    GI++   H+L   GG+        S
Sbjct:   121   YGHRDMRNVLERSSARETTVRVAAGAVAKKILRTFGIEVGSHVLEIGGVKAEKTSYDQLS   180

Query:   179   ELQERALHSELSIVNPKQEEEIKTYIDKIKKEGDTIGGIIETIVQGVPAGLGSYVQWDKK   238
               +L+E A  S +  ++ + E+E+    ID+ K+ GD+IGG++E  IV+GVP GLGS+V +D+K
Sbjct:   181   NLKELAEASPVRCLDKEAEQEMIAAIDQAKENGDSIGGVVEVIVEGVPIGLGSHVHYDRK   240

Query:   239   LDAKLAQAVLSINAFKGVEFGAGFDMGFQKGSQVMDEITWTPTQGYGRQTNHLGGFEGGM   298
               LDAK+A  AV+SINAFKGVEFG GF+   + GS+V DEI W     +GY R++N+LGGFEGGM
Sbjct:   241   LDAKIAAAVMSINAFKGVEFGIGFEAASKPGSEVHDEIAWDEERGYYRKSNNLGGFEGGM   300

Query:   299   TTGQPLVVKGVMKPIPTLYKPLMSVDIDSHEPYKATVERSDPTALPAAGVIMENVVATVL   358
               T G P+VV+GVMKPIPTLYKPL SVDI + EP+ A++ERSD  A+PAA V+ E VVA +
Sbjct:   301   TNGMPIVVRGVMKPIPTLYKPLQSVDIATKEPFAASIERSDSCAVPAAAVVAEAVVAWEV   360

Query:   359   AKEILETFSSTTMSELQKAFSDYRAYVKQF                                 388
               A  +LE F +  + E++K   ++         + F
Sbjct:   361   ANALLERFGADQVEEIEKNIREFNEKARLF                                 390
```

An alignment of the GAS and GBS proteins is shown below:

```
Identities = 284/388 (73%), Positives = 333/388 (85%)

Query:    1  MRYLTAGESHGPSLTAIIEGIPAGLKLSAKDINEDLKRRQGGYGRGNRMKIETDQVIISS    60
             +RYLTAGESHGPSLTAIIEGIPAGL L   DI+ +L+RRQGGYGRG RM IETD+V ISS
Sbjct:    1  LRYLTAGESHGPSLTAIIEGIPAGLTLHPADIDHELQRRQGGYGRGARMSIETDRVQISS    60

Query:   61  GVRHGKTLGSPITLTVTNKDHSKWLDIMSVEDIEERLKQKRRIKHPRPGHADLVGGIKYR   120
             GVRHGKT G+PITLTV NKDH KWLD+M+V DIEE LK KRR+KHPRPGHADLVGGIKY
Sbjct:   61  GVRHGKTTGAPITLTVINKDHQKWLDVMAVGDIEETLKLKRRVKHPRPGHADLVGGIKYH   120

Query:  121  FDDLRNALERSSARETTMRVAIGAIAKRILKEIGIEIANHIVVFGGKEITVPDKLTVQQI   180
             F+DLR+ALERSSARETTMRVA+GA+AKRIL E+GI++ +HI++FGG  IT+P KL+ +++
Sbjct:  121  FNDLRDALERSSARETTMRVAVGAVAKRILAELGIDMLHHILIFGGITITIPSKLSFREL   180

Query:  181  KVLSSQSQVAIVNPSFEQEIKDYIDSVKKAGDTIGGVVETIVGGVPVGLGSYVHWDRKLD   240
             + + S+++IVNP E+EIK YID +KK GDTIGG++ETIV GVP GLGSYV WD+KLD
Sbjct:  181  QERALHSELSIVNPKQEEEIKTYIDKIKKEGDTIGGIIETIVQGVPAGLGSYVQWDKKLD   240

Query:  241  AKIAQAVVSINAFKGVEFGLGFKSGFLKGSQVMDSISWTKDQGYIRQSNNLGGFEGGMTN   300
             AK+AQAV+SINAFKGVEFG GF  GF KGSQVMD I+WT  QGY RQ+N+LGGFEGGMT
Sbjct:  241  AKLAQAVLSINAFKGVEFGAGFDMGFQKGSQVMDEITWTPTQGYGRQTNHLGGFEGGMTT   300

Query:  301  GEPIIVRGVMKPIPTLYKPLMSVDIDTHEPYRATVERSDPTALPAAGVVMEAVVATVLVT   360
             G+P++V+GVMKPIPTLYKPLMSVDID+HEPY+ATVERSDPTALPAAGV+ME VVATVL
Sbjct:  301  GQPLVVKGVMKPIPTLYKPLMSVDIDSHEPYKATVERSDPTALPAAGVIMENVVATVLAK   360

Query:  361  EVLEKFSSDNMYELKEAVKLYRNYVDHF                                   388
             E+LE FSS  M EL++A   YR YV  F
Sbjct:  361  EILETFSSTTMSELQKAFSDYRAYVKQF                                   388
```

A related GBS gene <SEQ ID 8617> and protein <SEQ ID 8618> were also identified. Analysis of this protein sequence reveals the following:

Lipop: Possible site: −1 Crend: 9
McG: Discrim Score: −2.42
GvH: Signal Score (−7.5): −3.23
Possible site: 15
>>> Seems to have no N-terminal signal sequence
ALOM program count: 1 value: −4.67 threshold: 0.0

-continued

INTEGRAL   Likelihood = −4.67   Transmembrane 343-359 (341-364)
PERIPHERAL Likelihood = 0.69    214
modified ALOM score: 1.43
*** Reasoning Step: 3
----- Final Results -----
  bacterial membrane --- Certainty = 0.2869 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
57.7/73.8% over 354aa
Bacillus subtilis
EGAD|20299| chorismate synthase Insert characterized
SP|P31104|AROC_BACSU CHORISMATE SYNTHASE (EC 4.6.1.4) (5-ENOLPYRUVYLSHIKIMATE-3-
PHOSPHATE PHOSPHOLYASE)
(VEGETATIVE PROTEIN 216) (VEG216). Edit characterized
GP|143806|gb|AAA20859.1||M80245 AroF Insert characterized
GP|2634689|emb|CAB14187.1||Z99115 chorismate synthase Insert characterized
PIR|C69590|C69590 chorismate synthase aroF - Insert characterized
ORF00121(301-1359 of 1719)
EGAD|20299|BS2267(1-355 of 368) chorismate synthase {Bacillus
subtilis}SP|P31104|AROC_BACSU CHORISMATE SYNTHASE (EC 4.6.1.4) (5-ENOLPYRUVYLSHIKIMATE-
3-PHOSPHATE PHOSPHOLYASE)(VEGETATIVE PROTEIN 216)(VEG216).GP|143806|gb|AAA20859.1||M80245
AroF {Bacillus subtilis}GP|2634689|emb|CAB14187.1||Z99115 chorismate synthase {Bacillus
subtilis}PIR|C69590|C69590 chorismate synthase aroF - Bacillus subtilis
% Match = 35.0
% Identity = 57.6 % Similarity = 73.7
Matches = 204 Mismatches = 92 Conservative Sub.s = 57

75        105       135       165       195       225       255       285
                IQLSRVAERKNLMPRGISQDIYNMCLKFGLPVHYAEWDKDVLFDILSHDKKASGQFIKIVILPQLGSATVHQIPLEEMRD 315       345       375       405       435       465       495       525
                YLEK*MRYLTAGESHGPSLTAIIEGIPAGLKLSAKDINEDLKRRQGGYGRGNRMKIETDQVIISSGVRHGKTLGSPITLT
                     ||||||||||| || ||||:|||  ::  :|||  :|  ||| :||  ||:||  ||  |  |||||  :||||| |
                     MRYLTAGESHGPQLTTIIEGVPAGLYITEEDINFELARRQKGHGRGRRMQIEKDQAKIMSGVRHARTLGSPIALV
                      10        20        30        40        50        60        70
```

```
555            609       639       669       699       729       759
VTNKDHSKWLDIMSVEDI--EERLKQKRRIKHPRPGHADLVGGIKYRFDDLRNALERSSARETTMRVAIGAIAKRILKEI
|||   |  ||    |   :|  : ||:|  |||||||||  | |||   |:|| |||||||||||:||| ||:||:|| |:
VENNDWKHWTKIMGAAPITEDEEKEMKRQISRPRPGHADLNGAIKYNHRDMRNVLERSSARETTVRVAAGAVAKKILSEL
              90        100       110       120       130       140       150

789            819       849       879       909       939       969       999
GIEIANHIVVFGGKEITVPDKLTVQQIKVLSSQSQVAIVNPSFEQEIKDYIDSVKKAGDTIGGVVETIVGGVPVGLGSYV
||::|  ||::    |  |     :::  ::  ::  :| |      |    |    ||:||||  ||    |  ||||
GIKVAGHVLQIGAVKAEKTGYTSIEDLQRVTEESPVRCYDEEAGKKMMAAIDEAKANGDSIGGIVEVIVEGMPVGVGSYV
              170       180       190       200       210       220       230

1029           1059      1089      1119      1149      1179      1209      1239
HWDRKLDAKIAQAVVSINAFKGVEFGLGFKSGFLKGSQVMDSISWTKDQGYIRQSNNLGGFEGGMTNGEPIIVRGVMKPI
|:|||||:|:|  ||:||||||||||:||::   ||:|  | |  :::||   :|  |||:||||   || :|||||||
HYDRKLDSKLAAAVLSINAFKGVEFGIGFEAAGRNGSEVHDEIIWDEEKGYTRATNRLGGLEGGMTTGMPIVVRGVMKPI
              250       260       270       280       290       300       310

1269           1299      1329      1359      1389      1419      1449      1479
PTLYKPLMSVDIDTHEPYRATVERSDPTALPAAGVVMEAVVATVLVTEVLEKFSSDNMYN*KKL*NYIAIMLIIFK*KLV
|||||||   ||||:|  ||:  |::|||||    |:|||  ||  ||:    |    :
PTLYKPLKSVDIETKEPFSASIERSDSCAVPAASVVAEALSLGKLQPSLNNSD
              330       340       350       360
```

SEQ ID 8618 (GBS192) was expressed in *E. coli* as a His-fusion product. SDS-PAGE analysis of total cell extract is shown in FIG. 18 (lane 4; MW 44 kDa).

GBS192-His was purified as shown in FIG. 196, lane 4.

Based on this analysis, it was predicted that these proteins and their epitopes could be useful antigens for vaccines or diagnostics.

Example 608

A DNA sequence (GBSx0648) was identified in *S. agalactiae* <SEQ ID 1885> which encodes the amino acid sequence <SEQ ID 1886>. This protein is predicted to be 3-dehydroquinate synthase (aroB). Analysis of this protein sequence reveals the following:

Possible site: 24

>>> Seems to have no N-terminal signal sequence

INTEGRAL    Likelihood = −3.82    Transmembrane 99-115 (98-116)

----- Final Results ----- bacterial membrane --- Certainty = 0.2529 (Affirmative) <succ> bacterial outside --- Certainty = 0.0000 (Not Clear) <succ> bacterial cytoplasm --- Certainty = 0.0000 (Not Clear) <succ>

The protein has homology with the following sequences in the GENPEPT database:

```
>GP:BAA18068 GB:D90911 3-dehydroquinate synthase [Synechocystis sp.]
Identities = 138/351 (39%), Positives = 200/351 (56%), Gaps = 4/351 (1%)

Query:     3 VEVDLPNHPYHIKIEEGCFSEAGDWVSHLWQKQMITIITDSNVEILYGESLVNQLKKQGF    62
             + V LP  PY ++I  G  +   D ++ L   + I ++++   +   YGE ++  L++ G+
Sbjct:     5 IPVPLPQSPYQVQIVPGGLAAIADHLAPLGLGKKIMVVSNPEIYDYYGEVVIQALQRAGY    64

Query:    63 TVHVFSFAAGEASKTLEVANRIYAFLAKHHMTRSDGIIALGGGVVGDLAAFVASTYMRGI   122
              V      AGE  KTL   N +Y   + ++ R+   +++LGGGV+GD+  F A+T++RGI
Sbjct:    65 EVFQHLIPAGETHKTLASINELYDVAFQANLERNSTLLSLGGGVIGDMTGFGAATWLRGI   124

Query:   123 HFLQIPTSLTAQVDSSIGGKTGVNTSFAKNMVGTFAQPDGVLIDPVTLKTLGNRELVEGM   182
             +F+Q+PTSL A VD+SIGGKTGVN     KN++G F QP  V IDPV LKTL  RE   GM
Sbjct:   125 NFVQVPTSLLAMVDASIGGKTGVNHPQGKNLIGAFYQPRLVYIDPVVLKTLPEREFRAGM   184

Query:   183 GEVIKYGLIDDIKLWHILEEMD--GTIDSILDNALA-IIYHSCQVKRKHVLADQYDKGLR   239
              EVIKYG+I D +L+  LEE +    +ID + D  L  II  SCQ K    V D+ + GLR
Sbjct:   185 AEVIKYGVIWDSELFTALEEAEDLSSIDRLPDELLTKIIQRSCQAKVDVVSQDEKEAGLR   244

Query:   240 MHLNFGHTIGHAIEVHAGYGEIMHGEAVAIGMIQLSRVAERKNLMPRGISQDIYNMCLKF   299
              LN+GHT+GH +E   GYG I HGEAVAIGM     +A   L      + +   +  LK
Sbjct:   245 AILNYGHTVGHGVESLTGYGVINHGEAVAIGMEAAAKIAHYLGLCDQSLGDRQRQLLLKT   304

Query:   300 GLPVHY-AEWDKDVLFDILSHDKKASGQFIKIVILPQLGSATVHQIPLEEM           349
                LP       +  L   L HDKK    +++      ++ +G T      +E+
Sbjct:   305 KLPTEMPPTLAVENLLASLLHDKKVKAGKVRFILPTAIGQVTISDAVTDEV           355
```

A related DNA sequence was identified in *S. pyogenes* <SEQ ID 1887> which encodes the amino acid sequence <SEQ ID 1888>. Analysis of this protein sequence reveals the following:

---

Possible site: 60
>>> Seems to have no N-terminal signal sequence
INTEGRAL    Likelihood = −0.43 (97-114) Transmembrane 97-113
----- Final Results -----
   bacterial membrane --- Certainty = 0.1171 (Affirmative) <succ>
      bacterial outside --- Certainty = 0.0000 (Not Clear) <succ>
         bacterial cytoplasm --- Certainty = 0.0000 (Not Clear) <succ>

---

The protein has homology with the following sequences in the databases:

```
>GP:BAA18068 GB:D90911 3-dehydroquinate synthase [Synechocystis sp.]
Identities = 123/349 (35%), Positives = 190/349 (54%), Gaps = 9/349 (2%)

Query:    1  MPQTLHVHSRVKDYDILFTDHVLKTLADCLGERKQ-RKLLFITDQTVYHLYQTLFEEFAQ    59
             M  T+ V      Y +       L  +AD L     +K++ +++  +Y  Y  +  + Q
Sbjct:    1  MATTIPVPLPQSPYQVQIVPGGLAAIADHLAPLGLGKKIMVVSNPEIYDYYGEVVIQALQ    60

Query:   60  Q--YNAFVHVCPPGGQSKSLERVSAIYDQLIAENFSKKDMIVTIGGGVVGDLGGFVAATY   117
             +   Y   F H+ P G     K+L  ++ +YD      N  +    ++++GGGV+GD+ GF AAT+
Sbjct:   61  RAGYEVFQHLIPAGETHKTLASINELYDVAFQANLERNSTLLSLGGGVIGDMTGFGAATW   120

Query:  118  YRGIPYIQIPTTLLSQVDSSIGGKVGVHFKGLTNMIGSIYPPEAIISTTFLETLPQREF   177
             RGI ++Q+PT+LL+ VD+SIGGK GV+      N+IG+ Y P  + I     L+TLP+REF
Sbjct:  121  LRGINFVQVPTSLLAMVDASIGGKTGVNHPQGKNLIGAFYQPRLVYIDPVVLKTLPEREF   180

Query:  178  SCGISEMLKIGFIHDRPLFQQLRDFQ-----KETDKQGLERLIYQSISNKKRIVEQDEFE   232
              G++E++K G I D  LF  L + +           + L ++I +S    K  +V QDE E
Sbjct:  181  RAGMAEVIKYGVIWDSELFTALEEAEDLSSIDRLPDELLTKIIQRSCQAKVDVVSQDEKE   240

Query:  233  NGLRMSLNFGHTLGHAIESLCHHDFYHHGEAIAIGMVVDAKLAVSKGLLPKEDLDSLLQV   292
              GLR  LN+GHT+GH +ESL  +     +HGEA+AIGM      AK+A   GL  +  D      Q+
Sbjct:  241  AGLRAILNYGHTVGHGVESLTGYVINHHGEAVAIGMEAAAKIAHYLGLCDQSLGDRQRQL   300

Query:  293  FERYQLPTTLERADVSATSLFDVFKTDKKNSEQHIIFILPTETGFTTLA             341
             +  +LPT +     ++   +L      DKK     + FILPT G   T++
Sbjct:  301  LLKTKLPTEMP-PTLAVENLLASLLHDKKVKAGKVRFILPTAIGQVTIS             348
```

An alignment of the GAS and GBS proteins is shown below:

```
Identities = 121/332 (36%), Positives = 182/332 (54%), Gaps = 7/332 (2%)
Query:   12  YHIKIEEGCFSEAGDWVSHLWQKQMITIITDSNVEILYGESLVNQLKKQGFTVHVFSFAA    71
             Y I  +       D +     Q++++   ITD V LY ++L  +  +Q  +      V
Sbjct:   14  YDILFTDHVLKTLADCLGERKQRKLL-FITDQTVYHLY-QTLFEEFAQQ-YNAFVHVCPP    70

Query:   72  GEASKTLEVANRIYAFLAKHHMTRSDGIIALGGGVVGDLAAFVASTYMRGIHFLQIPTSL   131
             G  SK+LE  + IY  L   + ++ D  I+  +GGGVVGDL  FVA+TY RGI ++QIPT+L
Sbjct:   71  GGQSKSLERVSAIYDQLIAENFSKKDMIVTIGGGVVGDLGGFVAATYYRGIPYIQIPTTL   130

Query:  132  TAQVDSSIGGKTGVNTSFAKNMVGTFAQPDGVLIDPVTLKTLGNRELVEGMGEVIKYGLI   191
             + QVDSSIGGK GV+        NM+G+      P+  ++I      L+TL  RE    G+  E++K G I
Sbjct:  131  LSQVDSSIGGKVGVHFKGLTNMIGSIYPPEAIISTTFLETLPQREFSCGISEMLKIGFI   190

Query:  192  DDIKLWHILEEMDGTIDSILDNALAIIYHSCQVKRKHVLADQYDKGLRMHLNFGHTIGHA   251
             D    L+     +    D         +IY S     K++  V  D+++  GLRM LNFGHT+GHA
Sbjct:  191  HDRPLFQQLRDFQKETDK--QGLERLIYQSISNKKRIVEQDEFENGLRMSLNFGHTLGHA   248

Query:  252  IEVHAGYGEIMHGEAVAIGMIQLSRVAERKNLMPRGISQDIYNMCLKFGPL--VHYAEWD   309
             IE    +    HGEA+AIGM+   +++A  K L+P+    +   +  ++ LP  +    A+
Sbjct:  249  IESLCHHDFYHHGEAIAIGMVVDAKLAVSKGLLPKEDLDSLLQVFERYQLPTTLERADVS   308

Query:  310  KDVLFDILSHDKKASGQFIKIVILPQLGSATV                              341
                LFD+    DKK S Q I  ++    +  G  T+
Sbjct:  309  ATSLFDVFKTDKKNSEQHIIFILPTETGFTTL                              340
```

Figure 62:
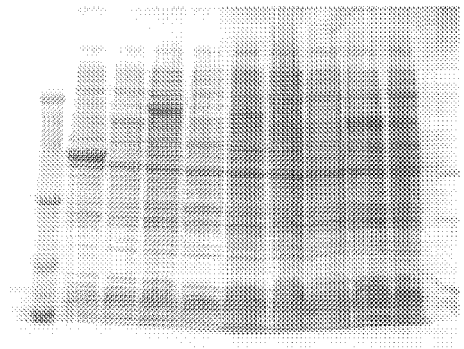

SEQ ID 1886 (GBS336) was expressed in *E. coli* as a His-fusion product. SDS-PAGE analysis of total cell extract is shown in FIG. 62 (lane 2; MW 42.7 kDa). It was also expressed in *E. coli* as a GST-fusion product. SDS-PAGE analysis of total cell extract is shown in FIG. 67 (lane 5; MW 68 kDa).

Figure 310:
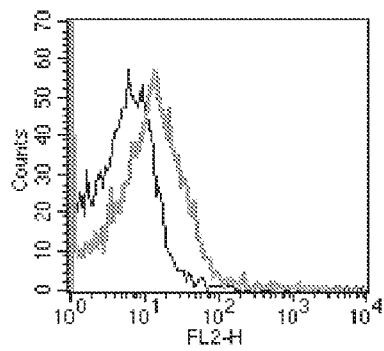

The GBS336-GST fusion product was purified (FIG. 209, lane 4) and used to immunise mice. The resulting antiserum was used for FACS (FIG. 310), which confirmed that the protein is immunoaccessible on GBS bacteria.

Based on this analysis, it was predicted that these proteins and their epitopes could be useful antigens for vaccines or diagnostics.

Example 609

A DNA sequence (GBSx0649) was identified in *S. agalactiae* <SEQ ID 1889> which encodes the amino acid sequence <SEQ ID 1890>. Analysis of this protein sequence reveals the following:

```
Possible site: 47
>>> Seems to have no N-terminal signal sequence
----- Final Results -----
   bacterial cytoplasm --- Certainty = 0.3884 (Affirmative) <succ>
   bacterial membrane --- Certainty = 0.0000 (Not Clear) <succ>
   bacterial outside --- Certainty = 0.0000 (Not Clear) <succ>
```

A related GBS nucleic acid sequence <SEQ ID 9973> which encodes amino acid sequence <SEQ ID 9974> was also identified.

The protein has homology with the following sequences in the GENPEPT database:

```
>GP: CAB14240 GB: Z99116 3-dehydroquinate dehydratase [Bacillus subtilis]
Identities = 70/233 (30%), Positives = 127/233 (54%), Gaps = 12/233 (5%)
Query:    2 KIVVPVMPRSLEEA-QEIDLSKFDSVDIIEWRADALPK----DDIINVAPAIFEKFAGHE   56
            KI++P+M ++ ++   E +  K  + DI+EWR D  K     + +  +    + +
Sbjct:   17 KIIIPLMGKTEKQILNEAEAVKLLNPDIVEWRVDVFEKANDREAVTKLISKLRKSLEDKL   76

Query:   57 IIFTLRTTREGGNIVLSDAEYVELIQKINSIYNPDYIDFEYFSHKEVFQEMLEFPN----  112
            +FT RT +EGG++ + ++ Y+ L++      + D  ID E FS     + ++
Sbjct:   77 FLFTFRTHKEGGSMEMDESSYLALLESAIQTKDIDLIDIELFSGDANVKALVSLAEENNV  136

Query:  113 -LVLSYHNFQETP--ENIMEIFSELTALAPRVVKIAVMPKNEQDVLDVMNYTRGFKTINP  169
             +V+S H+F++TP   + I+     ++  L   + K+AVMP +   D+L +++  T    KTI
Sbjct:  137 YVVMSNHDFEKTPVKDEIISRLRKMQDLGAHIPKMAVPNDTGDLLTLLDATYTMKTIYA   196

Query:  170 DQVYATVSMSKIGRISRFAGDVTGSSWTFAYLDSSIAPGQITISEMKRVKALL        222
            D+    T+SM+  G ISR +G+V GS+ TF   + + APGQI +SE++ V   +L
Sbjct:  197 DRPIITMSMAATGLISRLSGEVFGSACTFGAGEEASAPGQIPVSELRSVLDIL        249
```

A related DNA sequence was identified in *S. pyogenes* <SEQ ID 1891> which encodes the amino acid sequence <SEQ ID 1892>. Analysis of this protein sequence reveals the following:

```
Possible site: 17
>>> Seems to have no N-terminal signal sequence
----- Final Results -----
   bacterial cytoplasm --- Certainty = 0.3248 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below:

```
Identities = 160/225 (71%), Positives = 198/225 (87%)
Query:    1 MKIVVPVMPRSLEEAQEIDLSKFDSVDIIEWRADALPKDDIINVAPAIFEKFAGHEIIFT   60
            M+IV PVMPR  +EAQ ID+SK++ V++IEWRAD LPKD+I+ VAPAIFEKFAG EIIFT
Sbjct:    1 MRIVAPVMPRHFDEAQAIDISKYEDVNLIEWRADFLPKDEIVAVAPAIFEKFAGKEIIFT   60

Query:   61 LRTTREGGNIVLSDAEYVELIQKINSIYNPDYIDFEYFSHKEVFQEMLEFPNLVLSYHNF  120
            LRT +EGGNI LS   EYV++I++ IN+IYNPDYIDFEYF+HK VFQEML+FPNL+LSYHNF
Sbjct:   61 LRTVQEGGNITLSSQEYVDIIKEINAIYNPDYIDFEYFTHKSVFQEMLDFPNLILSYHNF  120

Query:  121 QETPENIMEIFSELTALAPRVVKIAVMPKNEQDVLDVMNYTRGFKTINPDQVYATVSMSK  180
            +ETPEN+ME FSE+T LAPRVVKIAVMP++EQDVLD+MNYTRGFKT+NP+Q  +AT+SM K
Sbjct:  121 EETPENLMEAFSEMTKLAPRVVKIAVMPQSEQDVLDLMNYTRGFKTLNPEQEFATISMGK  180

Query:  181 IGRISRFAGDVTGSSWTFAYLDSSIAPGQITISEMKRVKALLDAD                225
            +GR+SRFAGDV GSSWT+  LD     PGQ+T+++MKR+   +L+ D
Sbjct:  181 LGRLSRFAGDVIGSSWTYVSLDHVSGPGQVTLNDMKRIIEVLEMD                225
```

Based on this analysis, it was predicted that these proteins and their epitopes could be useful antigens for vaccines or diagnostics.

Example 610

A DNA sequence (GBSx0650) was identified in *S. agalactiae* <SEQ ID 1893> which encodes the amino acid sequence <SEQ ID 1894>. Analysis of this protein sequence reveals the following:

```
Possible site: 17
>>> Seems to have no N-terminal signal sequence
----- Final Results -----
   bacterial cytoplasm --- Certainty = 0.1195 (Affirmative) <succ>
```

-continued

```
   bacterial membrane --- Certainty = 0.0000 (Not Clear) <succ>
   bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 611

A DNA sequence (GBSx0651) was identified in *S. agalactiae* <SEQ ID 1895> which encodes the amino acid sequence <SEQ ID 1896>. Analysis of this protein sequence reveals the following:

```
Possible site: 41
>>> Seems to have no N-terminal signal sequence
----- Final Results -----
   bacterial cytoplasm --- Certainty = 0.3431 (Affirmative) <succ>
      bacterial membrane --- Certainty = 0.0000 (Not Clear) <succ>
      bacterial outside --- Certainty = 0.0000 (Not Clear) <succ>
```

The protein has homology with the following sequences in the GENPEPT database:

```
>GP: CAB15862 GB: Z99123 alternate gene name: ipa-19d-similar to
hypothetical proteins [Bacillus subtilis]
Identities = 161/396 (40%), Positives = 235/396 (58%), Gaps = 11/396 (2%)
Query:    1 MNKLKVNSVVERKIKSGAQLLEKKDFDTSLVNQ----LVQLFSQSN-QFLGMAYLSPQNK    55
            M  L +      KIK G  L+EK+        S +      LV + S+S  +FL  Y   QNK
Sbjct:    1 MKLLTLKKAHAAKIKKGYPLIEKEALAGSAGHMKEGDLVDIVSESGGEFLARGYYGLQNK    60

Query:   56 GIGWLLSRQVFD-FNHDYFVSLFEKSREKRQKFEKSSQTTAYRLFNQDGDNFGGLTIDFY   114
            G+GW L+R   +  +  +F+S   K+ + R K   ++  TTA+RLFN +GD  GG+TID+Y
Sbjct:   61 GVGWTLTRNKHEQIDQAFFLSKLTKAAQARAKLFEAQDTTAFRLFNGEGDGVGGVTIDYY   120

Query:  115 SDYALFSWYNEFVYTNRQMIVAAFKQVYPNIKGAYEKIRFKGLDF---ESAHLYGQEAPE   171
             Y L  WY++ +YT + M+++A  ++  + K  YEK RF         + G+
Sbjct:  121 DGYLLIQWYSKGIYTFKDMLISALDEMDLDYKAIYEKKRFDTAGQYVEDDDFVKGRRGEF   180

Query:  172 SFLILENNIKYSVFLNDGLMTGIFLDQHDVRKALATNLSEGKKVLNMFSYTAAFSVAAAV   231
              +I EN I+Y+V LN+G MTGIFLDQ  VRKA+     ++GK VLN FSYT AFSVAAA+
Sbjct:  181 PIIIQENGIQYAVDLNEGAMTGIFLDQRHVRKAIRDRYAKGKTVLNTFSYTGAFSVAAAL   240

Query:  232 GGALETTSVDLAKRSRELSKAHFDANQIVTDNHRFIVMDVFEYYKYAKRKHLSYDVIVID   291
            GGA +TTSVD+A RS +    F N++ + H   VMDVF Y+ YA +K L +D+I++D
Sbjct:  241 GGAEKTTSVDVANRSLAKTIEQFSVNKLDYEAHDIKVMDVFNYFSYAAKKDLRFDLIILD   300

Query:  292 PPSFARNKKQTFSVTKDYYKLIEQALDILTPGGTIIASTNAANLTVSQFKKQLEKGFGKA   351
            PPSFAR KK+TFS  KDY L+++ + I   G I+ASTN++    +FK  ++ F +
Sbjct:  301 PPSFARTKKRTFSAAKDYKNLLKETIAITADKGVIVASTNSSAFGMKKFKGFIDAAFKET   360

Query:  352 SHNYISLQQ--LPEDFTINDKDQQSNYLKVFTIKVK                         385
             +  Y +++   LPEDF       + NYLKV ++ K
Sbjct:  361 NERYTIIEEFTLPEDFKTISAFPEGNYLKVVLLQKK                         396
```

A related DNA sequence was identified in *S. pyogenes* <SEQ ID 1897> which encodes the amino acid sequence <SEQ ID 1898>. Analysis of this protein sequence reveals the following:

```
Possible site: 29
>>> Seems to have no N-terminal signal sequence
----- Final Results -----
   bacterial cytoplasm --- Certainty = 0.2699 (Affirmative) <succ>
      bacterial membrane --- Certainty = 0.0000 (Not Clear) <succ>
      bacterial outside --- Certainty = 0.0000 (Not Clear) <succ>
```

An alignment of the GAS and GBS proteins is shown below:

```
Identities = 259/386 (67%), Positives = 315/386 (81%), Gaps = 1/386 (0%)
Query:   1 MNKLKVNSVVERKIKSGAQLLEKKDFDT-SLVNQLVQLFSQSNQFLGMAYLSPQNKGIGW  59
           MNKL ++S VE+K+ +G QLL++KDF    NQLVQL ++SN+ +G AY+S QNKGIGW
Sbjct:   1 MNKLYIDSFVEKKLTAGVQLLDEKDFSNIKEKNQLVQLVTKSNRPIGTAYISKQNKGIGW  60

Query:  60 LLSRQVFDFNHDYFVSLFEKSREKRQKFEKSSQTTAYRLFNQDGDNFGGLTIDFYSDYAL 119
              L + D +  YFVSLF ++ KRQ F +S +T AYRLFNQ+GD FGG+TID Y D+A+
Sbjct:  61 YLGPEKIDLSISYFVSLFSVAKAKRQDFAQSDETNAYRLFNQEGDGFGGVTIDLYKDFAV 120

Query: 120 FSWYNEFVYTNRQMIVAAFKQVYPNIKGAYEKIRFKGLDFESAHLYGQEAPESFLILENN 179
           FSWYN FVY  ++MI+ AF+QV+P +KGAYEK RFKG D E+AHLYG+ A E+F ILEN
Sbjct: 121 FSWYNAFVYDKKEMIMEAFQQVFPEVKGAYEKCRFKGPDTETAHLYGELAQETFSILENG 180

Query: 180 IKYSVFLNDGLMTGIFLDQHDVRKALATNLSEGKKVLNMFSYTAAFSVAAAVGGALETTS 239
           I Y VFLN+GLMTGIFLDQHDVR+AL   L+ GK +LN+FSYTAAFSVAAA+GGA+ETTS
Sbjct: 181 IAYQVFLNEGLMTGIFLDQHDVRRALVDGLAMGKSLLNLFSYTAAFSVAAAMGGAIETTS 240

Query: 240 VDLAKRSRELSKAHFDANQIVTDNHRFIVMDVFEYYKYAKRKHLSYDVIVIDPPSFARNK 299
           VDLAKRSRELS AHF+ NQ+    +H F+VMDVFEY+KYAKRK L +DVIVIDPPSFARNK
Sbjct: 241 VDLAKRSRELSLAHFEHNQLNLASHHFVVMDVFEYFKYAKRKKLIFDVIVIDPPSFARNK 300

Query: 300 KQTFSVTKDYYKLIEQALDILTPGGTIIASTNAANLTVSQFKKQLEKGFGKASHNYISLQ 359
           KQTFSV++DY+KLI +ALDIL+P GTIIASTNAAN+TVSQFKKQ+  KGFG     ++LQ
Sbjct: 301 KQTFSVSRDYHKLITEALDILSPKGTIIASTNAANMTVSQFKKQIIKGFGSRRPESMTLQ 360

Query: 360 QLPEDFTINDKDQQSNYLKVFTIKVK                                   385
           QLP DFTIN D++SNYLKVFTIKV+
Sbjct: 361 QLPSDFTINKADERSNYLKVFTIKVR                                   386
```

Based on this analysis, it was predicted that these proteins and their epitopes could be useful antigens for vaccines or diagnostics.

Example 612

A DNA sequence (GBSx0652) was identified in *S. agalactiae* <SEQ ID 1899> which encodes the amino acid sequence <SEQ ID 1900>. This protein is predicted to be minimal change nephritis transmembrane glycoprotein. Analysis of this protein sequence reveals the following:

Possible site: 30
>>> Seems to have an uncleavable N-term signal seq
INTEGRAL    Likelihood = −6.85    Transmembrane 129-145 (126-152)

-continued

| | | |
|---|---|---|
| INTEGRAL | Likelihood = −4.88 | Transmembrane 48-64 (46-69) |
| INTEGRAL | Likelihood = −4.83 | Transmembrane 75-91 (74-97) |
| INTEGRAL | Likelihood = −4.62 | Transmembrane 16-32 (15-34) |
| INTEGRAL | Likelihood = −2.28 | Transmembrane 163-179 (163-182) |

----- Final Results ----- bacterial membrane --- Certainty = 0.3739 (Affirmative) <succ> bacterial outside --- Certainty = 0.0000 (Not Clear) <succ> bacterial cytoplasm --- Certainty = 0.0000 (Not Clear) <succ>

The protein has homology with the following sequences in the GENPEPT database:

```
>GP: CAB12545 GB: Z99107 alternate gene name: yetP-similar to
hypothetical proteins [Bacillus subtilis]
Identities = 299/676 (44%), Positives = 415/676 (61%), Gaps = 33/676 (4%)
Query:   2 KKIKDFASRAINTRLGFILLLVVIYWLKTIWAYHTDFNLGLENSYQLFLTIINPIPLGLL  61
           KK++     + ++L F +L V+++W KT  +Y T+FNLG++ + Q  L I NP   +
Sbjct:   9 KKVEVAMKKLFSYKLSFFVLAVILFWAKTYLSYKTEFNLGVKGTTQEILLIFNPFSSAVF  68

Query:  62 IIGLALYVKRTKAFYITAFITYAIVNILLIANAIYYREFSDFITVSAVLASSKTSAGLGD 121
            +GLAL  K  K+ I   I + ++   +L AN ++YR F DF+T    S      +GD
Sbjct:  69 FLGLALLAKGRKSAIIMLIIDF-LMTFVLYANILFYRFFDDFLTFPNIKQSGNVG-NMGD 126

Query: 122 SALNLLRIWDLVYVFDFIILIFLFATKKIHLDDRPFNKRASFSITALSGL-LFSINLFLA 180
             +++   D+ Y D IILI +     L +    KR +S+ LSG+ LF INL  A
Sbjct: 127 GIFSIMAGHDIFYFLDIIILIAVLIWRP-ELKEYKMKKRFA-SLVILSGIALFFINLHYA 184

Query: 181 EIDRPELLSRGFSNTYIVKALGLPSFSIYSGNQTYQAQKERNGATAQELATAKKYVAEHY 240
           E DRP+LL+R F   YIVK LGL +++IY G QT Q + +R  A++ +L + + Y   HY
Sbjct: 185 EKDRPQLLTRTFDRNYIVKYLGLYNYTIYDGVQTAQTETQRAYASSDDLTSVENYTTSHY 244

Query: 241 AKPNPEYYGIGKGRNVIMIHLESFQQFLIDYKLNIDGKEHVVTPFINSLYHSKETVS-FS 299
           AKPN EY+G   KG+N+I IHLESFQ FLIDYKLN  G+E   VTPF+N L H  E V+ F
Sbjct: 245 AKPNAEYFGSAKGKNIIKIHLESFQSFLIDYKLN--GEE--VTPFLNKLAHGGEDVTYFD 300

Query: 300 NFFHQVKAGKTSDAETLMENSLFGLSSGSFMVNYGGENTQFAAPHILAQNGGYSSAVFHG 359
           NFFHQ   GKTSDAE M+NS+FGL GS V   GENT +  P IL Q  GY+SAV HG
Sbjct: 301 NFFHQTGQGKTSDAELTMDNSIFGLPEGSAFVT-KGENTYQSLPAILDQKEGYTSAVLHG 359
```

```
Query:  360  NVGTFWNRNNAYKQWGYDYFFDSSYFSKQTKDNSFQYGLNDKYMFADSIKYLEHMQQPFY  419
             +  +FWNR+   YK GYD FFD+S +    + +N     GL DK  F +SI  LE ++QPFY
Sbjct:  360  DYKSFWNRDQIYKHIGYDKFFDASTYD-MSDENVINMGLKDKPFFTESIPKLESLKQPFY  418

Query:  420  TKFITVSNHYPYTSLKGESDEEGFPLAKTNDETINGYFATANYLDTALKSFFEYLKAAGV  479
               IT++NHYP+     +  +     A T D T++ YF TA YLD AL+ FF+ LK AG+
Sbjct:  419  AHLITLTNHYPFNL---DEKDASLKKATTGDNTVDSYFQTARYLDEALEQFFKELKEAGL  475

Query:  480  YDNSIIVMYGDHYGISNTRNPSLAELLGKDPETWSEYDNAMLQRVPYMIHIPGYSKGFIS  539
             YDNS+I++YGDH GIS    N  ++ E+LGK+       ++Y NA  QRVP MI +PG  KG ++
Sbjct:  476  YDNSVIMIYGDHNGISENHNRAMKEILGKE---ITDYQNAQNQRVPLMIRVPG-KKGGVN  531

Query:  540  NTYGGEVDNLPTLLHILGIDTSKYTQLGQDLLSKDNKQMVAMRTTGQYITPKYTNYSGHL  599
             +TYGGE+D +PTLLH+ GID+ KY    G DL SKD+    VA R   G  ++TPKYT+     +
Sbjct:  532  HTYGGEIDVMPTLLHLEGIDSQKYINFGTDLFSKDHDDTVAFR-NGDFVTPKYTSVDNII  590

Query:  600  YYTDSGQEITNPDETTKAEIKAIRDATNKQLSTSDSIQTGDLLRFDENNGLKTVEVEKFN  659
             Y T +G+++    +ET    K  ++      N+QLS SDS+    DLLRF + N  K V+     ++
Sbjct:  591  YDTKTGEKLKANEET-----KNLKTRVNQQLSLSDSVLYKDLLRFHKLNDFKAVDPSDYH  645

Query:  660  YTHSLKALKAKERKLK                                             675
             Y              KE+++K
Sbjct:  646  Y--------GKEKEIK                                             653
```

A related DNA sequence was identified in *S. pyogenes* <SEQ ID 1901> which encodes the amino acid sequence <SEQ ID 1902>. Analysis of this protein sequence reveals the following:

```
Possible site: 48
>>> Seems to have no N-terminal signal sequence
INTEGRAL    Likelihood = -6.85    Transmembrane 90-106 (88-112)
INTEGRAL    Likelihood = -5.68    Transmembrane 146-162 (139-165)
INTEGRAL    Likelihood = -4.99    Transmembrane 63-79 (60-84)
INTEGRAL    Likelihood = -3.98    Transmembrane 178-194 (176-197)
INTEGRAL    Likelihood = -0.59    Transmembrane 31-47 (31-47)
----- Final Results -----
    bacterial membrane --- Certainty = 0.3739 (Affirmative) <succ>
    bacterial outside --- Certainty = 0.0000 (Not Clear) <succ>
    bacterial cytoplasm --- Certainty = 0.0000 (Not Clear) <succ>
```

An alignment of the GAS and GBS proteins is shown below:

```
Identities = 533/713 (74%), Positives = 603/713 (83%)
Query:    1  MKKIKDFASRAINTRLGFILLLVVIYWLKTIWAYHTDFNLGLENSYQLFLTIINPIPLGL   60
             +KK K   +    INTRLGFI+ L+   YW+KT+WAYHTDF+L L N YQ+FLTIINPIPL
Sbjct:   16  VKKFKTLITGFINTRLGFIITLLFCYWIKTLWAYHTDFSLDLGNIYQVFLTIINPIPLAF   75

Query:   61  LIIGLALYVKRTKAFYITAFITYAIVNILLIANAIYYREFSDFITVSAVLASSKTSAGLG  120
             L++G+ALYVK T+AFYI +++  Y I+NILLI+N+IYYREFSDFITVSA+LASSK SAGLG
Sbjct:   76  LLLGVALYVKNTRAFYICSWVVYIILNILLISNSIYYREFSDFITVSAMLASSKVSAGLG  135

Query:  121  DSALNLLRIWDLVYVFDFIILIFLFATKKIHLDDRPFNKRASFSITALSGLLFSINLFLA  180
             DSALNLLRIWD++Y+ DFIILI L   KKI   D RPFNKRA+F+ITALS LL SINLFLA
Sbjct:  136  DSALNLLRIWDIIYILDFIILISLSIAKKIKNDQRPFNKRAAFAITALSSLLLSINLFLA  195

Query:  181  EIDRPELLSRGFSNTYIVKALGLPSFSIYSGNQTYQAQKERNGATAQELATAKKYVAEHY  240
             EIDRPELL+RGFSNTYIV+ALGLP+F++YSGNQTYQAQKERNGATA+EL   K YV  HY
Sbjct:  196  EIDRPELLTRGFSNTYIVRALGLPAFTLYSGNQTYQAQKERNGATAEELIDVKTYVKGHY  255

Query:  241  AKPNPEYYGIGKGRNVIMIHLESFQQFLIDYKLNIDGKEHVVTPFINSLYHSKETVSFSN  300
             A P+P+Y+GIGKG+N+I++HLESFQQFLIDYKL    KE+ VTPFINSLYHS  T++F N
Sbjct:  256  AAPDPQYFGIGKGKNIIVLHLESFQQFLIDYKLKEGDKEYEVTPFINSLYHSNATLAFPN  315

Query:  301  FFHQVKAGKTSDAETLMENSLFGLSSGSFMVNYGGENTQFAAPHILAQNGGYSSAVFHGN  360
             FFHQVKAGKTSDAET+MENSLFGL+SGSFMVNYGGENTQFA P  ILAQ GGY+SAVFHGN
Sbjct:  316  FFHQVKAGKTSDAETMMENSLFGLNSGSFMVNYGGENTQFATPSILAQKGGYTSAVFHGN  375

Query:  361  VGTFWNRNNAYKQWGYDYFFDSSYFSKQTKDNSFQYGLNDKYMFADSIKYLEHMQQPFYT  420
             VGTFWNRNNAYKQWGY+YFFDSSYFSKQ   NSFQYGLNDKYMF DSIKYLE MQQPFYT
Sbjct:  376  VGTFWNRNNAYKQWGYNYFFDSSYFSKQNSKNSFQYGLNDKYMFKDSIKYLEQMQQPFYT  435

Query:  421  KFITVSNHYPYTSLKGESDEEGFPLAKTNDETINGYFATANYLDTALKSFFEYLKAAGVY  480
             KFITVSNHYPYTSLKGES EEGFPLAKT+DETINGYFATANYLD ALKSFF+YLKA G+Y
Sbjct:  436  KFITVSNHYPYTSLKGESSEEGFPLAKTDDETINGYFATANYLDAALKSFFDYLKATGLY  495

Query:  481  DNSIIVMYGDHYGISNTRNPSLAELLGKDPETWSEYDNAMLQRVPYMIHIPGYSKGFISN  540
             DNSI V+YGDHYGISN+RN SLA LLGKD ETWSEYDNAMLQRVPYMIHIPGY+ G I
Sbjct:  496  DNSIFVLYGDHYGISNSRNSSLAPLLGKDSETWSEYDNAMLQRVPYMIHIPGYTNGSIKE  555

Query:  541  TYGGEVDNLPTLLHILGIDTSKYTQLGQDLLSKDNKQMVAMRTTGQYITPKYTNYSGHLY  600
             T+GGE+D LPTLLHILGIDTS++ QLGQDLLS  N Q+VA RT+G Y+TP+YTNYSG LY
```

```
                                    -continued
Sbjct:  556  TFGGEIDALPTLLHILGIDTSQFVQLGQDLLSPQNSQIVAQRTSGTYMTPEYTNYSGRLY  615

Query:  601  YTDSGQEITNPDETTKAEIKAIRDATNKQLSTSDSIQTGDLLRFDENNGLKTVEVEKFNY  660
                T +G EITNPDE T A+ K IR A  +QL+ SD+IQTGDLLRFD  NGLK ++  +F Y
Sbjct:  616  NTQTGLEITNPDEMTIAKTKEIRSAVAQQLAASDAIQTGDLLRFDTQNGLKAIDPNQFIY  675

Query:  661  THSLKALKAKERKLKDRSTSIYSKHNNKSTVDLFHAPSYLELQDPNKTHKTSK         713
                T  LK LK     KL    STS+YSK+ +KST LF APSYLEL        TS+
Sbjct:  676  TKQLKQLKDISAKLGSESTSLYSKNGHKSTQKLFKAPSYLELNPVEADAATSE         728
```

A related GBS gene <SEQ ID 8619> and protein <SEQ ID 8620> were also identified. Analysis of this protein sequence reveals the following:

Lipop Possible site: −1 Crend: 9
McG: Discrim Score: 12.63
GvH: Signal Score (−7.5): −2.99
Possible site: 30
>>> Seems to have an uncleavable N-term signal seq
ALOM program count: 5 value: −6.85 threshold: 0.0
INTEGRAL   Likelihood = −6.85   Transmembrane 129-145 (126-152)
INTEGRAL   Likelihood = −4.88   Transmembrane 48-64 (46-69)
INTEGRAL   Likelihood = −4.83   Transmembrane 75-91 (74-97)
INTEGRAL   Likelihood = −4.62   Transmembrane 16-32 (15-34)
INTEGRAL   Likelihood = −2.28   Transmembrane 163-179 (163-182)

-continued

PERIPHERAL   Likelihood = 3.76   103
modified ALOM score: 1.87
*** Reasoning Step: 3
----- Final Results -----
   bacterial membrane --- Certainty = 0.3739 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the databases:

```
45.2/63.1% over 643aa
Bacillus subtilis
EGAD|107893| hypothetical protein Insert characterized
GP|2116767|dbj|BAA20118.1||D86418 YfnI Insert characterized
GP|2633039|emb|CAB12545.1||Z99107 alternate gene name: yetP~similar to hypothetical
proteins Insert characterized
PIR|D69815|D69815 conserved hypothetical protein yfnI - Insert characterized
ORF00125(286-2280 of 2742)
EGAD|1078||| S0726(3-646 of 653) hypothetical protein { acillus subtilis} GP|2116767|dbj|
AA20118.1||D86418 YfnI { acillus subtilis} GP|2633039|emb|CA 12545.1||Z99107 alternate gene
name: yetP~similar to hypothetical proteins { acillus subtilis} PIR|D69815|D69815 conserved
hypothetical protein yfnI - acillus subtilis
% Match = 28.5
% Identity = 45.1 % Similarity = 63.1
Matches = 297 Mismatches = 227 Conservative Sub.s = 118

36          66          96         126         156         186         216         246
FVVKDRPSLRIDLTVKKVEPTG*LNWYQNLFFPVTEHLI*FFFQRQNSL*VYS*TVL*QIFIFFHTEFDLSLPYVTKFYV 276         306         336         366         396         426         456         486
II*SEILSLGKKLKEVPTVKKIKDFASRAINTRLGFILLLVVIYWLKTIWAYHTDFNLGLENSYQLFLTIINPIPLGLLI
                 :|:      ||::     :    :  :|  | :| |:::|   ||   :|  |:||||:: :  |   |    ||     ::
                 MNEELKVPKKVEVAMKKLFSYKLSFFVLAVILFWAKTYLSYKTEFNLGVKGTTQEILLIFNPFSSAVFF
                         10           20         30         40        50         60

516         546         576         606         636         666         696         726
IGLALYVKRTKAFYITAFITYAIVNILLIANAIYYREFSDFITVSAVLASSKTSAGLGDSALNLLRIWDLVYYFDFIILI
:||||   |   |:    |     |   : ::      :| ||  :::||   ||:|   :   |    :||   :::: :   |:    | : | ||||
LGLALLAKGRKSAIIMLIIDF-LMTFVLYANILFYRFFDDFLTFPNI-KQSGNVGMGDGIFSIMAGHDIFYFLDIIILI
       80          90         100        110        120       130        140

756         786             843         873        903       933         963
FLFATKKIHLDDRPFNKRASFSITALSGL-LFSINLFLAEIDRPELLSRGFSNTYIVKALGLPSFSIYSGNQTYQAQKER
     :    |   :     ||      |:    |||:   ||  |||      ||   ||||:|:|      ||||  |||    :::||     ||     : :|
-AVLIWRPELKEYKMKKR-FASLVILSGIALFFINLHYAEKDRPQLLTRTFDRNYIVKYLGLYNYTIYDGVQTAQTETQR
        160         170           180         190         200        210         220

993        1023        1053        1083        1113        1143       1173        1200
NGATAQELATAKKYVAEHYAKPNPEYYGIGKGRNVIMIHLESFQQFLIDYKLNIDGKEHVVTPFINSLYHSKETVS-FSN
|::  :|  :  :      |||||| ||:|    ||:|:|  ||||||| ||||||||                ||||:|  |      |:  |
AYASSDDLTSVENYTTSHYAKPNAEYFGSAKGKNIIKIHLESFQSFLIDYKLN----GEEVTPFLNKLAHGGEDVTYFDN
        240         250         260        270         280         290         300
```

```
1230      1260      1290      1320      1350      1380      1410      1440
FFHQVKAGKTSDAETLMENSLFGLSSGSFMVNYGGENTQFAAPHILAQNGGYSSAVFHGNVGTFWNRNNAYKQWGYDYFF
||||  |||||||   |:||:|||  ||  |   ||||  :  | ||  |   ||:|||:||:  :||||:  ||:  ||| ||
FFHQTGQGKTSDAELTMDNSIFGLPEGSAFVT-KGENTYQSLPAILDQKEGYTSAVLHGDYKSFWNRDQIYKHIGYDKFF
          320       330       340       350       360       370       380

1470      1500      1530      1560      1590      1620      1650      1680
DSSYFSKQTKDNSFQYGLNDKYMFADSIKYLEHMQQPFYTKFITVSNHYPYTSLKGESDEEGFPLAKTNDETINGYFATA
|:|    :  :|    ||  ||   |  :|| |   ::||||   |::||:    :|    |   |   :    | | |  |:: || ||
DAS-TYDMSDENVINMGLKDKPFFTESIPKLESLKQPFYAHLITLTNHYPF-NLD-EKDAS-LKKATTGDNTVDSYFQTA
      390       400       410       420       430       440       450

1710      1740      1770      1800      1830      1860      1890      1920
NYLDTALKSFFEYLKAAGVYDNSIIVMYGDHYGISNTRNPSLAELLGKDPETWSEYDNAMLQRVPYMIHIPGYSKGFISN
  |||  ||:  ||:  ||  ||:|||||:|::||||  |||    |  :: |:|||        ::|  ||   ||||  ||  :||   ||  :::
RYLDEALEQFFKELKEAGLYDNSVIMIYGDHNGISENHNRAMKEILGK---EITDYQNAQNQRVPLMIRVPG-KKGGVNH
      470       480       490       500       510       520       530

1950      1980      2010      2040      2070      2100      2130      2160
TYGGEVDNLPTLLHILGIDTSKYTQLGQDLLSKDNKQMVAMRTTGQYITPKYTNYSGHLYYTDSGQEITNPDETTKAEIK
|||||:|  :|||||:  |||:  ||   :|  ||:|||:    ||  |   |  ::||||||:       :|    |  :|:::            | |
TYGGEIDVMPTLLHLEGIDSQKYINFGTDLFSKDHDDTVAFR-NGDFVTPKYTSVDNIIYDTKTGEKL-----KANEETK
          550       560       570       580       590       600

2190      2220      2250      2280      2310      2340      2370      2400
AIRDATNKQLSTSDSIQTGDLLRFDENNGLKTVEVEKFNYTHSLKALKAKERKLKDRSTSIYSKHNNKSTVDLFHAPSYL
  ::    |:|||  |||:     |||||  :  |  :|  |:      ::|
NLKTRVNQQLSLSDDVLYKDLLRFHKLNDFKAVDPSDYHYGKEKEIK
620       630       640       650
```

Based on this analysis, it was predicted that these proteins and their epitopes could be useful antigens for vaccines or diagnostics.

Example 613

A DNA sequence (GBSx0653) was identified in *S. agalactiae* <SEQ ID 1903> which encodes the amino acid sequence <SEQ ID 1904>. This protein is predicted to be 50S ribosomal protein L20 (rp1T). Analysis of this protein sequence reveals the following:

Possible site: 37
>>> Seems to have no N-terminal signal sequence
----- Final Results -----
    bacterial cytoplasm --- Certainty = 0.3392 (Affirmative) <succ>
    bacterial membrane --- Certainty = 0.0000 (Not Clear) <succ>
       bacterial outside --- Certainty = 0.0000 (Not Clear) <succ>

A related GBS nucleic acid sequence <SEQ ID 9387> which encodes amino acid sequence <SEQ ID 9388> was also identified.

The protein has homology with the following sequences in the GENPEPT database:

A related DNA sequence was identified in *S. pyogenes* <SEQ ID 1905> which encodes the amino acid sequence <SEQ ID 1906>. Analysis of this protein sequence reveals the following:

Possible site: 27
>>> Seems to have no N-terminal signal sequence
INTEGRAL    Likelihood = –0.06    Transmembrane 94-110 (94-110)
----- Final Results -----
    bacterial membrane --- Certainty = 0.1022 (Affirmative) <succ>
       bacterial outside --- Certainty = 0.0000 (Not Clear) <succ>
       bacterial cytoplasm --- Certainty = 0.0000 (Not Clear) <succ>

An alignment of the GAS and GBS proteins is shown below:

```
>GP: CAB14845 GB:Z99118 ribosomal protein L20 [Bacillus subtilis]
Identities = 70/89 (78%), Positives = 78/89 (86%)

Query:   1 MFRTAKEQVMNSYYYAYRDRRQKKRDFRKLWITRINAAARMNGLSYSQLMHGLKLAEIEV    60
           +++ A +QVM S   YA+RDRRQKKRDFRKLWITRINAAARMNGLSYS+LMHGLKL+ IEV
Sbjct:  31 LYKVANQQVMKSGNYAFRDRRQKKRDFRKLWITRINAAARMNGLSYSRLMHGLKLSGIEV    90

Query:  61 NRKMLADLAVNDAAAFTALADAAKAKLGK                                 89
           NRKMLADLAVND  AF  LADAAKA+L K
Sbjct:  91 NRKMLADLAVNDLTAFNQLADAAKAQLNK                                119
```

```
Identities = 87/89 (97%), Positives = 88/89 (98%)
Query:   1 MFRTAKEQVMNSYYYAYRDRRQKKRDFRKLWITRINAAARMNGLSYSQLMHGLKLAEIEV   60
           +FRTAKEQVMNSYYYAYRDRRQKKRDFRKLWITRINAAARMNGLSYSQLMHGLKLAEIEV
Sbjct:  31 LFRTAKEQVMNSYYYAYRDRRQKKRDFRKLWITRINAAARMNGLSYSQLMHGLKLAEIEV   90

Query:  61 NRKMLADLAVNDAAAFTALADAAKAKLGK    89
           NRKMLADLAV DAAAFTALADAAKAKLGK
Sbjct:  91 NRKMLADLAVADAAAFTALADAAKAKLGK   119
```

Based on this analysis, it was predicted that these proteins and their epitopes could be useful antigens for vaccines or diagnostics.

Example 614

A DNA sequence (GBSx0654) was identified in *S. agalactiae* <SEQ ID 1907> which encodes the amino acid sequence <SEQ ID 1908>. Analysis of this protein sequence reveals the following:

```
Possible site: 21
>>> Seems to have an uncleavable N-term signal seq
INTEGRAL    Likelihood = -0.64    Transmembrane 32-48 (32-48)
INTEGRAL    Likelihood = -0.32    Transmembrane 3-19 (3-19)
----- Final Results -----
    bacterial membrane --- Certainty = 0.1256 (Affirmative) <succ>
    bacterial outside --- Certainty = 0.0000 (Not Clear) <succ>
        bacterial cytoplasm --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 615

A DNA sequence (GBSx0655) was identified in *S. agalactiae* <SEQ ID 1909> which encodes the amino acid sequence <SEQ ID 1910>. Analysis of this protein sequence reveals the following:

```
Possible site: 33
>>> Seems to have a cleavable N-term signal seq.
INTEGRAL    Likelihood = -12.63    Transmembrane 747-763 (743-772)
INTEGRAL    Likelihood = -12.52    Transmembrane 840-856 (835-856)
INTEGRAL    Likelihood = -11.20    Transmembrane 447-463 (440-466)
INTEGRAL    Likelihood = -5.79     Transmembrane 351-367 (346-372)
INTEGRAL    Likelihood = -4.25     Transmembrane 517-533 (516-537)
INTEGRAL    Likelihood = -1.49     Transmembrane 397-413 (396-413)
INTEGRAL    Likelihood = -0.96     Transmembrane 799-815 (799-817)
----- Final Results -----
    bacterial membrane --- Certainty = 0.6052 (Affirmative) <succ>
    bacterial outside --- Certainty = 0.0000 (Not Clear) <succ>
        bacterial cytoplasm --- Certainty = 0.0000 (Not Clear) <succ>
```

A related GBS nucleic acid sequence <SEQ ID 9349> which encodes amino acid sequence <SEQ ID 9350> was also identified.

The protein has homology with the following sequences in the GENPEPT database:

```
>GP: AAB89436 GB: AE000977 A. fulgidus predicted coding region AF1820
[Archaeoglobus fulgidus]
Identities = 100/483 (20%), Positives = 210/483 (42%), Gaps = 61/483 (12%)
Query:  351 LFPIILYLVAALVTLTTMTRFVEEERTNAGILKALGYSDRQVIFKFIIYGFIAGTLGTTL  410
            LFP      LV+  +T    ++R    + N  +++ALG++  +++  ++ Y  + G    +T
Sbjct:  276 LFPAFFILVSIFMTYALLSRIFRLQLGNIAVMRALGFTRNEIMLHYLQYPLLMGFFASTA  335

Query:  411 GIIGGHYLLPRIISDIISKDLTIPNTQYHLFLNYSLLAFVFSLLSIVLPVFVI-------  463
            G++  G +    + S  I+   L  +P          L    L+ +    L+ +   F++
Sbjct:  336 GLVAGFFASQLLTSQYIT-FLNLPYYVSKPHLEVYSLSLMAGTLTPTISGFLVAYQASRV  394

Query:  464 ----TRRELKEKAAFLLLPKPPAKGSKIALEYINWIWKKLSFTQKVTARNIFRYKQRMIM  519
                 R    E AA   + +   A   S+I          W    ++     ++ RNIFR K+R  +
Sbjct:  395 DIVKALRGYAEVAAVSFIARIDALFSRI------W---RMRLIFRLALRNIFRSKRRTAI  445

Query:  520 TIFGVAGSVALLFSGLGIQSSLKQTVNEHFGRIMPYDILLTYNTNASPPKILELLSKDSK  579
            +IF +    +L+ + +   S    +    FG++  YDI ++            E+L  K   K
Sbjct:  446 SIFSIVACTSLILNSMVFVDSFDYVMQLQFGKVYAYDIKVSLEGYDGK----EVLEKVRK  501

Query:  580 IDKY--------QPIHLENLDESIPGQINKQSISLFITDKKQLLPFIYLQEATTNKSLHL  631
            +D          PI++E   E++P        +L I      Q L  +Y  E             +
Sbjct:  502 MDGVLFAEPAVEMPIYVEKGGEAVP--------TLLIASNFQTLYNVYNAEG----EKLI  549

Query:  632 NNKGIIISKKLAQFYHVNTGDFIHL------SHSQTLPSRKLKITGVVNANVGHYIFMTK  685
            ++GII SK     +   + G+ + +                  ++       +  + V   A++
Sbjct:  550 PSEGIIFSKTAMKNLSLVEGEKVSVYTEFGKLEAEVEDVEMIPLLSVATASL--------  601

Query:  686 QYYRTIFKKEAKDNAFLVKLTKHKIANNLAEKLLEINGVESLTQNALQLASVEAVVRSLD  745
            Y+    I     +    N  +V      + +IA   +AEK+  +++GV+ ++             S+E  ++
Sbjct:  602 DYFSRISGVDG-FNRIVVDADEGRIA-EIAEKIRQMDGVKKVSTVIEAQESIEELMGFFY  659

Query:  746 GSMTILVVVSLLLAIVILYNLTNINLAERKRELSTIKVLGFYNEEVTLYIYRETIILSTI  805
            +     +     L        ++N  T+I++  ER REL+T+++ LG+  +  E+  +  +  E  ++ +
Sbjct:  660 AFIAFSLFFGVSLGFAAVFNTTSISVIERSRELATLRMLGYTSREIIISLILENLFVAIL  719
```

```
Query:  806  GVI                                                      808
             G++
Sbjct:  720  GLV                                                      722
```

A related DNA sequence was identified in *S. pyogenes* <SEQ ID 1911> which encodes the amino acid sequence <SEQ ID 1912>. Analysis of this protein sequence reveals the following:

```
Possible site: 34
>>> Seems to have no N-terminal signal sequence
INTEGRAL    Likelihood = -14.33   Transmembrane 749-765 (739-775)
INTEGRAL    Likelihood = -10.88   Transmembrane 845-861 (834-865)
INTEGRAL    Likelihood =  -6.64   Transmembrane 350-366 (344-369)
INTEGRAL    Likelihood =  -6.53   Transmembrane  22-38  (19-42)
INTEGRAL    Likelihood =  -6.32   Transmembrane 520-536 (515-537)
INTEGRAL    Likelihood =  -4.99   Transmembrane 446-462 (445-465)
INTEGRAL    Likelihood =  -2.92   Transmembrane 396-412 (395-413)
INTEGRAL    Likelihood =  -0.80   Transmembrane 800-816 (800-819)
----- Final Results -----
   bacterial membrane --- Certainty = 0.6731 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP: AAB89436 GB: AE000977 A. fulgidus predicted coding region AF1820
[Archaeoglobus fulgidus]
Identities = 101/542 (18%), Positives = 237/542 (43%), Gaps = 42/542 (7%)
Query:  350  IFPVVLYLVAALVAFTTMTRYVDEERTSSGLLKAIGYSNKDISLKFLIYGLLASFLGTTL  409
             +FP     LV+ + +  ++R    +   +++A+G++  +I L +L Y LL   F  +T
Sbjct:  276  LFPAFFILVSIFMTYALLSRIFRLQLGNIAVMRALGFTRNEIMLHYLQYPLLMGFFASTA  335

Query:  410  GIIGGTYLLSTLISEILTGA---LTIGKTHLYSYWFYNGIAYLLAMLSAVLPAYLIVKKE  466
             G++ G +    L S+ +T       + K HL Y         L    +S  L AY   + +
Sbjct:  336  GLVAGFFASQLLTSQYITFLNLPYYVSKPHLEVYSLSLMAGTLTPTISGFLVAYQASRVD  395

Query:  467  LFLN-------AAQLLLPKPPSKGAKIWLEHLTFVWKALSFTHKVTIRNIFRYKQRMLMT  519
             +          AA  + +  + ++IW   L F           ++ +RNIFR K+R ++
Sbjct:  396  IVKALRGYAEVAAVSFIARIDALFSRIWRMRLIF---------RLALRNIFRSKRRTAIS  446

Query:  520  IVGVAGSVALLFAGLGIQSSLAKVVEHQFGDLTTYDILAVGSAKATATEQTDLASYLKQE  579
             I +     +L+    +    S    V++ QFG + YDI             + L Y +E
Sbjct:  447  IFSIVACTSLILNSMVFVDSFDYVMQLQFGKVYAYDI------------KVSLEGYDGKE  494

Query:  580  PITGYQKVSYASLTLPVKGLP---DKQSISILSSS-ATSLSPYFNLLDSQEQKKVPIPTS  635
             +    +K+      P  +P   +P   +K   ++ +    A++      +N+ +++ +K   IP+
Sbjct:  495  VLEKVRKMDGVLFAEPAVEMPIYVEKGGEAVPTLLIASNFQTLYNVYNAEGEKL--IPSE  552

Query:  636  GVLISEKLASYYKVKPGDQLVLTDRKGQSYKVTIKQVIDMTVGHYLIMSDTYFKNHFKGL  695
             G++ S+         +  G+++ +      G+      ++ ++         L+   T  ++F  +
Sbjct:  553  GIIFSKTAMKNLSLVEGEKVSVYTEFGK-----LEAEVEDVEMIPLLSVATASLDYFSRI  607

Query:  696  EAAPAYLIKVKDKDSKHIKETASDLLTLKAIRAVSQNVNHIKSVQLVVTSLNQVMTLLVF  755
                    +  V D D    I E A   +  +  ++  VS +    +S++ ++         +   +F
Sbjct:  608  SGVDGFNRIVVDADEGRIAEIAEKIRQMDGVKKVSTVIEAQESIEELMGFFYAFIAFSLF  667

Query:  756  LSILLAIVILYNLTTINIAERIRELSTIKVLGFYDQEVTLYIYRETISLSLVGILLGIYL  815
                + L   ++N T+I++  ER  REL+T+++LG+  +E+ +    E  ++++G++    +  +
Sbjct:  668  FGVSLGFAAVFNTTSISVIERSRELATLRMLGYTSREIIISLILENLFVAILGLVFALPI  727

Query:  816  GKGLHTYIMTMISTGDIQFGVKVDAYVYLVPILVILSLLAVLGIWVNRHLKKVDMLEALK  875
                 +   +    + +         + +     +      +L + +++ +    R + ++D+ +   K
Sbjct:  728  AYSTAYFFFSSFESELYYMPMVIYPRTFAATVLAVFAIILLALLPSARRVSEMDIAKVTK  787

Query:  876  SI                                                           877
             I
Sbjct:  788  EI                                                           789
```

An alignment of the GAS and GBS proteins is shown below:

```
Identities = 377/857 (43%), Positives = 543/857 (62%), Gaps = 7/857 (0%)
Query:    3 KTFWKDIYRSITTSKGRFSSILLLMMLGSFAFIGLKVSAPNMQRTAQNYLAHHHVMDITV   62
            KT WKDI R+I  SKGRF S+  LM LGSFA +GLKV+ P+M+RTA  YL H VMD+TV
Sbjct:    4 KTLWKDILRAIKNSKGRFISLFFLMALGSFALVGLKVTGPDMERTASRYLERHQVMDLTV   63

Query:   63 FNSWGLDKHDQTVLESLKGSQVEFSYFVDTTPQQNSKSYRLYSNTKTISTFDLVKGRLPL  122
             S    + D+  L++LKG+ +E+ +  +D +   N KS RLYS  K +S    LVKG  P
Sbjct:   64 LASHQFSQADKQELDTLKGAHLEYGHLLDVSLTSNQKSLRLYSVPKKVSKPVLVKGSWPK  123

Query:  123 NKSEIALSFQERKKYAIGDKINFKQDKNKLFSNTGPLTIVGFVNSTEIWSKTNLGSSQTG  182
            ++++ LS      K Y IGD++         L + T     +VGF NS+E+WSK+NLGSS TG
Sbjct:  124 RETDLVLSSSLAKNYQIGDELAVTSPMEGLLTTTH-FQVVGFANSSEVWSKSNLGSSSTG  182

Query:  183 DGDLDSYGVLDKTAFHSPVYTMARVTFKDLRLINPFSISYKEKVAKYQEKVSRKLNIHNK  242
            DG L +Y ++    F S   + +R+ F  LRL N FS  Y+++V + Q +   L ++
Sbjct:  183 DGSLYAYAFVNPNVFKS-AFNLLRIRFSHLRLTNAFSKDYQKRVTQNQAHLDNLLKDNGQ  241

Query:  243 IRYTKTKKESLRKIDEEEKSLLKAQKQINRLDNDSLAMPLSQRQAIQMKIQDRLSLLKR  302
            RY  + +      +     +L K    ++    + +    S Q   +I+Q   +L K
Sbjct:  242 KRYDDLQNQYDLALKNGRAALAKETVKLAASEENLTFLEGSALQEAKHQIEQGKQALAKE  301

Query:  303 TKELLKLRHNTQIMESPQIIVYNRTTFPGGQGYNTFDSSTNSTSKISNLFPIILYLVAAL  362
            K+L +++       +E P   + YNR+T PGG+GY+T+  +ST  S S + N+FP++LYLVAAL
Sbjct:  302 EKQLEQVQATKDKLEKPSYLTYNRSTLPGGEGYHTYATSTTSISNVGNIFPVVLYLVAAL  361

Query:  363 VTLTTMTRFVEEERTNAGILKALGYSDRQVIFKFIIYGFIAGTLGTTLGIIGGHYLLPRI  422
            V  TTMTR+V+EERT++G+LKA+GYS++    KF+IYG +A  LGTTLGIIGG YLL +
Sbjct:  362 VAFTTMTRYVDEERTSSGLLKAIGYSNKDISLKFLIYGLLASFLGTTLGIIGGTYLLSTL  421

Query:  423 ISDIISKDLTIPNTQYHLFLNYSLLAFVFSLLSIVLPVFVITRRELKEKAAFLLLPKPPA  482
            IS+I++   LTI  T  + Y+ +A++ ++LS VLP ++ ++EL   AA LLLPKPP+
Sbjct:  422 ISEILTGALTIGKTHLYSYWFYNGIAYLLAMLSAVLPAYLIVKKELFLNAAQLLLPKPPS  481

Query:  483 KGSKIALEYINWIWKKLSFTQKVTARNIFRYKQRMIMTIFGVAGSVALLFSGLGIQSSLK  542
            KG+KI LE++ ++WK LSFT KVT RNIFRYKQRM+MTI GVAGSVALLF+GLGIQSSL
Sbjct:  482 KGAKIWLEHLTFVWKALSFTHKVTIRNIFRYKQRMLMTIVGVAGSVALLFAGLGIQSSLA  541

Query:  543 QTVNEHFGRIMPYDILLTYNTNASPPKILELLS--KDSKIDKYQPIHLENLDESIPGQIN  600
            + V   FG + YDIL  + A+  + +L S K   I YQ+     +L    + G  +
Sbjct:  542 KVVEHQFGDLTTYDILAVGSAKATATEQTDLASYLKQEPITGYQKVSYASLTLPVKGLPD  601

Query:  601 KQSISLFITDKKQLLPFIYLQEATTNKSLHLNNKGIIISKKLAQFYHVNTGDFIHLSHSQ  660
            KQSIS+ +     L P+  L ++     K +  +    G++IS+KLA +Y V  GD + L+ +
Sbjct:  602 KQSISILSSSATSLSPYFNLLDSQEQKKVPIPTSGVLISEKLASYYKVKPGDQLVLTDRK  661

Query:  661 TLPSRKLKITGVVNANVGHYIFMTKQYYRTIFKKEARDNAFLVKL--TKHKIANNIAEKL  718
                  S  K+ I  V++  VGHY+ M+    Y++   FK      A+L+K+      K    A L
Sbjct:  662 G-QSYKVTIKQVIDMTVGHYLIMSDTYFKNHFKGLEAAPAYLIKVKDKDSKHIKETASDL  720

Query:  719 LEINGVESLTQNALQLASVEAVVRSLDGSMTILVVVSLLLAIVILYNLTNINLAERKREL  778
            L +  + +++QN    + SV+ VV SL+  MT+LV  +S+LLAIVILYNLT IN+AER REL
Sbjct:  721 LTLKAIRAVSQNVNHIKSVQLVVTSLNQVMTLLVFLSILLAIVILYNLTTINIAERIREL  780

Query:  779 STIKVLGFYNEEVTLYIYRETIILSTIGVILGTISGTYLHRQMMLLIGSDQILFGEKVSP  838
            STIKVLGFY++EVTLYIYRETI LS +G++LG    G LH  +M +   I  FG KV
Sbjct:  781 STIKVLGFYDQEVTLYIYRETISLSLVGILLGIYLGKGLHTYIMTMISTGDIQFGVKVDA  840

Query:  839 TTFIIPISVVVIILXXL                                            855
            +++PI V++  +L  L
Sbjct:  841 YVYLVPILVILSLLAVL                                            857
```

Based on this analysis, it was predicted that these proteins and their epitopes could be useful antigens for vaccines or diagnostics.

Example 616

A DNA sequence (GBSx0656) was identified in *S. agalactiae* <SEQ ID 1913> which encodes the amino acid sequence <SEQ ID 1914>. This protein is predicted to be ABC transporter, ATP-binding protein. Analysis of this protein sequence reveals the following:

Possible site: 60

>>> Seems to have no N-terminal signal sequence

----- Final Results ----- bacterial cytoplasm --- Certainty = 0.2757 (Affirmative) <succ> bacterial membrane --- Certainty = 0.0000 (Not Clear) <succ> bacterial outside --- Certainty = 0.0000 (Not Clear) <succ>

The protein has homology with the following sequences in the GENPEPT database:

```
>GP: AAB89431 GB: AE000977 ABC transporter, ATP-binding protein
[Archaeoglobus fulgidus]
Identities = 112/230 (48%), Positives = 167/230 (71%)
Query:    4 IEMKHSYKRYQTGETEIVANNDISFSIERGELVVILGASGAGKSTVLNILGGMDSNSEGE   63
            + ++   +K YQ G+ E+ A    I+  IERGE +V+LG SG GK+T+LNI+GG+D  + G
Sbjct:    2 LRLEDVWKVWMGKVEVSALRGINLEIERGEFMVVLGPSGCGKTTMLNIIGGIDRPTRGR   61

Query:   64 VLIDGKNIANYTIRELTRYRRYDVGFVFQFYNLVPNLTALENVELASEIVPKALDAQQAL  123
            V+ DGK+I NY      LT +RR +VGF+FQF+NL+P LTA ENVE+A+++V    D  + L
Sbjct:   62 VIFDGKDITNYNEDRLTMHRRNNVGFIFQFFNLIPTLTARENVEIAADLVESPRDVDEVL  121

Query:  124 ENVGLGHRINHFPAQLSGGEQQRVAIARAIAKKPKLLLCDEPTGALDYQTGKQVLAILQK  183
            + VGL  R   HFPA+LSGGEQQRVAIARA+  K P ++L DEPTG+LD++TGK VL ++++
Sbjct:  122 KMVGLADRAEHFPAELSGGEQQRVAIARALVKNPPIILADEPTGSLDFETGKAVLKVMRE  181

Query:  184 MAQSKETTVIIVTHNTALAPIANRVIHMHDSKISDIVINENPSDIQNIEY           233
            + + +   T ++VTHN+A+A  IA+RV+++  D K+   +   N +P+D    I++
Sbjct:  182 INRKEGITFVLVTHNSAIAAIADRVVYLRDGKVERVERNLHPADPDEIQW          231
```

There is also homology to SEQ ID 1354.

Based on this analysis, it was predicted that this protein and its epitopes, could be useful antigens for vaccines or diagnostics.

Possible site: 34
>>> Seems to have no N-terminal signal sequence
----- Final Results -----
    bacterial cytoplasm --- Certainty = 0.4716 (Affirmative) <succ>
    bacterial membrane --- Certainty = 0.0000 (Not Clear) <succ>
    bacterial outside --- Certainty = 0.0000 (Not Clear) <succ>

Example 617

A DNA sequence (GBSx0657) was identified in *S. agalactiae* <SEQ ID 1915> which encodes the amino acid sequence <SEQ ID 1916>. This protein is predicted to be DNA topoisomerase I (topA). Analysis of this protein sequence reveals the following:

A related GBS nucleic acid sequence <SEQ ID 9821> which encodes amino acid sequence <SEQ ID 9822> was also identified.

The protein has homology with the following sequences in the GENPEPT database:

```
>GP: CAB13485 GB: Z99112 DNA topoisomerase I [Bacillus subtilis]
Identities = 442/690 (64%), Positives = 535/690 (77%), Gaps = 10/690 (1%)
Query:   27 LVIVESPAKAKTIEKYLGRNYKVVASVGHIRDLKKSSMSIDFENNYEPQYINIRGKGPLI   86
            LVIVESPAKAKTIE+YLG+ YKV AS+GH+RDL KS-M +D E N+EP+YI IRGKGP++
Sbjct:    5 LVIVESPAKAKTIERYLGKKYKVKASMGHVRDLPKSQMGVDIEQNFEPKYITIRGKGPVL   64

Query:   87 NDLKKEAKKAKKVYLASDPDREGEAISWHLAHILDLDKEDRNRVVFNEITKDAVKNAFVE  146
            +LK    AKKAKKVYLA+DPDREGEAI+WHLAH LDLD     RVVFNEITKDA+K +F
Sbjct:   65 KELKTAAKKAKKVYLAADPDREGEAIAWHLAHSLDLDLNSDCRVVFNEITKDAIKESFKH  124

Query:  147 PRQINMDLVDAQQARRVLDRIVGYSISPILWKKVKKGLSAGRVQSVALKLIIDRENEIKA  206
            PR INMDLVDAQQ ARR+LDR+VGY ISPILWKKVKKGLSAGRVQSVAL+LIIDRE EI
Sbjct:  125 PRMINMDLVDAQQQARRILDRLVGYKISPILWKKVKKGLSAGRVQSVALRLIIDREKEIND  184

Query:  207 FQPEEYWTIDGSFKKGTRKFNATFYGLDGKKFKLSNNEDVKTVLKRIKTDEFLVEKVEKK  266
            F+PEEYWTIDG+F KG    F A+F+G +GKK  L++   DVK +L ++K +++ VEKV KK
Sbjct:  185 FKPEEYWTIDGTFLKGQETFEASFFGKNGKKLPLNSEADVKEILSQLKGNQYTVEKVTKK  244

Query:  267 ERRRNAPLPYTTSSLQQDAANKINFRTRKTMMIAQQLYEGLSLGTAGHQGLITYMRTDST  326
            ER+RN  LP+TTS+LQQ+AA  K+NFR  +KTMMIAQQLYEG+  LG  G   GLITYMRTDST
Sbjct:  245 ERKRNPALPFTTSTLQQEAARKLNFRAKKTMMIAQQLYEGIDLGREGTVGLITYMRTDST  304

Query:  327 RISPLAQNEATEFITNRFGANYSKHGNK-VKNASGAQDAHEAIRPSSVNHTPESIAKYLD  385
            RIS A +EA FI  +G  +   K    K   AQDAHEAIRP+SV    P    +    L
Sbjct:  305 RISNTAVDEAAAFIDQTYGKEFLGGKRKPAKKNENAQDAHEAIRPTSVLRKPSELKAVLG  364

Query:  386 KDQLKLYTLIWNRFIASQMTAAVFDTMKVNLTQNGVTFIANGSQVKFDGYMAVYND----  441
            +DQ++LY LIW RF+ASQM  AV DTM V+LT NG+TF ANGS+VKF G+M VY +
Sbjct:  365 RDQMRLYKLIWERFVASQMAPAVLDTMSVDLTNNGLTFRANGSKVKFSGFMKVYVEGKDD  424

Query:  442 --TDKNKMLPDMEEGESVKKVNTNPEQHFTQPPARFSEASLIKTLEENGVGRPSTYAPTL  499
              +K++MLPD++EG++V  +   PEQHFTQPP R++EA L+KTLEE G+GRPSTYAPTL
Sbjct:  425 QMEEKDRMLPDLQEGDTVLSKDIEPEQHFTQPPPRYTEARLVKTLEERGIGRPSTYAPTL  484

Query:  500 ETIQKRYYVELAAKRFEPTELGEIVNSLIVEFFPDIVDVTFTAEMEGKLDEVEIGKEQWQ  559
            +TIQ+R YV L  KRF PTELG+IV  LI+EFFP+I++V FTA+ME  LD VE G  +W
Sbjct:  485 DTIQRRGYVALDNKRFVPTELGQIVLDLIMEFFPEIINVEFTAKMERDLDHVEEGNTEWV  544

Query:  560 KIIDEFYKPFEKELAKAETEMEKIQIKDEPAGFDCELCGSPMVIKLGRYGKFYACSNFPE  619
            KIID FY  FEK + KAE+EM++++I+ E AG DCELC SPMV K+GRYGKF ACSNFP+
```

```
-continued
Sbjct:  545  KIIDNFYTDFEKRVKKAESEMKEVEIEPEYAGEDCELCSSPMVYKMGRYGKFLACSNFPD  604

Query:  620  CHNTKAITKEIGVICPICQKGQVIERKTKRNRIFYGCDRYPECEFTSWDKPIGRTCPKSN  679
             C NTK I K+IGV CP C +G ++ERK+K+ R+FYGCDRYP+CEF SWDKPI R CPK
Sbjct:  605  CRNTKPIVKQIGVKCPSCGEGNIVERKSKKKRVFYGCDRYPDCEFVSWDKPIERKCPKCG  664

Query:  680  DFLVEKKVRGGGKQVVCSNEKCDYQEEKIK                                709
                 LVEKK++  G QV C    +CDY+EE  K
Sbjct:  665  KMLVEKKLK-KGIQVQC--VECDYKEEPQK                                691
```

A related DNA sequence was identified in *S. pyogenes* <SEQ ID 1917> which encodes the amino acid sequence <SEQ ID 1918>. Analysis of this protein sequence reveals the following:

---

Possible site: 35
>>> Seems to have no N-terminal signal sequence
----- Final Results -----
    bacterial cytoplasm --- Certainty = 0.5445 (Affirmative) <succ>
    bacterial membrane --- Certainty = 0.0000 (Not Clear) <succ>
       bacterial outside --- Certainty = 0.0000 (Not Clear) <succ>

---

An alignment of the GAS and GBS proteins is shown below:

```
Identities = 595/704 (84%), Positives = 656/704 (92%), Gaps = 1/704 (0%)
Query:    6  TTTKTSTKKTSKKKSATAKKNLVIVESPAKAKTIEKYLGRNYKVVASVGHIRDLKKSSMS   65
             T  KT TKK++ KK +TAKKNLVIVESPAKAKTIEKYLGR+YKVVASVGHIRDLKKSSMS
Sbjct:    7  TKPKTGTKKSTTKKKSTAKKNLVIVESPAKAKTIEKYLGRSYKVVASVGHIRDLKKSSMS   66

Query:   66  IDFENNYEPQYINIRGKGPLINDLKKEAKKAKKVYLASDPDREGEAISWHLAHILDLDKE  125
             IDF+NNYEPQYINIRGKGPLIN LKKEAK AKKVYLASDPDREGEAISWHL+HIL LD +
Sbjct:   67  IDFDNNYEPQYINIRGKGPLINSLKKEAKAAKKVYLASDPDREGEAISWHLSHILGLDPQ  126

Query:  126  DRNRVVFNEITKDAVKNAFVEPRQINMDLVDAQQARRVLDRIVGYSISPILWKKVKKGLS  185
             D NRVVFNEITKDAVK+AFVEPRQI+MDLVD+QQARRVLDRIVGYSISPILWKKVKKGLS
Sbjct:  127  DNNRVVFNEITKDAVKHAFVEPRQIDMDLVDSQQARRVLDRIVGYSISPILWKKVKKGLS  186

Query:  186  AGRVQSVALKLIIDRENEIKAFQPEEYWTIDGSFKKGTRKFNATFYGLDKKFKLSNNED   245
             AGRVQSVALKLIIDREN+IKAF P+EYW+IDG FKKGT+KF ATFYG++GKK KL NN D
Sbjct:  187  AGRVQSVALKLIIDRENDIKAFVPKEYWSIDGLFKKGTKKFQATFYGINGKKTKLDNNND  246

Query:  246  VKTVLKRIKTDEFLVEKVEKKERRRNAPLPYTTSSLQQDAANKINFRTRKTMMIAQQLYE  305
             VK VL ++  ++FLV KV+KKERRRNAPLPYTTSSLQQDAANKINFRTRKTMM+AQQLYE
Sbjct:  247  VKEVLAKLTNEDFLVSKVDKKERRRNAPLPYTTSSLQQDAANKINFRTRKTMMVAQQLYE  306

Query:  306  GLSLGTAGHQGLITYMRTDSTRISPLAQNEATEFITNRFGANYSKHGNKVKNASGAQDAH  365
             G+ LG  G QGLITYMRTDSTRISP+AQN+A  +FI NRFGANYSKHGN+VKN SG QDAH
Sbjct:  307  GIHLGENGTQGLITYMRTDSTRISPVAQNDAAQFIINRFGANYSKHGNRVKNTSGVQDAH  366

Query:  366  EAIRPSSVNHTPESIAKYLDKDQLKLYTLIWNRFIASQMTAAVFDTMKVNLIQNGVTFIA  425
             EAIRPSSVNHTP+SIAKYL+KDQLKLYTLIWNRF+ASQMTAAVFDT+KVNL QNGV F+A
Sbjct:  367  EAIRPSSVNHTPDSIAKYLNKDQLKLYTLIWNRFVASQMTAAVFDTVKVNLEQNGVIFVA  426

Query:  426  NGSQVKFDGYMAVYNDTDKNKMLPDMEEGESVKKVNTNPEQHFTQPPARFSEASLIKTLE  485
             NGSQ+KFDGYMAVYND+DKNKMLP+M EGE+VKK++T+PEQHFTQPPAR+SEA+LIKTLE
Sbjct:  427  NGSQMKFDGYMAVYNDSDKNKMLPEMAEGETVKKISTSPEQHFTQPPARYSEATLIKTLE  486

Query:  486  ENGVGRPSTYAPTLETIQKRYYVKLAAKRFEPTELGEIVNSLIVEFFPDIVDVTFTAEME  545
             ENGVGRPSTYAPTLE IQ+RYYVKL+AKRFEPTELGEIVN LIVEFFPDIVDV FTAEME
Sbjct:  487  ENGVGRPSTYAPTLEVIQRRYYVKLSAKRFEPTELGEIVNKLIVEFFPDIVDVAFTAEME  546

Query:  546  GKLDEVEIGKEQWQKIIDEFYKPFEKELAKAETEMEKIQIKDEPAGFDCELCGSPMVIKL  605
             GKLD+VEIG+EQWQ +ID+FY PF KEL KAE+E+EKIQIKDEPAGFDC++CG PMVIKL
Sbjct:  547  GKLDQVEIGEEQWQHVIDQFYQPFVKELNKAESEIEKIQIKDEPAGFDCDVCGHPMVIKL  606

Query:  606  GRYGKFYACSNFPECHNTKAITKEIGVICPICQKGQVIERKTKRNRIFYGCDRYPECEFT  665
             GR+GKFYACSNFPEC NTKAITKEIGV CP+C KGQVIERKTK+NRIFYGCD+YP+CEF
Sbjct:  607  GRFGKFYACSNFPECRNTKAITKEIGVTCPVCHKGQVIERKKNRIFYGCDQYPDCEFI    666

Query:  666  SWDKPIGRTCPKSNDFLVEKKVRGGGKQVVCSNEKCDYQEEKIK                  709
             SWD PIGR CPKS D+L+EKKVR GGKQV+CSNE CDY+EEKIK
Sbjct:  667  SWDLPIGRACPKSGDYLIEKKVR-GGKQVMCSNETCDYKEEKIK                  709
```

Based on this analysis, it was predicted that these proteins and their epitopes could be useful antigens for vaccines or diagnostics.

Example 618

A DNA sequence (GBSx0658) was identified in *S. agalactiae* <SEQ ID 1919> which encodes the amino acid sequence <SEQ ID 1920>. Analysis of this protein sequence reveals the following:

Possible site: 43
>>> Seems to have no N-terminal signal sequence
----- Final Results -----
   bacterial cytoplasm --- Certainty = 0.2578 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database:

```
>GP:AAD35341 GB:AE001708 DNA processing chain A [Thermotoga maritima]
Identities = 97/231 (41%), Positives = 149/231 (63%), Gaps = 2/231 (0%)
Query:  51 FIENYKQLDLKKLRQEFKKFPV--LSILDSNYPLELKEIYNPPVLLFYQGNIELLSKPKL 108
           F+E    + +L++ ++   +K   V   +S  + +YP   L+EI   PP +LF +G+ ELL +   +
Sbjct:  41 FLEKCGKEELERQKELIRKHNVKLVSFWEDDYPQHLREIRYPPAVLFVRGDAELLKEKCV 100

Query: 109 AVVGARQASQIGCQSVKKIIKETNNQFVIVSGLARGIDTAAHVSALKNGGSSIAVIGSGL 168
             VVG R+  +   G     K+ +K   +   FVIVSG+A GID+ AH  AL +GG ++AV+G+G+
Sbjct: 101 GVVGTRRPTSYGVNVTKRFVKLLSEYFVIVSGMAFGIDSVAHKEALSSGGKTVAVLGTGV 160

Query: 169 DVYYPTENKKLQEYMSYNHLVLSEYFTGEQPLKFHFPERNRIIAGLCQGIVVAEAKMRSG 228
           DV YP  N++L   +   N  V+SEY  G +   K HFP RNRIIAGL    I+V EA ++SG
Sbjct: 161 DVVYPRSNERLFHEIVKNGCVVSEYPMGTRARKHHFPARNRIIAGLSDAIIVTEAPIKSG 220

Query: 229 SLITCERALEEGREVFAIPGNIIDGKSDGCHHLIQEGAKCIISGKDILSEY          279
           +LIT + ALE GR+VFA+PG+I    S+G ++LI+ GA  +   +D+ + +
Sbjct: 221 ALITVKFALESGRDVFAVPGDIDRKTSEGTNYLIKSGAYPLTDEEDLETHF          271
```

A related DNA sequence was identified in *S. pyogenes* <SEQ ID 1921> which encodes the amino acid sequence <SEQ ID 1922>. Analysis of this protein sequence reveals the following:

Possible site: 50
>>> Seems to have no N-terminal signal sequence
----- Final Results -----
   bacterial cytoplasm --- Certainty = 0.2856 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below:

Based on this analysis, it was predicted that these proteins and their epitopes could be useful antigens for vaccines or diagnostics.

Example 619

A DNA sequence (GBSx0659) was identified in *S. agalactiae* <SEQ ID 1923> which encodes the amino acid sequence <SEQ ID 1924>. This protein is predicted to be lipoprotein (ceuE). Analysis of this protein sequence reveals the following:

Possible site: 24
>>> Seems to have a cleavable N-term signal seq.
----- Final Results -----
   bacterial outside --- Certainty = 0.3000 (Affirmative) <succ>
   bacterial membrane --- Certainty = 0.0000 (Not Clear) <succ>
   bacterial cytoplasm --- Certainty = 0.0000 (Not Clear) <succ>

```
Identities = 185/279 (66%), Positives = 238/279 (84%), Gaps = 1/279 (0%)

Query:   1 MNHFELFKLKKAGLTNLNIHNIINYLKKNSLTSLSVRNMAVVSKCKNPTFFIENYKQLDL   60
           +NHFEL+KLKKAGLTN NI NI++Y +K+    SLS+R+MAVVS CK+P+ FIE YKQLD+
Sbjct:   1 VNHFELYKLKKAGLTNKNILNILDY-QKHQEKSLSLRDMAVVSGCKHPSHFIEAYKQLDI   59

Query:  61 KKLRQEFKKFPVLSILDSNYPLELKEIYNPPVLLFYQGNIELLSKPKLAVVGARQASQIG  120
            + L+  EFK+FP  +SILD +YP+  LKEIYNPPVLLF+QGN++LL KPKLA+VG+R++S  G
Sbjct:  60 QNLKMEFKQFPSISILDKHYPMALKEIYNPPVLLFFQGNLDLLEKPKLAIVGSRRSSDTG  119

Query: 121 CQSVKKIIKETNNQFVIVSGLARGIDTAAHVSALKNGGSSIAVIGSGLDVYYPTENKKLQ  180
            +SV+KI+KE   N+FVIVSGLARGIDT+AH++  LKNGG +IA+IG+GLD +YP EN++LQ
Sbjct: 120 VKSVRKILKELGNRFVIVSGLARGIDTSAHLACLKNGGQTIAIIGTGLDRFYPKENRELQ  179

Query: 181 EYMSYNHLVLSEYFTGEQPLKFHFPERNRIIAGLCQGIVVAEAKMRSGSLITCERALEEG  240
            ++   NHLVL+EY  GE+ L  +HFPERNRIIAGL +GI+V EAK RSGSLITC+    +EEG
Sbjct: 180 TFLGKNHLVLTEYGPGREALSYHFPERNRIIAGLSRGILVVEAKNRSGSLITCQIGIEEG  239

Query: 241 REVFAIPGNIIDGKSDGCHHLIQEGAKCIISGKDILSEY                       279
           R++FA+PGNI+DGKS+GC   LI+EGA C+  SG DILSEY
Sbjct: 240 RDIFAVPGNILDGKSEGCLQLIKEGATCVTSGMDILSEY                       278
```

The protein has homology with the following sequences in the GENPEPT database:

```
>GP:CAA06500 GB:AJ005352 lipoprotein [Staphylococcus aureus]
Identities = 122/348 (35%), Positives = 201/348 (57%), Gaps = 16/348 (4%)
Query:   1 MTKKLIIAILALCTILTTSQAVLAKEKSQ--------TVTIKNNYSVYIKKEKRDKPDNK   52
           M K ++  +LA+  +L      KE+S+         TV I+NNY +  + EK+D  D K
Sbjct:   1 MKKTVLYLVLAVMFLLAACGNNSDKEQSKSETKGSKDTVKIENNYKM--RGEKKDGSDAK   58

Query:  53 KQISETLKVPLKPKKVVVFDMGALDTITALGAEKSVIGIPKAKNALSLLPNNVKSVYKAK  112
           K + ET++VP  P+  VV D GALD +  +G     V +PK +   SL PN ++S +K
Sbjct:  59 K-VKETVEVPKNPENAVVLDYGALDVMKEMGLSDKVKALPKGEGGKSL-PNFLES-FKDD  115

Query: 113 RYQDVGSLFEPNFEAIARMQPDVVFLGARMASVDNIEKLKEAAPKAALVYAGVDSKKVFD  172
           +Y +VG+L E NF+ IA  +P+V+F+  R A+  N+++ K+AAPKA +VY G D K +
Sbjct: 116 KYTNVGNLKEVNFDKIAATKPEVIFISGRTANQKNLDEFKKAAPKAKIVYVGADEKNLIG  175

Query: 173 KGVAERVTMLGKIFDQNKKAKTFNKDIAQAVLKLQKTIEKKGKPTALFVMANSGELLTQS  232
             + +     +GKI+D+  KAK  NKD+   +  ++    +   K T ++++ N GEL T
Sbjct: 176 S-MKQNTENIGKIYDKEVKAKELNKDLDNKIASMKDKTKNFNK-TVMYLLVNEGELSTFG  233

Query: 233 PSGRFGW-IFSVGGFKAVNENEKLSSHGTPVSYEYIAEKNPNYLFVLDRGATIGQGASSK  291
           P GRFG  ++    GF AV++      S+HG  VS EY+ ++NP+ +  +DRG  +  +++K
Sbjct: 234 PKGRFGGLVYDTLGFNAVDKKVSNSNHGQNVSNEYVNKENPDVILAMDRGQAVSGKSTAK  293

Query: 292 ELFNNDVIKATDAVKNKRVHEVDGKDWYINSGGSRVTLRMIKDVQNFV              339
           +  NN V+K    A+K  +V+ +D K WY  +G + T++ I+++  V
Sbjct: 294 QALNNPVLKNVKAIKEDKVYNLDPKLWYFAAGSTTTTIKQIEELDKVV              341
```

A related DNA sequence was identified in *S. pyogenes* <SEQ ID 1925> which encodes the amino acid sequence <SEQ ID 1926>. Analysis of this protein sequence reveals the following:

Possible site: 32
>>> May be a lipoprotein
----- Final Results -----
   bacterial membrane --- Certainty = 0.0000 (Not Clear) <succ>
    bacterial outside --- Certainty = 0.0000 (Not Clear) <succ>
      bacterial cytoplasm --- Certainty = 0.0000 (Not Clear) <succ>

An alignment of the GAS and GBS proteins is shown below:

```
Identities = 57/255 (22%), Positives = 104/255 (40%), Gaps = 30/255 (11%)
Query:  66 KKVVVFDMGALDTITALGAEKSVIGIPKAKNALSLLPNNVKSVYKAKRYQDVGSLFEPNF  125
           +++V  + +D    L + ++G+ +K  L LP   +V +      VG     P+
Sbjct:  45 QRIVATSVAVVDICDRLNLD--LVGVCDSK--LYTLPKRYDAVKR------VGLPMNPDI   94

Query: 126 EAIARMQPDVVFLGARMASVDNIEKLKEAAPKAALVYAGVDSKKVEDKGVAERVTMLGKI  185
           E IA ++P +  +      E L+    K      Y ++ + V  +G+ + +   LG +
Sbjct:  95 ELIASLKPTWILSPNSLQ-----EDLEPKYQKLDTEYGFLNLRSV--EGMYQSIDDLGNL  147

Query: 186 FDQNKKAKTFNKDIAQAVLKLQKTIEKKGKPTALFVMANSGELLTQSPSGRFGWIFSVGG  245
           F + ++AK  +        Q   + K KP L +M   G L  +     G +    + G
Sbjct: 148 FQRQQEAKELRQQYQDYYRAFQAKRKGKKKPKVLILMGLPGSYLVATNQSYVGNLLDLAG  207

Query: 246 FKAV---NENEKLSSHGTPVSYEYIAEKNPNYLFVLDRGATIGQGAS---SKELFNNDVI  299
           + V    +E E LS++       E +   K P+     +L   I        KE  ND+
Sbjct: 208 GENVYQSDEKEFLSANP-----EDMLAKEPD--LILRTAHAIPDKVKVMFDKEFAENDIW  260

Query: 300 KATDAVKNKRVHEVD                                              314
           K   AVK  +V+++D
Sbjct: 261 KHFTAVKEGKVYDLD                                              275
```

Figure 39:
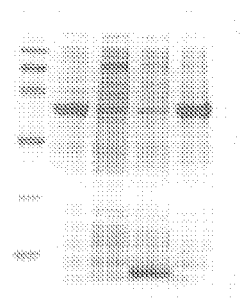

SEQ ID 1924 (GBS181) was expressed in *E. coli* as a His-fusion product. SDS-PAGE analysis of total cell extract is shown in FIG. 39 (lane 5; MW 38.7 kDa). It was also expressed in *E. coli* as a GST-fusion product. SDS-PAGE analysis of total cell extract is shown in FIG. 46 (lane 3; MW 64 kDa).

Figure 299:
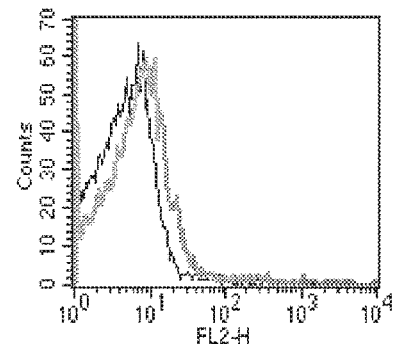

The GBS181-GST fusion product was purified (FIG. 204, lane 9) and used to immunise mice. The resulting antiserum was used for FACS (FIG. 299), which confirmed that the protein is immunoaccessible on GBS bacteria.

Based on this analysis, it was predicted that these proteins and their epitopes could be useful antigens for vaccines or diagnostics.

Example 620

A DNA sequence (GBSx0660) was identified in *S. agalactiae* <SEQ ID 1927> which encodes the amino acid sequence <SEQ ID 1928>. This protein is predicted to be iron(III) ABC transporter, ATP-binding protein. Analysis of this protein sequence reveals the following:

Possible site: 40
>>> Seems to have no N-terminal signal sequence

-continued

----- Final Results -----
   bacterial cytoplasm --- Certainty = 0.3231 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database:

```
>GP:CAB12190 GB:Z99106 similar to ferrichrome ABC transporter
(ATP-binding protein) [Bacillus subtilis]
Identities = 125/247 (50%), Positives = 187/247 (75%)
Query:   1  MIQINNLHKFYGQKEILKDINISIPKGKVTAILGPNGSGKSTLLSCISRLEPYDNGEIFL   60
            M+++ N+ K YG K +L++ +++I KGK+T+ +GPNG+GKSTLLS +SRL   D+GEI++
Sbjct:   1  MVEVRNVSKQYGGKVVLEETSVTIQKGKITSFIGPNGAGKSTLLSIMSRLIKKDSGEIYI   60

Query:  61  DKVPLAHYSSNDLAKTLAILRQSNHLTLKIKVRDLIGFGRFPYSKGRLSQKDKAVIESVI  120
            D    +   S +LAK ++IL+Q+N + +++ ++DL+ FGRFPYS+GRL+++D   I   +
Sbjct:  61  DGQEIGACDSKELAKKMSILKQANQINIRLTIKDLVSFGRFPYSQGRLTEEDWVHINQAL  120

Query: 121  SYMDLNDIADEFINNLSGGQIQRAFIAMTMAQDTQYICLDEPLNNLDMKYAVQMMDLIKR  180
            SYM L DI D++++ LSGGQ QRAFIAM +AQDT YI LDEPLNNLDMK++V++M L+KR
Sbjct: 121  SYMKLEDIQDKYLDQLSGGQCQRAFIAMVIAQDTDYIFLDEPLNNLDMKHSVEIMKLLKR  180

Query: 181  YAYEFNKTIVIIIHDINFATHYADNVVALKEGQVVTCGTVEDVMQEKILSHLFDMPIRIE  240
                 E   KTIVI+IHDINFA+ Y+D +VALK G++V  G  E++++  +L  ++DM I  I+
Sbjct: 181  LVEELGKTIVIVIHDINFASVYSDYIVALKNGRIVKEGPPEEMIETSVLEEIYDMTIPIQ  240

Query: 241  TVDGKPI                                                      247
            T+D + I
Sbjct: 241  TIDNQRI                                                      247
```

There is also homology to SEQ ID 1930.

Based on this analysis, it was predicted that this protein and its epitopes, could be useful antigens for vaccines or diagnostics.

Example 621

A DNA sequence (GBSx0661) was identified in *S. agalactiae* <SEQ ID 1931> which encodes the amino acid sequence <SEQ ID 1932>. Analysis of this protein sequence reveals the following:

Possible site: 33
>>> Seems to have a cleavable N-term signal seq.
INTEGRAL    Likelihood = −12.74   Transmembrane 271-287 (266-295)
INTEGRAL    Likelihood = −8.55    Transmembrane 49-65 (47-69)

-continued

| INTEGRAL | Likelihood = −8.07 | Transmembrane 185-201 (178-207) |
| INTEGRAL | Likelihood = −7.70 | Transmembrane 112-128 (105-132) |
| INTEGRAL | Likelihood = −7.38 | Transmembrane 231-247 (227-261) |
| INTEGRAL | Likelihood = −2.50 | Transmembrane 139-155 (135-156) |
| INTEGRAL | Likelihood = −1.97 | Transmembrane 302-318 (301-319) |

----- Final Results ----- bacterial membrane --- Certainty = 0.6095 (Affirmative) <succ> bacterial outside --- Certainty = 0.0000 (Not Clear) <succ> bacterial cytoplasm --- Certainty = 0.0000 (Not Clear) <succ>

The protein has homology with the following sequences in the GENPEPT database:

```
>GP:CAB12189 GB:Z99106 similar to ferrichrome ABC transporter
(permease) [Bacillus subtilis]
Identities = 138/315 (43%), Positives = 222/315 (69%), Gaps = 6/315 (1%)
Query:   9  KLLILLILLIAAIILFLIYGIPTDANEFLIIYILKTRYQKLIALILVGICIGSSSLIFQT   68
            K+ +L+ L I   I LFL Y +          Y L  R +K+ A++L G  I   S++IFQT
Sbjct:   6  KIALLVGLAIVCIGLFLFYDLGNWD------YTLPRRIKKVAAIVLTGGAIAFSTMIFQT   59

Query:  69  LTNNRLLTPSIIGLDSLYILIQTGLMYLIGAQRVIKFSSFSSFLLSLLLMVGFAYLLFTI  128
            +TNNR+LTPSI+GLDSLY+LIQTG+++L G+  ++     +F++S+LLM+ F+ +L+ I
Sbjct:  60  ITNNRILTPSILGLDSLYMLIQTGIIFLFGSANMVIMNKNINFIISVLLMILFSLVLYQI  119

Query: 129  LFRNKKQSLYFVLLAGLIFNTLFSSISSFIQAIMDPNDFMILQNQLFASFNAINTKILWI  188
            +F+ + ++++F+LL G++F TLFSS+SSF+Q ++DPN+F ++Q+++FASFN  INT +LW+
Sbjct: 120  MFKGEGRNIFFLLLIGIVFGTLFSSLSSFMQMLIDPNEFQVVQDKMFASFNNINTDLLWL  179

Query: 189  SFIIVVSFVINWPFIKELDVLLLGKENAISLGISYQKLTTRFFLWLALMVAIATALVGP  248
            +FII +++ V  W F K   DVL LG+E+A++LGI Y K+   +  +A++V+++TALVGP
Sbjct: 180  AFIIFLLTGVYVWRFTKFFDVLSLGREHAVNLGIDYDKVVKQMLIVVAILSVSTALVGP  239

Query: 249  ITFLGLLVAHITYHSFHTFRHQILVPIAIVICIFTLVLGQHLVQNLLHLTVQLSVLLNLI  308
            I  FGLLV ++        T++H L+    ++  I I  LV GQ +V+ +     + LSV++N
Sbjct: 240  IMFLGLLVVNLAREFLKTYKHSYLIAGSVFISIIALVGGQFVVEKVFTFSTTLSVIINFA  299

Query: 309  GGSYFIFTLIKGRKN                                              323
            GG YFI+ L+K  K+
Sbjct: 300  GGIYFIYLLLKENKS                                              314
```

A related DNA sequence was identified in *S. pyogenes* <SEQ ID 1933> which encodes the amino acid sequence <SEQ ID 1934>. Analysis of this protein sequence reveals the following:

```
Possible site: 58
>>> Seems to have no N-terminal signal sequence
INTEGRAL    Likelihood = -13.64   Transmembrane 33-49 (26-61)
INTEGRAL    Likelihood = -8.97    Transmembrane 259-275 (246-286)
INTEGRAL    Likelihood = -8.65    Transmembrane 293-312 (294-316)
INTEGRAL    Likelihood = -8.39    Transmembrane 83-99 (78-104)
INTEGRAL    Likelihood = -6.26    Transmembrane 212-228 (210-231)
INTEGRAL    Likelihood = -4.04    Transmembrane 113-129 (110-132)
INTEGRAL    Likelihood = -3.61    Transmembrane 140-156 (134-157)
INTEGRAL    Likelihood = -2.71    Transmembrane 165-181 (165-181)
INTEGRAL    Likelihood = -1.06    Transmembrane 327-343 (327-343)
INTEGRAL    Likelihood = -0.22    Transmembrane 50-66 (50-66)
----- Final Results -----
    bacterial membrane --- Certainty = 0.6456 (Affirmative) <succ>
    bacterial outside --- Certainty = 0.0000 (Not Clear) <succ>
        bacterial cytoplasm --- Certainty = 0.0000 (Not Clear) <succ>
```

A related sequence was also identified in GAS <SEQ ID 9175> which encodes the amino acid sequence <SEQ ID 9176>. Analysis of this protein sequence reveals the following:

```
Possible site: 49
>>> Seems to have no N-terminal signalsequence
INTEGRAL    Likelihood = -13.64   Transmembrane 24-40 (17-52)
INTEGRAL    Likelihood = -8.97    Transmembrane 250-266 (237-277)
INTEGRAL    Likelihood = -8.65    Transmembrane 287-303 (285-307)
INTEGRAL    Likelihood = -8.39    Transmembrane 74-90 (69-95)
INTEGRAL    Likelihood = -6.26    Transmembrane 203-219 (201-222)
INTEGRAL    Likelihood = -4.04    Transmembrane 104-120 (101-123)
INTEGRAL    Likelihood = -3.61    Transmembrane 131-147 (125-148)
INTEGRAL    Likelihood = -2.71    Transmembrane 156-172 (156-172)
INTEGRAL    Likelihood = -1.06    Transmembrane 318-334 (318-334)
INTEGRAL    Likelihood = -0.22    Transmembrane 41-57 (41-57)
----- Final Results -----
    bacterial membrane --- Certainty = 0.646 (Affirmative) <succ>
    bacterial outside --- Certainty = 0.0000 (Not Clear) <succ>
        bacterial cytoplasm --- Certainty = 0.0000 (Not Clear) <succ>
```

An alignment of the GAS and GBS proteins is shown below:

```
Identities = 80/326 (24%), Positives = 157/326 (47%), Gaps = 34/326 (10%)
Query:  10 LLILLILLIAAIILFLIYGIPTDANEFL----------IIYILKTRYQKLIALILVGICI   59
           +L++L LL  A+I   + G+          +         +  I   R+ +++  +L G  I
Sbjct:  34 VLLILSLLFLAVIALSLGGLAVSYGAIVKGLFVAYDPQVALIYDLRFPRIVIALLAGAGI   93

Query:  60 GSSSLIFQTLTNNRLLTPSIIGL---DSLYILIQTGLMYLIGAQRVIKFSSFSSFL---L   113
             S ++FQ +  N +  P+IIG+     S  +L+ + L+     +++ +    SFL      +
Sbjct:  94 AVSGVLFQAVLKNPISDPAIIGICSGASFMVLVSSLLL-----PQLLLYGPIVSFLGGGV   148

Query: 114 SLLLMVGFAYLLFTILFRNKKQSLYFVLLAGLIFNTLFSSISSFIQAIMDPNDFMILQNQ   173
           S LL+  G A+          K  +   ++L G+   N LF  +S+ + +          M+   N
Sbjct: 149 SFLLIYGLAW--------KKGLNPIRLILTGIAINALFMGLSTALTSFFTSASPMV--NA   198

Query: 174 LFASFNAINTKI-LWISFIIIVVSFVINWPFIKELDVLLLGKENAISLGISYQKLTTRFF   232
           L A   +  T   + +F    + ++       K  ++LLL   +      LGI         L
Sbjct: 199 LLAGHISQKTWADVGVLFPYTFIGLLLALLLSKTCNLLLLDDQVIRHLGIDATALRLGIS   258

Query: 233 LWLALMVAIATALVGPITFLGLLVAHITYHSFHTFRHQILVPIAIVICIFTLVLGQHLVQ   292
           L    L+ ++AT++VG  ++FLGL+V  H++       +  +HQIL+P  +  ++    F   +L     L  +
Sbjct: 259 LVAVLLASVATSIVGVVSFLGLIVPHMSRLLVGS-KHQILIPFSALLGAFVFLLADTLGR   317

Query: 293 NLLH-LTVQLSVLLNLIGGSYFIFTL                                      317
           +L +  L    +  ++++++++GG YFI+  L
Sbjct: 318 SLAYPLEISPAIIMSIVGGPYFIYLL                                      343
```

A related DNA sequence was identified in *S. pyogenes* <SEQ ID 2491> which encodes amino acid sequence <SEQ ID 2492>. An alignment of the GAS and GBS sequences follows:

```
Score = 51.9 bits (122), Expect = 5e-08
Identities = 73/327 (22%), Positives = 137/327 (41%), Gaps = 38/327 (11%)
Query: 494 IISSLGTAISTVAQGIGTGLAIAFRGLGAAIAMVPPTTWLALGTAILMVGAAFALAGTQA   553
           +I  L T   +   G   L IA  +GA + +V      A+       L++ A
Sbjct: 573 VILGLVTTAVMMLLGAIAPLVIAIGAIGAPVGIVVAAIVGAIAVITLIIQAIMNWGA---   629

Query: 554 DGISQILRTIGDXXXXXXXXXXTDSLATLLTIIANAIGSMLPIVAGAISQIVG-------A   606
           I++ L++   D             ++ T  T      A +         ++G      S  +V              +
Sbjct: 630 --ITEWLQSTWDSCAAWXSELWTNIVTTAT---TAWSNFTAWLSGLWSSVVSTGQSLWSS   684

Query: 607 VAGGLSQLIIAVSTGVSLVIGAFTGLLGGI-SGVINSISAVIQSLTGVITAVFNGIATVI   665
               LS +  ++ TG    +FT  L  + SG++++  S +   +L+     I+  +FNGI +
Sbjct: 685 FTSSLSNIFSSLITGAQSLWSSFTSTLSNLWSGLVSTGSNLFNNLSSTISGIFNGILSTA   744

Query: 666 SSVGSTIKDVLTGLGTAFEGFGNGVKSALEGVGAVIESFGSAVR--------NVLDGVAN   717
           S++  ++IK ++      A +G  N V +      GV A+     F  ++                 + G AN
Sbjct: 745 SNIWNSIKSTIS---NAIDGAKNAVSN---GVNAIKNLFNFQIKWPHIPLPHFRVSGSAN   798
```

```
                                     -continued
Query:  718  ILDSM--GTAALVAGRGVKEMAKGIKMLVDLSLGDLVATLAAVASGLGKMASSAGEMTTL  775
             LD +   G  ++       G+   AKG ++   +L +    A V   G A       +TL
Sbjct:  799  PLDWLKGGLPSI----GIDWYAKG-GIMTKPTLFGMNGNRAMVGGEAGAEAILPLNKSTL  853

Query:  776  GSAMSKVANGMTRLATSATIAITGLTV                                   802
             G+     +AN M   + +   +G+T+
Sbjct:  854  GAIGQSIANTM-NTSNNINVNFSGVTI                                   879

Score =  33.2 bits (74), Expect = 0.019
Identities = 83/477 (17%), Positives = 175/477 (36%), Gaps = 103/477 (21%)
Query:  420  GSFLDKISTKFGLFGKKAKEGTD--------------QAANGSRKSGGIISQIFNGLGNI  465
             G  + +++T+FGL G+K K  ++               +A ++++         LG +
Sbjct:  313  GDAVGELNTQFGLTGEKLKSASELLIKYAEINETDISSSAISAKQAIEAYGLTAEDLGMV  372

Query:  466  VKSAGTAISTAAKGIGTGIKTALSGAPPIISSLGTAISTVA--------QGIGTGLAIA-  516
             + +     A     + +T ++ A+ GAP   I   LG +    A           G+ + A++
Sbjct:  373  LDNVTKAAQDTGQSVDTIVQKAIDGAPQ-IKGLGLSFEEGAALIGKFEKSGVDSSAALSS  431

Query:  517  ---------------FRGLGAAIAMVPPTT--WLALGTAILMVGAAFALAGTQA------  553
                            GL  ++ +  +T    AL  A  + G+   A     A
Sbjct:  432  LSKAAVIYAKDGKTLTDGLNETVSAIQNSTSETEALSIASEIFGSKAAPRMVDAIQRGAF  491

Query:  554  --DGISQILRTIGDXXXXXXXXXTDSLATLLTI-------IANAIGSMLPIVAGAISQIV  604
               D +++ ++             D + L           +A   G +L V  A+  ++
Sbjct:  492  SFDDLAEAAKSSSGTVSTTFDETLDPIDKLTQYSNQAKEGMAELGGKLLETVIPALEPLM  551

Query:  605  GAVAGGLS----------QLII---AVSTGVSLVIGAFTGL---LGGISGVINSISAVIQ  648
             G +    ++           Q I+      V+T V +++GA   L    +G I   +  + A I
Sbjct:  552  GMLESSVNWFTSLNETDQQTIVILGLVTTAVMMLLGAIAPLVIAIGAIGAPVGIVVAAIV  611

Query:  649  SLTGVITAVFNGI-----------------ATVISSVGSTIKDVLTGLGTAFEGFGNGVK  691
                VIT +   I                  A   S ++ I    T   + F   + +G+
Sbjct:  612  GAIAVITLIIQAIMNWGAITEWLQSTWDSCAAWXSELWTNIVTTATTAWSNFTAWLSGLW  671

Query:  692  SALEGVG-AVIESFGSAVRNV----LDGVANILDSMGTAALNAGRGVKEMAKGIKMLVDL  746
             S++    G  ++   SF S++ N+      + G ++  S +      N    G+        +
Sbjct:  672  SSVVSTGQSLWSSFTSSLSNIFSSLITGAQSLWSSFTSTLSNLWSGLVSTGSNL------  725

Query:  747  SLGDLVATLAAVASGLGKMASSAGEMTTLGSAMSKVANGMTRLATSATIAITGLTVF    803
             +L +T++ +  +G+  +++++        ++  S  +S     +G     ++  AI   L  F
Sbjct:  726  -FNNLSSTISGIFNGI--LSTASNIWNSIKSTISNAIDGAKNAVSNGVNAIKNLFNF     779
```

Based on this analysis, it was predicted that these proteins and their epitopes could be useful antigens for vaccines or diagnostics.

Example 622

A DNA sequence (GBSx0662) was identified in *S. agalactiae* <SEQ ID 1935> which encodes the amino acid sequence <SEQ ID 1936>. Analysis of this protein sequence reveals the following:

Possible site: 13
>>> Seems to have no N-terminal signal sequence
----- Final Results -----
  bacterial cytoplasm --- Certainty = 0.2277(Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 623

A DNA sequence (GBSx0663) was identified in *S. agalactiae* <SEQ ID 1937> which encodes the amino acid sequence <SEQ ID 1938>. This protein is predicted to be membrane protein (ceuB). Analysis of this protein sequence reveals the following:

Possible site: 41
>>> Seems to have no N-terminal signal sequence
INTEGRAL    Likelihood = −11.30    Transmembrane 241-257 (237-274)
INTEGRAL    Likelihood = −6.42     Transmembrane 127-143 (118-149)
INTEGRAL    Likelihood = −5.79     Transmembrane 152-168 (150-174)
INTEGRAL    Likelihood = −5.47     Transmembrane 312-328 (309-330)
INTEGRAL    Likelihood = −4.83     Transmembrane 289-305 (287-308)
INTEGRAL    Likelihood = −4.67     Transmembrane 24-40 (22-46)
INTEGRAL    Likelihood = −4.35     Transmembrane 69-85 (68-86)
INTEGRAL    Likelihood = −4.19     Transmembrane 200-216 (198-216)
INTEGRAL    Likelihood = −2.76     Transmembrane 107-123 (107-123)
INTEGRAL    Likelihood = −0.85     Transmembrane 258-274 (258-274)
----- Final Results -----
   bacterial membrane --- Certainty = 0.5522 (Affirmative) <succ>
     bacterial outside --- Certainty = 0.0000 (Not Clear) <succ>
     bacterial cytoplasm --- Certainty = 0.0000 (Not Clear) <succ>

A related GBS nucleic acid sequence <SEQ ID 8621> which encodes amino acid sequence <SEQ ID 8622> was also identified. Analysis of this protein sequence reveals the following:

```
Lipop: Possible site: -1      Crend: 2
SRCFLG: 0
McG: Length of UR: 23
Peak Value of UR: 2.64
Net Charge of CR: 2
McG: Discrim Score: 8.59
GvH: Signal Score (-7.5): -4.6
Possible site: 26
>>> Seems to have an uncleavable N-term signal seq
Amino Acid Composition: calculated from 1
ALOM program      count: 9           value: -11.30      threshold: 0.0
INTEGRAL          Likelihood = -11.30   Transmembrane 226-242 (222-259)
INTEGRAL          Likelihood = -6.42    Transmembrane 112-128 (103-134)
INTEGRAL          Likelihood = -5.79    Transmembrane 137-153 (135-159)
INTEGRAL          Likelihood = -4.67    Transmembrane 9-25 (7-31)
INTEGRAL          Likelihood = -4.35    Transmembrane 54-70 (53-71)
INTEGRAL          Likelihood = -4.19    Transmembrane 185-201 (183-201)
INTEGRAL          Likelihood = -3.08    Transmembrane 268-284 (265-284)
INTEGRAL          Likelihood = -2.76    Transmembrane 92-108 ( 92-108)
INTEGRAL          Likelihood = -0.85    Transmembrane 243-259 (243-259)
PERIPHERAL        Likelihood = 5.73     203
modified ALOM score: 2.76
icml HYPID: 7     CFP: 0.552
*** Reasoning Step: 3
----- Final Results -----
   bacterial membrane --- Certainty = 0.5522 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the GENPEPT database:

```
>GP:CAB12188 GB:Z99106 similar to ferrichrome ABC transporter
(permease) [Bacillus subtilis]
Identities = 149/304 (49%), Positives = 234/304 (76%)
Query:  29  LVILSLTSLFVGVKSIPLEQITHLDQSQVDIFLTSRLPRTISILISGASLSVCGLLMQQL   88
            L+IL++TS+F+GV+  +    + L + +    SRLPR ISI+I+G S+S+CGL+MQQ+
Sbjct:  10  LIILAVTSVFIGVEDLSPLDLFDLSKQEASTLFASRLPRLISIVIAGLSMSICGLIMQQI   69

Query:  89  TQNKFVSPTTSGTMDWAKLGVVVTLIFFKNTSIFIQLCIASGFAILGSLLFVTILKMITF  148
            ++NKFVSPTT+GTMDWA+LG++++L+ F + S   I++ +A  FA+ G+ LF+ IL+ I F
Sbjct:  70  SRNKFVSPTTAGTMDWARLGILISLLLFTSASPLIKMLVAFVFALAGNPLFMKILERIKF  129

Query: 149  KDNIFIPLIGLMLGQIVAAATVFLGTHFQVLQSVNSWLQGNFSIMTSHRYEILYLALPCL  208
             D IFIPL+GLMLG IV++    F+    + ++Q+V+SWLQG+FS++    RYE+LYL++P +
Sbjct: 130  NDTIFIPLVGLMLGNIVSSIATFIAYKYDLIQNVSSWLQGDFSLVVKGRYELLYLSIPLV  189

Query: 209  FLVYFFAHQFTIVGLGESFAKNLGVAYEKMIYFGLVLVSIMTSLVIIIVGALPFLGLIVP  268
            + Y +A +FT+ G+GESF+ NLG+ Y++++   GL++VS++TSLVI+ VG LPFLGLI+P
Sbjct: 190  IIAYVYADKFTLAGMGESFSVNLGLKYKRVVNIGLIIVSLITSLVILTVGMLPFLGLIIP  249

Query: 269  NLISITKGDHMSSTILETSLLGACIVMICDLFGRLVIFPYEVSIGVTLGVLGSAFFLISI  328
            N++SI +GD++ S++   T LLGA  V+ CD+ GR++IFPYE+SIG+ +G++GS  FL +
Sbjct: 250  NIVSIYRGDNLKSSLPHTVLLGAVFVLFCDILGRIIIFPYEISIGLMVGIIGSGIFLFML  309

Query: 329  IRNE                                                          332
            +R +
Sbjct: 310  LRRK                                                          313
```

There is also homology to SEQ ID 1940.

Based on this analysis, it was predicted that these proteins and their epitopes could be useful antigens for vaccines or diagnostics.

Example 624

A DNA sequence (GBSx0664) was identified in *S. agalactiae* <SEQ ID 1941> which encodes the amino acid sequence <SEQ ID 1942>. Analysis of this protein sequence reveals the following:

```
Possible site: 35
>>> Seems to have no N-terminal signal sequence
INTEGRAL    Likelihood = -0.90    Transmembrane 140-156 (140-156)
----- Final Results -----
   bacterial membrane --- Certainty = 0.1362 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the GENPEPT database:

```
>GP:BAB06720 GB:AP001517 maltose transacetylase (maltose
O-acetyltransferase) [Bacillus halodurans]
Identities = 93/182 (51%), Positives = 125/182 (68%), Gaps = 2/182 (1%)
Query:    2 TEKEKMLAGQYYRPSAPELRKDREVALKNMQAFNN--EDNSSKRNVILQKWFGATGKSIH     59
            TEKEKMLAG+ Y+   PEL KDRE A +  + FN   E      +R ++++ FG+ G+S++
Sbjct:    3 TEKEKMLAGERYKAWDPELVKDRERARRLTRLFNQTTETEEKQRTELIKELFGSMGESVN     62

Query:   60 MEQRFVCDYGCNIYVGENFYANFNQTFLDVCEIRIGDNCMFGPNCQLLTPLHPLDPIERN    119
            +E  F  CDYG NI+VG NF+ANF+    LDVCE+RIG NCM  P   + T  HP+ P+ER
Sbjct:   63 IEPTFRCDYGYNIHVGNNFFANFDCVILDVCEVRIGANCMLAPGVHIYTATHPIHPLERV    122

Query:  120 SGLEYGAPIQIGNNVWLGGGVTILPGVVLGDNVVVGAGSVVTKSFENNVVIAGNPAKIIKKL    182
              G EYG P+ I NNVW+GG   + PGV +G+N V+ +GSVVTK    NVV+AGNPAK+I+ +
Sbjct:  123 EGPEYGKPVTIRNNVWIGGRAIVNPGVTIGNNAVIASGSVVTKDVPENVVAGNPAKVIQTI    184
```

A related DNA sequence was identified in *S. pyogenes* <SEQ ID 1943> which encodes the amino acid sequence <SEQ ID 1944>. Analysis of this protein sequence reveals the following:

Possible site: 61
>>> Seems to have no N-terminal signal sequence
----- Final Results -----
  bacterial cytoplasm --- Certainty = 0.4052 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below:

```
Identities = 68/188 (36%), Positives = 101/188 (53%), Gaps = 13/188 (6%)
Query:    2 TEKEKMLAGQYYRPSAPELRKDREVALKNMQAFN--------NEDNSSKRNVILQKWFGA     53
            TE +KM G++Y     +  D E+  K M A +                +R+ +L + FG
Sbjct:    3 TEFDKMTRGEWY-----DANFDSELIQKRMMAQDLCFDLNQLKPSREEERSAVLNQLFGQ     57

Query:   54 TGKSIHMEQRFVCDYGCNIYVGENFYANFNQTFLDVCEIRIGDNCMFGPNCQLLTPLHPL    113
            + + + +   F+CDYG NI  G+N + N N   F+D  +I +GDN   GP+     T HPL
Sbjct:   58 SFEGLVLLSPFICDYGKNITFGKNCFINSNCYFMDGAKIALGDNVFVGPSTGFYTANHPL    117

Query:  114 DPIERNSGLEYGAPIQIGNNVWLGGGVTILPGVVLGDNVVVGAGSVVTKSFENNVVIAGN    173
            D   RN GLE    PI IG+NVW G  V ++PGV +G    V+ +GSVVT    N + AG
Sbjct:  118 DYKRRNEGLEKALPITIGDNVWFGANVNVMPGVTIGSGCVIASGSVVTHDIPVNSLAAGV    177

Query:  174 PAKIIKKL    181
            P ++++K+
Sbjct:  178 PCQVVRKI    185
```

Based on this analysis, it was predicted that these proteins and their epitopes could be useful antigens for vaccines or diagnostics.

Example 625

A DNA sequence (GBSx0665) was identified in *S. agalactiae* <SEQ ID 1945> which encodes the amino acid sequence <SEQ ID 1946>. This protein is predicted to be ribonuclease H (rnhB-2). Analysis of this protein sequence reveals the following:

Possible site: 32
>>> Seems to have no N-terminal signal sequence
INTEGRAL    Likelihood = -0.16    Transmembrane 79-95 (79-95)
----- Final Results -----
  bacterial membrane --- Certainty = 0.1065 (Affirmative) <succ>
  bacterial outside --- Certainty = 0.0000 (Not Clear) <succ>
  bacterial cytoplasm --- Certainty = 0.0000 (Not Clear) <succ>

A related GBS nucleic acid sequence <SEQ ID 9823> which encodes amino acid sequence <SEQ ID 9824> was also identified.

The protein has homology with the following sequences in the GENPEPT database:

```
>GP:CAB13479 GB:Z99112 ribonuclease H [Bacillus subtilis]
Identities = 128/249 (51%), Positives = 168/249 (67%)
Query:    4 TIKEIKAILETIVDLKDKRWQEYQTDSRAGVQKAILQRKKNIQSDLDEEARLEQMLVYEK     63
            T+K+IK   L+ + D +D   + +D R  VQ  + Q K     +  + +   M   YE+
Sbjct:    5 TVKDIKDRLQEVKDAQDPFIAQCENDPRKSVQTLVEQWLKKQAKEKALKEQWVNMTSYER     64

Query:   64 KLYIEHINLIAGIDEVGRGPLAGPVVAAAVILPPNCKIKHLNDSKKIPKKKHQEIYQNIL    123
             +     LIAG+DEVGRGPLAGPVVA+AVILP  C+I  L DSKK+ +KK +E Y+ I+
Sbjct:   65 LARNKGFRLIAGVDEVGRGPLAGPVVASAVILPEECEILGLTDSKKLSEKKREEYYELIM    124

Query:  124 DQALAVGIGIQDSQCIDDINIYEATKHAMIDAVSHLSVAPEHLLIDAMVLDLSIPQTKII    183
            +ALAVGIGI ++   ID+INIYEA+K AM+ A+  LS  P++LL+DAM L L  Q  II
Sbjct:  125 KEALAVGIGIVEATVIDEINIYEASKMAMVKAIQDLSDTPDYLLVDAMTLPLDTAQASII    184
```

```
                                -continued
Query: 184 KGDANSLSIAAASIVAKVTRDKIMSDYDSTYPGYAFSKNAGYGTKEHLEGLQKYGITPIH  243
            KGDA S+SIAA + +AKVTRD++MS Y   TYP Y F KN GYGTKEHLE L  YG T +H
Sbjct: 185 KGDAKSVSIAAGACIAKVTRDRMMSAYAETYPMYGFEKNKGYGTKEHLEALAAYGPTELH  244

Query: 244 RKSFEPIKS                                                   252
            RK+F P++S
Sbjct: 245 RKTFAPVQS                                                   253
```

A related DNA sequence was identified in *S. pyogenes* <SEQ ID 1947> which encodes the amino acid sequence <SEQ ID 1948>. Analysis of this protein sequence reveals the following:

Possible site: 50
>>> Seems to have no N-terminal signal sequence
INTEGRAL    Likelihood = −0.53    Transmembrane 79-95 (79-95)
----- Final Results -----
  bacterial membrane --- Certainty = 0.1213 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the databases:

Based on this analysis, it was predicted that these proteins and their epitopes could be useful antigens for vaccines or diagnostics.

Example 626

A DNA sequence (GBSx0666) was identified in *S. agalactiae* <SEQ ID 1949> which encodes the amino acid sequence <SEQ ID 1950>. Analysis of this protein sequence reveals the following:

Possible site: 16
>>> Seems to have no N-terminal signal sequence

```
>GP:CAB13479 GB:Z99112 ribonuclease H [Bacillus subtilis]
Identities = 130/252 (51%), Positives = 176/252 (69%), Gaps = 3/252 (1%)
Query:   4 SIKAIKESLEAVTSLLDPLFQELATDTRSGVQKALKSRQKVIQAELAREERLEAMLSYEK   63
            ++K IK+ L+ V     DP  +   D R VQ  ++   K    E A +E+   M SYE+
Sbjct:   5 TVKDIKDRLQEVEDAQDPFIAQCENDPRKSVQTLVEQWLKKQAKEKALKEQVNMTSYER   64

Query:  64 ALYKKGYKAIAGIDEVGRGPLAGPVVAACVILPKYCKIKGLNDSKKIPKAKHETIYQAVK  123
            + KG++ IAG+DEVGRGPLAGPVVA+ VILP+ C+I GL DSKK+ + K E  Y+ +
Sbjct:  65 LARNKGFRLIAGVDEVGRGPLAGPVVASAVILPEECEILGLTDSKKLSEKKREEYYELIM  124

Query: 124 EKALAIGIGIIDNQLIDEVNIYEATKLAMLEAIKQLEGQLTQPDYLLIDAMTLDIAISQQ  183
            ++ALA+GIGI++   +IDE+NIYEA+K+AM++AI+ L     PDYLL+DAMTL +  +Q
Sbjct: 125 KEALAVGIGIVEATVIDEINIYEASKMAMVKAIQDLS---DTPDYLLVDAMTLPLDTAQA  181

Query: 184 SILKGDANSLSIAAASIVAKVTRDQMMANYDRIFPGYDFAKNAGYGTKEHLQGLKAYGIT  243
            SI+KGDA S+SIAA + +AKVTRD+MM+ Y    +P Y F KN GYGTKEHL+ L AYG T
Sbjct: 182 SIIKGDAKSVSIAAGACIAKVTRDRMMSAYAETYPMYGFEKNKGYGTKEHLEALAAYGPT  241

Query: 244 PIHRKSFEPVKS                                                255
            +HRK+F PV+S
Sbjct: 242 ELHRKTFAPVQS                                                253
```

An alignment of the GAS and GBS proteins is shown below:

```
Identities = 168/256 (65%), Positives = 203/256 (78%), Gaps = 3/256 (1%)
Query:   1 MMATIKEIKAILETIVDLKDKRWQEYQTDSRAGVQKAILQRKKNIQSDLDEEARLEQMLV   60
            M  +IK IK  LE +  L D  +QE  TD+R+GVQKA+  R+K IQ++L EE RLE ML
Sbjct:   1 MPTSIKAIKESLEAVTSLLDPLFQELATDTRSGVQKALKSRQKVIQAELAEEERLEAMLS   60

Query:  61 YEKKLYIEHINLIAGIDEVGRGPLAGPVVAAAVILPPNCKIKHLNDSKKIPKKKHQEIYQ  120
            YEK LY +    IAGIDEVGRGPLAGPVVAA VILP  CKIK LNDSKKIPK KH+ IYQ
Sbjct:  61 YEKALYKKGYKAIAGIDEVGRGPLAGPVVAACVILPKYCKIKGLNDSKKIPKAKHETIYQ  120

Query: 121 NILDQALAVGIGIQDSQCIDDINIYEATKHAMIDAVSHLS---VAPEHLLIDAMVLDSLI  177
            +  ++ALA+GIGI D+Q ID++NIYEATK AM++A+ L       P++LLIDAM LD++I
Sbjct: 121 AVKEKALAIGIGIIDNQLIDEVNIYEATKLAMLEAIKQLEGQLTQPDYLLIDAMTLDIAI  180

Query: 178 PQTKIIKGDANSLSIAAASIVAKVTRDKIMSDYDSTYPGYAFSKNAGYGTKEHLEGLQKY  237
            Q  I+KGDANSLSIAAASIVAKVTRD++M++YD  +PGY F+KNAGYGTKEHL+GL+ Y
Sbjct: 181 SQQSILKGDANSLSIAAASIVAKVIRDQMMANYDRIFPGYDFAKNAGYGTKEHLQGLKAY  240

Query: 238 GITPIHRKSFEPIKSM                                            253
            GITPIHRKSFEP+KSM
Sbjct: 241 GITPIHRKSFEPVKSM                                            256
```

----- Final Results -----
   bacterial cytoplasm --- Certainty = 0.1865 (Affirmative) <succ>
     bacterial membrane --- Certainty = 0.0000 (Not Clear) <succ>
       bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 627

A DNA sequence (GBSx0667) was identified in *S. agalactiae* <SEQ ID 1951> which encodes the amino acid sequence <SEQ ID 1952>. Analysis of this protein sequence reveals the following:

Possible site: 14
>>> Seems to have no N-terminal signal sequence
----- Final Results -----
   bacterial cytoplasm --- Certainty = 0.3034 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database:

```
>GP:BAB06195 GB:AP001515 unknown conserved protein [Bacillus halodurans]
Identities = 140/281 (49%), Positives = 195/281 (68%), Gaps = 5/281 (1%)
Query:   3    TIQWFPGHMSKARRQVQENIKHVDFVTILVDARLPLSSQNPMLIKIVGDKPKLMILNKAD    62
              TIQWFPGHM+KARR+V E +K +D V  L+DAR+PLSS+NPM+ +IV  KP+L++LNK D
Sbjct:   2    TIQWFPGHMAKARREVTEKLKLIDVVIELLDARVPLSSRNPMMDEIVAHKPRLVLLNKDD    61

Query:  63    LADPIRTKEWRDFYESQGLKTLAINSKEQSTVKKVIDIAKILMSDKIANLRGRGIQKETL   122
              LADP +TKEW  F+E  G   L IN++    V +++   + L     I    R +G++    +
Sbjct:  62    LADPSKTKEWTRFFEEGGATVLPINAQTGQGVSRISPACQTLAQALIEKQRAKGMKPRAI   121

Query: 123    RTMIIGIPNAGKSTLMNRLAGKKIAVVGNKPGVTKGQQWLKSNKELEILDTPGILWPKFE   182
              R MI+GIPN GKSTL+NRLA K+IA VG++PG+TK QQW+K  KELE+LDTPGILWPKF+
Sbjct: 122    RAMILGIPNVGKSTLINRLASKRIARVGDRPGITKQQQWIKVGKELELLDTPGILWPKFD   181

Query: 183    DELVGLKLALTGAIKDQLLPMDEVTIFGLNYFKTYYPDRLKERFKSINLEDEAPEIIMAL   242
              D+   G +LA TGAIKD+LL    +V +F L Y +  YPDRL +R+K    L ++    +  A+
Sbjct: 182    DQATGFRLAATGAIKDELLDFQDVALFVLRYMREMYPDRLMDRYKLNELPEDGVTLFDAI   241

Query: 243    TQKLGY-----RDDYDRFYNLFVKEVRDGKLGRYTLDIVGE                    278
              +K G+           DYD+    + ++E+R G LGR TL++ G+
Sbjct: 242    GKKRGHLLSGGYIDYDKTAEMILRELRAGTLGRITLEVPGK                    282
```

A related DNA sequence was identified in *S. pyogenes* <SEQ ID 1953> which encodes the amino acid sequence <SEQ ID 1954>. Analysis of this protein sequence reveals the following:

Possible site: 14
>>> Seems to have no N-terminal signal sequence
----- Final Results -----
   bacterial cytoplasm --- Certainty = 0.2688 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below:

```
Identities = 247/282 (87%), Positives = 265/282 (93%)
Query: 1    MATIQWFPGHMSKARRQVQENIKHVDFVTILVDARLPLSSQNPMLTKIVGDKPKLMILNK    60
            MA IQWFPGHMSKARRQVQEN+KHVDFVTILVDARLPLSSQNPMLTKIVGDKPKLMILNK
Sbjct: 1    MAMIQWFPGHMSKARRQVQENVKHVDFVTILVDARLPLSSQNPMLTKIVGDKPKLMILNK    60

Query: 61   ADLADPIRTKEWRDEYESQGLKTLAINSKEQSTVKKVTDIAKILMSDKIANLRGRGIQKE   120
            ADLAD  RTKEW+ +YESQG+KTLAINSKEQSTVKKVT+ AK LM+DKI  LR RGIQKE
Sbjct: 61   ADLADATRTKEWKAYYESQGIKTLAINSKEQSTVKKVTEAAKELMADKIQRLRERGIQKE   120

Query: 121  TLRIMIIGIPNAGKSTLMNRLAGKKIAVVGNKPGVTKGQQWLKSNKELEILDTPGILWPK   180
            TLRIMIIGIPNAGKSTLMNRLAGKKIAVVGNKPGVTKGQQWLKSNKELEILDTPGILWPK
Sbjct: 121  TLRTMIIGIPNAGKSTLMNRLAGKKIAVVGNKPGVTKGQQWLKSNKELEILDTPGILWPK   180

Query: 181  FEDELVGLKLALTGAIKDQLLPMDEVTIFGLNYFKTYYPDRLKERFKSINLEDEAPEIIM   240
            FEDELVGLKLALTGAIKDQLLPMDEVTIFGLNYF+ YYP+RL +RFK+I LE+EAPEIIM
Sbjct: 181  FEDELVGLKLALTGAIKDQLLPMDEVTIFGLNYFREYYPNRLTKRFKNIPLEEEAPEIIM   240

Query: 241  ALTQKLGYRDDYDRFYNLFVKEVRDGKLGRYTLDIVGEHDGN                    282
            LT++LG++DDYDRFY LFVKEVRDGKLG+YTLD VG+ D +
Sbjct: 241  TLTRQLGFKDDYDRFYTLFVKEVRDGKLGQYTLDQVGDMDAD                    282
```

Based on this analysis, it was predicted that these proteins and their epitopes could be useful antigens for vaccines or diagnostics.

Example 628

A DNA sequence (GBSx0668) was identified in *S. agalactiae* <SEQ ID 1955> which encodes the amino acid sequence <SEQ ID 1956>. Analysis of this protein sequence reveals the following:

---

Possible site: 24
>>> Seems to have a cleavable N-term signal seq.
----- Final Results -----
   bacterial outside --- Certainty = 0.3000 (Affirmative) <succ>
   bacterial membrane --- Certainty = 0.0000 (Not Clear) <succ>
   bacterial cytoplasm --- Certainty = 0.0000 (Not Clear) <succ>

---

A related GBS nucleic acid sequence <SEQ ID 9825> which encodes amino acid sequence <SEQ ID 9826> was also identified.

The protein has homology with the following sequences in the GENPEPT database:

```
>GP:CAB12129 GB:Z99105 similar to hypothetical proteins [Bacillus subtilis]
Identities = 69/173 (39%), Positives = 102/173 (58%), Gaps = 13/173 (7%)
Query: 29   DKAKEKASV-----IKQASQTSQTSKKEVLQKKT----YPNLNKYSNLEIHVSSTRQTMT    79
            D A+E AS+      ++ +    +T+K  +  K      YP++ K  ++ I V+   Q
Sbjct: 22   DHAEEHASINTKKTVENITDVRKTAKTSIDWTKPSGGEYPDI-KQKHVWIDVNVKEQKAY   80

Query: 80   ITSNDKVIFKTIVSTG---AKESPTPKGTEVIEPERGDFFYNASSKEGAYYWVSFKEHGI   136
            I        I+  ++S+G     K+  TPKGTF +EPERG++F++    +EGA YWVS+K HG
Sbjct: 81   IKEGSNTIYTMMISSGLDQTKDDATPKGTFYVEPERGEWFFSEGYQEGAEYWVSWKNHGE   140

Query: 137  YLFHSVPTDQQGNEIPEEAKQLGKAASHGCVRMSRADAKWFYENIPQGTIVTI          189
            +LFHSVP  +   I  EA++LG    SHGC+R++  DAKW YENIP+ T V I
Sbjct: 141  FLFHSVPMTKDQKVIKTEAEKLGTKVSHGCIRLTIPDAKWVYENIPEHTKVVI          193
```

No corresponding DNA sequence was identified in *S. pyogenes*.

Figure 130:
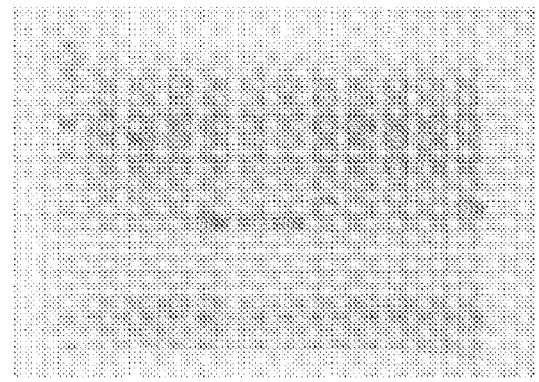

SEQ ID 1956 (GBS644) was expressed in *E. coli* as a GST-fusion product. SDS-PAGE analysis of total cell extract is shown in FIG. 130 (lane 2 & 3; MW 49.6 kDa) and in FIG. 186 (lane 3; MW 50 kDa). It was also expressed in *E. coli* as a His-fusion product. SDS-PAGE analysis of total cell extract is shown in FIG. 130 (lane 5-7; MW 24.6 kDa) and in FIG. 177 (lane 3; MW 25 kDa).

GBS644-GST was purified as shown in FIG. 236, lane 9.

Based on this analysis, it was predicted that these proteins and their epitopes could be useful antigens for vaccines or diagnostics.

Example 629

A DNA sequence (GBSx0669) was identified in *S. agalactiae* <SEQ ID 1957> which encodes the amino acid sequence <SEQ ID 1958>. This protein is predicted to be carbon starvation protein A. Analysis of this protein sequence reveals the following:

---

Possible site: 19
>>> Seems to have an uncleavable N-term signal seq
INTEGRAL   Likelihood = −11.25   Transmembrane 129-145 (122-157)
INTEGRAL   Likelihood = −9.92    Transmembrane 316-332 (305-342)
INTEGRAL   Likelihood = −6.42    Transmembrane 164-180 (157-181)
INTEGRAL   Likelihood = −5.73    Transmembrane 443-459 (441-466)
INTEGRAL   Likelihood = −5.57    Transmembrane 416-432 (414-435)
INTEGRAL   Likelihood = −4.88    Transmembrane 190-206 (183-209)
INTEGRAL   Likelihood = −4.83    Transmembrane 78-94 (70-95)
INTEGRAL   Likelihood = −3.13    Transmembrane 362-378 (359-379)
INTEGRAL   Likelihood = −2.34    Transmembrane 228-244 (227-245)
INTEGRAL   Likelihood = −2.02    Transmembrane 2-18 (1-18)
INTEGRAL   Likelihood = −1.28    Transmembrane 393-409 (393-410)
----- Final Results -----
   bacterial membrane --- Certainty = 0.5501 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the GENPEPT database:

```
>GP:AAF93852 GB:AE004154 carbon starvation protein A, putative [Vibrio cholerae]
Identities = 220/470 (46%), Positives = 311/470 (65%), Gaps = 16/470 (3%)
Query:   1   MVTFLGGVALLIVGYFTYGRYIEKNFQIDENRQTPAEALRDGYDFVPMPKWKNGMIELLN    60
             M+ FL  VA L+ GYF YG ++EK F I+E RQTPA   DG D+VPM K    +++LLN
Sbjct:   1   MLWFLTCVAALVGGYFIYGAFVEKVFGINEKRQTPAHTKTDGVDYVPMSTPKVYLVQLLN    60

Query:  61   IAGTGPIFGPILGALYGPVAYIWIVLGCIFAGAVHDYMIGMISLRNNGAYLPELASRYLG   120
             IAG GPIFGPI+GALYGP A +WIV+GCIFAGAVHDY  GM+S+RN GA +P +  RYLG
Sbjct:  61   IAGVGPIFGPIMGALYGPAAMLWIVVGCIFAGAVHDYFSGMLSIRNGGASVPSITGRYLG   120

Query: 121   KSMKHVINIFSMLLLILVATVFVVTPANLILSILPAG---TLSLPWIIGLIFVYYLISTV   177
              KH +NIF+++LL+LV  VFV  PA +I +++     T+S+  ++ +IF YY+++T+
Sbjct: 121   NGAKHFMNIFAIVLLLLVGVVFVSAPAGMITNLINQQTDFTVSMTTMVVIIFAYYILATI   180

Query: 178   LPIDKALGKVYPVF-------CVILMVSTAAVGFRLLTGGFDMPNLTFETFKNMHPAGLG   230
             +P+DK +G+ YP+F         V LM + A      + GGF++ ++     KN++P  +
Sbjct: 181   VPVDKIIGRFYPLFGALLIFMSVGLMTAIAFSSEHQVLGGFEISDMV----KNLNPNDMP   236

Query: 231   IFPALFFTISCGAISGFHATQAPMVSRTTVNEREGRFTFYGMMIAEGVIAMIWAGASMSL   290
             ++PALF TI+CGAISGFHATQ+P+++R    NE+GR F FYG MI EG+IA+IW   ++S
Sbjct: 237   LWPALFITIACGAISGFHATQSPLMARCMENEKNGRFVFYGAMIGEGIIALIWCTVALSF   296

Query: 291   FKG-QNLYEMIAAGTPSAVVNQVMLMLLGSVIGTIAIIGVIVLPVSSGLSAFRSLRTIVA   349
             F   + L E+   G P VV     LLG   G IA +GV++LP++SG +AFRS R  I+A
Sbjct: 297   FGSLEALSEAVKNGGPGNVVYGASFGLLGVFGGVIAFLGVVILPITSGDTAFRSSRLILA   356

Query: 350   DYIHVKQDTLPKIFAVTIPLYVISFVLTHVDFNLLWRYFNWANQVTAVIGLLVATRYLIL   409
             +Y +++Q TL   + +PL+VI   VLT VDF ++WRYF +ANQ  TAV+ L AT   YL+
Sbjct: 357   EYFNMEQKTLRNRLLMAVPLFVIGAVLTQVDFGIIWRYFGFANQATAVMMLWTATAYLMR   416

Query: 410   KRRNYWVTFVPAMFMLYAVVVYIL-SQPIGFNMGLGILTYSLALVLTGIL            458
             + +W+  VPA+FM   + +IL S  +GF + + I T +  L   G L
Sbjct: 417   HNKLHWICTVPALFMTTVCISFILNSSTLGFGLPMQISTIAGVLASLGAL            466
```

No corresponding DNA sequence was identified in *S. pyo-genes*.

A related GBS gene <SEQ ID 8623> and protein <SEQ ID 8624> were also identified. Analysis of this protein sequence reveals the following:

---

Lipop: Possible site: –1    Crend: 0
McG: Discrim Score: 6.07
GvH: Signal Score (–7.5): –3.54
Possible site: 19
>>> Seems to have an uncleavable N-term signal seq
ALOM program    count: 11    value: –11.25    threshold: 0.0
INTEGRAL    Likelihood = –11.25    Transmembrane 129-145 (122-157)
INTEGRAL    Likelihood = –9.92    Transmembrane 316-332 (305-342)
INTEGRAL    Likelihood = –6.42    Transmembrane 164-180 (157-181)
INTEGRAL    Likelihood = –5.57    Transmembrane 416-432 (414-435)
INTEGRAL    Likelihood = –4.88    Transmembrane 190-206 (183-209)
INTEGRAL    Likelihood = –4.83    Transmembrane 78-94 (70-95)
INTEGRAL    Likelihood = –4.67    Transmembrane 445-461 (441-463)
INTEGRAL    Likelihood = –3.13    Transmembrane 362-378 (359-379)
INTEGRAL    Likelihood = –2.34    Transmembrane 228-244 (227-245)
INTEGRAL    Likelihood = –2.02    Transmembrane 2-18 (1-18)
INTEGRAL    Likelihood = –1.28    Transmembrane 393-409 (393-410)
PERIPHERAL    Likelihood = 0.21    272
modified ALOM score: 2.75
*** Reasoning Step: 3
----- Final Results -----
   bacterial membrane --- Certainty = 0.5501 (Affirmative) <succ>
      bacterial outside --- Certainty = 0.0000 (Not Clear) <succ>
         bacterial cytoplasm --- Certainty = 0.0000 (Not Clear) <succ>

---

The protein has homology with the following sequences in the databases:

---

ORF01729(301-1668 of 2082)
GP|9655126|gb|AAF93852.1||AE004154(1-464 of 494) carbon starvation protein A, putative {*Vibrio cholerae*}
% Match = 29.9

-continued

```
% Identity = 47.6  % Similarity = 68.6
Matches = 218 Mismatches = 138 Conservative Sub.s = 96

174       204       234       264       294       324       354       384
       TNEKLFIIKLRLFISKKQPFILKIGNFNFSMLY*SHENA**N*AKKFLGGSDMVTFLGGVALLIVGYFTYGRYIEKNFQI
                                                             |: ||   || |: ||| || ::|| |
                                                           MLWFLTCVAALVGGYFIYGAFVEKVFGI
                                                             10         20

414       444       474       504       534       564       594       624
       DENRQTPAEALRDGYDFVPMPKWKNGMIELLNIAGTGPIFGPILGALYGPVAYIWIVLGCIFAGAVHDYMIGMISLRNNG
       :| |||||   || |:|||  |   :::|||||  ||||||:|||||  |:|||:||||||||||  ||:|:|| |
       NEKRQTPAHTKTDGVDYVPMSTPKVYLVQLLNIAGVGPIFGPIMGALYGPAAMLWIVVGCIFAGAVHDYFSGMLSIRNGG
         40        50        60        70        80        90       100

654       684       714       744       774       795       825       855
       AYLPELASRYLGKSMKHVINIFSMLLLILVATVFVVTPANLILSILPAGT---LSLPWIIGLIFVYYLISTVLPIDKALG
       | :| :    ||||     ||  :|||::|:||   |||  ||  :|  :::       :|:   ::  :||  ||::|::|| :|
       ASVPSITGRYLGNGAKHFMNIFAIVLLLLVGVVFVSAPAGMITNLINQQTDFTVSMTTMVVIIFAYYILATIVPVDKIIG
         120       130       140       150       160       170       180

894       924       954       984      1014      1044      1074
       KVYP------VFCVI-LMVSTAAVGFRLLTGGFDMPNLTFETFKNMHPAGLGIFPALFFTISCGAISGFHATQAPMVSRT
       : ||        :|  : || :  |       : |||:: ::     ||:::|  : ::|||| ||:|||||||||||:|:::|
       RFYPLFGALLIFMSVGLMTAIAFSSEHQVLGGFEISDM----VKNLNPNDMPLWPALFITIACGAISGFHATQSPLMARC
         200       210       220       230       240       250       260

1104      1134      1164      1191      1221      1251      1281      1311
       TVNEREGRFTFYGMMIAEGVIAMIWAGASMSLFKG-QNLYEMIAAGTPSAVVNQVMLMLLGSVIGTIAIIGVIVLPVSSG
         | |: ||| ||| || || |:|:|      ::|:|   |  |   |   ||  |   ||  :|||::||:|
       MENEKNGRFVFYGAMIGEGIIALIWCTVALSFFGSLEALSEAVKNGGPGNVVYGASFGLLGVFGGVIAFLGVVILPITSG
         280       290       300       310       320       330       340

1341      1371      1401      1431      1461      1491      1521      1551
       LSAFRSLRTIVADYIHVKQDTLPKIFAVTIPLYVISFVLTHVDFNLLWRYFNWANQVTAVIGLLVATRYLILKRRNYWVT
       :||||  |  |:|:|  ::: ||       : :  ::||:||    |||:|||   ::||||  :||| |||:    |  ||  ||::    : :|:
       DTAFRSSRLILAEYFNMEQKTLRNRLLMAVPLFVIGAVLTQVDFGIIWRYFGFANQATAVMMLWTATAYLMRHNKLHWIC
         360       370       380       390       400       410       420

1581      1608      1638      1668      1698      1728      1758      1788
       FVPAMFMLYAVVVYIL-SQPIGFNMGLGILTYSLALVLTGIXVGLFWKSGQKQLKTVHPEAFLFNDHRPINYYSSLDS*Y
       |||:||       :    : :||    :||  ::   | |   :  |    |
       TVPALFMTTVCISFILNSSTLGFGLPMQISTIAGVLASLGALAYVAKVSKGKGETDLADEEKPQGVTKTA
         440       450       460       470       480       490
```

Based on this analysis, it was predicted that these proteins and their epitopes could be useful antigens for vaccines or diagnostics.

Example 630

A DNA sequence (GBSx0670) was identified in *S. agalactiae* <SEQ ID 1959> which encodes the amino acid sequence <SEQ ID 1960>. This protein is predicted to be lytR (lytT). Analysis of this protein sequence reveals the following:

```
Possible site: 30
>>> Seems to have no N-terminal signal sequence
  INTEGRAL    Likelihood = -0.80   Transmembrane 27-43 (27-43)
----- Final Results -----
    bacterial membrane --- Certainty = 0.1319 (Affirmative) <succ>
      bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database:

```
>GP:AAB48183 GB:L42945 lytR [Staphylococcus aureus]
  Identities = 93/245 (37%), Positives = 150/245 (60%), Gaps = 3/245 (1%)
  Query:   1  MKVLVVDDEPVARNELIYLLNKYDSNLVIAEAHDMATALAILLRETFDVALLDIHLRDDS   60
              MK L++DDEP+ARNEL YLLN+     I EA ++   L  LL    +D+  LD++L D++
  Sbjct:   1  MKALIIDDEPLARNELTYLLNEIGGFEEINEAENVKETLEALLINQYDIIFLDVNLMDEN   60

Query:  61  GLQLAEYINKMPKPPLLIFATAYDQYAIQAFEHDARDYLLKPYDFDRLKQAMDRVKGALS  120
              G++L    I KM +PP +IFATA+DQYA+QAFE +A DY+LKP+   R+QA+++V+    +
  Sbjct:  61  GIELGAKIQKMKEPPAIIFATAHDQYAVQAFELNATDYILKPFGQKRIEQAVNKVRATKA  120

Query: 121  TSTIIESVTSGPL---FKQQYPLTVEDRIYLVSADDILLIEAMQGKLIIQTPDKNYEIDG  177
               S    + +   FQ  P+ ++D+I+++     +I+ I    G    I T +  YE
  Sbjct: 121  KDDNNASAIANDMSANFDQSLPVEIDDKIHMLKQQNIIGIGTHNGITTIHTTNHKYETTE  180

Query: 178  SLQQWQDKLPSSQFVRVHRSYIVNINAIKTIEPWFNQTLQLHLCNKITVPVSRANVKPLK  237
              L +++ +L + F+R+HRSYI+N   IK ++ WFN T +L    N + + V R+ +K   K
  Sbjct: 181  PLNRYEKRLNPTYFIRIHRSYIINTKHIKEVQQWFNYTMVILTNGVKMQVGRSFMKDFK   240
```

```
Query: 238  QMLGI                                          242
             +G+
Sbjct: 241  ASIGL                                          245
```

There is also homology to SEQ ID 460.

Figure 75:
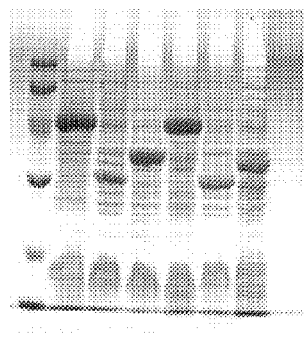
Figure 84:
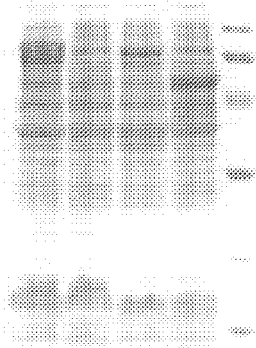

SEQ ID 1960 (GBS399) was expressed in *E. coli* as a His-fusion product. SDS-PAGE analysis of total cell extract is shown in FIG. 75 (lane 7; MW 30.4 kDa). It was also expressed in *E. coli* as a GST-fusion product. SDS-PAGE analysis of total cell extract is shown in FIG. 84 (lane 2; MW 55 kDa). Purified GBS399-GST is shown in FIG. 217, lane 9; purified GBS399d-GST is shown in FIG. 236, lane 3.

Based on this analysis, it was predicted that this protein and its epitopes, could be useful antigens for vaccines or diagnostics.

Example 631

A DNA sequence (GBSx0671) was identified in *S. agalactiae* <SEQ ID 1961> which encodes the amino acid sequence <SEQ ID 1962>. Analysis of this protein sequence reveals the following:

Possible site: 51
>>> Seems to have a cleavable N-term signal seq.
INTEGRAL    Likelihood = −7.59    Transmembrane 95-111 (86-116)
INTEGRAL    Likelihood = −5.95    Transmembrane 155-171 (152-176)
INTEGRAL    Likelihood = −2.28    Transmembrane 189-205 (187-206)
INTEGRAL    Likelihood = −1.49    Transmembrane 122-138 (121-138)
----- Final Results -----
    bacterial membrane --- Certainty = 0.4036 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database:

```
>GP:AAB48182 GB:L42945 lytS [Staphylococcus aureus]
Identities = 264/570 (46%), Positives = 389/570 (67%), Gaps = 2/570 (0%)
Query:   1  MTLFLIMMERAGLIILLAYAFVHIPFIKQTLKQPELKKHQYILLILFSLFAIISNFTGVE    60
            ++L ++++ER GLII+LAY  ++IP+ K  + +    K ++ L I+FSLFA++SN TG+
Sbjct:   2  LSLTMLLLERVGLIIILAYVLMNIPYFKNLMNRRRTWKARWQLCIIFSLFALMSNLTGIV   61

Query:  61  IQSDLSIIPQTLNHIADQSSVANTRVLTIGVSGLIGGPIVGIIVGLLSVEVRYLQGGLAP  120
            I     S+     + D  S+ANTRVLTIGV+GL+GGP VG+ VG++S    R    GG
Sbjct:  62  IDHQHSLSGSVYFRLDDDVSLANTRVLTIGVAGLVGGPFVGLFVGVISGIFRVYMGGADA  121

Query: 121  HIYVISSLLIGLCSGLSGNYLRKNYNKIRVLDAMVVGEGMEILQMICILIFSVDENQALR  180
             +Y+ISS+ IG+ +G  G        ++   + ++G ME++QM+ IL FS D   A+
Sbjct: 122  QVYLISSIFIGIIAGYFGLQAQRRKRYPSIAKSAMIGIVMEMIQMLSILTFSHDKAYAVD  181

Query: 181  LVSFISMPMILSNTLGLGIFISIISSTQKLEEHAKAFQTHQVLELANLTLPYLRKGLTTE  240
            L+S I++PMI+  N++G  IF+SII   T K E+   K   QTH VL+L N T PY ++GL  E
Sbjct: 182  LISLIALPMIIVNSVGPAIFMSIIIPTLKQEDQMKPVQTHDVLQLMNQTFPYFKEGLNRE  241

Query: 241  SCQPVAEIIHKHMDVSAVSLTSQSAILAYVGDGADHHLPNTQILTKLAKRAIDTGKVSVA  300
            S Q +A II   M VS+V++TS++ IL++VG G+DHH+P  +ILT L+K  + +GK+
Sbjct: 242  SAQQIAMIIKNLMKVSSVAITSKNEILSHVGGGSDHHIPTNEILTSLSKDVLKSGKLKEV  301

Query: 301  TDKSEIECDHKNCPLSSAIVIPLHIHDVIVGTLKLYFSDAQHMTYVDRQLAEGLGNIFST  360
              K EI C H NCPL +AIVIPL +H  IVGTLK+YF++    +T+V+RQLAEGL NIFS+
Sbjct: 302  HTKEEIGCSRPNCPLRAAIVIPLEMHGSIVGTLKMYFTNPNDLTFVERQLAEGLANIFSS  361

Query: 361  QLALGQAEEATRLLQDAEMKSLQAQVNPHFLFNALNTIYGLIRMDSEKARKLVQDFSKVI  420
            Q+ LG+AE  ++LL+DAE+KSLQAQV+PHF FN++N I  L+R++SEKAR+L+ + S
Sbjct: 362  QIELGEAETQSKLLKDAEIKSLQAQVSPHFFFNSINPISALVRINSEKARELLLELSYFF  421

Query: 421  RANLQRAKQNLIPLHDELEQVNAYLALEEARFPNMVAFNLDNQTNSDDNLMIPPFTLQVL  480
            RANLQ +KQ+ I L  EL QV AYL+LE+AR+P    N++ +    D +++PPF +Q+L
Sbjct: 422  RANLQGSKQHTITLDKELSQVRAYLSLEQARYPGRFNININVEDKYRD-VLVPPFLIQIL  480

Query: 481  IENSYKHAFKHVNKNNQLKVTIARNN-DRLHIIVQDNGIGIPKEKLITLGKKTQISKQGS  539
            +EN+ KHAF + + N + V++ +    +   IIVQDNG GI K+K+  LG+ + S+ G+
Sbjct: 481  VENAIKHAFTNRKQGNDIDVSVIKETATHVRIIVQDNGQGISKDKMHLLGETSVESESGT  540

Query: 540  GTAIENLVRRLNIIYDGQASLKFESNDSGT                              569
            G+A+ENL RL  ++    A+L+FES  SGT
Sbjct: 541  GSALENLNLRLKGLFGKSAALQFESTSSGT                              570
```

A related DNA sequence was identified in *S. pyogenes* <SEQ ID 1963> which encodes the amino acid sequence <SEQ ID 1964>. Analysis of this protein sequence reveals the following:

---

Possible site: 39
>>> Seems to have no N-terminal signal sequence
INTEGRAL    Likelihood = −6.79    Transmembrane 283-299 (276-307)
INTEGRAL    Likelihood = −5.57    Transmembrane 27-43 (24-48)
----- Final Results -----
   bacterial membrane --- Certainty = 0.3718 (Affirmative) <succ>
      bacterial outside --- Certainty = 0.0000 (Not Clear) <succ>
         bacterial cytoplasm --- Certainty = 0.0000 (Not Clear) <succ>

---

The protein has homology with the following sequences in the databases:

```
>GP:CAB54576 GB:AJ006396 histidine kinase [Streptococcus pneumoniae]
Identities = 115/231 (49.%), Positives = 159/231 (680), Gaps = 7/231 (3%)
Query: 351  MLASIKAYIDEVYVLEVEQRDAQMRALQSQINPHFLYNTLEYIRMYALSCQQEELADVIY    410
            ML ++    I ++Y LE+ Q+DA MRALQ+QINPHF+YNTLE++RMYA+   Q+ELAD+IY
Sbjct: 1    MLDRLEKNIHDIYQLELSQKDANMRALQAQINPHFMYNTLEFLRMYAVMQSQDELADIIY     60

Query: 411  AFASLLRNNISQDKMTTLKEELAFCEKYIYLYQMRYPDSFAYHVKIDESVADLAIPKEVI    470
             F+SLLRNNIS ++ T LK+EL FC KY YL  +RYP S AY  KID  + ++ IPKF +
Sbjct: 61   EFSSLLRNNISDERETLLKQELEFCRKYSYLCMVRYPKSIAYGFKIDPELENMKIPKFTL    120

Query: 471  QPLVENYFVHGIDYSRHDNALSIKALDETDHLLIQVLDNGRGISQERLADMEKRLQ----    526
            QPLVENYF HG+D+ R DN +SIKAL +   + I V+DNGRG+S E+LA++ ++L
Sbjct: 121  QPLVENYFAHGVDHRRTDNVISIKALKQDGFVEILVVDNGRGMSAEKLANIREKLSQRYF    180

Query: 527  EHQTT---GNSSIGLQNVYLRLFHHFRDRVSWSMAKEPNGGFIIQIRIRKD            574
            EHQ +      SIG+ NV+ R  +F DR + ++       G  +I I+ +
Sbjct: 181  EHQASYSDQRQSIGIVNVHERFVLYFGDRYAITIESAEQAGVQYRITIQDE            231
```

An alignment of the GAS and GBS proteins is shown below:

```
Identities = 59/180 (32%), Positives = 97/180 (53%), Gaps = 8/180 (4%)
Query: 375  QDAEMKSLQAQVNPHFLENALNTI--YGLIRMDSEKARKLVQDFSKVIRANLQRAKQNLI    432
            +DA+M++LQ+Q+NPHFL+N L   I   Y L    E A  ++  F+ ++R N+  + K  +
Sbjct: 370  RDAQMRALQSQINPHFLYNTLEYIRMYALSCQQEELA-DVIYAFASLLRNNISQDK--MT    426

Query: 433  PLHDELEQVNAYLALEEARFPNMVAFNLDNQTNSDDNLMIPPFTLQVLIENSYKHAFKHV    492
             L +EL       Y+ L + R+P+  A+++     +  D L IP F +Q L+EN + H  +
Sbjct: 427  TLKEELAFCEKYIYLYQMRYPDSFAYHVKIDESVAD-LAIPKFVIQPLVENYFVHGIDYS    485

Query: 493  NKNNQLKVTIARNNDRLHIIVQDNGIGIPKEKLITLGKKTQISKQ--GSGTAIENLVRRL    550
            +N L +      D L I V DNG GI +E+L  + K+ Q +   S   ++N+ RL
Sbjct: 486  RHDNALSIKALDETDHLLIQVLDNGRGISQERLADMEKRLQEHQTTGNSSIGLQNVYLRL    545
```

Based on this analysis, it was predicted that these proteins and their epitopes could be useful antigens for vaccines or diagnostics.

Example 632

A DNA sequence (GBSx0672) was identified in *S. agalactiae* <SEQ ID 1965> which encodes the amino acid sequence <SEQ ID 1966>. Analysis of this protein sequence reveals the following:

---

Possible site: 24
>>> May be a lipoprotein
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>

---

A related GBS nucleic acid sequence <SEQ ID 9827> which encodes amino acid sequence <SEQ ID 9828> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

Example 633

A DNA sequence (GBSx0673) was identified in *S. agalactiae* <SEQ ID 1967> which encodes the amino acid sequence <SEQ ID 1968>. Analysis of this protein sequence reveals the following:

---

Possible site: 57
>>> Seems to have no N-terminal signal sequence
INTEGRAL    Likelihood = −9.55    Transmembrane 52-68 (45-74)
INTEGRAL    Likelihood = −9.18    Transmembrane 83-99 (76-106)
INTEGRAL    Likelihood = −8.76    Transmembrane 126-142 (118-146)
INTEGRAL    Likelihood = −7.48    Transmembrane 174-190 (170-191)
INTEGRAL    Likelihood = −3.66    Transmembrane 195-211 (193-212)
INTEGRAL    Likelihood = −1.28    Transmembrane 24-40 (24-40)
----- Final Results -----
   bacterial membrane --- Certainty = 0.4821(Affirmative) <succ> bacterial outside --- Certainty = 0.0000 (Not Clear) <succ>
bacterial cytoplasm --- Certainty = 0.0000 (Not Clear) <succ>

The protein has no significant homology with any sequences in the GENPEPT database.

No corresponding DNA sequence was identified in S. pyogenes.

A related GBS gene <SEQ ID 8625> and protein <SEQ ID 8626> were also identified. Analysis of this protein sequence reveals the following:

Lipop: Possible site: –1   Crend: 8
McG: Discrim Score: –8.54
GvH: Signal Score (–7.5): –5.6
Possible site: 57
>>> Seems to have no N-terminal signal sequence
ALOM program   count: 6 value: –9.55 threshold: 0.0
INTEGRAL         Likelihood = –9.55    Transmembrane 52-68 (45-74)
INTEGRAL         Likelihood = –9.18    Transmembrane 83-99 (76-106)
INTEGRAL         Likelihood = –8.76    Transmembrane 126-142 (118-146)
INTEGRAL         Likelihood = –7.48    Transmembrane 174-190 (170-191)
INTEGRAL         Likelihood = –3.66    Transmembrane 195-211 (193-212)
INTEGRAL         Likelihood = –1.28    Transmembrane 24-40 (24-40)
PERIPHERAL       Likelihood = 13.05    100
modified ALOM score: 2.41
*** Reasoning Step: 3
----- Final Results -----
   bacterial membrane --- Certainty = 0.4821 (Affirmative) <succ>
     bacterial outside --- Certainty = 0.0000 (Not Clear) <succ>
       bacterial cytoplasm --- Certainty = 0.0000 (Not Clear) <succ>

Based on this analysis, it was predicted that these proteins and their epitopes could be useful antigens for vaccines or diagnostics.

Example 634

A DNA sequence (GBSx0674) was identified in S. agalactiae <SEQ ID 1969> which encodes the amino acid sequence <SEQ ID 1970>. Analysis of this protein sequence reveals the following:

Possible site: 51
>>> Seems to have no N-terminal signal sequence
INTEGRAL      Likelihood = –0.53    Transmembrane 83-99 (83-99)
----- Final Results -----
   bacterial membrane --- Certainty = 0.1213 (Affirmative) <succ>
     bacterial outside --- Certainty = 0.0000 (Not Clear) <succ>
       bacterial cytoplasm --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 635

A DNA sequence (GBSx0675) was identified in S. agalactiae <SEQ ID 1971> which encodes the amino acid sequence <SEQ ID 1972>. Analysis of this protein sequence reveals the following:

Possible site: 23
>>> Seems to have no N-terminal signal sequence
----- Final Results -----
   bacterial cytoplasm --- Certainty = 0.1902 (Affirmative) <succ>
     bacterial membrane --- Certainty = 0.0000 (Not Clear) <succ>
       bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 636

A DNA sequence (GBSx0676) was identified in S. agalactiae <SEQ ID 1973> which encodes the amino acid sequence <SEQ ID 1974>. Analysis of this protein sequence reveals the following:

Possible site: 20
>>> Seems to have no N-terminal signal sequence
----- Final Results -----
   bacterial cytoplasm --- Certainty = 0.4763 (Affirmative) <succ>
     bacterial membrane --- Certainty = 0.0000 (Not Clear) <succ>
       bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 637

A DNA sequence (GBSx0677) was identified in S. agalactiae <SEQ ID 1975> which encodes the amino acid sequence <SEQ ID 1976>. Analysis of this protein sequence reveals the following:

Possible site: 20
>>> Seems to have no N-terminal signal sequence
----- Final Results -----
 bacterial cytoplasm --- Certainty = 0.5089 (Affirmative) <succ>
 bacterial membrane --- Certainty = 0.0000 (Not Clear) <succ>
 bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 638

A DNA sequence (GBSx0678) was identified in *S. agalactiae* <SEQ ID 1977> which encodes the amino acid sequence <SEQ ID 1978>. Analysis of this protein sequence reveals the following:

Possible site: 25
>>> May be a lipoprotein
----- Final Results -----
 bacterial membrane --- Certainty = 0.0000 (Not Clear) <succ>
 bacterial outside --- Certainty = 0.0000 (Not Clear) <succ>
 bacterial cytoplasm --- Certainty = 0.0000 (Not Clear) <succ>

The protein has no significant homology with any sequences in the GENPEPT database.

No corresponding DNA sequence was identified in *S. pyogenes*.

Figure 26:
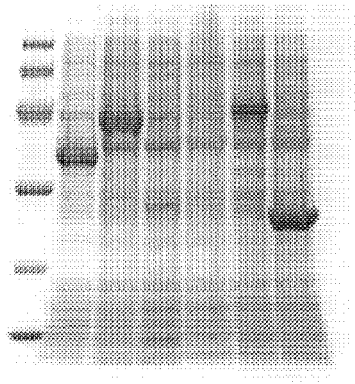
Figure 37:
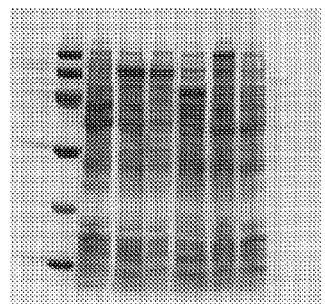

SEQ ID 1978 (GBS184) was expressed in *E. coli* as a His-fusion product. SDS-PAGE analysis of total cell extract is shown in FIG. 26 (lane 7; MW 21 kDa), in FIG. 168 (lane 14-16; MW 36 kDa—thioredoxin fusion) and in FIG. 238 (lane 9; MW 36 kDa). It was also expressed in *E. coli* as a GST-fusion product. SDS-PAGE analysis of total cell extract is shown in FIG. 37 (lane 7; MW 46.4 kDa).

Based on this analysis, it was predicted that this protein and its epitopes, could be useful antigens for vaccines or diagnostics.

Example 639

A DNA sequence (GBSx0679) was identified in *S. agalactiae* <SEQ ID 1979> which encodes the amino acid sequence <SEQ ID 1980>. Analysis of this protein sequence reveals the following:

Possible site: 52
>>> Seems to have no N-terminal signal sequence
----- Final Results -----
 bacterial cytoplasm --- Certainty = 0.2179 (Affirmative) <succ>
 bacterial membrane --- Certainty = 0.0000 (Not Clear) <succ>
 bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 640

A DNA sequence (GBSx0680) was identified in *S. agalactiae* <SEQ ID 1981> which encodes the amino acid sequence <SEQ ID 1982>. This protein is predicted to be immunogenic secreted protein precursor. Analysis of this protein sequence reveals the following:

Possible site: 34
>>> Seems to have no N-terminal signal sequence
----- Final Results -----
 bacterial cytoplasm --- Certainty = 0.2166 (Affirmative) <succ>
 bacterial membrane --- Certainty = 0.0000 (Not Clear) <succ>
 bacterial outside --- Certainty = 0.0000 (Not Clear) <succ>

A related GBS nucleic acid sequence <SEQ ID 9351> which encodes amino acid sequence <SEQ ID 9352> was also identified.

A related DNA sequence was identified in *S. pyogenes* <SEQ ID 1983> which encodes the amino acid sequence <SEQ ID 1984>. Analysis of this protein sequence reveals the following:

Possible site: 19
>>> Seems to have an uncleavable N-term signal seq
INTEGRAL    Likelihood = -3.77    Transmembrane 9-25 (5-27)
----- Final Results -----
 bacterial membrane --- Certainty = 0.2508 (Affirmative) <succ>
 bacterial outside --- Certainty = 0.0000 (Not Clear) <succ>
 bacterial cytoplasm --- Certainty = 0.0000 (Not Clear) <succ>

An alignment of the GAS and GBS proteins is shown below:

```
Identities = 64/86 (74%), Positives = 76/86 (87%)
Query:   1  MGNGGDWKNKPGYQTTHEAKTGYAISFSPGQAGADRTYGHVAIVEDVKEDGSIPISESNV  60
            MGNGGDW+ KPG+ TTH+ K GY +SF+PGQAGAD TYGHVA+VE +KEDGSI ISESNV
Sbjct: 452  MGNGGDWQRKPGFVTTHKPKVGYVVSFAPGQAGADATYGHVAVVEQIKEDGSILISESNV  511

Query:  61  LGLGTISYRTFSAAEAAQLTYVVGEK                                    86
            +GLGTISYRTF+A +A+ LTYVVG+K
Sbjct: 512  MGLGTISYRTFTAEQASLLTYVVGDK                                   537
```

Based on this analysis, it was predicted that these proteins and their epitopes could be useful antigens for vaccines or diagnostics.

Example 641

A DNA sequence (GBSx0681) was identified in *S. agalactiae* <SEQ ID 1985> which encodes the amino acid sequence <SEQ ID 1986>. This protein is predicted to be immunogenic secreted protein precursor. Analysis of this protein sequence reveals the following:

Possible site: 40
>>> Seems to have no N-terminal signal sequence
----- Final Results -----
   bacterial cytoplasm --- Certainty = 0.2495 (Affirmative) <succ>
      bacterial membrane --- Certainty = 0.0000 (Not Clear) <succ>
         bacterial outside --- Certainty = 0.0000 (Not Clear) <succ>

The protein has homology with the following sequences in the GENPEPT database:

```
AAB52379 GB:U31811 immunogenic secreted protein precursor [Streptococcus pyogenes]
Identities = 133/259 (5126), Positives = 170/259 (65.%), Gaps = 4/259 (196)
Query:   3  PSQPQVTATPQKSEVVTPAITSGIDLPDVAIPTAMASAAYVKHWIGNDAYTHNLLSHRYG     62
            P QP + A    + V  P    S  DL  +  P++ +SAAYV+HW G+ AYTHNLLS RYG
Sbjct: 174  PIQPPLGAA---APVFAPWRESDKDLSKLK-PSSRSSAAYVRHWTGDSAYTHNLLSRRYG    229

Query:  63  ITAAQLDGFLQSTGITYDSSRIDGQKILDREKSSGLDARAIIAIAIAESSLGTQGVATAP    122
            ITA QLDGFL S GI YD  R++G+++L+  EK +GLD RAI+AIA+AESSLGTQGVA
Sbjct: 230  ITAEQLDGFLNSLGIHYDKERLNGKRLLEWEKLTGLDVRAIVAIAMAESSLGTQGVAKEK    289

Query: 123  GANMFGFGAVDNNTTNAQNFSDDKAVIKMTQETIIQNQNTSFAIQDQKAQFLSTGNLNVA    182
            G+NMFG+GA D N  NA+ +SD+ A+  M ++TII N+N +F  QD KA+  S G L+
Sbjct: 290  GSNMFGYGAFDENPNNAKKYSDEVAIRHMVEDTIIANKNQTFERQDLKAKKWSLGQLDTL    349

Query: 183  ARGGVYFTDASGSGKRRAAIMESIDKWIDAHGGISEISKELLNTSSVAMMAVPTSYSVSR    242
               GGVYFTD SGSG+RRA IM  +D+WID HG    +I + L  TS      VP Y S+
Sbjct: 350  IDGGVYFTDTSGSGQRRADIMTKLDQWIDDHGNTPDIPEHLKITSGTQFSEVPVGYKRSQ    409

Query: 243  ANQAGNYVAGTYPWGQRTW                                            261
              Y + TY +GQ TW
Sbjct: 410  PQNVLTYKSETYSFGQCTW                                            428
```

A related DNA sequence was identified in *S. pyogenes* <SEQ ID 1987> which encodes the amino acid sequence <SEQ ID 1988>. Analysis of this protein sequence reveals the following:

Possible site: 22
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

An alignment of the GAS and GBS proteins is shown below:

```
Identities = 143/265 (53%), Positives = 184/265 (68%), Gaps = 5/265 (1%)
Query:   2  VPSQPQVTATPQKSEVVTPA-----ITSGIDLPDVAIPTAMASAAYVKHWIGNDAYTHNL     56
            V + P  + + Q  E  TP      S +DL ++ IP+    AAYV+HW G +AYTH+L
Sbjct: 135  VDTAPASSLSKQLPEARTPIQSLSPYVSDLDLSEIDIPSVNTYAAYVEHWSGKNAYTHHL    194

Query:  57  LSHRYGITAAQLDGFLQSTGITYDSSRIDGQKILDREKSSGLDARAIIAIAIAESSLGTQ    116
            LS RYGI A Q+D +L+STGI YDS+RI+G+K+L   EK SGLD RAI+AIA++ESSLGTQ
Sbjct: 195  LSRRYGIKADQIDSYLKSTGIAYDSTRINGEKLLQWEKKSGLDVRAIVAIAMSESSLGTQ    254

Query: 117  GVATAPGANMFGFGAVDNNTTNAQNFSDDKAVIKMTQETIIQNQNTSFAIQDQKAQFLST    176
            G+AT  GANMFG+ A D + T A  F+DD A++KMTQ+TII+N+N++FA+QD KA    S
Sbjct: 255  GIATLLGANMFGYAAFDLDPTQASKFNDDSAIVKMTQDTIIKNKNSNFALQDLKAAKFSR    314

Query: 177  GNLNVAARGGVYFTDASGSGKRRAAIMESIDKWIDAHGGISEISKELLNTSSVAMMAVPT    236
            G LN A+ GGVYFTD +GSGKRRA IME +DKWID HGG    I   EL    SS +  +VP
Sbjct: 315  GQLNFASDGGVYFTDTTGSGKRRAQIMEDLDKWIDDHGGTPAIPAELKVQSSASFASVPA    374

Query: 237  SYSVSRANQAGNYVAGTYPWGQRTW                                     261
             Y +S++       Y A +Y WGQ TW
Sbjct: 375  GYKLSKSYDVLGYQASSYAWGQCTW                                     399
```

Example 642

A DNA sequence (GBSx0682) was identified in *S. agalactiae* <SEQ ID 1989> which encodes the amino acid sequence <SEQ ID 1990>. Analysis of this protein sequence reveals the following:

---
Possible site: 27
>>> Seems to have a cleavable N-term signal seq.
----- Final Results -----
   bacterial outside --- Certainty = 0.3000 (Affirmative) <succ>

-continued bacterial membrane --- Certainty = 0.0000 (Not Clear) <succ>
   bacterial cytoplasm --- Certainty = 0.0000 (Not Clear) <succ>

---

The protein has no significant homology with any sequences in the GENPEPT database.

No corresponding DNA sequence was identified in *S. pyogenes*.

A related GBS gene <SEQ ID 8627> and protein <SEQ ID 8628> were also identified. Analysis of this protein sequence reveals the following:

---
Lipop: Possible site: −1   Crend: 4
McG: Discrim Score: 11.56
GvH: Signal Score (−7.5): 0.870001
Possible site: 27
>>> Seems to have a cleavable N-term signal seq.
ALOM program   count: 0 value: 11.88 threshold: 0.0
PERIPHERAL               Likelihood = 11.88      63
modified ALOM score: −2.88
*** Reasoning Step: 3
----- Final Results -----
   bacterial outside --- Certainty = 0.3000 (Affirmative) <succ>
     bacterial membrane --- Certainty = 0.0000 (Not Clear) <succ>
       bacterial cytoplasm --- Certainty = 0.0000 (Not Clear) <succ>

---

SEQ ID 8628 (GBS159) was expressed in *E. coli* as a His-fusion product. SDS-PAGE analysis of total cell extract is shown in FIG. 28 (lane 4; MW 26 kDa). It was also expressed in *E. coli* as a GST-fusion product. SDS-PAGE analysis of total cell extract is shown in FIG. 34 (lane 2; MW 41 kDa).

GBS159-GST was purified as shown in FIG. 198, lane 9.

Based on this analysis, it was predicted that these proteins and their epitopes could be useful antigens for vaccines or diagnostics.

Example 643

A DNA sequence (GBSx0683) was identified in *S. agalactiae* <SEQ ID 1991> which encodes the amino acid sequence <SEQ ID 1992>. Analysis of this protein sequence reveals the following:

---
Possible site: 32
>>> Seems to have no N-terminal signal sequence
----- Final Results -----
   bacterial cytoplasm --- Certainty = 0.2668 (Affirmative) <succ>
     bacterial membrane --- Certainty = 0.0000 (Not Clear) <succ>
       bacterial outside --- Certainty = 0.0000 (Not Clear) <succ>

---

The protein has homology with the following sequences in the GENPEPT database:

```
>GP:BAB04699 GB:AP001510 unknown conserved protein [Bacillus halodurans]
Identities = 32/76 (42%), Positives = 54/76 (70%)
Query:  7  LGSVIELKNDSQKVMITSRFPLYDNEGQLGYFDYSGCIFPISIVGNETYFFNLEDIDKVL   66
           +GS++ LK   + K+MI +R P+  +   G+   FDYSGC +P  +V ++ ++FN E+ID+V+
Sbjct:  4  IGSIVYLKEGTSKLMILNRGPILEANGENKMFDYSGCFYPQGLVPDKVEYFNHENIDEVV   63

Query: 67  FEGYYDENEEEMQKIF                                              82
           FEG+ D+ E+   QK+F
Sbjct: 64  FEGFQDDEEQRFQKLF                                              79
```

No corresponding DNA sequence was identified in *S. pyogenes*.

Based on this analysis, it was predicted that this protein and its epitopes, could be useful antigens for vaccines or diagnostics.

Example 644

A DNA sequence (GBSx0684) was identified in *S. agalactiae* <SEQ ID 1993> which encodes the amino acid sequence <SEQ ID 1994>. Analysis of this protein sequence reveals the following:

---
Possible site: 32
>>> Seems to have no N-terminal signal sequence
INTEGRAL     Likelihood = −14.81   Transmembrane 75-91 (69-99)
INTEGRAL     Likelihood = −14.38   Transmembrane 134-150 (129-179)
INTEGRAL     Likelihood = −8.49     Transmembrane 157-173 (151-179)
INTEGRAL     Likelihood = −1.17     Transmembrane 50-66 (46-67)
----- Final Results -----
   bacterial membrane --- Certainty = 0.6922 (Affirmative) <succ>
     bacterial outside --- Certainty = 0.0000 (Not Clear) <succ>
       bacterial cytoplasm --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 645

A DNA sequence (GBSx0685) was identified in *S. agalactiae* <SEQ ID 1995> which encodes the amino acid sequence <SEQ ID 1996>. Analysis of this protein sequence reveals the following:

```
Possible site: 35
>>> Seems to have no N-terminal signal sequence
INTEGRAL    Likelihood = –0.11    Transmembrane 40-56 (40-56)
----- Final Results -----
   bacterial membrane --- Certainty = 0.1044 (Affirmative) <succ>
      bacterial outside --- Certainty = 0.0000 (Not Clear) <succ>
         bacterial cytoplasm --- Certainty = 0.0000 (Not Clear) <succ>
```

The protein has no significant homology with any sequences in the GENPEPT database.

No corresponding DNA sequence was identified in *S. pyogenes*.

Figure 53:
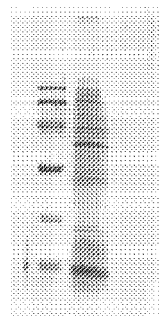
Figure 54:
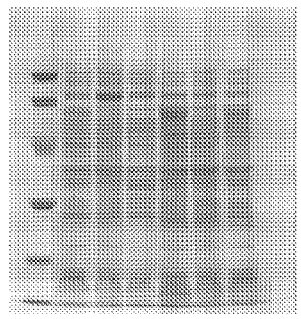

SEQ ID 1996 (GBS204) was expressed in *E. coli* as a His-fusion product. SDS-PAGE analysis of total cell extract is shown in FIG. 49 (lane 13; MW 32 kDa) and FIG. 53 (lane 2; MW 14.7 kDa). It was also expressed in *E. coli* as a GST-fusion product. SDS-PAGE analysis of total cell extract is shown in FIG. 54 (lane 6; MW 39.7 kDa).

Based on this analysis, it was predicted that this protein and its epitopes, could be useful antigens for vaccines or diagnostics.

Example 646

A DNA sequence (GBSx0686) was identified in *S. agalactiae* <SEQ ID 1997> which encodes the amino acid sequence <SEQ ID 1998>. Analysis of this protein sequence reveals the following:

```
Possible site: 38
>>> Seems to have no N-terminal signal sequence (or signal = aa 1-26)
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the GENPEPT database:

```
>GP:CAC16670 GB:AJ302698 hypothetical protein [Staphylococcus haemolyticus]
Identities = 60/254 (23%), Positives = 109/254 (42%), Gaps = 14/254 (5%)
Query:   2   VKVSVSSVGTQASTVAISMESRVSALNDAITKLSSFAEAATLQGTAYSNAKSYATGTLTP    61
             + + V   +Q+S V  ++ S  S  +     + F  A+ LQG AY + K + +  + P
Sbjct:   3   IDMYVGKSKSQSSDVGSTVKSISSGYDSLQKGIMQFVGASELQGQAYDSGKQFFSAVIAP    62

Query:  62   MLQGMILFSETLSEKCTELQTLYVSICGDEDLDSVVLESKLASDRASLKIAEALLEHLND   121
             + + +    E   + C +   Y S    + L     L  +       + EA+      L
Sbjct:  63   LTESIKTLGELTEQACNDFVDQYQSEVDSQSLKESELLEDIEELNKQISQLEAMNASLKH   122

Query: 122   DPEPSKSAISSTKSNIKKLKKRIKSNQKKLDNLNEFNAHSATVFADISNAQSTVNQALAA   181
                 + S  +S       I   L+++  K   ++KL   L +F+A S   +F  ++  + Q  TV  Q +
Sbjct: 123   KSSKNSSLLSGNHQMISSLEQQKKELEEKLRKLRQFDAKSPNIFKEVESFQKTVQQGINQ   182

Query: 182   VSTGFSGYNSKTGAFGKPTSGQMEWTKTVKKNWKEREDAKAEELKSKKAEESKKASKIEN   241
                  T   ++       F     P      MEW K   ++    E       K +++  ++KA++  KK  SK +
Sbjct: 183   ART---AWDPGKQTFNIPAGKDMEWAKVSQQKALE---VKMDKI-NQKAKDGKKLSKNDI   235

Query: 242   TT-------KKSNV                                                248
             T          KKSN+
Sbjct: 236   FTIIAYQQQKKSNI                                                249
```

No corresponding DNA sequence was identified in *S. pyogenes*.

SEQ ID 1998 (GBS270) was expressed in *E. coli* as a His-fusion product. SDS-PAGE analysis of total cell extract is shown in FIG. 51 (lane 2; MW 34.3 kDa). It was also expressed in *E. coli* as a GST-fusion product. SDS-PAGE analysis of total cell extract is shown in FIG. 54 (lane 7; MW 59.2 kDa).

Figure 265:
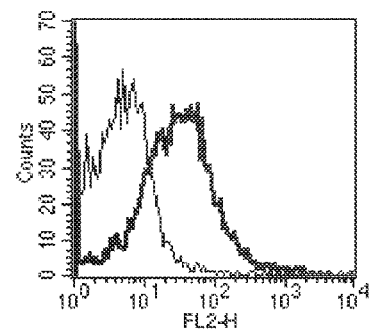

The GBS270-GST fusion product was purified (FIG. 206, lane 3) and used to immunise mice. The resulting antiserum was used for FACS (FIG. 265), which confirmed that the protein is immunoaccessible on GBS bacteria.

Based on this analysis, it was predicted that this protein and its epitopes, could be useful antigens for vaccines or diagnostics.

Example 647

A DNA sequence (GBSx0687) was identified in *S. agalactiae* <SEQ ID 1999> which encodes the amino acid sequence <SEQ ID 2000>. This protein is predicted to be outer surface protein F. Analysis of this protein sequence reveals the following:

```
Possible site: 23
>>> Seems to have no N-terminal signal sequence
----- Final Results -----
   bacterial cytoplasm --- Certainty = 0.3323 (Affirmative) <succ>
      bacterial membrane --- Certainty = 0.0000 (Not Clear) <succ>
         bacterial outside --- Certainty = 0.0000 (Not Clear) <succ>
```

The protein has no significant homology with any sequences in the GENPEPT database.

No corresponding DNA sequence was identified in *S. pyogenes*.

SEQ ID 2000 (GBS316) was expressed in *E. coli* as a His-fusion product. SDS-PAGE analysis of total cell extract is shown in FIG. 51 (lane 3; MW 23 kDa). It was also expressed in *E. coli* as a GST-fusion product. SDS-PAGE analysis of total cell extract is shown in FIG. 55 (lane 2; MW 41.8 kDa).

GBS316-GST was purified as shown in FIG. 206, lane 4.

Based on this analysis, it was predicted that this protein and its epitopes, could be useful antigens for vaccines or diagnostics.

Example 648

A DNA sequence (GBSx0688) was identified in *S. agalactiae* <SEQ ID 2001> which encodes the amino acid sequence <SEQ ID 2002>. This protein is predicted to be actin-like protein arp3 (act4). Analysis of this protein sequence reveals the following:

```
Possible site: 17
>>> Seems to have no N-terminal signal sequence
----- Final Results -----
  bacterial cytoplasm --- Certainty = 0.0217 (Affirmative) <succ>
    bacterial membrane --- Certainty = 0.0000 (Not Clear) <succ>
      bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 649

A DNA sequence (GBSx0689) was identified in *S. agalactiae* <SEQ ID 2003> which encodes the amino acid sequence <SEQ ID 2004>. This protein is predicted to be diarrheal toxin. Analysis of this protein sequence reveals the following:

```
Possible site: 25
>>> Seems to have no N-terminal signal sequence
INTEGRAL    Likelihood = -8.65    Transmembrane 65-81 (61-84)
INTEGRAL    Likelihood = -3.98    Transmembrane 89-105 (85-106)
----- Final Results -----
  bacterial membrane --- Certainty = 0.4461 (Affirmative) <succ>
    bacterial outside --- Certainty = 0.0000 (Not Clear) <succ>
      bacterial cytoplasm --- Certainty = 0.0000 (Not Clear) <succ>
```

The protein has homology with the following sequences in the GENPEPT database:

```
>GP:CAB15175 GB:Z99120 alternate gene name: yueA~similar to hypothetical
proteins [Bacillus subtilis]
Identities = 452/1058 (42%), Positives = 664/1058 (62%), Gaps = 39/1058 (3%)
Query:  98    VTMIFSITGYFKNRKQYKQDLQERIDSYHDYLSDKSIELQKLAKEQKRGQHYHYPTIEGL    157
              +T+I S   YF+++ Q K+  ++R   Y  YL +K  ELQ LA++QK+   +H+P+ E +
Sbjct:  1     MTLITSTVQYFRDKNQRKKREEKRERVYKLYLDNKRKELQALAEKQKQVLEFHFPSFEQM    60

Query:  158   QEMADTYHHRIYEKTPLHEDFLYYRLGLGEVPTSYNIHYSQPERSGKK-DPLENEGYNLY    216
              + +         RI+EK+    D+L  RLG G VP+SY I+ S   + +   D L  + ++
Sbjct:  61    KYLTSEISDRIWEKSLESKDYLQLRLGTGTVPSSYEINMSGGDLANRDIDDLMEKSQHMQ    120

Query:  217   FNNRYIKNMPIVANLSHGPVGYIGPRGLVLEQLQLMVNQLAFFHSYHDVQFITIVPEEEM    276
                + I+N P+  +L+ GP+G  +G    +V  ++  ++  QL+FF+SYHD++F  +I   EEE
Sbjct:  121   RVYKDIRNAPVTVDLAEGPMGLVGKSQIVYNEIHQLIGQLSFFNSYHDLRFVFIFHEEEY    180

Query:  277   DKWSWMRWLPHETLQDVNVRGFVYNQRSRDQVLNSLNQILKLRRTQREDKSAKEGTLFSP    336
              ++ WM+ +P  + +  +GF+YN+++RDQ+L+SL ++++     +R+ +  KE    F P
Sbjct:  181   KDWEWMKCVPQFQMPHIYAKGFIYNEQTRDQLLSSLYELIR----ERDLEDDKEKLQFKP    236

Query:  337   HYVVIVTDEKLILDHVIMEFFTEDPTELGCSLIFVQDVMSSLSENIKTIINIKDRNTGQL    396
              H+V ++T+++LI +HVI        LG  S I       SLSENI  T++    + G +
Sbjct:  237   HFVFVITNQQLISEHVILEYLEGQHEHLGISTIVAAETKESLSENITTLVRYINEHEGDI    296

Query:  397   VIEEGELKETDFELDHFLEDYDKENISRRLAPLNHLQNLKSSIPEAVTFMEMYQAEEFED    456
              +I++ +        F LDH   + D E   SR L   LNH    + +SIPE V+F+E++  A+E ++
Sbjct:  297   LIQKKKAVRIPFRLDHHQRE-DNERFSRTLRTLNHQVGITNSIPETVSFLELFHAKEVRE    355

Query:  457   LHVQERWISHAPYKSSAVPLGLRGQDDIVYLNLHEKAHGPHGLVAGTTGSGKSEIIQSYI    516
              + +Q+RW++      KS +VP+G +G+DDIVYLNLHEKAHGPHGL+AGTTGSGKSE +Q+YI
Sbjct:  356   IGIQQRWLTSESSKSLSVPIGYKGKDDIVYLNLHEKAHGPHGLLAGTTGSGKSEFLQTYI    415

Query:  517   LSLAVNFHPHDVAFLLIDYKGGGMANLFKDLPHLLGTITNLDGAQ--SMRALVSINAELK    574
              LSLAV+FHPH+ AFLLIDYKGGGMA  F+++PHLLGTITN++G++   SMRAL SI +ELK
Sbjct:  416   LSLAVHFHPHLEAAFLLIDYKGGGMAQPFRNIPHLLGTITNIEGSKNFSMRALASIKSELK    475

Query:  575   RRQRLFAKADVNHINQYQKKYKLGEVSEPMPHLFLISDEFAELKSNQPEFMKELVSTARI    634
              +RQRLF +   VNHIN Y K YK G+      MPHLFLISDEFAELKS +P+F++ELVS ARI
Sbjct:  476   KRQRLFDQYQVNHINDYTKLYKQGKAEVAMPHLFLISDEFAELKSEEPDFIRELVSAARI    535

Query:  635   GRSLGIHLILATQKPSGVVDDQIWSNSRFKLALKVADRGDSMEMLHTPDAAEITQAGRAY    694
              GRSLG+HLILATQKP G++DDQIWSNSRFK+ALKV D  DS E+L   DAA IT  GR Y
Sbjct:  536   GRSLGVHLILATQKPGGIIDDQIWSNSRFKVALKVQDATDSKEILKNSDAANITVTGRGY    595

Query:  695   LQVGNNEVYELFQSAWSGADYQPEKDDQGIEDHTIYSINDLGQYEILNDDLSGLDQAENI    754
              LQVGNNEVYELFQSAWSGA  Y  E      GED  I  +D G   L     S +D  +N
Sbjct:  596   LQVGNNEVYELFQSAWSGAPYLEEV--YGTEDE-IAIVTDTGLI-----PLSEVDTEDNA    647

Query:  755   -KEVPTELDAIVENIQALTKEMGISDLPQPWLPPLSNQIAVTDLRKEGSVDLWSKAPSYK    813
               K+V TE++A+V+ I+ +   EMGI  LP PWLPPL+ +I   T        L+
Sbjct:  648   KKDVQTEIEAVVDEIERIQDEMGIEKLPSPWLPPLAERIPRT---------LFPSNEKDH    698

Query:  814   AVLGEMDIPSQQAQEVAYHDFEDDGHLSIFAGPSMGKSTALQTVTMDLARHNSPEFLNLY    873
                ++D P Q Q       +  +DG++ IF     GKS A   T   M   A   +PE L++Y
Sbjct:  699   FHEAYVDEPDLQRQAPIAYKMMEDGNIGIFGSSGYGKSIAAATFLMSFADVYTPEELHVY    758
```

-continued

```
Query:  874  LFDFGTNGLLPLARLPHVADFFTIDDDEKIAKFIARIKVEMSDRKKALSRYNVATAKLYR    933
             +FDFG   LLPL +LPH AD+F +D    KI KF+ RIK E+  RK+         ++  K+Y
Sbjct:  759  IFDFGNGTLLPLAKLPHTADYFLMDQSRKIEKFMIRIKEEIDRRKRLFREKEISHIKMYN    818

Query:  934  QVSGETMPQILIVIDSYEGLREAQTPTNLEACFQNISRDGSSLGISLVISAGRTAALRSS    993
             +S E +P I I ID+++ +++     LE+F  +SRDG SLGI  +++A R A+ R S
Sbjct:  819  ALSEEELPFIFITIDNEDIVKDEM--HELESEFVQLSRDGQSLGIYFMLTATRVNAVRQS    876

Query:  994  LMANLKERIALKLTDDSESRTLVGRHQHIMEDIPGRGLIKRDDIEVLQVALSTEGTETFD   1053
             L+ NLK +I   L D SE ++  GR +  +E IPGR +I+++++    Q+ L  +   +
Sbjct:  877  LLNNLKTKIVHYLMDQSEGYSIYGRPKFNLEPIPGRVIIQKEELYFAQMFLPVDADDDIG    936

Query: 1054  IINNIQNESDAMNSKWTG-PRPKAIPIVPEELTFDDFMATDSVQADLSANRL--PLGLEM   1110
             + N ++++   + ++   +P  IP++PE L+  +    S++ L    L  P+GL
Sbjct:  937  MFNELKSDVQKLQGRFASMEQPAPIPMLPESLSTREL----SIRFKLERKPLSVPIGLHE    992

Query: 1111  VDVESYSLALNRFKHMLYMSDSDESLEAVGSHIIKVLL                        1148
              V        L + KH L +  +         ++++KV+L
Sbjct:  993  ETVSPVYFDLGKHKHCLILGQTQRG----KTNVLKVML                       1026
```

There is also homology to SEQ ID 24.

A related GBS gene <SEQ ID 8629> and protein <SEQ ID 8630> were also identified. Analysis of this protein sequence reveals the following:

Homology to a bacterial toxin

The protein has homology with the following sequences in the databases:

```
>OMNI|NT01BS3725 diarrheal toxin
Score = 203 bits (511), Expect = 4e-51
Identities = 123/377 (32%), Positives = 198/377 (51%), Gaps = 22/377 (5%)
Query:    1  MGISDLPQPWLPPLSNQIAVTDLRKEGSVDLWSKAPSYKAVLGFMDIPSQQAQEVAYHDF     60
             MGI  LP PWLPPL+ +I  T        L+      ++D P  Q  Q     +
Sbjct:  704  MGIEKLPSPWLPPLAERIPRT---------LFPSNEKDHFHFAYVDEPDLQRQAPIAYKM    754

Query:   61  EDDGHLSIFAGPSMGKSTALQTVTMDLARHNSPEFLNLYLFDFGTNGLLPLRRLPHVADF    120
             +DG++  IF G     KS A  T  M  A   +PE L++Y+FDFG  LLPL +LPH AD+
Sbjct:  755  MEDGNIGIFGSSGYGKSIAAATFLMSFADVYTPEELHVYIFDFGNGTLLPLAKLPHTADY    814

Query:  121  FTIDDDEKIAKFIARIKVEMSDRKKALSRYNVATAKLYRQVSGETMPQILIVIDSYEGLR    180
             F +D    KI KF+ RIK E+  RK+        ++    K+Y +S E +P I I ID+++ ++
Sbjct:  815  FLMDQSRKIEKFMIRIKEEIDRRKRLFREKEISHIKMYNALSEEELPFIFITIDNFDIVK    874

Query:  181  EAQTPTNLEACFQNISRDGSSLGISLVISAGRTAALRSSLMANLKERIALKLTDDSESRT    240
             +       LE+ F  +SRDG SLGI  +++A R  A+R SL++ NLK +I  L   D SE  +
Sbjct:  875  DEM--HELESEFVQLSRDGQSLGIYFMLTATRVNAVRQSLLNNLKTKIVHYLMDQSEGYS    932

Query:  241  LVGRHQHIMEDIPGRGLIKRDDIEVLQVALSTEGTETFDIINNIQNESDAMNSKWTG-PR    299
             + GR +  +E IPGR +I+++++    Q+ L   +  +  + N ++++   + ++    +
Sbjct:  933  IYGRPKFNLEPIPGRVIIQKEELYFAQMFLPVDADDDIGMFNELKSDVQKLQGRFASMEQ    992

Query:  300  PKAIPIVPEELTFDDFMATDSVQADLSANRL--PLGLEMVDVESYSLALNRFKHMLYMSD    357
             P   IP++PE L+  +    S++ L    L  P+GL V         L   + KH L +
Sbjct:  993  PAPIPMLPESLSTREL----SIRFKLERKPLSVPIGLHEETVSPVYFDLGKHKHCLILGQ   1048

Query:  358  SDESLEAVGSHIIKVLL                                              374
             +                ++++KV+L
Sbjct: 1049  TQRG----KTNVLKVML                                             1061
```

Figure 65:
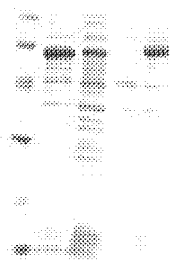

SEQ ID 8630 (GBS326) was expressed in *E. coli* as a His-fusion product. SDS-PAGE analysis of total cell extract is shown in FIG. 65 (lane 5; MW 66 kDa). It was also expressed in *E. coli* as a GST-fusion product. SDS-PAGE analysis of total cell extract is shown in FIG. 71 (lane 5; MW 91 kDa).

Figure 212:
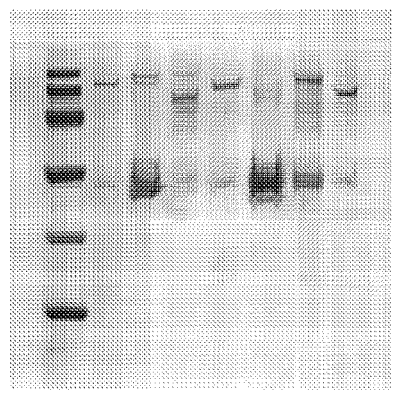

GBS326-GST was purified as shown in FIG. 212, lane 5.

Figure 127:
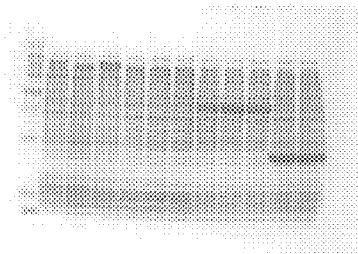
Figure 184:
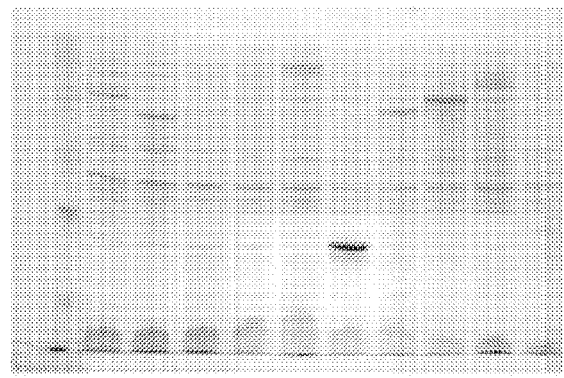

GBS326LN was expressed in *E. coli* as a GST-fusion product. SDS-PAGE analysis of total cell extract is shown in FIG. 127 (lane 2-4; MW 114 kDa). It was also expressed in *E. coli* as a GST-fusion product. SDS-PAGE analysis of total cell extract is shown in FIG. 184 (lane 6; MW 114 kDa). The purified protein is shown in FIG. 236, lane 12.

Based on this analysis, it was predicted that these proteins and their epitopes could be useful antigens for vaccines or diagnostics.

Example 650

A DNA sequence (GBSx0690) was identified in *S. agalactiae* <SEQ ID 2005> which encodes the amino acid sequence <SEQ ID 2006>. Analysis of this protein sequence reveals the following:

---

Possible site: 16
>>> Seems to have no N-terminal signal sequence
----- Final Results -----
    bacterial cytoplasm --- Certainty = 0.2693 (Affirmative) <succ> bacterial membrane --- Certainty = 0.0000 (Not Clear) <succ>
bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 651

A DNA sequence (GBSx0691) was identified in *S. agalactiae* <SEQ ID 2007> which encodes the amino acid sequence <SEQ ID 2008>. Analysis of this protein sequence reveals the following:

Possible site: 38
>>> Seems to have no N-terminal signal sequence
----- Final Results -----
bacterial cytoplasm --- Certainty = 0.3933 (Affirmative) <succ>
bacterial membrane --- Certainty = 0.0000 (Not Clear) <succ>
bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 652

A DNA sequence (GBSx0692) was identified in *S. agalactiae* <SEQ ID 2009> which encodes the amino acid sequence <SEQ ID 2010>. Analysis of this protein sequence reveals the following:

Possible site: 55
>>> Seems to have no N-terminal signal sequence
INTEGRAL    Likelihood = −7.32    Transmembrane 225-241 (219-246)
----- Final Results -----
bacterial membrane --- Certainty = 0.3930 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the GENPEPT database:

```
>GP:BAB04693 GB:AP001510 unknown conserved protein [Bacillus halodurans]
Identities = 83/320 (25%), Positives = 162/320 (49%), Gaps = 1/320 (0%)

Query:   103  VNFILHPSNLFLTKNATAKIAYRSLPGIMRPEKFGPEEFLYQFKCFVFALLTQHDYIELY   162
              ++ I+ P N+ ++      + +   +P + PE    ++ +  LL  +        Y
Sbjct:   106  LHLIVSPENVLVSDGLDVTFIHYGVKDSIPPYETDPERLFLELRATLLVLLDGNHRFHEY   165

Query:   163  NGAISVIEVSDFLKSIYHAETIQAVRDIITIDYEQQVEVETHTLAKVSRAKYKLYKYISV   222
                +++S     KS+      T++ +R++I   + Q+ E +    L KV + K+ + K+ +
Sbjct:   166  MNYHDTLKLSPEAKSLVQQTTLEGLRELIR-HWIQEHEQQEKQLHKVPKTKWTIQKWAGI   224

Query:   223  WLGALSTILLIPLVYLVFIHNPFKEKMLAADTSFIKVDYNQVINRLEHVKVSKLPYTQKY   282
              L A     +I +VY++      P +E   A+  +++    +Y+QVI+ LE     + +P      KY
Sbjct:   225  GLIAALVPAIIYIVYVLAFLQPRQEAFTASHAAYLNENYSQVIDTLEPYSPNSMPRVVKY   284

Query:   283  ELAYSYINGMSFSEEQREVILNNVTLKTDELYLDYWINIGRGLDDDAIDAAKRLDDSDLV   342
              +LA SY+             RE + N + L+   E Y DYWI  IGRG ++ AID A+ L D + +
Sbjct:   285  QLAQSYVAIEPLQAYHRENLKNVLVLQAAESYFDYWIAIGRGENEKAIDIARGLQDKEWL   344

Query:   343  IYAIVQKMDQVRKDNSLSGKDREQKLSELQTDYDKYWKDRKTALTDEESKSKNSNNHSTN   402
              +YA V++ ++V+ D +LSGK+RE   + E+++ + D Y ++ +     + E+    N+     ++N
Sbjct:   345  VYANVKRREEVKSDENLSGKEREDLIKEIRAEIDDYMRELEELAEEGEAFQPNAEPAASN   404

Query:   403  SNKESSESSSTTASTSSKTK                                           422
              +E    +      S + + K
Sbjct:   405  ELEEDEGDTEEDDSDNQEAK                                           424
```

No corresponding DNA sequence was identified in *S. pyogenes*.

SEQ ID 2010 (GBS337) was expressed in *E. coli* as a His-fusion product. SDS-PAGE analysis of total cell extract is shown in FIG. 62 (lane 3; MW 50.3 kDa).

Based on this analysis, it was predicted that this protein and its epitopes, could be useful antigens for vaccines or diagnostics.

Example 653

A DNA sequence (GBSx0693) was identified in *S. agalactiae* <SEQ ID 2011> which encodes the amino acid sequence <SEQ ID 2012>. Analysis of this protein sequence reveals the following:

Possible site: 27
>>> Seems to have a cleavable N-term signal seq.
INTEGRAL    Likelihood = −14.01    Transmembrane 131-147 (122-153)
----- Final Results -----

A related GBS nucleic acid sequence <SEQ ID 8631> which encodes amino acid sequence <SEQ ID 8632> was also identified. Analysis of this protein sequence reveals the following:

```
Lipop: Possible site: −1    Crend: 8
McG: Discrim Score: 13.38
GvH: Signal Score (−7.5): −1.25
Possible site: 23
>>> Seems to have a cleavable N-term signal seq.
ALOM program count: 1  value: −14.01  threshold: 0.0
INTEGRAL      Likelihood = −14.01   Transmembrane 127-143 (118-149)
PERIPHERAL    Likelihood = 16.13    113
modified ALOM score: 3.30
*** Reasoning Step: 3
----- Final Results -----
   bacterial membrane --- Certainty = 0.6604 (Affirmative) <succ>
      bacterial outside --- Certainty = 0.0000 (Not Clear) <succ>
         bacterial cytoplasm --- Certainty = 0.0000 (Not Clear) <succ>
```

The protein has no significant homology with any sequences in the GENPEPT database.

No corresponding DNA sequence was identified in *S. pyogenes*.

SEQ ID 8632 (GBS140) was expressed in *E. coli* as a GST-fusion product. SDS-PAGE analysis of total cell extract is shown in FIG. 32 (lane 3; MW 43 kDa). It was also expressed in *E. coli* as a His-fusion product. SDS-PAGE analysis of total cell extract is shown in FIG. 49 (lane 8; MW 18 kDa).

Based on this analysis, it was predicted that these proteins and their epitopes could be useful antigens for vaccines or diagnostics.

Example 654

A DNA sequence (GBSx0694) was identified in *S. agalactiae* <SEQ ID 2013> which encodes the amino acid sequence <SEQ ID 2014>. Analysis of this protein sequence reveals the following:

```
Possible site: 15
>>> Seems to have no N-terminal signal sequence
----- Final Results -----
   bacterial cytoplasm --- Certainty = 0.1486 (Affirmative) <succ>
      bacterial membrane --- Certainty = 0.0000 (Not Clear) <succ>
         bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 655

A DNA sequence (GBSx0695) was identified in *S. agalactiae* <SEQ ID 2015> which encodes the amino acid sequence <SEQ ID 2016>. Analysis of this protein sequence reveals the following:

```
Possible site: 32
>>> Seems to have an uncleavable N-term signal seq
INTEGRAL    Likelihood = −14.59   Transmembrane 984-1000 (976-1009)
INTEGRAL    Likelihood = −9.71    Transmembrane 19-35 (15-42)
INTEGRAL    Likelihood = −9.50    Transmembrane 872-888 (865-890)
INTEGRAL    Likelihood = −6.37    Transmembrane 927-943 (924-951)
INTEGRAL    Likelihood = −4.19    Transmembrane 831-847 (828-847)
INTEGRAL    Likelihood = −2.87    Transmembrane 899-915 (899-916)
----- Final Results -----
   bacterial membrane --- Certainty = 0.6838 (Affirmative) <succ>
      bacterial outside --- Certainty = 0.0000 (Not Clear) <succ>
         bacterial cytoplasm --- Certainty = 0.0000 (Not Clear) <succ>
```

A related GBS nucleic acid sequence <SEQ ID 8633> which encodes amino acid sequence <SEQ ID 8634> was also identified. Analysis of this protein sequence reveals the following:

```
Lipop Possible site: −1    Crend: 6
SRCFLG: 0
McG: Length of UR: 20
Peak Value of UR: 3.40
Net Charge of CR: 3
McG: Discrim Score: 13.67
GvH: Signal Score (−7.5): −3.27
Possible site: 21
>>> Seems to have an uncleavable N-term signal seq
Amino Acid Composition: calculated from 1
ALOM program count: 6 value: −14.59 threshold:0.0
INTEGRAL     Likelihood = −14.59   Transmembrane 973-989 (965-998)
INTEGRAL     Likelihood = −9.71    Transmembrane 8-24 (4-31)
INTEGRAL     Likelihood = −9.50    Transmembrane 861-877 (854-879)
INTEGRAL     Likelihood = −6.37    Transmembrane 916-932 (913-940)
INTEGRAL     Likelihood = −4.19    Transmembrane 820-836 (817-836)
INTEGRAL     Likelihood = −2.87    Transmembrane 888-904 (888-905)
PERIPHERAL   Likelihood = 3.82     936
modified ALOM score: 3.42
icml HYPID: 7    CFP: 0.684
*** Reasoning Step: 3
----- Final Results -----
   bacterial membrane --- Certainty = 0.6838 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the GENPEPT database:

```
>GP:AAB86324 GB:AE000938 phage infection protein homolog
[Methanothermobacter thermoautotrophicus]
Identities = 96/454 (21%), Positives = 190/454 (41%), Gaps = 63/454 (13%)

Query:    1   MLKIKYILGRIMKR-NNFRILWYIIAVALFLVAIAGLNLKLQGDHAKENKTTQSATNTKL    59
              M K   I  + MK    N  ++ ++IAV + + A+    +Q      ++T+        +
Sbjct:    1   MRKALEIFWKDMKTVKNSPVVLFVIAVIICIPALYAV-FNIQATLDPYSRTSS------I    53

Query:   60   NIALVNEDQNVSNGKESYNLGASYIKSIERDNSQNWSVVSRGTAQNGLDKGDYQLMVIIP   119
              +A+VNED            N+GA ++   ++  + +W    V R   A  +GL  KG Y   ++IIP
Sbjct:   54   EVAVVNEDMGADFNGTHLNVGAEFVSELRKNRNFDWQFVDRSDAMDGLRKGKYYAVLIIP    113
```

-continued

```
Query:   120  NNFSQKLLDVNKANAEQTTISYKVNAKGNLALEKKATEKEKDIVSELNSHLVNMYMASIL    179
              NFS  LL +      Q +I Y VN K N    +        + +++NS +V       +
Sbjct:   114  GNFSSDLLSIKNGTPRQASIKYMVNDKLNPVAPRITNAGADALQAKINSEVVKTIDGIVF    173

Query:   180  SNLYTAQENVQA---------MVNVQSGNISNYQKNLLDSATNF---QNIFPAL-----    221
              +  A E  +A          VN  +GN+     + L  + ++     QN++ +L
Sbjct:   174  GKISEAGELARANRDDILRTKRFVNELNGNLGKIDETLSTANSDLEKGQNLWSSLKTDLP    233

Query:   222  -VNQSSSSITANESLKKS-----------LEASDNMFNDLVTTQTNTGKDLSSL-----    263
               +  +++ +    SL +S              +++ ++  ++ +T+       L+SL
Sbjct:   234  EIRDNANFVKEKYSLLESYIGKDPAKALSTVQSMESHLSEAITSMKYLRAVLASLYSATG    293

Query:   264  -------IEQRHQDSISYEAFSTSLLEMNNELLEKQLSDIITQAQKDQETLSSQLNSIMG    316
                     I+Q   +      L  + ++L  K  +D I + +    + + S LN +M
Sbjct:   294  DPKLKTAIDQIDTNIEKASSVLGILQTIESDLKTKGTTDRIVKLKASIDRMDSALNKLMD    353

Query:   317  D-DNNHNHKENSSAYLNVARQKIQELSEALKSQDNIAKDQSEQLDKIVREGLASYFAKNN    375
              D     +++SA L +A  +    +  A+        +D S +L+ I   + L S     +
Sbjct:   354  SRDEIDAAMQDASAKLGIANARWPTMRSAI-------QDASRKLNMISDDDLNSLVKLAD    406

Query:   376  KDNITLLELLKSHSTNEK----TLKDFKAKVADF                              405
              D    + E  +S    EK       +K++ +  +A F
Sbjct:   407  IDPSAVREYFRSPVRMEKEHIYPVKNYGSALAPF                              440
```

SEQ ID 8634 (GBS250) was expressed in *E. coli* as a GST-fusion product. SDS-PAGE analysis of total cell extract is shown in FIG. 47 (lane 4; MW 136 kDa).

GBS250-GST was purified as shown in FIG. 203, lane 4.

Based on this analysis, it was predicted that these proteins and their epitopes could be useful antigens for vaccines or diagnostics.

Example 656

A DNA sequence (GBSx0696) was identified in *S. agalactiae* <SEQ ID 2019> which encodes the amino acid sequence <SEQ ID 2020>. Analysis of this protein sequence reveals the following:

Possible site: 39
>>> Seems to have no N-terminal signal sequence
----- Final Results -----
  bacterial cytoplasm --- Certainty = 0.5009 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database:

```
>GP:CAA46375 GB:X65276 ORFA1 [Clostridium acetobutylicum]
Identities = 35/91 (38%), Positives = 53/91 (57%)

Query:    1   MAQIKLTPEELRSSAQKYTAGSQQVTEVLNLLTQEQAVIDENWDGSTFDSFEAQFNELSP    60
              MAQI +TPEEL+S AQ Y    +++ + +  +      + I E W G  F ++  Q+N+L
Sbjct:    1   MAQISVTPEELKSQAQVYIQSKEEIDQAIQKVNSMNSTIAEEWKGQAFQAYLEQYNQLHQ    60

Query:   61   KITEFAQLLEDINQQLLKVADIIEQTDADIA                               91
              + +F  LLE +NQQL K AD + +  DA  A
Sbjct:   61   TVVQFENLLESVNQQLNKYADTVAERDAQDA                               91
```

No corresponding DNA sequence was identified in *S. pyogenes*.

Based on this analysis, it was predicted that this protein and its epitopes, could be useful antigens for vaccines or diagnostics.

Example 657

A DNA sequence (GBSx0697) was identified in *S. agalactiae* <SEQ ID 2021> which encodes the amino acid sequence <SEQ ID 2022>. Analysis of this protein sequence reveals the following:

Possible site: 22
>>> Seems to have no N-terminal signal sequence
----- Final Results -----
  bacterial cytoplasm --- Certainty = 0.3741 (Affirmative) <succ>
  bacterial membrane --- Certainty = 0.0000 (Not Clear) <succ>
  bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 658

A repeated DNA sequence (GBSx0698) was identified in *S. agalactiae* <SEQ ID 2023> which encodes the amino acid sequence <SEQ ID 2024>. This protein is predicted to be carbamoylphosphate synthetase (carB). Analysis of this protein sequence reveals the following:

Possible site: 23
>>> Seems to have a cleavable N-term signal seq.
INTEGRAL    Likelihood = −1.33    Transmembrane 807-823 (807-823)
----- Final Results -----
    bacterial membrane --- Certainty = 0.1532 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database:

```
>GP:CAA03928 GB:AJ000109 carbamoylphosphate synthetase [Lactococcus lactis]
Identities = 771/1062 (72%), Positives = 901/1062 (84%), Gaps = 5/1062 (0%)

Query:     1 MPKRTDIRKIMVIGSGPIVIGQAAEFDYSGTQACLSLKEEGYQVVLVNSNPATIMTDKDI    60
             MPKR DI+KIM+IGSGPI+IGQAAEFDY+GT+ACL+LKEEGY+VVLVNSNPATIMTD++I
Sbjct:     1 MPKRNDIKKIMIIGSGPIIIGQAAEFDYAGTEACLALKEEGYEVVLVNSNPATIMTDREI    60

Query:    61 ADKVYIEPITLEFVTRILRKERPDALLPTLGGQTGLNMAMALSKNGILEELNVELLGTKL   120
             AD VYIEPITLEFV++ILRKERPDALLPTLGGQTGLNMAM LSK GILEELNVELLGTKL
Sbjct:    61 ADTVYIEPITLEFVSKILRKERPDALLPTLGGQTGLNMAMELSKTGILEELNVELLGTKL   120

Query:   121 SAIDKAEDRDLFKQLMEELNQPIPESEIVNSVEEAIQFAEQIGYPLIVRPAFTLGGTGGG   180
             SAID+AEDR+LFK+L E +N+P+  S+I  +VEEAI A++IGYP+IV PAFT+GGTGGG
Sbjct:   121 SAIDQAEDRELFKELCESINEPLCASDIATTVEEAINIADKIGYPIIVGPAFTMGGTGGG   180

Query:   181 MCDNQEQLVDITTKGLKLSPVTQCLIERSIAGFKEIEYEVMRDAADNALVVCNMENFDPV   240
             +CD +E+L +I  GLKLSPVTQCLIE SIAG+KEIEYEVMRD+ADNA+VVCNMENFDPV
Sbjct:   181 ICDTEEELREIVANGLKLSPVTQCLIEESIAGYKEIEYEVMRDSADNAIVVCNMENFDPV   240

Query:   241 GIHTGDSIVFAPAQTLSDVENQLLRDASLDIIRALKIEGGCNVQLALDPNSFKYYVIEVN   300
             G+HTGDSIVFAP+QTLSD E Q+LRDASL+IIRALKIEGGCNVQLALDPNS++Y VIEVN
Sbjct:   241 GVHTGDSIVFAPSQTLSDNEYQMLRDASLNIIRALKIEGGCNVQLALDPNSYEYRVIEVN   300

Query:   301 PRVSRSSALASKATGYPIAKLAAKIAVGLTLDEVINPITKTTYAMFEPALDYVVAKMPRF   360
             PRVSRSSALASKATGYPIAK++AKIA+G+TLDE+INP+T  TYAMFEPALDYVVAK+ RF
Sbjct:   301 PRVSRSSALASKATGYPIAKMSAKIAIGMTLDEIINPVTNKTYAMFEPALDYVVAKIARF   360

Query:   361 PFDKFESGDRKLGTQMKATGEVMAIGRNIEESLLKACRSLEIGVDHIKIADLDNVSDDVL   420
             PFDKFE+GDR LGTQMKATGEVMAIGRNIEESLLKA RSLEIGV H ++ +    D+ L
Sbjct:   361 PFDKFENGDRHLGTQMKATGEVMAIGRNIEESLLKAVRSLEIGVFHNEMTEAIEADDEKL   420

Query:   421 LEKIRKAEDDRLFYLAEALRRHYSIEKLASLTSIDSFFLDKLRVIVELEDLLSKNRLDIN   480
             EK+ K +DDRLFY++EA+RR   IE++A LT ID FFLDKL  IVE+E+ L  N   +
Sbjct:   421 YEKMVKTQDDRLFYVSEAIRRGIPIEEIADLTKIDIFFLDKLLYIVEIENQLKVNIFEPE   480

Query:   481 ILKKVKNKGFSDKAIASLWQINEDQVRNMRKEAGILPVYKMVDTCASEFDSATPYFYSTY   540
             +LK  K  GFSD+ IA LW +  ++VR  R+E  I+PVYKMVDTCA+EF+S+TPYFYSTY
Sbjct:   481 LLKTAKKNGFSDREIAKLWNVTPEEVRRRRQENKIIPVYKMVDTCAAEFESSTPYFYSTY   540

Query:   541 AVENESLISDKASILVLGSGPIRIGQGVEFDYATVHSVKAIRESGFEAIIMNSNPETVST   600
               ENES  SDK  I+VLGSGPIRIGQGVEFDYATVH VKAI+  G EAI++NSNPETVST
Sbjct:   541 EWENESKRSDKEKIIVLGSGPIRIGQGVEFDYATVHCVKAIQALGKEAIVINSNPETVST   600

Query:   601 DFSISDKLYFEPLTFEDVMNVIDLEKPEGVILQFGGQTAINLAKDLNKAGVKILGTQLED   660
             DFSISDKLYFEPLTFEDVMNVIDLE+P  VI+QFGGQTAINLA+ L+KAGVKILGTQ+ED
Sbjct:   601 DFSISDKLYFEPLTFEDVMNVIDLEEPLVVIVQFGGQTAINLAEHLSKAGVKILGTQVED   660

Query:   661 LDRAENRKQFEATLQALNIPQPPGFTATTEEEAVNAAQKIGYPVLVRPSYVLGGRAMKIV   720
             LDRAE+R  FE  LQ L+IPQPPG TAT EEEAV  A KIGYPVL+RPS+VLGGRAM+I+
Sbjct:   661 LDRAEDRDLFEKALQDLDIPQPPGATATNEEEAVANANKIGYPVLIRPSFVLGGRAMEII   720

Query:   721 ENEEDLRHYMTTAVKASPDHPVLIDAYLIGKECEVDAISDGQNILIPGIMEHIERSGVHS   780
             NE+DLR YM  AVKASP+HPVL+D+YL G+ECEVDAI DG+ +L+PGIMEHIER+GVHS
Sbjct:   721 NNEKDLRDYMNRAVKASPEHPVLVDSYLQGQECEVDAICDGKEVLLPGIMEHIERAGVHS   780

Query:   781 GDSMAVYPPQTLSETIIETIVDYTKRLAIGLNCIGMMNIQFVIKDQKVYVIEVNPRASRT   840
             GDSMAVYPPQ LS+ II+TIVDYTKRLAIGLNCIGMMNIQFVI +++VYVIEVNPRASRT
Sbjct:   781 GDSMAVYPPQNLSQAIIDTIVDYTKRLAIGLNCIGMMNIQFVIYEEQVYVIEVNPRASRT   840

Query:   841 LPFLSKVTHIPMAQVATKVILGDKLCNFTYGYDLYPASDMVHIKAPVFSFTKLAKVDSLL   900
             +PFLSKVT+IPMAQ AT++ILG+ L + Y   L P DMVH+KAPVFSFTKLAKVDSLL
Sbjct:   841 VPFLSKVTNIPMAQLATQMILGENLKDLGYEAGLAPTPDMVHVKAPVFSFTKLAKVDSLL   900

Query:   901 GPEMKSTGEVMGSDINLQKALYKAFEAAYLHMPDYGNIVFTVDDTKEEALELAKVYQSI   960
             GPEMKSTG MGSD+ L+KALYK+FEAA LHM DYG+++FTV D DKEE L LAK + I
Sbjct:   901 GPEMKSTGLAMGSDVTLEKALYKSFEAAKLHMADYGSVLFTVADEDKEETLALAKDFAEI   960

Query:   961 GYRIYATQGTAIYFDANGLETVLVGKL--GENDRNHIPDLIKNGKIQAVINTVGQNNID-  1017
             GY + AT GTA +  NGL V KL GE++  +   + I+ G++QAV+NT+G
Sbjct:   961 GYSLVATAGTAAFLKENGLYVREVEKLAGGEDEEGTLVEDIRQGRVQAVVNTMGNTRASL  1020
```

```
Query:   1018 --NHDALIIRRSAIEQGVPLFTSLDTAHAMFKVLESRAFTLK      1057
              D   IR+ AI +G+PLFTSLDT  A+ KV++SR+FT K
Sbjct:   1021 TTATDGFRIRQEAISRGIPLFTSLDTVAAILKVMQSRSFTTK      1062
```

A related DNA sequence was identified in *S. pyogenes* <SEQ ID 2025> which encodes the amino acid sequence <SEQ ID 2026>. Analysis of this protein sequence reveals the following:

Possible site: 21
>>> Seems to have no N-terminal signal sequence

```
INTEGRAL   Likelihood = -1.17   Transmembrane 773-789 (773-789)
----- Final Results -----
      bacterial membrane --- Certainty = 0.1468 (Affirmative) <succ>
      bacterial outside --- Certainty = 0.0000 (Not Clear) <succ>
      bacterial cytoplasm --- Certainty = 0.0000 (Not Clear) <succ>
```

The protein has homology with the following sequences in the databases:

```
>GP:CAA03928 GB:AJ000109 carbamoylphosphate synthetase [Lactococcus lactis]
Identities = 753/1030 (73%), Positives = 876/1030 (84%), Gaps = 6/1030 (0%)

Query:      1 LALKEEGYKVILVNSNPATIMTDKEIADKVYIEPLTLEFVNRIIRKERPDAILPTLGGQT    60
              LALKEEGY+V+LVNSNPATIMTD+EIAD VYIEP+TLEFV++I+RKERPDA+LPTLGGQT
Sbjct:     35 LALKEEGYEVVLVNSNPATIMTDREIADTVYIEPITLEFVSKILRKERPDALLPTLGGQT    94

Query:     61 GLNMAMALSKAGILDDLEIELLGTKLSAIDQAEDRDLFKQLMQELDQPIPESTIVKTVDE   120
              GLNMAM LSK GIL++L +ELLGTKLSAIDQAEDR+LFK+L + +++P+  S I  TV+E
Sbjct:     95 GLNMAMELSKTGILEELNVELLGTKLSAIDQAEDRELFKELCESINEPLCASDIATTVEE   154

Query:    121 AVTFARDIGYPVIVRPAFTLGGTGGGICSSEEELCEITENGLKLSPVTQCLIERSIAGFK   180
              A+  A  IGYP+IV PAFT+GGTGGGIC +EEEL EI  NGLKLSPVTQCLIE SIAG+K
Sbjct:    155 AINIADKIGYPIIVGPAFTMGGTGGGICDTEEELREIVANGLKLSPVTQCLIEESIAGYK   214

Query:    181 EIEYEVMRDSADNALVVCNMENFDPVGIHTGDSIVFAPTQTLSDIENQMLRDASLKIIRA   240
              EIEYEVMRDSADNA+VVCNMENFDPVG+HTGDSIVFAP+QTLSD E QMLRDASL IIRA
Sbjct:    215 EIEYEVMRDSADNAIVVCNMENFDPVGVHTGDSIVFAPSQTLSDNEYQMLRDASLNIIRA   274

Query:    241 LKIEGGCNVQLALDPYSFKYYVIEVNPRVSRSSALASKATGYPIAKLAAKIAVGLTLDEM   300
              LKIEGGCNVQLALDP S++Y VIEVNPRVSRSSALASKATGYPIAK++AKIA+G+TLDE+
Sbjct:    275 LKIEGGCNVQLALDPNSYEYRVIEVNPRVSRSSALASKATGYPIAKMSAKIAIGMTLDEI   334

Query:    301 INPITGTTYAMFEPALDYVVAKIPRFPFDKFEHGERQLGTQMKATGEVMAIGRNLEESLL   360
              INP+T   TYAMFEPALDYVVAKI RFPFDKFE+G+R LGTQMKATGEVMAIGRN+EESLL
Sbjct:    335 INPVTNKTYAMFEPALDYVVAKIARFPFDKFENGDRHLGTQMKATGEVMAIGRNIEESLL   394

Query:    361 KACRSLEIGVCHNEMTSLSNISDEELVTKVIKAQDDRLFYLSEAIRRGYSIEELESLTKI   420
              KA RSLEIGV HNEMT      DE+L  K++K QDDRLFY+SEAIRRG  IEE+  LTKI
Sbjct:    395 KAVRSLEIGVFHNEMTEAIEADDEKLYEKMVKTQDDRLFYVSEAIRRGIPIEEIADLTKI   454

Query:    421 DLFFLDKLLHIVEIEQELQMHVDHLESLKKAKRYGFSDQKIAEIWQKDESDIRAMRHSHS   480
              D+FFLDKLL+IVEIE +L++++    E LK AK+ GFSD++IA++W      ++R  R  +
Sbjct:    455 DIFFLDKLLYIVEIENQLKVNIFEPELLKTAKKNGFSDREIAKLWNVTPEEVRRRQENK   514

Query:    481 LYPVYKMVDTCAAEFDAKTPYFYSTYELENESVQSNKESILVLGSGPIRIGQGVEFDYAT   540
              + PVYKMVDTCAAEF++ TPYFYSTYE ENES +S+KE I+VLGSGPIRIGQGVEFDYAT
Sbjct:    515 IIPVYKMVDTCAAEFESSTPYFYSTYEWENESKRSDKEKIIVLGSGPIRIGQGVEFDYAT   574

Query:    541 VHSVKAIQKAGYEAIIMNSNPETVSTDFSVSDKLYFEPLTFEDVMNVIDLEQPKGVIVQF   600
              VH VKAIQ  G EAI++NSNPETVSTDFS+SDKLYFEPLTFEDVMNVIDLE+P  VIVQF
Sbjct:    575 VHCVKAIQALGKEAIVINSNPETVSTDFSISDKLYFEPLTFEDVMNVIDLEEPLVVIVQF   634

Query:    601 GGQTAINLAQALSEAGVTILGTQVEDLDRAEDRDLFEKALKELGIPQPQGQTATNEEEAL   660
              GGQTAINLA+ LS+AGV ILGTQVEDLDRAEDRDLFEKAL++L IPQP G TATNEEEA+
Sbjct:    635 GGQTAINLAEHLSKAGVKILGTQVEDLDRAEDRDLFEKALQDLDIPQPPGATATNEEEAV   694

Query:    661 EAAKKIGFPVLVRPSYVLGGRAMEIVENKEDLREYIRTAVKASPEHPILVDSYIFGKECE   720
                A KIG+PVL+RPS+VLGGRAMEI+ N++DLR+Y+  AVKASPEHP+LVDSY+ G+ECE
Sbjct:    695 ANANKIGYPVLIRPSFVLGGRAMEIINNEKDLRDYMNRAVKASPEHPVLVDSYLQGQECE   754

Query:    721 VDAISDGKSVLIPGIMEHIERAGVHSGDSMAVYPPQQLSKQIQETIAEYTKRLAIGLNCI   780
              VDAI DGK VL+PGIMEHIERAGVHSGDSMAVYPPQ LS+ I +TI +YTKRLAIGLNCI
Sbjct:    755 VDAICDGKEVLLPGIMEHIERAGVHSGDSMAVYPPQNLSQAIIDTIVDYTKRLAIGLNCI   814

Query:    781 GMMNVQFVIKNEQVYVIEVNPRASRTVPFLSKVTGIPMAQIATKLILGQTLKDLGYEDGL   840
              GMMN+QFVI  EQVYVIEVNPRASRTVPFLSKVT IPMAQ+AT++ILG+ LKDLGYE GL
Sbjct:    815 GMMNIQFVIYEQVYVIEVNPRASRTVPFLSKVTNIPMAQLATQMILGENLKDLGYEAGL   874

Query:    841 YPQSPLVHIKAPVFSFTKLAQVDSLLGPEMKSTGEVMGSDTSLEKALYKAFEANNSHLSE   900
               P   +VH+KAPVFSFTKLA+VDSLLGPEMKSTG MGSD +LEKALYK+FEA   H+++
Sbjct:    875 APTPDMVHVKAPVFSFTKLAKVDSLLGPEMKSTGLAMGSDVTLEKALYKSFEAAKLHMAD   934
```

-continued

```
Query:   901 FGQIVFTIADDSKAEALSLARRFKAIGYQIMATQGTAAYFAEQGLSACLVGKIGDAANDI   960
             +G ++FT+AD+ K E L+LA+ F  IGY ++AT GTAA+   E GL    V K+    ++
Sbjct:   935 YGSVLFTVADEDKEETLALAKDFAEIGYSLVATAGTAAFLKENGLYVREVEKLAGGEDEE   994

Query:   961 PTLV---RHGHVQAIVNTVGIKR---TADKDGQMIRSSAIEQGVPLFTALDTAKAMLTVL  1014
             TLV    R G VQA+VNT+G  R   T  DG IR AI +G+PLFT+LDT  A+L V+
Sbjct:   995 GTLVEDIRQGRVQAVVNTMGNTRASLTTATDGFRIRQEAISRGIPLFTSLDTVAAILKVM  1054

Query:  1015 ESRCFNIEAI                                                   1024
             +SR F  + I
Sbjct:  1055 QSRSFTTKNI                                                   1064
```

Identities = 141/389 (36%), Positives = 222/389 (56%), Gaps = 16/389 (4%)

```
Query:   518 ESILVLGSGPIRIGQGVEFDYATVHSVKAIQKAGYEAIIMNSNPETVSTDFSVSDKLYFE   577
             +  I+++GSGPI  IGQ   EFDYA  +  A+++ GYE +++NSNP T+ TD  ++D +Y E
Sbjct:     8 KKIMIIGSGPIIIGQAAEFDYAGTEACLALKEEGYEVVLVNSNPATIMTDREIADTVYIE    67

Query:   578 PLTFEDVMNVIDLEQPKGVIVQFGGQTAINLAQALSEAG------VTILGTQVEDLDRAE   631
             P+T E V  ++  E+P  ++   GGQT +N+A  LS+ G       V +LGT++  +D+AE
Sbjct:    68 PITLEFVSKILRKERPDALLPTLGGQTGLNMAMELSKTGILEELNVELLGTKLSAIDQAE   127

Query:   632 DRDLFEKALKELGIPQPQGQTATNEEEALEAAKKIGFPVLVRPSYVLGGRAMEIVENKED   691
             DR+LF++  + +  P     AT EEA+  A KIG+P++V P++ +GG    I + +E+
Sbjct:   128 DRELFKELCESINEPLCASDIATTVEEAINIADKIGYPIIVGPAFTMGGTGGGICDTEEE   187

Query:   692 LREYIRTAVKASPEHPILVDSYIFG-KECEVDAISD-GKSVLIPGIMEHIERAGVHSGDS   749
             LRE +    +K SP    L++   I G KE E + + D     ME+ + GVH+GDS
Sbjct:   188 LREIVANGLKLSPVTQCLIEESIAGYKEIEYEVMRDSADNAIVVCNMENFDPVGVHTGDS   247

Query:   750 MAVYPPQQLSKQIQETIAEYTKRLAIGLNCIGMMNVQFVI--KNEQYVIEVNPRASRTV   807
             +    P Q LS   + + + +    L  G NVQ +   +   VIEVNPR SR+
Sbjct:   248 IVFAPSQTLSDNEYQMLRDASLNIIRALKIEGGCNVQLALDPNSYEYRVIEVNPRVSRSS   307

Query:   808 PFLSKVTGIPMAQIATKLILGQTLKDL--GYEDGLY----PQSPLVHIKAPVFSFTKLAQ   861
             SK TG P+A+++ K+ +G TL ++      + Y     P  V K   FF K
Sbjct:   308 ALASKATGYPIAKMSAKIAIGMTLDEIINPVTNKTYAMFEPALDYVVAKIARFPFDKFEN   367

Query:   862 VDSLLGPEMKSTGEVMGSDTSLEKALYKA                                890
             D  LG +MK+TGEVM    ++E++L KA
Sbjct:   368 GDRHLGTQMKATGEVMAIGRNIEESLLKA                                396
```

An alignment of the GAS and GBS proteins is shown below:

Identities = 777/1025 (75%), Positives = 896/1025 (86%), Gaps = 1/1025 (0%)

```
Query:    35 LSLKEEGYQVVLVNSNPATIMTDKDIADKVYIEPITLEFVTRILRKERPDALLPTLGGQT    94
             L+LKEEGY+V+LVNSNPATIMTDK+IADKVYIEP+TLEFV RI+RKERPDA+LPTLGGQT
Sbjct:     1 LALKEEGYKVILVNSNPATIMTDKEIADKVYIEPLTLEFVNRIIRKERPDAILPTLGGQT    60

Query:    95 GLNMAMALSKNGILEELNVELLGTKLSAIDKAEDRDLFKQLMEELNQPIPESEIVNSVEE   154
             GLNMAMALSK GIL++L +ELLGTKLSAID+AEDRDLFKQLM+EL QPIPES IV +V+E
Sbjct:    61 GLNMAMALSKAGILDDLEIELLGTKLSAIDQAEDRDLFKQLMQELDQPIPESTIVKTVDE   120

Query:   155 AIQFAEQIGYPLIVRPAFTLGGTGGGMCDNQEQLVDITTKGLKLSPVTQCLIERSIAGFK   214
             A+  FA  IGYP+IVRPAFTLGGTGGG+C ++E+L +IT  GLKLSPVTQCLIERSIAGFK
Sbjct:   121 AVTFARDIGYPVIVRPAFTLGGTGGGICSSEEELCEITENGLKLSPVTQCLIERSIAGFK   180

Query:   215 EIEYEVMRDAADNALVVCNMENFDPVGIHTGDSIVFAPAQTLSDVENQLLRDASLDIIRA   274
             EIEYEVMRD+ADNALVVCNMENFDPVGIHTGDSIVFAP QTLSD+ENQ+LRDASL IIRA
Sbjct:   181 EIEYEVMRDSADNALVVCNMENFDPVGIHTGDSIVFAPTQTLSDIENQMLRDASLKIIRA   240

Query:   275 LKIEGGCNVQLALDPNSFKYYVIEVNPRVSRSSALASKATGYPIAKLAAKIAVGLTLDEV   334
             LKIEGGCNVQLALDP SFKYYVIEVNPRVSRSSALASKATGYPIAKLAAKIAVGLTLDE+
Sbjct:   241 LKIEGGCNVQLALDPYSFKYYVIEVNPRVSRSSALASKATGYPIAKLAAKIAVGLTLDEM   300

Query:   335 INPITKTTYAMFEPALDYVVAKMPRFPFDKFESGDRKLGTQMKATGEVMAIGRNIEESLL   394
             INPIT TTYAMFEPALDYVVAK+PRFPFDKFE  G+R+LGTQMKATGEVMAIGRN+EESLL
Sbjct:   301 INPITGTTYAMFEPALDYVVAKIPRFPFDKFEHGERQLGTQMKATGEVMAIGRNLEESLL   360

Query:   395 KACRSLEIGVDHIKIADLDNVSDDVLLEKIRKAEDDRLFYLAEALRRHYSIEKLASLTSI   454
             KACRSLEIGV H ++  L N+SD+ L+ K+ KA+DDRLFYL EA+RR YSIE+L SLT I
Sbjct:   361 KACRSLEIGVCHNEMTSLSNISDEELVTKVIKAQDDRLFYLSEAIRRGYSIEELESLTKI   420
```

```
Query:    455 DSFFLDKLRVIVELEDLLSKNRLDINILKKVKNKGFSDKAIASLWQINEDQVRNMRKEAG  514
              D FFLDKL IVE+E L +  + LKK K GFSD+ IA +WQ +E  +R MR
Sbjct:    421 DLFFLDKLLHIVEIEQELQMHVDHLESLKKAKRYGFSDQKIAEIWQKDESDIRAMRHSHS  480

Query:    515 ILPVYKMVDTCASEFDSATPYFYSTYAVENESLISDKASILVLGSPIRIGQGVEFDYAT   574
              + PVYKMVDTCA+EFD+ TPYFYSTY +ENES+ S+K SILVLGSPIRIGQGVEFDYAT
Sbjct:    481 LYPVYKMVDTCAAEFDAKTPYFYSTYELENESVQSNKESILVLGSPIRIGQGVEFDYAT   540

Query:    575 VHSVKAIRESGFEAIIMNSNPETVSTDFSISDKLYFEPLTFEDVMNVIDLEKPEGVILQF  634
              VHSVKAI+++G+EAIIMNSNPETVSTDFS+SDKLYFEPLTFEDVMNVIDLE+P+GVI+QF
Sbjct:    541 VHSVKAIQKAGYEAIIMNSNPETVSTDFSVSDKLYFEPLTFEDVMNVIDLEQPKGVIVQF  600

Query:    635 GGQTAINLAKDLNKAGVKILGTQLEDLDRAENRKQFEATLQALNIPQPPGFTATTEEEAV  694
              GGQTAINLA+ L++AGV ILGTQ+EDLDRAE+R  FE  L+ L IPQP G TAT EEEA+
Sbjct:    601 GGQTAINLAQALSEAGVTILGTQVEDLDRAEDRDLFEKALKELGIPQPQGTATNEEEAL   660

Query:    695 NAAQKIGYPVLVRPSYVLGGRAMKIVENEEDLRHYMTTAVKASPDHPVLIDAYLIGKECE  754
              AA+KIG+PVLVRPSYVLGGRAM+IVEN+EDLR Y+ TAVKASP+HP+L+D+Y+ GKECE
Sbjct:    661 EAAKKIGFPVLVRPSYVLGGRAMEIVENKEDLREYIRTAVKASPEHPILVDSYIFGKECE  720

Query:    755 VDAISDGQNILIPGIMEHIERSGVHSGDSMAVYPPQTLSETIIETIVDYTKRLAIGLNCI  814
              VDAISDG+++LIPGIMEHIER+GVHSGDSMAVYPPQ LS+ I ETI +YTKRLAIGLNCI
Sbjct:    721 VDAISDGKSVLIPGIMEHIERAGVHSGDSMAVYPPQQLSKQIQETIAEYTKRLAIGLNCI  780

Query:    815 GMMNIQFVIKDQKVYVIEVNPRASRTLPFLSKVTHIPMAQVATKVILGDKLCNFTYGYDL  874
              GMMN+QFVIK+++VYVIEVNPRASRT+PFLSKVT IPMAQ+ATK+ILG  L + Y   L
Sbjct:    781 GMMNVQFVIKNEQVYVIEVNPRASRTVPFLSKVTGIPMAQIATKLILGQTLKDLGYEDGL  840

Query:    875 YPASDMVHIKAPVFSFTKLAKVDSLLGPEMKSTGEVMGSDINLQKALYKAFEAAYLHMPD  934
              YP S +VHIKAPVFSFTKLA+VDSLLGPEMKSTGEVMGSD +L+KALYKAFEA  H+ +
Sbjct:    841 YPQSPLVHIKAPVFSFTKLAQVDSLLGPEMKSTGEVMGSDTSLEKALYKAFEANNSHLSE  900

Query:    935 YGNIVFTVDDTDKEEALELAKVYQSIGYRIYATQGTAIYFDANGLETVLVGKLGENDRNH  994
              +G IVFT+ D  K EAL LA+ +++IGY+I ATQGTA YF  GL  LVGK+G+   N
Sbjct:    901 FGQIVFTIADDSKAEALSLARRFKAIGYQIMATQGTAAYFAEQGLSACLVGKIGD-AAND  959

Query:    995 IPDLIKNGKIQAVINTVGQNNIDNHDALIIRRSAIEQGVPLFTSLDTAHAMFKVLESRAF 1054
              IP L+++G +QA++NTVG    + D +IR SAIEQGVPLFT+LDTA  AM  VLESR F
Sbjct:    960 IPTLVRHGHVQAIVNTVGIKRTADKDGQMIRSSAIEQGVPLFTALDTAKAMLTVLESRCF 1019

Query:   1055 TLKVL                                                        1059
              ++ +
Sbjct:   1020 NIEAI                                                        1024

Identities = 145/387 (37%), Positives = 229/387 (58%), Gaps = 16/387 (4%)

Query:     10 IMVIGSGPIVIGQAAEFDYSGTQACLSLKEEGYQVVLVNSNPATIMTDKDIADKVYIEPI   69
              I+V+GSGPI IGQ  EFDY+   + ++++ GY+ +++NSNP T+ TD  ++DK+Y EP+
Sbjct:    520 ILVLGSPIRIGQGVEFDYATVHSVKAIQKAGYEAIIMNSNPETVSTDFSVSDKLYFEPL   579

Query:     70 TLEFVTRILRKERPDALLPTLGGQTGLNMANALSKNGILEELNVELLGTKLSAIDKAEDR  129
              T E V  ++  E+P ++     GGQT +N+A ALS+ G    V +LGT++  +D+AEDR
Sbjct:    580 TFEDVMNVIDLEQPKGVIVQFGGQTAINLAQALSEAG------VTILGTQVEDLDRAEDR  633

Query:    130 DLFKQLMEELNQPIPESEIVNSVEEAIQFAEQIGYPLIVRPAFTLGGTGGGMCDNQEQLV  189
              DLF++ ++EL  P P+ +   + EEA++ A++IG+P++VRP++ LGG     +N+E L
Sbjct:    634 DLFEKALKELGIPQPQGTATNEEEALEAAKKIGFPVLVRPSYVLGGRAMEIVENKEDLR   693

Query:    190 DITTKGLKLSPVTQCLIERSIAGFKEIEYEVMRDAADNALVVCNMENFDPVGIHTGDSIV  249
              +        +K SP   L++   I G KE E + + D  + L+  ME +   G+H+GDS+
Sbjct:    694 EYIRTAVKASPEHPILVDSYIFG-KECEVDAISD-GKSVLIPGIMEHIERAGVHSGDSMA  751

Query:    250 FAPAQTLSDVENQLLRDASLDIIRALKIEGGCNVQLALDPNSFKYYVIEVNPRVSRSSAL  309
                 P Q LS   +  +  + + L  G NVQ +  + + YVIEVNPR SR+
Sbjct:    752 VYPPQQLSKQIQETIAEYTKRLAIGLNCIGMMNVQFVI--KNEQVYVIEVNPRASRTVPF  809

Query:    310 ASKATGYPIAKLAAKIAVGLTLDEVINPITKTTYAMFEPALDYVVAKMPRFPFDKFESGD  369
               SK TG P+A++ K +G TL ++         Y    P   V KPFF K   D
Sbjct:    810 LSKVTGIPMAQIATKLILGQTLKDL--GYEDGLY----PQSPLVHIKAPVFSFTKLAQVD  863

Query:    370 RKLGTQMKATGEVMAIGRNIEESLLKA                                   396
                LG +MK+TGEVM   ++E++L KA
Sbjct:    864 SLLGPEMKSTGEVMGSDTSLEKALYKA                                   890
```

Based on this analysis, it was predicted that these proteins and their epitopes could be useful antigens for vaccines or diagnostics.

Example 659

A DNA sequence (GBSx0699) was identified in *S. agalactiae* <SEQ ID 2027> which encodes the amino acid sequence <SEQ ID 2028>. This protein is predicted to be carbamoyl phosphate synthetase small subunit (carA). Analysis of this protein sequence reveals the following:

```
Possible site: 19
>>> Seems to have no N-terminal signal sequence
----- Final Results -----
   bacterial cytoplasm --- Certainty = 0.2401 (Affirmative) <succ>
   bacterial membrane --- Certainty = 0.0000 (Not Clear) <succ>
   bacterial outside --- Certainty = 0.0000 (Not Clear) <succ>
```

The protein has homology with the following sequences in the GENPEPT database:

```
Possible site: 43
>>> Seems to have no N-terminal signal sequence
----- Final Results -----
   bacterial cytoplasm --- Certainty = 0.3534 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below:

```
>GP:CAB89872 GB:AJ132624 carbamoyl phosphate synthetase small
subunit [Lactococcus lactis]
Identities = 242/355 (68%), Positives = 305/355 (85%)

Query:     2  KRLLLLEDGSVFEGEAFGADVETSGEIVFSTGMTGYQESITDQSYNGQIITFTYPLIGNY    61
              KRLL+LEDG++FEGEA GA+++ +GE+VF+TGMTGYQESITDQSYNGQI+TFTYP++GNY
Sbjct:     3  KRLLILEDGTIFEGEALGANLDVTGELVFNTGMTGYQESITDQSYNGQILTFTYPIVGNY    62

Query:    62  GINRDDYESIRPTCKGVVIYEWAEYPSNWRQQMTLDEFLKLKGIPGISGIDTRALTKIIR   121
              G+NRDDYESI PTCK VV++E A  PSNWR QM+ DEFLK K IPGI+G+DTRA+TKI+R
Sbjct:    63  GVNRDDYESIHPTCKAVVVHEAARRPSNWRMQMSFDEFLKSKNIPGITGVDTRAITKIVR   122

Query:   122  KHGTMKACLINEGNSINEALENLQKSVLLNDQIEQVSTKLAYASPGVGKNIVLVDFGLKH   181
              +HGTMKA L+   + +    + LQ +VL  +Q+E  ST  AY SP  G+ +V+VDFGLKH
Sbjct:   123  EHGTMKASLVQARDEVDHQMSQLQATVLPTNQVETSSTATAYPSPNTGRKVVVVDFGLKH   182

Query:   182  SILRELSQRQCHITVVPHTTTAQEILNLNPDGVLLSNGPGNPEQLPNALQMIQEIQGKIP   241
              SILRELS+R+C++TVVP+ T+A+EIL + PDGV+L+NGPG+P  +P A++MI+E+QGKIP
Sbjct:   183  SILRELSKRECNLTVVPYNTSAKEILEMEPDGVMLTNGPGDPTDVPEAIEMIKEVQGKIP   242

Query:   242  IFGICMGHQLFAKANGAKTYKMTFGHRGFNHAVRHLQTGQVDFTSQNHGYAVSREDFPEA   301
              IFGIC+GHQLF+ ANGA TYKM FGHRGFNHAVR + TG++DFTSQNHGYAVS E+ PE
Sbjct:   243  IFGICLGHQLFSLANGATTYKMKFGHRGFNHAVREVATGRIDFTSQNHGYAVSSENLPED   302

Query:   302  LFITHEEINDKTVEGVRHKYYPAFSVQFHPDAAPGPHDTSYLFDEFINMIDDFQQ       356
              L ITH EIND +VEGVRHKY+PAFSVQFHPDAAPGPHD SYLFD+F++++D+F++
Sbjct:   303  LMITHVEINDNSVEGVRHKYFPAFSVQFHPDAAPGPHDASYLFDDFMDLMDNFKK       357
```

A related DNA sequence was identified in *S. pyogenes* <SEQ ID 2029> which encodes the amino acid sequence <SEQ ID 2030>. Analysis of this protein sequence reveals the following:

```
Identities = 265/354 (74%), Positives = 309/354 (86%)

Query:     2  KRLLLLEDGSVFEGEAFGADVETSGEIVFSTGMTGYQESITDQSYNGQIITFTYPLIGNY    61
              KRLL+LEDG++FEGE FGAD++ +GEIVF+TGMTGYQESITDQSYNGQI+TFTYPLIGNY
Sbjct:     3  KRLLILEDGTIFEGEPFGADIDVTGEIVFNTGMTGYQESITDQSYNGQILTFTYPLIGNY    62

Query:    62  GINRDDYESIRPTCKGVVIYEWAEYPSNWRQQMTLDEFLKLKGIPGISGIDTRALTKIIR   121
              GINRDDYESI PTCKGVV+ E +   SNWR+QMTLD FLK+KGIPGISGIDTRALTKIIR
Sbjct:    63  GINRDDYESISPTCKGVVVSEVSRLASNWRKQMTLDAFLKIKGIPGISGIDTRALTKIIR   122

Query:   122  KHGTMKACLINEGNSIHEALENLQKSVLLNDQIEQVSTKLAYASPGVGKNIVLVDFGLKH   181
              +HGTMKA + ++G+SI    + L+ +VL   IEQVSTK AY +PG+GKNIVLVDFGLKH
Sbjct:   123  QHGTMKATMADDGDSIQHLKDQLRATVLPTNTIEQVSTKTAYPAPGIGKNIVLVDFGLKH   182

Query:   182  SILRELSQRQCHITVVPHTTTAQEILNLNPDGVLLSNGPGNPEQLPNALQMIQEIQGKIP   241
              SILRE S+RQC+ITVVP   TA+E+L LNPDG++LSNGPGNPE LP AL MI+ +QGKIP
Sbjct:   183  SILREFSKRQCNITVVPFNITAEEVLQLNPDGLMLSNGPGNPEDLPEALDMIRGVQGKIP   242

Query:   242  IFGICMGHQLFAKANGAKTYKMTFGHRGFNHAVRHLQTGQVDFTSQNHGYAVSREDFPEA   301
              IFGICMGHQLF+ ANGAKT KMTFGHRGFNHAVR + TG++DFTSQNHGYAV R   P+
Sbjct:   243  IFGICMGHQLFSLANGAKTCKMTFGHRGFNHAVREIATGRIDFTSQNHGYAVERSSLPDT   302

Query:   302  LFITHEEINDKTVEGVRHKYYPAFSVQFHPDAAPGPHDTSYLFDEFINMIDDFQ        355
              L +THE+INDKTVEGV+H+ +PAFSVQFHPDAAPGPHD SYLFDEF+ MID ++
Sbjct:   303  LMVTHEDINDKTVEGVKHRDFPAFSVQFHPDAAPGPHDASYLFDEFLEMIDSWR        356
```

Based on this analysis, it was predicted that these proteins and their epitopes could be useful antigens for vaccines or diagnostics.

Example 660

A DNA sequence (GBSx0700) was identified in *S. agalactiae* <SEQ ID 2031> which encodes the amino acid sequence <SEQ ID 2032>. This protein is predicted to be aspartate carbamoyltransferase (pyrB). Analysis of this protein sequence reveals the following:

Possible site: 26
>>> Seems to have no N-terminal signal sequence
----- Final Results -----
  bacterial cytoplasm --- Certainty = 0.3260 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database:

A related DNA sequence was identified in *S. pyogenes* <SEQ ID 2033> which encodes the amino acid sequence <SEQ ID 2034>. Analysis of this protein sequence reveals the following:

Possible site: 38
>>> Seems to have a cleavable N-term signal seq.
----- Final Results -----
  bacterial outside --- Certainty = 0.3000 (Affirmative) <succ>
  bacterial membrane --- Certainty = 0.0000 (Not Clear) <succ>
  bacterial cytoplasm --- Certainty = 0.0000 (Not Clear) <succ>

An alignment of the GAS and GBS proteins is shown below:

```
>GP:AAF72727 GB:AF264709 aspartate transcarbamoylase [Enterococcus faecalis]
Identities = 197/303 (65%), Positives = 250/303 (82%)

Query:     5 TQTLSEHFVSLEELSNQEVMSLIKRSIEVKENPSNIGFDKDYYVSNLFFENSTRTHKSF     64
             ++ +SL+H ++ E L+++EVM LI+R+ E K+        ++ Y+ +NLFFENSTRTHKSF
Sbjct:     5 SERISLKHLLTAEALTDREVMGLIRRAGEFKQGAKWHPEERQYFATNLFFENSTRTHKSF     64

Query:    65 EMAELKLGLKTIEFNADTSSVNKGETLYDTILTMSALGLDVCVIRHPDIDYYKELIASPN    124
             E+AE KLGL+ IEF A  SSV KGETLYDT+LTMSA+G+DV VIRH   +YY ELI  S
Sbjct:    65 EVAEKKLGLEVIEFEASRSSVQKGETLYDTVLTMSAIGVDVAVIRHGKENYYDELIQSKT    124

Query:   125 IHSAIVNGGDGSGQHPSQSLLDLVTIYEEFGYFKGLKIAIVGDLTHSRVAKSNMQVLKRL    184
             I  +I+NGGDGSGQHP+Q LLDL+TIYEEFG F+GLK+AIVGD+THSRVAKSNMQ+L RL
Sbjct:   125 IQCSIINGGDGSGQHPTQCLLDLMTIYEEFGGFEGLKVAIVGDITHSRVAKSNMQLLNRL    184

Query:   185 GAEIFFSGPKEWYSSQFDEYGQYLPIDQLVDQIDVLMLLRVQHERHDGKGVFSKESYHQQ    244
             GAEI+FSGP+EWY  QFD YGQY+P+D++V+++DV+MLLRVQHERHDGK  FSKE YH +
Sbjct:   185 GAEIYFSGPEEWYDHQFDVYGQYVPLDEIVEKVDVMMLLRVQHERHDGKESFSKEGYHLE    244

Query:   245 FGLTKERYKHLRDTAIIMHPAPVNRDVEIASDLVEADKARIVKQMSNGVYARIAILEAVL    304
             +GLT ER    L+  AIIMHPAPVNRDVE+A +LVE+ ++RIV QMSNGV+ R+AILEA+L
Sbjct:   245 YGLTNERATRLQKHAIIMHPAPVNRDVELADELVESLQSRIVAQMSNGVFMRMAILEAIL    304

Query:   305 NSR                                                           307
             + +
Sbjct:   305 HGK                                                           307
```

```
Identities = 208/300 (69%), Positives = 249/300 (82%)

Query:     8 LSLEHFVSLEELSNQEVMSLIKRSIEVKENPSNIGFDKDYYVSNLFFENSTRTHKSFEMA     67
             ++L + VS+E L+ +EV+ LI R  E K     I    +   V+NLFFENSTRTHKSFE+A
Sbjct:    26 VALTNLVSMEALTTEEVLGLINRGSEYKAGKVVISDHQKDLVANLFFENSTRTHKSFEVA     85

Query:    68 ELKLGLKTIEFNADTSSVNKGETLYDTILTMSALGLDVCVIRHPDIDYYKELIASPNIHS    127
             E KLGL  ++FNAD S+VNKGE+LYDT+LTMSALG D+CVIRHP+ DYYKEL+ SP I +
Sbjct:    86 EKKLGLTVLDFNADASAVNKGESLYDTVLTMSALGTDICVIRHPEDDYYKELVESPTITA    145

Query:   128 AIVNGGDGSGQHPSQSLLDLVTIYEEFGYFKGLKIAIVGDLTHSRVAKSNMQVLKRLGAE    187
             +IVNGGDGSGQHPSQ LLDL+TIYEEFG F+GLKIAI GDLTHSRVAKSNMQ+LKRLGAE
Sbjct:   146 SIVNGGDGSGQHPSQCLLDLLTIYEEFGRFEGLKIAIAGDLTHSRVAKSNMQILKRLGAE    205

Query:   188 IFFSGPKEWYSSQFDEYGQYLPIDQLVDQIDVLMLLRVQHERHDGKGVFSKESYHQQFGL    247
             ++F GP+EWYS  F+ YG Y+ IDQ++ ++DVLMLLRVQHERHDG  FSKE YHQ FGL
Sbjct:   206 LYFYGPEEWYSEAFNAYGTYIAIDQIIKELDVLMLLRVQHERHDGHQSFSKEGYHQAFGL    265
```

```
Query:  248  TKERYKHLRDTAIIMHPAPVNRDVEIASDLVEADKARIVKQMSNGVYARIAILEAVLNSR       307
             T+ERY+ L+D+AIIMHPAPVNRDVEIA  LVEA KARIV QM+NGV+ R+AI+EA+LN R
Sbjct:  266  TQERYQQLKDSAIIMHPAPVNRDVEIADSLVEAPKARIVSQMANGVFVRMAIIEAILNGR       325
```

Based on this analysis, it was predicted that these proteins and their epitopes could be useful antigens for vaccines or diagnostics.

Example 661

A DNA sequence (GBSx0701) was identified in *S. agalactiae* <SEQ ID 2035> which encodes the amino acid sequence <SEQ ID 2036>. Analysis of this protein sequence reveals the following:

---

Possible site: 30
>>> Seems to have no N-terminal signal sequence
----- Final Results -----
  bacterial cytoplasm --- Certainty = 0.2392 (Affirmative) <succ>
  bacterial membrane --- Certainty = 0.0000 (Not Clear) <succ>
  bacterial outside --- Certainty = 0.0000 (Not Clear) <succ>

---

The protein has homology with the following sequences in the GENPEPT database:

A related DNA sequence was identified in *S. pyogenes* <SEQ ID 2037> which encodes the amino acid sequence <SEQ ID 2038>. Analysis of this protein sequence reveals the following:

---

Possible site: 35
>>> Seems to have no N-terminal signal sequence
INTEGRAL   Likelihood = −0.80   Transmembrane 76-92 (76-92)
INTEGRAL   Likelihood = −0.00   Transmembrane 286-302 (286-302)
----- Final Results -----
  bacterial membrane --- Certainty = 0.132 (Affirmative) <succ>
  bacterial outside --- Certainty = 0.000 (Not Clear) <succ>
  bacterial cytoplasm --- Certainty = 0.000 (Not Clear) <succ>

---

```
>GP:AAC06948 GB:AE000708 dihydroorotase [Aquifex aeolicus]
Identities = 176/422 (41%), Positives = 255/422 (59%), Gaps = 8/422 (1%)

Query:   11  IIKNGLIIDPQSGFNQVSDMLIDQGKIKQISKEIDIKGIPIIDASNKIVAPGLVDIHVHF       70
             I+KNG +IDP      D+L++ GKIK+I K I +     IIDA   IV PG +DIHVH
Sbjct:    5  IVKNGYVIDPSQNLEGEFDILVENGKIKKIDKNILVPEAEIIDAKGLIVCPGFIDIHVHL       64

Query:   71  REPGQTHKENIHTGALSAAVGGFTTVLMMANTNPTISSPEIVKQVKESAAKEAI-KIETV      129
             R+PGQT+KE+I +G+   A   GGFTT++ M NTNP I +  +V + +      + ++
Sbjct:   65  RDPGQTYKEDIESGSRCAVAGGFTTIVCMPNTNPPIDNTTVVNYILQKSKSVGLCRVLPT      124

Query:  130  ATITKSLNGKDLVNFEELLEAGVAGFSDDGIPLTDTKVLQEAMNLARKHDVVLSLHEEDP      189
              TITK  GK++ +F  L EAG   F+DDG P+ D+ V+++A+ LA +   V + H ED
Sbjct:  125  GTITKGRKGKEIADFYSLKEAGCVAFTDDGSPVMDSSVMRKALELASQLGVPIMDHCEDD      184

Query:  190  SLN-GVLGINEHIAQKIYHVCGASGLAEYSMIARDAMIAYQTQAKVHIQHLSSSESVEVV      248
                 L GV INE    +    + AE   IARD ++A +T   VHIQH+S+  S+E++
Sbjct:  185  KLAYGV--INEGEVSALLGLSSRAPEAEEIQIARDGILAQRTGGHVHIQHVSTKLSLEII      242

Query:  249  DFAQKLGANLTAEVTPQHFSKTENLLLTKGANAKLNPPLRLEKDRQALIDGLKSGVISII      308
             +F ++  G  +T EV P H    TE +L GANA++NPPLR ++DR ALI+G+K G+I
Sbjct:  243  EFFKEKGVKITCEVNPNHLLFTEREVLNSGANARVNPPLRKKEDRLALIEGVKRGIIDCF      302

Query:  309  ASDHAPHHIMEKAADNISQAPSGMTGLETSLALGITYLVSTKELSMIDFLAKMTCNPAQL      368
             A+DHAPH    EK + + A   G+ L+T+L       L    +S+    +  T NPA++
Sbjct:  303  ATDHAPHQTFEK--ELVEFAMPGIIGLQTALPSALE-LYRKGIISLKKLIEMFTINPARI      359

Query:  369  YGFDAGYLREGGPADIVIFDQAEERIIKAEF-ASKSSNSPFIGDKLKGVIHYTICNGEIV      427
              G D G L+ G PADI IFD +E I+  E     SKS N+P  G  LKG + YTI +G++V
Sbjct:  360  IGVDLGTLKLGSPADITIFDPNKEWILNEETNLSKSRNTPLWGKVLKGKVIYTIKDGKMV      419

Query:  428  YQ       429
             Y+
Sbjct:  420  YK       421
```

The protein has homology with the following sequences in the databases:

```
!GB:AE000708 dihydroorotase [Aquifex aeolicus] 316 3e-85
>GP:AAC06948 GB:AE000708 dihydroorotase [Aquifex aeolicus]
  Score = 316 bits (801), Expect = 3e-85
  Identities = 177/422 (41%), Positives = 254/422 (59%), Gaps = 8/422 (1%)
```

```
-continued
Query:   2  ILIKNGRVMDPKSQRDQVADVLIDGKQIVKIASAIECQEAQVIDASGLIVAPGLVDIHVH   61
            +++KNG V+DP     D+L++  +I KI    I   EA+++IDA GLIV PG +DIHVH
Sbjct:   4  LIVKNGYVIDPSQNLEGEFDILVENGKIKKIDKNILVPEAEIIDAKGLIVCPGFIDIHVH   63

Query:  62  FREPGQTHKEDIHTGALAAAAGGVTTVVMMANTNPVISDVETLQEVLASAAKEKI-HIYT  120
            R+PGQT+KEDI +G+  A AGG TT+V M NTNP I +     +L  +      +  +
Sbjct:  64  LRDPGQTYKEDIESGSRCAVAGGFTTIVCMPNTNPPIDNTTVVNYILQKSKSVGLCRVLP  123

Query: 121  NASVTQAFNGKDVTDFKALLEAGAVSFSDDGIPLESSKVLKEAFDLANANQTFISLHEED  180
            ++T+   GK++ DF +L EAG V+F+DDG P+  S V+++A +LA+         I H ED
Sbjct: 124  TGTITKGRKGKEIADFYSLKEAGCVAFTDDGSPVMDSSVMRKALELASQLGVPIMDHCED  183

Query: 181  PQL-NGVLGFNEGIAEEHFHFCGATGVAEYSMIARDVMIAYDRQAHVHIQHLSKAESVQV  239
            +L  GV+  NEG                AE   IARD ++A     HVHIQH+S   S+++
Sbjct: 184  DKLAYGVI--NEGEVSALLGLSSRAPEAEEIQIARDGILAQRTGGHVHIQHVSTKLSLEI  241

Query: 240  VAHAQQLGAKVTAEVSPQHFSTTEDLLLIAGTSAKMNPPLRTQRDRLAVIEGLKSGVITV  299
             + F ++ G K+T EV+P H    TE  +L +G +A++NPPLR + DRLA+IEG+K G+I
Sbjct: 242  IEFFKEKGVKITCEVNPNHLLFTEREVLNSGANARVNPPLRKKEDRLALIEGVKRGIIDC  301

Query: 300  IATDHAPHHKDEKTVDDMTKAPSGMTGLETSLSLGLTHLVEPGHLTLMSLLEKMTLNPAL  359
               ATDHAPH  EK + +    A G+ GL+T+L   L  L    G ++L  L+E  T+NPA
Sbjct: 302  FATDHAPHQTFEKELVEF--AMPGIIGLQTALPSAL-ELYRKGIISLKKLIEMFTINPAR  358

Query: 360  LYGFDAGYLAENGPADLVIFADKQERLITENF-ASKASNSPFIGNKLKGVVKYTIADGEV  418
            + G D G L   PAD+ IF  +E ++ E    SK+ N+P  G  LKG V YTI DG++
Sbjct: 359  IIGVDLGTLKLGSPADITIFDPNKEWILNEETNLSKSRNTPLWGKVLKGKVIYTIKDGKM  418

Query: 419  VY                                                           420
            VY
Sbjct: 419  VY                                                           420
```

An alignment of the GAS and GBS proteins is shown below:

```
Identities = 269/420 (64%), Positives = 338/420 (80%)

Query:   9  MYIIKNGLIIDPQSGFNQVSDMLIDQGKIKQISKEIDIKGIPIIDASNKIVAPGLVDIHV   68
            M +IKNG ++DP+S  +QV+D+LID  +I +I+  I+ +    +IDAS  IVAPGLVDIHV
Sbjct:   1  MILIKNGRVMDPKSQRDQVADVLIDGKQIVKIASAIECQEAQVIDASGLIVAPGLVDIHV   60

Query:  69  HFREPGQTHKENIHTGALSAAVGGFTTVLMMANTNPTISSPEIVKQVKESAAKEAIKIET  128
            HFREPGQTHKE+IHTGAL+AA GG TTV+MMANTNP IS   E +++V  SAAKE I  T
Sbjct:  61  HFREPGQTHKEDIHTGALAAAAGGVTTVVMMANTNPVISDVETLQEVIASAAKEKIHIYT  120

Query: 129  VATITKSLNGKDLVNFEELLEAGVAGFSDDGIPLTDTKVLQEAMNLARKHDVVLSLHEED  188
             A++T++ NGKD+ +F+ LLEAG   FSDDGIPL +KVL+EA +LA +   +SLHEED
Sbjct: 121  NASVTQAFNGKDVTDFKALLEAGAVSFSDDGIPLESSKVLKEAFDLANANQTFISLHEED  180

Query: 189  PSLNGVLGINEHIAQKIYHVCGASGLAEYSMIARDAMIAYQTQAKVHIQHLSSSESVEVV  248
            P LNGVLG NE IA++ +H CGA+G+AEYSMIARD MIAY  QA VHIQHLS +ESV VV
Sbjct: 181  PQLNGVLGFNEGIAEEHFHFCGATGVAEYSMIARDVMIAYDRQAHVHIQHLSKAESVQVV  240

Query: 249  DFAQKLGANLTAEVTPQHFSKTENLLLTKGANAKLNPPLRLEKDRQALIDGLKSGVISII  308
              FAQ+LGA +TAEV+PQHFS TE+LLL  G +AK+NPPLR ++DR A+I+GLKSGVI++I
Sbjct: 241  AFAQQLGAKVTAEVSPQHFSTTEDLLLIAGTSAKMNPPLRTQRDRLAVIEGLKSGVITVI  300

Query: 309  ASDHAPHHIMEKAADNISQAPSGMTGLETSLALGITYLVSTKELSMIDFLAKMTCNPAQL  368
            A+DHAPHH  EK  D++++APSGMTGLETSL+LG+T+LV     L    +  KMT NPA L
Sbjct: 301  ATDHAPHHKDEKTVDDMTKAPSGMTGLETSLSLGLTHLVEPGHLTLMSLLEKMTLNPALL  360

Query: 369  YGFDAGYLREGGPADIVIFDQAEERIIKAEFASKSSNSPFIGDKLKGVIHYTICNGEIVY  428
            YGFDAGYL E GPAD+VIF  +ER+I   FASK+SNSPFIG+KLKGV+ YTI +GE+VY
Sbjct: 361  YGFDAGYLAENGPADLVIFADKQERLITENFASKASNSPFIGNKLKGVVKYTIADGEVVY  420
```

Based on this analysis, it was predicted that these proteins and their epitopes could be useful antigens for vaccines or diagnostics.

Example 662

A DNA sequence (GBSx0702) was identified in *S. agalactiae* <SEQ ID 2039> which encodes the amino acid sequence <SEQ ID 2040>. This protein is predicted to be orotate phosphoribosyltransferase PyrE (pyrE). Analysis of this protein sequence reveals the following:

```
Possible site: 28
>>> Seems to have no N-terminal signal sequence
----- Final Results -----
    bacterial cytoplasm --- Certainty = 0.2214 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database:

```
>GP:AAC95453 GB:AF068902 orotate phosphoribosyltransferase PyrE
[Streptococcus pneumoniae]
Identities = 152/208 (73%), Positives = 180/208 (86%)
Query:   1  MDLARQIAMELLDIQAVYLRPQQPFTWASGVKSPIYTDNRVTLSYPETRTLIENGFVKQI     60
            M LA+ IA  LL IQAVYL+P++PFTWASG+KSPIYTDNRVTL+YPETRTLIENGFV  I
Sbjct:   1  MTLAKDIASHLLKIQAVYLKPEEPFTWASGIKSPIYTDNRVTLAYPETRTLIENGFVDAI     60

Query:  61  QKHFPNVDIIAGTATAGIPHGAIIADKMNLPFAYIRSKAKDHGVGNQIEGRVYSGQKMVI    120
            ++ FP V++IAGTATAGIPHGAIIADKMNLPFAYIRSK KDHG GNQIEGRV  GQKMV+
Sbjct:  61  KEAFPEVEVIAGTATAGIPHGAIIADKMNLPFAYIRSKPKDHGAGNQIEGRVAQGQKMVV    120

Query: 121  IEDLISTGGSVLEAVTAAQSQGIEVLGVVAIFTYQLAKAEQAFREADIPLVTLTDYNQLI    180
            +EDLISTGGSVLEAV AA+ +G +VLGVVAIF+YQL KA++  F +A + LVTL++Y++LI
Sbjct: 121  VEDLISTGGSVLEAVAAAKREGADVLGVVAIFSYQLPKADKNFADAGVKLVTLSNYSELI    180

Query: 181  KVAKVNGYITADQLVLLKKFKEDQMNWQ                                  208
             +A+  GYIT + L LLK+FKEDQ NWQ
Sbjct: 181  HLAQEEGYITPEGLDLLKRFKEDQENWQ                                  208
```

A related DNA sequence was identified in *S. pyogenes* <SEQ ID 2041> which encodes the amino acid sequence <SEQ ID 2042>. Analysis of this protein sequence reveals the following:

<SEQ ID 2044>. This protein is predicted to be orotidine 5'-phosphate decarboxylase (pyrF). Analysis of this protein sequence reveals the following:

Possible site: 28
>>> Seems to have no N-terminal signal sequence
----- Final Results -----
  bacterial cytoplasm --- Certainty = 0.1612 (Affirmative) <succ>
  bacterial membrane --- Certainty = 0.0000 (Not Clear) <succ>
  bacterial outside --- Certainty = 0.0000 (Not Clear) <succ>

Possible site: 40
>>> Seems to have an uncleavable N-term signal seq
----- Final Results -----
  bacterial membrane --- Certainty = 0.0000 (Not Clear) <succ>
  bacterial outside --- Certainty = 0.0000 (Not Clear) <succ>
  bacterial cytoplasm --- Certainty = 0.0000 (Not Clear) <succ>

An alignment of the GAS and GBS proteins is shown below:

```
Identities = 158/208 (75%), Positives = 179/208 (85%)
Query:   1  MDLARQIAMELLDIQAVYLRPQQPFTWASGVKSPIYTDNRVTLSYPETRTLIENGFVKQI     60
            M LA QIA +LLDI+AVYL+P+ PFTWASG+KSPIYTDNRVTLSYP+TR LIENGFV+ I
Sbjct:   1  MTLASQIATQLLDIKAVYLKPEDPFTWASGIKSPIYTDNRVTLSYPKTRDLIENGFVETI     60

Query:  61  QKHFPNVDIIAGTATAGIPHGAIIADKMNLPFAYIRSKAKDHGVGNQIEGRVYSGQKMVI    120
            + HFP V++IAGTATAGIPHGAIIADKM LPFAYIRSK KDHG GNQIEGRV  GQKMVI
Sbjct:  61  KAHFPEVEVIAGTATAGIPHGAIIADKMTLPFAYIRSKPKDHGAGNQIEGRVLKGQKMVI    120

Query: 121  IEDLISTGGSVLEAVTAAQSQGIEVLGVVAIFTYQLAKAEQAFREADIPLVTLTDYNQLI    180
            IEDLISTGGSVL+A  AA   +G +VLGVVAIFTY+L KA Q F+EA I  L+TL+++Y +LI
Sbjct: 121  IEDLISTGGSVLDAAAAASREGADVLGVVAIFTYELPKASQNFKEAGIKLITLSNYTELI    180

Query: 181  KVAKVNGYITADQLVLLKKFKEDQMNWQ                                  208
             VAK+ GYIT D L LLKKFKEDQ+NWQ
Sbjct: 181  AVAKLQGYITNDGLHLLKKFKEDQVNWQ                                  208
```

Based on this analysis, it was predicted that these proteins and their epitopes could be useful antigens for vaccines or diagnostics.

A related GBS nucleic acid sequence <SEQ ID 9829> which encodes amino acid sequence <SEQ ID 9830> was also identified.

Example 663

A DNA sequence (GBSx0703) was identified in *S. agalactiae* <SEQ ID 2043> which encodes the amino acid sequence The protein has homology with the following sequences in the GENPEPT database:

```
>GP:AAC95452 GB:AF068902 orotidine-5'-decarboxylase PyrF
[Streptococcus pneumoniae]
Identities = 149/231 (64%), Positives = 176/231 (75%), Gaps = 1/231 (0%)
Query:  19  MLEKCPIIALDFSDLASVTTFLEHFPKEELLFVKIGMELYYSEGPSIIRYIKSLGHRIFL     78
            M E  PIIALDF   +V  FL  FP EE L++K+GMELYY+ GP I+ Y+K LGH +FL
Sbjct:   1  MREHRPIIALDFPSFEAVKEFLALFPAEESLYLKVGMELYYAAGPEIVSYLKGLGHSVFL     60

Query:  79  DLKLHDIPNTVRSSMSVLAKLGIDMTNVHAAGGVEMMKAAREGLGKGPILLAVTQLTSTS    138
            DLKLHDIPNTV+S+M VL++LG+DMTNVHAAGGVEMMKAAREGLG    L+AVTQLTSTS
Sbjct:  61  DLKLHDIPNTVKSAMKVLSQLGVDMTNVHAAGGVEMMKAAREGLGSQAKLIAVTQLTSTS    120
```

```
Query: 139  QEQMQVDQHINLSVVDSVCHYAQKAQEAGLDGVVASAQEGMQIKKQTNEHFICLTPGIRP  198
            + QMQ  Q+I   S+ +SV HYA+K  EAGLDGVV SAQE   IK+ TN  FICLTPGIRP
Sbjct: 121  EAQMQEFQNIQTSLQESVIHYAKKTAEAGLDGVVCSAQEVQVIKQATNPDFICLTPGIRP  180

Query: 199  PQTNQLDDQKRTMTPEQARIVGADYIVVGRPITKAENPYQAYLEIKEEWNR           249
                 + DQKR MTP A  +G+DYIVVGRPIT+AE+P  AY  IK+EW +
Sbjct: 181  AGV-AVGDQKRVMTPADAYQIGSDYIVVGRPITQAEDPVAAYHAIKDEWTQ           230
```

A related DNA sequence was identified in *S. pyogenes* <SEQ ID 2045> which encodes the amino acid sequence <SEQ ID 2046>. Analysis of this protein sequence reveals the following:

Possible site: 44
>>> Seems to have no N-terminal signal sequence
----- Final Results -----
  bacterial cytoplasm --- Certainty = 0.1934 (Affirmative) <succ>
  bacterial membrane --- Certainty = 0.0000 (Not Clear) <succ>
  bacterial outside --- Certainty = 0.0000 (Not Clear) <succ>

Possible site: 52
>>> Seems to have no N-terminal signal sequence
INTEGRAL   Likelihood = −8.70   Transmembrane 192-208 (190-211)
INTEGRAL   Likelihood = −7.64   Transmembrane 226-242 (218-250)
INTEGRAL   Likelihood = −3.77   Transmembrane 388-404 (378-404)
INTEGRAL   Likelihood = −3.08   Transmembrane 293-309 (292-311)
INTEGRAL   Likelihood = −2.87   Transmembrane 165-181 (162-182)
INTEGRAL   Likelihood = −2.13   Transmembrane 267-283 (267-284)
INTEGRAL   Likelihood = −0.90   Transmembrane 114-130 (114-130)
INTEGRAL   Likelihood = −0.75   Transmembrane 318-334 (318-334)
INTEGRAL   Likelihood = −0.53   Transmembrane 140-156 (140-156)
----- Final Results -----
  bacterial membrane --- Certainty = 0.4482 (Affirmative) <succ>

An alignment of the GAS and GBS proteins is shown below:

```
Identities = 149/229 (65%), Positives = 180/229 (78%), Gaps = 1/229 (0%)
Query:  19  MLEKCPIIALDFSDLASVTTFLEHFPKEELLFVKIGMELYYSEGPSIIRYIKSLGHRIFL   78
            M E+ PIIALDFS      FL+ FP EE L+VKIGMELYY++GP I+RYIKSLGH +FL
Sbjct:   1  MKEERPIIALDFSSFEETKAFLDLFPAEEKLYVKIGMELYYAQGPDIVRYIKSLGHNVFL   60

Query:  79  DLKLHDIPNTVRSSMSVLAKLGIDMTNVHAAGGVEMMKAAREGLGKGPILLAVTQLTSTS  138
            DLKLHDIPNTVR++M+VL +L IDM  VHAAGGVEM+KAAREGLG+GP L+AVTQLTSTS
Sbjct:  61  DLKLHDIPNTVRAAMAVLKELDIDMATVHAAGGVEMLKAAREGLGQGPTLIAVTQLTSTS  120

Query: 139  QEQMQVDQHINLSVVDSVCHYAQKAQEAGLDGVVASAQEGMQIKKQTNEHFICLTPGIRP  198
            ++QM+ DQ+I  S+++SV HY++ A +A LDG V SAQE   IK  T    F CLTPGIRP
Sbjct: 121  EDQMRGDQNIQTSLLESVLHYSKGAAKAQLDGAVCSAQEVEAIKAVTPTGFTCLTPGIRP  180

Query: 199  PQTNQLDDQKRTMTPEQARIVGADYIVVGRPITKAENPYQAYLEIKEEW            247
             +N +  DQKR MTP QAR +G+DYIVVGRPIT+A++P  AY  IK EW
Sbjct: 181  KGSN-IGDQKRVMTPNQARRIGSDYIVVGRPITQAKDPVAAYQAIKAEW            228
```

Based on this analysis, it was predicted that these proteins and their epitopes could be useful antigens for vaccines or diagnostics.

Example 664

A DNA sequence (GBSx0704) was identified in *S. agalactiae* <SEQ ID 2047> which encodes the amino acid sequence <SEQ ID 2048> in others. Analysis of this protein sequence reveals the following:

-continued bacterial outside --- Certainty = 0.0000 (Not Clear) <succ>
  bacterial cytoplasm --- Certainty = 0.0000 (Not Clear) <succ>

The protein has homology with the following sequences in the GENPEPT database:

```
>GP:BAB03800 GB:AP001507 unknown conserved protein in others
[Bacillus halodurans]
Identities = 63/243 (25%), Positives = 120/243 (48%)
Query:   5  MSVVLRAGKLLIESGAEVYRVEDTMKHFAKALQIENFEAYVVSSSIIASGINRYGKQEAK   64
            M + + AG++++ +GAE YRVE+T++  AKA Q  N  ++V ++ I  S           +
Sbjct:   8  MDICMLAGEIMLINGAETYRVEETLERMAKAGQFRNVHSFVTTTGIFLSFEEEGAGDVMQ   67

Query:  65  VCNTDGVTANLGRLEAVNNLSRQIAKQDLVSPEEIVKQLDLIEHQKDYSLLVTLISYFCG  124
            +   D     +L ++ VN +SR+     ++ + E + K  ++  +  +YS L+   +
Sbjct:  68  MIRVDDRMQDLNKVTLVNQVSREFVNGEIDAAEALTKLQNIAKQPMNYSPLLLHTASGVA  127

Query: 125  AGSFSLALGSSLLDSFSAAVTGLILGYFLNLMESRIHTGFLLTILGSSVVALSANLLYFS  184
              G+FS   G +L D+  A + G +     + ++S +    F     +  +      A LL
Sbjct: 128  GGAFSYLFGGNLFDTLPAFIAGFVASMAVVHLQSYLKVRFFAEFMAAFTGGAVAILLVLI  187

Query: 185  GLGEHRSIIILGALMVMVPGAAFVNSVREFSQNNFSTGLALIMSALLICISISAGVAITI  244
            GLGE+   +I+G LM +VPG   N+VR+    +   G+          + +SI+ G+A+ I
Sbjct: 188  GLGENVDQVIIGTLMPLVPGIPLTNAVRDLISGDLLAGVTRGAECFVTSLSIATGIALAI  247
```

```
Query:  245  EII                                                247
             ++
Sbjct:  248  ALL                                                250
```

No corresponding DNA sequence was identified in *S. pyogenes*.

Based on this analysis, it was predicted that this protein and its epitopes, could be useful antigens for vaccines or diagnostics.

Example 665

A DNA sequence (GBSx0705) was identified in *S. agalactiae* <SEQ ID 2049> which encodes the amino acid sequence <SEQ ID 2050>. This protein is predicted to be ABC transporter. Analysis of this protein sequence reveals the following:

---
Possible site: 40
>>> Seems to have no N-terminal signal sequence
----- Final Results -----
  bacterial cytoplasm --- Certainty = 0.5134 (Affirmative) <succ>
  bacterial membrane --- Certainty = 0.0000 (Not Clear) <succ>
  bacterial outside --- Certainty = 0.0000 (Not Clear) <succ>
---

A related GBS nucleic acid sequence <SEQ ID 9353> which encodes amino acid sequence <SEQ ID 9354> was also identified.

The protein has homology with the following sequences in the GENPEPT database:

A related DNA sequence was identified in *S. pyogenes* <SEQ ID 2051> which encodes the amino acid sequence <SEQ ID 2052>. Analysis of this protein sequence reveals the following:

---
Possible site: 14
>>> Seems to have no N-terminal signal sequence
----- Final Results -----
  bacterial cytoplasm --- Certainty = 0.2794 (Affirmative) <succ>
  bacterial membrane --- Certainty = 0.0000 (Not Clear) <succ>
  bacterial outside --- Certainty = 0.0000 (Not Clear) <succ>
---

An alignment of the GAS and GBS proteins is shown below:

```
>GP:CAB12571 GB:Z99108 similar to ABC transporter (ATP-binding protein)
[Bacillus subtilis]
Identities = 193/288 (67%), Positives = 231/288 (80%)
Query:    1  MNDVINIVYHVENQDLVRYSGDYTNFESVYAMKKAQLEAAYERQQKEIADLQDFVNRNKA    60
             +N VIN++YHVENQ+L RY GDY  F  VY +KK QLEAAY++QQ+E+A+L+DFV RNKA
Sbjct:  222  LNSVINLIYHVENQELTRYVGDYHQFMEVYEVKKQQLEAAYKKQQQEVAELKDFVARNKA   281

Query:   61  RVATRNMAMSRQKKLDKMDIIELQAEKPKPSFEFKESRTPGRFIFQAKDLQIGYDRALTK   120
             RV+TRNMAMSRQKKLDKMD+IEL AEKPKP F FK +RT G+ IF+ KDL IGYD  L++
Sbjct:  282  RVSTRNMAMSRQKKLDKMDMIELAAEKPKPEFHFKPARTSGKLIFETKDLVIGYDSPLSR   341

Query:  121  PLNLTFERNQKIAIVGANGIGKTTLLKSLLGIIPPISGNVERGDFIDLGYFEQEVPGGNR   180
             PLNL  ER QKIA+ GANGIGKTTLLKSLLG I P+ G+VERG+ I  GYFEQEV    N
Sbjct:  342  PLNLRMERGQKIALYGANGIGKTTLLKSLLGEIQPLEGSVERGEHIYTGYFEQEVKETNN   401

Query:  181  QTPLEAVWDAFPALNQAEVRAALARCGLTSKHIESQIQVLSGGEQSKVRFCLLMNRENNV   240
                T +E VW  FP+  Q E+RAA A+CGLT+KHIES++ VLSGGE++KVR C L+N E N+
Sbjct:  402  NTCIEEVWSEFPSYTQYEIRAAPAKCGLTTKHIESRVSVLSGGEKAKVRLCKLINSETNL   461

Query:  241  LVLDEPTNHLDVDAKDELKRALKAYKGSILMVCHEPDFYEGWMDDVWD              288
             LVLDEPTNHLD DAK+ELKRALK YKGSIL++ HEPDFY    + W+
Sbjct:  462  LVLDEPTNHLDADAKEELKRALKEYKGSILLISHEPDFYMDIATETWN              509

Identities = 56/219 (25%), Positives = 97/219 (43%), Gaps = 44/219 (20%)
Query:  104  IFQAKDLQIGY-DRALTKPLNLTFERNQKIAIVGANGIGKTTLLKSLLGIIPPISGNVER   162
             I   KDL G+ DRA+      + + + ++GANG GK+T + + G + P  G VE
Sbjct:    3  ILSVKDLSHGFGDRAIFNNVSFRLLKGEHVGLIGANGEGKSTFMNIITGKLEPDEGKVEW    62

Query:  163  GDFIDLGYFEQEVPGGNRQTPLEAVWDAFPALNQAE-----------------------   198
              + +GY +Q      ++  + + DAF  L   E
Sbjct:   63  SKNVRVGYLDQHTVLEKGKSIRDVLKDAFHYLFAMEEEMNEIYNKMGEADPDELEKLLEE   122

Query:  199  ---VRAALAR----------------CGLTSKHIESQIQVLSGGEQSKVRFCLLMNRENN   239
                ++ AL                GL+    +E   LSGG+++KV      L+ +
Sbjct:  123  VGVIQDALTNNDFYVIDSKVEEIARGLGLSDIGLERDVTDLSGGQRTKVLLAKLLLEKPE   182

Query:  240  VLVLDEPTNHLDVDAKDELKRALKAYKGSILMVCHEPDF                       278
             +L+LDEPTN+LD     + LKR L+ Y+ + +++ H+  F
Sbjct:  183  ILLLDEPTNYLDEQHIEWLKRYLQEYENAFILISHDIPF                       221
```

```
Identities = 246/294 (83%), Positives = 274/294 (92%), Gaps = 1/294 (0%)
Query:   1  MNDVINIVYHVENQDLVRYSGDYTNFESVYAMKKAQLEAAYERQQKEIADLQDFVNRNKA    60
            +NDVINIVYHVENQ LVRY+GDY  F++VY MK++QLEAAYERQQKEIA+LQDFVNRNKA
Sbjct: 233  LNDVINIVYHVENQSLVRYTGDYYQFQAVYEMKQSQLEAAYERQQKEIANLQDFVNRNKA   292

Query:  61  RVATRNMAMSRQKKLDKMDIIELQAEKPKPSFEFKESRTPGRFIFQAKDLQIGYDRALTK   120
            RVATRNMAMSRQKKLDKMDIIELQAEKPKP+FEFK++RTP RFIFQ K+L IGYD LTK
Sbjct: 293  RVATRNMAMSRQKKLDKMDIIELQAEKPKPNFEFKQARTPSRFIFQTKNLVIGYDYPLTK   352

Query: 121  -PLNLTFERNQKIAIVGANGIGKTTLLKSLLGIIPPISGNVERGDFIDLGYFEQEVPGGN   179
             PLN+TFERNQKIAIVGANGIGK+TLLKSLLG+I P+ G++  GDF+++GYFEQEV G N
Sbjct: 353  EPLNITFERNQKIAIVGANGIGKSTLLKSLLGVIEPLEGHIVTGDFLEVGYFEQEVTGVN   412

Query: 180  RQTPLEAVWDAFPALNQAEVRAALARCGLTSKHIESQIQVLSGGEQSKVRFCLLMNRENN   239
            RQTPLE VWDAFPALNQAEVRAALARCGLTSKHIESQIQVLSGGEQ+KVRFCLLMNRENN
Sbjct: 413  RQTPLEVVWDAFPALNQAEVRAALARCGLTSKHIESQIQVLSGGEQAKVRFCLLMNRENN   472

Query: 240  VLVLDEPTNHLDVDAKDELKRALKAYKGSILMVCHEPDFYEGWMDDVWDFNQLS         293
            VL+LDEPTNHLD+DAK+ELKRALKAYKGSILMVCHEPDFY GW+ D WDF++L+
Sbjct: 473  VLILDEPTNHLDIDAKNELKRALKAYKGSILMVCHEPDFYNGWVTDTWDFSKLT         526

Identities = 60/218 (27%), Positives = 102/218 (46%), Gaps = 43/218 (19%)
Query: 104  IFQAKDLQIGY-DRALTKPLNLTFERNQKIAIVGANGIGKTTLLKSLLGIIPPISGNVER   162
            I + K L  G+ DRA+ + ++    + + I +VGANG GK+T +   + G + P   G VE
Sbjct:  15  ILEVKQLSHGFGDRAIFENVSFRLLKGEHIGLVGANGEGKSTFMSIVTGHLQPDEGKVEW    74

Query: 163  GDFIDLGYFEQEVPGGNRQTPLEAVWDAFPALNQAEVR-----AALA-------------   204
            ++  GY +Q    + QT + +  AF  L + E R      A++A
Sbjct:  75  SKYVTAGYLDQHTVLESGQTVRDVLRTAFDELFKTENRINEIYASMADDKADIAVLMEEV   134

Query: 205  ---------------------RCGLTSKHIESQIQVLSGGEQSKVRFCLLMNRENNV     240
                                  G+    +ES +  LSGG+++KV    L+  + ++
Sbjct: 135  GELQDRLESRDFYTLDAKIDEVARALGVMDFGMESDVTSLSGGQRTKVLLAKLLLEKPDI   194

Query: 241  LVLDEPTNHLDVDAKDELKRALKAYKGSILMVCHEPDF                        278
            L+LDEPTNHLD +  + LKR L+ Y+ + +++ H+  F
Sbjct: 195  LLLDEPTNHLDAEHIEWLKRYLQHYENAFVLISHDISF                        232
```

Based on this analysis, it was predicted that these proteins and their epitopes could be useful antigens for vaccines or diagnostics.

Example 666

A DNA sequence (GBSx0706) was identified in *S. agalactiae* <SEQ ID 2053> which encodes the amino acid sequence <SEQ ID 2054>. This protein is predicted to be lipoprotein Nlp1 precursor (pstS). Analysis of this protein sequence reveals the following:

---
Possible site: 32
>>> Seems to have no N-terminal signal sequence
----- Final Results -----
   bacterial cytoplasm --- Certainty = 0.2637 (Affirmative) <succ>
      bacterial membrane --- Certainty = 0.0000 (Not Clear) <succ>
         bacterial outside --- Certainty = 0.0000 (Not Clear) <succ>
---

The protein has homology with the following sequences in the GENPEPT database:

A related DNA sequence was identified in *S. pyogenes* <SEQ ID 1695> which encodes the amino acid sequence <SEQ ID 1696>. Analysis of this protein sequence reveals the following:

---
Possible site: 24
>>> May be a lipoprotein
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>
---

An alignment of the GAS and GBS proteins is shown below:

```
>GP:CAB14429 GB:Z99116 alternate gene name: yzmB~similar to phosphate ABC
transporter (binding protein) [Bacillus subtilis]
Identities = 42/62 (67%), Positives = 49/62 (78%)
Query:  15  SITSVGSTALQPLVEAAADEFGKTNLGKTINVQGGGSGTGLSQVQSGAVQIGNSDLFAEE    74
            S+T  GS+A+QPLV AAA++F + N   I VQ GGSGTGLSQV  GAVQIGNSD+FAEE
Sbjct:  45  SLTISGSSAMQPLVLAAAEKFMEENPDADIQVQAGGSGTGLSQVSEGAVQIGNSDVFAEE   104

Query:  75  KE                                                            76
            KE
Sbjct: 105  KE                                                           106
```

```
Identities = 63/74 (85%), Positives = 71/74 (95%)
Query:   3   LSGCANWIDKGQSITSVGSTALQPLVEAAADEFGKTNLGKTINVQGGGSGTGLSQVQSGA    62
             LS C++WIDKG+SIT+VGSTALQPLVEA ADEFG +NLGKT+NVQGGGSGTGLSQVQSGA
Sbjct:  20   LSACSSWIDKGESITAVGSTALQPLVEAVADEFGSSNLGKTVNVQGGGSGTGLSQVQSGA    79

Query:  63   VQIGNSDLFAEEKE    76
             VQIGNSD+FAEEK+
Sbjct:  80   VQIGNSDVFAEEKD    93
```

Based on this analysis, it was predicted that these proteins and their epitopes could be useful antigens for vaccines or diagnostics.

Example 667

A DNA sequence (GBSx0707) was identified in *S. agalactiae* <SEQ ID 2055> which encodes the amino acid sequence <SEQ ID 2056>. This protein is predicted to be lipoprotein Nlp1 precursor (pstS). Analysis of this protein sequence reveals the following:

Possible site: 60
>>> Seems to have an uncleavable N-term signal seq
----- Final Results -----
  bacterial membrane --- Certainty = 0.0000 (Not Clear) <succ>
    bacterial outside --- Certainty = 0.0000 (Not Clear) <succ>
       bacterial cytoplasm --- Certainty = 0.0000 (Not Clear) <succ>

A related GBS nucleic acid sequence <SEQ ID 9343> which encodes amino acid sequence <SEQ ID 9344> was also identified.

The protein has homology with the following sequences in the GENPEPT database:

```
>GP:CAB14429 GB:Z99116 alternate gene name: yzmB~similar to phosphate ABC
transporter (binding protein) [Bacillus subtilis]
Identities = 95/184 (51%), Positives = 126/184 (67%), Gaps = 1/184 (0%)
Query:    3   DHQVAVAGLAVIVNKKVNVKNLTTHQLRDIFAGKIKNWKEVGGQDLDISIINRAASSGSR     62
              DHQVAV G+A  VN     VK+++  +L+ IF GKIKNWKE+GG+D  I+++NR   SSG+R
Sbjct:  115   DHQVAVVGMAAAVNPDAGVKDISKDELKKIFTGKIKNWKELGGKDQKITLVNRPDSSGTR    174

Query:   63   ATFDNTIMGNVAPIQSQEQDSNGMVKSIVSQTPGAISYLAFAYV-DKSVGTLKLNGFAPT    121
              ATF   +   P +    +DS+  VK I++ TPGAI YLAF+Y+ D  V L ++G  P
Sbjct:  175   ATFVKYALDGAEPAEGITEDSSNTVKKIIADTPGAIGYLAFSYLTDDKVTALSIDGVKPE    234

Query:  122   AKNVTIDNWKLWSYEHMYTKGNETGLTKEFLDYMKSDKVQSSIVQHMGYISINDMKVVKD    181
              AKNV T   + +W+Y+H  YTKG   TGL KEFLDY+KS+ +Q SIV   GYI + DMKV +D
Sbjct:  235   AKNVATGEYPIWAYQHSYTKGEATGLAKEFLDYLKSEDIQKSIVTDQGYIPVTDMKVTRD    294

Query:  182   AEGK    185
              A GK
Sbjct:  295   ANGK    298
```

There is also homology to SEQ ID 1696.

Figure 135:
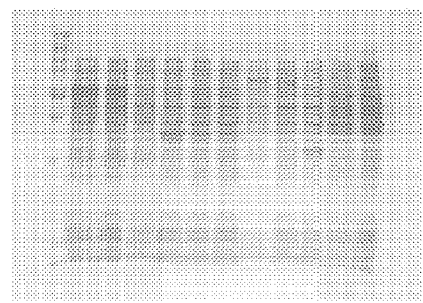

SEQ ID 9344 (GBS659) was expressed in *E. coli* as a GST-fusion product. SDS-PAGE analysis of total cell extract is shown in FIG. 135 (lane 2 & 3; MW 60 kDa). It was also expressed in *E. coli* as a His-fusion product. SDS-PAGE analysis of total cell extract is shown in FIG. 135 (lane 5-7; MW 35 kDa) and in FIG. 178 (lane 11; MW 35 kDa).

Figure 228:
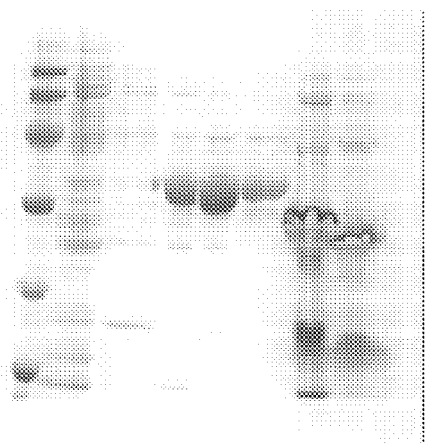

GBS659-His was purified as shown in FIG. 228, lane 6-8.

Based on this analysis, it was predicted that these proteins and their epitopes could be useful antigens for vaccines or diagnostics.

Example 668

A DNA sequence (GBSx0708) was identified in *S. agalactiae* <SEQ ID 2057> which encodes the amino acid sequence <SEQ ID 2058>. This protein is predicted to be phosphate transporter permease PstC (pstC-2). Analysis of this protein sequence reveals the following:

Possible site: 47
>>> Seems to have no N-terminal signal sequence
INTEGRAL    Likelihood = -15.50    Transmembrane 35-51 (27-61)
INTEGRAL    Likelihood = -7.64     Transmembrane 167-183 (154-186)
INTEGRAL    Likelihood = -6.37     Transmembrane 282-298 (277-302)
INTEGRAL    Likelihood = -5.52     Transmembrane 85-101 (81-116)
INTEGRAL    Likelihood = -3.24     Transmembrane 133-149 (131-155)
----- Final Results -----
  bacterial membrane --- Certainty = 0.7198 (Affirmative) <succ>
    bacterial outside --- Certainty = 0.0000 (Not Clear) <succ>
       bacterial cytoplasm --- Certainty = 0.0000 (Not Clear) <succ>

A related GBS nucleic acid sequence <SEQ ID 8635> which encodes amino acid sequence <SEQ ID 8636> was also identified. Analysis of this protein sequence reveals the following:

Lipop: Possible site: -1    Crend: 8
SRCFLG: 0

-continued

McG: Length of UR: 5
Peak Value of UR: -0.12
Net Charge of CR: 2
McG: Discrim Score: -16.22
GvH: Signal Score (-7.5) : -4.26
Possible site: 41
>>> Seems to have no N-terminal signal sequence
Amino Acid Composition: calculated from 1
ALOM program count: 5  value: -15.50  threshold: 0.0
INTEGRAL    Likelihood = -15.50    Transmembrane 29- 45 ( 21-55)
INTEGRAL    Likelihood = -7.64     Transmembrane 161-177 (148 -180)
INTEGRAL    Likelihood = -6.37     Transmembrane 276-292 (271 -296)

1193
-continued

| | | |
|---|---|---|
| INTEGRAL | Likelihood = −5.52 | Transmembrane 79-95 (75-110) |
| INTEGRAL | Likelihood = −3.24 | Transmembrane 127-143 (125-149) |
| PERIPHERAL | Likelihood = 0.69 | 205 | modified ALOM score: 3.60
icml HYPID: 7 CFP: 0.720
\*\*\* Reasoning Step: 3
----- Final Results -----

1194
-continued bacterial membrane --- Certainty = 0.7198 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the GENPEPT database:

```
>GP:CAB14428 GB:Z99116 alternate gene name: yzmC~similar to phosphate ABC
transporter (permease) [Bacillus subtilis]
Identities = 145/303 (47%), Positives = 209/303 (68%), Gaps = 4/303 (1%)
Query:   8 KNQELAKKLTSPSKNSRLEKFGKGITFLSLALIVFIVAM-ILIFVAQKGLSTFFVDGVKL     66
             +N ++++L S +N +L++   + + ALI+   ++ I IF+  KGL +F V+GV
Sbjct:   6 ENMSVSERLISSRQNRQLDEVRGRMIVTACALIMIAASVAITIFLGVKGLQSFLVNGVSP     65

Query:  67 TDFLFNTKWEP--SAKSFGAFPMIAGSFIVTILSAIIATPFAIGAAVFMTEISPKYGSKI    124
             +FL +  W P  S   +G  P I GSF VTILSA+IA P  I   +FMTEI+P +G K+
Sbjct:  66 IEFLTSLNWNPTDSDPKYGVLPFIFGSFAVTILSALIAAPLGIAGPIFMTEIAPNWGKKV    125

Query: 125 LQPAVELLVGIPSVVYGFIGLQIIVPFVRSI-FGGTGFGILSGVCVLFVMILPTVTFMTV    183
             LQP +ELLVGIPSVVYGFIGL ++VPF+      GTG  +L+G  VL VMILPT+T ++
Sbjct: 126 LQPVIELLVGIPSVVYGFIGLTVLVPFIAQFKSSGTGHSLLAGTIVLSVMILPTITSISA    185

Query: 184 DSLRAVPRHYKEASLAMGATRWQTIWRVILNAARPGIFTAIVFGMARAFGEALAIQMVVG    243
             D++ ++P+  +E S A+GATRWQTI +V++ AA P + TA+V GMARAFGEALA+QMV+G
Sbjct: 186 DAMASLPKSLREGSYALGATRWQTIRKVLVPAAFPILMTAVVLGMARAFGEALAVQMVIG    245

Query: 244 NSAILPTSLTTPAATLTSVLTMGIGNTVMGTVQNNVLWSLALVLLIMSLAFNTVIKLITR    303
             N+ +LP S   A TLT+++T+ +G+T  G+V+NN LWS+ LVLL+MS  F  +I+ ++
Sbjct: 246 NTRVLPESPFDTAGTLTTIITLNMGHTTYGSVENNTLWSMGLVLLVMSFLFILLIRYLSS    305

Query: 304 EGK    306
             K
Sbjct: 306 RRK    308
```

A related DNA sequence was identified in *S. pyogenes* <SEQ ID 1691> which encodes the amino acid sequence <SEQ ID 1692>. Analysis of this protein sequence reveals the following:

```
Possible site: 41
>>> Seems to have no N-terminal signal sequence
INTEGRAL    Likelihood = −17.25    Transmembrane 29-45 (21-55)
INTEGRAL    Likelihood = −7.22     Transmembrane 162-178 (154-184)
INTEGRAL    Likelihood = −5.57     Transmembrane 282-298 (277-302)
INTEGRAL    Likelihood = −5.41     Transmembrane 96-112 (81-116)
INTEGRAL    Likelihood = −3.08     Transmembrane 133-149 (131-152)
----- Final Results -----
   bacterial membrane --- Certainty = 0.7899 (Affirmative) <succ>
   bacterial outside --- Certainty = 0.0000 (Not Clear) <succ>
   bacterial cytoplasm --- Certainty = 0.0000 (Not Clear) <succ>
```

An alignment of the GAS and GBS proteins is shown below:

```
Identities = 266/311 (85%), Positives = 290/311 (92%), Gaps = 6/311 (1%)
Query:   7 MKNQELAKKLTSPSKNSRLEKFGKGITFLSLALIVFIVAMILIFVAQKGLSTFFVDGVKL     66
             M+NQELAKKL SPSKNSRLE FG+ ITFL LALIVFIVAMILIFVAQKGLSTFFVD V L
Sbjct:   1 MENQELAKKLASPSKNSRLETFGRTITFLCLALIVFIVAMILIFVAQKGLSTFFVDKVNL     60

Query:  67 TDFLFNTKWEPSAKS------FGAFPMIAGSFIVTILSAIIATPFAIGAAVFMTEISPKY    120
              DFLF +W+PS K+       GA PMI GSF+VTILSAIIATPFAIGAAVFMTEISPKY
Sbjct:  61 FDFLFGKEWQPSVKNAAGIPYLGALPMITGSFLVTILSAIIATPFAIGAAVFMTEISPKY    120

Query: 121 GSKILQPAVELLVGIPSVVYGFIGLQIIVPFVRSIFGGTGFGILSGVCVLFVMILPTVTF    180
             G+K+LQPAVELLVGIPSVVYGFIGLQ+IVPF+RSIFGGTGFGILSGVCVLFVMILPTVTF
Sbjct: 121 GAKLLQPAVELLVGIPSVVYGFIGLQVIVPFMRSIFGGTGFGILSGVCVLFVMILPTVTF    180

Query: 181 MTVDSLRAVPRHYKEASLAMGATRWQTIWRVILNAARPGIFTAIVFGMARAFGEALAIQM    240
             MT DSLRAVPRHY+EAS+AMGATRWQTIWRV+LNAARPGIFTA++FGMARAFGEALAIQM
```

```
                          -continued
Sbjct:  181  MTTDSLRAVPRHYREASMAMGATRWQTIWRVVLNAARPGIFTAVIFGMARAFGEALAIQM  240

Query:  241  VVGNSAILPTSLTTPAATLTSVLTMGIGNTVMGTVQNNVLWSLALVLLIMSLAFNTVIKL  300
             VVGNSA++P+SLTTPAATLTSVLTMGIGNTVMGTVQNNVLWSLALVLL+MSLAFN+++KL
Sbjct:  241  VVGNSAVMPSSLTTPAATLTSVLTMGIGNTVMGTVQNNVLWSLALVLLLMSLAFNSLVKL  300

Query:  301  ITREGKKNYER                                                  311
             IT+E K+NYER
Sbjct:  301  ITKERKRNYER                                                  311
```

Based on this analysis, it was predicted that these proteins and their epitopes could be useful antigens for vaccines or diagnostics.

Example 669

A DNA sequence (GBSx0709) was identified in *S. agalactiae* <SEQ ID 2059> which encodes the amino acid sequence <SEQ ID 2060>. Analysis of this protein sequence reveals the following:

---
Possible site: 13
>>> Seems to have no N-terminal signal sequence
----- Final Results -----
   bacterial cytoplasm --- Certainty = 0.2469 (Affirmative) <succ>

--- transporter permease protein in soda-comga intergenic reg. Analysis of this protein sequence reveals the following:

---
Possible site: 18
>>> Seems to have a cleavable N-term signal seq.
INTEGRAL    Likelihood = −9.24    Transmembrane 20-36 (19-41)
INTEGRAL    Likelihood = −8.28    Transmembrane 66-82 (57-88)
INTEGRAL    Likelihood = −6.90    Transmembrane 260-276 (258-285)
INTEGRAL    Likelihood = −5.47    Transmembrane 109-125 (106-129)
INTEGRAL    Likelihood = −2.87    Transmembrane 181-197 (178-198)
----- Final Results -----
   bacterial membrane --- Certainty = 0.4694 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the GENPEPT database:

```
>GP:CAB14427 GB:Z99116 alternate gene name: yzmD~similar to phosphate ABC
transporter (permease) [Bacillus subtilis]
Identities = 157/294 (53%), Positives = 225/294 (76%)
Query:    1  MNAKKADKLATTILYSIAAIIVTILASLLIFILVRGLPHVSWSFLTGKSSSYEAGGGIGI   60
             MN K  DKLAT +   AAII  IL  L  +I++ G+  +S+ F+T KSS+  AGGGI
Sbjct:    1  MNRKITDKLATGMFGLCAAIIAAILVGLFSYIIINGVSQLSFQFITTKSSAIAAGGGIRD   60

Query:   61  QLYNSFFLLIVTLIISIPLSLGAGIYLSEYAKKGRLTNFVRTCIEILSSLPSVVVGLFGY  120
             QL+NSF++L +T++I+IPL +G G++++EYA    ++T+F+RTCIE+LSSLPS+V+G+FG
Sbjct:   61  QLFNSFYILFITMLITIPLGVGGGVFMAEYAPNNKVTDFIRTCIEVLSSLPSIVIGMFGL  120

Query:  121  LIFVVQFQYGFSIISGALALTVFNLPQMTRSVEDSLQNVHHTQREAGLALGISRWETVIY  180
             L+FV   +G++II GALALTVFNLP M R  ED++++V   +EA LALG+SRW TV
Sbjct:  121  LMFVNLTGWGYTIIGGALALTVFNLPVMVRVTEDAIRSVPKDLKEASLALGVSRWHTVKT  180

Query:  181  VVVPEALPSIVTGVVLASGRIFGEAAALIYTAGQSAPALDWSNWNVLSVTSPISIFRQAE  240
             V++P A+PSI+TG +LASGR+FGEAAAL++TAG + P L+++  WN  S TSP++IFR AE
Sbjct:  181  VLIPSAIPSIITGAILASGRVFGEAAALLFTAGLTTPRLNFTEWNPFSETSPLNIFRPAE  240

Query:  241  TLAVHIWKVNSEGTIPDATQVSAGSAAVLLVVILIFNLSARSIGKKLHSKLTSS        294
             TLAVHIW  VN++G IPDA ++  G +  VL++  +L+FNL+AR +G   ++ KLT++
Sbjct:  241  TLAVHIWNVNTQGMIPDAEAIANGGSPVLVISVLVFNLAARWLGTMIYKKLTAN        294

294
```

---
-continued
   bacterial membrane --- Certainty = 0.0000 (Not Clear) <succ>
   bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 670

A DNA sequence (GBSx0710) was identified in *S. agalactiae* <SEQ ID 2061> which encodes the amino acid sequence <SEQ ID 2062>. This protein is predicted to be probable abc A related DNA sequence was identified in *S. pyogenes* <SEQ ID 1685> which encodes the amino acid sequence <SEQ ID 1686>. Analysis of this protein sequence reveals the following:

---
Possible site: 56
>>> Seems to have an uncleavable N-term signal seq
INTEGRAL    Likelihood = −11.89    Transmembrane 17-33 (8-40)
INTEGRAL    Likelihood = −10.19    Transmembrane 260-276 (257-285)
INTEGRAL    Likelihood = −5.89     Transmembrane 66-82 (57-87)
INTEGRAL    Likelihood = −5.47     Transmembrane 109-125 (106-129)
INTEGRAL    Likelihood = −2.02     Transmembrane 181-197 (180-197)
----- Final Results -----
   bacterial membrane --- Certainty = 0.5755 (Affirmative) <succ>
   bacterial outside --- Certainty = 0.0000 (Not Clear) <succ>
   bacterial cytoplasm --- Certainty = 0.0000 (Not Clear) <succ>

An alignment of the GAS and GBS proteins is shown below:

```
Identities = 257/294 (87%), Positives = 278/294 (94%)
Query:   1  MNAKKADKLATTILYSIAAIIVTILASLLIFILVRGLPHVSWSFLTGKSSSYEAGGGIGI   60
            MNAKK DK+AT  LY+IA IIV ILASL+++ILVRGLPH+SWSFLTGKSSSYEAGGGIGI
Sbjct:   1  MNAKKVDKVATGTLYTIAGIIVAILASLILYILVRGLPHISWSFLTGKSSSYEAGGGIGI   60

Query:  61  QLYNSFFLLIVTLIISIPLSLGAGIYLSEYAKKGRLTNFVRTCIEILSSLPSVVVGLFGY  120
            QLYNSFFLLIVTLIISIPLS GAGIYL+EYAKKG +TNF+RTCIEILSSLPSVVVGLFGY
Sbjct:  61  QLYNSFFLLIVTLIISIPLSTGAGIYLAEYAKKGPVTNFIRTCIEILSSLPSVVVGLFGY  120

Query: 121  LIFVVQFQYGFSIISGALALTVFNLPQMTRSVEDSLQNVHHTQREAGLALGISRWETVIY  180
            LIFVVQF+YGFSIISGALALTVFNLPQMTR+VEDSL +VHHTQREAGLALG+SRWETV Y
Sbjct: 121  LIFVVQFEYGFSIISGALALTVFNLPQMTRNVEDSLLHVHHTQREAGLALGLSRWETVFY  180

Query: 181  VVVPEALPSIVTGVVLASGRIFGEAAALIYTAGQSAPALDWSNWNVLSVTSPISIFRQAE  240
            VV+PEALP +VTG+VLASGRIFGEAAALIYTAGQSAPALDWSNWN LSVTSPISIFRQ+E
Sbjct: 181  VVIPEALPGMVTGIVLASGRIFGEAAALIYTAGQSAPALDWSNWNPLSVTSPISIFRQSE  240

Query: 241  TLAVHIWKVNSEGTIPDATQVSAGSAAVLLVVILIFNLSARSIGKKLHSKLTSS        294
            TLAVHIWKVNSEGTIPDAT VSAGSAAVLL+ ILIFN SA  IGKKLHSK+T++
Sbjct: 241  TLAVHIWKVNSEGTIPDATLVSAGSAAVLLIFILIFNFSAHFIGKKLHSKMTAA        294
```

Based on this analysis, it was predicted that these proteins and their epitopes could be useful antigens for vaccines or diagnostics.

Example 671

A DNA sequence (GBSx0711) was identified in *S. agalactiae* <SEQ ID 2063> which encodes the amino acid sequence <SEQ ID 2064>. This protein is predicted to be phosphate ABC transporter, ATP-binding protein (pstB) (pstB-2). Analysis of this protein sequence reveals the following:

Possible site: 60
>>> Seems to have no N-terminal signal sequence
----- Final Results -----
   bacterial cytoplasm --- Certainty = 0.4506 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database:

A related DNA sequence was identified in *S. pyogenes* <SEQ ID 1681> which encodes the amino acid sequence <SEQ ID 1682>. Analysis of this protein sequence reveals the following:

Possible site: 20
>>> Seems to have no N-terminal signal sequence
----- Final Results -----
   bacterial cytoplasm --- Certainty = 0.2796 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below:

```
>GP:AAB99016 GB:U67544 phosphate specific transport complex component (pstB)
[Methanococcus jannaschii]
Identities = 154/247 (62%), Positives = 204/247 (82%)
Query:  21  LTTKDLHVYYGEKEAIKGIDMQFEKNKITALIGPSGCGKSTYLRSLNRMNDTIDIARVTG   80
            + TK+L+++YGEK+A+  I++   +NKITALIGPSGCGKST+LR LNR+ND I   R+ G
Sbjct:   6  METKNLNLWYGEKQALFDINLPIYENKITALIGPSGCGKSTFLRCLNRLNDLIPNVRIEG   65

Query:  81  QIMYEGIDVNAQDINVYEMRKHIGMVFQRPNPFAKSIYKNITFAYERAGVKDKKFLDEVV  140
            +++ +G ++  +D++VYE+RK +GMVFQ+PNPFA SIY N+ F       G+KDKK LD++V
Sbjct:  66  EVLLDGKNIYDKDVDVYELRKRVGMVFQKPNPFAMSIYDNVAFGPRIHGIKDKKELDKIV  125

Query: 141  ETSLKQAALWDQVKDDLHKSAFTLSGGQQQRLCIARAIAVKPEILLMDEPASALDPIATM  200
            E +LK+AALWD+VKD+LHK+A +LSGGQQQRLCIARAIAVKPE+LLMDEP SALDPI+T+
Sbjct: 126  EWALKKAALWDEVKDELHKNALSLSGGQQQRLCIARAIAVKPEVLLMDEPTSALDPISTL  185

Query: 201  QLEETMFELKKNYTIIIVTHNMQQAARASDYTAFFYLGDLIEYDKTNNIFQNAKCQSTSD  260
            ++EE M EL K+YTI++VTHNMQQA+R SDYTAFF +G LIE+ +T  IF N + + T D
Sbjct: 186  KIEELMVELAKDYTIVVVTHNMQQASRVSDYTAFFLMGKLIEFGETEQIFLNPQKKETDD  245

Query: 261  YVSGRFG        267
            Y+SGRFG
Sbjct: 246  YISGRFG        252
```

```
Identities = 242/267 (90%), Positives = 258/267 (95%)
Query:   1  MAEYNWDERHIITFPEENSALTTKDLHVYYGEKEAIKGIDMQFEKNKITALIGPSGCGKS   60
            M EYNW+ERHIITFPEE  AL TKDLHVYYG KEAIKGIDMQFEK+KITALIGPSGCGKS
Sbjct:   1  MTEYNWNERHIITFPEETLALATKDLHVYYGAKEAIKGIDMQFEKHKITALIGPSGCGKS   60

Query:  61  TYLRSLNRMNDTIDIARVTGQIMYEGIDVNAQDINVYEMRKHIGMVFQRPNPFAKSIYKN  120
            TYLRSLNRMNDTIDIARVTG+I+Y+GIDVN +D+NVYE+RKH+GMVFQRPNPFAKSIYKN
Sbjct:  61  TYLRSLNRMNDTIDIARVTGEILYQGIDVNRKDMNVYEIRKHLGMVFQRPNPFAKSIYKN  120

Query: 121  ITFAYERAGVKDKKFLDEVVETSLKQAALWDQVKDDLHKSAFTLSGGQQQRLCIARAIAV  180
            ITFA+ERAGVKDKK LDE+VETSLKQAALWDQVKDDLHKSAFTLSGGQQQRLCIARAI+V
Sbjct: 121  ITFAHERAGVKDKKVLDEIVETSLKQAALWDQVKDDLHKSAFTLSGGQQQRLCIARAISV  180

Query: 181  KPEILLMDEPASALDPIATMQLEETMFELKKNYTIIIVTHNMQQAARASDYTAFFYLGDL  240
            KP+ILLMDEPASALDPIATMQLEETMFELKKNYTIIIVTHNMQQAARASDYTAFFYLG+L
Sbjct: 181  KPDILLMDEPASALDPIATMQLEETMFELKKNYTIIIVTHNMQQAARASDYTAFFYLGNL  240

Query: 241  IEYDKTNNIFQNAKCQSTSDYVSGRFG  267
            IEYDKT NIFQNA+CQST+DYVSG FG
Sbjct: 241  IEYDKTRNIFQNAQCQSTNDYVSGHFG  267
```

Based on this analysis, it was predicted that these proteins and their epitopes could be useful antigens for vaccines or diagnostics.

Example 672

A DNA sequence (GBSx0712) was identified in *S. agalactiae* <SEQ ID 2065> which encodes the amino acid sequence <SEQ ID 2066>. This protein is predicted to be phosphate ABC transporter, ATP-binding protein (pstB-1). Analysis of this protein sequence reveals the following:

Possible site: 50
>>> Seems to have no N-terminal signal sequence
----- Final Results -----
  bacterial cytoplasm --- Certainty = 0.3806 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 9815> which encodes amino acid sequence <SEQ ID 9816> was also identified.

The protein has homology with the following sequences in the GENPEPT database:

A related DNA sequence was identified in *S. pyogenes* <SEQ ID 2067> which encodes the amino acid sequence <SEQ ID 2068>. Analysis of this protein sequence reveals the following:

Possible site: 46
>>> Seems to have no N-terminal signal sequence
----- Final Results -----
  bacterial cytoplasm --- Certainty = 0.3590 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below:

```
>GP:CAB14426 GB:Z99116 alternate gene name: yzmE-similar to phosphate ABC
transporter (ATP-binding protein) [Bacillus subtilis]
Identities = 148/248 (59%), Positives = 189/248 (75%)
Query:   5  ILQVSDLSVYYNKKKALKEVSMDFYPNEITALIGPSGSGKSTLLRAINRMGDLNPEVTLT   64
            +L+V DLS+YY K+A+  V+MD  N +TALIGPSG GKST LR INRM DL P
Sbjct:  22  VLEVKDLSIYYGNKQAVHHVNMDIEKNAVTALIGPSGCGKSTFLRNINRMNDLIPSARAE   81

Query:  65  GAVMYNGHNVYSPRTDTVELRKEIGMVFQQPNPFPMSVFENVVYGLRLKGIKDKATLDEA  124
            G ++Y G N+     + V LR+EIGMVFQ+PNPFP S++ N+ + L+  G ++KA LDE
Sbjct:  82  GEILYEGLNILGGNINVVSLRREIGMVFQKPNPFPKSIYANITHALKYAGERNKAVLDEI  141

Query: 125  VETSLKGASIWDEVKDRLHDSALGLSGGQQQRVCIARTLATKPKIILLDEPTSALDPISA  184
            VE SL  A++WDEVKDRLH SAL LSGGQQQR+CIARTLA KP ++LLDEP SALDPIS
Sbjct: 142  VEESLTKAALWDEVKDRLHSSALSLSGGQQQRLCIARTLAMKPAVLLLDEPASALDPISN  201

Query: 185  GKIEETLHGLKDQYTMLLVTRSMQQASRISDRTGFFLDGNLIEYGNTKEMFMNPKHKETE  244
             KIEE + GLK +Y++++VT +MQQA R+SDRT FFL+G L+EYG T+++F +PK ++TE
Sbjct: 202  AKIEELITGLKREYSIIIVTHNMQQALRVSDRTAFFLNGELVEYGQTEQIFTSPKKQKTE  261

Query: 245  DYITGKFG  252
            DYI GKFG
Sbjct: 262  DYINGKFG  269
```

```
Identities = 208/252 (82%), Positives = 235/252 (92%)
Query:   1 MTQPILQVSDLSVYYNKKKALKEVSMDFYPNEITALIGPSGSGKSTLLRAINRMGDLNPE    60
           MT+PILQ+ DLSVYYN+KK LK+VS+D YPNEITALIGPSGSGKSTLLR+INRM DLNPE
Sbjct:   2 MTEPILQIRDLSVYYNQKKTLKDVSLDLYPNEITALIGPSGSGKSTLLRSINRMNDLNPE    61

Query:  61 VTLTGAVMYNGHNVYSPRTDTVELRKEIGMVFQQPNPFPMSVFENVVYGLRLKGIKDKAT   120
           VT+TG+++YNGHN+YSPRTDTV+LRKEIGMVFQQPNPFPMS++ENVVYGLRLKGI+DK+
Sbjct:  62 VTITGSIVYNGHNIYSPRTDTVDLRKEIGMVFQQPNPFPMSIYENVVYGLRLKGIRDKSI   121

Query: 121 LDEAVETSLKGASIWDEVKDRLHDSALGLSGGQQQRVCIARTLATKPKIILLDEPTSALD   180
           LD AVE+SLKGASIW+EVKDRLHDSA+GLSGGQQQRVCIAR LAT P+IILLDEPTSALD
Sbjct: 122 LDHAVESSLKGASIWNEVKDRLHDSAVGLSGGQQQRVCIARVLATSPRIILLDEPTSALD   181

Query: 181 PISAGKIEETLHGLKDQYTMLLVTRSMQQASRISDRTGFFLDGNLIEYGNTKEMFMNPKH   240
           PISAGKIEETL   LK  YT+ +VTRSMQQASR+SDRTGFFL+G+L+E G TK MFMNPK
Sbjct: 182 PISAGKIEETLLLLKKDYTLAIVTRSMQQASRLSDRTGFFLEGDLLECGPTKAMFMNPKR   241

Query: 241 KETEDYITGKFG                                                 252
           KETEDYI+GKFG
Sbjct: 242 KETEDYISGKFG                                                 253
```

Based on this analysis, it was predicted that these proteins and their epitopes could be useful antigens for vaccines or diagnostics.

Example 673

A DNA sequence (GBSx0713) was identified in *S. agalactiae* <SEQ ID 2069> which encodes the amino acid sequence <SEQ ID 2070>. Analysis of this protein sequence reveals the following:

---
Possible site: 21
>>> Seems to have no N-terminal signal sequence
----- Final Results -----
   bacterial cytoplasm --- Certainty = 0.1937 (Affirmative) <succ>
     bacterial membrane --- Certainty = 0.0000 (Not Clear) <succ>
      bacterial outside --- Certainty = 0.0000 (Not Clear) <succ>
---

The protein has homology with the following sequences in the GENPEPT database:

A related DNA sequence was identified in *S. pyogenes* <SEQ ID 1677> which encodes the amino acid sequence <SEQ ID 1678>. Analysis of this protein sequence reveals the following:

---
Possible site: 21
>>> Seems to have no N-terminal signal sequence
----- Final Results -----
   bacterial cytoplasm --- Certainty = 0.2229 (Affirmative) <succ>
     bacterial membrane --- Certainty = 0.0000 (Not Clear) <succ>
      bacterial outside --- Certainty = 0.0000 (Not Clear) <succ>
---

An alignment of the GAS and GBS proteins is shown below:

```
>GP:AAD22042 GB:AF118229 PhoU [Streptococcus pneumoniae]
Identities = 75/216 (34%), Positives = 126/216 (57%), Gaps = 1/216 (0%)
Query:   2 LRSKFDEELDKLHNQFYAMGIEAIGQIKKTVRAFVSHDRELAKEVIEDDVTLNNFETKLE    61
           +R++FD EL +L    F  +G +    K + A  S D+E+A+ +I  D  +N  ++ +E
Sbjct:   1 MRNQFDLELHELEQSFLGLGQLVLETASKALLALASKDKEMAELIINKDHAINQGQSAIE    60

Query:  62 KKSLEIIALQQPVSQDLRTVITVLKATSDVERMGDHAAAVAKATIRMKGEERIPAVELEI   121
                 ++ALQQP    DLR VI+++  + SD+ERMGDH A  +AKA +++K E ++    E ++
Sbjct:  61 LTCARLLALQQPQVSDLRFVISIMSSCSDLERMGDHMAGIAKAVLQLK-ENQLAPDEEQL   119

Query: 122 NNMGKAVKNMLEEALTAYINGDDEKAYEVAAMDEIVDDYFRDIQKMVVETIQKHPDVAFA   181
           +  MGK    +ML + L A+         KA   +A  DE +D Y+   + K ++    ++
Sbjct: 120 HQMGKLSLSMLADLLVAFPLHQASKAISIAQKDEQIDQYYYALSKEIIGLMKDQETSIPN   179

Query: 182 AKEYFQVLMHLERIGDYGKNICEWIVYLKTGKIIEL                         217
           +Y  ++ HLER  DY  NICE  +VYL+TG++++L
Sbjct: 180 GTQYLYIIGHLERFADYIANICERLVYLETGELVDL                         215
```

```
Identities = 174/217 (80%), Positives = 194/217 (89%)
Query:   1  MLRSKFDEELDKLHNQFYAMGIEAIGQIKKTVRAFVSHDRELAKEVIEDDVTLNNFETKL    60
            MLR+KF+EELDKLHNQFY+MG+E + QI KTVRAFVSHDRELAKEVIE+D T+NNFETKL
Sbjct:   1  MLRTKFEEELDKLHNQFYSMGMEVLAQINKTVRAFVSHDRELAKEVIEEDDTINNFETKL    60

Query:  61  EKKSLEIIALQQPVSQDLRTVITVLKATSDVERMGDHAAAVAKATIRMKGEERIPAVELE   120
            EKKSLEIIALQQPVS DLR VITVLKA+SD+ERMGDHAA++AKATIRMKGEERIP VE +
Sbjct:  61  EKKSLEIIALQQPVSNDLRMVITVLKASSDIERMGDHAASIAKATIRMKGEERIPVVEEQ   120

Query: 121  INNMGKAVKNMLEEALTAYINGDDEKAYEVAAMDEIVDDYFRDIQKMVVETIQKHPDVAF   180
            IN MGKAVK M+EEAL AYIN DD KAYE+AA DEI+D YFR+IQ + VE I+K PD  F
Sbjct: 121  INLMGKAVKQMVEEALNAYINADDTKAYEIAASDEIIDQYFRNIQTLAVEEIRKSPDAVF   180

Query: 181  AAKEYFQVLMHLERIGDYGKNICEWIVYLKTGKIIEL                         217
            A KEYFQVLM+LERIGDY +NICEWIVYLKTGKIIEL
Sbjct: 181  AGKEYFQVLMYLERIGDYARNICEWIVYLKTGKIIEL                         217
```

Based on this analysis, it was predicted that these proteins and their epitopes could be useful antigens for vaccines or diagnostics.

Example 674

A DNA sequence (GBSx0714) was identified in *S. agalactiae* <SEQ ID 2071> which encodes the amino acid sequence <SEQ ID 2072>. This protein is predicted to be aminopeptidase N. Analysis of this protein sequence reveals the following:

```
Possible site: 30
>>> Seems to have no N-terminal signal sequence
----- Final Results -----
    bacterial cytoplasm --- Certainty = 0.2845 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database:

```
>GP:CAB50785 GB:AJ007700 aminopeptidase N [Streptococcus thermophilus]
Identities = 556/847 (65%), Positives = 673/847 (78%), Gaps = 4/847 (0%)
Query:   3  TVEHFVTKFVPENYNLFLDINRQTKTFSGNVAVSGEALDNNISFHQKGLTIKSVLLDNQP    62
            +V F+  F+PENYNLFLDINR  KTF+GNVA++GEA+DN+IS HQK LTI SVLLDN+
Sbjct:   4  SVARFIESFIPENYNLFLDINRSEKTFTGNVAITGEAIDNHISLHQKDLTINSVLLDNES   63

Query:  63  LDFQLDEDNEAMHIQLHETGSMVLVFEFSGHITDNMTGMYPSYYTVNGIKKEVISTQFES   122
            L+FQ+D+ NEA HI+L ETG + +   EFSG ITDNMTG+YPSYYT NG KKE+ISTQFES
Sbjct:  64  LNFQMDDANEAFHIELPETGVLTIFIEFSGRITDNMTGIYPSYYTYNGEKKEIISTQFES   123

Query: 123  HFAREVFPSIDEPEAKATFDLSLKYDQKEGEIALSNMPEINAEQRQETGLWTFDTTPKMS   182
            HFARE FP +DEPEAKATFDLSLKFD +EG+ ALSNMPEIN+  R+ETG+WTF+TTP+MS
Sbjct: 124  HFAREAFPCVDEPEAKATFDLSLKFDAEEGDTALSNMPEINSHLREETGVWTFETTPRMS   183

Query: 183  SYLLAFALGELHGKTTHTKNGTLVGSYATKAHQLNELDFSLDIVVRVIEFYEDYFGVRYP   242
            +YLLAF  G LHGKT TKNGT VG +AT A    N +DF+LDI VRVIEFYEDYF V+YP
Sbjct: 184  TYLLAFGFGALHGKTAKTKNGTEVGVFATVAQAENSVDFALDIAVRVIEFYEDYFQVKYP   243

Query: 243  IPQSLHVALPDFSAGAMENWGLVTYREVYLLVDENSSVSSRQQVALVVAHEIAHQWFGNL   302
            IP S H+ALPD SAGAMENWGLVTYREVYLLVDENSS +SRQQVALVVAHE+AHQWFGNL
Sbjct: 244  IPLSYHLALPDLSAGAMENWGLVTYREVYLLVDENSSAASRQQVALVVAHELAHQWFGNL   303

Query: 303  VTMKWWDDLWLNESFANMMEYVSIDYIEPKLNIFEDFQTG-GLPLALKRDATDGVQSVHV   361
            VTMKWWDDLWLNESFANMMEYVS++  IEP  NIFE F     G+P AL+RDATDGVQSVH+
Sbjct: 304  VTMKWWDDLWLNESFANMMEYVSVNAIEPSWNIFEGFPNKLGVPNALQRDATDGVQSVHM   363

Query: 362  EVNHPDEINTLFDPAIVYAKGSRLMHMLRRWLGDTDFAAGLKIYFEKHQYQNTIGRDLWN   421
            EVNHPDEINTLFD AIVYAKGSRLMHMLRRWLGD  FA GLK YFEKHQY NT+GRDLWN
Sbjct: 364  EVNHPDEINTLFDSAIVYAKGSRLMHMLRRWLGDEAFAKGLKAYFEKHQYNNTVGRDLWN   423

Query: 422  ALSQTSGKDVAAFMDSWLEQPGYPVMAAKIEEDELILTQKQFFIGEHEDKSRLWQIPLNS   481
            ALS+  SGKDV++FMD+WLEQPGYPV++A++ +D LIL+QKQFFIGEHEDK RLW+IPLN+
Sbjct: 424  ALSEASGKDVSSFMDTWLEQPGYPVVSAEVVDDTLILSQKQFFIGEHEDKGRLWEIPLNT   483

Query: 482  NWEGIPEILTEETVVIPNFSQLAEKNKENGALRFNTENTAHYITNYQGQLLEHIISDLPL   541
            NW G+P+ L+EE + IPN+SQLA +N NG LR NT NTAHYIT+YQGQLL++I+  D
Sbjct: 484  NWNGLPDTLSEERIEIPNYSQLATEN--NGVLRLNTANTAHYITDYQGQLLDNILEDFAN   541

Query: 542  MDNISKLQIVQERHLLAESGMISYSSLIPLVSLLSQETSYLVNSAIKSVIDGLSLFVQED   601
            +D +SKLQI+QER LLAESG ISY+SL+ L+ L+ +E S+L++ A    ++ GL  F+ ED
Sbjct: 542  LDTVSKLQILQERRLLAESGRISYASLVGLLDLVEKEESFLISQAKSQILAGLKRFIDED   601

Query: 602  SQDEFDFKEFVNKLSAFNFNRLGFEKREGEGDDSEMVRHLSLSLALYSDNEHAIEEAHHI   661
            ++  E  +K V++   +F RLGF+ +EGE D+ EMVR +LS  +D +   A +
Sbjct: 602  TEAEVHYKALVSRQFQNDFERLGFDAKEGESDEDEMVRQTALSYLIEADYQPTVLAAANV   661
```

-continued

```
Query: 662   FKAHENNIAAIPAAIRLLVLTNEMKHFESKELSHLLLETYSTTTDGNFKRQLASALSHTT    721
             F+AH+ NI +IPA+IR LVL N+MK   S  L    +  Y  T D NF+RQL  ALS+
Sbjct: 662   FQAHKENIESIPASIRGLVLINQMKQENSLSLVEEYINAYVATNDSNFRRQLTQALSYLK    721

Query: 722   DSKTLKKLLSDWKNKDIVKPQDLAMSWYATFLKNSFTQESVWEWAQENWEWIKATLGGDM    781
             + + L  +L    K+K++VKPQDL + WY   FL   SF QE+VW+WA+ENWEWIKA LGGDM
Sbjct: 722   NQEGLDYVLGQLKDKNVVKPQDLYL-WYMNFLSKSFAQETVWDWAKENWEWIKAALGGDM    780

Query: 782   SFDKFVIYPSSSFKTEERLEQYKNFFEPQLSDMAISRNISMGIKEISARVLLITKQKEEV    841
             SFD FV  P+   FK +ERL+QY  FFEPQ SD A+ RNI MGIK I+ARV LI K+K   V
Sbjct: 781   SFDSFVNIPAGIFKNQERLDQYIAFFEPQTSDKALERNILMGIKTIAARVDLIEKEKAAV    840

Query: 842   INTIKKY    848
             +  +K Y
Sbjct: 841   ESALKDY    847
```

A related DNA sequence was identified in *S. pyogenes* <SEQ ID 2073> which encodes the amino acid sequence <SEQ ID 2074>. Analysis of this protein sequence reveals the following:

Possible site: 50
>>> Seems to have no N-terminal signal sequence

----- Final Results -----
bacterial cytoplasm --- Certainty = 0.1098 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below:

```
Identities = 576/848 (67%), Positives = 692/848 (80%), Gaps = 3/848 (0%)
Query:   1   MKTVEHFVTKFVPENYNLFLDINRQTKTFSGNVAVSGEALDNNISFHQKGLTIKSVLLDN     60
             MKTVEH +   FVPENYN+FLDINRQTKTF+GNVA++GEALDN+++FHQK L IKS+LLDN
Sbjct:  21   MKTVEHLIETFVPENYNIFLDINRQTKTFTGNVAINGEALDNHVAFHQKDLDIKSILLDN     80

Query:  61   QPLDFQLDEDNEAMHIQLHETGSMVLVFEFSGHITDNMTGMYPSYYTVNGIKKEVISTQF    120
             + + +Q+D DNE + ++L ETG M LV EFSG ITDNMTG+YPSYYT NG KKEVISTQF
Sbjct:  81   EAVIYQVDNDNEVVRVELPETGMMTLVIEFSGSITDNMTGIYPSYYTKNGEKKEVISTQF    140

Query: 121   ESHFAREVFPSIDEPEAKATFDLSLKFDQKEGEIALSNMPEINAEQRQETGLWTFDTTPK    180
             ESHFARE  FP IDEP+AKATFDLSL FDQ+ GEIALSNMPE+N ++R+ETGLWTFDTT +
Sbjct: 141   ESHFAREAFPCIDEPQAKATFDLSLTFDQEIGEIALSNMPEVNIDRREETGLWTFDTTLR    200

Query: 181   MSSYLLAFALGELHGKTTHTKNGTLVGSYATKAHQLNELDFSLDIVVRVIEFYEDYFGVR    240
             MSSYLLAFALGELHGKT  +K GT VG YAT AH L+ LDFSLDI VRVI FYEDYFGV
Sbjct: 201   MSSYLLAFALGELHGKTVESKKGTTVGVYATTAHPLSSLDFSLDIAVRVINFYEDYFGVH    260

Query: 241   YPIPQSLHVALPDFSAGAMENWGLVTYREVYLLVDENSSVSSRQQVALVVAHEIAHQWFG    300
             YPIPQSL++ALPDFS GAMENWGL+TYRE+YLLVDENS+V SRQQVALV+AHEIAHQWFG
Sbjct: 261   YPIPQSLNIALPDFSSGAMENWGLITYRETYLLVDENSTVQSRQQVALVIAHEIAHQWFG    320

Query: 301   NLVTMKWWDDLWLNESFANMMEYVSIDYIEPKLNIFEDFQTGGLPLALKRDATDGVQSVH    360
             NLVTMKWWDDLWLNESFANMMEYVSI+  IEP    I EDFQTGG+PLALKRDATDGVQSVH
Sbjct: 321   NLVTMKWWDDLWLNESFANMMEYVSIEAIEPSWKIIEDFQTGGIPLALKRDATDGVQSVH    380

Query: 361   VEVNHPDEINTLFDPAIVYAKGSRLMHMLRRWLGDTDFAAGLKIYFEKHQYQNTIGRDLW    420
             VEVNHPDEINTLFDPAIVYAKGSRLMHMLRR++GD DFA GL  YFEK+QY+NT+GRDLW
Sbjct: 381   VEVNHPDEINTLFDPAIVYAKGSRLMHMLRRFIGDRDFAIGLHHYFEKYQYRNTVGRDLW    440

Query: 421   NALSQTSGKDVAAFMDSWLEQPGYPVMAAKIEEDELILTQKQFFIGEHEDKSRLWQIPLN    480
             N LS TSGKDVAAFMD+WLEQPGYPV+ A++E D+LIL+QKQFFIG+ E+K RLW IPLN
Sbjct: 441   NILSDTSGKDVAAFMDAWLEQPGYPVLTARLENDQLILSQKQFFIGKGEEKGRLWPIPLN    500

Query: 481   SNWEGIPEILTEETVVIPNFSQLAEKNKENGALRFNTENTAHYITNYQGQLLEHIISDLP    540
             +NW G+PE LTE  +VIPNFSQLA +N+   GALRFN +NTAHYIT+YQG LL+ ++++L
Sbjct: 501   TNWHGLPETLTEAEMVIPNFSQLAAENE--GALRFNIDNTAHYITDYQGSLLDALVTELA    558

Query: 541   LMDNISKLQIVQERHLLAESGMISYSSLIPLVSLLSQETSYLVNSAIKSVIDGLSLFVQE    600
             +DN S  LQ++QER LLA+SG+ISY+ L+ L++  L     SY+V  A++ V+ GL  F+ E
Sbjct: 559   QLDNTSALQVIQERRLLADSGLISYAELVDLIAQLDDSKSYMNAEAVQQVVSGLKRFIDE    618

Query: 601   DSQDEFDFKEFVNKLSAFNFNRLGFEKREGEGDDSEMVRHLSLSLALYSDNEHAIEEAHH    660
             S    E    F V +     +FN+ GFEK+   E D+ EMVR ++L      ++N+  I+
Sbjct: 619   GSLAEKSFNRLVTTIYQEDFNQHGFEKKADESDEDEMVRQVALGRLWLAENQTIIDGLRT    678

Query: 661   IFKAHENNIAAIPAAIRLLVLTNEMKHFESKELSHLLLETYSTTTDGNFKRQLASALSHT    720
             IF+A++NNIA+IPAA+R LVL N+MK+FE+   L   +   ETY TTD  N +  L A ST
Sbjct: 679   IFEAYQNNIASIPAAVRRLVLANQMKYFETDSLVDIYFETYVATTDNNLRSDLTVAFSQT    738
```

```
-continued
Query:  721  TDSKTLKKLLSDWKNKDIVKPQDLAMSWYATFLKNSFTQESVWEWAQENWEWIKATLGGD  780
             T++++L    K+KDI+KPQDL+   WY   L   SFTQ+ +WEWA+ENW+WIK+ LGGD
Sbjct:  739  KQPTTIRRILVSLKDKDIIKPQDLSY-WYNALLGQSFTQDIIWEWARENWDWIKSALGGD  797

Query:  781  MSFDKFVIYPSSSFKTEERLEQYKNFFEPQLSDMAISRNISMGIKEISARVLLITKQKEE  840
             MSFDKFVIYP+S+FKT + L +YK+FFEP+L DMAISRNI+MGI EI ARV LITK+KE
Sbjct:  798  MSFDKFVIYPASNFKTPKHLAEYKSFFEPKLDDMAISRNITMGINEIEARVALITKEKEA  857

Query:  841  VINTIKKY  848
             VI + Y
Sbjct:  858  VIAALSHY  865
```

Based on this analysis, it was predicted that these proteins and their epitopes could be useful antigens for vaccines or diagnostics.

Example 675

A DNA sequence (GBSx0715) was identified in *S. agalactiae* <SEQ ID 2075> which encodes the amino acid sequence <SEQ ID 2076>. This protein is predicted to be response regulator (trcR). Analysis of this protein sequence reveals the following:

Possible site: 59
>>> Seems to have no N-terminal signal sequence
----- Final Results -----
  bacterial cytoplasm --- Certainty = 0.2741 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database:

A related DNA sequence was identified in *S. pyogenes* <SEQ ID 2077> which encodes the amino acid sequence <SEQ ID 2078>. Analysis of this protein sequence reveals the following:

Possible site: 59
>>> Seems to have no N-terminal signal sequence
----- Final Results -----
  bacterial cytoplasm --- Certainty = 0.2689 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below:

```
>GP:CAA54465 GB:X77249 response regulator [Streptococcus pneumoniae]
Identities = 198/224 (88%), Positives = 213/224 (94%)
Query:    1  MIKILLIEDDLSLSNSVFDFLDDFADVMQIFDGEEGLYEAESGVYDLILLDLMLPEKNGF   60
             MIKILL+EDDL LSNSVFDFLDDFADVMQ+FDGEEGLYEAESGVYDLILLDLMLPEKNGF
Sbjct:    1  MIKILLVEDDLGLSNSVFDFLDDFADVMQVFDGEEGLYEAESGVYDLILLDLMLPEKNGF   60

Query:   61  QVLKELREKGITTPVLIMTAKESIDDKGQGFDLGADDYLTKPFYLEELKMRIQALLKRSG  120
             QVLKELREKGITTPVLIMTAKES+DDKG GF+LGADDYLTKPFYLEELKMRIQALLKRSG
Sbjct:   61  QVLKELREKGITTPVLIMTARESLDDKGHGFELGADDYLTKPFYLEELKMRIQALLKRSG  120

Query:  121  KFNDNSLIYGDIRVDMSTNSTFVNQTEVELLGKEFDLLVYFLQNQNVILPKSQIFDRIWG  180
             KFN+N+L YG+I V++STN+  V  T VELLGKEFDLLVYFLQNQNVILPK+QIFDR WG
Sbjct:  121  KFNENTLTYGNIVVNLSTNTVKVEDTPVELLGKEFDLLVYFLQNQNVILPKTQIFDRLWG  180

Query:  181  FDSDTTISVVEVYVSKVRKKLKGTLFSENLQTLRSVGYILKHVE  224
             FDSDTTISVVEVYVSKVRKKLKGT F+ENLQTLRSVGY+LK V+
Sbjct:  181  FDSDTTISVVEVYVSKVRKKLKGTTFAENLQTLRSVGYLLKDVQ  224
```

```
Identities = 180/224 (80%), Positives = 200/224 (88%)
Query:   1  MIKILLIEDDLSLSNSVFDFLDDFADVMQIFDGEEGLYEAESGVYDLILLDLMLPEKNGF   60
            MIKILL+EDDLSLSNS+FDFLDDFADVMQ+FDG+EGLYEAESG+YDLILLDLMLPEKNGF
Sbjct:   1  MIKILLVEDDLSLSNSIFDFLDDFADVMQVFDGDEGLYEAESGIYDLILLDLMLPEKNGF   60

Query:  61  QVLKELREKGITTPVLIMTAKESIDDKGQGFDLGADDYLTKPFYLEELKMRIQALLKRSG  120
            QVLKELREK I  PVLIMTAKE +DDKG GF+LGADDYLTKPFYLEELKMRIQALLKR+G
Sbjct:  61  QVLKELREKDIKIPVLIMTAKEGLDDKGHGFELGADDYLTKPFYLEELKMRIQALLKRTG  120

Query: 121  KFNDNSLIYGDIRVDMSTNSTFVNQTEVELLGKEFDLLVYFLQNQNVILPKSQIFDRIWG  180
            KF D ++ +G++ VD++        V     VELLGKEFDLLVY LQNQNVILPK+QIFDR+WG
Sbjct: 121  KFADKNISFGNLVVDLARKEVKVEGKVVELLGKEFDLLVYLLQNQNVILPKTQIFDRLWG  180

Query: 181  FDSDTTISVVEVYVSKVRKKLKGTLFSENLQTLRSVGYILKHVE                 224
            FDSDTTISVVEVY+SK+RKKLKGT F    LQTLRSVGYILK+ E
Sbjct: 181  FDSDTTISVVEVYISKIRKKLKGTCFVNRLQTLRSVGYILKNNE                 224
```

Based on this analysis, it was predicted that these proteins and their epitopes could be useful antigens for vaccines or diagnostics.

Example 676

A DNA sequence (GBSx0716) was identified in *S. agalactiae* <SEQ ID 2079> which encodes the amino acid sequence <SEQ ID 2080>. This protein is predicted to be histidine kinase Analysis of this protein sequence reveals the following:

---

Possible site: 34
>>> Seems to have no N-terminal signal sequence
INTEGRAL    Likelihood = −9.18    Transmembrane 22-38 (17-46)
INTEGRAL    Likelihood = −4.94    Transmembrane 182-198 (178-201)
----- Final Results -----
  bacterial membrane --- Certainty = 0.4673 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the GENPEPT database:

A related DNA sequence was identified in *S. pyogenes* <SEQ ID 2081> which encodes the amino acid sequence <SEQ ID 2082>. Analysis of this protein sequence reveals the following:

---

Possible site: 57
>>> Seems to have an uncleavable N-term signal seq
INTEGRAL    Likelihood = −11.09   Transmembrane 19-35 (14-44)
INTEGRAL    Likelihood = −10.24   Transmembrane 185-201 (182-206)
----- Final Results -----
  bacterial membrane --- Certainty = 0.5437 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the databases:

```
>GP:CAA54466 GB:X77249 histidine kinase [Streptococcus pneumoniae]
Identities = 218/420 (51%), Positives = 305/420 (71%), Gaps = 4/420 (0%)
Query:  17  SHFIHFFTVFSGIFLVMTVIILQVMRYGVYSSVDSSLKYISTHPKNYINMVMSRTAAY--   74
            S+FI  F VF+ IF    MT+IILQVM   +Y+SVD  L +S +P+  I + ++R
Sbjct:  15  SYFIRNFGVFTLIFSTMTLIILQVMHSSLYTSVDDKLHGLSENPQAVIQLAINRATEEIK   74

Query:  75  -LDNSNIASVKLKPGGQTVANTDIILFTSEEEVINYFDAFSNYQFLKPNKKNLGGISELT  133
             L+N+   + K++      +NT++ILF +    +   + F   +K  KK LG I ++
Sbjct:  75  DLENARADASKVEIKPNVSSNTEVILFDKDFTQLLSGNRFLGLDKIKLEKKELGHIYQIQ  134

Query: 134  LTNIFGQDETYHAVTVKVN-NPAYPNVTYMTAIVNIDQLVNAKERYEKIIIFVMTTFWII  192
            + N +GQ+E Y + ++ N +    N+ Y  ++N  QL A +++E++I+ VM +FWI+
Sbjct: 135  VFNSYGQEEIYRVILMETNISSVSTNIKYAAVLINTSQLEQASQKHEQLIVVVMASFWIL  194

Query: 193  SIGASIYLAKWAQKPIIENYERQKAFVENASHELRTPLAVLQNRLETLFRKPNATILENS  252
            S+  AS+YLA+ + +P++E+ ++Q+++FVENASHELRTPLAVLQNRLETLFRKP ATI++  S
Sbjct: 195  SLLASLYLARVSVRPLLESMQKQQSFVENASHELRTPLAVLQNRLETLFRKPEATIMDVS  254

Query: 253  ENIASSLDEVRNMRILTTNLLNLARRDDGIKPELAVIKPTLFDSIFENYDLITQENGKNF  312
            E+IASSL+EVRNMR LTT+LLNLARRDDGIKPELA +   F++ F NY++I    EN + F
Sbjct: 255  ESIASSLEEVRNMRFLTTSLLNLARRDDGIKPELAEVPTSFFNTTFTNYEMIASENNRVF  314

Query: 313  TGHNMIQDSFKTDKTLLKQLMTILFDNAIKYTDNDGSIDFTISETDKYLFLEIADNGPGI  372
                  N I  +  TD+ LLKQLMTILFDNA+KYT  DG IDF IS TD+ L+L ++DNG GI
Sbjct: 315  RFENRIHRTIVTDQLLLKQLMTILFDNAVKYTEEDGEIDFLISATDRNLYLLVSDNGIGI  374

Query: 373  SEEDKVRIFDRFYRVDKARTRQQGGFGLGLSLAQQIVNSLRGNITVIDNKPRGSIFKIKL  432
            S  EDK  +IFDRFYRVDKARTRQ+GGFGLGLSLA+QIV++L+G +TV DNKP+G+IF++K+
Sbjct: 375  STEDKKKIFDRFYRVDKARTRQKGGFGLGLSLAKQIVDALKGTVTVKDNKPKGTIFEVKI  434
```

```
>GP:CAA54466 GB:X77249 histidine kinase [Streptococcus pneumoniae]
Identities = 223/436 (51%), Positives = 313/436 (71%), Gaps = 5/436 (1%)
Query:   2  NKLKKEILSDNYNHFFHFFAVFTGIFVIMTIIILQIMRFGVYSSVDSSLVSVSNNASSYA   61
            +KLKK   +D++++F    F VFT IF  MT+IILQ+M  +Y+SVD L +S N   +
Sbjct:   3  SKLKKTWYADDFSYFIRNFGVFTLIFSTMTLIILQVMHSSLYTSVDDKLHGLSENPQAVI   62

Query:  62  NRTMARISSFYFDTENNIIKALPDSSKLLGTPAANTDIILFSANGTILNAFDAFSNYQ    121
             + R +   D EN    A  D+     ++      ++NT++ILF + T L + + F
Sbjct:  63  QLAINRATEEIKDLEN----ARADASKVEIKPNVSSNTEVILFDKDFTQLLSGNRFLGLD  118

Query: 122  NFHLDKRRLGSIETTSLMNFYGQEEKYHTITVGVHIKNYPA-VAYMMAVVNVEQLDRANE  180
               L+K+ LG I    + N YGQEE Y  I +  +I +     + Y   ++N  QL++A++
Sbjct: 119  KIKLEKKELGHIYQIQVFNSYGQEEIYRVILMETNISSVSTNIKYAAVLINTSQLEQASQ  178

Query: 181  RYERIIIIVMSVFWLISILASIYLAKWSRKPILESYEKQKMFVENASHELRTPLAVLQNR  240
            ++E++I++VM+ FW++S+LAS+YLA+ S +P+LES +KQ+ FVENASHELRTPLAVLQNR
Sbjct: 179  KHEQLIVVVMASFWILSLLASLYLARVSVRPLLESMQKQQSFVENASHELRTPLAVLQNR  238

Query: 241  LESLFRKPNETILENSEHLASSLDEVRNMRILTTNLLNLARRDDGINPQWTHLDTDFFNA  300
            LE+LFRKP  TI++ SE +ASSL+EVRNMR LTT+LLNLARRDDGI P+   + T FFN
Sbjct: 239  LETLFRKPEATIMDVSESIASSLEEVRNMRFLTTSLLNLARRDDGIKPELAEVPTSFFNT  298

Query: 301  IFENYELVAKEYGKIFYFQNQVNRSLRMDKALLKQLITILFDNAIKYTDKNGIIEIIVKT  360
             F NYE++A E  ++F F+N+++R++  D+ LLKQL+TILFDNA+KYT+++G I+ ++
Sbjct: 299  TFTNYEMIASENNRVFRFENRIHRTIVTDQLLLKQLMTILFDNAVKYTEEDGEIDFLISA  358

Query: 361  TDKNLLISVIDNGPGITDEEKKKIFDRFYRVDKARTRQTGGFGLGLALAQQIVMSLKGNI  420
            TD+NL + V DNG GI+ E+KKKIFDRFYRVDKARTRQ GGFGLGL+LA+QIV +LKG +
Sbjct: 359  TDRNLYLLVSDNGIGISTEDKKKIFDRFYRVDKARTRQKGGFGLGLSLAKQIVDALKGTV  418

Query: 421  TVKDNDPKGSIFEVKL                                             436
            TVKDN PKG+IFEVK+
Sbjct: 419  TVKDNKPKGTIFEVKI                                             434
```

An alignment of the GAS and GBS proteins is shown below:

```
Identities = 265/436 (60%), Positives = 334/436 (75%), Gaps = 10/436 (2%)
Query:   7  ISKFKKNV-SDS--HFIHFFTVFSGIFLVMTVIILQVMRYGVYSSVDSSLKYISTHPKNY   63
            ++K KK + SD+  HF HFF VF+GIF++MT V+ IILQ+MR+GVYSSVDSSL +S + +Y
Sbjct:   1  MNKLKKEILSDNYNHFFHFFAVFTGIFVIMTIIILQIMRFGVYSSVDSSLVSVSNNASSY   60

Query:  64  INMVMSRTAAYLDNSNIASVKLKPG-------GQTVANTDIILFTSEEEVINYFDAFSNY  116
             N  M+R +++  ++    +K P        G   ANTDIILF++   ++N FDAFSNY
Sbjct:  61  ANRTMARISSFYFDTENNIIKALPDSSKLLGTPAANTDIILFSANGTILNAFDAFSNY   120

Query: 117  QFLKPNKKNLGGISELTLTNIFGQDETYHAVTVKVNNPAYPNVTYMTAIVNIDQLVNAKE  176
            Q   +K+ LG I   +L N +GQ+E YH +TV V+    YP V YM A+VN++QL  A E
Sbjct: 121  QNFHLDKRRLGSIETTSLMNFYGQEEKYHTITVGVHIKNYPAVAYMMAVVNVEQLDRANE  180

Query: 177  RYEKIIIFVMTTFWIISIGASIYLAKWAQKPIIENYERQKAFVENASHELRTPLAVLQNR  236
            RYE+III VM+ FW++SI ASIYLAKW ++KPI E+YE+QK FVENASHELRTPLAVLQNR
Sbjct: 181  RYERIIIIVMSVFWLISILASIYLAKWSRKPILESYEKQKMFVENASHELRTPLAVLQNR  240

Query: 237  LETLFRKPNATILENSENIASSLDEVRNMRILTTNLLNLARRDDGIKPELAVIKPTLFDS  296
            LE+LFRKPN TILENSE++ASSLDEVRNMRILTTNLLNLARRDDGI P+    +  F++
Sbjct: 241  LESLFRKPNETILENSEHLASSLDEVRNMRILTTNLLNLARRDDGINPQWTHLDTDFFNA  300

Query: 297  IFENYDLITQENGKNFTGHNMIQDSFKTDKTLLKQLMTILFDNAIKYTDNDGSIDFTISE  356
            IFENY+L+ +E GK F    N +   S + DK LLKQL+TILFDNAIKYTD +G I+ +
Sbjct: 301  IFENYELVAKEYGKIFYFQNQVNRSLRMDKALLKQLITILFDNAIKYTDKNGIIEIIVKT  360

Query: 357  TDKYLFLEIADNGPGISEEDKVRIFDRFYRVDKARTRQQGGFGLGLSLAQQIVNSLRGNI  416
            TDK L + +  DNGPGI++E+K  IFDRFYRVDKARTRQ GGFGLGL+LAQQIV SL+GNI
Sbjct: 361  TDKNLLISVIDNGPGITDEEKKKIFDRFYRVDKARTRQTGGFGLGLALAQQIVMSLKGNI  420

Query: 417  TVIDNKPRGSIFKIKL                                             432
            TV DN P+GSIF++KL
Sbjct: 421  TVKDNDPKGSIFEVKL                                             436
```

SEQ ID 2080 (GBS339d) was expressed in *E. coli* as a GST-fusion product. SDS-PAGE analysis of total cell extract is shown in FIG. 146 (lane 9; MW 73 kDa). It was also expressed in *E. coli* as a His-fusion product. SDS-PAGE analysis of total cell extract is shown in FIG. 185 (lane 5; MW 73 kDa).

Based on this analysis, it was predicted that these proteins and their epitopes could be useful antigens for vaccines or diagnostics.

Example 677

A DNA sequence (GBSx0717) was identified in *S. agalactiae* <SEQ ID 2083> which encodes the amino acid sequence <SEQ ID 2084>. Analysis of this protein sequence reveals the following:

```
Possible site: 39
>>> Seems to have no N-terminal signal sequence
----- Final Results -----
    bacterial cytoplasm --- Certainty = 0.1783 (Affirmative) <succ>
    bacterial membrane --- Certainty = 0.0000 (Not Clear) <succ>
    bacterial outside --- Certainty = 0.0000 (Not Clear) <succ>
```

A related GBS nucleic acid sequence <SEQ ID 9813> which encodes amino acid sequence <SEQ ID 9814> was also identified.

The protein has homology with the following sequences in the GENPEPT database:

```
>GP:AAB48049 GB:U88582 Y1xM [Streptococcus mutans]
Identities = 95/110 (86%), Positives = 103/110 (93%)
Query:   1    MEIEKTNRMNALFEFYAALLTDKQMNYIELYYADDYSLAEIAEESGVSRQAVYDNIKRTE    60
              MEIEKTNRMNALFEFYAALLTDKQMNYIELYYADDYSLAEIAEE VSRQAVYDNIKRTE
Sbjct:   1    MEIEKTNRMNALFEFYAALLTDKQMNYIELYYADDYSLAEIAEEFDVSRQAVYDNIKRTE    60

Query:  61    KILEAYEMKLHMYSDYIVRSQIFDDILEKYTDDAFLQEKISILSSIDNRD             110
              KILE YEMKLHMYSDY+VRS+IFD I++KY +D +LQ KISIL++IDNRD
Sbjct:  61    KILEDYEMKLHMYSDYVVRSEIFDAIMKKYPNDPYLQNKISILTTIDNRD             110
```

A related DNA sequence was identified in *S. pyogenes* <SEQ ID 2085> which encodes the amino acid sequence <SEQ ID 2086>. Analysis of this protein sequence reveals the following:

```
Possible site:54
>>> Seems to have no N-terminal signal sequence
----- Final Results -----
    bacterial cytoplasm --- Certainty = 0.1767 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below:

```
Identities = 95/110 (86%), Positives = 103/110 (93%)
Query:   1    MEIEKTNRMNALFEFYAALLTDKQMNYIELYYADDYSLAEIAEESGVSRQAVYDNIKRTE    60
              MEIEKTNRMNALFEFYAALLTDKQMNYIELYYADDYSLAEIA+E GVSRQAVYDNIKRTE
Sbjct:   4    MEIEKTNRKMALFEFYAALLTDKQMNYIELYYADDYSLAEIADEFGVSRQAVYDNIKRTE    63

Query:  61    KILEAYEMKLRMYSDYIVRSQIFDDILEKYTDDAFLQEKISILSSIDNRD             110
              KILE YEMKLHMYSDY+VRS+IFDD++  Y  D +LQEKISIL+SIDNR+
Sbjct:  64    KILETYEMKLHMYSDYVVRSEIFDDMIAHYPHDEYLQEKISILTSIDNRE             113
```

Based on this analysis, it was predicted that these proteins and their epitopes could be useful antigens for vaccines or diagnostics.

Example 678

A DNA sequence (GBSx0719) was identified in *S. agalactiae* <SEQ ID 2087> which encodes the amino acid sequence <SEQ ID 2088>. This protein is predicted to be signal recognition particle protein (ffh). Analysis of this protein sequence reveals the following:

```
Possible site: 51
>>> Seems to have no N-terminal signal sequence
INTEGRAL    Likelihood = -0.22    Transmembrane 37-53 (37-53)
----- Final Results -----
    bacterial membrane --- Certainty = 0.1086 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database:

```
>GP:AAB48050 GB:U88582 Ffh [Streptococcus mutans]
Identities = 437/522 (83%), Positives = 484/522 (92%), Gaps = 7/522 (1%)
Query:   1  MAFESLTERLQGVFKNIRGKKKLSEKDVQEVTKEIRLALLEADVALPVVKTFIKHVRERA  60
            MAFESLTERLQGVFKN+RGK+KLSEKDVQEVTKEIRLALLEADVALPVVK FIK VR+RA
Sbjct:   1  MAFESLTERLQGVFKNLRGKRKLSEKDVQEVTKEIRLALLEADVALPVVKEFIKRVRKRA  60

Query:  61  VGHEIIDTLDPTQQIVKIVNEELTDLLGAETSEIEKSPKIPTIIMMVGLQGAGKTTFAGK 120
            VGHE+IDTLDP+QQI+KIVNEELT +LG+ET+EIEKS KIPTIIMMVGLQGAGKTTFAGK
Sbjct:  61  VGHEVIDTLDPSQQIIKIVNEELTAVLGSETAEIEKSSKIPTIIMMVGLQGAGKTTFAGK 120

Query: 121  LANKLIKEDNARPMMIAADIYRPAAIDQLKTLGSQINVPVFDMGTNHSAVEIVTKGLEQA 180
            LANKL+KE+NARP+MIAADIYRPAAIDQLK LG QINVPVFDMGT HSAVEIV++GL QA
Sbjct: 121  LANKLVKEENARPLMIAADIYRPAAIDQLKILGQQINVPVFDMGTEHSAVEIVSQGLAQA 180

Query: 181  RENRNDYVLIDTAGRLQIDATLMQELHDVKAIAQPNEILLVVDSMIGQEAANVAEEFNRQ 240
            +ENRNDYVLIDTAGRLQID  LM EL D+KA+A PNEILLVVDSMIGQEAANVA EFN+Q
Sbjct: 181  KENREDYVLIDTAGRLQIDEKLMTELRDIKALANPNEILLVVDSMIGQEAANVAREFNQQ 240

Query: 241  LSISGVVLTKIDGDTRGGAALSVREITGKPIKFTGTGEKITDIETFHPDRMASRILGMGD 300
            L ++GV+LTKIDGDTRGGAALSVR+ITGKPIKFTGTGEKITDIETFHPDRM+SRILGMGD
Sbjct: 241  LEVTGVILTKIDGDTRGGAALSVRQITGKPIKFTGTGEKITDIETFHPDRMSSRILGMGD 300

Query: 301  LLTLIERASQEYDEKRSMELAEKMRENTFDFNDFIDQLDQVQNMGPMEDLLKMLPGMANN 360
            LLTLIE+ASQ+YDE++S ELAEKMREN+FDFNDFI+QLDQVQNMG MED+LKM+PGMANN
Sbjct: 301  LLTLIEKASQDYDEQKSAELAEKMRENSFDFNDFIEQLDQVQNMGSMEDILKMIPGMANN 360

Query: 361  PAMKNFKVDENEIARKRAIVSSMTPEERENPDLLNPSRRRRIAAGSGNTFVDVNKFIKDF 420
            PA+ N +VDE EIARKRAIVSSMTPEERENPDLL PSRRRRIA+GSGNTFV+VNKFIKDF
Sbjct: 361  PALANVEVDEGEIARKRAIVSSMTPEERENPDLLTPSRRRRIASGSGNTFVNVNKFIKDF 420

Query: 421  NQAKQMMQGVMSGDMNKMMKKMGIDPNNLPKDMPGMDGMDMSNLEGMMGQNGMPDLSSL- 479
            NQAK+MMQGVMSGDMNK+MK+MGI+PNN+P       + MD S LEGMMGQ GMPD+S L
Sbjct: 421  NQAKKMMQGVMSGDMNKVMKQMGINPNNMP------NNMDSSALEGMMGQGGMPDMSGLS 474

Query: 480  GGDMDFSQMFGGGLKGKVGAFAAKQSMKRMANKMKKAKKKRK                   521
            G +MD SQMFGGGLKGKVG FA KQSMK+MA +MKKAKK++K
Sbjct: 475  GANMDVSQMFGGGLKGKVGEFAMKQSMKKMAKRMKKAKKRKK                   516
```

A related DNA sequence was identified in S. pyogenes <SEQ ID 2089> which encodes the amino acid sequence <SEQ ID 2090>. Analysis of this protein sequence reveals the following:

Possible site: 53
>>> Seems to have no N-terminal signal sequence

-continued

INTEGRAL   Likelihood = -0.22   Transmembrane 39-55 (39-55)
----- Final Results -----
  bacterial membrane --- Certainty = 0.1086 (Affirmative) <succ>
  bacterial outside --- Certainty = 0.0000 (Not Clear) <succ>
  bacterial cytoplasm --- Certainty = 0.0000 (Not Clear) <succ>

An alignment of the GAS and GBS proteins is shown below:

```
Identities = 458/522 (87%), Positives = 489/522 (92%), Gaps = 4/522 (0%)
Query:   1  MAFESLTERLQGVFKNIRGKKKLSEKDVQEVTKEIRLALLEADVALPVVKTFIKHVRERA  60
            MAFESLT+RLQ VFK+IRGKKKLSE DVQEVTKEIRLALLEADVALPVVKTFIK VRERA
Sbjct:   3  MAFESLTQRLQDVFKHIRGKKKLSESDVQEVTKEIRLALLEADVALPVVKTFIKRVRERA  62

Query:  61  VGHEIIDTLDPTQQIVKIVNEELTDLLGAETSEIEKSPKIPTIIMMVGLQGAGKTTFAGK 120
            +GHEIIDTLDPTQQI+KIVNEELT +LG+ET+EI+KSPKIPTIIMMVGLQGAGK+TFAGK
Sbjct:  63  IGHEIIDILDPIQQILKIVNEELTSILGSETAEIDKSPKIPTIIMMVGLQGAGKITFAGK 122

Query: 121  LANKLIKEDNARPMMIAADIYRPAAIDQLKTLGSQINVPVFDMGTNHSAVEIVTKGLEQA 180
            LANKLIKE+NARP+MIAADIYRPAAIDQLKTLG QINVPVFDMGT+HSAV+IV KGLEQA
Sbjct: 123  LANKLIKEENARPLMIAADIYRPAAIDQLKTLGQQINVPVFDMGTDHSAVDIVRKGLEQA 182

Query: 181  RENRNDYVLIDTAGRLQIDATLMQELHDVKAIAQPNEILLVVDSMIGQEAANVAEEFNRQ 240
            REN NDYVLIDTAGRLQID  LM EL DVKA+AQPNEILLVVDSMIGQEAANVA EFN Q
Sbjct: 183  RENHNDYVLIDTAGRLQIDEKLMGELRDVKALAQPNEILLVVDSMIGQEAANVAYEFNHQ 242

Query: 241  LSISGVVLIKIDGDTRGGAALSVREITGKPIKFTGTGEKITDIETFHPDRMASRILGMGD 300
            LSI+GVVLTKIDGDTRGGAALSVREITGKPIKFTG GEKITDIETFHPDRM+SRILGMGD
Sbjct: 243  LSITGVVLTKIDGDTRGGAALSVREITGKPIKFTGIGEKITDIETFHPDRMSSRILGMGD 302

Query: 301  LLTLIERASQEYDEKRSMELAEKMRENTFDFNDFIDQLDQVQNMGPMEDLLKMLPGMANN 360
            LLTLIE+ASQEYDEK+S+ELAEKMRENTFDFNDFI+QLDQVQNMGPMEDLLKM+PGMA N
Sbjct: 303  LLTLIEKASQEYDEKKSLELAEKMRENTFDFNDFIEQLDQVQNMGPMEDLLKMIPGMAGN 362

Query: 361  PAMKNFKVDENEIARKRAIVSSMTPEERENPDLLNPSRRRRIAAGSGNTFVDVNKFIKDF 420
            PA+ N KVDEN+IARKRAIVSSMTP ERENPDLLNPSRRRRIAAGSGN+FVD NKFIKDF
Sbjct: 363  PALANIKVDENQIARKRAIVSSMTPAERENPDLLNPSRRRRIAAGSGNSFVD-NKFIKDF 421
```

```
Query:  421  NQAKQMMQGVMSGDMNKMMKKMGIDPNNLPKDMPGMDGM-DMSNLEGMMGQNGMPDLSSL  479
             NQAK MMQGVMSGDM+KMMK MGI+PNNLPK+MP   GM DMS+LEGMMGQ GMPDLS L
Sbjct:  422  NQAKSMMQGVMSGDMSKMMKDMGINPNNLPKNMPA--GMPDMSSLEGMMGQGGMPDLSGL  479

Query:  480  GGDMDFSQMFGGGLKGKVGAFAAKQSMKRMANKMKKAKKKRK                    521
             GGDMD SQ+FG G KGK+G FA KQ+MKR ANK+KKAKKKRK
Sbjct:  480  GGDMDMSQLFGKGFKGKIGQFAMKQAMKRQANKLKKAKKKRK                    521
```

Based on this analysis, it was predicted that these proteins and their epitopes could be useful antigens for vaccines or diagnostics.

Example 679

A DNA sequence (GBSx0721) was identified in *S. agalactiae* <SEQ ID 2091> which encodes the amino acid sequence <SEQ ID 2092>. This protein is predicted to be SatD. Analysis of this protein sequence reveals the following:

---

Possible site: 49
>>> Seems to have an uncleavable N-term signal seq
INTEGRAL    Likelihood = –1.28    Transmembrane 3-19 (2-19)
----- Final Results -----
   bacterial membrane --- Certainty = 0.1510 (Affirmative) <succ>
    bacterial outside --- Certainty = 0.0000 (Not Clear) <succ>
     bacterial cytoplasm --- Certainty = 0.0000 (Not Clear) <succ>

---

A related GBS nucleic acid sequence <SEQ ID 9811> which encodes amino acid sequence <SEQ ID 9812> was also identified.

The protein has homology with the following sequences in the GENPEPT database:

A related DNA sequence was identified in *S. pyogenes* <SEQ ID 2093> which encodes the amino acid sequence <SEQ ID 2094>. Analysis of this protein sequence reveals the following:

---

Possible site: 38
>>> Seems to have no N-terminal signal sequence
----- Final Results -----
   bacterial cytoplasm --- Certainty = 0.3744 (Affirmative) <succ>
   bacterial membrane --- Certainty = 0.0000 (Not Clear) <succ>
    bacterial outside --- Certainty = 0.0000 (Not Clear) <succ>

---

An alignment of the GAS and GBS proteins is shown below:

```
>GP:AAG28336 GB:U88582 SatD [Streptococcus mutans]
Identities = 106/222 (47%), Positives = 162/222 (72%), Gaps = 2/222 (0%)
Query:   13  MYLALIGDIINSKQILERETFQQSFQQLMTELSDVYGEELISPFTITAGDEFQALLKPSK   72
             +Y+A+IGD+I+SK I R   Q+  + L+ +++  Y E L S FTIT GDEFQALL P+
Sbjct:    2  IYLAIIGDLISSKAITNRPKSQKQLKNLLNQINKKYKELLKSAFTITTGDEFQALLVPNP   61

Query:   73  KVFQIIDHIQLALKPVNVRFGLGTGNIITSINSNESIGADGPAYWHARSAINHIHDKNDY  132
             ++FQIID I L  KP  +RFG+G+G+I+T IN  +SIG+DGPAYWHAR+AI++IHDKNDY
Sbjct:   62  QIFQIIDEIALGFKPYQIRFGVGSGSILTEINPEQSIGSDGPAYWHARAAIDYIHDKNDY  121

Query:  133  GTVQVAICLDDEDQNLELTLNSLISAGDFIKSKWTTNHFQMLEHLILQDNYQEQFQHQKL  192
             G+  +A+ L+D + +  +N++++A +FIKSKWT    +++++ L+    Y+E+F H+K+
Sbjct:  122  GSNHLAVDLEDTETSQQ--INAILAACEFIKSKRTVTQYEVIDGLLQAGIYEEKFSHKKM  179

Query:  193  AQLENIEPSALTKRLKASGLKIYLRTRTQAADLLVKSCTQTK                   234
             A+  ++ PS+  KRLK+SGLKIYLR + A    LL+ +  + K
Sbjct:  180  AEKLDLSPSSFNKRLKSSGLKIYLRNKKVATTLLLNAIRKEK                   221
```

```
Identities = 94/213 (44%), Positives = 137/213 (64%), Gaps = 3/213 (1%)
Query:  14 YLALIGDIINSKQILERETFQQSFQQLMTELSDVYGEELISPFTITAGDEFQALLKPSKK   73
           Y+ALIGDII SKQ+ +R    Q++     + +L+  +    +IS  ++T GDEFQ L +
Sbjct:   3 YIALIGDIIQSKQLTDRSKVQKTLAAYLDDLNKTFAPYIISKLSLTLGDEFQGLFQVDTP   62

Query:  74 VFQIIDHIQLALKPVNVRFGLGIGNIITSINSNESIGADGPAYWHARSAINHIHDKNDYG  133
           +F +ID I    +  +  +RFG+G G+I+T IN + SIGADGPAYWHAR AI +IH KNDYG
Sbjct:  63 IFHLIDLINHHMD-IPIRFGVGVGSILTDINPDISIGADGPAYWHAREAIRYIHQKNDYG  121

Query: 134 TVQVAICLDDEDQNLELTLNSLISAGDFIKSKWTTNHFQMLEHLILQDNYQEQFQHQKLA  193
              +A  L    N +  LNSL++AGD IK+ W  + +++ + L+     Y+E F  Q+L
Sbjct: 122 NTTLA--LRTGHHNQDDVLNSLLAAGDAIKANWRASQWEIFDTLLDLGIYEEYFDQQRLG  179

Query: 194 QLENIEPSALTKRLKASGLKIYLRTRTQAADLL                            226
           +  ++   SAL+KRLK+S +KIYLRTR  A + L
Sbjct: 180 KQLSLSSSALSKRLKSSHVKIYLRTRQSALNCL                            212
```

A related GBS gene <SEQ ID 8637> and protein <SEQ ID 8638> were also identified. Analysis of this protein sequence reveals the following:

Lipop: Possible site: −1    Crend: 7
McG: Discrim Score: 4.96
GvH: Signal Score (−7.5) : −5.46
Possible site: 49
>>> Seems to have an uncleavable N-term signal seq
ALOM program    count: 1  value: −1.28    threshold: 0.0
INTEGRAL      Likelihood = −1.28    Transmembrane 3-19 (1-19)
PERIPHERAL    Likelihood = 5.99     74
modified ALOM score: 0.76
*** Reasoning Step: 3
----- Final Results -----
    bacterial membrane --- Certainty = 0.1510 (Affirmative) <succ>
       bacterial outside --- Certainty = 0.0000 (Not Clear) <succ>
         bacterial cytoplasm --- Certainty = 0.0000 (Not Clear) <succ>

Figure 68:
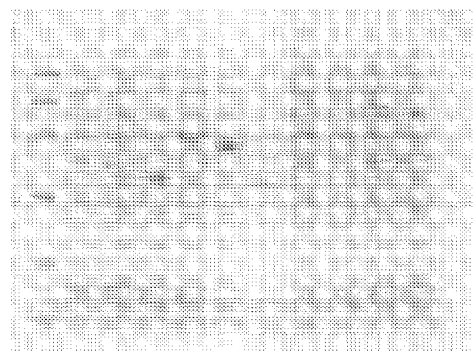

SEQ ID 8638 (GBS338) was expressed in *E. coli* as a His-fusion product. SDS-PAGE analysis of total cell extract is shown in FIG. 62 (lane 5; MW 30 kDa). It was also expressed in *E. coli* as a GST-fusion product. SDS-PAGE analysis of total cell extract is shown in FIG. 68 (lane 11; MW 55 kDa).

GBS338-GST was purified as shown in FIG. 215, lane 3.

Based on this analysis, it was predicted that these proteins and their epitopes could be useful antigens for vaccines or diagnostics.

Example 680

A DNA sequence (GBSx0722) was identified in *S. agalactiae* <SEQ ID 2095> which encodes the amino acid sequence <SEQ ID 2096>. Analysis of this protein sequence reveals the following:

Possible site: 14
>>> Seems to have no N-terminal signal sequence
----- Final Results -----
    bacterial cytoplasm --- Certainty = 0.6082 (Affirmative) <succ>
       bacterial membrane --- Certainty = 0.0000 (Not Clear) <succ>
          bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 681

A DNA sequence (GBSx0723) was identified in *S. agalactiae* <SEQ ID 2097> which encodes the amino acid sequence <SEQ ID 2098>. Analysis of this protein sequence reveals the following:

Possible site: 30
>>> Seems to have a cleavable N-term signal seq.
INTEGRAL    Likelihood = −9.87    Transmembrane 126-142 (124-154)
INTEGRAL    Likelihood = −8.23    Transmembrane 45-61 (41-66)
INTEGRAL    Likelihood = −5.10    Transmembrane 241-257 (236-257)
INTEGRAL    Likelihood = −4.04    Transmembrane 199-215 (198-218)
INTEGRAL    Likelihood = −0.22    Transmembrane 96-112 (96-112)
----- Final Results -----
    bacterial membrane --- Certainty = 0.4949 (Affirmative) <succ>
       bacterial outside --- Certainty = 0.0000 (Not Clear) <succ>
          bacterial cytoplasm --- Certainty = 0.0000 (Not Clear) <succ>

The protein has homology with the following sequences in the GENPEPT database:

```
>GP:AAG28337 GB:U88582 SatE [Streptococcus mutans]
Identities = 54/103 (52%), Positives = 70/103 (67%), Gaps = 2/103 (1%)
Query:   1 MISDFLRDNPILTLLFCAHFLADFQWQSQSLADSKSHSWRGLWRHLLIVFLPLAALMILI   60
           +IS FL  NP+LTLL  AHFLADFQWQSQ +AD KS +W  L RHL+IV LPL  L ++I
Sbjct:   6 VISQFLSGNPVLTLLLIAHFLADFQWQSQKMADLKSSNWTYLIRHLIIVALPLILLSVVI   65

Query:  61 PETTLLNLSIWGSHIVIDSIKKLSYPWVEEGHF--QKAAFIID                 101
           P + L+   I+  SH++IDS K L    + ++    F   KA F+ID
Sbjct:  66 PHSFLVLSLIFLSHVLIDSGKLLLNSFYKDRSFIKTKAVFLID                 108
```

A related DNA sequence was identified in *S. pyogenes* <SEQ ID 2099> which encodes the amino acid sequence <SEQ ID 2100>. Analysis of this protein sequence reveals the following:

Possible site: 16
>>> Seems to have an uncleavable N-term signal seq
INTEGRAL   Likelihood = −7.59   Transmembrane 125-141 (120-144)
INTEGRAL   Likelihood = −6.58   Transmembrane 222-238 (215-238)
INTEGRAL   Likelihood = −5.04   Transmembrane 47-63 (45-77)
INTEGRAL   Likelihood = −4.62   Transmembrane 179-195 (178-199)
INTEGRAL   Likelihood = −0.43   Transmembrane 67-83 (67-83)
----- Final Results -----
   bacterial membrane --- Certainty = 0.4036 (Affirmative) <succ>
   bacterial outside --- Certainty = 0.0000 (Not Clear) <succ>
   bacterial cytoplasm --- Certainty = 0.0000 (Not Clear) <succ>

The protein has no significant homology with any sequences in the GENPEPT database.

An alignment of the GAS and GBS proteins is shown below:

```
Identities = 109/256 (42%), Positives = 146/256 (56%), Gaps = 28/256 (10%)
Query:   2 ISDFLRDNPILTLLFCAHFLADFQWQSQSLADSKSHSWRGLWRHLLIVFLPLAALMILIP  61
           +S +L   P LTL   H L+D+Q QSQ +AD K      L  HL+ V +PL  L ++IP
Sbjct:   5 VSHYLAQTPTLTLFLICHVLSDYQLQSQQVADLKEKHLTYLGYHLIGVSIPLICLTLIIP  64

Query:  62 ETTLLNLSIWGSHIVIDSIKKL---SYPWVEEGHFQKAAFIIDQLAHYTCIIVFYHALPT 118
           +  L++L +   SH +ID +K     S W E     F++DQ H              L
Sbjct:  65 QAWLMSLLVMISHALIDWLKPKMANSLKWKREW-----IFLLDQCLHIAISSFAGLRLAG 119

Query: 119 YLPPNHWLLPIKHFIVIALVFIIITKPINIVFKIFFNKFQAKELSSLLTQEKTKIMKEKS 178
              PN WL PI   ++   L   ++ITKP NIVFK+FF K+Q   +      +
Sbjct: 120 VTLPN-WL-PIS-ILMTVLFILLITKPTNIVFKLFFIKYQPDQGEKM------------- 163

Query: 179 EDHEETIEGAGAMIGNLERLIMAILLISGQYAAIGLVFTAKSIARYDKISKSQVFAEYYL 238
               +TI GAGA IG LER+++ + +I GQ+A+IGLVFTAKSIARY+KIS+S  FAEYYL
Sbjct: 164 ----DTIIGAGATIGILERIVIGVCMIMGQFASIGLVFTAKSIARYNKISESPAFAEYYL 219

Query: 239 IGSLFSIISVLITHWL                                             254
           IGSLFSI+SV I  W+
Sbjct: 220 IGSLFSILSVFIAAWI                                             235
```

Based on this analysis, it was predicted that these proteins and their epitopes could be useful antigens for vaccines or diagnostics.

Example 682

A DNA sequence (GBSx0724) was identified in *S. agalactiae* <SEQ ID 2101> which encodes the amino acid sequence <SEQ ID 2102>. Analysis of this protein sequence reveals the following:

Possible site: 30
>>> May be a lipoprotein
----- Final Results -----
   bacterial membrane --- Certainty = 0.0000 (Not Clear) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database:

```
>GP:AAD17886 GB:AF100456 hyaluronate-associated protein precursor
[Streptococcus equi]
Identities = 358/521 (68%), Positives = 426/521 (81%), Gaps = 2/521 (0%)
Query:   1 MSSFNRKKLKFLGISLATLTATTVTLVACGNESKNSGDNKV-INWYIPTEISTLDISKNT  59
           M+   K  K LG++  TL A+   L+ACGN+   S D K  INWY PTEI TLDISKNT
Sbjct:   1 MTVLGTKACKRLGLAAVTL-ASVAALMACGNKQSASTDKKSEINWYTPTEIITLDISKNT  59

Query:  60 DAYSNLAIGNSGSNLLRIDKEGKPKPDLAKKVSVSSDGLTYTATLRDNLKWSDGSKLSAE 119
           D YS LAIGNSGSNLLR D +GK +PDLA+KV VS DGLTYTATLRD LKWSDGS L+AE
Sbjct:  60 DTYSALAIGNSGSNLLRADAKGKLQPDLAEKVDVSEDGLTYTATLRDGLKWSDGSDLTAE 119

Query: 120 DFVYTWRRIVDPKTASEYAYLATESHLLNADKINSGDIKDLNKLGVTAKGNQVTFKLTSP 179
           DFVY+W+R+VDPKTASEYAYLATESHL NA+ INSG   DL+ LGV A GN+V F LT P
Sbjct: 120 DFVYSWQRMVDPKTASEYAYLATESHLKNAEDINSGKNPDLSLGVKADGNKVIFTLTEP 179
```

```
-continued
Query: 180  CPQFKYYLAFSNFMPQKQSYVEKVGKDYGTTSKNQIYSGPYLVKDWNGSNGKFKLVKNKY 239
             PQFK  L+FSNF+PQK+S+V+  GKDYGTTS+ QIYSGPY+VKDWNG++G FKLVKNK
Sbjct: 180  APQFKSLLSFSNFVPQKESFVKDAGKDYGTTSEKQIYSGPYIVKDWNGTSGTFKLVKNKN 239

Query: 240  YWDSKHVKTNSVIVQTIKKPDTAVQMYKQGQIDFAEISGTSAIYQANKNNKDVVDASDAR 299
             YWD+K+VKT +V VQT+KKPDTAVQMYKQG++DFA ISGTSAIY ANK +KDVV   +A
Sbjct: 240  YWDAKNVKTETVNVQTVKKPDTAVQMYKQGKLDFANISGTSAIYNANKKHKDVVPVLEAT 299

Query: 300  TTYITYNQTGSVKALTNQKIRQALNLATDRKGVVKAAVDTGSTPAESLVPKKLAKLPNGE 359
             T YI+YNQTG+++ L + KIRQALNLATDRKG+V AAVDTGS PA +LVP  LAKL +G
Sbjct: 300  TAYIVYNQTGAIEGLNSLKIRQALNLATDRKGIVSAAVDTGSKPATALVPTGLAKLSDGT 359

Query: 360  DLSKYTAPGYTYNTSKAQKLFKEGLAEVGQSSLKLTITADSDSPAAKNAVDYVKSTWESA 419
             DL+++ APGY Y+  +A KLFKEGLAE+G+  +L +TITAD+D+PAAK+AVDY+K TWE+A
Sbjct: 360  DLTEHVAPGYKYDDKEAAKLFKEGLAELGKDALTITITADADAPAAKSAVDYIKETWETA 419

Query: 420  LPGLTVEEKFVTFKQRLEDAKNENFDVVLFSWGGDYPEGSTFYGLFTTNSAYNYGKFSSK 479
             LPGLTVEEKFV FKQRLED KN+NF+V +  WGGDYP+GSTFYGLF + SAYNYGKF++
Sbjct: 420  LPGLTVEEKFVPFKQRLEDTKNQNFEVAVVLWGGDYPKGSTFYGLFKSGSAYNYGKFTNA 479

Query: 480  EYDNAYQKAITTDALKPGDAANDYKTAEKALFDQSYYNPVY                   520
             +YD AY KA+TTDAL    AA+DYK AEKAL+D + YNP+Y
Sbjct: 480  DYDAAYNKALTTDALNTDAAADDYKAAEKALYDNALYNPLY                   520
```

There is also homology to SEQ ID 318. An alignment of the GAS and GBS proteins is shown below:

```
Identities = 138/524 (26%), Positives = 222/524 (42%), Gaps = 73/524 (13%)
Query:   7  KKLKFLG-ISLATLTATTVTLVACGNESKNSGDN--KVINWYIPTEISTLDISKNTDAYS   63
            KK K+L  +S+A L+ +    L ACGN++ + G    K    +    +LD          +
Sbjct:   5  KKSKWLAAVSVAILSVSA--LAACGNENASGGSEATKTYKYVFVNDPKSLDYILTNGGGT   62

Query:  64  NLAIGNSGSNLLRIDKEGKPKPDLAKKVSVSSDGLTYTATLRDNLKW--SDGSK---LSA  118
                 I      LL  D+ G   P LAK   VS DGLTYT TLRD + W  +DG +   ++A
Sbjct:  63  TDVITQMVDGLLENDEYGNLVPSLAKDWKVSKDGLTYTYTLRDGVSWYTADGEEYAPVTA  122

Query: 119  EDFVYTWRRIVDPKTASEYAYLATESHLLNADKINSGDIKDLNKLGVTAKGNQ-VTFKLT  177
            EDFV    + VD K+ + Y    E  + N       +G++  D  ++GV A  ++ V + L
Sbjct: 123  EDFVTGLKHAVDDKSDALY---VVEDSIKNLKAYQNGEV-DFKEVGVKALDDKTVQYTLN  178

Query: 178  SPCPQFKYYLAFSNFMPQKQSYVEKVGKDYGTTSKNQI-YSGPYLVKDWNGSNGKFKLVK  236
               P +    +S P    +++   GKD+GTT  + I  +G Y + +   + S     + K
Sbjct: 179  KPESYWNSKTTYSVLFPVNAKFLKSKGKDFGTTDPSSILVNGAYFLSAFT-SKSSMEFHK  237

Query: 237  NKYYWDSKHVKTNSV--IVQTIKKPDTAVQMYKQGQIDFAEISGTSAIYQ-ANKNNKDVV  293
            N+  YWD+K+V   SV            P +  + + +G+      A +       Y+ A KN    D +
Sbjct: 238  NENYWDAKNVGIESVKLTYSDGSDPGSFYKNFDKGEFSVARLYPNDPTYKSAKKNYADNI  297

Query: 294  D----ASDARTTYIIYN---------------QTGSVKALTNQKIRQALNLATDRKG---  331
                 D R  ++ +N                 Q    KAL N+ RQA+  A DR
Sbjct: 298  TYGMLTGDIR--HLTWNLNRTSFKNTKKDPAQQDAGKKALNNKDFRQATQFAFDRASFQA  355

Query: 332  ----------------VVKAAVDTGSTPAESLVPKKLAKL-PNGEDLSKYTAPGYTYNTS  374
                               V    V G +   S V K++AKL   +D++    A    YN
Sbjct: 356  QTAGQDAKTKALRNMLVPPTFVTIGESDFGSEVEKEMAKLGDEWKDVNLADAQDGFYNPE  415

Query: 375  KAQKLF---KEGLAEVGQS-SLKLTITADSDSPAAKNAVDYVKSTWESALPGLTV-----  425
            KA+ F   KE L  G +  ++L    D  + A     K + E++L      V
Sbjct: 416  KAKAEFAKAKEALTAEGVTFPVQLDYPVDQANAATVQEAQSFKQSVEASLGKENVIVNVL  475

Query: 426  EEKFVTFKQR---LEDAKNENFDVVLFSWGGDYPEGSTFYGLFT                466
            E +  T + +    E + +++D++   WG DY + T+ + +
Sbjct: 476  ETETSTHEAQGFYAETPEQQDYDIISSWWGPDYQDPRTYLDIMS                519
```

SEQ ID 2102 (GBS323) was expressed in *E. coli* as a His-fusion product. SDS-PAGE analysis of total cell extract is shown in FIG. 62 (lane 4; MW 61.3 kDa).

Figure 306:
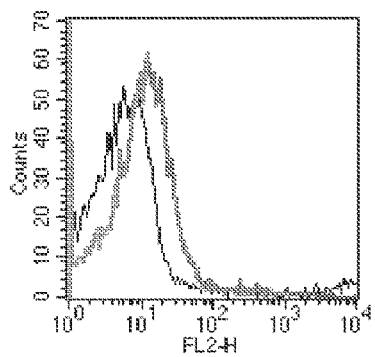

The GBS323-His fusion product was purified (FIG. 209, lane 5) and used to immunise mice. The resulting antiserum was used for FACS (FIG. 306), which confirmed that the protein is immunoaccessible on GBS bacteria.

Based on this analysis, it was predicted that these proteins and their epitopes could be useful antigens for vaccines or diagnostics.

Example 683

A DNA sequence (GBSx0725) was identified in *S. agalactiae* <SEQ ID 2103> which encodes the amino acid sequence <SEQ ID 2104>. Analysis of this protein sequence reveals the following:

Possible site: 60
>>> Seems to have no N-terminal signal sequence
INTEGRAL   Likelihood = −1.54   Transmembrane 199-215 (198-215)
----- Final Results -----
  bacterial membrane --- Certainty = 0.1617 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database:

```
>GP:AAC17173 GB:AF065141 unknown [Streptococcus mutans]
Identities = 304/356 (85%), Positives = 334/356 (93%)
Query:   1  MKRELLLEKIDELKEIMPWYVLEYYQSKLSVPYSFTTLYEYLKEYRRFLEWLLDSGVANC   60
            M+RELLLEKIDELKE+MPWYVLEYYQSKL+VPYSFTTLYEYLKEYRRF EWL+DSGV+N
Sbjct:   1  MRRELLLEKIDELKELMPWYVLEYYQSKLTVPYSFTTLYEYLKEYRRFFEWLIDSGVSNA   60

Query:  61  HHIAEIELSVLENLTKKDMEAFILYLRERPLLNANTRQNGVSQTTINRTLSALSSLFKYL  120
            + +A+I L  LE+L+KKDME+FILYLRER LLN    ++ GVSQTTINRTLSALSSL+KYL
Sbjct:  61  NKLADIPLETLEHLSKKDMESFILYLRERTLLNTKNKRQGVSQTTINRTLSALSSLYKYL  120

Query: 121  TEEVENADGEPYFYRNVMKKVSTKKKKETLASRAENIKQKLFLGNETIEFLEYIDCEYQN  180
            TEEVENADGEPYFYRNVMKKVSTKKKKETLA+RAENIKQKLFLGNET+EFLEY+DCEY+
Sbjct: 121  TEEVENADGEPYFYRNVMKKVSTKKKKETLAARAENIKQKLFLGNETMEFLEYVDCEYEQ  180

Query: 181  KLSKRALAFFNKNKERDLAIIALLLASGVRLSEAVNLDLKDINLNVMVIDVTRKGGKRDS  240
            KLSKRAL+ F KNKERDLAIIALLLASGVRLSEAVNLDLKD+NLN+M+I+VTRKGGK DS
Sbjct: 181  KLSKRALSSFRKNKERDLAIIALLLASGVRLSEAVNLDLKDVNLNMMIIEVTRKGGKHDS  240

Query: 241  VNVASFAKPYLANYLDIRKNRYKAENQDIALFLSEYRGVPNRIDASSVEKMVAKYSQDFK  300
            VNVA FAKPYL NY+ IR+ RYKA+  D+A FLSEYRGVPNR+DASS+EKMVAKYSQDFK
Sbjct: 241  VNVAGFAKPYLENYITIRRGRYKAKKTDLAFFLSEYRGVPNRMDASSIEKMVAKYSQDFK  300

Query: 301  VRVTPHKLRHTLATRLYDATKSQVLVSHQLGHASTQVTDLYTHIVNDEQKNALDKL      356
            +RVTPHKLRHTLATRLYDATKSQVLVSHQLGHASTQVTDLYTHIVNDEQKNALDKL
Sbjct: 301  IRVTPHKLRHTLATRLYDATKSQVLVSHQLGHASTQVTDLYTHIVNDEQKNALDKL      356
```

A related DNA sequence was identified in *S. pyogenes* <SEQ ID 2105> which encodes the amino acid sequence <SEQ ID 2106>. Analysis of this protein sequence reveals the following:

Possible site: 48
>>> Seems to have no N-terminal signal sequence
INTEGRAL   Likelihood = −1.54   Transmembrane 211-227 (210-227)
----- Final Results -----
  bacterial membrane --- Certainty = 0.1617 (Affirmative) <succ>
  bacterial outside --- Certainty = 0.0000 (Not Clear) <succ>
  bacterial cytoplasm --- Certainty = 0.0000 (Not Clear) <succ>

A related sequence was also identified in GAS <SEQ ID 9139> which encodes the amino acid sequence <SEQ ID 9140>. Analysis of this protein sequence reveals the following:

Possible cleavage site: 60
>>> Seems to have no N-terminal signal sequence
INTEGRAL   Likelihood = −1.54   Transmembrane 199-215 (198-215)
----- Final Results -----
  bacterial membrane --- Certainty = 0.162 (Affirmative) <succ>
  bacterial outside --- Certainty = 0.000 (Not Clear) <succ>
  bacterial cytoplasm --- Certainty = 0.000 (Not Clear) <succ>

An alignment of the GAS and GBS proteins is shown below:

```
Identities = 283/356 (79%), Positives = 321/356 (89%)
Query:   1  MKRELLLEKIDELKEIMPWYVLEYYQSKLSVPYSFTTLYEYLKEYRRFLEWLLDSGVANC   60
            M+RELLLEKI+  K IMPWYVL+YYQSKL+VPYSFTTLYEYLKEY+RF +WL+D+ +
Sbjct:  13  MRRELLLEKIETYKAIMPWYVLDYYQSKLAVPYSFTTLYEYLKEYKRFFDWLMDADLTQA   72

Query:  61  HHIAEIELSVLENLTKKDMEAFILYLRERPLLNANTRQNGVSQTTINRTLSALSSLFKYL  120
            IA+I+LS LE+LTKKD+EAF+LYLRERP LN + +  G+SQTTINRTLSALSSL+KYL
Sbjct:  73  PKIADIDLSTLEHLTKKDLEAFVLYLRERPSLNTYSTKEGLSQTTINRTLSALSSLYKYL  132
```

-continued
```
Query:  121  TEEVENADGEPYFYRNVMKKVSTKKKKETLASRAENIKQKLFLGNETIEFLEYIDCEYQN  180
             TEEVEN  GEPYFYRNVMKKVSTKKKKETLASRAENIKQKLFLG+ET+ FL+Y+D EY+
Sbjct:  133  TEEVENDQGEPYFYRNVMKKVSTKKKKETLASRAENIKQKLFLGDETLAFLDYVDKEYEQ  192

Query:  181  KLSKRALAFFNKNKERDLAIIALLLASGVALSEAVNLDLKDINLNVMVIDVTRKGGKRDS  240
             KLS RA + F KNKERDLAIIALLLASGVRLSEAVNLDLKD+NLN+M+I+V RKGGKRDS
Sbjct:  193  KLSNRAKSSFRKNKERDLAIIALLLASGVRLSEAVNLDLKDVNLNMMIIEVIRKGGKRDS  252

Query:  241  VNVASFAKPYLANYLDIRKNRYKAENQDIALFLSEYRGVPNRIDASSVEKMVAKYSQDFK  300
             VNVA FAK YL +YL +R+ RYKAE QD+A FL+EYRGVPNR+DASS+EKMV KYS+DFK
Sbjct:  253  VNVAGFAKGYLESYLAVRQRRYKAEKQDLAFFLTEYRGVPNRMDASSIEKMVGKYSEDFK  312

Query:  301  VRVTPHKLRHTLATRLYDATKSQVLVSHQLGHASTQVTDLYTHIVNDEQKNALDKL      356
             +RVTPHKLRHTLATRLYDATKSQVLVSHQLGH+STQVTDLYTHIVNDEQKNALD L
Sbjct:  313  IRVTPHKLRHTLATRLYDATKSQVLVSHQLGHSSTQVTDLYTHIVNDEQKNALDNL      368
```

SEQ ID 2104 (GBS420) was expressed in *E. coli* as a GST-fusion product. SDS-PAGE analysis of total cell extract is shown in FIG. 172 (lane 5; MW 68 kDa).

GBS420-GST was purified as shown in FIG. 219, lane 9-10.

Based on this analysis, it was predicted that these proteins and their epitopes could be useful antigens for vaccines or diagnostics.

Example 684

A DNA sequence (GBSx0726) was identified in *S. agalactiae* <SEQ ID 2107> which encodes the amino acid sequence <SEQ ID 2108>. This protein is predicted to be a sensor-like histidine kinase in idh 3' region. Analysis of this protein sequence reveals the following:

---
Possible site: 24
>>> Seems to have an uncleavable N-term signal seq
INTEGRAL   Likelihood = −7.75   Transmembrane 10-26 (8-34)
INTEGRAL   Likelihood = −3.93   Transmembrane 37-53 (35-54)
----- Final Results -----
   bacterial membrane --- Certainty = 0.4100 (Affirmative) <succ>
   bacterial outside --- Certainty = 0.0000 (Not Clear) <succ>
   bacterial cytoplasm --- Certainty = 0.0000 (Not Clear) <succ>
---

The protein has homology with the following sequences in the GENPEPT database:

SEQ ID 2108 (GBS421) was expressed in *E. coli* as a GST-fusion product. SDS-PAGE analysis of total cell extract is shown in FIG. 172 (lane 6; MW 63 kDa).

GBS421-GST was purified as shown in FIG. 219, lane 11.

Based on this analysis, it was predicted that this protein and its epitopes, could be useful antigens for vaccines or diagnostics.

Example 685

A DNA sequence (GBSx0727) was identified in *S. agalactiae* <SEQ ID 2111> which encodes the amino acid sequence <SEQ ID 2112>. Analysis of this protein sequence reveals the following:

---
Possible site: 37
>>> Seems to have no N-terminal signal sequence
----- Final Results -----
   bacterial cytoplasm --- Certainty = 0.1310 (Affirmative) <succ>
   bacterial membrane --- Certainty = 0.0000 (Not Clear) <succ>
   bacterial outside --- Certainty = 0.0000 (Not Clear) <succ>
---

The protein has homology with the following sequences in the GENPEPT database:

```
>GP:CAB16001 GB:Z99124 similar to two-component sensor histidine
kinase [YxdJ] [Bacillus subtilis]
Identities = 96/320 (30%), Positives = 172/320 (53%), Gaps = 16/320 (5%)
Query:   2  IRQFLREHLIWYILYIM--MFVLFFISFYLYHLPMPYLFNSLGLNVIVLLGISIWQYSRY   59
            ++ FLR H +  +L+++ +FV F+   F  H    +LF  LG+ +++L G   +++  +
Sbjct:   1  MKLFLRSHAVLILLFLLQGLFVFFYYWFAGLH-SFSHLFYILGVQLLILAGYLAYRWYKD   59

Query:  60  RKKMLHLKYFNSSQDPSFELQPSDYAYFNIITQLEA--REAQKVSETIEQTNHVALMIKM  117
            R     L    D  +L S +       Q+E    + QK+ ET + +       +
Sbjct:  60  RGVYHWLSSGQEGTDIPY-LGSSVFCSELYEKQMELIRLQHQKLHETEAKLDARVTYMNQ  118

Query: 118  WSHQMKVPLAAISLMAQTNHLDP--KEVEQQLLKLQHYLETLLAFLKFRQYRDDFRFEAV  175
            W HQ+K PL+ I+L+ Q    +P  ++++++ +++  LETLL   +   + DF+ EAV
Sbjct: 119  WVHQVKTPLSVINLIIQEED-EPVFEQIKKEVRQIEFGLETLLYSSRLDLFERDFKIEAV  177

Query: 176  SLREVVVEIIKSYKVICLSKSL--SIIIEGDNIWKIDKKWLTFALSQVLDNAIKYSNPES  233
            SL E++  +I+SYK + + +    + + D+   TD KWL FA+ QV+ NA+KYS +S
Sbjct: 178  SLSELLQSVIQSYKRFFIQYRVYPKMNVCDDHQIYIDAKWLKFAIGQVVTNAVKYSAGKS  237

Query: 234  -----KIIISIGEESIRIQDYGIGILEEDIPRLFEDGFTGYNGHEHQKATGMGLYMTKEV  288
                 +    + ++DYG+GI +DI R+F+ +TG NG   Q++TG+GL++ KE+
Sbjct: 238  DRLELNVFCDEDRTVLEVKDYGVGIPSQDIKRVFDPYYTGENGRRFQESTGIGLHLVKEI  297

Query: 289  LSSLNLSISVDSKINYGTAV                                          308
             LN ++ + S      GT+V
Sbjct: 298  TDKLNHTVDISSSPGEGTSV                                          317
```

```
>GP:AAD10258 GB:AF036964 putative response regulator [Lactobacillus
sakei]
Identities = 94/222 (42%), Positives = 140/222 (62%), Gaps = 8/222 (3%)
Query:   7 KIYIVEDDMTIVSLLKDHLSASYHVSSV--SNFRDVKQEIIAFQPDLILMDITLPYFNGF   64
           +I IVEDD TI +L+ ++L   + + ++    +F  +    +P L+L+DI LP ++GF
Sbjct:   3 EIMIVEDDPTIANLIAENLE-KWQLKAIIPDDFDTIFDRFLTDKPHLVLLDINLPVYDGF   61

Query:  65 YWTAELRKFLTIPIIFISSSNDEMDMVMALNMGGDDFISKPFSLAVLDAKLTAILRRSQQ  124
           YW  ++R+   +PIIFISS +  MDMVM++NMGGDDF++KPFS+ VL AK+ A+LRR+
Sbjct:  62 YWCRKIREVSKVPIIFISSRSTNMDMVMSMNMGGDDFVNKPFSMEVLIAKINALLRRTYN  121

Query: 125 FIQQE---LTFGGFTLT-REGLLSSQDKEVILSPTENKILSILLMHPKQVVSKESLLEKL  180
           ++ Q    +    G +  +G      D  V LS  E K+L  L+     Q+VS+E LL   L
Sbjct: 122 YVDQNTDVIEHNGLLINLQSGGAQVGDTVVDLSKNEYKLLQFLMRQHGQIVSREKLLRAL  181

Query: 181 WENDSFIDQNTLNVNMTRLRKKIVPIGF-DYIHTVRGVGYLL                   221
           W+++ F+D NTL VN+ RLRKKI    G  DYI T  G GY++
Sbjct: 182 WDDERFVDDNTLTVNINRLRKKIEQAGLEDYIQTKIGQGYII                   223
```

There is also homology to SEQ ID 1182.

Based on this analysis, it was predicted that this protein and its epitopes, could be useful antigens for vaccines or diagnostics.

Example 686

A DNA sequence (GBSx0728) was identified in *S. agalactiae* <SEQ ID 2113> which encodes the amino acid sequence <SEQ ID 2114>. This protein is predicted to be permease OrfY. Analysis of this protein sequence reveals the following:

```
Possible site: 37
>>> Seems to have no N-terminal signal sequence
INTEGRAL   Likelihood = –11.62   Transmembrane  55-71 (49-75)
INTEGRAL   Likelihood = –10.30   Transmembrane 197-213 (192-218)
INTEGRAL   Likelihood =  –9.13   Transmembrane 152-168 (141-172)
```

-continued

```
INTEGRAL   Likelihood = –8.70   Transmembrane 624-640 (619-645)
INTEGRAL   Likelihood = –8.44   Transmembrane 222-238 (219-250)
INTEGRAL   Likelihood = –7.75   Transmembrane 283-299 (280-307)
INTEGRAL   Likelihood = –7.70   Transmembrane 533-549 (526-552)
INTEGRAL   Likelihood = –6.95   Transmembrane 108-124 (99-140)
INTEGRAL   Likelihood = –4.88   Transmembrane 585-601 (581-610)
INTEGRAL   Likelihood = –3.82   Transmembrane  25-41 (21-47)
INTEGRAL   Likelihood = –0.48   Transmembrane 602-618 (602-618)
----- Final Results -----
    bacterial membrane --- Certainty = 0.5649 (Affirmative) <succ>
    bacterial outside --- Certainty = 0.0000 (Not Clear) <succ>
    bacterial cytoplasm --- Certainty = 0.0000 (Not Clear) <succ>
```

A related GBS nucleic acid sequence <SEQ ID 9809> which encodes amino acid sequence <SEQ ID 9810> was also identified.

The protein has homology with the following sequences in the GENPEPT database:

```
>GP:AAF99695 GB:AF267498 permease OrfY [Streptococcus mutans]
Identities = 154/665 (23%), Positives = 299/665 (44%), Gaps = 40/665 (6%)
Query:   4 MFYLKIAWHNLKHSIDQYIPFLLASLLLYSLTCSTLLILMSAVGRDMGTAAT---VLFLG    60
           MF  KI++HNL +   +P+   +       + L +    ++ TA     +L  G
Sbjct:   1 MFLPKISFHNLIVNKSLTLPYFAIMTIFSGFNYVLINFLTNPSFYNIPTARILIDILIFG    60

Query:  61 VIVLSIFAVVMEHYSYNILMKQRSSEFGLYNILGMNKRQVARVASLELFIIYIFLISIGS   120
           +I++S+  ++   Y+   +   +R+S+  G++  +LGM K+Q+ ++   LE   ++    G
Sbjct:  61 FILISLLMLLYGRYANRFISDERNSNMGIFLMLGMGKKQLLKIIYLEKLYLFTGTFFGGL   120

Query: 121 LFSAFFAKFIYLIFVNIINYHALNLSLSLWPFIICIVIFTGIFLTLEVPVIRHVHLSSPL   180
           +F  ++K +L   N+I    +   SL    +++   I+  +    +   R +      S
Sbjct: 121 IFGFVYSKIFFLFIRNLIVIGDVREQYSLTAISWLLILTFFIYFIIYLSEYRLLKRQSIT   180

Query: 181 SLFRKKQQGEKEPKGNLILAILALVAIAIAYTMALTSGKAPALAVIY-RFFFAVLLVIAG   239
           +F K + +    K  ++ + L A+  + Y ALTS  P   +  RF +A  LV  G
Sbjct: 181 VIFNSKAKRDNPRKTSVFVGLFGLFALLMGYHFALTS---PNVTTSFSRFIYAACLVTLG   237

Query: 240 TYLFYISFMTWYLKRLRQNKHYYYKSEHFVSTSQMIFRMKQNAVGLASITLLAVMALVTI   299
           +  + S +    L   +++   YY     FV + +    R++ NA+ LA+I + +    LV++
Sbjct: 238 IFCTFSSGVIMLLTVIKKRRAIYYNQRRFVVIASLFHRIRSNALSLATICIFSTATLVSL   297

Query: 300 ATTVSLYSNTQNVVTGLFPKSVSLSIDNSKGDAKNIFEEKILKKLGKSSKEAITYNQTMI   359
           +   SLY    N+V    P+ V++    S  D     E L +    +T Q
Sbjct: 298 SVLASLYAKDNMVRLSSPRDVTVL---STTDI-----EPNLMDIATKNHVTLTNRQ---   346

Query: 360 SMPVSQSSELNITSKNVKHVDITKTGFMY------LITQNDFRRLGHQLPKLKDNQVAYF   413
           ++ VSQS  NI      H+ +  G M        +I+ + F     +LK++++  +
Sbjct: 347 NLKVSQSVYGNIKGS---HLSVDPNGGMANDYQITVISLDSFNASNNTHYRLKNHEILTY   403

Query: 414 VQKGDSRLKKINLLGNKFDVVKNLKEA-YVPETTNTYNPGLIIFANNKQI-DNIRKAYLP   471
           V  G +          GK    VK +K  ++        + P   I  +N++I    I K L
Sbjct: 404 VSNGAAAPSSYTTNGVKLTNVKQIKRINFIFSPLRSMQPNFFIITDNREIIQTILKEELT   463

Query: 472 YTKNINTFPKTFKAYLDLNSQEINSISKNDIIEVEG--KYVGNISTKQSFLKEGYQMFGG   529
```

```
              +     T   Y   +   +++N      D  +E       ++  N+ + +      +FGG
Sbjct: 464   WG--------TMAGY-HVKGKKMNQKDFYDELETTNFRQFSANVVSIRQVKSMFNALFGG   514

Query: 530   LLFTGFLLGISFLLGIALIVYYKQYSEGHEDKRSYRILQEVGMSKKLVKRTINSQIMIFF   589
             LLF G + G   F +   A+ +YY+Q SEG   D+   Y+ + ++GM+ K ++ +I   QI    F
Sbjct: 515   LLFVGIIFGTIFAILTAITIYYQQLSEGIRDRDDYKAMIKLGMTNKTIQDSIKVQINFVF   574

Query: 590   FQPLVVAVIHFGVAIPMLKQMLLVFGVLNSTIVYVVSGLTVLAISIIYFIIYRITSRTYY   649
                P+   A+++    A+P+L +++   FG ++ +      G  ++      Y+ I    TS+ YY
Sbjct: 575   ILPIAFALLNLIFALPILYKIMTTFGFNDAGLFLRAVGTCLIVYLFFYWFICHCTSKLYY   634

Query: 650   HIIER   654
             +I +
Sbjct: 635   RLISK   639
```

A related DNA sequence was identified in *S. pyogenes* <SEQ ID 2115> which encodes the amino acid sequence <SEQ ID 2116>. Analysis of this protein sequence reveals the following:

Possible site: 35
>>> Seems to have a cleavable N-term signal seq.
INTEGRAL  Likelihood = −13.59  Transmembrane 602-618 (592-630)
INTEGRAL  Likelihood = −12.26  Transmembrane 59-75 (50-81)
INTEGRAL  Likelihood = −12.21  Transmembrane 235-251 (224-262)
INTEGRAL  Likelihood = −9.82   Transmembrane 159-175 (146-177)
INTEGRAL  Likelihood = −9.02   Transmembrane 201-217 (198-223)

-continued

INTEGRAL  Likelihood = −8.97  Transmembrane 510-526 (507-540)
INTEGRAL  Likelihood = −6.42  Transmembrane 569-585 (564-589)
INTEGRAL  Likelihood = −5.95  Transmembrane 109-125 (102-138)
INTEGRAL  Likelihood = −4.09  Transmembrane 294-310 (290-315)
INTEGRAL  Likelihood = −1.86  Transmembrane 126-142 (126-142)
----- Final Results -----
    bacterial membrane --- Certainty = 0.6434 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:BAB03337 GB:AB035452 ABC transporter [Staphylococcus aureus]
Identities = 141/657 (21%), Positives = 289/657 (43%), Gaps = 66/657 (10%)
Query:   5   ITKSNIKKNFSLYRIYFLATIGLLSIFIAFLNFISDKII--TEKIGDSGQALVIANGSL-    61
             I    N+++N    Y +Y       L S+F + + + S    +   T+ + +       +I   G+L
Sbjct:   6   IVFKNLRQNLKHYAMY------LFSLFFSIVLYFSFTTLQFTKGVNNDDSMAIIKKGALV    59

Query:  62   --IFLIVFLVVFLIYFNNFFVKKRSQELGVLAILGFSKRELTKLLTLENLVILVLSYLVS   119
               IFL + +V+FL+Y N+   FVK+R++E   +  ++G +++ + K+L LE +++ +++ +V
Sbjct:  60   GSIFLFIIIVIFLMIANHLFVKRRTREFALFQLIGLTRQNILKMLALEQMIVFLITGVVG   119

Query: 120   LLLGPTLYFLAVLAITHLLNLIMEVQWFITVNEIIESLGILVVVFLINVITNGLIISKQS   179
             +L G      L  +   ++ L++B ++ +        ++ ++ +L++ +++ +   + L + ++S
Sbjct: 120   VLCGIAGAQLLLSIVSKLMSLSINLSIHFEPMALVLTIFMLIIAYVLILFQSALFLKRRS   179

Query: 180   LIEFVNFSRKAE----KKIKIRKVRAIIAITALLLSYILCLATVFSSTRNMLLSIGMVPV   235
             ++  +    S K+        K      +   + + I  + L Y   +AT     T      L        P
Sbjct: 180   ILSMMKDSIKTDATTAKVTTAEVISGVLGIAMIALGYY--MATEMFGTFKALTMAMTSP-   236

Query: 236   SLLIIVLVVLGTVFTIRYGLAFVVSLLKENKKRLYRPLSNIIYPKFNYRIATKNKLLTVL   295
               +I+  L V+G        R  ++ +   LK++K        +       YR+        LT++
Sbjct: 237   -FIILFLTVVGAYLFFRSSVSLIFKTLKKSKNGRVSITDVVFTSSIMYRMKKNAMSLTII   295

Query: 296   GGLLTVTVSVAGMMVMLYAYSLNGIERLTPSAIEYNVESENGQVNVTTILENDQVSL---   352
                + VTV+V    + +   +  +    +  P+ E+NV +        T    L    Q++
Sbjct: 296   AIISAVTVTVLCFAALSKSNTDQTLTSMAPN--EFNVVATQDAKQFETKLSQQQITFSKN   353

Query: 353   ----VDVGLLRLNTIPEVTITDSGQTIPYFDIINYSDYKELMKAQGRTNSIEGSKSLPLL   408
                 + V  ++      I    +DSG+T        N          K    G    +KSLP +
Sbjct: 354   AYETITVDNVKDQVITLENGSDSGRTNSILSANN--------KVTGNNAIITNTKSLPNI   405

Query: 409   INYYPTEISLGKTFNLGNAYDVT--VKQVSTNNVFSFSTSVTTLV--VSDKLYAKLSSRF   464
             IN         I L K   +     + T  V Q           V+    +S   + V VS   + Y +L +
Sbjct: 406   IN-----IHLNKDLVVKGTKNETFRVTQEDKGRVYPLNLSFNSPVVEVSPEKYQQLKT--   458

Query: 465   PEKEMTIRTFNGTSIR------SSEAFYNQFSMVPDVISSYSKEHTVKTANIATYIFIT-   517
             +    + TF G I+         ++A   QF       D  +Y +         A       IF+T
Sbjct: 459   ---QNNVHTFYGYDIKQTSQKEKAQAIAKQFG---DKVITYDEMKKEVDATNGILIFVTS   512

Query: 518   FLSILFIICTGSILYFTSLIEIMENKEEYGYLSKLGYSKKMIHRILRYETGILFLIPVFI   577
             FL + F++   G I+Y       + E  +     + L ++G++    + +L +      F +P+ I
Sbjct: 513   FLGLAFLVAAGCIIYIKQMDETEDELSNFRILKRIGFTHTDMLKGLLLKITFNFGLPLLI   572

Query: 578   GIVNGGMLLIYYKYLFMDTLVAGNIIMLSLLLCLLFFLIIYGTFYVLTRLVTSIIK       634
             I++       I + L       GNI  +  +++ ++ + +IY TF ++              +IK
Sbjct: 573   AILHAVFAAIAFMKLM------GNISFMPVIVVIVVYTLIYITFALIAFVHSNKLIK     623
```

An alignment of the GAS and GBS proteins is shown below:

```
Identities = 145/678 (21%), Positives = 277/678 (40%), Gaps = 89/678 (13%)
Query:  13 NLKHSIDQYIPFLLASLLLYSLTCSTL-----LILMSAVGRDMGTAATVLFLGVIVLSIF   67
           N+K +   Y  + LA++ L S+  + L      I+   +G D GA  +     +I L +F
Sbjct:   9 NIKKNFSLYRIYFLATIGLLSIFIAFLNFISDKIITEKIG-DSGQALVIANGSLIFLIVF   67

Query:  68 AVVMEHYSYNILMKQRSSEFGLYNILGMNKRQVARVASLELFIIYIFLISIGSLFSAFFA  127
           VV    Y  N  +K+RS E G+   ILG +KR++ ++ +LE  +I +    + L S
Sbjct:  68 LVVFLIYFNNFFVKKRSQELGVLAILGFSKRELTKLLTLENLVILV----LSYLVSLLLG  123

Query: 128 KFIYLIFVNIINYHALNLSLSLWPFIICIVIFTGIFLTLEVPVIRHV------HLSSPLS  181
           +Y + V   I   H LNL++ +  FI      I  + + +V +I  +            S +
Sbjct: 124 PTLYFLAVLAIT-HLLNLIMEVQWFITVNEIIESLGILVVVFLINVITNGLIISKQSLIE  182

Query: 182 LFRKKQQGEKEPKGNLILAILALVAIAIAYTMAL------TSGKAPALAVIYRFFFAVLL  235
              ++ EK+ K   + AI+A+ A+ ++Y + L        T        ++ ++      ++L
Sbjct: 183 FVNFSRKAEKKIKIRKVRAIIAITALLLSYILCLATVFSSTRNMLLSIGMVPVSLLIIVL  242

Query: 236 VIAGTYLFYISFMTWYLKRLRQNKHYYYKSEHFVSTSQMIFRMKQNAVGLASITLLAVMA  295
           V+ GT      + +  +  L++NK     Y+   +    +R+   A      +T+L  +
Sbjct: 243 VVLGTVFTIRYGLAFVVSLLKENKKRLYRPLSNIIYPKFNYRI---ATKNKLLTVLGGLL  299

Query: 296 LVTIATT---VSLYSNTQNVVTGLFPKSVSLSIDNSKGDAKNIFEEKILKKLGKSSKEAI  352
           VT++      V LY+ + N  +  L P ++    ++++  G               +  I
Sbjct: 300 TVTVSVAGMMVMLYAYSLNGIERLTPSAIEYNVESENGQV---------------NVTTI  344

Query: 353 TYNQTMISMPVSQSSELNITSKNVKHVDITKTG----FMYLITQNDFRRL------GHQL  402
            N + +V     +  +  V IT +G       +I  +D++ L         + +
Sbjct: 345 LENDQVSLVDVGL-----LRLNTIPEVTITDSGQTIPYFDIINYSDYKELMKAQGRTNSI  399

Query: 403 PKLKDNQVAYFVQKGDSRLKKINLLGNKFDVVKNLKEAYVPETTNTYNPGLIIFANNKQI  462
              K +       +   L K    LGN +DV   +K+      +        +  ++K
Sbjct: 400 EGSKSLPLLINYYPTEISLGKTFNLGNAYDVT--VKQVSTNNVFSFSTSVTTLVVSDKLY  457

Query: 463 DNIRKAYLPYTKNINTFPKT-------FKAYLDLNSQEINSISKNDIIEVDGKYVGNIST  515
             +  +    I TF  T       F   +   I+S SK   ++          NI+T
Sbjct: 458 AKLSSRFPEKEMTIRTFNGTSIRSSEAFYNQFSMVPDVISSYSKEHTVKT-----ANIAT  512

Query: 516 KQSFLKEGYQMFGGLLFTGFLLGISFLLGIALIVYYKQYSEGHEDKRSYRILQEVGMSKK  575
                +F  FL  I F++     I+Y+    E   E+K  Y   L ++G SKK
Sbjct: 513 --------------YIFITFL-SILFIICTGSILYFTSLIEIMENKEEYGYLSKLGYSKK  557

Query: 576 LVKRTINSQIMIFFFQPLVVAVIHFGVAIPMLKQMLLVFGVLNSTIVYVVSGLTVLAISI  635
           ++ R +  + I F  P+ + +++ G+ +     K L +  ++      I+ +   L +L     I
Sbjct: 558 MIHRILRYETGILFLIPVFIGIVNGGMLLIYYK-YLFMDTLVAGNIIMLSLLLCLLFFLI  616

Query: 636 IYFIIYRITSRTYYHIIE                                           653
           IY    Y +T R     II+
Sbjct: 617 IYGTFYVLTLRLVTSIIK                                           634
```

A related GBS gene <SEQ ID 8639> and protein <SEQ ID 8640> were also identified. Analysis of this protein sequence reveals the following:

Lipop: Possible site: -1   Crend: 7
McG: Discrim Score: -11.64
GvH: Signal Score (-7.5): -3.52
Possible site: 37
>>> Seems to have no N-terminal signal sequence
ALOM program    count: 11  value: -11.62  threshold: 0.0

| | | |
|---|---|---|
| INTEGRAL | Likelihood = -11.62 | Transmembrane 55-71 (49-75) |
| INTEGRAL | Likelihood = -10.30 | Transmembrane 197-213 (192-218) |
| INTEGRAL | Likelihood = -9.13 | Transmembrane 152-168 (141-172) |
| INTEGRAL | Likelihood = -8.70 | Transmembrane 624-640 (619-645) |
| INTEGRAL | Likelihood = -8.44 | Transmembrane 222-238 (219-250) |
| INTEGRAL | Likelihood = -7.75 | Transmembrane 283-299 (280-307) |
| INTEGRAL | Likelihood = -7.70 | Transmembrane 533-549 (526-552) |
| INTEGRAL | Likelihood = -6.95 | Transmembrane 108-124 (99-140) |
| INTEGRAL | Likelihood = -4.88 | Transmembrane 585-601 (581-610) |
| INTEGRAL | Likelihood = -3.82 | Transmembrane 25-41 (21-47) |
| INTEGRAL | Likelihood = -0.48 | Transmembrane 602-618 (602-618) |
| PERIPHERAL | Likelihood = 1.16 | 129 | modified ALOM score: 2.82
*** Reasoning Step: 3
----- Final Results -----
  bacterial membrane --- Certainty = 0.5649 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
ORF02245(310-2262 of 2562)
GP|9802356|gb|AAF99695.1|AF267498_5|AF267498(1-639 of 640) permease OrfY
{Streptococcus mutans}
% Match = 10.2
% Identity = 24.0 % Similarity = 49.8
Matches = 147 Mismatches = 297 Conservative Sub.s = 158

123       153       183       213       243       273       303       333
       QKTC*IYLKLLTWMDKLF*W*PIQQMLLVMPNAFYLSKMDVFFTNFIVVIRIIANSIKIFL*QCLPY*GVNNMFYLKIAW
                                                                            ||  || ::
                                                                            MFLPKISF 363       393       423       453       474       504       534       564
       HNLKHSIDQYIPFLLASLLLYSLTCSTLLILMSAVGRDMGTAAT---VLFLGVIVLSIFAVVMEHYSYNILMKQRSSEFG
       |||   :  :|::    ::   :     :  |  :    ::  ||      :| :| |::|::  ::  |:   :  :|:|  |
       HNLIVNKSLTLPYFAIMTIFSGFNYVLINFLTNPSFYNIPTARILIDILIFGPILISLLMLLYGRYANRFISDERNSNMG
              20        30        40        50        60        70        80

594       624       654       684       714       744       774       804
       LYNILGMNKRQVARVASLELFIIYIFLISIGSLFSAFFAKFIYLIFVNIINYHALNLSLSLWPFIICIVIFTGIFLTLEV
       :|||  |:|:  ::    ||   :       ::  |    :|     :|    :|       ||         ||
       IFLMLGMGKKQLLKIIYLEKLYLFTGTFFGGLIFGFVYSKIFFLFIRNLIVIGDVREQYSLTAISWLLILTFFIYFIIYL
               100       110       120       130       140       150       160

834       864       894       924       954      1011      1041
       PVIRHVHLSSPLSLFRKKQQGEKEPKGNLILAILALVAIAIAYTMALTSGKAPALAVIY-RFFFAVLLVIAGTYLFYISF
        |  :    |    :|    |  :  |  | ::   ::  | |:  :    ||||    |  :  ||  :| ||  :   :  |
       SEYRLLKRQSITVIFNSKAKRDNPRKTSVFVGLFGLFALLMGYHFALTS---PNVTTSFSRFIYAACLVTLGIFCTFSSG
               180       190       200       210       220       230       240

1071      1101      1131      1161      1191      1221      1251      1281
       MTWYLKRLRQNKHYYYKSEHFVSTSQMIFRMKQNAVGLASITLLAVMALVTIATTVSLYSNTQNVVTGLFPKSVSLSIDN
       :    |    ::: :    ||        ||   ::    |::   ||: ||:|  :::   ||:::      |||       |:|     |: |
       WIMLLTVIKKRRAIYYNQRRFVVIASLFHRIRSNALSLATICIFSTATLVSLSVLASLYLAKDNMVRLSSPRDV------
               260       270       280       290       300       310

1311      1341      1371      1401      1431      1461
       SKGDAKNIFEEKILKKLGKSSKEAITYNQTMISMPVSQSSELNITSKNVKHVDITKTGFM--------------------
                                        |::|     :  ::|  :||   || :|        :
       ----------------------------TVLSTTDIEPNLMDIATKN--HVTLTNRQNLKVSQSVYGNIKGSHLSVDPN
                                       320       330       340       350       360

1464      1494      1524      1554      1584      1614      1641      1671
       ---------YLITQNDFRRLGHQLPKLKDNQVAYFVQKGDSRLKKINLLGNKFDVVKNLKEA-YVPETTNTYNPGLIIFA
                :|: :  |     :    :||:::: :|    |  :          | |:  || :|    ::       :  |:|
       GGMANDYQITVISLDSFNASNNTHYRLKNHEILTYVSNGAAAPSSYTTNGVKLTNVKQIKRINFIFSPLRSMQPNFFIIT
               380       390       400       410       420       430       440

1698      1728      1758      1788      1818      1842      1872      1902
       NNKQI-DNIRKAYLPYTKNINTFPKTFKAYLDLNSQEINSISKNDIIEVDG--KYVGNISTKQSFLKEGYQMFGGLLFTG
       :|::|    |  |    |    :     |     |    : :::|      |  :|      ::   |:   : :       :|||||| |
       DNREIIQTILKEELTWG--------TMAGY-HVKGKKMNQKDFYDELETTNFRQFSANVVSIRQVKSMFNALFGGLLFVG
               460       470       480       490       500       510

1932      1962      1992      2022      2052      2082      2112      2142
       FLLGISFLLGIALIVYYKQYSEGHEDKRSYRILQEVGMSKKLVKRTINSQOIMIFFFQPLVVAVIHFGVAIPMLKQMLLVF
       ::|   |  :   |:  :||:|  |||         |:   :  :::||:  |||     ||    :|      |:|:|     |
       IIFGTIFAILTAITIYYQQLSEGIRDRDDYKAMIKLGMTNKTIQDSIKVQINFVFILPIAFALLNLIFALPILYKIMTTF
               530       540       550       560       570       580       590

2172      2202      2232      2262      2292      2322      2352      2382
       GVLNSTIVYVVSGLTVLAISIIYFIIYRITSRTYYHIIER*KGLVILPILLH**KPID*KICYTK*KKEISYYFRRGYVT
       |  ::  :   |   ::     |: |   ||: || :|  :
       GFNDAGLFLRAVGTCLIVYLFFYWFICHCTSKLYYRLISKK
               610       620       630       640
```

Based on this analysis, it was predicted that these proteins and their epitopes could be useful antigens for vaccines or diagnostics.

Example 687

A DNA sequence (GBSx0729) was identified in *S. agalactiae* <SEQ ID 2117> which encodes the amino acid sequence <SEQ ID 2118>. This protein is predicted to be ABC transporter OrfX. Analysis of this protein sequence reveals the following:

Possible site: 58
>>> Seems to have no N-terminal signal sequence
----- Final Results -----
  bacterial cytoplasm --- Certainty = 0.5121 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database:

```
>GP:AAF99694 GB:AF267498 ABC transporter OrfX [Streptococcus mutans]
Identities = 118/242 (48%), Positives = 175/242 (71%), Gaps = 1/242 (0%)
Query:    5 INHLEKVFRTRFSKEETRALQDVDFKVEQGEFIAINGESGSGKTTLLNILATLEKPTNGQ   64
              ++HL+KV++T+         AL+D+ F V++GEFIAIMGESGSGK+TLLNILA ++ P++G
Sbjct:    6 VSHLKKVYKTQEGLTN-EALKDITFSVQEGEFIAIMGESGSGKSTLLNILACMDYPSSGH   64

Query:   65 VILNGEDITKIKEAKLASFRLKNLGFVFQDFNLLDTLSVRDNIYLPLVLDRKRYKEMDHR  124
             +I N   + K+K+ + A FR +++GF+FQ+FNLL+  + +DN+ +P+++   +    + R
Sbjct:   65 IIFNNYQLEKVKDEEAAVFRSRHIGFIFQNFNLLNIFNNKDNLLIPVIISGSKVNSYEKR  124

Query:  125 LSELSSHLRIDDLLDKRPFELSGGQKQRVAIARSLITNPQILLADEPTAALDYRNSEDLL  184
             L +L++ + I+ LL K P+ELSGGQ+QR+AIAR+LI NP ++LADEPT  LD + S+ +L
Sbjct:  125 LRDLAAVVGIESLLSKYPYELSGGQQQRLAIARALIMNPDLILADEPTGQLDSKTSQRIL  184

Query:  185 NLFETINLDGQTILMVTHSANAASHAKRVLFIKDGRIFHQLYRGNKNNSEFNKDISLTMS  244
             NL    IN    +TILMVTHS  AAS+A RVLFIKDG IF+QL RG K+    F   I +    +
Sbjct:  185 NLLSNINAKRKTILMVTHSPKAASYANRVLFIKDGVIFNQLVRGCKSREGFLDQIIMAQA  244

Query:  245 AI                                                          246
             ++
Sbjct:  245 SL                                                          246
```

A related DNA sequence was identified in *S. pyogenes* <SEQ ID 2119> which encodes the amino acid sequence <SEQ ID 2120>. Analysis of this protein sequence reveals the following:

---
Possible site: 45
>>> Seems to have no N-terminal signal sequence
----- Final Results -----
    bacterial cytoplasm --- Certainty = 0.2131 (Affirmative) <succ>
    bacterial membrane --- Certainty = 0.0000 (Not Clear) <succ>
    bacterial outside --- Certainty = 0.0000 (Not Clear) <succ>
---

An alignment of the GAS and GBS proteins is shown below:

```
Identities= 91/222 (40%), Positives = 142/222 (62%), Gaps = 2/222 (0%)
Query:    2 LLEINHLEKVFRTRFSKEETRALQDVDFKVEQGEFIAIMGESGSGKTTLLNILATLEKPT   61
              LL +  + K +         EE   L+ +D +V +G+F+AIMG SGSGK+TL+NI+   L+KP
Sbjct:    1 LLNLKDIRKSYH--LGTEEFAILKGIDLEVNEGDFLAIMGPSGSGKSTLMNIIGCLDKPG   58

Query:   62 NGQVILNGEDITKIKEAKLASFRLKNLGFVFQDFNLLDTLSVRDNIYLPLVLDRKRYKEM  121
             +G   + G D++ + +  +LA  R +  +GFVFQ+FNL+   L+     N+ LPL         KE
Sbjct:   59 SGSYAIEGRDVSSLSDNELADLRNQKIGFVFQNFNLMPKLTACQNVELPLTYMNVPKKER  118

Query:  122 DHRLSELSSHLRIDDLLDKRPFELSGGQKQRVAIARSLITNPQILLADEPTAALDYRNSE  181
                R  E+   + +++   + +P ELSGGQKQRVAIAR+L+TNP  +L DEPT ALD + S
Sbjct:  119 RKRALEMLKLVGLEERSEFKPMELSGGQKQRVAIARALVTNPSFILGDEPTGALDTKTSV  178

Query:  182 DLLNLFETINLDGQTILMVTHSANAASHAKRVLFIKDGRIFH                  223
             +++LF+   N +G+TI+++TH     A+  K+ + ++DG I H
Sbjct:  179 QIMDLFKQFNDNGKTIIIITHEPEVAALCKKTVILRDGNIEH                  220
```

<SEQ ID 2122>. This protein is predicted to be nisin-resistance protein. Analysis of this protein sequence reveals the following:

---
Possible site: 18
>>> Seems to have an uncleavable N-term signal seq
INTEGRAL    Likelihood = –13.16    Transmembrane 8-24 (1-31)
----- Final Results -----
    bacterial membrane --- Certainty = 0.6265 (Affirmative) <succ>
    bacterial outside --- Certainty = 0.0000 (Not Clear) <succ>
    bacterial cytoplasm --- Certainty = 0.0000 (Not Clear) <succ>
---

The protein has homology with the following sequences in the GENPEPT database:

Based on this analysis, it was predicted that these proteins and their epitopes could be useful antigens for vaccines or diagnostics.

Example 688

A DNA sequence (GBSx0730) was identified in *S. agalactiae* <SEQ ID 2121> which encodes the amino acid sequence

```
>GP:AAB08491 GB:U25181 nisin-resistance protein [Lactococcus lactis]
Identities = 108/318 (33%), Positives = 190/318 (58%), Gaps = 8/318 (2%)
Query:    3 RKIVLLFVVPMLIVLGILGVVVHYYGSALNIYLLPPSSERYGRVILDRVEQRGLYSQGRQ   62
              ++I+L V    + LGI    ++++G   NIYL+PPS ++Y RV L   +++ GL++   ++
Sbjct:    5 KRILLGLVAVCALFLGI----IYFWGYKFNIYLVPPSPQKYVRVALKNMDELGLFTDSKE   60

Query:   63 WQIIRQRSEKKLKTSKSYQESRNIVQEAVRYGGGKHSQILSKETVRRDTLDSRYPEYRRL  122
```

```
                W    ++++ ++    +K+Y E+    +Q+A++  GGKHS I  +E + + ++           +
Sbjct:   61  WVETKKKTIEETSNAKNYAETIPFLQKAIKVAGGKHSFIEHEEDISKRSITKYIKPKAEI  120

Query:  123  NEDILLITIPSISKLDKRSISHYSGKLQNILMEKSYKGLILDLSNNTGGNMIPMIGGVAS  182
                + L++TIP   + D ++ S Y+   L++     + +Y G+I+DL  N GG++ PM+ G++
Sbjct:  121  EGNTLILTIPEFTGNDSQA-SDYANFLESSFHENNYNGVIVDLRGNRGGDLSPMVLGLSP  179

Query:  183  ILPNDTLFHYTDKYGNKKTITMKNIPLEALKISRKTINTKHV---PIAIITNHKTASSAE  239
                +LP+ TLF Y DK  + K +  ++N + +    S K   + K +   PIA++ ++ T SS E
Sbjct:  180  LLPDGTLFTYVDKSSHSKPVELQNGEINSGGSSTKVSDNKKIKKAPIAVLIDNNTGSSGE  239

Query:  240  MTFLSFKGLPNVKSFGQATAGYTTVNETFMLYDGARLALTTGIVSDRQGYKYENTPILPD  299
                +T L FKG+PNVK    G   +AGYT+ N+T   LYDG+ L +T+   V DR     Y+N PI PD
Sbjct:  240  LTALCFKGIPNVKFLGSDSAGYTSANQTVYLYDGSTLQITSAFVKDRTNNIYKNFPISPD  299

Query:  300  QVTSLPLQESQSWLKSRI                                            317
                      T+        +      W+KS+I
Sbjct:  300  IQTNNAKSSAIEWIKSQI                                            317
```

No corresponding DNA sequence was identified in *S. pyogenes*.

A related GBS gene <SEQ ID 8641> and protein <SEQ ID 8642> were also identified. Analysis of this protein sequence reveals the following:

Lipop: Possible site: −1   Crend: 3
McG: Discrim Score: 12.71
GvH: Signal Score (−7.5): −5.64
Possible site: 18
>>> Seems to have an uncleavable N-term signal seq ALOM program   count: 1 value: −13.16 threshold: 0.0
INTEGRAL       Likelihood = −13.16   Transmembrane 8-24 (1-31)
PERIPHERAL     Likelihood = 4.03    174
modified ALOM score: 3.13
*** Reasoning Step: 3
----- Final Results -----
   bacterial membrane --- Certainty = 0.6265 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the databases:

```
34.7/62.5% over 311aa
Lactococcus lactis
GP|805128| nisin-resistance protein Insert characterized
ORF01108(343-1254 of 1560)
GP|805128|gb|AAB08491.1||U25181(7-318 of 318) nisin-resistance protein
{Lactococcus lactis}
% Match = 19.4
% Identity = 34.6 % Similarity = 62.4
Matches = 106 Mismatches = 112 Conservative Sub.s = 85

231       261       291       321       351       393       423
LKLSNL*EIGLKM*GYSKPFCHIIDLKRKGEQEMRRKIVLLFVVPMLIVLGILGV------VVHYYGSALNIYLLPPSSE
                :  |:||::  |         :::::|   :||||:|||  :
              MKIGKRILLGLVAVCALFLGIIYFWGYKFNIYLVPPSPQ
                10        20        30

453       483       513       543       573       603       633       663
RYGRVILDRVEQRGLYSQGRQWQIIRQRSEKKLTSKSYQESRNIVQEAVRYGGKHSQILSKETVRRDTLDSRYPEYRR
:| ||    |  :::  ||::    ::|     :::: ::     :|:| |:     :|:|::  |||||  |  :|  :   ::
KYVRVALKNMDELGLFTDSKEWVETKKKTIEETSNAKNYAETIPFLQKAIKVAGGKHSFIEHEEDISKRSITKYIKPKAE
         50        60        70        80        90       100       110

693       723       753       783       813       843       873       903
LNEDILLITIPSISKLDKRSISHYSGKLQNILMEKSYKGLILDLSNNTGGNMIPMIGGVASILPNDTLFHYTDKYGNKKT
:  :  |::|||    :    | ::  | |:   |:: : : :|   |:::|| |  ||::  ||:  |: |:::  :||  |||    ||   : |
IEGNTLILTIPEFTGNDSQA-SDYANFLESSFHKNNYNGVIVDLRGNRGGDLSPMVLGLSPLLPDGTLFTYVDKSSHSKP
        130       140       150       160       170       180       190

933       963       984      1014      1044      1074      1104      1134
ITMKNIPLEALKISRKTINTKHV---PIAIITNHKTASSAEMTFLSFKGLPNVKSFGQATAGYTTVNETFMLYDGARLAL
: ::|   :   :   |||:: ::    ||  |:   ||||:||:    |||||  |: ||||||  |  |:  |
VELQNGEINSGGSSTKVSDNKKIKKAPIAVLIDNNTGSSGELTALCFKGIPNVKFLGSDSAGYTSANQTVYLYDGSTLQI
        210       220       230       240       250       260       270

1164      1194      1224      1254      1284      1314      1344      1374
TTGIVSDRQGYKYENTPILPDQVTSLPLQESQSWLKSRINQN*GIINKGELYVIRNQSLRKSFSYTFFKRRDKGSTRRRF
|:   |  ||    |:| || ||   |:    :   |:|||:|
TSAFVKDRTNNIYKNFPISPDIQTNNAKSSAIEWIKSQIK
```

SEQ ID 2122 (GBS38) was expressed in *E. coli* as a His-fusion product. SDS-PAGE analysis of total cell extract is shown in FIG. 14 (lane 7; MW 37 kDa). It was also expressed in *E. coli* as a GST-fusion product. SDS-PAGE analysis of total cell extract is shown in FIG. 16 (lane 12; MW 62 kDa).

Based on this analysis, it was predicted that these proteins and their epitopes could be useful antigens for vaccines or diagnostics.

Example 689

A DNA sequence (GBSx0731) was identified in *S. agalactiae* <SEQ ID 2123> which encodes the amino acid sequence <SEQ ID 2124>. Analysis of this protein sequence reveals the following:

```
Possible site: 20
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>
```

The protein has no significant homology with any sequences in the GENPEPT database.

A related DNA sequence was identified in *S. pyogenes* <SEQ ID 2125> which encodes the amino acid sequence <SEQ ID 2126>. Analysis of this protein sequence reveals the following:

```
Possible site: 17
>>> Seems to have no N-terminal signal sequence
----- Final Results -----
    bacterial cytoplasm --- Certainty = 0.1369 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below:

```
Identities = 31/49 (63%), Positives = 43/49 (87%)
Query:  6 KKLTKSLGPIGKLISIIPDTTELIGKAIDNSRPIIEKELDRRHEKKTDL  54
          K++ K+LG +GKL+SI+PDTTE+IGK IDNSRPIIEK ++++HEK+  L
Sbjct:  3 KRIRKALGVVGKLMSIVPDTTEIIGKTIDNSRPIIEKRMEQKHEKEMQL  51
```

Based on this analysis, it was predicted that these proteins and their epitopes could be useful antigens for vaccines or diagnostics.

Example 690

A DNA sequence (GBSx0732) was identified in *S. agalactiae* <SEQ ID 2127> which encodes the amino acid sequence <SEQ ID 2128>. Analysis of this protein sequence reveals the following:

```
Possible site: 54
>>> Seems to have no N-terminal signal sequence
----- Final Results -----
    bacterial cytoplasm --- Certainty = 0.3644 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database, but there is homology to SEQ ID 2126.

Based on this analysis, it was predicted that this protein and its epitopes, could be useful antigens for vaccines or diagnostics.

Example 691

A DNA sequence (GBSx0733) was identified in *S. agalactiae* <SEQ ID 2129> which encodes the amino acid sequence <SEQ ID 2130>. This protein is predicted to be 28 kd outer membrane protein precursor (yaeC). Analysis of this protein sequence reveals the following:

```
Possible site: 16
>>> May be a lipoprotein
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database:

```
>GP:CAB59827 GB:AJ012388 hypothetical protein [Lactococcus lactis]
Identities = 123/290 (42%), Positives = 178/290 (60%), Gaps = 18/290 (6%)
Query:   1 MKIKKLLGLTTTVVISALILGAC------GQSKNEDAKVVRVGTMVKSKTEKARWDKIEE   54
           +K +++L +T  +++  +I+G        G      +K+V++G M   K E    W ++++
Sbjct:   3 VKNRRIL-ITIIILVFIIIVGGIFAFSHSGNKSKVSSKIVKIGLMPGGKQEDVIWKQVQK   61

Query:  55 LVKKK-GVKLKFTEFTDYTQPNKALESDEIDINAFQHYNYLNNWNKANKTNLVSVAETYF  113
           K + G+ LKF FTD +PNKAL  E+D+NAFQHY YL +WNKAN  N+VS+ +T
Sbjct:  62 NAKDQFGITLKFVNFTDGDEPNKALVNHEVDLNAFQHYAYLKSWNKANNGNIVSIGDTII  121
```

-continued

```
Query:  114  TSFRLYSGTKNGKGKYQTVSEIPNKATITIPNDAVNESRSLYLLQSAGLLKLKVSGDALA  173
             T   LYS       KY+ V EIP+K+TI IPND  NESR+LY+L++AGL+KL   S    LA
Sbjct:  122  TPIHLYST------KYKKVDEIPDKSTIAIPNDITNESRALYVLKNAGLIKLDTSRGVLA  175

Query:  174  TMSDVVSNPKSLDLKEVDAAQTARSLDSTDAAVINNDFVTEAGINPKSAIFIEPKSKNAK  233
             T+ D+  NPKSL +KE+DA+QT R+LDS  AAVIN +F  A  + K +I+ EP ++++
Sbjct:  176  TVKDIRENPKSLIIKEIDASQTPRALDSVAAAVINYNFAISAKNSDKESIYQEPLNEDSA  235

Query:  234  QWYNLLVAQKGWQDKSKAKAIKEVVKAYHTDAVKKVIEKT-SQGLDQPVW            282
             QW N + A   Q    K KEVVKAY    +  +I+K    G + P W
Sbjct:  236  QWINFIAAN---QSDKNNKVYKEVVKAYEQKNIADIIKKEYPDGGELPAW            282
```

A related DNA sequence was identified in *S. pyogenes* <SEQ ID 2131> which encodes the amino acid sequence <SEQ ID 2132>. Analysis of this protein sequence reveals the following:

Possible site: 24
>>> Seems to have no N-terminal signal sequence
----- Final Results -----
   bacterial cytoplasm --- Certainty = 0.1766 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below:

```
Identities = 145/264 (54%), Positives = 203/264 (75%), Gaps = 2/264 (0%)
Query:   20  LGACGQSKNEDAKVVRVGTMVKSKTEKARWDKIEELVKKKGVKLKFTEFTDYTQPNKALE   79
             L AC + K +D   + +G M K+++++ARWDK+EEL+KK + LK+  EFTDY+QPNKA+
Sbjct:    1  LVACSE-KQDDKNTLTIGVMTKTESDQARWDKVEELLKKDNITLKYKEFTDYSQPNKAVA   59

Query:   80  SDEIDINAFQHYNYLMNWNKANKTNLVSVAETYFTSFRLYSGT-KNGKGKYQTVSEIPNK  138
             + E+DINAFQHYN+LNNWNK NK +LV++A+TY +    L+SGT ++GK KY+V+++PN
Sbjct:   60  NGEVDINAFQHYNFLYNKNENKEHLVAIADTYISPINLFSGTSQDGKAKYKSVADLPNG  119

Query:  139  ATITIPNDAVNESRSLYLLQSAGLLKLKVSGDALATMSDVVSNPKSLDLKEVDAAQTARS  198
               I +PNDA NESR+LY+LQSAGL+KL VSGD LAT++++   N K LD+KE+DA+QTAR+
Sbjct:  120  TQIAVPNDATNESRALYVLQSAGLIKLNVSGDQLATIANISENKKKLDIKELDASQTARA  179

Query:  199  LDSTDAAVINNDFVTEAGINPKSAIFIEPKSKNAKQWYNLLVAQKGWQDKSKAKAIKEVV  258
             L S DAAV+NN +   A I+ K+++F E    N+KQW N++  QK W+    KA AIK+++
Sbjct:  180  LVSADAAVNNSYAVPAKIDYKTSLFKEKADDNSKQWINIIAGQKDWEKSEKADAIKKLI  239

Query:  259  KAYHTDAVKKVIEKTSQGLDQPVW                                     282
             KAY TD VKKV+EKTS G+D  VW
Sbjct:  240  KAYQTDEVKKVVEKTSNGIDVSVW                                     263
```

SEQ ID 2130 (GBS96) was expressed in *E. coli* as a His-fusion product. SDS-PAGE analysis of total cell extract is shown in FIG. 19 (lane 7; MW 32 kDa). It was also expressed in *E. coli* as a GST-fusion product. SDS-PAGE analysis of total cell extract is shown in FIG. 22 (lane 3; MW 57.2 kDa).

Figure 290:
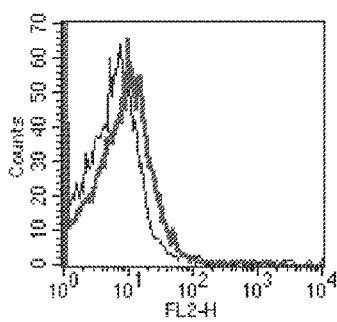

The GBS96-GST fusion product was purified (FIG. 195, lane 10) and used to immunise mice. The resulting antiserum was used for FACS (FIG. 290), which confirmed that the protein is immunoaccessible on GBS bacteria.

Based on this analysis, it was predicted that these proteins and their epitopes could be useful antigens for vaccines or diagnostics.

Example 692

A DNA sequence (GBSx0734) was identified in *S. agalactiae* <SEQ ID 2133> which encodes the amino acid sequence <SEQ ID 2134>. Analysis of this protein sequence reveals the following:

Possible site: 61
>>> Seems to have no N-terminal signal sequence
----- Final Results -----
   bacterial cytoplasm --- Certainty = 0.5103 (Affirmative) <succ>
   bacterial membrane --- Certainty = 0.0000 (Not Clear) <succ>
   bacterial outside --- Certainty = 0.0000 (Not Clear) <succ>

A related GBS nucleic acid sequence <SEQ ID 9807> which encodes amino acid sequence <SEQ ID 9808> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

Example 693

A DNA sequence (GBSx0735) was identified in *S. agalactiae* <SEQ ID 2135> which encodes the amino acid sequence <SEQ ID 2136>. This protein is predicted to be glucose-inhibited division protein (gid). Analysis of this protein sequence reveals the following:

Possible site: 18
>>> Seems to have no N-terminal signal sequence
----- Final Results -----
   bacterial cytoplasm --- Certainty = 0.0656 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database:

```
>GP:CAB13486 GB:Z99112 glucose-inhibited division protein [Bacillus subtilis]
Identities = 289/439 (65%), Positives = 352/439 (79%), Gaps = 10/439 (2%)
Query:   1  MSQSYINVIGAGLAGSEAAYQTAKRGIPVKLYEMRGVKSTPQHKTDNFAELVCSNSFRGD    60
            M+Q  +NVIGAGLAGSEAA+Q+AKRGI VKLYEMR VK TP H TD FAELVCSNS R +
Sbjct:   1  MNQQTVNVIGAGLAGSEAAWQLAKRGIQVKLYEMRPVKQTPAHHTDKFAELVCSNSLRSN    60

Query:  61  SLTNAVGLLKEEMRRLDSIIMRNGEAHRVPAGGAMAVDREGYSEAVTEEIHKHPLIEVIR   120
            +L NAVG+LKEEMR LDS I+   +   VPAGGA+AVDR ++ +VT +  HP + VI
Sbjct:  61  TLANAVGVLKEEMRALDSAIIAAADECSVPAGGALAVDRHEFAASVTNRVKNHPNVTVIN   120

Query: 121  DEITDIPGDAITVIATGPLTSDSLAAKIHELNGGDGFYFYDAAAPIVDKNTIDINKVYLK   180
            +E+T+IP +  T+IATGPLTS+SL+A++ EL G D  YFYDAAAPIV+K+++D++KVYLK
Sbjct: 121  EEVTEIP-EGPTIIATGPLTSESLSAQLKELTGEDYLYFYDAAAPIVEKDSLDMDKVYLK   179

Query: 181  SRYDKGEAAYLNCPMTKEEFMAFHEALTTAEEAPLNSFEKEKYFEGCMPIEVMAKRGIKT   240
            SRYDKGEAAYLNCPMT+EEF  FHEALT+AE  PL  FEKE +FEGCMPIEVMAKRG KT
Sbjct: 180  SRYDKGEAAYLNCPMTEEEFDRFHEALTSAETVPLKEFEKEIFFEGCMPIEVMAKRGKKT   239

Query: 241  MLYGPMKPVGLEYPEDYKGPRDGEFKTPYAVVQLRQDNAAGSLYNIVGFQTHLKWGEQKR   300
            ML+GPMKPVGLE+P   K         PYAVVQLRQD+AAG+LYNIVGFQTHLKWG+QK
Sbjct: 240  MLFGPMKPVGLEHPVTGK--------RPYAVVQLRQDDAAGTLYNIVGFQTHLKWGDQKE   291

Query: 301  VFQMIPGLENAEFVRYGVMHRNSYMDSPNLLNQTFATRKNPNLFFAGQMTGVEGYVESAA   360
            V ++IPGLEN E VRYGVMHRN++++SP+LL  T+ +     +LFFAGQMTGVEGYVESAA
Sbjct: 292  VLKLIPGLENVEIVRYGVMHRNTFINSPSLLKPTYQFKNRSDLFFAGQMTGVEGYVESAA   351

Query: 361  SGLVAGINAVRRFNGESEVVFPQTTAIGALPHYITHTDSKHFQPMNVNFGIIKELEGPRI   420
            SGLVAGINA +    GE  V+FPQ TAIG++ HYIT T+ K+FQPMN NFG++KEL   +I
Sbjct: 352  SGLVAGINAAKLVLGEELVIFPQETAIGSMAHYITTTNQKNFQPMNANFGLLKELP-VKI   410

Query: 421  RDKKERYEAIATRALKDLE                                          439
            ++KKER E  A RA++ ++
Sbjct: 411  KNKKERNEQYANRAIETIQ                                          429
```

A related DNA sequence was identified in *S. pyogenes* <SEQ ID 2137> which encodes the amino acid sequence <SEQ ID 2138>. Analysis of this protein sequence reveals the following:

Possible site: 30
>>> Seems to have an uncleavable N-term signal seq
INTEGRAL    Likelihood = –8.44    Transmembrane 12-28 (9-32)
----- Final Results -----
bacterial membrane --- Certainty = 0.4376 (Affirmative) <succ>

-continued bacterial outside --- Certainty = 0.0000 (Not Clear) <succ>
bacterial cytoplasm --- Certainty = 0.0000 (Not Clear) <succ>

RGD motif: 111-113

The protein has homology with the following sequences in the databases:

```
>GP:CAB13486 GB:Z99112 glucose-inhibited division protein [Bacillus subtilis]
Identities = 292/435 (67%), Positives = 350/435 (80%), Gaps = 10/435 (2%)
Query:  59  INVIGAGLAGSEAAYQIAERGIPVKLYEMRGVKATPQHKTTNFAELVCSNSFRGDSLTNA   118
            +NVIGAGLAGSEAA+Q+A+RGI VKLYEMR VK TP H T  FAELVCSNS R ++L NA
Sbjct:   6  VNVIGAGLAGSEAAWQLAKRGIQVKLYEMRPVKQTPAHHTDKFAELVCSNSLRSNTLANA    65

Query: 119  VGLLKEEMRRLDSIIMRNGEANRVPAGGAMAVDREGYAESVTAELENHPLIEVIRGEITE   178
            VG+LKEEMR LDS I+   +   VPAGGA+AVDR  +A  SVT ++NHP + VI  E+TE
Sbjct:  66  VGVLKEEMRALDSAIIAAADECSVPAGGALAVDRHEFAASVTNRVKNHPNVTVINEEVTE   125

Query: 179  IPDDAITVIATGPLTSDALAEKIHALNGGDGFYFYDAAAPIIDKSTIDMSKVYLKSRYDK   238
            IP+   T+IATGPLTS++L+ ++   L G D  YFYDAAAPI++K ++DM KVYLKSRYDK
Sbjct: 126  IPEGP-TIIATGPLTSESLSAQLKELTGEDYLYFYDAAAPIVEKDSLDMDKVYLKSRYDK   184

Query: 239  GEAAYLNCPMTKEEFMAFHEALTTAEEAPLNAFEKEKYFEGCMPIEVMAKRGIKTMLYGP   298
            GEAAYLNCPMT+EEF  FHEALT+AE  PL  FEKE +FEGCMPIEVMAKRG KTML+GP
Sbjct: 185  GEAAYLNCPMTEEEFDREHEALTSAETVPLKEFEKEIFFEGCMPIEVMAKRGKKTMLFGP   244

Query: 299  MKPVGLEYPDDYTGPRDGEFKTPYAVVQLRQDNAAGSLYNIVGFQTHLKWGEQKRVFQMI   358
            MKPVGLE+P   TG R         PYAVVQLRQD+AAG+LYNIVGFQTHLKWG+QK V ++I
Sbjct: 245  MKPVGLEHP--VTGKR------PYAVVQLRQDDAAGTLYNIVGFQTHLKWGDQKEVLKLI   296

Query: 359  PGLENAEFVRYGVMHRNSYMDSPNLLTETFQSRSNPNLFFAGQMTGVEGYVESAASGLVA   418
            PGLEN E VRYGVMHRN++++SP+LL  T+Q ++  +LFFAGQMTGVEGYVESAASGLVA
Sbjct: 297  PGLENVEIVRYGVMHRNTFINSPSLLKPTYQFKNRSDLFFAGQMTGVEGYVESAASGLVA   356
```

```
-continued
Query: 419  GINAARLFKREEALIFPQTTAIGSLPHYVTHADSKHFQPMNVNEGIIKELEGPRIRDKRE    478
            GINAA+L    EE +IFPQ TAIGS+ HY+T  + K+FQPMN NFG++KEL    +I++KKE
Sbjct: 357  GINAAKLVLGEELVIFPQETAIGSMAHYITTTNQKNFQPMNANFGLLKELP-VKIKNKKE    415

Query: 479  RYEAIASRALADLDT                                                493
            R E  A+RA+  + T
Sbjct: 416  RNEQYANRAIETIQT                                                430
```

An alignment of the GAS and GBS proteins is shown below:

```
Identities = 395/439 (89%), Positives = 417/439 (94%)
Query:   4  SYINVIGAGLAGSEAAYQIAKRGIPVKLYEMRGVKSTPQHKTDNFAELVCSNSFRGDSLT    63
            +YINVIGAGLAGSEAAYQIAKRGIPVKLYEMRGVK+TPQHKT NFAELVCSNSFRGDSLT
Sbjct:  57  TYINVIGAGLAGSEAAYQIAKRGIPVKLYEMRGVKATPQHKTINFAELVCSNSFRGDSLT   116

Query:  64  NAVGLLKEEMRRLDSIIMRNGEAHRVPAGGAMAVDREGYSEAVTEEIHKHPLIEVIRDEI   123
            NAVGLLKEEMRRLDSIIMRNGEA+RVPAGGAMAVDREGY+E+VT E+  HPLIEVIR EI
Sbjct: 117  NAVGLLKEEMRRLDSIIMRNGEANRVPAGGAMAVDREGYAESVTAELENHPLIEVIRGEI   176

Query: 124  TDIPGDAITVIATGPLTSDSLAAKIHELNGGDGFYFYDAAAPIVDKNTIDINKVYLKSRY   183
            T+IP DAITVIATGPLTSD+LA KIH LNGGDGFYFYDAAAPI+DK+TID++KVYLKSRY
Sbjct: 177  TEIPDDAITVIATGPLTSDALAEKIHALNGGDGFYFYDAAAPIIDKSTIDMSKVYLKSRY   236

Query: 184  DKGEAAYLNCPMTKEEFMAFHEALTTAEEAPLNSFEKEKYFEGCMPIEVMAKRGIKTMLY   243
            DKGEAAYLNCPMTKEEFMAFHEALTTAEEAPLN+FEKEKYFEGCMPIEVMAKRGIKTMLY
Sbjct: 237  DKGEAAYLNCPMTKEEFMAFHEALTTAEEAPLNAFEKEKYFEGCMPIEVMAKRGIKTMLY   296

Query: 244  GPMKPVGLEYPEDYKGPRDGEFKTPYAVVQLRQDNAAGSLYNIVGFQTHLKWGEQKRVFQ   303
            GPMKPVGLEYP+DY GPRDGEFKTPYAVVQLRQDNAAGSLYNIVGFQTHLKWGEQKRVFQ
Sbjct: 297  GPMKPVGLEYPDDYTGPRDGEFKTPYAVVQLRQDNAAGSLYNIVGFQTHLKWGEQKRVFQ   356

Query: 304  MIPGLENAEFVRYGVMHRNSYMDSPNLLNQTFATRKNPNLFFAGQMTGVEGYVESAASGL   363
            MIPGLENAEFVRYGVMHRNSYMDSPNLL +TF +R NPNLFFAGQMTGVEGYVESAASGL
Sbjct: 357  MIPGLENAEFVRYGVMHRNSYMDSPNLLTETFQSRSNPNLFFAGQMTGVEGYVESAASGL   416

Query: 364  VAGINAVRRFNGESEVVFPQTTAIGALPHYITHTDSKHFQPMNVNEGIIKELEGPRIRDK   423
            VAGINA R F  E  ++FPQTTAIG+LPHY+TH DSKHFQPMNVNFGIIKELEGPRIRDK
Sbjct: 417  VAGINAARLFKREEALIPQTTAIGSLPHYVTHADSKHFQPMNVNEGIIKELEGPRIRDK   476

Query: 424  KERYEAIATRALKDLEKFL                                            442
            KERYEAIA+RAL DL+  L
Sbjct: 477  KERYEAIASRALADLDTCL                                            495
```

Based on this analysis, it was predicted that these proteins and their epitopes could be useful antigens for vaccines or diagnostics.

Example 694

A DNA sequence (GBSx0736) was identified in *S. agalactiae* <SEQ ID 2139> which encodes the amino acid sequence <SEQ ID 2140>. This protein is predicted to be transcriptional regulator (GntRfamily). Analysis of this protein sequence reveals the following:

Possible site: 13
>>> Seems to have no N-terminal signal sequence

-continued

----- Final Results -----
bacterial cytoplasm --- Certainty = 0.5103 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database:

```
>GP:BAB04138 GB:AP001508 transcriptional regulator (GntR family)
[Bacillus halodurans]
Identities = 83/229 (36%), Positives = 133/229 (57%), Gaps = 1/229 (0%)
Query:   2  LPAYIKIHDAIKKEIDKGTWKIGQRLPSERDLADDYSVSRMTLRQSITLLVEEGILERRV    61
            LP Y +I + IK++I+ G  K G  L SER+ A+ Y VSRMT+RQ+I  LV +G + ++
Sbjct:   8  LPIYYQIEEQIKQQIESGVLKPGDMLKSEREYAEYYDVSRMTVRQAINNLVNQGYIYKKK    67

Query:  62  GSGTYVASHRVQEKMRGTTSFTEIVNSQGRKPSSKLISFQRKLANETEIQKLNLSQSDYV   121
            GSGTYV  ++++ + G TSFTE +  +G +PSS+L+ F+    A      ++LNL ++  V
Sbjct:  68  GSGTYVQEKKIEQALNGLTSFTEDMRKRGMEPSSRLLKFELIPATAKIAKELNLKENTPV   127
```

-continued

```
Query: 122  VRMERVRYADKVPLVYEVASIPENLIKGFEQSEVTEHFFKTLTEN-GYEIGKSQQTIYAR  180
            ++R+RY D VP+  E    +P NL+KG  +  + + ++   + E      I  + Q I  A
Sbjct: 128  TEIKRIRYGDGVPIAIERNLLPANLVKGLNEEIINQSLYQYIEEELNLRIADALQVIEAS  187

Query: 181  NASERVASHLEVNAGHAILALTQVSYFTDGKPFEYVHGQYVGDRFEFYL             229
            AS+   A  LE+   G   IL + +  ++   DG     E V    Y    DR++F   +
Sbjct: 188  TASKTEADLLEIQKGSPILLIERKTFLADGTVLELVKSAYRADRYKFMI             236
```

There is also homology to SEQ ID 1256.

Based on this analysis, it was predicted that this protein and its epitopes, could be useful antigens for vaccines or diagnostics.

Example 695

A DNA sequence (GBSx0737) was identified in *S. agalactiae* <SEQ ID 2141> which encodes the amino acid sequence <SEQ ID 2142>. This protein is predicted to be GMP synthase (guaA). Analysis of this protein sequence reveals the following:

---
Possible site: 46
>>> Seems to have no N-terminal signal sequence
INTEGRAL     Likelihood = –0.96    Transmembrane 228-244 (228-245)
----- Final Results -----
   bacterial membrane --- Certainty = 0.1383 (Affirmative) <succ>
      bacterial outside --- Certainty = 0.0000 (Not Clear) <succ>
         bacterial cytoplasm --- Certainty = 0.0000 (Not Clear) <succ>
---

The protein has homology with the following sequences in the GENPEPT database:

A related DNA sequence was identified in *S. pyogenes* <SEQ ID 2143> which encodes the amino acid sequence <SEQ ID 2144>. Analysis of this protein sequence reveals the following:

---
Possible site: 46
>>> Seems to have no N-terminal signal sequence
INTEGRAL     Likelihood = –0.96    Transmembrane 228-244 (228-245)
----- Final Results -----
   bacterial membrane --- Certainty = 0.1383 (Affirmative) <succ>
      bacterial outside --- Certainty = 0.0000 (Not Clear) <succ>
         bacterial cytoplasm --- Certainty = 0.0000 (Not Clear) <succ>
---

RGD motif: 203-205

The protein has homology with the following sequences in the databases:

```
>GP:AAD15805 GB:AF058326 GMP synthase [Lactococcus lactis]
Identities = 416/511 (81%), Positives = 467/511 (90%), Gaps = 3/511 (0%)
Query:  10  IQKIIVLDYGSQYNQLIARRIREFGVFSELKSHKITADEIRDINPIGIVLSGGPNSVYAD   69
            ++KIIVLDYGSQYNQLIARRIRE GVFSEL SHK+TA EIR+INPIGI+LSGGPNSVY +
Sbjct:   6  LEKIIVLDYGSQYNQLIARRIREIGVFSELMSHKVTAKEIREINPIGIILSGGPNSVYDE   65

Query:  70  GAFGIDEEIFELGIPILGICYGMQLITHKLGGKVLPAGEAGHREYGQSALRLRSESALFA  129
            G+F ID EIFELG+P+LGICYGMQL+++KLGG V  AGE    REYG + L+L   +SALFA
Sbjct:  66  GSFDIDPEIFELGLPVLGICYGMQLMSYKLGGMVEAAGE---REYGVAPLQLTEKSALFA  122

Query: 130  GTPQEQLVLMSHGDAVTEIPEGFHLVGDSVDCPFAAMENTEKQFYGIQFHPEVRHSVYGN  189
            GTP+  Q VLMSHGD VT IPEGFH+VG S + PFAA+ENTE+   YGIQFHPEVRHSV+G
Sbjct: 123  GTPEVQDVLMSHGDRVTAIPEGFHVVGTSPNSPFAAVENTERNLYGIQFHPEVRHSVHGT  182

Query: 190  DILKNFAVNICGARGDWSMDNFIDMEIAKIRETVGDRKVLLGLSGGVDSSVVGVLLQRAI  249
            ++L+NFA+NICGA+G+WSM+NFIDM+I   IRE VGD+KVLLGLSGGVDSSVVGVLLQRAI
Sbjct: 183  EMLRNFALNICGAKGNWSMENFIDMQIKDIREKVGDKKVLLGLSGGVDSSVVGVLLQRAI  242

Query: 250  GDQLTCIFVDHGLLRKNEGDQVMDMLGGKFGLNIIRVDASKRELDLLSGVEDPERKRKII  309
            GDQLT IFVDHG LRK E DQVM+ LGGKFGLNII+VDA KRF+D L G+ DPE +RKII
Sbjct: 243  GDQLTSIFVDHGFLRKGEADQVMETLGGKFGLNIIKVDAQKRFMDKLVGLSDPETQRKII  302

Query: 310  GNEFVYVEDDEASKLKGVDFLAQGTLYTDIIESGTETAQTIKSHHNVGGLPEDMQFELIE  369
            GNEFVYVFDDEA+KL+GVDFLAQGTLYTD+IESGT+TAQTIKSHHNVGGLPEDMQF+LIE
Sbjct: 303  GNEFVYVEDDEANKLEGVDFLAQGTLYTDVIESGTDTAQTIKSHHNVGGLPEDMQFQLIE  362

Query: 370  PLNTLFKDEVRALGTALGMPDEVVWRQPFPGPGLAIRVMGEITEEKLETVRESDAILREE  429
            PLNTLFKDEVRALGT LGMPDE+VWRQPFPGPGLAIRV+G++TEEKLETVRESDAILREE
Sbjct: 363  PLNTLFKDEVRALGTQLGMPDEIVWRQPFPGPGLAIRVLGDLTEEKLETVRESDAILREE  422

Query: 430  IAKAGLDRDVWQYFTVNTGVRSVGVMGDGRTYDYTIAIRAITSIDGMTADFAQLPWDVLK  489
            IA +GL+RDVWQYFTVNT V+SVGVMGD RTYDYT+AIRAITSIDGMTADFAQLPWD+L+
Sbjct: 423  IAASGLERDVWQYFTVNTDVKSVGVMGDQRTYDYTLAIRAITSIDGMTADFAQLPWDLLQ  482

Query: 490  KISTRIVNEVDHVNRIVYDITSKPPATVEWE                              520
            KIS RIVNEVDHVNRIVYDITSKPPATVEW+
Sbjct: 483  KISKRIVNEVDHVNRIVYDITSKPPATVEWQ                              513
```

```
>GP:AAD15805 GB:AF058326 GMP synthase [Lactococcus lactis]
Identities = 411/511 (80%), Positives = 464/511 (90%), Gaps = 3/511 (0%)
Query:    10 VQKIIVLDYGSQYNQLIARRIREFGVFSELKSHKITAQELREINPIGIVLSGGPNSVYAD     69
             ++KIIVLDYGSQYNQLIARRIRE GVFSEL SHK+TA+E+REINPIGI+LSGGPNSVY +
Sbjct:     6 LEKIIVLDYGSQYNQLIARRIREIGVFSELMSHKVTAKEIREINPIGIILSGGPNSVYDE     65

Query:    70 NAFGIDPEIFELGIPILGICYGMQLITHKLGGKVVPAGQAGNREYGQSTLHLRETSKLFS    129
             +F  IDPEIFELG+P+LGICYGMQL+++KLGG V  AG+    REYG + L  E S LF+
Sbjct:    66 GSFDIDPEIFELGLPVLGICYGMQLMSYKLGGMVEAAGE---REYGVAPLQLTEKSALFA    122

Query:   130 GTPQEQLVLMSHGDAVTEIPEGFHLVGDSNDCPYAAIENTEKNLYGIQFHPEVRHSVYGN    189
             GTP+ Q VLMSHGD VT IPEGFH+VG S + P+AA+ENTE+NLYGIQFHPEVRHSV+G
Sbjct:   123 GTPEVQDVLMSHGDRVTAIPEGFHVVGTSPNSPFAAVENTERNLYGIQFHPEVRHSVHGT    182

Query:   190 DILKNFAISICGARGDWSMDNFIDMEIAKIRETVGDRKVLLGLSGGVDSSVVGVLLQKAI    249
             ++L+NFA++ICGA+G+WSM+NFIDM+I  IRE VGD+KVLLGLSGGVDSSVVGVLLQ+AI
Sbjct:   183 EMLANFALNICGAKGNWSMENFIDMQIKDIREKVGDKKVLLGLSGGVDSSVVGVLLQRAI    242

Query:   250 GDQLTCIFVDHGLLRKDEGDQVMGMLGGKEGLNIIRVDASKRELDLLADVEDPEKKRKII    309
             GDQLT IFVDHG LRK E DQVM LGGKFGLNII+VDA KRF+D L  + DPE +RKII
Sbjct:   243 GDQLTSIFVDHGELRKGEADQVMETLGGKEGLNIIKVDAQKREMDKLVGLSDPETQRKII    302

Query:   310 GNEFVYVFDDEASKLKGVDFLAQGTLYTDIIESGTETAQTIKSHHNVGGLPEDMQFELIE    369
             GNEFVYVEDDEA+KL+GVDFLAQGTLYTD+IESGT+TAQTIKSHHNVGGLPEDMQF+LIE
Sbjct:   303 GNEFVYVEDDEANKLEGVDFLAQGTLYTDVIESGTDTAQTIKSHHNVGGLPEDMQFQLIE    362

Query:   370 PLNTLFKDEVRALGIALGMPEEIVWRQPFPGPGLAIRVMGAITEEKLETVRESDAILREE    429
             PLNTLFKDEVRALG  LGMP+EIVWRQPFPGPGLAIRV+G +TEEKLETVRESDAILREE
Sbjct:   363 PLNTLFKDEVRALGTQLGMPDEIVWRQPFPGPGLAIRVLGDLTEEKLETVRESDAILREE    422

Query:   430 IAKAGLDRDVWQYFTVNTGVRSVGVMGDGRTYDYTIAIRAITSIDGMTADFAQLPWDVLK    489
             IA +GL+RDVWQYFTVNT V+SVGVMGD RTYDYT+AIRAITSIDGMTADFAQLPWD+L+
Sbjct:   423 IAASGLERDVWQYFTVNTDVKSVGVMGDQRTYDYTLAIRAITSIDGMTADFAQLPWDLLQ    482

Query:   490 KISTRIVNEVDHVNRIVYDITSKPPATVEWEWE                             520
             KIS RIVNEVDHVNRIVYDITSKPPATVEW+
Sbjct:   483 KISKRIVNEVDHVNRIVYDITSKPPATVEWQ                               513
```

An alignment of the GAS and GBS proteins is shown below:

```
Identities = 487/520 (93%), Positives = 505/520 (96%)
Query:     1 MTDISILNDIQKIIVLDYGSQYNQLIARRIREFGVESELKSHKITADEIRDINPIGIVLS     60
             MT+ISILND+QKIIVLDYGSQYNQLIARRIREFGVESELKSHKITA E+R+INPIGIVLS
Sbjct:     1 MTEISILNDVQKIIVLDYGSQYNQLIARRIREFGVFSELKSHKITAQELREINPIGIVLS     60

Query:    61 GGPNSVYADGAFGIDEEIFELGIPILGICYGMQLITHKLGGKVLPAGEAGHREYGQSALR    120
             GGPNSVYAD AFGID EIFELGIPILGICYGMQLITHKLGGKV+PAG AG+REYGQS L
Sbjct:    61 GGPNSVYADNAFGIDPEIFELGIPILGICYGMQLITHKLGGKVVPAGQAGNREYGQSTLH    120

Query:   121 LRSESALFAGTPQEQLVLMSHGDAVTEIPEGFHLVGDSVDCPFAAMENTEKQFYGIQFHP    180
             LR  S LF+GTPQEQLVLMSHGDAVTEIPEGFHLVGDS DCP+AA+ENTEK  YGIQFHP
Sbjct:   121 LRETSKLFSGTPQEQLVLMSHGDAVTEIPEGFHLVGDSNDCPYAAIENTEKNLYGIQFHP    180

Query:   181 EVRHSVYGNDILKNFAVNICGARGDWSMDNFIDMEIAKIRETVGDRKVLLGLSGGVDSSV    240
             EVRHSVYGNDILKNFA++ICGARGDWSMDNFIDMEIAKIRETVGDRKVLLGLSGGVDSSV
Sbjct:   181 EVRHSVYGNDILKNFAISICGARGDWSMDNFIDMEIAKIRETVGDRKVLLGLSGGVDSSV    240

Query:   241 VGVLLQRAIGDQLTCIFVDHGLLRKNEGDQVMDMLGGKFGLNIIRVDASKRFLDLLSGVE    300
             VGVLLQ+AIGDQLTCIFVDHGLLRK+EGDQVM MLGGKFGLNIIRVDASKRFLDLL+ VE
Sbjct:   241 VGVLLQKAIGDQLTCIFVDHGLLRKDEGDQVMGMLGGKFGLNIIRVDASKRFLDLLADVE    300

Query:   301 DPERKRKIIGNEFVYVFDDEASKLKGVDFLAQGTLYTDIIESGTETAQTIKSHHNVGGLP    360
             DPE+KRKIIGNEFVYV DDEASKLKGVDFLAQGTLYTDIIESGTETAQTIKSHHNVGGLP
Sbjct:   301 DPEKKRKIIGNEFVYVEDDEASKLKGVDFLAQGTLYTDIIESGTETAQTIKSHHNVGGLP    360

Query:   361 EDMQFELIEPLNTLFKDEVRALGTALGMPDEVVWRQPFPGPGLAIRVMGEITEEKLETVR    420
             EDMQFELIEPLNTLFKDEVRALG ALGMP+E+VWRQPFPGPGLAIRVMG ITEEKLETVR
Sbjct:   361 EDMQFELIEPLNTLFKDEVRALGIALGMPEEIVWRQPFPGPGLAIRVMGAITEEKLETVR    420

Query:   421 ESDAILREEIAKAGLDRDVWQYFTVNTGVRSVGVMGDGRTYDYTIAIRAITSIDGMTADF    480
             ESDAILREEIAKAGLDRDVWQYFTVNTGVRSVGVMGDGRTYDYTIAIRAITSIDGMTADF
Sbjct:   421 ESDAILREEIAKAGLDRDVWQYFTVNTGVRSVGVMGDGRTYDYTIAIRAITSIDGMTADF    480

Query:   481 AQLPWDVLKKISTRIVNEVDHVNRIVYDITSKPPATVEWE                      520
             AQLPWDVLKKISTRIVNEVDHVNRIVYDITSKPPATVEWE
Sbjct:   481 AQLPWDVLKKISTRIVNEVDHVNRIVYDITSKPPATVEWE                      520
```

Example 696

A DNA sequence (GBSx0740) was identified in *S. agalactiae* <SEQ ID 2145> which encodes the amino acid sequence <SEQ ID 2146>. This protein is predicted to be branched chain amino acid ABC transporter, periplasmic amino acid-bind. Analysis of this protein sequence reveals the following:

```
Possible site: 58
>>> Seems to have no N-terminal signal sequence
----- Final Results -----
    bacterial cytoplasm --- Certainty = 0.0957 (Affirmative) <succ>
       bacterial membrane --- Certainty = 0.0000 (Not Clear) <succ>
         bacterial outside --- Certainty = 0.0000 (Not Clear) <succ>
```

A related GBS nucleic acid sequence <SEQ ID 9409> which encodes amino acid sequence <SEQ ID 9410> was also identified.

The protein has homology with the following sequences in the GENPEPT database:

```
>GP:AAD36211 GB:AE001771 branched chain amino acid ABC transporter,
periplasmic amino acid-binding protein [Thermotoga maritima]
Identities = 31/92 (33%), Positives = 51/92 (54%), Gaps = 4/92 (4%)
Query:  26  AKAFHDHYVKAYGEEPSMFSALSYDAVYMAAKSAKGAKTSID---IKKALAKLKDFKGVT      82
            AK F + Y + YG+EP+  +AL YDA YM     A     S D   I + + K ++F G +
Sbjct: 275  AKKFVEVYKEKYGKEPAALNALGYDA-YMVLLDAIERAGSFDREKIAEEIRKTRNFNGAS     333

Query:  83  GKMSIDKNHNVVKSAYVVKLEDGKTSSVNIIS                                114
            G ++ID+N + +KS   V   +++G         +I+
Sbjct: 334  GIINIDENGDAIKSVVVNIVKNGSVDFEAVIN                                365
```

No corresponding DNA sequence was identified in *S. pyogenes*.

Figure 141:
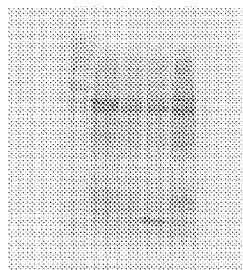

SEQ ID 9410 (GBS660) was expressed in *E. coli* as a GST-fusion product. SDS-PAGE analysis of total cell extract is shown in FIG. 135 (lane 8 & 9; MW 71.5 kDa)+lane 10; MW 27 kDa). It was also expressed in *E. coli* as a His-fusion product. SDS-PAGE analysis of total cell extract is shown in FIG. 141 (lane 2; MW 46.5 kDa) and in FIG. 181 (lane 3; MW 46 kDa).

GBS660-His was purified as shown in FIG. 233, lane 5-6.

Based on this analysis, it was predicted that these proteins and their epitopes could be useful antigens for vaccines or diagnostics.

Example 697

A DNA sequence (GBSx0741) was identified in *S. agalactiae* <SEQ ID 2147> which encodes the amino acid sequence <SEQ ID 2148>. Analysis of this protein sequence reveals the following:

```
Possible site: 27
>>> Seems to have a cleavable N-term signal seq.
INTEGRAL    Likelihood = -10.61   Transmembrane 140-156 (129-158)
INTEGRAL    Likelihood = -9.55    Transmembrane 60-76 (53-80)
INTEGRAL    Likelihood = -7.59    Transmembrane 264-280 (257-285)
INTEGRAL    Likelihood = -5.79    Transmembrane 232-248 (219-251)
INTEGRAL    Likelihood = -2.23    Transmembrane 190-206 (190-207)
INTEGRAL    Likelihood = -1.75    Transmembrane 90-106 (90-110)
----- Final Results -----
    bacterial membrane --- Certainty = 0.5246 (Affirmative) <succ >
      bacterial outside --- Certainty = 0.0000 (Not Clear) <succ >
    bacterial cytoplasm --- Certainty = 0.0000 (Not Clear) <succ >
```

A related GBS nucleic acid sequence <SEQ ID 10059> which encodes amino acid sequence <SEQ ID 10060> was also identified.

The protein has homology with the following sequences in the GENPEPT database:

```
>GP:AAD36212 GB:AE001771 branched chain amino acid ABC transporter,
permease protein [Thermotoga maritima]
Identities = 140/295 (47%), Positives = 200/295 (67%), Gaps = 7/295 (2%)
Query:    2  LQQLVNGLILGSIYALLALGYTMVYGIIKLINFAHGDIYMMGAFMGYYLINHLHLNFFLA      61
             LQ L NG++LG +YAL+A+GYTMVYGI++LINFAHGD+ MMG +   +Y     L LN    +
Sbjct:    5  LQNLFNGIMLGGLYALIAIGYTMVYGILRLINFAHGDVMMMGVYFAFYAATLLSLNPLFS      64

Query:   62  LLIAMLGSAFLGVVIEYLAYRPLRKSTRIAALITAIGVSFLLEYGMVYLVGADTRAFPQA     121
             ++A+LG+A LG +I+ +AY+PLR + RI+ALITAIGVSF LE      V + GA   ++F +
Sbjct:   65  AIVAILGAALLGFLIDRVAYKPLRNAPRISALITAIGVSFFLESLAVVVFGAIPKSFLKV     124

Query:  122  IHTVKYNLGPITITNVQL-----IILGIALLLMLTLQFIVQKTKMGKAMRALSVDSDAAQ     176
                +T+   ++      +++   I    ++++ L FIV +TK+G AMRA+S+D
Sbjct:  125  FKDRTILNKVLTVAGARIPLLTFLVIFITAVILIVLFFIVYRTKIGMAMRAISMDIPTTA     184

Query:  177  LMGINVNRTISFTFALGSALAGAGGVLIGLYYNSVQPLMGVTPGLKAFVAAVLGGIGIIP     236
             LMG+NV+    I FTFALGSALA A G++   +  + +V P MG  PGLKAF+AAV GGIG IP
Sbjct:  185  LMGVNVDAVIGFTFALGSALAAASGIMWAMRFPNVHPYMGFMPGLKAFIAAVFGGIGSIP     244

Query:  237  GAAIGGFVIGILETLATAL--GVSDFRDGIVYAILILIFLIRPAGILGKNIKEKV        289
             GA +GG ++G++E    A    V  +RD   + ILI+I L++P+G+LGK I EKV
Sbjct:  245  GAVLGGVLLGLIEIFLAAYFPAVMGYRDAFAFIILIIILLVKPSGLLGKKIVEKV        299
```

There is also homology to SEQ ID 2150. A related sequence was also identified in GAS <SEQ ID 9171> which encodes the amino acid sequence <SEQ ID 9172>. Analysis of this protein sequence reveals the following:

```
Possible site: 30
>>> Seems to have an uncleavable N-term signal seq
INTEGRAL    Likelihood = -12.42   Transmembrane 196-212 (191-219)
INTEGRAL    Likelihood = -7.22    Transmembrane 106-122 (102-126)
INTEGRAL    Likelihood = -4.78    Transmembrane 242-258 (240-260)
INTEGRAL    Likelihood = -2.50    Transmembrane 61-77 (60-77)
INTEGRAL    Likelihood = -2.34    Transmembrane 293-309 (291-309)
INTEGRAL    Likelihood = -1.44    Transmembrane 139-155 (138-156)
INTEGRAL    Likelihood = -1.33    Transmembrane 317-333 (317-333)
----- Final Results -----
    bacterial membrane --- Certainty = 0.609 (Affirmative) <succ>
    bacterial outside --- Certainty = 0.0000 (Not Clear) <succ>
    bacterial cytoplasm --- Certainty = 0.0000 (Not Clear) <succ>
```

An alignment of the GAS and GBS proteins is shown below:

chain amino acid ABC transporter, permease protein (livM). Analysis of this protein sequence reveals the following:

```
Possible site: 29
>>> Seems to have an uncleavable N-term signal seq
INTEGRAL    Likelihood = -8.76   Transmembrane 90-106 (84-113)
INTEGRAL    Likelihood = -8.23   Transmembrane 12-28 (5-33)
INTEGRAL    Likelihood = -8.17   Transmembrane 205-221 (200-224)
INTEGRAL    Likelihood = -7.86   Transmembrane 276-292 (273-300)
INTEGRAL    Likelihood = -6.32   Transmembrane 159-175 (154-176)
INTEGRAL    Likelihood = -6.05   Transmembrane 236-252 (232-264)
INTEGRAL    Likelihood = -5.95   Transmembrane 42-58 (38-60)
INTEGRAL    Likelihood = -5.84   Transmembrane 120-136 (119-138)
INTEGRAL    Likelihood = -4.35   Transmembrane 255-271 (253-274)
INTEGRAL    Likelihood = -1.59   Transmembrane 66-82 (66-85)
----- Final Results -----
    bacterial membrane --- Certainty = 0.4503 (Affirmative) <succ>
    bacterial outside --- Certainty = 0.0000 (Not Clear) <succ>
    bacterial cytoplasm --- Certainty = 0.0000 (Not Clear) <succ>
```

```
Identities = 35/147 (23%), Positives = 71/147 (47%), Gaps = 6/147 (4%)
Query:  134  ITNVQLIILGI--ALLLMLTLQFIVQKTKMGKAMRALSVDSDAAQLMGINVNRTISFTFA   191
             +TN    I  +GI   A++  +   + F++ KT  +G   +R++ ++   A++   G++   RTI    +
Sbjct:  197  LTNNSRINIGIFFAIIAIALIWFLLNKTTLGFEIRSVGLNPHASEYAGMSSKRTIILSMI   256

Query:  192  LGSALAGAGGVL--IGLYYNSVQPLMGVTPGLKAFVAAVLGGIGIIPGAAIGGFVIGILE   249
             +    ALAG GGV+    +G + N           +  G        ++L       + G          F+  G+L
Sbjct:  257  ISGALAGLGGVVEGLGTFENVFVQGSSLAVGFDGMAVSLLAANSPL-GIFFSSFLFGVLN   315

Query:  250  TLATALGVSDFRDGIVYAILI-LIFLI   275
                 A    + ++       +V     +    +IF +
Sbjct:  316  IGAPGMNIAGIPPELVKVVTASIIFFV   342
```

Based on this analysis, it was predicted that these proteins and their epitopes could be useful antigens for vaccines or diagnostics.

Example 698

A DNA sequence (GBSx0742) was identified in *S. agalactiae* <SEQ ID 2151> which encodes the amino acid sequence <SEQ ID 2152>. This protein is predicted to be branched The protein has homology with the following sequences in the GENPEPT database:

```
>GP:AAD36213 GB:AE001771 branched chain amino acid ABC transporter,
permease protein [Thermotoga maritima]
Identities = 119/332 (35%), Positives = 191/332 (56%), Gaps = 33/332 (9%)

Query:   12  LAIVVLDYLLISVLISMGIFNLYHIQIIETIGINVILAVGLNLIVGCSGQFSLGHAGFMA   71
             L +V L ++  + ++      + Y ++++  I I   I+AV LNLI G +G FSLGHAGF+
Sbjct:   16  LTVVFLIFMALLLYLADRYMDSYKLRVVRLIAIYGIMAVSLNLINGITGIFSLGHAGFIL   75

Query:   72  IGAYAVAIIGVKMP-----------------TYVGFLIAILVGTLVAGGIALGVGIPTLR   114
             IGAY  +++ +                       +   F    A + G  ++A       A    +G P LR
Sbjct:   76  IGAYTASLLTLSPEQKAMSFIIEPIVPWLANAHTDFFTATVAGGVLAAVFAFLIGWPVLR   135

Query:  115  LKGDYLAIATLGVAEIIRILLVNGGDITNGAAGIMGIPPFTTWSLVYGVAVVSLILAMNF   174
             L GDYLAIA+LG AE+IRI+ +N    ITNG  G+  GIP ++           YG    V+++    +
Sbjct:  136  LSGDYLAIASLGFAEVIRIIALNAISITNGPLGLKGIPEYSNIWWCYGWLFVTVLFMASL   195

Query:  175  LRSPLGRNTIAIREDEIAAESMGVDTTKVKVIVFVFGAILASIAGSLQAGYVGTVMPKDF   234
             + S    GR    AIRED IAAE+MG++   K +++ FV GA  A ++GSL A ++ T+ P+
Sbjct:  196  VNSSYGRALKAIREDRIAAEAMGINVFKHQLLSFVIGAFFAGVSGSLYAHWLTTIDPRTT   255

Query:  235  SF--MMSVNVLIIVVLGGLGSMTGTVLAAILLGLLNMLLQD--------------YASVR   278
              +     M++  VLI++VLGGLGS++G++    A L    +L      L+D                        +R
Sbjct:  256  TLGPMLTFYVLIMIVLGGLGSISGSLIGAALFAILFEWLRDLEEPFTFFGIHVPGIKGMR   315

Query:  279  MIIYALALILIMIFRPSGLLGTKELTLSHLFR   310
              +++   +     IL+MIF    G++G    +ELT    ++L+R
Sbjct:  316  ILVISAIFILVMIFWQRGIMGREELTWNNLYR   347
```

No corresponding DNA sequence was identified in *S. pyogenes*.

Based on this analysis, it was predicted that this protein and its epitopes, could be useful antigens for vaccines or diagnostics.

Example 699

A DNA sequence (GBSx0743) was identified in *S. agalactiae* <SEQ ID 2153> which encodes the amino acid sequence <SEQ ID 2154>. This protein is predicted to be branched chain amino acid ABC transporter, ATP-binding protein (livG). Analysis of this protein sequence reveals the following:

Possible site: 58
>>> Seems to have no N-terminal signal sequence
----- Final Results -----
   bacterial cytoplasm --- Certainty = 0.2057 (Affirmative) <succ>
      bacterial membrane --- Certainty = 0.0000 (Not Clear) <succ>
      bacterial outside --- Certainty = 0.0000 (Not Clear) <succ>

The protein has homology with the following sequences in the GENPEPT database:

```
>GP:AAD36214 GB:AE001771 branched chain amino acid ABC transporter,
ATP-binding protein [Thermotoga maritima]
Identities = 136/271 (50%), Positives = 189/271 (69%), Gaps = 21/271 (7%)

Query:     3   LLEVKNLSKHFGGLTAVGDVSMKLHKGELIGLIGPNGAGKTTLFNLLTGVYLPSKGTISI    62
               LL + +++  FGGL AV D + ++ +GEL+GLIGPNGAGKTT+FN++TG+Y P+KG I
Sbjct:    11   LLLLDHVTMQFGGLVAVDDFTNEIREGELVGLIGPNGAGKTTVFNVITGIYTPTKGRIVF    70

Query:    63   DGKILNGRKPAKIASLGLGRTFQNIRLFKNMTVLDNVLVGLSNHHLSHPIASFLRLPK--   120
               +   + G +P +I   LG+ RTFQNIRLF +MTVL+NVLV   +H LS+P A  + +
Sbjct:    71   NDIDITGLRPYQITHLGIARTFQNIRLFSDMTVLENVLVA-QHHVLSNPDADRILVKHGK   129

Query:   121   ------------------YYHSEKALRKKALELLEIFGLKAYQDALAKNLPYGKQRRLEI   162
                                 Y   EK + ++A +L++  GL+       A +LPYG+QR+LEI
Sbjct:   130   PRKGHGRFWFWRAVTKIGYLKKEKEMVERAKDLIKRVGLEKVMYEKASSLPYGEQRKLEI   189

Query:   163   VRALATEPKILFLDEPAAGMNPQETAELTQLISQIKSDFDITIMLIEHDMNLVMQVTERI   222
               RALATEPK++ LDEPAAGMNP+ET +L + I QI+ DF++T++LIEHDM +VM + ERI
Sbjct:   190   ARALATEPKLILLDEPAAGMNPKETEDLMEFIKQIRKDFNLTVLLIEHDMKVVMGICERI   249

Query:   223   YVLEYGRLIAHGTPEEIKNNKRVIEAYLGGE                               253
               V++YGR+IA GTP+EI+N+ RVIEAYLG E
Sbjct:   250   IVMDYGRIIAEGTPKEIQNDPRVIEAYLGRE                               280
```

There is also homology to SEQ ID 644.

Based on this analysis, it was predicted that this protein and its epitopes, could be useful antigens for vaccines or diagnostics.

Example 700

A DNA sequence (GBSx0744) was identified in *S. agalactiae* <SEQ ID 2155> which encodes the amino acid sequence <SEQ ID 2156>. Analysis of this protein sequence reveals the following:

Possible site: 61
>>> Seems to have no N-terminal signal sequence
----- Final Results -----
   bacterial cytoplasm --- Certainty = 0.2216 (Affirmative) <succ>
      bacterial membrane --- Certainty = 0.0000 (Not Clear) <succ>
      bacterial outside --- Certainty = 0.0000 (Not Clear) <succ>

The protein has homology with the following sequences in the GENPEPT database:

```
>GP:CAB52068 GB:AL109732 putative branched chain amino acid
transport ATP-binding protein [Streptomyces coelicolor A3(2)]
Identities = 136/233 (58%), Positives = 181/233 (77%)

Query:     3   MLKVENLSIHYGVIQAVNDVSFEVNQGEVVTLIGANGAGKTSILRTISGLVRPSQGSISF    62
               +L+VE+L + YG I+AV +SF+V+ GEVVTLIG NGAGKT+ LRT+SGL++P  G I F
Sbjct:     4   LLEVEDLRVAYGKIEAVKGISFKVDAGEVVTLIGTNGAGKTTTLRTLSGLLKPVGGQIRF    63

Query:    63   MGKPIHKLAARKIVGNGLAQVPEGRHVFSSLSVMENLEMGAFLQKDREQNQKMLKKVFDR   122
               GK + K+ A +IV  GLA  PEGRH+F  +++ +NL +GAFL+ DR    +K +++ +D
Sbjct:    64   GGKSLKKVPAHQIVSLGLAHSPEGRHIFPRMTIEDNLRLGAFLRSDRPGIEKDIQRAYDL   123

Query:   123   FPRLEERKNQDAATLSGGEQQMLAMGRALMSRPKLLLLDEPSMGLAPIFIQEIFNIIEDI   182
               FP L ER+ Q A TLSGGEQQMLAMGRALMS+PKLL+LDEPSMGL+PI +Q+I   I ++
Sbjct:   124   FPILGERRKQAAGTLSGGEQQMLAMGRALMSQPKLLMLDEPSMGLSPIMMQKIMATIAEL   183

Query:   183   KKQGTTVLLVEQNANKALTIADKAYVLETGKVVLSGTGKELLVSDQVRKAYLG         235
               K QGTT+LLVEQNA  AL++AD +V+E G +VLSG+G++LL  + VRKAYLG
Sbjct:   184   KSQGTTILLVEQNAQAALSLADHGHVMEVGNIVLSGSGQDLLHDESVRKAYLG         236
```

Based on this analysis, it was predicted that this protein and its epitopes, could be useful antigens for vaccines or diagnostics.

Example 701

A DNA sequence (GBSx0745) was identified in *S. agalactiae* <SEQ ID 2159> which encodes the amino acid sequence <SEQ ID 2160>. Analysis of this protein sequence reveals the following:

Possible site: 23
>>> Seems to have no N-terminal signal sequence
----- Final Results -----
  bacterial cytoplasm --- Certainty = 0.0415 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database:

```
>GP:AAD36216 GB:AE001771 conserved hypothetical protein [Thermotoga maritima]
Identities = 72/166 (43%), Positives = 116/166 (69%), Gaps = 2/166 (1%)

Query:     1   MPVKDFMTKKLVYVSPDTTVAEAADLLREHHLRRLPVVENDQLVGLVTEGTMAEAQPSKA    60
               M VKDFMT+  + ++P+T+ +EA  L++++ ++RL V++N+++VG+VTE +  A PSKA
Sbjct:     1   MLVKDFMTRNPITIAPETSFSEALKLMKQNKIKRLIVMKNEKIVGIVTEKDLLYASPSKA    60

Query:    61   TSLSIYEMNYLLNKTKIRDIMIKDIVTVSQYASLEDAIYLMMSRKIGVLPVVDN-GQLYG   119
               T+L+I+E++YLL+K KI +IM KD+VTV++   +EDA +M  + I  LPVVD+ G+L G
Sbjct:    61   TTLNIWELHYLLSKLKIEEIMTKDVVTVNENTPIEDAARIMEEKDISGLPVVDDAGRLVG   120

Query:   120   IVTDRDVFKAFLEIAGYGQE-SYRLVILADEGIGVLSKVLNRLSSA               164
               I+T  D+FK F+EI G  +E + R +    + GL +V R+  A
Sbjct:   121   IITQTDIFKVFVEIFGTKREGTIRYTMEMPDKPGELLEVAKRIYEA               166
```

Based on this analysis, it was predicted that this protein and its epitopes, could be useful antigens for vaccines or diagnostics.

Example 702

A DNA sequence (GBSx0746) was identified in *S. agalactiae* <SEQ ID 2163> which encodes the amino acid sequence <SEQ ID 2164>. Analysis of this protein sequence reveals the following:

Possible site: 41
>>> Seems to have no N-terminal signal sequence
----- Final Results -----
  bacterial cytoplasm --- Certainty = 0.5585 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 703

A DNA sequence (GBSx0747) was identified in *S. agalactiae* <SEQ ID 2165> which encodes the amino acid sequence <SEQ ID 2166>. This protein is predicted to be a transposase. Analysis of this protein sequence reveals the following:

Possible site: 38
>>> Seems to have no N-terminal signal sequence
INTEGRAL    Likelihood = -1.65    Transmembrane 53-69 (53-70)
----- Final Results -----
  bacterial membrane --- Certainty = 0.1659 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the GENPEPT database:

```
>GP:AAA85003 GB:U28972 SpV1 ORF3; putative transposase [Spiroplasma citri]
Identities = 49/154 (31%), Positives = 80/154 (51%), Gaps = 11/154 (7%)

Query:    39  WLEMDTVIGRIGGKVLLTFNVAFCNFIFAKLMDSKTAIETAKHIQ--VIKRTLYDNKRDF     96
              WLEMDTV+G+     +L         FA +++ TA E  K + +IK  L      +
Sbjct:   174  WLEMDTVVGKDHKSAILVLVEQLSKKYFAIKLENHTAREVEKKFKDIIIKNNLIGKIKG-    232

Query:    97  FELFPVILTDNGGEFARVDDIEIDVCGQSQLFFCDPNRSDQKARIEKNHTLVRDILPKGT    156
                    I+TD G EF++  ++EI      ++Q++FCD    QK  IE  ++ +R    PKGT
Sbjct:   233  ------IITDRGKEFSKWREMEI--FAETQVYFCDAGSPQQKPLIEYMNSELRHWFPKGT    284

Query:   157  SFDNLTQEDINLALSHINSVKRQALNGKTAYELF                              190
              F+ ++Q+ I+  ++ IN   R  LN  ++ E+F
Sbjct:   285  DFNKVSQKQIDWVVNVINDKLRPCLNWISSKEMF                              318
```

No corresponding DNA sequence was identified in *S. pyogenes*.

Based on this analysis, it was predicted that this protein and its epitopes, could be useful antigens for vaccines or diagnostics.

Example 704

A DNA sequence (GBSx0748) was identified in *S. agalactiae* <SEQ ID 2167> which encodes the amino acid sequence <SEQ ID 2168>. Analysis of this protein sequence reveals the following:

Possible site: 45
>>> Seems to have no N-terminal signal sequence
----- Final Results -----
  bacterial cytoplasm --- Certainty = 0.3116 (Affirmative) <succ>
    bacterial membrane --- Certainty = 0.0000 (Not Clear) <succ>
      bacterial outside --- Certainty = 0.0000 (Not Clear) <succ>

A related GBS nucleic acid sequence <SEQ ID 10055> which encodes amino acid sequence <SEQ ID 10056> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 705

A DNA sequence (GBSx0749) was identified in *S. agalactiae* <SEQ ID 2169> which encodes the amino acid sequence <SEQ ID 2170>. This protein is predicted to be thymidylate kinase (tmk). Analysis of this protein sequence reveals the following:

Possible site: 39
>>> Seems to have no N-terminal signal sequence
----- Final Results -----
  bacterial cytoplasm --- Certainty = 0.1876 (Affirmative) <succ>
    bacterial membrane --- Certainty = 0.0000 (Not Clear) <succ>
      bacterial outside --- Certainty = 0.0000 (Not Clear) <succ>

A related GBS nucleic acid sequence <SEQ ID 10053> which encodes amino acid sequence <SEQ ID 10054> was also identified.

The protein has homology with the following sequences in the GENPEPT database:

```
>GP:BAB03761 GB:AP001507 thymidylate kinase [Bacillus halodurans]
Identities = 112/210 (53%), Positives = 148/210 (70%), Gaps = 1/210 (0%)

Query:    17  MKKGLMISFEGPDGAGKTTVLEAVLPLLREKLSQDILTTREPGGVTISEEIRHIILDVKH     76
              M KG   I+ EG +GAGKT+ L+A+   +LRE       ++ TREPGG+ I+E+IR IILDV H
Sbjct:     1  MTKGCFITVEGGEGAGKTSALDAIEEMLREN-GLSVVRTREPGGIPIAEQIRSIILDVDH     59

Query:    77  TQMDKKTELLLYMAARRQHLVEKVLPALEEGKIVLMDRFIDSSVAYQGSGRGLDKSHIKW    136
              T+MD  +TE LLY AARRQHLVEKVLPALE G +VL DRFIDSS+AYQG   RG+     I
Sbjct:    60  TRMDPRTEALLYAAARRQHLVEKVLPALEAGHVVLCDRFIDSSLAYQGYARGIGFEDILA    119

Query:   137  LNDYATDSHKPDLTLYFDVPSEVGLERIQKSVQREVNRLDLEQLDMHQRVRQGYLELADS    196
              +N++A +     PDLTL F V +VGL RI +   RE NRLD E L   HQ+V++GY + ++
Sbjct:   120  INEFAIEGRYPDLTLLFRVDPDVGLSRIHRDQSREQNRLDQEALTFHQKVKEGYERIVET    179

Query:   197  EPNRIVTIDASQQLDEVIAETFSIILDRIN                                  226
               P R+V IDA+Q  D+V+A+     +I   R++
Sbjct:   180  YPERVVEIDANQSFDQVVADAVRMIKQRLS                                  209
```

A related DNA sequence was identified in *S. pyogenes* <SEQ ID 2171> which encodes the amino acid sequence <SEQ ID 2172>. Analysis of this protein sequence reveals the following:

Possible site: 56
>>> Seems to have no N-terminal signal sequence
INTEGRAL      Likelihood = –0.75    Transmembrane 215-231 (215-231)
----- Final Results -----
  bacterial membrane --- Certainty = 0.1298 (Affirmative) <succ> bacterial outside --- Certainty = 0.0000 (Not Clear) <succ>
bacterial cytoplasm ---Certainty = 0.0000 (Not Clear) <succ>

The protein has homology with the following sequences in the databases:

```
>GP:BAB03761 GB:AP001507 thymidylate kinase [Bacillus halodurans]
Identities = 109/205 (53%), Positives = 148/205 (72%), Gaps = 1/205 (0%)

Query:    22 MITGKLITVEGPDGAGKTTVLEQLIPLLKQKVAQDILTTREPGGVAISEHIRELILDINH    81
             M  G  ITVEG +GAGKT+ L+ +  +L++      ++ TREPGG+ I+E IR +ILD++H
Sbjct:     1 MTKGCFITVEGGEGAGKTSALDAIEEMLREN-GLSVVRTREPGGIPIAEQIRSIILDVDH    59

Query:    82 TAMDPKTELLLYIAARRQHLVEKVLPALEAGQLVFIDRFIDSSVAYQGAGRGLIKADIQW   141
             T MDP+TE LLY AARRQHLVEKVLPALEAG +V  DRFIDSS+AYQG  RG+   DI
Sbjct:    60 TRMDPRTEALLYAAARRQHLVEKVLPALEAGHVVLCDRFIDSSLAYQGYARGIGFEDILA   119

Query:   142 LNEFATDGLEPDLTLYFDVPSEIGLARINANQQREVNRLDLETIEIHQRVRKGYLALAKE   201
             +NEFA +G   PDLTL F V  ++GL+RI+ +Q RE NRLD E +  HQ+V++GY  + +
Sbjct:   120 INEFAIEGRYPDLTLLFRVDPDVGLSRIHRDQSREQNRLDQEALTFHQKVKEGYERIVET   179

Query:   202 HPKRIVTIDATKPLKEVVSVALEHV                                     226
             +P+R+V IDA +   +VV+ A+  +
Sbjct:   180 YPERVVEIDANQSFDQVVADAVRMI                                     204
```

An alignment of the GAS and GBS proteins is shown below:

```
Identities = 145/219 (66%), Positives = 181/219 (82%)

Query:     4 FDRIVVIINKGCTMKKGLMISFEGPDGAGKTTVLEAVLPLLREKLSQDILTTREPGGVTI    63
             FD+I ++ ++G  M   G +I+ EGPDGAGKTTVLE ++PLL++K++QDILTTREPGGV I
Sbjct:     9 FDKIELLKSEGNKMITGKLITVEGPDGAGKTTVLEQLIPLLKQKVAQDILTTREPGGVAI    68

Query:    64 SEEIRHIILDVKHTQMDKKTELLLYMAARRQHLVEKVLPALEEGKIVLMDRFIDSSVAYQ   123
             SE IR +ILD+ HT MD KTELLLY+AARRQHLVEKVLPALE G++V +DRFIDSSVAYQ
Sbjct:    69 SEHIRELILDINHTAMDPKTELLLYIAARRQHLVEKVLPALEAGQLVFIDRFIDSSVAYQ   128

Query:   124 GSGRGLDKSHIKWLNDYATDSHKPDLTLYFDVPSEVGLERIQKSVQREVNRLDLEQLDMH   183
             G+GRGL K+ I+WLN++ATD   +PDLTLYFDVPSE+GL RI  + QREVNRLDLE +++H
Sbjct:   129 GAGRGLIKADIQWLNEFATDGLEPDLTLYFDVPSEIGLARINANQQREVNRLDLETIEIH   188

Query:   184 QRVRQGYLELADSEPNRIVTIDASQQLDEVIAETFSIIL                       222
             QRVR+GYL LA    P RIVTIDA++ L EV++       +L
Sbjct:   189 QRVRKGYLALAKEHPKRIVTIDATKPLKEVVSVALEHVL                       227
```

Based on this analysis, it was predicted that these proteins and their epitopes could be useful antigens for vaccines or diagnostics.

Example 706

A DNA sequence (GBSx0750) was identified in *S. agalactiae* <SEQ ID 2173> which encodes the amino acid sequence <SEQ ID 2174>. This protein is predicted to be DNA polymerase III delta' subunit (dnaZX). Analysis of this protein sequence reveals the following:

Possible site: 26
>>> Seems to have no N-terminal signal sequence
----- Final Results -----
bacterial cytoplasm --- Certainty = 0.2603 (Affirmative) <succ>

-continued bacterial membrane --- Certainty = 0.0000 (Not Clear) <succ>
bacterial outside --- Certainty = 0.0000 (Not Clear) <succ>

The protein has homology with the following sequences in the GENPEPT database:

```
>GP:BAB03763 GB:AP001507 DNA polymerase III delta' subunit [Bacillus halodurans]
Identities = 78/189 (41%), Positives = 113/189 (59%), Gaps = 3/189 (1%)

Query:     2 DLKRTQPKLLEKFNTILQSDRMSHAYLFSGNFAS--LDMALYLAQSQFCEKRQSGLPCQE    59
             +L + QP +         L  R++HAY+F GN +      MAL+LA+S FC +R    PCQ
Sbjct:     5 NLAKNQPFVATMLKNSLAKGRLAHAYIFDGNRGTGKKRMALHLAKSFFCAQRAGVEPCQT    64

Query:    60 CRACRLIANGEFSDVKIIEPQGQLIKTETIKELTKDFSRSGFEGKSQVFIIKDCEKMHVN   119
             C+  C+ I +G   DV  IEP GQ IK    ++ L K+FS  G E   +V+I+    +KM  +
Sbjct:    65 CKECKRIEHGNHPDVHFIEPDGQSIKKHQVEHLQKEFSYRGMESAKKVYIVNHADKMTTS   124

Query:   120 AANSLLKFIEEPQSSSYVILLTNDENNVLPTIKSRTQIFRF-PKQLDMLVHQAEQAGLLK   178
             AANSLLKF+EEP + +   ILLT  N++LPTIKSR+Q+  F P ++      E+ G+ +
```

```
                                -continued
Sbjct:   125  AANSLLKFLEEPLADTVAILLTEQLQNMLPTIKSRSQVLSFAPLEVQAFAKLLEEEGISE   184

Query:   179  SQASLLAQV                                                      187
              S ++LLA +
Sbjct:   185  SVSNLLASL                                                      193
```

A related DNA sequence was identified in *S. pyogenes* <SEQ ID 2175> which encodes the amino acid sequence <SEQ ID 2176>. Analysis of this protein sequence reveals the following:

Possible site: 39
>>> Seems to have no N-terminal signal sequence
----- Final Results -----
   bacterial cytoplasm --- Certainty = 0.2685 (Affirmative) <succ>
   bacterial membrane --- Certainty = 0.0000 (Not Clear) <succ>
   bacterial outside --- Certainty = 0.0000 (Not Clear) <succ>

Possible site: 28
>>> Seems to have no N-terminal signal sequence
----- Final Results -----
   bacterial cytoplasm --- Certainty = 0.2016 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below:

The protein has homology with the following sequences in the GENPEPT database:

```
Identities = 151/290 (52%), Positives = 213/290 (73%), Gaps = 3/290 (1%)

Query:     1  MDLKRTQPKLLEKFNTILQSDRMSHAYLFSGNFASLDMALYLAQSQFCEKRQSGLPCQEC    60
              MDL +  P + + F TIL+ DR++HAYLFSG+FA+ +MAL+LA+  FCE+++   PC  C
Sbjct:     1  MDLAQKAPNVYQAFQTILKKDRLNHAYLFSGDFANEEMALFLAKVIFCEQKKDQTPCGHC    60

Query:    61  RACRLIANGEFSDVKIIEPQGQLIKTETIKELTKDFSRSGFEGKSQVFIIKDCEKMHVNA   120
              R+C+LI   G+F+DV  ++EP GQ+IKT+ +KE+   +FS++G+E K QVFIIKDC+KMH+NA
Sbjct:    61  RSCQLIEQGDFADVTVLEPTGQVIKTDVVKEMMANFSQTGYENKRQVFIIKDCDKMHINA   120

Query:   121  ANSLLKFIEEPQSSSYVILLTNDENNVLPTIKSRTQIFRFPKQLDMLVHQAEQAGLLKSQ   180
              ANSLLK+IEEPQ  +Y+ LLTND+N VLPTIKSRTQ+F+FPK     L   A++ GLL  Q
Sbjct:   121  ANSLLKYIEEPQGEAYIFLLTNDDNKVLPTIKSRTQVFQFPKNENYLYQLAQEKGLLNHQ   180

Query:   181  ASLLAQVADDPKHLEILLTNKKLLDYLNLSQQFVTTLAKDRQTAYLEVSRLTSQVVDKND   240
              A L+A++A +  HLE LL   KLL+ +  +++FV+  KD+  AYL ++RL    +K +
Sbjct:   181  AKLVAKLATNTSHLERLLQTSKLLELITQAERFVSIWLKDQLQAYLALNRLVQLATEKEE   240

Query:   241  QAFVFQWLTIMLAKE---GQLYDLENTYRAQQMWKSNVSFQNSLEYMVLS            287
              Q  V   LT++LA+E    L   LE  Y+A+ MW+SNV+FQN+LEYMV+S
Sbjct:   241  QDLVLTLLTLLLARERAQTPLTQLEAVYQARLMWQSNVNFQNTLEYMVMS            290
```

Based on this analysis, it was predicted that these proteins and their epitopes could be useful antigens for vaccines or diagnostics.

Example 707

A DNA sequence (GBSx0751) was identified in *S. agalactiae* <SEQ ID 2177> which encodes the amino acid sequence <SEQ ID 2178>. Analysis of this protein sequence reveals the following:

```
>GP:BAB03765 GB:AP001507 unknown conserved protein in B. subtilis
[Bacillus halodurans]
Identities = 45/116 (38%), Positives = 62/116 (52%), Gaps = 8/116 (6%)

Query:     1  MDKKDLFDAFDDFSQNLLVGLSEIETMKKQIQKLLEENTVLRIENGKLRERLSVIEAET-    59
              M+KK +F       + +      E+  +K+Q+ L+EEN  L IEN  LRERL    E E
Sbjct:     1  MNKKAIFTQVSQLEERIGELHRELGGLKEQLAYLIEENHFLTIENEHLRERLGEPELEET    60

Query:    60  ---ETAVKNSK----QGRELLEGIYNDGFHICNTFYGQRRENDEECAFCIELLYRD      108
                  E  K  K    +G + L +Y +GFHICNT YG  R+N E+C FC+  L +D
Sbjct:    61  EEKEQVTKERKPFVGEGYDNLARLYQEGFHICNTHYGSLRKNGEDCLFCLSFLNQD      116
```

A related DNA sequence was identified in *S. pyogenes* <SEQ ID 2179> which encodes the amino acid sequence <SEQ ID 2180>. Analysis of this protein sequence reveals the following:

---

Possible site: 22
>>> Seems to have no N-terminal signal sequence
----- Final Results -----
   bacterial cytoplasm --- Certainty = 0.0700 (Affirmative) <succ>
     bacterial membrane --- Certainty = 0.0000 (Not Clear) <succ>
      bacterial outside --- Certainty = 0.0000 (Not Clear) <succ>

---

Possible site: 48
>>> Seems to have no N-terminal signal sequence
INTEGRAL    Likelihood = −1.28    Transmembrane 119-135 (119-135)
----- Final Results -----
   bacterial membrane --- Certainty = 0.1510 (Affirmative) <succ>
     bacterial outside --- Certainty = 0.0000 (Not Clear) <succ>
      bacterial cytoplasm --- Certainty = 0.0000 (Not Clear) <succ>

---

A related GBS nucleic acid sequence <SEQ ID 10051> which encodes amino acid sequence <SEQ ID 10052> was also identified.

An alignment of the GAS and GBS proteins is shown below:

The protein has homology with the following sequences in the GENPEPT database:

```
Identities = 75/107 (70%), Positives = 89/107 (83%), Gaps = 1/107 (0%)

Query:   1  MDKKDLFDAFDDFSQNLLVGLSEIETMKKQIQKLLEENTVLRIENGKLRERLSVIEAETE   60
            ++KK+LFDAFD FSQNL+V L+EIE MKKQ+Q L+EENT+LR+EN KLRERLS +E ET
Sbjct:   1  VNKKELFDAFDGFSQNLMVTLAEIEAMKKQVQSLVEENTILRLENTKLRERLSHLEHET-   59

Query:  61  TAVKNSKQGRELLEGIYNDGFHICNTFYGQRRENDEECAFCIELLYR              107
            A   SKQ ++ LEGIY++GFHICN FYGQRRENDEEC FC ELL R
Sbjct:  60  VAKNPSKQRKDHLEGIYDEGFHICNFFYGQRRENDEECMFCRELLDR              106
```

Based on this analysis, it was predicted that these proteins and their epitopes could be useful antigens for vaccines or diagnostics.

Example 708

A DNA sequence (GBSx0752) was identified in *S. agalactiae* <SEQ ID 2181> which encodes the amino acid sequence <SEQ ID 2182>. Analysis of this protein sequence reveals the following:

```
>GP:BAB03768 GB:AP001507 unknown conserved protein [Bacillus halodurans]
Identities = 138/287 (48%), Positives = 189/287 (65%), Gaps = 2/287 (0%)

Query:    4  MQVQKSFKSNIHYGTLYLVPTPIGNLDDMTFRAIRILREVDFICAEDTRNTGLLLKHFDI   63
             M+ Q+S++       GTLYLV TPIGNL+D+TFRAIR L+E D I AEDTR T  LL HFDI
Sbjct:    1  MKTQQSYQQRDDKGTLYLVATPIGNLEDVTFRAIRTLKEADQIAAEDTRQTKKLLNHFDI   60

Query:   64  TTKQISFHEHNAYDKISGLIDLLKEGKSLAQVSDAGMPSISDPGHDLVKAAIEGDIPVVS  123
             T K +S+HEHN      LID L EG+++A VSDAGMP+ISDPG++LV +AI+   I V+
Sbjct:   61  ATKLVSYHEHNKETMGKRLIDDLIEGRTIALVSDAGMPAISDPGYELVVSAIKEGIAVIP  120

Query:  124  IPGASAGITALIASGLAPQPHIFYGFLPRKKGQQITFFETKQDYPETQIFYESPFRVSDT  183
             IPGA+A +TALIASGL +    F GFLPR+K Q+    E  +    T IFYESP R+ DT
Sbjct:  121  IPGANAAVTALIASGLPTESFQFIGFLPRQKKQRRQALEETKPTKATLIFYESPHRLKDT  180

Query:  184  LKHMKEIYGDRQVVLVRELTKLYEEYQRGTISQLLEHIEKVPLKGECLIIVDGKRDTERV  243
             L  M  I G+R V + RELTK YEE+ RGT+  +      +  +KGE  +IV+G    +
Sbjct:  181  LDDMLLILGNRHVSICRELTKTYEEFLRGTLEEAVHWAREATIKGEFCLIVEGNGEKVEP  240

Query:  244  KDS--SQQDPLVLVKEYIANGDKTNQAIKKVAKEFNLNRQELYASFH              288
             ++          P+    V+ YIA G ++ +AIK+VA +   + ++++Y  +H
Sbjct:  241  EEVWWESLSPVQHVEHYIALGFRSKEAIKQVATDRGVPKRDIYNIYH              287
```

A related DNA sequence was identified in *S. pyogenes* <SEQ ID 2183> which encodes the amino acid sequence <SEQ ID 2184>. Analysis of this protein sequence reveals the following:

A related GBS gene <SEQ ID 8643> and protein <SEQ ID 8644> were also identified. Analysis of this protein sequence reveals the following:

```
Possible site: 35
>>> Seems to have no N-terminal signal sequence
INTEGRAL     Likelihood = -4.09    Transmembrane 116-132 (116-134)
----- Final Results -----
    bacterial membrane --- Certainty = 0.2635 (Affirmative) <succ>
     bacterial outside --- Certainty = 0.0000 (Not Clear) <succ>
    bacterial cytoplasm --- Certainty = 0.0000 (Not Clear) <succ>
```

```
Lipop: Possible site: -1    Crend: 10
McG: Discrim Score: -6.92
GvH: Signal Score (-7.5): -9.26
Possible site: 48
>>> Seems to have no N-terminal signal sequence
ALOM program count: 1 value: -1.28  threshold: 0.0
INTEGRAL     Likelihood = -1.28   Transmembrane 118-134 (118-134)
PERIPHERAL   Likelihood = 6.89    32
modified ALOM score: 0.76
*** Reasoning Step: 3
----- Final Results -----
```

The protein has homology with the following sequences in the databases:

```
>GP:BAB03768 GB:AP001507 unknown conserved protein [Bacillus halodurans]
Identities = 139/287 (48%), Positives = 189/287 (65%), Gaps = 2/287 (0%)

Query:     1  MQVQKSFKDKKTSGTLYLVPTPIGNLQDMTFRAVATLKEVDFICAEDTRNTGLLLKHFDI   60
              M+ Q+S++ +   GTLYLV TPIGNL+D+TFRA+ TLKE D I AEDTR T  LL HFDI
Sbjct:     1  MKTQQSYQQRDDKGTLYLVATPIGNLEDVTFRAIRTLKEADQIAAEDTRQTKKLLNHFDI   60

Query:    61  ATKQISFHEHNAYEKIPDLIDLLISGRSLAQVSDAGMPSISDPGHDLVKAAIDSDIAVVA  120
              ATK +S+HEHN     LID LI GR++A VSDAGMP+ISDPG++LV +AI    IAV+
Sbjct:    61  ATKLVSYHEHNKETMGKRLIDDLIEGRTIALVSDAGMPAISDPGYELVVSAIKEGIAVIP  120

Query:   121  LPGASAGITALIASGLAPQPHVFYGFLPRKAGQQKAFFEDKHHYPETQMFYESPYRIKDT  180
              +PGA+A +TALIASGL +  F GFLPR+ Q++  E+        T +FYESP+R+KDT
Sbjct:   121  IPGANAAVTALIASGLPTESFQFIGFLPRQKKQRRQALEETKPTKATLIFYESPHRLKDT  180

Query:   181  LTNMLACYGDRQVVLVRELTKLFEEYQRGSISEILSYLEETPLKGECLLIVA--GAQADS  238
              L +ML   G+R V + RELTK +EE+ RG++ E + +  E  +KGE LIV   G + +
Sbjct:   181  LDDMLLILGNRHVSICRELTKTYEEFLRGTLEEAVHWAREATIKGEFCLIVEGNGEKVEP  240

Query:   239  EVELTADVDLSLVQKEIQAGAKPNQAIKTIAKAYQVNRQELYQQFH                285
              E     + V V+  I G +  +AIK +A    V ++++Y  +H
Sbjct:   241  EEVWWESLSPVQHVEHYIALGFRSKEAIKQVATDRGVPKRDIYNIYH                287
```

An alignment of the GAS and GBS proteins is shown below:

```
Identities = 208/287 (72%), Positives = 238/287 (82%)

Query:     4  MQVQKSFKSNIHYGTLYLVPTPIGNLDDMTFRAIRILREVDFICAEDTRNTGLLLKHFDI   63
              MQVQKSFK      GTLYLVPTPIGNL DMTFRA+  L+EVDFICAEDTRNTGLLLKHFDI
Sbjct:     1  MQVQKSFKDKKTSGTLYLVPTPIGNLQDMTFRAVATLKEVDFICAEDTRNTGLLLKHFDI   60

Query:    64  TTKQISFHEHNAYDKISGLIDLLKEGKSLAQVSDAGMPSISDPGHDLVKAAIEGDIPVVS  123
               TKQISFHEHNAY+KI  LIDLL  G+SLAQVSDAGMPSISDPGHDLVKAAI+ DI VV+
Sbjct:    61  ATKQISFHEHNAYEKIPDLIDLLISGRSLAQVSDAGMPSISDPGHDLVKAAIDSDIAVVA  120

Query:   124  IPGASAGITALIASGLAPQPHIFYGFLPRKKGQQITFFETKQDYPETQIFYESPFRVSDT  183
              +PGASAGITALIASGLAPQPH+FYGFLPRK GQQ  FFE K  YPETQ+FYESP+R+ DT
Sbjct:   121  LPGASAGITALIASGLAPQPHVFYGFLPRKAGQQKAFFEDKHHYPETQMFYESPYRIKDT  180

Query:   184  LKHMKEIYGDRQVVLVRELTKLYEEYQRGTISQLLEHIEKVPLKGECLIIVDGKRDTERV  243
              L +M   YGDRQVVLVRELTKL+EEYQRG+IS++L  ++E+ PLKGECL+IV G +   V
Sbjct:   181  LTNMLACYGDRQVVLVRELTKLFEEYQRGSISEILSYLEETPLKGECLLIVAGAQADSEV  240

Query:   244  KDSSQQDPLVLVKEYIANGDKTNQAIKKVAKEFNLNRQELYASFHDL               290
              + ++  D + LV++ I  G K NQAIK +AK + +NRQELY  FHDL
Sbjct:   241  ELTADVDLSLVQKEIQAGAKPNQAIKTIAKAYQVNRQELYQQFHDL               287
``` bacterial membrane --- Certainty = 0.1510 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the databases:

(cutC). Analysis of this protein sequence reveals the following:

Possible site: 41
>>> Seems to have no N-terminal signal sequence
----- Final Results -----

```
ORF00263(310-1164 of 1470)
EGAD|17863|BS0036(2-289 of 292) hypothetical 33.0 kd protein in xpac-abrb intergenic
region {Bacillus subtilis} OMNI|NT01BS0044 conserved hypothetical protein
SP|P37544|YABC_BACSU HYPOTHETICAL 33.0 KDA PROTEIN IN XPAC-ABRB INTERGENIC REGION.
GP|467425|dbj|BAA05271.1||D26185 unknown {Bacillus subtilis}
GP|2632303|emb|CAB11812.1||Z99104 similar to hypothetical proteins {Bacillus subtilis}
PIR|S66065|S66065 conserved hypothetical protein yabC - Bacillus subtilis
% Match = 24.5
% Identity = 45.8 % Similarity = 65.7
Matches = 131 Mismatches = 97 Conservative Sub.s = 57

123       153       183       213       243       273       303       333
       CSTH*KW*TS*ASERY*SRNRNCS*KF*TRKRITRRHLQ*WLSHL*YFLWSTS*K*RRMCFLY*III*RLMEMQVQKSFK
                                                                             :: | ||
                                                                             MLRRQMSFN 363       393       423       453       483       513       543       573
       SNIHYGTLYLVPTPIGNLDDMTFRAIRILREVDFICAEDTRNTGLLLKHFDITTKQISFHEHNAYDKISGLIDLLKEGKS
       | |||||||||||:||||||  |: || | ||||| |  |   ::| |  :|:||||       :|:  ||  ||:
       GKSDMGILYLVPTPIGNLEDMTFRAIDTLKSVDAIAAEDTRQTKKLCHVYEIETPLVSYHEHNKESSGHKIIEWLKSGKN
           20        30        40        50        60        70        80

603       633       663       693       723       753       783       813
       LAQVSDAGMPSISDPGHDLVKAAIEGDIPVVSIPGASAGITALIASGLAPQPHIFYGFLPRKKGQQITFFETKQDYPETQ
       :| |||||:|:||||| ::||   :    || :|||:|   |||| |:|:    |||| :|: :: ::|    ||
       IALVSDAGLPTISDPGAEIVKDFTDIGGYVVPLPGANAALTALIASGIVPQPFFFYGFLNRQKKEKKKELEALKKRQETI
           100       110       120       130       140       150       160

843       873       903       933       963       993      1023      1053
       IFYESPFRVSDTLKHMKEIYGDRQVVLVRELTKLYEEYQRGTISQLLEHIEKVPLKGECLIIVDGKRDTERVKDSSQQDP
       ||||:| : :|| | || ||::  :|||| |||: ||||:::    :  ::||  ::|:|  : |    ::
       IFYEAPHRLKETLSAMAEILGDREIAVTRELTKKYEEFIRGTISEVIGWANEDQIRGEFCLVVEGSNNEEVDEEEQWWET
           180       190       200       210       220       230       240

1074      1104      1134      1164      1194      1224      1254      1284
       LVL---VKEYIANGDKTNQAIKKVAKEFNLNRQELYASFHDL*VII*KGCQRKIWQPFIISDLAIGIKK*DTSNFLKIFN
       |    |: ||:|  :  :||||  |  |: :::|:| ::|
       LTAKEHVEHYISKGATSKEAIKKAAVDRNVPKREVYDAYHIKQ
           260       270       280       290
```

SEQ ID 8644 (GBS343) was expressed in *E. coli* as a His-fusion product. SDS-PAGE analysis of total cell extract is shown in FIG. 72 (lane 11; MW 35.4 kDa).

Figure 277:
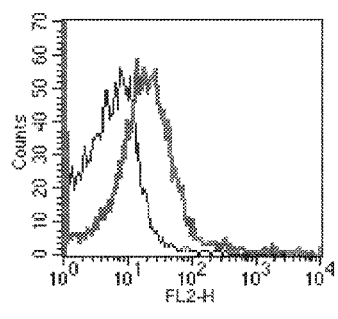

The GBS343-His fusion product was purified (FIG. 215, lane 4) and used to immunise mice. The resulting antiserum was used for FACS (FIG. 277), which confirmed that the protein is immunoaccessible on GBS bacteria.

Based on this analysis, it was predicted that these proteins and their epitopes could be useful antigens for vaccines or diagnostics.

Example 709

A DNA sequence (GBSx0753) was identified in *S. agalactiae* <SEQ ID 2185> which encodes the amino acid sequence <SEQ ID 2186>. This protein is predicted to be bA483F11.3

-continued bacterial cytoplasm --- Certainty = 0.2568 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database:

```
>GP:CAB88199 GB:AL133353 bA483F11.3 (CGI-32 protein) [Homo sapiens]
Identities = 79/203 (38%), Positives = 116/203 (56%), Gaps = 7/203 (3%)
Query:    3 LREFCAENLTDLTRLDKAIISRVELCDNLAVGGTTPSYGVIKEANQYLHEKGISVAVMIR   62
              L E C +++       ++   R+ELC  L+ GGTTPS GV++   Q +    I V VMIR
Sbjct:   27 LMEVCVDSVESAVNAERGGADRIELCSGLSEGGTTPSHGVLQVVKQSVQ---IPVFVMIR   83

Query:   63 PRGGNFVYNDLELRIMEEDILRAVELESDALVLGILTSNNHIDTEAIEQLLPATQGLPLV  122
              PRGG+F+Y+D E+ +M+ DI  A     +D LV G LT + HID E     L+   + LP+
Sbjct:   84 PRGGDFLYSDREIEVMKADIRLAKLYGADGLVFGALTEDGHIDKELCMSLMAICRPLPVT  143

Query:  123 FHMAFDVIPKSDQKKSIDQLVALGFTRILLHGSSNGEPIIENIKHIKALVEYANNRIEIM  182
              FH AFD++    D    +++ L+ LGF R+L  G +     +E +   IK L+E A  RI +M
Sbjct:  144 FHRAFDMV--HDPMAALETLLTLGFERVLTSGCDSS--ALEGLPLIKRLIEQAKGRIVVM  199

Query:  183 VGGGVTAENYQYICQETGVKQAH                                      205
                GGG+T   N Q I + +G  + H
Sbjct:  200 PGGGITDRNLQRILEGSGATEFH                                      222
```

A related DNA sequence was identified in *S. pyogenes* <SEQ ID 2187> which encodes the amino acid sequence <SEQ ID 2188>. Analysis of this protein sequence reveals the following:

Possible site: 57
>>> Seems to have no N-terminal signal sequence
----- Final Results -----
  bacterial cytoplasm --- Certainty = 0.2372 (Affirmative) <succ>
  bacterial membrane --- Certainty = 0.0000 (Not Clear) <succ>
  bacterial outside --- Certainty = 0.0000 (Not Clear) <succ>

Possible site: 23
>>> Seems to have no N-terminal signal sequence
----- Final Results -----
  bacterial cytoplasm --- Certainty = 0.1216 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below:

The protein has homology with the following sequences in the GENPEPT database:

```
Identities = 143/208 (68%), Positives = 168/208 (80%)
Query:    2 ILREFCAENLTDLTRLDKAIISRVELCDNLAVGGTTPSYGVIKEANQYLHEKGISVAVMI   61
              +++EFCAENLT L  LD    ISRVELCDNLAVGGTTPSYGVIKEA Q LH+K ISVA MI
Sbjct:    1 MIKEFCAENLTLLPTLDAGQISRVELCDNLAVGGTTPSYGVIKEACQLLHDKKISVATMI   60

Query:   62 RPRGGNFVYNDLELRIMEEDILRAVELESDALVLGILTSNNHIDTEAIEQLLPATQGLPL  121
              RPRGG+FVYNDLEL+ MEEDIL+AVE   SDALVLG+LT+ N +DT+AIEQLLPATQGLPL
Sbjct:   61 RPRGGDFVYNDLELKAMEEDILKAVEAGSDALVLGLLTTENQLDTDAIEQLLPATQGLPL  120

Query:  122 VFHMAFDVIPKSDQKKSIDQLVALGFTRILLHGSSNGEPIIENIKHIKALVEYANNRIEI  181
              VFHMAFD IP   Q  +++DQL+   GF R+L HGS    PI +N++ +K+LV YAN RIEI
Sbjct:  121 VFHMAFDRIPTDHQHQALDQLIDYGFVRVLTHGSPEATPITDNVEQLKSLVTYANKRIEI  180

Query:  182 MVGGGVTAENYQYICQETGVKQAHGTRI                                 209
              M+GGG+TAEN Q + Q TG    HGT+I
Sbjct:  181 MIGGGITAENCQSLSQLTGTAIVHGTKI                                 208
```

Based on this analysis, it was predicted that these proteins and their epitopes could be useful antigens for vaccines or diagnostics.

Example 710

A DNA sequence (GBSx0754) was identified in *S. agalactiae* <SEQ ID 2189> which encodes the amino acid sequence <SEQ ID 2190>. Analysis of this protein sequence reveals the following:

```
>GP:BAA12206 GB:D84061 phosphoserine aminotransferase [Spinacia
oleracea]
Identities = 65/109 (59%), Positives = 79/109 (71%), Gaps = 1/109 (0%)
Query:    3 IYNFSAGPAVLPKPVLVKAQSELLNYQGSSMSVLEVSHRSKEFDDIIKGAERYLRDLMGI   62
              ++NF+AGPAVLP+ VL KAQSELLN++GS MSV+E+SHR KEF  II  AE  LR L+ I
Sbjct:   69 VFNFAAGPAVLPENVLQKAQSELLNWRGSGMSVMEMSHRGKEFTSIIDKAEADLRTLLNI  128
```

```
Query:  63  PDNYKVIFLQGGASLQFSMIPLNIARGRKAY-YHVAGSWGEKSLYRGCK          110
            P +Y V+FLQGGAS QFS IPLN+      A  Y V GSWG+K+     K
Sbjct: 129  PSDYTVLFLQGGASTQFSAIPLNLCTPDSAVDYIVTGSWGDKAAKEAAK          177
```

No corresponding DNA sequence was identified in *S. pyogenes*.

Based on this analysis, it was predicted that this protein and its epitopes, could be useful antigens for vaccines or diagnostics.

Example 711

A DNA sequence (GBSx0755) was identified in *S. agalactiae* <SEQ ID 2191> which encodes the amino acid sequence <SEQ ID 2192>. Analysis of this protein sequence reveals the following:

Possible site: 24
>>> Seems to have an uncleavable N-term signal seq
----- Final Results -----
 bacterial membrane --- Certainty = 0.0000 (Not Clear) <succ>
   bacterial outside --- Certainty = 0.0000 (Not Clear) <succ>
      bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 712

A DNA sequence (GBSx0756) was identified in *S. agalactiae* <SEQ ID 2193> which encodes the amino acid sequence <SEQ ID 2194>. This protein is predicted to be phosphoserine aminotransferase (serC). Analysis of this protein sequence reveals the following:

Possible site: 50
>>> Seems to have no N-terminal signal sequence
----- Final Results -----
  bacterial cytoplasm --- Certainty = 0.3380 (Affirmative) <succ>
     bacterial membrane --- Certainty = 0.0000 (Not Clear) <succ>
        bacterial outside --- Certainty = 0.0000 (Not Clear) <succ>

A related GBS nucleic acid sequence <SEQ ID 10049> which encodes amino acid sequence <SEQ ID 10050> was also identified.

The protein has homology with the following sequences in the GENPEPT database:

```
>GP:AAF94318 GB:AE004196 phosphoserine aminotransferase [Vibrio cholerae]
Identities = 104/210 (49%), Positives = 152/210 (71%), Gaps = 3/210 (1%)
Query:    4  NNTIEGTSLYDIPKTNEVPVIADMSSNILAVKYKVEDFAMIYAGAQKNIGPAGVTVVIIR    63
             N TI+G  + D+P T++ P++ADMSS IL+ +  V  + +IYAGAQKNIGPAG+ + I+R
Sbjct: 170  NETIDGIEINDLPVTDK-PIVADMSSTILSREIDVSKYGVIYAGAQKNIGPAGICIAIVR    228

Query:   64  EDMIN-EEPTLSSMLDYKIQSDAGSLYNTPPAYSIYIAELVFEWVKSLGGVDAMEKANRE    122
             +D+++      L  +L+YKI ++   S++NTPP ++ Y++ LVF+W+K+ GGV A+E+ NR
Sbjct: 229  DDLLDLASDLLPGVLNYKILAEQESMFNTPPTFAWYLSGLVFQWLKAQGGVKAIEEVNRA    288

Query:  123  KSGLLYDIDSSEFYSNPVRDKKSRSLCNIPFITINKDLDEKFVKEATERGFKNIKGHRS    182
             K+ LLY YIDSS+FY N +    +RSL N+PF     +LD+ F++ A  RG  ++KGHR
Sbjct: 289  KAALLYGYIDSSDFYRNEIH-PDNRSLMNVPFQLAKPELDDTFLELAEARGLVSLKGHRV    347

Query:  183  VGGMRASLYNAFPKQGVIELIDFMKTFEAE                                212
             VGGMRAS+YNA P +GV  L+DFMK FEA+
Sbjct: 348  VGGMRASIYNAMPLEGVQALVDFMKEFEAQ                                377
```

No corresponding DNA sequence was identified in *S. pyogenes*.

Based on this analysis, it was predicted that these proteins and their epitopes could be useful antigens for vaccines or diagnostics.

Example 713

A DNA sequence (GBSx0757) was identified in *S. agalactiae* <SEQ ID 2195> which encodes the amino acid sequence <SEQ ID 2196>. Analysis of this protein sequence reveals the following:

Possible site: 27
>>> Seems to have no N-terminal signal sequence
----- Final Results -----
  bacterial cytoplasm --- Certainty = 0.0466 (Affirmative) <succ>
     bacterial membrane --- Certainty = 0.0000 (Not Clear) <succ>
        bacterial outside --- Certainty = 0.0000 (Not Clear) <succ>

A related GBS nucleic acid sequence <SEQ ID 10047> which encodes amino acid sequence <SEQ ID 10048> was also identified.

The protein has homology with the following sequences in the GENPEPT database:

```
>GP:CAB73701 GB:AL139079 putative acetyltransferase [Campylobacter
jejuni]
Identities = 46/170 (27%), Positives = 78/170 (45%), Gaps = 13/170 (7%)
Query:    7 IRLAFPNEIDQIMLLIEEARAEIAKTGSDQWQKEDGYPNRNDIIDDILNGYAWVGIEDGM    66
             I+ A   +++ I+ + ++A   +     QW  ++ YPN    +DI    +V  E+
Sbjct:    6 IQKAVNKDLNSILEITKDALNAMKTMNFHQW--DENYPNEIVFQEDIQAQELYVFKENDE   63

Query:   67 LATYAAVIDGHE-EVYDAIYEGKWLHDNHRYLTFHRIAISNQFRGRGLAQTFLQGL----  121
             +  +  ++   + E Y  +   K   D    YL  HR+A+     +G+G+AQ  L
Sbjct:   64 ILGFICINEKFKPEFYKQVIFNKNYDDKAFYL--HRLAVKQNAKGKGVAQKLLNFCENFA  121

Query:  122 IEGHKGPDFRCDTHEKNVTMQHILNKLGYQYCGKVPLDGVR---LAYQKI            168
             +E HK     R DTH KN M  +  KL + +CG  +   +    LAY+KI
Sbjct:  122 LENHKA-SLRADTHSKNFPMNSLFKKLDFNFCGNFDIPNYQDPFLAYEKI            170
```

No corresponding DNA sequence was identified in *S. pyogenes*.

Based on this analysis, it was predicted that these proteins and their epitopes could be useful antigens for vaccines or diagnostics.

Example 714

A DNA sequence (GBSx0758) was identified in *S. agalactiae* <SEQ ID 2197> which encodes the amino acid sequence <SEQ ID 2198>. Analysis of this protein sequence reveals the following:

Possible site: 28
>>> Seems to have no N-terminal signal sequence
----- Final Results -----
  bacterial cytoplasm --- Certainty = 0.2968 (Affirmative) <succ>
  bacterial membrane --- Certainty = 0.0000 (Not Clear) <succ>
  bacterial outside --- Certainty = 0.0000 (Not Clear)<succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 715

A DNA sequence (GBSx0759) was identified in *S. agalactiae* <SEQ ID 2199> which encodes the amino acid sequence <SEQ ID 2200>. This protein is predicted to be D-3-phosphoglycerate dehydrogenase (serA). Analysis of this protein sequence reveals the following:

Possible site: 54
>>> Seems to have no N-terminal signal sequence
----- Final Results -----
  bacterial cytoplasm --- Certainty = 0.3102 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 10045> which encodes amino acid sequence <SEQ ID 10046> was also identified.

The protein has homology with the following sequences in the GENPEPT database:

```
>GP:AAB99020 GB:U67544 phosphoglycerate dehydrogenase (serA)
[Methanococcus jannaschii]
Identities = 102/313 (32%), Positives = 168/313 (53%), Gaps = 21/313 (6%)
Query:   31 ENPDAYIIRSQNLHNQDF---PSNLKAIARAGAGINNIPIEEASAQGIVVENTPGANANA    87
             ++ D  ++RS    +D        LK I RAG G +NI +E A+ +GI+V N P A++ +
Sbjct:   40 KDADVLVVRSGTKVTRDVIEKAEKLKVIGRAGVGVDNIDVEAATEKGIIVVNAPDASSIS    99

Query:   88 VKEAVIAALLLSARDYLGANRWVNTLTGTDIPKQIEAGKKAFAGNEIAGKKLGVIGLGAI   147
             V E  + +L +AR   N    T   K+  E  +K F G E+ GK LGVIGLG I
Sbjct:  100 VAELTMGLMLAAAR---------NIPQATASLKRGEWDRKRFKGIELYGKTLGVIGLGRI   150

Query:  148 GARIANDARRLGMTVLGYDPYVSIETAWNISSHVQRVKEIKDIFETCDYITIHVPLTNET   207
             G ++    A+  GM ++GYDPY+   E A ++      V+ V +I ++  + D+IT+HVPLT  +T
Sbjct:  151 GQQVVERAKAFGMNIIGYDPYIPKEVAESMG--VELVDDINELCKRADFITLHVPLTPKT   208

Query:  208 KHTFDAKAFSIMKKGTTIINFARAELVNNQELFEAIETGVVKRYITDFGDKE------LL   261
             +H   +  ++MKK     I+N AR  L++ + L+EA++  G ++       D  ++E      LL
Sbjct:  209 RHIIGREQIALMKKNAIIVNCARGGLIDEKALYEALKEGKIRAAALDVFEEEPPKDNPLL   268

Query:  262 NQKGITVFPHVGGSTDEAELNCAIMASQTIRCFMETGEITNSVNFPNVHQIQTAPFR-IT   320
                +   PH G ST+EA+      + ++ I+   +     N VN PN+ Q +         +
Sbjct:  269 TLDNVIGTPHQGASTEEAQKAAGTIVAEQIKKVLRGELAENVVNMPNIPQEKLGKLKPYM   328

Query:  321 LINKNVPNIVAKI                                                333
             L+ + +  NIV ++
Sbjct:  329 LLAEMLGNIVMQV                                                341
```

There is also homology to SEQ ID 124.

Based on this analysis, it was predicted that these proteins and their epitopes could be useful antigens for vaccines or diagnostics.

Example 716

A DNA sequence (GBSx0760) was identified in *S. agalactiae* <SEQ ID 2201> which encodes the amino acid sequence <SEQ ID 2202>. This protein is predicted to be methylated-DNA-protein-cysteine S-methyltransferase (ogt). Analysis of this protein sequence reveals the following:

Possible site: 18
>>> Seems to have no N-terminal signal sequence
----- Final Results -----
    bacterial cytoplasm --- Certainty = 0.2460 (Affirmative) <succ>
    bacterial membrane --- Certainty = 0.0000 (Not Clear) <succ>
    bacterial outside --- Certainty = 0:0000 (Not Clear) <succ>

The protein has homology with the following sequences in the GENPEPT database:

```
>GP:BAB07204 GB:AP001518 arsenate reductase [Bacillus halodurans]
Identities = 56/107 (52%), Positives = 74/107 (68%), Gaps = 1/107 (0%)
Query:   3 TFYEYPKCTTCRSAKKELTELGLTFEAIDIKSNPPKVSLLKELLENSPYDLKKFFNTSGN  62
           TFY+YPKC TC+ AKK L + G+    ++ I     PP    LK+L E S  +LKKFFNTSG
Sbjct:   4 TFYQYPKCGTCQKAKKWLDQHGIEVNSVHIVEQPPSKEELKQLYEQSGLELKKFFNTSGK  63

Query:  63 SYRELGLKDKFDDLTLDQALDLLASDGMLIKRPLLVKDNKILQIGYR              109
           YRELGLKDK + + D+ L+ LASDGMLIKRP+L    +K+  +G++
Sbjct:  64 KYRELGLKDKVKEASEDELLETLASDGMLIKRPILTDGDKV-TVGFK              109
```

Possible site: 42
>>> Seems to have no N-terminal signal sequence
----- Final Results -----
    bacterial cytoplasm --- Certainty = 0.3137 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database:

A related DNA sequence was identified in *S. pyogenes* <SEQ ID 2205> which encodes the amino acid sequence <SEQ ID 2206>. Analysis of this protein sequence reveals the following:

Possible site: 38
>>> Seems to have no N-terminal signal sequence
----- Final Results -----
    bacterial cytoplasm ---Certainty = 0.3968 (Affirmative) <succ>

```
>GP:AAF96913 GB:AE004427 methylated-DNA--protein-cysteine
S-methyltransferase [Vibrio cholerae]
Identities = 73/156 (46%), Positives = 99/156 (62%), Gaps = 9/156 (5%)
Query:   7 YQSPLGEIRLLADNLGLSGLYFVGQKYDMLAVNQEEIVNMSNSYTLLGK--KWLDAYFSQ   64
           Y SPLG + L A + GL G++F  Q          E + +      +L K   + LD YFS
Sbjct:   7 YSSPLGPMTLQASSQGLLGVWFATQ-----TTQPEHLGDYVKECPILNKTIRQLDEYFSG   61

Query:  65 QNLP-SIPLSLRGTAFQTRVWQELQKIPFGDTKTYGELAKEL-NCQSAQAVGGAIGKNSI  122
           Q      +PL+  GTAFQ  VW  L KIP+G+   +Y +LA+ + N ++ +AVG A GKN I
Sbjct:  62 QRTQFELPLAASGTAFQQSVWHALCKIPYGEIWSYQQLAEAIGNPKAVRAVGLANGKNPI  121

Query: 123 SLIIPCHRVLGRYGQLTGYAGGLERKSWLLEYEKEK                         158
           S+I+PCHRV+G+ GQLTGYAGGLERK++LLE EK +
Sbjct: 122 SIIVPCHRVVGKNGQLTGYAGGLERKAFLLELEKRR                         157
```

No corresponding DNA sequence was identified in *S. pyogenes*.

Based on this analysis, it was predicted that this protein and its epitopes, could be useful antigens for vaccines or diagnostics.

Example 717

A DNA sequence (GBSx0761) was identified in *S. agalactiae* <SEQ ID 2203> which encodes the amino acid sequence <SEQ ID 2204>. Analysis of this protein sequence reveals the following:

-continued bacterial membrane --- Certainty = 0.0000 (Not Clear) <succ>
    bacterial outside --- Certainty = 0.0000 (Not Clear) <succ>

An alignment of the GAS and GBS proteins is shown below:

```
Identities = 64/99 (64%), Positives = 79/99 (79%)
Query:  19 ELTELGLTFEAIDIKSNPPKVSLLKELLENSPYDLKKFFNTSGNSYRELGLKDKFDDLTL   78
            EL +L   FEAIDIK+NPPK   LK  +E S Y +K FFNTSGNSYRELGLKDK D L+L
Sbjct:   3 ELKQLVSDFEAIDIKANPPKAQDLKHWMETSGYTIKNFFNTSGNSYRELGLKDKIDQLSL   62

Query:  79 DQALDLLASDGMLIKRPLLVKDNKILQIGYRTKYKDLNL                      117
            D+A +LLA+DGMLIKRP+L+KD  +LQ+GYR Y++L+L
Sbjct:  63 DKAAELLATDGMLIKRPILIKDGNVLQVGYRKPYQELDL                      101
```

Based on this analysis, it was predicted that these proteins and their epitopes could be useful antigens for vaccines or diagnostics.

Example 718

A DNA sequence (GBSx0762) was identified in *S. agalactiae* <SEQ ID 2207> which encodes the amino acid sequence <SEQ ID 2208>. This protein is predicted to be exodeoxyribonuclease (exoA). Analysis of this protein sequence reveals the following:

---
Possible site: 22
>>> Seems to have no N-terminal signal sequence
----- Final Results -----
    bacterial cytoplasm --- Certainty = 0.1859 (Affirmative) <succ>
        bacterial membrane --- Certainty = 0.0000 (Not Clear) <succ>
            bacterial outside --- Certainty = 0.0000 (Not Clear) <succ>
---

The protein has homology with the following sequences in the GENPEPT database:

A related DNA sequence was identified in *S. pyogenes* <SEQ ID 2209> which encodes the amino acid sequence <SEQ ID 2210>. Analysis of this protein sequence reveals the following:

---
Possible site: 13
>>> Seems to have no N-terminal signal sequence
----- Final Results -----
    bacterial cytoplasm --- Certainty = 0.2181 (Affirmative) <succ>
        bacterial membrane --- Certainty = 0.0000 (Not Clear) <succ>
            bacterial outside --- Certainty = 0.0000 (Not Clear) <succ>
---

An alignment of the GAS and GBS proteins is shown below:

```
>GP:AAA26879 GB:J04234 exodeoxyribonuclease [Streptococcus pneumoniae]
Identities = 217/275 (78%), Positives = 245/275 (88%)
Query:    1 MKLISWNIDSLNAALTSESTRALMSRQVIDTLVAEDADIIAIQETKLSAKGPTKKHLEVL   60
            MKLISWNIDSLNAALTS+S RA +S++V+ TLVAE+ADIIAIQETKLSAKGPTKKH+E+L
Sbjct:    1 MKLISWNIDSLNAALTSDSARAKLSQEVLQTLVAENADIIAIQETKLSAKGPTKKHVEIL   60

Query:   61 ETYFPEYDLVWRSSVEPARKGYAGTMFLYRKGLNPIVSFPEIDAPTTMDNEGRIITLELE  120
            E  FP Y+  WRSS EPARKGYAGTMFLY+K L P +SFPEI AP+TMD EGRIITLE +
Sbjct:   61 EELFPGYENTWRSSQEPARKGYAGTMFLYKKELTPTISFPEIGAPSTMDLEGRIITLEFD  120

Query:  121 NCYITQVYTPNAGDGLKRLADRQIWDIKYAEYLATLDSQKPVLATGDYNVAHKEIDLANP  180
              ++TQVYTPNAGDGLKRL +RQ+WD KYAEYLA LD +KPVLATGDYNVAH EIDLANP
Sbjct:  121 APFVTQVYTPNAGDGLKRLEERQVWDAKYAEYLAELDKEKPVLATGDYNVAHNEIDLANP  180

Query:  181 SSNRRSAGFTAEERQGFTNLLAKGFTDTFRYLHGDVPNVYSWWAQRSRTSKINNTGWRID  240
            +SNRRS GFT EER GFTNLLA GFTDTFR++HGDVP  Y+WWAQRS+TSKINNTGWRID
Sbjct:  181 ASNRRSPGFTDEERAGFTNLLATGFTDTFRHVGDVPERYTWWAQRSKTSKINNTGWRID  240

Query:  241 YWLTSNRVADKITKSEMIHSGDRQDHTPIILEIEL                          275
            YWLTSNR+ADK+TKS+MI SG RQDHTPI+LEI+L
Sbjct:  241 YWLTSNRIADKVTKSDMIDSGARQDHTPIVLEIDL                          275
```

```
Identities = 221/275 (80%), Positives = 251/275 (90%)
Query:   1  MKLISWNIDSLNAALTSESTRALMSRQVIDTLVAEDADIIAIQETKLSAKGPTKKHLEVL  60
            MKLISWNIDSLNAALT ES RAL+SR V+DTLVA+DADIIAIQETKLSAKGPTKKH+E L
Sbjct:   1  MKLISWNIDSLNAALTGESPRALLSRAVLDTLVAQDADIIAIQETKLSAKGPTKKHIETL  60

Query:  61  ETYFPEYDLVWRSSVEPARKGYAGTMFLYRKGLNPIVSFPEIDAPTTMDNEGRIITLELE  120
            +YFP Y  VWRSSVEPARKGYAGTMFLY+  LNP+++FPEI APTTMD EGRIITLE E
Sbjct:  61  LSYFPNYLHVWRSSVEPARKGYAGTMFLYKNTLNPVITFPEIGAPTTMDAEGRIITLEFE  120

Query: 121  NCYITQVYTPNAGDGLKRLADRQIWDIKYAEYLATLDSQKPVLATGDYNVAHKEIDLANP  180
            + ++TQVYTPNAGDGL+RL DRQIWD KYA+YL  LD+QKPVLATGDYNVAHKEIDLANP
Sbjct: 121  DFFVTQVYTPNAGDGLRRLDDRQIWDHKYADYLTELDAQKPVLATGDYNVAHKEIDLANP  180

Query: 181  SSNRRSAGFTAEERQGFTNLLAKGFTDTFRYLHGDVPNVYSWWAQRSRTSKINNTGWRID  240
            +SNRRS GFT EERQGFTNLLA+GFTDTFR++HGD+P+VY+WWAQRS+TSKINNTGWRID
Sbjct: 181  NSNRRSPGFTDEERQGFTNLLARGFTDTFRHVHGDIPHVYTWWAQRSKTSKINNTGWRID  240

Query: 241  YWLTSNRVADKITKSEMIHSGDRQDHTPIILEIEL                          275
            YWL SNR+ DK+ +SEMI SG+RQDHTPI+L+I+L
Sbjct: 241  YWLASNRLVDKVKRSEMISSGERQDHTPILLDIDL                          275
```

Based on this analysis, it was predicted that these proteins and their epitopes could be useful antigens for vaccines or diagnostics.

Example 719

A DNA sequence (GBSx0763) was identified in *S. agalactiae* <SEQ ID 2211> which encodes the amino acid sequence <SEQ ID 2212>. Analysis of this protein sequence reveals the following:

Possible site: 39
>>> Seems to have no N-terminal signal sequence
INTEGRAL    Likelihood = −7.96    Transmembrane 28-44 (22-49)
----- Final Results -----
   bacterial membrane --- Certainty = 0.4185 (Affirmative) <succ>
     bacterial outside --- Certainty = 0.0000 (Not Clear) <succ>
       bacterial cytoplasm --- Certainty = 0.0000 (Not Clear) <succ>

A related GBS nucleic acid sequence <SEQ ID 8645> which encodes amino acid sequence <SEQ ID 8646> was also identified. Analysis of this protein sequence reveals the following:

Lipop Possible site: −1  Crend: 5
McG: Discrim Score: 17.78
GvH: Signal Score (−7.5): −4.56
Possible site: 55
>>> Seems to have an uncleavable N-term signal seq
ALOM program    count: 1 value: −7.96 threshold: 0.0
INTEGRAL    Likelihood = −7.96    Transmembrane 8-24 (2-29)

PERIPHERAL    Likelihood = 9.28    138
modified ALOM score: 2.09
*** Reasoning Step: 3
----- Final Results -----
   bacterial membrane --- Certainty = 0.4185 (Affirmative) <succ>
     bacterial outside --- Certainty = 0.0000 (Not Clear) <succ>
       bacterial cytoplasm --- Certainty = 0.0000 (Not Clear) <succ>

The protein has homology with the following sequences in the GENPEPT database:

```
>GP:AAD11512 GB:U60828 unknown [Lactococcus lactis]
Identities = 53/240 (22%), Positives = 102/240 (42%), Gaps = 24/240 (10%)
Query:  65  PTILIPGSSATQERFNSMLAQL----NQMGEKHSVLKLTVKKDNSIIYNGQISGNDHKPY  120
            PTI I GS        + ++ +L     N    +K V+   + K+  +   GQIS ++  P
Sbjct:  64  PTIYIGGSGGNVTSIDWLVERLLPIKNISSQKSLVMTSNITKNYELKVEGQISQDNKYPI  123

Query: 121  IVIGFENNEDGYSNIKKQTKWLQIAMNDLQKKYKFKRFNAIGHSNGGLSWTIFLEDYYDS  180
            I         G ++ +  +K LQ  +  L  + Y+       N +G+S+G      ++ D  ++
Sbjct: 124  IEFA---TVKGTNSGELFSKGLQKIIVYLTENYQVPWINLVGYSSGATGAVYYMMDTGNN  180

Query: 181  DEFD-MKSLLTMGTPFNFEES-----NTSN--------HTQMLKDLISNKGNIPSSLMVY  226
            F +     +++    +N E +      + SN            T+M + +   N    + S    +
Sbjct: 181  PNEPPVNKYVSLDGEYNNETNLQLGESLSNVLKEGPIVKTEMYQYIADNYQKVSSKTQML  240

Query: 227  NLAGT--NSYDGDKIVPFASVETGKYIFQETAKHYTQLTVTGNNATHSDLPDNPEVIQYV  284
             L G    +    D    +P+A   +   ++F++    T    T+        +HS   P  NP  V++YV
Sbjct: 241  LLEGNENSEKQTDSAIPWADSFSIYHLFKKNGNEITT-TLYPTKTSHSQAPKNPTVVKYV  299
```

No corresponding DNA sequence was identified in *S. pyogenes*.

Figure 43:
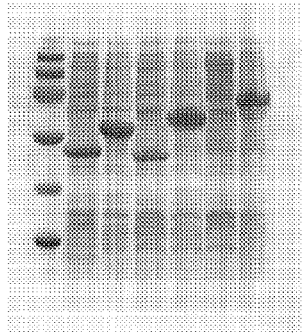

SEQ ID 8646 (GBS219) was expressed in *E. coli* as a His-fusion product. SDS-PAGE analysis of total cell extract is shown in FIG. 43 (lane 3; MW 31.6 kDa). It was also expressed in *E. coli* as a GST-fusion product. SDS-PAGE analysis of total cell extract is shown in FIG. 47 (lane 7; MW 56 kDa).

GBS219-GST was purified as shown in FIG. 203, lane 5.

Based on this analysis, it was predicted that these proteins and their epitopes could be useful antigens for vaccines or diagnostics.

Example 720

A DNA sequence (GBSx0764) was identified in *S. agalactiae* <SEQ ID 2213> which encodes the amino acid sequence <SEQ ID 2214>. This protein is predicted to be PTS system, cellobiose-specific IIC component. Analysis of this protein sequence reveals the following:

Possible site: 46
>>> Seems to have no N-terminal signal sequence
INTEGRAL    Likelihood = −7.64    Transmembrane 263-279 (260-282)
INTEGRAL    Likelihood = −6.26    Transmembrane 200-216 (197-226)
INTEGRAL    Likelihood = −5.95    Transmembrane 157-173 (156-175)
INTEGRAL    Likelihood = −5.79    Transmembrane 307-323 (306-332)
INTEGRAL    Likelihood = −5.68    Transmembrane 131-147 ( 126-148)
INTEGRAL    Likelihood = −4.73    Transmembrane 375-391 ( 370-396)
INTEGRAL    Likelihood = −3.61    Transmembrane 101-117 (98-119)
INTEGRAL    Likelihood = −1.75    Transmembrane 326 -342 (324-342)
INTEGRAL    Likelihood = −0.37    Transmembrane 25-41 (25-41)
INTEGRAL    Likelihood = −0.16    Transmembrane 71-87 (71-88)
----- Final Results -----
    bacterial membrane --- Certainty = 0.4057 (Affirmative) <succ>
        bacterial outside --- Certainty = 0.0000 (Not Clear) <succ>
            bacterial cytoplasm --- Certainty = 0.0000 (Not Clear) <succ>

The protein has homology with the following sequences in the GENPEPT database:

```
>GP:AAC74807 GB:AE000268 PEP-dependent phosphotransferase enzyme II
for cellobiose, arbutin, and salicin [Escherichia coli] K12]
Identities = 60/197 (30%), Positives = 83/197 (41%), Gaps = 12/197 (6%)
Query: 209 LAIPLTLSGLFVPDIL--FRPYSYFSVVSENLNAALSQHTDKIPYLYTFYTVKNSFAMFG 266
           LA+     +G+  P L      Y  +  V    LA  +  H      P L         +SF    G
Sbjct: 253 LALTALDNGIMTPWALENIATYQQYGSVEAALAAGKTFHIWAKPML-------DSFIFLG 305

Query: 267 GIGILLSLFLAVLYESRKLQSKNYYKLTLLTLTPLIFDQNLPFLVGLPVILQPILFIPMV 326
           G  G   L L  LA+    SR+      +Y ++   L L    IF   N P L GLP+I+  P++FIP V
Sbjct: 306 GSGATLGLILAIFIASRRA---DYRQVAKLALPSGIFQINEPILFGLPIIMNPVMFIPFV 362

Query: 327 LTTIFAEAFGALMLYLKFVDPAVYTVPSGTPSLLFGFLASNGDWRYLPVTAIILVVGFFI 386
           L       A       Y+  + P         P    P+ L  F   +NG      L V      L +     I
Sbjct: 363 LVQPILAAITLAAYYMGIIPPVTNIAPWTMPTGLGAFFNTNGSVAALLVALFNLGIATLI 422

Query: 387 YRPFVKIAFAKEEQYEK                                            403
           Y PFV +A     +  +K
Sbjct: 423 YLPFVVVANKAQNAIDK                                            439
```

Based on this analysis, it was predicted that this protein and its epitopes, could be useful antigens for vaccines or diagnostics.

Example 721

A DNA sequence (GBSx0765) was identified in *S. agalactiae* <SEQ ID 2217> which encodes the amino acid sequence <SEQ ID 2218>. Analysis of this protein sequence reveals the following:

Possible site: 14
>>> Seems to have no N-terminal signal sequence
----- Final Results -----
    bacterial cytoplasm --- Certainty = 0.1991 (Affirmative) <succ>
        bacterial membrane --- Certainty = 0.0000 (Not Clear) <succ>
            bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 722

A DNA sequence (GBSx0766) was identified in *S. agalactiae* <SEQ ID 2219> which encodes the amino acid sequence <SEQ ID 2220>. Analysis of this protein sequence reveals the following:

Possible site: 39
>>> Seems to have no N-terminal signal sequence
INTEGRAL    Likelihood = −5.79    Transmembrane 188-204 (179-206)
INTEGRAL    Likelihood =−5.36     Transmembrane 105-121 (104-127)
INTEGRAL    Likelihood = −4.41    Transmembrane 212-228 (210-229)
INTEGRAL    Likelihood = −3.45    Transmembrane 72-88 (69-89)
INTEGRAL    Likelihood = −0.48    Transmembrane 124-140 (124-140)
----- Final Results -----
    bacterial membrane --- Certainty = 0.3314 (Affirmative) <succ>
        bacterial outside --- Certainty = 0.0000 (Not Clear) <succ>
            bacterial cytoplasm --- Certainty = 0.0000 (Not Clear) <succ>

A related GBS nucleic acid sequence <SEQ ID 8647> which encodes amino acid sequence <SEQ ID 8648> was also identified. Analysis of this protein sequence reveals the following:

Lipop Possible site: −1    Crend: 6
SRCFLG: 0
McG: Length of UR: 5
Peak Value of UR: 2.99
Net Charge of CR: 4
McG: Discrim Score: 6.88
GvH: Signal Score (−7.5): −2.86
Possible site: 30
>>> Seems to have an uncleavable N-term signal seq
Amino Acid Composition: calculated from 1
ALOM program count: 5 value: −5.79 threshold: 0.0
INTEGRAL    Likelihood = −5.79    Transmembrane 179-195 (170-197)
INTEGRAL    Likelihood = −5.36    Transmembrane 96-112 (95-118)
INTEGRAL    Likelihood = −4.41    Transmembrane 203-219 (201-220)
INTEGRAL    Likelihood = −3.45    Transmembrane 63-79 (60-80)
PERIPHERAL  Likelihood = 0.10     18
modified ALOM score: 1.66
icmI HYPID: 7              CFP: 0.331
*** Reasoning Step: 3
----- Final Results -----
    bacterial membrane --- Certainty = 0.3314 (Affirmative) <succ>
        bacterial outside --- Certainty = 0.0000 (Not Clear) <succ>
            bacterial cytoplasm --- Certainty = 0.0000 (Not Clear) <succ>

The protein has no significant homology with any sequences in the GENPEPT database.

A related DNA sequence was identified in *S. pyogenes* <SEQ ID 2221> which encodes the amino acid sequence <SEQ ID 2222>. Analysis of this protein sequence reveals the following:

```
Possible site: 30
>>> Seems to have a cleavable N-term signal seq.
INTEGRAL    Likelihood = -11.20    Transmembrane 179-195 (173-201)
INTEGRAL    Likelihood = -3.66     Transmembrane 96-112 (95-113)
INTEGRAL    Likelihood = -1.44     Transmembrane 203-219 (203-219)
INTEGRAL    Likelihood = -0.96     Transmembrane 115-131 (115-131)
INTEGRAL    Likelihood = -0.64     Transmembrane 63-79 (63-79)
----- Final Results -----
   bacterial membrane --- Certainty = 0.5479 (Affirmative) <succ>
     bacterial outside --- Certainty = 0.0000 (Not Clear) <succ>
       bacterial cytoplasm --- Certainty = 0.0000 (Not Clear) <succ>
```

The protein has no significant homology with any sequences in the GENPEPT database.

An alignment of the GAS and GBS proteins is shown below:

```
Possible site: 20
>>> Seems to have no N-terminal signal sequence
INTEGRAL    Likelihood = -0.00    Transmembrane 190-206 (190-206)
----- Final Results -----
   bacterial membrane --- Certainty = 0.1001 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the GENPEPT database:

```
Identities = 160/228 (70%), Positives = 185/228 (80%)
Query:   10 MSKKSHRQYQIYEGLRCAVALCFISGYINAFTYVTQGKRFAGVQTGNLLSFAIHLSNKHY   69
            MSKK   +YQ+YEGLRCA+ LCFISGY+NAFTY+TQGKRFAGVQTGNLLSFAI LS +
Sbjct:    1 MSKKKRKHYQVYEGLRCAMTLCFISGYVNAFTYMTQGKRFAGVQTGNLLSFAIRLSEQQL   60

Query:   70 SQALAFLLPIMVFMLGQSFTYFMNRWANKHQLHWYLLSSFALTQVAIVTIILTPFLPSSF  129
             +AL FLLP++VFMLGQSFTYFM+RWA K  LHWYLLSS  LT +A  T + TPFLPS+
Sbjct:   61 KEALQFLLPMIVFMLGQSFTYFMHRWATKKGLHWYLLSSVILTGIAFGTALFTPFLPSNV  120

Query:  130 TVAGLAFFASIQVDTFKSLRGAPYANMMMTGNIKNAAYLLTKGLYEKNSDIFLIARNTII  189
            TVA LAFFASIQVDTFK+LRGA YAN+MMTGNIKNAAYLLTKGLYEKN ++   I RNT+I
Sbjct:  121 TVAALAFFASIQVDTFKTLRGASYANVMMTGNIKNAAYLLTKGLYEKNHELTHIGRNTLI  180

Query:  190 IIGGFIFGVVCSTYFSSKLGEWSLSLILIPLLYVNLLLGHEFYNLQVE              237
            +I  F  GVVCST      GE++L  IL+PLLYVN LL  EFY++Q +
Sbjct:  181 VILAFAVGVVCSTLLCIAYGEYALMPILMPLLYVNYLLAQEFYHIQTK              228
```

Based on this analysis, it was predicted that these proteins and their epitopes could be useful antigens for vaccines or diagnostics.

Example 723

A DNA sequence (GBSx0767) was identified in *S. agalactiae* <SEQ ID 2223> which encodes the amino acid sequence <SEQ ID 2224>. This protein is predicted to be tellurite resistance protein. Analysis of this protein sequence reveals the following:

```
>GP:AAC22923 GB:U32807 tellurite resistance protein (tehB)
[Haemophilus influenzae Rd]
Identities = 164/282 (58%), Positives = 205/282 (72%), Gaps = 1/282 (0%)
Query:    7 LLPYKTMPVWTAQSIPKAFLEKHNTKEGTWAKLTILSGSLVFYQLSPDGEEISRHIFDAS   66
            L+ YK MPVWT  ++P+ F EKHNTK GTW KLT+L G L FY+L+ +G+ I+ HIF
Sbjct:    5 LICYKQMPVWTKDNLPQMFQEKHNTKVGTWGKLTVLKGKLKFYELTENGDVIAEHIFTPE   64

Query:   67 SDIPFVDPQVWHKVSPNSPDLSCYLTFYCQKEDYFHKKYGLTRTHSEVIASAPLLSEKSN  126
            S IPFV+PQ WH+V   S DL C L FYC+KEDYF KKY   T   H +V+ +A ++S
Sbjct:   65 SHIPFVEPQAWHRVEALSDDLECTLGFYCKKEDYFSKKYNTTAIHGDVVDAAKIISP-CK  123

Query:  127 ILDLGCGQGRNSLYLSLLGHQVTSVDSNGQSLVALENMALEEELPYNIKRYDINTAAIEG  186
            +LDLGCGQGRNSLYLSLLG+ VTS D N  S+    L    +E L  +    YDIN A I+
Sbjct:  124 VLDLGCGQGRNSLYLSLLGYDVTSWDHNENSIAFLNETKEKENLNISTALYDINAANIQE  183

Query:  187 HYDFILSTVVFMFLNPDCISDIILQMQSHTQIGGYNLIVSAMDTAENPCPLPFPFTFKEG  246
            +YDFI+STVVFMFLN + +   II  M+ HT +GGYNLIV+AM T +  PCPLPF FTF E
Sbjct:  184 NYDFIVSTVVFMFLNRERVPSIIKNMKEHTNVGGYNLIVAAMSTDDVPCPLPFSFTFAEN  243

Query:  247 QLKSYYNDWEIIKYNENLGELHRVDENGNRLKLQFATLLARK                   288
            +LK YY DWE ++YNEN+GELH+ DENGNR+K++FAT+LARK
Sbjct:  244 ELKEYYKDWEFLEYNENMGELHKTDENGNRIKMKFATMLARK                   285
```

No corresponding DNA sequence was identified in *S. pyogenes*.

Figure 292:
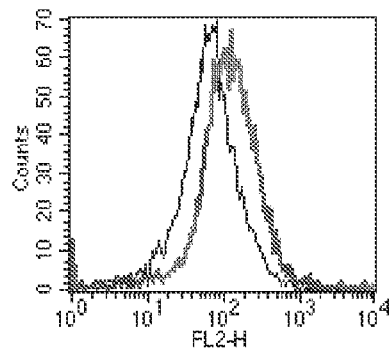

SEQ ID 2224 (GBS95) was expressed in *E. coli* as a His-fusion product. SDS-PAGE analysis of total cell extract is shown in FIG. 5 (lane 3; MW 35.6 kDa) and in FIG. 12 (lane 4; MW 35.6 kDa). The GBS95-His fusion product was purified (FIG. 191, lane 7) and used to immunise mice. The resulting antiserum was used for FACS (FIG. 292), which confirmed that the protein is immunoaccessible on GBS bacteria.

Based on this analysis, it was predicted that this protein and its epitopes, could be useful antigens for vaccines or diagnostics.

Example 724

A DNA sequence (GBSx0768) was identified in *S. agalactiae* <SEQ ID 2225> which encodes the amino acid sequence <SEQ ID 2226>. This protein is predicted to be methionyl-tRNA synthetase (metS). Analysis of this protein sequence reveals the following:

```
Possible site: 47
>>> Seems to have no N-terminal signal sequence
INTEGRAL    Likelihood = -0.32    Transmembrane 473-489 (473-489)
----- Final Results -----
    bacterial membrane --- Certainty = 0.1128 (Affirmative) <succ>
       bacterial outside --- Certainty = 0.0000 (Not Clear) <succ>
         bacterial cytoplasm --- Certainty = 0.0000 (Not Clear) <succ>
```

A related GBS nucleic acid sequence <SEQ ID 10043> which encodes amino acid sequence <SEQ ID 10044> was also identified.

The protein has homology with the following sequences in the GENPEPT database:

```
>GP:CAB11014 GB:Z99104 methionyl-tRNA synthetase [Bacillus subtilis]
Identities = 395/667 (59%), Positives = 501/667 (74%), Gaps = 12/667 (1%)
Query:  20  EKKSFYITTPIYYPSGKLHIGSAYTTIACDVLARYKRMMGFDVQYLTGLDEHGQKIQQKA    79
            E  +FYITTPIYYPSGKLHIG AYTT+A D +ARYKR+ GFDV+YLTG DEHGQKIQQKA
Sbjct:   4  ENNTFYITTPIYYPSGKLHIGHAYTTVAGDAMARYKRLKGFDVRYLTGTDEHGQKIQQKA    63

Query:  80  EEAGITPQEYVDGMAESVKTLWELLDISYDKFIRTTDTYHEEAVAKIFEQLLAQGDIYLG   139
            E+  ITPQEYVD A ++  LW+ L+IS D FIRTT+  H+  + K+F++LL  GDIYL
Sbjct:  64  EQENITPQEYVDRAAADIQKLWKQLEISNDDFIRTTEKRHKVVIEKVFQKLLDNGDIYLD   123

Query: 140  EYTGWYSVSDEEFFTESQLAEVYRDENGNMIGGVAP-SGHEVEKVSEESYFFRMSKYADR   198
            EY GWYS+ DE F+TE+QL ++ R+E G +IGG +P SGH VE + EESYFFRM KYADR
Sbjct: 124  EYEGWYSIPDETFYTETQLVDIERNEKGEVIGGKSPDSGHPVELIKEESYFFRMGKYADR   183

Query: 199  LKAYYAEHPEFIQPDGRMNEMLKNFIEPGLEDLAVSRTTYTWGVQVPSNPKHVIYVWIDA   258
            L  YY E+P FIQP+ R NEM+ NFI+PGLEDLAVSRTT+ WGV+VP NPKHV YVWIDA
Sbjct: 184  LLKYYEENPTFIQPESRKNEMINNFIKPGLEDLAVSRTTFDWGVKVPENPKHVVYVWIDA   243

Query: 259  LMNYISALGYGWSDDLSQYHKFWPADIHMIGKDILRFHSIYWPIMLMALDLPLPKRLVAH   318
            L NY++ALGY  +D  Y K+WPAD+H++GK+I+RFH+IYWPIMLMALDLPLPK++ AH
Sbjct: 244  LFNYLTALGYDTEND-ELYQKYWPADVHLVGKEIVRFHTIYWPIMLMALDLPLPKQVFAH   302

Query: 319  GWFVMQDGKMSKSKGNVVYPEMLVERFGLDPLRYYLMRSLPVGSDGTFTPEDYVGRINYE   378
            GW +M+DGKMSKSKGNVV P  L+ER+GLD LRYYL+R +P GSDG FTPE +V RINY+
Sbjct: 303  GWLLMKDGKMSKSKGNVVDPVTLIERYGLDELRYYLLREVPFGSDGVFTPEGFVERINYD   362

Query: 379  LANDLGNLLNRTIAMVNKYEDGEVPRF-AVATDFDADLASVATDSIENYHKQMEAVDFPR   437
            LANDLGNLLNRT+AM+NKYEDG++     T+FD  L SVA ++++ Y K ME ++F
Sbjct: 363  LANDLGNLLNRTVAMINKYEDGQIGSYKGAVTEFDHTLTSVAEETVKAYEKAMENMEFSV   422

Query: 438  ALEAVWNLISRTNKYIDETAPWVLAKDETDRDKLAAVMSHLVASLRVVAHLIQPFMMETS   497
            AL  +W LISRTNKYIDETAPWVLAKD   ++L +VM HL  SLR+ A L+QPF+ +T
Sbjct: 423  ALSTLWQLISRTNKYIDETAPWVLAKDPAKEEELRSVMYHLAESLRISAVLLQPFLTKTP   482

Query: 498  DAIMEQLGL--GATFDLEKLT-FADLPEGVRVVAKGSPIFPRLDMEDEITYIKEQMNAGK   554
            + + EQLG+ +    + +T F  L +   V KG P+FPRL+ E+EI YIK +M  G
Sbjct: 483  EKMFEQLGITDESLKAWDSITAFGQLKD--TKVQKGEPLFPRLEAEEEIAYIKGKMQ-GS   539

Query: 555  APVEKEWVPEEVELTSSKGQIKFEDFDAVEIRVAEVIEVEKVEGSDKLLRFRLDAGDEGH   614
            AP ++E   EE +      +I  + F  VE+RVAEVIE E V+ +D+LL+ +LD G E
Sbjct: 540  APAKEETKEEEPQEVDRLPEITIDQFMDVELRVAEVIEAEPVKKADRLLKLQLDLGFE-K   598

Query: 615  RQILSGIARFYPNEQELVGKKLQIVANLKPRKMMKKYVSQGMILSAEHDGKLTVLTVDSA   674
            RQ++SGIAK Y  E ELVGKKL V NLKP K ++  +SQGMIL+ E DG L V+++D +
Sbjct: 599  RQVVSGIAKHYTPE-ELVGKKLVCVTNLKPVK-LRGELSQGMILAGEADGVLKVVSIDQS   656

Query: 675  VANGSII                                                        681
            +  G+ I
Sbjct: 657  LPKGTRI                                                        663
```

A related DNA sequence was identified in *S. pyogenes* <SEQ ID 2227> which encodes the amino acid sequence <SEQ ID 2228>. Analysis of this protein sequence reveals the following:

Possible site: 29
>>> Seems to have no N-terminal signal sequence
----- Final Results -----
  bacterial cytoplasm --- Certainty = 0.1245 (Affirmative) <succ>
   bacterial membrane --- Certainty = 0.0000 (Not Clear) <succ>
    bacterial outside --- Certainty = 0.0000 (Not Clear) <succ>

An alignment of the GAS and GBS proteins is shown below:

```
Identities = 516/665 (77%), Positives = 573/665 (85%), Gaps = 4/665 (0%)
Query:  21 KKSFYITTPIYYPSGKLHIGSAYTTIACDVLARYKRMMGFDVQYLTGLDEHGQKIQQKAE   80
           KK FYITTPIYYPSGKLHIGSAYTTIACDVLARYKR+MG +V YLTGLDEHGQKIQ KA+
Sbjct:   3 KKPFYITTPIYYPSGKLHIGSAYTTIACDVLARYKRLMGHEVFYLTGLDEHGQKIQTKAK   62

Query:  81 EAGITPQEYVDGMAESVKTLWELLDISYDKFIRTTDTYHEEAVAKIFEQLLAQGDIYLGE  140
           EAGITPQ YVD MA+ VK LW+LLDISYD FIRTTD YHEE VA +FE+LLAQ DIYLGE
Sbjct:  63 EAGITPQTYVDNMAKDVKALWQLLDISYDTFIRTTDDYHEEVVAAVFEKLLAQDDIYLGE  122

Query: 141 YTGWYSVSDEEFFTESQLAEVYRDENGNMIGGVAPSGHEVEKVSEESYFFRMSKYADRLK  200
           Y+GWYSVSDEEFFTESQL EV+RDE+G +IGG+APSGHEVE VSEESYF R+SKY DRL
Sbjct: 123 YSGWYSVSDEEFFTESQLKEVFRDEDGQVIGGIAPSGHEVEWVSEESYFLRLSKYDDRLV  182

Query: 201 AYYAEHPEFIQPDGRMEEMLKNFIEPGLEDLAVSRTTYTWGVQVPSNPKHVIYVWIDALM  260
           A++ E P+FIQPDGRMNEM+KNFIEPGLEDLAVSRTT+TWGV VPS+PKHV+YVWIDAL+
Sbjct: 183 AFFKERPDFIQPDGRMNEMVKNFIEPGLEDLAVSRTTFTWGVPVPSDPKHVVYVWIDALL  242

Query: 261 NYISALGYGWSDDLSQYHKFWPADI-HMIGKDILRFHSIYWPIMLMALDLPLPKRLVAHG  319
           NY +ALGY ++  + + KFW   + HM+GKDILRFHSIYWPI+LM LDLP+P RL+AHG
Sbjct: 243 NYATALGYRQANH-ANFDKFWNGTVFHMVGKDILRFHSIYWPILLMMLDLPMPDRLIAHG  301

Query: 320 WFVMQDGKMSKSKGNVVYPEMLVERFGLDPLRYYLMRSLPVGSDGTFTPEDYVGRINYEL  379
           WFVM+DGKMSKSKGNVVYPEMLVERFGLDPLRYYLMRSLPVGSDGTFTPEDYVGRINYEL
Sbjct: 302 WFVMKDGKMSKSKGNVVYPEMLVERFGLDPLRYYLMRSLPVGSDGTFTPEDYVGRINYEL  361

Query: 380 ANDLGNLLNRTIAMVNKYFDGEVPRFA-VATDFDADLASVATDSIENYHKQMEAVDFPRA  438
           ANDLGNLLNRT+AM+NKYFDG VP +    T FDADL+ +    + +YHK MEAVD+PRA
Sbjct: 362 ANDLGNLLNRTVAMINKYFDGTVPAYVDNGTAFDADLSQLIDAQLADYHKHMEAVDYPRA  421

Query: 439 LEAVWNLISRTNKYIDETAPWVLAKDETDRDKLAAVMSHLVASLRVVAHLIQPFMMETSD  498
           LEAVW +I+RTNKYIDETAPWVLAK++ D+ +LA+VM+HL ASLR+VAH+IQPFMMETS
Sbjct: 422 LEAVWTIIARTNKYIDETAPWVLAKEDGDKAQLASVMAHLAASLRLVAHVIQPFMMETSA  481

Query: 499 AIMEQLGLGATFDLEKLTFADLPEGVRVVAKGSPIFPRLDMEDEITYIKEQMNAGKA-PV  557
           AIM QLGL   DL  L AD P  +VVAKG+PIFPRLDME EI YIK QM     A
Sbjct: 482 AIMAQLGLEPVSDLSTLALADFPANTKVVAKGTPIFPRLDMEAEIDYIKAQMGDSSAISQ  541

Query: 558 EKEWVPEEVELTSSKGQIKFEDFDAVEIRVAEVIEVEKVEGSDKLLRFRLDAGDEGHRQI  617
           EKEWVPEEV L S K  I FE FDAVEIRVAEV EV KVEGS+KLLRFR+DAGD   RQI
Sbjct: 542 EKEWVPEEVALKSEKDVITFETFDAVEIRVAEVKEVSKVEGSEKLLRFRVDAGDGQDRQI  601

Query: 618 LSGIAKFYPNEQELVGKKLQIVANLKPRKMMKKYVSQGMILSAEHDGKLTVLTVDSAVAN  677
           LSGIAKFYPNEQELVGKKLQIVANLKPRKMMKKY+SQGMILSAEH  +LTVLTVDS+V N
Sbjct: 602 LSGIAKFYPNEQELVGKKLQIVANLKPRKMMKKYISQGMILSAEHGDQLTVLIVDSSVPN  661

Query: 678 GSIIG                                                         682
           GSIIG
Sbjct: 662 GSIIG                                                         666
```

Based on this analysis, it was predicted that these proteins and their epitopes could be useful antigens for vaccines or diagnostics.

Example 725

A DNA sequence (GBSx0769) was identified in *S. agalactiae* <SEQ ID 2229> which encodes the amino acid sequence <SEQ ID 2230>. Analysis of this protein sequence reveals the following:

Possible site: 35
>>> Seems to have no N-terminal signal sequence
----- Final Results -----
  bacterial cytoplasm --- Certainty = 0.2633 (Affirmative) <succ>
   bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 726

A DNA sequence (GBSx0770) was identified in *S. agalactiae* <SEQ ID 2231> which encodes the amino acid sequence <SEQ ID 2232>. This protein is predicted to be branched chain amino acid transport system II carrier protein (brnQ). Analysis of this protein sequence reveals the following:

Possible site: 26
>>> Seems to have a cleavable N-term signal seq.
INTEGRAL    Likelihood = −14.91    Transmembrane 279-295 (269-303)
INTEGRAL    Likelihood = −9.98     Transmembrane 82-98 (74-102)
INTEGRAL    Likelihood = −6.58     Transmembrane 345-361 (340-364)
INTEGRAL    Likelihood = −6.00     Transmembrane 157-173( 153-179)
INTEGRAL    Likelihood = −4.30     Transmembrane 48-64 (45-66)
INTEGRAL    Likelihood = −4.14     Transmembrane 251-267 (250-278)
INTEGRAL    Likelihood = −4.09     Transmembrane 308-324 (305-326)
INTEGRAL    Likelihood = −2.55     Transmembrane 218-234 (216-237)
INTEGRAL    Likelihood = −1.38     Transmembrane 126-142 (126-142)
----- Final Results -----
    bacterial membrane --- Certainty = 0.6965 (Affirmative) <succ>
    bacterial outside --- Certainty = 0.0000 (Not Clear) <succ>
    bacterial cytoplasm --- Certainty = 0.0000 (Not Clear) <succ>

A related GBS nucleic acid sequence <SEQ ID 9407> which encodes amino acid sequence <SEQ ID 9408> was also identified.

The protein has homology with the following sequences in the GENPEPT database:

```
>GP:AAC00400 GB:AF008220 branch-chain amino acid transporter
[Bacillus subtilis]
Identities = 130/367 (35%), Positives = 204/367 (55%), Gaps = 12/367 (3%)
Query:    1 MSEKFSPWFSLTFLVILYLTIGPLFAIPRTATVSFEIGVAPIVGHSP--IALLCFTACFF      58
            +++K  P F   F V+LYL+IGPLFAIPRT TVS+EIG  P +    P  ++LL FT  FF
Sbjct:   73 LADKAHPVFGTIFTVVLYLSIGPLFAIPRTGTVSYEIGAVPFLTGVPERLSLLIFTLIFF     132

Query:   59 AAAYYLAIRPNGILDSVGKILTPVFAFLILSLVVVGAIAYGNLESAKASADYAGKAFGSG     118
              YYLA+ P+ ++D VGKILTP+  F I+ ++V+ AI        + Y G      G
Sbjct:  133 GVTYYLALNPSKVVDRVGKILTPI-KFTIILIIVLKAIFTPMGGLGAVTEAYKGTPVFKG     191

Query:  119 VLAGYNTLDALAAVAFCLVATETLKKFGFKTKKEYLSTIWIVGIVTSLAFSILYIGLGFL     178
              L GY T+DALA++ F +V   +K  G   K    +   G++ +L  + +Y+ L +L
Sbjct:  192 FLEGYKTMDALASIVFGVVVVNAVKSKGVTQSKALAAACIKAGVIAALGLTFIYVSLAYL     251

Query:  179 GNKFPVPADILADPNVNKGAYVLSQASYKLFGNFGRYFLSIMVTLTCFTTTVGLIVSVSE     238
              G          A   V +GA +LS +S+ LFG+ G    L   +T+ C TT++GL+  S  +
Sbjct:  252 G-----ATSTNAIGPVGEGAKILSASSHYLFGSLGNIVLGAAITVACLTTSIGLVTSCGQ     306

Query:  239 FFDKNFRFGNYKLFATVFTLIGFLIANLGLNAVITFSVPVLTLLYPIVIVIVLIILINKW     298
             +F K   +YK+ T+ TL  +IAN GL  +I FSVP+L+  YP+ IVI+++   I+K
Sbjct:  307 YFSKLIPALSYKIVVTIVTLFSLIIANFGLAQIIAFSVPILSAIYPLAIVIIVLSFIDKI     366

Query:  299 LPLSKK---GMSLTIGLVTLVSFVEVLAGQWQEKTLTQLVGFLPFHTISMGWLVPMLIGI     355
            +       +    GL +++ ++ AG        L  LP +++ +GW++P ++G
Sbjct:  367 FKERREVYIACLIGTGLFSILDGIKA-AGFSLGSLDVFLNANLPLYSLGIGWVLPGIVGA     425

Query:  356 VFSLVLS                                                         362
            V   VL+
Sbjct:  426 VIGYVLT                                                         432
```

There is also homology to SEQ ID 2234.

A related GBS gene <SEQ ID 8649> and protein <SEQ ID 8650> were also identified. Analysis of this protein sequence reveals the following:

Lipop: Possible site: −1   Crend: 3
SRCFLG: 0
McG: Length of UR: 30
Peak Value of UR: 2.99

Net Charge of CR: 2
McG: Discrim Score: 13.17
GvH: Signal Score (−7.5): −3.3
Possible site: 33
>>> Seems to have an uncleavable N-term signal seq
Amino Acid Composition: calculated from 1
ALOM program count: 11 value: −14.91 threshold: 0.0
INTEGRAL    Likelihood = −14.91    Transmembrane 347-363 (337-371)
INTEGRAL    Likelihood = −9.98     Transmembrane 150-166 (142-170)
INTEGRAL    Likelihood = −7.54     Transmembrane 40-56 (36-61)
INTEGRAL    Likelihood = −6.64     Transmembrane 79-95 (76-97)
INTEGRAL    Likelihood = −6.00     Transmembrane 225-241 (221-247)
INTEGRAL    Likelihood = −4.30     Transmembrane 116-132 (113-134)
INTEGRAL    Likelihood = −4.14     Transmembrane 319-335 (318-346)
INTEGRAL    Likelihood = −4.09     Transmembrane 376-392 (373-394)
INTEGRAL    Likelihood = −2.92     Transmembrane 7-23 (6-28)
INTEGRAL    Likelihood = −2.55     Transmembrane 286-302 (284-305)
INTEGRAL    Likelihood = −1.38     Transmembrane 194-210 (194-210)
PERIPHERAL  Likelihood = 2.49      402
modified ALOM score: 3.48
icml HYPID: 7    CFP: 0.696

*** Reasoning Step: 3
----- Final Results -----
    bacterial membrane --- Certainty = 0.6965 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
ORF00247(304-1596 of 1941)
OMNI|NT01BS3447(19-446 of 459) branched chain amino acid transport
system II carrier protein
% Match = 21.7
% Identity = 38.8 % Similarity = 61.2
Matches = 166 Mismatches = 157 Conservative Sub.s = 96

93       123       153       183       213       243       273       303
VLTVDSAVANGSIIG*SKRALCSFFVFKKKVTE*LENYENDLEFIFIFDIIKDIDSKHLDRI**GEFMERV*IDYLH*WL

LTEYFNIIIRRIFFMKHS
                                                                10

333       363       393       423       453       483       513       543
LMVKKGFLTGLLLFGIFFGAGNLIFPPALGVASGQDFWPAILGFCLSGVGLAIITLLLGTLTNGGYKTEMSEKFSPWFSL
| ||   : |::||  :|||||| :|:|| || |:|:: | ||  ||  |:|||  :: ::   ||    |  :::|  | |
LPVKDTIIGFMLFALFFGAGNMIYPPELGQAAGHNVWKAIGGFLLTGVGLPLLGIIAIALTGKDAKG-LADKAHPVFGT
            30        40        50        60        70        80        90

573       603       633       657       687       717       747       777
TFLVILYLTIGPLFAIPRTATVSFEIGVAPIVGHSP--IALLCFTACFFAAAYYLAIRPNGILDSVGKILTPVFAFLILS
 | |:|||:||||||||||| |||:|||  |  :    |   ::|| || ||   ||||: |:  ::|  |||||||:    | |:
IFTVVLYLSIGPLFAIPRTGTVSYEIGAVPFLTGVPERLSLLIFTLIFFGVTYYLALNPSKVVDRVGKILTPI-KFTIIL
           110       120       130       140       150       160       170

801       831       861       891       921       951       981      1011
LVVVGAI--AYGNLESAKASADYAGKAFGSGVLAGYNTLDALAAVAFCLVATETLKKGFGKTKKEYLSTIWIVGIVTSLA
::|: ||      | |  :    :   ||        | || |:|||||:: | :|      :| |         |    :    |:: :|
IIVLKAIFTPMGGLGA--VTEAYKGTPVFKGFLEGYKTMDALASIVFGVVVVNAVKSKGVTQSKALAAACIKAGVIAALG
           190       200       210       220       230       240       250

1041      1071      1101      1131      1161      1191      1221      1251
FSILYYIGLGFLGNKFPVPADILADPNVNKGAYVLSQASYKLFGNFGRYFLSIMVTLTCFTTTVGLIVSSEFFDKNFRFG
::  :|:  |  ||           |     |   :|| :|| :|:   |||||: ::  :|:  :|:|||:|:     ||  |
LTFIYVSLAYLG-----ATSTNAIGPVGEGAKILSASSHYLFGSLGNIVLGAAITVACLTTSIGLVTSCGQYFSKLIPAL
                270       280       290       300       310       320

1281      1311      1341      1371      1401      1431      1461      1488
NYKLFATVFTLIGFLIANLGLNAVITFSVPVLTLLYPIVIVIVLIILINKWLPLSKKGMSLTIGLVTLVSFVEVLAG-QW
:|||   |: | ||   ::|||:||   :|  ||||:|:  :||:  |||:::  :|:|    : |    :    |    :|| |:
SYKIVVTIVTLFSLIIANFGLAWIIAFSVPILSAIYPLAIVIIVLSFIDK---IFKERREVYIACLIGTGLFSILDGIKA
           340       350       360       370       380       390       400

1518      1536      1566      1596      1626      1656      1686      1716
QEKTLTQLVGFL----PFHTISMGWLVPMLIGIVFSLVLSDKQKGQAFDLEKFEG*HYFNFIDMSKRLKLRF*PFLYQIF
:|    |  ||      |:::: :||::|  ::|  |   ||:
AGFSLGSLDVFLNANLPLYSLGIGWVLPGIVGAVIGYVLTLFIGPSKQLNEIS
           420       430       440       450
```

Based on this analysis, it was predicted that these proteins and their epitopes could be useful antigens for vaccines or diagnostics.

Example 727

A DNA sequence (GBSx0771) was identified in *S. agalactiae* <SEQ ID 2235> which encodes the amino acid sequence <SEQ ID 2236>. Analysis of this protein sequence reveals the following:

Possible site: 36
>>> Seems to have no N-terminal signal sequence
----- Final Results -----
    bacterial cytoplasm --- Certainty = 0.3291 (Affirmative) <succ>
      bacterial membrane --- Certainty = 0.0000 (Not Clear) <succ>
       bacterial outside --- Certainty = 0.0000 (Not Clear) <succ>

A related GBS nucleic acid sequence <SEQ ID 10041> which encodes amino acid sequence <SEQ ID 10042> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

Example 728

A DNA sequence (GBSx0772) was identified in *S. agalactiae* <SEQ ID 2237> which encodes the amino acid sequence <SEQ ID 2238>. Analysis of this protein sequence reveals the following:

Possible site: 39
>>> Seems to have a cleavable N-term signal seq.
INTEGRAL    Likelihood = −8.33    Transmembrane 117-133 (112-136)
INTEGRAL    Likelihood = −3.77    Transmembrane 53-69 (53-70)
INTEGRAL    Likelihood = −3.40    Transmembrane 98-114 (97-115)
-----Final Results-----
    bacterial membrane --- Certainty = 0.4333 (Affirmative) <succ>
       bacterial outside --- Certainty = 0.0000 (Not Clear) <succ>
     bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 729

A DNA sequence (GBSx0773) was identified in *S. agalactiae* <SEQ ID 2239> which encodes the amino acid sequence <SEQ ID 2240>. Analysis of this protein sequence reveals the following:

```
>GP:CAB15623 GB:Z99122 spore coat protein (inner) [Bacillus subtilis]
Identities = 71/359 (19%), Positives = 148/359 (40%), Gaps = 49/359 (13%)
Query: 127  ISYRGNTSRYFDKKSLKVKFVTNKLKEKKHRLAGMPKESEWVLHGPFLDRTLLRNYLSYN  186
            I+YRG+  R F KKS  + F   K       +        L+  + D +L+RN LS +
Sbjct:  47  IAYRGSHIRDFKKKSYHISFYQPKTFRGAREIH--------LNAEYKDPSLMRNKLSLD   97

Query: 187  IAGEIMSYAPNVRYCELFVNGEYQGVYLAVENIEQGEQRVPIEKSDKKLHKTPYIVAWDR  246
            E+ + +P   + + +NG+ +GVYL +E++++         + +KL        A D
Sbjct:  98  FFSELGTLSPKAEFAFVKMNGKNEGVYLELESVDE------YYLAKRKLADGAIFYAVDD  151

Query: 247  EHKAKQKLDNYVHYTHQSGISALDVKYPGKQRLTSKQLEFINKD----INHIEKVLYSYD  302
             +         D   +   ++L++  Y +++  +++ +F  +D      IN + K   +
Sbjct: 152  DANFSLMSD-----LERETKTSLELGY--EKKTGTEEDDFYLQDMIFKINTVPKAQFK--  202

Query: 303  FSQYPKYIDRESFANYFVINEFFRNVDAGKFSTYLYKDLRDRA-KLVVWDFNNAFDNQIE  361
            S+  K++D + +      F  N D   + LY+      +++  WD++   +   I
Sbjct: 203  -SEVTKHVDVDKYLRWLAGIVFTSNYDGFVHNYALYRSGETGLFEVIPWDYDATWGRDIH  261

Query: 362  GRVDEADFTLTDAPWFNMLIKDKAFIDLVVHRYKELRKGVLATEYLSNYIDETRHFLGPA  421
            G      AD+      FN L          YK L +   L +  +    Y++             P
Sbjct: 262  GERMAADYVRIQG--FNTLTARILDESEFRKSYKRLLEKTLQSLFTIEYME-------PK  312

Query: 422  IDRNYKKWGYVFDLKNTDPRNYLIPTERN-VTSYHKSVEQLKDFIKKRGRWMDRNIETL   479
            I    Y++            P   + P ++N +   +  + + + ++IK R +++   ++   L
Sbjct: 313  IMAMYER---------IRPFVLMDPYKKNDIERFDREPDVICEYIKNRSQYLKDHLSIL   362
```

Possible site: 15
>>> Seems to have no N-terminal signal sequence
INTEGRAL   Likelihood = −4.19   Transmembrane 22-38 (20-44)
----- Final Results -----
  bacterial membrane --- Certainty = 0.2678 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 8651> which encodes amino acid sequence <SEQ ID 8652> was also identified. Analysis of this protein sequence reveals the following:

Lipop Possible site: −1   Crend: 3
SRCFLG: 0
McG: Length of UR: 21
Peak Value of UR: 3.11
Net Charge of CR: 2
McG: Discrim Score: 11.30
GvH:               Signal Score (−7.5): −5.35
Possible site: 28
>>> Seems to have an uncleavable N-term signal seq
Amino Acid Composition: calculated from 1
ALUM program count: 1 value: −4.19 threshold: 0.0
INTEGRAL       Likelihood = −4.19   Transmembrane 5-21 (3-27)
PERIPHERAL     Likelihood = 6.74    53
modified ALOM score: 1.34
icmI HYPID: 7       CFP: 0.268

*** Reasoning Step: 3
----- Final Results -----
  bacterial membrane --- Certainty = 0.2678 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the GENPEPT database:

No corresponding DNA sequence was identified in *S. pyogenes*.

Based on this analysis, it was predicted that these proteins and their epitopes could be useful antigens for vaccines or diagnostics.

Example 730

A DNA sequence (GBSx0774) was identified in *S. agalactiae* <SEQ ID 2241> which encodes the amino acid sequence <SEQ ID 2242>. Analysis of this protein sequence reveals the following:

Possible site: 17
>>> Seems to have no N-terminal signal sequence
----- Final Results -----
  bacterial membrane --- Certainty = 0.0000 (Not Clear) <succ>
    bacterial outside --- Certainty = 0.0000 (Not Clear) <succ>
      bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 731

A DNA sequence (GBSx0775) was identified in *S. agalactiae* <SEQ ID 2243> which encodes the amino acid sequence <SEQ ID 2244>. Analysis of this protein sequence reveals the following:

```
Possible site: 21
>>> Seems to have an uncleavable N-term signal seq
INTEGRAL    Likelihood = -4.62    Transmembrane 5-21 (3-24)
----- Final Results -----
    bacterial membrane --- Certainty = 0.2848 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the GENPEPT database:

```
>GP:BAB05949 GB:AP001514 unknown [Bacillus halodurans]
Identities = 199/697 (28%), Positives = 322/697 (45%), Gaps = 58/697 (8%)
Query:   57 KPFVVKGVDVESSLAGYHHNDFPITQKTYREWFPHLISNMGANTVRVKVPMNVAFYDALYH   116
            K   + GV++       G    + I +K Y  WF  I  MG N +RV       FY AL
Sbjct:  414 KKLQIHGVNLGMGKPGTFPGEAAIKEKDYYRWFEQIGEMGGNAIRVYTLHPPGFYHALKR   473

Query:  117 HNKASKRPLYLLQGIRIDSYRNNASITAFNDNYRGYLKREAKGVVDILHGRKQVWNTDLG   176
            +N+  + P+YL  G+   ID      ++ AF++      ++E K +VD++HG   V + + G
Sbjct:  474 YNEQHENPIYLFHGVWIDEEPLEDTLDAFDEETNEEFQQEMKRIVDVIHGNAVV-DPNPG   532

Query:  177 SRH--YHYDLSPWVLGYVVGDDWNSGTVAYTNHQEKKT-QYKGRYFKTSVAANPFEVMLA   233
              H  Y D+SP+ +G+++G  +W    TV  TN       Y G+Y +T   A PFE  LA
Sbjct:  533 HAHGVYQADVSPYTIGWIIGIEWYPHTVKATNKNNPDIGDYDGKYVETK-DAEPFEYWLA   591

Query:  234 QVMDELTHYETAKYGWQHLISFSNSPTTDPF-HYRKPFEAQAPKYVQLNVENIQANSNVK   292
                 D L  YE  +Y W  +SF+N  TTD    H  +P E +    V  NV +++  +   +
Sbjct:  592 NQFDILLSYEIEQYNWIRPVSFTNWVTTDLLTHPAEPNEDEDLVGVDPNVIHLKGPA-TE   650

Query:  293 AGMFAAYKAIDFHPRYKDYLLFDKENISKEDRQKIKELSLSQGYVKLLNAYHKIPVLVTG   352
              FA+Y     +P Y D+L ++++  I    D +    EL+    GY+K L+   H +P+L+
Sbjct:  651 TNQFASYHV---YPYYPDFLNYEEDYIHYVDHR--GELNNYAGYLKDLHDAHDLPILIAE   705

Query:  353 YGYSTARGIA-QKEIDKRPLPINEKEQGQRLLEDYESFISSGSFGATINAWQDDWNARAW   411
            +G   +RG+      K     ++E+EQG+ ++E +E  I    G I  WQD+W  R W
Sbjct:  706 FGVPASRGLTHENPFGKNQGFLSEEEQGKIVVELFEDIIEEKLLGGLIFTWQDEWFKRTW   765

Query:  412 NTSFATNKHSQFLWGDAQVFNQGYGLLGFKNAKHHYQVDGKRGKG-----EWKHPLMTSA   466
            NT   N   +  W +AQ  Q +GLL F K    D +     E  HP +
Sbjct:  766 NTMDYDNPDRRPFWSNAQTNEQQFGLLSFDRLKVKVNGDDQDWEDASLLYEEDHPYVKR-   824

Query:  467 TGDDLYASSDESYLYLAIKTKPEKLKE-----KRLLPIDITPKSGSRKMNGSK-VTFSKS   520
              LY    DE YLY  I  K     +         +L +D  P  G+      +   VTF
Sbjct:  825 ----LYMDHDERYLYFRIDMKSGSTDDFFKDGFPILVLDTLPGQGNEHIKEVEGVTFDHG   880

Query:  521 SDFVLSIDPNGKSELFVQERYNALKANYLRQLNGKDFYAFPPKKNSSNFEQINMVLRNTK   580
              DF++    +S + V   Y +         +  + + N+   F++I+  L N +
Sbjct:  881 IDFIIELKGYDESRVKVDAYYDFFTYQYSQIYQMIEETSIEPQNNTGVFQKIHYAL-NQE   939

Query:  581 IVEDMEKVKATERFLP--THPTGLLKTGTTDRHQKTFDSQTD--ISFGKDFIEVRIPWQL   636
            I       ++ +T  +P    + TG L+ G D     +DS D   ++  K  IEVRIPW L
Sbjct:  940 I-----RIPSTNEVIPFSYYETGELRHGNGDPEADDYDSLADFFVNEEKGMIEVRIPWLL   994

Query:  637 LNFSDPSSQKIHDDYFKHYGVKELE-IESI-ALGLGANSKENTLIKMAD-----------   683
            L+F DPS +++   ++   G +  E IE + A L     K++    ++  D
Sbjct:  995 LSFKDPSQREVMSAIYEGEGGETSEIIEGVRAAVLFVEPKDDDSYQVVDALPALDGDRLT   1054

Query:  684 ------YRLKNWERPDTKTFLKDSYYSIKKEWSKERE                         714
                  Y  + W+ P    +  LK SY  +K+ ++  +E
Sbjct: 1055 DEVMNMYTWETWDIPLYEERLKQSYDLVKEAFTSIKE                         1091
```

No corresponding DNA sequence was identified in *S. pyogenes*.

A related GBS gene <SEQ ID 8653> and protein <SEQ ID 8654> were also identified. Analysis of this protein sequence reveals the following:

```
Lipop: Possible site: -1    Crend: 2
McG: Discrim Score: 12.00
GvH: Signal Score (-7.5): -5.46
Possible site: 21
>>> Seems to have an uncleavable N-term signal seq
ALOM program   count: 1 value: -4.62 threshold: 0.0
INTEGRAL       Likelihood = -4.62    Transmembrane 5-21 (3-24)
PERIPHERAL     Likelihood =  7.32    223
modified ALOM score: 1.42
*** Reasoning Step: 3
----- Final Results -----
    bacterial membrane --- Certainty = 0.2848 (Affirmative) <succ>
      bacterial outside --- Certainty = 0.0000 (Not Clear) <succ>
        bacterial cytoplasm --- Certainty = 0.0000 (Not Clear) <succ>
```

SEQ ID 2244 (GBS62) was expressed in *E. coli* as a His-fusion product. SDS-PAGE analysis of total cell extract is shown in FIG. 5 (lane 7; MW 80.5 kDa). It was also expressed in *E. coli* as a GST-fusion product. SDS-PAGE analysis of total cell extract is shown in FIG. 13 (lane 4; MW 105 kDa).

The GBS62-GST fusion product was purified (FIG. 100A; see also FIG. 193, lane 7) and used to immunise mice (lane 1 product; 20 μg/mouse). The resulting antiserum was used for Western blot (FIG. 100B), FACS (FIG. 100C), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 732

A DNA sequence (GBSx0778) was identified in *S. agalactiae* <SEQ ID 2245> which encodes the amino acid sequence <SEQ ID 2246> in others. Analysis of this protein sequence reveals the following:

Possible site: 14
>>> Seems to have no N-terminal signal sequence
INTEGRAL    Likelihood = −7.48    Transmembrane 310-326 (302-335)
INTEGRAL    Likelihood = −7.32    Transmembrane 362-378 (361-380)
INTEGRAL    Likelihood = −7.11    Transmembrane 334-350 (329-355)
INTEGRAL    Likelihood = −2.28    Transmembrane 381-397 (380-397)
----- Final Results -----
    bacterial membrane --- Certainty = 0.3994 (Affirmative) <succ>
      bacterial outside --- Certainty = 0.0000 (Not Clear) <succ>
        bacterial cytoplasm --- Certainty = 0.0000 (Not Clear) <succ>

A related GBS nucleic acid sequence <SEQ ID 10039> which encodes amino acid sequence <SEQ ID 10040> was also identified.

The protein has homology with the following sequences in the GENPEPT database:

A related DNA sequence was identified in *S. pyogenes* <SEQ ID 2247> which encodes the amino acid sequence <SEQ ID 2248>. Analysis of this protein sequence reveals the following:

Possible site: 60
>>> Seems to have no N-terminal signal sequence
INTEGRAL    Likelihood = −11.04    Transmembrane 33-49 (24-57)
INTEGRAL    Likelihood = −10.77    Transmembrane 376-392 (370-399)
INTEGRAL    Likelihood = −7.86    Transmembrane 344-360 (342-372)
INTEGRAL    Likelihood = −4.94    Transmembrane 63-79 (55-81)
INTEGRAL    Likelihood = −2.07    Transmembrane 403-419 (403-419)
----- Final Results -----
    bacterial membrane --- Certainty = 0.5416 (Affirmative) <succ>
      bacterial outside --- Certainty = 0.0000 (Not Clear) <succ>
        bacterial cytoplasm --- Certainty = 0.0000 (Not Clear) <succ>

An alignment of the GAS and GBS proteins is shown below:

```
>GP:BAB05950 GB:AP001514 unknown conserved protein in others
[Bacillus halodurans]
Identities = 143/405 (35%), Positives = 226/405 (55%), Gaps = 5/405 (1%)
Query:   11 IVPAYNESTTIVSSIDSLLHLDYEAYEIIVVDDGSSDNISDVLKEEFALMKISNTIDSII      70
            +VPAYNE T I+ ++ SLL L Y    EI+VV+DGS+D T +V+ E F ++K+    I    I
Sbjct:   69 LVPAYNEETGIIETVRSLLSLKYPQTEIVVVNDGSTDQTLEVIIEHFQMVKVGKVIRKQI    128

Query:   71 ATQTCKDVFQRQVGKVKLTLIVKENGGKGDALNMGINAANYDYFLCLDADSMLQVDSLSQ    130
             T+  K V+Q  +    L L+ K NGGK DALN G+N + Y YF  +D DS+L+ D+L +
Sbjct:  129 ETEPIKGVYQSTIFP-HLLLVDKSNGGKADALNAGLNVSKYPYFCSIDGDSILETDALLK    187

Query:  131 ISKSIQV----DPIVIAVGGLVQVAQGVKIEQGKVASYRLPWRIIPCAQALEYDSSFLGA    186
            + K I    +    VIA GG V++A G  I+ G V S +L    +   Q  +EY  +FL
Sbjct:  188 VMKPIVTSRDDEDEVIASGGNVRIANGSDIQMGSVLSVQLAKNPLVVMQVIEYLRAFLMG    247

Query:  187 RIFLDYLRANLIISGAFGLFKKDLVRAVGGYDTQTLGEDMELVMKLHFFCRNNNIPYRIC    246
            RI L        LIISGAF +F K  V    GGY +T+GEDMELV++LH   +    + RI
Sbjct:  248 RIGLSRHNMVLIISGAFSVFAKKWVMEAGGYSKKTVGEDMELVVRLHRLVKEKRLKKRIT    307

Query:  247 YETDAVCWSQAPTNLGDLRKQRRRWYLGLYQCLKKYKSIFANYRFGAVGSISYIYYILFE    306
            +  D VCW++AP      L++QR RW+ GL + L   ++ +   N ++G VG+  S  Y+ + E
Sbjct:  308 FVPDPVCWTEAPATFRVLQRQRSRWHRGLMESLWLHRGMTFNPKYGLVGTASIPYFWIVE    367

Query:  307 LLTPFIECFGIVIIFLSLLFNQLNIPFFISLVSLYIFYCVLITLSSFLHRIYSQQLVIGI    366
               P +E  G + I +   F L + F  ++L ++ Y   +++ +   +S +           +
Sbjct:  368 FFGPVVELMGYLYIVFAFFFGGLYVEFALALFLLFVLYGTVFSMTAVILEGWSLKRYPKV    427

Query:  367 LDIVKVFYIAVFRYLILHPVLTFVKVASVIGYKNKKMVWGHITRE                411
               D+ ++    ++F  L   P+    +   ++I       WG +TR+
Sbjct:  428 SDMSRLMIFSLFEALWYRPLTVLWRFGAIIEALFRSKAWGEMTRK                472
```

```
Identities = 84/397 (21%), Positives = 173/397 (43%), Gaps = 71/397 (17%)
Query:   6 FRRKSIVPAYNEST-TIVSSIDSLLHLDYEAYEIIVVDDGSSDNTSDVLKEEFALMKISN   64
           ++ +++P+YNE    +++ ++ S+L  Y   EI +VDDGSS+ +  L EE+       ++
Sbjct:  90 YKVAAVIPSYNEDAESLLETLKSVLAQTYPLSEIYIVDDGSSNTDAIQLIEEY----VNR  145

Query:  65 TIDSIIATQTCKDVFQRQVGKVKLTLIVKENGGKGDALNMGINAANYDYFLCLDADSMLQ  124
           +D        C++V       V  +L+    N GK  A          ++ D FL +D+D+ +
Sbjct: 146 EVD------ICRNVI------VHRSLV---NKGKRHAQAWAFERSDADVFLTVDSDTYIY  190

Query: 125 VDSLSQISKSIQVDPTVIAVGGLVQVAQGVKIEQGKVASYRLPWRIIPCAQALEYDSSFL  184
           ++L ++ KS   D TV A              G + +       ++    + YD++F
Sbjct: 191 PNALEELLKSFN-DETVYAA-------------TGHLNARNRQTNLLTRLTDIRYDNAF-  235

Query: 185 GARIFLDYLRANLII-SGAFGLFKKD-LVKAVGGYDTQT-------LGEDMELVMKLHFF  235
           G        L  N+++ SG   +++++  ++  +  Y  QT       +G+D  L
Sbjct: 236 GVERAAQSLTGNILVCSGPLSIYRREVIIPNLERYKNQTFLGLPVSIGDDRCLT------  289

Query: 236 CRNNNIPY-RICYETDAVCWSQAPTNLGDLRKQRRRWYLGLY-QCLKKYKSIFANYRFGA  293
                N   I    R  Y++ A C +  P  L       KQ+ RW    + + +   K I +N
Sbjct: 290 --NYAIDLGRTVYQSTARCDTDVPFQLKSYLKQQNRWNKSFFKESIISVKKILSN----P  343

Query: 294 VGSISYIYYILFELLTPFIECFGIVIIFLSLLFNQLNIPFFISLVSLYIFYCV--LITLS  351
           + ++  I+ ++ ++         +++   +LLFNQ       + L+ L+ F  +  ++ L
Sbjct: 344 IVALWTIFEVVMFMM--------LIVAIGNLLFNQ---AIQLDLIKLFAFLSIIFIVALC  392

Query: 352 SFLHRIYSQQLVIGILDIVKVFYIAVFRYLILHPVLT                         388
           +H +            +   +   +    + ++ V + L L+ + T
Sbjct: 393 RNVHYMIKHPASFLLSPLYGILHLFVLQPLKLYSLCT                         429
```

A related GBS gene <SEQ ID 8655> and protein <SEQ ID 8656> were also identified. Analysis of this protein sequence reveals the following:

Lipop: Possible site: −1   Crend: 8
McG: Discrim Score: −5.18
GvH: Signal Score (−7.5): −4.91
Possible site: 14
>>> Seems to have no N-terminal signal sequence
ALOM program   count: 4 value: −7.48 threshold: 0.0
INTEGRAL   Likelihood = −7.48   Transmembrane 310-326 (302-335)
INTEGRAL   Likelihood = −7.32   Transmembrane 362-378 (361-380)
INTEGRAL   Likelihood = −7.11   Transmembrane 334-350 (329-355)
INTEGRAL   Likelihood = −2.28   Transmembrane 381-397 (380-397)
PERIPHERAL Likelihood = 1.22    140

-continued modified ALOM score: 2.00
*** Reasoning Step: 3
----- Final Results -----
  bacterial membrane --- Certainty = 0.3994 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
ORF00238(331-1401 of 1866)
GP|5813901|gb|AAD52055.1|AF086783_3|AF086783(52-367 of 412) IcaA {Staphylococcus aureus}
% Match = 10.3
% Identity = 34.8 % Similarity = 55.9
Matches = 109 Mismatches = 128 Conservative Sub.s = 66

150       180       210       240       270       300       330       360
         VAMRRSSKLNLGVRPPFACLR**AVFNTANISSKVVR*TPTRRLNRTSVNCLLAS*FIELLYHILFRRKSIVPAYNESTT
                                                                    : :   ||||
                                           MQFFNFLLFYPVFMSIYWIVGSIYFYFTREIRYSLNKKPDINVDELEGITFLLACYNESET
                                                    10        20        30        40        50        60

390       420       450       471       501       531       561       591
         IVSSIDSLLHLDYEAYEIIVVDDGSSDNTSDVL---KEEFALMKISNTIDSIIATQTCKDVFQRQVGKVKLTLIVKENGG
         |  :: ::|  |  ||   |||:::|||||||:::: ||  ::  :                              :: || |
         IEDTLSNVLALKYEKKEIIINDGSSDNTAELIYKIKENNDFIVD-------------------------LQENRG
                   80        90       100                                                    110

621       651       681       711       741       771       801       831
         KGDALNMGINAANYDYFLCLDADSMLQVDSLSQISKSIQVDPTVIAVGGLVQVAQGVKIEQGKVASYRLPWRIIPCAQAL
         |:|||  ||  :|||  :||||  |:    : ::   ::  ||  ||  ||   ::      |         :    |  :
         KANALNQGIKQASYDYVMCLDADTIVDQDAPYYMIENFKHDPLLGAVTGNPRIRNKSSI--------------LGKIQTI
                   130       140       150       160       170
```

```
861       891       918       948       978      1008      1038      1068
EYDSSFLGARIFLDYLRANL-IISGAFGLFKKDLVKAVGGYDTQTLGEDMELVMKLHFFCRNNNIPYRICYETDAVCWSQ
 ||  :|::|       |    :  |||  | |||| |  || :||   :||: :  |||        ||| ||   |:||
EY-ASLIGCIKRSQTLAGAVNTISGVFTLFKKSAVVDVGYWDTDMITEDIAVDWKLH------LRGYRIKYEPLAMCWML
           190       200       210       220       230                240       250

1098      1128      1155                1194      1224      1254      1284
APTNLGDLRKQRRRWYLGLYQCL-KKYKSIFANYRFG-------AVGSISYIYYILFELLTPFIECFGIVIIFLSLLFNQ
 |  ||  ||||||| |:: | : |       ||       || ::|::|:  |   ||           ||  |
VPETLGGLWKQRVRWAQGGHEVLLRDFFSTMKTKRFPLYILMFEQIISILWVYIVLLYLGYLFI-----TANFLDYTFMT
                270       280       290       300       310       320

1311      1341      1371      1401      1431      1461      1491      1521
LNIP-FFISLVSLYIFYCVLITLSSFLHRIYSQQLVIGILDIVKVFYIAVFRYLILHPVLTFVKVASVIGYKNKKMVWGH
 :   |::|   ::     :   |::  |:     |  | ::  :  |::
YSFSIFLLSSFTMTFINVIQFTVALFIDSRYEKKNMAGLIFVSWYPTVYWIINAAVVLVAFPKALKRKRGGYATWSSPDR
         340       350       360       370       380       390       400
```

Based on this analysis, it was predicted that these proteins and their epitopes could be useful antigens for vaccines or diagnostics.

Example 733

A DNA sequence (GBSx0779) was identified in S. agalactiae <SEQ ID 2249> which encodes the amino acid sequence <SEQ ID 2250>. Analysis of this protein sequence reveals the following:

Possible site: 29
>>> Seems to have no N-terminal signal sequence
----- Final Results -----
  bacterial cytoplasm --- Certainty = 0.2014 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database:

```
>GP:CAA22725 GB:AL035161 hypothetical protein SC9C7.13c
[Streptomyces coelicolor A3(2)]
Identities = 35/153 (22%), Positives = 64/153 (40%), Gaps = 5/153 (3%)
Query:    5  IRRARLGDEVNLAYIQTESWKAAFGKILPEDIIQKTTEIEPAITMYQQLLHKEVGKGYIL    64
             +R   L D   ++ I+   W++A+  ++P+  +         A              G+   ++
Sbjct:   10  VREMTLADCDRVSLIRVRGWQSAYRGLMPQPYLDAMDPAADAERRRSLFARPPEGRVNLV    69

Query:   65  EVDSNPHCMAWWD----KSREDGMLDYAELICIHSLKEGWGKGYGSQMMNHVLSEIQQAG   120
                D    + W    +  E    D AEL ++        +G G G +    +   + AG
Sbjct:   70  AEDEGGEVVGWACHGPYRDGEARTAD-AELYALYVDAARFGAGIGRALAGESVRRCRAAG   128

Query:  121  YNKVILWVFTENTRARKFYDRFGFSFKGKSKTY                              153
             +  +++LWV    N  RAR+FYDR GF    G  +  +
Sbjct:  129  HARMLLWVLKGNVRARRFYDRAGFRPDGAEEPF                              161
```

No corresponding DNA sequence was identified in S. pyogenes.

Based on this analysis, it was predicted that this protein and its epitopes, could be useful antigens for vaccines or diagnostics.

Example 734

A DNA sequence (GBSx0780) was identified in S. agalactiae <SEQ ID 2251> which encodes the amino acid sequence <SEQ ID 2252>. This protein is predicted to be a DNA-binding protein. Analysis of this protein sequence reveals the following:

Possible site: 48
>>> Seems to have no N-terminal signal sequence
----- Final Results -----
  bacterial cytoplasm --- Certainty = 0.1162 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 735

A DNA sequence (GBSx0781) was identified in S. agalactiae <SEQ ID 2253> which encodes the amino acid sequence <SEQ ID 2254>. Analysis of this protein sequence reveals the following:

Possible site: 56
>>> Seems to have no N-terminal signal sequence
----- Final Results -----
  bacterial cytoplasm --- Certainty = 0.2589 (Affirmative) <succ>
    bacterial membrane --- Certainty = 0.0000 (Not Clear) <succ>
      bacterial outside --- Certainty= 0.0000 (Not Clear) <succ>

A related GBS nucleic acid sequence <SEQ ID 10037> which encodes amino acid sequence <SEQ ID 10038> was also identified.

The protein has no significant homology with any sequences in the GENPEPT database.

A related DNA sequence was identified in *S. pyogenes* <SEQ ID 2255> which encodes the amino acid sequence <SEQ ID 2256>. Analysis of this protein sequence reveals the following:

```
Possible site:53
>>> Seems to have no N-terminal signal sequence
----- Final Results -----
    bacterial cytoplasm --- Certainty = 0.2767 (Affirmative) <succ>
      bacterial membrane --- Certainty = 0.0000 (Not Clear) <succ>
       bacterial outside --- Certainty = 0.0000 (Not Clear) <succ>
```

An alignment of the GAS and GBS proteins is shown below:

```
Identities = 80/86 (93%), Positives = 84/86 (97%)
Query:   6    LKTIKENNMTFEEILPGLKAKKKYVRTGWGGAENYVQLFDTLEVNGKVLQATPYFLINVT    65
              + +IKENNMTFEEILPGLKAKKKYVRTGWGGAENYVQLFDTLEV+GKVLQATPYFLI+VT
Sbjct:   3    ISSIKENNMTFEEILPGLKAKKKYVRTGWGGAENYVQLFDTLEVDGKVLQATPYFLIHVT    62

Query:  66    GEGEGFSMWAPTPCDVLAEDWIEVND    91
              G GEGFSMWAPTPCDVLAEDWIEVND
Sbjct:  63    GAGEGFSMWAPTPCDVLAEDWIEVND    88
```

Based on this analysis, it was predicted that these proteins and their epitopes could be useful antigens for vaccines or diagnostics.

Example 736

A DNA sequence (GBSx0782) was identified in *S. agalactiae* <SEQ ID 2257> which encodes the amino acid sequence <SEQ ID 2258>. Analysis of this protein sequence reveals the following:

```
Possible site: 19
>>> Seems to have an uncleavable N-term signal seq
----- Final Results -----
     bacterial membrane --- Certainty = 0.0000 (Not Clear) <succ>
      bacterial outside --- Certainty = 0.0000 (Not Clear) <succ>
       bacterial cytoplasm --- Certainty = 0.0000 (Not Clear) <succ>
```

The protein has homology with the following sequences in the GENPEPT database:

```
>GP:BAA85256 GB:AB021978 3-oxoacyl-[acyl carrier protein] reductase homolog
[Moritella marina]
Identities = 82/239 (34%), Positives = 125/239 (51%), Gaps = 15/239 (6%)
Query:   2    TKVVLVTGCASGIGYAQAQYFLKQGYQVYGVDKSDKPNLN-----GNFNF-IKLDLSSDL    55
              +K VLVTG + GIG A A++F K G  V G    S +          G+   F ++L+++S
Sbjct:   5    SKTVLVTGASRGIGRAIAEHFAKLGATVIGTATSAQGAERIGAYLGDAGFGLELNVTSQD    64

Query:  56    S------PLFTMVPTVDILCNTAGILDAYKPLLEVSDEELEHLFDINFFVTVRLTRHYLR   109
              S       + T V +DIL N AGI  A    L + ++E  ++ D N      RL +  LR
Sbjct:  65    SVDALYAEIKTQVGHIDILVNNAGIT-ADNIFLRMKEDEWCNVIDTNLTSLYRLCKPCLR   123

Query: 110    RMVEKKSGIIINMCSIASFIAGGGGAAYTSSKHALAGFTRQLALDYAKDCIQIEGIAPGA   169
              M++++  G IIN+ S+     GG A Y ++K  L GFT+ LA + A    I +  +APG
Sbjct: 124    GMMKQRHGRIINIGSVVGTTGNGGQANYAAAKSGLLGFTKSLASEVASRGITVNAVAPGF   183

Query: 170    VQTAMTASDFEPGGLAEWVASETPIGRWTKPSEVAELTGFLASGKARSMQGEIVKIDGG    228
              ++T MTA   E    + ++ P R      +E+AE  GFLAS  A  + GE +  ++GG
Sbjct: 184    IETDMTAELTEE--QKQTILAQVPTSRLGSTTEIAETVGFLASDGASYITGETIHVNGG    240
```

There is also homology to SEQ IDs 2628 and 7170.

A related sequence was also identified in GAS <SEQ ID 9107> which encodes the amino acid sequence <SEQ ID 9108>. Analysis of this protein sequence reveals the following:

```
Possible site: 19
>>> Seems to have an uncleavable N-term signal seq
----- Final Results -----
     bacterial membrane --- Certainty = 0.0000 (Not Clear) <succ>
      bacterial outside --- Certainty = 0.0000 (Not Clear) <succ>
       bacterial cytoplasm --- Certainty = 0.0000 (Not Clear) <succ>
```

An alignment of the GAS and GBS proteins is shown below:

```
Identities = 206/232 (88%), Positives = 224/232 (95%)
Query:   1  MTKVVLVTGCASGIGYAQAQYFLKQGYQVYGVDKSDKPNLNGNFNFIKLDLSSDLSPLFT    60
            MTKVVLVTGCASGIGYAQA+YFLKQG+ VYGVDKSDKP+L+GNF+FIKLDLSS+L+PLF
Sbjct:   4  MTKVVLVTGCASGIGYAQARYFLKQGHHVYGVDKSDKPDLSGNFHFIKLDLSSELAPLFK    63

Query:  61  MVPTVDILCNTAGILDAYKPLLEVSDEELEHLFDINFFVTVRLTRHYLRRMVEKKSGIII   120
            +VP+VDILCNTAGILDAYKPLL+VSDEE+EHLFDINFF TV+LTRHYLRRMVEK+SG+II
Sbjct:  64  VVPSVDILCNTAGILDAYKPLLDVSDEEVEHLFDINFFATVKLTRHYLRRMVEKQSGVII   123

Query: 121  NMCSIASFIAGGGGAAYTSSKHALAGFTRQLALDYAKDCIQIFGIAPGAVQTAMTASDFE   180
            NMCSIASFIAGGGG AYTSSKHALAGFTRQLALDYAKD I IFGIAPGAV+TAMTA+DFE
Sbjct: 124  NMCSIASFIAGGGGVAYTSSKHALAGFTRQLALDYAKDQIHIFGIAPGAVKTAMTANDFE   183

Query: 181  PGGLAEWVASETPIGRWTKPSEVAELTGFLASGKARSMQGEIVKIDGGWSLK           232
            PGGLA+WVA ETPIGRWTKP EVAELTGFLASGKARSMQGEIVKIDGGW+LK
Sbjct: 184  PGGLADWVARETPIGRWTKPDEVAELTGFLASGKARSMQGEIVKIDGGWTLK           235
```

A related DNA sequence was identified in S. pyogenes <SEQ ID 9063> which encodes amino acid sequence <SEQ ID 9064>. An alignment of the GAS and GBS sequences follows:

```
Score = 83.1 bits (202), Expect = 4e-18
Identities = 72/258 (27%), Positives = 106/258 (40%), Gaps = 36/258 (13%)
Query:   6  EVAFITGAASGIGKQIGETLLKEGKTVVFSDINQE-----KLDQVVADYTKEGYDAFSVV    60
            +V  +TG ASGIG   + LK+G  V  D + +           + + D + +  F++V
Sbjct:   3  KVVLVTGCASGIGYAQAQYFLKQGYQVYGVDKSDKPNLNGNFNFIKLDLSSDLSPLFTMV    62

Query:  61  CDVTKEEAINAAIDTVVEKYGRIDILVNNAG-LQHVAMIEDFPTEKFEFMIKIMLTAPFI   119
                             +DIL N AG L    + +  E+ E + I
Sbjct:  63  -------------------PTVDILCNTAGILDAYKPLLEVSDEELEHLFDINFFVTVR   102

Query: 120  AIKRAFPTMKAQKHGRIINMASINGVIGFAGKSAYNSAKHGLIGLTKVTALEAADSGITV   179
              +    M  +K G IINM SI    I     G +AY S+KH L G T+  AL+ A    I +
Sbjct: 103  LTRHYLRRMVEKKSGIIINMCSIASFIAGGGGAAYTSSKHALAGFTRQLALDYAKDCIQI   162

Query: 180  NAICPGYVDTPLVRGQFEDLSKTRGIPLENVLEEVLYPLVPQKRLIDVQEIADYVSFLAS   239
               I PG V T +     FE              L E +   P R     E+A+   FLAS
Sbjct: 163  FGIAPGAVQTAMTASDFE----------PGGLAEWVASETPIGRWTKPSEVAELTGFLAS   212

Query: 240  DKAKGVTGQACILDGGYT                                            257
            KA+  + G+    +DGG++
Sbjct: 213  GKARSMQGEIVKIDGGWS                                            230
```

A further related DNA sequence was identified in S. pyogenes <SEQ ID 2259> which encodes the amino acid sequence <SEQ ID 2260>. An alignment of the GAS and GBS sequences follows:

```
Score = 427 bits (1086), Expect = e-122
Identities = 206/232 (88%), Positives = 224/232 (95%)
Query:   4  MTKVVLVTGCASGIGYAQARYFLKQGHHVYGVDKSDKPDLSGNFHFIKLDLSSELAPLFK    63
            MTKVVLVTGCASGIGYAQA+YFLKQG+ VYGVDKSDKP+L+GNF+FIKLDLSS+L+PLF
Sbjct:   1  MTKVVLVTGCASGIGYAQAQYFLKQGYQVYGVDKSDKPNLNGNFNFIKLDLSSDLSPLFT    60

Query:  64  VVPSVDILCNTAGILDAYKPLLDVSDEEVEHLFDINFFATVKLTRHYLRRMVEKQSGVII   123
            +VP+VDILCNTAGILDAYKPLL+VSDEE+EHLFDINFF TV+LTRHYLRRMVEK+SG+II
Sbjct:  61  MVPTVDILCNTAGILDAYKPLLEVSDEELEHLFDINFFVTVRLTRHYLRRMVEKKSGIII   120

Query: 124  NMCSIASFIAGGGGVAYTSSKHALAGFTRQLALDYAKDQIHIFGIAPGAVKTAMTANDFE   183
            NMCSIASFIAGGGG AYTSSKHALAGFTRQLALDYAKD I IFGIAPGAV+TAMTA+DFE
Sbjct: 121  NMCSIASFIAGGGGAAYTSSKHALAGFTRQLALDYAKDCIQIFGIAPGAVQTAMTASDFE   180

Query: 184  PGGLADWVARETPIGRWTKPDEVAELTGFLASGKARSMQGEIVKIDGGWTLK           235
            PGGLA+WVA ETPIGRWTKP EVAELTGFLASGKARSMQGEIVKIDGGW+LK
Sbjct: 181  PGGLAEWVASETPIGRWTKPSEVAELTGFLASGKARSMQGEIVKIDGGWSLK           232
```

SEQ ID 2258 (GBS251) was expressed in E. coli as a His-fusion product. SDS-PAGE analysis of total cell extract is shown in FIG. 43 (lane 2; MW 21.7 kDa). It was also expressed in E. coli as a GST-fusion product. SDS-PAGE analysis of total cell extract is shown in FIG. 47 (lane 6; MW 52 kDa).

Based on this analysis, it was predicted that these proteins and their epitopes could be useful antigens for vaccines or diagnostics.

Example 737

A DNA sequence (GBSx0783) was identified in S. agalactiae <SEQ ID 2261> which encodes the amino acid sequence <SEQ ID 2262>. Analysis of this protein sequence reveals the following:

```
Possible site: 48
>>> Seems to have no N-terminal signal sequence
INTEGRAL      Likelihood = −3.82    Transmembrane 62-78 (62-79)
----- Final Results -----
    bacterial membrane --- Certainty= 0.2529 (Affirmative) <succ>
       bacterial outside --- Certainty = 0.0000 (Not Clear) <succ>
          bacterial cytoplasm --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 738

A DNA sequence (GBSx0784) was identified in *S. agalactiae* <SEQ ID 2263> which encodes the amino acid sequence <SEQ ID 2264>. Analysis of this protein sequence reveals the following:

```
Possible site 31
>>> Seems to have no N-terminal signal sequence
----- Final Results -----
    bacterial cytoplasm --- Certainty = 0.1495 (Affirmative) <succ>
       bacterial membrane --- Certainty = 0.0000 (Not Clear) <succ>
          bacterial outside --- Certainty = 0.0000 (Not Clear) <succ>
```

The protein has homology with the following sequences in the GENPEPT database:

```
>GP:CAA20397 GB:AL031317 SC6G4.19c, unknown, len: 190 aa; contains
Pro-Ser- r ich domain at N-terminus [Streptomyces coelicolor A3(2)]
Identities = 26/80 (32%), Positives = 44/80 (54%), Gaps = 5/80 (6%)
Query:   1  MDSNDEAICIIEITKVDIVPFKDVSADHAFKEGEGDKTLEWWRKAHIDFF-----KPYFE    55
            +DS +  + +IE+T+V +VP  +V   HA  EGEGD ++  WR  H  F+       +
Sbjct: 103  VDSRERPVAVIEVTEVRVVPLAEVDLAHAVDEGEGDTSVAGWRAGHERFWHGAEMRAALG   162

Query:  56  EFGLMFSEDSRIVLEEFQVV                                           75
            + G    + + +VLE F++V
Sbjct: 163  DPGFTVDDATPVVLERFRIV                                          182
```

No corresponding DNA sequence was identified in *S. pyogenes*.

Based on this analysis, it was predicted that this protein and its epitopes, could be useful antigens for vaccines or diagnostics.

Example 739

A DNA sequence (GBSx0785) was identified in *S. agalactiae* <SEQ ID 2265> which encodes the amino acid sequence <SEQ ID 2266>. Analysis of this protein sequence reveals the following:

```
Possible site: 40
>>> Seems to have an uncleavable N-term signal seq
INTEGRAL      Likelihood = −1.49    Transmembrane 3-19 (3-19)
----- Final Results -----
    bacterial membrane --- Certainty = 0.1595 (Affirmative) <succ>
       bacterial outside --- Certainty = 0.0000 (Not Clear) <succ>
          bacterial cytoplasm --- Certainty = 0.0000 (Not Clear) <succ>
```

The protein has homology with the following sequences in the GENPEPT database:

```
>GP:BAB06422 GB:AP001516 unknown conserved protein [Bacillus halodurans]
Identities = 133/315 (42%), Positives = 191/315 (60%), Gaps = 4/315 (1%)
Query:   1  MKLAVLGTGMIVKEVLPVLQKIEGIDLVAILSTVRSLETAKDLAKEYNMSLATSEYKAVL    60
            MK+A +GTG IV+  L  L  I+G   VA+ S R   TAK LA +YN+     + +  +L
Sbjct:   1  MKIATVGTGPIVEAFLSALDDIDGPMCVAMYS--RKETTAKPLADQYNIPTIYTHFDHML    58

Query:  61  DNEEIDTVYIGLPNHLHFDYAKEALLAGKHVICEKPFTLEASQLEELVSIANTRQLILLE   120
            +   ++ VY+  PN LH+ +A +AL    KHVICEKPFT  A +LE L+S+A     +L+L E
Sbjct:  59  ADPNVEVVYVASPNSLHYQHALQALEHRKHVICEKPFTSTARELEHLISVARKNELMLFE   118

Query: 121  AITNQYLPNFDLVKEHLSNLGDIKIVECNYSQYSSRYDAFKRGEIAPAFNPEMGGGALRD   180
            AIT  +LPN+ L+KE++   LG IK+++CNYSQYSSRYD F  GE     FNP    GGAL D
Sbjct: 119  AITTIHLPNYQLIKENIHKLGSIKMIQCNYSQYSSRYDRFLSGETPNVFNPAFSGGALMD   178

Query: 181  LNIYNLHLVIGLFGEPITAQYLPNIE-RGIDTSGVLVLDYGHFKTVCIGAKDCSAEVKST   239
            +N+YN+H V+  LFG P  A Y+ N    GIDTSGVLVL Y HF + C+G KD    +
Sbjct: 179  INVYNIHFVMNLFGPPEAAHYIANQHANGIDTSGVLVLKYPHFISECVGCKDTQSMNFVL   238

Query: 240  IQGDKGSIAILGPTNTMPKISLTMNGQESHVYQLNGDRHRMHDEFVIFEGIISNLDFKRA   299
            IQG+KG I +      N  + ++ Q S +    D       ++  +E +     +F++
Sbjct: 239  IQGEKGYIHVENGANGCRNVKIYLDDQTSELNAQTNDNLLYYETRTFYE-MYQAKNFEKC   297
```

```
Query:  300  AQALEHSRTVMKVLD                                     314
             + L +S +VM+V++
Sbjct:  298  YELLSYSHSVMRVME                                     312
```

A related DNA sequence was identified in *S. pyogenes* <SEQ ID 719> which encodes the amino acid sequence <SEQ ID 720>. Analysis of this protein sequence reveals the following:

---

Possible site: 40
>>> Seems to have a cleavable N-term signal seq.
----- Final Results -----
    bacterial outside --- Certainty = 0.3000 (Affirmative) <succ>
      bacterial membrane --- Certainty = 0.0000 (Not Clear) <succ>
        bacterial cytoplasm --- Certainty = 0.0000 (Not Clear) <succ>

---

An alignment of the GAS and GBS proteins is shown below:

Based on this analysis, it was predicted that these proteins and their epitopes could be useful antigens for vaccines or diagnostics.

Example 740

A DNA sequence (GBSx0786) was identified in *S. agalactiae* <SEQ ID 2267> which encodes the amino acid sequence <SEQ ID 2268>. Analysis of this protein sequence reveals the following:

---

Possible site: 19
>>> Seems to have no N-terminal signal sequence

```
Identities = 233/314 (74%), Positives = 269/314 (85%)

Query:    1  MKLAVLGTGMIVKEVLPVLQKIEGIDLVAILSTVRSLETAKDLAKEYNMSLATSEYKAVL   60
             MKLAVLGTGMIVKEVLPVLQKI+GIDLVAILSTVRSL TAKDLAK ++M LATS+Y+A+L
Sbjct:    1  MKLAVLGTGMIVKEVLPVLQKIDGIDLVAILSTVRSLTTAKDLAKAHHMPLATSKYEAIL   60

Query:   61  DNEEIDTVYIGLPNHLHFDYAKEALLAGKHVICEKPFTLEASQLEELVSIANTRQLILLE  120
              NEEIDTVYIGLPNHLHF YAKEALLAGKHVICEKPFT+ A +L+ELV IA  R+LILLE
Sbjct:   61  GNEEIDTVYIGLPNHLHFAYAKEALLAGKHVICEKPFTMTAGELDELVVIARKRKLILLE  120

Query:  121  AITNQYLPNFDLVKEHLSNLGDIKIVECNYSQYSSRYDAFKRGEIAPAFNPEMGGGALRD  180
             AITNQYL N   +KEHL  LGDIKIVECNYSQYSSRYDAFKRG+IAPAFNP+MGGGALRD
Sbjct:  121  AITNQYLSNMTFIKEHLDQLGDIKIVECNYSQYSSRYDAFKRGDIAPAFNPKMGGGALRD  180

Query:  181  LNIYNLHLVIGLFGEPITAQYLPNIERGIDTSGVLVLDYGHFKTVCIGAKDCSAEVKSTI  240
             LNIYN+H V+GLFG P T QYL N+E+GIDTSG+LV+DY  FK VCIGAKDC+AE+KSTI
Sbjct:  181  LNIYNIHFVVGLFGRPKTVQYLANVEKGIDTSGMLVMDYEQFKVVCIGAKDCTAEIKSTI  240

Query:  241  QGDKGSIAILGPTNTMPKISLTMNGQESHVYQLNGDRHRMHDEFVIFEGIISNLDFKRAA  300
             QG+KGS+A+LG TNT+P++ L+++G E V   N   HRM++EFV F  +I   DF++
Sbjct:  241  QGNKGSLAVLGATNTLPQVQLSLHGHEPQVINHNKDHRMYEEFVAFRDMIDQRDFEKVN  300

Query:  301  QALEHSRTVMKVLD                                               314
             QALEHSR VM VL+
Sbjct:  301  QALEHSRAVMAVLE                                               314
```

SEQ ID 2266 (GBS342) was expressed in *E. coli* as a His-fusion product. SDS-PAGE analysis of total cell extract is shown in FIG. 72 (lane 10; MW 36.6 kDa). It was also expressed in *E. coli* as a GST-fusion product. SDS-PAGE analysis of total cell extract is shown in FIG. 81 (lane 2; MW 61 kDa).

GBS342-GST was purified as shown in FIG. 226, lane 3.

-continued

----- Final Results -----
    bacterial cytoplasm --- Certainty = 0.0499 (Affirmative) <succ>
      bacterial membrane --- Certainty = 0.0000 (Not Clear) <succ>
        bacterial outside --- Certainty = 0.0000 (Not Clear) <succ>

---

The protein has homology with the following sequences in the GENPEPT database:

```
>GP:CAB12535 GB:Z99107 similar to hypothetical proteins [Bacillus subtilis]
 Identities = 41/127 (32%), Positives = 63/127 (49%), Gaps = 11/127 (8%)

Query:    1  MISSIGQVMLYVSNVEASADFWKNKVGFERVEKQTQGDYVTYI-VAPKLDSEVSFVLHDK   59
                 MI  IG V +YV + + +  FW  KVGF+        G    +++ VAPK  +E    V++  K
    Sbjct:    1  MIKQIGTVAVYVEDQQKAKQFWTEKVGFDIAADHPMGPEASWLEVAPK-GAETRLVIYPK   59

Query:   60  AIIAQMSPELDLATPSILFETTDIDSTYQELTAN--EVMTNP-IVDMGSMRVFNFSDNDN  116
                 A    M   +     SI+FE DI TY+++  N  E +  P  ++ G+     F D D
    Sbjct:   60  A----MMKGSEQMKASIVFECEDIFGTYEKMKTNGVEFLGEPNQMEWGTF--VQFKDEDG  113

Query:  117  NYFAIRE                                                      123
                 N F ++E
    Sbjct:  114  NVFLLKE                                                      120
```

No corresponding DNA sequence was identified in *S. pyogenes*.

Based on this analysis, it was predicted that this protein and its epitopes, could be useful antigens for vaccines or diagnostics.

Example 741

A DNA sequence (GBSx0787) was identified in *S. agalactiae* <SEQ ID 2269> which encodes the amino acid sequence <SEQ ID 2270>. Analysis of this protein sequence reveals the following:

Possible site: 37
>>> Seems to have no N-terminal signal sequence
----- Final Results -----
   bacterial cytoplasm --- Certainty = 0.3402 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database:

```
>GP:BAB04569 GB:AP001510 unknown conserved protein in others [Bacillus halodurans]
Identities = 46/144 (31%), Positives = 83/144 (56%), Gaps = 10/144 (6%)

Query:    1 MVKALETYIVTNGNGRQAVDFYKDVFQADLVNMMTWEEM--DPNC--LEDRKDLIINAQL      56
            M+   +  Y++ +G+G+ A++FY+D   A+++ + T+ ++   PN      KDLI++A L
Sbjct:    1 MILTMNPYLMLDGDGQAAIEFYQDALNAEVITIQTYGDLPEQPNSPMASVNKDLILHAHL     60

Query:   57 IFDGIRLQISDENPD-----FVYQAGKNVTAAIIVGSVEEAREIYEKLKKSAQEVQLELQ    111
             + L ISD+  D       F   +G  VT A+   +VE   E+++KL     +E+  L+
Sbjct:   61 KLGEMDLMISDQCLDVDPERFPQHSGSPVTIALTTNNVEMITEVFQKLASGGEEIA-PLE    119

Query:  112 ETFWSPAYANLVDQFGVMWQISTE                                        135
            +TF+SP Y  + D+FG+ W +ST+
Sbjct:  120 KTFFSPLYGQVTDKFGITWHVSTQ                                        143
```

No corresponding DNA sequence was identified in *S. pyogenes*.

Based on this analysis, it was predicted that this protein and its epitopes, could be useful antigens for vaccines or diagnostics.

Example 742

A DNA sequence (GBSx0788) was identified in *S. agalactiae* <SEQ ID 2271> which encodes the amino acid sequence <SEQ ID 2272>. Analysis of this protein sequence reveals the following:

Possible site: 42
>>> Seems to have no N-terminal signal sequence
----- Final Results -----
   bacterial membrane --- Certainty = 0.0000 (Not Clear) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database:

```
>GP:BAB03784 GB:AP001507 UDP-N-acetylglucosamine pyrophosphorylase
[Bacillus halodurans]
Identities = 238/453 (52%), Positives = 322/453 (70%), Gaps = 1/453 (0%)

Query:    1 MSN-YAIILAAGKGTRMKSDLPKVMHKVSGITMLEHVFRSVQAIEPSKIVTVIGHKAELV     59
            MSN +A+ILAAG+GTRMKS  KV+H V G  M++HV   V A+    +IVT+IGH A+ V
Sbjct:    1 MSNRFAVILAAGQGTRMKSKLYKVLHSVCGKPMVQHVVDQVSALGFDEIVTIIGHGADAV     60

Query:   60 RDVLGDKSEFVMQTEQLGTGHAVMMAEEELATSKGHTLVIAGDTPLITGESLKNLIDFHV    119
            +  LG++  + +Q EQLGTGHAV+ AE  L   +G T+V+ GDTPL+T E++  ++ +H
Sbjct:   61 KSQLGERVSYALQEEQLGTGHAVLQAESALGGRRGVTIVLCGDTPLLTAETIDHVMSYHE    120

Query:  120 NHKNVATILTADAANPFGYGRIIRNSDDEVTKIVEQKDANDFEQQVKEINTGTYVFDNQS    179
             +   AT+LTA+ A+P GYGRI +RN    V +IVE KDA    E+Q+ E+NTGTY FDN++
Sbjct:  121 EEQAKATVLTAELADPTGYGRIVRNDKGLVERIVEHKDATSEEKQITEVNTGTYCFDNEA    180

Query:  180 LFEALKDINTNNAQGEYYLTDVIGIFKEAGKKVGAYKLRDFDESLGVNDRVALATAEKVM    239
            LF+ALK++  NNAQGEYYL DV I +   G+KV AYK    +E+LGVNDRVALA AE+VM
Sbjct:  181 LFQALKEVGNNNAQGEYYLPDVIQILQTKGEKVAAYKTAHVEETLGVNDRVALAQAEQVM    240

Query:  240 RHRIARQHMVNGVTVVNPDSAYIDIDVEIGEESVIEPNVTLKGQTKIGKGTLLTNGSYLV    299
            + RI   M  GVT ++P+  Y+  D  IG+++VI P  + GQT IG+G +L       + L
Sbjct:  241 KRRINEAWMRKGVTFIDPEQTYVSPDATIGQDTVIYPGTMVLGQTTIGEGCVLGPHTELK    300

Query:  300 DAQVGNDVTITNSMVEESIISDGVTVGPYAHIRPGTSLAKGVHIGNFVEVKGSQIGENTK    359
            D++++GN   +  S+V   S +  + V++GP++HIRP + +    V IGNFVEVK S IG+ +K
Sbjct:  301 DSKIGNKTAVKQSVVHNSEVGERVSIGPFSHIRPASMIHDDVRIGNFVEVKKSTIGKESK    360

Query:  360 AGHLTYIGNAEVGCDVNFGAGTITVNYDGQNKFKTEIGSNVFIGSNSTLIAPLEIGDNAL    419
            A HL+YIG+AEVG   VNF   GITVNYDG+NKF T+I   FIG NS LIAP+ IG  AL
Sbjct:  361 ASHLSYIGDAEVGERVNFSCGSITVNYDGKNKFLTKIEDDAFIGCNSNLIAPVTIGKGAL    420
```

```
-continued
Query:   420  TAAGSTITDNVPIDSIAIGRGRQVNKEGYANKK                    452
              AAGSTIT++VP D+++I R RQ NKE Y  KK
Sbjct:   421  IAAGSTITEDVPSDALSIARARQTNKEHYVTKK                    453
```

A related DNA sequence was identified in *S. pyogenes* <SEQ ID 2273> which encodes the amino acid sequence <SEQ ID 2274>. Analysis of this protein sequence reveals the following:

Possible site: 42
>>> Seems to have no N-terminal signal sequence
----- Final Results -----
   bacterial cytoplasm --- Certainty = 0.0461 (Affirmative) <succ>
    bacterial membrane --- Certainty = 0.0000 (Not Clear) <succ>
     bacterial outside --- Certainty = 0.0000 (Not Clear) <succ>

An alignment of the GAS and GBS proteins is shown below:

```
Identities = 345/458 (75%), Positives = 398/458 (86%)

Query:     1  MSNYAIILAAGKGTRMKSDLPKVMHKVSGITMLEHVFRSVQAIEPSKIVTVIGHKAELVR      60
              M+NYAIILAAGKGTRM SDLPKV+HKVSG+TMLEHVFRSV+AI P K VTVIGHK+E+VR
Sbjct:     1  MTNYAIILAAGKGTRMTSDLPKVLHKVSGLTMLEHVFRSVKAISPEKSVTVIGHKSEMVR      60

Query:    61  DVLGDKSEFVMQTEQLGTGHAVMMAEEELATSKGHTLVIAGDTPLITGESLKNLIDFHVN     120
               VL D+S FV QTEQLGTGHAVMMAE +L    +GHTLVIAGDTPLITGESLK+LIDFHVN
Sbjct:    61  AVLADQSAFVHQTEQLGTGHAVMMAETQLEGLEGHTLVIAGDTPLITGESLKSLIDFHVN     120

Query:   121  HKNVATILTADAANPFGYGRIIRNSDDEVTKIVEQKDANDFEQQVKEINTGTYVFDNQSL     180
              HKNVATILTA A +PFGYGRI+RN D EV KIVEQKDAN++EQQ+KEINTGTYVFDN+ L
Sbjct:   121  HKNVATILTATAQDPFGYGRIVRNKDGEVIKIVEQKDANEYEQQLKEINTGTYVFDNKRL     180

Query:   181  FEALKDINTNNAQGEYYLTDVIGIFKEAGKKVGAYKLRDFDESLGVNDRVALATAEKVMR     240
              FEALK I TNNAQGEYYLTDV+ IF+   +KVGAY LRDF+ESLGVNDRVALA AE VMR
Sbjct:   181  FEALKCITTNNAQGEYYLTDVVAIFRANKEKVGAYILRDFNESLGVNDRVALAIAETVMR     240

Query:   241  HRIARQHMVNGVTVVNPDSAYIDIDVEIGEESVIEPNVTLKGQTKIGKGTLLTNGSYLVD     300
               RI ++HMVNGVT  NP++ YI+ DVEI  + +IE NVTLKG+T IG GT+LTNG+Y+VD
Sbjct:   241  QRITQKHMVNGVTFQNPETVYIESDVEIAPDVLIEGNVTLKGRTHIGSGTVLTNGTYIVD     300

Query:   301  AQVGNDVTITNSMVEESIISDGVTVGPYAHIRPGTSLAKGVHIGNFVEVKGSQIGENTKA     360
              +++G++  +TNSM+E S+++ GVTVGPYAH+RPGT+L + VHIGNFVEVKGS IGE TKA
Sbjct:   301  SEIGDNCVVTNSMIESSVLAAGVTVGPYAHLRPGTTLDREVHIGNFVEVKGSHIGEKTKA     360

Query:   361  GHLTYIGNAEVGCDVNFGAGTITVNYDGQNKFKTEIGSNVFIGSNSTLIAPLEIGDNALT     420
              GHLTYIGNA+VG  VN GAGTITVNYDGQNK++T IG +FIGSNSTLIAPLE+GD+ALT
Sbjct:   361  GHLTYIGNAQVGSSVNVGAGTITVNYDGQNKYETVIGDHAFIGSNSTLIAPLEVGDHALT     420

Query:   421  AAGSTITDNVPIDSIAIGRGRQVNKEGYANKKPHHPSQ                        458
              AAGSTI+ VPIDSIAIGR RQV KEGYA + HHPS+
Sbjct:   421  AAGSTISKTVPIDSIAIGRSRQVTKEGYAKRLAHHPSR                        458
```

Based on this analysis, it was predicted that these proteins and their epitopes could be useful antigens for vaccines or diagnostics.

Example 743

A DNA sequence (GBSx0790) was identified in *S. agalactiae* <SEQ ID 2275> which encodes the amino acid sequence <SEQ ID 2276>. Analysis of this protein sequence reveals the following:

Possible site: 52
>>> Seems to have no N-terminal signal sequence
----- Final Results -----
   bacterial cytoplasm --- Certainty = 0.1366 (Affirmative) <succ>
    bacterial membrane --- Certainty = 0.0000 (Not Clear) <succ>
     bacterial outside --- Certainty = 0.0000 (Not Clear) <succ>

The protein has homology with the following sequences in the GENPEPT database:

```
>GP:CAB14293 GB:Z99116 similar to hypothetical proteins [Bacillus subtilis]
Identities = 92/177 (51%), Positives = 124/177 (69%), Gaps = 4/177 (2%)

Query:     4  EEKTINRQTVFDGQIIKVAVDDVELPNGLGQSKRELVFHGGAVATLAVTPEHKIVLVKQY      63
              EEKTI ++ +F G++I + V+DVELPNG  SKRE+V H GAVA LAVT E KI++VKQ+
```

```
Sbjct:    5  EEKTIAKEQIFSGKVIDLYVEDVELPNGKA-SKREIVKHPGAVAVLAVTDEGKIIMVKQF    63

Query:   64  RKAIEGISYEIPAGKLETGESGSKEEAALRELEEETGYTG-NLEILYSFYTAIGFCNEKI   122
             RK +E     EIPAGKLE GE   E  ALRELEEETGYT   L  + +FYT+ GF +E +
Sbjct:   64  RKPLERTIVEIPAGKLEKGE--EPEYTALRELEEETGYTAKKLTKITAFYTSPGFADEIV   121

Query:  123  VLYLATDLQKVENPRPQDDDEVLELLELSYEDCMQMVEKGMIQDAKTIIALQYYGLK    179
               ++LA +L  +E  R  D+DE +E++E++ ED +++VE    + DAKT  A+QY  LK
Sbjct:  122  HVFLAEELSVLEEKRELDEDEFVEVMEVTLEDALKLVESREVYDAKTAYAIQYLQLK    178
```

A related DNA sequence was identified in *S. pyogenes* <SEQ ID 2277> which encodes the amino acid sequence <SEQ ID 2278>. Analysis of this protein sequence reveals the following:

---

Possible site: 50
>>> Seems to have no N-terminal signal sequence
----- Final Results -----
    bacterial cytoplasm --- Certainty = 0.1120 (Affirmative) <succ>
      bacterial membrane --- Certainty = 0.0000 (Not Clear) <succ>
        bacterial outside --- Certainty = 0.0000 (Not Clear) <succ>

---

An alignment of the GAS and GBS proteins is shown below:

```
Identities = 136/182 (74%), Positives = 153/182 (83%)

Query:    1  MDFEEKTINRQTVFDGQIIKVAVDDVELPNGLGQSKRELVFHGGAVATLAVTPEHKIVLV    60
             M FEEKT+ RQTVFDG I KV VDDVELPN LGQSKREL+FH GAVA LA+TPE KIVLV
Sbjct:    1  MKFEEKTLKRQTVFDGHIFKVVVDDVELPNNLGQSKRELIFHRGAVAVLAITPERKIVLV    60

Query:   61  KQYRKAIEGISYEIPAGKLETGESGSKEEAALRELEEETGYTGNLEILYSFYTAIGFCNE   120
             KQYRKAIE +SYEIPAGKLE GE GSK +AA RELEEET YTG L  LY FYTAIGFCNE
Sbjct:   61  KQYRKAIERVSYEIPAGKLEIGEEGSKLKAAARELEEETAYTGTLTFLYEFYTAIGFCNE   120

Query:  121  KIVLYLAIDLQKVENPRPQDDDEVLELLELSYEDCMQMVEKGMIQDAKTIIALQYYGLKM   180
             KI L+LATDL +V NP+PQDDDEV+E+LEL+Y++CM +V +G + DAKT+IALQYY L
Sbjct:  121  KITLFLAIDLIQVANPKPQDDDEVIEVLELTYQECMDLVAQGKLADAKTLIALQYYALHF   180

Query:  181  GG    182
             GG
Sbjct:  181  GG    182
```

Based on this analysis, it was predicted that these proteins and their epitopes could be useful antigens for vaccines or diagnostics.

Example 744

A DNA sequence (GBSx0791) was identified in *S. agalactiae* <SEQ ID 2279> which encodes the amino acid sequence <SEQ ID 2280>. Analysis of this protein sequence reveals the following:

---

Possible site: 16
>>> Seems to have no N-terminal signal sequence
INTEGRAL    Likelihood = –15.44    Transmembrane 70-86 (64-88)
----- Final Results -----
    bacterial membrane --- Certainty = 0.7177 (Affirmative) <succ>
      bacterial outside --- Certainty = 0.0000 (Not Clear) <succ>
        bacterial cytoplasm --- Certainty = 0.0000 (Not Clear) <succ>

---

The protein has no significant homology with any sequences in the GENPEPT database.

A related DNA sequence was identified in *S. pyogenes* <SEQ ID 2281> which encodes the amino acid sequence <SEQ ID 2282>. Analysis of this protein sequence reveals the following:

---

Possible site: 35
>>> Seems to have no N-terminal signal sequence
INTEGRAL    Likelihood = –15.60    Transmembrane 65-81 (58-83)
----- Final Results -----
    bacterial membrane --- Certainty = 0.7241 (Affirmative) <succ>
      bacterial outside --- Certainty = 0.0000 (Not Clear) <succ>
        bacterial cytoplasm --- Certainty = 0.0000 (Not Clear) <succ>

---

An alignment of the GAS and GBS proteins is shown below:

```
Identities = 39/89 (43%), Positives = 61/89 (67%), Gaps = 6/89 (6%)

Query:    1  MGKPLLTDDMIERSNRGEKVSGQTILDQETKIISTEDGMEQLTDENGKHIYKSRRIENAK    60
             MG+PLLTDD+IE++ R E       ++ +TK+++  +       ++  IYKSRRIENAK
Sbjct:    2  MGRPLLTDDIIEKARRMETFEPDDAVNFDTKVMTLPE------KDDKARIYKSRRIENAK    55

Query:   61  RNEFQRKLNLVLFILLILLALLFYAIFKL    89
             R++ Q KLN++L   +++L+A+L YAIF L
Sbjct:   56  RSQLQSKLNVILIAVMLLIAILVYAIFYL    84
```

Based on this analysis, it was predicted that these proteins and their epitopes could be useful antigens for vaccines or diagnostics.

Example 745

A DNA sequence (GBSx0792) was identified in *S. agalactiae* <SEQ ID 2283> which encodes the amino acid sequence <SEQ ID 2284>. This protein is predicted to be pfs protein (pfs). Analysis of this protein sequence reveals the following:

```
Possible site: 55
>>> Seems to have no N-terminal signal sequence
INTEGRAL    Likelihood = –0.32    Transmembrane 56-72 (56-72)
----- Final Results -----
    bacterial membrane --- Certainty = 0.1128 (Affirmative) <succ>
        bacterial outside --- Certainty = 0.0000 (Not Clear) <succ>
            bacterial cytoplasm --- Certainty = 0.0000 (Not Clear) <succ>
```

The protein has homology with the following sequences in the GENPEPT database:

```
>GP:AAC22869 GB:U32801 pfs protein (pfs) [Haemophilus influenzae Rd]
Identities = 100/229 (43%), Positives = 144/229 (62%)

Query:    1   MKIGIIAAMEEELKLLVENLEDKSQETVLSNVYYSGRYGEHELVLVQSGVGKVMSAMSVA    60
              MKIGI+ AM +E+++L   + D+++  V S V + G+    ++ L+QSG+GKV +A+
Sbjct:    1   MKIGIVGAMAQEVEILKNLMADRTETRVASAVIFEGKINGKDVALLQSGIGKVAAAIGTT  60

Query:   61   ILVESEKVDAIINTGSAGAVATGLNVGDVVVADTLVYHDVDLTAFGYDYGQMSMQPLYFH  120
              L++  K D +INTGSAG VA GL VGD+V++D   YHD D+TAFGY+ GQ+   P  F
Sbjct:   61   ALLQLAKPDCVINTGSAGGVAKGLKVGDIVISDETRYHDADVTAFGYEKGQLPANPAAFL 120

Query:  121   SDKTFVSTFEAVLSKEEMISKVGLIATGDSFIAGQEKIDVIKGHFPQVLAVEMEGAAIAQ  180
              SDK      + +  K+     K GLI +GDSFI  ++KI  IK  FP V  VEME  AIAQ
Sbjct:  121   SDKKLADLAQEIAEKQGQSVKRGLICSGDSFINSEDKIAQIKADFPNVTGVEMEATAIAQ 180

Query:  181   AAQATGKPFVVVRAMSDTAAHDANITFDEFIIEAGKRSAQVLMAFLKAL            229
                    A   PFVVVRA+SD     A+++F+EF+   A K+S+ +++   +   L
Sbjct:  181   VCYAFNVPFVVVRAISDGGDGKASMSFEEFLPLAAKQSSALVLGMIDRL            229
```

A related DNA sequence was identified in *S. pyogenes* <SEQ ID 2285> which encodes the amino acid sequence <SEQ ID 2286>. Analysis of this protein sequence reveals the following:

```
Possible site: 23
>>> Seems to have no N-terminal signal sequence
----- Final Results -----
    bacterial cytoplasm --- Certainty = 0.1245 (Affirmative) <succ>
        bacterial membrane --- Certainty = 0.0000 (Not Clear) <succ>
            bacterial outside --- Certainty = 0.0000 (Not Clear) <succ>
```

An alignment of the GAS and GBS proteins is shown below:

```
Identities = 169/229 (73%), Positives = 189/229 (81%)

Query:    1   MKIGIIAAMEEELKLLVENLEDKSQETVLSNVYYSGRYGEHELVLVQSGVGKVMSAMSVA   60
              MKIGIIAAMEEEL LL+ NL D   +  VLS  YY+GR+G+HEL+LVQSGVGKVMSAM+VA
Sbjct:    1   MKIGIIAAMEEELSLLLANLLDAQEHQVLSKTYYTGRFGKHELILVQSGVGKVMSAMTVA  60

Query:   61   ILVESFKVDAIINTGSAGAVATGLNVGDVVVADTLVYHDVDLTAFGYDYGQMSMQPLYFH  120
              ILVE FK  AIINTGSAGAVA+ L +GDVVVAD LVYHDVD TAFGY YGQM+  QPLY+
Sbjct:   61   ILVEHFKAQAIINTGSAGAVASHLAIGDVVVADRLVYHDVDATAFGYAYGQMAGQPLYYD 120

Query:  121   SDKTFVSTFEAVLSKEEMISKVGLIATGDSFIAGQEKIDVIKGHFPQVLAVEMEGAAIAQ  180
                D   FV+ F+ +  VL   E+     +VGLIATGDSF+AGQ+KID  IK   F    VLAVEMEGAAIAQ
Sbjct:  121   CDPQFVAIFKQVLKHEKTNGQVGLIATGDSFVAGQDKIDQIKTAFSDVLAVEMEGAAIAQ 180

Query:  181   AAQATGKPFVVVRAMSDTAAHDANITFDEFIIEAGKRSAQVLMAFLKAL            229
              AA   GKPF+VVRAMSDTAAHDANITFD+FIIEAGKRSAQ LM FL+ L
Sbjct:  181   AAHTAGKPFIVVRAMSDTAAHDANITFDQFIIEAGKRSAQTLMTFLENL            229
```

Based on this analysis, it was predicted that these proteins and their epitopes could be useful antigens for vaccines or diagnostics.

Example 746

A DNA sequence (GBSx0793) was identified in *S. agalactiae* <SEQ ID 2287> which encodes the amino acid sequence <SEQ ID 2288>. This protein is predicted to be SloR. Analysis of this protein sequence reveals the following:

```
Possible site: 53
>>> Seems to have no N-terminal signal sequence
```

-continued

```
----- Final Results -----
    bacterial cytoplasm --- Certainty = 0.3777 (Affirmative) <succ>
        bacterial membrane --- Certainty = 0.0000 (Not Clear) <succ>
            bacterial outside --- Certainty = 0.0000 (Not Clear) <succ>
```

A related GBS nucleic acid sequence <SEQ ID 9405> which encodes amino acid sequence <SEQ ID 9406> was also identified.

The protein has homology with the following sequences in the GENPEPT database:

```
>GP:AAF81675 GB:AF232688 SloR [Streptococcus mutans]
Identities = 97/175 (55%), Positives = 134/175 (76%)

Query:      1   MSEMIKKMISEQLIVKDKDLGYYLTKQGLLVVSDLYRKHRLVEVFLVNHLHYTADDIHEE    60
                +SEM+KK++ E L++KDK  GY LTK+G ++ S LYRKHRL+EVFL+NHL+YTAD+IHEE
Sbjct:     38   VSEMVKKLLLEDLVLKDKQAGYLLTKKGQILASSLYRKHRLIEVFLMNHLNYTADEIHEE    97

Query:     61   AEVLEHTVSTTFVDQLEKLLDFPQFCPHGGTIPKKGEFLVEINQMTLDQISQLGTYVISR   120
                AEVLEHTVS  FV++L+K L++P+ CPHGGTIP+ G+ LVE  + TL  ++++G Y++ R
Sbjct:     98   AEVLEHTVSDVFVERLDKFLNYPKVCPHGGTIPQHGQPLVERYRTTLKGVTEMGVYLLKR   157

Query:    121   VHDDFQLLKYLEQHRLHINDTIELTQIDPYAKTYHITYNDENLTIPERIASQIYV       175
                V D+FQLLKY+EQH L I D + L + D +A  Y I  + E L +    +ASQIY+
Sbjct:    158   VQDNFQLLKYMEQHHLKIGDELRLLEYDAFAGAYTIEKDGEQLQVTSAVASQIYI       212
```

A related DNA sequence was identified in *S. pyogenes* <SEQ ID 2289> which encodes the amino acid sequence <SEQ ID 2290>. Analysis of this protein sequence reveals the following:

Possible site: 39
>>> Seems to have no N-terminal signal sequence
----- Final Results -----
　　bacterial cytoplasm --- Certainty = 0.2910 (Affirmative) <succ>
　　　bacterial membrane --- Certainty = 0.0000 (Not Clear) <succ>
　　　　bacterial outside --- Certainty = 0.0000 (Not Clear) <succ>

Possible site: 46
>>> Seems to have no N-terminal signal sequence
----- Final Results -----
　　bacterial cytoplasm --- Certainty = 0.3569 (Affirmative) <succ>
　　　bacterial membrane --- Certainty = 0.0000 (Not Clear) <succ>
　　　　bacterial outside --- Certainty = 0.0000 (Not Clear) <succ>

An alignment of the GAS and GBS proteins is shown below:

```
Identities = 44/75 (58%), Positives = 59/75 (78%)

Query:      1   MSEMIKKMISEQLIVKDKDLGYYLTKQGLLVVSDLYRKHRLVEVFLVNHLHYTADDIHEE    60
                +SEMIKKMIS+  IVKDK  GY L  +G  +V++LYRK RL+EVFL++ L Y   ++H+E
Sbjct:     38   VSEMIKKMISQGWIVKDKAKGYLLKDKGYALVANLYRKLRLIEVFLIHQLGYNTQEVHQE    97

Query:     61   AEVLEHTVSTTFVDQ                                                75
                AEVLEHTVS +F+D+
Sbjct:     98   AEVLEHTVSDSFIDR                                               112
```

Based on this analysis, it was predicted that these proteins and their epitopes could be useful antigens for vaccines or diagnostics.

Example 747

A DNA sequence (GBSx0794) was identified in *S. agalactiae* <SEQ ID 2291> which encodes the amino acid sequence <SEQ ID 2292>. This protein is predicted to be undecaprenyl pyrophosphate synthetase (uppS). Analysis of this protein sequence reveals the following:

A related GBS nucleic acid sequence <SEQ ID 9435> which encodes amino acid sequence <SEQ ID 9436> was also identified.

The protein has homology with the following sequences in the GENPEPT database:

```
>GP:CAB13526 GB:Z99112 similar to hypothetical proteins [Bacillus subtilis]
Identities = 88/165 (53%), Positives = 118/165 (71%), Gaps = 4/165 (2%)

Query:      1   MNLPVKFFDKYVPELDENNVRVQVIGDTHKLPKATYDAMQRACLRTKHNSGLVLNFALNY    60
                M LP +F + Y+PEL + NV+V++IGD   LP T  A+++A    T  N G++LNFALNY
Sbjct:    100   MKLPEEFLNTYLPELVEENVQVRIIGDETALPAHTLRAIEKAVQDTAQNDGMILNFALNY   159

Query:     61   GGRSEITNAIKEIAQDVLEAKLNPDDITEDLVANHLMTNSLPYLYRDPDLIIRTSGELRL   120
                GGR+EI +A K +A+ V E  LN +DI E L + +LMT SL    +DP+L+IRTSGE+RL
Sbjct:    160   GGRTEIVSAAKSLAEKVKEGSLNIEDIDESLFSTYLMTESL----QDPELLIRTSGEIRL   215

Query:    121   SNFLPWQSAYSEFYFTPVLWPDFKKDELHKAIVDYNQRHRRFGSV                 165
                SNF+ WQ AYSEF FT VLWPDFK+D   +A+ ++ QR RRFG +
Sbjct:    216   SNFMLWQVAYSEFVFTDVLWPDFKEDHFLQALGEFQQRGRRFGGI                 260
```

A related DNA sequence was identified in *S. pyogenes* <SEQ ID 2293> which encodes the amino acid sequence <SEQ ID 2294>. Analysis of this protein sequence reveals the following:

Possible site: 57
>>> Seems to have no N-terminal signal sequence
----- Final Results -----
    bacterial cytoplasm --- Certainty = 0.2073 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below:

```
Identities = 125/165 (75%), Positives = 145/165 (87%)

Query:    1   MNLPVKFFDKYVPELDKNNVRVQVIGDTHKLPKATYDAMQRACLRTKHNSGLVLNFALNY    60
              MNLPV FFDKYVP L +NNV++Q+IG+T +LP+ T  A+  A  +TK N+GL+LNFALNY
Sbjct:   85   MNLPVTFFDKYVPVLHENNVKIQMIGETSRLPEDTLAALNAAIDKTKRNTGLILNFALNY   144

Query:   61   GGRSEITNAIKEIAQDVLEAKLNPDDITEDLVANHLMTNSLPYLYRDPDLIIRTSGELRL   120
              GGR+EIT+A++ IAQDVL+AKLNP DITEDL+AN+LMT+ LPYLYRDPDLIIRTSGELRL
Sbjct:  145   GGRAEITSAVRFIAQDVLDAKLNPGDITEDLIANYLMTDHLPYLYRDPDLIIRTSGELRL   204

Query:  121   SNFLPWQSAYSEFYFTPVLWPDFKKDELHKAIVDYNQRHRRFGSV                165
              SNFLPWQSAYSEFYFTPVLWPDFKK EL KAI DYN+R RRFG V
Sbjct:  205   SNFLPWQSAYSEFYFTPVLWPDFKKAELLKAIADYNRRQRRFGKV                249
```

Based on this analysis, it was predicted that these proteins and their epitopes could be useful antigens for vaccines or diagnostics.

Example 748

A DNA sequence (GBSx0795) was identified in *S. agalactiae* <SEQ ID 2295> which encodes the amino acid sequence <SEQ ID 2296>. This protein is predicted to be phosphatidate cytidylyltransferase (cdsA). Analysis of this protein sequence reveals the following:

Possible site: 22
>>> Seems to have a cleavable N-term signal seq.
INTEGRAL    Likelihood = −8.65    Transmembrane 201-217 (194-222)
INTEGRAL    Likelihood = −7.96    Transmembrane 175-191 (170-197)
INTEGRAL    Likelihood = −5.89    Transmembrane 81-97 (74-99)
INTEGRAL    Likelihood = −3.03    Transmembrane 26-42 (23-42)
INTEGRAL    Likelihood = −2.92    Transmembrane 136-152 (135-153)
INTEGRAL    Likelihood = −2.02    Transmembrane 49-65 (47-66)
INTEGRAL    Likelihood = −0.64    Transmembrane 248-264 (248-264)
----- Final Results -----
    bacterial membrane --- Certainty = 0.4461 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database:

```
>GP:BAB06141 GB:AP001515 phosphatidate cytidylyltransferase [Bacillus halodurans]
Identities = 116/266 (43%), Positives = 172/266 (64%), Gaps = 6/266 (2%)

Query:    1   MKERVIWGAVALAIFIPFLVMGGLPFQFLVGLLAMIGVSELLRMRRLEIFSFEGALAMIG    60
              MK+RV+       +F+ F+V+GGLPF    + ++A I +SELL+M+++   FS   GA +++
Sbjct:    1   MKQRVVTAIIFGLVFLTFVVVGGLPFTMFIIVVATIAMSELLKMKKIAPFSPMGAFSLLP    60

Query:   61   AFVLTVPLDSYLSFLPVDASLSAYGIVIFMILAGTVLNSNSYSFEDAAFPIASSFYVGIG   120
              ++L +P D +    +P    +  +    I  +L TVL N+++F++A F I SS Y+G G
Sbjct:   61   MWMLLLPNDWFKVVIPDFTKVEIFIFFILFLLLLTVLTKNTFTFDEAGFVILSSAYIGYG   120

Query:  121   FQNLVSARMA---GIDKVLLALFIVWATDIGAYMIGRQFGQRKLLPSVSPNKTIEGSLGG   177
              F  L+ +R    G+  V   LF++WATD GAY  GR FG+ KL P +SPNKTIEGS+GG
Sbjct:  121   FHFLLLSREIPEIGLPLVFFVLFVIWATDSGAYFAGRAFGKHKLWPHISPNKTIEGSIGG   180

Query:  178   IASAIVVAFFFMLFDKTVYAPHSFLVMLVLVAIFSIFGQFGDLVESSIKRHFGVKDSGKL   237
              I A+++   F           S+ V L ++ + S+FGQ GDLVES++KRH+ VKDSG +
Sbjct:  181   IILAVIIGSLFYWIMPLF---SSYGVALAVIVVASVFGQLGDLVESALKRHYAVKDSGTV   237

Query:  238   IPGHGGILDRFDSMIFVFPIMHFFGL                                    263
              +PGHGGILDRFDS+I+V PI+H    L
Sbjct:  238   LPGHGGILDRFDSLIYVMPILHLLHL                                    263
```

A related DNA sequence was identified in *S. pyogenes* <SEQ ID 2297> which encodes the amino acid sequence <SEQ ID 2298>. Analysis of this protein sequence reveals the following:

Possible site: 61
>>> Seems to have an uncleavable N-term signal seq
INTEGRAL    Likelihood = 9.98    Transmembrane 175-191 (170-197)

| | | | |
|---|---|---|---|
| INTEGRAL | Likelihood = 8.97 | Transmembrane 5-21 (4-42) | |
| INTEGRAL | Likelihood = 6.85 | Transmembrane 201-217 (197-222) | |
| INTEGRAL | Likelihood = 6.53 | Transmembrane 81-97 (79-99) | |
| INTEGRAL | Likelihood = 4.73 | Transmembrane 49-65 (47-71) | |
| INTEGRAL | Likelihood = 3.40 | Transmembrane 136-152 (135-153) | |
| INTEGRAL | Likelihood = 3.24 | Transmembrane 26-42 (22-42) | |
| INTEGRAL | Likelihood = 1.17 | Transmembrane 248-264 (248-264) | |

----- Final Results -----
   bacterial membrane --- Certainty= 0.4991 (Affirmative) <succ>
     bacterial outside --- Certainty= 0.0000 (Not Clear) <succ>
       bacterial cytoplasm --- Certainty= 0.0000 (Not Clear) <succ>

Possible site: 46
>>> Seems to have an uncleavable N-term signal seq

| | | | |
|---|---|---|---|
| INTEGRAL | Likelihood = −11.09 | Transmembrane 2-18 (1-25) |
| INTEGRAL | Likelihood = −9.39 | Transmembrane 394-410 (390-415) |
| INTEGRAL | Likelihood = −8.01 | Transmembrane 181-197 (173-198) |
| INTEGRAL | Likelihood = −2.97 | Transmembrane 343-359 (342-360) |

----- Final Results -----
   bacterial membrane --- Certainty = 0.5437 (Affirmative) <succ>
     bacterial outside --- Certainty = 0.0000 (Not Clear) <succ>
       bacterial cytoplasm --- Certainty = 0.0000 (Not Clear) <succ>

The protein has homology with the following sequences in the databases:

The protein has homology with the following sequences in the GENPEPT database:

```
>GP:BAB06141 GB:AP001515 phosphatidate cytidylyltransferase
[Bacillus halodurans]
Identities = 125/266 (46%), Positives = 177/266 (65%), Gaps = 6/266 (2%)
Query:   1 MKERVVWGGVAVAIFLPFLIIGNLPFQLFVGVLAMIGVSELLKMKRLEVFSFEGVFAMLA   60
           MK+RVV   + +FL F+++G LPF +F+ V+A I +SELLKMK++   FS  G F++L
Sbjct:   1 MKQRVVTAIIFGLVFLTFVVVGGLPFTMFIIVVATIAMSELLKMKKIAPFSPMGAFSLLP   60

Query:  61 AFVLAVPMDHYLTFLPIDANVAFYSLMVFFILAGTVLNSRAYSFDDAAFPIATSFYVGIG  120
           ++L +P D +   +P   V  +  + F+L  TVL     ++FD+A F I +S Y+G G
Sbjct:  61 MWMLLLPNDWFKVVIPDFTKVEIFIFFILFLLLLTVLTKNTFTFDEAGFVILSSAYIGYG  120

Query: 121 FQHLINAR---LSGIDKVFLALFIVWATDIGAYLIGRQFGRRKLLPTVSPNKTIEGSLGG  177
           F  L+ +R    G+  VF  LF++WATD GAY  GR FG+ KL P +SPNKTIEGS GG
Sbjct: 121 FHFLLLSREIPEIGLPLVFFVLFVIWATDSGAYFAGRAFGKHKLWPHISPNKTIEGSIGG  180

Query: 178 IACAVLVSFIFMVIDRSVYAPHHFLTMLVLVALFSIFAQFGDLVESALKRHFGVKDSGKL  237
           I  AV++  +F I  +++ +       +++VA  S+F Q GDLVESALKRH+ VKDSG +
Sbjct: 181 IILAVIIGSLFYWI-MPLFSSYGVALAVIVVA--SVFGQLGDLVESALKRHYAVKDSGTV  237

Query: 238 IPGHGGILDRFDSMIFVFPIMHLFGL                                   263
           +PGHGGILDRFDS+I+V PI+HL  L
Sbjct: 238 LPGHGGILDRFDSLIYVMPILHLLHL                                   263
```

An alignment of the GAS and GBS proteins is shown below:

```
Identities = 204/264 (77%), Positives = 243/264 (91%)
Query:   1 MKERVIWGAVALAIFIPFLVMGGLPFQFLVGLLAMIGVSELLRMRRLEIFSFEGALAMIG   60
           MKERV+WG VA+AIF+PFL++G LPFQ  VG+LAMIGVSELL+M+RLE+FSFEG  AM+
Sbjct:   1 MKERVVWGGVAVAIFLPFLIIGNLPFQLFVGVLAMIGVSELLKMKRLEVFSFEGVFAMLA   60

Query:  61 AFVLTVPLDSYLSFLPVDASLSAYGIVIFMILAGTVLNSNSYSFEDAAFPIASSFYVGIG  120
           AFVL VP+D YL+FLP+DA+++ Y +++F ILAGTVLNS +YSF+DAAFPIA+SFYVGIG
Sbjct:  61 AFVLAVPMDHYLTFLPIDANVAFYSLMVFFILAGTVLNSRAYSFDDAAFPIATSFYVGIG  120

Query: 121 FQNLVSARMAGIDKVLLALFIVWATDIGAYMIGRQFGQRKLLPSVSPNKTIEGSLGGIAS  180
           FQ+L++AR++GIDKV LALFIVWATDIGAY+IGRQFG+RKLLP+VSPNKTIEGSLGGIA
Sbjct: 121 FQHLINARLSGIDKVFLALFIVWATDIGAYLIGRQFGRRKLLPTVSPNKTIEGSLGGIAC  180

Query: 181 AIVVAFFFMLFDKTVYAPHSFLVMLVLVAIFSIFGQFGDLVESSIKRHFGVKDSGKLIPG  240
           A++V+F FM+ D++VYAPH FL MLVLVA+FSIF QFGDLVES++KRHFGVKDSGKLIPG
Sbjct: 181 AVLVSFIFMVIDRSVYAPHHFLTMLVLVALFSIFAQFGDLVESALKRHFGVKDSGKLIPG  240

Query: 241 HGGILDRFDSMIFVFPIMHFFGLF                                     264
           HGGILDRFDSMIFVFPIMH FGLF
Sbjct: 241 HGGILDRFDSMIFVFPIMHLFGLF                                     264
```

Based on this analysis, it was predicted that these proteins and their epitopes could be useful antigens for vaccines or diagnostics.

Example 749

A DNA sequence (GBSx0796) was identified in *S. agalactiae* <SEQ ID 2299> which encodes the amino acid sequence <SEQ ID 2300>. Analysis of this protein sequence reveals the following:

```
>GP:AAD47948 GB:AF152237 Eep [Enterococcus faecalis]
Identities = 229/425 (53%), Positives = 298/425 (69%), Gaps = 9/425 (2%)
Query:   1 MLGILTFIIIFGVIVVVHEFGHFYFAKKSGILVREFAIGMGPKIFSHIDKEGTTYTIRIL  60
           M  I+TFII+FG++V+VHEFGHFYFAK++GILVREFAIGMGPKIF+H  K+GTTYTIR+L
Sbjct:   1 MKTIITFIIVFGILVLVHEFGHFYFAKRAGILVREFAIGMGPKIFAHRGKDGTTYTIRLL  60

Query:  61 PLGGYVRMAGWGDDKTEIKTGTPASLTLNKEGIVTRINLSGKQLDNTSLPINVTAYDLED 120
           P+GGYVRMAG G+D TEI  G P S+ LN  G V +IN S K     S+P+ V  +DLE
Sbjct:  61 PIGGYVRMAGMGEDMTEITPGMPLSVELNAVGNVVKINTSKKVQLPHSIPMEVVDFDLEK 120

Query: 121 KLTITGLV---LSETKTYSVDHDATIIEEDGTEIRIAPLDMQYQNASVWGRLITNFAGPM 177
           +L I G V      E   Y VDHDATIIE DGTE+RIAPLD+Q+Q+A +  R++TNFAGPM
Sbjct: 121 ELFIKGYVNGNEEEETVYKVDHDATIIESDGTEVRIAPLDVQFQSAKLSQRILTNFAGPM 180

Query: 178 NNFILGLVVFIALAFIQGGVQDLSTNQV-RVSENGPAASAGLKNNDRILQIGSHKVSNWE 236
           NNFILG ++F     F+QGGV DL+TNQ+ +V  NGPAA AGLK ND++L I + K+  +E
Sbjct: 181 NNFILGFILFTLAVFLQGGVTDLNTNQIGQVIPNGPAAEAGLKENDKVLSINNQKIKKYE 240

Query: 237 QLTAAVEKSTRHLEKKQKLALKIKSKEVVKTINVKPQKVDKSYI--IGIMPALKTSFKDK 294
              T  V+K+    EK    ++    KE   T+  + QKV+K  I   +G+ P +KT   K
Sbjct: 241 DFTTIVQKNP---EKPLTFVVERNGKEEQLTVTPEKQKVEKQTIGKVGVYPYMKTDLPSK 297

Query: 295 LLGGLKLAWESFFRILNELKKLIAHFSINKLGGPVALYQASSQAAKNGFVTVLNLMGLIS 354
           L+GG++      S +I   L   L   FS+NKLGGPV +++ S +A+  G   TV+ LM ++S
Sbjct: 298 LMGGIQDTLNSTTQIFKALGSLFTGFSLNKLGGPVMMFKLSEEASNAGVSTVVFLMAMLS 357

Query: 355 INLGIMNLIPIPALDGGKIVMNILEAIRRKPLKQETETYITLAGVAVMLVLMIAVTWNDI 414
           +NLGI+NL+PIPALDGGKIV NI+E +R KP+   E E   ITL G   ++VLM+ VTWNDI
Sbjct: 358 MNLGIINLLPIPALDGGKIVLNIIEGVRGKPISPEKEGIITLIGFGFVMLMVLVTWNDI 417

Query: 415 MRAFF                                                        419
            R FF
Sbjct: 418 QRFFF                                                        422
```

A related DNA sequence was identified in *S. pyogenes* <SEQ ID 2301> which encodes the amino acid sequence <SEQ ID 2302>. Analysis of this protein sequence reveals the following:

Possible site: 26
>>> Seems to have an uncleavable N-term signal seq
INTEGRAL    Likelihood = 11.41    Transmembrane 2-18 (1-25)
INTEGRAL    Likelihood = -9.77    Transmembrane 394-410 (390-415)

-continued

INTEGRAL    Likelihood = -9.61    Transmembrane 180-196 (173-201)
INTEGRAL    Likelihood = -2.66    Transmembrane 347-363 (343-363)

----- Final Results -----
  bacterial membrane --- Certainty = 0.5564 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP:AAD47948 GB:AF152237 Eep [Enterococcus faecalis]
Identities = 230/427 (53%), Positives = 298/427 (68%), Gaps = 13/427 (3%)
Query:   1 MLGIITFIIIFGILVIVHEFGHFYFAKKSGILVREFAIGMGPKIFSHVDQGGTLYTLRML  60
           M  IITFII+FGILV+VHEFGHFYFAK++GILVREFAIGMGPKIF+H   + GT YT+R+L
Sbjct:   1 MKTIITFIIVFGILVLVHEFGHFYFAKRAGILVREFAIGMGPKIFAHRGKDGTTYTIRLL  60

Query:  61 PLGGYVRMAGWGDDKTEIKTGTPASLTLNEQGFVKRINLSQSKLDPTSLPMHVTGYDLED 120
           P+GGYVRMAG G+D TEI  G P S+ LN  G V +IN S+     P S+PM V  +DLE
Sbjct:  61 PIGGYVRMAGMGEDMTEITPGMPLSVELNAVGNVVKINTSKKVQLPHSIPMEVVDFDLEK 120

Query: 121 QLSITGLV---LEETKTYKVAHDATIVEEDGTEIRIAPLDVQYQNASIGGRLITNFAGPM 177
           +L I G V      EE    YKV HDATI+E DGTE+RIAPLDVQ+Q+A +  R++TNFAGPM
Sbjct: 121 ELFIKGYVNGNEEEETVYKVDHDATIIESDGTEVRIAPLDVQFQSAKLSQRILTNFAGPM 180

Query: 178 NNFILGIVVFILLVFLQGGMPDFSSNHV-RVQENGAAAKAGLRDNDQIVAINGYKVTSWN 236
           NNFILG ++F L VFLQGG+ D ++N + +V  NG AA+AGL+ ND+++ IN  K+  +
Sbjct: 181 NNFILGFILFTLAVFLQGGVTDLNTNQIGQVIPNGPAAEAGLKENDKVLSINNQKIKKYE 240

Query: 237 DLTEAVDLATRDLGPSQTIKVTYKSHQRLKTVAVKPQKH-AKTYTI---GVKASLKTGFK 292
           D T  V               + + + + + + + V P+K  +  TI   GV    +KT
Sbjct: 241 DFTTIV-----QKNPEKPLTFVVERNGKEEQLTVTPEKQKVEKQTIGKVGVYPYMKTDLP 295

Query: 293 DKLLGGLELAWSRAFTILNALKGLITGFSLNKLGGPVAMYDMSNQAAQNGLESVLSLMAM 352
            KL+GG++         +  I   AL  L TGFSLNKLGGPV M+ +S +A+  G  +V+ LMAM
Sbjct: 296 SKLMGGIQDTLNSTTQIFKALGSLFTGFSLNKLGGPVMMFKLSEEASNAGVSTVVFLMAM 355
```

-continued

```
Query:  353  LSINLGIFNLIPIPALDGGKILMNIIEAIRRKPIKQETEAYITLAGVAIMVVLMIAVTWN  412
             LS+NLGI NL+PIPALDGGKI++NIIE +R KPI  E E  ITL G    ++VLM+ VTWN
Sbjct:  356  LSMNLGIINLLPIPALDGGKIVLNIIEGVRGKPISPEKEGIITLIGFGFVMVLMVLVTWN  415

Query:  413  DIMRVFF                                                       419
             DI R FF
Sbjct:  416  DIQRFFF                                                       422
```

An alignment of the GAS and GBS proteins is shown below:

```
Identities = 306/419 (73%), Positives = 359/419 (85%)
Query:    1  MLGILTFIIIFGVIVVVHEFGHFYFAKKSGILVREFAIGMGPKIFSHIDKEGTTYTIRIL   60
             MLGI+TFIIIFG++V+VHEFGHFYFAKKSGILVREFAIGMGPKIFSH+D+ GT YT+R+L
Sbjct:    1  MLGIITFIIIFGILVIVHEFGHFYFAKKSGILVREFAIGMGPKIFSHVDQGGTLYTLRML   60

Query:   61  PLGGYVRMAGWGDDKTEIKTGTPASLTLNKEGIVTRINLSGKQLDNTSLPINVTAYDLED  120
             PLGGYVRMAGWGDDKTEIKTGTPASLTLN++G V RINLS +LD TSLP++VT YDLED
Sbjct:   61  PLGGYVRMAGWGDDKTEIKTGTPASLTLNEQGFVKRINLSQSKLDPTSLPMHVTGYDLED  120

Query:  121  KLTITGLVLSETKTYSVDHDATIIEEDGTEIRIAPLDMQYQNASVWGRLITNFAGPMNNF  180
             +L+ITGLVL ETKTY V HDATI+EEDGTEIRIAPLD+QYQNAS+ GRLITNFAGPMNNF
Sbjct:  121  QLSITGLVLEETKTYKVAHDATIVEEDGTEIRIAPLDVQYQNASIGGRLITNFAGPMNNF  180

Query:  181  ILGLVVFIALAFIQGGVQDLSTNQVRVSENGPAASAGLKNNDRILQIGSHKVSNWEQLTA  240
             ILG+VVFI L F+QGG+ D S+N VRV ENG AA AGL++ND+I+ I  +KV++W  LT
Sbjct:  181  ILGIVVFILLVFLQGGMPDFSSNHVRVQENGAAAKAGLRDNDQIVAINGYKVTSWNDLTE  240

Query:  241  AVEKSTRHLEKKQKLALKIKSKEVVKTINVKPQKVDKSYIIGIMPALKTSFKDKLLGGLK  300
             AV+ +TR L  Q + +  KS + +KT+ VKPQK  K+Y IG+  +LKT FKDKLLGGL+
Sbjct:  241  AVDLATRDLGPSQTIKVTYKSHQRLKTVAVKPQKHAKTYTIGVKASLKTGFKDKLLGGLE  300

Query:  301  LAWESFFRILNELKKLIAHFSINKLGGPVALYQASSQAAKNGFVTVLNLMGLISINLGIM  360
             LAW   F ILN LK LI   FS+NKLGGPVA+Y  S+QAA+NG  +VL+LM ++SINLGI
Sbjct:  301  LAWSRAFTILNALKGLITGFSLNKLGGPVAMYDMSNQAAQNGLESVLSLMAMLSINLGIF  360

Query:  361  NLIPIPALDGGKIVMNILEAIRRKPLKQETETYITLAGVAVMLVLMIAVTWNDIMRAFF   419
             NLIPIPALDGGKI+MNI+EAIRRKP+KQETE YITLAGVA+M+VLMIAVTWNDIMR FF
Sbjct:  361  NLIPIPALDGGKILMNIIEAIRRKPIKQETEAYITLAGVAIMVVLMIAVTWNDIMRVFF   419
```

Based on this analysis, it was predicted that these proteins and their epitopes could be useful antigens for vaccines or diagnostics.

Example 750

A DNA sequence (GBSx0797) was identified in *S. agalactiae* <SEQ ID 2303> which encodes the amino acid sequence <SEQ ID 2304>. This protein is predicted to be prolyl-tRNA synthetase (proS). Analysis of this protein sequence reveals the following:

---

Possible site: 18

>>> Seems to have no N-terminal signal sequence

INTEGRAL       Likelihood = 0.32   Transmembrane 473-489 (473-490)

----- Final Results ----- bacterial membrane --- Certainty = 0.1128 (Affirmative) <succ> bacterial outside --- Certainty = 0.0000 (Not Clear) <succ> bacterial cytoplasm --- Certainty = 0.0000 (Not Clear) <succ>

---

A related GBS nucleic acid sequence <SEQ ID 10181> which encodes amino acid sequence <SEQ ID 10182> was also identified.

The protein has homology with the following sequences in the GENPEPT database:

```
>GP:CAB13530 GB:Z99112 prolyl-tRNA synthetase [Bacillus subtilis]
Identities = 301/608 (49%), Positives = 410/608 (66%), Gaps = 52/608 (8%)
Query:    1  MKQSKMLIPTLREMPSDAQVISHALMVRAGYVRQVSAGIYAYLPLANRTIEKFKTIMRQE   60
             M+QS  LIPTLRE+P+DA+   SH L++RAG++RQ ++G+Y+Y+PLA + I+ + I+R+E
Sbjct:    1  MRQSLTLIPTLREVPADAEAKSHQLLLRAGFIRQNTSGVYSYMPLAYKVIQNIQQIVREE   60

Query:   61  FEKIGAVEMLAPALLTADLWRESGRYETYGEDLYKLKNRDQSDFILGPTHEETFTTLVRD  120
             EKI AVEML PAL   A+ W+ESGR+ TYG +L +LK+R   +F LG THEE  T+LVRD
Sbjct:   61  MEKIDAVEMLMPALQQAETWQESGRWYTYGPELMRLKDRHGREFALGATHEEVITSLVRD  120
```

```
-continued
Query: 121 AVKSYKQLPLNLYQIQSKYRDEKRPRNGLLRTREFIMKDGYSFHKDYEDLDVTYEDYRKA 180
            VKSYK+LPL LYQIQSK+RDEKRPR GLLR REFIMKD YSFH   E LD TY+    +A
Sbjct: 121 EVKSYKRLPLTLYQIQSKFRDEKRPRFGLLRGREFIMKDAYSFHASAESLDETYQKMYEA 180

Query: 181 YEAIFTRAGLDFKGIIGDGGAMGGKDSQEFMAVTPNRTDLNRWLVLDKTIPSIDDIPEDV 240
            Y  IF R G++ + +I D GAMGGKD+ EFMA++
Sbjct: 181 YSNIFARCGINVRPVIADSGAMGGKDTHEFMALS------------------------- 214

Query: 241 LEEIKVELSAWLVSGEDTIAYSTESSYAANLEMATNEYKPSTKAATFEEVTKVETPNCKS 300
                        GEDTIAYS ES YAAN+EMA     ++       + + KV TPN K+
Sbjct: 215 ------------AIGEDTIAYSDESQYAANIEMAEVLHQEVPSDEEPKALEKVHTPNVKT 262

Query: 301 IDEVAGFLSIDENQTIKTLLFIADEQPVVALLVGNDQVNDVKLKNYLAADFLEPASEEQA 360
            I+E+  FL +    IK++LF AD++ V+ L+ G+ +VND+K+KN L A+ +E A+ E+
Sbjct: 263 IEELTAFLQVSAEACIKSVLFKADDRFVLVLVRGDHEVNDIKVKNLLHAEVVELATHEEV 322

Query: 361 KEIFGAGFGSLGPVNLPDSVKIIADRKVQDLANAVSGANQDGYHFTGVNPERDFTA-EYV 419
              + G   G +GPV +     V++ AD+ V+ + NAV+GAN+   +H+   VN  RD     E+
Sbjct: 323 IQQLGTEPGFVGPVGIHQDVEVYADQAVKAMVNAVAGANEGDHHYKNVNVNRDAQIKEFA 382

Query: 420 DIREVKEGEISPDGKGTLKFARGIEIGHIFKLGTRYSDSMGANILDENGRSNPIVMGCYG 479
            D+R  +KEG+ SPDGKGT++FA GIE+G +FKLGTRYS++M A   LDENGR+ P++MGCYG
Sbjct: 383 DLRFIKEGDPSPDGKGTIRFAEGIEVGQVFKLGTRYSEAMNATYLDENGRAQPMLMGCYG 442

Query: 480 IGVSRILSAVIEQHARLFVNKTPKGAYRFAWGINFPEELAPFDVHLITVNVKDQESQDLT 539
            IGVSR LSA+ EQH                 G+  +P+  +AP+D+H++ +N+K+    ++L
Sbjct: 443 IGVSRTLSAIAEQH------------HDEKGLIWPKSVAPYDLHILALNMKNDGQRELA 489

Query: 540 EKIEADLMLKGYEVLTDDRNERVGSKFSDSDLIGLPIRVTVGKKASEGIVEVKIKASGDT 599
            EK+ ADL  +GYEVL DDR ER G  KF+DSDLIGLPIR+TVGK+A EGIVEVKI+ +G++
Sbjct: 490 EKLYADLKAEGYEVLYDDRAERAGVKFADSDLIGLPIRITVGKRADEGIVEVKIRQTGES 549

Query: 600 IEVHADNL                                                     607
            E+  D L
Sbjct: 550 TEISVDEL                                                     557
```

A related DNA sequence was identified in *S. pyogenes* <SEQ ID 2305> which encodes the amino acid sequence <SEQ ID 2306>. Analysis of this protein sequence reveals the following:

Possible site: 18
>>> Seems to have no N-terminal signal sequence
INTEGRAL    Likelihood = −0.32   Transmembrane 473-489 (473-490)
----- Final Results -----
  bacterial membrane --- Certainty = 0.1128 (Affirmative) <succ>
  bacterial outside --- Certainty = 0.0000 (Not Clear) <succ>
  bacterial cytoplasm --- Certainty = 0.0000 (Not Clear) <succ>

An alignment of the GAS and GBS proteins is shown below:

```
Identities = 535/617 (86%), Positives = 584/617 (93%)
Query:   1 MKQSKMLIPTLREMPSDAQVISHALMVRAGYVRQVSAGIYAYLPLANRTIEKFKTIMRQE  60
           MKQSK+LIPTLREMPSDAQVISHALMVRAGYVRQVSAGIYAYLPLANRTIEKFKTIMR+E
Sbjct:   1 MKQSKLLIPTLREMPSDAQVISHALMVRAGYVRQVSAGIYAYLPLANRTIEKFKTIMREE  60

Query:  61 FEKIGAVEMLAPALLTADLWRESGRYETYGEDLYKLKNRDQSDFILGPTHEETFTTLVRD 120
           FEKIGAVEMLAPALLTADLWRESGRYETYGEDLYKLKNRD SDFILGPTHEETFTTLVRD
Sbjct:  61 FEKIGAVEMLAPALLTADLWRESGRYETYGEDLYKLKNRDNSDFILGPTHEETFTTLVRD 120

Query: 121 AVKSYKQLPLNLYQIQSKYRDEKRPRNGLLRTREFIMKDGYSFHKDYEDLDVTYEDYRKA 180
           AVKSYKQLPLNLYQIQSKYRDEKRPRNGLLRTREFIMKDGYSFH +YEDLDVTYEDYR+A
Sbjct: 121 AVKSYKQLPLNLYQIQSKYRDEKRPRNGLLRTREFIMKDGYSFHHNYEDLDVTYEDYRQA 180

Query: 181 YEAIFTRAGLDFKGIIGDGGAMGGKDSQEFMAVTPNRTDLNRWLVLDKTIPSIDDIPEDV 240
           YEAIFTRAGLDFKGIIGDGGAMGGKDSQEFMA+TP RTDL+RW+VLDK+I S+DDIP++V
Sbjct: 181 YEAIFTRAGLDFKGIIGDGGAMGGKDSQEFMAITPARTDLDRWVVLDKSIASMDDIPKEV 240

Query: 241 LEEIKVELSAWLVSGEDTIAYSTESSYAANLEMATNEYKPSTKAATFEEVTKVETPNCKS 300
           LE+IK EL+AW++SGEDTIAYSTESSYAANLEMATNEYKPS+K A   + + +VETP+CK+
Sbjct: 241 LEDIKAELAAWMISGEDTIAYSTESSYAANLEMATNEYKPSSKVAAEDALAEVETPHCKT 300

Query: 301 IDEVAGFLSIDENQTIKTLLFIADEQPVVALLVGNDQVNDVKLKNYLAADFLEPASEEQA 360
           IDEVA FLS+DE QTIKTLLF+AD +PVVALLVGND +N VKLKNYLAADFLEPASEE+A
Sbjct: 301 IDEVAAFLSVDETQTIKTLLFVADNEPVVALLVGNDHINTVKLKNYLAADFLEPASEEEA 360
```

```
-continued
Query:  361  KEIFGAGFGSLGPVNLPDSVKIIADRKVQDLANAVSGANQDGYHFTGVNPERDFTAEYVD  420
             +  FGAGFGSLGPVNL   +I+ADRKVQ+L NAV+GAN+DG+H TGVNP RDF AEYVD
Sbjct:  361  RAFFGAGFGSLGPVNLAQGSRIVADRKVQNLTNAVAGANKDGFHMTGVNPGRDFQAEYVD  420

Query:  421  IREVKEGEISPDGKGTLKFARGIEIGHIFKLGTRYSDSMGANILDENGRSNPIVMGCYGI  480
             IREVKEGE+SPDG G L+FARGIE+GHIFKLGTRYSDSMGA ILDENGR+ PIVMGCYGI
Sbjct:  421  IREVKEGEMSPDGHGVLQFARGIEVGHIFKLGTRYSDSMGATILDENGRTVPIVMGCYGI  480

Query:  481  GVSRILSAVIEQHARLFVNKTPKGAYRFAWGINFPEELAPFDVHLITVNVKDQESQDLTE  540
             GVSRILSAVIEQHARLFVNKTPKG YR+AWGINFP+ELAPFDVHLITVNVKDQ +QDLT
Sbjct:  481  GVSRILSAVIEQHARLFVNKTPKGDYRYAWGINFPKELAPFDVHLITVNVKDQVAQDLTA  540

Query:  541  KIEADLMLKGYEVLTDDRNERVGSKFSDSDLIGLPIRVTVGKKASEGIVEVKIKASGDTI  600
             K+EADLM KGY+VLTDDRNERVGSKFSDSDLIGLPIRVTVGKKA+EGIVE+KIKA+GD+I
Sbjct:  541  KLEADLMAKGYDVLTDDRNERVGSKFSDSDLIGLPIRVTVGKKAAEGIVEIKIKATGDSI  600

Query:  601  EVHADNLIETLEILTKK                                            617
             EV+A+NLIETLEILTK+
Sbjct:  601  EVNAENLIETLEILTKE                                            617
```

Based on this analysis, it was predicted that these proteins and their epitopes could be useful antigens for vaccines or diagnostics.

Example 751

A DNA sequence (GBSx0798) was identified in *S. agalactiae* <SEQ ID 2307> which encodes the amino acid sequence <SEQ ID 2308>. This protein is predicted to be peptidoglycan hydrolase (flgJ). Analysis of this protein sequence reveals the following:

---

Possible site: 21
>>> Seems to have an uncleavable N-term signal seq
INTEGRAL     Likelihood = −1.86     Transmembrane 9-25 (9-25)
----- Final Results -----
  bacterial membrane --- Certainty = 0.1744 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the GENPEPT database:

```
>GP:CAB94815 GB:AJ245582 peptidoglycan hydrolase [Streptococcus thermophilus]
Identities = 101/201 (50%), Positives = 122/201 (60%), Gaps = 9/201 (4%)
Query:   2  KSRKKDKLVLRLTT-----TLLVFGL----GGVWFYNYKNDNVEPTVTSASDQTTTFIQT   52
            KS+KK K VL        +L+ GL    G +   N+   +E  +T   + T   FI
Sbjct:  16  KSKKKKKSVLLFPKFFQKWSLIFIGLFSLLGLLASLNFPRLTMEKNMTPTDETTVAFIAE   75

Query:  53  ISPTAIEISKTYDLYASVLLAQAILESSSGQSDLSKAPNYNLFGIKGEYKGKSVQMPTLE  112
            I   T+  ++   DLYASV++AQAILES SGQS LS+ P YN FGIKGEY G+SV +PT E
Sbjct:  76  IGETSRYLAARNDLYASVMIAQAILESDSGQSQLSQKPLYNFFGIKGEYNGQSVTLPTWE  135

Query: 113  DDGKGNMTQIQAPFRAYPNYSASLYDYAELVSSQKYASVWKSNTSSYKDATAALTGLYAT  172
            DDGKGN     I A FR+Y +    SL DY E +    Y  V +S T  SYKDATAALTG+YAT
Sbjct: 136  DDGKGNPYHIDAAFRSYGSVENSLQDYVEFLEGSYYVGVHRSKTRSYKDATAALTGVYAT  195

Query: 173  DTAYASKLNQIIETYSLDAYD                                        193
            DT Y   KLN IIE Y L  YD
Sbjct: 196  DTTYGDKLNSIIEQYQLTIYD                                        216
```

A related DNA sequence was identified in *S. pyogenes* <SEQ ID 2309> which encodes the amino acid sequence <SEQ ID 2310>. Analysis of this protein sequence reveals the following:

---

Possible site: 24
>>> Seems to have a cleavable N-term signal seq.
----- Final Results -----
  bacterial outside --- Certainty = 0.3000 (Affirmative) <succ>
    bacterial membrane --- Certainty = 0.0000 (Not Clear) <succ>
      bacterial cytoplasm --- Certainty = 0.0000 (Not Clear) <succ>

---

The protein has homology with the following sequences in the databases:

```
>GP:CAB94815 GB:AJ245582 peptidoglycan hydrolase [Streptococcus thermophilus]
Identities = 103/189 (54%), Positives = 126/189 (66%), Gaps = 4/189 (2%)
Query:    4  KKGKLVLISLFVLAACLGAYSAMRQSHKTSNVSAETIASSSTRHFIDEIGPTASTIGQER    63
             +K  L+ I LF L    L + + R + + +     T   +T  FI EIG T+   +
Sbjct:   32  QKWSLIFIGLFSLLGLLASLNFPRLTMEKNM----TPTDETTVAFIAEIGETSRYLAARN   87

Query:   64  DLYASVMIAQAILESSNGKSSLSQAPYYNFFGIKGAYNGSSVTMSTWEDDGNGNTYTIDQ   123
             DLYASVMIAQAILES +G+S LSQ P YNFFGIKG YNG SVT+ TWEDDG GN Y ID
Sbjct:   88  DLYASVMIAQAILESDSGQSQLSQKPLYNFFGIKGEYNGQSVTLPTWEDDGKGNPYHIDA   147

Query:  124  AFRAYPSIADSLNDYADLLSSSTYIGARKSNTLSYQDATAALTGLYATDTSYNLKLNNII   183
             AFR+Y S+ +SL DY + L  S Y+G  +S T SY+DATAALTG+YATDT+Y  KLN+II
Sbjct:  148  AFRSYGSVENSLQDYVEFLEGSYYVGVHRSKTRSYKDATAALTGVYATDTTYGDKLNSII   207

Query:  184  ATYGLTAYD                                                     192
               Y LT YD
Sbjct:  208  EQYQLTIYD                                                     216
```

An alignment of the GAS and GBS proteins is shown below:

```
Identities = 108/192 (56%), Positives = 124/192 (64%), Gaps = 2/192 (1%)
Query:    3  SRKKDKLVL-RLTTTLLVFGLGGVWFYNYKNDNVEPTVTSASDQTTTFIQTISPTAIEIS    61
             ++KK KLVL  L         G    ++K NV    T AS T  FI  I PTA  I
Sbjct:    2  TKKKGKLVLISLFVLAACLGAYSAMRQSHKTSNVSAE-TIASSSTRHFIDEIGPTASTIG   60

Query:   62  KTYDLYASVLLAQAILESSSGQSDLSKAPNYNLFGIKGEYKGKSVQMPTLEDDGKGNMTQ   121
             +  DLYASV++AQAILESS+G+S LS+AP YN FGIKG Y G SV M T EDDG GN
Sbjct:   61  QERDLYASVMIAQAILESSNGKSSLSQAPYYNFFGIKGAYNGSSVTMSTWEDDGNGNTYT   120

Query:  122  IQAPFRAYPNYSASLYDYAELVSSQKYASVWKSNTSSYKDATAALTGLYATDTAYASKLN   181
             I   FRAYP+ + SL DYA+L+SS Y    KSNT SY+DATAALTGLYATDT+Y  KLN
Sbjct:  121  IDQAFRAYPSIADSLNDYADLLSSSTYIGARKSNTLSYQDATAALTGLYATDTSYNLKLN   180

Query:  182  QIIETYSLDAYD                                                  193
              II TY L AYD
Sbjct:  181  NIIATYGLTAYD                                                  192
```

A further related DNA sequence was identified in *S. pyogenes* <SEQ ID 9073> which encodes the amino acid sequence <SEQ ID 9074>. Analysis of this protein sequence reveals the following:

Possible site: 58
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000(Not Clear) <succ>

An alignment of the GAS and GBS sequences follows:

```
Score = 130 bits (323), Expect = 2e-32
Identities = 68/169 (40%), Positives = 96/169 (56%), Gaps = 3/169 (1%)
Query:   30  MWTLKLGNQRLAPY---ADHETLTFVRKISHAAQSVAQKKQLYSSVMMAQAILESNNGKS    86
             +W    N + P   A  +T TF++ IS  A   +++    LY+SV++AQAILES++G+S
Sbjct:   25  VWFYNYKNDNVEPTVTSASDQTTTFIQTISPTAIEISKTYDLYASVLLAQAILESSSGQS   84

Query:   87  QLSQKPYYNFFGIKGSYKERSVIFPTLEDDGQGNLYQIDAAFRSYGSLTACFLDYARVLN   146
             +LS+ P YN FGIKG YK +SV  PTLEDDG+GN+ QI A FR+Y +  +A   DYA +++
Sbjct:   85  DLSKAPNYNLFGIKGEYKGKSVQMPTLEDDGKGNMTIQAPFRAYPNYSASLYDYAELVS   144

Query:  147  DPLYDKTHKKFWSHYQXXXXXXXXXXXXXXXXXXXXKLNELIEWYQLTNFD           195
                Y   K   S Y+                    KLN++IE Y L  +D
Sbjct:  145  SQKYASVWKSNTSSYKDATAALTGLYATDTAYASKLNQIIETYSLDAYD             193
```

A further related DNA sequence was identified in *S. pyogenes* <SEQ ID 9075> which encodes the amino acid sequence <SEQ ID 9076>. An alignment of the GAS and GBS sequences follows:

```
Score = 69.1 bits (166), Expect = 1e-13
Identities = 52/151 (34%), Positives = 79/151 (51%), Gaps = 10/151 (6%)
Query:    2 TFLDKIKQGCLDGWAKYKILPSLTAAQAILESGWGKH----APHNALFGIKADSSWTGKS   57
            TF+ I    ++   Y +  S+ AQAILES  G+      AP+ LFGIK +  + GKS
Sbjct:   48 TFIQTISPTAIEISKTYDLYASVLLAQAILESSSGQSDLSKAPNYNLFGIKGE--YKGKS  105

Query:   58 FDTKTQEEYQAGVVTDIVDRFRAYDSWDESIADHGQFLVDNPRYEAV--IGETDYKKACY  115
               T E+    G +T I   FRAY ++  S+ D+ + LV + +Y +V    + YK A
Sbjct:  106 VQMPTLEDDGKGNMTQIQAPFRAYPNYSASLYDYAE-LVSSQKYASVWKSNTSSYKDATA  164

Query:  116 AIKAAGYATASSYVELLIQLIEENDLQSWDR                              146
            A+    YAT ++Y  L Q+IE    L  ++D+
Sbjct:  165 ALTGL-YATDTAYASKLNQIIETYSLDAYDK                              194
```

Figure 58:
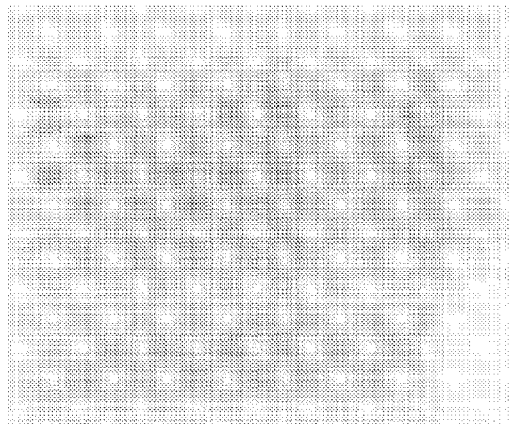

SEQ ID 2308 (GBS275) was expressed in *E. coli* as a His-fusion product. SDS-PAGE analysis of total cell extract is shown in FIG. 52 (lane 4; MW 22.6 kDa). It was also expressed in *E. coli* as a GST-fusion product. SDS-PAGE analysis of total cell extract is shown in FIG. 58 (lane 4; MW 47.5 kDa).

Figure 276:
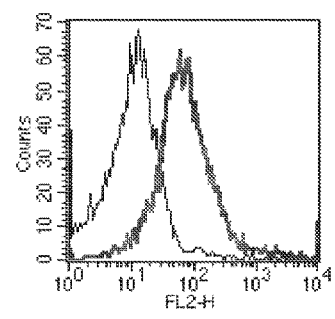

The GBS275-GST fusion product was purified (FIG. 208, lane 5) and used to immunise mice. The resulting antiserum was used for FACS (FIG. 276), which confirmed that the protein is immunoaccessible on GBS bacteria.

Based on this analysis, it was predicted that these proteins and their epitopes could be useful antigens for vaccines or diagnostics.

Example 752

A DNA sequence (GBSx0799) was identified in *S. agalactiae* <SEQ ID 2311> which encodes the amino acid sequence <SEQ ID 2312>. Analysis of this protein sequence reveals the following:

Possible site: 27
>>> Seems to have no N-terminal signal sequence
INTEGRAL    Likelihood = −0.16    Transmembrane 876-892 (876-892)
----- Final Results -----
   bacterial membrane --- Certainty = 0.1065 (Affirmative) <succ>

-continued bacterial outside --- Certainty = 0.0000 (Not Clear) <succ>
   bacterial cytoplasm --- Certainty = 0.0000 (Not Clear) <succ>

A related DNA sequence was identified in *S. pyogenes* <SEQ ID 2313> which encodes the amino acid sequence <SEQ ID 2314>. Analysis of this protein sequence reveals the following:

Possible site: 48
>>> Seems to have no N-terminal signal sequence
INTEGRAL    Likelihood = −0.16    Transmembrane 873-889 (873-889)
----- Final Results -----
   bacterial membrane --- Certainty= 0.1065 (Affirmative) <succ>
   bacterial outside --- Certainty= 0.0000 (Not Clear) <succ>
   bacterial cytoplasm --- Certainty= 0.0000 (Not Clear) <succ>

The protein has homology with the following sequences in the databases:

```
>GP:CAB94815 GB:AJ245582 peptidoglycan hydrolase [Streptococcus thermophilus]
Identities = 96/202 (47%), Positives = 127/202 (62%), Gaps = 10/202 (4%)
Query:    4 KKRRRRAKSSV---------NRLVLGLV-LLNLIVSMWTLKLGNQRLAPYADHETLTFVR   53
            KK +++ KS +           + + +GL  LL L+ S+    +L  ++     D  T+ F+
Sbjct:   15 KKSKKKKKSVLLFPKFFQKWSLIFIGLFSLLGLLASLNFPRLTMEKNMTPTDETTVAFIA   74

Query:   54 KISHAAQSVAQKKQLYSSVMMAQAILESNNGKSQLSQKPYYNFFGIKGSYKERSVIFPTL  113
            +I   ++ +A +   LY+SVM+AQAILES++G+SQLSQKP YNFFGIKG  Y  +SV  PT
Sbjct:   75 EIGETSRYLAARNDLYASVMIAQAILESDSGQSQLSQKPLYNFFGIKGEYNGQSVTLPTW  134

Query:  114 EDDGQGNLYQIDAAFRSYGSLTACFLDYARVLNDPLYDKTHKKFWSHYQDATATLTGTYA  173
            EDDG+GN Y IDAAFRSYGS+       DY  L   Y    H+    Y+DATA LTG YA
Sbjct:  135 EDDGKGNPYHIDAAFRSYGSVENSLQDYVEFLEGSYYVGVHRSKTRSYKDATAALTGVYA  194

Query:  174 TDTTYHTKLNELIEWYQLTNFD                                       195
            TDTTY   KLN +IE YQLT +D
Sbjct:  195 TDTTYGDKLNSIIEQYQLTIYD                                       216
```

An alignment of the GAS and GBS proteins is shown below:

```
Identities = 1244/1468 (84%), Positives = 1351/1468 (91%), Gaps = 3/1468 (0%)
Query:    1 MSELFKKLMDQIEMPLEIKNSSVFSSADIIEVKVHSLSRLWEFHFSFPELLPIEVYRELQ   60
            MS+LF KLMDQIEMPL+++ SS FSSADIIEVKVHS+SRLWEFHF+F  +LPI  YREL
Sbjct:    1 MSDLFAKLMDQIEMPLDMRRSSAFSSADIIEVKVHSVSRLWEFHFAFAAVLPIATYRELH   60

Query:   61 TRLVNSFEKADIKATFDIRAETIDFSDDLLQDYYQQAFCEPLCNSASFKSSFSQLKVHYN  120
            RL+ +FE ADIK TFDI+A +D+SDDLLQ YYQ+AF    CNSASFKSSFS+LKV Y
Sbjct:   61 DRLIRTFEAADIKVTFDIQAAQVDYSDDLLQAYYQEAFEHAPCNSASFKSSFSKLKVTYE  120

Query:  121 GSQMIISAPQFVNNNHFRQNHLPRLEQQFSLFGFGKLAIDMVSDEQMTQDLKSSFETNRE  180
             ++II+AP FVNN+HFR NHLP L +Q   FGFG L IDMVSD++MT+ L  +F ++R+
Sbjct:  121 DDKLIIAAPGFVNNDHFRNNHLPNLVKQLEAFGFGILTIDMVSDQEMTEHLTKNFVSSRQ  180

Query:  181 QLLEKANQEAMQALEAQKSLEDSAPPSEEVTPTQNYDFKERIKQRQAGFEKAEITPMIEV  240
             L++KA Q+    LEAQKSLE   PP EE TP   +D+KER +RQAGFEKA ITPMIE+
Sbjct:  181 ALVKKAVQDN---LEAQKSLEAMMPPVEEATPAPKFDYKERAAKRQAGFEKATITPMIEI  237

Query:  241 TTEENRIVFEGMVFSVERKTTRTGRHIINFKMTDYTSSFAMQKWAKDDEELKKYDMISKG  300
             TEENRIVFEGMVF VERKTTRTGRHIINFKMTDYTSSFA+QKWAKDDEEL+K+DMI+KG
Sbjct:  238 ETEENRIVFEGMVFDVERKTTRTGRHIINFKMTDYTSSFALQKWAKDDEELRKFDMIAKG  297

Query:  301 SWLRVRGNIENNNFTKSLTMNVQDIKEIVHHERKDLMPADQKRVEFHAHTNMSTMDALPT  360
            +WLRV+GNIE N FTKSLTMNVQ +KEIV HERKDLMP  QKRVE HAHTNMSTMDALPT
Sbjct:  298 AWLRVQGNIETNPFTKSLTMNVQQVKEIVRHERKDLMPEGQKRVELHAHTNMSTMDALPT  357

Query:  361 VESLIDTAAKWGHPAIAITDHANVQSFPHGYHRAKKAGIKAIFGLEANIVEDKVPISYNE  420
            VESLIDTAAKWGH AIAITDHANVQSFPHGYHRA+KAGIKAIFGLEANIVEDKVPISY
Sbjct:  358 VESLIDTAAKWGHKAIAITDHANVQSFPHGYHRARKAGIKAIFGLEANIVEDKVPISYEP  417

Query:  421 VDMNLHEATYVVFDVETTGLSAANNDLIQIAASKMFKGNIIEQFDEFIDPGHPLSAFTTE  480
            VDM+LHEATYVVFDVETTGLSA NNDLIQIAASKMFKGNI+EQFDEFIDPGHPLSAFTTE
Sbjct:  418 VDMDLHEATYVVFDVETTGLSAMNNDLIQIAASKMFKGNIVEQFDEFIDPGHPLSAFTTE  477

Query:  481 LTGITDNHVRGSKPILQVLQEFQNFCQGTVLVAHNATFDVGFMNANYERHNLPLITQPVI  540
            LTGITD H++G+KP++ VL+ FQ+FC+ ++LVAHNA+FDVGFMNANYERH+LP ITQPVI
Sbjct:  478 LTGITDKHLQGAKPLVTVLKAFQDFCKDSILVAHNASFDVGFMNANYERHDLPKITQPVI  537

Query:  541 DTLEFARNLYPEYKRHGLGPLTKRFQVALEHHHMANYDAEATGRLLFIFLKEARENRDVT  600
            DTLEFARNLYPEYKRHGLGPLTKRFQV+L+HHHMANYDAEATGRLLFIFLK+ARE   +
Sbjct:  538 DTLEFARNLYPEYKRHGLGPLTKRFQVSLDHHHMANYDAEATGRLLFIFLKDAREKHGIK  597

Query:  601 NLMELNTKLVAEDSYKKARIKHATIYVQNQVGLKNIFKLVSLSNVKYFEGVARIPRSVLD  660
            NL++LNT LVAEDSYKKARIKHATIYVQNQVGLKN+FKLVSLSN+KYFEGV RIPR+VLD
Sbjct:  598 NLLQLNTDLVAEDSYKKARIKHATIYVQNQVGLKNMFKLVSLSNIKYFEGVPRIPRTVLD  657

Query:  661 AHREGLLLGTACSDGEVFDALLSNGIDAAVTLAKYYDFIEVMPPAIYRPLVVRDLIKDEV  720
            AHREGLLLGTACSDGEVFDA+L+ GIDAAV LA+YYDFIE+MPPAIY+PLVVR+LIKD+
Sbjct:  658 AHREGLLLGTACSDGEVFDAVLTKGIDAAVDLARYYDFIEIMPPAIYQPLVVRELIKDQA  717

Query:  721 GIQQIIRDLIEVGRRLDKPVLATGNVHYIEPEDEIYREIIVRSLGQGAMINRTIGRGEDA  780
            GI+Q+IRDLIEVG+R  KPVLATGNVHY+EPE+EIYREIIVRSLGQGAMINRTIGRGE A
Sbjct:  718 GIEQVIRDLIEVGKRAKKPVLATGNVHYLEPEEEIYREIIVRSLGQGAMINRTIGRGEGA  777

Query:  781 QPAPLPKAHFRTTNEMLDEFAFLGKDLAYEIVVTNTNTFADRFEDVEVVKGDLYTPFVDR  840
            QPAPLPKAHFRTTNEMLDEFAFLGKDLAY++VV NT   FADR E+VEVVKGDLYTP++D+
Sbjct:  778 QPAPLPKAHFRTTNEMLDEFAFLGKDLAYQVVVQNTQDFADRIEEVEVVKGDLYTPYIDK  837

Query:  841 AEERVAELTYAKAFEIYGNPLPDIIDLRIEKELASILGNGFAVIYLASQMLVQRSNERGY  900
            AEE VAELTY KAFEIYGNPLPDIIDLRIEKEL SILGNGFAVIYLASQMLV RSNERGY
Sbjct:  838 AEETVAELTYQKAFEIYGNPLPDIIDLRIEKELTSILGNGFAVIYLASQMLVNRSNERGY  897

Query:  901 LVGSRGSVGSSFVATMIGITEVNPMPPHYVCPNCQHSEFITDGSCGSGYDLPNKNCPKCG  960
            LVGSRGSVGSSFVATMIGITEVNPMPPHYVCP+CQHSEFITDGS GSGYDLPNK CPKCG
Sbjct:  898 LVGSRGSVGSSFVATMIGITEVNPMPPHYVCPSCQHSEFITDGSVGSGYDLPNKPCPKCG  957

Query:  961 TLYKKDGQDIPFETFLGFDGDKVPDIDLNFSGDDQPSAHLDVRDIFGEEYAFRAGTVGTV 1020
            T Y+KDGQDIPFETFLGFDGDKVPDIDLNFSGDDQPSAHLDVRDIFG EYAFRAGTVGTV
Sbjct:  958 TPYQKDGQDIPFETFLGFDGDKVPDIDLNFSGDDQPSAHLDVRDIFGDEYAFRAGTVGTV 1017

Query: 1021 AEKTAFGFVKGYERDYNKFYNDAEVERLATGAAGVKRSTGQHPGGIVVIPNYMDVYDFTP 1080
            AEKTA+GFVKGYERDY KFY DAEV+RLA GAAGVKR TGQHPGGIVVIPNYMDVYDFTP
Sbjct: 1018 AEKTAYGFVKGYERDYGKFYRDAEVDRLAAGAAGVKRTTGQHPGGIVVIPNYMDVYDFTP 1077

Query: 1081 VQYPADDMTAAWQTTHFNFHDIDENVLKLDILGHDDPTMIRKLQDLSGIDPSNILPDDPD 1140
            VQYPADD+TA+WQTTHFNFHDIDENVLKLDILGHDDPTMIRKLQDLSGIDP   I DDP
Sbjct: 1078 VQYPADDVTASWQTTHFNFHDIDENVLKLDILGHDDPTMIRKLQDLSGIDPITIPADDPG 1137
```

-continued

```
Query: 1141   VMKLFSGTEVLGVTEEQIGTPTGMLGIPEFGTNFVRGMVNETHPTTFAELLQLSGLSHGT   1200
              VM LFSGTEVLGVT EQIGTPTGMLGIPEFGTNFVRGMVNETHPTTFAELLQLSGLSHGT
Sbjct: 1138   VMALFSGTEVLGVTPEQIGTPTGMLGIPEFGTNFVRGMVNETHPTTFAELLQLSGLSHGT   1197

Query: 1201   DVWLGNAQDLIKEGIATLSTVIGCRDDIMVYLMHAGLQPKMAFTIMERVRKGLWLKISED   1260
              DVWLGNAQDLIKEGIATL TVIGCRDDIMVYLMHAGL+PKMAFTIMERVRKGLWLKISE+
Sbjct: 1198   DVWLGNAQDLIKEGIATLKTVIGCRDDIMVYLMHAGLEPKMAFTIMERVRKGLWLKISEE   1257

Query: 1261   ERNGYIQAMRDNNVPDWYIESCGKIKYMFPKAHAAAYVLMALRVAYFKVHYPIFYYCAYF   1320
              ERNGYI AMR+NNVPDWYIESCGKIKYMFPKAHAAAYVLMALRVAYFKVH+PI YYCAYF
Sbjct: 1258   ERNGYIDAMRENNVPDWYIESCGKIKYMFPKAHAAAYVLMALRVAYFKVHHPIMYYCAYF   1317

Query: 1321   SIRAKAFELRTMSAGLDAVKARMKDITEKRQRNEATNVENDLFTTLELVNEMLERGFKFG   1380
              SIRAKAFEL+TMS GLDAVKARM+DIT KR+ NEATNVENDLFTTLE+VNEMLERGFKFG
Sbjct: 1318   SIRAKAFELKTMSGGLDAVKARMEDITIKRKNNEATNVENDLFTTLEIVNEMLERGFKFG   1377

Query: 1381   KLDLYRSHATDFIIEEDTLIPPFVAMEGLGENVAKQIVRAREDGEFLSKTELRKRGGVSS   1440
              KLDLY+S A +F I+ DTLIPPF+A+EGLGENVAKQIV+AR++GEFLSK ELRKRGG SS
Sbjct: 1378   KLDLYKSDAIEFQIKGDTLIPPFIALEGLGENVAKQIVKARQEGEFLSKMELRKRGGASS   1437

Query: 1441   TLVEKFDEMGILGNLPEDNQLSLFDDFF                                 1468
              TLVEK DEMGILGN+PEDNQLSLFDDFF
Sbjct: 1438   TLVEKMDEMGILGNMPEDNQLSLFDDFF                                 1465
```

Based on this analysis, it was predicted that these proteins and their epitopes could be useful antigens for vaccines or diagnostics.

Example 753

A DNA sequence (GBSx0800) was identified in S. agalactiae <SEQ ID 2315> which encodes the amino acid sequence <SEQ ID 2316>. Analysis of this protein sequence reveals the following:

Possible site: 24
>>> Seems to have no N-terminal signal sequence
----- Final Results -----
   bacterial cytoplasm --- Certainty = 0.1505 (Affirmative) <succ>
      bacterial membrane --- Certainty = 0.0000 (Not Clear) <succ>
         bacterial outside --- Certainty = 0.0000 (Not Clear) <succ>

A related GBS nucleic acid sequence <SEQ ID 10179> which encodes amino acid sequence <SEQ ID 10180> was also identified.

The protein has homology with the following sequences in the GENPEPT database:

A related DNA sequence was identified in S. pyogenes <SEQ ID 2317> which encodes the amino acid sequence <SEQ ID 2318>. Analysis of this protein sequence reveals the following:

Possible site: 37
>>> Seems to have no N-terminal signal sequence
----- Final Results -----
   bacterial cytoplasm --- Certainty = 0.0537 (Affirmative) <succ>
      bacterial membrane --- Certainty = 0.0000 (Not Clear) <succ>
         bacterial outside --- Certainty = 0.0000 (Not Clear) <succ>

An alignment of the GAS and GBS proteins is shown below:

```
>GP:CAB13207 GB:Z99111 similar to transcriptional regulator (MarR
family) [Bacillus subtilis]
Identities = 49/124 (39%), Positives = 73/124 (58%)
Query:  18   VMRKAFRTIDGKVSESFKEFELTPTQFAVLDVLYAKGTMKIGELIENMLATSGNMTVVIK    77
             V  +AF+++       KE   PT+FAVL++LY +G  K+ ++    +L  SGN+T VI
Sbjct:  20   VFARAFKSVSEHSIRDSKEHGFNPTEFAVLELLYTRGPQKLQQIGSRLLLVSGNVTYVID    79

Query:  78   NMEKKGWVLRHSCPNDKRAFLVSLTTEGEEVIKKALPEHIKRVEDAFSVLTETEQEDLIN   137
             +E+ G+++R    P DKR+    LT +G E + K  P H  R+  AFS L+  EQ+ LI
Sbjct:  80   KLERNGFLVREQDPKDKRSVYAHLTDKGNEYLDKIYPIHALRIARAFSGLSPDEQDQLIV   139

Query: 138   LLKK                                                         141
             LLKK
Sbjct: 140   LLKK                                                         143
```

```
Identities = 80/145 (55%), Positives = 111/145 (76%), Gaps = 1/145 (0%)
Query:    2 GDEMGNF-KNSAVKSMVVMRKAFRTIDGKVSESFKEFELTPTQFAVLDVLYAKGTMKIGE   60
            G++M +   KN+A+K+MVV RKA RT+D    ++ FK+ +LT TQF+VL+VLY KG M+I
Sbjct:    8 GNQMSHLDKNTALKAMVVFRKAQRTLDAFGADIFKKADLTATQFSVLEVLYTKGCMRINH   67

Query:   61 LIENMLATSGNMTVVIKNMEKKGWVLRHSCPNDKRAFLVSLTTEGEEVIKKALPEHIKRV  120
            LI+++LATSGNMTVV+ NME+ GW+ +      DKRA++V+LT +G  +I+  LP+H+ RV
Sbjct:   68 LIDSLLATSGNMTVVLNNMERNGWISKCKDKTDKRAYVVTLTDKGTRLIEAVLPEHVARV  127

Query:  121 EDAFSVLTETEQEDLINLLKKFKTL                                   145
            E+AF+VLTE EQ  LI LLKKFK L
Sbjct:  128 EEAFAVLTEKEQLCLIELLKKFKQL                                   152
```

Based on this analysis, it was predicted that these proteins and their epitopes could be useful antigens for vaccines or diagnostics.

Example 754

A DNA sequence (GBSx0801) was identified in *S. agalactiae* <SEQ ID 2319> which encodes the amino acid sequence <SEQ ID 2320>. Analysis of this protein sequence reveals the following:

Possible site: 46
>>> Seems to have no N-terminal signal sequence
----- Final Results -----
   bacterial cytoplasm --- Certainty = 0.3742 (Affirmative) <succ>
     bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:AAG05963 GB:AE004686 hypothetical protein [Pseudomonas aeruginosa]
Identities = 115/203 (56%), Positives = 143/203 (69%), Gaps = 7/203 (3%)
Query:    2 SFLEELKNRRSIYALGRNTEVSDEKIVEIIKEAVRQSPSAFNSQTSRVVILLNDEVTKFW   61
            +FL  +KNRR+IYAL +    VS EKIVE++KEAV SPSAFNSQ+SRVV+L   E  +FW
Sbjct:    4 AFLSSIKNRRTIYALDKQLPVSQEKIVELVKEAVSHSPSAFNSQSSRVVVLFGAEHEQFW   63

Query:   62 DELVANDLVETMKVQGAPETAIAGTKEKLASFGASKGTVLFFEDQDVVKSLQEQFVLYAD  121
            +  +A D  E K+    P  A A T+ KL SF A  GTVLFFEDQ VV+ LQEQF LVAD
Sbjct:   64 N--IAKD--ELKKI--VPADAFAATETKLNSFAAGAGTVLFFEDQTVVRQLQEQFALYAD  117

Query:  122 NFPVWSEQSTGIASVNTWTALSAELGLGGNLQHYNPVIDASVQAVYGPASWKLRGQLNF  181
            NFPVWSEQ++G+A    WTAL AE  +G +LQHYNP++DA      +P SWKLR Q+ F
Sbjct:  118 NFPVWSEQASGMAQFAVWTAL-AEHKVGASLQHYNPLVDAQTHKTWNLPESWKLRAQMPF  176

Query:  182 GSIEAETGEKEFMNDDDRFKVIG                                     204
            G+I A  GEK F+ +  +RFKV G
Sbjct:  177 GAIAAPAGEKAFIAESERFKVFG                                     199
```

No corresponding DNA sequence was identified in *S. pyogenes*.

Example 755

A DNA sequence (GBSx0802) was identified in *S. agalactiae* <SEQ ID 2321> which encodes the amino acid sequence <SEQ ID 2322>. Analysis of this protein sequence reveals the following:

Possible site: 58
>>> Seems to have no N-terminal signal sequence
----- Final Results -----
   bacterial cytoplasm --- Certainty = 0.2730 (Affirmative) <succ>
     bacterial membrane --- Certainty = 0.0000 (Not Clear) <succ>
      bacterial outside --- Certainty = 0.0000 (Not Clear) <succ>

Based on this analysis, it was predicted that this protein and its epitopes, could be useful antigens for vaccines or diagnostics.

The protein has homology with the following sequences in the GENPEPT database.

```
>GP:CAB62846 GB:AL035475 hypothetical protein [Plasmodium falciparum] (ver 2)
Identities = 112/529 (21%), Positives = 217/529 (40%), Gaps = 67/529 (12%)
Query:    3 NKKHKLLKNIEEFKTITQKRLTERGKFPYDTVHSTFEIKDENFIMERLKSSGLSMGKP--   60
            N K+  +K +   ++ Q  + E+ KF  D H    E +EFI E  +   K
Sbjct: 1063 NVKYNEMGAKN-DSLNQNEIIEKEKF--DLQH---ENRSERFIEEEKQICIVDDKKNNI  1116

Query:   61 --VDYMGVNGIPIYTKTLSIVNKFAFENNSKDSSYSSNINISEDKIKENDQKILDLIVKS  118
              VD     + P Y + L +       +N +   YS+       DKI +N++    ++ K
Sbjct: 1117 MNVDEKRKSDHPSYERVLKMEG-----SNKNEEGYSNT-----DKILKNEKNEKNVEKK  1166

Query:  119 GANNQNLTDEEKVIAFTKYIGEITNYDNEAYRARNVDTEYYRASDLFSVTERKLAMCVGY  178
            G N++    +E+K     K + E +  ++E     D       +  F          +C
Sbjct: 1167 GENDEKNENEKKEENDEKNVEKKDENDEKNENEKKDENDNNNSYFYNNSDTFELCTNS  1226
```

-continued
```
Query:  179  SVTAARAFNIMGIPSYVVSGKSPQGISHAAVRAYYNRSWHIIDITASTYWKNGNYKTTYS  238
              +     N + IPS       ++ +GI +      NS   I+       KN N ++ YS
Sbjct: 1227  LIFINNKKNSILIPS-----ENEKGIIGSQKEEEQNISPVKINNKKKDLCKNIN-ESDYS  1280

Query:  239  DFIKEYCIDGYD--VYDPAKTNNRFK-VKYMESNEAFENWIHNNGSKSML-------FIN  288
              D        ++   +Y    +N++ + ++   + NE + +    + N S++ L        ++
Sbjct: 1281  DKQYSVLLNSIEKKIYKKCSSNSKIRGIEKKKINEDYVDLKNINCSRNTLEFFLTKKYLK  1340

Query:  289  ESAALKDKKPKDDFVPVTEKEKNELIDKYKKLLSQIPENTQNPGEKNIRDYLKNEYEEIL  348
              S   + ++     +   V EK+K +    K KKL   +I   N    P + I + + +EY  +
Sbjct: 1341  SSELIINEHDCQNINNVYEKKKKKEQAK-KKLNRKI--NVNIPNDSIIEENMSSEYNFVK  1397

Query:  349  KKDN----LFEHEHAE-------FKESLNLNESFYLQLKKEE-------MKPSDNLKKEE  390
              KK+N      FE + ++       F     N  + L      +E+         ++ +N K+ E
Sbjct: 1398  KKNNNCMVKFETKRSKSILSSEIFAVKKNKKRATNLMRSEEQFISSIGLVEKGENKKRIE  1457

Query:  391  KPRENSVKERETPAENNDFVSVTEKNNLIDKYKELLSKIPENTQNPGEKNIRN--YLEKE  448
              +  E  +KE+     + N+F     KNNL  ++    L  K   EN     G   N      ++++
Sbjct: 1458  EKDEEYIKEK-IKNKKNEF-----KNNLTEQL--LFFKSAENINTSGSFNTEKIRHVKRT  1509

Query:  449  YEELLQKDKLFKHEYTEFTKSLNLNETFYSQLKEGEMKLSENPEKGETN             497
                    ++    +     + ++    K L     E        ++ E + ++++N EKGE N
Sbjct: 1510  KRKVNLSNNFILNNFSNILKKLQRMEEDKIKMDEQKKEINKNNEKGEFN             1558
```

There is also homology to SEQ ID 598.

Based on this analysis, it was predicted that this protein and its epitopes, could be useful antigens for vaccines or diagnostics.

Example 756

A DNA sequence (GBSx0803) was identified in *S. agalactiae* <SEQ ID 2323> which encodes the amino acid sequence <SEQ ID 2324>. Analysis of this protein sequence reveals the following:

Possible site: 22
>>> Seems to have no N-terminal signal sequence
----- Final Results -----
   bacterial cytoplasm --- Certainty = 0.1243 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 757

A DNA sequence (GBSx0804) was identified in *S. agalactiae* <SEQ ID 2325> which encodes the amino acid sequence <SEQ ID 2326>. This protein is predicted to be 2-dehydro-3-deoxyphosphogluconate aldolase/4-hydroxy-2-oxoglutarate al. Analysis of this protein sequence reveals the following:

Possible site: 49
>>> Seems to have no N-terminal signal sequence
----- Final Results -----
   bacterial cytoplasm --- Certainty = 0.1057 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:AAD35160 GB:AE001693 2-dehydro-3-deoxyphosphogluconate
aldolase/4-hydroxy-2-oxoglutarate aldolase [Thermotoga maritima]
Identities = 78/192 (40%), Positives = 118/192 (60%), Gaps = 6/192 (3%)
Query:   14  KIVAVIRGNSQEEAFQAAQACIKGGISAIEIAYTNSKASQVIEQLVTQYTNQEQVVVGAG   73
              KIVAV+R NS EEA + A A  +GG+    IEI +T    A  VI++L    +  ++  ++GAG
Sbjct:   11  KIVAVLRANSVEEAKEKALAVFEGGVHLIEITFTVPDADTVIKEL--SFLKEKGAIIGAG   68

Query:   74  TVLDSETARMAILAGAKFIVSPAFNLQTAKLCNRYAIPYLPGCMTLSEVTTALEAGCEII  133
              TV    E   R A+ +GA+FIVSP + + ++  C    + Y+PG MT  +E+  A++ G  I+
Sbjct:   69  TVTSVEQCRKAVESGAEFIVSPHLDEEISQFCKEKGVFYMPGVMTPTELVKAMKLGHTIL  128

Query:  134  KIFPGGTLGTSFISSLKAPLPQVQIMVTGGVNLTNAKDWFLSGVTAIGIGGEFNKLAALG  193
              K+FPG  +G  F+ ++K P P V+ + TGGVNL N  +WF +GV A+G+G      K      G
Sbjct:  129  KLFPGEVVGPQFVKAMKGPFPNVKFVPTGGVNLDNVCEWFKAGVLAVGVGSALVK----G  184

Query:  194  EFDKITEMAKQY                                                   205
              D++ E AK +
Sbjct:  185  TPDEVREKAKAF                                                   196
```

There is also homology to SEQ ID 1252.

Based on this analysis, it was predicted that this protein and its epitopes, could be useful antigens for vaccines or diagnostics.

Example 758

A DNA sequence (GBSx0805) was identified in *S. agalactiae* <SEQ ID 2327> which encodes the amino acid sequence <SEQ ID 2328>. This protein is predicted to be 2-keto-3-deoxygluconate kinase. Analysis of this protein sequence reveals the following:

Possible site: 55
>>> Seems to have no N-terminal signal sequence
----- Final Results -----
   bacterial cytoplasm --- Certainty = 0.4213 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:AAD35161 GB:AE001693 2-keto-3-deoxygluconate kinase [Thermotoga maritima]
Identities = 94/329 (28%), Positives = 169/329 (50%), Gaps = 7/329 (2%)
Query:   3 KILFFGEPLIRITPKENDYFADSISTKLFYGGSEVNTARALQGFGQDTKLLSALPNNPIG    62
           K++ FGE ++R++P ++    + S  + YGG+E N A  L   G D  ++   LPNNP+G
Sbjct:   2 KVVTFGEIMLRLSPPDHKRIFQTDSFDVTYGGAEANVAAFLAQMGLDAYFVTKLPNNPLG    61

Query:  63 NSFLQFLKAQGIDTHSIQWVGERVGLYFLEDSFACRKGEVVYDRDHSSLHDFRINQIDFD   122
           ++    L+  G+ T  I   G R+G+YFLE   + R  +VVYDR HS++ + +    D++
Sbjct:  62 DAAAGHLRKFGVKTDYIARGGNRIGIYFLEIGASQRPSKVVYDRAHSAISEARREDFDWE   121

Query: 123 QLFEGVSLFHFSGITLSLDESIQEITLLLLKEAKKREITISLDLNFRSKLISPKNAKILF   182
           ++ +G  FHFSGIT  L + +  I       LK A ++ +T+S DLN+R++L + + A+ +
Sbjct: 122 KILDGARWFHFSGITPPLGKELPLILEDALKVANEKGVTVSCDLNYRARLWTKEEAQKVM   181

Query: 183 SQFATFADICFG----IEPLMVDSQDTTFFNRDEATIEDVKERMISLINHFDFQVIFHTK   238
               F  + D+       IE ++ S  +         + E    +     ++F+ +  T
Sbjct: 182 IPFMEYVDVLIANEEDIEKVLGISVEGLDLKTGKLNREAYAKIAEEVTRKYNFKTVGITL   241

Query: 239 RLQDEWGRNHYQAYI-ANRKQEFVTSKEITTAVNQRIGSGDAFVAGALYQLLQHSDSKTV   297
           R         N++   + N +  F     EI     + R+G+GD+F    +Y  L   DS+
Sbjct: 242 RESISATVNYWSVMVFENGQPHFSNRYEI--HIVDRVGAGDSFAGALIYGSLMGFDSQKK   299

Query: 298 IDFAVASASLKCALEGDNMFETVTAVNKV                                326
           +FA A++ LK  + GD + ++    + K+
Sbjct: 300 AEFAAAASCLKHTIPGDFVVLSIEEIEKL                                328
```

There is also homology to SEQ ID 1264.

INTEGRAL   Likelihood = −0.22   Transmembrane 53-69 (53-70)
----- Final Results -----
   bacterial membrane --- Certainty = 0.1086 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database.

```
>GP:AAD36157 GB:AE001768 sugar-phosphate isomerase [Thermotoga maritima]
Identities = 41/125 (32%), Positives = 61/125 (48%), Gaps = 10/125 (8%)
Query:   1 MKIALINENSQASKNTIIYKELKAVSDEKGFEVFNYGMYGKEEESQLTVQNGLLTAILL    60
           MKIA+ ++++         + +++K    KG EV ++G Y +E       Y +  ++ +IL
Sbjct:   1 MKIAIASDHAAFE----LKEKVKNYLLGKGIEVEDHGTYSEESVDYPDYAKK-VVQSILS    55

Query:  61 NSGAADFVITGCGTGIGAMLACNSFPGVVCGFAADPVDAYLFSQVNGGNALSLPFAKGFG   120
           N   ADF I  CGTG+G  +A N + G+          P  A L     N  L LP     G
Sbjct:  56 NE--ADFGILLCGTGLGMSIAANRYRGIRAALCLFPDMARLARSUNNANILVLP---GRL   110

Query: 121 WGAEL                                                         125
            GAEL
Sbjct: 111 IGAEL                                                         115
```

Based on this analysis, it was predicted that this protein and its epitopes, could be useful antigens for vaccines or diagnostics.

Example 759

A DNA sequence (GBSx0806) was identified in *S. agalactiae* <SEQ ID 2329> which encodes the amino acid sequence <SEQ ID 2330>. Analysis of this protein sequence reveals the following:

Possible site: 16
>>> Seems to have no N-terminal signal sequence

A related DNA sequence was identified in *S. pyogenes* <SEQ ID 2331> which encodes the amino acid sequence <SEQ ID 2332>. Analysis of this protein sequence reveals the following:

Possible site: 13
>>> Seems to have no N-terminal signal sequence
----- Final Results -----
   bacterial cytoplasm --- Certainty = 0.2599 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 159/212 (750), Positives = 186/212 (87%)
Query:   1  MKIALINENSQASKNTIIYKELKAVSDEKGFEVFNYGMYGKEEESQLTYVQNGLLTAILL    60
            MKIALINENSQA+KN IIY  L  V+D+ G++VFNYGMYG E ESQLTYVQNGLL +ILL
Sbjct:   1  MKIALINENSQAAKNGIIYDALTTVTDKHGYQVFNYGMYGTEGESQLTYVQNGLLASILL    60

Query:  61  NSGAADFVITGCGTGIGAMLACNSFPGVVCGFAADPVDAYLFSQVNGGNALSLPFAKGFG   120
             + AADFV+TGCGTG+GAMLA NSFPGV CGFA++P +AYLFSQ+NGGNALS+PFAKGFG
Sbjct:  61  TTKAADFVVTGCGTGVGAMLALNSFPGVTCGFASEPTEAYLFSQINGGNALSIPFAKGFG   120

Query: 121  WGAELNLRYLFERLFEDEKGGGYPKERAVPEQRNARILSEIKQITYRDLLSVLKEIDQDF   180
            WGAELNL  +FERLF +  GGGYPKERA+PEQRNARILS++K+ITYRDLL+++K+IDQDF
Sbjct: 121  WGAELNLTLIFERLFAEPMGGGYPKERAIPEQRNARILSDLKKITYRDLLAIVKDIDQDF   180

Query: 181  LKETISGEHFQEYFFANCQNQNIADYLKSVLD                              212
            LKETISG HFQEYFFAN +   +  YLKSVL+
Sbjct: 181  LKETISGAHFQEYFFANAEPSELVTYLKSVLE                              212
```

Based on this analysis, it was predicted that these proteins and their epitopes could be useful antigens for vaccines or diagnostics.

Example 760

A DNA sequence (GBSx0807) was identified in *S. agalactiae* <SEQ ID 2333> which encodes the amino acid sequence <SEQ ID 2334>. Analysis of this protein sequence reveals the following:

Possible site: 23
>>> Seems to have no N-terminal signal sequence
INTEGRAL    Likelihood = –0.37    Transmembrane 10-26 (8-26)
----- Final Results -----
bacterial membrane --- Certainty = 0.1150 (Affirmative) <succ>
bacterial outside --- Certainty = 0.0000 (Not Clear) <succ>
bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 761

A DNA sequence (GBSx0808) was identified in *S. agalactiae* <SEQ ID 2335> which encodes the amino acid sequence <SEQ ID 2336>. This protein is predicted to be gluconate 5-dehydrogenase (fabG). Analysis of this protein sequence reveals the following:

Possible site: 35
>>> Seems to have no N-terminal signal sequence
----- Final Results -----
bacterial cytoplasm --- Certainty = 0.1117 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:AAC77223 GB:AE000497 5-keto-D-gluconate 5-reductase [Escherichia coli K12]
Identities = 116/260 (44%), Positives = 165/260 (62%), Gaps = 6/260 (2%)
Query:   6  LKDNFSLEGKVALITGASYGIGFSIATAFARAGATIVFNDIKQELVDKGISAYKKLGIKA    65
            + D FSL GK LITG++ GIGF +AT   + GA I+ NDI  E  +      + GI+A
Sbjct:   1  MNDLFSLAGKNILITGSAQGIGFLLATGLGKYGAQIIINDITAERAELAVEKLHQEGIQA    60

Query:  66  HGYVCDVTDEDGINEMVDKISQDVGVIDILVNNAGIIKRTPMLEMSAADFRQVIDIDLNA   125
             +VT +  I+  V+ I +D+G ID+LVNNAGI +R P E    ++ VI ++ A
Sbjct:  61  VAAPFNVTHKHEIDAAVEHIEKDIGPIDVLVNNAGIQRRHPFTEFPEQEWNDVIAVNQTA   120

Query: 126  PFIVSKAVLPGMIQKGHGKIINICSMMSELGRETVAAYAAAKGGLKMLTKNIASEYGSAN   185
            F+VS+AV    M+++  GK+INICSM SELGR+T+  YAA+KG +KMLT+ +  E   N
Sbjct: 121  VFLVSQAVTRHMVERKAGKVINICSMQSELGRDTITPYAASKGAVKMLTRGMCVELARHN   180

Query: 186  IQCNGIGPGYIATPQTAPLRERQDDGSRHPFDQFIIAKTPAARWGEAEDLGAPAIFLASD   245
            IQ NGI PGY T  T  L E +        F  ++  +TPAARWG+ ++L   A+FL+S
Sbjct: 181  IQVNGIAPGYFKTEMTKALVEDE------AFTAWLCKRTPAARWGDPQELIGAAVFLSSK   234

Query: 246  ASNFINGHILYVDGGILAYI                                          265
            AS+F+NGH+L+VDGG+L  +
Sbjct: 235  ASDFVNGHLLFVDGGMLVAV                                          254
```

There is also homology to SEQ ID 1242:

```
Identities = 225/264 (85%), Positives = 246/264 (92%)
Query:    6  LKDNFSLEGKVALITGASYGIGFSIATAFARAGATIVFNDIKQELVDKGISAYKKLGIKA    65
                +++ FSL+GK+ALITGASYGIGF IA A+A+AGATIVENDIKQELVDKG++AY++LGI+A
Sbjct:    1  MENMESLQGKIALITGASYGIGFEIAKAYAQAGATIVENDIKQELVDKGLAAYRELGIEA    60

Query:   66  HGYVCDVTDEDGINEMVDKISQDVGVIDILVNNAGIIKRTPMLEMSAADFRQVIDIDLNA   125
             HGYVCDVTDE GI +MV +I  +VG IDILVNNAGII+RTPMLEM+A DFRQVIDIDLNA
Sbjct:   61  HGYVCDVTDEAGIQQMVSQIEDEVGAIDILVNNAGIIRRTPMLEMAAEDFRQVIDIDLNA   120

Query:  126  PFIVSKAVLPGMIQKGHGKIINICSMMSELGRETVAAYAAAKGGLKMLTKNIASEYGSAN   185
             PFIVSKAVLP MI KGHGKIINICSMMSELGRETV+AYAAAKGGLKMLTKNIASE+G AN
Sbjct:  121  PFIVSKAVLPSMIAKGHGKIINICSMMSELGRETVSAYAAAKGGLKMLTKNIASEFGEAN   180

Query:  186  IQCNGIGPGYIATPQTAPLRERQDDGSRHPFDQFIIAKTPAARWGEAEDLGAPAIFLASD   245
             IQCNGIGPGYIATPQTAPLRERQ DGSRHPFDQFIIAKTPAARWG  EDL   PA+FLASD
Sbjct:  181  IQCNGIGPGYIATPQTAPLRERQADGSRHPFDQFIIAKTPAARWGTTEDLAGPAVFLASD   240

Query:  246  ASNFINGHILYVDGGILAYIGKQP                                      269
             ASNF+NGHILYVDGGILAYIGKQP
Sbjct:  241  ASNFVNGHILYVDGGILAYIGKQP                                      264
```

Based on this analysis, it was predicted that this protein and its epitopes, could be useful antigens for vaccines or diagnostics.

Example 762

A DNA sequence (GBSx0809) was identified in *S. agalactiae* <SEQ ID 2337> which encodes the amino acid sequence <SEQ ID 2338>. This protein is predicted to be mannose-specific phosphotransferase system component IIAB. Analysis of this protein sequence reveals the following:

---
Possible site: 24
>>> Seems to have no N-terminal signal sequence
----- Final Results -----
    bacterial cytoplasm --- Certainty = 0.0886 (Affirmative) <succ>
      bacterial membrane --- Certainty = 0.0000 (Not Clear) <succ>
        bacterial outside --- Certainty = 0.0000 (Not Clear) <succ>
---

The protein has homology with the following sequences in the GENPEPT database.

A related DNA sequence was identified in *S. pyogenes* <SEQ ID 2339> which encodes the amino acid sequence <SEQ ID 2340>. Analysis of this protein sequence reveals the following:

---
Possible site: 41
>>> Seems to have an uncleavable N-term signal seq
----- Final Results -----
    bacterial membrane --- Certainty = 0.0000 (Not Clear) <succ>
      bacterial outside --- Certainty = 0.0000 (Not Clear) <succ>
      bacterial cytoplasm --- Certainty = 0.0000 (Not Clear) <succ>
---

The protein has homology with the following sequences in the databases:

```
>GP:AAD46485 GB:AF130465 mannose-specific phosphotransferase system component
IIAB [Streptococcus salivarius]
Identities = 43/107 (40%), Positives = 61/107 (56%), Gaps = 3/107 (2%)
Query:    2  IKIIIVAHGNFPDGILSSLELIAGHQEYVVGINFIAGMSSNDVRVALQREVIDFK---EI    58
             I III +HG F +GI   S  +I G QE V  + F+      +D+        + F  EI
Sbjct:    3  IGIIIASHGKFAEGIHQSGSMIFGDQEKVQVVTFMPSEGPDDLYAHFNDAIAQFDADDEI    62

Query:   59  LVLTDLLGGTPFNVSSALSVEYTDKKIKVLSGLNLSMLMEAVLSRTM              105
             LVL DL  G+PFN +S  ++  E  D+KI +++GLNL ML++A    R M
Sbjct:   63  LVLADLWSGSPFNQASRIAGENPDRKIAIITGLNLPMLIQAYTERMM              109
```

```
>GP:AAF81086 GB:AF228498 AgaF [Escherichia coli]
Identities = 48/127 (37%), Positives = 71/127 (55%), Gaps = 6/127 (4%)
Query:   1  MIAIIVMGHGHFASGIVSALELIAGKQEKVTAIDFTTEMTAADVQDQLSRALIP---EEE   57
            M++II+ GHG FASG+  A++ I G+Q +  AID    + A+  QL  A+       E+
Sbjct:   1  MLSIILTGHGGFASGMEKAMKQILGEQSQFIAIDVPETSSTALLTSQLEEAIAQLDCEDG  60

Query:  58  TLVLCDLLGGTPFKVAATLMESLPNTTCNVLSGLNLAMLIEASFARQTAASFDDLVSGLI  117
            + L DLLGGTPF+VA+TL    P    C V++G NL +L+E    R+ +  + V  L
Sbjct:  61  IVFLTDLLGGTPERVASTLAMQKPG--CEVITGTNLQLLLEMVLEREGLSGEEFRVQAL-  117

Query: 118  TCSKEGI   124
             C    G+
Sbjct: 118  ECGHRGL   124
```

An alignment of the GAS and GBS proteins is shown below.

```
Identities = 73/146 (50%), Positives = 94/146 (64%), Gaps = 3/146 (2%)
Query:   1  MIKIIIVAHGNFPDGILSSLELIAGHQEYVVGINFIAGMSSNDVRVALQREVIDFKEILV   60
            MI II++ HG+F  GI+S+LELIAG QE V  I+F  M++ DV+  L R +I +E  LV
Sbjct:   1  MIAIIVNGHGHFASGIVSALELIAGKQEKVTAIDFTTEMTAADVQDQLSRALIPEEETLV   60

Query:  61  LTDLLGGTPFNVSSALSVEYTDKKIKVLSGLNLSMLMEAVLSRTMFEHVDDLVDKVITSS  120
            L DLLGGTPF V++ L   +    VLSGLNL+ML+EA +R     DDLV +IT S
Sbjct:  61  LCDLLGGTPFKVAATLMESLPNTTCNVLSGLNLAMLIEASFARQTAASFDDLVSGLITCS  120

Query: 121  HEGIVDFSTCLATQTAEATFE--GGI    144
            EGIVD+ T L+ Q    AT +  GGI
Sbjct: 121  KEGIVDWKT-LSQQEDGATDDELGGI   145
```

Based on this analysis, it was predicted that these proteins and their epitopes could be useful antigens for vaccines or diagnostics.

Example 763

A DNA sequence (GBSx0811) was identified in *S. agalactiae* <SEQ ID 2341> which encodes the amino acid sequence <SEQ ID 2342>. This protein is predicted to be unsaturated glucuronyl hydrolase. Analysis of this protein sequence reveals the following:

Possible site: 48
>>> Seems to have no N-terminal signal sequence
INTEGRAL     Likelihood = −0.11    Transmembrane 172-188 (172-188)
----- Final Results -----
bacterial membrane --- Certainty = 0.1044 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the GENPEPT database.

```
>GP:BAB05773 GB:AP001514 unsaturated glucuronyl hydrolase [Bacillus halodurans]
Identities = 156/370 (42%), Positives = 219/370 (59%), Gaps = 3/370 (0%)
Query:  30  EEAIEKALKQLYINIDYFGEEYPTPATFNNIYKVMDNTEWTNGFWTGCLWLAYEYNQDKK   89
            ++A+ ++ NI F +P + Y++ +N EWTNGFW+G LWL YEY D
Sbjct:   4  KQAMTDVAEKTLTNIKRFNGRFPHVSEDGEHYELNNNNEWTNGFWSGILWLCYEYTNDPA   63

Query:  90  LKNIARKNVLSFLNRINNRIALDHHDLGFLYTPSCTAEYRINGDVKALEATIKAADKLME  149
            +  A   V SF R+   + LDHHD+GFLY S  A++ I  D +A + TI+AAD LM+
Sbjct:  64  FRQAAASTVRSFQQRMEQNLELDHHDIGFLYSLSSKAQWIIERDERAKQLTIEAADVLMK  123

Query: 150  RYQEKGGFIQAWGELG-YKEHYRLIIDCLLNIQLLFFAYEQTGDEKYRQVAVNHFYASAN  208
            R++EK    QAWG G     R+I+DCL+N+ LLF+A E TG+  YR+ A+ H   +
Sbjct: 124  RWREKIELFQAWGPEGDLSNGGRIIVDCLMNLPLLFWASEVTGNPDYREAAIIHADKTRR  183

Query: 209  NVVRDDSSAFHTFYFDPETGEPLKGVTRQGYSDESSWARGQAWGIYGIPLSYRKMKDYQQ  268
            +VR D S +HTFYF+ ETGE L+G T QGY D S+W+RGQAW IYG ++YR  + +
Sbjct: 184  FIVRGDDSTYHTFYFNQETGEALRGGTHQGYEDGSTWSRGQAWAIYGFAIAYRYTGNERY  243

Query: 269  IILFKGMTNYFLNRLPEDKVSYWDLIFTDGSGQPRDTSATATAVCGIHEMLKYLPEVDPD  328
            +  K    YF+  LP D V+YWD            RD+SA+A A CGI E+L +L E DPD
Sbjct: 244  LETAKRTAKYFIENLPADYVAYWDFNAPITPDTKRDSSASAIASCGILELLSHLQETDPD  303

Query: 329  KETYKYAMHTMLRSLIEQYSNNELIAGRPLLLHGVYSWHSGKGVDEGNIWGDYYYLEALI  388
            K  ++  ++  + SL+E Y++ +   G  L+ G YS   G    D+  IWGDY+Y EAL+
Sbjct: 304  KAFFQQSVQKQMTSLVENYASEKDAQG--LIKRGSYSVRIGHAPDDYVIWGDYFYTEALM  361

Query: 389  RFYKDWELYW  398
            R  K    YW
Sbjct: 362  RLEKLRNGYW  371
```

A related DNA sequence was identified in *S. pyogenes* <SEQ ID 2343> which encodes the amino acid sequence <SEQ ID 2344>. Analysis of this protein sequence reveals the following:

Possible site: 33
>>> Seems to have no N-terminal signal sequence
INTEGRAL    Likelihood = −0.37    Transmembrane 173-189 (173-189)
----- Final Results -----
   bacterial membrane --- Certainty = 0.1150 (Affirmative) <succ>
     bacterial outside --- Certainty = 0.0000 (Not Clear) <succ>
      bacterial cytoplasm --- Certainty = 0.0000 (Not Clear) <succ>

An alignment of the GAS and GBS proteins is shown below.

Example 764

A DNA sequence (GBSx0812) was identified in *S. agalactiae* <SEQ ID 2345> which encodes the amino acid sequence <SEQ ID 2346>. Analysis of this protein sequence reveals the following:

Possible site: 36
>>> Seems to have no N-terminal signal sequence
----- Final Results -----
   bacterial cytoplasm --- Certainty = 0.3035 (Affirmative) <succ>
     bacterial membrane --- Certainty = 0.0000 (Not Clear) <succ>
      bacterial outside --- Certainty = 0.0000 (Not Clear) <succ>

The protein has homology with the following sequences in the GENPEPT database.

```
Identities = 273/395 (69%), Positives = 336/395 (84%)
Query:    4  IKPVKVESIENPKRFLNSRLLTKIEVEEAIEKALKQLYINIDYFGEEYPTPATFNNIYKV   63
             +K + +E I+ P+RF       L++ ++ +A++ ALKQ+ +N+DYF E++PTPAT +N Y +
Sbjct:    5  LKTIALEPIKQPERFTKEDFLSQEDITQALDLALKQVRLNMDYFKEDFPTPATKDNQYAI   64

Query:   64  MDNTEWTNGFWTGCLWLAYEYNQDKKLKNIAHKNVLSFLNRINNRIALDHHDLGFLYTPS  123
             MDNTEWTN FWTGCLWLAYEY+ D  +K +A  N LSFL+R+    I LDHHDLGFLYTPS
Sbjct:   65  MDNTEWTNAFWTGCLWLAYEYSGDDAIKALAQANDLSFLDRVTRDIELDHHDLGFLYTPS  124

Query:  124  CTAEYRINGDVKALEATIKAADKLMERYQEKGGFIQAWGELGYKEHYRLIIDCLLNIQLL  183
             C AE+++     ++ EA +KAADKL+++RYQ+KGGFIQAWGELG KE YRLIIDCLLNIQLL
Sbjct:  125  CMAEWKLLKTPESREAALKAADKLVQRYQDKGGFIQAWGELGKKEDYRLIIDCLLNIQLL  184

Query:  184  FFAYEQTGDEKYRQVAVNHFYASANNVVRDDSSAFHTFYFDPETGEPLKGVTRQGYSDES  243
             FFA ++TGD +YR +A+NHFYASAN+V+RDD+SA HTFYFDPETG P+KGVTRQGYSD+S
Sbjct:  185  FFASQETGDNRYRDMAINHFYASANHVIRDDASAYHTFYFDPETGDPVKGVTRQGYSDDS  244

Query:  244  SWARGQAWGIYGIPLSYRKMKDYQQIILFKGMTNYFLNRLPEDKVSYWDLIFTDGSGQPR  303
             +WARGQAWGIYGIPL+YR +K+ + I LFKGMT+YFLNRLP+D+VSYWDLIF DGS Q R
Sbjct:  245  AWARGQAWGIYGIPLTYRFLKEPELIQLFKGMTHYFLNRLPKDQVSYWDLIFGDGSEQSR  304

Query:  304  DTSATATAVCGIHEMLKYLPEVDPDKETYKYAMHTMLRSLIEQYSNNELIAGRPLLLHGV  363
             D+SATA AVCGIHEMLK LP+ DPDK+TY+ AMH+MLR+LI+ Y+N +L  G PLLLHGV
Sbjct:  305  DSSATAIAVCGIHEMLKTLPDHDPDKKTYEAAMHSMLRALIKDYANKDLKPGAPLLLHGV  364

Query:  364  YSWHSGKGVDEGNIWGDYYYLEALIRFYKDWELYW                         398
             YSWHSGKGVDEGNIWGDYYYLEAL+RFYKDW  YW
Sbjct:  365  YSWHSGKGVDEGNIWGDYYYLEALLRFYKDWNPYW                         399
```

Based on this analysis, it was predicted that these proteins and their epitopes could be useful antigens for vaccines or diagnostics.

```
>GP:AAC44679 GB:U65015 PTS permease for mannose subunit IIIMan C terminal
domain [Vibrio furnissii]
Identities = 63/125 (500), Positives = 89/125 (700), Gaps = 1/125 (0%)
Query:    5 PNIVMTRVDERLIHGQ-GQLWVKFLSCNTVIVANDDVSKDHLQQTLMKTVVPESIALRFF     63
            PNIV++R+DERL+HGQ G  WV F    N V+VAND+V+ D +QQ LM+ V+ + IA+RF+
Sbjct:    2 PNIVLSRIDERLVHGQVGVQWVGFADANIVVVANDEVAADTIQQNLMEMVLADGIAIRFW     61

Query:   64 DIQKVIDIIHKANPAQTIFIIVKDLKDVYRLVAGGVPIKEINIGNIHNGEGKEQVSRSIF    123
             +QK ID IHKA+ Q I ++ K   D   RLV GGVPI   IN+GN+H  +GK Q+S+++
Sbjct:   62 TVQKTIDTIHKASDRQRILLVCKTPHDFRRLVEGGVPIAAINVGNMHYIDGKTQISKTVS    121

Query:  124 LGMKD                                                         128
            +   +D
Sbjct:  122 VDAED                                                         126
```

A related DNA sequence was identified in *S. pyogenes* <SEQ ID 2347> which encodes the amino acid sequence <SEQ ID 2348>. Analysis of this protein sequence reveals the following:

Possible site: 58
>>> Seems to have no N-terminal signal sequence
----- Final Results -----
  bacterial cytoplasm --- Certainty = 0.2511 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the databases:

```
>GP:BAA84216 GB:AB019619 unsaturated glucuronyl hydrolase [Bacillus sp. GL1]
Identities = 161/369 (43%), Positives = 220/369 (58%), Gaps = 1/369 (0%)
Query:   32 QALDLALKQVRLNMDYFKEDFPTPATKDNQYAIMDNTEWTNAFWTGCLWLAYEYSGDDAI     91
            QA+  AL     N+ F + FP  +    N+Y + DNT+WT+ FW+G LWL YEY+GD+
Sbjct:    4 QAIGDALGITARNLKKFGDRFPHVSDGSNKYVLNDNTDWTDGFWSGILWLCYEYTGDEQY     63

Query:   92 KALAQANDLSFLDRVTRDIELDHHDLGFLYTPSCMAEWKLLKTPESREAALKAADKLVQR    151
            +  A      SF +R+ R   LDHHD+GFLY+ S  A+W + K   +R+ AL AAD L++R
Sbjct:   64 REGAVRTVASFRERLDRFENLDHHDIGFLYSLSAKAQWIVEKDESARKLALDAADVLMRR    123

Query:  152 YQDKGGFIQAWGELGKKEDY-RLIIDCLLNIQLLFFASQETGDNRYRDMAINHFYASANH    210
            ++   G IQAWG  G  E+  R+IIDCLLN+ LL +A ++TGD  YR +A  H    S
Sbjct:  124 WRADAGIIQAWGPKGDPENGGRIIIDCLLNLPLLLWAGEQTGDPEYRRVAEAHALKSRRF    183

Query:  211 VIRDDASAYHTFYFDPETGDPVKGVTRQGYSDDSAWARGQAWGIYGIPLTYRFLKEPELI    270
            ++R D S+YHTFYFDPE G+ ++G T QG +D S W RGQAWGIYG   L  R+L   +L+
Sbjct:  184 LVRGDDSSYHTFYFDPENGNAIRGGTHQGNTDGSTWTRGQAWGIYGFALNSRYLGNADLL    243

Query:  271 QLFKGMTHYFLNRLPKDQVSYWDLIFGDGSEQSRDSSATAIAVCGIHEMLKTLPDHDPDK    330
            + K M +FL R+P+D V YWD         RDSSA+AI CG+ E+   L + DP++
Sbjct:  244 ETAKRMARHFLARVPEDGVVYWDFEVPQEPSSYRDSSASAITACGLLEIASQLDESDPER    303

Query:  331 KTYEAAMHSMLRALIKDYANKDLKPGAPLLLHGVYSWHSGKGVDEGNIWGDYYYLEALLR    390
            + + A + + AL    YA +D       + G Y    G    D+  IWGDYYYLEALLR
Sbjct:  304 QRFIDAAKTTVTALRDGYAERDDGEAEGFIRRGSYHVRGGISPDDYTIWGDYYYLEALLR    363

Query:  391 FYKDWNPYW                                                     399
             +   YW
Sbjct:  364 LERGVTGYW                                                     372
```

An alignment of the GAS and GBS proteins is shown below.

```
Identities = 112/160 (70%), Positives = 132/160 (82%), Gaps = 1/160 (0%)
Query:    5 PNIVMTRVDERLIHGQGQLWVKFLSCNTVIVANDDVSKDHLQQTLMKTVVPESIALRFFD     64
            PNI+MTRVDERLIHGQGQLWVKFL+CNTVIVAND VS+D +QQ+LMKTV+P SIA+RFF
Sbjct:    4 PNIIMTRVDERLIHGQGQLWVKFLNCNTVIVANDAVSEDKIQQSLMKTVIPSSIAIRFFS     63

Query:   65 IQKVIDIIHKANPAQTIFIIVKDLKDVYRLVAGGVPIKEINIGNIHNGEGKEQVSRSIFL    124
            IQKVIDIIHKA+PAQ+IFI+VKDL+D   LV GGVPI EINIGNIH  +K  +++ I L
Sbjct:   64 IQKVIDIIHKASPAQSIFIVVKDLQDAKLLVEGGVPITEINIGNIHKTDDKVAITQFISL    123
```

-continued

```
Query: 125  GMKDKEIIRKLNQEYHIAFNTKTTPTGNDGAVEVNILDYI              164
            G  DK  IR L  ++H+ FNTKTTP GN  A +V+ILDYI
Sbjct: 124  GETDKSAIRCLAHDHHVVFNTKTTPAGN-SASDVDILDYI              162
```

Based on this analysis, it was predicted that these proteins and their epitopes could be useful antigens for vaccines or diagnostics.

Example 765

A DNA sequence (GBSx0813) was identified in *S. agalactiae* <SEQ ID 2349> which encodes the amino acid sequence <SEQ ID 2350>. This protein is predicted to be AgaW (agaC). Analysis of this protein sequence reveals the following:

Possible site: 25
>>> Seems to have a cleavable N-term signal seq.
INTEGRAL    Likelihood = −6.95    Transmembrane 251-267 (244-269)
INTEGRAL    Likelihood = −4.30    Transmembrane 213-229 (208-230)
INTEGRAL    Likelihood = −2.71    Transmembrane 149-165 (148-165)
INTEGRAL    Likelihood = −1.81    Transmembrane 31-47 (31-49)
INTEGRAL    Likelihood = −1.49    Transmembrane 173-189 (173-189)
----- Final Results -----
  bacterial membrane --- Certainty = 0.3781 (Affirmative) <succ>
  bacterial outside --- Certainty = 0.0000 (Not Clear) <succ>
  bacterial cytoplasm --- Certainty = 0.0000 (Not Clear) <succ>

Possible site: 52
>>> Seems to have a cleavable N-term signal seq.
INTEGRAL    Likelihood = −6.37    Transmembrane 220-236 (214-241)
INTEGRAL    Likelihood = −5.10    Transmembrane 146-162 (144-165)
INTEGRAL    Likelihood = −1.59    Transmembrane 184-200 (184-202)
----- Final Results -----
  bacterial membrane --- Certainty = 0.3548 (Affirmative) <succ>
  bacterial outside --- Certainty = 0.0000 (Not Clear) <succ>
  bacterial cytoplasm--- Certainty = 0.0000 (Not Clear) <succ>

The protein has homology with the following sequences in the GENPEPT database.

The protein has homology with the following sequences in the databases:

```
>GP:AAF81084 GB:AF228498 AgaW [Escherichia coli]
Identities = 93/295 (31%), Positives = 140/295 (46%), Gaps = 48/295 (16%)
Query:   1  MDISILQAVLIGLWTAFCFSGMLLGL-YTNRCIVLSLGVGVILGDIQTALAVGAISELAY     59
            M+IS+LQA  +G+         M  GL + +R +VL   VG++LGD+ T +   G   EL +
Sbjct:   1  MEISLLQAFALGIIAFIAGLDMFNGLTHMHRPVVLGPLVGLVLGDLHTGILTGGTLELVW    60

Query:  60  MGFGVGAGGTVPPNPIGPGIFGTLMAITTAGTKGKITPEAALSLSTPIAVGIQFLQTATY   119
            MG    AG   PPN I   I GT AITT        + P+ A+ ++ P AV +Q   T +
Sbjct:  61  MGLAPLAGAQ-PPNVIIGTIVGTAFAITTG-----VKPDVAVGVAVPFAVAVQMGITFLF   114

Query: 120  TAFAGAPETAKK--------ALQAGNFRGFKIAANGT-IWAFAGLGFGLGVLGALSTQTL   170
             +  +G   +         AL A N+           N  + AF  + FG   A   +T+
Sbjct: 115  SVMSGVMSRCARMPRTPILAALNACNYLALLALGNFYFLCAFLPIYFG-----AEHAKTI   169

Query: 171  TDLFALIPPVLLNGLTLAGKMLPAIGFAMILSVMAKKELIPYILLGYVLAVYFGLPVLTP   230
                D+   +P  L++GL +AG  ++PAIGFA++L +M K    IPY +LG+V A +   LPVL
Sbjct: 170  IDV---LPQRLIDGLGVAGGIMPAIGFAVLLKIMMKNVYIPYFILGFVAAAWLKLPVL--   224

Query: 231  TANGDGVLTSVATNSVLGVPTIGVAIIATIFALLDIFRKPAAPTKETKTEGDNQD       285
                                +A  A   AL+D+ RK   PT+    + +D
Sbjct: 225  --------------------AIACPALAMALIDLLRKSPEPTQPAAQKEEFED        257
```

A related DNA sequence was identified in *S. pyogenes* <SEQ ID 2351> which encodes the amino acid sequence <SEQ ID 2352>. Analysis of this protein sequence reveals the following:

```
>GP:AAC44680 GB:U65015 PTS permease for mannose subunit IIPMan
            [Vibrio furnissii]
Identities = 86/255 (33%), Positives = 137/255 (53%), Gaps = 11/255 (4%)
Query:   1  MDINLLQALLIGLWTAFCFSGMLLGI-YTNRCIILSFGVGIILGDLPTALSMGAISELAY     59
            M+I L QAL++GL         + G+ + G+ + +R ++L   VG+ILGDL T + +G   EL +
Sbjct:   1  MEIGLFQALMLGLLAFLAGLDLFNGLTHFHRPVVLGPLVGLILGDLHTGILVGGTLELIW    60

Query:  60  MGFGVGAGGTVPPNPIGPGIFGTLMAITSAGKVTPEAALALSTPIAVAIQFLQTFAYTAF    119
            MG    AG   PPN I   I GT  AIT+       V P  A+ ++ P AVA+Q   T    ++A
Sbjct:  61  MGLAPLAGAQ-PPNVIIGTIVGTTFAITT--NVEPNVAVGVAVPFAVAVQMGITLLFSAM   117
```

```
-continued
Query:  120  AGAPETAKKQLQKGNIRGFK---FAANGTIWAFAFIGLGLGLLGALSMDTLLHLVDYIPP   176
                +     +   +   +RG +     + A   + +F F+    L  +    L    D     +V   +P
Sbjct:  118  SAVMSKCDEYAKNADTRGIERVNYFALAVLGSFYFLCAFLPIY--LGADHAGAMMAALPK   175

Query:  177  VLLNGLTVAGKMLPAIGFAMILSVMAKKELIPFVLIGYVCAAYLQIPTIGIAIIGIIFAL   236
                L++GL VAG ++PAIGFA+++ +M K       IP+ ++G+V AA+LQ+P + I           A+
Sbjct:  176  ALIDGLGVAGGIMPAIGFAVLMKIMMKNAYIPYFILGFVAAAWLQLPILAIRCAATAMAI   235

Query:  237  NEFYNK--PKQVDAT                                              249
                +F   K    P   V+A+
Sbjct:  236  IDFMRKSEPTPVNAS                                              250
```

An alignment of the GAS and GBS proteins is shown below.

```
Identities = 203/288 (70%), Positives = 225/288 (77%), Gaps = 28/288 (9%)
Query:    1  MDISILQAVLIGLWTAFCFSGMLLGLYTNRCIVLSLGVGVILGDIQTALAVGAISELAYM   60
             MDI++LQA+LIGLWTAFCFSGMLLG+YTNRCI+LS GVG+ILGD+ TAL++GAISELAYM
Sbjct:    1  MDINLLQALLIGLWTAFCFSGMLLGIYTNRCIILSFGVGIILGDLPTALSMGAISELAYM   60

Query:   61  GFGVGAGGTVPPNPIGPGIFGTLMAITTAGTKGKITPEAALALSTPIAVGIQFLQTATYT   120
             GFGVGAGGTVPPNPIGPGIFGTLMAIT+AG    K+TPEAALALSTPIAV IQFLQT  YT
Sbjct:   61  GFGVGAGGTVPPNPIGPGIFGTLMAITSAG---KVTPEAALALSTPIAVAIQFLQTFAYT   117

Query:  121  AFAGAPETAKKALQAGNFRGFKIAANGTIWAFAGLGFGLGVLGALSTQTLTDLFALIPPV   180
             AFAGAPETAKK LQ GN RGFK AANGTIWAFA +G GLG+LGALS   TL   L   IPPV
Sbjct:  118  AFAGAPETAKKQLQKGNIRGFKFAANGTIWAFAFIGLGLGLLGALSMDTLLHLVDYIPPV   177

Query:  181  LLNGLTLAGKMLPAIGFAMILSVMAKKELIPYILLGYVLAVYFGLPVLTPTANGDGVLTS   240
             LLNGLT+AGKMLPAIGFAMILSVMAKKELIP++L+GYV A Y
Sbjct:  178  LLNGLTVAGKMLPAIGFAMILSVMAKKELIPFVLIGYVCAAY------------------   219

Query:  241  VATNSVLGVPTIGVAIIATIFALLDIFRKPAAPTKETKTEGDNQDDWI              288
                    L +PTIG+AII   IFAL + +  KP          T   +G  QDDWI
Sbjct:  220  ------LQIPTIGIAIIGIIFALNEFYNKP-KQVDATTVQGGQQDDWI              260
```

Based on this analysis, it was predicted that these proteins and their epitopes could be useful antigens for vaccines or diagnostics.

Example 766

A DNA sequence (GBSx0814) was identified in *S. agalactiae* <SEQ ID 2353> which encodes the amino acid sequence <SEQ ID 2354>. Analysis of this protein sequence reveals the following:

Possible site: 31
>>> Seems to have no N-terminal signal sequence
----- Final Results -----
  bacterial cytoplasm --- Certainty = 0.2442 (Affirmative) <succ>
  bacterial membrane --- Certainty = 0.0000 (Not Clear) <succ>
  bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 767

A DNA sequence (GBSx0815) was identified in *S. agalactiae* <SEQ ID 2355> which encodes the amino acid sequence <SEQ ID 2356>. This protein is predicted to be PTS permease for mannose subunit IIBMan. Analysis of this protein sequence reveals the following:

Possible site: 43
>>> Seems to have no N-terminal signal sequence
INTEGRAL   Likelihood = -8.28   Transmembrane 278-294 (272-294)
INTEGRAL   Likelihood = -3.45   Transmembrane 155-171 (155-174)
INTEGRAL   Likelihood = -1.59   Transmembrane 250-266 (250-267)
----- Final Results -----
  bacterial membrane --- Certainty = 0.4312 (Affirmative) <succ>
  bacterial outside --- Certainty = 0.0000 (Not Clear) <succ>
  bacterial cytoplasm --- Certainty = 0.0000 (Not Clear) <succ>

A related GBS nucleic acid sequence <SEQ ID 8657> which encodes amino acid sequence <SEQ ID 8658> was also identified. Analysis of this protein sequence reveals the following:

Lipop: Possible site: -1   Crend: 10
McG: Discrim Score: -9.70
GvH: Signal Score (-7.5): -6.12
Possible site: 19
>>> Seems to have no N-terminal signal sequence
ALOM program count: 3   value: -8.28   threshold:0.0
INTEGRAL   Likelihood = -8.28   Transmembrane 254-270 (248-270)
INTEGRAL   Likelihood = -3.45   Transmembrane 131-147 (131-150)
INTEGRAL   Likelihood = -1.59   Transmembrane 226-242 (226-243)
PERIPHERAL Likelihood = 0.37      175
modified ALOM score: 2.16
*** Reasoning Step: 3
----- Final Results -----
  bacterial membrane --- Certainty = 0.4312 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

```
>GP:AAA57943 GB:U18997 ORF_o290; Geneplot suggests frameshift linking
to o267, not found [Escherichia coli]
Identities = 101/278 (36%), Positives = 164/278 (58%), Gaps = 6/278 (2%)
Query:  17 LRQKETTKMTGSKKLAKSDYTKTALRAFYLQNGFNYSNYQGLGYANVIYPALKKYYGDDK    76
              ++ K+ T   GS+ ++K D T+   R+  LQ FNY   Q  G+   + P LKK Y DDK
Sbjct:  19 VKMKKRTTAMGSE-ISKKDITRLGFRSSLLQASFNYERMQAGGFTWAMLPILKKIYKDDK    77

Query:  77 KALAGALEENVEFYNTNPHFLPFVTSLHLAMLDNERPEEEIRGIKMALMGPLAGIGDSLS   136
              L+ A+++N+EF NT+P+ + F+  L ++M +     + I+G+K+AL GP+AGIGD++
Sbjct:  78 PGLSAAMKDNLEFINTHPNLVGFLMGLLISMEEKGENRDTIKGLKVALFGPIAGIGDAIF   137

Query: 137 QFCLAPLFSTIAASLATDGLVMGPILFFVAMNTILTGIKLVTGMYGYRLGTSFIDKLSEQ   196
              F L P+ + I +S A+ G ++GPILFF A+  ++  +++       GY +G   IDK+ E
Sbjct: 138 WFTLLPIMAGICSSFASQGNLLGPILFF-AVYLLIFFLRVGWTHVGYSVGVKAIDKVREN   196

Query: 197 MSVISRAANIVGVTVISSLAATQVKLTIPYTFAPEKVTSTTQKIVTVQGMLDKIAPALLP   256
              +I+R+A I+G+TVI   L A+ V + +   +FA        T  +    Q    DK+ P +LP
Sbjct: 197 SQMIARSATILGITVIGGLIASYVHINVVTSFA----IDNTHSVALQQDFFDKVFPNILP   252

Query: 257 ALYTFLMFYLIKNKKWTTYKLVILTVIIGILGSWLGIL                         294
              YT LM+Y ++ KK      L+ +T ++ I+ S  GIL
Sbjct: 253 MAYTLLMYYFLRVKKAHPVLLIGVTFVLSIVCSAFGIL                         290
```

A related DNA sequence was identified in *S. pyogenes* <SEQ ID 2357> which encodes the amino acid sequence <SEQ ID 2358>. Analysis of this protein sequence reveals the following:

```
Possible site: 45
>>> Seems to have no N-terminal signal sequence
INTEGRAL     Likelihood = -8.49    Transmembrane 276-292 (270-292)
INTEGRAL     Likelihood = -7.01    Transmembrane 151-167 (149-176)
INTEGRAL     Likelihood = -3.03    Transmembrane 202-218 (202-220)
INTEGRAL     Likelihood = -2.13    Transmembrane 249-265 (248-265)
----- Final Results -----
   bacterial membrane --- Certainty = 0.4397 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the databases:

```
>GP:AAA57943 GB:U18997 ORF_o290; Geneplot suggests frameshift linking
to o267, not found [Escherichia coli]
Identities = 104/285 (36%), Positives = 162/285 (56%), Gaps = 7/285 (2%)
Query:   8 NKSMQQLSKEANKMTGSNKLTKKDYLKTALRAFFLQNGFNYNNYQGIGYANVIYPALKKH    67
              N+S  + +     ++++KKD   R+  LQ FNY   Q  G+   + P LKK
Sbjct:  13 NRSPLPVKMKKRTTAMGSEISKKDITRLGFRSSLLQASFNYERMQAGGFTWAMLPILKKI    72

Query:  68 FGNDKKGLYQALEDNCEFYNTNPHFLPFITSLHLVMLENNRPEEETRNIKMALMGPLAGI   127
              + +DK GL  A++DN EF NT+P+ + F+  L + M E      +  ++K+AL GP+AGI
Sbjct:  73 YKDDKPGLSAAMKDNLEFINTHPNLVGFLMGLLISMEEKGENRDTIKGLKVALFGPIAGI   132

Query: 128 GDSLSQFCLAPLFSTIAASLASDGLVLGPILFFLAMNIILTAIKIGSGLYGYKVGTSFID   187
              GD++  F L P+ + I +S AS G +LGPILFF A+ +++  +++G       GY VG    ID
Sbjct: 133 GDAIFWFTLLPIMAGICSSFASQGNLLGPILFF-AVYLLIFFLRVGWTHVGYSVGVKAID   191

Query: 188 KLSEQMAVVSRMANIVGVTVIAGLAATSVKITVPITFAAGKVDAANTAQKFVTIQGMLDK   247
              K+ E    +++R A I+G+TVI GL A+ V I V +FA     +    Q F       DK
Sbjct: 192 KVRENSQMIARSATILGITVIGGLIASYVHINVVTSFAIDNTHSVALQQDF------FDK   245

Query: 248 IAPALLPALFTLLMYYLIKNKKWTTYKLVILTVIIGVIGSWLGIL                 292
              + P +LP +TLLMYY ++ KK      L+ +T ++ ++ S  GIL
Sbjct: 246 VFPNILPMAYTLLMYYFLRVKKAHPVLLIGVTFVLSIVCSAFGIL                 290
```

An alignment of the GAS and GBS proteins is shown below.

```
Identities = 224/288 (77%), Positives = 255/288 (87%), Gaps = 4/288 (1%)
Query:  12 HLLKKLRQ--KETTKMTGSKKLAKSDYTKTALRAFYLQNGENYSNYQGLGYANVIYPALK    69
              +L K ++Q   KE  KMTGS KL K DY KTALRAF+LQNGFNY+NYQG+GYANVIYPALK
```

```
                              -continued
Sbjct:    6  NLNKSMQQLSKEANKMTGSNKLTKKDYLKTALRAFFLQNGENYNNYQGIGYANVIYPALK   65

Query:   70  KYYGDDKKALAGALEENVEFYNTNPHFLPFVTSLHLAMLDNERPEEEIRGIKMALMGPLA  129
             K++G+DKK L  ALE+N EFYNTNPHFLPF+TSLHL ML+N RPEEE R IKMALMGPLA
Sbjct:   66  KHEGNDKKGLYQALEDNCEFYNTNPHFLPFITSLHLVMLENNRPEEETRNIKMALMGPLA  125

Query:  130  GIGDSLSQFCLAPLFSTIAASLATDGLVMGPILFFVAMNTILTGIKLVTGMYGYRLGTSF  189
             GIGDSLSQFCLAPLFSTIAASLA+DGLV+GPILFF+AMN ILT IK+ +G+YGY++GTSF
Sbjct:  126  GIGDSLSQFCLAPLFSTIAASLASDGLVLGPILFFLAMNIILTAIKIGSGLYGYKVGTSF  185

Query:  190  IDKLSEQMSVISRAANIVGVTVISSLAATQVKLTIPYTFAPEKV--TSTTQKIVTVQGML  247
             IDKLSEQM+V+SR ANIVGVTVI+ LAAT VK+T+P TFA  KV   +T QK VT+QGML
Sbjct:  186  IDKLSEQMAVVSRMANIVGVTVIAGLAATSVKITVPITFAAGKVDAANTAQKFVTIQGML  245

Query:  248  DKIAPALLPALYTFLMFYLIKNKKWTTYKLVILTVIIGILGSWLGILA              295
             DKIAPALLPAL+T LM+YLIKNKKWTTYKLVILTVIIG++GSWLGILA
Sbjct:  246  DKIAPALLPALFTLLMYYLIKNKKWTTYKLVILTVIIGVIGSWLGILA              293
```

Based on this analysis, it was predicted that these proteins and their epitopes could be useful antigens for vaccines or diagnostics.

Example 768

A DNA sequence (GBSx0816) was identified in *S. agalactiae* <SEQ ID 2359> which encodes the amino acid sequence <SEQ ID 2360>. Analysis of this protein sequence reveals the following:

---
Possible site: 58
>>> Seems to have no N-terminal signal sequence
INTEGRAL    Likelihood = −0.37    Transmembrane 135-151 (135-151)
----- Final Results -----
  bacterial membrane --- Certainty = 0.1150 (Affirmative) <succ>
    bacterial outside --- Certainty = 0.0000 (Not Clear) <succ>
      bacterial cytoplasm --- Certainty = 0.0000 (Not Clear) <succ>
---

The protein has homology with the following sequences in the GENPEPT database.

```
>GP:CAB01924 GB:Z79691 OrfA [Streptococcus pneumoniae]
Identities = 76/206 (36%), Positives = 124/206 (59%), Gaps = 1/206 (0%)
Query:  428  SWTYNSYPKCDYCQLTSKDRYHLVEGQLHVQRASDIYYHKRWLLTLPQAITLVIDKVSCP  487
             SW Y  YP  +C   ++  H +EG        Y HKR +L L + + L++D + C
Sbjct:    2  SWEYEYYPHSLFCHHKEREGMHYIEGAYWSAEPDLPYLHKRKILMLVEDVWLLVDDIRCQ   61

Query:  488  GEHVLTNQYILDDQVIYENGFVNDLKLVSPTTFNLEDCLISKRYNQLTESHKLVKKIKFV  547
             G+H    Q+ILD  V Y++G +N L+L S   F+LED +IS +YN+L  S KL K+  F
Sbjct:   62  GQHEALTQFILDKDVTYQDGKINQLRLWSEVDFDLEDTIISPKYNELERSSKLTKRQFFE  121

Query:  548  DEVMDYTLIVDRNCQVKYVPLVQTNSHKELSNSIAFDIRSQDFHYLIGVLMDDIIFGDKL  607
             ++++DYT+I  + ++    + QT+  +E+ N++AF++++ +   LI +L +DI  G+KL
Sbjct:  122  NQMLDYTIIAHESFEIIRHSVYQTDD-REVENALAFEVKNDETDKLILLLSEDIRVGEKL  180

Query:  608  YLMQGIKCKGKVIVYDKNNGKMSRLK                                    633
             L+  G K +GK +VYDK N +M RL+
Sbjct:  181  CLVDGTKMRGKCLVYDKINERMIRLQ                                    206
```

A related DNA sequence was identified in *S. pyogenes* <SEQ ID 2361> which encodes the amino acid sequence <SEQ ID 2362>. Analysis of this protein sequence reveals the following:

---
Possible site: 53
>>> Seems to have no N-terminal signal sequence
INTEGRAL    Likelihood = −2.55    Transmembrane 477-493 (477-493)
----- Final Results -----
  bacterial membrane --- Certainty = 0.2020 (Affirmative) <succ>
    bacterial outside --- Certainty = 0.0000 (Not Clear) <succ>
      bacterial cytoplasm --- Certainty = 0.0000 (Not Clear) <succ>
---

The protein has homology with the following sequences in the databases:

```
>GP:CAB01924 GB:Z79691 OrfA [Streptococcus pneumoniae]
Identities = 75/207 (36%), Positives = 125/207 (60%), Gaps = 2/207 (0%)
Query: 434  SWAYLSYPKSNYCHLRQNGHVYFIEGSYQTQFSDRNNYQHDRQILILPPGIFLIIDTIQA  493
            SW Y  YP S +CH ++    +++IEG+Y +    Y H R+IL+L    ++L++D I+
Sbjct:   2  SWEYEYYPHSLFCHHKEREGMHYIEGAYWSAEPDLP-YLHKRKILMLVEDVWLLVDDIRC   60

Query: 494  QGNHCLVSQFILDNHLDVKTDHLSDLRLISDCPFTIEETILSKKYNQYLTSHKLIKRKPF  553
            QG H  ++QFILD  +    ++ LRL S+  F +E+TI+S KYN+   S KL KR+ F
Sbjct:  61  QGQHEALTQFILDKDVTYQDGKINQLRLWSEVDFDLEDTIISPKYNELERSSKLTKRQFF  120

Query: 554  KDKGCTSTLLVPDDTKVTPLTPLQTGKRNPIETALSWHLKGKQFDYSICVLQEDLIKGEK  613
            +++     T++ +  ++    +  QT R  +E AL++ +K   + D  I +L ED+  GEK
Sbjct: 121  ENQMLDYTIIAHESFEIIRHSVYQTDDRE-VENALAFEVKNDETDKLILLLSEDIRVGEK  179

Query: 614  LVLLNSHKIRGKVVVINHITNEIIRLK                                  640
            L L++   K+RGK +V + I   +IRL+
Sbjct: 180  LCLVDGTKMRGKCLVYDKINERMIRLQ                                  206
```

An alignment of the GAS and GBS proteins is shown below.

```
Identities = 282/631 (44%), Positives = 414/631 (64%), Gaps = 2/631 (0%)
Query:   6  YNKFKD-FDREFCQKYIKTYQSNAYQEMKASVNLMMRNTFVFNDNWDMEPCSKAYCLDPL   64
            + +FK+ + +FC+ Y+  YQ+++Y + K   +L++ NTF+F DNWDMEPC   Y LDP+
Sbjct:  11  FARFKETVNPDFCRNYLLDYQTDSYADQKRIADLLLTNTFLFEDNWDMEPCHIPYHLDPI   70

Query:  65  EWDKPVTDDPEWLYMLNRQTYLFKFLVVYIVEGDKSYLRQMKYFMYHWIDCQFTLKPEGA  124
            W + V DDPEW +MLNRQTYL K ++VY+VE D+ YL   K F+ +WI+    L P+G
Sbjct:  71  TWQEAVIDDPEWNFMLNRQTYLQKLILVYLVERDERYLLTAKGFILNWIESAIPLDPKGL  130

Query: 125  VSRTIDTGIRCMSWLKVLIFLDYFGLITETKKIKLLTSLREQITYMRDYYREKDSLSNWG  184
            +RT+DTGIRC +W+K LI+L+ F  +T+ ++   +L SL +Q+ ++    Y +K SLSNWG
Sbjct: 131  ATRTLDTGIRCFAWVKCLIYLNLFNALTKQEESLILASLEKQLQFLHANYLDKYSLSNWG  190

Query: 185  ILQTTAILACLYYYEDELNLPEIQSFAEEELLLQIKLQILDDGSQYEQSIMYHVEVLKSL  244
            ILQTTAIL    Y+ +L++   +FA +EL  QI LQIL+DGSQ+EQS MYHVEVLK+L
Sbjct: 191  ILQTTAILLADAYFGSDLDIAAATAFARKELTQQIALQILEDGSQFEQSTMYHVEVLKAL  250

Query: 245  MELVILAPKYYLPLEETIEKMVTYLIAMTGPDYCQLAIGDSDVTDTRDILTLATLVLKSS  304
            +EL  L P Y  L  T+ M YL+ MTGPD+ Q+ +GDSDVTDTRDILTLA  +L+
Sbjct: 251  LELTALVPDYLPQLRPTLLAMSDYLLKMTGPDHKQIPLGDSDVTDTRDILTLAATILEEP  310

Query: 305  KTKSFSFDNVNLETLLLFGKPSIYLFEEIPRATIGESAYLFPDSGHVCLRDDRRYIFFKN  364
            K+ +F +++++LLL G+ ++    FE++P T+    A+ F   SGH+ +   + Y+FFKN
Sbjct: 311  HLKAAAFPTLDIDSLLLLGEKGVHTFEQLPVQTLPTFAHHFEHSGHITINQENYYLFFKN  370

Query: 365  GPFGSAHTHSDNNSVCLYDKKKPIFIDAGRYTYKEEQLRYDFKRSTSHSTCTLDGQPLEM  424
            GP GS+HTHSD NS+CLY K +P+F DAGRYTYKEE LRY  K ++ HST  L+ Q  E
Sbjct: 371  GPIGSSHTHSDQNSLCLYYKGQPLFCDAGRYTYKEEPLRYALKSAHHSTAFLEEQLPEQ   430

Query: 425  IKDSWTYNSYPKCDYCQLTSKDRYHLVEGQLHVQRAS-DIYYHKRWLLTLPQAITLVIDK  483
            I  SW Y SYPK +YC L    + +EG   Q +  +  +Y HKR+L LP     I L+ID
Sbjct: 431  IDSSWAYLSYPKSNYCHLRQNGHVYFIEGSYQTQFSDRNNYQHDRQILILPPGIFLIIDT  490

Query: 484  VSCPGEHVLTNQYILDDQVIYENGFVNDLKLVSPTTFNLEDCLISKRYNQLTESHKLVKK  543
            +    G H L +Q+ILD+ +     ++DL+L+S  F +E+  ++SK+YNQ  SHKL+K+
Sbjct: 491  IQAQGNHCLVSQFILDNHLDVKTDHLSDLRLISDCPFTIEETILSKKYNQYLTSHKLIKR  550

Query: 544  IKFVDEVMDYTLIVDRNCQVKYVPLVQTNSHKELSNSIAFDIRSQDFHYLIGVLMDDIIF  603
             +F  D+    TL+V  +V   +QT      ++++  ++  +   F Y I VL +D+I
Sbjct: 551  KPFKDKGCTSTLLVPDDTKVTPLTPLQTGKRNPIETALSWHLKGKQFDYSICVLQEDLIK  610

Query: 604  GDKLYLMQGIKCKGKVIVYDKNNGKMSRLKN                              634
            G+KL L+   K +GKV+V +   ++ RLK+
Sbjct: 611  GEKLVLLNSHKIRGKVVVINHITNEIIRLKH                              641
```

Based on this analysis, it was predicted that these proteins and their epitopes could be useful antigens for vaccines or diagnostics.

Example 769

A DNA sequence (GBSx0817) was identified in *S. agalactiae* <SEQ ID 2363> which encodes the amino acid sequence <SEQ ID 2364>. This protein is predicted to be RegR (kdgR). Analysis of this protein sequence reveals the following:

Possible site: 57
>>> Seems to have no N-terminal signal sequence
----- Final Results -----
   bacterial cytoplasm --- Certainty = 0.2545 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:CAB01925 GB:Z79691 RegR [Streptococcus pneumoniae]
Identities = 222/333 (66%), Positives = 279/333 (83%)
Query:   1  MSKKMTINDIAQLSKTSKTTVSFFLNQKFEKMSDETRQRIQEVIDETGYRPSTIARSLNS    60
            M KK+TI DIA++++TSKTTVSF+LN K+EKMS ETR++I++VI ET Y+PS +ARSLNS
Sbjct:   1  MEKKLTIKDIAEMAQTSKTTVSFYLNGKYEKMSQETREKIEKVIHETNYKPSIVARSLNS    60

Query:  61  KKTKLLGVLIGDITNTFSNQIVKGIEHITKQKGYQIIVGNSNYDAKSEEDYIENMLNLGV   120
            K+TKL+GVLIGDITN+FSNQIVKGIE I  Q GYQ+++GNSNY  +SE+ YIE+ML LGV
Sbjct:  61  KRTKLIGVLIGDITNSFSNQIVKGIEDIASQNGYQVMIGNSNYSQESEDRYIESMLLLGV   120

Query: 121  DGFIIQPTSNERKYSRILKEKKKPMVFFDSQLYEHKTSWVKANNYDAVYDMTQECLNRGY   180
            DGFIIQPTSNFRKYSRI+ EKKK MVFFDSQLYEH+TSWVK NNYDAVYDMTQ C+ +GY
Sbjct: 121  DGFIIQPTSNERKYSRIIDEKKKKMVFFDSQLYEHRTSWVKTNNYDAVYDMTQSCIEKGY   180

Query: 181  KKFIMITADTSLLSTRIERASGFMDALKDNGFGYDTLVIEDDDHSKSDIEDFLKAVVPDK   240
            + F++ITADTS LSTRIERASGF+DAL D    + +L IED  +    I++FL+   +
Sbjct: 181  EYFLLITADTSRLSTRIERASGFVDALTDANMRHASLTIEDKHTNLEQIKEFLQKEIDPD   240

Query: 241  EETLVFAPNCWALPMVETAMKNLNFDMPRVGLVGEDNIEWTDFSSPKVSTIVQPAYEEGE   300
            E+TLVF PNCWALP+VFT +K LN+++P+VGL+GFDN EWT FSSP VST+VQP++EEG+
Sbjct: 241  EKTLVFIPNCWALPLVFTVIKELNYNLPQVGLIGFDNTEWTCFSSPSVSTLVQPSFEEGQ   300

Query: 301  QVAQILINRIEGDDSVDNQQIVDCQMFWKESTF   333
            Q +ILI++IEG +  + QQ++DC + WKESTF
Sbjct: 301  QATKILIDQIEGRNQEERQQVLDCSVNWKESTF   333
```

A related DNA sequence was identified in *S. pyogenes* <SEQ ID 2365> which encodes the amino acid sequence <SEQ ID 2366>. Analysis of this protein sequence reveals the following:

```
Possible site: 45
>>> Seems to have no N-terminal signal sequence
----- Final Results -----
    bacterial cytoplasm --- Certainty = 0.2928 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

Based on this analysis, it was predicted that these proteins and their epitopes could be useful antigens for vaccines or diagnostics.

Example 770

A DNA sequence (GBSx0818) was identified in *S. agalactiae* <SEQ ID 2367> which encodes the amino acid sequence <SEQ ID 2368>. This protein is predicted to be polypeptide defromylase (def-1). Analysis of this protein sequence reveals the following:

```
Identities = 214/333 (64%), Positives = 266/333 (79%), Gaps = 2/333 (0%)
Query:   1  MSKKMTINDIAQLSKTSKTTVSFFLNQKFEKMSDETRQRIQEVIDETGYRPSTIARSLNS    60
            M +K+TI DIA+L+KTSKTTVSF+LN +F+KMS+ET+ RI E I   T Y+PS  ARSLN+
Sbjct:  13  MQRKVTIKDIAELAKTSKTTVSFYLNGRFDKMSEETKNRISESIKATNYKPSIAARSLNA    72

Query:  61  KKTKLLGVLIGDITNTFSNQIVKGIEHITKQKGYQIIVGNSNYDAKSEEDYIENMLNLGV   120
            K TKL+GV+IGDITN+FSNQIVKGIE   ++ GYQII+GNSNYD   E++ IE MLNLGV
Sbjct:  73  KSTKLIGVVIGDITNSFSNQIVKGIESKAQEFGYQIIIGNSNYDPSREDELIEKMLNLGV   132

Query: 121  DGFIIQPTSNFRKYSRILKEKKKPMVFFDSQLYEHKTSWVKANNYDAVYDMTQECLNRGY   180
            DGFIIQPTSNFRKYSRI+  KKK +VFFDSQLYEH+T+WVK NNYDAVYD  Q+C+++GY
Sbjct: 133  DGFIIQPTSNFRKYSRIIDIKKKKVVFFDSQLYEHRTNWVKTNNYDAVYDTIQQCIDKGY   192

Query: 181  KKFIMITADTSLLSTRIERASGFMDALKDNGFGYDTLVIEDDDHSKSDIEDFLKAVVPDK   240
            + FIMIT + +LLSTRIERASGF+D L+ N   + ++I+++  S   I  FL+  + K
Sbjct: 193  EHFIMITGNPNLLSTRIERASGFIDVLEANHLTHQEMIIDENQTSSEAIAQFLQGSLTKK   252

Query: 241  EETLVFAPNCWALPMVFTAMKNLNFDMPRVGLVGFDNIEWTDFSSPKVSTIVQPAYEEGE   300
               +LVF PNCWALP VFTAMK+L F++P +GLVGFDNIEWT FSSP ++TI+QPAYEEGE
Sbjct: 253  --SLVFVPNCWALPKVFTAMKSLKFNIPEIGLVGFDNIEWTKFSSPTLTTIIQPAYEEGE   310

Query: 301  QVAQILINRIEGDDSVDNQQIVDCQMFWKESTF   333
            Q +ILI+ IEG    QQI DCQ+ W+ESTF
Sblct: 311  QATKILIDDIEGHSQEAKQQIFDCQVNWQESTF   343
```

Possible site: 56
\>>> Seems to have no N-terminal signal sequence
----- Final Results -----
   bacterial cytoplasm --- Certainty = 0.2339 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:CAC15392 GB:AJ278785 polypeptide deformylase [Streptococcus pneumoniae]
Identities = 169/204 (82%), Positives = 192/204 (93%), Gaps = 1/204 (0%)
Query:   1  MSAIDKLVKASHLIDMNDIIREGNPTLRKVAEEVTFPLSEKEEILGEKMMQFLKHSQDPI    60
            MSAI+++ KA+HLIDMNDIIREGNPTLR +AEEVTFPLS++E ILGEKMMQFLKHSQDP+
Sbjct:   1  MSAIERITKAAHLIDMNDIIREGNPTLRAIAEEVTFPLSDQEIILGEKMMQFLKHSQDPV    60

Query:  61  MAEKLGLRGGVGLAAPQLDISKRIIAVLVPNVEDAQGNPPKEAYSLQEVMYNPKVVSHSV   120
            MAEK+GLRGGVGLAAPQLDISKRIIAVLVPN+ + +G  P+EAY L+ +MYNPK+VSHSV
Sbjct:  61  MAEKMGLAGGVGLAAPQLDISKRIIAVLVPNIVE-EGETPQEAYDLEAIMYNPKIVSHSV   119

Query: 121  QDAALSDGEGCLSVDREVPGYVVRHARVTIEYFDKTGEKHRLKLKGYNSIVVQHEIDHID   180
            QDAAL +GEGCLSVDR VPGYVVRHARVT++YFDK GEKHR+KLKGYNSIVVQHEIDHI+
Sbjct: 120  QDAALGEGEGCLSVDRNVPGYVVRHARVTVDYFDKDGEKHRIKLKGYNSIVVQHEIDHIN   179

Query: 181  GIMFYDRINEKNPFAVKEGLLILE                                      204
            GIMFYDRINEK+PFAVK+GLLILE
Sbjct: 180  GIMFYDRINEKDPFAVKDGLLILE                                      203
```

A related DNA sequence was identified in *S. pyogenes* <SEQ ID 2369> which encodes the amino acid sequence <SEQ ID 2370>. Analysis of this protein sequence reveals the following:

Possible site: 56
\>>> Seems to have no N-terminal signal sequence
----- Final Results -----
   bacterial cytoplasm --- Certainty = 0.1745 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 160/204 (78%), Positives = 186/204 (90%)
Query:   1  MSAIDKLVEASHLIDMNDIIREGNPTLRKVAEEVTFPLSEKEEILGEKMMQFLKHSQDPI    60
            MSA DKL+K SHLI M+DIIREGNPTLR VA+EV+ PL +++ +LGEKMMQFLKHSQDP+
Sbjct:   1  MSAQDKLIKPSHLITMDDIIREGNPTLRAVAKEVSLPLCDEDILLGEKMMQFLKHSQDPV    60

Query:  61  MAEKLGLRGGVGLAAPQLDISKRIIAVLVPNVEDAQGNPPKEAYSLQEVMYNPKVVSHSV   120
            MAEKLGLR GVGLAAPQ+D+SKRIIAVLVPN+ D +GNPPKEAYS QEV+YNPK+VSHSV
Sbjct:  61  MAEKLGLRAGVGLAAPQIDVSKRIIAVLVPNLPDKEGNPPKEAYSWQEVLYNPKIVSHSV   120

Query: 121  QDAALSDGEGCLSVDREVPGYVVRHARVTIEYFDKTGEKHRLKLKGYNSIVVQHEIDHID   180
            QDAALSDGEGCLSVDR V GYVVRHARVT++Y+DK G++HR+KLKGYN+IVVQHEIDHI+
Sbjct: 121  QDAALSDGEGCLSVDRVVEGYVVRHARVTVDYYDKEGQQHRIKLKGYNAIVVQHEIDHIN   180

Query: 181  GIMFYDRINEKNPFAVKEGLLILE                                      204
            G++FYDRIN KNPF  KE LLIL+
Sbjct: 181  GVLFYDRINAKNPFETKEELLILD                                      204
```

Based on this analysis, it was predicted that these proteins and their epitopes could be useful antigens for vaccines or diagnostics.

Example 771

A DNA sequence (GBSx0819) was identified in *S. agalactiae* <SEQ ID 2371> which encodes the amino acid sequence <SEQ ID 2372>. Analysis of this protein sequence reveals the following:

Possible site: 46
\>>> Seems to have no N-terminal signal sequence
----- Final Results -----
   bacterial cytoplasm --- Certainty = 0.3620 (Affirmative) <succ>
   bacterial membrane --- Certainty = 0.0000 (Not Clear) <succ>
   bacterial outside --- Certainty = 0.0000 (Not Clear) <succ>

A related GBS nucleic acid sequence <SEQ ID 10177> which encodes amino acid sequence <SEQ ID 10178> was also identified.

The protein has homology with the following sequences in the GENPEPT database.

```
>GP:AAC75224 GB:AE000305 putative transcriptional regulator [Escherichia coli K12]
Identities = 58/191 (30%), Positives = 98/191 (50%)
Query:  37   DLQVITLTAGQSVCKQGEQLEYLHYIVKGRFKIVRRLFNGKEHILDIKTKPTLIGDIELL    96
             D ++    A   + ++G+Q  +L Y+ +GR ++    L NG+   ++D     P   IG+IEL+
Sbjct:  17   DTRLFHFLARDYIVQEGQQPSWLFYLTRGRARLYATLANGRVSLIDFFAAPCFIGEIELI    76

Query:  97   TNRQIVSSVIALEDLTVIQLSLKGRKEKLLTDATFLLKLSQELAQAFHDQNIKASTNLGY   156
                 +V A+E+    + L +K   +  LL D   FL KL    L+    +     +  + N  +
Sbjct:  77   DKDHEPRAVQAIEECWCLALPMKHYRPLLLNDTLFLRKLCVTLSHKNYRNIVSLTQNQSF   136

Query: 157   TVKELLASHILAIEEQGYFQLELSSLADSFGVSYRHLLRVIHDMVKEGLIQKEKPKYFIK   216
                +    LA+ IL   +E   +   + +   A+    GVSYRHLL  V+     +  +GL+  K K    Y IK
Sbjct: 137   PLVNRLAAFILLSQEGDLYHEKHTQAAEYLGVSYRHLLYVLAQFIHDGLLIKSKKGYLIK   196

Query: 217   NRFALESLNIQ                                                  227
             NR    L    L ++
Sbjct: 197   NRKQLSGLALE                                                  207
```

A related DNA sequence was identified in *S. pyogenes* <SEQ ID 2373> which encodes the amino acid sequence <SEQ ID 2374>. Analysis of this protein sequence reveals the following:

Possible site: 27
>>> Seems to have no N-terminal signal sequence
----- Final Results -----
   bacterial cytoplasm --- Certainty = 0.3809 (Affirmative) <succ>
    bacterial membrane --- Certainty = 0.0000 (Not Clear) <succ>
     bacterial outside --- Certainty = 0.0000 (Not Clear) <succ>

An alignment of the GAS and GBS proteins is shown below.

```
Identities = 23/63 (36%), Positives = 35/63 (55%), Gaps = 1/63 (1%)
Query: 146   QNIKASTNLGYTVKELLASHILAIEEQGYFQLELSSLADSFGVSYRHLLRVIHDMVKEGL   205
             QN+      N+  YTVKE  AS+ L    +      L  L+  LA+ FG S  RHL   V+      +  + +
Sbjct:   3   QNV-CQQNITYTVKERFASYTLEAQANQEVHLNLTLLANRFGTSDRHLKHVLKQPIFQRI    61

Query: 206   IQK                                                          208
             I++
Sbjct:  62   IER                                                           64
```

Based on this analysis, it was predicted that these proteins and their epitopes could be useful antigens for vaccines or diagnostics.

Example 772

A DNA sequence (GBSx0820) was identified in *S. agalactiae* <SEQ ID 2375> which encodes the amino acid sequence <SEQ ID 2376>. Analysis of this protein sequence reveals the following:

Possible site: 54
>>> Seems to have a cleavable N-term signal seq.
INTEGRAL    Likelihood = −9.24    Transmembrane 163-179 (159-185)
INTEGRAL    Likelihood = −8.49    Transmembrane 204-220 (201-226)
INTEGRAL    Likelihood = −7.80    Transmembrane 272-288 (269-296)
INTEGRAL    Likelihood = −6.00    Transmembrane 333-349 (331-352)
INTEGRAL    Likelihood = −5.41    Transmembrane 75-91 (73-92)
INTEGRAL    Likelihood = −4.94    Transmembrane 245- 261 (240-262)
INTEGRAL    Likelihood = −4.41    Transmembrane 362-378 (359-380)
INTEGRAL    Likelihood = −4.14    Transmembrane 96-112 (95-113)
INTEGRAL    Likelihood = −2.44    Transmembrane 141-157 (141-158)
INTEGRAL    Likelihood = −1.81    Transmembrane 302-318 (301-320)

-continued

----- Final Results -----
   bacterial membrane --- Certainty = 0.4694 (Affirmative) <succ>
    bacterial outside --- Certainty = 0.0000 (Not Clear) <succ>
     bacterial cytoplasm --- Certainty = 0.0000 (Not Clear) <succ>

A related GBS nucleic acid sequence <SEQ ID 8659> which encodes amino acid sequence <SEQ ID 8660> was also identified. Analysis of this protein sequence reveals the following:

Lipop: Possible site: −1    Crend: 7
McG: Discrim Score: −3.52
GvH: Signal Score (−7.5): 0.340001
Possible site: 25
>>> Seems to have no N-terminal signal sequence
ALOM program count: 11    value: −9.24    threshold: 0.0
INTEGRAL    Likelihood = −9.24    Transmembrane 134-150 (130-156)
INTEGRAL    Likelihood = −8.60    Transmembrane 17-33 (13-37)
INTEGRAL    Likelihood = −8.49    Transmembrane 175-191 (172-197)
INTEGRAL    Likelihood = −7.80    Transmembrane 243-259 (240-267)
INTEGRAL    Likelihood = −6.00    Transmembrane 304-320 (302-323)
INTEGRAL    Likelihood = −5.41    Transmembrane 46-62 (44-63)
INTEGRAL    Likelihood = −4.94    Transmembrane 216-232 (211-233)
INTEGRAL    Likelihood = −4.41    Transmembrane 333-349 (330-351)
INTEGRAL    Likelihood = −4.14    Transmembrane 67-83 (66-84)
INTEGRAL    Likelihood = −2.44    Transmembrane 112-128 (112-129)
INTEGRAL    Likelihood = −1.81    Transmembrane 273-289 (272-291)
PERIPHERAL    Likelihood = 3.45    193
modified ALOM score: 2.35
*** Reasoning Step: 3
----- Final Results -----
   bacterial membrane --- Certainty = 0.4694 (Affirmative) <succ>
    bacterial outside --- Certainty = 0.0000 (Not Clear) <succ>
     bacterial cytoplasm --- Certainty = 0.0000 (Not Clear) <succ>

The protein has homology with the following sequences in the GENPEPT database.

```
>GP:CAB50057 GB:AJ248286 TRANSPORT PROTEIN, permease [Pyrococcus abyssi]
Identities = 94/382 (24%), Positives = 173/382 (44%), Gaps = 30/382 (7%)
Query:   5  MEKLSLLSL-SLILLSTFSTSPALPQMISYY-RDKGLPSPQVELLFSIPSMAIIFILLIT    62
            MEKL +L L SL + +S   A+P +     +D G+ + ++ LL +   +    I +
Sbjct:   1  MEKLIILILISLGWIFNYSHRMAVPSLAPIIMKDLGINNAEIGLLMTSLLLPYSLIQVPA    60

Query:  63  PWLSKKLSEKHMIIFGLLLTALGGGLPVVSQNYLLVFVSRLLLGSGIGFINTRAISVISE   122
            ++   K+ K ++   +L  +L     L V++++Y +    R L G G       A ++ISE
Sbjct:  61  GYIGDKIGRKKLLTISILGYSLSSALIVLTRDYWDLVTVRALYGFFAGLYYAPATALISE   120

Query: 123  YYQGKERRKLLGLRGSFEVLGNA---GLTAL--VGLLLTFGWSKSFMIYFLALPILVLYL   177
            ++ ++   L       F ++G A   G+T L  V + LT  W  +F++ +  I+ + L
Sbjct: 121  LFRERKGSAL-----GFFMVGPAIGSGITPLIVVPVALTLSWRYAFLVLSIMSSIVGILL   175

Query: 178  VFAPKKVVYDTNDKIKTKGQKIPKADLTYIVALAILAGFVITINTGINLRIPLLVVEFGL   237
             + A K   +   +  IK +G K       ++++LA  G    +   +  LV   G+
Sbjct: 176  MVAIK------GEPIKVEGVKFKIPRGVFLLSLANFLGLGAFFAM-LTFLVSYLVSR-GV   227

Query: 238  GTPAQASLVLSAMMLMGIIAGMSFGQLIAMFHKQLIPICLVLFS-LTLLGVGLPSNLMVL   296
            G  +ASL+ S + L+GI+ +   G L      K + + L   S LT L + +PS L ++
Sbjct: 228  GME-KASLMFSMLSLVGILGSIIAGFLYDHLGKVSVLLAYALNSLLTFLVIVIPSPLFLI   286

Query: 297  TISAMASGFLYSL--MVTAVFSLVADRVEYSLVGSATTLVLVF-CNIGGASAAILLSCFD   353
             +  +       LYS+ ++TA  S A R    +V       +V F   IG       L+
Sbjct: 287  PLGLV----LYSVGGIMTAYTSEKASRENLGVVMGFVNMVGFFGATIGPYIVGFLIDRLG   342

Query: 354  HLLGQINAVFYVYAILSLAVGM                                        375
            + L   +V   Y  + ++ +G+
Sbjct: 343  YSLALL-SVPLAYLVSAVIIGL                                        363
```

There is also homology to SEQ ID 2378.

Based on this analysis, it was predicted that these proteins and their epitopes could be useful antigens for vaccines or diagnostics.

Possible site: 23
>>> Seems to have no N-terminal signal sequence
INTEGRAL    Likelihood = −1.38    Transmembrane 171-187 (171-187)
----- Final Results -----
  bacterial membrane --- Certainty = 0.1553 (Affirmative) <succ>
  bacterial outside --- Certainty = 0.0000 (Not Clear) <succ>
  bacterial cytoplasm --- Certainty = 0.0000 (Not Clear) <succ>

Example 773

A DNA sequence (GBSx0821) was identified in *S. agalactiae* <SEQ ID 2379> which encodes the amino acid sequence <SEQ ID 2380>. Analysis of this protein sequence reveals the following:

The protein has homology with the following sequences in the GENPEPT database.

```
>GP:CAB61731 GB:AL133220 putative oxidoreductase. [Streptomyces coelicolor A3(2)]
Identities = 101/327 (30%), Positives = 169/327 (50%), Gaps = 12/327 (3%)
Query:   8  WATLGTGVIANEL-AQALEARGQKLYSVANRTYDKGLEFATKYGIQKVYDHIDQVFEDPE    66
            W  L TG +A    A     ++   +VA+RT      FA ++GI + Y  +   D +
Sbjct:  11  WGILATGGMAARFTADLVDLPDAEVVAVASRTEASAKTFAERFGIPRAYGGWETLARDED    70

Query:  67  VDIIYISTPHNTHISFLRKALANGKHVLCEKSITLNSTELKEAIDLAETNHVVLAEAMTI   126
            VD++Y++TPH+ H + L        G++VLCEK  TLN+ E   E + LA  N V L EAM +
Sbjct:  71  VDVVYVATPHSAHRTAAGLCLEAGRNVLCEKPFTLNAREAAELVALARENGVFLMEAMWM   130

Query: 127  FHMPIYRQLKTLVDSGKLGPLKMIQMNFGSYKEYDMTNRFFSRDLAGGALLDIGVYALSC   186
            + P+ R+LK LV  G +G ++ +Q +FG    +R         GGALLD+GVY +S
Sbjct: 131  YCNPLVRRLKELVADGAIGEVRSLQADFGLAGPFPAAHRLRDPAQGGGALLDLGVYPVSF   190

Query: 187  IRWFMSEAPHNITSQVTFAPTGVDEQVGILLTNPANEMATVSLSLHAKQPKRATIAYDKG   246
            +  +  E P  +++   +   GVD Q G  LL+   +A++  S+    P   A+I   +G
Sbjct: 191  AQLLLGE-PTDVAARAVLSEEGVDLQTGALLSYGNDALASIHCSITGGTPNBASITGSEG   249

Query: 247  YIEL---FEYPRGQKAVITYTEDGHQDIL--EAGKTENALQYEVADMEEAV-SGKTNH--   298
              I++   F +P  V+  T     Q+  A     +L++E ++ A+ +G+T
Sbjct: 250  RIDVPNGFFFP--DHFVLHRTGRDPQEFRADPADGPRESLRHEAEEVMRALRAGETESPL   307

Query: 299  MYLNYTKDVMDIMTQLRQEWGFTYPEE                                   325
            + L+ T   VM +   +R    G Y P E
Sbjct: 308  VPLDGTLAVMRTLDAIRDRVGVRYPGE                                   334
```

Example 774

A DNA sequence (GBSx0822) was identified in *S. agalactiae* <SEQ ID 2381> which encodes the amino acid sequence <SEQ ID 2382>. This protein is predicted to be oligopeptidase. Analysis of this protein sequence reveals the following:

Possible site: 19
>>> Seems to have no N-terminal signal sequence
----- Final Results -----
  bacterial cytoplasm --- Certainty = 0.2881 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

Based on this analysis, it was predicted that this protein and its epitopes, could be useful antigens for vaccines or diagnostics.

A related DNA sequence was identified in *S. pyogenes* <SEQ ID 2383> which encodes the amino acid sequence <SEQ ID 2384>. Analysis of this protein sequence reveals the following:

Possible site: 51
>>> Seems to have no N-terminal signal sequence
----- Final Results -----
  bacterial cytoplasm --- Certainty = 0.2622 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

```
>GP:CAC14579 GB:AJ249396 oligopeptidase [Streptococcus thermophilus]
Identities = 504/631 (79%), Positives = 563/631 (88%)
Query:   1  MIKYQDDFYQAVNGEWAKTAVIPDDKPRTGGFSDLADDIEALMLSTTDKWLADENKPSDT   60
            M + QDDFY A+NGEW KTAVIPDDKP TGGFSDLAD+IE LML TTD+WLA EN P +
Sbjct:   1  MTRLQDDFYHAINGEWEKTAVIPDDKPCTGGFSDLADEIEDLMLETTDQWLAGENVPDNA  60

Query:  61  ILNHFIAFHKMTADYQKREEVGVSPVLPLIEEYKGLQSFSEFASKVAEYELEGKPNEFPF  120
            IL +FI FH+MTADY +RE VG+ PV PLIEEYK L SFSEFASK+AEYE+ GKPNEFPF
Sbjct:  61  ILQNFIKFHRMTADYDRREAVGIEPVKPLIEEYKKLSSFSEFASKIAEYEMSGKPNEFPF  120

Query: 121  GVAPDFMNAQLNVLWAEAPGIILPDTTYYSEDNEKGKELLAFWRKSQEDLLPLFGLSEQE  180
               V+PDFMNAQLNVLWA+APGIILPDTTYY+EDNEKGKELL  WR+ QE+LL  +G + +E
Sbjct: 121  SVSPDFMNAQLNVLWADAPGIILPDTTYYTEDNEKGKELLEIWREMQEELLGKYGFTAEE  180

Query: 181  IKDILDKVLALDAKLAQYVLSREESSEYVKLYHPYNWEDFTKLAPELPLDAIFQKILGQK  240
            IKD+LDKV+ LDAKLA+YVLS EESSEYV+LYHPY+W DFTKLAPELPLD+IF +ILGQ
Sbjct: 181  IKDLLDKVIDLDAKLAKYVLSHEESSEYVELYHPYDWADFTKLAPELPLDSIFTEILGQV  240

Query: 241  PDKVIVPEERFWTEFASDYYSESNWELLKADLILSAANAYNAYLTDDIRIKSGVYSRALS  300
            PDKVIV EE FWTEFA++YYSE+NWELLKA L++ A  ++NAYLTD++R+ SG YSRALS
Sbjct: 241  PDKVIVSEESFWTEFAAEYYSEANWELLKAVLLIDATTSWNAYLTDELRVLSGKYSRALS  300

Query: 301  GTPQAMDKKKAAYYLASGPYNQALGLWYAGEKFSPEAKADVEHKIATMIDVYKSRLEKAD  360
            GTPQAMDKKKAA+YLA GPYNQALGLWYAGEKFSPEAKADVE K+ATMIDVYKSRL+ AD
Sbjct: 301  GTPQAMDKKKAAFYLAQGPYNQALGLWYAGEKFSPEAKADVEAKVATMIDVYKSRLQTAD  360

Query: 361  WLAQSTREKAIMKLNVITPHIGYPEKLPETYTKKIIDPKLSLVENATNLDKISIAYGWSK  420
            WLA  TREKAI KLNVITPHIGYPEKLPETY KKIID  LSLVENA  L +ISIA+ WSK
Sbjct: 361  WLAPETREKAITKLNVITPHIGYPEKLPETYDKKIIDENLSLVENAQKLVEISIAHSWSK  420

Query: 421  WNKPVDRSEWHMPAHMVNAYYDPQQNQIVFPAAILQEPFYALEQSSSANYGGIGAVIAHE  480
            WNKPVDRSEWHMPAHMVNAYYDPQQNQIVFPAAILQ PFY + QSSSANYGGIGAVIAHE
Sbjct: 421  WNKPVDRSEWHMPAHMVNAYYDPQQNQIVFPAAILQAPFYDIAQSSSANYGGIGAVIAHE  480

Query: 481  ISHAFDTNGASFDEHGSLNNWWTDEDFEAFKKLTDKVVEQFDGLESYGAKVNGKLTVSEN  540
            ISHAFDTNGASFDE+GSL NWWT++D+ AFK+ TDK+V+QF+GL+SYGAKVNGKLTVSEN
Sbjct: 481  ISHAFDTNGASFDENGSLKNWWTEDDYAAFKERTDKIVDQFEGLDSYGAKVNGKLTVSEN  540

Query: 541  VADLGGVACALEAAQRESDFSARDFFINFATIWRMKARDEYMQMLASVDVHAPAQWRTNI  600
            VADLGGVACALEAA+R+ DFS R+FFINFATIWR KAR+EYMQMLASVDVHAPA+WRTN+
Sbjct: 541  VADLGGVACALEAAKRDEDFSVREFFINFATIWRTKAREEYMQMLASVDVHAPAKWRTNV  600

Query: 601  TVTNFEEFHKEFDVKDGDNMWRPVEKRVIIW                              631
             VTNF+EFHKEFDVK+GD MWR  E RVIIW
Sbjct: 601  IVTNFDEFHKEFDVKEGDGMWRAPEDRVIIW                              631
```

Endopeptidases are often exposed antigens.

```
Identities = 504/631 (79%), Positives = 564/631 (88%)
Query:   1   MIKYQDDFYQAVNGEWAKTAVIPDDKPRTGGFSDLADDIEALMLSTTDKWLADENKPSDT    60
             M  YQDDFYQAVNG+WA+TAVIPDDKPRTGGFSDLAD+IEALML TTD WLA EN P D
Sbjct:   1   MTTYQDDFYQAVNGKWAETAVIPDDKPRTGGFSDLADEIEALMLDTTDAWLAGENIPDDA    60

Query:  61   ILNHFIAFHKMTADYQKREEVGVSPVLPLIEEYKGLQSFSEFASKVAEYELEGKPNEFPF   120
             IL +F+ FH++ ADY KR+EVGVSP+LPLIEEY+ L+SFSEF + +A+YEL G PNEFPF
Sbjct:  61   ILKNFVKFHRLVADYAKRDEVGVSPILPLIEEYQSLKSFSEFVANIAKYELAGLPNEFPF   120

Query: 121   GVAPDFMNAQLNVLWAEAPGIILPDTTYYSEDNEKGKELLAFWRKSQEDLLPLFGLSEQE   180
              VAPDFMNAQLNVLWAEAP I+LPDTTYY E NEK +EL   WR+SQE LLP FG S +E
Sbjct: 121   SVAPDFMNAQLNVLWAEAPSILLPDTTYYEEGNEKAEELRGIWRQSQEKLLPQFGFSTEE   180

Query: 181   IKDILDKVLALDAKLAQYVLSREESSEYVKLYHPYNWEDFTKLAPELPLDAIFQKILGQK   240
             IKD+LDKV+LD  +LA+YVLSREE SEY KLYHPY W DF KLAPELPLD+IF+KILGQ
Sbjct: 181   IKDLLDKVIELDKQLAKYVLSREEGSEYAKLYHPYVWADFKKLAPELPLDSIFEKILGQV   240

Query: 241   PDKVIVPEERFWTEFASDYYSESNWELLKADLILSAANAYNAYLTDDIRIKSGVYSRALS   300
             PDKVIVPEERFWTEFA+ YYSE+NW+LLKA+LI+ AANAYNAYLTDDIR++SG YSRALS
Sbjct: 241   PDKVIVPEERFWTEFAATYYSEANWDLLKANLIVDAANAYNAYLTDDIRVESGAYSRALS   300

Query: 301   GTPQAMDKKKAAYYLASGPYNQALGLWYAGEKFSPEAKADVEHKIATMIDVYKSRLEKAD   360
             GTPQAMDK+KAA+YLA GP++QALGLWYAG+KFSPEAKADVE K+A MI+VYKSRLE AD
Sbjct: 301   GTPQAMDKQKAAFYLAQGPFSQALGLWYAGQKFSPEAKADVESKVARMIEVYKSRLETAD   360

Query: 361   WLAQSTREKAIMKLNVITPHIGYPEKLPETYTKKIIDPKLSLVENATNLDKISIAYGWSK   420
             WLA +TREKAI KLNVITPHIGYPEKLPETY KK+ID   LSLVENA NL KI+IA+ WSK
Sbjct: 361   WLAPATREKAITKLNVITPHIGYPEKLPETYAKKVIDESLSLVENAQNLAKITIAHTWSK   420

Query: 421   WNKPVDRSEWHMPAHMVNAYYDPQQNQIVFPAAILQEPFYALEQSSSANYGGIGAVIAHE   480
             WNKPVDRSEWHMPAH+VNAYYD QQNQIVFPAAILQEPFY+L+QSSSANYGGIGAVIAHE
Sbjct: 421   WNKPVDRSEWHMPAHLVNAYYDLQQNQIVFPAAILQEPFYSLDQSSSANYGGIGAVIAHE   480

Query: 481   ISHAFDTNGASFDEHGSLNNWWTDEDFEAFKKLTDKVVEQFDGLESYGAKVNGKLTVSEN   540
             ISHAFDTNGASFDEHGSLN+WWT ED+ AFK+ TDK+V QFDGLES+GAKVNGKLTVSEN
Sbjct: 481   ISHAFDTNGASFDEHGSLNDWWTQEDYAAFKERTDKIVAQFDGLESHGAKVNGKLTVSEN   540

Query: 541   VADLGGVACALEAAQRESDFSARDFFINFATIWRMKARDEYMQMLASVDVHAPAQWRTNI   600
             VADLGGVACALEAAQ E DFSARDFFINFATIWRMKAR+EYMQMLAS+DVHAP + RTN+
Sbjct: 541   VADLGGVACALEAAQSEEDFSARDFFINFATIWRMKAREEYMQMLASIDVHAPGELRTNV   600

Query: 601   TVTNFEEFHKEFDVKDGDNMWRPVEKRVIIW                               631
             T+TNF+ FH+ FD+K+GD MWR +  RVIIW
Sbjct: 601   TLTNFDAFHETFDIKEGDAMWRAPKDRVIIW                               631
```

SEQ ID 2382 (GBS193) was expressed in *E. coli* as a His-fusion product. SDS-PAGE analysis of total cell extract is shown in FIG. 23 (lane 3; MW 73 kDa).

The GBS193-His fusion product was purified (FIG. 196, lane 5) and used to immunise mice. The resulting antiserum was used for Western blot (FIG. 253). These tests confirm that the protein is immunoaccessible on GBS bacteria.

Based on this analysis, it was predicted that these proteins and their epitopes could be useful antigens for vaccines or diagnostics.

Example 775

A DNA sequence (GBSx0823) was identified in *S. agalactiae* <SEQ ID 2385> which encodes the amino acid sequence <SEQ ID 2386>. This protein is predicted to be immunity protein (mccF-1). Analysis of this protein sequence reveals the following:

Possible site: 36
>>> Seems to have no N-terminal signal sequence
----- Final Results -----
bacterial cytoplasm --- Certainty = 0.1627 (Affirmative) <succ>
bacterial membrane --- Certainty = 0.0000 (Not Clear) <succ>
bacterial outside --- Certainty = 0.0000 (Not Clear) <succ>

A related GBS nucleic acid sequence <SEQ ID 9433> which encodes amino acid sequence <SEQ ID 9434> was also identified.

The protein has homology with the following sequences in the GENPEPT database.

```
>GP:AAB84435 GB:AF027868 YocD [Bacillus subtilis]
Identities = 114/270 (42%), Positives = 170/270 (62%), Gaps = 4/270 (1%)
Query:   1   MSFSKHYLENDILYSASITSRVEDLHEAFADPSVDAILATIGGFNSNELLPYLDYDLISK    60
             ++ ++H  E +   S+SI SRV DLH AF DP V AIL T+GGFNSN+LL YLDY+ I +
Sbjct:  43   VTIAEHANECNEFDSSSIESRVHDLHAAFFDPGVKAILTTLGGFNSNQLLRYLDYEKIKR   102

Query:  61   NPKIICGYSDSTAFLNAIFAKAKIQTYMGPAYSSFKMKEGQPYQTQAWLT-AMTENHYEL   119
             +PKI+CGYSD TA  NAI+ K + TY GP +S+F MK+G Y +   +L+   +++ +E+
Sbjct: 103   HPKILCGYSDITALCNAIYQKTGLVTYSGPHFSTFAMKKGLDYTEEYFLSCCASDDPFEI   162

Query: 120   WPSEEWSSDPWYDPSKPRQFFPTEWK-IYNHGKASGTIIGGNLSTFGLLRGTPYAPKIER   178
                PS EWS D W+   + R+F+P     +   G A GT+IGGNL T  LL+GT Y P+ E
Sbjct: 163   HPSSEWSDDRWFLDQENRRFYPNNGPVVIQEGYAEGTLIGGNLCTLNLLQGTEYFPETEH   222
```

```
Query:  179  YVLLIEEAEESNFYEFDRNLAAI--LQAYPHPQAILMGRFPKECGMTPQVFEYILSKHAI   236
             +LLIE+   S+ + FDR+L ++   L A+ H +AIL+GRF K    ++  + + ++
Sbjct:  223  TILLIEDDYMSDIHMFDRDLQSLIHLPAFSHVKAILIGRFQKASNVSIDLVKAMIETKKE   282

Query:  237  FKEIPVIYDMDFAHTQPLLTVTIGAELSVD                                266
             IP+I +++  HT P+ T  IG    ++
Sbjct:  283  LSGIPIIANINAGHTSPIATFPIGGTCRIE                                312
```

A related DNA sequence was identified in *S. pyogenes* <SEQ ID 2387> which encodes the amino acid sequence <SEQ ID 2388>. Analysis of this protein sequence reveals the following:

---

Possible site: 42
>>> Seems to have no N-terminal signal sequence
----- Final Results -----
    bacterial cytoplasm --- Certainty = 0.1162 (Affirmative) <succ>
      bacterial membrane --- Certainty = 0.0000 (Not Clear) <succ>
        bacterial outside --- Certainty = 0.0000 (Not Clear) <succ>

---

An alignment of the GAS and GBS proteins is shown below.

```
Identities = 75/252 (29%), Positives = 125/252 (48%), Gaps = 22/252 (8%)
Query:   34  VDAILATIGGFNSNELLPYLDYDLISKNPKIICGYSDSTAFLNAIFAKAKIQTYMGPAYS    93
             VD I+ +IGG+NSN +L Y+DYDL  +    I  GYSD+TA   A++ K    TY+  +
Sbjct:    1  VDVIMTSIGGYNSNSVLKYIDYDLFKQKFPIFIGYSDTTALALALYKKTGCITYLSQSVI    60

Query:   94  SFKMKEGQP----------YQTQAWLTAMTENHYELWPSEEWSSDPWYDPSKPRQFFPTE   143
             S      E +P          + Q+    +      ++W ++EW +  W    + +     E
Sbjct:   61  S-NFGEFEPFNELNYFYFDFMLQSKCETLMVQIPDVW-TDEWIN--WETYERTKKTNKNE   116

Query:  144  WKIYNHGKASGTIIGGNLSTFGLLRGTPYAPKIERYVLLIEEAEESNFYEFDRNLA--AI   201
             W I+N G+ +GT+IGGNL T   + GT Y PKI     +L+ E    ++    RN    A+
Sbjct:  117  WIIFNKGEFNGTLIGGNLDTIVGIIGTEYMPKITEDTILLLEDVYTDLGRLYRNFTTLAL   176

Query:  202  LQAYPHPQAILMGRFPKECGMTPQVFEYILSKHAIFKEIPVIYDMDFAHTQPLLTVTIGA   261
             +         +++ +F +  G     V   I+++     ++IP++ + D  HT P   + IG
Sbjct:  177  HGIFDKIGGLIISKF-ETIGENSDVINDIINEFVGHRKIPILLNFDCGHTHPSCLMPIGG   235

Query:  262  ELSVDTTTLSLS                                                  273
             ++        TLSLS
Sbjct:  236  KI-----TLSLS                                                  242
```

Based on this analysis, it was predicted that these proteins and their epitopes could be useful antigens for vaccines or diagnostics.

Example 776

A DNA sequence (GBSx0824) was identified in *S. agalactiae* <SEQ ID 2389> which encodes the amino acid sequence <SEQ ID 2390>. Analysis of this protein sequence reveals the following:

--- possible site: 15
>>> Seems to have no N-terminal signal sequence
----- Final Results -----
    bacterial cytoplasm --- Certainty = 0.3112 (Affirmative) <succ>
      bacterial membrane --- Certainty = 0.0000 (Not Clear) <succ>
        bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 777

A DNA sequence (GBSx0825) was identified in *S. agalactiae* <SEQ ID 2391> which encodes the amino acid sequence <SEQ ID 2392>. Analysis of this protein sequence reveals the following:

---

Possible site: 21
>>> Seems to have no N-terminal signal sequence
----- Final Results -----
    bacterial cytoplasm --- Certainty = 0.6171 (Affirmative) <succ>
      bacterial membrane --- Certainty = 0.0000 (Not Clear) <succ>
        bacterial outside --- Certainty = 0.0000 (Not Clear) <succ>

---

A related GBS nucleic acid sequence <SEQ ID 10175> which encodes amino acid sequence <SEQ ID 10176> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

Example 778

A DNA sequence (GBSx0826) was identified in *S. agalactiae* <SEQ ID 2393> which encodes the amino acid sequence <SEQ ID 2394>. Analysis of this protein sequence reveals the following:

Possible site: 19
>>> Seems to have an uncleavable N-term signal seq
INTEGRAL   Likelihood = −10.19   Transmembrane 83-99 (80-113)
INTEGRAL   Likelihood = −9.71    Transmembrane 4-20 (1-24)
INTEGRAL   Likelihood = −9.45    Transmembrane 315-331 (307-337)
INTEGRAL   Likelihood = −8.33    Transmembrane 186-202 (180-210)
INTEGRAL   Likelihood = −7.75    Transmembrane 233-249 (227-255)
INTEGRAL   Likelihood = −3.98    Transmembrane 390-406 (382-407)
INTEGRAL   Likelihood = −3.61    Transmembrane 27-43 (27-45)
INTEGRAL   Likelihood = −3.29    Transmembrane 107-123 (105-125)
INTEGRAL   Likelihood = −1.75    Transmembrane 273-289 (273-290)
----- Final Results -----
   bacterial membrane --- Certainty = 0.5076 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database.

```
>GP:CAB15347 GB:Z99121 similar to hypothetical proteins [Bacillus subtilis]
Identities = 174/524 (33%), Positives = 275/524 (52%), Gaps = 13/524(2%)
Query: 1   MEETILIVSFLLFLILSNVINRIFPKLPLPFIQLVFGILSGLVFHKSQVHIDPELFLAFV    60
           M+  ++++  L   + +SN++NR  P +P+P IQ+  GIL+         ++ ELF
Sbjct: 1   MDIFLVVLVLLTIIAISNIVNRFIPFIPVPLIQVALGILAASFPQGLHFELNTELFFVLF    60

Query: 61  IAPLNFREGQESDIGSFIKYRAIILYLILPTVFLTAIVVGYVAGHLLPVSLPLAACFALG   120
           IAPL F +G+ +         RA IL L L  VF T IV GY    ++P ++PLAA F L
Sbjct: 61  IAPLLFNDGKRTPRAELWNLRAPILLLALGLVFATVIVGGYTIHWMIP-AIPLAAAFGLA   119

Query: 121 AALGPTDAVAFISIAKRFQFPKRAENILKLEGLLNDASGLVSFQFALTALVTGYFSLAKA   180
              A L PTD VA  +++ R + PK     +L+ EGL+NDASGLV+F+FA+A  VTG FSLA+A
Sbjct: 120 AILSPTDVVAVSALSGRVKMPKGILRLLEGEGLMNDASGLVAFKFAIAAAVTGAFSLAQA   179

Query: 181 SLKLALAIMGGFLIGLLFAFLMRLCLTVLEKFDAADVTGALLLELTLPFVAYFVADLLGF   240
              ++       +GG L G++ +FL+      L +    DVT  +L+++  PFV  Y  A+ +G
Sbjct: 180 AVSFVFISLGGLLCGVVISFLIIRFRLFLRRLGMQDVTMHMLIQILTPFVIYLAAEEIGV   239

Query: 241 SAIIAVVVAGVMQANRLKKVTLFDAQVDRVTSVIWETLNFILNGLVFLIFGRELTRIIGP   300
             S  I+AVV  G+  A    ++      ++  V+S  W  +   FILNGLVF+I G ++    +I
Sbjct: 240 SGILAVVAGGITHAVEQDRLESTMIKLQIVSSSTWNIILFILNGLVFVILGTQIPDVISV   299

Query: 301 LLTSNAYSNFDLISIVVLVTCTLFLVRFLAVSCFY--AWRSFKYHKSFKKYWREIQLLTF   358
           +      A SN  +I  ++++T TL L+RFL V   F+     W   K +K      R    L++
Sbjct: 300 IFNDTAISNMKVIGYILVITFTLMLLRFLWVLFFWNGKWFFNKDQNIYKPGLRSILLISI   359

Query: 359 SGVKGSVSIATILLLPKHSVIGE--LGYSLILFTVGAVTLMSFLTGLLVLPKLAPPLQVK   416
             SGV+G+V++A     +P   G         +LILF V    L + +   +VLP L        +
Sbjct: 360 SGVRGAVTLAGSFSIPYFLEDGTPFPERNLILFLAAGVILCTLVIATVVLPILTEKEEED   419

Query: 417 DD-----YLIRLSILTKVLSVLEEDGKSSENQASFYAVIDNYNSRIRHLILEQ--ESSDI   469
             ++       R  ++    L  ++ED    +    AS    AVI   YN  ++++L  +Q    S+  I
Sbjct: 420 EERNKKLLTARRKLIKTALQTIKEDMNETNKTASL-AVIAEYNEKMKNLRFQQYTSSNRI   478

Query: 470 KKDLAELQLMMLSIESDGLEAAYRYGNISIKEYRIYQRYLKYLE                  513
            KK    +++  +  + E + L        G+I +    + Q     LE
Sbjct: 479 KKHERKVRAQGVKAEQEALMKMLERGDIPEETANVLQERFNELE                  522
```

No corresponding DNA sequence was identified in S. pyogenes.

Based on this analysis, it was predicted that this protein and its epitopes, could be useful antigens for vaccines or diagnostics.

Example 779

A DNA sequence (GBSx0827) was identified in S. agalactiae <SEQ ID 2395> which encodes the amino acid sequence <SEQ ID 2396>. Analysis of this protein sequence reveals the following:

Possible site: 23
>>> Seems to have no N-terminal signal sequence

----- Final Results -----
   bacterial cytoplasm --- Certainty = 0.3494 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 780

A DNA sequence (GBSx0828) was identified in S. agalactiae <SEQ ID 2397> which encodes the amino acid sequence <SEQ ID 2398>. This protein is predicted to be integrase (phage-relatedpr). Analysis of this protein sequence reveals the following:

Possible site: 61
>>> Seems to have no N-terminal signal sequence
----- Final Results -----
   bacterial cytoplasm --- Certainty = 0.5094 (Affirmative) <succ>
   bacterial membrane --- Certainty = 0.0000 (Not Clear) <succ>
   bacterial outside --- Certainty = 0.0000 (Not Clear) <succ>

A related GBS nucleic acid sequence <SEQ ID 10173> which encodes amino acid sequence <SEQ ID 10174> was also identified.

The protein has homology with the following sequences in the GENPEPT database.

```
>GP:AAF12706 GB:AF066865 integrase [bacteriophage TPW2]
Identities = 171/353 (48%), Positives = 253/353 (71%), Gaps = 1/353 (0%)
Query:  21 MASYRKRENGLWEYRISYKTIDGKYKRKEKGGFKTKKLAQAAAIEIEKKLTQNILTNDEV   80
           MA++RKR    W++R+SYK   +G+YK+ EKGG+KTKK A+AAA E +K+L  +   ++++
Sbjct:   1 MANFRKRGK-TWQFRLSYKDNNGEYKKFEKGGYKTKKEAEAAADEAKKRLNNHSEFDNDI   59

Query:  81 TLYDFVKTWSEVYKRPYVKDKTWETYSKNFKHIKNYFQELKVKDITPLYYQKKLNEFGEK  140
           +LYDF + W++VYK+P+V + TW TY +     I  Y ++  + +ITP +YQ  LN+
Sbjct:  60 SLYDFFEKWAKVYKKPHVTEATWRTYKRTLNLIDKYIKDKPIAEITPTFYQAVLNKMSLL  119

Query: 141 YAQETLEKFHYQIKGAMKVAVREQVVTFNFAEGAKVKSQVEPKNEEEDFLEEREYKALLA  200
           Y QE+L+KF++QIK AMK+AV E+V++ NFA+  K KS++  +   EE +L   EY   LLA
Sbjct: 120 YRQESLDKFYFQIKSAMKIAVHEKVISENFADFTKAKSKLAARPVEEKYLHADEYLKLLA  179

Query: 201 LTRENIQYVSYFTLYLLAVTGLRFSEAMGLTWSDIDFKNGILDINKSFDYSNTQDFADLK  260
            +   E ++Y SYF  YL AVTG+RF+E +GLTWS +DF   + I +++DYS T +FA+ K
Sbjct: 180 IAEEKMEYTSYFACYLTAVTGMRFAELLGLTWSHVDFDKKEISIQRTWDYSITNNFAETK  239

Query: 261 NESSKRKVPIDSNTIDILREYKKNHWQANIKNRVCFGVSNSACNKLIKKIVGRKVRNHSL  320
           NESSKRK+PI S TI +L++YKK +W  N  +RV + +SN+  NK IK I GRKV  HSL
Sbjct: 240 NESSKRKIPISSKTIKLLKKYKKEYWHENKYDRVIYNLSNNGLNKTIKVIAGRKVHPHSL  299

Query: 321 RHTYASFLILNGVDIVTISKLLGHESPDITLKVYTHQMEALAERNFEKIKNIF         373
           RH++AS+LI  G+D++T+SKLLGHE+ ++TLKVY HQ++ + + N + I+ IF
Sbjct: 300 RHSFASYLIYKGIDLLTVSKLLGHENLNVTLKVYAHQLKEMEQENNDVIRKIF         352
```

There is also homology to SEQ ID 578.

Based on this analysis, it was predicted that these proteins and their epitopes could be useful antigens for vaccines or diagnostics.

Example 781

A DNA sequence (GBSx0829) was identified in *S. agalactiae* <SEQ ID 2399> which encodes the amino acid sequence <SEQ ID 2400>. Analysis of this protein sequence reveals the following:

---

Possible site: 56
>>> Seems to have no N-terminal signal sequence
----- Final Results -----
   bacterial cytoplasm --- Certainty = 0.3377 (Affirmative) <succ>
     bacterial membrane --- Certainty = 0.0000 (Not Clear) <succ>
       bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 782

A DNA sequence (GBSx0830) was identified in *S. agalactiae* <SEQ ID 2401> which encodes the amino acid sequence <SEQ ID 2402>. This protein is predicted to be homology to cI-like repressor. Analysis of this protein sequence reveals the following:

---

Possible site: 28
>>> Seems to have no N-terminal signal sequence
----- Final Results -----
   bacterial cytoplasm --- Certainty = 0.0827 (Affirmative) <succ>
     bacterial membrane --- Certainty = 0.0000 (Not Clear) <succ>
       bacterial outside --- Certainty = 0.0000 (Not Clear) <succ>

---

The protein has homology with the following sequences in the GENPEPT database.

```
>GP:AAD44097 GB:AF115103 orf122 gp [Streptococcus thermophilus
bacteriophage Sfi21]
Identities = 57/125 (45%), Positives = 77/125 (61%), Gaps = 5/125 (4%)
Query:   3 MKLDQLCKEFGVELCLFDASDWHSSGFYNPITKVLGVDVNLSEQEQKQVALHELQHKNHF    62
           M    +L ++FGV LC F +S W    GF +P+ +V+ ++  +L  + + +V LHEL H   H
Sbjct:   1 MNESELLEQFGVSLCEFSSSQWTRDGFLDPVNRVVYINRDLPTERRLKVLLHELGHLEHD    60

Query:  63 PYQYQLFRERCELDANRNMIHHLLKEELEIAEDHTQFNYLVFMEKYKLKTIADEAMIKEE   122
           P QY+  RE+  E  ANRNMIH LLK       E+   FNY+ FMEKY L TI DE  +K E
Sbjct:  61 PKQYERLREKYEAQANRNMIHELLKN-----ENLDNFNYVHFMEKYNLTTICDETFVKNE   115

Query: 123 YLNLV                                                          127
           YL L+
Sbjct: 116 YLKLI                                                          120
```

No corresponding DNA sequence was identified in *S. pyogenes*.

Based on this analysis, it was predicted that this protein and its epitopes, could be useful antigens for vaccines or diagnostics.

Example 783

A DNA sequence (GBSx0831) was identified in *S. agalactiae* <SEQ ID 2403> which encodes the amino acid sequence <SEQ ID 2404>. This protein is predicted to be EpsR protein. Analysis of this protein sequence reveals the following:

Possible site: 37
>>> Seems to have no N-terminal signalsequence
----- Final Results -----
   bacterial cytoplasm --- Certainty = 0.4692 (Affirmative) <succ>
      bacterial membrane --- Certainty = 0.0000 (Not Clear) <succ>
         bacterial outside --- Certainty = 0.0000 (Not Clear) <succ>

The protein has homology with the following sequences in the GENPEPT database.

```
>GP:AAF12710 GB:AF066865 repressor protein [bacteriophage TPW22]
Identities = 36/101 (35%), Positives = 62/101 (60%), Gaps = 7/101 (6%)
Query:  4   LIDRIRELSNKKGMSLNDLEDTLGYSRNSLYSLNE-NSKMGKPKEIAQYFNVSLDYLLGL   62
            L ++I+EL+++K +S+  +E+ LG++  ++    + N  + K K++A+YFNVS+D+LLGL
Sbjct:  3   LYEKIKELASQKNVSIRQVEEKLGFANGTIRQWGKKNPGINKVKDVAKYFNVSVDFLLGL   62

Query: 63   TDNPRIAS--DETAIIDGQVVDLREAAARTMLFDGKPLDED                    101
            DN R    D    +D  V+ E +    FDGKPL ++
Sbjct: 63   DDNQRKKEPVDLADFVDDNKVNWDEWVS----FDGKPLSDE                    99
```

Based on this analysis, it was predicted that this protein and its epitopes, could be useful antigens for vaccines or diagnostics.

Example 784

A DNA sequence (GBSx0832) was identified in *S. agalactiae* <SEQ ID 2405> which encodes the amino acid sequence <SEQ ID 2406>. Analysis of this protein sequence reveals the following:

Possible site: 43
>>> Seems to have no N-terminal signal sequence
----- Final Results -----
   bacterial cytoplasm --- Certainty = 0.4079 (Affirmative) <succ>
      bacterial membrane --- Certainty = 0.0000 (Not Clear) <succ>
         bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 785

A DNA sequence (GBSx0833) was identified in *S. agalactiae* <SEQ ID 2407> which encodes the amino acid sequence <SEQ ID 2408>. Analysis of this protein sequence reveals the following:

Possible site: 52
>>> Seems to have no N-terminal signal sequence
----- Final Results -----
   bacterial cytoplasm --- Certainty = 0.2942 (Affirmative) <succ>
      bacterial membrane --- Certainty = 0.0000 (Not Clear) <succ>
         bacterial outside --- Certainty = 0.0000 (Not Clear) <succ>

A related GBS nucleic acid sequence <SEQ ID 10171> which encodes amino acid sequence <SEQ ID 10172> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

Example 786

A DNA sequence (GBSx0834) was identified in *S. agalactiae* <SEQ ID 2409> which encodes the amino acid sequence <SEQ ID 2410>. This protein is predicted to be a replication initiation protein Rep (RC). Analysis of this protein sequence reveals the following:

Possible site: 54
>>> Seems to have no N-terminal signal sequence
----- Final Results -----
   bacterial cytoplasm --- Certainty = 0.3335 (Affirmative) <succ>
      bacterial membrane --- Certainty = 0.0000 (Not Clear) <succ>
         bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 787

A DNA sequence (GBSx0835) was identified in *S. agalactiae* <SEQ ID 2411> which encodes the amino acid sequence <SEQ ID 2412>. This protein is predicted to be antirepressor. Analysis of this protein sequence reveals the following:

Possible site: 40
>>> Seems to have no N-terminal signal sequence
----- Final Results -----
   bacterial cytoplasm --- Certainty = 0.3380 (Affirmative) <succ>
      bacterial membrane --- Certainty = 0.0000 (Not Clear) <succ>
         bacterial outside --- Certainty = 0.0000 (Not Clear) <succ>

The protein has homology with the following sequences in the GENPEPT database.

```
>GP:BAA97816 GB:AB044554 antirepressor [Staphylococcus aureus prophage phiPV83]
Identities = 70/153 (45%), Positives = 93/153 (60%), Gaps = 15/153 (9%)
Query:   3    EIFVFHGQEVRTVTINNEPWFVGKDVADILGYSKSRNAIALHVDEDDALKQGITDNLGRM      62
              + F F      VRTV I NEP+FVGKD+A+ILGY+++ NAI  HVD +D L    + + G+
Sbjct:   5    QTFNFKELPVRTVEIENEPYFVGKDIAEILGYARTDNAIRNHVDSEDKLTHQFSAS-GQN     63

Query:  63    QETIIINESGLYSLIL----SSKLPQVKE----FKRWVTSEVLPQIRQQGAYVPENLSDE    114
              +  IIINESGLYSLI      SK   +++E    FKRWVTS+VLP IR+ G Y  +N+ ++
Sbjct:  64    RNMIIINESGLYSLIFDASKQSKNEKIRETARKFKRWVTSDVLPAIRKHGIYATDNVIEQ    123

Query: 115    A------FIALFTGQKKLKEHQLALAQDVDYLK                                141
                      I + T  KK KE  L L Q V+ K
Sbjct: 124    TLKDPDYIITVLTEYKKEKEQNLVLQQQVEVNK                                156
```

A related DNA sequence was identified in *S. pyogenes* <SEQ ID 2413> which encodes the amino acid sequence <SEQ ID 2414>. Analysis of this protein sequence reveals the following:

Possible site: 17
>>> Seems to have no N-terminal signal sequence
----- Final Results -----
   bacterial cytoplasm --- Certainty = 0.4609 (Affirmative) <succ>
   bacterial membrane --- Certainty = 0.0000 (Not Clear) <succ>
   bacterial outside --- Certainty = 0.0000 (Not Clear) <succ>

Possible site: 58
>>> Seems to have no N-terminal signal sequence
----- Final Results -----
   bacterial cytoplasm --- Certainty = 0.3281 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

The protein has homology with the following sequences in the GENPEPT database.

```
Identities = 54/142 (38%), Positives = 73/142 (51%), Gaps = 7/142 (4%)
Query:  11    EVRTVTINNEPWFVGKDVADILGYSKSRNAIALHVDEDDALKQGITDNLGRMQETIIINE     70
              EVRT TINN+ +F  D   IL  S R I   +++D      I D+LGR Q+    INE
Sbjct:  13    EVRTATINNQIYFNLNDCCQILELSNPRKTIE-RLNKDGVTTSDIIDSLGRTQQANFINE    71

Query:  71    SGLYSLILSSKLPQVKEFKRWVTSEVLPQIRQQGAYVPENLSDEA------FIALFTGQK    124
              S   Y L+   S+ P+ ++F  WVTSEVLP IR+ GAY+ E    ++A       I L   K
Sbjct:  72    SNFYKLVFQSRKPEAEKFADWVTSEVLPSIRKHGAYMTEQTLEQALTSPDFLIRLANELK    131

Query: 125    KLKEHQLALAQDVDYLKNEQPI                                          146
              + KE L     +    L E +
Sbjct: 132    EEKERSRQLEAEKSILSVENMV                                          153
```

Based on this analysis, it was predicted that these proteins and their epitopes could be useful antigens for vaccines or diagnostics.

Example 788

A DNA sequence (GBSx0836) was identified in *S. agalactiae* <SEQ ID 2415> which encodes the amino acid sequence <SEQ ID 2416>. This protein is predicted to be ell. Analysis of this protein sequence reveals the following:

```
>GP:AAC27227 GB:AF009630 ell [bacteriophage bIL170]
Identities = 66/161 (40%), Positives = 93/161 (56%), Gaps = 13/161 (8%)
Query:  15    YQVSNLGRVRSIGRTVNAKQRTRKTKGRILKQSL-SSGYAIVTLSVNGLRKSIRVHRLVA     73
              Y+VSNLG+VR+I            GRILK  + +GY +  L N  +K++ +HR++A
Sbjct:  16    YEVSNLGKVRNI------------KSGRILKPWIVPNGYLMHQLCENNKKKNLFLHRIIA     63

Query:  74    EAFIPNPINKRTINHIDENKLNNRVDNLEWATDKENANHGNRTTKSSLGRCKPVEQFTLE    133
                 AFI NP  K  +NHIDENKLNN ++NLEW T KEN  HG R  + +     K V Q  L
Sbjct:  64    TAFIDNPEEKPQVNHIDENKLNNDLNNLEWCTVKENNIHGTRMKRIAEKHFKKVIQLDLN    123

Query: 134    GEFINTFDSIKSASMKTGISSQRITATAMGHQKQTHGYKWR                        174
                 +N F+S+  A  +TG+S +  I++    G +K      +KWR
Sbjct: 124    DNVLNEFESMVQAEQETGVSRRNISSCCNGKRKSAGRFKWR                        164
```

Example 789

A DNA sequence (GBSx0837) was identified in *S. agalactiae* <SEQ ID 2417> which encodes the amino acid sequence <SEQ ID 2418>. Analysis of this protein sequence reveals the following:

Possible site: 21
>>> Seems to have no N-terminal signal sequence
----- Final Results -----
  bacterial cytoplasm --- Certainty = 0.2357 (Affirmative) <succ>
    bacterial membrane --- Certainty = 0.0000 (Not Clear) <succ>
      bacterial outside --- Certainty = 0.0000 (Not Clear) <succ>

A related GBS nucleic acid sequence <SEQ ID 10169> which encodes amino acid sequence <SEQ ID 10170> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

Example 790

A DNA sequence (GBSx0838) was identified in *S. agalactiae* <SEQ ID 2419> which encodes the amino acid sequence <SEQ ID 2420>. Analysis of this protein sequence reveals the following:

Possible site: 57
>>> Seems to have an uncleavable N-term signal seq
INTEGRAL     Likelihood = −5.47     Transmembrane 21-37 (19-38)
----- Final Results -----
  bacterial membrane--- Certainty = 0.3187 (Affirmative) <succ>
    bacterial outside--- Certainty = 0.0000 (Not Clear) <succ>
      bacterial cytoplasm--- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 791

A DNA sequence (GBSx0839) was identified in *S. agalactiae* <SEQ ID 2421> which encodes the amino acid sequence <SEQ ID 2422>. This protein is predicted to be DNA polymerase III delta prime subunit (dnaB). Analysis of this protein sequence reveals the following:

Possible site: 55
>>> Seems to have no N-terminal signal sequence
----- Final Results -----
  bacterial cytoplasm --- Certainty = 0.0544 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database.

```
AAF98347 AF280763 DNA polymerase III delta prime subunit [Streptococcus pyogenes]
Identities = 284/444 (63%), Positives = 357/444 (79%), Gaps = 4/444 (0%)
Query:   3   ELKVLPHDIQAEQSVLGSIFIKPEKMIEVAEYLKPNDFYRPAHKILFKAMVSLADRGEAI    62
             EL+V P D+ AEQSVLGSIFI P+K+I V E++ P+DFY+ AHKI+F+AM++L+DR +AI
Sbjct:   8   ELRVQPQDLLAEQSVLGSIFISPDKLIAVREFISPDDFYKYAHKIIFRAMITLSDRNDAI    67

Query:  63   DIVTIKSTLESTDELGMVGGISYIAEIVNAVPTSSHAEHYAKIVAKKAQLRSIIDNLSDS   122
             D  TI++ L+  D+L  +GG+SYI E+VN+VPTS++AE+YAKIVA+KA LR II  L++S
Sbjct:  68   DATTIRTILDDQDDLQSIGGLSYIVELVNSVPTSANAEYYAKIVAEKAMLRDIIARLTES   127

Query: 123   IGNAYDEDMDIDEIIAKAERSLIEVSQASNKSSFRPIHDVLLENHSKIEERSENTSQITG   182
             +  AYDE +  +E+IA  ER+LIE+++ SN+S FR I DVL  N+  +E RS  TS +TG
Sbjct: 128   VNLAYDEILKPEEVIAGVERALIELNEHSNRSGFRKISDVLKVNYEALEARSKQTSNVTG   187

Query: 183   IETGFYDFDKLITGLHEDQLIVLAARPAMGKTALALNIAQNVATKSNKAVAVFSLEMGAE   242
             + TGF D DK+ TGLH DQL++LAARPA+GKTA  LNIAQNV TK  K VA+FSLEMGAE
Sbjct: 188   LPTGFRDLDKITTGLHPDQLVILAARPAVGKTAFVLNIAQNVGTKQKKTVAIFSLEMGAE   247

Query: 243   SLVERMLSAEGTIINHHIRTGNLTVNEWQRLIYAQGQLAEAPIFIDDTAGVKITDIRARA   302
             SLV+RML+AEG + +H +RTG LT  +W  +  AQG LAEAPI+IDDT G+KIT+IRAR+
Sbjct: 248   SLVDRMLAAEGMVDSHSLRTGQLTDQDWNNVTIAQGALAEAPIYIDDTPGIKITEIRARS   307

Query: 303   RRLSQETD-GLGLIVIDYLQLIQGSRSDNRQQEVSEISRQLKIIAKELKVPVIALSQLSR   361
             R+LSQE D GLGLIVIDYLQLI G++ +NRQQEVS+ISRQLKI+AKELKVPVIALSQLSR
```

```
-continued
Sbjct: 308  RKLSQEVDGGLGLIVIDYLQLITGTKPENRQQEVSDISRQLKILAKELKVPVIALSQLSR  367

Query: 362  GVEQRNDKRPIMSDLRESGSIEQDADIVAFLYRDAYYQ---DKKEGQPENDITELIIRKN  418
            GVEQR DKRP++SD+RESGSIEQDADIVAFLYRD YY+   D  E    E++ E+I+ KN
Sbjct: 368  GVEQRQDKRPVLSDIRESGSIEQDADIVAFLYRDDYYRKECDDAEENVEDNTIEVILEKN  427

Query: 419  RHGNLGTVKLYFHKEYTKFSSVEE                                     442
            R G  GTVKL F KEY KFSS+ +
Sbjct: 428  RAGARGTVKLMFQKEYNKFSSIAQ                                     451
```

There is also homology to SEQ ID 2424:

```
Identities = 284/444 (63%), Positives = 357/444 (79%), Gaps = 4/444 (0%)
Query:   3  ELKVLPHDIQAEQSVLGSIFIKPEKMIEVAEYLKPNDFYRPAHKILFKAMVSLADRGEAI   62
            EL+V P D+ AEQSVLGSIFI P+K+I V E++ P+DFY+ AHKI+F+AM++L+DR +AI
Sbjct:  11  ELRVQPQDLLAEQSVLGSIFISPDKLIAVREFISPDDFYKYAHKIIFRAMITLSDRNDAI   70

Query:  63  DIVTIKSTLESTDELGMVGGISYIAEIVNAVPTSSHAEHYAKIVAKKAQLRSIIDNLSDS  122
            D TI++ L+  D+L  +GG+SYI E+VN+VPTS++AE+YAKIVA+KA LR II   L++S
Sbjct:  71  DATTIRTILDDQDDLQSIGGLSYIVELVNSVPTSANAEYYAKIVAEKAMLRDIIARLTES  130

Query: 123  IGNAYDEDMDIDEIIAKAERSLIEVSQASNKSSFRPIHDVLLENHSKIEERSNNTSQITG  182
            +  AYDE +  +E+IA  ER+LIE+++ SN+S FR I DVL  N+  +E RSTS   +TG
Sbjct: 131  VNLAYDEILKPEEVIAGVERALIELNEHSNRSGFRKISDVLKVNYEALEARSKQTSNVTG  190

Query: 183  IETGFYDFDKLITGLHEDQLIVAARPAMGKTALALNIAQNVATKSNKAVAVFSLEMGAE  242
             + TGF D DK+ TGLH  QL++LAARPA+GKTA  LNIAQNV TK  K VA+FSLEMGAE
Sbjct: 191  LPTGFRDLDKITTGLHPDQLVILAARPAVGKTAFVLNIAQNVGTKQKKTVAIFSLEMGAE  250

Query: 243  SLVERMLSAEGTIINHHIRTGNLTVNEWQRLIYAQGQLAEAPIFIDDTAGVKITDIRARA  302
            SLV+RML+AEG + +H +RTG LT  +W  +  AQG LAEAPI+IDDT G+KIT+IRAR+
Sbjct: 251  SLVDRMLAAEGMVDSHSLRTGQLTDQDWNNVTIAQGALAEAPIYIDDTPGIKITEIRARS  310

Query: 303  RRLSQETD-GLGLIVIDYLQLIQGSRSDNRQQEVSEISRQLKIIAKELKVPVIALSQLSR  361
            R+LSQE D GLGLIVIDYLQLI G++ +NRQQEVS+ISRQLKI+AKELKVPVIALSQLSR
Sbjct: 311  RKLSQEVDGGLGLIVIDYLQLITGTKPENRQQEVSDISRQLKILAKELKVPVIALSQLSR  370

Query: 362  GVEQRNDKRPIMSDLRESGSIEQDADIVAFLYRDAYYQ---DKKEGQPENDITELIIRKN  418
            GVEQR DKRP++SD+RESGSIEQDADIVAFLYRD YY+   D  E    E++ E+I+ KN
Sbjct: 371  GVEQRQDKRPVLSDIRESGSIEQDADIVAFLYRDDYYRKECDDAEEAVEDNTIEVILEKN  430

Query: 419  RHGNLGTVKLYFHKEYTKFSSVEE                                     442
            R G  GTVKL F KEY KFSS+ +
Sbjcti 431  RAGARGTVKLMFQKEYNKFSSIAQ                                     454
```

Based on this analysis, it was predicted that this protein and its epitopes, could be useful antigens for vaccines or diagnostics.

Example 792

A DNA sequence (GBSx0840) was identified in *S. agalactiae* <SEQ ID 2425> which encodes the amino acid sequence <SEQ ID 2426>. Analysis of this protein sequence reveals the following:

Possible site: 19
>>> Seems to have no N-terminal signal sequence
----- Final Results -----
   bacterial cytoplasm --- Certainty = 0.2146 (Affirmative) <succ>
   bacterial membrane --- Certainty = 0.0000 (Not Clear) <succ>
   bacterial outside --- Certainty = 0.0000 (Not Clear) <succ>

A related GBS nucleic acid sequence <SEQ ID 10167> which encodes amino acid sequence <SEQ ID 10168> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 793

A DNA sequence (GBSx0841) was identified in *S. agalactiae* <SEQ ID 2427> which encodes the amino acid sequence <SEQ ID 2428>. Analysis of this protein sequence reveals the following:

Possible site: 15
>>> Seems to have no N-terminal signal sequence
----- Final Results -----
   bacterial cytoplasm --- Certainty = 0.2774 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 794

A DNA sequence (GBSx0842) was identified in *S. agalactiae* <SEQ ID 2429> which encodes the amino acid sequence <SEQ ID 2430>. Analysis of this protein sequence reveals the following:

```
Possible site: 28
>>> Seems to have no N-terminal signal sequence
INTEGRAL    Likelihood = -1.91    Transmembrane 63-79 (62-79)
----- Final Results -----
    bacterial membrane --- Certainty = 0.1765 (Affirmative) <succ>
        bacterial outside --- Certainty = 0.0000 (Not Clear) <succ>
            bacterial cytoplasm --- Certainty = 0.0000 (Not Clear) <succ>
```

A related GBS nucleic acid sequence <SEQ ID 8661> which encodes amino acid sequence <SEQ ID 8662> was also identified. Analysis of this protein sequence reveals the following:

```
Lipop: Possible site: -1 Crend: 10
McG: Discrim Score: -11.31
GvH: Signal Score (-7.5): -1.86
Possible site: 28
>>> Seems to have no N-terminal signal sequence
ALOM program count: 1 value: -1.91 threshold: 0.0
INTEGRAL Likelihood = -1.91 Transmembrane 61-77 (60-77)
PERIPHERAL Likelihood = 9.92 19
modified ALOM score: 0.88
*** Reasoning Step: 3
-----Final Results-----
bacterial membrane --- Certainty = 0.1765 (Affirmative) <succ>
bacterial outside --- Certainty = 0.0000 (Not Clear) <succ>
bacterial cytoplasm ---Certainty = 0.0000 (Not Clear) <succ>
```

The protein has homology with the following sequences in the GENPEPT database.

```
>GP:AAB18686 GB:U38906 ORF11 [Bacteriophage rlt]
Identities = 101/249 (40%), Positives = 157/249 (62%), Gaps, 21/249 (8%)
Query: 3    MAQRRMESRKITETDRFLEMPLSSQALYFHLNMGADDEGFIDKAKTIQRTIGASDDDMKL    62
            MAQRRM  ++   +T +FL +PL +QALYFHL + ADD+G ++ A  + R +GA++D + L
Sbjct: 1    MAQRRMIDKRTIQTQKFLRLPLETQALYFHLMLNADDDGVVE-AFPVVRMVGAAEDSLGL    59

Query: 63   LIAKGFLIPFDSGVV-VIRHWRIHNYIQSDRFQSTLYQSEKAQLEYDKSKTASLKPIGNC   121
            L+ K F+ P +  +V  I ++   N I+ DR++++ Y    AQL  ++    ++P  N
Sbjct: 60   LVVKQFIKPLNEEMVYFIIDFKEQNTIKKDRYKASKY----AQLLTNEEFGTEMEPKRNQ   115

Query: 122  IQNVSKMETQVRLSKGSLDKDSLTTYPTVSDNEEEDIPYKEIISYLNEKANRNYRPNIQK   181
            +    K    RL K  LDK++       +S   ++ IPY EI+ YLN+K  R++R N++
Sbjct: 116  LGTSDKN----RLDKNRLDKNN-----NMSGKPDDVIPYSEILEYLNKKTGRSFR-NVEA   165

Query: 182  NKTLIKARWSEGFRLDDFKHVIDTTVKDWSGTKY-----EKYLRPETLFGSKFEGYLNQA   236
            NK LIKARW+EG++L+DFK V+D   V +WSG  +      E YL+P+TLF +KF+ YLNQ
Sbjct: 166  NKKLIKARWNEGYKLEDFKTVVDNMVSNWSGKMFNGVPAENYLQPKTLFSNKFDSYLNQV   225

Query: 237  PRIKTETID                                                    245
            PRI+ + I+
Sbjct: 226  PRIEQKEIN                                                    234
```

No corresponding DNA sequence was identified in *S. pyogenes*.

SEQ ID 8662 (GBS344) was expressed in *E. coli* as a His-fusion product. SDS-PAGE analysis of total cell extract is shown in FIG. 72 (lane 12; MW 30.9 kDa). It was also expressed in *E. coli* as a GST-fusion product. SDS-PAGE analysis of total cell extract is shown in FIG. 81 (lane 3; MW 59 kDa).

Figure 213:
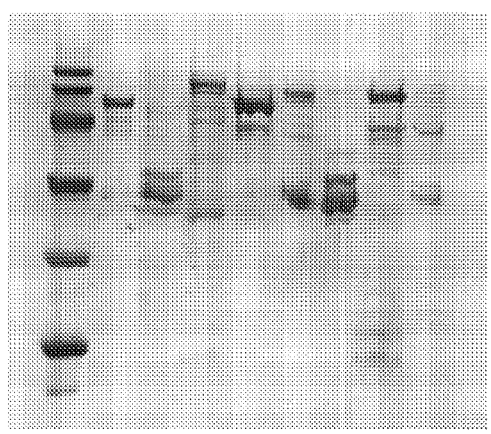
Figure 271:
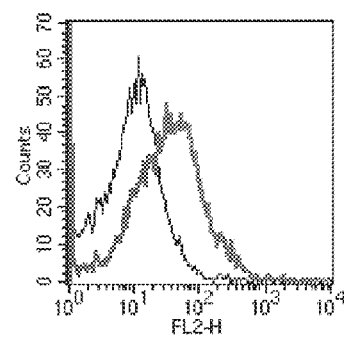

The GBS344-GST fusion product was purified (FIG. 213, (lane 3; FIG. 226, lanes 4-6) and used to immunise mice. The resulting antiserum was used for FACS (FIG. 271), which confirmed that the protein is immunoaccessible on GBS bacteria.

Based on this analysis, it was predicted that these proteins and their epitopes could be useful antigens for vaccines or diagnostics.

Example 795

A DNA sequence (GBSx0843) was identified in *S. agalactiae* <SEQ ID 2431> which encodes the amino acid sequence <SEQ ID 2432>. Analysis of this protein sequence reveals the following:

```
Possible site: 47
>>> Seems to have no N-terminal signal sequence
----- Final Results -----
```

-continued

```
bacterial cytoplasm --- Certainty = 0.2549 (Affirmative) <succ>
    bacterial membrane --- Certainty = 0.0000 (Not Clear) <succ>
        bacterial outside --- Certainty = 0.0000 (Not Clear) <succ>
```

The protein has homology with the following sequences in the GENPEPT database:

```
>GP:AAG31329 GB:AF182207 ORF 272 [Bacteriophage mv4]
Identities = 70/241 (29%), Positives = 125/241 (5196), Gaps = 30/241 (12%)
Query: 12   VLEETCEVHGCQLWLTKVPIKGRLEELKQCPECTKAAINIFENKLNSQSKINSKLADTYA      71
            VLE+ C  HG  L +T    +G E++  CP+C   A+ + + + +++   S +A
Sbjct: 16   VLEQKCSKHGLNL-ITYKNHEG--EQVTCCPQCQAEALEVLQERFDQKAR-QSIIARK--     69

Query: 72   VFERDSLVSDKLRAKSLENYE---------IKDEIDQHAINYAKRMEQFYRQDRTGNAII    122
            F  +SL + K+   + + +E         IK ++   A+ +A +     +       A++
Sbjct: 70   -FRENSLANSKMWKCTFDTFEAQPGSAEELIKGQVRNAAVAFATKPVAHH-------AVL    121

Query: 123  TGPSGVGKSHLTYGLAKFMNEQFKAYESPKSVLFISLVSLFTKIKESFKVDNGY-RQADM    181
               G  G GKSHL     A M ++   +  K++ FI++  LF+KIK SF    + Y  +
Sbjct: 122  YGQPGAGKSHL----AMAMMQEIHKHRPTKTMAFINISRLFSKIKNSFDDPSEYWTKEKA    177

Query: 182  IELLTRVDYLFLDDLGKESRKGDS--QNNEWTHQILYEILDNRSNTIINTNLSSKEIKALY    240
            +E++  VD L +DDLG ES  G +  + +W   ++Y++L+N    II TNLS +E+K  +Y
Sbjct: 178  LEIMRGVDLLCIDDLGTESSMGRTGQEATKWAQDVIYDVLENQDRIIITTNLSERELKRVY    238
```

No corresponding DNA sequence was identified in *S. pyogenes*.

Based on this analysis, it was predicted that this protein and its epitopes, could be useful antigens for vaccines or diagnostics.

Possible site: 47
>>> Seems to have no N-terminal signal sequence
----- Final Results -----
    bacterial cytoplasm --- Certainty = 0.1241 (Affirmative) <succ>
    bacterial membrane --- Certainty = 0.0000 (Not Clear) <succ>
    bacterial outside --- Certainty = 0.0000 (Not Clear) <succ>

Example 796

A DNA sequence (GBSx0844) was identified in *S. agalactiae* <SEQ ID 2433> which encodes the amino acid sequence <SEQ ID 2434>. This protein is predicted to be methyl transferase. Analysis of this protein sequence reveals the following:

A related GBS nucleic acid sequence <SEQ ID 10165> which encodes amino acid sequence <SEQ ID 10166> was also identified.

The protein has homology with the following sequences in the GENPEPT database.

```
>GP:AAC98421 GB:L29323 methyl transferase [Streptococcus pneumoniae]
Identities = 262/474 (55%), Positives = 313/474 (65%), Gaps = 71/474 (14%)
Query: 2    MKFLDLFAGIGGFRLGMEQAGHECIGFCEINKFARASYKVIHDTEGEIELHDITRVSD-E     60
            M+F+DLF+GIGGFRLGME  GHECIGFCEI+KFAR SYK I  TEGEIE HDI  VSD E
Sbjct: 1    MRFIDLFSGIGGFRLGMESVGHECIGFCEIDKFARESYKSIFQTEGEIEFHDIRDVSDDE     60

Query: 61   FIRGIGSVDVICGGFPCQAFSIAGNRRGFEDTRGTLFFEIARFASILRPKYLFLENVKGL    120
            F +  G VDVICGGFPCQAFSIAG R GFEDTRGTLFFEIAR A  ++P++LFLENVKGL
Sbjct: 61   FKKLRGKVDVICGGFPCQAFSIAGRRLGFEDTRGTLFFEIARAAKQIQPRELFLENVKGL    120

Query: 121  LNHEGGATFETIIRTLDELGYNVEWQIENSKNFGVPQNRERVFIIGHLRGEGTRPIFPFE    180
            LNH+ G  TF TI+ TLDELG++VEWQ+ NSK+FGVPQNRERVFIIGH R  GTR  FPF
Sbjct: 121  LNHDKGRTFTTILTTLDELGEDVEWQMLNSKDFGVPQNRERVFIIGHSRKRGTRLGFPFR    180

Query: 181  SSITENYPIHTRKIGNVNPSGNGMNGEVYDSEGLSPTLTTNKGEGVKIAVN---------    231
                 P   + +GN+NPS +GM+G+VY SEGL+PTL     KGEG KIA+
Sbjct: 181  REGQATNPETLKILGNLNPSKSGMSGKVYYSEGLAPTLVRGKGEGFKIAIPCMTPDRLDK    240

Query: 232  -------------------------VVGRLPGKFEMPNRVYDPDGLAPTIRTMQGGGLE    265
                                     VVG LP  F+    RVY  +GL+PT+ TMQGG
Sbjct: 241  RQNGRRFKDNQEPMFTLNTQDRHGIVVVVGDLPTSFKETGRVYGSEGLSPTLTTMQGGDKI    300

Query: 266  PKIIQRGRGYNQGGEYEISPTVTCNSWQENNLLKIKEATKKGYSEAEAGDSVNLSHPNSE    325
            PKI+                +      LK++EATKKGY++AE GDS+N    P+S+
Sbjct: 301  PKILIP--------------------EPIQFLKVREATKKGYAQAEIGDSINLERPSSQ    332

Query: 326  TRRGRVGKGIANTLLTGEEQGVVV--YDLYNRRKKDIVGTLTASGHNGNTTTGTFGISNG    383
             RRGRVGKGIANTL T + GVVV   Y+   +++    + G L              G
Sbjct: 340  HRRGRVGKGIANTLTTSGQMGVVVASYEGEDKQVYQVAGVLID------------GQFYR    387

Query: 384  FRIRKLTPRECWRLQGFPDWAFDKASQVNSNSQLYKQAGNSVTVNVIAAIARRL         437
            +RIR++TP+EC+RLQGFPDWAF+ A  +V+SNSQLYKQAGNSVTV VIAAIA++L
Sbjct: 388  LRIRRITPKECFRLQGFPDWAFFAARKVSSNSQLYKQAGNSVTVPVIAAIAKKL         441
```

There is also homology to SEQ ID 2436:

```
Identities = 53/75 (70%), Positives = 62/75 (82%), Gaps = 1/75 (1%)
Query: 2   MKFLDLFAGIGGFRLGMEQAGHECIGFCEINKFARASYKVIHDTEGEIELHDITRVSDEF 61
           MKFLDLFAGIGGFRLG+   HECIGFCEI+KFAR SYK I++TEGEIE HDI +V+D+
Sbjct: 4   MKFLDLFAGIGGFRLGLINQCHECIGFCEIDKFARQSYKAIYETEGEIEFHDIRQVTDQD 63

Query: 62  IRGI-GSVDVICGGF                                              75
           R + G VD+ICGGF
Sbjct: 64  FRQLRGQVDIICGGF                                              78
```

Based on this analysis, it was predicted that these proteins and their epitopes could be useful antigens for vaccines or diagnostics.

Example 797

A DNA sequence (GBSx0845) was identified in *S. agalactiae* <SEQ ID 2437> which encodes the amino acid sequence <SEQ ID 2438>. Analysis of this protein sequence reveals the following:

---
Possible site: 29
>>> Seems to have no N-terminal signal sequence
----- Final Results -----
    bacterial cytoplasm --- Certainty = 0.2585 (Affirmative) <succ>
    bacterial membrane --- Certainty = 0.0000 (Not Clear) <succ>
    bacterial outside --- Certainty = 0.0000 (Not Clear) <succ>
---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 798

A DNA sequence (GBSx0846) was identified in *S. agalactiae* <SEQ ID 2439> which encodes the amino acid sequence <SEQ ID 2440>. This protein is predicted to be arpR protein. Analysis of this protein sequence reveals the following:

---
Possible site: 46
>>> Seems to have no N-terminal signal sequence
----- Final Results -----
    bacterial cytoplasm --- Certainty = 0.5070 (Affirmative) <succ>
    bacterial membrane --- Certainty = 0.0000 (Not Clear) <succ>
    bacterial outside --- Certainty = 0.0000 (Not Clear) <succ>
---

The protein has homology with the following sequences in the GENPEPT database.

```
>GP:AAB09197 GB:U24159 orf12 [Bacteriophage HP1]
Identities = 34/69 (49%), Positives = 47/69 (67%), Gaps = 1/69 (1%)
Query: 1   MTKIMTLEEKVEQWFIDRNLHE-ANPVKQFQKLIEETGELYSGIAKGKSEIIRDSLGDMQ 59
           M    L + +EQW  DRNL E + P KQF KL+EE GEL SG+AK K ++I+DS+GD
Sbjct: 1   MADLQQLIKNIEQWAEDRNLVEDSTPQKQFIKLMEEFGELCSGVAKNKPDVIKDSIGDCF 60

Query: 60  VVLIGIEQQ                                                    68
           VV++ + +Q
Sbjct: 61  VVMVILAKQ                                                    69
```

No corresponding DNA sequence was identified in *S. pyogenes*.

Based on this analysis, it was predicted that this protein and its epitopes, could be useful antigens for vaccines or diagnostics.

Example 799

A DNA sequence (GBSx0847) was identified in *S. agalactiae* <SEQ ID 2441> which encodes the amino acid sequence <SEQ ID 2442>. Analysis of this protein sequence reveals the following:

---
Possible site: 58
>>> Seems to have an uncleavable N-term signal seq
INTEGRAL    Likelihood = −5.10    Transmembrane 13-29 (10-36)
----- Final Results -----
    bacterial membrane --- Certainty = 0.3039 (Affirmative) <succ>
    bacterial outside --- Certainty = 0.0000 (Not Clear) <succ>
    bacterial cytoplasm --- Certainty = 0.0000 (Not Clear) <succ>
---

The protein has homology with the following sequences in the GENPEPT database.

```
>GP:AAD21919 GB:AF085222 unknown [Streptococcus thermophilus bacteriophage DT1]
Identities = 31/67 (46%), Positives = 49/67 (72%), Gaps = 1/67 (1%)
Query:  42   HQEADRVIIYVADNAGAEMFGKITDKEIIEGRHTVTAGAYGKFLVTEEQYNEITVGDDIP    101
             ++  + ++++ ADN    E+ GK+T K ++    +T+  GAYGKFLV++EQY+ + VGD+IP
Sbjct:  34   NRPVEAIVVHKADNF-VELHGKVTGKSMVGKLYTIDCGAYGKFLVSKEQYDSVQVGDEIP    92

Query: 102   DYLKGRG    108
              YLKGRG
Sbjct:  93   SYLKGRG    99
```

No corresponding DNA sequence was identified in *S. pyogenes*.

Based on this analysis, it was predicted that this protein and its epitopes, could be useful antigens for vaccines or diagnostics.

Example 800

A DNA sequence (GBSx0848) was identified in *S. agalactiae* <SEQ ID 2443> which encodes the amino acid sequence <SEQ ID 2444>. This protein is predicted to be gene 17 protein. Analysis of this protein sequence reveals the following:

Possible site: 55
>>> Seems to have no N-terminal signal sequence
----- Final Results -----
   bacterial cytoplasm --- Certainty = 0.5428 (Affirmative) <succ>
    bacterial membrane --- Certainty = 0.0000 (Not Clear) <succ>
     bacterial outside --- Certainty = 0.0000 (Not Clear) <succ>

The protein has homology with the following sequences in the GENPEPT database.

```
>GP:CAA24397 GB:V01146 gene 1.7 [Bacteriophage T7]
Identities = 30/72 (41%), Positives = 40/72 (54%)
Query:  47   DNVNYPSHYQGKYGLESIDVLRNFMTPEMLKGFYLGNALKYQLRYRKKNGLEDLKKARKN    106
             + V   PSHY      +E+I+V+    MT E   KG+  GN LKY+LR   KK+ L  L+K
Sbjct: 120   EGVTKPSHYMLFDDIEAIEVIARSMTVEQFKGYCFGNILKYRLRAGKKSELAYLEKDLAK    179

Query: 107   LDWLIEEMEKEK    118
             D+  E   EK K
Sbjct: 180   ADFYKELFEKHK    191
```

No corresponding DNA sequence was identified in *S. pyogenes*.

Based on this analysis, it was predicted that this protein and its epitopes, could be useful antigens for vaccines or diagnostics.

Example 801

A DNA sequence (GBSx0849) was identified in *S. agalactiae* <SEQ ID 2445> which encodes the amino acid sequence <SEQ ID 2446>. Analysis of this protein sequence reveals the following:

Possible site: 28
>>> Seems to have no N-terminal signal sequence
----- Final Results -----
   bacterial cytoplasm --- Certainty = 0.1375 (Affirmative) <succ>
    bacterial membrane --- Certainty = 0.0000 (Not Clear) <succ>
     bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 802

A DNA sequence (GBSx0850) was identified in *S. agalactiae* <SEQ ID 2447> which encodes the amino acid sequence <SEQ ID 2448>. Analysis of this protein sequence reveals the following:

Possible site: 31
>>> Seems to have no N-terminal signal sequence
----- Final Results -----
   bacterial cytoplasm --- Certainty = 0.0087 (Affirmative) <succ>
    bacterial membrane --- Certainty = 0.0000 (Not Clear) <succ>
     bacterial outside --- Certainty = 0.0000 (Not Clear) <succ>

A related GBS nucleic acid sequence <SEQ ID 10163> which encodes amino acid sequence <SEQ ID 10164> was also identified.

The protein has homology with the following sequences in the GENPEPT database.

```
>GP:AAF26608 GB:AF145054 ORF9 [Streptococcus thermophilus bacteriophage 7201]
Identities = 99/148 (66%), Positives = 116/148 (77%), Gaps = 10/148 (696)
```

```
                                         -continued
Query:   5   MINNVVLIGRLTRDVELRYTPSNIANATFNLAVNRNFKNAAGDREADFINCVMWRQQAEN    64
             MINN VL+GRLT+D E +YT SNIA A+F+LAVNRNFK+A G+READFINCV+WRQQAEN
Sbjct:   1   MINNTVLVGRLTKDPEFKYTGSNIAVASFSLAVNRNFKDANGEREADFINCVIWRQQAEN    60

Query:  65   LANWTKKGMLIGITGRIQTRSYENQQGQRIYVTEVVADSFQILEKR----DNSTNQASMD   120
             LANW KKG LIGITGRIQTRSYENQQGQR+YVTEVVA++FQ+LE R    + N +
Sbjct:  61   LANWAKKGALIGITGRIQTRSYENQQGQRVYVTEVVAENFQMLESRAAREGGNANNSYSQ   120

Query: 121   DQLP------PSFGNSQPMDISDDDLPF                                  142
             Q+P        + N QP+DIS DDLPF
Sbjct: 121   QQVPNFARKNTEYSNKQPLDISSDDLPF                                  148
```

There is also homology to SEQ ID 1492.

Based on this analysis, it was predicted that these proteins and their epitopes could be useful antigens for vaccines or diagnostics.

Example 803

A DNA sequence (GBSx0851) was identified in *S. agalactiae* <SEQ ID 2449> which encodes the amino acid sequence <SEQ ID 2450>. This protein is predicted to be puff C4B protein. Analysis of this protein sequence reveals the following:

Possible site: 19
>>> Seems to have no N-terminal signal sequence
----- Final Results -----
   bacterial cytoplasm --- Certainty = 0.1203 (Affirmative) <succ>
     bacterial membrane --- Certainty = 0.0000 (Not Clear) <succ>
       bacterial outside --- Certainty = 0.0000 (Not Clear) <succ>

A related GBS nucleic acid sequence <SEQ ID 10161> which encodes amino acid sequence <SEQ ID 10162> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

Example 804

A DNA sequence (GBSx0852) was identified in *S. agalactiae* <SEQ ID 2451> which encodes the amino acid sequence <SEQ ID 2452>. This protein is predicted to be F5M15.19. Analysis of this protein sequence reveals the following:

Possible site: 16
>>> Seems to have an uncleavable N-term signal seq
INTEGRAL    Likelihood = –2.34    Transmembrane 7-23 (6-23)
----- Final Results -----
   bacterial membrane --- Certainty = 0.1935 (Affirmative) <succ>
     bacterial outside --- Certainty = 0.0000 (Not Clear) <succ>
       bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 805

A DNA sequence (GBSx0853) was identified in *S. agalactiae* <SEQ ID 2453> which encodes the amino acid sequence <SEQ ID 2454>. Analysis of this protein sequence reveals the following:

Possible site: 54
>>> Seems to have no N-terminal signal sequence
----- Final Results -----
   bacterial cytoplasm --- Certainty = 0.4398 (Affirmative) <succ>
     bacterial membrane --- Certainty = 0.0000 (Not Clear) <succ>
       bacterial outside --- Certainty = 0.0000 (Not Clear) <succ>

A related GBS nucleic acid sequence <SEQ ID 10159> which encodes amino acid sequence <SEQ ID 10160> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 806

A DNA sequence (GBSx0855) was identified in *S. agalactiae* <SEQ ID 2455> which encodes the amino acid sequence <SEQ ID 2456>. Analysis of this protein sequence reveals the following:

Possible site: 58
>>> Seems to have no N-terminal signal sequence
----- Final Results -----
   bacterial cytoplasm --- Certainty = 0.2992 (Affirmative) <succ>
     bacterial membrane --- Certainty = 0.0000 (Not Clear) <succ>
       bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 807

A DNA sequence (GBSx0856) was identified in *S. agalactiae* <SEQ ID 2457> which encodes the amino acid sequence <SEQ ID 2458>. Analysis of this protein sequence reveals the following:

Possible site: 54
>>> Seems to have no N-terminal signal sequence
----- Final Results -----
    bacterial cytoplasm --- Certainty = 0.4639 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database.

```
>GP:BAB07758 GB:AP001520 unknown conserved protein [Bacillus halodurans]
Identities = 65/184 (35%), Positives = 102/184 (55%), Gaps = 6/184 (3%)
Query:   1   MNIVEPLRDKDDIQAMKDYLSSWNEKYYMLFLLGINTGFRVGDILKLKVKDVQGWNIKVR     60
             M  V P RD D IQA+K L   + +Y+LF  +GINTG R+   +L LK+KDV
Sbjct:   1   MEYVVPFRDVDQIQAIKRSLKKKSPRDYLLFTIGINTGLRISQLLALKIKDVYDGQKPKD    60

Query:  61   EQKTGKYKSIKMTRPLKNELR---EFVKDKELHEYLFQSRVGKNKALSYKTVYWFLKRAA   117
             +    + + +   +K  L+     F++ +E H  LF S    ++ ++ +  Y  +K+AA
Sbjct:  61   YLQLESGEIVYLNDQVKKALQFYAHFIEFQEQH-CLFAS-TNPDQPMTRQHAYRIIKQAA   118

Query: 118   EDLGI-DNVGTHTMRKTFGYHYYKKYKNVADLMSLFNHSSPAVTLIYICVRQDELDTKMS   176
              +G+ D +GTHT+RKTFGYH Y++    ++ L   FNH +PA TL YI + ++E
Sbjct: 119   LQVGLTDQIGTHTLRKTFGYHAYRQGVALSLLQQRFNHQTPAQTLRYIDIAKNEQTIPRI   178

Query: 177   NFSL                                                          180
             N +L
Sbjct: 179   NVNL                                                          182
```

No corresponding DNA sequence was identified in S. pyogenes.

Based on this analysis, it was predicted that this protein and its epitopes, could be useful antigens for vaccines or diagnostics.

Example 808

A DNA sequence (GBSx0857) was identified in S. agalactiae <SEQ ID 2459> which encodes the amino acid sequence <SEQ ID 2460>. Analysis of this protein sequence reveals the following:

Possible site: 33
>>> Seems to have no N-terminal signal sequence
----- Final Results -----
    bacterial cytoplasm --- Certainty = 0.3582 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 809

A DNA sequence (GBSx0858) was identified in S. agalactiae <SEQ ID 2461> which encodes the amino acid sequence <SEQ ID 2462>. Analysis of this protein sequence reveals the following:

Possible site: 33
>>> Seems to have no N-terminal signal sequence
----- Final Results -----
    bacterial cytoplasm --- Certainty = 0.2732 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 810

A DNA sequence (GBSx0859) was identified in S. agalactiae <SEQ ID 2463> which encodes the amino acid sequence <SEQ ID 2464>. Analysis of this protein sequence reveals the following:

Possible site: 27
>>> Seems to have no N-terminal signal sequence
----- Final Results -----
    bacterial cytoplasm --- Certainty = 0.1720 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 811

A DNA sequence (GBSx0860) was identified in S. agalactiae <SEQ ID 2465> which encodes the amino acid sequence <SEQ ID 2466>. Analysis of this protein sequence reveals the following:

Possible site: 26
>>> Seems to have no N-terminal signal sequence
----- Final Results ----- bacterial cytoplasm --- Certainty = 0.2619 (Affirmative) <succ>
bacterial membrane --- Certainty = 0.0000 (Not Clear) <succ>
bacterial outside --- Certainty = 0.0000 (Not Clear) <succ>

A related GBS nucleic acid sequence <SEQ ID 10157> which encodes amino acid sequence <SEQ ID 10158> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

Example 812

A DNA sequence (GBSx0861) was identified in *S. agalactiae* <SEQ ID 2467> which encodes the amino acid sequence <SEQ ID 2468>. This protein is predicted to be terminase large subunit. Analysis of this protein sequence reveals the following:

Possible site: 13
>>> Seems to have no N-terminal signal sequence
----- Final Results -----
bacterial cytoplasm --- Certainty = 0.2753 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

No corresponding DNA sequence was identified in *S. pyogenes*.

Based on this analysis, it was predicted that this protein and its epitopes, could be useful antigens for vaccines or diagnostics.

Example 813

A DNA sequence (GBSx0862) was identified in *S. agalactiae* <SEQ ID 2469> which encodes the amino acid sequence <SEQ ID 2470>. Analysis of this protein sequence reveals the following:

Possible site: 53
>>> Seems to have no N-terminal signal sequence
----- Final Results -----
bacterial cytoplasm --- Certainty = 0.3319 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:AAC27181 GB:AF009630 putative terminase subunit [bacteriophage bIL170]
Identities = 147/531 (27%), Positives = 261/531 (48%), Gaps = 26/531 (4%)
Query:  19  IRICKLTMKSIRRVERYKEQYLFKQEEADKRIEFIEEECSNTKGLAGKLRLALPQKVWLE    78
            I + K   K+I++  R  ++Y+++ +   + IE+IE+     T G   K++L   QK W E
Sbjct:  16  IELNKYMRKTIQKQIRIHKKYIYRYDRVTQAIEWIEDNFYLTTGNLMKIKLHPTQKYWYE    75

Query:  79  TTWGFYHTVEVTKTNPDTLEEYTDYEERRLIHEVPIIVPRGTGKTTLGSAIAEVGQIIDG   138
               G+            D ++E   +  LI+E+ + + RG+GK++L +      I+  G
Sbjct:  76  LMLGY----------DMVDEKG--VQVNLINEIFLNLGRGSGKSSLMATRVLNWMILGG   122

Query: 139  EWGADIQLLAYSREQAGYLFNASRAMLSNEESLLHYMREADILRSTKQGILYETTNSLMS   198
            ++G +  ++AY    QA  ++F+   R         ++L   Y    E   I +STKQG+  +         +
Sbjct: 123  QYGGESLVIAYDNTQARHVFDQVRNQTEASDTLRVY-NENKIFKSTKQGLEFTAFKTTFK   181

Query: 199  IKTSDYESLDGTNAHYNIFDEVHTYDDDFIKVVNDGSSRKRKNWITWYISTNGTKRDKLE   258
             +T+D     G N+   NIFDEVHTY +D  + VN GS +K+ NW + YI++ G KRD L+
Sbjct: 182  KQTNDTLRAQGGNSSLNIFDEVHTYGEDITESVNKGSRQKQDNWQSIYITSGGLKRDGLY   241

Query: 259  DKYYNIWVDILDDKIINDSVMPWIYQLDDVSEIHDPDMWQKAMPLLGITTEKETIARDIE   318
            DK        +++ ND     +Y L++ ++ D   W  A+PL+G   +   +   + E
Sbjct: 242  DKLVERFKS--EEEFYNDRSFGLLYMLENHEQVKDKKNWTMALPLIGDVPKWSGVIEEYE   299

Query: 319  MSKNDPAQQAELMAKTFNLPVNNYLAYFSNEECKGWSDKFDESLFVGDDERNARCVIGID   378
             +++ DPA  Q + +A    LP+ +   YF+ ++  K    +F+ S+F         R   +GID
Sbjct: 300  LAQGDPALQNKFLAFNMGLPMQDTAYYFTPQDTK--LTEFNLSVF-----NKNRTYVGID   352

Query: 379  LSDVNDICSISFMVVRGEERHYLNKKFMPRHTIETLPKELRDKYTEWELSGMLHVHELDY   438
            LS + D+  ++SF+        + +        F R   E L   E ++ +TE+    G L + + +Y
Sbjct: 353  LSLIGDLTAVSFVCELEGKTYSHTLTFSVRSQYEQLDTEQQELWTEFVDRGELILLDTEY   412

Query: 439  NDQAYIFEELRQFMSDNRILPVAVGYDRYNARELIRLFNDYYGDICHDIPQTVK---SLS   495
             +    +   +  F S       +GYD      L   L  Y+ D    D +    ++ S++
Sbjct: 413  INVNDLIPYINDFRSKTGCRLRKIGYDPARYEILKGLIERYFFDKDGDNQRAIRQGFSMN   472

Query: 496  NPLKVYKEKAKMGKIIFDDPVATWNHANVRVKIDANNNIFPNKEKAKEKID           546
            + +K+ K K     K+I + V W  N  VKI + +    K+  K+KID
Sbjct: 473  DYIKLLKSKLVENKLIHNQKVMQWALNNTAVKIGQSGDYMYTKKLEKDKID           523
```

```
>GP:AAB41469 GB:L35061 orfL4 [Bacteriophage phi-41]
Identities = 86/374 (22%), Positives = 166/374 (43%), Gaps = 38/374 (10%)
Query:  12  FARIFRPNNRKSTRTYLQRSISYWRRNSIYLDNIYNKISTDTAQLRFKHVKITRNPGGVD    71
            F+R    N+ +    +    ++ Y    S ++ NI+NKI+ +  ++ F HVK  ++  G D
Sbjct:  10  FSRGKLNNDTQRVTAWQNEAVEY---TSAFVTNIHNKIANEITKVEFNHVKYKKSDVGSD    66

Query:  72  SMVWYEHSDLAEVLTVSPNPLEVPVVFWSNVTRAMLRDGVAVVVPRW--KNGRLVEIWLA   129
            +++     SDL EVL  S         + FW  V + +L         + P +  K G LV++   A
Sbjct:  67  TLISMAGSDLDEVLNWSSKGERNSMEFWQKVIKKLLTTRYIDLYPIFDRKTGDLVDLLFA   126

Query: 130  KKTVTWTAESVELMLDDVAVELPLTDVWVFENPKLNVTAQLNQITELIDINLNALTEKLS   189
               +   E+   ++     +                              N+  T ++D   L  +  KL
Sbjct: 127  DNKKEYKPEELVRLISPFYI--------------------NEDTSILDNALAGIQTKLE   165

Query: 190  DGNSSLRGELKLPT---KAADEHLKQQARDRVDSMLDLAKNGGIAYLEQGEEFQELSKDY   246
               G   ++G LK+         D+   K  +A     +  +M +++    G+    +    E   EL KDY
Sbjct: 166  QGK--MKGLLKINAFIDTDNDQEFKDKAMLTIKNMQEMSNYNGLTPTDNKTEIVELKKDY   223

Query: 247  STASKEELEFLKSQLYNAHGINEKLFTCDYTEEQYRAYYSSVMKLYQRVYSEEINRKYFT   306
            S   +K+E++ +KS+L    +  +NE +       ++EQ    +Y+S  +         +E+    K   +
Sbjct: 224  SVLNKDEIDLIKSELLTGYFMNENILLGTASQEQQIYFYNSTIIPLLIQLEKELTYKLIS   283

Query: 307  KTAR--TQGN----KLLVFFDMADMISFKDLVEGGFKSKYAGLMNSNEFRETYLGLPGYE   360
                R    +GN       +++V   +    + K+L++   ++     +     N+      +G        E
Sbjct: 284  TNRRRVVKGNLYYERIIVDNQLFKFATLKELIDLYHENINGPIFTQNQLL-VKMGEQPIE   342

Query: 361  GGEVFETNLNAVRI                                                  374
            GG+V+    NLNAV   +
Sbjct: 343  GGDVYIANLNAVAV                                                  356
```

No corresponding DNA sequence was identified in *S. pyogenes*.

Based on this analysis, it was predicted that this protein and its epitopes, could be useful antigens for vaccines or diagnostics.

Example 814

A DNA sequence (GBSx0863) was identified in *S. agalactiae* <SEQ ID 2471> which encodes the amino acid sequence <SEQ ID 2472>. This protein is predicted to be a prohead protease. Analysis of this protein sequence reveals the following:

Possible site: 25
>>> Seems to have no N-terminal signal sequence
----- Final Results -----
  bacterial cytoplasm --- Certainty = 0.3496 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

No corresponding DNA sequence was identified in *S. pyogenes*.

Based on this analysis, it was predicted that this protein and its epitopes, could be useful antigens for vaccines or diagnostics.

Example 815

A DNA sequence (GBSx0864) was identified in *S. agalactiae* <SEQ ID 2473> which encodes the amino acid sequence <SEQ ID 2474>. Analysis of this protein sequence reveals the following:

Possible site: 47
>>> Seems to have no N-terminal signal sequence
----- Final Results -----
  bacterial cytoplasm --- Certainty = 0.2247 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 10155> which encodes amino acid sequence <SEQ ID 10156> was also identified.

The protein has homology with the following sequences in the GENPEPT database.

```
>GP:AAF31089 GB:AF069529 protease [Bacteriophage HK97]
Identities = 52/142 (36%), Positives = 73/142 (50.%), Gaps = 11/142 (7%)
Query:  21  FEAYASTYDNTDREGDVMAKGCFDNTLKSKA-VVPMCLNHDR-NCVIGKHE-LSVDEKGL    77
            FE YAS ++NTD +GD++  G F N L ++    V M  NH       +GK +  L+ DEKGL
Sbjct:  26  FEGYASVFNNTDSDGDIILPGAFKNALANQTRKVAMFFNHKTWELPVGKWDSLAEDEKGL    85

Query:  78  RTRSTFNLSDPEAKKTYDLMKMGALDSLSIGFFI--KDYEPIDAKQPYGGWIFKEVE-IF   134
                R        A         M+ G  ++  +S+GF  +       DY    I         G IFK ++   +
Sbjct:  86  YVRGQLTPGHSGAADLKAAMQHGTVEGMSVGFSVAKDDYTIIPT-----GRIFKNIQALR   140

Query: 135  EISVVTVPANPQATVDNIKEFD                                          156
            EISV  T PAN QA +   +K  D
Sbjct: 141  EISVCTFPANEQAGIAAMKSVD                                          162
```

```
>GP:AAC27185 GB:AF009630 16 [bacteriophage bIL170]
Identities = 70/249 (28%), Positives = 121/249 (48%), Gaps = 23/249 (9%)
Query:  51  LEQLKTDAESLVSQATA--IKETIAGLDSDIEETEEELSK-AAKIIK---------EKQK     98
            L +LK +  SL SQ      +K  I   L    ++E E+ LS+ + +IIK         EK K
Sbjct:  13  LAELKENNVSLKSQINGFEVKNAIEDLPK-VQELEKTLSENSIEIIKIENELNAQEEKPK   71

Query:  99  GNTPM-DYLKTKAAALDFVRILMDNEGSANSARKAWEANLVEKGV--TNLTKILPEPVLI   155
            G    M ++++++ A  +F  +L  N G +   + AW A L E GV   T+ T  LP ++
Sbjct:  72  GKAKMTNFIESQNAVTEFFDVLKKNSGKSE-IKNAWNAKIAENGVTITDTTFQLPRKLVE   130

Query: 156  AIQDAFTNYNGILN--HVSKDPRYAVRVALQTQVSQAKGHKAGKTKKDEDFTFLDFTINS   213
            +I   A  N N +      HV+       V  +  +  ++A+ HK G+TK ++   T      T+
Sbjct: 131  SINTALLNTNPVFKVFHVTNVGALLVSRSFDSS-AEAQVHKDGQTKTEQAATLTIDTLEP   189

Query: 214  ATVY-IKYAFEYSDLKKDTTGAYFNYVMKELAQGFI-RTIERAVVIGDGKSN-SAEDKIT   270
                VY ++     E      + +     +N ++ EL Q + + ++ A+V GDG +   + DK
Sbjct: 190  VMVYKLQSLAERVKRLQMSYSELYNLIVAELTQAIVNKIVDLALVEGDGSNGFKSIDKEA   249

Query: 271  EIKSIAEET                                                      279
            ++K I + T
Sbjct: 250  DVKKIKKIT                                                      258
```

No corresponding DNA sequence was identified in *S. pyogenes*.

Based on this analysis, it was predicted that these proteins and their epitopes could be useful antigens for vaccines or diagnostics.

Example 816

A DNA sequence (GBSx0865) was identified in *S. agalactiae* <SEQ ID 2475> which encodes the amino acid sequence <SEQ ID 2476>. Analysis of this protein sequence reveals the following:

Possible site: 39
>>> Seems to have no N-terminal signal sequence
----- Final Results -----
    bacterial cytoplasm --- Certainty = 0.3068 (Affirmative) <succ>
        bacterial membrane --- Certainty = 0.0000 (Not Clear) <succ>
        bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 817

A DNA sequence (GBSx0866) was identified in *S. agalactiae* <SEQ ID 2477> which encodes the amino acid sequence <SEQ ID 2478>. Analysis of this protein sequence reveals the following:

Possible site: 56
>>> Seems to have no N-terminal signal sequence
----- Final Results -----
    bacterial cytoplasm --- Certainty = 0.0437 (Affirmative) <succ>
        bacterial membrane --- Certainty = 0.0000 (Not Clear) <succ>
        bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 818

A DNA sequence (GBSx0867) was identified in *S. agalactiae* <SEQ ID 2479> which encodes the amino acid sequence <SEQ ID 2480>. Analysis of this protein sequence reveals the following:

Possible site: 14
>>> Seems to have no N-terminal signal sequence
----- Final Results -----
    bacterial cytoplasm --- Certainty = 0.3181 (Affirmative) <succ>
        bacterial membrane --- Certainty = 0.0000 (Not Clear) <succ>
        bacterial outside --- Certainty = 0.0000 (Not Clear) <succ>

A related GBS nucleic acid sequence <SEQ ID 10153> which encodes amino acid sequence <SEQ ID 10154> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

Example 819

A DNA sequence (GBSx0869) was identified in *S. agalactiae* <SEQ ID 2481> which encodes the amino acid sequence <SEQ ID 2482>. This protein is predicted to be a major structural protein. Analysis of this protein sequence reveals the following:

Possible site: 29
>>> Seems to have no N-terminal signal sequence
----- Final Results -----
    bacterial cytoplasm --- Certainty = 0.3364 (Affirmative) <succ>
        bacterial membrane --- Certainty = 0.0000 (Not Clear) <succ>
        bacterial outside --- Certainty = 0.0000 (Not Clear) <succ>

The protein has homology with the following sequences in the GENPEPT database.

```
>GP:AAA74331 GB:L33769 unidentified ORF28; putative [Bacteriophage bIL67]
Identities = 55/201 (27%), Positives = 84/201 (41%), Gaps = 18/201 (8%)
Query:   9   EVTHGNANGF-YAKIAKTDAGALDLQUYPFTGLRSTSFETSQESNAYYAD-NVEHVRLQ      66
             E+THG   G + + + G        P  GLR   ++ QE+ +YA N + +
Sbjct:   8   ELTHGLGYGVVFTDLTGSKTGI------PIAGLRGIETDSKQENKNFYAGFNAPYRTIA    60

Query:  67   GKKSTEGSITTYQIPKQFMIDHLGKKLTNSTPPALIDTGVNTN-FIWGYAETVTDEFGAE    125
             G K T+ + +Y +P F    LG    S    L D   N  + + YAE   D +G
Sbjct:  61   GAKDTQIKVKSYDLPDDFATHALG---FGSVQGFLTDDVANYKPYGFAYAERYRDDDGTG   117

Query: 126   IEEFHIWTNVKASAPKGSTSTDETSATPKEIEIPCTASPNNFIVDSEKKPVSEIVWRDDS    185
              +    +V+A+ P  +    DE S T KE E     T +   +F +  +K+    +     D
Sbjct: 118   YKA-TFYPSVQATTPSDTAEADEESPTGKEYEHEATVTTGDFTLGDKKRLFVKFKVSDTE   176

Query: 186   KGT-VRGK---FDKLFADKSP                                          202
                T   GK    F KLF D  P
Sbjct: 177   LATGTSGKALAFKKLFTDLKP                                         197
```

No corresponding DNA sequence was identified in *S. pyogenes*.

Based on this analysis, it was predicted that this protein and its epitopes, could be useful antigens for vaccines or diagnostics.

Example 820

A DNA sequence (GBSx0870) was identified in *S. agalactiae* <SEQ ID 2483> which encodes the amino acid sequence <SEQ ID 2484>. Analysis of this protein sequence reveals the following:

---

Possible site: 61
>>> Seems to have no N-terminal signal sequence
----- Final Results -----
    bacterial cytoplasm --- Certainty = 0.2531 (Affirmative) <succ>
    bacterial membrane --- Certainty = 0.0000 (Not Clear) <succ>
    bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 821

A DNA sequence (GBSx0871) was identified in *S. agalactiae* <SEQ ID 2485> which encodes the amino acid sequence <SEQ ID 2486>. Analysis of this protein sequence reveals the following:

---

Possible site: 22
>>> Seems to have no N-terminal signal sequence
----- Final Results -----
    bacterial cytoplasm --- Certainty = 0.2972 (Affirmative) <succ>
    bacterial membrane --- Certainty = 0.0000 (Not Clear) <succ>
    bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 822

A DNA sequence (GBSx0872) was identified in *S. agalactiae* <SEQ ID 2487> which encodes the amino acid sequence <SEQ ID 2488>. Analysis of this protein sequence reveals the following:

---

Possible site: 49
>>> Seems to have no N-terminal signal sequence
----- Final Results -----
    bacterial cytoplasm --- Certainty = 0.3860 (Affirmative) <succ>
    bacterial membrane --- Certainty = 0.0000 (Not Clear) <succ>
    bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 823

A DNA sequence (GBSx0873) was identified in *S. agalactiae* <SEQ ID 2489> which encodes the amino acid sequence <SEQ ID 2490>. Analysis of this protein sequence reveals the following:

---

Possible site: 16
>>> Seems to have no N-terminal signal sequence
INTEGRAL    Likelihood = −14.22    Transmembrane 605-621 (569-631)
INTEGRAL    Likelihood = −8.12     Transmembrane 583-599 (569-604)
----- Final Results -----
    bacterial membrane --- Certainty = 0.6689 (Affirmative) <succ>
    bacterial outside --- Certainty = 0.0000 (Not Clear) <succ>
    bacterial cytoplasm --- Certainty = 0.0000 (Not Clear) <succ>

---

The protein has homology with the following sequences in the GENPEPT database.

```
>GP:AAB70053 GB:AF011378 unknown [Bacteriophage sk1]
Identities = 159/709 (22%), Positives = 285/709 (39%), Gaps = 112/709 (15%)
```

```
-continued
Query: 128  SILNLNKELDNVAKELDIVNQKLELDPDNVELAEQKMKLLGKQSELAGDKVQELKKKQAA  187
            S+  +N  +  +  E  +     L+LDP N+    Q  KL  Q  L+ DK  +LK++ ++
Sbjct:  21  SLKGVNTAMSGLRGEAKNLRDALKLDPTNTDKMAQLQKNLQTQLGLSRDKATKLKQELSS   80

Query: 188  LGDEK-IGTEEWRQLQNEIGQAEVEVLKIDRAMDILGESSRSATGDI--KEATSYLRADV  244
            +        G  ++W  QL   ++G AE  +   +++   +   +   S  + DI  K  T  + + +
Sbjct:  81  VDKSSPAGQKKWLQLTRDLGTAETQANRLEGEIKQVEGAISSGSWDIDAKMDTKGVNSGI  140

Query: 245  MMDVADKAG----------QIGQKMVDAGKMTVDAWSEIDEALDTVTTKTGLTGD-----  289
              +     +G              QIG    V A    + W  +  +A+DT        L
Sbjct: 141  DGMKSRFSGLREIAVGVFRQIGSSAVSAVGNGLKGW--VSDAMDTQKAMISLQNTLKFKG  198

Query: 290  -------ALAELQEIAKDIATG------MPTSFQNAGD----AVGEL------NTQFGLT  326
                         +Q  +AKD         + T+F    GD        AVG+          N   FG  T
Sbjct: 199  NGQDFDYVSKSMQTLAKDTNANTEDTLKLSTTFIGLGDSAKTAVGKTEALVKANQAFGGT  258

Query: 327  GEKLKSASELL---------IKYAEINE-TD--------ISSSAISAKQAIEAYG--LTAE  367
            GE+LK       +                IN+ TD            + S+ +       A++  YG       +A
Sbjct: 259  GEQLKGVVQAYGQMSASGKVSAENINQLTDNNTALGSALKSTVMEMNPALKQYGSFASAS  318

Query: 368  DLGMV----LDNVTKAAQDTGQSVDTIVQKAIDGAPQIKGLGLSFEEGA------ALIGK  417
            + G +        LD  +        G       T    + AD  +          L L            ++I    K
Sbjct: 319  EKGAISVEMLDKAMQKLGGAGGGAVTTIGDAWDSFNETLSLALLPTLDALTPIISSIIDK  378

Query: 418  FEKSGVDSSAALSSLSKAAVIYAKD--GKTLTDGLNETVSAIQNSTSET--EALSIASEI  473
                        G  +  AL S+  K           Y K+     G       +G        ++S  I  +       T        LSI    ++
Sbjct: 379  MAGWGESAGKALDSIVK----YVKELWGALEKNGALSSLSKIWDGLKSTFGSVLSIIGQL  434

Query: 474  FGSKAAPRMVDAIQRGAFSFDDLAEAAKSSSGTVSTTFDETLPIDKLTQYSNQAKEGMA   533
                     S  A     +D+         +  A  +  ++  S  T++           D    I  K+   ++  +    E
Sbjct: 435  IESFAG---IDS------KTGESAGSVENVSKTIANLAKGLADVIKKIADFAKKFSESKG  485

Query: 534  ELGGKLLETVIPALEPLMGMLESSVNWFTSLNETDQ-QTIVLGLVTTAVMMLLGAIAPL  592
              +         L+T + AL       +         T+++    + QT +   G            + AI  P
Sbjct: 486  AID--TLKTSLVALTAGFVAFKIGSGIITAISAFKKLQTAIQAGTGVMGAFNAVMAINPF  543

Query: 593  VIAIGAIGAPVGIVVAAIV-GAIAVITLIIQAIMNWGAITEWLQSTWDSCAA-------W  644
            V            +GI +AAIV G  +     T             W  +     ++L+S WD      +                 W
Sbjct: 544  VA--------LGIAIAAIVAGLVYFFTQTETGKKAWASFVDFLKSAWDGIVSFFSGIGQW  595

Query: 645  LSELWTNIVTTATTAWSNFTAWLSGLWSSVVSTGQSLWSSFTSSLSNIFSSLITGAQSLW  704
            +++W    V   A      W         W SG+        V           Q++W+    T+    +    ++++++TG  Q+   W
Sbjct: 596  FADIWNGAVDGAKGIWQGLVDWFSGIVQGV----QNIWNGITTFFTTLWTTVVTGIQTAW  651

Query: 705  SSFTSTLSNLWSGLVSTGSNLFNNLSSTISGIFNGILSTASNIWNSIKS             753
              +    T       +   LW  G+V+   +    +F    +SS   ++G  +N     ++T       +   +   KS
Sbjct: 652  AGVTGFFTGLWDGIVNVVTTVFTTISSLVTGAYNWFVTTFQPLISFYKS            700
```

There is also homology to SEQ ID 2492.

A related GBS gene <SEQ ID 8663> and protein <SEQ ID 8664> were also identified. Analysis of this protein sequence reveals the following:

---

Lipop: Possible site: −1  Crend: 10
McG: Discrim Score: −13.98
GvH: Signal Score (−7.5): −2.78
Possible site: 16
>>> Seems to have no N-terminal signal sequence
ALOM program count: 2 value: −14.22 threshold: 0.0
INTEGRAL      Likelihood = −14.22   Transmembrane 605-621 (569-631)
INTEGRAL      Likelihood = −8.12    Transmembrane 583-599 (569-604)
PERIPHERAL    Likelihood = 4.45       539
modified ALOM score: 3.34
*** Reasoning Step: 3
----- Final Results -----
    bacterial membrane --- Certainty = 0.6689 (Affirmative) <succ>
      bacterial outside --- Certainty = 0.0000 (Not Clear) <succ>
        bacterial cytoplasm --- Certainty = 0.0000 (Not Clear)

---

The protein has homology with the following sequences in the databases:

```
27.1/51.7% over 981aa
Bacteriophage skl
GP|2392838| unknown Insert characterized
ORF00471(328-2976 of 3333)
GP|2392838|gb|AAB70053.1||AF011378(9-990 of 999) unknown {Bacteriophage skl}
% Match = 7.3
% Identity = 27.1 % Similarity = 51.7
Matches = 164 Mismatches = 275 Conservative Sub.s = 149

243       273       303       333       363       393       423       453
MSINQEEKKTLSNADLLSVMSD*KERRKSMTETFEGLYVKFGANTVEFDRSVKGINTALSSLKKDFNNINRQLKMDPDNV
                   :  : |:   || :|: |:|:||:|||:|   |:      |:       ||:|| |
                      MASNATFEVEIYGNTTKFENSLKGVNTAMSGLRGEAKNLRDALKLDPTNT
                               10        20        30        40        50

483       513       543       570       600       630       660       690
DLLNRKLVNLQEQARVGAIKIAELKKQQKALGESE-VGSAQWNKLQLEIAKVESQMKIVDKAMESTKKHIEDVGDPKSIL
|  : :    |||      :     |   :||::  ::  :|     |  :|  |  ::     |:|   ::  ::
DKMAQLQKNLQTQLGLSRDKATKLKQELSSVDKSSPAGQKKWLQLTRDLGTAETQANRLEGEIKQVE------------
        60        70        80        90       100       110

1053      1083      1113      1143      1167      1197      1227
NLNKELD~~~~DVMMDVADKAGQIGQKMVDAGKMTVDAWSEIDEALDTVTTKTGLTG--DALAELQEIAKDIATGMPTSF
       |    ::  :| :||   :||     :|:  |    :: :|||   :  ::|
-----------GAISSGSW-DIDAKMDTKGVNSGIDGMKSRFSGLREIAVGVFRQIGSSA
                    120       130       140       150       160 cag                                                                          g
aac                                                                          g
gtt                                                                          t
                                                                          1239
QNA--------------------------------------------------------------------------G
 :|
VSAVGNGLKGWVSDAMDTQKAMISLQNTLKFKGNGQDFDYVSKSMQTLAKDTNANTEDTLKLSTTFIGLGDSAKTAVGKT
               180       190       200       210       220       230       240

1269      1299      1329      1359      1389      1416      1446      1476
DAVGELNTQFGLTGEKLKSASELLIKYAEINETDISSSAISAKQAIEAYG-LTAEDLGMVLDNVTKAAQDTGQSVDTIVQ
:|: :  |  || |||:||       :  :       :  : |  | ::||::  : |||
EALVKANQAFGGTGEQLKGV------------------VQAYGQMSASGKVSAENINQLTDNNT---------------
              260                        270       280       290

1506      1536      1566      1596      1626      1656      1686      1716
KAIDGAPQIKGLGLSFEEGAALIGKFEKSGVDSSAALSSLSKAAVIYAKDGKTLTDGLNETVSAIQNSTSETEALSIASE
                                                       |  |  | :  :   ::: |||
-------------------------------------------------------ALGSALKSTVMEMNPALKQYGSFASASE
                                                            300       310

1746      1794      1824      1854      1884      1914      1944
IFGSKAAPRMVDAIQR----GAFSFDDLAEAAKSSSGTVSTTFDETLDPIDKLTQYSNQAKEGMAELGGKLLETVIPALE
|:  :    :|:|        |    :   ::|  |  | |:|   |||    |       |  |  || |::::  ::
-KGAISVEMLDKAMQKLGGAGGGAVTTIGDAWDSFNETLSLALLPTLDALTPIISSIIDKMAGWGESAGKALDSIVKYVK
        330       340       350       360       370       380       390

1974      2004      2034      2064
PLMGMLESSVNWFTSLNETDQQTIVILGLVTTAVMMLLGAIAPL-----------------------------------
|  | ||   :   ::||::       :|   | |   |: :    :
ELWGALEKN-GALSSLSKIWDGLKSTFGSVLSIIGQLIESFAGIDSKTGESAGSVENVSKTIAN~~~~FKKLQTAIQAGT
         410       420       430       440       450       460

2082      2112      2139      2169      2199      2238      2268
--------VIAIGAIGAPVGIVVAAIV-GAIAVITLIIQAIMNWGAITEWLQSTWD-------SCAAWXSELWTNIVTTA
        |:|   :|| :||||  |   :||  |     |     |   ::|: ||        | |:::|    | |
GVMGAFNAVMAINPF-VALGIAIAAIVAGLVYFFTQTETGKKAWASFVDFLKSAWDGIVSFFSGIGQWFADIWNGAVDGA
        540       550       560       570       580       590       600

2298      2328      2358      2388      2418      2448      2478
TTAWSNFTAWLSGLWSSVSTGQSLWSSFTSSLSNIFSSLITGAQSLWSSFTSTLSNLWSGLVSTGSNLFNNLSS-----
|  : |:||:  |     |||::     |:::| |:  :::::::::|| |:  |  |: ||:::||| ::    ::
KGIWQGLVDWFSGIVQGV----QNIWNGITTFFTTLWTTVVTGIQTAWAGVTGFFTGLWDGIVNVVTTVFTTISSLVTGA
        620       630       640       650       660       670       680

2496      2526      2556      2586      2616
--------------------------------------TISGIFNGILSTASNIWNSIKSTISNAIDGAKNAVSNGVNA
                                      |:|:||||  |  |:|:   :|:| :: : |   ::|   :
YNWFVTTFQPLISFY~~~~KNIVSGVFEAFGNFASNAWNAITGVFNGIGSFFSDIFGGVKNTIDSVLGGVTDTINNIKGS
                            870       880       890       900       910       920
```

-continued

```
      2646      2676      2706      2736      2766      2796      2826      2856
      IKNLFNFQIKWPHIPLPHFRVSGSANPLDWLKGGLPSIGIDWYAKGGIMTKPTLFGMNGNRAMVGGEAGAEAILPLNKST
      |                                                       :    :|||        ::  |
      I-------------------------------------------------------DWVASKVGGLFKGSMVVGLTDVN
                                                              930        940       950

2886      2916      2946      2976      3006      3036      3066      3096
      LGAIGQSIANTMNTSNNINVNFSGVTIREEADLNRLANVVGNRIAEELQRKTNLRGGMA*QKSMNLPLTV*KHHLLSVMY
      |:|      ::       :|:|      |       |        |::||     :
      LSSSGYGLSTNSVSSDNRTYNTFNVQGGAGQDVSNLARAIRREFELGRA
              960       970       980       990
```

SEQ ID 8664 (GBS58) was expressed in and purified from *E. coli* as a GST fusion. The purified protein is shown in lane 10 of FIG. 193.

Based on this analysis, it was predicted that these proteins and their epitopes could be useful antigens for vaccines or diagnostics.

Example 824

A DNA sequence (GBSx0874) was identified in *S. agalactiae* <SEQ ID 2493> which encodes the amino acid sequence <SEQ ID 2494>. Analysis of this protein sequence reveals the following:

---
Possible site: 43
>>> Seems to have no N-terminal signal sequence
----- Final Results -----
   bacterial cytoplasm --- Certainty = 0.2732 (Affirmative) <succ>
   bacterial membrane --- Certainty = 0.0000 (Not Clear) <succ>
   bacterial outside --- Certainty = 0.0000 (Not Clear) <succ>
---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 825

A DNA sequence (GBSx0875) was identified in *S. agalactiae* <SEQ ID 2495> which encodes the amino acid sequence <SEQ ID 2496>. Analysis of this protein sequence reveals the following:

---
Possible site: 18
>>> Seems to have no N-terminal signal sequence
----- Final Results -----
   bacterial cytoplasm --- Certainty = 0.2467 (Affirmative) <succ>
   bacterial membrane --- Certainty = 0.0000 (Not Clear) <succ>
   bacterial outside --- Certainty = 0.0000 (Not Clear) <succ>
---

A related GBS nucleic acid sequence <SEQ ID 10151> which encodes amino acid sequence <SEQ ID 10152> was also identified. A further related GBS nucleic acid sequence <SEQ ID 10935> which encodes amino acid sequence <SEQ ID 10936> was also identified.

The protein has no significant homology with any sequences in the GENPEPT database.

A related DNA sequence was identified in *S. pyogenes* <SEQ ID 2497> which encodes the amino acid sequence <SEQ ID 2498>. Analysis of this protein sequence reveals the following:

---
Possible site: 40
Seems to have no N-terminal signal sequence
----- Final Results -----
   bacterial cytoplasm --- Certainty = 0.2136 (Affirmative) <succ>
   bacterial membrane --- Certainty = 0.0000 (Not Clear) <succ>
   bacterial outside --- Certainty = 0.0000 (Not Clear) <succ>
---

An alignment of the GAS and GBS proteins is shown below.

```
Identities = 55/240 (22%), Positives = 92/240 (37%), Gaps = 20/240 (8%)
Query:   4  INELTIDGVKTSSFKCDVLVETRPNVIVSSS--KTALLEHDGISGAVVQSNRHRGLIEKP     61
            I ++ ID   TSS    VL       I+S S  +     +G S    N + I
Sbjct:   2  IPKVIIDDFDTSSIPNCVLTGYDVGDILSPSFVENEAYGMNGTSRELESYNESKPTIM--    59

Query:  62  YHITLIEPSDEEIYRFSALLNREKFW-LENEQEPTIRLWCYKVDSFEIGKDEFGAWVVDV   120
            +H++ + +   I       L + +FW + N          ++ Y     S +I    +W V +
Sbjct:  60  WHLSTFDDAVNLINHLDGLSKKIEFWHIPNS------IYYYDCLSVKINAVTMSSWRVTL   113

Query: 121  TFICHPTKFFKTTDIQTLTGNGVLRVQGSALAFPKITVVGQSASETSFTIGNQVIKLEKL   180
               +P ++ K     + GNG +    G+  + PKI V G   + + TIG QV++L   L
Sbjct: 114  KLALYPFRYAKGVSDVVIAGNGNINNAGNVFSEPKIVVEG--TGKGTLTIGKQVMEL-NL   170

Query: 181  SESLVMTNDPDNPSFKTASGKL---IKWAGDFITVDTAKGQNVGVVLGAGITSLKFETVW   237
            S   +             A G +    I+  G F +         G+ + GIT      W
Sbjct: 171  SGKATIECKHGQQCVYDAEGNVKNSIRIRGSFFEIQPG---TQGIAVSGGITRTIISPRW   227
```

Based on this analysis, it was predicted that these proteins and their epitopes could be useful antigens for vaccines or diagnostics.

Example 826

A DNA sequence (GBSx0876) was identified in *S. agalactiae* <SEQ ID 2499> which encodes the amino acid sequence <SEQ ID 2500>. This protein is predicted to be PblB. Analysis of this protein sequence reveals the following:

```
Possible site: 27
>>> Seems to have no N-terminal signal sequence
INTEGRAL    Likelihood = -0.00    Transmembrane 952-968 (952-968)
----- Final Results -----
    bacterial membrane --- Certainty = 0.1001 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:AAG18640 GB:AY007505 PblB [Streptococcus mitis]
Identities = 145/542 (26%), Positives = 255/542 (46%), Gaps = 52/542 (9%)
Query:   1 MLFLLDANVRTVKWNGIPLHEASSAIVKEETNGDFYLTVRYPITDSGIYQLIKEDMLIKS    60
             M++L + N         PL+ A ++ +   E N  + LT R+P +D  +++ +KE+   +K+
Sbjct:   1 MIYLTNGNT--------PLNAAYADKISQEANSTYQLTFRFPTSDV-LWEKLKEETFLKA    51

Query:  61 PVPVLGAQLFRIKKPIENDDSMDITAYHVSDDIMKRSITPVSVVGQGCAMALSQMVQNAK   120
              + G Q F I +  +    + + AV       +    I P+S+          + ALS+       +
Sbjct:  52 D-DLHGEQDFVIFEVQKKHGYIQVYANQVMTLLNNYVINPISLDRATGSTALSRFAGSI-   109

Query: 121 TGLGDFSFTSDIMDSRTFNTTETETLYSVLMDGKHSIVGTWEGELVRDNFALSIKRSRGA   180
             T      FSF SDI +   TFNT    + +     D KHSI+G W G+LVR + + + ++ G+
Sbjct: 110 TRYNTFSFFSDIDERHTFNTDSVNAMVAFTKD-KHSILGQWGGDLVRHGYQVRLLKNGGS   168

Query: 181 DRGVVITTHKNLKSYQRTKNSQGVVTRIHARSTFKPDGAE-DEVTLRVSVDSPLINSYPY   239
             +   +        KNL SYQ   +++ +   TRI   ++T K  +G +   +     V VDSPL+N Y
Sbjct: 169 ENESLFMYKKNLSSYQHKTSTKSLKTRITFKATVKGEGEKAPDRKFSVVVDSPLVNKYSQ   228

Query: 240 INEKEYENNNAETVED--LRKWAEAKFTNEGIDKVSDAIEIEANELDGQVVNLGDTVNLK   297
             I E    E N+ +  ++   LRK+ E  F       D + D++EI+           V + D V+L
Sbjct: 229 IYEDVIEVNDQDVKDEVGLRKYGEQYFRTTLCDMLEDSLEIQVEGKSDVPVQIFDIVSLF   288

Query: 298 SRKHSADLYKKAIAYEFNALTEEYISITFDDKPGVGGSGVSSGLSN-VADAILVASATAQ   356
                    + D+ KK    Y ++ +  ++   +SI  F       G       SG+S+ LSN V+DA+      +     Q
Sbjct: 289 HDRFKMDVRKKITKYTYSPMAKKLLSIGF----GQFKSGLSNMLSNAVSDAVKNETQHLQ   344

Query: 357 D---VAVQRAVKNANAAFDAEFGKTKTKINDDIEIAKAKVESFKSELSNRMDNQLLP---   410
                    + ++ KNA+ AFD +  +      + D +  AKAK  E +   K    L+    +D +
Sbjct: 345 GQFATQLGKEIKNADLAFDRKKEELVNQFTDGLNAAKAKAEEVKKSLTETIDQRFRDFDS   404

Query: 411 ---------------------LATEAKNLASQAQADLTRKEIELRAELNRQVTSTEAVK   448
                                  LA EAK ++ QA+  +  K   E +  ++ +  + TS +
Sbjct: 405 TGLNEIKQKAEEEALQRVGANTLLAQEAKQISEQARQQMDSKFAEYKQSVDGRFTSLSSQL   464

Query: 449 ISLTNLSHNMDIIKQKALNDLRDAETRLKEADSVQQLATKRVEDKLTGLSTKLESFSVGG   508
                     NL    +D + +  ++L +       E+D  +++A  +  ++L +          S +VGG
Sbjct: 465 AGKANL---IDFQRVQEKSNLYERIIGSSESDIAEKVARMTLTNQLFQVEVGKYS-AVGG   520

Query: 509 YN                                                            510
             N
Sbjet: 521 PN                                                            522
```

```
Identities = 47/183 (25%), Positives = 83/183 (44%), Gaps = 22/183 (12%)
Query: 867 VTTLRVTKGTIPADWSPSPDDLKAYSDTKLEQTANEIKASVTSLDHKTLKQTDITMTSEG   926
             +T L  +GT    W P+P+D       +D  LE T                   QT +T+
Sbjct: 667 MTELDFYEGTTDRRWQPAPEDATLETDKTLEAT----------------QTKLTLLQGS   709

Query: 927 IVLRAGKTSNDVARAIGSYFKVTPDAIALFSSLIKVSGNMLVDGSVTSRKLVTGAVETGH   986
              ++    TS   A +I S    T + I ++   I++    G    L+D    +T+          +  G
Sbjct: 710 FAIQ-NLTS---AGSIVSQINATNNQILIEAEKIRLKGKTLLD-ELTAIDGYFKRLFVGE   764

Query: 987 VKAGAITGVLLAAEAVTAEKLKVDQAFFNKLMANDAYLKQLFAKSAFITQVQSVTISASQ   1046
             +      ++ ++ +TA+KL +DQA        +++D +    L  AK AFI +++SV +SA+
Sbjct: 765 GTFAKLNAEIIGSKTITADKLIMDQAMARLFVSSDIFTDTLAAKEAFINKLRSVVVSATL   824

Query: 104 ISG                                                          1049
             G
Sbjct: 825 FEG                                                          827
```

A related DNA sequence was identified in *S. pyogenes* <SEQ ID 2501> which encodes the amino acid sequence <SEQ ID 2502>. Analysis of this protein sequence reveals the following:

Possible site: 25
>>> Seems to have no N-terminal signal sequence
----- Final Results -----
   bacterial cytoplasm --- Certainty = 0.2445 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

```
Identities = 143/552 (25%), Positives = 251/552 (44%), Gaps = 43/552 (7%)
Query:  11   TVKWNGIPLHEASSAIVKEETNGDFYLTVRYPITDSGIYQLIKEDMLIKSPVPVLGAQLF     70
             ++K +  PL  A    + +E N D+ L  +YP         LIK+ +++++  +  G+QLF
Sbjct:   3   SIKDDNTPLVAAFEDEITQEANSDYKLNFKYPAKHE-YRPLIKKGIILEAD-DLHGSQLF     60

Query:  71   RIKKPIENDDSMDITAYHVSDDIMKRSITPVSVVGQGCAMALSQMVQNAKTGLGDFSFTS    130
             RI +  +    +++ A  V+DD+    +I   +SV           +S++   +  K        FSF S
Sbjct:  61   RIFEITKRHGYINVYANQVADDLNGYAIDTISVDRVQGMTVMSELAGSIKRE-HPFSFFS    119

Query: 131   DIMDSRTFNTTETETLYSVLMDGKHSIVGTWEGELVRDNFALSIKRSRGADRGVVITTHK    190
             DI       TFN  ++   +     L  +GKHSI+G W  GELVR+  +  +++  +  G D    +     K
Sbjct: 120   DIDGRHTFNQSDVSVM-DALANGKHSIMGQWGGELVRNKYQINLLKKAGKDTETLEMYKK    178

Query: 191   NLKSYQRTKNSQGVVTRIH---------ARSTFKPDG------AEDEVTLRVSVDSPLI    234
             NLKSY+  T   +G+V+  +H                      +      DG       +   + T+RVSV+S L
Sbjct: 179   NLKSYEETDTIKGLVSILHLVAEVEEEHEVETREASDGNIGHSESPKKKTIRVSVESKLK    238

Query: 235   NSYPYINEK--EYENNNAETVEDLRKWAEAKFTNEGIDKVSDAIEIEAYELDGQVVNLGD    292
             +++P I EK    + ++ ++T EDL  + +  F        D    ++++I+              V L D
Sbjct: 239   DTHPIIVEKTIKVQDQDVKTEEDLLAYGKKYFEKTLCDIPGNSLKIDVTNNYEGAVRLFD    298

Query: 293   TVNLKSRKHSADLYKKAIAYEFNALTEEYISITFDDKPGVGGSGVSSGLSNVADAILVAS    352
             T   +    +    DL +      YF +          SI       G   + ++   +SN    D    + S
Sbjct: 299   TAIVFHELYDRDLRMQITGYRFAPMANRLKSIIF----GEIKTNLAKQISNQIDNKVAES    354

Query: 353   ATAQDVA----VQRAVKNANAAFDAEFGKTKTKINDDIEIAKAKVESFKSELSNR-MDNQ    407
                    D A      +Q+ +  NAN     FD +   K + +I  D   I+ A+A    E     +E++  +  ++ +
Sbjct: 355   TAQHDAAFEAKLQKQIDNANRIFDTKEAKLREEIEDGIKKAEANAEVKVAEVNAKVLEAE    414

Query: 408   LLPLATEAK-----NLASQAQADLTRKEIELRAELNRQVTSTEAVKISLTNLSHNMDIIK    462
                 L  A + +        + A   +D  +K E R L          + +    +L      + D +
Sbjct: 415   ELAKAVDERLKKFLSDADTKEQDFDKKLEEFRTSLKDLEVDEKQIDDALAKAGFSKDSLA    474

Query: 463   QKALNDLRDAETRLKEADSVQQL-ATKRVEDKLTGLSTKLESFSVGGYNYVIDGGEPKEL    521
                 +ET     A+  V       T        ++L G + K+  +F     GY  +      GE     E
Sbjct: 475   DIKAKLEDTSETATVTANIVGSTGGTFYNRNRLDGDTDKVITFE-QGYIDIAHNGEGFE-    532

Query: 522   MANFYGKTYDIN                                                  533
                        GKTY I+
Sbjct: 533   ----EGKTYTIS                                                  540
```

A related GBS gene <SEQ ID 8665> and protein <SEQ ID 8666> were also identified. Analysis of this protein sequence reveals the following:

Lipop Possible site: −1 Crend: 3
SRCFLG: 0
McG: Length of UR: 11
Peak Value of UR: 1.54
Net Charge of CR: 1
McG: Discrim Score: −3.43
GvH: Signal Score (−7.5): −5.44
Possible site: 58
>>> Seems to have no N-terminal signal sequence
Amino Acid Composition: calculated from 1
ALOM program    count: 1 value: −0.00 threshold: 0.0
INTEGRAL    Likelihood = −0.00    Transmembrane 897-913 (897-913)
PERIPHERAL    Likelihood = 1.48    932
modified ALOM score: 0.50
icml HYPID: 7 CFP: 0.100
*** Reasoning Step: 3
----- Final Results -----
   bacterial membrane --- Certainty = 0.1001 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the database:

```
32.8/53.9% over 503aa
EGAD|33685| hypothetical protein Insert characterized
EGAD|71773|76294 hypothetical protein { } Insert characterized
SP|P15317|YHYA_BPH44 HYPOTHETICAL 65 KDA PROTEIN IN HYALURONIDASE REGION. Insert
characterized
GP|215054|gb|AAA98102.1||M19348 ORF {Streptococcus pyogenes phage H4489A} Insert
characterized
PIR|B30566|B30566 hypothetical protein - phage H4489A Insert characterized
ORF00870(1957-3777 of 4272)
EGAD|33685|35003(37-540 of 593) hypothetical protein {Streptococcus pyogenes}
EGAD|71773|76294 hypothetical protein { } SP|P15317|YHYA_BPH44 HYPOTHETICAL 65 KDA PROTEIN
IN HYALURONIDASE REGION. GP|215054|gb|AAA98102.1||M19348 ORF {Streptococcus pyogenes phage
H4489A} PIR|B30566|B30566 hypothetical protein - Streptococcus pyogenes phage H4489A
% Match = 4.4
% Identity = 32.8 % Similarity = 53.8
Matches = 137 Mismatches = 175 Conservative Sub.s = 88

1749      1779      1809      1839      1869      1899      1929      1959
TRLKEADSVQQLATKRVEDKLTGLSTKLESFSVGGYNYVIDGGEPKELMANFYGKTYDINPQLLERTSQATLSFSYEAES
                                              ::         | :|  |              :
                                           MSRDPTYTINEHDLSFADGRFYVTFKADKSSETVRLN
                                              10        20        30

1989      2019      2049      2079      2109      2139
TSRLEVRLYKKMHTGDTSKITIIVMPNFDLSPGKGFISQSFDLGGVMPDPRNQAWLVMRGTNANPLTL------------
:| |    :  :||::  | |          |:   |   :       |:  |  |||       :
SSCLGNTIIKKLQVEDDNTMHDFVKPKVTTQQAFGLAQQVKELDLQLKDPKSDLWGKIKFNNKAMLVEYANKEMSSAIAQ
       50        60        70        80        90       100       110

2184      2214      2244
--------------------------------SKVKLERGTVATDWNNRDETLKASFAEYKQTVDE-------------
                                |:  |   :|:  :::|    |    |   ||:
SAEQILLQVKSIDDERYSKFEQTLNGIKQTVKSESVESARTQLASMFDSRISGLDGKYSRLSQTIDSLSSRLDDGVGNYS
       130       140       150       160       170       180       190

2271      2301      2331      2361      2388      2418      2448
-----------------NLANLRTSTETLAGQLTSAESSIRQTSESFSNRLVSLETY-KDSEPNRASRYFEASKSETAK
                 :::    |   |:|:|     |    |:|   :| |: | |
TLSQKVSGIDLRVSNAANDVSRLSQTAQGLQSQITNA----NQNYSSLSQTVQGLQTTVRDNQSNATSRI----------
       210       220       230       240       250       260

2478      2838      2868      2898      2928      2958      3009
QLSALRTEVN~~~~SFVANNANFRANSLKIRFTDSQLKFRVTTLRVTKGTIPADWSPSPDDLK-AYSDT--KLEQTANEI
              :||   :|  :||||   :     :  |  |   | |     :|||
------------------------------NQLSDLIST-KVTKGDVETTIAQSYDKIAFAIRDKLPASKMTGSEI
                                270       280       290       300

3039      3069      3099      3129      3159      3189      3213      3243
KASVTSLDHKTLKQTDITMTSEGIVLRAGKTSNDVARAIGSYFKVTPDAIALFSSLIKVSG-NMLVDG-SVTSRKLVTGA
:                             ||  |  |:|::    :|||  |  :||    :
IS-------------------------------------------AINLDRSGVKITGKNITLDGNSYISNAVIKDA
                                              320       330       340

3261      3291      3321      3351      3381      3411      3441      3471
----VETGHVKAGAITGVLLAAEAVTAEKLKVDQAFFNKLMANDAYLKQLFAKSAFITQVQSVTISASQISGGVIKALNN
    ::  | :    | :  ||||:| :|:|  ||||||| |||   |:||| ||: |||: ||  ||  ||| :
HIANMDAGKINTGYLNASRIAAEAITGDKIKMDYAFFNKLTANEGYFRTLFAKNIFTTSVQAVTTSASKITGGVLSATNG
       360       370       380       390       400       410       420

3501      3537      3567         3624      3648      3678
AMEIQMNSGQILYYTD--------QAALKRVLSGYPTQFVKFATGTVSG-KGNAGVTVIG--SNRYGTESTNDGGFVGVR
|   :||  | |  :      |      ||   ||   ||     |:  ||    ||   |: : |   || ||||
ASRWDLNSANIDFNRDATINFNSKNNALVRK-SGTNTAFVHFSNATPKGYRGSALYASIGITSSGDGIDSASSGRFCGVR
       440       450       460       470       480       490       500

3687      3717      3747      3777      3807      3837      3867      3897
-------AWNGSNIDSLDLVGDEIRLASSAFDNSDGWDVRTLDSGLKITPHNRAAERNSRIEVGDVWILKGNGSYSSLRD
       : :  :|   ::  ||:|  |   |: |    |: |   :|  :                        |
FFRYAEGLQHTAKVDQAEIYGDDI-VFSDDFNIDRGFKMRPSLMPKMVDLNKMYQAILALGRCWLHANNTAWSWNFDTRS
       520       530       540       550       560       570       580
```

A related DNA sequence was identified in *S. pyogenes* <SEQ ID 9059> which encodes amino acid sequence <SEQ ID 9060>. An alignment of the GAS and GBS sequences follows:

```
Score = 87.8 bits (214), Expect = 4e-19
Identities = 88/273 (32%), Positives = 133/273(48%), Gaps = 47/273 (17%)
Query: 370  AINLNSRGVQIAGKNIALDGNTT----VNGAF-------GAKLGEFI--------KLRAD   410
            AI L S  ++++G N+ +DG+ T    V GA        GA G +         KL+ D
Sbjct: 897  AIALFSSLIKVSG-NMLVDGSVTSRKLVTGAVETGHVKAGAITGVLLAAEAVTAEKLKVD   955

Query: 411  QIIGGTIDANKINVINLKASSIVGLDANFIKARISYAIT-DLLEGKVIKARNGAMTIDLQ   469
            Q      + AN   + L A S     FI   S  I+    + G VIKA N AM I +
Sbjct: 956  QAFFNKLMANDAYLKQLFAKSA------FITQVQSVTISASQISGGVIKALNNAMEIQMN  1009

Query: 470  SGQINHYTNESAMRRIDSSTASQFIKMTKSGFISEIGNMQAAMTVIGSNSDGSENHENKT   529
            SGQI +YT+++A++R+ S   +QF+K   +G +S  GN  A +TVIGSN  G+E+  +
Sbjct: 1010 SGQILYYTDQAALKRVLSGYPTQFVKFA-TGTVSGKGN--AGVTVIGSNRYGTESTNDGG  1066

Query: 530  FGGIRIWNGKSSYQSTSFVELVGN--RVAIYGNKNRSPWLFDSTTSGYAYLIPQNDRGIK   587
            F G+R WNG     +    ++LVG+  R+A   N      W   + SG    + P N
Sbjct: 1067 FVGVRAWNG----SNIDSLDLVGDEIRLASSAFDNSDGWDVRTLDSGLK-ITPHN-----  1116

Query: 588  HVIGRADRKIDQIHVGDIYV-QGERVAMMLKDL                             619
                  RA  +  +I VGD+++ +G         L+D+
Sbjct: 1117 ----RAAERNSRIEVGDVWILKGNGSYSSLRDI                            1145

Score = 31.3 bits (69), Expect = 0.038
Identities = 34/151 (22%), Positives = 62/151 (40%), Gaps = 13/151 (8%)
Query: 160  QNADKKLSASYQLGIDGLKATMRSDKIGLQAEIQTTAQGLYQRYDNEIRKLSAKITTISS   219
            Q  A K  +A++         K + D    +A++++      L  R DN++ L+ +   +S
Sbjct: 306  QRAVKNANAAFDAEFGKTKTKINDDIEIAKAKVESFKSELSNRMDNQLLPLATEAKNLAS   365

Query: 220  GTTEAYESKLDGLRAEFTH---SNQGMRVELES--------KISGLQSTQQATARQISQE   268
                K    LRAE      S + +++ L +        K L  + A R + +
Sbjct: 366  QAQADLTRKEIELRAELNRQVTSTEAVKISLTNLSHNMDIIKQKALNDLRDAETR-LKEA   424

Query: 269  ISNREGAVSRVQQGLDSYQRRLQS-AEGNYN                              298
            S ++ A  RV+  L     +L+S + G YN
Sbjct: 425  DSVQQLATKRVEDKLTGLSTKLESFSVGGYN                              455
```

Figure 50:
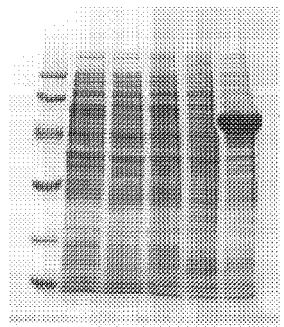

SEQ ID 8666 (GBS202) was expressed in *E. coli* as a His-fusion product. SDS-PAGE analysis of total cell extract is shown in FIG. 50 (lane 5; MW 132 kDa).

Based on this analysis, it was predicted that these proteins and their epitopes could be useful antigens for vaccines or diagnostics.

Example 827

A DNA sequence (GBSx0877) was identified in *S. agalactiae* <SEQ ID 2503> which encodes the amino acid sequence <SEQ ID 2504>. This protein is predicted to be nuclear/mitotic apparatus protein. Analysis of this protein sequence reveals the following:

Possible site: 22
>>> Seems to have no N-terminal signal sequence
----- Final Results -----
   bacterial cytoplasm --- Certainty = 0.2847 (Affirmative) <succ>
    bacterial membrane --- Certainty = 0.0000 (Not Clear) <succ>
     bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 828

A DNA sequence (GBSx0879) was identified in *S. agalactiae* <SEQ ID 2505> which encodes the amino acid sequence <SEQ ID 2506>. Analysis of this protein sequence reveals the following:

Possible site: 23
>>> Seems to have no N-terminal signal sequence
----- Final Results -----
   bacterial cytoplasm --- Certainty = 0.3420 (Affirmative) <succ>
    bacterial membrane --- Certainty = 0.0000 (Not Clear) <succ>
     bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 829

A DNA sequence (GBSx0880) was identified in *S. agalactiae* <SEQ ID 2507> which encodes the amino acid sequence <SEQ ID 2508>. Analysis of this protein sequence reveals the following:

Possible site: 13
>>> Seems to have an uncleavable N-term signal seq
INTEGRAL Likelihood = −7.54 Transmembrane 10-26 (2-28)
----- Final Results -----
  bacterial membrane --- Certainty = 0.4015 (Affirmative) <succ>
    bacterial outside --- Certainty = 0.0000 (Not Clear) <succ>
      bacterial cytoplasm--- Certainty = 0.0000 (Not Clear) <succ>

The protein has homology with the following sequences in the GENPEPT database.

```
>GP:CAB07984 GB:Z93946 hypothetical protein [bacteriophage Dp-1]
Identities = 67/136 (49%), Positives = 91/136 (66%)
Query:   1   MPPWLIDSTVVVAMVTVLGGLFSTIITTSANRKDQLIKHUEDIKEDLSGLIDKVKTIDH    60
             MP WL D+ V+ ++T   G+ + ++      K    K EDI    LS L  +V ID
Sbjct:   1   MPMWLNDTAVLTTIITACSGVLTVLLNKLFEWKSNKAKSVLEDISTTLSTLKQQVDGIDQ   60

Query:  61   TTTETKKISEITKDGTLKIQRYRLFHDLTKEISQGYTTIEHFRELSILFESYQLLGGNGE  120
             TT     +++ +DGT KIQRYRL+HDL +E+  GYTT++HFRELSILFESY+ LGGNGE
Sbjct:  61   TTVAINHQNDVIQDGTRKIQRYRLYHDLKREVITGYTTLDHFRELSILFESYKNLGGNGE  120

Query: 121   IEALFEKFKQLPIEED                                              136
             +EAL+EK+K+LPI E+
Sbjct: 121   VEALYEKYKKLPIREE                                              136
```

No corresponding DNA sequence was identified in *S. pyogenes*.

SEQ ID 2508 (GBS118) was expressed in *E. coli* as a GST-fusion product. SDS-PAGE analysis of total cell extract is shown in FIG. 32 (lane 5; MW 42 kDa).

GBS118-GST was purified as shown in FIG. 198, lane 8.

Based on this analysis, it was predicted that this protein and its epitopes, could be useful antigens for vaccines or diagnostics.

Example 830

A DNA sequence (GBSx0882) was identified in *S. agalactiae* <SEQ ID 2509> which encodes the amino acid sequence <SEQ ID 2510>. Analysis of this protein sequence reveals the following:

Possible site: 53
>>> Seems to have a cleavable N-term signal seq.
----- Final Results -----
  bacterial outside --- Certainty = 0.3000 (Affirmative) <succ>
    bacterial membrane --- Certainty = 0.0000 (Not Clear) <succ>
      bacterial cytoplasm --- Certainty = 0.0000 (Not Clear) <succ>

The protein has no significant homology with any sequences in the GENPEPT database.

No corresponding DNA sequence was identified in *S. pyogenes*.

A related GBS gene <SEQ ID 8667> and protein <SEQ ID 8668> were also identified. Analysis of this protein sequence reveals the following:

Lipop: Possible site: −1 Crend: 5
McG: Discrim Score: 6.58
GvH: Signal Score (−7.5) : −0.49
Possible site: 53
>>> Seems to have a cleavable N-term signal seq.
ALOM program count: 0   value: 12.15   threshold: 0.0
PERIPHERAL Likelihood = 12.15    84
modified ALOM score: −2.93

*** Reasoning Step: 3
----- Final Results -----
  bacterial outside --- Certainty = 0.3000 (Affirmative) <succ>
    bacterial membrane --- Certainty = 0.0000 (Not Clear) <succ>
      bacterial cytoplasm --- Certainty = 0.0000 (Not Clear)

Figure 21:
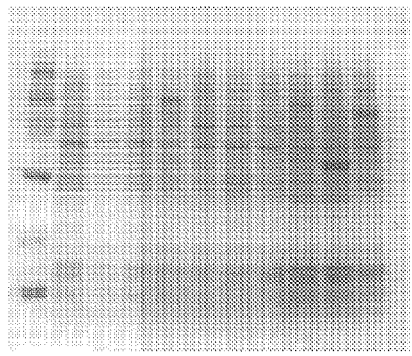

SEQ ID 2510 (GBS56) was expressed in *E. coli* as a His-fusion product. SDS-PAGE analysis of total cell extract is shown in FIG. 17 (lane 8; MW 9.9 kDa). It was also expressed in *E. coli* as a GST-fusion product. SDS-PAGE analysis of total cell extract is shown in FIG. 21 (lane 10; MW 34.9 kDa).

Figure 195:
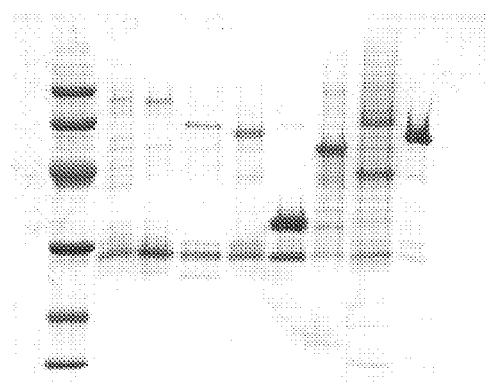

GBS56-GST was purified as shown in FIG. 195, lane 7.

Example 831

A DNA sequence (GBSx0883) was identified in *S. agalactiae* <SEQ ID 2511> which encodes the amino acid sequence <SEQ ID 2512>. Analysis of this protein sequence reveals the following:

Possible site: 40
>>> Seems to have a cleavable N-term signal seq.
----- Final Results -----
  bacterial outside --- Certainty = 0.3000 (Affirmative) <succ>
    bacterial membrane --- Certainty = 0.0000 (Not Clear) <succ>
      bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Based on this analysis, it was predicted that these proteins and their epitopes could be useful antigens for vaccines or diagnostics.

Example 832

A DNA sequence (GBSx0884) was identified in *S. agalactiae* <SEQ ID 2513> which encodes the amino acid sequence <SEQ ID 2514>. This protein is predicted to be N-acetylmuramoyl-L-alanine amidase. Analysis of this protein sequence reveals the following:

Possible site: 53
>>> Seems to have no N-terminal signal sequence

```
----- Final Results -----
    bacterial cytoplasm --- Certainty = 0.0342 (Affirmative) <succ>
    bacterial membrane --- Certainty = 0.0000 (Not Clear) <succ>
        bacterial outside --- Certainty = 0.0000 (Not Clear) <succ>
```

The protein has homology with the following sequences in the GENPEPT database.

```
>GP:CAB07986 GB:Z93946 N-acetylmuramoyl-L-alanine amidase [bacteriophage Dp-1]
Identities = 96/141 (68%), Positives = 118/141 (83%)
Query:   1    MEINTEIAIAWMSARQGKVSYSMDYRDGPNSYDCSSSVYYALRSAGASSAGWAVNTEYMH    60
              M ++ E   +AWM AR+G+VSYSMD+RDGP+SYDCSSS+YYALRSAGASSAGWAVNTEYMH
Sbjct:   1    MGVDIEKGVAWMQARKGRVSYSMDFRDGPDSYDCSSSMYYALRSAGASSAGWAVNTEYMH    60

Query:  61    DWLIKNGYELIAENVDWNAVRGDIAIWGMRGHSSGAGGHVVMFIDPENIIHCNWANNGIT   120
                WLI+NGYELI+EN   W+A RGDI IWG +G S+GAGGH  MFID +NIIHCN+A +GI+
Sbjct:  61    AWLIENGYELISENAPWDAKRGDIFIWGRKGASAGAGGHTGMFIDSDNIIHCNYAYDGIS   120

Query: 121    VNNYNQTAAASGWMYCYVYRL                                         141
              VN++++    +G  Y YVYRL
Sbjct: 121    VNDHDERWYYAGQPYYYVYRL                                         141
```

No corresponding DNA sequence was identified in *S. pyogenes*.

A related GBS gene <SEQ ID 8669> and protein <SEQ ID 8670> were also identified. Analysis of this protein sequence reveals the following:

RGD motif 81-83

Figure 302:
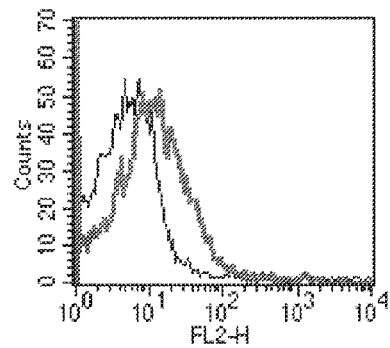

The protein has homology with the following sequences in the databases:

was used for FACS (FIG. 302), which confirmed that the protein is immunoaccessible on GBS bacteria.

Based on this analysis, it was predicted that these proteins and their epitopes could be useful antigens for vaccines or diagnostics.

Example 833

A DNA sequence (GBSx0885) was identified in *S. agalactiae* <SEQ ID 2515> which encodes the amino acid sequence <SEQ ID 2516>. Analysis of this protein sequence reveals the following:

```
58.2/72.9% over 182aa
GP|1934766| N-acetylmuramoyl-L-alanine amidase {bacteriophage Dp-1} Insert characterized
ORF00875(301-1044 of 2004)
GP|1934766|emb|CAB07986.1||Z93946(1-183 of 296) N-acetylmuramoyl-L-alanine amidase
{bacteriophage Dp-1}
% Match = 15.5
% Identity = 58.2 % Similarity = 72.8
Matches = 107 Mismatches = 49 Conservative Sub.s = 27

234       264       294       324       354       384       414       444
LQKYNIHMSDDDLTLFVESAVKQMHDAWKE*PMEINTEIAIAWMSARQGKVSYSMDYRDXPNSYDCSSSVYYALRSAGAS
                              | :: |  :|||  ||:|:|||||||:||  |:|||||||||:|||||||||
                              MGVDIEKGVAWMQARKGRVSYSMDFRDGPDSYDCSSSMYYALRSAGAS
                                  10        20        30        40

474       504       534       564       594       624       654       684
SAGWAVNTEYMHDWLIKNGYELIAENVDWNAVRGDIAIWGMRGHSSGAGGHVVMFIDPENIIHCNWANNGITVNNYNQTA
||||||||||||||  |||:|||||:||    |:|  ||||  |||  |  |:  ||||  |:||||||:|  :||:||::::
SAGWAVNTEYMHAWLIENGYELISENAPWDAKRGDIFIWGRKGASAGAGGHTGMFIDSDNIIHCNYAYDGISVNDHDERW
         60        70        80        90       100       110       120

714       744       774       804       834       864       894       924
AASGWMYCYVYRLKSGASTQGKSLDTLVKETLAGNYGNGEARKAVLGNQYEAVMSVINGKTTTNQKTVDQLVQEVIAGKH
  :|  |  |||||  :
YYAGQPYYYVYRLTNA------------------------------------------------------------
         140

954       984      1014      1044      1074      1104      1134      1164
GNGEARKKSLGSQYDAVQKRVTELLKKQPSEPPFKAQEVNKPTETKTSQTELTGQATATKEEGDLSFNGTILKKAVLDKIL
 |  : :|| ||  | ||           |  : |:   ||           | : |:   |            |  :  |   :
-NAQPAEKKLGWQKDATGFWYARANGTYPKDEFEYIEENKSWFYFDDQGYMLAEKWLKHTDGNWYWFDRDGYMATSWKRI
          160       170       180       190       200       210       220
```

SEQ ID 8670 (GBS302) was expressed in *E. coli* as a His-fusion product. SDS-PAGE analysis of total cell extract is shown in FIG. 50 (lane 6; MW 55 kDa).

The GBS302-His fusion product was purified (FIG. 205, lane 6) and used to immunise mice. The resulting antiserum Possible site: 38
>>> Seems to have no N-terminal signal sequence
----- Final Results -----
    bacterial cytoplasm --- Certainty = 0.1509 (Affirmative) <succ> bacterial membrane --- Certainty = 0.0000 (Not Clear) <succ>
bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 834

A DNA sequence (GBSx0886) was identified in *S. agalactiae* <SEQ ID 2517> which encodes the amino acid sequence <SEQ ID 2518>. Analysis of this protein sequence reveals the following:

Possible site: 19
>>> Seems to have no N-terminal signal sequence
----- Final Results -----
bacterial cytoplasm --- Certainty = 0.1264 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:CAB13473 GB:Z99112 similar to hypothetical proteins [Bacillus subtilis]
Identities = 25/68 (36%), Positives = 41/68 (59%)
Query:  4  IENLIIAIVKPLISQPDQLTIKIQDGPEFLEYHLDLDTQDIGRVIGKKGRTITAIRSIVY  63
           +E+LI+ IV PL+  PD + +  ++  + +    L +    D G+VIGK+GRT  AIR+ V+
Sbjct:  6  LEDLIVHIVTPLVDHPDDIRVIREETDQKIALRLSVHKSDTGKVIGKQGRTAKAIRTAVF  65

Query: 64  SVPTQGKK                                                      71
           +   Q K
Sbjct: 66  AAGVQSSK                                                      73
```

A related DNA sequence was identified in *S. pyogenes* <SEQ ID 2519> which encodes the amino acid sequence <SEQ ID 2520>. Analysis of this protein sequence reveals the following:

Possible site: 19
>>> Seems to have no N-terminal signal sequence
----- Final Results -----
bacterial cytoplasm --- Certainty = 0.1012 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 72/79 (91%), Positives = 75/79 (94%)
Query:  1  MDTIENLIIAIVKPLISQPDQLTIKIQDGPEFLEYHLDLDTQDIGRVIGKKGRTITAIRS  60
           MDTIENLIIAIVKPLISQPD LTIKI+D P+FLEYHLDLD QDIGRVIGKKGRTITAIRS
Sbjct:  1  MDTIENLIIAIVKPLISQPDNLTIKIEDTPDFLEYHLDLDAQDIGRVIGKKGRTITAIRS  60

Query: 61  IVYSVPTQGKKVRLIIDEK                                            79
           IVYSVPT GKKVRL+IDEK
Sbjct: 61  IVYSVPTLGKKVRLVIDEK                                            79
```

Based on this analysis, it was predicted that these proteins and their epitopes could be useful antigens for vaccines or diagnostics.

Example 835

A DNA sequence (GBSx0887) was identified in *S. agalactiae* <SEQ ID 2521> which encodes the amino acid sequence <SEQ ID 2522>. This protein is predicted to be ribosomal protein S16 (rpsP). Analysis of this protein sequence reveals the following:

Possible site: 45
>>> Seems to have no N-terminal signal sequence
----- Final Results -----
bacterial cytoplasm --- Certainty = 0.3654 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:BAB06202 GB:AP001515 ribosomal protein S16 (BS17) [Bacillus halodurans]
Identities = 62/90 (68%), Positives = 73/90 (80%)
Query:  1  MAVKIRLTRMGSKKKPFYRINVADSRAPRDGRFIETVGTYNPLVAENQVTIKEERVLEWL  60
           MAVKIRL RMGSKK PFYR+ VADSR+PRDGRFIE +GTYNPL   +V +KE+R L+W+
Sbjct:  1  MAVKIRLKRMGSKKAPFYRVVVADSRSPRDGRFIEEIGTYNPLTQPAKVELKEDRALDWM  60

Query: 61  SKGAQPSDTVRNLLSKAGVMTKFHDQKFSK                               90
           KGA+PSDTVRNL SKAG+M K H+ K  K
Sbjct: 61  LKGAKPSDTVRNLFSKAGLMEKLHNAKNEK                               90
```

A related DNA sequence was identified in *S. pyogenes* <SEQ ID 2523> which encodes the amino acid sequence <SEQ ID 2524>. Analysis of this protein sequence reveals the following:

Possible site: 45
>>> Seems to have no N-terminal signal sequence
----- Final Results -----
   bacterial cytoplasm --- Certainty = 0.3654 (Affirmative) <succ>
   bacterial membrane --- Certainty = 0.0000 (Not Clear) <succ>
      bacterial outside --- Certainty = 0.0000 (Not Clear) <succ>

Possible site: 35
>>> Seems to have no N-terminal signal sequence
INTEGRAL Likelihood = –11.09  Transmembrane 22-38 (16-42)
INTEGRAL Likelihood = –7.64   Transmembrane 382-398 (375-402)
INTEGRAL Likelihood = –7.59   Transmembrane 291-307 (284-317)
INTEGRAL Likelihood = –4.94   Transmembrane 340-356 (335-366)
----- Final Results -----
   bacterial membrane --- Certainty = 0.5437 (Affirmative) <succ>
      bacterial outside --- Certainty = 0.0000 (Not Clear) <succ>
         bacterial cytoplasm --- Certainty = 0.0000 (Not Clear) <succ>

An alignment of the GAS and GBS proteins is shown below.

The protein has homology with the following sequences in the GENPEPT database.

```
Identities = 86/90 (95%), Positives = 89/90 (98%)
Query:  1  MAVKIRLTRMGSKKKPFYRINVADSRAPRDGRFIETVGTYNPLVAENQVTIKEERVLEWL  60
           MAVKIRLTRMGSKKKPFYRINVADSRAPRDGRFIETVGTYNPLVAENQ+TIKE+RVLEWL
Sbjct:  1  MAVKIRLTRMGSKKKPFYRINVADSRAPRDGRFIETVGTYNPLVAENQITIKEDRVLEWL  60

Query: 61  SKGAQPSDTVRNLLSKAGVMTKFHDQKFSK                               90
           SKGAQPSDTVRN+LSKAGVM KFHDQKFSK
Sbjct: 61  SKGAQPSDTVRNLLSKAGVMTKFHDQKFSK                               90
```

Based on this analysis, it was predicted that these proteins and their epitopes could be useful antigens for vaccines or diagnostics.

Example 836

A DNA sequence (GBSx0888) was identified in *S. agalactiae* <SEQ ID 2525> which encodes the amino acid sequence <SEQ ID 2526>. Analysis of this protein sequence reveals the following:

```
>GP:AAC24912 GB:AF012285 YknZ [Bacillus subtilis]
Identities =  161/417 (38%), Positives = 241/417 (57%), Gaps = 25/417 (5%)
Query:   1  MENWKFALSSILGHKMRAFLTMLGIIIGVASVVLIMALGKGMKDSVTNEITKSQKNLQIY   60
            +EN + ALSS+L HKMR+ LTMLGIIIGV SV++++A+G+G +   +   I+      +++Y
Sbjct:   4  LENIRMALSSVLAHKMRSILTMLGIIIGVGSVIVVVAVGQGGEQMLKQSISGPGNTVELY   63

Query:  61  YKTKEDQ-KNEDNFGAQGAFMQGSDTNRKEPIIQESWLKKIAKEVDGVSGYYVTNQTNAP  119
            Y    +++   +  N  A+  F   +                 K   K ++G+    +    +
Sbjct:  64  YMPSDEELASNPNAAAESTFTENDI--------------KGLKGIEGIKQVVASTSESMK  109

Query: 120  VAYLEKKAKTVNITGINRTYLGIKKFKIKSGRQFQEEDYNQFSRVILLEEKLAQRLFQTN  179
                Y E++     + GIN  Y+ +    KI+SGR F + D+    +RV ++ +K+A+ LF
Sbjct: 110  ARYHEEETDAT-VNGINDGYMNVNSLKIESGRTFTDNDFLAGNRVGIISQKMAKELFDKT  168

Query: 180  EAALNKVVTVKNKSYLVVGVYSDPEAGSGLYGSNSDGNAILTNTQLASEFGAKEAENIYF  239
             + L +VV +   ++GV     +GL +           + N  +  S FG   +  N+
Sbjct: 169  -SPLGEVVWINGQPVEIIGVLKKV---TGLLSFDLSEMYVPFN-MMKSSFGTSDFSNVSL  223
```

-continued
```
Query: 240  HLNDVSQSNRIGKEIGKRLTDISHAKDGYYDNFDMTSIVKSINTQVGIMTGVIGAIAAIS  299
            +           GKE  + + D +H  + Y  +M  I   I     IMT +IG+IA IS
Sbjct: 224  QVESADDIKSAGKEAAQLVND-NHGTEDSYQVMNMEEIAAGIGKVTAIMTTIIGSIAGIS  282

Query: 300  LLVGGIGVMNIMLVSVTERTREIGLRKALGATRRKILAQFLIESMVLTILGGLIGLLLAY  359
            LLVGGIGVMNIMLVSVTERTREIG+RK+LGATR +IL QFLIES+VLT++GGL+G+ + Y
Sbjct: 283  LLVGGIGVMNIMLVSVTERTREIGIRKSLGATRGQILTQFLIESVVLTLIGGLVGIGIY  342

Query: 360  GGTMLIANAQDKITPS-VSLNVAIGSLIFSAFIGIIFGLLPANKASKLNPIDALRYE     415
            GG L++         PS +S   V  G ++FS  IG+IFG+LPANKA+KL+PI+ALRYE
Sbjct: 343  GGAALVSAIAG--WPSLISWQVVCGGVLFSMLIGVIFGMLPANKAAKLDPIEALRYE    397
```

There is also homology to SEQ ID 1350.

Based on this analysis, it was predicted that this protein and its epitopes, could be useful antigens for vaccines or diagnostics.

Example 837

A DNA sequence (GBSx0889) was identified in *S. agalactiae* <SEQ ID 2527> which encodes the amino acid sequence <SEQ ID 2528>. This protein is predicted to be ABC transporter (ATP-bindingprot). Analysis of this protein sequence reveals the following:

Possible site: 52
>>> Seems to have no N-terminal signal sequence
----- Final Results -----
   bacterial cytoplasm --- Certainty = 0.4080 (Affirmative) <succ>
    bacterial membrane --- Certainty = 0.0000 (Not Clear) <succ>
     bacterial outside --- Certainty = 0.0000 (Not Clear) <succ>

The protein has homology with the following sequences in the GENPEPT database.

```
>GP:BAB06841 GB:AP001517 ABC transporter (ATP-binding protein)
[Bacillus halodurans]
Identities = 131/218 (60%), Positives = 169/218 (77%)
Query: 8    LIRLHQIVKSYQNGDQKLQVLKNIDLIVYEGEFLAIMGPSGSGKSTLMNIIGLLDSPTSG  67
            +I+L ++ KS++ G + +++L  IDL +   G+FLAIMGPSGSGKSTLMNIIG LD PTSG
Sbjct: 1    MIKLERVTKSFRVGTEMVEILSAIDLEIASGDFLAIMGPSGSGKSTLMNIIGCLDQPTSG  60

Query: 68   DYSLNGKRVEELSQTKLAQVRNKEIGFVFQQFFLLSKLTALQNVELPLIYAGVPPKKRKN  127
              Y  +GK +     S+ ++A++RN+  IGFVFQQF LL +LTALQNVELP++YAG+   K+R
Sbjct: 61   RYMFDGKDLTNYSEQEIAKIRNRHIGFVFQQFHLLPRLTALQNVELPMVYAGMKKKERTE  120

Query: 128  LAKQFLDKVELRERMNHLPTELSGGQKQRVAIARALVNSPSIILADEPTGALDTKTGEQI  187
                A    L++V L ERM +LP  LSGGQKQRVAIAR++VN P+IILADEPTGALDTKT  E I
Sbjct: 121  RAAHALERVGLAERMTYLPNSLSGGQKQRVAIARSIVNEPNIILADEPTGALDTKTSETI  180

Query: 188  MQFLTELNQEGKTIIMVTHEPEIADYATRKIVIRDGEI                      225
            M+ L   LN EG TI +VTHEPEIA+Y  + +  +RDG+I
Sbjct: 181  MELLCSLNNEGTTIALVTHEPEIAEYTQQTVEVRDGQI                       218
```

A related DNA sequence was identified in *S. pyogenes* <SEQ ID 2529> which encodes the amino acid sequence <SEQ ID 2530>. Analysis of this protein sequence reveals the following:

Possible site: 52
>>> Seems to have no N-terminal signal sequence
----- Final Results -----
   bacterial cytoplasm --- Certainty.0.1739 (Affirmative) <succ>
    bacterial membrane --- Certainty = 0.0000 (Not Clear) <succ>
     bacterial outside --- Certainty = 0.0000 (Not Clear) <succ>

An alignment of the GAS and GBS proteins is shown below.

```
Identities = 182/232 (78%), Positives = 207/232 (38%)
Query: 5    RKELIRLHQIVKSYQNGDQKLQVLKNIDLTVYEGEFLAIMGPSGSGKSTLMNIIGLLDSP  64
            +K+L++L    IVKSYQNGDQ L+VLK  I+LTVYEGEFLAIMGPSGSGKSTLMNIIGLLD P
Sbjct: 5    KKQLMQLSNIVKSYQNGDQVLKVLKGINLTVYEGEFLAIMGPSGSGKSTLMNIIGLLDRP  64

Query: 65   TSGDYSLNGERVEELSQTKLAQVRNKEIGFVFQQFFLLSKLTALQNVELPLIYAGVPPKK  124
            TSGDY+L+  ++E L+   +LA+VRN  EIGFVFQQFFLL+KLTALQNVELPLIYAGV    K
Sbjct: 65   TSGDYTLHNTKIEILNDRELAKVANDEIGFVFQQFFLLAKLTALQNVELPLIYAGVNVSK  124
```

-continued
```
Query: 125  RKNLAKQFLDKVELRERMNHLPTELSGGQKQRVAIARALVNSPSIILADEPTGALDTKTG 184
            R+  AKQFL+KV L  R+ HLP+ELSGGQKQRVAIARALVN PSIILADEPTGALDTKTG
Sbjct: 125  RREQAKQFLEKVGLGRRIKHLPSELSGGQKQRVAIARALVNDPSIILADEPTGALDTKTG 184

Query: 185  EQIMQFLTELNQEGKTIIMVTHEPEIADYATRKIVIRDGEITADTTDSIRID         236
            +QIM+ LTELN+EGKTIIMVTHEPEIAD+ATRKI+IRDG+IT DTT S+ ID
Sbjct: 185  QQIMELLTELNKEGKTIIMVTHEPEIADFATRKIIIRDGDITTDTTASVVID         236
```

Based on this analysis, it was predicted that these proteins and their epitopes could be useful antigens for vaccines or diagnostics.

Example 838

A DNA sequence (GBSx0890) was identified in *S. agalactiae* <SEQ ID 2531> which encodes the amino acid sequence <SEQ ID 2532>. This protein is predicted to be ATP-binding cassette transporter-like protein. Analysis of this protein sequence reveals the following:

Possible site: 37
>>> Seems to have no N-terminal signal sequence
INTEGRAL Likelihood = –8.97 Transmembrane 17-33 (13-39)
----- Final Results -----
    bacterial membrane --- Certainty = 0.4588 (Affirmative) <succ>
        bacterial outside --- Certainty = 0.0000 (Not Clear) <succ>
            bacterial cytoplasm --- Certainty = 0.0000 (Not Clear) <succ>

A related GBS nucleic acid sequence <SEQ ID 9965> which encodes amino acid sequence <SEQ ID 9966> was also identified.

The protein has homology with the following sequences in the GENPEPT database.

A related DNA sequence was identified in *S. pyogenes* <SEQ ID 2533> which encodes the amino acid sequence <SEQ ID 2534>. Analysis of this protein sequence reveals the following:

Possible site: 42
>>> Seems to have an uncleavable N-term signal seq
INTEGRAL Likelihood = –9.61 Transmembrane 15-31 (11-36)
----- Final Results -----
    bacterial membrane --- Certainty = 0.4843 (Affirmative) <succ>
        bacterial outside --- Certainty = 0.0000 (Not Clear) <succ>
            bacterial cytoplasm--- Certainty = 0.0000 (Not Clear) <succ>

The protein has homology with the following sequences in the databases:

```
>GP:AAC24909 GB:AF012285 YknX [Bacillus subtilis]
Identities = 104/391 (26%), Positives = 182/391 (45%), Gaps = 21/391 (5%)
Query:  13  KKGAIISGLSVALIVVIGGFLWVQSQPNKSAVKTNYKVFNVREGSVSSSTLLTGKAKANQ  72
            KK  I  G++V + + +G  ++  + P  +      + +V E  +SS+ ++  G  K +
Sbjct:   2  KKVWIGIGIAVIVALFVGINIYRSAAPTSGSAGKEVQTGSVEENEISSTVMVPGTLKFSN  61

Query:  73  EQYVYFDANKGNRATVTVKVGDKITAGQQLVQYDTTTAQAAYDTANRQLNKVARQINNLK 132
            EQYV+++A+KG   + VK GDK+  G  LV Y T   Q + +    QL  + ++   +
Sbjct:  62  EQYVFYEADKGTLEDIKVKEGDKVKKGTALVTY--TNEQLSLEKEQNQLTSESNRLQIDQ 119

Query: 133  TTGSLPAMESSDQSSSSSQGQGTQSTSGATNRLQQNYQSQANASYNQQLQDLNDAYADAQ 192
                L A++S ++       G+        + R +  Q +           +L     Q
Sbjct: 120  IQEKLKALDSKERELEKQVGKKEAEKQIESERTELQMQKKTAEI------ELKQTELQRQ 173

Query: 193  AEVNKAQKALNDTVITSDVSGTVVEVNSDIDPASKTSQV---LVHVATEGKLQVQGTMSE 249
             +  N+    ++D  S++ GTV+ VN    + ASK S +     ++H+      L V G +SE
Sbjct: 174  SLANR----VSDLEVKSEIEGTVISVNQ--EAASKESDIQEPVIHIGNPKDLVVSGKLSE 227

Query: 250  YDLANVKKDQAVKIKSKVYPDKEWEGKISYISNYPEAEANNNDSNNGSSAVNYKYKVDIT 309
            YD   VKK Q V + S V    K W+G +S +   P+ +  +  + +    AV Y  +V I
Sbjct: 228  YDTLKVKKGQKVTLTSDVIQGKTWKGTVSAVGLVPD-QQESAAAQGTEQAVQYPLQVKIK 286

Query: 310  SPLDALKQGFTVSVEV-VNGDKHLIVPTSSVINKDNKHFVWVYNDSNRKISKVEVKIGKA 368
              L    K GF + + +    K   +P+ +V  +D++++V+     D   K   +V+KIG+
Sbjct: 287  GNLPEGKPGFKFIMNIETDKRKANTLPSKAVKKEDDQYYVYTVKDG--KAKRVDVKIGEV 344

Query: 369  DAKTQEILSGLKAGQIVVTNPSKTFKDGQKI                              399
                EI  GL      V+ NPS   DG ++
Sbjct: 345  TDDLTEIKEGLTQDDQVILNPSDQVTDGMEV                              375
```

```
>GP:AAC24909 GB:AF012285 YknX [Bacillus subtilis]
Identities = 103/380 (27%), Positives = 180/380 (47%), Gaps = 21/380 (5%)
Query:  16   ITASVITLVLIITGIVLWKQQRNTLTADIAKEPYSTVSVTEGSIASSTLLSGTVKALSEE   75
              I   +  +V +  GI +++     T +    A +     T SV E  I+S+ ++ GT+K +E+
Sbjct:   6   IGIGIAVIVALFVGINIYRSAAPT--SGSAGKEVQTGSVEENEISSTVMVPGTLKFSNEQ   63

Query:  76   YIYFDANKGNDATVTKVGDQVTQGQQLVQYNTTTAQSAYDTAVRSLNKIGRQINHLKTY  135
              Y++++A+KG       + VK GD+V +G   LV Y   T   Q + +    + N++     +N L+
Sbjct:  64   YVFYEADKGTLEDIKVKEGDKVKKGTALVTY--TNEQLSLE---KEQNQLTSESNRLQID  118

Query: 136   GVPAVSTETNRDEATGEETTTTVQPSAQ-QNANYKQQLQDLNDAYADAQAEVNKAQIA--  192
               +       + E   E+         + Q ++   + Q+Q            Q E+ +   +A
Sbjct: 119   QIQEKLKALDSKERELEKQVGKKEAEKQIESERTELQMQKKTAEIELKQTELQRQSLANR  178

Query: 193   LNDTVVISSVSGTVVEVNND-IDPSSKNSQTLVHVATEGQLQVKGTLTEYDLANVKVGQS  251
               ++D   V S + GTV+ VN +        S  + ++H+      L V G L+EYD     VK GQ
Sbjct: 179   VSDLEVKSEIEGTVISVNQEAASKKSDIQEPVIHIGNPKDLVVSGKLSEYDTLKVKKGQK  238

Query: 252   VKIKSKVYSNQEWTGKISYVSNYPTESNAGSTTPAGSTGAGSSTGATYDYKIDIISPLNQ  311
               V + S V    + W G +S V   P + +          + G+       Y  ++ I    L +
Sbjct: 239   VTLTSDVIQGKTWKGTVSAVGLVPDQQES-------AAAQGTEQAVQYPLQVKIKGNLPE  291

Query: 312   LKQGFTVSVEVVNEAKQA-LVPLTAVIKKDKKHYVWTYDDATGKAKKVEVTLGNADAQQQ  370
                K GF  + +  + ++A  +P   AV K+D ++YV+T  D   GKAK+V+V +G
Sbjct: 292   GKPGFKFIMNIETDKRKANTLPSKAVKKEDDQYYVYTVKD--GKAKRVDVKIGEVTDDLT  349

Query: 371   EIHKGVAVGDIVIANPDKNI                                          390
              EI +G+    D VI NP +
Sbjct: 350   EIKEGLTQDDQVILNPSDQV                                          369
```

An alignment of the GAS and GBS proteins is shown below.

```
Identities = 234/421 (55%), Positives = 301/421 (700), Gaps = 19/421 (4%)
Query:   3   MSKRQNLGISKKGAIISGLSVALIVVIGGF-LWVQSQPNKSA--VKTNYKVFNVREGSVS   59
              MSKR  + I+ K  +I+    + L+++I G  LW Q +    +A   K   Y    +V EGS++
Sbjct:   1   MSKRGKIKITTKTKLITASVITLVLIITGIVLWKQQRNTLTADIAKEPYSTVSVTEGSIA   60

Query:  60   SSTLLTGKAKANQEQYVYFDANKGNRATVTVKVGDKITAGQQLVQYDTTTAQAAYDTANR  119
              SSTLL+G  KA   E+Y+YFDANKGN ATVTVKVGD++T GQQLVQY+TTTAQ+AYDTA R
Sbjct:  61   SSTLLSGTVKALSEEYIYFDANKGNDATVTVKVGDQVTQGQQLVQYNTTTAQSAYDTAVR  120

Query: 120   QLNKVARQINNLKTTGSLPAMESSDQSSSSSQGQGTQSTSGATNRLQQNYQSQANASYNQ  179
               LNK+ RQIN+LKT G +PA+ S++ +    + G+ T +T     +       +Q NA+Y Q
Sbjct: 121   SLNKIGRQINHLKTYG-VPAV-STETNRDEATGEETTTTVQPS--------AQQNANYKQ  170

Query: 180   QLQDLNDAYADAQAEVNKAQKALNDTVITSDVSGTVVEVNSDIDPASKTSQVLVHVATEG  239
               QLQDLNDAYADAQAEVNKAQ  ALNDTV+ S  VSGTVVEVN+DIDP+SK SQ LVHVATEG
Sbjct: 171   QLQDLNDAYADAQAEVNKAQIALNDTVVISSVSGTVVEVNNDIDPSSKNSQTLVHVATEG  230

Query: 240   KLQVQGTMSEYDLANVKKDQAVKIKSKVYPDKEWEGKISYISNYP-EAEANN-----NDS  293
               +LQV+GT++EYDLANVK  Q+VKIKSKVY ++EW GKISY+SNYP E+ A +          +
Sbjct: 231   QLQVKGTLTEYDLANVKVGQSVKIKSKVYSNQEWTGKISYVSNYPTESNAGSTTPAGSTG  290

Query: 294   NNGSSAVNYKYKVDITSPLDALKQGFTVSVEVVNGDKHLIVPTSSVINKDNKHFVWVYND  353
                   S+    Y YK+DI SPL+ LKQGFTVSVEVVN  K  +VP ++VI KD KH+VW Y+D
Sbjct: 291   AGSSTGATYDYKIDIISPLNQLKQGFTVSVEVVNEAKQALVPLTAVIKKDKKHYVNTYDD  350

Query: 354   SNRKISKVEVKIGKADAKTQEILSGLKAGQIVVTNPSKTFKDGQKIDNIESIDLNSNKKSE  414
              +   K   KVEV +G ADA+ QEI  G+   G IV+ NP K    K   +K++ +   SI  N+ + +
Sbjct: 351   ATGKAKKVEVTLGNADAQQQEIHKGVAVGDIVIANPDKNIKPDKKLEGVISIGTNTKPEKD  411
```

Based on this analysis, it was predicted that these proteins and their epitopes could be useful antigens for vaccines or diagnostics.

Example 839

A DNA sequence (GBSx0891) was identified in *S. agalactiae* <SEQ ID 2535> which encodes the amino acid sequence <SEQ ID 2536>. Analysis of this protein sequence reveals the following:

Possible site: 29
>>> Seems to have no N-terminal signal sequence
----- Final Results -----
  bacterial cytoplasm --- Certainty = 0.1832 (Affirmative) <succ>
  bacterial membrane --- Certainty = 0.0000 (Not Clear) <succ>
  bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 840

A DNA sequence (GBSx0892) was identified in *S. agalactiae* <SEQ ID 2537> which encodes the amino acid sequence <SEQ ID 2538>. This protein is predicted to be carbamoyl-phosphate synthase, pyrimidine-specific, large chain, putati. Analysis of this protein sequence reveals the following:

---
Possible site: 59
>>> Seems to have an uncleavable N-term signal seq
INTEGRAL Likelihood = −1.70 Transmembrane 486-502 (486-502)
----- Final Results -----
   bacterial membrane --- Certainty = 0.1680 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the GENPEPT database.

```
GP:CAA91005 GB:Z54240 carbamoyl-phosphate synthase [Lactobacillus plantarum]
Identities = 117/417 (28%), Positives = 205/417 (49%), Gaps = 37/417 (8%)
Query: 122  FVQVDCLVMRDSLNNCLYVSDLEYIES-NKTTGKSLAIVPSQTLSDAARQTIRDVAPDVC  180
            + +++  VMRD+ +N + V ++E +     TG S+   P QTL+D   Q +RD A +
Sbjct: 213  YKEIEFEVMRDAADNAMVVCNMENFDPVGIHTGDSIVYAPVQTLADREVQLLRDAALKII  272

Query: 181  RKANIIGVCYFSFLIDLNSLDYHIISLSSGLSHQSILFETITTYPVLEIATKLTVGYTFS  240
            R    I G C   +D NS +Y+II ++  +S  S L    T YP+++ A K+ VG
Sbjct: 273  RALKIEGGCNVQLALDPNSFNYYIIEVNPRVSRSSALASKATGYPIAKMAAKIAVGLHLD  332

Query: 241  QLKHSYYPNTSAFLEPQLDYVATV--SFSFEKVDY---------------IFFARNIEQL  283
            ++K+    T A  EP LDYV    + F+K +                  + RNIE+
Sbjct: 333  EIKNPVTGTTYAEFEPALDYVVCKIPRWPFDKFTHADRRLGTQMKATGEVMAIGRNIEEA  392

Query: 284  FLNLLEASS----HDHFPPLSDISEEDLMFALIQKKENRLAYLLEAFRRGFDLYDLSSVT  339
                L + +     H    L + ++ L    LI  +++RL YL EA RRG+ + +L+ +T
Sbjct: 393  TLKAVRSLEIGVHHVEESTLRSVDDDVLSDKLIHAQDDRLFYLTEAIRRGYQIDELAELT  452

Query: 340  KINPFYLDKCLHIVELYENLNKSQYNVDIYKEAKRYGFSDDYIASSWQISLIDMLEYRKK  399
            KIN F+LDK LHI+E+ + L      +++    AKR GF+D  +A  W ++   + ++R
Sbjct: 453  KINVFFLDKLLHIIEIEQALRTHTDDIETLTVAKRNGFADQTVADYWHETIDQVRDFRLA  512

Query: 400  HSVAPVLKQVEQSSGVLTGHQIQYFRSYDWHSDYISSGCQKALIM----------VDKGY  449
            H +APV K V+  +G       Y+ +Y++ ++ I +      L++         V+  Y
Sbjct: 513  HKLAPVYKMVDTCAGEFASETPYYYGTYEFENESIVTKRPSVLNLGSGPIRIGQGVEFDY  572

Query: 450  SLVKLNELIKQIKQTHLELLIVTNQPLLIEQLNDTS--IIFDTIGIETILTIMGIEE     504
            + V     +K I++   E +I+ + P +        S + F+ +  IE +L ++ +E+
Sbjct: 573  ATV---HSVKAIQKAGYEAIIMNSNPETVSTDFSVSDKLYFEPLTIEDVLNVIELEK     626
```

Based on this analysis, it was predicted that this protein and its epitopes, could be useful antigens for vaccines or diagnostics.

Example 841

A DNA sequence (GBSx0893) was identified in *S. agalactiae* <SEQ ID 2539> which encodes the amino acid sequence <SEQ ID 2540>. This protein is predicted to be carbamoyl phosphate synthetase small subunit (carA). Analysis of this protein sequence reveals the following:

---
Possible site: 27
>>> Seems to have no N-terminal signal sequence
----- Final Results -----
   bacterial cytoplasm --- Certainty = 0.2709 (Affirmative) <succ>
   bacterial membrane --- Certainty = 0.0000 (Not Clear) <succ>
   bacterial outside --- Certainty = 0.0000 (Not Clear) <succ>

---

The protein has homology with the following sequences in the GENPEPT database.

```
>GP:CAB89872 GB:AJ132624 carbamoyl phosphate synthetase small subunit
[Lactococcus lactis]
Identities = 188/352 (53%), Positives = 265/352 (74%)
Query: 1    MAKKLLILEDGTVFEGLSFGSSLDVTGELVFCTGNTGYQEIITNPSHNGKILVFTSPLIG  60
            M+K+LLILEDGT+FEG + G++LDVTGELVF TG TGYQE IT+ S+NG+IL FT P++G
Sbjct: 1    MSKRLLILEDGTIFEGEALGANLDVTGELVFNTGMTGYQESITDQSYNGQILTFTYPIVG  60

Query: 61   NYGIHRSYSEAIIPTCLGVVVAEYSRCVSSDTSKMNLDEFLKMKKVPAMSGVDTRYLMQV  120
            NYG++R   E+I PTC  VVV E +R  S+    +M+ DEFLK K +P ++GVDTR + ++
```

```
-continued
Sbjct:  61  NYGVNRDDYESIHPTCKAVVVHEAARRPSNWRMQMSFDEFLKSKNIPGITGVDTRAITKI  120

Query: 121  IKEKGFVKATLAEAGDVLSHLQDQLIATVLPTNNVEQVSTKTAYPSPASGRNIVVLDFGL  180
            ++E G +KA+L +A D + H   QL ATVLPTN VE  ST TAYPSP +GR +VV+DFGL
Sbjct: 121  VREHGTMKASLVQARDEVDHQMSQLQATVLPTNQVETSSTATAYPSPNTGRKVVVVDFGL  180

Query: 181  KHSILRELSKRQCDVTVIPYNTSLEGIKNLYPEGIILSNGPGNPEKLQEILNTIKELQKS  240
            KHSILRELSKR+C++TV+PYNTS + I  + P+G++L+NGPG+P   + E +  IKE+Q
Sbjct: 181  KHSILRELSKRECNLTVVPYNTSAKEILEMEPDGVMLTNGPGDPTDVPEATEMIKEVQGK  240

Query: 241  VPMLGIGLGHQLIAMANGAEIMRLPVAKKGPNYPMRDIATGRLETVSQFNHFTVNRLNLP  300
            +P+ GI LGHQL ++ANGA   ++    +G N+ +R++ATGR++  SQ + + V+  NLP
Sbjct: 241  IPIFGICLGHQLFSLANGATTYKMKFGHRGFNHAVREVATGRIDFTSQNHGYAVSSENLP  300

Query: 301  HDLLVTHEGLNDQEIVALRHRSFPVMSVQFYPEAAPGPHDVTYFFDEFLEMI          352
              DL++TH  +ND  +  +RH+ FP  SVQF+P+AAPGPHD +Y FD+F++++
Sbjct: 301  EDLMITHVEINDNSVEGVRHKYFPAFSVQFHPDAAPGPHDASYLFDDFMDLM          352
```

There is also homology to SEQ ID 2030.

Based on this analysis, it was predicted that this protein and its epitopes, could be useful antigens for vaccines or diagnostics.

Example 842

A DNA sequence (GBSx0894) was identified in *S. agalactiae* <SEQ ID 2541> which encodes the amino acid sequence <SEQ ID 2542>. Analysis of this protein sequence reveals the following:

Possible site: 57
>>> Seems to have no N-terminal signal sequence
----- Final Results -----
    bacterial cytoplasm --- Certainty = 0.3646 (Affirmative) <succ>
      bacterial membrane --- Certainty = 0.0000 (Not Clear) <succ>
        bacterial outside --- Certainty = 0.0000 (Not Clear) <succ>

A related GBS nucleic acid sequence <SEQ ID 9967> which encodes amino acid sequence <SEQ ID 9968> was also identified.

The protein has homology with the following sequences in the GENPEPT database.

A related DNA sequence was identified in *S. pyogenes* <SEQ ID 2543> which encodes the amino acid sequence <SEQ ID 2544>. Analysis of this protein sequence reveals the following:

Possible site: 45
>>> Seems to have no N-terminal signal sequence
----- Final Results -----
    bacterial cytoplasm --- Certainty = 0.3870 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below.

```
>GP:CAB89869 GB:AJ132624 pyrimidine regulatory protein [Lactococcus lactis]
Identities = 127/169 (75%), Positives = 147/169 (86%)
Query:  13  MKRKEIIDDVTMKRAITRITYEIIERNKNLDNIVLAGIKTRGVFLAKRIQERLKQLENLD   72
            M RKEIID++TMKRAITRITYEIIERNK LD +VL GIKTRGV+LAKRIQERL+QLE L+
Sbjct:   1  MARKEIIDEITMKRAITRITYEIIERNKELDKLVLIGIKTRGVYLAKRIQERLQQLEGLE   60

Query:  73  IPVGELDTKPFRDDMKVEVDTTTMPVDITDKDIILIDDVLYTGRTIRAAIDNLVSLGRPS  132
            IP GELDT+PFRDD + + DTT + +DIT KD+IL+DDVLYTGRTIRAAID +V LGRP+
Sbjct:  61  IPFGELDTRPFRDDKQAQEDTTEIDIDITGKDVILVDDVLYTGRTIRAAIDGIVKLGRPA  120

Query: 133  RVSLAVLIDRGHRELPIRADYVGKNIPTSQFEEILVEVMEHDGYDRVSI             181
            RV LAVL+DRGHRELPIRADYVGKNIPT    EEI+V++ EHDG D + I
Sbjct: 121  RVQLAVLVDRGHRELPIRADYVGKNIPTGHDEEIIVQMSEHDGNDSILI             169
```

```
Identities = 147/171 (85%), Positives = 158/171 (91%)
Query:  13  MKRKEIIDDVTMKRAITRITYEIIERNKNLDNIVLAGIKTRGVFLAKRIQERLKQLENLD   72
            MK KEI+DDVTMKRAITRITYEIIERNK LDN+VLAGIKTRGVFLA+RIQERL QLE LD
Sbjct:   1  MKTKEIVDDVTMKRAITRITYEIIERNKQLDNVVLAGIKTRGVFLARRIQERLHQLEGLD   60

Query:  73  IPVGELDTKPFRDDMKVEVDTTTMPVDITDKDTILIDDVLYTGRTIRAAIDNLVSLGRPS  132
            +P+GELD KPFRDDM+VE DTT M VDIT KD+ILIDDVLYTGRTIRAAIDNLVSLGRP+
Sbjct:  61  LPIGELDIKPFRDDMRVEEDTTLMSVDITGKDVILIDDVLYTGRTIRAAIDNLVSLGRPA  120

Query: 133  RVSLAVLIDRGHRELPIRADYVGKNIPTSQFEEILVEVMEHDGYDRVSIID           183
            RVSLAVL+DRGHRELPIRADYVGKNIPTS  EEI+VEV+E DG DRVSIID
Sbjct: 121  RVSLAVLVDRGHRELPIRADYVGKNIPTSSVEEIVVEVVEVDGRDRVSIID           171
```

Based on this analysis, it was predicted that these proteins and their epitopes could be useful antigens for vaccines or diagnostics.

Example 843

A DNA sequence (GBSx0895) was identified in *S. agalactiae* <SEQ ID 2545> which encodes the amino acid sequence <SEQ ID 2546> (rluD). Analysis of this protein sequence reveals the following:

---

Possible site: 35
>>> Seems to have no N-terminal signal sequence
----- Final Results -----
    bacterial cytoplasm --- Certainty = 0.0687 (Affirmative) <succ>
    bacterial membrane --- Certainty = 0.0000 (Not Clear) <succ>
    bacterial outside --- Certainty = 0.0000 (Not Clear) <succ>

---

A related GBS nucleic acid sequence <SEQ ID 9969> which encodes amino acid sequence <SEQ ID 9970> was also identified.

The protein has homology with the following sequences in the GENPEPT database.

A related DNA sequence was identified in *S. pyogenes* <SEQ ID 2547> which encodes the amino acid sequence <SEQ ID 2548>. Analysis of this protein sequence reveals the following:

---

Possible site: 27
>>> Seems to have no N-terminal signal sequence
----- Final Results -----
    bacterial cytoplasm --- Certainty = 0.2455 (Affirmative) <succ>
    bacterial membrane --- Certainty = 0.0000 (Not Clear) <succ>
    bacterial outside --- Certainty = 0.0000 (Not Clear) <succ>

---

An alignment of the GAS and GBS proteins is shown below.

```
>GP:BAB06261 GB:AP001515 unknown conserved protein [Bacillus halodurans]
Identities = 178/290 (61%), Positives = 216/290 (74%), Gaps = 2/290 (0%)
Query:  17  GVRLDKAL-ADNSELSRSQANEEIKKGIVLVNGQVKKAKYTVQEGDRITFDIPKEEVLDY   75
            G R+DK L A   E SR+Q + IK G VL+NG+ K+ Y V+ GD +   +P+ EVL+
Sbjct:  15  GERIDKFLTAQGEEWSRTQVQQWIKDGHVLINGRTIKSNYKVETGDTLELFVPEPEVLEV   74

Query:  76  QAENIPLDIIYQDDDVAVVNKPQGMVVHPSAGHSSGTLVNALMYHIKDLSSINGVVRPGI  135
              ENIP++IIY+D+DVAVVNKP+GMVVHP+ GH++GTLVNALMYH  DLSSINGVVRPGI
Sbjct:  75  VPENIPIEIIYEDEDVAVVNKPRGMVVHPAPGHTTGTLVNALMYHCNDLSSINGVVRPGI  134

Query: 136  VHRIDKDTSGLLMVAKNDRAHQVLAEELKDKKSLRKYLAIVHGNLPNDRGVIEAPIGRSD  195
            VHRIDKDTSGLLM+AKNDRAH+ L  +LK K + R Y AIVHGN+P+D G I+APIGR
Sbjct: 135  VHRIDKDTSGLLMIAKNDRAHESLVNQLKAKTTERVYQAIVHGNIPHDHGTIDAPIGRDK  194

Query: 196  KDRKKQAVTAK-GKPAITRFHVLERFGDYTLVELSLETGRTHQIRVHMAYIGHPLAGDPV  254
             DR+   VT +   A+T F VLERFGD+T VE  LETGRTHQIRVH  YIG PLAGDP
Sbjct: 195  VDRQSMTVTEENSRDAVTHFTVLERFGDFTFVECQLETGRTHQIRVHFKYIGFPLAGDPK  254

Query: 255  YGPRKTLGGKGQFLHAQTLGFTHPSNGENLIFSVEVPEIFQTTLEKLRKN            304
            YGP+KTL   GQ LHAQ LGF HP  GE + F VE+PE +  +L+ N
Sbjct: 255  YGPKKTLSIDGQALHAQKLGFEHPRTGEFMRFKVEMPEEMKKLIRQLQNN            304
```

```
Identities = 239/295 (81%), Positives = 265/295 (89%)
Query:   9  MEITIKIAGVRLDKALADNSELSRSQANEEIKKGIVLVNGQVKKAKYTVQEGDRITFDIP   68
            MEI + +G RLDKALAD S LSR QAN++IK+G+VLVNGQ KKAKYTVQ GD I F++P
Sbjct:   1  MEINVITSGQRLDKALADLSPLSRGQANDQIKQGLVLVNGQQKKAKYTVQAGDVICFELP   60

Query:  69  KEEVLDYQAENIPLDIIYQDDDVAVVNKPQGMVVHPSAGHSSGTLVNALMYHIKDLSSIN  128
            KEEVL+YQA+NIPLDIIY+DD +A++NKPQGMVVHPSAGH SGT+VNALMYHIKDLSSIN
Sbjct:  61  KEEVLEYQAQNIPLDIIYEDDALAIINKPQGMVVHPSAGHPSGTMVNALMYHIKDLSSIN  120

Query: 129  GVVRPGIVHRIDKDTSGLLMVAKNDRAHQVLAEELKDKKSLRKYLAIVHGNLPNDRGVIE  188
            GVVRPGIVHRIDKDTSGLLMVAK D AHQ LAEELK KKSLRKYLAIVHGNLPNDRG+IE
Sbjct: 121  GVVRPGIVHRIDKDTSGLLMVAKTDAAHQALAEELKAKKSLRKYLAIVHGNLPNDRGMIE  180

Query: 189  APIGRSDKDRKKQAVTAKGKPAITRFHVLERFGDYTLVELSLETGRTHQIRVHMAYIGHP  248
            APIGRS+KDRKKQAVTAKGK A+TRF VLERFGDY+LVEL LETGRTHQIRVHMAYIGHP
Sbjct: 181  APIGRSEKDRKKQAVTAKGKEAVTRFTVLERFGDYSLVELQLETGRTHQIRVHMAYIGHP  240

Query: 249  LAGDPVYGPRKTLGGKGQFLHAQTLGFTHPSNGENLIFSVEVPEIFQTTLEKLRK       303
            +AGDP+YGPRKTL G GQFLHA+TLG THP  G+ +IF+VE PEIFQ  L+ LRK
Sbjct: 241  VAGDPLYGPRKTLSGHGQFLHAKTLGLTHPMTGKEMIFTVEAPEIFQKVLKLLRK       295
```

Based on this analysis, it was predicted that these proteins and their epitopes could be useful antigens for vaccines or diagnostics.

Example 844

A DNA sequence (GBSx0896) was identified in *S. agalactiae* <SEQ ID 2549> which encodes the amino acid sequence <SEQ ID 2550>. Analysis of this protein sequence reveals the following:

---
Possible site: 33
>>> Seems to have no N-terminal signal sequence
----- Final Results -----
    bacterial cytoplasm --- Certainty = 0.0496 (Affirmative) <succ>
    bacterial membrane --- Certainty = 0.0000 (Not Clear) <succ>
        bacterial outside --- Certainty = 0.0000 (Not Clear) <succ>
---

The protein has homology with the following sequences in the GENPEPT database.

A related DNA sequence was identified in *S. pyogenes* <SEQ ID 2551> which encodes the amino acid sequence <SEQ ID 2552>. Analysis of this protein sequence reveals the following:

---
Possible site: 13
>>> Seems to have no N-terminal signal sequence
----- Final Results -----
    bacterial cytoplasm --- Certainty = 0.1252 (Affirmative) <succ>
    bacterial membrane --- Certainty = 0.0000 (Not Clear) <succ>
        bacterial outside --- Certainty = 0.0000 (Not Clear) <succ>
---

An alignment of the GAS and GBS proteins is shown below.

```
>GP:AAD53064 GB:AF163833 CpsY [Streptococcus agalactiae]
Identities = 105/297 (35%), Positives = 163/297 (54%), Gaps = 4/297 (1%)
Query:   1  MNIQQLRYVVAIANSGTFREAAAKLFVSQPSLSVAVRDLETELGFQIFTRTITGAVLTNQ   60
            M IQQL+YV+ I +G+  EAA +L+++QPSLS AVR+LETE+G QIF R   G  LT
Sbjct:   1  MRIQQLQYVIKIVETGSMNEAAKQLYITQPSLSNAVRNLETEMGIQIFIRNPKGITLTKD   60

Query:  61  GMTFYENALEVVKSFDSFEKQFSQSEATEQEFSIASQHYDFLPPLITAFSKCNDNFSY-F  119
            GM F   A ++++      E+++    + + FS++SQHY F+      A    D   Y
Sbjct:  61  GMEFLSYARQILEQTALLEERYKGDNTSRELFSVSSQHYAFVVNAFVALFNGTDMTQYEL  120

Query: 120  RIFESTTIRILDEVAQGNSEIGIIYINSQNKKGLLQRLDKLGLEFVELIPFKTHIYLGKD  179
             + E+ T  I+D+V    SEIG++++NS N+  L+    D  L    L    HI++ K
Sbjct: 121  FLRETRTWEIIDDVKNFRSEIGVLFLNSYNRDVLTKLFDDNSLIATTLFTTTPHIFVSKS  180

Query: 180  HPLASKTSLIMTDLEGLPTVRFTQDRDDYRYYSENFVEVLDSSVTYNVTDRATLNGILER  239
            +PLA++  L M DLE  P + Q   +  Y+SE + +    + V+DRATL++
Sbjct: 181  NPLANRKKLSMKDLEDYPYLSYDQGLHNSFYFSEEMMSQIPHPKSIVVSDRATLFNLMIG  240

Query: 240  TQAYATGSGFLDSRSVNG--ITVIPLEDHLDNQMIYIKRKDRNLSQMALKFVAVMEE     294
                Y   +G L+S++ NG  I   IPL+    ++ YI+    NLS+M  KF+  + E
Sbjct: 241  LDGYTVATGILNSK-LNGDEIVAIPLDVDDVIDIVYIRHDKANLSKMGQKFIDYLLE     296
```

```
Identities = 217/296 (7396), Positives = 253/296 (85%)
Query: 1    MNIQQLRYVVAIANSGTFREAAAKLFVSQPSLSVAVRDLETELGFQIFTRTTTGAVLTNQ    60
            MNIQQLRYVVAIAN+GTFREAA+KLFVSQPSLSV+++DLE ELGFQIF RTT+G VLT+Q
Sbjct: 1    MNIQQLRYVVAIANNGTFREAASKLFVSQPSLSVSIKDLEAELGFQIFNRTTSGTVLTSQ    60

Query: 61   GMTFYENALEVVKSFDSFEKQFSQSEATEQEFSIASQHYDFLPPLITAFSKCNDNFSYFR   120
            G+ FYE ALEVVKSFDSFEK FSQ++  + EFSIASQHYDFLPPLITAFS+  D    FR
Sbjct: 61   GLVFYEKALEVVKSFDSFEKTFSQADLDQNEFSIASQHYDFLPPLITAFSQQYDGHRVFR   120

Query: 121  IFESTTIRILDEVAQGNSEIGIIYINSQNKKGLLQRLDKLGLEFVELIPFKTHIYLGKDH   180
            IFESTTI+ILDEVAQGNSEIGIIY+N  N+KGL QR+DKLGLE+V LIPF THIYL K H
Sbjct: 121  IFESTTIQILDEVAQGNSEIGIIYLNVDNQKGLFQRMDKLGLEYVSLIPFITHIYLSKTH   180

Query: 181  PLASKTSLIMTDLEGLPTVRFTQDRDDYRYYSENFVEVLDSSVTYNVTDRATLNGILERT   240
            PLA++ +L + D++GLP VRFTQ+RD+Y YYSENFV+ +     YNV+DRATLNGILERT
Sbjct: 181  PLANREALYLNDIQGLPAVRFTQERDEYLYYSENFVDTSECPRIYNVSDRATLNGILERT   240

Query: 241  QAYATGSGFLDSRSVNGITVIPLEDHLDNQMIYIKRKDRNLSQMALKFVAVMEEYF      296
             A+ATGSGFLD RSVNGI VIPL DH+DNQMIY+KRKD+NLS       FV ++++YF
Sbjct: 241  NAFATGSGFLDHRSVNGIKVIPLADHIDNQMIYVKRKDKNLSVAGATFVTILKDYF      296
```

Based on this analysis, it was predicted that these proteins and their epitopes could be useful antigens for vaccines or diagnostics.

Example 845

A DNA sequence (GBSx0897) was identified in *S. agalactiae* <SEQ ID 2553> which encodes the amino acid sequence <SEQ ID 2554>. This protein is predicted to be 50S ribosomal protein L27 (rpmA). Analysis of this protein sequence reveals the following:

Possible site: 36
>>> Seems to have no N-terminal signal sequence
----- Final Results -----
  bacterial cytoplasm --- Certainty = 0.0976 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

A related DNA sequence was identified in *S. pyogenes* <SEQ ID 2555> which encodes the amino acid sequence <SEQ ID 2556>. Analysis of this protein sequence reveals the following:

Possible site: 36
>>> Seems to have no N-terminal signal sequence
----- Final Results -----
  bacterial cytoplasm --- Certainty = 0.0976 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

```
>GP:CAB14754 GB:Z99118 ribosomal protein L27 (BL24) [Bacillus subtilis]
Identities = 70/90 (77%), Positives = 80/90 (88%)
Query: 8    NLQLFAHKKGGGSTSNGRDSQAKRLGAKAADGQTVSGGSILYRQRGTHIYPGANVGRGGD    67
            +LQ FA KKG GST NGRDS+AKRLGAK ADGQ V+GGSILYRQRGT IYPG NVGRGGD
Sbjct: 5    DLQFFASKKGVGSTKNGRDSEAKRLGAKRADGQFVTGGSILYRQRGTKIYPGENVGRGGD    64

Query: 68   DTLFAKVEGVVRFERKGRDKKQVSVYPIAK                                97
            DTLFAK++G V+FER GRD+K+VSVYP+A+
Sbjct: 65   DTLFAKIDGTVKFERFGRDRKKVSVYPVAQ                                94
```

```
Identities = 95/97 (97%), Positives = 96/97 (98%)
Query:   1  MLKMNLANLQLFAHKKGGGSTSNGRDSQAKRLGAKAADGQTVSGGSILYRQRGTHIYPGA  60
            MLKMNLANLQLFAHKKGGGSTSNGRDSQAKRLGAKAADGQTVSGGSILYRQRGTHIYPG
Sbjct:   1  MLKMNLANLQLFAHKKGGGSTSNGRDSQAKRLGAKAADGQTVSGGSILYRQRGTHIYPGV  60

Query:  61  NVGRGGDDTLFAKVEGVVRFERKGRDKKQVSVYPIAK                         97
            NVGRGGDDTLFAKVEGVVRFERKGRDKKQVSVYP+AK
Sbjct:  61  NVGRGGDDTLFAKVEGVVRFERKGRDKKQVSVYPVAK                         97
```

Based on this analysis, it was predicted that these proteins and their epitopes could be useful antigens for vaccines or diagnostics.

Example 846

A DNA sequence (GBSx0898) was identified in *S. agalactiae* <SEQ ID 2557> which encodes the amino acid sequence <SEQ ID 2558>. Analysis of this protein sequence reveals the following:

Possible site: 25
>>> Seems to have no N-terminal signal sequence
INTEGRAL Likelihood = −0.75 Transmembrane 32-48 (32-48)
----- Final Results -----
   bacterial membrane --- Certainty = 0.1298 (Affirmative) <succ>
   bacterial outside --- Certainty = 0.0000 (Not Clear) <succ>
   bacterial cytoplasm --- Certainty = 0.0000 (Not Clear) <succ>

Possible site: 52
>>> Seems to have no N-terminal signal sequence
INTEGRAL Likelihood = −0.59 Transmembrane 32-48 (32-48)
----- Final Results -----
   bacterial membrane --- Certainty = 0.1235 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database.

The protein has homology with the following sequences in the databases:

```
>GP:BAB06729 GB:AP001517 unknown conserved protein in B. subtilis
[Bacillus halodurans]
Identities = 33/107 (30%), Positives = 63/107 (58%), Gaps = 4/107 (3%)
Query:   1  MIKATFTRNQSGYLYSAEISGHAGSGEYGFDVICAAVSTLSINFINSLEALTTCQAQLII  60
            MI   F RN+     +S  +SGHA +G YG D++CA   S +++  +N++ AL  CQ +L+
Sbjct:   1  MIDVVFERNKQNDIVSFTMSGHADAGPYGQDLVCAGASAVALGTVNAIIAL--CQVELVT  58

Query:  61  N-DVEGGYMKIDL-SSIPQHKEDKVQLLFESYLLGMTNLSKDSSEFV              105
            +   EGG+++   +   + +  +KVQLL E   + ++++  E +
Sbjct:  59  EMENEGGFLRCRVPNDLEETTFEKVQLLLEGMNISLQSIAESYGEHI              105
```

A related DNA sequence was identified in *S. pyogenes* <SEQ ID 2559> which encodes the amino acid sequence <SEQ ID 2560>. Analysis of this protein sequence reveals the following:

```
>GP:BAB06729 GB:AP001517 unknown conserved protein in B. subtilis
[Bacillus halodurans]
Identities = 33/109 (30%), Positives = 60/109 (54%), Gaps = 4/109 (3%)
Query:   1  MIKAIFTRQKNGQLSSVTLTGHAGSGKHGFDIVCASVSTLAINFVNSLEVLADCQALVDL  60
            MI  +F R K    + S T++GHA +G +G D+VCA   S +A+  VN++  L    + ++
Sbjct:   1  MIDVVFERNKQNDIVSFTMSGHADAGPYGQDLVCAGASAVALGTVNAIIALCQVELVTEM  60

Query:  61  NDVEGGYMAITIP---PHDNKEEVQLLFESFLLGMTSLAKDSSKFVNTQ              106
            +  EGG++   +P          E+VQLL E   + S+A+    +
Sbjct:  61  EN-EGGFLRCRVPNDLEETTFEKVQLLLEGMNISLQSIAESYGEHIQIE              108
```

An alignment of the GAS and GBS proteins is shown below.

```
Identities = 67/110 (60%), Positives = 90/110 (80%), Gaps = 2/110 (1%)
Query:  1  MIKATFTRNQSGYLYSAEISGHAGSGEYGFDVICAAVSTLSINFINSLEALTTCQAQLII   60
           MIKA FTR ++G L S   ++GHAGSG++GFD++CA+VSTL+INF+NSLE L   CQA + +
Sbjct:  1  MIKAIFTRQKNGQLSSVTLTGHAGSGKHGFDIVCASVSTLAINFVNSLEVLADCQALVDL   60

Query: 61  NDVEGGYMKIDLSSIPQHKEDKVQLLFESYLLGMTNLSKDSSEFVSTVVM            110
           NDVEGGYM I +   P    +++VQLLFES+LLGMT+L+KDSS+FV+T V+
Sbjct: 61  NDVEGGYMAITIP--PHDNKEEVQLLFESFLLGMTSLAKDSSKFVNTQVI            108
```

Figure 78:
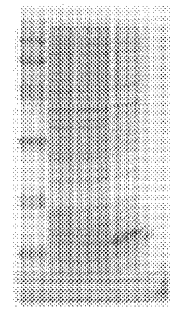

SEQ ID 2558 (GBS433) was expressed in *E. coli* as a His-fusion product. SDS-PAGE analysis of total cell extract is shown in FIG. 78 (lane 4; MW 16 kDa). It was also expressed in *E. coli* as a GST-fusion product. SDS-PAGE analysis of total cell extract is shown in FIG. 173 (lane 8; MW 41 kDa).

GBS433-GST was purified as shown in FIG. 223, lane 10.

Based on this analysis, it was predicted that these proteins and their epitopes could be useful antigens for vaccines or diagnostics.

Example 847

A DNA sequence (GBSx0899) was identified in *S. agalactiae* <SEQ ID 2561> which encodes the amino acid sequence <SEQ ID 2562>. This protein is predicted to be ribosomal protein L21 (rplU). Analysis of this protein sequence reveals the following:

---

Possible site 57
>>> Seems to have no N-terminal signal sequence
----- Final Results -----
   bacterial cytoplasm --- Certainty = 0.2972 (Affirmative) <succ>
    bacterial membrane --- Certainty = 0.0000 (Not Clear) <succ>
     bacterial outside --- Certainty = 0.0000 (Not Clear) <succ>

---

The protein has homology with the following sequences in the GENPEPT database.

```
>GP:CAB14756 GB:Z99118 ribosomal protein L21 (BL20) [Bacillus subtilis]
Identities = 67/101 (66%), Positives = 78/101 (76%)
Query:  4  YAIIKTGGKQVKVEVGQAIYVEKLDVEAGAEVTFNEVVLVGGETTKVGTPVVEGATVVGT   63
           YAIIKTGGKQ+KVE GQ +Y+EKL  EAG  VTF +V+ VGG+  KVG P VEGATV
Sbjct:  2  YAIIKTGGKQIKVEEGQTVYIEKLAAEAGETVTFEDVLFVGGDNVKGNPTVEGATVTAK   61

Query: 64  VEKQGKQKKVVSYKYKPKKGSHRKQGHRQPYTKVVINAINA                    104
           VEKQG+ KK+  ++YKPKK  H+KQGHRQPYTKV I  INA
Sbjct: 62  VEKQGRAKKITVFRYKPKKNVHKKQGHRQPYTKVTIEKINA                    102
```

A related DNA sequence was identified in *S. pyogenes* <SEQ ID 2563> which encodes the amino acid sequence <SEQ ID 2564>. Analysis of this protein sequence reveals the following:

---

Possible site: 33
>>> Seems to have no N-terminal signal sequence
----- Final Results -----
   bacterial cytoplasm --- Certainty = 0.3026 (Affirmative) <succ>
    bacterial membrane --- Certainty = 0.0000 (Not Clear) <succ>
     bacterial outside --- Certainty = 0.0000 (Not Clear) <succ>

---

An alignment of the GAS and GBS proteins is shown below.

```
Identities = 97/104 (93%), Positives = 101/104 (96%)
Query:  1  MSTYAIIKTGGKQVKVEVGQAIYVEKLDVEAGAEVTFNEVVLVGGETTKVGTPVVEGATV   60
           MSTYAIIKTGGKQVKVEVGQAIYVEK+D EAGAEVTFNEVVLVGG+ T VGTPVVEGATV
Sbjct:  1  MSTYAIIKTGGKQVKVEVGQAIYVEKIDAEAGAEVTFNEVVLVGGDKTVVGTPVVEGATV   60

Query: 61  VGTVEKQGKQKKVVSYKYKPKKGSHRKQGHRQPYTKVVINAINA                 104
           VGTVEKQGKQKKVV++KYKPKKGSHRKQGHRQPYTKVVINAINA
Sbjct: 61  VGTVEKQGKQKKVVTFKYKPKKGSHRKQGHRQPYTKVVINAINA                 104
```

Based on this analysis, it was predicted that these proteins and their epitopes could be useful antigens for vaccines or diagnostics.

Example 848

A DNA sequence (GBSx0900) was identified in *S. agalactiae* <SEQ ID 2565> which encodes the amino acid sequence <SEQ ID 2566>. Analysis of this protein sequence reveals the following:

---

Possible site: 16
>>> Seems to have no N-terminal signal sequence
----- Final Results -----
   bacterial cytoplasm --- Certainty = 0.1032 (Affirmative) <succ>
    bacterial membrane --- Certainty = 0.0000 (Not Clear) <succ>
     bacterial outside --- Certainty = 0.0000 (Not Clear) <succ>

A related GBS nucleic acid sequence <SEQ ID 9369> which encodes amino acid sequence <SEQ ID 9370> was also identified.

The protein has homology with the following sequences in the GENPEPT database.

```
>GP:CAB14809 GB:Z99118 excinuclease ABC (subunit C) [Bacillus subtilis]
Identities = 221/373 (59%), Positives = 288/373 (76%)
Query: 1    MKSAAMTMEFERAAEYRDLIEAISLLRTKQRVIHQDMKDRDVFGYFVDKGWMCVQVFFVR    60
            M  AA +EFERA E RD I      KQ++   D+ DRDVF Y  DKGWMCVQVFF+R
Sbjct: 206  MHEAAENLEFERAKELRDQIAHIESTMEKQKMTMNDLVDRDVFAYAYDKGWMCVQVFFIR   265

Query: 61   NGKLIQRDVNMFPYYNEPEEDFLTYIGQFYQDTKHFLPKEVFIPQDIDAKSVETIVGCKI   120
             GKLI+RDV+MFP Y E +E+FLT+IGQFY    HFLPKE+  +P  ID    +E ++    +
Sbjct: 266  QGKLIERDVSMFPLYQEADEEFLTFIGQFYSKNNHFLPKEILVPDSIDQSMIEQLLETNV   325

Query: 121  VKPQRGEKKQLVNLAIKNARVSLQQKFDLLEKDIRKTHGAIENLGNLLNIPKPVRIEAFD   180
             +P++G KK+L+ LA KNA+++L++KF L+E+D  ++ GA++ LG  LNI  P RI AFD
Sbjct: 326  HQPKKGPKKELLMLAHKNAKIALKEKFSLIERDEERSIGAVQKLGEALNIYTPHRIVAFD   385

Query: 181  NSNIQGTSPVAAMVVFVNGKPSKKDYRKFKIKTVIGPDDYASMREVIHRRYSRVLKDGLT   240
            NSNIQGT+PV+AM+VF++GKP KK+YRK+KIKTV GPDDY SMREV+ RRY+RVL++ L
Sbjct: 386  NSNIQGTNPVSAMIVFIDGKPYKKEYRKYKIKTVTGPDDYGSMREVVRRRYTRVLRENLP   445

Query: 241  PPDLIVIDGGQGQVNIARDVIENQFGLAIPIAGLQKNDKHQTHELLFGDPLEVVELPRNS   300
             PDLI+IDGG+GQ+N ARDVIEN+ GL IPIAGL K++KH+T  LL GDPLEV  L RNS
Sbjct: 446  LPDLIIIDGGKGQINAARDVIENELGLDIPIAGLAKDEKHRTSNLLIGDPLEVAYLERNS   505

Query: 301  EEFFLLHRIQDEVHRFAITFHRQLRSKNSFSSKLDGITGLGPKRKQLLMKHFKSLPNIQK   360
            +EF+LL RIQDEVHRFAI+FHRQ+R K++F S LD I G+G KRK++L+KHF S+   +++
Sbjct: 506  QEFYLLQRIQDEVHRFAISFHRQIRGKSAFQSVLDDIPGIGEKRKKMLLKHFGSVKKMKE   565

Query: 361  AEIEDIIMCGIPR   373
            A +EDI   G+P+
Sbjct: 566  ASLEDIKKAGVPQ   578
```

A related DNA sequence was identified in *S. pyogenes* <SEQ ID 2567> which encodes the amino acid sequence <SEQ ID 2568>. Analysis of this protein sequence reveals the following:

Possible site: 53
>>> Seems to have no N-terminal signal sequence

-continued

----- Final Results -----
bacterial cytoplasm --- Certainty = 0.4332 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 289/385 (75%), Positives = 334/385 (86%)
Query: 1    MKSAAMTMEFERAAEYRDLIEAISLLRTKQRVIHQDMKDRDVFGYFVDKGWMCVQVFFVR    60
            M +A+  M FERAAEYRDLI  I+ +RTKQRV+ +D++DRD FGY+VDKGWMCVQVFFVR
Sbjct: 206  MLAASKEMAFERAAEYRDLISGIATMRTKQRVMSKDLQDRDIFGYYVDKGWMCVQVFFVR   265

Query: 61   NGKLIQRDVNMFPYYNEPEEDFLTYIGQFYQDTKHFLPKEVFIPQDIDAKSVETIVGCKI   120
             GKLIQRDVN+FPYY + EEDFLTY+GQFYQD +HF+PKEVFIP+ ID + V   IV KI
Sbjct: 266  QGKLIQRDVNLFPYYTDAEEDFLTYMGQFYQDKQHFIPKEVFIPEAIDEELVAAIVPTKI   325

Query: 121  VKPQRGEKKQLVNLAIKNARVSLQQKFDLLEKDIRKTHGAIENLGNLLNIPKPVRIEAFD   180
            +KP+RGEKKQLV LA KNARVSLQQKFDLLEKDI+KT GAIENLG LL I KPVRIEAFD
Sbjct: 326  IKPKRGEKKQLVALATKNARVSLQQKFDLLEKDIKKTSGAIENLGQLLRIDKPVRIEAFD   385

Query: 181  NSNIQGTSPVAAMVVFVNGKPSKKDYRKFKIKTVIGPDDYASMREVIHRRYSRVLKDGLT   240
            NSNIQGTSPVAAMVVFV+GKPSKKDYRKFKIKTV+GPDDYASMREV+ RRYSRV K+GL
Sbjct: 386  NSNIQGTSPVAAMVVFVDGKPSKKDYRKFKIKTVVGPDDYASMREVLFRRYSRVEKEGLQ   445

Query: 241  PPDLIVIDGGQGQVNIARDVIENQFGLAIPIAGLQKNDKHQTHELLFGDPLEVVELPRNS   300
             P+LI++DGG GQVN+A+DVIE Q GL IP+AGLQKNDKHQTH LLFG+PLEVV LPR S
Sbjct: 446  APNLIIVDGGVGQVNVAKDVIEKQLGLTIPVAGLQKNDKHQTHDLLFGNPLEVVPLRRS   505

Query: 301  EEFFLLHRIQDEVHRFAITFHRQLRSKNSFSSKLDGITGLGPKRKQLLMKHFKSLPNIQK   360
            EEFFLLHRIQDEVHRFA+TFHRQ+R KNSFSS LD I+GLGPKRKQLL++HFK++   I
Sbjct: 506  EEFFLLHRIQDEVHRFAVTFHRQVRRKNSFSSTLDHISGLGPKRKQLLLRHFKTITAIAS   565

Query: 361  AEIEDIIMCGIPRTVAESLRDSLND   385
            A  E+I   GIP+TV E+++  + D
Sbjct: 566  ATSEEIQALGIPKTVVEAIQQQITD   590
```

Based on this analysis, it was predicted that these proteins and their epitopes could be useful antigens for vaccines or diagnostics.

Example 849

A DNA sequence (GBSx0901) was identified in *S. agalactiae* <SEQ ID 2569> which encodes the amino acid sequence <SEQ ID 2570>. Analysis of this protein sequence reveals the following:

```
Possible site: 16
>>> Seems to have no N-terminal signal sequence
----- Final Results -----
   bacterial cytoplasm --- Certainty = 0.2491 (Affirmative) <succ>
    bacterial membrane --- Certainty = 0.0000 (Not Clear) <succ>
     bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 850

A DNA sequence (GBSx0902) was identified in *S. agalactiae* <SEQ ID 2571> which encodes the amino acid sequence <SEQ ID 2572>. Analysis of this protein sequence reveals the following:

```
Possible site: 55
>>> Seems to have no N-terminal signal sequence
----- Final Results -----
   bacterial cytoplasm --- Certainty = 0.3349 (Affirmative) <succ>
    bacterial membrane --- Certainty = 0.0000 (Not Clear) <succ>
     bacterial outside --- Certainty = 0.0000 (Not Clear) <succ>
```

The protein has homology with the following sequences in the GENPEPT database.

```
>GP:BAA86651 GB:AB033763 glycerophosphoryl diester phosphodiesterase
homologue [Staphylococcus aureus]
Identities = 50/202 (24%), Positives = 96/202 (46%), Gaps = 15/202 (7%)
Query:   1  MDVIMTKDHKLVVIHDDNLKRLSGMNKDVSKLTLDQVTKIPIHQ---GRFA-SHIPSFTE   56
            +DV +TKD +L++IHDD L+R + M+++++L   D++           +F   H+P+F +
Sbjct:  36  LDVAITKDEQLIIIHDDYLERTINMSGEITELNYDEIKDASAGSWFGEKFKDEHLPTFDD   95

Query:  57  FMKTAQSLDQKIMIELKPY-NQNLDIYADEFIKEFKE----LRLSTKHKVMSLNLTLIEK  111
            +K A   +  +ELK   N        +K+ +E      L  +  +  S N+ L++
Sbjct:  96  VVKIANEYNMVLNVELKGITGPNGLALSKSMVKQVEEQLTNLNQNQEVLISSFNVVLVKL  155

Query: 112  VEKKLPQLDTGYLIPL-----HWGTLQNH-NVDFYGIEEFSYNDWIAYLAQEYNKQLYVW  165
            E+ +PQ +   +       W  TL ++ N      E+        + +E   +L VW
Sbjct: 156  AEEIMPQYNRAVIFHTTSFREDWRTLLDYCNAKIVNTEDAKLTKAKVKMVKEAGYELNVW  215

Query: 166  TINRDNLMIRYLQSPVNGIITD                                        187
            T+N+      +    V+GI TD
Sbjct: 216  TVNKPARANQLANWGVDGIFTD                                        237
```

A related DNA sequence was identified in *S. pyogenes* <SEQ ID 2573> which encodes the amino acid sequence <SEQ ID 2574>. Analysis of this protein sequence reveals the following:

```
Possible site: 36
>>> Seems to have no N-terminal signal sequence
INTEGRAL    Likelihood = -12.26   Transmembrane 239-255 (227-260)
INTEGRAL    Likelihood =  -9.45   Transmembrane  80-96  (78-108)
INTEGRAL    Likelihood =  -9.13   Transmembrane 137-153 (131-160)
INTEGRAL    Likelihood =  -4.94   Transmembrane 278-294 (277-295)
INTEGRAL    Likelihood =  -3.56   Transmembrane  36-52  (33-55)
INTEGRAL    Likelihood =  -3.56   Transmembrane 188-204 (185-206)
INTEGRAL    Likelihood =  -3.35   Transmembrane 314-330 (310-331)
----- Final Results -----
    bacterial membrane --- Certainty = 0.5904 (Affirmative) <succ>
     bacterial outside --- Certainty = 0.0000 (Not Clear) <succ>
   bacterial cytoplasm --- Certainty = 0.0000 (Not Clear) <succ>
```

The protein has homology with the following sequences in the databases:

```
>GP:CAB12801 GB:Z99109 similar to glycerophosphodiester phosphodiesterase
[Bacillus subtilis]
Identities = 67/244 (27%), Positives = 110/244 (44%), Gaps = 14/244 (5%)
Query: 344  VIAHRGLVSAGVENSLEALEGAKKAGSDYVELDLILTKDNHFVVSHDNRLKRLAGVNKTI  403
            +IAHRG      EN++ A  +A K  +D +ELD+ LTKD   VV HD+R+ R     +  +
Sbjct:   3  IIAHRGASGYAPENTIAAFDLAVKMNADMIELDVQLTKDRQIVVIHDDRVDRTTNGSGFV   62

Query: 404  RNLTLKEVEHLTSHQGH---FSGRFVSFDTFYQKAKKLNMPLLIELKPIGTEPGNYVDLF  460
            ++ TL+E++ L +   +    F G +        K     + LLIELK    ++ G   ++
Sbjct:  63  KDFTLEELQKLDAGSWYGPAFQGERIPTLEAVLKRYHKKIGLLIELKGHPSQVGIEEEVG  122

Query: 461  LETYHRLGISKDNKVMSLDLEVIEAIKKKNPSITTGYIIPIQFGFFG-------DEFVDF  513
             +  +   S +N V S    ++ ++  PSI T  I   FG          F ++
Sbjct: 123  -QLLGQFSFSINNIVQSFQFRSVQRFRELYPSIPTAVITRPNFGMLSRNQMKAFRSFANY  181

Query: 514  YVIEDFSYRSYLSSQAFWNNKEIYVWTINDPKRIEHYLLKPIQGIITDQPALTNQLIKDL  573
             I+    +    N  I+ WT+N+ K        + GI+TD P   + +IKD
Sbjct: 182  VNIKHTRLNRLMIGSINKNGLNIFAWTVNNQKTAAKLQAMGVDGIVTDYP---DFIIKDG  238

Query: 574  KQDN                                                         577
            K +N
Sbjct: 239  KHEN                                                         242
```

An alignment of the GAS and GBS proteins is shown below.

```
Identities = 90/215 (41%), Positives = 136/215 (62%)
Query:   1  MDVIMTKDHKLVVIHDDNLKRLSGMNKDVSKLTLDQVTKIPIHQGRFASHIPSFTEFMKT   60
            +D+I+TKD+  VV HD+ LKRL+G+NK +   LTL +V  +  HQG F+    SF  F +
Sbjct: 375  LDLILTKDNHFVVSHDNRLKRLAGVNKTIRNLTLKEVEHLTSHQGHFSGREVSFDTFYQK  434

Query:  61  AQSLDQKIMIELKPYNQNLDIYADEFIKEFKELRLSTKHKVMSLNLTLIEKVEKKLPQLD  120
            A+ L+  ++IELKPY   D    F++ +  L +S+K  VMSL+L +IE ++KK P +
Sbjct: 435  AKKLNMPLLIELKPIGTEPGNYVDLFLETYHRLGISKDNKVMSLDLEVIEAIKKKNPSIT  494

Query: 121  TGYLIPLHWGTLQNHNVDFYGIEEFSYNDWIAYLAQEYNKQLYVWTINRDNLMIRYLQSP  180
            TGY+IP+ +G  + VDFY IE+FSY +++ A    NK++YVWTIN+       YL  P
Sbjct: 495  TGYIIPIQFGFFGDEFVDFYVIEDFSYRSYLSSQAFWNNKEIYVWTINDPKRIEHYLLKP  554

Query: 181  VNGIITDELNLFKVINKDIKNSPNYYQRALQLIDS                          215
            + GIITD+ L   + KD+K  +Y+ R +++I S
Sbjct: 555  IQGIITDQPALTNQLIKDLKQDNSYFSRLVRIISS                          589
```

Based on this analysis, it was predicted that these proteins and their epitopes could be useful antigens for vaccines or diagnostics.

Example 851

A DNA sequence (GBSx0903) was identified in *S. agalactiae* <SEQ ID 2575> which encodes the amino acid sequence <SEQ ID 2576>. Analysis of this protein sequence reveals the following:

Possible site: 53
>>> Seems to have no N-terminal signal sequence
INTEGRAL    Likelihood = −15.02  Transmembrane 84-100 (76-112)
INTEGRAL    Likelihood = −3.50   Transmembrane 139-155 (139-157)
INTEGRAL    Likelihood = −2.23   Transmembrane 41-57 (39-59)
INTEGRAL    Likelihood = −0.96   Transmembrane 179-195 (179-195)
----- Final Results -----
   bacterial membrane --- Certainty = 0.7007 (Affirmative) <succ>
   bacterial outside --- Certainty = 0.0000 (Not Clear) <succ>
   bacterial cytoplasm --- Certainty = 0.0000 (Not Clear) <succ>

A related GBS nucleic acid sequence <SEQ ID 9901> which encodes amino acid sequence <SEQ ID 9902> was also identified.

The protein has no significant homology with any sequences in the GENPEPT database, but there is homology to SEQ ID 2574.

A related GBS gene <SEQ ID 8671> and protein <SEQ ID 8672> were also identified. Analysis of this protein sequence reveals the following:

Lipop: Possible site: −1   Crend: 10
McG: Discrim Score: −3.38
GvH: Signal Score (−7.5): −4.08
Possible site: 53
>>> Seems to have no N-terminal signal sequence
ALOM program count: 4  value: −15.02  threshold: 0.0
INTEGRAL    Likelihood = −15.02  Transmembrane 84-100 (76-112)
INTEGRAL    Likelihood = −3.50   Transmembrane 139-155 (139-157)
INTEGRAL    Likelihood = −2.23   Transmembrane 41-57 (39-59)
INTEGRAL    Likelihood = −0.96   Transmembrane 179-195 (179-195)
PERIPHERAL  Likelihood = 2.01    104
modified ALOM score: 3.50
*** Reasoning Step: 3
----- Final Results -----
   bacterial membrane --- Certainty = 0.7007 (Affirmative) <succ>
   bacterial outside --- Certainty = 0.0000 (Not Clear) <succ>
   bacterial cytoplasm --- Certainty = 0.0000 (Not Clear) <succ>

Based on this analysis, it was predicted that these proteins and their epitopes could be useful antigens for vaccines or diagnostics.

Example 852

A DNA sequence (GBSx0904) was identified in *S. agalactiae* <SEQ ID 2577> which encodes the amino acid sequence <SEQ ID 2578>. Analysis of this protein sequence reveals the following:

---

Possible site: 61
>>> Seems to have no N-terminal signal sequence
----- Final Results -----
   bacterial cytoplasm --- Certainty = 0.4150 (Affirmative) <succ>
     bacterial membrane --- Certainty = 0.0000 (Not Clear) <succ>
     bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted, that this protein and its epitopes, could be useful antigens for vaccines or diagnostics.

```
>GP:CACD9964 GB:AX033132 unnamed protein product [Bacillus subtilis]
Identities = 62/204 (30%), Positives = 106/204 (51%), Gaps = 11/204 (5%)
Query:   3  FLELNKKRHAVKHFNDKPVDFKDVRTAI-EIATLAPSANNIQPWKFVVVQ--EKKSALAE    59
            F+E+ K R ++++++     K+  T I E AT APS+N  QPW+F+V+   E K  LA
Sbjct:   7  FMEIMKGRRSIRNYDPAVKISKEEMTEILEEATTAPSSVNAQPWRFLVIDSPEGKEKLAP  66

Query:  60  GLPESNCNQINQAQYVIALFTDTD----LGQRSRKIARIGRRSLPDDLIGYYMETLPPRY   115
            L N     Q+ + VIA+F D +    L +    K   +G   +P ++    + L    +
Sbjct:  67  -LASFNQTQVTTSSAVIAVFADMNNADYLEEIYSKAVELG--YMPQEVKDRQIAALTAHF  123

Query: 116  ALYSEKQTGEYLSLNAGIVAMNLVLALTDQGISSNMILGFDKAITNDVLEIDK-RFRPEI   174
                 +   E + ++ G+V+M L+L      G  +N I G+DK     +DK R+ P +
Sbjct: 124  EKLPAQVNRETILIDGGLVSMQLMLTARAHGYDTNPIGGYDKENIAETFGLDKERYVPVM  183

Query: 175  LITVGYSDEKVEPSYRLPVDHIIE 198
            L+++G + ++   SYRLP+D I E
Sbjct: 184  LLSIGKAADEGYASYRLPIDTIAE 207
```

Example 853

A DNA sequence (GBSx0905) was identified in *S. agalactiae* <SEQ ID 2579> which encodes the amino acid sequence <SEQ ID 2580>. Analysis of this protein sequence reveals the following:

---

Possible site: 13
>>> Seems to have no N-terminal signal sequence
INTEGRAL     Likelihood = -0.32     Transmembrane 2-18 (2-18)
----- Final Results -----
   bacterial membrane --- Certainty = 0.1128 (Affirmative) <succ>
     bacterial outside --- Certainty = 0.0000 (Not Clear) <succ>
     bacterial cytoplasm --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 854

A DNA sequence (GBSx0906) was identified in *S. agalactiae* <SEQ ID 2581> which encodes the amino acid sequence <SEQ ID 2582>. This protein is predicted to be nad(p)h nitroreductase ydgi. Analysis of this protein sequence reveals the following:

---

Possible site: 38
>>> Seems to have no N-terminal signal sequence
INTEGRAL     Likelihood = -1.81     Transmembrane 127-143 (126-143)
----- Final Results -----
   bacterial membrane --- Certainty = 0.1723 (Affirmative) <succ>
     bacterial outside --- Certainty = 0.0000 (Not Clear) <succ>
     bacterial cytoplasm --- Certainty = 0.0000 (Not Clear) <succ>

---

The protein has homology with the following sequences in the GENPEPT database.

A related DNA sequence was identified in *S. pyogenes* <SEQ ID 2583> which encodes the amino acid sequence <SEQ ID 2584>. Analysis of this protein sequence reveals the following:

---

Possible site: 38
>>> Seems to have no N-terminal signal sequence
INTEGRAL     Likelihood = -2.18     Transmembrane 127-143 (126-143)
----- Final Results -----
   bacterial membrane --- Certainty = 0.1871 (Affirmative) <succ>
     bacterial outside --- Certainty = 0.0000 (Not Clear) <succ>
     bacterial cytoplasm --- Certainty = 0.0000 (Not Clear) <succ>

---

The protein has homology with the following sequences in the databases:

```
>GP:CAC09964 GB:AX033132 unnamed protein product [Bacillus subtilis]
Identities = 63/204 (30%), Positives = 109/204 (52%), Gaps = 11/204 (5%)
```

-continued

```
Query:    3 FLELNKKRHAIKTFNDQ-PVDYEDLRTAIEIATLAPSANNIQPWKFVVVQ--EKKAELAK     59
            F+E+ K R +I+ ++    +  E++   +E AT APS+ N QPW+F+V+   E K +LA
Sbjct:    7 FMEIMKGRRSIRNYDPAVKISKEEMTEILEEATTAPSSVNAQPWRFLVIDSPEGKEKLA-    65

Query:   60 GLPLA--NKVQVEQAQYVVALFSDTDLALRSRKIARIGVK--SLPDDLIGYYMETLPPRF    115
              PLA   N+ QV +   V+A+F+D + A    +I     V+    +P ++   + L   F
Sbjct:   66 --PLASENQTQVTISSAVIAVFADMNNADYLEEIYSKAVELGYMPQEVKDRQIAALTAHF    123

Query:  116 AAFNEVQTGEYLAINAGIVAMNLVLSLTDQKIASNIILGFDKSTTNEILDID-PRFRPEL    174
                      E + I  +G+V+M  L+L+       +N I  G+DK     E   +D  R+ P+
Sbjct:  124 EKLPAQVNRETILIDGGLVSMQLMLTARAHGYDTNPIGGYDKENIAETEGLDKERYVPVM    183

Query:  175 LITVGYSDEKPEPSYRLPVDEVIE                                       198
            L+++G + ++    SYRLP+D + E
Sbjct:  184 LLSIGKAADEGYASYRLPIDTIAE                                       207
```

An alignment of the GAS and GBS proteins is shown below.

```
Identities = 157/200 (78%), Positives = 184/200 (91%)
Query:    1 MKFLELNKKRHAVKHFNDKPVDFKDVRTAIEIATLAPSANNIQPWKFVVVQEKKSALAEG     60
            MKFLELNKKRHA+K FND+PVD++D+RTAIEIATLAPSANNIQPWKFVVVQEKK+ LA+G
Sbjct:    1 MKFLELNKKRHAIKTFNDQPVDYEDLRTAIEIATLAPSANNIQPWKFVVVQEKKAELAKG     60

Query:   61 LPESNCNQINQAQYVIALFTDTDLGQRSRKIARIGRRSLPDDLIGYYMETLPPRYALYSE    120
            LP +N  Q+ QAQYV+ALF+DTDL  RSRKIARIG +SLPDDLIGYYMETLPPR+A ++E
Sbjct:   61 LPLANKVQVEQAQYVVALFSDTDLALRSRKIARIGVKSLPDDLIGYYMETLPPRFAAFNE    120

Query:  121 KQTGEYLSLNAGIVAMNLVLALTDQGISSNMILGFDKAITNDVLEIDKRFRPEILITVGY    180
            +QTGEYL++NAGIVAMNLVL+LTDQ I+SN+ILGFDK+ TN++L+ID RFRPE+LITVGY
Sbjct:  121 VQTGEYLAINAGIVAMNLVLSLTDQKIASNIILGFDKSTTNEILDIDPRFRPELLITVGY    180

Query:  181 SDEKVEPSYRLPVDHIIEKR                                           200
            SDEK EPSYRLPVD +IE+R
Sbjct:      SDEKPEPSYRLPVDEVIERR                                           200
  181
```

Based on this analysis, it was predicted that these proteins and their epitopes could be useful antigens for vaccines or diagnostics.

Example 855

A DNA sequence (GBSx0907) was identified in *S. agalactiae* <SEQ ID 2585> which encodes the amino acid sequence <SEQ ID 2586>. Analysis of this protein sequence reveals the following:

Possible site: 37
>>> Seems to have no N-terminal signal sequence

-continued

----- Final Results -----
bacterial cytoplasm --- Certainty = 0.2895 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:AAC45369 GB:U78036 dipeptidase [Lactococcus lactis]
Identities = 312/474 (65%), Positives = 370/474 (77%), Gaps = 11/474 (2%)
Query:    2 TIDFRAEVDKRKDALMDDLINLLRINSERDDSQADAEHPFGPGPVKALEFFLEMAERDGY     61
            TIDF+AEV+KRKDALM+DL +LLRI+S D   ADAE+PFGPGP KAL+ FL++AERDGY
Sbjct:    3 TIDFKAEVEKRKDALMEDLFSLLRIDSANDMEHADAENPFGPGPRKALDAFLKIAERDGY     62

Query:   62 ETKNVDNYAGHFTFGQGE----EELGIFGHLDVVPAGSGWDTDPYEPVIKDNRLYARGSS    117
            TKN DNY GHF + G     E LGI GHLDVVPAGSGWD++P+EP I++  LYARG+S
Sbjct:   63 TTKNYDNYVGHFEYENGANADAEVLGIIGHLDVVPAGSGWDSNPFEPEIRNGNLYARGAS    122

Query:  118 DDKGPTMACYYALKIIKELGLPTSKKVRFVVGTDEESGWGDMDYYFEHVGLPKPDFGFSP    177
            DDKGPT+ACYYALKI +KEL LP SKK+RF+VGT EE+GW DMDYYFEH  LP PDFGFSP
Sbjct:  123 DDKGPTVACYYALKILKELNLPLSKKIRFIVGTNEETGWADMDYYFEHCELPLPDFGFSP    182

Query:  178 DAEFPIINGEKGNITEYLHFSGENKGAVRLHSFSGGLRENMVPESATARFTSHLDQTTLG    237
            DAEFPIINGEKGNITEYLHFSG+N G V LHSF  GL ENMVPESATA + D  L
Sbjct:  183 DAEFPIINGEKGNITEYLHFSGKNAGQVVLHSFKAGLAENMVPESATAVISGAED---LE    239
```

```
Query: 238   ASLADFASKH---NLKAELSVEDEQYTATVYGKSAHGSTPQEGVNGATYLALYLSQFDFE    294
              A+L  F ++H    NL+ +L   D + T T+YGKSAHG+ P++G+NGATYL L+L+QFDF
Sbjct: 240   AALEKFVAEHASKNLRFDLEEADGKATITLYGKSAHGAMPEKGINGATYLTLFLNQFDFA    299

Query: 295   GPARAFLDVTANIIHEDFSGEKLGVAYEDDCMGPLSMNAGVFQFDETNDDNTIALNFRYP    354
                A AF+ V A  + ED  GEKLG A+ D+ M   SMNAGV+ FDE N +  IALNFR+P
Sbjct: 300   DGAAAFIKVGAEKLLEDHEGEKLGTAFVDELMENTSMNAGVWSFDE-NGEGKIALNFRFP    358

Query: 355   QGTDAKTIQTKLEKLNGVEKVTLSDHEHTPHYVPMDDELVSTLLAVYEKQTGLKGHEQVI    414
              QG   + +Q   L  KL+GV +V LS H HTPHYVPM D LVSTL+ VYEK TGLKG+E +I
Sbjct: 359   QGNSPERMQEILAKLDGVVEVELSKHLHTPHYVPMSDPLVSTLIDVYEKHTGLKGYETII    418

Query: 415   GGGTFGRLLERGVAYGAMFPGDENTMHQANEYMPLENIFRSAAIYARAIYELIK         468
              GGGTFGRLLERGVAYGAMF G+ ++MHQANE  P+ENI+++A IYAEAIYEL K
Sbjct: 419   GGGTFGRLLERGVAYGAMFEGEPDSMHQANEMKPVENIYKAAVIYAEAIYELAK         472
```

A related DNA sequence was identified in *S. pyogenes* <SEQ ID 2587> which encodes the amino acid sequence <SEQ ID 2588>. Analysis of this protein sequence reveals the following:

Possible site: 14
>>> Seems to have no N-terminal signal sequence
----- Final Results -----
   bacterial cytoplasm --- Certainty = 0.3107 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 361/467 (77%), Positives = 403/467 (85%)
Query:   2   TIDFRAEVDKRKDALMDDLINLLRINSERDDSQADAEHPFGPGPVKALEFFLEMAERDGY    61
              TIDF+AEVDKRK A++ DL++LLRINSERDD  AD +HPFGPGPVKALE FL MAERDGY
Sbjct:  20   TIDFKAEVDKRKKAMLADLVDLLRINSERDDQLADDKHPFGPGPVKALEHFLAMAERDGY    79

Query:  62   ETKNVDNYAGHFTFGQGEEELGIFGHLDVVPAGSGWDTDPYEPVIKDNRLYARGSSDDKG    121
              +T+N+DNYAG F  FGQG+E  LGIFGHLDVVPAGSGWDTDPYEPVIKD+R+YARGSSDDKG
Sbjct:  80   KTRNIDNYAGDFEFGQGDEVLGIFGHLDVVPAGSGWDTDPYEPVIKDDRIYARGSSDDKG    139

Query: 122   PTMACYYALKIIKELGLPTSKKVRFVVGTDEESGWGDMDYYFEHVGLPKPDFGFSPDAEF    181
              PTMACYYALKIIKELGLP SKKVRF+VGTDEESGWGDMDYYF H GL  PDFGFSPDAEF
Sbjct: 140   PTMACYYALKIIKELGLPVSKKVRFIVGTDEESGWGDMDYYFAHNGLKNPDFGFSPDAEF    199

Query: 182   PIINGEKGNITEYLHFSGENKGAVRLHSFSGGLRENMVPESATARFTSHLDQTTLGASLA    241
              PIINGEKGNITEYLHF+G+NKGA  LH F GGLRENMVPESATA  T+  D   L A+L
Sbjct: 200   PIINGEKGNITEYLHFAGDNKGAFVLHRFQGGLRENMVPESATAVITAPHDLDVLEAALE    259

Query: 242   DFASKHNLKAELSVEDEQYTATVYGKSAHGSTPQEGVNGATYLALYLSQFDFEGPARAFL    301
                 F S+H +K  +     D +   T+ GKSAHGSTP+ GVNGAT LA +L+QF FEG A+ +L
Sbjct: 260   QFLSEHGVKGSMKATDGKIEVTIIGKSAHGSTPEAGVNGATLLAKFLNQFTFEGAAKDYL    319

Query: 302   DVTANIIHEDFSGEKLGVAYEDDCMGPLSMNAGVFQFDETNDDNTIALNFRYPQGTDAKT    361
                V   ++HEDF+ EKLG+AY DD MG LSMNAGVF FD  + DNTIALNFRYP+GTDA T
Sbjct: 320   HVAGEVLHEDFAAEKLGLAYTDDRMGALSMNAGVFTFDSQSADNTIALNFRYPKGTDAAT    379

Query: 362   IQTKLEKLNGVEKVTLSDHEHTPHYVPMDDELVSTLLAVYEKQTGLKGHEQVIGGGTFGR    421
              ++   LEKL G+ KV+LS+HEHTPHYVPMDDELV+TLLAVYEKQTGLKG+EQVIGGGTFGR
Sbjct: 380   LKAGLEKLPGLTKVSLSEHEHTPHYVPMDDELVATLLAVYEKQTGLKGYEQVIGGGTFGR    439

Query: 422   LLERGVAYGAMFPGDENTMHQANEYMPLENIFRSAAIYAEAIYELIK                468
              LLERGVA+GAMFPGDENTMHQANEYMPLENI+RSAAIYAEAIYELIK
Sbjct: 440   LLERGVAFGAMFPGDENTMHQANEYMPLENIYRSAAIYAEAIYELIK                486
```

Based on this analysis, it was predicted that these proteins and their epitopes could be useful antigens for vaccines or diagnostics.

Example 856

A DNA sequence (GBSx0908) was identified in *S. agalactiae* <SEQ ID 2589> which encodes the amino acid sequence <SEQ ID 2590>. Analysis of this protein sequence reveals the following:

Possible site: 30
>>> Seems to have no N-terminal signal sequence
----- Final Results -----
   bacterial cytoplasm --- Certainty = 0.5598 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP: AAC21888 GB: U32707 H. influenzae predicted coding region
HI0220.2 [Haemophilus influenzae Rd]
Identities = 123/192 (64%), Positives = 160/192 (83%), Gaps = 1/192 (0%)

Query:    1 MTDLEKIIKAIKSDSQNQNYTENGIDPLFAAPKTARINIVGQAPGLKTQEARLYWKDKSG   60
            + +L++I  +I +D QN+++TE GI PLF+APKTARINIVGQAPGLK +++RLYW DKSG
Sbjct:   21 LKNLDEITSSIIADPQNKDFTERGIFPLFSAPKTARINIVGQAPGLKAEQSRLYWNDKSG   80

Query:   61 DRLRQWLGVDEETFYHSGKFAVLPLDFYYPGKGKSGDLSPRKGFAEKWHPLILKEMPNVQ  120
            DRLR+WLGVD + FY+SG FAVLP+DFYYPG GKSGDL PR+GFAE+WHP+IL   +PN+Q
Sbjct:   81 DRLREWLGVDYDYFYNSGIFAVLPMDFYYPGYGKSGDLPPRQGFAERWHPMILGNLPNIQ  140

Query:  121 LTLLVGQYTQKYYLGSSAHKNLTETVKAYKDYLPDYLPLVHPSPRNQIWLKKNPWFEKDL  180
            LT+L+GQY QKYYL +   N+T TVK Y+ +LP ++PLVHPSPRNQ+W+ KNPWFE+ +
Sbjct:  141 LTILIGQYAQKYYLPEN-KDNVTNTVKNYRQFLPHEMPLVHPSPRNQLWVTKNPWFEEQV  199

Query:  181 IVDLQKIVADIL                                                 192
            I +LQ +V  I+
Sbjct:  200 IPELQILVKQII                                                 211
```

A related DNA sequence was identified in *S. pyogenes* <SEQ ID 2591> which encodes the amino acid sequence <SEQ ID 2592>. Analysis of this protein sequence reveals the following:

Possible site: 47
>>> Seems to have no N-terminal signal sequence
----- Final Results -----
    bacterial cytoplasm --- Certainty = 0.3740 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below.

```
Identities = 122/189 (64%), Positives = 150/189 (78%)

Query:    4 LEKIIKAIKSDSQNQNYTENGIDPLFAAPKTARINIVGQAPGLKTQEARLYWKDKSGDRL   63
            ++ + KAI +D  N +YTE GI PL+ AP+TARI IVGQAPG+  Q  +LYW D+SG RL
Sbjct:    1 MDDLTKAIMADEANLSYTERGIFPLYDAPQTARIIIVGQAPGIVAQGTKLYWNDRSGIRL   60

Query:   64 RQWLGVDEETFYHSGKFAVLPLDFYYPGKGKSGDLSPRKGFAEKWHPLILKEMPNVQLTL  123
            R WLGVD +TFYHSG F ++P+DFYYPGKGKSGDL PR+GFA KWHP +  MP V+LT+
Sbjct:   61 RDWLGVDNDTFYHSGLFGIIPMDFYYPGKGKSGDLPPREGFAAKWHPPLRALMPEVELTI  120

Query:  124 LVGQYTQKYYLGSSAHKNLTETVKAYKDYLPDYLPLVHPSPRNQIWLKKNPWFEKDLIVD  183
            LVG+Y Q +YLG+ A+K LTETV+ ++DYLPDY PLVHPSPRNQ+WL KNPWFE+DL+
Sbjct:  121 LVGRYAQDFYLGNKAYKTLTETVRHFEDYLPDYFPLVHPSPRNQLWLAKNPWFEQDLLPI  180

Query:  184 LQKIVADIL                                                    192
            LQK V  IL
Sbjct:  181 LQKRVEAIL                                                    189
```

Based on this analysis, it was predicted that these proteins and their epitopes could be useful antigens for vaccines or diagnostics.

Example 857

A DNA sequence (GBSx0909) was identified in *S. agalactiae* <SEQ ID 2593> which encodes the amino acid sequence <SEQ ID 2594>. Analysis of this protein sequence reveals the following:

Possible site: 16
>>> Seems to have no N-terminal signal sequence
----- Final Results -----
    bacterial cytoplasm --- Certainty = 0.4178 (Affirmative) <succ>
      bacterial membrane --- Certainty = 0.0000 (Not Clear) <succ>
        bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 858

A DNA sequence (GBSx0910) was identified in *S. agalactiae* <SEQ ID 2595> which encodes the amino acid sequence <SEQ ID 2596>. Analysis of this protein sequence reveals the following:

Possible site: 45
>>> Seems to have no N-terminal signal sequence
----- Final Results -----
    bacterial cytoplasm --- Certainty = 0.2779 (Affirmative) <succ>
      bacterial membrane --- Certainty = 0.0000 (Not Clear) <succ>
        bacterial outside --- Certainty = 0.0000 (Not Clear) <succ>

A related GBS nucleic acid sequence <SEQ ID 9899> which encodes amino acid sequence <SEQ ID 9900> was also identified.

The protein has homology with the following sequences in the GENPEPT database.

```
>GP: AAD35886 GB: AE001748 conserved hypothetical protein [Thermotoga maritima]
Identities = 36/124 (29%), Positives = 58/124 (46%), Gaps = 3/124 (2%)

Query:  19 VPTKELLADYFNRMEFAIGRVEAHVLAHFDYGFRKLNLDVEDLKPFETQLKRIFIKMLSK     78
           +P  EL DY R F + RV+ H LAH DY R    D   K    +++I + ++
Sbjct:  98 LPPDELARDYLERTLFVMERVKFHTLAHLDYPARYAKAD---FKANRDLIEKILVFLVKN    154

Query:  79 GLAFELNTKSLYLYGNEKLYRYALEILKQLGCKQYSIGSDGHIPEHFCYEFDRLQGLLKD    138
              A E+NT L+ +G     + +E+   LG +  +IGSD H  +H     + +    LK
Sbjct: 155 EKALEINTAGLFKHGKPNPDYWIVEMYYDLGGRVVTIGSDAHESQHIGRGIEEVMRELKK    214

Query: 139 YQID    142
           + +
Sbjct: 215 FNFE    218
```

No corresponding DNA sequence was identified in *S. pyogenes*.

Based on this analysis, it was predicted that these proteins and their epitopes could be useful antigens for vaccines or diagnostics.

Example 859

A DNA sequence (GBSx0911) was identified in *S. agalactiae* <SEQ ID 2597> which encodes the amino acid sequence <SEQ ID 2598>. This protein is predicted to be alkaline amylopullulanase (pulA). Analysis of this protein sequence reveals the following:

Possible site: 41
>>> Seems to have no N-terminal signal sequence
INTEGRAL Likelihood = –10.08 Transmembrane 1225-1241 (1222-1247)
INTEGRAL Likelihood = –2.44 Transmembrane 19-35 (18-36)
INTEGRAL Likelihood = –0.11 Transmembrane 1146-1162 (1146-1162)
----- Final Results -----
   bacterial membrane --- Certainty = 0.5034 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database.

```
>GP: AAG33958 GB: AF217414 pullulanase [Streptococcus pneumoniae]
Identities = 641/1311 (48%), Positives = 854/1311 (64%), Gaps = 88/1311 (6%)

Query:    1 MKRKDLFGDKQTQYTIRKLSVGVASVATGVCIFLHSPQVFAEEVSASPANTAIAESNINQ     60
            M++     +K+ Y+IR L G SV G +L                   A+A  I+
Sbjct:    1 MRKTPSHTEKKMVYSIRSLKNGTGSVLIGASLVL---------------LAMATPTISS     44

Query:   61 VDNQQSTNLKDDINSNSETVVTPSDMPDTKQLVSDETDTQKGVTEPDKATSLLEENKG-P    119
            ++  +TN  +  N N+ T+ P  + DT     +     +  ++ P A + LE +   P
Sbjct:   45 DESTPTTN--EPNNRNTTTLAQP--LTDT---AAGSGKNESDISSPGNANASLEKTEEKP     97

Query:  120 VSDKNTLDLKVAPSTLQNTPDKTSQAIGAPSPTLKVANQAPRIENGYFRLHLKELPQGHP    179
            ++  T    A    Q  D++S+    + SP          IE+ YFR+H+K+LP+ +
Sbjct:   98 ATEPTTPAASPADPAPQTGQDRSSEPTTSTSPVTTETKAEEPIEDNYFRIHVKKLPEENK    157

Query:  180 VESTGLWIWGDVDQPSSNWPNGAIPMTDARKDDYGYYVDFKLSEKQRKQISFLINNKAGT    239
            ++ GLW W DV++PS NWPNGA+    DAKKDDYGYY+D KL  +Q K+ISFLINN AG
Sbjct:  158 -DAQGLWTWDDVEKPSENWPNGALSFKDAKKDDYGYYLDVKLKGEQAKKISFLINNTAGK    216

Query:  240 NLSGDHHIPLLRPEMNQVWIDEKYGTHTYQPLKEGYVRINYLSSSSNYDHLSAWLFKDVA    299
            NL+GD + L P+MN+ W+D+ Y   +Y+P  G VR+NY +  NYD S W + DV
Sbjct:  217 NLTGDKSVEKLVPKMNEAWLDQDYKVFSYEPQPAGTVRVNYYRTDGNYDKKSLWYWGDVK    276

Query:  300 TPSTT-WPDGSNFVNQGLYGRYIDVSLKTNAKEIGFLILDESKTGDAVKVQPNDYVFRDL    358
            PS+   WPDG++F   G YGRYID+ +    A+E GFL+LDESK GD VK++   +Y F DL
Sbjct:  277 NPSSAQWPDGTDFTATGKYGRYIDIPLNEAAREFGFLLLDESKQGDDVKIRKENYKFTDL    336

Query:  359 ANHNQIFVKDKDPKVYNNPYYIDQVQLKDAQQIDLTSIQASETTLDGVDKTEILKELKVT    418
            NH+QIF+KD D  +Y NPYY+   +++ AQ + +SI++SF+TL G  K +ILK   +T
Sbjct:  337 KNHSQIFLKDDDESIYTNPYYVHDIRMTGAQHVGTSSIESSFSTLVGAKKEDILKHSNIT    396

Query:  419 DKNQNAIQISDITLDTSKSLLIIKGDFNPKQGHFNISYNGNNVMTRQSWEFKDQLYAYSG    478
             +  N + I+D+ +D +      GDF+ +  + +SYN +    T+  SW   KD+ Y+Y G
Sbjct:  397 NHLGNKVTITDVAIDEAGKKVTYSGDFSDTKHPYTVSYNSDQFTTKTSWRLKDETYSYDG    456

Query:  479 NLGAVLNQDGSKVEASLWSPSADSVTMIIYDKDNQNRVVATTPLMKNNKGVWQTILDT--    536
              LGA L  ++G +V+ +LWSPSAD V++++YDK++  ++VV T   L  K +G W+  LD+
Sbjct:  457 KLGADLKEEGKQVDLTLWSPSADKVSVVVYDKNDPDKVVGTVALEKGERGTWKQTLDSTN    516
```

-continued

```
Query:   537 KLGIKNYTGYYYLYEIKRGKDKVKILDPYAKSLAEWDSNT--VNDDIKTAKAAFVNPSQL   594
             KLGI ++TGYYY Y+I+R    V  LDPYAKSLA W+S+    ++D  K AKAAFV+P++L
Sbjct:   517 KLGITDFTGYYYQYQIERQGKTVLALDPYAKSLAAWNSDDAKIDDAHKVAKAAFVDPAKL   576

Query:   595 GPQNLSFAKIANFKGRQDAVIYEAHVRDFTSDRSLDGKLENQFGTFAAFSEKLDYLQKLG   654
             GPQ+L++ KI NFK R+DAVIYEAHVRDFTSD ++    L   FGTF AF EKLDYL+ LG
Sbjct:   577 GPQDLTYGKIHNFKTREDAVIYEAHVRDFTSDPAIAEDLTKPFGTFEAFIEKLDYLKDLG   636

Query:   655 VTHIQLLPVLSYFYVNEMDKSRSTA-YTSSDNNYNWGYDPQSYFALSGMYSEKPKDPSAR   713
             VTHIQLLPVLSY++VNE+       + Y SS++NYNWGYDPQ+YF+L+GMYS  PK+P  R
Sbjct:   637 VTHIQLLPVLSYYFVNELKNHEHLSDYASSNSNYNWGYDPQNYFSLTGMYSSDPKNPEKR   696

Query:   714 IAELKQLIHDIHKRGMGVILDVVYNHTAKTYLFEDIEPNYYHFMNEDGSPRESFGGGRLG   773
             IAE K LI++IHKRGMG ILDVVYNHTAK +FED+EPMYYHFM+ DG+PR SFGGGRLG
Sbjct:   697 IAEFKNLINEIHKRGMGAILDVVYNHTAKVDIFEDLEPNYYHFMDADGTPRTSFGGGRLG   756

Query:   774 TTHAMSRRVLVDSIKYLTSEFKVDGFRFDMMGDHDAAAIELAYKEAKAINPNMIMIGEGW   833
             TTH M++R+LVDSIKYL   +KVDGFRFDMMGDHDAA+IE AYK A+A+NPN+IM+GEGW
Sbjct:   757 TTHHMTKRLLVDSIKYLVDTYKVDGFRFDMMGDHDAASIEEAYKAARALNPNLIMLGEGW   816

Query:   834 RTFQGDQGQPVKPADQDWMKSTDTVGVFSDDIRNSLKSGFPNEGTPAFITGGPQSLQGIF   893
             RT+ GD+  P K ADQDWMK TDTV VFSDDIRN+LKSG+PNEG PAFITGG + +  IF
Sbjct:   817 RTYAGDENMPTKAADQDWMKHTDTVAVFSDDIRNNLKSGYPNEGQPAFITGGKRDVNTIF   876

Query:   894 KNIKAQPGNFEADSPGDVVQYIAAHDNLTLHDVIAKSINKDPKVAEE--EIHRRLRLGNV   951
             KN+ AQP NFEADSPGDV+QYIAAHDNLTL D+IA+SI KDP  AE    EIHRRLRLGN+
Sbjct:   877 KNLIAQPTNFEADSPGDVIQYIAAHDNLTLFDIIAQSIKKDPSKAENYAEIHRRLRLGNL   936

Query:   952 MILTSQGTAFIHSGQEYGRTKRLLNPDYMTKVSDDKLPNKATLIEAVK----EYPYFIHD   1007
             M+LT+QGT FIHSGQEYGRTK+  NP Y T V++DK+PNK+ L+       +YPYFIHD
Sbjct:   937 MVLTAQGTPFIHSGQEYGRTKQFRNPAYRTPVAEDKVPNKSHLLRDKGNPFDYPYFIHD   996

Query:  1008 SYDSSDAINHFDWAAATDNNKHPISTKTQAYTAGLITLRRSTDAFRKLSKAEIDREVSLI   1067
             SYDSSDA+N FDW  ATD  +P + K++ Y GLI LR+STDAFR  S  +I   V LI
Sbjct:   997 SYDSSDANNKFDWTKATDGKAYPENVKSRDYMKGLIALRQSTDAFRLKSLQDIKDRVHLI   1056

Query:  1068 TEVGQGDIKEKDLVIAYQTIDSKGDIYAVFVNADSKARNVLLGEKYKHLLKGQVIVDADQ   1127
             T  GQ  ++++D+VI YQ      GDIYAVFVNAD KAR   LG  + HL    +V+ D +Q
Sbjct:  1057 TVPGQNGVEKEDVVIGYQITAPNGDIYAVFVNADEKAREFNLGTAFAHLRNAEVLADENQ   1116

Query:  1128 AGIKPISTPRGVHFEKDSLLIDPLTAIVIKVGKVAPS---------------PKEELQAD   1172
             AG  I+ P+G+ + +  L ++ LTA V++V +  S                P+ + +A
Sbjct:  1117 AGSVGIANPKGLEWTEKGLKLNALTATVLRVSQNGTSHESTAEEKPDSTPSKPEHQNEAS   1176

Query:  1173 YPKTQ----------SFKESKTVEKVNRIANKT---------------SITPVVSKKADS   1207
             +P  Q           + ++K   + N+ + T                S+    V K++
Sbjct:  1177 HPAHQDPAPEARPDSTKPDAKVADAENKPSQATADSQAEQPAQEAQASSVKEAVRKESVE   1236

Query:  1208 YLTNE---------ANLPKTGDKSSKILSVVGISILASLLALVGLSLKRNR          1249
              + E         A LP TG K+  L   GIS+LA LL  L G  LK +
Sbjct:  1237 NSSKENISATPDRQAELPNTGIKNENKLLFAGISLLA-LLGL-GFLLKNKK          1285
```

A related DNA sequence was identified in *S. pyogenes* <SEQ ID 2599> which encodes the amino acid sequence <SEQ ID 2600>. Analysis of this protein sequence reveals the following:

Possible site: 35
>>> Seems to have no N-terminal signal sequence
INTEGRAL Likelihood = −10.83 Transmembrane 1153 -1169 (1148-1171)
INTEGRAL Likelihood = −1.97  Transmembrane 29-45 (28-46)
----- Final Results -----
  bacterial membrane --- Certainty = 0.5331 (Affirmative) <succ>
  bacterial outside --- Certainty = 0.0000 (Not Clear) <succ>
  bacterial cytoplasm --- Certainty = 0.0000 (Not Clear) <succ>

A related sequence was also identified in GAS <SEQ ID 9125> which encodes the amino acid sequence <SEQ ID 9126>. Analysis of this protein sequence reveals the following:

Possible cleavage site: 26
>>> Seems to have an uncleavable N-term signal seq
----- Final Results -----
  bacterial membrane --- Certainty = 0.533 (Affirmative) <succ>
  bacterial outside --- Certainty = 0.000 (Not Clear) <succ>
  bacterial cytoplasm --- Certainty = 0.000 (Not Clear) <succ>
LPXTG motif: 1133-1137

An alignment of the GAS and GBS proteins is shown below.

```
Identities = 715/1097 (65%), Positives = 872/1097 (79%), Gaps = 21/1097 (1%)

Query:   156 ANQAPRIENGYFRLHLKELPQGHPVESTGLWIWGDVDQPSSNWPNGAIPMTDAKKDDYGY   215
             AN A   E+ + +R+H K LP G  +S GLW+WGDVDQPS +WPNGAI MT AKKDDYGY
Sbjct:    95 ANPASIAEH-HLRMHFKTLPAGESLGSLGLWVWGDVDQPSKDWPNGAITMTKAKKDDYGY   153
```

```
Query:   216  YVDFKLSEKQRKQISFLINNKAGTNLSGDHHIPLLRPEMNQVWIDEKYGTHTYQPLKEGY       275
              Y+D  L+ K R+Q+S+LINNKAG NLS D HI LL P+MN+VWIDE Y  H Y+PLK+GY
Sbjct:   154  YLDVPLAAKHRQQVSYLINNKAGENLSKDQHISLLTPKMNEVWIDENYHAHAYRPLKKGY       213

Query:   276  VRINYLSSSSNYDHLSAWLFKDVATPSTTWPDGSNFVNQGLYGRYIDVSLKTNAKEIGFL       335
              +RINY + S +YD+L+ W FKDV TP+T WP+G +  ++G YG Y+DV KL  A EIGFL
Sbjct:   214  LRINYHNQSGHYDNLAVWTFKDVKTPTTDWPNGLDLSHKGHYGAYVDVPLKEGANEIGFL       273

Query:   336  ILDESKTGDAVKVQPNDYVFRDLANHNQIFVKDKDPKVYNNPYYIDQVLKDAQQIDLTS       395
              ILD+SKTGDA+KVQP DY+F++L NH Q+FVKD DPKVYNNPYYIDQV LK A+Q
Sbjct:   274  ILDKSKTGDAIKVQPKDYLFKELDNHTQVFVKDTDPKVYNNPYYIDQVELKGAEQTTPNE       333

Query:   396  IQASFTTLDGVDKTEILKELKVTDKNQAIQISDITLDTSKSLLIIKGDFNPKQGHFNIS       455
              I+A FTTLDG+D+ + + +K+TDK    I I ++TLD  KS++ +KGDF +   + ++
Sbjct:   334  IKAIFTTLDGLDEDAVKQNIKITDKAGKTVAIDELTLDRDKSVMTLKGDFKAQGAVYTVT       393

Query:   456  YNGNNVMTRQSWEFKDQLYAYSGNLGAVINQDGSKVEASLWSPSADSVTMIIYDKDNQNR       515
              +   + + RQSW+ KD+LYAY G LGA L +DGS V+ +LWSPSAD+V +++YDK +Q R
Sbjct:   394  FGEVSQVARQSWQLKDKLYADGELGATLAKDGS-VDLALWSPSADTVKVVVYDKQDQTR       452

Query:   516  VVATTPLMKNNKGVWQTIL--DTKLGIKNYTGYYYLYEIKRGKDKVKILDPYAKSLAEWD       573
              VV    L K++KGVW+  L  D+  GI +YTGYYYLYEI RG++KV +LDPYAKSLA W+
Sbjct:   453  VVGQADLTKSDKGVWRAHLTSDSVKGISDYTGYYYLYEITRGQEKVMVLDPYAKSLAAWN       512

Query:   574  SNTVNDDIKTAKAAFVNPSQLGPQNLSFAKIANFKGRQDAVIYEAHVRDFTSDRSLDGKL       633
                 T  DDIKTAKAAF++PS+LGP   L FAKI NFK R+DA+IYEAHVRDFTSD++L+GKL
Sbjct:   513  DATATDDIKTAKAAFIDPSKLGPTGLDFAKINNFKKREDATIYEAHVRDFTSDKALEGKL       572

Query:   634  KNQFGTFAAFSEKLDYLQKLGVTHIQLLPVLSYFYVNEMDKSRSTAYTSSDNNYNWGYDP       693
               + FGTF+AF E+LDYL+ LGVTH+QLLPVLSYFY NE+DKSRSTAYTSSDNNYNWGYDP
Sbjct:   573  THPFGTFSAFVEQLDYLKDLGVTHVQLLPVLSYFYANELDKSRSTAYTSSDNNYNWGYDP       632

Query:   694  QSYFALSGMYSEKPKDPSARIAELKQLIHDIHKRGMGVILDVVYNHTAKTYLFEDIEPNY       753
              Q YFALSGMYS   P DP+ RIAELK L+++IHKRGMGVI DVVYNHTA+TYLFED+EPNY
Sbjct:   633  QHYFALSGMYSANPNDPALRIAELKNLVNEIHKRGMGVIFDVVYNHTARTYLFEDLEPNY       692

Query:   754  YHFMNEDGSPRESFGGGRLGTTHAMSRRVLVDSIKYLTSEFKVDGFRFDMMGDHDAAAIE       813
              YHFMN DG+ RESFGGGRLGTTHAMSRR+LVDSI YLT EFKVDGFRFDMMGDHDAAAIE
Sbjct:   693  YHFMNADGTARESFGGGRLGTTHAMSRRILVDSITYLTREFKVDGFRFDMMGDHDAAAIE       752

Query:   814  LAYKRAKAINPNMIMIGEGWRTFQGDQGQPVKPADQDWMKSTDTVGVFSDDIRNSLKSGF       873
               A+K AKAINPN IMIGEGWRT+QGD+G+    ADQDWMK+T+TVGVFSDDIRN+LKSGF
Sbjct:   753  QAFKAAKAINPNTIMIGEGWRTYQGDEGKKEIAADQDWMKATNTVGVFSDDIRNTLKSGF       812

Query:   874  PNEGTPAFITGGPQSLQGIFKNIKAQPGNFEADSPGDVVQYIAAHDNLTLHDVIAKSINK       933
              PNEGT AFITGG ++L+G+FK IKAQPGNFEAD+PGDVVQYIAAHDNLTLHDVIAKSINK
Sbjct:   813  PNEGTAAFITGGAKNLEGLFKTIKAQPGNFEADAPGDVVQYIAAHDNLTLHDVIAKSINK       872

Query:   934  DPKVAEEEIHRRLRLGNVMILTSQGTAFIHSGQEYGRTKRLLNPDYMTKVSDDKLPNKAT       993
              DPKVAEEEIH+R+RLGN MILT+QGTAFIHSGQEYGRTK+LLNPDY TK SDDK+PNKAT
Sbjct:   873  DPKVAEEEIHKRIRLGNTMILTAQGTAFIHSGQEYGRTKQLLNPDYKTKASDDKVPNKAT       932

Query:   994  LIEAVKEYPYFIHDSYDSSDAINHFDWAAATDNNKHPISTKTQAYTAGLITLRRSTDAFR      1053
              LI+AV +YPYFIHDSYDSSDA+NHFDWA ATD+  HPIS +T AYT GLI LRRSTDAF
Sbjct:   933  LIDAVAQYPYFIHDSYDSSDAVNHFDWAKATDSIAHPISNQTKAYTQGLIALRRSTDAFT       992

Query:  1054  KLSKAEIDREVSLITEVGQGDIKEKDLVIAYQTIDSKGDIYAVFVNADSKARNVLLGEKY      1113
              K +KAE+DR+V+LIT+ GQ  I+++DL++ YQT+ S GD YAVFVNAD+K R V+L + Y
Sbjct:   993  KATKAEVDRDVTLITQAGQDGIQQEDLIMGYQTVASNGDRYAVFVNADNKTRKVVLPQAY      1052

Query:  1114  KHLLKGQVIVDADQAGIKPISTPRGVHFEKDSLLIDPLTAIVIKV-GKVAPSPKEELQAD      1172
              ++LL  QV+VDA+QAG+ I+ P+GV F K+ L I+ LTA+V+KV  K A     +++ Q D
Sbjct:  1053  RYLLGAQVLVDAEQAGVTAIAKPKGVQFTKEGLTIEGLTALVLKVSSKTANPSQQKSQTD      1112

Query:  1173  YPKTQSFKESKTVEKVNRIANKTSITPVVSKADSYLTNEANLPKTGDKSSKILSVVGIS      1232
              +T++   SK ++K    K + T                LPKTG+ SSK L   GI+
Sbjct:  1113  NHQTKTPDGSKDLDKSLMTRPKRAKT-------------NQKLPKTGEASSKGLLAAGIA      1159

Query:  1233  ILASLLALVGLSLKRNR      1249
               +   LL   L +KR +
Sbjct:  1160  L---LLLAISLLMKRQK      1173
```

A related GBS gene <SEQ ID 8673> and protein <SEQ ID 8674> were also identified. Analysis of this protein sequence reveals the following:

```
Lipop: Possible site: -1    Crend: 9
McG: Discrim Score: -0.88
GvH: Signal Score (-7.5): 4.13
Possible site: 41
>>> Seems to have no N-terminal signal sequence
ALOM program count: 3    value: -10.08    threshold: 0.0
INTEGRAL      Likelihood = -10.08    Transmembrane
                                     1225-1241 (1222-1247)
INTEGRAL      Likelihood = -2.44     Transmembrane
                                     19-35 (18-36)
INTEGRAL      Likelihood = -0.11     Transmembrane
                                     1146-1162 (1146-1162)
PERIPHERAL    Likelihood = -2.44         653
modified ALOM score: 2.52
*** Reasoning Step: 3
----- Final Results -----
    bacterial membrane --- Certainty = 0.5034 (Affirmative) <succ>
    bacterial outside --- Certainty = 0.0000 (Not Clear) <succ>
    bacterial cytoplasm --- Certainty = 0.0000 (Not Clear) <succ>
LPXTG motif: 1081-1085
```

The protein has homology with the following sequences in the databases:

```
ORF00953(1111-3768 of 4356)
EGAD|165156|TM1845(18-840 of 843) pullulanase {Thermotoga maritima}SP|O33840|PULA_THEMA
PULLULANASE PRECURSOR (EC 3.2.1.41) (ALPHA-DEXTRIN
ENDO-1,6-ALPHA-GLUCOSIDASE) (PULLULAN 6-
GLUCANOHYDROLASE) .GP|2815006|emb|CAA04522.1||AJ001087 pullulanase {Thermotoga
maritima}GP|4982428|gb|AAD36907.1|AE001821_7|AE001821 pullulanase {Thermotoga
maritima}PIR|H72204|H72204 pullulanase - Thermotoga maritima (strain MSB8)
% Match = 8.4
% Identity = 30.6 % Similarity = 52.8
Matches = 210 Mismatches = 298 Conservative Sub.s = 152

1032      1062      1092      1122      1152      1182      1212      1242
       NKAGTNLSGDHHIPLLRPEMNQVWIDEKYGTHTYQPLKEGYVRINYLSSSSNYDHLSAWLFKDVATPSTTWPDGSNFVNQ
                  :    :|      :   ::|   ||   :  :|        |    |      |     |    :
                       MKTKLWLLLVLLLSALIFSETTIVVHYHRYDGKYDGWNLWIWP--VEPVSQEGKAYQFTGE
                           10        20        30        40        50

1272      1302      1329      1359              1668      1698
       GLYGRYIDVSLKTNAKEIGFLI-LDESKTGDAVKVQPNDYVFRDLA~~~~PKQGHFNISYNGNNVMTRQSWEFKDQL---
         :|:    ||    |  :   ::|   ::  |:|                                      |:  ||
       DDFGKVAVVKLPMDLTKVGIIVRLNE------------------~~~--------------------WQAKDVAKDR
               70        80                                                       90

1746      1776      1806      1836
       ---------------------~~~~-----------------YAYSGNLGAVLNQDGSKVEASLWSPSADSVTMIIYDKDN
                                                 |   | |||  : :    :|||   :   |  : :::
       FIEIKDGKAEVWILQGV~~~~ELIIEGYKPARVIMMEILDDYYYDGELGAVYSPE--KTIFRVWSPVSKWVKVLLFKNGE
               110          210       220       230       240       250

1866      1896      1926      1956      1986      2016      2046      2076
       QNRVVATTPLMKNNKGVWQTILDTKLGIKNYTGYYYLYEIKRGKDKVKILDPYAKSLAEWDSNTVNDDIKTAKAAFVNPS
         :     |||:  :::    |         |   : |||:::          :|||:|::                : |:| || :
       DTEPYQVVNMEYKGNGVWEAVVEGDL-----DGVFYLYQLENYGKIRTTVDPYSKAVYA----------NSKKSAVVNLA
                  270       280            290       300                 310       320

2106      2136      2166      2196      2226             2253      2283
       QLGPQNLSFAKIANFKGRQDAVIYEAHVRDFTSDRSLDGKLKNQFGTFAAFSEK-----------LDYLQKLGVTHIQLL
         :   |:     :     :|  :|||:|||   |:  |       :    :||:    |   ::|:           | :| :||||:::|
       RTNPEGWENDRGPKIEGYEDAIIYEIHIADITG--LENSGVKNK-GLYLGLTEENTKGPGGVTTGLSHLVELGVTHVHIL
               330       340       350       360       370       380       390

2313      2343      2373      2403      2433      2463      2493
       PVLSYFYVNEMDKSRSTAYTSSDNNYNWGYDPQSYFALSGMYSEKPKDPSARIAELKQLIHDIHKRGMGVILDVVYNHT-
       |  :  ::      :|:||           :  |||||      |    |  :|    ||  :|:::      |    :|::::          :  | |||||::|           |::  ||
       PFFDFYTGDELDK-------DFEKYYNWGYDPYLFMVPEGRYSTDPKNPHTRIREVKEMVKALHKHGIGVIMDMVFPHTY
               410              420       430       440       450       460       470

2544      2574      2601      2631      2661      2691      2721      2751
       --AKTYLFEDIEPNYYHFMNEDGSP-RESFGGGRLGTTHAMSRRVLVDSIKYLTSEFKVDGFRFDMMGGLIDHDAAAIELAYK
         :      |:      |   |:: ::: |:     ||    |    ::   |  |:  :|||:: |         |:  |||||| || :   :
       GIGELSAFDQTVPYYFYRIDKTGAYLNESGOGNVIASERPMMRKFIVDTVTYWVKEYHIDGFRFDQMGLIDKKTMLEVER
               480       490       500       510       520       530       540       550

2781      2811      2841      2871      2901      2931      2979
       EAKAINPNMIMIGEGWRTFQGDQGQPVKPADQDWMKSTDTVGVFSDDIRNSLKSGFPNEGTPAFITGG----PQSLQGIF
       |:|    :|:   |||      |        |       |::    |       |:|:   | ::::      |   | ||             :   :|:
       ALHKIDPTIILYGEPW----GGWGAPIRFGKSD--VAGTHVAAFNDEFRDAIRGSVFNPSVKGFVMGGYGKETKIKRGVV
               560          570           580        590       600       610       620
```

```
3030         3060       3084       3114       3144       3174       3204
KNIKAQPG---NFEADSPGDVVQYIAAHDNLTLHD--VIAKSINKDPKVAEEEIHRRLRLGNVMILTSQGTAFIHSGQEY
    |       :|    |   | :  |   |||  ||    :|     :|    :  |||      :|   ::|||||   |:|   ||::
GSINYDGKLIKSFALD-PEETINYAACHDNHTLWDKNYLAAKADKKKEWTEEELKNAQKLAGAILLTSQGVPFLHGGQDF
             640          650          660          670          680          690        700

3234         3264       3294       3324       3354       3384       3414       3444
GRTKRLLNPDYMTKVSDDKLPNKATLIEAVKEYPYFIHDSYDSSDAINHFDWAAATDNNKHPISTKTQAYTAGLITLRRS
|||                             |  :||::   :|| ||:           :            |    |||  ||:
CRTKN---------------------------FNDNSYNAPISINGFDY------ERKLQFIDVFNYHKGLIKLRKE
                                       710          720                730          740

3474               3504        3534       3564        3594        3624         3654
TDAFRKLSKAEI----------DREVSLITEVGQGDIKEKDLVIAYQTIDSKGDIYAVFVNADSKARNVLLGEKYKHLLK
|||   :    ||          |  |:::   :  |      ||:|: |                       |    || |  :
HPAFRLKNAEEIKKHLEFLPGGRRIVAFMLKDHAGGDPWKDIVVIYN-------------------GNLEKTTYK-LPE
      760        770         780        790                                          800

3678         3708       3738       3768       3798       3828       3858       3888
GQ--VIVDADQAGIKPISTPRGVHFEKDSLLIDPLTAIVIKVGKVAPSPKEELQADYPKTQSFKESKTVEKVNRIANKTS
|:   |:|::  :||   :  |  |           ::  :|||:| |:
GKWNVVVNSQKAGTEVIETVEG------TIELDPLSAYVLYRE
                820          830        840
```

SEQ ID 2598 (GBS5) was expressed in *E. coli* as a His-fusion product. SDS-PAGE analysis of total cell extract is shown in FIG. 3 (lane 7; MW 134 kDa).

The His-fusion protein was purified as shown in FIG. 190, lane 7.

Based on this analysis, it was predicted that these proteins and their epitopes could be useful antigens for vaccines or diagnostics.

Example 860

A DNA sequence (GBSx0912) was identified in *S. agalactiae* <SEQ ID 2601> which encodes the amino acid sequence <SEQ ID 2602>. Analysis of this protein sequence reveals the following:

Possible site: 26
>>> Seems to have no N-terminal signal sequence
INTEGRAL Likelihood = −10.72 Transmembrane 231-247 (228-251)
INTEGRAL Likelihood = −8.39 Transmembrane 50-66 (44-68)
INTEGRAL Likelihood = −6.74 Transmembrane 23-39 (20-41)
INTEGRAL Likelihood = −5.84 Transmembrane 173-189 (168-196)
INTEGRAL Likelihood = −4.41 Transmembrane 299-315 (297-318)
INTEGRAL Likelihood = −4.14 Transmembrane 115-131 (114-133)
INTEGRAL Likelihood = −3.35 Transmembrane 80-96 (79-97)
INTEGRAL Likelihood = −0.48 Transmembrane 97-113 (97-113)
----- Final Results -----
   bacterial membrane --- Certainty = 0.5288 (Affirmative) <succ>
   bacterial outside --- Certainty = 0.0000 (Not Clear) <succ>
   bacterial cytoplasm --- Certainty = 0.0000 (Not Clear) <succ>

A related GBS nucleic acid sequence <SEQ ID 8675> which encodes amino acid sequence <SEQ ID 8676> was also identified. Analysis of this protein sequence reveals the following:

SRCFLG: 0
MCG: Length of UR: 19
Peak Value of UR: 3.08
Net Charge of CR: 1
McG: Discrim Score: 9.76
GvH: Signal Score (−7.5) : −4.57
Possible site: 22
>>> Seems to have an uncleavable N-term signal seq
Amino Acid Composition: calculated from 1
ALOM program count: 7   value: −10.72   threshold: 0.0
INTEGRAL     Likelihood = −10.72 Transmembrane 217-233 (214-237)
INTEGRAL     Likelihood = −8.39 Transmembrane 36-52 (30-54)
INTEGRAL     Likelihood = −6.74 Transmembrane 9-25 (6-27)
INTEGRAL     Likelihood = −5.84 Transmembrane 159-175 (154-182)
INTEGRAL     Likelihood = −4.14 Transmembrane 101-117 (100-119)
INTEGRAL     Likelihood = −3.35 Transmembrane 66-82 (65-83)
INTEGRAL     Likelihood = −0.48 Transmembrane 83-99 (83-99)
PERIPHERAL   Likelihood = 0.26   136
modified ALOM score: 2.64
icml HYPID: 7 CFP: 0.529
*** Reasoning Step: 3
----- Final Results -----
   bacterial membrane --- Certainty = 0.5288 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database.

```
>GP: BAB08178 GB: AB036768 exfoliative toxin A [Staphylococcus hyicus]
Identities = 134/298 (44%), Positives = 197/298 (65%)

Query:   22 PLVMAGLVLGLLALGNLLEGYGTYVRYCLGLVALVFWIFLIKGILKNKKESRKELSNPLI   81
            PLV +GLVLGLL LGNLL+        G++A++ W+ L+   +  N    + +L++PL+
Sbjct:    7 PLVSSGLVLGLLGLGNLLKDVSLSLNALCGILAILVWLHLLYSMFNNVNHVENQLNSPLV   66
```

```
-continued
Query:  82 ASVFTTFFMAGMILSTYILLFRSLGIWVAVLSKGVWWLSFIALIIHMAIFSWKYLRHFSM 141
           +SVFTTFFM+G + +TY+  F S   ++   L    +W L   I ++ HM IFS KYL+ FS+
Sbjct:  67 SSVFTTFFMSGFLGTTYLNTFFSHISFIHHLITPLWLLCLIGILTHMIIFSHKYLKSFSL 126

Query: 142 ANLFPSWSVLYVGIGVASLTAPISGQFTIGKIVFWYGFIATLVLLPFLFIKAYKIGLPSA 201
              N++PSW+VLY+GI +A LTAP+SG F IGK+    YGF+AT ++LP +F +      L ++
Sbjct: 127 ENVYPSWTVLYIGIAIAGLTAPVSGYFFIGKLTVIYGFVATCIVLPLVFKRLKTYPLQTS 186

Query: 202 VKPNITTICAPMSLITAGYVNSFVSPNRGLLLLLIVMAQFLYFFILFQVPKLLIGDFTPG 261
           +KPN +TICAP SL+ A YV +F   +   +++L ++++Q  YF+I+FQ+PKLL     F+P
Sbjct: 187 IKPNTSTICAPFSLVAAAYVLAFPEAHDFVVILFLILSQVFYFYIVFQLPKLLREPFSPV 246

Query: 262 FSAFTFPLVISATSLKLSIQHLSLPVDIQGLVHFEIGTTTLIVMIVMVRYIFFLRRTI   319
           FSAFTFPLVISAT+LK S+  L  P      GL+ FE       T+IV   V    YI     + +
Sbjct: 247 FSAFTFPLVISATALKNSMPILIFPEIWNGLLMFETVLATVIVFRVFFGYIHLFLKPV   304
```

A related DNA sequence was identified in *S. pyogenes* <SEQ ID 2603> which encodes the amino acid sequence <SEQ ID 2604>. Analysis of this protein sequence reveals the following:

Possible site: 40
>>> Seems to have no N-terminal signal sequence
INTEGRAL Likelihood = −9.82 Transmembrane 169-185 (163-189)
INTEGRAL Likelihood = −8.49 Transmembrane 50-66 (38-69)
INTEGRAL Likelihood = −7.86 Transmembrane 228-244 (224-247)
INTEGRAL Likelihood = −5.15 Transmembrane 288-304 (284-306)
INTEGRAL Likelihood = −3.29 Transmembrane 108-124 (107-126)
INTEGRAL Likelihood = −3.29 Transmembrane 140-156 (140-161)
INTEGRAL Likelihood = −1.33 Transmembrane 84-100 (84-100)
----- Final Results -----
  bacterial membrane --- Certainty = 0.4927 (Affirmative) <succ>
  bacterial outside --- Certainty = 0.0000 (Not Clear) <succ>
  bacterial cytoplasm --- Certainty = 0.0000 (Not Clear) <succ>

An alignment of the GAS and GBS proteins is shown below.

```
Identities = 138/305 (45%), Positives = 200/305 (65%), Gaps = 5/305 (1%)

Query:  12 RYMMKNWEKPPLVMAGLVLGLLALGNLLEGYGTYVRYCLGLVALVFWIFLIKGILKNKKE  71
           R +MK+ + PPLVM+GL LG L+ GNLL  Y +    Y   L AL  + L+ G+++N   +
Sbjct:  12 RTLMKHLKIPPLVMSGLALGTLSFGNLLATYVSIFNYLGILAALFIYGILLVGMVRNLND  71

Query:  72 SRKELSNPLIASVFTTFFMAGMILSTYILLFRSLGIWVAVLSKGVWWLSFIALIIHMAIF 131
           ++  +L  PLIASVF TFFM GM+LS+   L    G W+   L+   WWL F+  ++ +A +
Sbjct:  72 TKMQLRQPLIASVFPTFFMTGMLLSSLFLKVTG-GCWLGFLT---WWLFFLGNLVLIAYY 127

Query: 132 SWKYLRHFSMANLFPSWSVLYVGIGVASLTAPISGQFTIGKIVFWYGFIATLVLLPFLFI 191
             ++++   FS   N+FPSWSVL+VGI +A+LTAP S QF +G+++FW    + T V+LPF+
Sbjct: 128 QYRFVFSFSWDNVFPSWSVLFVGIAMAALTAPASRQFLLGQVIFWVCLLLTAVILPFMAK 187

Query: 192 KAYKIGLPSAVKPNITTICAPMSLITAGYVNSFVSPNRGLLLLLIVMAQFLYFFILFQVP 251
           K Y IGL  AV PNI+T CAP+SL++A YA +F  P   G++++ L+V +Q LY F++ Q+P
Sbjct: 188 KTYGIGLGQAVMPNISTFCAPLSLLSASYLATFPRPQVGMVIFLLVSSQLLYAFVVVQLP 247

Query: 252 KLLIGDFTPGFSAFTFPLVISATSLKLSIQHLSLP-VDIQGLVHFEIGTTTLIVMIVMVR 310
           +LL   F  PGFSAFTFP VISATSLK+++   L    +  Q L+   E+      T +V   V
Sbjct: 248 RLLNRPFNPGFSAFTFPFVISATSLKMTLSFLGWQGLGWQVLLLGEVLLATALVTYVYGA 307

Query: 311 YIFFL 315
           Y+ FL
Sbjct: 308 YLRFL 312
```

Based on this analysis, it was predicted that these proteins and their epitopes could be useful antigens for vaccines or diagnostics.

Example 861

A DNA sequence (GBSx0913) was identified in *S. agalactiae* <SEQ ID 2605> which encodes the amino acid sequence <SEQ ID 2606>. Analysis of this protein sequence reveals the following:

Possible site: 28
>>> Seems to have a cleavable N-term signal seq.
----- Final Results -----
  bacterial outside --- Certainty = 0.3000 (Affirmative) <succ>
  bacterial membrane --- Certainty = 0.0000 (Not Clear) <succ>
  bacterial cytoplasm --- Certainty = 0.0000 (Not Clear) <succ>

The protein has no significant homology with any sequences in the GENPEPT database.

A related DNA sequence was identified in *S. pyogenes* <SEQ ID 2607> which encodes the amino acid sequence <SEQ ID 2608>. Analysis of this protein sequence reveals the following:

Possible site: 28
>>> Seems to have a cleavable N-term signal seq.
----- Final Results -----
  bacterial outside --- Certainty = 0.3000 (Affirmative) <succ>
  bacterial membrane --- Certainty = 0.0000 (Not Clear) <succ>
  bacterial cytoplasm --- Certainty = 0.0000 (Not Clear) <succ>

An alignment of the GAS and GBS proteins is shown below.

```
Identities = 45/57 (78%), Positives = 53/57 (92%)

Query:   1 MVKKFAFAKGIATGVVATAATLAGAAFAIKKTIIEPEEEKIAFIEENRKKAARKRVS 57
           MVKK+ F KG+ATGV+ATAAT+AGA FA+KKTII+PEEEK AFIEENRKKAAR+RV+
Sbjct:   1 MVKKYQFVKGLANGVLATAATVAGAVFAVKKTIIDPEEEKAAFIEENRKKAARREVA 57
```

Based on this analysis, it was predicted that these proteins and their epitopes could be useful antigens for vaccines or diagnostics.

Example 862

A DNA sequence (GBSx0914) was identified in *S. agalactiae* <SEQ ID 2609> which encodes the amino acid sequence <SEQ ID 2610>. This protein is predicted to be tRNA isopentenylpyrophosphate transferase (miaA). Analysis of this protein sequence reveals the following:

---
Possible site: 20
>>> Seems to have an uncleavable N-term signal seq
----- Final Results -----
  bacterial membrane --- Certainty = 0.0000 (NotClear) <succ>
  bacterial outside --- Certainty = 0.0000 (NotClear) <succ>
  bacterial cytoplasm --- Certainty = 0.0000 (NotClear) <succ>
---

A related GBS nucleic acid sequence <SEQ ID 9897> which encodes amino acid sequence <SEQ ID 9898> was also identified.

The protein has homology with the following sequences in the GENPEPT database.

A related DNA sequence was identified in *S. pyogenes* <SEQ ID 2611> which encodes the amino acid sequence <SEQ ID 2612>. Analysis of this protein sequence reveals the following:

---
Possible site: 27
>>> Seems to have a cleavable N-term signal seq.
----- Final Results -----
  bacterial outside --- Certainty = 0.3000 (Affirmative) <succ>
  bacterial membrane --- Certainty = 0.0000 (Not Clear) <succ>
  bacterial cytoplasm --- Certainty = 0.0000 (Not Clear) <succ>
---

An alignment of the GAS and GBS proteins is shown below.

```
>GP: BAB06085 GB: AP001515 tRNA isopentenylpyrophosphate transferase
[Bacillus halodurans]
Identities = 139/311 (44%), Positives = 200/311 (63%), Gaps = 21/311 (6%)

Query:   7 KIKLIAVVGPTAVGKTALGIELAKTFNGEIISGDSQQVYQKLDIGTAKASKEEQEQAYHH    66
           K KL+A+VGPTAVGKT   + LAK  NGE+ISGDS QVY+ +DIGTAK + EE +    HH
Sbjct:   2 KEKLVAIVGPTAVGKTKTSVMLAKRLNGEVISGDSMQVYRGMDIGTAKITAEEMDGVPHH    61

Query:  67 LIDVREVNENYSVYDFVKEAKVAIDTIISKGKIPIIVGGTGLYLQSLFEGYHLGGEVNQE   126
           LID+++ +E++SV DF   A   I  I  +G++P +VGGTGLY+ ++    ++LG    E
Sbjct:  62 LIDIKDPSESFSVADFQDLATPLITEIHERGRLPFLVGGTGLYVNAVIHQFNLGDIRADE   121

Query: 127 TLMAYREKLE----SLSDEDLFEKLT----EQSIIIPQVNRRRAIRALELAKF-------   171
                YR +LE     S   + L +KL+      + +  I    N RR IRALE+  K
Sbjct: 122 D---YRHELEAFVNSYGVQALHDKLSKIKPKAAAAIHPNNYRRVIRALEIIKLTGKTVTE   178

Query: 172 -GNDLQNSESPYDVLLIGLNDDRQVLYDRINRRVDLMMDNGLLDEAKWLYD-NYPSVQAS   229
            + +  SPY++++IGL   +R VLYDRINRRVD M++ GL+DEAK LYD    Q+
Sbjct: 179 QARHEEETPSPYNLVMIGLTMERDVLYDRINRRVDQMVEEGLIDEAKKLYDRGIRDCQSV   238

Query: 230 KGIGYKELFPYFSKQIPLEEAVDKLKQNTRRFAKRQLTWFRNRNNVEFIMVGEENYQQKI   289
           + IGYKE++ Y   + LEEA+D LK+N+RR+AKRQLRWFRN+ NV + + + ++ +KI
Sbjct: 239 QAIGYKEMYDYLDGNVTLEEAIDTLKRNSRRYAKRQLTWFRNKANVTWFDMTDVDFDKKI   298

Query: 290 KRKVSDFLSSK                                                  300
           ++ +F++ K
Sbjct: 299 -MEIHNFIAGK                                                  308
```

```
Identities = 202/296 (68%), Positives = 250/296 (84%)

Query:     5 MRKIKLIAVVGPTAVGKTALGIELAKTENGEIISGDSQQVYQKLDIGTAKASKEEQEQAY    64
             M KIK++ +VGPTAVGKTALGI LAK FNGEIISGDSQQVY++LDIGTAKA++EEQE A
Sbjct:     1 MTKIKIVVIVGPTAVGKTALGISLAKAFNGEIISGDSQQVYRQLDIGTAKATQEEQEAAV   60

Query:    65 HHLIDVREVNENYSVYDFVKEKAKVAITIISKGKIPIIVGGTGLYLQSLFEGYHLGGEVN   124
             HHLID+REV E+YS YDFV++A+ +I  I+S+GK+PIIVGGTGLYLQSL EGYHLGG+V+
Sbjct:    61 HHLIDIREVTESYSAYDFVQDAQKSISDIVSRGKLPIIVGGTGLYLQSLLEGYHLGGQVD  120

Query:   125 QETLMAYREKLESLSDEDLFEKLTEQSIIIPQVNRRRAIRALELAKFGNDLQNSESPYDV   184
             QE + AYR +LE L D DL+E+L   +I I QVNRRRAIRALELA+F ++L+N+E+ Y+
Sbjct:   121 QEAVKAYRNELEQLDDHDLYERLQVNNITIEQVNRRRAIRELELAQFADELENAETATEP  180

Query:   185 LLIGLNDDRQVLYDRINRRVDLMMDNGLLDEAKWLYDNYPSVQASKGIGYKELFPYFSKQ   244
             L+IGLNDDRQV+YDRIN+RV+ M++NGLL+EAKWLY++YP+VQAS+GIGYKELFPYF  +
Sbjct:   181 LIIGLNDDRQVIYDRINQRVNRMIENGLLEEARWLYEHYPTVQASRGIGYKELFPYFVGE  240

Query:   245 IPLEEAVDKLKQNTRRFAKRQLTWFRNRMNVEFIMNGEENYQQKIKRKVSDFLSSK       300
             + L EA D+LKQYTRRFAKRQLTWFRNRM V F +   +Y Q +  +V DFL  K
Sbjct:   241 MTLAEASDQLKQNTRRFAKRQLTWFRNRMAVSFTAITAPDYPQVVHDRVRDFLGQK      296
```

Based on this analysis, it was predicted that these proteins and their epitopes could be useful antigens for vaccines or diagnostics.

Example 863

A DNA sequence (GBSx0915) was identified in *S. agalactiae* <SEQ ID 2613> which encodes the amino acid sequence <SEQ ID 2614>. This protein is predicted to be hflX (hflX). Analysis of this protein sequence reveals the following:

Possible site: 35
>>> Seems to have an uncleavable N-term signal seq
----- Final Results -----
  bacterial membrane --- Certainty = 0.0000 (Not Clear) <succ>
  bacterial outside --- Certainty = 0.0000 (Not Clear) <succ>
  bacterial cytoplasm --- Certainty = 0.0000 (Not Clear) <succ>

A related DNA sequence was identified in *S. pyogenes* <SEQ ID 2615> which encodes the amino acid sequence <SEQ ID 2616>. Analysis of this protein sequence reveals the following:

Possible site: 48
>>> Seems to have an uncleavable N-term signal seq
----- Final Results -----
  bacterial membrane --- Certainty = 0.0000 (Not Clear) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

The protein has homology with the following sequences in the databases:

```
>GP: BAB06081 GB:P001515 unknown conserved protein [Bacillus halodurans]
Identities = 182/406 (44%), Positives = 254/406 (61%), Gaps = 12/406 (2%)

Query:     9 ERVILVGVELQDT--ENFEMSMEELASLAKTAGANVVNHYYQKRDKYDSKSFIGSGKLEE    66
             ERV LV +L +    E FE S+EEL +L TA   V++  QKR+ +  ++IG GKL+E
Sbjct:    10 ERVFLVACQLPNMTDEQFEASLEELEALTLTAQGTVIDRLTQKREAIEPATYIGRGKLDE   69

Query:    67 IKAIVEADEIDTVVVNNRLTPRQNSNLEAELGVKVIDRMQLILDIFAMRARSHEGKLQVH   126
             +   +E  E D V+VN L+ Q  NL   LGV+VIDR QLILDIFA RA+S EGKLQV
Sbjct:    70 LAIKMEEQEADLVIVNGELSGSQVRNLTNRLGVRVIDRTQLILDIFAGRAKSREGKLQVE  129

Query:   127 LAQLKYMLPRLVGQGIMLSRQAGGIGSRGPGESQLELNARSIRHQISDIERQLKIVEKNR   186
             LAQL Y+LPR+VGQG  LSR  GGIG+RGPGE++LE +RR IR +++DI++QLK   K+R
Sbjct:   130 LAQLNYLLPRIVGQGQGLSRLGGGIGTRGPGETKLETDRRHIRKRMADIDKQLKHTVKHR  189

Query:   187 ETVRERRVDSTTFKIGLIGYTNAGKSTIMNVLTDDKQYEANELFATIDATTKQTYLQNQF   246
             +  R RR  + TF+I L+GYTNAGKST++N LT    YE + LFATLD T+++ L +
Sbjct:   190 DRYRARRERNQTFRIALVGYTNAGKSTLLNRLTASDSYEEDLLFATLDPMTRKMRLPSGM  249

Query:   247 QVTLTDTVGFIQDLPTELVAAFKSTLEESRHVDLLFHVIDASDPNHEEHEKVVMEILKDL   306
             +V L+DTVGFI  LPT LVAAF+STLEE +H DLL HV+D S    +H + V E+L  L
Sbjct:   250 EVILSDTVGFINQLPTTLVAAFRSTLEEVKHADLLLHVVDRSSEQLQAHMETVSELLHQL  309

Query:   307 DMIDIPRLAIYNKMDVTEQLNATTFP-----NVRIAAKKQGSKDLLRRLIVDEIRHIFDE   361
              ++        L +YNK D  +N   P      + ++A K+   LR++I  +   +F
Sbjct:   310 EVDQSQMLVVYNKAD---KPNLPIIPVHQQNGIEMSAHKREDIQRLRQMIERTLVDLFTP  366

Query:   362 FSIRVHQNQAYKLYDLNKIALLDTYTFEEEYE--NITGYISPKQQW                405
             +  + ++ KL L+ ++    ++E+ E  + GY+ P   W
Sbjct:   367 YVTELASDEGNKLAKLRRETIMTEMKWDEDRECYQVKGYVHPNBAW                412
```

```
>GP: BAB06081 GB: AP001515 unknown conserved protein [Bacillus halodurans]
Identities = 185/403 (45%), Positives = 246/403 (60%), Gaps = 6/403 (1%)

Query:   13 ERVILLGVEL--QTTEHFDMSMTELANLAKTAGVKVMASFSQKRERYDSKTFIGSGKLDE    70
            ERV L+   +L    T E F+ S+ EL  L  TA   V+   +QKRE  +  T+IG GKLDE
Sbjct:   10 ERVFLVACQLPNMTDEQFEASLEELEALTLTAQGTVIDRLTQKREAIEPATYIGRGKLDE    69

Query:   71 IKAIVEADEIDAVIVNNRLTARQNANLEAVLEVKVIDRMQLILDIFAMRARSHEGKLQVH   130
            +     +E  E D VIVN  L+   Q  NL    L V+VIDR QLILDIFA  RA+S  EGKLQV
Sbjct:   70 LAIKMEEQEADLVIVNGELSGSQVRNLTNRLGVRVIDRTQLILDIFAGRAKSREGKLQVE   129

Query:  131 LAQLKYMLPRLVGQGIMLSRQAGGIGSRGPGESQLELNRRSIRHQIADIERQLTQVEKNR   190
            LAQL Y+LPR+VGQG  LSR  GGIG+RGPGE++LE +RR IR  ++ADI++QL     K+R
Sbjct:  130 LAQLNYLLPRIVGQGQGLSRLGGGIGTRGPGETKLETDRRHIRKRMADIDKQLKHTVKHR   189

Query:  191 QTIRDRRVGSDTFKIGLIGYTNAGKSTIMNLLTDDSHYEANELFATLDATTKQLYLENQF   250
                R RR  + TF+I L+GUTNAGKST++N LT    YE + LFATLD  T+++ L +
Sbjct:  190 DRYRARRERNQTFRIALVGYTNAGKSILLNRLTASDSYEEDLLFAILDPMTRKMALPSGM   249

Query:  251 QATLTDTVGFIQDLPTELVAAFKSTLEESKYVDLLLHVIDASDPNHSEQEKVVLNLLKEL   310
             +  L+DTVGFI  LPT LVAAF+STLEE K+ DLLLHV+D S        + V   LL +L
Sbjct:  250 EVILSDTVGFINQLPTILVAAFRSTLEEVKHADLLLHVVDRSSEQLQAHMETVSELLHQL   309

Query:  311 DMLNIPRLAIYNKVDIAEQ--FTATAFPNIRISARSKDSKILLRRLIIDQIRDQFVPFRI   368
            ++       L +YNK D        I +SA  ++    LR++I   + D F P+
Sbjct:  310 EVDQSQMLVVYNKADKPNLPIIPVHQQNGIEMSAHKREDIQRLRQMIERTLVDLFTPYVT   369

Query:  369 KVHQDKAYKLYDLNRVALLDHYTFDQEIE--DISGYISPKQQW                  409
            ++  D+ KL  L R ++    +D++ E    + GY+ P    W
Sbjct:  370 ELASDEGNKLAKLRRETIMTEMKWDEDRECYQVKGYVHPNHAW                  412
```

An alignment of the GAS and GBS proteins is shown below.

```
Identities = 326/412 (79%), Positives = 375/412 (90%)

Query:    1 MIETKEEQERVILVGVELQDTENFEMSMEELASLAKTAGANVVNHYYQKRDKYDSKSFIG    60
            MIETK +QERVIL+GVELQ TE+F+MSM ELA+LAKTAG  V+ +  QKR++YDSK+FIG
Sbjct:    5 MIETKRQQERVILLGVELQTTEHEDMSMTELANLAKTAGVKVMASFSQKRERYDSKTFIG    64

Query:   61 SGKLEEIKAIVEADEIDTVVVNNRLTPRQNSNLEAELGVKVIDRMQLILDIFAMRARSHE   120
            SGKL+EIKAIVEADEID V+VNNRLT RQN+NLEA L VKVIDRMQLILDIFAMRARSHE
Sbjct:   65 SGKLDEIKAIVEADEIDAVIVNNRLTARQNANLEAVLEVKVIDRMQLILDIFAMRARSHE   124

Query:  121 GKLQVHLAQLKYMLPRLVGQGIMLSRQAGGIGSRGPGESQLELNRRSIRHQISDIERQLK   180
            GKLQVHLAQLKYMLPRLVGQGIMLSRQAGGIGSRGPGESQLELNRRSIRHQI+DIERQL
Sbjct:  125 GKLQVHLAQLKYMLPRLVGQGIMLSRQAGGIGSRGPGESQLELNRRSIRHQIADIERQLT   184

Query:  181 IVEKNRETVRERRVDSTTFKIGLIGYTNAGKSTIMNVLTDDKQYEANELFATLDATTKQI   240
             VEKNR+T+R+RRV S TFKIGLIGYTNAGKSTIMN+LTDD  YEANELFATLDATTKQ+
Sbjct:  185 QVEKNRQTIRDRRVGSDTFKIGLIGYTNAGKSTIMNLLTDDSHYEANELFATLDATTKQL   244

Query:  241 YLQNQFQVILTDTVGFIQDLPTELVAAFKSTLEESRHVDLLFHVIDASDPNHEEHEKVVM   300
            YL+NQFQ  TLTDTVGFIQDLPTELVAAFKSTLEES++VDLL HVIDASDPNH E EKV++
Sbjct:  245 YLENQFQATLTDTVGFIQDLPTELVAAFKSTLEESKYVDLLLHVIDASDPNHSEQEKVVL   304

Query:  301 EILKDLDMIDIPRLAIYNKMDVTEQLNATTFPNVRIAAKKQGSKDLLRRLIVDEIRHIFD   360
             +LK+LDM++IPRLAIYNK+D+ EW   AT FPN RI+A+   SK LLRRLI+D+IR  F
Sbjct:  305 NLLKELDMLNIPRLAIYNKVDIAEQFTATAFPNIRISARSKDSKILLRRLIIDQIRDQFV   364

Query:  361 EFSIRVHQNQAYKLYDLNKIALLDTYTFEEEYENITGYISPKQKWKLEEFYD          412
             F I+VHQ++AYKLYDLN++ALLD YTF++ E+I+GYISPKQ+W L++FY+
Sbjct:  365 PFRIKVHQDKAYKLYDLNRVALLDHYTFDQEIEDISGYISPKQQWRLDDFYE          416
```

Based on this analysis, it was predicted that these proteins and their epitopes could be useful antigens for vaccines or diagnostics.

Example 864

A DNA sequence (GBSx0916) was identified in *S. agalactiae* <SEQ ID 2617> which encodes the amino acid sequence <SEQ ID 2618>. Analysis of this protein sequence reveals the following:

Possible site: 46
>>> Seems to have no N-terminal signal sequence
----- Final Results -----
    bacterial cytoplasm --- Certainty = 0.2044 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

A related DNA sequence was identified in *S. pyogenes* <SEQ ID 2619> which encodes the amino acid sequence <SEQ ID 2620>. Analysis of this protein sequence reveals the following:

Possible site: 40
>>> Seems to have no N-terminal signal sequence
----- Final Results -----
   bacterial cytoplasm --- Certainty = 0.3436 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 124/209 (59%), Positives = 150/209 (71%)

Query:    1  MIDYIDLALTYGGFTSLDKVYLEKKLDGLSKQQRLDFITPPPSVINAYFAEIYQKQGPEA    60
             M +YIDLA TYGGFTSLD  YL   L+ QQ+L FITPPPSVINAYFAEIYQKQ P+A
Sbjct:    5  MNNYIDLAKTYGGFTSLDTNYLNHLLASLTDQQKLAFITPPPSVINAYFAEIYQKQSPQA    64

Query:   61  ATDYYFDLSKALGLFPKHLSFDEEKPFIRLNLSGKSFGFAYLNDQEEASVFSEVKEVITP   120
             ATDYYF+LSKALGLF    SF+EEKPF+RLNLSGK++GFAY NDQE A VFSE E   P
Sbjct:   65  ATDYYFNLSKALGLFTDQPSFEEEKPFVRLNLSGKAYGFAYQNDQEVALVFSEKAEPKKP   124

Query:  121  QLLLEIAQIFPQYKVYRDRSGIRMAKIDFDETESQNITPETSLLGNVLQLKKDIIKITSF   180
             +L  E+ QIFPQY VY D+  ++M    F++ E ++ITP+ +LL   +L   I  + F
Sbjct:  125  ELFFELTQIFPQYMVYEDKGQLKMQAKQFEQGECEDITPDDTLLSKIYRLANGITMLKGF   184

Query:  181  NQEELLELVKTKSGKYYYSSQGRESVIYI   209
             N EEL  L +T SG+ YY   RE +IYI
Sbjct:  185  NVEELWALSQTFSGQKYYDFAQREFMIYI   213
```

Based on this analysis, it was predicted that these proteins and their epitopes could be useful antigens for vaccines or diagnostics.

Example 865

A DNA sequence (GBSx0917) was identified in *S. agalactiae* <SEQ ID 2621> which encodes the amino acid sequence <SEQ ID 2622>. Analysis of this protein sequence reveals the following:

Possible site: 16
>>> Seems to have no N-terminal signal sequence

----- Final Results -----
   bacterial cytoplasm --- Certainty = 0.1060 (Affirmative) <succ>
   bacterial membrane --- Certainty = 0.0000 (Not Clear) <succ>
   bacterial outside --- Certainty = 0.0000 (Not Clear) <succ>

A related GBS nucleic acid sequence <SEQ ID 9895> which encodes amino acid sequence <SEQ ID 9896> was also identified.

The protein has homology with the following sequences in the GENPEPT database.

```
GP: CAB14316 GB: Z99116 similar to hypothetical proteins [Bacillus subtilis]
Identities = 156/309 (50%), Positives = 210/309 (67%), Gaps = 5/309 (1%)

Query:    1  MEIQFLGTGAGQPAKARNVSSLVLKLLDEINEVWMFDCGEGTQRQILETTIKPRKVKKIF    60
             ME+ FLGTGAG PAKARNV+S+ LKLL+E    VW+EGCGE TQ QIL TTIKPRK++KIF
Sbjct:    1  MELLFLGTGAGIPAKARNVTSVALKLLEERRSVWLFDCGEATQHQILHTTIKPRKIEKIF    60

Query:   61  ITHMHGDHVFGLPGFLSSRAFQANEEQTDLDIYGPVGIKSFVMTALRTSGSRLPYRIHFH   120
             ITHMHGDHV+GLPG L SR+FQ  E++  L +YGP GIK+F+ T+L   + L Y +
Sbjct:   61  ITHMHGDHVYGLPOLLGSRSFQGGEDE--LTVYGPKGIKAFIETSLAVTKTHLTYPLAIQ   118

Query:  121  EFDESSLGKIMETDKFTVYAEKLDHTIFCMGYRVVQKDLEGTLDAEALKLAGVPFGPLFG   180
             E +E   G + E D+F V A  + H +   GYRV +KD+ G+L A+ LK    +P GP++
Sbjct:  119  EIEE---GIVFEDDQFIVTAVSVIHGVEAFGYRVQEKDVPGSLKADVLKEMNIPPGPVYQ   175

Query:  181  KVKNGENVTLEDGREITAKDYISEPKKGKVITILGDTRKTDASIRLALGADVLVHESTYG   240
             K+K GE VTLEDGR I    D++  PKKG+ +    GDTR +D   LA   DVLVHE+T+
Sbjct:  176  KIKKGETVTLEDGRIINGNDFLEPPKKGRSVVFSGDTRVSDKLKELARDCDVLVHEATFA   235

Query:  241  KGDERIAKSHGHSTNMQAADIAKQANAKRLLLNHVSARFMGRDCWQMEEDAKTIFSNTHL   300
             K D ++A + HST  QAA  AK+A AK+L+L H+SAR+ G     +++++A +F N+
```

-continued

```
Sbjct:  236 KEDRKLAYDYYHSTTEQAAVTAKEARAKQLILTHISARYQGDASLELQKEAVDVFPNSVA    295

Query:  301 VRDLEEVGI     309
            D  EV +
Sbjct:  296 AYDFLEVNV     304
```

A related DNA sequence was identified in *S. pyogenes* <SEQ ID 2623> which encodes the amino acid sequence <SEQ ID 2624>. Analysis of this protein sequence reveals the following:

---

Possible site: 16
>>> Seems to have no N-terminal signalsequence
----- Final Results -----
    bacterial cytoplasm --- Certainty = 0.2352 (Affirmative) <succ>
      bacterial membrane --- Certainty = 0.0000 (Not Clear) <succ>
        bacterial outside --- Certainty = 0.0000 (Not Clear) <succ>

---

An alignment of the GAS and GBS proteins is shown below.

```
Identities = 253/307 (82%), Positives = 285/307 (92%)

Query:    1 MEIQFLGTGAGQPAKARNVSSLVLKLL-                                   60
            DEINEVWMFDCGEGTQRQILETTIKPRKVKKIF
            ME+QFLGTGAGQPAK RNVSSL LKLLDEINEVWMFDCGEGTQRQILETTIKPRK++
            KIF
Sbjct:    1 MELQFLGTGAGQPAKQRNVSSLALKLL-                                   60
            DEINEVWMFDCGEGTQRQILETTIKPRKIRKIF Query:   61 ITHMHGDHVFGLPGFLSSRAFQANEEQT-                                 120
            DLDIYGPVGIKSFVMTALRTSGSRLPYRIHFH
            ITH+HGDH+FGLPGFLSSR+FQA+EEQTDLDIYGP+GIK++V+T+L+ SG+R+PY+IHFH
Sbjct:   61 ITHLHGDHIFGLPGFLSSRSFQASEEQT-                                 120
            DLDIYGPIGIKTYVLISLKVSGARVPYQIHFH Query:  121 EFDESSLGKIMETDKFTVYAEK-                                       180
            LDHTIFCMGYRVVQKDLEGTLDAEALKLAGVPFGPLFG
            EFD+ SLGKIMETDKF VYAE+L HTIFCMGYRVVQKDLEGTLKAEALK-
            AGVPFGPLFP
Sbjct:  121 EFDDKSLGKIMETDKFEVYAER-                                       180
            LAHTIFCMGYRVVQKDLEGTLDAEALKAAGVPFGPLFG Query:  181 KVKNGENVTLEDGREIIAKDYISEP-                                    240
            KKGKVITILGDTRKIDASIRLALGADVLVHESTYG
            K+KNG++V LEDGR I AKDYIS PKKGK+ITI+GDTRKT AS++LA  ADVLVH-
            ESTYG
Sbjct:  181 KIKNGQDVELEDGRLICAKDYISAP-                                    240
            KKGKIITIIGDTRKTSASVKLARDADVLVHESTYG Query:  241 KGDERIAKSHGHSTNMQAADI-                                        300
            AKQANAKRLLLNHVSARFMGRDCWQMEEDAKTIFSNTHL
            KGDERIA++HGHSTNMQAA IA +A AKRLLLNHVSARF+GRDC QME+DA T-
            IF N  +
Sbjct:  241 KGDERIARNHGHSTNMQAAQIA-                                       300
            HEAGAKRLLLNHVSARFLGRDCRQMEKDAATIFENVKM Query:  301 VRDLEEV     307
            V+DLEEV
Sbjct:  301 VQDLEEV
```

Example 866

A DNA sequence (GBSx0918) was identified in *S. agalactiae* <SEQ ID 2625> which encodes the amino acid sequence <SEQ ID 2626>. This protein is predicted to be similar to ketoacyl reductase. Analysis of this protein sequence reveals the following:

---

Possible site: 17
>>> Seems to have no N-terminal signal sequence
----- Final Results -----
    bacterial membrane --- Certainty = 0.0000 (NotClear) <succ>
      bacterial outside --- Certainty = 0.0000 (NotClear) <succ>
        bacterial cytoplasm --- Certainty = 0.0000 (NotClear) <succ>

---

307

Based on this analysis, it was predicted that these proteins and their epitopes could be useful antigens for vaccines or diagnostics.

The protein has homology with the following sequences in the GENPEPT database.

```
+>P: CAB14310 GB: Z99116 similar to ketoacyl reductase [Bacillus subtilis]
Identities = 100/253 (39%), Positives = 152/253 (59%), Gaps = 2/253 (0%)

Query:   3 RTILITGASGGLAQAIINQLPQDD-HLIVTGRSREKLEKLYGKRPNTLCLSLDITN-DNA   60
           + I ITGASGGL + I    +  H++++ R  ++L ++ K         +I    D
Sbjct:   7 KRIWITGASGGLGERIAYLCAAEGAHVLLSARREDRLIEIKRKITEEWSGQCEIFPLDVG   66

Query:  61 VTNMIEKIYGEFGQIDILINNAGFGSFKEFWDYSDEEVKDMFAVNTFATMSIARQIGHKM  120
              I ++   + G ID+LINNAGFG F+    D + +++K MF VN F   ++  + + +M
Sbjct:  67 RLEDIARVRDQIGSIDVLINNAGFGIFETVLDSTLDDMKAMFDVNVFGLIACTKAVLPQM  126

Query: 121 SLVKSGHIVNIASMAGLIATSKASVYGASKFAVVGFSNALRLELAEKNVYVTSVNPGPIK  180
              K GHI+NIAS AG IAT K+S+Y A+K AV+G+SNALR+EL+     +YVT+VNPGPI+
Sbjct: 127 LEQKKGHIINIASQAGKIATPKSSLYSATKHAVLGYSNALRMELSGTGIYVTTVNPGPIQ  186

Query: 181 TGFFAQADPSGDYLASIGRFALTPEKVSKKVVSILGKNKRELNLPFILAFAHKYYSLFPK  240
           T FF+ AD  GDY  ++GR+ L P+ V+ ++ + +    KRE+NLP ++   K Y LFP
Sbjct: 187 TDFFSIADKGGDYAKNVGRWMLDPDDVAAQITAAIFTKKREINLPRLMNAGTKLYQLFPA  246

Query: 241 TADYFARKVFNYK                                                253
              +  A +    K
Sbjct: 247 LVEKLAGRALMKK                                                259
```

A related DNA sequence was identified in *S. pyogenes* <SEQ ID 2627> which encodes the amino acid sequence <SEQ ID 2628>. Analysis of this protein sequence reveals the following:

Possible site: 18
>>> Seems to have a cleavable N-term signal seq.
----- Final Results -----
  bacterial outside --- Certainty = 0.3000 (Affirmative) <succ>
    bacterial membrane --- Certainty = 0.0000 (Not Clear) <succ>
      bacterial cytoplasm --- Certainty = 0.0000 (Not Clear) <succ>

The protein has homology with the following sequences in the databases:

```
>GP: BAB05225 GB: AP001512 oxidoreductase [Bacillus halodurans]
Identities = 107/259 (41%), Positives = 156/259 (59%), Gaps = 5/259 (1%)

Query:   1 MAQRIIVITGASGGLAQAIVKQLPKEDSLI-LLGRNKERLEHCYQHI----DNKE-      55
           CLELD
           M ++ I ITGAS GL + +         E++++ L  R++ERLE+  + +           +D
Sbjct:   1 MRKKTIFITGASSGLGRQLAIDFSWEET-                                60
           VLCLFARSQERLENVQRIVVENGGEAHIYPVD Query:  56 ITNPVAIEKMVAQIYQRYGRIDVLIN-                                  115
           NAGYGAFKGFEEFSAQEIADMFQVNTLASIHFAC
           +  +P +I++   A+       G +DVLINNAGYG F+ F +      E     MF+VN      I
Sbjct:  61 LADPQSIDRSFAEAISAVGVVDVLIN-                                  120
           NAGYGVFEPFCDSQMDENERMFRVNVFGLMRATA Query: 116 LIGQKMAEQGQGHLINIVSMA-                                       175
           GLIASAKSSIYSATKFALIGFSNALRLELADKGVYVTTV
           +   M EQG GH+INI S AG IA+AKS+IYSATK A++GF+N+LR+EL   G++V+ V
Sbjct: 121 AVLPTMREQGSGHIINIASQAGKIATAK-                                180
           SAIYSATKHAVLGFTNSLRMELKGTGIHVSAV Query: 176 NPGPIATKFFDQADPSGHYLESVGK-                                   235
           FTLQPNQVAKRLVSIIGKNKRELNLPFSLAVTHQF
           NPGPI T FFDQAD  G Y   V +   L P  V++++V +    K KRELNLP+ + +
Sbjct: 181 NPGPIQTPFFDQADKEGAY-                                         240
           TSKVQRIMLDPEDVSEKIVQLTKKPKRELNLPWWMNIGATA Query: 236 YTLFPKLSDYLARKVFNYK                                          254
           Y + P+L + LA K F  K
Sbjct: 241 YQVAPRLLELLAGKQFRQK                                          259
```

An alignment of the GAS and GBS proteins is shown below.

```
Identities = 155/251 (61%), Positives = 200/251 (78%)

Query:   3 RTILITGASGGLAQAIINQLPQD-                                         62
           DHLIVTGRSREKLEKLYGKRPNTLCLSLDITNDNAVT
             R I+ITGASGGLAQAI+ QLP++D LI+ GR++E+LE  Y    N  CL LDITN  A+
Sbjct:   4 RIIVITGASGGLAQAIVKQLPKEDS-                                       63
           LILLGRNKERLEHCYQHIDNKECLELDITNPVAIE Query:  63 NMIEKIYGEFGQIDILINNAGFGSFKEF-                                   122
           WDYSDEEVKDMFAVNTFATMSIARQIGHKMSL
             M+ +IY  +G+ID+LINNAG+G+FK F ++S +E+ DMF VNT A++  A  IG KM+
Sbjct:  64 KMVAQIYQRYGRIDVLINNAGYGAFKG-                                    123
           FEEFSAQEIADMFQVNTLASIHFACLIGQKMAE Query: 123 VKSGHIVNIASMAGLIATSKASVYGA-                                     182
           SKFAVVGFSNALRLELAEKNVYVTSVNPGPIKTG
              GH++NI SMAGLIA++K+S+Y A+KFA++GFSNALRLELA+K VYVT+VNPG-
           PI T
Sbjct: 124 QGQGHLINIVSMAGLIASAKSSIYSATK-                                   183
           FALIGFSNALRLELADKGVYVTTVNPGPIATK Query: 183 FFAQADPSGDYLASIGRFALTPE-                                        242
           KVSKKVVSILGKNKRELNLPFILAFAHKYYSLFPKTA
              FF QADPSG YL S+G+F L P +V+K++VSI+GKNKRELNLPF LA  H++Y+
           LFPK +
Sbjct: 184 FFDQADPSGHYLESVGKFTLQPNQ-                                       243
           VAKRLVSIIGKNKRELNLPFSLAVTHQFYTLFPKLS Query: 243 DYFARKVFNYK                                                     253
           DY ARKVFNYK
Sbjct: 244 DYLARKVFNYK                                                     254
```

Based on this analysis, it was predicted that these proteins and their epitopes could be useful antigens for vaccines or diagnostics.

Example 867

A DNA sequence (GBSx0919) was identified in *S. agalactiae* <SEQ ID 2629> which encodes the amino acid sequence <SEQ ID 2630>. This protein is predicted to be single-stranded-DNA-specific exonuclease (red). Analysis of this protein sequence reveals the following:

```
Possible site: 31
>>> Seems to have no N-terminal signal sequence
INTEGRAL Likelihood = -0.16 Transmembrane 197-213 (197- 213)
----- Final Results -----
  bacterial membrane --- Certainty = 0.1065 (Affirmative) <succ>
  bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP: CAB14721 GB: Z99118 similar to single-strand DNA-specific
exonuclease [Bacillus subtilis]
Identities = 276/772 (35%), Positives = 447/772 (57%), Gaps = 45/772 (5%)

Query:   1 MISAKYSWVLNNQKPDAGFFEASKKE-KISEAVASLIYSRGIKTSAELHHFLQTNLENLH   59
           M+++K W + Q+PD    ++  ++ I+ VASL+ RG  T+    FL T  + +
Sbjct:   1 MLASKMRWEI--QRPDQDKVKSLTEQLHITPLVA5LLVKRGFDTAESARLFLHTRDADFY   58

Query:  60 DPYLLNDMDKAVNRIRRAIENNETILVYGDYDADGMTSASIMKEALDMMGAEVQVYLPNR  119
           DP+ +  M +A +RI++AI   E I++YGDYDADG+TS S+M   L   + A+V  Y+P+R
Sbjct:  59 DPFEMKGMKEAADRIKQAISQQEKIMIYGDYDADGVTSTSVMLHTLQKLSAQVDFYIPDR  118

Query: 120 FTDGYGPNQSVYKYFIEQQDVSLIITVDNGVAGHEAITYAQNQGVDVVVTDHHSMPADLP  179
           F +GYGPN+ ++  I+++  SLIITVD G+A       A+  G+DV++TDHH    +LP
Sbjct: 119 FKEGYGPNEQAFRS-IKERGFSLIITVDTGIAAVHEAKVAKELGLDVIITDHHEPGPELP  177

Query: 180 CAYAIIHPEHPDANYPFPYLAGCGVAFKVACALLETIPTEMLDLVAIGTIADMVSLTDEN  239
                 AI+HP+  P   YPF  LAG GVAFK+A ALL   +P E+LDL AIGTIAD+V L DEN
Sbjct: 178 DVRAIVHPKQPGCTYPFKELAGVGVAFKLAHALLGELPDELLDLAAIGTIADLVPLHDEN  237

Query: 240 RIMVKAGLEVMKDSERIGLQELISLSNIDLKTLNEETIGFKIAPQLNALGRLDDPNPAIE  299
           R++    GLE ++ + R+GL+ELI LS  D+    NEET+GF++AP+LNA+GR++   +PA+
Sbjct: 238 RLIATLGLERLRRTNRLGLKELIKLSGGDIGEANEETVGFQLAPRLNAVGRIEQADPAVH  297

Query: 300 LLTGFDDEESQAIAQMIDQKNEERKEIVQTIFDQAMQMLDQ---TKPVQVLAKENWHPGV  356
           LL   D  E++ +A  IDQ N+ER+++V  +D+A++M++Q---    V+AK W+PGV
Sbjct: 298 LLMSEDSFEAEELAAEIDQLNKERQKMVSKMTDEAIEMVEQQGLDQTAIVVAKAGWNPGV  357

Query: 357 LGIVAGRILERTGQPVIVLNI--EDGIAKGSARSVEALDIFQAFDQHRELFIAFGGHSGA  414
           +GIVA ++++R   +P IVL I  E GIAKGSARS+       ++F++   + R++    FGGH  A
Sbjct: 358 VGIVASKLVDRFYRRAIVLGIDEEKGIAKGSARSIRGFNLFESLSECRDILPHFGGHPMA  417

Query: 415 AGMTLEESKVGDLSQVLCDYISKKQLDMSQKKTLTIDSELREDELSLDTVRDFEKLAPFG  474
           AGMTL+    V DL  L +          +D   ++++++++ +    L+PFG
```

```
                            -continued
Sbjct: 418 AGMTLKAEDVPDLRSRLNEIADNTLTEEDFIPVQEVDLVCGVEDITVESIAEMNMLSPFG 477

Query: 475 MDNKKPVFLLKDFKVSQARVMGQNGAHLKLKLEQDGQALDLVAFNMGSQLQEFQQAQHLE 534
           M N KP L+++   +   R +G N  H+K+ + +   LD V FN G   +        +
Sbjct: 478 MLNPKPHVLVENAVLEDVRKIGANKTHVKMTIRNESSQLDCVGFNKGELQEGIVPGSRIS 537

Query: 535 LAVTLSVNQWNGATTLQLMLEDARVDGIQLFDIRSK------ASSLPHG----------- 577
           +   +S+N+WN    QLM++DA V   QLFD+R K         S+LP
Sbjct: 538 IVGEMSINEWNNRKKPQLMIKDAAVSEWQLFDLRGKRTWEDTVSALPSAKRAIVSFKEDS 597

Query: 578 ------------VPILSQEEQSKE-------VILLTVPDHPQELKQMTQGKQFDAIYFKN
                       V ++S  +Q+K         ++LL  P     L ++ +GK  + IYF
Sbjct: 598 TTLLQTEDLRREVHVISSKDQAKAFDLDGAYIVLLDPPPSLDMLARLLEGKAPERIYFIF 657

Query: 619 EIPKNYFISGYGTRDQFASLYKTIYQFPEFDVRYKLKELSSYLHIPDILLIKMIQIFEEL 678
              +++F+S +  RD F    Y  + +   FDV+      EL+ +         +  M ++F +L
Sbjct: 658 LNHEDHFLSTFPARDHFKWYYAFLLKRGAFDVKKHGSELAKHKGWSVETINFMTKVFFDL 717

Query: 679 HFVTITEGIMTVNKEAEKRDISESQIYQELKETVKFQELMALGTPKEIYDFM         730
           FV  I    G+++V    A+KRD+++SQ YQ  ++  ++   +  +   + +E+ +++
Sbjct: 718 GFVKIENGVLSVVSGAKKRDLTDSQTYQAKQQLMELDQKLNYSSAEELKEWL         769
```

A related DNA sequence was identified in *S. pyogenes* <SEQ ID 2631> which encodes the amino acid sequence <SEQ ID 2632>. Analysis of this protein sequence reveals the following:

Possible site: 31
>>> Seems to have no N-terminal signal sequence
INTEGRAL Likelihood = –0.16 Transmembrane 220-236 (220-236)

-continued

INTEGRAL Likelihood = –0.11 Transmembrane 667-683 (667-683)
----- Final Results -----
 bacterial membrane --- Certainty = 0.1065 (Affirmative) <succ>
 bacterial outside --- Certainty = 0.0000 (Not Clear) <succ>
 bacterial cytoplasm --- Certainty = 0.0000 (Not Clear) <succ>

An alignment of the GAS and GBS proteins is shown below.

```
               Identities = 474/731 (64%), Positives = 594/731 (80%)

Query:    1 MISAKYSWVLNNQKPDAG-                                          60
            FFEASKKEKISEAVASLIYSRGIKTSAELHHFLQTNLENLHD
            MI +KYSW +  ++KPD GFF+ +K + +++   A LIY RGI+T      L   FL  +L   LHD
Sbjct:    1 MIKSKYSWKIKDKKPDDGFFKLAKTKG-                                 60
            LYQTAAQLIYDRGIRTEEALDEFLTADLSQLHD Query:   61 PYLLNDMDKAVNRIRRAIENNETIL-                                   120
            VYGDYDADGMTSASIMKEALDMMGAEVQVYLPNRF
            PYLL+DM KAV RIR+AIE  E  IL+YGDYDADGMTSASI+KE LDMMGAE   VLYP-
            NRF
Sbjct:   61 PYLLHDMAKAVPRIRQAIEEGERIL-                                   120
            IYGDYDADGMTSASIVKETLDMMGAEPLVYLPNRF Query:  121 TDGYGPNQSVYKYFIEQQDVSLIITVD-                                 180
            NGVAGHEAITYAQNQGVDVVVTDHHSMPADLPC
            TDGYGPNQSVYKYFIEQ+ VSLIITVDNGVAGHEAI YAQ Q VDV+VTDHHS+P +LP
Sbjct:  121 TDGYGPNQSVYKYFIEQEAVSLIITVD-                                 180
            NGVAGHEAIRYAQEQEVDVIVTDHHSLPEELPE Query:  181 AYAIIHPEHPDANYPFPYLAGCGVAFK-                                 240
            VACALLETIPTEMLDLVAIGTIADMVSLTDENR
            A+AIIHPEHPDA+YPF +LAGCGVAFK+A ALLE++PT+ LDLVAIGTIADMVS-
            LT ENR
Sbjct:  181 AFAIIHPEHP-                                                  240
            DADYPFKHLAGCGVAFKLATALLESLPTDCLDLVAIGTIADMVSLTGENR Query:  241 IMVKAGLEVMKDSERIGLQELISL-                                    300
            SNIDLKTLNEETIGFKIAPQLNALGRLDDPNPAIEL
            ++VK  GL  ++K +ER+GLQEL+SLS  ILD+  NE+ IGF+IAPQLNALGRLDDPN-
            PAIEL
Sbjct:  241 VLVKNGLAMLKHTERVGLQELMSL-                                    300
            SPIDLEHFNEDAIGFQIAPQLNALGRLDDPNPAIEL
Query:  301 LTGFDDEESQAIAQMIDQKNEERKEIVQ-                                360
            TIFDQAMQMLDQTKPVQVLAKENWHPGVLGIV
            LTGFDD+E+QAIA MI +KNEERK +VQ IFDQAM M+D  KPVQVLA+  HWPGVL-
            GIV
Sbjct:  301 LTGFDDQEAQAIALM-                                             360
            IKKKNEERKALVQDIFDQAMAMVDPQKPVQVLAQAGWHPGVLGIV Query:  361 AGRILERTGQPVIVLNIEDGIAKGSARS-                                420
            VEALDIFQAFDQHRELFIAFGGHSGAAGMTLE
            AGRI+E  GQ V+VL I++G AKGSARS+EA++IF+A  +  RELF AFGGH+GAAGMTL
Sbjct:  361 AGRIMETIGQTVVVLTIDNGFAKGSARS-                                420
            LEAINIFEALNGKRELFTAFGGHAGAAGMTLP
```

```
Query:  421   ESKVGDLSQVLCDYISKKQLDMSQKK-                                 480
              TLTIDSELRFDELSLDTVRDFEKLAPFGMDNKKP
                   +  LS  LC ++ ++ LD + K TLTID   L  D+LSLD ++   +KLAP+GMD++KP
Sbjct:  421   VDNLEALSDFLCQFVIER-                                        480
              GLDQTAKNTLTIDERLSLDDLSLDILKSLDKLAPYGMDHQKP Query:  481   VFLLKDFKVSQARVMGQNGAHL-                                    540
              KLKLEQDGQALDLVAFNMGSQLQEFQQAQHLELAVTLS
                  VF +KD +VSQAR +GQ+ +HLK K+ Q    + D++AF   GSQLQEF+QA   LE-
              LAVTLS
Sbjct:  481   VFYVKDIRVSQARTIGQDQSHLK-                                   540
              FKVSQGKASFDVLAFGQGSQLQERFQATGLELAVTLS Query:  541   VNQWNGATTLQLMLEDARVDGIQLFDIR-                              600
              SKASSLPHGVPILSQEEQSKEVILLTVPDHPQ
                  VN WNG T+LQ ML DARVDG+QL D+R+K + +P G+P + ++  ++ +++  +P+   +
Sbjct:  541   VNHWNGNTSLQFMLVDARVDGVQLLDL-                               600
              RTKTAKVPEGIPTIEEDPNARVILINDIPEDFK Query:  601   ELKQMTQGKQFDAIYFKNEIPKNYFIS-                               660
              GYGTRDQFASLYKTIYQFPEFDVRYKLKELSSY
                   +      K FDAIYFKN++    Y+++G+G+R+QFA LYKTIYQFPEFD+R+
              KL ELS Y
Sbjct:  601   TWRNQFVHKDFDAIYFKNQMKHPYYLTG-                              660
              FGSREQFAKLYKTIYQFPEFDLRHKLTELSHY Query:  661   LHIPDILLIKMIQIFEELHFVTITE-                                 720
              GIMTVNKEAEKRDISESQIYQELKETVKFQELMAL
                   L+I   +LLIK+IQIFEEL FVTI  +G+MTVN +A+KR+ISES  IYQ+LKE VKFQE+
              MAL
Sbjct:  661   LNIEKLLLIKLIQIFEELSFVTIDDG-                                720
              LMTVNPQAQKREISESHIYQDLKELVKFQEIMAL Query:  721   GTPKEIYDFMM                                                731
                    +PKE+YD+++
Sbjct:  721   ASPKEMYDYLV                                                731
```

Based on this analysis, it was predicted that these proteins and their epitopes could be useful antigens for vaccines or diagnostics.

Example 868

A DNA sequence (GBSx0920) was identified in *S. agalactiae* <SEQ ID 2633> which encodes the amino acid sequence <SEQ ID 2634>. Analysis of this protein sequence reveals the following:

Possible site: 13
>>> Seems to have no N-terminal signal sequence
----- Final Results -----
   bacterial cytoplasm --- Certainty = 0.4114 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 869

A DNA sequence (GBSx0921) was identified in *S. agalactiae* <SEQ ID 2635> which encodes the amino acid sequence <SEQ ID 2636>. Analysis of this protein sequence reveals the following:

Possible site: 42
>>> Seems to have an uncleavable N-term signal seq
INTEGRAL Likelihood = −5.10 Transmembrane 15-31 (14-33)
----- Final Results -----
   bacterial membrane --- Certainty = 0.3039 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database.

```
>GP: AAA88584 GB: M18954 fructosyltransferase [Streptococcus mutans]
Identities = 67/219 (30%), Positives = 106/219 (47%), Gaps = 31/219 (14%)

Query:   1   MRPIVRKKMYKKGKFWVVAGIVT-ILGGSAILGQDVKAEQAEAVTSTISEKTDSSQTISD   59
             M   VRKKMYKKGKFWVVA I T +L G  +    V+A++A + T    SE   + SQ     +
Sbjct:   1   METKVRKKMYKKGKFWVVATITTAMLTGIGL--SSVQADEANS-TQVSSELAERSQVQEN   57

Query:  60   TSKLTLPVNSSEAMKNSAEPLIKTAFATSVSSNPREIAATPVKTFDASSKVVVKASTAEH   119
                  T+         SS  A +N A      KT     + S+NP    AA   V+   D ++KV+    +   E
Sbjct:  58   TTA------SSSAAENQA----KTEVQETPSTNP---AAATVENTDQTTKVITDNAAVES   104
```

```
Query:  120 SANQTN---SNVNQVANDSEVITQQN------STKQLPTVTYSAHVQDIGW----QKSVD 166
             A++T     + V + A + + Q N      +TK+     T    + + G    +K
Sbjct:  105 KASKTKDQAATVTKTAASTPEVGQTNEKDKAKATKEADITTPKNTIDEYGLTEQARKIAT 164

Query:  167 NATVSGTVGQEKQVEAIKLSIKAPEGITG-KLSYKTYVK                      204
             A ++ +   +KQVEA+         + TG +++Y+ + K
Sbjct:  165 EAGINLSSLTQKQVEALNKVKLTSDAQTGHQMTYQEFDK                      203
```

No corresponding DNA sequence was identified in *S. pyogenes*.

Based on this analysis, it was predicted that this protein and its epitopes, could be useful antigens for vaccines or diagnostics.

A related GBS gene <SEQ ID 8677> and protein <SEQ ID 8678> were also identified. Analysis of this protein sequence reveals the following:

Lipop Possible site: −1   Crend: 5
McG: Discrim Score: 9.08
GvH: Signal Score (−7.5) : −3.94
Possible site: 34

>>> Seems to have an uncleavable N-term signal seq
ALOM program count: 1   value: −5.10   threshold: 0.0
INTEGRAL          Likelihood = −5.10 Transmembrane 7-23 (6-25)
PERIPHERAL        Likelihood = 4.03   694
modified ALOM score: 1.52
\*\*\* Reasoning Step: 3
----- Final Results -----
    bacterial membrane --- Certainty = 0.3039 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
31.1/52.1% over 749aa
Streptococcus mutans
EGAD|14681| levansucrase precursor Insert characterized
SP|P11701|SACB_STRMU LEVANSUCRASE PRECURSOR (EC 2.4.1.10)
(BETA-D-FRUCTOFURANOSYL TRANSFERASE) (SUCROSE
6-FRUCTOSYL TRANSFERASE). Edit characterized
GP|153636|gb|AAA88584.1||M18954 fructosyltransferase Insert characterized
PIR|B28551|B28551 levansucrase (EC 2.4.1.10) precursor - (strain GS-5) Insert
characterized
ORF02172(295-1731 of 3138)
EGAD|14681|14686(7-756 of 797) levansucrase precursor {Streptococcus mutans}
SP|P11701|SACB_STRMU LEVANSUCRASE PRECURSOR (EC 2.4.1.10) (BETA-D-FRUCTOFURANOSYL
TRANSFERASE) (SUCROSE 6-FRUCTOSYL TRANSFERASE). GP|153636|gb|AAA88584.1||M18954
fructosyltransferase {Streptococcus mutans} PIR|B28551|B28551 levansucrase (EC 2.4.1.10)
precursor - Streptococcus mutans (strain GS-5)
% Match = 2.9
% Identity = 31.1 % Similarity = 52.1
Matches = 83 Mismatches = 115 Conservative Sub.s = 56

132       162       192       222       252       282       312       342
         LPEHLENQSYQH*PYQH*YQ*RHNHHQYLVQ*ERVQQLIQRAPCL*FQFYVSYXXXN*LXXYR*KKMYKKGKFWVVAGIV
                                                                    ||||||||||||| |
                                                                    METKVRKKMYKKGKFWVVATIT
                                                                      10        20

372       402       432       462       492       522       552       582
         TILGGSAILGQDVKAEQAEAVTSTISEKTDSSQTISDTSKLTLPVNSSEAMKNSAEPLIKTAFATSVSSNPREIAATPVK
         | :    :  | :  ||    ||         | |: :: :       :: |   ::||   ||    : |:||    || |:
         TAM----LTGIGLSSVQADEANST--------QVSSELAERSQVQENTTASSSAAENQAKTEVQETPSTNP---AAATVE
             30        40                50        60        70        80

612       642       663       693       705       735                  783
         TFDASSKVVVKASTAEHSANQTNSN---VNQVANDSEVITQQN------STKQLPTVTYSAHVQDIGW----QKSVDNAT
         |  :: ||:    :    | |::|     |  :  |     ||        :|| :    |   : :  |       : |    |
         NTDQTTKVITDNAAVESKASKTKDQAATVTKTAASTPEVGQTNEKDKAKATKEADITTPKNTIDEYGLTEQARKIATEAG
             100       110       120       130       140       150       160

813       834                                                          882
         VSGTVGQEKQVEA---IKLSIKAPEG------------------------------------ITGKLSYKTY
         :: :    :|||||    :|| :  | |                                               : |    |  |:
         INLSSLTQKQVEALNKVKLTSDAQTGHQMTYQEFDKIAQTLIAQDE~~~~VGTLDTAYLPGENDGYIDWNVIGGYGLKPH
             180       190       200       210                    660       670

912       942       972      1002      1032      1062      1092      1122
         VKGQGWQPSVESGQVSGTVGQSRPIEALSINLTDNLQKLYDVYYRVHVQDIGWMAWAKNGAYAGTLGMSKRLEAYEVKFT
         ||  :||: |
         TPGQ-YQPTV----------------------------------------------------------------------
```

-continued

```
1152      1182      1209      1239      1269      1290      1320      1350
LKGQSVLTPTIPKEERPVLNYQVKV-GQNGWQSNKLEGQMAGTLGESKALDG---VKFTLSTLKYGDILYRTHVQDKGWG
         |:  |     :::::|    |:    :   |:    ||  :  :|:      |     |   |   |:|
--------PSTPIHTDDIISFEVSFDGHLVIKPVKVNNDSAGRIDQSRNSGGSLNVAFNVSA------------------
        690       700       710       720       730       740

1641      1671      1701      1731      1761      1791      1821      1851
EI~~~~SYQTYLQKDGWKPTVLEGQLGGSIGLSKSIKAIKLNLGSTALGNIEYRTFLNGSGWQTVVNSGRESNVPNESQQ
      ||:|    :    |     |:|           :           ::                    |
-~~~~~--------------------GGNISVKPSQKSINNTKETKKAHHVSTEKKQKKGNSFFAALLALFSAFCVSIGF
                          750       760       770       780       790
```

SEQ ID 8678 (GBS243) was expressed in *E. coli* as a His-fusion product. SDS-PAGE analysis of total cell extract is shown in FIG. 57 (lane 7; MW 94 kDa).

GBS243-His was purified as shown in FIG. 208, lane 10.

Example 870

A DNA sequence (GBSx0922) was identified in *S. agalactiae* <SEQ ID 2637> which encodes the amino acid sequence <SEQ ID 2638>. This protein is predicted to be adenine phosphoribosyltransferase (apt). Analysis of this protein sequence reveals the following:

---

Possible site: 59
>>> Seems to have no N-terminal signal sequence
INTEGRAL Likelihood = −1.86 Transmembrane 61-77 (59-77)
INTEGRAL Likelihood = −0.64 Transmembrane 137-153 (137- 153)
----- Final Results -----
   bacterial membrane --- Certainty = 0.1744 (Affirmative) <succ>
     bacterial outside --- Certainty = 0.0000 (Not Clear) <succ>
       bacterial cytoplasm --- Certainty.0.0000 (Not Clear) <succ>

---

The protein has homology with the following sequences in the GENPEPT database.

A related DNA sequence was identified in *S. pyogenes* <SEQ ID 2639> which encodes the amino acid sequence <SEQ ID 2640>. Analysis of this protein sequence reveals the following:

---

Possible site: 40
>>> Seems to have a cleavable N-term signal seq.
----- Final Results -----
   bacterial outside --- Certainty = 0.300 (Affirmative) <succ>
     bacterial membrane --- Certainty = 0.000 (Not Clear) <succ>
       bacterial cytoplasm --- Certainty = 0.000 (Not Clear) <succ>

---

The protein has homology with the following sequences in the databases:

```
>GP: AAC46040 GB: U86377 adenine phosphoribosyltransferase; Apt
[Bacillus subtilis]
Identities = 110/170 (64%), Positives = 135/170 (78%)

Query:    1  MDLNNYIASIENYPQEGITFRDISPL-                                 60
             MADGKAYSYAVREIVQYAADKDIDMIVGPEARGF
             MDL  Y+  + +YP+EG+ F+DI+ LM  G   Y YA   +IV+YA  +K ID++VGPE-
             ARGF
Sbjct:    1  MDLKQYVTIVPDYPKEGVQFKDITTLMD-                               60
             KGDVYRYATDQIVEYAKEKQIDLVVGPEARGF Query:   61  IVGCPVAYALGIGFAPVRKPGKLPRE-                                120
             VISADYEKEYGLDTLIMHADAIKPGQRVLIVDDL
             I+GCPVAYALG+GFAPVRK GKLPREVI  DY  EYG D LT+H DAIKPGQRV-
             LI DDL
Sbjct:   61  IIGCPVAYALGVGFAPVRKEGKLPRE-                                120
             VIKVDYGLEYGKDVLTIHKDAIKPGQRVLITDDL Query:  121  LATGGTVKATIEMIEKLGGVVAGCAFLVELDGLNGRKAIEGYDTKVLMNF         170
             LATGGT++ATI+++E+LGGVVAG AFL+EL   L+GR   +E YD    LM +
Sbjct:  121  LATGGTIEATIKLVEELGGVVAGIAFLIELSYLDGRNKLEDYDILTLMKY         170
```

```
!GB: Z99120 similar to opine catabolism [Bacillus sub . . . 231 1e-59
>GP: CAB15253 GB: Z99120 similar to opine catabolism [Bacillus subtilis]
Score = 231 bits (583), Expect = 1e-59
Identities = 138/363 (38%), Positives = 212/363 (58%), Gaps = 11/363 (3%)

Query:    5 IIGAGIVGSTAAYYLQQSGQKEVTIFDHGQ-GQATKAAAGIISPWFSKRRNKVWYRMARL   63
            I+GAGI+G++ AY+L ++G + VT+ D  + GQAT AAAGI+ PW S+RRN+ WY++A+
Sbjct:    6 IVGAGILGASTAYHLAKTGAR-VTVIDRKEPGQATDAAAGIVCPWLSQRRNQDWYQLAKG   64

Query:   64 GADFYQQLINDLKEDGFATDFYQQNGIYVLKKQEEKLRDLYELALARKVESPIIGELAIK  123
            GA +Y+ LI+ L++DG +    Y++ G  +        KL  + E A  R+ ++P IG++
Sbjct:   65 GARYYKDLIHQLEKDGESDTGYKRVGAISIHTDASKLDKMEERAYKRREDAPEIGDITRL  124

Query:  124 NRKELGNDFKGLIGEDNCLYASGAARVEGAALCETLLKAS---GYPVIRQKVTLKQQG--  178
            +  E    F L        ++ SGAARV G ALC +LL A+     G VI+    +L  +
Sbjct:  125 SASETKKLFPILADGYESVHISGAARVNGRALCRSLLSAAEKRGATVIKGNASLLFENGT  184

Query:  179 -SGYEIAGHYF--DQVILAAGAWLPDLLRPLGYQVDVRPQKGQLLDYDVHHIISDTYPVV  235
              +G +        F  D VI+ AGAW  ++L+PLG    V QK Q++ +++    + ++PVV
Sbjct:  185 VTGVQTDTKQFAADAVIVTAGAWANEILKPLGIHFQVSFQKAQIMHFEMTDADTGSWPVV  244

Query:  236 MPEGEIDLIPFNQGKISVGTSHENDKGY-DLEPDWQVLKKLEMQALTYLPLLKEATQKTC  294
            MP  +  ++ F+ G+I  G +HEND G  DL      ++  +AL   P L +A
Sbjct:  245 MPPSDQYILSFDNGRIVAGATHENDAGLDDLRVTAGGQHEVLSKALAVAPGLADAAAVET  304

Query:  295 RVGIRAYTSDYSPFYGQVSGLKNLYTASGLGSSGLTVGPLIGYELAQLLLGHEGLLTPSD  354
            RVG R +T  + P  G V  ++ LY A+GLG+SGLT+GP +G ELA+L+LG +   L  S
Sbjct:  305 RVGFRPFTPGFLPVVGAVPNVQGLYAANGLGASGLTMGPFLGAELAKLVLGKQTELDLSP  364

Query:  355 YSP                                                          357
            Y P
Sbjct:  365 YDP                                                          367
```

An alignment of the GAS and GBS proteins is shown below.

```
Identities = 150/172 (87%), Positives = 161/172 (93%)

Query:    1 MDLNNYIASIENYPQEGITFRDISPL-                                   60
              MADGKAYSYAVREIVQYAADKDIDMIVGPEARGF
              MDL NYIASI++YP+ GITFRDISPLMADGKAYSYA+REI QYA DKDIDM+VGPE-
              ARGF
Sbjct:    1 MDLTNYIASIKDYPKAGITFRDISPL-                                   60
              MADGKAYSYAIREIAQYACDKDIDMVVGPEARGF Query:   61 IVGCPVAYALGIGFAPVRKPGKLPRE-                                  120
              VISADYEKEYGLDTLTMHADAIKPGQRVLIVDDL
              I+GCPVA   LGIGFAPVRKPGKLPR+V+SADYEKEYGLDTLTMHADAIKPGQRV-
              LIVDDL
Sbjct:   61 IIGCPVAVELGIGFAPVRKPGKLPRDV-                                 120
              VSADYEKEYGLDTLTMHADAIKPGQRVLIVDDL Query:  121 LATGGTVKATIEMIEKLGGVVAGCAFLVELDGLNGRKAIEGYDTKVLMNFPG          172
              LATGGTVKATIEMIEKLGG+VAGCAFL+EL+GLNGR AI  YD KVLM FPG
Sbjct:  121 LATGGTVKATIEMIEKLGGIVAGCAFLIELEGLNGRHAIRNYDYKVLMQFPG          172
```

SEQ ID 2638 (GBS419) was expressed in *E. coli* as a His-fusion product. SDS-PAGE analysis of total cell extract is shown in FIG. 79 (lane 6; MW 22.6 kDa). It was also expressed in *E. coli* as a GST-fusion product. SDS-PAGE analysis of total cell extract is shown in FIG. 172 (lane 4; MW 47.5 kDa).

GBS419-GST was purified as shown in FIG. 219, lane 6-8.

Based on this analysis, it was predicted that these proteins and their epitopes could be useful antigens for vaccines or diagnostics.

Example 871

A DNA sequence (GBSx0923) was identified in *S. agalactiae* <SEQ ID 2641> which encodes the amino acid sequence <SEQ ID 2642>. Analysis of this protein sequence reveals the following:

Possible site: 29

>>> Seems to have no N-terminal signal sequence

----- Final Results ----- bacterial cytoplasm --- Certainty = 0.0847 (Affirmative) <succ> bacterial membrane --- Certainty = 0.0000 (Not Clear) <succ> bacterial outside --- Certainty = 0.0000 (Not Clear) <succ>

The protein has homology with the following sequences in the GENPEPT database.

```
>GP: BAA11244 GB: D78182 ORF2 [Streptococcus mutans]
Identities = 140/225 (62%), Positives = 178/225 (78%)

Query:    1 MTYLEQYQSGQLTLPSALFFHFKSIFK-                                60
            TADDFLVWQFFYLQNTTNLSDLTPSRIATSLDK
              M++L+ Y+SG L LPSAL FH+K IF   ADDFLVWQFFY QNTT + D+  S+IAT++
              K
Sbjct:    1 MSFLQHYKSGNLVLPSALLFHYKDIFS-                                60
            NADDFLVWQFFYFQNTTKMEDIATSQIATAIGK Query:   61 TVADINRSISNLTSQGLLDVKTIELN-                                120
            HEIEIIFDTSPVFAKLDKLFEEDNQVIIDNKTSD
              TV ++NRS+SNL SQ LLD+KTIEL+ E E++FD +     KLD L    ++  + +
Sbjct:   61 TVPEVNRSVSNLISQELLDMKTIELD-                                120
            GESEVLFDATLALKKLDDLLTAADETTVSSSKGT Query:  121 SNRLKDLVGDFERELGRLL-                                       180
            SPPFELEDLQKTLQEDQTDPDIVRAALREAVFNGKTSWNYIN
              SN LKDLV DFERELGR+LSPFELEDLQKT+ +D+TDPD+VR+ALREAVFNGKT+WNYI
Sbjct:  121 SNALKDLVEDFERELGRML-                                       180
            SPFELEDLQKTVSDDKTDPDLVRSALREAVINGKTNWNYIQ Query:  181 AILRNWRREGLTTLRQIEERKQAREDNQMKDLAISDDFKNAMNLW              225
            AILRNWRREG++TLRQ+EER++ RE        ++ +SDDF +AMNLW
Sbjct:  181 AILRNWRREGISTLRQVEERRKEREQANPANVTVSDDFLSAMNLW              225
```

A related DNA sequence was identified in *S. pyogenes* <SEQ ID 2643> which encodes the amino acid sequence <SEQ ID 2644>. Analysis of this protein sequence reveals the following:

Possible site: 57
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

The protein has homology with the following sequences in the databases:

```
>GP: BAA11244 GB: D78182 ORF2 [Streptococcus mutans]
Identities = 154/228 (67%), Positives = 188/228 (81%), Gaps = 1/228 (0%)

Query:    1 MSFLEHYKSGNLVIPSALLF-                                       60
            HYKDLFKSSDDFLVWQFFLYQNTTKRDDLAPSQIAHALGK
              MSFL+HYKSGNLV+PSALLFHYKD+F ++DDFLVWQFFY QNTTK +D+A SQIA A+
              GK
Sbjct:    1 MSFLQHYKSGNLVLPSALLFHYKDIFS-                                60
            NADDFLVWQFFYFQNTTKMEDIATSQIATAIGK Query:   61 SVADINKIISSLTMQGLLDMRTIELT-                                119
            GEIEIIFDASPLVAKLDQLFVSQTATEIDKQE-T
              +V ++N+ +S+L +Q LLDM+TIEL GE E++FDA+  L KLD L  +   T +   + T
Sbjct:   61 TVPEVNRSVSNLISQELLDMKTIELD-                                120
            GESEVLFDATLALKKLDDLLTAADETTVSSSKGT Query:  120 PNHFKRLVDEFERELGRFLSPFELEDLE-                              179
            KTLRDDKTDPDLIREALKEAVFNGKTNWKYIQ
              N  K LV++FERELGR LSPFELEDL+KT+ DDKTDPDL+R AL+EAVFNGKT-
              NW YIQ
Sbjct:  121 SNALKDLVEDFERELGRML-                                       180
            SPFELEDLQKTVSDDKTDPDLVRSALREAVENGKTNWNYIQ Query:  180 AILRNWRKEGIVNLRQVEERRRVREGEDLSQVTISEDFLSAMNLWSDS           227
            AILRNWR+EGI  LRQVEERR+ RE  + + VT+S+DFLSAMNLWSDS
Sbjct:  181 AILRNWRREGISTLRQVEERRKEREQANPANVTVSDDFLSAMNLWSDS           228
```

An alignment of the GAS and GBS proteins is shown below.

```
Identities = 144/225 (64%), Positives = 179/225 (79%), Gaps = 1/225 (0%)

Query:    1 MTYLEQYQSGQLTLPSALFFHFKSIFKTADDFLVWQFFYLQNTTNLSDLTPSRIATSLDK  60
              M++LE Y+SG L +PSAL FH+K +FK++DDFLVWQFFYLQNTT  DL PS+IA +L K
```

-continued

```
Sbjct:    1 MSFLEHYKSGNLVIPSALLFHYKDLFKSSDDFLVWQFFYLQNTTKRDDLAPSQIAHALGK  60

Query:   61 TVADINRSISNLTSQGLLDVKTIELNHEIEIIFDTSPVFAKLDKLFEEDNQVIIDNKTSD 120
            +VADIN+ IS+LT+QGLLD++TIEL  EIEIIFD SPV AKLD+LF       ID K
Sbjct:   61 SVADINKIISSLTNQGLLDMRTIELTGEIEIIFDASPVLAKLDQLFVSQTATEID-KQET 119

Query:  121 SNRLKDLVGDFERELGRLLSPFELEDLQKTLQEDQTDPDIVRAALREAVFNGKTSWNYIN 180
              N  K LV +FERELGR LSPFELEDL+KTL++D+TDPD++R  AL+EAVFNGKT+W YI
Sbjct:  120 PNHFKRLVDEFERELGRFLSPFELEDLEKTLRDDKTDPDLIREALKENVFNGKTNWKYIQ 179

Query:  181 AILRNWRREGLTTLRQIEERKQAREDNQMKDLAISDDFKNAMNLW                225
            AILRNWR+EG+  LRQ+EER++ RE   +  + IS+DF +AMNLW
Sbjct:  180 AILRNWRKEGIVNLRQVEERRVREGEDLSQVTISEDFLSAMNLW                224
```

Based on this analysis, it was predicted that these proteins and their epitopes could be useful antigens for vaccines or diagnostics.

Example 872

A DNA sequence (GBSx0924) was identified in *S. agalactiae* <SEQ ID 2645> which encodes the amino acid sequence <SEQ ID 2646>. Analysis of this protein sequence reveals the following:

---
Possible site: 47
>>> Seems to have no N-terminal signal sequence
----- Final Results -----
    bacterial cytoplasm --- Certainty = 0.1617 (Affirmative) <succ>
       bacterial membrane --- Certainty = 0.0000 (Not Clear) <succ>
          bacterial outside --- Certainty = 0.0000 (Not Clear) <succ>
---

The protein has homology with the following sequences in the GENPEPT database.

A related DNA sequence was identified in *S. pyogenes* <SEQ ID 2647> which encodes the amino acid sequence <SEQ ID 2648>. Analysis of this protein sequence reveals the following:

---
Possible site: 47
>>> Seems to have no N-terminal signal sequence
----- Final Results -----
    bacterial cytoplasm --- Certainty = 0.0803 (Affirmative) <succ>
       bacterial membrane --- Certainty = 0.0000 (Not Clear) <succ>
          bacterial outside --- Certainty = 0.0000 (Not Clear) <succ>
---

An alignment of the GAS and GBS proteins is shown below.

```
>GP: BAA11245 GB: D78182 ORF3 [Streptococcus mutans]
Identities = 134/226 (59%), Positives = 170/226 (74%)

Query:    2 DLQLSKRLQKVANYVPKGARLLDVGSDHAYLPIFLLQMGYCDFAIAGEVVNGPYQSALKN  61
            ++ LS RLQ+VA++VPKGARLLDVGSDHAYLPI+LL+ G  DFA+AGE++ GPY+SA+ N
Sbjct:    7 EVSLSHRLQEVASFVPKGARLLDVGSDHAYLPIYLLEQGLIDFAVAGEIIKGPYESAVAN  66

Query:   62 VSEHGLTSKIDVRLANGLSAFEEADNIDTITICGMGGRLIADILNNDIDKLQHVKTLVLQ 121
            V+E GL+ +I VRLA+GL+A  + D+ID ITICGMGGRLIADIL   DKL  VK L+LQ
Sbjct:   67 VNESGLSGQIAVRLADGLAALNDNDDIDLITICGMGGRLIADILAAGSDKLNSVKQLILQ 126

Query:  122 PNNREDDLRKWLAANDFEIVAEDILTENDKRYEILVVKHGHMNLTAKELRFGPFLLSNNT 181
            PNN EDDLR WL ANDF I AE ++ +  K YEILVV+ G + L+ K+LRFGPFL   +
Sbjct:  127 PNNCEDDLRSWLVANDFMIKAEKMVKDRHKYYEILVVEKGKITLSDKDLRFGPFLRQERS 186

Query:  182 TVFKEKWQNELNKLTFALNSIPNSKMEERAILEDKIQDIKEVLDES              227
            ++FKE+W+ EL KL  AL +P K +   L KI+ I+EVL ES
Sbjct:  187 SIFKERWRKELAKLELALTRVPAKKKADNMFLSTKIEQIREVLYES              232
```

```
Identities = 145/224 (64%), Positives = 173/224 (76%)

Query:    1  MDLQLSKRLQKVANYVPKGARLLDVGSDHAYLPIFLLQMGYCDFAIAGEVVNGPYQSALK   60
             MD QLS RL +VA YVPKG +LLDVGSDHAYLPIFL++      AIAGEVV GPY+SALK
Sbjct:    1  MDSQLSNRLAQVAAYVPKGVKLLDVGSDHAYLPIFLVETNQISAAIAGEVVRGPYESALK   60

Query:   61  NVSEHGLTSKIDVRLANGLSAFEEADNIDTITICGMGGRLIADILNNDIDKLQHVKTLVL  120
             NV++ GL   I VRLANGL+AFEEAD++  ITICGMGGRLIADIL   +KLQ ++ LVL
Sbjct:   61  NVTQSGLAEHIQVRLANGLAAFEEADDVTAITICGMGGRLIADILEAGKEKLQGIERLVL  120

Query:  121  QPNNREDDLRKWLAANDFEIVAEDILTENDKRYEILVVKHGHMNLTAKELRFGPFLLSNN  180
             QPNNREDDLR WL+ N F+IVAE I+ ENDK YEI+V +HG   L+A ELRFGP+L
Sbjct:  121  QPNNREDDLRAWLSVNAFKIVAETIMAENDKYYEIIVAEHGEKALSATELRFGPYLSQEK  180

Query:  181  TTVFKEKWQNELKKLTFALNSIPNSKMEERAILEDKIQDIKEVL                 224
             + VFKEKWQ E++KL +AL+ IP  K +ER +L   KIQ IKEV+
Sbjct:  181  SVVFKEKWQREMDKLAYALSCIPEEKTQERQLLLTKIQQIKEVI                 224
```

Based on this analysis, it was predicted that these proteins and their epitopes could be useful antigens for vaccines or diagnostics.

Example 873

A DNA sequence (GBSx0925) was identified in *S. agalactiae* <SEQ ID 2649> which encodes the amino acid sequence <SEQ ID 2650>. Analysis of this protein sequence reveals the following:

---

Possible site: 54
>>> Seems to have no N-terminal signal sequence
----- Final Results -----
  bacterial cytoplasm --- Certainty = 0.3245 (Affirmative) <succ>
  bacterial membrane --- Certainty = 0.0000 (Not Clear) <succ>
  bacterial outside --- Certainty = 0.0000 (Not Clear) <succ>

---

A related GBS nucleic acid sequence <SEQ ID 9893> which encodes amino acid sequence <SEQ ID 9894> was also identified.

The protein has homology with the following sequences in the GENPEPT database.

A related DNA sequence was identified in *S. pyogenes* <SEQ ID 2651> which encodes the amino acid sequence <SEQ ID 2652>. Analysis of this protein sequence reveals the following:

---

Possible site: 53
>>> Seems to have no N-terminal signal sequence
----- Final Results -----
  bacterial cytoplasm --- Certainty = 0.1804 (Affirmative) <succ>
  bacterial membrane --- Certainty = 0.0000 (Not Clear) <succ>
  bacterial outside --- Certainty = 0.0000 (Not Clear) <succ>

---

An alignment of the GAS and GBS proteins is shown below.

```
>GP: BAA11246 GB: D78182 ORF4 [Streptococcus mutans]
Identities = 187/262 (71%), Positives = 224/262 (85%)

Query:    2  MKARELIDVYETYCPQELSMEGDISGLQIGSLDKEIKTVMVALDVRETTVAEAIERQVDL   61
             MKA ++I  YE YCPQ+LS+EGDISGLQIG+LDKEIK +M+ALDVRETTVAEAIE++VDL
Sbjct:    1  MKASQIIKRYEAYCPQDLSLEGDISGLQIGTLDKEIKRLMIALDVRETTVARAIEKKVDL   60

Query:   62  LIVKHAPIFRPLKDLVATPQNKIYIDLLKSDIAVYVSHTNIDIVPNGLNDWFCELLDIQY  121
             LIVKHAPIFRPLK+LV T QN IY +L+K DIAVYVSHTNIDIVP+GLNDWFC+LLDI+
Sbjct:   61  LIVKHAPIFRPLKNLVETAQNHIYFNLIKHDIAVYVSHTNIDIVPDGLNDWFCDLLDIKN  120

Query:  122  PDILSETSNGYGIGRIGDIRPQSFEFFAWKIKDVFGLDSVRLVSYDKSNPEIQRVAICGG  181
                 ILS + + YGIGR+GDI P SFE  A K+L +F LDSVRLVSY ++NP I R+AICGG
Sbjct:  121  RRILSPSKDDYGIGRVGDISPLSFEDLAKKVKKIFNLDSVRLVSYGENNPLISRIAICGG  180

Query:  182  SGQSFYKEAIAKGADVFVTGDIYYHTAQEMITNGLLAIDPGHHIEVLFVSKIATMIEQWK  241
             SGQSFY+EA+ KGA V++TGDIYYHTAQEM+TNGLLA+DPGHHIEVLFV K+A    +W
Sbjct:  181  SGQSFYQEALTKGAQVYITGDIYYHTAQEMLTNGLLALDPGHHIEVLFVRKLAEKFQTWS  240

Query:  242  LEKGWDISVLESKAPTNPFYHM                                       263
             ++ WDI++LES+  TNPFYH+
Sbjct:  241  CQENWDITILESQVNTNPFYHL                                       262
```

```
Identities = 169/262 (64%), Positives = 214/262 (81%)

Query:    2 MKARELIDVYETYCPQELSMEGDISGLQIGSLDKEIKTVMVALDVRETTVAEAIERQVDL     61
            MKA+ LID YE +CP +LSMEGD+ GLQ+GSLDK+I+ VM+ LD+RE+TVAEAI+ +VDL
Sbjct:    3 MKAKTLIDAYEAFCPLDLSMEGDVKGLQMGSLDKDIRKVMITLDIRESTVAEAIKNEVDL     62

Query:   62 LIVKHAPIFRPLKDLVATPQNKIYIDLLKSDIAVYYSHTNIDIVPNGLNDWFCELLDIQY    121
            +I KHAPIF+PLKDLV++PQ  I +DL+K DI+VYVSHTNIDIVP GLNDWFC+LL+I+
Sbjct:   63 IITKHAPIFKPLKDLVSSPQRDILLDLVKHDISVYVSHTNIDIVPGGLNDWFCDLLEIKE    122

Query:  122 PDILSETSNGYGIGRIGDIRPQSFEFFAWKIKDVFGLDSVRLVSYDKSNPEIQRVAICGG    181
                LSET  G+GIGRIG ++ Q+ E  A K+L VF LD+VRL+ YDK NP I ++AICGG
Sbjct:  123 ATYLSETKEGFGIGRIGTVKEQALEELASKVKRVFDLDTVRLIRYDKENPLISKIAICGG    182

Query:  182 SGQSFYKEAIAKGADVFVTGDIYYHTAQEMITNGLLAIDPGHHIEVLFVSKIATMIEQWK    241
            SG  FY++A+ KGADV++TGDIYYHTAQEM+T GL A+DPGHHIEVLF  K+   ++ WK
Sbjct:  183 SGGEFYQDAVQKGADVYITGDIYYHTAQEMLTEGLFAVDPGHHIEVLFTEKLKEKLQGWK    242

Query:  242 LEKGWDISVLESKAPTNPFYHM                                         263
            E GWD+S++ SKA TNPF H+
Sbjct:  243 EENGWDVSIISSKASTNPFSHL                                         264
```

Based on this analysis, it was predicted that these proteins and their epitopes could be useful antigens for vaccines or diagnostics.

Example 874

A DNA sequence (GBSx0926) was identified in *S. agalactiae* <SEQ ID 2653> which encodes the amino acid sequence <SEQ ID 2654>. This protein is predicted to be ( ). Analysis of this protein sequence reveals the following:

---

Possible site: 41
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

---

The protein has homology with the following sequences in the GENPEPT database.

A related DNA sequence was identified in *S. pyogenes* <SEQ ID 2655> which encodes the amino acid sequence <SEQ ID 2656>. Analysis of this protein sequence reveals the following:

---

Possible site: 40
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

---

An alignment of the GAS and GBS proteins is shown below.

```
>GP: CAB15253 GB: Z99120 similar to opine catabolism [Bacillus subtilis]
Identities = 148/368 (40%), Positives = 211/368 (57%), Gaps = 13/368 (3%)

Query:    1 MKKIAIIGAGAVGATLAYYLSKEKDIQVTVFDYGV-GQATKAAAGIISPWFSKRRNKAWY     59
            MK   I+GAG +GA+ AY+L+K     +VTV D    GQAT AAAGI+ PW S+RRN+ WY
Sbjct:    1 MKSYIIVGAGILGASTAYHLAKT-GARVTVIDRKEPGQATDAAAGIVCPWLSQRRNQDWY     59

Query:   60 RMARLGADFYSKLVTDLQKDGFETKFYQQTGVFLLKKDESQLESLFALADKRRLESPLIG    119
            ++A+ GA +Y  L+  L+KDG     Y++ G   +  D S+S+ +   A KRR ++P IG
Sbjct:   60 QLAKGGARYYKDLIHQLEKDGESDTGYKRVGAISIHTDASKLDKMEERAYKRREDAPEIG    119

Query:  120 DLQILNKSEANTHFPEL-DGYEQLLYASGGARVEGADLTRILLEAS---GVNVIKDEVHF    175
            D+  L+ SE    FP L DGYE ++ SG ARV G  L R LL A+   G  VIK
Sbjct:  120 DITRLSASETKKLFPILADGYES-VHISGAARVNGRALCRSLLSAAEKRGATVIKGNASL    178

Query:  176 -----TITDNGFRVQGIDFDKLVLASGAWLAKILDEHNYQVDVRPQKGQLRDYYFSNINT    230
                 T+T   +   D +++   +GAW +IL         V QK Q+  +   ++ +T
Sbjct:  179 LFENGTVTGVQTDTKQFAADAVIVTAGAWANEILKPLGIHFQVSFQKAQIMHFEMTDADT    238

Query:  231 GKYPVVMPEGELDIIPFDNGKVSVGASHENDMAF-DLNIDFKVLDKFEEQAIGYFPQLKK    289
            G +PVVMP +  I+ FDNG++  GA+HEND    DL +      +A+     P L
Sbjct:  239 GSWPVVMPPSDQYILSFDNGRIVAGATHENDAGLDDLRVTAGGQHEVLSKALAVAPGLAD    298

Query:  290 ADTTSERVGIRAYTSDFSPFFGPVPCMEGAYAASGLGSTGLTVGPLIGYELCQLILNKEN    349
            A      RVG R +T F P  G VP ++G YAA+GLG++GLT+GP +G EL +L+L K+
Sbjct:  299 AAAVETRVGFRPFTPGFLPVVGAVPNVQGLYAANGLGASGLTMGPFLGAELAKLVLGKQT    358

Query:  350 QLNLEDYD                                                      357
            +L+L  YD
Sbjct:  359 ELDLSPYD                                                      366
```

```
Identities = 211/360 (58%), Positives = 262/360 (72%)

Query:   3 KIAIIGAGAVGATLAYYLSKEKDIQVTVFDYGVGQATKAAAGIISPWFSKRRNKAWYRMA  62
           KIAIIGAG VG+T AYYL +    +VT+FD+G GQATKAAAGIISPWFSKRRNK WYRMA
Sbjct:   2 KIAIIGAGIVGSTAAYYLQQSGQKEVTIFDHGQGQATKAAAGIISPWFSKRRNKVWYRMA  61

Query:  63 RLGADFYSKLVTDLQKDGFETKFYQQTGVFLLKKDESQLESLFALADKRRLESPLIGDLQ 122
           +LGADFY +L+ DL++DGF T FYQQ G+++LKK E +L  L+ LA  R++ESP+IG+L
Sbjct:  62 RLGADFYQQLINDLKEDGFATDFYQQNGIYVLKKQEEKLRDLYELALARKVESPIIGELA 121

Query: 123 ILNKSEANTHFPELDGYEQLLYASGGARVEGADLTRILLEASGVNVIKDEVHFTITDNGF 182
           I N+ E    F  L G++  LYASG ARVEGA L  LL+ASG VI+ +V      +G+
Sbjct: 122 IKNRKELGNDFKGLIGFDNCLYASGAARVEGAALCETLLKASGYPVIRQKVTLKQQGSGY 181

Query: 183 RVQGIDFDKLVLASGAWLAKILDEHNYQVDVRPQKGQLRDYYFSNINTGKYPVVMPEGEL 242
           + G  FD+++LA+GAWL  +L      YQVDVRPQKGQL DY    +I +  YPVVMPEGE+
Sbjct: 182 EIAGHYFDQVILAAGAWLPDLLRPLGYQVDVRPQKGQLLDYDVHHIISDTYPVVMPEGEI 241

Query: 243 DIIPFDNGKVSVGASHENDMAFDLNIDFKVLDKFEEQAIGYFPQLKKADTTSERVGIRAY 302
           D+IPF+ GK+SVG SHEND  +DL D++VL K E QA+ Y P LK+A    + RVGIRAY
Sbjct: 242 DLIPFNQGKISVGTSHENDKGYDLEPDWQVLKKLEMQALTYLPLLKEATQKTCRVGIRAY 301

Query: 303 TSDFSPFFGPVPCMEGAYAASGLGSTGLTVGPLIGYELCQLILNKENQLNEDYDITKYV 362
           TSD+SPF+G V  ++   Y ASGLGS+GLTVGPLIGYEL QL+L   E L     DY    Y+
Sbjct: 302 TSDYSPFYGQVSGLKNLYTASGLGSSGLTVGPLIGYELAQLLLGHEGLLTPSDYSPEPYL 361
```

Based on this analysis, it was predicted that these proteins and their epitopes could be useful antigens for vaccines or diagnostics.

A related GBS gene <SEQ ID 8679> and protein <SEQ ID 8680> were also identified. Analysis of this protein sequence reveals the following:

Lipop Possible site: −1 Crend: 2
McG: Discrim Score: 4.44
GvH: Signal Score (−7.5): 0.81
Possible site: 41

-continued

>>> Seems to have a cleavable N-term signal seq.
ALOM program    count: 0 value: 7.32 threshold: 0.0
PERIPHERAL            Likelihood = 7.32            153
modified ALOM score: −1.96
*** Reasoning Step: 3
----- Final Results -----
    bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>

The protein has homology with the following sequences in the databases:

```
45.2/62.7% over 163aa
Bacillus subtilis
EGAD|109026| hypothetical protein Insert characterized
SP|O32159|YURR_BACSU HYPOTHETICAL 39.4 KDA OXIDOREDUCTASE IN HOM-MRGA INTERGENIC REGION.
Insert characterized
GP|2635760|emb|CAB15253.1||Z99120 similar to opine catabolism Insert characterized
PIR|A70019|A70019 opine catabolism homolog yurR - Insert characterized
ORF02167(301-792 of 1161)
EGAD|109026|BS3258(1-164 of 372) hypothetical protein {Bacillus subtilis}
SP|O32159|YURR_BACSU HYPOTHETICAL 39.4 KDA OXIDOREDUCTASE IN HOM-MRGA INTERGENIC REGION.
GP|2635760|emb|CAB15253.1||Z99120 similar to opine catabolism {Bacillus subtilis}
PIR|A70019|A70019 opine catabolism homolog yurR - Bacillus subtilis
% Match = 16.6
% Identity = 45.2 % Similarity = 62.7
Matches = 75 Mismatches = 58 Conservative Sub.s = 29

228       258       288       318       348       378           435
     SYYD*AVET*KRLGYFSFRE*SSNKSLLPYVGAIMKKIAIIGAGAVGATLAYYLSKEKDIQVTVFDYGV-GQATKAAAGI
                                        ||     |:|||  :||:  ||:|:|         ||||     ||||  ||||
                                        MKSYIIVGAGILGASTAYHLAKT-GARVTVIDRKEPGQATDAAAGI
                                        10        20        30        40

465       495       525       555       585       615       645       675
     ISPWFSKRRNKAWYRMARLGADFYSKLVTDLQKDGFETKFYQQTGVFLLKKDESQLESLFALADKRRLESPLIGDLQILN
     : ||:|:|||: ||::|: ||  :|:   |:  |:||       |::  |    :  ||:| :    |||  ::  |||:   |:
     VCPWLSQRRNQDWYQLAKGGARYYKDLIHQLEKDGESDTGYKRVGAISIHTDASKLDKMEERAYKRREDAPEIGDITRLS
          60        70        80        90        100       110       120

705       732       762       792       822       852       882       912
     KSEANTHFPEL-DGYEQLLYASGGARVEGADLTRILXEASGVNVIKDESHFTITDKWLSCSRN*F**TCLASGAPAS*IL
     ||    |  ||||   ::  || ||  ||  |  |  |:
     ASETKKLFPILADGYE-SVHISGAARVNGRALCRSLLSAAEKRGATVIKGNASLLFENGTVTGVQTDTKQFAADAVIVTA
          140       150       160       170       180       190       200
```

SEQ ID 8680 (GBS290) was expressed in *E. coli* as a His-fusion product. SDS-PAGE analysis of total cell extract is shown in FIG. 57 (lane 6; MW 22 kDa). It was also expressed in *E. coli* as a GST-fusion product. SDS-PAGE analysis of total cell extract is shown in FIG. 77 (lane 4; MW 47 kDa).

GBS290-GST was purified as shown in FIG. 226, lane 9.

Based on this analysis, it was predicted that these proteins and their epitopes could be useful antigens for vaccines or diagnostics.

Example 875

A DNA sequence (GBSx0927) was identified in *S. agalactiae* <SEQ ID 2657> which encodes the amino acid sequence <SEQ ID 2658>. Analysis of this protein sequence reveals the following:

```
Possible site: 20
>>> Seems to have no N-terminal signal sequence
INTEGRAL    Likelihood = −2.18   Transmembrane 38-54 (36-54)
----- Final Results -----
   bacterial membrane --- Certainty = 0.1871 (Affirmative) <succ>
   bacterial outside --- Certainty = 0.0000 (Not Clear) <succ>
   bacterial cytoplasm --- Certainty = 0.0000 (Not Clear) <succ>
```

The protein has homology with the following sequences in the GENPEPT database.

```
>GP: AAD19913 GB: AF105113 glucose-1-phosphate thymidylyl transferase
[Streptococcus pneumoniae]
Identities = 262/289 (90%), Positives = 276/289 (94%)

Query:    1 MKGIILAGGSGTRLYPLTRAASKQLMPIYDKPMIYYPLSVLMLAGIKEILIISTPQDLPR   60
            MKGIILAGGSGTRLYPLTRAASKQLMP+YDKPMIYYPLS LMLAGIK+ILIISTPQDLPR
Sbjct:    1 MKGIILAGGSGTRLYPLTRAASKQLMPVYDKPMIYYPLSTLMLAGIKDILIISTPQDLPR   60

Query:   61 FEDMLGDGSELGISLSYAEQPSPDGLAQAFIIGEDFIGDDHVALVLGDNIYHGPGLSAML  120
            F+D+L DGSE GI LSYAEQPSPDGLAQAF+IGE+FIGDD VAL+LGDNIYHGPGLS ML
Sbjct:   61 FKDLLLDGSEFGIKLSYAEQPSPDGLAQAFLIGEEFIGDDSVALILGDNIYHGPGLSTML  120

Query:  121 QRAASKESGATVFGYQVKDPERFGVVEFDTDMNAISIEEKPAQPKSNYAVTGLYFYDNDV  180
            Q+AA KE GATVFGYQVKDPERFGVVEFDTDMNAISIEEKP  P+SNYAVTGLYFYDNDV
Sbjct:  121 QKAAKKEKGATVFGYQVKDPERFGVVEFDTDMNAISIEEKPEYPRSNYAVTGLYFYDNDV  180

Query:  181 VEIAKNIKPSPRGELEITDVNKAYLDRGDLSVELMGRGFAWLDTGTHESLLEAAQYIETV  240
            VEIAK IKPS RGELEITDVNKAYL+RGDLSVELMGRGFAWLDTGTHESLLEA+QYIETV
Sbjct:  181 VEIAKQIKPSARGELEITDVNKAYLNRGDLSVELMGRGFAWLDTGTHESLLEASQYIETV  240

Query:  241 QRMQNVQVANLEEIAYRMGYITREQVLELAQPLKKNEYGQYLLRLIGEA             289
            QRMQNVQVANLEEI+YRMGYI+RE VLELAQPLKKNEYG+YLLRLIGEA
Sbjct:  241 QRMQNVQVANLEEISYRMGYISREDVLELAQPLKKNEYGRYLLRLIGEA             289
```

A related DNA sequence was identified in *S. pyogenes* <SEQ ID 2659> which encodes the amino acid sequence <SEQ ID 2660>. Analysis of this protein sequence reveals the following:

```
Possible site: 20
>>> Seems to have no N-terminal signal sequence
----- Final Results -----
   bacterial cytoplasm --- Certainty = 0.1585 (Affirmative) <succ>
   bacterial membrane --- Certainty = 0.0000 (Not Clear) <succ>
   bacterial outside --- Certainty = 0.0000 (Not Clear) <succ>
```

RGD motif: 207-209

The protein has homology with the following sequences in the databases:

```
>GP: AAC69538 GB: AF057294 Cps23fO [Streptococcus pneumoniae]
Identities = 263/289 (91%), Positives = 276/289 (95%)

Query:    1 MKGIILAGGSGTRLYPL-                                            60
              TRAASKQLMPIYDKPMIYYPLSTLMLAGIKDVLIISTPQDLPR
            MKGIILAGGSGTRLYPLTRAASKQLMP+YDKPMIYYPLSTLMLAGI+D+LIIST-
            PQDLPR
Sbjct:    1 MKGIILAGGSGTRLYPL-                                            60
              TRAASKQLMPVYDKPMIYYPLSTLMLAGIRDILIISTPQDLPR
```

```
Query:   61 FEELLGDGSEFGISLSYKEQPSPDG-                                    120
            LAQAFIIGEEFIGDDRVALILGDNIYHGNGLTKML
            F+EEL DGSEFGI LSY EQPSPDGLAQAFIIGEEFIGDD VALILGDNIYHG GL+
            ML
Sbjct:   61 FKELLQDGSEFGIKLSYAEQPSPDG-                                   120
            LAQAFIIGEEFIGDDSVALILGDNIYHGPGLSTML Query:  121 QKAAAKEKGATVFGYQVKDPERF-                                     180
            GVVEFDENMNAISIEEKPEVPKSHFAVTGLYFYDNDV
            QKAA KEKGATVFGY VKDPERFGVVEFDENMNAISIEEKPE P+S++AVTGLY-
            FYDNDV
Sbjct:  121 QKAAKKEKGATVFGYHVKDPERF-                                     180
            GVVEFDENMNAISIEEKPEYPRSNYAVTGLYFYDNDV Query:  181 VEIAKNIKPSARGELEITDVNKAY-                                    240
            LERGDLSVELMGRGFAWLDTGTHESLLEAAQYIETV
            VEIAK+IKPS RGELEITDVNKAYL+RGDLSVELMGRGFAWLDTGTHESLLEA+QYI-
            ETV
Sbjct:  181 VEIAKSIKPSPRGELEITDVNKAY-                                    240
            LDRGDLSVELMGRGFAWLDTGTHESLLEASQYIETV Query:  241 QRLQNAQVANLEEIAYRMGYISKEDVHKLAQSLKKNEYGQYLLRLIGEA            289
            QR+QN QVANLEEIAYRMGYIS+EDV  LAQSLKKNEYGQYLLRLIGEA
Sbjct:  241 QRMQNVQVANLEEIAYRMGYISREDVLALAQSLKKNEYGQYLLRLIGEA            289
```

An alignment of the GAS and GBS proteins is shown below.

```
Identities = 257/289 (88%), Positives = 274/289 (93%)

Query:    1 MKGIILAGGSGTRLYPLTRAASKQLMPIYDKPMIYYPLSVLMLAGIKEILIISTPQDLPR  60
            MKGIILAGGSGTRLYPLTRAASKQLMPIYDKPMIYYPLS LMLAGIK++LIISTPQDLPR
Sbjct:    1 MKGIILAGGSGTRLYPLTRAASKQLMPIYDKPMIYYPLSTLMLAGIKDVLIISTPQDLPR  60

Query:   61 FEDMLGDGSELGISLSYAEQPSPDGLAQAFIIGEDFIGDDHVALVLGDNIYHGPGLSAML 120
            FE++LGDGSE GISLSY EQPSPDGLAQAFIIGE+FIGDD VAL+LGDNIYHG GL+ ML
Sbjct:   61 FEELLGDGSEFGISLSYKEQPSPDGLAQAFIIGEEFIGDDRVALILGDNIYHGNGLTKML 120

Query:  121 QRAASKESGATVFGYQVKDPERFGVVEFDTDMNAISIEEKPAQPKSNYAVTGLYFYDNDV 180
            Q+AA+KE GATVFGYQVKDPERFGVVEFD +MNAISIEEKP  PKS++AVTGLYFYDNDV
Sbjct:  121 QKAAAKEKGATVFGYQVKDPERFGVVEFDENMNAISIEEKPEVPKSHFAVTGLYFYDNDV 180

Query:  181 VEIAKNIKPSPRGELEITDVNKAYLDRGDLSVELMGRGFAWLDTGTHESLLEAAQYIETV 240
            VEIAKNIKPS RGELEITDVNKAYL+RGDLSVELMGRGFAWLDTGTHESLLEAAQYIETV
Sbjct:  181 VEIAKNIKPSARGELEITDVNKAYLERGDLSVELMGRGFAWLDTGTHESLLEAAQYIETV 240

Query:  241 QRMQNVQNANLEEIAYRMGYITREQVLELAQPLKKNEYGQYLLRLIGEA            289
            QR+QN QVANLEEIAYRMGYI++E V +LAQ LKKNEYGQYLLRLIGEA
Sbjct:  241 QRLQNAQVANLEEIAYRMGYISKEDVHKLAQSLKKNEYGQYLLRLIGEA            289
```

There is also homology to SEQ ID 858.

SEQ ID 2658 (GBS296) was expressed in *E. coli* as a His-fusion product. SDS-PAGE analysis of total cell extract is shown in FIG. 43 (lane 5; MW 35.4 kDa).

GBS296-His was purified as shown in FIG. 203, lane 7.

Based on this analysis, it was predicted that these proteins and their epitopes could be useful antigens for vaccines or diagnostics.

Example 876

A DNA sequence (GBSx0929) was identified in *S. agalactiae* <SEQ ID 2661> which encodes the amino acid sequence <SEQ ID 2662>. Analysis of this protein sequence reveals the following:

Possible site: 18
>>> Seems to have no N-terminal signal sequence
----- Final Results -----
  bacterial cytoplasm --- Certainty = 0.2635 (Affirmative) <succ>

-continued bacterial membrane --- Certainty = 0.0000 (Not Clear) <succ>
  bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 877

A DNA sequence (GBSx0930) was identified in *S. agalactiae* <SEQ ID 2663> which encodes the amino acid sequence <SEQ ID 2664>. This protein is predicted to be unnamed protein product. Analysis of this protein sequence reveals the following:

```
Possible site: 56
>>> Seems to have no N-terminal signal sequence
----- Final Results -----
    bacterial cytoplasm --- Certainty = 0.1868 (Affirmative) <succ>
    bacterial membrane  --- Certainty = 0.0000 (Not Clear)  <succ>
    bacterial outside   --- Certainty = 0.0000 (Not Clear)  <succ>
```

A related DNA sequence was identified in *S. pyogenes* <SEQ ID 2665> which encodes the amino acid sequence <SEQ ID 2666>. Analysis of this protein sequence reveals the following:

```
Possible site: 30
>>> Seems to have no N-terminal signal sequence
----- Final Results -----
    bacterial cytoplasm --- Certainty = 0.2818 (Affirmative) <succ>
    bacterial membrane  --- Certainty = 0.0000 (Not Clear)  <succ>
    bacterial outside   --- Certainty = 0.0000 (Not Clear)  <succ>
```

RGD motif: 29-31
The protein has homology with the following sequences in the databases:

```
>GP: AAC69539 GB: AF057294 Cps23fP [Streptococcus pneumoniae]
Identities = 168/197 (85%), Positives = 183/197 (92%)

Query:    1 MTETFFDKPLACREIKEIPGLLEF-                                    60
            DIPVRGDNRGWFKENFQKEKMLPIGFPERFFEEGKL
              MT+ FF K LA R+++ IPG+LEFDIPV GDNRGWFKENFQKEKMLP+GFPE F-
              F EGKL
Sbjct:    1 MTDNFFGKILAARKVEAIPGMLEF-                                    60
            DIPVHGDNRGWFKENFQKEKMLPLGFPESFFAEGKL Query:   61 QNNVSFSRQHVLRGLHAEPWDKYIS-                                  120
            VADDGKVLGAWVDLREGETFGNVYQTVIDASKGMF
            QNNVSFSR++VLRGLHAEPWDKYISVAD GKVLG+WVDLREGETFGN YQTVI-
            DASKG+F
Sbjct:   61 QNNVSFSRKNVLRGLHAEPWDKYIS-                                  120
            VADGGKVLGSWVDLREGETFGNTYQTVIDASKGIF Query:  121 VPRGVANGFQVLSETVSYSYLVNDY-                                  180
            WALDLKPKYAFVNYADPSLGITWENLAAAEVSEAD
            VPRGVANGFQVLS+TVSYSYLVNDYWAL+LKPKYAFVNYADPSLGI WEN+A AE-
            VSEAD
Sbjct:  121 VPRGVANGFQVLSDTVSYSYLVNDY-                                  180
            WALELKPKYAFVNYADPSLGIEWENIAEAEVSEAD Query:  181 KNHPLLSDVKPLKPKDL                                           197
            K+HPLL DVKPLK +DL
Sbjct:  181 KHHPLLKDVKPLKKEDL                                           197
```

Based on this analysis, it was predicted that these proteins and their epitopes could be useful antigens for vaccines or diagnostics.

Example 878

A DNA sequence (GBSx0931) was identified in *S. agalactiae* <SEQ ID 2667> which encodes the amino acid sequence <SEQ ID 2668>. Analysis of this protein sequence reveals the following:

```
Possible site: 14
>>> Seems to have no N-terminal signal sequence
----- Final Results -----
    bacterial cytoplasm --- Certainty = 0.3019 (Affirmative) <succ>
    bacterial membrane  --- Certainty = 0.0000 (Not Clear)  <succ>
    bacterial outside   --- Certainty = 0.0000 (Not Clear)  <succ>
```

The protein has no significant homology with any sequences in the GENPEPT database.

No corresponding DNA sequence was identified in *S. pyogenes*.

An alignment of the GAS and GBS proteins is shown below.

```
Identities = 157/197 (79%), Positives = 180/197 (90%)

Query:    1 MTEQFFDKELTCRPIEAIPGLLEFDIPVRGDNRGWFKENGQKEKMIPLGFPESFFEADKL  60
            MTE FFDK L CR I+ IPGLLEFDIPVRGDNRGWFKENFQKEKM+P+GFPE FFE  KL
Sbjct:    1 MTETFFDKPLACREIKEIPGLLEFDIPVRGDNRGWFKENGQKEKMLPIGFPERFFEEGKL  60

Query:   61 QNNISFNKKNTLRGLHAEPWDKYVSIADEGRVIGTWVDLREGDSFGNVYQTIIDASKGIF 120
            QNN+SF++++ LRGLHAEPWDKY+S+AD+G+V+G WVDLREG++FGNVYQT+IDASKG+F
Sbjct:   61 QNNVSFSRQHVLRGLHAEPWDKYISVADDGKVLGAWVDLREGETFGNVYQTVIDASKGMF 120

Query:  121 VPRGVANGFQVLSDKAAYTYLVNDYWALELKPKYAFVNYADPNLGIQWENLEEAEVSEAD 180
            VPRGVANGFQVLS+   +Y+YLVNDYWAL+LKPKYAFVNYADP+LGI WENL  AEVSEAD
Sbjct:  121 VPRGVNAGFQVLSETVSYSYLVNDYWALDLKPKYAFVNYADPSLGITWENLAAAEVSEAD 180

Query:  181 KNHPLLKDVKPLKKEDL                                           197
            KNHPLL DVKPLK +DL
Sbjct:  181 KNHPLLSDVKPLKPKDL                                           197
```

Example 879

A DNA sequence (GBSx0932) was identified in *S. agalactiae* <SEQ ID 2669> which encodes the amino acid sequence <SEQ ID 2670>. Analysis of this protein sequence reveals the following:

```
Possible site: 37
>>> Seems to have an uncleavable N-term signal seq
----- Final Results -----
   bacterial membrane --- Certainty = 0.0000 (Not Clear) <succ>
   bacterial outside --- Certainty = 0.0000 (Not Clear) <succ>
      bacterial cytoplasm --- Certainty = 0.0000 (Not Clear) <succ>
```

The protein has no significant homology with any sequences in the GENPEPT database.

```
Possible site: 38
>>> Seems to have no N-terminal signal sequence
----- Final Results -----
   bacterial cytoplasm --- Certainty = 0.0957 (Affirmative) <succ>
   bacterial membrane --- Certainty = 0.0000 (Not Clear) <succ>
      bacterial outside --- Certainty = 0.0000 (Not Clear) <succ>
```

A related GBS nucleic acid sequence <SEQ ID 9367> which encodes amino acid sequence <SEQ ID 9368> was also identified.

The protein is similar to the dTDP-glucose-4,6-dehydratase from *S. mutans*:

```
>GP: BAA11249 GB: D78182 dTDP-glucose-4,6-dehydratase [Streptococcus mu-
tans]
Identities = 290/310 (93%), Positives = 304/310 (97%)

Query:    1 MTYAGNRANIEAILGDRVELVVGDIADAELVDKLAAKADAIVHYAAESHNDNSLNDPSPF   60
            +TYAGN AN+E ILGDRVELVVGDIAD+ELVDKLAAKADAIVHYAAESHNDNSL DPSPF
Sbjct:   39 LTYAGNHANLEEILGDRVELVVGDIADSELVDKLAAKADAIVHYAAESHNDNSLKDPSPF   98

Query:   61 IHTNFIGTYTLLEAARKYDIREHHVSTDEVYGDLPLREDLPGNGEGPGEKFTAETKYNPS  120
            I+TNF+GTYTLLEAARKYDIRFHHVSTDEVYGDLPLREDLPG+GEGPGEKFTAETKYNPS
Sbjct:   99 IYTNFVGTYTLLEAARKYDIREHHVSTDEVYGDLPLREDLPGHGEGPGEKFTAETKYNPS  158

Query:  121 SPYSSTKAASDLIVKAWVRSFGVKATISNCSNNYGPYQHIEKFIPRQITNILAGIKPKLY  180
            SPYSSTKAASDLIVKAWVRSFGVKATISNCSNNYGPYQHIEKFIPRQITNIL+GIKPKLY
Sbjct:  159 SPYSSTKAASDLIVKAWVRSFGVKATISNCSNNYGPYQHIEKFIPRQITNILSGIKPKLY  218

Query:  181 GEGKNVRDWIHTNDHSTGVWAILTKGRIGETYLIGADGEKNNKEVLELILEKMGQPKDAY  240
            GEGK VRDWIHTNDHSTGVWAILTKGRIGETYLIGADGEKNNKEVLELILEKM QPKDAY
Sbjct:  219 GEGKEVRDWIHTNDHSTGVWAILTKGRIGETYLIGADGEKNNKEVLELILEKMSQPKDAY  278

Query:  241 DHVTDRAGHDLRYAIDSTKLREELGWEPQFTNESEGLEETINWYTENQDWWKAEKEAVEA  300
            DHVTDRAGHDLRYAIDSTKLREELGW+PQFTNF EGLE+TI WYTE++DWWKAEKEAVEA
Sbjct:  279 DHVTDRAGHDLRYAIDSTELREELGWKPQFTNFEEGLEDTIKWYTEHEDWWKAEKEAVEA  338

Query:  301 NYAKTQEVIN                                                   310
            NYAKTQ+++N
Sbjct:  339 NYAKTQKILN                                                   348
```

No corresponding DNA sequence was identified in *S. pyogenes*.

Based on this analysis, it was predicted that this protein and its epitopes, could be useful antigens for vaccines or diagnostics.

A related DNA sequence was identified in *S. pyogenes* <SEQ ID 2673> which encodes the amino acid sequence <SEQ ID 2674>. Analysis of this protein sequence reveals the following:

```
Possible site: 40
>>> Seems to have no N-terminal signal sequence
----- Final Results -----
   bacterial cytoplasm --- Certainty = 0.1150 (Affirmative) <succ>
      bacterial membrane --- Certainty = 0.0000 (Not Clear) <succ>
      bacterial outside --- Certainty = 0.0000 (Not Clear) <succ>
```

An alignment of the GAS and GBS proteins is shown below.

Example 880

A DNA sequence (GBSx0933) was identified in *S. agalactiae* <SEQ ID 2671> which encodes the amino acid sequence <SEQ ID 2672>. Analysis of this protein sequence reveals the following:

```
Identities = 300/309 (97%), Positives = 303/309 (97%)

Query:    1 MTYAGNRANIEAILGDRVELVVGDI-                                    60
            ADAELVDKLAAKADAIVHYAAESHNDNSLNDPSPF
```

```
                    -continued
            +TYAGNRANIEAILGDRVELVVGDI-
            ADAELVDKLAAK DIAVHYAAESHNDNSL DPSPF
Sbjct:  37  LTYAGNRANIEAILGDRVELVVGDI-                        96
            ADAELVDKLAAKTDAIVHYAAESHNDNSLEDPSPF Query:  61  IHTNFIGTYTLLEAARKYDIRFHHVST-                     120
            DEVYGDLPLREDLPGNGEGPGEKFTAETKYNPS
            IHTNFIGTYTLLEAARKYDIRFHHVST-
            DEVYGDLPLREDLPG GEGPGEKFTAETKYNPS
Sbjct:  97  IHTNFIGTYTLLEAARKYDIRFHHVST-                     156
            DEVYGDLPLREDLPGQGEGPGEKFTAETKYNPS Query: 121  SPYSSTKAASDLIVRAWVRSF-                           180
            GVKATISNCSNNYGPYQHIEKFIPRQITNILAGIKPKLY
            SPYSSTKAASDLIVKAWVRSF-
            GVKATISNCSNNYGPYQHIEKFIPRQITNILAGIKPKLY
Sbjct: 157  SPYSSTKAASDLIVKAWVRSF-                           216
            GVKATISNCSNNYGPYQHIEKFIPRQITNILAGIKPKLY Query: 181  GEGKNVRDWIHTNDHSTGVWAILTK-                       240
            GRIGETYLIGADGEKNNKEVLELILEKMGQPKDAY
            GEGKNVRDWIHTNDHSTGVWAILTK-
            GRIGETYLIGADGEKNNKEVLELILEKMGQPKDAY
Sbjct: 217  GEGKNVRDWIHTNDHSTGVWAILTK-                       276
            GRIGETYLIGADGEKNNKEVLELILEKMGQPKDAY Query: 241  DHVTDRAGHDLRYAIDSTKLREELG-                       300
            WEPQFTNFSEGLEETINWYTENQDWWKAEKEAVEA
            DHVTDRAGHDLRYAIDSTKLREELGWEPQFTNFSEGLEETI WYTEN+ WWKAEK+
            AVEA
Sbjct: 277  DHVTDRAGHDLRYAIDSTKLREELG-                       336
            WEPQFTNFSEGLEETIKWYTENETWWKAEKDAVEA Query: 301  NYAKTQEVI                                        309
            YAKTQEVI
Sbjct: 337  KYAKTQEVI                                        345
```

Based on this analysis, it was predicted that these proteins and their epitopes could be useful antigens for vaccines or diagnostics.

Example 881

A DNA sequence (GBSx0935) was identified in *S. agalactiae* <SEQ ID 2675> which encodes the amino acid sequence <SEQ ID 2676>. Analysis of this protein sequence reveals the following:

Possible site: 36
>>> Seems to have a cleavable N-term signal seq.
----- Final Results -----
  bacterial outside --- Certainty = 0.3000 (Affirmative) <succ>
    bacterial membrane --- Certainty = 0.0000 (Not Clear) <succ>
      bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 882

A DNA sequence (GBSx0936) was identified in *S. agalactiae* <SEQ ID 2677> which encodes the amino acid sequence <SEQ ID 2678>. Analysis of this protein sequence reveals the following:

Possible site: 35
>>> Seems to have an uncleavable N-term signal seq
INTEGRAL    Likelihood = −15.55    Transmembrane 13-29 (3-40)
----- Final Results -----
  bacterial membrane --- Certainty = 0.7220 (Affirmative) <succ>
    bacterial outside --- Certainty = 0.0000 (Not Clear) <succ>
      bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 883

A DNA sequence (GBSx0937) was identified in *S. agalactiae* <SEQ ID 2679> which encodes the amino acid sequence <SEQ ID 2680>. Analysis of this protein sequence reveals the following:

Possible site: 15
>>> Seems to have no N-terminal signal sequence
----- Final Results -----
  bacterial cytoplasm --- Certainty = 0.2882 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Example 884

A DNA sequence (GBSx0938) was identified in *S. agalactiae* <SEQ ID 2681> which encodes the amino acid sequence <SEQ ID 2682>. This protein is predicted to be hyaluronate lyase. Analysis of this protein sequence reveals the following:

Possible site: 30
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

A related DNA sequence was identified in *S. pyogenes* <SEQ ID 2683> which encodes the amino acid sequence <SEQ ID 2684>. Analysis of this protein sequence reveals the following:

Possible site: 46
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

A related sequence was also identified in GAS <SEQ ID 9099> which encodes the amino acid sequence <SEQ ID 9100>. Analysis of this protein sequence reveals the following:

Possible cleavage site: 23
>>> Seems to have a cleavable N-term signal seq.
----- Final Results -----
   bacterial outside --- Certainty = 0.300 (Affirmative) <succ>
      bacterial membrane --- Certainty = 0.000 (Not Clear) <succ>
         bacterial cytoplasm --- Certainty = 0.000 (Not Clear) <succ>

An alignment of the GAS and GBS proteins is shown below.

```
Identities = 359/771 (46%), Positives = 492/771 (63%), Gaps = 50/771 (6%)

Query:  307 PNAT--GSTTVKISDKSGKIIKEVPLSVTASTEDNFTKLLDKWNDVTIGNHVYDTNDSNM   364
            PN T    + T+  +D   K+++            +D +T+LLD+WN +  GN   YD  + +M
Sbjct:   65 PNNTYFQTQTLTTTDSEKKVVQP-------QQKDYYTELLDQWNSIIAGNDAYDKTNPDM   117

Query:  365 QKLNQKLDETNAKNIEAIKL-----DSNRTFLWKDLDNLNNSAWLTATYRRLEDLAKQIT   419
             + K  E +A+NI  IK       NRT+LW+   + + SA +T TYR +E +AKQIT
Sbjct:  118 VTFHNKA-EKDAQNI--IKSYQGPDHENRTYLWEHAKDYSASANITKTYRNIEKIAKQIT   174

Query:  420 NPHSTIYKNEKAIRTVKESLAWLHQNFYNVNDKI------EGSANWWDFEIGVPRSITGT   473
            NP S  Y++ KAI   VK+ +A+++++ YN++++       E   NWW +EIG PR+I  T
Sbjct:  175 NPESCYYQDSKAIAIVEDGMAFMYEHAYNLDRENHQTTGKENKENWWVYEIGTPRAINNT   234

Query:  474 LALMYNYFTDAEIKTYTDPIEHFVPDAGFFRKTLVN--PFKALOGNLVDMGRVKIIEGLL   531
            L+LMY YFT  EI   YT PIE FVPD   FR   N  PF+A  GLN+DMGRVK+I G+L
Sbjct:  235 LSLMYPYFTQEEILKYTAPIEKFVPDPTRFRVRAANFSPFEANSGNLIDMGRVKLISGIL   294

Query:  532 RKDNTIIEKTSHSLKNLFTTATKAEGFYADGSYIDHT----------NVAYTGAYGNVL   580
            RKD+  I  T +++ +FT   +  GFY DGS  IDH            +AYTGAYGVNL
Sbjct:  295 RKDDLEISDTIKAIEKVFTLVDEGNGFYQDGSLIDHVVTNAQSPLYKKGIAYTGAYGNVL   354

Query:  581 IDGLTQLLPIIQETDYKISNQELDMVYKWINQSFLPLIVKGELMDMSRGRSISREAASSH   640
            IDGL+QL+PIIQ+T   I   ++ +Y WIN SF P+IV+GE+MDM+RGRSISR  A SH
Sbjct:  355 IDGLSQLIPIIQKTKSPIKADKMATIYHWINHSFFPIIVRGEMMDMTRGRSISRFNAQSH   414

Query:  641 AAAVEVLRGFLRLANMSNEERNLDLKSTIKTIITS-NKFYNVFNNLKSYSDIANMNKLLN   699
            A +E LR  LR+A+MS E    L LK+ IKT++T  N FYNV++NLK+Y DI  M +LL+
Sbjct:  415 VAGIEALRAILRIADMSEEPHRLALKTRIKTLVTQGNAFTNVYDNLKTYHDIKLMKELLS   474

Query:  700 DSTVATKPLKSNLSTFNSMDRLAYYNAEKDFGFALSLHSKRTLNYEGMNDENTRGWYTGD   759
            D++V  + L S +++FNSMD +LA YN + DF F LS+ S RT NYE MN+EN GW+T D
Sbjct:  475 DTSVPVQKLDSYVASFNSMDKLALYNNKHDFAFGLSMFSNRTQNYEAMNNENLHGWFTSD   534

Query:  760 GMFYLYNSDQSHYSNHFWPTVNPYKMAGTTEKDAKREDTTKDFMSKHSKDAKEKTGQVTG   819
            GMFYLYN+D  HYS ++W TVNPY++ GTTE  + K  +T +       + K  ++ G +TG
Sbjct:  535 GMFYLYNNDLGHYSENYWATVNPYRLPGTTETEQKPLEGTPE----NIKTNYQQVG-MTG   589

Query:  820 ASD--FVGSVKLNDHFALAAMDFTNWDRTLTAQKGWVILNDKIVFLGSNIKNTNGIGNVS   877
              SD   FV S KLN+  ALAAM FTNW+++LT  KGW IL +KI+F+GSNIKN +
Sbjct:  590 LSDDAFVASKKLNNTSALAANTFTNWNKSLTLNKGWFILGNKTIFVGSNIENQSS-HKAY   648

Query:  878 TTIDQRKDDSKTPYTTYVNGKTVDLKQASSQQFTDTKSVFLESKEPGRNIGYIFFKNSTI   937
            TTI+QRI++ K PY +YVN + VDL        FT+TKS+FLES +P +NIGY FFK +T+
Sbjct:  649 TTIEQRKENQKYPYCSYVNNQPVDLNN-QLVDFTNTKSIFLESDDPAQNIGYYFFKPTTL   707

Query:  938 DIERKEQTGTWNSINRTSKNTSI---VSNPFITISQKHDNKGDSYDYMMVPNIDRTSFDK   994
              I +   QTG W +I      K+        VSN FITI Q H    GD Y YMM+PN+ R   F+
Sbjct:  708 SISKALQTGKWQNIKADDKSPEAIKEVSNTFITIMQNHTQDGDRYAYMMLPNMTRQEFET   767
```

```
Query: 995 LANSKEVELLENSSKQQVIYDKNSQTWAVIKHDNQESLINNQFKMNKAGLY      1045
            +   +++LLEN+ K    +YD +SQ    VI +  + ++ +N    ++   G Y
Sbjct: 768 YISKLDIDLLENNDKLAAVYDHDSQQMHVIHYGKKATMFSNH-NLSHQGFY      817
```

Figure 6:
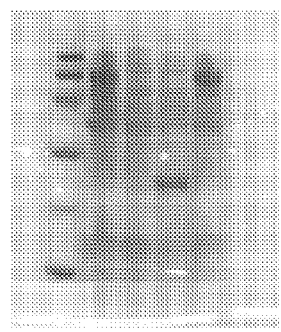

SEQ ID 2682 (GBS89) was expressed in *E. coli* as a His-fusion product. SDS-PAGE analysis of total cell extract is shown in FIG. 6 (lane 3; MW 118 kDa).

The His-fusion protein was purified as shown in FIG. 190, lane 4.

Based on this analysis, it was predicted that these proteins and their epitopes could be useful antigens for vaccines or diagnostics.

Example 885

A DNA sequence (GBSx0939) was identified in *S. agalactiae* <SEQ ID 2685> which encodes the amino acid sequence <SEQ ID 2686>. This protein is predicted to be mutator mutt protein. Analysis of this protein sequence reveals the following:

---

Possible site: 42
>>> Seems to have no N-terminal signal sequence
----- Final Results -----
bacterial cytoplasm --- Certainty = 0.3781 (Affirmative) <succ>
bacterial membrane --- Certainty = 0.0000 (Not Clear) <succ>
bacterial outside --- Certainty = 0.0000 (Not Clear) <succ>

---

The protein has homology with the following sequences in the GENPEPT database.

```
>GP: BAA11250 GB: D78182 MutX [Streptococcus mutans]
Identities = 132/160 (82%), Positives = 146/160 (90%), Gaps = 1/160 (0%)

Query:   1 MTKLATICYIDNGKELLLLHANKKENDVHEGKWISVGGKLEAGETPDECAKREILEETHL  60
             M KLATICYIDNG+ELLL+HRNKK NDVHEGKWISVGGKLE GE+PDECA+REI EETHL
Sbjct:   1 MIKLATICYIDNGRELLLMHRNKKPNDVHEGKWISVGGKLEKGESPDECARREIFEETHL  60

Query:  61 TVKKMDFKGVITEPEFTPGHDWYTYVEKVTDYEGELISDDESREGTLEWVPYDQVLSKPT 120
             VK+MDFKG+ITFP+FTPGHDWYTYVFKV D+EG LISD +SREGTLEWVPY+QVL+KPT
Sbjct:  61 IVKQMDFKGIITFPDFTPGHDWYTYVEKVRDFEGRLISDKDSREGTLEWVPYNQVLTKPT 120

Query: 121 WQGDYEIFKWILEDVPFFSAKFVYDEHQNLIEKTVNFYEK                     160
             W+GDYEIFKWILED PFFSAKFVY E Q L++K V FYEK
Sbjct: 121 WEGDYEIFKWILEDAPFFSAKFVYQE-QKLVDKHVIFYEK                     159
```

A related DNA sequence was identified in *S. pyogenes* <SEQ ID 2687> which encodes the amino acid sequence <SEQ ID 2688>. Analysis of this protein sequence reveals the following:

---

Possible site: 42
>>> Seems to have no N-terminal signal sequence
----- Final Results -----
bacterial cytoplasm --- Certainty = 0.2399 (Affirmative) <succ>
bacterial membrane --- Certainty = 0.0000 (Not Clear) <succ>
bacterial outside --- Certainty = 0.0000 (Not Clear) <succ>

---

An alignment of the GAS and GBS proteins is shown below.

```
Identities = 131/158 (82%), Positives = 146/158 (91%)

Query:   1 MTKLATICYIDNGKELLLLHRNKKENDVHEGKWISVGGKLEAGETPDECAKREILEETHL  60
             MT+LATICYIDNG   LLLLHRNKKENDVH+GKWISVGGKLEAGETPDECA+REILEETHL
Sbjct:   1 MTQLATICYIDNGDSLLLLHRNKKENDVHKGKWISVGGKLEAGETPDECARREILEETHL  60

Query:  61 TVKKMDFKGVITFPEFTPGHDWYTYVFKVTDYEGELISDDESREGTLEWVPYDQVLSKPT 120
             TV +M FKG+ITFPEFTPGHDWYTYVFKVT +EG+LISD+ESREGTLEWVPYDQVL KPT
Sbjct:  61 TVTEMAFKGIITFPEFTPGHDWYTYVFKVTGFEGDLISDEESREGTLEWVPYDQVLEKPT 120

Query: 121 WQGDYEIFKWILEDVPFFSAKFVYDEHQNLIEKTVNFY                       158
             W+GDY+IFKWILED  FFSAKF YD++  L++K+V FY
Sbjct: 121 WEGDYDIFKWILEDRSFFSAKFTYDQNNQLMDKSVTFY                       158
```

Based on this analysis, it was predicted that these proteins and their epitopes could be useful antigens for vaccines or diagnostics.

Example 886

A DNA sequence (GBSx0940) was identified in *S. agalactiae* <SEQ ID 2689> which encodes the amino acid sequence <SEQ ID 2690>. This protein is predicted to be MutT/nudix family protein. Analysis of this protein sequence reveals the following:

```
Possible site: 28
>>> Seems to have no N-terminal signal sequence
----- Final Results -----
    bacterial cytoplasm --- Certainty = 0.1901 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP: AAF11817 GB: AE002059 MutT/nudix family protein [Deinococcus radiodurans]
Identities = 40/135 (29%), Positives = 62/135 (45%), Gaps = 3/135 (2%)

Query:  22 FGVRVSALIIENQKLLLIYAPHLDKYY-LPGGALQVGEDSNKAVAREVLEEIGLHSQVGD    80
           F  R + + +++ +LL  +       ++ LPGGA+Q GE S   A   RE   EE GL + V
Sbjct:  33 FQTRATLICVQDNRLLTCWDERFPDFFALPGGAVQTGESSAAAAQREWHEETGLRADVTR   92

Query:  81 LAYIIENQFNIKRHHYHSVEFLYFVNLLGQAPESIKEGTHKRHFVWLPIKELTKIDCNPN   140
              A  +E  F+ +     H    F + V L G+ P ++ +   H    F WL +   L          P
Sbjct:  93 CA-TLERFFHWEGRERHEFGFFFRVELTGELPATVLDNPHV-FFRWLAVDALDDHTLYPR   150

Query: 141 FLAQDLIEWPGHVVH                                              155
           + Q L     G + H
Sbjct: 151 CVPQLLRLPAGEIGH                                              165
```

A related DNA sequence was identified in *S. pyogenes* <SEQ ID 2691> which encodes the amino acid sequence <SEQ ID 2692>. Analysis of this protein sequence reveals the following:

```
Possible site: 55
>>> Seems to have no N-terminal signal sequence
----- Final Results -----
    bacterial cytoplasm --- Certainty = 0.3832 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
Identities = 33/80 (41%), Positives = 50/80 (62%), Gaps = 1/80 (1%)

Query:  29 LIIENQKLLLIYAPHLDKYYLPG-                                     88
              GALQVGEDSNKAVAREVLEEIGLHSQVGDLAYIIENQ
           LI+  N K  L        D+YY   GG     VGE +++ V RE LEE+G+ ++V   LA+++EN
Sbjct:   1 LIVRNGKNFLTRDAD-DQYYTIGGTSLVGEKTHETVLRETLEEV-                59
              GIRAKVNQLAFMVENH Query:  89 FNIKRHHYHSVEFLYFVNLL                                        108
           F+I    +H++EF Y V+ L
Sbjct:  60 FDIDDVFWHNIEFHYLVSPL                                         79
```

Based on this analysis, it was predicted that these proteins and their epitopes could be useful antigens for vaccines or diagnostics.

Example 887

A DNA sequence (GBSx0941) was identified in *S. agalactiae* <SEQ ID 2693> which encodes the amino acid sequence <SEQ ID 2694>. This protein is predicted to be unnamed protein product. Analysis of this protein sequence reveals the following:

```
Possible site: 26
>>> Seems to have no N-terminal signal sequence
INTEGRAL    Likelihood = -12.95   Transmembrane 24-40 (17-48)
INTEGRAL    Likelihood = -11.09   Transmembrane 88-104 (82-112)
INTEGRAL    Likelihood =  -9.39   Transmembrane 294-310 (276-315)
INTEGRAL    Likelihood =  -8.07   Transmembrane 242-258 (236-262)
INTEGRAL    Likelihood =  -7.86   Transmembrane 50-66 (43-74)
INTEGRAL    Likelihood =  -3.13   Transmembrane 337-353 (332-355)
INTEGRAL    Likelihood =  -2.23   Transmembrane 185-201 (182-202)
```

-continued

```
INTEGRAL    Likelihood = -1.38    Transmembrane 269-285 (267-285)
----- Final Results -----
    bacterial membrane --- Certainty = 0.6180 (Affirmative) <succ>
    bacterial outside --- Certainty = 0.0000 (Not Clear) <succ>
    bacterial cytoplasm --- Certainty = 0.0000 (Not Clear) <succ>
```

A related DNA sequence was identified in *S. pyogenes* <SEQ ID 2695> which encodes the amino acid sequence <SEQ ID 2696>. Analysis of this protein sequence reveals the following:

Possible site: 26
>>> Seems to have no N-terminal signal sequence
INTEGRAL    Likelihood = −9.71    Transmembrane 88-104 (85-112)
INTEGRAL    Likelihood = −9.29    Transmembrane 24-40 (21-72)
INTEGRAL    Likelihood = −8.92    Transmembrane 47-63 (41-72)
INTEGRAL    Likelihood = −7.59    Transmembrane 243-259 (237-266)
INTEGRAL    Likelihood = −6.10    Transmembrane 181-197 (178-203)
INTEGRAL    Likelihood = −5.47    Transmembrane 278-294 (273-310)
INTEGRAL    Likelihood = −3.88    Transmembrane 338-354 (331-368)
INTEGRAL    Likelihood = −1.59    Transmembrane 297-313 (297-314)
----- Final Results -----
    bacterial membrane --- Certainty = 0.4885 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP: AAD00285 GB: U78604 putative membrane protein [Streptococcus mutans]
Identities = 244/382 (63%), Positives = 310/382 (80%), Gaps = 3/382 (0%)

Query:   12 SLFYKWFLNNQATMALVITLLAFLTIFVFTKISFLFMPVISFFAVIMLPLVISTILYYLT   71
             S F+KWFL+N+    L++ LL FL I VFTKIS +F P++SF AVIMLPLVIS +LYYL
Sbjct:   17 SWFFKWFLDNKTVTVLLVLLLVFLDILVFTKISSIFKPLLSFLAVIMLPLVISALLYYLL   76

Query:   72 KPLVDLINHLGPNRTTSIFIVFGLITLLFVWAISGFVPMVQTQLTSFIEDLPKYVGKVNE  131
             KP+VD I    G +R  +I IVF +I  L VW I+ F PM+   QLTSFI+ LP YV  V+
Sbjct:   77 KPIVDFIEIRGTSRVMAITIVFVIIAGLLVWGIANFFPMLNEQLTSFIKYLPSYVRSVDA  136

Query:  132 EANKLLENEWLVSYKPQLQDMLTHTSQKALDYAQSFSKNAIDWAGNFAGAIARITVAIII  191
             + +KLL N+ L S++PQ+++  +T+ SQKA+DYA  FSK A+ WAGNFA  IAR+TVAIII
Sbjct:  137 QVSKLLRNDLLASFRPQIENAVTNFSQKAVDYAEPFSKGAVTWAGNFASLIARVTVAIII  196

Query:  192 SPFILFYFLRDSSHMKNGLVNVLPLKLRVPMVRVLGDINKQLSGYVQGQVTVAIVVGFMF  251
             SPFI+FY LRDSS MK   V+ LP K+R P+ R+LGD+N+QL+QYVQ   TVAI+VGFMF
Sbjct:  197 SPFIVFYLLRDSSKMKEAFVSYLPTKMRQPIHRILGDVNRQLAGYVQRSSIVAIIVGFMF  256

Query:  252 SIMFSLVGLKYAITFGIIAGFLNMIPYLGSFLAMIPVVIMAMVQGPFMLVKVLVIFMIEQ  311
             SIMF+++GL+YA+TFGIIAGFLNMIPYLGSFLA IPV I+A+V+GP  +VKV  +F++EQ
Sbjct:  257 SIMFTIIGLRYAVTFGIIAGFLNMIPYLGSFLATIPVFILALVEGPVKVVKVALVFIVEQ  316

Query:  312 TIEGRFVAPLVLGNKLSIHPITIMFLLLTAGSMFGVWGVFLVIPIYASVKVVIKELFDWY  371
             TIEGRFV+PLVLG+KLSIHPITIMF+LLTAGSMFGVWGVFL IP+YAS+KVV+KE+F+WY
Sbjct:  317 TIEGRFVSPLVLGSKLSIHPITIMFILLTAGSMFGVWGVFLGIPVYASIKVVVKEIFEWY  376

Query:  372 KKVSGLYDEEVLVIEEVKDHVK                                       393
             K +SGLY++E    E++K  VK
Sbjct:  377 KPISGLYEKEE---EDIKKDVK                                       395
```

An alignment of the GAS and GBS proteins is shown below.

```
Identities = 243/389 (62%), Positives = 306/389 (78%), Gaps = 2/389 (0%)

Query:    6 EKEFKNSLFFKWILNNQAVIALMITFLV-                                 65
            FLTIFIFTKISFMFKPVFDFLAVLILPLVISG
            EK   +SLF+KW LNNQA +AL+IT L  FLTIF+FTKISF+F PV   F AV++LPLVIS
Sbjct:    6 EKSRTDSLFYKWFLNNQATMALVITL-                                   65
            LAFLTIFVFTKISFLFMPVISFFAVIMLPLVIST Query:   66 LLYYLLKPMVTFLEKRGIKRVTAILS-                                  125
            VFTIIILLLIWAMSSFIPMMSNQLRHFMEDLPSY
            +LYYL KP+V +     G  R T+I  VF +I LL +WA+S F+PM+   QL   F+
            EDLP Y
Sbjct:   66 ILYYLTKPLVDLINHLGPNRTTSIFIVF-                                125
            GLITLLFVWAISGFVPMVQTQLTSFIEDLPKY Query:  126 VNKVQMETSSFIDHNP-                                            185
            WLKSYKGEISSMLSNISSQAVSYAEKFSKNILDWAGNLASTVAR
            V KV  E +  ++ N  WL SYK ++   ML++ S +A+ YA+ FSKN +DWAGN A +AR
Sbjct:  126 VGKVNEEANKLLE-NEWLVSYKPQLQDMLTHISQKALDYAQS-                  184
            FSKNAIDWAGNFAGAIAR Query:  186 VTVATIMAPFILFYLLRDSRNMKNGFLM-                                245
            VLPTKLRQPTDRILREMNSQMSGYVQGQIIVA
            +TVA I++PFILFY LRDS +MKNG + VLP KLR P  R+L ++N Q+SGYVQGQ+
            VA
Sbjct:  185 ITVAIIISPFILFYFLRDSSHMKNGLVN-                                244
            VLPLKLRVPMVRVLGDINKQLSGYVQGQVTVA Query:  246 ITVGVIFSIMYSIIGLRYGVTLGIIAGV-                                305
            LNMVPYLGSFVAQIPVFILALVAGPVMVVKVA
            I VG +FSIM+S++GL+Y +T GIIAG LNM+PYLGSF+A IPV I+A+V GP M+VKV
Sbjct:  245 IVVGFMFSIMFSLVGLKYAITFGIIAG-                                 304
            FLNMIPYLGSFLAMIPVVIMAMVQGPFMLVKVL
```

```
-continued
Query:  306 IVFVIEQTLEGRFVSPLVLGNKLSIH-                                    365
            PITIMFILLLTSGAMFGVWGVFLSIPIYASIKVVV
            ++F+IEQT+EGRFV+PLVLGNKLSIHPITIMF+LLT+G+MFGVWGVFL IPIYAS+
            KVV+
Sbjct:  305 VIFMIEQTIEGRFVAPLVLGNKLSIH-                                    364
            PITIMFLLLTAGSMFGVWGVFLVIPIYASVKVVI Query:  366 KELFDWYKAVSGLYTVDV-VTEERSEEVK                                  393
            KELFDWYK VSGLY  +V V EE  + VK
Sbjct:  365 KELFDWYKKVSGLYDEEVLVIEEVKDHVK                                  393
```

Based on this analysis, it was predicted that these proteins and their epitopes could be useful antigens for vaccines or diagnostics.

Example 888

A DNA sequence (GBSx0942) was identified in *S. agalactiae* <SEQ ID 2697> which encodes the amino acid sequence <SEQ ID 2698>. Analysis of this protein sequence reveals the following:

---
Possible site: 58
>>> Seems to have no N-terminal signal sequence
----- Final Results -----
  bacterial cytoplasm --- Certainty = 0.2715 (Affirmative) <succ>
    bacterial membrane --- Certainty = 0.0000 (Not Clear) <succ>
      bacterial outside --- Certainty = 0.0000 (Not Clear) <succ>
---

A related GBS nucleic acid sequence <SEQ ID 9891> which encodes amino acid sequence <SEQ ID 9892> was also identified.

The protein has homology with the following sequences in the GENPEPT database.

A related DNA sequence was identified in *S. pyogenes* <SEQ ID 2699> which encodes the amino acid sequence <SEQ ID 2700>. Analysis of this protein sequence reveals the following:

---
Possible site: 25
>>> Seems to have no N-terminal signal sequence
----- Final Results -----
  bacterial cytoplasm --- Certainty = 0.2991 (Affirmative) <succ>
    bacterial membrane --- Certainty = 0.0000 (Not Clear) <succ>
      bacterial outside --- Certainty = 0.0000 (Not Clear) <succ>
---

An alignment of the GAS and GBS proteins is shown below.

```
>GP: AAA25160 GB: L16975 ORF1 [Lactococcus lactis]
Identities = 132/345 (38%), Positives = 203/345 (58%), Gaps = 3/345 (0%)

Query:   79 INLAQIVAEDGDIEQAFLYLDYISEDSQEYVSALLVMADLYDMEGLIDVAREKLLLASKL 138
            +NLA+I  ++G++++A  YL I  + + Y++AL+ +ADLY  E   + A  KL   A +L
Sbjct:    1 VNLAEIAEDNGNLDEALNYLYQIPVNDENYIAALIKIADLYQFEVDFETAISKLEEAREL  60

Query:  139 SDDPLVTFGLAEMNLSLEHYQEAIEGYASLDNREILETTGVSTYQRIGKSYAIMGKEDAA 198
            SD PL+TF LAE        Y  AI  YA L  R+IL  T +S YQRIG SYA +G F+ A
Sbjct:   61 SDSPLITFALABSYFEQGDYSAAITEYAKLSERKILHETKISIYQRIGDSYAQLGNFENA 120

Query:  199 IEFLEKAVDIEYDDLTVFELATILYDQEEYQKANLYFKQLDTINPDFAGYEYIYGLSLRE 258
            I FLEK+++ +   T++++A +  +        +A  FK+L+ ++ +F  YE  Y  +L
Sbjct:  121 ISFLEKSLEFDEKPETLYKIALLYGETHNETRAIANFKRLEKMDVEFLNYELAYAQTLEA 180

Query:  259 EHKSEEALRLVQQGIRKNSEDGQLLLLASQLSYELHDVHSSESYLKQAEKVSENQDEIVM 318
            + + AL + ++G++++KN       LL    AS++ ++L D  ++E YL  A  + E  DE V
Sbjct:  181 NQEFKAALEMAKKGMKKNPNAVPLLHFASKICFKLKDKAAAERYLVDALNLPELHDETVF 240

Query:  319 RLSNLYLEEERFEEVLELDN-DNLENILAKWNIAKAHKALEMDDSVD--YYQSLYNDLKD 375
            L+NLY  EE  FE V+ L+      E++LAKW  A  AHKALE D           Y + + +L +
Sbjct:  241 LLANLYFNEEDFEAVINLEELLEDEHLLAKWLFAGAHKALENDSEAAALYEELIQTNLSE 300

Query:  376 NPEFLQDYAYILREFGYLDKAQEVGKAYLKLVPDDIEMSEWVNNI                420
            NPEFL+DY   L+E G + K + + +  YL+LVPDD  M    + ++
Sbjct:  301 NPEFLEDYIDELKEIGQISKTEPIIEQYLELVADDENMRNLLTDL                345
```

```
Identities = 267/409 (65%), Positives = 336/409 (81%), Gaps = 1/409 (0%)

Query:  13 MLNSEKMIVSIQNQDLEHANKYFEKALKNDPEEVLLELGAYLESIGFLPQAKRLYDQIRP   72
            MLNSEKMI S+  QDL HA KYF+KALK D  + L+ LG YLESIGFLP AKR+Y Q+
Sbjct:   7 MLNSEKMIASLDQQDLAHAEKYFQKALKEDDADSLIALGEYLESIGFLPHAKRIYLQLAD   66

Query:  73 NYPEVAINLAQIVAEDGDIEQAFLYLDYISEDSQEYVSALLVMADLYDMEGLTDVAREKL  132
            +YPE+ INLAQI AED   IE+AFLYLD +S+DS   Y+SALLVMADLYDMEGLT+VAREKL
Sbjct:  67 DYPELNINLAQIAAEDDAIEEAFLYLDKVSKDSPNYLSALLVMADLYDMEGLTEVAREKL  126

Query: 133 LLASKLSDDPLVTFGLAEMNLSLEHYQEAIEGYASLDNREILETTGVSTYQRIGKSYAIM  192
            L A  +S +PLV FGLAE+++SL+H++EAI+  YA LDNR+ILE TG+STYQRIG++YA +
Sbjct: 127 LQAVGISPEPLVIFGLAEIDMSLQHFKEAIDYYAQLDNRQILELTGISTYQRIGRAYASL  186

Query: 193 GKEDAAIEFLEKAVDIEYDDLTVFELATILYDQEEYQKANLYFKQLDTINPDFAGYEYIY  252
            GKF+AAIEFLEKAV IEY+D TVFELAT++YDQE YQKANLYFKQL+TINPD+ GYEY Y
Sbjct: 187 GKFEAAIEFLEKAVAIEYEDETVFELATLMYDQENYQKANLYFKQLETINPDYPGYEYGY  246

Query: 253 GLSLREEHKSEEALRLVQQGIRKNSFDGQLLLLASQLSYELHDVHSSESYLKQAEKVSEN  312
             LSL EEHK+ EALRLVQQG+RKN+FD QLLLLASQLSYELHD  ++E+YL QA++V+ +
Sbjct: 247 ALSLHEEHKTSEALRLVQQGLRKNAFDSQLLLLASQLSYELHDRQNAENYLLQAKEVAVD  306

Query: 313 QDEIVMRLSNLYLEEERFEEVLELDNDNLENILAKWNIAKAHKALEMDD-SVDYYQSLYN  371
            +EI+MRL  LY + ERFEEV+ L+ +  ++N+L KW IAKA+ ALE ++ ++   Y  +
Sbjct: 307 DEEILMRLVTLYFDAERFEEVIALNRETIDNVLTKWTIAKAYHALEQEEVALALYNEISA  366

Query: 372 DLKDNPEFLQDYAYILREFGYLDKAQEVGKAYLKLVPDDIEMSEWVNNI            420
            DL +NPEFLQDYAY+LREFG    KA ++   AYL+ VPDD+ M +++++I
Sbjct: 367 DLAENPEFLQDYAYLLREFGQFHKAIQMATAYLRQVPDDVNMQDFLDHI            415
```

Based on this analysis, it was predicted that these proteins and their epitopes could be useful antigens for vaccines or diagnostics.

Example 889

A DNA sequence (GBSx0943) was identified in *S. agalactiae* <SEQ ID 2701> which encodes the amino acid sequence <SEQ ID 2702>. This protein is predicted to be alpha-acetolactate synthase (ilvK). Analysis of this protein sequence reveals the following:

Possible site: 60
>>> Seems to have no N-terminal signal sequence
----- Final Results -----
bacterial cytoplasm --- Certainty = 0.2105 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP: CAA01700 GE: A23961 alpha-acetolactate synthase [Lactococcus lactis]
Identities = 396/559 (70%), Positives = 466/559 (82%), Gaps = 8/559 (1%)

Query:   4 SHNQYGADLIVDSLINHDVKYVFGIPGAKIDRVFDTLE-DKGPELIVARHEQNATFMAQA   62
            S  Q+AG+L+VDSLINH VKYVFGIPGAKIDRVFD LE ++GP+++V RHEQ A FMAQA
Sbjct:   2 SEKQFGANLVVDSLINHKVKYVEGIPGAKIDRVFDLLENEEGPQMVVTRHEQGAAFMAQA   61

Query:  63 VGRITGEPGVVIATSGPGISNLATGLVTATDEGDAVLAIGGQVKRGDLLKRAHQSMNNVA  122
            VGR+TGEPGVV+ TSGPG+SNLAT L+TAT EGDA+LAIGGQVKR D LKRAHQSM+N
Sbjct:  62 VGRLTGEPGVVVVTSGPGVSNLATPLLTATSEGDAILAIGGQVKRSDRLKRAHQSMDNAG  121

Query: 123 MLEPITKYSAEVHDPNTLSETVANAYRLAKSGKPGASFISIPQDVTDSPVSVEAIKPLSA  182
            M++   TKYSAEV DPNTLSE++ANAYR+AKSG PGA+F+SIPQDVTD+ VS+KAI+PLS
Sbjct: 122 MMQSATEYSAEVLDPNTLSESIANAYRIAKSGHPGATFLSIPQDVTDAEVSIKAIQPLSD  181

Query: 183 PKLGSASVLDINYLAQAINNAVLPVLLLGNGASSEGVTAAVRRLLDAVKLPVVETFQGAG  242
            PK+G+AS+ DINYLAQAI NAVLPV+L+G GAS   V +++R LL  V +PVVETFQGAG
Sbjct: 182 PKMGNASIDDINYLAQAIENAVLPVILVGAGASDAKVASSLRELLTHVNIPVVETFQGAG  241

Query: 243 IVSRELEDETFFGRVGLFRNQPGDMLLKRADLVIAIGYDPIEYEARNWNAEISARIIVID  302
            ++S +LE  TF+GR+GLFRNQPGDMLLKR+DLVIA+GYDPIEYEARNWNAEI +RIIVID
Sbjct: 242 VISHDLE-HTFYGRIGLFRNQPGDMLLKRSDLVIAVGYDPIEYEARNWNAEIDSRIIVID  300

Query: 303 VEQAEIDTYFQPERELIGDMAHTLDLLLRAIKGYELPEGSKEYLKGLRNNIENVSDVKFD  362
                AEIDTY+QPERELIGD+A TLD LLPA++GY++P+G+K+YL GL      E    +FD
Sbjct: 301 NAIAEIDTYYQPERELIGDIAATLDELLPAVRGYKIPKGTKDYLDGLH---EVAEQHEFD  357

Query: 363 RDSA-HGLVHPLDLIDVLQENTTDDMTVTVDVGSHYIWMARYFESYEARHLLFSNGMQTL  421
             ++   G +HPLDL+   QE   DD TVTVDVGS YIWMAR+FKSYE RHLLFSNGMQTL
Sbjct: 358 TENTEEGRMHPLDLVSTFQEIVKDDETVTVDVGSLYIWMARHFKSYEPRHLLFSNGMQTL  417
```

```
                              -continued
Query:  422 GVALPWAISAALLRPNTKVISVSGDGGFLFSAQELETAVRLHLPIVHIIWNDGKYNMVEF 481
            GVALPWAI+AALLRP  KV S SGDGGFLF+ QELETAVRL+LPIV IIWNDG Y+MV+F
Sbjct:  418 GVALPWAITAALLRPGKKVYSHSGDGGFLFTGQELETAVRLNLPIVQIIWNDGHYDMVKF 477

Query:  482 QEEMKYGRSSGVDFGPVDFVKYAESFGAKGYRVDSKDSFEETLKQALIDAENGPVLIDVP 541
            QEEMKYGRS+ VDFG VD+VKYAE+  AKGYR  SK+   E LK  I     GPV+IDVP
Sbjct:  478 QEEMKYGRSAAVDFGYVDYVKYAEAMRAKGYRAHSKEELAEILKS--IPDTTGPVVIDVP 535

Query:  542 IDYKDNVTLGETILPDEFY                                          560
            +DY DN+ L E +LP+EFY
Sbjct:  536 LDYSDNIKLAEKLLPEEFY                                          554
```

No corresponding DNA sequence was identified in *S. pyogenes*.

Based on this analysis, it was predicted that this protein and its epitopes, could be useful antigens for vaccines or diagnostics.

Example 890

A DNA sequence (GBSx0944) was identified in *S. agalactiae* <SEQ ID 2703> which encodes the amino acid sequence <SEQ ID 2704>. This protein is predicted to be alpha-acetolactate decarboxylase (aldC). Analysis of this protein sequence reveals the following:

Possible site: 43
>>> Seems to have no N-terminal signal sequence
----- Final Results -----
   bacterial cytoplasm --- Certainty = 0.3096 (Affirmative) <succ>
   bacterial membrane --- Certainty = 0.0000 (Not Clear) <succ>
     bacterial outside --- Certainty = 0.0000 (Not Clear) <succ>

A related GBS nucleic acid sequence <SEQ ID 9889> which encodes amino acid sequence <SEQ ID 9890> was also identified.

The protein has homology with the following sequences in the GENPEPT database.

```
>GP: CAA57941 GB: X82620 alpha-acetolactate decarboxylase [Lactococcus lactis]
Identities = 139/239 (58%), Positives = 187/239 (78%), Gaps = 3/239 (1%)

Query:   16 MSETVKLFQYSTLSSLMAGLYKGSLTIGELLTHGDLGIGTVHMIDGELIVLDGKAYQAIG   75
            MSE  +LFQY+TL +LMAGLY+G++TIGELL HGDLGIGT+  +D+IDGELIVLDGKAYQA
Sbjct:    1 MSEITQLFQYNTLGALMAGLYEGTMTIGELLKHGDLGIGTLDSIDGELIVLDGKAYQA--   58

Query:   76 TDGKAEIIQLSDDVTVPYAAVLPHHIQKQFDINAEIDNKDLEEMILKNFEGQNLFKSLKI  135
                   G    I++L+DD+  VPYAAV+PH   +  F        + +K+LE+  I    F+GQNLF+S+KI
Sbjct:   59 -KGDKTIVELTDDIKVPYAAVVPHQAEVVFKQKFTVSDKELEDRIESYFDGQNLFRSIKI  117

Query:  136 KGTFSRMHVRMIPKSPQHKRFADIASNQPEFTRENVEGTLVGIWTPELFHGVGVKGFHVH  195
                G F +MHVRMIP++       +F +++ NQPE+T EN+  GT+VGIWTPE+FHGV V G+H+H
Sbjct:  118 TGKFPKMHVRMIPRAKSGTKFVEVSQNQPEYTEENIKGTIVGIWTPEMFHGVSVAGYHLH  177

Query:  196 FISDDLTFGGHVMDYSLTQGKVEIGKVDQLDQCFPTQDQEFLKANFDLQKLREDIDLSE   254
            FIS+D TFGGHV+D+ +    G VEIG +DQL+Q FP QD++FL A+ D++ L++DID++E
Sbjct:  178 FISEDFTFGGHVLDFIIDNGTVEIGAIDQLNQSFPVQDRKFLFADLDIEALKKDIDVAE   236
```

No corresponding DNA sequence was identified in *S. pyogenes*.

Based on this analysis, it was predicted that these proteins and their epitopes could be useful antigens for vaccines or diagnostics.

Example 891

A DNA sequence (GBSx0945) was identified in *S. agalactiae* <SEQ ID 2705> which encodes the amino acid sequence <SEQ ID 2706>. This protein is predicted to be fibronectin-binding protein-like protein A. Analysis of this protein sequence reveals the following:

Possible site: 57
>>> Seems to have no N-terminal signal sequence
----- Final Results -----
   bacterial cytoplasm --- Certainty = 0.5042 (Affirmative) <succ>
   bacterial membrane --- Certainty = 0.0000 (Not Clear) <succ>
     bacterial outside --- Certainty = 0.0000 (Not Clear) <succ>

The protein has homology with the following sequences in the GENPEPT database.

```
>GP: CAA46282 GB: X65164 fibronectin-binding protein-like protein A
[Streptococcus gordonii]
Identities = 392/550 (71%), Positives = 462/550 (83%)

Query:    1 MSEDGFFLHHLTNELQEQIEKGRIQKVNQPFDHELVLTIRNNRRNYKLLLSAHPVFGRIQ   60
            MSFDGFFLHH+T EL+ ++   GRIQK+NQPF+ ELVL IR+NR++ KLLLSAH VFGR+Q
Sbjct:    1 MSEDGFFLHHMTEELRHELVGGRIQKINQPFEQELVLQIRSNRKSLKLLLSAHSVFGRVQ   60
```

-continued
```
Query:   61 TTEANFQNPQNPNTFTMIMRKYLQGAVIETIQQIENDRILEIVVSNKNEIGDHIKATLVV 120
            T+  F+NP  PNTF M+MRKYLQGAVIE IQQ+ENDRILEI VSNKNEIGD +  TLV+
Sbjct:   61 LTDTTFENPAVPNIFIMVMRKYLQGAVIEAIQQVENDRILEISVSNKNEIGDSVAVTLVI 120

Query:  121 EIMGKHSNIILIDKNEHKIIESIKHVGESQNSYRTILPGSTYIAPPKTKAINPFDISDQT 180
            EIMGKHSNIIL+DK   KIIE+IKHVGFSQNSYRTILPGSTY+APP+T ++NPF + D+
Sbjct:  121 EIMGKHSNIILLDKASGKIIEAIKHVGFSQNSYRTILPGSTYVAPPQTGSLNPFTVGDEK 180

Query:  181 LFELLQTNDLSPKNLQQLLQGLGRDTALELSHCLKDNKLNDFRQFFSREYYPSLTEKSFS 240
            LFE+LQT ++ PK L Q+ QGLGRDTA ELS  L  ++L  FR  FF+      PSLTEKSFS
Sbjct:  181 LFEILQTEEIEPKRLLQIFQGLGRDTATELSGRLTTDRLKTFRAFFASPTQPSLTEKSFS 240

Query:  241 AVQFSSSHETFQSLGQLLDYYYQEKAEKDRIAQQASDLIHRVQSELEKNIKKLAKQQDEL 300
            A+  FS S      +L  +LLD +Y++KAE+ R+ QQAS+LI RV++ELEKN KKL KQ+DEL
Sbjct:  241 ALVESDSKTQMSTLSELLDTFYKDKAERYRVNQQASELIRRVENELEKNRKKLGKQEDEL 300

Query:  301 LATENAEEFRQKGELLTTYLSMVPNNQDVVVLDNYYTNQTIEISLDRALTPNQNAQRYFK 360
            LATE AEEFRQKGELLTT+L   VPN+QD V LDNYYT + I I+LD+ALTPNQVAQRYFK
Sbjct:  301 LATERAEEFRQKGELLTTFLHQVPNDQDQVELDNYYTGEKILITLDKALTPNQVAQRYFK 360

Query:  361 KYQKLKEAVKHLKGIISDTENTITYLESVETSLNHASMEDINDIREELVETGFIKRRAHD 420
            +YQKLKEAVKHL  +I +T  TI YLESVET+L   AS+ +I +IREEL++TGFI++R  +
Sbjct:  361 RYQKLKEAVKHLTSLIEETRTTILYLESVETALAQASLTEIAEIREELIQTGFIRRRQRE 420

Query:  421 KQHKRKKPEQYLASDGKTIIMVGRNNLQNDELTFKMARKGELWFHAKDIPGSRVLIRDNL 480
            K  KRKKPE+YLASDG+TII+VGRNNLQNDELTFKMA+K ELWFHAKDIPGSHV+I  NL
Sbjct:  421 KIQKRKKPEKYLASDGQTIILVGRNNLQNDELTFKMARKDELWFHAKDIPGSHVVITGNL 480

Query:  481 NPSDEVKTDAAELAAYYSKARLSNLVQVDMIEAKKLNKPSGTKPGFVTYTGQKTLRVTPT 540
              PSDEVKTDAAELAAY+SKARLSNLVQVDMIE KKLNKP+G KPGFVTYTGQKTLRVTP
Sbjct:  481 QPSDEVKTDAAELAAYFSKARLSNLVQVDMIEIKKLNKPTGGKPGFVTYTGQKTLRVTPD 540

Query:  541 QEKIDSLKLK                                                  550
            +KI S+K++
Sbjct:  541 ADKIKSMKIQ                                                  550
```

A related DNA sequence was identified in *S. pyogenes* <SEQ ID 2707> which encodes the amino acid sequence <SEQ ID 2708>. Analysis of this protein sequence reveals the following:

---

Possible site: 38
>>> Seems to have no N-terminal signal sequence
----- Final Results -----
  bacterial cytoplasm --- Certainty = 0.5434 (Affirmative) <succ>
  bacterial membrane --- Certainty = 0.0000 (Not Clear) <succ>
  bacterial outside --- Certainty = 0.0000 (Not Clear) <succ>

---

The protein differs significantly from L28919 in its mid-region:

```
Query:   223 QHFQGLGRDTAKELAELLTTD
             F  L  +T K +  ELLTTD
Sbjct:   121 PAFSRLRGETPKRIGELLTTD
```

An alignment of the GAS and GBS proteins is shown below.

```
Identities = 421/549 (76%), Positives = 487/549 (88%)

Query:    1 MSEDGEFLHHLTNELQEQIEKGRIQKVNQPFDHELVLTIRNNRRNYKLLLSAHPVFGRIQ  60
            MS DGFFLHHLTNEL+E +  GRIQKVNQPF+ ELVLTIRN+R+NYKLLLSAHPVFGR+Q
Sbjct:   27 MSFDGFFLHHLTNELKENLLYGRIQKVNQPFERELVLTIRNHRKNYKLLLSAHPVFGRVQ  86

Query:   61 TTEANFQNPQNPNTFTMIMRKYLQGAVIETIQQIENDRILEIVVSNKNEIGDHIKATLVV 120
            T+A+FQNPQ PNTFTMIMRKYLQGAVIE ++QI+NDRI+EI VSNKNEIGD I+ATL++
Sbjct:   87 ITQADFQNPQVPNTFTMIMRKYLQGAVIEQLEQIDNDRIIEIKVSNKNEIGDAIQATLII 146

Query:  121 EIMGKHSNIILIDKNEHKIIESIKHVGESQNSYRTILPGSTYIAPPKTKAINPFDISDQT 180
            EIMGKHSNIIL+D+ E+KIIESIKHVGFSQNSYRTILPGSTYI PPKT A+NPF I+D
Sbjct:  147 EIMGKHSNIILVDRAENKIIESIKHVGFSQNSYRTILPGSTYIEPPKTAAVNPFTITDVP 206

Query:  181 LFELLQINDLSPKNLQQLLQGLGRDTALELSHCLKDNKLNDFRQFFSREYYPSLTEKSFS 240
            LFE+LQT +L+ K+LQQ  QGLGRDTA EL+   L  +KL  FR+FF+R    +LT  SF+
Sbjct:  207 LFEILQTQELTVKSLQQHFQGLGRDTAKELAELLTTDKLKRFREFFARPTQANLTTASFA 266

Query:  241 AVQFSSSHETFQSLGQLLDYYYQEKAEKDRIAQQASDLIHRVQSELEKNIKKLAKQQDEL 300
             V  FS SH  TF++L   +LD++YQ+KAE+DRI QQASDLIHRVQ+EL+KN  KL+KQ+ EL
```

-continued

```
Sbjct: 267 PVLFSDSHATFETLSDMLDHFYQDKAERDRINQQASDLIHRVQTELDKNRNKLSKQEAEL 326

Query: 301 LATENAEEFRQKGELLTTYLSMVPNNQDVVVLDNYYTNQTIEISLDRALTPNQNAQRYFK 360
           LATENAE FRQKGELLTTYLS+VPNNQD V+LDNYYT + IEI+LD+ALTPNQNAQRYFK
Sbjct: 327 LATENAELFRQKGELLTTYLSLVPNNQDSVILDNYYTGEKIEIALDKALTPNQNAQRYFK 386

Query: 361 KYQKLKEAVKHLKGIISDIENTITYLESVETSLNHASMEDINDIREELVETGFIKRRAHD 420
           KYQKLKEAVKHL G+I+DT+ +ITY ESV+ +L+ AS++DI DIREEL + GF+K R  D
Sbjct: 387 KYQKLKEAVKHLSGLIADTKQSITYFESVDYNLSQASIDDIEDIREELYQAGFLKSRQRD 446

Query: 421 KQHKRKKPEQYLASDGKTIIMVGRNNLQNDELTFKMARKGELWFHAKDIPGSHVLIRDNL 480
           K+HKRKKPEQYLASDG TI+MVGRNNLQN+ELTFKMA+KGELWFHAKDIPGSHV+I+DNL
Sbjct: 447 KRHKRKKPEQYLASDGTTILMVGRNNLQNEELTFKMAKKGELWFHAKDIPGSHVIIKDNL 506

Query: 481 NPSDEVKTDAAELAAYYSKARLSNLVQVDMIEAKKLNKPSGTKPGFVTYTGQKTLRVTPT 540
           +PSDEVKTDAAELAAYYSKARLSNLVQVDMIEAKKL+KPSG KPGFVTYTGQKTLRVTP
Sbjct: 507 DPSDEVKTDAAELAAYYSKARLSNLVQVDMIEAKKLHKPSGAKPGFVTYTGQKTLRVTPD 566

Query: 541 QEKIDSLKL                                                   549
           Q KI S+KL
Sbjct: 567 QAKILSMKL                                                   575
```

Figure 319:
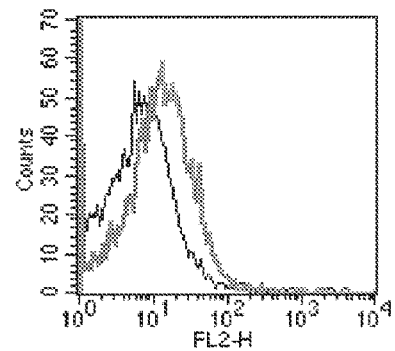

SEQ ID 2706 (GBS81) was expressed in *E. coli* as a His-fusion product. SDS-PAGE analysis of total cell extract is shown in FIG. 6 (lane 2; MW 64 kDa) and in FIG. 6 (lane 5; MW 64 kDa). The GBS81-His fusion product was purified (FIG. 190, lane 3) and used to immunise mice. The resulting antiserum was used for FACS (FIG. 319), which confirmed that the protein is immunoaccessible on GBS bacteria.

Based on this analysis, it was predicted that these proteins and their epitopes could be useful antigens for vaccines or diagnostics.

Example 892

A DNA sequence (GBSx0946) was identified in *S. agalactiae* <SEQ ID 2709> which encodes the amino acid sequence <SEQ ID 2710>. Analysis of this protein sequence reveals the following:

```
Possible site: 53
>>> Seems to have an uncleavable N-term signal seq
INTEGRAL    Likelihood = -9.08    Transmembrane 6-22 (1-24)
----- Final Results -----
   bacterial membrane --- Certainty = 0.4630 (Affirmative) <succ>
   bacterial outside --- Certainty = 0.0000 (Not Clear) <succ>
   bacterial cytoplasm --- Certainty = 0.0000 (Not Clear) <succ>
```

The protein has homology with the following sequences in the GENPEPT database.

```
>GP: AAF94260 GB: AE004191 conserved hypothetical protein [Vibrio cholerae]
Identities = 111/295 (37%), Positives = 184/295 (61%), Gaps = 1/295 (0%)

Query:  36 QVVKIGILQYVTHDALDAIEKGVEDGLAQEGYK-GKKVKLTVLNAEADQSKIQAM-        94
           SKQLV
              +   K+ + Q V H ALDA  +G+ DGL  +GY+ GK ++       A+ + +    +++Q V
Sbjct:  26 KTAKVAVSQIVEHPALDATRQGLLDG-                                   85
           LKAKGYEEGKNLEFDYKTAQGNPAIAVQIARQFV Query:  95 NHHNDILIGIATPSAQGLAASTKDTPI-                                 154
           IMGAVSDPLGAKLVTNMKKPTTNVTGLSNVVPT
              + D+L+GIATP+AQ L  ++TK  PI+  AV+DP+GAKLV   +++P  NVTGLS++ P
Sbjct:  86 GENPDVLVGIATPTAQALVSATKTIPIV-                                145
           FTAVTDPVGAKLVKQLEQPGKNVTGLSDLSPV Query: 155 KQTVQLIKDITPNIKRIGILYASSEDNS-                                214
           VSQVTEPTKYAQKAGLEVLKYSVPSTNEIKTS
              +Q V+LIK+I PN+K IG++Y     E N+VS +       A K G+++++ +   + +++++
Sbjct: 146 EQHVELIKEILPNVKSIGVVYN-                                      205
           PGEANAVSLMELLKLSAAKHGIKLVEATALKSADVQSA Query: 215 MSVMTKKVDAVFVPQDNTIASA-                                      274
           FRTVIVAANQANIPVYSSVDTMVEQGSIASVAQSQYGL
              + +K  D ++    DNT+ASA    +IVAANQA  PV+ +  + VE+G+IAS+    Y +
Sbjct: 206 TQAIAEKSDVIYALIDNTVASAIEG-                                   265
           MIVAANQAKTPVEGAATSYVERGAIASLGEDYYQI Query: 275 GLETAKQAIKVLEGKPVKDVPVKVIDTGKPSLNLKAAKHLGIKIPKKIMKQAEIT       329
              G++TA   +L GK   + V+V          +N   AA+ LGI IP+ ++ +A   T
Sbjct: 266 GVQTADYVAAILEGKEPGSLDVQVAKGSDLVINKTAAEQLGITIPEAVLARATST      320
```

A related DNA sequence was identified in *S. pyogenes* <SEQ ID 2711> which encodes the amino acid sequence <SEQ ID 2712>. Analysis of this protein sequence reveals the following:

Possible site: 23
>>> Seems to have an uncleavable N-term signal seq
INTEGRAL    Likelihood = −11.25    Transmembrane 6-22 (1-27)
----- Final Results -----
    bacterial membrane --- Certainty = 0.5501 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP: AAF94260 GB: AE004191 conserved hypothetical protein [Vibrio cholerae]
Identities = 103/304 (33%), Positives = 178/304 (57%), Gaps = 1/304 (0%)

Query:   17 VIGSLLSKGVSKENRDLANQQNITIGILQFVTHEALDDIKRGIEDQLK-KQMPQKQNVVI   75
            VI + +  G +  +       + + +Q V H ALD  ++G+ D LK K   + +N+
Sbjct:    6 VIATAVLAGAALLSSQSIMAKTAKVAVSQIVEHPALDATRQGLLDGLKAKGYEEGKNLEF  65

Query:   76 KVMMAEGDQSKIQTMSRQLVQSGSDIVIGIATPAAQGLAATSKDIPVVMSAVSDPVGSRL  135
               A+G+ +      ++RQ V    D+++GIATP AQ L + +K  IP+V  +AV+DPVG++L
Sbjct:   66 DYKTAQGNPAIAVQIARQFVGENPDVLVGIATPTAQALVSATKTIPIVFTAVTDPVGAKL 125

Query:  136 VMQLDQPEANVTGLSNKVPVKQTIDLMKKLTPHVKTVGILYASNEDNSLSQVKEFRRLAR  195
            V QL+QP  NVTGLS+   PV+Q ++L+K++ P+VK++G++Y     E N++S ++  +   A
Sbjct:  126 VKQLEQPGKNVTGLSDLSPVEQHVELIKEILPNVKSIGVVYNPGEANAVSLMELLKLSAA 185

Query:  196 KKGYQVISYAVPSTNEVPATMSVMLGKVDAVFIPQDNTIASAFSSVMTTSKAAKIPVYTS  255
            K G +++      + +V +      +  K D ++    DNT+ASA   ++   + AK PV+ +
Sbjct:  186 KHGIKLVEATALKSADVQSATQAIAEKSDVIYALIDNTVASAIEGMIVAANQAKTPVFGA 245

Query:  256 VDRMVEKGGLAAISQNQYDLGVQTANQVLKLIKGKRVVDVPVKVVDIGQPLINKNVAAEL  315
              VE+G +A++  + Y +GVQTA+ V  +++GK    + V+V      +INK  A +L
Sbjct:  246 ATSYVERGAIASLGEDYYQIGVQTADYVAAILEGKEPGSLDVQVAKGSDLVINKTAAEQL 305

Query:  316 GIAI                                                          319
            GI I
Sbjct:  306 GITI                                                          309
```

An alignment of the GAS and GBS proteins is shown below.

Figure 48:
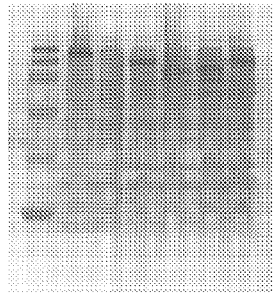

SEQ ID 2710 (GBS254) was expressed in *E. coli* as a His-fusion product. SDS-PAGE analysis of total cell extract is shown in FIG. 43 (lane 4; MW 27 kDa). It was also expressed in *E. coli* as a GST-fusion product. SDS-PAGE analysis of total cell extract is shown in FIG. 48 (lane 3; MW 59.6 kDa).

GBS254-GST was purified as shown in FIG. 203, lane 6.

Based on this analysis, it was predicted that these proteins and their epitopes could be useful antigens for vaccines or diagnostics.

Example 893

A DNA sequence (GBSx0947) was identified in *S. agalactiae* <SEQ ID 2713> which encodes the amino acid sequence <SEQ ID 2714>. This protein is predicted to be probable permease of ABC transporter (rbsC). Analysis of this protein sequence reveals the following:

```
Identities = 181/322 (56%), Positives = 252/322 (78%), Gaps = 1/322 (0%)

Query:    1 MKNKGLIATLILLTILVVGELFYNK-SEKRLNLSEKQVVKIGILQYVTHDALDAIEKGVE   59
            MKNK LIATL++LT++V+G L     S++   +L+  +Q + IGILQ+VTH+ALD I++G+E
Sbjct:    1 MKNKSLIATLLVLTVIVIGSLLSKGVSKENRDLANQQNITIGILQFVTHEALDDIKRGIE   60

Query:   60 DGLAQEGYKGKKVKLTVLNAEADQSKIQAMSKQLVNHHNDILIGIATPSAQGLAASTKDT  119
            D L ++  + + V + V+NAE DQSKIQ MS+QLV    +DI+IGIATP+AQGLAA++KD
Sbjct:   61 DQLKKQMPQKQNVVIKVMNAEGDQSKIQTMSRQLVQSGSDIVIGIATPAAQGLAATSKDI 120

Query:  120 PIIMGAVSDPLGAKLVTNMKKPTTNVTGLSNVVPTKQTVQLIKDITPNIKRIGILYASSE  179
            P++M AVSDP+G++LV  + +P  NVTGLSN VP KQT+ L+K +TP++K +GILYAS+E
Sbjct:  121 PVVMSAVSDPVGSRLVMQLDQPEANVTGLSNKVPVKQTIDLMKKLTPHVKTVGILYASNE 180

Query:  180 DNSVSQVTEFTKYAQKAGLEVLKYSVPSTNEIKTSMSVMTKKVDAVFVPQDNTIASAFRT  239
            DNS+SQV EF + A+K G +V+ Y+VPSTNE+   +MSVM   KVDAVF+PQDNTIASAF +
Sbjct:  181 DNSLSQVKEFRRLARKKGYQVISYAVPSTNEVPATMSVMLGKVDAVFIPQDNTIASAFSS 240

Query:  240 VIVAANQANIPVYSSVDTMVEQGSIASVAQSQYGLGLETAKQAIKVLRGKPVKDVPVKVI  299
            V+   A  A IPVY+SVD MVE+G +A+++Q+QY LG++TA Q +K+++GK V DVPVKV+
Sbjct:  241 VMTTSKAAKIPVYTSVDRMVEKGGLAAISQNQYDLGVQTANQVLKLIKGKRVVDVPVKVV 300

Query:  300 DTGKPSLNLKAAKHLGIKIPKK                                        321
            D G+P +N  A  +LGI I K+
Sbjct:  301 DIGQPLINKNVAAELGIAIKKE                                        322
```

Possible site: 24
>>> Seems to have an uncleavable N-term signal seq
INTEGRAL   Likelihood = −15.12   Transmembrane 127-143 (119-151)
INTEGRAL   Likelihood = −8.81    Transmembrane 206 - 222 (200 - 227)
INTEGRAL   Likelihood = −6.48    Transmembrane 260-276 (258-282)
INTEGRAL   Likelihood = −5.84    Transmembrane 234-250 (231-257)
INTEGRAL   Likelihood = −4.78    Transmembrane 55-71 (54-72)
INTEGRAL   Likelihood = −3.61    Transmembrane 177-193 (176-194)
INTEGRAL   Likelihood = −3.35    Transmembrane 84-100 (83-102)
INTEGRAL   Likelihood = −1.91    Transmembrane 10-26 (10-26)
----- Final Results -----
    bacterial membrane --- Certainty = 0.7050 (Affirmative) <succ>
    bacterial outside --- Certainty = 0.0000 (Not Clear) <succ>
        bacterial cytoplasm --- Certainty = 0.0000 (Not Clear) <succ>

The protein has homology with the following sequences in the GENPEPT database.

```
GP: AAG07224 GB: AE004801 probable permease of ABC transporter
[Pseudomonas aeruginosa]
Identities = 116/288 (40%), Positives = 185/288 (63%), Gaps = 9/288 (3%)

Query:    2 IISSVSQGLLWGILGLGIYLTFRILKFPDMTTEGSFPLGGAVCVTLMNQGVNPILATILG   61
            +   ++   GL++  ++  LG++++FR+L+FPD+T +GSFPLGGAVC TL+  G  +P   AT+
Sbjct:    6 LFGALEIGLIFSLVALGVFISFRLLRFPDLTVDGSFPLGGAVCATLIALGWDPYSATLAA   65

Query:   62 MLSGMLAGFVTGLLYTKGKIPTILAGILVMTSCHSIMLMVMKRANLGLNEIQTLKDFLPF  121
            +G LAG    TGLL    K KI    +LA  IL+M  +  +SI L   K   N+   L       TL     L
Sbjct:   66 TAAGALAGLATGLLNVKLKIMDLLASILMMIALYSINLRIMGKPNVPLIAEPTLFILLQP  125

Query:  122 SNDLNLLVLGLIAILLVISA---LIYFLYTALGQAYIATGDNPDMAKSFGIDTDKMEMLG  178
             + +       L+ + +VI+A       L +F   T+ G A    ATG   NP  MA++   G++T   M  +LG
Sbjct:  126 EWLSDYVFRPLLLVFIVIAAKLLLDWFFITQKGLAIRATGSNPRMARAQGVNTGGMILLG  185

Query:  179 LIVSNGLIALSGALVSQQDGYADVSKGIGVIVIGLASIIIGE-VLYSTGLTLFERLIAIV  237
            + +SN L+AL+GAL +Q    G AD+S GIG IVIGLA++I+GE  +L S     L  L        +A++
Sbjct:  186 MAISNALVALAGALFAQTQGGADISMGIGTIVIGLAAVIVGESILPSRRLIL--ATLAVI  243

Query:  238 VGSILYQFLITAVI---ALGFNTNYLKLFSAIVLGICLMVPVLKTKIL            282
            +G+I+Y+F  I    +   +G        L  L +A+++  +  L++P++K   ++L
Sbjct:  244 LGAIVYRFFIALALNSDFIGLQAQDLNLVTAVLVTVALVIPMMKKRLL            291
```

A related DNA sequence was identified in *S. pyogenes* <SEQ ID 2715> which encodes the amino acid sequence <SEQ ID 2716>. Analysis of this protein sequence reveals the following:

Possible site: 55
>>> Seems to have an uncleavable N-term signal seq
INTEGRAL   Likelihood = −10.46   Transmembrane 131-147 (125-156)
INTEGRAL   Likelihood = −8.65    Transmembrane 210-226 (204-230)
INTEGRAL   Likelihood = −8.17    Transmembrane 265-281 (261-283)
INTEGRAL   Likelihood = −7.22    Transmembrane 238-254 (233-261)
INTEGRAL   Likelihood = −3.03    Transmembrane 89-105 (87-107)
INTEGRAL   Likelihood = −2.60    Transmembrane 63-79 (62-79)
INTEGRAL   Likelihood = −2.23    Transmembrane 180-196 (180-198)
INTEGRAL   Likelihood = −2.13    Transmembrane 14-30 (14-30)
----- Final Results -----
    bacterial membrane --- Certainty = 0.5182 (Affirmative) <succ>
    bacterial outside --- Certainty = 0.0000 (Not Clear) <succ>
        bacterial cytoplasm --- Certainty = 0.0000 (Not Clear) <succ>

The protein has homology with the following sequences in the databases:

```
>GP: AAG07224 GB: AE004801 probable permease of ABC transporter
[Pseudomonas aeruginosa]
Identities = 118/285 (41%), Positives = 186/285 (64%), Gaps = 7/285 (2%)

Query:    6 IISSVSQGLIWGVLGLGIYLTFRILNFPDMITEGSFPLGGAVAVTAISLGWNPFLSTLLG   65
            +   ++   GLI+  ++  LG++++FR+L  FPD+T +GSFPLGGAV   T I+LGW+P+   +TL
Sbjct:    6 LFGALEIGLIFSLVALGVFISFRLLRFPDLTVDGSFPLGGAVCATLIALGWDPYSATLAA   65

Query:   66 MLSGALAGFLTGLLYTKGKMPTLLAGILVMTSCNSIMLMVGRANLGLHDKRIQDCLPF   125
            +GALAG    TGLL    K K+    LLA  IL+M +   SI L  +MG+  N+   L      +     L
Sbjct:   66 TAAGALAGLATGLLNVKLKIMDLLASILMMIALYSINLRIMGKPNVPLIAEPTLFILLQP  125
```

-continued

```
Query: 126 SIDLNSLLTGLITVVIVIS---VLIYFLYTNLGQAYIATGDNKDMAKSFGINTDWMEVMG 182
            + +    L+ V IVI+    +L +F  T  G A  ATG N  MA++ G+NT  M ++G
Sbjct: 126 EWLSDYVFRPLLLVFIVIAAKLLLDWFFITQKGLAIRATGSNPRMARAQGVNIGGMILLG 185

Query: 183 LVVSNSLIALSGALVSQQDGYADVSKGIGVIVIGLASIIVGEVLYSTGLTLLERLIAIVI 242
            + +SN+L+AL+GAL +Q  G AD+S GIG IVIGLA++IVGE +   +   +L  L A+++
Sbjct: 186 MAISNALVALAGALFAQTQGGADISMGIGTIVIGLAAVIVGESILPSRRLILATL-AVIL 244

Query: 243 GSILYQFLISVVIT---LGFNISYLKLISALVLALCLMIPVVKER          284
            G+I+Y+F I++ +    +G    L L++A+++ + L+IP++K+R
Sbjct: 245 GAIVYRFFIALALNSDFIGLQAQDLNLVTAVLVTVALVIPMMKKR          289
```

An alignment of the GAS and GBS proteins is shown below.

```
Identities = 227/287 (79%), Positives = 259/287 (90%)

Query:   1 MIISSVSQGLLWGILGLGIYLTFRILKFPDMTTEGSFPLGGAVCVTLMNQGVNPILATIL  60
           MIISSVSQGL+WG+LGLGIYLTFRIL FPDMTTEGSFPLGGAV VT ++ G NP L+T+L
Sbjct:   5 MIISSVSQGLIWGVLGLGIYLTFRILNFPDMTTEGSFPLGGAVAVTAISLGWNPFLSTLL  64

Query:  61 GMLSGMLAGFVTGLLYTKGKIPTILAGILVMTSCHSIMLMVMKRANLGLNEIQTLKDFLP 120
           GMLSG LAGF+TGLLYTKGK+PT+LAGILVMTSC+SIMLMVM RANLGL++ + ++D LP
Sbjct:  65 GMLSGALAGFLTGLLYTKGKMPTLLAGILVMTSCNSIMLMVMGRANLGLHDHKRIQDCLP 124

Query: 121 FSNDLNLLVLGLIAILLVISALIYFLYTRLGQAYIATGDNPDMAKSFGIDTDKMEMLGLI 180
           FS DLN L+ GLI +++VIS LIYFLYT LGQAYIATGDN DMAKSFGI+TD ME++GL+
Sbjct: 125 FSIDLNSLLTGLITVVIVISVLIYFLYTNLGQAYIATGDNKDMAKSFGINTDWMEVMGLV 184

Query: 181 VSNGLIALSGALVSQQDGYADVSKGIGVIVIGLASIIIGEVLYSTGLTLFERLIAIVVGS 240
           VSN LIALSGALVSQQDGYADVSKGIGVIVIGLASII+GEVLYSTGLTL ERLIAIV+GS
Sbjct: 185 VSNSLIALSGALVSQQDGYADVSKGIGVIVIGLASIIVGEVLYSTGLTLLERLIAIVIGS 244

Query: 241 ILYQFLITAVIALGFNTNYLKLFSAIVLGICLMVPVLKTKILKGVRL              287
           ILYQFLI+ VI LGFNT+YLKL SA+VL +CLM+PV+K +  KGVRL
Sbjct: 245 ILYQFLISVVITLGFNTSYLKLISALVLALCLMIPVVEERFFKGVRL              291
```

A related GBS gene <SEQ ID 8681> and protein <SEQ ID 8682> were also identified. Analysis of this protein sequence reveals the following:

Lipop: Possible site: −1 Crend: 0
McG: Discrim Score: 4.24
GvH: Signal Score (−7.5): −6.43
Possible site: 24
>>> Seems to have an uncleavable N-term signal seq
ALOM program   count: 8 value: −15.12 threshold: 0.0
INTEGRAL    Likelihood = −15.12   Transmembrane 127-143 (119-151)
INTEGRAL    Likelihood = −7.54    Transmembrane 206-222 (201-225)
INTEGRAL    Likelihood = −6.48    Transmembrane 260-276 (258-282)
INTEGRAL    Likelihood = −5.84    Transmembrane 234-250 (231-257)
INTEGRAL    Likelihood = −4.78    Transmembrane 55-71 (54-72)
INTEGRAL    Likelihood = −3.61    Transmembrane 177-193 (176-194)

-continued

INTEGRAL    Likelihood = −3.35    Transmembrane 84-100 (83-102)
INTEGRAL    Likelihood = −1.91    Transmembrane 10-26 (10-26)
PERIPHERAL  Likelihood = 4.77     36
modified ALOM score: 3.52
*** Reasoning Step: 3
----- Final Results -----
    bacterial membrane --- Certainty = 0.7050 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
ORF00338(298-1146 of 1461)
GP|9950013|gb|AAG07224.1|AE004801_2|AE004801(4-291 of 296) probable permease of ABC
transporter {Pseudomonas aeruginosa}
% Match = 20.2
% Identity = 40.8 % Similarity = 68.3
Matches = 116 Mismatches = 84 Conservative Sub.s = 78

126       156       186       216       246       276       306       336
          YGLGLETAKQAIKVLRGKPVKDVPVKVIDTGKPSLNLKAAKHLGIKIPKKIMKQAEITVKVDD*KEGFMIISSVSQGLLW
                                                                         |  :   ::   ||::
                                                                         MSLFSLFGALEIGLIF
                                                                         10
```

-continued

```
366       396       426       456       486       516       546       576
GILGLGIYLTFRILKFPDMTTEGSFPLGGAVCVTLMNQGVNPILATILGMLSGMLAGFVTGLLYTKGKIPTILAGILVMT
 ::  ||::::||:|:|||:| :||||||||||  ||:    | :|   ||:      :| |||: ||||   | ||   :|| ||:|
SLVALGVFISFRLLRFPDLTVDGSFPLGGAVCATLIALGWDPYSATLAATAAGALAGLATGLLNVKLKIMDLLASILMMI
            30        40        50        60        70        80        90

606       636                 690       720       747       777       807
SCHSIMLMVMKRANLGLNEIQTLKDFL-P-FSNDLNLLVLGLIAILLVISALI-YFLYTRLGQAYIATGDNPDMAKSFGI
:  :|| | :| : |: |      ||   :| |  : :|   :   | |: |::      |: :|: |: | |   ||| || ||:: |:
ALYSINLRIMGKPNVPLIAEPTLFTLLQPEWLSDYVFRPLLLVFIVIAAKLLLDWFFTTQKGLAIRATGSNPRMARAQGV
           110       120       130       140       150       160       170

837       867       897       927       957       987      1017      1047
DTDKMEMLGLIVSNGLIALSGALVSQQDGYADVSKGIGVIXIGLASIIIGEVLYSTGLTLFERLIAIVVGSILYQFLITA
:|   | :||: :|| |:||:||| :|   | ||:| ||| | ||||::|:|| :   :    ::  | |:::|:|:|:|:|
NTGGMILLGMAISNALVALAGALFAQTQGGADISMGIGTIVIGLAAVIVGESILPSRRLILATL-AVILGAIVYRFFI--
           190       200       210       220       230       240        250

1077      1086      1116      1146      1176      1206      1236      1266
VIALGFNTNY-------LKLFSAIVLGICLMVPVLKTKILKGVRL*W**KS*S*KKQPYKSVMV*QK*KRY*IMLI*VFM
  ||  :|:::        | |  :|::: :  |::|::| ::|
--ALALNSDFIGLQAQDLNLVTAVLVTVALVIPMMKKRLLGKKGA
                  270       280       290
```

Based on this analysis, it was predicted that these proteins and their epitopes could be useful antigens for vaccines or diagnostics.

Example 894

A DNA sequence (GBSx0948) was identified in *S. agalactiae* <SEQ ID 2717> which encodes the amino acid sequence <SEQ ID 2718>. This protein is predicted to be ABC transporter (potA). Analysis of this protein sequence reveals the following:

```
Possible site: 36
>>> Seems to have an uncleavable N-term signal seq
----- Final Results -----
  bacterial membrane --- Certainty = 0.0000 (Not Clear) <succ>
    bacterial outside --- Certainty = 0.0000 (Not Clear) <succ>
      bacterial cytoplasm --- Certainty = 0.0000 (Not Clear) <succ>
```

A related GBS nucleic acid sequence <SEQ ID 9887> which encodes amino acid sequence <SEQ ID 9888> was also identified.

The protein has homology with the following sequences in the GENPEPT database.

```
>GP: AAF86640 GB: AF162694 ABC transporter [Enterococcus gallinarum]
Identities = 117/252 (46%), Positives = 167/252 (65%)

Query:  19 MVMKIIELKEATVQVSNGLAEMKTILDH-                                    78
        VNLSIYEHDFITILGGNGAGKSTLFNVIAGTL
         M   ++ + +       G      +L  ++L++   DFITI+GGNGAGK-
        STL N IAGT+
Sbjct:   1 MTTPVLTISDLHQTFEKGTINENHVLR-                                    60
        GIDLTMNSGDFITIIGGNGAGKSTLLNSIAGTI Query:  79 MLSSGNIYIMGQDVTNL-                                              138
        SAEKRAKYLSRVFQDPKMGTAPRMTVAENLLVAKFRGEKRPLV
             G I +   +++T   S   +R+K +SRVFQDP+MGTA R+TV ENL +A   RG+ R
Sbjct:  61 PTEQGKIVLGDKEITRHSVTRRSKEIS-                                    120
        RVFQDPRMGTAVRLTVEENLALAYKRGQVRGFS Query: 139 PRKIINYTEEFQKLIART-                                             198
        GNGLDRHLETPTGLLSGGQRQALSLLMATLKKPNLLLLDEHT
             +    F++ +AR   GL+   L T   GLLSGGQRQA++LLMATL++P L+LL-
        DEHT
Sbjct: 121 SGVKGKHRAFFKEKLARLNLGLENRLT-                                    180
        TEIGLLSGGQRQAITLLMATLQQPKLILLDEHT Query: 199 AALDPRTSVSLMGLTDEFIKQDSL-                                       258
        TALMITHHMEDALKYGNRVLVMKDGKIVRDLNQAQK
         AALDP+TS+++M LTD+ I++   LTA M+TH MEDA++YGNR++++   GKIV D+   +K
Sbjct: 181 AALDPKTSMTVMALTDQLIQEQQLTAFM-                                   240
        VTHDMEDAIRYGNRLIMLHQGKIVVDITGEEK Query: 259 NKMAIADYYQLF                                                    270
             + + D   LF
Sbjct: 241 QSLTVPDLMALF                                                    252
```

A related DNA sequence was identified in *S. pyogenes* <SEQ ID 2719> which encodes the amino acid sequence <SEQ ID 2720>. Analysis of this protein sequence reveals the following:

Possible site: 58
>>> Seems to have no N-terminal signal sequence
----- Final Results -----
  bacterial cytoplasm --- Certainty = 0.2249 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 186/250 (74%), Positives = 210/250 (83%)

Query:   22 KIIELKEATVQVSNGLAEMKTILDHVNLSIYEHDFITILGGNGAGKSTLFNVIAGTLMLS  81
            KIIEL  ATV V NG  + KTILD+V L+IYEHDF+TILGGNGAGKSTLFNVIAGTL L+
Sbjct:    3 KIIELINATVDVDNGFEDAKTILDNVTLTIYEHDFLTILGGNGAGKSTLFNVIAGTLSLT  62

Query:   82 SGNIYIMGQDVTNLSAEKRAKYLSRVFQDPKMGTAPRMTVAENLLVAKFRGEKRPLVPRK 141
               G I I+GQDVT+  AEKRA YLSRVFQD KMGTAPRMTVAENLL+A+ RG KR L  RK
Sbjct:   63 RGQIRILGQDVTHWPAEKRALYLSRVFQDSKMGTAPRMTVAENLLIARQRGGKRSLASRK 122

Query:  142 IINYTEEFQKLIARTGNGLDRHLETPTGLLSGGQRQALSLLMATLKKPNLLLLDEHTAAL 201
            I  +   F+ L+ RTGNGL++HLETP GLLSGGQRQALSLLMATLKKP LLLLDEHTAAL
Sbjct:  123 ITEHLASFEDLVKRTGNGLEKHLETPAGLLSGGQRQALSLLMATLKKPALLLLDEHTAAL 182

Query:  202 DPRTSVSLMGLTDEFIKQDSLTALMITHHMEDALKYGNRVLVMKDGKIVRDLNQAQKNKM 261
            DP+TS SLM LTDEF+ +D LTALMITHHMEDAL YGNR++VMKDG I++DLNQ +K ++
Sbjct:  183 DPKTSQSLMQLTDEFVTKDGLTALMITHHMEDALTYGNRLIVMKDGNIIKDLNQMEKEQL 242

Query:  262 AIADYYQLFD                                                   271
              I DYYQLFD
Sbjct:  243 TITDYYQLFD                                                   252
```

Based on this analysis, it was predicted that these proteins and their epitopes could be useful antigens for vaccines or diagnostics.

Example 895

A DNA sequence (GBSx0949) was identified in *S. agalactiae* <SEQ ID 2721> which encodes the amino acid sequence <SEQ ID 2722>. Analysis of this protein sequence reveals the following:

Possible site: 33
>>> Seems to have no N-terminal signal sequence
----- Final Results -----
  bacterial cytoplasm --- Certainty = 0.1930 (Affirmative) <succ>
    bacterial membrane --- Certainty = 0.0000 (Not Clear) <succ>
      bacterial outside --- Certainty = 0.0000 (Not Clear) <succ>
RGD motif: 415-417

The protein has homology with the following sequences in the GENPEPT database.

```
>GP: BAB06117 GB: AP001515 unknown conserved protein [Bacillus halodurans]
Identities = 236/549 (42%), Positives = 362/549 (64%), Gaps = 2/549 (0%)

Query:    4 IKIMALGGVRENGKNLYVVEVNDSIFVLDAGLKYPENEQLGVDVVIPNLDYLIENKKRVQ  63
            I++ ALGGV E GKN+YVVEV+D +FV+DAGL +P++E LGVDVVIP++ YL+EN++EV+
Sbjct:    9 IRVFALGGVGEIGKNMYVVEVDDDLFVIDAGLMFPDDEMLGVDVVIPDISYLVENEERVR  68
```

```
-continued
Query:   64 GIFLTHGHADAIGALPYIIAEVKAPVFGSPLTIELAKLFVKNSTAVKKFNNFHVIDSETE 123
             I LTHGH D IG LPY++ ++  PV+G+ LT+ L +  +K +  ++        +IDS +
Sbjct:   69 AILLTHGHEDHIGGLPYVLQKLNVPVYGTKLTLGLVEEKLKEAGLIRSAK-LKLIDSNSR 127

Query:  124 IEFQDAVISFFKTTHSIPESMGIVIGTKEGNIVYTGDFKFDQAARKYYQTDLARLAEIGR 183
             ++      +SFF+T HSIP+S+GI I T +G IV+TGDFKFDQ     Q ++ ++A IG
Sbjct:  128 LKLGSTPVSFFRTNHSIPDSVGICIQTSQGFIVHTGDFKFDQTPVDGKQAEIGKMAAIGH 187

Query:  184 DGVLALLSDSANATSNEQVASEYEVGDEIKSVIEDAEGRVIVAAVASNLIRIQQVFDAAA 243
              GVL LLSDS NA       SE EVG  I   E  +GR+IV   ASN+ R+QQV  AA
Sbjct:  188 KGVLCLLSDSTNAERPGMTKSETEVGRGIAEAFEQTKGRIIVTTFASNVHRVQQVIHAAI 247

Query:  244 ENGRRVVLTGFDIENIVRTAIRMKRIHIADENMIIKPKDMTRYEDNELLILETGRMGEPI 303
                R++ + G  +   +V  A R+   +  D+ + I  +++++Y+D  + I+ TG  GEP+
Sbjct:  248 ATNRKLAVAGRSMVKVVSIAERLGYLEAPDD-LFIDIEEVSKYDDERVAIITTGSQGEPM 306

Query:  304 NGLQKMAIGRHRYVQIKDGDLVFIVTTPSIAKEAVVARVENLIYKAGGSVKLITQNLRVS 363
              + L +MA G HR + I + D V I  TP    E  V+ + +L+++ G   V   + S
Sbjct:  307 SALSRMAKGAHRQITITENDTVIIAATPIPGNERSVSTIVDLLHRIGADVIFGHGKVHAS 366

Query:  364 GHANGRELQLLMNLLKPKYLFPIQGEYRDLSAHAGLAQEVGMSADDIYIVERGDIMVLEK 423
              GH + EL+L++NL++PK+  PI GE+R    AH  LA+ VG+  + I++V +G++ +K
Sbjct:  367 GHGSAEELKLMLNLMRPKFFVPIHGEFRMQHAHKELAKSVGIREEAIFLVDKGEVVEFRN 426

Query:  424 DGFFHSGSVPAGDVMIDGNAIGDVGNIVLRDRKVLSEDGIFIVVITVSKKEKKIISKARV 483
                  +G VP+G+V+IDG  +GDVGNIVLRDR++LS+DGI +VV+T++K+      I+S   +
Sbjct:  427 GQGRKAGKVPSGNVLIDGLGVGDVGNIVLRDRRLLSKDGILVVVVTLNKQSGTILSGPNI 486

Query:  484 NTRGFVYVKKSRDILRESAELVNTTVEDYLSKDTFDWGELKGKVRDEVSKFLFDQTKRRP 543
                +RGFVYV++S  ++ E+ ELV  T++  ++++   +W  LK  VR+ +S+FLF++TKRRP
Sbjct:  487 ISRGFVYVRESEKLIEEANELVTETLKKCVTENVNEWSSLKSNVREVLSRFLFEKTKRRP 546

Query:  544 AILPVVMEV                                                   552
             ILP++MEV
Sbjct:  547 MILPIIMEV                                                   555
```

A related DNA sequence was identified in *S. pyogenes* <SEQ ID 2723> which encodes the amino acid sequence <SEQ ID 2724>. Analysis of this protein sequence reveals the following:

Possible site: 33

>>> Seems to have no N-terminal signal sequence

----- Final Results ----- bacterial cytoplasm --- Certainty = 0.2204 (Affirmative) <succ> bacterial membrane --- Certainty = 0.0000 (Not Clear) <succ> bacterial outside --- Certainty = 0.0000 (Not Clear) <succ>

The protein has homology with the following sequences in the databases:

```
>GP: BAB06117 GB: AP001515 unknown conserved protein [Bacillus halodurans]
Identities = 232/549 (42%), Positives = 360/549 (65%), Gaps = 2/549 (0%)

Query:    4 IKMIALGGVREYGKNFYLVEINDSMFILDAGLKYPENEQLGVDLVIPNLDYVIENKQKVQ  63
             I++ ALGGV E GKN Y+VE++D +F++DAGL +P++E LGVD+VIP++ Y++EN+ +V+
Sbjct:    9 IRVFALGGVGEIGKNMYVVEVDDDLFVIDAGLMFPDDEMLGVDVVIPDISYLVENEERVR  68

Query:   64 GIFLSHGHADAIGALPYLLAEVSAPVFGSELTIELAKLFVKSNNSTKKFNNFHVVDSDTE 123
             I L+HGH D IG LPY+L +++   PV+G++LT+ L +  +K +      ++DS++
Sbjct:   69 AILLTHGHEDHIGGLPYVLQKLNVPVYGTKLTLGLVEEKLKEAGLIRSAK-LKLIDSNSR 127

Query:  124 IEFKDGLVSFFRTTHSIPESMGIVIGTDKGNIIYTGDFKFDQAAREGYQTDLLRLAEIGK 183
             ++     VSFFRT HSIP+S+GI I T +G I++TGDFKFDQ  +G Q ++ ++A IG
Sbjct:  128 LKLGSTPVSFFRTNHSIPDSVGICIQTSQGFIVHTGDFKFDQTPVDGKQAEIGKMAAIGH 187
```

```
-continued

Query: 184 EGVLALLSDSVNATSNDQIASESEVGEEMDSVISDADGRVIVAAVASNLVRIQQVFDSAT 243
            +GVL LLSDS NA      SE+EVG +       GR+IV  ASN+ R+QQV  +A
Sbjct: 188 KGVLCLLSDSTNAERPGMTKSETEVGRGIAEAFEQTKGRIIVTTFASNVHRVQQVIHAAI 247

Query: 244 AHGRRVVLTGTDAENIVRTALRLEKLMITDERLLIKPKDMSKFEDHELIILEAGRMGEPI 303
            A  R++ + G      +V  ARL  L   D+ L I  +++SK++D  + I+  G GEG+
Sbjct: 248 ATNRKLAVAGRSMVKVVSIAERLGYLEAPDD-LFIDIEEVSKYDDERVAIITTGSQGEPM 306

Query: 304 NSLQKMAAGRHRYVQIKEGDLVYIVTTPSTAKEAMVARVENLIYKAGGSVKLITQNLRVS 363
            ++L +MA GHR + I E D V I  TP    E V+ + +L+++ G V     + S
Sbjct: 307 SALSRMAKGAHRQITITENDTVIIAATPIPGNERSVSTIVDLLHRIGADVIFGHGKVHAS 366

Query: 364 GHANGRDLQLLMNLLKPQYLFPVQGEYRDLAAHAKLAEEVGIFPENIHILKRGDIMVLND 423
            GH +   +L+L++NL++P++   P+ GE+R   AH +LA+ VGI  E I  ++ +G+++    +
Sbjct: 367 GHGSAEELKLMLNLMRPKFFVPIHGEFRMQHAHKELAKSVGIREEAIFLVDKGEVVEFRN 426

Query: 424 EGFLHEGGVPASDVMIDGNAIGDVGNIVLRDRKVLSEDGIFIVAITVSKKEKRIISKAKV 483
                   G VP+  +V+IDG  +GDVGNIVLRDR++LS+DGI +V  +T+++K+   I+S  +
Sbjct: 427 GQGRKAGKVPSGNVLIDGLGVGDVGNIVLRDRRLLSKDGILVVVVTLNKQSGTILSGPNI 486

Query: 484 NTRGFVYVKKSHDILRESAELVNTTVGNYLKKDTFDWGELKGNVRDDLSKFLFEQTKRRP 543
            +RGFVYV++S  ++ E+ ELV  T+   + ++  +W   LK NVR+ LS+FLFE+TKRRP
Sbjct: 487 ISRGFVYVRESEKLIEEANELVTETLKKCVTENVNEWSSLKSNVREVLSRFLFEKTKRRP 546

Query: 544 AILPVVMEV                                                    552
            ILP++MEV
Sbjct: 547 MILPIIMEV                                                    555
```

An alignment of the GAS and GBS proteins is shown below.

```
Identities = 446/553 (80%), Positives = 513/553 (92%)

Query:   1 MSDIKIMALGGVRENGKNLYVVEVND-                                  60
             SIFVLDAGLKYPENEQLGVDVVIPNLDYLIENKK
             M+DIK++ALGGVRE GKN Y+VE+NDS+F+LDAGLKYPENEQLGVD+VIPNLDY+IENK
Sbjct:   1 MTDIKMIALGGVREYGKNFYLVEINDSM-                                60
             FILDAGLKYPENEQLGVDLVIPNLDYVIENKG Query:  61 RVQGIFLTHGHADAIGALPYIIAE-                                   120
             VKAPVFGSPLTIELAKLFVKNSTAVKKFNNFHVIDS
             +VQGIFL+HGHADAIGALPY++AEV APVFGS LTIELAKLFVK++ + KKFNNFHV+
             DS
Sbjct:  61 KVQGIFLSHGEADAIGALPYLLAE-                                   120
             VSAPVEGSELTIELAKLFVKSNNSTKKENNFHVVDS Query: 121 ETEIEFQDAVISFFKTTTHSIPESM-                                  180
             GIVIGTKEGNIVYTGDFKFDQAARKYYQTDLARLAE
             +TEIEF+D ++SFF+TTHSIPESMGIVIGT +GNI+YTGDFKFDQAAR+ YQTDL T-
             LAE
Sbjct: 121 DTEIEFKDGLVSFFRTTHSIPESM-                                   180
             GIVIGTDKGNIIYTGDFKFDQAAREGYQTDLLRLAE Query: 181 IGRDGVLALLSDSANAISNEQVA-                                    240
             SEYEVGDEIKSVIEDAEGRVIVAAVASNLIRIQQVFD
             IG++GVLALLSDS NATSN+Q+ASE EVG+E+ SVI DA+GRVIVAAVASNL+
             RIQQVFD
Sbjct: 181 IGKEGVLALLSDSVNATSNDQIASESEV-                               240
             GEEMDSVISDADGRVIVAAVASNLVRIQQVFD Query: 241 AAAENGRRVVLTGEDIENIVR-                                      300
             TAIRMKRIEIADENMIIKPKDMTRYEDNELLILETGRMG
             +A  +GRRVVLTG D ENIVRTA+R++++ I DE ++IKPKDM+++ED EL+ILE GRMG
Sbjct: 241 SATAHGRRVVLTGIDAENIVRTALRLEK-                               300
             LMITDERLLIKPKDMSKFEDHELIILEAGRMG Query: 301 EPINGLQKMAIGRHRYV-                                          360
             QIKDGDLVFIVTTPSIAKEAVVARVENLIYKAGGSVKLITQNL
             EPIN LQKMA GRHRYVQIK+GDLV+IVTTPS AKEA+VARVENLIYKAGGSVKL-
             ITQNL
Sbjct: 301 EPINSLQKMAAGRHRYVQIKEG-                                     360
             DLVYIVTTPSTAKEAMVARVENLIYKAGGSVKLITQNL Query: 361 RVSGHANGRELQLLMNLLKPKYLF-                                   420
             PIQGEYRDLSAHAGLAQEVGMSADDIYIVERGDIMV
             RVSGHANGR+LQLLMNLLKP+YLFP+QGEYRDL+AHA LA+EVG+  ++I+I+
             KRGDIMV
Sbjct: 361 RVSGHANGRDLQLLMNLLKPQYLF-                                   420
             PVQGEYRDLAAHAKLAEEVGIFPENIHILKRGDIMV
```

```
Query:  421 LEKDGFFHSGSVPAGDVMIDGNAIGD-                                  480
            VGNIVLRDRKVLSEDGIFIVVITVSKKEKKIISK
            L  +GF H G VPA DVMIDGNAIGDVGNIVLRDRKVLSEDGIFIV ITVSKKEK+
            IISK
Sbjct:  421 LNDEGFLHEGGVPASDVMIDGNAIGD-                                  480
            VGNIVLRDRKVLSEDGIFIVAITVSKKEKRIISK Query:  481 ARVNTRGFVYVKKSRDILRESAELVNT-                                 540
            TVEDYLSKDTEDWGELKGKVRDEVSKFLFDQTK
            A+VNTRGFVYVKKS DILRESAELVNTTV +YL KDTFDWGELKG VRD++SKFLE+
            QTK
Sbjct:  481 AKVNTRGFVYVKKSHDILRESAELVNT-                                 540
            TVGNYLKEDTEDWGELKGNVRDDLSKFLFEQTK Query:  541 RRPAILPVVMEVR                                                553
            RRPAILPVVMEVR
Sbjct:  541 RRPAILPVVMEVR                                                553
```

There is also homology to SEQ ID 4910.

SEQ ID 2722 (GBS295) was expressed in *E. coli* as a GST-fusion product. SDS-PAGE analysis of total cell extract is shown in FIG. 48 (lane 2; MW 89.4 kDa). It was also expressed in *E. coli* as a His-fusion product. SDS-PAGE analysis of total cell extract is shown in FIG. 167 (lane 9 & 11; MW 79 kDa—thioredoxin fusion) and in FIG. 238 (lane 3; MW 79 kDa—thioredoxin fusion).

Purified Thio-GBS295-His is shown in FIG. 244, lane 3.

Based on this analysis, it was predicted that these proteins and their epitopes could be useful antigens for vaccines or diagnostics.

Example 896

A DNA sequence (GBSx0950) was identified in *S. agalactiae* <SEQ ID 2725> which encodes the amino acid sequence <SEQ ID 2726>. This protein is predicted to be tributyrin esterase. Analysis of this protein sequence reveals the following:

---
Possible site: 22
>>> Seems to have a cleavable N-term signal seq.
----- Final Results -----
 bacterial outside --- Certainty = 0.3000 (Affirmative) <succ>
  bacterial membrane --- Certainty = 0.0000 (Not Clear) <succ>
   bacterial cytoplasm --- Certainty = 0.0000 (Not Clear) <succ>

---

A related GBS nucleic acid sequence <SEQ ID 9885> which encodes amino acid sequence <SEQ ID 9886> was also identified.

The protein has homology with the following sequences in the GENPEPT database.

```
>GP: AAF62859 GB: AF157484 tributyrin esterase [Lactococcus lactis
subsp. lactis]
Identities = 154/262 (58%), Positives = 188/262 (70%), Gaps = 4/262 (1%)

Query:   21 MAFFNIEYHSKVLGTERQVNVIYP-                                     80
            DAFEMSDDKIDDCDIPVLYLLHGMGGNENSWQKRTN
            MA  NIEY+S+VLG  R+VNVIYP++ ++ D        DIPVLYLLHGM GNENSW  R+
Sbjct:    1 MAVINIEYYSEVLGMNRKVNVIYPESSKVED--FTQTDIPVLYLLHGMSGNENSWI-     58
            IRSG Query:   81 IERLLRHTNLIVVMPSTDLAWYTNT-                                   140
            KYGLDYFDAIAIELPKVLKRFFPNMSDKREKNFIA
            IERL+RHTNL +VMPSTDL +Y NT  YG++YFDAIA ELPKV+  FFPN+S KREKN-
            FIA
Sbjct:   59 IERLIRHTNLAIVMPSTDLGFYVNTTYG-                                118
            MNYFDAIAHELPKVINNFFPNLSTKREKNFIA Query:  141 GLSMGGYGAYKIALLTNRFSHAASLS-                                  200
            GALSFDFDLLENNGNNNINYWSGIFGDLNNTDNI
            GLSMGGYGAY++AL T+ FS+AASLSG L+FD   +  N   N  YW GIFG+
Sbjct:  119 GLSMGGYGAYRLALGTDYFSYAASLSGVLTFDG--MEENFKENPAYWGGIFGNWET-    176
            FKGS Query:  201 ERHSLRRYVESFDMKTKFYAWCGYED-                                  260
            FLFEANEVAIDELRQLGLTIDYFNDHGKHEWYYW
            +    L       + K K YAWCG +DFLF  NE A  EL++LG  I Y +  G HEW-
            YYW
Sbjct:  177 DNEILSLADRKQENKPKLYAWCGKQD-                                  236
            FLFPGNEYATAELKKLGFDITYESSDGVHEWYYW Query:  261 NQQLEKVLEWLPVDYVKEERLS                                       282
            Q++E VL+WLP++Y +EERLS
Sbjct:  237 TQKIESVLKWLPINYKQEERLS                                       258
```

A related DNA sequence was identified in *S. pyogenes* <SEQ ID 2727> which encodes the amino acid sequence <SEQ ID 2728>. Analysis of this protein sequence reveals the following:

Possible site: 14
>>> Seems to have no N-terminal signal sequence
----- Final Results -----
  bacterial cytoplasm --- Certainty = 0.2183 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 172/262 (65%), Positives = 199/262 (75%), Gaps = 1/262 (0%)

Query:   21 MAFFNIEYHSKVLGTERQVNVIYP-                              80
            DAFEMSDDKIDDCDIPVLYLLHGMGGNENSWQKRTN
            MA   IEYHS VLG ER+VNVIYPD  E+        D DIPVLYLLHGMGGNENSWQKRT
Sbjct:    1 MASIAIEYHSVVLGMERKVNVIYP-                              60
            DQSEIPKKDQGDKDIPVLYLLHGMGGNENSWQKRTA Query:   81 IERLLRHTNLIVVMPSTDLAWYTNT-                            140
            KYGLDYFDAIAIELPKVLKRFFPNMSDKREKNFIA
            IERLLRHTNLIVVMPSTDL WYT+T YGL+Y+ A++  ELP+VL   FFPNM+
            KREK F+A
Sbjct:   61 IERLLRHTNLIVVMPSTDLGWYTD-                             120
            TAYGLNYYRALSQELPQVLAAFFPNMTQKREKTFVA Query:  141 GLSMGGYGAYKIALLTNRFSHAASLS-                           200
            GALSFDFDLLFNNGNNNINYWSGIFGDLNNTDNI
            GLSMGGYGA+K AL +NRFS+AAS SGAL F  + L       + YW G+FG  ++
            D +
Sbjct:  121 GLSMGGYGAFKWALKSNRFSYAASFS-                           179
            GALDFSPETLLEGKLGELAYWQGVFGQFDDPD-L Query:  201 ERHSLRRYVESFDMKTKFYAWCGYED-                           260
            FLFEANEVAIDELRQLGLTIDYFNDHGKHEWYYW
            ++H L+  V   D KTKFYAWCGYEDFLF  NE AI + +   GL IDY    HGKHEW-
            YYW
Sbjct:  180 DKHYLKNMVAESDGKTKFYAWCGYED-                           239
            FLFATNEKAIADFQAQGLDIDYHKGHGKHEWYYW Query:  261 NQQLEKVLEWLPVDYVKEERLS                                282
            NQQLE +LEWLP++Y KEERLS
Sbjct:  240 NQQLEVLLEWLPINYQKEERLS                                261
```

Figure 229:
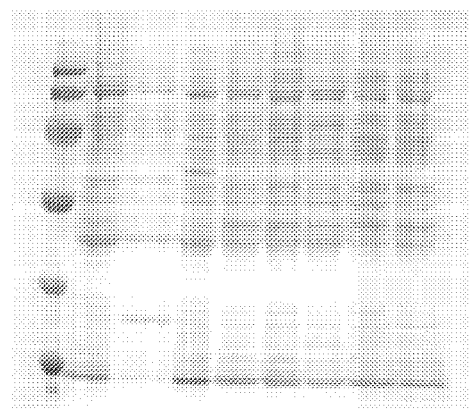

SEQ ID 2726 (GBS645) was expressed in *E. coli* as a GST-fusion product. SDS-PAGE analysis of total cell extract is shown in FIG. 129 (lanes 8 & 10; MW 60 kDa+lane 9; MW 27 kDa) and in FIG. 186 (lane 4; MW 60 kDa). It was also expressed in *E. coli* as a His-fusion product. SDS-PAGE analysis of total cell extract is shown in FIG. 129 (lane 12; MW 34.7 kDa), in FIG. 140 (lane 8; MW 35 kDa) and in FIG. 178 (lane 4; MW 35 kDa). Purified GBS645-GST is shown in FIG. 236, lane 11; purified GBS645-His is shown in FIG. 229, lanes 3-4.

Based on this analysis, it was predicted that these proteins and their epitopes could be useful antigens for vaccines or diagnostics.

Example 897

A DNA sequence (GBSx0951) was identified in *S. agalactiae* <SEQ ID 2729> which encodes the amino acid sequence <SEQ ID 2730>. Analysis of this protein sequence reveals the following:

Possible site: 44
>>> Seems to have no N-terminal signal sequence
INTEGRAL    Likelihood = −9.34    Transmembrane 22-38 (18-46)
----- Final Results -----
  bacterial membrane --- Certainty = 0.4736 (Affirmative) <succ>
    bacterial outside --- Certainty = 0.0000 (Not Clear) <succ>
      bacterial cytoplasm --- Certainty = 0.0000 (Not Clear) <succ>

The protein has no significant homology with any sequences in the GENPEPT database.

A related DNA sequence was identified in *S. pyogenes* <SEQ ID 2731> which encodes the amino acid sequence <SEQ ID 2732>. Analysis of this protein sequence reveals the following:

Possible site: 52
>>> Seems to have an uncleaveble N-term signal seq
INTEGRAL    Likelihood = −7.43    Transmembrane 25-41 (20-46)
INTEGRAL    Likelihood = −2.71    Transmembrane 4-20 (3-20)
----- Final Results -----
  bacterial membrane --- Certainty = 0.3972 (Affirmative) <succ>
    bacterial outside --- Certainty = 0.0000 (Not Clear) <succ>
      bacterial cytoplasm --- Certainty = 0.0000 (Not Clear) <succ>

The protein has no significant homology with any sequences in the GENPEPT database.

An alignment of the GAS and GBS proteins is shown below.

```
Identities = 31/87 (35%), Positives = 50/87 (56%), Gaps = 2/87 (2%)

Query:   1 MRTLFRMIFAIPKFIFRLIWNIIWGIFKTVLVIAIILFGLYYYANHSQSEFANQLSDIIQ  60
           M+ L  +I  +PK I ++ W++I G  +T+L++ II+ GL YY+NHS S   AN++S  I
Sbjct:   1 MKQLLAIILWLPKLIVKMFWHLIKGFLQTILLVTIIIGLMYYSNHSDSVLANKIS--IV  58

Query:  61 TGKTFLNFADTNQLKNSFTNLATDNVH                                  87
           T +   F    Q  ++ T   + N H
Sbjct:  59 TEQVVQIFDILTQKPSAKTRHGSGNSH                                  85
```

Figure 155:
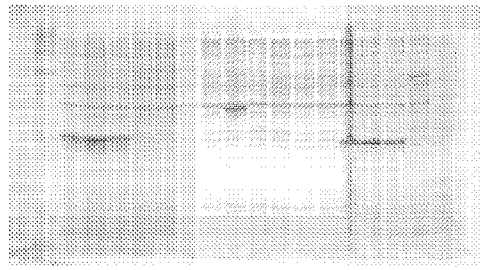
Figure 246:
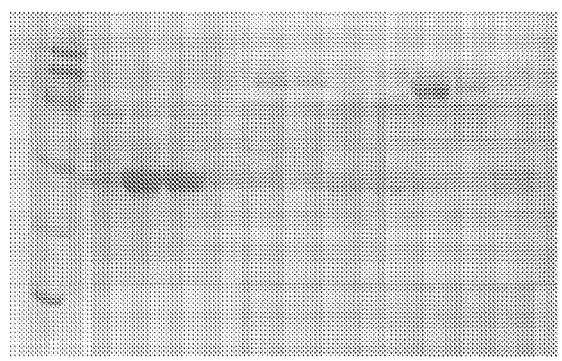

SEQ ID 2730 (GBS220d) was expressed in *E. coli* as a GST-fusion product. SDS-PAGE analysis of total cell extract is shown in FIG. 155 (lane 11-13; MW 50 kDa) and in FIG. 239 (lane 12; MW 50 kDa). It was also expressed in *E. coli* as a His-fusion product. SDS-PAGE analysis of total cell extract is shown in FIG. 155 (lane 14-16; MW 25.2 kDa) and in FIG. 184 (lane 7; MW 25 kDa). Purified GBS220d-GST is shown in FIG. 246, lanes 3 & 4.

Based on this analysis, it was predicted that these proteins and their epitopes could be useful antigens for vaccines or diagnostics.

Example 898

A DNA sequence (GBSx0953) was identified in *S. agalactiae* <SEQ ID 2733> which encodes the amino acid sequence <SEQ ID 2734>. This protein is predicted to be unnamed protein product (rpiA). Analysis of this protein sequence reveals the following:

```
Possible site: 33
>>> Seems to have no N-terminal signal sequence
----- Final Results -----
   bacterial cytoplasm --- Certainty = 0.2538 (Affirmative) <succ>
   bacterial membrane  --- Certainty = 0.0000 (Not Clear)  <succ>
   bacterial outside   --- Certainty = 0.0000 (Not Clear)  <succ>
```

The protein has homology with the following sequences in the GENPEPT database.

A related DNA sequence was identified in *S. pyogenes* <SEQ ID 2735> which encodes the amino acid sequence <SEQ ID 2736>. Analysis of this protein sequence reveals the following:

```
Possible site: 30
>>> Seems to have no N-terminal signal sequence
----- Final Results -----
   bacterial cytoplasm --- Certainty = 0.1646 (Affirmative) <succ>
   bacterial membrane  --- Certainty = 0.0000 (Not Clear)  <succ>
   bacterial outside   --- Certainty = 0.0000 (Not Clear)  <succ>
```

An alignment of the GAS and GBS proteins is shown below.

```
>GP: CAB69583 GB: A93589 unnamed protein product [Spinacia oleracea]
Identities = 114/232 (49%), Positives = 147/232 (63%), Gaps = 11/232 (4%)

Query:   2 DELKKLAGVTAAKYVKNGMIVGLGIGSTAYFFVEEIGERVKEEGL-QVVGVTTSNRTTEQ  60
           D+LKKLA    A  VK+GM++GLGTGSTA F V  IG +    L  +VG+ TS RT EQ
Sbjct:  59 DDLKKLAAEKAVDSVKSGMVLGLGIGSTAAFAVSRIGELLSAGKLTNIVGIPTSKRTAEQ 118

Query:  61 ARGLGIPLKSADDIDVIDVTVDGADEVDPDFNGIKGGGGALLMEKIVATPTKEYIWVVDE 120
           A  LGIPL    DD    ID+ +DAGAEVDPD N +KG GGALL EK+V   + ++I VVD+
Sbjct: 119 AASLGIPLSVLDDHPRIDLAIDGADEVDPDLNLVKGRGGALLREKMVEAASDKFIVVVDD 178

Query: 121 SKLVETLGAFKL--PVEVV----RYGSERLFRVFKSKGYCPSFRETEGDR--FITDMGNY 172
           +KLV+ LG +L  PVEVV     +Y  +RL +FK  G C +        EGD    ++
             TD  NY
Sbjct: 179 TKLVDGLGGSRLAMPVEVVQFCWKYNLKRLQEIFKELG-CEAKLRMEGDSSPYVTDNSNY 237

Query: 173 IIDLDL-KKIEDPKQLANELDHTVGVVEHGLENGMVNKVIVAGKNGLDILEK         223
           I+DL   I+D +    E+    GVVEHGLF GM ++VI+AGK G+ +  K
Sbjct: 238 IVDLYEPTSIKDAEAAGREISALEGVVEHGLFLGMASEVIIAGKTGVSVKTK         289
```

```
Identities = 166/222 (74%), Positives = 190/222 (84%)

Query:    1  MDELKKLAGVTAAKYVKNGMIVGLGTGSTAYFFVEEIGRRVKEEGLQVVGVTTSNRTTEQ    60
             M+ LKK+AGVTAA+YV +GM +GLGTGSTAY+FVEEIGRRVK+EGLQVVGVTTS+ T++Q
Sbjct:    1  MEALKKIQGVTAAQYVTDGMTIGLGTGSTAYYFVEEIGRRVKQEGLQVVGVTTSSVTSKQ    60

Query:   61  ARGLGIPLKSADDIDVIDVTVDGADEVDPDFNGIKGGGGALLMEKIVATPTKEYIWVVDE   120
             A  LGIPLKS DDID ID+TVDGADEVD +FNGIKGGG ALLMEKIVATPTKEYIWVVD
Sbjct:   61  AEVLGIPLKSIDDIDSIDLTVDGADEVDKNFNGIKGGGAALLMEKIVATPTKEYIWVVDA   120

Query:  121  SKLVETLGAFKLPVEVVRYGSERLFRVFKSKGYCPSFRETEGDRFITDMGNYIIDLDLKK   180
             SK+VE LGAFKLPVEVV+YG++RLFRVF+ GY PSFR    R +TDM NYIIDLDL
Sbjct:  121  SKMVEHLGAFKLPVEVVQYGADRLFRVFEKAGYKPSFRMKGDSRLVTDMQNYIIDLDLGC   180

Query:  181  IEDPKQLANELDHTVGVVEHGLFNGMVNKVIVAGKNGLDILE                    222
             I+DP    + LD TVGVVEHGLFNGMV+KVIVA K+G+ +LE
Sbjct:  181  IKDPVAFGHLLDGTVGVVEHGLFNGMVDKVIVASKDGVTVLE                    222
```

Based on this analysis, it was predicted that these proteins and their epitopes could be useful antigens for vaccines or diagnostics.

Example 899

A DNA sequence (GBSx0954) was identified in *S. agalactiae* <SEQ ID 2737> which encodes the amino acid sequence <SEQ ID 2738>. This protein is predicted to be phosphopentomutase (deoB). Analysis of this protein sequence reveals the following:

---

Possible site: 22
>>> Seems to have no N-terminal signal sequence
----- Final Results -----
bacterial cytoplasm --- Certainty = 0.0546 (Affirmative) <succ>
bacterial membrane --- Certainty = 0.0000 (Not Clear) <succ>
bacterial outside --- Certainty = 0.0000 (Not Clear) <succ>

---

The protein has homology with the following sequences in the GENPEPT database.

A related DNA sequence was identified in *S. pyogenes* <SEQ ID 2739> which encodes the amino acid sequence <SEQ ID 2740>. Analysis of this protein sequence reveals the following:

---

Possible site: 22
>>> Seems to have no N-terminal signal sequence
----- Final Results -----
bacterial cytoplasm --- Certainty = 0.0185 (Affirmative) <succ>
bacterial membrane --- Certainty = 0.0000 (Not Clear) <succ>
bacterial outside --- Certainty = 0.0000 (Not Clear) <succ>

---

An alignment of the GAS and GBS proteins is shown below.

```
>GP: AAC45496 GB: U80410 phosphopentomutase [Lactococcus lactis subsp. cremoris]
Identities = 275/408 (67%), Positives = 325/408 (79%), Gaps = 7/408 (1%)

Query:    3  QFDRIHLVVLDSVGIGAAPDANDFVNAGVP------DGASDTLGHISKTVGLAVPNMAKI    56
             +F RIHLVV+DSVGIGAAPDA+ F N V       D SDT+GHIS+ GL VPN+ K+
Sbjct:    4  KFGRIHLVVMDSVGIGAAPDADKFFNHDVETHEAINDVKSDTIGHISEIRGLDVPNLQKL    63

Query:   57  GLGNIPRPQALKTVPAEENPSGYATKLQEVSLGKDTMTGHWEIMGLNITEPFDTEWNGFP   116
             G GNIPR   LKT+PA + P+ Y TKL+E+S GKDTMTGHWEIMGLNI  PF T+ G+P
Sbjct:   64  GWGNIPRESPLKTIPAAQKPAAYVTKLEEISKGKDTMTGHWEIMGLNIQTPEPTYPEGYP   123

Query:  117  EDIITKIEDFSGRKVIREANKPYSGTAVIDDEGPRQMETGELIIYTSADPVLQIAAHEDI   176
             ED++ KIE+FSGRK+IREANKPYSGTVAI+DFGPRQ+ETGELIIYTSADPVLQIAAHED+
Sbjct:  124  EDLLEKIEEFSGRKIIREANKPYSGTAVIEDFGPRQLETGELIIYTSADPVLQIAAHEDV   183

Query:  177  IPLEELYRICEYARSITMELPALL-GRIIARPYVGEPGNFTRTANRHDYAVSPFEDTVLN   235
             I  EELY+ICEY RSIT+E   ++ GRIIARPYVGE GNF RT  R DYA+SPF +TVL
Sbjct:  184  ISREELYKICEYVRSITLEGSGIMIGRIIARPYVGEAGNFERTDGRRDYALSPFAETVLE   243

Query:  236  KLDQAGIDTYAVGKINDIFNGSGINHDMGHNKSNSHGIDTLIKTMGLSEFEKGFSFTNLV   295
             KL +AGIDTY+VGKI+DIFN  G+ +DMGHN ++   G+D L+K M  +EF +GFSFTNLV
Sbjct:  244  KLYKAGIDTYSVGKISDIFNTVGVKYDMGHNHNDMDGVDRLLKAMIKTEFTEGFSFTNLV   303

Query:  296  DFDALYGHRRDPHGYRDCLHEFDERLPEIISAMRDKDLLLITADHGNDPTYAGTDHTREY   355
             DFDA YGHRRD  GY   + +FD RLPEII AM++ DLL+ITADHGNDP+Y GTDHTREY
Sbjct:  304  DFDAKYGHRRDVEGYGKAIEDFDGRLPEIIDAMKEDDLLMITADHGNDPSYVGTDHTREY   363

Query:  356  IPLLAYSPSFTGNGLIPVGHFADISATVADNFGVDTAMIGESFLQDLV              403
             IPL+ +S SF      ++PVGHFADISAT A+NF V A  GESFL LV
Sbjct:  364  IPLVIFSKSFKEPKVLPVGHFADISATIAENFSVKKAQTGESFLDALV              411
```

```
Identities = 348/402 (86%), Positives = 374/402 (92%)

Query:   1 MSQFDRIHLVVLDSVGIGAAPDANDFVNAGVPDGASDTLGHISKTVGLAVPNMAKIGLGN   60
           MS+F+RIHLVVLDSVGIGAAPDA+ F NAGV D  SDTLGHIS+  GL+VPNMAKIGLGN
Sbjct:   1 MSKFNRIHLVVLDSVGIGAAPDADKFFNAGVADTDSDTLGHISEAAGLSVPNMAKIGLGN   60

Query:  61 IPRPQALKTVPAEENPSGYATKLQEVSLGKDTMTGHWEIMGLNITEPFDTFWNGFPEDII 120
           I RP  LKTVP E+NP+GY TKL+EVSLGKDTMTGHWEIMGLNITEPFDTFWNGFPE+I+
Sbjct:  61 ISRPIPLKTVPTEDNPTGYVTKLEEVSLGKDTMTGHWEIMGLNITEPFDTFWNGFPEEIL 120

Query: 121 TKIEDFSGRKVIREANKPYSGTAVIDDFGPRQMETGELIIYTSADPVLQIAAHEDIIPLE 180
           TKIE+FSGRK+IREANKPYSGTAVIDDFGPRQMETGELI+YTSADPVLQIAAHEDIIP+E
Sbjct: 121 TKIEEFSGRKIIREANKPYSGTAVIDDFGPRQMETGELIVYTSADPVLQIAAHEDIIPVE 180

Query: 181 ELYRICEYARSITMERPALLGRIIARPYVGEPGNFTRTANRHDYAVSPFEDTVLNKLDQA 240
           ELY+ICEYARSIT+ERPALLGRIIARPYVG+PGNFTRTANRHDYAVSPF+DTVLNKL  A
Sbjct: 181 ELYKICEYARSITLERPALLGRIIARPYVGDPGNFTRTANRHDYAVSPFQDTVINKLADA 240

Query: 241 GIDTYAVGKINDIFNGSGINHDMGHNKSNSHGIDTLIKTMGLSEFEKGFSFTNLVDFDAL 300
           G+ TYAVGKINDIFNGSGI +DMGHNKSNSHGIDTLIKT+ L EF KGFSFTNLVDFDA
Sbjct: 241 GVPTYAVGKINDIFNGSGITNDMGHNKSNSHGIDTLIKTLQLPEFTKGFSFTNLVDFDAN 300

Query: 301 YGHRRDPHGYRDCLHEFDERLPEIISAMRDKDLLLITADHGNDPTYAGTDHTREYIPLLA 360
           +GHRRDP GYRDCLHEFD RLPEII+ M++ DLLLITADHGNDPTYAGTDHTREYIPLLA
Sbjct: 301 FGHRRDPEGYRDCLHEFDNRLPEIIANMKEDDLLLITADHGNDPTYAGTDHTREYIPLLA 360

Query: 361 YSPSFTGNGLIPVGHFADISATVADNFGVDTAMIGESFLQDL              402
           YS SFTGNGLIP GHFADISATVA+NFGVDTAMIGESFL  L
Sbjct: 361 YSVSFTGNGLIPQGHFADISATVAENFGVDTAMIGESFLSHL              402
```

Based on this analysis, it was predicted that these proteins and their epitopes could be useful antigens for vaccines or diagnostics.

Example 900

A DNA sequence (GBSx0955) was identified in *S. agalactiae* <SEQ ID 2741> which encodes the amino acid sequence <SEQ ID 2742>. This protein is predicted to be unnamed protein product (mtaP). Analysis of this protein sequence reveals the following:

---

Possible site: 36
>>> Seems to have no N-terminal signal sequence
INTEGRAL    Likelihood = −1.44    Transmembrane 215-231 (215-231)
----- Final Results -----
  bacterial membrane --- Certainty = 0.1574 (Affirmative) <succ>
  bacterial outside --- Certainty = 0.0000 (Not Clear) <succ>
  bacterial cytoplasm --- Certainty = 0.0000 (Not Clear) <succ>

---

A related DNA sequence was identified in *S. pyogenes* <SEQ ID 2743> which encodes the amino acid sequence <SEQ ID 2744>. Analysis of this protein sequence reveals the following:

---

Possible site: 36
>>> Seems to have no N-terminal signal sequence
INTEGRAL    Likelihood = −1.44    Transmembrane 215-231 (215-231)
----- Final Results -----
  bacterial membrane --- Certainty = 0.1574 (Affirmative) <succ>
  bacterial outside --- Certainty = 0.0000 (Not Clear) <succ>
  bacterial cytoplasm --- Certainty = 0.0000 (Not Clear) <succ>

---

An alignment of the GAS and GBS proteins is shown below.

```
Identities = 225/269 (83%), Positives = 248/269 (91%)

Query:   1 MTLLEKINETRDFLQAKGVTAPEFGLILGSGLGELAEEIENPIVVDYADIPNWGQSTVVG   60
           M+L+ KINET+DFL  KG+  PEFGLILGSGLGELAEE+EN IV+DYADIPNWG+STVVG
Sbjct:   1 MSLMTKINETKDFLVTKGIETPEFGLILGSGLGELAEEVENAIVIDYADIPNWGKSTVVG   60

Query:  61 HAGKLVYGDLSGRKVLALQGRFHFYEGNTMEVVTFPVRIMRALACHSVLVTNAAGGIGYG 120
           HAGKLVYGDL+GRKVLALQGRFHFYEGN +EVVTFPVR+M+AL C  VLVTNAAGGIGYG
Sbjct:  61 HAGKLVYGDLAGRKVLALQGRFHFYEGNPLEVVTFPVRVMKALGCEGVLVTNAAGGIGYG 120

Query: 121 PGTLMLIKDHINMIGTNPLIGENLEEFGPRFPDMSDAYTATYRQKAHQIAEKQNIKLEEG 180
           PGTLM I DHINM G NPLIGENL+EFGPRFPDMSDAYT  YR KAH++AEK NIKLE+G
Sbjct: 121 PGTLMAITDHINMTGNNPLIGENLDEFGPRFPDMSDAYTKVYRNKAHEVAEKMNIKLEDG 180

Query: 181 VYLGVSGPTYETPAEIRAFQTMGAQAVGMSTVPEVIVAAHSGLKVLGISAITNFAAGFQS 240
           VY+G++GPTYETPAEIRAF+  GA AVGMSTVPEVIVAAHSGLKVLGISAITNFAAGFQS
Sbjct: 181 VYMGLTGPTYETPAEIRAFKVLGADAVGMSTVPEVIVAAHSGLKVLGISAITNFAAGFQS 240

Query: 241 ELNHEEVVEVTQRIKEDFKGLVKSLVAEL                              269
           ELNHEEVVEVTQ IKEDFKGLVK+++AEL
Sbjct: 241 ELNHEEVVEVTQHIKEDFKGLVKAILAEL                              269
```

Based on this analysis, it was predicted that these proteins and their epitopes could be useful antigens for vaccines or diagnostics.

Example 901

A DNA sequence (GBSx0956) was identified in *S. agalactiae* <SEQ ID 2745> which encodes the amino acid sequence <SEQ ID 2746>. Analysis of this protein sequence reveals the following:

```
Possible site: 31
>>> Seems to have a cleavable N-term signal seq.
INTEGRAL    Likelihood = -9.34    Transmembrane 266-282 (263-289)
INTEGRAL    Likelihood = -8.97    Transmembrane 231-247 (229-253)
INTEGRAL    Likelihood = -7.70    Transmembrane 356-372 (352-376)
INTEGRAL    Likelihood = -7.32    Transmembrane 303-319 (297-326)
INTEGRAL    Likelihood = -5.57    Transmembrane 337-353 (334-355)
INTEGRAL    Likelihood = -5.57    Transmembrane 391-407 (387-409)
INTEGRAL    Likelihood = -2.44    Transmembrane 177-193 (177-193)
INTEGRAL    Likelihood = -1.01    Transmembrane 159-175 (159-175)
INTEGRAL    Likelihood =  0.43    Transmembrane 198-214 (196-215)
----- Final Results -----
   bacterial membrane --- Certainty = 0.4736 (Affirmative) <succ>
   bacterial outside  --- Certainty = 0.0000 (Not Clear)   <succ>
   bacterial cytoplasm --- Certainty = 0.0000 (Not Clear)  <succ>
```

A related GBS nucleic acid sequence <SEQ ID 9883> which encodes amino acid sequence <SEQ ID 9884> was also identified.

The protein has homology with the following sequences in the GENPEPT database.

A related DNA sequence was identified in *S. pyogenes* <SEQ ID 2747> which encodes the amino acid sequence <SEQ ID 2748>. Analysis of this protein sequence reveals the following:

```
Possible site: 13
>>> Seems to have no N-terminal signal sequence
INTEGRAL    Likelihood = -5.41    Transmembrane 247-263 (245-267)
INTEGRAL    Likelihood = -5.15    Transmembrane 326-342 (323-345)
INTEGRAL    Likelihood = -5.04    Transmembrane 411-427 (407-429)
INTEGRAL    Likelihood = -4.94    Transmembrane 39-55 (34-59)
INTEGRAL    Likelihood = -4.46    Transmembrane 284-300 (282-307)
INTEGRAL    Likelihood = -3.45    Transmembrane 380-396 (376-400)
INTEGRAL    Likelihood = -2.13    Transmembrane 185-201 (184-201)
INTEGRAL    Likelihood = -2.02    Transmembrane 88-104 (87-105)
INTEGRAL    Likelihood = -1.12    Transmembrane 350-366 (350-367)
----- Final Results -----
   bacterial membrane --- Certainty = 0.3166 (Affirmative) <succ>
   bacterial outside  --- Certainty = 0.0000 (Not Clear)   <succ>
   bacterial cytoplasm --- Certainty = 0.0000 (Not Clear)  <succ>
```

The protein has homology with the following sequences in the databases:

```
>GP: AAD53928 GB: AF179611 chloride channel protein [Zymomonas mobilis]
Identities = 121/410 (29%), Positives = 213/410 (51%), Gaps = 19/410 (4%)

Query:   14 VKFMIAVLFMTVMAGVGAILMHYVLMFTEWLAFGDSRENTLSLLN------SVTPIKRVL   67
            +++ +A L +  + G+G +L+ ++L   + +A+G S ++ +S +       + +PP+R+
Sbjct:    3 IRYGLACLAVGCLTGLGGMLLSWILHAVQHIAYGYSLQHVISEESFLKGSMAASPLRRLE   62

Query:   68 SLTLVSFLASLSWYYLQIKPKQITSIKQQVVFKDFSVKKSPYWLHIGHAFLQLIYVGTGG  127
            L       +   W  L+     + SI Q V       + P+W   I H   LQ++ VG G
Sbjct:   63 VLVFCGAVVGGGWGLLRHFGSPLVSITQAVAANK---RVMPFWTTIIHVLLQIVTVGLGS  119

Query:  128 PIGKEGAPREFGAINAGKISDLLALKVLDKRLLIISGAAAGLSAVYQVPLASVFFAFETL  187
            P+G+E APRE G++  + +     L    +R+L+   GA AG ++VY VPL+    FA E L
Sbjct:  120 PLGREVAPRELGSLIGERRAFWGGLSENQRRILVACGAGAGFASVYNVPLSGALFALEAL  179

Query:  188 ALGISLKNIVTLLASTFGAASIAQLVISTAPLYHISKMSLNSQSLAFMFLIVLCVTPI--  245
            +  +   ++ L ++  +A +A +++   + +YH+      ++++   + L+  L   PI
Sbjct:  180 LMTWASPVVIVALLTSALSARMAWILLGNSMVYHVPAWPVDTR----LMLLALLAGPIFG  235

Query:  246 --AISFRYLNQKVTERRIK-NIKILLSLPVVSLIVSVLSIVYPQILGNGNALVQEVFKGT  302
              A  FR+ +QK+T  RIK N ++ L +    +LS+ +P+ILGNG    V     F
Sbjct:  236 IAAHYFRFWSQKITASRIKDNRRLALVAILCFAAIGLLSMWFPEILGNGKGPVSLAFNDN  295

Query:  303 TVSLIA-ILVVLKMIATLSTLYAGAYGGILTPSFSIGACLGFLLASISIPLLPHISIVTS  361
            + A L   K++A     L+AGAYGG+LTP  S GA L ++    +     LP + I
Sbjct:  296 LSGMKAGELFCFKILAVFLALWAGAYGGLLTPGISFGALLAVVIGHLWNMWLPPVPIGAF  355

Query:  362 MLVGAAIFLAITMRAPLTAVGLVISFTGQSVITIVPLTIAVLFATAYDYF           411
            ++G A FLA +M+ P+TA+ LVI F      ++P+  AV   + A   F
Sbjct:  356 AIIGGAAFLASSMKMPITAMALVIEFARTGHDFLIPIAFAVAGSIAISQF           405
```

```
>GP:AAF41386 GB:AE002449 chloride channel protein-related protein
[Neisseria meningitidis MC58]
Identities = 137/373 (36%), Positives = 201/373 (53%), Gaps = 23/373 (6%)
Query:  59 IHLIQSLSFGFSQG----SFSTMIASVPPQRRALSLLFAGLLAGLGWHLLAKKGKDIQSI 114
           +H IQ  ++G+      SF  +A    RR  L   G +AG GW LL +  GK     I
Sbjct:   1 MHFIQHTAYGYGADGVYTSFREGVAQASGMRRVAVLTLCGAVAGSGWWLLKRFGKPQIEI 60

Query: 115 QQIIQDDISFSPW-TQFWHGWLQLTTVSMGAPVGREGASREVAVTLTSLWSQRCNLSKAD 173
           +  ++  +   P+ T  +H LQ+ TV +G+P+GRE A RE+        +R  L  + +
Sbjct:  61 KAALKQPLQGLPFLTTVYHVLLQIITVGLSPLGREVAPREMTAAFAFAGGKRLGLDEGE 120

Query: 174 QKLLLACASGAALGAVYNAPLATILFILEAILNRWSLKNIYAACLTSYVAVETVALLQGR 233
            +LL+ACASGA L AVYN PLA+ LFILEA+L  W+ + + AA LTS +A     +  G
Sbjct: 121 MRLLIACASGAGLAAVYNVPLASTLFILEAMLGVWTQQAVAAALLTSVIATAVARI--GL 178

Query: 234 HEIQYLMPQQHWTLGT--LIGSVLAGLILSLFAHAYKHLLKHLPKADAKSQWFIPKVLIA 291
            ++Q   P  + T+ T   L  S+ G IL + A  ++     + P       IP +
Sbjct: 179 GDVQQYHP-ANLTVNTSLLWFSAVIGPILGVAAVFFQRTAQKFPFIKRDNIKIIPLAVCM 237

Query: 292 FSLIAGLSIFFPEILGNGKAG--LLF-FLHEEPH---LSYISWLLVAKAVAISLVFASGA 345
           F+LI  +S++FPEILGNGKAG   L F    L+    H    L+ +  WL+V  A+A+      GA
Sbjct: 238 FALIGVISVWFPEILGNGKAGNQLTFGGLTDWQHSLGLTAVKWLVVLMALAV------GA 291

Query: 346 KGGKIAPSMMLGGASGLLLAILSQYLIPLSLSNTLAIMVGATIFLGVINKIPLAAPVFLV 405
            GG I  PSMMLG  A      + P +S+   A +VGA +FLGV  K+PL A   F++
Sbjct: 292 YGGLITPSMMLGSTIAFAAATAWNSVFP-EMSSESAAIVGAAVFLGVSLKMPLTAIAFIL 350

Query: 406 EITGQSLLMIIPL                                              418
           E+T    +  +++PL
Sbjct: 351 ELTYAPVALLMPL                                              363

An alignment of the GAS and GBS proteins is shown
below.

Identities = 131/415 (31%), Positives = 215/415 (51%), Gaps = 9/415 (2%)
Query:   2 LNFKMVSRLYYAVKFMIAVLFMT-VMAGVGAILMHYVLMFTEWLAFGDSRENTLSLLNSV 60
           LNF  S +         LF+T + AG+ A ++        +  L+FG S+ +   +++ SV
Sbjct:  22 LNFCYNSLMKRHFLLLTFYLFLTGLTAGLVAFILTKAIHLIQSLSFGFSQGSFSTMIASV 81

Query:  61 TPIKRVLSLTLVSFLASLSWYYLQIKPKQITSIKQQVVFKDFSVKKSPYWLHIGHAFLQL 120
             P +R LSL    LA L W+ L   K K I SI QQ++   D S       SP W   H +LQL
Sbjct:  82 PPQRRALSLLFAGLLAGLGWHLLAKKGKDIQSI-QQIIQDDISF--SP-WTQFWHGWLQL 137

Query: 121 IYVGTGGPIGKEGAPREFGAINAGKISDLLALKVLDKRLLIISGAAAGLSAVYQVPLASV 180
               V  G P+G+EGA RE       S   L    D++LL+    +  A L AVY   PLA++
Sbjct: 138 TTVSMGAPVGREGASREVAVTLTSLWSQRCNLSKADQKLLLACASGAALGAVYNAPLATI 197

Query: 181 FFAFETLALGISLKNIVTLLASTFGAASIAQLVISTAPL-YHISKMSLNSQSLAFMFLIV 239
           F    E +     SLKNI    +++ A      L+       + Y  +  +      +L    L
Sbjct: 198 LFILEAILNRWSLKNIYAACLTSYVAVETVALLQGRHEIQYLMPQQHWTLGTLIGSVLAG 257

Query: 240 LCVTPIAISFRYLNQKVTERRIKNIKILLSLPVVSLIVSVLSIVYPQILGNGNA-LVQEV 298
           L ++     A  ++++L   + +   K+       + ++ +++ LSI +P+ILGNG A L+    +
Sbjct: 258 LILSLFAHAYKHLLKHLPKADAKSQWFIPKVLIAFSLIAGLSIFFPEILGNGKAGLLFFL 317

Query: 299 FKGTTVSLIAILVVLKMIATLSTLYAGAYGGILTPSFSIGACLGFLLASISIPLLP-HIS 357
             +S I+ L+V K +A      +GA GG + PS  +G   G LLA +S   L+P  +S
Sbjct: 318 HEEPHLSYISWLLVAKAVAISLVFASGAKGGKIAPSMMLGGASGLLLAILSQYLIPLSLS 377

Query: 358 IVTSMLVGAAIFLAITMRAPLTAVGLVISFTGQSVITIVPLTIA-VLFATAYDYF      411
           +++VGA IFL +  + PL A  ++   TGQS++ I+PL +A ++F  +Y ++
Sbjct: 378 NTLAIMVGATIFLGVINKIPLAAPVFLVEITGQSLLMIIPLALANLIFYFSYQFY       432
```

A related GBS gene <SEQ ID 8683> and protein <SEQ ID 8684> were also identified. Analysis of this protein sequence reveals the following:

Lipop: Possible site: −1 Crend: 9
SRCFLG: 0
McG: Length of UR: 19
Peak Value of UR: 2.96
Net Charge of CR: 2
McG: Discrim Score: 9.64
GvH: Signal Score (−7.5): 1.15

Possible site: 26
>>> Seems to have a cleavable N-term signal seq.
Amino Acid Composition: calculated from 27
ALOM program   count: 9 value: −9.34 threshold: 0.0

| | | |
|---|---|---|
| INTEGRAL | Likelihood = −9.34 | Transmembrane 261-277 (258-284) |
| INTEGRAL | Likelihood = −8.97 | Transmembrane 226-242 (224-248) |
| INTEGRAL | Likelihood = −7.70 | Transmembrane 351-367 (347-371) |
| INTEGRAL | Likelihood = −7.32 | Transmembrane 298-314 (292-321) |
| INTEGRAL | Likelihood = −5.57 | Transmembrane 332-348 (329-350) |
| INTEGRAL | Likelihood = −5.57 | Transmembrane 386-402 (382-404) |
| INTEGRAL | Likelihood = −2.44 | Transmembrane 172-188 (172-188) |
| INTEGRAL | Likelihood = −1.01 | Transmembrane 154-170 (154-170) |

-continued

| | | |
|---|---|---|
| INTEGRAL | Likelihood = −0.43 | Transmembrane 193-209 (191-210) |
| PERIPHERAL | Likelihood = 1.22 | 61 | modified ALOM score: 2.37
icml HYPID: 7 CFP: 0.474
*** Reasoning Step: 3
----- Final Results -----
    bacterial membrane --- Certainty = 0.4736 (Affirmative) <succ>
      bacterial outside --- Certainty = 0.0000 (Not Clear) <succ>
        bacterial cytoplasm --- Certainty = 0.0000 (Not Clear) <succ>

The protein has homology with the following sequences in the databases:

```
ORF00327(340-1533 of 1869)
GP|5834362|gb|AAD53928.1|AF179611_12|AF179611(3-405 of 425) chloride channel protein
{Zymomonas mobilis}
% Match = 14.7
% Identity = 30.2  % Similarity = 56.1
Matches = 121 Mismatches = 169 Conservative Sub.s = 104

270       300       330       360       390       420       450       468
RSLKLLSVLKKISRD*LNH*LLNFKMVSRLYYAVKFMIAVLFMTVMAGVGAILMHYVLMFTEWLAFGDSRENTLS---~-L
        :::    :|   |   :   :   |:|   :|:   :|   |       :  |:|   |  ::   |      |
                                MKIRYGLACLAVGCLTGLGGMLLSWILHAVQHIAYGYSLQHVISEESFL
                                10        20        30        40

492       522       552       582       612       642       672       702
LNSV--TPIKRVLSLTLVSFLASLSWYYLQIKPKQITSIKQQVVFKDFSVKKSPYWLHIGHAFLQLIYVGTGGPIGKEGA
 |:    :|::|:    |    :      |  |:       : ||||       :   |:|    |  |  :||:: || | |:|:| |
KGSMAASPLRRLEVLVFCGAVVGGGWGLLRHFGSPLVSITQAVAANK---RVMPFWTTIIHVLLQIVTVGLGSPLGREVA
        60        70        80        90        100       110       120

732       762       792       822       852       882       912       942
PREFGAINAGKISDLLALKVLDKRLLIISGAAAGLSAVYQVPLASVFFAFETLALGISLKNIVTLLASTFGAASIAQLVI
|||:|::   :  :       |   :|:|:  ||  ||:::||  |||:   :||:|  |   :    ::   | ::    :|  :| :::
PRELGSLIGERFAFWGGLSENQRRILVACGAGAGFASVYNVPLSGALFALEALLMTWASPVVIVALLTSALSRMAWILL
        140       150       160       170       180       190       200

972      1002      1032      1059      1089      1119      1146      1176
STAPLYHISKMSLNSQSLAFMPLIVLCVTPIAIS-FRYLNQKVTERRIKNIKILLSLPVVSLI-VSVLSIVYPQILGNGN
 :||:   ::::    |  ::  |   ::     ||       |||   ||  :||:|   :  :||:|   |   :   ::    :|   :|    :|:||||||
GNSMVYHVPAWPVDTR-LMLLALLAGPIFGIAAHYFRFWSQKITASRIKDNRRLALVAILCFAAIGLLSMWFPEILGNGK
        220       230       240       250       260       270       280

1206      1233      1263      1293      1323      1353      1383      1413
ALVQEVFKGTTVSLIA-ILVVLKMIATLSTLYAGAYGGILTPSFSIGACLGFLLASISIPLLPHISIVTSMLVGAAIFLA
 |    |     :  |   |   :|::|  :   |:|||||||:|||   |||   |   :  :        ||   :       ::| | |||
GPVSLAFNDNLSGMKAGELFCFKILAVFLALWAGAYGGLLTPGISFGALLAVVIGHLWNMWLPPVPIGAFAIIGGAAFLA
        300       310       320       330       340       350       360

1443      1473      1503      1533      1563      1593      1623      1653
ITMRAPLTAVGLVISFTGQSVITIVPLTIAVLFATAYDYFIRKMRSLYVNPY*SKTR*NCR*NFTSRRSTPCEIYCREFF
 :|:  |:|||: |||      ::|:  ||   |   |        |
SSMKMPITAMALVIEFARTGHDFLIPIAFAVAGSIAISQFYDQKKQPKTASKSVISHLGG
        380       390       400       410       420
```

<SEQ ID 2750>. This protein is predicted to be purine nucleoside phosphorylase, fragment (deoD-1). Analysis of this protein sequence reveals the following:

Possible site: 25
>>> Seems to have no N-terminal signal sequence
----- Final Results -----
    bacterial cytoplasm --- Certainty = 0.2384 (Affirmative) <succ>
      bacterial membrane --- Certainty = 0.0000 (Not Clear) <succ>
        bacterial outside --- Certainty = 0.0000 (Not Clear) <succ>

Based on this analysis, it was predicted that these proteins and their epitopes could be useful antigens for vaccines or diagnostics.

Example 902

A DNA sequence (GBSx0957) was identified in *S. agalactiae* <SEQ ID 2749> which encodes the amino acid sequence The protein has homology with the following sequences in the GENPEPT database.

```
>GP:CAC18350 GB:Y17900 putative purine-nucleotide phosphorylase
[Streptococcus salivarius]
Identities = 200/236 (84%), Positives = 219/236 (92%)
Query:  1 MSIHIEAKQGEIADKILLPGDPLRAKFIAENFLEDAVCFNIVRNMFGYTGTYKGHRVSVM 60
          MSIHI AKQGEIADKILLPGDPLRAKFIAENFLEDAVCFN VRNMFGYTGTYKG RVSVM
Sbjct:  1 MSIHIAAKQGEIADKILLPGDPLRAKFIAENFLEDAVCFNEVRNMEGYTGTYKGERVSVM 60
```

```
-continued
Query:   61 GTGMGMPSISIYARELIVDYGVKTLIRVGTAGAINPDIHVRELVLAQAAATNSNIIRNDW 120
            GTGMGMPSISIYARELIVDYGVK LIRVGTAG++N D+HVRELVLAQAAATNSNIIRNDW
Sbjct:   61 GTGMGMPSISIYARELIVDYGVKKLIRVGTAGSLNEDVHVRELVLAQAAATNSNIIRNDW 120

Query:  121 PEFDFPQIADFKLLDKAYHIAKEMDITTHVGSVLSSDVFYSNQPDRNMALGKLGVHAIEM 180
            P++DFPQIA+F LLDKAYHIAK   +TTHVG+VLSSDVFYSN ++N+ LGK GV A+EM
Sbjct:  121 PQYDFPQIANFNLLDKAYHIAKNEGMTTHVGNVLSSDVFYSNYFEKNIELGKWGVEAVEM 180

Query:  181 EAAALYYLAAQHNVNALAMMTISDNLNNPEEDTSAEERQTTFTDMMKVGLETLISE       236
            EAAALYYLAAQH V+ALA+MTISD+L NP+EDT+AEERQ TFTDMMKVGLETLI++
Sbjct:  181 EAAALYYLAAQHQVDALAIMTISDSLVNPDEDTTAEERQNTFTDMMKVGLETLIAD       236
```

A related DNA sequence was identified in *S. pyogenes* <SEQ ID 2751> which encodes the amino acid sequence <SEQ ID 2752>. Analysis of this protein sequence reveals the following:

Possible site: 25
>>> Seems to have no N-terminal signal sequence
----- Final Results -----
   bacterial cytoplasm --- Certainty = 0.2117 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 210/235 (89%), Positives = 226/235 (95%)
Query:    1 MSIHIEAKQGEIADKILLPGDPLRAKFIAENFLEDAVCFNTVRNMFGYTGTYKGHRVSVM  60
            MSIHI AK+G+IADKILLPGDPLRAKFIAENFLEDAVCFN VRNMFGYTGTYKGHRVSVM
Sbjct:    1 MSIHISAKKGDIADKILLPGDPLRAKFIAENFLEDAVCFNEVRNMFGYTGTYKGHRVSVM  60

Query:   61 GTGMGMPSISIYARELIVDYGVKTLIRVGTAGAINPDIHVRELVLAQAAATNSNIIRNDW 120
            GTGMGMPSISIYARELIVDYGVKTLIRVGTAGAI+P++HVRELVLAQAAATNSNIIRND+
Sbjct:   61 GTGMGMPSISIYARELIVDYGVKTLIRVGTAGAIDPEVHVRELVLAQAAATNSNIIRNDF 120

Query:  121 PEFDFPQIADFKLLDKAYHIAKEMDITTHVGSVLSSDVFYSNQPDRNMALGKLGVHAIEM 180
            PEFDFPQIADF LLDKAYHIA+EM +TTHVG+VLSSDVFY+N P+RNMALGKLGV AIEM
Sbjct:  121 PEFDFPQIADFGLLDKAYHIAREMGVTTHVGNVLSSDVFYTNMPERNMALGKLGVKAIEM 180

Query:  181 EAAALYYLAAQHNVNALAMMTISDNLNNPEEDTSAEERQTTFTDMMKVGLETLIS       235
            EAAALYYLAAQH+V AL +MTISDNLN+P EDT+AEERQTTFTDMMKVGLETLI+
Sbjct:  181 EAAALYYLAAQHHVKALGIMTISDNLNDPTEDTTAEERQTTFTDMMKVGLETLIA       235
```

Based on this analysis, it was predicted that these proteins and their epitopes could be useful antigens for vaccines or diagnostics.

Example 903

A DNA sequence (GBSx0958) was identified in *S. agalactiae* <SEQ ID 2753> which encodes the amino acid sequence <SEQ ID 2754>. Analysis of this protein sequence reveals the following:

Possible site: 36
>>> Seems to have no N-terminal signal sequence
----- Final Results -----
   bacterial cytoplasm --- Certainty = 0.1710 (Affirmative) <succ>
   bacterial membrane --- Certainty = 0.0000 (Not Clear) <succ>
   bacterial outside --- Certainty = 0.0000 (Not Clear) <succ>

A related GBS nucleic acid sequence <SEQ ID 9881> which encodes amino acid sequence <SEQ ID 9882> was also identified.

The protein has no significant homology with any sequences in the GENPEPT database.

A related DNA sequence was identified in *S. pyogenes* <SEQ ID 2755> which encodes the amino acid sequence <SEQ ID 2756>. Analysis of this protein sequence reveals the following:

Possible site: 21
>>> Seems to have no N-terminal signal sequence
----- Final Results -----
   bacterial cytoplasm --- Certainty = 0.1386 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 126/253 (49%), Positives = 175/253 (68%), Gaps = 2/253 (0%)
Query:    3 IEMTDFSTALKVLVDQYSYHNAFLLLQKHGPLNSDLLFLLEMMKERRELNIDFLFAHQEQ 62
            + MT+   T L +L+D Y+Y++AF + +         L+LLEM+KERRELN+ FL   H +
Sbjct:    1 LPMTNNQT-LDILLDVYAYNHAFRIAKALPNIPKTALYLLEMLKERRELNLAFLAEHAAE 59
```

```
Query:   63 VVILQEKYNIKL-LHNPYDLELLANYIMDLEAKVKNGLIIDFVRSVSPILYRLFMILLAQ 121
            ++++Y+  L L+     + E +ANYI+DLE KVKNG IIDFVRSVSPILYRLF+ L+
Sbjct:   60 NRTIEDQYHCSLWLNQSLEDEQIANYILDLEVKVKNGAIIDFVRSVSPILYRLFLRLITS 119

Query:  122 EVPHLHDYIHNARDDHYDTWKFKELKESNHPVLLAFSERWHDSRLTSKSLAECLQLTDLD 181
            E+P+    YI + ++D YDTW F+ + ES+H V  A+  +        +T+KSLA+ L LT L
Sbjct:  120 EIPNFKAYIFDTKNDQYDTWHFQAMLESDHEVFKAYLSQKQSRNVTTKSLADMLTLTSLP 179

Query:  182 EEVKSTIIQLRQFEKSVRNPLAHLIKPFDEQELYRTTQFSSQAFLDQIIFLAKVIGVEYD 241
            +E+K  +   LR FEK+VRNPLAHLIKPFDE+EL+RTT FSSQAFL+ II LA   GV Y
Sbjct:  180 QEIKDLVFLLRHFEKAVRNPLAHLIKPFDEEELHRTTHFSSQAFLENIITLATFSGVIYR 239

Query:  242 TVNFHYDTVNKLI                                                254
            F++D +N +I
Sbjct:  240 REPFYFDDMNAII                                                252
```

Based on this analysis, it was predicted that these proteins and their epitopes could be useful antigens for vaccines or diagnostics.

Example 904

A DNA sequence (GBSx0959) was identified in *S. agalactiae* <SEQ ID 2757> which encodes the amino acid sequence <SEQ ID 2758>. This protein is predicted to be CpsY protein. Analysis of this protein sequence reveals the following:

Possible site: 35
>>> Seems to have no N-terminal signal sequence
INTEGRAL    Likelihood = −0.59    Transmembrane 260-276 (260-276)
----- Final Results -----
   bacterial membrane --- Certainty = 0.1235 (Affirmative) <succ>
      bacterial outside --- Certainty = 0.0000 (Not Clear) <succ>
         bacterial cytoplasm --- Certainty = 0.0000 (Not Clear) <succ>

A related GBS nucleic acid sequence <SEQ ID 9879> which encodes amino acid sequence <SEQ ID 9880> was also identified.

A related DNA sequence was identified in *S. pyogenes* <SEQ ID 2759> which encodes the amino acid sequence <SEQ ID 2760>. Analysis of this protein sequence reveals the following:

Possible site: 35
>>> Seems to have no N-terminal signal sequence

----- Final Results -----
   bacterial cytoplasm --- Certainty = 0.1958 (Affirmative) <succ>
      bacterial membrane --- Certainty = 0.0000 (Not Clear) <succ>
         bacterial outside --- Certainty = 0.0000 (Not Clear) <succ>

An alignment of the GAS and GBS proteins is shown below.

```
Identities = 247/301 (82%), Positives = 274/301 (90%)
Query:    1 MRIQQLQYVIKIVETGSMNEAAKQLYITQPSLSNAVRNLETEMGIQIFIRNPKGITLTKD   60
            MRIQQL Y+IKIVE GSMNEAAKQL+ITQPSLSNAV+ +LE EMGI IF RNPKGITLTKD
Sbjct:    1 MRIQQLHYIIKIVECGSMNEAAKQLFITQPSLSNAVKDLEMEMGITIFNRNPKGITLTKD   60

Query:   61 GMEFLSYARQILEQTALLEERYKGDNTSRELFSVSSQHYAFVVNAFVALFNGTDMTQYEL  120
            G+EFLSYARQI+EQT+LLE+RYK   NT RELFSVSSQHYAFVVNAFV+L    TDMT+YEL
Sbjct:   61 GVEFLSYARQIIEQTSLLEDRYKNHNTGRELFSVSSQHYAFVVNAFVSLLKRTDMTRYEL  120

Query:  121 FLRETRTWEIIDDVKNFRSEIGVLFLNSYNRDVLTKLFDDNSLIATTLFTTTPHIFVSKS  180
            FLRETRTWEIIDDVKNFRSEIGVLF+N YNRDVLTKLFDDN L A+ LF     PHIFVSKS
Sbjct:  121 FLRETRTWEIIDDVKNFRSEIGVLFINDYNRDVLTKLFDDNHLTASPLFKAQPHIFVSKS  180

Query:  181 NPLANRKKLNMKDLEDYPYLSYDQGLHNSFYFSEEMMSQIPHPKSIVVSDRATLFNLMIG  240
                NPLA +   L+M DL D+PYLSYDQG+HNSFYFSEEMMSQ+PH KSIVVSDRATLFNLMIG
Sbjct:  181 NPLATKSLLSMDDLRDFPYLSYDQGIHNSFYFSEEMMSQMPHNKSIVVSDRATLFNLMIG  240

Query:  241 LDGYTVATGILNSKLNGDEIVAIPLDVDDVIDIVYIRHDKANLSKMGQKFIDYLLEEVSFN  301
            LDGYTVA+GILNS LNGD+IVAIPLDV D IDIV+I+H+KANLSKMG++FI+YLLEEV+F+
Sbjct:  241 LDGYTVASGILNSNLNGDQIVAIPLDVPDEIDIVFIKHEKANLSKMGERFIEYLLEEVTFD  301
```

Based on this analysis, it was predicted that these proteins and their epitopes could be useful antigens for vaccines or diagnostics.

Example 905

A DNA sequence (GBSx0960) was identified in *S. agalactiae* <SEQ ID 2761> which encodes the amino acid sequence <SEQ ID 2762>. This protein is predicted to be CpsX protein. Analysis of this protein sequence reveals the following:

Possible site: 32
>>> Seems to have an uncleavable N-term signal seq
INTEGRAL    Likelihood = −14.91    Transmembrane 22-38 (13-42)
INTEGRAL    Likelihood = −14.65    Transmembrane 52-68 (44-77)
INTEGRAL    Likelihood = −6.74     Transmembrane 76-92 (73-97)
----- Final Results -----
   bacterial membrane --- Certainty = 0.6965 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the databases:

```
>GP:AAC44935 GB:U56901 putative transcriptional regulator [Bacillus subtilis]
Identities = 120/389 (30%), Positives = 196/389 (49%), Gaps = 17/389 (4%)
Query:    2  KIGKKIVLMFTAIVLTTVLALGVYLTSAYTFSTGELSKTFKDFSTSSNKSDAIK-QTRAF    60
             KI K+I+L+F A+ L   V+ LG Y      +  E     + S+ +++ +  + + F
Sbjct:   19  KILKRIMLLF-ALALLVVVGLGGYKLYKTINAADESYDALSRGNKSNLRNEVVDMKKKPF    77

Query:   61  SILLMGVDTGSSERASKWEGNSDSMILVTVNPKTKKTTMTSLERDTLTTLSGPKNNEMNG   120
             SIL MG++  +++       +G SDS+I+VT++PK K   M S+ RDT   L+G   +  G
Sbjct:   78  SILFMGIEDYATKGQ---KGRSDSLIVVTLDPKNKTMKMLSIPRDTRVQLAG----DTTG   130

Query:  121  VEAKLNAAYAAGGAQMAIMTVQDLLNITIDNYVQINMQGLIDLVNAVGGITVTNEFDFPI   180
             +  K+NAAY+ GG      + TV++ L I ID YV ++   G  D++N VGGI V    FDF
Sbjct:  131  SKTKINAAYSKGGKDETVETVENFLQIPIDKYVTVDEDGFKDVINEVGGIDVDVPFDFDE   190

Query:  181  SIAENEPEYQATVAPGTHKINGEQALVYARMRYDDPEGDYGRQKRQREVIQKVLKKILAL   240
                 +E + +        G   +NGE+AL YARMR  D  GD+GR  RQ++++  ++ ++ +
Sbjct:  191  KSDVDESK-RIYFKKGEMHLNGEEALAYARMRKQDKRGDFGRNDRQKQILNALIDRMSSA   249

Query:  241  DSISSYRKILSAVSSNMQTNIEISSRTIPSLLGYRDALRTIKTYQLKGEDATLSDGGSYQ   300
             +I+    KI     S N++TNI I+         +  I T  + G D  L      +Y
Sbjct:  250  SNIAKIDKIAEKASENVETNIRITEGLALQQIYSGFTSKKIDTLSITGSDLYLGPNNTYY   309

Query:  301  IVTSNHLLEIQNRIRTELGLHKVNQLKTNATVYENLYGSTKSQTVNNNYDSSGQAPSYSD   360
                        LE    ++R  L  H ++       +T          T  S  +  +  S+G      +
Sbjct:  310  FEPDATNLE---KVRKTLQEH-LDYTPDTSTGTSGTEDGTDSSSSGSTGSTGTTTDGTT   365

Query:  361  SHSSYANYSSGVDTGQSASTDQDSTASSH                                389
             +  SSY+N SS    T   + ST     +T SS+
Sbjct:  366  NGSSYSNDSS---TSSNNSTTNSTTDSSY                                391
```

There is also homology to SEQ ID 2764.

Based on this analysis, it was predicted that these proteins and their epitopes could be useful antigens for vaccines or diagnostics.

Example 906

A DNA sequence (GBSx0961) was identified in *S. agalactiae* <SEQ ID 2765> which encodes the amino acid sequence <SEQ ID 2766>. This protein is predicted to be CpsIaB. Analysis of this protein sequence reveals the following:

---

Possible site: 41
>>> Seems to have no N-terminal signal sequence
INTEGRAL    Likelihood = −0.75    Transmembrane 121-137 (121-137)
----- Final Results -----
  bacterial membrane --- Certainty = 0.1298 (Affirmative) <succ>
    bacterial outside --- Certainty = 0.0000 (Not Clear) <succ>
      bacterial cytoplasm --- Certainty = 0.0000 (Not Clear) <succ>

---

A related GBS nucleic acid sequence <SEQ ID 9877> which encodes amino acid sequence <SEQ ID 9878> was also identified.

No corresponding DNA sequence was identified in *S. pyogenes*.

Based on this analysis, it was predicted that these proteins and their epitopes could be useful antigens for vaccines or diagnostics.

Example 907

A DNA sequence (GBSx0962) was identified in *S. agalactiae* <SEQ ID 2767> which encodes the amino acid sequence <SEQ ID 2768>. This protein is predicted to be cpsb protein. Analysis of this protein sequence reveals the following:

---

Possible site: 35
>>> Seems to have no N-terminal signal sequence
INTEGRAL    Likelihood = −9.02    Transmembrane 182-198 (179-204)
INTEGRAL    Likelihood = −5.57    Transmembrane 30-46 (24-48)
----- Final Results -----
  bacterial membrane --- Certainty = 0.4609 (Affirmative) <succ>
    bacterial outside --- Certainty = 0.0000 (Not Clear) <succ>
      bacterial cytoplasm --- Certainty = 0.0000 (Not Clear) <succ>

---

No corresponding DNA sequence was identified in *S. pyogenes*.

A related GBS gene <SEQ ID 10785> and protein <SEQ ID 10786> were also identified. Analysis of this protein sequence reveals the following:

---

Lipop: Possible site: −1    Crend: 9
McG: Discrim Score: −8.96
GvH: Signal Score (−7.5): 0.11
Possible site: 35
>>> Seems to have no N-terminal signal sequence
ALOM program         count: 2 value: −9.02  threshold: 0.0
INTEGRAL             Likelihood = −9.02    Transmembrane 182-198
                                           (179-204)
INTEGRAL             Likelihood = −5.57    Transmembrane 30-46
                                           (24-48)
PERIPHERAL           Likelihood = 6.21     113
modified ALOM score: 2.30
*** Reasoning Step: 3
----- Final Results -----
  bacterial membrane --- Certainty = 0.4609 (Affirmative) <succ>
    bacterial outside --- Certainty = 0.0000 (Not Clear) <succ>
      bacterial cytoplasm --- Certainty = 0.0000 (Not Clear) <succ>

---

Based on this analysis, it was predicted that these proteins and their epitopes could be useful antigens for vaccines or diagnostics.

Example 908

A DNA sequence (GBSx0963) was identified in *S. agalactiae* <SEQ ID 2769> which encodes the amino acid sequence <SEQ ID 2770>. This protein is predicted to be CpsIaD. Analysis of this protein sequence reveals the following:

```
Possible site: 61
>>> Seems to have no N-terminal signal sequence
INTEGRAL    Likelihood = −2.44    Transmembrane 149-165 (149-166)
----- Final Results -----
    bacterial membrane --- Certainty = 0.1977 (Affirmative) <succ>
       bacterial outside --- Certainty = 0.0000 (Not Clear) <succ>
          bacterial cytoplasm --- Certainty = 0.0000 (Not Clear) <succ>
```

No corresponding DNA sequence was identified in S. pyogenes.

Based on this analysis, it was predicted that this protein and its epitopes, could be useful antigens for vaccines or diagnostics.

Example 909

A DNA sequence (GBSx0964) was identified in S. agalactiae <SEQ ID 2771> which encodes the amino acid sequence <SEQ ID 2772>. Analysis of this protein sequence reveals the following:

```
Possible site: 25
>>> Seems to have an uncleavable N-term signal seq
INTEGRAL    Likelihood = −12.26   Transmembrane 276-292 (270-297)
INTEGRAL    Likelihood = −4.62    Transmembrane 10-26 (9-28)
INTEGRAL    Likelihood = −4.14    Transmembrane 41-57 (39-58)
INTEGRAL    Likelihood = −3.24    Transmembrane 100-116 (100-116)
INTEGRAL    Likelihood = −3.08    Transmembrane 445-461 (443-461)
----- Final Results -----
    bacterial membrane --- Certainty = 0.5904 (Affirmative) <succ>
       bacterial outside--- Certainty = 0.0000 (Not Clear) <succ>
          bacterial cytoplasm --- Certainty = 0.0000 (Not Clear) <succ>
```

No corresponding DNA sequence was identified in S. pyogenes.

A related GBS gene <SEQ ID 8687> and protein <SEQ ID 8688> were also identified. Analysis of this protein sequence reveals the following:

```
Lipop: Possible site: −1  Crend: 8
McG: Discrim Score: 5.69
GvH: Signal Score (−7.5): −5.63
Possible site: 25
>>> Seems to have an uncleavable N-term signal seq
ALOM program    count: 5 value: −12.26    threshold: 0.0
INTEGRAL        Likelihood = −12.26       Transmembrane 276-292
                                          (270-297)
INTEGRAL        Likelihood = −4.62        Transmembrane 10-26
                                          (9-28)
INTEGRAL        Likelihood = −4.14        Transmembrane 41-57
                                          (39-58)
INTEGRAL        Likelihood = −3.24        Transmembrane 100-116
                                          (100-116)
INTEGRAL        Likelihood = −3.08        Transmembrane 445-461
                                          (443-461)
PERIPHERAL      Likelihood = 2.23         221
modified ALOM score: 2.95
*** Reasoning Step: 3
----- Final Results -----
    bacterial membrane --- Certainty = 0.5904 (Affirmative) <succ>
       bacterial outside --- Certainty = 0.0000 (Not Clear) <succ>
          bacterial cytoplasm --- Certainty = 0.0000 (Not Clear) <succ>
```

Based on this analysis, it was predicted that these proteins and their epitopes could be useful antigens for vaccines or diagnostics.

Example 910

A DNA sequence (GBSx0965) was identified in S. agalactiae <SEQ ID 2773> which encodes the amino acid sequence <SEQ ID 2774>. This protein is predicted to be CpsF. Analysis of this protein sequence reveals the following:

```
Possible site: 13
>>> Seems to have no N-terminal signal sequence
INTEGRAL    Likelihood = −2.60    Transmembrane 79-95 (78-95)
----- Final Results -----
    bacterial membrane --- Certainty = 0.2041 (Affirmative) <succ>
       bacterial outside --- Certainty = 0.0000 (Not Clear) <succ>
          bacterial cytoplasm --- Certainty = 0.0000 (Not Clear) <succ>
```

No corresponding DNA sequence was identified in S. pyogenes.

Based on this analysis, it was predicted that this protein and its epitopes, could be useful antigens for vaccines or diagnostics.

Example 911

A DNA sequence (GBSx0966) was identified in S. agalactiae <SEQ ID 2775> which encodes the amino acid sequence <SEQ ID 2776>. This protein is predicted to be galactosyltransferase. Analysis of this protein sequence reveals the following:

```
Possible site: 39
>>> Seems to have no N-terminal signal sequence
----- Final Results -----
    bacterial cytoplasm --- Certainty = 0.4634 (Affirmative) <succ>
       bacterial membrane --- Certainty = 0.0000 (Not Clear) <succ>
          bacterial outside --- Certainty = 0.0000 (Not Clear) <succ>
```

No corresponding DNA sequence was identified in S. pyogenes.

Based on this analysis, it was predicted that this protein and its epitopes, could be useful antigens for vaccines or diagnostics.

Example 912

A DNA sequence (GBSx0967) was identified in S. agalactiae <SEQ ID 2777> which encodes the amino acid sequence <SEQ ID 2778>. Analysis of this protein sequence reveals the following:

```
Possible site: 23
>>> Seems to have an uncleavable N-term signal seq
INTEGRAL    Likelihood = −12.47   Transmembrane 59-75 (54-82)
INTEGRAL    Likelihood = −10.88   Transmembrane 309-325 (307-332)
INTEGRAL    Likelihood = −8.07    Transmembrane 33-49 (28-53)
INTEGRAL    Likelihood = −6.48    Transmembrane 195-211 (187-212)
INTEGRAL    Likelihood = −6.16    Transmembrane 285-301 (283-306)
INTEGRAL    Likelihood = −4.09    Transmembrane 222-238 (221-240)
INTEGRAL    Likelihood = −3.50    Transmembrane 78-94 (77-96)
INTEGRAL    Likelihood = −2.71    Transmembrane 101-117 (99-117)
INTEGRAL    Likelihood = −2.44    Transmembrane 8-24 (7-25)
INTEGRAL    Likelihood = −1.59    Transmembrane 147-163 (147-164)
INTEGRAL    Likelihood = −0.48    Transmembrane 168-184 (168-184)
----- Final Results -----
    bacterial membrane --- Certainty = 0.5989 (Affirmative) <succ>
       bacterial outside --- Certainty = 0.0000 (Not Clear) <succ>
          bacterial cytoplasm --- Certainty = 0.0000 (Not Clear) <succ>
```

The protein has homology with the following sequences in the GENPEPT database.

```
>GP:CAB43614 GB:AJ239004 polysaccharide polymerase [Streptococcus pneumoniae]
Identities = 74/309 (23%), Positives = 137/309 (43%), Gaps = 36/309 (11%)
Query:  53 FERRKLV---IIFLLFIATILNLFFVHKVTFILTLIFFLALKDI--SLKKAFSIIIGSRI   107
            FE+RK      II ++ I T+L     +    ++    +F+ +   I    L++    II
Sbjct:  61 FEKRKYTLQFIISIILITTLLLYTSIQMQNYVYFTSWFMLIGTIHYDLRRVIKIIFIVS-   119

Query: 108 LGVLLNQIFVKLDLIEIKY-----VNFYRDGQFILRSDLGFGHPNFIHNFFALTIFLYIV   162
            L ++    IF+ L +   I Y      +N  R+ + +     GF HPN       +    ++I
Sbjct: 120 LSIMFISIFISLLMYIIDYKREILINIRRN-ETVRAFTFGFIHPNKFTIVLSNLCLMFIW   178

Query: 163 LNYKRLKPVVMVLFLTLNYLLYQYTFSRTGYYIVILFIVLIYVTKNSLIKRVFMKLAPYV   222
            L    RLK   +     L +       Y +T +RT     + I+    L+Y+      ++ + ++     Y
Sbjct: 179 LIKDRLKYYHVTFCLFIQLFFYFFTQTRTALLVSIVIFALLYI--YMFVENLELRWIGYS   236

Query: 223 QFFLLVFTFLSSTIFFNSN--FVQKLDVLLTGRLHY-AHLQLVDGLTPFGNSFKE-----   274
               F  +   F + +    F+  SN   F    +D +LTGR+       A+ +       G T  +G         +
Sbjct: 237 FFCISTFLGVLAFQFYPSNNKFSIFIDNILTGRIKLAAYARTFFGYTFWGQYVDKEIVWD   296

Query: 275 -----TSVLFDNSYSMLLSMYGVVLTMFCMIIY-----YIYSKKIIIIELQLLLFIMSII   324
                 TS    FD+ YS L+S G++  +   +++        Y+ +K +I+     LL + M   +
Sbjct: 297 PIWGLTSFTFDSFYSFLMSNAGIIWLLILSVLFVKLQKYLDNKSLIL----LLAWSMYAV   352

Query: 325 LFTESFYPS                                                     333
            T+   +PS
Sbjct: 353 TETDLIFPS                                                    361
```

No corresponding DNA sequence was identified in *S. pyogenes*.

Based on this analysis, it was predicted that this protein and its epitopes, could be useful antigens for vaccines or diagnostics.

Example 913

A DNA sequence (GBSx0968) was identified in *S. agalactiae* <SEQ ID 2779> which encodes the amino acid sequence <SEQ ID 2780>. This protein is predicted to be cap8J. Analysis of this protein sequence reveals the following:

Possible site: 57
>>> Seems to have no N-terminal signal sequence
----- Final Results -----
   bacterial cytoplasm --- Certainty = 0.3424 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

No corresponding DNA sequence was identified in *S. pyogenes*.

Based on this analysis, it was predicted that this protein and its epitopes, could be useful antigens for vaccines or diagnostics.

Example 914

A DNA sequence (GBSx0969) was identified in *S. agalactiae* <SEQ ID 2781> which encodes the amino acid sequence <SEQ ID 2782>. Analysis of this protein sequence reveals the following:

Possible site: 44
>>> Seems to have no N-terminal signal sequence
----- Final Results -----
   bacterial cytoplasm --- Certainty = 0.3897 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:CAB43613 GB:AJ239004 cap8J [Streptococcus pneumoniae]
Identities = 94/237 (39%), Positives = 135/237 (56%), Gaps = 10/237 (4%)
Query:    1 MIPKVIHYCWFGGNPLPDNLKKYIKTWREQCPDYEIIEWNEHNYDVSKNVFMREAYTKKN  60
            MIPK  IHY WFGG+   PD + K I +W++   PDYEI+EWNE N+D+S  +F + AY    +
Sbjct:    1 MIPKKIHYIWFGGSEKPDVVLKCINSWKKYMPDYEIVEWNEDNFDLSDSQFAKSAYESRK  60

Query:   61 FAYVSDYARLDIIYTYGGFYLDTDVELLKSL-DPLRIHECFLAREISCDVNTGLIIGAVK 119
             +A+ SDYAR  I+   YGG Y DTDVELLK++  D +  H  F    E   +VN GL+    +
Sbjct:   61 WAFASDYARFKILSKYGGIYFDTDVELLKTISDDILAHSSFTGFEYIGEVNPGLVYACMP 120

Query:  120 GHHFLKSNMSIYDKS--DLTSLNKTCVEVTTNLLINRGLKNKNIIQKIDDITIYPRNYFN 177
                K  + Y+++ D+   L  T   + T+ L+    +   N    Q ID +  IYP +YF
Sbjct:  121 DDKIAKYMVQYYEQASFDINHL-VTVNTIITDYLLKNNFQKNNQFQIIDGLAIYPDDYFC 179

Query:  178 PKNLLTGKVDCLTSVTYSIHHYEGSWKSSSFISDSLKIRVRLIIDFLFGYGTYRMLL    234
             +      +V  LT  T SIHHY +WK+         +LK +V++I+   + G YR   LL
Sbjct:  180 GYDQEVKEVR-LTERTISIHHYSATWKTR-----TLKRKVQMIVKTIIGAENYRKLL     230
```

```
>GP:CAA87700 GB:Z47767 WbcL, [Yersinia enterocolitica]
Identities = 60/207 (28%), Positives = 101/207 (47%), Gaps = 22/207 (10%)
Query:    4 IFTPTFNRGYRLSYLYDSLCNQTNKNFIWLIVDDGSEDSTKEIVSNYIKENKVSIVYLYK 63
            +FTPTFNR + L   Y S+   Q   +  WLIVDDGS D+T E+V ++  ENK++I Y+Y+
Sbjct:    6 VETPTFNRAHVLKRCYLSILEQDRDDIEWLIVDDGSTDNTAEVVDSFKIENKLNIKYIYQ 65

Query:   64 RNGGKHSAYNLAMRYMQPSDYHVCVDSDDWLLEDAV------EIIFKDLESLTLSNRYVG117
            N GK +A+N A+         +Y  +DSDD  +  ++          +F D E + +
Sbjct:   66 DNSGKQAAWNKAVENAS-GEYFIGLDSDDAFIAGSINKLLSMNAVFDDKEIIGIR----A120

Query:  118 LVYPRYSLNQGNNWLNPKILEVNIPDLKYKYHLKIETCIVINNAYLVDFEFPCFEGENFL177
            +       +L   N +L+ +  + +   D ++    ++ E         L    + +P    G NF+
Sbjct:  121 ISVSSETLKPNNYYLSNEDKKSSWFD-EFSSGIRGERIDFFKTELLRKYLYPVASGINFI179

Query:  178 SEEIMYIYLSKKGYFCPQNRKIYCFDY                                204
              E   Y  ++K+           YCF Y
Sbjct:  180 PEIWFYSTVAKE----------YCFYY                                196
```

No corresponding DNA sequence was identified in *S. pyogenes*.

Based on this analysis, it was predicted that this protein and its epitopes, could be useful antigens for vaccines or diagnostics.

Example 915

A DNA sequence (GBSx0970) was identified in *S. agalactiae* <SEQ ID 2783> which encodes the amino acid sequence <SEQ ID 2784>. This protein is predicted to be eps7. Analysis of this protein sequence reveals the following:

---
Possible site: 32
>>> Seems to have an uncleavable N-term signal seq
INTEGRAL    Likelihood = −2.18    Transmembrane 190-206 (189-206)
----- Final Results -----
    bacterial membrane --- Certainty = 0.1871 (Affirmative) <succ>
        bacterial outside --- Certainty = 0.0000 (Not Clear) <succ>
            bacterial cytoplasm --- Certainty = 0.0000 (Not Clear) <succ>
---

The protein has homology with the following sequences in the GENPEPT database.

Based on this analysis, it was predicted that this protein and its epitopes, could be useful antigens for vaccines or diagnostics.

Example 916

A DNA sequence (GBSx0971) was identified in *S. agalactiae* <SEQ ID 2785> which encodes the amino acid sequence <SEQ ID 2786>. This protein is predicted to be galactosyltransferase. Analysis of this protein sequence reveals the following:

---
Possible site: 26
>>> Seems to have an uncleavable N-term signal seq
----- Final Results -----
    bacterial membrane --- Certainty = 0.0000 (NotClear) <succ>
        bacterial outside --- Certainty = 0.0000 (NotClear) <succ>
            bacterial cytoplasm --- Certainty = 0.0000 (NotClear) <succ>
---

A related DNA sequence was identified in *S. pyogenes* <SEQ ID 2787> which encodes the amino acid sequence <SEQ ID 2788>. Analysis of this protein sequence reveals the following:

```
>GP:CAB59293 GB:AJ131984 putative galactosyl transferase
[Streptococcus pneumoniae]
Identities = 101/312 (32%), Positives = 172/312 (54%), Gaps = 4/312 (1%)
Query:    3 LISIIVPVYNGEIYIGRCLDSILEQTYQNLEIIIDDGSSDRTGDICEKYFLEDRRIKYF 62
            +IS+IVPVYN   Y+    LDS+LEQTY++  E+I+++DGS+D +G+IC++Y      I  F
Sbjct:    1 MISVIVPVYNVADYLRFALDSLLEQTYKDFEVILVNDGSTDNSGEICDEYGKLYDNIHVF 60

Query:   63 YQENRGQSVARNNGVLRCTGDWIAFLDSDDVYLPYSIEVMYNIQKATNADIVLT--SIGN120
            +++N G S ARN G+ +   G++I FLDSDD + PY++E++   IQK  + DIV T    I
Sbjct:   61 HKKNGGLSDARNFGLEKSRGEFITFLDSDDYFEPYALELLITIQKKYDVDIVSTKGGITY120

Query:  121 FNNTYNTSINSQYLKEIKLYTLEVALEEMYYGKTYGVSPLAKLYPRSNLLSNPYPEGKIH180
             ++ Y+ + ++       +K+ T +    L +YY       VS    KLY R +L     +P+GKI+
Sbjct:  121 SHDIYSKKLMAEDYLTVKILTNKEFLAAVYYNDEMTVSAWGKLYKR-DLFKTIFPKGKIY179

Query:  181 EDMDTTFKLISCASKIAVCDIVTAVVYFSDNSTTRTKFNERMLYFFRAIQNNIVFINLNF240
            ED+       + +       +A  D+       Y   S    + F++R    FF+AI +N   I      +
Sbjct:  180 EDLYVVAERLLNIKTVAHTDLPIYHYYQRQGSIVNSTFSDRQYDFFDAIDHNEAIIKKFY239

Query:  241 PHNTSLISAVIYNEVFGGIDICGKMIDFKLYDTVDYYRKKYRKYFKTILFNNNRISVKEKV300
             +   L++A+        V G  I     +    + +   + + Y+  ++ N +I   +K KV
Sbjct:  240 CGDKELLAALNAKRVIGSF-ILSNSAFYNSKNDITKIIRIIKPYYWEVIKNKKIPMKRKV298

Query:  301 KYILFISSIRYF                                               312
             +  +LF+  S    Y+
Sbjct:  299 QCVLFLLSPNYY                                               310
```

Possible site: 28
>>> Seems to have no N-terminal signal sequence
----- Final Results -----
  bacterial cytoplasm --- Certainty = 0.2065 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 37/111 (33%), Positives = 61/111 (54%), Gaps = 3/111 (2%)
Query:   1 MDKVSIIIPVYNVQSFLNECIESVLAQ-TYSNLEIILVNDGSTDNSGDIC-DYYSEIDGR 58
           M KVSII    YN   ++++ ++S L+Q T   +EII+++D STD+S +I   Y  + G+
Sbjct:   1 MYKVSIICTNYNKAPWISDALDSFLSQVTDFEVEIIVIDDASTDDSREILKSYQKKSSGK 60

Query:  59 I-FVFHKNNGGLSDARNYGISRATGDYIYLLDSDDYLYKEDAIERMVEFSE         108
           I  +F++ N G++          A G YI   D DDY      +++ V+  E
Sbjct:  61 IKLLFNETNIGITKTWIKACLYAKGKYIARCDGDDYWTDSFKLQKQVDVLE         111
```

Based on this analysis, it was predicted that these proteins and their epitopes could be useful antigens for vaccines or diagnostics.

Example 917

A DNA sequence (GBSx0972) was identified in *S. agalactiae* <SEQ ID 2789> which encodes the amino acid sequence <SEQ ID 2790>. This protein is predicted to be CpsK. Analysis of this protein sequence reveals the following:

Possible site: 52
>>> Seems to have an uncleavable N-term signal seq
----- Final Results -----
  bacterial membrane --- Certainty = 0.0000 (Not Clear) <succ>
    bacterial outside --- Certainty = 0.0000 (Not Clear) <succ>
      bacterial cytoplasm --- Certainty = 0.0000 (Not Clear) <succ>

No corresponding DNA sequence was identified in *S. pyogenes*.
Based on this analysis, it was predicted that this protein and its epitopes, could be useful antigens for vaccines or diagnostics.

Example 918

A DNA sequence (GBSx0973) was identified in *S. agalactiae* <SEQ ID 2791> which encodes the amino acid sequence <SEQ ID 2792>. Analysis of this protein sequence reveals the following:

Possible site: 31
>>> Seems to have no N-terminal signal sequence
----- Final Results -----
  bacterial cytoplasm --- Certainty = 0.1956 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.
No corresponding DNA sequence was identified in *S. pyogenes*.
Based on this analysis, it was predicted that this protein and its epitopes, could be useful antigens for vaccines or diagnostics.

Example 919

A DNA sequence (GBSx0974) was identified in *S. agalactiae* <SEQ ID 2793> which encodes the amino acid sequence <SEQ ID 2794>. This protein is predicted to be capsular polysaccharide. Analysis of this protein sequence reveals the following:

Possible site: 36
>>> Seems to have an uncleavable N-term signal seq
INTEGRAL    Likelihood = -8.81    Transmembrane 89-105 (80-112)
INTEGRAL    Likelihood = -7.01    Transmembrane 439-455 (428-460)
INTEGRAL    Likelihood = -6.74    Transmembrane 322-338 (317-342)
INTEGRAL    Likelihood = -4.88    Transmembrane 175-191 (174-195)
INTEGRAL    Likelihood = -3.45    Transmembrane 146-162 (145-166)
INTEGRAL    Likelihood = -3.08    Transmembrane 381-397 (375-398)
INTEGRAL    Likelihood = -2.50    Transmembrane 413-429 (412-430)
INTEGRAL    Likelihood = -1.91    Transmembrane 206-222 (205-222)
INTEGRAL    Likelihood = -1.59    Transmembrane 354-370 (354-372)
INTEGRAL    Likelihood = -1.54    Transmembrane 43-59 (43-61)
INTEGRAL    Likelihood = -0.22    Transmembrane 252-268 (252-268)
----- Final Results -----
  bacterial membrane --- Certainty = 0.4524 (Affirmative) <succ>
    bacterial outside --- Certainty = 0.0000 (Not Clear) <succ>
      bacterial cytoplasm --- Certainty = 0.0000 (Not Clear) <succ>

No corresponding DNA sequence was identified in *S. pyogenes*.
Based on this analysis, it was predicted that this protein and its epitopes, could be useful antigens for vaccines or diagnostics.

Example 920

A DNA sequence (GBSx0975) was identified in *S. agalactiae* <SEQ ID 2795> which encodes the amino acid sequence <SEQ ID 2796>. This protein is predicted to be NeuB. Analysis of this protein sequence reveals the following:

Possible site: 30
>>> Seems to have no N-terminal signal sequence
----- Final Results -----
  bacterial cytoplasm --- Certainty = 0.2992 (Affirmative) <succ>
    bacterial membrane --- Certainty = 0.0000 (Not Clear) <succ>
      bacterial outside --- Certainty = 0.0000 (Not Clear) <succ>

No corresponding DNA sequence was identified in *S. pyogenes*.
Based on this analysis, it was predicted that this protein and its epitopes, could be useful antigens for vaccines or diagnostics.

Example 921

A DNA sequence (GBSx0976) was identified in *S. agalactiae* <SEQ ID 2797> which encodes the amino acid sequence <SEQ ID 2798>. This protein is predicted to be NeuC. Analysis of this protein sequence reveals the following:

Possible site: 41
>>> Seems to have no N-terminal signal sequence
----- Final Results -----
  bacterial cytoplasm --- Certainty = 0.3150 (Affirmative) <succ>
    bacterial membrane --- Certainty = 0.0000 (Not Clear) <succ>
      bacterial outside --- Certainty = 0.0000 (Not Clear) <succ>

No corresponding DNA sequence was identified in *S. pyogenes*.

Based on this analysis, it was predicted that this protein and its epitopes, could be useful antigens for vaccines or diagnostics.

Example 922

A DNA sequence (GBSx0977) was identified in *S. agalactiae* <SEQ ID 2799> which encodes the amino acid sequence <SEQ ID 2800>. This protein is predicted to be neuD. Analysis of this protein sequence reveals the following:

Possible site: 16
>>> Seems to have no N-terminal signal sequence
----- Final Results -----
  bacterial membrane --- Certainty = 0.0000 (Not Clear) <succ>
    bacterial outside --- Certainty = 0.0000 (Not Clear) <succ>
      bacterial cytoplasm --- Certainty = 0.0000 (Not Clear) <succ>

There is homology to SEQ ID 542.

Based on this analysis, it was predicted that this protein and its epitopes, could be useful antigens for vaccines or diagnostics.

Example 923

A DNA sequence (GBSx0979) was identified in *S. agalactiae* <SEQ ID 2801> which encodes the amino acid sequence <SEQ ID 2802>. Analysis of this protein sequence reveals the following:

Possible site: 33
>>> Seems to have no N-terminal signal sequence
----- Final Results -----
  bacterial cytoplasm --- Certainty = 0.2576 (Affirmative) <succ>
    bacterial membrane --- Certainty = 0.0000 (Not Clear) <succ>
      bacterial outside --- Certainty = 0.0000 (Not Clear) <succ>

No corresponding DNA sequence was identified in *S. pyogenes*.

Based on this analysis, it was predicted that this protein and its epitopes, could be useful antigens for vaccines or diagnostics.

Example 924

A DNA sequence (GBSx0980) was identified in *S. agalactiae* <SEQ ID 2803> which encodes the amino acid sequence <SEQ ID 2804>. Analysis of this protein sequence reveals the following:

Possible site: 49
>>> Seems to have no N-terminal signal sequence
----- Final Results -----
  bacterial cytoplasm --- Certainty = 0.1621 (Affirmative) <succ>
    bacterial membrane --- Certainty = 0.0000 (Not Clear) <succ>
      bacterial outside --- Certainty = 0.0000 (Not Clear) <succ>

A related GBS nucleic acid sequence <SEQ ID 9875> which encodes amino acid sequence <SEQ ID 9876> was also identified.

A related DNA sequence was identified in *S. pyogenes* <SEQ ID 2805> which encodes the amino acid sequence <SEQ ID 2806>. Analysis of this protein sequence reveals the following:

Possible site: 51
>>> Seems to have no N-terminal signal sequence
----- Final Results -----
  bacterial cytoplasm --- Certainty = 0.1066 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 83/139 (59%), Positives = 111/139 (79%)
Query:    6 TETHDHQALIQKLLVSIHYLTLFRDEIILVEKTPSLLGKHFSIAIVQNELGEILSKIEAL 65
            TE + HQ LIQKLLVSIHYLTLFRDE+ LVE+TPS+LG  F   +VQ+ELG+I++ I+ L
Sbjct:    4 TEQNSHQILIQKLLVSIHYLTLFRDELKLVERTPSILGGEFPAHLVQSELGDIVAAIDTL 63

Query:   66 SKQKKLIRSIYWYDESSFKVMNKALAIVEEWIKGLDNLLEFCQSQTVFQAILGDERAHVF 125
            Q++LI S +WY+ES+FK+MNK L IV+ WIKG+D+L++ CQS+ VFQ I+GD+R   VF
Sbjct:   64 DMQQRLIESTFWYEESAFKLMNKTLDIVDNWIKGVDHLIDLCQSKEVFQIIIGDKRIRVF 123

Query:  126 GILIDVYTSLNIINTSLKE                                         144
            G+L DV++SL +   SLKE
Sbjct:  124 GVLSDVFSSLKVSALSLKE                                         142
```

Based on this analysis, it was predicted that these proteins and their epitopes could be useful antigens for vaccines or diagnostics.

Example 925

A DNA sequence (GBSx0981) was identified in *S. agalactiae* <SEQ ID 2807> which encodes the amino acid sequence <SEQ ID 2808>. This protein is predicted to be uracil-DNA glycosylase (ung). Analysis of this protein sequence reveals the following:

```
Possible site: 34
>>> Seems to have no N-terminal signal sequence
----- Final Results -----
   bacterial cytoplasm --- Certainty = 0.3427 (Affirmative) <succ>
      bacterial membrane --- Certainty = 0.0000 (Not Clear) <succ>
         bacterial outside --- Certainty = 0.0000 (Not Clear) <succ>
```

A related DNA sequence was identified in *S. pyogenes* <SEQ ID 2809> which encodes the amino acid sequence <SEQ ID 2810>. Analysis of this protein sequence reveals the following:

```
Possible site: 33
>>> Seems to have no N-terminal signal sequence
----- Final Results -----
   bacterial cytoplasm --- Certainty = 0.4200 (Affirmative) <succ>
      bacterial membrane --- Certainty = 0.0000 (Not Clear) <succ>
         bacterial outside --- Certainty = 0.0000 (Not Clear) <succ>
```

An alignment of the GAS and GBS proteins is shown below.

```
Identities = 160/216 (74%), Positives = 185/216 (85%)
Query:    1 MKHSSWHDLIKRELPNHYYNKINTFMDAVYESGIVYPPRDKVFNAIQITPLENVKVVIIG 60
            M HS WH+ IK  LP HYY +IN F+D  Y SG+VYPPR+ VF A+Q+TPLE  KV+I+G
Sbjct:    1 MAHSIWHEKIKSFLPEHYYGRINHFLDEAYASGLVYPPRENVFKALQVTPLEETKVLILG 60

Query:   61 QDPYHGPQQAQGLSFSVPDNLPAPPSLQNILKELAEDIGSRSHHDLTSWAQQGVLLLNAC 120
            QDPYHGP+QAQGLSFSVP+ + APPSL NILKELA+DIG R HHDL++WA QGVLLLNAC
Sbjct:   61 QDPYHGPKQAQGLSFSVPEEISAPPSLININILKELADDIGPRDHHDLSTWASQGVLLLNAC 120

Query:  121 LTVPEHQANGHAGLIWEPFTDAVIKVVNQKETPVVFILWGGYARKKKSLIDNPIHHIIES 180
            LTVP  QANGHAGLIWEPFTDAVIKV+N+K++PVVFILWG YARKKK+ I NP HHIIES
Sbjct:  121 LTVPAGQANGHAGLIWEPFTDAVIKVLNEKDSPVVFILWGAYARKKKAFITNPKHHIIES 180

Query:  181 PHPSPLSAYRGFFGSRPFSRTNHFLEEEGINEIDWL                        216
            PHPSPLS+YRGFFGS+PFSRTN  LE+EG+  +DWL
Sbjct:  181 PHPSPLSSYRGFFGSKPFSRTNAILEKEGMTGVDWL                        216
```

Based on this analysis, it was predicted that these proteins and their epitopes could be useful antigens for vaccines or diagnostics.

Example 926

A DNA sequence (GBSx0982) was identified in *S. agalactiae* <SEQ ID 2811> which encodes the amino acid sequence <SEQ ID 2812>. Analysis of this protein sequence reveals the following:

```
Possible site: 20
>>> Seems to have an uncleavable N-term signal seq
INTEGRAL    Likelihood = -11.15   Transmembrane 147-163 (109-166)
INTEGRAL    Likelihood = -8.92    Transmembrane 124-140 (109-146)
INTEGRAL    Likelihood = -6.16    Transmembrane 167-183 (166-186)
INTEGRAL    Likelihood = -4.67    Transmembrane 3-19 (1-23)
INTEGRAL    Likelihood = -3.98    Transmembrane 72-88 (64-92)
INTEGRAL    Likelihood = -1.06    Transmembrane 106-122 (105-122)
INTEGRAL    Likelihood = -0.90    Transmembrane 54-70 (54-70)
----- Final Results -----
   bacterial membrane --- Certainty = 0.5458 (Affirmative) <succ>
      bacterial outside --- Certainty = 0.0000 (Not Clear) <succ>
         bacterial cytoplasm --- Certainty = 0.0000 (Not Clear) <succ>
```

A related GBS nucleic acid sequence <SEQ ID 9873> which encodes amino acid sequence <SEQ ID 9874> was also identified.

The protein has homology with the following sequences in the GENPEPT database.

```
>GP:CAA91549 GB:Z67739 unidentified [Streptococcus pneumoniae]
   Identities = 134/212 (63%), Positives = 168/212 (79%)
   Query:    1 MNIIIMIIIAYLLGSIQTGLWIGKYPYQVNLRQHGSGNTGTTNTFRILGVKAGIVTLTID 60
              M  I+++I+AYLLGSI +GLWIG+ F+Q+NLR+HGSGNTGTTNTFRILG KAG+ T   ID
   Sbjct:    1 MITIVLLILAYLLGSIPSGLWIGQVFFQINLREHGSGNTGTTNTFRILGKKAGMATFVID 60

Query:   61 ILKGTLATLIPIILGITTVSPFFIGFFAIIGHTFPIFAQFKGGKAVATSAGVLLGFAPSF 120
              KGTLATL+PII +  VSP  G  A+IGHTFPIFA FKGGKAVATSAGV+ GFAP F
   Sbjct:   61 FFKGTLATLLPIIFHLQGVSPLIFGLLAVIGHTFPIFAGFKGGKAVATSAGVIFGFAPIF 120

Query:  121 FLYLLVIFLLTLYLFSMISLSSITVAVVGILSVLIFPLVGFILTDYDWIFTTVVILMALT 180
              LYL +IF   LYL SMISLSS+T ++   ++VL+FPL GFIL++YD++F  +++ +A
   Sbjct:  121 CLYLAIIFFGALYLGSMISLSSVTASIAAVIGVLLFPLFGFILSNYDFLFIAIILALASL 180
```

```
                              -continued
Query: 181 IIIRHQDNIKRIRKRQENLVPFGLNLSKQKNK            212
           IIIRH+DNI RI+ + ENLVP+GLNL+ Q  K
Sbjct: 181 IIIRHKDNIARIKNKTENLVPWGLNLTHQDPK            212
```

A related DNA sequence was identified in *S. pyogenes* <SEQ ID 2813> which encodes the amino acid sequence <SEQ ID 2814>. Analysis of this protein sequence reveals the following:

```
Possible site: 17
>>> Seems to have no N-terminal signal sequence
INTEGRAL    Likelihood = -10.83   Transmembrane 194-210 (191-216)
INTEGRAL    Likelihood = -9.77    Transmembrane 146-162 (132-191)
INTEGRAL    Likelihood = -7.70    Transmembrane 165-181 (163-191)
INTEGRAL    Likelihood = -5.89    Transmembrane 23-39 (19-47)
INTEGRAL    Likelihood = -4.83    Transmembrane 95-111 (91-118)
----- Final Results -----
    bacterial membrane --- Certainty = 0.5331 (Affirmative) <succ>
       bacterial outside --- Certainty = 0.0000 (Not Clear) <succ>
          bacterial cytoplasm --- Certainty = 0.0000 (Not Clear) <succ>
```

The protein has homology with the following sequences in the databases:

```
>GP:CAA91549 GB:Z67739 unidentified [Streptococcus pneumoniae]
Identities = 138/213 (64%), Positives = 166/213 (77%)
Query:   28 MKLLLFITIAYLLGSIPTGLWIGQYFYHINLREHGSGNTGTTNTFRILGVKAGTATLAID   87
            M  ++ + +AYLLGSIP+GLWIGQ F+  INLREHGSGNTGTTNTFRILG KAG AT   ID
Sbjct:    1 MITIVLLILAYLLGSIPSGLWIGQVFFQINLREHGSGNTGTTNTFRILGKKAGMATFVID   60

Query:   88 MFKGTLSILLPIIFGMTSISSIAIGFFAVLGHTFPIFANFKGGKAVATSAGVLLGFAPLY  147
            FKGTL+ LLPIIF +  +s +   G  AV+GHTFPIFA FKGGKAVATSAGV+ GFAP++
Sbjct:   61 FFKGTLATLLPIIFHLQGVSPLIFGLLAVIGHTFPIFAGFKGGKAVATSAGVIFGFAPIF  120

Query:  148 LFFLASIFVLVLYLFSMISLASVVSAIVGVLSVLTFPAIHFLLPNYDYFLTFIVILLAFI  207
            +LA IF    LYL SMISL+SV ++I  V+ VL FP    F+L NYD+    I++ LA +
Sbjct:  121 CLYLAIIFFGALYLGSMISLSSVTASIAAVIGVLLFPLFGFILSNYDFLFIAIILALASL  180

Query:  208 IIIRHKDNISRIKHHTENLIPWGLNLSKQVPKK                            240
            IIIRHKDNI+RIK+ TENL+PWGLNL+ Q PKK
Sbjct:  181 IIIRHKDNIARIKNKTENLVPWGLNLTHQDPKK                            213
```

An alignment of the GAS and GBS proteins is shown below.

```
Identities = 143/212 (6796), Positives = 174/212 (81%)
Query:    1 MNIIIMIIIAYLLGSIQTGLWIGKYFYQVNLRQHGSGNTGTTNTFRILGVKAGIVTLTID   60
            M +++ I  IAYLLGSI TGLWIG+YFY +NLR+HGSGNTGTTNTFRILGVKAG  TL ID
Sbjct:   28 MKLLLFITIAYLLGSIPTGLWIGQYFYHINLREHGSGNTGTTNTFRILGVKAGTATLAID   87

Query:   61 ILKGTLATLIPIILGITTVSPFFIGFFAIIGHTFPIFAQFKGGKAVATSAGVLLGFAPSF  120
            + KGTL+ L+PII G+T++S   IGFFA++GHTFPIFA FKGGKAVATSAGVLLGFAP +
Sbjct:   88 MFKGTLSILLPIIFGMTSISSIAIGFFAVLGHTFPIFANFKGGKAVATSAGVLLGFAPLY  147

Query:  121 FLYLLVIFLLTLYLFSMISLSSITVAVVGILSVLIFPLVGFILTDYDWIFTTVVILMALT  180
            +L  IF+L LYLFSMISL+S+  A+VG+LSVL FP + F+L +YD+  T +VIL+A
Sbjct:  148 LFFLASIFVLVLYLFSMISLASVVSAIVGVLSVLTFPAIHFLLPNYDYFLTFIVILLAFI  207

Query:  181 IIIRHQDNIKRIRKRQENLVPFGLNLSKQKNK                              212
            IIIRH+DNI RI+    ENL+P+GLNLSKQ  K
Sbjct:  208 IIIRHKDNISRIKHHTENLIPWGLNLSKQVPK                              239
```

Based on this analysis, it was predicted that these proteins and their epitopes could be useful antigens for vaccines or diagnostics.

Example 927

A DNA sequence (GBSx0983) was identified in *S. agalactiae* <SEQ ID 2815> which encodes the amino acid sequence <SEQ ID 2816>. Analysis of this protein sequence reveals the following:

```
Possible site: 18
>>> Seems to have an uncleavable N-term signal seq
----- Final Results -----
    bacterial membrane --- Certainty = 0.0000 (Not Clear) <succ>
       bacterial outside --- Certainty = 0.0000 (Not Clear) <succ>
          bacterial cytoplasm --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 928

A DNA sequence (GBSx0984) was identified in *S. agalactiae* <SEQ ID 2817> which encodes the amino acid sequence <SEQ ID 2818>. Analysis of this protein sequence reveals the following:

```
Possible site: 56
>>> Seems to have no N-terminal signal sequence
----- Final Results -----
    bacterial cytoplasm --- Certainty = 0.1585 (Affirmative) <succ>
    bacterial membrane --- Certainty = 0.0000 (Not Clear) <succ>
    bacterial outside --- Certainty = 0.0000 (Not Clear) <succ>
```

A related GBS nucleic acid sequence <SEQ ID 9871> which encodes amino acid sequence <SEQ ID 9872> was also identified.

The protein has homology with the following sequences in the GENPEPT database.

A related DNA sequence was identified in *S. pyogenes* <SEQ ID 2819> which encodes the amino acid sequence <SEQ ID 2820>. Analysis of this protein sequence reveals the following:

```
Possible site: 53
>>> Seems to have no N-terminal signal sequence
----- Final Results -----
    bacterial cytoplasm --- Certainty = 0.1518 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
>GP:CAA91550 GB:Z67739 DNA topoisomerase IV [Streptococcus pneumoniae] (ver 2)
Identities = 574/649 (88%), Positives = 617/649 (94%), Gaps = 2/649 (0%)
Query:     5 LAKQDITVTNYGDDAIQVLEGLDAVRKRPGMYIGSTDGTGLHHLVWEIVDNAVDEALSGF    64
             ++K++I + NY DDAIQVLEGLDAVRKRPGMYIGSTDG GLHHLVWEIVDNAVDEALSGF
Sbjct:     1 MSKKEININNYNDDAIQVLEGLDAVRKRPGMYIGSTDGAGLHHLVWEIVDNAVDEALSGF    60

Query:    65 GNRIDVIINKDGSITVTDHGRGMPTGMHAMGKPTVEVIFTVLHAGGKFGQGGYKTSGGLH   124
             G+RIDV INKDGS+TV DHGRGMPTGMHAMG PTVEVIFT+LHAGGKFGQGGYKTSGGLH
Sbjct:    61 GDRIDVTINKDGSLTVQDHGRGMPTGMHAMGIPTVEVIFTILHAGGKFGQGGYKTSGGLH   120

Query:   125 GVGSSVVNALSSWLEVEIIRDGAIYRQRFENGGKPVTTLKKIGTAPKSKSGTSVSEMPDQ   184
             GVGSSVVNALSSWLEVEI RDGA+Y+QRFENGGKPVTTLKKIGTAPKSK+GT V+FMPD
Sbjct:   121 GVGSSVVNALSSWLEVEITRDGAVYKQRFENGGKPVTTLKKIGTAPKSKTGTKVTFMPDA   180

Query:   185 SVFSTIDFKFNTIAERLKESAFLLKNVTLTLTDNRSEEAEHLEFHYENGVQDFVEYLNED   244
             ++FST DFK+NTI+ERL ESAFLLKNVTL+LTD R++EA  +EFHYENGVQDFV YLNED
Sbjct:   181 TIFSTTDFKYNTISERLNESAFLLKNVTLSLTDKRTDEA--IEFHYENGVQDFVSYLNED   238

Query:   245 KETLTPIMFFEGEEQEFHIEVALQYNDGFSDNILSFVNNVRTKDGGTHETGLKSAITKSM   304
             KE LTP+++FEGE+  F +EVALQYNDGFSDNILSFVNNVRTKDGGTHETGLKSAITK M
Sbjct:   239 KEILTPVLYFEGEDNGFQVEVALQYNDGESDNILSFVNNVRTKDGGTHETGLKSAITKVM   298

Query:   305 NDYARKTGLLKEKDKNLEGSDYREGLSAILSILVPEEHLQFEGQTKDKLGSPLARPIVDG   364
             NDYARKTGLLKEKDKNLEGSDYREGL+A+LSILVPEEHLQFEGQTKDKLGSPLARP+VDG
Sbjct:   299 NDYARKTGLLKEKDKNLEGSDYREGLAAVLSILVPEEHLQFEGQTKDKLGSPLARPVVDG   358

Query:   365 IVSEKLTYFLMENGDLASNLIRKAIKARDAREAARKARDESRNGKESKKDKGLLSGKLTP   424
             IV++KLT+FLMENG+LASNLIRKAIKARDAREAARKARDESRNGK+KKDKGLLSGKLTP
Sbjct:   359 IVADKLTFFLMENGELASNLIRKAIKARDAREAARKARDESRNGKENKKDKGLLSGKLTP   418

Query:   425 AQSKNAKKNELYLVEGDSAGGSAKQGRDRKFQAILPLRGKVLNTAKAKMADIIKNEEINT   484
             AQSKN  KNELYLVEGDSAGGSAKQGRDRKFQAILPLRGKV+NTAKAKMADI+KNEEINT
Sbjct:   419 AQSKNPAKNELYLVEGDSAGGSAKQGRDRKFQAILPLRGKVINTAKAKMADILKNEEINT   478

Query:   485 MIHTIGAGVGPDFNLDDINYDKIIIMTDADTDGAHIQTLLLTFFYRMPRPLVEEGHVYIA   544
             MI+TIGAGVG DF+++D NYDKIIIMTDADTDGAHIQTLLLTFFYRMPRPLVE GHVYIA
Sbjct:   479 MIYTIGAGVGADFSIEDANYDKIIIMTDADTDGAHIQTLLLTFFYRMPRPLVEAGHVYIA   538

Query:   545 LPPLYKMSKGKGKKEIVEYAWTDIELEELRQKFGKGSLLQRYKGLGEMNADQLWETTMNP   604
             LPPLYKMSKGKGKKE V YAWTD ELEELR++FGKG+ LQRYKGLGEMNADQLWETTMNP
Sbjct:   539 LPPLYKMSKGKGKKEEVAYAWTDGELEELRKQFGKGATLQRYKGLGEMNADQLWETTMNP   598

Query:   605 ETRTLIRVTIEDLARAERRVNVLMGDKVPPRRQWIEDNVKFTLEENTVF   653
             ETRTLIRVTIEDLARAERRVNVLMGDKV PRR+WIEDNVKFTLEE TVF
Sbjct:   599 ETRTLIRVTIEDLARAERRVNVLMGDKVEPRRKWIEDNVKFTLEEATVF   647
```

```
Identities = 560/649 (86%), Positives = 615/649 (94%)
Query:    5 LAKQDITVTNYGDDAIQVLEGLDAVRKRPGMYIGSTDGTGLHHLVWEIVDNAVDEALSGF  64
            L K++IT+ NY DDAIQVLEGLDAVRKRPGMYIGSTD TGLHHL+WEIVDNAVDEALSGF
Sbjct:    2 LTKKEITINNYNDDAIQVLEGLDAVRKRPGMYIGSTDATGLHHLIWEIVDNAVDEALSGF  61

Query:   65 GNRIDVIINKDGSITVTDHGRGMPTGMHAMGKPTVEVIFTVLHAGGKFGQGGYKTSGGLH 124
            G+ I V+INKDGS++V D GRGMPTG HAMG PTV+VIFT+LHAGGKFGQGGYKTSGGLH
Sbjct:   62 GDDIKVVINKDGSVSVADSGRGMPTGQHAMGIPTVQVIFTILHAGGKFGQGGYKTSGGLH 121

Query:  125 GVGSSVVNALSSWLEVEIIRDGAIYRQRFENGGKPVTTLKKIGTAPKSKSGTSVSFMPDQ 184
            GVGSSVVNALS+WLEVEI RDG++YRQRFENGGKPVTTLKK+GTAPKSKSGT V+FMPD
Sbjct:  122 GVGSSVVNALSAWLEVEITRDGSVYRQRFENGGKPVTTLKKVGTAPKSKSGTVVTFMPDD 181

Query:  185 SVFSTIDFKFNTIAERLKESAFLLKNVTLTLTDNRSEEAEHLEFHYENGVQDFVEYLNED 244
             +FSTIDFKFNTI+ERLKESAFLLKNV ++LTD R ++    EFHYENGVQDFVEYLNED
Sbjct:  182 KIFSTIDFKFNTISERLKESAFLLKNVKMSLTDLRGDDPIIEEFHYENGVQDFVEYLNED 241

Query:  245 KETLTPIMFFEGEEQEFHIEVALQYNDGFSDNILSFVNNVRTKDGGTHETGLKSAITKSM 304
            KETLTP+++  EG++Q+F  +EVALQYNDGFSDNILSFVNNVRTKDGG+HETGLKSAITK+M
Sbjct:  242 KETLTPVIYMEGQDQDFQVEVALQYNDGFSDNILSFVNNVRTKDGGSHETGLKSAITKAM 301

Query:  305 NDYARKTGLLKEKDKNLEGSDYREGLSAILSILVPEEHLQFEGQTKDKLGSPLARPIVDG 364
            NDYARKT LLKEKDKNLEGSDYREGLSA+LSILVPE+HLQFEGQTKDKLGSPLARPIV+
Sbjct:  302 NDYARKTNLLKEKDKNLEGSDYREGLSAVLSILVPEQHLQFEGQTKDKLGSPLARPIVES 361

Query:  365 IVSEKLTYFLMENGDLASNLIRKAIKARDAREAARKARDESRNGKKSKKDKGLLSGKLTP 424
            IVSEKLT+FL+ENG++AS+L+RKAIKARDAREAARKARD+SRNGKK+KKDKGLLSGKLTP
Sbjct:  362 IVSEKLTFELLENGEVASHLVRKAIKARDAREAARKARDDSRNGKKNKKDKGLLSGKLTP 421

Query:  425 AQSKNAKKNELYLVEGDSAGGSAKQGRDRKFQAILPLRGKVINTAKAKMADIIKNEEINT 484
            AQSKNAKKNELYLVEGDSAGGSAKQGRDRKFQAILPLRGKVLNT KAKMADI+KNEEINT
Sbjct:  422 AQSKNAKKNELYLVEGDSAGGSAKQGRDRKFQAILPLRGKVLNTEKAKMADILKNEEINT 481

Query:  485 MIHTIGAGVGPDFNLDDINYDKIIIMTDADTDGAHIQTLLLTFFYRYMRPLVEEGHVYIA 544
            M++TIGAGVG DFNL+DINYDKIIIMTDADTDGAHIQTLLLTFFYRYMRPLVE GHVYIA
Sbjct:  482 MVYTIGAGVGADFNLEDINYDKIIIMTDADTDGAHIQTLLLTFFYRYMRPLVEAGHVYIA 541

Query:  545 LPPLYKMSKGKGKKEIVEYAWTDIELEELRQKFGKGSLLQRYKGLGEMNADQLWETTMNP 604
            LPPLYKMSKGKGK E + YAWTD ELE+LR++FGKG++LQRYKGLGEMNA+QLWETTM+P
Sbjct:  542 LPPLYKMSKGKGKTEKIAYAWTDGELEDLRREFGKGAILQRYKGLGEMNANQLWETTMDP 601

Query:  605 ETRTLIRVTIEDLARAERRVNVLMGDKVPPRRQWIEDNVKFTLEENTVF            653
            ETRTLIRVTI+DLARAERRV+VLMGDK  PRRQWIEDNVKFTLEENTVF
Sbjct:  602 ETRTLIRVTIDDLARAERRVSVLMGDKAAPRRQWIEDNVKFTLEENTVF            650
```

Based on this analysis, it was predicted that these proteins and their epitopes could be useful antigens for vaccines or diagnostics.

Example 929

A DNA sequence (GBSx0985) was identified in *S. agalactiae* <SEQ ID 2821> which encodes the amino acid sequence <SEQ ID 2822>. Analysis of this protein sequence reveals the following:

Possible site: 49
>>> Seems to have no N-terminal signal sequence
INTEGRAL   Likelihood = –0.80   Transmembrane 378-394 (378-394)
----- Final Results -----
  bacterial membrane --- Certainty = 0.1319 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

```
>GP:AAD34369 GB:AF129764 ParC [Streptococcus mitis]
Identities = 640/820 (78%), Positives = 722/820 (88%), Gaps = 5/820 (0%)
Query:    1 MSNIQNMSLEDIMGERFGRYSKYIIQERALPDIRDGLKPVQRRILYSMNKDGNTFEKGFR  60
            MSNIQNMSLEDIMGERFGRYSKYIIQ+RALPDIRDGLKPVQRRILYSMNKDGNTF+K +R
Sbjct:    1 MSNIQNMSLEDIMGERFGRYSKYIIQDRALPDIRDGLKPVQRRILYSMNKDGNTFDKSYR  60

Query:   61 KSAKSVGNVMGNFHPHGDSSIYDAMVRMSQDWKNRETLIEMHGNNGSMDGDPAAAMRYTE 120
            KSAKSVGN+MGNFHPHGDSSIYDAMVRMSQDWKNRE L+EMHGNNGSMDGDP AAMRYTE
Sbjct:   61 KSAKSVGNIMGNFHPHGDSSIYDAMVRMSQDWKNREILVEMHGNNGSMDGDPPAAMRYTE 120

Query:  121 ARLSEIAGYLLQDIDKNTVPFAWNFDDTEKEPTVLPAAFPNLLVNGATGISAGYATDIPP 180
            ARLSEIAGYLLQDIDK TVPF+WNFDDTEKEPTVLPAAFPNLLVNG+TGISAGYATDIPP
Sbjct:  121 ARLSEIAGYLLQDIDKKTVPFSWNFDDTEKEPTVLPAAFPNLLVNGSTGISAGYATDIPP 180

Query:  181 HNLAEVIDAVVYMIDHPKAKLDKLMEFLPGPDFPTGAIIQGKDEIRKAYETGKGRVAVRS 240
            HNLAEVIDA VYMIDHP AK+DKLMEFLPGPDFPTG IIQG+DEI+KAYETGKGRV VRS
Sbjct:  181 HNLAEVIDAAVYMIDHPTAKVDKLMEFLPGPDFPTGGIIQGRDEIKKAYETGKGRVVVRS 240
```

```
Query:  241 RTAIETLKGGKKQIIVTEIPYEVNKSVLVKRIDDVRVNNKVPGIAEVRDESDRDGLRIAI 300
            +T IE LKGGK+QI++TEIPYE+NK+ LVK+IDDVRVN+KV GIAEVRDESDRDGLRIAI
Sbjct:  241 KTEIEKLKGGKEQIVITEIPYEINKANLVKKIDDVRVNSKVAGIAEVRDESDRDGLRIAI 300

Query:  301 ELKKEADETIVLNYLFKYTDLQVNYNFNMVAIDDYTPKQVGLSRILTSYIAHRREIIIAR 360
            ELKK+A+  +VLNYLFKYTDLQ+NYNFNMVAID++TP+QVG+  IL+SYIAHRRE+I+AR
Sbjct:  301 ELKKDANTELVLNYLFKYTDLQINYNFNMVAIDNFTPRQVGIVPILSSYIAHRREVILAR 360

Query:  361 SKFDKEKAEKRLHIVEGLIRVLSILDEVIALIRASENKADAKENLKVSYEFSEAQAEAIV 420
            S+FDKEKAEKRLHIVEGLIRV+SILDEVIALIRASENKADAKENLKVSY+F+E QAEAIV
Sbjct:  361 SRFDKEKAEKRLHIVEGLIRVISILDEVIALIRASENKADAKENLKVSYDFTEEQAEAIV 420

Query:  421 TLQLYRLTNTDIVTLREEEEELRQQITMLKAIISDERTMYNVMKRELREVKKKFANTRRS 480
            TLQLYRLTNTD+V L+EEE ELR++I ML AII DERTMYN+MK+ELREVKKKFA  R S
Sbjct:  421 TLQLYRLTNTDVVVLQEEEAELREKIAMLAAIIGDERTMYNLMKKELREVKKKFATPRLS 480

Query:  481 ELQELAETIEIDTASLIIEEDTYVSVTRGGYVKRTSPRSFNASTVDELGKREDDELIFVS 540
            L++ A+ IEIDTASLI EEDTYVSVT+ GY+KRTSPRSF AST++E+GKR+DD LIFV
Sbjct:  481 SLEDTAKAIEIDTASLIAEEDTYVSVTKAGYIKRTSPRSFAASTLEEIGKRDDDRLIFVQ 540

Query:  541 NAKTTQHLLMFTNLGNLAYRPVHELADIRWKDVGEHLSQNLVNFASNEEIIYAELVDDF- 599
            +AKTTQHLLMFT LGN+ YRP+HELADIRWKD+GEHLSQ + NF +NEEI+Y E+VD F
Sbjct:  541 SAKTTQHLLMFTTLGNVIYRPIHELADIRWKDIGEHLSQTITNFETNEEILYVEVVDQFD 600

Query:  600 TKETYFAVTSLGQIKRFERQEISPWRTYKSKTAKYAKLKSVEDYVVTVAPIQLEDVILVT 659
             TYFA T LGQIKR ER+E +PWRTYKSK+ KYAKLK    D +V VAPI+L+DV+L++
Sbjct:  601 DATTYFAATRLGQIKRVERKEFTPWRTYKSKSVKYAKLKDDTDQIVAVAPIKLDDVLLIS 660

Query:  660 YNGYALRFSINDVPVVGSKAAGVKAMNLKDRDHIVSAFIANTTSLYLLTHRGSLKRMAID 719
            NGYALRF+I +VPVVG+KAAGVKAMNLK+ D + SAFI NT+S YLLT RGSLKR++ID
Sbjct:  661 QNGYALRFNIEEVPVVGAKAAGVKAMNLKEDDTLQSAFICNTSSFYLLTQRGSLKRVSID 720

Query:  720 VIPTTSRANRGLQVLRELKSKPHRVFKAGPVYLEDSSFEFDLFSSVSNHEGDTFVLEIMS 779
               IP TSRA RGLQVLRELK+KPHRVF AG V  +  F DLFS+     T  L + S
Sbjct:  721 EIPATSRAKRGLQVLRELKNKPHRVFLAGSV--AEQGFVGDLFSTEVEENDQT--LLVQS 776

Query:  780 KTGKVYDVDLSQWSFSERTSNGSFVSDKISDEEVFSVKIK                   819
              G +Y+  L  + SERTSNGSF+SD ISDEEVF  +K
Sbjct:  777 NKGTIYESRLQDLNLSERTSNGSFISDTISDEEVFDAYLK                   816
```

A related DNA sequence was identified in *S. pyogenes* <SEQ ID 2823> which encodes the amino acid sequence <SEQ ID 2824>. Analysis of this protein sequence reveals the following:

Possible site: 51
>>> Seems to have no N-terminal signal sequence

INTEGRAL  Likelihood = –0.53  Transmembrane 376-392 (376-394)
----- Final Results -----
  bacterial membrane --- Certainty = 0.1213 (Affirmative) <succ>
  bacterial outside --- Certainty = 0.0000 (Not Clear) <succ>
  bacterial cytoplasm --- Certainty = 0.0000 (Not Clear) <succ>

An alignment of the GAS and GBS proteins is shown below.

```
Identities = 633/819 (77%), Positives = 719/819 (87%)
Query:    1 MSNIQNMSLEDIMGERFGRYSKYIIQERALPDIRDGLKPVQRRILYSMNKDGNTFEKGFR  60
            MSNIQNMSLEDIMGERFGRYSKYIIQERALPDIRDGLKPVQRRILYSMNKDGNTFEKG+R
Sbjct:    3 MSNIQNMSLEDIMGERFGRYSKYIIQERALPDIRDGLKPVQRRILYSMNKDGNTFEKGYR  62

Query:   61 KSAKSVGNVMGNFHPHGDSSIYDAMVRMSQDWKNRETLIEMHGNNGSMDGDPAAAMRYTE 120
            KSAKSVGN+MGNFHPHGDSSIYDAMVRMSQDWKNRE L+EMHGNNGSMDGDP AAMRYTE
Sbjct:   63 KSAKSVGNIMGNFHPHGDSSIYDAMVRMSQDWKNREILVEMHGNNGSMDGDPPAAMRYTE 122

Query:  121 ARLSEIAGYLLQDIDKNTVPFAWNFDDTEKEPTVLPAAFPNLLVNGATGISAGYATDIPP 180
            ARLSEIAGYLLQDI+KNTV FAWNFDDTEKEPTVLPAAFPNLLVNG++GISAGYATDIPP
Sbjct:  123 ARLSEIAGYLLQDIEKNTVSFAWNFDDTEKEPTVLPAAFPNLLVNGSSGISAGYATDIPP 182

Query:  181 HNLAEVIDAVVYMIDHPKAKLDKLMEFLPGPDFPTGAIIQGKDEIRKAYETGKGRVAVRS 240
            HNL+EVIDAVVYMIDHPKA L+KLMEFLPGPDFPTG IIQG DEI+KAYETGKGRV VRS
Sbjct:  183 HNLSEVIDAVVYMIDHPKASLEKLMEFLPGPDFPTGGIIQGADEIKKAYETGKGRVVVRS 242

Query:  241 RTAIETLKGGKKQIIVTEIPYEVNKSVLVKRIDDVRVNNKVPGIAEVRDESDRDGLRIAI 300
            RT IE LKGGK+QIIVTEIPYEVNK+VLVK+IDDVRVNNKVPGI EVRDESDR GLRIAI
Sbjct:  243 RTEIEELKGGKQQIIVTEIPYEVNKAVLVKKIDDVRVNNKVPGIVEVRDESDRTGLRIAI 302

Query:  301 ELKKEADETIVLNYLFKYTDLQVNYNFNMVAIDDYTPKQVGLSRILTSYIAHRREIIIAR 360
            ELKKEAD   +LNYL KYTDLQVNYNFNMVAID +TP+QVGL  +IL+SYI HR++III R
Sbjct:  303 ELKKEADSQTILNYLKYTDLQVNYNFNMVAIDHFTPRQVGLQKILSSYISHRKDIIIER 362
```

-continued
```
Query: 361 SKFDKEKAEKRLHIVEGLIRVLSILDEVIALIRASENKADAKENLKVSYEFSEAQAEAIV 420
           SKFDK KAEKRLHIVEGLIRVLSILDE+IALIR+S+NKADAKENLKVSY+FSE QAEAIV
Sbjct: 363 SKFDKARAEKRLHIVEGLIRVLSILDEIIALIRSSDNKADAKENLKVSYDFSEEQAEAIV 422

Query: 421 TLQLYRLTNTDIVTLREEEEELRQQITMLKAIISDERTMYNVMKRELREVKKKFANTRRS 480
           TLQLYRLTNTDIVTL+ EE +LR  IT L AII DE TMYNVMKRELREVKKKFAN R S
Sbjct: 423 TLQLYRLTNTDIVTLQNEENDLRDLITTLSAIIGDEATMYNVMKRELREVKKKFANPRLS 482

Query: 481 ELQELAETIEIDTASLIIEEDTYVSVTRGGYVKRTSPRSFNASTVDELGKREDDELIFVS 540
           ELQ  ++ IEIDTASLI EE+T+VSVTRGGY+KRTSPRSFNAS+++E+GKR+DDELIFV
Sbjct: 483 ELQAESQIIEIDTASLIAEEETFVSVTRGGYLKRTSPRSFNASSLEEVGKRDDDELIFVK 542

Query: 541 NAKTTQHLLMFTNLGNLAYRPVHELADIRWKDVGEHLSQNLVNFASNEEIIYAELVDDFT 600
           +AKTT+HLL+FT LGN+ YRP+HEL D+RWKD+GEHLSQ + NFA+ EEI+YA++V  F
Sbjct: 543 QAKTTEHLLLFTTLGNVIYRPIHELTDLRWKDIGEHLSQTISNFATEEEILYADIVTSFD 602

Query: 601 KETYFAVTSLGQIKRFERQEISPWRTYKSKTAKYAKLKSVEDYVVTVAPIQLEDVILVTY 660
           +  Y AVT  G IKRF+R+E+SPWRTYKSK+ KY KLK  +D VVT++P+ +ED++LVT
Sbjct: 603 QGLYVAVTQNGFIKRFDRKELSPWRTYKSKSTKYVKLKDDKDRVVTLSPVIMEDLLLVTK 662

Query: 661 NGYALRFSINDVPVVGSKAAGVEAMNLKDRDHIVSAFIANTTSLYLLTHRGSLKRMAIDV 720
           NGYALRFS  +VP+ G K+AGVK +NLK+ D + SAF    + S ++LT RGSLKRMA+D
Sbjct: 663 NGYALRFSSQEVPIQGLKSAGVKGINLKNDDSLASAFAVTSNSFFVLIQRGSLKRMAVDD 722

Query: 721 IPTTSRANRGLQVLRELKSKPHRVFKAGPVYLEDSSFEFDLFSSVSNHEGDIFVLEIMSK 780
           IP  TSRANRGL VLRELK+KPHRVF AG V + S+ +FDLF+ +    E +  +LE++SK
Sbjct: 723 IPQTSRANRGLLVLRELKTKPHRVFLAGGVQSDTSAEQFDLFTDIPEEETNQQMLEVISK 782

Query: 781 TGKVYDVDLSQWSFSERTSNGSFVSDKISDEEVFSVKIK                    819
           TG+ Y++  L   S SER SNGSF+SD ISD+EV  + +
Sbjct: 783 TGQTYEIALETLSLSERISNGSFISDTISDQEVLVARTR                    821
```

Based on this analysis, it was predicted that these proteins and their epitopes could be useful antigens for vaccines or diagnostics.

Example 930

A DNA sequence (GBSx0986) was identified in *S. agalactiae* <SEQ ID 2825> which encodes the amino acid sequence <SEQ ID 2826>. Analysis of this protein sequence reveals the following:

```
Possible site: 49
>>> Seems to have no N-terminal signal sequence
----- Final Results -----
  bacterial cytoplasm --- Certainty = 0.3369 (Affirmative) <succ>
  bacterial membrane --- Certainty = 0.0000 (Not Clear) <succ>
  bacterial outside --- Certainty = 0.0000 (Not Clear) <succ>
```

The protein has homology with the following sequences in the GENPEPT database.

```
>GP:AAF64593 GB:AF169649 branched-chain aminotransferase IlvE
[Lactococcus lactis]
Identities = 259/340 (76%), Positives = 294/340 (86%)
Query:   1 MTVNLDWDNLGFAYRKLPFRYISHFKDGKWDDGKLTDDATLHISESSPALHYGQQAFEGL 60
           M +NLDW+NLGF+YR LPFRYI+ FKDGKW  G+LT D  LHISESSPALHYGQQ FEGL
Sbjct:   1 MAINLDWENLGFSYRNLPFRYIARFKDGKWSAGELTGDNQLHISESSPALHYGQQGFEGL 60

Query:  61 KAYRTKDGSIQLFRPDQNAERLQRTADRLLMPHVPTDKFIAAVKSVVRANEEFVPPYGTG 120
           KAYRTKDGSIQLFRPDQNA RLQ+TA RL M  V T+ FI AVK VV+AN++FVPPYGTG
Sbjct:  61 KAYRTKDGSIQLFRPDQNAARLQKTARRLCMAEVSTEMFIDAVKQVVKANKDFVPPYGTG 120

Query: 121 ATLYIRPLLIGVGDIIGVKPAERYIFTVFAMPVGSYFKGGLTPTNFIVSKEYDRAAPNGT 180
           ATLY+RPLLIGVGD+IGVKPA+EYIF VFAMPVGSYFKGGL P+ F++S+EYDRAAP GT
Sbjct: 121 ATLYLRPLLIGVGDVIGVKPADEYIFKVFAMPVGSYFKGGLAPSKFVISREYDRAAPLGT 180

Query: 181 GAAKVGGNYAASLLPGKYAHEKQFSDVIYLDPATHTKIEEVGAANFFGITKDNQFITPLS 240
           G AKVGGNYAASL    A    ++D IYLDP+THTKIEEVGAANFFGIT DN+FITPLS
Sbjct: 181 GGAKVGGNYAASLQAEVGAKASGYADAIYLDPSTHTKIEEVGAANFFGITADNEFITPLS 240

Query: 241 PSILPSITKYSLLYLAKERFGMEAIEGDVFVDELDKFTEAGACGTAAVISPIGGIQNGDD 300
           PSILPSITKYSLLYLA+ R G++AIEG+V+  +L KF EAGACGTAA+ISPIG I +G+D
Sbjct: 241 PSILPSITKYSLLYLAEHRLGLKAIEGEVYAKDLGKFVEAGACGTAAIISPIGRIDDGED 300

Query: 301 FHVFYSETEVGPATRKLYDELVGIQFGDVEAPEGWIYKVD                    340
           ++F+SETEVGP  +LYDELVGIQFGDVEAPEGWI KVD
Sbjct: 301 SYIFHSETEVGPTVKRLYDELVGIQFGDVEAPEGWIVKVD                    340
```

A related DNA sequence was identified in *S. pyogenes* <SEQ ID 2827> which encodes the amino acid sequence <SEQ ID 2828>. Analysis of this protein sequence reveals the following:

```
Possible site: 61
>>> Seems to have no N-terminal signal sequence
----- Final Results -----
   bacterial cytoplasm --- Certainty = 0.1208 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below.

```
Identities = 280/340 (82%), Positives = 308/340 (90%)
Query:    1 MTVNLDWDNLGFAYRKLPFRYISHFKDGKWDDGKLTDDATLHISESSPALHYGQQAFEGL  60
            MT+ +DWDNLGF Y KLPFRYIS++K+G+WD G+LT+DATLHISES+PALHYGQQAFEGL
Sbjct:   16 MTIAIDWDNLGFEYHKLPFRYISYYKNGQWDKGQLTEDATLHISESAPALHYGQQAFEGL  75

Query:   61 KAYRTKDGSIQLFRADQNAERLQRTADRLLMPHVPTDKFIAAVKSVVRANEEFVPPYGTG 120
            KAYRTKDGSIQLFRPD+NA RLQ TADRLLMP V T++FI A K VV+ANE+FVPPYGTG
Sbjct:   76 KAYRTKDGSIQLFRPDRNAVRLQATADRLLMPQVSTEQFIDAAKQVVKANEDFVPPYGTG 135

Query:  121 ATLYIRPLLIGVGDIIGVKPAEEYIFTVFAMPVGSYFKGGLTPTNFIVSKEYDRAAPNGT 180
            ATLY+RPLLIGVGDIIGVKPAEEYIFT+FAMPVG+YFKGGL PTNFIVS+ +DRAAP GT
Sbjct:  136 ATLYLRPLLIGVGDIIGVKPAEEYIFTIFAMPVGNYFKGGLAPTNFIVSEAFDRAAPYGT 195

Query:  181 GAAKVGGNYAASLLPGKYAHEKQFSDVIYLDPATHTKIEEVGAANFFGITKDNQFITPLS 240
            GAAKVGGNYA SLLPGK A      FSDVIYLDPATHTKIEEVGAANFFGIT +N+F+TPLS
Sbjct:  196 GAAKVGGNYAGSLLPGKAAKSAGFSDVIYLDPATHTKIEEVGAANFFGITANNEFVTPLS 255

Query:  241 PSILPSITKYSLLYLAKERFGMEAIEGDVFVDELDKFTEAGACGTAAVISPIGGIQNGDD 300
            PSILPSITKYSLL LA+ER GM  IEGDV ++ELDKF EAGACGTAAVISPIGGIQ  D+
Sbjct:  256 PSILPSITKYSLLQLAEERLGMTVIEGDVPINELDKFVEAGACGTAAVISPIGGIQYKDN 315

Query:  301 FHVFYSETEVGPATRKLYDELVGIQFGDVEAPEGWIYKVD                    340
            HVFYSETEVGP TR+LYDELVGIQFGD+EAPEGWI KVD
Sbjct:  316 LHVFYSETEVGPVTRRLYDELVGIQFGDIEAPEGWIVKVD                    355
```

Based on this analysis, it was predicted that these proteins and their epitopes could be useful antigens for vaccines or diagnostics.

Example 931

A DNA sequence (GBSx0987) was identified in *S. agalactiae* <SEQ ID 2829> which encodes the amino acid sequence <SEQ ID 2830>. Analysis of this protein sequence reveals the following:

```
Possible site: 30
>>> Seems to have no N-terminal signal sequence
----- Final Results -----
   bacterial cytoplasm --- Certainty = 0.3459 (Affirmative) <succ>
   bacterial membrane --- Certainty = 0.0000 (Not Clear) <succ>
   bacterial outside --- Certainty = 0.0000 (Not Clear) <succ>
```

A related GBS nucleic acid sequence <SEQ ID 9365> which encodes amino acid sequence <SEQ ID 9366> was also identified. A further related GBS nucleic acid sequence <SEQ ID 10915> which encodes amino acid sequence <SEQ ID 10916> was also identified.

The protein has no significant homology with any sequences in the GENPEPT database.

A related DNA sequence was identified in *S. pyogenes* <SEQ ID 2831> which encodes the amino acid sequence <SEQ ID 2832>. Analysis of this protein sequence reveals the following:

```
Possible site: 50
>>> Seems to have no N-terminal signal sequence
----- Final Results -----
   bacterial cytoplasm --- Certainty = 0.3043 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below.

```
Identities = 22/36 (61%), Positives = 30/36 (83%)
Query:    4 IVSKKDKKIEIQISDAQVTVNGTKVDGYQLVMEKKL  39
            ++SKKDKKIEIQ+ D +V VN TK+DGYQL + K++
Sbjct:    1 VMSKKDKKIEIQLIDHKVMVNETKIDGYQLQIGKRV  36
```

Based on this analysis, it was predicted that these proteins and their epitopes could be useful antigens for vaccines or diagnostics.

Example 932

A DNA sequence (GBSx0988) was identified in *S. agalactiae* <SEQ ID 2833> which encodes the amino acid sequence <SEQ ID 2834>. This protein is predicted to be glycyl-tRNA synthetase beta subunit (glyS). Analysis of this protein sequence reveals the following:

```
Possible site: 14
>>> Seems to have no N-terminal signal sequence
----- Final Results -----
   bacterial cytoplasm --- Certainty = 0.1617 (Affirmative) <succ>
   bacterial membrane --- Certainty = 0.0000 (Not Clear) <succ>
   bacterial outside --- Certainty = 0.0000 (Not Clear) <succ>
```

The protein has homology with the following sequences in the GENPEPT database.

```
>GP:CAB73488 GB:AL139077 glycyl-tRNA synthetase beta chain
[Campylobacter jejuni]
Identities = 33/90 (36%), Positives = 49/90 (53%), Gaps = 2/90 (2%)
Query:    3 RAFNLAEKVTHSVLVDSSLFENNQEKALYQAILSLELTEDMHDNLDKLFALSPIINDFFD  62
            R  N+A K  HV D SLF    E  LY+A         + + L+ LFAL P I++FF+
Sbjct:  570 RLANIATKNPHKV--DESLFVQEAESKLYKAFQEKTKANSLQEKLENLFALKPFIDEFFN 627

Query:   63 NTMVMTDDEKMKQNRLAILNSLVAKARTVA                               92
             M+  +DEK+K NR A++  + A+   +A
Sbjct:  628 QVMINAEDEKLKNNRQALVYEIYAEFLKIA                              657
```

There is also homology to SEQ ID 2836.

Based on this analysis, it was predicted that this protein and its epitopes, could be useful antigens for vaccines or diagnostics.

Example 933

A DNA sequence (GBSx0989) was identified in *S. agalactiae* <SEQ ID 2837> which encodes the amino acid sequence <SEQ ID 2838>. Analysis of this protein sequence reveals the following:

Possible site: 30
>>> Seems to have no N-terminal signal sequence
----- Final Results -----
   bacterial cytoplasm --- Certainty = 0.4825 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:CAB13672 GB:Z99113 ynzC [Bacillus subtilis]
Identities = 41/72 (56%), Positives = 56/72 (76%)
Query:    5 KIARINELSKKKKTVGLTGEEKVEQAKLRERYIEGFRRSVRHHVEGIKLVDDEGNDVTPE  64
            KIARINEL+ K K   +T EEK EQ KLR+EY++GFR S+++ ++ +K++D EGNDVTPE
Sbjct:    6 KIARINELAAKAKAGVITEEEKAEQQKLRQEYLKGFRSSMKNTLKSVKIIDPEGNDVTPE  65

Query:   65 KLRQVQREKGLH                                                76
            KL++ QR   LH
Sbjct:   66 KLKREQRNNKLH                                                77
```

A related DNA sequence was identified in *S. pyogenes* <SEQ ID 2839> which encodes the amino acid sequence <SEQ ID 2840>. Analysis of this protein sequence reveals the following:

Possible site: 30
>>> Seems to have no N-terminal signal sequence
----- Final Results -----
   bacterial cytoplasm --- Certainty = 0.4303 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 79/85 (92%), Positives = 83/85 (960)
Query:    1 MDPKKIARINELSKKKKTVGLTGEEKVEQAKLREEYIEGFRRSVRHHVEGIKLVDDEGND  60
            MDPKKIARINEL+KKKKTVGLTG EKVEQAKLREEYIEG+RRSVRHH+EGIKLVD+EGND
Sbjct:    1 MDPKKIARINELAKKKKTVGLTGPEKVEQAKLREEYIEGYRRSVRHHIEGIKLVDEEGND  60

Query:   61 VTPEKLRQVQREKGLHGRSLDDPNS                                   85
            VTPEKLRQVQREKGLHGRSLDDP S
Sbjct:   61 VTPEKLRQVQREKGLHGRSLDDPKS                                   85
```

Based on this analysis, it was predicted that these proteins and their epitopes could be useful antigens for vaccines or diagnostics.

Example 934

A DNA sequence (GBSx0990) was identified in *S. agalactiae* <SEQ ID 2841> which encodes the amino acid sequence <SEQ ID 2842>. Analysis of this protein sequence reveals the following:

Possible site: 20
>>> Seems to have no N-terminal signal sequence
----- Final Results -----
   bacterial cytoplasm --- Certainty = 0.2343 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:AAB69985 GB:U94355 glycerol kinase [Enterococcus casseliflavus]
Identities = 381/496 (76%), Positives = 439/496 (87%)
Query:   3 SEEKYIMAIDQGTTSSRAIIFNKKGEKIASSQKEFPQIFPQAGWVEHNANQIWNSVQSVI 62
           +E+ Y+MAIDQGTTSSRAIIF++ G+KI SSQKEFPQ FP++GWVEHNAN+IWNSVQSVI
Sbjct:   2 AEKNYVMAIDQGTTSSRAIIFDRNGKKIGSSQKEFPQYFPKSGWVEHNANEIWNSVQSVI 61

Query:  63 AGAFIESSIKPGQIEAIGITNQRETTVVWDKKTGLPIYNAIVWQSRQTAPIADQLKQEGH 122
           AGAFIES I+P  I  IGITNQRETTVVWDK TG PI NAIVWQSRQ++PIADQLK +GH
Sbjct:  62 AGAFIESGIRPEAIAGIGITNQRETTVVWDKTTGQPIANAIVWQSRQSSPIADQLKVDGH 121

Query: 123 TNMIHEKTGLVIDAYFSATKVRWILDHVPGAQERAEKGELLFGTIDTWLVWKLTDGLVHV 182
           T MIHEKTGLVIDAYFSATKVRW+LD++ GAQE+A+ GELLFGTID+WLVWKLTDG VHV
Sbjct: 122 TEMIHEKTGLVIDAYFSATKVRWLLDNIEGAQEKADNGELLFGTIDSWLVWKLTDGQVHV 181

Query: 183 TDYSNAARTMLYNIKELKWDDEILELLNIPKAMLPEVKSNSEVYGKTTPFHFYGGEVPIS 242
           TDYSNA+RTMLYNI +L+WD EIL+LLNIP +MLPEVKSNSEVYG T  +HFYG EVPI+
Sbjct: 182 TDYSNASRTMLYNIHKLEWDQEILDLLNIPSSMLPEVKSNSEVYGHTRSYHFYGSEVPIA 241

Query: 243 GMAGDQQAALFGQLAFEPGMVKNTYGTGSFIIMNTGEEMQLSQNNLLTTIGYGINGKVHY 302
           GMAGDQQAALFGQ+AFE GM+KNTYGTG+FI+MNTGEE QLS N+LLTTIGYGINGKV+Y
Sbjct: 242 GMAGDQQAALFGQMAFEKGMIKNTYGTGAFIVMNTGEEPQLSDNDLLTTIGYGINGKVYY 301

Query: 303 ALEGSIFIAGSAIQWLRDGLRMIETSSESEGLAQSSTSDDEVYVVPAFTGLGAPYWDSNA 362
           ALEGSIF+AGSAIQWLRDGLRMIETS +SE LA   + D+EVYVVPAFTGLGAPYWDS A
Sbjct: 302 ALEGSIFVAGSAIQWLRDGLRMIETSPQSEELAAKAKGDNEVYVVPAFTGLGAPYWDSEA 361

Query: 363 RGSVFGLTRGTSKEDFVKATLQSIAYQVRDVIDTMQVDSGIDIQQLRVDGGAAMNNLLMQ 422
           RG+VFGLTRGT+KEDFV+ATLQ++AYQ +DVIDTM+ DSGIDI  L+VDGGAA N+LLMQ
Sbjct: 362 RGAVFGLTRGTTKEDFVRATLQAVAYQSKDVIDTMKKDSGIDIPLLKVDGGAAKNDLLMQ 421

Query: 423 FQADILGIDIARAKNLETTALGAAFLAGLSVGYWESMDELKELNATGQLFQATMNESRKE 482
           FQADIL ID+ RA NLETTALGAA+LAGL+VG+W+ +DELK +   GQ+F   M    ++
Sbjct: 422 FQADILDIDVQRAANLETTALGANYLAGLAVGFWKDLDELKSMAEEGQMFTPEMPAEERD 481

Query: 483 KLYKGWRKAVKATQVF                                            498
           LY+GW++AV ATQ F
Sbjct: 482 NLYEGWKQAVAATQTF                                            497
```

A related DNA sequence was identified in *S. pyogenes* <SEQ ID 2843> which encodes the amino acid sequence <SEQ ID 2844>. Analysis of this protein sequence reveals the following:

Possible site: 19
>>> Seems to have no N-terminal signal sequence

-continued

----- Final Results -----
bacterial cytoplasm --- Certainty = 0.2282 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 464/500 (92%), Positives = 484/500 (96%)
Query:   3 SEEKYIMAIDQGTTSSRAIIFNKKGEKIASSQKEFPQIFPQAGWVEHNANQIWNSVQSVI 62
           S+EKYIMAIDQGT+SSRAIIFN+KGEK++SSQKEFPQIFP AGWVEHNANQIWNSVQSVI
Sbjct:   2 SQEKYIMAIDQGTTSSRAIIFNQKGEKVSSSQKEFPQIFPHAGWVEHNANQIWNSVQSVI 61

Query:  63 AGAFIESSIKPGQIEAIGITNQRETTVVWDKKTGLPIYNAIVWQSRQTAPIADQLKQEGH 122
           AGAFIESSIKP QIEAIGITNQRETTVVWDKKTG+PIYNAIVWQSRQTAPIA+QLKQ+GH
Sbjct:  62 AGAFIESSIKPSQIEAIGITNQRETTVVWDKKTGVPIYNAIVWQSRQTAPIAEQLKQDGH 121

Query: 123 TNMIHEKTGLVIDAYFSATKVRWILDHVPGAQERAEKGELLFGTIDTWLVWKLTDGLVHV 182
           T MIHEKTGLVIDAYFSATK+RWILDHVPGAQERAEKGELLFGTIDTWLVWKLTDG VHV
Sbjct: 122 TKMIHEKTGLVIDAYFSATKIRWILDHVPGAQERAEKGELLFGTIDTWLVWKLIDGAVHV 181

Query: 183 TDYSNAARTMLYNIKELKWDDEILELLNIPKAMLPEVKSNSEVYGKTTPFHFYGGEVPIS 242
           TDYSNAARTMLYNIK+L WDDEILELLNIPK MLPEVKSNSE+YGKT  FHFYGGEVPIS
Sbjct: 182 TDYSNAARTMLYNIKDLTWDDEILELLNIPKDMLPEVKSNSEIYGKTAAFHFYGGEVPIS 241

Query: 243 GMAGDQQAALFGQLAFEPGMVKNTYGTGSFIIMNTGEEMQLSQNNLLTTIGYGINGKVHY 302
           GMAGDQQAALFGQLAFEPGMVKNTYGTGSFIIMNTG+EMQLS NNLLTTIGYGINGKVHY
Sbjct: 242 GMAGDQQAALFGQLAFEPGMVKNTYGIGSFIIMNTGDEMQLSSNNLLTTIGYGINGKVHY 301

Query: 303 ALEGSIFIAGSAIQWLRDGLRMIETSSESEGLAQSSTSDDEVYVVPAFTGLGAPYWDSNA 362
           ALEGSIFIAGSAIQWLRDGL+MIETS ESE  A  +STSDDEVYVVPAFTGLGAPYWDSNA
Sbjct: 302 ALEGSIFIAGSAIQWLRDGLKMIETSPESEQFALASTSDDEVYVVPAFTGLGAPYWDSNA 361

Query: 363 RGSVFGLTRGTSKEDFVKATLQSIAYQVRDVIDTMQVDSGIDIQQLRVDGGAAMNNLLMQ 422
           RGSVFGLTRGTSKEDFVKATLQSIAYQVRDVIDTMQVDSGIDIQQLRVDGGAAMNN+LMQ
Sbjct: 362 RGSVFGLTRGISKEDFVKATLQSIAYQVRDVIDTMQVDSGIDIQQLRVDGGAAMNNMLMQ 421
```

```
-continued
Query:  423 FQADILGIDIARAKNLETTALGAAFLAGLSVGYWESMDELKELNATGQLFQATMNESRKE 482
            FQADILGIDIARAKNLETTALGAAFLAGL+VGYWE MD LKELNATGQLF+A+MNESRKE
Sbjct:  422 FQADILGIDIARAKNLETTALGAAFLAGLAVGYWEDMDALKELNATGQLFKASMNESRKE 481

Query:  483 KLYKGWRKAVKATQVFAQED                                         502
            KLYKGW++AVKATQVF QE+
Sbjct:  482 KLYKGWKRAVKATQVFTQEE                                         501
```

Based on this analysis, it was predicted that these proteins and their epitopes could be useful antigens for vaccines or diagnostics.

Example 935

A DNA sequence (GBSx0992) was identified in *S. agalactiae* <SEQ ID 2845> which encodes the amino acid sequence <SEQ ID 2846>. Analysis of this protein sequence reveals the following:

---
Possible site: 14
>>> Seems to have no N-terminal signal sequence
----- Final Results -----
    bacterial cytoplasm --- Certainty = 0.3146 (Affirmative) <succ>
    bacterial membrane --- Certainty = 0.0000 (Not Clear) <succ>
    bacterial outside --- Certainty = 0.0000 (Not Clear) <succ>
---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 936

A DNA sequence (GBSx0993) was identified in *S. agalactiae* <SEQ ID 2847> which encodes the amino acid sequence <SEQ ID 2848>. This protein is predicted to be alpha-glycerophosphate oxidase (glpD). Analysis of this protein sequence reveals the following:

---
Possible site: 40
>>> Seems to have no N-terminal signal sequence
INTEGRAL   Likelihood = −1.81   Transmembrane 20-36 (20-36)
----- Final Results -----
    bacterial membrane --- Certainty = 0.1723 (Affirmative) <succ>
    bacterial outside --- Certainty = 0.0000 (Not Clear) <succ>
    bacterial cytoplasm --- Certainty = 0.0000 (Not Clear) <succ>
---

The protein has homology with the following sequences in the GENPEPT database.

```
>GP:AAC34740 GB:U94770 alpha-glycerophosphate oxidase [Streptococcus pneumoniae]
Identities = 464/608 (76%), Positives = 539/608 (88%)
Query:    1 MEFSRETRRLALQRMQDRTLDLLIIGGGITGAGVALQAAASGLDTGLIEMQDFAEGTSSR    60
            MEFS++TR  L++++MQ+RTLDLLIIGGGITGAGVALQAAASGL+TGLIEMQDFAEGTSSR
Sbjct:    1 MEFSKKTRELSIKKMQERTLDLLIIGGGITGAGVALQAAASGLETGLIEMQDFAEGTSSR    60

Query:   61 STKLVHGGLRYLKQFDVEVVSDTVSERAVVQQIAPHIPKPDPMLLPVYDEPGSTFSMFRL   120
            STKLVHGGLRYLKQFDVEVVSDTVSERAVVQQIAPHIPKPDPMLLPVYDE G+TFS+FRL
Sbjct:   61 STKLVHGGLRYLKQFDVEVVSDTVSERAVVQQIAPHIPKPDPMLLPVYDEDGATFSLFRL   120

Query:  121 KVAMDLYDLLAGVTNTPAANKVLSAEDVLKREPDLQKEGLLGGGVYLDFRNNDARLVIEN   180
            KVAMDLYDLLAGV+NTP ANKVLS + VL+R+P+L+KEGL+GGGVYLDFRNNDARLVIEN
Sbjct:  121 KVAMDLYDLLAGVSNTPTANKVLSKDQVLERQPNLKKEGLVGGGVYLDFRNNDARLVIEN   180

Query:  181 IKRANRDGAYIASHVKAEDFLFDDNNQIIGVRARDLLTDQVIDIKARLVINTTGPWSDTV   240
            IKRAN+DGA IA+HVKAE FLFD++ +I GV ARDLLTDQV +IKARLVINTTGPWSD V
Sbjct:  181 IKRANQDGALIANHVKAEGFLFDESGKITGVVARDLLTDQVFEIKARLVINTTGPWSDKV   240

Query:  241 RNFSNEGKQIHQLRPTKGVHLVVDRQKLNISQPVYVDTGLNDGRMIFVLPREDKTYFGTT   300
            RN SN+G  Q  Q+RPTKGVHLVVD  K+ +SQPVY DTGL DGRM+FVLPRE+KTYFGTT
Sbjct:  241 RNLSNKGTQFSQMRPTKGVHLVVDSSKIKVSQPVYFDTGLGDGRMVFVLPRENKTYFGTT   300

Query:  301 DTDYHGDLEHPTVTKEDVDYLLNIVNKRFPEAELTIDDIESSWAGLRPLLSGNSASDYNG   360
            DTDY GDLEHP VT+EDVDYLL IVN RFPE+ +TIDDIESSWAGLRPL++GNSASDYNG
Sbjct:  301 DTDYTGDLEHPKVTQEDVDYLLGIVNNRFPESNITIDDIESSWAGLRPLIAGNSASDYNG   360

Query:  361 GNSGKLSDESFEELIDSVKDYIAHKNHREDVEKAISHVESSTSEKELDPSAVSRGSSFER   420
            GN+G  +SDESF+ LI +V+ Y++ +   REDVE A+S +ESSTSEK LDPSAVSRGSS +R
Sbjct:  361 GNNGTISDESFDNLIATVESYLSKEKTREDVESAVSKLESSTSEKHLDPSAVSRGSSLDR   420

Query:  421 DDNGLLTLAGGKITDYRKMAEGAMETIINILDKEYNRKFKLINSKTYPVSGGEINPSNVD   480
            DDNGLLTLAGGKITDYRKMAEGAME +++IL  E++R FKLINSKTYPVSGGE+NP+NVD
Sbjct:  421 DDNGLLTLAGGKITDYRKMAEGAMERVVDILKAEFDRSFKLINSKTYPVSGGELNPANVD   480

Query:  481 SEIEAYAQLGTLSGLSIEDARYIANLYGSNAPKLFALTRQITEAEGLSLVETLSLHYAMD   540
            SEIEA+AQLG    GL  ++A Y+ANLYGSNAPK+FAL    + +A GLSL +TLSLHYAM
Sbjct:  481 SEIEAFAQLGVSRGLDSKEAHYLANLYGSNAPKVFALAHSLEQAPGLSLADTLSLHYAMR   540

Query:  541 YEMALSPTDFFLRRTNHMLFMRDNLDSLIQPVIDEMAKHYQWSDQDKTFYEEELHETLKD   600
            E+ALSP DF LRRTNHMLFMRD+LDS+++PV+DEM + Y W++++K  Y ++     L +
```

-continued
```
Sbjct:  541 NELALSPVDFLLRRTNHMLFMRDSLDSIVEPVLDEMGRFYDWTEEEKATYRADVEAALAN   600

Query:  601 NDLAALKD                                                      608
            NDLA LK+
Sbjct:  601 NDLAELKN                                                      608
```

There is also homology to SEQ ID 128.

Figure 7:
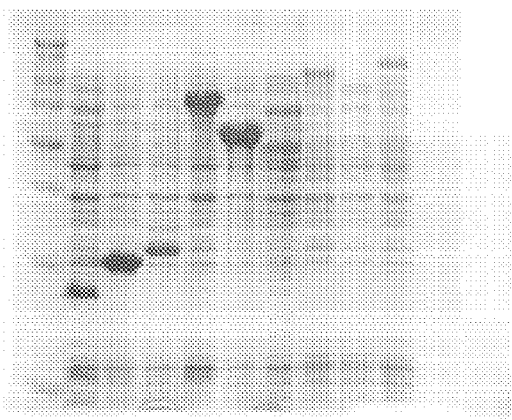

SEQ ID 2848 (GBS93) was expressed in *E. coli* as a His-fusion product. SDS-PAGE analysis of total cell extract is shown in FIG. 7 (lane 7; MW 70.6 kDa).

GBS93-His was purified as shown in FIG. 192, lane 4.

Based on this analysis, it was predicted that this protein and its epitopes, could be useful antigens for vaccines or diagnostics.

Example 937

A DNA sequence (GBSx0994) was identified in *S. agalactiae* <SEQ ID 2849> which encodes the amino acid sequence <SEQ ID 2850>. Analysis of this protein sequence reveals the following:

Possible site: 23
>>> Seems to have no N-terminal signal sequence
----- Final Results -----
 bacterial cytoplasm --- Certainty = 0.0965 (Affirmative) <succ>
 bacterial membrane --- Certainty = 0.0000 (Not Clear) <succ>
 bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 938

A DNA sequence (GBSx0995) was identified in *S. agalactiae* <SEQ ID 2851> which encodes the amino acid sequence <SEQ ID 2852>. This protein is predicted to be glycerol uptake facilitator protein (glpF). Analysis of this protein sequence reveals the following:

Possible site: 55
>>> Seems to have a cleavable N-term signal seq.
INTEGRAL    Likelihood = –7.43    Transmembrane 220-236 (216-236)
INTEGRAL    Likelihood = –6.48    Transmembrane 139-155 (136-158)
INTEGRAL    Likelihood = –3.88    Transmembrane 87-103 (83-107)
INTEGRAL    Likelihood = –3.03    Transmembrane 164-180 (162-183)
----- Final Results -----
 bacterial membrane --- Certainty = 0.3972 (Affirmative) <succ>
 bacterial outside --- Certainty = 0.0000 (Not Clear) <succ>
 bacterial cytoplasm --- Certainty = 0.0000 (Not Clear) <succ>

A related GBS nucleic acid sequence <SEQ ID 8689> which encodes amino acid sequence <SEQ ID 8690> was also identified. Analysis of this protein sequence reveals the following:

Lipop: Possible site: –1    Crend: 5
SRCFLG: 0
McG: Length of UR: 21
Peak Value of UR: 2.51
Net Charge of CR: –2
McG: Discrim Score: 4.43
GvH: Signal Score (–7.5): –0.139999
Possible site: 50
>>> Seems to have a cleavable N-term signal seq.
Amino Acid Composition: calculated from 51
ALOM program count: 4  value: –7.43  threshold: 0.0
INTEGRAL    Likelihood = –7.43    Transmembrane 215-231 (211-231)
INTEGRAL    Likelihood = –6.48    Transmembrane 134-150 (131-153)
INTEGRAL    Likelihood = –3.88    Transmembrane 82-98 (78-102)
INTEGRAL    Likelihood = –3.03    Transmembrane 159-175 (57-178)
PERIPHERAL  Likelihood = 4.98     65
modified ALOM score: 1.99
icml HYPID: 7 CFP: 0.397
*** Reasoning Step: 3
----- Final Results -----
 bacterial membrane --- Certainty = 0.3972 (Affirmative) <succ>
 bacterial outside --- Certainty = 0.0000 (Not Clear) <succ>
 bacterial cytoplasm --- Certainty = 0.0000 (Not Clear) <succ>

The protein has homology with the following sequences in the GENPEPT database.

```
>GP:AAA91618 GB:U12567 glycerol uptake facilitator [Streptococcus pneumonia]
Identities = 150/230 (65%), Positives = 194/230 (84%), Gaps = 1/230 (0%)
Query:    7 DIFGEFLGTALLVLLGNGVVAGVVLPKTKNHNSGWIVITFGWGLAVAIAALVSGNISPAH    66
            ++FGEFLGT +L+LLGNGVVAGVVLPKTK+++SGWIVIT   G+AVA+A  VSG +SPAH
Sbjct:    4 ELFGEFLGTLILILLGNGVVAGVVLPKTKSNSSGWIVITMV-GIAVAVAVFVSGKLSPAH    62

Query:   67 LNPAVSLAFAIKGDLAWGTAILYMIAQIIGAMLGSLLVYLQFRPHYEAAENRADILGTFA   126
            LNPAV++  A+KG L W + + Y++AQ  GAMLG +LV+LQF+PHYEA EN  +IL TF+
Sbjct:   63 LNPAVTIGVALKGGLPWASVLPYILAQFAGAMLGQILVWLQFKPHYEAEENAGNILATFS   122

Query:  127 TGPALKDNFSNFLSEVLGTLVLVLTIFAIGKYNMPPGVGTMSVGMLVVGIGLSLGGTTGY   186
            TGPA+KD  SN +SE+LGT VLVLTIFA+G Y+    G+GT +VG L+VGIGLSLGGTTGY
Sbjct:  123 TGPAIKDTVSNLISEILGTFVLVLTIFALGLYDFQAGIGTFAVGTLIVGIGLSLGGTTGY   182

Query:  187 AINPARDFGPRLLHALLPMKNKGDSDWTYSWIPIVGPMVGAILAALIFAM             236
            A+NPARD GPR++H++LP+ NKGD DW+Y+WIP+VGP++GA LA L+F++
Sbjct:  183 ALNPARDLGPRIMHSILPIPNKGDGDWSYAWIPVVGPVTGAALAVLVFSL             232
```

A related DNA sequence was identified in *S. pyogenes* <SEQ ID 2853> which encodes the amino acid sequence <SEQ ID 2854>. Analysis of this protein sequence reveals the following:

```
Possible site: 50
>>> Seems to have a cleavable N-term signal seq.
INTEGRAL    Likelihood = -9.13   Transmembrane 213-229 (209-232)
INTEGRAL    Likelihood = -5.52   Transmembrane 137-153 (132-157)
INTEGRAL    Likelihood = -4.35   Transmembrane 159-175 (155-178)
INTEGRAL    Likelihood = -1.17   Transmembrane 85-101 (85-101)
----- Final Results -----
   bacterial membrane --- Certainty = 0.4652 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP:AAA91618 GB:U12567 glycerol uptake facilitator [Streptococcus pneumoniae]
Identities = 159/230 (69%), Positives = 196/230 (85%), Gaps = 1/230 (0%)
Query:     2 DIFGEFLGTALLVLLGNGVVAGVVLPKTKTHASGWIVIATGWGIAVAVAVFISGKVAPAH        61
             ++FGEFLGT +L+LLGNGVVAGVVLPKTK+++SGWIVI T   GIAVAVAVF+SGK++PAH
Sbjct:     4 ELFGEFLGTLILILLGNGVVAGVVLPKTKSNSSGWIVI-TMVGIAVAVAVFVSGKLSPAH       62

Query:    62 LNPAVSLAFAMSGTIAWSTAIAYSLAQLLGAMVGSTLVFLQFRPHYLAAESQADILGTFA      121
             LNPAV++   A+ G + W++ + Y LAQ    GAM+G   LV+LQF+PHY A E+  +IL TF+
Sbjct:    63 LNPAVTIGVALKGGLPWASVLPYILAQFAGAMLGQILVWLQFKPHYEAEENAGNILATFS      122

Query:   122 TGPAIRDTSSNLLSEIFGTFVLMLGILAFGLYDMPAGLGTLCVGTLVIGIGLSLGGTTGY      181
             TGPAI+DT SNL+SEI GTFVL+L  I A GLYD   AG+GT  VGTL++GIGLSLGGTTGY
Sbjct:   123 TGPAIKDTVSNLISEILGTFVLVLTIFALGLYDFQAGIGTFAVGTLIVGIGLSLGGTTGY      182

Query:   182 AINPARDLGPRLVHAILPLNNKGDSDWSYAWIPVVGPIIGAVLAVLLFQV              231
             A+NPARDLGPR++H+ILP+ NKGD DWSYAWIPVVGP+IGA LAVL+F +
Sbjct:   183 ALNPARDLGPRIMHSILPIPNKGDGDWSYAWIPVVGPVIGAALAVLVFSL              232
```

An alignment of the GAS and GBS proteins is shown below.

```
Identities = 169/232 (72%), Positives = 202/232 (86%)
Query:     6 MDIFGEFLGTALLVLLGNGVVAGVVLPKTKNHNSGWIVITFGWGLAVAIAALVSGNISPA       65
             MDIFGEFLGTALLVLLGNGVVAGVVLPKTK H SGWIVI   GWG+AVA+A   +SG ++PA
Sbjct:     1 MDIFGEFLGTALLVLLGNGVVAGVVLPKTKTHASGWIVIATGWGIAVAVAVFISGKVAPA       60

Query:    66 HLNPAVSLAFAIKGDLAWGTAILYMIAQIIGAMLGSLLVYLQFRPHYEAAENRADILGTF      125
             HLNPAVSLAFA+ G +AW TAI Y +AQ++GAM+GS LV+LQFRPHY AAE++ADILGTF
Sbjct:    61 HLNPAVSLAFAMSGTIAWSTAIAYSLAQLLGAMVGSTLVFLQFRPHYLAAESQADILGTF      120

Query:   126 ATGPALKDNFSNFLSEVLGTLVLVLTIFAIGKYNMPPGVGTMSVGMLVVGIGLSLGGTTG      185
             ATGPA++D  SN LSE+ GT VL+L  I A G Y+MP G+GT+ VG LV+GIGLSLGGTTG
Sbjct:   121 ATGPAIRDTSSNLLSEIFGTFVLMLGILAFGLYDMPAGLGTLCVGTLVIGIGLSLGGTTG      180

Query:   186 YAINPARDFGPRLLHALLPMKNKGDSDWTYSWIPIVGPMVGAILAALIFAMM             237
             YAINPARD GPRL+HA+LP+ NKGDSDW+Y+WIP+VGP++GA+LA L+F +M
Sbjct:   181 YAINPARDLGPRLVHAILPLNNKGDSDWSYAWIPVVGPIIGAVLAVLLFQVM             232
```

```
Possible site: 23
>>> Seems to have a cleavable N-term signal seq.
INTEGRAL    Likelihood = -2.87    Transmembrane 152-168 (152-168)
----- Final Results -----
   bacterial membrane --- Certainty = 0.2147 (Affirmative) <succ>
     bacterial outside --- Certainty = 0.0000 (Not Clear) <succ>
       bacterial cytoplasm --- Certainty = 0.0000 (Not Clear) <succ>
```

A related GBS nucleic acid sequence <SEQ ID 9523> which encodes amino acid sequence <SEQ ID 9524> was also identified.

The protein has homology with the following sequences in the GENPEPT database.

Based on this analysis, it was predicted that these proteins and their epitopes could be useful antigens for vaccines or diagnostics.

Example 939

A DNA sequence (GBSx0996) was identified in *S. agalactiae* <SEQ ID 2855> which encodes the amino acid sequence <SEQ ID 2856>. This protein is predicted to be NADH oxidase. Analysis of this protein sequence reveals the following:

```
>GP:CAA48728 GB:X68847 NADH oxidase [Enterococcus faecalis]
Identities = 105/423 (24%), Positives = 197/423 (45%), Gaps = 15/423 (3%)
Query:  10 IVILGASFAGMTCAQKLRQLNPNWDIVLIDKEIHPDYVPNGLNWYYRHEISGLNQAMWQT 69
            +V++G + AG + + +    +P ++ + ++  +  ++  G+ Y  +       +
Sbjct:   3 VVVVGCTHAGTSAVKSILANHPEAEVTVYERNDNISFLSCGIALYVGGVVKNAADLFYSN 62

Query:  70 EEEQRLQNIRCLFGLKVEKINKEDR-----ELMLSDGSSVYYDQLICAMGSQAESTYIDG 124
            EE        VE+IN +D+      L      +V YD+L+   GS       I G
Sbjct:  63 PEELASLGATVKMEHNVEEINVDDKTVTAKNLQTGATETVSYDKLVMTTGSWPIIPPIPG 122

Query: 125 ADAQGVLTTKTYATSQNAKQVLDKSHKVAVVGAGIIGLDIAYSLHESGKAVTLLEAQERP 184
             DA+  +L  K Y+ + +      + +V VVG G IG+++   +  ESGK VTL++  +R
Sbjct: 123 IDAENILLCKNYSQANVIIEKAKDAKRVVVVGGGYIGIELVEAFVESGKQVTLVDGLDRI 182

Query: 185 DFRHTDPDMSLPLLDAMAESKLHFFQNQKVEKITVTREEKLCLRTLTGDTFTVDAVILAV 244
            ++ D   + L   + ++ +   V++     + K+        F   D VI+ V
Sbjct: 183 LNKYLDKPFTDVLEKELVDRGVNLALGENVQQFVADEQGKVAKVITPSQEFEADMVIMCV 242

Query: 245 NFRPDSRLLTGLVDLSVDNSVVVNDYFQTSDPNIYAIGDLIWSYFKGLNSAYYMPLINQA 304
            FRP++ LL    VD+  + ++ VN+Y QTS+P+I+A GD       ++     + Y+PL    A
Sbjct: 243 GFRPNTELLKDKVDMLPNGAIEVNEYMQTSNPDIFAAGDSAVVHYNPSQTKNYIPLATNA 302

Query: 305 IRSAQMLAYHLSGHAVPKLKITRATGSKHFGYYRANIGLT---------ELEAGFYEDTV 355
              +R   ++  +L+    +       +G     FG+   + G+T       ++EA  +ED
Sbjct: 303 VRQGMLVGRNLTEQKLAYRGTQGTSGLYLFGWKIGSTGVTKESAKLNGLDVEATVFEDNY 362

Query: 356 SVTYFPKEQYDLRIKLIANQKTGHLLGAQLISKENCLATANQLVQAISCDMTDFDLAFQD 415
              + P  +  L ++L+   + T ++G   QL+SK +   +AN L  A+     MT  DLA   D
Sbjct: 363 RPEFMPTTEKVL-MELVYEKGTQRIVGGQLMSKYDITQSANTLSLAVQNKMTVEDLAISD 421

Query: 416 FIY                                                           418
            F +
Sbjct: 422 FFF                                                           424
```

A related DNA sequence was identified in *S. pyogenes* <SEQ ID 2857> which encodes the amino acid sequence <SEQ ID 2858>. Analysis of this protein sequence reveals the following:

---

Possible site: 16
>>> Seems to have an uncleavable N-term signal seq
INTEGRAL    Likelihood = −3.35    Transmembrane 155-171 (155-173)

----- Final Results -----
bacterial membrane --- Certainty = 0.2338 (Affirmative) <succ>
bacterial outside --- Certainty = 0.0000 (Not Clear) <succ>
bacterial cytoplasm --- Certainty = 0.0000 (Not Clear) <succ>
RGD motif: 54-56

The protein has homology with the following sequences in the databases:

```
>GP:CAA44611 GB:X62755 NADH peroxidase [Enterococcus faecalis]
Identities = 111/428 (25%), Positives = 202/428 (46%), Gaps = 24/428 (5%)
Query:  10 VIGASFAGLAFVDKYKDLNPDSQIILIDKESCPNYIPNGINQLFRGDIQDLSDAMWGRAC 69
            V+G+S  G    V++  +L+PD++I   +K     +++ G+       G ++D++     R
Sbjct:   5 VLGSSHGGYEAVEELLNLHPDAEIQWYEKGDFISFLSCGMQLYLEGKVKDVNSV---RYM 61

Query:  70 LAAQIESN--HRFIQAEVLAIEAPSNTLLLKDS-QGRVFEEGYETLVCAMGASPQSHYIE 126
             ++ES    + F    E+ AI+  + +   +KD   G     E Y+ L+ + GA P      I
Sbjct:  62 TGEKMESRGVNVESNTEITAIQPKEHQVTVKDLVSGEERVENYDKLIISPGAVPFELDIP 121

Query: 127 TSQTNKVLVTKYYEESQASLKLIEASQE-----VLVIGAGLIGLDLAYSLSLQGKRVKLI 181
            + + + +    Q ++KL + + +    V+VIG+G IG++ A + +   GK+V +I
Sbjct: 122 GKDLDNIYLMR---GRQWAIKLKQKTVDPEVNNVVVIGSGYIGIEAAEEAFAKAGKKVTVI 178

Query: 182 EAAERPDFYQTDAELIAPVMAEMSTHHVTFINNKRVIATHEIEGKVVAHTEQGDTFQGDL 241
            +   +RP   D E +     EM  +++T    + V  +E +G+V         + + DL
Sbjct: 179 DILDRPLGVYLDKEFTDVLTEEMEANNITIATGETVER-YEGDRVQKVVTDKNAYDADL 237

Query: 242 AILAINFRPNTHLLQGQVACALDKTILVNENLQTSQANIYAIGDMVSLHFGILGMDYYTP 301
             ++A+  RPNT  L+G +     +  I    +E  ++TS+ +++A+GD   +        +
Sbjct: 238 VVVAVGVRPNTAWLKGTLELHPNGLIKTDEYMRTSEPDVFAVGDATLIKYNPADTEVNIA 297

Query: 302 LINQAMKTGQALALHLAGYPIPPLQTVK-VLGSSHFDYYRASVGVTE-------EEAELY 353
            L      AK G+    +L    P+ P V+    G + FDY   AS  G+     E        +E +
Sbjct: 298 LATNARKQGRFAVKNLE-EPVKPFPGVQGSSGLAVFDYKFASTGINEVMAQKLGKETKAV 356

Query: 354 MDTCSYLYQNGDSKNLFWLKLIARKTDGILIGAQLLSKTNALVIANQLGQALALKVTDAD 413
                   YL    K     W  KL+      ++GAQL+SK + N +       A+ K+T  D
Sbjct: 357 TVVEDYLMDFNPDKQKAWFKLVYDPETTQILGAQLMSKADLTANINAISLAIQAKMTIED 416
```

```
-continued
Query:  414 LAFQDFLF                                                421
            LA+ DF F
Sbjct:  417 LAYADFFF                                                424
```

An alignment of the GAS and GBS proteins is shown below.

```
Identities = 192/440 (43%), Positives = 276/440 (62%), Gaps = 7/440 (1%)
Query:    8 KVIVILGASFAGMTCAQKLRQLNPNWDIVLIDKEIHPDYVPNGLNWYYRHEISGLNQAMW 67
            K I ++GASFAG+    K + LNP+  I+LIDKE  P+Y+PNG+N   +R    L+ AMW
Sbjct:    6 KTIHVIGASFAGLAFVDKYKDLNPDSQIILIDKESCPNYIPNGINQLFRGDIQDLSDAMW 65

Query:   68 -QTEEEQRLQNIRCLFGLKVEKINKEDRELMLSDGSSVY----YDQLICAMGSQAESTYI 122
             +      ++++      +V  I       L+L D       Y+ L+CAMG+  +S YI
Sbjct:   66 GRACLAAQIESNHRFIQAEVLAIEAPSNTLLLKDSQGRVFEEGYETLVCAMGASPQSHYI 125

Query:  123 DGADAQGVLTTKTYATSQNAKQVLDKSHKVAVVGAGIIGLDIAYSLHESGKAVTLLEAQE 182
            + +      VL TK Y  SQ + ++++ S +V V+GAG+IGLD+AYSL   GK V L+EA E
Sbjct:  126 ETSQTNKVLVTKYYEESQASLKLIEASQEVLVIGAGLIGLDLAYSLSLQGKRVKLIEAAE 185

Query:  183 RPDFRHTDPDMSLPLLDAMAESKLHFFQNQKVEKITVTREEKLCLRTLTGDTFTVDAVIL 242
            RPDF   TD ++  P++  M+    + F  N++V  I     E K+   T GDTF  D  IL
Sbjct:  186 RPDFYQTDAELIAPVMAEMSTHHVTFINNKRVTAIHEI-EGKVVAHTEQGDTFQGDLAIL 244

Query:  243 AVNFRPDSRLLTGLVDLSVDNSVVVNDYFQTSDPNIYAIGDLIWSYFKGLNSAYYMPLIN 302
            A+NFRP++ LL G V  ++D +++VN+  QTS   NIYAIGD++  +F  L    YY PLIN
Sbjct:  245 AINFRPNTHLLQGQVACALDKTILVNENLQTSQANIYAIGDMVSLHFGILGMDYYTPLIN 304

Query:  303 QAIRSAQMLAYHLSGHAVPKLKITRATGSKHFGYYRANIGLTELEAGFYEDTVSVTYFPK 362
            QA+++  Q LA HL+G+ +P L+  +   GS HF YYRA++G+TE EA   Y DT S  Y
Sbjct:  305 QAMKTGQALALHLAGYPIPPLQTVKVLGSSHFDYYRASVGVTEEEAELYMDTCSYLYQNG 364

Query:  363 EQYDL-RIKLIANQKTGHLLGAQLISKENCLATANQLVQAISCDMTDFDLAFQDFIYTAR 421
             +  +L +KLIA +  G L+GAQL+SK N L  ANQL QA++  +TD DLAFQDF++
Sbjct:  365 DSKNLFWLKLIARKTDGILIGAQLLSKTNALVIANQLGQALALKVTDADLAFQDFLFLQG 424

Query:  422 ESEMAYMLHQAAINLYEKRI                                        441
            S++AY LH+A + L+EKR+
Sbjct:  425 HSDLAYHLHEACLKLFEKRL                                        444
```

There is also homology to SEQ IDs 1820, 1876, 4666.

Based on this analysis, it was predicted that these proteins and their epitopes could be useful antigens for vaccines or diagnostics.

Example 940

A DNA sequence (GBSx0998) was identified in *S. agalactiae* <SEQ ID 2859> which encodes the amino acid sequence <SEQ ID 2860>. Analysis of this protein sequence reveals the following:

Possible site: 31
>>> Seems to have no N-terminal signal sequence
----- Final Results -----
   bacterial cytoplasm --- Certainty = 0.2980 (Affirmative) <succ>
     bacterial membrane --- Certainty = 0.0000 (Not Clear) <succ>
       bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 941

A DNA sequence (GBSx0999) was identified in *S. agalactiae* <SEQ ID 2861> which encodes the amino acid sequence <SEQ ID 2862>. Analysis of this protein sequence reveals the following:

Possible site: 23
>>> Seems to have no N-terminal signal sequence
----- Final Results -----
   bacterial cytoplasm --- Certainty = 0.3548 (Affirmative) <succ>
     bacterial membrane --- Certainty = 0.0000 (Not Clear) <succ>
       bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 942

A DNA sequence (GBSx1000) was identified in *S. agalactiae* <SEQ ID 2863> which encodes the amino acid sequence <SEQ ID 2864>. Analysis of this protein sequence reveals the following:

```
Possible site: 29
>>> Seems to have no N-terminal signal sequence
----- Final Results -----
    bacterial cytoplasm --- Certainty = 0.1685 (Affirmative) <succ>
      bacterial membrane --- Certainty = 0.0000 (Not Clear) <succ>
        bacterial outside --- Certainty = 0.0000 (Not Clear) <succ>
```

A related GBS nucleic acid sequence <SEQ ID 9525> which encodes amino acid sequence <SEQ ID 9526> was also identified.

The protein has no significant homology with any sequences in the GENPEPT database.

A related DNA sequence was identified in *S. pyogenes* <SEQ ID 2865> which encodes the amino acid sequence <SEQ ID 2866>. Analysis of this protein sequence reveals the following:

```
Possible site: 22
>>> Seems to have no N-terminal signal sequence
----- Final Results -----
    bacterial cytoplasm --- Certainty = 0.3125 (Affirmative) <succ>
      bacterial membrane --- Certainty = 0.0000 (Not Clear) <succ>
        bacterial outside --- Certainty = 0.0000 (Not Clear) <succ>
```

An alignment of the GAS and GBS proteins is shown below.

Based on this analysis, it was predicted that these proteins and their epitopes could be useful antigens for vaccines or diagnostics.

Example 943

A DNA sequence (GBSx1001) was identified in *S. agalactiae* <SEQ ID 2867> which encodes the amino acid sequence <SEQ ID 2868>. This protein is predicted to be transketolase (tktA-1). Analysis of this protein sequence reveals the following:

```
Possible site: 27
>>> Seems to have no N-terminal signal sequence
----- Final Results -----
    bacterial cytoplasm --- Certainty = 0.2084 (Affirmative) <succ>
      bacterial membrane --- Certainty = 0.0000 (Not Clear) <succ>
        bacterial outside --- Certainty = 0.0000 (Not Clear) <succ>
```

A related GBS nucleic acid sequence <SEQ ID 9527> which encodes amino acid sequence <SEQ ID 9528> was also identified.

The protein has homology with the following sequences in the GENPEPT database.

```
Identities = 179/476 (37%), Positives = 279/476 (58%), Gaps = 5/476 (1%)
Query:    1 MRIEALMEKERRVQYRLLSFLRGSPQAIALKLALLETGLSRATFLKYINNLNSYFEQEKV 60
            M+IE LM+KERR QYRLL  L  +  + LK  +  LS+ T LKYI+NLN    ++ +
Sbjct:   21 MKIEDLMDKERRAQYRLLVTLYHAKETLRLKDLMRLSNLSKVTLLKYIDNLNHLCREQGL 80

Query:   61 NCRIVYYKDKLFLEEDYNLSNQEVLKALMKDSIKYTILISLFNQRQFTIVGLSQELMVSE 120
            C+++  KD L L+E+    ++++  L+K+S+ Y IL  ++    F I  LS ELMVSE
Sbjct:   81 ACQLLLEKDSLSLKENGQFHWEDLVALLLKESVAYQILTYMYCHEHFNITNLSVELMVSE 140

Query:  121 ATLNRHLAHLNELLAEFDIAISQGKQIGDELQWRYFYYELFKQLWSYDKCQNMIKKLDLD 180
            ATLNR LAHLN+LL+EFD+A+SQG+Q+G ELQWRYFY+ELF+     +    ++ +LD
Sbjct:  141 ATLNRQLAHLNQLLSEFDLALSQGRQLGSELQWRYFYFELFRHTLTRQGIDALVNQLDAS 200

Query:  181 SLILLIERLAQHTLTREAHQNLGLWFSICHHRLLAMEKISDNLKPIVKHYQCNAFYKRLD 240
            L    LIERL   +L+ EA + L +W +I   R+  +  +D+       N F+KRL+
Sbjct:  201 HLATLIERLIGQSLSAEALEQLLIWLAISQARMSFQKSYNDHFLRDSDFMTSNIFFKRLE 260

Query:  241 AALVLYMSRFALEYREGEVLATFAFLHSQNILPINTMEYIMGFGGPIIDCVTETIIYFKK 300
            + L+ Y+ R+ALE+     E +  F FLH+  +LPI +M+Y +GFGGPI D ++E +   KK
Sbjct:  261 SMLLHYLRRYALEFDAFEAKSLFVFLHAYPLLPIASMKYSLGFGGPIADHISEALWLLKK 320

Query:  301 ESILADETSDQVIYQLGQLYSHYYFFKGHILVEQPDLEQTYRLIDHNMRDKLHHISKKII 360
            ++   +T +++IY LG   +S  YFFKG IL  +     Y+L+  + R  L  I    ++
Sbjct:  321 AHVIIHQTKEEIIYGLGIFFSKAYFFKGAILSQPTNSQYLYQLVGEDKRALLRVIINHLV 380

Query:  361 ANVNRIRPLTEDGCSLLTLHLLELLIFSKNSQKMPFRIGLDMTGNAVEQSLLEYRIRQHF 420
            +++        D    L+  +L LLIFS       P   +GL +  N VE ++ E   IR+H
Sbjct:  381 LQMDQ----ETDFSQQLSDDILALLIFSIERHHEPLLVGLALGQNKVEAAIAELAIRRHL 436

Query:  421 SGNNSIQVEPYDEGKGFD-MVIYQSHSRPYKAKLTYCLNKGASERELQEIDSLIYD    475
              Q+ PYD  K +D ++ YQ+   P +     Y L  +S  EL  +++ + D
Sbjct:  437 GHRRDFQLMPYDHQKVYDCLITYQTVCLPRQDLPYYRLKQYSSPYELTALEAFLKD    492
```

```
>GP:BAB06071 GB:AP001515 transketolase [Bacillus halodurans]
Identities = 403/661 (60%), Positives = 520/661 (77%), Gaps = 8/661 (1%)
Query:   6 IDQLAVNTVRTLSIDAIQAANSGHPGLPMGAAPMAYVLWNKFLNVNPKTSRNWTNRDRFV    65
             ++QLAVNT+RTLSID+++ ANSGHPG+PMGAAPMA+ LW KF+N NP  + +W NRDRFV
Sbjct:   5 VEQLAVNTIRTLSIDSVEKANSGHPGMPMGAAPMAFCLWTKFMNHNP-ANPDWVNRDRFV    63

Query:  66 LSAGHGSALLYSLLHLAGYDLSIDDLKQFRQWGSKTPGHPEVNHTDGVEATTGPLGQGIA   125
             LSAGHGS LLYSLLHL GYDLS+++L+ FRQWGSKTPGHPE  HT GVEATTGPLGQ+A
Sbjct:  64 LSAGHGSMLLYSLLHLTGYDLSLEELQNFRQWGSKTPGHPEYGHTPGVEATTGPLGQGVA   123

Query: 126 NAVGMAMAEAHLAAKFNKPGFDLVDHYTYTLHGDGCLMEGVSQEAASLAGHLKLGKLVLL   185
              AVGMAMAE HLAA +N+ G+++VDHYTYT+ GDG LMEGVS EAASLAGHLKLG+++LL
Sbjct: 124 MAVGMAMAERHLAATYNRDGYNIVDHYTYTICGDGDLMEGVSAEAASLAGHLKLGRMILL   183

Query: 186 YDSNDISLDGPTSQSFTEDVKGRFESYGWQHILVKDGNDLEAIAAAIEAAKAETDKPTII   245
             YDSNDISLDG    SF+E V+ RF++YGW  + V+DGN+L+ IA AIE AKA+ ++P++I
Sbjct: 184 YDSNDISLDGDLHHSFSESVEDRFKAYGWHVVRVEDGNNLDEIAKAIEEAKAD-ERPSLI   242

Query: 246 EVKTIIGFGAEKQGTSSV-HGAPLGAEGITFAKKAYVWEYP-DFTVPAEVADRFASDLQA   303
             EVKT IGFG+  +G  SV HGAPLGA+ +    K+AY W Y +F +P EVA    + ++
Sbjct: 243 EVKTTIGFGSPNKGGKSVSHGAPLGADEVKLTKEAYEWTYENEFHIPEEVA-AYYEQVKQ   301

Query: 304 RGAKEEEAWNDLFAKYEVEYPELATEYKEAFAG---QAETVELKAHDLGSSVASRVSSQQ   360
              +GA+ EE+WN+LFA+Y+  YPELA++++ A  G  +          ++++G SVA+R SS +
Sbjct: 302 QGAEKEESWNELFAQYKKAYPELASQFELAVHGDLPEGWDAVAPSYEVGKSVATRSSSGE   361

Query: 361 AIQQLSTQLPNLWGGSADLSASNNTMVAAETDFQASNYAGRNIWFGVREFAMAAAMNGIA   420
             A+    +P L+GGSADL++SN T++ E +F    +Y+GRN+WFGVREFAM AAMNG+A
Sbjct: 362 ALNAFAKTVPQLFGGSADLASSNKTLIKGEANFSRDDYSGRNVWFGVREFAMGAAMNGMA   421

Query: 421 LHGGTRVYGGTFFVFSNYLLPAVRMAALQNLPTVYVMTHDSIAVGEDGPTHEPIEQLASV   480
             LHGG +V+G TFFVFS+YL PA+R+AAL  LP +YV THDSIAVGEDGPTHEP+EQLAS+
Sbjct: 422 LHGGLKVFGATFFVFSDYLRPAIRLAALMQLPVIYVFTHDSIAVGEDGPTHEPVEQLASL   481

Query: 481 RSMPNLNVIRPADGNETNAAWQRAVSETDRPTMLVLTRQNLPVLEGTSELAQEGVNKGAY   540
             R+MP L+VIRPADGNE+ AAW+ A+   D+PT LVL+RQNLP LEG + A +GV+KGAY
Sbjct: 482 RAMPGLSVIRPADGNESVAAWKLALESKDQPTALVLSRQNLPTLEGAVDRAYDGVSKGAY   541

Query: 541 ILSEAKGELDGIIIATGSEVELALDTQDKLESEGIHVRVVSMPAQNIFDEQEASYQEQVL   600
             +L+ A G  D +++A+GSEV LA++ ++ LE EGIH VVSMP+  + F+ Q A Y+E+VL
Sbjct: 542 VLAPANGSADLLLLASGSEVSLAVNAKEALEKEGIHAAVVSMPSWDRFEAQSAEYKEEVL   601

Query: 601 PSAVTKRLAIEAGSSFGWGKYVGLNGLTLTIDTWGASAPGNRIFEEYGFTVENAVSLYKEL   661
              PS  VT RLAIE GSS GW KYVG  G  + ID +GASAPG RI EE+GFTV++ V+  K L
Sbjct: 602 PSDVTARLAIEMGSSLGWAKYVGNQGDVVAIDRFGASAPGERIMEEFGFTVQHVARAKAL   662
```

There is also homology to SEQ ID 520.

Based on this analysis, it was predicted that these proteins and their epitopes could be useful antigens for vaccines or diagnostics.

Example 944

A DNA sequence (GBSx1002) was identified in *S. agalactiae* <SEQ ID 2869> which encodes the amino acid sequence <SEQ ID 2870>. Analysis of this protein sequence reveals the following:

Possible site: 39
>>> Seems to have no N-terminal signal sequence
----- Final Results -----
  bacterial cytoplasm --- Certainty = 0.4477 (Affirmative) <succ>
   bacterial membrane --- Certainty = 0.0000 (Not Clear) <succ>
    bacterial outside --- Certainty = 0.0000 (Not Clear) <succ>

A related GBS nucleic acid sequence <SEQ ID 9529> which encodes amino acid sequence <SEQ ID 9530> was also identified.

The protein has no significant homology with any sequences in the GENPEPT database.

A related DNA sequence was identified in *S. pyogenes* <SEQ ID 2871> which encodes the amino acid sequence <SEQ ID 2872>. Analysis of this protein sequence reveals the following:

Possible site: 42
>>> Seems to have no N-terminal signal sequence
----- Final Results -----
  bacterial cytoplasm --- Certainty = 0.4581 (Affirmative) <succ>
   bacterial membrane --- Certainty = 0.0000 (Not Clear) <succ>
    bacterial outside --- Certainty = 0.0000 (Not Clear) <succ>

An alignment of the GAS and GBS proteins is shown below.

```
Identities = 27/79 (34%), Positives = 45/79 (56%)
Query:  3 MKKECRDFYRQIQHTYNDISVREDAVLSSILLSASNGLIKTSDVPRVAYELTQQLENNEI   62
            M+K+  + Y  I+  Y+    RE+ LS +LL+ASN LIK S+   VAY+L Q ++N +
Sbjct:  1 MEKKRQRLYDVIRQAYDYPENRENVALSQLLLAASNRLIKHSNPLLVAYQLNQDVDNYLL   60
```

```
Query:  63 EKSFESLATVKELKKSAKK                                             81
           +       ++  K+S +K
Sbjct:  61 DNDILLPKSLCRFKQSLEK                                             79
```

Based on this analysis, it was predicted that these proteins and their epitopes could be useful antigens for vaccines or diagnostics.

Example 945

A DNA sequence (GBSx1003) was identified in *S. agalactiae* <SEQ ID 2873> which encodes the amino acid sequence <SEQ ID 2874>. This protein is predicted to be ABC transporter, ATP-binding protein. Analysis of this protein sequence reveals the following:

Possible site: 56
>>> Seems to have no N-terminal signal sequence
----- Final Results -----
  bacterial cytoplasm --- Certainty = 0.2610 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:CAB49925 GB:AJ248286 ABC transporter, ATP-binding protein
[Pyrococcus abysi]
Identities = 96/243 (39%), Positives = 164/243 (66%), Gaps = 2/243 (0%)
Query:   1 MIKFEHVSKVYGEKEALSDLTLSVKDGEIFGLIGHNGAGKTTTISILTSIIDATYGQVYI  60
           MI E++  K +G KE L   ++ +VKDGEI+GL+G NG+GK+TT+ IL+ II    G+V +
Sbjct:   1 MIIVENLRKRFGGKEVLKGISFTVKDGEIYGLLGPNGSGKSTTMRILSGIITDFEGKVIV  60

Query:  61 DDLLLTEHRDQIKKKIGYVPDSPDIFLNLTAEEYWYFLAKIYDVAPEDIEARITKLVDIF 120
           + + +    Q+K+ +GYVP++P ++ +LT  E++ F+  +   +  +E R+ KLV+ F
Sbjct:  61 GGVEVAKDPLQVKRIVGYVPETPALYESLTPAEFFSFVGGVRGIPKDILEERVRKLVEAF 120

Query: 121 ELEEQRYNPIESFSHGMRQKVIVIGALLPNPDIWILDEPLTGLDPQASFDLKEMMKEHAK 180
           E+++      I + S G +QK+ +I +LL +P + ILDE + GLDP+++   +E++ E  +
Sbjct: 121 EIKKYMNQLIGTLSFGTKQKISLISSLLHDPKVLILDEAMNGLDPKSARIFRELLYEFKE 180

Query: 181 NGKTVIFSTHVLAVAEQLCDRIGILKQGKLIFVGSLGELKMKYPDKDLETIYLELAGRQA 240
             GK+++FSTHVLA+AE +CDR+GI+ QG++I   G++ ELK     ++ LE ++L+L   QA
Sbjct: 181 EGKSIVFSTHVLALAELICDRVGIIYQGRIIAEGTVEELKEISKEERLEDVFLKLT--QA 238

Query: 241 SRE                                                         243
           E
Sbjct: 239 KEE                                                         241
```

A related DNA sequence was identified in *S. pyogenes* <SEQ ID 2875> which encodes the amino acid sequence <SEQ ID 2876>. Analysis of this protein sequence reveals the following:

Possible site: 56
>>> Seems to have no N-terminal signal sequence
----- Final Results -----
  bacterial cytoplasm --- Certainty = 0.2723 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 182/244 (74%), Positives = 215/244 (87%)
Query:    1 MIKFEHVSKVYGEKEALSDLTLSVKDGEIFGLIGHNGAGKTTTISILTSIIDATYGQVYI 60
            MI+F+HVSK+YG+KEALSDL +++ DGEIFGLIGHNGAGKTTTISILTSII+A+YG+V++
Sbjct:    1 MIEFKHVSKLYGDKEALSDLNVTINDGEIFGLIGHNGAGKTTTISILTSIIEASYGEVFV 60

Query:   61 DDLLLTEHRDQIKKKIGYVPDSPDIFLNLTAEEYWYFLAKIYDVAPEDIEARITKLVDIF 120
            D LLTE+R+ IKK+I YVPDSPDIFLNLT EYW FLAKIY V+ ED E R+ +L +F
Sbjct:   61 DGQLLTENREAIKKQIAYVPDSPDIFLNLTPNEYWQFLAKIYGVSDEDREERLAQLTTLF 120

Query:  121 ELEEQRYNPIESFSHGMRQKVIVIGALLPNPDIWILDEPLTGLDPQASFDLKEMMKEHAK 180
            EL+E+    I+SFSHGMRQKVIVIGAL+ NP+IWILDEPLTGLDPQASFDLKEMMK HA
Sbjct:  121 ELKEEVNQTIDSFSHGMRQKVIVIGALVSNPNIWILDEPLTGLDPQASFDLKEMMKAHAA 180

Query:  181 NGKTVIFSTHVLAVAEQLCDRIGILKQGKLIFVGSLGELKMKYPDKDLETIYLELAGRQA 240
            +G TV+FSTHVL+VAEQLCDRIGILK+GKLIFVG++ ELK +PDKDLE+IYLELAGR+A
Sbjct:  181 SGHTVLFSTHVLSVAEQLCDRIGILKKGKLIFVGTIDELKEHHPDKDLESIYLELAGRKA 240

Query:  241 SREG                                                      244
            EG
Sbjct:  241 QEEG                                                      244
```

Based on this analysis, it was predicted that these proteins and their epitopes could be useful antigens for vaccines or diagnostics.

Example 946

A DNA sequence (GBSx1004) was identified in *S. agalactiae* <SEQ ID 2877> which encodes the amino acid sequence <SEQ ID 2878>. Analysis of this protein sequence reveals the following:

Possible site: 55
>>> Seems to have no N-terminal signal sequence
INTEGRAL    Likelihood = −13.43    Transmembrane 504-520 (495-529)
INTEGRAL    Likelihood = −12.58    Transmembrane 427-443 (400-449)
INTEGRAL    Likelihood = −10.99    Transmembrane 151-167 (144-179)
INTEGRAL    Likelihood = −8.44     Transmembrane 194-210 (189-214)
INTEGRAL    Likelihood = −7.96     Transmembrane 48-64 (46-68)
INTEGRAL    Likelihood = −7.32     Transmembrane 350-366 (348-378)
INTEGRAL    Likelihood = −6.69     Transmembrane 475-491 (474-501)
INTEGRAL    Likelihood = −6.00     Transmembrane 319-335 (318-337)
INTEGRAL    Likelihood = −5.73     Transmembrane 252-268 (244-271)
INTEGRAL    Likelihood = −4.78     Transmembrane 125-141 (121-148)
INTEGRAL    Likelihood = −4.51     Transmembrane 76-92 (71-98)
INTEGRAL    Likelihood = −3.56     Transmembrane 406-422 (400-426)
----- Final Results -----
  bacterial membrane --- Certainty = 0.6371 (Affirmative) <succ>
    bacterial outside --- Certainty = 0.0000 (Not Clear) <succ>
      bacterial cytoplasm --- Certainty = 0.0000 (Not Clear) <succ>

The protein has no significant homology with any sequences in the GENPEPT database.

A related DNA sequence was identified in *S. pyogenes* <SEQ ID 2879> which encodes the amino acid sequence <SEQ ID 2880>. Analysis of this protein sequence reveals the following:

Possible site: 37
>>> Seems to have no N-terminal signal sequence
INTEGRAL    Likelihood = −14.33    Transmembrane 167-183 (158-193)

-continued

INTEGRAL    Likelihood = −12.52    Transmembrane 524-540 (508-546)
INTEGRAL    Likelihood = −10.93    Transmembrane 63-79 (60-84)
INTEGRAL    Likelihood = −8.39     Transmembrane 421-437 (414-456)
INTEGRAL    Likelihood = −8.23     Transmembrane 208-224 (203-228)
INTEGRAL    Likelihood = −8.23     Transmembrane 504-520 (493-521)
INTEGRAL    Likelihood = −7.59     Transmembrane 139-155 (134-162)
INTEGRAL    Likelihood = −6.64     Transmembrane 261-277 (257-287)
INTEGRAL    Likelihood = −4.99     Transmembrane 446-462 (444-464)
INTEGRAL    Likelihood = −4.25     Transmembrane 369-385 (367-387)
INTEGRAL    Likelihood = −0.80     Transmembrane 87-103 (87-104)
INTEGRAL    Likelihood = −0.11     Transmembrane 334-350 (334-350)
----- Final Results -----
  bacterial membrane --- Certainty = 0.6731 (Affirmative) <succ>
    bacterial outside --- Certainty = 0.0000 (Not Clear) <succ>
      bacterial cytoplasm --- Certainty = 0.0000 (Not Clear) <succ>

A related sequence was also identified in GAS <SEQ ID 9173> which encodes the amino acid sequence <SEQ ID 9174>. Analysis of this protein sequence reveals the following:

Possible site: 51
>>> Seems to have no N-terminal signalsequence
INTEGRAL    Likelihood = −14.33    Transmembrane 153-169 (144-179)
INTEGRAL    Likelihood = −12.52    Transmembrane 510-526 (494-532)
INTEGRAL    Likelihood = −10.93    Transmembrane 49-65 (46-70)
INTEGRAL    Likelihood = −8.39     Transmembrane 407-423 (400-442)
INTEGRAL    Likelihood = −8.23     Transmembrane 194-210 (189-214)
INTEGRAL    Likelihood = −8.23     Transmembrane 490-506 (479-507)
INTEGRAL    Likelihood = −7.59     Transmembrane 125-141 (120-148)
INTEGRAL    Likelihood = −6.64     Transmembrane 247-263 (243-273)
INTEGRAL    Likelihood = −4.99     Transmembrane 432-448 (430-450)
INTEGRAL    Likelihood = −4.25     Transmembrane 355-371 (353-373)
INTEGRAL    Likelihood = −0.80     Transmembrane 73-89 (73-90)
INTEGRAL    Likelihood = −0.11     Transmembrane 320-336 (320-336)
----- Final Results -----
  bacterial membrane --- Certainty = 0.673 (Affirmative) <succ>
    bacterial outside --- Certainty = 0.0000 (Not Clear) <succ>
      bacterial cytoplasm --- Certainty = 0.0000 (Not Clear) <succ>

An alignment of the GAS and GBS proteins is shown below.

```
Identities = 255/542 (47%), Positives = 378/542 (69%), Gaps = 12/542 (2%)
Query:    1 MNWSRIWELVKINILYSNPQTLSALRKKQEKHPKKEFSAYKSMFRNQLFQILLFSIIYVF 60
            MNWS IWEL+KINILYSNPQ+L+ L+K+QEKHPK+ F AYKSM R Q   I +F +IY+F
```

-continued

```
Sbjct:   15 MNWSTIWELIKINILYSNPQSLANLKKRQEKHPKENFKAYKSMMRQQALMIAMFLVIYLF 74

Query:   61 LFVSLDFKEYPGYFTFYIGIFTLVSIIYSFIAMYSVFYESDDVKQYAYLPIKSEELYVAK 120
            +F+ +DF  YPG F+F + +F ++S + +F ++Y++FYES+D+K Y +LP+ SEELY+AK
Sbjct:   75 MFIGVDFSHYPGLFSFDVAMFFIMSTLTAFSSLYTIFYESNDLKYIHLPVTSEELYIAK 134

Query:  121 IFATFGMSVTFLMPILTLMIVAYWRIIGGPLAVLLAIINFAILFLSVTVISLYINSLIGR 180
            I ++ GM   FLMP+++L+++AYW+++G PL++L+AI+ F +L +S  V+++YIN+ +G+
Sbjct:  135 IVSSLGMGAVFLMPLISLLLIAYWQLLGNPLSILVAIVLFLVLLVSSMVLAIYINAWVGK 194

Query:  181 AIIRSANRKLISTILISLATFGAIVPLLFVNMTSQK--MVQGKLQDIAPIPYVRGYYDIV 238
            I+RS RKLISTI++ ++TFGA V + +N+++ K  M  G   D   IPY +G+YD+V
Sbjct:  195 IIVRSRKRKLISTIMMFVSTFGAFVLIFAINISNNKRTMTDGVFTDYPTIPYFKGFYDVV 254

Query:  239 TAPFSMESLLNYYLPLLIILFLIGAIYKWVMPRYYQELLY----GQVKQRK--VHRQIDF 292
            APFS +LLN++LPLL+IL ++ I   VMP YY+E Y     +VKQ K  V+R
Sbjct:  255 QAPFSTAALLNFWLPLLLILAMVYGIVTKVMPTYYREAFYISNENKVKQTKKPVNRP---311

Query:  293 SKRESINKTLVKHHLSSLQNATLLTNTFLMPLLYLAMFIVPILNNGKEIGRFFNENYFGI 352
            + +S+ + L KHHL +LQNATLLT T+LMPL+Y+ +FI P L+ G   +  + +YFG+
Sbjct:  312 HQNQSLAQLLRKHHLLTLQNATLLTQTYLMPLMYVMLFIGPSLSRGTGFFKHISPDYFGV 371

Query:  353 AFLAGILIGSLCVMPASIVGVGISLEKSNFYFIKSLPISFSYFLKHKFVTLITLQLAVPT 412
            A L G+ +G +C  P S +GVGISLEK NF FIKSLPI+   FL  KF L+ LQL VP
Sbjct:  372 ALLFGVSLGVMCATPTSFIGVGISLEKDNFTFIKSLPITLKKFLMDKFCLLVGLQLIVPM 431

Query:  413 FIYFLVGFFLLKLSILVLLSFILGLVFMGLIEGQFIYRRDYKHLFLNWQEVTQLFNRGLG 472
            IY + G F+L L  L+ ++F LG    +++G+ +YRRDY+ L L WQ++TQLF RG G
Sbjct:  432 VIYLVFGLFVLHLHPLLTIAFCLGYALSLIVQGELMYRRDYRLLDLKWQDMTQLFTRGDG 491

Query:  473 QWLLVGSLFGMMIIGSFL-IGISIFWSMVWNTVAVNIIILIIGLLILSICQYLLLKNFWK 531
            QWL +G +FG +I+  L G I +++  + ++I++  + L++L + Q + K FWK
Sbjct:  492 QWLTMGLIFGNLIVAGVLGFGAVIIANIIQQPLLISILLSCLILMVLGLAQLWIQKTFWK 551

Query:  532 KL  533
            L
Sbjct:  552 SL  553
```

Based on this analysis, it was predicted that these proteins and their epitopes could be useful antigens for vaccines or diagnostics.

Example 947

A DNA sequence (GBSx1005) was identified in *S. agalactiae* <SEQ ID 2881> which encodes the amino acid sequence <SEQ ID 2882>. Analysis of this protein sequence reveals the following:

Possible site: 44
>>> Seems to have no N-terminal signal sequence

| | | |
|---|---|---|
| INTEGRAL | Likelihood = −8.12 | Transmembrane 242-258 (239-265) |
| INTEGRAL | Likelihood = −7.64 | Transmembrane 430-446 (421-450) |
| INTEGRAL | Likelihood = −5.84 | Transmembrane 120-136 (113-139) |
| INTEGRAL | Likelihood = −5.52 | Transmembrane 212-228 (210-232) |
| INTEGRAL | Likelihood = −5.20 | Transmembrane 287-303 (283-313) |
| INTEGRAL | Likelihood = −3.56 | Transmembrane 148-164 (143-166) |
| INTEGRAL | Likelihood = −0.48 | Transmembrane 382-398 (382-398) |

----- Final Results -----
bacterial membrane --- Certainty = 0.4248 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the GENPEPT database.

```
>GP:CAB15963 GB:Z99124 phosphotransferase system (PTS)
beta-glucoside-specific enzyme IIABC component [Bacillus subtilis]
Identities = 175/447 (39%), Positives = 266/447 (59%), Gaps = 10/447 (2%)
Query:    4 EYITLSKNIIKHLGGQNNINNVYHCQTRLRFSLNDPTKVNLEQLKTLKEVKTVVISGGQH 63
            +Y  LSK+I++ +GG+ N+   V HC TRLRF+L+D   K + QL+ L V    ISG Q
Sbjct:    2 DYDKLSKDILQLVGGEENVQRVIHCMTRLRFNLHDNAKADRSQLEQLPGVMGTNISGEQF 61

Query:   64 QIVIGTHVAKVFEEI---NSLIETNSTTKIEQTKKAKAVSRIIDFVSGTFQPILPALSGA 120
            QI+IG  V KV++ I   ++L +   S   Q K   +S + D +SG F PILPA++GA
Sbjct:   62 QIIIGNDVPKVYQAIVRHSNLSDEKSAGSSSQKKNV--LSAVFDVISGVFTPILPAIAGA 119

Query:  121 GMIKALLALLLVFKILTPSSQTYILLNLFADGVFYFLPILIAITAAQKLKANPILALGTV 180
            GMIK L+AL + F +    SQ +++L   DG FYFLP+L+A++AA+K  +NP +A
Sbjct:  120 GMIKGLVALAVTFGWMAEKSQVHVILTAVGDGAFYFLPLLLAMSAARKFGSNPYVAAAIA 179

Query:  181 VMLLHPNWANLVASGKPVSLFHTIPFTLTNYASSVIPIILIICVQAYIEKYLKQIIPKSL 240
            +LHP+    L+ +GKP+S F  +P T  Y+S+VIPI+L I + +Y+EK++ +    SL
Sbjct:  180 AAILHPDLTALLGAGKPIS-FIGLPVTAATYSSTVIPILLSIWIASYVEKWIDRFTHASL 238

Query:  241 RLVLVPMLIFLSMGILSFSILGPMGTIAGQYLAVIFTFLSKYASW-APAFLVGAFAPILI 299
            +L++VP   L + +L+   +GP+G I G+YL+    +L +A   A  FL G F  ++I
```

```
-continued
Sbjct: 239 KLIVVPTFTLLIVVPLTLITVGPLGAILGEYLSSGVNYLFDHAGLVAMIFLAGTFS-LII 297

Query: 300 MFGVHSGIAALGITQLAKLGVDSIFGPGMLCSNIAQATAGTVVTLITKEKKLKEIAGPAA 359
            M G+H    + I +A+ G D +  P M  +N+ QA A   V L ++ KK K +A   +
Sbjct: 298 MTGMHYAFVPIMINNIAQNGHDYLL-PAMFLANMGQAGASFAVFLRSRNKKFKSLALTTS 356

Query: 360 ITAYMGITEPILYGVNLPKRYPLIASLIGGGLGGLYAGIMNAHRFAV-GSSGLPGLFLYI 418
            ITA MGITEP +YGVN+  + P  A+LIGG  GG + G+      + V G++GLP + ++I
Sbjct: 357 ITALMGITEPAMYGVNMRLKKPFAAALIGGAAGGAFYGMTGVASYIVGGNAGLPSIPVFI 416

Query: 419 SHTSTHLFITMLIAVIITVSTTAILTF                                445
            T + I ++IA      S       F
Sbjct: 417 GPTFIYAMIGLVIAFAAGTSAAYLLGF                                443
```

There is also homology to SEQ ID 2884.

Based on this analysis, it was predicted that this protein and its epitopes, could be useful antigens for vaccines or diagnostics.

Example 948

A DNA sequence (GBSx1006) was identified in *S. agalactiae* <SEQ ID 2885> which encodes the amino acid sequence <SEQ ID 2886>. This protein is predicted to be gamma-glutamyl kinase (proB). Analysis of this protein sequence reveals the following:

---

Possible site: 58
>>> Seems to have no N-terminal signal sequence
INTEGRAL    Likelihood = −0.11    Transmembrane 160-176 (160-176)
----- Final Results -----
  bacterial membrane --- Certainty = 0.1044 (Affirmative) <succ>
    bacterial outside --- Certainty = 0.0000 (Not Clear) <succ>
     bacterial cytoplasm --- Certainty = 0.0000 (Not Clear) <succ>

---

The protein has homology with the following sequences in the GENPEPT database.

```
>GP:CAA63147 GB:X92418 gamma-glutamyl kinase [Streptococcus thermophilus]
Identities = 200/265 (75%), Positives = 235/265 (88%)
Query:    1 MKRHFETTRRIVIKVGTSSLVQTSGKINLSKIDHLAFVISSLMNRGMEVILVSSGAMGFG  60
            MKR+F++ +R+VIK+GTSSLV  SGKINL KID LAFVISSL N+G+EV+LVSSGAMGFG
Sbjct:    1 MKRNFDSVKRLVIKIGTSSLVLPSGKINLEKIDQLAFVISSLHNKGIEVVLVSSGAMGFG  60

Query:   61 LDILKMDKRPQEISQQQAVSSVGQVAMMSLYSQIFSHYQTHVSQILLTRDVVVFPESLQN 120
            L++L  ++KRP E+ +QQAVSSVGQVAMMSLYSQ+FSHYQT VSQ+LLTRDVV + ESL N
Sbjct:   61 LNVLDLEKRPAEVGKQQAVSSVGQVAMMSLYSQVFSHYQTKVSQLLLTRDVVEYSESLAN 120

Query:  121 VTNSFESLLSMGILPIVNENDAVSVDEMDHKTKFGDNDRLSAVVAKITKADLLIMLSDID 180
                N+FESL   +G++PIVNENDAVSVDEMDH TKFGDNDRLSA+VAK+  ADLLIMLSDID
Sbjct:  121 AINAFESLFELGVVPIVNENDAVSVDEMDHATKFGDNDRLSAIVAKVVGADLLIMLSDID 180

Query:  181 GLFDKNPNIYDDAVLRSHVSEITDDIIKSAGGAGSKFGTGGMLSKIKSAQMVFDNNGQMI 240
            GLFDKNPN+Y+DA LRS+V EIT++I+ SAGGAGSKFGTGGM+SKIKSAQMVF+N  QM+
Sbjct:  181 GLFDKNPNVYEDATLRSYVPEITEEILASAGGAGSKFGTGGMMSKIKSAQMVFENQSQMV 240

Query:  241 LMNGANPRDILKVLDGHNIGTYFAQ                                 265
            LMNG NPRDIL+VL+G  IGT F Q
Sbjct:  241 LMNGENPRDILRVLEGAKIGTLFKQ                                 265
```

A related DNA sequence was identified in *S. pyogenes* <SEQ ID 2887> which encodes the amino acid sequence <SEQ ID 2888>. Analysis of this protein sequence reveals the following:

---

Possible site: 61
>>> Seems to have no N-terminal signal sequence
INTEGRAL    Likelihood = −1.97    Transmembrane 163-179 (163-179)
INTEGRAL    Likelihood = −0.06    Transmembrane 124-140 (124-140)
----- Final Results -----
  bacterial membrane --- Certainty = 0.1786 (Affirmative) <succ>
    bacterial outside --- Certainty = 0.0000 (Not Clear) <succ>
     bacterial cytoplasm --- Certainty = 0.0000 (Not Clear) <succ>

---

The protein has homology with the following sequences in the databases:

```
>GP:CAA63147 GB:X92418 gamma-glutamyl kinase [Streptococcus thermophilus]
Identities = 212/265 (80%), Positives = 237/265 (89%)
Query:    4 MKRQFEDVTRIVIKIGTSSLVLPTGKINLEKIDQLAFVISSLMNKGKEVILVSSGAMGFG  63
            MKR F+ V R+VIKIGTSSLVLP+GKINLEKIDQLAFVISSL NKG EV+LVSSGAMGFG
```

-continued

```
Sbjct:  1 MKRNFDSVKRLVIKIGTSSLVLPSGKINLEKIDQLAFVISSLHNKGIEVVLVSSGAMGFG 60

Query: 64 LDILKMEKRPTNLAKQQAVSSVGQVAMMSLYSQIFAYYQTNVSQILLTRDVVVFPESLAN 123
          L++L +EKRP  + KQQAVSSVGQVAMMSLYSQ+F++YQT VSQ+LLTRDVV + ESLAN
Sbjct: 61 LNVLDLEKRPAEVGKQQAVSSVGQVAMMSLYSQVFSHYQTKVSQLLLTRDVVEYSESLAN 120

Query: 124 VTNAFESLISLGIVPIVNENDAVSVDEMDHATKFGDNDRLSAVVAGITKADLLIMLSDID 183
            NAFESL  LG+VPIVNENDAVSVDEMDHATKFGDNDRLSA+VA +  ADLLIMLSDID
Sbjct: 121 AINAFESLFELGVVPIVNENDAVSVDEMDHATKFGDNDRLSAIVAKVVGADLLIMLSDID 180

Query: 184 GLFDKNPTIYEDAQLRSHVANITQEIIASAGGAGSKFGTGGMLSKVQSAQMVFENKGQMV 243
            GLFDKNP +YEDA LRS+V   IT+EI+ASAGGAGSKFGTGGM+SK++SAQMVFEN+ QMV
Sbjct: 181 GLFDKNPNVYEDATLRSYVPEITEEILASAGGAGSKFGTGGMMSKIKSAQMVFENQSQMV 240

Query: 244 LMNGANPRDILRVLEGQPLGTWFKQ 268
            LMNG NPRDILRVLEG +GT FKQ
Sbjct: 241 LMNGENPRDILRVLEGAKIGTLFKQ 265
```

An alignment of the GAS and GBS proteins is shown below.

```
Identities = 217/265 (81%), Positives = 242/265 (90%)
Query:  1 MKRHFETTRRIVIKVGTSSLVQTSGKINLSKIDHLAFVISSLMNRGMEVILVSSGAMGFG 60
          MKR FE   RIVIK+GTSSLV +GKINL KID LAFVISSLMN+G EVILVSSGAMGFG
Sbjct:  4 MKRQFEDVTRIVIKIGTSSLVLPTGKINLEKIDQLAFVISSLMNKGKEVILVSSGAMGFG 63

Query: 61 LDILKMDKRPQEISQQQAVSSVGQVAMMSLYSQIFSHYQTHVSQILLTRDVVVFPESLQN 120
          LDILKM+KRP +++QQAVSSVGQVAMMSLYSQIF++YQT+VSQILLTRDVVVFPESL N
Sbjct: 64 LDILKMEKRPTNLAKQQAVSSVGQVAMMSLYSQIFAYYQTNVSQILLTRDVVVFPESLAN 123

Query: 121 VTNSFESLLSMGILPIVNENDAVSVDEMDHKTKFGDNDRLSAVVAKITKADLLIMLSDID 180
            VTN+FESL+S+GI+PIVNENDAVSVDEMDH TKFGDNDRLSAVVA ITKADLLIMLSDID
Sbjct: 124 VTNAFESLISLGIVPIVNENDAVSVDEMDHATKFGDNDRLSAVVAGITKADLLIMLSDID 183

Query: 181 GLFDKNPNIYDDAVLRSHVSEITDDIIKSAGGAGSKFGTGGMLSKIKSAQMVFDNNGQMI 240
            GLFDKNP IY+DA LRSHV+ IT +II SAGGAGSKFGTGGMLSK++SAQMVF+N GQM+
Sbjct: 184 GLFDKNPTIYEDAQLRSHVANITQEIIASAGGAGSKFGTGGMLSKVQSAQMVFENKGQMV 243

Query: 241 LMNGANPRDILKVLDGHNIGTYFAQ 265
            LMNGANPRDIL+VL+G  +GT+F Q
Sbjct: 244 LMNGANPRDILRVLEGQPLGTWFKQ 268
```

Based on this analysis, it was predicted that these proteins and their epitopes could be useful antigens for vaccines or diagnostics.

Example 949

A DNA sequence (GBSx1007) was identified in *S. agalactiae* <SEQ ID 2889> which encodes the amino acid sequence <SEQ ID 2890>. This protein is predicted to be unnamed protein product (proA). Analysis of this protein sequence reveals the following:

---

Possible site: 55
>>> Seems to have no N-terminal signal sequence
----- Final Results -----
    bacterial cytoplasm --- Certainty = 0.3517 (Affirmative) <succ>
        bacterial membrane --- Certainty = 0.0000 (Not Clear) <succ>
            bacterial outside --- Certainty = 0.0000 (Not Clear) <succ>

---

A related DNA sequence was identified in *S. pyogenes* <SEQ ID 2891> which encodes the amino acid sequence <SEQ ID 2892>. Analysis of this protein sequence reveals the following:

---

Possible site: 55
>>> Seems to have no N-terminal signal sequence
----- Final Results -----
    bacterial membrane --- Certainty = 0.0000 (Not Clear) <succ>
        bacterial outside --- Certainty = 0.0000 (Not Clear) <succ>
            bacterial cytoplasm --- Certainty = 0.0000 (Not Clear) <succ>

---

The protein has homology with the following sequences in the databases:

```
>GP:CAA63148 GB:X92418 gamma-glutamyl phosphate reductase
[Streptococcus thermophilus]
Identities = 309/416 (74%), Positives = 355/416 (85%)
Query:  1 MTDMRRLGQRAKQASLLIAPLSTQIKNRFLSTLAKALVDDTQTLLAANQKDLANAKEHGI 60
          MT +  LGQ+AK AS  IA LST  KN  L+ +AKALV ++  +   N KD+ANA E+GI
Sbjct:  1 MTYVDTLGQQAKVASRQIAKLSTAAKNDLLNQVAKALVAESDYIFTENAKDMANASENGI 60

Query: 61 SDIMMDRLRLTSERIKAIAQGVQQVADLADPIGQVIKGYTNLDGLKILQKRVPLGVIAMI 120
```

-continued

```
            S IM DRL LT +RI   IA+GV+QVADL DPIGQV++GYTNLDGLKI+QKRVP+GVIAMI
Sbjct:   61 SKIMQDRLLLTEDRIAGIAEGVRQVADLQDPIGQVVRGYTNLDGLKIVQKRVPMGVIAMI 120

Query:  121 FESRPNVSVDAFSLAFKTNNAIILRGGKDALHSNKALVKLIRQSLEKSGITPDAVQLVED 180
            FESRPNVS+DAFSLAFKTNNAIILRGG+DA++SNKALV + R++L+ +GIT DAVQ VED
Sbjct:  121 FESRPNVSIDAFSLAFKTNNAIILRGGRDAINSNKALVTVARKALKNAGITADAVQFVED 180

Query:  181 PSHAVAEELMQATDYVDVLIPRGGAKLIQTVKEKAKVPVIETGVGNVHIYVDAQADLDIA 240
             SH VAEELM AT YVD+LIPRGGA+LIQTVKEKAKVPVIETGVGN HIYVD  A+LD+A
Sbjct:  181 TSHEVAEELMVATKYVDLLIPRGGARLIQTVKEKAKVPVIETGVGNCHIYVDKYANLDMA 240

Query:  241 TKIVINAKTKRPSVCNAAEGLVIHEAVAARFIPMLEKAINQVQPVEWRADDKALPLFEQA 300
            T+IVINAKT+RPSVCNAAE LV+H  +    F+P LEKAI+++Q VE+RAD++AL L E+A
Sbjct:  241 TQIVINAKTQRPSVCNAAESLVVHADIVEEFLPNLEKAISKIQSVEFRADERALKLMEKA 300

Query:  301 VPAKAEDFETEFLDYIMSVKVVSSLEEAISWINQYTSHHSEAIITRDIKAAETFQDLVDA 360
            VPA   EDF TEFLDYIMSVKVV SL+EAI+WIN YT+ HSEAI+T+DI  AE FQD VDA
Sbjct:  301 VPASPEDFATEFLDYIMSVKVVDSLDEAINWINTYTTSHSEAIVTQDISRAEQFQDDVDA 360

Query:  361 AAVYVNASTRFTDGFVFGLGAEIGISTQKMHARGPMGLEALTSTKFYINGDGHIRE   416
            AAVYVNASTRFTDGFVFGLGAEIGISTQKMHARGPMGLEALTSTKFYING G IRE
Sbjct:  361 AAVYVNASTRFTDGFVFGLGAEIGISTQKMHARGPMGLEALTSTKFYINGQGQIRE   416
```

An alignment of the GAS and GBS proteins is shown below.

```
Identities = 307/417 (73%), Positives = 353/417 (84%), Gaps = 1/417 (0%)
Query:    1 MTYIEILGQNAKKASQSVARLSTASKNEILRDLARNIVADTETILTENARDVVKAKDNGI  60
            MT +  LGQ AK+AS  +A LST  KN   L  LA+ +V DT+T+L  N +D+  AK++GI
Sbjct:    1 MTDMRRLGQRAKQASLLIAPLSTQIKNRFLSTLAKALVDDTQTLLAANQKDLANAKEHGI  60

Query:   61 SEIMVDRLRLNKDRIQAIANGIYQVADLADPIGQVVSGYTNLDGLKILKKRVPLGVIAMI 120
            S+IM+DRLRL  +RI+AIA G+ QVADLADPIGQV+ GYTNLDGLKIL+KRVPLGVIAMI
Sbjct:   61 SDIMMDRLRLTSERIKAIAQGVQQVADLADPIGQVIKGYTNLDGLKILQKRVPLGVIAMI 120

Query:  121 FESRPNVSVDAFSLAFKTGNAIILRGGKDAIFSNTALVNCMRQTLQDTGHNPDIVQLVED 180
            FESRPNVSVDAFSLAFKT NAIILRGGKDA+ SN ALV  +RQ+L+ +G  PD VQLVED
Sbjct:  121 FESRPNVSVDAFSLAFKTNNAIILRGGKDALHSNKALVKLIRQSLEKSGITPDAVQLVED 180

Query:  181 TSHVVAEELMQATDYVDVLIPRGGAKLIQTVKEKSKIPVIETGVGNVHIYIDEFADLDMA 240
             SH VAEELMQATDYVDVLIPRGGAKLIQTVKEK+K+PVIETGVGNVHIY+D  ADLD+A
Sbjct:  181 PSHAVAEELMQATDYVDVLIPRGGAKLIQTVKEKAKVPVIETGVGNVHIYVDAQADLDIA 240

Query:  241 AKIVINAKTQRPSVCNAAEGLVVHQAIAKGFLSQLEKMLKESNQSVEFRADEEALQLLEN 300
             KIVINAKT+RPSVCNAAEGLV+H+A+A  F+  LEK + +  Q VE+RAD++AL L E
Sbjct:  241 TKIVINAKTKRPSVCNAAEGLVIHEAVAARFIPMLEKAINQV-QPVEWRADDKALPLFEQ 299

Query:  301 AVAASESDYATEFLDYIMSVKVVDSFEQAISWINKYSSHHSEAIITNNISRAEIFQDMVD 360
            AV A    D+ TEFLDYIMSVKVV S E+AISWIN+Y+SHHSEAIIT  +I  AE FQD+VD
Sbjct:  300 AVPAKAEDFETEFLDYIMSVKVVSSLEEAISWINQYTSHHSEAIITRDIKAAETFQDLVD 359

Query:  361 AAVYVNASTRFTDGFVFGLGAEIGISTQKLHARGPMGLEALTSTKYYINGTGQVRE   417
            AAAVYVNASTRFTDGFVFGLGAEIGISTQK+HARGPMGLEALTSTK+YING G +RE
Sbjct:  360 AAAVYVNASTRFTDGFVFGLGAEIGISTQKMHARGPMGLEALTSTKFYINGDGHIRE   416
```

Based on this analysis, it was predicted that these proteins and their epitopes could be useful antigens for vaccines or diagnostics.

Example 950

A DNA sequence (GBSx1008) was identified in *S. agalactiae* <SEQ ID 2893> which encodes the amino acid sequence <SEQ ID 2894>. Analysis of this protein sequence reveals the following:

Possible site: 53
>>> Seems to have no N-terminal signal sequence
----- Final Results -----
    bacterial cytoplasm --- Certainty = 0.1859 (Affirmative) <succ>
    bacterial membrane --- Certainty = 0.0000 (Not Clear) <succ>
    bacterial outside --- Certainty = 0.0000 (Not Clear) <succ>

A related GBS nucleic acid sequence <SEQ ID 9531> which encodes amino acid sequence <SEQ ID 9532> was also identified.

A related DNA sequence was identified in *S. pyogenes* <SEQ ID 2895> which encodes the amino acid sequence <SEQ ID 2896>. Analysis of this protein sequence reveals the following:

Possible site: 23
>>> Seems to have no N-terminal signal sequence
----- Final Results -----
    bacterial cytoplasm --- Certainty = 0.0853 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below.

```
Identities = 259/315 (82%), Positives = 287/315 (90%)
Query:    1 MTNDFHHITVLLHETVDMLDIKPDGIYVDATLGGAGHSEYLLSQLGPDGHLYAFDQDQKA  60
            MT +FHH+TVLLHETVDMLDIKPDGIYVDATLGG+GHS YLLS+LG +GHLY FDQDQKA
Sbjct:   22 MTKEFHHVTVLLHETVDMLDIKPDGIYVDATLGGSGHSAYLLSKLGEEGHLYCFDQDQKA  81

Query:   61 IDNAHIRLKKYVDTGQVTFIKDNFRNLSSNLKALGVSEINGICYDLGVSSPQLDERERGF 120
            IDNA + LK Y+D GQVTFIKDNFR+L + L ALGV EI+GI YDLGVSSPQLDERERGF
Sbjct:   82 IDNAQVTLKSYIDKGQVTFIKDNFRHLKARLTALGVDEIDGILYDLGVSSPQLDERERGF 141

Query:  121 SYKQDAPLDMRMNREQSLTAYDVVNTYSYHDLVRIFFKYGEDKFSKQIARKIEQVRAEKT 180
            SYKQDAPLDMRM+R+   LTAY+VVNTY ++DLV+IFFKYGEDKFSKQIARKIEQ RA K
Sbjct:  142 SYKQDAPLDMRMDRQSLLTAYEVVNTYPFNDLVKIFFKYGEDKFSKQIARKIEQARAIKP 201

Query:  181 ISTTTELAEIIKSSKSAKELKKKGHPAKQIFQAIRIEVNDELGAADESIQQAMDLLAVDG 240
            I TTTELAE+IK++K AKELKKKGHPAKQIFQAIRIEVNDELGAADESIQ AM+LLA+DG
Sbjct:  202 IETTTELAELIKAAKPAKELKKKGHPAKQIFQAIRIEVNDELGAADESIQDAMELLALDG 261

Query:  241 RISVITFHSLEDRLTKQLFKEASTVEVPKGLPFIPDDLQPKMELVNRKPILPSQEELEAN 300
            RISVITFHSLEDRLTKQLFKEASTV+VPKGLP IP+D++PK ELV+RKPILPS  EL AN
Sbjct:  262 RISVITFHSLEDRLTKQLFKEASTVDVPKGLPLIPEDMKPKFELVSRKPILPSHSELTAN 321

Query:  301 NRAHSAKLRVARRIR                                             315
            RAHSAKLRVA++IR
Sbjct:  322 KRAHSAKLRVAKKIR                                             336
```

Based on this analysis, it was predicted that these proteins and their epitopes could be useful antigens for vaccines or diagnostics.

Example 951

A DNA sequence (GBSx1009) was identified in *S. agalactiae* <SEQ ID 2897> which encodes the amino acid sequence <SEQ ID 2898>. This protein is predicted to be FtsL. Analysis of this protein sequence reveals the following:

---

Possible site: 42
>>> Seems to have no N-terminal signal sequence
INTEGRAL    Likelihood = −8.92    Transmembrane 30-46 (24-49)
----- Final Results -----
   bacterial membrane --- Certainty = 0.4567 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the GENPEPT database.

```
>GP:AAC95455 GB:AF068903 Y11D [Streptococcus pneumoniae]
Identities = 44/99 (44%), Positives = 71/99 (71%)
Query:    5 KRTEAVTQTLQRHIKTFSRIEKAFYGAIVITAIIMAVGIIYLQSNSLQVKQEVNQLNSKI  64
            ++ E   Q LQ  +K FSR+EKAFY +I +T +I+A+ II++Q+  LQV+ ++ ++N++I
Sbjct:    3 EKMEKTGQILQMQLKRFSRVEKAFYFSIAVTTLIVAISIIFMQTKLLQVQNDLTKINAQI  62

Query:   65 NDKQTEFDNAKQEVNELSNRDRITKIAKDAGLTIQNDNI                     103
            +K+TE D+AKQEVNEL   +R+ +IA    L + N+NI
Sbjct:   63 EEKKTELDDAKQEVNELLRAERLKEIANSHDLQLNNENI                     101
```

A related DNA sequence was identified in *S. pyogenes* <SEQ ID 2899> which encodes the amino acid sequence <SEQ ID 2900>. Analysis of this protein sequence reveals the following:

---

Possible site: 50
>>> Seems to have no N-terminal signal sequence
INTEGRAL    Likelihood = −5.79    Transmembrane 40-56 (37-58)
----- Final Results -----
   bacterial membrane --- Certainty = 0.3314 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the databases:

```
>GP:AAC95455 GB:AF068903 Y11D [Streptococcus pneumoniae]
Identities = 45/94 (47%), Positives = 69/94 (72%)
Query:   24 LQKRIKTFSRIEKAFYTAIIVTAITMAVSIIYLQSRKLQLQQEITSLNSHISDQKLELNN  83
            LQ ++K FSR+EKAFY +I VT + +A+SII++Q++ LQ+Q ++T +N+ I ++K EL++
Sbjct:   12 LQMQLKRFSRVEKAFYFSIAVTTLIVAISIIFMQTKLLQVQNDLTKINAQIEEKKTELDD  71

Query:   84 AKQEVNELSRRDRIIDIAGKAGLSNRNNNIKKVE                          117
            AKQEVNEL R +R+ +IA    L    N NI+  E
Sbjct:   72 AKQEVNELLRAERLKEIANSHDLQLNNENIRIAE                          105
```

An alignment of the GAS and GBS proteins is shown below.

```
Identities = 71/108(65%), Positives = 87/108 (79%), Gaps = 1/108 (0%)
Query:   1 MTNEKRTEAVTQTLQRHIKTFSRIEKAFYGAIVITAIIMAVGIIYLQSNSLQVKQEVNQL 60
           MTNEKRT+ VT  LQ+ IKTFSRIEKAFY AI++TAI MAV IIYLQS  LQ++QE+  L
Sbjct:  11 MTNEKRTQVVTNALQKRIKTFSRIEKAFYTAIIVTAITMAVSIIYLQSRKLQLQQEITSL 70

Query:  61 NSKINDKQTEFDNAKQEVNELSNRDRITKIAKDAGLTIQNDNIYRKVD          108
           NS I+D++ E +NAKQEVNELS RDRI  IA  AGL+ +N+NI +KV+
Sbjct:  71 NSHISDQKLELNNAKQEVNELSRRDRIIDIAGKAGLSNRNNNI-KKVE          117
```

SEQ ID 2898 (GBS82) was expressed in *E. coli* as a GST-fusion product. SDS-PAGE analysis of total cell extract is shown in FIG. 15 (lane 2; 2 bands).

Based on this analysis, it was predicted that these proteins and their epitopes could be useful antigens for vaccines or diagnostics.

Example 952

A DNA sequence (GBSx1010) was identified in *S. agalactiae* <SEQ ID 2901> which encodes the amino acid sequence <SEQ ID 2902>. Analysis of this protein sequence reveals the following:

Possible site: 21
>>> Seems to have no N-terminal signal sequence
----- Final Results -----
   bacterial cytoplasm --- Certainty = 0.1435 (Affirmative) <succ>
      bacterial membrane --- Certainty = 0.0000 (Not Clear) <succ>
         bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes could be useful antigens for vaccines or diagnostics.

Example 953

A DNA sequence (GBSx1011) was identified in *S. agalactiae* <SEQ ID 2903> which encodes the amino acid sequence <SEQ ID 2904>. This protein is predicted to be unnamed protein product. Analysis of this protein sequence reveals the following:

Possible site: 47
>>> Seems to have no N-terminal signal sequence
INTEGRAL    Likelihood = –13.90    Transmembrane 37-53 (30-60)
----- Final Results -----
   bacterial membrane --- Certainty = 0.6562 (Affirmative) <succ>
      bacterial outside --- Certainty = 0.0000 (Not Clear) <succ>
         bacterial cytoplasm --- Certainty = 0.0000 (Not Clear) <succ>

A related DNA sequence was identified in *S. pyogenes* <SEQ ID 2905> which encodes the amino acid sequence <SEQ ID 2906>. Analysis of this protein sequence reveals the following:

Possible site: 42
>>> Seems to have no N-terminal signal sequence
INTEGRAL    Likelihood = –13.06    Transmembrane 33-49 (24-53)
----- Final Results -----
   bacterial membrane --- Certainty = 0.6222 (Affirmative) <succ>
      bacterial outside --- Certainty = 0.0000 (Not Clear) <succ>
         bacterial cytoplasm --- Certainty = 0.0000 (Not Clear) <succ>

An alignment of the GAS and GBS proteins is shown below.

```
Identities = 480/753 (63%), Positives = 603/753 (79%), Gaps = 8/753 (1%)
Query:    5 KKLKKIFLDYVIHIRDRRSPQKNRERVGQNLMILTIFLFFIFIINFVIIVGTDSKFGVNL 64
            KK +K  LDYV+  RDRR+P +NR RVGQN+M+LTIF+FFIFIINF+II+GTD KFGV+L
Sbjct:    2 KKWQKYVLDYVV--RDRRTPVENRVRVGQNMMLLTIFIFFIFIINFMIIIGTDQKFGVSL 59

Query:   65 SKEAKKVYQQSMTVQAKRGTIYDRNGNPIAEDATTYSLYAIISKNYTTATGQKLYVQPSQ 124
            S+ AKKVYQ+++T+QAKRGTIYDRNG   IA D+TTYS+YAI+ K++ +A+ +KLYVQPSQ
Sbjct:   60 SEGAKKVYQETVTIQAKRGTIYDRNGTAIAVDSTTYSIYAILDKSFVSASDEKLYVQPSQ 119

Query:  125 YEKVASILENKLGMKKNLVLKQLNQKKLFQVSFGSSGSGLSYTKMADIKKTMEKSDIKGI 184
            YE VA IL+  LGMKK  V+KQL +K LFQVSFG SGSG+SY+ M+ I+K ME + IKGI
Sbjct:  120 YETVADILKKHLGMKKTDVIKQLKRKGLFQVSFGPSGSGISYSTMSTIQKAMEDAKIKGI 179

Query:  185 GFSTSPGRIYPNGIFASQFIGF-TLPQDDGDG-KKLVGNTGLEAALNKVLSGTDGKVTYE 242
            F+TSPGR+YPNG FAS+FIG  +L +D    G K LVG TGLEA+ +K+LSG DG +TY+
Sbjct:  180 AFTTSPGRMYPNGTFASEFIGLASLTEDKKTGVKSLVGKTGLEASFDKILSGQDGVITYQ 239

Query:  243 KDRSGNVLLGTATTERRAVNGKDIYTTLSEPIQTVLETQMDVFAEKTKGKFASATVVNAK 302
            KDR+G  LLGT  T ++A++GKDIYTTLSEPIQT LETQMDVF  K+ G+ ASAT+VNAK
Sbjct:  240 KDRNGTTLLGTGKTVKKAIDGKDIYTTLSEPIQTFLETQMDVFQAKSNGQLASATLVNAK 299

Query:  303 TGEILATSQRPTYNPSTLKGYDKKNLGTYNTLLYDNFFEPGSTMKVMTLASAIDSKHFNS 362
            TGEILAT+QRPTYN  TLKG +  N   Y+ L    N FEPGSTMKVMTLA+AID K FN
```

```
-continued
Sbjct: 300 TGEILATTQRPTYNADTLKGLENTNYKWYSALHQGN-FEPGSTMKVMTLAAAIDDKVFNP 358

Query: 363 TEVYNSAQ-YKIADAIIRDWDVNEGLSSGSYMTFPQGFAHSSNVGMVTLEQKMGRDKWLN 421
            E +++A    IADA I+DW +NEG+S+G YM + QGFA SSNVGM  LEQKMG  KW+N
Sbjct: 359 NETFSNANGLTIADATIQDWSINEGISTGQYMNYAQGFAFSSNVGMTKLEQKMGNAKWMN 418

Query: 422 YLSKFKFGYPTRFGMLHESGGLFPSDNEVTIAMSSFGQGIGVTQVQMLRAFTSISNDGVM 481
            YL+KF+FG+PTRFG+  E  G+FPSDN VT AMS+FGQGI VTQ+QMLRAFT+ISN+G M
Sbjct: 419 YLTKFRFGFPTRFGLKDEDAGIFPSDNIVTQAMSAFGQGISVTQIQMLRAFTAISNNGEM 478

Query: 482 LQPQFISSIYDPNTGTSRTARKEVVGKPVSKEAASKTRDYMVTVGTDPYYGTLYA-AGAP 540
            L+PQFIS IYDPNT + RTA KE+VGKPVSK+AAS+TR YM+ VGTDP +GTLY+    P
Sbjct: 479 LEPQFISQIYDPNTASFRTANKEIVGKPVSKKAASETRQYMIGVGTDPEFGTLYSKTFGP 538

Query: 541 VIQVGNQSVAVKSGTAQIAQEGGGGYLQ-GKNDTINSVVAMVPSENPDFIMYVTIQQPEK 599
             +I+VG+ VAVKSGTAQI  E G GY   G + + SVVAMVP++ PDF+MYVT  +P+
Sbjct: 539 IIKVGDLPVAVKSGTAQIGSEDGSGYQDGGLTNYVYSVVAMVPADKPDFLMYVTMTKPQH 598

Query: 600 FSITFWKDVVNPVLEQATAMKETILKPGLNDSEHQTKYKLSKIVGENPGHVAEELRRNLV 659
            F    FW+DVVNPVLE+A  M++T+ KP ++D+  QT YKL   VG+NPG  + ELRRNLV
Sbjct: 599 FGPLFWQDVVNPVLEEAYLMQDTLTKPVVSDANRQTTYKLPNFVGKNPGETSSELRRNLV 658

Query: 660 QPIILGNGSKVSKVSKRPGANLAENEQLLVLTNKLTELPDMYGWSKANVEQFAKWTGIKV 719
            QP++LG GSK+ KVS +PG  L EN+Q+L+L+++   E+PDMYGW+K+NV+ FAKWTGI +
Sbjct: 659 QPVVLGTGSKIKKVSHQPGQTLTENQQVLILSDRFVEVPDMYGWTKSNVKTFAKWTGIDI 718

Query: 720 TYKGSTSGKVRKQSIDVGKSINKIKKIKITIGD                            752
            ++KG+ SG+V KQS+DVGKS+ KIKK+ IT+GD
Sbjct: 719 SFKGTDSGRVMKQSVDVGKSLKKIKKMTITLGD                            751
```

A related GBS gene <SEQ ID 8691> and protein <SEQ ID 8692> were also identified. Analysis of this protein sequence reveals the following:

---

Lipop: Possible site: –1   Crend: 8
McG: Discrim Score: –4.31
GvH: Signal Score (–7.5): –7.07
Possible site: 47
>>> Seems to have no N-terminal signal sequence
ALOM program   count: 1 value: –13.90 threshold: 0.0

---

-continued

INTEGRAL     Likelihood = –13.90   Transmembrane 37-53 (30-60)
PERIPHERAL   Likelihood = 5.30     450
modified ALOM score: 3.28
*** Reasoning Step: 3
----- Final Results -----
  bacterial membrane --- Certainty = 0.6562 (Affirmative) <succ>
  bacterial outside --- Certainty = 0.0000 (Not Clear) <succ>
  bacterial cytoplasm --- Certainty = 0.0000 (Not Clear) <succ>

---

The protein has homology with the following sequences in the databases:

```
ORF00411(301-2556 of 2856)
GP|6779111|emb|CAB70457.1||A94911(1-752 of 752) unnamed protein product {unidentified},
homology to penicillin-binding protein 2x (S. pneumoniae)
% Match = 77.4
% Identity = 99.7 % Similarity = 99.9
Matches = 750 Mismatches = 1 Conservative Sub.s = 1

66        96       126       156       186       216       246       276
RIEKAFYGAIVITAIIMAVGIIYLQSNSLQVKQEVNQLNSKINDKQTEFDNAKQEVNELSNRDRITKIAKDAGLTIQNDN 306       336       366       396       426       456       486       516
IYRKVD*SVTFFKKLKKIFLDYVIHIRDRRSPQKNRERVGQNLMILTIFLFFIFIINFVIIVGTDSKFGVNLSKEAKKVY
       ||||||||||||||||||||||||||||||||||||||||||||||||||||||||||||||||||||||||
       VTFFKKLKKIFLDYVIHIRDRRSPQKNRERVGQNLMILTIFLFFIFIINFVIIVGTDSKFGVNLSKEAKKVY
              10        20        30        40        50        60        70

546       576       606       636       666       696       726       756
QQSMTVQAKRGTIYDRNGNPIAEDATTYSLYAIISKNYTTATGQKLYVQPSQYEKVASILENKLGMKKNLVLKQLNQKKL
|||||||||||||||||||||||||||||||||||||||||||||||||||||||||||||||||||||||||||||||
QQSMTVQAKRGTIYDRNGNPIAEDATTYSLYAIISKNYTTATGQKLYVQPSQYEKVASILENKLGMKKNLVLKQLNQKKL
        90       100       110       120       130       140       150

786       816       846       876       906       936       966       996
FQVSFGSSGSGLSYTKMADIKKTMEKSDIKGIGFSTSPGRIYPNGIFASQFIGFTLPQDDGDGKKLVGNTGLEAALNKVL
|||||||||||||||||||||||||||||||||||||||||||||||||||||||||||||||||||||||||||||||
FQVSFGSSGSGLSYTKMADIKKTMEKSDIKGIGFSTSPGRIYPNGIFASQFIGFTLPQDDGDGKKLVGNTGLEAALNKVL
       170       180       190       200       210       220       230
```

```
1026        1056        1086        1116        1146        1176        1206        1236
SGTDGKVTYEKDRSGNVLLGTATTERRAVNGKDIYTTLSEPIQTVLETQMDVFAEKTKGKFASATVVNAKTGEILATSQR
||||||||||||||||||||||||||||||||||||||||||||||||||||||||||||||||||||||||||||||||
SGTDGKVTYEKDRSGNVLLGTATTERRAVNGKDIYTTLSEPIQTVLETQMDVFAEKTKGKFASATVVNAKTGEILATSQR
         250         260         270         280         290         300         310

1266        1296        1326        1356        1386        1416        1446        1476
PTYNPSTLKGYDKKNLGTYNTLLYDNFFEPGSTMKVMTLASAIDSKHFNSTEVYNSAQYKIADAIIRDWDVNEGLSSGSY
||||||||||||||||||||||||||||||||||||||||||||||||||||||||||:|||||||||||||||||||
PTYNPSTLKGYDKKNLGTYNTLLYDNFFEPGSTMKVMTLASAIDSKHFNSTEVYNSAQYKIADAVIRDWDVNEGLSSGSY
         330         340         350         360         370         380         390

1506        1536        1566        1596        1626        1656        1686        1716
MTFPQGFAHSSNVGMVTLEQKMGRDKWLNYLSKFKFGYPTRFGMLHESGGLFPSDNEVTIAMSSFGQGIGVTQVQMLRAF
||||||||||||||||||||||||||||||||||||||||||||||||||||||||||||||||||||||||||||||
MTFPQGFAHSSNVGMVTLEQKMGRDKWLNYLSKFKFGYPTRFGMLHESGGLFPSDNEVTIAMSSFGQGIGVTQVQMLRAF
         410         420         430         440         450         460         470

1746        1776        1806        1836        1866        1896        1926        1956
TSISNDGVMLQPQFISSIYDPNTGTSRTARKEVVGKPVSKEAASKTRDYMVTVGTDPYYGTLYAAGAPVIQVGNQSVAVK
||||||||||||||||||||||||||||||||||||||||||||||||||||||||||||||||||||||||||||||
TSISNDGVMLQPQFISSIYDPNTGTSRTARKEVVGKPVSKEAASKTRDYMVTVGTDPYYGTLYAAGAPVIQVGNQSVAVK
         490         500         510         520         530         540         550

1986        2016        2046        2076        2106        2136        2166        2196
SGTAQIAQEGGGGYLQGKNDTINSVVAMVPSENPDFIMYVTIQQPEKFSITFWKDVVNPVLEQATAMKETILKPGLNDSE
||||||||||||||||||||||||||||||||||||||||||||||||||||||||||||||||||||||    ||||
SGTAQIAQEGGGGYLQGKNDTINSVVAMVPSENPDFIMYVTIQQPEKFSITFWKDVVNPVLEQATAMKETILKPVLNDSE
         570         580         590         600         610         620         630

2226        2256        2286        2316        2346        2376        2406        2436
HQTKYKLSKIVGENPGHVAEELRRNLVQPIILGNGSKVSKVSKRPGANLAENEQLLVLTNKLTELPDMYGWSKANVEQFA
||||||||||||||||||||||||||||||||||||||||||||||||||||||||||||||||||||||||||||||
HQTKYKLSKIVGENPGHVAEELRRNLVQPIILGNGSKVSKVSKRPGANLAENEQLLVLTNKLTELPDMYGWSKANVEQFA
         650         660         670         680         690         700         710

2466        2496        2526        2556        2586        2616        2646        2676
KWTGIKVTYKGSTSGKVRKQSIDVGKSINKIKKIKITIGD*HVFKYNGRCHSICPDSYCHSALH*VLPIEENWRATNA*R
|||||||||||||||||||||||||||||||||||||||
KWTGIKVTYKGSTSGKVRKQSIDVGKSINKIKKIKITIGD
         730         740         750
```

SEQ ID 8692 (GBS352d) was expressed in E. coli as a GST-fusion product. SDS-PAGE analysis of total cell extract is shown in FIG. 145 (lane 15 & 16; MW 105.5 kDa). It was also expressed in E. coli as a His-fusion product. SDS-PAGE analysis of total cell extract is shown in FIG. 145 (lane 17 & 18; MW 80.5 kDa), in FIG. 182 (lane 3; MW 80 kDa) and in FIG. 185 (lane 4; MW 105 kDa). Purified GBS352d-GST is shown in lane 5 of FIG. 236.

Based on this analysis, it was predicted that these proteins and their epitopes could be useful antigens for vaccines or diagnostics.

Example 954

A DNA sequence (GBSx1012) was identified in S. agalactiae <SEQ ID 2907> which encodes the amino acid sequence <SEQ ID 2908>. Analysis of this protein sequence reveals the following:

Possible site: 36
>>> Seems to have no N-terminal signal sequence
----- Final Results -----
    bacterial cytoplasm --- Certainty = 0.1950 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 955

A DNA sequence (GBSx1013) was identified in S. agalactiae <SEQ ID 2909> which encodes the amino acid sequence <SEQ ID 2910>. This protein is predicted to be unnamed protein product (mraY). Analysis of this protein sequence reveals the following:

Possible site: 18
>>> Seems to have a cleavable N-term signal seq.
| INTEGRAL | Likelihood = −15.12 | Transmembrane 56-72 (47-76) |
| INTEGRAL | Likelihood = −14.70 | Transmembrane 203-219 (198-223) |
| INTEGRAL | Likelihood = −6.69 | Transmembrane 318-334 (315-335) |
| INTEGRAL | Likelihood = −6.64 | Transmembrane 83-99 (79-103) |
| INTEGRAL | Likelihood = −5.52 | Transmembrane 179-195 (175-197) |
| INTEGRAL | Likelihood = −5.31 | Transmembrane 232-248 (230-249) |
| INTEGRAL | Likelihood = −3.08 | Transmembrane 119-135 (119-137) |
| INTEGRAL | Likelihood = −2.87 | Transmembrane 151-167 (147-167) |
| INTEGRAL | Likelihood = −2.34 | Transmembrane 254-270 (254-270) |

----- Final Results -----
    bacterial membrane --- Certainty = 0.7050 (Affirmative) <succ>
    bacterial outside --- Certainty = 0.0000 (Not Clear) <succ>
    bacterial cytoplasm --- Certainty = 0.0000 (Not Clear) <succ>

A related DNA sequence was identified in *S. pyogenes* <SEQ ID 2911> which encodes the amino acid sequence <SEQ ID 2912>. Analysis of this protein sequence reveals the following:

```
Possible site: 36
>>> Seems to have no N-terminal signal sequence
INTEGRAL    Likelihood = -9.55    Transmembrane 52-68 (48-75)
INTEGRAL    Likelihood = -9.39    Transmembrane 175-191 (171-194)
INTEGRAL    Likelihood = -8.12    Transmembrane 30-46 (23-48)
INTEGRAL    Likelihood = -6.37    Transmembrane 121-137 (119-145)
INTEGRAL    Likelihood = -6.32    Transmembrane 293-309 (287-309)
INTEGRAL    Likelihood = -5.31    Transmembrane 204-220 (202-221)
INTEGRAL    Likelihood = -5.20    Transmembrane 151-167 (150-170)
INTEGRAL    Likelihood = -4.67    Transmembrane 226-242 (224-244)
INTEGRAL    Likelihood = -0.11    Transmembrane 91-107 (91-107)
----- Final Results -----
   bacterial membrane --- Certainty = 0.4821 (Affirmative) <succ>
   bacterial outside --- Certainty = 0.0000 (Not Clear) <succ>
      bacterial cytoplasm --- Certainty = 0.0000 (Not Clear) <succ>
```

The protein has homology with the following sequences in the databases:

```
>GP:CAB70458 GB:A94911 unnamed protein product [unidentified]
Identities = 244/309 (78%), Positives = 273/309 (87%), Gaps = 1/309 (0%)
Query:    1 LKKIGGQQMHEDVKQHLAKAGTPTMGGTVFLLVATAVSLLVSLF-SIKNTQSLALISGIL 59
            LKKIGGQQMHEDVKQHLAKAGTPTMGGTVFL+VA  VSL+ S+  S +N+         GIL
Sbjct:   28 LKKIGGQQMHEDVKQHLAKAGTPTMGGTVFLVVALLVSLIFSIILSKENSGNLGATFGIL 87

Query:   60 SVVIYGIIGFLDDFLKIFKQINEGLTAKQKLALQLVGGLMFYFLHVSPSGISSINVFGY 119
            S+V+IYGIIGFLDDFLKIFKQINEGLT KQK++LQL+ GL+FYF+HV PSG S+IN+FG+
Sbjct:   88 SVVLIYGIIGFLDDFLKIFKQINEGLTPKQKMSLQLIAGLIFYFVHVLPSGTSAINIFGF 147

Query:  120 QLPLGIFYLFFVLFWVVGFSNAVNLTDGIDGLASISVVISLVTYGVIAYVQSQFDVLLLI 179
               L +G  Y FFVLFWVVGFSNAVNLTDGIDGLASISVVISL+TYG+IAY Q+QFD+LL+I
Sbjct:  148 NLEVGYLYAFFVLFWVVGFSNAVNLTDGIDGLASISVVISLITYGIIAYNQTQFDILLII 207

Query:  180 GAMIGALLGFFCFNHKPAKVFMGDVGSLALGAMLAAISIALRQEWTLLIIGIVYVLETSS 239
                MIGALLGFF  FNHKPAKVFMGDVGSLALGAMLAAISIALRQEWTLL  IG VYV  ETSS
Sbjct:  208 VIMIGALLGFFVFNHKPAKVFMGDVGSLALGAMLAAISIALRQEWTLLFIGFVYVFETSS 267

Query:  240 VMLQVSYFKYTKKKYGEGRRIFRMTPFHHHLELGGLSGKGKKWSEWQVDAFLWGVGSLAS 299
            VMLQV+YFKYTKKK  G G+RIFRMTPFHHHLELGG+SGKG KWSEW+VDAFLW +G    S
Sbjct:  268 VMLQVAYFKYTKKKTGVGKRIFRMTPFHHHLELGGVSGKGNKWSEWKVDAFLWAIGIFMS 327

Query:  300 LLVLAILYV                                                   308
              +   LAILY+
Sbjct:  328 AITLAILYL                                                   336
```

An alignment of the GAS and GBS proteins is shown below.

```
Identities = 244/309 (78%), Positives = 273/309 (87%), Gaps = 1/309 (0%)
Query:   28 LKKIGGQQMHEDVKQHLAKAGTPTMGGTVFLIVALLVSLIFSIILSKENSGNLGATFGIL 87
            LKKIGGQQMHEDVKQHLAKAGTPTMGGTVFL+VA  VSL+ S+  S +N+ +L     GIL
Sbjct:    1 LKKIGGQQMHEDVKQHLAKAGTPTMGGTVFLLVATAVSLLVSLF-SIKNTQSLALISGIL 59

Query:   88 SVVLIYGIIGFLDDFLKIFKQINEGLTPKQKMSLQLIAGLIFYFVHVLPSGTSAINIFGF 147
            S+V+IYGIIGFLDDFLKIFKQINEGLT KQK++LQL+ GL+FYF+HV PSG S+IN+FG+
Sbjct:   60 SVVIYGIIGFLDDFLKIFKQINEGLTAKQKLALQLVGGLMFYFLHVSPSGISSINVFGY 119

Query:  148 YLEVGYLYAFFVLFWVVGFSNAVNLTDGIDGLASISVVISLITYGIIAYNQTQFDILLII 207
               L +G  Y FFVLFWVVGFSNAVNLTDGIDGLASISVVISL+TYG+IAY Q+QFD+LL+I
Sbjct:  120 QLPLGIFYLFFVLFWVVGFSNAVNLTDGIDGLASISVVISLVTYGVIAYVQSQFDVLLLI 179

Query:  208 VIMIGALLGFFVFNHKPAKVFMGDVGSLALGAMLAAISIALRQEWTLLFIGFVYVFETSS 267
                MIGALLGFF  FNHKPAKVFMGDVGSLALGAMLAAISIALRQEWTLL  IG VYV  ETSS
Sbjct:  180 GAMIGALLGFFCFNHKPAKVFMGDVGSLALGAMLAAISIALRQEWTLLIIGIVYVLETSS 239

Query:  268 VMLQVAYFKYTKKKTGVGKRIFRMTPFHHHLELGGVSGKGNKWSEWKVDAFLWAIGIFMS 327
            VMLQV+YFKYTKKK  G G+RIFRMTPFHHHLELGG+SGKG KWSEW+VDAFLW +G    S
Sbjct:  240 VMLQVSYFKYTKKKYGEGRRIFRMTPFHHHLELGGLSGKGKKWSEWQVDAFLWGVGSLAS 299
```

-continued

```
Query: 328 AITLAILYL         336
            + LAILY+
Sbjct: 300 LLVLAILYV         308
```

Based on this analysis, it was predicted that these proteins and their epitopes could be useful antigens for vaccines or diagnostics.

Example 956

A DNA sequence (GBSx1014) was identified in *S. agalactiae* <SEQ ID 2913> which encodes the amino acid sequence <SEQ ID 2914>. This protein is predicted to be autoaggregation-mediating protein (deaD). Analysis of this protein sequence reveals the following:

---
Possible site: 29
>>> Seems to have no N-terminal signal sequence
----- Final Results -----
   bacterial cytoplasm --- Certainty = 0.3018 (Affirmative) <succ>
   bacterial membrane --- Certainty = 0.0000 (Not Clear) <succ>
   bacterial outside --- Certainty = 0.0000 (Not Clear) <succ>
---

The protein has homology with the following sequences in the GENPEPT database.

A related DNA sequence was identified in *S. pyogenes* <SEQ ID 2915> which encodes the amino acid sequence <SEQ ID 2916>. Analysis of this protein sequence reveals the following:

---
Possible site: 54
>>> Seems to have no N-terminal signal sequence
----- Final Results -----
   bacterial cytoplasm --- Certainty = 0.2315 (Affirmative) <succ>
   bacterial membrane --- Certainty = 0.0000 (Not Clear) <succ>
   bacterial outside --- Certainty = 0.0000 (Not Clear) <succ>
---

```
>GP:CAB14444 GB:Z99116 similar to ATP-dependent RNA helicase
[Bacillus subtilis]
Identities = 215/436 (49%), Positives = 310/436 (70%), Gaps = 5/436 (1%)
Query:   3 FKDFNFKPYIQRALDELKFVDPTDVQAKLIPVVRSGRDLVGESKTGSGKTHTFLLPIFEK  62
           F+  + KP+I  A+  L F +PTD+Q +LIP V     ++G+S+TG+GKTH +LLP+   K
Sbjct:   6 FELYELKPFIIDAVHRLGFYEPTDIQKRLIPAVLKKESVIGQSQTGTGKTHAYLLPLLNK  65

Query:  63 LDESSDDVQVVITAPSRELGTQIYQATKQIAEHSE-QEIRVVNYVGGTDKLRQIEKLKVS 121
           +D + D  VQVVITAP+REL    QIYQ   +I +   E   +IR   ++GGTDK  I+KLK+
Sbjct:  66 IDPAKDVVQVVITAPTRELANQIYQEALKITQGEEGSQIRSKCFIGGTDKQKSIDKLKI- 124

Query: 122 QPHIVIGTPGRIYDLVKSGDLAIHKAHTFVVDEADMTLDMGFLDTVDKIAGSLPKDVQIL 181
           QPH+V+GTPGRI DL+K   L++HKA + V+DEAD+ LDMGF  VD I   +P+D+Q+L
Sbjct: 125 QPHLVVGTPGRIADLIKEQALSVHKAESLVIDEADLMLDMGFLADVDYIGSRMPEDLQML 184

Query: 182 VFSATIPQKLQPFLKKYLTNPVMEKIKTATVIADTIDNWLLSTKGRDKNAQILELSKLMQ 241
           VFSATIP+KL+PFLKKY+ NP    ++   V A   I++ L+ +K RDK+  + ++    +
Sbjct: 185 VFSATIPEKLKPFLKKYMENPKYAHVEPKQVTAAKIEHILIPSKHRDKDKLLFDIMSHLN 244

Query: 242 PYLAMIFVNTKERADELHSYLSSNGLKVAKIHGGIAPRERKRIMNQVKNLEFEYIVATDL 301
           PYL ++F NTK  AD +   YL+  G+K+   +HGG+ PRERK++M Q+ +LEF YI+ATDL
Sbjct: 245 PYLGIVFANTKNTADHIAQYLTGKGMKIGLLHGGLTPRERKKVMKQINDLEFTYIIATDL 304

Query: 302 AARGIDIEGVSHVINDAIPQDLSFFVHRVGRTGRNGLSGTAITLYQPSDDSDIRELEKLG 361
           AARGIDI+GVSHVIN   +P DL F+VHRVGRT R G SG A+T+Y+  +D+     LEK+G
Sbjct: 305 AARGIDIKGVSHVINYELPDDLDETVHRVGRTARAGSSGQAMTIYELTDEDALVRLEKMG 364

Query: 362 INFIPKVIKNGEFQDTYDRDRRNNREKSYQKLDTEMIGLVKKKKKKIKPGYKKKIQWKVD 421
           I F    ++ GE++    DR RR   R+K+   + D E+      + KK  KK+KPGYKKK+   ++++
Sbjct: 365 IEFEYLELEKGEWKKGDDRQRRKKRKKTPNEAD-EIAHRLVKKPKKVKPGYKKKMSYEME 423

Query: 422 EKRRKERRASNRAKGR                                             437
           +  ++K+RR   N++K R
Sbjct: 424 KIKKKQRR--NQSKKR                                             437
```

An alignment of the GAS and GBS proteins is shown below.

```
Identities = 382/447 (85%), Positives = 420/447 (93%)
Query:   1 MSFKDFNFKPYIQRALDELKFVDPTDVQAKLIPVVRSGRDLVGESKTGSGKTHTFLLPIF  60
           MSFKD++FK Y+Q+AL+E+  FV+PT+VQ +LIP+V SGRDLVGESKTGSGKTHTFLLPIF
```

```
                              -continued
Sbjct:   1 MSFKDYHFKQYVQQALEEIGFVNPTEVQKRLIPIVNSGRDLVGESKTGSGKTHTFLLPIF 60

Query:  61 EKLDESSDDVQVVITAPSRELGTQIYQATKQIAEHSEQEIRVVNYVGGTDKLRQIEKLKV 120
           EKLDE+  +VQVVITAPSREL TQI+ A KQIA+H ++EIR+ NYVGGTDKLRQIEKLK
Sbjct:  61 EKLDEAKAEVQVVITAPSRELATQIFDACKQIAKHFQEEIRLANYVGGTDKLRQIEKLKD 120

Query: 121 SQPHIVIGTPGRIYDLVKSGDLAIHKAHTFVVDEADMTLDMGFLDTVDKIAGSLPKDVQI 180
           SQPHIVIGTPGRIYDLVKSGDLAIHKA TFVVDEADMT+DMGFLDTVDKIA SLPK VQI
Sbjct: 121 SQPHIVIGTPGRIYDLVKSGDLAIHKATTFVVDEADMTMDMGFLDTVDKIAASLPKSVQI 180

Query: 181 LVFSATIPQKLQPFLKKYLTNPVMEKIKTATVIADTIDNWLLSTKGRDKNAQILELSKLM 240
           LVFSATIPQKLQPFLKKYLTNPV+E+IKT TVIADTIDNWL+STKGRDKN Q+LE+ K M
Sbjct: 181 LVFSATIPQKLQPFLKKYLTNPVIEQIKTKTVIADTIDNWLVSTKGRDKNGQLLEILKTM 240

Query: 241 QPYLAMIFVNTKERADELHSYLSSNGLKVAKIHGGIAPRERKRIMNQVKNLEFEYIVATD 300
           QPY+AM+FVNTKERAD+LH++L++NGLKVAKIHGGI PRERKRIMNQVK L+FEYIVATD
Sbjct: 241 QPYMAMLFVNTKERADDLHAFLTANGLKVAKIHGGIPPRERKRIMNQVKKLDFEYIVATD 300

Query: 301 LAARGIDIEGVSHVINDAIPQDLSFFVHRVGRTGRNGLSGTAITLYQPSDDSDIRELEKL 360
           LAARGIDIEGVSHVINDAIPQDLSFFVHRVGRTGRNG++GTAITLYQPSDDSDI+ELEK+
Sbjct: 301 LAARGIDIEGVSHVINDAIPQDLSFFVHRVGRTGRNGMAGTAITLYQPSDDSDIKELEKM 360

Query: 361 GINFIPKVIKNGEFQDTYDRDRRNNREKSYQKLDTEMIGLVKKKKKKIKPGYKKKIQWKV 420
           GI F PKV+KNGEFQDTYDRDRR NREK+YQKLDTEMIGLVKKKKKK+KPGYKKKIQW V
Sbjct: 361 GIAFTPKVLKNGEFQDTYDRDRRQNREKAYQKLDTEMIGLVKKKKKKVKPGYKKKIQWAV 420

Query: 421 DEKRRKERRASNRAKGRAERKAKKQSF                                 447
           DEKRRKERRA NRAKGRAERKAKKQ F
Sbjct: 421 DEKRRKERRAENRAKGRAERKAKKQHF                                 447
```

Based on this analysis, it was predicted that these proteins and their epitopes could be useful antigens for vaccines or diagnostics.

Example 957

A DNA sequence (GBSx1015) was identified in *S. agalactiae* <SEQ ID 2917> which encodes the amino acid sequence <SEQ ID 2918>. This protein is predicted to be unnamed protein product. Analysis of this protein sequence reveals the following:

---

Possible site: 19
>>> Seems to have a cleavable N-term signal seq.
----- Final Results -----
    bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>

---

There is also homology to SEQ ID 2920.

A related GBS gene <SEQ ID 8693> and protein <SEQ ID 8694> were also identified. Analysis of this protein sequence reveals the following:

---

Lipop: Possible site: –1    Crend: 3
McG: Discrim Score: 8.85
GvH: Signal Score (–7.5): –1.77
Possible site: 19
>>> Seems to have a cleavable N-term signal seq.
ALOM program   count: 0 value: 8.12 threshold: 0.0
PERIPHERAL            Likelihood = 8.12            182
modified ALOM score: –2.12
*** Reasoning Step: 3
----- Final Results -----
    bacterial outside --- Certainty = 0.3000 (Affirmative) <succ>
    bacterial membrane --- Certainty = 0.0000 (Not Clear) <succ>

---

The protein has homology with the following sequences in the databases:

---

```
EGAD|126750| collagen binding protein Insert characterized
GP|1617328|emb|CAA68052.1||X99716 collagen binding protein Insert characterized
ORF00181(331-1089 of 1410)
EGAD|126750|135177(23-260 of 263) collagen binding protein {Lactobacillus
reuteri}GP|1617328|emb|CAA68052.1||X99716 collagen binding
protein {Lactobacillus reuteri}
% Match = 11.2
% Identity = 35.4 % Similarity = 59.0
Matches = 69 Mismatches = 77 Conservative Sub.s = 46

177       207       237       267       297       327       357       387
            KTKFLKLLKSEISSFQAFLLI*NLYHLIRKYYYTDRF*SVRLVI*YFRRILMFKKIILSIATIAATASLAVSVQASEKVE
                                     :::     |   :    :  |  :||  ||: :    | |
                                              MKFWKKALLTIAALTVGTSAGITSVSAASSAVNSELVHKGE
                                              10        20        30        40
```

```
417       447       477       507       537       567       597       627
LKVATDSDTAPFTYQKDGKFKGYDVDVVKAVFKGSKYKVTFKTVPFDTISTGIDAGKFDLSANDFSYNKERAEKYLFSDP
| :    :    :|::|:|:  |:  |::||: |||  |    |    |  :|::   |: :||||:   |:   :   |||::| ||  |
LTIGLEGTYSPYSYRKNNKLTGFEVDLGKAVAKKMGLKANFVPTKWDSLIAGLGSGKFDVVMNNITQTPERAKQYNFSTP
           60        70        80        90        100       110       120

657       687       717       747
XSRSNYAVVGKKGSHYKSLSDLSGKSTEVLSGVNYAQVLENWNKN-HPN------------------------------
:|  :|::      |:  |||  |:  ||         :|  |  |   |  |::  :      |   ||
YIKSRFALIVPTDSNIKSLKDIKGKKIIAGTGTNNANVVKKYKGNLTPNGDFASSLDMIKQGRAAGTVNSREAWYAYSKK
           140       150       160       170       180       190       200

789       819       849       879       909       939       969
--------------KKPIKIKYVSGTTGVTSRLKNIESGKIDFILYDAISSDYIVKDQSLNLSVSPLKGKIGNNKDGLEY
              :  |||  :
NSTKGLKMIDVSSEQDPAKISALF--------------------------------------------------------
              220

999       1029      1059      1089      1119      1149      1179      1209
LLLPKDKKGKTLQKFINKRIKVLKENGTLARLSKQYFGGDYVSNIDK*ISETISFIFLHVRVLRDRITEIESLEKESRRN
:||     :|     ||  :| |:::||:  :||::|||  |
-----NKKDTAIQSSYNKALKELQQDGTVKKLSEKYFGADITE
     230       240       250       260
```

SEQ ID 8694 (GBS8) was expressed in *E. coli* as a His-fusion product. SDS-PAGE analysis of total cell extract is shown in FIG. 2 (lane 5; MW 31 kDa), FIG. 63 (lane 2; MW 31.3 kDa), FIG. 66 (lane 2 & 3; MW 31 kDa), in FIG. 178 (lane 2; MW 31 kDa), in FIG. 179 (lane 3 & 4; MW 31 kDa) and in FIG. 180 (lane 3; MW 31 kDa). It was also expressed in *E. coli* as a GST-fusion product, with SDS-PAGE shown in FIG. 66 (lanes 4 & 5; MW 56 kDa) and in FIG. 180 (lanes 4 & 5; MW 55 kDa).

GBS8-His was purified as shown in FIGS. 189 (lane 7), 211 (lane 3), 228 (lanes 4-5) and 230 (lanes 3-6). Purified GBS8-GST is shown in FIG. 209, lane 6.

The GBS8-His fusion product was purified (FIG. 90A) and used to immunise mice (lane 2 product; 12.9 μg/mouse). The resulting antiserum was used for Western blot (FIG. 90B), FACS (FIG. 90C), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 958

A DNA sequence (GBSx1016) was identified in *S. agalactiae* <SEQ ID 2921> which encodes the amino acid sequence <SEQ ID 2922>. Analysis of this protein sequence reveals the following:

---

Possible site: 30
>>> Seems to have no N-terminal signal sequence
----- Final Results -----
    bacterial cytoplasm --- Certainty = 0.3991 (Affirmative) <succ>
    bacterial membrane --- Certainty = 0.0000 (Not Clear) <succ>
    bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 959

A DNA sequence (GBSx1017) was identified in *S. agalactiae* <SEQ ID 2923> which encodes the amino acid sequence <SEQ ID 2924>. This protein is predicted to be probable amino-acid abc transporter permease protein in idh-deor inter. Analysis of this protein sequence reveals the following:

---

Possible site: 56
>>> Seems to have no N-terminal signal sequence
INTEGRAL     Likelihood = −11.62    Transmembrane 50-66 (41-74)
INTEGRAL     Likelihood = −0.90     Transmembrane 226-242 (226-242)
INTEGRAL     Likelihood = −0.53     Transmembrane 80-96 (80-96)
----- Final Results -----
    bacterial membrane --- Certainty = 0.5649 (Affirmative) <succ>
    bacterial outside --- Certainty = 0.0000 (Not Clear) <succ>
    bacterial cytoplasm --- Certainty = 0.0000 (Not Clear) <succ>

---

The protein has homology with the following sequences in the GENPEPT database.

```
>GP:CAB15985 GB:Z99124 similar to amino acid ABC transporter
(permease) [Bacillus subtilis]
 Identities = 90/224 (40%), Positives = 137/224 (60%), Gaps = 10/224 (4%)
 Query:  28 WKAVLDAIPSILERLPITLLLTVAGALFGLILALIFAVVKINRVKILYPIQALFVSFLRG 87
```

```
            W+ ++ A P++++ LPITL + +A  +F +I   LI A++   N++ +L+ +    L++SF RG
Sbjct:    6 WEFMISAFPTLIQALPITLFMAIAAMIFAIIGGLILALITKNKIPVLHQLSKLYISFFRG 65

Query:   88 TPILVQLMLSYYGIPLFLKFLNQKYGFDWNINAIPASVFAITAFAFNEAAYTSETIRAAI 147
            P LVQL L YYG+P         +++        + A   AI   +   AAY +E  RAA+
Sbjct:   66 VPTLVQLFLIYYGLPQLFPEMSK---------MTALTAAIIGLSLKNAAYLAEIFRAAL 115

Query:  148 LSVDQGETEAARSLGMTSAQVYRRVIIPNAAVVATPTLINTLIGLTKGTSLAFNAGIVEM 207
               SVD G++EA  S+GMT Q YRR+I+P A    A P  NT IGL K TSLAF  G++EM
Sbjct:  116 NSVDDGQLEACLSVGMTKFQAYRRIILPQAIRNAIPATGNTFIGLLKETSLAFTLGVMEM 175

Query:  208 FAQAQIMGGSDYRYFERYISVALVYWAVSFLIEQLGNAIERKMA                 251
            FAQ ++     + +YFE Y++VA+VYW ++ +    L +   ER M+
Sbjct:  176 FAQGKMYASGNLKYFETYLAVAIVYWVLTIIYSILQDLFERAMS                 219
```

A related DNA sequence was identified in *S. pyogenes* <SEQ ID 2925> which encodes the amino acid sequence <SEQ ID 2926>. Analysis of this protein sequence reveals the following:

---

Possible site: 43
>>> Seems to have no N-terminal signal sequence
INTEGRAL   Likelihood = −7.27   Transmembrane 80-96 (74-104)
INTEGRAL   Likelihood = −1.06   Transmembrane 207-223 (207-223)
INTEGRAL   Likelihood = −0.90   Transmembrane 110-126 (110-126)
----- Final Results -----
   bacterial membrane --- Certainty = 0.3909 (Affirmative) <succ>
   bacterial outside --- Certainty = 0.0000 (Not Clear) <succ>
   bacterial cytoplasm --- Certainty = 0.0000 (Not Clear) <succ>

---

A related sequence was also identified in GAS <SEQ ID 9167> which encodes the amino acid sequence <SEQ ID 9168>. Analysis of this protein sequence reveals the following:

---

Possible site: 60
>>> Seems to have no N-terminal signal sequence
INTEGRAL   Likelihood = −7.27   Transmembrane 50-66 (44-74)
INTEGRAL   Likelihood = −1.06   Transmembrane 177-193 (177-193)
INTEGRAL   Likelihood = −0.90   Transmembrane 80-96 (80-96)
----- Final Results -----
   bacterial membrane --- Certainty = 0.391 (Affirmative) <succ>
   bacterial outside --- Certainty = 0.0000 (Not Clear) <succ>
   bacterial cytoplasm --- Certainty = 0.0000 (Not Clear) <succ>

---

An alignment of the GAS and GBS proteins is shown below.

```
Identities = 212/267 (79%), Positives = 238/267 (88%)
Query:    1 MNQFILTGGWSWYNNLVSQVPAGKLFSWKAVLDAIPSILERLPITLLLTVAGALFGLILA 60
            M   LT GW++Y+ L+S +P GKLFSW AV DAIP+I++RLPITL LT++GA FGL+LA
Sbjct:   31 MTSVFLTSGWAFYDYLISPIPHGKLFSWHAVFDAIPNIIQRLPITLGLTLSGATFGLVLA 90

Query:   61 LIFAVVKINRVKILYPIQALFVSFLRGTPILVQLMLSYYGIPLFLKFLNQKYGFDWNINA 120
            LIFA+VKIN+VK+LYPIQA+FVSFLRGTPILVQLML+YYGIPLFLKFLNQKYGFDWN+NA
Sbjct:   91 LIFALVKINKVKLLYPIQAIFVSFLRGTPILVQLMLTYYGIPLFLKFLNQKYGFDWNVNA 150

Query:  121 IPASVFAITAFAFNEAAYTSETIRAAILSVDQGEIEAARSLGMTSAQVYRRVIIPNAAVV 180
            IPAS+FAITAFAFNEAAY SETIRAAILSVD GEIEAA+SLGMTS QVYRRVIIPNA VV
Sbjct:  151 IPASIFAITAFAFNEAAYASETIRAAILSVDTGEIEAAKSLGMTSVQVYRRVIIPNATVV 210

Query:  181 ATPTLINTLIGLTKGTSLAFNAGIVEMFAQAQINGGSDYRYFERYISVALVYWAVSFLIE 240
            A PTLIN LIGLTKGTSLAFNAGIVEMFAQAQI+GGSDYRYFERYISVALVYW++S L+E
Sbjct:  211 AIPTLINGLIGLTKGTSLAFNAGIVEMFAQAQILGGSDYRYFERYISVALVYWSISILME 270

Query:  241 QLGNAIERKMAIKAPRHLTDEIPGGVR                                 267
            Q+G  IE KMAIKAP   +E  G +R
Sbjct:  271 QVGRLIENKMAIKAPEQARNEKLGELR                                 297
```

There is also homology to SEQ ID 4794.

Based on this analysis, it was predicted that these proteins and their epitopes could be useful antigens for vaccines or diagnostics.

Example 960

A DNA sequence (GBSx1018) was identified in *S. agalactiae* <SEQ ID 2927> which encodes the amino acid sequence <SEQ ID 2928>. This protein is predicted to be amino acid ABC transporter, ATP-binding protein. Analysis of this protein sequence reveals the following:

---

Possible site: 46
>>> Seems to have no N-terminal signal sequence
----- Final Results -----
   bacterial cytoplasm --- Certainty = 0.3205 (Affirmative) <succ>
   bacterial membrane --- Certainty = 0.0000 (Not Clear) <succ>
   bacterial outside --- Certainty = 0.0000 (Not Clear) <succ>

---

The protein has homology with the following sequences in the GENPEPT database.

```
>GP:AAC00329 GB:AF008220 putative amino acid transporter [Bacillus subtilis]
Identities = 121/247 (48%), Positives = 176/247 (70%)
Query:    1 MIKLRQLTKSFSGQKVLDKLDLDIEKGQVVALVGASGAGKSTFLRSMNYLEEPDYGTIEI    60
            MI+++ + K F    VL  ++L + KG+VV ++G SG+GK+TFLR +N LE PD G I I
Sbjct:    1 MIEIKNIHKQFGIHHVLKGINLTVRKGEVVTIIGPSGSGKTTFLRCLNLLERPDEGIISI    60

Query:   61 DDFKVDFKSISKDDILTLRRKLAMVFQQFNLFERRTALDNVKEGLKIVKKMSDQEATRIA   120
             D  ++ + SK ++ LR++ AMVFQQ++LF +T ++NV EGL I +KM Q+A +A
Sbjct:   61 HDKVINCRFPSKKEVHWLRKQTAMVFQQYHLFAHKTVIENVMEGLTIARKMRKQDAYAVA   120

Query:  121 RDELAKVGLADREKYYPRHLSGGQKQRVALARALAMKPDVLLLDEPTSALDPELVGEVEK   180
            +EL KVGL D+   YP LSGGQKQRV +ARALA+ PDVLL DEPT+ALDPELVGEV +
Sbjct:  121 ENELRKVGLQDKLNAYPSQLSGGQKQRVGIARALAIHPDVLLFDEPTAALDPELVGEVLE   180

Query:  181 SIADAAKQGQTMVLVSHDMNFVYQVADKVLFLEKGRILESGTPEQLFNHPLEERTKEFFA   240
             + +   K G TM++V+H+M F  +V+D+V+F+++G I+E GTPE++F H  ++RT++F
Sbjct:  181 VMLEIVKTGATMIVVTHEMEFARRVSDQVVFMDEGVIVEQGTPEEVFRHTKKDRTRQFLR   240

Query:  241 SYNKSYL                                                       247
            +  YL
Sbjct:  241 RVSPEYL                                                       247
```

A related DNA sequence was identified in *S. pyogenes* <SEQ ID 2929> which encodes the amino acid sequence <SEQ ID 2930>. Analysis of this protein sequence reveals the following:

Possible site: 13
>>> Seems to have no N-terminal signal sequence
----- Final Results -----
  bacterial cytoplasm --- Certainty = 0.1840 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

Based on this analysis, it was predicted that these proteins and their epitopes could be useful antigens for vaccines or diagnostics.

Example 961

A DNA sequence (GBSx1019) was identified in *S. agalactiae* <SEQ ID 2931> which encodes the amino acid sequence <SEQ ID 2932>. Analysis of this protein sequence reveals the following:

Possible site: 17
>>> Seems to have no N-terminal signal sequence
----- Final Results -----
  bacterial cytoplasm --- Certainty = 0.0831 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
Identities = 199/247(800), Positives = 229/247 (92%)

Query:    1 MIKLRQLTKSFSGQKVLDKLDLDIEKGQVVALVGASGAGKSTFLRSMNYLEEPDYGTIEI 60
            MI +R L+K+FSGQKVLD L LDIEKGQV+ALVGASGAGKSTFLRS+NYLE+PD G+I I
Sbjct:    2 MITIRNLSKTFSGQKVLDSLALDIEKGQVIALVGASGAGKSTFLRSLNYLEKPDSGSISI 61

Query:   61 DDFKVDFKSISKDDILTLRRKLAMVFQQFNLFERRTALDNVKEGLKIVKKMSDQEATRIA 120
            D F VDF++I+ + +L LRRKLAMVFQQFNLFERRTAL+NVKEGLK+VKK+SDQEAT++A
Sbjct:   62 GDFTVDFETITTEQVLILRRKLAMVFQQFNLFERRTALENVKEGLKVVKKLSDQEATKLA 121

Query:  121 RDELAKVGLADREKYYPRHLSGGQKQRVALARALAMKPDVLLLDEPTSALDPELVGEVEK 180
            + ELAKVGLADR+ +YPRHLSGGQKQRVALARALAMKPDVLLLDEPTSALDPELVGEVEK
Sbjct:  122 QAELAKVGLADRKHHYPRHLSGGQKQRVALARALAMKPDVLLLDEPTSALDPELVGEVEK 181

Query:  181 SIADAAKQGQTMVLVSHDMNETYQVADKVLFLEKGRILESGTPEQLFNHPLEERTKEFFA 240
            SI DAAK GQTMVLVSHDMN VYQVAD+VLFL++G+ILE GTPE++F HP +ERTKEFFA
Sbjct:  182 SITDAAKSGQTMVLVSHDMNEVYQVADRVLFLDQGKILEQGTPEEVFRHPQKERTKEFFA 241

Query:  241 SYNKSYL                                                      247
            SY+K+Y+
Sbjct:  242 SYSKTYI                                                      248
```

```
>GP:BAB07290 GB:AP001519 thioredoxin reductase (NADPH) [Bacillus halodurans]
Identities = 173/302 (57%), Positives = 234/302 (77%)
Query:    1 MYDTLIIGSPGGMTAALYAARSNLKVGLIEQGAPGGQMNNTAEIENYPGYDHISGPELS   60
            +YD +I G+GP GMTAA+Y +R+NL   ++E+G PGGQM NT ++ENYPG+DHI GPELS
Sbjct:    7 VYDVVIAGAGPAGMTAAVYTSRANLSTVMVERGVPGGQMANTEDVENYPGFDHILGPELS   66

Query:   61 MKMYEPLEKFEVEHIYGIVQRVENDGDVKRVITEDESYEAKTVILATGAKNSLLGVPGEE  120
              KM+E  +KF  E+ YG ++ + + GD+K V   ++ Y+A+ VI+ATGA+    LGVPGE+
Sbjct:   67 TKMFEHAKKFGAEYAYGDIKEIIDQGDLKLVKAGNKEYKARAVIVATGAEYKKLGVPGEK  126

Query:  121 EYTSRGVSYCAVCDGAFFRDQDLLVVGGGDSAVEEAVFLTQFAKSVTIIHRRDQLRAQKV  180
            E + RGVSYCAVCDGAFF+  ++L+VVGGGDSAVEEAV+LT+FA   VTIIHRRDQLRAQK+
Sbjct:  127 ELSGRGVSYCAVCDGAFFKGKELVVVGGGDSAVEEAVYLTRFASKVTIIHRRDQLRAQKI  186

Query:  181 LQDRAFANEKIKFVWDSVVKEIKGNEIKVSGVTVENLKTGEISEMTFGGVFIYVGLKPHS  240
            LQ RAF N+KI+F+WD VVK+I G + KVS VT+E+ KTGE +    GVFIY+G+ P +
Sbjct:  187 LQQRAFDNDKIEFINDHVVKQINGTDGKVSSVTIEHAKTGEQQDFKTDGVFIYIGMLPLN  246

Query:  241 SMVSELGITDETGWVLTDTNMKTSIPGLYAIGDVRQKDLRQIATAVGEGAIAGQGVYNYI  300
               V  L I ++ G+++T+  M+TS+PG++A GDVR+K LRQI TA G+G++A Q V +YI
Sbjct:  247 EAVKNLNILNDEGYIVTNEEMETSVPGIFAAGDVREKSLRQIVTATGDGSLAAQNVQHYI  306

Query:  301 TE                                                           302
            E
Sbjct:  307 EE                                                           308
```

A related DNA sequence was identified in *S. pyogenes* <SEQ ID 2933> which encodes the amino acid sequence <SEQ ID 2934>. Analysis of this protein sequence reveals the following:

---

Possible site: 28
>>> Seems to have no N-terminal signal sequence
----- Final Results -----
    bacterial cytoplasm --- Certainty = 0.0386 (Affirmative) <succ>
    bacterial membrane --- Certainty = 0.0000 (Not Clear) <succ>
    bacterial outside --- Certainty = 0.0000 (Not Clear) <succ>

---

An alignment of the GAS and GBS proteins is shown below.

Based on this analysis, it was predicted that these proteins and their epitopes could be useful antigens for vaccines or diagnostics.

Example 962

A DNA sequence (GBSx1020) was identified in *S. agalactiae* <SEQ ID 2935> which encodes the amino acid sequence <SEQ ID 2936>. Analysis of this protein sequence reveals the following:

---

Possible site: 35
>>> Seems to have no N-terminal signal sequence
----- Final Results -----
    bacterial cytoplasm --- Certainty = 0.3626 (Affirmative) <succ>
    bacterial membrane --- Certainty = 0.0000 (Not Clear) <succ>
    bacterial outside --- Certainty = 0.0000 (Not Clear) <succ>

---

The protein has homology with the following sequences in the GENPEPT database.

```
Identities = 236/300 (78%), Positives = 273/300 (90%)

Query:    1 MYDTLIIGSPGGMTAALYAARSNLKVGLIEQGAPGGQMNNTAEIENYPGYDHISGPELS   60
            MYDTLIIGSP GMTAALYAARSNL V +IEQGAPGGQMNNT +IENYPGYDHISGPEL+
Sbjct:    1 MYDTLIIGSPAGMTAALYAARSNLSVAIIEQGAPGGQMNNTFDIENYPGYDHISGPELA   60

Query:   61 MKMYEPLEKFEVEHIYGIVQRVENDGDVKRVITEDESYEAKTVILATGARNSLLGVPGEE  120
            MKMYEPLEKF VE+IYGIVQ++EN GD K V+TED SYEAKTVI+ATGAK  +LGVPGEE
Sbjct:   61 MKMYEPLEKFNVENIYGIVQKIENFGDYKCVLTEDASYEAKTVIIATGAKYRVLGVPGEE  120

Query:  121 EYTSRGVSYCAVCDGAFFRDQDLLVVGGGDSAVEEAVFLTQFAKSVTIIHRRDQLRAQKV  180
             YTSRGVSYCAVCDGAFFRDQDLLVVGGGDSAVEEA++LTQFAK VT++HRRDQLRAQK+
Sbjct:  121 YYTSRGVSYCAVCDGAFFRDQDLLVVGGGDSAVEEAIYLTQFAKKVTVVHRRDQLRAQKI  180

Query:  181 LQDRAFANEKIKFVWDSVVKEIKGNEIKVSGVTVENLKTGEISEMTFGGVFIYVGLKPHS  240
            LQDRAFAN+K+ F+WDSVVKEI+GN+IKVS V +EN+KTG++++  FGGVFIYVG+ P +
Sbjct:  181 LQDRAFANDKVDFIWDSVVKEIQGNDIKVSNVLIENVKTGQVTDHAFGGVFIYVGMNPVT  240

Query:  241 SMVSELGITDETGWVLTDTNMKTSIPGLYAIGDVRQKDLRQIATAVGEGAIAGQGVYNYI  300
              MV +L ITD  GW++TD +M+TSIPG++AIGDVRQKDLRQI TAVG+GAIAGQGVY+Y+
Sbjct:  241 GMVKDLEITDSEGWIITDDHMRTSIPGIFAIGDVRQKDLRQITTAVGDGAIAGQGVYHYL  300
```

```
>GP:CAB15163 GB:Z99120 similar to nicotinate
phosphoribosyltransferase [Bacillus subtilis]
Identities = 309/476 (64%), Positives = 384/476 (79%), Gaps = 2/476 (0%)
Query:   2 YKDDSLTLHTDLYQINMMQVYFNKGIHNKRAVFEAYFRKVPFENGYAVFAGLERIVRYLE  61
            +KDDSL+LHTDLYQINM + Y+  GIH K+A+FE +FR++PFENGYAVFAGLE+ + YLE
Sbjct:   6 FKDDSLSLHIDLYQINMAETYWRDGIHEKKAIFELFFRRLPFENGYAVFAGLEKAIEYLE  65

Query:  62 NLSFSDSDLSYLE-ELGYPEEFLDYLKNLKMELTVESAKEGDLVFANEPLVQIEGPLAQC 120
           N  +DSDLSYL+   ELGY E+F++YL+ L     ++ S KEG+LVF NEP++++E PL +
Sbjct:  66 NFKFTDSDLSYLQDELGYHEDFIEYLRGLSFTGSLYSMKEGELVFNNEPIMRVEAPLVEA 125

Query: 121 QLVETAILNIINYQTLVATKAARIRSVIEDEPLLEFGTRRAQEMDAAIWGTRAAIIGGAN 180
           QL+ETA+LNI+NYQTL+ATKAARI+ VI DE  LEFGTRRA EMDAA+WG RAA+IGG +
Sbjct: 126 QLIETALLNIVNYQTLIATKAARIKGVIGDEVALEFGTRRAHEMDAAMWGARAALIGGFS 185

Query: 181 ATSNVRAGKIFNIPVSGTHAHALVQTYGDDYQAFKAYAETHKDCVFLVDTYDTLRVGVPN 240
           ATSNVRAGK FNIPVSGTHAHALVQ Y D+Y AFK YAETHKDCVFLVDTYDTLR G+PN
Sbjct: 186 ATSNVRAGKRFNIPVSGTHAHALVQAYRDEYTAFKKYAETHKDCVFLVDTYDTLRSGMPN 245

Query: 241 AIRVAKEMGEKINFLGVRLDSGDLAYLSKKVRQQLDDAGFPNAKIYASNDLDENTILNLK 300
           AIRVAKE G++INF+G+RLDSGDLAYLSKK R+ LD+AGF +AK+ AS+DLDE+TI+NLK
Sbjct: 246 AIRVAKEFGDRINFIGIRLDSGDLAYLSKKARKMLDEAGFTDAKVIASSDLDEHTIMNLK 305

Query: 301 MQKAKIDVWGVGTKLITAYDQPALGAVYKIVSIETDAGSMRDTIKLSNNAEKVSTPGKKQ 360
            Q A+IDVWGVGTKLITAYDQPALGAVYK+V+IE D G M DTIK+S+N EKV+TPG+K+
Sbjct: 306 AQGARIDVWGVGTKLITAYDQPALGAVYKLVAIEED-GKMVDTIKISSNPEKVTTPGRKK 364

Query: 361 VWRITSRAKGKSEGDYITFADTDVTQLDEIEMFHPTYTYINKTVRDFDAVPLLVDIFDKG 420
           V+RI +++    SEGDYI   D  V    + MFHP +T+I+K V +F A  L   IF+KG
Sbjct: 365 VYRIINQSNHHSEGDYIALYDEQVNDQKRLRMFHPVHTFISKFVTNFYAKDLHELIFEKG 424

Query: 421 KLVYQLPSLQEIQEYGRKEFDQLWDEYKRVLNPQDYPVDLARDVWQNKMDLIDRIR     476
           L  YQ P + +IQ+Y +     LW+EYKR+ P++YPVDL+ D W NKM I    ++
Sbjct: 425 ILCYQNPEISDIQQYVQDNLSLLWEEYKRISKPEEYPVDLSEDCWSNKMQRIHEVK    480
```

A related DNA sequence was identified in S. *pyogenes* <SEQ ID 2937> which encodes the amino acid sequence <SEQ ID 2938>. Analysis of this protein sequence reveals the following:

----- Final Results -----
bacterial cytoplasm --- Certainty = 0.3192 (Affirmative) <succ>
bacterial membrane --- Certainty = 0.0000 (Not Clear) <succ>
bacterial outside --- Certainty = 0.0000 (Not Clear) <succ>

Possible site: 32
>>> Seems to have no N-terminal signal sequence

An alignment of the GAS and GBS proteins is shown below.

```
Identities = 409/484 (84%), Positives = 446/484 (91%)
Query:   1 MYKDDSLTLHTDLYQINMMQVYFNKGIHNKRAVFEAYFRKVPFENGYAVFAGLERIVRYL  60
           MYKDDSLTLHTDLYQINMMQVYF +GIHN+ AVFE YFRK PF NGYAVFAGL+R+V YL
Sbjct:   1 MYKDDSLTLHTDLYQINMMQVYFEQGIHNRHAVFEVYFRKEPFNNGYAVFAGLQRMVEYL  60

Query:  61 ENLSFSDSDLSYLEELGYPEEFLDYLKNLKMELTVKSAKEGDLVFANEPLVQIEGPLAQC 120
           E   FS++DL+YLEELGYPE FL YLK L++ELT++SAKEGDLVFANEP+VQ+EGPL QC
Sbjct:  61 EQFQFSETDLAYLEELGYPENFLTYLKELRLELTIRSAKEGDLVFANEPIVQVEGPLGQC 120

Query: 121 QLVETAILNIINYQTLVATKAARIRSVIEDEPLLEFGTRRAQEMDAAIWGTRAAIIGGAN 180
           QLVETA+LNI+N+QTL+ATKAARIRSVIEDEPLLEFGTRRAQE+DAAIWGTRAA+IGGA+
Sbjct: 121 QLVETALLNIVNFQTLIATKAARIRSVIEDEPLLEFGTRRAQELDAAIWGTRAAMIGGAD 180

Query: 181 ATSNVRAGKIFNIPVSGTHAHALVQTYGDDYQAFKAYAETHKDCVFLVDTYDTLRVGVPN 240
           ATSNVRAGK F+IPVSGTHAHALVQ YG+DY AF AYA+THKDCVFLVDTYDTL+VGVP
Sbjct: 181 ATSNVRAGKRFDIPVSGTHAHALVQAYGNDYDAFMAYAKTHKDCVFLVDTYDTLKVGVPT 240

Query: 241 AIRVAKEMGEKINFLGVRLDSGDLAYLSKKVRQQLDDAGFPNAKIYASNDLDENTILNLK 300
           AIRVAKEMG+KINFLGVRLDSGDLAYLSK VRQQLDDAGF  AKIYASNDLDENTILNLK
Sbjct: 241 AIRVAKEMGDKINFLGVRLDSGDLAYLSKTVRQQLDDAGFTEAKIYASNDLDENTILNLK 300

Query: 301 MQKAKIDVWGVGTKLITAYDQPALGAVYKIVSIETDAGSMRDTIKLSNNAEKVSTPGKKQ 360
           MQKAKIDVWGVGTKLITAYDQPALGAVYKIVSIE + GSMRDTIKLSNNAEKVSTPGKKQ
Sbjct: 301 MQKAKIDVWGVGTKLITAYDQPALGAVYKIVSIEQEDGSMRDTIKLSNNAEKVSTPGKKQ 360

Query: 361 VWRITSRAKGKSEGDYITFADTDVTQLDEIEMFHPTYTYINKTVRDFDAVPLLVDIFDKG 420
           VWRITSR KGKSEGDYITF D +V +L EIEMFHPTYTYI KTV++FDA+PLLVDIF KG
Sbjct: 361 VWRITSREKGKSEGDYITFTDINVNELTEIEMFHPTYTYIKKTVKEFDAIPLLVDIFVKG 420

Query: 421 KLVYQLPSLQEIQEYGRKEFDQLWDEYKRVLNPQDYPVDLARDVWQNKMDLIDRIRKEAL 480
           +LVYQLP+L EI+ Y +KEFD+LWDEYKRVLNPQDYPVDLARDVWQNKM LID IRK+A
```

```
-continued
Sbjct: 421 ELVYQLPTLAEIKAYAKKEFDKLWDEYKRVLNPQDYPVDLARDVWQNKMALIDNIRKDAY 480

Query: 481 AKGE 484
           K E
Sbjct: 481 GKSE 484
```

Based on this analysis, it was predicted that these proteins and their epitopes could be useful antigens for vaccines or diagnostics.

Example 963

A DNA sequence (GBSx1021) was identified in *S. agalactiae* <SEQ ID 2939> which encodes the amino acid sequence <SEQ ID 2940>. Analysis of this protein sequence reveals the following:

Possible site: 56
>>> Seems to have no N-terminal signal sequence
----- Final Results -----
  bacterial cytoplasm --- Certainty = 0.2744 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

A related DNA sequence was identified in *S. pyogenes* <SEQ ID 2941> which encodes the amino acid sequence <SEQ ID 2942>. Analysis of this protein sequence reveals the following:

Possible site: 18
>>> Seems to have no N-terminal signal sequence
----- Final Results -----
  bacterial cytoplasm --- Certainty = 0.3482 (Affirmative) <succ>
  bacterial membrane --- Certainty = 0.0000 (Not Clear) <succ>
  bacterial outside --- Certainty = 0.0000 (Not Clear) <succ>

```
>GP:AAC74810 GB:AE000269 NAD synthetase, prefers NH3 over glutamine
[Escherichia coli K12]
Identities = 173/274 (63%), Positives = 214/274 (77%), Gaps = 1/274 (0%)
Query:   1 MTLQDQIIKELGVKPVINPSQEIRRSVEFLKDYLLKHSFLKTYVLGISGGQDSTLAGRLA  60
           MTLQ QIIK LG KP IN +EIRRSV+FLK YL  + F+K+ VLGISGGQDSTLAG+L
Sbjct:   1 MTLQQQIIKALGAKPQINAEEEIRRSVDFLKSYLQTYPFIKSLVLGISGGQDSTLAGKLC  60

Query:  61 QLNVEELRADTG-ENYQFIAIRLPYGIQADEEDAQKALDFIKPDIALTINIKEAVDGQVR 119
           Q+A+ ELR +TG E+ QFIA+RLPYG+QADE+D Q A+ FI+PD  LT+NIK AV    +
Sbjct:  61 QMAINELRLETGNESLQFIAVRLPYGVQADEQDCQDAIAFIQPDRVLTVNIKGAVLASEQ 120

Query: 120 ALNAAGVEITDFNKGNIKARQRMISQYAVAGQYAGAVIGTDHAAENITGFFTKFGDGGAD 179
           AL  AG+E++DF +GN KAR+RM +QY++AG  +G V+GTDHAAE ITGFFTK+GDGG D
Sbjct: 121 ALREAGIELSDFVRGNEKARERMKAQYSIAGMTSGVVVGTDHAAEAITGFFTKYGDGGTD 180

Query: 180 LLPLFRLNKSQGKQLLAELGADKALYEKIPTADLEENKPGIADEIALGVTYQEIDAYLEG 239
           + PL+RLNK QGKQLLA L   + LY+K PTADLE+++P + DE+ALGVTY  ID YLEG
Sbjct: 181 INPLYRLNKRQGKQLLAALACPEHLYKKAPTADLEDDRPSLPDEVALGVTYDNIDDYLEG 240

Query: 240 KVVSDKSRGIIENWWYKGQHKRHLPITIFDDFWK 273
           K V +      IENW+ K +HKR  PIT+FDDFWK
Sbjct: 241 KNVPQQVARTIENWYLKTEHKRRPPITVFDDFWK 274
```

An alignment of the GAS and GBS proteins is shown below.

```
Identities = 213/274 (77%), Positives = 242/274 (87%), Gaps = 1/274 (0%)
Query:   1 MTLQDQIIKELGVKPVINPSQEIRRSVEFLKDYLLKHSFLKTYVLGISGGQDSTLAGRLA  60
           MTLQ++II++LGVK  I+P +EIR++V+FLK YL KHSFLKTYVLGISGGQDSTLAG+LA
Sbjct:  15 MTLQEEIIRQLGVKASIDPQEEIRKAVDFLKAYLRKHSFLKTYVLGISGGQDSTLAGKLA  74

Query:  61 QLAVEELRADTGEN-YQFIAIRLPYGIQADEEDAQKALDFIKPDIALTINIKEAVDGQVR 119
           Q+A+ ELR +   + YQFIA+RLPYG+QADE DAQKAL FI PD  LTINIK AVDGQV
Sbjct:  75 QMAIAELREEASDQAYQFIAVRLPYGVQADEADAQKALAFIAPDQTLTINIKAAVDGQVE 134

Query: 120 ALNAAGVEITDFNKGNIKARQRMISQYAVAGQYAGAVIGTDHAAENITGFFTKFGDGGAD 179
           AL  AAGVEI+DFNKGNIKARQRMISQYA+AGQ AGAVIGTDHAAENITGFFTKFGDGGAD
Sbjct: 135 ALQAAGVEISDFNKGNIKARQRMISQYAIAGQMAGAVIGTDHAAENITGFFTKFGDGGAD 194

Query: 180 LLPLFRLNKSQGKQLLAELGADKALYEKIPTADLEENKPGIADEIALGVTYQEIDAYLEG 239
```

```
                +LPLFRLNK QGK LL   LGAD ALYEK+PTADLE+ KPG+ADE+ALGVTYQ+ID YLEG
Sbjct: 195 ILPLFRLNKRQGKALLKVLGADAALYEKVPTADLEDQKPGLADEVALGVTYQDIDDYLEG 254

Query: 240 KVVSDKSRGIIENWWYKGQHKRELPITIFDDFWK                           273
            K++S   ++   IE WW+KGQHKRHLPITIFDDFWK
Sbjct: 255 KLISKVAQATIEKWWHKGQHKRHLPITIFDDFWK                           288
```

Based on this analysis, it was predicted that these proteins and their epitopes could be useful antigens for vaccines or diagnostics.

Example 964

A DNA sequence (GBSx1022) was identified in *S. agalactiae* <SEQ ID 2943> which encodes the amino acid sequence <SEQ ID 2944>. Analysis of this protein sequence reveals the following:

---

Possible site: 28
>>> Seems to have no N-terminal signal sequence
----- Final Results -----
  bacterial cytoplasm --- Certainty = 0.2718 (Affirmative) <succ>
  bacterial membrane --- Certainty = 0.0000 (Not Clear) <succ>
  bacterial outside --- Certainty = 0.0000 (Not Clear) <succ>

---

The protein has homology with the following sequences in the GENPEPT database.

A related DNA sequence was identified in *S. pyogenes* <SEQ ID 2945> which encodes the amino acid sequence <SEQ ID 2946>. Analysis of this protein sequence reveals the following:

---

Possible site: 14
>>> Seems to have no N-terminal signal sequence
----- Final Results -----
  bacterial cytoplasm --- Certainty = 0.3002 (Affirmative) <succ>
  bacterial membrane --- Certainty = 0.0000 (Not Clear) <succ>
  bacterial outside --- Certainty = 0.0000 (Not Clear) <succ>

---

An alignment of the GAS and GBS proteins is shown below.

```
>GP:CAA82960 GB:Z30315 aminopeptidase C [Streptococcus thermophilus]

Identities = 363/444 (81%), Positives = 407/444 (90%)

Query:    1 MSKLTQTFTDKLFADYQANTKFSAIENAVTHNGLLKSLETRQSEIENDYVFSIDLTKDEV  60
            M+ L+   FT+KLFADY+AN K+ AIENAVTHNGLLKS+ETRQSE+END+VFSIDLTKDEV
Sbjct:    1 MTSLSTDFTEKLFADYEANAKYGAIENAVTHNGLLKSIETRQSEVENDFVFSIDLTKDEV  60

Query:   61 SNQKQSGRCWMFAALNTFRHKLISDFKLENFELSQAHTFFWDKYEKSNWFMEQIIATANQ 120
            SNQK SGRCWMFAALNTFRHKLISDFKLE+FELSQAHTFFWDKYEKSNWF+EQIIATA+Q
Sbjct:   61 SNQKASGRCWMFAALNTFRHKLISDFKLESFELSQAHTFFWDKYEKSNWFLEQIIATADQ 120

Query:  121 ELSSRKVKFLLDVPQQDGGQWDMVVALFEKYGVVPKTVYPESVSSSASRELNQYLNKLLR 180
            E+ SRKVKFLLD PQQDGGQWDMVV+LFEKYGVVPK+VYPESV+SS SRELNQYLNKLLR
Sbjct:  121 EIGSRKVKFLLDTPQQDGGQWDMVVSLFEKYGVVPKSVYPESVASSNSRELNQYLNKLLR 180

Query:  181 QDAQILRELIAQGADGATVQNKKEELLQEIFNFLAMNLGLPPQSFDFAYRDKDNHYQSDK 240
            QDAQILR+LIA GAD A VQ KKEE LQEIFN+LAM LGLPP+ FDFAYRDKD++Y+S+K
Sbjct:  181 QDAQILRDLIASGADQAAVQAKKEEFLQEIFNYLAMTLGLPPRQFDFAYRDKDDNYRSEK 240

Query:  241 NITPKAFYQKYVNLDLSDYVSIINAPTVDKPYGQSYTVEMLGNVVGGPAVKYLNLDMKRF 300
              ITP+AF++KYV L LSDYVS+INAPT DKPYG+SYTVEMLGNVVG P+V+Y+NL M RF
Sbjct:  241 GITPRAFFEKYVGLKLSDYVSVINAPTADKPYGKSYTVEMLGNVVGAPSVRYINLPMDRF 300

Query:  301 KELAIAQMKSGETVWFGSDVGQVSNRQKGILATTTYDFNSSMDIKLSQDKAGRLDYSESL 360
            KELAIAQMK+GE+VWFGSDVGQVS+RQKGILAT   YDF +SMDI  +QDKAGRLDYSESL
Sbjct:  301 KELAIAQMKAGESVWFGSDVGQVSDRQKGILATNVYDFTASMDINWTQDKAGRLDYSESL 360

Query:  361 MTHAMVLTGVDLDESGQPLKWKVENSWGEKVGKDGYFVASDAWMDEYTYQIVVRKELLTK 420
            MTHAMVLTGVDLD  G+P+KWK+ENSWG+KVG+ GYFVASDAMMDEYTYQIVVRK+ LT
Sbjct:  361 MTHAMVLTGVDLDADGKPIKWKIENSWGDKVGQKGYFVASDAWMDEYTYQIVVRKDFLTA 420

Query:  421 EELEAYNAEPITLAPWDPMGALAN                                    444
            EEL AY A+P  LAPWDPMG+LA+
Sbjct:  421 EELAAYEADPQVLAPWDPMGSLAS                                    444
```

```
Identities = 369/443 (83%), Positives = 407/443 (91%)
Query:    1 MSKLTQTFTDKLFADYQANTKFSAIENAVTHNGLLKSLETRQSEIENDYVFSIDLTKDEV 60
            MS LT+TFT++LFA Y+AN KFSAIENAVTHNGLLKSLETRQSE++ND+VFSIDLTKD+V
Sbjct:    1 MSALTETFTEQLFAHYEANAKFSAIENAVTHNGLLKSLETRQSEVDNDFVFSIDLTKDKV 60

Query:   61 SNQKQSGRCWMFAALNTFRHKLISDFKLENFELSQAHTFFWDKYEKSNWFMEQIIATANQ 120
            SNQK SGRCWMFAALNTFRHKLI++FKLENFELSQAHTFFWDKYEK+NWFMEQ+IATA+Q
Sbjct:   61 SNQKASGRCWMFAALNTFRHKLITEFKLENFELSQAHTFFWDKYEKANWFMEQVIATADQ 120

Query:  121 ELSSRKVKFLLDVPQQDGGQWDNVVALFEKYGVVPKTVYPESVSSSASRELNQYLNKLLR 180
            EL+SRKVKFLLDVPQQDGGQWDMVV+LFEKYGVVPK+VYPES+SSS SRELNQYLNKLLR
Sbjct:  121 ELTSRKVKFLLDVPQQDGGQWDMVVSLFEKYGVVPKSVYPESISSSNSRELNQYLNKLLR 180

Query:  181 QDAQILRELIAQGADGATVQNKKEELLQEIFNFLAMNLGLPPQSFDFAYRDKDNHYQSDK 240
            QDAQILR+LIA GA   V+++K ELLQEIFNFLAM LGLPP+ FDFAYRDKD+HY  +K
Sbjct:  181 QDAQILRDLIASGAKADQVEDRKAELLQEIFNFLAMTLGLPPRHFDFAYRDKDDHYHVEK 240

Query:  241 NITPKAFYQKYVNLDLSDYVSIINAPTVDKPYGQSYTVEMLGNVVGGPAVKYLNLDMKRF 300
            +TP+AFY K+V L LSDYVS+INAPT DKPYG+SYTVEMLGNVVG   V+YLNLDMKRF
Sbjct:  241 GLTPQAFYDKFVGLKLSDYVSVINAPTADKPYGKSYTVEMLGNVVGSREVRYLNLDMKRF 300

Query:  301 KELAIAQMKSGETVWFGSDVGQVSNRQKGILATTTYDFNSSMDIKLSQDKAGRLDYSESL 360
            KELAI QM++GE+VWFGSDVGQVS+RQKGILAT TYDF +SMDI LSQDKAGRLDYSESL
Sbjct:  301 KELAIKQMQAGESVWFGSDVGQVSDRQKGILATNTYDFEASMDINLSQDKAGRLDYSESL 360

Query:  361 MTHAMVLTGVDLDESGQPLKWKVENSWGEKVGKDGYFVASDAWMDEYTYQIVVRKELLTK 420
            MTHAMVLTGVDLDE+G+PLKWKVENSWGEKVG  GYFVASDAWMDEYTYQIVVRKE LT
Sbjct:  361 MTHAMVLTGVDLDETGKPLKWKVENSWGEKVGDKGYFVASDAWMDEYTYQIVVRKEFLTA 420

Query:  421 EELEAYNAEPITLAPWDPMGALA                                    443
            +EL AY  EP  LAPWDPMGALA
Sbjct:  421 DELAAYEKEPQVLAPWDPMGALA                                    443
```

Based on this analysis, it was predicted that these proteins and their epitopes could be useful antigens for vaccines or diagnostics.

Example 965

A DNA sequence (GBSx1024) was identified in *S. agalactiae* <SEQ ID 2947> which encodes the amino acid sequence <SEQ ID 2948>. Analysis of this protein sequence reveals the following:

---

Possible site: 36
>>> Seems to have a cleavable N-term signal seq.

-continued

----- Final Results -----
bacterial outside --- Certainty = 0.3000 (Affirmative) <succ>
bacterial membrane --- Certainty = 0.0000 (Not Clear) <succ>
bacterial cytoplasm --- Certainty = 0.0000 (Not Clear) <succ>

---

A related GBS nucleic acid sequence <SEQ ID 9533> which encodes amino acid sequence <SEQ ID 9534> was also identified.

The protein has homology with the following sequences in the GENPEPT database.

```
>GP:AAF17262 GB:AF210752 penicillin-binding protein 1A
[Streptococcus pneumoniae]
Identities = 412/725 (56%), Positives = 544/725 (74%), Gaps = 14/725 (1%)
Query:     4 IKKESVIKLLKYAFGIIMGFIILAIVIGGLLFAYYVSRSPKLTDQALKSVNSSLVYDGNN 63
             + K ++++L+KY     +  +I AIV+GG +F YYVS++P L++   L + SS  +YD N
Sbjct:     1 MNKPTILRLIKYLSISFLSLVIAAIVLGGGVFFYYVSKAPSLSESKLVATTSSKIYDNKN 60

Query:    64 KLIADLGSEKRESVSADSIPLNLVNAITSIEDKRFFKHRGVDIYRILGAAWHNLVSSNTQ 123
             +LIADLGSE+R  + A+ IP +LV AI SIED RFF HRG+D  RILGA   NL S++ Q
Sbjct:    61 QLIADLGSERRVNAQANDIPTDLVKAIVSIEDHRFFDHRGIDTIRILGAFLRNLQSNSLQ 120

Query:   124 GGSTLDQQLIKLAYFSTNKSDQTLKRKSQEVWLALQMERKYTKEEILTFYINKVYMGNGN 183
             GGSTL QQLIKL YFST+ SDQT+ RK+QE WLA+Q+E+K TK+EILT+YINKVYM NGN
Sbjct:   121 GGSTLTQQLIKLTYFSTSTSDQTISRKAQEAWLAIQLEQKATKQEILTYYINKVYMSNGN 180

Query:   184 YGMRTTAKSYFGKDLKELSIAQLALLAGIPQAPTQYDPYKNPESAQTRRNTVLQQMYQDK 243
             YGM+T  A++Y+GKDL  LS+ QLALLAG+PQAP QYDPY +PE+AQ RRN VL +M
Sbjct:   181 YGMQTAAQNYYGKDLNNLSLPQLALLAGMPQAPNQYDPYSHPEAAQDRRNLVLSEMKNQG 240

Query:   244 NISKKEYDQAVATPVTDGLKELKQKSTYPKYMDNYLKQVISEVKQKTGKDIFTAGLKVYT 303
             +IS ++Y++AV TP+TDGL+ LK  S YP YMDNYLK+VI++V+++TG ++ T G+ VYT
Sbjct:   241 YISAEQYEKAVNTPITDGLQSLKSASNYPAYMDNYLKEVINQVEEETGYNLLTTGMDVYT 300

Query:   304 NINTDAQKQLYDIYNSDTYIAYPNNELQIASTIMDATNGKVIAQLGGRHQNENISFGTNQ 363
             N++  +AQK L+DIYN+D Y+AYP++ELQ+ASTI+D +NGKVIAQLG RHQ+ N+SFG NQ
Sbjct:   301 NVDQEAQKHLWDIYNTDEYVAYPDDELQVASTIVDVSNGKVIAQLGARHQSSNVSFGINQ 360
```

```
Query:  364 SVLTDRDWGSTMKPISAYAPAIDSGVYNSTGQSLNDSVYYWPGTSTQLYDWDRQYMGWMS 423
            +V T+RDWGSTMKPI+ YAPA++ GVY+ST    ++D Y +PGT T +Y+WDR Y G ++
Sbjct:  361 AVETNRDWGSTMKPITDYAPALEYGVYDSTATIVHDEPYNYPGTDTPVYNWDRGYFGNIT 420

Query:  424 MQTAIQQSRNVPAVRALEAAGLDEAKSFLEKLGIYYPEMNYSNAISSNNSSSDAKYGASS 483
            +Q A+QQSRNVPAV  L   GL+ AK+FL  LGI YP ++YSNAISSN + SD KYGASS
Sbjct:  421 LQYALQQSRNVPAVETLNKVGLNRAKTFLNGLGIDYPSLHYSNAISSNTTESDKKYGASS 480

Query:  484 EKMAAAYSAFANGGTYYKPQYVNKIEFSDGTNDTYAASGSRAMKETTAYMMTDMLKTVLT 543
            EKMAAAY+AFANGGTYYKP Y++K+ FSDG    ++  G+RAMKETTAYMMTDM+KTVL
Sbjct:  481 EKMAAAYAAFANGGTYYKPMYIHKVVFSDGSEKEFSNVGTRAMKETTAYMMTDMMKTVLV 540

Query:  544 FGTGTKAAIPGVAQAGKTGTSNYTEDELAKIEATTGIYNSAVGTMAPDENFVGYTSKYTM 603
            +G G  A +P + QAGKTGTSNYT++E+ K      Y     G +APDE FVGYT KY M
Sbjct:  541 YGIGRGAYLPWLPQAGKTGTSNYTDEEIEK-------YIKNTGYVAPDEMFVGYTRKYAM 593

Query:  604 AIWTGYKNRLTPLYGSQLDIATEVYRAMMSYLTGGYSA-DWTMPEGLYRSGSYLYINGTT 662
            A+WTGY NRLTPL  G  L +A +VYR+MM+YL+ G + DW +PEGLYR+G +++ NG
Sbjct:  594 AVWTGYSNRLTPLVGDGLTVAAKVYRSMMTYLSEGSNPEDWNIPEGLYRNGEFVFKNGAR 653

Query:  663 TTGTYSSSVYKNIYQNSGQSSQSSSSTSSEKQKEDKNTANDANSSSPQVETPNNGNATTP 722
            +T  +SS    S +SS SSS +S+ +      + N++ +++P   T  +    TTP
Sbjct:  654 ST--WSSPAPQQ--PPSTESSSSSSDSSTSQSNSTTPSTNNSTTTNPNNNTQQSN--TTP 707

Query:  723 NNSNQ 727
            + NQ
Sbjct:  708 DQQNQ 712
```

A related DNA sequence was identified in *S. pyogenes* <SEQ ID 2949> which encodes the amino acid sequence <SEQ ID 2950>. Analysis of this protein sequence reveals the following:

Possible site: 41
>>> Seems to have an uncleavable N-term signal seq

-continued

INTEGRAL    Likelihood = –13.96    Transmembrane 19-35 (9-43)
----- Final Results -----
    bacterial membrane --- Certainty = 0.6583 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:CAA88918 GB:Z49095 penicillin-binding protein 1a [Streptococcus pneumoniae]
Identities = 422/712 (59%), Positives = 536/712 (75%), Gaps = 8/712 (1%)
Query:    4 IKNPKILKWLKYVLSAILSLIILVIIIGGLLPTFYISSAPKLSEAQLKSTNSSLVYDGNN   63
            +  P IL+ +KY+ + LSL+I  I++GG +F +Y+S AP LSE++L +T SS +YD  N
Sbjct:    1 MNKPTILRLIKYLSISFLSLVIAAIVLGGGVFFYYVSKAPSLSESKLVATTSSKIYDNKN   60

Query:   64 NLIADLGSEKRENVTADSIPINLVNAITSIEDKRFFNHRGVDLYRIFGAAFHNLTSQTTQ  123
            +LIADLGSE+R N  A+ IP +LV AI SIED RFF+HRG+D  RI GA   NL S + Q
Sbjct:   61 QLIADLGSERRVNAQANDIPTDLVKAIVSIEDHRFFDHRGIDTIRILGAFLRNLQSNSLQ  120

Query:  124 GGSTLDQQLIKLAYFSTNESDQTLKRKAQEVWLALQMERKYTKQEILTFYINKVYMGNGN  183
            GGSTL QQLIKL YFST+ SDQT+ RKAQE WLA+Q+E+K TKQEILT +YINKVYM NGN
Sbjct:  121 GGSTLTQQLIKLTYFSTSTSDQTISRKAQEAWLAIQLEQKATKQEILTYYINKVYMSNGN  180

Query:  184 YGMLTAAKSYYGKDLKDLSYAQLALLAGIPQAPSQYDPYLHPEAAQNRRNVVLQQMYMEK  243
            YGM TAA++YYGKDL +LS  QLALLAG+PQAP+QYDPY HPEAAQ+RRN+VL +M  +
Sbjct:  181 YGMQTAAQNYYGKDLNNLSLPQLALLAGMPQAPNQYDPYSHPEAAQDRRNLVLSEMKNQG  240

Query:  244 HLTKAEYETAIATPVAEGLQSLQQRSTYPKYMDNYLKQVIEEVKKETNKDIFTAGLKVYT  303
            +++   +YE A+ TP+  +GLQSL+  S YP YMDNYLK+VI  +V++ET   ++ T G+ VYT
Sbjct:  241 YISAEQYEKAVNTPITDGLQSLKSASNYPAYMDNYLKEVINQVEEETGYNLLTTGMDVYT  300

Query:  304 NIIPDAQQTLYNIYHSGDYVYYPDQDFQVASTIVDVTNGHVIAQLGGRNQDENVSFGTNQ  363
            N+   +AQ+ L++IY+S  YV YPD D QVAST+VDV+NG VIAQLG R+Q  NVSFGTNQ
Sbjct:  301 NVDQEAQKHLWDIYNSDQYVSYPDDDLQVASTVVDVSNGKVIAQLGARHQASNVSFGTNQ  360

Query:  364 AVLTDRDWGSTMKPITAYAPAIESGVYTSTAQSTNDSVYYWPGTTTQLFNWDLRYNGWMT  423
            AV T+RDWGS+MKPIT YAPA+E GVY STA    +D Y +PGT T L+NWD  Y G +T
Sbjct:  361 AVETNRDWGSSMKPITDYAPALEYGVYDSTASIVHDVPYNYPGTDTPLYNWDHVYFGNIT  420

Query:  424 IQAAIMLSRNVPAVRALEAAGLDYARSFLSSLGINYPEMHYSNAISSNNSSSDKKYGASS  483
            IQ A+  SRNV AV  L   GLD A++FL  LGI+YP MHY+NAISSN + S+KKYGASS
Sbjct:  421 IQYALQQSRNVTAVETLNKVGLDRAKTFLNGLGIDYPSMHYANAISSNTTESNKKYGASS  480

Query:  484 EKMAAAYAAFANGGIYHKPRYVNKVEFSDGTSKTFDEKGKRAMKETTAYMMTDMLKTVLT  543
            EKMAAAYAAFANGGIYHKP Y+NK+ FSDG  K F +  G RAMKETTAYMMT+M+KTVLT
Sbjct:  481 EKMAAAYAAFANGGIYHKPMYINKIVFSDGSEKEFSDAGTRAMKETTAYMMTEMMKTVLT  540
```

```
-continued
Query:  544 YGTGTAAAIPGVAQAGKTGTSNYTDEELAKIGEKYGLYPDYVGTLAPDENFVGFTKRYAM  603
            YGTG  A +P + QAGKTGTSNYTDEE+ K        Y    G +APDE FVG+T++YAM
Sbjct:  541 YGTGRGAYLPWLPQAGKTGTSNYTDEEIEK-------YIKNTGYVAPDEMFVGYTRKYAM  593

Query:  604 AVWTGYKNRLTPVYGSSLEIASDVYRSMMTYLT-NGYSEDWTMPNGLYRSGGFLYLSGTY  662
            AVWTGY NRLTP+ G    +A VYRSM+TYL+ +    DWTMP+GLYR+G F++ +G
Sbjct:  594 AVWTGYSNRLTPIIGDGELVAGKVYRSMITYLSEDDQPGDWTMPDGLYRNGEFVFKNGAR  653

Query:  663 ASNTDYTNSVYNNLYSNNTTTASSQTTSDDTSSSNDTSNSTNTDNNGSHPST          714
            ++ +       + S+++++ SS + S+ T+ S + S +TN +NN    +T
Sbjct:  654 STWSSPAPQQPPSTESSSSSSDSSTSQSNSTTPSTNNSTTTNPNNNTQQSNT          705
```

An alignment of the GAS and GBS proteins is shown below.

```
Identities = 521/729 (71%), Positives = 621/729 (84%), Gaps = 10/729 (1%)
Query:    1 MITIKKESVIKLLKYAFGIIMGFIILAIVIGGLLFAYYVSRSPKLTDQALKSVNSSLVYD   60
            +ITIK   ++K LKY   I+    IIL I+GGLLF +Y+S +PKL++  LKS NSSLVYD
Sbjct:    1 VITIKNPKILKWLKYVLSAILSLIILVIIIGGLLFTFYISSAPKLSEAQLKSTNSSLVYD   60

Query:   61 GNNKLIADLGSEKRESVSADSIPLNLVNAITSIEDKRFFKHRGVDIYRILGAAWHNLVSS  120
            GNN LIADLGSEKRE+V+ADSIP+NLVNAITSIEDKRFF HRGVD+YRI GAA+HNL S
Sbjct:   61 GNNNLIADLGSEKRENVTADSIPINLVNAITSIEDKRFFNHRGVDLYRIFGAAFHNLTSQ  120

Query:  121 NTQGGSTLDQQLIKLAYFSTNKSDQTLKRKSQEVWLALQMERKYTKEEILTFYINKVYMG  180
              TQGGSTLDQQLIKLAYFSTN+SDQTLKRK+QEVWLALQMERKYTK+EILTFYINKVYMG
Sbjct:  121 TTQGGSTLDQQLIKLAYFSTNESDQTLKRKAQEVWLALQMERKYTKQEILTFYINKVYMG  180

Query:  181 NGNYGMRTTAKSYFGKDLKELSIAQLALLAGIPQAPTQYDPYKNPESAQTRRNTVLQQMY  240
            NGNYGM T AKSY+GKDLK+LS AQLALLAGIPQAP+QYDPY +PE+AQ RRN VLQQMY
Sbjct:  181 NGNYGMLTAAKSYYGKDLKDLSYAQLALLAGIPQAPSQYDPYLHPEAAQNRRNVVLQQMY  240

Query:  241 QDKNISKKEYDQAVATPVTDGLKELKQKSTYPKYMDNYLKQVISEVKQKTGKDIFTAGLK  300
             +K+++K EY+  A+ATPV +GL+  L+Q+STYPKYMDNYLKQVI  EVK++T KDIFTAGLK
Sbjct:  241 MEKHLTKAEYETAIATPVAEGLQSLQQRSTYPKYMDNYLKQVIEEVKKETNKDIFTAGLK  300

Query:  301 VYTNINTDAQKQLYDIYNSDTYIAYPNNELQIASTIMDATNGKVIAQLGGRHQNENISFG  360
            VYTNI  DAQ+ LY+IY+S  Y+ YP+ +  Q+ASTI+D TNG VIAQLGGR+Q+EN+SFG
Sbjct:  301 VYTNIIPDAQQTLYNIYHSGDYVYYPDQDFQVASTIVDVTNGHVIAQLGGRNQDENVSFG  360

Query:  361 TNQSVLTDRDWGSTMKPISAYAPAIDSGVYNSTGQSLNDSVYYWPGTSTQLYDWDRQYMG  420
            TNQ+VLTDRDWGSTMKPI+AYAPAI+SGVY ST QS NDSVYYWPGT+TQL++WD +Y G
Sbjct:  361 TNQAVLTDRDWGSTMKPITAYAPAIESGVYTSTAQSTNDSVYYWPGTTTQLFNWDLRYNG  420

Query:  421 WMSMQTAIQQSRNVPAVRALEAAGLDEAKSFLEKLGIYYPEMNYSNAISSNNSSSDAKYG  480
            WM++Q AI  SRNVPAVRALEAAGLD A+SFL  LGI YPEM+YSNAISSNNSSSD KYG
Sbjct:  421 WMTIQAAIMLSRNVPAVRALEAAGLDYARSFLSSLGINYPEMHYSNAISSNNSSSDKKYG  480

Query:  481 ASSEKMAAAYSAFANGGTYYKPQYVNKIEFSDGTNDTYAASGSRAMKETTAYMMTDMLKT  540
            ASSEKMAAAY+AFANGG Y+KP+YVNK+EFSDGT+ T+   G RAMKETTAYMMTDMLKT
Sbjct:  481 ASSEKMAAAYAAFANGGIYHKPRYVNKVEFSDGTSKTFDEKGKRAMKETTAYMMTDMLKT  540

Query:  541 VLTFGTGTKAAIPGVAQAGKTGTSNYTEDELAKIEATTGIYNSAVGTMAPDENFVGYTSK  600
            VLT+GTGT AAIPGVAQAGKTGTSNYT++ELAKI     G+Y    VGT+APDENFVG+T +
Sbjct:  541 VLTYGTGTAAAIPGVAQAGKTGTSNYTDEELAKIGEKYGLYPDYVGTLAPDENFVGFTKR  600

Query:  601 YTMAIWTGYKNRLTPLYGSQLDIATEVYRAMMSYLTGGYSADWTMPEGLYRSGSYLYING  660
            Y MA+WTGYKNRLTP+YGS L+IA++VYR MM+YLT GYS DWTMP GLYRSG +LY++G
Sbjct:  601 YAMAVWTGYKNRLTPVYGSSLEIASDVYRSMMTYLTNGYSEDWTMPNGLYRSGGFLYLSG  660

Query:  661 TTTTGT-YSSSVYKNIYQNSGQSSQSSSSTSSEKQKEDKNTANDANSSSPQVETPNNGNA  719
            T  + T Y+++SVY N+Y N    ++++ SS+  +D +++ND ++S+   T NNG+
Sbjct:  661 TYASNTDYTNSVYNNLYSN------NTTTASSQTTSDDTSSSNDTSNST---NTDNNGSH  711

Query:  720 TTPNNSNQT                                                    728
            + ++  T
Sbjct:  712 PSTDDKKTT                                                    720
```

A related GBS gene <SEQ ID 8695> and protein <SEQ ID 8696> were also identified. Analysis of this protein sequence reveals the following:

Lipop: Possible site: −1  Crend: 10
McG: Discrim Score: 6.55

GvH: Signal Score (−7.5): −1.98
Possible site: 36
>>> Seems to have a cleavable N-term signal seq.
ALOM program   count: 0 value: 4.03 threshold: 0.0
PERIPHERAL      Likelihood = 4.03       201

1671
-continued modified ALOM score: −1.31
*** Reasoning Step: 3
----- Final Results -----
  bacterial outside --- Certainty = 0.3000 (Affirmative) <succ>

1672
-continued bacterial membrane --- Certainty = 0.0000 (Not Clear) <succ>
bacterial cytoplasm --- Certainty = 0.0000 (Not Clear) <succ>

The protein has homology with the following sequences in the databases:

```
57.5/76.2% over 712aa
Streptococcus pneumoniae
GP|6563351| penicillin-binding protein 1A Insert characterized
ORF00399(310-2484 of 2850)
GP|6563351|gb|AAF17262.1|AF210752_1|AF210752(1-713 of 719) penicillin-binding protein 1A
{Streptococcus pneumoniae}
% Match = 43.8
% Identity = 57.5 % Similarity = 76.2
Matches = 412 Mismatches = 166 Conservative Sub.s = 134

237       267       297       327       357       387       417       447
         LIISEKMDFS*RRVPFLKSLT*ILLKKNY*AVITIKKESVIKLLKYAFGIIMGFIILAIVIGGLLFAYYVSRSPKLTDQA
                              :   |  :::: | :||      :  :: ||      |||     :|   ||||:: |  |::
                              MNKPTILRLIKYLSISFLSLVIAAIVLGGGVFFYYVSKAPSLSESK
                                        10        20        30        40

477       507       537       567       597       627       657       687
         LKSVNSSLVYDGNNKLIADLGSEKRESVSADSIPLNLVNAITSIEDKRFFKHRGVDIYRILGAAWHNLVSSNTQGGSTLD
         |  :    || :||    |:|||||||||:|  :    |: ||  ||   ||||  |||:|   |||||      || |:: ||||||
         LVATTSSKIYDNKNQLIADLGSERRVNAQANDIPTDLVKAIVSIEDHRFFDHRGIDTIRILGAFLRNLQSNSLQGGSTLT
                60        70        80        90       100       110       120

717       747       777       807       837       867       897       927
         QQLIKLAYFSTNKSDQTLKRKSQEVWLALQMERKYTKEEILTFYINKVYMGNGNYGMRTTAKSYFGKDLKELSIAQLALL
         ||||||  ||||  ||||: ||:||  |||:|:|:|  |:||||||||||||:|  |::|:||||   ||:  |||||
         QQLIKLTYFSTSTDQTISRKAQEAWLAIQLEQKATKQEILTYYINKVYMSNGNYGMQTAAQNYYGKDLNNLSLPQLALL
                140       150       160       170       180       190       200

957       987      1017      1047      1077      1107      1137      1167
         AGIPQAPTQYDPYKNPESAQTRRNTVLQQMYQDKNISKKEYDQAVATPVTDGLKELKQKSTYPKYMDNYLKQVISEVKQK
         ||:||||  |||||  :||:||  |||  || |:|        || ::|::||  ||:||||  ||  :  ||||||||||:|::|:::
         AGMPQAPNQYDPYSHPEAAQDRRNLVLSEMKNQGYISAEQYEKAVNTPITDGLQSLKSASNYPAYMDNYLKEVINQVEEE
                220       230       240       250       260       270       280

1197      1227      1257      1287      1317      1347      1377      1407
         TGKDIFTAGLKVYTNINTDAQKQLYDIYNSDTYIAYPNNELQIASTIMDATNGKVIAQLGGRHQNENISFGTNQSVLTDR
         || :::|  |:  ||||::  :|||:|:||||:|  :|||::|||||||:|  :||||||||  :::|||  ||:|  |:|
         TGYNLLTTGMDVYTNVDQEAQKHLWDIYNTDEYVAYPDDELQVASTIVDVSNGKVIAQLGARHQSSNVSFGINQAVETNR
                300       310       320       330       340       350       360

1437      1467      1497      1527      1557      1587      1617      1647
         DWGSTMKPISAYAPAIDSGVYNSTGQSLNDSVYYWPGTSTQLYDWDRQYMGWMSMQTAIQQSRNVPAVRALEAAGLDEAK
         |||||||||:   ||||::  |||:||     ::   |||:||  | : :|  |  |||||||| |  ||:  |  ||: |
         DWGSTMKPITDYAPALEYGVYDSTATIVHDEPYNYPGTDTPVYNWDRGYFGNITLQYALQQSRNVPAVETLNKVGLNRAK
                380       390       400       410       420       430       440

1677      1707      1737      1767      1797      1827      1857      1887
         SFLEKLGIYYPEMNYSNAISSNNSSSDAKYGASSEKMAAAYSAFANGGTYYKPQYVNKIEFSDGTNDTYAASGSRAMKET
         :||   ||| || ||  ::||||||||  : ||  ||||||||||||:|||||||||||  |::: ||||   ::    |:||||||
         TFLNGLGIDYPSLHYSNAISSNTTESDKKYGASSEKMAAAYAAFANGGTYYKPMYIHKVVFSDGSEKEFSNVGTRAMKET
                460       470       480       490       500       510       520

1917      1947      1977      2007      2037      2067      2097      2127
         TAYMMTDMLKTVLTFGTGTKAAIPGVAQAGKTGTSNYTEDELAKIEATTGIYNSAVGTMAPDENFVGYTSKYTMAIWTGY
         |||||||||:||||  :|  |  |  :|  :  |||||||||||::|:  |        |  |:||||  ||||| ||  ||::|||
         TAYMMTDMMKTVLVYGIGRGAYLPWLPQAGKTGTSNYTDEEIEK-------YIKNTGYVAPDEMFVGYTRKYAMAVWTGY
                540       550       560       570               580       590

2157      2187      2214      2244      2274      2304      2334      2364
         KNRLTPLYGSQLDIATEVYRAMMSYLT-GGYSADWTMPEGLYRSGSYLYINGTTTTGTYSSSVYKNIYQNSGQSSQSSSS
         ||||||  |  |  |  :|||::|||:||: | :|||||||||||| |::  :||         |  |    |    |   |
         SNRLTPLVGDGLTVAAKVYRSMMTYLSEGSNPEDWNIPEGLYRNGEFVFKNGARST--WSSPAPQQ--PPSTESSSSSSD
                610       620       630       640       650       660       670

2394      2424      2454      2484      2514      2544      2574      2604
         TSSEKQKEDKNTANDANSSPQVETPNNGNATTPNNSNQTVPGTGHGNGNGNGNNNTVPNGN*KTGYIIQFFNL*LLLLI
         :|: :       :  |:: :::|    |    :    |||:  ||
         SSTSQSNSTTPSTNNSTTTNPNNNTQQS--NTTPDQQNQNPQPAQP
                690       700       710
```

SEQ ID 8696 (GBS146) was expressed in *E. coli* as a His-fusion product. SDS-PAGE analysis of total cell extract is shown in FIG. 23 (lane 4; MW 82 kDa), in FIG. 168 (lane 11-13; MW 96.5 kDa) and in FIG. 238 (lane 8; MW 96.5 kDa). It was also expressed in *E. coli* as a GST-fusion product. SDS-PAGE analysis of total cell extract is shown in FIG. 49 (lane 2; MW 107 kDa).

Purified Thio-GBS146-His is shown in FIG. 244, lane 4.

Based on this analysis, it was predicted that these proteins and their epitopes could be useful antigens for vaccines or diagnostics.

Example 966

A DNA sequence (GBSx1025) was identified in *S. agalactiae* <SEQ ID 2951> which encodes the amino acid sequence <SEQ ID 2952>. Analysis of this protein sequence reveals the following:

```
Possible site: 37
>>> Seems to have no N-terminal signal sequence
----- Final Results -----
    bacterial cytoplasm --- Certainty = 0.3647 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

A related DNA sequence was identified in *S. pyogenes* <SEQ ID 2953> which encodes the amino acid sequence <SEQ ID 2954>. Analysis of this protein sequence reveals the following:

```
Possible site: 37
>>> Seems to have no N-terminal signal sequence
----- Final Results -----
    bacterial cytoplasm --- Certainty = 0.5030 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
>GP:AAA26957 GB:M90528 ORF [Streptococcus oralis]
Identities = 143/196 (72%), Positives = 165/196 (83%), Gaps = 1/196 (0%)
Query:    1 MVNYPHQLIRKTTVTKSKKKKIDFANRGMSFEAAINATNDYYLSHELAVIHKKPTPVQIV 60
            MVNYPH++  +      + K +FANRGMSFE  INATNDYYLSH LAVIHKKPTP+QIV
Sbjct:    1 MVNYPHKISSQKRQAPPSQTK-NFANRGMSFEKMINATNDYYLSHGLAVIHKKPTPIQIV 59

Query:   61 KVDYPKRSRAKIVEAYFRQASTTDYSGVYKGYYIDFEAKETRQKTAMPMKNFHAHQIEHM 120
            +VDYP+RSRAKIVEAYFRQASTTDYSGVY GYYIDFEAKETRQK A+PMKNFH HQI+HM
Sbjct:   60 RVDYPQRSRAKIVEAYFRQASTTDYSGVYDGYYIDFEAKETRQKHAIPMKNEHHHQIQHM 119

Query:  121 ANVLQQKGICFVLLHFSTLKETYLLPANELISFYQIDKGNKSMPIDYIRKNGFFVKESAF 180
              VL Q+GICFVLLHF++ +ETYLLPA +LI FY  DKG KSMP+ YIR+NG+ ++  AF
Sbjct:  120 EQVLAQRGICFVLLHFASQQETYLLPAVDLIRFYHQDKGQKSMPLGYIRENGYRIELGAF 179

Query:  181 PQVPYLDIIEEKLLGG                                             196
            PQ+PYLDII+E LLGG
Sbjct:  180 PQIPYLDIIKEHLLGG                                             195

Identities = 166/199 (83%), Positives = 177/199 (88%)
Query:    1 MVNYPHQLIRKTTVTKSKKKKIDFANRGMSFEAAINATNDYYLSHELAVIHKKPTPVQIV 60
            MVNYPH LIR+    +  K+ K+DFANRGMSFEAAINATNDYYLS ++AVIHKKPTPVQIV
Sbjct:    1 MVNYPHNLIRQKVSSVQKQNKVDFANRGMSFEAAINATNDYYLSRQIAVIHKKPTPVQIV 60

Query:   61 KVDYPKRSRAKIVEAYFRQASTTDYSGVYKGYYIDFEAKETRQKTAMPMKNFHAHQIEHM 120
            KVDYPKRSRAKIVEAYFRQASTTDY GVYKG+Y+DFEAKETRQKTAMPMKNFH HQIEHM
Sbjct:   61 KVDYPKRSRAKIVEAYFRQASTTDYCGVYKGHYVDFEAKETRQKTAMPMKNFHLHQIEHM 120

Query:  121 ANVLQQKGICFVLLHFSTLKETYLLPANELISFYQIDKGNKSMPIDYIRKNGFFVKESAF 180
            A VL QKGICFVLLHFSTLKETY LPA  LISFYQID G+KSMPIDYIRKNGF V   AF
Sbjct:  121 ACVLHQKGICFVLLHFSTLKETYYLPAQALISFYQIDNGSKSMPIDYIRKNGFKVAFGAF 180

Query:  181 PQVPYLDIIEEKLLGGDYN                                          199
            PQVPYL+IIE+  LGGDYN
Sbjct:  181 PQVPYLNIIEQNFLGGDYN                                          199
```

Based on this analysis, it was predicted that these proteins and their epitopes could be useful antigens for vaccines or diagnostics.

Example 967

A DNA sequence (GBSx1026) was identified in *S. agalactiae* <SEQ ID 2955> which encodes the amino acid sequence <SEQ ID 2956>. Analysis of this protein sequence reveals the following:

Possible site: 61
>>> Seems to have no N-terminal signal sequence
----- Final Results -----
    bacterial cytoplasm --- Certainty = 0.3227 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database.

```
>GP:CAB14136 GB:Z99115 similar to hypothetical proteins from B. subtilis
[Bacillus subtilis]
Identities = 74/174 (42%), Positives = 97/174 (55%), Gaps = 6/174 (3%)
Query:    5 ILVTGYKNFELGIFQDKDPRITIIKKAIDKDFRRFLENGADWFIFMGNLGFEYWALEVAL  64
            + +TGYK FELGIF+ D + IKKAI       FL+ G +W + G LG E WA E A
Sbjct:    4 LAITGYKPFELGIFKQDDKALYYIKKAIKNRLIAFLDEGLEWILISGQLGVELWAAEAAY  63

Query:   65 DLQKEY-DFQIATIFTFENHGQNWNEANKAKL-ALFKQVDF-VKYTFPSYENPGQFKQYN 121
            DLQ+EY D ++A I F   +NW E NK +  A+  Q D+    T   YE+P QFKQ N
Sbjct:   64 DLQEEYPDLKVAVITPFYEQEKNWKEPNKEQYEAVLAQADYEASLTHRPYESPLQFKQKN 123

Query:  122 HFLINNTQGAYLFYDSENETNLKFLLEMMEKK---EAYDISFLTFDRLNEIYEE        172
            F I+ + G  L YD E E + K++L    EK+   + Y I F+T D L    EE
Sbjct:  124 QFFIDKSDGLLLLYDPEKEGSPKYMLGTAEKRREQDGYPIYFITMDDLRVTVEE        177
```

A related DNA sequence was identified in *S. pyogenes* <SEQ ID 2957> which encodes the amino acid sequence <SEQ ID 2958>. Analysis of this protein sequence reveals the following:

Possible site: 60
>>> Seems to have no N-terminal signal sequence
----- Final Results -----
    bacterial cytoplasm --- Certainty = 0.3041 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below.

```
Identities = 102/167 (61%), Positives = 127/167 (75%)

Query:    3 STILVTGYKNFELGIFQDKDPRITIIKKAIDKDFRRFLENGADWFIFMGNLGFEYWALEV  62
            + IL+TGY++FE+GIF KDPR++IIK+AI KD   +LENG DWFIF GNLGFE WALEV
Sbjct:    2 TAILITGYRSFEIGIFDHKDPRVSIIKQAIRKDLIGYLENGVDWFIFTGNLGFEQWALEV  61

Query:   63 ALDLQKEYDFQIATIFTFENHGQNWNEANKAKLALFKQVDFVKYTFPSYENPGQFKQYNH 122
            A +L++EY  QIATIF FE HG  WNE NK  L+ F+ VDFVKY FP+YE P QF QY
Sbjct:   62 ANELKEEYPLQIATIFLFETHGDRWNEKNKEVLSQFRAVDFVKYYFPNYEQPTQFSQYYQ 121

Query:  123 FLINNTQGAYLFYDSENETNLKFLLEMMEKKEAYDISFLTFDRLNEI              169
            FL+  T+GAY+FYD+ENETNLK+ L+  +     Y +  LTFDRLN++
Sbjct:  122 FLLEKTEGAYVFYDTENETNLKYFLKKAKDMPHYQLLLLTFDRLNDM              168
```

Based on this analysis, it was predicted that these proteins and their epitopes could be useful antigens for vaccines or diagnostics.

Example 968

A DNA sequence (GBSx1027) was identified in *S. agalactiae* <SEQ ID 2959> which encodes the amino acid sequence <SEQ ID 2960>. Analysis of this protein sequence reveals the following:

Possible site: 23
>>> Seems to have no N-terminal signal sequence
----- Final Results -----
    bacterial cytoplasm --- Certainty = 0.5188 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 969

A DNA sequence (GBSx1028) was identified in *S. agalactiae* <SEQ ID 2961> which encodes the amino acid sequence <SEQ ID 2962>. This protein is predicted to be cell division protein DivIVA. Analysis of this protein sequence reveals the following:

Possible site: 16
>>> Seems to have no N-terminal signal sequence
----- Final Results -----
    bacterial cytoplasm --- Certainty = 0.2736 (Affirmative) <succ>
      bacterial membrane --- Certainty = 0.0000 (Not Clear) <succ>
        bacterial outside --- Certainty = 0.0000 (Not Clear) <succ>

A related GBS nucleic acid sequence <SEQ ID 9535> which encodes amino acid sequence <SEQ ID 9536> was also identified.

The protein has homology with the following sequences in the GENPEPT database.

```
>GP: CAB14135 GB: Z99115 ypsB [Bacillus subtilis]
Identities = 46/102 (45%), Positives = 69/102 (67%), Gaps = 14/102 (13%)
Query:   14 SPKDIFEQDFKVSMRGYDKKEVDVFLDDVIKDYENYLEQIEKLQMENRRLQQALDKKESE   73
            S K+I E++FK  +RGY +++VD FLD +IKDYE + ++IE+LQ EN +L++ L+    E
Sbjct:    9 SAKEILEKEFKTGVRGYKQEDVDKFLDMIIKDYETFHQEIEELQQENLQLKKQLE----E   64

Query:   74 ASNVRNSGTAMYNQKPIAQSATNFDILKRISRLEKEVFGRQI                    115
            AS            ++P+  + TNFDILKR+S LEK VFG ++
Sbjct:   65 AS----------KKQPVQSNTTNFDILKRLSNLEKHVFGSKL                     96
```

A related DNA sequence was identified in *S. pyogenes* <SEQ ID 2963> which encodes the amino acid sequence <SEQ ID 2964>. Analysis of this protein sequence reveals the following:

Possible site: 51
>>> Seems to have no N-terminal signal sequence
----- Final Results -----
    bacterial cytoplasm --- Certainty = 0.4466 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below.

```
Identities = 71/112 (63%), Positives = 85/112 (75%), Gaps = 6/112 (5%)
Query:    8 MASIIYSPKDIFEQDFKVSMRGYDKKEVDVFLDDVIKDYENYLEQIEKLQMENRRLQQAL   67
            M SIIYSPKDIFEQ+FK SMRG+DKKEVD FLD+VIKDYEN+  QIE L+ EN   +AL
Sbjct:    1 MTSIIYSPKDIFEQEFKTSMRGFDKKEVDEFLDNVIKDYENFNAQIEALKAEN----EAL   56

Query:   68 DKKESEASNVRNSGTAMYNQKP--IAQSATNFDILKRISRLEKEVFGRQIRE          117
            K + +A N ++       +P  +AQSATNFDILKRIS+LEKEVFG+QI E
Sbjct:   57 KKAKFQARNTVSATVQQPVPQPTRVAQSATNFDILKRISKLEKEVFGKQIIE          108
```

Based on this analysis, it was predicted that these proteins and their epitopes could be useful antigens for vaccines or diagnostics.

Example 970

A DNA sequence (GBSx1029) was identified in *S. agalactiae* <SEQ ID 2965> which encodes the amino acid sequence <SEQ ID 2966>. Analysis of this protein sequence reveals the following:

Possible site: 55
>>> Seems to have no N-terminal signal sequence (or aa 1-19)
----- Final Results -----
    bacterial cytoplasm --- Certainty = 0.0655 (Affirmative) <succ>
      bacterial membrane --- Certainty = 0.0000 (Not Clear) <succ>
        bacterial outside --- Certainty = 0.0000 (Not Clear) <succ>

The protein has homology with the following sequences in the GENPEPT database.

```
>GP: CAB14134 GB: Z99115 similar to hypothetical proteins [Bacillus subtilis]
Identities = 204/382 (53%), Positives = 274/382 (71%), Gaps = 3/382 (0%)
Query:    3 ESFKLIATAAAGLEAIVGREIRNLGIDCQVENGRVRFHGDIKTIIETNLWLRAADRIKII   62
            + +  LIATA  G+EA+V +E+R+LG +C+V+NG+V F GD   I   NLWLR ADRIK+
Sbjct:    2 KKYTLIATAPMGIEAVVAKEVRDLGYECKVDNGKVIFEGDALAICRANLWLRTADRIKVQ   61

Query:   63 VGEFPAPTFEELFQGVYGLDWENYLPLGAKFPIAKAKCVKSKLHNEPSVQAISKKAVAKK  122
            V  F A TF+ELF+    ++W +++P  KFP+   K VKS L +P  Q I KKA+ +K
```

-continued

```
Sbjct:  62 VASFKAKTFDELFEKTKAINWRSFIPENGKEPVI-GKSVKSTLASVPDCQRIVKKAIVEK    120

Query: 123 LQKVFHRPEGVPLQENGAEFKIEVSILKDKATVMIDTTGSSLFKRGYRAEKGGAPIKENM    182
           L K+        ++E GAE+K+E+S+LKD+A + +D++G+ L KRGYR ++GGAPIKE +
Sbjct: 121 L-KLQSGKANDWIEETGAEYKVEISLLKDQALITLDSSGTGLHKRGYRVDQGGAPIKETL    179

Query: 183 AAAIIQLSNWFPDKPLIDPTCGSGTFCIEAAMIGMNIAPGFNRDFAFEAWPWVDQSQVQK    242
           AAA++QL+NW PD+P +DP CGSGT  IEAA+IG NIAPGFNRDF  E W W+ +    K
Sbjct: 180 AAALVQLTNWTPDRPFVDPFCGSGTIAIEAALIGQNIAPGFNRDFVSEDWEWIGKDLWNK    239

Query: 243 VRDEAESKANYDIDLDISGFDLDGRMVEIARKNAEEAGLGDVIKLKQMRLQDLKTDKING    302
              R E E KANYD L I   D+D RMV+IA++NAEEAGLGD+I+ KQM+++D  T+   G
Sbjct: 240 ARLEVEEKANYDQPLTIFASDIDHRMVQIAKENAEEAGLDLIQFKQMQVKDFTTNLEFG    299

Query: 303 VIISNPPYGERLLDDKAVDILYNEMGQTFAPLKTWSKFILTSDEGFEKKYGSQADKKRKL    362
           VI+ NPPYGERL + KAV+ +Y EMGQ F PL TWS ++LTS+E FE+ YG +A KKRKL
Sbjct: 300 VIVGNPPYGERLGEKKAVEQMYKEMGQAFEPLDTWSVYMLTSNENFEEAYGRKATKKRKL    359

Query: 363 YNGTLKVDLYQYYGERVRRQVK                                        384
           +NG +K D YQY+   +VR Q K
Sbjct: 360 FNGFIKTDYYQYW-SKVRPQRK                                        380
```

A related DNA sequence was identified in *S. pyogenes* <SEQ ID 2967> which encodes the amino acid sequence <SEQ ID 2968>. Analysis of this protein sequence reveals the following:

---

Possible site: 14
>>> Seems to have no N-terminal signal sequence
----- Final Results -----
    bacterial cytoplasm --- Certainty = 0.0324 (Affirmative) <succ>
        bacterial membrane --- Certainty = 0.0000 (Not Clear) <succ>
        bacterial outside --- Certainty = 0.0000 (Not Clear) <succ>

---

An alignment of the GAS and GBS proteins is shown below.

```
Identities = 317/383 (82%), Positives = 354/383 (91%)
Query:   1 MKESFKLIATAAAGLEAIVGREIRNLGIDCQVENGRVRFHGDIKTIIETNLWLRAADRIK     60
           MKE+F+L+ATAAAGLEA+VG+E+R LG DCQVENG+V F GD++ I++TNLWLRAADRIK
Sbjct:   1 MKETFRLVATAAAGLEAVVGKEVRALGFDCQVENGKVYFEGDVEAIVKTNLWLRAADRIK     60

Query:  61 IIVGEFPAPTFEELFQGVYGLDWENYLPLGAKFPIAKAKCVKSKLHNEPSVQAISKKAVA    120
           IIVG+FPA TFEELFQGV+ LDWENYLPLGAKFPI+KAKCVKSKLHNEPSVQAI+KKAV
Sbjct:  61 IIVGQFPARTFEELFQGVFALDWENYLPLGAKFPISKAKCVKSKLHNEPSVQAITKKAVV    120

Query: 121 KKLQKVFHRPEGVPLQENGAEFKIEVSILKDKATVMIDTTGSSLFKRGYRAEKGGAPIKE    180
           KKLQK FHRPEGVPLQE G+ F IEVSILKD+AT+MIDTTGSSLFKRGYR +KGGAPIKE
Sbjct: 121 KKLQKHFHRPEGVPLQEVGSTFNIEVSILKDQATIMIDTTGSSLFKRGYRVQKGGAPIKE    180

Query: 181 NMAAAIIQLSNWFPDKPLIDPTCGSGTFCIEAAMIGMNIAPGFNRDFAFEAWPWVDQSQV    240
           NMAAAI+ LSNWFPDKPL+DPTCGSGTFCIEAAMIGMNIAPGFNR FAFE W WVD+  V
Sbjct: 181 NMAAAILALSNWFPDKPLVDPTCGSGTFCIEAAMIGMNIAPGFNRSFAFEEWSWVDKDMV    240

Query: 241 QKVRDEAESKANYDIDLDISGFDLDGRMVEIARKNAEEAGLGDVIKLKQMRLQDLKTDKI    300
           Q+VRD+AE  ANY+I+LDISGFD+DGRM+EIA+ NAEEAGL DVI  KQMRLQD +TDK+
Sbjct: 241 QQVRDDAEQEANYEIELDISGFDIDGRMIEIAKSNAEEAGLSDVITFKQMRLQDFRTDKV    300

Query: 301 NGVIISNPPYGERLLDDKAVDILYNEMGQTFAPLKTWSKFILTSDEGFEKKYGSQADKKR    360
           NGV+ISNPPYGERLLDDKAVDILYNEMGQTFAPLKTWSKFILTSDE FE KYG +ADKKR
Sbjct: 301 NGVVISNPPYGERLLDDKAVDILYNEMGQTFAPLKTWSKFILTSDELFELKYGQKADKKR    360

Query: 361 KLYNGTLKVDLYQYYGERVRRQV                                       383
           KLYNGTLKVDLYQ+YGERV+R +
Sbjct: 361 KLYNGTLKVDLYQFYGERVKRHL                                       383
```

SEQ ID 2966 (GBS255) was expressed in *E. coli* as a His-fusion product. SDS-PAGE analysis of total cell extract is shown in FIG. 43 (lane 7; MW 44 kDa). It was also expressed in *E. coli* as a GST-fusion product. SDS-PAGE analysis of total cell extract is shown in FIG. 48 (lane 4; MW 69 kDa).

Based on this analysis, it was predicted that these proteins and their epitopes could be useful antigens for vaccines or diagnostics.

Example 971

A DNA sequence (GBSx1030) was identified in *S. agalactiae* <SEQ ID 2969> which encodes the amino acid sequence <SEQ ID 2970>. Analysis of this protein sequence reveals the following:

---

Possible site: 30
>>> Seems to have no N-terminal signal sequence
INTEGRAL    Likelihood = −15.02   Transmembrane 171-187 (167-193)
----- Final Results -----
    bacterial membrane --- Certainty = 0.7007 (Affirmative) <succ>

-continued

```
bacterial outside --- Certainty = 0.0000 (Not Clear) <succ>
bacterial cytoplasm --- Certainty = 0.0000 (Not Clear) <succ>
```

The protein has homology with the following sequences in the GENPEPT database.

```
>GP: AAD16120 GB: AF094508 dentin phosphoryn [Homo sapiens]
Identities = 71/398 (17%), Positives = 152/398 (37%), Gaps = 16/398 (4%)
Query:  16 TDGLEFKDAK-EMTVEEAVRKDSEIKAGITEEDSILDKYIKQHRDEVASQKFETKSSDFA    74
           +D   D+K + +  E+    DS+ K+  ++ +S         D    S       S
Sbjct: 152 SDSSDSSDSKSDSSKSESDSSDSDSKSDSSDSNSSDSSDNSDSSDSSNSSNSSDSSDSSD  211

Query:  75 NLDTASLDDFIKKQREELSAMLAAEELSKKLDNSVSQEQDTEANAVSPKEESSQEQENSV   134
           + D++S D      + S   + S+ D+S S + D+ ++ S     SS        ++
Sbjct: 212 SSDSSSSSD--SSNSSDSSDSSDSSNSSESSDSSDSSDSDSSDSSDSSNSNSSDSSDSSNS  269

Query: 135 TPVPPLNTEAEPTATEPDSTIADSEEYKSSSKKRGGIVGTLIALILLLIVAIFGYNYFKN   194
           +   +  ++ + +  S +DS +   SS           + +      +   N   +
Sbjct: 270 SDSSDSSNSSDSDSSDSSNSSDSSDSDSSNSSDSSDSSDSS------DSSDSSNSSDS     323

Query: 195 NNSTNSQTATSQSSSSKATTTSSEEDKKASQNLDNFNKSYANFFVDDKKTQLKNSEFDKL   254
           N+S+NS ++ S SS ++ +S   D    S + D+ N S        D          +S+
Sbjct: 324 NDSSNSSDSSDSSDSSDSSNSSDSSDSSDSSDSDSSNSS-------DSSNSSDSSDSCNS  376

Query: 255 SELEKKVDALKGTKYYGKVKVKFDSLKRQIDAVKAVNDKFKSPAVVDGKKSEKLEVKDGA   314
           S+       D+    G+      +       +      D+  + N    S    +    + D+
Sbjct: 377 SDSSDSSDSSDGSDSDSSNRSDSSNSSDSSDSSDSSNSSDSSDSSDSNESSSNSSDSSDSS  436

Query: 315 NFDSLDSKTLNTGNASLDSLLHSIVSTGRNQVKQSEEQASSNKVSDTQITEQPNVTNGQS   374
           N    DS +   + S DS    S   S    N        S    SSN   + ++  N ++ +
Sbjct: 437 NSSDSDSSDSSNSSDSSDSSNSSDSSESSNSSDNSNSSDSSNSSDSSDSSDSSNSSDSSN  496

Query: 375 SSSAATINNQAAGTASGNLERNRSRVPYNNAAIADTGN                         412
           SS ++  ++ +    +S + + + S      +++  +D+  +
Sbjct: 497 SSDSSNSSDSSDSNSSDSSDSSXSSDSSDSSDSSDSSD                         534

Identities = 64/341 (18%), Positives = 140/341 (40%), Gaps = 35/341 (10%)
Query:  59 DEVASQKFETKSSDFANLDTASLDDFIKKQREELS-AMLAAEELSKKLDNSVSQEQDTEA   117
           D+   S K ++ SSD   + D+++        D                + S +   +++  S    D+S  S   +  D+
Sbjct:  76 DKSDSGKGKSDSDSDSDSDSSNSSDSSDSSDSDSSDSNSSDSSDSSDSSDSSDSDSSD   135

Query: 118 NAVSPKEESSQEQENSVTPVPPLNTEAEPTATEPDSTIADSEEYKSSSKKRGGIVGTLIA   177
           ++ S       S + +S             +++++ + +E DS+ +DS+         S S
Sbjct: 136 SSNSSDSSDSSDSSDSSDSSDSSDSSDSKSDSSKSESDSSDSDSKSDSDSN-----------  184

Query: 178 LILLLIVAIFGYNYFKNNNSTNSQTATSQSSSSKATTTSSEEDKKASQNLDNFNKSYANF   237
                            +++S NS ++  S +SS+ +  ++  S +     +S + D+ N S ++
Sbjct: 185 ---------------SSDSSSDNSDSSDSSNSSNSSDSSDSSDSSDSSDSSSSDSSNSSDSS-  228

Query: 238 FVDDKKTQLKNSEFDKLSELEKKVDALKGTKYYGKVKVKFDSLKRQIDAVKAVNDKFKSP   297
                  D      +SE    S+       D+       +               DS         D+     +  N       S
Sbjct: 229 ---DSSDSSNSSESSDSSD-SSDSSDSSDSSNSNSSDSDS-SNSSDSSDSSNSSDSSD    283

Query: 298 AVVDGKKSEKLEVKDGANFDSLDSKTLNTGNASLDSLLHSIVSTGRNQVKQSEEQASSNK   357
           +         S+   +   D  +N   S DS     +  + S DS     S    +     N      S+        SS+
Sbjct: 284 SSDSSNSDSSDSSDSSN--SSDSSDSSDSSDSSDSSNSSDSNDSSNSSDSSDSSDSSDS   341

Query: 358 VSDTQITEQPNVTNGQSSSSAATINNQAAGTASGNLERNRS                      398
           +  +   ++  ++  ++    SS+S+ +  N+    +    + + +  + S
Sbjct: 342 SNSSDSSDSSDSSDSSNSSDSSNSSDSSDSCNSSDSSDS                        382
```

A related DNA sequence was identified in *S. pyogenes* <SEQ ID 2971> which encodes the amino acid sequence <SEQ ID 2972>. Analysis of this protein sequence reveals the following:

```
Possible site: 28
>>> Seems to have no N-terminal signal sequence
INTEGRAL    Likelihood = -14.70   Transmembrane 180-196 (175-202)
----- Final Results -----
    bacterial membrane --- Certainty = 0.6880 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the databases:

```
>GP: AAF15293 GB: AF202180 erythrocyte membrane-associated giant
protein antigen 332 [Plasmodium falciparum]

Identities = 41/173 (23%), Positives = 87/173 (49%), Gaps = 10/173 (5%)
Query:    1 VSEESKEVEVTKESQTLGLNEAKSMTIGEAVRKQSE----IKAGVTKDDSILDKYIKQHR   56
            + E  + V + KE +   GL+  + +     ++V +Q+E      I    + K+ S ++        ++
Sbjct:   78 IEEAEENVWIEKEVEEEGLDNEEVIDEEDSVSEQAEEEVYINEEILKESSDVEDVKVENE  137

Query:   57 ---DEVSSQKFDAKYTELDTASLDNFIKKQREALSKAGLVDDEPVSAESAEQDSTLVEEV  113
               +EV+ +            +    LDN++ ++ E++++   +VD+  P  S  E   +S  ++EE+
Sbjct:  138 LMNEEVNEETQSVAENNEEDKELDNYVVEETESVTEEVVVDEVPNSKEVQEIES-IIEEI  196

Query:  114 AEDLAPMETTAVVTGIPVEATVPVLDLDPSERVIPEPQMTKEEPKRDQFLSED         166
            ED    +       G  +E   V   +    D SE ++ E  +T+E   K++    ++ED
Sbjct:  197 VEDGLTTDDLVGQQGSVIEEVVEEVGSD-SEGIVEEASITEEVEKKES-VTED         247
```

SEQ ID 2970 (GBS351) was expressed in *E. coli* as a His-fusion product. SDS-PAGE analysis of total cell extract is shown in FIG. 73 (lane 2; MW 57 kDa). It was also expressed in *E. coli* as a GST-fusion product. SDS-PAGE analysis of total cell extract is shown in FIG. 81 (lane 5; MW 82 kDa).

GBS351-GST was purified as shown in FIG. 216, lane 4.

Based on this analysis, it was predicted that these proteins and their epitopes could be useful antigens for vaccines or diagnostics.

Example 972

A DNA sequence (GBSx1031) was identified in *S. agalactiae* <SEQ ID 2973> which encodes the amino acid sequence <SEQ ID 2974>. Analysis of this protein sequence reveals the following:

An alignment of the GAS and GBS proteins is shown below.

```
Identities = 234/506 (46%), Positives = 304/506 (59%), Gaps = 36/506 (7%)
Query:    1 MSEDQKHPFFEPKKETDGLEFKDAKEMTVEEAVRKDSEIKAGITEEDSILDKYIKQHRDE   60
            +SE+ K    E  KE+  L    +AK MT+  EAVRK SEIKAG+T++DSILDKYIKQHRDE
Sbjct:    1 VSEESKE--VEVTKESQTLGLNEAKSMTIGEAVRKQSEIKAGVTKDDSILDKYIKQHRDE   58

Query:   61 VASQKFETKSSDFANLDTASLDDFIKKQREELSAMLAAEELSKKLDNSVSQEQDTEANAV  120
            V+SQKF+  K   +    LDTASLD+FIKKQRE LS    A   +   ++ S  EQD+
Sbjct:   59 VSSQKFDAK---YTELDTASLDNFIKKQREALSK---AGLVDDEPVSAESAEQDSTLVEE  112

Query:  121 SPKEESSQEQENSVTPVPPLNT--------------EAEPTATEP--DSTIADSEEYKSS  164
            ++ +  E      VT +P   T                  E + T  EP  D  +++   + +
Sbjct:  113 VAEDLAPMETTAVVTGIPVEATVPVLDLDPSERVIPEPQMTKEEPKRDQFLSEDSHHPAK  172

Query:  165 SKKRGGIVGTLIALILLLIVAIFGYNYFKNNNSTNSQTATSQSSSSKATTTSSEEDKKAS  224
                + G + L  L+L ++  +FG+N+F      +S +      S+ + +    T S+++  +
Sbjct:  173 QNTKKGWLIALFLLLLAILAVVFGWNHFLRQDSGKTTQTASKQTKTSLQTDSAKKATRLK  232

Query:  225 QNLDNFNKSYANFFVDDKKTQLKNSEFDKLSELEKKVDALKGTKYYGKVKVKFDSLKRQI  284
                  F K Y F+ D  K++LKNS   F   L  +LE    + AL+G+   YY K K K DSLK+ I
Sbjct:  233 AAAKAFEKLYGTFYTDATKSKLKNSAFATLPDLEAALKALEGSAYYDKAKAKVDSLKKAI  292

Query:  285 DAVRAVNDKFKSPAVVDGKKSEKLEVKDGANFDSLDSKTLNTGNASLDSLLHSIVSTGRN  344
             A+  AVN KF S   VVDG+K     EVK  ANFD L S TL   GNA+LD++ L  +  ++ GR
Sbjct:  293 AAITAVNGKFVSDVVVDGEKVSA-EVKADANFDDLSSATLTIGNANLDAVLQASITEGRQ  351

Query:  345 QVKQSEEQASSNKVSDTQITEQPNVTNGQSSSSAATINNQAAGTAS---GNLERNRSRVP  401
            Q+       E A     K ++ Q  Q         GQS+S A +           G  S     +L+R+ SRVP
Sbjct:  352 QLASKAEAA---KAANEQAV-QDQAAQGQSTSVAPS----GYGLTSYDPASLQRHLSRVP  403

Query:  402 YNNAAIADTGNPAWIFNPGVLEKIVATSQARGYFSGNNYILEPVNIINGNGYYNMFKLDG  461
            YN   IAD  NP+W FNPGVLEKIVATSQARGY SGN  YILEPVNIINGNGYYNMFK DG
Sbjct:  404 YNQDVIADRANPSWAFNPGVLEKIVATSQARGYISGNQYILEPVNIINGNGYYNMFKPDG  463

Query:  462 TYLFSINAKTGYFVGNAPGRADSLDY                                    487
            TYLFSIN KTGYFVGN  G AD+LDY
Sbjct:  464 TYLFSINCKTGYFVGNGKGYADALDY                                    489
```

Possible site: 19
>>> Seems to have no N-terminal signal sequence
----- Final Results -----
   bacterial cytoplasm --- Certainty = 0.3169 (Affirmative) <succ>
    bacterial membrane --- Certainty = 0.0000 (Not Clear) <succ>
      bacterial outside --- Certainty = 0.0000 (Not Clear) <succ>

A related DNA sequence was identified in *S. pyogenes* <SEQ ID 2975> which encodes the amino acid sequence <SEQ ID 2976>. Analysis of this protein sequence reveals the following:

Possible site: 19
>>> Seems to have no N-terminal signal sequence
----- Final Results -----
   bacterial cytoplasm --- Certainty = 0.3169 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 129/160 (80%), Positives = 149/160 (92%)
Query:     1 MTKEVVVESFELDHTIVKAPYVRLISEEVGPVGDIITNFDIRLIQPNENAIDTAGLHTIE    60
             MTKEV+VESFELDHTIVKAPYVRLISEE GP GD ITNFD+RL+QPN+N+I+TAGLHTIE
Sbjct:     1 MTKEVIVESFELDHTIVKAPYVRLISEEFGPKGDRITNFDVRLVQPNQNSIETAGLHTIE    60

Query:    61 HLLAKLIRQRINGLIDCSPFGCRTGFHMIMWGKQDATEIAKVIKSSLEAIAGGVTWEDVP   120
             HLLAKLIRQRI+G+IDCSPFGCRTGFH+IMWGK  +T+IAKVIKSSLE IA G+TWEDVP
Sbjct:    61 HLLAKLIRQRIDGMIDCSPFGCRTGFHLIMWGKHSSTDIAKVIKSSLEEIATGITWEDVP   120

Query:   121 GTTIESCGNYKDHSLHSAQEWAKLILSQGISDNAFERHIV                      160
             GTT+ESCGNYKDHSL +A+EWA+LI+ QGISD+ F RH++
Sbjct:   121 GTTLESCGNYKDHSLFAAKEWAQLIIDQGISDDPFSRHVI                      160
```

Based on this analysis, it was predicted that these proteins and their epitopes could be useful antigens for vaccines or diagnostics.

Example 973

A DNA sequence (GBSx1032) was identified in *S. agalactiae* <SEQ ID 2977> which encodes the amino acid sequence <SEQ ID 2978>. Analysis of this protein sequence reveals the following:

Possible site: 32
>>> Seems to have a cleavable N-term signal seq.
----- Final Results -----
      bacterial outside --- Certainty = 0.3000 (Affirmative) <succ>
    bacterial membrane --- Certainty = 0.0000 (Not Clear) <succ>
   bacterial cytoplasm --- Certainty = 0.0000 (Not Clear) <succ>

The protein has homology with the following sequences in the GENPEPT database.

```
>GP: AAF34762 GB: AF228345 unknown [Listeria monocytogenes]
Identities = 302/532 (56%), Positives = 400/532 (74%), Gaps = 14/532 (2%)
Query:     4 IILAMVCALIGLIIGYVAISMKMKSSKEAAELTLLNAEQDAVDLRGKAEIEAEHIRKAAE    63
             I + ++ +L+ LI+G V  S+ KSS          E+    RG AE+  E  +K AE
Sbjct:     3 IAITIISSLLFLIVGLVVGSLIFKSS----------TEKKLAAARGTAELIVEDAKKEAE    52

Query:    64 RESKAHQKELLLEAKEEARKYREEIEKEFKSDRQELKQMEARLTDRASSLDRKDENLSNK   123
               +KE LLEAKEE + R EIE E +  R E ++ E RL  R   +LDRKD +LS +
Sbjct:    53 TT----KKEALLEAKEENHRLRTEIENELRGRRTETQKAENRLLQREENLDRKDTSLSKR   108

Query:   124 EKMLDSKEQSLTDKSRHINEREQEIATLETKKVEELSRIAELSQEEAKDIILADTEKDLA   183
             E   L+ KE+S++ + +  I  E+E ++A +     EL RI+ LS+EEAK IIL   E++L
Sbjct:   109 EATLERKEESISKRQQQIEEKESKLAEMIQAEQTELERISALSKEEAKSIILNQVEEELT   168

Query:   184 HDIATRIKEAEREVKDRSNKIAKDLLAQAMQRLAGEYVTEQTITTVHLPDDNMKGRIIGR   243
             HD A  +KE+E    K+ S+K AK++L+ A+QR A ++V E T++  V LP+D MKGRIIGR
Sbjct:   169 HDTAIMVKESENRAKEESDKKAKNILSLAIQRCAADHVAETTVSVVTLPNDEMKGRIIGR   228

Query:   244 EGRNIRTLESLTGIDVIIDDTPEVVVLSGFDPIRREIARMTLESLIQDGRIHPARIEELV   303
             EGRNIRTLE+LTGID+IIDDTPE V+LSGFDPIRREIAR+ LE L+QDGRIHPARIEE+V
Sbjct:   229 EGRNIRTLETLTGIDLIIDDTPEAVILSGFDPIRREIARIALEKLVQDGRIHPARIEEMV   288

Query:   304 EKNRLEMDQRIREYGEAAAYEIGAPNLHPDLIKIMGRLQFRTSYGQNVLRHSVEVGKLAG   363
             +K R E+D+  IRE GE A  +E+G   ++HPDLIKI+GRL++RTSYGQNVL  HS+EV KLAG
Sbjct:   289 DKARKEVDEHIREVGEQATFEVGIHSIHPDLIKILGRLRYRTSYGQNVLNHSLEVSKLAG   348
```

```
Query:  364 ILAGELGENVDLARRAGFLHDMGKAIDREVEGSHVEIGMEFARKYKEHPIVVNTIASHHG  423
            ILAGELGE+V LA+RAG LHD+GKAID E+EGSHVEIG+E A KYKE+ +V+N+IASHHG
Sbjct:  349 ILAGELGEDVTLAKRAGLLHDIGKAIDHEIEGSHVEIGVELATKYKENDVVINSIASHHG  408

Query:  424 DVEPDSVIAVIVAAADALSSARPGARNESMENYIKRLRDLEEIANGFEGVQNAFALQAGR  483
            D E  SVIAV+VAAADALS+ARPGAR+E++ENYI+RL  LEEI+  ++GV+ ++A+QAGR
Sbjct:  409 DTEATSVIAVLVAAADALSAARPGARSETLENYIRRLEKLEEISESYDGVEKSYAIQAGR  468

Query:  484 EIRIMVQPGKVSDDQVVIMSHKVREKIEQNLDYPGNIKVTVIREMRAVDFAK          535
            E+RI+V+P  + D        ++  +R++IE+ LDYPG+IKVTVIRE RAV++AK
Sbjct:  469 EVRIIVEPDTIDDLSSYRLARDIRKRIEEELDYPGHIKVTVIRETRAVEYAK          520
```

A related DNA sequence was identified in *S. pyogenes* <SEQ ID 2979> which encodes the amino acid sequence <SEQ ID 2980>. Analysis of this protein sequence reveals the following:

Possible site: 32
>>> Seems to have a cleavable N-term signal seq.

-continued

----- Final Results -----
bacterial outside --- Certainty = 0.3000 (Affirmative) <succ>
bacterial membrane --- Certainty = 0.0000 (Not Clear) <succ>
bacterial cytoplasm --- Certainty = 0.0000 (Not Clear) <succ>

The protein has homology with the following sequences in the databases:

```
>GP: AAF34762 GB: AF228345 unknown [Listeria monocytogenes]
Identities = 299/534 (55%), Positives = 408/534 (75%), Gaps = 14/534 (2%)
Query:    2 VNIILLIVSALIGLILGYALISIRLKSAKEAAELTLLNAEQEAVDIRGKAEVDAEHIKKT   61
            + I + I+S+L+ LI+G  + S+  KS+           E++    RG AE+   I +
Sbjct:    1 MTIAITIISSLLFLIVGLVVGSLIFKSS----------TEKKLAAARGTAEL----IVED   46

Query:   62 AKRESKANRKELLLEAKEEARKYREEIEQEFKSERQELKQLETRLAERSLTLDRKDENLS  121
            AK+E++   +KE LLEAKEE  + R EIE E +  R E ++ E RL +R     LDRKD +LS
Sbjct:   47 AKKEAETTKKEALLEAKEENHRLRTEIENELRGRRTETQKAENRLLQREENLDRKDTSLS  106

Query:  122 SKEKVLDSKEQSLTDKSKHIDERQLQVEKLEEEKKAELEKVAAMTIAEAREVILMETENK  181
            +E  L+ KE+S++  + + I+E++ ++ ++ ++ + ELE+++A++   EA+ +IL + E +
Sbjct:  107 KREATLERKEESISKRQQQIEEKESKLAEMIQAEQTELERISALSKEEAKSIILNQVEEE  166

Query:  182 LTHEIATRIRDAERDIKDRTVKTAKDLLAQAMQRLAGEYVTEQTITSVHLPDDNMKGRII  241
            LTH+ A  ++++E    K+ + K AK++L+ A+QR A ++V E T++ V LP+D MKGRII
Sbjct:  167 LTHDTAIMVKESENRAKEESDKKAKNILSLAIQRCAADHVAETTVSVVTLPNDEMKGRII  226

Query:  242 GREGRNIRTLESLTGIDVIIDDTPEVVILSGFDPIRREIARMTLESLIADGRIHPARIEE  301
            GREGRNIRTLE+LTGID+IIDDTPE VILSGFDPIRREIAR+ LE L+ DGRIHPARIEE
Sbjct:  227 GREGRNIRTLETLTGIDLIIDDTPEAVILSGFDPIRREIARIALEKLVQDGRIHPARIEE  286

Query:  302 LVEKNRLEMDNRIREYGEAAAYEIGAPNLHPDLIKIMGRLQFRTSFGQNVLRHSVEVGKL  361
            +V+K R E+D  IRE GE A +E+G  ++HPDLIKI+GRL++RTS+GQNVL HS+EV KL
Sbjct:  287 MVDKARKEVDEHIREVGEQATFEVGIHSIHPDLIKILGRLRYRTSYGQNVLNHSLEVSKL  346

Query:  362 AGILAGELGENVALARRAGFLHDMGKAIDREVEGSHVEIGMEFARKYKEHPVVVNTIASH  421
            AGILAGELGE+V LA+RAG LHD+GKAID E+EGSHVEIG+E A KYKE+ VV+N+IASH
Sbjct:  347 AGILAGELGEDVTLAKRAGLLHDIGKAIDHEIEGSHVEIGVELATKYKENDVVINSIASH  406

Query:  422 HGDVEPDSVIAVLVAAADALSSARPGARNESMENYIKRLRDLEEIATSFDGVQNSFALQA  481
            HGD E  SVIAVLVAAADALS+ARPGAR+E++ENYI+RL  LEEI+ S+DGV+ S+A+QA
Sbjct:  407 HGDTEATSVIAVLVAAADALSAARPGARSETLENYIRRLEKLEEISESYDGVEKSYAIQA  466

Query:  482 GREIRIMVQPEKISDDQVVILSHKVREKIENNLDYPGNIKVTVIREMRAVDYAK         535
            GRE+RI+V+P+  I D        L+  +R++IE  LDYPG+IKVTVIRE RAV+YAK
Sbjct:  467 GREVRIIVEPDTIDDLSSYRLARDIRKRIEEELDYPGHIKVTVIRETRAVEYAK         520
```

An alignment of the GAS and GBS proteins is shown below.

```
Identities = 451/535 (84%), Positives = 503/535 (93%)
Query:    1 MFNIILAMVCALIGLIIGYVAISMKMKSSKEAAELTLLNAEQDAVDLRGKAEIEAEHIRK   60
            M NIIL +V ALIGLI+GY  IS+++KS+KEAAELTLLNAEQ+AVD+RGKAE++AEHI+K
Sbjct:    1 MVNIILLIVSALIGLILGYALISIRLKSAKEAAELTLLNAEQEAVDIRGKAEVDAEHIKK   60

Query:   61 AAERESKAHQKELLLEAKEEARKYREEIEKEEKSDRQELKQMEARLTDRASSLDRKDENL  120
            A+RESKA++KELLLEAKEEARKYREEIE+EFKS+RQELKQ+E RL +R+  +LDRKDENL
Sbjct:   61 TAKRESKANRKELLLEAKEEARKYREEIEQEFKSERQELKQLETRLAERSLTLDRKDENL  120
```

```
Query:  121  SNKEKMLDSKEQSLTDKSRHINEREQEIATLETKKVEELSRIAELSQEEAKDIILADTEK  180
             S+KEK+LDSKEQSLTDKS+HI+ER+ ++  LE +K  EL ++A ++  EA+++IL +TE
Sbjct:  121  SSKEKVLDSKEQSLTDKSKHIDERQLQVEKLEEEKKAELEKVAAMTIAEAREVILMETEN  180

Query:  181  DLAHDIATRIKEAEREVKDRSNKIAKDLLAQAMQRLAGEYVTEQTITTVHLPDDNMKGRI  240
              L H+IATRI++AER++KDR+ K AKDLLAQAMQRLAGEYVTEQTIT+VHLPDDNMKGRI
Sbjct:  181  KLTHEIATRIRDAERDIKDRTVRTAKDLLAQAMQRLAGEYVTEQTITSVHLPDDNMKGRI  240

Query:  241  IGREGRNIRTLESLTGIDVIIDDTPEVVVLSGFDPIRREIARMTLESLIQDGRIHPARIE  300
             IGREGRNIRTLESLTGIDVIIDDTPEVV+LSGFDPIRREIARMTLESLI DGRIHPARIE
Sbjct:  241  IGREGRNIRTLESLTGIDVIIDDTPEVVILSGFDPIRREIARMTLESLIADGRIHPARIE  300

Query:  301  ELVEKNRLEMDQRIREYGEAAAYEIGAPNLHPDLIKIMGRLQFRTSYGQNVLRHSVEVGK  360
             ELVEKNRLEMD RIREYGEAAAYEIGAPNLHPDLIKIMGRLQFRTS+GQNVLRHSVEVGK
Sbjct:  301  ELVEKNRLEMDNRIREYGEAAAYEIGAPNLHPDLIKIMGRLQFRTSFGQNVLRHSVEVGK  360

Query:  361  LAGILAGELGENVDLARRAGFLHDMGKAIDREVEGSHVEIGMEFARKYKEHPIVVNTIAS  420
             LAGILAGELGENV LARRAGFLHDMGKAIDREVEGSHVEIGMEFARKYKEHP+VVNTIAS
Sbjct:  361  LAGILAGELGENVALARRAGFLHDMGKAIDREVEGSHVEIGMEFARKYKEHPVVVNTIAS  420

Query:  421  HHGDVEPDSVIAVIVAAADALSSARPGARNESMENYIKRLRDLEEIANGFEGVQNAFALQ  480
             HHGDVEPDSVIAV+VAAADALSSARPGARNESMENYIKRLRDLEEIA  F+GVQN+FALQ
Sbjct:  421  HHGDVEPDSVIAVLVAAADALSSARPGARNESMENYIKRLRDLEEIATSFDGVQNSFALQ  480

Query:  481  AGREIRIMVQPGKVSDDQVVIMSHKVREKIEQNLDYPGNIKVTVIREMRAVDFAK  535
             AGREIRIMVQP K+SDDQVVI+SHKVREKIE NLDYPGNIKVTVIREMRAVD+AK
Sbjct:  481  AGREIRIMVQPEKISDDQVVILSHKVREKIENNLDYPGNIKVTVIREMRAVDYAK  535
```

SEQ ID 2978 (GBS86) was expressed in *E. coli* as a His-fusion product. SDS-PAGE analysis of total cell extract is shown in FIG. 7 (lane 6; MW 59 kDa). It was also expressed in *E. coli* as a GST-fusion product. SDS-PAGE analysis of total cell extract is shown in FIG. 13 (lane 5; MW 84 kDa).

GBS86-GST was purified as shown in FIG. 192, lane 3.

Based on this analysis, it was predicted that these proteins and their epitopes could be useful antigens for vaccines or diagnostics.

Example 974

A DNA sequence (GBSx1033) was identified in *S. agalactiae* <SEQ ID 2981> which encodes the amino acid sequence <SEQ ID 2982>. Analysis of this protein sequence reveals the following:

Possible site: 28
>>> Seems to have no N-terminal signal sequence
----- Final Results -----
  bacterial cytoplasm --- Certainty = 0.4984 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 975

A DNA sequence (GBSx1034) was identified in *S. agalactiae* <SEQ ID 2983> which encodes the amino acid sequence <SEQ ID 2984>. Analysis of this protein sequence reveals the following:

Possible site: 37
>>> Seems to have no N-terminal signal sequence
INTEGRAL   Likelihood = −2.87   Transmembrane 146-162 (146-162)
----- Final Results -----
  bacterial membrane --- Certainty = 0.2147 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 8697> which encodes amino acid sequence <SEQ ID 8698> was also identified. Analysis of this protein sequence reveals the following:

Lipop: Possible site: −1    Crend: 9
McG: Discrim Score: −10.72
GvH: Signal Score (−7.5): −5.66
Possible site: 29
>>> Seems to have no N-terminal signal sequence
ALOM program  count: 1            value: −2.87    threshold: 0.0
INTEGRAL    Likelihood = −2.87    Transmembrane 138-154 (138-154)
PERIPHERAL  Likelihood = 3.76     51
modified ALOM score: 1.07
*** Reasoning Step: 3
----- Final Results -----
  bacterial membrane --- Certainty = 0.2147 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the GENPEPT database.

```
>GP: AAG21390 GB: AF302051 ABC transporter ATP binding subunit
[Bacillus licheniformis]
Identities = 84/218 (38%), Positives = 138/218 (62%), Gaps = 1/218 (0%)
Query:    12 DIIKVDHIFKSIGQKTILEDISFSIASNQCVALIGPNGAGKTTLMSTLLGDISISSGSLT    71
             +++ + ++ K+  QKT ++ I FSI   + VA++GPNGAGKTT +S +LG +  ++G++T
Sbjct:     3 NVVSLTNVTKTFRQKTAVDQIDFSIKKGEIVAILGPNGAGKTTTISMILGLLKPTAGNIT    62

Query:    72 IFNLPAHHNRLKYKVAILPQE-NVLPSKFTVRELIDFQRCLFPEVLPMSLILDYLQWSDT   130
             +F+   H  R++ K+  + QE +V+P       E+I+  R  +P+ L    +       +D
Sbjct:    63 LFDSMPHEKRVREKIGTMLQEVSVMPGLRCRVEIIELIRSYYPKPLSFQKLRTLTGLTDK   122

Query:   131 HLQQFTETLSGGQKRLLAFVLTLVGKPQLLFLDEPTSGMDTSTRQRFWELIATLKKEGVT   190
                L+    E LSGGQKR L F L L G P+L+   DEPT GMD ++R RFW+ + +L ++G T
Sbjct:   123 DLKTQAEKLSGGQKRRLGFALALAGDPELMIFDEPTVGMDITSRNRFWQTVQSLAEQGKT   182

Query:   191 IVYSSHYIEEVEHTADRILVLHKGKLLRDTTPLCHEAR                        228
             I++S+HY++E +  A RIL+   GK++ D TPL   ++R
Sbjct:   183 IIFSTHYLQEADDAAQRILLFKDGKIVADGTPLQIKSR                        220
```

There is also homology to SEQ ID 686.

SEQ ID 8698 (GBS350) was expressed in *E. coli* as a His-fusion product. SDS-PAGE analysis of total cell extract is shown in FIG. 72 (lane 13; MW 28.9 kDa). It was also expressed in *E. coli* as a GST-fusion product. SDS-PAGE analysis of total cell extract is shown in FIG. 81 (lane 4; MW 54 kDa).

GBS350-GST was purified as shown in FIG. 226, lane 7.

Based on this analysis, it was predicted that these proteins and their epitopes could be useful for vaccines or diagnostics.

Example 976

A DNA sequence (GBSx1035) was identified in *S. agalactiae* <SEQ ID 2985> which encodes the amino acid sequence <SEQ ID 2986>. Analysis of this protein sequence reveals the following:

```
Possible site: 35
>>> Seems to have no N-terminal signal sequence
----- Final Results -----
  bacterial cytoplasm --- Certainty = 0.2913 (Affirmative) <succ>
  bacterial membrane --- Certainty = 0.0000 (Not Clear) <succ>
  bacterial outside  --- Certainty = 0.0000 (Not Clear) <succ>
```

Based on this analysis, it was predicted that this protein and its epitopes, could be useful antigens for vaccines or diagnostics.

Example 977

A DNA sequence (GBSx1036) was identified in *S. agalactiae* <SEQ ID 2987> which encodes the amino acid sequence <SEQ ID 2988>. Analysis of this protein sequence reveals the following:

```
Possible site: 31
>>> Seems to have an uncleavable N-term signal seq
INTEGRAL    Likelihood = -10.51   Transmembrane 222-238 (214-241)
INTEGRAL    Likelihood =  -6.90   Transmembrane 104-120 (101-125)
INTEGRAL    Likelihood =  -5.84   Transmembrane 140-156 (138-159)
INTEGRAL    Likelihood =  -5.20   Transmembrane 19-35 (18-41)
INTEGRAL    Likelihood =  -1.28   Transmembrane 164-180 (164-180)
----- Final Results -----
  bacterial membrane --- Certainty = 0.5203 (Affirmative) <succ>
  bacterial outside  --- Certainty = 0.0000 (Not Clear)   <succ>
  bacterial cytoplasm --- Certainty = 0.0000 (Not Clear)  <succ>
```

The protein has homology with the following sequences in the GENPEPT database.

```
>GP: CAB69806 GB: AJ243712 YVFS protein [Bacillus cereus]
Identities = 73/239 (30%), Positives = 127/239 (52%), Gaps = 4/239 (1%)
Query:     9 KMEFLLTKRQLANLIMAIGMPVAFFLFFSGFMGEGLTKAIEAIYVRNYMITMAGFSSLSF    68
             K+E L T R     + ++ MPV F+ F+ +     +       + +Y+I+MA FS +
Sbjct:     4 KIEILRTFRNKLFIFFSLLMPVMFYYIFTNVVQ---VPQNGDAWKAHYLISMATFSIVGT    60

Query:    69 AFFTFPFSMKDDQLSNRMQLLRHSPVPMWQYYLAKIIRILFYYCLAITVVFLTGHILRQV   128
             A F+F   + ++        LL+ +P+P   Y  AKII       +I V+F+ G ++   V
Sbjct:    61 ALFSFGVRLSQERGQGWTHLLKITPLPEGAYLTAKIIAQTVVNAFSILVIFIAGILINHV   120

Query:   129 SMPIEQWMQSFLLLLGGATCFIPFGLLVSYFKNTELMSMVANICYMSLAVLGGMWMPITM   188
             + I  QW+ + L LL G T F+  G ++       K  + +ANI   MSLA++GG+WMPI +
Sbjct:   121 ELTIGQWIGAGLWLLLGVTPFLALGTVIGSIKKADAAAGLANILNMSLAIVGGLWMPIEV   180

Query:   189 FPKWLQALSKLTPTYHLTQVILSPFANSFAGF-SLIILIGYGIIMLVIAYLLSQKRHSI   246
             FPK L+ + +  TPTYH          A     G+ ++ +L GY +I +V++ + +++ ++
Sbjct:   181 FPKILRTIGEWTPTYHFGSGAWDIVAGKSIGWENIAVLGGYFLIFVVVSIYIRKRQEAV   239
```

The protein has no significant homology with any sequences in the GENPEPT database.

No corresponding DNA sequence was identified in *S. pyogenes*.

There is also homology to SEQ ID 682 and to SEQ ID 1628.

Based on this analysis, it was predicted that this protein and its epitopes, could be useful antigens for vaccines or diagnostics.

Example 978

A DNA sequence (GBSx1037) was identified in *S. agalactiae* <SEQ ID 2989> which encodes the amino acid sequence <SEQ ID 2990>. This protein is predicted to be histidine kinase. Analysis of this protein sequence reveals the following:

```
Possible site: 49
>>> Seems to have a cleavable N-term signal seq.
INTEGRAL    Likelihood = −7.43    Transmembrane 105-121 (102-124)
INTEGRAL    Likelihood = −6.95    Transmembrane 130-146 (129-149)
----- Final Results -----
    bacterial membrane --- Certainty = 0.3972 (Affirmative) <succ>
    bacterial outside --- Certainty = 0.0000 (Not Clear) <succ>
      bacterial cytoplasm --- Certainty = 0.0000 (Not Clear) <succ>
```

A related GBS nucleic acid sequence <SEQ ID 9537> which encodes amino acid sequence <SEQ ID 9538> was also identified.

The protein has homology with the following sequences in the GENPEPT database.

```
>GP: CAB54584 GB: AJ006400 histidine kinase [Streptococcus pneumoniae]
Identities = 138/350 (39%), Positives = 212/350 (60%), Gaps = 3/350 (0%)

Query:   11  MYFIPLVFLIYPIGGILYYHYPFWTLFFTLAFVGAYLYSVIIRGESKYHMIAWSTMLTYI     70
             M++I L+F+I+PI  ++        W L   + FV AYL V+    +   + W  MLTY+
Sbjct:   11  MFWISLIFMIFPILSVVTGWLSAWHLLIDILFVVAYL-GVLTTKSQRLSWLYWGLMLTYV    69

Query:   71  FYMTIFINSGFIWYIYFLSNLLVYRFRDK-LKSFRFISFACTLATVVF-LCFFKASDFGD   128
                 T F+    +IW+ +FLSNLL Y F   + LKS    +F      VV  L F+  +
Sbjct:   70  VGNTAFVAVNYIWFFFFLSNLLSYHFSVRSLKSLHVWTFLLAQVLVVGQLLIFQRIEVEF   129

Query:  129  RIMFLIVPIFCIGYMWIAIENRNSEEQREKIAEQNQYINILSAENERNRIGRDLHDSLGH   188
                  L++  F     +  +  R  E+ +E    +QN    IN+L AENER+RIG+DLHDSLGH
Sbjct:  130  LFYLLVILTFVDLMTFGLVRIRIVEDLKEAQVKQNAQINLLLAENERSRIGQDLHDSLGH   189

Query:  189  TFAMMTLKTELALKLLEKRNYDKVQKELSELNHISHQSMSEVRQIVSNLKYRTVVEEIDE   248
             TFAM+++KT+LAL+L +     Y +V+KEL E++  IS   SM+EVR  IV NLK RT+    E++
Sbjct:  190  TFAMLSVKTDLALQLFQMEAYPQVEKELKEIHQISKDSMNEVRTIVENLKSRTLTSELET   249

Query:  249  LYRLFQLSNIKLTVVNKLETSQLSPVTQSTITMILKELSNNIVKHAEADSVELSLVRQGA   308
             +  ++ +++  I++  V N  L+  S  L+       +ST +MIL  EL     NI+  KHA+A    V L L R
Sbjct:  250  VKKMLEIAGIEVQVENHLDKSSLTQELESTASMILLELVTNIIKHAKASKVYLKLERTEK   309

Query:  309  TINIEMIDNGCGFTNLDGDELHSIQERLTIVEGTLTILSRSKPTHIQVVL            358
              +  +  +  D+GCGF ++  GDELH+++  R+        G  ++++S+    PT  +QV L
Sbjct:  310  ELILTVRDDGCGFASISGDELHTVRNRVFPFSGEVSVISQKHPTEVQVRL            359
```

There is also homology to SEQ ID 2992.

A related GBS gene <SEQ ID 8699> and protein <SEQ ID 8700> were also identified. Analysis of this protein sequence reveals the following:

```
Lipop: Possible site: −1    Crend: 8
McG: Discrim Score: 10.90
GvH: Signal Score (−7.5): −2.42
Possible site: 49
>>> Seems to have a cleavable N-term signal seq.
ALOM program count: 2  value: −7.43  threshold: 0.0
INTEGRAL     Likelihood = −7.43   Transmembrane 105-121 (102-124)
INTEGRAL     Likelihood = −6.95   Transmembrane 130-146 (129-149)
PERIPHERAL   Likelihood = 0.16    61
modified ALOM score: 1.99
```

```
*** Reasoning Step: 3
----- Final Results -----
    bacterial membrane --- Certainty = 0.3972 (Affirmative) <succ>
    bacterial outside --- Certainty = 0.0000 (Not Clear) <succ>
      bacterial cytoplasm --- Certainty = 0.0000 (Not Clear) <succ>
```

Based on this analysis, it was predicted that these proteins and their epitopes could be useful antigens for vaccines or diagnostics.

Example 979

A DNA sequence (GBSx1038) was identified in *S. agalactiae* <SEQ ID 2993> which encodes the amino acid sequence <SEQ ID 2994>. This protein is predicted to be response regulator. Analysis of this protein sequence reveals the following:

```
Possible site: 28
>>> Seems to have no N-terminal signal sequence
INTEGRAL    Likelihood = −0.16   Transmembrane 49-65 (49-65)
----- Final Results -----
    bacterial membrane --- Certainty = 0.1065 (Affirmative) <succ>
    bacterial outside --- Certainty = 0.0000 (Not Clear) <succ>
      bacterial cytoplasm --- Certainty = 0.0000 (Not Clear) <succ>
```

The protein has homology with the following sequences in the GENPEPT database.

```
>GP: CAB54585 GB: AJ006400 response regulator [Streptococcus pneumoniae]
Identities = 95/153 (62%), Positives = 125/153 (81%), Gaps = 3/153 (1%)
Query:    1 MKLLVAEDQSMLRDAMCQLLLMEESVSTIDQAGNGGEAIAILSNKAIDVAILDVEMPILS    60
            MK+LVAEDQSMLRDAMCQLL+++  V ++ QA NG EAI +L  +++D+AILDVEMP+ +
Sbjct:    1 MKVLVAEDQSMLRDAMCQLLMLQPDVESVFQAKNGQAIQLLEKESVDIAILDVEMPVKT    60

Query:   61 GLDVLEWVRKYQ-NVKVIIVTTFKRSGYFQRAIRSNVDAYVLKDRSVADLMKTIQKVLSG   119
            GL+VLEW+R  +    KV++VTTFKR GYF+RA+++ VDAYVLK+R++ADLM+T+  VL G
Sbjct:   61 GLEVLEWIRAEKLETKVVVVTTFKRPGYFERAVKAGVDAYVLKERNIADLMQTLHTVLEG   120

Query:  120 GKEYSPELMENVI--SNPLSEQEIKILSLIAQG                             150
             KEYSPELME V+    NPL+EQEI +L  IAQG
Sbjct:  121 RKEYSPELMEVVMMHPNPLTEQEIAVLKGIAQG                             153
```

There is also homology to SEQ ID 2996.

Based on this analysis, it was predicted that this protein and its epitopes, could be useful antigens for vaccines or diagnostics.

Example 980

A DNA sequence (GBSx1039) was identified in *S. agalactiae* <SEQ ID 2997> which encodes the amino acid sequence <SEQ ID 2998>. Analysis of this protein sequence reveals the following:

---

Possible site: 34
>>> Seems to have an uncleavable N-term signal seq
INTEGRAL     Likelihood = −6.69     Transmembrane 158-174 (145-184)
INTEGRAL     Likelihood = −4.94     Transmembrane 11-27 (8-31)
INTEGRAL     Likelihood = −3.93     Transmembrane 74-90 (73-92)
INTEGRAL     Likelihood = −2.39     Transmembrane 103-119 (102-119)
INTEGRAL     Likelihood = −1.86     Transmembrane 42-58 (38-59)
----- Final Results -----
   bacterial membrane --- Certainty = 0.3675 (Affirmative) <succ>
      bacterial outside --- Certainty = 0.0000 (Not Clear) <succ>
         bacterial cytoplasm --- Certainty = 0.0000 (Not Clear) <succ>

---

The protein has homology with the following sequences in the GENPEPT database.

```
>GP: AAB85965 GB: AE000909 unknown [Methanothermobacter
thermoautotrophicus]
Identities = 46/183 (25%), Positives = 81/183 (44%), Gaps = 11/183 (6%)
Query:    5 KERFDTLSDAILAIAMTILVLEI-------KTPATMGDIGDFTRNIGLFIVSFVVVFNFW    57
            K+R + L DAI AIAMTILVL I       PA  I     ++ + +SF+++  FW
Sbjct:    6 KKRLEGLVDAIFAIAMTILVLGIDVPTGTMSVPAMDAYIMGLASDLYSYCLSFLLLGVFW    65

Query:   58 YERAQNSLDAQKTNDEIIALDIIEHLGICLIPLFTKFMISFENHNFAVMAYGLLTLLVGL   117
             +      +K +  I ++I+  + L+P  TK  ++ +      + + L  L +GL
Sbjct:   66 WVNHMHFEKLEKVDTGFIWINIVWLMVVVLVPFSTKLTGNYGDLVTPNILFHLNMLTIGL   125

Query:  118 TSDIIRIRLASYDLVTIPSELKERVIKVMTTFAIRSVVVRFIIIILAYFLPEVGIFAYLV   177
             + I      L+ I        ++K     + + +  +IL   PE    AY V
Sbjct:  126 LLSMSWIYTQRNGLMDIGENEYRLILKKNLLMPLAAI----LALILTPIAPEYSSTAYAV   181

Query:  178 IPL                                                           180
             + L
Sbjct:  182 LIL                                                           184
```

No corresponding DNA sequence was identified in *S. pyogenes*.

Based on this analysis, it was predicted that this protein and its epitopes, could be useful antigens for vaccines or diagnostics.

Example 981

A DNA sequence (GBSx1040) was identified in *S. agalactiae* <SEQ ID 2999> which encodes the amino acid sequence <SEQ ID 3000>. This protein is predicted to be guanylate kinase (gmk). Analysis of this protein sequence reveals the following:

---

Possible site: 16
>>> Seems to have an uncleavable N-term signal seq
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>

---

The protein has homology with the following sequences in the GENPEPT database.

```
>GP: CAB13441 GB: Z99112 similar to guanylate kinase [Bacillus subtilis]
Identities = 121/202 (59%), Positives = 155/202 (75%)
Query:    1 MSERGLLIVFSGPSGVGKGTVRQEIFSTPDHKFDYSVSMTTRPQRPGEVDGVDYFFRTRE    60
            M ERGLLIV SGPSGVGKGTVRQ IFS  D KF+YS+S+TTR  R GEV+GVDYFF+TR+
Sbjct:   41 MKERGLLIVLSGPSGVGKGTVRQAIFSQEDTKFEYSISVTTRSPREGEVNGVDYFFKTRD   100

Query:   61 EFEALIKEGQMLEYAEYVGNYYGTPLSYVNETLDKGIDVFLEIEVQGALQVKSKVPDGVF   120
```

-continued

```
                  EFE +I + ++LE+AEYVGNYYGTP+  YV +TL   G DVFLEIEVQGALQV++   P+G+F
Sbjct:   101  EFEQMIADNKLLEWAEYVGNYYGTPVDYVEQTLQDGKDVFLEIEVQGALQVRNAFPEGLF  160

Query:   121  IFLTPPDLEELEERLVGRGTDSPEVIAQRIERAKEEIALMREYDYAVVNDQVSLAAERVK  180
                IFL PP L EL+ R+V RGT++   +I   R++ AK EI +M  YDY V ND V  A +++K
Sbjct:   161  IFLAPPSLSELKNRIVTRGTETDALIENRMKAAKAEIEMMDAYDYVVENDNVETACDKIK  220

Query:   181  RVIEAEHYRVDRVIGRYTNMVK                                        202
                ++  AEH + +RV  RY  M++
Sbjct:   221  AIVLAEHLKRERVAPRYKKMLE                                        242
```

A related DNA sequence was identified in *S. pyogenes* <SEQ ID 3001> which encodes the amino acid sequence <SEQ ID 3002>. Analysis of this protein sequence reveals the following:

Possible site: 16
\>\>\> Seems to have an uncleavable N-term signal seq
----- Final Results -----
   bacterial membrane --- Certainty = 0.0000 (Not Clear) <succ>
    bacterial outside --- Certainty = 0.0000 (Not Clear) <succ>
     bacterial cytoplasm --- Certainty = 0.0000 (Not Clear) <succ>

The protein has homology with the following sequences in the databases:

```
>GP: CAB13441 GB: Z99112 similar to guanylate kinase [Bacillus subtilis]
Identities = 123/203 (60%), Positives = 157/203 (76%)
Query:     1  MSERGLLIVFSGPSGVGKGTVRQEIFSTPDHKFEYSVSMTTRPQRPGEVDGVDYFFRTRE   60
              M ERGLLIV SGPSGVGKGTVRQ IFS  D KFEYS+S+TTR  R GEV+GVDYFF+TR+
Sbjct:    41  MKERGLLIVLSGPSGVGKGTVRQAIFSQEDTKFEYSISVTTRSPREGEVNGVDYFFKTRD  100

Query:    61  EFEELIKTGQMLEYAEYVGNYYGTPLTYVNETLDKGIDVFLEIEVQGALQVKSKVPDGVF  120
              EFE++I    ++LE+AEYVGNYYGTP+ YV +TL  G DVFLEIEVQGALQV++   P+G+F
Sbjct:   101  EFEQMIADNKLLEWAEYVGNYYGTPVDYVEQTLQDGKDVFLEIEVQGALQVRNAFPEGLF  160

Query:   121  VFLTPPDLDELEDRLVGRGTDSQEVIAQRIERAKEEIALMREYDYAVVNDEVAIAAERVK  180
              +FL PP L EL++R+V RGT++   +I   R++ AK EI +M  YDY V ND V   A +++K
Sbjct:   161  IFLAPPSLSELKNRIVTRGTETDALIENRMKAAKAEIEMMDAYDYVVENDNVETACDKIK  220

Query:   181  RIIETEHFRVERVIGRYDKMIKI                                      203
                I+  EH + ERV  RY  KM+++
Sbjct:   221  AIVLAEHLKRERVAPRYKKMLEV                                      243
```

An alignment of the GAS and GBS proteins is shown below.

```
Identities = 186/204 (91%), Positives = 197/204 (96%)
Query:     1  MSERGLLIVFSGPSGVGKGTVRQEIFSTPDHKFDYSVMTTRPQRPGEVDGVDYFFRTRE   60
              MSERGLLIVFSGPSGVGKGTVRQEIFSTPDHKF+YSVSMTTRPQRPGEVDGVDYFFRTRE Sbjct:     1  MSERGLLIVFSGPSGVGKGTVRQEIFSTPDHKFEYSVSMTTRPQRPGEVDGVDYFFRTRE   60

Query:    61  EFEALIKEGQMLEYAEYVGNYYGTPLSYVNETLDKGIDVFLEIEVQGALQVKSKVPDGVF  120
              EFE LIK GQMLEYAEYVGNYYGTPL+YVNETLDKGIDVFLEIEVQGALQVKSKVPDGVF
Sbjct:    61  EFEELIKTGQMLEYAEYVGNYYGTPLTYVNETLDKGIDVFLEIEVQGALQVKSKVPDGVF  120

Query:   121  IFLTPPDLEELEERLVGRGTDSPEVIAQRIERAKEEIALMREYDYAVVNDQVSLAAERVK  180
              +FLTPPDL+ELE+RLVGRGTDS EVIAQRIERAKEEIALMREYDYAVVND+V+LAAERVK
Sbjct:   121  VFLTPPDLDELEDRLVGRGTDSQEVIAQRIERAKEEIALMREYDYAVVNDEVALAAERVK  180

Query:   181  RVIEAEHYRVDRVIGRYTNMVKET                                     204
              R+IE EH+RV+RVIGRY  M+K T
Sbjct:   181  RIIETEHFRVERVIGRYDKMIKIT                                     204
```

Based on this analysis, it was predicted that these proteins and their epitopes could be useful antigens for vaccines or diagnostics.

Example 982

A DNA sequence (GBSx1041) was identified in *S. agalactiae* <SEQ ID 3003> which encodes the amino acid sequence <SEQ ID 3004>. Analysis of this protein sequence reveals the following:

Possible site: 30
\>\>\> Seems to have no N-terminal signal sequence
----- Final Results -----
   bacterial cytoplasm --- Certainty = 0.1763 (Affirmative) <succ>
    bacterial membrane --- Certainty = 0.0000 (Not Clear) <succ>
     bacterial outside --- Certainty = 0.0000 (Not Clear) <succ>

The protein has no significant homology with any sequences in the GENPEPT database.

A related DNA sequence was identified in *S. pyogenes* <SEQ ID 3005> which encodes the amino acid sequence <SEQ ID 3006>. Analysis of this protein sequence reveals the following:

```
Possible site:35
>>> Seems to have no N-terminal signal sequence
----- Final Results -----
    bacterial cytoplasm --- Certainty = 0.1551 (Affirmative) <succ>
       bacterial membrane --- Certainty = 0.0000 (Not Clear) <succ>
         bacterial outside --- Certainty = 0.0000 (Not Clear) <succ>
```

An alignment of the GAS and GBS proteins is shown below.

```
Identities = 95/105 (90%), Positives = 100/105 (94%), Gaps = 1/105 (0%)
Query:   1 MMLKPSIDTLLDKVPSKYSLVILQAKRAHELEAGEKATQDFKSVKSTLRALEEIESGNVV    60
           MMLKPSIDTLLDKVPSKYSLVILQAKRAHELEAG  TQ+FKSVKSTL+ALEEIESGNVV
Sbjct:   1 MMLKPSIDTLLDKVPSKYSLVILQAKRAHELEAGATPTQEFKSVKSTLQALEEIESGNVV    60

Query:  61 IHPDPSAKRASVRARIEAERLAKEEEERKIKEQIAKEK-EDGEKI                 104
           IHPDPSAKR +VRA+IEAERLAKEEEERKIKEQIAKEK E+GEKI
Sbjct:  61 IHPDPSAKREAVRAKIEAERLAKEEEERKIKEQIAKEKEEEGEKI                 105
```

Based on this analysis, it was predicted that these proteins and their epitopes could be useful antigens for vaccines or diagnostics.

Example 983

A DNA sequence (GBSx1043) was identified in *S. agalactiae* <SEQ ID 3007> which encodes the amino acid sequence <SEQ ID 3008>. Analysis of this protein sequence reveals the following:

```
Possible site: 24
>>> Seems to have no N-terminal signal sequence
----- Final Results -----
    bacterial cytoplasm --- Certainty = 0.3413 (Affirmative) <succ>
       bacterial membrane --- Certainty = 0.0000 (Not Clear) <succ>
         bacterial outside --- Certainty = 0.0000 (Not Clear) <succ>
```

The protein has homology with the following sequences in the GENPEPT database.

```
>GP: CAB13444 GB: Z99112 primosomal replication factor Y (primosomal
protein N') [Bacillus subtilis]
Identities = 377/807 (46%), Positives = 529/807 (64%), Gaps = 21/807 (2%)
Query:    6 AQVIVDIPLMQTDKPFSYAIPKDLEDLVQVGVRVHVPFGRGNRLLQGFVVGFRDDDELET   65
            A+VIVD+     D+PF Y IP  L+ +++ G+RV VPFG   R +QGFV   ++  +L
Sbjct:    4 AEVIVDVSTKNIDRPFDYKIPDHLKGMIKTGMRVIVPFGP--RKIQGFVTAVKEASDLSG   61

Query:   66 KDIAEV---LDFEPVLNQEQLDLADQMRHTVFSYKISILKSMLPSLLNSQYDKLLL---A  119
            K + EV   LD  PVL +E + L+ +       S+KI+ L++MLP+ L ++Y+K L
Sbjct:   62 KSVKEVEDLLDLTPVLTEELMILSSWLSDKTLSFKITALQAMLPAALKAKYEKELKIAHG  121

Query:  120 TDTLPSEDREDLFGHKTEIVFSSLSSQDAKKA-GRLIQKGFIEVQYLAKDKKTIKTEKIY  178
             D   P  +R  LF    +++S +   K    R +QKG I+V Y    K     K   +
Sbjct:  122 ADLPPQVER--LFSETKTLLYSDIPDHETLKLIQRHVQKGDIDVTYKVAQKTNKKMVRHI  179

Query:  179 KINRTLLEKSQ----IAARAKKRLELKEFLLENPQPGRLTALN----KQFSSPVVNFFRE  230
            + N +   E ++    ++ +A K+   + FL+ P+   + A         SS +     +
Sbjct:  180 QANASKEELAKQAEGLSRQAAKQQAILHFLISEPEGVKIPAAELCKKTDTSSATIKTLIQ  239

Query:  231 EGIIEVIEKEASRSDNYFKGILKTDFLDLNQEQAKVVKIVVDQIGKEQNKPFLLEGITGS  290
            +G+++      +E  R      K    KT+ L L  EQ    + + +  +++K FLL G+TGS
Sbjct:  240 KGLLKESYEEVYRDPYQDKMFKKTEPLPLTDEQRAAFEPIRETLDSDEHKVFLLHGVTGS  299

Query:  291 GKTEVYLHIIDNVLKLGKTAIVLVPEISLTPQMTNRFISRFGKQVAIMHSGLSEGEKFDE  350
            GKTE+YL I+   VL  GK AIVLVPEISLTPQM NRF  RFG QVA+MHSGLS GEK+DE
Sbjct:  300 GKTEIYLQSIEKVLAKGKEAIVLVPEISLTPQMVNRFKGRFGSQVAVMHSGLSTGEKYDE  359

Query:  351 WRKIKSGQAKVVVGARSAIFAPLENIGAIIIDEEHESTYKQESNPRYHARDVALLRAEYY  410
            WRKI   + ++VVGARSAIFAP EN+G IIIDEEHES+YKQE   PRYHA++VA+ RAE++
Sbjct:  360 WRKIHRKEVRLVVGARSAIFAPFENLGMIIIDEEHESSYKQEEMPRYHAKEVAIKRAEHH  419

Query:  411 KAVLLMGSATPSIESRARASRDVYKFLELKHRANPKARIPQVEIIDFRNFIGQQEVSNFT  470
                 +++GSATP++ES ARA + VY+ L LKHR N +   +P+V ++D R    +    S F+
Sbjct:  420 SCPVVLGSATPTLESYARAQKGVYELLSLKHRVNHRV-MPEVSLVDMREELRNGNRSMFS  478

Query:  471 SYLLDKIRDRLDKKEQVVLMLNRRGYSSFIMCRDCGYVDQCPNCDISLTLHMATKTMNCH  530
            + L++K + + + K EQ VL LN+RGYSSF+MCRDCGYV QCP+CDIS+T H    +   CH
Sbjct:  479 VELMEKLEETIAKGEQAVLFLNKRGYSSFVMCRDCGYVPQCPHCDISMTYHRYGQRLKCH  538
```

-continued

```
Query:   531 YCGFEKPIPRTCPNCNSKSISYYGTGTQKAYEELLKVIPDAKILRMDVDTTRQKGGHESI  590
             YCG E+P+P TCP C S+ I ++GTGTQ+ EEL  KV+P A+++RMDVDTT +KG HE +
Sbjct:   539 YCGHEEPVPHTCPECASEHIRFFGTGTQRVEEELTKVLPSARVIRMDVDTTSRKGAHEKL  598

Query:   591 LKRFGNHEADILLGTQMIAKGLDFPNVTLVGVLNADTSLNLPDFRSSERTFQLLTQVAGR  650
             L  FG  +ADILLGTQMIAKGLDFPNVTLVGVL+ADT+L++PDFRS+E+TFQLLTQV+GR
Sbjct:   599 LSAFGEGKADILLGTQMIAKGLDFPNVTLVGVLSADTTLHIPDFRSAEKTFQLLTQVSGR  658

Query:   651 AGRAEKEGEVVIQTYNPNHYAIQLAQKQDFEAFYQYEMNIRRQLGYPPYYFTVGLTLSHK  710
             AGR EK G V+IQTY P+HY+IQL +  D+E FYQ+EM RR+  YPPYY+   +T+SH+
Sbjct:   659 AGRHEKPGHVIIQTYTPSHYSIQLTKTHDYETFYQHEMAHRREQSYPPYYYLALVTVSHE  718

Query:   711 DEEWLIRKSYEVLSLLKQGFSDKVKLLGPTPKPIARTHNLYHYQIIIKYRFEDNLELVLN  770
              +     + ++  LK       K+LGP+  PIAR  + Y YQ +IKY+ E  L   +L
Sbjct:   719 EVAKAAVTAEKIAHFLKANCGADTKILGPSASPIARIKDRYRYQCVIKYKQETQLSALLK  778

Query:   771 RLLD-MTQDKENRDLRLAIDHEPQNMM                                  796
             ++L+    ++ E + + ++ID  P  MM
Sbjct:   779 KILEHYKREIEQKHVMISIDMNPYMMM                                  805
```

A related DNA sequence was identified in *S. pyogenes* <SEQ ID 3009> which encodes the amino acid sequence <SEQ ID 3010>. Analysis of this protein sequence reveals the following:

Possible site: 32
>>> Seems to have no N-terminal signal sequence

-continued

```
----- Final Results -----
   bacterial cytoplasm --- Certainty = 0.1396 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below.

```
Identities = 556/793 (70%), Positives = 659/793 (82%), Gaps = 1/793 (0%)
Query:     4 KLAQVIVDIPLMQTDKPFSYAIPKDLEDLVQVGVRVHVPFGRGNRLLQGFVVGFRDDDEL   63
             K+A VIVDIPLMQTDKPFSY IPK+L  LVQ+G RVHVPFG+GNRLLQGF++GF +D
Sbjct:    12 KVAHVIVDIPLMQTDKPFSYGIPKELVSLVQLGSRVHVPFGKGNRLLQGFIIGFGQEDSS   71

Query:    64 ETKDIAEVLDFEPVLNQEQLDLADQMRHTVFSYKISILKSMLPSLLNSQYDKLLLATDTL  123
             +  K  I  VLD EPVLNQEQL LADQ+R TVFSYKI++LK+M+P+LLNS YDK+L    L
Sbjct:    72 SLKLIQTVLDPEPVLNQEQLTLADQLRKTVFSYKITLLKAMIPNLLNSNYDKVLRPESGL  131

Query:   124 PSEDREDLFGHKTEIVFSSLSSQDAKKAGRLIQKGFIEVQYLAKDKKTIKTEKIYKINRT  183
                DR+ LF K  +++S+L +    K A + IQ G I V YLAKDKK +KTEK Y ++
Sbjct:   132 KKSDRDFLFEGKPSVLYSTLDREKEKIALKGIQAGHITVSYLAKDKKNLKTEKYYHVDLD  191

Query:   184 LLEKSQIAARAKKRLELKEFLLENPQPGRLTALNKQFSSPVVNFFREEGIIEVIEKEASR  243
             L    I++RAKKR  LK++LL + +  +L L +  FS  VV +F    +I + E+   R
Sbjct:   192 ALAVHPISSRAKKRQLLKDYLLTHTKEAKLATLYQAFSRDVVAYFVTNHLIRIDERPIDR  251

Query:   244 SDNYFKGILKTDFLDLNQEQAKVVKIVVDQIGKEQNKPFLLEGITGSGKTEVYLHIIDNV  303
             S++YF  I  + FL LN++QA  V  +V+QIGK  +KPFL+EGITGSGKTEVYLHII+ V
Sbjct:   252 SESYFDQIKPSSFLTLNEQQASAVTEIVEQIGKP-SKPFLIEGITGSGKTEVYLHIIEAV  310

Query:   304 LKLGKTAIVLVPEISLTPQMTNRFISRFGKQVAIMHSGLSEGEKFDEWRKIKSGQAKVVV  363
             LK  KTAIVLVPEISLTPQMT+RFISRFGKQVAIMHSGLS+GEKFDEWRKIK+GQAKVVV
Sbjct:   311 LKQDKTAIVLVPEISLTPQMTSRFISRFGKQVAIMHSGLSDGEKFDEWRKIKTGQAKVVV  370

Query:   364 GARSAIFAPLENIGAIIIDEEHESTYKQESNPRYHARDVALLRAEYYKAVLLMGSATPSI  423
             GARSAIF+PLE IGAIIIDEEHESTYKQESNPRYHAR+VALLRA++++AV++MGSATPSI
Sbjct:   371 GARSAIFSPLERIGAIIIDEEHESTYKQESNPRYHAREVALLRAKHHQAVVVMGSATPSI  430

Query:   424 ESRARASRDVYKFLELKHRANPKARIPQVEIIDFRNFIGQQEVSNFTSYLLDKIRDRLDK  483
             ESRARAS+  VY F++L  RANP A+IP+V I+DFR++IGQQ VSNFT YL+DKI++RL K
Sbjct:   431 ESRARASKGVYHFIQLTQRANPLAKIPEVTIVDFRDYIGQQAVSNFTPYLIDKIKERLVK  490

Query:   484 KEQVVLMLNRRGYSSFIMCRDCGYVDQCPNCDISLTLHMATKTMNCHYCGFEKPIPRTCP  543
             KEQVVLMLNRRGYSS+ MCRDCGYVD+CPNCDISLTLHM  TKTMNCHYCGF+KPIP TCP
Sbjct:   491 KEQVVLMLNRRGYSSFVMCRDCGYVDKCPNCDISLTLHMDTKTMNCHYCGFQKPIPITCP  550

Query:   544 NCNSKSISYYGTGTQKAYEELLKVIPDAKILRMDVDTTRQKGGHESILKRFGNHEADILL  603
                 C+S SI YYGTGTQKA++EL  VIP+AKILRMDVDTTR+K H++IL  FG  EADILL
Sbjct:   551 ECHSNSIRYYGTGTQKAFDELQGVIPEAKILRMDVDTTRKKRSHKTILDSFGRQEADILL  610

Query:   604 GTQMIAKGLDFPNVTLVGVLNADTSLNLPDFRSSERTFQLLTQVAGRAGRAEKEGEVVIQ  663
             GTQMIAKGLDFPNVTLVGVLNADTSLNLPDFR+SE+TFQLLTQVAGRAGRA K GEV+IQ
Sbjct:   611 GTQMIAKGLDFPNVTLVGVLNADTSLNLPDFRASEKTFQLLTQVAGRAGRAHKPGEVLIQ  670
```

-continued

```
Query:  664 TYNPNHYAIQLAQKQDFEAFYQYEMNIRRQLGYPPYYFTVGLTLSHKDEEWLIRKSYEVL  723
            TYNP+HYAIQLA+KQDFEAFY+YEM+IR Q+ YPPYYFTVG+TLSH+ E   +++K+Y+V
Sbjct:  671 TYNPDHYAIQLAKKQDFEAFYRYEMSIRHQMAYPPYYFTVGITLSHRLEASVVKKAYQVT  730

Query:  724 SLLKQGFSDKVKLLGPTPKPIARTHNLYHYQIIIKYRFEDNLELVLNRLLDMTQDKENRD  783
            LLK   SD +K+LGPTPKPIARTHNLYHYQI++KYRFEDNLE  LNR+LD +Q+ +NR
Sbjct:  731 ELLKSHLSDNIKILGPTPKPIARTHNLYHYQILLKYRFEDNLEETLNRILDWSQEADNRH  790

Query:  784 LRLAIDHEPQNMM                                                796
            L+L ID EPQ +
Sbjct:  791 LKLIIDCEPQQFL                                                803
```

Based on this analysis, it was predicted that these proteins and their epitopes could be useful antigens for vaccines or diagnostics.

Example 984

A DNA sequence (GBSx1044) was identified in *S. agalactiae* <SEQ ID 3011> which encodes the amino acid sequence <SEQ ID 3012>. This protein is predicted to be methionyl-tRNA formyltransferase (fmt). Analysis of this protein sequence reveals the following:

Possible site: 13
>>> Seems to have no N-terminal signal sequence
----- Final Results -----
   bacterial cytoplasm --- Certainty = 0.1329 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database.

A related DNA sequence was identified in *S. pyogenes* <SEQ ID 3013> which encodes the amino acid sequence <SEQ ID 3014>. Analysis of this protein sequence reveals the following:

Possible site: 15
>>> Seems to have no N-terminal signal sequence
----- Final Results -----
   bacterial cytoplasm --- Certainty = 0.0730 (Affirmative) <succ>
     bacterial membrane --- Certainty = 0.0000 (Not Clear) <succ>
       bacterial outside --- Certainty = 0.0000 (Not Clear) <succ>

```
>GP: CAB13446 GB: Z99112 methionyl-tRNA formyltransferase [Bacillus subtilis]
Identities = 155/314 (49%), Positives = 221/314 (70%), Gaps = 7/314 (2%)
Query:    1 MTKLLFMGTPDFSATVLKGILADGKYDVLAVVTQPDRAVGRKKEIKMTPVKEVALENNIP   60
            MT+++FMGTPDFS  VL+ ++ DG Y+V+ VVTQPDR  GRKK +   PVKE AL + IP
Sbjct:    1 MTRIVFMGTPDFSVPVLRTLIEDG-YEVVGVVTQPDRPKGRKKVLTPPPVKEEALRHGIP   59

Query:   61 VYQPEKLSGSPELEQLMTLGADGIVTAAFGQFLPTKLLESVGFA-INVHASLLPKYRGGA  119
            V QPEK+  + E+E+++ L  D IVTAAFGQ LP +LL+S  +   INVHASLLP+ RGGA
Sbjct:   60 VLQPEKVRLTEEIEKVLALKPDLIVTAAFGQILPKELLDSPKYGCINVHASLLPELRGGA  119

Query:  120 PIHYAIINGEKEAGVTIMEMVAKMDAGDMVSKASVEITDEDNVGTMFDRLAVVGRDLLLD  179
            PIHY+I+ G+K+ G+TIM MV K+DAGDM+SK  V+I + DNVGT+ D+L+V G  LL +
Sbjct:  120 PIHYSILQGKKKTGITIMYMVEKLDAGDMISKVEVDIEETDNVGTLHDKLSVAGAKLLSE  179

Query:  180 TLPGYLSGDIKPIPQNEEEVSFSPNISPDEERIDWNKSSRDIFNHVRGMYPWPVAHTLLE  239
            T+P   ++G I P  Q+EE+ +++PNI  ++E +DW+++  +++N +RG+ PWPVA+T L
Sbjct:  180 TVPNVIAGSISPEKQDEEKATYAPNIKREQELLDWSRTGEELYNQIRGLNPWPVAYTTLN  239

Query:  240 GNRFKLY--EVTMSEGKGSPGQVIAKTKNSLTVATG-DGAIELKSVQPAGKPRMDIKDFL  296
            G   K++  +      +   PG V+A K  + VATG  + A+ L  +QPAGK RM +DF+
Sbjct:  240 GQNLKIWASKKIAAPTTAEPGTVVAVEKEGIIVATGNETALLLTELQPAGKKRMKGEDFV  299

Query:  297 NGVGRNLEIGDKFG                                                310
            G    ++E GD  G
Sbjct:  300 RGA--HVEAGDVLG                                                311
```

An alignment of the GAS and GBS proteins is shown below.

```
Identities = 217/310 (70%), Positives = 266/310 (85%)
Query:    1 MTKLLFMGTPDFSATVLKGILADGKYDVLAVVTQPDRAVGRKKEIEMTPVKEVALENNIP   60
            M KLLFMGTP FSATVLKG+L +   Y++L VVTQPDRAVGRKK+IK+TPVK++ALE+ I
```

```
Sbjct:    1 MIKLLFMGTPQFSATVLKGLLDNPAYEILGVVTQPDRAVGRKKDIKVTPVKQLALEHGIS    60

Query:   61 VYQPEKLSGSPELEQLMTLGADGIVTAAFGQFLPTKLLESVGFAINVHASLLPKYRGGAP   120
            +YQPEKLSGS EL ++M LGADGI+TAAFGQFLPT LL+SV FAINVHASLLPKYRGGAP
Sbjct:   61 IYQPEKLSGSQELIEIMGLGADGIITAAFGQFLPTILLDSVSFAINVHASLLPKYRGGAP   120

Query:  121 IHYAIINGEKEAGVTIMEMVAKMDAGDMVSKASVEITDEDNVGTMFDRLAVVGRDLLLDT   180
            IHYAI+NG+KEAGVTIMEM+ +MDAGDMV+KAS   I + DNVGT+F++LA++GRDLLLD+
Sbjct:  121 IHYAIMNGDKEAGVTIMEMIKEMDAGDMVAKASTPILETDNVGTLFEKLAIIGRDLLLDS   180

Query:  181 LPGYLSGDIKPIPQNEEEVSFSPNISPDEERIDWNKSSRDIFNHVRGMYPWPVAHTLLEG   240
            LP YLSG++KPIPQ+  + +FSPNISP+ E++DW  S++++FNH+RGM PWPVAHT LEG
Sbjct:  181 LPAYLSGELKPIPQDHSQATFSPNISPEHEKLDWTMSNQEVFNHIRGMNPWPVAHTFLEG   240

Query:  241 NRFKLYEVTMSEGKGSPGQVIAKTKNSLTVATGDGAIELKSVQPAGKPRMDIKDFLNGVG   300
               R K+YE  ++EG+G PGQV+ KTK SL +ATG GA+ L  VQPAGKP+M I DFLNG+G
Sbjct:  241 QRLKIYEAQLAEGEGLPGQVVVKTKKSLVIATGQGALSLIVVQPAGKPKMSIIDFLNGIG   300

Query:  301 RNLEIGDKFG                                                    310
            R LE+GD  G
Sbjct:  301 RKLEVGDIIG                                                    310
```

Based on this analysis, it was predicted that these proteins and their epitopes could be useful antigens for vaccines or diagnostics.

Example 985

A DNA sequence (GBSx1045) was identified in *S. agalactiae* <SEQ ID 3015> which encodes the amino acid sequence <SEQ ID 3016>. This protein is predicted to be sunL protein (sun). Analysis of this protein sequence reveals the following:

Possible site: 59
>>> Seems to have no N-terminal signal sequence
----- Final Results -----
   bacterial cytoplasm --- Certainty = 0.1677 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP: CAA10711 GB: AJ132604 sunL protein [Lactococcus lactis]
Identities = 222/434 (51%), Positives = 305/434 (70%), Gaps = 15/434 (3%)
Query:    7 KSARGLALMTLEEVFDKGAYSNIALNKSLKKSRLSDKDRALVTEIVYGTVARKITLEWYL    66
            K+AR  AL  L  ++F    AY+NI+L+++L+ S LS   D+   VT +VYG V++K  LEWY+
Sbjct:    3 KNARQTALDVLNDIFGNDAYANISLDRNLRDSELSTVDKGFVTALVYGVVSKKALLEWYI    62

Query:   67 SHFIVDRDKLELWVYHLLLLSLYQLLYLDNIPDHAIVNDAVTIAKNRGNKKGAEKLINAV   126
             +   +   K  W   LLLL++YQ+L++D  +P   A V++AV IAK R  + +     INAV
Sbjct:   63 TPLLKKEPKP--WAKMLLLLTIYQVLFMDKVPISAAVDEAVKIAK-RHDGQATANFINAV   119

Query:  127 LRR-VSSETLPEIASIKRQNKRYSVAYSMPVWLVKKLIDQYGETRALAIMESLFERNKAS   185
            LR + SE  E       + K +    YSMP L+ K++ Q+G  R    I+ESL + +   S
Sbjct:  120 LRNFMRSEHRNE------EPKDWETKYSMPKLLLDKMVRQFGGKRTGEILESLEKPSHVS   173

Query:  186 LRVTDLSQKQTIKETLNVRDSHIAETALVADSGNFASTSFFQDGLITIQDESSQLVAPTL   245
            LR  D +      E     R S+  ETAL+ADSGNF+  T  FQ G  ITIQDE+SQLVAP L
Sbjct:  174 LRKIDPTV-----EIAGTRPSLLTETALIADSGNFSITEEFQTGRITIQDETSQLVAPQL   228

Query:  246 KVSGNDQVLDACSAPGGKTSHIASYLTTGAVTALDLYDHKLELVMENAKRLGLSDKIKTK   305
            ++  G  ++VLDAC+APGGK++H+A  YLTTG +TALDLY+HKL+L+  +NA+R    ++DKI T+
Sbjct:  229 ELEGTEEVLDACAAPGGKSTHMAQYLTTGHITALDLYEHKLDLINQNAQRQHVADKITTQ   288

Query:  306 KLDASKAHEYFLEDTFDKILVDAPCSGIGLIRRKPDIKYNKANQDFEALQEIQLSILSSV   365
            K DA+   +E F   + FD+ILVDAPCSGIGLIRRKPDI+Y K + DF   LQ+IQL IL+S
Sbjct:  289 KADATMIYENFGPEKFDRILVDAPCSGIGLIRRKPDIRYRKESSDFIDLQKIQLEILNSA   348

Query:  366 CQTLRKGGIITYSTCTIFEEENFQVIEKFLENHPNFEQVELSHTQEDIVKRGCISISPEQ   425
             ++L+K GI+ YSTCTIF+EENF V+  +FLENHPNFEQVE+S+ +  +++K GC+ I+PE
Sbjct:  349 SKSLKKSGIMVYSTCTIFDEENFDVVHEFLENHPNFEQVEISNEKPEVIKEGCLFITPEM   408

Query:  426 YHTDGFFIGQVKRI                                                439
            YHTDGFFI + K+I
Sbjct:  409 YHTDGFFIAKFKKI                                                422
```

A related DNA sequence was identified in *S. pyogenes* <SEQ ID 3017> which encodes the amino acid sequence <SEQ ID 3018>. Analysis of this protein sequence reveals the following:

Possible site: 42
>>> Seems to have a cleavable N-term signal seq.

```
----- Final Results -----
   bacterial outside --- Certainty = 0.3000 (Affirmative) <succ>
   bacterial membrane --- Certainty = 0.0000 (Not Clear) <succ>
      bacterial cytoplasm --- Certainty = 0.0000 (Not Clear) <succ>        5
```

The protein has homology with the following sequences in the databases:

```
>GP: CAA10711 GB: AJ132604 sunL protein [Lactococcus lactis]
Identities = 208/433 (48%), Positives = 287/433 (66%), Gaps = 13/433 (3%)
Query:     7  KSTRGKALLVIEAIFDQGAYTNIALNQQLSNKALSAKDRALLTEIVYGTVSRKISLEWYL    66
              K+ R  AL V+  IF    AY NI+L++ L +   LS  D+  +T +VYG VS+K  LEWY+
Sbjct:     3  MARQTALDVLNDIFGNDAYANISLDRNLRDSELSTVDKGFVTALVYGVVSKKALLEWYI    62

Query:    67  AHYVKDRDKLDKWVYYLLMLSLYQLTYLDKLPAHAIVNDAVGIAKNRGNKKGAEKFVNAI   126
               +K   K   W   LL+L++YQ+ ++DK+P  A V++AV IAK R + +      F+NA+
Sbjct:    63  TPLLKKEPK--PWAKMLLLLTIYQVLFMDKVPISAAVDEAVKIAK-RHDGQATANFINAV   119

Query:   127  LRQFTSHPLPDMETIKRRNKYYSVKYSLPVWLVKKLEDQFGSDRSVAIMESLFVRSKASI   186
              LR F        E       K + KYS+P  L+ K+ QFG R+  I+ESL   S   S+
Sbjct:   120  LRNFMRS-----EHRNEEPKDWETKYSMPKLLLDKMVRQFGGKRTGEILESLEKPSHVSL   174

Query:   187  RVTDPLKLEEVAEALDAERSLLSATGLTKASGHFAASDYFTNGDITIQDESSQLVAPTLN   246
              R  DP    E         SLL+  T L    SG+F+  ++ F  G  ITIQDE+SQLVAP L
Sbjct:   175  RKIDP-----TVEIAGTRPSLLTETALIADSGNFSITEEFQTGRITIQDETSQLVAPQLE   229

Query:   247  IDGDDIILDACSAPGGKTSHIASYLKTGKVIALDLYDHKLELVKENANRLGVADNIETRK   306
              ++G + +LDAC+APGGK++H+A YL TG + ALDLY+HKL+L+  +NA R  VAD I T+K
Sbjct:   230  LEGTEEVLDACAAPGGKSTHMAQYLTTGHITALDLYEHKLDLINQNAQRQHVADKITTQK   289

Query:   307  LDAREVHRHFEKDSFDKILVDAPCSGIGLIRRKPDIKYNKESQGFNALQAIQLEILSSVC   366
                 DA   ++ +F  + FD+ILVDAPCSGIGLIRRKPDI+Y KES  F  LQ  IQLEIL+S
Sbjct:   290  ADATMIYENFGPEKFDRILVDAPCSGIGLIRRKPDIRYRKESSDFIDLQKIQLEILNSAS   349

Query:   367  QTLRKGGIITYSTCTIFDEENRQVIEAFLQSHPNFEQVKLNHTQADIVKDGYLIITPEQY   426
              ++L+K GI+ YSTCTIFDEEN  V+    FL++HPNFEQV++++ +  +++K+G L  ITPE Y
Sbjct:   350  KSLKKSGIMVYSTCTIFDEENFDVVHEFLENHPNFEQVEISNEKPEVIKEGCLFITPEMY   409

Query:   427  QTDGFFIGQVRRV                                                439
                TDGFFI + +++
Sbjct:   410  HTDGFFIAKFKKI                                                422
```

An alignment of the GAS and GBS proteins is shown below.

```
Identities = 305/440 (69%), Positives = 370/440 (83%)
Query:     1  MANDWKKSARGLALMTLEEVFDKGAYSNIALNKSLKKSRLSDKDRALVTEIVYGTVARKI    60
              +A++WKKS RG AL+ +E +FD+GAY+NIALN+ L     LS  KDRAL+TEIVYGTV+RKI
Sbjct:     1  LADNWKKSTRGKALLVIEAIFDQGAYTNIALNQQLSNKALSAKDRALLTEIVYGTVSRKI    60

Query:    61  TLEWYLSHFIVDRDKLELWVYHLLLLSLYQLLYLDNIPDHAIVNDAVTIAKNRGNKKGAE   120
              +LEWYL+H++  DRDKL+ WVY+LL+LSLYQL  YLD +P HAIVNDAV IAKNRGNKKGAE
Sbjct:    61  SLEWYLAHYVKDRDKLDKWVYYLLMLSLYQLTYLDKLPAHAIVNDAVGIAENRGNKKGAE   120

Query:   121  KLINAVLRRVSSETLPEIASIKRQNKRYSVAYSMPVWLVKKLIDQYGETRALAIMESLFE   180
              K +NA+LR+ +S   LP++  +IKR+NK YSV YS+PVWLVKKL DQ+G  R++AIMESLF
Sbjct:   121  KFVNAILRQFTSHPLPDMETIKRRNKYYSVKYSLPVWLVKKLEDQFGSDRSVAIMESLFV   180

Query:   181  RNKASLRVTDLSQKQTIKETLNVRDSHIAETALVADSGNFASTSFFQDGLITIQDESSQL   240
              R+KAS+RVTD +  + + E L+     S ++ T L    SG+FA++  +F +G ITIQDESSQL
Sbjct:   181  RSKASIRVTDPLKLEEVAEALDAERSLLSATGLTKASGHFAASDYFTNGDITIQDESSQL   240

Query:   241  VAPTLKVSGNDQVLDACSAPGGKTSHIASYLTTGAVTALDLYDHKLELVMENAKRLGLSD   300
              VAPTL + G+D  +LDACSAPGGKTSHIASYL TG V ALDLYDHKLELV  ENA  RLG++D
Sbjct:   241  VAPTLNIDGDDIILDACSAPGGKTSHIASYLKTGKVIALDLYDHKLELVKENANRLGVAD   300

Query:   301  KIKTKKLDASKAHEYFLEDTFDKILVDAPCSGIGLIRRKPDIKYNKANQDFEALQEIQLS   360
               I+T+KLDA + H +F +D+FDKILVDAPCSGIGLIRRKPDIKYNK +Q  F  ALQ  IQL
Sbjct:   301  NIETRKLDAREVHRHFEKDSFDKILVDAPCSGIGLIRRKPDIKYNKESQGFNALQAIQLE   360

Query:   361  ILSSVCQTLRKGGIITYSTCTIFEEENFQVIEKFLENHPNFEQVELSHTQEDIVKRGCIS   420
              ILSSVCQTLRKGGIITYSTCTIF+EEN QVIE  FL++HPNFEQV+L++HTQ DIVK G +
Sbjct:   361  ILSSVCQTLRKGGIITYSTCTIFDEENRQVIEAFLQSHPNFEQVKLNHTQADIVKDGYLI   420
```

```
Query:  421 ISPEQYHTDGFFIGQVKRIL                          440
            I+PEQY TDGFFIGQV+R+L
Sbjct:  421 ITPEQYQTDGFFIGQVRRVL                          440
```

Based on this analysis, it was predicted that these proteins and their epitopes could be useful antigens for vaccines or diagnostics.

Example 986

A DNA sequence (GBSx1046) was identified in *S. agalactiae* <SEQ ID 3019> which encodes the amino acid sequence <SEQ ID 3020>. This protein is predicted to be pppL protein. Analysis of this protein sequence reveals the following:

---

Possible site: 45
>>> Seems to have no N-terminal signal sequence
----- Final Results -----
    bacterial cytoplasm --- Certainty = 0.5796 (Affirmative) <succ>
    bacterial membrane --- Certainty = 0.0000 (Not Clear) <succ>
    bacterial outside --- Certainty = 0.0000 (Not Clear) <succ>

---

The protein has homology with the following sequences in the GENPEPT database.

A related DNA sequence was identified in *S. pyogenes* <SEQ ID 3021> which encodes the amino acid sequence <SEQ ID 3022>. Analysis of this protein sequence reveals the following:

---

Possible site: 43
>>> Seems to have no N-terminal signal sequence
----- Final Results -----
    bacterial cytoplasm --- Certainty = 0.5301 (Affirmative) <succ>
    bacterial membrane --- Certainty = 0.0000 (Not Clear) <succ>
    bacterial outside --- Certainty = 0.0000 (Not Clear) <succ>

---

```
>GP: CAA10712 GB: AJ132604 pppL protein [Lactococcus lactis]
Identities = 131/245 (53%), Positives = 177/245 (71%), Gaps = 4/245 (1%)
Query:    1 MEISLLTDIGQRRSNNQDFINQFENKAGVPLIILADGMGGHRAGNIASEMTVTDLGSDWA   60
            ME S+L+DIG +RS NQD++  + N+AG  L +LADGMGGH+AGN+AS++TV DLG  W+
Sbjct:    1 MEYSILSDIGSKRSTNQDYVGTYVNRAGYQLFLLADGMGGHKAGNVASKLTVEDLGKLWS   60

Query:   61 ETDF---SELSEIRDWMLVSIETENRKIYELGQSDDYKGMGTTIEAVAIVGDNIIFAHVG  117
            ET F    + + +  W+    +  EN  I   LG+ D+Y+GMGTT+EA+  I G+ I+ AHVG
Sbjct:   61 ETFFDAGTPEATLEIWLRNQVRNENENIASLGKLDEYQGMGTTLEALVIKGNTIVSAHVG  120

Query:  118 DSRIGIVRQGEYHLLTSDHSLVNELVKAGQLTEEEAASHPQKNIITQSIGQANPVEPDLG  177
            DSR  ++R GE + +T+DHSLV ELV  AGQ+TEEEA  HP KNIIT+S+GQ N V+ D+
Sbjct:  121 DSRTYLMRDGELNKITTDHSLVQELVDAGQITEEEAEVHPNKNIITRSLGQTNEVQADIQ  180

Query:  178 VHLLEEGDYLVVNSDGLTNMLSNADIATVLTQEK-TLDDKNQDLITLANHRGGLDNITVA  236
                L+ GD +++NSDGLTNM+S  +I   VL +E  TLD+K++ LI LAN  GGLDNITV
Sbjct:  181 ALELQAGDIILMNSDGLTNMVSTTEIMEVLEREDLTLDNKSEALIRLANEHGGLDNITVV  240

Query:  237 LVYVE                                                        241
            L+  E
Sbjct:  241 LIKFE                                                        245
```

An alignment of the GAS and GBS proteins is shown below.

```
Identities = 180/245 (73%), Positives = 220/245 (89%)
Query:    1 MEISLLTDIGQRRSNNQDFINQFENKAGVPLIILADGMGGHRAGNIASEMTVTDLGSDWA   60
            M+ISL  TDIGQ+RSNNQDFIN+F+NK G+  L+ILADGMGGHRAGNIASEMTVTDLG +W
Sbjct:    1 MKISLKTDIGQKRSNNQDFINKFDNKKGITLVILADGMGGHRAGNIASEMTVTDLGREWV   60

Query:   61 ETDFSELSEIRDWMLVSIETENRKIYELGQSDDYKGMGTTIEAVAIVGDNIIFAHVGDSR  120
            +TDF+ELS+IRDW+   +I++ EN++IY+LGQS+D+KGMGTT+EAVA+V   + I+AH+GDSR
Sbjct:   61 KTDFTELSQIRDWLFETIQSENQRIYDLGQSEDFKGMGTTVEAVALVESSAIYAHIGDSR  120

Query:  121 IGIVRQGEYHLLTSDHSLVNELVKAGQLTEEEAASHPQKNIITQSIGQANPVEPDLGVHL  180
            IG+V   G Y LLTSDHSLVNELVKAGQ+TEEEAASHPQ+NIITQSIGQA+PVEPDLGV +
Sbjct:  121 IGLVHDGHYTLLTSDHSLVNELVKAGQITEEEAASHPQRNIITQSIGQASPVEPDLGVRV  180

Query:  181 LEEGDYLVVNSDGLTNMLSNADIATVLTQEKTLDDKNQDLITLANHRGGLDNITVALVYV  240
            LE GDYLV+NSDGLTNM+SN +I  T+L +  +LD+KNQ++I LAN RGGLDNIT+ALV+
Sbjct:  181 LEPGDYLVINSDGLTNMISNDEIVTILGSKVSLDEKNQEMIDLANLRGGLDNITIALVHN  240
```

```
Query:  241 ESEAV                                                    245
            ESE V
Sbjct:  241 ESEDV                                                    245
```

Based on this analysis, it was predicted that these proteins and their epitopes could be useful antigens for vaccines or diagnostics.

Example 987

A DNA sequence (GBSx1047) was identified in *S. agalactiae* <SEQ ID 3023> which encodes the amino acid sequence <SEQ ID 3024>. Analysis of this protein sequence reveals the following:

Possible site: 56
>>> Seems to have no N-terminal signal sequence
INTEGRAL    Likelihood = −10.03   Transmembrane 346-362 (340-372)
----- Final Results -----
  bacterial membrane --- Certainty = 0.5012 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 9539> which encodes amino acid sequence <SEQ ID 9540> was also identified.

The protein has homology with the following sequences in the GENPEPT database.

```
>GP: CAA10713 GB: AJ132604 hypothetical protein [Lactococcus lactis]
Identities = 219/380 (57%), Positives = 284/380 (74%), Gaps = 8/380 (2%)
Query:    1 MIQIGKLFAGRYRILKSIGRGGMADVYLARDLILDNEEVAIKVLRTNYQTDQIAVARFQR    60
            MIQIGK+FA RYRI+K IGRGGMA+VY   D  L +  +VAIKVLR+N++ D IA+ARFQR
Sbjct:    1 MIQIGKIFADRYRIIKEIGRGGMANVYQGEDTFLGDRKVAIKVLRSNFENDDIAIARFQR    60

Query:   61 EARAMAELTHPNIVAIRDIGEEDGQQFLVMEYVDGFDLKKYIQDNAPLSNNEVVRIMNEV   120
            EA AMAEL+HPNIV I D+GE + QQ++VME+VDG LK+YI   NAPL+N+E + I+ E+
Sbjct:   61 EAFAMAELSHPNIVGISDVGEFESQQYIVMEFVDGMTLKQYINQNAPLANDEAIEIITEI   120

Query:  121 LSAMSLAHQKGIVHRDLKPQNILLTKKGTVKVTDFGIAVAFAETSLTQTNSMLGSVHYLS   180
            LSAM +AH  GI+HRDLKPQN+L++   GTVKVTDFGIA A +ETSLTQTN+M GSVHYLS
Sbjct:  121 LSAMDMAHSHGIIHRDLKPQNVLVSSSGTVKVTDFGIAKALSETSLTQTNTMFGSVHYLS   180

Query:  181 PEQARGSKATVQSDIYAMGIMLFEMLTGHIPYDGDSAVTIALQHFQKPLPSILAENKSVP   240
            PEQARGS ATVQSDIYA+GI+LFE+LTG IP+DGDSAV IAL+HFQ+ +PSI+   N  VP
Sbjct:  181 PEQARGSNATVQSDIYAIGIILFELLTGQIPEDGDSAVAIALKHFQENIPSIINLNPEVP   240

Query:  241 QALENIVIKATAKKLTDRYKTTYEMGRDLSTALSSTRHREPKLVFN-DTESTKTLPKVTS   299
            QALEN+VIKATAK + +RY    EM  D++T+ S  R   E KLVFN D + TK +P  +
Sbjct:  241 QALENVVIKATAKDINNRYADVEEMMTDVATSTSLDRRGEEKLVFNKDHDETKIMP--AN   298

Query:  300 TVSSLTTEQLLRNQKQAKTTEKITPDSASNDKTKSKKKASHRLLGTIMKLFFALCVVGII   359
            ++     T+ L+    K+      EK    +S++ +    K+K  S +    G I+ L    L V+G
Sbjct:  299 LINPYDTKPLI--DKKTDDQEKAQSESSTTENNKNKNKKSKK--GLIISLVVLLLVIGGG   354

Query:  360 VFAYKILVSPTTIRVPDVSN                                          379
            FA+ +  +PT ++VP+V+N
Sbjct:  355 AFAWAV-STPTNVKVPNVTN                                          373
```

A related DNA sequence was identified in *S. pyogenes* <SEQ ID 3025> which encodes the amino acid sequence <SEQ ID 3026>. Analysis of this protein sequence reveals the following:

Possible site: 56
>>> Seems to have no N-terminal signal sequence
INTEGRAL    Likelihood = −8.60   Transmembrane 349-365 (340-370)
----- Final Results -----
  bacterial membrane --- Certainty = 0.4439 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the databases:

```
>GP: CAA10713 GB: AJ132604 hypothetical protein [Lactococcus lactis]
Identities = 209/378 (55%), Positives = 273/378 (71%), Gaps = 8/378 (2%)
Query:    1 MIQIGKLFAGRYRILKSIGRGGMADVYLANDLILDNEDVAIKVLRTNYQTDQVAVARFQR    60
            MIQIGK+FA RYRI+K IGRGGMA+VY   D  L +   VAIKVLR+N++ D +A+ARFQR
Sbjct:    1 MIQIGKIFADRYRIIKEIGRGGMANVYQGEDTFLGDRKVAIKVLRSNFENDDIAIARFQR    60
```

-continued

```
Query:  61 EARAMAELNHPNIVAIRDIGEEDGQQFLVMEYVDGADLKRYIQNHAPLSNNEVVRIMEEV 120
           EA AMAEL+HPNIV I D+GE + QQ++VME+VDG  LK+YI  +APL+N+E + I+ E+
Sbjct:  61 EAFAMAELSHPNIVGISDVGEFESQQYIVMEFVDGMTLKQYINQNAPLANDEAIEIITEI 120

Query: 121 LSAMTLAHQKGIVHRDLKPQNILLTKEGVVKVTDFGIAVAFAETSLTQTNSMLGSVHYLS 180
           LSAM +AH  GI+HRDLKPQN+L++  G VKVTDFGIA A +ETSLTQTN+M GSVHYLS
Sbjct: 121 LSAMDMAHSHGIIHRDLKPQNVLVSSSGTVKVTDFGIAKALSETSLTQTNTMFGSVHYLS 180

Query: 181 PEQARGSKATIQSDIYAMGIMLFEMLTGHIPYDGDSAVTIALQHFQKPLPSIIEENHNVP 240
           PEQARGS AT+QSDIYA+GI+LFE+LTG IP+DGDSAV IAL+HFQ+ +PSII  N  VP
Sbjct: 181 PEQARGSNATVQSDIYAIGIILFELLTGQIPFDGDSAVAIALKHFQENIPSIINLNPEVP 240

Query: 241 QALENVVIRATAKKLSDRYGSTFEMSRDLMTALSYNRSRERKIIF-ENVESTKPLPKVAS 299
           QALENVVI+ATAK +++RY    EM  D+ T+ S +R  E K++F ++ + TK  +P
Sbjct: 241 QALENVVIKATAKDINNRYADVEEMMTDVATSTSLDRRGEEKLVFNKDHDETKIMPANLI 300

Query: 300 GPTASVKLSPPTPTVLTQESRLDQTNQTDALQPPTKKKKSGRFLGTLFKILFSFFIVGVA 359
               P + L       QE    +++ T+ +    KK K G + + +L    ++G
Sbjct: 301 NPYDTKPLIDKKTD--DQEKAQSESSTTENNKNKNKKSKKGLIISLVVLLL----VIGGG 354

Query: 360 LFTYLILTKPTSVKVPNV 377
           F + + T PT+VKVPNV
Sbjct: 355 AFAWAVST-PTNVKVPNV 371
```

An alignment of the GAS and GBS proteins is shown below.

```
Identities = 390/643 (60%), Positives = 480/643 (73%), Gaps = 29/643 (4%)
Query:   1 MIQIGKLFAGRYRILKSIGRGGMADVYLARDLILDNEEVAIKVLRTNYQTDQIAVARFQR  60
           MIQIGKLFAGRYRILKSIGRGGMADVYLA DLILDNE+VAIKVLRTNYQTDQ+AVARFQR
Sbjct:   1 MIQIGKLFAGRYRILKSIGRGGMADVYLANDLILDNEDVAIKVLRTNYQTDQVAVARFQR  60

Query:  61 EARAMAELTHPNIVAIRDIGEEDGQQFLVMEYVDGFDLKKYIQDNAPLSNNEVVRIMNEV 120
           EARAMAEL HPNIVAIRDIGEEDGQQFLVMEYVDG DLK+YIQ++APLSNNEVVRIM EV
Sbjct:  61 EARAMAELNHPNIVAIRDIGEEDGQQFLVMEYVDGADLKRYIQNHAPLSNNEVVRIMEEV 120

Query: 121 LSAMSLAHQKGIVHRDLKPQNILLTKKGTVKVTDFGIAVAFAETSLTQTNSMLGSVHYLS 180
           LSAM+LAHQKGIVHRDLKPQNILLTK+G VKVTDFGIAVAFAETSLTQTNSMLGSVHYLS
Sbjct: 121 LSAMTLAHQKGIVHRDLKPQNILLTKEGVVKVTDFGIAVAFAETSLTQTNSMLGSVHYLS 180

Query: 181 PEQARGSKATVQSDIYAMGIMLFEMLTGHIPYDGDSAVTIALQHFQKPLPSILAENKSVP 240
           PEQARGSKAT+QSDIYAMGIMLFEMLTGHIPYDGDSAVTIALQHFQKPLPSI+ EN +VP
Sbjct: 181 PEQARGSKATIQSDIYAMGIMLFEMLTGHIPYDGDSAVTIALQHFQKPLPSIIEENHNVP 240

Query: 241 QALENIVIKATAKKLTDRYKTTYEMGRDLSTALSSTRHREPKLVFNDTESTKTLPKVTS- 299
           QALEN+VI+ATAKKL+DRY +T+EM RDL TALS  R  RE K++F +  ESTK LPKV S
Sbjct: 241 QALENVVIRATAKKLSDRYGSTFEMSRDLMTALSYNRSRERKIIFENVESTKPLPKVASG 300

Query: 300 ----------TVSSLTTEQLLRNQKQAKTTEKITPDSASNDKTKSKKKASHRLLGTIMKL 349
                     T + LT E L   Q  T+ + P +       KKK S R LGT+ K+
Sbjct: 301 PTASVKLSPPTPTVLTQESRL---DQTNQTDALQPPT--------KKKKSGRFLGTLFKI 349

Query: 350 FFALCVVGIIVPAYKILVSPTTIRVPDVSNKTVAQAKMTLENSGLKVGAIRNIESDSVSE 409
           F+  +VG+ +F Y IL    PT+++VP+V+  ++   AK  L + GLKVG IR  IESD+V+E
Sbjct: 350 LFSFFIVGVALFTYLILTKPTSVKVPNVAGTSLKVAKQELYDVGLKVGKIRQIESDTVAE 409

Query: 410 GLVVKTDPAAGRSRREGAKVNLYIATPNKSFTLGNYKEHNYKDILKDL-QGKGVKKSLIK 468
           G VV+TDP AG ++R+G+ + LY++  NK F + NYK  +Y++ +  L + GV KS IK
Sbjct: 410 GNVVRTDPKAGTAKRQGSSITLYVSIGNKGFDMENYKGLDYQEAMNSLIETYGVPKSKIK 469

Query: 469 VKRKINNDYTTGTILAQSLPEGTSFNPDGNKKLTLTVAVNDPMIMPDVTGMTVGEVIETL 528
           +++R + N+Y   T+++QS   G  FNP+G  K+TL+VAV+D + MP VT  +  + + TL
Sbjct: 470 IERIVTNEYPENTVISQSPSAGDKFNPNGKSKITLSVAVSDTITMPMVTEYSYADAVNTL 529

Query: 529 TDLGLDADNLVFYQMQNGV---YQTVVTPPSSSKIASQDPYYGGEVGLRRGDKVKLYLLG 585
           T LG+DA + Y +  +  + ++P S ++ Q PYYG  L      ++ LYL
Sbjct: 530 TALGIDASRIKAYVPSSSSATGFVPIHSPSSKAIVSGQSPYYGTSLSLSDKGEISLYLYP 589

Query: 586 SKTTNNSSSTPIDSSASSSTGTTTSDSVSSTDASTSDSSSTS                  628
           +T ++SSS+   SS SSS ++ +DS + ++    S S +TS
Sbjct: 590 EETHSSSSSS---SSTSSSNSSSINDSTAPGSNTELSPSETTS                 629
```

Figure 27:
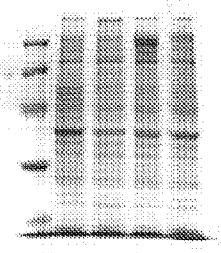
Figure 159:
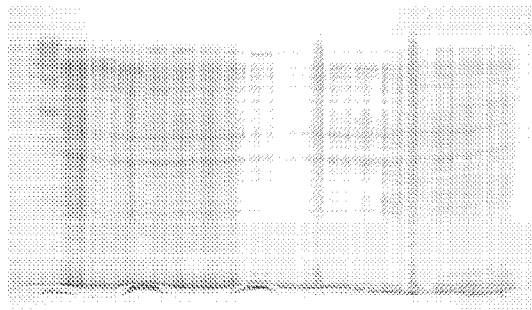

SEQ ID 3024 (GBS297) was expressed in *E. coli* as a His-fusion product. SDS-PAGE analysis of total cell extract is shown in FIG. 43 (lane 6; MW 75 kDa). It was also expressed in *E. coli* as a GST-fusion product. SDS-PAGE analysis of total cell extract is shown in FIG. 27 (lane 4; MW 100.2 kDa) and in FIG. 159 (lane 2-4; MW 100 kDa). GBS297-GST was purified as shown in FIG. 223, lane 3. GBS297-His was purified as shown in FIG. 203, lane 8.

Based on this analysis, it was predicted that these proteins and their epitopes could be useful antigens for vaccines or diagnostics.

Example 988

A DNA sequence (GBSx1048) was identified in *S. agalactiae* <SEQ ID 3027> which encodes the amino acid sequence <SEQ ID 3028>. Analysis of this protein sequence reveals the following:

Possible site: 16
>>> Seems to have an uncleavable N-term signal seq
INTEGRAL    Likelihood = −7.91    Transmembrane 60-76 (50-90)
INTEGRAL    Likelihood = −7.43    Transmembrane 7-23 (3-25)
INTEGRAL    Likelihood = −5.68    Transmembrane 27-43 (24-46)
----- Final Results -----
   bacterial membrane --- Certainty = 0.4163 (Affirmative) <succ>
   bacterial outside --- Certainty = 0.0000 (Not Clear) <succ>
      bacterial cytoplasm --- Certainty = 0.0000 (Not Clear) <succ>

The protein has homology with the following sequences in the GENPEPT database.

```
>GP: BAB03323 GB: AB035448 hypothetical protein [Staphylococcus
aureus]
Identities = 53/230 (23%), Positives = 104/230 (45%), Gaps = 14/230 (6%)
Query:     5 QFFLLVEAVVLVMGLMKILSDDWTSFIFILAL--ILLALRF-YNNDSRHNFLLTTSLLLL   61
             Q  ++ A++++     I  +     F+ +L L  +L+ + + Y +  R         LL+
Sbjct:     9 QMLIIFTALMIIANFYYIFFEK-IGFLLVLLLGCVLVYVGYLYFHKIRGLLAFWIGALLI   67

Query:    62 FLIFMLNPY-IIAAVVFAVLYVLINHFSQVKKKNRYALIQFKNHQLDVKTTRNQWLGTDQ  120
                + N Y II    VF +L ++       + K K   A +      +K      +W G  +
Sbjct:    68 AFTLLSNKYTIIILFVFLLLLIVRYLIHKFKPKKVVATDEVMTSPSFIK---QKWFGEQR  124

Query:   121 HESDFYAFEDINIIRISGTDTIDLTNVIVSGQDNVIIQKVFGDTKVLVPLDVAVKADIS  180
                   Y +ED+ I    G IDLT         ++N I+++  G  +V++P++   +     ++
Sbjct:   125 TPVYVYKWEDVQIQHGIGDLHIDLTKAANIKENNTIVVRHILGKVQVILPVNYNINLHVA  184

Query:   181 SVYGSVQYFDFEEYDLRNESIKLSQ--EEEYYLLKRVKLVVNTIAGKVEV            228
             + YGS  Y + + Y + N +I + +    + +Y    V + V+T  G  VEV
Sbjct:   185 AFYGST-YVNEKSYKVENNNIHIEEMMKPDNY---TVNIYVSTFIGDVEV            230
```

A related DNA sequence was identified in *S. pyogenes* <SEQ ID 3029> which encodes the amino acid sequence <SEQ ID 3030>. Analysis of this protein sequence reveals the following:

Possible site: 35
>>> Seems to have no N-terminal signal sequence
INTEGRAL    Likelihood = −9.92    Transmembrane 44-60 (36-64)
INTEGRAL    Likelihood = −8.76    Transmembrane 69-85 (66-105)
INTEGRAL    Likelihood = −8.70    Transmembrane 24-40 (20-42)
INTEGRAL    Likelihood = −6.64    Transmembrane 88-104 (85-105)
----- Final Results -----
   bacterial membrane --- Certainty = 0.4970 (Affirmative) <succ>
   bacterial outside --- Certainty = 0.0000 (Not Clear) <succ>
      bacterial cytoplasm --- Certainty = 0.0000 (Not Clear) <succ>

The protein has homology with the following sequences in the databases:

```
>GP: BAB03323 GB: AB035448 hypothetical protein [Staphylococcus
aureus]
Identities = 41/187 (21%), Positives = 85/187 (44%), Gaps = 22/187 (11%)
Query:    47 FILILVL--ILLALRF-YNQDSRNNFLLTVSLLFLFLIFMLNPYIIMAVLLGIVYIFINH  103
             F+L+L+L  +L+ + + Y  R        + L +    + N Y I+ + + ++ + +
Sbjct:    33 FLLVLLLGCVLVYVGYLYFHKIRGLLAFWIGALLIAFTLLSNKYTIIILFVFLLLLIV--   90

Query:   104 FSQVKKKNRFALIRFKEEKIEVNNT--------KHQWIGTANYESDYYCFDDINIIRISG  155
                       R+ +  +FK +K+  +             K +W G         Y ++D+ I     G
Sbjct:    91 --------RYLIHKFKPKKVVATDEVMTSPSFIKQKWFGEQRTPVYVYKWEDVQIQHGIG  142

Query:   156 NDTVDLTNVIVTGMDNIIVIRKIFGNTTILVPIDVTVTLDVSSIYGSVDFFRCQQYDLRN  215
               + +DLT      +N IV+R I G    +++P++  + L V++  YGS  +   + Y + N
Sbjct:   143 DLHIDLTKAANIKENNTIVVRHILGKVQVILPVNYNINLHVAAFYGST-YVNEKSYKVEN  201

Query:   216 ESIKFKE                                                      222
             +I  +E
Sbjct:   202 NNIHIEE                                                      208
```

An alignment of the GAS and GBS proteins is shown below.

```
Identities = 137/211 (64%), Positives = 175/211 (82%)
Query:    1 MKKFQFFLLVEAVVLVMGLMKILSDDWTSFIFILALILLALRFYNNDSRHNFLLTTSLLL   60
            MKKFQFFLL+E ++L MG+M IL +D +SFI IL LILLALRFYN DSR+NFLLT SLL
Sbjct:   18 MKKFQFFLLIECILLAMGIMTILDNDLSSFILILVLILLALRFYNQDSRNNFLLTVSLLF   77

Query:   61 LFLIFMLNPYIIAAVVFAVLYVLINHFSQVKKKNRYALIQFKNHQLDVKTTRNQWLGTDQ  120
            LFLIFMLNPYII AV+  ++Y+ INHFSQVKKKNR+ALI+FK   +++V  T++QW+GT
Sbjct:   78 LFLIFMLNPYIIMAVLLGIVYIFINHFSQVKKKNRFALIRFKEEKIEVNNTKHQWIGTAN  137

Query:  121 HESDFYAFEDINIIRISGTDTIDLTNVIVSGQDNVIIQKVFGDTKVLVPLDVAVKADIS   180
            +ESD+Y F+DINIIRISG DT+DLTNVIV+G DN+I+I+K+FG+T +LVP+DV V  D+S
Sbjct:  138 YESDYYCFDDINIIRISGNDTVDLTNVIVTGMDNIIVIRKIFGNTTILVPIDVTVTLDVS  197

Query:  181 SVYGSVQYFDFEEYDLRNESIKLSQEEEYYL                              211
            S+YGSV +F  ++YDLRNESIK  +     L
Sbjct:  198 SIYGSVDFFRCQQYDLRNESIKFKETDNQSL                              228
```

SEQ ID 3028 (GBS66) was expressed in *E. coli* as a His-fusion product. SDS-PAGE analysis of total cell extract is shown in FIG. 6 (lane 4; MW 25 kDa) and in FIG. 7 (lane 2; MW 24.7 kDa).

Based on this analysis, it was predicted that these proteins and their epitopes could be useful antigens for vaccines or diagnostics.

Example 989

A DNA sequence (GBSx1049) was identified in *S. agalactiae* <SEQ ID 3031> which encodes the amino acid sequence <SEQ ID 3032>. This protein is predicted to be histidine kinase (narQ). Analysis of this protein sequence reveals the following:

```
Possible site: 19
>>> Seems to have an uncleavable N-term signal seq
INTEGRAL    Likelihood = –11.41    Transmembrane 47-63 (40-72)
INTEGRAL    Likelihood = –9.98     Transmembrane 9-25 (5-36)
----- Final Results -----
    bacterial membrane --- Certainty = 0.5564 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP: CAB54570 GB: AJ006393 histidine kinase [Streptococcus pneumoniae]
Identities = 159/334 (47%), Positives = 239/334 (70%), Gaps = 5/334 (1%)
Query:    1 MKKHHYFLAFFYGSVIIFAICFVIIDSLGVNL-VHLYQTSRLWLIEQLIFSIFFLSLAVT   59
            MKK  Y +    + +F   +++ L  +  + L+   +    E+ +F +   S+++T
Sbjct:    1 MKKQAYVIIALTSFLFVFFFSHSLLEILDFDWSIFLHDVEKT---EKFVFLLLVFSMSMT   57

Query:   60 ILLLLTWFLLDDNSKRQINHNLRRILNNQSINVTDDGTEISTNIQRLSKKMNLMTASLQS  119
            LL  L  W   +++ S R++  NL+R+L  Q +    D ++ + + LS K+NL+T +LQ
Sbjct:   58 CLLALFWRGIEELSLRKMQANLKRLLAGQEVVQVAD-PDLDASFKSLSGKLNLLTEALQK  116

Query:  120 KENSRILKSQEIVKQERKRIARDLHDTVSQDLFAASMVLSGIAQNVSQLDVDQVGSQLLA  179
            +EN + + +EI+++ERKRIARDLHDTVSQ+LFAA M+LSGI+Q   +LD +++ +QL +
Sbjct:  117 AENQSLAQEEEIIEKERKRIARDLHDTVSQELFAAHMILSGISQQALKLDREKMQTQLQS  176

Query:  180 VEEMLQHAQNDLRILLLHLRPVELENKTLSEGFRMILKELTDKSDIEVVYHESILTLPKK  239
            V  +L+ AQ DLR+LLLHLRPVELE K+L EG +++LKEL DKSD+ V    +++ LPKK
Sbjct:  177 VTAILETAQKDLRVLLLHLRPVELEQKSLIEGIQILLKELEDKSDLRVSLKQNMTKLPKK  236

Query:  240 IEDNIFRIGQEFISNTLKHSQASRLEVYLNQTENELQLKMIDNGIGFDMDSVYDLSYGLK  299
            IE++IFRI QE ISNTL+H+QAS L+VYL QT+ ELQLK++DNGIGF + S+ DLSYGL+
Sbjct:  237 IEEHIFRILQELISNTLRHAQASCLDVYLYQTDVELQLKVVDNGIGFQLGSLDDLSYGLR  296

Query:  300 NIEDRVEDLAGNLQLLSQPGKGVAMDIRLPLVNQ                           333
            NI++RVED+AG +QLL+ P +G+A+DIR+PL+++
Sbjct:  297 NIKERVEDMAGTVQLLLTAPKQGLAVDIRIPLLDK                          330
```

A related DNA sequence was identified in *S. pyogenes* <SEQ ID 2991> which encodes the amino acid sequence <SEQ ID 2992>. Analysis of this protein sequence reveals the following:

```
Possible site: 18
>>> Seems to have an uncleavable N-term signal seq
INTEGRAL      Likelihood = -14.22      Transmembrane 49-65 (42-70)
INTEGRAL      Likelihood = -6.58       Transmembrane 8-24 (5-33)
----- Final Results -----
    bacterial membrane --- Certainty = 0.6689 (Affirmative) <succ>
      bacterial outside --- Certainty = 0.0000 (Not Clear) <succ>
     bacterial cytoplasm --- Certainty = 0.0000 (Not Clear) <succ>
```

```
Lipop: Possible site: -1                         Crend: 4
McG: Discrim Score: 14.69
GvH: Signal Score (-7.5): -4.31
Possible site: 19
>>> Seems to have an uncleavable N-term signal seq
ALOM program count: 2 value: -11.41       threshold: 0.0
INTEGRAL      Likelihood = -11.41       Transmembrane 47-63 (40-72)
INTEGRAL      Likelihood = -9.98        Transmembrane 9-25 (5-36)
PERIPHERAL    Likelihood = 3.61         146
modified ALOM score: 2.78
*** Reasoning Step: 3
----- Final Results -----
    bacterial membrane --- Certainty = 0.5564 (Affirmative) <succ>
      bacterial outside --- Certainty = 0.0000 (Not Clear) <succ>
     bacterial cytoplasm --- Certainty = 0.0000 (Not Clear) <succ>
```

An alignment of the GAS and GBS proteins is shown below.

```
Identities = 218/337 (640), Positives = 276/337 (81%), Gaps = 3/337 (0%)
Query:    1 MKKHHYFLAFFYGSVIIFAICFVIIDSLGVNLVHLYQTSRLWLIEQLIFSIFFLSLAVTI    60
            MKK +Y L + Y ++ I +I FV++D+LG+   +L   + LW +E+L FSI   L ++VT+
Sbjct:    1 MKKRYYALVWLYSTITILSIVFVVMDNLGITFNYL--RNHLWQVERLGFSILLLIVSVTL    58

Query:   61 LLLLTWFLLDDNSKRQINHNLRRILNNQSINVTDDGTEISTNIQRLSKKMNLMTASLQSK   120
            LLLL W ++DDNSKR IN NL+  ILNN+ + + D+ +EI+TN+ RLSKKM+ +TA++Q K
Sbjct:   59 LLLLLWIIMDDNSKRNINQNLKYILNNRRLYL-DETSEINTNLSRLSKKMSHLTANMQKK   117

Query:  121 ENSRILKSQEIVKQERKRIARDLHDTVSQDLFAASMVLSGIAQNVSQLDVDQVGSQLLAV   180
            E++ IL SQE+VKQERKRIARDLHDTVSQ+LFA+S++LSGI+ ++ QLD  Q+ +QL  V
Sbjct:  118 ESAYILDSQEVVKQERKRIARDLHDTVSQELFASSLILSGISMSLEQLDKTQLQTQLTTV   177

Query:  181 EEMLQHAQNDLRILLLHLRPVELENKTLSEGFRMILKELTDKSDIEVVYHESILTLPKKI   240
            E MLQ+AQNDLRILLLHLRP  EL N+TLSEG  MILKELTDKSDIEV+Y E+I  LPK +
Sbjct:  178 EAMLQNAQNDLRILLLHLRPTELANRTLSEGLHMILKELTDKSDIEVIYKETIAQLPKTM   237

Query:  241 EDNIFRIGQEFISNTLKHSQASRLEVYLNQTENELQLKMIDNGIGFDMDSVYDLSYGLKN   300
            EDN+FRI QEFISNTLKH++ASR+EVYLNQT  ELQLKMID+G+GFDMD V DLSYGLKN
Sbjct:  238 EDNLFRIAQEFISNTLKHAKASRIEVYLNQTSTELQLKMIDDGVGFDMDQVRDLSYGLKN   297

Query:  301 IEDRVEDLAGNLQLLSQPGKGVAMDIRLPLVNQSEDK                         337
            IEDRV DLAGNL L+SQ GKGV+MDIRLP+V   +D+
Sbjct:  298 IEDRVNDLAGNLHLISQKGKGVSMDIRLPIVKGDDDE                         334
```

A related GBS gene <SEQ ID 8701> and protein <SEQ ID 8702> were also identified. Analysis of this protein sequence reveals the following:

The protein has homology with the following sequences in the databases:

```
52.5/77.6% over 288aa
Streptococcus pneumoniae
GP|5830526| histidine kinase Insert characterized
ORF00320(433-1302 of 1617)
GP|5830526|emb|CAB54570.1||AJ006393(43-331 of 331) histidine kinase {Streptococcus
pneumoniae}
% Match = 28.6
% Identity = 52.4 % Similarity = 77.6
Matches = 152 Mismatches = 64 Conservative Sub.s = 73

252       282       312       342       372       402       432       462
        QEEEYTF*NVSN*L*TLSLES*G*S*MKKHHYFLAFFYGSVIIFAICFVIIDSLGVNLVHLYQTSRLWLIEQLIFSIFFL
                                 :  :|   |      :::     :    |:::|  ::  :
                                 MKKQAYVIIALTSFLFVFFFSHSLLEILDFDWSIFLHDVEKTEKFVFLLLVF
                                        10        20        30        40        50

492       522       552       582       612       642       672       702
        SLAVTILLLLTWFLLDDNSKRQINHNLRRILNNQSINVTDDGTEISTNIQRLSKKMNLMTASLQSKENSRILKSQEIVKQ
        |:::|  ||  |     :::  | :::   ||:|: |    :    ||  :|:||:|:||   ||    :  :||:::
        SMSMTCLLALFWRGIEELSLRKMQANLKRLLAGQEVVQVAD-PDLDASFKSLSGKLNLLTEALQKAENQSLAQEEEIIEK
                70        80        90        100       110       120       130
```

```
732         762         792         822         852         882         912         942
ERKRIARDLHDTVSQDLFAASMVLSGIAQNVSQLDVDQVGSQLLAVEEMLQHAQNDLRILLLHLRPVELENKTLSEGFRM
|||||||||||||||:||||  |:||||:|   :||  :::  :||  :|  :|:  ||  |||:|||||||||||  |:|  ||  ::
ERKRIARDLHDTVSQELFAAHMILSGISQQALKLDREKMQTQLQSVTAILETAQKDLRVLLLHLRPVELEQKSLIEGIQI
            150         160         170         180         190         200         210

972         1002        1032        1062        1092        1122        1152        1182
ILKELTDKSDIEVVYHESILTLPKKIEDNIFRIGQEFISNTLKHSQASRLEVYLNQTENELQLKMIDNGIGFDMDSVYDL
:||||  ||||:  |    :::    ||||||::||||   ||:||||  ||:||||:|:|||   |:|||  |||:  ||||::|||||   :  |:  ||
LLKELEDKSDLRVSLKQNMTKLPKKIEEHIFRILQELISNTLRHAQASCLDVYLYQTDVELQLKVVDNGIGFQLGSLDDL
            230         240         250         260         270         280         290

1212        1242        1272        1302        1332        1362        1392        1422
SYGLKNIXDRVEDLAGNLQLLSQPGKGVAMDIRLPLVNQSEDKNG*NKNCTC**P*DGSSRFKKFFKLTS*C*SNR*GLK
||||:||  :|||||:||  :|||  |  :|:|:|||:||:::
SYGLRNIKERVEDMAGTVQLLTAPKQGLAVDIRIPLLDKE
            310         320         330
```

Figure 151:
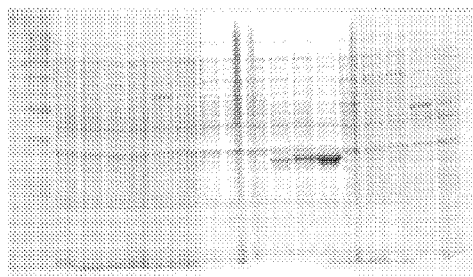

SEQ ID 8702 (GBS31) was expressed in *E. coli* as a GST-fusion product. SDS-PAGE analysis of total cell extract is shown in FIG. 15 (lane 8; MW 64 kDa). It was also expressed as GBS31d in *E. coli* as a GST-fusion product. SDS-PAGE analysis of total cell extract is shown in FIG. 151 (lane 8-10; MW 59 kDa) and in FIG. 187 (lane 8; MW 59 kDa). GBS31d was also expressed in *E. coli* as a His-fusion product. SDS-PAGE analysis of total cell extract is shown in FIG. 151 (lane 11-13; MW 34 kDa) and in FIG. 182 (lane 11; MW 34 kDa). Purified GBS31d-GST is shown in lane 3 of FIG. 237.

Example 990

A DNA sequence (GBSx1050) was identified in *S. agalactiae* <SEQ ID 3033> which encodes the amino acid sequence <SEQ ID 3034>. Analysis of this protein sequence reveals the following:

---

Possible site: 31
>>> Seems to have no N-terminal signal sequence
----- Final Results -----
   bacterial cytoplasm --- Certainty = 0.2706 (Affirmative) <succ>
   bacterial membrane --- Certainty = 0.0000 (Not Clear) <succ>
   bacterial outside --- Certainty = 0.0000 (Not Clear) <succ>

---

The protein has homology with the following sequences in the GENPEPT database.

```
>GP: CAB54571 GB: AJ006393 response regulator [Streptococcus pneumoniae]
Identities = 154/209 (73%), Positives = 184/209 (87%)
Query:    8 IKIVLVDDHEMVRLGLKSFLNLQADVEVIGEASNGLEGIKKALELRPDVVVMDLVMPEMD   67
            +KI+LVDDHEMVRLGLKS+ +LQ DVEV+GEASNG +GI   ALELRPDV+MD+VMPEM+
Sbjct:    1 MKILLVDDHEMVRLGLKSYFDLQDDVEVVGEASNGSQGIDLALELRPDVIVMDIVMPEMN   60

Query:   68 GVEATLALLKDWPEAAILVLTSYLDNEKIYPVIEAGAKGYMLKTSSAAEILNAIRKVSRG  127
            G++ATLA+LK+WPEA IL++TSYLDNEKI PV++AGAKGYMLKTSSA E+L+A+ KV+ G
Sbjct:   61 GIDATLAILKEWPEAKILIVTSYLDNEKIMPVLDAGAKGYMLKTSSADELLHAVSKVAAG  120

Query:  128 EQAIENEVDKKKIKAHDKCPALHEGLTARERDILNLLAKGYDNQRIADELFISLKTVKTHV  187
            E AIE EV KK++ H     LHE LTARERD+L L+AKGY+NQRIAD+LFISLKTVKTHV
Sbjct:  121 ELAIEQEVSKKVEYHRNHMELHEELTARERDVLQLIAKGYENQRIADDLFISLKTVKTHV  180

Query:  188 SNILGKLNVADRTQAVVYAFQHHLVPQDD                                216
            SNIL KL V+DRTQA VYAFQHHLV Q++
Sbjct:  181 SNILAKLEVSDRTQAAVYAFQHHLVGQEE                                209
```

A related DNA sequence was identified in *S. pyogenes* <SEQ ID 2995> which encodes the amino acid sequence <SEQ ID 2996>. Analysis of this protein sequence reveals the following:

```
Possible site: 29
>>> Seems to have no N-terminal signal sequence
----- Final Results -----
    bacterial cytoplasm --- Certainty = 0.3094 (Affirmative) <succ>
      bacterial membrane --- Certainty = 0.0000 (Not Clear) <succ>
        bacterial outside --- Certainty = 0.0000 (Not Clear) <succ>
```

An alignment of the GAS and GBS proteins is shown below.

```
Identities = 175/212 (82%), Positives = 192/212 (90%)
Query:     5 MDKIKIVLVDDHEMVRLGLKSFLNLQADVEVIGEASNGLEGIKKALELRPDVVVMDLVMP    64
             M KIK++LVDDHEMVR+GLKSFLNLQAD++V+GEASNG EG+   AL L+PDV+VMDLVMP
Sbjct:     3 MSKIKVILVDDHEMVRMGLKSFLNLQADIDVVGEASNGREGVDLALALKPDVLVMDLVMP    62

Query:    65 EMDGVEATLALLKDWPEAAILVLTSYLDNEKIYPVIEAGAKGYMLKTSSAAEILNAIRKV   124
             E+ GVEATL +LK W EA +LVLTSYLDNEKIYPVI+AGAKGYMLKTSSAAEILNAIRKV
Sbjct:    63 ELGGVEATLEVLKKWKEAKVLVLTSYLDNEKIYPVIDAGAKGYMLKTSSAAEILNAIRKV   122

Query:   125 SRGEQAIENEVDKKIKAHDKCPALHEGLTARERDILNLLAKGYDNQRIADELFISLKTVK   184
             S+GE AIE EVDKKIKAHD+ P LHE LTARE DIL+LLAKGYDNQ IADELFISLKTVK
Sbjct:   123 SKGELAIETEVDKKIKAHDQHPDLHEELTAREYDILHLLAKGYDNQTIADELFISLKTVK   182

Query:   185 THVSNILGKLNVADRTQAVVYAFQHHLVPQDD                              216
             THVSNIL KL V DRTQAVVYAF+HHLVPQDD
Sbjct:   183 THVSNILAKLEVGDRTQAVVYAFRHHLVPQDD                              214
```

Based on this analysis, it was predicted that these proteins and their epitopes could be useful antigens for vaccines or diagnostics.

Example 991

A DNA sequence (GBSx1051) was identified in *S. agalactiae* <SEQ ID 3035> which encodes the amino acid sequence <SEQ ID 3036>. Analysis of this protein sequence reveals the following:

```
Possible site: 59
>>> Seems to have no N-terminal signal sequence
----- Final Results -----
    bacterial cytoplasm --- Certainty = 0.1688 (Affirmative) <succ>
      bacterial membrane --- Certainty = 0.0000 (Not Clear) <succ>
        bacterial outside --- Certainty = 0.0000 (Not Clear) <succ>
```

The protein has homology with the following sequences in the GENPEPT database.

```
>GP: CAB08166 GB: Z94864 putative peptidyl-prolyl cis-trans isomerase
[Schizosaccharomyces pombe]
Identities = 81/174 (46%), Positives = 109/174 (62%), Gaps = 30/174 (17%)
Query:   288 IKTNHGDMTVKLFPDHAPKTVANFIGLAKQGYYDGIIFHRIIPDFMIQGGDPTGTGMGGE   347
             ++T+ G + ++L+ +HAPKT  NF  LAK+GYYDG+IFHR+IPDF+IQGGDPTGTG GG
Sbjct:     6 LQTSLGKILIELYTEHAPKTCQNFYTLAKEGYYDGVIFHRVIPDFVIQGGDPTGTGRGGT    65

Query:   348 SIYGESFEDEFSEELYNV-RGALSMANAGPNTNGSQFFIVQNTKIPYAKKELERGGWPTP   406
             SIYG+ F+DE   +L++    G LSMANAGPNTN SQFFI    T P
Sbjct:    66 SIYGDKFDDEIHSDLHHTGAGILSMANAGPNTNSSQFFI---TLAP--------------   108

Query:   407 IAELYAGQGGTPHLDRRHSVFGQLVDQSSFEVLDEIAAVETGSQDKPLEDVVIL         460
                        TP LD +H++FG++V  S   V   +  + T S D+P+E + I+
Sbjct:   109 ----------TPWLDGKHTIFGRVV--SGLSVCKRMGLIRTDSSDRPIEPLKII         150
```

A related DNA sequence was identified in *S. pyogenes* <SEQ ID 3037> which encodes the amino acid sequence <SEQ ID 3038>. Analysis of this protein sequence reveals the following:

Possible site: 59
\>\>\> Seems to have no N-terminal signal sequence
----- Final Results -----
    bacterial cytoplasm --- Certainty = 0.2175 (Affirmative) <succ>
    bacterial membrane --- Certainty = 0.0000 (Not Clear) <succ>
    bacterial outside --- Certainty = 0.0000 (Not Clear) <succ>

Possible site: 36
\>\>\> Seems to have no N-terminal signal sequence
----- Final Results -----
    bacterial cytoplasm --- Certainty = 0.3126 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below.

The protein has homology with the following sequences in the GENPEPT database.

```
Identities = 381/464 (82%), Positives = 422/464 (90%)
Query:     1 MDAKTKYKAKKIKAVFFDIDDTLRVKDTGYMPPSILKVFKALKDKGIVVGIASGRARYGV   60
             MDAK KYKAKKIK VFFDIDDTLRVKDTGYMP SI +VFKALK KGI+VGIASGRARYGV
Sbjct:     5 MDAKLKYKAKKIKMVFFDIDDTLRVKDTGYMPESIQRVFKALKAKGILVGIASGRARYGV   64

Query:    61 PKEVQDLNADYCVKLNGAYVKDKDKNIIFHRPIPAEYVEQYKKWADTVGIKYGLAGRHEA  120
             P+EVQDL+ADYCVKLNGAYVKD  K IIF  PIPA+ V  YKKWAD +GI YG+AGRHEA
Sbjct:    65 PQEVQDLHADYCVKLNGAYVKDDAKTIIFQAPIPADVVVAYKKWADDMGIFYGMAGRHEA  124

Query:   121 VLSDRDDLVNDAIDIVYSDLEVNPDFNKEHDIYQMWTFEDKGDSLHLPEPLAEHLRLIRW  180
             VLS R+D++++AID VY+ LEV PD+N+ HD+YQMWTFEDKGD L LP  LAEHLRL+RW
Sbjct:   125 VLSARNDMISNAIDNVYAQLEVCPDYNEYHDVYQMWTFEDKGDGLQLPAELAEHLRLVRW  184

Query:   181 HDHSSDVVLKGTSKALGVSKVVEHLGLKPENILVFGDELNDLELFDYAGLAVAMGVSHPE  240
             HD+SSDVVLKGTSKALGVSKVV+HLGLKPENILVFGDELNDLELFDYAG+++AMGVSHP
Sbjct:   185 HDNSSDVVLKGTSKALGVSKVVDHLGLKPENILVFGDELNDLELFDYAGISIAMGVSHPL  244

Query:   241 AQKKADFITKKVEEDGILYALEELGLIEKELTFPQVDIENTEGPVAVIKTNHGDMTVKLF  300
              Q+KADFITKKVEEDGILYALEELGLI+KEL FPQ+D+ N +GP A IKTNHGDMT+ LF
Sbjct:   245 LQEKADFITKKVEEDGILYALEELGLIDKELQFPQLDLPNHKGPKATIKTNHGDMTLVLF  304

Query:   301 PDHAPKTVANFIGLAKQGYYDGIIFHRIIPDFMIQGGDPTGTMGGESIYGESFEDEFSE  360
             PDHAPKTVANF+GLAK+GYYDGIIFHRIIP+FMIQGGDPTGIGM G+SIYGESFEDEFS+
Sbjct:   305 PDHAPKTVANFLGLAKEGYYDGIIFHRIIPEFMIQGGDPTGTMCGQSIYGESFEDEFSD  364

Query:   361 ELYNVRGALSMANAGPNTNGSQFFIVQNTKIPYAKKELERGGWPTPIAELYAGQGGTPHL  420
             ELYN+RGALSMANAGPNTNGSQFFIVQN+KIPYAKKELERGGWP PIA  YA  GGTPHL
Sbjct:   365 ELYNLRGALSMANAGPNTNGSQFFIVQNSKIPYAKKELERGGWPAPIAASYAANGGTPHL  424

Query:   421 DRRHSVFGQLVDQSSFEVLDEIAAVETGSQDKPLEDVVILTIEV                 464
             DRRH+VFGQLVD++SF+VLD IA VETG+QDKP EDV+I TIEV
Sbjct:   425 DRRHTVFGQLVDETSFQVLDLIAGVETGAQDKPKEDVIIETIEV                 468
```

Based on this analysis, it was predicted that these proteins and their epitopes could be useful antigens for vaccines or diagnostics.

Example 992

A DNA sequence (GBSx1052) was identified in *S. agalactiae* <SEQ ID 3039> which encodes the amino acid sequence <SEQ ID 3040>. This protein is predicted to be ribosomal protein S1 (rpsA). Analysis of this protein sequence reveals the following:

```
>GP: BAB07066 GB: AP001518 polyribonucleotide nucleotidyltransferase
(general stress protein 13) [Bacillus halodurans]
Identities = 46/120 (38%), Positives = 71/120 (58%), Gaps = 11/120 (9%)
Query:     8 KIGDKLKGTVTGIRPYGAFVSLEDGRTGLIHISEIKTGYIDNIYDVLSVGDEVYVQVIDV   67
             ++G  ++G VTGI+P+GAFV+++D + GL+HISE+  G++  +I DVLSVGDEV V+++ V
Sbjct:     5 EVGSIVEGKVTGIKPFGAFVAIDDQKGLVHISEVAHGFVKDINDVLSVGDEVKVKILSV   64

Query:    68 DEFTQKASLSLRTLEEERHHIQH----------RHRFSNNRLKIGFKPLEENLPSWVEE  116
             DE + K SLS+R  +E         R         GF  LE+ L W+++
Sbjct:    65 DEESGKISLSIRATQEAPERPARAPKPRPAGGGGRKPQKGQSQGQGFNTLEDKLKEWLKQ  124
```

A related DNA sequence was identified in *S. pyogenes* <SEQ ID 3041> which encodes the amino acid sequence <SEQ ID 3042>. Analysis of this protein sequence reveals the following:

Possible site: 58
>>> Seems to have no N-terminal signal sequence
----- Final Results -----
 bacterial cytoplasm --- Certainty = 0.1832 (Affirmative) <succ>
   bacterial membrane --- Certainty = 0.0000 (Not Clear) <succ>
     bacterial outside --- Certainty = 0.0000 (Not Clear) <succ>

An alignment of the GAS and GBS proteins is shown below.

```
Identities = 78/115 (670), Positives = 100/115 (86%)
Query: 7    MKIGDKLKGTVTGIRPYGAFVSLEDGRTGLIHISEIKTGYIDNIYDVLSVGDEVYVQVID  66
            MKIGDKL GT+TGI+PYGAFV+LE+G TGLIHISEIKTG+ID+I  +L++G++V VQVID
Sbjct: 1    MKIGDKLHGTITGIKPYGAFVALENGTTGLIHISEIKTGFIDDIDQLLAIGNQVLVQVID  60

Query: 67   VDEFTQKASLSLRTLEEERHHIQHRHRFSNNRLKIGFKPLEENLPSWVEEGLAYL      121
            +DE+++K SLS+RTL EE+ H  HRHR+SN+R KIGF+PLEE LP W+EE L +L
Sbjct: 61   IDEYSKKPSLSMRTLAEEKQHFFHRHRYSNSRHKIGFRPLEEQLPQWIEESLQFL      115
```

Based on this analysis, it was predicted that these proteins and their epitopes could be useful antigens for vaccines or diagnostics.

Example 993

A DNA sequence (GBSx1053) was identified in *S. agalactiae* <SEQ ID 3043> which encodes the amino acid sequence <SEQ ID 3044>. This protein is predicted to be pyruvate formate-lyase 2 activating enzyme (pflA). Analysis of this protein sequence reveals the following:

Possible site: 41
>>> Seems to have no N-terminal signal sequence
----- Final Results -----
 bacterial cytoplasm --- Certainty = 0.2889 (Affirmative) <succ>
   bacterial membrane --- Certainty = 0.0000 (Not Clear) <succ>
     bacterial outside --- Certainty = 0.0000 (Not Clear) <succ>

The protein has homology with the following sequences in the GENPEPT database.

A related DNA sequence was identified in *S. pyogenes* <SEQ ID 3045> which encodes the amino acid sequence <SEQ ID 3046>. Analysis of this protein sequence reveals the following:

Possible site: 58
>>> Seems to have no N-terminal signal sequence
----- Final Results -----
 bacterial cytoplasm --- Certainty = 0.2209 (Affirmative) <succ>
   bacterial membrane --- Certainty = 0.0000 (Not Clear) <succ>
     bacterial outside --- Certainty = 0.0000 (Not Clear) <succ>

An alignment of the GAS and GBS proteins is shown below.

```
GP: AAC76934 GB: AE000469 probable pyruvate formate lyase activating
enzyme 2 [Escherichia coli K12]
Identities = 90/251 (35%), Positives = 142/251 (55%), Gaps = 16/251 (6%)
Query:    8  VFNIQHFSIHDGPGIRTTVFLKGCPLRCPWCANPESQKMVPETMR---------------   52
             +FNIQ +S++DG GIRT VF KGCP  CPWCANPES        +T+R
Sbjct:   24  IFNIQRYSLNDGEGIRTVVFFKGCPHLCPWCANPESISGKIQTVRREAKCLHCAKCLRDA   83

Query:   53  -DAITNESVIVGEEKSVDDIIEEVLKDIDFYEESGGGITLSGGEIFAQFEFAKAILKRAK  111
             +        +G + S+D +  EV+KD  F+  SGGG+TLSGGE+   Q EFA    L+R +
Sbjct:   84  DECPSGAFERIGRDISLDALEREVMKDDIFFRTSGGGVTLSGGEVLMQAEFATRFLQRLR  143

Query:  112  SLGIHTAIETTAYTRHEQFIDLIQYVDFIYTDLKHYNSLKHQEKTMVKNASIIKNIHYAF  171
                G+  AIET     + + L + D + DLK ++ + ++    + +++N+
Sbjct:  144  LWGVSCAIETAGDAPASKLLPLAKLCDEVLFDLKIMDATQARDVVKMNLPRVLENLRLLV  203

Query:  172  ANGKTIVLRIPVIPNFNDSLEDAEEFACLFDRLDIRQVQLLPFHQFGQNKYQLLNRQYEM  231
             + G  ++ R+P+IP F  S E+ ++     L+IRQ+ LLPFHQ+G+ KY+LL + + M
Sbjct:  204  SEGVNVIPRLPLIPGFTLSRENMQQALDVLIPLNIRQIHLLPFHQYGEPKYRLLGKTWSM  263

Query:  232  EEIAALHPEDL                                                   242
             +E+ A     D+
Sbjct:  264  KEVPAPSSADV                                                   274
```

```
Identities = 187/255 (73%), Positives = 220/255 (85%)
Query:    4 EKGIVFNIQHFSIHDGPGIRTTVFLKGCPLRCPWCANPESQKMVPETMRDAITNESVIVG   63
            ++GIVFNIQHFSIHDGPGIRTTVFLKGCPLRCPWCANPESQ+  PE M  +    + IVG
Sbjct:    3 DRGIVFNIQHFSIHDGPGIRTTVFLKGCPLRCPWCANPESQQKAPEQMLTSDGLNTKIVG   62

Query:   64 EEKSVDDIIEEVLKDIDFYEESGGGITLSGGEIFAQFEFAKAILKRAKSLGIHTAIETTA  123
            EEK+VD++IEEVLKD+DFYEESGGG+TLSGGEIFAQF+FA A+LK AK+ G+HTAIETTA
Sbjct:   63 EEKTVDEVIEEVLKDLDFYEESGGGMTLSGGEIFAQFDFALALLKAAKAAGLHTAIETTA  122

Query:  124 YTRHEQFIDLIQYVDFIYTDLKHYNSLKHQEKTMVKNASIIKNIHYAFANGKTIVLRIPV  183
            +  +HEQF+ L+ YVDFIYTDLKHYN L+HQ+ T V+N  IIKNIHYAF  GK IVLRIPV
Sbjct:  123 FAKHEQFVTLVDYVDFIYTDLKHYNQLRHQKVTGVRNDLIIKNIHYAFQAGKEIVLRIPV  182

Query:  184 IPNFNDSLEDAEEFACLFDRLDIRQVQLLPFHQFGQNKYQLLNRQYEMEEIAALHPEDLL  243
            IP FNDSL+DA+ F+ LF++L+I QVQLLPFHQFG+NKY+LL R+YEM E+ A HPEDL
Sbjct:  183 IPQFNDSLDDAKAFSELFNQLEIDQVQLLPFHQFGENKYKLLGREYEMAEVKAYHPEDLA  242

Query:  244 DYQAIFSKYNIHCYF                                              258
            DYQA+F  +NIHCYF
Sbjct:  243 DYQAVFLNHNIHCYF                                              257
```

Based on this analysis, it was predicted that these proteins and their epitopes could be useful antigens for vaccines or diagnostics.

Example 994

A DNA sequence (GBSx1054) was identified in *S. agalactiae* <SEQ ID 3047> which encodes the amino acid sequence <SEQ ID 3048>. Analysis of this protein sequence reveals the following:

---

Possible site: 57
>>> Seems to have no N-terminal signal sequence
----- Final Results -----
  bacterial cytoplasm --- Certainty = 0.1762 (Affirmative) <succ>
  bacterial membrane --- Certainty = 0.0000 (Not Clear) <succ>
  bacterial outside --- Certainty = 0.0000 (Not Clear) <succ>

---

A related GBS nucleic acid sequence <SEQ ID 9299> which encodes amino acid sequence <SEQ ID 9300> was also identified.

The protein has homology with the following sequences in the GENPEPT database.

A related DNA sequence was identified in *S. pyogenes* <SEQ ID 3049> which encodes the amino acid sequence <SEQ ID 3050>. Analysis of this protein sequence reveals the following:

---

Possible site: 58
>>> Seems to have no N-terminal signalsequence
----- Final Results -----
  bacterial cytoplasm --- Certainty = 0.2888 (Affirmative) <succ>
  bacterial membrane --- Certainty = 0.0000 (Not Clear) <succ>
  bacterial outside --- Certainty = 0.0000 (Not Clear) <succ>

---

```
>GP: AAC74366 GB: AE000226 putative DEOR-type transcriptional
regulator [Escherichia coli K12]
Identities = 74/177 (41%), Positives = 113/177 (63%), Gaps = 1/177 (0%)
Query:    2 NRLENIISLVSQYQKIDVNTLSELLQVSKVTIRKDLDKLEGKGLLHREHGYAVLNSGDDL   61
            +R + I+ +V   ++ V  L++    VS+VTIR+DL+ LE   L R HG+AV    DD+
Sbjct:    3 SRQQTILQMVIDQGQVSVTDLAKATGVSEVTIRQDLNTLEKLSYLRRAHGFAVSLDSDDV   62

Query:   62 NVRLSFNHKTKKEIAALAANMVSDNDTILIESGSTCALLAENICQTKRNVTILTNSCFIA  121
              R+   N+   K+E+A  AA++V   +TI IE+GS+ ALLA  +  + K+NVTI+T S +IA
Sbjct:   63 ETRMMSNYTLKRELAEFAASLVQPGETIFIENGSSNALLARTLGEQKKNVTIITVSSYIA  122

Query:  122 NYLREYDSCQIVLLGGEYQSSSQVTVGPLLKKMISLFHVSLAFVGTDGFDPKTRIYG    178
            + L++   C+++LLGG YQ S+    VGPL ++ I   H S AF+G DG+ P+T    G
Sbjct:  123 HLLKD-APCEVILLGGVYQKKSESMVGPLTRQCIQQVHFSKAFIGIDGWQPETGFTG    178
```

An alignment of the GAS and GBS proteins is shown below.

```
Identities = 131/171 (76%), Positives = 150/171 (87%)
Query:    1 MNRLENIISLVSQYQKIDVNTLSELLQVSKVTIRKDLDKLEGKGLLHREHGYAVLNSGDD   60
            MNRLE II LVSQ +KIDVN+LSE L  VSKVTIRKDLDKLE KGLL REHGYAVLNSGDD
Sbjct:    2 MNRLERIIQLVSQKKKIDVNSLSEQLDVSKVTIRKDLDKLESKGLLRREHGYAVLNSGDD   61
```

```
                                -continued
Query:    61 LNVRLSFNHKTKKEIAALAANMVSDNDTILIESGSTCALLAENICQTKRNVTILTNSCFI   120
             LNVRLS+N+   K+  IA   AA +V DNDTI+IESGSTCALLAE +CQTKRN+ ++TNSCFI
Sbjct:    62 LNVRLSYNYNIKRRIAEKAAELVQDNDTIMIESGSTCALLAEVLCQTKRNIKVITNSCFI   121

Query:   121 ANYLREYDSCQIVLLGGEYQSSSQVTVGPLLKKMISLFHVSLAFVGTDGFD            171
             ANY+R+Y SCQI+LLGG YQ +S+VTVGPLLK+MISLFHV+  FVGTDGF+
Sbjct:   122 ANYIRQYSSCQIILLGGYYQPNSEVTVGPLLKEMISLFHVNRVFVGTDGFN            172
```

Based on this analysis, it was predicted that these proteins and their epitopes could be useful antigens for vaccines or diagnostics.

Example 995

A DNA sequence (GBSx1055) was identified in *S. agalactiae* <SEQ ID 3051> which encodes the amino acid sequence <SEQ ID 3052>. Analysis of this protein sequence reveals the following:

---

Possible site: 24
>>> Seems to have no N-terminal signal sequence
----- Final Results -----
   bacterial cytoplasm --- Certainty = 0.1672 (Affirmative) <succ>
     bacterial membrane --- Certainty = 0.0000 (Not Clear) <succ>
      bacterial outside --- Certainty = 0.0000 (Not Clear) <succ>

---

The protein has homology with the following sequences in the GENPEPT database.

```
>GP: AAG04879 GB: AE004578 probable transcriptional regulator
[Pseudomonas aeruginosa]
Identities = 20/70 (28%), Positives = 40/70 (56%)
Query:     6 GFMGRDLMRSEVAQEMANAADEVIILTDSSKFNQTALVEQLPLSTVSQVITDKHPNSEIA    65
             G M    +  +E+A+ M    A ++ ++ DSSK   + AL  +  PLS +++++ D+ P    E+
Sbjct:   179 GAMDFSIEEAEIARAMIAQARQLTVIADSSKLGRRALFQVFPLSRINRLVVDRKPTGELW   238

Query:    66 NLFQEAEITI                                                    75
             Q+A + +
Sbjct:   239 EALQQARVEV                                                   248
```

There is also homology to SEQ ID 3050.

Based on this analysis, it was predicted that this protein and its epitopes, could be useful antigens for vaccines or diagnostics.

Example 996

A DNA sequence (GBSx1056) was identified in *S. agalactiae* <SEQ ID 3053> which encodes the amino acid sequence <SEQ ID 3054>. This protein is predicted to be transcriptional regulator. Analysis of this protein sequence reveals the following:

---

Possible site: 46
>>> Seems to have no N-terminal signal sequence
----- Final Results -----
   bacterial cytoplasm --- Certainty = 0.0904 (Affirmative) <succ>
     bacterial membrane --- Certainty = 0.0000 (Not Clear) <succ>
      bacterial outside --- Certainty = 0.0000 (Not Clear) <succ>

---

A related GBS nucleic acid sequence <SEQ ID 9541> which encodes amino acid sequence <SEQ ID 9542> was also identified.

The protein has homology with the following sequences in the GENPEPT database.

```
>GP: BAB04499 GB: AP001509 transcriptional regulator [Bacillus halodurans]
Identities = 98/309 (31%), Positives = 178/309 (56%), Gaps = 1/309 (0%)
Query:     6 ERQKLLAKVAYLYYMEGKSQSEIANELGIYRTTISRMLAKAREEGLVRIEISDFNPEIFQ    65
             E ++L+ KVA LYY EG +Q+++A ++G+ R   IS++L KA+E+G+V I I D N      +
Sbjct:     5 EERRLIVKVASLYYFEGWTQAQVAKKIGVSRPVISKLLNKAKEQGIVEIYIKDENIHTVE    64

Query:    66 LESYFKSKYHLKDIEIVSSRKDSDTSEIEKDLAHVAAAMIRKKIKENDKVGIAWGRTLSK   125
             LE    + KYHLK+  +V +            I++ +       +   + K IK  D +GI+WG T+S
Sbjct:    65 LEQRLEKKYHLKEAIVVPT-SGLTQDMIKRAIGKATSYYVSKNIKGMDSIGISWGTTVSS   123

Query:   126 VVEAMRPHPVSQVSFVPLAGGPSHINARYHVNTLVYEMSRRFQGSCTFINATLVQENANL   185
             V+          ++    +PL GG       H N L YE++++      C+++ A  + E     L
Sbjct:   124 FVQEYPYEQHRELKVIPLVGGMGRKFVELHSNLLAYELAKKMNCECSYLYAPAMVEAKEL   183

Query:   186 AKGILTSKYFEGLMDNWEKLDVAIVGVGGKPKSNEQQWLDLLNQDDFQCLDEEAAVGEIT   245
             + ++ S+       +++     + +A+VG+G      K +    +  ++ L ++D     L  +      AVG+++
Sbjct:   184 KERLIQSEDIASVLEEGRNVKMAVVGIGSPFKGSTMKVMNYLKEEDIATLKKIGAVGDMS   243

Query:   246 CRFFNHSGDPVNQHLAKRTIGITLEQLQKVPNRIAVAHGNYKAAALLAVLKKGYINHLVT   305
                RF++      G P++  L  +     IGI  L++L+++P    I V+ G +K   ++ A LK GY++  LVT
Sbjct:   244 SRFYDALGQPIDHPLNELVIGIDLDELKRIPIVIGVSEGAHKVDSVEAALKGGYLDVLVT   303

Query:   306 DFSTALNIL                                                    314
             D STA +++
Sbjct:   304 DDSTAQSLI                                                   312
```

A related DNA sequence was identified in *S. pyogenes* <SEQ ID 3055> which encodes the amino acid sequence <SEQ ID 3056>. Analysis of this protein sequence reveals the following:

Possible site: 44
>>> Seems to have no N-terminal signal sequence
----- Final Results -----
   bacterial cytoplasm --- Certainty = 0.2123 (Affirmative) <succ>
     bacterial membrane --- Certainty = 0.0000 (Not Clear) <succ>
       bacterial outside --- Certainty = 0.0000 (Not Clear) <succ> bacterial membrane --- Certainty = 0.0000 (Not Clear) <succ>
      bacterial cytoplasm --- Certainty = 0.0000 (Not Clear) <succ>

A related GBS nucleic acid sequence <SEQ ID 9543> which encodes amino acid sequence <SEQ ID 9544> was also identified.

An alignment of the GAS and GBS proteins is shown below.

The protein has homology with the following sequences in the GENPEPT database.

```
Identities = 165/324 (50%), Positives = 238/324 (72%), Gaps = 1/324 (0%)
Query:    3 MKLERQKLLAKVAYLYYMEGKSQSEIANELGIYRTTISRMLAKAREEGLVRIEISDFNPE    62
            MK ER++LLAKVAYL+Y++GKSQ+ I+ E+ IYRTT+ RMLAKA+EEG+VRIEI+D++ +
Sbjct:    1 MKEERRRLLAKVAYLHYVQGKSQTLISKEMNIYRTTVCRMLAKAKEEGIVRIEIADYDAD    60

Query:   63 IFQLESYFKSKYHLKDIEIVSSRKDSDTSEIEKDLAHVAAAMIRKKIKENDKVGIAWGRT   122
            +F LE Y + +Y L+ +++V ++ +     +   ++A  AA + R   +K+ DK+G++WG T
Sbjct:   61 LFALEEYVRQQYGLEKLDLVPNQVEDTPMDTLTNVAKTAAEVFRHVVKDGDKIGLSWGAT   120

Query:  123 LSKVVEAMRPHPVSQVSFVPLAGGPSHINARYHVNTLVYEMSRRFQGSCTFINATLVQEN   182
            LS +++ + P  + V    PLAGGPSHINA+YHVNTLVY ++R F G+   F+NA ++QE+
Sbjct:  121 LSCLMDELNPKAMKDVFIYPLAGGPSHINAKYHVNTLVYRLARIFHGNSAFMNAMVIQED   180

Query:  183 ANLAKGILTSKYFEGLMDNWEKLDVAIVGVGGKPKSNEQ-QWLDLLNQDDFQCLDEEAAV   241
             +LAKGIL SKYF  ++ +W++LD+A+VG+GG+P S EQ QW DLL    D    L  E AV
Sbjct:  181 KHLAKGILQSKYFNDILTSWDQLDLALVGIGGEPNSLEQSQWRDLLTSSDHDQLKYEKAV   240

Query:  242 GEITCRFFNHSGDPVNQHLAKRTIGITLEQLQKVPNRIAVAHGNYKAAALLAVLKKGYIN   301
            GE+ CRFF+ +G PV   L   RTIGI+LEQL++VP  +AVA G +KA A+LA LK G+IN
Sbjct:  241 GEVCCRFFDQAGQPVYTGLQDRTIGISLEQLRRVPKTMAVATGKHKAKAILAALKAGFIN   300

Query:  302 HLVTDFSTALNILRLDKDTFVDTI                                      325
            +LVTD   T L +L LD+D  ++ +
Sbjct:  301 YLVTDKETMLAVLALDEDIDLNNV                                      324
```

Based on this analysis, it was predicted that these proteins and their epitopes could be useful antigens for vaccines or diagnostics.

Example 997

A DNA sequence (GBSx1057) was identified in *S. agalactiae* <SEQ ID 3057> which encodes the amino acid sequence <SEQ ID 3058>. This protein is predicted to be PTS enzyme III cel (celC). Analysis of this protein sequence reveals the following:

```
>GP: AAA23551 GB: M93570 PTS enzyme III cel [Escherichia coli]
Identities = 42/102 (41%), Positives = 70/102 (68%)
Query:    4 EIIVADQIIMGLILNAGDAKQHIYQALKLAKEGNFAESKIEIELADSALLEAHNLQTQFL    63
            E+   ++++MGLI+N+G A+   Y ALK AK+G+FA +K  ++ +  AL EAH +QT+ +
Sbjct:   13 EVEELEEVVMGLIINSGQARSLAYAALKQAKQGDFAAAKAMMDQSRMALNEAHLVQTKLI    72

Query:   64 AQEAGGTRTDISALFIHSQDHLMTSITEINLIKEIIDLRQEL                   105
            +AG  +  +S +  +H+QDHLMTS+     LI E+I+L ++L
Sbjct:   73 EGDAGEGKMKVSLVLVHAQDHLMTSMLARELITELIELHEKL                   114
```

Possible site: 55
>>> Seems to have a cleavable N-term signal seq.
----- Final Results -----
   bacterial outside --- Certainty = 0.3000 (Affirmative) <succ>

A related DNA sequence was identified in *S. pyogenes* <SEQ ID 3059> which encodes the amino acid sequence <SEQ ID 3060>. Analysis of this protein sequence reveals the following:

Possible site: 17
>>> Seems to have an uncleavable N-term signal seq
----- Final Results -----

The protein has homology with the following sequences in the databases:

```
>GP: AAC74806 GB: AE000268 PEP-dependent phosphotransferase enzyme III
for cellobiose, arbutin, and salicin [Escherichia coli]
Identities = 39/97 (40%), Positives = 66/97 (67%)
Query:    7 DQIIMGLILNAGDAKQHIYQALKCAKEDDYATSEKEMALADDALLEAHNLQTQFLAQEAS  66
            ++++MGLI+N+G A+    Y ALK AK+ D+A ++   M  +   AL EAH +QT+ +  +A
Sbjct:   18 EEVVMGLIINSGQARSLAYAALKQAKQGDFAAAKAMMDQSRMALNEAHLVQTKLIEGDAG  77

Query:   67 GNKSEITALFVHSQDHLMTTITEINLIKEIIDLRKEL                         103
               K +++ + VH+QDHLMT++     LI E+I+L ++L
Sbjct:   78 EGKMKVSLVLVHAQDHLMTSMLARELITELIELHEKL                         114
```

An alignment of the GAS and GBS proteins is shown below.

```
Identities = 81/103 (780), Positives = 94/103 (90%)
Query:    3 MEIIVADQIIMGLILNAGDAKQHIYQALKLAKEGNFAESKIEIELADSALLEAHNLQTQF  62
            M++IV  DQIIMGLILNAGDAKQHIYQALK AKE ++A S+ E+ LAD ALLEAHNLQTQF
Sbjct:    1 MQVIVPDQIIMGLILNAGDAKQHIYQALKCAKEDDYATSEKEMALADDALLEAHNLQTQF  60

Query:   63 LAQEAGGTRTDISALFIHSQDHLMTSITEINLIKEIIDLRQEL                  105
            LAQEA G +++I+ALF+HSQDHLMT+ITEINLIKEIIDLR+EL
Sbjct:   61 LAQEASGNKSEITALFVHSQDHLMTTITEINLIKEIIDLRKEL                  103
```

Based on this analysis, it was predicted that these proteins and their epitopes could be useful antigens for vaccines or diagnostics.

Example 998

A DNA sequence (GBSx1058) was identified in *S. agalactiae* <SEQ ID 3061> which encodes the amino acid sequence <SEQ ID 3062>. This protein is predicted to be PTS system, cellobiose-specific IIB component (celA). Analysis of this protein sequence reveals the following:

Possible site: 24
>>> Seems to have a cleavable N-term signal seq.
----- Final Results -----
  bacterial outside --- Certainty = 0.3000 (Affirmative) <succ>
    bacterial membrane --- Certainty = 0.0000 (Not Clear) <succ>
      bacterial cytoplasm --- Certainty = 0.0000 (Not Clear) <succ>

The protein has homology with the following sequences in the GENPEPT database.

A related DNA sequence was identified in *S. pyogenes* <SEQ ID 3063> which encodes the amino acid sequence <SEQ ID 3064>. Analysis of this protein sequence reveals the following:

Possible site: 31
>>> Seems to have a cleavable N-term signal seq.
----- Final Results -----
  bacterial outside --- Certainty = 0.3000 (Affirmative) <succ>
    bacterial membrane --- Certainty = 0.0000 (Not Clear) <succ>
      bacterial cytoplasm --- Certainty = 0.0000 (Not Clear) <succ>

The protein has homology with the following sequences in the databases:

```
>GP: AAF94440 GB: AE004207 PTS system, cellobiose-specific IIB
component [Vibrio cholerae]
Identities = 46/100 (460), Positives = 62/100 (62%)
Query:    1 MIKIGLFCAAGFSTGMLVNNMKIAADKEGIEAHIEAYSQGKIADYAKDLDVALLGPQVSY  60
            M KI L C+AG ST MLV M+ AA+ +GIE  I+A S   +  ++ DV LLGPQV +
Sbjct:    1 MKKILLCCSAGMSTSMLVKKMQQAAESKGIECKIDALSVNAFEEAIQEYDVCLLGPQVRF  60

Query:   61 TLDKSKSICDEYGVPIAVIPMADYGMLDGVKVLKLALSLL                     100
            L++ +    DEYG IA I   YGM+ G +VL+ AL L+
Sbjct:   61 QLEELRKTADEYGKNIAAISPQAYGMMKGDEVLQQALDLI                     100
```

>GP: AAF94440 GB: AE004207 PTS system, cellobiose-specific IIB component [*Vibrio cholerae*]

-continued
```
Identities = 43/100 (43%), Positives = 58/100 (58%)
Query:   8 MIKIGLECAAGFSTGMLVNNMKNAAEKKGIDCQIEAYAQGKLADYAPLLDVALLGPQVAY  67
           M KI L C+AG ST MLV  M+ AAE KGI+C+I+A +       +   DV LLGPQV +
Sbjct:   1 MKKILLCCSAGMSTSMLVKKMQQAAESKGIECKIDALSVNAFEEAIQEYDVCLLGPQVRF  60

Query:  68 TLDKSEAICKDNDIPIAVIPMADYGMLDGNKVLDLALSLV                      107
           L++        +    IA I   YGM+ G++VL  AL L+
Sbjct:  61 QLEELRKTADEYGKNIAAISPQAYGMMKGDEVLQQALDLI                      100
```

An alignment of the GAS and GBS proteins is shown below.

```
Identities = 79/101 (78%), Positives = 92/101 (90%)
Query:   1 MIKIGLFCAAGFSTGMLVNNMKIAADKEGIEAHIEAYSQGKIADYAKDLDVALLGPQVSY  60
           MIKIGLFCAAGFSTGMLVNNMK+AA+K+GI+  IEAY+QGK+ADYA  LDVALLGPQV+Y
Sbjct:   8 MIKIGLFCAAGFSTGMLVNNMKVAAEKKGIDCQIEAYAQGKLADYAPLLDVALLGPQVAY  67

Query:  61 TLDKSKSICDEYGVPIAVIPMADYGMLDGVKVLKLALSLLE                     101
           TLDKS++IC +  +PIAVIPMADYGMLDG KVL LALSL++
Sbjct:  68 TLDKSEAICKDNDIPIAVIPMADYGMLDGNKVLDLALSLVK                     108
```

SEQ ID 3062 (GBS180) was expressed in *E. coli* as a His-fusion product. SDS-PAGE analysis of total cell extract is shown in FIG. 39 (lane 4; MW 12.6 kDa). It was also expressed in *E. coli* as a GST-fusion product. SDS-PAGE analysis of total cell extract is shown in FIG. 41 (lane 2; MW 37.6 kDa).

Figure 298:
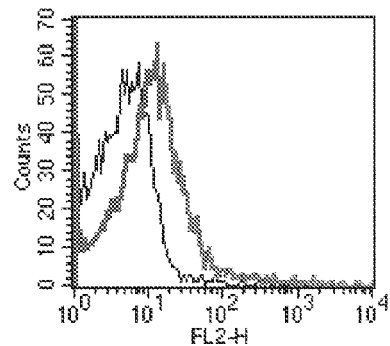

The GBS180-GST fusion product was purified (FIG. 204, lane 8) and used to immunise mice. The resulting antiserum was used for FACS (FIG. 298), which confirmed that the protein is immunoaccessible on GBS bacteria.

Based on this analysis, it was predicted that these proteins and their epitopes could be useful antigens for vaccines or diagnostics.

Example 999

A DNA sequence (GBSx1059) was identified in *S. agalactiae* <SEQ ID 3065> which encodes the amino acid sequence <SEQ ID 3066>. This protein is predicted to be pts system, cellobiose-specific iic component (celB). Analysis of this protein sequence reveals the following:

Possible site: 40
>>> Seems to have no N-terminal signal sequence
INTEGRAL    Likelihood = −11.68   Transmembrane 346-362 (334-374)
INTEGRAL    Likelihood = −9.77    Transmembrane 182-198 (178-205)
INTEGRAL    Likelihood = −8.65    Transmembrane 29-45 (27-50)
INTEGRAL    Likelihood = −6.53    Transmembrane 140-156 (134-161)
INTEGRAL    Likelihood = −4.78    Transmembrane 292-308 (289-312)
INTEGRAL    Likelihood = −4.41    Transmembrane 397-413 (395-416)
INTEGRAL    Likelihood = −2.97    Transmembrane 77-93 (72-93)
INTEGRAL    Likelihood = −2.97    Transmembrane 228-244 (222-246)
----- Final Results -----
   bacterial membrane --- Certainty = 0.5670 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database.

```
>GP: AAA17390 GB: U07818 cellobiose phosphotransferase enzyme II"
[Bacillus stearothermophilus]
Identities = 160/415 (38%), Positives = 251/415 (59%), Gaps = 13/415 (3%)
Query:   15 KFVNMRGIIALKDGMLAILPLTVVGSLFLILGQLPFKGLNQAIANVFGPEWTEPFMQVYS   74
            K    R +  A++DG++  +PL  ++GSLFLI+G LP  G N+ +A  FG  W +   +
Sbjct:   18 KIAEQRHLQAIRDGIILSMPLLIIGSLFLIVGFLPIPGYNEWMAKWFGEHWLDKLLYPVG   77

Query:   75 GTFAIMGLISCFAIAYAYAKNSSVEPLPAGVLSLSSFFILMKSSYIPVKGEA------IA  128
            TF IM L+  F +AY  A+   V+ L AG +SL++F +L    +P E         ++
Sbjct:   78 ATFDIMALVVSFGVAYRLAEKYKVDALSAGAISLAAF-LLATPYQVPFTPEGAKETIMVS  136

Query:  129 DAISKVWFGGQGIIGAIIGLVVGAIYTWFIQHHIVIKMPEQVPQAIAKQFEAMIPAFVI   188
            I   W G +G+  A+I+ +V   IY    IQ +IVIK+P+ VP A+A+ F A+IP   +
Sbjct:  137 GGIPVQWVGSKGLFVAMILAIVSTEIYRKIIQKNIVIKLPDGVPPAVARSFVALIPGAAV  196

Query:  189 FLLSMIVYLIAKVTTGGTFIEMIYDIIQVPLQGLTGSLYGAIGIAFFISFLWWFGVHGQS  248
            ++  +   LI ++T   +F  ++  ++  PL  L GS++GAI    +  + LW  G+HG +
Sbjct:  197 LVVVWVARLILEMTPFESFHNIVSVLLNKPLSVLGGSVFGAIVAVLLVQLLWSTGLHGAA  256

Query:  249 VVNGIVTALLLSNLDANKSLLAAN-RLTLDNGAHIVTQQFLDSFLILSGSGITFGLVIAM  307
            +V G++    + LS +D N+ +    N      L N    ++TQQF D ++ + GSG T   L + M
Sbjct:  257 IVGGVMGPIWLSLMDENRMVFQQNPNAELPN---VITQQFFDLWIYIGGSGATLALALTM  313

Query:  308 LFAAKSQYKALGKVAAFPAIFNVNEPIVFGFPIVMNPVMFLPFILVPVLAALIVYGAIA  367
            +F A+S+Q K+LG++A  P IFN+NEPI FG PIVMNP++ +PFILVPV+  ++ Y A+A
Sbjct:  314 MFRARSRQLKSLGRLAIAPGIFNINEPITFGMPIVMNPLLIIPFILVPVVLVVVSYAAMA  373

Query:  368 VGFMQPFSGVTLPWSTPAIISGFMVGGWQ--GALVQIVILAISTAVYFPFFKIQD       420
            G +   SGV +PW+TP +ISG++   G +  G+++QIV  I+ A+Y+PFF  I D
Sbjct:  374 TGLVAKPSGVAVPWTTPIVISGYLATGGKISGSILQIVNFFIAFAIYYPFFSIWD       428
```

A related DNA sequence was identified in *S. pyogenes* <SEQ ID 2215> which encodes the amino acid sequence <SEQ ID 2216>. Analysis of this protein sequence reveals the following:

```
Possible site: 40
>>> Seems to have no N-terminal signal sequence
INTEGRAL    Likelihood = -8.92    Transmembrane 347-363 (335-373)
INTEGRAL    Likelihood = -7.59    Transmembrane 29-45 (27-50)
INTEGRAL    Likelihood = -7.38    Transmembrane 182-198 (179-204)
INTEGRAL    Likelihood = -5.68    Transmembrane 398-414 (395-420)
INTEGRAL    Likelihood = -4.99    Transmembrane 293-309 (291-314)
INTEGRAL    Likelihood = -3.61    Transmembrane 140-156 (134-160)
INTEGRAL    Likelihood = -2.60    Transmembrane 229-245 (229-246)
INTEGRAL    Likelihood = -0.75    Transmembrane 72-88 (72-88)
----- Final Results -----
    bacterial membrane --- Certainty = 0.4567 (Affirmative) <succ>
    bacterial outside --- Certainty = 0.0000 (Not Clear) <succ>
      bacterial cytoplasm --- Certainty = 0.0000 (Not Clear) <succ>
```

Based on this analysis, it was predicted that these proteins and their epitopes could be useful antigens for vaccines or diagnostics.

Example 1000

A DNA sequence (GBSx1060) was identified in *S. agalactiae* <SEQ ID 3067> which encodes the amino acid sequence <SEQ ID 3068>. This protein is predicted to be formate acetyltransferase 2 (pflB). Analysis of this protein sequence reveals the following:

```
Possible site: 54
>>> Seems to have no N-terminal signal sequence
----- Final Results -----
    bacterial cytoplasm --- Certainty = 0.5049 (Affirmative) <succ>
      bacterial membrane --- Certainty = 0.0000 (Not Clear) <succ>
        bacterial outside --- Certainty = 0.0000 (Not Clear) <succ>
```

An alignment of the GAS and GBS proteins is shown below.

The protein has homology with the following sequences in the GENPEPT database.

```
Identities = 366/428 (85%), Positives = 402/428 (93%), Gaps = 1/428 (0%)
Query:    1 MSKFDSQKIITPIMKFVNMRGIIALKDGMLAILPLTVVGSLFLILGQLPFKGLNQAIANV   60
            M+K + Q II PIM FVNMRGIIALKDGMLAILPLTVVGSLFLI GQ+PF+G+N AIA+V
Sbjct:    1 MAKMNMQNIIKPIMTFVNMRGIIALKDGMLAILPLTVVGSLFLIAGQIPFQGVNDAIASV   60

Query:   61 FGPEWTEPFMQVYSGTFAIMGLISCFAIAYAYAKNSSVEPLPAGVLSLSSFFILMKSSYI  120
            FG +WTEPFMQVY GTFAIMGLISCFAI Y+YAKNS VEPLP+GVLSLS+FFIL++SSY+
Sbjct:   61 FGADWTEPFMQVYHGTFAIMGLISCFAIGYSYAKNSGVEPLPSGVLSLSAFFILLRSSYV  120

Query:  121 PVKGEAIADAISKVWFGGQGIIGAIIGLVVGAIYTWFIQHHIVIKMPEQVPQAIAKQFE  180
            P +GEAI DAISKVWFGGQGIIGAI+IGL VGA+YT FI+ HIVIKMP+QVPQAIAKQFE
Sbjct:  121 PAEGEAIGDAISKVWFGGQGIIGAIVIGLTVGAVYTTFIRRHIVIKMPDQVPQAIAKQFE  180

Query:  181 AMIPAFVIFLLSMIVYLIAK-VTTGGTFIEMIYDIIQVPLQGLTGSLYGAIGIAFFISFL  239
            AMIPAFVIF LSM+VY+IAK VT GGTFIEMIYD+IQVPLQGLTGSLYGA+GIAFFISFL
Sbjct:  181 AMIPAFVIFTLSMLVYIIAKSVTGGGTFIEMIYDVIQVPLQGLTGSLYGALGIAFFISFL  240

Query:  240 WWFGVHGQSVVNGIVTALLLSNLDANKSLLAANRLTLDNGAHIVTQQFLDSFLILSGSGI  299
            WWFGVHGQSVVNGIVTALLLSNLDANK+L+AA  L+LD GAHIVTQQFLDSFLILSGSGI
Sbjct:  241 WWFGVHGQSVVNGIVTALLLSNLDANKALMAAGELSLDKGAHIVTQQFLDSFLILSGSGI  300

Query:  300 TFGLVIAMLFAAKSKQYKALGKVAAFPAIFNVNEPIVFGFPIVMNPVMFLPFILVPVLAA  359
            TFGLV+AM+FAAKSKQYKALGKVAAFPA+FNVNEP+VFGFPIVMNPVMFLPFILVPVLAA
Sbjct:  301 TFGLVVAMIFAAKSKQYKALGKVAAFPALFNVNEPVVFGFPIVMNPVMFLPFILVPVLAA  360

Query:  360 LIVYGAIAVGFMQPFSGVTLPWSTPAIISGFMVGGWQGALVQIVILAISTAVYFPFFKIQ  419
            L VYGAIA+GFMQPF+GVTLPWSTPAIISGFMVGGWQGA+VQI+IL +ST VYFPFFKIQ
Sbjct:  361 LTVYGAIAIGFMQPFAGVTLPWSTPAIISGFMVGGWQGAIVQILILIMSTLVYFPFFKIQ  420

Query:  420 DNITYKNE  427
            DN+ Y+NE
Sbjct:  421 DNMAYQNE  428
```

```
>GP: AAC73910 GB: AE000184 putative formate acetyltransferase
[Escherichia coli K12]
Identities = 414/805 (510), Positives = 555/805 (680), Gaps = 14/805 (10)
Query:    25 LTERMYSYRDKVLD-KKPFIDAERAILVTEAYQKHQEKPNVLKRAYMLQNILEKMTIYID    83
             L++R+ ++++ ++    KP +  ERA   TE YQ+H +KP  ++RA  L + L    TI+I
Sbjct:     9 LSDRIKAHKNALVHIVKPPVCTERAQHYTEMYQQHLDKPIPVRRALALAHHLANRTIWIK    68

Query:    84 DETMIVGNQASSDKDAPIFPEYTLEFVVNELDLFEKRDGDVFYITEETKEQIRNIAPFWE   143
             +  +I+GNQAS  + APIFPEYT+ ++  E+D   R G  F ++EE K  +  + P+W
Sbjct:    69 HDELIIGNQASEVRAAPIFPEYTVSWIEKEIDDLADRPGAGFAVSEENKRVLHEVCPWWR   128

Query:   144 NNNLRARAGVMLPEEVQVYMETGFFGMEGKMNSGDAHLAVNYQKLLEEGLIGFEKKARKA   203
                     ++ R    M  +E +  + TG     EG M SGDAHLAVN+   LLE+GL G  ++ +
Sbjct:   129 GQTVQDRCYGMFTDEQKGLLATGIIKAEGNMTSGDAHLAVNFPLLLEKGLDGLREEVAER   188

Query:   204 KADLDLTKPESIDKYHFYDSILITIEAVKTYAERFAILAKKQAKTANAK-RRQELLDIAS   262
             ++ ++LT E +    F  +I I + AV  + ERFA LA++ A T    + RR ELL +A
Sbjct:   189 RSRINLTVLEDLHGEQFLKAIDIVLVAVSEHIERFAALAREMAATETRESRRDELLAMAE   248

Query:   263 ICERVPYYPAETFAEAVQSVWFIQCILQIESNGHSLSYGRFDQYMYPYVKSDLEAGRETE   322
             C+ + + P +TF +A+Q  +FIQ ILQIESNGHS+S+GR DQY+YPY + D+E   +  +
Sbjct:   249 NCDLIAHQPPQTFWQALQLCYFIQLILQIESNGHSVSFGRMDQYLYPYYRRDVELNQTLD   308

Query:   323 -DSIVERLTNLWIKTITINKVRSQAHTFSSAGSPLYQNVTIGGQTR---HKEDAVNPLSF   378
             +  +E L + W+K + +NK+RS +H+  +SAGSPLYQNVTIGGQ            DAVNPLS+
Sbjct:   309 REHAIEMLHSCWLKLLEVNKIRSGSHSKASAGSPLYQNVTIGGQNLVDGQPMDAVNPLSY   368

Query:   379 LVLKSVAQTHLPQPNLTVRYHANLDKSFMNEAIEVMKLGFGMPAFNNDEIIIPSFIKKGV   438
             +L+S +     QPNL+VRYHA +    F++   ++V++ GFGMPAFNNDEI+IP FIK G+
Sbjct:   369 AILESCGRLRSTQPNLSVRYHAGMSNDFLDACVQVIRCGFGMPAFNNDEIVIPEFIKLGI   428

Query:   439 SEEDAYDYSAIGCVETAVPGKWGYRCTGMSYINFPKVLLITMNDGIDPASGKRFAP----   494
              +DAYDY+AIGC+ETAV GKWGYRCTGMS+INF +V+L  +   G D   SGK F P
Sbjct:   429 EPQDAYDYAAIGCIETAVGGKWGYRCTGMSFINFARVMLAALEGGHDATSGKVFLPQEKA   488

Query:   495 -SYGHFTQMTSYKELKEAWDKTLRYLTRMSVIVENAIDISLEREVPDILCSALTDDCIGR   553
              S G+F     ++ E+ +AWD  +RY TR S+ +E  +D  LE  V DILCSAL DDCI R
Sbjct:   489 LSAGNFN---NFDEVMDAWDTQIRYYTRKSIEIEYVVDTMLEENVHDILCSALVDDCIER   545

Query:   554 GKHLKEGGAVYDYISGLQVGIANLSDSLAALKKLVFEEKRLTTLEVWQALQSDYAGPRGE   613
              K +K+GGA YD++SGLQVGIANL +SLAA+KKLVFE+  +   ++   AL  D+  G    E
Sbjct:   546 AKSIKQGGAKYDWVSGLQVGIANLGNSLAAVKKLVFEQGAIGQQQLAAALADDFDGLTHE   605

Query:   614 EIRQMLINEAPKYGNDDDYADSLVRECYDVYVEEIAKYPNTRYGRGPIGGIRYSGTSSIS   673
             ++RQ LIN APKYGNDDD  D+L+     Y   Y++E+ +Y N RYGRGP+GG   Y+GTSSIS
Sbjct:   606 QLRQRLINGAPKYGNDDDTVDTLLARAYQTYIDELKQYHNPRYGRGPVGGNYYAGTSSIS   665

Query:   674 ANVGQGRGTLATPDGRHAGTPLAEGCSPSHNMDKKGPTSVLKSVSKLPTDEIVGGVLLNQ   733
             ANV  G   T+ATPDGR A TPLAEG SP+     D  GPT+V+ SV  KLPT   I+GGVLLNQ
Sbjct:   666 ANVPFGAQTMATPDGRKAHTPLAEGASPASGTDHLGPTAVIGSVGKLPTAAILGGVLLNQ   725

Query:   734 KVNPQTLAKEEDKQKLIALLRTFFNRLHGYHIQYNVVSRETLIDAQKHPEKHRDLIVRVA   793
             K+NP TL  E DKQKL+ LLRTFF     G+HIQYN+VSRETL+DA+KHP+++RDL+VRVA
Sbjct:   726 KLNPATLENESDKQKLMILLRTFFEVHKGWHIQYNIVSRETLLDAKKHPDYRDLVVRVA   785

Query:   794 GYSAFFNVLSKATQDDIIARTEHAL                                     818
             GYSAFF  LS  QDDIIARTEH L
Sbjct:   786 GYSAFFTALSPDAQDDIIARTEHML                                     810
```

A related DNA sequence was identified in *S. pyogenes* <SEQ ID 3069> which encodes the amino acid sequence <SEQ ID 3070>. Analysis of this protein sequence reveals the following:

Possible site: 19
>>> Seems to have no N-terminal signal sequence

----- Final Results -----
bacterial cytoplasm --- Certainty = 0.4763 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 694/803 (86%), Positives = 747/803 (92%)
Query:    16 QNSQKHFGYLTERMYSYRDKVLDKKPFIDAERAILVTEAYQKHQEKPNVLKRAYMLQNIL    75
             +    +FG+LT+RM  YR+ VLDKKP+IDAERAIL TEAYQKHQ+ KP  LKRAYMLQ IL
Sbjct:     3 ETKSPYFGHLTDRMTHYREAVLDKKPYIDAERAILATEAYQKHQNKPANLKRAYMLQTIL    62

Query:    76 EKMTIYIDDETMIVGNQASSDKDAPIFPEYTLEFVVNELDLFEKRDGDVFYITEETKEQI   135
             E MTIYI+DE++I GNQASS+KDAPIFPEYTLEFV+NELDLFEKRDGDVFYITEETK+Q+
```

```
-continued
Sbjct:    63 ENMTIYIEDESLIAGNQASSNKDAPIFPEYTLEFVLNELDLFEKRDGDVFYITEETKQQL  122

Query:   136 RNIAPFWENNNLRARAGVMLPEEVQVYMETGFFGMEGKMNSGDAHLAVNYQKLLEEGLIG  195
             R+IAPFWENNNLRAR GV+LPEEVQVYMETGFFGMEGKMNSGDAHLAVNYQKLLE GL G
Sbjct:   123 RDIAPFWENNNLRARCGVLLPEEVQVYMETGFFGMEGKMNSGDAHLAVNYQKLLEHGLKG  182

Query:   196 FEKKARKAKADLDLTKPESIDKYHFYDSILITIEAVKTYAERFAILAKKQAKTANARRRQ  255
             FE++AR AKA LDLT PE+IDKYHFYDS+ I I+AVKTYA+R A LA++ AKTA  +R+
Sbjct:   183 FEERARAAKAALDLTIPENIDKYHFYDSVFIVIDAVKTYAKRYAKLARELAKTAKPERQA  242

Query:   256 ELLDIASICERVPYYPAETFAEAVQSVWFIQCILQIESNGHSLSYGRFDQYMYPYVKSDL  315
             ELLDIA IC++VPY PA+TFAEAVQSVWFIQCILQIESNGHSLSYGRFDQYMYPYVK+DL
Sbjct:   243 ELLDIARICDKVPYEPAKTFAEAVQSVWFIQCILQIESNGHSLSYGRFDQYMYPYVKADL  302

Query:   316 EAGRETEDSIVERLTNLWIKTITINKVRSQAHTFSSAGSPLYQNVTIGGQTRHKEDAVNP  375
             EAGRETED+IVERLTNLWIKT+TINKVRSQAHTFSSAGSPLYQNVTIGGQTR K+DAVNP
Sbjct:   303 EAGRETEDTIVERLTNLWIKTLTINKVRSQAHTFSSAGSPLYQNVTIGGQTRDKKDAVNP  362

Query:   376 LSFLVLKSVAQTHLPQPNLTVRYHANLDKSFMNEAIEVMKLGFGMPAFNNDEIIIPSFIK  435
             LS+LVL+SVAQT LPQPNLTVRYH  LD +FMNE IEVMKLGFGMPA NNDEIIIPSFIK
Sbjct:   363 LSYLVLRSVAQTKLPQPNLTVRYHKGLDNTFMNECIEVMKLGFGMPAMNNDEIIIPSFIK  422

Query:   436 KGVSEEDAYDYSAIGCVETAVPGKWGYRCTGMSYINFPKVLLITMNDGIDPASGKRFAPS  495
             KGVSEEDAYDYSAIGCVETAVPGKWGYRCTGMSYINFPK+LLITMNDGIDPASGKRFA
Sbjct:   423 KGVSEEDAYDYSAIGCVETAVPGKWGYRCTGMSYINFPKILLITMNDGIDPASGKRFAKG  482

Query:   496 YGHFTQMTSYKELKEAWDKTLRYLTRMSVIVENAIDISLEREVPDILCSALTDDCIGRGK  555
             +GHF  MTSY+ELK AWD TLR +TRMSVIVENAID+ LEREVPDILCSALTDDCIGRGK
Sbjct:   483 HGHFKDMTSYEELKAAWDATLREITRMSVIVENAIDLGLEREVPDILCSALTDDCIGRGK  542

Query:   556 HLKEGGAVYDYISGLQVGIANLSDSLAALKKLVFEEKRLTTLEVWQALQSDYAGPRGEEI  615
              LKEGGAVYDYISGLQVGIANLSDSLAALKELVFEE RLT  E+W+AL+SD+AG RGE+I
Sbjct:   543 TLKEGGAVYDYISGLQVGIANLSDSLAALKKLVFEEGRLTPEELWKALESDFAGERGEDI  602

Query:   616 RQMLINEAPKYGNDDDYADSLVRECYDVYVEEIAKYPNTRYGRGPIGGIRYSGTSSISAN  675
             RQMLIN+APKYGNDDDYADSLV E YD Y++EIAKYPNTRYGRGPIGGIRYSGTSSISAN
Sbjct:   603 RQMLINDAPKYGNDDDYADSLVVEAYDTYIDEIAKYPNTRYGRGPIGGIRYSGTSSISAN  662

Query:   676 VGQGRGTLATPDGRHAGTPLAEGCSPSHNMDKKGPTSVLKSVSKLPTDEIVGGVLLNQKV  735
             VGQG+GTLATPDGRHAGTPLAEGCSP H+MDKKGPTSVLKSV+KLPTDEIVGGVLLNQKV
Sbjct:   663 VGQGKGTLATPDGRHAGTPLAEGCSPEHSMDKKGPTSVLKSVAKLPTDEIVGGVLLNQKV  722

Query:   736 NPQTLAKEEDKQKLIALLRTFFNRLHGYHIQYNVVSRETLIDAQKHPEKHRDLIVRVAGY  795
             NPQTLAKEEDK KL+ALLRTFFNRLHGYHIQYNVVSRETLIDAQKHPEKHRDLIVRVAGY
Sbjct:   723 NPQTLAKEEDKLKLMALLRTFFNRLHGYHIQYNVVSRETLIDAQKHPEKHRDLIVRVAGY  782

Query:   796 SAFFNVLSKATQDDIIARTEHAL                                      818
             SAFFNVLSKATQDDII RTEH L
Sbjct:   783 SAFFNVLSKATQDDIIERTEHTL                                      805
```

Based on this analysis, it was predicted that these proteins and their epitopes could be useful antigens for vaccines or diagnostics.

Example 1001

A DNA sequence (GBSx1061) was identified in *S. agalactiae* <SEQ ID 3071> which encodes the amino acid sequence <SEQ ID 3072>. Analysis of this protein sequence reveals the following:

Possible site: 32
>>> Seems to have no N-terminal signal sequence
----- Final Results -----
   bacterial cytoplasm --- Certainty = 0.1024 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP: CAA05516 GB: AJ002527 OrfX [Clostridium beijerinckii]
Identities = 90/214 (42%), Positives = 131/214 (61%), Gaps = 1/214 (0%)
Query:     1 MEFLLDTLNLEAIKKWHHILPLAGVTSNPTIAKKEGDIHFFQRIRDVREIIGREASLHVQ   60
             M+ ++D +N+E IK   I  + GVTSNP+I  K G   + +RE IG  + LHVQ
Sbjct:     1 MKLIIDDVNIEKIKDVFSIFQIDGVTSNPSILHKYGKQPYEILIK-IREFIGENSELHVQ   59

Query:    61 VVAKDYQGILDDAAKIRQETDDDIYIKVPVTPDGLAAIKTLKAEGYNITATAIYTSMQGL  120
             V+++   +G+L +A KI +E   + Y+K+PVT DGL AIK L+  E    N+TATAIYT MQ
Sbjct:    60 VISESSEGMLKEAHKIIKELGKNTYVKIPVTRDGLKAIKILRKEEINVTATAIYTQMQAY  119

Query:   121 LAISAGADYLAPYFNRMENLDIDATQVIKELAQAIERTGSSSKILAASFKNASQVTKALS  180
             LA  AGA Y APY NR++NL   QV K++   E+    +++LAASFKN+ QV +
Sbjct:   120 LAGKAGAQYAAPYVNRIDNLGANGVQVAKDIHDIFEENNFKTEVLAASFKNSQQVLELCK  179
```

```
Query:  181 QGAQSITAGPDIFESVFAMPSIAKAVNDFADDWK                         214
            G   + T  PD+ E +      +  AV +F  D++
Sbjct:  180 YGIGAATISPDVIEGLIKNDCVDVAVENFKKDFE                         213
```

A related DNA sequence was identified in *S. pyogenes* <SEQ ID 3073> which encodes the amino acid sequence <SEQ ID 3074>. Analysis of this protein sequence reveals the following:

---
Possible site: 32
>>> Seems to have no N-terminal signal sequence
----- Final Results -----
   bacterial cytoplasm --- Certainty = 0.1090 (Affirmative) <succ>
   bacterial membrane --- Certainty = 0.0000 (Not Clear) <succ>
   bacterial outside --- Certainty = 0.0000 (Not Clear) <succ>

---

An alignment of the GAS and GBS proteins is shown below.

```
Identities = 158/222 (71%), Positives = 194/222 (87%)
Query:    1 MEFLLDTLNLEAIKKWHHILPLAGVTSNPTIAKKEGDIHFFQRIRDVREIIGREASLHVQ   60
            ME++LDTL+LEAIKKWHHILPLAGVTSNP+IAKKEG+I FF+RIR+VR IIG +AS+HVQ
Sbjct:    1 MEYMLDTLDLEAIKKWHHILPLAGVTSNPSIAKKEGEIDFFERIREVRAIIGDKASIHVQ   60

Query:   61 VVAKDYQGILDDAAKIRQETDDDIYIKVPVTPDGLAAIKTLKAEGYNITATAIYTSMQGL  120
            V+A+DY+GIL DAA+IR++  D +Y+KVPVT +GLAAIKTLKAEGY+ITATAIYT+ QGL
Sbjct:   61 VIAQDYEGILKDAAEIRRQCGDSVYVKVPVTTEGLAAIKTLKAEGYHITATAIYTTFQGL  120

Query:  121 LAISAGADYLAPYFNRMENLDIDATQVIKELAQAIERTGSSSKILAASFKNASQVTKALS  180
            LAI AGADYLAPY+NRMENL+ID   VI++LA+AI R   ++SKILAASFKN +QV K+ +
Sbjct:  121 LAIEAGADYLAPYYNRMENLNIDPEAVIEQLAEAINRENANSKILAASFKNVAQVNKSFA  180

Query:  181 QGAQSITAGPDIFESVFAMPSIAKAVNDFADDWKASQHSEHI                  222
            GAQ+ITAGPD+FE+ FAMPSI KAV+DF   DW+A  H + I
Sbjct:  181 LGAQAITAGPDVFEAGFAMPSIQKAVDDFGKDWEAIHHRKSI                  222
```

Based on this analysis, it was predicted that these proteins and their epitopes could be useful antigens for vaccines or diagnostics.

Example 1002

A DNA sequence (GBSx1062) was identified in *S. agalactiae* <SEQ ID 3075> which encodes the amino acid sequence <SEQ ID 3076>. Analysis of this protein sequence reveals the following:

---
Possible site: 30
>>> Seems to have no N-terminal signal sequence
----- Final Results -----
   bacterial cytoplasm --- Certainty = 0.3086 (Affirmative) <succ>
   bacterial membrane --- Certainty = 0.0000 (Not Clear) <succ>
   bacterial outside --- Certainty = 0.0000 (Not Clear) <succ>

---

A related GBS nucleic acid sequence <SEQ ID 9545> which encodes amino acid sequence <SEQ ID 9546> was also identified.

The protein has homology with the following sequences in the GENPEPT database.

```
>GP: AAA22477 GB: M65289 glycerol dehydrogenase [Bacillus
stearothermophilus]
Identities = 199/362 (54%), Positives = 271/362 (73%), Gaps = 2/362 (0%)
Query:    4 KVFASPSRYIQGKDALFQSIEHIKSLGQTPLILCDDVVYNIVGERFLSYLQD-DLLPHRV   62
            +VF SP++Y+QGK+ +   +++ +G   +++ D++V+ I G   ++ L+   ++     V
Sbjct:    5 RVFISPAKYVQGKNVITKIANYLEGIGNKTVVIADEIVWKIAGHTIVNELKKGNIAAEEV   64

Query:   63 SFNGEASDNEINRVVAVAKEKNSDLIIGLGGGKTIDSAKAIADKVNLPVVIAPTVASTDA  122
            +F+GEAS NE+ R+   +A++    + ++IG+GGGKT+D+AKA+AD+++   +VI PT ASTDA
Sbjct:   65 VFSGEASRNEVERIANIARKAEAAIVIGVGGGKTLDTAKAVADELDAYIVIVPTAASTDA  124

Query:  123 PTSALSVIYTDEGAFEKYIFYSKNPDLVLVDTQVIAQAPKRLLASGIADGLATWVEARAV  182
            PTSALSVIY+D+G FE Y FY KNPDLVLVDT++IA AP RLLASGIAD LATWVEAR+V
Sbjct:  125 PTSALSVIYSDDGVFESYRFYKKNPDLVLVDTKIIANAPPRLLASGIADALATWVEARSV  184
```

-continued

```
Query:  183 LQKNGIAMAGGRQTLAGVAIAQACERTLFNDSLQALAACDAKVVTKALENVIEANTLLSG  242
            ++  G  MAGG  T+A  AIA+ CE+TLF     A  +  AKVVT ALE V+EANTLLSG
Sbjct:  185 IKSGGKTMAGGIPTIAAEAIAEKCEQTLFKYGKLAYESVKAKVVTPALEAVVEANTLLSG  244

Query:  243 LGFESAGLAAAHAIHNGFTALSGDIHHLTHGEKVAYGTLTQLFLENRPKEEIDRYINLYQ  302
            LGFES GLAAAHAIHNGFTAL G+IHHLTHGEKVA+GTL QL LE   ++EI+RYI LY
Sbjct:  245 LGFESGGLAAAHAIHNGFTALEGEIHHLTHGEKVAFGTLVQLALEEHSQQEIERYIELYL  304

Query:  303 AIGMPTTLAELHLGDATYEELLKVGQQATIEGETIHEMPFKISAEDVAAALLTVDRYVSN  362
            ++ +P TL ++ L DA+ E++LKV + AT EGETIH    F ++A+DVA A+    D+Y
Sbjct:  305 SLDLPVTLEDIKLKDASREDILKVAKAATAEGETIHN-AFNVTADDVADAIFAADQYAKA  363

Query:  363 HQ  364
            ++
Sbjct:  364 YK  365
```

A related DNA sequence was identified in £pyogenes <SEQ ID 3077> which encodes the amino acid sequence <SEQ ID 3078>. Analysis of this protein sequence reveals the following:

---

Possible site: 35
>>> Seems to have no N-terminal signal sequence
INTEGRAL       Likelihood = –4.62    Transmembrane 101-117 (98-119)
----- Final Results -----
   bacterial membrane --- Certainty = 0.2848 (Affirmative) <succ>
      bacterial outside --- Certainty = 0.0000 (Not Clear) <succ>
         bacterial cytoplasm --- Certainty = 0.0000 (Not Clear) <succ>

---

The protein has homology with the following sequences in the databases:

```
>GP: AAA22477 GB: M65289 glycerol dehydrogenase [Bacillus
stearothermophilus]
Identities = 202/357 (56%), Positives = 261/357 (72%), Gaps = 1/357 (0%)
Query:    2 KVFASPSRYIQGKNALFTNVKTLKQLGDSPILLCDDVVYGIVGERFESYLIDNGMTPVHV   61
            +VF SP++Y+QGKN +     L+ +G+  +++ D++V+ I G    + L    +    V
Sbjct:    5 RVFISPAKYVQGKNVITKIANYLEGIGNKTVVIADEIVWKIAGHTIVNELKKGNIAAEEV   64

Query:   62 AFNGEASDNEISRVVAIAKENGNDVIIGLGGGKTIDSAKAIADLLAVPVIIAPTIASTDA  121
                F+GEAS NE+ R+   IA++       ++IG+GGGKT+D+AKA+AD L     ++I PT ASTDA
Sbjct:   65 VFSGEASRNEVERIANIARKAEAAIVIGVGGGKTLDTAKAVADELDAYIVIVPTAASTDA  124

Query:  122 PTSALSVIYTDEGAFEKYIFYSKNPDLVLVDTQVICQAPKRLLASGIADGLATWVEARAV  181
            PTSALSVIY+D+G FE Y FY KNPDLVLVDT++I  AP RLLASGIAD LATWVEAR+V
Sbjct:  125 PTSALSVIYSDDGVFESYRFYKKNPDLVLVDTKIIANAPPRLLASGIADALATWVEARSV  184

Query:  182 MQKNGDTMAGGNQTLAGVAIAKACEQTLFADGLKAMASCDRQVVTPALENVIEANTLLSG  241
            ++  G  TMAGG  T+A  AIA+ CEQTLF   G  A   S    +VVTPALE V+EANTLLSG
Sbjct:  185 IKSGGKTMAGGIPTIAAEAIAEKCEQTLFKYGKLAYESVKAKVVTPALEAVVEANTLLSG  244

Query:  242 LGFESAGLAAAHAIHNGFTALTGAIHHLTHGEKVAYGTLTQLFLENRSREEIDRYIDFYQ  301
            LGFES GLAAAHAIHNGFTAL G IHHLTHGEKVA+GTL QL LE    S++EI+RYI+ Y
Sbjct:  245 LGFESGGLAAAHAIHNGFTALEGEIHHLTHGEKVAFGTLVQLALEEHSQQEIERYIELYL  304

Query:  302 AIGMPTTLKEMHLDTATQEDFLKIGRQATMAGETIHQMPFVISPEDVAAALVAVDAY     358
            ++ +P TL+++ L  A++ED LK+ + AT  GETIH    F ++ +DVA A+  A D Y
Sbjct:  305 SLDLPVTLEDIKLKDASREDILKVAKAATAEGETIHN-AFNVTADDVADAIFAADQY     360
```

An alignment of the GAS and GBS proteins is shown below.

```
Identities = 287/361 (79%), Positives = 325/361 (89%), Gaps = 1/361 (0%)
Query:    3 MKVFASPSRYIQGKDALFQSIEHIKSLGQTPLILCDDVVYNIVGERFLSYLQDD-LLPHR   61
            MKVFASPSRYIQGK+ALF +++  +K LG +P++LCDDVVY IVGERF SYL D+ + P
Sbjct:    1 MKVFASPSRYIQGKNALFTNVKTLKQLGDSPILLCDDVVYGIVGERFESYLIDNGMTPVH   60

Query:   62 VSFNGEASDNEINRVVAVAKEKNSDLIIGLGGGKTIDSAKAIADKVNLPVVIAPTVASTD  121
            V+FNGEASDNEI+RVVA+AKE  +D+IIGLGGGKTIDSAKAIAD + +PV+IAPT+ASTD
Sbjct:   61 VAFNGEASDNEISRVVAIAKENGNDVIIGLGGGKTIDSAKAIADLLAVPVIIAPTIASTD  120
```

```
-continued
Query:  122 APTSALSVIYTDEGAFEKYIFYSKNPDLVLVDTQVIAQAPKRLLASGIADGLATWVEARA  181
            APTSALSVIYTDEGAFEKYIFYSKNPDLVLVDTQVI QAPKRLLASGIADGLATWVEARA
Sbjct:  121 APTSALSVIYTDEGAFEKYIFYSKNPDLVLVDTQVICQAPKRLLASGIADGLATWVEARA  180

Query:  182 VLQKNGIAMAGGRQTLAGVAIAQACERTLFNDSLQALAACDAKVVTKALENVIEANTLLS  241
            V+QKNG  MAGG QTLAGVAIA+ACE+TLF D L+A+A+CD +VVT ALENVIEANTLLS
Sbjct:  181 VMQKNGDTMAGGNQTLAGVAIAKACEQTLFADGLKAMASCDRQVVTPALENVIEANTLLS  240

Query:  242 GLGFESAGLAAAHAIHNGFTALSGDIHHLTHGEKVAYGTLTQLFLENRPKEEIDRYINLY  301
            GLGFESAGLAAAHAIHNGFTAL+G IHHLTHGEKVAYGTLTQLFLENR +EEIDRYI+ Y
Sbjct:  241 GLGFESAGLAAAHAIHNGFTALTGAIHHLTHGEKVAYGTLTQLFLENRSREEIDRYIDFY  300

Query:  302 QAIGMPTTLAELHLGDATYEELLKVGQQATIEGETIHEMPFKISAEDVAAALLTVDRYVSN  362
            QAIGMPTTL E+HL  AT E+ LK+G+QAT+ GETIH+MPF IS EDVAAAL+ VD YV++
Sbjct:  301 QAIGMPTTLKEMHLDTATQEDFLKIGRQATMAGETIHQMPFVISPEDVAAALVAVDAYVTS  361
```

Based on this analysis, it was predicted that these proteins and their epitopes could be useful antigens for vaccines or diagnostics.

Example 1003

A DNA sequence (GBSx1063) was identified in *S. agalactiae* <SEQ ID 3079> which encodes the amino acid sequence <SEQ ID 3080>. Analysis of this protein sequence reveals the following:

---

Possible site: 28
>>> Seems to have no N-terminal signal sequence
INTEGRAL    Likelihood = −0.75    Transmembrane 262-278 (262-279)
----- Final Results -----
   bacterial membrane --- Certainty = 0.1298 (Affirmative) <succ>
     bacterial outside --- Certainty = 0.0000 (Not Clear) <succ>
       bacterial cytoplasm --- Certainty = 0.0000 (Not Clear) <succ>

---

The protein has homology with the following sequences in the GENPEPT database.

A related DNA sequence was identified in *S. pyogenes* <SEQ ID 3081> which encodes the amino acid sequence <SEQ ID 3082>. Analysis of this protein sequence reveals the following:

---

Possible site: 58
>>> Seems to have no N-terminal signal sequence
INTEGRAL    Likelihood = −0.48    Transmembrane 262-278 (262-278)
----- Final Results -----
   bacterial membrane --- Certainty = 0.1192 (Affirmative) <succ>
     bacterial outside --- Certainty = 0.0000 (Not Clear) <succ>
       bacterial cytoplasm --- Certainty = 0.0000 (Not Clear) <succ>

---

The protein has homology with the following sequences in the databases:

```
>GP: BAA88310 GB: AB028865 O-acetylserine lyase [Streptococcus suis]
Identities = 239/304 (78%), Positives = 273/304 (89%)
Query:    4 IYNSITDLIGNTPIIQLHHIVPEGAAEVYVKLESFNPGSSVKDRIALAMIEDAEQKGILK   63
            IY +IT L+G TP+I+L++IVPEGAAEVYVKLE+FNPGSSVKDRIALAMIEDAE+ G +K
Sbjct:    3 IYQNITQLVGKTPVIKLNNIVPEGAAEVYVKLEAFNPGSSVKDRIALAMIEDAEKAGTIK   62

Query:   64 AGDTIVEPTSGNTGIGLAWVGKAKGYNVIIVMPETMSIERRKIIQAYGAQLVLTPGSEGM  123
             GDTIVEPTSGNTGIGLAWVG AKGYNVIIVMPETMS+ERRKIIQAYGA+LVLTPGSEGM
Sbjct:   63 PGDTIVEPTSGNTGIGLAWVGAAKGYNVIIVMPETMSVERRKIIQAYGAELVLTPGSEGM  122

Query:  124 KGAIAKAKEISAEQNAWLPLQFNNQANPEIHEKTTGREIIETFGEKGLDAFIAGVGTGGT  183
            KGAIAKAKEI+ E+N W+P QF N +NP++HE TTG+EI+E FG  GLDAF++GVGTGGT
Sbjct:  123 KGAIAKAKEIAEEKNGWVPFQFANPSNPKVHEDTTGQEILEDEGTTGLDAFVSGVGTGGT  182

Query:  184 ITGVSRALKKVNPDVAIYAVEADESAILSGEQPGPHKIQGISAGFIPETLATDSYDHIIR  243
            ++GVS  LK  NPD+AIYAVEADESA+LSGE PGPHKIQGISAGFIP+TL T +YD IIR
Sbjct:  183 VSGVSHVLKTANPDIAIYAVEADESAVLSGEAPGPHKIQGISAGFIPDTLDTSAYDGIIR  242

Query:  244 VTSDDAIETGRIIGGLEGFLAGISASAAIYAAIEVAKQLGKGKKVLALLPDNGERYLSTS  303
            V SDDA+ TGR IGG EGFL GIS+ AAI+AAIEVAK+LG GKKVLA+LPDNGERYLST+
Sbjct:  243 VKSDDALATGRAIGGKEGFLVGISSGAAIHAAIEVAKELGTGKKVLAILPDNGERYLSTA  302

Query:  304 LYDF                                                          307
            LY+F
Sbjct:  303 LYEF                                                          306
```

```
>GP: BAA88310 GB: AB028865 O-acetylserine lyase [Streptococcus suis]
Identities = 235/303 (77%), Positives = 261/303 (85%)
Query:    4 IYKTITELVGQTPIIKLNRLIPNEAADVYVKLEAFNPGSSVKDRIALSMIEAAEAEGLIS   63
            IY+ IT+LVG+TP+IKLN ++P  AA+VYVKLEAFNPGSSVKDRIAL+MIE AE  G I
Sbjct:    3 IYQNITQLVGKTPVIKLNNIVPEGAAEVYVKLEAFNPGSSVKDRIALAMIEDAEKAGTIK   62

Query:   64 PGDVIIEPTSGNTGIGLAWVGAAKGYRVIIVMPETMSLERRQIIQAYGAELVLTPGAEGM  123
            PGD I+EPTSGNTGIGLAWVGAAKGY VIIVMPETMS+ERR+IIQAYGAELVLTPG+EGM
Sbjct:   63 PGDTIVEPTSGNTGIGLAWVGAAKGYNVIIVMPETMSVERRKIIQAYGAELVLTPGSEGM  122

Query:  124 KGAIAKAETLAIELGAWMPMQFNNPANPSIHEKTTAQEILEAFKEISLDAFVSGVGTGGT  183
            KGAIAKA+ +A E   W+P QF NP+NP +HE TT QEILE F    LDAFVSGVGTGGT
Sbjct:  123 KGAIAKAKEIAEEKNGWVPFQFANPSNPKVHEDTTGQEILEDFGTTGLDAFVSGVGTGGT  182

Query:  184 LSGVSHVLKKANPETVIYAVEAEESAVLSGQEPGPHKIQGISAGFIPNTLDTKAYDQIIR  243
            +SGVSHVLK ANP+  IYAVEA+ESAVLSG+ PGPHKIQGISAGFIP+TLDT AYD IIR
Sbjct:  183 VSGVSHVLKTANPDIAIYAVEADESAVLSGEAPGPHKIQGISAGFIPDTLDTSAYDGIIR  242

Query:  244 VKSKDALETARLTGAKEGFLVGISSGAALYAAIEVAKQLGKGKHVLTILPDNGERYLSTE  303
            VKS DAL T R  G KEGFLVGISSGAA++AAIEVAK+LG GK VL ILPDNGERYLST
Sbjct:  243 VKSDDALATGRAIGGKEGFLVGISSGAAIHAAIEVAKELGTGKKVLAILPDNGERYLSTA  302

Query:  304 LYD                                                          306
            LY+
Sbjct:  303 LYE                                                          305
```

An alignment of the GAS and GBS proteins is shown below.

```
Identities = 222/306 (72%), Positives = 263/306 (85%)
Query:    1 MSKIYNSITDLIGNTPIIQLHHIVPEGAAEVYVKLESFNPGSSVKDRIALAMIEDAEQKG   60
            M+KIY +IT+L+G TPII+L+ ++P  AA+VYVKLE+FNPGSSVKDRIAL+MIE AE +G
Sbjct:    1 MTKIYKTITELVGQTPIIKLNRLIPNEAADVYVKLEAFNPGSSVKDRIALSMIEAAEAEG   60

Query:   61 ILKAGDTIVEPTSGNTGIGLAWVGKAKGYNVIIVMPETMSIERRKIIQAYGAQLVLTPGS  120
            ++  GD I+EPTSGNTGIGLAWVG AKGY VIIVMPETMS+ERR+IIQAYGA+LVLTPG+
Sbjct:   61 LISPGDVIIEPTSGNTGIGLAWVGAAKGYRVIIVMPETMSLERRQIIQAYGAELVLTPGA  120

Query:  121 EGMKGAIAEAKEISAEQNAWLPLQFNNQANPEIHEKTTGREIIETFGEKGLDAFIAGVGT  180
            EGMKGAIAKA+ ++ E  AW+P+QFNN ANP IHEKTT +EI+E F E   LDAF++GVGT
Sbjct:  121 EGMKGAIAKAETLAIELGAWMPMQFNNPANPSIHEKTTAQEILEAFKEISLDAFVSGVGT  180

Query:  181 GGTITGVSRALKKVNPDVAIYAVEADESAILSGEQPGPHKIQGISAGFIPETLATDSYDH  240
            GGT++GVS  LKK NP+  IYAVEA+ESA+LSG++PGPHKIQGISAGFIP TL T +YD
Sbjct:  181 GGTLSGVSHVLKKANPETVIYAVEAEESAVLSGQEPGPHKIQGISAGFIPNTLDTKAYDQ  240

Query:  241 IIRVTSDDAIETGRIIGGLEGFLAGISASAAIYAAIEVAKQLGKGKKVLALLPDNGERYL  300
            IIRV S DA+ET R+ G  EGFL GIS+ AA+YAAIEVAKQLGKGK VL +LPDNGERYL
Sbjct:  241 IIRVKSKDALETARLTGAKEGFLVGISSGAALYAAIEVAKQLGKGKHVLTILPDNGERYL  300

Query:  301 STSLYD                                                       306
            ST LYD
Sbjct:  301 STELYD                                                       306
```

Based on this analysis, it was predicted that these proteins and their epitopes could be useful antigens for vaccines or diagnostics.

Example 1004

A DNA sequence (GBSx1064) was identified in *S. agalactiae* <SEQ ID 3083> which encodes the amino acid sequence <SEQ ID 3084>. Analysis of this protein sequence reveals the following:

Possible site: 56
>>> Seems to have no N-terminal signal sequence

----- Final Results ----- bacterial cytoplasm --- Certainty = 0.3666 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP: BAB07349 GB: AP001519 unknown conserved protein [Bacillus halodurans]
Identities = 96/204 (47%), Positives = 127/204 (62%)
```

-continued

```
Query:    2 NYKTIKSDGIVEEEIKKSRFICHLKRVESEEEGRNYITQIKKAHYKANHSCSAMVIGEKG    61
            +Y T+K  GI E   I+KSRFI HL R  SEEE   +I QIKK H+ A H+CSA +IGE
Sbjct:    4 SYYTVKESGIHEISIQKSRFIAHLSRATSEEEAIQFIEQIKKEHWNATHNCSAYLIGEND    63

Query:   62 DIKRSSDDGEPSGTAGIPMLTVLEKQGLTNVVAVVTRYFGGIKLGAGGLIRAYSGSVANT  121
            +++++DDGEPSGTAG+PML VL+K+ L + VAVVTRYFGG+KLGAGGLIRAY  +V++
Sbjct:   64 QVQKANDDGEPSGTAGVPMLEVLKKARLKDTVAVVTRYFGGVKLGAGGLIRAYGSAVSDG  123

Query:  122 IKEIGVVEVKEQIGIRIQLTYPQYQTFDNFLKEHHLQEFETEFLEAVTCKIYVDPKEFEH  181
            +  IGVVE K   I  + Y    +N L++ H   E  +LE V  + YV    E E
Sbjct:  124 LNAIGVVERKRMQVIHTSIDYHWLGKVENELRQSHYLLKEISYLENVDVQTYVLEAEVES  183

Query:  182 TITNLTEFYQGKALLTEEGSQIVE                                     205
             +T    G+A  T     + +E
Sbjct:  184 YCEWMTNLTNGQAAFTHGAIEYLE                                     207
```

A related DNA sequence was identified in *S. pyogenes* <SEQ ID 3085> which encodes the amino acid sequence <SEQ ID 3086>. Analysis of this protein sequence reveals the following:

---

Possible site: 36
>>> Seems to have no N-terminal signal sequence
INTEGRAL    Likelihood = −0.43    Transmembrane 86-102 (86-102)
----- Final Results -----
    bacterial membrane --- Certainty = 0.1171 (Affirmative) <succ>
        bacterial outside --- Certainty = 0.0000 (Not Clear) <succ>
            bacterial cytoplasm --- Certainty = 0.0000 (Not Clear) <succ>

---

A related sequence was also identified in GAS <SEQ ID 9153> which encodes the amino acid sequence <SEQ ID 9154>. Analysis of this protein sequence reveals the following:

---

Possible site: 31
>>> Seems to have no N-terminal signal sequence
INTEGRAL    Likelihood = −0.43    Transmembrane 81-97 (81-97)
----- Final Results -----
    bacterial membrane --- Certainty = 0.1171 (Affirmative) <succ>
        bacterial outside --- Certainty = 0.0000 (Not Clear) <succ>
            bacterial cytoplasm --- Certainty = 0.0000 (Not Clear) <succ>

---

An alignment of the GAS and GBS proteins is shown below.

Based on this analysis, it was predicted that these proteins and their epitopes could be useful antigens for vaccines or diagnostics.

Example 1005

A DNA sequence (GBSx1065) was identified in *S. agalactiae* <SEQ ID 3087> which encodes the amino acid sequence <SEQ ID 3088>. Analysis of this protein sequence reveals the following:

---

Possible site: 45
>>> Seems to have no N-terminal signal sequence
----- Final Results -----
    bacterial cytoplasm --- Certainty = 0.1421 (Affirmative) <succ>
        bacterial membrane --- Certainty = 0.0000 (Not Clear) <succ>
            bacterial outside --- Certainty = 0.0000 (Not Clear) <succ>

---

The protein has homology with the following sequences in the GENPEPT database.

```
Identities = 122/206 (59%), Positives = 153/206 (74%)

Query:    2 NYKTIKSDGIVEEEIKKSRFICHLKRVESEEEGRNYITQIKKAHYKANHSCSAMVIGEKG    61
                ++KTIK+ G  EE IKKSRFICH+KRV +EE+G+N++  IKK HYKANHSC AM+IG
    Sbjct:    8 HFKTIKASGFFEESIKKSRFICHIKRVSTEEDGKNFVNAIKKEHYKANHSCFAMIIGNNR    67

Query:   62 DIKRSSDDGEPSGTAGIPMLTVLEKQGLTNVVAVVTRYFGGIKLGAGGLIRAYSGSVANT  121
                 IKRSSDDGEPSGTAGIP+L+VLEKQ LTNVV VVTRYFGGIKLG GGLIRAYS    A
    Sbjct:   68 QIKRSSDDGEPSGTAGIPILSVLEKQCLTNVVVVVTRYFGGIKLGTGGLIRAYSNMTATA  127

Query:  122 IKEIGVVEVKEQIGIRIQLTYPQYQTFDNFLKEHHLQEFETEFLEAVTCKIYVDPKEFEH  181
                IK  G++EVK+QIG+ I L+YPQYQ + N L +  L E ET+F + +    +Y D +  E+
    Sbjct:  128 IKRFGIIEVKQQIGLEITLSYPQYQLYSNLLDQLALTETETKFSDTIKTTLYCDTERVEN  187

Query:  182 TITNLTEFYQGKALLTEEGSQIVEIP                                   207
                   I   LT +Y G+   + GS+++E P
    Sbjct:  188 LIDTLTNYYHGQISCEKIGSKVIEFP                                   213
```

```
>GP: AAC44940 GB: U56901 involved in transformation [Bacillus subtilis]
Identities = 160/405 (39%), Positives = 228/405 (55%), Gaps = 20/405 (4%)
Query:  35 YICTRCSSSVAKNCQL----PTGNYYCRECIVFGRVTSNENLYYFPQKTFSKTNSLK--W   88
           Y C RC + +          YCR C++ GRV+    LY + ++   S   S+K   W
Sbjct:  58 YRCNRCGQTDQRYFSFYHSSGKNKLYCRSCVMMGRVSEEVPLYSWKEENESNWKSIKLTW  117

Query:  89 KGELTPYQNEVSEELLKGISSKENLLVHAVTGAGKTEMIYHSVAKVIDTGGSVCIASPRI  148
              G+L+  Q + +  L++ IS KE LL+ AV GAGKTEM++  +    ++ G  VCIA+PR
Sbjct: 118 DGKLSSGQQKAANVLIEAISKKEELLIWAVCGAGKTEMLFPGIESALNQGLRVCIATPRT  177

Query: 149 DVCLELYKRLSNDFRCA-ITLMHGESPSYQR-SPLTIATTHQLLKFYHAFDLLIVDEVDA  206
           DV LEL  RL    F+ A I+  ++G S     R SPL I+TTHQLL++  A D++I+DEVDA
Sbjct: 178 DVVLELAPRLKAAFQGADISALYGGSDDKGRLSPLMISTTHQLLRYKDAIDVMIIDEVDA  237

Query: 207 FPYVDNPILYQGVKQALKENGTSIFLTATSTTELERKVARKELKKLHLARRFHANPLVIP  266
           FPY + L   V++A K+N T ++L+AT    EL+RK    +L + +  R H  PL   P
Sbjct: 238 FPYSADQTLQFAVQKARKKNSTLVYLSATPPKELKRKALNGQLHSVRIPARHHRKPLPEP  297

Query: 267 EMVWVSGIQKSLQTQKLPPKLYQLINKQRQTRYPLLLFFPHISEGQVFTEILRQAFPMEK  326
              VW    +K L    K+PP + + I    +    P+ LF P +S       IL +A    K
Sbjct: 298 RFVWCGNWKKKLNRNKIPPAVKRWIEFHVKEGRPVFLFVPSVS-------ILEKAAACFK  350

Query: 327 -----IGFVSSKSTSRLKLVQDFRDNKLSILVSTTILERGVTFPSVDVFVIQANHHLFTK  381
                  V ++    R + VQ FRD +L +L++TTILERGVT P V   V+ A     +FT+
Sbjct: 351 GVHCRTASVHAEDKHRKEKVQQFRDGQLDLLITTTILERGVTVPKVQTGVLGAESSIFTE  410

Query: 382 SSLVQISGRVGRALERPEGLLYFLHDGKSKSMHQAIKEIKNMNHI                426
           S+LVQI+GR GR   E   +G + +  H GK+KSM   A K  IK MN +
Sbjct: 411 SALVQIAGRTGRHKEYADGDVIYFHFGKTKSMLDARKHIKEMNEL                455
```

A related DNA sequence was identified in *S. pyogenes* <SEQ ID 3089> which encodes the amino acid sequence <SEQ ID 3090>. Analysis of this protein sequence reveals the following:

Possible site: 21
>>> Seems to have no N-terminal signal sequence

-continued

INTEGRAL    Likelihood = −4.09    Transmembrane 304-320 (303-322)
----- Final Results -----
bacterial membrane --- Certainty = 0.2635 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the databases:

```
!GB: U56901 involved in transformation [Bacillus subt . . . 258 1e-67
>GP: AAC44940 GB: U56901 involved in transformation [Bacillus subtilis]
Identities = 155/435 (35%), Positives = 249/435 (56%), Gaps =20/435 (4%)
Query:  10 RLLLESQLPDSAKQLAQPLK--------SVVILRGKMICQRCHYQLDEEA-----RLPSG   56
           R LL ++L  S + +   +K           S+ I + +  C RC    Q D+
Sbjct:  22 RHLLRTELSFSDEMIEWHIKNGYITAENSISINKRRYRCNRCG-QTDQRYFSFYHSSGKN   80

Query:  57 AYYCRFCLVFGRNQSDKLLYAIPPMHFP--KGNYLVWGGQLTAYQEMISQQLLINMQNQK  114
           YCR C++ GR + LY+    + K   L W G+L++ Q+ + L+ + ++
Sbjct:  81 KLYCRSCVMMGRVSEEVPLYSWKEENESNWKSIKLTWDGKLSSGQQKAANVLIEAISKKE  140

Query: 115 TTLVHAVTGAGKTEMIYAAIEAVINTGGWVCIASPRVDVCVEVATRLSQAFS-CSICLMH  173
           L+ AV GAGKTEM++   IE+ +N G   VCIA+PR DV +E+A RL AF     I  ++
Sbjct: 141 ELLIWAVCGAGKTEMLFPGIESALNQGLRVCIATPRTDVVLELAPRLKAAFQGADISALY  200

Query: 174 AESLPYQR-APIIVATTHQLLKFHKAFDLLIIDEVDAFPFVNNIQLHYAASQALKEGGAK  232
           S      R +P+++++TTHQLL++  A D++IIDEVDAFP+ +  L +A +A K+
Sbjct: 201 GGSDDKGRLSPLMISTTHQLLRYKDAIDVMIIDEVDAFPYSADQTLQFAVQKARKKNSTL  260

Query: 233 ILLTATSTRTLERKVNKGEVVKLTLARRFHNRPLVIPKFIRSFNLFKMIHRQKLPLKILK  292
           + L+AT   + L+RK   G++    + + R H +PL  P+F+   N  K  ++R K+P + +
Sbjct: 261 VYLSATPPKELKRKALNGQLHSVRIPARHHRKPLPEPRFVWCGNWKKKLNRNKIPPAVKR  320

Query: 293 YLKKQRKTGYPLLIFLPTIIMAESVTAILKELLPAEQIACVSSQSQNRKEDITAFRQGKK  352
           +++     K G P+ +F+P++ + E   A  K +    + A V ++ ++RKE +  FR G+
Sbjct: 321 WIEFHVKEGRPVFLFVPSVSILEKAAACFKGV--HCRTASVHAEDKHRKEVQQFRDGQL  378

Query: 353 TILITTSILERGVTFPQIDVFVLGSHHRVYSSQSLVQIAGRVGRSIDRPDGTLYFFHEGI  412
           +LITT+ILERGVT P++    VLG+   +++   +LVQIAGR GR   + DG +++FH G
Sbjct: 379 DLLITTTILERGVTVPKVQTGVLGAESSIFTESALVQIAGRTGRHKEYADGDVIYFHFGK  438

Query: 413 SKAMLLARKEIKEMN                                               427
           +K+ML  ARK IKEMN
Sbjct: 439 TKSMLDARKHIKEMN                                               453
```

An alignment of the GAS and GBS proteins is shown below.

```
Identities = 223/427 (52%), Positives = 299/427 (69%)
Query:   1 MENYLGRLWTKAQLSEQLRKIAISLPSFIKKGSDYICTRCSSSVAKNCQLPTGNYYCREC   60
           +EN  GRL ++QL +  +++A  L S +      IC RC   + +  +LP+G YYCR C
Sbjct:   4 IENSYGRLLLESQLPDSAKQLAQPLKSVVILRGKMICQRCHYQLDEEARLPSGAYYCRFC   63

Query:  61 IVFGRVTSNENLYYFPQKTFSKTNSLKWKGELTPYQNEVSEELLKGISSKENLLVHAVTG  120
           +VFGR  S++ LY  P    F K N L W G+LT YQ  +S++LL   + +++  LVHAVTG
Sbjct:  64 LVFGRNQSDKLLYAIPPMHFPKGNYLVWGGQLTAYQEMISQQLLINMQNQKTTLVHAVTG  123

Query: 121 AGKTEMIYHSVAKVIDTGGSVCIASPRIDVCLELYKRLSNDFRCAITLMHGESPSYQRSP  180
           AGKTEMIY ++  VI+TGG VCIASPR+DVC+E+  RLS   F C+I LMH ES   YQR+P
Sbjct: 124 AGKTEMIYAAIEAVINTGGWVCIASPRVDVCVEVATRLSQAFSCSICLMHAESLPYQRAP  183

Query: 181 LTIATTHQLLKFYHAFDLLIVDEVDAFPYVDNPILYQGVKQALKENGTSIFLTATSTTEL  240
           + +ATTHQLLKF+ AFDLLI+DEVDAFP+V+N  L+     QALKE G  I LTATST  L
Sbjct: 184 IIVATTHQLLKFHKAFDLLIIDEVDAFPFVNNIQLHYAASQALKEGGAKILLTATSTRTL  243

Query: 241 ERKVARKELKKLHLARRFHANPLVIPEMVWVSGIQKSLQTQKLPPKLYQLINKQRQTRYP  300
           ERKV + E+ KL LARRFH  PLVIP+ +     + K +  QKLP K+ + + KQR+T YP
Sbjct: 244 ERKVNKGEVVKLTLARRFHNRPLVIPKFIRSFNLFKMIHRQKLPLKILKYLKKQRKTGYP  303

Query: 301 LLLFFPHISEGQVFTEILRQAFPMEKIGFVSSKSTSRLKLVQDFRDNKLSILVSTTILER  360
           LL+F  P I    + T IL++  P E+I  VSS+S +R + +   FR  K +IL++T+ILER
Sbjct: 304 LLIFLPTIIMAESVTAILKELLPAEQIACVSSQSQNRKEDITAFRQGKKTILITTSILER  363

Query: 361 GVTFPSVDVFVIQANHHLFTKSSLVQISGRVGRALERPEGLLYFLHDGKSKSMHQAIKEI  420
           GVTFP +DVFV+ ++H +++   SLVQI+GRVGR+++RP+G LYF H+G SK+M  A KEI
Sbjct: 364 GVTFPQIDVFVLGSHHRVYSSQSLVQIAGRVGRSIDRPDGTLYFFHEGISKAMLLARKEI  423

Query: 421 KNMNHIG                                                       427
           K MN+ G
Sbjct: 424 KEMNYKG                                                       430
```

Based on this analysis, it was predicted that these proteins and their epitopes could be useful antigens for vaccines or diagnostics.

Example 1006

A DNA sequence (GBSx1066) was identified in *S. agalactiae* <SEQ ID 3091> which encodes the amino acid sequence <SEQ ID 3092>. This protein is predicted to be comf operon protein 3 (comFC). Analysis of this protein sequence reveals the following:

Possible site: 41
>>> Seems to have no N-terminal signal sequence
----- Final Results -----
bacterial cytoplasm --- Certainty = 0.0894 (Affirmative) <succ>

-continued bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP: AAC44942 GB: U56901 involved in transformation [Bacillus subtilis]
Identities = 76/230 (33%), Positives = 118/230 (51%), Gaps = 11/230 (4%)
Query:   1 MTCLLCHEIDLSQLTFVELMLLKPKQNVICQTCKGSFEALSREMGCQTCCK-QIPQKQCQ   59
           M CLLC     +T+  L LLKP + V C +C+   + ++   + C  C + Q      C+
Sbjct:   1 MICLLCDSQFSQDVTWRALFLLKPDEKV-CYSCRSKLKKITGHI-CPLCGRPQSVHAVCR   58

Query:  60 DCIYWGKKGIEV----NHFSLYRYNEAMKKNFSLFKFQGDYLLKDVFTKEIKAALKKY--  113
           DC  W + +       + S+Y YN+ MK+  S FKF+GD + + F  +  K
Sbjct:  59 DCEVWRTRIRDSLLLRQNRSVYTYNDMMKETLSRFKFRGDAEIINAFKSDFSSTFSKVYP  118

Query: 114 -KGYTIVPVPLSHEGYQNRQFNQVIAFLQSANIPYKNILSKKDGGKQSANNKEERLKQVQ  172
            K + +VP+PLS E  + R FNQ      +  +P + L + + KQS   K ERL
Sbjct: 119 DKHFVLVPIPLSKEREEERGFNQAHLLAECLDRPSHHPLIRLNNEKQSKKKKTERLLSEC  178

Query: 173 QFTLKNEAELGDNLLIVDDIYTTGATIAQIRKLLEEKG-IKNIKSFSLAR            221
           F  KN +  G N++++DD+YTTGAT+     + L EKG  ++ SF+L R
Sbjct: 179 IFDTKNNSAEGMNIILIDDLYTTGATLHFAARCLLEKGKAASVSSFTLIR            228
```

A related DNA sequence was identified in *S. pyogenes* <SEQ ID 3093> which encodes the amino acid sequence <SEQ ID 3094>. Analysis of this protein sequence reveals the following:

Possible site: 52
>>> Seems to have no N-terminal signal sequence
----- Final Results -----

```
            bacterial cytoplasm --- Certainty = 0.0763 (Affirmative) <succ>
            bacterial membrane --- Certainty = 0.0000 (Not Clear) <succ>
             bacterial outside --- Certainty = 0.0000 (Not Clear) <succ>
```

An alignment of the GAS and GBS proteins is shown below.

```
Identities = 100/222 (45%), Positives = 139/222 (62%), Gaps = 2/222 (0%)
Query:   1  MTCLLCHEIDLSQLTFVELMLLKPKQNVICQTCKGSFEALSREMGCQTCCKQIPQKQCQD   60
            M CLLC +I  + ++   E++ L+   + ICQ C+ SF+ + + + C TCC         C+D
Sbjct:   1  MICLLCQQISQTPISITEIIFLERISSPICQQCQKSFQKIGKSV-CATCCANSDIIACRD   59

Query:  61  CIYWGKKGIEVNHFSLYRYNEAMKKNFSLFKFQGDYLLKDVFTKEIKAALKKY-KGYTIV   119
            C+ W   KG VNH SLY YN AMK  FS +KFQGDYLL+ VF  E+    + KY KGY V
Sbjct:  60  CLKWENKGYNVNHRSLYCYNAAMKAYFSQYKFQGDYLLRKVFAVELADVITKYYKGYIPV   119

Query: 120  PVPLSHEGYQNRQFNQVIAFLQSANIPYKNILSKKDGGKQSANNKEERLKQVQQFTLKNE   179
            PVP+S    ++ RQFNQV A L++AN+ Y ++  K D    QS+  K+ERL    + + L
Sbjct: 120  PVPVSPGCFRERQFNQVSAILEAANVSYLSLFEKLDNTHQSSRTKKERLLVEKSYRLLKV   179

Query: 180  AELGDNLLIVDDIYTTGATIAQIRKLLEEKGIKNIKSFSLAR                    221
            + + D +LIVDDIYTTG+TI  +RK L +      +IKS S+AR
Sbjct: 180  SNIPDKILIVDDIYTTGSTIIALRKQLAKVANSDIKSLSIAR                    221
```

Based on this analysis, it was predicted that these proteins and their epitopes could be useful antigens for vaccines or diagnostics.

Example 1007

A DNA sequence (GBSx1067) was identified in *S. agalactiae* <SEQ ID 3095> which encodes the amino acid sequence <SEQ ID 3096>. Analysis of this protein sequence reveals the following:

```
Possible site: 16
>>> Seems to have no N-terminal signal sequence
----- Final Results -----
    bacterial cytoplasm --- Certainty = 0.3889 (Affirmative) <succ>
    bacterial membrane --- Certainty = 0.0000 (Not Clear) <succ>
     bacterial outside --- Certainty = 0.0000 (Not Clear) <succ>
```

The protein has homology with the following sequences in the GENPEPT database.

```
>GP:CAB91549 GB:AJ249134 hypothetical protein [Lactococcus lactis]
Identities = 107/185 (57%), Positives = 140/185 (74%), Gaps = 3/185 (1%)
Query:   1  MIKYSIRGENIEVTEAIREYVETKLSKVEKYFNEAQELDTRVNLKVYREKTAKVEVTILI   60
            MIK++IRGEN+EVT AIR YVE K+ K++KYFN+   E+    VNLKVY EK AKVEVT+
Sbjct:   1  MIKFNIRGENVEVTDAIRAYVEDKIGKLDKYFNDGHEVTAYVNLKVYTEKRAKVEVTLPA   60

Query:  61  DSITLRAEDVSQDMYGSIDLVVDKIERQIRKNKTKIAKKYREKIPASQVFTTEFEAEPDE   120
            ++TLRAED SQDMY SID V +K+ERQIRK KT++ +K  R +P   QVF   EF
Sbjct:  61  KNVTLRAEDTSQDMYSSIDEVEEKLERQIRKYKTRMNRKPRNAVPTGQVFGDEFAPLDTT   120

Query: 121  EAVSQ---RIVRTKNVNLKPMDVEEALLQMELLGHDFFIYTDAEDNTTNVLYKREDGELG   177
            + V++     IVRTK+V LKPMD EEA+LQM++LGHDF+++TDA+ N T+V+Y+R DG  G
Sbjct: 121  DEVAEDHVDIVRTKHVALKPMDAEEEAVLQMDMLGHDFYVFTDADSNGTHVVYRRTDGRYG   180

Query: 178  LIEAK                                                         182
            LIE +
Sbjct: 181  LIETE                                                         185
```

A related DNA sequence was identified in *S. pyogenes* <SEQ ID 3097> which encodes the amino acid sequence <SEQ ID 3098>. Analysis of this protein sequence reveals the following:

```
Possible site: 16
>>> Seems to have no N-terminal signal sequence
----- Final Results -----
    bacterial cytoplasm --- Certainty = 0.3751 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
Identities = 145/182 (79%), Positives = 165/182 (89%)
Query:   1  MIKYSIRGENIEVTEAIREYVETKLSKVEKYFNEAQELDTRVNLKVYREKTAKVEVTILI   60
            MIK+SIRGENIEVTEAIR+YVE+KL+K+EKYF + QE+D RVNLKVYRE+++KVEVTI +
Sbjct:   1  MIKFSIRGENIEVTEAIRDYVESKLTKIEKYFAKDQEIDARVNLKVYRERSSKVEVTIPL   60

Query:  61  DSITLRAEDVSQDMYGSIDLVVDKIERQIRKNKTKIAKKYREKIPASQVFTTEFEAEPDE  120
            DS+TLRAEDVSQDMYGSIDLVVDKIERQIRKNKTKIAKK+REK+P  QVFTTEFEAE  +
Sbjct:  61  DSVTLRAEDVSQDMYGSIDLVVDKIERQIRKNKTKIAKKHREKVPTGQVFTTEFEAEEVD  120

Query: 121  EAVSQRIVRTKNVNLKPMDVEEALLQMELLGHDFFIYTDAEDNTTNVLYKREDGELGLIE  180
            E    ++VRTKNV LKPMDVEEA LQMELLGHDFFIYTD+ED   TN+LY+REDG LGLIE
Sbjct: 121  EIPEVQVVRTKNVTLKPMDVEEARLQMELLGHDFFIYTDSEDGATNILYRREDGNLGLIE  180

Query: 181  AK                                                           182
            AK
Sbjct: 181  AK                                                           182
```

Based on this analysis, it was predicted that these proteins and their epitopes could be useful antigens for vaccines or diagnostics.

Example 1008

A DNA sequence (GBSx1068) was identified in *S. agalactiae* <SEQ ID 3099> which encodes the amino acid sequence <SEQ ID 3100>. Analysis of this protein sequence reveals the following:

```
Possible site: 16
>>> Seems to have no N-terminal signal sequence
```

-continued

```
----- Final Results -----
    bacterial cytoplasm --- Certainty = 0.0685 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1009

A DNA sequence (GBSx1077) was identified in *S. agalactiae* <SEQ ID 3101> which encodes the amino acid sequence <SEQ ID 3102>(sgaT). Analysis of this protein sequence reveals the following:

```
Possible site: 41
>>> Seems to have a cleavable N-term signal seq.
INTEGRAL    Likelihood = –5.95    Transmembrane 99-115 (87-115)
INTEGRAL    Likelihood = –3.50    Transmembrane 43-59 (42-60)
----- Final Results -----
    bacterial membrane --- Certainty = 0.3378 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:BAB03942 GB:AP001507 unknown conserved protein [Bacillus halodurans]
Identities = 47/111 (42%), Positives = 76/111 (68%), Gaps = 5/111 (4%)
Query:   1  MAIIYLIVAVFAG--EAYIAKEI---SNGVNGLVYALQLAGQFAAGVFVILAGVRLILGE   55
            M I++L+ A+       A+E+   S   +YA+   FA G+ V+L GV++ +GE
Sbjct: 233  MGILFLVGAIILALKDTQGAQELIAQSGEQSFFIYAIIQSFMFAGGIAVVLLGVKMFIGE  292

Query:  56  IVPAFKGISEKLVPNSKPALDCPIVYPYAPNAVLIGFISKFVGGLVSMIVM          106
            +VPAF GI+ KLVP ++PALD P+V+P APNAV++GF+  FVG L+ ++V+
Sbjct: 293  VVPAFNGIATKLVPGARPALDAPVVFPMAPNAVILGFLGAFVGALIWLVVI          343
```

There is also homology to SEQ ID 516.

Based on this analysis, it was predicted that this protein and its epitopes, could be useful antigens for vaccines or diagnostics.

Example 1010

A DNA sequence (GBSx1078) was identified in *S. agalactiae* <SEQ ID 3103> which encodes the amino acid sequence <SEQ ID 3104>. This protein is predicted to be tryptophanyl-tRNA synthetase (trpS). Analysis of this protein sequence reveals the following:

Possible site: 50
>>> Seems to have no N-terminal signal sequence
----- Final Results -----
   bacterial cytoplasm --- Certainty = 0.2156 (Affirmative) <succ>
   bacterial membrane --- Certainty = 0.0000 (Not Clear) <succ>
   bacterial outside --- Certainty = 0.0000 (Not Clear) <succ>

Possible site: 54
>>> Seems to have no N-terminal signal sequence
----- Final Results -----
   bacterial cytoplasm --- Certainty = 0.2737 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

An alignment of the GAS and GBS proteins is shown below.

```
>GP:AAC05711 GB:L49336 tryptophanyl-tRNA synthetase [Clostridium longisporum]
Identities = 225/340 (66%), Positives = 271/340 (79%), Gaps = 3/340 (0%)
Query:    1 MTKPIILTGDRPTGKLHIGHYVGSLKNRVLLQNEGSYTLFVFLADQQALTDHAKDPQTIV   60
            M K IILTGDRPTGKLHIGHYVGSLKNRV LQN G Y  F+ +ADQQALTD+A++P+ I
Sbjct:    1 MAKEIILTGDRPTGKLHIGHYVGSLKNRVQLQNSGDYRSFIMIADQQALTDNARNPEKIR   60

Query:   61 ESIGNVALDYLAVGLDPNKSTLFIQSQIPELAELSMYYMNLVSLARLERNPTVKTEIAQK  120
            S+  VALDYLAVG+DP KST+ +QSQIPEL EL+M+Y+NLV+L+RLERNPTVK EI QK
Sbjct:   61 NSLIEVALDYLAVGIDPLKSTILVQSQIPELNELTMHYLNLVTLSRLERNPTVKAEIKQK  120

Query:  121 GFGESIPAGFLVYPVAQAADITAFKANLVPVGTDQKPMIEQTREIVRSFNHAYNCQVLVE  180
            F  SIPAGFL+YPV+QAADITAFKA  VPVG DQ PMIEQ REIVRSFN  Y   +VLVE
Sbjct:  121 NFENSIPAGFLIYPVSQAADITAFKATTVPVGEDQLPMIEQAREIVRSFNTIYGKEVLVE  180

Query:  181 PEGIYPENDAAGRLPGLDGNAKMSKSLNNGIFLADDMDTVKKKVMSMYTDPNHIKVEEPG  240
            P+ + P+     GRLPG DG AKMSKS+ N I+LAD+ D +K+KVMSMYTDPNHIKV +PG
Sbjct:  181 PKAVIPKG-TIGRLPGTDGKAKMSKSIGNAIYLADEADVIKQKVMSMYTDPNHIKVTDPG  239

Query:  241 QIEGNMVFHYLDVFGRDEDQKEITAMKEHYQKGGLGDVKTKRYLLDILERELSPIRERRL  300
            Q+EGN VF YLD F +D + E   MK HY +GGLGDVK K++L +IL+ EL PIR RR
Sbjct:  240 QVEGNTVFTYLDTFCKDTETLE--EMKAHYSRGGLGDVKVKKFLNEILQAELEPIRNRRK  297

Query:  301 EYAKDMGQVYQMLQKGSEKAQAVAASTLDEVKSAMGLNYF                     340
            E+ KD+ +VY++L++GSEKA+ VAA TL EV+  +G+ YF
Sbjct:  298 EFQKDIPEVYRILKEGSEKAREVAAGTLKEVRETIGIEYF                     337
```

A related DNA sequence was identified in *S. pyogenes* <SEQ ID 3105> which encodes the amino acid sequence <SEQ ID 3106>. Analysis of this protein sequence reveals the following:

```
                    Identities = 290/340 (85%), Positives = 316/340 (92%)

Query:    1 MTKPIILTGDRPTGKLHIGHYVGSLKNRVLLQNEGSYTLFVFLADQQALTDHAKDPQTIV   60
                    MTKPIILTGDRPTGKLH+GHYVGSLKNRV LQNE  Y +FVFLADQQALTDHAK+ + I
        Sbjct:    2 MTKPIILTGDRPTGKLHLGHYVGSLKNRVFLQNENKYKMFVFLADQQALTDHAKESELIQ   61

Query:   61 ESIGNVALDYLAVGLDPNKSTLFIQSQIPELAELSMYYMNIVSLARLERNPTVKTEIAQK  120
                    ESIGNVALDYL+VGLDP +ST+FIQSQIPELAELSMYYMNLVSLARLERNPTVKTEIAQK
        Sbjct:   62 ESIGNVALDYLSVGLDPKQSTIFIQSQIPELAELSMYYMNLVSLARLERNPTVKTEIAQK  121

Query:  121 GFGESIPAGFLVYPVAQAADITAFKANLVPVGTDQKPMIEQTREIVRSFNHAYNCQVLVE  180
                    GFGESIP+GFLVYPV+QAADITAFKANLVPVG DQKPMIEQTREIVRSFNH Y+    LVE
        Sbjct:  122 GFGESIPSGFLVYPVSQAADITAFKANLVPVGNDQKPMIEQTREIVRSFNHTYHTDCLVE  181

Query:  181 PEGIYPENDAAGRLPGLDGNAKMSKSLNNGIFLADDMDTVKKKVMSMYTDPNHIKVEEPG  240
                    PEGIYPEN+ AGRLPGLDGNAKMSKSL NGI+L+DD DTV+KKVMSMYTDPNHIK+E+PG
        Sbjct:  182 PEGIYPENEKAGRLPGLDGNAKMSKSLGNGIYLSDDADTVRKKVMSMYTDPNHIKIEDPG  241

Query:  241 QIEGNMVFHYLDVFGRDEDQKEITAMKEHYQKGGLGDVKTKRYLLDILERELSPIRERRL  300
                    QIEGNMVFHYLD+F R EDQ +I AMKEHYQ GGLGDVKTKRYLLDILEREL+PIRERRL
        Sbjct:  242 QIEGNMVFHYLDIFARKEDQADIEAMKEHYQIGGLGDVKTKRYLLDILERELAPIRERRL  301

Query:  301 EYAKDMGQVYQMLQKGSEKAQAVAASTLDEVKSAMGLNYF                     340
                    EYAKDMG+V++MLQ+GS+KA  VAA TL EVKSAMG+NYF
        Sbjct:  302 EYAKDMGEVFRMLQEGSQKARTVAAKTLSEVKSAMGINYF                     341
```

Based on this analysis, it was predicted that these proteins and their epitopes could be useful antigens for vaccines or diagnostics.

Example 1011

A DNA sequence (GBSx1079) was identified in *S. agalactiae* <SEQ ID 3107> which encodes the amino acid sequence <SEQ ID 3108>. This protein is predicted to be carbamate kinase. Analysis of this protein sequence reveals the following:

Possible site: 24
>>> Seems to have no N-terminal signal sequence
----- Final Results -----
bacterial cytoplasm --- Certainty = 0.0013 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

A related DNA sequence was identified in *S. pyogenes* <SEQ ID 3109> which encodes the amino acid sequence <SEQ ID 3110>. Analysis of this protein sequence reveals the following:

Possible site: 22
>>> Seems to have no N-terminal signal sequence
----- Final Results -----
bacterial cytoplasm --- Certainty = 0.0013 (Affirmative) <succ>
bacterial membrane --- Certainty = 0.0000 (Not Clear) <succ>
bacterial outside --- Certainty = 0.0000 (Not Clear) <succ>

```
>GP:CAA04684 GB:AJ001330 carbamate kinase [Lactobacillus sakei]
Identities = 199/311 (63%), Positives = 254/311 (80%), Gaps = 3/311 (0%)
Query:   6  QKIVVALGGNAILSTDASAKAQQEALINTSKSLVKLIKEGHDVIVTHGNGPQVGNLLLQQ    65
            +KIVVALGGNAILSTDASA AQ +A+  T K LV  +K+G  +I++HGNGPQVGNLL+QQ
Sbjct:   4  RKIVVALGGNAILSTDASANAQIKAVKETVKQLVAFVKQGDQLIISHGNGPQVGNLLIQQ    63

Query:  66  AASDSEKNPAMPLDTCVAMTEGSIGFWLQNALNNELQEQGIDKEVATVVTQVIVDEKDQA   125
            AASDSEK PAMPLDT  AM++G IG+W+QNA N  L E+G+  +VAT+VTQ IVD KD+A
Sbjct:  64  AASDSEKTPAMPLDTVGAMSQGEIGYWMQNAFNEVLAEEGLALDVATIVTQTIVDAKDEA   123

Query: 126  FTNPTKPIGPFLSEEDAKKQAQ-ETGSKFKEDAGRGWRKVVPSPKPVGIKEASVIRRLVD   184
            F NPTKPIGPF SE +AKKQ     + F EDAGRGWR+VVPSP+P+GI+EA VI++LV+
Sbjct: 124  FQNPTKPIGPFYSEAEAKKQQSINPEAHFVEDAGRGWRRVVPSPRPIGIQEAPVIQKLVE   183

Query: 185  SGVVVISAGGGGVPVIEDANTKALKGVEAVIDKDFASQTLSELVDADLFIVLTGVDNVFV   244
               V+ ISAGGGGVPV ++ N   L+GVEAVIDKDFAS+ L+ELV AD+  I+LT VDNV+V
Sbjct: 184  GNVITISAGGGGVPVAKEGN--KLRGVEAVIDKDFASEKLAELVGADMLIILTAVDNVYV   241

Query: 245  NFNKPNQEKLEEVTVSQMKQYITENQFAPGSMLPKVEAAIAFVENKPESRAIITSLENID   304
            NFNKP+Q+KL  V+V++++ YI ++QFA GSMLPK++ AI +V N+P+S+AIITSL+N+
Sbjct: 242  NFNKPDQKKLTNVSVAELEDYIKDDQFAKGSMLPKIQTAIEYVNNRPDSKAIITSLDNVK   301

Query: 305  NVLAQNAGTQI                                                  315
            N+LA +AGT I
Sbjct: 302  NLLAHDAGTII                                                  312
```

An alignment of the GAS and GBS proteins is shown below.

```
Identities = 275/312 (88%), Positives = 295/312 (94%)
Query:   6  QKIVVALGGNAILSTDASAKAQQEALINTSKSLVKLIKEGHDVIVTHGNGPQVGNLLLQQ    65
            QKIVVALGGNAILSTDASAKAQQEALI+TSKSLVKLIKEGH+VIVTHGNGPQVGNLLLQQ
Sbjct:   4  QKIVVALGGNAILSTDASAKAQQEALISTSKSLVKLIKEGHEVIVTHGNGPQVGNLLLQQ    63

Query:  66  AASDSEKNPAMPLDTCVAMTEGSIGFWLQNALNNELQEQGIDKEVATVVTQVIVDEKDQA   125
            AA+DSEKNPAMPLDTCVAMTEGSIGFWL NAL+NELQ QGI KEVA VVTQVIVD KD A
Sbjct:  64  AAADSEKNPAMPLDTCVAMTEGSIGEWLVNALDNELQAQGIQKEVAAVVTQVIVDAKDPA   123

Query: 126  FTNPTKPIGPFLSEEDAKKQAQETGSKFKEDAGRGWRKVVPSPKPVGIKEASVIRRLVDS   185
            F NPTKPIGPFL+EEDAKKQ   E+G+  FKEDAGRGWRKVVPSPKPVGIKEA+VIR LVDS
Sbjct: 124  FENPTKPIGPFLTEEDAKKQMAESGASEKEDAGRGWRKVVPSPKPVGIKEANVIRSLVDS   183

Query: 186  GVVVISAGGGGVPVIEDANTKALKGVEAVIDKDFASQTLSELVDADLFIVLTGVDNVFVN   245
            GVVV+SAGGGGVPV+EDA +K L GVEAVIDKDFASQTLSELVDADLFIVLTGVDNV+VN
Sbjct: 184  GVVVSAGGGGVPVVEDATSKTLTGVEAVIDKDFASQTLSELVDADLFIVLTGVDNVYVN   243

Query: 246  FNKPNQEKLEEVTVSQMKQYITENQFAPGSMLPKVEAAIAFVENKPESRAIITSLENIDN   305
```

```
                 FNKP+Q KLEEVTVSQMK+YIT++QFAPGSMLPKVEAAIAFVENKP ++AIITSLENIDN
Sbjct:  244      FNKPDQAKLEEVTVSQMKEYITQDQFAPGSMLPKVEAAIAFVENKPNAKAIITSLENIDN   303

Query:  306      VLAQNAGTQIVA                                                   317
                 VL+ NAGTQI+A
Sbjct:  304      VLSANAGTQIIA                                                   315
```

Based on this analysis, it was predicted that these proteins and their epitopes could be useful antigens for vaccines or diagnostics.

Example 1012

A DNA sequence (GBSx1080) was identified in *S. agalactiae* <SEQ ID 3111> which encodes the amino acid sequence <SEQ ID 3112>. This protein is predicted to be permease (potE). Analysis of this protein sequence reveals the following:

| | | |
|---|---|---|
| Possible site: 52 | | |
| >>> Seems to have an uncleavable N-term signal seq | | |
| INTEGRAL | Likelihood = −12.63 | Transmembrane 450-466 (441-478) |
| INTEGRAL | Likelihood = −8.97 | Transmembrane 236-252 (231-259) |
| INTEGRAL | Likelihood = −8.70 | Transmembrane 283-299 (277-308) |
| INTEGRAL | Likelihood = −8.44 | Transmembrane 165-181 (153-186) |
| INTEGRAL | Likelihood = −7.96 | Transmembrane 129-145 (126-151) |
| INTEGRAL | Likelihood = −6.16 | Transmembrane 396-412 (394-415) |
| INTEGRAL | Likelihood = −5.15 | Transmembrane 45-61 (38-63) |
| INTEGRAL | Likelihood = −4.94 | Transmembrane 335-351 (334-352) |
| INTEGRAL | Likelihood = −3.72 | Transmembrane 13-29 (10-30) |
| INTEGRAL | Likelihood = −2.92 | Transmembrane 417-433 (417-435) |
| INTEGRAL | Likelihood = −1.54 | Transmembrane 360-376 (360-376) |
| INTEGRAL | Likelihood = −0.53 | Transmembrane 207-223 (207-223) |
| ----- Final Results ----- | | |
| bacterial membrane --- Certainty = 0.6052 (Affirmative) <succ> | | |
| bacterial outside --- Certainty = 0.0000 (Not Clear) <succ> | | |
| bacterial cytoplasm --- Certainty = 0.0000 (Not Clear) <succ> | | |

A related GBS nucleic acid sequence <SEQ ID 10295> which encodes amino acid sequence <SEQ ID 10296> was also identified.

The protein has homology with the following sequences in the GENPEPT database.

```
>GP:CAA76779 GB:Y17554 permease [Bacillus licheniformis]
Identities = 265/470 (56%), Positives = 347/470 (73%), Gaps = 3/470 (0%)
Query:    5   MEKEKKLGLLPLTMLVIGSLIGGGIFDLMQNMSSRAGLVPMLIAWVITAIGMGTFVLSFQ    64
              M +EKKLGL  L LVIGS+IGGG F+L  +M+S AG   +LI W+IT +GM     SFQ
Sbjct:    1   MAEEKKLGLFALIALVIGSMIGGGAFNLASDMASGAGAGAILIGWIITGVGMIALAFSFQ    60

Query:   65   NLSEKRPDLTAGIFSYAKEGFGNFMGFNSAWGYWLSAWLGNVAYAALLFSSLGYFFKFFG   124
              NL+ KRPDL  GIF+YA+EGFG+FMGFNS WGYW +A LGNVAY  LLFS++GYF   FG
Sbjct:   61   NLTTKRPDLDGGIFTYAREGFGHFMGFNSGWGYWFAALLGNVAYGTLLFSAIGYFIPAFG   120

Query:  125   NGNNIISIIGASIVIWVVHFLILRGVNTAAFINTIVTFAKLVPVIIFLISALLAFKFNIF   184
              +G NI SIIGAS+++W VHFLILRGV +AA IN I T +KLVP+  F+I+ +  F ++F
Sbjct:  121   DGQNIASIIGASVILWCVHFLILRGVQSAAMINLITTISKLVPIFAFIIAIIFVFHLDLF   180

Query:  185   SLDIWGNGLH-QSIFNQVNSTMKTAVWVFIGIEGAVVFSGRAKKHSDIGKASILALFTMI   243
              + D WG GL   SI   QV STM    VWVF GIEGAV+FS RAKK SD+GKA+++ L +++
Sbjct:  181   TNDFWGKGLSLGSIGTQVKSTMLVTVWVFTGIEGAVLFSSRAKKSSDVGKATVIGLISVL   240

Query:  244   SLYVLISVLSLGIMSRPELANLKTPAMAYVLEKAVGHWGAILVNLGVIISVFGAILAWTL   303
                +YV+I++LSLG+M++    LA L   P+MA  ++E   VG WGA+L+NLG+IISV GA LAWTL
Sbjct:  241   VIYVMITMLSLGVMNQQNLAELPNPSMAAIMEHIVGKWGAVLINLGLIISVLGAWLAWTL   300

Query:  304   FAAELPYQAAKEGAFPKFFAKENKNKAPINSLLVTNLCVQAFLITFLFTQSAYRFGFALA   363
              FA ELP   AA+EG FPK+F KENKN AP N+L  +TN  +Q FL+TFL +  +AY+F F+LA
Sbjct:  301   FAGELPLIAAREGVFPKWFGKENKNGAPTNALTLINAIIQLFLLTFLISDAAYQFAFSLA   360

Query:  364   SSAILIPYAFTALYQLQFTLREDKSTPGHQKNLIIGILATIYAVYLIYAGGFDYLLLTMI   423
              SSAILIPY F+ LYQL+++       +  P    KNLIIGI+A+IY V+L+YA G DYLLLTMI
Sbjct:  361   SSAILIPYLFSGLYQLKYSWLHKE--PNRGKNLIIGIIASIYGVWLVYAAGLDYLLLTMI   418

Query:  424   AYTLGMILYIKMRKDDKLPIFVGYEKISAIVILALCLLCIIEIMTGQIDI           473
               Y  G++++  +RK  + P+F     E + A +IL L ++ +I + +G I I
Sbjct:  419   LYAPGILVFRAVRKGKEGPVFNKAELLIAALILVLAVIAVIRLASGSISI           468
```

A related DNA sequence was identified in *S. pyogenes* <SEQ ID 3113> which encodes the amino acid sequence <SEQ ID 3114>. Analysis of this protein sequence reveals the following:

| | | |
|---|---|---|
| Possible site: 51 | | |
| >>> Seems to have no N-terminal signal sequence | | |
| INTEGRAL | Likelihood = −11.52 | Transmembrane 331-347 (327-354) |
| INTEGRAL | Likelihood = −9.50 | Transmembrane 390-406 (383-410) |
| INTEGRAL | Likelihood = −8.12 | Transmembrane 50-66 (45-75) |
| INTEGRAL | Likelihood = −7.59 | Transmembrane 235-251 (234-262) |
| INTEGRAL | Likelihood = −6.21 | Transmembrane 133-149 (128-151) |
| INTEGRAL | Likelihood = −5.84 | Transmembrane 162-178 (153-183) |
| INTEGRAL | Likelihood = −2.02 | Transmembrane 105-121 (105-121) |
| INTEGRAL | Likelihood = −1.49 | Transmembrane 414-430 (414-431) |
| INTEGRAL | Likelihood = −0.69 | Transmembrane 280-296 (280-296) |
| INTEGRAL | Likelihood = −0.59 | Transmembrane 21-37 (21-37) |
| INTEGRAL | Likelihood = −0.32 | Transmembrane 205-221 (205-222) |
| ----- Final Results ----- | | |
| bacterial membrane --- Certainty = 0.5607 (Affirmative) <succ> | | |

-continued bacterial outside --- Certainty = 0.0000 (Not Clear) <succ>
bacterial cytoplasm --- Certainty = 0.0000 (Not Clear) <succ>

The protein has homology with the following sequences in the databases:

```
>GP:AAB85052 GB:AE000837 cationic amino acid transporter related
protein [Methanobacterium thermoautotrophicum]
Identities = 108/422 (25%), Positives = 213/422 (49%), Gaps = 36/422 (8%)
Query:  26 INAVIGSGIFLLPRAIYKGLGPASIAVMFGTAILTIMLAVCFAEVSGYFGKNGGAFQYSK    85
            + ++G+ I+++       LGPASI      ++ +++A+ F+E S    + GG + Y+
Sbjct:  19 VGTIVGADIYIVAAYGAGSLGPASILAWLLAGLMALIIALVFSEASAMLPRTGGPYVYAG   78

Query:  86 RAFGDFIGFNVGFLGWTVTIFAWAAMAAGFARMFIITFPAFEGWHIPL--------SIGL  137
            A G F GF      GW++ + +W A+A    +F + F  +  + IPL            +
Sbjct:  79 EALGRFTGF---ITGWSLWVSSWVAIA-----VFPLAFIYYLEYFIPLDPPAEAVIKVLF  130

Query: 138 IILLSLMNIAGLKTSKIVTITATIAKLIPIVAFCACTLFFIKNG----LPNFTPFVQLEP  193
            I+ L+++NIAG+  + V    TI K+ P++ F            +   + N+TP    +
Sbjct: 131 ILSLTIINIAGVGRAGKVNDILTILKVAPVLLFAVLGAIHLALNPGLLVSNYTPAAPMG-  189

Query: 194 GTNLLGAISNTAVYIFYGFIGFETLSIVAGEMRDPEKNVPRALLGSISIVSVLYMLIIGG  253
                   LGA+     V +F+ ++GFE +++ A E+RDPE+ +P ++    + V++ Y+L
Sbjct: 190 ----LGALGTVTVLVFWAYVGFELVTVPADEVRDPERTIPLSITLGMIFVTLFYILTNAV  245

Query: 254 TIAMLGSQIMMTN-APVQDAFVKMIGPAGAWMVSIGALISITGLNMGESIMVPRYGAAIA  312
            + ++  +++ ++ AP+ A    ++G  GA +++ GA+ SI G      + R     A++
Sbjct: 246 ILGLVPWRVLASSTAPLTVAGYSLMGGIGALILTAGAVFSIAGSEEAGMLTTARLLFAMS  305

Query: 313 DEGLLPAAIAKQNQN-GAPLVAILVSGAIAIVLLLTGSFESLAKLSVVFRFFQYIPTALA  371
            ++G LP +++ ++   G P ++ILV   A++   LTG+    L +LSVV      Y  T ++
Sbjct: 306 EDGFLPGFLSRVHRRFGTPHMSILVQNLTALLAALTGTVSGLIELSVVTLLLPYAVTCIS  365

Query: 372 VMKLRKDDPDANVIFRVPFGPIIPILAVIVSLVMIWGDNPMNFVYGAVGVIIASSVYYLM  431
            +  LR+ D          P+  +L V+V + ++      P    +G + +I++ +  YL+
Sbjct: 366 LAILRRRDGSGI--------PLKSVLGVLVCIYLLMNTTPSTTAWGLL-LILSGAPLYLI  416

Query: 432 HG                                                           433
            G
Sbjct: 417 FG                                                           418
```

An alignment of the GAS and GBS proteins is shown below.

```
Identities = 104/368 (28%), Positives = 162/368 (43%), Gaps = 32/368 (8%)
Query:   1 MRYKMEKEKKLGLLPLTMLVIGSLIGGGIFDLMQNMSSRAGLVPMLIAWVI-TAIGMGTF   59
           M  + ++ K  L    T+ I ++IG GIF L + +      GL  P  IA +  TAI
Sbjct:   6 MNEQEREQAKFSLSGATLYGINAVIGSGIFLLPRAIYK--GLGPASIAVMFGTAILTIML   63

Query:  60 VLSFQNLSEKRPDLTAGIFSYAKEGFGNFMGFNSA---WGYWLSAWLGNVAYAALLFSSL  116
            + F +S           G F Y+K  FG+F+GFN         W    + AW    A A +F
Sbjct:  64 AVCFAEVSGYFGK-NGGAFQYSKRAFGDFIGFNVGFLGWTVTIFAWAAMAAGFARMFIIT  122

Query: 117 GYFFKFFGNGNNIISIIGASIVIWVVHFLILRGVNTAAFINTIVTFAKLVPVIIFLISAL  176
              F+     G +I     IG  I+ +    + + G+ T+ +        T AKL+P++ F       L
Sbjct: 123 FPAFE----GWHIPLSIGLIILLSLMN---IAGLKTSKIVTITATIAKLIPIVAFCACTL  175

Query: 177 LAFK-----FNIFSLDIWGNGLHQSIFNQVNSTMKTAVWVFIGIEGAVVFSGRAKKHSDI  231
                K      F F       G L  +I N       TAV++F  G    S A  + D
Sbjct: 176 FFIKNGLPNFTPFVQLEPGTNLLGAISN-------TAVYIFYGFIGFETLSIVAGEMRDP  228

Query: 232 GKASILALFTMISLYVLISVLSLG---IMSRPELANLKTPAM-AYVLEKAVGHWGAILVN  287
            K     AL  IS+ ++ +L +G     M ++        P    A+V K +G  GA +V+
Sbjct: 229 EKNVPRALLGSISIVSVLYMLIIGGTIAMLGSQIMMTNAPVQDAFV--KMIGPAGAWMVS  286

Query: 288 LGVIISVFGAILAWTLFAAELPYQAAKEGAFPKFFAKENKNKAPINSLLVTNLCVQAFLI  347
            +G +IS+ G  +        A EG  P    AK+N+N AP+ ++LV+         L+
Sbjct: 287 IGALISITGLNMGESIMVPRYGAAIADEGLLPAAIAKQNQNGAPLVAILVSGAIAIVLLL  346

Query: 348 TFLFTQSA                                                     355
            T  F    A
Sbjct: 347 TGSFESLA                                                     354
```

A further related DNA sequence was identified in *S. pyogenes* <SEQ ID 9079> which encodes the amino acid sequence <SEQ ID 9080>. Analysis of this protein sequence reveals the following:

```
Possible site: 60
>>> Seems to have no N-terminal signal sequence
INTEGRAL    Likelihood = -9.92    Transmembrane 77-93 (72-100)
INTEGRAL    Likelihood = -9.29    Transmembrane 279-295 (274-303)
INTEGRAL    Likelihood = -9.08    Transmembrane 203-219 (199-225)
INTEGRAL    Likelihood = -8.55    Transmembrane 174-190 (171-197)
INTEGRAL    Likelihood = -8.33    Transmembrane 436-452 (432-455)
INTEGRAL    Likelihood = -7.32    Transmembrane 329-345 (324-350)
INTEGRAL    Likelihood = -5.63    Transmembrane 402-418 (396-421)
INTEGRAL    Likelihood = -4.88    Transmembrane 460-476 (456-479)
INTEGRAL    Likelihood = -4.51    Transmembrane 379-395 (377-401)
INTEGRAL    Likelihood = -2.81    Transmembrane 48-64 (48-65)
INTEGRAL    Likelihood = -2.23    Transmembrane 243-259 (243-262)
INTEGRAL    Likelihood = -0.37    Transmembrane 123-139 (123-139)
----- Final Results -----
    bacterial membrane --- Certainty = 0.4970 (Affirmative) <succ>
    bacterial outside --- Certainty = 0.0000 (Not Clear) <succ>
    bacterial cytoplasm --- Certainty = 0.0000 (Not Clear) <succ>
```

An alignment of the GAS and GBS sequences follows:

```
 Score = 62.1 bits (148), Expect = 2e-11
 Identities = 59/250 (23%), Positives = 107/250 (42%), Gaps = 12/250 (4%)
 Query: 143  WGSYLKGLLAN--YNIVLPNALNGTFNL--KNGTYIDILPV-LVMFFVTGIVLMNSKLAL    197
             WG +L    LN Y +L ++L   F         I I+   +V++ V  ++L     A
 Sbjct:  95  WGYWLSAWLGNVAYAALLFSSLGYFFKFFGNGNNIISIIGASIVIWVVHFLILRGVNTAA    154

Query: 198  RFNSFLVILKFSALALFIFVGIFFIDHNNWSHFAPYGVGQITGGKTGIFAGASVMFFAFL    257
                N+ +    K   + F+    +         N +S     +G G         + +      + F+
 Sbjct: 155  FINTIVTFAKLVPVIIFLISALLAFKFNIFS-LDIWGNGLHQSIFNQVNSTMKTAVWVFI    213

Query: 258  GFESISMAVDEVKEPQKTIPKGIILSLIIVTALYIVVTTILTGIV---HYTKLNVPDAVA    314
             G E   +     K+     I K  IL+L  + +LY++++ +  GI+       L  P A+A
 Sbjct: 214  GIEGAVVFSGRAKK-HSDIGKASILALFTMISLYVLISVLSLGIMSRPELANLKTP-AMA    271

Query: 315  FALRNIRLYWAADYVSIVAILTLITVCISMTYALARTIYSISRDGLLPKSLYTLTKKNKV    374
             + L    +W A  V++  I+++     ++ T   A  Y   +++G  PK  +   KNK
 Sbjct: 272  YVLEKAVGHWGAILVNLGVIISVFGAILAWTLFAAELPYQAAKEGAFPK-FFAKENKNKA    330

Query: 375  PQNATLVTGL    384
             P N+ LVT L
 Sbjct: 331  PINSLLVTNL    340
```

Based on this analysis, it was predicted that these proteins and their epitopes could be useful antigens for vaccines or diagnostics.

Example 1013

A DNA sequence (GBSx1081) was identified in *S. agalactiae* <SEQ ID 3115> which encodes the amino acid sequence <SEQ ID 3116>. This protein is predicted to be unnamed protein product (argF). Analysis of this protein sequence reveals the following:

```
Possible site: 31
>>> Seems to have no N-terminal signal sequence
----- Final Results -----
    bacterial cytoplasm --- Certainty = 0.3757 (Affirmative) <succ>
    bacterial membrane --- Certainty = 0.0000 (Not Clear) <succ>
    bacterial outside --- Certainty = 0.0000 (Not Clear) <succ>
```

A related DNA sequence was identified in *S. pyogenes* <SEQ ID 3117> which encodes the amino acid sequence <SEQ ID 3118>. Analysis of this protein sequence reveals the following:

```
Possible site: 31
>>> Seems to have no N-terminal signal sequence
INTEGRAL    Likelihood = -0.48    Transmembrane 171-187 (171-188)
----- Final Results -----
```

-continued

```
    bacterial membrane --- Certainty = 0.1192 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the databases:

```
>GP:CAB12563 GB:Z99108 similar to metabolite transporter [Bacillus subtilis]
Identities = 190/467 (40%), Positives = 284/467 (60%), Gaps = 13/467 (2%)
Query:  25  TIFRKK-----KKYSNKTEMQRHFKVIDLVFLGLGSMVGTGIFTVTGIGAAKYAGPALTI    79
            ++FRKK         S   + R    DL  LG+G ++GTGIF +TG  AA   AGPAL I
Sbjct:   3  SLFRKKPLETLSAQSKSKSLARTLSAFDLTLLGIGCVIGTGIFVITGTVAATGAGPALII    62

Query:  80  SIIISAIAIGILALFYAEFASRMPSNGGAYSYVYATLGEFPAWLVGWYIIMEFLTAISSV   139
            S I++ +A  + A  YAEF+S +P +G   YSY Y TLGE  A+L+GW +++E++ A+S+V
Sbjct:  63  SFILAGLACALAAFCYAEFSSSIPISGSVYSYSYVTLGELLAFLIGWDLMLEYVIALSAV   122

Query: 140  AVGWGSYLKGLLANYNIVLPNALNGTFNLKNGTYIDILPVLVMFFVTGIVLMNSKLALRF   199
            A GW SY + LLA +N+ +P AL G       G     ++    +++  +T IV    K + RF
Sbjct: 123  ATGWSSYFQSLLAGFNLHIPAALTGAPGSMAGAVFNLPAAVIILLITAIVSRGVKESTRF   182

Query: 200  NSFLVILKFSALALFIFVGIFFIDHNNWSHFAPYGVGQITGGKTGIFAGASVMFFAFLGF   259
            N+ +V++K + + LFI VGI ++   +NWS F P+G+       G+    A+ +FFA+LGF
```

```
                                -continued
Sbjct: 183  NNVIVLMKIAIILLFIIVGIGYVKPDNWSPFMPFGM-------KGVILSAATVFFAYLGF  235

Query: 260  ESISMAVDEVKEPQKTIPKGIILSLIIVTALYIVVTTILTGIVHYTKLNVPDAVAFALRN  319
            +++S A +EVK PQK +P GII +L + T LYI V+ +LTG++ Y KLNV D V+FAL+
Sbjct: 236  DAVSNASEEVKNPQKNMPVGIISALAVCTVLYIAVSLVLTGMMPYAKLNVGDPVSFALKF  295

Query: 320  IRLYWAADYVSIVAILTLITVCISMTYALARTIYSISRDGLLPKSLYTLTKKNKVPQNAT  379
            +     A  +S+ AI+ + TV +++ YA  R   +++SRDGLLP +        K P   T
Sbjct: 296  VGQDAVAGIISVGAIIGITTVMLALLYAQVRLTFAMSRDGLLPGLFAKVHPSFKTPFRNT  355

Query: 380  LVTGLLAMICAGIFPLSSLAEFVNICTLAYLIILSGAIIKLRRIEGEPKANEFKTPLVPF  439
              +TG++A   AG    L +LA  VN+ TLA    ++S A+I LR+    E KA+ F+ P VP
Sbjct: 356  WLTGIVAAGIAGFINLGTLAHLVNMGTLAAFTVISIAVIVLRKKHPEIKAS-FRVPFVPV  414

Query: 440  LPMLAIIICLSFMSQYKAFTWIAFAIATIIGTLIYLAYGYTHSIENK  486
            +P+++  ICL FM      TW++F I   +GTL+Y  Y   HS+ NK
Sbjct: 415  VPIISAGICLWFMYSLPGVTWLSFVIWIAVGTLVYFLYSRKHSLLNK  461
```

An alignment of the GAS and GBS proteins is shown below.

```
Identities = 312/337 (92%), Positives = 324/337 (95%)
Query:   1  MTQVFQGRSFLAEKDFSREEFEYLIDFSAHLKDLKKRGVPHHYLEGKNIALLFEKTSTRT   60
            MTQVFQGRSFLAEKDF+R E EYLIDFSAHLKDLKKRGVPHHYLEGKNIALLFEKTSTRT
Sbjct:   1  MTQVFQGRSFLAEKDFTRAELEYLIDFSAHLKDLKKRGVPHHYLEGKNIALLFEKTSTRT   60

Query:  61  RAAFTTAAIDLGAHPEYLGANDIQLGKKESTEDTAKVLGRMFDGIEFRGFSQRMVEELAE  120
            RAAFTTAAIDLGAHPEYLGANDIQLGKKESTEDTAKVLGRMFDGIEFRGFSQRMVEELAE
Sbjct:  61  RAAFTTAAIDLGAHPEYLGANDIQLGKKESTEDTAKNLGRMFDGIEFRGFSQRMVEELAE  120

Query: 121  FSGVPVWNGLTDEWHPTQMLADYLTIKENFGKLEGITLVYCGDGRNNVANSLLVAGTLMG  180
            FSGVPVWNGLTDEWHPTQMLADY T+KENFGKLEG+TLVYCGDGRNNVANSLLV G ++G
Sbjct: 121  FSGVPVWNGLTDEWHPTQMLADYFTVKENFGKLEGLTLVYCGDGRNNVANSLLVTGAILG  180

Query: 181  VNVHIFSPKELFPAEEIVKLAEEYAKESGAHVLVTDNVDEAVKGADVFYTDVWVSNGEED  240
            VNVHIFSPKELFP EEIV LAE YAKESGA +L+T++ DEAVKGADV YTDVWVSMGEED
Sbjct: 181  VNVHIFSPKELFPEEEIVTLAEGYAKESGARILITEDADEAVKGADVLYTDVWVSMGEED  240

Query: 241  KFKERVELLQPYQVNMELIKKANNDNLIFLHCLPAFHDTNTVYGKDVAEKFGVKEMEVTD  300
            KFKERVELLQPYQVNM+L++K  ND  LIFLHCLPAFHDTNTVYGKDVAEKFGVKEMEVTD
Sbjct: 241  KFKERVELLQPYQVNMDLVQKAGNDKLIFLHCLPAFHDTNTVYGKDVAEKFGVKEMEVTD  300

Query: 301  EVFRSKYARHFDQAENRMHTIKAVMAATLGNLFIPKV  337
            EVFRSKYARHFDQAENRMHTIKAVMAATLGNLFIPKV
Sbjct: 301  EVFRSKYARHFDQAENRMHTIKAVMAATLGNLFIPKV  337
```

Based on this analysis, it was predicted that these proteins and their epitopes could be useful antigens for vaccines or diagnostics.

Example 1014

A DNA sequence (GBSx1082) was identified in *S. agalactiae* <SEQ ID 3119> which encodes the amino acid sequence <SEQ ID 3120>. Analysis of this protein sequence reveals the following:

Possible site: 24
>>> Seems to have no N-terminal signal sequence
----- Final Results -----
  bacterial cytoplasm --- Certainty = 0.0456 (Affirmative) <succ>
    bacterial membrane --- Certainty = 0.0000 (Not Clear) <succ>
      bacterial outside --- Certainty = 0.0000 (Not Clear) <succ>

A related GBS nucleic acid sequence <SEQ ID 10921> which encodes amino acid sequence <SEQ ID 10922> was also identified.

A related DNA sequence was identified in *S. pyogenes* <SEQ ID 3121> which encodes the amino acid sequence <SEQ ID 3122>. Analysis of this protein sequence reveals the following:

Possible site: 61
>>> Seems to have no N-terminal signal sequence
INTEGRAL     Likelihood = −5.41    Transmembrane 121-137 (118-140)
----- Final Results -----
  bacterial membrane --- Certainty = 0.3166 (Affirmative) <succ>
    bacterial outside --- Certainty = 0.0000 (Not Clear) <succ>
      bacterial cytoplasm --- Certainty = 0.0000 (Not Clear) <succ>

An alignment of the GAS and GBS proteins is shown below.

```
Identities = 65/113 (57%), Positives = 83/113 (72%)
Query:  31  MEEEFDDNDEQDTIYAVLYDGKQPVSTGRFLPETQTEARLTRIATLKGYRGNGYGTKIII   90
            M ++FD NDE  T+YAV+YD QPVSTG+FL ET+ EARLTRI TL  Y G GYG K+
Sbjct:   1  MADKFDANDETRTVYAVVYDNDQPVSTGQFLAETKIEARLTRIVTLADYCGCGYGAKVTE   60
```

```
-continued
Query:  91 ALENYAKENGYHYLTIHAELTAKDFYQTLGYQATGNIYMEDGEACQTLEKYLI        143
           ALE Y +  G++ LTIH+ELTA+ FY+ LGYQ+ G    +EDGE CQ+L K ++
Sbjct:  61 ALETYTRREGFYQLTIHSELTAQTFYENLGYQSYGPKCLEDGEYCQSLAKTIL        113
```

Based on this analysis, it was predicted that these proteins and their epitopes could be useful antigens for vaccines or diagnostics.

Example 1015

A DNA sequence (GBSx1083) was identified in *S. agalactiae* <SEQ ID 3123> which encodes the amino acid sequence <SEQ ID 3124>. Analysis of this protein sequence reveals the following:

Possible site: 58
>>> Seems to have no N-terminal signal sequence
----- Final Results -----
   bacterial cytoplasm --- Certainty = 0.2160 (Affirmative) <succ>
      bacterial membrane --- Certainty = 0.0000 (Not Clear) <succ>
      bacterial outside --- Certainty = 0.0000 (Not Clear) <succ>

A related DNA sequence was identified in *S. pyogenes* <SEQ ID 3125> which encodes the amino acid sequence <SEQ ID 3126>. Analysis of this protein sequence reveals the following:

Possible site: 58
>>> Seems to have no N-terminal signal sequence
----- Final Results -----
   bacterial cytoplasm --- Certainty = 0.2730 (Affirmative) <succ>
      bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 375/411 (91%), Positives = 395/411 (95%), Gaps = 1/411 (0%)
Query:    1 MTQTHPIHVFSEIGKLKKVMLHRPGKEIENLMPDYLERLLFDDIPFLEDAQKEHDAFAQA      60
            MT   PIHV+SEIGKLKKV+LHRPGKEIENLMPDYLERLLFDDIPFLEDAQKEHDAFAQA
Sbjct:    1 MTAQTPIHVYSEIGKLKKVLLHRPGKEIENLMPDYLERLLFDDIPFLEDAQKEHDAFAQA      60

Query:   61 LRNEGVEVLYLENLAAESLTNQEIREQFIDEYIGEANVRGRATKKAIRELLLNIKDNKEL     120
            LR+EG+EVLYLE LAAESL   EIRE FIDEY+ EAN+RGRATKKAIRELL+ I+DN+EL
Sbjct:   61 LRDEGIEVLYLETLAAESLVTPEIREAFIDEYLSEANIRGRATKKAIRELLMAIEDNQEL     120

Query:  121 IEKTMAGIQKSELPEIPSSEKGLTDLVESNYPFAIDPMPNLYFTRDPFATIGNGVSLNHM     180
            IEKTMAG+QKSELPEIP+SEKGLTDLVESNYPFAIDPMPNLYFTRDPFATIG GVSLNHM
Sbjct:  121 IEKTMAGVQKSELPEIPASEKGLTDLVESNYPFAIDPMPNLYFTRDPFATIGTGVSLNHM     180

Query:  181 FSETRNRETLYGKYIFTHHPEYGG-KVPMVYEREETTRIEGGDELVLSKDVLAVGISQRT     239
            FSETRNRETLYGKYIFTHHP YGG KVPMVY+R ETTRIEGGDELVLSKDVLAVGISQRT
Sbjct:  181 FSETRNRETLYGKYIFTHHPIYGGGKVPMVYDRNETTRIEGGDELVLSKDVLAVGISQRT     240

Query:  240 DAASIEKLLVNIFKQNLGFKKVLAFEFANNRKFMHLDTVFTMVDYDKFTIHPEIEGDLRV     299
            DAASIEKLLVNIFKQNLGFKKVLAFEFANNRKFMHLDTVFTMVDYDKFTIHPEIEGDLRV
Sbjct:  241 DAASIEKLLVNIFKQNLGFKKVLAFEFANNRKFMHLDTVFTMVDYDKFTIHPEIEGDLRV     300

Query:  300 YSVTYENQDLHIEEEKGDLADLLAKNLGVEKVELIRCGGDNLVAAGREQWNDGSNTLTIA     359
            YSVTY+N++LHI EEKGDLA+LLA NLGVEKV+LIRCGGDNLVAAGREQWNDGSNTLTIA
Sbjct:  301 YSVTYDNEELHIVEEKGDLAELLAANLGVEKVDLIRCGGDNLVAAGREQWNDGSNTLTIA     360

Query:  360 PGVVIVYNRNTITNAILESKGLKLIKINGSELVRGRGGPRCMSMPFEREDL             410
            PGVV+VYNRNTITNAILESKGLKLIKI+GSELVRGRGGPRCMSMPFERED+
Sbjct:  361 PGVVVVYNRNTITNAILESKGLKLIKIHGSELVRGRGGPRCMSMPFEREDI             411
```

Based on this analysis, it was predicted that these proteins and their epitopes could be useful antigens for vaccines or diagnostics.

Example 1016

A DNA sequence (GBSx1084) was identified in *S. agalactiae* <SEQ ID 3127> which encodes the amino acid sequence <SEQ ID 3128>. Analysis of this protein sequence reveals the following:

Possible site: 20
>>> Seems to have no N-terminal signal sequence
----- Final Results -----
   bacterial cytoplasm --- Certainty = 0.3162 (Affirmative) <succ>
      bacterial membrane --- Certainty = 0.0000 (Not Clear) <succ>
      bacterial outside --- Certainty = 0.0000 (Not Clear) <succ>

A related GBS nucleic acid sequence <SEQ ID 8703> which encodes amino acid sequence <SEQ ID 8704> was also identified. This protein has an RGD motif and has homology with the following sequences in the GENPEPT database.

```
>GP: AAG07568 GB: AE004834 hypothetical protein [Pseudomonas aeruginosa]
Identities = 42/132 (31%), Positives = 74/132 (55%), Gaps = 3/132 (2%)
Query:  35 IQTYRKAYQTFKTK-KGARSSIEALLKRVNSGNEITSINPLVDIYNAASLRFGLPIGAED      93
           +  + +A++ F  K +   S EAL KR    + SI+P+VD+YNA S++F +P+G E+

Sbjct:  63 LAAWAEAFRREGAKPQRTPCSAEALRKRALRDGGLPSIDPVVDLYNAISVQFAIPVGGEN     122

Query:  94 SDTFRGDLKLTITNGGDEFYLI--GEDFNRPTLSGELAYVDDVGAVCRCFNWRDGKRTMI    151
           + G  +L + +G + F  +   GE +       GE+ + DD+G  CR +NWR G RT +

Sbjct: 123 LAAYAGPPRLVVADGSETFDTLKNGEALDESPDPGEVVWRDDLGVTCRRWNWRQGVRTRL    182

Query: 152 TDNTQNAFLVIE                                                  163
           + +  + ++E Sbjct: 183 DASARRMWFILE                                                  194
```

A related DNA sequence was identified in *S. pyogenes* <SEQ ID 3129> which encodes the amino acid sequence <SEQ ID 3130>. Analysis of this protein sequence reveals the following:

---

Possible site: 33
>>> Seems to have no N-terminal signal sequence
----- Final Results -----
  bacterial cytoplasm --- Certainty = 0.0700 (Affirmative) <succ>
    bacterial membrane --- Certainty = 0.0000 (Not Clear) <succ>
      bacterial outside --- Certainty = 0.0000 (Not Clear) <succ>

---

An alignment of the GAS and GBS proteins is shown below.

```
Identities = 127/199 (63%), Positives = 155/199 (77%)
Query:   8 ELKQLLSDSHSLAKKYLQEKEFSQNRVIQTYRKAYQTFKTKKGARSSIEALLKRVNSGNE      67
           ++KQLL+DSH LAK YL    FS N+V+Q YRKAYQ FKTKKGARSSIEALLKRV++G Sbjct:  36 DVKQLLADSHELAKAYLTADNFSDNQVVQVYRKAYQHFKTKKGARSSIEALLKRVSNGQS     95

Query:  68 ITSINPLVDIYNAASLRFGLPIGAEDSDTFRGDLKLTITNGGDEFYLIGEDFNRPTLSGE    127
           I SINPLVDIYNAASLRFGLP GAEDSD+F GDL+LTIT+GGD+FYLIG+ N PTL  E Sbjct:  96 IPSINPLVDIYNAASLRFGLPAGAEDSDSFIGDLRLTITDGGDDFYLIGDADNNPTLPNE    155

Query: 128 LAYVDDVGAVCRCFNWRDGKRTMITDNTQNAFLVIELIDNGREIIFKEALDFIATNTNRF    187
           L Y DD+GA CRC NWRDG+RTM+T++T+NAFL+IE +D   +  +EAL FI  +   +

Sbjct: 156 LCYKDDIGAFCRCLNWRDGERTMVTEHTKNAFLIIEALDQEGQNRLQEALKFIEGSAKMY    215

Query: 188 LKAKTQTIILDKEHSEITL                                           206
           L A T   +LDK++  + L Sbjct: 216 LHAITSVHVLDKDNPHVPL                                           234
```

SEQ ID 8704 (GBS298) was expressed in *E. coli* as a His-fusion product. SDS-PAGE analysis of total cell extract is shown in FIG. 44 (lane 2; MW 29 kDa). It was also expressed in *E. coli* as a GST-fusion product. SDS-PAGE analysis of total cell extract is shown in FIG. 48 (lane 5; MW 54 kDa).

Figure 297:
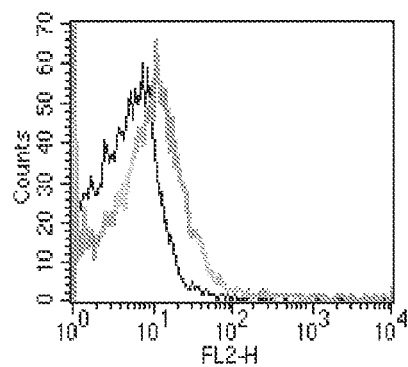

The GBS298-GST fusion product was purified (FIG. 203, lane 9) and used to immunise mice. The resulting antiserum was used for FACS (FIG. 297), which confirmed that the protein is immunoaccessible on GBS bacteria.

Based on this analysis, it was predicted that these proteins and their epitopes could be useful antigens for vaccines or diagnostics.

Example 1017

A DNA sequence (GBSx1085) was identified in *S. agalactiae* <SEQ ID 3131> which encodes the amino acid sequence <SEQ ID 3132>. Analysis of this protein sequence reveals the following:

---

Possible site: 26
>>> Seems to have no N-terminal signal sequence
----- Final Results -----
  bacterial cytoplasm --- Certainty = 0.3770 (Affirmative) <succ>

-continued bacterial membrane --- Certainty = 0.0000 (Not Clear) <succ>
      bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1018

A DNA sequence (GBSx1086) was identified in *S. agalactiae* <SEQ ID 3133> which encodes the amino acid sequence <SEQ ID 3134>. Analysis of this protein sequence reveals the following:

Possible site: 20
>>> Seems to have no N-terminal signal sequence
----- Final Results -----
 bacterial cytoplasm --- Certainty = 0.4263 (Affirmative) <succ>
 bacterial membrane --- Certainty = 0.0000 (Not Clear) <succ>
 bacterial outside --- Certainty = 0.0000 (Not Clear) <succ>

The protein has homology with the following sequences in the GENPEPT database.

A related DNA sequence was identified in *S. pyogenes* <SEQ ID 3135> which encodes the amino acid sequence <SEQ ID 3136>. Analysis of this protein sequence reveals the following:

Possible site: 20
>>> Seems to have no N-terminal signal sequence
----- Final Results -----
 bacterial cytoplasm --- Certainty = 0.4478 (Affirmative) <succ>
 bacterial membrane --- Certainty = 0.0000 (Not Clear) <succ>
 bacterial outside --- Certainty = 0.0000 (Not Clear) <succ>

```
>GP: CAB95946 GB: Y17554 Crp/Fnr family protein [Bacillus
licheniformis]
Identities = 85/214 (39%), Positives = 126/214 (58%), Gaps = 14/214 (6%)
Query:  11 RQLDDFKHFTIEQFDHIVSHIKHRTALKNHTLFFEGDYREKLFLIQSGHVKIEQSDASGS           70
            R L+D K F           I  R+   K   LF E D  RE+++L+   G  +K+E+S+  +GS
Sbjct:  22 RDLEDMKQF-----------IYWRSYHKGQILFMEDDPRERMYLLLDGFIKLEKSNEAGS           70

Query:  71 FIYTDYVRQGTVFPYGGLFLDDDYHFSAVAITDIEYFSLPMALYEEYSLQNINQMKHLCR          130
            YTDYVR   T+FP+GGLF D+  YH++A A+TDIE +  +PM ++E+    N N +   +
Sbjct:  71 MFYTDYVRPHTLFPFGGLFRDEHYHYAAEALTDIELYYIPMNIFEDLVRDNKNLLYDILN          130

Query: 131 KYSKLLRVHEIRLRNMVTSSASMRVIQSLATL---LLQVPTERGHLPFPITTIEIANMSG          187
            S  +L +HE RL+ +   S A  RV Q++  L      L Q +        + PIT  EIA +SG
Sbjct: 131 HLSDILALHEERLKRITLSHAHDRVTQAIYYLTESLGQKESNSTVINCPITAAEIAKISG          190

Query: 188 TTRETVSHVLKELRQKDIVEMKGKKLLYNNKNYF                                  221
            T+RETVS VLK+LR + ++   K+++    N   YF
Sbjct: 191 TSRETVSAVLKKLRCEGVISQMNKQIMINRPEYF                                  224
```

An alignment of the GAS and GBS proteins is shown below.

```
Identities = 130/224 (58%), Positives = 180/224 (80%)
Query:   1 MITKEQYFYFRQLDDFKHFTIEQFDHIVSHIKHRTALKNHTLFFEGDYREKLFLIQSGHV           60
            +I +E Y Y R+L+DF++F+IEQFD IV  ++ R A K+H LFFEGD R+KLFL+ SG+
Sbjct:   1 VIRREDYQYLRKLNDFRYFSIEQFDKIVGQMEFRKAKKDHILFFEGDKRDKLFLVTSGYF          60

Query:  61 KIEQSDASGSFIYTDYVRQGTVFPYGGLFLDDDYHFSAVAITDIEYFSLPMALYEEYSLQ          120
            K+EQSD  SG+F+ YTD++R  GT+FPYGGLF DD YHFS  VA+TD+ YF  P+  L+E+YSL+
Sbjct:  61 KVEQSDQSGTFMYTDFIRHGTIFPYGGLFTDDYYHFSVVAMTDVTYFYFPVDLFEDYSLE          120

Query: 121 NINQMKHLCRKYSKLLRVHEIRLRNMVTSSASMRVIQSLATLLLQVPTERGHLPFPITTI          180
            N  QMKHL  K SKLL +HE+R+RN++TSSAS RVIQSLA LL+++  +     LPF +TT
Sbjct: 121 NRLQMKHLYSKMSKLLELHELRVRNLITSSASSRVIQSLAILLVEMGKDSDTLPFQLTTT          180

Query: 181 EIANMSGTTRETVSHVLKELRQKDIVEMKGKKLLYNNKNYFKKF                        224
            +IA +SGTTRETVSHVL++L++++++  +KGK L Y +K+YF ++
Sbjct: 181 DIAQISGTTRETVSHVLRDLKKQELITIKGKYLTYLDKDYFLQY                        224
```

Based on this analysis, it was predicted that these proteins and their epitopes could be useful antigens for vaccines or diagnostics.

Example 1019

A DNA sequence (GBSx1087) was identified in *S. agalactiae* <SEQ ID 3137> which encodes the amino acid sequence <SEQ ID 3138>. Analysis of this protein sequence reveals the following:

Possible site: 59
>>> Seems to have no N-terminal signal sequence
----- Final Results -----
   bacterial cytoplasm --- Certainty = 0.1201 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 461/493 (93%), Positives = 478/493 (96%)
Query:    2 MSNWDTKFLKKGFTFDDVLLIPAESHVLPNEVDMKTKLADNLTLNIPIITAAMDTVTDSK       61
            MSNWDTKFLKKG+TFDDVLLIPAESHVLPNEVD+KTKLADNLTLNIPIITAAMDTVT SK
Sbjct:    1 MSNWDTKFLKKGYTFDDVLLIPAESHVLPNEVDLKTKLADNLTLNIPIITAAMDTVTGSK       60

Query:   62 MAIAIARAGGLGIIHKNMSIVDQAEEVRKVKRSENGVIIDPFFLTPDNTVSEAEELMQNY      121
            MAIAIARAGGLG+IHKNMSI +QAEEVRKVKRSENGVIIDPFFLTP++ VSEAEELMQ Y
Sbjct:   61 MAIAIARAGGLGVIHKNMSITEQAEEVRKVKRSENGVIIDPFFLTPEHKVSEAEELMQRY      120

Query:  122 RISGVPIVETLENRKLVGIITNRDMRFISDYKQLISEHMTSQNLVTAPIGTDLETAERIL      181
            RISGVPIVETL NRKLVGIITNRDMRFISDY  ISEHMTS++LVTA +GTDLETAERIL
Sbjct:  121 RISGVPIVETLANRKLVGIITNRDMRFISDYNAPISEHMTSEHLVTAAVGTDLETAERIL      180

Query:  182 HEHRIEKLPLVDDEGRLSGLITIKDIEKVIEFPKAAKDEFGRLLVAGAVGVTSDTFERAE      241
            HEHRIEKLPLVD+ GRLSGLITIKDIEKVIEFP AAKDEFGRLLVA AVGVTSDTFERAE
Sbjct:  181 HEHRIEKLPLVDNSGRLSGLITIKDIEKVIEFPHAAKDEFGRLLVAAAVGVTSDTFERAE      240

Query:  242 ALFEAGADAIVIDTAHGHSAGVLRKIAEIRAHFPNRTLIAGNIATAEGARALYDAGVDVV      301
            ALFEAGADAIVIDTAHGHSAGVLRKIAEIRAHFPNRTLIAGNIATAEGARALYDAGVDVV
Sbjct:  241 ALFEAGADAIVIDTAHGHSAGVLRKIAEIRAHFPNRTLIAGNIATAEGARALYDAGVDVV      300

Query:  302 KVGIGPGSICTIRVVAGVGVPQITAIYDAAAVAREYGKTIIADGGIKYSGDIVKALAAGG      361
            KVGIGPGSICTIRVVAGVGVPQ+TAIYDAAAVAREYGKTIIADGGIKYSGDIVKALAAGG
Sbjct:  301 KVGIGPGSICTTRVVAGVGVPQVTAIYDAAAVAREYGKTIIADGGIKYSGDIVKALAAGG      360

Query:  362 NAVMLGSMFAGTDEAPGETEIFQGRKEKTYRGMGSIAAMKKGSSDRYFQGSVNEANKLVP      421
            NAVMLGSMFAGTDEAPGETEI+QGRKFKTYRGMGSIAAMKKGSSDRYFQGSVNEANKLVP
Sbjct:  361 NAVMLGSMFAGTDEAPGETEIYQGRKFKTYRGMGSIAAMKKGSSDRYFQGSVNEANKLVP      420

Query:  422 EGIEGRVAYKGSVADIVFQMLGGIRSGMGYVGAANIKELHDNAQFVEMSGAGLKESHPHD      481
            EGIEGRVAYKG+ +DIVFQMLGGIRSGMGYVGA +I+ELH+NAQFVEMSGAGL ESHPHD
Sbjct:  421 EGIEGRVAYKGAASDIVFQMLGGIRSGMGYVGAGDIQELHENAQFVEMSGAGLIESHPHD      480

Query:  482 VQITNEAPNYSVH                                                    494
            VQITNEAPNYSVH
Sbjct:  481 VQITNEAPNYSVH                                                    493
```

Possible site: 53
>>> Seems to have no N-terminal signal sequence
----- Final Results -----
   bacterial cytoplasm --- Certainty = 0.1643 (Affirmative) <succ>
   bacterial membrane --- Certainty = 0.0000 (Not Clear) <succ>
   bacterial outside --- Certainty = 0.0000 (Not Clear) <succ>

A related DNA sequence was identified in *S. pyogenes* <SEQ ID 2161> which encodes the amino acid sequence <SEQ ID 2162>. Analysis of this protein sequence reveals the following:

Based on this analysis, it was predicted that these proteins and their epitopes could be useful antigens for vaccines or diagnostics.

Example 1020

A DNA sequence (GBSx1089) was identified in *S. agalactiae* <SEQ ID 3139> which encodes the amino acid sequence <SEQ ID 3140>. This protein is predicted to be MutR. Analysis of this protein sequence reveals the following:

Possible site: 23
>>> Seems to have no N-terminal signal sequence

----- Final Results -----
   bacterial cytoplasm --- Certainty = 0.1841 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP: AAD04237 GB: AF007761 MutR [Streptococcus mutans]
Identities = 51/215 (23%), Positives = 102/215 (46%), Gaps = 9/215 (4%)
Query:    5 GKILKELREDKGISLSSLAKSAQLSKSTLSRFENGETQIGIDKFIKALQTLEVGVTINEV      64
            G++ KELR  +G+ L  +A+    LS S LS+FENG+T +  DK I A+Q +    +T +E
Sbjct:    9 GELYKELRMARGLKLKDIARD-NLSVSQLSKFENGQTMLAADKLILAIQGIH--MTESEF      65

Query:   65 SILDSKVKAGTSNTDLEQLTLLESYRDNEDIMRIFSFQKQQSCDRIESNVLKILAKLFIS     124
            S   ++ +        ++L  L++ +D + + +I         + + + K++ K  +
Sbjct:   66 SYAFTQYQESDLFKTGKKLVELQTKKDIKGLKKILKDYPDTETYNVYNRLNKLVIKAAVY     125

Query:  125 NLGLNMRLPQDEINLVVTYLNGVTQYNDFYFKVICYFQDILPED--VILNKI----SNMT     178
            +L  +  +E    + +YL + ++ ++   +      IL +D  V L K         +
Sbjct:  126 SLDSSFEITNEEKEFLTSYLYAIEEWTEYELYLFGNTLFILSDDDLVFLGKAFVERDKLY     185

Query:  179 KEQLPYSKSLVNLLIKQVIIALEKDSVDKAIVFAD                               213
            +E   + K     +LI ++I +E  S   A  F +
Sbjct:  186 RELSEHKKRAELVLINLILILVEHHSFYHAQYFIE                               220
```

There is also homology to SEQ ID 628.

Based on this analysis, it was predicted that this protein and its epitopes, could be useful antigens for vaccines or diagnostics.

Example 1021

A DNA sequence (GBSx1090) was identified in *S. agalactiae* <SEQ ID 3141> which encodes the amino acid sequence <SEQ ID 3142>. Analysis of this protein sequence reveals the following:

Possible site: 15
>>> Seems to have a cleavable N-term signal seq.
INTEGRAL    Likelihood = −10.77    Transmembrane 269-285 (265-287)
INTEGRAL    Likelihood = −6.90     Transmembrane 33-49 (31-51)
INTEGRAL    Likelihood = −6.79     Transmembrane 182-198 (176-200)
INTEGRAL    Likelihood = −6.37     Transmembrane 117-133 (113-135)
INTEGRAL    Likelihood = −5.57     Transmembrane 240-256 (232-259)
INTEGRAL    Likelihood = −3.40     Transmembrane 223-239 (220-239)
INTEGRAL    Likelihood = −0.96     Transmembrane 56-72 (55-72)
----- Final Results -----
   bacterial membrane --- Certainty = 0.5310 (Affirmative) <succ>
   bacterial outside --- Certainty = 0.0000 (Not Clear) <succ>
   bacterial cytoplasm --- Certainty = 0.0000 (Not Clear) <succ>

A related DNA sequence was identified in *S. pyogenes* <SEQ ID 3143> which encodes the amino acid sequence <SEQ ID 3144>. Analysis of this protein sequence reveals the following:

Possible site: 48
>>> Seems to have an uncleavable N-term signal seq
INTEGRAL    Likelihood = −10.99    Transmembrane 269-285 (264-286)
INTEGRAL    Likelihood = −8.76     Transmembrane 117-133 (112-135)
INTEGRAL    Likelihood = −7.70     Transmembrane 179-195 (174-200)
INTEGRAL    Likelihood = −4.83     Transmembrane 34-50 (32-52)
INTEGRAL    Likelihood = −4.46     Transmembrane 213-229 (211-230)
INTEGRAL    Likelihood = −4.14     Transmembrane 240-256 (232-259)
INTEGRAL    Likelihood = −0.69     Transmembrane 91-107 (91-108)
INTEGRAL    Likelihood = −0.32     Transmembrane 4-20 (4-20)
----- Final Results -----
   bacterial membrane --- Certainty = 0.5394 (Affirmative) <succ>
   bacterial outside --- Certainty = 0.0000 (Not Clear) <succ>
   bacterial cytoplasm --- Certainty = 0.0000 (Not Clear) <succ>

A related sequence was also identified in GAS <SEQ ID 9181> which encodes the amino acid sequence <SEQ ID 9182>. Analysis of this protein sequence reveals the following:

Possible site: 38
>>> Seems to have an uncleavable N-term signal seq
INTEGRAL    Likelihood = −10.99    Transmembrane 259-275 (254-276)
INTEGRAL    Likelihood = −8.76     Transmembrane 107-123 (102-125)
INTEGRAL    Likelihood = −7.70     Transmembrane 169-185 (164-190)
INTEGRAL    Likelihood = −4.83     Transmembrane 24-40 (22-42)
INTEGRAL    Likelihood = −4.46     Transmembrane 203-219 (201-220)
INTEGRAL    Likelihood = −4.14     Transmembrane 230-246 (222-249)
INTEGRAL    Likelihood = −0.69     Transmembrane 81-97 (81-98)
----- Final Results -----
   bacterial membrane --- Certainty = 0.539 (Affirmative) <succ>
   bacterial outside --- Certainty = 0.0000 (Not Clear) <succ>
   bacterial cytoplasm --- Certainty = 0.0000 (Not Clear) <succ>

An alignment of the GAS and GBS proteins is shown below.

```
Identities = 200/287 (69%), Positives = 244/287 (84%)
Query:   1 MEGLLIALIPMFAWGSIGFVSNKIGGRPNQQTFGMTLGALLFAIIVWLFKQPEMTASLWI    60
           +EG+  ALIPMF WGSIGFVSNKIGG+P+QQT GMT GALLF++ VWL  +PEMT  LW+
Sbjct:   1 LEGIFYALIPMFTWGSIGFVSNKIGGKPSQQTLGMTFGALLFSLAVMWLIVRPEMTLQLWL    60

Query:  61 FGILGGILWSVGQNGQFQAMKYMGVSVANPLSSGAQLVGGSLVGALVFHEWTKPIQFILG   120
           FGILGG +WS+GQ GQF AM+YMGVSVANPLSSG+QLV GSL+G LVFHEWT+P+QF++G
Sbjct:  61 FGILGGFIWSIGQTGQFHAMQYMGVSVANPLSSGSQLVLGSLIGVLVFHEWTRPMQFVVG   120

Query: 121 LTALTLLVIGFYFSSKRDVSEQALATHQEFSKGFATIAYSTVGYISYAVLFNNIMKFDAM   180
              AL LL++GFYFSSK+D +  +    FSKGF + YST+GY+ YAVLFNNIMKF+ +
Sbjct: 121 SLALLLLIVGFYFSSKQDDANAQVNHLHNFSKGFRALTYSTIGYVMYAVLFNNIMKFEVL   180

Query: 181 AVILPMAVGMCLGAICFMKFRVNFEAVVVKNMITGLMWGVGNVFMLLAAAKAGLAIAFSF   240
           +VILPMAVGM LGAI FM F+++ +   V+KN + GL+WG+GN+FMLLAA+KAGLAIAFSF
Sbjct: 181 SVILPMAVGMVLGAITFMSFKISIDQYVIKNSVVGLLWGIGNIFMLLAASKAGLAIAFSF   240

Query: 241 SQLGVIISIIGGILFLGETKTKKEQKWVVMGILCFVMGAILLGIVKS               287
           SQLG IISI+GGILFLGETKTKKE +WVV GI+CF++GAILLG+VKS
Sbjct: 241 SQLGAIISIVGGILFLGETKTKKEMRWVVTGIICFIVGAILLGVVKS               287
```

Based on this analysis, it was predicted that these proteins and their epitopes could be useful antigens for vaccines or diagnostics.

Example 1022

A DNA sequence (GBSx1092) was identified in *S. agalactiae* <SEQ ID 3145> which encodes the amino acid sequence <SEQ ID 3146>. This protein is predicted to be recf protein (recF). Analysis of this protein sequence reveals the following:

---

Possible site: 56
>>> Seems to have no N-terminal signal sequence
----- Final Results ----
   bacterial cytoplasm --- Certainty = 0.2653 (Affirmative) <succ>
   bacterial membrane --- Certainty = 0.0000 (Not Clear) <succ>
   bacterial outside --- Certainty = 0.0000 (Not Clear) <succ>

---

A related DNA sequence was identified in *S. pyogenes* <SEQ ID 3147> which encodes the amino acid sequence <SEQ ID 3148>. Analysis of this protein sequence reveals the following:

---

Possible site: 56
>>> Seems to have no N-terminal signal sequence
----- Final Results -----
   bacterial cytoplasm --- Certainty = 0.1677 (Affirmative) <succ>
   bacterial membrane --- Certainty = 0.0000 (Not Clear) <succ>
   bacterial outside --- Certainty = 0.0000 (Not Clear) <succ>

---

An alignment of the GAS and GBS proteins is shown below.

```
Identities = 248/364 (68%), Positives = 300/364 (82%), Gaps = 1/364 (0%)
Query:   1 MWIKNISLKHYRNYEEAQVDFSPNLNIFIGRNAQGKTNFLEAIYFLALTRSHRTRSDKEL    60
           MWIK + LKHYRNY+    FS LN+FIG NAQGKTNFLEAIYFL+LTRSHRTR+DKEL
Sbjct:   1 MWIKELELKHYRNYDHLLASFSSGLNVFIGNNAQGKTNFLEAIYFLSLTRSHRTRADKEL    60

Query:  61 VHFKHHDVQITGEVIRKSGHLNLDIQLSEKGRITKVNHLKQAKLSDYIGAMTVVLFAPED   120
           +HF H   V +TG++ R SG ++L+I LS+KGR+TK+N LKQAKLSDYIG M VVLFAPED
Sbjct:  61 IHFDHSTVSLTGKIQRISGTVDLEINLSDKGRVTKINALKQAKLSDYIGTMMVVLFAPED   120

Query: 121 LQLVKGAPSLRRKFLDIDIGQIKPTYLAELSNYNHVLKQRNTYLKTTNNVDKTFLTVLDE   180
           LQLVKGAPSLRRKF+DID+GQIKP YL+ELS+YNHVLKQRN+YLK+    +D  FL VLDE
Sbjct: 121 LQLVKGAPSLRRKFIDIDLGQIKPVYLSELSHYNHVLKQRNSYLKSAQQIDAAFLAVLDE   180

Query: 181 QLADYGSRVIEHRFDFIQALNDEADKHHYIISTELEHLSIHYKSSIEFTDKSSIREHFLN   240
           QLA YG+RV+EHR DFI AL  EA+ HH  IS  LE LS+ Y+SS+ F  K++I + FL+
Sbjct: 181 QLASYGARVMEHRIDFINALEKEANTHHQAISNGLESLSLSYQSSVVFDKKTNIYQQFLH   240

Query: 241 QLSKSHSRDIFKKNTSIGPHRDDITFFINDINATFASQGQQRSLILSLKLAEIELIKTVT   300
           QL K+H +D F+KNTS+GPHRD++ F+IN +NA FASQGQ RSLILSLK+AE+ L+K +T
Sbjct: 241 QLEKNHQKDFFRKNTSVGPHRDELAFYINGMNANFASQGQHRSLILSLKMAEVSLMKALT   300

Query: 301 NDYPILLLDDVMSELDNHRQLKLLEG-IKENVQTFITTTSLEHLSALPDQLKIFNVSDGT   359
              D  PILLLDDVMSELDN RQ KLLE   IKENVQTFITTTSL+HLS LP+ ++IF+V+ GT
```

```
Sbjct: 301 GDNPILLLDDVMSELDNTRQTKLLETVIKENVQTFITTTSLDHLSQLPEGIRIFHVIKGT    360

Query: 360 ISIN                                                            363
           + I+

Sbjct: 361 VQID                                                            364
```

Based on this analysis, it was predicted that these proteins and their epitopes could be useful antigens for vaccines or diagnostics.

Example 1023

A DNA sequence (GBSx1093) was identified in *S. agalactiae* <SEQ ID 3149> which encodes the amino acid sequence <SEQ ID 3150>. Analysis of this protein sequence reveals the following:

Possible site: 26
>>> Seems to have no N-terminal signal sequence
----- Final Results -----
    bacterial cytoplasm --- Certainty = 0.1807 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database.

```
>GP: CAA61548 GB: X89367 orf121 [Lactococcus lactis]
Identities = 56/116 (48%), Positives = 74/116 (63%), Gaps = 3/116 (2%)
Query:  3 YKLFDEYITLQSLLKEIGIIQSGGAIKKFLADNR--VLFNGDLENRRGKKLRLGDIITIP   60
          Y LF+EYITL  LLKE+G+I +GG  K FLA+N   + +NG+ ENRRGKKLR GD++  P Sbjct:  4 YILFEEYITLGQLLKELGLISIGGQPKIFLAENEGNIFYNGEAENRRGKKLRDGDLLEFP   63

Query: 61 DQNIEIIIRKPSDQEIEERNIEIAEKQRVSAIVKEMNKNTNGKSKTSKKPVRFPG       116
          ++++   +      I+E   E AE+ RV AIVK+MN   NK      K P RFPG Sbjct: 64 TFDLKVTFEQADADAIKEHEAEKAEEARVKAIVKKMNAE-NKTTKPAKKAPPRFPG      118
```

A related DNA sequence was identified in *S. pyogenes* <SEQ ID 3151> which encodes the amino acid sequence <SEQ ID 3152>. Analysis of this protein sequence reveals the following:

Possible site: 34
>>> Seems to have no N-terminal signal sequence
----- Final Results -----
    bacterial cytoplasm --- Certainty = 0.0493 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below.

```
Identities = 74/136 (54%), Positives = 94/136 (68%), Gaps = 20/136 (14%)
Query:   1 MDYKLFDEYITLQSLLKEIGIIQSGGAIKKFLADNRVLFNGDLENRRGKKLRLGDIITIP       60
           M YKLF E+ITLQ+LLKE+GIIQSGGAIK FLA+  VLFNG+ E RRGKK+R+GD I++P Sbjct:   9 MIYKLFTEFITLQALLKELGIIQSGGAIKGFLAETTVLFNGEDEKRRGKKIRVGDKISLP       68

Query:  61 DQNIEIIIRKPSDQEIEERNIEIAEKQRVSAIVKEMNKNTNGKSK------TSKK----      110
           DQ++ I I +PS +E E+    E+AEK RV+A+VK+MN+   K SK        T+KK Sbjct:  69 DQDLIITIVEPSQEEKEQFAEEMAEKTRVAALVKQMNQANKKTSSKHNNRQSTTKKSLRA      128

Query: 111 ----------PVRFPG                                                116
                     PVRFPG Sbjct: 129 TKKTKGKPTAPVRFPG                                                144
```

Based on this analysis, it was predicted that these proteins and their epitopes could be useful antigens for vaccines or diagnostics.

Example 1024

A DNA sequence (GBSx1094) was identified in *S. agalactiae* <SEQ ID 3153> which encodes the amino acid sequence <SEQ ID 3154>. Analysis of this protein sequence reveals the following:

---

Possible site: 47
>>> Seems to have no N-terminal signal sequence
INTEGRAL   Likelihood = −1.86   Transmembrane 269-285 (267-285)
----- Final Results -----
   bacterial membrane --- Certainty = 0.1744 (Affirmative) <succ>
      bacterial outside --- Certainty = 0.0000 (Not Clear) <succ>
         bacterial cytoplasm --- Certainty = 0.0000 (Not Clear) <succ>

---

A related DNA sequence was identified in *S. pyogenes* <SEQ ID 3155> which encodes the amino acid sequence <SEQ ID 3156>. Analysis of this protein sequence reveals the following:

---

Possible site: 48
>>> Seems to have no N-terminal signal sequence
----- Final Results -----
   bacterial cytoplasm --- Certainty = 0.3008 (Affirmative) <succ>
      bacterial membrane --- Certainty = 0.0000 (Not Clear) <succ>
         bacterial outside --- Certainty = 0.0000 (Not Clear) <succ>

---

An alignment of the GAS and GBS proteins is shown below.

SEQ ID 3154 (GBS400) was expressed in *E. coli* as a His-fusion product. SDS-PAGE analysis of total cell extract is shown in FIG. 76 (lane 2; MW 49.2 kDa). It was also expressed in *E. coli* as a GST-fusion product. SDS-PAGE analysis of total cell extract is shown in FIG. 84 (lane 3; MW 74 kDa) and in FIG. 177 (lane 6; MW 74 kDa).

GBS400-GST was purified as shown in FIG. 217, lane 10.

Based on this analysis, it was predicted that these proteins and their epitopes could be useful antigens for vaccines or diagnostics.

Example 1025

A DNA sequence (GBSx1095) was identified in *S. agalactiae* <SEQ ID 3157> which encodes the amino acid sequence <SEQ ID 3158>. Analysis of this protein sequence reveals the following:

---

Possible site: 50
>>> Seems to have no N-terminal signal sequence
----- Final Results -----
   bacterial cytoplasm --- Certainty = 0.3473 (Affirmative) <succ>
      bacterial membrane --- Certainty = 0.0000 (Not Clear) <succ>
         bacterial outside --- Certainty = 0.0000 (Not Clear) <succ>

---

A related DNA sequence was identified in *S. pyogenes* <SEQ ID 3159> which encodes the amino acid sequence <SEQ ID 3160>. Analysis of this protein sequence reveals the following:

```
Identities = 227/413 (54%), Positives = 309/413 (73%)
Query:    1 MKIVEGVSLHLIKNQQFKTNHLTFRFSGDFNNKTVARRSLVAQMLVTANAKYPKVQEFRE       60
            MKIV+GV LHLIK +QFKTNH+TFRFSGD N KTVA++ LVAQML TAN  YP V++FRE
Sbjct:    1 MKIVQGVQLHLIKTKQFKTNHITFRFSGDLNQKTVAKKVLVAQMLATANECYPTVRQFRE       60

Query:   61 KLASLYGASLSTKISTKGLVHIVDIDIVFVKNTFTLEQENIVEQIITFLEDMLFSPLISL      120
            KLA LYGASLST + TKGLVHIVDIDI F+++ +    E I++++I FL+D+LFSPL+S+
Sbjct:   61 KLARLYGASLSTNVLTKGLVHIVDIDITFIQDRYACNGEKILDEMIQFLKDILFSPLLSI      120

Query:  121 EQYQTSIFDTEKKNLIQYLEADIEDNFYSSDLALKSLFYNNKTLRLPKYGTASLVESENS      180
              QYQ  +F+TEK NLI Y+E+D ED+FY S L +K LFY NK L++ +YG+  L+  E +
Sbjct:  121 AQYQPKVFETEKNNLINYIESDREDSFYYSSLKVKELFYCNKNLQMSEYGSPELIAKETA      180

Query:  181 FTAYQEFQKMLKEDQLDIFVVGDFDDYRMIQAFNRMAFEPRHKVLAFDYTQTYENITRSQ      240
              +T+YQEF KML EDQ+DIF++GDFDDYR++Q  ++    + R+K L F + Q   NI +
Sbjct:  181 YTSYQEFHKMLNEDQIDIFILGDFDDYRVVQLIHQFPLDNRNKNLNFFHLQNSVNIIKES      240

Query:  241 VEDKDVNQSIMQLAYHLPITYKDEDYFALIVFNGLFGAFAHSLLFTEIREKQGLAYTIGS      300
              +E + V+QSI+QLAYH P  +    DY+AL++ NGL G+FAHS LF +IRE++GLAY+IG
Sbjct:  241 IEKRAVHQSILQLAYHFPSVFGQRDYYALVLLNGLLGSFAHSRLFIKIREEEGLAYSIGC      300

Query:  301 QFDSFTGLFTIYAGIDKENRERFLKLINKQFNNIKMGRFSSTLLKQTKDILKMNYVLASD      360
              +FDS+TGLF IY GID ++R + L+LI ++ N IKMGRFS  L+K+T+ +L  N +L+ D
Sbjct:  301 RFDSYTGLFEIYTGIDSQHRTKTLQLIIQELNAIKMGRFSEQLIKKTRSMLLNNALLSED      360

Query:  361 NPKVIVDHIYHEHYLDQFHTSALFIDKVDDVTKSDIVSVATKLKLQAFYFLEG             413
                 K I++ IY     Y+D  ++     +I  V++V K+DI+ VA   LKLQ  YFLEG
Sbjct:  361 YNKNIIERIYRSSYIDSSYSIKNWIKGVNEVNKADIIKVANLLKLQTVYFLEG             413
```

Possible site: 45
>>> Seems to have no N-terminal signal sequence
----- Final Results -----
   bacterial cytoplasm --- Certainty = 0.4298 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 207/424 (48%), Positives = 276/424 (64%), Gaps = 3/424 (0%)
Query:    5 KITYQNLQEEVYKLTLESGLNVYLIPKPSFKETVGVLTANFGSLHTKYTRNGCVEHYPAG          64
            KI Y N+ E++Y + LE+GL VY I K  F E    +LT FGSL  K T +         PAG Sbjct:    6 KINYPNIDEDLYYVKLENGLTVYFIKKIGFLEKTAMLTVGFGSLDNKLTVDDESRDAPAG          65

Query:   65 IAHFLEHKLFELDKGQDAATQFTKYGAESNAFTTFDKTSFYFSTISHITNCLDILLDFVL         124
            IAHFLEHKLFE + G D + +FT+ GAE+NAFTTF++TSF+FST S      L++L  FVL Sbjct:   66 IAHFLEHKLFEDESGGDISLKFTQLGAETNAFTTFNQTSFFFSTASKFQENLELLQYFVL         125

Query:  125 TTNFTEESITKEKDIIKQEIEMYQDDPEYRLYQGVLSNLYPNSPLAFDIAGDYQSISQIT         184
            + N T+ES+++EK II QEI+MYQDD +YR Y G+L NL+P + LA DIAG    SI +IT Sbjct:  126 SANITDESVSREKKIIGQEIDMYQDDADYRAYSGILQNLFPKTSLANDIAGSKASIQKIT         185

Query:  185 LTDLQENHKDFYQLSNMNLVLVGQFSPQEIITYLQKNSHFTSY--SQNIDRDSISLEPVI         242
            L+  +H FYQ +NM+L +VG    E   +Q+    SY + +  D +   PVI Sbjct:  186 KILLETHHTYFYQPTNMSLFIVGDIDIDETFLAIQRFQTTLSYPDRKRVTVDPLHYYPVI         245

Query:  243 KNNSCHMTVTKPKLAIGYRKSNHMIHGSYLKEKIGLQLFFAMLLGWTSTINQDWYESGQI         302
            K++S  M VT KL +G+R  +   S L  +I L+LF +ML+GWTS I    YE G+I Sbjct:  246 KSSSVDMDVTTAKLVVGFRGYLTLTQHSLLTYRIALKLFLSMLIGWTSKIYHTLYEDGKI         305

Query:  303 DDSFDIEIEVHPDFECVIISLDTTEPIAFSTQLRLLLKNALQSSDLTESHLKNVKRELYG         362
            DDSFD+++E+H +F+ V+ISLDT EPIA S  +R L    S + T  HL  +K+E+YG Sbjct:  306 DDSFDVDVEIHHNFQFVLISLDTPEPIAMSNYIRQKLATIKISKEFTNEHLNLLKKEMYG         365

Query:  363 DFLRSLDSIENLAMQFVTYLYDG-KTMYLDLPSIVEELDLEDVITIGKDFLDNADTSDFV         421
            DF++SLDSIE+L  QF  YL D  K  Y D+P I+E L L+DV+TIGK F+   AD SDF Sbjct:  366 DFIQSLDSIEHLTHQFSLYLSDSDKETYFDIPKIIERLTLKDVVTIGKAFFEKADASDFT         425

Query:  422 IFPK                                                             425
            +FPK Sbjct:  426 VFPK                                                             429
```

Based on this analysis, it was predicted that these proteins and their epitopes could be useful antigens for vaccines or diagnostics.

Example 1026

A DNA sequence (GBSx1096) was identified in *S. agalactiae* <SEQ ID 3161> which encodes the amino acid sequence <SEQ ID 3162>. This protein is predicted to be phosphotidylglycerophosphate synthase (pgsA). Analysis of this protein sequence reveals the following:

Possible site: 55
>>> Seems to have no N-terminal signal sequence
INTEGRAL    Likelihood = −8.17    Transmembrane 17-33 (14-39)
INTEGRAL    Likelihood = −3.77    Transmembrane 92-108 (88-108)
INTEGRAL    Likelihood = −2.87    Transmembrane 144-160 (142-162)
INTEGRAL    Likelihood = −1.65    Transmembrane 42-58 (42-59)
----- Final Results -----
   bacterial membrane --- Certainty = 0.4270 (Affirmative) <succ>
   bacterial outside --- Certainty = 0.0000 (Not Clear) <succ>
   bacterial cytoplasm --- Certainty = 0.0000 (Not Clear) <succ>

A related GBS nucleic acid sequence <SEQ ID 10293> which encodes amino acid sequence <SEQ ID 10294> was also identified.

A related DNA sequence was identified in *S. pyogenes* <SEQ ID 3163> which encodes the amino acid sequence <SEQ ID 3164>. Analysis of this protein sequence reveals the following:

Possible site: 48
>>> Seems to have a cleavable N-term signal seq.
INTEGRAL    Likelihood = −6.64    Transmembrane 76-92 (72-102)
INTEGRAL    Likelihood = −5.36    Transmembrane 136-152 (131-164)
INTEGRAL    Likelihood = −2.34    Transmembrane 98-114 (97-114)
----- Final Results -----
   bacterial membrane --- Certainty = 0.3654 (Affirmative) <succ>
   bacterial outside --- Certainty = 0.0000 (Not Clear) <succ>
   bacterial cytoplasm --- Certainty = 0.0000 (Not Clear) <succ>

An alignment of the GAS and GBS proteins is shown below.

```
Identities = 145/180 (80%), Positives = 160/180 (88%)
Query:    8 MMKKENIPNLLTVVRILMIPLFIVLTSVTTSTTWHIVAAIVFAIASLTDYLDGYLARKWQ      67
            M+KKENIPNLLT+VRI MIP F+ +TS +    WHI AA++FAIAS TDYLDGYLARKW Sbjct:    1 MIKKENIPNLLTLVRIAMIPFFLFITSSSNKVGWHIFAAVIFAIASFTDYLDGYLARKWH      60

Query:   68 VVTNFGKFADPLADKMLVMSAFIMLVGLDLAPAWVSAIIICRELAVTGLRLLLVETGGTV     127
            V +NFGKFADPLADKMLVMSAFIMLVGL L PAWVSA+IICRELAVTGLRLLLVETGG V Sbjct:   61 VASNFGKFADPLADKMLVMSAFIMLVGLGLVPAWVSAVIICRELAVTGLRLLLVETGGKV     120

Query:  128 LAAAMPGKIKTATQMFAVIFLLVHWMTLGNIMLYIALFFTLYSGYDYFKGAGFLFKDTFK     187
            LAAAMPGKIKTATQM ++I LL HW+ LGN++LYIALFFT+YSGYDYFKGA FLFKDTFK Sbjct:  121 LAAAMPGKIKTATQMLSIILLLCHWIFLGNVLLYIALFFTIYSGYDYFKGASFLFKDTFK     180
```

A related GBS gene <SEQ ID 8705> and protein <SEQ ID 8706> were also identified. Analysis of this protein sequence reveals the following:

```
Lipop Possible site: -1    Crend: 4
SRCFLG: 0
McG:           Length of UR: 9
               Peak Value of UR: 3.03
               Net Charge of CR: 1
McG:           Discrim Score: 6.36
GvH:           Signal Score (-7.5): -0.400001
               Possible site: 48
>>> Seems to have a cleavable N-term signal seq.
Amino Acid Composition: calculated from 49
ALOM program count: 2 value: -3.77 threshold: 0.0
INTEGRAL    Likelihood = -3.77    Transmembrane 85-101 (81-101)
INTEGRAL    Likelihood = -2.87    Transmembrane 137-153 (135-155)
PERIPHERAL  Likelihood = 1.27     109
modified ALOM score: 1.25
icml HYPID: 7    CFP: 0.251
*** Reasoning Step: 3
----- Final Results -----
   bacterial membrane --- Certainty = 0.2508 (Affirmative) <succ>
      bacterial outside --- Certainty = 0.0000 (Not Clear) <succ>
         bacterial cytoplasm --- Certainty = 0.0000 (Not Clear) <succ>
```

Based on this analysis, it was predicted that these proteins and their epitopes could be useful antigens for vaccines or diagnostics.

Example 1027

A DNA sequence (GBSx1097) was identified in *S. agalactiae* <SEQ ID 3165> which encodes the amino acid sequence <SEQ ID 3166>. This protein is predicted to be ABC transporter ATP-binding protein (potA). Analysis of this protein sequence reveals the following:

```
Possible site: 32
>>> Seems to have no N-terminal signal sequence
----- Final Results -----
   bacterial cytoplasm --- Certainty = 0.1805 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database.

```
>GP: AAC61484 GB: AF082738 ABC transporter ATP-binding protein
[Streptococcus pyogenes]
Identities = 201/279 (72%), Positives = 231/279 (82%)
Query:    1 MTNIITVNNLFFKYDSNQTHYQLENVSFHVKQGEWLSIIGHNGSGKSTTVRLIDGLLEAE      60
            M+ II +  + F Y +Q    L+ VSFHVKQGEWLSIIGHNGSGKSTT+RLIDGLLE E Sbjct:   18 MSAIIELKKVTFNYHKDQEKPTLDGVSFHVKQGEWLSIIGHNGSGKSTTIRLIDGLLEPE      77

Query:   61 SGQIIIDGQELTEDNVWELRHKIGMVFQNPDNQFVGATVEDDVAFGLENKGIPLKDMKER     120
            SG II+DG  LT  NVWE+RHKIGMVFQNPDNQFVGATVEDDVAFGLENKGI +D+KER Sbjct:   78 SGSIIVDGDLLTITNVWEIRHKIGMVFQNPDNQFVGATVEDDVAFGLENKGIAHEDIKER     137

Query:  121 VDQALDLVGMSEFKMREPARLSGGQKQRVAIAGAVAMRPQVIILDEATSMLDPEGRLELI     180
            V+ AL+LVGM  FK +EPARLSOGQKQRVAIAGAVAM+P++IILDEATSMIDP+GRLELI Sbjct:  138 VNEALELVGMQNFKEKEPARLSGGQKQRVAIAGAVAMKPKIIILDEATSMLDPKGRLELI     197

Query:  181 RTIRAIRQKYNLTVISITHDLDEVALSDRVIVMKNGKVESTSTPKALFGRGNALISLGLD     240
             +TI+ IR  Y LTVISITHDLDEVALSDRV+VMK+G+VESTSTP+ LF RG+ L+ LGLD Sbjct:  198 KTIKNIRDDYQLTVISITHDLDEVALSDRVLVMKDGQVESTSTPEQLFARGDELLQLGLD     257

Query:  241 VPFTSRLMAELAANGLDIGTEYLTEKELEEQLWELNLKM                        279
            +PFT+ ++   L   G I    YLTEKELE QL +L  KM Sbjct:  258 IPFTTSVVQMLQEEGYPIDYGYLTEKELENQLCQLISKM                        296
```

A related DNA sequence was identified in *S. pyogenes* <SEQ ID 3167> which encodes the amino acid sequence <SEQ ID 3168>. Analysis of this protein sequence reveals the following:

```
Possible site: 19
>>> Seems to have no N-terminal signal sequence
----- Final Results -----
  bacterial cytoplasm --- Certainty = 0.2235 (Affirmative) <succ>
    bacterial membrane --- Certainty = 0.0000 (Not Clear) <succ>
     bacterial outside --- Certainty = 0.0000 (Not Clear) <succ>
```

RGD motif: 247-249

An alignment of the GAS and GBS proteins is shown below.

```
Identities = 200/279 (71%), Positives = 231/279 (82%)
Query:   1 MTNIITVNNLFFKYDSNQTHYQLENVSFHVKQGEWLSIIGHNGSGKSTTVRLIDGLLEAE     60
           M+ II +  + F Y +Q    L+ VSFHVKQGEWLSIIGHNGSGKSTT+RLIDGLLE E
Sbjct:  18 MSAIIELKKVIENYHKDQEKPTLDGVSFHVKQGEWLSIIGHNGSGKSTTIRLIDGLLEPE     77

Query:  61 SGQIIIDGQELTEDNVWELRHKIGMVFQNPDNQFVGATVEDDVAFGLENKGIPLKDMKER    120
           SG II+DG  LT  NVWE+RHKIGMVFQNPDNQFVGATVEDDVAFGLENKGI +D+KER
Sbjct:  78 SGSIIVDGDLLTITNVWEIRHKIGMVFQNPDNQFVGATVEDDVAFGLENKGIAHEDIKER    137

Query: 121 VDQALDLVGMSEFKMREPARLSGGQKQRVAIAGAVAMRPQVIILDEATSMLDPEGRLELI    180
           V+ AL+LVGM  FK +EPARLSGGQKQRVAIAGAVAM+P++IILDEATSMLDP+GRLELI
Sbjct: 138 VNHALELVGMQNFKEKEPARLSGGQKQRVAIAGAVAMKPKIIILDEATSMLDPKGRLELI    197

Query: 181 RTIRAIRQKYNLTVISITHDLDEVALSDRVIVMKNGKVESTSTPKALFGRGNRLISLGLD    240
           +TI+ IR  Y LTVISITHDLDEVALSDRV+VMK+G+VESTSTP+ LF RG+ L+ LGLD
Sbjct: 198 KTIKNIRDDYQLTVISITHDLDEVALSDRVLVMKDGQVESTSTPEQLFARGDELLQLGLD    257

Query: 241 VPFTSRLMAELAANGLDIGTEYLTEKELEEQLWELNLKM                        279
           +PFT+ ++  L    G  +   YLTEKELE QL +L   KM
Sbjct: 258 IPFTTSVVQMLQEEGYPVDYGYLTEKELENQLCQLISKM                        296
```

-continued

```
----- Final Results -----
    bacterial membrane --- Certainty = 0.1107 (Affirmative) <succ>
     bacterial outside --- Certainty = 0.0000 (Not Clear) <succ>
   bacterial cytoplasm --- Certainty = 0.0000 (Not Clear) <succ>
```

The protein has homology with the following sequences in the GENPEPT database.

Based on this analysis, it was predicted that these proteins and their epitopes could be useful antigens for vaccines or diagnostics.

Example 1028

A DNA sequence (GBSx1098) was identified in *S. agalactiae* <SEQ ID 3169> which encodes the amino acid sequence <SEQ ID 3170>. Analysis of this protein sequence reveals the following:

```
Possible site: 49
>>> Seems to have no N-terminal signal sequence
INTEGRAL    Likelihood = -0.27   Transmembrane 154-170 (154-170)
```

```
>GP: CAB11922 GB: Z99104 similar to ABC transporter (ATP-binding
protein) [Bacillus subtilis]
Identities = 141/242 (58%), Positives = 188/242 (77%), Gaps = 1/242 (0%)
Query:  16 TPFEGRALFDVNLKIEDASYTAFIGHTGSGKSTIMQLLNGLHIPTKGEVIVDDFSIKAGD     75
            TPFE  AL+D+N  I++ SY A IGHTGSGKST++Q LNGL  PTKG++ +    I+AG Sbjct:   3 TPFERLALYDINASIKEGSYVAVIGHTGSGKSTLLQHLNGLLKPTKGQISLGSTVIQAGK     62

Query:  76 KNKEIKFIRQKVGLVFQFPESQLFEETVLKDVAFGPQNFGISQIEAERLAEEKLRLVGIS    135
            KNK++K +R+KVG+VFQFPE  QLFEETVLKD++ FGP NFG+ +  +AE+ A E L+LVG+S
Sbjct:  63 KNKDLKKLRKKVGIVFQFPEHQLFEETVLKDISFGPMNFGVKKEDAEQKAREMLQLVGLS    122
```

```
-continued
Query: 136 EDLFDKNPFELSGGQMRRVAIAGILAMEPKVLVLDEPTAGLDPKGRKELMTLFKNLHKKG    195
            E+L D++PFELSGGQMRRVAIAG+LAM+P+VLVLDEPTAGLDP+GRKE+M +F  LH++G Sbjct: 123 EELLDRSPFELSGGQMRRVAIAGVLAMDPEVLVLDEPTAGLDPRGRKEIMDMFYELHQRG    182

Query: 196 -MTIVLVTHLMDDVADYADYVYVLEAGKVTLSGQPKQIFQEVELLESKQLGVPKITKFAQ    254
            +T  +LVTH M+D A YAD + V+  G +  SG P+ +F + E +    L +P+  KF +

Sbjct: 183 NLTTILVTHSMEDAAAYADEMIVMHKGTIQASGSPRDLFLKGEEMAGWGLDLPETIKFQR    242

Query: 255 RL    256
            L

Sbjct: 243 HL    244
```

A related DNA sequence was identified in *S. pyogenes* <SEQ ID 3171> which encodes the amino acid sequence <SEQ ID 3172>. Analysis of this protein sequence reveals the following:

Possible site: 40
>>> Seems to have no N-terminal signal sequence
INTEGRAL     Likelihood = −0.27    Transmembrane 154-170 (154-170)
----- Final Results -----
    bacterial membrane --- Certainty = 0.1107 (Affirmative) <succ>
      bacterial outside --- Certainty = 0.0000 (Not Clear) <succ>
        bacterial cytoplasm --- Certainty = 0.0000 (Not Clear) <succ>

The protein has homology with the following sequences in the databases:

```
>GP: CAB11922 GB: Z99104 similar to ABC transporter (ATP-binding
protein) [Bacillus subtilis]
Identities = 146/259 (56%), Positives = 187/259 (71%), Gaps = 2/259 (0%)
Query:  16 TPFEGRALFNINLDILDGSYTAFIGHTGSGKSTIMQLLNGLHVPTTGIVSVDKQDITNHS    75
            TPFE  AL++IN  I +GSY A IGHTGSGKST++Q LNGL  PT G +S+    I Sbjct:   3 TPFERLALYDINASIKEGSYVAVIGHTGSGKSTLLQHLNGLLKPTKGQISLGSTVIQAGK    62

Query:  76 KNKEIKSIRKHVGLVFQFPESQLFEETVLKDVAFGPQNFGVSPEEAEALAREKLALVGIS    135
            KNK++K +RK VG+VFQFPE QLFEETVLKD++FGP NFGV  E+AE  ARE L LVG+S Sbjct:  63 KNKDLKKLRKKVGIVFQFPEHQLFEETVLKDISFGPMNFGVKKEDAEQKAREMLQLVGLS    122

Query: 136 ENLFEKNPFELSGGQMRRVAIAGILAMQPKVLVLDEPTAGLDPKGRKELMTIFKKLHQSG    195
            E L +++PFELSGGQMRRVAIAG+LAM P+VLVLDEPTAGLDP+GRKE+M +F +LHQ G Sbjct: 123 EELLDRSPFELSGGQMRRVAIAGVLAMDPEVLVLDEPTAGLDPRGRKEIMDMFYELHQRG    182

Query: 196 -MTIVLVTHLMDDVANYADEVYVLDKGKIILSGKPKTIFQQVSLLEKKQLGVPKVTKLAQ    254
            +T  +LVTH M+D A YAD + V+ KG I SG   P+ +F +   +    L +P+ K +

Sbjct: 183 NLTTILVTHSMEDAAAYADEMIVMHKGTIQASGSPRDLFLKGEEMAGWGLDLPETIKFQR    242

Query: 255 RL-VDRGIPISSLPITLEE    272
            L     G+ +    +T+E+

Sbjct: 243 HLEAALGVRFNEPMLTIED    261
```

An alignment of the GAS and GBS proteins is shown below.

```
Identities = 218/280 (77%), Positives = 241/280 (85%)
Query:   1 MGIEFKNVSYTYQAGTPFEGRALFDVNLKIEDASYTAFIGHTGSGKSTIMQLLNGLHIPT    60
            M I  +NVSYTYQAGTPFEGRALF++NL I D SYTAFIGHTGSGKSTIMQLLNGLH+PT Sbjct:   1 MSINLQNVSYTYQAGTPFEGRALFNINLDILDGSYTAFIGHTGSGKSTIMQLLNGLHVPT    60

Query:  61 KGEVIVDDFSIKAGDKNKEIKFIRQKVGLVFQFPESQLFEETVLKDVAFGPQNFGISQIE    120
            G  V VD  I   KNKEIK IR+ VGLVFQFPESQLFEETVLKDVAFGPQNFG+S  E
```

```
Sbjct:   61 TGIVSVDKQDITNHSKNKEIKSIRKHVGLVFQFPESQLFEETVLKDVAFGPQNFGVSPEE      120

Query:  121 AERLAEEKLRLVGISEDLFDKNPFELSGGQMRRVAIAGILAMEPKVLVLDEPTAGLDPKG      180
             AE LA EKL LVGISE+LF+KNPFELSGGQMRRVAIAGILAM+PKVLVLDEPTAGLDPKG
Sbjct:  121 AEALAREKLALVGISENLFEKNPFELSGGQMRRVAIAGILAMQPKVLVLDEPTAGLDPKG      180

Query:  181 RKELMTLFKNLHKKGMTIVLVTHLMDDVADYADYVYVLEAGKVTLSGQPKQIFQEVELLE      240
             RKELMT+FK LH+ GMTIVLVTHLMDDVA+YAD+VYVL+ GK+ LSG+PK IFQ+V LLE
Sbjct:  181 RKELMTIFKKLHQSGMTIVLVTHLMDDVANYADFVYVLDKGKIILSGKPKTIFQQVSLLE      240

Query:  241 SKQLGVPKITKFAQRLSHKGLNLPSLPITINEFVEAIKHG                        280
             KQLGVPK+TK AQRL  +G+ + SLPIT+ E  E +KHG
Sbjct:  241 KKQLGVPKVTKLAQRLVDRGIPISSLPITLEELREVLKHG                        280
```

SEQ ID 3170 (GBS401) was expressed in *E. coli* as a His-fusion product. SDS-PAGE analysis of total cell extract is shown in FIG. 76 (lane 3; MW 34.4 kDa). It was also expressed in *E. coli* as a GST-fusion product. SDS-PAGE analysis of total cell extract is shown in FIG. 84 (lane 4; MW 59 kDa).

GBS401-GST was purified as shown in FIG. 218, lane 2.

Based on this analysis, it was predicted that these proteins and their epitopes could be useful antigens for vaccines or diagnostics.

Example 1029

A DNA sequence (GBSx1099) was identified in *S. agalactiae* <SEQ ID 3173> which encodes the amino acid sequence <SEQ ID 3174>. Analysis of this protein sequence reveals the following:

```
Possible site: 43
>>> Seems to have no N-terminal signal sequence
INTEGRAL     Likelihood = -10.46   Transmembrane 47-63 (25-69)
INTEGRAL     Likelihood = -8.81    Transmembrane 252-268 (249-269)
INTEGRAL     Likelihood = -7.91    Transmembrane 116-132 (110-141)
INTEGRAL     Likelihood = -4.25    Transmembrane 29-45 (25-46)
INTEGRAL     Likelihood = -2.55    Transmembrane 77-93 (77-95)
INTEGRAL     Likelihood = -0.43    Transmembrane 199-215 (199-215)
----- Final Results -----
    bacterial membrane --- Certainty = 0.5182 (Affirmative) <succ>
       bacterial outside --- Certainty = 0.0000 (Not Clear) <succ>
         bacterial cytoplasm --- Certainty = 0.0000 (Not Clear) <succ>
```

A related GBS nucleic acid sequence <SEQ ID 8707> which encodes amino acid sequence <SEQ ID 8708> was also identified. Analysis of this protein sequence reveals the following:

```
Lipop: Possible site: -1    Crend: 7
SRCFLG: 0
McG:         Length of UR: 8
             Peak Value of UR: 0.65
             Net Charge of CR: 1
McG:         Discrim Score: -10.55
GvH:         Signal Score (-7.5): 1.45
             Possible site: 37
>>> Seems to have no N-terminal signal sequence
Amino Acid Composition: calculated from 1
ALOM program count: 6 value: -10.46    threshold: 0.0
INTEGRAL     Likelihood = -10.46   Transmembrane 41-57 (19-63)
INTEGRAL     Likelihood = -8.81    Transmembrane 246-262 (243-263)
INTEGRAL     Likelihood = -7.91    Transmembrane 110-126 (104-135)
INTEGRAL     Likelihood = -4.25    Transmembrane 23-39 (19-40)
INTEGRAL     Likelihood = -2.55    Transmembrane 71-87 (71-89)
INTEGRAL     Likelihood = -0.43    Transmembrane 193-209 (193-209)
PERIPHERAL   Likelihood = 0.79     90
modified ALOM score: 2.59
icml HYPID: 7    CFP: 0.518
*** Reasoning Step: 3
----- Final Results -----
    bacterial membrane --- Certainty = 0.5182 (Affirmative) <succ>
       bacterial outside --- Certainty = 0.0000 (Not Clear) <succ>
         bacterial cytoplasm --- Certainty = 0.0000 (Not Clear) <succ>
```

The protein has homology with the following sequences in the GENPEPT database.

```
>GP: CAB11923 GB: Z99104 ybaF [Bacillus subtilis]
Identities = 133/263 (50%), Positives = 191/263 (72%)
Query:    7 MDKLILGRYIPGNSLIHKLDPRSKLLAMLLFIIIVFWANNVVTNVIVFIFTLVIVGLSQI      66
            MD +I+G+Y+PG SL+H+LDPR+KL+ + LF+ IVF ANNV T ++   +FT+ +V L+++
Sbjct:    2 MDSMIIGKYVPGTSLVHRLDPRTKLITIFLFVCIVFLANNVQTYALLGLFTIGVVSLTRV      61

Query:   67 KFSYFFNGIKPMVGIILFTTLFQMLFAQGGQVIFSFWIFSITSLGLQQAALIFMRFVLII     126
            FS+    G+KP++ I+LFT L  +L     G +IF       +   GL Q  I +RFV +I
Sbjct:   62 PFSFLMKGLKPIIWIVLFTFLLHILMTHEGPIIFQIGFSRVYEGGLVQGIFISLRFVYLI     121

Query:  127 FFSTLLTLTTTPLSLADAMESLLKPLEVLRVPAHEIGLMLSLSLRFVPTLMDDTTRIMNA     186
            +TLLTLTTTP+ + D +E LL PL+ L++P HE+ LM+S+SLRF+PTLM++T +IM A
Sbjct:  122 LITTLLTLTTTPIEITDGMEQLLNPLKKLKLPVHELALMMSISLRFIPTLMEETDKIMKA     181
```

```
Query:  187 QRARGVDFGEGNLIHKVKSIIPILIPLFASSFKRADALAIAMEARGYQGGANRSKYRLLK    246
             Q ARGVDF G +  +VK+I+P+L+PLF S+FKRA+ LA+AMEARGYQGG  R+KYR L Sbjct:  182 QMARGVDFTSGPVKERVKAIVPLLVPLFVSAFKRAEELAVAMEARGYQGGEGRTKYRKLV   241

Query:  247 WTVRDTFSILLMLLLGLSLFLLK                                       269
             WT +DT  I+ +++L   LF L+

Sbjct:  242 WTGKDTSVIVSLIVLAALLFSLR                                       264
```

A related DNA sequence was identified in *S. pyogenes* <SEQ ID 3175> which encodes the amino acid sequence <SEQ ID 3176>. Analysis of this protein sequence reveals the following:

```
Possible site: 53
>>> Seems to have no N-terminal signal sequence
INTEGRAL    Likelihood = -9.50    Transmembrane 246-262 (243-265)
INTEGRAL    Likelihood = -9.34    Transmembrane 110-126 (103-135)
INTEGRAL    Likelihood = -6.69    Transmembrane 41-57 (40-58)
INTEGRAL    Likelihood = -2.81    Transmembrane 23-39 (21-40)
INTEGRAL    Likelihood = -1.01    Transmembrane 62-78 (62-78)
INTEGRAL    Likelihood = -0.27    Transmembrane 193-209 (193-209)
----- Final Results -----
    bacterial membrane --- Certainty = 0.4800 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the databases:

```
>GP: CAB11923 GB: Z99104 ybaF [Bacillus subtilis]
Identities = 138/263 (52%), Positives = 195/263 (73%)
Query:    1 MDKLILGRYIPGDSLIHRLDPRSKLLAMIIYIVIIFWANNVQTYALLGLFTIGVVSLTRV    60
            MD +I+G+Y+PG SL+HRLDPR+KL+ + +++ I+F ANNV T L+    FT+ VV L+++

Sbjct:    2 MDSMIIGKYVPGTSLVHRLDPRTKLITIFLFVCIVFLANNVQTYALLGLFTIGVVSLTRV   61

Query:   61 KLSFFLNGVKPMIGIILFTTLFQMFFSQGGKVIFSWWFISITDLGLSQAILIFMRFVLII  120
            SF +  G+KP+I I+LFT L +  +   G +IF   F + + GL Q I I +RFV +I Sbjct:   62 PFSFLMKGLKPIIWIVLFTFLLHILMTHEGPIIFQIGFSRVYEGGLVQGIFISLRFVYLI  121

Query:  121 FFSTLLTLTTTPLSLSDAVESLLKPLTRFKVPAHEIGLMLSLSLRFVPTLMDDTTRIMNA  180
            +TLLTLTTTP+ ++D +E LL PL + K+P HE+ LM+S+SLRF PTLM++T +IM A Sbjct:  122 LITTLLTLTTTPIEITDGMEQLLNPLKKLKLPVHELALMMSISLRFIPTLMEETDKIMKA  181

Query:  181 QRARGVDFGEGNLIQKVESIIPILIPLFASSFKRADALAIAMEARGYQGGEGRTKYRQLD  240
            Q ARGVDF G + ++VK+I+P+L+PLF S+FKRA+ LA+AMEARGYQGGEGRTKYR+L Sbjct:  182 QMARGVDFTSGPVKERVKAIVPLLVPLFVSAFKRAEELAVAMEARGYQGGEGRTKYRKLV  241

Query:  241 WQLKDSLAIGIVSLLGLLLFFLK                                       263
            W  KD+  I +  +L  LLF L+

Sbjct:  242 WTGKDTSVIVSLIVLAALLFSLR                                       264
```

An alignment of the GAS and GBS proteins is shown below.

```
Identities = 210/263 (79%), Positives = 237/263 (89%)
Query:    7 MDKLILGRYIPGNSLIHKLDPRSKLLAMLLFIIIVFWANNVVTNVIVFIFTLVIVGLSQI    66
            MDKLILGRYIPG+SLIH+LDPRSKLLAM+++I+I+FWANNVVTN+++  FTL +V LS+I Sbjct:    1 MDKLILGRYIPGDSLIHRLDPRSKLLAMIIYIVIIFWANNVVTNLLMLTFTLAVVFLSKI    60

Query:   67 KFSYFFNGIKPMVGIILFTTLFQMLFAQGGQVIFSFWIFSITSLGLQQAALIFMRFVLII   126
            K S+F NG+KPM+GIILFTTLFQM F+QGG+VIFS+W  SIT LGL QA LIFMRFVLII
```

```
-continued
Sbjct:   61 KLSFFLNGVKPMIGIILFTTLFQMFFSQGGKVIFSWWFISITDLGLSQAILIFMRFVLII       120

Query:  127 FFSTLLTLTTTPLSLADAVESLLKPLEVLRVPAHEIGLMLSLSLRFVPTLMDDTTRIMNA       186
             FFSTLLTLTTTPLSL+DAVESLLKPL   +VPAHEIGLMLSLSLRFVPTLMDDTTRIMNA
Sbjct:  121 FFSILLTLTTTPLSLSDAVESLLKPLTRFKVPAHEIGLMLSLSLRFVPTLMDDTTRIMNA       180

Query:  187 QRARGVDFGEGNLIHKVKSIIPILIPLFASSFKRADALAIAMEARGYQGGANRSKYRLLK       246
             QRARGVDFGEGNLI KVKSIIPILIPLFASSFKRADALAIAMEARGYQGG  R+KYR L
Sbjct:  181 QRARGVDFGEGNLIQKVKSIIPILIPLFASSFKRADALAIAMEARGYQGGEGRTKYRQLD       240

Query:  247 WTVRDTFSILLMLLLGLSLFLLK                                           269
             W ++D+ +I ++ LLGL LF LK
Sbjct:  241 WQLKDSLAIGIVSLLGLLLFFLK                                           263
```

Based on this analysis, it was predicted that these proteins and their epitopes could be useful antigens for vaccines or diagnostics.

Example 1030

A DNA sequence (GBSx1101) was identified in *S. agalactiae* <SEQ ID 3179> which encodes the amino acid sequence <SEQ ID 3180>. This protein is predicted to be unnamed protein product. Analysis of this protein sequence reveals the following:

Possible site 45
>>> Seems to have an uncleavable N-term signal seq
INTEGRAL    Likelihood = −12.05    Transmembrane 22-38 (16-43)
----- Final Results -----
  bacterial membrane --- Certainty = 0.5819 (Affirmative) <succ>
  bacterial outside --- Certainty = 0.0000 (Not Clear) <succ>
  bacterial cytoplasm --- Certainty = 0.0000 (Not Clear) <succ>

A related DNA sequence was identified in *S. pyogenes* <SEQ ID 3181> which encodes the amino acid sequence <SEQ ID 3182>. Analysis of this protein sequence reveals the following:

Possible site: 31
>>> Seems to have a cleavable N-term signal seq.
----- Final Results -----
  bacterial outside --- Certainty = 0.3000 (Affirmative) <succ>
  bacterial membrane --- Certainty = 0.0000 (Not Clear) <succ>
  bacterial cytoplasm --- Certainty = 0.0000 (Not Clear) <succ>

An alignment of the GAS and GBS proteins is shown below.

```
Identities = 116/233 (49%), Positives = 140/233 (59%), Gaps = 39/233 (16%)
Query:    9 KLNVKKHHLAYGAITLVALFSCILAVMVIFKSSQVTTESLSKADKVRVAKKSK------       61
            K N+K+ + +G  LVAL   ILA++ F S   T+S +K  + ++      K
Sbjct:    4 KENLKQRYFNFG---LVALALTILAITFAFSSKNADTKSYAKKSESKMVTIDKAPKNNHA     60

Query:   62 MTKATSKSKVEDVKQAPKPSQASNEAPKSSSQSTEANSQQQVTASEEAAVEQAVVTENTP    121
            +TK  SK K + +    P  P+  ++ AP             T +EE  V Q  VT
Sbjct:   61 ITKEESKEKAKSIASEPIPTVENSVAP---------------TVTEEVPVVQQEVT----    101

Query:  122 ATSQAQQAYAVTETTYRPAQHQTSGQVLSNGNTAGAIGSAAAAQMAAATGVPQSTWEHII    181
                   Q    V+   Y P    +    VLSNGNTAG +GS AAAQMAAATGVPQSTWEHII
Sbjct:  102 -----QTVQQVSSVAYNP-----NNVVLSNGNTAGIVGSQAAAQMAAATGVPQSTWEHII    151

Query:  182 ARESNGNPNVANASGASGLFQTMPGWGSTATVQDQVNSAIKAYRAQGLSAWGY          234
            ARESNGNPN ANASGASGLFQTMPGWGSTATV+DQVN+A+KAY AQGLSAWGY
Sbjct:  152 ARESNGNPNAANASGASGLFQTMPGWGSTATVEDQVNAALKAYSAQGLSAWGY          204
```

A related GBS gene <SEQ ID 8713> and protein <SEQ ID 8714> were also identified. Analysis of this protein sequence reveals the following:

Lipop: Possible site: −1    Crend: 8
McG: Discrim Score: 2.48
GvH: Signal Score (−7.5) : −3.74
Possible site: 45
>>> Seems to have an uncleavable N-term signal seq
ALOM program count: 1  value: −12.05  threshold: 0.0
INTEGRAL    Likelihood = −12.05 Transmembrane 22-38 (16-43)
PERIPHERAL  Likelihood = 4.29   156
modified ALOM score: 2.91
*** Reasoning Step: 3
----- Final Results -----
  bacterial membrane --- Certainty = 0.5819 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
61.8/68.7% over 114aa
Staphylococcus aureus
GP|7959131| secretory protein SAI-B Insert characterized
ORF01057(664-1002 of 1302)
GP|7959131|dbj|BAA95959.1||AB042839(119-233 of 233) secretory protein SAI-B
{Staphylococcus aureus}
% Match = 15.1
% Identity = 61.7 % Similarity = 68.7
Matches = 71 Mismatches = 34 Conservative Sub.s = 8

438       468       498       528       558       588       618       648
IFKSSQVTTESLSKADKVRVAKKSKMTKATSKSKVEDVKQAPKPSQASNEAPKSSSQSTEANSQQQVTASEEAAVEQAVV

VDQAHLVDLAHNHQDQLNAAPIKDGAYDIHFVKDGFQYNFTSNGTTWSWSYEAANGQTAGFSNVAGADYTTSYNQGSNVQ
            50        60        70        80        90       100       110

678       708       735       762       792       822       852       882
TENTPATSQAQQAYAVTETTYRP-AQHQTSGQV-LSNGNTAGAIGSAAAAQMAAATGVPQSTWEHIIARESNGNPNVANA
: :  | |      ||:  ||   :   ||    | ||||||||| ||:||  ||  |||| |||  |||||||||  | |
SVSYNAQSSNSNVEAVSAPTYHNYSTSTTSSSVRLSNGNTAGATGSSAAQIMAQRTGVPASTWAAIIARESNGQVNAYNP
           130       140       150       160       170       180       190

912       942       972      1002      1032      1062      1092      1122
SGASGLFQTMPGWGSTATVQDQVNSAIKAYRAQGLSAWGY**IAIN*LYTVVNNNYRLLKQINKNATVKL*RFYLFSGKE
||||||||||||||| |  ||   |:|:|:|||:||||  |||:
SGASGLFQTMPGQGPTNTVDQQINAAVKAYKAQGLGAWGF
```

SEQ ID 3180 (GBS25) was expressed in *E. coli* as a His-fusion product. SDS-PAGE analysis of total cell extract is shown in FIG. 14 (lane 5; MW 25 kDa). It was also expressed in *E. coli* as a GST-fusion product. SDS-PAGE analysis of total cell extract is shown in FIG. 16 (lane 11; MW 50 kDa), FIG. 63 (lane 6; MW 50.3 kDa), FIG. 66 (lane 6; MW 50 kDa) and in FIG. 175 (lane 8 & 9; MW 50 kDa).

Purified GBS25-GST is shown in FIG. 9A, FIG. 193 (lane 11) and FIG. 210 (lane 5).

The purified GBS25-GST fusion product was used to immunise mice (lane 1+2+3 products; 20μg/mouse). The resulting antiserum was used for Western blot (FIG. 95B), FACS (FIG. 95C), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 1031

A DNA sequence (GBSx1103) was identified in *S. agalactiae* <SEQ ID 3183> which encodes the amino acid sequence <SEQ ID 3184>. This protein is predicted to be L-serine dehydratase 1 (sdaA-2). Analysis of this protein sequence reveals the following:

---

Possible site: 61

>>> Seems to have no N-terminal signal sequence

INTEGRAL Likelihood = –0.85 Transmembrane 205-221 (205-221)

INTEGRAL Likelihood = –0.59 Transmembrane 171-187 (171-187)

INTEGRAL Likelihood = –0.53 Transmembrane 226-242 (226-242)

----- Final Results ----- bacterial membrane --- Certainty = 0.1341 (Affirmative) <succ> bacterial outside --- Certainty = 0.0000 (Not Clear) <succ> bacterial cytoplasm --- Certainty = 0.0000 (Not Clear) <succ>

---

The protein has homology with the following sequences in the GENPEPT database.

```
>GP: CAB13459 GB: Z99112 similar to L-serine dehydratase [Bacillus subtilis]
Identities = 176/289 (60%), Positives = 224/289 (76%), Gaps = 1/289 (0%)
Query:   1 MFYTIEELVEQANSQHKGNIAELMIQTEIEMTGRSREEIRYIMSRNLEVMKASVIDGLTP       60
             MF  ++EL+E    + +  I+++MI  E+E+T +++E+I   M  NL VM+A+V  GL
Sbjct:   1 MFRNVKELIE-ITKEKQILISDVMIAQEMEVTEKTKEDIFQQMDHNLSVMEAAVQKGLEG      59

Query:  61 SKSISGLTGGDAVKMDQYLQSGKTISDTTILAAVRNAMAVNELNAKMGLVCATPTAGSAG     120
             S +GLTGGDAVK+  Y++SGK++S    IL AV  A+A NE+NA MG +CATPTAGSAG
Sbjct:  60 VTSQTGLTGGDAVKLQAYIRSGKSLSGPLILDAVSKAVATNEVNAAMGTICATPTAGSAG     119

Query: 121 CLPAVISTAIEKLNLTEEEQLDFLFTAGAFGLVIGNNASISGAEGGCQAEVGSASAMAAA     180
             +P +       EKLN T E+ + FLFTAGAFG V+ NNASISGA GGCQAEVGSAS MAAA
Sbjct: 120 VVPGTLFAVKEKLNPTREQMIRFLFTAGAFGFVVANNASISGAAGGCQAEVGSASGMAAA     179

Query: 181 ALVMAAGGTPFQASQATAFVIKNMLGLICDPVAGLVEVPCVKRNALGSSFALVAADMALA     240
             A+V  AGGTP Q+++A+A  +KNMLGL+CDPVAGLVEVPCVKRNA+G+S A++AADMALA
```

-continued

```
Sbjct:  180 AIVEMAGGTPEQSAEAMAITLKNMLGLVCDPVAGLVEVPCVKRNAMGASNAMIAADMALA       239

Query:  241 GIESQIPVDEVIDAMYQVGSSLPTAFRETAEGGLAATPTGRRYSKEIFG                 289
            GI S+IP DEVIDAMY++G ++PTA RET +GGLAATPTGR   K+IFG
Sbjct:  240 GITSRIPCDEVIDAMYKIGQTMPTALRETGQGGLAATPTGRELEKKIFG                 288
```

A related DNA sequence was identified in *S. pyogenes* <SEQ ID 3185> which encodes the amino acid sequence <SEQ ID 3186>. Analysis of this protein sequence reveals the following:

Possible site: 55
>>> Seems to have no N-terminal signal sequence
INTEGRAL Likelihood = −1.12 Transmembrane 196-212 (196-213)
INTEGRAL Likelihood = −0.27 Transmembrane 226-242 (226-242)
----- Final Results -----
   bacterial membrane --- Certainty = 0.1447 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the databases:

```
>GP: CAB13459 GB: Z99112 similar to L-serine dehydratase [Bacillus subtilis]
Identities = 173/289 (59%), Positives = 222/289 (75%), Gaps = 1/289 (0%)
Query:    1 MFYTIEELVKQADQQFNGNIAELMIATEVEMSGRNREDIIKIMSRNLQVMKAAVTEGLTS      60
            MF  ++EL++    ++    I+++MIA E+E++ + +EDI + M  NL VM+AAV +GL
Sbjct:    1 MFRNVKELIEITKEK-QILISDVMIAQEMEVTEKTKEDIFQQMDHNLSVMEAAVQKGLEG     59

Query:   61 TKSISGLTGGDAVKMDNYIKKGNSLSDTTILNAVRNAIAVNELNAKMGLVCATPTAGSAG    120
              S +GLTGGDAVK+   YI+ G SLS     IL+AV  A+A NE+NA MG +CATPTAGSAG
Sbjct:   60 VTSQTGLTGGDAVKLQAYIRSGKSLSGPLILDAVSKAVATNEVNAAMGTICATPTAGSAG    119

Query:  121 CLPAVLATAIEKLDLSEKEQLEFLFTAGAFGLVIGNNASISGAEGGCQAEVGSAAAMSAA    180
              +P  L    EKL+ + ++ + FLFTAGAFG V+ NNASISGA GGCQAEVGSA+ M+AA
Sbjct:  120 VVPGTLFAVKEKLNPTREQMIRFLETAGAFGFVVANNASISGAAGGCQAEVGSASGMAAA    179

Query:  181 ALVKAAGGTSHQASQAIAEVIKNLLGLVCDPVAGLVEVPCVKRNALGASFALVAADMALA    240
              A+V+ AGGT  Q+++A+A   +KN+LGLVCDPVAGLVEVPCVKRNA+GAS A++ADMALA
Sbjct:  180 AIVEMAGGTPEQSAEAMAITLKNMLGLVCDPVAGLVEVPCVKRNAMGASNAMIAADMALA    239

Query:  241 DIDSQIPVDEVIDAMYQVGSAMPTAFRETAEGGLAATPTGRRYSVEIFG                 289
             I S+IP DEVIDAMY++  MPTA RET +GGLAATPTGR    +IFG
Sbjct:  240 GITSRIPCDEVIDAMYKIGQTMPTALRETGQGGLAATPTGRELEKKIFG                 288
```

An alignment of the GAS and GBS proteins is shown below.

```
Identities = 244/290 (84%), Positives = 273/290 (94%)
Query:    1 MFYTIEELVEQANSQHKGNIAELMIQTEIEMTGRSREEIRYIMSRNLEVMKASVIDGLTP      60
            MFYTIEELV+QA+ Q  GNIAELMI TE+EM+GR+RE+I   IMSRNL+VMKA+V +GLT
Sbjct:    1 MFYTIEELVKQADQQFNGNIAELMIATEVEMSGRNREDIIKIMSRNLQVMKAAVTEGLTS     60

Query:   61 SKSISGLTGGDAVKMDQYLQSGKTISDTTILAAVRNAMAVNELNAKMGLVCATPTAGSAG    120
            +KSISGLTGGDAVKMD Y++ G ++SDTTIL AVRNA+AVNELNAKMGLVCATPTAGSAG
Sbjct:   61 TKSISGLTGGDAVKMDNYIKKGNSLSDTTILNAVRNAIAVNELNAKMGLVCATPTAGSAG    120

Query:  121 CLPAVISTAIEKLNLTEEEQLDFLFTAGAFGLVIGNNASISGAEGGCQAEVGSASAMAAA    180
            CLPAV++TAIEKL+L E+EQL+FLFTAGAFGLVIGNNASISGAEGGCQAEVGSA+AM+AA
Sbjct:  121 CLPAVLATAIEKLDLSEKEQLEFLFTAGAFGLVIGNNASISGAEGGCQAEVGSAAAMSAA    180
```

```
Query: 181 ALVMAAGGTPFQASQAIAFVIKNMLGLICDPVAGLVEVPCVKRNALGSSFALVAADMALA    240
            ALV AAGGT  QASQATAFYIKN+LGL+CDPVAGLVEVPCVKRNALG+SFALVAADMALA Sbjct: 181 ALVKAAGGTSHQASQAIAPVIKNLLGLVCDPVAGLVEVPCVKRNALGASFALVAADMALA    240

Query: 241 GIESQIPVDEVIDAMYQVGSSLPTAFRETAEGGLAATPTGRRYSKEIFGE    290
            I +SQIPVDEVIDAMYQVGS++PTAFRETAEGGLAATPTGRRYS EIFGE Sbjct: 241 DIDSQIPVDEVIDAMYQVGSAMPTAFRETAEGGLAATPTGRRYSVEIFGE    290
```

SEQ ID 3184 (GBS358) was expressed in *E. coli* as a His-fusion product. SDS-PAGE analysis of total cell extract is shown in FIG. 176 (lane 6; MW 35 kDa).

Based on this analysis, it was predicted that these proteins and their epitopes could be useful antigens for vaccines or diagnostics.

Example 1032

A DNA sequence (GBSx1104) was identified in *S. agalactiae* <SEQ ID 3187> which encodes the amino acid sequence <SEQ ID 3188>. Analysis of this protein sequence reveals the following:

Possible site: 28
>>> Seems to have a cleavable N-term signal seq.
----- Final Results -----
    bacterial outside --- Certainty = 0.3000 (Affirmative) <succ>
        bacterial membrane --- Certainty = 0.0000 (Not Clear) <succ>
            bacterial cytoplasm --- Certainty = 0.0000 (Not Clear) <succ>

The protein has homology with the following sequences in the GENPEPT database.

```
>GP: BAB06216 GB: AP001515 L-serine dehydratase beta subunit
[Bacillus halodurans]
Identities = 101/216 (46%), Positives = 156/216 (71%), Gaps =2/216 (0%)
Query:    4 LKFQSVFDIIGPVMIGPSSSHTAGAVRIGKVVHSIFGE-PSEVTFHLYNSFAKTYQGHGT    62
            +K+++VFDIIGPVMIGPSSSHTAGA RIG+V ++FG+ P    + Y SFA+TY+GRGT Sbjct:    1 MKYRTVFDIIGPVMIGPSSSHTAGAARIGRVARTLFGQQPERCDIYFYGSFAETYKGHGT    60

Query:   63 DKALVAGILGMDTDNPDIKNSLEIAHQKGIKIYWDILKDSNSPHPNTAKITVKNGDRSMS   122
            D A+V GIL  DT +P I  SL++A +KG+++Y+   +++ + HPNTAK+ ++ G+    +

Sbjct:   61 DVAIVGGILDFDTFDPRIPRSLQLAKEKGVRVYFHE-EEAITDHPNTAKVVLQKGEDQLE   119

Query:  123 ITGVSIGGGNIQVTELNGFSVSLTMNTPTLIIVHQDIPGMIAKVTDILSDFNINIAQMNV   182
            + GVSIGGG I++ ELNGF + L+ N P +++VH D  G+IA V+++L+   INI  M V Sbjct:  120 VVGVSIGGGKIEIVELNGFHLKLSGNHPAILVVHTDRFGVIASVSNMLAKHEINIGHMEV   179

Query:  183 TRESAGEKAIMIIEVDSRDCQQAVKKIEAIPHLHNV   218
            +R+  G++A+M+IEVD      ++++E +P++  V Sbjct:  180 SRKEKGKEALMVIEVDQNVDDLLLQELERLPNIVTV   215
```

A related DNA sequence was identified in *S. pyogenes* <SEQ ID 3189> which encodes the amino acid sequence <SEQ ID 3190>. Analysis of this protein sequence reveals the following:

Possible site: 30
>>> Seems to have no N-terminal signal sequence
----- Final Results -----
    bacterial membrane --- Certainty = 0.0000 (Not Clear) <succ>
        bacterial outside --- Certainty = 0.0000 (Not Clear) <succ>
            bacterial cytoplasm --- Certainty = 0.0000 (Not Clear) <succ>

A related sequence was also identified in GAS <SEQ ID 9161> which encodes the amino acid sequence <SEQ ID 9162>. Analysis of this protein sequence reveals the following:

Possible site: 28
>>> Seems to have a cleavable N-term signal seq.
----- Final Results -----
    bacterial outside --- Certainty = 0.300 (Affirmative) <succ>
        bacterial membrane--- Certainty = 0.000 (Not Clear) <succ>
            bacterial cytoplasm--- Certainty = 0.000 (Not Clear) <succ>

An alignment of the GAS and GBS proteins is shown below.

```
Identities = 187/223 (83%), Positives = 205/223 (91%), Gaps = 1/223 (0%)
Query:    1 MKHLKFQSVFDIIGPVMIGPSSSHTAGAVRIGKVVHSIFGE-PSEVTFHLYNSFAKTYQG    59
            M   KFQSVFDIIGPVMIGPSSSHTAGAVRIGKVVHSIFG+ P  EVTFHLYNSFAKTY+G Sbjct:    3 MNTQKFQSVFDIIGPVMIGPSSSHTAGAVRIGKVVHSIFGDIPDEVTFHLYNSFAKTYRG    62
```

-continued

```
Query:   60 HGTDKALVAGILGMDTDNPDIKNSLEIAHQKGIKIYWDILKDSNSPHPNTAKITVKNGDR    119
            HGTDKALVAGI+GM TDNPDIKNSLEIAHQKGIKIYWDILKDSN+PHPNT KI+VK  D+

Sbjct:   63 HGTDKALVAGIMGMGTDNPDIKNSLEIAHQKGIKIYWDILKDSNAPHPNTVKISVKKADK   122

Query:  120 SMSITGVSIGGGNIQVTELNGFSVSLTMNTPTLIIVHQDIPGMIAKVTDILSDFNINIAQ   179
            ++S+TGVSIGGGNIQVTELNGFSVSL+MNTPT++ VH+DIPGMIAKVTDILS  NINIA Sbjct:  123 TLSVTGVSIGGGNIQVTELNGFSVSLSMNTPTIVTVHKDIPGMIAKVTDILSSNNINIAT   182

Query:  180 MNVTRESAGEKAIMIIEVDSRDCQQAVKKIEAIPHLHNVNFFD                   222
            MNVTRESAGEKA MIIEVDSR+CQ+A  +I  IPH++NVNFFD Sbjct:  183 MNVTRESAGEKATMIIEVDSRECQEAANQIAKIPHIYNVNFFD                   225
```

Figure 188:
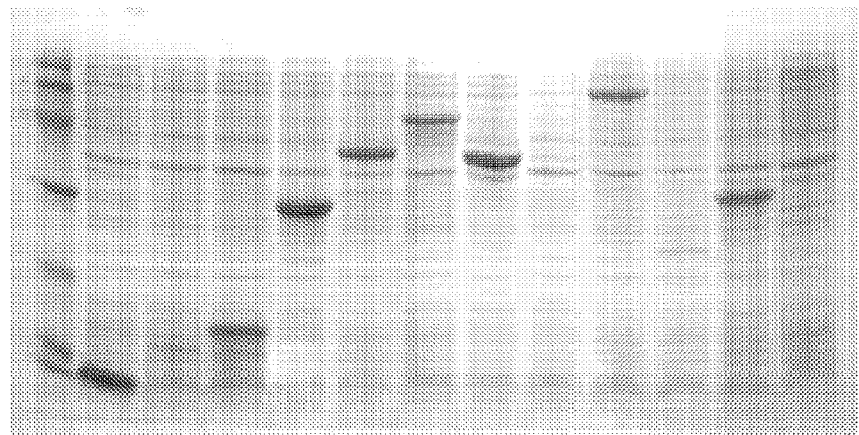

SEQ ID 3188 (GBS151) was expressed in *E. coli* as a GST-fusion product. SDS-PAGE analysis of total cell extract is shown in FIG. 31 (lane 3; MW 50 kDa). It was also expressed in *E. coli* as a His-fusion product. SDS-PAGE analysis of total cell extract is shown in FIG. 188 (lane 11; MW 25 kDa) and in FIG. 165 (lane 14-16; MW 25.3 kDa).

Figure 289:
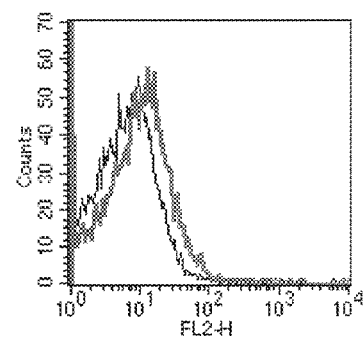

The GBS151-GST fusion product was purified (FIG. 198, lane 3; FIG. 236, lane 8) and used to immunise mice. The resulting antiserum was used for FACS (FIG. 289), which confirmed that the protein is immunoaccessible on GBS bacteria.

Figure 128:
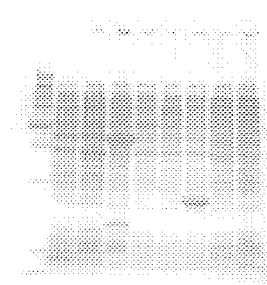

GBS151L was expressed in *E. coli* as a GST-fusion product. SDS-PAGE analysis of total cell extract is shown in FIG. 127 (lane 8-10; MW 50 kDa). GBS151L was also expressed in *E. coli* as a His-fusion product. SDS-PAGE analysis of total cell extract is shown in FIG. 127 (lane 11 & 12; MW 25 kDa), in FIG. 128 (lane 7; MW 25 kDa) and in FIG. 180 (lane 7; MW 25 kDa). Purified GBS151L-His is shown in FIG. 232 (lanes 5 & 6) and in FIG. 240 (lanes 3 & 4).

Based on this analysis, it was predicted that these proteins and their epitopes could be useful antigens for vaccines or diagnostics.

Example 1033

A DNA sequence (GBSx1105) was identified in *S. agalactiae* <SEQ ID 3191> which encodes the amino acid sequence <SEQ ID 3192>. This protein is predicted to be tRNA (5-methylaminomethyl-2-thiouridylate)-methyltransferase (trmU). Analysis of this protein sequence reveals the following:

Possible site: 47
>>> Seems to have no N-terminal signal sequence
----- Final Results -----
  bacterial cytoplasm --- Certainty = 0.2208 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 10291> which encodes amino acid sequence <SEQ ID 10292> was also identified.

The protein has homology with the following sequences in the GENPEPT database.

```
>GP: BAB04980 GB: AP001511
(5-methylaminomethyl-2-thiouridylate)-methyltransferase
[Bacillus halodurans]
Identities = 250/359 (69%), Positives = 292/359 (80%), Gaps = 6/359 (1%)
Query:   32 RVVVGMSGGVDSSVTALLLKEQGYDVIGVFMKNWDDTDEFGVCTATEDYKDVAAVADQIG    91
            RVVVGMSGGVDSSVTALLLKEQGYDVIG+FMKNWDDTDE GVCTATEDY+DV  V +Q+G Sbjct:   10 RVVVGMSGGVDSSVTALLLKEQGYDVIGIFMKNWDDTDENGVCTATEDYQDVVQVCNQLG    69

Query:   92 IPYYSVNFEKEYWDRVFEYFLAEYRAGRTPNPDVMCNKEIKFKAFLDYAMTLGADYVATG   151
            I  YY+VNFEKEYWD+VF YFL EY+AGRTPNPDVMCNKEIKFKAFL++A+TLGADYVATG Sbjct:   70 IAYYAVNFEKEYWDKVFTYFLEEYKAGRTPNPDVMCNKEIKFKAFLNHALTLGADYVATG   129

Query:  152 HYAQVTRDENGIVHMLRGADNNKDQTYFLSQLSQEQLQKTLFPLGHLQKPEVRRIAEEAG   211
            HYAQV ++  +G    ++RG D NKDQTYFL+ LSQ+QL +  +FPLGHL+K  EVR  IAE AG Sbjct:  130 HYAQV-KNVDGQYQLIRGKDPNKDQTYFLNALSQQQLSRVMFPLGHLEKKEVRAIAERAG   188

Query:  212 LATAKKKDSTGICFIGEKNFKDFLGQYLPAQPGRMMTVDGRDMGEHAGLMYYTIGQRGGL   271
            LATAKKKDSTGICFIG+++FK+FL  YLPAQPG M  T+DG    G H  GLMYYT+GQR GL Sbjct:  189 LATAKKKDSTGICFIGKRDFKEFLSSYLPAQPGEMQTLDGEVKGTHDGLMYYTLGQRQGL   248

Query:  272 GIGGQHGGDNKPWFVVGKDLSKNILYVGQGFYHDSLMSTSLTASEIHFTRDMPNEFKLEC   331
            GI     GG   +PWFV+GK+L KNILYVGQGF+H  L  S    L A ++++       ++  EC Sbjct:  249 GI----GGSGEPWFVIGKNLEKNILYVGQGFHHPGLYSEGLRAIKVNWILRRESDEPFEC   304
```

```
                         -continued
Query: 332 TAKFRYRQPDSKVTVYVKGNQA-RVVFDDLQRAITPGQAVVFYNEQECLGGGMIDQAYR    389
           TAKFRYRQPD KVTVY + + A  V+F + QRAITPGQAVVFY+   CLGGG ID   +

Sbjct: 305 TAKFRYRQPDQKVTVYPQSDGAVEVLFAEPQRAITPGQAVVFYDGDVCLGGGTIDHVLK    363
```

A related DNA sequence was identified in *S. pyogenes* <SEQ ID 3193> which encodes the amino acid sequence <SEQ ID 3194>. Analysis of this protein sequence reveals the following:

```
Possible site: 29
>>> Seems to have no N-terminal signal sequence
----- Final Results -----
    bacterial cytoplasm --- Certainty = 0.1691 (Affirmative) <succ>
     bacterial membrane --- Certainty = 0.0000 (Not Clear) <succ>
      bacterial outside --- Certainty = 0.0000 (Not Clear) <succ>
RGD motif: 331-333
```

The protein has homology with the following sequences in the databases:

```
>GP: BAB04980 GB: AP001511
(5-methylaminomethyl-2-thiouridylate)-methyltransferase
[Bacillus halodurans]
Identities = 255/359 (71%), Positives = 293/359 (81%), Gaps = 6/359 (1%)
Query:  14 RVVVGMSGGVDSSVTALLLKEQGYDVIGVFMKNWDDTDEFGVCTATEDYKDVAAVADKIG    73
           RVVVGMSGGVDSSVTALLLKEQGYDVIG+FMKNWDDTDE GVCTATEDY+DV  V +++G Sbjct:  10 RVVVGMSGGVDSSVTALLLKEQGYDVIGIFMKNWDDTDENGVCTATEDYQDVVQVCNQLG    69

Query:  74 IPYYSVNFEKEYWDRVFEYFLAEYRAGRTPNPDVMCNKEIKFKAFLDYAMTLGADYVATG   133
           I YY+VNFEKEYWD+VF YFL EY+AGRTPNPDVMCNKEIKFKAFL++A+TLGADYVATG Sbjct:  70 IAYYAVNFEKEYWDKVFTYFLEEYKAGRTPNPDVMCNKEIKFKAFLNHALTLGADYVATG   129

Query: 134 HYAQVKRDENGTVHMLRGADNGKDQTYFLSQLSQEQLQKTLFPLGHLQKSEVREIAERAG   193
           HYAQVK + +G   ++RG D  KDQTYFL+ LSQ+QL + +FPLGHL+K EVR IAERAG Sbjct: 130 HYAQVK-NVDGQYQLIRGKDPNKDQTYFLNALSQQQLSRVMFPLGHLEKKEVRAIAERAG   188

Query: 194 LATAKKKDSTGICFIGEKNFKQFLSQYLPAQKGRMMTIDGRDMGEHAGLMYYTIGQRGGL   253
           LATAKKKDSTGICFIG+++FK+FLS YLPAQ G M T+DG   G H GLMYYT+GQR GL Sbjct: 189 LATAKKKDSTGICFIGKRDFKEFLSSYLPAQPGEMQTLDGEVKGTHDGLMYYTLGQRQGL   248

Query: 254 GIGGQHGGDNQPWFVVGKDLSQNILYVGQGFYHEALMSNSLDASVIHFTREMPEEFTFEC   313
           GI    GG +PWFV+GK+L +NILYVGQGF+H  L  S    L A  +++      + FEC Sbjct: 249 GI----GGSGEPWFVIGKNLEKNILYVGQGFHHPGLYSEGLRAIKVNWILRRESDEPFEC   304

Query: 314 TAKFRYRQPDSHVAVHVRGDKA-EVVFAEPQRAITPGQAVVFYDGKECLGGGMIDMAYK    371
           TAKFRYRQPD  V V+ + D A EV+FAEPQRAITPGQAVVFYDG  CLGGG ID   K Sbjct: 305 TAKFRYRQPDQKVTVYPQSDGAVEVLFAEPQRAITPGQAVVFYDGDVCLGGGTIDHVLK    363
```

An alignment of the GAS and GBS proteins is shown below.

```
Identities = 332/377 (88%), Positives = 349/377 (92%)
Query:  21 GRILMTDNSNIRVVVGMSGGVDSSVTALLLKEQGYDVIGVFMKNWDDTDEFGVCTATEDY    80
           G   MTDNS IRVVVGMSGGVDSSVTALLLKEQGYDVIGVFMKNWDDTDEFGVCTATEDY Sbjct:   3 GEFFMTDNSKIRVVVGMSGGVDSSVTALLLKEQGYDVIGVFMKNWDDTDEFGVCTATEDY    62

Query:  81 KDVAAVADQIGIPYYSVNFEKEYWDRVFEYFLAEYRAGRTPNPDVMCNKEIKFKAFLDYA   140
           KDVAAVAD+IGIPYYSVNFEKEYWDRVFEYFLAEYRAGRTPNPDVMCNKEIKFKAFLDYA Sbjct:  63 KDVAAVADKIGIPYYSVNFEKEYWDRVFEYFLAEYRAGRTPNPDVMCNKEIKFKAFLDYA   122

Query: 141 MTLGADYVATGHYAQVTRDENGIVHMLRGADNNKDQTYFLSQLSQEQLQKTLFPLGHLQK   200
           MTLGADYVATGHYAQV RDENG VHMLRGADN KDQTYFLSQLSQEQLQKTLFPLGHLQK
```

```
Sbjct: 123 MTLGADYVATGHYAQVKRDENGTVHMLRGADNGKDQTYFLSQLSQEQLQKTLFPLGHLQK    182

Query: 201 PEVRRIAEEAGLATAKKKDSTGICFIGEKNFKDFLGQYLPAQPGRMMTVDGRDMGEHAGL    260
           EVR IAE AGLATAKKKDSTGICFIGEKNFK FL QYLPAQ GRMMT+DGRDMGEHAGL
Sbjct: 183 SEVREIAERAGLATAKKKDSTGICFIGEKNFKQFLSQYLPAQKGRMMTIDGRDMGEHAGL    242

Query: 261 MYYTIGQRGGLGIGGQHGGDNKPWFVVGKDLSKNILYVGQGFYHDSLMSTSLTASEIHFT    320
           MYYTIGQRGGLGIGGQHGGDN+PWFVVGKDLS+NILYVGQGFYH++LMS SL AS IHFT
Sbjct: 243 MYYTIGQRGGLGIGGQHGGDNQPWFVVGKDLSQNILYVGQGFYHEALMSNSLDASVIHFT    302

Query: 321 RDMPNEFKLECTAKFRYRQPDSKVTVYVKGNQARVVFDDLQRAITPGQAVVFYNEQECLG    380
           R+MP EF  ECTAKFRYRQPDS V V+V+G++A VVF + QRAITPGQAVVFY+ +ECLG
Sbjct: 303 REMPEEFTFECTAKFRYRQPDSHVAVHVRGDKAEVVFAEPQRAITPGQAVVFYDGKECLG    362

Query: 381 GGMIDQAYRDDKICQYI                                             397
           GGMID AY++ + CQYI
Sbjct: 363 GGMIDMAYKNGQPCQYI                                             379
```

Based on this analysis, it was predicted that these proteins and their epitopes could be useful antigens for vaccines or diagnostics.

Example 1034

A DNA sequence (GBSx1106) was identified in *S. agalactiae* <SEQ ID 3195> which encodes the amino acid sequence <SEQ ID 3196>. Analysis of this protein sequence reveals the following:

---

Possible site: 29
>>> Seems to have a cleavable N-term signal seq.
INTEGRAL Likelihood = −12.84 Transmembrane 141-157 (134-165)
INTEGRAL Likelihood = −11.78 Transmembrane 40-56 (36-73)
INTEGRAL Likelihood = −4.35  Transmembrane 68-84 (65-86)
INTEGRAL Likelihood = −3.50  Transmembrane 180-196 (175-199)
----- Final Results -----
   bacterial membrane --- Certainty = 0.6137 (Affirmative) <succ>
   bacterial outside --- Certainty = 0.0000 (Not Clear) <succ>
      bacterial cytoplasm --- Certainty = 0.0000 (Not Clear) <succ>

---

The protein has homology with the following sequences in the GENPEPT database.

No corresponding DNA sequence was identified in *S. pyogenes*.

A related GBS gene <SEQ ID 8715> and protein <SEQ ID 8716> were also identified. Analysis of this protein sequence reveals the following:

---

Lipop: Possible site: −1    Crend: 3
McG: Discrim Score: 9.79
GvH: Signal Score (−7.5) : −1.53
Possible site: 29
>>> Seems to have a cleavable N-term signal seq.
ALOM program count: 4  value: −12.84  threshold: 0.0
INTEGRAL       Likelihood = −12.84 Transmembrane 141-157 (134-165)
INTEGRAL       Likelihood = −11.78 Transmembrane 40-56 (36-73)
INTEGRAL       Likelihood = −4.35  Transmembrane 68-84 (65-86)
INTEGRAL       Likelihood = −3.50  Transmembrane 180-196 (175-199)
PERIPHERAL     Likelihood = 1.27   110
modified ALOM score: 3.07
*** Reasoning Step: 3
----- Final Results -----
   bacterial membrane --- Certainty = 0.6137 (Affirmative) <succ>
   bacterial outside --- Certainty = 0.0000 (Not Clear) <succ>
      bacterial cytoplasm --- Certainty = 0.0000 (Not Clear) <succ>

---

```
>GP: CAB15390 GB: Z99121 similar to hypothetical proteins [Bacillus subtilis]
Identities = 71/202 (35%), Positives = 120/202 (59%), Gaps = 5/202 (2%)

Query:   1 MISKFILAFMAFFAIMNPISNLPAFMALVADDDQKISRRIAAKGVLLAFVIIVIFVLSGH    60
           M S  + F++ FA+ NPI N+P F+ L        + IA K  +L+F I+  F++ GH
Sbjct:   2 MFSFIVHVFISLFAVSNPIGNVPIFLTLTEGYTAAERKAIARKAAILSFFILAAFLVFGH    61

Query:  61 LLFNLFGITLAALKISGGILVGIIGYKMINGIHSPTNK-NLEEHKD--DPMNVAVSPLAM    117
           L+F LF I + AL+++GGI +  I Y ++N   S     + +EHK+   +  +++V+PL++
Sbjct:  62 LIFKLFDINIHALRVAGGIFIFGIAYNLLNAKESHVQSLHHDEHKESKEKADISVTPLSI    121

Query: 118 PLLAGPGTIATAMGLSSG--GLSGKLITILAFAILCVIMYVILISANEITKFLGKNAMTI    175
           P++AGPGTIAT M LS+G  G+      ++ A +   + ++   +  I+  LGK  M +
Sbjct: 122 PIIAGPGTIATVMSLSAGHSGIGHYAAVMIGIAAVIALTFLFFHYSAFISSKLGKTEMNV    181

Query: 176 ITKMMGLILMTIGIEMLITGIK                                        197
           IT++MGLIL  + + M+  G+K
Sbjct: 182 ITRLMGLILAVVAVGMIGAGLK                                        203
```

The protein has homology with the following sequences in the databases:

```
ORF00620(301-891 of 1209)
OMNI|NT01BS3953(11-212 of 220) conserved hypothetical protein
% Match = 15.8
% Identity = 35.5  % Similarity = 61.5
Matches = 71  Mismatches = 74  Conservative Sub.s = 52

96        126       156       186       216       246       276       306
VQLSSDIVNLTVKLQFR*KVIKQGLCLMIYNEQSHQVKLLFFIMNKNV*AVG*LIRLIVMIKSVNTFN*HLIIK*GNRMI
                                                                             |
                                                                      VQRLSTRRYMMF
                                                                            10

336       366       396       426       456       486       516       546
SKFILAFMAFFAIMNPISNLPAFMALVADDDQKISRRIAAKGVLLAFVIIVIFVLSGHLLFNLFGITLAALKISGGILVG
 |  :  |:::||:  |||  |:| |: |         : || |  :|:| |: |:: |||:| || | : ||:::|||::
SFIVHVFISLFAVSNPIGNVPIFLTLTEGYTAAERKAIARKAAILSFFILAAFLVFGHLIFKLFDINIHALRVAGGIFIF
             30        40        50        60        70        80        90

576       603       627       657       687       711       741       771
IIGYKMINGIHSPTNK-NLEEHKD--DPMNVAVSPLAMPLLAGPGTIATAMGLSSG--GLSGKLITILAFAILCVIMYVI
 |  |  ::|    |    : :|||  :   : :::|:||::|:::|||||||||   |  ||:|  |:       :   | :  : ::
GIAYNLLNAKESHVQSLHHDEHKESKEKADISVTPLSIPIIAGPGTIATVMSLSAGHSGIGHYAAVMIGIAAVIALTFLF
              110       120       130       140       150       160       170

801       831       861       891       921       951       981      1011
LISANEITKFLGKNAMTIITKMMGLILMTIGIEMLITGIKIGFHXT*PIPSG*LLKDKC*NKFNXNYDGQSSWNL*VFLT
 :   :   |:   |||    |  | :||::|||||    :  :  |:    |:|
FHYSAFISSKLGKTEMNVITRLMGLILAVVAVGMIGAGLKGMFPVLTS
              190       200       210       220
```

Based on this analysis, it was predicted that these proteins and their epitopes could be useful antigens for vaccines or diagnostics.

Example 1035

A DNA sequence (GBSx1107) was identified in *S. agalactiae* <SEQ ID 3197> which encodes the amino acid sequence <SEQ ID 3198>. Analysis of this protein sequence reveals the following:

Possible site: 17
>>> Seems to have no N-terminal signal sequence

----- Final Results -----
bacterial cytoplasm --- Certainty = 0.1747 (Affirmative) <succ>
bacterial membrane --- Certainty = 0.0000 (Not Clear) <succ>
bacterial outside --- Certainty = 0.0000 (Not Clear) <succ>

A related GBS nucleic acid sequence <SEQ ID 10289> which encodes amino acid sequence <SEQ ID 10290> was also identified.

The protein has homology with the following sequences in the GENPEPT database.

```
>GP: AAC45494 GB: U80409 glucose inhibited division protein homolog
GidA [Lactococcus lactis subsp. cremoris]
Identities = 394/524 (75%), Positives = 458/524 (87%), Gaps = 2/524 (0%)
Query:  13 KTLLATINLEMLAFMPCNPSIGGSAKGIVVREIDALGGEMGKNIDKTYIQMKMLNTGKGP        72
           KTLL TINL M+AFMPCNPSIGGSAKGIVVREIDALGGEMG+NIDKTYIQMKMLNTGKGP
Sbjct:  12 KTLLMTINLNMVAFMPCNPSIGGSAKGIVVREIDALGGEMGRNIDKTYIQMKMLNTGKGP        71

Query:  73 AVRALRAQADKALYAQTMKQTVEKQENLTLRQAMIDEILVEDGK--VVGVRTATNQKFSA       130
           AVRALRAQADK  YA +MK TV  QENLTLRQ M++E++++D K  V+GVRT+T  ++ A
Sbjct:  72 AVRALRAQADKDEYAASMKNTVSDQENLTLRQGMVEELILDDEKQKVIGVRTSTGTQYGA       131

Query: 131 KSVVITTGTALRGEIILGDLKYSSGPNNSLASVTLADNLRDLGLEIGRFKTGTPPRVKAS       190
           K+V+ITTGTALRGEII+G+LKYSSGPNNSL+S+ LADNLR++G EIGRFKTGTPPRV AS
Sbjct: 132 KAVIITTGTALRGEIIIGELKYSSGPNNSLSSIGLADNLREIGFEIGREKTGTPPRVLAS       191

Query: 191 SINYEKTEIQPGDEQPNHFSFMSRDEDYITDQVPCWLTYTNTLSHDIINQNLHRAPMFSG       250
           SI+Y+KTEIQPGDE PNHFSFMS DEDY+ DQ+PCWLTYT   SH I+  NLHRAP+FSG
Sbjct: 192 SIDYDKTEIQPGDEAPNHFSFMSSDEDYLKDQIPCWLTYTTENSHTILRDNLHRAPLFSG       251

Query: 251 IVKGVGPRYCPSIEDKIVRFADKERHQLFLEPEGRYTEEVYVQGLSTSLPEDVQVDLLRS       310
           IVKGVGPRYCPSIEDKI RFADK RHQLFLEPEGR TEEVY+ GLSTS+PEDVQ DL++S
Sbjct: 252 IVKGVGPRYCPSIEDKITRFADKPRHQLFLEPEGRNTEEVYIGGLSTSMPEDVQFDLVKS       311
```

```
Query: 311 IKGLENAEMMRTGYAIEYDIVLPHQLRATLETKVIAGLFTAGQTNGTSGYEEAAGQGLVA    370
            I GLENA+MMR GYAIEYD+V+PHQLR TLETK+I+GLFTAGQTNGTSGYEEAAGQGLVA Sbjct: 312 IPGLENAKMMRPGYAIEYDVVMPHQLRPTLETKLISGLFTAGQTNGTSGYEEAAGQGLVA    371

Query: 371 GINAALKVQGKPELILKRSDAYIGVMIDDLVTKGTLEPYRLLTSRAEYRLILRHDNADMR    430
            GINAALK+QGKPE ILKRS+AYIGVMIDDLVTKGTLEPYRLLTSRAEYRLILRHDNAD R Sbjct: 372 GINAALKIQGKPEFILKRSEAYIGVMIDDLVTKGTLEPYRLLTSRAEYRLILRHDNADRR    431

Query: 431 LTEIGYEIGLVDEERYAIFKKRQMQFENELERLDSIKLKPVSETNKRIQELGFKPLTDAL    490
            LTEIG ++GLV + ++   ++ +   QF+ E++RL+S KLKP+ +T +++ +LGF P+ DAL Sbjct: 432 LTEIGRQVGLVSDAQWEHYQAKMAQFDREMKRLNSEKLKPLPDTQEKLGKLGFGPIKDAL    491

Query: 491 TAKEFMRRPQITYAVATDFVGCADEPLDSKVIELLETEIKTEGY                   534
            T  EF++RP++ Y      DF+G A E +D  V EL+ETEI YEGY Sbjct: 492 TGAEFLKRPEVNYDEVIDFIGQAPEVIDRTVSELIETEITYEGY                   535
```

A related DNA sequence was identified in *S. pyogenes* <SEQ ID 3199> which encodes the amino acid sequence <SEQ ID 3200>. Analysis of this protein sequence reveals the following:

Possible site: 28
>>> Seems to have no N-terminal signal sequence

----- Final Results -----
bacterial cytoplasm --- Certainty = 0.1064 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 530/610 (86%), Positives = 574/610 (93%)
Query:   1 MEASLAASRMGCKTLLATINLEMLAFMPCNPSIGGSAKGIVVREIDALGGEMGKNIDKTY    60
            +EASLA SRMGCKTLLATINL+MLAFMPCNPSIGGSAKGIVVREIDALGGEMGKNIDKTY Sbjct:  21 VEASLATSRMGCKTLLATINLDMLAFMPCNPSIGGSAKGIVVREIDALGGEMGKNIDKTY    80

Query:  61 IQMKMLNTGKGPAVRALRAQADKALYAQTMKQTVEKQENLTLRQAMIDEILVEDGKVVGV    120
            IQMKMLNTGKGPAVRALRAQADK+LYA+ MK TVEKQ NLTLRQ MID+ILVEDG+VVGV Sbjct:  81 IQMKMLNTGKGPAVRALRAQADKSLYAREMKHTVEKQANLTLRQTMIDDILVEDGRVVGV    140

Query: 121 RTATNQKFSAKSVVITTGTALRGEIILGDLKYSSGPNNSLASVTLADNLRDLGLEIGRFK    180
              TAT QKF+AK+VV+TTGTALRGEIILG+LKYSSGPNNSLASVTLADNL+ LGLEIGRFK Sbjct: 141 LTATGQKFAAKAVVVTTGTALRGEIILGELKYSSGPNNSLASVTLADNLKKLGLEIGRFK    200

Query: 181 TGTPPRVKASSINYEKTEIQPGDEQPNHFSFMSRDEDYITDQVPCWLTYTNTLSHDIINQ    240
            TGTPPRVKASSINY++TEIQPGD++PNHFSFMS+D DY+ DQ+PCWLTYTN  SHDIINQ Sbjct: 201 TGTPPRVKASSINYDQTEIQPGDDKPNHFSFMSKDADYLKDQIPCWLTYTNQTSHDIINQ    260

Query: 241 NLHRAPMFSGIVKGVGPRYCPSIEDKIVRFADKERHQLFLEPEGRYTEEVYVQGLSTSLP    300
            NL+RAPMFSGIVKGVGPRYCPSIEDKIVRFADKERHQLFLEPEGR TEEVYVQGLSTSLP Sbjct: 261 NLYRAPMFSGIVKGVGPRYCPSIEDKIVRFADKERHQLFLEPEGRDTEEVYVQGLSTSLP    320

Query: 301 EDVQVDLLRSIKGLENAEMMRTGYAIEYDIVLPHQLRATLETKVIAGLFTAGQTNGTSGY    360
            EDVQ DL+ SIKGLE AEMMRTGYAIEYDIVLPHQLRATLETK+I+GLFTAGQTNGTSGY Sbjct: 321 EDVQKDLIHSIKGLEKAEMMRTGYAIEYDIVLPHQLRATLETKLISGLFTAGQTNGTSGY    380

Query: 361 EEAAGQGLVAGINAALKVQGKPELILKRSDAYIGVMIDDLVTKGTLEPYRLLTSRAEYRL    420
            EEAAGQGL+AGINAALKVQGKPELILKRSDAYIGVMIDDLVTKGTLEPYRLLTSRAEYRL Sbjct: 381 EEAAGQGLIAGINAALKVQGKPELILKRSDAYIGVMIDDLVTKGTLEPYRLLTSRAEYRL    440

Query: 421 ILRHDNADMRLTEIGYEIGLVDEERYAIFKKRQMQFENELERLDSIKLKPVSETNKRIQE    480
            ILRHDNADMRLTEIG +IGLVD+ER+  F+ ++ QF+NEL+RL+SIKLKP+ ETN R+Q+

Sbjct: 441 ILRHDNADMRLTEIGRDIGLVDDERWKAFEIKKNQFDNELKRLNSIKLKPIKETNDRVQD    500

Query: 481 LGFKPLTDALTAKEFMRRPQITYAVATDFVGCADEPLDSKVIELLETEIKYEGYIKKALD    540
            LGFKPLTDA+TAKEFMRRP+I YA A  FVG A E LD+K+IELLETEIKYEGYI+KALD Sbjct: 501 LGFKPLTDAMTAKEFMRRPEIDYATAVSFVGPAAEDLDAKIIELLETEIKYEGYIRKALD    560
```

-continued

```
Query: 541 QVAKMKRMEEKRIPPHIDWDDIDSIATEARQKFKKINPETLGQASRISGVNPADISILMV        600
           QVAKMKRMEEKRIP +IDWD IDSIATEARQKFKKINPET+GQASRISGVNPADISILM+

Sbjct: 561 QVAKMKRMEEKRIPTNIDWDAIDSIATEARQKFKKINPETIGQASRISGVNPADISILMI        620

Query: 601 YLEGRQKGRK                                                          610
           YLEG  K  +

Sbjct: 621 YLEGNGKAHR                                                          630
```

Based on this analysis, it was predicted that these proteins and their epitopes could be useful antigens for vaccines or diagnostics.

Example 1036

A DNA sequence (GBSx1108) was identified in *S. agalactiae* <SEQ ID 3201> which encodes the amino acid sequence <SEQ ID 3202>. Analysis of this protein sequence reveals the following:

```
Possible site: 44
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>
```

The protein has homology with the following sequences in the GENPEPT database.

```
>GP: BAB07750 GB: AP001520 unknown conserved protein in B. subtilis
[Bacillus halodurans]
Identities = 205/644 (31%), Positives = 362/644 (55%), Gaps = 28/644 (4%)
Query:  35 LLLAIFVALSFVVALLYYQ--------------------KITYELSEVEQIELLNDQTE          73
           ++  + VAL F++AL +YQ                    +I++E    + I  L+ +

Sbjct:  14 VIALLAVALVFLIALSFYQWQLGVIGVLLLLVIAIFSLRARISFERDLEQYISTLSYRVH          73

Query:  74 VSLKSLLEQMPVGVIQFDLETNDIEWFNPYA-ELIFTGDNGHFQSATVKDIITSRRNGTA        132
             + +  + Q+PVG+I ++ +   ++W NPYA E +    +          +++ +    GT Sbjct:  74 KAGEEAVTQLPVGMILYNDQLR-VQWVNPYAAEHLPKAEIDASLEELSPELVRALEEGTD        132

Query: 133 GQSFEYGDNKYSAYLDTETGVFYFFDNFMGNRRNYDSSMLRPVIGIISIDNYDDIMDTML        192
             Q      +  Y          + YFFD      R +       +PV+  I +DNYD++    M Sbjct: 133 EQKIVIEEKTYDCTFKPNERLIYFFDITESERMHQQFEESQPVLIFIYLDNYDEVTQGME        192

Query: 193 EADMSKINAFVTSFISDFTQSKNIFYRRVNMDRYYIFTDYSVLNTLIKDKFDILNEFRKR        252
             +   S++ + VTS ++ +    ++F RR   DR+      Y  L   + K KF IL+E R+

Sbjct: 193 DQVRSRLMSQVTSSLNQWANEHDLFLRRTAADRFIAVMSYGSLLAIEKTKFGILDEIRET        252

Query: 253 AQENHLSLTLSMGISYGDGNHNQIGQIALENLNTALVRGGDQIVVRENDSSKKALYFGGG        312
              +  + LTLS+G+ YGD +  ++GQ+A  +L+ AL RGGDQ+ +++      K  ++GG Sbjct: 253 TGKEKIPLTLSIGVGYGDLSLRELGQLAQSSLDLALGRGGDQVAIKQKTG--KVRFYGGK        310

Query: 313 AVSTIKRSRTRTRAMMTAISDRLKVVDSVFIVGHRKLDMDALGASVGMQFFASNIVNASY        372
           + +  KR+R R R +  A+ D +   D V ++GH+  DMDA+GA++G+   A       ++

Sbjct: 311 SNAMEKRTRVRARVISHALRDFVLESDRVIVMGHKNPDMDAVGAAIGILKIAEVNDREAF        370

Query: 373 VVYDPNDMNSDIERAIDYLQEDGET--RLVSVERAFELITQNSLLVMVDHSKTALTLSKE        430
           VV DPND+N D+ + ++ ++++ +    + ++ E + EL+T+ +LLV+VD  K ++ +

Sbjct: 371 VVLDPNDVNPDVSKLMEEVEKNEQLWDKFITPEESLELMTEETLLVIVDTHKPSMVIEPR        430

Query: 431 FFNKFADVIVVDHHRRDEDFPKNAVLSFIESGASSASELVTELIQFQQAKDKLSRSQASI        490
             +    V+V+DHHRR E+F ++ VL ++E  ASS +ELVTEL+++Q  K K+   +++

Sbjct: 431 LLDYVERVVVLDHHRRGEEFIEDPVLVYMEPYASSTAELVTELLEYQPKKLKMDILESTA        490

Query: 491 LMAGIMLDTRNFASNVTSRTFDVASYLRGLGSNSMAIQKISATDFDEYRLINELILKGER        550
           L+AG+++DT++FA    +RTFD AS+LR  G++++ +QK+    D + Y    +L+    +

Sbjct: 491 LLAGMIVDTKSFAIRTGARTFDAASFLRSHGADTVLVQKLLKEDLNHYVKRAKLVETAKL        550

Query: 551 IYDNIIVATGEEHKVYSHVIASKAADTMLTMAGIEATFVITKNSSN-IGISARSRNNINV        609
             D + +AT  E +  S ++ ++AADT+LTM G+ A+FVI++     + ISARS  ++NV Sbjct: 551 YRDGMAIATAREEEAVSQLLIAQAADTLLTMKGVVASFVISRRHDGVVSISARSLGDVNV        610
```

-continued

```
Query:  610 QRIMEKLGGGGHFSFAACQIQDKSVKQVRRMLLEIIDEDLRENS           653
             Q IME L GGGH + AA Q +D ++++    L E ID+ L   S
Sbjct:  611 QLIMESLDGGGHLTNAATQFEDATLEEAEAKLKEAIDQYLEGGS           654
```

A related DNA sequence was identified in *S. pyogenes* <SEQ ID 3203> which encodes the amino acid sequence <SEQ ID 3204>. Analysis of this protein sequence reveals the following:

Possible site: 25
>>> Seems to have an uncleavable N-term signal seq
INTEGRAL Likelihood = −18.57 Transmembrane 33-49 (6-56)

-continued

INTEGRAL Likelihood = −10.14 Transmembrane 12-28 (6-32)
----- Final Results -----
  bacterial membrane --- Certainty = 0.8429 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP: BAB07750 GB: AP001520 unknown conserved protein in B. subtilis
[Bacillus halodurans]
Identities = 199/659 (30%), Positives = 367/659 (55%), Gaps = 16/659 (2%)
Query:    1 MKKF---RFETIHLI-MMGLILFGLLALCVSIMQSKILILLAIFLVLLFVV-ALLWYQKE            55
              M KF    R+   H+I ++ + L  L+AL     Q  ++ +L + ++ +F + A +  ++++
Sbjct:    1 MPKFLLKRWHGYHVIALLAVALVFLIALSFYQWQLGVIGVLLLLVIAIFSLRARISFERD           60

Query:   56 AYQLSDLAHIELLNEQTEDNLKTLLDNMPVGVVQFDQETNAVEWYNPYA-ELIFTTEEGF          114
                 Q     +I  L+ +    + +  +PVG++ ++ +    V+W NPYA E +    E
Sbjct:   61 LEQ-----YISTLSYRVHKAGEEAVTQLPVGMILYNDQLR-VQWVNPYAAEHLPKAEIDA          114

Query:  115 IQNGLIQQIITEKRREDISQTFEVSGNKYTSYIDVSSGIFYFFDSFVGNRQLADASMLRP          174
              L +++         Q +       Y    + + YFFD      R       +P
Sbjct:  115 SLEELSPELVRALEEGIDEQKIVIEEKTYDCTFKPNERLIYFFDITESERMHQQFEESQP          174

Query:  175 VVGIISVDNYDDITDDLSDADTSKINSFVANFIDEFMESKRIFYRRVNMDRYYFFTDFKT          234
              V+  I +DNYD++T   + D   S++  S V + ++++       +F RR   DR+      + +
Sbjct:  175 VLTFIYLDNYDEVTQGMEDQVRSRLMSQVTSSLNQWANEHDLFLRRTAADRFIAVMSYGS          234

Query:  235 LNDLMDNKFSVLEEFRKEAQDAQRPLTLSIGISFGEENHSQIGQVALENLNIALVRGGDQ          294
              L  +    KF +L+E R+    + PLTLSIG+ +G+ +  ++GQ+A  +L++AL RGGDQ
Sbjct:  235 LLAIEKTKFGILDEIRETTGKEKIPLTLSIGVGYGDLSLRELGQLAQSSLDLALGRGGDQ          294

Query:  295 IVIRENADHTNPIYFGGGSVSTVKRSRTRTRAMMTAISDRIKMVDNVFIVGHRKLDMDAL          354
              + I++            ++GG S  +   KR+R R R  +  A+ D  +    D V ++GH+  DMDA+
Sbjct:  295 VAIKQKTGKVR--FYGGKSNAMEKRTRVRARVISHALRDFVLESDRVIVMGHKNPDMDAV          352

Query:  355 GSAVGMQFFAGNIIENSFAVYNPDEMSPDIERAIERLQADGKT--RLISVSQAMGLVTPR          412
              G+A+G+    A       +F V +P++++PD+ + +E ++ +  +     + I+   +++ L+T
Sbjct:  353 GAAIGILKIAEVNDREAFVVLDPNDVNPDVSKLMEEVEKNEQLWDKFITPEESLELMTEE          412

Query:  413 SLLVMVDHSKISLTLSKEFYEQFQNVIVVDHHRRDDDFPDNAILTFIESGASSAAELVTE          472
              +LLV+VD   K S+ +         + V+V+DHHRR ++F ++  +L ++E  ASS AELVTE
Sbjct:  413 TLLVIVDTHKPSMVIEPRLLDYVERVVVLDHHRRGEEFIEDPVLVYMEPYASSTAELVTE          472

Query:  473 LIQFQNAKKCLNKIQASVLMAGIMLDTKNFSTRVTSRTFDVASYLRSKGSDSVEIQNISA          532
              L+++Q  K   ++ ++ ++++ L+AG+++DTK+F+ R   +RTFD AS+LRS G+D+V  +Q +
Sbjct:  473 LLEYQPKKLKMDILESTALLAGMIVDTKSFAIRTGARTFDAASFLRSHGADTVLVQKLLK          532

Query:  533 TDFEEYKQINEIILQGERLGDSIIVAAGEKNHLYSNVIASKAADTILSMAHVEASFVLVE          592
                 D  Y +    +++     +  D + +A     +   S ++ ++AADT+L+M  V  ASFV+
Sbjct:  533 EDLNHYVKRAKLVETAKLYRDGMAIATAREEEAVSQLLIAQAADTLLTMKGVASFVISR          592

Query:  593 TASHKIAISARSRSKINVQRVMEKLGGGHFNLAACQLTDISLPQAKYLLLKTINMTMK           651
                ++ISARS   +NVQ +ME L GGH    AA Q  D +L +A+   L + I++   ++
Sbjct:  593 RHDGVVSISARSLGDVNVQLIMESLDGGGHLTNAATQFEDATLEEAEAKLKEAIDQYLE          651
```

An alignment of the GAS and GBS proteins is shown below.

```
Identities = 428/658 (65%), Positives = 547/658 (83%), Gaps = 1/658 (0%)
Query:   1 MKRFRFATVHLVLIGLILFGLLAICVRLFQSYTALLLAIFVALSFVVALLYYQKITYELS        60
           MK+FRF T+HL+++GLILFGLLA+CV + QS  +LLAIF+ L FVVALL+YQK  Y+LS Sbjct:   1 MKKFRFETIHLIMMGLILFGLLALCVSIMQSKILILLAIFLVLLFVVALLWYQKEAYQLS        60

Query:  61 EVEQIELLNDQTEVSLKSLLEQMPVGVIQFDLETNDIEWFNPYAELIFTGDNGHFQSATV       120
           ++  IELLN+QTE +LK+LL+ MPVGV+QFD ETN +EW+NPYAELIFT + G  Q+  +

Sbjct:  61 DLAHIELLNEQTEDNLKTLLDNMPVGVVQFDQETNAVEWYNPYAELIFTTEEGFIQNGLI       120

Query: 121 KDIITSRRNGTAGQSFEYGDNKYSAYLDTETGVFYFEDNFMGNRRNYDSSMLRPVIGIIS       180
            + IIT +R      Q+FE    NKY++Y+D  +G+FYFFD+F+GNR+  D+SMLRPV+GIIS Sbjct: 121 QQIITEKRREDISQTFEVSGNKYTSYIDVSSGIFYFFDSFVGNRQLADASMLRPVVGIIS       180

Query: 181 IDNYDDIMDTMLEADMSKINAFVTSFISDFTQSKNIFYRRVNMDRYYIFTDYSVLNTLIK       240
           +DNYDDI D + +AD SKIN+FV +FI +F +SK IFYRRVNMDRYY FTD+  LN L+

Sbjct: 181 VDNYDDITDDLSDADTSKINSFVANFIDEFMESKRIFYRRVNMDRYYFFTDFKTLNDLMD       240

Query: 241 DKFDILNEFRKRAQENHLSLTLSMGISYGDGNHNQIGQIALENLNTALVRGGDQIVVREN       300
           +KF +L EFRK AQ+    LTLS+GIS+G+ NH+QIGQ+ALENLN ALVRGGDQIV+REN Sbjct: 241 NKFSVLEEFRKEAQDAQRPLTLSIGISFGEENHSQIGQVALENLNIALVRGGDQIVIREN       300

Query: 301 DSSKKALYFGGGAVSTIKRSRTRTRAMMTAISDRLKVVDSVFIVGHRKLDMDALGASVGM       360
                +YFGGG+VST+KRSRTRTRAMMTAISDR+K+VD+VFIVGHRKLDMDALG++VGM Sbjct: 301 ADHTNPIYFGGGSVSTVKRSRTRTRAMMTAISDRIKMVDNVFIVGHRKLDMDALGSAVGM       360

Query: 361 QFFASNIVVNASYVVVYDPNDMNSDIERAIDYLQEDGETRLVSVERAFELITQNSLLVMVDH       420
           QFFA NI+  S+ VY+P++M+ DIERAI+ LQ DG+TRL+SV +A  L+T  SLLVMVDH Sbjct: 361 QFFAGNIIENSFAVYNPDEMSPDIERAIERLQADGKTRLISVSQAMGLVTPRSLLVMVDH       420

Query: 421 SKTALTLSKEFFNKFADVIVVDHHRRDEDFPKNAVLSFIESGASSASELVTELIQFQQAK       480
           SK +LTLSKEF+ +F +VIVVDHHRRD+DFP NA+L+FIESGASSA/ELVTELIQFQ AK Sbjct: 421 SKISLTLSKEFYEQFQNVIVVDHHRRDDDFPDNAILTFIESGASSAAELVTELIQFQNAK       480

Query: 481 DKLSRSQASILMAGIMLDTRNFASNVTSRTFDVASYLRGLGSNSMAIQKISATDFDEYRL       540
           L++ QAS+LMAGIMLDT+NF++  VTSRTFDVASYLR  GS+S+ IQ ISATDF+EY+

Sbjct: 481 KCLNKIQASVLMAGIMLDTKNFSTRVTSRTFDVASYLRSKGSDSVEIQNISATDFEEYKQ       540

Query: 541 INELILKGERIYDNIIVATGEEHKVYSHVIASKAADTMLTMAGIEATFVITKNSSN-IGI       599
           INE+IL+GER+ D+IIVA GE++  +YS+VIASKAADT+L+MA  EA+FV+ + +S+ I I Sbjct: 541 INEIILQGERLGDSIIVAAGEKNHLYSNVIASKAADTILSMAHVEASFVLVETASHKIAI       600

Query: 600 SARSRNNINVQRIMEKLGGGGHFSFAACQIQDKSVKQVRAMLLEIIDEDLRENSTVEN       657
           SARSR+ INVQR+MEKLGGGGHF+ AACQ+ D S+ Q +  +LL+ I+  ++E    VE+

Sbjct: 601 SARSRSKINVQRVMEKLGGGGHFNLAACQLTDISLPQAKYLLLKTINMTMKETGEVES       658
```

A related GBS gene <SEQ ID 8717> and protein <SEQ ID 8718> were also identified. Analysis of this protein sequence reveals the following:

Lipop: Possible site: −1 Crend: 9
McG: Discrim Score: 13.82
GvH: Signal Score (−7.5) : −0.890001
Possible site: 44
>>> Seems to have a cleavable N-term signal seq.

ALOM program count: 0  value: 2.97  threshold: 0.0
PERIPHERAL Likelihood = 2.97   574
modified ALOM score: −1.09
*** Reasoning Step: 3
----- Final Results -----
  bacterial outside --- Certainty = 0.3000 (Affirmative) <succ>
  bacterial membrane --- Certainty = 0.0000 (Not Clear) <succ>

The protein has homology with the following sequences in the databases:

```
31.3/55.8% over 631aa
Bacillus subtilis
EGAD|19304| hypothetical 74.3 kd protein in rpli-cotf intergenic region Insert
characterized
```

-continued

```
SP|P37484|YYBT_BACSU HYPOTHETICAL 74.3 KDA PROTEIN IN RPLI-COTF INTERGENIC REGION. Insert
characterized
GP|467336|dbj|BAA05182.1||D26185 unknown Insert characterized
GP|2636598|emb|CAB16088.1||Z99124 yybT Insert characterized
PIR|S65976|S65976 yybT protein - Insert characterized
ORF00251(364-2241 of 2580)
EGAD|19304|BS4045(20-651 of 659) hypothetical 74.3 kd protein in rpli-cotf intergenic
region {Bacillus subtilis}SP|P37484|YYBT_BACSU
HYPOTHETICAL 74.3 KDA PROTEIN IN RPLI-COTF INTERGENIC
REGION.GP|467336|dbj|BAA05182.1||D26185 unknown {Bacillus subtilis}GP|26365
98|emb|CAB16088.1||Z99124 yybT {Bacillus subtilis}PIR|S65976|S65976 yybT protein -
Bacillus subtilis
% Match = 18.5
% Identity = 31.2 % Similarity = 55.8
Matches = 197 Mismatches = 271 Conservative Sub.s = 155

258       288       318       348       378       408       438       468
N***CSPLFIRGVLCYN*VLRGYLMKRFRFATVHLVLIGLILFGLLAICVRLFQSYTALLLAIFVALSFVVALLYYQKIT
                                 |    |   : :  |:|   |    |   :|       |  :  |  |:: ::
                 MPSFYEKPLFRYPIYALIALSIITILISFYFNWILGTVEVLLLAVILFFIKRAD
                 10        20        30        40        50

522       552       582       612            666       696
YEL-SEVEQ-IELLNDQTEVSLKSLLEQMPVGVIQFDLETNDIEWFNPYAELIFTGDN--GHFQSATVKDIITSRRNGTA
    :    |::    |    |: :  :    |   :||:|::  |: :    |||  ||      |         |
SLIRQEIDAYISTLSYRLKKVGEEALMEMPIGIMLFN-DQYYIEWANPFLSSCFNESTLVGRSLYDTCESVVPLIKQEVE
            70        80        90       100       110       120       130

726       756       786       816       846       876       906       936
GQSFEYGDNKYSAYLDTETGVFYFFDNFMGNRRNYDSSMLRPVIGIISIDNYDDIMDTMLEADMSKINAXVTSFXSDFTQ
::    | |:    :    :  ::||||      :         || :    |:||||||    : :    |:|  ||| : : :     |
SETVTLNDRKFRVVIKRDERLLYFFDVTEQIQIEKLYENERTVLAYIFLDNYDDVTQGLDDQTRSTMNSQVTSLLNAWAQ
            150       160       170       180       190       200       210

966       996       1026      1056      1086      1116      1146      1176
SKNIFYRRVNMDRYYIFTDYSVLNTLIKDKFDILNEFRKRAQENHLSLTLSMGISYGDGNHNQIGQIALENLNTALVRGG
 || :|  :  :|:    :  :|   |   ||  ||:| |::      : ::||||:|:        : ::| :|   :|: || |||
EYGIFLKRTSSERFIAVLNEGILTELENSKFSILDEVREKTSFDGVALTLSVGVGASVSSLKELGDLAQSSLDLALGRGG
            230       240       250       260       270       280       290

1206      1236      1266      1296      1326      1356      1386      1416
DQIVVRENDSSKKALYFGGGAVSTIKRSRTRTRAMMTAISDRLKVVDSVFIVGHRKLDMDALGASVGMQFFASNIVNASY
|| :  ::     :    | |  ||:| |   |       :|     |    : :|       |: |||::||::|:       :
DQVAIKLPNGKVK--FYGGKTNPMEKRTRVRARVISHALKEIVTESSNVIIMGHKFPDMDSIGAAIGILKVAQANNKDGF
            310       320       330       340       350       360       370

1446      1476      1500      1530      1560      1590      1620      1650
VVYDPNDMNSDIERAIDYLQEDGE--TRLVSVERAFELITQNSLLVMVDHSKTALTLSKEFFNKFADVIVVDHHRRDEDF
:|  |||  :  | ::|    |      :   :|: |  |  ||| :| :|     |||   | |:    | :|      |:|
IVIDPNQIGSSVQRLIGEIKKYEELWSRFITPEEAMEISNDDTLLVIVDTHKPSLVMEERLVNKIEHIVVIDHHRRGEEF
            390       400       410       420       430       440       450

1680      1710      1740      1770      1800      1830      1860      1890
PKNAVLSFIESGASSASELVTELIQFQQAKDKLSRSQASILMAGIMLDTRNFASNVTSRTFDVASYLRGLGSNSMAIQKI
 ::   :|   ::|     |||   :||||||:::|   :   |::   : |:   |:|||::|::|:       |||||   |||||  |::::  :||
IRDPLLVYMEPTASSTAELVTELLEYQPKRLKINMIEATALLAGIIVDTKSFSLRTGSRTFDAASYLRAKGADTVLVQKF
            470       480       490       500       510       520       530

1920      1950           2004      2034      2064      2091      2121
SATDFDEYRLINELILKGERIYDNIIVAT--GEEHKVYSHVIASKAADTMLTMAGIEATFVITK-NSSNIGISARSRNNI
  | |    :||        |||   :|:      |   : : :|: :::|||::|:|   :||:|   :   :   |||||    :
LKETVDSYIKRAKLIQHTVLYKDNIAIASLPENEEEYFDQVLIAQAADSLLSMSEVEASFAVARRDEQTVCISARSLGEV
            550       560       570       580       590       600       610

2151      2181      2211      2241      2271      2301      2331      2361
NVQRIMEKLGGGGHFSFAACQIQDKSVKQVRRMLLEIIDEDLRENSTVENRRD*LR*KLFFYKMLRGKEKKVRLRKYLLV
|||  |||  |  |||||:: || |:   ||   :       |     |||  :
NVQIIMEALEGGGHLTNAATQLSGISVSEALERLKHAIDEYFEGGVQR
            630       640       650
```

SEQ ID 8718 (GBS10) was expressed in *E. coli* as a GST-fusion product. SDS-PAGE analysis of total cell extract is shown in FIG. 1 (lane 6; MW 98 kDa). It was also expressed in *E. coli* as a His-fusion product. SDS-PAGE analysis of total cell extract is shown in FIG. 2 (lane 7; MW 73 kDa).

The GST-fusion protein was purified as shown in FIG. 189, lane 3.

Based on this analysis, it was predicted that these proteins and their epitopes could be useful antigens for vaccines or diagnostics.

Example 1037

A DNA sequence (GBSx1109) was identified in *S. agalactiae* <SEQ ID 3205> which encodes the amino acid sequence <SEQ ID 3206>. Analysis of this protein sequence reveals the following:

```
Possible site: 59
>>> Seems to have no N-terminal signal sequence
----- Final Results -----
   bacterial cytoplasm --- Certainty = 0.4643 (Affirmative) <succ>
     bacterial membrane --- Certainty = 0.0000 (Not Clear) <succ>
       bacterial outside --- Certainty = 0.0000 (Not Clear) <succ>
```

The protein has homology with the following sequences in the GENPEPT database.

```
>GP: CAA43972 GB: X62002 ribosomal protein L9 [Bacillus
stearothermophilus]
Identities = 80/149 (53%), Positives = 105/149 (69%), Gaps = 2/149 (1%)
Query:   1 MKVIFLQDVKGKGKKGEVKEVPTGYAQNFLLKKNLAKEATTQAIGELKGKQKSEEKAQAE     60
           MKVIFL+DVKGKGKKGE+K V  GYA NFL K+ LA EAT   +  L+ +++ E++  AE
Sbjct:   1 MKVIFLKDVKGKGKKGEIKNVADGYANNFLFKQGLAIEATPANLKALEAQKQKEQRQAAE     60

Query:  61 ILAQAKELKTQLESETTRVQFIEKVGPDGRTFGSITAKKIAEELQKQYGIKIDKRHIDLD    120
              LA AK+LK QLE  T  +     K G  GR FGSIT+K+IAE LQ Q+G+K+DKR I+L
Sbjct:  61 ELANAKKLKEQLEKLTVTIP--AKAGEGGRLFGSITSKQIAESLQAQHGLKLDKRKIELA    118

Query: 121 HTIRAIGKVEVPVKLHKQVSSQIKLDIKE                                 149
              IRA+G   VPVKLH +V++ +K+ + E
Sbjct: 119 DAIRALGYTNVPVKLHPEVTATLKVHVTE                                 147
```

A related DNA sequence was identified in *S. pyogenes* <SEQ ID 3207> which encodes the amino acid sequence <SEQ ID 3208>. Analysis of this protein sequence reveals the following:

```
Possible site: 59
>>> Seems to have no N-terminal signal sequence
----- Final Results -----
   bacterial cytoplasm --- Certainty = 0.4630 (Affirmative) <succ>
     bacterial membrane --- Certainty = 0.0000 (Not Clear) <succ>
       bacterial outside --- Certainty = 0.0000 (Not Clear) <succ>
```

An alignment of the GAS and GBS proteins is shown below.

```
Identities = 119/150 (79%), Positives = 138/150 (91%)
Query:   1 MKVIFLQDVKGKGKKGEVKEVPTGYAQNFLLKKNLAKEATTQAIGELKGKQKSEEKAQAE     60
           MKVIFL DVKGKGKKGE+KEVPTGYAQNFL+KKNLAKEAT+Q+IGELKGKQK+EEKAQAE
Sbjct:   1 MKVIFLADVKGKGKKGEIKEVPTGYAQNFLIKKNLAKEATSQSIGELKGKQKAEEKAQAE     60

Query:  61 ILAQAKELKTQLESETTRVQFIEKVGPDGRTFGSITAKKIAEELQKQYGIKIDKRHIDLD    120
           ILA+A+ +K  L+ + TRVQF EKVGPDGRTFGSITAKKI/EELQKQ+G+K+DKRHI LD
Sbjct:  61 ILAEAQAVKAVLDEDKTRVQFQEKVGPDGRTFGSITAKKISEELQKQFGVKVDERHIVLD    120

Query: 121 HTIRAIGKVEVPVKLHKQVSSQIKLDIKEA                                150
           H IRAIG +EVPVKLHK+V+++IKL I EA
Sbjct: 121 HPIRAIGLIEVPVKLHKEVTAEIKLAITEA                                150
```

Based on this analysis, it was predicted that these proteins and their epitopes could be useful antigens for vaccines or diagnostics.

Example 1038

A DNA sequence (GBSx1110) was identified in *S. agalactiae* <SEQ ID 3209> which encodes the amino acid sequence <SEQ ID 3210>. This protein is predicted to be DNA polymerase III delta prime subunit (dnaB). Analysis of this protein sequence reveals the following:

```
Possible site: 61
>>> Seems to have an uncleavable N-term signal seq
```

-continued

```
INTEGRAL    Likelihood = -0.43   Transmembrane 204-220 (204-220)
----- Final Results -----
     bacterial membrane --- Certainty = 0.1171 (Affirmative) <succ>
       bacterial outside --- Certainty = 0.0000 (Not Clear) <succ>
      bacterial cytoplasm --- Certainty = 0.0000 (Not Clear) <succ>
```

A related DNA sequence was identified in *S. pyogenes* <SEQ ID 2423> which encodes the amino acid sequence <SEQ ID 2424>. Analysis of this protein sequence reveals the following:

Possible site: 21
>>> Seems to have no N-terminal signal sequence
INTEGRAL    Likelihood = -0.27    Transmembrane 210-226 (210-226)
----- Final Results -----
    bacterial membrane --- Certainty = 0.1107 (Affirmative) <succ>
        bacterial outside --- Certainty = 0.0000 (Not Clear) <succ>
            bacterial cytoplasm --- Certainty = 0.0000 (Not Clear) <succ> bacterial cytoplasm --- Certainty = 0.4909 (Affirmative) <succ>
        bacterial membrane --- Certainty = 0.0000 (Not Clear) <succ>
            bacterial outside --- Certainty = 0.0000 (Not Clear) <succ>

An alignment of the GAS and GBS proteins is shown below.

The protein has no significant homology with any sequences in the GENPEPT database.

```
Identities = 397/450 (88%), Positives = 431/450 (95%), Gaps = 1/450 (0%)
Query:   3 EVSELRVQPQDLLAEQAVLGSIFISPEKLIMVREFISPDDFYKYSHKVIFRAMITLADRN       62
           EV+ELRVQPQDLLAEQ+VLGSIFISP+KLI VREFISPDDFYKY+HK+IFRAMITL+DRN
Sbjct:   8 EVAELRVQPQDLLAEQSVLGSIFISPDKLIAVREFISPDDFYKYAHKIIFRAMITLSDRN       67

Query:  63 DAIDAATVRNILDDQGDLQNIGGLGYIVELVNSVPTSANAEFYAFIVSEKAMLRDIISKL      122
           DAIDA T+R ILDDQ DLQ+IGGL YIVELVNSVPTSANAE+YAKIV+EKAMLRDII++L
Sbjct:  68 DAIDATTIRTILDDQDDLQSIGGLSYIVELVNSVPTSANAEYYAKIVAEKAMLRDIIARL      127

Query: 123 TDTVNMAY-EGNDSDEIIATAEKALVDINEHSNRSGFRKISDVLKVNYENLELRSQQTSD      181
           T++VN+AY E    +E+IA  E+AL+++NEHSNRSGFRKISDVLKVNYE LE RS+QTS+
Sbjct: 128 TESVNLAYDEILKPEEVIAGVERALIELNEHSNRSGFRKISDVLKVNYEALEARSKQTSN      187

Query: 182 VTGLPTGFRDLDRITTGLHPDQLIILAARPAVGKTAFVLNIAQNVGTKQNRPVAIFSLEM      241
           VTGLPTGFRDLD+ITTGLHPDQL+ILAARPAVGKTAFVLNIAQNVGTKQ + VAIFSLEM
Sbjct: 188 VTGLPTGFRDLDKITTGLHPDQLVILAARPAVGKTAFVLNIAQNVGTKQKKTVAIFSLEM      247

Query: 242 GAESLVDRMLAAEGMVDSHSLRTGQLTDQDWNNVTIAQGALADAPIYIDDTPGIKITEIR      301
           GAESLVDRMLAAEGMVDSHSLRTGQLTDQDWNNVTIAQGALA+APIYIDDTPGIKITEIR
Sbjct: 248 GAESLVDRMLAAEGMVDSHSLRTGQLTDQDWNNVTIAQGALAEAPIYIDDTPGIKITEIR      307

Query: 302 ARSRKLSQEVDDGLGLIVIDYLQLISGTRPENRQQEVSEISRQLKILAKELKVPVIALSQ      361
           ARSRKLSQEVD GLGLIVIDYLQLI+GT+PENRQQEVS+ISRQLKILAKELKVPVIALSQ
Sbjct: 308 ARSRKLSQEVDGGLGLIVIDYLQLITGTKPENRQQEVSDISRQLKILAKELKVPVIALSQ      367

Query: 362 LSRGVEQRQDKRPVLSDIRESGSIEQDADIVAFLYRDDYYRREGEEAEEIVEDNTVEVIL      421
           LSRGVEQRQDKRPVLSDIRESGSIEQDADIVAFLYRDDYYR+E ++AEE VEDNT+EVIL
Sbjct: 368 LSRGVEQRQDKRPVLSDIRESGSIEQDADIVAFLYRDDYYRKECDDAEEAVEDNTIEVIL      427

Query: 422 EKNRAGARGTVKLMFQKEYNKFSSIAQFEE                                    451
           EKNRAGARGTVKLMFQKEYNKFSSIAQFEE
Sbjct: 428 EKNRAGARGTVKLMFQKEYNKFSSIAQFEE                                    457
```

Based on this analysis, it was predicted that these proteins and their epitopes could be useful antigens for vaccines or diagnostics.

A related DNA sequence was identified in *S. pyogenes* <SEQ ID 3213> which encodes the amino acid sequence <SEQ ID 3214>. Analysis of this protein sequence reveals the following:

Example 1039

A DNA sequence (GBSx1111) was identified in *S. agalactiae* <SEQ ID 3211> which encodes the amino acid sequence <SEQ ID 3212>. Analysis of this protein sequence reveals the following:

Possible site: 21
>>> Seems to have no N-terminal signal sequence
----- Final Results -----
    bacterial cytoplasm --- Certainty = 0.3467 (Affirmative) <succ>
        bacterial membrane --- Certainty = 0.0000 (Not Clear) <succ>
            bacterial outside --- Certainty = 0.0000 (Not Clear) <succ>

Possible site: 61
>>> Seems to have no N-terminal signal sequence
----- Final Results -----

An alignment of the GAS and GBS proteins is shown below.

```
Identities = 77/90 (85%), Positives = 84/90 (92%)
Query:    1 MSDAFADVAKMKKIKEDIKSHEGQMVELTLENGRKREKNKIGRLIEVYPSLFIVEYKDTA        60
            MSDAF DVAKMKKIKEDI++HEGQ+VELTLENGRKREKNKIGRLIEVY SLFI+EY D++

Sbjct:   11 MSDAFTDVAKMKKIKEDIRAHEGQLVELTLENGRKREKNKIGRLIEVYSSLFIIEYSDSS        70

Query:   61 AVPGAIDNTYVESYTYSDILTEKTLIRYFD                                    90
            PGAIDN+YVESYTYSDILTEKTLIRY D Sbjct:   71 DTPGAIDNSYVESYTYSDILTEKTLIRYLD                                   100
```

Based on this analysis, it was predicted that these proteins and their epitopes could be useful antigens for vaccines or diagnostics.

Example 1040

A DNA sequence (GBSx1112) was identified in *S. agalactiae* <SEQ ID 3215> which encodes the amino acid sequence <SEQ ID 3216>. This protein is predicted to be 30S ribosomal protein S4 (rpsD). Analysis of this protein sequence reveals the following:

Possible site: 27
>>> Seems to have no N-terminal signal sequence
----- Final Results -----
   bacterial cytoplasm --- Certainty = 0.2937 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

A related DNA sequence was identified in *S. pyogenes* <SEQ ID 3217> which encodes the amino acid sequence <SEQ ID 3218>. Analysis of this protein sequence reveals the following:

Possible site: 27
>>> Seems to have no N-terminal signal sequence
----- Final Results -----
   bacterial cytoplasm --- Certainty = 0.2937 (Affirmative) <succ>
   bacterial membrane --- Certainty = 0.0000 (Not Clear) <succ>
   bacterial outside --- Certainty = 0.0000 (Not Clear) <succ>

```
>GP: AAC00397 GB: AF008220 ribosomal protein S4 [Bacillus subtilis]
Identities = 138/201 (68%), Positives = 158/201 (77%), Gaps = 1/201 (0%)
Query:    1 MSRYTGPSWKQSRRLGLSLTGTGKELARRNYVPGQHGPNNRSKLSEYGLQLAEKQKLRFS        60
            M+RYTGPSWK SRRLG+SL+GTGKEL +R Y PG HGP  R KLSEYGLQL EKQKLR Sbjct:    1 MARYTGPSWKLSRRLGISLSGTGKELEKRPYAPGPHGPGQRKKLSEYGLQLQEKQKLRHM        60

Query:   61 YGLGEKQFRNLFVQATKAKEGTLGFNFMVLLERRLDNVVYRLGLATTRRQARQFVNHGHI       120
            YG+ E+QFR LF +A K   G  G NFM+LL+ RLDNVVY+LGLA TRRQARQ VNHGHI Sbjct:   61 YGVNERQFRTLFDKAGKLA-GKHGENFMILLDSRLDNVVYKLGLARTRRQARQLVNHGHI       119

Query:  121 LVDGKRVDIPSYRVTPGQVISVREKSMKVPAILEAVEATLGRPAFVSFDAEKLEGSLTRL       180
            LVDG RVDIPSY V PGQ I VREKS +  I E+VE    P +++FDAEKLEG+ TRL Sbjct:  120 LVDGSRVDIPSYLVKPGQTIGVREKSRNLSIIKESVEVNNFVPEYLTFDAEKLEGTFTRL       179

Query:  181 PERDEINPEINEALVVEFYNK                                            201
            PER E+ PEINEAL+VEFY++

Sbjct:  180 PERSELAPEINEALIVEFYSR                                            200
```

An alignment of the GAS and GBS proteins is shown below.

```
Identities = 201/203 (99%), Positives = 201/203 (99%)
Query:    1 MSRYTGPSWKQSRRLGLSLTGTGKELARRNYVPGQHGPNNRSKLSEYGLQLAEKQKLRFS        60
            MSRYTGPSWKQSRRLGLSLTGTGKELARRNYVPGQHGPNNRSKLSEYGLQLAEKQKLRFS Sbjct:    1 MSRYTGPSWKQSRRLGLSLTGTGKELARRNYVPGQHGPNNRSKLSEYGLQLAEKQKLRFS        60

Query:   61 YGLGEKQFRNLFVQATKAKEGTLGFNFMVLLERRLDNVVYRLGLATTRRQARQFVNHGHI       120
            YGLGEKQFRNLFVQATK KEGTLGFNFMVLLERRLDNVVYRLGLATTRRQARQFVNHGHI Sbjct:   61 YGLGEKQFRNLFVQATKIKEGTLGFNFMVLLERRLDNVVYRLGLATTRRQARQFVNHGHI       120
```

```
Query: 121 LVDGKRVDIPSYRVTPGQVISVREKSMKVPAILEAVEATLGRPAFVSFDAEKLEGSLTRL    180
            LVDGKRVDIPSYRV PGQVISVREKSMKVPAILEAVEATLGRPAFVSFDAEKLEGSLTRL Sbjct: 121 LVDGKRVDIPSYRVDPGQVISVREKSMKVPAILEAVEATLGRPAFVSFDAEKLEGSLTRL    180

Query: 181 PERDEINPEINEALVVEFYNKML                                         203
            PERDEINPEINEALVVEFYNKML Sbjct: 181 PERDEINPEINEALVVEFYNKML                                         203
```

Based on this analysis, it was predicted that these proteins and their epitopes could be useful antigens for vaccines or diagnostics.

Example 1041

A DNA sequence (GBSx1113) was identified in *S. agalactiae* <SEQ ID 3219> which encodes the amino acid sequence <SEQ ID 3220>. Analysis of this protein sequence reveals the following:

Possible site: 29
>>> Seems to have no N-terminal signal sequence
----- Final Results -----
   bacterial cytoplasm --- Certainty = 0.4067 (Affirmative) <succ>
   bacterial membrane --- Certainty = 0.0000 (Not Clear) <succ>
   bacterial outside --- Certainty = 0.0000 (Not Clear) <succ>

A related DNA sequence was identified in *S. pyogenes* <SEQ ID 3221> which encodes the amino acid sequence <SEQ ID 3222>. Analysis of this protein sequence reveals the following:

Possible site: 34
>>> Seems to have no N-terminal signal sequence
----- Final Results -----
   bacterial cytoplasm --- Certainty = 0.3465 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP: AAF98302 GB: AF243383 unknown; Orf3 [Lactococcus lactis subsp.
lactis]
Identities = 46/97 (47%), Positives = 69/97 (70%)
Query:  1 MNLNDRLKIEEMEEKYDSFKPRINALVEAIDDFQKHYEDYVKLREFYGSEDWFRLSEQTE     60
          M+   D   I++ME KYD+F P +  L+++++ F    Y +Y++LR FYGSE WF   E  +

Sbjct:  1 MDNKDIELIQQMENKYDTFMPVLTNLIDSVEKFNSIYNNYIELRNFYGSEKWFEYMEIEK     60

Query: 61 NNLKCGVLSEDQLFDFIGEHNELVGQFLDMSSQMYRH                            97
            +KCGVL+EDQLFD I +HNEL+G  LD++S+MY++

Sbjct: 61 IPVKCGVLTEDQLFDMISDHNELLGVLLDLTSKMYKN                            97
```

An alignment of the GAS and GBS proteins is shown below.

```
Identities = 48/98 (48%), Positives = 74/98 (74%)
Query:  1 MNLNDRLKIEEMEEKYDSFKPRINALVEAIDDFQKHYEDYVKLREFYGSEDWFRLSEQTE     60
          M   D+L +E+ME+ Y++F P++  L+EA+D F++HYE+Y  LR FY S++WFRL+ Q Sbjct:  1 MTKQDQLIVEKMEQTYEAFSPKLANLIEALDAFKEHYEEYATLRNEYSSDEWFRLANQPW     60

Query: 61 NNLKCGVLSEDQLFDFIGEHNELVGQFLDMSSQMYRHL                           98
          +++ CGVLSED LFD IG+HN+L+    LD++  MY+H+

Sbjct: 61 DDIPCGVLSEDLLFDMIGDHNQLLADILDLAPIMYKHM                           98
```

Example 1042

A DNA sequence (GBSx1114) was identified in *S. agalactiae* <SEQ ID 3223> which encodes the amino acid sequence <SEQ ID 3224>. Analysis of this protein sequence reveals the following:

Possible site: 50
>>> Seems to have no N-terminal signal sequence
----- Final Results -----
   bacterial cytoplasm --- Certainty = 0.0965 (Affirmative) <succ>
      bacterial membrane --- Certainty = 0.0000 (Not Clear) <succ>
         bacterial outside --- Certainty = 0.0000 (Not Clear) <succ>

The protein has homology with the following sequences in the GENPEPT database.

```
>GP: BAB04438 GB: AP001509 transcriptional regulator (TetR/AcrR
family) [Bacillus halodurans]
Identities = 47/181 (25%), Positives = 95/181 (51%), Gaps = 16/181 (8%)
Query:    4 DTRREKTKRAIEAAMITLLKDQSFDEISTINLTKTAGISRSSFYTHYKDKYEMIDQYQQS        63
            D R++ T+   ++ +++ L++++    I+   +   A  I+RS+FY+HY D Y+++ Q+

Sbjct:    6 DRRKRYTRMLLKESLMKLMQEKPLSNITIKEICDLADINRSTFYSHYTDLYDLLYQIEDE       65

Query:   64 LFNKV-EYIFDRNQFKKEDAL-----LEIFQFLDRESLFAALLTQNGTKEIQTYILNKLQ      117
              +   + E +   N  K E+AL      L ++   +RES    L ++ G    Q     K Sbjct:   66 IIKDLSEALSSYNYTKDEEALQMTENLLVYIANNRESC-QTLFSEYGDPSFQ-----KKV      119

Query:  118 LMLSKELPVVNP---DATKSDINRLYYSVYLSHAIFGVYQMWITRGKKESPQQITQVLLSL    175
             +ML+ +  +  P      TK DI+  Y  S+Y+ +     + Q  W+    G K+SP+++  ++++  L Sbjct:  120 MMLAHDHVIKTPLVGKHTKPDISE-YVSLYIVNGSIHIVQSWLKNGLKQSPKEMAELIIKL    179
```

Example 1043

A related DNA sequence was identified in *S. pyogenes* <SEQ ID 3225> which encodes the amino acid sequence <SEQ ID 3226>. Analysis of this protein sequence reveals the following:

Possible site: 48
>>> Seems to have an uncleavable N-term signal seq
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>

The protein has homology with the following sequences in the databases:

```
>GP: BAB04438 GB: AP001509 transcriptional regulator (TetR/AcrR
family) [Bacillus halodurans]

Identities = 47/180 (26%), Positives = 88/180 (48%), Gaps = 18/180 (10%)

Query:    4 RKENTKQAILKAMVMLLKTESFDDITTVKLSKRAGISRSSFYTHYKDKYEMIDYYQQTFF       63
            RK+ T+  + ++++ L++ +      +IT   ++   A  I+RS+FY+HY D Y+++    +

Sbjct:    8 RKKYTRMLLKESLMKLMQEKPLSNITIKEICDLADINRSTFYSHYTDLYDLLYQIEDEII      67

Query:   64 HKLEYIFEKKYQNKEQAFLEVFEFL-----QREQLLSSLLSANGTKEIQAFIINKVRLL-     117
             L               K++ L++ E L            +   +L  S G       Q          KV +L Sbjct:   68 KDLSEALSSYNYTKDEEALQMTENLLVYIANNRESCQTLFSEYGDPSFQ----KKVMMLA     123

Query:  118 ----ITTDLQDKESTEELSQTKEKEYQSIYLAHAFFGVCQSWIAKGKKESPQEMTQFVLKM    173
                 I T L  K +    ++S    EY  S+Y+ +       + QSW+    G K+SP+EM + ++K+

Sbjct:  124 HDHVIKTPLVGKHTKPDIS----EYVSLYIVNGSIHIVQSWLKNGLKQSPKEMAELIIKL     179
```

An alignment of the GAS and GBS proteins is shown below.

```
Identities = 100/179 (55%), Positives = 134/179 (73%), Gaps = 2/179 (1%)
Query:   1 MVNDTRREKTKRAIEAAMITLLKDQSFDEISTINLTKTAGISRSSFYTHYKDKYEMIDQY          60
           MVN R+E TK+AI  AM+ LLK +SFD+I+T+ L+K AGISRSSFYTHYKDKYEMID Y
Sbjct:   1 MVN--RKENTKQAILKAMVMLLKTESFDDITTVKLSKRAGISRSSFYTHYKDKYEMIDYY         58

Query:  61 QQSLFNKVEYIFDRNQFKKEDALLEIFQFLDRESLFAALLTQNGTKEIQTYILNKLQLML        120
           QQ+ F+K+EYIF++    KE A LE+F+FL RE L ++LL+ NGTKEIQ +I+NK++L++
Sbjct:  59 QQTFFHKLEYIFEKKYQNKEQAFLEVFEFLQREQLLSSLLSANGTKEIQAFIINKVRLLI        118

Query: 121 SKELPVVNPDATKSDINRLYYSVYLSHAIFGVYQMWITRGKKESPQQITQVLLSLLPQT         179
             + +L       S    + Y S+YL+HA FGV Q WI +GKKESPQ++TQ +L +L  T
Sbjct: 119 TTDLQDKESTEELSQTEKEYQSIYLAHAFFGVCQSWIAKGKKESPQEMTQFVLKMLTST         177
```

Based on this analysis, it was predicted that these proteins and their epitopes could be useful antigens for vaccines or diagnostics.

Example 1043

A DNA sequence (GBSx1115) was identified in *S. agalactiae* <SEQ ID 3227> which encodes the amino acid sequence <SEQ ID 3228>. Analysis of this protein sequence reveals the following:

---

Possible site:58
>>> Seems to have no N-terminal signal sequence
INTEGRAL    Likelihood = –10.35    Transmembrane 790-806 (787-808)

-continued

| INTEGRAL | Likelihood = –7.32 | Transmembrane 707-723 (703-725) |
| INTEGRAL | Likelihood = –7.11 | Transmembrane 637-653 (630-659) |
| INTEGRAL | Likelihood = –6.32 | Transmembrane 678-694 (672-698) |
| INTEGRAL | Likelihood = –1.44 | Transmembrane 55-71 (55-73) |
| INTEGRAL | Likelihood = –0.22 | Transmembrane 732-748 (730-748) |

----- Final Results -----
 bacterial membrane --- Certainty = 0.5140 (Affirmative) <succ>
 bacterial outside --- Certainty = 0.0000 (Not Clear) <succ>
 bacterial cytoplasm --- Certainty = 0.0000 (Not Clear) <succ>

A related GBS nucleic acid sequence <SEQ ID 10287> which encodes amino acid sequence <SEQ ID 10288> was also identified.

The protein has homology with the following sequences in the GENPEPT database.

```
>GP: CAB12856 GB: Z99109 alternate gene name: yixE~similar to phage
infection protein [Bacillus subtilis]
Identities = 227/783 (28%), Positives = 387/783 (48%), Gaps = 60/783 (7%)
Query:  45 KAIIKSPKLWITMAGVALIPTLYNVIFLSSMWDPYGNTKNLPVAVVNQDKSAKLNGKTIS        104
           K I+ S KL I +  +  +P +Y+ +FL + WDPYG     LPV VVNQDK A   G+ +
Sbjct:   9 KDIVTSKKLLIPIIAILFVPLIYSGVFLKAYWDPYGTVDQLPVVVVNQDKGATYEGEKLQ         68

Query: 105 IGKDMEDNLSKNDSLDFHFFT-AKRAEKELEKGHYYMVITFPKDLSRKATTLMTEKPERL        163
           IG D+    L   N++ D+HF+     ++ K+L    YY+V+  P+D S+ A+T++ + P++L
Sbjct:  69 IGDDLVKELKDNNNFDWHFSNDLDQSLKDLLNQKYYLVVEIPEDFSKNASTVLDKNPKKL        128

Query: 164 NITYKTTKGRSFVASKMSETAANKLKDEVAESITGTYTESVFKNMGSMKTGINKAADGSQ        223
           ++  Y T  G ++V + + E A +KLK  V++ +T  YT+ +F N   +  G++ A+ G++
Sbjct: 129 DLKYHTNAGSNYVGATIGEKAIDKLKASVSKEVTEQYTKVIFDNFKDIAKGLSDASSGAK        188

Query: 224 ELLNGSNKLQDGSQTLTSNLDVLASSSQTFSGGANKLNSGINLYTDGVGTLSNGLETLSD        283
           ++ +G+   ++GS L NL  L  S+ T S     +L G     T G+ +L + L     D
Sbjct: 189 KIDDGTKDAKNGSAQLKENLAKLKESTATISDKTAQLADGAAQVTSGIQSLDSSLGKFQD        248

Query: 284 GVTAYTTGVHKLSEGSQKLDDKSQALV-------EGSEKLTDGLQQLSQATQLKPEQERT        336
            +L+ GS +L  K   L+         +G+  LT+GL QL+    Q    E+
Sbjct: 249 SSNQIYDKSSQLAAGSGELTSKMNELLAGLQNVQKGTPNLTNGLDQLNSKVQEGSEKAAK        308

Query: 337 LQNLSDG--LKNLNQIITNLQSTATTDSDTNSKLFNFLSTIESSTKALMNTAAADKQKQM        394
            + ++   L  L    + NL+ + T      +L +F +++++  +A N   +   +
Sbjct: 309 AEKIINALDLTKLETAVNNLEKSETAMKEFKKQLTDFENSLKNRDQAFKN--VINSSDFL        366

Query: 395 TAVQST----SAFKSLTPEQQSQITSAVTGTPTSAE-TIAANISSNIENMKTVLSEASSS        449
           TA Q +     S K L         ++ PT+ +   A I S++E++K  +++ +
Sbjct: 367 TAEQKSQLINSVEKKLPQVDAPDFDQILSQLPTADQLPDIATIKSSLEDVKAQVAQVKAM        426
```

```
Query:  450 APSN----NGSQNLQTLSGTANNLVLKAISDLDKIQKLPTATKQLYQGSQTLTKGITDYT  505
             +       NG++ +Q              D I +L       ++Y GSQ LT G T   T Sbjct:  427 PEATSKLYNGAKTIQ----------------DAIDRLTEGADKIYNGSQKLTDGQTKLT  469

Query:  506 NAVGQLRKGAVTLDSKSNQLISGTQKASQGAQTLDSKSDQLRDGAGQLASGSDRIADGSN  565
             +G+  K    + S QL++G              S Q+  G  +L  GS  ++   GS+

Sbjct:  470 AGIGEYNKQFAKAKAGSEQLVTG--------------SSQVSGGLFKLLDGSKQVQSGSS  515

Query:  566 KLAGGGHQLTDGLTELSGGVSQLSSSLGKAGDQLSMVSVNKDNANAVSSPVTIKHEDYDS  625
             KLA G   L  GL +L  G  +LSS L  A DQ    +  +         + PV  K +     S Sbjct:  516 KLADGSASLDTGLGKLLDGTGELSSKLKDAADQTGDIDADDQTYGMFADPVKTKDDAIHS  575

Query:  626 VDTNGVGMAPYMISVALMVVALSANVIFARALSGKEPANRFSWAKNK---LLINGFIATL  682
             V   G G+ PY++S+ L V  +    V+F    +    P N F W   +K   +++ G I +L Sbjct:  576 VPNYGTGLTPYILSMGLYVGGIMLTVVFPLKEASGRPRNGFEWFFSKFNVMMLVGIIQSL  635

Query:  683 -AATILFFAVQFIGLKPDYPGKTYFIILLTAWTLMALVTALVGWDNRYGSFLSLLILLFQ  741
              AT+L       IGL+ +   + Y   ++T+     +A++   L        G       F++++IL+ Q Sbjct:  636 IVATVLLLG---IGLEVESTWRFYVFTIITSLAFLAIIQFLATTMGNPGRFIAVIILVLQ  692

Query:  742 LGSSAGTYPIELSPKFFQTIQPFLPMTYSVSGLRETISLTGDVNHQWRMLVIFLVSSMIL  801
             LG+S GT+P+EL  P  F+Q I     LPMTYS++G R   IS   GD    + W+M   + +    ++++

Sbjct:  693 LGASGGTFPLELLPNFYQVIHGALPMTYSINGFRAVIS-NGDFGYMWQMAGVLIGIALVM  751

Query:  802 ALL  804
             L

Sbjct:  752 IAL  754
```

A related DNA sequence was identified in *S. pyogenes* <SEQ ID 2017> which encodes the amino acid sequence <SEQ ID 2018>. Analysis of this protein sequence reveals the following:

Possible site: 26
>>> Seems to have no N-terminal signal sequence
INTEGRAL    Likelihood = –9.29    Transmembrane 735-751 (729-754)
INTEGRAL    Likelihood = –5.79    Transmembrane 582-598 (580-601)

-continued

INTEGRAL    Likelihood = –3.66    Transmembrane 652-668 (650-669)
INTEGRAL    Likelihood = –2.97    Transmembrane 14-30 (14-34)
INTEGRAL    Likelihood = –2.66    Transmembrane 623-639 (622-641)
----- Final Results -----
   bacterial membrane --- Certainty = 0.4715 (Affirmative) <succ>
   bacterial outside --- Certainty = 0.0000 (Not Clear) <succ>
   bacterial cytoplasm --- Certainty = 0.0000 (Not Clear) <succ>

An alignment of the GAS and GBS proteins is shown below.

```
Identities = 360/779 (46%), Positives = 508/779 (64%), Gaps = 32/779 (4%)
Query:   40 MLDELKAIIKSPKLWITMAGVALIPTLYNVIFLSSMWDPYGNTKNLPVAVVNQDKSAKLN   99
            ML+ELK +IK+PKL ITM GVAL+P LYN+ FL SMWDPYG   +LP+AVVN DK AK Sbjct:    1 MLEELKTLIKNPKLMITMIGVALVPALYNLSFLGSMWDPYGRVNDLPIAVVNHDKPAKRA   60

Query:  100 GKTISIGKDMEDNLSKNDSLDFHFTTAKRAEKELEKGHYYMVITFPKDLSRKATTLMTEK  159
            K+++IG DM D +SK+   L++HF  +AK+A++  L++G YYMVIT P+DLS++A TL+    +

Sbjct:   61 DKSLTIGNDMVDKMSKSKDLEYHFVSAKQAQEGLKEGDYYMVITLPEDLSQRAATLLNPE  120

Query:  160 PERLNITYKTTKGRSFVASKMSETAANKLKDEVAESITGTYTESVFKNMGSMKTGINKAA  219
            P++L  I Y+T+KG   VA+KM ETA  KLK+ V+++IT TYT +VF +M    +++G+ +A+

Sbjct:  121 PQKLTIRYQTSKGHGMVAAKMGETAMAKLKESVSQNITKTYTSAVFSSMTDLQSGLKEAS  180

Query:  220 DGSQELLNGSNKLQDGSQTLTSNLDVLASSSQTFSGGANKLNSGINLYTDGVGTLSNGLE  279
              GSQ L +G+    Q GSQTL++NL  L  +SQ F  G  +L SG+     YTDGV  + NGL Sbjct:  181 AGSQALASGAKTAQAGSQTLSTNLAALTGASQQFQQGTGRLTSGLTTYTDGVNQVKNGLG  240

Query:  280 TLSDGVTAYTTGVHKLSEGSQKLDDKSQALVEGSEKLTDGLQQLSQATQLKPEQERTLQN  339
            TLS   +  Y  GV +LS+G+   +L+                GL QL+QAT L  E+ +  +Q+

Sbjct:  241 TLSTDIPNYLNGVSRLSQGASQLNQ--------------GLSQLTQATTLSDEKAKGIQS  286

Query:  340 LSDGLKNLNQIITNLQSTATTDSDTN---SKLFNFLSTIESSTKALMNTAAADKQKQMTA  396
             L   GL   LNQ  I  L+   +T   N    +L N L  I    + K ++       A + ++++A
```

-continued

```
Sbjct: 287  LIVGLPVLNQGIQQLNTELSTLQPPNLNADELGNSLGAIAQAAKQVIAEETAAQNEELSA  346

Query: 397  VQSTSAFKSLTPEQQSQITSAVTGTPTSAETIAAN-ISSNIENMKTVLSEASSSAPSNNG  455
            +Q+TS ++SLT EQQ ++ +A++ +  S      AA I S+++ + T L    S    S
Sbjct: 347  LQATSVYQSLTAEQQGELAAALSQSDKSQTVSAAQTILSSVQTLSTSLQSLSQEDQSKQL  406

Query: 456  SQNLQTLSGTANNLVLKAISDLDKIQKLPTATKQLYQGSQTLTKGITDYTNAV----GQL  511
              Q  + ++  AN              Q LP A+  L + S   L K        V        QL
Sbjct: 407  EQLKEAVAQIANQ----------SNQALPGASSALTELSTGLAKVNGSLNQQVLPGSNQL  456

Query: 512  RKGAVTLDSKSNQLISGTQKASQGAQTLDSKSDQLRDGAGQLASGSDRIADGSNKLAGGG  571
                    G    L+  +  +  SG   K  S+GA   L  SKS +L DG+ QL+ G+ ++ADGS++L+ GG
Sbjct: 457  TTGLAQLNRYNTAIGSGVIKLSEGANALSSKSGELLOGSHQLSEGATKLADGSSQLSQGG  516

Query: 572  HQLTDGLTELSGGVSQLSSSLGKAGDQLSMVSVNKDNANAVSSPVTIKHEDYDSVDTNGV  631
            HQLT  GLTELS  G+S  L+  SL  KA    QLS+VSV    NA AV+ P+ +    +D D V TNG+
Sbjct: 517  HQLTSGLTELSTGLSTLNGSLAKASQQLSLVSVTDKNAKAVAKPLVLNEKDKDGVKTNGI  576

Query: 632  GMAPYMISVALMVVALSANVIFAKALSGKEPANRFSWAKNKLLINGFIATLAATILFFAV  691
            GMAPYMI+V+LMVVALS  NVIFA +LSG+    +++ WAK K +INGFI+T+ +  +L+ A+
Sbjct: 577  GMAPYMIAVSLMVVALSTNVIFANSLSGRPVEDKWDWAKQKFVINGFISTMGSIVLYLAI  636

Query: 692  QFIGLKPDYPGKTYFIILLTAWTLMALVTALVGWDNRYGSFLSLLILLFQLGSSAGTYPI  751
            Q +G +   Y   +T    I+L+ WT MALVTALVGWD+RYGSF  SL++LL  Q+GSS  G+YPI
Sbjct: 637  QLLGFEARYGMETLGFIMLSGWTFMALVTALVGWDDRYGSFASLVMLLLQVGSSGGSYPI  696

Query: 752  ELSPKFFQTIQPFLPMTYSVSGLRETISLTGDVNHQWRMLVIFLVSSMILALLIYRKQE  810
            ELS  FFQ +  PFLPMTY VSGLR+TISL+G  +   +  ++L  FL++ M+LALLIYR ++
Sbjct: 697  ELSGAFFQKLHPFLPMTYVVSGLRQTISLSGHIGVEVKVLTGFLLAFMVLALLIYRPKK  755
```

Based on this analysis, it was predicted that these proteins and their epitopes could be useful antigens for vaccines or diagnostics.

Example 1044

A DNA sequence (GBSx1116) was identified in *S. agalactiae* <SEQ ID 3229> which encodes the amino acid sequence <SEQ ID 3230>. Analysis of this protein sequence reveals the following:

---

Possible site: 35
>>> Seems to have no N-terminal signal sequence
----- Final Results -----
   bacterial cytoplasm --- Certainty = 0.2664 (Affirmative) <succ>
     bacterial membrane --- Certainty = 0.0000 (Not Clear) <succ>
       bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1045

A DNA sequence (GBSx1117) was identified in *S. agalactiae* <SEQ ID 3231> which encodes the amino acid sequence <SEQ ID 3232>. Analysis of this protein sequence reveals the following:

---

Possible site: 60
>>> Seems to have no N-terminal signal sequence
INTEGRAL    Likelihood = −9.45    Transmembrane 48-64 (45-69)
INTEGRAL    Likelihood = −1.49    Transmembrane 71-87 (71-87)
----- Final Results -----
   bacterial membrane --- Certainty = 0.4779 (Affirmative) <succ>
     bacterial outside --- Certainty = 0.0000 (Not Clear) <succ>
       bacterial cytoplasm --- Certainty = 0.0000 (Not Clear) <succ>

---

A related GBS nucleic acid sequence <SEQ ID 9441> which encodes amino acid sequence <SEQ ID 9442> was also identified.

The protein has homology with the following sequences in the GENPEPT database.

```
>GP: AAA25222 GB: M87483 ORF 1 [Lactococcus lactis]
Identities = 50/88 (56%), Positives = 66/88 (74%), Gaps = 1/88 (1%)
Query:   2  TGKIFSMSKEELSYLPVIKLFKNQGVYNGLIGLFLLYGLYISQNQ-EIVAVFL/NVLLVA  60
            T ++F+M KEEL    V  LFKNQG+YNGLIGL L+Y ++ S  Q  EIV + LI ++LVA
Sbjct:  32  TSRVFNMGKEELERSSVQTLFKNQGIYNGLIGLGLIYAIFFSSAQLEIVRLLLIYIILVA  91
```

-continued
```
Query:  61 IYGALTVDKKILLKQGGLPILALLTFLF                           88
           +YG+LT +KKI+L QGGL ILAL++   F
Sbjct:  92 LYGSLTSNKKIILTQGGLAILALISSFF                           119
```

No corresponding DNA sequence was identified in *S. pyogenes*.

A related GBS gene <SEQ ID 8719> and protein <SEQ ID 8720> were also identified. Analysis of this protein sequence reveals the following:

---

Lipop: Possible site: −1   Crend: 8
McG: Discrim Score: 4.19
GvH: Signal Score (−7.5): −3.99
Possible site: 38
>>> Seems to have an uncleavable N-term signal seq
ALOM program  count: 3  value: −9.45  threshold: 0.0
INTEGRAL    Likelihood = −9.45   Transmembrane 87-103 (84-108)
INTEGRAL    Likelihood = −1.49   Transmembrane 110-126 (110-126)
INTEGRAL    Likelihood = −0.37   Transmembrane 13-29 (13-29)
PERIPHERAL  Likelihood = 0.47    65
modified ALOM score: 2.39
*** Reasoning Step: 3
----- Final Results -----
   bacterial membrane --- Certainty = 0.4779 (Affirmative) <succ>
      bacterial outside --- Certainty = 0.0000 (Not Clear) <succ>
         bacterial cytoplasm --- Certainty = 0.0000 (Not Clear) <succ>

---

The protein has homology with the following sequences in the databases:

Based on this analysis, it was predicted that these proteins and their epitopes could be useful antigens for vaccines or diagnostics.

Example 1046

A DNA sequence (GBSx1118) was identified in *S. agalactiae* <SEQ ID 3233> which encodes the amino acid sequence <SEQ ID 3234>. Analysis of this protein sequence reveals the following:

---

Possible site: 41
>>> Seems to have no N-terminal signal sequence
----- Final Results -----
   bacterial cytoplasm --- Certainty = 0.3140 (Affirmative) <succ>
      bacterial membrane --- Certainty = 0.0000 (Not Clear) <succ>
         bacterial outside --- Certainty = 0.0000 (Not Clear) <succ>

---

A related GBS nucleic acid sequence <SEQ ID 10285> which encodes amino acid sequence <SEQ ID 10286> was also identified.

The protein has homology with the following sequences in the GENPEPT database.

---

```
ORF00610(328-681 of 981)
SP|Q02009|YTRP_LACLA(1-119 of 119) HYPOTHETICAL 13.3 KDA PROTEIN IN TRPE 5'REGION.
GP|551879|gb|AAA25222.1||M87483 ORF 1 {Lactococcus lactis} PIR|S35123|S35123 hypothetical
protein (trpE 5' region) - Lactococcus lactis subsp. lactis
% Match = 19.9
% Identity = 58.8 % Similarity = 77.3
Matches = 70 Mismatches = 26 Conservative Sub.s = 22

114       144       174       204       234       264       294       324
SPKFFQTIQPFLPMTYSVSGLRETISLTGDVNHQWRMLVIFLVSSMILALLIYRKQED**KVSSDRLTV*YGMSKYLGGE 354       384       414       444       474       504       534       561
DMSTLTIIIATLTALEHFYIMYLETLATQSNMTGKIFSMSKEELSYLPVIKLFKNQGVYNGLIGLFLLYGLYISQNQ-EI
 |  ||||::  |  |||  |||||||||||:||   |   ::|:|  ||||    |    ||||||:|||||  :|   ::   |   ||
MTILTIILSLLVALEFFYIMYLETFATSSKTTSRVFNMGKEELERSSVQTLFKNQGIYNGLIGLGLIYAIFFSSAQLEI
         10        20        30        40        50        60        70

591       621       651       681       711       741       771       801
VAVFLINVLLVAIYGALTVDKKILLKQGGLPILALLTFLF*YYLAVRFS*TAFSNHFFLIIQVV*VICL*K*YNITTNSK
|  ::||  ::|||:||:||   :|||:|  |||| ||||::   :|
VRLLLIYIILVALYGSLTSNKKIILTQGGLAILALISSFF
         90        100       110
```

```
>GP: CAB12447 GB: Z99107 similar to arylesterase [Bacillus subtilis]
Identities = 37/91 (40%), Positives = 56/91 (60%)
Query:  13 KDGSDIYYRVVGQGQPIVFLHGNSLSSRYFDKQIAYFSKYYQVIVMDSRGHGKSHAKLNT          72
           +D + +YY   G G PI+F+HG  +S ++F KQ +  S  YQ I +D RGHG+S    L+

Sbjct:   7 EDQTRLYYETHGSGTPILFIHGVLMSGQFFHKQFSVLSANYQCIRLDLRGHGESDKVLHG          66

Query:  73 ISFRQIAVDLKDILVHLEIDKVILVGHSDGA                                     103
            +  Q A D+++ L  +E+D V+L G S GA Sbjct:  67 HTISQYARDIREFLNAMELDHVVLAGWSMGA                                      97
```

No corresponding DNA sequence was identified in *S. pyogenes*.

Based on this analysis, it was predicted that these proteins and their epitopes could be useful antigens for vaccines or diagnostics.

Example 1047

A DNA sequence (GBSx1119) was identified in *S. agalactiae* <SEQ ID 3235> which encodes the amino acid sequence <SEQ ID 3236>. This protein is predicted to be an integral membrane protein. Analysis of this protein sequence reveals the following:

Possible site: 58
>>> Seems to have an uncleavable N-term signal seq
INTEGRAL    Likelihood = −12.90   Transmembrane 14-30 (9-41)
INTEGRAL    Likelihood = −9.71    Transmembrane 451-467 (447-472)
INTEGRAL    Likelihood = −9.18    Transmembrane 234-250 (229-257)

-continued

INTEGRAL    Likelihood = −8.07    Transmembrane 56-72 (46-77)
INTEGRAL    Likelihood = −8.01    Transmembrane 490-506 (484-512)
INTEGRAL    Likelihood = −5.84    Transmembrane 414-430 (412-436)
INTEGRAL    Likelihood = −4.99    Transmembrane 136-152 (135-159)
INTEGRAL    Likelihood = −4.14    Transmembrane 213-229 (211-232)
INTEGRAL    Likelihood = −4.14    Transmembrane 365-381 (364-382)
INTEGRAL    Likelihood = −2.66    Transmembrane 393-409 (391-412)
INTEGRAL    Likelihood = −1.06    Transmembrane 168-184 (167-184)
INTEGRAL    Likelihood = −0.64    Transmembrane 275-291 (275-291)
INTEGRAL    Likelihood = −0.32    Transmembrane 328-344 (328-345)
INTEGRAL    Likelihood = −0.27    Transmembrane 821-837 (821-837)
----- Final Results -----
  bacterial membrane --- Certainty = 0.6158 (Affirmative) <succ>
  bacterial outside --- Certainty = 0.0000 (Not Clear) <succ>
  bacterial cytoplasm --- Certainty = 0.0000 (Not Clear) <succ>

A related GBS nucleic acid sequence <SEQ ID 10283> which encodes amino acid sequence <SEQ ID 10284> was also identified.

The protein has homology with the following sequences in the GENPEPT database.

```
>GP: BAA24464 GB: D85082 YfiX [Bacillus subtilis]
Identities = 190/596 (31%), Positives = 324/596 (53%), Gaps = 31/596 (5%)
Query: 246 IVSLIPGGLGSFELVLFTGFAAEGLPKETVVAWLLLYRLAYYIIPFFAGIYFFIHYLGSQ         305
           ++SL+PGG GSF+L+     G    G  +E +V  ++LYRLAY  IPF  G++F     L Sbjct:   1 MISLVPGGFGSFDLLFLLGMEQLGYHQEAIVTSIVLYRLAYSFIPFILGLFFAAGDLTEN          60

Query: 306 INQRYENVPK-----ELVSTVLQTMVSHLMRILG---AFLIFSTAFFENITYIMWLQKLG      357
           +R E  P+     E  +L    + L+RIL    + ++F        +  + + +L Sbjct:  61 TMKRLETNPRIAPAIETTNVLLVVQRAVLVRILQGSLSLIVFVAGLIVLASVSLPIDRLT       120

Query: 358 LDP-LQEQMLWQFPGLLLGVCFILLARTID--QKVKNAFPIAIIWITLTLFYLNLGHISW      414
             + P +   L   F GL L     ILL  I+ ++ K ++ +AI +    +  L ++

Sbjct: 121 VIPHIPRPALLLFNGLSLSSALILLILPIELYKRTKRSYTMAITALVGGFVFSFLKGLNI       180

Query: 415 RLSFWFILLLLGLLVIKPTLYKKQFIYSWEERIKDGIIIVSLMGVLFY----IAGLLFPI      470
              F ++++ L+++K    ++Q Y+ + I      V+L V +       IAG ++

Sbjct: 181 SAIFVLPMIIVLLVLLKKQFVREQASYTLGQLI----FAVALFTVALFNYNLIAGFIWDR      236

Query: 471 RAHITGGSIERLHYIIAWEPIALATL----ILTLVYLCLVKILQGKSCQIGDVFNVDRYK      526
            +    +    +++  +  I   AT+    I+ L +L  +  ++ IG+   +R Sbjct: 237 MKKV----LRHEYFVHSTSHITHATIMAIIIVPLFFLIFTVVYHKRTKPIGEKADPERLA      292

Query: 527 KLLQAYGGSSDSGLAFLNDKRLYWYQKNGEDCVAFQFVIVNNKCLIMGEPAGDDTYIREA      586
            L    GG++  S L FL DKR Y +    +G  + F  +    + +++G+P+G Sbjct: 293 AFLNEKGGNALSHLGFLGDKRFY-FSSDGNALLLFGKIA--RRLVVLGDPSGQRESFPLV      349

Query: 587 IESFIDDADKLDYDLVFYSIGQKLTLLLHEYGFDPMKVGEDALVNLETFTLKGNKYKPFR      646
           +E F+++A +  +  ++FY I ++    L H++G+++F K+GE+A V+L TFTL G K     R Sbjct: 350 LEEFLNEAHQKGFSVLFYQIEREDMALYHDFGYNFFKLGEEAYVDLNTFTLTGKKKAGLR      409

Query: 647 NALNREVKDGFYFEVVQSPHSQELLNSLEEISNTWLEGRPEKGFSLGYFNKDYFQQAPIA     706
           N  NR E++   F V    P S     L  ++IS+ WL  +  EKGFSLG+F+    Y Q+APIA
```

```
-continued
Sbjct:  410 AINNRFEREEYTFHVDHPPFSDAFLEELKQISDEWLGSKKEKGFSLGFFDPSYLQKAPIA   469

Query:  707 LVKNAEHEVVAFANIMPNYEKSIISIDLMRHDKQKIPNGVMDFLFLSLFSYYQEKGYHYF   766
            +KNAE E+VAFAN+MP Y++  IS+DLMR+ +   PNG+MD LF+ +F + +E+G    F
Sbjct:  470 YMKNAEGEIVAFANVMPMYQEGEISVDLMRY-RGDAPNGIMDALFIRMFLWAKEEGCTSF   528

Query:  767 DLGMAPLSGVGRVETSFAKERMAYLVYHFGSHFYSFNGLEKYKKKFTPLWSERYIS   822
            ++GMAPL+ VG   TSF  ER A ++++   + YSF+GL  +K+K+ P W   +Y++
Sbjct:  529 NMGMAPLANVGTAFTSFWSERFAAVIFNNVRYMYSFSGLRAFKEKYKPEWRGKYLA   584
```

No corresponding DNA sequence was identified in *S. pyogenes*.

A related GBS gene <SEQ ID 8721> and protein <SEQ ID 8722> were also identified. Analysis of this protein sequence reveals the following:

Lipop: Possible site: −1   Crend: 9
McG: Discrim Score: 9.22
GvH: Signal Score (−7.5): −7.66
Possible site: 58
>>> Seems to have an uncleavable N-term signal seq
ALOM program count: 14  value: −12.90  threshold: 0.0
INTEGRAL     Likelihood = −12.90   Transmembrane 14-30 (9-41)
INTEGRAL     Likelihood = −9.71    Transmembrane 451-467 (447-472)
INTEGRAL     Likelihood = −9.18    Transmembrane 234-250 (229-257)
INTEGRAL     Likelihood = −8.07    Transmembrane 56-72 (46-77)
INTEGRAL     Likelihood = −8.01    Transmembrane 490-506 (484-512)
INTEGRAL     Likelihood = −5.84    Transmembrane 414-430 (412-436)
INTEGRAL     Likelihood = −4.99    Transmembrane 136-152 (135-159)
INTEGRAL     Likelihood = −4.14    Transmembrane 213-229 (211-232)
INTEGRAL     Likelihood = −4.14    Transmembrane 365-381 (364-382)
INTEGRAL     Likelihood = −2.66    Transmembrane 393-409 (391-412)
INTEGRAL     Likelihood = −1.06    Transmembrane 168-184 (167-184)
INTEGRAL     Likelihood = −0.64    Transmembrane 275-291 (275-291)
INTEGRAL     Likelihood = −0.32    Transmembrane 328-344 (328-345)
INTEGRAL     Likelihood = −0.27    Transmembrane 821-837 (821-837)
PERIPHERAL   Likelihood = 1.06     558
modified ALOM score: 3.08
*** Reasoning Step: 3
----- Final Results -----
    bacterial membrane --- Certainty = 0.6158 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
ORF00608(967-2787 of 3141)
OMNI|NT01BS0989(20-633 of 652) putative integral membrane protein, putative
% Match = 14.6
% Identity = 33.0  % Similarity = 58.0
Matches = 201 Mismatches = 244 Conservative Sub.s = 153

825       855       885       915       945       975      1005      1035
YYLVLIGASMYFPVIYWISGHKGSHYFGDMPSSTRIKLGVVSFFEWGCAAAAFIIIGYLMGIHLPVYKILPLFCIGCAVG
                                                      :  ||||   :  :: :|  |      |
                                        LELQLLNGSWPGPVIYFALFAMGIHADIRYVFGVFVIAAIGG
                                                10        20        30        40

1065      1095      1125      1155      1185      1215      1245      1260
IVSLIPGGLGSFELVLFTGFAAEGLPKETVVAWLLLYRLAYYIIPFFAGIYFFIHYLGSQINQRYENVPK-----ELVST
::||:|||:|||:|::  |        |   :| :|  ::||||||  |||  |::|        :| ||  |    |  :
MISLVPGGFGSFDLLFLLGMEQLGYHQEAIVTSIVLYRLAYSFIPFILGLFFAAGDLTENTMKRLETNPRIAPAIETTNV
              60        70        80        90       100       110       120

1290      1311      1341      1371      1398      1428      1458      1482
VLQTMVSHLMRIL-GAF--LIFSTAFFENITYIMWLQKLGLDP-LQEQMLWQFPGLLLGVCFILLARTID--QKVKNAFP
 :|     :  |:|||  |::  ::|    :    :  :  :|:  |  :    |   |  :||  |:  ::  |  ::
LLVVQRAVLVRILQGSLSLIVFVAGLIVLASVSLPIDRLTVIPHIPRPALLLFNGLSLSSALILLILPIELYKRTKRSYT
             140       150       160       170       180       190       200

1512      1542      1572      1602      1632      1659      1689      1719
IAIIWITLTLFYLNLGHISWRLSFWFILLLLGLLVIKPTLYKKQFIYSWEE-RIKDGIIIVSLMGVLFYIAGLLFPIRAH
:||   :   :    |   ::    :|   |:| :: :|::   |||:      |    |:|      |   ::      |:
MAITALVGGFVFSFLKGLN--ISAIFVLPMIIVLLV---LLKKQFVREQASYTLGQLIFAVALFTVALFNYNLIAGFIWD
             220          230          240       250       260       270

1749      1779      1797      1827      1857      1887      1917      1947
ITGGSIERLHYIIAWEPIALAT----LILTLVYLCLVKILQGKSCQIGDVFNVDRYKKLLQAYGGSSDSGLAFLNDKRLY
   :::: :   |     ||              |:|  |    | | :    :|  |  || ::  |    |  |||:|
RMKKVLRHEYFVHSTSHITHATIMAIIIVPLFFLIFTVVYHKRTKPIGEKADPERLAAFLNEKGGNALSHLGFLGDKRFY
             290       300       310       320       330       340       350

1977      2007      2037      2067      2097      2127      2157      2187
WYQKNGEDCVAFQFVIVNNKCLIMGEPAGDDTYIREAIESFIDDADKLDVFYSIGQKLTLLLHEYGFDFMKVGEDAL
  :  |    :   |      :  :::|:|:|       :|  |:::| : :   :: ||  |::: |:||:|  |:|:
-FSSDGNALLLF--GKIARRLVVLGDPSGQRESFPLVLEEFLNEAHQKGFSVLFYQIEREDMALYHDFGYNFFKLGEEAY
             370          380       390       400       410       420       430
```

```
2217      2247       2277      2307      2337      2367      2397      2427
VNLETFTLKGNKYKPFRNALNRVEKDGFYFEVVQSPHSQELLNSLEEISNTWLEGRPEKGFSLGYFNKDYFQQAPIALVK
|:|  ||||  |   |    ||  |::  :  |  |  : |  |    |::||:  ||   : |||||||:|:  |:|:|||| :|
VDLNTFTLTGKKKAGLRAINNRFEREEYTFHVDHPPFSDAFLEELKQISDEWLGSKKEKGFSLGFFDPSYLQKAPIAYMK
            450       460       470       480       490       500       510

2457      2487       2517      2547      2577      2607      2637      2667
NAEHEVVAFANIMPNYEKSIISIDLMRHDKQKIPNGVMDFLFLSLFSYYQEKGYHYFDLGMAPLSGVGRVETSFAKERMA
|||  |:|||||:||   |::  ||||||: :    |||:||  |  : :|:    ||::|||||::  ||     ||
NAEGEIVAFANVMPMYQEGEISVDLMRY-RGDAPNGIMDALFIRMFLWAKEEGCTSFNMGMAPLANVGTAFTSFWSERFA
            530       540       550       560       570       580       590

2697      2727       2757      2787      2817      2847      2877      2907
YLVYHFGSHFYSFNGLHKYKKKFTPLWSERYISCSRSSWLICAICALLMEDSKIKIVK*ALFGN*KEHVMRHALFKSFNT
::::    :   |||:||   :|:|:  |  |    :|::   ::     |
                   AVIFNNVRYMYSFSGLRAFKEKYKPEWRGKYLAYRKNRSLSVTMFLVTRLIGKSKKDSV
                              610       620       630       640       650
```

Based on this analysis, it was predicted that these proteins and their epitopes could be useful antigens for vaccines or diagnostics.

Example 1048

A DNA sequence (GBSx1120) was identified in *S. agalactiae* <SEQ ID 3237> which encodes the amino acid sequence <SEQ ID 3238>. This protein is predicted to be choline transporter. Analysis of this protein sequence reveals the following:

Possible site: 37
>>> Seems to have no N-terminal signal sequence

| | | |
|---|---|---|
| INTEGRAL | Likelihood = −10.24 | Transmembrane 28-44 (22-47) |
| INTEGRAL | Likelihood = −8.81 | Transmembrane 178-194 (176-204) |
| INTEGRAL | Likelihood = −7.22 | Transmembrane 81-97 (63-105) |
| INTEGRAL | Likelihood = −3.50 | Transmembrane 209-225 (206-226) |
| INTEGRAL | Likelihood = −3.13 | Transmembrane 64-80 (63-80) |
| INTEGRAL | Likelihood = −2.44 | Transmembrane 156-172 (153-172) |
| INTEGRAL | Likelihood = −0.64 | Transmembrane 137-153 (137-153) |

----- Final Results -----
  bacterial membrane --- Certainty = 0.5097 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

```
>GP: AAD45530 GB: AF162656 choline transporter [Streptococcus pneumoniae]
Identities = 326/505 (64%), Positives = 409/505 (80%), Gaps = 1/505 (0%)
Query:   1 MTTLITTFQERFGDWTQSLIEHLQLSLLTLILATLIAIPLGIIISHYKKISHVVLQITGI          60
           MT LI TFQ+RF DW  +L +HLQLSLLTL+LA  L+AIPL + + +++K++   VLQI GI
Sbjct:   1 MTNLIATFQDRESDWLTALSQHLQLSLLTLLLAILLAIPLAVFLRYHEKLADWVLQIAGI          60

Query:  61 FQTIPSLALLGLFIPFMGIGTVPAVVALIIYALFPILQNTVTVLMQIDANLIEAATAFGM         120
           FQTIPSLALLGLFIP MGIGT+PA+ AL+IYA+FPILQNT+T L   ID NL EA  AFGM
Sbjct:  61 FQTIPSLALLGLFIPLMGIGTLPALTALVIYAIFPILQNTITGLKGIDPNLQEAGIAFGM         120

Query: 121 TRWERLKKFELALSMPVIISGIRTASVMIIGTATLASLIGAGGLGSFILLGIDRNNPSLI         180
           TRWERLKKFE+ L+MPVI+SGIRTA+V+IIGTATLA+LIGAGGLGSFILLGIDRNN SLI
Sbjct: 121 TRWERLKKFEIPLAMPVIMSGIRTAAVLIIGTATLAALIGAGGLGSFILLGIDRNNASLI         180

Query: 181 LIGAISSAVLAIIFSGLIGLLEKARLRTIAVSGILLLAGLGLSYAPKWMPGTNTATITVA         240
           LIGA+SSAVLAI F+ L+ ++EKA+LRTI      L+   LGLSY+P +        + +A
Sbjct: 181 LIGALSSAVLAIAFNELLKVMEKAKLRTIFSGFALVALLLGLSYSPALLVQKEKENLVIA         240

Query: 241 GKLGTEPDILINMYKELIEDQTDIKVKLKPNFGKTTFLYQALKSGDIDLYPEFTGTITSS         300
           GK+G EP+IL NMYK LIE+ T +    +KPNFGKT+FLY+ALK GDID+YPEFTGT+T S
Sbjct: 241 GKIGPEPEILANMYKLLIEENTSMTATVKPNFGKTSFLYEALKKGDIDIYPEFTGTVTES         300

Query: 301 LLKNPPKVSNNPKQVYNLAKNGILKQDKLSLLSPMAYQNTYAVAVKKDYAEANQLKNISD         360
           LL+    PKVS+ P+QVY +A++GI KQD L  L PM+YQNTYAVAV K   A+     LK ISD
Sbjct: 301 LLQPSPKVSHEPEQVYQVARDGIAKQDHLAYLKPMSYQNTYAVAVPKKIAQEYGLKTISD         360

Query: 361 LKKLD-KLKAGFTLEFKDREDGSIGLQKHYGLNLDISTLEPALRYQAINSKDVNIIDAYS         419
           LKK++  +LKAGFTLEF DREDG+ GLQ   YGLNL+++T+EPALRYQAI S D+ I DAYS
Sbjct: 361 LKKVEGQLKAGFTLEFNDREDGNKGLQSMYGLNLNVATIEPALRYQAIQSGDIQITDAYS         420
```

```
-continued
Query:  420 TDSELIQYQLQILKDDKHLFPPYQGAPLLRQDTIKKYPQVKKALNKLAGHITEKEMQEMN         479
            TD+EL +Y LQ+L+DDK LFPPYQGAPL+++  +KK+P++++ LN LAG ITE +M ++N Sbjct:  421 TDAELERYDLQVLEDDKQLFPPYQGAPLMKEALLKKHPELERVLNTLAGKITESQMSQLN         480

Query:  480 YQVAVKHKSAATVAKQYLKAHHIIK                                           504
            YQV V+ KSA  VAK++L+    ++K Sbjct:  481 YQVGVEGKSAKQVAKEFLQEQGLLK                                           505
```

There is also homology to SEQ ID 636.

Based on this analysis, it was predicted that this protein and its epitopes, could be useful antigens for vaccines or diagnostics.

Example 1049

A DNA sequence (GBSx1121) was identified in *S. agalactiae* <SEQ ID 3239> which encodes the amino acid sequence <SEQ ID 3240>. This protein is predicted to be choline transporter (opuBA). Analysis of this protein sequence reveals the following:

Possible site: 59
>>> Seems to have no N-terminal signal sequence
----- Final Results -----
   bacterial cytoplasm --- Certainty = 0.2345 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

There is also homology to SEQ ID 644.

Based on this analysis, it was predicted that this protein and its epitopes, could be useful antigens for vaccines or diagnostics.

Example 1050

A DNA sequence (GBSx1122) was identified in *S. agalactiae* <SEQ ID 3241> which encodes the amino acid sequence <SEQ ID 3242>. This protein is predicted to be two-component response regulator. Analysis of this protein sequence reveals the following:

Possible site: 61
>>> Seems to have no N-terminal signal sequence
INTEGRAL     Likelihood = −5.52    Transmembrane 49-65 (46-66)
----- Final Results -----
   bacterial membrane --- Certainty = 0.3208 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database.

```
>GP: AAD45529 GB: AF162655 choline transporter [Streptococcus pneumoniae]
Identities = 139/236 (58%), Positives = 178/236 (74%)
Query:    1 MISFENVSKSYGDHTIIDNISCHIQRGEFFVLVGASGSGKTTILKMINRLIEPSQGAITL          60
            MI ++NV+  Y +  ++ +++   I+ GEF VLVG SGSGKTT+LKMINRL+EP+ G I +

Sbjct:    1 MIEYKNVALRYTEKDVLRDVNLQIEDGEFMVLVGPSGSGKTTMLKMINRLLEPTDGNIYM          60

Query:   61 DGENITSLDLRQLRLETGYVLQQIALFPNLTVGENIELIPEMKGWSKGDQKKAASDLLDK        120
            DG+ I   D R+LRL TGYVLQ IALFPNLTV ENI LIPEMKGWSK +  K +  LL K Sbjct:   61 DGKRIKDYDERELRLSTGYVLQAIALFPNLTVAENIALIPEMKGWSKEEITKKTEELLAK        120

Query:  121 VGLPAKDYFNRYPHELSGGEQQRIGILRAIVAKPKVLLMDEPFSALDPISRRQLQDITKQ        180
            VGLP  +Y +R P ELSGGEQQR+GI+RA++  +PK+ LMDEPFSALD ISR+QLQ +TK+

Sbjct:  121 VGLPVAEYGHRLPSELSGGEQQRVGIVRAMIGQPKIFLMDEPFSALDAISRKQLQVLTKE        180

Query:  181 LQSELGITLVFVTHDMKEAMRLADRICVIKEGKIVQLDRPEIIQNNPSDQFVRTLF           236
            L   E G+T +FVTHD  EA++LADRI V+++G+I Q+  PE I   P+  FV  LF Sbjct:  181 LHKEFGMTTIFVTHDTDEALKLADRIAVLQDGEIRQVANPETILKAPATDFVADLF           236
```

```
>GP: BAB06434 GB: AP001516 two-component response regulator
[Bacillus halodurans]
Identities = 101/305 (33%), Positives = 152/305 (49%), Gaps = 31/305 (10%)
Query:   1 MKFYIDDDPTITMILQDIIE-EDFNNTVVRVNNVSSKAYNELLIADVDIVLIDLLMPIL          59
           M F+I DDD T+  IL  IIE E    V    + S      L I  VDI+LIDLLMP Sbjct:   1 MNFFITDDDVTVRSILAQIIEDEQLGQVVGEAEDGSELDGKRLNIKQVDILLIDLLMPNC         60

Query:  60 DGVTLVQKIYKQRSDLKFIMISQVKDNDLRQEAYKAGIEFFINKPINIIEVKSVVKRVTD         119
           DG+  +QKI K      K IMISQ++  +L  EAY  GIE +I KPIN IEV SV+++V +

Sbjct:  61 DGLEAIQKI-KPEFKGKIIMISQIESKELISEAYLLGIEHYIMKPINKIEVLSVIRKVIN         119

Query: 120 TIEMQKKLNTIQNLLENTPSYQKPITTSNLT----KIRS----ILSYLGITSETAYTDIL         171
           +++ L  IQ L N     P    ++       I+S    +LS LGI  E+     D++

Sbjct: 120 HTRLEQSLYDIQKSLSNVLQGSIPTQVNDQVFHDDSIKSYGQYLLSELGIAGESGSKDLM         179

Query: 172 NICELLLKQELNF-------AQFDFQKELSIDE----------HQQKIILQRIRRAVKK         213
           NI    L  E +        A D  ++L+ ++              + K    QR+RRAV +

Sbjct: 180 NILMFLYTYEKEYSFEKGFPALKDIFEQLASEKLGDAADERDVRREVKAAKQRVRRAVYQ         239

Query: 214 AMINMAHLYIDDFENELTLQYANALFGFQNIHNEAQLIQGK---SMYGGKISLKHFFDEL         270
           ++ ++A L + DF N    +YA+  F F + ++    ++ +    S    +I++K F   L Sbjct: 240 SLEHVASLGLIDESNPKFEEYASHFFDFSVVRSKMTELKNETSSSYTSARINVKKFTQAL         299

Query: 271 ILQSK                                                             275
           ++K Sbjct: 300 YYEAK                                                             304
```

There is homology to SEQ ID 460.

A related GBS gene <SEQ ID 8723> and protein <SEQ ID 8724> were also identified. Analysis of this protein sequence reveals the following:

Lipop: Possible site: −1   Crend: 8
McG: Discrim Score: −7.05
GvH: Signal Score (−7.5): −6.58
Possible site: 61
>>> Seems to have no N-terminal signal sequence
ALOM program   count: 1   value: −5.52   threshold: 0.0

-continued

INTEGRAL       Likelihood = −5.52   Transmembrane 49-65 (46-66)
PERIPHERAL     Likelihood = 7.37    155
modified ALOM score: 1.60
*** Reasoning Step: 3
----- Final Results -----
  bacterial membrane --- Certainty = 0.3208 (Affirmative) <succ>
     bacterial outside --- Certainty = 0.0000 (Not Clear) <succ>
        bacterial cytoplasm --- Certainty = 0.0000 (Not Clear) <succ>

The protein has homology with the following sequences in the databases:

```
ORF00604(307-1125 of 1431)
EGAD|137180|146289(3-304 of 310) hypothetical protein {Bacillus cereus}
GP|1769946|emb|CAA67094.1||X98455 orf1 {Bacillus cereus}
% Match = 12.7
% Identity = 34.1 % Similarity = 53.0
Matches = 95 Mismatches = 123 Conservative Sub.s = 53

168       198       228       258       288       318       348     375
          *C*W*YLSRNRAIPRAYFNGRAISRNDNCLS*SAKWNNIYTVIP*KSI*VRR*YVKFYIIDDDPTITMILQDIIEE-DFN
                                                             :||:|||      :|   |||:  |:
                                                             MFYYIVDDDEVFRSMLSQIIEDGDLG
                                                                  10        20

405       435       465       495       525       555       585     615
          NTVVRVNNVSSKAYNELLIADVDIVLIDLLMPILDGVTLVQKIYKQRSDLKFIMISQVKDNDLRQEAYKAGIEFFINKPI
          :    : :     :|    ||::||||||||:  ||   |: |          |  ||||||:     |||   |:|::| ||:
          EVIGESEDGAFVEAEQLNYKKVDILFIDLLMPMRDGIETVRHI-ASSFTGKIIMISQVESKQLIGEAYTLGVEYYITKPL
               40        50        60        70        80        90        100

645       675       705       753       771       801       831
          NIIEVKSVVKRVTDTIEMQKKLNTIQNLLENTPSYQKP----ITTSNLTKI----RSILSYLGITSETAYTDILNICELL
          | ||| |||::| :  | ::: :  ||   |   ::||    |      ||    |    |:| |||   |:|:: ||
          NKIEVVSVVRKVIERIRLERSIYDIQKSLNNVFQWEKPQMRSETVQEEKKISDSGRFLLAELGIAGENGSKDLLSMLEYL
               120       130       140       150       160       170       180
```

-continued

```
861                     894      924      954      984     1014
LKQELNFAQFDFQKELSID-----------------EHQQKIILQRIRRAVKKAMINMAHLYIDDFENELTLQYANAL
 ||    :|      |               |  ::|    ||:|||:  :::  ::|  | : ||  |   || :
YGQE-KAQTFEFGFPALKDIFHQITLKKLGEIASDADIEKEKKASEQRVRRAIYQSLNHLASLGLTDFSNPKFESYAPKF
          200       210       220       230       240       250       260

1071      1095     1125     1155     1185     1215     1245
FGFQNIHNE-AQLIQGKSMYGGKISL--KHFFDELILQSKTF*DLFKHGLIYYNHPKTFLFINLQQTPCLPQCVCFCF*F
 | |  :    :: :           ||   ||   :  ||   | :::|
FDFTVVRKRMTEMTKDGVATSGHIRINTKKFIWQVLFEAKRLMEIE
         280       290       300       310
```

SEQ ID 8724 (GBS356) was expressed in *E. coli* as a His-fusion product. SDS-PAGE analysis of total cell extract is shown in FIG. 73 (lane 3; MW 34 kDa). It was also expressed in *E. coli* as a GST-fusion product. SDS-PAGE analysis of total cell extract is shown in FIG. 81 (lane 8; MW 59 kDa).

GBS356-GST was purified as shown in FIG. 216, lane 7.

Based on this analysis, it was predicted that these proteins and their epitopes could be useful antigens for vaccines or diagnostics.

Example 1051

A DNA sequence (GBSx1123) was identified in *S. agalactiae* <SEQ ID 3243> which encodes the amino acid sequence <SEQ ID 3244>. Analysis of this protein sequence reveals the following:

Possible site: 26
>>> Seems to have a cleavable N-term signal seq.
INTEGRAL    Likelihood = -6.48    Transmembrane 149-165 (147-172)
INTEGRAL    Likelihood = -5.20    Transmembrane 37-53 (29-55)
INTEGRAL    Likelihood = -2.50    Transmembrane 126-142 (126-142)
INTEGRAL    Likelihood = -2.13    Transmembrane 62-78 (60-78)
INTEGRAL    Likelihood = -0.64    Transmembrane 314-330 (314-330)
INTEGRAL    Likelihood = -0.11    Transmembrane 89-105 (89-105)
----- Final Results -----
   bacterial membrane --- Certainty = 0.3590 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database.

```
>GP: BAB06435 GB: AP001516 two-component sensor histidine kinase
[Bacillus halodurans]
Identities = 118/427 (27%), Positives = 199/427 (45%), Gaps = 25/427 (5%)
Query:  10 LERRQRIIISAIAIA-LAAQINISILADGFIMTLSLFILPVFLYFNDDINPILLCLGITF    68
              L +     II+S +  A +A +IN    + +  F ++L    I  +FL F +   I+
Sbjct:   7 LSKDYMIILSMLLFAPIAGEINFYPVNETFRVSLGPPIFFLFLLFLRNTAAIVPGFFTAI    66

Query:  69 ASPIFRGIILSIAGEAEIHQIIEFVLTDMAFYICYGITFYTIYWHRSYRNKGTFFFSIII   128
              A  +FR  +  ++    +      E      FY    Y + F   R +      F  II
Sbjct:  67 ANVVFRVFLDTLHADFYWVDSFEIHYPTFFFYFTYSLLFSLAKVQRFHEQPLIIFLFGII   126

Query: 129 CDYFANLVEISFLIKFNNYTITIFA-TLFAIALLRAFISCAVAYTYSYLSLLLQKD---D   184
              +  A+  E F+ ++  + +     ++F I L+      S V   +S + L    +       +
Sbjct: 127 IEILADTAE--FIAQYFAFGVMVTKDSIFQILLIAFSHSFIVLGVFSMMKLYETRSRELE   184

Query: 185 HERRYYYFMWSTSAVKSEVYFMQKNIIEIENIMKNAYLLDKELSKY---HLPKEYQHLS-   240
              +R   + +    S +  E      ++K +      E+I        + L  +E+ +      H+ +    HL
Sbjct: 185 IRKRNEHMLLLISNLYEESVHLKKTLQNSEDITSKVFGLYREMKRLQSEHMDQVNPHLEK   244

Query: 241 -----LDISRDVHEVEKDYQNIIKGLGTYFSVKNESTMALKDIFQIVLSYTRS---IIQF   292
                   L+IS +VHE+KKD Q I  GL     S   NES +    +I QI+     R+         Q
Sbjct: 245 ISKRLLEISGEVHEIKKDNQRIFAGLSKLIS--NESYVDYIEIGQIIKMIVRTNEKYAQL   302

Query: 293 RHQDIIILENNKCNLIISNYYYLLTIISNIVLNAVEAIDKQKKGTISVHTEELEDFIKIE   352
              ++I      + +         + Y  L+II+N+V NAVEAID     KG +++   + L     ++
Sbjct: 303 LGKEIDFHYSIQGEHPPYHIYTHLSIINNLVANAVEAIDG--KGMLTIRVKALGQTVEFR   360

Query: 353 ISDNGPGIPDKMKHMIFKPGFSTKFDANGDIYRGIGLSHVRILMEEQYQGTITVCPNQ-P   411
              I D+GPGIPDK + +IFKPGF++KFD   G       GIGL++V   M ++   GT+     Q
Sbjct: 361 IEDDGPGIPDKHRALIFKPGFTSKFDHTGKPSTGIGLTYVHD-MVDKLGGTVVYERGQGG   419

Query: 412 NGTTFTL                                                        418
              G+  FT+
Sbjct: 420 KGSVFTI                                                        426
```

Based on this analysis, it was predicted that this protein and its epitopes, could be useful antigens for vaccines or diagnostics.

Example 1052

A DNA sequence (GBSx1124) was identified in *S. agalactiae* <SEQ ID 3245> which encodes the amino acid sequence <SEQ ID 3246>. This protein is predicted to be ornithine carbamoyltransferase Otc6850 (argF). Analysis of this protein sequence reveals the following:

---

Possible site: 61
>>> Seems to have no N-terminal signal sequence
INTEGRAL    Likelihood = −0.64    Transmembrane 171-187 (171-187)
----- Final Results -----
   bacterial membrane --- Certainty = 0.1256 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the GENPEPT database.

```
>GP: CAB75986 GB: AJ272085 ornithine carbamoyltransferase
[Staphylococcus aureus]
Identities = 264/332 (79%), Positives = 292/332 (87%)
Query:    1 MKNLRNRSFLTLLDFSTAEVEFLLKLSEDLKRAKYAGIEQQKLVGKNIALIFEKDSTRTR         60
            MKNLRNRSFLTLLDFS  EVEFLL LSEDLKRAKY G E+   L  KNIAL+FEKDSTRTR Sbjct:    1 MKNLRNRSFLTLLDFSRQEVEFLLTLSEDLKRAKYIGTEKPMLKNKNIALLFEKDSTRTR         60

Query:   61 CAFEVAAHDQGAHVTYLGPTGSQMGKKETSKDTARVLGGMYDGIEYRGFSQETVETLAEF        120
            CAFEVAAHDQGA+VTYLGPTGSQMGKKET+KDTARVLGGMYDGIEYRGFSQ TVETLAE+

Sbjct:   61 CAFEVAAHDQGANVTYLGPTGSQMGKKETTKDTARVLGGMYDGIEYRGFSQRTVETLAEY        120

Query:  121 SGVPVWNGLTDADHPTQVLADFLTAKECLHKPYKDIRFTYVGDGRNNVANALMIGASIVG        180
            SGVPVWNGLTD DHPTQVLADFLTAKE L K Y DI FTYVGDGRNNVANALM GA+I+G Sbjct:  121 SGVPVWNGLTDEDHPTQVLADFLTAKEVLKKDYADINFTYVGDGRNNVANALMQGAAIMG        180

Query:  181 MTYHLVCPKELEPDPELLSKCQEIAKTTGASIEITADIAEGVRDSDVLYTDVWVSMGEPD        240
            M +HLVCPKEL P  ELL++C+ IA    G +I IT DI +GV+ SDV+YTDVWVSMGEPD Sbjct:  181 MNFHLVCPKELNPTDELLNRCKNIAAENGGNILITDDIDQGVKGSDVIYTDVWVSMGEPD        240

Query:  241 EVWKERIALLEPYRITQEMLNMTENPNVIFEHCLPSFHNIDTKVGYDIYEKYGLKEMEVS        300
            EVWKER+ LL+PY++ +EM++ T NPNVIFEHCLPSFHN DTK+G  I+EKYG++EMEV+

Sbjct:  241 EVWKERLELLKPYQVNKEMMDKTGNPNVIFEHCLPSEHNADTKIGQQIFEKYGIREMEVT        300

Query:  301 DEVFEGPHSVVFQEAENRMHTIKAVMVATLGD                                332
            DEVFE   SVVFQ AENRMHTIKAVMVATLG+

Sbjct:  301 DEVFESKASVVFQEAENRMHTIKAVMVATLGE                                332
```

There is also homology to SEQ ID 3118.

Based on this analysis, it was predicted that this protein and its epitopes, could be useful antigens for vaccines or diagnostics.

Example 1053

A DNA sequence (GBSx1126) was identified in *S. agalactiae* <SEQ ID 3247> which encodes the amino acid sequence <SEQ ID 3248>. This protein is predicted to be carbamate kinase (b2874). Analysis of this protein sequence reveals the following:

---

Possible site: 53
>>> Seems to have no N-terminal signal sequence
INTEGRAL    Likelihood = −0.48    Transmembrane 214-230 (214-230)
----- Final Results -----
   bacterial membrane --- Certainty = 0.1192 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the GENPEPT database.

```
>GP: CAA66367 GB: X97768 carbamate kinase [Clostridium perfringens]
Identities = 162/313 (51%), Positives = 207/313 (65%), Gaps = 7/313 (2%)
Query:    3 KIVVALGGNAL-----GNSPEEQLRLVKHTAKSLVALIKKGHEIVVSHGNGPQVGAINLG         57
            KIV+ALG NAL     S E QL   + TA S+  LI+ GHE+ + HGNGPQVG I Sbjct:    2 KIVLALGENALQKDSKDKSAEGQLETCRQTAISVADLIEDGHEVSIVHGNGPQVGQILAS         61

Query:   58 MNFAAESGQGTN-FPFPECGAMSQGYIGYHLQQSLLNELRQEGINKEVATIITQIEVDES        116
            +  A + G      FPF   GA S+GYIGYHLQ ++  EL + GI K V TI TQ+ VD++

Sbjct:   62 IELAHQVDNGNPLFPFDVVGAFSEGYIGYHLQNTIREELLKRGIEKSVDTITTQVIVDKN        121
```

-continued

```
Query: 117 DQAFSAPTKPIGTFYDKETSEKIAIEKGYTFVEDAGRGYRRVVASPEPKKIIEINSIKTL    176
            D  F+ PTKPIG+FY KE +EK+   +KGYT  EDAGRGYRRVVASP+P  I+E  +IKT+

Sbjct: 122 DPGFTNPTKPIGSFYTKEEAEKLEKDKGYTMKEDAGRGYRRVVASPKPVDIVEKEAIKTM    181

Query: 177 IENDTLVIAGGGGGIPVINKGG-YEGIAAVIDKDKSSALLAGELAADQLIILTAVDYVYT    235
            +++  +VIA GGGGIPV+  G    EG+ AVIDKD ++  LA  L AD L+ILTAVD V Sbjct: 182 VDSGFIVIACGGGGIPVVEDGDRLEGVPAVIDKDFAAEKLAEILDADALLILTAVDRVCV    241

Query: 236 QFGKENQKALTEVNENQMIDYVNQGEFAKGSMLPKVIACMSFLDHNPKGTALITSLNGLE    295
               F K +QKAL E+N  ++   Y+ +G+FA GSMLPKV AC   F+     K  A+I SL    +

Sbjct: 242 NFNKPDQKALKEINLEEVDKYIEEGQFAPGSMLPKVEACKKFVLSGDKKVAIIASLTNAK    301

Query: 296 DALDGKLGTRITK                                                  308
             AL G+ GT+I K Sbjct: 302 AALRGESGTKIVK                                                  314
```

There is also homology to SEQ ID 3110.

Based on this analysis, it was predicted that this protein and its epitopes, could be useful antigens for vaccines or diagnostics.

Example 1054

A DNA sequence (GBSx1127) was identified in *S. agalactiae* <SEQ ID 3249> which encodes the amino acid sequence <SEQ ID 3250>. Analysis of this protein sequence reveals the following:

---

Possible site: 34
>>> Seems to have no N-terminal signal sequence
----- Final Results -----
    bacterial cytoplasm --- Certainty = 0.3558 (Affirmative) <succ>
      bacterial membrane --- Certainty = 0.0000 (Not Clear) <succ>
        bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1055

A DNA sequence (GBSx1128) was identified in *S. agalactiae* <SEQ ID 3251> which encodes the amino acid sequence <SEQ ID 3252>. This protein is predicted to be a transmembrane protein (b2298). Analysis of this protein sequence reveals the following:

---

Possible site: 35
>>> Seems to have a cleavable N-term signal seq.
INTEGRAL    Likelihood = −13.11    Transmembrane 413-429 (405-440)
INTEGRAL    Likelihood = −9.61    Transmembrane 498-514 (489-516)
INTEGRAL    Likelihood = −9.45    Transmembrane 165-181 (161-185)
INTEGRAL    Likelihood = −8.07    Transmembrane 127-143 (122-146)
INTEGRAL    Likelihood = −7.22    Transmembrane 308-324 (306-326)
INTEGRAL    Likelihood = −5.57    Transmembrane 334-350 (330-357)
INTEGRAL    Likelihood = −4.51    Transmembrane 194-210 (193-217)
INTEGRAL    Likelihood = −3.82    Transmembrane 372-388 (371-390)
INTEGRAL    Likelihood = −1.22    Transmembrane 250-266 (250-268)
INTEGRAL    Likelihood = −0.80    Transmembrane 468-484 (468-484)
INTEGRAL    Likelihood = −0.32    Transmembrane 436-452 (436-452)
----- Final Results -----
    bacterial membrane --- Certainty = 0.6243 (Affirmative) <succ>
      bacterial outside --- Certainty = 0.0000 (Not Clear) <succ>
        bacterial cytoplasm --- Certainty = 0.0000 (Not Clear)<succ>

---

The protein has homology with the following sequences in the GENPEPT database.

```
>GP: AAC22251 GB: U32741 conserved hypothetical transmembrane protein
[Haemophilus influenzae Rd]
Identities = 303/506 (59%), Positives = 389/506 (75%), Gaps = 6/506 (1%)
Query:  10 NKRSKGFRMPGAFTILFILTIFSVLATWWIPAGSYSKLQFDTASSKLVVTDPNGKTVHVP    69
            +K+ K F  P AFTILF + I +V  TW IP+GSYSKL +++   +  VV           P Sbjct:   4 SKKKKTFNFPSAFTILFAILILAVGLTWVIPSGSYSKLTYNSTDNVFVVKAYGVDDKTYP    63

Query:  70 ATQTQLDKMNVKIKIKEFTSGAISKPVSVPNTYKRLKQNPAGIGSVTISMVNGTIEAVDI    129
            AT   LD +N+KIK+  FT G I KP+++P TY+R++Q+  GI   +T SMV GTIEAVD+

Sbjct:  64 ATTDILDNLIKIKLSNFTEGVIKKPIAIPGTYQRVEQHHKGIEDITKSMVEGTIEAVDV    123

Query: 130 MVFIMVLGGMIGVVRKSGAFESGLLALTKKTKGREFLLIFLVSLLMVLGGTLCGIEEEAV    189
             MVFI VLGGMIGV+ ++G+F +GL+AL KKTKG EF ++F VS+LMVLGGT CGIEEEAV Sbjct: 124 MVFIFVLGGMIGVINRTGSFNAGLMALVKKTKGNEFFIVFCVSVLMVLGGTTCGIEEEAV    183
```

```
-continued
Query:  190 AFYPILVPIFLAMGYDSIICVGAIFLASSVGTSFSTINPFSSVIASNAAGISFTEGLSWR   249
            AFYPILVP+FLA+GYD+I+CVGAIFLA+S+GT+FSTINPFS VIASNAAGI FTEG+ +R Sbjct:  184 AFYPILVPVFLALGYDAIVCVGAIFLAASMGTAFSTINPFSVVIASNAAGIQFTEGIGFR   243

Query:  250 TAGCIAGAIFVVVYLHWYAKKIKANPEFSYSYEDRVEFNAKWGMTTN-HTPSLFTIRQKI   308
            G + GA   V+ YL+WY KKIKA+P FSY+Y+DR EF  ++     + +T    F+ R+K+

Sbjct:  244 ALGLVLGATCVIAYLYWYCKKIKADPSFSYTYDDREEFRQRYMKNFDPNTTIPFSARRKL   303

Query:  309 ILSLFVISFPLMVWGVMSQGWWFPTMASSFLAITIIIMFLTATGANGIGERDVVDEFVNG   368
            IL+LF ISFP+M+WGVM  GWWFP MA+SFLAITIIIMF+    +G+     E+D+++ F  G Sbjct:  304 ILTLFCISFPIMIWGVMVGGWWFPQMAASFLAITIIIMFI-----SGLSEKDIMESFTEG   358

Query:  369 ASSLVGVSLIIGLARGINIILSQGYISDTMLYTASKLASHVSGSVFIIVMMFIYFVLGFV   428
            AS LVGVSLIIGLARG+N++L QG ISDT+L   S + S + GSVFI+   + ++   LG +

Sbjct:  359 ASELVGVSLIIGLARGVNLVLEQGMISDTILDYMSNVVSGMPGSVFILGQLVVFIFLGLI   418

Query:  429 VPSSSGLAVLSMPILAPLADTVGIPRSVVVMAYQFGQYAMLFLAPTGLVMATLQMLDMKY   488
            VPSSSGLAVLSMPI+APLAD+VGIPR +VV AY +GQYAMLFLAPTGLV+ TLQML + +

Sbjct:  419 VPSSSGLAVLSMPIMAPLADSVGIPRDIVVSAYNWGQYAMLFLAPTGLVLVTLQMLQIPF   478

Query:  489 SHWLKFVWPVVLFLLIFGGGLLVLQV                                    514
             W+KFV P++  LL+ G  LLV+QV Sbjct:  479 DRWVKFVMPMIGCLLLIGSILLVVQV                                    504
```

A related DNA sequence was identified in *S. pyogenes* <SEQ ID 3253> which encodes the amino acid sequence <SEQ ID 3254>. Analysis of this protein sequence reveals the following:

Possible site: 36
>>> Seems to have a cleavable N-term signal seq.
INTEGRAL    Likelihood = −13.21    Transmembrane 479-495 (472-496)
INTEGRAL    Likelihood = −10.24    Transmembrane 261-277 (258-280)
INTEGRAL    Likelihood = −9.24     Transmembrane 153-169 (142-180)
INTEGRAL    Likelihood = −7.17     Transmembrane 393-409 (391-411)
INTEGRAL    Likelihood = −6.00     Transmembrane 81-97 (78-99)
INTEGRAL    Likelihood = −5.95     Transmembrane 318-334 (314-338)
INTEGRAL    Likelihood = −3.77     Transmembrane 352-368 (352-369)
INTEGRAL    Likelihood = −2.66     Transmembrane 120-136 (119-138)

-continued

INTEGRAL    Likelihood = −0.32    Transmembrane 204-220 (204-220)
----- Final Results -----
    bacterial membrane --- Certainty = 0.6286 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:AAB94000 GB:AF008219 unknown [Borrelia afzelii]
Identities = 174/496 (35%), Positives = 306/496 (61%), Gaps = 37/496 (7%)

Query:   10 RIPSSYTVLFIIIAIMAVLTWFIPAGAYETAK---GGG-----VISGTYKTVASNPQGFF    61
                    ++PSS+T++F +I  + +LT+ IPAG ++         G G      +++GTY+T+   P+GF
        Sbjct:    3 KMPSSFTIIFSLIVFVTILTYVIPAGKFDKEFRQIGDGPKREIIVAGTYQTIDRGPRGFL    62

Query:   62 DILMAPVRGMLGVEGIDGAIQVSFFILMVGGFLGVVNKTGALDTGIASVVRKNKGREKML   121
                     +M   + M   +G + A +V F+L+VGG  G++  KTGA+D GI S+++K    ++K+L
        Sbjct:   63 HPIMTILTAMS--KGMEHAAEVIIFVLIVGGAYGIIMKTGAIDAGIYSLIKKLGHKDKLL   120

Query:  122 IAILIPLFALGGTTYGMEETMAFYPLLIPVMIAVGFDSIVAVAIILIGSQIGCLASTIN   181
                    I ++L+ +F++GGT  GM EET+ FY ++IP+++A+G+D++V VAII +G+ +G +AST+N
        Sbjct:  121 IPLLMFIFSIGGTVTGMSEETLPFYFVMIPLIVALGYDNVVGVAIIALGAGVGTMASTVN   180

Query:  182 PFATGVAADAAGVSIADGMIWRVIQWVILVGMSIWFVYNYASKIEEDPSKSLVADKEEEH   241
                    PFATG+A+  A +S+ DG  +R++  + I + ++I +V YAS+I++DPSKSLV  K+ EH
        Sbjct:  181 PFATGIASAIASISLQDGFSFRIVLYFISILVAIIYVCVYASRIKKDPSKSLVYSKKNEH   240

Query:  242 KELF-QLQNSGEDLNKRQRNVLTIFTLTFVIMILSLIPWEDFGIKFFTNINTWLTTMPIL   300
                      + F + + S ED       NV    TF   ++ L+    FG       I +  ++ L
        Sbjct:  241 YQYFVKNEISKED------NVQNTLEFTFARKLVLLL----FGFM----ILFLVFSIVQL   286

Query:  301 GGVIGKTMGAFGTWYFPEITMLFIMMGVLVAIVYRMSEEDFFSSFLTGAGEFLGVAMICA   360
                    G             W+   E+TML++  + ++  A +R+ E  + +F+ G+     + A+I
        Sbjct:  287 G-----------WWMQEMTMLYLGVAIISAFICRLGESEMWDAFVKGSESLITAALIIG   334

Query:  361 IARGIQVIMNGGMITATILHLGETSLSGLSSQVFVILAYIFYLPMSFLIPSTSGLAGATM   420
```

```
                    +ARG+ ++ + G+ITAT+L+      L    L    F+IL  I  + + F++PS+SG A   TM
Sbjct:  335  LARGVMIVCDDGLITATMLNAATNFLYNLPRPFFIILNEIIQIFIGFIVPSSSGHASLTM   394

Query:  421  GIMAPLGQFSNVPAHLVITAFQSASGILNMISPTSAIVMGALALGRVDLGTWWKFIGKFI   480
              IMAPL  F ++     V+ A Q++SG++N+I+PTS ++M  L + ++   GTW+KF+
Sbjct:  395  PIMAPLADFLSIGRSSVVIAMQTSSGLINLITPTSGVIMAVLGISKLSYGTWFKFVLPLF   454

Query:  481  VMVMLVSVLLLVVATF                                               496
              ++   +S+L+++   +
Sbjct:  455  IIEFFISILVIIANVY                                               470
```

An alignment of the GAS and GBS proteins is shown below.

```
Identities = 158/542 (29%), Positives = 274/542 (50%), Gaps = 92/542 (16%)

Query:   11  KRSKGFRMPGAFTILFILTIFSVLATWWIPAGSYSKLQFDTASSKLVVTDPNGKTVHVPA    70
              ++ +GFR+P ++T+LFI+      + TW+IPAG+Y        +TA
Sbjct:    4  EKKRGFRIPSSYTVLFIIIAIMAVLTWFIPAGAY-----ETAKG----------------   42

Query:   71  TQTQLDKMNVKIKIKEFTSGAISKPVSVPNTYKRLKQNPAGIGSVTTSMVNG------TI   124
                                G IS       TYK +  NP G   +  +V G      T
Sbjct:   43  ------------------GGVIS------GTYKTVASNPQGFFDILMAPVRGMLGVEGTD    78

Query:  125  EAVDIMVFIMVLGGMIGVVRKSGAFESGLLALTKKTKGREFLLIFLVSLLMVGGTLCGI   184
              A+ +   FI+++GG +GVV K+GA ++G+ ++ +K KGRE +LI ++    L  LGGT  G+
Sbjct:   79  GAIQVSFFILMVGGFLGVVNKTGALDTGIASVVRKNKGREKMLIAILIPLFALGGTTYGM   138

Query:  185  EEEAVAFYPILVPIFLAMGYDSIICVGAIFLASSVGTSFSTINPFSSVIASNAAGISFTE   244
              EE +AFYP+L+P+  +A+G+DSI+ V   I + S +G   STINPF++ +A++AAG+S  +
Sbjct:  139  GEETMAFYPLLIPVMIAVGFDSIVAVAIILIGSQIGCLASTINPFATGVAADAAGVSIAD   198

Query:  245  GLSWRTAGCIAGAIFVVVYLHWYAKKIKANPEFSYSYEDRVEFNAKWGMTTNHTPSLFTI   304
              G+ WR       +       YA KI+ +P  S   D+ E + +    N     L
Sbjct:  199  GMIWRVIQWVILVGMSIWFVYNYASKIEEDPSKSL-VADKEEEHKELFQLQNSGEDL-NK   256

Query:  305  RQKIILSLFVISFPLMV-----W----------------------GVMSQ------GWWF   331
              RQ+ +L++F ++F +M+     W                      GV+ +          W+F
Sbjct:  257  RQRNVLTIFTLTFVIMILSLIPWEDFGIKFFTNINTWLTTMPILGGVIGKTMGAFGTWYF   316

Query:  332  PTMASSFLAITIIIMFLTATGANGIGERDVVDEFVNGASSLVGVSLIIGLARGINIILSQ   391
               P +     F+ + +++   +                + E D    F+ GA   +GV++I   +ARGI +I++
Sbjct:  317  PEITMLFIMMGVLVAIVYR-----MSEEDFFSSFLTGAGEFLGVAMICAIARGIQVIMNG   371

Query:  392  GYISDTMLYTASKLASHVSGSVFIIVMMFIYFVLGFVVPSSSGLAVLSMPILAPLADTVG   451
              G I+ T+L+              S +S   VF+I+     Y    + F++PS+SGLA   +M I+APL
Sbjct:  372  GMITATILHLGETSLSGLSSQVFVILAYIFYLPMSFLIPSTSGLAGATMGIMAPLGQFSN   431

Query:  452  IPRSVVVMAYQFGQYAMLFLAPT-GLVMATLQMLDMKYSHWLKFVWPVVLFLLIFGGGLLVL   512
              +P  +V+ A+Q     +  ++PT  +VM  L  +  +         W KF+   ++ +++      LLV+
Sbjct:  432  VPAHLVITAFQSASGILNMISPTSAIVMGALALGRVDLGTWWKFIGKFIVMVMLVSVLLLVV   493
```

Based on this analysis, it was predicted that these proteins and their epitopes could be useful antigens for vaccines or diagnostics.

Possible site: 46
>>> Seems to have no N-terminal signal sequence
INTEGRAL    Likelihood = –10.83   Transmembrane 25-41 (18-47)
INTEGRAL    Likelihood = –10.46   Transmembrane 153-169 (148-176)
----- Final Results -----
  bacterial membrane --- Certainty = 0.5331 (Affirmative) <succ>
  bacterial outside --- Certainty = 0.0000 (Not Clear) <succ>
  bacterial cytoplasm --- Certainty = 0.0000 (Not Clear) <succ>

Example 1056

A DNA sequence (GBSx1129) was identified in *S. agalactiae* <SEQ ID 3255> which encodes the amino acid sequence <SEQ ID 3256>. Analysis of this protein sequence reveals the following:

The protein has homology with the following sequences in the GENPEPT database.

```
>GP:CAB13183 GB:Z99110 similar to two-component sensor histidine
kinase [YkoG] [Bacillus subtilis]
Identities = 119/446 (26%), Positives = 212/446 (46%), Gaps = 18/446 (4%)

Query:   17  TQITLWYSSFIFILVIGVLIGSFFISKSIAENKSKKNLEAKAVQMSQALAKGHRYEAFED    76
              T+I  L+ S   + IL+I V    + I  S  +K    L  +   +++AL
Sbjct:    5  TKIHLYTSISLLILLILVHTAVYLIFSSALTSKDAARLADETDNIAEALRAAETEGVALQ    64
```

```
Query:   77  GIFYSVYDQNGKV-IYSGFPKGFKRDLDHQHKHKKKLSLFSMEN--------RTFQYVDI   127
             + +      NG V + +G K            LS  S E         + F     +
Sbjct:   65  DMLQAYLPANGMVRVVNGDQKAVMTITKEKAYKDFPLSFHSGETADVRKPDGKLFAEAAV   124

Query:  128  PISGKNQWLRAIRTVDRLDKQLTELLFSLGIVLPLMLIIITVG----GYLILKRTFRPIQ   183
             P+   +  + +++ V+RL+    E LF L I+L      + +    G L+ +R   PI+
Sbjct:  125  PVIWTDGQVVSLQLVERLENT-EESLFLLKIILIAASAAVCIASFFAGSLLARRIINPIR   183

Query:  184  EITETAQFITQNEDYTKRIITKNNENELTELAAVINTMLASIESSFVREKQFNNDVSHEL   243
             + T + I +++++    +    + +EL ++    N M   ++  + +++QF  D SHEL
Sbjct:  184  RLMITMKDIQRDKEFKTISLEGQSNDELYQMGLTFNEMAMMLKEHYDKQQQFVQDASHEL   243

Query:  244  RTPVTVILSESEYGKNYAENLSEA-KESFEVIHRQSLSMKKLVEQLLELTKAENPLSIQL   302
             +TP+T+I S S   K +      E  +ES E IH +++ MKKL  QLL L K+    L + L
Sbjct:  244  KTPLTIIESYSSLMKRWGAKKPEVLEESIEAIHSEAVHMKKLTNQLLALAKSHQGLEVDL   303

Query:  303  EPLNFSIMMKQLVSDSSRLLDNTPIHLDSQIEDDLWIIGQQTLLKRLFDNLFSNAIKFTN   362
             + ++  I   + V  + +       I L++  ++ L +   +  +K+L    L   NAIK++
Sbjct:  304  KTIDL-IKAARAVMQTLQSVYQRDILLETD-KESLLVKADEERIKQLLTILLDNAIKYSE   361

Query:  363  NHISISLRQSDNQIVFSIKDNGLGISVDDQSKIWNRFYQVDSARTKDSQSGIGLGLSLVK   422
                 I +S     + +     S++D G+GI  +       ++ RFY+ D AR + +   G GLGLS+ K
Sbjct:  362  KPIEMSAGTRNGRPFLSVRDEGIGIPEEHIPHLFERFYRADEARNRKT-GGTGLGLSIAK   420

Query:  423  QIATIHRAKIWVDSKPDDGSQFTLTF                                    448
             QIA   H ++ V SKP  G+   T+ F
Sbjct:  421  QIADEHGIELSVKSKPGQGTAVTMQF                                    446
```

There is also homology to SEQ ID 1178.

SEQ ID 3256 (GBS77) was expressed in *E. coli* as a GST-fusion product. SDS-PAGE analysis of total cell extract is shown in FIG. 21 (lane 2; MW 78.5 kDa) and in FIG. 28 (lane 2; MW 78.5 kDa).

GBS77-GST was purified as shown in FIG. 195, lane 4.

-continued bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:CAC07978 GB:AJ278983 CopR protein [Ralstonia metallidurans]
 Identities = 102/221 (46%), Positives = 145/221 (65%)

Query:    1  MKILVVEDEFDLNRSIVKLLKKQHYSVDSASNGEEALQFVSVAEYDVIILDVMMPKMDGF    60
                    MK+LVVEDE      + + L +  + VD  +NG +   F      YD+IILDVM+P +DG+
        Sbjct:    1  MKLLVVEDEVKTGEYLRQGLTEAGFVVDLVANGLDGQHFAVNETYDLIILDVMLPDVDGW    60

Query:   61  TFLKLLRNKGSQVSILMLTARDAVEDRIAGLDFGADDYLVKPFEFGELMARIRAMLRRAN   120
                       L  +R  G+  V +L LTARD+V DR+ GL+ GADDYLVKPF F EL+AR+R +LRR
        Sbjct:   61  HILHAIRASGNAVPVLFLTARDSVADRVRGLELGADDYLVKPFAFSELLARVRTLLRRGA   120

Query:  121  RQVSSDDIQIQDITINLSTKQVWRNDNLIDLTAKEYEVLEYLARHRDQVLSRHQIREHVW   180
                      Q++ D  IQ+ D+ ++LS ++   R     I LT+KE+ +LE  AR R +VL R  I   VW
        Sbjct:  121  VQLAMDRIQVADLILDLSRRRASRGGRRITLTSKEFALLELFARRRGEVLPRSLIASQVW   180

Query:  181  DYDYYGESNIIDVLIKNLRRKLDNNRDGSLIKTKRGLGYVI                     221
                    D ++   +SN+IDV I+ LR  K+D+   +  LI+T RG+GYV+
        Sbjct:  181  DMNFDSDSNVIDVAIRRLRAKIDDGFEVKLIQTVRGMGYVL                     221
```

Based on this analysis, it was predicted that this protein and its epitopes, could be useful antigens for vaccines or diagnostics.

Example 1057

A DNA sequence (GBSx1130) was identified in *S. agalactiae* <SEQ ID 3257> which encodes the amino acid sequence <SEQ ID 3258>. This protein is predicted to be CopR protein (tcrA). Analysis of this protein sequence reveals the following:

Possible site: 33
>>> Seems to have no N-terminal signal sequence
----- Final Results -----
  bacterial cytoplasm --- Certainty = 0.3963 (Affirmative) <succ>

There is also homology to SEQ ID 3260.

Based on this analysis, it was predicted that this protein and its epitopes, could be useful antigens for vaccines or diagnostics.

Example 1058

A DNA sequence (GBSx1131) was identified in *S. agalactiae* <SEQ ID 3261> which encodes the amino acid sequence <SEQ ID 3262>. Analysis of this protein sequence reveals the following:

Possible site: 40
>>> Seems to have no N-terminal signal sequence
INTEGRAL    Likelihood = -3.45    Transmembrane 18-34 (16-36)
----- Final Results -----

A related GBS nucleic acid sequence <SEQ ID 10281> which encodes amino acid sequence <SEQ ID 10282> was also identified.

The protein has no significant homology with any sequences in the GENPEPT database.

No corresponding DNA sequence was identified in *S. pyogenes*.

SEQ ID 3262 (GBS78) was expressed in *E. coli* as a His-fusion product. SDS-PAGE analysis of total cell extract is shown in FIG. 16 (lane 4; MW 23.8 kDa).

Figure 317:
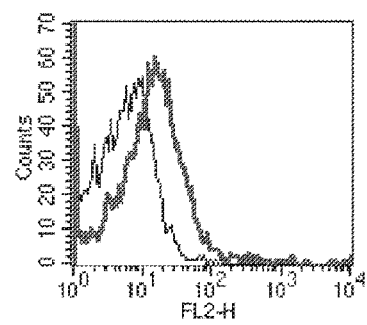

The GBS78-GST fusion product was purified (FIG. 194, lane 4) and used to immunise mice. The resulting antiserum was used for FACS (FIG. 317), which confirmed that the protein is immunoaccessible on GBS bacteria.

Based on this analysis, it was predicted that these proteins and their epitopes could be useful antigens for vaccines or diagnostics.

Example 1059

A DNA sequence (GBSx1132) was identified in *S. agalactiae* <SEQ ID 3263> which encodes the amino acid sequence <SEQ ID 3264>. Analysis of this protein sequence reveals the following:

Possible site: 36
>>> Seems to have an uncleavable N-term signal seq
INTEGRAL   Likelihood = −11.04   Transmembrane   15-31 (6-35)
INTEGRAL   Likelihood = −1.28    Transmembrane   51-67 (51-67)
----- Final Results -----
  bacterial membrane --- Certainty = 0.5416 (Affirmative) <succ>
  bacterial outside --- Certainty = 0.0000 (Not Clear) <succ>
  bacterial cytoplasm --- Certainty = 0.0000 (Not Clear) <succ>

The protein has no significant homology with any sequences in the GENPEPT database.

No corresponding DNA sequence was identified in *S. pyogenes*.

Figure 154:
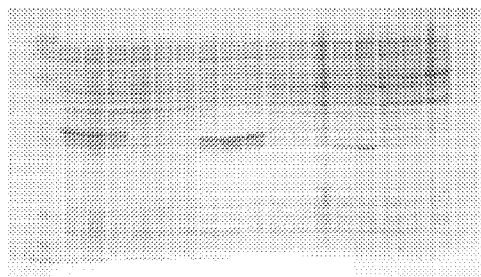
Figure 243:
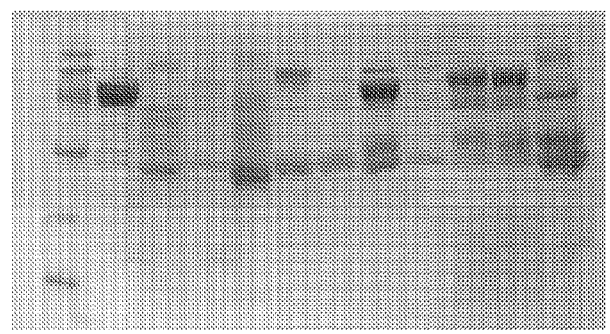

SEQ ID 3264 (GBS79) was expressed in *E. coli* as a GST-fusion product. GBS79d was expressed in *E. coli* as a GST-fusion product. SDS-PAGE analysis of total cell extract is shown in FIG. 154 (lane 17 & 18; MW 51 kDa), in FIG. 155 (lane 17; MW 51 kDa) and in FIG. 187 (lane 13; MW 51 kDa). GBS79d was also expressed in *E. coli* as a His-fusion product. SDS-PAGE analysis of total cell extract is shown in FIG. 155 (lane 2-4; MW 26 kDa) and in FIG. 183 (lane 5; MW 26 kDa). Purified GBS79d-GST is shown in FIG. 243, lane 2.

Based on this analysis, it was predicted that this protein and its epitopes, could be useful antigens for vaccines or diagnostics.

Example 1060

A DNA sequence (GBSx1133) was identified in *S. agalactiae* <SEQ ID 3265> which encodes the amino acid sequence <SEQ ID 3266>. Analysis of this protein sequence reveals the following:

Possible site: 50
>>> Seems to have no N-terminal signal sequence
----- Final Results -----
  bacterial cytoplasm --- Certainty = 0.5326 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 10279> which encodes amino acid sequence <SEQ ID 10280> was also identified.

The protein has homology with the following sequences in the GENPEPT database.

```
>GP:AAG20974 GB:AE005164 Vng6349c [Halobacterium sp. NRC-1]
Identities = 97/358 (27%), Positives = 163/358 (45%), Gaps = 20/358 (5%)

Query:    35  DPQIIKLTTRANIAIGTYEGFLESIINPMLLISPLLSQEAVLSSKLEGTHATLKDLLNYE    94
              D    +    A  +G   G    + P +L + LL +EA+ S+++EG       L + E
Sbjct:    70  DDDFYETLADATFWLGKLSGVSLELDFPPVLYTSLLRKEAMESAEIEGADVDYDALYSLE   129

Query:    95  AGNKVDIERDELHEII------NYRKALFYALENISTINNIDSKGLPLSNRIIKEMHKIL   148
                      D  RDE  E          + R+ L Y       I+ +D+ G  L+  ++ ++H+ L
Sbjct:   130  T-RTFDEGRDEPSETTAAAETKDTREVLNYETAVKEGIDALDA-GEELNVELLHDLHETL   187

Query:   149  LDNV---RGSSKNPGNFKRSQNYIGSVSSISYTPVPAEKTPEYMSNLEQYIHYD-DLDLL   204
              L V  R  +    G++K + NY+G       + P        + M L Y        L
Sbjct:   188  LTGVPDDRVDTDTIGDYKTNPNYLGD-----FLPPAPGAVEDLMDGLFTYYRTGGSYHPL   242

Query:   205  VQSAIIHAQFEMIHPFEDGNGRIGRLLIPLFLYYQELLSYPTFYMSSYFERDRSLYISHL   264
              V  A+  H  QFE  IHP+  DGNGR+GRLLI  L LY    +LL    P   Y+S Y  R+++ Y+   +
Sbjct:   243  VDIALFHYQFETIHPYGDGNGRLGRLLITLQLYDADLLERPNLYLSEYLNRNKTTYVERM   302

Query:   265  SNISKDNNWKDWFEYYLEGVILSAEESTKKAQDILSLYNIMKEQVIPKLNSVSGIQLLDF   324
                +     W+  W   +++EG+       A ES ++ + +      L       + +      K   + +  QL
Sbjct:   303  EGVRFHGEWEAWLSFFIEGIARQAHESVERTRALADLRREYEHEYGGKAYTKN--QLAVT   360

Query:   325  IFSAPIFKAEQVSEHLKISKRTTYTLLNKLIDEGYL-STDNAQRNRTYYCPQLLSIVQ     381
              +F   P   ++ V    I + T     +N+L++EG L         RN+ Y   ++  I++
Sbjct:   361  LFEQPYITSKTVQRLFDIEQSTASRAINELVNEGILEEVPRHGRNKEYRAREIFEILE     418
```

No corresponding DNA sequence was identified in S. pyogenes.

Based on this analysis, it was predicted that these proteins and their epitopes could be useful antigens for vaccines or diagnostics.

Example 1061

A DNA sequence (GBSx1134) was identified in S. agalactiae <SEQ ID 3267> which encodes the amino acid sequence <SEQ ID 3268>. Analysis of this protein sequence reveals the following:

```
Possible site: 47
>>> Seems to have no N-terminal signal sequence
----- Final Results -----
   bacterial cytoplasm --- Certainty = 0.4370 (Affirmative) <succ>
   bacterial membrane --- Certainty = 0.0000 (Not Clear) <succ>
      bacterial outside --- Certainty = 0.0000 (Not Clear) <succ>
RGD motif : 46-48
```

The protein has no significant homology with any sequences in the GENPEPT database.

No corresponding DNA sequence was identified in S. pyogenes.

SEQ ID 3268 (GBS299) was expressed in E. colt as a GST-fusion product. SDS-PAGE analysis of total cell extract is shown in FIG. 58 (lane 2; MW 62.2 kDa) and in FIG. 60 (lane 4; MW 62.2 kDa).

Figure 225:
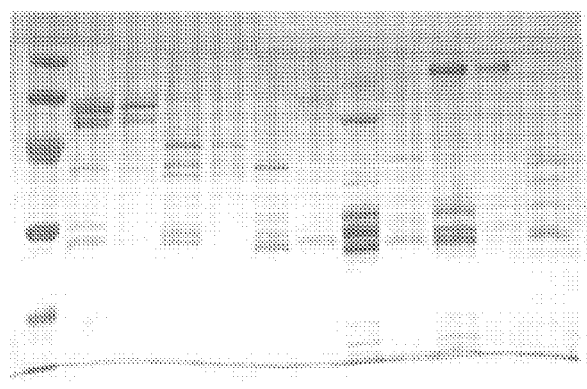

GBS299-GST was purified as shown in FIG. 207 (lane 4) and FIG. 225 (lanes 2-3).

Based on this analysis, it was predicted that this protein and its epitopes, could be useful antigens for vaccines or diagnostics.

Example 1062

A DNA sequence (GBSx1135) was identified in S. agalactiae <SEQ ID 3269> which encodes the amino acid sequence <SEQ ID 3270>. Analysis of this protein sequence reveals the following:

```
Possible site: 37
>>> Seems to have no N-terminal signal sequence
----- Final Results -----
   bacterial cytoplasm --- Certainty = 0.4176 (Affirmative) <succ>
   bacterial membrane --- Certainty = 0.0000 (Not Clear) <succ>
      bacterial outside --- Certainty = 0.0000 (Not Clear) <succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1063

A DNA sequence (GBSx1136) was identified in S. agalactiae <SEQ ID 3271> which encodes the amino acid sequence <SEQ ID 3272>. Analysis of this protein sequence reveals the following:

```
Possible site: 19
>>> Seems to have no N-terminal signal sequence
----- Final Results -----
   bacterial cytoplasm --- Certainty = 0.1789 (Affirmative) <succ>
   bacterial membrane --- Certainty = 0.0000 (Not Clear) <succ>
      bacterial outside --- Certainty = 0.0000 (Not Clear) <succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1064

A DNA sequence (GBSx1137) was identified in S. agalactiae <SEQ ID 3273> which encodes the amino acid sequence <SEQ ID 3274>. Analysis of this protein sequence reveals the following:

```
Possible site: 49
>>> Seems to have no N-terminal signal sequence
----- Final Results -----
   bacterial cytoplasm --- Certainty = 0.3748 (Affirmative) <succ>
   bacterial membrane --- Certainty = 0.0000 (Not Clear) <succ>
      bacterial outside --- Certainty = 0.0000 (Not Clear) <succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1065

A DNA sequence (GBSx1138) was identified in S. agalactiae <SEQ ID 3275> which encodes the amino acid sequence <SEQ ID 3276>. Analysis of this protein sequence reveals the following:

```
Possible site: 51
>>> Seems to have no N-terminal signal sequence
----- Final Results -----
   bacterial cytoplasm --- Certainty = 0.1638 (Affirmative) <succ>
   bacterial membrane --- Certainty = 0.0000 (Not Clear) <succ>
      bacterial outside --- Certainty = 0.0000 (Not Clear) <succ>
```

The protein has homology with the following sequences in the GENPEPT database.

```
>GP:CAB12294 GB:Z99106 similar to transposon protein [Bacillus subtilis]
Identities = 84/291 (28%), Positives = 138/291 (46%), Gaps = 6/291 (2%)

Query:     6  MLDYLAVTIKGLAPDDVIEKILILPKDKFVLNEWGINKYQRHYSFSEIKVYFNKDWQSKM      65
              M+DY+ V+ K    D +IE++L L KD     + G Y Y        IKV+++     ++
Sbjct:    31  MVDYIRVSFKTHDVDRIIEEVLHLSKDFMTEKQSGFYGYVGTYELDYIKVFYSAPDDNR-      89

Query:    66  GVFIELRGQGCRQYEEYMENNVNNWVTLMKRISECHSNVTRLDIANDIFDDSLSVPLIYS     125
              GV IE+ GQGCRQ+E ++E      W    +      +  TR D+A D       S+P +
Sbjct:    90  GVLIEMSGQGCRQFESFLECRKKTWYDFFQDCMQQGGSFTRFDLAIDDKKTYFSIPELLK     149

Query:   126  YCKKQLCISTAKTFDYHEKSLLENGEKVGEMVTIGVRGTQQW-CVYNKLLEQKLDQELPN     184
                +K  CIS + D++     L +G    G  +  G + ++  + C Y  K    EQ        +P
Sbjct:   150  KAQKGECISRFRKSDFNGSFDLSDGITGGTTIYFGSKKSEAYLCFYEKNYEQAEKYNIPL     209

Query:   185  TPL-SWTRAELRCWQEKANLLAKQIKEGRPLKEIYFEVINGHYRFVSPRDKDSNRWRRKT     243
                 L   W R ELR    E+A +    + + + L I   ++IN + RFV   D++   R    KT
Sbjct:   210  EELGDWNRYELRLKNERAQVAIDALLKTKDLTLIAMQIINNYVRFVD-ADENITREHWKT     268

Query:   244  VKWWNDYLETQEKTVLSVKRTKPTLKRSEKWTEKQVSRTLGKLYVAKAESH     294
                +W+D++      +   L VK  K     ++S  W       + T+       V +A+ H
Sbjct:   269  SLFWSDFIGDVGRLPLYVKPQKDFYQKSRNWLRNSCAPTM--KMVLEADEH     317
```

No corresponding DNA sequence was identified in *S. pyogenes*.

Based on this analysis, it was predicted that this protein and its epitopes, could be useful antigens for vaccines or diagnostics.

Example 1066

A DNA sequence (GBSx1139) was identified in *S. agalactiae* <SEQ ID 3277> which encodes the amino acid sequence <SEQ ID 3278>. This protein is predicted to be integrase. Analysis of this protein sequence reveals the following:

Possible site: 58
>>> Seems to have no N-terminal signal sequence
----- Final Results -----
   bacterial cytoplasm --- Certainty = 0.1914 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:CAB70622 GB:AJ243106 integrase [Streptococcus thermophilus]
Identities = 135/474 (28%), Positives = 233/474 (48%), Gaps = 68/474 (14%)

Query:    20  KAGNVLVKFAMRFTHPITKKSHKKYLSTGASKGWFTTKATPSKKLPSGKERLLVSDIKNT      79
              K G + VKF   F + +T K  ++ LS       W+T     +KK  +GK +L   S
Sbjct:    19  KTGYIEVKFRTYFNNQLTNK-RREILSD-----WYTIV---NKKDTTGKIKL--SPQIKA      67

Query:    80  QLITQVTQELNKLVDDYIAELMGIKPKKAKKLLTLEEIAKPFDKDGNFYGKAFKAWH---     136
              +   ++ ++ NK+ ++       ++         K    +TL+E+              + WH
Sbjct:    68  IIHKELQEKANKVYEELTRTIL-----LEKSDITLDEV--------------WNEWHNER     108

Query:   137  -ERVKPANNTLKTRVTIYNRYIEPNFDTRMSITKFAFMTDEIQNLIN-----ASSMHMAR     190
               ER     A  TL     Y +I    + SI K     + I+NL++          +A+
Sbjct:   109  VERQLVAPKTLAGEDGRYRNHITKQIP-KNSILK-NIPSSLIKNLLDNLYPIGNHKRLAQ     166

Query:   191  NLHIYLKMIFDWSVENGQITLTQDPIASNKVKRRVLTKSEEQDK-KREDIAEKYLEASEV     249
               +   L   I+ +++      I+   Q+P+          + R+ L  S+E D+ K+  DI ++YLE+ E+
Sbjct:   167  GVKSDLTSIYKFAILHDYISPDQNPMPYISIGRKGL--SDELDRLKKSDIEDQYLESWEL     224

Query:   250  NHVLRLIESWTNRPDNQLIADVLRMIFLTGMRPSEVLGLNEDMLDFEKKWIKVHWQRASK     309
                VL ++  +     N+   A +        LTGMR   EVLGL  E+ +DF K         V    RA+
Sbjct:   225  KEVLSIVRKY-----NEQYARIFEFQALTGMRIGEVLGLKEEAIDFNKNIASVIRTATH     279

Query:   310  NKSDDMMEALNLDEKERYRADLKTKESVRTIPMSPEVEKILRHYIDRNKFQAQFSPTYQD     369
                 + +            + Y ++K  +S R + +S        +IL+    I+ N    +F+P Y+D
Sbjct:   280  GGASE----------DSYEGNVKNLQSYRNVQLSKRAIEILKEEIELNHQIRFNPDYKD     329

Query:   370  LGYLFTRTYIRAGNRQGSPLYHNELSQFLRGGSSQSAKYNKKAGKPYK---DIDSFLDFG     426
              G++FT   I   +    G+PL+++  L+  FL        SS++ K N+    G P +      DID+ L F
Sbjct:   330  NGWIFTSKSIHKPDYNGTPLHYSVLNNFL--NSSENGKLNRN-GNPRRAGIDIDNKLSFK     386

Query:   427  RPIHVIPHMFRHSFISIMASEGIDLPTIREFVGHSEDSKEIERVYLHVIKKQKD     480
                 + H+   H+FRH+ IS +A +G+ L   I++     VGHS   S+ +       +YLH+    KK KD
Sbjct:   387  K--HITTHIFRHTHISFLAEQGVPLEAIQDRVGHSRGSR-VTEIYLHITKKTKD     437
```

A related DNA sequence was identified in *S. pyogenes* <SEQ ID 3279> which encodes the amino acid sequence <SEQ ID 3280>. Analysis of this protein sequence reveals the following:

Possible site: 33
>>> Seems to have no N-terminal signal sequence
----- Final Results -----
  bacterial cytoplasm --- Certainty = 0.5203 (Affirmative) <succ>
  bacterial membrane --- Certainty = 0.0000 (Not Clear) <succ>
  bacterial outside --- Certainty = 0.0000 (Not Clear) <succ>

Possible site: 42
>>> Seems to have no N-terminal signal sequence
----- Final Results -----
  bacterial cytoplasm --- Certainty = 0.3023 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 10277> which encodes amino acid sequence <SEQ ID 10278> was also identified.

An alignment of the GAS and GBS proteins is shown below.

The protein has homology with the following sequences in the GENPEPT database.

```
Identities = 82/357 (22%), Positives = 155/357 (42%), Gaps = 52/357 (14%)

Query:   135  WHERVKPANNTLKTRVTIYNRYIEPNFDTRMSITKFAFMTDEIQNLINA--SSMHMARNL   192
              W    K  +T  +    R +    D  + I K    T  +Q++I+    S     +
Sbjct:    73  WEHHQKSLKSTSVRSLDFRIRELRNLIDPEVMIAKIT--TKYLQSIIDKIPGSYDKRKRA  130

Query:   193  HIYLKMIFDWSVENGQITLTQDPIASNKVKRRVLTKSEEQDKKREDIAEKYLEASEVNHV   252
                  LK    FD+++     +++   +P+ S ++ + V T    K   ED+A+K+LE   E+
Sbjct:   131  RQLLKQTFDYAIALEYVSI--NPVISTQLAKPVKTI-----KDFEDVAQKFLEKDELK--  181

Query:   253  LRLIESWTNRPDNQLIADVLRMIFLTGMRPSEVLGLNEDMLDFEKKWIKVHWQRASKNKS   312
              RL++    R +  +A +   + L G R   EL+  D  + +    I++H
Sbjct:   182  -RLLDEMYRRKGSIKMAYLAEFMSLNGCRIGEALAIQPD--NIKNDIIEIH---------  229

Query:   313  DDMMEALNLDEKERYRADLKTKESVRTIPMSPEVEKILRHYIDRNKFQAQFSPTYQDLGY   372
                ++   +   +    +    KT   S R    ++    ++I++    +   N   +   +P Y+D+GY
Sbjct:   230  -GTLDYTSNGYRNAIKTTPKTNSSWRETLITKREKEIIQDILKINALEKNTNPNYKDMGY  288

Query:   373  LFTRTYIRAGNRQGSPLYHNELSQFLRGGSSQSAKYNKKAGKPYKDIDSFLDFGRPIHVI   432
              +F          +R G P+   N L+  +R             NK+   KP  +                +
Sbjct:   289  IFI-------SRNGVPIQDNALNTSIRAA-------NKRLEKPIQK-----------ELT  323

Query:   433  PHMFRHSFISIMASEGIDLPTIREFVGHSEDSKEIERVYLHVIKKQKDTMRGAVEKL    489
              H+FRH+ +S  +A    + L TI + VGH+ DSK   +++Y HV K   K+ +    +  +L
Sbjct:   324  SHIFRHTLVSRLAENKVPLKTIMDRVGHA-DSKTIQQIYTHVTKSMKNEVVDILNRL     379
```

Based on this analysis, it was predicted that these proteins and their epitopes could be useful antigens for vaccines or diagnostics.

Example 1067

A DNA sequence (GBSx1140) was identified in *S. agalactiae* <SEQ ID 3281> which encodes the amino acid sequence <SEQ ID 3282>. Analysis of this protein sequence reveals the following:

```
>GP:AAB64982 GB:U43834 Ydr540cp [Saccharomyces cerevisiae]
Identities = 88/170 (51%), Positives = 117/170 (68%), Gaps = 3/170 (1%)

Query:    36  MRTYSDKNELKEEVLKSYKKYIAEFNDIPEKLKDLRIDEVDRTPAENLAYQVGWTTLILK    95
              MR Y+ K ELKEE+ K Y+KY AEF   I E  KD +++ VDRTP+ENL+YQ+GW  L+L+
Sbjct:     1  MREYTSKKELKEEIEKKYEKYDAEFETISESQKDEKVETVDRTPSENLSYQLGWVNLLLE    60

Query:    96  WESDEQSGLEVKTPTETFKWNQLGELYQHFTETYASLTIKELTAQLNDNVDAIGNMIDSM   155
              WE+ E +G   V+TP    +KWN LG LYQ F + Y    +IKE  A+L + V+ +    I ++
Sbjct:    61  WEAKEIAGYNVETPAPGYKWNNLGGLYQSFYKKYGIYSIKEQRAKLREAVNEVYKWISTL   120

Query:   156  SDEVLFKPHMRNWADSATKNAVWEVYKFIHINTVAPFGTFRTKIRKWKKV             205
              SD+ LF+    R W    AT   A+W VYK+IHINTVAPF  FR KIRKWK++
Sbjct:   121  SDDELFQAGNRKW---ATTKAMWPVYKWIHINTVAPFTNFRGKIRKWKRL            167
```

No corresponding DNA sequence was identified in *S. pyogenes*.

Based on this analysis, it was predicted that these proteins and their epitopes could be useful antigens for vaccines or diagnostics.

Example 1068

A DNA sequence (GBSx1141) was identified in *S. agalactiae* <SEQ ID 3283> which encodes the amino acid sequence <SEQ ID 3284>. This protein is predicted to be 50S ribosomal protein subunit L33-related protein. Analysis of this protein sequence reveals the following:

```
>GP:AAB66692 GB:U89998 50S ribosomal protein subunit L33
[Lactococcus lactis subsp. cremoris]
Identities = 43/49 (87%), Positives = 46/49 (93%)

Query:   1   MRVNITLEHKESGERLYLTSKNKRNTPDRLQLKKYSPKLRKHVVFTEVK   49
             MRVNITLEHKESGERLYLT KNKRNTPD+L+LKKYS KLRKHV+F EVK
Sbjct:   1   MRVNITLEHKESGERLYLTQKNKRNTPDKLELKKYSKELRKHVIFKEVK   49
```

A related DNA sequence was identified in *S. pyogenes* <SEQ ID 3285> which encodes the amino acid sequence <SEQ ID 3286>. Analysis of this protein sequence reveals the following:

Possible site: 46
>>> Seems to have no N-terminal signal sequence
----- Final Results -----
   bacterial cytoplasm --- Certainty = 0.5394 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 48/49 (97%), Positives = 48/49 (97%)

Query:   1   MRVNITLEHKESGERLYLTSKNKRNTPDRLQLKKYSPKLRKHVVFTEVK   49
             MRVNITLEHKESGERLYLTSKNKRNTPDRLQLKKYSPKLRKHV FTEVK
Sbjct:   1   MRVNITLEHKESGERLYLTSKNKRNTPDRLQLKKYSPKLRKHVTFTEVK   49
```

Based on this analysis, it was predicted that these proteins and their epitopes could be useful antigens for vaccines or diagnostics.

Example 1069

A DNA sequence (GBSx1142) was identified in *S. agalactiae* <SEQ ID 3287> which encodes the amino acid sequence <SEQ ID 3288>. This protein is predicted to be 50S ribosomal protein subunit L32-related protein. Analysis of this protein sequence reveals the following:

Possible site: 56
>>> Seems to have no N-terminal signal sequence
----- Final Results -----
   bacterial cytoplasm --- Certainty = 0.3577 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

Possible site: 46
>>> Seems to have no N-terminal signal sequence
----- Final Results -----
   bacterial cytoplasm --- Certainty = 0.5420 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:AAB66691 GB:U89998 50S ribosomal protein subunit L32
[Lactococcus lactis subsp. cremoris]
Identities = 44/53 (83%), Positives = 48/53 (90%)

Query:   1  MAKPARHTSKAKRNKRRTHYKLTAPSVQFDETTGDYSRSHRVSLKGYYKGRKI   53
            MA PARHTS AK+N+RRTHYKLTAP+V FDETTGDY  SHRVSLKGYYKGRK+
Sbjct:   1  MAVPARHTSSAKKNRRRTHYKLTAPTVTFDETTGDYRHSHRVSLKGYYKGRKV   53
```

A related DNA sequence was identified in *S. pyogenes* <SEQ ID 3289> which encodes the amino acid sequence <SEQ ID 3290>. Analysis of this protein sequence reveals the following:

Possible site: 35
>>> Seems to have no N-terminal signal sequence
----- Final Results -----
    bacterial cytoplasm --- Certainty = 0.5148 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below.

```
Identities = 38/39 (97%), Positives = 39/39 (99%)

Query:  22  LTAPSVQFDETTGDYSRSHRVSLKGYYKGRKIAKANEAK    60
            +TAPSVQFDETTGDYSRSHRVSLKGYYKGRKIAKANEAK
Sbjct:   1  MTAPSVQFDETTGDYSRSHRVSLKGYYKGRKIAKANEAK    39
```

Based on this analysis, it was predicted that these proteins and their epitopes could be useful antigens for vaccines or diagnostics.

Example 1070

A DNA sequence (GBSx1144) was identified in *S. agalactiae* <SEQ ID 3291> which encodes the amino acid sequence <SEQ ID 3292>. This protein is predicted to be histidyl-tRNA synthetase (hisS). Analysis of this protein sequence reveals the following:

Possible site: 32
>>> Seems to have no N-terminal signal sequence
----- Final Results -----
    bacterial cytoplasm --- Certainty = 0.4357 (Affirmative) <succ>
      bacterial membrane --- Certainty = 0.0000 (Not Clear) <succ>
        bacterial outside --- Certainty = 0.0000 (Not Clear) <succ>

A related GBS nucleic acid sequence <SEQ ID 10275> which encodes amino acid sequence <SEQ ID 10276> was also identified.

The protein has homology with the following sequences in the GENPEPT database.

```
>GP:CAA78919 GB:Z17214 histidine--tRNA ligase [Streptococcus equisimilis]
Identities = 327/404 (80%), Positives = 361/404 (88%)

Query:   32  WQYVENVIRNLFKQYHYDEIRTPMFEHYEVISRSVGDTTDIVTKEMYDFHDKGDRHITLR    91
             WQYVE V R  FKQYHY EIRTPMFEHYEVISRSVGDTTDIVTKEMYDF+DKGDRHITLR
Sbjct:    1  WQYVEGVARETFKQYHYGEIRTPMFEHYEVISRSVGDTTDIVTKEMYDFYDKGDRHITLR    60

Query:   92  PEGTAPVVRSYVENKLFAPEVQKPTKMYYIGSMFRYERPQAGRLREFHQVGVECFGSNNP   151
             PEGTAPVVRSYVENKLFAPEVQKP K+YYIGSMFRYERPQAGRLREFHQ+GVECFGS NP
Sbjct:   61  PEGTAPVVRSYVENKLFAPEVQKPVKLYYIGSMFRYERPQAGRLREFHQIGVECFGSANP   120

Query:  152  ATDVETIAMGHHLFEDLGIKNVKLHLNSLGNPESRQAYRQALIDYLTPIREQLSKDSQRR   211
             ATDVETIAM +HLFE LGIK V LHLNSLGN  SR AYRQALIDYL+P+R+ LSKDSQRR
Sbjct:  121  ATDVETIAMAYHLFERLGIKGVTLHLNSLGNAASRAAYRQALIDYLSPMRDTLSKDSQRR   180

Query:  212  LNENPLRVLDSKEPEDKLAVENAPSILDYLDESSQAHFDAVCHMLDALNIPYIIDTNMVR   271
             L+ENPLRVLDSKE EDK+AV NAPSILDY DE SQAHFDAV  ML+AL IPY+IDTNMVR
Sbjct:  181  LDENPLRVLDSKEKEDKIAVANAPSILDYQDEESQAHFDAVRSMLEALAIPYVIDTNMVR   240

Query:  272  GLDYYNHTIFEFITEIEDNELTICAGGRYDGLVSYFGGPETPAFGFGLGLERLLLILDKQ   331
             GLDYYNHTIFEFITE++ +ELTICAGGRYDGLV YFGGP TP FGFGLGLERLLLILDKQ
Sbjct:  241  GLDYYNHTIFEFITEVDQSELTICAGGRYDGLVEYFGGPATPGFGFGLGLERLLLILDKQ   300

Query:  332  GISLPIENTIDLYIAVLGSEANLAALDLAQSIRHQGFKVERDYLGRKIKAQFKSADTFNA   391
             G+ LP+E  +D+YIAVLG++AN+AAL L Q+IR QGF VERDYLGRKIKAQFKSADTF A
Sbjct:  301  GVELPVEEGLDVYIAVLGADANVAALALTQAIRRQGFTVERDYLGRKIKAQFKSADTFKA   360

Query:  392  KVIMTLGSSEVDSKEVGLKNNQTRQEVKVSFENIKTDFSSVLKQ                  435
             KV++TLG SE + +  LK+NQTRQE+ VSF+ I+TDF+S+  +
Sbjct:  361  KVVITLGESEIKAGQAVLKHNQTRQEMTVSFDQIQTDFASIFAE                  404
```

A related DNA sequence was identified in *S. pyogenes* <SEQ ID 3293> which encodes the amino acid sequence <SEQ ID 3294>. Analysis of this protein sequence reveals the following:

```
Possible site: 27
>>> Seems to have no N-terminal signal sequence
----- Final Results -----
   bacterial cytoplasm --- Certainty = 0.3183 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below.

```
Identities = 339/424(79%), Positives = 387/424(90%)
Query:  13  MKLQKPKGTQDILPGESAKWQYVENVIRNLFKQYHYDEIRTPMFEHYEVISRSVGDTTDI   72
            MKLQKPKGTQDILPG++AKWQYVE+V R+ F QY+Y EIRTPMFEHYEVISRSVGDTTDI
Sbjct:   1  MKLQKPKGTQDILPGDAAKWQYVESVARDTESQYNYGEIRTPMFEHYEVISRSVGDTTDI   60

Query:  73  VTKEMYDFHDKGDRHITLRPEGTAPVVRSYVENKLFAPEVQKPTKMYYIGSMFRYERPQA  132
            VTKEMYDF+DKGDRHITLRPEGTAPVVRSYVENKLEAPEVQKP K+YYIGSMFRYERPQA
Sbjct:  61  VTKEMYDFYDKGDRHITLRPEGTAPVVRSYVENKLEAPEVQKPVKLYYIGSMFRYERPQA  120

Query: 133  GRLREFHQVGVECFGSNNPATDVETIAMGHHLFEDLGIKNVKLHLNSLGNPESRQAYRQA  192
            GRLREFHQ+GVECFG+ NPATDVETIAM +HLFE LGIK+V LHLNSLG+PESR AYRQA
Sbjct: 121  GRLREFHQIGVECFGAANPATDVETIAMAYHLFEKLGIKDVTLHLNSLGSPESRAAYRQA  180

Query: 193  LIDYLTPIREQLSKDSQRRLNENPLRVLDSKEPEDKLAVENAPSILDYLDESSQAHFDAV  252
            LIDYLTP+R+QLSKDSQRRL+ENPLRVLDSKE EDKLAVE APSILDYLDE SQAHF+AV
Sbjct: 181  LIDYLTPMRDQLSKDSQRRLDENPLRVLDSKEKEDKLAVEKAPSILDYLDEESQAHFEAV  240

Query: 253  CHMLDALNIPYIIDTNMVRGLDYYNHTIFEFITEIEDNELTICAGGRYDGLVSYEGGPET  312
              ML+AL+IPY+IDTNMVRGLDYY+HTIFEFIT +E ++LTICAGGRYD LV YFGGPET
Sbjct: 241  KDMLEALDIPYVIDTNMVRGLDYYSHTIFEFITSVEGSDLTICAGGRYDSLVGYEGGPET  300

Query: 313  PAFGFGLGLERLLLILDKQGISLPIENTIDLYIAVLGSEANLAALDLAQSIRHQGFKVER  372
            P FGFGLGLERLL+I++KQGI+LPIE  +D+Y+AVLG  AN  AL+L Q+IR QGF  ER
Sbjct: 301  PGFGEGLGLERLLMIIEKQGITLPIETEMDIYLAVLGDGANSKALELVQAIRRQGFTAER  360

Query: 373  DYLGRKIKAQFKSADTFNAKVIMTLGSSEVDSKEVGLKNNQTRQEVKVSFENIKTDFSSV  432
            DYLGRKIKAQFKSADTF AK++MTLG SEV++ +  +KNN++RQEV+VSFE++ T+F+++
Sbjct: 361  DYLGRKIKAQFKSADTFKAKLVMTLGESEVEAGKAVIKNNRSRQEVEVSFEDMMTNFANI  420

Query: 433  LKQL  436
            +QL
Sbjct: 421  SEQL  424
```

Based on this analysis, it was predicted that these proteins and their epitopes could be useful antigens for vaccines or diagnostics.

```
   bacterial membrane --- Certainty = 0.0000 (Not Clear) <succ>
   bacterial outside --- Certainty = 0.0000 (Not Clear) <succ>
```

A related GBS nucleic acid sequence <SEQ ID 10273> which encodes amino acid sequence <SEQ ID 10274> was also identified.

The protein has homology with the following sequences in the GENPEPT database.

Example 1071

A DNA sequence (GBSx1145) was identified in *S. agalactiae* <SEQ ID 3295> which encodes the amino acid sequence <SEQ ID 3296>. This protein is predicted to be aspartyl-tRNA synthetase (aspS). Analysis of this protein sequence reveals the following:

```
Possible site: 29
>>> Seems to have no N-terminal signal sequence
----- Final Results -----
   bacterial cytoplasm --- Certainty = 0.5124 (Affirmative) <succ>
```

```
>GP:CAB14714 GB:Z99118 aspartyl-tRNA synthetase [Bacillus subtilis]
Identities = 339/585 (57%), Positives = 432/585 (72%), Gaps = 9/585 (1%)
Query:  20 RSMYAGRVRSEHIGTSITLKGWVGRRRDLGGLIFIDLRDREGIMQLVINPEEVSASVMAT    79
            R+ Y G +  + IG S+TLKGWV +RRDLGGLIFIDLRDR GI+Q+V NP+ VS    +A
Sbjct:   4 RTYYCGDITEKAIGESVTLKGWVQKRRDLGGLIFIDLRDRTGIVQVVFND-VSKEALAI    62

Query:  80 AESLRSEFVIEVSGVVTAREQA--NDNLPTGEVELKVQELSILNTSKTTPFEIKDGIE-A   136
            AE +R+E+V+++ G V ARE+    N NL TG +E+    +++LN +KT PF I D  E
Sbjct:  63 AEGIRNEYVLDIQGKVVAREEGTVNPNLKTGAIEIHADGVNVLNAAKTPPFAISDQAEEV   122

Query: 137 NDDTRMRYRYLDLRRPEMLENFKLRAKVTHSIRNYLDNLEFIDVETPMLTKSTPEGARDY   196
            ++D R+++RYLDLRRP M +  +LR  VT ++R++LD   F+D+ETP+LT STPEGARDY
Sbjct: 123 SEDVRLKHRYLDLRRPAMFQTMQLRHNVTKAVRSFLDENGFLDIETPILTGSTPEGARDY   182

Query: 197 LVPSRVNQGHFYALPQSPQITKQLLMNAGFDRYYQIVKCFRDEDLRGDRQPEFTQVDLET   256
            LVPSRV++G FYALPQSPQ+ KQLLM +G +RYYQI +CFRDEDLR DRQPEFTQ+D+E
Sbjct: 183 LVPSRVHEGEFYALPQSPQLFKQLLMVSGIERYYQIARCFRDEDLRADRQPEFTQIDIEM   242

Query: 257 SFLSDQEIQDIVEGMIAKVMKDTKGLEVSLPFPRMAYDDAMNNYGSDKPDTRFDMLLQDL   316
            SF+S  ++I +  E M+AKVM++TKG E+ LP PRM YD+AMN YGSDKPDTRFDMLL D+
Sbjct: 243 SFMSQEDIMSLAEEMMAKVMRETKGEELQLPLPRMTYDEAMNKYGSDKPDTRFDMLLTDV   302

Query: 317 TEIVKEVDFKVFSEA----SVVKAIVVKDKADKYSRKNIDKLTEIAKQYGAKGLAWLKYA   372
            ++IVK+ +FKVFS A     VVKAI VK A  YSRK+ID L    A YGAKGLAW+K
Sbjct: 303 SDIVKDTEFKVFSSAVANGGVVKAINVKGGAGDYSRKDIDALGAFAANYGAKGLAWVKVE   362

Query: 373 DNTISGPVAKFL-TAIEGRLTEALQLENNDLILFVADSLEVANETLGALRTRIAKELELI   431
             + + GP+AKF   + +L EAL    DL+LF AD  EV   +LGALR ++ KE  LI
Sbjct: 363 ADGVKGPIAKFFDEEKQSKLIEALDAAEGDLLLFGADQFEVVAASLGALRLKLGKERGLI   422

Query: 432 DYSKFNFLWVVDWPMFEWSEEEGRYMSAHHPFTLPTAETAHELEGDLAKVRAVAYDIVLN   491
            D    FNFLWV+DWP+ E    EEGR+ +AHHPFT+P  E    +E    ++A AYD+VLN
Sbjct: 423 DEKLFNFLWVIDWPLLEHDPEEGRFYAAHHPFTMPVREDLELIETAPEDMKAQAYDLVLN   482

Query: 492 GYELGGGSLRINQKDTQERMFKALGFSAESAQEQFGFLLEAMDYGFPPHGGLAIGLDRFV   551
            GYELGGGS+RI +KD QE+MF   LGFS E A  EQFGFLLEA +YG PPHGG+A+GLDR V
Sbjct: 483 GYELGGGSIRIFEKDIQEKMFALLGFSPEEAAEQFGFLLEAFEYGAPPHGGIALGLDRLV   542

Query: 552 MLLAGKDNIREVIAFPKNNKASDPMTQAPSLVSEQQLEELSLTVE                596
            MLLAG+ N+R+ IAFPK   AS  MT+AP  VS+ QL+EL L+++
Sbjct: 543 MLLAGRTNLRDTIAFPKTASASCLMTEAPGEVSDAQLDELHLSIK                587
```

A related DNA sequence was identified in *S. pyogenes* <SEQ ID 3297> which encodes the amino acid sequence <SEQ ID 3298>. Analysis of this protein sequence reveals the following:

Possible site: 23
>>> Seems to have an uncleavable N-term signal seq

----- Final Results -----
  bacterial membrane --- Certainty = 0.0000 (Not Clear) <succ>
  bacterial outside --- Certainty = 0.0000 (Not Clear) <succ>
  bacterial cytoplasm --- Certainty = 0.0000 (Not Clear) <succ>

An alignment of the GAS and GBS proteins is shown below.

```
Identities = 495/582 (85%), Positives = 538/582 (92%)
Query:  18 MKRSMNAGRVRSEHIGTSITLKGWVGRRRDLGGLIFIDLRDREGIMQLVINPEEVSASVM    77
           MKRSM AGRVR EHIGT+ITLKGWV RRRDLGGLIFIDLRDREG+MQLVINPEEVS+ VM
Sbjct:  18 MKRSMYAGRVREEHIGTTITLKGWVSRRRDLGGLIFIDLRDREGVMQLVINPEEVSSDVM    77

Query:  78 ATAESLRSEFVIEVSGVVTAREQANDNLPTGEVELKVQELSILNTSKTTPFEIKDGIEAN   137
           ATAE LRSE+VIEV G V AR+QAND L TG VELKV  L+ILNT+KTTPFEIKD +E +
Sbjct:  78 ATAERLRSEYVIEVEGFVEARQQANDKLATGMVELKVSALTILNTAKTTPFEIKDDVEVS   137

Query: 138 DDTRMRYRYLDLRRPEMLENFKLRAKVTHSIRNYLDNLEFIDVETPMLTKSTPEGARDYL   197
           DDTR+RYRYLDLRRPEMLENFKLRAKVTHSIRNYLD+LEFIDVETPMLTKSTPEGARDYL
Sbjct: 138 DDTRLRYRYLDLRRPEMLENFKLRAKVTHSIRNYLDDLEFIDVETPMLTKSTPEGARDYL   197

Query: 198 VPSRVNQGHFYALPQSPQITKQLLMNAGFDRYYQIVKCFRDEDLRGDRQPEFTQVDLETS   257
           VPSRV+QGHEYALPQSPQITKQLLMNAGFDRYYQIVKCFRDEDLRGDRQPEFTQVDLETS
Sbjct: 198 VPSRVSQGHEYALPQSPQITKQLLMNAGFDRYYQIVKCFRDEDLRGDRQPEFTQVDLETS   257

Query: 258 FLSDQEIQDIVEGMIAKVMKDTKGLEVSLPFPRMAYDDAMNNYGSDKPDTRFDMLLQDLT   317
           FLS+QEIQDIVEGMIAKVMK+TK  ++V+LPFPRM+YD AMN+YGSDKPDTRF+MLLQDLT
Sbjct: 258 FLSEQEIQDIVEGMIAKVMKETKEIDVTLPFPRMSYDVAMNSYGSDKPDTRFEMLLQDLT   317

Query: 318 EIVKEVDEKVESEASVVKAIVVKDKADKYSRKNIDKLTEIAKQYGAKGLAWLKYADNTIS   377
             VK  DFKVFSEA VKAIVVK AD+YSRK+IDKLTE AKQ+GAKGLAW+K  D  ++
Sbjct: 318 VTVKGNDEKVESEAPAVKAIVVKGNADRYSRKDIDKLTEFAKQFGAKGLAWVKVTDGQLA   377
```

-continued

```
Query:  378  GPVAKFLTAIEGRLTEALQLENNDLILEVADSLEVANETLGALRTRIAKELELIDYSKFN  437
             GPVAKFLTAIE  L+  L+L  NDL+LFVAD+LEVAN TLGALR RIAK+L++ID S+FN
Sbjct:  378  GPVAKFLTAIETELSSQLKLAENDLVLEVADTLEVANNTLGALRNRIAKDLDMIDQSQFN  437

Query:  438  FLWVVDWPMFEWSEEEGRYMSAHHPFTLPTAETAHELEGDLAKVRAVAYDIVLNGYELGG  497
             FLWVVDWPMFEWSEEEGRYMSAHHPFTLPT E+AHELEGDLAKVRA+AYDIVLNGYELGG
Sbjct:  438  FLWVVDWPMFEWSEEEGRYMSAHHPFTLPTPESAHELEGDLAKVRAIAYDIVLNGYELGG  497

Query:  498  GSLRINQKDTQERMFKALGFSAESAQEQFGELLEAMDYGFPPHGGLAIGLDRFVMLLAGK  557
             GSLRINQK+ QERMFKALGF+A+ A +QFGELLEAMDYGFPPHGGLAIGLDRFVMLLAGK
Sbjct:  498  GSLRINQKEMQERMFKALGFTADEANDQFGELLEAMDYGFPPHGGLAIGLDRFVMLLAGK  557

Query:  558  DNIREVIAFPKNNKASDPMTQAPSLVSEQQLEELSLTVESYE                   599
             DNIREVIAFPKNNKASDPMTQAPSLVSE QLEELSL +ES++
Sbjct:  558  DNIREVIAFPKNNKASDPMTQAPSLVSENQLEELSLQIESHD                   599
```

Based on this analysis, it was predicted that these proteins and their epitopes could be useful antigens for vaccines or diagnostics.

Example 1072

A DNA sequence (GBSx1146) was identified in *S. agalactiae* <SEQ ID 3299> which encodes the amino acid sequence <SEQ ID 3300>. Analysis of this protein sequence reveals the following:

---

Possible site: 54
>>> Seems to have no N-terminal signal sequence
INTEGRAL    Likelihood = −8.44    Transmembrane 186-202 (182-205)
INTEGRAL    Likelihood = −5.68    Transmembrane 88-104 (86-106)
INTEGRAL    Likelihood = −3.40    Transmembrane 115-131 (112-132)
INTEGRAL    Likelihood = −2.13    Transmembrane 141-157 (141-157)
INTEGRAL    Likelihood = −0.96    Transmembrane 43-59 (43-59)
----- Final Results -----
    bacterial membrane --- Certainty = 0.4376 (Affirmative) <succ>
        bacterial outside --- Certainty = 0.0000 (Not Clear) <succ>
            bacterial cytoplasm --- Certainty = 0.0000 (Not Clear) <succ>

---

The protein has homology with the following sequences in the GENPEPT database.

```
>GP:CA812952 GB:Z99109 alternate gene name: yuxA~similar to hypothetical
proteins [Bacillus subtilis]

Identities = 104/275 (37%), Positives = 181/275 (65%), Gaps = 1/275 (0%)
Query:   39  EKISASLLYGILSSVAVNFFFQPGHVYSSGATGLAQVISAVSKHWFSFEIPVALAFYAIN   98
             +K+   ++  +L++  +N F  P   VY+SG TG+AQ++S+V   + F I      + +N
Sbjct:    7  KKLLIVIIGALLNAAGLNLFLIPADVYASGFTGVAQLLSSVVDQYAPFYISTGTLLFLLN   66

Query:   99  IPLLILSWRKIGHKFTIFTFITITVSSIFIQLMPQITLTTDPLINAIFGGLIMGAGVGFS  158
             IP+  IL W K+G   FT+++  ++V ++++F+  ++P+  +L+ D  L+NA+FGG+I    G+G +
Sbjct:   67  IPVGILGWLKVGKSFTVYSILSVALTTLFMGILPETSLSHDILLNAVFGGVISAVGIGLT  126

Query:  159  FKSRISSGGTDIISLTIRKKTGRDVGSISFIINGIILLFAGLLFGWKYALYSMVTIFVSS  218
                 K    S+GG DI+++  + K    + VG+  FI+NGII+L AGLL GW+  ALY++VT++V++
Sbjct:  127  LKYGASTGGLDIVAMVLAKWKDKPVGTYFFILNGIIILTAGLLQGWEKALYTLVTLYVTT  186

Query:  219  RVTDAIFTKQKKMQAMIVTSKPYCVIKRIHRDLHRGVTCINDAEGTYNHEKKAVLITILT  278
             RV DAI T+  K+ AMIVT K   + +  I+   + RG+T +   A+G + +E+K ++I ++T
Sbjct:  187  RVIDAIHTRHMKLTAMIVTKKADEIKEAIYGKMVRGITTV-PAKGAFTNEQKEMMIIVIT  245

Query:  279  REEFSDFKYLMLKADPKAFVSVAENVHIIGRFVDD                          313
             R E  D + ++  + DPKAF ++ +       I G F   D
Sbjct:  246  RYELYDLEKIVKEVDPKAFTNIVQTTGIFGFFRKD                          280
```

A related DNA sequence was identified in *S. pyogenes* <SEQ ID 3301> which encodes the amino acid sequence <SEQ ID 3302>. Analysis of this protein sequence reveals the following:

---

Possible site: 53
>>> Seems to have no N-terminal signal sequence
INTEGRAL    Likelihood = −5.47    Transmembrane 87-103 (86-106)
INTEGRAL    Likelihood = −4.94    Transmembrane 185-201 (182-203)
INTEGRAL    Likelihood = −1.59    Transmembrane 114-130 (113-130)
INTEGRAL    Likelihood = −1.12    Transmembrane 42-58 (42-58)
INTEGRAL    Likelihood = −0.32    Transmembrane 140-156 (140-156)
----- Final Results -----
    bacterial membrane --- Certainty = 0.3187 (Affirmative) <succ>
        bacterial outside --- Certainty = 0.0000 (Not Clear) <succ>
            bacterial cytoplasm --- Certainty = 0.0000 (Not Clear) <succ>

---

The protein has homology with the following sequences in the databases:

```
>GP:CAA66894 GB:X98238 orf2 [Lactobacillus sakei]
Identities = 105/280 (37%), Positives = 180/280 (63%), Gaps = 7/280 (2%)
Query:  37 AEKISASLLYGILSSIAVNFFFQPGHVYSSGATGLAQVFSAL-SHRLLGYDFPIAFAFYL    95
              +++I  +++YG L++++VN F  P   YSSG TG+AQ+ +AL SH  LG   +A   ++
Sbjct:   8 SKRIVIAMVYGFLAAVSVNLFLIPAKTYSSGVTGVAQLLTALVSH--LGGSLSVAALVFI    65

Query:  96 INIPLLILAWYKIGHQFTIFTFITVSMSSFFIQIMPQVT--LTTDPLINAIFGGLVMGMG   153
              +N+PLL+LAW+KI HQ+ IF+ + V  S  F++I+P    + T+   A+FGG ++G+G
Sbjct:  66 LNVPLLVLAWFKINHQYAIFSIVAVFTSVIFLKIIPVPVQPILTERFAGALFGGALIGLG   125

Query: 154 IGTGLKSRISSGGTDIVSLTLRKRTGKDVGSLSLMVNGAILAFAGILFGWQYALYSMVSI   213
              +G   ++  S+GGTD++   + + TGK VG+++ ++NG I+   AGI  FGW  ALYS+V I
Sbjct: 126 VGLCFRAGFSTGGTDVIVTLVGRLTGKRVGAVNNVINGMIILAAGIFFGWGAALYSIVEI   185

Query: 214 FVSSRVTDAIFTKQKKMQATIVTSHPERVIHMIHKRLHRGVTSINDAEGTYKHEQKAVLI   273
              FVSS + D I+T+Q+K+   TI T  PE +    + + +H G T + D  G Y +++ +V++
Sbjct: 186 FVSSLLMDYIYTQQQKVTVTIFTKQPEALKERMREFIH-GATEL-DGTGLYTNQETSVIM   243

Query: 274 TILTCEEYPEFKWLMLKTDPQAFVSVAENVRIIGRFVEDD                       313
              T+++  +     K ++    DP AFV++   + + GRF  ++
Sbjct: 244 TVVSKYDLTALKLVVQDADPNAFVNIQSTMNLWGRFESNE                       283
```

An alignment of the GAS and GBS proteins is shown below.

```
Identities = 239/311 (76%), Positives = 274/311 (87%)
Query:   4 RRTPLEKKVKYIISVWAKKFGLLHTLKSISREKYAEKISASLLYGILSSVAVNFFFQPGH    63
              ++T  +KKVKY+IS  AKK GLLH L+SISREKYAEKISASLLYGILSS+AVNFFFQPGH
Sbjct:   3 KKITYKKKVKYVISRGAKKVGLLHALRSISREKYAEKISASLLYGILSSIAVNFFFQPGH    62

Query:  64 VYSSGATGLAQVISAVSKHWFSFEIPVALAFYAINIPLLILSWRKIGHKFTIFTFITVTV   123
              VYSSGATGLAQV SA+S     ++ P+A AFY INIPLLIL+W KIGH+FTIFTFITV++
Sbjct:  63 VYSSGATGLAQVFSALSHRLLGYDFPIAFAFYLINIPLLILAWYKIGHQFTIFTFITVSM   122

Query: 124 SSIFIQLMPQIILTTDPLINAIFGGLIMGAGVGFSFKSRISSGGTDIISLTIRKKTGRDV   183
              SS FIQ+MPQ+TLTTDPLINAIFGGL+MG G+G    KSRISSGGTDI+SLT+RK+TG+DV
Sbjct: 123 SSFFIQIMPQVTLTTDPLINAIFGGLVMGMGIGTGLKSRISSGGTDIVSLTLRKRTGKDV   182

Query: 184 GSISFIINGIILLFAGLLFGWKYALYSMVTIFVSSRVTDAIFTKQKRMQAMIVTSKPYCV   243
              GS+S+ ++NG IL  FAG+LFGW+YALYSMV+IFVSSRVTDAIFTKQKRMQA IVTS P  V
Sbjct: 183 GSLSLMVNGAILAFAGILFGWQYALYSMVSIFVSSRVTDAIFTKQKKMQATIVTSHPERV   242

Query: 244 IKRIHRDLHRGVTCINDAEGTYNHEKKAVLITILTREEFSDFKYLMLKADPKAFVSVAEN   303
              I  IH+ LHRGVT INDAEGTY HE+KAVLITILT EE+  +FK+LMLK DP+AFVSVAEN
Sbjct: 243 IHMIHKRLHRGVTSINDAEGTYKHEQKAVLITILTCEEYPEFKWLMLKTDPQAFVSVAEN   302

Query: 304 VHIIGRFVDDD                                                    314
              V IIGRFV+DD
Sbjct: 303 VRIIGRFVEDD                                                    313
```

Based on this analysis, it was predicted that these proteins and their epitopes could be useful antigens for vaccines or diagnostics.

Example 1073

A DNA sequence (GBSx1147) was identified in *S. agalactiae* <SEQ ID 3303> which encodes the amino acid sequence <SEQ ID 3304>. Analysis of this protein sequence reveals the following:

Possible site: 26
>>> Seems to have a cleavable N-term signal seq.

-continued

| INTEGRAL | Likelihood = −3.72 | Transmembrane 156-172 (156-174) |
| INTEGRAL | Likelihood = −3.03 | Transmembrane 112-128 (110-129) |
| INTEGRAL | Likelihood = −2.34 | Transmembrane 80-96 (79-96) |
| INTEGRAL | Likelihood = −1.49 | Transmembrane 60-76 (58-76) |

----- Final Results -----
  bacterial membrane --- Certainty = 0.2487 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

```
>GP:BAB05397 GB:AP001512 unknown conserved protein [Bacillus halodurans]
Identities = 113/278 (40%), Positives = 192/278 (68%), Gaps = 1/278 (0%)
Query:   7 KTKIKETILIAFGVALYTFGFVKFNMANHLAEGGISGVTLIIHALFGVNPALSSLLLNIP    66
              +  K K  + I  G A+++FG V FNM N+LAEGG +G+TLI++  +F +NPA+++L+LNIP
Sbjct:   4 RLKWKNIVFILLGSAIFSFGLVYFNMENNLAEGGFTGITLILYFMFQINPAVTNLVLNIP    63

Query:  67 LFILGARILGKKSLLLTIYGTVLMSFFMWFWQQIP-VTVPLKNDMMLVAVAAGILAGTGS   125
              + ++G +ILG+ +L+ TI GTV +S F+  +Q+    + +PL +DM L A+ AG+   GTG
Sbjct:  64 ILLIGWKILGRVTLIYTIIGTVSVSVFLEMFQRWKFMDIPLHDDMTLAALFAGVFVGTGL   123
```

```
                         -continued
Query: 126  GLVFRYGATTGGADIIGRIVEEKSGIKLGQTLLFIDAIVLTSSLVYINLQQMLYTLVASF  185
            G+VFR+G TTGG DII ++    G  +G+T+   DA+V+ SSL+Y+N ++ +YTL+A F
Sbjct: 124  GIVFRFGGTTGGVDIIARLGFRYLGWSMGKTMFMFDAVVIASSLIYLNYREAMYTLLAVF  183

Query: 186  VFSQVLTNVENGGYTVRGMIIITKESESAAATILHEINRGVTFLRGQGAYSGREHDVLYV  245
            + ++V+  ++    Y+ +   II++ +E+ A TIL E+ RG T L+G+G+++G E ++LY
Sbjct: 184  IAAKVIDFIQQTAYSAKAAFIISEHTEAIADTILKEMERGATTLKGKGSFTGTEKEILYC  243

Query: 246  ALNPSEVRDVKEIMADLDPDAFISVINVDEVISSDFKI  283
             +   +E+  +K ++  +DP AF++V +V +VI   F +
Sbjct: 244  VVGRNELIRLKSLVERIDPHAFVTVNDVQDVIGEGFTL  281
```

A related DNA sequence was identified in *S. pyogenes* <SEQ ID 3305> which encodes the amino acid sequence <SEQ ID 3306>. Analysis of this protein sequence reveals the following:

```
Possible site: 26
>>> Seems to have a cleavable N-term signal seq.
INTEGRAL     Likelihood = -5.15    Transmembrane 112-128 (109-130)
INTEGRAL     Likelihood = -2.34    Transmembrane 156-172 (156-174)
INTEGRAL     Likelihood = -1.81    Transmembrane 178-194 (177-194)
INTEGRAL     Likelihood = -1.65    Transmembrane 80-96 (79-96)
INTEGRAL     Likelihood = -0.37    Transmembrane 60-76 (59-76)
----- Final Results -----
   bacterial membrane --- Certainty = 0.3060 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP:BAB05397 GB:AP001512 unknown conserved protein [Bacillus halodurans]
Identities = 116/276 (42%), Positives = 182/276 (65%), Gaps = 1/276 (0%)
Query:   9  KLLKLFLIALGVAIYTFGFVNFNMANALAEGGVAGITLILHAHFGINPAYSSLLFNLPLF   68
            K   +  I LG AI++FG V FNM N LAEGG  GITLIL+  F INPA ++L+ N+P+
Sbjct:   6  KWKNIVFILLGSAIFSFGLVYFNMENNLAEGGFIGITLILYFMFQINPAVTNLVLNIPIL   65

Query:  69  ILGAKIFGKRSLALTIYGTVLMSAFIWMWQKVP-IELGLENDMMLVAVVAGLFSGIGSGI  127
            ++G KI G+ +L   TI GTV +S F+ M+Q+   +++ L +DM L A+ AG+F G G GI
Sbjct:  66  LIGWKILGRVTLIYTIIGTVSVSVFLEMFQRWKFMDIPLHDDMTLAALFAGVFVGIGLGI  125

Query: 128  VFRYGATIGGTDIIGRIAEEKFGAKLGQTLLLVDALVLTASLTYVDLKHMLYTLVASFVF  187
            VFR+G TTGG DII ++       G  +G+T+ + DA+V+ +SL Y++ +  +YTL+A F+
Sbjct: 126  VFRFGGTTGGVDIIAKLGFRYLGWSMGKTMFMFDAVVIASSLIYLNYREAMYTLLAVFIA  185

Query: 188  SQMISVVQNGGYTIRGMIIITKHSEAAAQAILTEINRGVTYLKGQGAYSGNDYNIMYVTL  247
            +++I  +Q    Y+ +   II++H+EA A  IL E+ RG T LKG+G+++G +  I+Y  +
Sbjct: 186  AKVIDFIQQTAYSAKAAFIISEHTEAIADTILKEMERGATTLKGKGSFIGTEKEILYCVV  245

Query: 248  NPTEVREVKRILAGLDPDAFISIIDVDEVISSDFKI  283
                E+  +K ++  +DP AF+++ DV +VI   F +
Sbjct: 246  GRNELIRLKSLVERIDPHAFVTVNDVQDVIGEGFTL  281
```

An alignment of the GAS and GBS proteins is shown below.

```
Identities = 206/286 (72%), Positives = 250/286 (87%)
Query:   5  DLKTKIKETILIAFGVALYTFGFVKFNMANHLAEGGISGVTLIIHALFGVNPALSSLLLN   64
            D  TK+ + LIA GVA+YTFGFV FNMAN LAEGG++G+TLI+HA FG+NPA SSLL N
Sbjct:   5  DKLTKLLKLFLIALGVAIYTFGFVNFNMANALAEGGVAGITLILHAHFGINPAYSSLLFN   64

Query:  65  IPLFILGARILGKKSLLLTIYGTVLMSFFMWFWQQIPVTVPLKNDMMLVAVAAGILAGTG  124
            +PLFILGA+I GK+SL LTIYGTVLMS F+W WQ++P+ + L+NDMMLVAV AG+ +G G
Sbjct:  65  LPLFILGAKIFGKRSLALTIYGTVLMSAFIWMWQKVPIELGLENDMMLVAVVAGLFSGIG  124

Query: 125  SGLVFRYGATTGGADIIGRIVEEKSGIKLGQTLLFIDAIVLTSSLVYINLQQMLYTLVAS  184
            SG+VFRYGATTGG DIIGRI EEK G KLGQTLL +DA+VLT+SL Y++L+ MLYTLVAS
Sbjct: 125  SGIVFRYGATTGGTDIIGRIAEEKFGAKLGQTLLLVDALVLTASLTYVDLKHMLYTLVAS  184

Query: 185  FVFSQVLTNVENGGYTVRGMIIITKESESAAATILHEINRGVTFLRGQGAYSGREHDVLY  244
```

```
                              -continued
              FVFSQ+++ V+NGGYT+RGMIIITK SE+AA   IL EINRGVT+L+GQGAYSG +++++Y
Sbjct:  185   FVFSQMISVVQNGGYTIRGMIIITKHSEAAAQAILTEINRGVTYLKGQGAYSGNDYNIMY      244

Query:  245   VALNPSEVRDVKEIMADLDPDAFISVINVDEVISSDFKIRRRNYDK                      290
              V LNP+EVR+VK I+A LDPDAFIS+I+VDEVISSDFKIRRRNYDK
Sbjct:  245   VTLNPTEVREVKRILAGLDPDAFISIIDVDEVISSDFKIRRRNYDK                      290
```

Based on this analysis, it was predicted that these proteins and their epitopes could be useful antigens for vaccines or diagnostics.

Example 1074

A DNA sequence (GBSx1148) was identified in *S. agalactiae* <SEQ ID 3307> which encodes the amino acid sequence <SEQ ID 3308>. This protein is predicted to be BacB protein. Analysis of this protein sequence reveals the following:

---

Possible site: 60
>>> Seems to have no N-terminal signal sequence
----- Final Results -----
   bacterial cytoplasm --- Certainty = 0.4355 (Affirmative) <succ>
     bacterial membrane --- Certainty = 0.0000 (Not Clear) <succ>
       bacterial outside --- Certainty = 0.0000 (Not Clear) <succ>

---

The protein has homology with the following sequences in the GENPEPT database.

```
>GP:BAA11330 GB:D78257 BacB [Enterococcus faecalis]
Identities = 27/88 (30%), Positives = 48/88 (53%), Gaps = 1/88 (1%)
Query:  1    MPSEKEILDALSKVYSEEVIQADDYFRQAIFELASQLEKEGMN-SLLATKIDSLINQYVL     59
             M  ++E+LD LSK Y++  I   +  +FE A +L        N   + K+ ++ ++Y+
Sbjct:  1    MDKQQELLDLLSKAYNDPKINEYEGLKDKLFECAKRLTTNETNIGEVCYKLSTINSEYLA     60

Query:  60   THQFDAPKSIFDLSRLVKTKASHYKGTA                                       87
              H F+ PKSI +L + V +    Y+G A
Sbjct:  61   RHHFEMPKSIIELQKFVTKEGQKYRGWA                                       88
```

A related DNA sequence was identified in *S. pyogenes* <SEQ ID 3309> which encodes the amino acid sequence <SEQ ID 3310>. Analysis of this protein sequence reveals the following:

---

Possible site: 27
>>> Seems to have no N-terminal signal sequence
----- Final Results -----
   bacterial cytoplasm --- Certainty = 0.2712 (Affirmative) <succ>
     bacterial membrane --- Certainty = 0.0000 (Not Clear) <succ>
       bacterial outside --- Certainty = 0.0000 (Not Clear) <succ>

---

An alignment of the GAS and GBS proteins is shown below.

```
Identities = 99/102 (97%), Positives = 102/102 (99%)

Query:  1    MPSEKEILDALSKVYSEEVIQADDYFRQAIFELASQLEKEGMNSLLATKIDSLINQYVLT     60
             MPSEKEILDALSKVYSE+VIQADDYFRQAIFELASQLEKEGM+SLLATKIDSLINQY+LT
Sbjct:  7    MPSEKEILDALSKVYSEQVIQADDYFRQAIFELASQLEKEGMSSLLATKIDSLINQYILT     66

Query:  61   HQFDAPKSIFDLSRLVKTKASHYKGTAISAIMLGSFLSGGPK                         102
             HQFDAPKSIFDLSRLVKTKASHYKGTAISAIMLGSFLSGGPK
Sbjct:  67   HQFDAPKSIFDLSRLVKTKASHYKGTAISAIMLGSFLSGGPK                         108
```

Based on this analysis, it was predicted that these proteins and their epitopes could be useful antigens for vaccines or diagnostics.

Example 1075

A DNA sequence (GBSx1149) was identified in *S. agalactiae* <SEQ ID 3311> which encodes the amino acid sequence <SEQ ID 3312>. This protein is predicted to be ArgS (argS). Analysis of this protein sequence reveals the following:

---

Possible site: 57
>>> Seems to have no N-terminal signal sequence
----- Final Results -----
   bacterial cytoplasm --- Certainty = 0.2522 (Affirmative) <succ>
     bacterial membrane --- Certainty = 0.0000 (Not Clear) <succ>
       bacterial outside --- Certainty = 0.0000 (Not Clear) <succ>

---

A related GBS nucleic acid sequence <SEQ ID 10271> which encodes amino acid sequence <SEQ ID 10272> was also identified.

The protein has homology with the following sequences in the GENPEPT database.

```
>GP:AAF86984 GB:AF282249 ArgS [Lactococcus lactis subsp. lactis]
Identities = 377/566 (66%), Positives = 464/566 (81%), Gaps = 5/566 (0%)
Query:  12  MDTKHLIASEIQKVVPD-MEQSTILSLLETPKNSSMGDLAFPAFSLAKTLRKAPQIIASD    70
            MD K L++  +    +   I +++E PK+S +GDLAFPAF LAKTLRK+PQIIA +
Sbjct:   1  MDEKQLVSQALSAAIDGVLGVEQIAAIIEKPKSSDLGDLAFPAFQLAKTLRKSPQIIAGE    60

Query:  71  IAEQIKSDQFEKVEAVGPYVNFFLDKAAISSQVLKQVLSDGSAYATQNIGEGRNVAIDMS   130
            IAE+I +   FEKV AVGPYVNFFLDK A +S+V+++VL++G  Y    NIGEG NV IDMS
Sbjct:  61  IAEKIDTKGFEKVIAVGPYVNFFLDKNATASEVIREVLAEGEHYGDANIGEGGNVPIDMS   120

Query: 131  SPNIAKPFSIGHLRSTVIGDSLANIFDKIGYHPVKINHLGDWGKQFGMLIVAYKKWGNEE   190
            +PNIAKPFSIGHLRSTVIGDS+A  I++K+GY P+KINHLGDWGKQFG+LI AYKK+G+E
Sbjct: 121  APNIAKPFSIGHLRSTVIGDSIAKIYEKLGYQPIKINHLGDWGKQFGLLITAYKKYGDEA   180

Query: 191  AMRAHPIDELLKLYVRINAEAETDPSVDEEAREWFRKLEANDPEATELWQWFRDESLLEF   250
             + A+PIDELLKLYV+INAEA+ D  VDEE R+WF K+E  D EA  +W+WF D SL+EF
Sbjct: 181  TITANPIDELLKLYVKINAEAKEDSEVDEEGRQWFLKMEQGDEEALRIWKWFSDVSLIEF   240

Query: 251  NRLYDQMNVTFDSYNGEAFYNDKMDEVLELLESKNLLVESKGAQVVNLEKYGIEHPALIK   310
            NR+Y ++ VTFD + GE+FY+DKMD ++E LE+KNLL ESKGA +V+LEKY + +PALIK
Sbjct: 241  NRIYGKLGVTFDHFMGESFYSDKMDAIVEDLENKNLLHESKGALIVDLEKYNL-NPALIK   299

Query: 311  KSDGATLYITRDLAAALYRKRTYDFAKSIYVVGNEQSAHFKQLKAVLKEMDYDWSDDMTH   370
            K+DGATLYITRDLA A  YRK+T++F KS+YVVG EQ+  HFKQLKAVLKE   YDWSDDM H
Sbjct: 300  KTDGATLYITRDLATAAYRKKTFNFVKSLYVVGGEQTNHFKQLKAVLKEAGYDWSDDMVH   359

Query: 371  VPFGLVTKGGAKLSTRKGNVILLEPTVAEAINRAASQIEAKNPNLADKDKVAQAVGVGAI   430
            VPFG+VT+GG K STRKG+V+ LE   + EA++RA  QIEAKNPNL +K++VA+ VGVGA+
Sbjct: 360  VPFGMVTQGGKKFSTRKGHVVELEMALDEAVDRAEKQIEAKNPNLENKEEVAKQVGVGAV   419

Query: 431  KFYDLKTDRTNGYDFDLEAMVSFEGETGPYVQYAHARIQSILRKANFSPSNSDNYSL--N   488
            KFYDLKTDR NGYDFDL+ MVSFEGETGPYVQYAHARIQSILRKAN     N DN SL  +
Sbjct: 420  KFYDLKTDRNNGYDFDLDEMVSFEGETGPYVQYAHARIQSILRKAN-RKVNIDNISLVVS   478

Query: 489  DVESWEIIKLIQDFPRIIVRAADNFEPSIIAKFAINLAQCFNKYYAHTRILDEDAEISSR   548
            D E+WEI+K +++FP I+ RAADN+EPSIIAK+AI+LAQ FNKYYAH RIL++DA++  R
Sbjct: 479  DAEAWEIVKALKEFPNIVRRAADNYEPSIIAKYAISLAQAFNKYYAHVRILEDDAQLDGR   538

Query: 549  LALCYATATVLKESLRLLGVDAPNEM                                    574
            LAL  AT+ VLKE+LRLLGV AP M
Sbjct: 539  LALISATSIVLKEALRLLGVAAPENM                                    564
```

A related DNA sequence was identified in *S. pyogenes* <SEQ ID 3313> which encodes the amino acid sequence <SEQ ID 3314>. Analysis of this protein sequence reveals the following:

Possible site: 46
>>> Seems to have no N-terminal signal sequence

----- Final Results -----
bacterial cytoplasm --- Certainty = 0.1734 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 492/563 (87%), Positives = 526/563 (93%)
Query:  12  MDTKHLIASEIQKVVPDMEQSTILSLLETPKNSSMGDLAFPAFSLAKTLRKAPQIIASDI    71
            MDTK LIASEI  KVVP++EQ   I +LLETPKNS MGDLAFPAFSLAK LRKAPQ+IAS++
Sbjct:   1  MDTKTLIASEIARVVPELEQDAIFNLLETPKNSDMGDLAFPAFSLAKVLRKAPQMIASEL    60

Query:  72  AEQIKSDQFEKVEAVGPYVNFFLDKAAISSQVLKQVLSDGSAYATQNIGEGRNVAIDMSS   131
            AEQI    QFEKV AVGPY+NFFLDKA ISSQVL+QV++  GS YA Q+  G+GRNVAIDMSS
Sbjct:  61  AEQIDESQFEKVVAVGPYINFFLDKAKISSQVLEQVITAGSDYAQQDEGQGRNVAIDMSS   120

Query: 132  PNIAKPFSIGHLRSTVIGDSLANIFDKIGYHPVKINHLGDWGKQFGMLIVAYKKWGNEEA   191
            PNIAKPFSIGHLRSTVIGDSLA+IF K+GY PVKINHLGDWGKQFGMLIVAYKKWG+E A
Sbjct: 121  PNIAKPFSIGHLRSTVIGDSLAHIFAKMGYKPVKINHLGDWGKQFGMLIVAYKKWGDEAA   180

Query: 192  VRAHPIDELLKLYVRINAEAETDPSVDEEAREWFRKLEANDPEATELWQWFRDESLLEFN   251
            V+AHPIDELLKLYVRINAEAETDP+VDEEAREWFRKLE D EATELWQWFRDESLLEFN
Sbjct: 181  VQAHPIDELLKLYVRINAEAETDPTVDEEAREWFRKLEDGKEATELWQWFRDESLLEFN   240

Query: 252  RLYDQMNVTFDSYNGEAFYNDKMDEVLELLESKNLLVESKGAQVVNLEKYGIEHPALIKK   311
            RLYDQ++VTFDSYNGEAFYNDKMDEVL+LLE+KNLLVESKGAQVVNLEKYGIEHPALIKK
Sbjct: 241  RLYDQLHVTFDSYNGEAFYNDKMDEVLDLLEAKNLLVESKGAQVVNLEKYGIEHPALIKK   300
```

```
-continued
Query: 312  SDGATLYITRDLAAALYRKRTYDFAKSIYVVGNEQSAHFKQLKAVLKEMDYDWSDDMTHV    371
            SDGATLYITRDLAAALYRKRTYDFAKS+YVVGNEQ+AHFKQLKAVLKEM YDWSDDMTHV
Sbjct: 301  SDGATLYITRDLAAALYRKRTYDFAKSVYVVGNEQAAHFKQLKAVLKEMGYDWSDDMTHV    360

Query: 372  PFGLVTKGGAKLSTRKGNVILLEPTVAEAINRAASQIEAKNPNLADKDKVAQAVGVGAIK    431
             FGLVTKGGAKLSTRKGNVILLEPTVAEAINRAASQIEAKNPNLADK+ VA AVGVGAIK
Sbjct: 361  AFGLVTKGGAKLSTRKGNVILLEPTVAEAINRAASQIEAKNPNLADKEAVAHAVGVGAIK    420

Query: 432  FYDLKTDRTNGYDFDLEAMVSFEGETGPYVQYAHARIQSILRKANFSPSNSDNYSLNDVE    491
            FYDLKTDR NGYDFDLEAMVSFEGETGPYVQYAHARIQSILRKA+F+PS +  YSL D E
Sbjct: 421  FYDLKTDRMNGYDFDLEAMVSFEGETGPYVQYAHARIQSILRKADFTPSATTTYSLADAE    480

Query: 492  SWEIIKLIQDFPRIIVRAADNEEPSIIAXFAINLAQCFNKYYAHTRILDEDAEISSRLAL    551
            SWEIIKLIQDFPRII R +DNFEPSI+AKFAINLAQ FNKYYAHTRILD+++E  +RLAL
Sbjct: 481  SWEIIKLIQDFPRIIKRTSDNFEPSIMAKFAINLAQSFNKYYAHTRILDDNSERDNRLAL    540

Query: 552  CYATATVLKESLRLLGVDAPNEM                                         574
            CYATATVLKE+LRLLGVDAPNEM
Sbjct: 541  CYATATVLKEALRLLGVDAPNEM                                         563
```

Based on this analysis, it was predicted that these proteins and their epitopes could be useful antigens for vaccines or diagnostics.

Example 1076

A DNA sequence (GBSx1150) was identified in *S. agalactiae* <SEQ ID 3315> which encodes the amino acid sequence <SEQ ID 3316>. This protein is predicted to be arginine hydroximate resistance protein (argR). Analysis of this protein sequence reveals the following:

Possible site: 42
>>> Seems to have no N-terminal signal sequence
----- Final Results -----
    bacterial cytoplasm --- Certainty = 0.3252 (Affirmative) <succ>
    bacterial membrane --- Certainty = 0.0000 (Not Clear) <succ>
    bacterial outside --- Certainty = 0.0000 (Not Clear) <succ>

A related GBS nucleic acid sequence <SEQ ID 10269> which encodes amino acid sequence <SEQ ID 10270> was also identified.

The protein has homology with the following sequences in the GENPEPT database.

A related DNA sequence was identified in *S. pyogenes* <SEQ ID 3317> which encodes the amino acid sequence <SEQ ID 3318>. Analysis of this protein sequence reveals the following:

Possible site: 42
>>> Seems to have no N-terminal signal sequence
----- Final Results -----
    bacterial cytoplasm --- Certainty = 0.3176 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below.

```
>GP:AAA88596 GB:M18729 unknown protein [Streptococcus pneumoniae]

Identities = 63/141 (44%), Positives = 90/141 (63%)

Query:   4  MNKIERQKRIKRLIQSGQIGTQEEIKLHLKNEGIDVTQATLSRDLREIGLLKLRSPEGKL     63
            M K +R + IK++I   ++ TQ+EI+  L+   + VTQ TLSRDLREIGL K++   +
Sbjct:   1  MRKRDRHQLIKKMITEEKLSTQKEIQDRLEAHNVCVTQTTLSRDLREIGLTKVKKNDMVY     60

Query:  64  YYSLSTATSNRFSPALRSYILKVSRASFMLVLNTNLGEASVLANFIDEKGLPEILGTMAG    123
            Y ++             L ++  V+RA F LVL+T LGEASVLAN +D       ILGT+AG
Sbjct:  61  YVLVNETEKIDLVEFLSHHLEGVARAEFTLVLHTKLGEASVLANIVDVNKDEWILGTVAG    120

Query: 124  ADTLLVICQNEDIAKVFEKEL                                           144
            A+TLLVIC+++ +AK+ E  L Sbjct: 121  ANTLLVICRDQHVAKLMEDRL                                           141
```

```
Identities = 101/145 (69%), Positives = 121/145 (82%)
Query:   4  MNKIERQKRIKRLIQSGQIGTQEEIKLHLHKNEGIDVTQATLSRDLREIGLLKLRSPEGKL    63
            MNK+ERQ++IKR+IQ+  IGTQE+IK HL+ EGI VTQATLSRDLREIGLLKLR  +GKL
Sbjct:   1  MNKMERQQQIKRIIQAEHIGTQEDIKNHLQKEGIVVTQATLSRDLREIGLLKLRDEQGKL    60

Query:  64  YYSLSTATSNRFSPALRSYILKVSRASFMLVINTNLGEASVLANFIDEKGLPEILGTMAG   123
            YYSLS    +  FSP +R Y+LKV RA FMLVL+TNLGEA VLAN ID    + +ILGT+AG
Sbjct:  61  YYSLSEPVATPFSPEVRFYVLKVDRAGFMLVLHTNLGEADVLANLIDNDAIEDILGTIAG   120

Query: 124  ADTLLVICQNEDIAKVFEKELSVGL   148
            ADTLLVIC++E+IAK FEK+L+ GL
Sbjct: 121  ADTLLVICRDEEIAKRFEKDLAAGL   145
```

Based on this analysis, it was predicted that these proteins and their epitopes could be useful antigens for vaccines or diagnostics.

Example 1077

A DNA sequence (GBSx1151) was identified in *S. agalactiae* <SEQ ID 3319> which encodes the amino acid sequence <SEQ ID 3320>. This protein is predicted to be DNA mismatch repair protein hexa (mutS). Analysis of this protein sequence reveals the following:

```
15  Possible site: 43
    >>> Seems to have no N-terminal signal sequence
    ----- Final Results -----
    bacterial cytoplasm --- Certainty = 0.3570 (Affirmative) <succ>
    bacterial membrane --- Certainty = 0.0000 (Not Clear) <succ>
    bacterial outside  --- Certainty = 0.0000 (Not Clear) <succ>
```

The protein has homology with the following sequences in the GENPEPT database.

```
>GP:AAA88597 GB:M18729 mismatch repair protein [Streptococcus pneumoniae]
Identities = 593/858 (69%), Positives = 698/858 (81%), Gaps = 14/858 (1%)
Query:    1  MAKPTISPGMQQYLDIKENYPDAFLLFRMGDFYELFYDDAVKAAQILEISLTSRNKNAEK    60
             MA   +SPGMQQY+DIK+ YPDAFLLFRMGDFYELFY+DAV AAQILEISLTSRNKNA+
Sbjct:    1  MAIEKLSPGMQQYVDIKKQYPDAFLLFRMGDFYELFYEDAVNAAQILEISLTSRNKNADN    60

Query:   61  PIPMAGVPYHSAQQYIDVLVELGYKVAIAEQMEDPKKAVGVVKREVVQVVTPGTVVESTK   120
             PIPMAGVPYHSAQQYIDVL+E GYKVAIAEQMEDPK+AVGVVKREVVQV+TPGTVV+S+K
Sbjct:   61  PIPMAGVPYHSAQQYIDVLIEQGYKVAIAEQMEDPKQAVGVVKREVVQVITPGTVVDSSK   120

Query:  121  PDSANNFLVAIDSQDQQTFGLAYMDVSTGEFQATLLTDFESVRSEILNLKAREIVVGYQL   180
             PDS NNFLV+ID +  Q FGLAYMD+ TG+F  T L DF  V  EI NLKARE+V+GY L
Sbjct:  121  PDSQNNFLVSIDREGNQ-FGLAYMDLVTGDFYVTGLLDFTLVCGEIRNLKAREVVLGYDL   179

Query:  181  TDEKNHLLTKQMNLLLSYEDERLNDIHLIDEQLTDLEISAAEKLLQYVHRTQKRELSHLQ   240
             ++E+  +L++QMNL+LSYE E   D+HL+D +L  +E +A+ KLLQYVHRTQ REL+HL+
Sbjct:  180  SEEEEQILSRQMNLVLSYEKESFEDLHLLDLRLATVEQTASSKLLQYVHRTQMRELNHLK   239

Query:  241  KVVHYEIKDYLQMSYATKNSLDLLENARTSKKHGSLYWLLDETKTAMGTRMLRTWIDRPL   300
              V+ YEIKD+LQM YATK SLDL+ENAR+ KK GSL+WLLDETKTAMG R+LR+WI RPL
Sbjct:  240  PVIRYEIKDFLQMDYATKASLDLVENARSGKKQGSLFWLLDETKTAMGMRLLRSWIHRPL   299

Query:  301  VSMNRIKERQDIIQVFLDYFFERNDLTESLKGVYDIERLASRVSFGKANPKDLLQLGQTL   360
             +   RI +RQ+++QVFLD +FFER+DLT+SLKGVYDIERLASRVSFGK NPKDLLQL  TL
Sbjct:  300  IDKERIVQRQEVVQVFLDHFFERSDLTDSLKGVYDIERLASRVSFGKTNPKDLLQLATTL   359

Query:  361  SQIPRIKMILQSFNQPELDIIVNKIDTMPELESLINTAIAPEAQATITEGNIIKSGFDKQ   420
             S  +PRI+ IL+   QP L   ++ ++D +PELESLI+ AIAPEA PHVIT+G IIR+GFD+
Sbjct:  360  SSVPRIRAILEGMEQPTLAYLIAQLDAIPELESLISAAIAPEAPHVITDGGIIRTGFDET   419

Query:  421  LDNYRTVMREGTGWIADIEAKERAASGIGTLKIDYNKKDGYYFHVTNSNLSLVPEHFFRK   480
             LD YR V+REGT WIA+IEAKER  SGI TLKIDYNKKDGYYFHVTNS L VP HFFRK
Sbjct:  420  LDKYRCVLREGTSWIAEIEAKERENSGISTLKIDYNKKDGYYFHVTNSQLGNVPAHFFRK   479

Query:  481  ATLKNSERYGTAELAKIEGEMLEAREQSSNLEYDIFMRVRAQVESYIKRLQELAKTIATV   540
             ATLKNSER+GT ELA+IEG+MLEARE+S+NLEY+IFMR+R +V  YI+RLQ LA+ IATV
Sbjct:  480  ATLKNSERFGTEELARIEGDMLEAREKSANLEYEIFMRIREEVGKYIQRLQALAQGIATV   539

Query:  541  DVLQSLAVVAENYHYVRPKFNDQHQIKIKNGRHATVEKVMGVQEYIPNSIYFDSQTDIQL   600
             DVLQSLAVVAE  H +RP+F D  QI I+ GRHA VEKVMG Q YIPN+I     T IQL
Sbjct:  540  DVLQSLAVVAETQHLIRPEFGDDSQIDIRKGRHAVVEKVMGAQTYIPNTIQMAEDTSIQL   599

Query:  601  ITGPNMSGKSTYMRQLALTVIMAQMGGFVSADEVDLPVFDAIFTRIGAADDLISGQSTFM   660
             +TGPNMSGKSTYMRQLA+T +MAQ+G +V A+   LP+FDAIFTRIGAADDL+SGQSTFM
Sbjct:  600  VTGPNMSGKSTYMRQLAMTAVMAQLGSYVPAESAHLPIFDAIFTRIGAADDLVSGQSTFM   659

Query:  661  VEMMEANQAVKRASDKSLILFDELGRGTATYDGMALAQSIIEYIHDRVRAKTMFATHYHE   720
             VEMMEAN A+   A+  SLILFDELGRGTATYDGMALAQSIIEYIH+  + AKT+FATHYHE
Sbjct:  660  VEMMEANNAISHATKNSLILFDELGRGTATYDGMALAQSIIEYIHEHIGAKTLFATHYHE   719

Query:  721  LTDLSEQLTRLVNVHVATLERDGEVTFLHKIESGPADKSYGIHVAKIAGLPIDLLDRATD   780
```

-continued
```
                LT L     L  LVNVHVATLE+DG+VTFLHKIE GPADKSYGIHVAKIAGLP DLL RA
Sbjct: 720      LTSLESSLQHLVNVHVATLEQDGQVTFLHKIEPGPADKSYGIHVAKIAGLPADLLARADK  779

Query: 781      ILSQLEADAVQLIVSPSQEAVTADLNEELDSEKQQGQLSLFEEPSNAGRVIEELEAIDIM  840
                IL+QLE    +   SP    T+ + E         Q+SLF+  +    ++ EL  +D+
Sbjct: 780      ILTQLENQGTE---SPPPMRQTSAVTE---------QISLFDR-AEEHPILAELAKLDVY  826

Query: 841      NLTPMQAMNAIFDLKKLL                                            858
                N+TPMQ MN +  +LK+ L
Sbjct: 827      NMTPMQVMNVLVELKQKL                                            844
```

A related DNA sequence was identified in *S. pyogenes* <SEQ ID 3321> which encodes the amino acid sequence <SEQ ID 3322>. Analysis of this protein sequence reveals the following:

Possible site: 58
>>> Seems to have no N-terminal signal sequence

-continued
```
    INTEGRAL    Likelihood = −1.38   Transmembrane 532-548 (532-549)
    ----- Final Results -----
    bacterial membrane --- Certainty = 0.1553 (Affirmative) <succ>
      bacterial outside --- Certainty = 0.0000 (Not Clear) <succ>
     bacterial cytoplasm --- Certainty = 0.0000 (Not Clear) <succ>
```

An alignment of the GAS and GBS proteins is shown below.

```
Identities = 661/858 (77%), Positives = 746/858 (86%), Gaps = 7/858 (0%)
Query:   1      MAKPTISPGMQQYLDIKENYPDAFLLFRMGDFYELFYDDAVKAAQILEISLTSRNKNAEK   60
                MAK  ISPGMQQYLDIK++YPDAFLLFRMGDFYELFY+DAVKAAQ+LEI LTSRNKNAE
Sbjct:   1      MAKTNISPGMQQYLDIKKDYPDAFLLFRMGDFYELFYEDAVKAAQLLEIGLTSRNKNAEN   60

Query:  61      PIPMAGVPYHSAQQYIDVLVELGYKVAIAEQMEDPKKAVGVVKREVVQVVTPGTVVESTK  120
                PIPMAGVP+HSAQQYIDVL+ELGYKVA+AEQMEDPK+AVGVVKREVVQV+TPGTVV+S K
Sbjct:  61      PIPMAGVPHHSAQQYIDVLIELGYKVAVAEQMEDPKQAVGVVKREVVQVITPGTVVDSAK  120

Query: 121      PDSANNFLVAIDSQDQQTFGLAYMDVSTGEFQATLLTDFESVRSEILNLKAREIVVGYQL  180
                PDSANNFLVA+D  D   +GLAYMDVSTGEF   T L DF SVRSEI NLKA+E+++G+ L
Sbjct: 121      PDSANNFLVAVDF-DGCRYGLAYMDVSTGEFCVTDLADFTSVRSEIQNLKAKEVLLGFDL  179

Query: 181      TDEKNHLLTKQMNLLLSYEDERLNDIHLIDEQLTDLEISAAEKLLQYVHRTQKRELSHLQ  240
                ++E+  +L KQMNLLLSYE+    D   LID QLT +E++AA KLLQYVH+TQ RELSHLQ
Sbjct: 180      SEEEQTILVKQMNLLLSYEETVYEDKSLIDGQLTTVELTAAGKLLQYVHKTQMRELSHLQ  239

Query: 241      KVVHYEIKDYLQMSYATKNSLDLLENARTSKKHGSLYWLLDETKTAMGTRMLRTWIDRPL  300
                 +VHYEIKDYLQMSYATK+SLDL+ENART+KKHGSLYWLLDETKTAMG R+LR+WIDRPL
Sbjct: 240      ALVHYEIKDYLQMSYATKSSLDLVENARTNKKHGSLYWLLDETKTAMGMRLLRSWIDRPL  299

Query: 301      VSMNRIKERQDIIQVFLDYFFERNDLTESLKGVYDIERLASRVSFGKANPKDLLQLGQTL  360
                VS    I ERQ+IIQVFL+ F ER DL+ SLKGVYDIERL+SRVSFGKANPKDLLQLG TL
Sbjct: 300      VSKEAILERQEIIQVFLNAFIERTDLSNSLKGVYDIERLSSRVSFGKANPKDLLQLGHTL  359

Query: 361      SQIPRIKMILQSFNQPELDIIVNKIDTMPELESLINTAIAPEAQATITEGNIIKSGFDKQ  420
                +Q+P IK IL+SF+ P +D +VN ID++PELE LI TAI P+A ATI+EG+II++GFD++
Sbjct: 360      AQVPYIKAILESFDSPCVDKLVNDIDSLPELEYLIRTAIDPDAPATISEGSIIRNGFDER  419

Query: 421      LDNYRTVMREGTGWIADIEAKERAASGIGTLKIDYNKKDGYYFHVTNSNLSLVPEHFFRK  480
                LD+YR VMREGTGWIADIEAKER ASGI  LKIDYNKKDGYYFHVTNSNLSLVPEHFFRK
Sbjct: 420      LDHYRKVMREGTGWIADIEAKERQASGINNLKIDYNKKDGYYFHVTNSNLSLVPEHFFRK  479

Query: 481      ATLKNSERYGTAELAKIEGEMLEAREQSSNLEYDIFMRVRAQVESYIKRLQELARTIATV  540
                ATLKNSERYGTAELAKIEG MLEARE+SS+LEYDIFM +RAQVE+YI RLQ+LAK +ATV
Sbjct: 480      ATLKNSERYGTAELAKIEGQMLEAREESSSLEYDIFMCIRAQVETYINRLQKLAKILATV  539

Query: 541      DVLQSLAVVAENYHYVRPKFNDQHQIKIKNGRHATVEKVMGVQEYIPNSIYFDSQTDIQL  600
                DVLQSLAVVAE  HY+RP+FND H I I+ GRHA VEKVMGVQEYIPNSI  FD QT IQL
Sbjct: 540      DVLQSLAVVAETNHYIRPQFNDNHVITIQEGRHAVVEKVMGVQEYIPNSISFDQQTSIQL  599

Query: 601      ITGPNMSGKSTYMRQLALTVIMAQGGFVSADEVDLPVFDAIFTRIGAADDLISGQSTFM  660
                ITGPNMSGKSTYMRQLALTVIMAQMG FV+AD VDLP+FDAIFTRIGAADDLISGQSTFM
Sbjct: 600      ITGPNMSGKSTYMRQLALTVIMAQMGSFVAADHVDLPLFDAIFTRIGAADDLISGQSTFM  659

Query: 661      VEMMEANQAVKRASDKSLILFDELGRGTATYDGMALAQSIIEYIHDRVRAKTMFATHYHE  720
                VEMMEANQA+KRASD  SLILFDELGRGTATYDGMALAQ+IIEYIHDRV  AKT+FATHYHE
Sbjct: 660      VEMMEANQAIKRASDNSLILFDELGRGTATYDGMALAQAIIEYIHDRVGAKTIFATHYHE  719

Query: 721      LTDLSEQLTRLVNVHVATLERDGEVTFLHKIESGPADKSYGIHVAKIAGLPIDLLDRATD  780
                LTDLS  LT LVNVHVATLE+DG+VTFLHKI  GPADKSYGIHVAKIAGLP  LL RA +
Sbjct: 720      LTDLSTNLTSLVNVHVATLEKDGDVTFLHKIAEGPADKSYGIHVAKIAGLPKSLLKRADE  779

Query: 781      ILSQLEADAVQLIVSPSQEAVTADLNEELDSEKQQGQLSLFEEPSNAGRVIEELEAIDIM  840
                +L++LE          S  E  ++        E  S     +QGQLSLF +     A   +  + LE ID+M
```

```
-continued
Sbjct: 780  VLTRLETQ------SRSTEIISVPSQVESSSAVRQGQLSLFGDEEKAHEIRQALEVIDVM  833

Query: 841  NLTPMQAMNAIFDLKKLL                                           858
            N+TP+QAM   +++LKKLL
Sbjct: 834  NMTPLQAMTTLYELKKLL                                           851
```

Based on this analysis, it was predicted that these proteins and their epitopes could be useful antigens for vaccines or diagnostics.

Example 1078

A DNA sequence (GBSx1152) was identified in *S. agalactiae* <SEQ ID 3323> which encodes the amino acid sequence <SEQ ID 3324>. This protein is predicted to be cold shock protein-related protein. Analysis of this protein sequence reveals the following:

Possible site: 28
>>> Seems to have no N-terminal signal sequence
----- Final Results -----
   bacterial cytoplasm --- Certainty = 0.2095 (Affirmative) <succ>
   bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:CAB69404 GB:A91080 unnamed protein product [unidentified]
Identities = 48/63 (76%), Positives = 56/63 (88%)
Query:  1  MTQGTVKWFNSEKGFGFISSETGTDVFAHFSEIKVDGFKTLEEGQKVTFDIQDGQRGPQA  60
           MT+GTVKWFN +KGFGFI+SE G DVFAHFS+I+  GFKTL+EGQKVTFD++ GQRGPQA
Sbjct:  1  MTKGTVKWFNPDKGFGFITSEDGQDVFAHFSQIQTSGFKTLDEGQKVTFDVEAGQRGPQA  60

Query: 61  TNI                                                           63
           NI
Sbjct: 61  VNI                                                           63
```

A related DNA sequence was identified in *S. pyogenes* <SEQ ID 3325> which encodes the amino acid sequence <SEQ ID 3326>. Analysis of this protein sequence reveals the following:

Possible site: 30
>>> Seems to have no N-terminal signal sequence
----- Final Results -----
   bacterial cytoplasm --- Certainty = 0.2350 (Affirmative) <succ>
   bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 49/63 (77%), Positives = 56/63 (88%)

Query:  1  MTQGTVKWFNSEKGFGFISSETGTDVFAHFSEIKVDGFKTLEEGQKVTFDIQDGQRGPQA  60
           M QGTVKWFN+EKGFGFIS+E G DVFAHFS I+ +GFKTLEEGQKV FD+++GQRGPQA
Sbjct:  3  MAQGTVKWFNAEKGFGFISTENGQDVFAHFSAIQTNGFKTLEEGQKVAFDVEEGQRGPQA  62

Query: 61  TNI                                                           63
           NI
Sbjct: 63  VNI                                                           65
```

Based on this analysis, it was predicted that these proteins and their epitopes could be useful antigens for vaccines or diagnostics.

Example 1079

A DNA sequence (GBSx1153) was identified in *S. agalactiae* <SEQ ID 3327> which encodes the amino acid sequence <SEQ ID 3328>. Analysis of this protein sequence reveals the following:

Possible site: 13
>>> Seems to have no N-terminal signal sequence
----- Final Results -----
   bacterial cytoplasm --- Certainty = 0.6378 (Affirmative) <succ>
   bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1080

A DNA sequence (GBSx1154) was identified in *S. agalactiae* <SEQ ID 3329> which encodes the amino acid sequence <SEQ ID 3330>. This protein is predicted to be DNA mismatch repair protein hexb (mutL). Analysis of this protein sequence reveals the following:

Possible site: 37
>>> Seems to have no N-terminal signal sequence
----- Final Results -----
bacterial cytoplasm --- Certainty = 0.2242 (Affirmative) <succ>
bacterial membrane --- Certainty = 0.0000 (Not Clear) <succ>
bacterial outside --- Certainty = 0.0000 (Not Clear) <succ>

A related GBS nucleic acid sequence <SEQ ID 10267> which encodes amino acid sequence <SEQ ID 10268> was also identified.

The protein has homology with the following sequences in the GENPEPT database.

Possible site: 25
>>> Seems to have no N-terminal signal sequence
----- Final Results -----
bacterial cytoplasm --- Certainty = 0.1854 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
>GP:AAA88600 GB:M29686 mismatch repair protein [Streptococcus pneumoniae]
Identities = 452/657 (68%), Positives = 543/657 (81%), Gaps = 8/657 (1%)
Query:  20  LSKIIELPDILANQIAAGEVVERPSSVVKELVENAIDAGSSQITIEVEESGLKKIQITDN   79
            +S IIELP++LANQIAAGEV+ERP+SV KELVENAIDAGSSQI IE+EE+GLKK+QITDN
Sbjct:   1  MSHIIELPEMLANQIAAGEVIERPASVCKELVENAIDAGSSQIIIEIEEAGLKKVQITDN   60

Query:  80  GEGMTSEDAVLSLRRHATSKIKSQSDLFRIRTLGFRGEALPSIASISLMTIKTATEQGKQ  139
            G G+ ++   L+LRRHATSKIK+Q+DLFRIRTLGFRGEALPSIAS+S++T+ TA +
Sbjct:  61  GHGIAHDEVELALRRHATSKIKNQADLFRIRTLGFRGEALPSIASVSVLTLLTAVDGASH  120

Query: 140  GTLLVAKGGNIEKQEVVSSPRGTKILVENLFFNTPARLKYMKSLQSELAHIIDIVNRLSL  199
            GT LVA+GG +E+    +SP GTK+ VE+LFFNTPARLKYMKS Q+EL+HIIDIVNRL L
Sbjct: 121  GTKLVARGGEVEEVIPATSPVGTKVCVEDLFFNTPARLKYMKSQQAELSHIIDIVNRLGL  180

Query: 200  AHPEVAFTLINDGKEMTKTSGTGDLRQAIAGIYGLNTAKKMIEISNADLDFEISGYVSLP  259
            AHPE++F LI+DGKEMT+T+GTG LRQAIAGIYGL +AKKMIEI N+DLDFEISG+VSLP
Sbjct: 181  AHPEISFSLISDGKEMTRTAGTGQLRQAIAGIYGLVSAKKMIEIENSDLDFEISGFVSLP  240

Query: 260  ELTRANRNYITLLINGRYIKNFLLNRSILDGYGSKLMVGRFPIAVIDIQIDPYLADVNVH  319
            ELTRANRNYI+L INGRYIKNFLLNR+ILDG+GSKLMVGRFP+AVI I IDPYLADVNVH
Sbjct: 241  ELTRANRNYISLFINGRYIKNFLLNRAILDGFGSKLMVGRFPLAVIHIHIDPYLADVNVH  300

Query: 320  PTKQEVRISKERELMSLISTAISESLKQYDLIPDALENLAKTSTRSVDKPIQTSFSLKQP  379
            PTKQEVRISKE+ELM+L+S AI+ SLK+  LIPDALENLAK++ R+ +K  QT   LK+
Sbjct: 301  PTKQEVRISKEKELMTLVSEAIANSLKEQTLIPDALENLAKSTVRNREKVEQTILPLKEN  360

Query: 380  GLYYDRAKNDFFIGADTVSEPIANFTNLDKSDGSVDNDVKNSVNQGATQSPNIKYASRDQ  439
              LYY++ +         + +E      L      +       K ++++ T+   + +A R
Sbjct: 361  TLYYEKTEP----SRPSQTEVADYQVELTDEGQDLTLFAKETLDR-LTKPAKLHFAERKP  415

Query: 440  ADSENFIHSQDYLSSKQSLNKLVEKLDSEESSTFPELEFFGQMHGTYLFAQGNGGLYIID  499
            A+ +   H +  L+    S++K  +KL+ EE+S+FPELEFFGQMHGTYLFAQG  GLYIID
Sbjct: 416  ANYDQLDHPELDLA---SIDKAYDKLEREEASSFPELEFFGQMHGTYLFAQGRDGLYIID  472

Query: 500  QHAAQERVKYEYYREKIGEVDNSLQQLLVPFLFEFSSSDFLQLQEKMSLLQDVGIFLEPY  559
            QHAAQERVKYE YRE IG VD S QQLLVP++FEF + D L+L+E+M LL++VG+FL  Y
Sbjct: 473  QHAAQERVEYEEYRESIGNVDQSQQQLLVPYIFEFPADDALRLKERMPLLEEVGVFLAEY  532

Query: 560  GNNTFILREHPIWMKEEEVESGIYEMCDMLLLTNEVSVKKYRAELAIMMSCKRSIKANHT  619
            G N FILREHPIWM EEE+ESGIYEMCDMLLLT EVS+KKYRAELAIMMSCKRSIKANH
Sbjct: 533  GENQFILREHPIWMAEEEIESGIYEMCDMLLLTKEVSIKKYRAELAIMMSCKRSIKANHR  592

Query: 620  LDDYSARHLLDQLAQCKNPYNCPHGRPVLVNFTKADMEKMFKRIQENHTSLRDLGKY     676
            +DD+SAR LL QL+QC NPYNCPHGRPVLN+FTK DMEKMF+RIQENHTSLR LGKY
Sbjct: 593  IDDHSARQLLYQLSQCDNPYNCPHGRPVLVHFTKSDMEKMFRRIQENHTSLRELGKY     649
```

A related DNA sequence was identified in *S. pyogenes* <SEQ ID 3331> which encodes the amino acid sequence <SEQ ID 3332>. Analysis of this protein sequence reveals the following:

```
Identities = 502/663 (75%), Positives = 574/663 (85%), Gaps = 9/663 (1%)
Query:  20  LSKIIELPDILANQIAAGEVVERPSSVVKELVENAIDAGSSQITIEVEESGLKKIQITDN   79
            ++ IIELP++LANQIAAGEVVERP+SVVKELVENAIDA SSQIT+E+EESGLK IQ+TDN
Sbjct:  14  MTNIIELPEVLANQIAAGEVVERPASVVKELVENAIDAKSSQITVEIEESGLKMIQVTDN   73

Query:  80  GEGMTSEDAVLSLRRHATSKIKSQSDLFRIRTLGFRGEALPSIASISLMTIKTATEQGKQ  139
            GEGM+ ED  LSLRRHATSKIKSQSDLFRIRTLGFRGEALPS+ASIS +TIKTAT++
Sbjct:  74  GEGMSHEDLPLSLRRHATSKIKSQSDLFRIRTLGFRGEALPSVASISKITIKTATKEVTH  133

Query: 140  GTLLVAKGGNIEKQEVVSSPRGTKILVENLFFNTPARLKYMKSLQSELAHIIDIVNRLSL  199
```

-continued

```
                  G+LL+A GG IE   E +S+P GTKI VENLF+NTPARLKYMKSLQ+ELAHI+D+VNRLSL
Sbjct: 134  GSLLIATGGEIETLEAISTPTGTKIKVENLFYNTPARLKYMKSLQAELAHIVDVVNRLSL     193

Query: 200  AHPEVAFTLINDGKEMTKTSGTDLRQAIAGIYGLNTAKKMIEISNADLDFEISGYVSLP     259
            AHPEVAFTLI+DG+++T+TSGTDLRQAIAGIYGLNT KKM+ ISNADLDFE+SGYVSLP
Sbjct: 194  AHPEVAFTLISDGRQLTQTSGTDLRQAIAGIYGLNTTKKMLAISNADLDFEVSGYVSLP     253

Query: 260  ELTRANRNYITLLINGRYIKNELLNRSILDGYGSKLMVGREPIAVIDIQIDPYLADVNVH    319
            ELTRANRNY+T+L+NGRYIKNELLNR+ILDGYGSKLMVGREPI VIDIQIDPYLADVNVH
Sbjct: 254  ELTRANRNYMTILVNGRYIKNFLLNRAILDGYGSKLMVGREPIVVIDIQIDPYLADVNVH    313

Query: 320  PTKQEVRISKERELMSLISTAISESLKQYDLIPDALENLAKTSTRSVDKPIQTSFSLKQP    379
            PTKQEVRISKERELM+LISTAISESLK+ DLIPDALENLAK+STR    KP QT   L+
Sbjct: 314  PTKQEVRISKERELMALISTAISESLKEQDLIPDALENLAKSSTRHFSKPEQTQLPLQSR    373

Query: 380  GLYYDRAKNDFFIGADTVSEPIANFTNLDKSDGSVDNDVKNSV------NQGATQSPNIK    433
            GLYYD KNDFF+    VSE I    D   G+VDN VK          ++      ++K
Sbjct: 374  GLYYDPQKNDFFVKESAVSEKI---PETDFYSGAVDNSVKVEKVELLPHSEEVIGPSSVK    430

Query: 434  YASRDQADSENFIHSQDYLSSKQSLNKLVEKLDSEESSTFPELEFFGQMHGTYLFAQGNG    493
            +ASR Q       H    L ++Q L++++ +L++E  S FPEL++FGQMHGTYLFAQG
Sbjct: 431  HASRPQNTFTETDHPNLDLKNRQKLSQMLTRLENEGQSVFPELDYFGQMHGTYLFAQGKD    490

Query: 494  GLYIIDQHAAQERVKYEYYREKIGEVDNSLQQLLVPFLFEFSSSDFLQLQEKMSLLQDVG    553
            GL+IIDQHAAQERVKYEYYR+KIGEVD+SLQQLLVP+LFEFS SDF+ LQEKM+LL +VG
Sbjct: 491  GLFIIDQHAAQERVKYEYYRDKIGEVDSSLQQLLVPYLFEFSGSDFINLQEKMALLNEVG    550

Query: 554  IFLEPYGNNTFILREHPIWMKEEEVESGIYEMCDMLLLTNEVSVKKYRAELAIMMSCKRS    613
            IFLE YG+NTFILREHPIWMKEEE+ SG+YEMCDMLLLTNEVS+K YRAELAIMMSCKRS
Sbjct: 551  IFLEVYGHNTFILREHPIWMKEEEIASGVYEMCDMLLLTNEVSIKTYRAELAIMMSCKRS    610

Query: 614  IKANHTLDDYSARHLLDQLAQCENPYNCPHGRPVLVNFTKADMEKMFKRIQENHTSLRDLGKY    676
            IKANH+LDDYSAR+LL QLAQC+NPYNCPHGRPVL+NF+KADMEKMF+RIQENHTSLR+LGKY
Sbjct: 611  IKANHSLDDYSARNLLLQLAQCQNPYNCPHGRPVLINFSKADMEKMERRIQENHTSLRELGKY    673
```

Based on this analysis, it was predicted that these proteins and their epitopes could be useful antigens for vaccines or diagnostics.

Example 1081

A DNA sequence (GBSx1155) was identified in *S. agalactiae* <SEQ ID 3333> which encodes the amino acid sequence <SEQ ID 3334>. Analysis of this protein sequence reveals the following:

Possible site: 15
>>> Seems to have no N-terminal signal sequence
----- Final Results -----
   bacterial cytoplasm --- Certainty = 0.3372 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1082

A DNA sequence (GBSx1156) was identified in *S. agalactiae* <SEQ ID 3335> which encodes the amino acid sequence <SEQ ID 3336>. Analysis of this protein sequence reveals the following:

Possible site: 43
>>> Seems to have no N-terminal signal sequence
INTEGRAL    Likelihood = −14.01    Transmembrane 176-192 (170-197)
INTEGRAL    Likelihood = −8.07     Transmembrane 390-406 (387-412)
INTEGRAL    Likelihood = −6.10     Transmembrane 271-287 (269-291)
INTEGRAL    Likelihood = −6.00     Transmembrane 83-99 (82-101)
INTEGRAL    Likelihood = −4.78     Transmembrane 51-67 (50-71)
INTEGRAL    Likelihood = −2.92     Transmembrane 303-319 (302-320)
INTEGRAL    Likelihood = −2.76     Transmembrane 363-379 (362-381)
INTEGRAL    Likelihood = −2.39     Transmembrane 152-168 (151-169)
INTEGRAL    Likelihood = −2.02     Transmembrane 325-341 (325-342)
INTEGRAL    Likelihood = −1.65     Transmembrane 226-242 (226-242)
INTEGRAL    Likelihood = −0.90     Transmembrane 24-40 (24-40)
INTEGRAL    Likelihood = −0.27     Transmembrane 111-127 (111-127)
----- Final Results -----
   bacterial membrane --- Certainty = 0.6604 (Affirmative) <succ>
   bacterial outside --- Certainty = 0.0000 (Not Clear) <succ>
   bacterial cytoplasm --- Certainty = 0.0000 (Not Clear) <succ>

A related GBS nucleic acid sequence <SEQ ID 10265> which encodes amino acid sequence <SEQ ID 10266> was also identified.

The protein has homology with the following sequences in the GENPEPT database.

```
>GP:CAA61918 GB:X89779 LmrP integral membrane protein [Lactococcus
lactic]
Identities = 145/401 (36%), Positives = 236/401 (58%), Gaps = 4/401 (0%)
Query:   9 VKEFFALPKQLQLRELLRFISITVGSAIFPFMAMYYVQYFGNLVTGILIIITQLSGFVAT   68
           +KEF+ L K LQLR  + F+         +F  M +YY QY G+ +TGIL+ ++ ++ FVA
Sbjct:   1 MKEFWNLDKNLQLRLGIVFLGAFSYGTVFSSMTIYYNQYLGSAITGILLALSAVATFVAG   60

Query:  69 LYGGHLSDAMGRKKVVIIGSLLATIGWAITIAANVPNHITPHLTFVGILIIEIAHQFYFP  128
           + G +D GRK V++ G+++  +G A+  IA+N+P H+ P   TF+   L+I  + F
Sbjct:  61 ILAGFFADRNGRKPVMVFGTIIQLLGAALAIASNLPGHVNPWSTFIAFLLISFGYNFVIT  120

Query: 129 AYEAMTIDLTNEQNRRFVYTIGYWLVNIAVMLGSGIAGIFYDHHFFELLIVLLIISAICC  188
           A  AM ID +N +NR+ V+ + YW  N++V+LG+ +        F  LL++LL+   +
Sbjct: 121 AGNAMIIDASNAENRKVVFMLDYWAQNLSVILGAALGAWLFRPAFEALLVILLLTVLVSF  180

Query: 189 FVVYFKFDET-KPQEGTFKHDKGVLGTFKNYSQVLVDKAFVVYTLGAIGSSVVWLQVDNY  247
           F+  F    ET KP    T K D+       F+ Y  VL DK ++++     I ++ + +Q DN+
Sbjct: 181 FLTTFVMTETFKP---TVKVDEKAENIFQAYKTVLQDKTYMIFMGANIATTFIIMQFDNF  237

Query: 248 FSVNLKQNFEVVSILGHTITGAKMLSLAVFTNTLLIVLLMTTINKFIENWPLKRQLILGS  307
              V+L  +F+ ++  G  I G +ML++ +       +L+VLLMTT+N+   ++W  ++   I GS
Sbjct: 238 LPVHLSNSFKTITFWGFEIYGQRMLTIYLILACVLVVLLMTTLNRLTKDWSHQKGFIWGS  297

Query: 308 LICGFGMLFNISLNTFGAILIAMTFFTFGEMIYVPASQVLRAEMMVEGKIGSYSGFLAIA  367
           L    GM+F+    TF   I  IA  +T GE++Y P+ Q L A++M   KIGSY+G   AI
Sbjct: 298 LFMAIGMIFSFLTTTFTPIFIAGIVYTLGEIVYTPSVQTLGADLMNPEKIGSYNGVAAIK  357

Query: 368 QPVASVLAGAMVSLSYFTGKIGVQITLTIFMLAGLVLILYA                    408
            P+AS+LAG +VS+S        IGV + L +    + ++L+L A
Sbjct: 358 MPIASILAGLLVSISPMIKAIGVSLVLALTEVLAIILVLVA                    398
```

A related DNA sequence was identified in *S. pyogenes* <SEQ ID 3337> which encodes the amino acid sequence <SEQ ID 3338>. Analysis of this protein sequence reveals the following:

Possible site: 56
>>> Seems to have no N-terminal signal sequence
INTEGRAL    Likelihood = −11.41    Transmembrane 166-182 (161-188)
INTEGRAL    Likelihood = −7.75     Transmembrane 384-400 (376-403)
INTEGRAL    Likelihood = −7.64     Transmembrane 266-282 (261-285)
INTEGRAL    Likelihood = −4.25     Transmembrane 295-311 (291-313)
INTEGRAL    Likelihood = −2.71     Transmembrane 98-114 (98-115)

-continued

INTEGRAL    Likelihood = −2.23     Transmembrane 355-371 (355-374)
INTEGRAL    Likelihood = −2.02     Transmembrane 218-234 (218-234)
INTEGRAL    Likelihood = −1.91     Transmembrane 315-331 (315-331)
INTEGRAL    Likelihood = −1.22     Transmembrane 75-91 (75-92)
INTEGRAL    Likelihood = −0.75     Transmembrane 45-61 (45-63)
INTEGRAL    Likelihood = −0.75     Transmembrane 144-160 (144-161)
----- Final Results -----
  bacterial membrane --- Certainty = 0.5564 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the databases:

```
>GP:CAA61918 GB:X89779 LmrP integral membrane protein [Lactococcus
lactis]
Identities = 138/400 (34%), Positives = 223/400 (55%), Gaps = 2/400 (0%)
Query:   1 MQEFLNLPKQIQLRQLVRFVTITLGSSIFPFMAMYYTTYFGTFWTGLLMMITSLMGFVGT   60
           M+EF NL K +QLR + F+       ++F M +YY  Y G+  TG+L+ ++++  FV
Sbjct:   1 MKEFWNLDKNLQLRLGIVFLGAFSYGTVFSSMTIYYNQYLGSAITGILLALSAVATFVAG   60

Query:  61 LYGGHLSDALGRKKVIMIGSVGTTLGWFLTILANLPNAAIPWLTFAGILLVEIASSFYGP  120
           + G +D GRK V++ G++   LG L I +NLP     PW TF   LL+     +F
Sbjct:  61 ILAGFFADRNGRKPVMVFGTIIQLLGAALAIASNLPGHVNPWSTFIAFLLISFGYNFVIT  120

Query: 121 AYEAMLIDLTDESNRRFVYTINYWFINIAVMFGAGLSGLFYDHHFLALLVALLLVNVLCF  180
           A  AM+ID ++ NR+ V+ ++YW  N++V+ GA L   +  F   ALLV LLL ++ F
Sbjct: 121 AGNAMIIDASNAENRKVVFMLDYWAQNLSVILGAALGAWLFRPAFEALLVILLLTVLVSF  180

Query: 181 GVAYYCFDETRPETHAFDHGKGLLASFQNYRQVFHDRAFVLFTLGAIFSGSIWMQMDNYV  240
           + +    ET    T    D       + FQ Y+ V D+ +++F  I   + I MQ DN++
Sbjct: 181 FLTTFVMTETFKPTVKVDEKAENI--FQAYKTVLQDKTYMIFMGANIATTFIIMQFDNFL  238

Query: 241 PVHLKLYFQPTAVLGFQVTSSKMLSLMVLTNTLLIVLFMTVVNKLTEKWKLLPQLVVGSL  300
           PVHL     F+      GF++    +ML++ ++      +L+VL MT +N+LT + W       + GSL
Sbjct: 239 PVHLSNSFKTITFWGFEIYGQRMLTIYLILACVLVVLLMTTLNRLTKDWSHQKGFIWGSL  298

Query: 301 LFTLGMLLSFTFTQFYAIWLSVVLLTFGEMINVSASQVLRADMMDHSQIGSYTGFVSMAQ  360
                +GM+ SF  T F  I+++ ++ T GE++       + Q L AD+M+  +IGSY G ++
Sbjct: 299 FMAIGMIFSFLTTTFTPIFIAGIVYTLGEIVYTPSVQTLGADLMNPEKIGSYNGVAAIKM  358

Query: 361 PLGAILASLLVSVSHFTGPLGVQCLFAVIALLGIYFTVVS                     400
           P+ +ILA LLVS+S        +GV   + A+   +L I   +V+
Sbjct: 359 PIASILAGLLVSISPMIKAIGVSLVLALTEVLAIILVLVA                     398
```

An alignment of the GAS and GBS proteins is shown below.

```
Identities = 228/406 (56%), Positives = 305/406 (74%)
Query:   9  VKEFFALPKQLQLRELLRFISITVGSAIFPFMAMYYVQYFYDHHFFELLIVTGILIIITQLSGFVAT   68
            ++EF  LPKQ+QLR+L+RF++IT+GS+IFPFMAMYY  YFG   TG+L++IT L GFV T
Sbjct:   1  MQEFLNLPKQIQLRQLVRFVTITLGSSIFPFMAMYYTTYFGTFWTGLLMMITSLMGFVGT      60

Query:  69  LYGGHLSDAMGRKKVVIIGSLLATIGWAITIAANVPNHITPHLTFVGILIIEIAHQFYFP    128
            LYGGHLSDA+GRKKV++IGS+  T+GW +TI AN+PN   P LTF GIL++EIA FY P
Sbjct:  61  LYGGHLSDALGRKKVIMIGSVGTTLGWFLTILANLPNAAIPWLTFAGILLVEIASSFYGP    120

Query: 129  AYEAMTIDLTNEQNRRFVYTIGYWLVNIAVMLGSGIAGIFYDHHFFELLIVLLIISAICC    188
            AYEAM IDLT+E NRRFVYTI YW +NIAVM G+G++G+FYDHHF  LL+ LL+++ +C
Sbjct: 121  AYEAMLIDLTDESNRRFVYTINYWFINIAVMFGAGLSGLFYDHHFLALLVALLLVNVLCF    180

Query: 189  FVVYFKFDETKPQEGTFKHDKGVLGTFKNYSQVLVDKAFVVYTLGAIGSSVVWLQVDNYF    248
             V Y+ FDET+P+    F H KG+L +F+NY QV  D+AFV++TLGAI S   +W+Q+DNY
Sbjct: 181  GVAYYCFDETRPETHAFDHGKGLLASFQNYRQVFHDRAFVLFTLGAIFSGSIWMQMDNYV    240

Query: 249  SVNLKQNFEVVSILGHTITGAKMLSLAVFTNTLLIVLMTTINKFIENWPLKRQLILGSL    308
             V+LK  F+   ++LG  +T  +KMLSL V TNTLLIVL MT  +NK   E W L  QL++GSL
Sbjct: 241  PVHLKLYFQPTAVLGFQVTSSKMLSLMVLTNTLLIVLFMTVVNKLTEKWKLLPQLVVGSL    300

Query: 309  ICGFGMLFNISLNTFGAILIAMTFFTFGEMIYVPASQVLRAEMMVEGKIGSYSGFLAIAQ    368
             +    GML + +   F AI +++    TFGEMI V ASQVLRA+MM    +IGSY+GF+++AQ
Sbjct: 301  LFTLGMLLSFTFTQFYAIWLSVVLLTFGEMINVSASQVLRADMMDHSQIGSYTGFVSMAQ    360

Query: 369  PVASVLAGAMVSLSYFTGKIGVQITLTIFMLAGLVLILYATKMKNI                414
            P+ ++LA +VS+S+FTG +GVQ      +  L G+   + + KMK +
Sbjct: 361  PLGAILASLLVSVSHFTGPLGVQCLFAVIALLGIYFTVVSAKMKKV                406
```

A related GBS gene <SEQ ID 8725> and protein <SEQ ID 8726> were also identified. Analysis of this protein sequence reveals the following:

Lipop: Possible site: −1 Crend: 8
SRCFLG: 0
McG: Length of UR: 4
Peak Value of UR: 1.73
Net Charge of CR: 1
McG: Discrim Score: −4.26
GvH: Signal Score (−7.5): −2.48
Possible site: 35
>>> Seems to have no N-terminal signal sequence
Amino Acid Composition: calculated from 1
ALOM program    count: 12 value: −14.01   threshold: 0.0
INTEGRAL        Likelihood = −14.01   Transmembrane 168-184 (162-189)
INTEGRAL        Likelihood = −8.07    Transmembrane 382-398 (379-404)
INTEGRAL        Likelihood = −6.10    Transmembrane 263-279 (261-283)
INTEGRAL        Likelihood = −6.00    Transmembrane 75-91 (74-93)
INTEGRAL        Likelihood = −4.78    Transmembrane 43-59 (42-63)
INTEGRAL        Likelihood = −2.92    Transmembrane 295-311 (294-312)
INTEGRAL        Likelihood = −2.76    Transmembrane 355-371 (354-373)
INTEGRAL        Likelihood = −2.39    Transmembrane 144-160 (143-161)
INTEGRAL        Likelihood = −2.02    Transmembrane 317-333 (317-334)
INTEGRAL        Likelihood = −1.65    Transmembrane 218-234 (218-234)
INTEGRAL        Likelihood = −0.90    Transmembrane 16-32 (16-32)
INTEGRAL        Likelihood = 0.27     Transmembrane 103-119 (103-119)
PERIPHERAL      Likelihood = 9.44     239
modified ALOM score: 3.30
icml HYPID: 7    CFP: 0.660
*** Reasoning Step: 3
----- Final Results -----
    bacterial membrane --- Certainty = 0.6604 (Affirmative) <succ>
      bacterial outside --- Certainty = 0.0000 (Not Clear) <succ>
       bacterial cytoplasm --- Certainty = 0.0000 (Not Clear) <succ>

The protein has homology with the following sequences in the databases:

```
ORF01675(325-1530 of 1854)
EGAD|40187|42348(1-400 of 408) integral membrane protein (lmrP) {Lactococcus lactis}
GP|1052754|emb|CAA61918.1||X89779 LmrP integral membrane protein {Lactococcus lactis}
PIR|S58131|S58131 integral membrane protein LmrP - Lactococcus lactis
% Match = 21.7
% Identity = 36.2  % Similarity = 60.8
Matches = 145 Mismatches = 155 Conservative Sub.s = 99

243       273       303       333       363       393       423       453
LQKLIWRKCLNESKKIIQASGI*ENIDNYLLGKKGEKVKEFFALPKQLQLRELLRFISITVGSAIFPFMAMYYVQYFGNL
          :|||:  | ||||   : |:           :|    |  :||  ||:|:
          MKEFWNLDKNLQLRLGIVFLGAFSYGTVFSSMTIYYNQYLGSA
             10        20        30        40
```

```
483         513         543         573         603         633         663         693
VTGILIIITQLSGFVATLYGGHLSDAMGRKKVVIIGSLLATIGWAITIAANVPNHITPHLTFVGILIIEIAHQFYFPAYE
:||||:  ::  ::  |||  :   |  ::|   |||  |::  |:::    :|  |:  ||:|:|  |:  |  ||:   |:|    :  |        |
ITGILLALSAVATFVAGILAGFFADRNGRKPVMVFGTIIQLLGAALAIASNLPGHVNPWSTFIAFLLISFGYNFVITAGN
             60          70          80          90         100         110         120

723         753         783         813         843         873         900         930
AMTIDLTNEQNRRFVYTIGYWLVNIAVMLGSGIAGIFYDHHFFELLIVLLIISAICCFVVYFKFDET-KPQEGTFKHDKG
||  ||  :|  :||:  |:  ||   |::|:||:    ::       ::      |  ||:||:      :    |    ||||    |||
AMIIDASNAENRKVVFMLDYWAQNLSVILGAALGAWLFRPAFEALLVILLLTVLVSFFLTTFVMTETFKP---TVKVDEK
            140         150         160         170         180         190         200

960         990        1020        1050        1080        1110        1140        1170
VLGTFKNYSQVLVDKAFVVYTLGAIGSSVVWLQVDNYFSVNLKQNFEVVSILGHTITGAKMLSLAVFTNTLLIVLLMTTI
  |:  |     ||  ||    :::::            |  ::  :  :|   ||::  |:|        :|:  ::        |      |   :||::  :           :|:|||||:
AENIFQAYKTVLQDKTYMIFMGANIATTFIIMQFDNFLPVHLSNSFKTITFWGFEIYGQRMLTIYLILACVLVVLLMTTL
            210         220         230         240         250         260         270         280

1200        1230        1260        1290        1320        1350        1380        1410
NKFIENWPLKRQLILGSLICGFGMLFNISLNTFGAILIAMTFFTFGEMIYVPASQVLRAEMMVEGKIGSYSGFLAIAQPV
|::  :||   ::  ::   :|   |||         ||:|:      ||    :|:||        :|:|||    :||:||      |||||:||    ||    :|
NRLTKDWSHQKGFIWGSLFMAIGMIFSFLTTTFTPIFIAGIVYTLGEIVYTPSVQTLGADLMNPEKIGSYNGVAAIKMPI
            290         300         310         320         330         340         350         360

1440        1470        1500        1530        1560        1590        1620        1650
ASVLAGAMVSLSYFTGKIGVQITLTIFMLAGLVLILYATKMKNIEIGK*NVRLY*RKIE*NNG*IYCCGNSWIGIHDICG
||:|||  :||:|        |||  :  |:     :    ::|:|  |
ASILAGLLVSISPMIKAIGVSLVLALTEVLAIILVLVAVNRHQKTKLN
            370         380         390         400
```

Based on this analysis, it was predicted that these proteins and their epitopes could be useful antigens for vaccines or diagnostics.

Example 1083

A DNA sequence (GBSx1157) was identified in S. agalactiae <SEQ ID 3339> which encodes the amino acid sequence <SEQ ID 3340>. This protein is predicted to be holliday junction DNA helicase (ruvA). Analysis of this protein sequence reveals the following:

---

Possible site:37
>>> Seems to have no N-terminal signal sequence
INTEGRAL    Likelihood = –1.75    Transmembrane 75-91 (74-91)
----- Final Results -----
  bacterial membrane --- Certainty = 0.1702 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the GENPEPT database.

A related DNA sequence was identified in S. pyogenes <SEQ ID 3341> which encodes the amino acid sequence <SEQ ID 3342>. Analysis of this protein sequence reveals the following:

---

Possible site: 37
>>> Seems to have no N-terminal signal sequence
INTEGRAL    Likelihood = –1.59    Transmembrane 75-91 (74-91)
----- Final Results -----
  bacterial membrane --- Certainty = 0.1638 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the databases:

```
>GP:BAB04943 GB:AP001511 holliday junction DNA helicase [Bacillus halodurans]
Identities = 86/201 (42%), Positives = 122/201 (59%), Gaps = 6/201 (2%)
Query:    1 MYDYIKGKLSKITAKFIVVETAGLGYMIYVANPYSFSGYVNQEVTIYLHQVIRDDAHLLF    60
            M DY++G L+ I   ++ VVE  G+GY +Y  NPY F    +  +TIY Q +R+D    L+
Sbjct:    1 MIDYLRGTLTDIDHQYAVVEVHGVGYQVYCPNPYEFEKERDSVITIYTFQYVREDVIRLY   60

Query:   61 GFHTENEKEIFLNLISVSGIGPTTALAIIAVDDNEGLVSAIDNSDIKYLTKEPKIGKKTA  120
            GF T+ ++  +F  L+++VSGIGP  ALAI+A     E ++ AI+  D  +L KFP +GKKTA
Sbjct:   61 GFRTKEKRSLFEKLLNVSGIGPKGALAILATGQPEHVIQAIEEEDEAFLVKFPGVGKKTA  120

Query:  121 QQMILDLSGKFVE------ASGESATSRKVSSEQNSNLEEAMEALLALGYKATELKKVKA  174
            +Q+ILDL GK E       +  E          ++ N   L+EAMEAL ALGY   ELKKVK
Sbjct:  121 RQIILDLKGKVDELHPGLESQKEEQPKPHEKNDGNQALDEAMEALKALGYVEKELKKVKP  180

Query:  175 FFEGTNETVEQYIKSSLKMLM                                         195
            E      T +  YIK  +L++++
Sbjct:  181 KLEQETLTTDAYIKKALQLML                                         201
```

```
>GP:BAB04943 GB:AP001511 holliday junction DNA helicase [Bacillus halodurans]
Identities = 91/201 (45%), Positives = 128/201 (63%), Gaps = 5/201 (2%)
Query:   1  MYDYIKGQLTKITAKYIVVEANGLGYMINVANPYSFTDSVNQLVTIYLHQVIREDAHLLF    60
            M DY++G LT I  +Y VVE +G+GY +   NPY F    + ++TIY  Q +RED    L+
Sbjct:   1  MIDYLRGTLTDIDHQYAVVEVHGVGYQVYCPNPYEFEKERDSVITIYTFQYVREDVIRLY    60

Query:  61  GFHTEDEKDVFLKLISVSGIGPTTALAIVAVDDNEGLVNAIDNSDIKYLMKFPKIGKKTA   120
            GF T++++ +F KL++VSGIGP  ALAI+A     E ++ AI+  D  +L+KFP +GKKTA
Sbjct:  61  GFRTKEKRSLFEKLLNVSGIGPKGALAILATGQPEHVIQAIEEEDEAFLVKFPGVGKKTA  120

Query: 121  QQMVLDLAGKFVEA-----PQETGHTKARSNKAGNTQLDEAIEALLALGYKAKELKKIRA  175
            +Q++LDL GK E        Q+    K     GN  LDEA+EAL ALGY  KELKK++
Sbjct: 121  RQIILDLKGKVDELHPGLFSQKEEQPKPHEKNDGNQALDEAMEALKALGYVEKELKKVKP  180

Query: 176  FFEGTSETAEQYIKSALKLLM                                         196
                E  + T + YIK AL+L++
Sbjct: 181  KLEQETLTTDAYIKKALQLML                                         201
```

An alignment of the GAS and GBS proteins is shown below.

```
Identities = 153/197 (77%), Positives = 176/197 (88%), Gaps = 1/197 (0%)
Query:   1  MYDYIKGKLSKITAKFIVVETAGLGYMIYVANPYSFSGYVNQEVTIYLHQVIRDDAHLLF    60
            MYDYIKG+L+KITAK+IVVE  GLGYMI VANPYSF+  VNQ VTIYLHQVIR+DAHLLF
Sbjct:   1  MYDYIKGQLTKITAKYIVVEANGLGYMINVANPYSFTDSVNQLVTIYLHQVIREDAHLLF    60

Query:  61  GFHTENEKEIFLNLISVSGIGPTTALAIIAVDDNEGLVSAIDNSDIKYLTKFPKIGKKTA   120
            GFHTE+EK++FL LISVSGIGPTTALAI+AVDDNEGLV+AIDNSDIKYL KFPKIGKKTA
Sbjct:  61  GFHTEDEKDVFLKLISVSGIGPTTALAIVAVDDNEGLVNAIDNSDIKYLMKFPKIGKKTA  120

Query: 121  QQMILDLSGKFVEASGESA-TSRKVSSEQNSNLEEAMEALLALGYKATELKKVKAFFEGT  179
            QQM+LDL+GKFVEA  E+  T  + +   N+ L+EA+EALLALGYKA ELKK++AFFEGT
Sbjct: 121  QQMVLDLAGKFVEAPQETGHTKARSNKAGNTQLDEAIEALLALGYKAKELKKIRAFFEGT  180

Query: 180  NETVEQYIKSSLKMLMK                                             196
            +ET EQYIKS+LK+LMK
Sbjct: 181  SETAEQYIKSALKLLMK                                             197
```

Based on this analysis, it was predicted that these proteins and their epitopes could be useful antigens for vaccines or diagnostics.

Example 1084

A DNA sequence (GBSx1159) was identified in *S. agalactiae* <SEQ ID 3343> which encodes the amino acid sequence <SEQ ID 3344>. This protein is predicted to be DNA-3-methyladenine glycosidase I (tag). Analysis of this protein sequence reveals the following:

Possible site: 50
>>> Seems to have no N-terminal signal sequence
----- Final Results ----- bacterial cytoplasm --- Certainty = 0.2812 (Affirmative) <succ>
bacterial membrane --- Certainty = 0.0000 (Not Clear) <succ>
bacterial outside --- Certainty = 0.0000 (Not Clear) <succ>

A related GBS nucleic acid sequence <SEQ ID 10263> which encodes amino acid sequence <SEQ ID 10264> was also identified.

The protein has homology with the following sequences in the GENPEPT database.

```
>GP:AAC76573 GB:AE000432 3-methyl-adenine DNA glycosylase I,
constitutive [Escherichia coli K12]
Identities = 87/176 (49%), Positives = 122/176 (68%), Gaps = 1/176 (0%)
Query:   5  MKRCSWVNLDNPLYVAYHDKEWGRAVHDDHVLFELLCLETYQSGLSWETVLNKRQEFRQV    64
            M+RC WV+ D PLY+AYHD EWG   D   LFE++CLE  Q+GLSW TVL KR+ +R
Sbjct:   1  MERCGWVSQD-PLYIAYHDNEWGVPETDSKKLFEMICLEGQQAGLSWITVLKKRENYRAC    59

Query:  65  FHHYNIEKVAAMSDADLEIILQNPRVIRHRLKLFSTRQNARSIILIQKEFGSFDRYIWSF   124
            FH ++  KVAAM + D+E ++Q+  +IRHR K+     NAR+ +  +++     F  ++WSF
Sbjct:  60  FHQFDPVKVAAMQEEDVERLVQDAGIIRHRGKIQAIIGNARAYLQMEQNGEPFVDFVWSF  119

Query: 125  VDNKVQVNSVNNYNDVPASTILSERLSKDLKKRGFKFVGPTCLYSFIQAAGMVNDH       180
```

```
              V+++ QV       +++P ST+  S+ LSK LKKRGFKFVG T  YSF+QA G+VNDH

Sbjct: 120    VNHQPQVTQATTLSEIPTSTSASDALSKALKKRGFKFVGTTICYSFMQACGLVNDH      175
```

A related DNA sequence was identified in *S. pyogenes* <SEQ ID 3345> which encodes the amino acid sequence <SEQ ID 3346>. Analysis of this protein sequence reveals the following:

Possible site: 48
>>> Seems to have no N-terminal signal sequence
----- Final Results -----
   bacterial cytoplasm --- Certainty = 0.4149 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

```
Identities = 114/184 (61%), Positives = 135/184 (72%)
Query:   3  FHMKRCSWVNLDNPLYVAYHDKEWGRAVHDDHVLFELLCLETYQSGLSWETVLNKRQEFR    62
            FHMKRCSWV DN LY  YHD EWG+ + DD    FELLCLE+YQSGLSW TVL KRQ FR
Sbjct:   2  FHMKRCSWVPKDNQLYCDYHDLEWGQPLDDDRDFFELLCLESYQSGLSWLTVLKKRQAFR    61

Query:  63  QVFHHYNIEKVAAMSDADLEIILQNPRVIRHRLKLFSTRQNARSIILIQKEFGSFDRYIW   122
               VFHHY+I   VA +  ++   L+NP +IRH+LKL +T  NA ++  IQKEFGSF  Y+W
Sbjct:  62  TVFHHYDIASVATFTSEEMADALENPSIIRHKLKLAATVNNAIAVQKIQKEFGSFSTYLW   121

Query: 123  SFVDNKVQVNSVNNYNDVPASTTLSERLSKDLKKRGFKFVGPTCLYSFIQAAGMVNDHEN   182
            +FV K   N VN  N VPA T LS RL+KDLKKRGFKF+GPT +YSF+QA+G+VNDHE
Sbjct: 122  NFVGGKPINNLVNQENLVPAQTELSIRLAKDLKKRGFKFLGPTTVYSFMQASGLVNDHEE   181

Query: 183  ICDF                                                          186
             C F
Sbjct: 182  ACVF                                                          185
```

Based on this analysis, it was predicted that these proteins and their epitopes could be useful antigens for vaccines or diagnostics.

Example 1085

A DNA sequence (GBSx1160) was identified in *S. agalactiae* <SEQ ID 3347> which encodes the amino acid sequence <SEQ ID 3348>. This protein is predicted to be competence-damage inducible protein (cinA). Analysis of this protein sequence reveals the following:

Possible site: 22
>>> Seems to have an uncleavable N-term signal seq
----- Final Results -----
   bacterial membrane --- Certainty = 0.0000 (Not Clear) <succ>
     bacterial outside --- Certainty = 0.0000 (Not Clear) <succ>
       bacterial cytoplasm --- Certainty = 0.0000 (Not Clear) <succ>

A related GBS nucleic acid sequence <SEQ ID 10261> which encodes amino acid sequence <SEQ ID 10262> was also identified.

The protein has homology with the following sequences in the GENPEPT database.

```
>GP:CAA84071 GB:Z34303 CinA protein [Streptococcus pneumoniae]
Identities = 194/297 (65%), Positives = 236/297 (79%), Gaps = 1/297 (0%)
Query:   1  MVEGSIPLQNLTGLAVGGIVTSKGVQYMVLPGPPSELKPMVMEQVVPILSNNGTKLYSRV    60
            +VEG+IPL N TGLAVGG +   GV Y+VLPGPPSELKPMV+ Q++P L   G+KLYSRV
Sbjct: 121  IVEGAIPLPNETGLAVGGKLEVDGVTYVVLPGPPSELKPMVLNQLLPKLMT-GSKLYSRV   179

Query:  61  LRFFGIGESQLVTILEDIIKNQTDPTIAPYAKVGEVTLRLSTKAENQDEADFKLDSLEKE   120
            LRFFGIGESQLVTIL D+I NQ DPT+APYAK GEVTLRLSTKA +Q+EA+   LD LE +
Sbjct: 180  LRFFGIGESQLVTILADLIDNQIDPTLAPYAKTGEVTLRLSTKASSQEEANQALDILENQ   239

Query: 121  ILALKTLDNRKLKDLLYGYGDNNSMARTVLELLKVQNKTITAAESLTAGLFQSQLAEFSG   180
            IL  +T +   L+D  YGYG+   S+A  V+E LK Q KTI AAAESLTAGLFQ+ +A FSG
Sbjct: 240  ILDCQTFEGISLRDFCYGYGEETSLASIVVEELKRQGKTIAAAESLTAGLFQATVANFSG   299

Query: 181  ASQVFNGGETTYSMEAKSQLLGIPKKKLQEYGVVSHFTAEAMAQQARQLLKADFGIGLTG   240
            +S +F GGF TYS+E KS++L IP K L+E+GVVS FTA+ MA+QAR    ++DFGI LTG
Sbjct: 300  VSSIFEGGFVTYSLEEKSRMLDIPAKNLEEHGVVSEFTAQKMAEQARSKTQSDFGISLTG   359

Query: 241  VAGPDELEGYPAGTVFIGIATPEGVSSIKVSIGGKSRSDVRHISTLHAFDLVRRALL      297
            VAGPD LEG+P GTVFIG+A  +G    IKV+IGG+SR+DVRHI+  +HAF+LVR+ALL
Sbjct: 360  VAGPDSLEGHPVGTVFIGLAQDQGTEVIKVNIGGRSRADVRHIAVMHAFNLVRKALL      416
```

A related DNA sequence was identified in *S. pyogenes* <SEQ ID 3349> which encodes the amino acid sequence <SEQ ID 3350>. Analysis of this protein sequence reveals the following:

Possible site: 22
>>> Seems to have no N-terminal signal sequence
INTEGRAL    Likelihood = −1.91    Transmembrane 134-150 (134-150)
----- Final Results -----
  bacterial membrane --- Certainty = 0.1765 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the databases:

```
>GP:CAAS4071 GB:Z34303 CinA protein [Streptococcus pneumoniae]
Identities = 286/417 (68%), Positives = 336/417 (79%), Gaps = 1/417 (0%)
Query:    1 MKAELIAVGTEILTGQIVNTEAQFLSEKMAELGIDVYFQTAVGDNEERLLSVITTASQRS     60
            MKAE+IAVGTEILTGQIVNTNAQFLSEK+AE+G+DVYFQTAVGDNE RLLS++  ASQRS
Sbjct:    1 MKAEIIAVGTEILTGQIVNTNAQFLSEKLAEIGVDVYFQTAVGDNEVRLLSLLEIASQRS     60

Query:   61 NLVILCGGLGPTKDDLTKQTLAKYLRKDLVYDEQACQKLDDFFAKRKPSSRTPNNERQAQ    120
            +LVIL GGLG T+DDLTKQTLAK+L K LV+D QA +KLD FFA R   +RTPNNERQAQ
Sbjct:   61 SLVILTGGLGATEDDLTKQTLAKFLGKALVFDPQAQEKLDIFFALRPDYARTPNNERQAQ    120

Query:  121 VIEGSIPLPNKTGLAVGGFITVDGISYVVLPGPPSELKPMVNEELVPLLSKQYSTLYSKV    180
            ++EG+IPLPN+TGLAVGG + VDG++YVVLPGPPSELKPMV  +L+P L    S LYS+V
Sbjct:  121 IVEGAIPLPNETGLAVGGKLEVDGVTYVVLPGPPSELKPMVLNQLLPKLMTG-SKLYSRV    179

Query:  181 LRFFGIGESQLVTVLSDFIENQTDPTIAPYAKTGEVTLRLSTKTENQALADKKLGQLEAQ    240
            LRFFGIGESQLVT+L+D I+NQ DPT+APYAKTGEVTLRLSTK  +Q A++ L  LE Q
Sbjct:  180 LRFFGIGESQLVTILADLIDNQIDPTLAPYAKTGEVTLRLSTKASSQEEANQALDILENQ    239

Query:  241 LLSRKTLEGQPLADVFYGYGEDNSLARETFELLVKYDKTITAAESLTAGLFQSTLASFPG    300
            +L +T EG  L D  YGYGE+ SLA    E L +  KTI AAESLTAGLFQ+T+A+F G
Sbjct:  240 ILDCQTFEGISLRDFCYGYGEETSLASIVVEELKRQGKTIAAAESLTAGLFQATVANFSG    299

Query:  301 ASQVFNGGFVTYSMEEKAKMLGLPLEELKSHGVVSAYTAEGMAEQARLLTGADIGVSLTG    360
            S +F GGFVTYS+EEK++ML +P + L+ HGVVS +TA+ MAEQAR  T +D G+SLTG
Sbjct:  300 VSSIFEGGFVTYSLEEKSRMLDIPAKNLEEHGVVSEFTAQKMAEQARSKTQSDFGISLTG    359

Query:  361 VAGPDMLEEQPAGTVFIGLATQNKVESIKVLISGRSRLDVRYIATLHAFNMVRKTLL      417
            VAGPD LE  P GTVFIGLA      E IKV I GRSR DVR+IA +HAFN+VRK LL
Sbjct:  360 VAGPDSLEGHPVGTVFIGLAQDQGTEVIKVNIGGRSRADVRHIAVMHAFNLVRKALL      416
```

An alignment of the GAS and GBS proteins is shown below.

```
Identities = 201/299 (67%), Positives = 242/299 (80%)
Query:    1 MVEGSIPLQNLTGLAVGGIVTSKGVQYMVLPGPPSELKPMVMEQVVPILSNNGTKLYSRV     60
            ++EGSIPL N TGLAVGG +T  G+ Y+VLPGPPSELKPMV E++VP+LS    + LYS+V
Sbjct:  121 VIEGSIPLPNKTGLAVGGFITVDGISYVVLPGPPSELKPMVNEELVPLLSKQYSTLYSKV    180

Query:   61 LRFFGIGESQLVTILEDIIKNQTDPTIAPYAKVGEVTLRLSTKAENQDEADFKLDSLEKE    120
            LRFFGIGESQLVT+L D I+NQTDPTIAPYAK GEVTLRLSTK ENQ  AD KL  LE +
Sbjct:  181 LRFFGIGESQLVTVLSDFIENQTDPTIAPYAKTGEVTLRLSTKTENQALADKKLGQLEAQ    240

Query:  121 ILALKTLDNRKLKDLLYGYGDNNSMARTVLELLKVQNKTITAAESLTAGLFQSQLAEFSG    180
            +L+ KTL+ + L D+ YGYG++NS+AR   ELL   +KTITAAESLTAGLFQS LA F G
Sbjct:  241 LLSRKTLEGQPLADVFYGYGEDNSLARETFELLVKYDKTITAAESLTAGLFQSTLASFPG    300

Query:  181 ASQVFNGGFTTYSMEAKSQLLGIPKKKLQEYGVVSHFTAEAMAQQARQLLKADEGIGLTG    240
            ASQVFNGGF TYSME K+++LG+P ++L+ +GVVS +TAE MA+QAR L  AD G+ LTG
Sbjct:  301 ASQVFNGGFVTYSMEEKAKMLGLPLEELKSHGVVSAYTAEGMAEQARLLTGADIGVSLTG    360

Query:  241 VAGPDELEGYPAGTVFIGIATPEGVSSIKVSIGGKSRSDVRHISTLHAFDLVRRALLKI     299
            VAGPD LE  PAGTVFIG+AT    V SIKV I G+SR DVR+I+TLHAF++VR+ LLK+
Sbjct:  361 VAGPDMLEEQPAGTVFIGLATQNKVESIKVLISGRSRLDVRYIATLHAFNMVRKTLLKL    419
```

Figure 131:
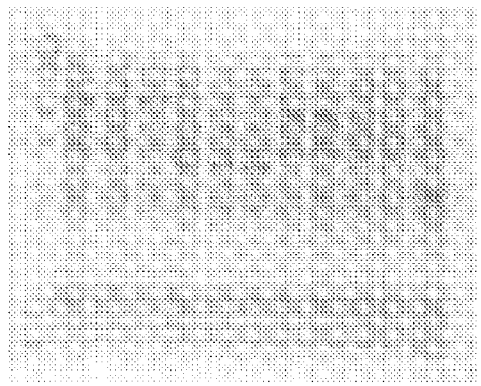

SEQ ID 3348 (GBS646) was expressed in *E. coli* as a GST-fusion product. SDS-PAGE analysis of total cell extract is shown in FIG. 131 (lane 2-4; MW 61.6 kDa), in FIG. 134 (lane 3; MW 57.5 kDa+lanes 2 & 4; MW 27 kDa). It was also expressed in *E. coli* as a His-fusion product. SDS-PAGE analysis of total cell extract is shown in FIG. 131 (lane 5-7; MW 36.6 kDa) and in FIG. 178 (lane 5; MW 37 kDa).

GBS646-His was purified as shown in FIG. 229, lane 5.

Based on this analysis, it was predicted that these proteins and their epitopes could be useful antigens for vaccines or diagnostics.

Example 1086

A DNA sequence (GBSx1161) was identified in *S. agalactiae* <SEQ ID 3351> which encodes the amino acid sequence <SEQ ID 3352>. Analysis of this protein sequence reveals the following:

Possible site: 59
>>> Seems to have no N-terminal signal sequence
INTEGRAL    Likelihood = −0.37    Transmembrane 148-164 (148-164)
----- Final Results -----
   bacterial membrane --- Certainty = 0.1150 (Affirmative) <succ>
     bacterial outside --- Certainty = 0.0000 (Not Clear) <succ>
       bacterial cytoplasm --- Certainty = 0.0000 (Not Clear) <succ>

A related DNA sequence was identified in *S. pyogenes* <SEQ ID 3353> which encodes the amino acid sequence <SEQ ID 3354>. Analysis of this protein sequence reveals the following:

Possible site: 59
>>> Seems to have no N-terminal signal sequence
INTEGRAL    Likelihood = −0.37    Transmembrane 148-164 (148-164)
----- Final Results -----
   bacterial membrane --- Certainty = 0.1150 (Affirmative) <succ>
     bacterial outside --- Certainty = 0.0000 (Not Clear) <succ>
       bacterial cytoplasm --- Certainty = 0.0000 (Not Clear) <succ>

The protein has homology with the following sequences in the databases:

```
>GP:AAD04860 GB:AF069745 RecA protein [Streptococcus parasanguinis]
Identities = 333/381 (87%), Positives = 356/381 (93%), Gaps = 3/381 (0%)
Query:    1 LAKKLKKNEEITKKFGDERRKALDDALKNIEKDFGKGAVMRLGERAEQKVQVMSSGSLAL    60
            +AKK KK ++ITKKFGDER KAL+DALK IEKDFGKG++MRLGERAEQKVQVMSSGSLAL
Sbjct:    1 MAKKQKKLDDITKKFGDEREKALNDALKLIEKDFGKGSIMRLGERAEQKVQVMSSGSLAL    60

Query:   61 DIALGAGGYPKGRIIEIYGPESSGKTTVALHAVAQAQKEGGIAAFIDAEHALDPAYAAAL   120
            DIALGAGGYPKGRIIEIYGPESSGKTTVALHAVAQAQKEGGIAAFIDAEHALDP+YAAAL
Sbjct:   61 DIALGAGGYPKGRIIEIYGPESSGKTTVALHAVAQAQKEGGIAAFIDAEHALDPSYAAAL   120

Query:  121 GVNIDELLLSQPDSGEQGLEIAGKLIDSGAVDLVVVDSVAALVPRAEIDGDIGDSHVGLQ   180
            GVNIDELLLSQPDSGEQGLEIAGKLIDSGAVDLVVVDSVAALVPRAEIDGDIGDSHVGLQ
Sbjct:  121 GVNIDELLLSQPDSGEQGLEIAGKLIDSGAVDLVVVDSVAALVPRAEIDGDIGDSHVGLQ   180

Query:  181 ARMMSQAMRKLSASINKTKTIAIFINQLREKVGVMFGNPETTPGGRALKFYASVRLDVRG   240
            ARAMSQAMRKL ASINKTKTIAIFINQLREKVGVMFGNPETTPGGRALKFYASVRLDVRG
Sbjct:  181 ARAMSQAMRKLGASINKTKTIAIFINQLREKVGVMFGNPETTPGGRALKFYASVRLDVRG   240

Query:  241 TTQIKGTGDQKDSSIGKETKIKVVENKVAPPFKVAEVEIMYGEGISRTGELVKIASDLDI   300
               TQIKGTGDQKD+++GKETKIKVVKNKVAPPFK A VEIMYGEGISRTGELVKIA+DLDI
Sbjct:  241 NTQIKGTGDQKDTNVGKETKIKVVKNKVAPPFKEAMVEIMYGEGISRTGELVKIATDLDI   300

Query:  301 IQKAGAWFSYNGEKIGQGSENAKRYLADHPELFDEIDLKVRVKFGLLEESEEESAMAVAS   360
            IQKAGAW+SYNGEKIGQGSENAK++LADHPE+FDEID KVRV FGL+E+ E    ++
Sbjct:  301 IQKAGAWYSYNGEKIGQGSENAKKFLADHPEIFDEIDHKVRVHFGLIEKDEAVKSLDKTE   360

Query:  361 EE---TDDLALDLDNGIEIED                                          378
            E     +++ LDLD+ IEIED
Sbjct:  361 EAAPVVEEVTLDLDDAIEIED                                          381
```

An alignment of the GAS and GBS proteins is shown below.

```
Identities = 339/379 (89%), Positives = 356/379 (93%), Gaps = 1/379 (0%)
Query:    1 MAKKTKKAEEITKKFGDERRKALDDALKNIEKDFGKGAVMRLGERAEQKVQVMSSGSLAL    60
            +AKK KK EEITKKFGDERRKALDDALKNIEKDFGKGAVMRLGERAEQKVQVMSSGSLAL
Sbjct:    1 LAKKLKKNEEITKKFGDERRKALDDALKNIEKDFGKGAVMRLGERAEQKVQVMSSGSLAL    60

Query:   61 DIALGAGGYPKGRIVEIYGPESSGKTTVALHAVAQAQKEGGIAAFIDAEHALDPAYAAAL   120
            DIALGAGGYPKGRI+EIYGPESSGKTTVALHAVAQAQKEGGIAAFIDAEHALDPAYAAAL
Sbjct:   61 DIALGAGGYPKGRIIEIYGPESSGKTTVALHAVAQAQKEGGIAAFIDAEHALDPAYAAAL   120

Query:  121 GVNIDELLLSQPDSGEQGLEIAGKLIDSGAVDLVVVDSVAALVPRAEIDGDIGDSHVGLQ   180
            GVNIDELLLSQPDSGEQGLEIAGKLIDSGAVDLVVVDSVAALVPRAEIDGDIGDSHVGLQ
Sbjct:  121 GVNIDELLLSQPDSGEQGLEIAGKLIDSGAVDLVVVDSVAALVPRAEIDGDIGDSHVGLQ   180

Query:  181 ARMMSQAMRKLSASINKTKTIAIFINQLREKVGVMFGNPETTPGGRALKFYSSVRLDVRG   240
            ARMMSQAMRKLSASINKTKTIAIFINQLREKVGVMFGNPETTPGGRALKFY+SVRLDVRG
Sbjct:  181 ARNMSQAMRKLSASINKTKTIAIFINQLREKVGVMFGNPETTPGGRALKFYASVRLDVRG   240

Query:  241 NTQIKGTGEHKDHNVGKETKIKVVKNKVAPPFREAFVEIMYGEGISRTGELIKIASDLDI   300
            TQIKGTG+ KD ++GKETKIKVVKNKVAPPF+ A VEIMYGEGISRTGEL+KIASDLDI
Sbjct:  241 TTQIKGTGDQKDSSIGKETKIKVVKNKVAPPFKVAEVEIMYGEGISRTGELVKIASDLDI   300

Query:  301 IQKAGAWYSYNGEKIGQGSENAKKYLADNPAIFDEIDHKVRVHFGMTEDDSPVQSELVEE   360
            IQKAGAW+SYNGEKIGQGSENAK+YLAD+P +FDEID KVRV FG+ E +S  +S +
Sbjct:  301 IQKAGAWFSYNGEKIGQGSENAKRYLADHPELFDEIDLKVRVKFGLLE-ESEEESAMAVA   359

Query:  361 KNEADDLVLDLDNAIEIEE                                            379
            E DDL LDLDN IEIE+
Sbjct:  360 SEETDDLALDLDNGIEIED                                            378
```

Based on this analysis, it was predicted that these proteins and their epitopes could be useful antigens for vaccines or diagnostics.

Example 1087

A DNA sequence (GBSx1162) was identified in *S. agalactiae* <SEQ ID 3355> which encodes the amino acid sequence <SEQ ID 3356>. Analysis of this protein sequence reveals the following:

```
Possible site: 26
>>> Seems to have no N-terminal signal sequence
----- Final Results -----
    bacterial cytoplasm --- Certainty = 0.2344 (Affirmative) <succ>
    bacterial membrane --- Certainty = 0.0000 (Not Clear) <succ>
    bacterial outside --- Certainty = 0.0000 (Not Clear) <succ>
```

A related GBS nucleic acid sequence <SEQ ID 10259> which encodes amino acid sequence <SEQ ID 10260> was also identified.

The protein has homology with the following sequences in the GENPEPT database.

```
>GP:AAG37358 GB:AF028804 NrpR [Lactococcus lactis subsp. cremoris]
Identities = 69/132 (52%), Positives = 102/132 (77%)
Query:   5 MIKIYTISSCTSCKKAKTWLNAHQLPYKEQNLGKESLTRDEILEILTKTESGIESIVSSK    64
           MI IYT  SCTSCKKAKTWL+ H +P+ E+NL  + L+  EI +IL K + G+E ++SS+
Sbjct:   1 MITIYTAPSCTSCKKAKTWLSYHHIPFNERNLIADPLSTTEISQILQKCDDGVEGLISSR    60

Query:  65 NRYAKALNCNIEELSVNEVIDLIQENPRILKSPILIDDKRLQVGYKEDDIRAFLPRSIRN   124
           NR+ K L  + E++S+++ I +I ENP+I++ PI++D+KRL VGY E++IRAFLPR++R
Sbjct:  61 NRFVKTLGVDFEDISLSQAIKIISENPQIMRRPIIMDEKRLHVGYNEEEIRAFLPRTVRV   120

Query: 125 VENAEARLRAAL                                                 136
           +EN   ARLR+A+
Sbjct: 121 LENGGARLRSAI                                                 132
```

A related DNA sequence was identified in *S. pyogenes* <SEQ ID 3357> which encodes the amino acid sequence <SEQ ID 3358>. Analysis of this protein sequence reveals the following:

```
Possible site: 28
>>> Seems to have no N-terminal signal sequence
----- Final Results -----
    bacterial cytoplasm --- Certainty = 0.2569 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
Identities = 117/132 (88%), Positives = 128/132 (96%)
Query:   5 MIKIYTISSCTSCKKAKTWLNAHQLPYKEQNLGKESLTRDEILEILTKTESGIESIVSSK    64
           MIKIYTISSCTSCKKAKTWLNAH+L YKEQNLGKE LT++EIL IL+KTE+G+ESIVSSK
Sbjct:   1 MIKIYTISSCTSCKKAKTWLNAHKLAYKEQNLGKEPLTKEEILAILSKTENGVESIVSSK    60

Query:  65 NRYAKALNCNIEELSVNEVIDLIQENPRILKSPILIDDKRLQVGYKEDDIRAFLPRSIRN   124
           NRYAKAL+C+IEELSV+EVIDLIQ+NPRILKSPILIDDKRLQVGYKEDDIRAFLPRSIRN
Sbjct:  61 NRYAKALDCDIEELSVSEVIDLIQDNPRILKSPILIDDKRLQVGYKEDDIRAFLPRSIRN   120

Query: 125 VENAEARLRAAL                                                 136
           +EN EARLRAAL
Sbjct: 121 IENTEARLRAAL                                                 132
```

Based on this analysis, it was predicted that these proteins and their epitopes could be useful antigens for vaccines or diagnostics.

Example 1088

A DNA sequence (GBSx1163) was identified in *S. agalactiae* <SEQ ID 3359> which encodes the amino acid sequence <SEQ ID 3360>. Analysis of this protein sequence reveals the following:

```
Possible site: 49
>>> Seems to have no N-terminal signal sequence
----- Final Results -----
    bacterial cytoplasm --- Certainty = 0.3097 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP:BAB04987 GB:AP001511 unknown [Bacillus halodurans]
Identities = 49/82 (59%), Positives = 64/82 (77%), Gaps = 1/82 (1%)
Query:  1   MGFTDETVRFRLDDSN-KVEISETLTAVYRSLEEKGYNPINQIVGYVLSGDPAYVPRYND   59
            M   D T++F +++    V++ E L +VY +LEEKGYNPINQIVGY+LSGDPAY+PR+ D
Sbjct:  1   MSSMDNTMKFNVNEEPVSVDVQEVLMSVYEALEEKGYNPINQIVGYLLSGDPAYIPRHKD   60

Query: 60   ARNQIRKYERDEIVEELVRYYL                                         81
            AR  IRK ERDE++EELV+ YL
Sbjct: 61   ARTLIRKLERDELIEELVKSYL                                         82
```

A related DNA sequence was identified in *S. pyogenes* <SEQ ID 3361> which encodes the amino acid sequence <SEQ ID 3362>. Analysis of this protein sequence reveals the following:

Possible site: 49
>>> Seems to have no N-terminal signal sequence
----- Final Results -----
   bacterial cytoplasm --- Certainty = 0.3097 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 80/88 (90%), Positives = 85/88 (95%)
Query:  1   MGFTDETVRFRLDDSNKVEISETLTAVYRSLEEKGYNPINQIVGYVLSGDPAYVPRYNDA   60
            MGFTDETVRF+LDD +K +ISETLTAVY SL+EKGYNPINQIVGYVLSGDPAYVPRYNDA
Sbjct:  1   MGFTDETVRFKLDDGDKRQISETLTAVYHSLDEKGYNPINQIVGYVLSGDPAYVPRYNDA   60

Query: 61   RNQIRKYERDEIVEELVRYYLQGNGIDL                                   88
            RNQIRKYERDEIVEELVRYYLQGNGID+
Sbjct: 61   RNQIRKYERDEIVEELVRYYLQGNGIDV                                   88
```

Based on this analysis, it was predicted that these proteins and their epitopes could be useful antigens for vaccines or diagnostics.

Possible site: 27
>>> Seems to have no N-terminal signal sequence
----- Final Results -----
   bacterial cytoplasm --- Certainty = 0.1575 (Affirmative) <succ>
   bacterial membrane --- Certainty = 0.0000 (Not Clear) <succ>
   bacterial outside --- Certainty = 0.0000 (Not Clear) <succ>

A related GBS nucleic acid sequence <SEQ ID 10257> which encodes amino acid sequence <SEQ ID 10258> was also identified.

The protein has homology with the following sequences in the GENPEPT database.

Example 1089

A DNA sequence (GBSx1164) was identified in *S. agalactiae* <SEQ ID 3363> which encodes the amino acid sequence <SEQ ID 3364>. Analysis of this protein sequence reveals the following:

```
>GP:CAB14698 GB:Z99118 similar to hypothetical proteins [Bacillus subtilis]
Identities = 82/138 (59%), Positives = 109/138 (78%), Gaps = 1/138 (0%)
Query:   1   MRIMGLDVGSKTVGVAISDPLGFTAQGLEIIKIDEESGNFGFDRLAELVKEYKVDKFVVG    60
             MRI+GLD+G+KT+GVA SD +G+TAQG+E IKI+E   G++G  RL+EL+K+Y +DK V+G
Sbjct:   1   MRILGLDLGTKTLGVALSDEMGWTAQGIETIKINEAEGDYGLSRLSELIKDYTIDKIVLG    60

Query:  61   LPKNMNNTSGPRVEASQAYGDKITELFNLPVEYQDERLTTVQAERMLVEQADISRGKRKK   120
              PKNMN T GPR EASQ +       +N+PV      DERLTT+ AE+ML+   AD+SR KRKK
Sbjct:  61   FPKNMNGTVGPRGEASQTFAKVLETTYNVPVVLWDERLTTMAAEKMLI-AADVSRQKRKK   119

Query: 121   VIDKLAAQLILQNYLDRM                                            138
             VIDK+AA +ILQ YLD +
Sbjct: 120   VIDKMAAVMILQGYLDSL                                            137
```

A related DNA sequence was identified in *S. pyogenes* <SEQ ID 3365> which encodes the amino acid sequence <SEQ ID 3366>. Analysis of this protein sequence reveals the following:

```
Possible site: 27
>>> Seems to have no N-terminal signal sequence
----- Final Results -----
   bacterial cytoplasm --- Certainty = 0.1575 (Affirmative) <succ>
   bacterial membrane --- Certainty = 0.0000 (Not Clear) <succ>
   bacterial outside  --- Certainty = 0.0000 (Not Clear) <succ>
```

An alignment of the GAS and GBS proteins is shown below.

```
Possible site: 52
>>> Seems to have no N-terminal signal sequence
----- Final Results -----
   bacterial cytoplasm --- Certainty = 0.3170 (Affirmative) <succ>
   bacterial membrane --- Certainty = 0.0000 (Not Clear) <succ>
   bacterial outside  --- Certainty = 0.0000 (Not Clear) <succ>
```

An alignment of the GAS and GBS proteins is shown below.

```
Identities = 114/139 (82%), Positives = 126/139 (90%)
Query:   1  MRIMGLDVGSKTVGVAISDPLGFTAQGLEIIKIDEESGNFGFDRLAELVEEYKVDKFVVG   60
            MRIMGLDVGSKTVGVAISDPLGFTAQGLEIIKIDEE   FGF RL ELVK+Y+V++FV+G
Sbjct:   1  MRIMGLDVGSKTVGVAISDPLGFTAQGLEIIKIDEEKAEFGFTRLEELVKQYQVEQFVIG   60

Query:  61  LPKNMNNTSGPRVEASQAYGDKITELFNLPVEYQDERLTTVQAERMLVEQADISRGKRKK  120
            LPKNMNNT+GPRV+AS  YG+ I  LF LPV YQDERLTTV+A+RML+EQADISRGKRKK
Sbjct:  61  LPKNMNNTNGPRVDASITYGNHIEHLFGLPVHYQDERLTTVEAKRMLIEQADISRGKRKK  120

Query: 121  VIDKLAAQLILQNYLDRMF                                          139
            VIDKLAAQLILQNYL+R F
Sbjct: 121  VIDKLAAQLILQNYLNRNF                                          139
```

Based on this analysis, it was predicted that these proteins and their epitopes could be useful antigens for vaccines or diagnostics.

Example 1090

A DNA sequence (GBSx1165) was identified in *S. agalactiae* <SEQ ID 3367> which encodes the amino acid sequence <SEQ ID 3368>. Analysis of this protein sequence reveals the following:

```
Possible site: 56
>>> Seems to have no N-terminal signal sequence
----- Final Results -----
   bacterial cytoplasm --- Certainty = 0.2631 (Affirmative) <succ>
   bacterial membrane --- Certainty = 0.0000 (Not Clear) <succ>
   bacterial outside  --- Certainty = 0.0000 (Not Clear) <succ>
```

The protein has homology with the following sequences in the GENPEPT database.

```
>GP:CAB14697 GB:Z99118 yrzB [Bacillus subtilis]
Identities = 50/94 (53%), Positives = 65/94 (68%), Gaps = 5/94 (5%)
Query:  12  EHQHEVITLVDENGNETLFEILLTIDGREEFGKNYVLLVPAGAEEDEQGEIEIQAYSFTE   71
            EH +  IT+VD+ GNE L E+L T +  EEFGK+YVL  P  +++DE  E+EI A SFT
Sbjct:   2  EHGEKNITIVDDQGNEQLCEVLFTFEN-EEFGKSYVLYYPIESKDDE--EVEILASSFTP   58

Query:  72  NADGTEGDLQPIPEDSDAEWDMIEEVFNSFLDEE                           105
            N DG  G+L PI  ++D EWDMIEE  N+FL +E
Sbjct:  59  NEDGENGELFPI--ETDEEWDMIEETLNTFLADE                            90
```

A related DNA sequence was identified in *S. pyogenes* <SEQ ID 3369> which encodes the amino acid sequence <SEQ ID 3370>. Analysis of this protein sequence reveals the following:

```
Identities= 90/98 (91%), Positives = 94/98 (95%)
Query:   7  HDHNHEHQHEVITLVDENGNETLFEILLTIDGREEFGKNYVLLVPAGAEEDEQGEIEIQA   66
            H+H ++HQHEVITLVDE GNETLFEILLTIDGREEFGKNYVLLVPAG+EEDE GEIEIQA
Sbjct:   3  HNHENDHQHEVITLVDEQGNETLFEILLTIDGREEFGKNYVLLVPAGSEEDESGEIEIQA   62

Query:  67  YSFTENADGTEGDLQPIPEDSDAEWDMIEEVFNSFLDE                       104
            YSFTEN DGTEGDLQPIPEDSDAEWDMIEEVFNSFLDE
Sbjct:  63  YSFTENEDGTEGDLQPIPEDSDAEWDMIEEVFNSFLDE                       100
```

Based on this analysis, it was predicted that these proteins and their epitopes could be useful antigens for vaccines or diagnostics.

Example 1091

A DNA sequence (GBSx1166) was identified in *S. agalactiae* <SEQ ID 3371> which encodes the amino acid sequence <SEQ ID 3372>. Analysis of this protein sequence reveals the following:

Possible site: 20
>>> Seems to have no N-terminal signal sequence
----- Final Results -----
    bacterial cytoplasm --- Certainty = 0.2059 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1092

A DNA sequence (GBSx1167) was identified in *S. agalactiae* <SEQ ID 3373> which encodes the amino acid sequence <SEQ ID 3374>. This protein is predicted to be unnamed protein product. Analysis of this protein sequence reveals the following:

Possible site: 53
>>> Seems to have no N-terminal signal sequence
INTEGRAL    Likelihood = -9.18    Transmembrane 314-330 (308-334)
INTEGRAL    Likelihood = -6.21    Transmembrane 279-295 (274-300)
INTEGRAL    Likelihood = -6.10    Transmembrane 136-152 (135-157)
INTEGRAL    Likelihood = -5.31    Transmembrane 232-248 (226-253)
INTEGRAL    Likelihood = -4.73    Transmembrane 163-179 (162-180)
INTEGRAL    Likelihood = -3.13    Transmembrane 95-111 (94-119)
INTEGRAL    Likelihood = -3.03    Transmembrane 386-402 (386-405)
INTEGRAL    Likelihood = -2.18    Transmembrane 204-220 (204-221)
INTEGRAL    Likelihood = -2.13    Transmembrane 40-56 (40-57)
INTEGRAL    Likelihood = -1.70    Transmembrane 186-202 (182-202)
----- Final Results -----
    bacterial membrane --- Certainty = 0.4673 (Affirmative) <succ>
    bacterial outside --- Certainty = 0.0000 (Not Clear) <succ>
    bacterial cytoplasm --- Certainty = 0.0000 (Not Clear) <succ>

A related GBS nucleic acid sequence <SEQ ID 10255> which encodes amino acid sequence <SEQ ID 10256> was also identified.

A related DNA sequence was identified in *S. pyogenes* <SEQ ID 3375> which encodes the amino acid sequence <SEQ ID 3376>. Analysis of this protein sequence reveals the following:

Possible site: 53
>>> Seems to have no N-terminal signal sequence
INTEGRAL    Likelihood = -7.38    Transmembrane 315-331 (311-333)
INTEGRAL    Likelihood = -6.48    Transmembrane 40-56 (37-61)
INTEGRAL    Likelihood = -6.10    Transmembrane 278-294 (274-298)
INTEGRAL    Likelihood = -5.57    Transmembrane 392-408 (387-410)
INTEGRAL    Likelihood = -3.98    Transmembrane 186-202 (184-208)
INTEGRAL    Likelihood = -3.93    Transmembrane 339-355 (338-356)
INTEGRAL    Likelihood = -2.97    Transmembrane 235-251 (228-253)
INTEGRAL    Likelihood = -2.44    Transmembrane 166-182 (166-182)
INTEGRAL    Likelihood = -2.23    Transmembrane 106-122 (106-125)
INTEGRAL    Likelihood = -1.81    Transmembrane 83-99 (83-101)
----- Final Results -----
    bacterial membrane --- Certainty = 0.3951 (Affirmative) <succ>
    bacterial outside --- Certainty = 0.0000 (Not Clear) <succ>
    bacterial cytoplasm --- Certainty = 0.0000 (Not Clear) <succ>

A related sequence was also identified in GAS <SEQ ID 9179> which encodes the amino acid sequence <SEQ ID 9180>. Analysis of this protein sequence reveals the following:

Possible cleavage site: 13
>>> Seems to have a cleavable N-term signal seq.
INTEGRAL    Likelihood = -7.38    Transmembrane 243-259 (239-261)
INTEGRAL    Likelihood = -6.10    Transmembrane 206-222 (202-226)
INTEGRAL    Likelihood = -5.57    Transmembrane 320-336 (315-338)
INTEGRAL    Likelihood = -3.98    Transmembrane 114-130 (112-136)
INTEGRAL    Likelihood = -3.93    Transmembrane 267-283 (266-284)
INTEGRAL    Likelihood = -2.97    Transmembrane 163-179 (156-181)
INTEGRAL    Likelihood = -2.44    Transmembrane 94-110 (94-110)
INTEGRAL    Likelihood = -2.23    Transmembrane 34-50 (34-53)
----- Final Results -----
    bacterial membrane --- Certainty= 0.395 (Affirmative) <succ>
    bacterial outside --- Certainty= 0.0000 (Not Clear) <succ>
    bacterial cytoplasm --- Certainty= 0.0000 (Not Clear) <succ>

An alignment of the GAS and GBS proteins is shown below.

```
Identities = 200/480 (41%), Positives = 310/480 (63%), Gaps = 1/480 (0%)
Query:  40  ILLYSVLSTLLAIANPLLTYFANGLQTQNLYTGLMMTKGQIPYSDVFATGGFLYYVTIAL    99
            +L +S++ + L IA P LT  ANGLQ+QNLY G+M+TKGQ+PYS  F TGG  Y+V IAL
Sbjct:  40  LLFFSIIISSLTIAVPFLTDAANGLQSQNLYIGMMLTKGQLPYSAAFTTGGLFYFVIIAL    99

Query: 100  SYLLGSSIWLLIVQFIAYYVSGIYFYKLVYYVAQSEIVSIGMTLIFYIMNIVLGFGGMYP   159
            SY LGS++WL+ VQ   +Y+SG+Y YKL+ Y+   + V++ ++ +Y++++ LGFGG+YP
```

```
-continued
Sbjct: 100  SYYLGSTLWLVFVQVFCFYLSGLYLYKLINYMTGFQKVALTFSISYYLLSVSLGFGGLYP  159

Query: 160  IQWALPFMLISLWFLIKFCVDNIVDEAFIFYGILAAFSLFIDPQTLIFWLCSFVLLTATN  219
              Q A+PF+LIS WFL K+   + DEAFI +G + A ++ IDP TLIFW  + V + + N
Sbjct: 160  TQLAMPFILISAWFLTKYFACLVKDEAFILFGFVGALAMLIDPSTLIFWSFACVTVFSYN  219

Query: 220  IKQKQSLRGFYQFLCVVFGMILIAYTVGYFMFNLQIISSYIDKAIFYPFTYFARTNHSFL  279
            I QK   RGFYQ L  +FGMIL+ YT GYF+ NLQ+++ Y+ + +  YPFT+F    N S L
Sbjct: 220  ISQKHLARGFYQLLASIFGMILVFYTAGYFILNLQVLNPYLSQTMIYPFTFFKSGNLSLL  279

Query: 280  LSLAIQIVVLLGSGCLFGLWDFIQNRKKASYQIGLNFIACIFIIYAIMAIFSRDFNLYHF  339
                LAIQ+    LG G L G+ + I+    K  S ++         + +     ++AIFS+D+    YH
Sbjct: 280  FGLAIQLFFALGLGLLTGMENVIRRFKNNSDRVVKWLFVMVILESILVAIFSQDYRPYHL  339

Query: 340  LPALPFGLLLTSNKITILYQKVIDRRSHRRQY-FSGKSLIVDLFVKKTYYLPLLLVSLSI  398
            LP LPFGL+LT+  +    Y  + + SHRR++   +G   ++ +++K+ +YLP+L+V   +
Sbjct: 340  LPLLPFGLILTAIPVGYQYGIGLGQSSHRRRHGKNGVGRVMMIYLKRHFYLPILIVGTIL  399

Query: 399  GLLVYNTYQNVTLSKERRDISHYLTTKIDRDGKIYVWDKVASIYSQTRLKSASQFVLPHI  458
                 Y   ++ L++ER I+ YL  K+++    IYVWD   + IY  ++ KS SQF   P I
Sbjct: 400  ICSTYCFISSIPLNQERDHIASYLEQKLNKTQSIYVWDDTSKIYLDSKAKSVSQFSSPDI  459

Query: 459  NTAQKNNEKILKDELLQHGAKYFILNKNEKLPNELKSDIKKHYQEVPLSNITHFVLYRFK  518
            NT ++++ KIL+DELL++ A Y ++N+ + LP  ++  + +Y+           F++Y+ K
Sbjct: 460  NTQKESHRKILEDELLENKAAYIVVNRYKNLPKIIQKVLSTNYKVDKQITTKSFIVYQKK  519
```

A related GBS gene <SEQ ID 8727> and protein <SEQ ID 8728> were also identified. Analysis of this protein sequence reveals the following:

Lipop: Possible site: −1    Crend: 0
SRCFLG: 0
McG: Length of UR: 34
Peak Value of UR: 2.23
Net Charge of CR: 0
McG: Discrim Score: 7.72
GvH: Signal Score (−7.5): −2.21
Possible site: 60
>>> Seems to have a cleavable N-term signal seq.
Amino Acid Composition: calculated from 61
ALOM program count: 5 value: −9.18 threshold: 0.0
INTEGRAL      Likelihood = −9.18       Transmembrane 174-190 ( 168-194)

-continued

INTEGRAL      Likelihood = −6.21       Transmembrane 139-155 ( 134-160)
INTEGRAL      Likelihood = −5.31       Transmembrane 92-108 (86-113)
INTEGRAL      Likelihood = −3.03       Transmembrane 246-262 ( 246-265)
INTEGRAL      Likelihood = −2.18       Transmembrane 64-80 (64-81)
PERIPHERAL    Likelihood = 3.29        194
modified ALOM score: 2.34
icml HYPID: 7              CFP: 0.467
*** Reasoning Step: 3
----- Final Results -----
    bacterial membrane --- Certainty = 0.4673 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
ORF02392(331-978 of 1764)
EGAD|43696|MJ1079(2-379 of 397) conserved hypothetical protein {Methanococcus jannaschii}
OMNI|MJ1079 conserved hypothetical protein GP|1591727|gb|AAB99076.1||U67550 conserved
hypothetical protein {Methanococcus jannaschii} PIR|F64434|F64434 hypothetical protein
MJ1079 - Methanococcus jannaschii
% Match = 3.1
% Identity = 25.6 % Similarity = 50.7
Matches = 57 Mismatches = 100 Conservative Sub.s = 56

174       204       234       264       294       324       354
*LLLANI*LSVHPTSFFTXXXN*LXXSSIWLLIVQFIAYYVSGIYFYKLVYYVAQSEIVSIGMTLIFYIMNIVLG-----
                                                             : |:: |: |: |
                                                             MLNLLYLILGIICGTITGL 426       447       477       507       537       567       597
FGGMYPIQW-ALPFMLISLWFL---IKFCVDNIVDEAFIFYGILAAFSLFIDPQTLIFWLCSFVLLTATNIKQKQSLRGF
| |::|    || |:::  : |      | | : ::   || : :||    |:| :  |      |      :     ||
FPGIHPNNIVALSFLILPYFGLDNYIPFLIGLVITHYFINF-IPSAFLGVPDDETAVSALPMHKLTLNGNGYEAIVLAGF
        30        40        50        60        70        80        90

627       657       687       717       747       774
YQFLCVVFGMILIAYTVGYFMFNLQIISSYIDKAIFYPFTYFARTNHSFLLSLAI-QIVVLLGSFC--------------
:|  |||  :::   :  : |:::     |     ||  |   |  : :  ::: |::  ||
GSYLGVVFSILISLFLMSILHFDVRAFYCSI--KIFIPFILIAFILYQIFTAKSVWEVLVIFLSGIFGIAVLYCSEAFNI
       110       120       130       140       150       160       170
```

```
798          828                                                  846          876
--------LFGLWDFIQNRKKASYQ----------------------~~~-------------------IGLNFIACIFI
        :||:   :|   |     :                                      : : |::    ||
TLTAIFTGMFGIPLLINNLKTYKIKSQMMAFPDFELKFLKSSFFA~~~~TIAIIILLNLSKYILLFIRKVNFKFLSLFFI
            190       200       210       220           320       330

906             948        978       1008      1038      1068      1098
IYAIMAIFSRDFN---LYH---FLPALPFGLLLTSNKITILYQKVIDRRSHRRQYFSGKSLIVDLFVKKTYYLPLLLVSL
|:  :  :   :|    :||         :|  |:   |||    :     :
IFCSLVVIIGSYNTYLIYHIIVYLTAIYIGLLAVKSNTNLSNMMNVLIFPTILYFLRG
       350       360       370       380       390
```

Based on this analysis, it was predicted that these proteins and their epitopes could be useful antigens for vaccines or diagnostics.

Example 1093

A DNA sequence (GBSx1168) was identified in *S. agalactiae* <SEQ ID 3377> which encodes the amino acid sequence <SEQ ID 3378>. This protein is predicted to be anaerobic ribonucleotide reductase (nrdD). Analysis of this protein sequence reveals the following:

Possible site: 52
>>> Seems to have no N-terminal signal sequence

----- Final Results -----
bacterial cytoplasm --- Certainty = 0.3722(Affirmative) <succ>
bacterial membrane --- Certainty = 0.0000(Not Clear) <succ>
bacterial outside --- Certainty = 0.0000(Not Clear) <succ>

A related GBS nucleic acid sequence <SEQ ID 10253> which encodes amino acid sequence <SEQ ID 10254> was also identified.

The protein has homology with the following sequences in the GENPEPT database.

```
>GP:AAD00215 GB:U73336 anaerobic ribonucleotide reductase
[Lactococcus lactis subsp. cremoris]
Identities = 539/725 (74%), Positives = 616/725 (84%), Gaps = 7/725 (0%)
Query:  10  MTESDIKVIKRDGRLVSFDKYKIYTALLKASNKVIKMSPLVEAKLEMIADHVIAEIYNRF    69
            +T  +I VIKRDGR V F+   KI+ AL KA+ KV      V    L  + D V++EI++RF
Sbjct:  10  VTLEEINVIKRDGRSVKFNSEKIFDALTKAAKKVELTDKSV---LSELTDRVVSEIFSRF   66

Query:  70  KDNIKIYEIQNIVEHKLLEANEYAIAQEYINYRTQRDFERSQATDINFSIGKLINKDQTV   129
            +N+KIYEIQ+IVE +LLE+ E A+A+EYI+YR  RD  R++ATDINF+I KLIN+DQTV
Sbjct:  67  SENVKIYEIQSIVEQELLESGETALAEEYISYRANRDLARTKATDINFTIEKLINRDQTV   126

Query: 130  VNENANKDSDVFNTQRDLTAGIVGKSIGLKMLPSHVANAHQKGDIHYHDLDYSPYTPMTN   189
            VNENANKDS+VFNTQRDLTAG V K+IGLK+LP HVANAHQKGDIHYHDLDYSP+T M N
Sbjct: 127  VNENANKDSNVFNTQRDLTAGAVSKAIGLKLLPPHVANAHQKGDIHYHDLDYSPFTTMAN   186

Query: 190  CCLIDFKGMLANGFKIGNAEVESPKSIQTATAQISQIIANVASSQYGGCTADRIDEFLAP   249
            CCLIDFK M  NGFK+GNA+V+SPKSIQTATAQ SQIIANVASSQYGGC+ DR DE LAP
Sbjct: 187  CCLIDFKNMFENGFKLGNAQVDSPKSIQTATAQASQIIANVASSQYGGCSFDRADEVLAP   246

Query: 250  YAQLNYQKHLKDAKEWVIED-KQEDYARAKTQKDIYDAMQSLEYEINTLFTSNGQTPFTS   308
            YA+LNYQKHLKDA++W+   D K+E YAR KT KDIYDAMQSLEYEINTLFTSNGQTPF +
Sbjct: 247  YAKLNYQKHLKDAQKWIDGDEKREAYAREKTAKDIYDAMQSLEYEINTLFTSNGQTPFVT   306

Query: 309  LGFGLGTNWFEREIQKAILKIRIQGLGSEHRTAIFPKLIFTLKKGLNLEEDSPNYDIKQL   368
            +GFGLG +W+ REIQKAILK+RI GLGSEHRTAIFPKLIFTLK+GLNLE  +PNYDIK+L
Sbjct: 307  VGFGLGDDWYAREIQKAILKVRIGGLGSEHRTAIFPKLIFTLKRGLNLEVGTPNYDIKEL   366

Query: 369  ALECATKRMYPDVLSYDKIIDLTGSFKAPMGCRSFLQGWRDANGQDVTSGRMNLGVVTVN   428
            ALEC+TKRMYPD+LSYDKI++LTGSFKA MGCRSFLQGW+DANG DVT+GR NLGVVTVN
Sbjct: 367  ALECSTKRMYPDILSYDKIVELTGSFKASMGCRSFLQGWKDANGNDVTAGRNNLGVVTVN   426

Query: 429  LPRVAMESNGDMDKFWEIFNERMSIARDALVYRVERVKEAIPANAPILYQYGAFGERLGK   488
            LPR+A+E+ G+ +KFWEIFNER+ IA DAL +RVER KEA P NAPIL+  GA G RL
Sbjct: 427  LPRIALEAAGNKEKFWEIFNERVEIAHDALAFRVERAREAQPKNAPILFMNGALG-RLDS   485

Query: 489  YDNVDRLFNHRRATVSLGYIGLYEVASVFYGGDWEDNHQAKAFTVDIVRKMKQLCADWSD   548
            +VD L+N+ RATVSLGYIGLYEVA+ FYG  WE N +AKAFT++IV++M + C DWS
Sbjct: 486  EGSVDDLYNNERATVSLGYIGLYEVATTFYGPTWESNPEAKAFTIEIVKRMHEDCEDWSK   545

Query: 549  EYDYHFSVYSTPSESLTDRFCRLDTEKFGIVTDITDKEYYTNSFHYDVRKNPTPFEKLDF   608
                YH+SVYSTPSESLTDRFCR+D EKFG V DITDK+YYTNSFHYDVRKNPTPFEKL+F
Sbjct: 546  ASGYHYSVYSTPSESLTDRFCRMDKEKFGSVADITDKDYYTNSFHYDVRKNPTPFEKLEF   605

Query: 609  EKIYPETGASGGFIHYCEYPVLQQNPKALEAVWDYAYDRVGYLGTNTPIDKCYQCQFEGD   668
```

```
                  EK YP   A+GGFIHYCEYPVLQQNPKALEAVWD+AYDR+GYLGTN PID CY C FEGD
Sbjct: 606        EKDYP-VYANGGFIHYCEYPVLQQNPKALEAVWDFAYDRIGYLGTNAPIDHCYACGFEGD        664

Query: 669        FTPTDRGFTCPNCGNSDPKTVDVVKRTCGYLGNPQARPMVNGRHKEISARVKHMNGS-SI       727
                  FTPT+RGF CP CGN DPKT DVVKRTCGYLGNPQARPMV+GRHKEIS+RVKHMNGS
Sbjct: 665        FTPTERGFKCPQCGNDDPKTCDVVKRTCGYLGNPQARPMVHGRHKEISSRVKHMNGSVGA       724

Query: 728        KNQGN                                                             732
                   N GN
Sbjct: 725        LNDGN                                                             729
```

A related DNA sequence was identified in *S. pyogenes* <SEQ ID 3379> which encodes the amino acid sequence <SEQ ID 3380>. Analysis of this protein sequence reveals the following:

Possible site: 52
>>> Seems to have no N-terminal signal sequence

----- Final Results -----
bacterial cytoplasm --- Certainty = 0.2975 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 641/731 (87%), Positives = 680/731 (92%)
Query:   1   MMVLERERFMTESDIKVIKRDGRLVSFDKYKIYTALLKASNKVIKMSPLVEAKLEMIADH    60
             M+ LE ++   + DIKVIKRDGRLV+FD  KIY+ALLKAS KV +MSPLVEAKLE I+D
Sbjct:   1   MVSLEEDKVTVQPDIKVIKRDGRLVNFDSTKIYSALLKASMKVTRMSPLVEAKLEAISDR    60

Query:  61   VIAEIYNRFKDNIKIYEIQNIVEHKLLEANEYAIAQEYINYRTQRDFERSQATDINFSIG   120
             +IAEI  RF  NIKIYEIQNIVEHKLL ANEYAIA+EYINYRTQRDF RSQATDINFSI
Sbjct:  61   IIAEIIERFPTNIKIYEIQNIVEHKLLAANEYAIAKEYINYRTQRDFARSQATDINFSID   120

Query: 121   KLINKDQTVVNENANKDSDVFNTQRDLTAGIVGKSIGLKMLPSHVANAHQKGDIHYHDLD   180
             KLINKDQTVVNENANKDSDVFNTQRDLTAGIVGKSIGLKMLPSHVANAHQKGDIHYHDLD
Sbjct: 121   KLINKDQTVVNENANKDSDVFNTQRDLTAGIVGKSIGLKMLPSHVANAHQKGDIHYHDLD   180

Query: 181   YSPYTPMTNCCLIDFKGMLANGFKIGNAEVESPKSIQTATAQISQIIANVASSQYGGCTA   240
             YSPYTPMTNCCLIDFKGMLANGFKIGNAEVESPKSIQTATAQISQIIANVASSQYGGCTA
Sbjct: 181   YSPYTPMTNCCLIDFKGMLANGFKIGNAEVESPKSIQTATAQISQIIANVASSQYGGCTA   240

Query: 241   DRIDEFLAPYAQLNYQKHLKDAKEWVIEDKQEDYARAKTQKDIYDAMQSLEYEINTLFTS   300
             DRIDEFLAPYA+LN++KH+ DAK+W++E K+E YA  KTQKDIYDAMQSLEYEINTLFTS
Sbjct: 241   DRIDEFLAPYAELNFKKHMADAKKWIVETKRESYAFEKTQKDIYDAMQSLEYEINTLFTS   300

Query: 301   NGQTPFTSLGFGLGTNWFEREIQKAILKIRIQGLGSEHRTAIFPKLIFTLKKGLNLEEDS   360
             NGQTPFTSLGFGLGT+WFEREIQKAIL IRI GLGSEHRTAIFPKLIFT+K+GLNLE DS
Sbjct: 301   NGQTPFTSLGFGLGTSWFEREIQKAILTIRINGLGSEHRTAIFPKLIFTVKRGLNLEPDS   360

Query: 361   PNYDIKQLALECATKRMYPDVLSYDKIIDLTGSFKAPMGCRSFLQGWRDANGQDVTSGRM   420
             PNYDIK LALECATKRMYPD+LSYDKIIDLTGSFK+PMGCRSFLQGW+D NGQDVTSGRM
Sbjct: 361   PNYDIKTLALECATKRMYPDMLSYDKIIDLTGSFKSPMGCRSFLQGWKDENGQDVTSGRM   420

Query: 421   NLGVVTVNLPRVAMESNGDMDKFWEIFNERMSIARDALVYRVERVKEAIPANAPILYQYG   480
             NLGVVT+NLPR+AMESNGDMDKFWE+FNERM I++DAL+YRVERV EA PANAPILYQYG
Sbjct: 421   NLGVVTLNLPRIAMESNGDMDKFWELFNERMLISKDALIYRVERVTEAKPANAPILYQYG   480

Query: 481   AFGERLGKYDNVDRLFNHRRATVSLGYIGLYEVASVFYGGDWEDNHQAKAFTVDIVRKMK   540
             AFG+RL K  NV+ LF +RRATVSLGYIGLYEVASVFYGG WE N  AKAFT+ IV+ MK
Sbjct: 481   AFGKRLEKTGNVNDLFKNRRATVSLGYIGLYEVASVFYGGQWEGNPDAKAFTLSIVKAMK   540

Query: 541   QLCADWSDEYDYHFSVYSTPSESLTDRFCRLDTEKFGIVTDITDKEYYTNSFHYDVRKNP   600
             Q C DWSDEY YHFSVYSTPSESLTDRFCRLDTEKFGIVTDITDKEYYTNSFHYDVRK+P
Sbjct: 541   QACEDWSDEYGYHFSVYSTPSESLTDRFCRLDTEKFGIVTDITDKEYYTNSFHYDVRKSP   600

Query: 601   TPFEKLDFEKIYPETGASGGFIHYCEYPVLQQNPKALEAVWDYAYDRVGYLGTNTPIDKC   660
             TPFEKLDFEK YPE GASGGFIHYCEYPVLQQNPKALEAVWDYAYDRVGYLGTNTPIDKC
Sbjct: 601   TPFEKLDFEKDYPEAGASGGFIHYCEYPVLQQNPKALEAVWDYAYDRVGYLGTNTPIDKC   660

Query: 661   YQCQFEGDFTPTDRGFTCPNCGNSDPKTVDVVKRTCGYLGNPQARPMVNGRHKEISARVK   720
             Y CQFEGDFTPT+RGFTCPNCGN+DPKTVDVVKRTCGYLGNPQARPMVNGRHKEISARVK
Sbjct: 661   YNCQFEGDFTPTERGFTCPNCGNNDPKTVDVVKRTCGYLGNPQARPMVNGRHKEISARVK   720

Query: 721   HMNGSSIKNQG                                                       731
             HMNGS+IK  G
Sbjct: 721   HMNGSTIKYPG                                                       731
```

Based on this analysis, it was predicted that these proteins and their epitopes could be useful antigens for vaccines or diagnostics.

Example 1094

A DNA sequence (GBSx1169) was identified in *S. agalactiae* <SEQ ID 3381> which encodes the amino acid sequence <SEQ ID 3382>. Analysis of this protein sequence reveals the following:

Possible site: 27
>>> Seems to have no N-terminal signal sequence
----- Final Results -----
   bacterial cytoplasm --- Certainty = 0.5372 (Affirmative) <succ>
     bacterial membrane --- Certainty = 0.0000 (Not Clear) <succ>
      bacterial outside --- Certainty = 0.0000 (Not Clear) <succ>

The protein has no significant homology with any sequences in the GENPEPT database.

A related DNA sequence was identified in *S. pyogenes* <SEQ ID 3383> which encodes the amino acid sequence <SEQ ID 3384>. Analysis of this protein sequence reveals the following:

Possible site: 45
>>> Seems to have no N-terminal signal sequence
----- Final Results -----
   bacterial cytoplasm --- Certainty = 0.6084 (Affirmative) <succ>
     bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 28/47 (59%), Positives = 40/47 (84%), Gaps = 1/47 (2%)
Query:  1    MGKYQLDYKGQAQVQKFHEKHSTGENANQKSRLKDLRKQFLEKAKKK      47
             MGKYQLDYKG  QV++FHEKHS  +  ++KSR+++L+ +FLEK+KK+
Sbjct:  1    MGKYQLDYKGMQQVERFHEKHSK-KKTDKKSRVQELKARFLEKSKKQ      46
```

Based on this analysis, it was predicted that these proteins and their epitopes could be useful antigens for vaccines or diagnostics.

Example 1095

A DNA sequence (GBSx1170) was identified in *S. agalactiae* <SEQ ID 3385> which encodes the amino acid sequence <SEQ ID 3386>. Analysis of this protein sequence reveals the following:

Possible site: 51
>>> Seems to have no N-terminal signal sequence
----- Final Results -----
   bacterial cytoplasm --- Certainty = 0.0436 (Affirmative) <succ>
     bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:CAB95794 GB:AL359949 putative oxidoreductase [Streptomyces
             coelicolor A3(2)]
Identities = 91/299 (30%), Positives = 147/299 (48%), Gaps = 7/299 (2%)
Query:    2  LQLGIVGLGGISQKAYLPYMRQVTGVHWHLFTRQKQILEEV--NMLFGSSTAYDSLDSLA    59
             +++G +GLG I+QK YLP +  + G+  HL TR    L V   +   +  LD+L
Sbjct:    1  MKVGCIGLGDIAQKGYLPVLAALPGIELHLQTRTPATLTRVADKLRIPPAQRHADLDALL    60

Query:   60  EHPLDGVFIHVATSAHFDIAKLFLKKGIPVFMDKPLTEDYTSTKALYDLAKDHKTFLMAG   119
                LD  F+H   T+AH +I     L+  G+P ++DKPL  +    ++ L  LA++   T L  G
Sbjct:   61  AQGLDAAFVHAPTAAHPEIVTRLLEAGVPTYVDKPLAYELADSERLVTLAEERGTSLAVG   120

Query:  120  FNRRFAPRIMEMKKVEDKNHIRTFKNAVNAPADFQYKLFDMFIHPLDTALFLTNNVVKRG   179
             FNRR AP   +  +   +  I   KN       P D  +  D FIH +DT  FL       V
Sbjct:  121  FNRRHAPGYAQCAE-HPRELILMQKNRTGLPEDPRTMILDDFIHVVDTLRFLVPGPVDDV   179

Query:  180  YFVTKRDGNKILQVSVTLETDSEIIEASMNLQSGSRREIIEIESPEVTYSLDDLSNLSVI   239
               + +G  + V +L D          MN  SGS   EI+E+    +   +L+   VI
Sbjct:  180  TVRARTEGGLLHHVVLQLAGDGFTALGVMNRLSGSAEEILEVSGQDTKRQVVNLA--EVI   237

Query:  240  DGFDRRAI-GFGSWASTLEKRGFEPMIDAFIQAITTGVNPISPKSSLLSHFICDQINKA    297
             D   +   G W      +RG E   + AF+ A+ +G   +S + +L +H +C+++  +A
Sbjct:  238  DHKGQPTVRRRGDWVPVARQRGIEQAVLAFLDAVRSG-EVLSARDALATHELCERVVRA    295
```

A related DNA sequence was identified in *S. pyogenes* <SEQ ID 3387> which encodes the amino acid sequence <SEQ ID 3388>. Analysis of this protein sequence reveals the following:

```
Possible site: 57
>>> Seems to have an uncleavable N-term signal seg
----- Final Results -----
   bacterial membrane --- Certainty = 0.0000 (Not Clear) <succ>
     bacterial outside --- Certainty = 0.0000 (Not Clear) <succ>
        bacterial cytoplasm --- Certainty = 0.0000 (Not Clear) <succ>
```

The protein has homology with the following sequences in the databases:

```
>GP:AAF96942 GB:AE004430 oxidoreductase, Gfo/Idh/MocA family [Vibrio cholerae]
Identities = 103/304 (33%), Positives = 158/304 (51%), Gaps = 11/304 (3%)
Query:   4 LNIGIVGLGAISQKAYLPYMRQLSDITWHLSTRNAAVRQQVGQLFGHAILYSDVKELSKT     63
           + I ++GLG I+QKAYLP + Q DI   L TRN V   +  +    +D +++ +
Sbjct:   1 MKIAMIGLGDIAQKAYLPVLAQWPDIELVLCTRNPKVLGTLATRYRVSATCTDYRDVLQY     60

Query:  64 NLDGVFIHAATSAHAELASLFLNQGIPVFMDKPIADNYLMTKNLYDLAKENQTFLMAGFN    123
            +D V IHAAT  H+ LA+ FL+ GIP F+DKP+A +    +NLY+LA+++   L  GFN
Sbjct:  61 GVDAVMIHAATDVHSTLAAFFLHLGIPTFVDKPLAASAQECENLYELAEKHHQPLYVGFN    120

Query: 124 RRFTPRVKK-LSSLSTK-----RKVAVEKNDLNRPGDMTFKLFDFFIHPLDTALFLTEGT    177
           RR  P    + LS L+ +      R +  EK+    PGD+    +FD FIHPLD+      +
Sbjct: 121 RRHIPLYNQHLSELAQQECGALRSLRWEKHRHALPGDIRTFVFDDFIHPLDSVNLSRQCN    180

Query: 178 LLKGHFQYHLEAGLLSQVMVTLMTESMTTTASMNLQSGSRREVMEVQRAEETYHLENLDE    237
           L   H  YH+  GLL+++ V  T     ASMN Q G   E +          Y  ++ +
Sbjct: 181 LDDLHLTYHMSEGLLARLDVQWQTGDTLLHASMNRQFGITTEHVTASYDNVAYLFDSFTQ    240

Query: 238 LSIYKGTEKRVLGFASWDTTLHKRGFETMIDAFLEAISTGVNPVS-PESSLLSHW----I    292
            +++ ++ +       W  L  +GF+ M+  +L+  + G P       E +L SH       I
Sbjct: 241 GKMWRDNQESRVALKDWTPMLASKGFDAMVQDWLQVAAAGKLPTHIIERNLASHQLAEAI    300

Query: 293 CQQI                                                           296
           CQQI
Sbjct: 301 CQQI                                                           304
```

SEQ ID 3386 (GBS309) was expressed in *E. coli* as a GST-fusion product. SDS-PAGE analysis of total cell extract is shown in FIG. 68 (lane 10; MW 63 kDa).

GBS309-GST was purified as shown in FIG. 212, lane 10.

Based on this analysis, it was predicted that these proteins and their epitopes could be useful antigens for vaccines or diagnostics.

Example 1096

A DNA sequence (GBSx1171) was identified in *S. agalactiae* <SEQ ID 3389> which encodes the amino acid sequence <SEQ ID 3390>. Analysis of this protein sequence reveals the following:

An alignment of the GAS and GBS proteins is shown below.

```
Identities = 168/308 (54%), Positives = 223/308 (71%)
Query:   1 MLQLGIVGLGGISQKAYLPYMRQVTGVHWHLFTRQKQILEEVNMLFGSSTAYDSLDSLAE     60
           ML +GIVGLG ISQKAYLPYMRQ++ + WHL TR   + ++V LFG + Y  + L++
Sbjct:   3 MLNIGIVGLGAISQKAYLPYMRQLSDITWHLSTRNAAVRQQVGQLFGHAILYSDVKELSK     62

Query:  61 HPLDGVFIHVATSARFDIAKLFLKKGIPVFMDKPLTEDYTSTKALYDLAKDHKTFLMAGF    120
              LDGVFIH ATSAR ++A LFL +GIPVFMDKP+ ++Y  TK LYDLAK+++TFLMAGF
Sbjct:  63 TNLDGVFIHAATSAHAELASLFLNQGIPVFMDKPIADNYLMTKNLYDLAKENQTFLMAGF    122

Query: 121 NRRFAPRIMEMKKVEDKNHIRTFKNAVNAPADFQYKLFDMFIRPLDTALFLTNNVVKRGY    180
           NRRF  PR+ ++  +  K     +   KN +N P D   +KLFD  FIHPLDTALFLT     + +G+
Sbjct: 123 NRRFTPRVKKLSSLSTKRKVAVEKNDLNRPGDMTFKLFDFFIHPLDTALFLTEGTLLKGH    182

Query: 181 FVTKRDGNKILQVSVTLETDSEIIEASMNLQSGSRREIIEIESPEVTYSLDDLSNLSVID    240
           F     +  + QV VTL T+S     ASMNLQSGSRRE++E++  E TY L++L  LS+
Sbjct: 183 FQYHLEAGLLSQVMVTLMTESMTTTASMNLQSGSRREVMEVQRAEETYHLENLDELSIYK    242

Query: 241 GFDRRAIGFGSWASTLEKRGFEPMIDAFIQAITTGVNPISPKSSLLSHFICDQINKANAP    300
           G ++R +GF SW +TL KRGFE MIDAF++AI+TGVNP+SP+SSLLSH+IC QI   +
Sbjct: 243 GTEKRVLGFASWDTTLHKRGFETMIDAFLEAISTGVNPVSPESSLLSHWICQQIADSQLS    302

Query: 301 FGMLNLKI                                                       308
           +G L +++
Sbjct: 303 YGELTVEL                                                       310
```

Possible site: 27
>>> Seems to have no N-terminal signal sequence
----- Final Results -----
   bacterial cytoplasm --- Certainty = 0.2983 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database.

```
>GP:BAB04222 GB:AP001508 unknown conserved protein in others
           [Bacillus halodurans]
Identities = 52/129 (40%), Positives = 70/129 (53%), Gaps = 5/129 (3%)
Query:  39  FEDWLDHNLNMELGVGVPDNFVPYIQFVSFDNDNNAIGFLNLRLRLNDTLLEKGGHIGYS    98
            FE  L    + + GV +P N V    +          IG +N+R  LND L  +GGHIGY
Sbjct:  43  FEHLLKTLKDYQHGVNLPANRVANTTYWLVHEQKRLIGAINIRHTLNDWLHHRGGHIGYG   102

Query:  99  IRPRQRGKGYAKEQLKLGIEQAHLKNINEILVTCHVDNDASKSVILANGGVLEDCLHQ--   156
            IRP +RGKGYA   LKLG+E+A    + ++L+TC  +N  S    I  NGGVL+  +
Sbjct: 103  IRPSERGKGYATLMLKLGLEKAAALGLEKVLITCDKENLPSARTIQRNGGVLDSEVVDER  162

Query: 157  ---TERYWI                                                    162
               +RYWI
Sbjct: 163  GIAIQRYWI                                                    171
```

A related DNA sequence was identified in *S. pyogenes* <SEQ ID 3391> which encodes the amino acid sequence <SEQ ID 3392>. Analysis of this protein sequence reveals the following:

Possible site: 59
>>> Seems to have no N-terminal signal sequence
----- Final Results -----
   bacterial cytoplasm --- Certainty = 0.2195 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

```
Identities = 90/164 (54%), Positives = 115/164 (69%), Gaps = 4/164 (2%)
Query:   1  MKLRRPVLEDKEEILAMYKEFQKESSSVDG--GFYEPTMHFEDWLDHNLNMELGVGVPDN    58
            M++RRP L+DK+ +L+M  EF ++ S+ DG  F     ++E WL+ +L  E+G+
Sbjct:   1  MEIRRPTLKDKDAVLSMINEFLEQKSATDGLWHFNVNDFNYETWLEDSLRQEMGLS--SQ    58

Query:  59  FVPYIQFVSFDNDNNAIGELNLRLRLNDTLLEKGGHIGYSIRPRQRGKGYAKEQLKLGIE   118
             VP  IQ+V+FD  + AIGFLNLRLRLN+ LLEKGGHIGYS+RP QRGKGYAKE LK  +
Sbjct:  59  GVPAIQYVAFDERSQAIGFLNLRLRLNERLLEKGGHIGYSVRPSQRGKGYAKEMLKQAVS   118

Query: 119  QAHLKNINEILVTCHVDNDASKSVILANGGVLEDCLHQTERYWI                  162
             A  KNI   ILVTC  N AS++VI+AN G+LED     TERYWI
Sbjct: 119  YAISKNITTILVTCDETNVASRAVIVANVGILEDSRGGTERYWI                  162
```

Based on this analysis, it was predicted that these proteins and their epitopes could be useful antigens for vaccines or diagnostics.

Example 1097

A DNA sequence (GBSx1172) was identified in *S. agalactiae* <SEQ ID 3393> which encodes the amino acid sequence <SEQ ID 3394>. This protein is predicted to be anaerobic ribonucleotide reductase activator protein (nrdG). Analysis of this protein sequence reveals the following:

Possible site: 59
>>> Seems to have no N-terminal signal sequence
----- Final Results -----
  bacterial cytoplasm --- Certainty = 0.4239 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:AAD00216 GB:U73336 anaerobic ribonucleotide reductase activator protein
           [Lactococcus lactis subsp. cremoris]
Identities = 152/198 (76%), Positives = 176/198 (88%)
Query:    8 NTPKPGEWKSEELSHGHIIDYKAFNFVDGEGVRNSLYVAGCMFHCKGCYNTATWSFRAGI   67
            N PKPGEW+++ELS  +I DYK FNFVDGEGVR SLYV+GCMFHC+GCYN ATWSFR G
Sbjct:    2 NNPKPGEWRADELSQNYIADYKPFNFVDGEGVRCSLYVSGCMFHCEGCYNQATWSFRYGR   61

Query:   68 PYTKELEDQIMTDLEQPYVQGLTLLGGEPFLNTGILLPLLQRIRRELPEKDIWSWTGYTW  127
            PYTKELED+IM DL +PYVQGLTLLGGEPFLNT  L+PLL+RIRRELP+KDIWSWTGYTW
Sbjct:   62 PYTKELEDKIMADLAEPYVQGLTLLGGEPFLNTTFLIPLLKRIRRELPDKDIWSWTGYTW  121

Query:  128 EEMMLETQDKLEMLSLIDILVDGRFDQSKRNLMLQFRGSSNQRIIDVQKSLKEGEVVIWE  187
            EEMMLET DKLEML L+D+LVDGRF+ SK+NLMLQFRGSSNQRIIDV KS  +G+VVIWE
Sbjct:  122 EEMMLETDDKLEMLDLLDVINDGRFELSKKNLMLQFRGSSNQRIIDVPKSRSKGQVVIWE  181

Query:  188 GLNDGDNSYEQVKRDDLL                                           205
            LNDG+N++EQ+ ++ L+
Sbjct:  182 KLNDGENNFEQIHKEKLI                                           199
```

A related DNA sequence was identified in *S. pyogenes* <SEQ ID 3395> which encodes the amino acid sequence <SEQ ID 3396>. Analysis of this protein sequence reveals the following:

Possible site: 59
>>> Seems to have no N-terminal signal sequence
----- Final Results -----
  bacterial cytoplasm --- Certainty = 0.4111 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

```
Identities = 167/202 (82%), Positives = 186/202 (91%)
Query:    4 EASWNTPKPGEWKSEELSHGHIIDYKAFNFVDGEGVRNSLYVAGCMFHCKGCYNTATWSF   63
            E  WN PKP EW++EELS G IIDYKAFNFVDGEGVRNSLYV+GC+FHCKGCYN ATWSF
Sbjct:    4 EKCKNMPKPKEWQAEELSQGRIIDYKAFNFVDGEGVRNSLYVSGCLFHCKGCYNAATWSF   63

Query:   64 RAGIPYTKELEDQIMTDLEQPYVQGLTLLGGEPFLNTGILLPLLQRIRRELPEKDIWSWT  123
            +AG+PYT+ELE+QIMTDL QPYVQGLTLLGGEPFLNTGIL+PL++RIRRELPEKDIWSWT
Sbjct:   64 KAGMPYTQELEEQIMTDLAQPYVQGLTLLGGEPFLNTGILIPLIKRIRRELPEKDIWSWT  123

Query:  124 GYTWEEMMLETQDKLEMLSLIDILVDGRFDQSKRNLMLQFRGSSNQRIIDVQKSLKEGEV  183
            GYTWEEMMLET DKLEMLSLIDILVDGRFD +K+NLMLQFRGSSNQRIIDVQKSL   EV
Sbjct:  124 GYTWEEMMLETPDKLEMLSLIDILVDGRFDITKKNLMLQFRGSSNQRIIDVQKSLAAKEV  183

Query:  184 VIWEGLNDGDNSYEQVKRDDLL                                       205
            +IW+ LNDGD ++EQ+ R+DLL
Sbjct:  184 IIWDKLNDGDQTFEQISREDLL                                       205
```

Based on this analysis, it was predicted that these proteins and their epitopes could be useful antigens for vaccines or diagnostics.

Example 1098

A DNA sequence (GBSx1173) was identified in *S. agalactiae* <SEQ ID 3397> which encodes the amino acid sequence <SEQ ID 3398>. Analysis of this protein sequence reveals the following:

Possible site: 27
>>> Seems to have no N-terminal signal sequence
INTEGRAL    Likelihood = −3.03    Transmembrane 102-118 (101-119)
----- Final Results -----
  bacterial membrane --- Certainty = 0.2211 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

```
>GP:AAD24446 GB:AF118389 unknown [Streptococcus suis]
Identities = 97/240 (40%), Positives = 151/240 (62%), Gaps = 1/240 (0%)
Query:   2 IKILIPTAKEMKV-CQNIAWPKLSAQTKIIIDYFSTLTVSDLEDIYRINTSAARCEAQRW    60
           +KI+IP AKE+     +N ++  LS ++K ++D   S    V +    Y++N + A  EA RW
Sbjct:   1 MKIIIPNAKEVNTNLENASFYLLSDRSKPVLDAISQFDVKKMAAFYKLNEAKAELEADRW    60

Query:  61 QDFKAKQLTLNPAIKLFNGLMYRNIKRHNLSTSEAQFMENSVFITSALYGIIPAMTLISP   120
            +   Q    PA +L++GLMYR + R  + + E  ++ + V + +ALYG+I      ISP
Sbjct:  61 YRIRTGQAKTYPAWQLYDGLMYRYMDRRGIDSKEENYLRDHVRVATALYGLIHPFEFISP   120

Query: 121 HRLDFNTKIKINNNSLKVFWRENYDTFMQSDDIMVSLLSNEFETVFSPKERQKLIHLNFI   180
           HRLDF   +KI N SLK +WR  YD  +  D++++SL S+EFE VFSP+ +++L+ + F+
Sbjct: 121 HRLDFQGSLKIGNQSLKQYWRPYYDQEVGDDELILSLASSEFEQVFSPQIQKRLVKILFM   180

Query: 181 EDRDGQLKTHSTISKKARGKCLTAMMENNCQTLEHLKQLRFDGFCYDNELSDSKQLTFVK   240
           E++  GQLK HSTISKK RG+ L+ +  +NN Q  L   ++     + DGF  Y      S +  QLTF++
Sbjct: 181 EEKAGQLKVHSTISKKGRGRLLSWLAKNNIQELSDIQDFKVDGFEYCTSESTANQLTFIR   240
```

A related GBS nucleic acid sequence <SEQ ID 10941> which encodes amino acid sequence <SEQ ID 10942> was also identified.

A related DNA sequence was identified in *S. pyogenes* <SEQ ID 3399> which encodes the amino acid sequence <SEQ ID 3400>. Analysis of this protein sequence reveals the following:

Possible site: 38
>>> Seems to have no N-terminal signal sequence
----- Final Results -----
  bacterial cytoplasm --- Certainty = 0.3759 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

```
Identities = 114/242 (47%), Positives = 155/242 (63%)
Query:   1 MIKILIPTAKEMKVCQNIAWPKLSAQTKIIIDYFSTLTVSDLEDIYRINTSAARCEAQRW    60
           M+  LIPTAKEM + +      L  ++ I+   + +T  DL    YRI   +A+ E QRW
Sbjct:   1 MLTFLIPTAKEMTIPKESHPHLLPQDSQAILKIMAAMTTEDLAKSYRIKEESAKKEQQRW    60

Query:  61 QDFKAKQLTLNPAIKLFNGLMYRNIKRHNLSTSEAQFMENSVFITSALYGIIPAMTLISP   120
           QD  ++Q     PA +LFNGLMYR+IKR  L+T E  ++   V+ITS+ YGIIPA   I+
Sbjct:  61 QDMASQQSLAYPAYQLFNGLMYRHIKRDKLTTQEQAYLTQQVYITSSFYGIIPANHPIAE   120

Query: 121 HRLDFNTKIKINNNSLKVFWRENYDTFMQSDDIMVSLLSNEFETVFSPKERQKLIHLNFI   180
           HR DF+T+IKI    SLK +WR  Y+ F +    ++SLLS+EF+ VFS    +Q   I    F+
Sbjct: 121 HRHDFHTRIKIEGQSLKSYWRPCYNQFAKEHPQVISLLSSEFDDVFSKDCKQLWISPKFM   180

Query: 181 EDRDGQLKTHSTISKKARGKCLTAMMENNCQTLEHLKQLRFDGFCYDNELSDSKQLTFVKKQ   242
            +++GQ KTHSTISKKARG  LTA MENNCQT++ LK L F GF Y  +LS   +  ++KK+
Sbjct: 181 AEKEGQFKTHSTISKKARGAFLTACMENNCQTVDSLKSLVFAGFYYHPDLSTDHEFVYIKKK   242
```

Figure 80:
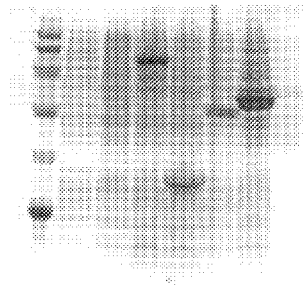

SEQ ID 3398 (GBS428) was expressed in *E. coli* as a His-fusion product. SDS-PAGE analysis of total cell extract is shown in FIG. 80 (lane 6; MW 30.4 kDa). It was also expressed in *E. coli* as a GST-fusion product. SDS-PAGE analysis of total cell extract is shown in FIG. 173 (lane 4; MW 55 kDa).

Figure 220:
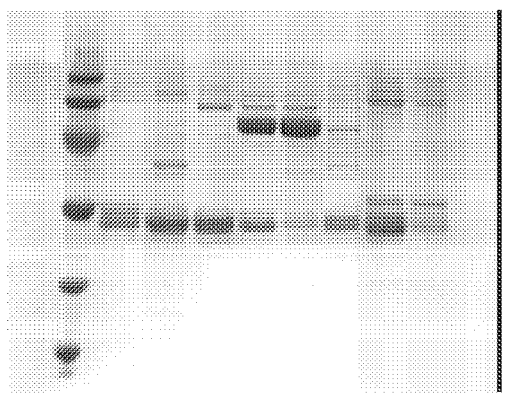

GBS428-GST was purified as shown in FIG. 220, lane 6-7.

Based on this analysis, it was predicted that these proteins and their epitopes could be useful antigens for vaccines or diagnostics.

Example 1099

A DNA sequence (GBSx1174) was identified in *S. agalactiae* <SEQ ID 3401> which encodes the amino acid sequence <SEQ ID 3402>. Analysis of this protein sequence reveals the following:

Possible site: 23
>>> Seems to have an uncleavable N-term signal seq
INTEGRAL    Likelihood = –0.59    Transmembrane 3-19 (3-19)
----- Final Results -----
  bacterial membrane --- Certainty = 0.1235 (Affirmative) <succ>
  bacterial outside --- Certainty = 0.0000 (Not Clear) <succ>
  bacterial cytoplasm --- Certainty = 0.0000 (Not Clear) <succ>

A related GBS nucleic acid sequence <SEQ ID 10251> which encodes amino acid sequence <SEQ ID 10252> was also identified.

The protein has homology with the following sequences in the GENPEPT database.

```
>GP:BAB07024 GB:AP001518 unknown conserved protein [Bacillus halodurans]
Identities = 86/275 (31%), Positives = 143/275 (51%), Gaps = 6/275 (2%)
Query:  17 MSYPYKANHSIESITLKVNDLENLVNFYSDIIGLTVIDKSSTRALLGVNQKIPLIILEKT    76
           M +  + N  ++  + +KV+DL   + FY +IIG  V+++S   A L  N +  PL+++E+
Sbjct:   1 MEFHRQPNTFVDLVNIKVSDLSRALTFYQEIIGFQVLERSERSATLTANGRTPLLVIEQP    60

Query:  77 E---LEKHSTYGLYHTAILVPDEYHLSLALNHLLSQHIPLEGGADHGYSNAIYLSDPEGN   133
           +        ++ T GLYH A+L+P    L   LNHLL     PL+G +DH  S AIY +DP+GN
Sbjct:  61 DPVIAKQPRTTGLYHFALLLPSRADLGRFLNHLLQSGYPLQGASDHLVSEAIYFADPDGN   120
```

```
Query:  134  GIEIYNDKDISMWDIRESGQIIGITERLDIDNLLDSLVNVPNNYKLSEKTSIGHIHLSVK  193
             G+E+Y D+  S WD   +G++   TE +  +NLL    + P      L  +T +GHIHL V
Sbjct:  121  GVEVYADRPSSSWD-WSNGEVKMSTEPIHAENLLAEGKDEPWT-ALPPETILGHIHLHVA  178

Query:  194  DAKISSKLYQNVEGLDEKFAIPT-ASWIASGNYHHHLAFNNWAGPNLSKNQEDRPGISLL  252
              +   +    Y    G +    +   A +I++GNYHHH+   N W G       E   G+
Sbjct:  179  NLFEAETFYIEGLGFNVVARLGNQALFISTGNYHHHIGLNTWNGVGAPTPPEHSVGLKWF  238

Query:  253  TIAYNDDNLFRDSLKKAQLYQLTFLEKQDHYYIIE       287
             ++ Y  + +   ++ + +        K     ++I+
Sbjct:  239  SLTYPSEEVRAKTVNRLETIGFQVERKHGEEWVID       273
```

A related DNA sequence was identified in *S. pyogenes* <SEQ ID 3403> which encodes the amino acid sequence <SEQ ID 3404>. Analysis of this protein sequence reveals the following:

Possible site: 38
>>> Seems to have no N-terminal signal sequence
----- Final Results -----
   bacterial cytoplasm --- Certainty = 0.0936 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

Possible site: 59
>>> Seems to have no N-terminal signal sequence
----- Final Results -----
   bacterial cytoplasm --- Certainty = 0.2362 (Affirmative) <succ>
   bacterial membrane --- Certainty = 0.0000 (Not Clear) <succ>
   bacterial outside --- Certainty = 0.0000 (Not Clear) <succ>

A related GBS nucleic acid sequence <SEQ ID 10249> which encodes amino acid sequence <SEQ ID 10250> was also identified.

The protein has homology with the following sequences in the GENPEPT database.

```
Identities = 143/282 (50%), Positives = 194/282 (68%)
Query:   17  MSYPYKANHSIESITLKVNDLENLVNFYSDIIGLTVIDKSSTRALLGVNQKIPLIILEKT   76
             M YPY +   S+ +++L V DL  +  FY+ IIGL V+ + +T    L  + K  ++ L +T
Sbjct:    1  MIYPYNSTISLGTVSLNVTDLAKMTTFYTSIIGLQVLSQDTTSRQLTTDGKTVILELRQT   60

Query:   77  ELEKHSTYGLYHTAILVPDEYHLSLALNHLLSQHIPLEGGADHGYSNAIYLSDPEGNGIE  136
                  L      YGLYHTA LVPD + L L LNH L++ I LEG ADHG+S AIYLSDPEGNGIE
Sbjct:   61  PLPGDKAYGLYHTAFLVPDRHSLGLVLNHFLTRSISLEGAADHGHSEAIYLSDPEGNGIE  120

Query:  137  IYNDKDISMWDIRESGQIIGITERLDIDNLLDSLVNVPNNYKLSEKTSIGHIHLSVEDAK  196
             IY+DK +    WDIR++GQIIG+TE   D   ++L+ L ++P ++ L++ T I H+HLSVK+A
Sbjct:  121  IYHDKAVEHWDIRDNGQIIGVTEPTDTKSILEQLTDIPKHELLAQDTRIRHVHLSVKNAL  180

Query:  197  ISSKLYQNVEGLDEKFAIPTASWIASGNYHHHLAFNNWAGPNLSKNQEDRPGISLLTIAY  256
              SS LYQ VF L +K   IP+ASWIASGNY+HHLAFN+W+  P L K+QE  PG++ LTI
Sbjct:  181  ASSLLYQKVFDLGDKMTIPSASWIASGNYYHHLAFNHWSAPYLKKHQEGAPGLAFLTIHI  240

Query:  257  NDDNLFRDSLKKAQLYQLTFLEKQDHYYIIEDFDGIRIKVVL                   298
                    LF    +LKKA+L+  L   L++       + ED +GIR+  V+L
Sbjct:  241  ETPLLFSATLKKARLHGLAILQEDSSSFTTEDEEGIRVNVIL                   282
```

SEQ ID 3402 (GBS429) was expressed in *E. coli* as a His-fusion product. SDS-PAGE analysis of total cell extract is shown in FIG. 80 (lane 7; MW 34.2 kDa).

Figure 214:
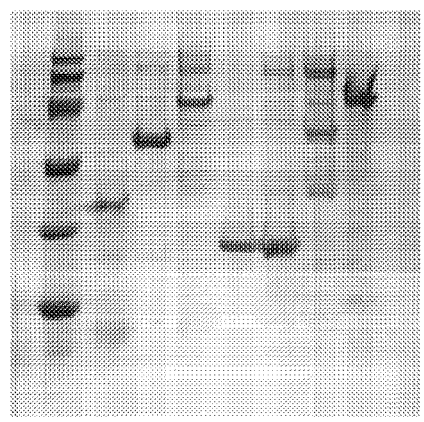

GBS429-His was purified as shown in FIG. 214, lane 9.

Based on this analysis, it was predicted that these proteins and their epitopes could be useful antigens for vaccines or diagnostics.

Example 1100

A DNA sequence (GBSx1175) was identified in *S. agalactiae* <SEQ ID 3405> which encodes the amino acid sequence <SEQ ID 3406>. Analysis of this protein sequence reveals the following:

```
>GP:AAC21682 GB:U32686 conserved hypothetical protein
               [Haemophilus influenzae Rd]
   Identities = 89/261 (34%), Positives = 151/261 (57%), Gaps = 4/261 (1%)
   Query:   10  MVRLIFSDIDGTLINSNFKVTPKTRQGIKQIVAQGATFVPISARMPEAITPIMEQIGIDS   69
                M + +FSD +GTL+ S    ++P+T    IK++ A G   FVPISAR P   I P  +Q+  ++
```

-continued

```
Sbjct:   2  MYKAVFSDFNGTLLTSQHTISPRTVVVIKRLTANGIPFVPISARSPLGILPYWKQLETNN   61

Query:  70  YIISYNGALIQDMQQKTIASHTMDGQVALQVCSYVSKHYSKIAWNVYRYHEWYSCDKENE  129
            +++++GALI +   + I S  ++ +  L++ + +++H     N Y  ++ ++ D EN+
Sbjct:  62  VLVAFSGALILNQNLEPIYSVQIEPKDILEINTVLAEH-PLLGVNYYTNNDCHARDVENK  120

Query: 130  WVQKEEEIVGLQSKEMSLMELEKQDRIHKLLLMGEPSLMGELENTLKAQYPHLSIAQSAP  189
            WV  E  +  ++        +     HK+ ++GE   + E+E  LK ++PHLSI +S
Sbjct: 121  WVIYERSVTKIEIHPFDEVATRSP---HKIQIIGEAEEIIEIEVLLKEKFPHLSICRSHA  177

Query: 190  YFIEIMAPGIEKGKSAKTLADYLDISLADSIAFGDNYNDLNLLEIVGKGFVMGNAPKDLQ  249
               F+E+M      KG + + L DY  +    + IAFGDN+NDL++LE  VG G  MGNAP +++
Sbjct: 178  NFLEVMHKSATKGSAVRPLEDYFGVQTNEVIAFGDNFNDLDMLEHVGLGVAMGNAPNEIK  237

Query: 250  ERIGNVTQDNDNDGIYYALVE                                         270
            +      VT  N+ DG+    L E
Sbjct: 238  QAANVVTATNNEDGLALILEE                                         258
```

Based on this analysis, it was predicted that these proteins and their epitopes could be useful antigens for vaccines or diagnostics.

Example 1101

A DNA sequence (GBSx1176) was identified in *S. agalactiae* <SEQ ID 3409> which encodes the amino acid sequence <SEQ ID 3410>. Analysis of this protein sequence reveals the following:

---

Possible site: 19
>>> May be a lipoprotein
----- Final Results -----
   bacterial membrane --- Certainty = 0.0000 (Not Clear) <succ>
   bacterial outside --- Certainty = 0.0000 (Not Clear) <succ>
      bacterial cytoplasm --- Certainty = 0.0000 (Not Clear) <succ>

---

The protein has homology with the following sequences in the GENPEPT database.

```
>GP:AAG07223 GB:AE004801 hypothetical protein [Pseudomonas aeruginosa]
Identities = 103/283 (36%), Positives = 165/283 (57%), Gaps = 1/283 (0%)
Query:  33  KHIGILQYVEHPSLTATRKGFIKELAKEGYKDGKNIKIEYKNAQGDQSNIQSISEKLIKD   92
            K + +    VEHP+L A R G  + L + GY+DGKN+K +Y++AQG+      I+ K I D
Sbjct:  31  KSVAVTAIVEHPALDAARDGVKEALQEAGYEDGKNLKWQYQSAQGNGTAAQIARKFIGD   90

Query:  93  NK-LVLGIATPAAQSLTTVSTETPILFTAVTDPVSAELVKSMKKPEGLATGTSDMSPIKK  151
              +++GIATP+AQ+L    +     PI+F+ VTDPV A L  S +       TG SDM  + K
Sbjct:  91  KPDVIVGIATPSAQALVAATKSIPIVFSTVTDPVGAHLTPSWEASGTNVTGVSDMLALDK  150

Query: 152  QVSLLRKVMPKVKRVGIMYTTSERNSEVQVKQAKKIFQEAGIKTSVKGISSTNDVQDTAK  211
            Q+ L++KV+P  KR+G++Y    E NS V  VK+ K++   + G+        + DV    A+
Sbjct: 151  QIELIKKVVPGAKRIGMVYNPGEANSVVVVKELKELLPKMGLSLVEASAPRSVDVSSAAR  210

Query: 212  SLMSKTEVIEVPTDNIIASSVTLLGNLSKELKVPVVGGSADMVPSGLLFSYGADYEALGR  271
            SL+  K + I+   TDN + S+      L  + + K+P++        D V  G + + G +Y+  +G+
Sbjct: 211  SLVGKVDAIYTNTDNNVVSAYEALVKVGNDAKIPLIASDTDSVKRGAIAALGINYKEMGK  270

Query: 272  QTARQAVKILKGKDVAKVPSEYPQNLKVVVNEDMAKELGIDVS                  314
            QT R  V+ILKG+   ++   E     NL++ VN   A++ G+ +S
Sbjct: 271  QTGRMVVRILKGEKPGEIKPETSDNLQLFVNPGAAQKQGVTLS                  313
```

There is also homology to SEQ ID 2712.

SEQ ID 3410 (GBS188) was expressed in *E. coli* as a His-fusion product. SDS-PAGE analysis of total cell extract is shown in FIG. 39 (lane 2; MW 36.6 kDa).

Figure 247:
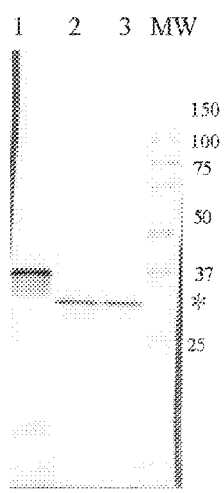

The GBS188-His fusion product was purified (FIG. 204, lane 6) and used to immunise mice. The resulting antiserum was used for Western blot (FIG. 247), FACS, and in the in vivo passive protection assay (Table III). These tests confirm that the protein is immunoaccessible on GBS bacteria and that it is an effective protective immunogen.

Based on this analysis, it was predicted that this protein and its epitopes, could be useful antigens for vaccines or diagnostics.

Example 1102

A DNA sequence (GBSx1177) was identified in *S. agalactiae* <SEQ ID 3411> which encodes the amino acid sequence <SEQ ID 3412>. This protein is predicted to be probable permease of ABC transporter (rbsC). Analysis of this protein sequence reveals the following:

---

Possible site: 21
>>> Seems to have a cleavable N-term signal seq.
INTEGRAL Likelihood = −16.13  Transmembrane 132-148 (124-160)
INTEGRAL Likelihood =  −6.42  Transmembrane 241-257 (238-258)
INTEGRAL Likelihood =  −6.32  Transmembrane 264-280 (260-284)
INTEGRAL Likelihood =  −6.00  Transmembrane 213-229 (207-235)
INTEGRAL Likelihood =  −4.67  Transmembrane 58-74 (57-75)

-continued

INTEGRAL Likelihood =  −1.38  Transmembrane 36-52 (36-52)
INTEGRAL Likelihood =  −0.85  Transmembrane 90-106 (87-106)
----- Final Results -----
   bacterial membrane --- Certainty = 0.7453 (Affirmative) <succ>
   bacterial outside --- Certainty = 0.0000 (Not Clear) <succ>
      bacterial cytoplasm --- Certainty = 0.0000 (Not Clear) <succ>

---

The protein has homology with the following sequences in the GENPEPT database.

```
>GP:AAG07224 GB:AE004801 probable permease of ABC transporter
            [Pseudomonas aeruginosa]
Identities = 114/285 (40%), Positives = 175/285 (61%), Gaps = 3/285 (1%)
Query:   5  ILSGISQGLLWSIMAIGVFITFRILDIADLSAEGAFPMGAAVCALCIVNDINPIVATIAG    64
            +   +  GL++S++A+GVFI+FR+L   DL+ +G+FP+G AVCA  I    +P  AT+A
Sbjct:   6  LFGALEIGLIFSLVALGVFISFRLLRFPDLTVDGSFPLGGAVCATLIALGWDPYSATLAA    65

Query:  65  MLGGMLAGLVSGFLHTKMKIPALLTGIITLTGLYSINLLVLGRSNVSFALKNTLVTMVTR   124
              G LAGL +G L+ K+KI    LL    I+ +  LYSINL ++G+ NV    + TL T++
Sbjct:  66  TAAGALAGLATGLLNVKLKIMDLLASILMMIALYSINLRIMGKPNVPLIAEPTLFILLQP   125

Query: 125  LGLNKLSAVLLIGIVCVGLVILILYLFLNTQLGLALRATGDNEAMGQANSIKVDRMKMLG   184
            L+        L+ +   V    L+L  F   TQ  GLA+RATG N    M  +A   +       M +LG
Sbjct: 126  EWLSDYVFRPLLLVFIVIAAKLLLDWFFTTQKGLAIRATGSNPRMARAQGVNTGGMILLG   185

Query: 185  YMIGNGLIALSGALLAQNNGYADLNMGVGTIVIGLASIILAEVMIKYLPLGKRLWSIVLG   244
               I N  L+AL+GAL AQ   G AD++MG+GTIVIGLA++I+ E ++     L    +++LG
Sbjct: 186  MAISNALVALAGALFAQTQGGADISMGIGTIVIGLAAVIVGESILPSRRLILATLAVILG   245

Query: 245  SVLYRMIIVFILTTD---IDAQMIKLVSAILLALILYVPELRAKL                 286
            +++YR  I   L  +D    + AQ +  LV+A+L+ + L +P ++ +L
Sbjct: 246  AIVYRFFIALALNSDFIGLQAQDLNLVTAVLVTVALVIPMMKKRL                 290
```

There is also homology to SEQ ID 2716.

Based on this analysis, it was predicted that this protein and its epitopes, could be useful antigens for vaccines or diagnostics.

Example 1103

A DNA sequence (GBSx1178) was identified in *S. agalactiae* <SEQ ID 3413> which encodes the amino acid sequence <SEQ ID 3414>. This protein is predicted to be ABC transporter. Analysis of this protein sequence reveals the following:

Possible site: 41
>>> Seems to have no N-terminal signal sequence
----- Final Results -----
bacterial cytoplasm --- Certainty = 0.3798 (Affirmative) <succ>
bacterialmembrane --- Certainty = 0.0000 (Not Clear) <succ>
bacterialoutside --- Certainty = 0.0000 (Not Clear) <succ>

The protein has homology with the following sequences in the GENPEPT database.

```
>GP:AAF86640 GB:AF162694 ABC transporter [Enterococcus gallinarum]

Identities = 171/264 (64%), Positives = 213/264 (79%), Gaps = 1/264 (0%)

Query:   3  LLELVNLHKTFEKGTVNENHVLRGLDLTIEDGDFISVIGGNGAGKSTLLNCIAGLIPIDQ    62
            +L + +LH+TFEKGT+NENHVLRG+DLT+  GDFI++IGGNGAGKSTLLN IAG IP +Q
Sbjct:   5  VLTISDLHQTFEKGTINENHVLRGIDLTMNSGDFITIIGGNGAGKSTLLNSIAGTIPTEQ    64

Query:  63  GAITLDNQSITKDSVEKRSKDISRVFQDPRMGTATNLTIEENMAIAHKRGNKRHIFRQSV   122
            G I L ++ IT+ SV +RSK+ISRVFQDPRMGTA  LT+EEN+A+A+KRG   R  F   V
Sbjct:  65  GKIVLGDKEITRHSVTRRSKEISRVFQDPRMGTAVRLTVEENIALAYKRGQVRG-FSSGV   123

Query: 123  TDDDRQLFKKSLSQLGLGLENRMKTDAAFLSGGQRQALTLAMATLVRPKLLLLDEHTAAL   182
                R   FK+ L++L LGLENR+ T+     LSGGQRQA+TL MATL +PKL+LLDEHTAAL
Sbjct: 124  KGKHRAFFKEKLARLNLGLENRLTTEIGLLSGGQRQATTLLMATLQQPKLILLDEHTAAL   183

Query: 183  DPKTSDMVMELTQKVIEEQRLTALMITHNMEHAIAYGNRLVMLYHGKIVVDVKGEAKRNL   242
            DPKTS  VM LT ++I+EQ+LTA M+TH+ME AI YGNRL+ML+  GKIVVD+ GE K++L
Sbjct: 184  DPKTSMTVMALTDQLIQEQQLTAFMVTHDMEDAIRYGNRLIMLHQGKIVVDITGEEKQSL   243

Query: 243  TVAELMELFHKNSGQQLIDDALVL                                      266
            TV +LM LFH+NSG +L DD L+L
Sbjct: 244  TVPDLMALFHQNSGTELKDDQLLL                                      267
```

There is also homology to SEQ ID 2720:

```
Identities = 116/249 (46%), Positives = 166/249 (66%), Gaps = 1/249 (0%)
Query:    3 LLELVNLHKTFEKGTVNENHVLRGLDLTIEDGDFISVIGGNGAGKSTLLNCIAGLIPIDQ      62
            ++EL+N    + G +    +L  + LTI + DF++++GGNGAGKSTL N IAG + + +
Sbjct:    4 IIELINATVDVDNGFEDAKTILDNVTLTIYEHDFLTILGGNGAGKSTLFNVIAGTLSLTR      63

Query:   63 GAITLDNQSITKDSVEKRSKDISRVFQDPRMGTATNLTIEENMAIAHKRGNKRHIFRQSV     122
            G I +  Q +T      EKR+  +SRVFQD +MGTA  +T+ EN+ IA +RG KR +  + +
Sbjct:   64 GQIRILGQDVTHWPAEKRALYLSRVFQDSKMGTAPRMTVAENLLIARQRGGKRSLASRKI     123

Query:  123 TDDDRQLFKKSLSQLGLGLENRMKTDAAFLSGGQRQALTLAMATLVRPKLLLLDEHTAAL     182
            T+       F+ + + G GLE  ++T A  LSGGQRQAL+L MATL +P LLLLDEHTAAL
Sbjct:  124 TEHLAS-FEDLVKRTGNGLEKHLETPAGLLSGGQRQALSLLMATLKKPALLLLDEHTAAL     182

Query:  183 DPKTSDMVMELTQKVIEEQRLTALMITHNMEHAIAYGNRLVMLYHGKIVVDVKGEAKRNL     242
            DPKTS  +M+LT + + +   LTALMITH+ME A+ YGNRL+++  G I+ D+     K  L
Sbjct:  183 DPKTSQSLMQLTDEFVTKDGLTALMITHHMEDALTYGNRLIVMKDGNIIKDLNQMEKEQL     242

Query:  243 TVAELMELF                                                         251
            T+ +  +LF
Sbjct:  243 TITDYYQLF                                                         251
```

Based on this analysis, it was predicted that this protein and its epitopes, could be useful antigens for vaccines or diagnostics.

Example 1104

A DNA sequence (GBSx1179) was identified in *S. agalactiae* <SEQ ID 3415> which encodes the amino acid sequence <SEQ ID 3416>. This protein is predicted to be mannose-specific phosphotransferase system component IIAB. Analysis of this protein sequence reveals the following:

Possible site:54
>>> Seems to have no N-terminal signal sequence
----- Final Results -----
    bacterial cytoplasm --- Certainty = 0.3527 (Affirmative) <succ>
      bacterial membrane --- Certainty = 0.0000 (Not Clear) <succ>
        bacterial outside --- Certainty = 0.0000 (Not Clear) <succ>

The protein has homology with the following sequences in the GENPEPT database.

A related DNA sequence was identified in *S. pyogenes* <SEQ ID 3417> which encodes the amino acid sequence <SEQ ID 3418>. Analysis of this protein sequence reveals the following:

Possible site: 14
>>> Seems to have no N-terminal signal sequence
----- Final Results -----
    bacterial cytoplasm --- Certainty = 0.3533 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below.

```
>GP:AAD46485 GB:AF130465 mannose-specific phosphotransferase system
component IIAB [Streptococcus salivarius]
Identities = 287/336 (85%), Positives = 306/336 (90%), Gaps = 6/336 (1%)
Query:    1 MGIGIIIASHGKFAEGIHQSGSMIFGEQEKVQVVTFMPNEGPDDLYGHFNNAIAQFDADD      60
            MGIGIIIASHGKFAEGIHQSGSMIFG+QEKVQVVTFMP+EGPDDLY HFN+AIAQFDADD
Sbjct:    1 MGIGIIIASHGKFAEGIHQSGSMIFGDQEKVQVVTFMPSEGPDDLYAHFNDAIAQFDADD      60

Query:   61 EVLVLADLWSGSPFNQASRVMGENPERKMAIITGLNLPMLIQAYTERMMDANAGVEQVAA     120
            E+LVLADLWSGSPFNQASR+ GENP+RK+AIITGLNLPMLIQAYTERMMDANA  EQVAA
Sbjct:   61 EILVLADLWSGSPFNQASRIAGENPDRKIAIITGLNLPMLIQAYTERMMDANATAEQVAA     120

Query:  121 NIIKESKEGIKALPEELNPVVEATPVAGVPADVPAEVKQSGSIPEGTVIGDGKLKINLAR     180
            NIIKE+K GIKALPEELNP  E T  A V A P       G+IPEGTVIGDGKLKINLAR
Sbjct:  121 NIIKEAKGGIKALPEELNPAEETT-AAPVEAAAP-----QGAIPEGTVIGDGKLKINLAR     174

Query:  181 IDTRLLHGQVATAWTPASKANRIIVASDEVSKDELRKQLIKQAAPGGVKANVVPISKLIE     240
            +DTRLLHGQVAT WTPASKA+RIIVASD+V+KDELRK+LIKQAAP GVKANVVPI KLI+
Sbjct:  175 LDTRLLHGQVATNWTPASKADRIIVASDDVAKDELRKELIKQAAPNGVKANVVPIQKLID     234

Query:  241 VAKDPRFGNTRALILFETVQDALRAIEGGVEIPELNVGSMAHSTGKTMVNNVLSMDKDDV     300
             +KDPRFGNT ALILFETVQDALRAIEGGV I ELNVGSMAHSTGKTMVNNVLSMDKDDV
Sbjct:  235 ASKDPRFGNTHALILFETVQDALRAIEGGVPIKELNVGSMAHSTGKTMVNNVLSMDKDDV     294

Query:  301 AAFEKLRDLGVSFDVRKVPNDAKKNLFDLINKANVK                              336
            A FEKLRDLGV FDVRKVPND+KK+LFDLI KANV+

Sbjct:  295 ACFEKLRDLGVEFDVRKVPNDSKKDLFDLIKKANVQ                              330
```

```
Identities = 288/336 (85%), Positives = 308/336 (90%), Gaps = 6/336 (1%)
Query:   1  MGIGIIIASHGKFAEGIHQSGSMIFGEQEKVQVVTFMPNEGPDDLYGHFNNAIAQFDADD    60
            MGIGIIIASHGKFAEGIHQSGSMIFGEQEKVQVVTFMPNEGPDDLYGHFNNAI QFDADD
Sbjct:   1  MGIGIIIASHGKFAEGIHQSGSMIFGEQEKVQVVTFMPNEGPDDLYGHFNNAIQQFDADD    60

Query:  61  EVLVLADLWSGSPFNQASRVMGENPERKMAIITGLNLPMLIQAYTERMMDANAGVEQVAA   120
            E+LVLADLWSGSPFNQASRV GENP+RKMAIITGLNLPMLIQAYTER+MDA AGVEQVAA
Sbjct:  61  EILVLADLWSGSPFNQASRVAGENPDRKMAIITGLNLPMLIQAYTERLMDAGAGVEQVAA   120

Query: 121  NIIKESKEGIKALPEELNPVVEATPVAGVPADVPAEVKQSGSIPEGTVIGDGKLKINLAR   180
            NIIKESK+GIKALPE+LNPV E      V   +       G+IP GTVIGDGKLKINLAR
Sbjct: 121  NIIKESKDGIKALPEDLNPVEETAATEKVVNAL------QGAIPAGTVIGDGKLKINLAR   174

Query: 181  IDTRLLHGQVATAWTPASKANRIIVASDEVSKDELRKQLIKQAAPGGVKANVVPISKLIE   240
            +DTRLLHGQVATAWTPASKA+RIIVASDEV++D+LRKQLIKQAAPGGVKANVVPISKLIE
Sbjct: 175  VDTRLLHGQVATAWTPASKADRIIVASDEVAQDDLRKQLIKQAAPGGVKANVVPISKLIE   234

Query: 241  VAKDPRFGNTRALILFETVQDALRAIEGGVEIPELNVGSMAHSTGKTMVNNVLSMDKDDV   300
             +KDPRFGNT ALILF+T QDALRA+EGGVEI ELNVGSMAHSTGKTMVNNVLSMDK+DV
Sbjct: 235  ASEDPRFGNTHALILFQTPQDALRAVEGGVEINELNVGSMAHSTGKTMVNNVLSMDKEDV   294

Query: 301  AAFEKLRDLGVSFDVRKVPNDAKKNLFDLINKANVK                          336
            A FEKLRDLGV+FDVRKVPND+KKNLF+LI K N+K
Sbjct: 295  ATFEKLRDLGVTFDVRKVPNDSKKNLFELIQKTNIK                          330
```

Based on this analysis, it was predicted that these proteins and their epitopes could be useful antigens for vaccines or diagnostics.

Example 1105

A DNA sequence (GBSx1180) was identified in *S. agalactiae* <SEQ ID 3419> which encodes the amino acid sequence <SEQ ID 3420>. Analysis of this protein sequence reveals the following:

Possible site: 52
>>> Seems to have no N-terminal signal sequence
----- Final Results -----
  bacterial cytoplasm --- Certainty = 0.3873 (Affirmative) <succ>
   bacterial membrane --- Certainty = 0.0000 (Not Clear) <succ>
    bacterial outside --- Certainty = 0.0000 (Not Clear) <succ>

The protein has homology with the following sequences in the GENPEPT database.

A related DNA sequence was identified in *S. pyogenes* <SEQ ID 3421> which encodes the amino acid sequence <SEQ ID 3422>. Analysis of this protein sequence reveals the following:

Possible site: 50
>>> Seems to have no N-terminal signal sequence
----- Final Results -----
  bacterial cytoplasm --- Certainty = 0.4380 (Affirmative) <succ>
   bacterial membrane --- Certainty = 0.0000 (Not Clear) <succ>
    bacterial outside --- Certainty = 0.0000 (Not Clear) <succ>

An alignment of the GAS and GBS proteins is shown below.

```
>GP:BAB06625 GB:AP001517 unknown conserved protein [Bacillus halodurans]
Identities = 89/267 (33%), Positives = 139/267 (51%), Gaps = 3/267 (1%)
Query:   3  KKIIAVDLDGTLLHNNNTISDYTADTLRKVQAQGHKVIITTGRPYRMALAHYLRLDLKTP    62
            + +IA+DLDGTLL +N TIS  T  T++K +  GH V+I+TGRPYR ++ +Y  L L T
Sbjct:   4  RHLIALDLDGTLLTDNKTISMKTKQTIQKAREAGHIVVISTGRPYRASIQYYQELQLDTA    63

Query:  63  MINFNGALTHIPEKKWAFERSATIDKKLLLETLNLSDAIQADFIASEYRKNFYITMDNRD   122
            ++NFNGA  H P+             ++     + +   +A  I E   ++Y+      D
Sbjct:  64  IVNFNGAFVHHPKDSSFGTYHHPLELSTARQVIETCEAFDVSNIMVEVIDDYYLRY--YD   121

Query: 123  KINPQLFGVNEITDKMALDVTKITRNPNALLMQTRHKDKYELAKELRQHFNHELEVDSWG   182
            ++   Q F +    +     +  K+  +P  +L+ +         EL  L      ++  +WG
Sbjct: 122  ELFIQTFTEGQGPVEHGNLLKKLRDDPTCVLIHPKDDHVSELRSLLDGAHAEVIDQRTWG   181

Query: 183  GPLNILEFSPKGVNKAYALKHLLKSLNLSQENLIAFGDEHNDTEMLAFAHTGYAMKNANP   242
             P N++E    G+NKA LK +     + +E +IAFGDE ND EM+  +A  G AM NA
Sbjct: 182  APWNVIEIVKAGMNKAVGLKRIADYYQVPKERIIAFGDEDNDFEMIEYAGKGVAMANAID   241

Query: 243  TLLPYADQQIQWTNEEDGVAKTLEKLL                                   269
             L    A+  I  +NE+DG+A  LE+ L
Sbjct: 242  PLKALAN-DITLSNEDDGIAVYLEEAL                                   267
```

```
Identities = 188/270 (69%), Positives = 224/270 (82%)
Query:   1   MTKKIIAVDLDGTLLHNNNTISDYTADTLRKVQAQGHKVIITTGRPYRNALAHYLRLDLK    60
             MTKK+IA+DLDGTLLH++NTIS YT   T++ VQ +GH VII+TGRPYRMAL +YL+L+LK
Sbjct:   1   MTKKLIAIDLDGTLLHHDNTISTYTQKTIKAVQDKGHHVIISTGRPYRMALGYYLQLNLK    60

Query:  61   TPMINFNGALTHIPEKKWAFERSATIDKKLLLETLNLSDAIQADFIASEYRKNFYITMDN   120
             TP+I FNGALTH+PE+KWA+E + T+DK LL  L   D  Q DFIASEYRKN YITM N
Sbjct:  61   TPIITFNGALTHMPEQKWAYEHNVTLDKGYLLRLLKYQDDFQMDFIASEYRKNVYITMTN   120

Query: 121   RDKINPQLFGVNEITDKMALDVTKITRNPNALLMQTRHKDKYELAKELRQHFNHELEVDS   180
              + I+PQLFGV+EIT  MAL++TKITRNPNALLMQT H+DKY LAK +R  F  E+E+DS
Sbjct: 121   PESIDPQLFGVDEITQDMALEITKITRNPNALLMQTHHEDKYALARNMRACFKDEIEIDS   180

Query: 181   WGGPLNILEFSPKGVNKAYALKHLLKSLNLSQENLIAFGDEHNDTEMLAFAHTGYAMKNA   240
             WGGPLNILE S K VNKAYAL +LL    N+ +++LIAFGDEHNDTEMLAFA TGYAMKNA
Sbjct: 181   WGGPLNILEISSKNVNKAYALNYLLGIYNMDKKDLIAFGDEHNDTEMLAFAGTGYAMKNA   240

Query: 241   NPTLLPYADQQIQWTNEEDGVAKTLEKLLL                                270
             +P LLPYADQQ+ ++NEEDGVAK LE+L L
Sbjct: 241   SPVLLPYADQQLNFSNEEDGVAKKLEELFL                                270
```

Based on this analysis, it was predicted that these proteins and their epitopes could be useful antigens for vaccines or diagnostics.

Example 1106

A DNA sequence (GBSx1181) was identified in *S. agalactiae* <SEQ ID 3423> which encodes the amino acid sequence <SEQ ID 3424>. Analysis of this protein sequence reveals the following:

---

Possible site: 39
>>> Seems to have an uncleavable N-term signal seq
INTEGRAL Likelihood = −7.38 Transmembrane 96-112 (90-119)
INTEGRAL Likelihood = −6.58 Transmembrane 28-44 (27-47)
INTEGRAL Likelihood = −6.26 Transmembrane 176-192 (174-193)
INTEGRAL Likelihood = −5.26 Transmembrane 127-143 (126-144)
INTEGRAL Likelihood = −1.59 Transmembrane 4-20 (3-20)
INTEGRAL Likelihood = −0.22 Transmembrane 60-76 (59-78)
----- Final Results -----
    bacterial membrane --- Certainty = 0.3951 (Affirmative) <succ>
        bacterial outside --- Certainty = 0.0000 (Not Clear) <succ>
            bacterial cytoplasm --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1107

A DNA sequence (GBSx1182) was identified in *S. agalactiae* <SEQ ID 3425> which encodes the amino acid sequence <SEQ ID 3426>. Analysis of this protein sequence reveals the following:

---

Possible site: 31
>>> Seems to have no N-terminal signal sequence
----- Final Results -----
    bacterial cytoplasm --- Certainty = 0.2025 (Affirmative) <succ>
        bacterial membrane --- Certainty = 0.0000 (Not Clear) <succ>
            bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1108

A DNA sequence (GBSx1183) was identified in *S. agalactiae* <SEQ ID 3427> which encodes the amino acid sequence <SEQ ID 3428>. This protein is predicted to be an integral membrane protein. Analysis of this protein sequence reveals the following:

---

Possible site: 22
>>> Seems to have a cleavable N-term signal seq.
INTEGRAL Likelihood = −5.41 Transmembrane 180-196 (179-199)
INTEGRAL Likelihood = −5.31 Transmembrane 96-112 (94-114)
INTEGRAL Likelihood = −2.18 Transmembrane 129-145 (129-145)
INTEGRAL Likelihood = −1.33 Transmembrane 37-53 (37-53)
----- Final Results -----
    bacterial membrane --- Certainty = 0.3166 (Affirmative) <succ>
        bacterial outside --- Certainty = 0.0000 (Not Clear) <succ>
            bacterial cytoplasm --- Certainty = 0.0000 (Not Clear) <succ>

---

A related GBS nucleic acid sequence <SEQ ID 8729> which encodes amino acid sequence <SEQ ID 8730> was also identified. Analysis of this protein sequence reveals the following:

---

Lipop: Possible site: −1    Crend: 7
McG: Discrim Score: 5.85
GvH: Signal Score (−7.5) : −2.39
Possible site: 18
>>> Seems to have a cleavable N-term signal seq.
ALOM program count: 4  value: −5.41  threshold: 0.0
INTEGRAL        Likelihood = −5.41 Transmembrane 176-192 (175-195)
INTEGRAL        Likelihood = −5.31 Transmembrane 92-108 (90-110)
INTEGRAL        Likelihood = −2.18 Transmembrane 129-145 (129-145)
PERIPHERAL      Likelihood = 0.05  57
modified ALOM score: 1.58
*** Reasoning Step: 3
----- Final Results -----
    bacterial membrane --- Certainty = 0.3166 (Affirmative) <succ>
        bacterial outside --- Certainty = 0.0000 (Not Clear) <succ>
            bacterial cytoplasm --- Certainty = 0.0000 (Not Clear) <succ>

---

The protein has homology with the following sequences in the GENPEPT database.

```
>GP:AAC65028 GB:AE001188 conserved hypothetical integral membrane
protein [Treponema pallidum]
Identities = 54/190 (28%), Positives = 93/190 (48%), Gaps = 14/190 (7%)
Query:  14 LFFIVISFGIKYYHLQG--PNLIWNMTLALIALDFAYLTSL--FKKKILIGLFALAWFFF      69
           +F +++SFG +        L+WN+ LA I    + +  + F  + +     L W  F
Sbjct:   3 VFCLLLSFGRRCVAADNFLSFLVWNLVLAFIPWLISAILHVRRFAVRSVQLFLMLLWLLF      62

Query:  70 YPNTFYMLTDIIHMHFVGDVLYNKTNLILYILYVSSILFGFLSGIESFSVIMRKFRISNI     129
           +PN   Y+LTDIIH+       L     +IL   + + + F+S      S++ R F I
Sbjct:  63 FPNAPYILTDIIHLGKGKSFLLYYDLIILLAYSFTGLFYAFVSLHLIESILARDFHIKRP     122

Query: 130 FLRWGIIGIVSL-VSSFGIHIGRYARLNSWDILTKPQVVINELLAVPSR-----DSFHFI     183
           F     II +  L + +FGI++GR+ R NSWDI+   + +++++     R     D++ F+
Sbjct: 123 F----IISVFELYLCAFGIYLGRFLRWNSWDIVLHGRTILSDIGIRVIRPVFYVDTWMFV     178

Query: 184 LGFTFLQVLC                                                      193
              F  + VLC
Sbjct: 179 FFFGTMLVLC                                                      188
```

No corresponding DNA sequence was identified in *S. pyogenes*.

Based on this analysis, it was predicted that these proteins and their epitopes could be useful antigens for vaccines or diagnostics.

Example 1109

A DNA sequence (GBSx1184) was identified in *S. agalactiae* <SEQ ID 3429> which encodes the amino acid sequence <SEQ ID 3430>. Analysis of this protein sequence reveals the following:

---

Possible site: 17
>>> Seems to have no N-terminal signal sequence
INTEGRAL Likelihood = −6.79 Transmembrane 171-187 (166-191)
----- Final Results -----
   bacterial membrane --- Certainty = 0.3718 (Affirmative) <succ>
     bacterial outside --- Certainty = 0.0000 (Not Clear) <succ>
        bacterial cytoplasm --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1110

A DNA sequence (GBSx1185) was identified in *S. agalactiae* <SEQ ID 3431> which encodes the amino acid sequence <SEQ ID 3432>. Analysis of this protein sequence reveals the following:

---

Possible site: 29
>>> Seems to have no N-terminal signal sequence
INTEGRAL Likelihood = −10.46 Transmembrane 193-209 (191-214)
INTEGRAL Likelihood = −10.30 Transmembrane 99-115 (96-119)
INTEGRAL Likelihood = −8.17  Transmembrane 454-470 (451-472)
INTEGRAL Likelihood = −6.64  Transmembrane 216-232 (212-236)
INTEGRAL Likelihood = −6.37  Transmembrane 49-65 (43-68)
INTEGRAL Likelihood = −4.88  Transmembrane 362-378 (357-383)
INTEGRAL Likelihood = −3.61  Transmembrane 385-401 (385-402)
INTEGRAL Likelihood = −2.76  Transmembrane 275-291 (275-291)
INTEGRAL Likelihood = −1.70  Transmembrane 18-34 (18-34)
----- Final Results -----
   bacterial membrane --- Certainty = 0.5182 (Affirmative) <succ>
     bacterial outside --- Certainty = 0.0000 (Not Clear) <succ>
        bacterial cytoplasm --- Certainty = 0.0000 (Not Clear) <succ>

---

The protein has homology with the following sequences in the GENPEPT database.

```
>GP:AAF95422 GB:AE004299 conserved hypothetical protein [Vibrio cholerae]
Identities = 193/471 (40%), Positives = 286/471 (59%), Gaps = 42/471 (8%)
Query:   1 MEKFFKLKEHGTTIRTEITAGLTTFFAMSYILFVNPAILSQTGMPAQGVFLATIIGAVVA      60
           +EK FKL E+GT +RTEI AG+TTF M+YI+FVNPAILS  GM      VF+AT + A +
Sbjct:   2 LEKLFKLSEYGTNVRTEILAGVTTFLTMAYIIFVNPAILSDAGMDRGAVFVATCLAAAIG      61

Query:  61 TSVMAFYANLPYAQAPGMGLNAFFTYTVVFALGYTWQEALAMVFICGLISLIITLTKVRK     120
           +M F AN P AQAPGMGLNAFFTY VV  +G+TWQ ALA VF   G++ ++++L K+R+
Sbjct:  62 CFIMGFIANYPIAQAPGMGLNAFFTYGVVLGMGHTWQVALAAVFCSGVLFILLSLFKIRE     121

Query: 121 MIIESIPTTLKSAITAGIGTFLAYVGIKNAGFLKFSIDPGTYDVVGKGAAKGLATITANS     180
            II SIP +L++ I+AGIG FLA++ +KNAG +    +P T  +V GA    L   +
Sbjct: 122 WIINSIPHSLRTGISAGIGLFLAFIALKNAGIV--VDNPAT--LVSLGAITSLHAV----     173

Query: 181 SATPGLVSFDNPAILLSLIGLSITIFFIVKGIRGGIILSILTTTLLGILMGVVKLDAINW     240
                  L+ +G  +TI  + +G++G    ++++IL  T LG++ G V+    I
Sbjct: 174 ---------------LAAVGFFLTIGLVYRGVKGAVMIAILAVTALGLVFGDVQWGGIMS     218

Query: 241 EATNLSASFRDLKQVFGVALGEKGLISLFSNPSRLPSVLMAILAFSLTDIFDTIGTLIGT     300
           +++ +F    Q+    A+ E G+IS+              + AF   D+FDT GTL+G
Sbjct: 219 TPPSIAPTF---MQLDFSAVFEIGMISV------------VFAFLFVDLFDTAGTLVGV     262

Query: 301 GEKVGILATTGDNHESKSLDKALYSDLIGTTFGAICGTSNVTTYVESAAGIGAGGRTGLT     360
```

```
                 K G++     G     +    L++AL +D      T+  GA+ GTSN T+Y+ES +G+  GGRTGLT
Sbjct: 263  ATKAGLIEKDG---KIPRLNRALLADSTATSVGALLGTSNTTSYIESVSGVAVGGRTGLT     319

Query: 361  ALVVAGLFAISSFFSPLVSIVPSQATAPILVIVGIMMLSNLKDIKWDDMSEAIPAFFTSL     420
            A+VV  LF ++ FFSPL  ++P+ ATA   L   V I+M+S L   I W D++EA P    T L
Sbjct: 320  AVVVGILFLLALFFSPLAGMIPAYATAGALFYVAILMMSGLVSIDWRDLTEAAPTVVTCL     379

Query: 421  FMGFTYSITYGIAAGFLTYTLAKVIKGQAKDIHVVLWILDILFILNFISLA              471
            M    T+SI  GI+ GF+ Y    K+   G+ + + + +W++    +F++ +I   A
Sbjct: 380  MMPLTFSIAEGISLGFIRYAAIKLFSGKGRSVSLSVWVMAAIFVIKYILAA              430
```

A related DNA sequence was identified in *S. pyogenes* <SEQ ID 3433> which encodes the amino acid sequence <SEQ ID 3434>. Analysis of this protein sequence reveals the following:

Possible site: 51
>>> Seems to have no N-terminal signal sequence
INTEGRAL    Likelihood = −11.57    Transmembrane 378-394 (370-419)
INTEGRAL    Likelihood = −9.29     Transmembrane 202-218 (195-221)
INTEGRAL    Likelihood = −7.64     Transmembrane 48-64 (46-71)
INTEGRAL    Likelihood = −7.64     Transmembrane 99-115 (97-118)
INTEGRAL    Likelihood = −6.90     Transmembrane 225-241 (221-245)
INTEGRAL    Likelihood = −6.05     Transmembrane 468-484 (465-485)
INTEGRAL    Likelihood = −4.35     Transmembrane 399-415 (395-419)
INTEGRAL    Likelihood = −3.24     Transmembrane 425-441 (425-442)
INTEGRAL    Likelihood = −3.08     Transmembrane 18-34 (18-34)
INTEGRAL    Likelihood = −2.28     Transmembrane 442-458 (442-460)
INTEGRAL    Likelihood = −0.00     Transmembrane 282-298 (282-298)
----- Final Results -----
  bacterial membrane --- Certainty = 0.5628 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP:BAB04327 GB:AP001509 unknown conserved protein [Bacillus halodurans]
Identities = 192/485 (39%), Positives = 276/485 (56%), Gaps = 53/485 (10%)
Query:   1  MEKFFKLSENGTTVSTEIMAGLITFFAMSYILFVNPSILGAAGMPSNAVFLATIIAAAIS     60
            M+++F   E+GTT    E +AGLTTF +M+YILFVNP ILG AGM    AVF+AT +AAAI
Sbjct:   1  MDRYFGFKEHGTTYGRESIAGLTTFLSMAYILFVNPLILGDAGMDVQAVFMATALAAAIG     60

Query:  61  TLIMGLFANVPYALAPGMGLNAFFTYTVVFALRFSWQEALAMVFICGLFNIFITVTKFRK    120
            TLIMG+  A  P ALAPGMGLNAFF Y+VV  +   WQ AL  VF+ G+   I ITV K R+
Sbjct:  61  TLIMGILAKYPIALAPGMGLMAFFAYSVVIGMGIDWQLALFGVFVSGIIFILITVFKIRE    120

Query: 121  SIIKAIPVSLQHAIGGGIGVFVAYLGFKNANIITFSISAENIVMVNGVEPAKASAKTFAD    180
              II AIP   L++A      GIG+F+A++G KNA I+
Sbjct: 121  VIINAIPAELKNAAAAGIGLFIAFIGLKNAGIVV------------------------    154

Query: 181  GLLFVDANGGVVPTISSFTDSGVLLAIFGLLLTTALVIRNFRGAILIGIVATTLVGIPLG    240
                        ++     ++    +    LLA FGL++T    ++R   +G I   G++  T +VG+     G
Sbjct: 155  ------SDEATAVSLGHILNGPILLACFGLIVTVLFMVRGIQGGIFYGMILTAIVGLISG    208

Query: 241  IVDVSNLNFGISHIGEAWTELGTTFLAAFD-GLSSLFSDSSRLPLVFMTIFAFSLSDTFD    299
            I+  +        I       L  TF  AF+   ++ +FS         +   +     F    D FD
Sbjct: 209  IITYTG-----GGIVSTPPSLAPTFGQAFNIQMADVFSVQ-----FLIVVLTFLFVDFFD    258

Query: 300  TIGTFIGTGRRTGIFSQDDENALENSIGFSSKMDRALFADAIGTSIGALVGTSNTTTYVE    359
            T GT  G    + G F +D++                    +    +AL AD+    TSIGA++GTS TT  Y+E
Sbjct: 259  TAGTLYGVANQAG-FIKDNK---------LPRAGKALLADSSATSIGAILGTSTTTAYIE    308

Query: 360  SAAGIAEGGRTGLTAVSTAVCFLLSILLLPLVGIVPAAATAPALIIVGVMMVSSFLDVNW    419
            S+AG+A  GGRTG ++ TA  F+L++      PL+  +V      TA ALI+VG++M SS          ++W
Sbjct: 309  SSAGVAAGGRTGFASIVTAGLFVLAMFFSPLLSVVTEQVTAAALIVVGILMASSLRFIDW    368

Query: 420  SKFADALPAFFAAFFMALCYSISYGIAAAFIFYCLVKVVEGKTKDIHPIIWGATFLFIVN    479
            +K    A+P+F     M L YSI+ GIA   F+FY   +V+G+ K++HPI++       F+F+
Sbjct: 369  TKLEIAIPSFLTVVAMPLTYSIATGIAFGFLFYPITMIVKGRGKEVHPIMYALFFVFLAY    428

Query: 480  FIILT                                                          484
            FI L+
Sbjct: 429  FIFLS                                                          433
```

An alignment of the GAS and GBS proteins is shown below.

```
Identities = 258/488 (52%), Positives = 336/488 (67%), Gaps = 17/488 (3%)
Query:   1  MEKFFKLKEHGTTIRTEITAGLTTFFAMSYILFVNPAILSQTGMPAQGVFLATIIGAVVA     60
            MEKFFKL E+GTT+ TEI AGLTTFFAMSYILFVNP+IL    GMP+   VFLATII A ++
Sbjct:   1  MEKFFKLSENGTTVSTEIMAGLTTFFAMSYILFVNPSILGAAGMPSNAVFLATIIAAAIS     60
```

```
                           -continued
Query:   61 TSVMAFYANLPYAQAPGMGLNAFFTYTVVFALGYTWQEALAMVFICGLISLIITLTKVRK        120
            T +M  +AN+PYA APGMGLNAFFTYTVVFAL ++WQEALAMVFICGL ++ IT+TK RK
Sbjct:   61 TLIMGLFANVPYALAPGMGLNAFFTYTVVFALRFSWQEALAMVFICGLFNIFITVTKFRK        120

Query:  121 MIIESIPTTLKSAITAGIGTFLAYVGIKNAGFLKFSIDPGTYDVV---------GKGAAK        171
            II++IP +L+ AI  GIG F+AY+G KNA  + FSI     +V           K  A
Sbjct:  121 SIIKAIPVSLQHAIGGGIGVFVAYLGFKNANIITFSISAENIVMVNGVEPAKASAKTFAD        180

Query:  172 GLATITANSSATPGLVSFDNPAILLSLIGLSITIFFIVKGIRGGIILSILTTTLLGILMG        231
            GL  + AN     P + SF +  +LL++ GL +T    +++  RG I++ I+ TTL+GI +G
Sbjct:  181 GLLFVDANGGVVPTISSFTDSGVLLAIFGLLLTTALVIRNFRGAILIGIVATTLVGIPLG        240

Query:  232 VVKLDAINWEATNLSASFRDLKQVFGVALGEKGLISLFSNPSRLPSVLMAILAFSLTDIF        291
            +V +  +N+  +++ ++ +L   F   A      GL SLFS+  SRLP V M I AFSL+D F
Sbjct:  241 IVDVSNLNFGISHIGEAWTELGTTFLAAF--DGLSSLFSDSSRLPLVFMTIFAFSLSDTF        298

Query:  292 DTIGTLIGTGEKVGILATTGDN------HESKSLDKALYSDLIGTTFGAICGTSNVTTYV        345
            DTIGT IGTG + GI +   +N           S    +D+AL++D IGT+ GA+ GTSN TTYV
Sbjct:  299 DTIGTFIGTGRRTGIFSQDDENALENSIGFSSKMDRALFADAIGTSIGALVGTSNTTTYV        358

Query:  346 ESAAGIGAGGRTGLTALVVAGLFAISSFFSPLVSIVPSQATAPILVIVGIMMLSNLKDIK        405
            ESAAGI  GGRTGLTA+   A   F +S    PLV IVP+ ATAP L+IVG+MM+S+  D+
Sbjct:  359 ESAAGIAEGGRTGLTAVSTAVCFLLSILLLPLVGIVPAAATAPALIIVGVMMVSSFLDVN        418

Query:  406 WDDMSEAIPAFFTSLFMGFTYSITYGIAAGFLTYTLAKVIKGQAKDIHVVLWILDILFIL        465
            W   ++A+PAFF + FM    YSI+YGIAA F+ Y L  KV++G+ KDIH ++W     LFI+
Sbjct:  419 WSKFADALPAFFAAFFMALCYSISYGIAAAFIFYCLVKVVEGKTKDIHPIIWGATFLFIV        478

Query:  466 NFISLAIL                                                    473
            NFI L IL
Sbjct:  479 NFIILTIL                                                    486
```

Based on this analysis, it was predicted that these proteins and their epitopes could be useful antigens for vaccines or diagnostics.

Example 1111

A DNA sequence (GBSx1186) was identified in *S. agalactiae* <SEQ ID 3435> which encodes the amino acid sequence <SEQ ID 3436>. Analysis of this protein sequence reveals the following:

Possible site: 32
>>> Seems to have no N-terminal signal sequence
----- Final Results -----
   bacterial cytoplasm --- Certainty = 0.3221 (Affirmative) <succ>
   bacterial membrane --- Certainty = 0.0000 (Not Clear) <succ>
   bacterial outside --- Certainty = 0.0000 (Not Clear) <succ>

A related DNA sequence was identified in *S. pyogenes* <SEQ ID 3437> which encodes the amino acid sequence <SEQ ID 3438>. Analysis of this protein sequence reveals the following:

Possible Site: 43
>>> Seems to have no N-terminal signal sequence
----- Final Results -----
   bacterial cytoplasm --- Certainty = 0.1202 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

An alignment of the GAS and GBS proteins is shown below.

```
>GP:BAB04264 GB:AP001508 unknown conserved protein [Bacillus halodurans]
Identities = 68/147 (46%), Positives = 100/147 (67%), Gaps = 1/147 (0%)
Query:   27 MFYTQNEEELIALGQKLGTVLKSGDIVLLTGNLGAGKTTLTKGIAKGLDIKQMIKSPTYT    86
            M  TQ+ E  +A  QKL    L +GD++ L G+LGAGKT+ TKG+A GL IK+++KSPT+T
Sbjct:    5 MMITQSPEATMAFAQKLADKLLAGDVITLEGDLGAGKTSFTKGLALGLGIKRVVKSPTFT    64

Query:   87 IVREYEGRVPLYHLDVYRIGDDPDSIDLDDFLFGQGVTVIEWGELLSDNLINNYLEIVIT   146
            I+REY+GR+PLYH+DVYR+ ++ + +  D++  G GVTV+EW  L+   L    L I IT
Sbjct:   65 IIREYKGRLPLYHMDVYRLNEEEEDLGFDEYFHGDGVTVVEWASLIEGRLPPVRLAITIT   124

Query:  147 RSNQG-RQVQLEAYGHRAREIIEAIQD                                  172
            + +   RQ+   AYG R  E+++ + D
Sbjct:  125 HAGENERQLSFTAYGERWEEVLKELLD                                  151
```

```
Identities = 97/142 (68%), Positives = 122/142 (85%)
Query:  27  MFYTQNEEELIALGQKLGTVLKSGDIVLLTGNLGAGKTTLTKGIAKGLDIKQMIKSPTYT    86
            MFY++NE  L A G+ LGT L  GD+++L+G+LGAGKTTL KGIAKG+ I QMIKSPTYT
Sbjct:   1  MFYSENEYTLKAYGETLGTYLSIGDVIVLSGDLGAGKTTLAKGIAKGMGISQMIKSPTYT    60

Query:  87  IVREYEGRVPLYHLDVYRIGDDPDSIDLDDFLFGQGVTVIEWGELLSDNLINNYLEIVIT   146
            IVREYEGR+PLYHLD+YR+GDDPDSIDLDDFLFG GVTVIEWGELL + L+ +YL+I IT
Sbjct:  61  IVREYEGRLPLYHLDIYRVGDDPDSIDLDDFLFGNGVTVIEWGELLGEGLLQDYLQITIT   120

Query: 147  RSNQGRQVQLEAYGHRAREIIE                                        168
            +  ++GRQ+ L A+G R+R+++E
Sbjct: 121  KRDKGRQLDLLAHGERSRQLLE                                        142
```

Based on this analysis, it was predicted that these proteins and their epitopes could be useful antigens for vaccines or diagnostics.

Example 1112

A DNA sequence (GBSx1187) was identified in *S. agalactiae* <SEQ ID 3439> which encodes the amino acid sequence <SEQ ID 3440>. Analysis of this protein sequence reveals the following:

Possible site: 58
>>> Seems to have no N-terminal signal sequence
----- Final Results -----
bacterial cytoplasm --- Certainty = 0.1782 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:AAD35662 GB:AE001732 conserved hypothetical protein [Thermotoga maritima]
Identities = 56/163 (34%), Positives = 94/163 (57%), Gaps = 1/163 (0%)
Query:  24  EASREEASAILEFLNTVTEETDFILHTVSNQLSLSEMETFIENTLMTKNCICLIAKLKNK    83
            EAS  +A  I+E+L  VT ETDF++        +S   +I         + ++ ++   +
Sbjct:  18  EASIWDARRIVEYLKEVTSETDFLITRPDEVYDVSTERNYIRMYRSNPGKLMIVGEINRE    77

Query:  84  VIGLITIISQSDIEIEHVGDLFIAVQKDYWGYGIGHILMEEAIEWASDNDITRRLELSVQ   143
            ++  L+T         +HVG++  I+V+K  YW   GIG  ++   AIEWA  N    R++L V
Sbjct:  78  IVSLLTFTGFGRKRTKHVGEIGISVEKRYWNIGIGTRMITSAIEWARRNGFI-RIQLEVL   136

Query: 144  GRNERAIHLYQKFGFEIDGLQTRGIKRENGEFLDIYRMSKLID                   186
             NERAI LY+K GFE++G++ + ++R++G F D+  M+ L+D
Sbjct: 137  KSNERAISLYRKLGFELEGIKRKAVRRDDGSFEDVLVMALLLD                   179
```

There is also homology to SEQ ID 1724.
Based on this analysis, it was predicted that this protein and its epitopes, could be useful antigens for vaccines or diagnostics.

Example 1113

A DNA sequence (GBSx1188) was identified in *S. agalactiae* <SEQ ID 3441> which encodes the amino acid sequence <SEQ ID 3442>. Analysis of this protein sequence reveals the following:

Possible site: 53
>>> Seems to have a cleavable N-term signal seq.
----- Final Results -----
bacterial outside --- Certainty = 0.3000 (Affirmative) <succ>
bacterial membrane --- Certainty = 0.0000 (Not Clear) <succ>
bacterial cytoplasm --- Certainty = 0.0000 (Not Clear) <succ>

The protein has homology with the following sequences in the GENPEPT database.

```
>GP:CAB15582 GB:Z99122 membrane-bound protein [Bacillus subtilis]
Identities = 108/324 (33%), Positives = 178/324 (54%), Gaps = 33/324 (10%)
Query:   5  KKITLMFSAIILTTVIALGV--YVASAYNFSTNELSKTFKDFKLAKS--KSHAIEETKPF    60
            KK TL+ + + +  ++ LG   Y      ++  + ++      +K    K  +I + PF
Sbjct:   8  KKKTLLLTILTIIGLLVLGTGGYAYYLWHKAASTVASIHESIDKSKKRDKEVSINKKDPF    67

Query:  61  SILLMGVDTGSEHRKSKWSGNSDSMILVTINPKTNKTTMTSLERDVLIKLSGPKNNGQTG   120
            S+L+MGVD       +      G +D++I +T+NPKTN T M S+ RD    K+ G        G
Sbjct:  68  SVLIMGVDERDGDK-----GRADTLIYMTVNPKTNTTDMVSIPRDTYTKIIGK------G   116

Query: 121  VEAKLNAAYASGGAEMALMTVQDLLDINVDYFMQINMQGLVDLVNAVGGITVTNKFDFPI   180
                K+N +YA GG +M + TV++ LD+ VDYF+++NM+     D+V+ +GGITV + F F
Sbjct: 117  TMDKINHSYAFGGTQMTVDTVENFLDVPVDYFVKVNMESFRDVVDTLGGITVNSTFAFSY   176

Query: 181  SIAANEPEYKAVVEPGTHKINGEQALVYSRMRYDDPEGDYGRQKRQREVIQKVLKKILAL   240
             +                G     +NG++AL Y+RM +DP GD+GRQ RQR+VIQ ++ K    +
Sbjct: 177  DGYS--------FGKGEITLNGKEALAYTRMRKEDPRGDFGRQDRQRQVIQGIINKGANI   228

Query: 241  NSISSYKKILSAVSNNMQTNIEISSKTIPNL----LAYKDSLEHIKSYQLKGEDATLSDG   296
            +SI+ +  +  V NN++TN+    T N+         YK + +HIK ++LKG  T   +G
Sbjct: 229  SSITKFGDMFKVVENNVKTNL-----TFDNMNDIQSDYKGARKHIKQHELKG-TGTKING   282
```

```
Query: 297  GSYQILTKKHLLAVQNRIKKELDK                                320
             Y   + L +   +K+ L+K
Sbjct: 283  IYYYQADESALSDITKELKESLEK                                306
```

A related DNA sequence was identified in *S. pyogenes* <SEQ ID 2763> which encodes the amino acid sequence <SEQ ID 2764>. Analysis of this protein sequence reveals the following:

---

Possible site: 33
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

---

An alignment of the GAS and GBS proteins is shown below.

```
Identities = 288/436 (66%), Positives = 342/436 (78%), Gaps = 22/436 (5%)
Query:   1  MKIWKKITLMFSAIILTTVIALGVYVASAYNFSTNELSKTFKDFKLAKSKSHAIEETKPF    60
            MKI KKI LMF+AI+LTTV+ALGVY+ SAY FST ELSKTFKDF  + +KS AI++T+ F
Sbjct:   1  MKIGKKIVLMFTAIVLTTVLALGVYLTSAYTFSTGELSKTFKDFSTSSNKSDAIKQTRAF    60

Query:  61  SILLMGVDTGSEHRKSKWSGNSDSMILVTINPKTNKTTMTSLERDVLIKLSGPKNNGQTG   120
            SILLMGVDTGS  R SKW GNSDSMILVT+NPKT KTTMTSLERD L  LSGPKNN   G
Sbjct:  61  SILLMGVDTGSSERASKWEGNSDSMILVTVNPKTKKTTMTSLERDTLTTLSGPKNNEMNG   120

Query: 121  VEAKLNANYASGGAEMALMTVQDLLDINVDYFMQINMQGLVDLVNAVGGITVTNKFDFPI   180
            VEAKLNAAYA+GGA+MA+MTVQDLL+I  +D  ++QINMQGL+DLVNAVGGITVTN+FDFPI
Sbjct: 121  VEAKLNAAYAAGGAQMAIMTVQDLLNITIDNYVQINMQGLIDLVNAVGGITVTNEFDFPI   180

Query: 181  SIAANEPEYKAVVEPGTHKINGEQALVYSRMRYDDPEGDYGRQKRQREVIQKVLKKILAL   240
            SIA NEPEY+A V PGTHKINGEQALVY+RMRYDDPEGDYGRQKRQREVIQKVLKKILAL
Sbjct: 181  SIAENEPEYQATVAPGTHKINGEQALVYARMRYDDPEGDYGRQKRQREVIQKVLKKILAL   240

Query: 241  NSISSYKKILSAVSNNMQTNIEISSKTIPNLLAYKDSLEHIKSYQLKGEDATLSDGGSYQ   300
            +SISSY+KILSAVS+NMQTNIEISS+TIP+LL  Y+D+L   IK+YQLKGEDATLSDGGSYQ
Sbjct: 241  DSISSYRKILSAVSSNMQTNIEISSRTIPSLLGYRDALRTIKTYQLKGEDATLSDGGSYQ   300

Query: 301  ILTKKHLLAVQNRIKKELDKKRSKTLKTSAILYEDYYGTTASNDSSTYSSTQENNYNTT-   359
            I+T  HLL +QNRI+ EL  +   LKT+A +YE+ YG     ST S T  NNY+++
Sbjct: 301  IVTSNHLLEIQNRIRTELGLHKVNQLKTNATVYENLYG-------STKSQTVNNNYDSSG   353

Query: 360  ---PYSEAPPSYSG-----NTTYSSETNQTTHQNYYNSSTPASNYSSNTNTGQADSSGSV   411
               YS++  SY+       +T  S+ T+Q +  + +  +TP+S+ S      ++ SSGS
Sbjct: 354  QAPSYSDSHSSYANYSSGVDTGQSASTDQDSTASSHRPATPSSS-SDALAADESSSSGS-   411

Query: 412  NNHNGAATPNPNTGTQ                                             427
                G+  P N   Q
Sbjct: 412  ----GSLVPPANINPQ                                             423
```

SEQ ID 3442 (GBS54) was expressed in *E. coli* as a His-fusion product. SDS-PAGE analysis of total cell extract is shown in FIG. 16 (lane 8; MW 48.4 kDa).

The GBS54-His fusion product was purified (FIG. 98A; see also FIG. 194, lane 6) and used to immunise mice (lane 1+2 product; 20 µg/mouse). The resulting antiserum was used for Western blot (FIG. 98B), FACS (FIG. 98C), and in the in vivo passive protection assay (Table III). These tests confirm that the protein is immunoaccessible on GBS and that it is an effective protective immunogen.

Based on this analysis, it was predicted that these proteins and their epitopes could be useful antigens for vaccines or diagnostics.

Example 1114

A DNA sequence (GBSx1189) was identified in *S. agalactiae* <SEQ ID 3443> which encodes the amino acid sequence <SEQ ID 3444>. This protein is predicted to be Vesl-1L. Analysis of this protein sequence reveals the following:

---

Possible site: 18
>>> Seems to have an uncleavable N-term signal seq
INTEGRAL      Likelihood = –1.44      Transmembrane 3-19 (3-19)
----- Final Results -----
   bacterial membrane --- Certainty = 0.1574 (Affirmative) <succ>
      bacterial outside --- Certainty = 0.0000 (Not Clear) <succ>
         bacterial cytoplasm --- Certainty = 0.0000 (Not Clear) <succ>

---

The protein has no significant homology with any sequences in the GENPEPT database.

A related DNA sequence was identified in *S. pyogenes* <SEQ ID 3445> which encodes the amino acid sequence <SEQ ID 3446>. Analysis of this protein sequence reveals the following:

---

Possible site: 15
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

---

The protein has no significant homology with any sequences in the GENPEPT database.

An alignment of the GAS and GBS proteins is shown below.

```
Identities = 42/98 (42%), Positives = 64/98 (64%)
Query:   1   MKIGRLIALGLVSLGALELYKNRKTIKDSYQNTKNETDSAKLKLERIKNDLAIISQEKEK   60
             MK+  +IA+GL+S A   + Y+ R TIK+     ++    D+A+L L+ IK +L +I  + +
Sbjct:   1   MKVKTVIAVGLLSFTAYKAYQKRCTIKELLSISRQAKDAAQLDLDNIKANLDLIHSQGKV   60

Query:  61   IRLISQELNHKFQVFNKDIQPRLEEINQRMAKYQEKDE                         98
             I+ ISQ+L HK++ FN++ Q  L EI  RMAKYQE  E
Sbjct:  61   IQNISQDLAHKWRYFNQETQAHLTEIQNRMAKYQEDSE                         98
```

Based on this analysis, it was predicted that these proteins and their epitopes could be useful antigens for vaccines or diagnostics.

Example 1115

A DNA sequence (GBSx1190) was identified in *S. agalactiae* <SEQ ID 3447> which encodes the amino acid sequence <SEQ ID 3448>. This protein is predicted to be Hit-like protein involved in cell-cycle regulation (hit). Analysis of this protein sequence reveals the following:

Possible site: 37
>>> Seems to have no N-terminal signal sequence
----- Final Results -----
   bacterial cytoplasm --- Certainty = 0.2694 (Affirmative) <succ>
      bacterial membrane --- Certainty = 0.0000 (Not Clear) <succ>
         bacterial outside --- Certainty = 0.0000 (Not Clear) <succ>

The protein has homology with the following sequences in the GENPEPT database.

A related DNA sequence was identified in *S. pyogenes* <SEQ ID 3449> which encodes the amino acid sequence <SEQ ID 3450>. Analysis of this protein sequence reveals the following:

Possible site: 37
>>> Seems to have no N-terminal signal sequence
----- Final Results -----
   bacterial cytoplasm --- Certainty = 0.0125 (Affirmative) <succ>
      bacterial membrane --- Certainty = 0.0000 (Not Clear) <succ>
         bacterial outside --- Certainty = 0.0000 (Not Clear) <succ>

```
>GP:BAB04908 GB:AP001511 Hit-like protein involved in cell-cycle
regulation [Bacillus halodurans]
Identities = 74/137 (54%), Positives = 95/137 (69%), Gaps = 2/137 (1%)
Query:   3   NCIFCKIISGEIPSSKVYEDDEVLAFLDITQTTTGHTLLIPKKHVRNVLEMDEKTAQITF    62
             NCIFCKII+GEIPS+ VYEDD V AFLDI+Q T GHTL+IPK H RNV E+ E+ A    F
Sbjct:   6   NCIFCKIIAGEIPSATVYEDDHVYAFLDISQVTKGHTLVIPKVHKRNVFELSEEIASSLF    65

Query:  63   ERLPKVARAVQAATKAKGMNIINNNEEIAGQTVFHAHVHLVPRFDESDGIKIHYTTHEPD   122
               +PK++RA+  A  +   GMNI+NNN E AGQTVFH H+HL+PR+ E DG     + H
Sbjct:  66   AAVPKISRAINDAFQPIGMNIVNNNGEAAGQTVFHYHLHLLPRYGEGDGYGAVWKDHSSQ   125

Query: 123   F--EALAKLAKEIRKEI                                             137
             +   + L  L+   IR+ +
Sbjct: 126   YSGDDLQVLSSSIREHL                                             142
```

An alignment of the GAS and GBS proteins is shown below.

```
Identities = 97/137 (70%), Positives = 117/137 (84%)

Query:   1   MDNCIFCKIISGEIPSSKVYEDDEVLAFLDITQTTTGHTLLIPKKHVRNVLEMDEKTAQI    60
             M+NCIFC II G+IPSSKVYED++VLAFLDI+QTT GHTL+IPK+HVRN+LEM  +TA
Sbjct:   1   MENCIFCSIIQGDIPSSKVYEDEQVLAFLDISQTTKGHTLVIPKQHVRNLLEMTAETASH    60

Query:  61   TFERLPKVARAVQAATKAKGMNIINNNEEIAGQTVFHAHVHLVPRFDESDGIKIHYTTHE   120
                F R+PK+ARA+Q+AT A  MNIINNNE +AGQTVFHAHVHLVPR++E DGI I YTTHE
Sbjct:  61   LFARIPKIARAIQSATGATAMNIINNNEALAGQTVFHAHVHLVPRYNEEDGISIQYTTHE   120

Query: 121   PDFEALAKLAKEIRKEI                                             137
             PDF  L  KLA++I +E+
Sbjct: 121   PDFPVLEKLARQINQEV                                             137
```

Based on this analysis, it was predicted that these proteins and their epitopes could be useful antigens for vaccines or diagnostics.

Example 1116

A DNA sequence (GBSx1191) was identified in *S. agalactiae* <SEQ ID 3451> which encodes the amino acid sequence <SEQ ID 3452>. Analysis of this protein sequence reveals the following:

Possible site: 36
>>> Seems to have a cleavable N-term signal seq.
----- Final Results -----
  bacterial outside --- Certainty = 0.3000 (Affirmative) <succ>
    bacterial membrane --- Certainty = 0.0000 (Not Clear) <succ>
      bacterial cytoplasm --- Certainty = 0.0000 (Not Clear) <succ>

Possible site: 45
>>> Seems to have no N-terminal signal sequence
INTEGRAL    Likelihood = −6.53    Transmembrane 143-159 (141-161)
----- Final Results -----
  bacterial membrane --- Certainty = 0.3612 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 9563> which encodes amino acid sequence <SEQ ID 9564> was also identified.

The protein has homology with the following sequences in the GENPEPT database.

```
>GP:CAB12844 GB:Z99109 ABC transporter (ATP-binding protein)
[Bacillus subtilis]
Identities = 137/242 (56%), Positives = 181/242 (74%)
Query:   1  MTMLKIENVTGGYVNIPVLKNISFEVNDGELVGLIGLNGAGKSTTINEIIGILRPYQGDI   60
            M++L ++++TGGY    PVLKN+SF +   ++VGLIGLNGAGKSTTI  IIG++ P++G I
Sbjct:   1  MSLLSVKDLTGGYTRNPVLKNVSFTLEPNQIVGLIGLNGAGKSTTIRHIIGLMDPHKGSI   60

Query:  61  TIDGISLEADQELYRKKIGFIPETPSLYEELTLREHLETVAMAYDIATDEVMARAQKLLE  120
            ++G +   D E YR +  +IPETP LYEELTL EHLE  AMAY ++ + +  R    LL+
Sbjct:  61  ELNGKTFAEDPEGYRSQFTYIPETPVLYEELTLMEHLELTAMAYGLSKETMEKRLPPLLK  120

Query: 121  MFRLTDKLDWFPMHFSKGMKQKVMIICAFVVSPSLFIVDEPFLGLDPLAISDLINLLAEE  180
            FR+  +L WFP HFSKGMKQKVMI+CAF+  P+L+I+DEPFLGLDPLAI+ L+  + E
Sbjct: 121  EFRMEKRLKWFPAHFSKGMKQKVMIMCAFLAEPALYIIDEPFLGLDPLAINALLERMNEA  180

Query: 181  KAKGKSILMSTHVLDSAEKMCDRFVILHKGEIRAVGTLEELRAIFGDSNANLNDIYIALT  240
            K   G S+LMSTH+L  +AE+ CD F+ILH GE+RA GTL ELR   FG   +A L+D+Y+ LT
Sbjct: 181  KKGGASVLMSTHILATAERYCDSFIILHNGEVRARGTLSELREQFGMKDAALDDLYLELT  240

Query: 241  KE                                                            242
            KE
Sbjct: 241  KE                                                            242
```

A related GBS nucleic acid sequence <SEQ ID 10923> which encodes amino acid sequence <SEQ ID 10924> was also identified.

The protein has no significant homology with any sequences in the GENPEPT database.

No corresponding DNA sequence was identified in *S. pyogenes*.

Figure 8:
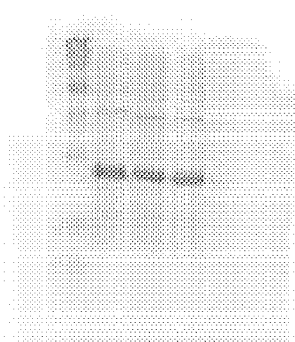

SEQ ID 3452 (GBS87) was expressed in *E. coli* as a His-fusion product. SDS-PAGE analysis of total cell extract is shown in FIG. 8 (lane 3; MW 19.5 kDa). It was also expressed in *E. coli* as a GST-fusion product. SDS-PAGE analysis of total cell extract is shown in FIG. 15 (lane 10; MW 44 kDa).

Based on this analysis, it was predicted that these proteins and their epitopes could be useful antigens for vaccines or diagnostics.

Example 1117

A DNA sequence (GBSx1192) was identified in *S. agalactiae* <SEQ ID 3453> which encodes the amino acid sequence <SEQ ID 3454>. This protein is predicted to be ABC transporter, ATP-binding protein. Analysis of this protein sequence reveals the following:

A related DNA sequence was identified in *S. pyogenes* <SEQ ID 3455> which encodes the amino acid sequence <SEQ ID 3456>. Analysis of this protein sequence reveals the following:

Possible site: 43
>>> Seems to have no N-terminal signal sequence
INTEGRAL    Likelihood = −5.04    Transmembrane 141-157 (139-158)
----- Final Results -----
  bacterialmembrane --- Certainty = 0.3017 (Affirmative) <succ>
    bacterialoutside --- Certainty = 0.0000 (Not Clear) <succ>
      bacterial cytoplasm --- Certainty = 0.0000 (Not Clear) <succ>

The protein has homology with the following sequences in the databases:

```
>GP:CAB12844 GB:Z99109 ABC transporter (ATP-binding protein)
[Bacillus subtilis]
Identities = 139/241 (57%), Positives = 189/241 (77%)
Query:   1  MLNIKNLTGGYHNIPVLNDVSFSVDNGELVGLIGLNGAGKSTTINEIIGFLKPYQGSISI   60
            +L++K+LTGGY   PVL +VSF+++  ++VGLIGLNGAGKSTTI  IIG + P++GSI +
Sbjct:   3  LLSVKDLTGGYTRNPVLKNVSFTLEPNQIVGLIGLNGAGKSTTIRHIIGLMDPHKGSIEL  62

Query:  61  DGLTLAENAVAYRQKIGFIPETPSLYEELTLSEHINTVAMAYDIDLEVAQKRAQPFLEMF  120
            +G T AE+   YR +  +IPETP LYEELTL EH+    AMAY +  E  +KR  P L+ F
Sbjct:  63  NGKTFAEDPEGYRSQFTYIPETPVLYEELTLMEHLELTAMAYGLSKETMEKRLPPLLKEF  122

Query: 121  RLTDKLEWFPVNFSKGMKQKVMIICAFVIDPSLFILDEPFLGLDPLAISDLIQTLEVEKA  180
            R+   +L+WFP  +FSKGMKQKVMI+CAF+  +P+L+I+DEPFLGLDPLAI+ L++  +       K
Sbjct: 123  RMEKRLKWFPAHFSKGMKQKVMIMCAFLAEPALYIIDEPFLGLDPLAINALLERMNEAKK  182

Query: 181  KGKSILMSTHVLDSAERMCDRFVILHHGQVRAQGTLADLQEAFGDRSASLNDIYLALTKED  241
             G S+LMSTH+L +AER CD F+ILH+G+VRA+GTL++L+E FG + A+L+D+YL LTKED
Sbjct: 183  GGASVLMSTHILATAERYCDSFIILHNGEVRARGTLSELREQFGMKDAALDDLYLELTKED  243
```

An alignment of the GAS and GBS proteins is shown below.

```
Identities = 181/240 (75%), Positives = 208/240 (86%)
Query:   3  MLKIENVTGGYVNIPVLKNISFEVNDGELVGLIGLNGAGKSTTINEIIGILRPYQGDITI   62
            ML I+N+TGGY NIPVL ++SF V++GELVGLIGLNGAGKSTTINEIIG L+PYQG I+I
Sbjct:   1  MLNIKNLTGGYHNIPVLNDVSFSVDNGELVGLIGLNGAGKSTTINEIIGFLKPYQGSISI   60

Query:  63  DGISLEADQELYRKKIGFIPETPSLYEELTLREHLETVAMAYDIATDEVMARAQKLLEMF  122
            DG++L +    YR+KIGFIPETPSLYEELTL EH+ TVAMAYDI +    RAQ  LEMF
Sbjct:  61  DGLTLAENAVAYRQKIGFIPETPSLYEELTLSEHINTVAMAYDIDLEVAQKRAQPFLEMF  120

Query: 123  RLTDKLDWFPMHFSKGMKQKVMIICAFVVSPSLFIVDEPFLGLDPLAISDLINLLAEEKA  182
            RLTDKL+WFP++FSKGMKQKVMIICAFV+ PSLFI+DEPFLGLDPLAISDLI  L   EKA
Sbjct: 121  RLTDKLEWFPVNFSKGMKQKVMIICAFVIDPSLFILDEPFLGLDPLAISDLIQTLEVEKA  180

Query: 183  KGKSILMSTHVLDSAEKMCDRFVILHKGEIRAVGTLEELRAIFGDSNANLNDIYIALTKE  242
            KGKSILMSTHVLDSAE+MCDRFVILH G++RA GTL +L+  FGD +A+LNDIY+ALTKE
Sbjct: 181  KGKSILMSTHVLDSAERMCDRFVILHHGQVRAQGTLADLQEAFGDRSASLNDIYLALTKE  240
```

SEQ ID 3454 (GBS353) was expressed in *E. coli* as a His-fusion product. SDS-PAGE analysis of total cell extract is shown in FIG. 74 (lane 2; MW 30 kDa). It was also expressed in *E. coli* as a GST-fusion product. SDS-PAGE analysis of total cell extract is shown in FIG. 81 (lane 6; MW 55 kDa).

GBS353-GST was purified as shown in FIG. 216, lane 5.

Based on this analysis, it was predicted that these proteins and their epitopes could be useful antigens for vaccines or diagnostics.

Example 1118

A DNA sequence (GBSx1193) was identified in *S. agalactiae* <SEQ ID 3457> which encodes the amino acid sequence <SEQ ID 3458>. Analysis of this protein sequence reveals the following:

Possible site: 28
>>> Seems to have no N-terminal signal sequence
----- Final Results -----
  bacterial cytoplasm --- Certainty = 0.1475 (Affirmative) <succ>
  bacterial membrane --- Certainty = 0.0000 (Not Clear) <succ>
  bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1119

A DNA sequence (GBSx1194) was identified in *S. agalactiae* <SEQ ID 3459> which encodes the amino acid sequence <SEQ ID 3460>. Analysis of this protein sequence reveals the following:

Possible site: 44
>>> Seems to have no N-terminal signal sequence
INTEGRAL   Likelihood = −12.68   Transmembrane 57-73 (50-80)
INTEGRAL   Likelihood = −8.49    Transmembrane 122-138 (103-152)
INTEGRAL   Likelihood = −6.58    Transmembrane 319-335 (308-337)
INTEGRAL   Likelihood = −4.99    Transmembrane 252-268 (249-273)
INTEGRAL   Likelihood = −4.19    Transmembrane 104-120 (103-121)
INTEGRAL   Likelihood = −3.50    Transmembrane 231-247 (229-248)
INTEGRAL   Likelihood = −1.91    Transmembrane 298-314 (298-314)
INTEGRAL   Likelihood = −1.44    Transmembrane 28-44 (27-44)
----- Final Results -----
  bacterial membrane --- Certainty = 0.6074 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

```
>GP:CAB12845 GB:Z99109 ABC transporter (membrane protein) [Bacillus subtilis]
Identities = 101/409 (24%), Positives = 187/409 (45%), Gaps = 76/409 (18%)
Query:   1 MKKLFNKRRSLFLTQNSKYLRYVFNDHFVLVLMPLSGFLLYQYSQLLKDFPKTHWPIIVI     60
             M  ++  R    + +     Y++Y+ NDH V+VL+F        YS+ ++D P  H+P   +
Sbjct:   4 MLDIWQSRLQEHIKETRTYMKYMLNDHLVIVLIFFLAGAASWYSKWIRDIP-AHFPSFWV    62

Query:  61 VSIIILMLLAMGGIASYLEPADKQFLLIKEEAIKEIINSAKKRTYI--------------   106
             ++++ ++L    + + L+  AD    FLL  E ++   +  A      +Y+
Sbjct:  63 MAVLFSLVLTSSYVRTLLKEADLVFLLPLEAKMEPYLKQAFVYSYVSQLFPLIALSIVAM   122

Query: 107 --FWLVIQTLFLVLISPILIKLGL------------------------------------   128
               ++ V       LV + +  ++L L
Sbjct: 123 PLYFAVTPGASLVSYAAVFVQLLLLKAWNQVMEWRTTFQNDRSMKRMDVIIRFAANTLVL   182

Query: 129 -----SVFMITLLIFGLGIIKWLVITYKVKVFYNNQNLNWDAAINHEQERKQSILKFFSL   183
                  SV+M  LL++ +   + +L ++    K    +    W++ I  E  RKQ    + +L
Sbjct: 183 YFVFQSVYMYALLVYVIMAVLYLYMSSAAK----RKTFKWESHIESELRRKQRFYRIANL   238

Query: 184 FTNVKGISTSVKRRSFLDGILKLISKTPSRLWTNLFVRAFLRSSDYLGLTIRLVTLNILS   243
             FT+V +     KRR++LD +L+L+      + +  +F RAFLRSSDYLG+  +RL    + L
Sbjct: 239 FTDVPHLRKQAKRRAYLDFLLRLVPFEQRKTFAYMFTRAFLRSSDYLGILVRLTIVFALI   298

Query: 244 VIFVNETYLALALAFVFN-YLLLFQLLALGHHFDYQYMNQLYPVRLNAKASQLKGFLRVL   302
             +++V+ + L  A+   VF  ++    QLL L  HFD+   + +LYPV+    K ++LK+   +L
Sbjct: 299 IMYVSASPLIAAVLTVFAIFITGIQLLPLFGHFDHLALQELYPVQ---KETKLKSYFSLL   355

Query: 303 SYAVTVIDSI----------LIRELKPVILLIVLMLIVTEYYIPYKIKK             341
             A+++   +                L      L  +I    VL+ +V   Y+  ++KK
Sbjct: 356 KTALSIQALLMSVASAYAAGLTGFLYALIGSAVLIFVVLPAYMTTRLKK              404
```

A related DNA sequence was identified in *S. pyogenes* <SEQ ID 3461> which encodes the amino acid sequence <SEQ ID 3462>. Analysis of this protein sequence reveals the following:

Possible site: 44
>>> Seems to have no N-terminal signal sequence
INTEGRAL   Likelihood = –14.91   Transmembrane 126-142 (119-151)
INTEGRAL   Likelihood = –9.77    Transmembrane 320-336 (311-339)
INTEGRAL   Likelihood = –6.37    Transmembrane 59-75 (53-79)
INTEGRAL   Likelihood = –4.94    Transmembrane 28-44 (22-47)

-continued

INTEGRAL   Likelihood = –4.73    Transmembrane 250-266 (249-273)
INTEGRAL   Likelihood = –4.04    Transmembrane 231-247 (229-248)
INTEGRAL   Likelihood = –3.19    Transmembrane 298-314 (295-315)
INTEGRAL   Likelihood = –2.28    Transmembrane 103-119 (103-119)
----- Final Results -----
  bacterial membrane --- Certainty = 0.6965 (Affirmative) <succ>
  bacterial outside  --- Certainty = 0.0000 (Not Clear) <succ>
  bacterial cytoplasm --- Certainty = 0.0000 (Not Clear) <succ>

The protein has homology with the following sequences in the databases:

```
>GP:CAB12845 GB:Z99109 ABC transporter (membrane protein) [Bacillus subtilis]
Identities = 96/403 (23%), Positives = 173/403 (42%), Gaps = 78/403 (19%)
Query:   1 MKALFLKRRQDFQKQQNKYLRYVLNDHFVLVLMFLLGFAMVQYGQLLN----HFPT----    52
             M  ++   R Q+   K+     Y++Y+LNDH V+VL+F L A    Y + +         HFP+
Sbjct:   4 MLDIWQSRLQEHIKETRTYMKYMLNDHLVIVLIFFLAGAASWYSKWIRDIPAHFPSFWVM    63

Query:  53 --------------NHLPIQVCLGILIPLLLSM---------------------------    71
                            L +  L +PL        M
Sbjct:  64 AVLFSLVLTSSYVRTLLKEADLVFLLPLEAKMEPYLKQAFVYSYVSQLFPLIALSIVAMP   123

Query:  72 --------GSIATYLEEADQHFLLPKEEEVISYI------KQAERLSFLLWGTLQTAVLL   117
                     S+ +Y     Q  LL    +V+          + +R+ ++         T VL
Sbjct: 124 LYFAVTPGASLVSYAAVFVQLLLLKAWNQVMEWRTTFQNDRSMKRMDVIIRFAANTLVLY   183

Query: 118 FLYPIFRRLGLSLFIFIILVLILLALKRVVLSRKTRYFLRGNRLDWAKAVAFESNRKQSI   177
             F++             S++++ +LV +++A+   +  +S  +              W    +  E  RKQ
Sbjct: 184 FVFQ-------SVYNYALLVYVIMAVLYLYMSSAAKR----KTFKWESHIESELRRKQRF   232

Query: 178 LKFYSLFTTVKGISTKVKERTYLNPLLKLVKQTPSNLWLSLYARAFLRSSDYLGLFLRLM   237
             +    +LFT V  +   + +   K R YL+   LL+LV          +  ++ RAFLRSSDYLG+ +RL
Sbjct: 233 YRIANLFTDVPHLRKQAKRRAYLDFLLRLVPFEQRKTFAYMFTRAFLRSSDYLGILVRLT   292

Query: 238 LLSSLSVFFIHNLYLSVSLALIFN-YLVVFQLLSLYYHYDYHYMTSLYPENSRSKKKNML   296
             ++  +L  +  ++      L  ++  +F  ++      QLL L+ H+D+   +    LYP    +K K+
Sbjct: 293 IVFALIIMYVSASPLIAAVLTVFAIFITGIQLLPLFGHFDHLALQELYPVQKETKLKSYF   352

Query: 297 SFLR-GLSFLMLIVNMLCCSSAPKA--LILIVGMVFIACIYLP                   336
             S L+   LS    L++++       +A      L  ++G     +  + LP
Sbjct: 353 SLLKTALSIQALLMSVASAYAAGLTGFLYALIGSAVLIFVVLP                   395
```

An alignment of the GAS and GBS proteins is shown below.

```
Identities = 170/344 (49%), Positives = 237/344 (68%)
Query:   1  MKKLFNKRRSLFLTQNSKYLRYVFNDHFVLVLMFLSGFLLYQSQLLKDFPKTHWPIIVI      60
            MK LF KRR  F  Q +KYLRYV NDHFVLVLMFL GF + QY QLL  FP  H PI V
Sbjct:   1  MKALFLKRRQDFQKQQNKYLRYVLNDHFVLVLMPLLGFAMVQYGQLLNHFPTNHLPIQVC      60

Query:  61  VSIIILMLLAMGGIASYLEPADKQFLLIKEEAIKEIINSAKKRTYIFWLVIQTLFLVLIS     120
            + I+I +LL+MG IA+YLE AD+ FLL KEE +   I   A++ +++ W   +QT  L+ +
Sbjct:  61  LGILIPLLLSMGSIATYLEEADQHFLLPKEEEVISYIKQAERLSFLLWGTLQTAVLLFLY     120

Query: 121  PILIKLGLSVFMITLLIFGLGIIKWLVITYKVKVFYNNQNLNWDAAINHEQERKQSILKF     180
            PI +LGLS+F+       +L+   L   +K +V++ K  + F         L+W  A+     E  RKQSILKF
Sbjct: 121  PIFRRLGLSLFIFIILVLILLALKRVVLSRKTRYFLRGNRLDWAKAVAFESNRKQSILKF     180

Query: 181  FSLFTNVKGISTSVKRRSFLDGILKLISKTPSRLWTNLFVRAFLRSSDYLGLTIRLVTLN     240
            +SLFT VKGIST VK R++L+ +LKL+ +TPS LW +L+ RAFLRSSDYLGL +RL+ L+
Sbjct: 181  YSLFTTVKGISTKVKERTYLNPLLKLVKQTPSNLWLSLYARAFLRSSDYLGLFLRLMLLS     240

Query: 241  ILSVIFVNETYLALALAFVFNYLLLFQLLALGHHFDYQYMNQLYPVRLNAKASQLKGFLR     300
              LSV F++  YL+++LA +FNYL++FQLL+L +H+DY YM  LYP    +K   +  FLR
Sbjct: 241  SLSVFFIHNLYLSVSLALIFNYLVVFQLLSLYYHYDYHYMTSLYPENSRSKKKNMLSFLR     300

Query: 301  VLSYAVTVIDSILIRELKPVILLIVLMLIVTEYYIPYKIKKMID                   344
              LS+ +  +++ +          ++LIV M+ +     Y+PYK+KK+ID
Sbjct: 301  GLSFLMLIVNMLCCSSAPKALILIVGMVFIACIYLPYKLKKIID                   344
```

Based on this analysis, it was predicted that these proteins and their epitopes could be useful antigens for vaccines or diagnostics.

Example 1120

A DNA sequence (GBSx1195) was identified in *S. agalactiae* <SEQ ID 3463> which encodes the amino acid sequence <SEQ ID 3464>. Analysis of this protein sequence reveals the following:

---

Possible site: 45
>>> Seems to have no N-terminal signal sequence
----- Final Results -----
   bacterial cytoplasm --- Certainty = 0.2821 (Affirmative) <succ>
     bacterial membrane --- Certainty = 0.0000 (Not Clear) <succ>
      bacterial outside --- Certainty = 0.0000 (Not Clear) <succ>

---

The protein has homology with the following sequences in the GENPEPT database.

A related DNA sequence was identified in *S. pyogenes* <SEQ ID 3465> which encodes the amino acid sequence <SEQ ID 3466>. Analysis of this protein sequence reveals the following:

---

Possible site: 45
>>> Seems to have no N-terminal signal sequence
----- Final Results -----
   bacterial cytoplasm --- Certainty = 0.2686 (Affirmative) <succ>
     bacterial membrane --- Certainty = 0.0000 (Not Clear) <succ>
      bacterial outside --- Certainty = 0.0000 (Not Clear) <succ>

---

An alignment of the GAS and GBS proteins is shown below.

```
>GP:AAC00284 GB:AF008220 YtmP [Bacillus subtilis]

Identities = 69/214 (32%), Positives = 121/214 (56%), Gaps = 1/214 (0%)

Query:  12  PLRGKSGKAYIGTYPNGERVFVKYNTTPILPALAKEQIAPQLLWARRTSNGDMMSAQEWL      71
            P  G +G AY    + NG+++F+K N++P L  L+ E I P+L+W +R  NGD+++AQ W+
Sbjct:  20  PAGGATGDAYYAKH-NGQQLFLKRNSSPFLAVLSAEGIVPKLVWTKRMENGDVITAQHWM      78

Query:  72  DGRTLTKEDMGSKQIIHILLRLHKSRPLVNQLLQLGYKIENPYDLLMDWEKQTPIQIREN     131
            +GR L  +DM + +  +L ++H S+ L++  L +LG +  NP LL       ++    + +
Sbjct:  79  TGRELKPKDMSGRPVAELLRKIHTSKALLDMLKRLGKEPLNPGALLSQLKQAVFAVQQSS     138

Query: 132  TYLQSIVTELKRSLPEFRTEVATIVHGDIKHSNWVITTSGLIYLVDWDSVRLTDRMYDVA     191
            +  +Q  + L+  L E      + H D+ H+NW+++       +YL+DWD      + D    D+
Sbjct: 139  PLIQEGIKYLEEHLHEVHFGEKVVCHCDVNHNNWLLSEDNQLYLIDWDGAMIADPAMDLG     198

Query: 192  YILSHYIPQKHWKDWLSYYGYKDNEKVWSKIIWY                             225
            +L HY+ +   W+ WLS YG + E +  ++ WY
Sbjct: 199  PLLYHYVEKPAWESWLSMYGIELTESLRLRMAWY                             232
```

```
Identities = 214/262 (81%), Positives = 242/262 (91%)
Query:   1  MTISNQELTLTPLRGKSGKAYIGTYPNGERVFVKYNTTPILPALAKEQIAPQLLWARRTS    60
            +T + QELTLTPLRGKSGKAY GTYPNGE VF+K NTTPILPALAKEQIAPQLLWA+R
Sbjct:   1  VTTTEQELTLTPLRGKSGKAYKGTYPNGECVFIKLNTTPILPALAKEQIAPQLLWAKRMG    60

Query:  61  NGDMMSAQEWLDGRTLTKEDMGSKQIIHILLRLHKSRPLVNQLLQLGYKIENPYDLLMDW   120
            NGDMMSAQEWL+GRTLTKEDM SKQIIHILLRLHKS+ LVNQLLQL YKIENPYDLL+D+
Sbjct:  61  NGDMMSAQEWLNGRTLTKEDMNSKQIIHILLRLHKSKKLVNQLLQLNYKIENPYDLLVDF   120

Query: 121  EKQTPIQIRENTYLQSIVTELKRSLPEFRTEVATIVHGDIKHSNWVITTSGLIYLVDWDS   180
            E+  P+QI++N+YLQ+IV ELKRSLPEF++EVATIVHGDIKHSNWVITTSG+I+LVDWDS
Sbjct: 121  EQNAPLQIQQNSYLQAIVKELKRSLPEFKSEVATIVHGDIKHSNWVITTSGMIFLVDWDS   180

Query: 181  VRLTDRMYDVAYILSHYIPQKHWKDWLSYYGYKDNEKVWSKIIWYGQFSYLSQIIKCFDK   240
            VRLTDRMYDVAY+LSHYIP+  W +WLSYYGYK+N+KV  KIIWYGQFS+L+QI+KCFDK
Sbjct: 181  VRLTDRMYDVAYLLSHYIPRSRWSEWLSYYGYKNNDKVMQKIIWYGQFSHLTQILKCFDK   240

Query: 241  RDMEHVNQEIYELRKFRELIKK                                        262
            RDMEHVNQEIY LRKFRE+ +K
Sbjct: 241  RDMEHVNQEIYALRKFREIFRK                                        262
```

Based on this analysis, it was predicted that these proteins and their epitopes could be useful antigens for vaccines or diagnostics.

Example 1121

A DNA sequence (GBSx1196) was identified in *S. agalactiae* <SEQ ID 3467> which encodes the amino acid sequence <SEQ ID 3468>. Analysis of this protein sequence reveals the following:

Possible site: 51
>>> Seems to have no N-terminal signal sequence
----- Final Results -----
   bacterial cytoplasm --- Certainty = 0.4529 (Affirmative) <succ>
     bacterial membrane --- Certainty = 0.0000 (Not Clear) <succ>
      bacterial outside --- Certainty = 0.0000 (Not Clear) <succ>

A related DNA sequence was identified in *S. pyogenes* <SEQ ID 3469> which encodes the amino acid sequence <SEQ ID 3470>. Analysis of this protein sequence reveals the following:

Possible site: 29
>>> Seems to have no N-terminal signal sequence
----- Final Results -----
   bacterial cytoplasm --- Certainty = 0.3303 (Affirmative) <succ>
     bacterial membrane --- Certainty = 0.0000 (Not Clear) <succ>
      bacterial outside --- Certainty = 0.0000 (Not Clear) <succ>

The protein has homology with the following sequences in the GENPEPT database.

An alignment of the GAS and GBS proteins is shown below.

```
>GP:AAC00285 GB:AF008220 YtmQ [Bacillus subtilis]
Identities = 126/211 (59%), Positives = 161/211 (75%)

Query:   1  MRVRKRKGAEEHLENNPHYVISNPEEAKGRWHEIFGNNNPIHIEVGSGKGAFITGMAEQN    60
            MR+R +  A++ L  N    ISNP + KG+W+  +FGN+NPIHIEVG+GKG FI+GMA+QN
Sbjct:   1  MRMRHKPWADDFLAENADIAISNPADYKGKWNTVFGNDNPIHIEVGTGKGQFISGMAKQN    60

Query:  61  PDINYIGIDIQLSVLSYALDKVLDSGAKNIKLLLVDGSSLSNYFDTGEVDLMYLNFSDPW   120
            PDINYIGI++   SV+  A+ KV DS A+N+KLL  +D  +L++ F+ GEV  +YLNFSDPW
Sbjct:  61  PDINYIGIELFKSVIVTAVQKVEDSEAQNVKLLNIDADTLTDVFEPGEVKRVYLNFSDPW   120

Query: 121  PKKKHEKRRLTYKTFLDTYKDILPEQGEIHFKTDNRGLFEYSLASFSQYGMTLKQVWLDL   180
            PKK+HEKRRLTY   FL  Y++++ + G IHFKTDNRGLFEYSL SFS+YG+ L  V LDL
Sbjct: 121  PKKRHEKRRLTYSHFLKKYEEVMGKGGSIHFKTDNRGLFEYSLKSFSEYGLLLTYVSLDL   180

Query: 181  HASDYQQNIMTEYERKFSNKGQVIYRVEARF                              211
            H S+ + NIMTEYE KFS  GQ IYR E +
Sbjct: 181  HNSNLEGNIMTEYEEKFSALGQPIYRAEVEW                              211
```

```
Identities = 179/211 (84%), Positives = 193/211 (90%)
Query:   1  MRVRKRKGAEEHLENNPHYVISNPEEAKGRWHEIFGNNNPIHIEVGSGKGAFITGMAEQN    60
            MRVRKRKGAEEHL NNPHYVI NPE+AKGRWH++FGN+ PIHIEVGSGKG FITGMA +N
Sbjct:   1  MRVRKRKGAEEHLANNPHYVILNPEDAKGRWHDVFGNDRPIHIEVGSGKGGFITGMALKN    60

Query:  61  PDINYIGIDIQLSVLSYALDKVLDSGAKNIKLLLVDGSSLSNYFDTGEVDLMYLNFSDPW   120
            PDINYIGIDIQLSVLSYALDKVL S   N+KLL VDGSSL+NYF+ GEVD+MYLNFSDPW
Sbjct:  61  PDINYIGIDIQLSVLSYALDKVLASEVPNVKLLRVDGSSLTNYFEDGEVDMMYLNFSDPW   120

Query: 121  PKKKHEKRRLTYKTFLDTYKDILPEQGEIHFKTDNRGLFEYSLASFSQYGMTLKQVWLDL   180
            PK KHEKRRLTYK FLDTYK ILPE GEIHFKTDNRGLFEYSLASFSQYGMTL+Q+WLDL
Sbjct: 121  PKTKHEKRRLTYKDFLDTYKRILPEHGEIHFKTDNRGLFEYSLASFSQYGMTLRQIWLDL   180

Query: 181  HASDYQQNIMTEYERKFSNKGQVIYRVEARF                               211
            HAS+Y+ N+MTEYE KFSNKGQVIYRVEA F
Sbjct: 181  HASNYEGNVMTEYEEKFSNKGQVIYRVEANF                               211
```

Based on this analysis, it was predicted that these proteins and their epitopes could be useful antigens for vaccines or diagnostics.

Example 1122

A DNA sequence (GBSx1197) was identified in *S. agalactiae* <SEQ ID 3471> which encodes the amino acid sequence <SEQ ID 3472>. Analysis of this protein sequence reveals the following:

Possible site: 35
>>> Seems to have no N-terminal signal sequence
----- Final Results -----
 bacterial cytoplasm --- Certainty = 0.1311 (Affirmative) <succ>
 bacterial membrane --- Certainty = 0.0000 (Not Clear) <succ>
 bacterial outside --- Certainty = 0.0000 (Not Clear) <succ>

The protein has homology with the following sequences in the GENPEPT database.

```
>GP:BAB06136 GB:AP001515 unknown conserved protein [Bacillus halodurans]
Identities = 61/124 (49%), Positives = 81/124 (65%), Gaps = 2/124 (1%)
Query:   2  GGDYVLSILIDKPGGITVEDTAQLTDVVSPLLDTIQPDPFPEQYMLEVSSPGLERPLKTA    61
            G D+ L + ID   G+ +ED   ++++ +S   LD   + DP  + Y LEVSSPG ERPLK
Sbjct:  33  GKDWFLRVFIDSETGVDLEDCGKVSERLSEKLD--ETDPIEQAYFLEVSSPGAERPLKRE    90

Query:  62  EALSNAVGSYINVSLYKSIDKVKIFEGDLLSFDGETLTIDYMDKTRHKTVDIPYQTVAKA   121
            + L  ++G  ++V+LY+ ID K  EG+L  FDGETLTI+   KTR KTV IPY  VA A
Sbjct:  91  KDLLRSIGKNVHVTLYEPIDGEKALEGELTEFDGETLTIEIKIKTRKKTVTIPYAKVASA   150

Query: 122  RLAV                                                          125
            RLAV
Sbjct: 151  RLAV                                                          154
```

A related DNA sequence was identified in *S. pyogenes* <SEQ ID 3473> which encodes the amino acid sequence <SEQ ID 3474>. Analysis of this protein sequence reveals the following:

Possible site: 33
>>> Seems to have no N-terminal signal sequence
----- Final Results -----
 bacterial cytoplasm --- Certainty = 0.3445 (Affirmative) <succ>
 bacterial membrane --- Certainty = 0.0000 (Not Clear) <succ>
 bacterial outside --- Certainty = 0.0000 (Not Clear) <succ>

An alignment of the GAS and GBS proteins is shown below.

```
Identities = 101/127 (79%), Positives = 117/127 (91%)
Query:   1  MGGDYVLSILIDKPGGITVEDTAQLTDVVSPLLDTIQPDPFPEQYMLEVSSPGLERPLKT    60
            MG DY+LSIL+DK GGITVEDT+ LT+++SPLLDTI PDPFP QYMLEVSSPGLERPLKT
Sbjct:  52  MGSDYILSILVDKEGGITVEDTSDLTNIISPLLDTIDPDPFPNQYMLEVSSPGLERPLKT   111

Query:  61  ARALSNAVGSYINVSLYKSIDKVKIFEGDLLSFDGETLTIDYMDKTRHKTVDIPYQTVAK   120
            A++L  AVGSYINVSLY++IDKVK+F+GDLL+FDGETLTIDY+DKTRHK V+IPYQ VAK
Sbjct: 112  ADSLKAAVGSYINVSLYQAIDKVKVFQGDLLAFDGETLTIDYLDKTRHKIVNIPYQAVAK   171

Query: 121  ARLAVKL                                                       127
            R+AVKL
Sbjct: 172  VRMAVKL                                                       178
```

Example 1123

A DNA sequence (GBSx1198) was identified in *S. agalactiae* <SEQ ID 3475> which encodes the amino acid sequence <SEQ ID 3476>. This protein is predicted to be n utilization substance protein a homolog (nusA). Analysis of this protein sequence reveals the following:

```
Possible site: 36
>>> Seems to have no N-terminal signal sequence
----- Final Results -----
   bacterial cytoplasm --- Certainty = 0.5069 (Affirmative) <succ>
   bacterial membrane --- Certainty = 0.0000 (Not Clear) <succ>
   bacterial outside --- Certainty = 0.0000 (Not Clear) <succ>
```

A related GBS nucleic acid sequence <SEQ ID 9565> which encodes amino acid sequence <SEQ ID 9566> was also identified.

The protein has homology with the following sequences in the GENPEPT database.

A related DNA sequence was identified in *S. pyogenes* <SEQ ID 3477> which encodes the amino acid sequence <SEQ ID 3478>. Analysis of this protein sequence reveals the following:

```
Possible site: 44
>>> Seems to have no N-terminal signal sequence
----- Final Results -----
   bacterial cytoplasm --- Certainty = 0.2074 (Affirmative) <succ>
   bacterial membrane --- Certainty = 0.0000 (Not Clear) <succ>
   bacterial outside --- Certainty = 0.0000 (Not Clear) <succ>
```

```
>GP:CAB13533 GB:Z99112 nusA [Bacillus subtilis]
Identities = 164/370 (44%), Positives = 251/370 (67%), Gaps = 15/370 (4%)

Query:    4  MSKEMLEAFRILEEEKHINKEDIIDAVTESLKSAYKRRYGQSESCVIEFNEKKADFTVYT    63
             MS E+L+A  ILE+EK I+KE II+A+  +L SAYKR + Q+++ ++ N +     V+
Sbjct:    1  MSSELLDALTILEKEKGISKEIIEAIEAALISAYKRNFNQAQNVRVDLNRETGSIRVFA    60

Query:   64  VREVVDEVFDSRLEISLKDALAISSAYELGDKIRFEESVTEFGRVAAQSAKQTIMEKMRR    123
             ++VVDEV+D RLEIS+++A  I   Y +GD +  E +  +FGR+AAQ+AKQ + +++R
Sbjct:   61  RKDVVDEVYDQRLEISIEEAQGIHPEYMVGDVVEIEVTPKDFGRIAAQTAKQVVTQRVRE    120

Query:  124  QMREVTFNEYKQHEGEIMTGTVERFDQRFIYVNLGSLEAQLSHQDQIPGESFKSHDMIDV    183
                R V ++E+    E +IMTG V+R D +FIYV+LG +EA L    +Q+P ES+K HD I V
Sbjct:  121  AERGVIYSEFIDREEDIMTGIVQRLDNKFIYVSLGKIEALLPVNEQMPNESYKPHDRIKV    180

Query:  184  YVYKVENNPKGVNVFVSRSHPEFIKRIMEREIPEVFDGTVEIMSVSREAGDRTKVAVRSH    243
             Y+ KVE   KG  ++VSR+HP  +KR+ E E+PE++DGTVE+ SV+REAGDR+K++VR+
Sbjct:  181  YITKVEKTTKGPQIYVSRTHPGLLKRLFEIEVPEIYDGTVELKSVAREAGDRSKISVRTD    240

Query:  244  NSNVDAIGTIVGRGGSNIKKVISNFHPKRVDAKTGLEIPVEENIDVIQWVEDPAEFIYNA    303
             + +VD +G+ VG  G  ++ +++                    E ID++ W  DP EF+ NA
Sbjct:  241  DPDVDPVGSCVGPKGQRVQAIVNELK--------------GEKIDIVNWSSDPVEFVANA    286

Query:  304  IAPAEVDMVLFDDEDTKRATVVVPDSKLSLAIGRRGQNVRLAAHLTGYRIDIKSASEYEK    363
             ++P++V  V+ ++E+ K  TV+VPD +LSLAIG+RGQN  RLAA  LTG++IDIKS ++  +
Sbjct:  287  LSPSKVLDVIVNEEE-KATTVIVPDYQLSLAIGKRGQNARLAAKLTGWKIDIKSETDARE    345

Query:  364  MEAQELQTEE    373
             +     + EE
Sbjct:  346  LGIYPRELEE    355
```

An alignment of the GAS and GBS proteins is shown below.

```
Identities = 348/380 (91%), Positives = 361/380 (94%), Gaps = 2/380 (0%)

Query:    4  MSKEMLEAFRILEEEKHINKEDIIDAVTESLKSAYKRRYGQSESCVIEFNEKKADFTVYT    63
             MSKEMLEAFRILEEEKHI+K DIIDAVTESLKSAYKRRYGQSESCVIEFNEK ADF V+T
Sbjct:   12  MSKEMLEAFRILEEEKHIDKADIIDAVTESLKSAYKRRYGQSESCVIEFNEKTADFQVFT    71

Query:   64  VREVVDEVFDSRLEISLKDALAISSAYELGDKIRFEESVTEFGRVAAQSAKQTIMEKMRR    123
             VREVV+EVFDSRLEISLKDALAISSAYELGDKIRFEESV EFGRVAAQSAKQTIMEKMRR
Sbjct:   72  VREVVEEVFDSRLEISLKDALAISSAYELGDKIRFEESVNEFGRVAAQSAKQTIMEKMRR    131
```

-continued
```
Query:  124  QMREVTFNEYKQHEGEIMTGTVERFDQRFIYVNLGSLEAQLSHQDQIPGESFKSHDMIDV   183
             QMREV FNEYK+HEGEIMTGTVERFDQRFIYVNLGSLEAQLSHQDQIPGE+FKSHD IDV
Sbjct:  132  QMREVMFNEYKEHEGEIMTGTVERFDQRFIYVNLGSLEAQLSHQDQIPGETFKSHDRIDV   191

Query:  184  YVYKVENNPKGVNVFVSRSHPEFIKRIMEREIPEVFDGTVEIMSVSREAGDRTKVAVRSH   243
             YVYKVENNPKGVNVFVSRSHPEFIKRIME+EIPEVFDGTVEIMSVSREAGDRTKVAVRSH
Sbjct:  192  YVYKVENNPKGVNVFVSRSHPEFIKRIMEQEIPEVFDGTVEIMSVSREAGDRTKVAVRSH   251

Query:  244  NSNVDAIGTIVGRGGSNIKKVISNFHPKRVDAKTGLEIPVEENIDVIQWVEDPAEFIYNA   303
             N NVDAIGTIVGRGGSNIKKVIS FHPKRVDAKTGLEIPVEENIDVIQWV+DPAEFIYNA
Sbjct:  252  NPNVDAIGTIVGRGGSNIKKVISKFHPKRVDAKTGLEIPVEENIDVIQWVDDPAEFIYNA   311

Query:  304  IAPAEVDMVLFDDEDTKRATVVVPDSKLSLAIGRRGQNVRLAAHLTGYRIDIKSASEYEK   363
             IAPAEVDMVLFDDED KRATVVVPDSKLSLAIGRRGQNVRLAAHLTGYRIDIKSASEY++
Sbjct:  312  IAPAEVDMVLFDDEDLKRATVVVPDSKLSLAIGRRGQNVRLAAHLTGYRIDIKSASEYDR   371

Query:  364  MEAQELQTEEVAQESEVISD                                          383
             +EA+  +    A E  V+ D
Sbjct:  372  LEAE--KEAATAVEEPVVDD                                          389
```

Based on this analysis, it was predicted that these proteins and their epitopes could be useful antigens for vaccines or diagnostics.

Example 1124

A DNA sequence (GBSx1199) was identified in *S. agalactiae* <SEQ ID 3479> which encodes the amino acid sequence <SEQ ID 3480>. Analysis of this protein sequence reveals the following:

Possible site: 37
>>> Seems to have no N-terminal signal sequence
----- Final Results -----
   bacterial cytoplasm --- Certainty = 0.2012 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:CAB13534 GB:Z99112 alternate gene name: ymxB-similar to
hypothetical proteins [Bacillus subtilis]
Identities = 46/92 (50%), Positives = 67/92 (72%), Gaps = 1/92 (1%)

Query:   1   MAKTKKIPLRKSVVSGEVIDKRDLLRIVKNKEGQVFIDPTGKQNGRGAYIKLDNDEAILA    60
             M K KKIPLRK VV+GE+   K++L+R+V++KEG++ +DPTGK+NGRGAY+ LD +  + A
Sbjct:   1   MNKHKKIPLRKCVVTGEMKPKKELIRVVRSKEGEISVDPTGKKNGRGAYLTLDKECILAA    60

Query:  61   KKKRVFDRSFSMEVSDEFYDELLAYVDHKVKR                              92
             KKK     F  ++ D+ +DELL    + KVK+
Sbjct:  61   KKKNTLQNQFQSQIDDQIFDELLELAE-KVKK                              91
```

A related DNA sequence was identified in *S. pyogenes* <SEQ ID 3481> which encodes the amino acid sequence <SEQ ID 3482>. Analysis of this protein sequence reveals the following:

Possible site: 61
>>> Seems to have no N-terminal signal sequence
----- Final Results -----
   bacterial cytoplasm --- Certainty = 0.1008 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 77/98 (78%), Positives = 92/98 (93%)

Query:   1   MAKTKKIPLRKSVVSGEVIDKRDLLRIVKNKEGQVFIDPTGKQNGRGAYIKLDNDEAILA    60
             M+K KKIPLRKS+VSGE+I KRDLLRIVK K+GQVFIDPTGKQNGRGAYIKLDN EA++A
Sbjct:   2   MSKVKKIPLRKSLVSGEIIAKRDLLRIVKTKDGQVFIDPTGKQNGRGAYIKLDNQEALMA    61

Query:  61   KKKRVFDRSFSMEVSDEFYDELLAYVDHKVKRRELGLE                        98
             KKK+VF+RSFSM++  + FYD+L+AYVDHK+KRRELGL+
Sbjct:  62   KKKQVFNRSFSMDIPESFYDDLIAYVDHKIKRRELGLD                        99
```

Based on this analysis, it was predicted that these proteins and their epitopes could be useful antigens for vaccines or diagnostics.

Example 1125

A DNA sequence (GBSx1200) was identified in *S. agalactiae* <SEQ ID 3483> which encodes the amino acid sequence <SEQ ID 3484>. This protein is predicted to be probable ribosomal protein in infb 5' region. Analysis of this protein sequence reveals the following:

Possible site: 19
>>> Seems to have an uncleavable N-term signal seq
----- Final Results -----
  bacterial membrane --- Certainty = 0.0000 (Not Clear) <succ>
    bacterial outside --- Certainty = 0.0000 (Not Clear) <succ>
      bacterial cytoplasm --- Certainty = 0.0000 (Not Clear) <succ>

The protein has homology with the following sequences in the GENPEPT database.

```
>GP:BAB06133 GB:AP001515 unknown conserved protein [Bacillus halodurans]
Identities = 46/95 (48%), Positives = 65/95 (68%), Gaps = 1/95 (1%)

Query:    6    KVLNLIGLAQRAGRLITGEELVIKAIQNQQVSLIFLANDAGPNLTKKVTDKSNYYKTEVS    65
               K L+L+GLA RA +L+TGEE V+KA+QN QV+L+ L++DAG +   KK+ DK   Y+  V
Sbjct:    5    KWLSLLGLAARARQLLTGEEQVVKAVQNGQVTLVILSSDAGIHTKKKLLDKCGSYQIPVK   64

Query:   66    TVFSTLELSDALGK-PRKVVAVADAGFSKKMRTLM                           99
               V +   L  A+GK  R V+ V DAGFS+K+   L+
Sbjct:   65    VVGNRQMLGRAIGKHERVVIGVKDAGFSRKLAALI                           99
```

A related DNA sequence was identified in *S. pyogenes* <SEQ ID 3485> which encodes the amino acid sequence <SEQ ID 3486>. Analysis of this protein sequence reveals the following:

Possible site: 45
>>> Seems to have no N-terminal signal sequence
----- Final Results -----
  bacterial cytoplasm --- Certainty = 0.1950 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 75/99 (75%), Positives = 88/99 (88%)

Query:    1    MNNSEKVLNLIGLAQRAGRLITGEELVIKAIQNQQVSLIFLANDAGPNLTKKVTDKSNYY   60
               + N E++ +LIG AQRAG++I+GEELV+KAIQ+QQV L+FLANDAGPN+TKKVTDKSNYY
Sbjct:    1    LTNLERLSSLIGPAQRAGKVISGEELVVKAIQHQQVILVFLANDAGPNVTKKVTDKSNYY   60

Query:   61    KTEVSTVFSTLELSDALGKPRKVVAVADAGFSKKMRTLM                       99
                 EVSTV + LELS ALGKPRKV A+ADAGFSKKMRTLM
Sbjct:   61    NVEVSTVLNALELSAALGKPRKVAAIADAGFSKKMRTLM                       99
```

Based on this analysis, it was predicted that these proteins and their epitopes could be useful antigens for vaccines or diagnostics.

Example 1126

A DNA sequence (GBSx1201) was identified in *S. agalactiae* <SEQ ID 3487> which encodes the amino acid sequence <SEQ ID 3488>. Analysis of this protein sequence reveals the following:

Possible site: 37
>>> Seems to have no N-terminal signal sequence
----- Final Results -----
  bacterial cytoplasm --- Certainty = 0.2873 (Affirmative) <succ>
    bacterial membrane --- Certainty = 0.0000 (Not Clear) <succ>
      bacterial outside --- Certainty = 0.0000 (Not Clear) <succ>

A related GBS nucleic acid sequence <SEQ ID 10959> which encodes amino acid sequence <SEQ ID 10960> was also identified.

A related DNA sequence was identified in *S. pyogenes* <SEQ ID 3489> which encodes the amino acid sequence <SEQ ID 3490>. Analysis of this protein sequence reveals the following:

Possible site: 37
>>> Seems to have no N-terminal signal sequence
----- Final Results -----
  bacterial cytoplasm --- Certainty = 0.2985 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 735/961 (76%), Positives = 805/961 (83%), Gaps = 42/961 (4%)

Query:   1    MSKKRLHEIAKEIGKTSKEVVEQAQSLGLPVKSHASSVEENDATRIVESFS-SSKTKAPT    59
              +SKKRLHEIAKEIGK+SKEVVE A+ LGL VKSHASSVEE DA +I+ SFS +SK
Sbjct:   1    LSKKRLHEIAKEIGKSSKEVVEHAKYLGLDVKSHASSVEEADAKKIISSFSKASKPDVTA   60

Query:   60   NSVQTNQGVKTESKTVETKQGLSDDKPSTQPVAKPKPQSRNFKAEREARAKAEAEKRQHN   119
              +      + V    S TV  + G S+     TQ V+KPK  SRNFKAEREARAK +A ++Q N
Sbjct:   61   SQTVKPKEVAQPSVTVVKETG-SEHVEKTQ-VSKPK--SRNFKAEREARAKEQAARKQAN   116

Query:   120  GD----------HRKNNRHNDTRSDDRR--HQGQKRSNGNR-----------NDNRQ--G   154
              G              +R+ N H      D+R H+ Q +N R              +DN Q   G
Sbjct:   117  GSSHRSQERRGGYRQPNNHQTNEQGDKRITHRSQGDTNDKRIERKASNVSPRHDNHQLVG   176

Query:   155  QQNN----RNKNDGRYADHKQKPQTRPQQPAGNRIDFKARAAALKAEQNAEYSRHSEQRF   210
              +N    N    +GR+ + K++ +   PQ  +  +IDFKARAAALKAEQNAEYSR SE RF
Sbjct:   177  DRNRSFAKENHKNGRFTNQKKQGRQEPQSKSP-KIDFKARAAALKAEQNAEYSRQSETRF   235

Query:   211  REEQEAKRQAAKEQELAKAAALKAQEEAQKAKEKLASKPVAKVKEIVNKVAATPSQTADS   270
              R +QEAKR A    ++ AK AALKAQ E    +E   A K + + +   +      TAD+
Sbjct:   236  RAQQEAKRLAELARQEAKEAALKAQAEEMSHREA-ALKSIEEAETKLKSSNISAKSTADN   294

Query:   271  RRKKQTRSDKSRQFSNENEDGQKQTRNKKNWNNQNQVRNQRNSNWNHNKKNKKGK----T   326
              RRKKQ R +K+R+ ++ +++GQK  +NKK+WN+QNQVRNQ +NSNWN NKK KKGK        T
Sbjct:   295  RRKKQARPEKNRELTHHSQEGQK--KNKKSWNSQNQVRNQKNSNWNKNKKTKKGKNVKNT   352

Query:   327  NGAPKPVTERKFHELPKEFEYTEGMTVAEIAKRIKREPAEIVKKLFMMGVMATQNQSLDG   386
              N APKPVTERKFHELPKEFEYTEGMTVAEIAKRIKREPAEIVKKLFMMGVMATQNQSLDG
Sbjct:   353  NTAPKPVTERKFHELPKEFEYTEGMTVAEIAKRIKREPAEIVKKLFMMGVMATQNQSLDG   412

Query:   387  DTIELLMVDYGIEAHAKVEVDEADIERFFADEDYLNPDNLTERPPVVTIMGHVDHGKTTL   446
              DTIELLMVDYGIEA AKVEVD+ADIERFF DE+YLNP+N+ ER PVVTIMGHVDHGKTTL
Sbjct:   413  DTIELLMVDYGIEAKAKVEVDDADIERFFEDENYLNPENIVERAPVVTIMGHVDHGKTTL   472

Query:   447  LDTLRNSRVATGEAGGITQHIGAYQIEEAGKKITFLDTPGHAAFTSMRARGASVTDITIL   506
              LDTLRNSRVATGEAGGITQHIGAYQIEEAGKKITFLDTPGHAAFTSMRARGASVTDITIL
Sbjct:   473  LDTLRNSRVATGEAGGITQHIGAYQIEEAGKKITFLDTPGHAAFTSMRARGASVTDITIL   532

Query:   507  IVAADDGVMPQTVEAINHSKAAGVPIIVAINKIDKPGANPERVISELAEHGVISTAWGGE   566
              IVAADDGVMPQT+EAINHSKAAGVPIIVAINKIDKPGANPERVI+ELAE+G+ISTAWGGE
Sbjct:   533  IVAADDGVMPQTIEAINHSKAAGVPIIVAINKIDKPGANPERVIAELAEYGIISTAWGGE   592

Query:   567  SEFVEISAKFGKNIQELLETVLLVAEMEELKADADVRAIGTVIEARLDKGKGAVATLLVQ   626
                EFVEISAKF KNI ELLETVLLVAE+EELKAD   VRAIGTVIEARLDKGKGA+ATLLVQ
Sbjct:   593  CEFVEISAKFNKNIDELLETVLLVAEVEELKADPTVRAIGTVIEARLDKGKGAIATLLVQ   652

Query:   627  QGTLNVQDPIVVGNTFGRVRAMTNDLGRRVKVAGPSTPVSITGLNEAPMAGDHFAVYADE   686
              QGTL+VQDPIVVGNTFGRVRAM NDLGRRVK A PSTPVSITGLNE PMAGDHFAVYADE
Sbjct:   653  QGTLHVQDPIVVGNTFGRVRAMVNDLGRRVKSAEPSTPVSITGLNETPMAGDHFAVYADE   712

Query:   687  KAARAAGEERAKRALLKQRQNTQRVSLENLFDTLKAGEVKSVNVIIKADVQGSVEALAAS   746
              KAARAAGEER+KRALLKQRQNTQRVSL +NLFDTLKAGE+K+VNVIIKADVQGSVEALAAS
Sbjct:   713  KAARAAGEERSKRALLKQRQNTQRVSLDNLFDTLKAGEIKTVNVIIKADVQGSVEALAAS   772

Query:   747  LLKIDVEGVKVNVVHSAVGAINESDVTLAEASNAVIIGFNVRPTPQARQQADADDVEIRQ   806
              L+KI+VEGV+VNVVHSAVGAINESDVTLAEASNAVIIGFNVRPTPQARQQAD DDVEIR
Sbjct:   773  LVKIEVEGVRVNVVHSAVGAINESDVTLAEASNAVIIGFNVRPTPQARQQADTDDVEIRL   832

Query:   807  HSIIYKVIEEVEEAMKGKLDPEYQEKILGEAIIRETFKVSKVGTIGGFMVINGKVTRDSS   866
              HSIIYKVIEEVEEAMKGKLDP YQEKILGEAIIRETFKVSKVGTIGGFMVINGKVTRDSS
Sbjct:   833  HSIIYKVIEEVEEAMKGKLDPVYQEKILGEAIIRETFKVSKVGTIGGFMVINGKVTRDSS   892

Query:   867  VRVIRDGVVIFDGKLASLKHYKDDVKEVGNAQEGGLMIENYNDLKEDDTIEAYIMEEIKRK   927
              VRVIRD VVIFDGKLASLKHYKDDVKEVGNAQEGGLMIEN+NDLK DDTIEAYIMEEI RK
Sbjct:   893  VRVIRDSVVIFDGKLASLKHYKDDVKEVGNAQEGGLMIENFNDLKVDDTIEAYIMEEIVRK   953
```

Based on this analysis, it was predicted that this protein and its epitopes, could be useful antigens for vaccines or diagnostics.

Example 1127

A DNA sequence (GBSx1202) was identified in *S. agalactiae* <SEQ ID 3491> which encodes the amino acid sequence <SEQ ID 3492>. This protein is predicted to be ribosome binding factor A (rbfA). Analysis of this protein sequence reveals the following:

Possible site: 56
>>> Seems to have no N-terminal signal sequence
----- Final Results -----
bacterial cytoplasm --- Certainty = 0.2557 (Affirmative) <succ>
bacterial membrane --- Certainty = 0.0000 (Not Clear) <succ>
bacterial outside --- Certainty = 0.0000 (Not Clear) <succ>

A related GBS nucleic acid sequence <SEQ ID 9567> which encodes amino acid sequence <SEQ ID 9568> was also identified.

A related DNA sequence was identified in *S. pyogenes* <SEQ ID 3493> which encodes the amino acid sequence <SEQ ID 3494>. Analysis of this protein sequence reveals the following:

```
Possible site: 60
>>> Seems to have no N-terminal signal sequence
----- Final Results -----
    bacterial cytoplasm --- Certainty = 0.4765 (Affirmative) <succ>
      bacterial membrane --- Certainty = 0.0000 (Not Clear) <succ>
       bacterial outside --- Certainty = 0.0000 (Not Clear) <succ>
```

An alignment of the GAS and GBS proteins is shown below.

```
Identities = 93/117 (79%), Positives = 103/117 (87%)

Query:    8   LIMANHRIDRVGMEIKREVNEILRLRVNDPRVQDVTITDVQMLGDLSMAKVFYTIHSTLA    67
              + MANHRIDRVGMEIKREVN+IL++V DPRVQ VTIT+VQM GDLS+AKV+YTI S LA
Sbjct:    1   MAMANHRIDRVGMEIKREVNDILQKKVRDPRVQGVTITEVQMQGDLSLAKVYYTIMSDLA    60

Query:   68   SDNQKAQIGLEKATGTIKRELGKNLTMYKIPDLQFVKDESIEYGNKIDEMLRNLDKK     124
              SDNQKAQ GLEKATGTIKRELGK LTMYKIPDL F KD SI YGNKID++LR+LD K
Sbjct:   61   SDNQKAQTGLEKATGTIKRELGKQLTMYKIPDLVFEKDNSIAYGNKIDQLLRDLDNK     117
```

Based on this analysis, it was predicted that these proteins and their epitopes could be useful antigens for vaccines or diagnostics.

Example 1128

A DNA sequence (GBSx1203) was identified in *S. agalactiae* <SEQ ID 3495> which encodes the amino acid sequence <SEQ ID 3496>. This protein is predicted to be esterase. Analysis of this protein sequence reveals the following:

```
Possible site: 28
>>> Seems to have a cleavable N-term signal seq.
----- Final Results -----
    bacterial outside --- Certainty = 0.3000 (Affirmative) <succ>
      bacterial membrane --- Certainty = 0.0000 (Not Clear) <succ>
       bacterial cytoplasm --- Certainty = 0.0000 (Not Clear) <succ>
```

The protein has homology with the following sequences in the GENPEPT database.

```
>GP:AAA79277 GB:M64783 acetyl-hydrolase [Streptomyces hygroscopicus]
Identities = 58/220 (26%), Positives = 90/220 (40%), Gaps = 8/220 (3%)

Query:   98   WNDNGKANQKTIFYLAGGSYLNNPTPYHISMLKTLSTSLDAKIILPIYPKTPRYTYDYAI    157
              W    + + +T+ YL GGSY      H  +   L  + A ++   Y + P   + A+
Sbjct:   58   WVRPARQDGRTLLYLHGGSYALGSPQSHRHLSSALGDAAGAAVLALHYRRPPESPFPAAV    117

Query:  158   PRLVNLYRHFHEKN---ANLTLMGDSAGGGLALGLAHALSHQSGQEAIPQPKNIILLSPW    214
                 V   YR    E+         +TL GDSAG  GLA+       AL       P P   + +SPW
Sbjct:  118   EDAVAAYRMLLEQGCPPGRVTLAGDSAGAGLAVAALQALR----DAGTPLPAAAVCISPW    173

Query:  215   LDVTMKHPEIPKYEDTDPILSAWGLARVGEIWANGSNNTNHTYVSPKNAPATKLAPITLF    274
                 D+  +          +  +L     L R+ E +    G+ +  H     SP +     T L P+ +
Sbjct:  174   ADLACEGASHTTRKAREILLDTADLRRMAERYLAGT-DPRHPLASPAHGDLTGLPPLLIQ    232

Query:  275   TGTREIFFPDIRDYAAQLQAANHPVNYIAQEGMNHVYPIY                      314
                 G+ E+    D R         A PV +      M HV+  Y
Sbjct:  233   VGSEEVLHDDARALEQAALKAGTPVTFEEWPEMFHVWHWY                      272
```

A related DNA sequence was identified in *S. pyogenes* <SEQ ID 3497> which encodes the amino acid sequence <SEQ ID 3498>. Analysis of this protein sequence reveals the following:

```
Possible site: 27
>>> Seems to have a cleavable N-term signal seq.
----- Final Results -----
    bacterial outside --- Certainty = 0.3000 (Affirmative) <succ>
      bacterial membrane --- Certainty = 0.0000 (Not Clear) <succ>
       bacterial cytoplasm --- Certainty = 0.0000 (Not Clear) <succ>
```

An alignment of the GAS and GBS proteins is shown below.

```
Identities = 244/334 (73%), Positives = 280/334 (83%), Gaps = 6/334 (1%)

Query:     1  MKPSFKKLLLLFSIITILSIACTPHAKASGRSWKSWFIEQYFWLKRDKSYYKVQDESSFQ    60
              +K  +K L+   ++  L +  TP A AS RSWKSWFIEQYFWLKRDKSYY  QD+ SFQ
Sbjct:     1  LKHPIRKTLVTLGLLLTLCLP-TPVA-ASSRSWKSWFIEQYFWLKRDKSYYSKQDDPSFQ    58

Query:    61  KYLNASREQSDKGYYLDPNSVNGGLVQERLFDMQVYSWNDNGKANQKTIFYLAGGSYLNN   120
              +YL+A REQSDK Y LD N VNG LVQE L+ MQVYSWNDNGK +QKTI YLAGGSYLNN
Sbjct:    59  RYLDACREQSDKPYQLDTNLVNGPLVQENLYGMQVYSWNDNGKPDQKTIIYLAGGSYLNN   118

Query:   121  PTPYHISMLKTLSTSLDAKIILPIYPKTPRYTYDYAIPRLVNLYRHFHEKNANLTLMGDS   180
              PT YHI+MLKTLSTSLDAKI+LPIYPK PRYTY+Y +P+LVNLY+H++ KN N+ LMGDS
Sbjct:   119  PTTYHINMLKTLSTSLDAKIVLPIYPKAPRYTYNYTMPKLVNLYQHYYHKNQNVFLMGDS   178

Query:   181  AGGGLALGLAHALSHQSGQEAIPQPKNIILLSPWLDVTMKHPEIPKYEDTDPILSAWGLA   240
              AGGGLALGLAHAL +   E++PQPK ++LLSPWLDVTM HPEIP+YED DPILS+WGL
Sbjct:   179  AGGGLALGLAHALHN----ESVPQPKQLVLLSPWLDVTMSHPEIPEYEDADPILSSWGLK   234

Query:   241  RVGEIWANGSNNTNHTYVSPKNAPATKLAPITLFTGTREIFFPDIRDYAAQLQAANHPVN   300
              RVGE+WA  ++NTNH YVSPKN P T L PITLFTGTREIF+PDIRDYAA+L+A ANH +
Sbjct:   235  RVGELWAYSADNTNHIYVSPKNGPITYLPPITLFTGTREIFYPDIRDYAAKLKAANHNIT   294

Query:   301  YIAQEGMNHVYPIYPIEEAKTAQYQMIDIINKTP                            334
              +I QEGMNHVYPIYPIEEAKTAQYQ+ID INKTP
Sbjct:   295  FITQEGMNHVYPIYPIEEAKTAQYQIIDAINKTP                            328
```

A related GBS gene <SEQ ID 8731> and protein <SEQ ID 8732> were also identified. Analysis of this protein sequence reveals the following:

---

Lipop: Possible site: –1   Crend: 6
McG: Discrim Score: 11.88
GvH: Signal Score (–7.5): –1.33
Possible site: 28
>>> Seems to have a cleavable N-term signal seq.
ALOM program count: 0   value: 4.03   threshold: 0.0

-continued

PERIPHERAL Likelihood = 4.03   174
modified ALOM score: –1.31
*** Reasoning Step: 3
----- Final Results -----
   bacterial outside --- Certainty = 0.3000 (Affirmative) <succ>
   bacterial membrane --- Certainty = 0.0000 (Not Clear) <succ>
   bacterial cytoplasm --- Certainty = 0.0000 (Not Clear) <succ>

---

The protein has homology with the following sequences in the databases:

```
28.4/46.2% over 220aa
Streptomyces hygroscopicus
EGAD|5925| acetyl-hydrolase Insert characterized
ORF00486(589-1245 of 1602)
EGAD|5925|5724(57-277 of 300) acetyl-hydrolase {Streptomyces hygroscopicus}
% Match = 6.8
% Identity = 28.3 % Similarity = 46.1
Matches = 62 Mismatches = 111 Conservative Sub.s = 39

462       492       522       552       582       612       642       669
          KRDKSYYKVQDESSFQKYLNASREQSDKGYYLDPNSVNGGLVQERLFDMQVYSWNDNGKANQKTIFYLAGGSY-LNNPTP
              :        ::           :       | :          ::              |    :  : :|::|| |||| | :|
          ELELVRELIELNWHTRNGEMEPRRIAYDRAQEAFGNLGVPPGDVVTVGHCTAEWVRPARQDGRTLLYLHGGSYALGSPQS
                 20        30        40        50        60        70        80

696       726       756       786              837       867       897
          Y-HISMLKTLSTSLDAKIILPIYPKTPRYTYDYAIPRLVNLYRHFHEKN---ANLTLMGDSAGGGLALGLAHALSHQSGQ
          : |:|    |    : |::     |  :     |   :  |   ||  :  |:      :||  ||||| |||:    :||
          HRHLS--SALGDAAGAAVLALHYRRPPESPFPAAVEDAVAAYRMLLEQGCPPGRVTLAGDSAGAGLAVAALQAL----RD
                100       110       120       130       140       150

927       957       987      1017      1047      1077      1107      1137
          EAIPQPKNIILLSPWLDVTMKHPEIPKYEDTDPILSAWGLARVGEIWANGSNNTNHTYVSPKNAPATKLAPITLFTGTRE
           |    |  : :|||  |:  :          :  :  |   | |:|: |   |   ||     | |||   | | |:: |:|
          AGTPLPAAAVCISPWADLACEGASHTTRKAREILLDTADLRRMAERYLAGTD-PRHPLASPAHGDLTGLPPLLIQVGSEE
                170       180       190       200       210       220       230

1167      1197      1227      1245      1275      1305      1335      1365
         IFFPDIRDYAAQLQAANHPVNYIAQEGMNHV----YPIYPIEEAKTAQYQMIDIINKTP*Y*LSQL*SYKK*TMILTWFI
         ::   ||       |    | ||:     ||    :|: |     :     :     |
         VLHDDARALEQAALKAGTPVTFEEWPEMFHVWHWYHPVLPEGRRAAIEVAGAFLRTATGRGLK
                250       260       270       280       290       300
```

SEQ ID 8732 (GBS149) was expressed in *E. coli* as a His-fusion product. SDS-PAGE analysis of total cell extract is shown in FIG. 23 (lane 6; MW 37 kDa).

Figure 291:
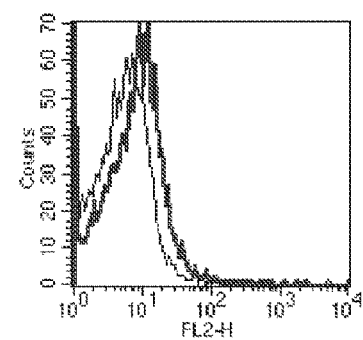

The GBS149-His fusion product was purified (FIG. 196, lane 6) and used to immunise mice. The resulting antiserum was used for FACS (FIG. 291), which confirmed that the protein is immunoaccessible on GBS bacteria.

Based on this analysis, it was predicted that these proteins and their epitopes could be useful antigens for vaccines or diagnostics.

Example 1129

A DNA sequence (GBSx1204) was identified in *S. agalactiae* <SEQ ID 3499> which encodes the amino acid sequence <SEQ ID 3500>. This protein is predicted to be CopY. Analysis of this protein sequence reveals the following:

Possible site:22
>>> Seems to have no N-terminal signal sequence
----- Final Results -----
bacterial cytoplasm --- Certainty = 0.3140 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:AAG10085 GB:AF296446 CopY [Streptococcus mutans]

Identities = 67/137 (48%), Positives = 98/137 (70%)

Query:     2  TISSAEWEIMRVVWAQQNTTSNEILAVLLEKYDWTPSTVKTLLRRLLDKGYVSREKMGKG    61
              +IS+AEWE+MRVVWA+Q T+S+EI+A+L   Y W+ ST+KTL+ RL +KGY++ ++ G+

Sbjct:     3  SISNAEWEVMRVVWAKQMTSSSEIIAILSRTYCWSASTIKTLITRLSEKGYLTSQRQGRK    62

Query:    62  FSYSPLIDEDLAMMSEVDSVFQKVCQTKHVAIVRHLLESIPMTEKDRLNLQSSLEAKKGK   121
              + YS LI E+ A+  +V  VF ++C TKH A++RHL+E   PMT  D    L++ L +KK Sbjct:    63  YIYSSLISEEEALEQQVSEVFSRICVTKHQALIRHLVEETPMTLSDIEKLEALLLSKKAN   122

Query:   122  TLERVACNCIPGQCQCH                                            138
              +  V CNCI GQC C+

Sbjct:   123  AVPEVKCNCIVGQCSCY                                            139
```

A related DNA sequence was identified in *S. pyogenes* <SEQ ID 3501> which encodes the amino acid sequence <SEQ ID 3502>. Analysis of this protein sequence reveals the following:

Possible site: 13
>>> Seems to have no N-terminal signal sequence
----- Final Results -----
bacterial cytoplasm --- Certainty = 0.2331 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 54/135 (40%), Positives = 84/135 (62%)

Query:     3  ISSAEWEIMRVVWAQQNTTSNEILAVLLEKYDWTPSTVKTLLRRLLDKGYVSREKMGKGF    62
              IS+AEWE+MRVVWA  +  S++I+ +L +KY W+ ST+KTL+ RL+ K +++  + G+ +
Sbjct:    10  ISAAEWEVMRVVWASGDIKSSDIITILRKKYQWSDSTIKTLIGRLVKKNFLTSYRQGRAY    69

Query:    63  SYSPLIDEDLAMMSEVDSVFQKVCQTKHVAIVRHLLESIPMTEKDRLNLQSSLEAKKGKT   122
              Y  L+DE L    + +V   +CQ +H ++    L  +PMT ++     Q  LE KK
Sbjct:    70  IYQALLDETLLQKEALATVLDGICQRQHTRLLLERLYHLPMTLEEIGAFQELLEVKKENA   129

Query:   123  LERVACNCIPGQCQC                                              137
              +  V CNC+PGQC C
Sbjct:   130  VLEVPCNCLPGQCHC                                              144
```

Example 1130

A DNA sequence (GBSx1206) was identified in *S. agalactiae* <SEQ ID 3503> which encodes the amino acid sequence <SEQ ID 3504>. This protein is predicted to be CopA. Analysis of this protein sequence reveals the following:

Possible site:19
>>> Seems to have no N-terminal signal sequence
INTEGRAL Likelihood = −9.82 Transmembrane 382-398 (370-406)
INTEGRAL Likelihood = −8.01 Transmembrane 356-372 (344-374)
INTEGRAL Likelihood = −2.50 Transmembrane 719-735 (719-738)
INTEGRAL Likelihood = −2.28 Transmembrane 202-218 (202-218)
INTEGRAL Likelihood = −1.59 Transmembrane 693-709 (691-712)
INTEGRAL Likelihood = −1.33 Transmembrane 167-183 (167-183)
----- Final Results -----
bacterial membrane --- Certainty = 0.4927 (Affirmative) <succ>
bacterial outside --- Certainty = 0.0000 (Not Clear) <succ>
bacterial cytoplasm --- Certainty = 0.0000 (Not Clear) <succ>

Based on this analysis, it was predicted that these proteins and their epitopes could be useful antigens for vaccines or diagnostics.

The protein has homology with the following sequences in the GENPEPT database.

```
>GP:AAG10086 GB:AF296446 CopA [Streptococcus mutans]
Identities = 440/740 (59%), Positives = 571/740 (76%), Gaps = 1/740 (0%)

Query:    5  KETFLIDGMTCASCALTIEKAVNKLDHVDSAVVNLATEKMTVTFDDTTLSPNVIEECVSE   64
             +E FLIDGMTCASCA+ +E AV KLD ++SAVVNL TEKMT+ +D    +S   + + V+
Sbjct:    3  EEVFLIDGMTCASCAINVENAVKKLDGIESAVVNLTTEKMTIDYDAAKVSEADVTKAVAG   62

Query:   65  SGYEASLFKEETSKSQSERHQLAIEKMWHRFWMSAVATIPLLYISMGPMINLWLPSFLMP  124
             +GY A ++   T++SQ +R + + +  R   +++ TIPL YI+MG M+ L LP+FL P
Sbjct:   63  AGYGAKVYDPTTAESQKDREEHKLAGIKKRLLWTSIFTIPLFYIAMGSMVGLPLPNFLAP  122

Query:  125  DKGPLNYGMIQLLLTLPVMYFGRIFYQNGFKALFKRHPNMDSLVAIATTAAFIYSLYGLY  184
              PL Y M+ LLLT+PV+    FY NGF++LFK HPNMDSLV++ATTAAF+YSLYG Y
Sbjct:  123  SSAPLTYAMVLLLLTIPVIVLSWSFYDNGFRSLFKGHPNMDSLVSLATTAAFLYSLYGTY  182

Query:  185  EILQGDIHYAHQLYFESVAVILTLITLGKYFEILSKGRTSASIEKLLTLSAKEARVIKDG  244
              + G  H+AH LY+ESVAVILTLITLGKYFE LSKGRTS +I+KL+ LSAKEA +I+DG
Sbjct:  183  HVYLGHTHHAHHLYYESVAVILTLITLGKYFETLSKGRTSDAIKKLMHLSAKEATLIRDG  242

Query:  245  EDYMVPLDKVKIGETILVKPGEKIPLDGHVVAGESSIDESMLTGESIPVEKKVGSKVYGA  304
             E+  VP+++V+I + ILVKPGEKIP+DG V++G S+IDESMLTGESIP+EK   S VY
Sbjct:  243  EEIKVPIEQVQIRDQILVKPGEKIPVDGRVLSGHSAIDESMLTGESIPIEKMADSPVYAG  302

Query:  305  SINGQGSLTIFVEKEAGGSLLSQIINLVEAAQTSKAPIANLADKVSGVFVPFVIVIAILS  364
             SINGQGSLT  EK   +LLSQII LVE AQ +KAPIA +ADKVS VFVP +I IAIL+
Sbjct:  303  SINGQGSLTFEAEKVGNETLLSQIIKLVENAQQTKAPIAKIADKVSAVFVPVIITIAILT  362

Query:  365  GLSWYLILGQSFAFSLKIMIAVLVIACPCALGLATPTAIMVASGKAAENGILFKGGEVLE  424
             GL WY ++GQ F FS+ I +AVLVIACPCALGLATPTAIMV +G+AAENGIL+K G+VLE
Sbjct:  363  GLFWYFVMGQDFTFSMTISVAVLVIACPCALGLATPTAIMVGTGRAAENGILYKRGDVLE  422

Query:  425  KAHHIDTIVFDKTGTLTKGKPEVVAIKTYGGDKEEFLGQVASVEKLSNHPLSQTIVNKAK  484
              AH I+TIVFDKTGT+T+GKPEVV   +Y D+ + +   A++E LS HPLSQ IV+ AK
Sbjct:  423  LAHQINTIVFDKTGTITQGKPEVVHQFSY-HDRTDLVQVTAALEALSEHPLSQAIVDYAK  481

Query:  485  EKELPLREVMAFKNILGYGLSATINGKTMLVGNANLMTKNDVNLDLAKADIEIAQEEAQT  544
             ++  L V F ++ G GL  +  +T+LVGN LM + +++L+ A+AD + A  + QT
Sbjct:  482  KEGTHLLAVDDFTSLTGLGLKGCVADETLLVGNEKLMRQANISLEQAQADFKAATAQGQT  541

Query:  545  VVYVSENGVLSGLITLTDQLKTDSQETVKQLQRLGFNLVLLTGDNKASADAIAQKLGITT  604
              ++V+ +G L GLIT+ D++K DS  TVK LQ +G  + +LTGDN+ +A AIA+++GIT
Sbjct:  542  PIFVASDGQLLGLITIADKVKNDSAATVKALQNMGVEVAMLTGDNEETAQAIAKEVGITF  601

Query:  605  VVSEVLPDQKANVILELKEKGGQIAMVGDGINDAPALASSDVGISMSSGTDIAIESADIV  664
             V+S+V  +K    IL+L+ +G ++AMVGDGINDAPALA++D+GISM SGTDIA+ESADIV
Sbjct:  602  VISQVFSQEKTQAILDLQAEGKKVAMVGDGINDAPALATADIGISMGSGTDIAMESADIV  661

Query:  665  LMKPELTDLLKAMTISKQTIQIIKENLFWAFFYNVLAIPVAMGVLHINGGPLLNPMLAGL  724
             LMKP + D++KA+ IS+ TI  IKENLFWAF YNVL++P+AMGVL+LFGGPLL+PM+AGL
Sbjct:  662  LMKPAMLDIIKALKISRVTIINIKENLFWAFIYNVLSVPIAMGVLYLFGGPLLDPMIAGL  721

Query:  725  AMAFSSVSVVLNALRLKVLK                                          744
             AM+FSSVSVVLNALRLKV+K
Sbjct:  722  AMSFSSVSVVLNALRLKVVK                                          741
```

There is also homology to SEQ ID 3506.

Based on this analysis, it was predicted that this protein and its epitopes, could be useful antigens for vaccines or diagnostics.

Example 1131

A DNA sequence (GBSx1207) was identified in *S. agalactiae* <SEQ ID 3507> which encodes the amino acid sequence <SEQ ID 3508>. This protein is predicted to be cation-transporting ATPase, P-type (pacS). Analysis of this protein sequence reveals the following:

```
Possible site: 28
>>> Seems to have no N-terminal signal sequence
----- Final Results -----
   bacterial cytoplasm --- Certainty = 0.1934 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database.

```
>GP:AAG10087 GB:AF296446 CopZ [Streptococcus mutans]
Identities = 31/67 (46%), Positives = 43/67 (63%)

Query:    1   MKHTYRVSGMKCDGCAKTVSDKLSSVIGVDEVNVDLTKNQVVVSGKTFKWLLKRSLKDTK    60
              M+ TY + G+KC GCA  V+ + S +  V++V VDL K +V ++G   KW LKR+LK T
Sbjct:    1   MEKTYHIDGLKCQGCADNVTKRFSELKKVNDVKVDLDKKEVRITGNPSKWSLKRALKGTN    60

Query:   61   YSLEEEI    67
              Y L  EI
Sbjct:   61   YELGAEI    67
```

A related DNA sequence was identified in *S. pyogenes* <SEQ ID 3509> which encodes the amino acid sequence <SEQ ID 3510>. Analysis of this protein sequence reveals the following:

```
Possible site: 18
>>> Seems to have no N-terminal signal sequence
----- Final Results -----
   bacterial cytoplasm --- Certainty = 0.2997 (Affirmative) <succ>
      bacterial membrane --- Certainty = 0.0000 (Not Clear) <succ>
         bacterial outside --- Certainty = 0.0000 (Not Clear) <succ>
```

An alignment of the GAS and GBS proteins is shown below.

```
Identities = 33/63 (52%), Positives = 48/63 (75%)

Query:    1   MKHTYRVSGMKCDGCAKTVSDKLSSVIGVDEVNVDLTKNQVVVSGKTFKWLLKRSLKDTK    60
              M+  Y+V+GM CDGCA+TV++KLS+V GV  V V+L K +   V+G+   +L+KR+LKDTK
Sbjct:    1   MEKHYQVTGMTCDGCARTVTEKLSAVPGVQSVQVNLEKGEAKVTGRPLTFLIKRALKDTK    60

Query:   61   YSL    63
              + L
Sbjct:   61   FEL    63
```

Based on this analysis, it was predicted that these proteins and their epitopes could be useful antigens for vaccines or diagnostics.

Example 1132

A DNA sequence (GBSx1208) was identified in *S. agalactiae* <SEQ ID 3511> which encodes the amino acid sequence <SEQ ID 3512>. Analysis of this protein sequence reveals the following:

```
Possible site:20
>>> Seems to have a cleavable N-term signal seq.
   INTEGRAL Likelihood = -7.59 Transmembrane 67-83 (65-90)
   INTEGRAL Likelihood = -3.72 Transmembrane 35-51 (31-51)
   INTEGRAL Likelihood = -3.61 Transmembrane 122-138 (120-139)
   INTEGRAL Likelihood = -1.59 Transmembrane 154-170 (154-171)
----- Final Results -----
   bacterial membrane --- Certainty = 0.4036 (Affirmative) <succ>
      bacterial outside --- Certainty = 0.0000 (Not Clear) <succ>
         bacterial cytoplasm --- Certainty = 0.0000 (Not Clear) <succ>
```

A related GBS nucleic acid sequence <SEQ ID 8733> which encodes amino acid sequence <SEQ ID 8734> was also identified. Analysis of this protein sequence reveals the following:

```
Lipop: Possible site: -1    Crend: 5
McG: Discrim Score: 4.09
GvH: Signal Score (-7.5): 3.87
Possible site: 20
>>> Seems to have a cleavable N-term signal seq.
ALOM program count: 4  value: -7.59  threshold: 0.0
INTEGRAL      Likelihood = -7.59 Transmembrane 65-81 (63-88)
INTEGRAL      Likelihood = -3.72 Transmembrane 33-49 (29-49)
INTEGRAL      Likelihood = -3.61 Transmembrane 120-136 (118-137)
INTEGRAL      Likelihood = -1.59 Transmembrane 152-168 (152-169)
PERIPHERAL    Likelihood = 0.85   96
modified ALOM score: 2.02
```

-continued

*** Reasoning Step: 3
----- Final Results -----
   bacterial membrane --- Certainty = 0.4036 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the GENPEPT database.

```
>GP:CAB15351 GB:Z99121 similar to hypothetical proteins [Bacillus subtilis]
Identities = 107/192 (55%), Positives = 137/192 (70%)
Query:   8 WNILSLVGTVAFASSGAIVAIEEEFDILGLFILGFVTAFGGGAIRNVLIGLPIETLWSQG    67
           W +LS++G +AFA SGAIVA+EEE+DILG++ILG VTAFGGGAIRN+LIG+P+  LW QG
Sbjct:   3 WELLSVIGIIAFAVSGAIVAMEEEYDILGVYILGIVTAFGGGAIRNLLIGVPVSALWEQG    62

Query:  68 IAFYAAAAAILFIMIFPNLLSGKGRDAEVVSDAIGLAAFSVQGALYATQSHQPLSAVIVA   127
             F A  +I + +FP LL          +SDAIGLAAF++QGALYA +   PLSAVIVA
Sbjct:  63 AYFQIALLSITIVFLFPKLLLKHWNKWGNLSDAIGLAAFAIQGALYAVKMGHPLSAVIVA   122

Query: 128 AVLTGAGGGIVRDVLAGRKPGVLRSEIYAGWSILVGIILYFKIAKTTTDYYLLVLVVTSL   187
           AVLTG+GGGI+RD+LAGRKP VL++EIYA W+ L G+I+        +   Y+L  V+
Sbjct: 123 AVLTGSGGGIIRDLLAGRKPLVLKAEIYAVWAALGGLIVGLGWLGNSFGLYVLFFVLVVC   182

Query: 188 RMLGYKKQWHLP   199
           R+  Y   W LP
Sbjct: 183 RVCSYMFNWKLP   194
```

A related DNA sequence was identified in *S. pyogenes* <SEQ ID 3513> which encodes the amino acid sequence <SEQ ID 3514>. Analysis of this protein sequence reveals the following:

Possible site: 27
>>> Seems to have a cleavable N-term signal seq.
INTEGRAL Likelihood = −5.15 Transmembrane 70-86 (65-88)
INTEGRAL Likelihood = −4.09 Transmembrane 33-49 (29-49)
INTEGRAL Likelihood = −2.13 Transmembrane 120-136 (119-137)
INTEGRAL Likelihood = −0.43 Transmembrane 173-189 (172-189)
----- Final Results -----
   bacterial membrane --- Certainty = 0.3060 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the databases:

```
>GP:BAB05428 GB:AP001512 unknown conserved protein [Bacillus halodurans]
Identities = 109/195 (55%), Positives = 137/195 (69%)
Query:   6 WEILNIIGTIATALSGAIVAMEEEFDILGIFILGFVTAFGGGAIRNTLIGLPIEALWGQK    65
           W++LN+IGTIAFALSG IVAMEE+FD++G++ILGFVTAFGGGAIRN LIG+P+ ALW Q
Sbjct:   3 WDVLNVIGTIAFALSGVIVAMEEDFDLMGVYILGFVTAFGGGAIRNLLIGVPVSALWEQG    62

Query:  66 PEFTCAFFAMVLIMLFPKLMARGWVRAAVLTDAIGLAAFSVQGALHAVRLNQPLSAVIVT   125
              FT AF M +   P L   W++  +L DAIGLAAF++QGAL A  ++ PLSAVIV
Sbjct:  63 TLFTIAFIVMTIAFFLPNLWINHWLKFGLLFDAIGLAAFAIQGALFATSMDHPLSAVIVA   122

Query: 126 AVLTGAGGGVVRDILAGRKPSVLRSEIYAGWSILAAIVLHFKLADSTIECYALVVLLTTL   185
           A LTGAGGG+VRD+LA RKP VL  EIY GW++LA  +    + I    L++L+  L
Sbjct: 123 AALTGAGGGIVRDMLARRKPLVLSKEIYIGWAMLAGAAIGLNIVSGPIGIGFLIILVVFL   182

Query: 186 RMIGNRKKWNLPKIK   200
           RM+    W LP K
Sbjct: 183 RMLSVHYNWCLPHRK   197
```

An alignment of the GAS and GBS proteins is shown below.

```
Identities = 133/200 (66%), Positives = 168/200 (83%)
Query:   3 MSIDIWNILSLVGTVAFASSGAIVAIEEEFDILGLFILGFVTAFGGGAIRNVLIGLPIET    62
```

```
                    M+ID+W IL+++GT+AFA SGAIVA+EEEFDILG+FILGFVTAFGGGAIRN LIGLPIE
Sbjct:   1  MTIDMWEILNIIGTIAFALSGAIVAMEEEFDILGIFILGFVTAFGGGAIRNTLIGLPIEA   60

Query:  63  LWSQGIAFYAAAAAILFIMIFPNLLSGKGRDAEVVSDAIGLAAFSVQGALYATQSHQPLS  122
            LW Q   F  A  A++ IM+FP L++       A V++DAIGLAAFSVQGAL+A +  QPLS
Sbjct:  61  LWGQKPEFTCAFFAMVLIMLFPKLMARGWVRAAVLTDAIGLAAFSVQGALHAVRLNQPLS  120

Query: 123  AVIVAAVLTGAGGGIVRDVLAGRKPGVLRSEIYAGWSILVGIILYFKIAKTTTDYYLLVL  182
            AVIV AVLTGAGGG+VRD+LAGRKP VLRSEIYAGWSIL  I+L+FK+A +T + Y LV+
Sbjct: 121  AVIVTAVLTGAGGGVVRDILAGRKPSVLRSEIYAGWSILAAIVLHFKLADSTIECYALVV  180

Query: 183  VVTSLRMLGYKKQWHLPVVR                                         202
            ++T+LRM+G +K+W+LP ++
Sbjct: 181  LLTTLRMIGNRKKWNLPKIK                                         200
```

Based on this analysis, it was predicted that these proteins and their epitopes could be useful antigens for vaccines or diagnostics.

Example 1133

A DNA sequence (GBSx1209) was identified in *S. agalactiae* <SEQ ID 3515> which encodes the amino acid sequence <SEQ ID 3516>. Analysis of this protein sequence reveals the following:

---

Possible site: 42
>>> Seems to have no N-terminal signalsequence
----- Final Results -----
  bacterial cytoplasm --- Certainty = 0.2805 (Affirmative) <succ>
    bacterial membrane --- Certainty = 0.0000 (Not Clear) <succ>
      bacterial outside --- Certainty = 0.0000 (Not Clear) <succ>

---

A related GBS nucleic acid sequence <SEQ ID 9569> which encodes amino acid sequence <SEQ ID 9570> was also identified.

The protein has homology with the following sequences in the GENPEPT database.

```
>GP:CAB94816 GB:AJ245582 hypothetical protein [Streptococcus thermophilus]
Identities = 138/238 (57%), Positives = 184/238 (76%)
Query:   5  KKMIKLIAIDMDGTLLNDEKKIPKENIQAIKEATQAGIKIVLCTGRPMSGILPYFNELGL   64
            +  +KLIAIDMDGTLLN +K+IPKENI+AI+EAT AAGIKIVLCTGRP SGI+P+F +LGL
Sbjct:   3  QNQVKLIAIDMDGTLLNSQKEIPKENIKAIQEATAAGIKIVLCTGRPRSGIVPHFEKLGL   62

Query:  65  TKEEYIIMNNGCSTYSTKDWQLIDSATLTHDELIFLEEVVKEFPNVCLTLTAENTFYAVG  124
            ++EE+IIMNNGCSTY TK+W L++S +L+  E+   L +  ++FP V LT T E ++Y VG
Sbjct:  63  SEEEFIIMNNGCSTYETKNWTLLESESLSRSEMEELLQACEDFPGVALTFTGEKSYYVVG  122

Query: 125  EEVPEIVAYDADLVFTKAKSTSLDALRNQEEIVFQAMYMGLDADVTAFQEAVEEALISKF  184
            E VPE+VAYDA  VFT+AK+ SL+ +  + +++FQAMYM     + AFQ AV++ L    +
Sbjct: 123  NEVPELVAYDAGTVFTEAKARSLEEIFEEGQVIFQAMYMAESEPLDAFQNAVQDRLDQSY  182

Query: 185  SGVRSQDYIYEIMPQGVTKARGLKSLIAKLGLDINQVMAIGDAPNDIELLDLVPNSVA    242
            S VRSQ+YI+E+MPQG TKA GLK L  KL ++ +Q+MA+GDA ND+E+L  V   SVA
Sbjct: 183  STVRSQEYIFEVMPQGATKASGLKHLAEKLDINRDQIMALGDAANDLEMLQFVGQSVA    240
```

A related DNA sequence was identified in *S. pyogenes* <SEQ ID 3517> which encodes the amino acid sequence <SEQ ID 3518>. Analysis of this protein sequence reveals the following:

---

Possible site: 14
>>> Seems to have no N-terminal signal sequence
----- Final Results -----
  bacterial cytoplasm --- Certainty = 0.1468 (Affirmative) <succ>
    bacterial membrane --- Certainty = 0.0000 (Not Clear) <succ>
      bacterial outside --- Certainty = 0.0000 (Not Clear) <succ>

---

An alignment of the GAS and GBS proteins is shown below.

```
Identities = 152/270 (56%), Positives = 193/270 (71%)
Query:   6  KMIKLIAIDMDGTLLNDEKKIPKENIQAIKEATQAGIKIVLCTGRPMSGILPYFNELGLT    65
            +MI+LIAID+DGTLLN +K+IPKENI AI+EA Q+G+KIVLCTGRP SG  PYF++LGLT
Sbjct:  19  RMIQLIAIDLDGTLLNQDKQIPKENITAIQEAAQSGLKIVLCTGRPQSGTRPYFDQLGLT    78

Query:  66  KEEYIIMNNGCSTYSTKDWQLIDSATLTHDELIFLEEVVKEFPNVCLTLTAENTFYAVGE   125
            +EE++I+NNGCSTYS+ DWQL  S  L   ++  LEE+ + FP++ LTLT EN +  + E
Sbjct:  79  QEEFLIINNGCSTYSSPDWQLRHSKMLKVSDIELLEELSQSFPDIYLTLTEENDYLVLEE   138

Query: 126  EVPEIVAYDADLVFTKAKSTSLDALRNQEEIVFQAMYMGLDADVTAFQEAVEEALISKFS   185
            EVP++V  D DLVFT  K  SL  L +    ++FQAMY+G  A + AF+ AV    L  F
Sbjct: 139  EVPDLVQEDGDLVFTIVKPVSLAELSDTPRLIFQAMYLGEKAALDAFERAVRNQLSQSFH   198

Query: 186  GVRSQDYIYEIMPQGVTKARGLKSLIAKLGLDINQVMAIGDAPNDIELLDLVPNSVAMGN   245
             VRSQD I EI+PQGV+KA  LK L+  LGL +QVMAIGDAPNDIE+L     VAM N
Sbjct: 199  VVRSQDNILEILPQGVSKASALKELVEDLGLIADQVMAIGDAPNDIEMLTYAGLGVAMEN   258

Query: 246  ASDEIKSRCKYITVDNNKAGVAKAIYDYAL                                275
            AS  IK     +T+ N+ AGVA+AI  +AL
Sbjct: 259  ASAAIKPLADKVTLTNDMAGVAQAIRQFAL                                288
```

Based on this analysis, it was predicted that these proteins and their epitopes could be useful antigens for vaccines or diagnostics.

Example 1134

A DNA sequence (GBSx1210) was identified in *S. agalactiae* <SEQ ID 3519> which encodes the amino acid sequence <SEQ ID 3520>. Analysis of this protein sequence reveals the following:

Possible site: 18
>>> Seems to have no N-terminal signal sequence
INTEGRAL    Likelihood = −0.43    Transmembrane 7-23 (7-23)
----- Final Results -----
  bacterial membrane --- Certainty = 0.1171 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

```
>GP:AAA26954 GB:J04479 DNA polymerase I [Streptococcus pneumoniae]
Identities = 655/879 (74%), Positives = 748/879 (84%), Gaps = 4/879 (0%)
Query:   3  NKNKLLLIDGSSVAFRAFFALYNQIDRFKNNSGLHINAIYGFHLMLNHILGRVQPSHILV    62
            +K KLLLIDGSSVAFRAFFALY Q+DRFKN +GLHTNAIYGF LML+H+L RV+PSHILV
Sbjct:   2  DKKKLLLIDGSSVAFRAFFALYQQLDRFKNAAGLHTNAIYGFQLMLSHLLERVEPSHILV    61

Query:  63  AFDAGKTTFRTEMYADYKGGRAKTPDEFREQFPYIRQQLDVLGIKEYELEHYEADDIIGT   122
            AFDAGKTTFRTEMYADYKGGRAKTPDEFREQFP+IR+  LD +GI+HYEL  YEADDIIGT
Sbjct:  62  AFDAGKTTFRTEMYADYKGGRAKTPDEFREQFPFIRELLDHMGIRHYELAQYEADDIIGT   121

Query: 123  LAKQAEASNEHFDITVVSGDKDLIQLTDTNTVVEISKKGVAEFEEFTPAYLMEKMGITPS   182
            L K AE   + FDIT+VSGDKDLIQLTD +TVVEISKKGVAEFE FTP YLME+MG+TP+
Sbjct: 122  LDKLAE--QDGFDITIVSGDKDLIQLTDEHTVVEISKKGVAEFEAFTPDYLMEEMGLTPA   179

Query: 183  QFIDLKALMGDKSDNIPGVTKIGEKTGLKLLSEYGSLEGIYENIEAMKQSKMKENLINDK   242
            QFIDLKALMGDKSDNIPGVTK+GEKTG+KLL E+GSLEGIYENI+ MK SKMKENLINDK
Sbjct: 180  QFIDLKALMGDKSDNIPGVIKVGEKTGIKLLLEHGSLEGIYENIDGMKTSKMKENLINDK   239

Query: 243  EQAFLSKTLATINIASPITIGLEDILYSGPQDIKALSQFYDEMDFKQFKAALGEETSQED   302
            EQAFLSKTLATI+   +PI IGLED++YSGP D++  L +FYDEM FKQ K AL      ++
Sbjct: 240  EQAFLSKTLATIDTKAPIAIGLEDLVYSGP-DVENLGKFYDEMGFKQLKQALNMSSADVA   298

Query: 303  FEVDFTEVEQLKTEMFSDNDFYYFEMLGDNYHVEDLGIAWGNSDTIYATSNVSLLQEAL   362
               +DFT V+Q+  +M S+    ++FE+ G+NYH ++L+G AW D    +YAT +  LLQ+ +
Sbjct: 299  EGLDFTIVDQISQDMLSEESIFHFELFGENYHTDNLVGFAWSCGDQLYATDKLELLQDPI   358

Query: 363  FKKALSKP-IKTYDFKRSKVLLNRFNIDLPEPAFDTRLAKYLLSTTEDNLVSTIARLYTN   421
            FK   L K  ++ YDFK+ KVLL RF +DL  PAFD RLAKYLLST EDN ++TIA LY
Sbjct: 359  FKDFLEKTSLRVYDFKKVKVLLQRFGVDLQAPAFDIRLAKYLLSTVEDNEIATIASLYGQ   418

Query: 422  LPLDTDDAVYGKGAKRAIPEKTRFLEHLAKKVKVLVDSEANIMQQLKANEQEELLFEMEQ   481
             L  D+  YGKG K+AIPE+  +FLEHLA K+ VLV++E ++     N Q ELL++MEQ
Sbjct: 419  TYLVDDETFYGKGVKKAIPEREKFLEHLACKLAVLVETEPILLEKLSENGQLELLYDMEQ   478

Query: 482  PLANVLAKMEIRGIKVKKNTLNEMAIENQKVIETLIQEIYELAGQEFNINSPKQLGKLLF   541
            PLA VLAKMEI GI VKK TL EM  EN+ VIE LTQEIYELAG+EFN NSPKQLG LLF
Sbjct: 479  PLAFVLAKMEIAGIVVKKETLLEMQAENELVIEKLTQEIYELAGEEFNVNSPKQLGVLLF   538

Query: 542  ETLGLPVEMIKKTKTGYSTAVDVLERLAPISPLVTKILEYRQITKLQSTYIIGLQDYILE   601
            E LGLP+E  KKTKTGYSTAVDVLERLAPI+P+V  KIL+YRQI K+QSTY+IGLQD+IL
Sbjct: 539  EKLGLPLEYIKKIKTGYSTAVDVLERLAPIAPIVKKILDYRQIAKIQSTYVIGLQDWILA   598
```

```
Query:  602  DGKIHTRYVQDLTQTGRLSSSDPNLQNIPVRLEQGRLIRKAFVPSEDNAVLLSSDYSQIE  661
             DGKIHTRYVQDLTQTGRLSS DPNLQNIP RLEQGRLIRKAFVP +++VLLSSDYSQIE
Sbjct:  599  DGKIHTRYVQDLIQTGRLSSVDPNLQNIPARLEQGRLIRKAFVPEWEDSVLLSSDYSQIE  658

Query:  662  LRVLAHISKDEHLIAAFKEGADIHTSTAMRVFGIEKPENVTPNDRRNAKAVNFGIVYGIS  721
             LRVLAHISKDEHLI AF+EGADIHTSTAMRVFGIE+P+NVT NDRRNAKAVNFG+VYGIS
Sbjct:  659  LRVLAHISKDEHLIKAFQEGADIHTSTAMRVFGIERPDNVTANDRRNAKAVNFGVVYGIS  718

Query:  722  DFGLSENLGIPRKLAKQYIDTYFERYPGIKNYMETVVREAKDKGYVETLFHRRRSLPDIN  781
             DFGLS+NLGI RK AK YIDTYFER+PGIKNYM+ VVREA+DKGYVETLF RRR LPDIN
Sbjct:  719  DFGLSNNLGISRKEAKAYIDTYFERFPGIKNYMDEVVREARDKGYVETLFKRRRELPDIN  778

Query:  782  SRNFNIRQFAERTAINSPIQGSAADILKIAMINLDRVLDKGGYKSKMLLQVHDEIVLEVP  841
             SRNFNIR FAE TAINSPIQGSAADILKIAMI LD+ L  GGY++KMLLQVHDEIVLEVP
Sbjct:  779  SRNFNIRGFAEATAINSPIQGSAADILKIAMIQLDKALVAGGYQTKMLLQVHDEIVLEVP  838

Query:  842  NEEIGAIRELVTKTMESAISLSVPLIADENAGETWYEAK                      880
             +E+   +++LV +TME AI LSVPLIADEN G TWYEAK
Sbjct:  839  KSELVEMKKLVKQTMEEAIQLSVPLIADENEGATWYEAK                      877
```

A related DNA sequence was identified in *S. pyogenes* <SEQ ID 3521> which encodes the amino acid sequence <SEQ ID 3522>. Analysis of this protein sequence reveals the following:

Possible site: 18
>>> Seems to have no N-terminal signal sequence

-continued

INTEGRAL    Likelihood = −0.43    Transmembrane 7-23 (7-23)
----- Final Results -----
    bacterial membrane --- Certainty.0.1171 (Affirmative) <succ>
    bacterial outside --- Certainty = 0.0000 (Not Clear) <succ>
    bacterial cytoplasm --- Certainty = 0.0000 (Not Clear) <succ>

An alignment of the GAS and GBS proteins is shown below.

```
Identities = 665/881 (75%), Positives = 761/881 (85%), Gaps = 2/881 (0%)
Query:    1  MTKNKLLLIDGSSVAFRAFFALYNQIDRFKNNSGLHTNAIYGFHLMLNHILGRVQPSHI   60
             M NKNKLLLIDGSSVAFRAFFALYNQIDRFKN+SGLHTNAIYGFHLML+H++ RVQP+H+
Sbjct:    1  MENKNKLLLIDGSSVAFRAFFALYNQIDREKNHSGLHTNAIYGEHLMLDHMMKRVQPTHV   60

Query:   61  LVAFDAGKTTFRTEMYADYKGGRAKTPDEFREQFPYIRQQLDVLGIKHYELEHYEADDII  120
             LVAFDAGKTTFRTEMYADYK GRAKTP+EFREQFPYIR+ L  LGI +YELEHYEADDII
Sbjct:   61  LVAFDAGKITFRTEMYADYKAGRAKTPEEFREQFPYIREMLTALGIAYYELEHYEADDII  120

Query:  121  GTLAKQAEASNEHFDITVVSGDKDLIQLTDTNTVVEISKKGVAEFEEFTPAYLMEKMGIT  180
             GTL K AE +    FD+T+VSGDKDLIQLTD NTVVEISKKGVAEFEEFTPAYLMEKMG+T
Sbjct:  121  GTLDKMAERTEVPFDVTIVSGDKDLIQLTDENTVVEISKKGVAEFEEFTPAYLMEKMGLT  180

Query:  181  PSQFIDLKALMGDKSDNIPGVTKIGEKTGLKLLSEYGSLEGIYENIEAMKQSKMKENLIN  240
             P+QFIDLKALMGDKSDNIPGVTKIGEKTGLKLL E+GSLEGIYE+I+  K SKMKENLIN
Sbjct:  181  PNQFIDLKALMGDKSDNIPGVTKIGEKTGLKLLHEFGSLEGIYEHIDGFKTSKMKENLIN  240

Query:  241  DKEQAFLSKTLATINIASPITIGLEDILYSGPQDIKALSQFYDEMDFKQFKAALGEETSQ  300
             D++QAFLSKTLATIN ASPITIGL+DI+Y+GP D+ +LSQFYDEMDF Q K  L  + Q
Sbjct:  241  DRDQAFLSKTLATINTASPITIGLDDIVYNGP-DVASLSQFYDEMDFVQLKKGLASQMPQ  299

Query:  301  EDFEV-DFTEVEQLKTEMFSDNDFYYFEMLGDNYHVEDLIGIAWGNSDTIYATSNVSLLQ  359
             E    V + EV + ++FS D   +YFE L DNYH E +IG AWG+ + + IYA++++ LL
Sbjct:  300  EPVAVISYQEVTNVSADLFSAEDIFYFETLRDNYHREAIIGFANGHGEQIYASTDLGLLA  359

Query:  360  EALFKKALSKPIKTYDFKRSKVLLNRFNIDLPEPAFDTRLAKYLLSTTEDNLVSTIARLY  419
                  FK+   KPI TYDFKRSKVLL+   I+L  P++D RLA YLLST EDN +STIAR++
Sbjct:  360  TDSFKQVFQKPIATYDFKRSKVLLSHLGIELVAPSYDARLANYLLSTVEDNELSTIARIF  419

Query:  420  TNLPLDTDDAVYGKGAKRAIPEKTRFLEHLAKKVKVLVDSEANIMQQLKANEQEELLFEM  479
             T++ L+ DD VYGKGAKRA+P+K    LEHLA+KVKVL+DS++ ++ +L A+EQ +L
Sbjct:  420  TDISLEEDDTVYGKGAKRAVPDKDVLLEHLARKVKVLLDSKSQMLDKLTAHEQLDLYQNI  479

Query:  480  EQPLANVLAKMEIRGIKVKKNTLNEMAIENQKVIETLTQEIYELAGQEFNINSPKQLGKL  539
             E PLANVLAKMEI GIKV + TL +MA +N+ +IE LTQEIY+++AGQEFNINSPKQLG +
Sbjct:  480  ELPLANVLAKMEIEGIKVNRATLQDMAEQNKVIIEALTQEIYDMAGQEFNINSPKQLGSI  539

Query:  540  LFETLGLPVEMTKKTKTGYSTAVDVLERLAPISPLVTKILEYRQITKLQSTYIIGLQDYI  599
             LFE + LP+EMTKKTKTGYSTAV+VLERLAPI+P+V KIL+YRQITKLQSTY+IGLQDYI
Sbjct:  540  LFEKMQLPLEMTKKTKTGYSTAVNVLERLAPIAPIVAKILDYRQITKLQSTYVIGLQDYI  599

Query:  600  LEDGKIHTRYVQDLTQTGRLSSSDPNLQNIPVRLEQGRLIRKAFVPSEDNAVLLSSDYSQ  659
             L DGKIHTRYVQDLTQTGRLSS DPNLQNIP+RLEQGRLIRKAF PS ++AVLLSSDYSQ
Sbjct:  600  LADGKIHTRYVQDLTQTGRLSSVDPNLQNIPIRLEQGRLIRKAFTPSHEDAVLLSSDYSQ  659
```

```
-continued
Query:  660  IELRVLAHISKDEHLIAAFKEGADIHTSTAMRVEGIEKPENVTPNDRRNAKAVNEGIVYG  719
             IELRVLAHIS DEHLIAAF EGADIHTSTAMRVFGI++  +VT NDRRNAKAVNFGIVYG
Sbjct:  660  IELRVLAHISGDEHLIAAFNEGADIHTSTAMRVFGIDRAADVTANDRRNAKAVNFGIVYG  719

Query:  720  ISDFGLSHNLGIPRKLAKQYIDTYFERYPGIKNYMETVVREAKDKGYVETLFHRRRSLPD  779
             ISDFGLS+NLGI RK AK YIDTYFERYPGIK YME VVREAKDKGYVETLF RRR LPD
Sbjct:  720  ISDFGLSNNLGITRKQAKSYIDTYFERYPGIKAYMENVVREAKDKGYVETLFKRRRELPD  779

Query:  780  INSRNFNIRQFAERTAINSPIQGSAADILKIAMINLDRVLDKGGYKSKMLLQVHDEIVLE  839
             INSRNFN+R FAERTAINSPIQGSAADILKIAMINLD+ L  GG+++KMLLQVHDEIVLE
Sbjct:  780  INSRNFNVRSFAERTAINSPIQGSAADILKIAMINLDKALQAGGFRAKMLLQVHDEIVLE  839

Query:  840  VPNEEIGAIRELVTKTMESAISLSVPLIADENAGETWYEAK                    880
             VPN+E+ AI++LV  TME+A+ L+VPL  DE+ G +WYEAK
Sbjct:  840  VPNDELTAIKKLVKDTMEAAVDLAVPLCVDESTGHSWYEAK                    880
```

Based on this analysis, it was predicted that these proteins and their epitopes could be useful antigens for vaccines or diagnostics.

Example 1135

A DNA sequence (GBSx1211) was identified in *S. agalactiae* <SEQ ID 3523> which encodes the amino acid sequence <SEQ ID 3524>. Analysis of this protein sequence reveals the following:

Possible site: 30
>>> Seems to have no N-terminal signal sequence
----- Final Results -----
  bacterial cytoplasm --- Certainty = 0.1880 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 9571> which encodes amino acid sequence <SEQ ID 9572> was also identified.

The protein has homology with the following sequences in the GENPEPT database.

A related DNA sequence was identified in *S. pyogenes* <SEQ ID 3525> which encodes the amino acid sequence <SEQ ID 3526>. Analysis of this protein sequence reveals the following:

Possible site: 24
>>> Seems to have no N-terminal signal sequence
----- Final Results -----
  bacterial cytoplasm --- Certainty = 0.0837 (Affirmative) <succ>
  bacterial membrane --- Certainty = 0.0000 (Not Clear) <succ>
  bacterial outside --- Certainty = 0.0000 (Not Clear) <succ>

```
>GP:BAB05860 GB:AP001514 unknown conserved protein [Bacillus halodurans]
Identities = 72/134 (53%), Positives = 94/134 (69%), Gaps = 3/134 (2%)
Query:   17  NPSDFMLKNYLTKAKTIAVVGLSDRQETAAYQVSKIMQEAGYQIIPVNPKNAGQKILGQM   76
             NPSD  +K  L +AK IAVVGLS   +  +Y VS  MQ AGY+IIPVNP     ++LG+
Sbjct:    4  NPSDEKIKQILQEAKRIAVVGLSGNPDRISYMVSAAMQHAGYEIIPVN--TVDEVLGEK   61

Query:   77  TYASLKDVTEHIDIVNIFRRSEYLPDIAREFLEVDADIFWAQLGLESQEAETILKQAGHK  136
                SL+D+    +DIVN+FRRSE+LPD+ARE +E+ A +FWAQLGLE++EA    L+Q G
Sbjct:   62  AVPSLQDIEGAVDIVNVFRRSEHLPDVARETVEIGAPVFWAQLGLENKEAYDYLQQHGVT  121

Query:  137  QIVMNKCLKVECQK                                               150
              I MN+C+KVE  K
Sbjct:  122  SI-MNRCIKVEHAK                                               134
```

An alignment of the GAS and GBS proteins is shown below.

```
Identities = 87/141 (61%), Positives = 114/141 (80%)
Query:   11  MVYHFQNPSDFMLKNYLTKAKTIAVVGLSDRQETAAYQVSKIMQEAGYQIIPVNPKNAGQ   70
             ++Y FQNPS+ +LK YL  AKTIAVVGLSDR++TAAY V+K MQ    Y+IIPVNPK AGQ
Sbjct:    1  VIYSFQNPSEDVLKAYLESAKTIAVVGLSDRKDTAAYGVAKFMQAMDYRIIPVNPKLAGQ   60

Query:   71  KILGQMTYASLKDVTEHIDIVNIFRRSEYLPDIAREFLEVDADIFWAQLGLESQEAETIL  130
              ILG+  YAS+K   +DIV++FRRSE+LP++AR+FL   A +FWAQLGLE+QEA+TIL
Sbjct:   61  LILGEKVYASIKAIPFEVDIVDVFRRSEFLPEVARDFLAGQAKVFWAQLGLENQEAQTIL  120
```

```
                                          -continued
Query: 131  KQAGHKQIVMNKCLKVECQKL                                      151
            + AG + IVMN+CLK++  +L
Sbjct: 121  RSAGKEAIVMNRCLKIDYLQL                                      141
```

Based on this analysis, it was predicted that these proteins and their epitopes could be useful antigens for vaccines or diagnostics.

Example 1136

A DNA sequence (GBSx1212) was identified in *S. agalactiae* <SEQ ID 3527> which encodes the amino acid sequence <SEQ ID 3528>. Analysis of this protein sequence reveals the following:

---

Possible site: 13
>>> Seems to have no N-terminal signal sequence
----- Final Results -----
    bacterial cytoplasm --- Certainty = 0.3367 (Affirmative) <succ>
        bacterial membrane --- Certainty = 0.0000 (Not Clear) <succ>
            bacterial outside --- Certainty = 0.0000 (Not Clear) <succ>

---

A related GBS nucleic acid sequence <SEQ ID 9573> which encodes amino acid sequence <SEQ ID 9574> was also identified.

A related DNA sequence was identified in *S. pyogenes* <SEQ ID 3529> which encodes the amino acid sequence <SEQ ID 3530>. Analysis of this protein sequence reveals the following:

---

Possible site: 49
>>> Seems to have no N-terminal signal sequence
----- Final Results -----
    bacterial cytoplasm --- Certainty = 0.4960 (Affirmative) <succ>
        bacterial membrane --- Certainty = 0.0000 (Not Clear) <succ>
            bacterial outside --- Certainty = 0.0000 (Not Clear) <succ>

---

An alignment of the GAS and GBS proteins is shown below.

```
Identities = 113/151 (74%), Positives = 133/151 (87%), Gaps = 1/151 (0%)
Query:   7  MDSHSHGHRPLDAYENVLEHLREKRIRITETRKAIISYMVNSREHPSAEKIYNDLLPEYP   66
            MD HSH +  LDAYENVLEHLREK IRITETRKAIISYM+ S EHPSA+KIY DL P +P
Sbjct:   1  MDIHSH-QQALDAYENVLEHLREKHIRITETRKAIISYMIQSTEHPSADKIYRDLQPNFP   59

Query:  67  NMSLATVYNNLKVLVDEGFVTELKLCNYSTTYYDFMGHQHLNIACEDCGKIVDFVDVDLL  126
            NMSLATVYNNLKVLVDEGFV+ELK+ N  TTYYDFMGHQH+N+ CE CGKI DF+DVD++
Sbjct:  60  NMSLATVYNNLKVLVDEGFVSELKISNDLTTYYDFMGHQHVNVVCEICGKIADFMDVDVM  119

Query: 127  DISREAHQQTGFEVTRVQLVAYGICPECQRK                              157
            DI++EAH+QTG++VTR+ ++AYGICP+CQ K
Sbjct: 120  DIAREAHEQTGYKVTRIPVIAYGICPDCQAK                              150
```

Based on this analysis, it was predicted that these proteins and their epitopes could be useful antigens for vaccines or diagnostics.

Example 1137

A DNA sequence (GBSx1213) was identified in *S. agalactiae* <SEQ ID 3531> which encodes the amino acid sequence <SEQ ID 3532>. Analysis of this protein sequence reveals the following:

Possible site: 39
>>> Seems to have no N-terminal signal sequence
INTEGRAL    Likelihood = −2.13    Transmembrane 16-32 (14-32)
INTEGRAL    Likelihood = −1.81    Transmembrane 496-512 (496-515)
----- Final Results -----
    bacterial membrane --- Certainty = 0.1850 (Affirmative) <succ>
        bacterial outside --- Certainty = 0.0000 (Not Clear) <succ>
            bacterial cytoplasm --- Certainty = 0.0000 (Not Clear) <succ>

The protein has homology with the following sequences in the GENPEPT database.

```
>GP:CAA06650 GB:AJ005645 sdrc [Staphylococcus aureus]
Identities = 41/146 (28%), Positives = 63/146 (43%), Gaps = 13/146 (8%)
Query:    4  SQYNKWSIRRLKVGAASVMIASGSIVALGQSHIVSAD----EMSQPKTTITAPTANTSTN    59
             ++ NK+SIR+  VG AS+++ +  I  L       +A+   E++Q K   TAP+ N +T
Sbjct:   16  NRLNKFSIRKYSVGTASILVGTTLIFGLSGHEAKAAEHTNGELNQSKNETTAPSENKTT-   74

Query:   60  VESSTDKALSKVTTMETSSEMPK--MQNMAKVEKTSDKPMMVATSVRKMMATPTPVAMT-   116
                     D    K  T    +++ PK   M + A V++TS           +    TT    T
Sbjct:   75  --KKVDSRQLKDNTQTATADQPKVTMSDSATVKETSSNMQSPQNATANQSTTKTSNVTTN  132

Query:  117  ---KTTSVDEVKKSTDTAFKQTVDVP                                    139
                TT  +E  KS   T   K      P
Sbjct:  133  DKSSTTYSNETDKSNLTQAKDVSTTP                                    158
```

No corresponding DNA sequence was identified in *S. pyogenes*.

A related GBS gene <SEQ ID 8735> and protein <SEQ ID 8736> were also identified. Analysis of this protein sequence reveals the following:

Lipop: Possible site: −1    Crend: 7
McG: Discrim Score: −0.92
GvH: Signal Score (−7.5) : −2.48
Possible site: 39
>>> Seems to have no N-terminal signal sequence
ALOM program    count: 2  value: −2.13    threshold: 0.0
INTEGRAL    Likelihood = −2.13    Transmembrane 16-32 (14-32)
INTEGRAL    Likelihood = −1.81    Transmembrane 496-512 (496-515)
PERIPHERAL    Likelihood = 7.96    402
modified ALOM score: 0.93
*** Reasoning Step: 3
----- Final Results -----
    bacterial membrane --- Certainty = 0.1850 (Affirmative) <succ>
        bacterial outside --- Certainty = 0.0000 (Not Clear) <succ>
            bacterial cytoplasm --- Certainty = 0.0000 (Not Clear) <succ>
LPXTG motif: 485-489

The protein has homology with the following sequences in the databases:

```
D|5981|5780 leukotoxin > Insert characterized
SP|P16462|HLYA_ACTAC LEUKOTOXIN. > Edit characterized
GP|141834|gb|AAA21922.1||M27399 leukotoxin (LtA) {Actinobacillus
actinomycetemcomitans} Insert characterized
Query:  210  VSLNGNTTGKEGQALLDQI|AND---KHSYQATIRVYGAKDGKVDLKNMISPKMVTINIP   266
             ++ NG+    + G+A +D +K  +    KHS + T ++      G +DL  +     +T   P
Sbjct:  488  ITRNGDRI-QSGKAYVDYLKKGEELAKHSDKFTKQILDPIKGNIDLSGIKGSTTLTFLNP   546

Query:  267  HITTDMEVKNSLKMAFKEKV-DVPAKYVSAAKAKG-PFLAGVNE--TIPYEAFGGDGMLT   322
             +T    E + + +     E + ++   K   +  KG P    GV +   +  A    D  +
Sbjct:  547  LLTAGKEERKTRQSGKYEFITELKVKGRTDWKVKGVPNSNGVYDFSNLIQHAVTRDNKVL   606

Query:  323  RLILKASEGAKWSDNGVDKNSPLL------PLKDLTKGKYFYQVSLNGNTAGKKGQALLD   376
                   L A+ GAK        V     S ++         + D +KG+     ++++G   A K GQ   ++
Sbjct:  607  EARLIANLGAKDDYVFVGSGSTIVNAGDGYDVVDYSKGRTG-ALTIDGRNATKAGQYKVE   665

Query:  377  QIKANGSHTYQATITIYGTKDGKV                                      400
             +     +G+    Q T++       TK GKV
Sbjct:  666  R-DLSGTQVLQETVSKQETKRGKV                                      688
```

SEQ ID 3532 (GBS1) was expressed in *E. coli* as a GST-fusion product. SDS-PAGE analysis of total cell extract is shown in FIG. 1 (lane 3; MW 78 kDa). It was also expressed in *E. coli* as a His-fusion product. SDS-PAGE analysis of total cell extract is shown in FIG. 2 (lane 3; MW 53 kDa).

The His-fusion protein was purified as shown in FIG. 189, lane 5.

Based on this analysis, it was predicted that these proteins and their epitopes could be useful antigens for vaccines or diagnostics.

Example 1138

A DNA sequence (GBSx1214) was identified in *S. agalactiae* <SEQ ID 3533> which encodes the amino acid sequence <SEQ ID 3534>. This protein is predicted to be response regulator (regX3). Analysis of this protein sequence reveals the following:

Possible site: 32
>>> Seems to have no N-terminal signal sequence
----- Final Results -----
   bacterial cytoplasm --- Certainty = 0.3585 (Affirmative) <succ>
      bacterial membrane --- Certainty = 0.0000 (Not Clear) <succ>
        bacterial outside --- Certainty = 0.0000 (Not Clear) <succ>

The protein has homology with the following sequences in the GENPEPT database.

```
>GP:CAB54578 GB:AJ006397 response regulator [Streptococcus pneumoniae]
Identities = 143/228 (62%), Positives = 183/228 (79%), Gaps = 1/228 (0%)
Query:   1 MTQKLLLVDDEFEIIDINRRYLEQAGYEVSVAADGIEALKEVDENRFDLIISDIMMPKMD   60
           M + +LLVDDE EI DI++RYL QAGY+V VA DG+EAL+   +    DLII+D+MMP+MD
Sbjct:   1 MGKTILLVDDEVEITDIHQRYLIQAGYQVLVAHDGLEALELFKKKPIDLIITDVMMPRMD   60

Query:  61 GYDFISEVLVREPNQPFLFITAKVSEPDKIYSLSMGADDFISKPFSPRELVLRVKNILRR  120
           GYD ISEV    P QPFLFITAK SE DKIY LS+GADDFI+KPFSPRELVLRV NILRR
Sbjct:  61 GYDLISEVQYLSPEQPFLFITAKTSEQDKIYGLSLGADDFIAKPFSPRELVLAVHNILRR  120

Query: 121 IYGNHQQSEVLTIGDLVIDQKQRLVMVDCNTISLTNKSFDLLWILANHLNRVFSKTELYE  180
           ++      ++E++++G+L ++      V +    + LT KSF+LLWILA++  RVFSKT+LYE
Sbjct: 121 LH-RGGETELISLGNLKMNHSSHEVQIGEEMLDLTVKSFELLWILASNPERVFSKTDLYE  179

Query: 181 RVWGEEFLDDTNTLNVHIHALRNDLAKFSTDNTPTIKTVWGLGYKLEE              228
           ++W E+++DDTNTLNVHIHALR  LAK+S+D TPTIKTVWGLGYK+E+
Sbjct: 180 KIWKEDYVDDTNTLNVHIHALRQELAKYSSDQTPTIKTVWGLGYKIEK              227
```

There is also homology to SEQ ID 1182.

Based on this analysis, it was predicted that this protein and its epitopes, could be useful antigens for vaccines or diagnostics.

Example 1139

A DNA sequence (GBSx1215) was identified in *S. agalactiae* <SEQ ID 3535> which encodes the amino acid sequence <SEQ ID 3536>. This protein is predicted to be histidine kinase (resE). Analysis of this protein sequence reveals the following:

Possible site: 25
>>> Seems to have an uncleavable N-term signal seq
INTEGRAL    Likelihood = −9.13    Transmembrane 42-58 (33-65)
INTEGRAL    Likelihood = −7.54    Transmembrane 7-23 (3-29)
----- Final Results -----
   bacterial membrane --- Certainty = 0.4652 (Affirmative) <succ>
     bacterial outside --- Certainty = 0.0000 (Not Clear) <succ>
     bacterial cytoplasm --- Certainty = 0.0000 (Not Clear) <succ>

The protein has homology with the following sequences in the GENPEPT database.

```
>GP:CAB54579 GB:AJ006397 histidine kinase [Streptococcus pneumoniae]
Identities = 190/343 (55%), Positives = 249/343 (72%)
Query:   1 MKLKYYIVIGYLISMLITVAGVFFGLNHMLIETRGVYYILSVTIIACIVGGIVNLFLLSS   60
           MKLK YI++GY+IS L+T+  VF+ +   MLI    +Y++L +TI+A +VG  ++LFLL
Sbjct:   1 MKLKSYILVGYIISTLLTILVVFWAVQKMLIAKGEIYFLLGMTIVASLVGAGISLELLLP   60

Query:  61 VFTSLKKLKQKMKDISQRCFDTKAQICSPQEFKDLETAFNQMSSELESTFKSLNESEREK  120
           VFTSL KLK+ K ++ + F +  ++  P EF+  L     FN+MS +L+ +F SL ESEREK
Sbjct:  61 VFTSLGKLKEHAERVAAKDFPSNLEVQGPVEFQQLGQTFNEMSHDLQVSFDSLEESEREK  120

Query: 121 TMMIAQLSHDIKTPITSIQSTVEGIIDGIISEEEVNYYLNTISRQTNRLNHLVEELSFIT  180
           +MIAQLSHDIKTPITSIQ+TVEGILDGII E E  +YL TI RQT RLN LVEEL+F+T
Sbjct: 121 GLMIAQLSHDIKTPITSIQATVEGILDGIIKESEQAHYLATIGRQTERLNKLVEELNFLT  180

Query: 181 LETMSDTAEPHKEETIYLDKLLIDILSEFQLVFEKENRQVMIDVAPDVSKLSSQYDKLSR  240
           L T  +   E     +++I+LDKLLI+ +SEFQ + E+E R V + V P+ +++     Y KLSR
Sbjct: 181 LNTARNQVETTSKDSIFLDKLLIECMSEFQFLIEQERRDVHLQVIPESARIEGDYAKLSR  240

Query: 241 ILLNLISNAVKYSDPGSPLTIKAYSNRQDIVIDIIDQGYGIKDEDLASIFNRLYRVESSR  300
           IL+NL+ NA KYS PG+ L + A   + + I + D+G GI  EDL +IF RLYRVE+SR
Sbjct: 241 ILVNLVDNAFKYSAPGTKLEVVAKLEKDQLSISVTDEGQGIAPEDLENIFKRLYRVETSR  300

Query:  30 NMKTGGHGLGLYIARQLAHQLNGDILVESQYQKGSKFSLVLKL                   343
           NMKTGGHGLGL IAR+LAHQL G+I V SQY  GS F+LVL L
Sbjct: 301 NMKTGGHGLGLAIARELAHQLGGEITVSSQYGLGSTFTLVLNL                   343
```

There is also homology to SEQ ID 1178.

A related GBS gene <SEQ ID 8737> and protein <SEQ ID 8738> were also identified. Analysis of this protein sequence reveals the following:

---

Lipop: Possible site: −1   Crend: 3
McG: Discrim Score: 8.67
GvH: Signal Score (−7.5) : −5.75
Possible site: 25
>>> Seems to have an uncleavable N-term signal seq
ALOM program   count: 2   value: −9.13   threshold: 0.0
INTEGRAL     Likelihood = −9.13   Transmembrane 42-58 (33-65)
INTEGRAL     Likelihood = −7.54   Transmembrane 7-23 (3-29)
PERIPHERAL   Likelihood = 3.92    196
modified ALOM score: 2.33
*** Reasoning Step: 3
----- Final Results -----
   bacterial membrane --- Certainty = 0.4652 (Affirmative) <succ>
      bacterial outside --- Certainty = 0.0000 (Not Clear) <succ>
         bacterial cytoplasm --- Certainty = 0.0000 (Not Clear) <succ>

---

The protein has homology with the following sequences in the databases:

---

```
55.3/72.7% over 343aa
Streptococcus pneumoniae
GP|5830539| histidine kinase Insert characterized
ORF00129(301-1332 of 1635)
GP|5830539|emb|CAB54579.1||AJ006397(1-344 of 350) histidine kinase {Streptococcus
pneumoniae}
% Match = 34.0
% Identity = 55.2 % Similarity = 72.7
Matches = 190 Mismatches = 94 Conservative Sub.s = 60

42          72         102         132         162         192         222         252
VIWLSTKNNVW*WWTAIQFP*PINHLTCFGY*QII*IVFFQKQSFMNVSGAKNF*MTLIL*MFISMPYAMTLLNLVQTIP 282         312         342         372         402         432         462         492
QLSKQFGD*GIN*RNKMKLKYYIVIGYLISMLITVAGVFFGLNMHLIETRGVYYILSVTIIACIVGGIVNLFLLSSVFTS
                    ||||  ||::||:||  |:|:   ||:     |||       :|::|  :||:  :||   ::||||    ||||
                    MKLKSYILVGYIISTLLTILVVFWAVQKMLIAKGEIYFLLGMTIVASLVGAGISLFLLLPVFTS
                         10          20          30          40          50          60

522         552         582         612         642         672         702         732
LKKKLKQKMKDISQRCFDTKAQICSPQEFKDLETAFNQMSSELESTFKSLNESEREKTMMIAQLSHDIKTPITSIQSTVEG
|  |||:    |  ::  :    |   :   ::     ||:  |      ||:||   :|:    :|  || ||||||| :||||||||||||||||:||||
LGKLKEHAKRVAAKDFPSNLEVQGPVEFQQLGQTFNEMSHDLQVSFDSLEESEREKGLMIAQLSHDIKTPITSIQATVEG
          80          90         100         110         120         130         140

762         792         822         852         882         912         942         972
ILDGIISEEEVNYYLNTISRQTNRLNHLVEELSFITLETMSDTAEPHKEETIYLDKLLIDILSEFQLVFEKENRQVMIDV
||||||  |   :||  |||  ||||||:|:||  |   |        :  :::||||||   :|||||::  :||||
ILDGIIKESEQAHYLATIGRQTERLNKLVEELNFLTLNTARNQVETTSKDSIFLDKLLIECMSEFQFLIEQERRDVHLQV
          160         170         180         190         200         210         220

1002        1032        1062        1092        1122        1152        1182        1212
APDVSKLSSQYDKLSRILLNLISNAXKYSDPGSPLTIKAYSNRQDIVIDIIDQGYGIKDEDLASIFNRLYRVESSRNMKT
 |: :::    |   |||||||:||: ||  ||| ||: |  :  :   :    |    |  |:|  ||| |||||:||  ||||||:|||||
IPESARIEGDYAKLSRILVNLVDNAFKYSAPGTKLEVVAKLEKDQLSISVTDEGQGIAPEDLENIFKRLYRVETSRNMKT
          240         250         260         270         280         290         300

1242        1272        1302        1332        1362        1392        1422        1452
GGHGLGLYIARQLAHQLNGDILVESQYQKGSKFSLVLKLQK*LGIIPSYFL*CFYKRLSAQ*FGKEGDRYRLIRN*RL*G
|||||||  |||:|||||  |:|   |||   ||  ||:|||  |
GGHGLGLAIARELAHQLGGEITVSSQYGLGSTFTLVLNLSGSENKA
          320         330         340         350
```

---

Figure 157:
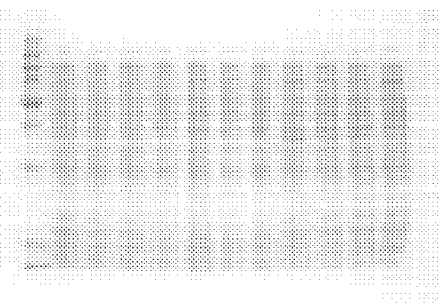
Figure 158:
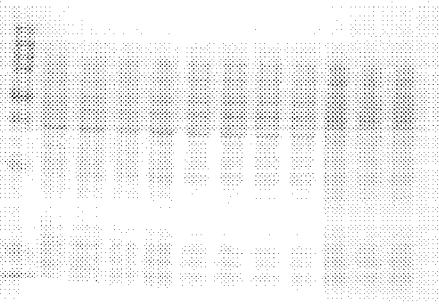

SEQ ID 8738 (GBS28) was expressed in *E. coli* as a GST-fusion product. SDS-PAGE analysis of total cell extract is shown in FIG. 14 (lane 3; MW 64 kDa). It was also expressed in *E. coli* as a His-fusion product. SDS-PAGE analysis of total cell extract is shown in FIG. 85 (lane 5; MW 38.8 kDa) and in FIG. 157 (lane 9-11; MW 39 kDa).

GBS28-His was purified as shown in FIG. 221, lane 6-7.

Based on this analysis, it was predicted that these proteins and their epitopes could be useful antigens for vaccines or diagnostics.

Example 1140

A DNA sequence (GBSx1216) was identified in *S. agalactiae* <SEQ ID 3537> which encodes the amino acid sequence <SEQ ID 3538>. Analysis of this protein sequence reveals the following:

---

Possible site: 19
>>> Seems to have no N-terminal signal sequence
INTEGRAL     Likelihood = −7.70   Transmembrane 125-141 (110-155)
INTEGRAL     Likelihood = −7.59   Transmembrane 38-54 (36-56)
INTEGRAL     Likelihood = −6.48   Transmembrane 146-162 (143-174)
INTEGRAL     Likelihood = −5.57   Transmembrane 72-88 (63-93)
INTEGRAL     Likelihood = −1.33   Transmembrane 229-245 (227-245)
----- Final Results -----
   bacterial membrane --- Certainty = 0.4079 (Affirmative) <succ>

-continued bacterial outside --- Certainty = 0.0000 (Not Clear) <succ>
      bacterial cytoplasm --- Certainty = 0.0000 (Not Clear) <succ>

A related GBS nucleic acid sequence <SEQ ID 9575> which encodes amino acid sequence <SEQ ID 9576> was also identified.

The protein has homology with the following sequences in the GENPEPT database.

```
>GP:CAA79984 GB:Z21972 ORF1 [Bacillus megaterium]
Identities = 35/119 (29%), Positives = 62/119 (51%), Gaps = 15/119 (12%)
Query: 142  SSFRLLLSGNLILAPVLIVVSSLITTKAVIKLV---QQYYSYSISTLVFYTQLESGNYEG  198
            +SF+L+   +++ A  + + S L+    +IK +   QQ++   +    YT LE+
Sbjct: 105  TSFKLI-GASILQAIFIFLWSLLLIIPGIIKAIAYSQQFFL--LKDHPEYTVLEA-----  156

Query: 199  PSKVLVASRELMNGNKLRLFLLDLSFIGWQFLTIFSFGLVYIYLLPYQTTARLIFYRNI   257
            +   S++ M G K + FL+ LSFIGW  L +F+ G+  ++L+PY  T      FY  +
Sbjct: 157  ----ITESKKRMKGLKWKYFLMHLSFIGWGILCMFTLGIGLLWLIPYAGITTAAFYEEL   211
```

A related DNA sequence was identified in *S. pyogenes* <SEQ ID 3539> which encodes the amino acid sequence <SEQ ID 3540>. Analysis of this protein sequence reveals the following:

```
Possible site: 54
>>> Seems to have an uncleavable N-term signal seq
INTEGRAL    Likelihood = -10.08   Transmembrane 148-164 (143-170)
INTEGRAL    Likelihood = -8.28    Transmembrane 114-130 (101-141)
INTEGRAL    Likelihood = -6.69    Transmembrane 60-76 (49-82)
INTEGRAL    Likelihood = -3.72    Transmembrane 21-37 (21-39)
INTEGRAL    Likelihood = -2.34    Transmembrane 222-238 (221-239)
----- Final Results -----
    bacterial membrane --- Certainty = 0.5034 (Affirmative) <succ>
       bacterial outside --- Certainty = 0.0000 (Not Clear) <succ>
          bacterial cytoplasm --- Certainty = 0.0000 (Not Clear) <succ>
```

The protein has homology with the following sequences in the databases:

```
>GP:CAA79984 GB:Z21972 ORF1 [Bacillus megaterium]
Identities = 63/220 (28%), Positives = 100/220 (44%), Gaps = 31/220 (14%)
Query:  62  LGLILSLFILSASFTMI-DVVRHFRQKVSFAESTTAFSKEFFGNLLVLAITKWLFFLIWS  120
            + L+L LF+++  F +I +V+        + T   + F   +A+      L   S
Sbjct:  22  VSLMLLLFLINLVFPLIVEVIGSGGFSEWLMQEETPLWSDIFSMVFSIALIP----LTIS   77

Query: 121  LIWFF-------------GLFIFLSGLSAFLVNAKSGSSTVISLIFLLFGAVLSLIGFGI  167
            WF+             I +G ++F +    G+S + ++   L+  +L + G
Sbjct:  78  TTWFYLNLVREGNPGIPEVFAIYKDGKTSFKL---IGASILQAIFIFLWSLLLIIPG---  131

Query: 168  YINRYYAYSLSEYLLYDEVKEGTYLGAIAVIETSVAMMKGYKWKLFFLQLSFTGWFLLNI  227
            I +  AYS  +LL D   E T L AI    S   MKG KWK F + LSF GW +L +
Sbjct: 132  -IIKAIAYSQQFFLLKDH-PEYTVLEAIT---ESKKRMKGLKWKYFLMHLSFIGWGILCM  186

Query: 228  VTFGLLNIYLLPYFTTANVIFYDQLKKRFKDKDD--PIEG                     265
            T G+  ++L+PY  T     FY++L     +D DD   IEG
Sbjct: 187  FTLGIGLLWLIPYAGTTTAAFYEELIVPQEDIDDDQQIEG                     226
```

An alignment of the GAS and GBS proteins is shown below.

```
Identities = 87/254 (34%), Positives = 137/254 (53%), Gaps = 10/254 (3%)
Query:  16  MTNSEIKNEAKTILSNLQGKNQLFLLPILLSIITLYISFYYQYN-----NMTLLDFFVPL   70
            M+   IK +A+  L NL GK LFL+P LL  +   I + Y     ++L   + PL
Sbjct:   1  MSIKAIKGQARDTLKNLSGKYLLFLIPTLLFMFHFGIEIHQGYVLSSGIEVSLAASYFPL   60

Query:  71  PVYFFYTLFIISVSFVMLDVVKNQKLNVRFSDNTYVFSSHIFWKLLSVLVLKGLILSFFY  130
            +    +LFI+S SF M+DVV++ +   V F+++T  FS    F   LL + + K L       +
Sbjct:  61  LLGLILSLFILSASFTMIDVVRHFRQKVSFAESTTAFSKEFFGNLLVLAITKWLFFLIWS  120

Query: 131  LLSTFGLLIIISSFRLLL-----SGNLILAPVLIVVSSLITTKAVIKLVQQYYSYSISTL  185
            L+  FGL I +S       L        + +++ + ++   ++++         + +YY+YS+S
Sbjct: 121  LIWFFGLFIFLSGLSAFLVNAKSGSSTVISLIFLLFGAVLSLIGFGIYINRYYAYSLSEY  180
```

-continued
```
Query:  186 VFYTQLESGNYEGPSKVLVASRELMNGNKLRLFLLDLSFIGWQFLTIFSFGLVYIYLLPY 245
            + Y +++ G Y G    V+  S  +M G K +LF L LSF GW   L I +FGL+  IYLLPY
Sbjct:  181 LLYDEVREGTYLGAIAVIETSVAMMKGYKWKLFFLQLSFTGWFLLNIVTFGLLNIYLLPY 240

Query:  246 QTTARLIFYRNITK                                               259
            TTA +IFY +  K
Sbjct:  241 FTTANVIFYDQLKK                                               254
```

A related GBS gene <SEQ ID 8739> and protein <SEQ ID 8740> were also identified. Analysis of this protein sequence reveals the following:

Lipop: Possible site: −1  Crend: 4
McG: Discrim Score: −11.32
GvH: Signal Score (−7.5) : −5.39
Possible site: 19
>>> Seems to have no N-terminal signal sequence
ALOM program  count: 5  value: −7.70 threshold: 0.0
INTEGRAL      Likelihood = −7.70  Transmembrane 125-141 (110-155)
INTEGRAL      Likelihood = −7.59  Transmembrane 38-54 (34-56)
INTEGRAL      Likelihood = −6.48  Transmembrane 146-162 (143-174)
INTEGRAL      Likelihood = −5.57  Transmembrane 72-88 (63-93)
INTEGRAL      Likelihood = −1.33  Transmembrane 229-245 (227-245)
PERIPHERAL    Likelihood = 0.37   105
modified ALOM score: 2.04
*** Reasoning Step: 3
----- Final Results -----
  bacterial membrane --- Certainty = 0.4079 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the databases:

```
ORF00498(901-1071 of 1383)
EGAD|19922|20421(155-211 of 226) hypothetical protein {Bacillus megaterium}
GP|288299|emb|CAA79984.1||Z21972 ORF1 {Bacillus megaterium} PIR|S32215|S32215
hypothetical protein 1 - Bacillus megaterium
% Match = 4.8
% Identity = 36.8 % Similarity = 61.4
Matches = 21 Mismatches = 22 Conservative Sub.s = 14

741         771         801         831         861         891         921         951
LIIISSFRLLLSGNLILAPVLIVVSSLITTKAVIKLVQQYYSYSISTLVFYTQLESGNYEGPSKVLVASRELMNGNKLRL
                                                     :  :  |::  | | |  :
GIPEVFAIYKDGKTSFKLIGASILQAIFIFLWSLLLIIPGIIKAIAYSQQFFLLKDHPEYTVLEAITESKKRMKGLKWKY
            110         120         130         140         150         160         170

981         1011        1041        1071        1101        1131        1161        1191
FLLDLSFIGWQFLTIFSFGLVYIYLLPYQTTARLIFYRNITKNS*E*FLAIFVI*VLKRTYCLFDTDFRPKPKYPHSVDVQV
||: |||||| | :|::|:  ::|:|| |    ||  :
FLMHLSFIGWGILCMFTLGIGLLWLIPYAGTTTAAFYEELIVPQEDIDDDQQIEG
            190         200         210         220
```

Based on this analysis, it was predicted that these proteins and their epitopes could be useful antigens for vaccines or diagnostics.

Example 1141

A DNA sequence (GBSx1217) was identified in *S. agalactiae* <SEQ ID 3541> which encodes the amino acid sequence <SEQ ID 3542>. This protein is predicted to be tRNA-guanine transglycosylase (tgt). Analysis of this protein sequence reveals the following:

Possible site: 54
>>> Seems to have no N-terminal signal sequence
----- Final Results -----
  bacterial cytoplasm --- Certainty = 0.3706 (Affirmative) <succ>
    bacterial membrane --- Certainty = 0.0000 (Not Clear) <succ>
      bacterial outside --- Certainty = 0.0000 (Not Clear) <succ>

A related GBS nucleic acid sequence <SEQ ID 9577> which encodes amino acid sequence <SEQ ID 9578> was also identified.

The protein has homology with the following sequences in the GENPEPT database.

```
>GP:CAB14731 GB:Z99118 tRNA-guanine transglycosylase [Bacillus subtilis]
 Identities = 269/377 (71%), Positives = 320/377 (84%)
```

```
                        -continued
Query:  12 MTDHPIKYRLIKQEKHTGARLGEIITPHGTFPTPMFMPVGTQATVKTQSPEELKEMGSGI  71
           M +PI+Y   IK+ K TGARLG++ TPHG+F TP+FMPVGT ATVKT SPEELK M +GI
Sbjct:   1 MAEQPIRYEFIKECKQTGARLGKVHTPHGSFETPVFMPVGTLATVKTMSPEELKAMDAGI  60

Query:  72 ILSNTYHLWLRPGDELIAKAGGLHKFMNWDQAILTDSGGFQVYSLADSRNITEEGVTFKN 131
           ILSNTYHLWLRPG +++ +AGGLHKFMNWD+AILTDSGGFQV+SL+  RNI EEGV F+N
Sbjct:  61 ILSNTYHLWLRPGQDIVKEAGGLHKFMNWDRAILTDSGGFQVFSLSKFRNIEEEGVHYRN 120

Query: 132 HLNGAKMFLSPEKAISIQNNLGSDIMMSFDECPQFYQPYDYVKKSIERTSRWAERGLNAH 191
           HLNG K+FLSPEKA+ IQN LGSDIMM+FDECP +  YDY+K+S+ERTSRWAER LMAH
Sbjct: 121 HLNGDKLFLSPEKAMEIQNALGSDIMMAFDECPPYPAEYDYMKRSVERTSRWAERCLNAH 180

Query: 192 RRPHDQGLFGIVQGAGFEDLRRQSARDLVSMDFPGYSIGGLAVGETHDEMNAVLDFTVPM 251
           R    +QGLFGIVQG  +EDLR QSA+DL+S+DFPGY+IGGL+VGE   D MN VL+FT P+
Sbjct: 181 NRQDEQGLFGIVQGGEYEDLRTQSAKDLISLDFPGYAIGGLSVGEPKDVMNRVLEFTTPL 240

Query: 252 LPNDKPRYLMGVGAPDSLIDAVIRGVDMFDCVLPTRIARNGTCMTSQGRLVVKNAKFAED 311
           LP DKPRYLMGVG+PD+LID   IRGVDMFDCVLPTRIARNGT  T++GRL +KNAKF  D
Sbjct: 241 LPKDKPRYLMGVGSPDALIDGAIRGVDMFDCVLPTRIARNGTVFTAEGRLNMKNAKFERD 300

Query: 312 FTPLDPNCDCYTCKNYTRAYIRHLLKADETFGIRLTSYHNLYFLVNLMKDVRQAIMDDNL 371
           F  P+D   CDCYTCKNYTRAYIRHL++  +ETFG+RLT+YHNL+FL++LM+ VRQAI +D L
Sbjct: 301 FRPIDEECDCYTCKNYTRAYIRHLIRCNETFGLRLTTYHNLHFLLHLMEQVRQAIREDRL 360

Query: 372 LEFRQDFMERYGYGMNN                                           388
               +FR++F ERYGY    N
Sbjct: 361 GDFREEFFERYGYNKPN                                           377
```

A related DNA sequence was identified in *S. pyogenes* <SEQ ID 3543> which encodes the amino acid sequence <SEQ ID 3544>. Analysis of this protein sequence reveals the following:

---

Possible site: 43
>>> Seems to have no N-terminal signal sequence
----- Final Results -----
  bacterial cytoplasm --- Certainty = 0.2590 (Affirmative) <succ>
    bacterial membrane --- Certainty = 0.0000 (Not Clear) <succ>
      bacterial outside --- Certainty = 0.0000 (Not Clear) <succ>

---

An alignment of the GAS and GBS proteins is shown below.

```
Identities = 351/380 (92%), Positives = 368/380 (96%)
Query:  12 MTDHPIKYRLIKQEKHTGARLGEIITPHGTFPTPMFMPVGTQATVKTQSPEELKEMGSGI  71
           MTD+PIKYRLIK EKHTGARLGEIITPHGTFPTPMFMPVGTQATVKTQSPEELK +GSGI
Sbjct:   1 MTDYPIKYRLIKAEKHTGARLGEIITPHGTFPTPMFMPVGTQATVKTQSPEELKAIGSGI  60

Query:  72 ILSNTYHLWLRPGDELIAKAGGLHKFMNWDQAILTDSGGFQVYSLADSRNITEEGVTFKN 131
           ILSNTYHLWLRPGDELIA++GGLHKFMNWDQ ILTDSGGFQVYSLADSRNITEEGVTFKN
Sbjct:  61 ILSNTYHLWLRPGDELIARSGGLHKFMNWDQPILTDSGGFQVYSLADSRNITEEGVTFKN 120

Query: 132 HLNGAKMFLSPEKAISIQNNLGSDIMMSFDECPQFYQPYDYVKKSIERTSRWAERGLNAH 191
           HLNG+KMFLSPEKAISIQNNLGSDIMMSFDECPQFYQPYDYVKKSIERTSRWAERGL AH
Sbjct: 121 HLNGSKMFLSPEKAISIQNNLGSDIMMSFDECPQFYQPYDYVKKSIERTSRWAERGLKAH 180

Query: 192 RRPHDQGLFGIVQGAGFEDLRRQSARDLVSMDFPGYSIGGLAVGETHDEMNAVLDFTVPM 251
           RRPHDQGLFGIVQGAGFEDLRRQSA DLV+MDFPGYSIGGLAVGE+H+EMNAVLDFT P+
Sbjct: 181 RRPHDQGLFGIVQGAGFEDLRRQSAADLVAMDFPGYSIGGLAVGESHEEMNAVLDFTTPL 240

Query: 252 LPNDKPRYLMGVGAPDSLIDAVIRGVDMFDCVLPTRIARNGTCMTSQGRLVVKNAKFAED 311
           LP +KPRYLMGVGAPDSLID  VIRGVDMFDCVLPTRIARNGTCMTS+GRLV+KNAKFAED
Sbjct: 241 LPENKPRYLMGVGAPDSLIDGVIRGVDMFDCVLPTRIARNGTCMTSEGRLVIKNAKFAED 300

Query: 312 FTPLDPNCDCYTCKNYTRAYIRHLLKADETFGIRLTSYHNLYFLVNLMKDVRQAIMDDNL 371
           FTPLD +CDCYTC NY+RAYIRHLLKADETFGIRLTSYHNLYFLVNLMK VRQAIMDDNL
Sbjct: 301 FTPLDHDCDCYTCQNYSRAYIRHLLKADETFGIRLTSYHNLYFLVNLMKKVRQAIMDDNL 360

Query: 372 LEFRQDFMERYGYGMNNRNF                                        391
           LEFRQDF+ERYGY  +NRNF
Sbjct: 361 LEFRQDFLERYGYNKSNRNF                                        380
```

Based on this analysis, it was predicted that these proteins and their epitopes could be useful antigens for vaccines or diagnostics.

Example 1142

A DNA sequence (GBSx1218) was identified in *S. agalactiae* <SEQ ID 3545> which encodes the amino acid sequence <SEQ ID 3546>. Analysis of this protein sequence reveals the following:

Possible site: 56
>>> Seems to have no N-terminal signal sequence
----- Final Results -----
    bacterial cytoplasm --- Certainty = 0.2479 (Affirmative) <succ>
      bacterial membrane --- Certainty = 0.0000 (Not Clear) <succ>
        bacterial outside --- Certainty = 0.0000 (Not Clear) <succ>

A related GBS nucleic acid sequence <SEQ ID 9303> which encodes amino acid sequence <SEQ ID 9304> was also identified. A further related GBS nucleic acid sequence <SEQ ID 10795> which encodes amino acid sequence <SEQ ID 10796> was also identified.

The protein has homology with the following sequences in the GENPEPT database.

```
>GP:CAB16256 GB:Z99164 hypothetical protein [Schizosaccharomyces pombe]
Identities = 42/91 (46%), Positives = 62/91 (67%), Gaps = 3/91 (3%)
Query:   6 FGIGLDSSSRCYHYHTKLDIVALKCAVCQKYYACYKCHDALEEHCFAA-TKSDETFP-VL  63
           +G +D+  +RC+HYH+K D+VAL+C  C+K+YAC++CHD L  H F    K+   P V+
Sbjct:  13 YGKLVDNETRCFHYHSKADVVALRCGQCEKFYACFQCHDELNTHPFLPWRKAKFHIPCVI  72

Query:  64 CGSCRQMLTLKEYK-TGFCPYCRMLFNPNCQ                              93
           CG+C+  LT++EY+ T  C YC   FNP C+
Sbjct:  73 CGACKNSLTVEEYRSTVHCKYCNHPFNPKCK                             103
```

A related DNA sequence was identified in *S. pyogenes* <SEQ ID 3547> which encodes the amino acid sequence <SEQ ID 3548>. Analysis of this protein sequence reveals the following:

Possible site: 36
>>> Seems to have no N-terminal signal sequence
----- Final Results -----
    bacterial cytoplasm --- Certainty = 0.2769 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below.

```
Identities = 55/93 (59%), Positives = 62/93 (66%)
Query:   2 MQEYFGIGLDSSSRCYHYHTKLDIVALKCAVCQKYYACYKCHDALEEHCFAATKSDETFP  61
           M + FGI LD   RC HYHT LDIV LKCA CQ YYACY CHD L +H F  T   ET P
Sbjct:   1 MTDCFGIDLDQEYRCLHYHTPLDIVGLKCASCQTYYACYHCHDQLTDHAFVPTGHQETSP  60

Query:  62 VLCGSCRQMLTLKEYKTGFCPYCRMLFNPNCQR                            94
           V+CG CR++L+  EY  G CPYC+  FNP C R
Sbjct:  61 VICGHCRKLLSRAEYGCGCCPYCQSPFNPACHR                            93
```

Based on this analysis, it was predicted that these proteins and their epitopes could be useful antigens for vaccines or diagnostics.

Example 1143

A DNA sequence (GBSx1219) was identified in *S. agalactiae* <SEQ ID 3549> which encodes the amino acid sequence <SEQ ID 3550>. This protein is predicted to be transport protein. Analysis of this protein sequence reveals the following:

Possible site: 19
>>> Seems to have no N-terminal signal sequence
INTEGRAL Likelihood = –9.45 Transmembrane 300-316 (292-321)
INTEGRAL Likelihood = –1.17 Transmembrane 265-281 (265-281)
----- Final Results -----
    bacterial membrane --- Certainty = 0.4779 (Affirmative) <succ>
        bacterial outside --- Certainty = 0.0000 (Not Clear) <succ>
          bacterial cytoplasm --- Certainty = 0.0000 (Not Clear) <succ>

A related GBS nucleic acid sequence <SEQ ID 10113> which encodes amino acid sequence <SEQ ID 10114> was also identified.

The protein has homology with the following sequences in the GENPEPT database.

```
>GP:AAF12002 GB:AE002075 transport protein, putative [Deinococcus radiodurans]
Identities = 108/295 (36%), Positives = 174/295 (58%), Gaps = 4/295 (1%)
Query:  31 GAWINLVNPSQEESEQVADQFGIDIDDLRAPLDVEETSRISVEDDYTLVIVDVPTYEERN  90
           G WI+   P+ EE  +V+ + G+++D L+ PLD +E SR   ED   L+I+      +
Sbjct:  21 GCWIDAAAPTTEELARVSRETGLELDYLKYPLDPDERSRFEREDGQLLIIMQTSYRLAED  80

Query:  91 NKSYYMTIPMGIIVTDNAVITTC-LEHLTLFDHFYRRRVKNFYTFMKTRFVFQLLYRNAE 149
           +    Y T+P+GI  TD+ ++T C LE   +       V+   T  K R   QL  RNA+
```

```
-continued
Sbjct:  81 SDIPYDTVPLGILHTDHCLVTVCSLEENPVVKDVVSGLVRRVSTVKKNRLTLQLFLRNAQ 140

Query: 150 LYLQALRTIDRQSDKIEAQLESATRNEQLIDMMELEKSIVYLKASLKFNERIVKKLTSST 209
           +L  +R I+++ D IE ++E+ATRN +L+D+++LEKS+VY    LK NE +++++
Sbjct: 141 RFLIDVRQINKRVDAIEDKMENATRNRELLDLLKLEKSLVYFITGLKANEAMMERVKRDR 200

Query: 210 SSLKKYIEDEDLLEDTLIETQQAIEMANIYENVLNAMTETTASIIGNNQNTIMKTLALVT 269
            + Y ED +LL+D LIE  QAIEMA+I  N+L +M    AS+I NN N ++K L + T
Sbjct: 201 I-FEMYEEDSELLDDVLIENLQAIEMASIASNILTSMAGAFASVINNNVNQVVKVLTVTT 259

Query: 270 MTLDIPTVIFSAYGMNFQNNWMPLNGLAHGFIYVVLLAFLMSSFVVFYIRKKWF        324
           + + IPT++   +GMN +    +P +    +GF  V+ +A  ++S + F F R K F
Sbjct: 260 ILVAIPTLVSGFFGMNVEG--LPFSDSPYGFWLVMTVAMGIASLLAFLFYRWKVF        312
```

A related DNA sequence was identified in *S. pyogenes* <SEQ ID 715> which encodes the amino acid sequence <SEQ ID 716>. Analysis of this protein sequence reveals the following:

---

Possible site: 61
>>> Seems to have no N-terminal signal sequence
INTEGRAL Likelihood = −8.81 Transmembrane 293-309 (288-311)
INTEGRAL Likelihood = −1.28 Transmembrane 255-271 (255-271)
----- Final Results -----
  bacterial membrane --- Certainty = 0.4524 (Affirmative) <succ>
  bacterial outside --- Certainty = 0.0000 (Not Clear) <succ>
    bacterial cytoplasm --- Certainty = 0.0000 (Not Clear) <succ>

---

An alignment of the GAS and GBS proteins is shown below.

```
Identities = 272/314 (86%), Positives = 296/314 (93%)
Query:  11 MKQMFLSTAIEFKEIETFEPGAWINLVNPSQEESEQVADQFGIDIDDLRAPLDVEETSRI  70
           MKQMFLS+AIEFKEIETFEPGAWI LVNPSQEES ++ADQF IDI DLRAPLDVEETSRI
Sbjct:   1 MKQMFLSSAIEFKEIETFEPGAWIKLVNPSQEESMKIADQFNIDISDLRAPLDVEETSRI  60

Query:  71 SVEDDYTLVIVDVPTYEERNNKSYYMTIPMGIIVTDNAVITTCLEHLTLFDHFYRRRVKN 130
           +VEDDYTL+IVDVP YEERNNKSYY+T+P+GIIVT+NAVITTCL  +TLFDHF+ RRVKN
Sbjct:  61 AVEDDYTLIIVDVPIYEERNNKSYYITMPLGIIVTENAVITTCLHDMTLFDHFHNRRVKN 120

Query: 131 FYTFMKTRFVFQLLYRNAELYLQALRTIDRQSDKIEAQLESATRNEQLIDMMELEKSIVY 190
           FYTFMKTRFVFQ+LYRNAEL+L ALRTIDRQS+++EAQLE+ATRNE+LIDMMELEKSIVY
Sbjct: 121 FYTFMKTRFVFQILYRNAELFLTALRTIDRQSERLEAQLEAATRNEELIDMMELEKSIVY 180

Query: 191 LKASLKFNERIVKKLTSSTSSLKKYIEDEDLLEDTLIETQQAIEMANIYENVLNAMTETT 250
           LKASLKFNERIVKKL+SSTSSLKKYIEDEDLLEDTLIETQQAIEMA IYENVLNAMTETT
Sbjct: 181 LKASLKFNERIVKKLSSSTSSLKKYIEDEDLLEDTLIETQQAIEMAGIYENVLNAMTETT 240

Query: 251 ASIIGNNQNTIMKTLALVTMTLDIPTVIFSAYGMNFQNNWMPLNGLAHGFIYVVLLAFLM 310
           ASII NNQNTIMKTLAL+TM LDIPTVIFSAYGMNFQNNW+PLNGL H F Y+ L+A L+
Sbjct: 241 ASIINNNQNTIMKTLALMTMALDIPTVIFSAYGMNFQNNWLPLNGLEHAFWYITLIAMLL 300

Query: 311 SSFVVFYIRKKWF                                                324
           SSFVV YIRKKWF
Sbjct: 301 SSFVVIYIRKKWF                                                314
```

SEQ ID 3550 (GBS257) was expressed in *E. coli* as a His-fusion product. SDS-PAGE analysis of total cell extract is shown in FIG. 44 (lane 3; MW 35 kDa), in FIG. 169 (lane 9 & 10; MW 50 kDa) and in FIG. 239 (lane 2; MW 50 kDa). It was also expressed in *E. coli* as a GST-fusion product. SDS-PAGE analysis of total cell extract is shown in FIG. 48 (lane 6; MW 60 kDa).

Based on this analysis, it was predicted that these proteins and their epitopes could be useful antigens for vaccines or diagnostics.

Example 1144

A DNA sequence (GBSx1220) was identified in *S. agalactiae* <SEQ ID 3551> which encodes the amino acid sequence <SEQ ID 3552>. Analysis of this protein sequence reveals the following:

---

Possible site: 29
>>> Seems to have no N-terminal signal sequence
INTEGRAL Likelihood = −12.26 Transmembrane 158-174 (151-182)
INTEGRAL Likelihood = −6.37  Transmembrane 93-109 (91-111)
INTEGRAL Likelihood = −5.68  Transmembrane 188-204 (184-205)
INTEGRAL Likelihood = −0.85  Transmembrane 118-134 (118-134)
----- Final Results -----
  bacterial membrane --- Certainty = 0.5904 (Affirmative) <succ>

-continued bacterial outside --- Certainty = 0.0000 (Not Clear) <succ>
    bacterial cytoplasm --- Certainty = 0.0000 (Not Clear) <succ>

---

The protein has no significant homology with any sequences in the GENPEPT database.

A related DNA sequence was identified in *S. pyogenes* <SEQ ID 3553> which encodes the amino acid sequence <SEQ ID 3554>. Analysis of this protein sequence reveals the following:

Possible site: 52
>>> Seems to have no N-terminal signal sequence
INTEGRAL Likelihood = −6.95 Transmembrane 92-108 (88-110)
INTEGRAL Likelihood = −6.69 Transmembrane 153-169 (151-177)
INTEGRAL Likelihood = −2.34 Transmembrane 183-199 (183-200)
----- Final Results -----
   bacterial membrane --- Certainty = 0.3781 (Affirmative) <succ>
      bacterial outside --- Certainty = 0.0000 (Not Clear) <succ>
         bacterial cytoplasm --- Certainty = 0.0000 (Not Clear) <succ>

The protein has no significant homology with any sequences in the GENPEPT database.

An alignment of the GAS and GBS proteins is shown below.

```
Identities = 135/217 (62%), Positives = 167/217 (76%), Gaps = 1/217 (0%)
Query:   1 MTLQDLTKKNQEFVHIATNQLLADGKSDAEIKAILEEHLPEIIDNQKKGITARSLLGAPT  60
           M LQ+LTKKNQEF+H ATN+L+ DGKSD +IK ILEE +P I++NQKKG+TAR+LLG PT
Sbjct:   1 MELQELTKKNQEFIHTATNKLIQDGKSDEDIKLILEEAIPAILENQKKGVTARNLLGTPT  60

Query:  61 TWAASFTERPEDKARVSVQKNTNPWLMWLDTSLLFLGLVTALNGLMLLFGQSNVNTGLIS 120
             WAASF++ P  KA    KNTNPWLMWLDTSLLF+G+V LNG+M F +   TGLIS
Sbjct:  61 AWAASFSQDPSQKA-AETDKNTNPWLMWLDTSLLFIGIVALLNGIMTFFNTNATVTGLIS 119

Query: 121 ILTLGFGGGAAMYVTYYYTYRHMGKPKSERPGWLKSFAVLALVMLVWFALFAVVPLLPAT 180
           +L LGFGGGA+MY TYY+IYRH+GK KS RP W K  A L+L ML+W AL++    LP +
Sbjct: 120 LLALGFGGGASMYATYYFIYRHLGKDKSLRPSWFKIIAALSLAMLIWIALYSATAFLPTS 179

Query: 181 INPKLPEVVLFIIALASFGLRFYLQRKYNIQSSMAPV                        217
           +NP+LP +L II   S  LR+YLQRKYNIQ++M+PV
Sbjct: 180 LNPQLPPLALLIIGGVSLALRYYLQRKYNIQNTMSPV                        216
```

A related GBS gene <SEQ ID 10787> and protein <SEQ ID 10788> were also identified. Analysis of this protein sequence reveals the following:

Lipop: Possible site: −1    Crend: 8
McG: Discrim Score: −9.94
GvH: Signal Score (−7.5) : −3.66
Possible site: 29
>>> Seems to have no N-terminal signal sequence
ALOM program count: 4    value: −12.26    threshold: 0.0
INTEGRAL     Likelihood = −12.26 Transmembrane 158-174 (151-182)
INTEGRAL     Likelihood = −6.37  Transmembrane 93-109 (91-111)
INTEGRAL     Likelihood = −5.68  Transmembrane 188-204 (184-205)
INTEGRAL     Likelihood = −0.85  Transmembrane 118-134 (118-134)
PERIPHERAL   Likelihood = 8.43    50
modified ALOM score: 2.95
*** Reasoning Step: 3
----- Final Results -----
   bacterial membrane --- Certainty = 0.5904 (Affirmative) <succ>
      bacterial outside --- Certainty = 0.0000 (Not Clear) <succ>
         bacterial cytoplasm --- Certainty = 0.0000 (Not Clear) <succ>

Based on this analysis, it was predicted that these proteins and their epitopes could be useful antigens for vaccines or diagnostics.

Example 1145

A DNA sequence (GBSx1221) was identified in S. agalactiae <SEQ ID 3555> which encodes the amino acid sequence <SEQ ID 3556>. Analysis of this protein sequence reveals the following:

Possible site: 28
>>> Seems to have no N-terminal signal sequence
----- Final Results -----
   bacterial cytoplasm --- Certainty = 0.1348 (Affirmative) <succ>
      bacterial membrane --- Certainty = 0.0000 (Not Clear) <succ>
         bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1146

A DNA sequence (GBSx1222) was identified in S. agalactiae <SEQ ID 3557> which encodes the amino acid sequence <SEQ ID 3558>. This protein is predicted to be excinuclease ABC (uvrA). Analysis of this protein sequence reveals the following:

Possible site: 18
>>> Seems to have no N-terminal signal sequence
----- Final Results -----
   bacterial cytoplasm --- Certainty = 0.1738 (Affirmative) <succ>
      bacterial membrane --- Certainty = 0.0000 (Not Clear) <succ>
         bacterial outside --- Certainty = 0.0000 (Not Clear) <succ>

A related GBS nucleic acid sequence <SEQ ID 10111> which encodes amino acid sequence <SEQ ID 10112> was also identified.

The protein has homology with the following sequences in the GENPEPT database.

```
>GP:AAC67271 GB:AF017113 excinuclease ABC subunit A [Bacillus subtilis]
Identities = 642/940 (68%), Positives = 785/940 (83%), Gaps = 3/940 (0%)
Query:   9 DKLMIRGARAHNLKNISVDIPRDKLVVVTGLSGSGKSSLAFDTIYAEGQRRYVESLSAYA  68
             D++ ++GARAHNLKNI V IPRD+LVVVTGLSGSGKSSLAFDTIYAEGQRRYVESLSAYA
Sbjct:   4 DRIEVKGARAHNLKNIDVTIPRDQLVVVTGLSGSGKSSLAFDTIYAEGQRRYVESLSAYA  63

Query:  69 RQFLGNMEKPDVDSIDGLSPAISIDQKTTSKNPRSTVGTVTEINDYLRLLYARVGTPYCI 128
             RQFLG M+KPDVD+I+GLSPAISIDQKTTS+NPRSTVGTVTEI DYLRLLYARVG P+C
Sbjct:  64 RQFLGQMDKPDVDAIEGLSPAISIDQKTTSRNPRSTVGTVTEIYDYLRLLYARVGKPHCP 123

Query: 129 NGHGAITASSVEQIVDKVLALPERTKMQILAPIIRRKKGQHKSTFEKIQKDGYVRVRIDG 188
                 IT+ ++EQ+VD++L  PERTK+Q+LAPI+  +KG H    E+I+K GYVRVRIDG
Sbjct: 124 EHGIEITSQTIEQMVDRILEYPERTKLQVLAPIVSGRKGAHVKVLEQIRKQGYVRVRIDG 183

Query: 189 DIHDVTEVPELSKSKMHNIDIVVDRLINKEGIRSRLFDSVEAALRLSDGYVVIDTMDGNE 248
             ++ ++++  EL K+K H+I++V+DR++KEG+ +RL DS+E  ALRL +G V+ID +   E
Sbjct: 184 EMAELSDDIELEKNKKHSIEVVIDRIVVKEGVAARLSDSLETALRLGEGRVMIDVIGEEE 243

Query: 249 LLFSEHYSCPECGFTVPELEPRLFSFNAPFGSCPTCDGLGIKLEVDIDLVIPDRSKTLRE 308
             L+FSEH++CP CGF++ ELEPRLFSEN+PFG+CPTCDGLG+KLEVD DLVIP++   +L+E
Sbjct: 244 LMFSEHHACPHCGFSIGELEPRLFSFNSPFGACPTCDGLGMKLEVDADLVIPNQDLSLKE 303

Query: 309 GALVPWNPISSNYYPTMLEQAMTQFGVDMDTPFEKLSKAEQDLALYGSGEREFHFHYIND 368
               A+ PW PISS YYP +LE    T +G+DMD P + L K + D LYGSG+    +F Y ND
Sbjct: 304 NAVAPWTPISSQYYPQLLEAVCTHYGIDMDVPVKDLPKHQLDKVLYGSGDDLIYFRYEND 363

Query: 369 FGGERNIDLPFEGVVNNINRRYHETNSDYTRNVMREYMNELKCNTCHGYRLNDQALCRVR 428
             FG  R   ++  FEGV+ NI RRY ET SD+ R  M +YM++   C TC GYRL  +AL V +
Sbjct: 364 FGQIREGEIQFEGVLRNIERRYKETGSDFIREQMEQYMSQKSCPTCKGYRLKKEALAVLI 423

Query: 429 GGEEGLNIGQVSDLSIADHLELLETLRLSSNEQLIARPIIKEIHDRLSFLNNVGLNYLNL 488
                +G +IG+++++LS+AD L   + L LS +  IA  I++EI +RLSFL+ VGL+YL L
Sbjct: 424 ---DGRHIGKITELSVADALAFFKDLTLSEKDMQIANLILREIVERLSFLDKVGLDYLTL 480

Query: 489 SRSAGTLSGGESQRIRLATQIGSNLSGVLYVLDEPSIGLHQRDNDRLIDSLKKMRDLGNT 548
             SR+AGTLSGGE+QRIRLATQIGS LSGVLY+LDEPSIGLHQRDNDRLI +LK MRDLGNT
Sbjct: 481 SRAAGTLSGGEAQRIRLATQIGSRLSGVLYILDEPSIGLHQRDNDRLISALKNMRDLGNT 540

Query: 549 LIVVEHDEDTMMAADWLIDVGPGAGAFGGEIVASGTPKQVAKNTKSITGQYLSGKKVIPV 608
             LIVVEHDEDTMMAAD+LID+GPGAG  GG+++++GTP+V ++   S+TG YLSGKK IP+
Sbjct: 541 LIVVEHDEDTMMAADYLIDIGPGAGIHGGQVISAGTPEEVMEDPNSLTGSYLSGKKFIPL 600

Query: 609 PSERRVGNGRFLEIKGAAENNLQNLDVKFPLGKFIAVTGVSGSGKSTLINSILKKAVAQK 668
             P ERR  +GR++EIKGA+ENNL+ ++ KFPLG F AVTGVSGSGKSTL+N IL KA+AQK
Sbjct: 601 PPERRKPDGRYIEIKGASENNLKKVNAKFPLGTFTAVTGVSGSGKSTLVNEILHKALAQK 660

Query: 669 LNRNSDKPGKYVSLEGIEYVDRLIDIDQSPIGRTPRSNPATYTGVFDDIRDLFAQTNEAK 728
             L++   KPG +  ++G++++D++IDIDQ+PIGRTPRSNPATYTGVFDDIRD+FAQTNEAK
Sbjct: 661 LHKAKAKPGSHKEIKGLDHLDKVIDIDQAPIGRTPRSNPATYTGVFDDIRDVFAQTNEAK 720

Query: 729 IRGYKKGRFSFNVKGGRCESCSGDGIIKIEMHFLPDVYVPCEVCHGTRYNSETLEVHYKE 788
             +RGYKKGRFSFNVKGGRCE+C GDGIIKIEMHFLPDVYVPCEVCHG RYN ETLEV YK
Sbjct: 721 VRGYKKGRFSFNVKGGRCEACRGDGIIKIEMHFLPDVYVPCEVCHGKRYNRETLEVTYKG 780

Query: 789 KNIAQILDMTVNDAVTFFAAIPKIARKLQTIKDVGLGYVTLGQPATTLSGGEAQRMKLAS 848
             K+I+ +LDMTV DA++FF   IPKI RKLQT+ DVGLGY+TLGQPATTLSGGEAQR+KLAS
Sbjct: 781 KSISDVLDMTVEDALSFFENIPKIKRKLQTLYDVGLGYITLGQPATTLSGGEAQRVKLAS 840

Query: 849 ELHKRSTGKSLYILDEPTTGLHADDIARLLKVLDRFVDDGNTVLVIEHNLDVIKTADHII 908
             ELHKRSTG++LYILDEPTTGLH DDIARLL VL R VD+G+TVLVIEHNLD+IKTAD+I+
Sbjct: 841 ELHKRSTGRTLYILDEPTTGLHVDDIARLLVVLQRLVDNGDTVLVIEHNLDIIKTADYIV 900

Query: 909 DLGPEGGIGGGQIVAIGTPEEVAENPKSYTGYYLKEKLAR 948
             DLGPEGG GGG IVA GTPEE+ E  +SYTG YLK + R
Sbjct: 901 DLGPEGGAGGGTIVASGTPEEITEVEESYTGRYLKPVIER 940
```

A related DNA sequence was identified in *S. pyogenes* <SEQ ID 3559> which encodes the amino acid sequence <SEQ ID 3560>. Analysis of this protein sequence reveals the following:

Possible site: 52
>>> Seems to have no N-terminal signal sequence

----- Final Results -----
bacterial cytoplasm --- Certainty = 0.1138 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 835/940 (88%), Positives = 896/940 (94%)
Query:   7 MQDKLMIRGARAHNLKNISVDIPRDKLVVVTGLSGSGKSSLAFDTIYAEGQRRYVESLSA  66
           MQ+K++I GARAHNLENI V+IPRDKLVVVTGLSGSGKSSLAFDTIYAEGQRRYVESLSA
Sbjct:  11 MQNKIIIHGARAHNLKNIDVEIPRDKLVVVTGLSGSGKSSLAFDTIYAEGQRRYVESLSA  70

Query:  67 YARQFLGNMEKPDVDSIDGLSPAISIDQKTTSKNPRSTVGTVTEINDYLRLLYARVGTPY 126
           YARQFLGNMEKPDVDSIDGLSPAISIDQKTTSKNPRSTVGTVTEINDYLRLLYARVGTPY
Sbjct:  71 YARQFLGNMEKPDVDSIDGLSPAISIDQKTTSKNPRSTVGTVTEINDYLRLLYARVGTPY 130

Query: 127 CINGHGAITASSVEQIVDKVLALPERTKMQILAPIIRRKKGQHKSTFEKIQKDGYVRVRI 186
           CINGHGAITASS EQIV++VIALPERT+MQILAP++RRKKGQHK+ FEKIQKDGYVRVR+
Sbjct: 131 CINGHGAITASSAEQIVEQVLALPERTRMQILAPVVRRKKGQHKTVFEKIQKDGYVRVRV 190

Query: 187 DGDIHDVTEVPELSKSKMHNIDIVVDRLINKEGIRSRLFDSVEAALRLSDGYVVIDTMDG 246
           DGDI DVTEVPELSKSKMHNI++V+DRL+NK+GIRSRLFDSVEAALRL DGY++IDTMDG
Sbjct: 191 DGDIFDVTEVPELSKSKMHNIEVVIDRLVNKDGIRSRLFDSVEAALRLGDGYLMIDTMDG 250

Query: 247 NELLFSEHYSCPECGFTVPELEPRLFSFNAPFGSCPTCDGLGIKLEVDIDLVIPDRSKTL 306
           NELLFSEHYSCP CGFTVPELEPRLFSFNAPFGSCPTCDGLGIKLEVD+DLV+PD SK+L
Sbjct: 251 NELLFSEHYSCPVCGFTVPELEPRLFSFNAPFGSCPTCDGLGIKLEVDLDLVVPDPSKSL 310

Query: 307 REGALVPWNPISSNYYPTMLEQAMTQFGVDMDTPFEKLSKAEQDLALYGSGEREFHFYI 366
           REGAL PWNPISSNYYPTMLEQAM  FGVDMDTPFE L++ E+DL LYGSG+REFHFHY+
Sbjct: 311 REGALAPWNPISSNYYPTMLEQAMASFGVDMDTPFEALTEEERDLVLYGSGDREFHFYV 370

Query: 367 NDFGGERNIDLPFEGVVNNINRRYHETNSDYTRNVMREYMNELKCNTCHGYRLNDQALCV 426
           NDFGGERNID+PFEGVV N+NRRYHETNSDYTRNVMR YMNEL C TCHGYRLNDQALCV
Sbjct: 371 NDFGGERNIDIPFEGVVTNVNRRYHETNSDYTRNVMRGYMNELTCATCHGYRLNDQALCV 430

Query: 427 RVGGEEGLNIGQVSDLSIADHLELLETLRLSSNEQLIARPIIKEIHDRLSFLNNVGLNYL 486
             VGGEEG +IGQ+S+LSIADHL+LLE L+ NE  IA+PI+KEIHDRL+FLNNVGLNYL
Sbjct: 431 HVGGEEGTHIGQISELSIADHLQLLEELELTENESTIAKPIVKEIHDRLTFLNNVGLNYL 490

Query: 487 NLSRSAGILSGGESQRIRLATQIGSNLSGVLYVLDEPSIGLHQRDNDRLIDSLKKMRDLG 546
            LSR +AGTLSGGESQRIRLATQIGSNLSGVLY+LDEPSIGLHQRDNDRLI+SLKKMRDLG
Sbjct: 491 TLSRAAGTLSGGESQRIRLATQIGSNLSGVLYILDEPSIGLHQRDNDRLIESLKKMRDLG 550

Query: 547 NTLIVVEHDEDTMMAADWLIDVGPGAGAFGGEIVASGTPKQVAKNTKSITGQYLSGKKVI 606
           NTLIVVEHDEDTMM ADWLIDVGPGAG FGGEI ASGTPKQVAKN KSITGQYLSGKK I
Sbjct: 551 NTLIVVEHDEDTMMQADWLIDVGPGAGEFGGEITASGTPKQVAKNKKSITGQYLSGKKFI 610

Query: 607 PVPSERRVGNGRFLEIKGAAENNLQNLDVKFPLGKFIAVTGVSGSGKSTLINSILKKAVA 666
           PVP ERR GNGRF+EIKGAA+NNLQ+LDV+FPLGKFIAVTGVSGSGKSTL+NSILKKAVA
Sbjct: 611 PVPLERRSGNGRFIEIKKGAAQNNLQSLDVRFPLGKFIAVTGVSGSGKSTLVNSILKKAVA 670

Query: 667 QKLNRNSDKPGKYVSLEGIEYVDRLIDIDQSPIGRTPRSNPATYTGVFDDIRDLFAQTNE 726
           QKLNRN+DKPGKY S+ GIE+++RLIDIDQSPIGRTPRSNPATYTGVFDDIRDLFAQTNE
Sbjct: 671 QKLNRNADKPGKYHSISIGIEHIERLIDIDQSPIGRTPRSNPATYTGVFDDIRDLFAQTNE 730

Query: 727 AKIRGYKKGRFSFNVKGGRCESCSGDGIIKIEMHFLPDVYVPCEVCHGTRYNSETLEVHY 786
           AKIRGYKKGRFSFNVKGGRCE+CSGDGIIKIEMHFLPDVYVPCEVCHG RYNSETLEVHY
Sbjct: 731 AKIRGYKKGRFSFNVKGGRCEACSGDGIIKIEMHFLPDVYVPCEVCHGRRYNSETLEVHY 790

Query: 787 KEKNIAQILDMTVNDAVTFFAAIPKIARKLQTIKDVGLGYVTLGQPATTLSGGEAQRMKL 846
           K KNIA++LDMTV+DA+ FF+AIPKIARK+QTIKDVGLGYVTLGQPATTLSGGEAQRMKL
Sbjct: 791 KGKNIAEVLDMTVDDALVFFSAIPKIARKIQTIKDVGLGYVTLGQPATTLSGGEAQRMKL 850

Query: 847 ASELHKRSTGKSLYILDEPTTGLHADDIARLLKVLDRFVDDGNTVLVIEHNLDVIKTADH 906
           ASELHKRSTGKSLYILDEPTTGLH DDIARLLKVL+RFVDDGNTVLVIEHNLDVIK+ADH
Sbjct: 851 ASELHKRSTGKSLYILDEPTTGLHTDDIARLLKVLERFVDDGNTVLVIEHNLDVIKSADH 910

Query: 907 IIDLGPEGGIGGGQIVAIGTPEEVAENPKSYTGYYLKEKL                     946
           IIDLGPEGG GGGQIVA GTPEEVA+   +SYTG+YLK KL
Sbict: 911 IIDLGPEGGDGGGQIVATGTPEEVAQVKESYTGHYLKVKL                     950
```

Based on this analysis, it was predicted that these proteins and their epitopes could be useful antigens for vaccines or diagnostics.

Example 1147

A DNA sequence (GBSx1223) was identified in *S. agalactiae* <SEQ ID 3561> which encodes the amino acid sequence <SEQ ID 3562>. Analysis of this protein sequence reveals the following:

Possible site: 60
>>> Seems to have an uncleavable N-term signal seq
INTEGRAL Likelihood = −10.40 Transmembrane 471-487 (463-490)
INTEGRAL Likelihood = −9.29 Transmembrane 246-262 (242-264)
INTEGRAL Likelihood = −7.27 Transmembrane 183-199 (178-207)
INTEGRAL Likelihood = −5.41 Transmembrane 351-367 (349-370)
INTEGRAL Likelihood = −4.41 Transmembrane 87-103 (83-107)
INTEGRAL Likelihood = −3.24 Transmembrane 375-391 (374-392)
INTEGRAL Likelihood = −2.97 Transmembrane 17-33 (16-35)
INTEGRAL Likelihood = −2.28 Transmembrane 420-436 (420-438)
INTEGRAL Likelihood = −1.97 Transmembrane 320-336 (320-337)
INTEGRAL Likelihood = −1.75 Transmembrane 214-230 (214-230)

-continued

```
INTEGRAL Likelihood = -1.75   Transmembrane 288-304 (288-304)
INTEGRAL Likelihood = -1.70   Transmembrane 110-126 (110-126)
INTEGRAL Likelihood = -0.69   Transmembrane 152-168 (151-168)
----- Final Results -----
   bacterial membrane --- Certainty = 0.5161 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the GENPEPT database.

```
>GP:CAB12192 GB:Z99106 similar to multidrug resistance protein [Bacillus subtilis]
Identities = 198/481 (41%), Positives = 300/481 (62%), Gaps = 24/481 (4%)
Query:    9 IHGKPYNRTAMITLLLIATFAGVLNQTSLGTAIPTLMNSFNISLSTAQQATTWFLLANGI   68
            I  KP+NR+ ++ +LL    F   +LNQT L TA+P +M   FN+   + AQ  TT F+L NGI
Sbjct:    5 IEQKPFNRSVIVGILLAGAFVAILNQTLLITALPHIMRDFNVDANQAQWLTTSFMLTNGI   64

Query:   69 MIPVSAYLATRFSTKWLYVTSYVVLLIGLLMTTLAPTSNWNLFLVGRIIQAISVGISMPL  128
            +IP++A+L   +F+++ L +T+   +    G ++     AP  N+ + L  RIIQA    GI MPL
Sbjct:   65 LIPITAFLIEKFTSRALLITAMSIFTAGTVVGAFAP--NFPVLLTARIIQAAGAGIMMPL  122

Query:  129 MQVVMVNVFPPEQRGAAMGLNGLVVGLAPAIGPTLAGWILKQHFHFAGBDLTWRAIFLLP  188
            MQ V + +FP E+RG AMG+ GLV+   APAIGPTL+GW ++             +WR++F  +
Sbjct:  123 MQTVFLTIFPIEKRGQAMGMVGLVISFAPAIGPTLSGWAVEA--------FSWRSLFYII  174

Query:  189 LLILTVTTILSPFVLKDVVDNKSVKLEVPSLILSIIGFGSFLWGFTNVATYGWGDIGYVI  248

Query:  429 LSSVAQNIITNNKPSKDLLTMNPLKYANQMLNASLDGFHVSFAIGFVFAVLGLLVSLFLRK 489
            L SV  N     +                       + +A+L G + +F +  V A++G L+S  L+K
Sbjct:  414 LVSVMSNQAAH-------------AGTTNVKHAALHGMNAAFIVAAVIALVGFLLSFTLKK 461
```

There is also homology to SEQ ID 46.

Based on this analysis, it was predicted that this protein and its epitopes, could be useful antigens for vaccines or diagnostics.

Example 1148

A DNA sequence (GBSx1224) was identified in *S. agalactiae* <SEQ ID 3563> which encodes the amino acid sequence <SEQ ID 3564>. Analysis of this protein sequence reveals the following:

```
Possible site: 47
>>> Seems to have an uncleavable N-term signal seq
INTEGRAL Likelihood = -8.81 Transmembrane 8-24 (5-30)
INTEGRAL Likelihood = -7.32 Transmembrane 36-52 (31-54)
----- Final Results -----
   bacterial membrane --- Certainty = 0.4524 (Affirmative) <succ>
      bacterial outside --- Certainty = 0.0000 (Not Clear) <succ>
         bacterial cytoplasm --- Certainty = 0.0000 (Not Clear) <succ>
```

A related GBS nucleic acid sequence <SEQ ID 10109> which encodes amino acid sequence <SEQ ID 10110> was also identified.

A related GBS gene <SEQ ID 8743> and protein <SEQ ID 8744> were also identified. Analysis of this protein sequence reveals the following:

```
Lipop: Possible site: -1    Crend: 8
McG: Discrim Score: 9.52
GvH: Signal Score (-7.5) : -3.4
Possible site: 22
>>> Seems to have an uncleavable N-term signal seq
ALOM program count: 1    value: -7.32    threshold: 0.0
INTEGRAL           Likelihood = -7.32 Transmembrane 11-27 (6-29)
PERIPHERAL         Likelihood = 11.19 130
```

```
modified ALOM score: 1.96
*** Reasoning Step: 3
----- Final Results -----
   bacterial membrane --- Certainty = 0.3930 (Affirmative) <succ>
      bacterial outside --- Certainty = 0.0000 (Not Clear) <succ>
         bacterial cytoplasm --- Certainty = 0.0000 (Not Clear) <succ>
```

The protein has no significant homology with any sequences in the GENPEPT database.

No corresponding DNA sequence was identified in *S. pyogenes*.

SEQ ID 8744 (GBS29) was expressed in *E. coli* as a His-fusion product. SDS-PAGE analysis of total cell extract is shown in FIG. 7 (lane 2; MW 25.6 kDa). It was also expressed in *E. coli* as a GST-fusion product. SDS-PAGE analysis of total cell extract is shown in FIG. 15 (lane 6; MW 51 kDa).

Based on this analysis, it was predicted that these proteins and their epitopes could be useful antigens for vaccines or diagnostics.

Example 1149

A DNA sequence (GBSx1225) was identified in *S. agalactiae* <SEQ ID 3565> which encodes the amino acid sequence <SEQ ID 3566>. This protein is predicted to be aminopeptidase P (pepQ). Analysis of this protein sequence reveals the following:

```
Possible site: 41
>>> Seems to have no N-terminal signal sequence
----- Final Results -----
   bacterial cytoplasm --- Certainty = 0.0724 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database.

```
>GP:CAA70068 GB:Y08842 aminopeptidase P [Lactococcus lactis]
Identities = 44/126 (34%), Positives = 78/126 (60%)
Query:   6 RLTRCQTAISQLSCDALLITNLTNIFYLTGFSGTNATVLISPKHRIFVTDSRYALIAKNT  65
           R+ + +  +   + D+LLIT++NIFYLTGFSGT TV ++K IF+TDSRY++A+
Sbjct:   2 RIEKLKVKMLTENIDSLLITDMKNIFYLTGFSGTAGTVFLTQKRNIFMTDSRYSEMARGL  61

Query:  66 VREFDIIISREPLAAILKIIRDDALIAIGFETDISYHMYKHMVEVFEDYRLIEAPSVVEK 125
           ++F+II +R+P+++++++++FE +Y +K ++L +V +
Sbjct:  62 IKNFEIIETRDPISLLTELSASESVKNMAFEETVDYAFFKRLSKAATKLDLFSTSNFVLE 121

Query: 126 LRMIKD                                                       131
           LR IKD
Sbjct: 122 LRQIKD                                                       127
```

There is also homology to SEQ ID 3568.

Based on this analysis, it was predicted that this protein and its epitopes, could be useful antigens for vaccines or diagnostics.

Example 1150

A DNA sequence (GBSx1226) was identified in *S. agalactiae* <SEQ ID 3569> which encodes the amino acid sequence <SEQ ID 3570>. This protein is predicted to be aminopeptidase P (pepQ-2). Analysis of this protein sequence reveals the following:

---

Possible site: 44
>>> Seems to have no N-terminal signal sequence
----- Final Results -----
   bacterial cytoplasm --- Certainty = 0.2508 (Affirmative) <succ>
   bacterial membrane --- Certainty = 0.0000 (Not Clear) <succ>
   bacterial outside --- Certainty = 0.0000 (Not Clear) <succ>

---

The protein has homology with the following sequences in the GENPEPT database.

```
>GP:CAA70068 GB:Y08842 aminopeptidase P [Lactococcus lactis]
Identities = 131/205 (63%), Positives = 163/205 (78%), Gaps = 3/205 (1%)
Query:   2 LDFIKPDRTTELQVANFLDFRMRELGATGPSFDFIVASGYRSAMPHGVASQKTIQSGETL  61
           L FI+P RT E++VANFLDF+MR+L A+G SF+ IVASG RS++PHGVA+ K IQ G+ +
Sbjct: 149 LRFIEPGRT-EIEVANFLDFKMRDLEASGISFETIVASGKRSSLPHGVATSKMIQFGDPV 207

Query:  62 TLDFGCYYQHYVSDMTRTIHIGHVTDQEREIYDIVLKSNQAIIGNVKSGMKRCDYDYLAR 121
           T+DFGCYY+HY SDMTRTI +G V D+ R IY+ V K+N+A+I  VK+GM   YD + R
Sbjct: 208 TIDFGCYYEHYASDMTRTIFVGSVDDKMRTIYETVRKANEALIKQVKAGMTYAQYDNIPR 267

Query: 122 QVIENSGYGNHFTHGIGHGMGLDVHEIPYFGKS--EGVIASGMVVTDEPGIYLDNKYGVR 179
           +VIE + +G +FTHGIGHG+GLDVHEIPYF +S  E  + SGMV+TDEPGIYL    GVR
Sbjct: 268 EVIEKADFGQYFTHGIGHGLGLDVHEIPYFNQSMTENQLRSGMVITDEPGIYLPEFGGVR 327

Query: 180 IEDDLLITETGCEVLTSAPKELIVL                                    204
           IEDDLL+TE GCEVLT APKELIV+
Sbjct: 328 IEDDLLVTENGCEVLTKAPKELIVI                                    352
```

A related DNA sequence was identified in *S. pyogenes* <SEQ ID 3567> which encodes the amino acid sequence <SEQ ID 3568>. Analysis of this protein sequence reveals the following:

---

Possible site: 45
>>> Seems to have no N-terminal signal sequence
----- Final Results -----
   bacterial cytoplasm --- Certainty = 0.1450 (Affirmative) <succ>
   bacterial membrane --- Certainty = 0.0000 (Not Clear) <succ>
   bacterial outside --- Certainty = 0.0000 (Not Clear) <succ>

---

An alignment of the GAS and GBS proteins is shown below.

```
Identities = 145/203 (71%), Positives = 171/203 (83%)
Query:   2 LDFIKPDRTTELQVANFLDERMRELGATGPSFDFIVASGYRSAMPHGVASQKTIQSGETL  61
           LDFIKP  TTE +ANFLD FRMR+ GA+G SFD IVASGY SAMPHG AS K IQ+ E+L
Sbjct: 168 LDFIKPGTTTERDLANFLDERMRQYGASGTSFDIIVASGYLSAMPHGRASDKVIQNKESL 227

Query:  62 TLDFGCYYQHYVSDMTRTIHIGHVTDQEREIYDIVLKSNQAIIGNVKSGMKRCDYDYLAR 121
           T+DFGCYY HYVSDMTRTIHIG VTD+EREIY +VL +N+A+I    +GM   D+D + R
Sbjct: 228 TMDFGCYYNHYVSDMTRTIHIGQVTDEEREIYALVLAANKALIAKASAGMTYSDFDGIPR 287
```

-continued
```
Query: 122 QVIENSGYGNHFTHGIGHGMGLDVHEIPYFGKSEGVIASGMVVTDEPGIYLDNKYGVRIE 181
            Q+I  +GYG+ FTHGIGHG+GLD+HE P+FGKSE ++ +GMVVTDEPGIYLDNKYGVRIE
Sbjct: 288 QLITEAGYGSRFTHGIGHGIGLDIHENPFFGKSEQLLQAGMVVTDEPGIYLDNKYGVRIE 347

Query: 182 DDLLITETGCEVLTSAPKELIVL                                      204
            DDL+IT+TGC+VLT APKELIVL
Sbjct: 348 DDLVITKTGCQVLTLAPKELIVL                                      370
```

Based on this analysis, it was predicted that these proteins and their epitopes could be useful antigens for vaccines or diagnostics.

Example 1151

A DNA sequence (GBSx1227) was identified in *S. agalactiae* <SEQ ID 3571> which encodes the amino acid sequence <SEQ ID 3572>. This protein is predicted to be yfhC protein (comEB). Analysis of this protein sequence reveals the following:

Possible site: 14
>>> Seems to have no N-terminal signal sequence
----- Final Results -----
   bacterial cytoplasm --- Certainty = 0.1401 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

A related DNA sequence was identified in *S. pyogenes* <SEQ ID 3573> which encodes the amino acid sequence <SEQ ID 3574>. Analysis of this protein sequence reveals the following:

Possible site: 30
>>> Seems to have no N-terminal signal sequence
----- Final Results -----
   bacterial cytoplasm --- Certainty = 0.3155 (Affirmative) <succ>
   bacterial membrane --- Certainty = 0.0000 (Not Clear) <succ>
   bacterial outside --- Certainty = 0.0000 (Not Clear) <succ>

```
>GP:BAB05053 GB:AP001511 late competence operon required for DNA binding
and uptake [Bacillus halodurans]
Identities = 78/146 (53%), Positives = 107/146 (72%)
Query:   1 MNRLSWEDYFMANAELISKRSTCDRAFVGAVLVKNNRIIATGYNGGVSETDNCNEVGHYM   60
           MNR+SW+ YFMA + L++ RSTC R  VGA +V++ RIIA GYNG +S   +C + G Y+
Sbjct:   1 MNRISWDQYFMAQSHLLALRSTCTRLMVGATIVRDKRIIAGGYNGSISGGPHCIDEGCYV   60

Query:  61 EDGHCIRTVHAEMNALIQCAKEGISTNNTEIYVTHFPCINCTKALLQAGVKKITYKANYR  120
              +GHCIRT+HAE+NAL+QCAK G+ T   EIYVTHFPC+NCTKA++Q+G+KK+ Y  +Y+
Sbjct:  61 VEGHCIRTIHAEVNALLQCAKFGVPTEGAEIYVTHFPCVNCTKAIIQSGIKKVYYATDYK  120

Query: 121 PHPFAIELMEAKGVAYVQHDVPEVTL                                   146
             P+A EL    GV  Q ++ E+ L
Sbjct: 121 NSPYAEELFRDAGVDVEQVELEEMIL                                   146
```

An alignment of the GAS and GBS proteins is shown below.

```
Identities = 133/146 (91%), Positives = 140/146 (95%)
Query:   2 NRLSWEDYFMANAELISKRSTCDRAFVGAVLVKNNRIIATGYNGGVSETDNCNEVGHYME   61
           NRLSW+DYFMANAELISKRSTCDRAFVGAVLVK+NRIIATGYNGGVS TDNCNE GHYME
Sbjct:  18 NRLSWQDYFMANAELISKRSTCDRAFVGAVLVKDNRIIATGYNGGVSATDNCNEAGHYME   77

Query:  62 DGHCIRTVHAEMNALIQCAKEGISTNNTEIYVTHFPCINCTKALLQAGVKKITYKANYRP  121
           DGHCIRTVHAEMNALIQCAKEGIST+ TEIYVTHFPCINCTKALLQAG+ KITYKA+YRP
Sbjct:  78 DGHCIRTVHAEMNALIQCAKEGISTDGTEIYVTHFPCINCTKALLQAGITKITYKAHYRP  137

Query: 122 HPFAIELMEAKGVAYVQHDVPEVTLG                                   147
           HPFAIELME KGVAYVQHDVP++ LG
Sbjct: 138 HPFAIELMEKKGVAYVQHDVPQIVLG                                   163
```

Example 1152

A DNA sequence (GBSx1228) was identified in *S. agalactiae* <SEQ ID 3575> which encodes the amino acid sequence <SEQ ID 3576>. Analysis of this protein sequence reveals the following:

```
Possible site: 13
>>> Seems to have no N-terminal signal sequence
----- Final Results -----
    bacterial cytoplasm --- Certainty = 0.2454 (Affirmative) <succ>
```

-continued

```
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1153

A DNA sequence (GBSx1229) was identified in *S. agalactiae* <SEQ ID 3577> which encodes the amino acid sequence <SEQ ID 3578>. Analysis of this protein sequence reveals the following:

```
Possible site: 25
>>> Seems to have an uncleavable N-term signal seq
    INTEGRAL    Likelihood = -1.65    Transmembrane 4-20 (3-21)
----- Final Results -----
    bacterial membrane --- Certainty = 0.1659 (Affirmative) <succ>
        bacterial outside --- Certainty = 0.0000 (Not Clear) <succ>
            bacterial cytoplasm --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1154

A DNA sequence (GBSx1230) was identified in *S. agalactiae* <SEQ ID 3579> which encodes the amino acid sequence <SEQ ID 3580>. Analysis of this protein sequence reveals the following:

```
Possible site: 54
>>> Seems to have an uncleavable N-term signal seq
----- Final Results -----
    bacterial membrane --- Certainty = 0.0000 (Not Clear) <succ>
        bacterial outside --- Certainty = 0.0000 (Not Clear) <succ>
            bacterial cytoplasm --- Certainty = 0.0000 (Not Clear) <succ>
```

The protein has homology with the following sequences in the GENPEPT database.

```
>GP:BAB04699 GB:AP001510 unknown conserved protein [Bacillus halodurans]
Identities = 47/94 (50%), Positives = 65/94 (69%)
Query:   2  LLPVGSVVYLIDGNQKLVIVNRGAIVEQEGQEVYFDYLGGIFPEGLNLEQVYYFNQEDID   61
            +LP+GS+VYL +G  KL+I+NRG I+E  G+   FDY G  +P+GL  ++V+YFN E+ID
Sbjct:   1  MLPIGSIVYLKEGTSKLMILNRGPILEANGENKMFDYSGCFYPQGLVPDKVFYFNHENID   60

Query:  62  EVVFEGYHDEEEERVSRLIEKWKNTEGKNLPKGK                            95
            EVVFEG+ D+EE+R  +L   WK         KGK
Sbjct:  61  EVVFEGFQDDEEQRFQKLFHDWKKENKDRYVKGK                            94
```

No corresponding DNA sequence was identified in *S. pyogenes*.

Based on this analysis, it was predicted that this protein and its epitopes, could be useful antigens for vaccines or diagnostics.

Example 1155

A DNA sequence (GBSx1231) was identified in *S. agalactiae* <SEQ ID 3581> which encodes the amino acid sequence <SEQ ID 3582>. Analysis of this protein sequence reveals the following:

```
Possible site: 15
>>> Seems to have no N-terminal signal sequence
----- Final Results -----
    bacterial cytoplasm --- Certainty = 0.3560 (Affirmative) <succ>
        bacterial membrane --- Certainty = 0.0000 (Not Clear) <succ>
            bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1156

A DNA sequence (GBSx1232) was identified in *S. agalactiae* <SEQ ID 3583> which encodes the amino acid sequence <SEQ ID 3584>. This protein is predicted to be elongation factor p (efp). Analysis of this protein sequence reveals the following:

Possible site: 29
>>> Seems to have no N-terminal signal sequence
----- Final Results -----
    bacterial cytoplasm --- Certainty = 0.3067 (Affirmative) <succ>
       bacterial membrane --- Certainty = 0.0000 (Not Clear) <succ>
          bacterial outside --- Certainty = 0.0000 (Not Clear) <succ>

The protein has homology with the following sequences in the GENPEPT database.

```
>GP:CAB14376 GB:Z99116 elongation factor P [Bacillus subtilis]
Identities = 89/186 (47%), Positives = 120/186 (63%), Gaps = 1/186 (0%)
Query:   1  MIEASKLKAGMTFETADGKLIRVLEASHHKPGKGNTIMRMKLRDVRTGSTFDTSYRPEEK   60
            MI  +  + G+T +   DG + RV++  H KPGKG   +R KLR++RTG+  + ++R  EK
Sbjct:   1  MISVNDFRTGLTIDV-DGGIWRVVDFQHVKPGKGAAFVRSKLRNLRTGAIQEKTFRAGEK   59

Query:  61  FEQAIIETVPAQYLYKMDDTAYFMNNETYDQYEIPTVNIENELLYILENSEVKIQFYGTE  120
               +A IET   QYLY  D    FM+ +Y+Q E+    IE EL Y+LEN  V I  Y  E
Sbjct:  60  VAKAQIETKTMQYLYANGDQHVFMDTSSYEQLELSATQIEEELKYLLENMSVHIMMYQDE  119

Query: 121  VIGVQIPTTVELTVAETQPSIKGATVTGSGKPATMETGLVVNVPDFIEAGQKLVINTAEG  180
              +G+++P TVEL V ET+P IKG T +G   KPA    ETGLVVNVP F+   G  LV+NT++G
Sbjct: 120  TLGIELPNTVELKVVETEPGIKGDTASGGTKPAKTETGLVVNVPFFVNEGDTLVVNTSDG  179

Query: 181  TYVSRA  186
            +YVSRA
Sbjct: 180  SYVSRA  185
```

A related DNA sequence was identified in *S. pyogenes* <SEQ ID 3585> which encodes the amino acid sequence <SEQ ID 3586>. Analysis of this protein sequence reveals the following:

Possible site: 14
>>> Seems to have no N-terminal signal sequence
----- Final Results -----
    bacterial cytoplasm --- Certainty = 0.1813 (Affirmative) <succ>
       bacterial membrane --- Certainty = 0.0000 (Not Clear) <succ>
          bacterial outside --- Certainty = 0.0000 (Not Clear) <succ>

An alignment of the GAS and GBS proteins is shown below.

```
Identities = 170/186 (91%), Positives = 180/186 (96%), Gaps = 1/186 (0%)
Query:   1  MIEASKLKAGMTFETADGKLIRVLEASHHKPGKGNTIMRMKLRDVRTGSTFDTSYRPEEK   60
            MIEASKLKAGMTFE A+GKLIRVLEASHHKPGKGNTIMRMKLRDVRTGSTFDT+YRP+EK
Sbjct:   1  MIEASKLKAGMTFE-AEGKLIRVLEASHHKPGKGNTIMRMKLRDVRTGSTFDTTYRPDEK   59

Query:  61  FEQAIIETVPAQYLYKMDDTAYFMNNETYDQYEIPTVNIENELLYILENSEVKIQFYGTE  120
            FEQAIIETVPAQYLYKMDDTAYFMN +TYDQYEIP  N+E ELLYILENS+VKIQFYG+E
Sbjct:  60  FEQAIIETVPAQYLYKMDDTAYFMNTDTYDQYEIPVANVEQELLYILENSDVKIQFYGSE  119

Query: 121  VIGVQIPTTVELTVAETQPSIKGATVTGSGKPATMETGLVVNVPDFIEAGQKLVINTAEG  180
            VIGV +PTTVELTVAETQPSIKGATVTGSGKPAT+ETGLVVNVPDFIEAGQKL+INTAEG
Sbjct: 120  VIGVTVPTTVELTVAETQPSIKGATVTGSGKPATLETGLVVNVPDFIEAGQKLIINTAEG  179

Query: 181  TYVSRA  186
            TYVSRA
Sbjct: 180  TYVSRA  185
```

Based on this analysis, it was predicted that these proteins and their epitopes could be useful antigens for vaccines or diagnostics.

Example 1157

A DNA sequence (GBSx1233) was identified in *S. agalactiae* <SEQ ID 3587> which encodes the amino acid sequence <SEQ ID 3588>. Analysis of this protein sequence reveals the following:

```
Possible site: 29
>>> Seems to have no N-terminal signal sequence
----- Final Results -----
    bacterial cytoplasm --- Certainty = 0.1508 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database.

```
>GP:BAB06505 GB:AP001516 unknown conserved protein [Bacillus halodurans]
Identities = 42/107 (39%), Positives = 70/107 (65%), Gaps = 4/107 (3%)
Query:   5 NLGEIVISPRVLEVITGIAATKVDGVHSLRNK---AVTDSLSKKSLGRGVYLKNEEDDTV      61
           +LG + ISP V+EVI GIAA++V+GV ++R       V + L  K+ G+GV + +  D+ +
Sbjct:  15 DLGRVEISPEVIEVIAGIAASEVEGVATMRGNFAAGVAEKLGYKNHGKGVKV-DLNDEGI     73

Query:  62 AADIYVYLQYGVNVPAVSIAIQQAVKTAVYDMAEVKISSVNIHVEGI                 108
           D+ V + YGV+VP V+   IQQ +K A+   M  +++ S+N+H+ G+
Sbjct:  74 IVDVSVIILYGVSVPEVAKKIQQNIKQALQTMTAIELQSINVHIVGV                 120
```

A related DNA sequence was identified in *S. pyogenes* <SEQ ID 3589> which encodes the amino acid sequence <SEQ ID 3590>. Analysis of this protein sequence reveals the following:

```
Possible site: 41
>>> Seems to have no N-terminal signal sequence
----- Final Results -----
    bacterial cytoplasm --- Certainty = 0.0882 (Affirmative) <succ>
      bacterial membrane --- Certainty = 0.0000 (Not Clear) <succ>
         bacterial outside --- Certainty = 0.0000 (Not Clear) <succ>
```

An alignment of the GAS and GBS proteins is shown below.

```
Identities = 101/129 (78%), Positives = 113/129 (87%)
Query:    1 MTTENLGEIVISPRVLEVITGIAATKVDGVHSLRNKAVTDSLSKKSLGRGVYLKNEEDDT      60
            MTTE +GEIVISPRVLEVITGIA T+V+GVHSL NK + DS +K SLG+GVYL+ EED +
Sbjct:    1 MTTEYIGEIVISPRVLEVITGIATTQVEGVHSLHNKKMADSFNKASLGKGVYLQTEEDGS     60

Query:   61 VAADIYVYLQYGVNVPAVSIAIQQAVKTAVYDMAEVKISSVNIHVEGIVPEKTPKPDLKS    120
            V ADIYVYLQYGV VP VS+ IQ+ VK+AVYDMAEV IS+VNIHVEGIV EKTPKPDLKS
Sbjct:   61 VTADIYVYLQYGVKVPTVSMNIQKTVKSAVYDMAEVPISAVNIHVEGIVAEKTPKPDLKS    120

Query:  121 LFDEDFLDD                                                      129
            LFDEDFLDD
Sbjct:  121 LFDEDFLDD                                                      129
```

Based on this analysis, it was predicted that these proteins and their epitopes could be useful antigens for vaccines or diagnostics.

Example 1158

A DNA sequence (GBSx1234) was identified in *S. agalactiae* <SEQ ID 3591> which encodes the amino acid sequence <SEQ ID 3592>. This protein is predicted to be n utilization substance protein b homolog (nusB). Analysis of this protein sequence reveals the following:

```
Possible site: 27
>>> Seems to have no N-terminal signal sequence
INTEGRAL     Likelihood = -0.32    Transmembrane 48-64 (47-64)
----- Final Results -----
    bacterial membrane --- Certainty = 0.1128 (Affirmative) <succ>
       bacterial outside --- Certainty = 0.0000 (Not Clear) <succ>
       bacterial cytoplasm --- Certainty = 0.0000 (Not Clear) <succ>
```

The protein has homology with the following sequences in the GENPEPT database.

```
>GP:CAB14363 GB:Z99116 similar to transcription termination
[Bacillus subtilis]
```

```
Identities = 51/129 (39%), Positives = 82/129 (63%), Gaps = 9/129 (6%)
Query:   9 RRDLRERAFQTLFSLEIGGEFIDAAHFAYGYDKTVSEDKVLEVPIFLLNLVNGVVDHKDE    68
           RR  RE+A Q LF ++      ++ A       +  + E+K       F   LV+GV++H+D+
Sbjct:   3 RRTAREKALQALFQIDVSDIAVNEA-----IEHALDEEKT---DPFFEQLVHGVLEHQDQ    54

Query:  69 LDTLISSHLKSGWSLERLTLVDKSLLRLGLYEIKYFDETPDRVALNEIIEIAKKYSDETS   128
           LD +IS HL + W L+R+   VD+++LRL   YE+ Y ++ P  V++NE IE+AK++ D+ +
Sbjct:  55 LDEMISKHLVN-WKLDRIANVDRAILRLAAYEMAYAEDIPVNVSMNEAIELAKRFGDDKA   113

Query: 129 AKFVNGLLS                                                     137
            KFVNG+LS
Sbjct: 114 TKFVNGVLS                                                     122
```

A related DNA sequence was identified in *S. pyogenes* <SEQ ID 3593> which encodes the amino acid sequence <SEQ ID 3594>. Analysis of this protein sequence reveals the following:

---

Possible site: 44
>>> Seems to have no N-terminal signal sequence
INTEGRAL    Likelihood = −1.75    Transmembrane 53-69 (53-69)
----- Final Results -----
  bacterial membrane --- Certainty = 0.1702 (Affirmative) <succ>
  bacterial outside --- Certainty = 0.0000 (Not Clear) <succ>
  bacterial cytoplasm --- Certainty = 0.0000 (Not Clear) <succ>

---

The protein has homology with the following sequences in the databases:

```
>GP:CAB14363 GB:Z99116 similar to transcription termination
[Bacillus subtilis]
```

Based on this analysis, it was predicted that these proteins and their epitopes could be useful antigens for vaccines or diagnostics.

Example 1159

A DNA sequence (GBSx1235) was identified in *S. agalactiae* <SEQ ID 3595> which encodes the amino acid sequence <SEQ ID 3596>. Analysis of this protein sequence reveals the following:

---

Possible site: 20
>>> Seems to have a cleavable N-term signal seq.
INTEGRAL    Likelihood = −2.81    Transmembrane 239-255 (239-255)

---

```
Identities = 47/134 (35%), Positives = 76/134 (56%), Gaps = 10/134 (7%)
Query:  15 RRDLRERAFQALFNIEMGAELLAASQFAYGYDKVTGEDAQVLELPIFLLSLVTGVNNHKE    74
           RR  RE+A QALF I++ +++       + D+  +          F    LV GV H++
Sbjct:   3 RRTAREKALQALFQIDV-SDIAVNEAIEHALDEEKTDP--------FFEQLVHGVLEHQD    53

Query:  75 ELDNLISTHLKKGWSLERLTLTDKTLLRLGLFEIKYFDKTPDRVALNEIIEVVKKYSDET   134
           +LD +IS HL   W L+R+   D+ +LRL  +E+ Y  + P  V++NE IE+ K++ D+
Sbjct:  54 QLDEMISKHLVN-WKLDRIANVDRAILRLAAYEMAYAEDIPVNVSMNEAIELAKRFGDDK   112

Query: 135 SAKFINGLLSQYVS                                                148
           + KF+NG+LS   S
Sbjct: 113 ATKFVNGVLSNIKS                                                126
```

An alignment of the GAS and GBS proteins is shown below.

```
Identities = 104/142 (73%), Positives = 125/142 (87%), Gaps = 1/142 (0%)
Query:   1 MTSVFKDSRRDLRERAFQTLFSLETGGEFIDAAHFAYGYDKTVSED-KVLEVPIFLLNLV    59
           MT+ F++SRRDLRERAFQ LF++E G E + A+ FAYGYDK    ED +VLE+PIFLL+LV
Sbjct:   7 MTNSFQNSRRDLRERAFQALFNIEMGAELLAASQFAYGYDKVTGEDAQVLELPIFLLSLV    66

Query:  60 NGVVDHKDELDTLISSHLKSGWSLERLTLVDKSLLRLGLYEIKYFDETPDRVALNEIIEI   119
           +GV +HK+ELD LIS+HLK GWSLERLTL DK+LLRLGL+EIKYFD+TPDRVALNEIIE+
Sbjct:  67 TGVNNHKEELDNLISTHLKKGWSLERLTLTDKTLLRLGLFEIKYFDKTPDRVALNEIIEV   126

Query: 120 AKKYSDETSAKFVNGLLSQFIT                                        141
           KKYSDETSAKF+NGLLSQ+++
Sbjct: 127 VKKYSDETSAKFINGLLSQYVS                                        148
```

-----Final Results-----
   bacterial membrane --- Certainty = 0.2126 (Affirmative) <succ>
   bacterial outside --- Certainty = 0.0000 (Not Clear) <succ>
   bacterial cytoplasm --- Certainty = 0.0000 (Not Clear) <succ>

Possible site: 20
>>> Seems to have a cleavable N-term signal seq.
-----Final Results-----
   bacterial outside --- Certainty = 0.3000 (Affirmative) <succ>
   bacterial membrane --- Certainty = 0.0000 (Not Clear) <succ>
   bacterial cytoplasm --- Certainty = 0.0000 (Not Clear) <succ>

The protein has homology with the following sequences in the GENPEPT database.

```
>GP:AAC31628 GB:U46902 ScrR [Streptococcus mutans]
Identities = 225/320 (70%), Positives = 273/320 (85%)
Query:    1 MVAKLTDVAALAGVSPTTVSRVINKKGYLSQKTVTKVNEAMRTLGYKPNNLARSLQGKSA    60
            MVAKLTDVA LAGVSPTTVSRVIN+KGYLS+KT TKV  AM+TLGYKPNNLARSLQGKSA
Sbjct:    1 MVAKLTDVAKLAGVSPTTVSRVINRKGYLSEKTITKVQAAMKTLGYKPNNLARSLQGKSA    60

Query:   61 KLIGLIFPNIRNIFYAELIEHLEIELFKHGYKTILCNSEKDPIKEKEYLEMLGANQVDGI   120
            KLIGLIFPNI +IFY+ELIE+LEIELFKHGYK I+CNS+ +P KE++YLEML ANQVDGI
Sbjct:   61 KLIGLIFPNISHIFYSELIEYLEIELFKHGYKAIICNSQNNPDKERDYLEMLEANQVDGI   120

Query:  121 ISSSHNLGIDDYEKVEAPIVAFDRNLAPHIPIVSSDNFFGGKMAAQTLKKHGCQKMIMIT   180
            ISSSHNLGIDDYEKV API+AFDRNLAP+IPIVSSDNF GG+MAA+ LKKHGCQ  IMI
Sbjct:  121 ISSSHNLGIDDYEKVSAPIIAFDRNLAPNIPIVSSDNFEGGRMAAKLLKKHGCQHPIMIA   180

Query:  181 GNDNSDSPTGLRRLGFSYESKESKVITVTNGLSNMRREMELKSIISTHKPDGIFTSDDLT   240
            G DNS+SPT LR+LGF    ++ +  ++ LS +R+EME+K I+    KPDGIF SDD+T
Sbjct:  181 GKDNSNSPTALRQLGFKSVFAQAPIFHLSGELSIIRKEMEIKVILQNEKPDGIFLSDDMT   240

Query:  241 ALLVIKLISQLGLSIPEDIKVIGYDGTSFIQDYVPHLTTIKQPIREIAQLMVEILLAKIE   300
            A+L +K+ +QL ++IP ++K+IGYDGT F+++Y P+LTTI+QPI++IA L+V+ILL KI+
Sbjct:  241 AILTMKIANQLNITIPHELKIIGYDGTHFVENYYPYLTTIRQPIKDIAHLLVDILLKKID   300

Query:  301 GQKTNKDYILPVSLIPGSSV                                          320
             Q    KDYILPV L+ G SV
Sbjct:  301 HQDIPKDYILPVGLLSGESV                                          320
```

A related DNA sequence was identified in *S. pyogenes* <SEQ ID 3597> which encodes the amino acid sequence <SEQ ID 3598>. Analysis of this protein sequence reveals the following:

The protein has homology with the following sequences in the databases:

```
>GP:AAC31628 GB:U46902 ScrR [Streptococcus mutans]
Identities = 226/321 (70%), Positives = 269/321 (83%), Gaps = 1/321 (0%)
Query:    1 VVAKLTDVAALAGVSPTTVSRVINKKGYLSQKTVNKVNKAMRELGYKPNNLARSLQGKST    60
            +VAKLTDVA LAGVSPTTVSRVIN+KGYLS+KT+ KV  AM+ LGYKPNNLARSLQGKS
Sbjct:    1 MVAKLTDVAKLAGVSPTTVSRVINRKGYLSEKTITKVQAAMKTLGYKPNNLARSLQGKSA    60

Query:   61 QLIGLIFPNISNIFYAELIEHLEIELFKQGYKTIICNSEHNPVKEREYLEMLAANQVDGI   120
            +LIGLIFPNIS+IFY+ELIE+LEIELFK GYK IICNS++NP KER+YLEML ANQVDGI
Sbjct:   61 KLIGLIFPNISHIFYSELIEYLEIELFKHGYKAIICNSQNNPDKERDYLEMLEANQVDGI   120

Query:  121 ISSSHNLGIEDYERVEAPIVAFDRNLAPNIPVISSDNFEGGKLAAQTLQKHGCQNIVMIT   180
            ISSSHNLGI+DYE+V API+AFDRNLAPNIP++SSDNFEGG++AA+ L+KHGCQ+ +MI
Sbjct:  121 ISSSHNLGIDDYEKVSAPIIAFDRNLAPNIPIVSSDNFEGGRMAAKLLKKHGCQHPIMIA   180

Query:  181 GNDNSDSPTGLRQLGFNYQLKRSAEIIKLPNNLSPVRREMEIKSILATRKPDGLFVSDDL   240
            G DNS+SPT LRQLGF     + A I L   LS +R+EMEIK IL   KPDG+F SDD+
Sbjct:  181 GKDNSNSPTALRQLGFK-SVFAQAPIFHLSGELSIIRKEMEIKVILQNEKPDGIFLSDDM   239

Query:  241 TAILIMKVAKQLHITIPEDMKVIGYDGTTFIQQYVPQLATIRQPIDEIAKLSVEILIKKI   300
            TAIL MK+A QL+ITIP ++++IGYDGT F++ Y P L TIRQPI +IA L V+IL+KKI
Sbjct:  240 TAILTMKIANQLNITIPHELKIIGYDGTHFVENYYPYLTTIRQPIKDIAHLLVDILLKKI   299

Query:  301 KKEKTSKDYILPITLLPGASI                                         321
             +    KDYILP+ LL G S+
Sbjct:  300 DHQDIPKDYILPVGLLSGESV                                         320
```

An alignment of the GAS and GBS proteins is shown below.

```
Identities = 247/321 (76%), Positives = 293/321 (90%), Gaps = 1/321 (0%)
Query:   1 MVAKLTDVAALAGVSPTTVSRVINKKGYLSQKTVTKVNEAMRTLGYKPNNLARSLQGKSA      60
           +VAKLTDVAALAGVSPTTVSRVINKKGYLSQKTV KVN+AMR LGYKPNNLARSLQGKS
Sbjct:   1 VVAKLTDVAALAGVSPTTVSRVINKKGYLSQKTVNKVNKAMRELGYKPNNLARSLQGKST     60

Query:  61 KLIGLIFPNIRNIFYAELIEHLEIELFKHGYKTILCNSEKDPIKEKEYLEMLGANQVDGI     120
           +LIGLIFPNI NIFYAELIEHLEIELFK GYKTI+CNSE +P+KE+EYLEML ANQVDGI
Sbjct:  61 QLIGLIFPNISNIFYAELIEHLEIELFKQGYKTIICNSEHNPVKEREYLEMLAANQVDGI     120

Query: 121 ISSSHNLGIDDYEKVEAPIVAFDRNLAPHIPIVSSDNFFGGKMAAQTLKKHGCQKMIMIT     180
           ISSSHNLGI+DYE+VEAPIVAFDRNLAP+IP++SSDNF GGK+AAQTL+KHGCQ ++MIT
Sbjct: 121 ISSSHNLGIEDYERVEAPIVAFDRNLAPNIPVISSDNFEGGKLAAQTLQKHGCQNIVMIT     180

Query: 181 GNDNSDSPTGLRRLGFSYESKES-KVITVTNGLSNMRREMELKSIISTHKPDGIFTSDDL     239
           GNDNSDSPTGLR+LGF+Y+ K S ++I + N LS +RREME+KSI++T KPDG+F SDDL
Sbjct: 181 GNDNSDSPTGLRQLGFNYQLKRSAEIIKLPNNLSPVRREMEIKSILATRKPDGLFVSDDL     240

Query: 240 TALLVIKLISQLGLSIPEDIKVIGYDGTSFIQDYVPHLTTIKQPIREIAQLMVEILLAKI     299
           TA+L++K+ QL ++IPED+KVIGYDGT+FIQ YVP L TI+QPI EIA+L VEIL+ KI
Sbjct: 241 TAILIMKVAKQLHITIPEDMKVIGYDGTTFIQQYVPQLATIRQPIDEIAKLSVEILIKKI     300

Query: 300 EGQKTNKDYILPVSLIPGSSV                                            320
           + +KT+KDYILP++L+PG+S+
Sbjct: 301 KKEKTSKDYILPITLLPGASI                                            321
```

Based on this analysis, it was predicted that these proteins and their epitopes could be useful antigens for vaccines or diagnostics.

Example 1160

A DNA sequence (GBSx1236) was identified in *S. agalactiae* <SEQ ID 3599> which encodes the amino acid sequence <SEQ ID 3600>. This protein is predicted to be sucrose-6-phosphate hydrolase (cscA). Analysis of this protein sequence reveals the following:

Possible site: 52
>>> Seems to have no N-terminal signal sequence
----- Final Results -----
  bacterial cytoplasm --- Certainty = 0.4775 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:CAA35872 GB:X51507 sucrose-6-phosphate hydrolase [Streptococcus mutans]
Identities = 303/479 (63%), Positives = 359/479 (74%), Gaps = 25/479 (5%)
Query:   1 MNLPTEIRYRPYDEWTEEDKENIVENVSKSPWRATYHLEAKTGLLNDPNGFSYFNGKFHL     60
           MNLP  IRYR Y +WTEE+ ++I  NV+ SPW  TYH+E KTGLLNDPNGFSYFNGKF+L
Sbjct:   1 MNLPQNIRYRRYQDWTEEEIKSIKTNVALSPWHTTYHIEPKTGLLNDPNGFSYFNGKFNL     60

Query:  61 FYQNWPFGAAHGLKQWVHTESDDLVHFKETGIKLKPDHVNDSHGAYSGSALAIDDKLFLF     120
           FYQNWPFGAAHGLK W+HTES+DLVHFKETG  L PD +DSHGAYSGSA  I D+LFLF
Sbjct:  61 FYQNWPFGAAHGLKSWIHTESEDLVHFKETGTVLYPDTSHDSHGAYSGSAYEIGDQLFLF     120

Query: 121 YTGNVRDMKWNRDPRQIGAWMTNDGKITKFDKVLISQPNDVTEHFRDPQIFNYDNQFYAV     180
           YTGNVRD  W R P  QIGA+M    G I KF  VLI QPNDVTEHFRDPQIFNY  QFYA+
Sbjct: 121 YTGNVRDENWVRHPLQIGAFMDKKGNIQKFTDVLIKQPNDVTEHFRDPQIFNYKGQFYAI     180

Query: 181 IGAQNSKKCGFIKLYKALNNDIHHWEFVGDLDFGGTGSEYMIECPNIIFVKGKPVLLYSP     240
           +GAQ+                    LDFGG+ SEYMIECPN++F+   +PVL+YSP
Sbjct: 181 VGAQS---------------------LDFGGSKSEYMIECPNLVFINEQPVLIYSP       215

Query: 241 QGLDKNELDYQNIYPNTYKIGQYFDANSSKIVEPSPIYNLDYGFEAYATQGFNTSDGRAF     300
           QGL K+ELDY NIYPNTYK+ Q FD      +V+ S I NLD+GFE YATQ FN  DGR +
Sbjct: 216 QGLSKSELDYHNIYPNTYKVCQSFDTEKPALVDASEIQNLDFGFECYATQAFNAPDGRVY     275

Query: 301 IVSWIGLPDIDYPSDQFDYQGAMSLVKELSIKNGNLYQYPVPAMKNLRQHQAEFKTQLQT     360
            VSWIGLPDIDYPSD +DYQGA+SLVKELS+K+G LYQYPV A+++LR    +    +T
Sbjct: 276 AVSWIGLPDIDYPSDSYDYQGALSLVKELSLKHGKLYQYPVEAVRSLRSEKEAVTYKPET     335

Query: 361 NNTYELELLVPRNDLSSFVLFANPKGQGLSITIDTVKGKVIIDRSQAGQQYATEFGTSRQ     420
           NNTYELEL   + ++   +LFA+ KG GL+IT+DT  G ++IDRS+AG+QYA EFG+ R
Sbjct: 336 NNTYELELTFDSSSVNELLLFADNKGNGLAITVDTRIGTILIDRSKAGEQYALEFGSQRS     395

Query: 421 CDIPKDATSINIFIDKSIFEIFINKGEKVFTGRVFPDAEQSGIQLKEGHVHGKYFELKY     479
           C I    T +NIF+DKSIFEIFINKGEKVFTGRVFP+  +Q+GI +K G   G Y+ELKY
Sbjct: 396 CSIQAKETVVNIFVDKSIFEIFINKGEKVFTGRVFPNDKQTGIVIKSGKPSGNYYELKY     454
```

A related DNA sequence was identified in *S. pyogenes* <SEQ ID 3601> which encodes the amino acid sequence <SEQ ID 3602>. Analysis of this protein sequence reveals the following:

---

Possible site 31
>>> Seems to have no N-terminal signal sequence
----- Final Results -----
    bacterial cytoplasm --- Certainty = 0.4629 (Affirmative) <succ>
      bacterial membrane --- Certainty = 0.0000 (Not Clear) <succ>
        bacterial outside --- Certainty = 0.0000 (Not Clear) <succ>

---

An alignment of the GAS and GBS proteins is shown below.

```
Identities = 288/479 (60%), Positives = 367/479 (76%)
Query:    1 MNLPTEIRYRPYDEWTEEDKENIVKNVSKSPWRATYHLEAKTGLLNDPNGFSYFNGKFHL    60
            M+LP  IRYRPY EW+ +D +I  + +++SPW + +H+E KTGLLNDPNGFSYFNG++HL
Sbjct:    2 MDLPQAIRYRPYKEWSSKDYQAITEKMAQSPWHSQFHVEPKTGLLNDPNGFSYFNGRYHL    61

Query:   61 FYQNWPFGAAHGLKQWVHTESDDLVHFKETGIKLKPDHVNDSHGAYSGSALAIDDKLFLF   120
            FYQNWP+GAAHGLKQWVH  S DLVHF ET  +L PDH +DSHGAYSGSA AIDDKLFLF
Sbjct:   62 FYQNWPYGAAHGLKQWVHMISTDLVHFTETRSRLLPDHAHDSHGAYSGSAYAIDDKLFLF   121

Query:  121 YTGNVRDMKWNRDPRQIGAWMTNDGKITKFDKVLISQPNDVTEHFRDPQIFNYDNQFYAV   180
            YTGNVRD  W R P Q+GAWM   G I+K  +VLI QP+DVTEHFRDPQ+F+Y  QFYA+
Sbjct:  122 YTGNVRDANWVRTPLQVGAWMDKQGNISKIPQVLIEQPDDVTEHFRDPQLFSYQGQFYAI   181

Query:  181 IGAQNSKKCGFIKLYKALNNDIHHWEFVGDLDFGGTGSEYMIECPNIIFVKGKPVLLYSP   240
            IGAQ    G IKLYKA++N + +W F+ DLDF  +G+EYMIECPN++FV  KPVL++SP
Sbjct:  182 IGAQGLDGKGKIKLYKAVDNHVDNWRFIADLDFDDSGTEYMIECPNLVFVDDKPVLIFSP   241

Query:  241 QGLDKNELDYQNIYPNTYKIGQYFDANSSKIVEPSPIYNLDYGFEAYATQGFNTSDGRAF   300
            QGL K +LDYQNIYPNTYKI + F+  + +++    + NLD+GFEAYATQ F++ DGR
Sbjct:  242 QGLAKADLDYQNIYPNTYKIFESFNPETGQLLGGGALQNLDFGFEAYATQAFSSPDGRVL   301

Query:  301 IVSWIGLPDIDYPSDQFDYQGAMSLVKELSIKNGNLYQYPVPAMKNLRQHQAEFKTQLQT   360
             VSWIGLPDIDYP+D++DYQGA+SLVKEL IK+G LYQ PV A++NLR    F ++ +
Sbjct:  302 AVSWIGLPDIDYPTDRYDYQGALSLVKELRIKDGILYQTPVSALQNLRGPAELFHNKIDS   361

Query:  361 NNTYELELLVPRNDLSSFVLFANPKGQGLSITIDTVKGKVIIDRSQAGQQYATEFGTSRQ   420
            +N YELEL +P        +LFA+ KG GL + +DT KG++ IDRS+AG QYA ++GT R
Sbjct:  362 SNCYELELTIPGQKKLDLLLFADQKGNGLRLKVDTTKGQLSIDRSRAGVQYAQDYGTVRS   421

Query:  421 CDIPKDATSINIFIDKSIFEIFINKGEKVFTGRVFPDAEQSGIQLKEGHVHGKYFELKY   479
            C IP+   ++N+++D SI EIFIN+G+KV T RVFP   Q+GIQ+ EG   G Y+E++Y
Sbjct:  422 CQIPQGHVTLNVYVDNSILEIFINQGQKVLTSRVFPTHGQTGIQVVEGQAFGHYYEMRY   480
```

Based on this analysis, it was predicted that these proteins and their epitopes could be useful antigens for vaccines or diagnostics.

Example 1161

A DNA sequence (GBSx1237) was identified in *S. agalactiae* <SEQ ID 3603> which encodes the amino acid sequence <SEQ ID 3604>. Analysis of this protein sequence reveals the following:

---

Possible site: 14
>>> Seems to have no N-terminal signal sequence
----- Final Results -----
    bacterial cytoplasm --- Certainty = 0.2204 (Affirmative) <succ>
      bacterial membrane --- Certainty = 0.0000 (Not Clear) <succ>
        bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1162

A DNA sequence (GBSx1238) was identified in *S. agalactiae* <SEQ ID 3605> which encodes the amino acid sequence <SEQ ID 3606>. Analysis of this protein sequence reveals the following:

---

Possible site: 27
>>> Seems to have no N-terminal signal sequence
INTEGRAL    Likelihood = −7.64    Transmembrane 259-275 (250-283)
INTEGRAL    Likelihood = −4.41    Transmembrane 113-129 (109-130)
INTEGRAL    Likelihood = −3.03    Transmembrane 180-196 (180-196)
INTEGRAL    Likelihood = −3.03    Transmembrane 439-455 (438-456)
INTEGRAL    Likelihood = −2.81    Transmembrane 298-314 (298-317)
INTEGRAL    Likelihood = −2.02    Transmembrane 396-412 (395-412)
----- Final Results -----
    bacterial membrane --- Certainty = 0.4057 (Affirmative) <succ>
      bacterial outside --- Certainty = 0.0000 (Not Clear) <succ>
        bacterial cytoplasm --- Certainty = 0.0000 (Not Clear) <succ>

---

The protein has homology with the following sequences in the GENPEPT database.

```
>GP:AAC99320 GB:AF059741 sucrose-specific PTS permease [Clostridium
beijerinckii]
Identities = 235/453 (51%), Positives = 312/453 (67%), Gaps = 15/453 (3%)
Query:   7 IAKQVINAIGGASNVRSVAHCATRLRVMVKDETVIDKNTVENIEKVQGAFFNSGQYQIIF    66
             +AK+++   IGG  N++SV HCATRLR+++ D+  I++   +ENI+ V+G FF++ QYQII
Sbjct:   6 VAKEILENIGGKENIKSVEHCATRLRLILNDKEKINEKAIENIDGVKGQFFSAAQYQIIL    65

Query:  67 GTGTVNKIYDEVVAQGLPTSSTSDQKAEAAKQGNAFQRAIRTFGDVFVPLLPAIVATGLF   126
            GTG VN++YD +V Q      T + K EA   Q+   RTFGDVFVP++P +VATGLF
Sbjct:  66 GTGFVNEVYDVIVGQNSDLV-TGNNKEEAYSQMTLIQKISRTFGDVFVPIIPVLVATGLF   124

Query: 127 MGIRGAINNDTVLALFGTTSKAFSSSNFYTYTVVLTDTAFAFFPPALISWSAFRVFGGNPV   186
            MG+RG + N  V              + NF  +T VLTDTAFAF PAL++WS  + FGG PV
Sbjct: 125 MGLRGLLTNLGVQM---------NENFVLFTQVLTDTAFAFLPALVAWSTMKKFGGTPV   174

Query: 187 IGLVLGLMMVNSALPNAWAVASGDAHPIKF--FGF-IPVVGYQNSVLPAFFVGLLGAKLE   243
            IG+V+GLM+V+ +LPNA+AVA+G A PI    G    IPVVGYQ SVLPA  +G++ AK +
Sbjct: 175 IGIVIGLMLVSPSLPNAYAVAAGTATPINLTILGLNIPVVGYQGSVLPALVLGIIAAKTQ   234

Query: 244 KWLHKKIPDVLDLLLVPFLTFTVMSILALFVIGPIFHSVENYVLAGTKFVLNLPLGLSGL   303
            K L K +PDVLDL++ PF+T     +L L ++GPI H+ E +    K   + LP GL GL
Sbjct: 235 KALKKVVPDVLDLIVTPFITLLFSMVLGLLIVGPIMHNAEQLIFGAIKGFMGLPFGLGGL   294

Query: 304 ILGGVHQIIVVTGVHHIFNLLEAQLIAADGKDPFNAIITAAMTAQAGATLAVGVKTKNKK   363
            ++GGVHQ+IVVTGVHH  N LE +L+++ GKD FNA+IT   + AQ  A LAV VKTK+KK
Sbjct: 295 VVGGVHQLIVVTGVHHALNALEVELLSSTGKDAFNAMITCGIVAQGAAALAVAVKTKDKK   354

Query: 364 LKALAFPAALSAGLGITEPAIFGVNLRFGKPFIMGLIAGAAGGWLASILKLAGTGFGITI   423
              ++L   +A+  A LGITEPAIFGVNLRF KPFI G    GA GG L+ IL LAGTG GIT
Sbjct: 355 KRSLYISSAIPAFLGITEPAIFGVNLRFIKPFIFGCAGGAVGGMLSGILHLAGTGMGITA   414

Query: 424 IPGTLLYLNGQIVKYLIMVIGTTSLAFVLTYMF                             456
            +PG LLY+N  +   Y+++ +    ++AF LT  F
Sbjct: 415 LPGMLLYVN-NLGSYILVNVVAIAVAFCLTLFF                             446
```

A related DNA sequence was identified in *S. pyogenes* <SEQ ID 3607> which encodes the amino acid sequence <SEQ ID 3608>. Analysis of this protein sequence reveals the following:

---

Possible site: 26
>>> Seems to have no N-terminal signal sequence
INTEGRAL    Likelihood = –4.99    Transmembrane 111-127 (108-129)
INTEGRAL    Likelihood = –4.57    Transmembrane 176-192 (176-193)
INTEGRAL    Likelihood = –4.35    Transmembrane 436-452 (431-453)
INTEGRAL    Likelihood = –3.88    Transmembrane 295-311 (293-314)
INTEGRAL    Likelihood = –3.50    Transmembrane 259-275 (253-277)
INTEGRAL    Likelihood = –2.07    Transmembrane 405-421 (405-421)
INTEGRAL    Likelihood = –0.43    Transmembrane 219-235 (219-235)
----- Final Results -----
   bacterial membrane --- Certainty = 0.2996 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the databases:

```
>GP:AAC99320 GB:AF059741 sucrose-specific PTS permease [Clostridium
beijerinckii]
Identities = 234/451 (51%), Positives = 312/451 (68%), Gaps = 11/451 (2%)
Query:   1 MDNRQIAAEVIEALGGRENVRSVAHCATRLRVMVYDEGKIDKEKAEAIDKVKGAFFNSGQ    60
            M  + +A E++E +GG+EN++SV HCATRLR+++ D+ KI+++   E ID VKG FF++ Q
Sbjct:   1 MKEQIVAKEILENIGGKENIKSVEHCATRLRLILNDKEKINEKAIENIDGVKGQFFSAAQ    60

Query:  61 YQMIFGTGTVNNIYDEVVALGLPTSSTSEQKAEAGKHGNIFQRAIRTFGDVFVPIIPAIV   120
            YQ+I GTG VN +YD +V      T   K EA   + Q+   RTFGDVFVPIIP +V
Sbjct:  61 YQIILGTGFVNEVYDVIVGQNSDLV-TGNNKEEAYSQMTLIQKISRTFGDVFVPIIPVLV   119

Query: 121 ATGLFMGVRGLVTQPAIMDLFGVHEYGENFLMYTRILTDTAFVYLPALVAWSAFRVFGGN   180
            ATGLFMG+RGL+T  +          +   ENF+++T++LTDTAF +LPALVAWS  + FGG
Sbjct: 120 ATGLFMGLRGLLTNLGV-------QMNENFVLFTQVLTDTAFAFLPALVAWSTMKKFGGT   172

Query: 181 PIIGIVLGLMLVSNELPNAWVVASGGDVK-PLTFFGF-VPVVGYQGTVLPAFFVGLVGAK   238
            P+IGIV+GLMLVS  LPNA+ VA+G        LT G +PVVGYQG+VLPA  +G++ AK
Sbjct: 173 PVIGIVIGLMLVSPSLPNAYAVAAGTATPINLTILGLNIPVVGYQGSVLPALVLGIIAAK   232

Query: 239 LEKWLHKKVPEALDLLVTPFLTFAIMSTLGLFVIGPVFHSLENLVLAGTQAVLHLPFGIA   298
             +K L K VP+ LDL+VTPF+T      LGL ++GP+ H+ E L+      +  + LPFG+
Sbjct: 233 TQKALKKVVPDVLDLIVTPFITLLFSMVLGLLIVGPIMHNAEQLIFGAIKGFMGLPFGLG   292

Query: 299 GLIVGGIQQLIVVTGIHHIFNFLEAQLIANTGKDPFNAYLTAATAAQAGATLAVAVKTKS   358
            GL+VGG+ QLIVVTG+HH  N LE +L++ TGKD FNA +T    AQ  A LAVAVKTK
Sbjct: 293 GLVVGGVHQLIVVTGVHHALNALEVELLSSTGKDAFNAMITCGIVAQGAAALAVAVKTKD   352
```

```
Query: 359  TKLKGLAFPSTLSALLGITEPAIFGVNLRYPKVFVSGLIGGALGGWVAGLFGIAGTGFGI  418
            K + L   S + A LGITEPAIFGVNLR+ K F+ G  GGA+GG ++G+   +AGTG GI
Sbjct: 353  KKKRSLYISSAIPAFLGITEPAIFGVNLRFIKPFIFGCAGGAVGGMLSGILHLAGTGMGI  412

Query: 419  TVLPGTLLYLNGQLLQYLVTMLVGLGVAFAI                              449
            T LPG LLY+N L  Y++  +V + VAF +
Sbjct: 413  TALPGMLLYVN-NLGSYILVNVVAIAVAFCL                              442
```

An alignment of the GAS and GBS proteins is shown below.

```
Identities = 409/618 (66%), Positives = 491/618 (79%), Gaps = 12/618 (1%)
Query:   4  NTEIAKQVINAIGGASNVRSVAHCATRLRVMVKDETVIDKNTVENIEKVQGAFFNSGQYQ   63
            N +IA +VI A+GG  NVRSVAHCATRLRVMV DE   IDK    E I+KV+GAFFNSGQYQ
Sbjct:   3  NRQIAAEVIEALGGRENVRSVAHCATRLRVMVYDEGKIDKEKAEAIDKVKGAFFNSGQYQ   62

Query:  64  IIFGTGTVNKIYDEVVAQGLPTSSTSDQKAEAAKQGNAFQRAIRTFGDVFVPLLPAIVAT  123
            +IFGTGTVN IYDEVVA GLPTSSTS+QKAEA K GN FQRAIRTFGDVFVP++PAIVAT
Sbjct:  63  MIFGTGTVNNIYDEVVALGLPTSSTSEQKAEAGKHGNIFQRAIRTFGDVFVPIIPAIVAT  122

Query: 124  GLFMGIRGAINNDTVLALFGTTSKAFSSSNFYTYTVVLTDTAFAFFPALISWSAFRVFGG  183
            GLFMG+RG +   ++ LFG       NF YT +LTDTAF + PAL++WSAFRVFGG
Sbjct: 123  GLFMGVRGLVTQPAIMDLFGVHEYG---ENFLMYTRILTDTAFVYLPALVAWSAFRVFGG  179

Query: 184  NPVIGLVLGLMMVNSALPNAWAVASG-DAHPIKFFGFIPVVGYQNSVLPAFFVGLLGAKL  242
            NP+IG+VLGLM+V++ LPNAW VASG D  P+ FFGF+PVVGYQ +VLPAFFVGL+GAKL
Sbjct: 180  NPIIGIVLGLMLVSNELPNAWVVASGGDVKPLTFFGFVPVVGYQGTVLPAFFVGLVGAKL  239

Query: 243  EKWLHKKIPDVLDLLLVPFLTFTVMSILALFVIGPIFHSVENYVLAGTKFVLNLPLGLSG  302
            EKWLHKK+P+ LDLL+ PFLTF +MS L LFVIGP+FHS EN VLAGT+ VL+LP G++G
Sbjct: 240  EKWLHKKVPEALDLLVTPFLTFAIMSTLGLFVIGPVFHSLENLVLAGTQAVLHLPFGIAG  299

Query: 303  LILGGVHQIIVVTGVHHIFNLLEAQLIAADGKDPFNAIITAAMTAQAGATLAVGVKTKNK  362
            LI+GG+ Q+IVVTG+HHIFN LEAQLIA  GKDPFNA +TAA  AQAGATLAV VKTK+
Sbjct: 300  LIVGGIQQLIVVTGIHHIFNFLEAQLIANTGKDPFNAYLTAATAAQAGATLAVAVKTKST  359

Query: 363  KLKALAFPAALSAGLGITEPAIFGVNLRFGKPFIMGLIAGAAGGWLASILKLAGTGFGIT  422
            KLK LAFP+ LSA LGITEPAIFGVNLR+ K F+ GLI GA GGW+A +  +AGTGFGIT
Sbjct: 360  KLKGLAFPSTLSALLGITEPAIFGVNLRYPKVFVSGLIGGALGGWVAGLFGIAGTGFGIT  419

Query: 423  IIPGTLLYLNGQIVKYLIMVIGTTSLAFVLTYMFGYEDKDEKAVAEVSPLVEETDDDPTI  482
            ++PGTLLYLNGQ+++YL+ ++    +AF + Y +GY+D++   + V   V++T D P +
Sbjct: 420  VLPGTLLYLNGQLLQYLVTMLVGLGVAFAIAYTWGYQDRETLPLPAVE--VDQTADQPAL  477

Query: 483  TQTSQLRAETIVSPLDGQVIALDTVSDPVFSSGIMGDGLAIKPRGNTIYSPVDGFVQIAF  542
            +          ET+ SPL+G V+ L  VSDPVFSSG MG GLAIKP   NT+YSPVDG V+I F
Sbjct: 478  AE------ETLYSPLNGTVVDLSAVSDPVFSSGAMGQGLAIKPEDNTLYSPVDGKVEIVF  531

Query: 543  ETGHAYGIKSDKGAEILIHIGIDTVTMNGTGFTSKVKADQKVKKGDILGTFDSAKIAEAG  602
            ETGHAY I S +GAE+L+HIGIDT +M G GF S V   Q VKKGD+LG FD +KIAEAG
Sbjct: 532  ETGHAYAITSSQGAEVLLHIGIDTESMAGDGFESLVAVGQAVKKGDLLGHFDPSKIAEAG  591

Query: 603  LDNTAMIIVTNTADFADV                                           620
            LD+T M+IV+N AD+  V
Sbjct: 592  LDDTTMMIVSNIADYQSV                                           609
```

Based on this analysis, it was predicted that these proteins and their epitopes could be useful antigens for vaccines or diagnostics.

Example 1163

A DNA sequence (GBSx1239) was identified in *S. agalactiae* <SEQ ID 3609> which encodes the amino acid sequence <SEQ ID 3610>. This protein is predicted to be fructokinase. Analysis of this protein sequence reveals the following:

Possible site: 18
>>> Seems to have no N-terminal signal sequence
----- Final Results -----
  bacterial cytoplasm --- Certainty = 0.2436 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:BAA02467 GB:D13175 fructokinase [Streptococcus mutans]
Identities = 232/291 (79%), Positives = 257/291 (87%)
Query:   1  MTKLYGSIEAGGTKFVCAVGDEELKVVEKMQFPTTTPQETIKKTVDFFKRFEKKLEAVAI   60
            M+KLYGSIEAGGTKFVCAVGDE   +EK+QFPTTTP ETI+KTV FFK+FE  L +VAI
Sbjct:   1  MSKLYGSIEAGGTKFVCAVGDENFQILEKVQFPTTTPYETIEKTVAFFKKFEADLASVAI   60
```

```
Query:  61  GSFGPIDIDKKSKTYGYITTTPKLHWANVDLLGLISKDFNVPFYFTTDVNSSAYGEVIAR    120
            GSFGPIDID+ S TYGYIT+TPK +WANVD +GLISKDF +PFYFTTDVNSSAYGE IAR
Sbjct:  61  GSFGPIDIDQNSDTYGYITSTPKPNWANVDFVGLISKDFKIPFYFTTDVNSSAYGETIAR    120

Query: 121  NNIDSLVYYTIGTGIGAGAIQKGEFIGGTGHTEAGHTYMAMHPQDQANDFKGICPFHNSC    180
            +N+ SLVYYTIGTGIGAGAIQ GEFIGG GHTEAGH YMA HP D  + F G CPFH  C
Sbjct: 121  SNVKSLVYYTIGTGIGAGAIQNGEFIGGMGHTEAGHVYMAPHPNDVHHGFVGTCPFHKGC    180

Query: 181  LEGLASGPTLEARTGIRGELIEENSMVWDVQAYYIAQAAIQATVLYRPQVIVFGGGVMAQ    240
            LEGLA+GP+LEARTGIRGELIE+NS  VWD+QAYYIAQAAIQATVLYRPQVIVEGGGVMAQ
Sbjct: 181  LEGLAAGPSLEARTGIRGELIEQNSEVWDIQAYYIAQAAIQATVLYRPQVIVEGGGVMAQ    240

Query: 241  EHMLRRVRQTFATLLLNGYLPVPDLSDYIVTPAIEENGSATLGNFALAKKIS          291
            EHML RVR+ F +LLN YLPVPD+ DYIVTPA+ ENGSATLGN ALAKKI+
Sbjct: 241  EHMLNRVREKFTSLLNDYLPVPDVKDYIVTPAVAENGSATLGNLALAKKIA          291
```

A related DNA sequence was identified in *S. pyogenes* <SEQ ID 3611> which encodes the amino acid sequence <SEQ ID 3612>. Analysis of this protein sequence reveals the following:

---

Possible site: 52
>>> Seems to have no N-terminal signal sequence
----- Final Results -----
bacterial cytoplasm --- Certainty = 0.2012 (Affirmative) <succ>
bacterial membrane --- Certainty = 0.0000 (Not Clear) <succ>
bacterial outside --- Certainty = 0.0000 (Not Clear) <succ>

---

An alignment of the GAS and GBS proteins is shown below.

```
Identities = 212/293 (72%), Positives = 246/293 (83%)
Query:   1  MTKLYGSIEAGGTKFVCAVGDEELKVVEKMQFPTTTPQETIKKTVDFFKRFEKKLEAVAI    60
            M KLYGSIEAGGTKFVCAVGDEE  VV+K QFPTTTP+ETI +T+ +FK FE  L  +AI
Sbjct:   1  MGKLYGSIEAGGTKFVCAVGDEEFTVVDKTQFPTTTPEETIARTIAYFKAFEADLAGMAI    60

Query:  61  GSFGPIDIDKKSKTYGYITTTPKLHWANVDLLGLISKDFNVPFYFTTDVNSSAYGEVIAR   120
            GSFGPIDID    S+TYGYITTTPK  WANVDLLG +S  F  +PF TTDVNSSAYGEV+AR
Sbjct:  61  GSFGPIDIDPSSETYGYITTTPKSGWANVDLLGQLSAAFKIPFDVTTDVNSSAYGEVLAR   120

Query: 121  NNIDSLVYYTIGTGIGAGAIQKGEFIGGTGHTEAGHTYMAMHPQDQANDFKGICPFHNSC   180
                ++SLVYYTIGTGIGAGAIQ G FIGG GHTEAGHTY+  HP D A  F G+CPFH  C
Sbjct: 121  PGVESLVYYTIGTGIGAGAIQHGHFIGGLGHTEAGHTYVMPHPDDMAKGFLGVCPFHKGC   180

Query: 181  LEGLASGPTLEARTGIRGELIEENSMVWDVQAYYIAQAAIQATVLYRPQVIVFGGGVMAQ   240
            LEG+A+GP++EARTG+RGE +++  + VWD+QA+YIAQAA+QAT+LYRPQVIVFGGGVMAQ
Sbjct: 181  LEGMAAGPSIEARTGVRGERLDQEADVWDIQAFYIAQAALQATMLYRPQVIVFGGGVMAQ   240

Query: 241  EHMLRRVRQTFATLLLNGYLPVPDLSDYIVTPAIEENGSATLGNFALAKKISKG        293
            EHM+ RV   F  LL+GYLPVPDL+DYIVTPA+ +NGSATLGNFALAK  ++G
Sbjct: 241  EHMVLRVHDKFTALLSGYLPVPDLTDYIVTPAVADNGSATLGNFALAKLAAQG        293
```

Based on this analysis, it was predicted that these proteins and their epitopes could be useful antigens for vaccines or diagnostics.

Example 1164

A DNA sequence (GBSx1240) was identified in *S. agalactiae* <SEQ ID 3613> which encodes the amino acid sequence <SEQ ID 3614>. This protein is predicted to be Mannose-phosphate Isomerase (pmi). Analysis of this protein sequence reveals the following:

---

Possible site: 50
>>> Seems to have no N-terminal signal sequence
----- Final Results -----
bacterial cytoplasm --- Certainty = 0.4717 (Affirmative) <succ>
bacterial membrane --- Certainty = 0.0000 (Not Clear) <succ>
bacterial outside --- Certainty = 0.0000 (Not Clear) <succ>

---

The protein has homology with the following sequences in the GENPEPT database.

```
>GP:BAA04021 GB:D16594 Mannosephosphate Isomerase [Streptococcus mutans]
Identities = 232/312 (74%), Positives = 262/312 (83%)
Query:   1  MSEPLFLEASMHDKIWGGTKLRDEFGYDIPSETTGEYWAISAHPNGVSRVKNGRFKGCFL    60
            M  PLFL++ MH KIWGG +LR EFGYDIPSETTGEYWAISAHPNGVS VKNG +KG  L
Sbjct:   1  MEGPLFLQSQMHKKIWGGNRLRKEFGYDIPSETTGEYWAISAHPNGVSVVKNGVYKGVPL    60

Query:  61  DKLYQGEKSLFGNPDDTVFPLLTKILDANDWLSVQVHPDDAYALKHEGELGKTECWYIIS   120
            D+LY  + LFGN   +VFPLLTKILDANDWLSVQVHPD+AYAL+HEGELGKTECWY+IS
```

```
Sbjct:  61  DELYAEHRELFGNSKSSVFPLLTKILDANDWLSVQVHPDNAYALEHEGELGKTECWYVIS  120

Query: 121  ADEGSEIIYGHNAKTKEELRQMIESGDWEHLLTRIPVKSGDFYYVPSGTMHAIGKGILIL  180
            ADEG+EIIYGH AK+KEELRQMI +GDW+HLLT+IPVK+GDF+YVPSGTMHAIG+GI+IL
Sbjct: 121  ADEGAEIIYGHEAKSKEELRQMIAAGDWDHLLTKIPVKAGDFFYVPSGTMHAIGRGIMIL  180

Query: 181  ETQQSSDTTYRVYDFDRPDASGKLRDLHIEQSIDVLTIGKPANTVPANMKLKHLSSTLLV  240
            ETQQSSDTTYRVYDFDR  D  G+ R LHIEQSIDVLTIGKPAN  PA + L+ L +T+LV
Sbjct: 181  ETQQSSDTTYRVYDFDRKDDQGRKRALHIEQSIDVLTIGKPANATPAWLSLQGLETTVLV  240

Query: 241  SNDFFTVYKWEISGVTNFKQFAPYLLVSVLDGAGHITVDNKVYTLKKGDHFILPNDVVKW  300
            S+ FFTVYKW+ISG   +Q APYLLVSVL G G ITV + Y L+KGDH ILPN +  W
Sbjct: 241  SSPFFTVYKWQISGSVKMQQTAPYLLVSVLAGQGRITVGLEQYALRKGDHLILPNTIKSW  300

Query: 301  DIDGQLEIIASH                                                  312
              DG LEIIASH
Sbjct: 301  QFDGDLEIIASH                                                  312
```

A related DNA sequence was identified in *S. pyogenes* <SEQ ID 3615> which encodes the amino acid sequence <SEQ ID 3616>. Analysis of this protein sequence reveals the following:

Possible site: 53
>>> Seems to have no N-terminal signal sequence
----- Final Results -----
  bacterial cytoplasm --- Certainty = 0.3714 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 232/312 (74%), Positives = 264/312 (84%)
Query:   1  MSEPLFLEASMHDKIWGGTKLRDEFGYDIPSETTGEYWAISAHPNGVSRVKNGRFKGCFL   60
            MSEPLFL+++MHD+IWGGTKLRD F Y+IPS+TTGEYWAISAHPNGVS V NGR++G  L
Sbjct:   1  MSEPLFLKSTMHDRIWGGTKLRDVFAYNIPSDTTGEYWAISAHPNGVSTVTNGRYQGQPL   60

Query:  61  DKLYQGEKSLFGNPDDTVFPLLTKILDANDWLSVQVHPDDAYALKHEGELGKTECWYIIS  120
            + LY  E +LFGNP + VFPLLTKILDANDWLSVQVHPDDAY +HEGELGKTECWYIIS
Sbjct:  61  NTLYAQEPALFGNPKEEVFPLLTKILDANDWLSVQVHPDDAYGREHEGELGKTECWYIIS  120

Query: 121  ADEGSEIIYGHNAKTKEELRQMIESGDWEHLLTRIPVKSGDFYYVPSGTMHAIGKGILIL  180
            A+EGSEI+YGH AK+KE+LR MIE+G W+ LLTR+PVK+GDF+YVPSGTMHAIGKGILIL
Sbjct: 121  AEEGSEIVYGHQAKSKEDLRAMIEAGAWDDLLTRVPVKAGDFFYVPSGTMHAIGKGILIL  180

Query: 181  ETQQSSDTTYRVYDFDRPDASGKLRDLHIEQSIDVLTIGKPANTVPANMKLKHLSSTLLV  240
            ETQQSSDTTYRVYDFDR D +G LRDLHIE+SIDVLTIGKP N+VPA M L ++ +T LV
Sbjct: 181  ETQQSSDTTYRVYDFDRKDVNGNLRDLHIEKSIDVLTIGKPENSVPATMVLDNMVATTLV  240

Query: 241  SNDFFTVYKWEISGVTNFKQFAPYLLVSVLDGAGHITVDNKVYTLKKGDHFILPNDVVKW  300
            S   FFTVYKW  S + + KQ APYLLVSVL G G + VD K Y L+KG HFILPNDV W
Sbjct: 241  STPFFTVYKWVTSQMVDMKQAAPYLLVSVLKGQGKLYVDQKAYELEKGMHFILPNDVKSW  300

Query: 301  DIDGQLEIIASH                                                  312
              DGQLE+I SH
Sbjct: 301  SFDGQLEMIVSH                                                  312
```

Based on this analysis, it was predicted that these proteins and their epitopes could be useful antigens for vaccines or diagnostics.

Example 1165

A DNA sequence (GBSx1241) was identified in *S. agalactiae* <SEQ ID 3617> which encodes the amino acid sequence <SEQ ID 3618>. This protein is predicted to be preprotein translocase seca subunit (secA). Analysis of this protein sequence reveals the following:

Possible site: 53
>>> Seems to have no N-terminal signal sequence
----- Final Results -----
  bacterial cytoplasm --- Certainty = 0.1102 (Affirmative) <succ>
    bacterial membrane --- Certainty = 0.0000 (Not Clear) <succ>
      bacterial outside --- Certainty = 0.0000 (Not Clear) <succ>

A related GBS nucleic acid sequence <SEQ ID 10107> which encodes amino acid sequence <SEQ ID 10108> was also identified.

The protein has homology with the following sequences in the GENPEPT database.

```
>GP:AAA50286 GB:L32090 secA [Listeria monocytogenes]
Identities = 503/843 (59%), Positives = 643/843 (75%), Gaps = 16/843 (1%)
Query:  11  MANILRTVIENDKGELKKLDKIAKKVDSYADHMAALSDEALQAKTPEFKERYQNGETLDQ   70
            MA +L+ + E+ K ++K L++ A ++ + AD  AALSD+AL+ KT EFKER Q GETLD
Sbjct:   1  MAGLLKKIFESGKKDVKYLERKADEIIALADETAALSDDALREKTVEFKERVQKGETLDD   60

Query:  71  LLPEAFAVVREASKRVLGLYPYHVQIMGGIVLHHGDIPEMRTGEGKTLTATMPVYLNAIS  130
            LL EAFAV RE +KR LGLYP+ VQ+MGGIVLH  +I EM+TGEGKTLTAT+PVYLNA+S
Sbjct:  61  LLVEAFAVAREGAKRALGLYPFKVQLMGGIVLHEDNIAEMKTGEGKTLTATLPVYLNALS  120

Query: 131  GLGVHVITVNEYLSTRDATEMGEVYSWLGLSVGINLAAKSPFEKREAYNCDITYSTNAEV  190
            G GVHV+TVNEYL+ RDA EMG +Y++LGLSVG+NL A S  EKREAY CDITYSTN E+
Sbjct: 121  GEGVHVVTVNEYLAHRDAEEMGVLYNFLGLSVGLNLNALSSTEKREAYACDITYSTNNEL  180

Query: 191  GFDYLRDNMVVRQEDMVQRPLNYALVDEVDSVLIDEARTPLIVSGPVSSEMNQLYTRADM  250
            GFDYLRDNMVV +E+MVQRPL +A++DEVDS+L+DEARTPLI+SG  + +   LY RA+
Sbjct: 181  GFDYLRDNMVVYKEEMVQRPLAFAVIDEVDSILVDEARTPLIISGE-AEKSTILYVRANT  239

Query: 251  FVKTL-NSDDYIIDVPTKTIGLSDTGIDKAENYFHLNNLYDLENVALTHYIDNALRANYI  309
            FV+TL   +DY +D+ TK++ L++ G+ K ENYF + NL+DLEN + H+I AL+ANY
Sbjct: 240  FVRTLTEEEDYTVDIKTKSVQLTEDGMTKGENYFDVENLFDLENTVILHHIAQALKANYT  299

Query: 310  MLLNIDYVVSEEQEILIVDQFTGRTMEGRRFSDGLHQAIEAKESVPIQEESKTSASITYQ  369
            M L++DYVV ++ E+LIVDQFTGR M+GRRFS+GLHQA+EAKE V IQ ESKT A+IT+Q
Sbjct: 300  MSLDVDYVV-QDDEVLIVDQFTGRIMKGRRFSEGLHQALEAKEGVTIQNESKTMATITFQ  358

Query: 370  NMFRMYHKLAGMTGTGKTEEEEFREIYNMRVIPIPTNRPVQRIDHSDLLYPTLDSKFRAV  429
            N FRMY KLAGMTGT KTEEEEFR+IYNMRVI IPTN+ + R D  DL+Y T+++KF AV
Sbjct: 359  NYFRMYKKLAGMTGTAKTEEEEFRDIYNMRVIEIPTNKVIIRDDRPDLIYTTMEAKFNAV  418

Query: 430  VADVKERYEQGQPVLVGTVAVETSDLISRKLVAAGVPHEVLNAKNHFKEAQIIMNAGQRG  489
            V D+ ER+ +GQPVLVGTVA+   +LIS KL   G+ H+VLNAK H +EA II +AG+RG
Sbjct: 419  VEDIAERHAKGQPVLVGTVAMNI-ELISSKLKRKGIKHDVLNAKQHEREADIIKHAGERG  477

Query: 490  AVTIATNMAGRGTDIKLGEGVRELGGLCVIGTERHESRRIDNQLRGRSGRQGDPGESQFY  549
            AV IATNMAGRGTDIKLGEG  E GGL VIGTERHESRRIDNQLRGRSGRQGDPG +QFY
Sbjct: 478  AVVIATNMAGRGTDIKLGEGTIEAGGLAVIGTERHESRRIDNQLRGRSGRQGDPGVTQFY  537

Query: 550  LSLEDDLMRRFGTDRIKVVLERMNLAEDDTVIKSKMLTRQVESAQRRVEGNNYDTRKQVL  609
            LS+ED+LMRRFG+D +K ++ER  +AED   I+SKM++R VESAQRRVEGNN+D+RKQVL
Sbjct: 538  LSMEDELMRRFGSDNMKSMMERFGMAED--AIQSKMVSRAVESAQRRVEGNNFDSRKQVL  595

Query: 610  QYDDVMREQREIIYANRREVITAERDLGPELKGMIKRTIKRAVDAHSRSDKNTAA---EA  666
            QYDDV+R+QRE+IY  R EVI AE  L    ++ MI+RT+   V +++ +  A     +
Sbjct: 596  QYDDVLRQQREVIYKQRYEVINAENSLREIIEQMIQRTVNFIVSSNASSHEPEEAWNLQG  655

Query: 667  IVNFARSALLDEEAITVSELRGLKEAEIKELLYERALAVYEQQIAKLKDPEAIIEFQKVL  726
            I+++  + LL E  IT+ +L+     +I+ L+ ++ A Y+++   L PE   EF+KV+
Sbjct: 656  IIDYVDANLLPEGTITLEDLQNRTSEDIQNLILDKIKAANDEK-ETLLPPEEFNEFEKVV  714

Query: 727  ILMVVDNQWTEHIDALDQLRNSVGLRGYAQNNPIVEYQSEGFRMFQDMIGSIEFDVTRTL  786
            +L VVD +W +HIDA+D LR+ + LR Y Q +P+ EYQSEGF MF+ M+ SI+ DV R +
Sbjct: 715  LLRVVDTKWVDHIDAMDHLRDGIHLRAYGQIDPLREYQSEGFEMFEAMVSSIDEDVARYI  774

Query: 787  MKAQIHEQ-ERER-ASQHATTTAEQNISAQHVPMNNESPEYQGIKRNDKCPCGSGMKFKN  844
            MKA+I +  ERE+ A   A     AE   A+  P+  +    Q I RND CPCGSG K+KN
Sbjct: 775  MKAEIRQNLEREQVAKGEAINPAEGKPEAKRQPIRKD----QHIGRNDPCPCGSGKKYKN  830

Query: 845  CHG                                                          847
            CHG
Sbjct: 831  CHG                                                          833
```

A related DNA sequence was identified in *S. pyogenes* <SEQ ID 3619> which encodes the amino acid sequence <SEQ ID 3620>. Analysis of this protein sequence reveals the following:

-continued

----- Final Results -----
bacterial cytoplasm --- Certainty = 0.4443 (Affirmative) <succ>
bacterial membrane --- Certainty = 0.0000 (Not Clear) <succ>
bacterial outside --- Certainty = 0.0000 (Not Clear) <succ>

Possible site: 43
>>> Seems to have no N-terminal signal sequence

An alignment of the GAS and GBS proteins is shown below.

```
Identities = 710/837 (84%), Positives = 777/837 (92%), Gaps = 3/837 (0%)
Query:  11  MANILRTVIENDKGELKKLDKIAKKVDSYADHMAALSDEALQAKTPEFKERYQNGETLDQ   70
            MANILR VIENDKGEL+KL+KIAKKV+SYAD MA+LSD  LQ KT EFKERYQ GETL+Q
Sbjct:   1  MANILRKVIENDKGELRKLEKIAKKVESYADQMASLSDRDLQGKTLEFKERYQKGETLEQ   60
```

-continued

```
Query:   71  LLPEAFAVVREASKRVLGLYPYHVQIMGGIVLHHGDIPEMRTGEGKTLTATMPVYLNAIS   130
             LLPEAFAVVREA+KRVLGL+PY VQIMGGIVLH+GD+PEMRTGEGKTLTATMPVYLNAI+
Sbjct:   61  LLPEAFAVVREAARRVLGLEPYRVQIMGGIVLHNGDVPEMRTGEGKTLTATMPVYLNAIA   120

Query:  131  GLGVHVITVNEYLSTRDATEMGEVYSWLGLSVGINLAAKSPFEKREAYNCDITYSTNAEV   190
             G GVHVITVNEYLSTRDATEMGEVYSWLGLSVGINLAAKSP EKREAYNCDITYSTN+EV
Sbjct:  121  GEGVHVITVNEYLSTRDATEMGEVYSWLGLSVGINLAAKSPAEKREAYNCDITYSTNSEV   180

Query:  191  GFDYLRDNMVVRQEDMVQRPLNYALVDEVDSVLIDEARTPLIVSGPVSSEMNQLYTRADM   250
             GFDYLRDNMVVRQEDMVQRPLN+ALVDEVDSVLIDEARTPLIVSG VSSE NQLY RADM
Sbjct:  181  GFDYLRDNMVVRQEDMVQRPLNFALVDEVDSVLIDEARTPLIVSGAVSSETNQLYIRADM   240

Query:  251  FVKTLNSDDYIIDVPTKTIGLSDTGIDKAENYFHLNNLYDLENVALTHYIDNALRANYIM   310
             FVKTL S DY+IDVPTKTIGLSD+GIDKAE+YE+L+NLYD+ENVALTH+IDNALRANYIM
Sbjct:  241  FVKTLTSVDYVIDVPTKTIGLSDSGIDKAESYFNLSNLYDIENVALTHFIDNALRANYIM   300

Query:  311  LLNIDYVVSEEQEILIVDQFTGRTMEGRRFSDGLHQAIEAKESVPIQEESKTSASITYQN   370
             LL+IDYVVSE+ EILIVDQFTGRTMEGRRFSDGLHQAIEAKE V IQEESKTSASITYQN
Sbjct:  301  LLDIDYVVSEDGEILIVDQFTGRTMEGRRESDGLHQAIEAKEGVRIQEESKTSASITYQN   360

Query:  371  MFRMYHKLAGMTGTGKTEEEEFREIYNMRVIPIPTNRPVQRIDHSDLLYPTLDSKFRAVV   430
             MFRMY  KLAGMTGT KTEEEEFRE+YNMR+IPIPTNRP+ RIDH+DLLYPTL+SKFRAVV
Sbjct:  361  MERMYKKLAGMTGTAKTEEEEFREVYNMRIIPIPTNRPIARIDHTDLLYPTLESKFRAVV   420

Query:  431  ADVKERYEQGQPVLVGTVAVETSDLISRKLVAAGVPHEVLNAKNHFKEAQIIMNAGQRGA   490
              DVK R+ +GQP+LVGTVAVETSDLISRKLV AG+PHEVLNAKNHFKEAQIIMNAGQRGA
Sbjct:  421  EDVKTRHARGQPILVGTVAVETSDLISRKLVEAGIPHEVINAKNHFKEAQIIMNAGQRGA   480

Query:  491  VTIATNMAGRGTDIKLGEGVRELGGLCVIGTERHESRRIDNQLRGRSGRQGDPGESQFYL   550
             VTIATNMAGRGTDIKLGEGVRELGGLCVIGTERHESRRIDNQLRGRSGRQGDPGESQFYL
Sbjct:  481  VTIATNMAGRGTDIKLGEGVRELGGLCVIGTERHESRRIDNQLRGRSGRQGDPGESQFYL   540

Query:  551  SLEDDLMRRFGTDRIKVVLERMNLAEDDTVIKSKMLTRQVESAQRRVEGNNYDTRKQVLQ   610
             SLEDDLMRRFG+DRIK   L+RM L E+DTVIKS  ML RQVESAQ+RVEGNNYDTRKQVLQ
Sbjct:  541  SLEDDLMRRFGSDRIKAFLDRMKLDEEDTVIKSGMLGRQVESAQKRVEGNNYDTRKQVLQ   600

Query:  611  YDDVMREQREIIYANRREVITAERDLGPELKGMIKRTIKRAVDAHSRSDKNTAAEAIVNF   670
             YDDVMREQREIIYANRR+VITA RDLGPE+K MIKRTI RAVDAH+RS++  A +AIV F
Sbjct:  601  YDDVMREQREIIYANRRDVITANRDLGPEIKAMIKRTIDRAVDAHARSNRKDAIDAIVTF   660

Query:  671  ARSALLDEEAITVSELRGLKEAEIKELLYERALAVYEQQIARLKDPEAIIEFQKVLILMV   730
             AR++L+ EE I+   ELRGLK+ +IKE LY+RALA+Y+QQ++KL+D EAIIEFQKVLILM+
Sbjct:  661  ARTSLVPEEFISAKELRGLKDDQIKEKLYQRALAIYDQQLSKLRDQEAIIEFQKVLILMI   720

Query:  731  VDNQWTEHIDALDQLRNSVGLRGYAQNNPIVEYQSEGFRMFQDMIGSIEFDVTRTLMKAQ   790
             VDN+WTEHIDALDQLRN+VGLRGYAQNNP+VEYQ+EGF+MFQDMIG+IEFDVTRT+MKAQ
Sbjct:  721  VDNKWTEHIDALDQLRNAVGLRGYAQNNPVVEYQAEGFKMFQDMIGAIEFDVTRTMMKAQ   780

Query:  791  IHEQERERASQHATTTAEQNISAQHVPMNNESPEYQGIKRNDKCPCGSGMKFKNCHG     847
             IHEQERERASQ ATT A QNI +Q      ++ P+   ++RN+ CPCGSG KFKNCHG
Sbjct:  781  IHEQERERASQRATTAAPQNIQSQQSANTDDLPK---VERNEACPCGSGKKFKNCHG     834
```

Based on this analysis, it was predicted that these proteins and their epitopes could be useful antigens for vaccines or diagnostics.

Example 1166

A DNA sequence (GBSx1242) was identified in *S. agalactiae* <SEQ ID 3621> which encodes the amino acid sequence <SEQ ID 3622>. This protein is predicted to be phospho-2-dehydro-3-deoxyheptonate aldolase (aroH). Analysis of this protein sequence reveals the following:

Possible site: 31
>>> Seems to have no N-terminal signal sequence
----- Final Results -----
bacterial cytoplasm --- Certainty = 0.3429 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:AAF40753 GB:AE002387 phospho-2-dehydro-3-deoxyheptonate
aldolase, phe-sensitive [Neisseria meningitidis MC58]
Identities = 122/348 (35%), Positives = 187/348 (53%), Gaps = 32/348 (9%)
Query:    1  MGFHQLSDKINIEILKQKTSLDLEVSQKKLAKE--------EELKNIIKGEDQRFLVIV    51
             M  H  +D I I+ +K+     + + ++KE         +E+ +++ G D+R LVI+
Sbjct:    1  MTHHYPTDDIKIKEVKELLPPIAHLYELPISKEASGLVHRTRQEISDLVHGRDKRLLVII   60

Query:   52  GPCSADNPKAVLTYAKRLAKLEAAFKDKMFLVMRVYTAKPRTNGDGYKGLVHHSDKLGVF   111
             GPCS  +PKA L YA+RL KL     +++++ +VMRVY  KPRT  G+KGL++     G F
Sbjct:   61  GPCSIHDPKAALEYAERLLKLRKQYENELLIVMRVYFEKPRTT-VGWKGLINDPHLDGTF   119
```

```
                              -continued
Query: 112  ------FQARKMHYDIIRETGLLTADELLYPEMLSVMDDLVSYYAIGARSVEDQGHRFIS  165
                  QAR +    +   G+   + E  L          DL+S+ AIGAR+ E Q HR ++
Sbjct: 120  DINFGLRQARSLLLS-LNNMGMPASTEFLDMITPQYYADLISWGAIGARTTESQVHRELA  178

Query: 166  SGIDAPVGMKNPTSGNLRVMFNAVYAAQNQQELFYQNKQ-----VRTDGNLLSHVILRGY  220
            SG+   PVG KN T GNL++ +A+  AA +         K       V T GN  HVILRG
Sbjct: 179  SGLSCPVGFKNGTDGNLKIAIDAIGAASHSHHFLSVTKAGHSAIVHTGGNPDCHVILRGG  238

Query: 221  HNADYRSIPNYHYENLLETITHYEETDLQNPFIVVDTNHDNSGKQFLEQIRIVKSVLADR  280
                     PNY  E++  E           + +  +++D +H NS K +  Q+ + + + A
Sbjct: 239  KE------PNYDAEHVSEAAEQLRAAGVTDK-LMIDCSHANSRKDYTRQMEVAQDIAAQL  291

Query: 281  QWHTKIRNYVRGFLIESYLEDGRQDKPDVFGKSITDPCLGWDKTEMLI             328
             +    +   + G ++ES+L +GRQDKP+V+GKSITD C+GW   TE L+
Sbjct: 292  E---QDGGNIMGVMVESHLVEGRQDKPEVYGKSITDACIGWGATEELL             336
```

A related DNA sequence was identified in *S. pyogenes* <SEQ ID 3623> which encodes the amino acid sequence <SEQ ID 3624>. Analysis of this protein sequence reveals the following:

Possible site: 57
>>> Seems to have no N-terminal signal sequence
----- Final Results -----
 bacterial cytoplasm --- Certainty = 0.1171 (Affirmative) <succ>
 bacterial membrane --- Certainty = 0.0000 (Not Clear) <succ>
 bacterial outside --- Certainty = 0.0000 (Not Clear) <succ>

An alignment of the GAS and GBS proteins is shown below.

```
Identities = 52/233 (22%), Positives = 93/233 (39%), Gaps = 40/233 (17%)
Query:  50  IVGPCSADNPKAVLTYAKRLAKLEAAFKDKMFLVMRVYTAKPRTNGDYKGLVHHSDKLG  109
            IVGPCS ++     +  A   KL  +       R    KPRT+    ++GL
Sbjct:  19  IVGPCSIESYDHIRLAASSAKKLGYNY-------FRGGAYKPRTSAASFQGLG------   64

Query: 110  VFFQARKMHYDIIRETGLLTADELLYPEMLSVMDDLVSYYAIGARSVEDQGHRFISSGID  169
            Q  + +++ +E GLL+     E++   L    D +   +GAR++++    S ID
Sbjct:  65  --LQGIRYLHEVCQEFGLLSVSEIMSERQLEEAYDYLDVIQVGARNMQNFEFLKTLSHID  122

Query: 170  APVGMKNPTSGNLRVMFNAVYAAQNQQELFYQNKQVRTDGNLLSHVIL--RGYHNADYRS  227
            P+  K       +    A+    Q+   +                 S++IL  RG    D
Sbjct: 123  KPILFKRGLMATIEEYLGALSYLQDTGK---------------SNIILCERGVRGYD---  164

Query: 228  IPNYHYENLLETITHYEETDLQNPFIVVDTNHDNSGKQ-FLEQIRIVKSVLAD         279
            +   +  +++        ++TDL    I+VD +H   +     L   +I K+V A+
Sbjct: 165  VETRNMLDIMAVPIIQQKTDLP---IIVDVSHSTGRRDLLLPAAKIAKAVGAN          214
```

Based on this analysis, it was predicted that these proteins and their epitopes could be useful antigens for vaccines or diagnostics.

Example 1167

A DNA sequence (GBSx1243) was identified in *S. agalactiae* <SEQ ID 3625> which encodes the amino acid sequence <SEQ ID 3626>. This protein is predicted to be AcpS (acpS). Analysis of this protein sequence reveals the following:

Possible site: 59
>>> Seems to have no N-terminal signal sequence
----- Final Results -----
 bacterial cytoplasm --- Certainty = 0.3620 (Affirmative) <succ>
 bacterial membrane --- Certainty = 0.0000 (Not Clear) <succ>
 bacterial outside --- Certainty = 0.0000 (Not Clear) <succ>

The protein has homology with the following sequences in the GENPEPT database.

```
>GP:AAG22706 GB:AF276617 acyl carrier protein synthase; AcpS
[Streptococcus pneumoniae]
Identities = 61/117 (52%), Positives = 90/117 (76%), Gaps = 1/117 (0%)
Query:   1  MIVGHGIDLQEIEAITKAYERNQRFAERVLTEQELLLFKGISNPKRQMSFLTGRWAAKEA   60
            MIVGHGID++E+ +I  A  R++ FA+RVLT QE+  F   +RQ+ +L GRW+AKEA
Sbjct:   1  MIVGHGIDIEELASIESAVTRHEGFAKRVLTAQEMERFTSLKG-RRQIEYLAGRWSAKEA   59

Query:  61  YSKALGTGIGKVNFHDIEILSDDKGAPLITKEPFNGKSFVSISHSGNYAQASVILEE    117
            +SKA+GTGI K+ F D+E+L++++GAP  ++ PF+GK ++SISH+ +  ASVILEE
Sbjct:  60  FSKAMGTGISKLGFQDLEVINNERGAPYFSQAPFSGKIWLSISHTDQFVTASVILEE    116
```

A related DNA sequence was identified in *S. pyogenes* <SEQ ID 3627> which encodes the amino acid sequence <SEQ ID 3628>. Analysis of this protein sequence reveals the following:

Possible site: 61
>>> Seems to have no N-terminal signal sequence
----- Final Results -----
bacterial cytoplasm --- Certainty = 0.2001 (Affirmative) <succ>
bacterial membrane --- Certainty = 0.0000 (Not Clear) <succ>
bacterial outside --- Certainty = 0.0000 (Not Clear) <succ>

----- Final Results -----
bacterial membrane --- Certainty = 0.2296 (Affirmative) <succ>
bacterial outside --- Certainty = 0.0000 (Not Clear) <succ>
bacterial cytoplasm --- Certainty = 0.0000 (Not Clear) <succ>

An alignment of the GAS and GBS proteins is shown below.

The protein has homology with the following sequences in the GENPEPT database.

```
Identities = 76/119 (63%), Positives = 99/119 (82%), Gaps = 1/119 (0%)
Query:   1  MIVGHGIDLQEIEAITKAYERNQRFAERVLTEQELLLFKGISNPKRQMSFLTGRWAAKEA   60
            MIVGHGIDLQEI AI K Y+RN RFA+++LTEQEL +F+     KR++++L GRW+ KEA
Sbjct:   1  MIVGHGIDLQEISAIEKVYQRNPRFAQKILTEQELAIFESFPY-KRRLNYLAGRWSGKEA   59

Query:  61  YSKALGTGIGKVNEHDIEILSDDKGAPLITKEPFNGKSFVSISHSGNYAQASVILEEEK   119
            ++KA+GTGIG++ F DIEIL+D +G P++TK PF G SF+SISHSGNY QASVILE++K
Sbjct:  60  FAKAIGTGIGRLTFQDIEILNDVRGCPILTKSPFKGNSFISISHSGNYVQASVILEDKK   118
```

Based on this analysis, it was predicted that these proteins and their epitopes could be useful antigens for vaccines or diagnostics.

Example 1168

A DNA sequence (GBSx1244) was identified in *S. agalactiae* <SEQ ID 3629> which encodes the amino acid sequence <SEQ ID 3630>. Analysis of this protein sequence reveals the following:

```
>GP:AAD51027 GB:AF171873 alanine racemase [Streptococcus pneumoniae]
Identities = 227/366 (62%), Positives = 270/366 (73%)
Query:    1  MISSYHRPTRALIDLEAIANNVKSVQEHIPSDKKTFAVVKANAYGHGAVEVSKYIESIVD   60
             M +S HRPT+ALI L AI  N++ +  HIP     AVVKANAYGHGAV V+K I+  VD
Sbjct:    1  MKASPHRPTKALIHLGAIRQNIQQMGAHIPQGTLKLAVVKANAYGHGAVAVAKAIQDDVD   60

Query:   61  GFCVSNLDEAIELRQAGIVKMILVLGVVMPEQVILAKNENITLTVASLEWLRLCQTSAVD   120
             GFCVSN+DEAIELRQAG+ K IL+LGV  E V LAK  + TLTVA LEW++      VD
Sbjct:   61  GFCVSNIDEAIELRQAGLSKPILILGVSEIEAVALAKEYDFTLTVAGLEWIQALLDKEVD   120

Query:  121  LSGLEVHIKVDSGMGRIGVRQLDEGNKLISELGESGASVKGIFTHFATADEADNCKFNQQ   180
             L+GL VH+K+DSGMGRIG R+ E +    L + G V+GIFTHFATADE    FN Q
Sbjct:  121  LTGLTVHLKIDSGMGRIGFREASEVEQAQDLLQQHGVCVEGIFTHFATADEESDDYFNAQ   180

Query:  181  LTFFKDFISGLDNCPDLVHASNSATSLWHSETIFNAVRLGVVMYGLNPSGTDLDLPYPIN   240
             L  FK  ++ +    P+LVHASNSAT+LWH ETIFNAVR+G  MYGLNPSG  LDLPY +
Sbjct:  181  LERFKTILASMKEVPELVHASNSATTLWHVETIFNAVRMGDAMYGLNPSGAVLDLPYDLI   240

Query:  241  PALSLESELVHVKQLHDGSQVGYGATYQVTGDEFVGTVPIGYADGWTRDMQGFSVIVNGE   300
             PAL+LES LVHVK + G+ +GYGATYQ    ++ + TVPIGYADGWTRDMQ FSV+V+G+
Sbjct:  241  PALTLESALVHVKTVPAGACMGYGATYQADSEQVIATVPIGYADGWTRDMQNFSVLVDGQ   300

Query:  301  LCEIIGRVSMDQMTIRLPQKYTIGTKVTLIGQQGSCNITTTDVAQKRQTINYEVLCLLSD   360
              C I+GRVSMDQ+TIRLP+ Y +GTKVTLIG    IT T VA R TINYEV+CLLSD
Sbjct:  301  ACPIVGRVSMDQITIRLPKLYPLGTKVTLIGSNGDKEITATQVATYRVTINYEVVCLLSD   360

Query:  361  RIPRYY                                                        366
             RIPR Y
Sbjct:  361  RIPREY                                                        366
```

Possible site: 19
>>> Seems to have no N-terminal signal sequence
INTEGRAL    Likelihood = −3.24    Transmembrane 78-94 (77-97)

A related DNA sequence was identified in *S. pyogenes* <SEQ ID 3631> which encodes the amino acid sequence <SEQ ID 3632>. Analysis of this protein sequence reveals the following:

```
Possible site: 41
>>> Seems to have no N-terminal signal sequence
INTEGRAL    Likelihood = -2.34   Transmembrane 82-98 (82-98)
----- Final Results -----
    bacterial membrane --- Certainty = 0.1935 (Affirmative) <succ>
    bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP:AAD51027 GB:AF171873 alanine racemase [Streptococcus pneumoniae]
Identities = 222/366 (60%), Positives = 273/366 (73%)
Query:   1 MISSFHRPTVARVNLQAIKENVASVQKHIPLGVKTYAVVKADAYGHGAVQVSKALLPQVD   60
           M +S HRPT A ++L AI++N+  +  HIP G   AVVKA+AYGHGAV V+KA+    VD
Sbjct:   1 MKASPHRPTKALIHLGAIRQNIQQMGAHIPQGTLKLAVVKANAYGHGAVAVAKAIQDDVD   60

Query:  61 GYCVSNLDEALQLRQAGIDKEILILGVLLPNELELAVANAITVTIASLDWIALARLEKKE  120
           G+CVSN+DEA++LRQAG+ K ILILGV    + LA     T+T+A L+WI    ++ +
Sbjct:  61 GFCVSNIDEAIELRQAGLSKPILILGVSEIEAVALAKEYDFTLTVAGLEWIQALLDKEVD  120

Query: 121 CQGLKVHVKVDSGMGRIGLRSSKEVNLLIDSLKELGADVEGIFTHFATADEADDTKFNQQ  180
               GL VH+K+DSGMGRIG R + EV    D L++ G  VEGIFTHFATADE  D  FN Q
Sbjct: 121 LTGLTVHLKIDSGMGRIGFREASEVEQAQDLLQQHGVCVEGIFTHFATADEESDDYFNAQ  180

Query: 181 LQFFKKLIAGLEDKPRLVHASNSATSIWHSDTIFNAVRLGIVSYGLNPSGSDLSLPFPLQ  240
           L+ FK ++A +++ P LVHASNSAT++WH +TIFNAVR+G   YGLNPSG+ L LP+ L
Sbjct: 181 LERFKTILASMKEVPELVHASNSATTLWHVETIFNAVRMGDAMYGLNPSGAVLDLPYDLI  240

Query: 241 EALSLESSLVHVKMISAGDTVGYGATYTAKKSEYVGTVPIGYADGWTRNMQGFSVLVDGQ  300
              AL+LES+LVHVK + AG  +GYGATY A   + + TVPIGYADGWTR+MQ FSVLVDGQ
Sbjct: 241 PALTLESALVHVKTVPAGACMGYGATYQADSEQVIATVPIGYADGWTRDMQNFSVLVDGQ  300

Query: 301 FCEIIGRVSMDQLTIRLPKAYPLGTKVTLIGSNQQKNISTTDIANYRNTINYEVLCLLSD  360
              C I+GRVSMDQ+TIRLPK YPLGTKVTLIGSN  K I+ T +A YR TINYEV+CLLSD
Sbjct: 301 ACPIVGRVSMDQITIRLPKLYPLGTKVTLIGSNGDKEITATQVATYRVTINYEVVCLLSD  360

Query: 361 RIPRIY  366
           RIPR Y
Sbjct: 361 RIPREY  366
```

An alignment of the GAS and GBS proteins is shown below.

Based on this analysis, it was predicted that these proteins and their epitopes could be useful antigens for vaccines or diagnostics.

Example 1169

A DNA sequence (GBSx1245) was identified in *S. agalactiae* <SEQ ID 3633> which encodes the amino acid sequence <SEQ ID 3634>. This protein is predicted to be immunogenic secreted protein precursor. Analysis of this protein sequence reveals the following:

```
Identities = 247/366 (67%), Positives = 295/366 (80%)
Query:   1 MISSYHRPTRALIDLEAIANNVKSVQEHIPSDKKTFAVVKANAYGHGAVEVSKYIESIVD   60
           MISS+HRPT A ++L+AI  NV SVQ+HIP   KT+AVVKA+AYGHGAV+VSK +    VD
Sbjct:   1 MISSFHRPTVARVNLQAIKENVASVQKHIPLGVKTYAVVKADAYGHGAVQVSKALLPQVD   60

Query:  61 GFCVSNLDEAIELRQAGIVKMILVLGVVMPEQVILAKNENITLTVASLEWLRLCQTSAVD  120
           G+CVSNLDEA++LRQAGI K IL+LGV++ ++ LA     IT+T+ASL+W+ L +    +
SbjCt:  61 GYCVSNLDEALQLRQAGIDKEILILGVLLPNELELAVANAITVTIASLDWIALARLEKKE  120

Query: 121 LSGLEVHIKVDSGMGRIGVRQLDEGNKLISELGESGASVKGIFTHFATADEADNCKFNQQ  180
              GL+VH+KVDSGMGRIG+R   E N LI   L E GA V+GIFTHFATADEAD+ KFNQQ
Sbjct: 121 CQGLKVHVKVDSGMGRIGLRSSKEVNLLIDSLKELGADVEGIFTHFATADEADDTKFNQQ  180

Query: 181 LTFFKDFISGLDNCPDLVHASNSATSLWHSETIFNAVRLGVVMYGLNPSGTDLDLPYPIN  240
           L FFK  I+GL++ P LVHASNSATS+WHS+TIFNAVRLG+V YGLNPSG+DL LP+P+
Sbjct: 181 LQFFKKLIAGLEDKPRLVHASNSATSIWHSDTIFNAVRLGIVSYGLNPSGSDLSLPFPLQ  240

Query: 241 PALSLESELVHVKQLHDGSQVGYGATYQVTGDEFVGTVPIGYADGWTRDMQGFSIVNGE  300
              ALSLES LVHVK +   G  VGYGATY     E+VGTVPIGYADGWTR+MQGFSV+V+G+
Sbjct: 241 EALSLESSLVHVKMISAGDTVGYGATYTAKKSEYVGTVPIGYADGWTRNMQGFSVLVDGQ  300

Query: 301 LCEIIGRVSMDQMTIRLPQKYTIGTKVTLIGQQGSCNITTTDVAQKRQTINYEVLCLLSD  360
               CEIIGRVSMDQ+TIRLP+ Y +GTKVTLIG      NI+TTD+A  R TINYEVLCLLSD
Sbjct: 301 FCEIIGRVSMDQLTIRLPKAYPLGTKVTLIGSNQQKNISTTDIANYRNTINYEVLCLLSD  360

Query: 361 RIPRYY  366
           RIPR Y
Sbjct: 361 RIPRIY  366
```

```
Possible site: 27
>>> Seems to have a cleavable N-term signal seq.
----- Final Results -----
    bacterial outside --- Certainty = 0.3000 (Affirmative) <succ>
      bacterial membrane --- Certainty = 0.0000 (Not Clear) <succ>
        bacterial cytoplasm --- Certainty = 0.0000 (Not Clear) <succ>
```

There is also homology to SEQ ID 1988.

A related GBS gene <SEQ ID 8745> and protein <SEQ ID 8746> were also identified. Analysis of this protein sequence reveals the following:

```
Lipop: Possible site: -1    Crend: 4
McG: Discrim Score: 8.81
GvH: Signal Score (-7.5): 0.659999
Possible site: 27
>>> Seems to have a cleavable N-term signal seq.
ALOM program    count: 0 value: 1.06 threshold: 0.0
PERIPHERAL          Likelihood = 1.06              247
modified ALOM score: -0.71
*** Reasoning Step: 3
----- Final Results -----
    bacterial outside --- Certainty = 0.3000 (Affirmative) <succ>
      bacterial membrane --- Certainty = 0.0000 (Not Clear) <succ>
        bacterial cytoplasm --- Certainty = 0.0000 (Not Clear)
```

SEQ ID 8746 (GBS98) was expressed in *E. coli* as a His-fusion product. SDS-PAGE analysis of total cell extract is shown in FIG. 7 (lane 5; MW 80 kDa).

GBS98-His was purified as shown in FIG. 192, lane 9.

Based on this analysis, it was predicted that these proteins and their epitopes could be useful antigens for vaccines or diagnostics.

Example 1170

A DNA sequence (GBSx1246) was identified in *S. agalactiae* <SEQ ID 3635> which encodes the amino acid sequence <SEQ ID 3636>. This protein is predicted to be junction specific DNA helicase (mmsA) (recG). Analysis of this protein sequence reveals the following:

```
Possible site: 17
>>> Seems to have no N-terminal signal sequence
INTEGRAL     Likelihood = -0.16    Transmembrane 530-546 (530-546)
----- Final Results -----
    bacterial membrane --- Certainty = 0.1065 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the GENPEPT database.

```
>GP:CAA90280 GB:Z49988 MmsA [Streptococcus pneumoniae]
Identities = 483/671 (71%), Positives = 568/671 (83%)
Query:    1 MLLQSPISNLKGFGPKSAEKFQKLDIYTVEDLLLYYPFRYEDFKSKSVFDLVDGEKAVIT    60
            M L  P+   L G GPKSAEK+ KL I  ++DLLLY+PFRYEDFK+K V +L DGEKAV++
Sbjct:    1 MNLHQPLHVLPGVGPKSAEKYAKLGIENLQDLLLYFPFRYEDFKTKQVLELEDGEKAVLS    60

Query:   61 GLVVTPANVQYYGFKRNRLSFKLRQGEAVLNVSFFNQPYLADKIELGQEVAVFGKWDATK   120
            G VVTPA+VQYYGFKRNRL F L+QGE V   V+FFNQPYLADKIELG  +AVFGKWD  K
Sbjct:   61 GQVVTPASVQYYGFKRNRLRFSLKQGEVVFAVNFFNQPYLADKIELGATLAVFGKWDRAK   120

Query:  121 SAITGMKVLAQVEDDMQPVYRVAQGISQSTLIKAIKSAFEISAHLELKENLPATLLEKYR   180
            +++TGMKVLAQVEDD+QPVYR+AQGISQ++L+K IK+AF+      L ++ENLP +LL+KY+
Sbjct:  121 ASLTGMKVLAQVEDDLQPVYRLAQGISQASLVKVIKTAFDQGLDLLIEENLPQSLLDKYK   180

Query:  181 LMGRSQACLAMHFPKDITEYKQALRRIKFEELFYFQMNLQVLKSENKSETNGLPILYSKH   240
            LM R QA  AMHFPKD+ EYKQALRRIKF ELFYFQM LQ LKSEN+ +  +GL + +S+
Sbjct:  181 LMSRCQAVRAMHFPKDLAEYKQALRRIKFAELFYFQMQLQTLKSENRVQGSGLVLNWSQE   240

Query:  241 AMETKISSLPFILTNAQKRSLDEILSDMSSGAHMNRLLQGDVGSGKTVIAGLSMYAAYTA   300
                +   +SLPF LT AQ++SL EIL+DM S  HMNRLLQGDVGSGKTV+AGL+M+AA TA
Sbjct:  241 KVTAVKASLPFALTQAQEKSLQEILTDMKSDHHMNRLLQGDVGSGKTVVAGLAMFAAVTA   300

Query:  301 GFQSALMVPTEILAEQHYISLQELFPDLSIAILTSGMKAAVKRTVLAAIANGSVDMIVGT   360
            G+Q+ALMVPTEILAEQH+ SLQ LFP+L +A+LT  +KAA KR VL   IA G  D+I+GT
Sbjct:  301 GYQAALMVPTEILAEQHFESLQNLFPNLKLALLTGSLKAAEKREVLETIAKGEADLIIGT   360

Query:  361 HALIQDSVQYHKLGLVITDEQHRFGVKQRRIFREKGENPDVLMMTATPIPRTLAITAFGE   420
            HALIQD V+Y +LGL+I DEQHRFGV QRRI REKG+NPDVLMMTATPIPRTLAITAFG+
Sbjct:  361 HALIQDGVEYARLGLIIIDEQHRFGVGQRRILREKGDNPDVLMMTATPIPRTLAITAFGD   420

Query:  421 MDVSIIDELPAGRKPIITRWVKHEQLGTVLEWVKGELQKDAQVYVISPLIEESEALDLKN   480
            MDVSIID++PAGRKPI+TRW+KHEQL  VL W++GE+QK +Q YVISPLIEESEALDLKN
Sbjct:  421 MDVSIIDQMPAGRKPIVTRWIKHEQLPQVLTWLEGEIQKGSQAYVISPLIEESEALDLKN   480

Query:  481 AVALHAELSTYFEGIAKVALVHGRMKNDEKDAIMQDFKDKKSHILVSTTVIEVGVNVPNA   540
            A+AL  EL+T+F G A+VAL+HGRMK+DEKD IMQDFK++K+ ILVSTTVIEVGVNVPNA
Sbjct:  481 AIALSEELTTHVAGKAEVALLHGRMKSDEKDQIMQDFKERKTDILVSTTVIEVGVNVPNA   540

Query:  541 TIMIIMDADRFGLSQLHQLRGRVGRGYKQSYAVLVANPKTDSGKKRMTIMTETTDGFVLA   600
            T+MIIMDADRFGLSQLHQLRGRVGRG KQSYAVLVANPKTDSGK RM IMTETT+GFVLA
Sbjct:  541 TVMIIMDADRFGLSQLHQLRGRVGRGDKQSYAVLVANPKTDSGKDRMRIMTETTNGFVLA   600
```

```
Query: 601 ESDLKMRGSGEIFGTRQSGIPEFQVADIVEDYPILEEARRVASDIVKDNNWKENTEWALI 660
            E DLKMRGSGEIFGTRQSG+PEFQVADI+ED+PILEEAR+VAS I    W+E+ EW +I
Sbjct: 601 EEDLKMRGSGEIFGTRQSGLPEFQVADIIEDFPILEEARKVASYISSIEAWQEDPEWRMI 660

Query: 661 LDNLRQHSDFD 671
            +L +    D
Sbjct: 661 ALHLEKKEHLD 671
```

A related DNA sequence was identified in *S. pyogenes* <SEQ ID 3637> which encodes the amino acid sequence <SEQ ID 3638>. Analysis of this protein sequence reveals the following:

```
Possible site: 17
>>> Seems to have no N-terminal signal sequence
INTEGRAL    Likelihood = -0.16   Transmembrane 530-546 (530-546)
----- Final Results -----
    bacterial membrane --- Certainty = 0.1065 (Affirmative) <succ>
    bacterial outside --- Certainty = 0.0000 (Not Clear) <succ>
        bacterial cytoplasm --- Certainty = 0.0000 (Not Clear) <succ>
```

An alignment of the GAS and GBS proteins is shown below.

Based on this analysis, it was predicted that these proteins and their epitopes could be useful antigens for vaccines or diagnostics.

Example 1171

A DNA sequence (GBSx1247) was identified in *S. agalactiae* <SEQ ID 3639> which encodes the amino acid sequence <SEQ ID 3640>. This protein is predicted to be aryl-alcohol dehydrogenase (b1647). Analysis of this protein sequence reveals the following:

```
Identities = 641/671 (95%), Positives = 655/671 (97%)
Query:   1 MLLQSPISNLKGFGPKSAEKFQKLDIYTVEDLLLYYPFRYEDFKSKSVFDLVDGEKAVIT  60
           M+L  +P+SNLKGFGPKSAEKFQKLDIYTVEDLLLYYPFRYEDFKSKSVFDLVDGEKAVIT
Sbjct:   1 MILTAPMSNLKGFGPKSAEKFQKLDIYTVEDLLLYYPFRYEDFKSKSVFDLVDGEKAVIT  60

Query:  61 GLVVTPANVQYYGFKRNRLSFKLRQGEAVLNVSFFNQPYLADKIELGQEVAVFGKWDATK 120
           GLVVTPANVQYYGFKRNRLSFKLRQGEAVLNVSFFNQPYLADKIELGQEVAVFGKWDATK
Sbjct:  61 GLVVTPANVQYYGFKRNRLSFKLRQGEAVLNVSFFNQPYLADKIELGQEVAVFGKWDATK 120

Query: 121 SAITGMKVLAQVEDDMQPVYRVAQGISQSTLIKAIKSAFEISAHLELKENLPATLLEKYR 180
           SAITGMKVLAQVEDDMQPVYRVAQGISQSTLIKAIKSAFEI AHLELKENLPATLLEKYR
Sbjct: 121 SAITGMKVLAQVEDDMQPVYRVAQGISQSTLIKAIKSAFEIDAHLELKENLPATLLEKYR 180

Query: 181 LMGRSQACLAMHFPKDITEYKQALRRIKFEELFYFQMNLQVLKSENKSETNGLPILYSKH 240
           LMGRSQACLAMHFPKDITEYKQALRRIKFEELFYFQMNLQVLK+ENKSETNGLPILYSK
Sbjct: 181 LMGRSQACLAMHFPKDITEYKQALRRIKFEELFYFQMNLQVLKAENKSETNGLPILYSKR 240

Query: 241 AMETKISSLPFILTNAQKRSLDEILSDMSSGAHMNRLLQGDVGSGKTVIAGLSMYAAYTA 300
           AMETKISSLPFILTNAQKRSLD+ILSDMSSGAHMNRLLQGDVGSGKTVIAGLSMYAAYTA
Sbjct: 241 AMETKISSLPFILTNAQKRSLDDILSDMSSGAHMNRLLQGDVGSGKTVIAGLSMYAAYTA 300

Query: 301 GFQSALMVPTEILAEQHYISLQELFPDLSIAILTSGMKAAVKRTVLAAIANGSVDMIVGT 360
           GFQSALMVPTEILAEQHYISLQELFPDLSIAILTSGMKAAVKRTVLAAIANGSVDMIVGT
Sbjct: 301 GFQSALMVPTEILAEQHYISLQELFPDLSIAILTSGMKAAVKRTVLAAIANGSVDMIVGT 360

Query: 361 HALIQDSVQYHKLGLVITDEQHRFGVKQRRIFREKGENPDVLMMTATPIPRTLAITAFGE 420
           HALIQDSVQYHKLGLVITDEQHRFGVKQRRIFREKGENPDVLMMTATPIPRTLAITAFGE
Sbjct: 361 HALIQDSVQYHKLGLVITDEQHRFGVKQRRIFREKGENPDVLMMTATPIPRTLAITAFGE 420

Query: 421 MDVSIIDELPAGRKPIITRWVRHEQLGTVLEWVKGELQKDAQVYVISPLIEESEALDLKN 480
           MDVSIIDELPAGRKPI+TRWV+HEQLGTVLEWVKGELQKDAQVYVISPLIEESEALDLKN
Sbjct: 421 MDVSIIDELPAGRKPIMTRWVYHEQLGTVLEWVKGELQKDAQVYVISPLIEESEALDLKN 480

Query: 481 AVALHAELSTYFEGIAKVALVHGRMKNDEKDAIMQDFKDKKSHILVSTTVIEVGVNVPNA 540
           AVALHAELSTYFEGIAKVALVHGRMKNDEKDAIMQDFKDKKSHILVSTTVIEVGVNVPNA
Sbjct: 481 AVALHAELSTYFEGIAKVALVHGRMKNDEKDAIMQDFKDKKSHILVSTTVIEVGVNVPNA 540

Query: 541 TIMIIMDADRFGLSQLHQLRGRVGRGYKQSYAVLVANPKTDSGKKRMTIMTETTDGFVLA 600
           TIMIIMDADRFGLSQLHQLRGRVGRGYKQSYAVLVANPKTDSGKKRMTIMTETTDGFVLA
Sbjct: 541 TIMIIMDADRFGLSQLHQLRGRVGRGYKQSYAVLVANPKTDSGKKRMTIMTETTDGFVLA 600

Query: 601 ESDLKMRGSGEIFGTRQSGIPEFQVADIVEDYPILEEARRVASDIVKDNNWKENTEWALI 660
           ESDLKMRGSGEIFGTRQSGIPEFQVADIVEDYPILEEAR+V++ IV D NW    +W L+
Sbjct: 601 ESDLKMRGSGEIFGTRQSGIPEFQVADIVEDYPILEEARKVSAAIVSDPNWIYEKQWQLV 660

Query: 661 LDNLRQHSDFD 671
            N+R+  +D
Sbjct: 661 AQNIRKKEVYD 671
```

Possible site: 50
>>> Seems to have no N-terminal signal sequence
----- Final Results -----
    bacterial cytoplasm --- Certainty = 0.1562 (Affirmative) <succ>
    bacterial membrane --- Certainty = 0.0000 (Not Clear) <succ>
    bacterial outside --- Certainty = 0.0000 (Not Clear) <succ>

A related GBS nucleic acid sequence <SEQ ID 10105> which encodes amino acid sequence <SEQ ID 10106> was also identified.

The protein has homology with the following sequences in the GENPEPT database.

Possible site: 21
>>> Seems to have no N-terminal signal sequence
----- Final Results -----
    bacterial cytoplasm --- Certainty = 0.0988 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database.

```
>GP:BAB07646 GB:AP001520 aryl-alcohol dehydrogenase [Bacillus halodurans]
Identities = 173/300 (57%), Positives = 224/300 (74%)
Query:   7 IGQTGIQATRIALGCMRMSDLKGKQAEEVVGTALDLGINFFDHADIYGGGLSELRFRDAI   66
           +G + ++    +A+GCMR++ +   K+AE  V TAL+ G NFFDHADIYGGG  E   F DAI
Sbjct:   6 LGSSSLEVPVVAVGCMRINAISKKEAERFVQTALEQGANFFDHADIYGGGECEEIFADAI   65

Query:  67 KHLNVNRDKMIIQSKCGIREGYFDFSKEYILSSVDGILERLGTEYLDFLILHRPDVLVEP  126
           +       R+K+I+QSKCGIREG FDFSKEYIL SVDGIL+RL T+YLD L+LHRPD LVEP
Sbjct:  66 QMNEAVREKIILQSKCGIREGRFDFSKEYILQSVDGILQRLKTDYLDVLLLHRPDALVEP  125

Query: 127 EEVAEAFTKLRAEGKVKHFGVSNQNRFQMELLQSYLDEPLAVNQLQLSPAHTPMFDAGLN  186
           EEVAEAF  L + GKV+HFGVSNQN  Q+ELL+ ++ +P+  NQLQLS  +   M  +G+N
Sbjct: 126 EEVAEAFDLLESSGKVRHFGVSNQNPMQIELLKKFVRQPIVANQLQLSITNATMISSGIN  185

Query: 187 VNMLNKASIEHDDGIVDYCRLKRVTIQAWSPFQIDLSRGLFVNHPDYKELNETIAKLAKN  246
           VNM N+++I  D  ++DYCRL  VTIQ WSPFQ       G+F+ +  +  ELN+  I +LA+
Sbjct: 186 VNMENESAINRDGSVLDYCRLHDVTIQPWSPFQYGFFEGVFLGNDLFPELNKKIDELAEK  245

Query: 247 YNVSSEAIVIAWILRHPAKMQAIVGSMNPSRLKAIDKANDIALTRKEWYDIYRSAGNILP  306
           Y VS+   I IAW+LRHPA MQ  ++G+MN  RLK    KA++I LTR+EWY+IYR+AGNILP
Sbjct: 246 YEVSNTTIAIAWLLRHPANMQPVIGTMNLKRLKDCCKASEIRLTREEWYEIYRAAGNILP  305
```

There is also homology to SEQ ID 780.

Based on this analysis, it was predicted that these proteins and their epitopes could be useful antigens for vaccines or diagnostics.

Example 1172

A DNA sequence (GBSx1248) was identified in *S. agalactiae* <SEQ ID 3641> which encodes the amino acid sequence <SEQ ID 3642>. This protein is predicted to be shikimate 5-dehydrogenase (aroE) (aroE). Analysis of this protein sequence reveals the following:

```
>GP:AAC74762 GB:AE000264 putative oxidoreductase [Escherichia coli K12]
Identities = 114/279 (40%), Positives = 171/279 (60%), Gaps = 3/279 (1%)
Query:  10 LTGLIANPARHSLSPLMWNTSFQEKNMNYAYLTFEVEEGKLTEAVRGVRALGIRGVNVSM   69
           L GL+A P RHSLSP M N + ++   + + Y+ FEV+        A+ G++AL +RG  VSM
Sbjct:   9 LIGLMAYPIRHSLSPEMQNKALEKAGLPFTYMAFEVDNDSFPGAIEGLKALKMRGTGVSM   68

Query:  70 PFKQSVIPLLDDLSPQAKLVGAVNTIVNQGGTGRLVGHMTDGIGCFKALAAQGFSAKNKI  129
           P KQ       +D+L+P AKLVGA+NTIVN  G  R  G+ TDG G   +A+     GF  K  K
Sbjct:  69 PNKQLACEYVVDELTPAAKLVGAINTIVNDDGYLR--GYNTDGTGHIRAIKESGFDIKGKT  126

Query: 130 ITIAGIGGSGKAVAVQAAMEGVAEIRLFNRNSSNYDKVIDLSDKIKKQFQIKVVVDYLEN  189
           + + G GG+   A+  Q A+EG+ EI+LFNR     +DK +  + ++     V V   L +
Sbjct: 127 MVLLGAGGASTAIGAQGAIEGLKEIKLFNRRDEFFDKALAFAQRVNENTDCVVTVTDLAD  186

Query: 190 KTAFKDAIRTSHFYIDATSLGMRPLDNYSLINDPEILTPNLVVVDLVYKPKETALLRFVR  249
           + AF +A+ ++     + T +GM+PL+N SL+ND   +L P L+V + VY P    T LL+  +
Sbjct: 187 QQAFAEALASADILTNGTKVGMKPLENESLVNDISLLHPGLLVTECVYNPHMTKLLQQAQ  246

Query: 250 QNGVKHAYNGLGMLIYQGAEAFQLITNQEMPISSVERVL                      288
           Q G K    +G GML++QGAE  F L T  ++ P+    V++V+
Sbjct: 247 QAGCK-TIDGYGMLLWQGAEQFTLWTGKDFPLEYVKQVM                      284
```

A related DNA sequence was identified in *S. pyogenes* <SEQ ID 3643> which encodes the amino acid sequence <SEQ ID 3644>. Analysis of this protein sequence reveals the following:

Possible site: 54
>>> Seems to have an uncleavable N-term signal seq
----- Final Results -----
  bacterial membrane --- Certainty = 0.0000 (Not Clear) <succ>
    bacterial outside --- Certainty = 0.0000 (Not Clear) <succ>
      bacterial cytoplasm --- Certainty = 0.0000 (Not Clear) <succ>

The protein has homology with the following sequences in the databases:

```
>GP:AAC74762 GB:AE000264 putative oxidoreductase [Escherichia coli]
Identities = 132/280 (47%), Positives = 186/280 (66%), Gaps = 3/280 (1%)
Query:    11 LVSLLATPIRHSLSPKMHNEAYAKLGLDYAYLAFEVGTEQLADAVQGIRALGIRGSNVSM    70
             L+ L+A PIRHSLSP+M N+A  K GL + Y+AFEV +    A++G++AL +RG+ VSM
Sbjct:     9 LIGLMAYPIRHSLSPEMQNKALEKAGLPFTYMAFEVDNDSFPGAIEGLKALKMRGTGVSM    68

Query:    71 PNKEAILPLLDDLSPAAELVGAVNTVVNKDGKGHLVGHITDGIGALRALADEGVSVKNKI   130
             PNK+     +D+L+PAA+LVGA+NT+VN DG  +L G+ TDG G +RA+ + G   +K K
Sbjct:    69 PNKQLACEYVDELTPAAKLVGAINTIVNDDG--YLRGYNTDGTGHIRAIKESGFDIKGKT   126

Query:   131 ITLAGVGGAGKAIAVQLAFDGAKEVRLFNRQATRLSSVQKLVTKLNQLTRTKVTLQDLED   190
             + L G GGA  AI   Q A +G KE++LFNR+         ++N+ T    VT+ DL D
Sbjct:   127 MVLLGAGGASTAIGAQGAIEGLKEIKLFNRRDEFFDKALAFAQRVNENTDCVVTVTDLAD   186

Query:   191 QTAFKEAIRESHLFIDATSVGMKPLENLSLITDPELIRPDLVVFDIVYSPAETKLLAFAR   250
             Q AF EA+  +  + T VGMKPLEN SL+ D  L+ P L+V + VY+P  TKLL  A+
Sbjct:   187 QQAFAEALASADILTNGTKVGMKPLENESLVNDISLLHPGLLVTECVYNPHMTKLLQQAQ   246

Query:   251 QHGAQKVINGLGMVLYQGAEAFKLITGQDMPVDAIKPLLG                      290
             Q G  K I+G GM+L+QGAE F L TG+D P++ +K ++G
Sbjct:   247 QAGC-KTIDGYGMLLWQGAEQFTLWTGKDFPLEYVKQVMG                      285
```

An alignment of the GAS and GBS proteins is shown below.

```
Identities = 166/288 (57%), Positives = 221/288 (76%)
Query:     4 LNGETLLTGLIANPARHSLSPLMWNTSFQEKNMNYAYLTFEVEEGKLTEAVRGVRALGIR    63
             L+G TLL  L+A P RHSLSP M N ++ +  ++YAYL FEV   +L +AV+G+RALGIR
Sbjct:     5 LSGHTLLVSLLATPIRHSLSPKMHNEAYAKLGLDYAYLAFEVGTEQLADAVQGIRALGIR    64

Query:    64 GVNVSMPFKQSVIPLLDDLSPQAKLVGAVNTIVNQGGTGRLVGHMTDGIGCFKALAAQGF   123
             G NVSMP K++++PLLDDLSP A+LVGAVNT+VN+ G G LVGH+TDGIG   +ALA +G
Sbjct:    65 GSNVSMANKEAILPLLDDLSPAAELVGAVNTVVNKDGKGHLVGHITDGIGALRALADEGV   124

Query:   124 SAKNKIITIAGIGGSGKAVAVQAAMEGVAEIRLFNRNSSNYDKVIDLSDKIKKQFQIKVV   183
             S KNKIIT+AG+GG+GKA+AVQ A +G  E+RLFNR ++     V L K+ +   + KV
Sbjct:   125 SVKNKIITLAGVGGAGKAIAVQLAFDGAKEVRLFNRQATRLSSVQKLVTKLNQLTRTKVT   184

Query:   184 VDYLENKTAFKDAIRTSHFYIDATSLGMRPLDNYSLINDPEILTPNLVVVDLVYKPKETA   243
             +   LE++TAFK+AIR SH  +IDATS+GM+PL+N  SLI DPE++ P+LVV D+VY P ET
Sbjct:   185 LQDLEDQTAFKEAIRESHLFIDATSVGMKPLENLSLITDPELIRPDLVVFDIVYSPAETK   244

Query:   244 LLRFVRQNGVKHAYNGLGMLIYQGAEAFQLITNQEMPISSVERVLQTE              291
             LL F RQ+G +   NGLGM++YQGAEAF+LIT Q+MP+ +++ +L  E
Sbjct:   245 LLAFARQHGAQKVINGLGMVLYQGAEAFKLITGQDMPVDAIKPLLGDE              292
```

Based on this analysis, it was predicted that these proteins and their epitopes could be useful antigens for vaccines or diagnostics.

Example 1173

A DNA sequence (GBSx1249) was identified in *S. agalactiae* <SEQ ID 3645> which encodes the amino acid sequence <SEQ ID 3646>. Analysis of this protein sequence reveals the following:

Possible site 13
>>> Seems to have no N-terminal signal sequence
INTEGRAL     Likelihood = −6.16    Transmembrane 57-73 (53-76)
----- Final Results -----
  bacterial membrane --- Certainty = 0.3463 (Affirmative) <succ>
    bacterial outside --- Certainty = 0.0000 (Not Clear) <succ>
      bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1174

A DNA sequence (GBSx1250) was identified in *S. agalactiae* <SEQ ID 3647> which encodes the amino acid sequence <SEQ ID 3648>. Analysis of this protein sequence reveals the following:

Possible site: 17
>>> Seems to have no N-terminal signal sequence
----- Final Results -----
    bacterial cytoplasm --- Certainty = 0.2333 (Affirmative) <succ>
    bacterial membrane --- Certainty = 0.0000 (Not Clear) <succ>
       bacterial outside --- Certainty = 0.0000 (Not Clear) <succ>

A related GBS nucleic acid sequence <SEQ ID 10103> which encodes amino acid sequence <SEQ ID 10104> was also identified.

The protein has homology with the following sequences in the GENPEPT database.

```
>GP:BAB05343 GB:AP001512 L-asparaginase [Bacillus halodurans]
Identities = 158/319 (49%), Positives = 214/319 (66%), Gaps = 4/319 (1%)
Query:   1 MKKILVLHTGGTISMNANEKGQVMSSADNPMKYVDLSLDDL-DLTVVDFLNLPSPQITPH  59
           MKK+LV+HTGGTI+M+ +EKG V     NP+      SL +  + V DFLN+PSP +TP
Sbjct:   1 MKKVLVIHTGGTIAMHEDEKGGVQPKETNPLFATVESLTSIASIEVDDFLNIPSPHMTPE  60

Query:  60 HMLDIYHYLKQHASN--FDGVVITHGTDTLEETAYFLDTMILPKIPIIITGAMRSTNELG 117
             M +  LK   N    FDGVVITHGTDTLEETAY LD ++   ++P+++TGAMRS+NELG
Sbjct:  61 LMFQLAERLKSRVGNESEDGVVITHGTDTLEETAYLLDLLLDWEVPVVVTGAMRSSNELG 120

Query: 118 SDGVYNYLSALRVANSTKAADKGVLVVMNDEIHAAKYVTKTHTTNVSTFQTPTHGPLGII 177
           +DG +N++SA++ A + +A  KGVLVV NDEIH AK VTKTHT+NV+TFQ+P +GP+GI+
Sbjct: 121 ADGPHNFISAVKTAATDEAKGKGVLVVENDEIHTAKNVTKTHTSNVATFQSPQYGPIGIV 180

Query: 178 MKQDLLFFKATEERVRFDLDKITGTVPIVKAYAGMGDSGIISFLNSQNISGLVIEALGAG 237
            K+ + F A  +  ++  I   V  ++KAYAGM D  ++ +     I GLVIEA G G
Sbjct: 181 TKRGVTFHHAPSYKESYTVSSIDHRVVLLKAYAGM-DGSVVDAIADTGIDGLVIEAFGQG 239

Query: 238 NMPPKAAQEIEELIEQGVPVVLVSRCFNGIAEPVYGYEGGGAKLQESGVMFVKELNAPKA 297
           N+PP     I+ L +  +PVVLVSR +GI + Y YEGGG L++ GV+F   LN  KA
Sbjct: 240 NLPPAVVPSIKRLHQANIPVVLVSRSVSGIVQETYAYEGGGRHLKDLGVIFTNGLNGQKA 299

Query: 298 RLKLLIALNAGLTGQNLKD                                          316
           RLKLL+AL      + L++
Sbjct: 300 RLKLLVALELTTDRKKLQE                                          318
```

A related DNA sequence was identified in *S. pyogenes* <SEQ ID 3649> which encodes the amino acid sequence <SEQ ID 3650>. Analysis of this protein sequence reveals the following:

Possible site: 16
>>> Seems to have no N-terminal signal sequence
INTEGRAL    Likelihood = -2.28    Transmembrane 245-261 (243-261)
----- Final Results -----
    bacterial membrane --- Certainty = 0.1914 (Affirmative) <succ>
       bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:BAB05343 GB:AP001512 L-asparaginase [Bacillus halodurans]
Identities = 158/320 (49%), Positives = 218/320 (67%), Gaps = 5/320 (1%)
Query:   1 MKKILVLHTGGTISMQADNSGRVVPNQDNPM-TKIHAAAQDIQLTVSDFLNLPSPHITPH  59
           MKK+LV+HTGGTI+M  D  G V P + NP+     + +     + V DFLN+PSPH+TP
Sbjct:   1 MKKVLVIHTGGTIAMHEDEKGGVQPKETNPLFATVESLTSIASIEVDDFLNIPSPHMTPE  60

Query:  60 HMLSIYHHIQERT--DVFDGIVITHGTDTLEETAYFLDTMALPTNIPVVLTGAMRSSNEV 117
             M +  ++ R  +    FDG+VITHGTDTLEETAY LD + L    +PVV+TGAMRSSNE+
Sbjct:  61 LMFQLAERLKSRVGNESFDGVVITHGTDTLEETAYLLDLL-LDWEVPVVVTGAMRSSNEL 119

Query: 118 GSDGIYNYLTALRVASSDKAKEKGVLVVMNDEIHAAKYVTKTHTTNISTFQTPTHGPLGI 177
           G+DG +N+++A++ A++D+AK KGVLVV NDEIH AK VTKTHT+N++TFQ+P +GP+GI
Sbjct: 120 GADGPHNFISAVKTAATDEAKGKGVLVVFNDEIHTAKNVTKTHTSNVATFQSPQYGPIGI 179

Query: 178 IMKNDLLFFKTAEPRIRFDLRCISGTIPIIKAYAGMGDSILSLLTPGSIQGLVIEALGA  237
           + K + F       + ++  I    + ++KAYAGM DGS++ +       I GLVIEA G
Sbjct: 180 VTKRGVTFHHAPSYKESYTVSSIDHRVVLLKAYAGM-DGSVVDAIADTGIDGLVIEAFGQ 238

Query: 238 GNVPPLAVGEIEHLIALGIPVILVSRCFNGMAEPVYAYEGGGAMLQEAGVMFVKELNAPK 297
           GN+PP   V  I+ L    IPV+LVSR +G+ + YAYEGGG  L++ GV+F   LN  K
Sbjct: 239 GNLPPAVVPSIKRLHQANIPVVLVSRSVSGIVQETYAYEGGGRHLKDLGVIFTNGLNGQK 298

Query: 298 ARLKLLIALNAGLTGQELKD                                         317
           ARLKLL+AL     ++L++
Sbjct: 299 ARLKLLVALELTTDRKKLQE                                         318
```

An alignment of the GAS and GBS proteins is shown below.

```
Identities = 242/321 (75%), Positives = 275/321 (85%), Gaps = 1/321 (0%)
Query:   1  MKKILVLHTGGTISMNANEKGQVMSSADNPMKYVDLSLDDLDLTVVDFLNLPSPQITPHH    60
            MKKILVLHTGGTISM A+  G+V+ + DNPM  +  +  D+ LTV DFLNLPSP ITPHH
Sbjct:   1  MKKILVLHTGGTISMQADNSGRVVPNQDNPMTKIHAAAQDIQLTVSDFLNLPSPHITPHH    60

Query:  61  MLDIYHYLKQHASNFDGVVITHGTDTLEETAYFLDTMILP-KIPIIITGAMRSTNELGSD   119
            ML IYH++++    FDG+VITHGTDTLEETAYFLDTM  LP  IP+++TGAMRS+NE+GSD
Sbjct:  61  MLSIYHHIQERTDVFDGIVITHGTDTLEETAYFLDTMALPTNIPVVLTGAMRSSNEVGSD   120

Query: 120  GVYNYLSALRVANSTKAADKGVLVVMNDEIHAAKYVTKTHTTNVSTFQTPTHGPLGIIMK   179
            G+YNYL+ALRVA+S KA +KGVLVVMNDEIHAAKYVTKTHTTN+STFQTPTHGPLGIIMK
Sbjct: 121  GIYNYLTALRVASSDKAKEKGVLVVMNDEIHAAKYVTKTHTTNISTFQTPTHGPLGIIMK   180

Query: 180  QDLLFFKATEERVRFDLDKITGTVPIVKAYAGMGDSGIISFLNSQNISGLVIEALGAGNM   239
             DLLFFK  E R+RFDL I+GT+PI+KAYAGMGD  I+S L    +I GLVIEALGAGN+
Sbjct: 181  NDLLFFKTAEPRIRFDLRCISGTIPIIKAYAGMGDSILSLLTPGSIQGLVIEALGAGNV   240

Query: 240  PPKAAQEIEELIEQGVPVVLVSRCFNGIAEPVYGYEGGGAKLQESGVMFVKELNAPKARL   299
            PP A  EIE LI  G+PV+LVSRCFNG+AEPVY YEGGGA LQE+GVMFVKELNAPKARL
Sbjct: 241  PPLAVGEIEHLIALGIPVILVSRCFNGMAEPVYAYEGGGAMLQEAGVMFVKELNAPKARL   300

Query: 300  KLLIALNAGLTGQNLKDYIEG                                          320
            KLLIALNAGLTGQ LKDYIEG
Sbjct: 301  KLLIALNAGLTGQELKDYIEG                                          321
```

Based on this analysis, it was predicted that these proteins and their epitopes could be useful antigens for vaccines or diagnostics.

Example 1175

A DNA sequence (GBSx1251) was identified in *S. agalactiae* <SEQ ID 3651> which encodes the amino acid sequence <SEQ ID 3652>. Analysis of this protein sequence reveals the following:

Possible site: 50
>>> Seems to have no N-terminal signal sequence
----- Final Results -----
   bacterial cytoplasm --- Certainty = 0.4427 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

A related DNA sequence was identified in *S. pyogenes* <SEQ ID 3653> which encodes the amino acid sequence <SEQ ID 3654>. Analysis of this protein sequence reveals the following:

Possible site: 45
>>> Seems to have no N-terminal signal sequence
----- Final Results -----
   bacterial cytoplasm --- Certainty = 0.6014 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
>GP:CAB85142 GB:AL162757 conserved hypothetical protein [Neisseria
meningitidis Z2491]
Identities = 87/285 (30%), Positives = 138/285 (47%), Gaps = 35/285 (12%)
Query:   4  KAVFFDIDGTLLNDRKNVQKSTIK-AIRNLKDQGILVGLATGRG----PSFVQPFLENLG    58
            K VFFDID TL    + ++K A+  L+ +GIL LATGR     P   V+  +    G
Sbjct:  11  KIVFFDIDDTLYRKYTDTLRPSVKTAVAALRGKGILTALATGRSLATIPEKVRDMMAETG    70

Query:  59  LDFAVTYNGQYIYSRSEIIYTNQLSKTTVYRLIRYAGARRREISLGTASGLLGSGIIGLS   118
            +D   VT NGQ+    +  +  +    + R+ +          SLG    +G   G+
Sbjct:  71  MDAVVTINGQFALLHGKTVCEVPMDAGLMGRVCAHLD------SLGMDYAFVGGE--GIA   122

Query: 119  TSRLGQIVSSLVPRKWAKAIERSFKHFIRRIKPQNIDSLMVILREPIYQVVLVATEGE--   176
                 S L + V               R+ KH     I         +P+YQ+++ A E E
Sbjct: 123  VSALSECVC-----------RALKH----IASDFFADKDYFSSKPVYQMLVFAEENEMP   166

Query: 177  --SERIQKQFPRVKLTRSSPYSMDVISEGQSKVKGIERVGQRYGFDLSEVIAFGDSDNDI   234
              S+ ++++    +K  R    ++D++   G SK  GI  V +  G  ++++V+AFGD  ND+
Sbjct: 167  LWSDIVERE--GLKTVRWHEEAVDLLPAGASKTDGIRSVVEALGLEMADVMAFGDGLNDV   224

Query: 235  EMLSQVGIGVAMGNASQQVRENARYTTADNNDDGISKALAHYGLI                 279
            EMLS+VG GVAMGN  Q  +E A+Y      ++DG + L    G+I
Sbjct: 225  EMLSEVGFGVAMGNGEQAAKEEAAKYVCPGVDEDGVLRGLQDLVI                 269
```

```
Identities = 320/459 (69%), Positives = 391/459 (84%)
Query:   1  MAIKAVFFDIDGTLLNDRKNVQKSTIKAIRNLKDQGILVGLATGRGPSFVQPFLENLGLD  60
            + +KAVFFDIDGTLLNDRKN+QK+T KAI+ LK QGI+VGLATGRGP FVQPFLEN GLD
Sbjct:   1  LTVKAVFFDIDGTLLNDRKNIQKTTQKAIQQLKKQGIMVGLATGRGPGFVQPFLENFGLD  60

Query:  61  FAVTYNGQYIYSRSEIIYTNQLSKTTVYRLIRYAGARRREISLGTASGLLGSGIIGLGTS  120
            FAVTYNGQYI +R +++Y NQL K+ +Y++IRYA  ++REISLGTASGL GS II +GTS
Sbjct:  61  FAVTYNGQYILTRDKVLYQNQLPKSMIYKVIRYANEKKREISLGTASGLAGSRIIDMGTS  120

Query: 121  RLGQIVSSLVPRKWAKAIERSFKHFIRRIKPQNIDSLMVILREPIYQVVLVATEGESERI  180
               GQ++SS VP+ WA+ +E SFKH IRRIKPQ+  +L+ I+REPIYQVVLVA++ E+++I
Sbjct: 121  PFGQVISSFVPKSWARTVEGSFKHLIRRIKPQSFRNLVTIMREPIYQVVLVASQAETKKI  180

Query: 181  QKQFPRVKLTRSSPYSMDVISEGQSKVKGIERVGQRYGFDLSEVIAFGDSDNDIEMLSQV  240
            Q++FP +K+TRSSPYS+D+IS  QSK+KGIER+G+ +GFDLSEV+AFGDSDND+EMLS V
Sbjct: 181  QEKFPHIKITRSSPYSLDLISVDQSKIKGIERLGEMFGFDLSEVMAFGDSDNDLEMLSGV  240

Query: 241  GIGVAMGNASQQVRENARYTTADNNDDGISKALAHYGLIQFEIEKTFSSRDENFNKVKSF  300
            GIG+AMGNA    V++ A +TT  NN+DGISKALAHYGLI F+IEK+F SRDENFNKVK F
Sbjct: 241  GIGIAMGNAETVVKDGAHFTTDSNNNDGISKALAHYGLIHFDIEKSFKSRDENFNKVKDF  300

Query: 301  HLLMDGETIETPRLYDSKEAGFRSDFKVEEIVEFLYAASQGNQKVFDQSIRNLHLAIDKA  360
            H LMD +TIETPR Y   EAG+RS FKVEEIVEFLYAAS+G+Q+ F Q+I +LH A+D+A
Sbjct: 301  HRLMDSDTIETPRSYTISEAGYRSGFKVEEIVEFLYAASKGDQQQFTQAIFDLHGAVDQA  360

Query: 361  RDKVISKDHPETPLVGEVDALTDLLYLTYGSFVLMGVDPKPLFDTVHEANMGKIFPDGKA  420
             +KV +K H ETPL+G+VDAL DLLY TYGSFVLMGVDP+P+F+ VHEANM KIFPDGKA
Sbjct: 361  ANKVQAKKHVETPLIGQVDALADLLYFTYGSFVLMGVDPQPIFEAVHEANMAKIFPDGKA  420

Query: 421  HFDPVTHKILKPDDWEEHFAPEPSIRRELDSQIQKSLNR                      459
            HFDPVTHKI KPD W+E  APE +I++ELD Q+QKSL R
Sbjct: 421  HFDPVTHKIQKPDYWQERHAPEVAIKKELDKQLQKSLQR                      459
```

Based on this analysis, it was predicted that these proteins and their epitopes could be useful antigens for vaccines or diagnostics.

Example 1176

A DNA sequence (GBSx1252) was identified in *S. agalactiae* <SEQ ID 3655> which encodes the amino acid sequence <SEQ ID 3656>. Analysis of this protein sequence reveals the following:

---

Possible site: 38
>>> Seems to have no N-terminal signal sequence
----- Final Results -----
   bacterial cytoplasm --- Certainty = 0.1671 (Affirmative) <succ>
   bacterial membrane --- Certainty = 0.0000 (Not Clear) <succ>
   bacterial outside --- Certainty = 0.0000 (Not Clear) <succ>

---

A related GBS nucleic acid sequence <SEQ ID 10101> which encodes amino acid sequence <SEQ ID 10102> was also identified.

The protein has homology with the following sequences in the GENPEPT database.

A related DNA sequence was identified in *S. pyogenes* <SEQ ID 3657> which encodes the amino acid sequence <SEQ ID 3658>. Analysis of this protein sequence reveals the following:

---

Possible site: 51
>>> Seems to have no N-terminal signal sequence
----- Final Results -----
   bacterial cytoplasm --- Certainty = 0.1296 (Affirmative) <succ>
   bacterial membrane --- Certainty = 0.0000 (Not Clear) <succ>
   bacterial outside --- Certainty = 0.0000 (Not Clear) <succ>

---

An alignment of the GAS and GBS proteins is shown below.

```
>GP:BAB06903 GB:AP001518 unknown conserved protein [Bacillus halodurans]
Identities = 61/141 (43%), Positives = 92/141 (64%)
Query:  22  YERILVAIDGSTESELAFEKAVNVALRNDSELILTHVIDTRALQSFATFDTYIYEKLEKE  81
            Y  ILVA+DGST+++ A  KA N A   ++L + HVID+R+ +   +D +    E +
Sbjct:   2  YNHILVAVDGSTQAKRALYKAFNYAKEFKADLFICHVIDSRSFATVEQYDRTVVGAAELD  61

Query:  82  AKDVLEEYEKQAREKGADKVRQVIEFGNPKTLLAHDIPEKEKVDLIMVGATGLNTFERFX  141
            K +L+ Y ++A + G DKV   +++FG+PK  ++  I +K  +DLI+ GATGLN  ERF
Sbjct:  62  GKKLLQRYSEEAEKAGVDKVHTILDFGSPKANISKTIAQKYDIDLIITGATGLNAVERFL  121

Query: 142  IGSSSEYILRHAKVDLLIVRD                                        162
            +GS SE + RHAK D+LIVR+
Sbjct: 122  MGSVSESVARHAKCDVLIVRN                                        142
```

```
Identities = 117/156 (75%), Positives = 135/156 (86%)
Query:  12 LEEDRLMSQKYERILVAIDGSTESELAFEKAVNVALRNDSELILTHVIDTRALQSFATFD    71
            L+ED  MS KY+RILVAIDGS ESELAF K VNVALRND+ L+L HVIDTRALQS ATFD
Sbjct:  25 LKEDSSMSLKYKRILVAIDGSYESELAFNKGVNVALRNDATLLLVHVIDTRALQSVATFD    84

Query:  72 TYIYEKLEKEAKDVLEEYEKQAREKGADKVRQVIEFGNPKTLLAHDIPEKEKVDLIMVGA   131
            TYIYEKLE+EAKDVL+++EKQA+  G   ++Q+IEFGNPK LLAHDIP++E  DLIMVGA
Sbjct:  85 TYIYEKLEQEAKDVLDDFEKQAQIAGITNIKQIIEFGNPKNLLAHDIPDRENADLIMVGA   144

Query: 132 TGLNTFERFXIGSSSEYILRHAKVDLLIVRDPNKTM                           167
            TGLNTFER  IGSSSEYI+RHAK+DLL+VRD  KT+
Sbjct: 145 TGLNTFERLLIGSSSEYIMRHAKIDLLVVRDSTKTL                           180
```

Based on this analysis, it was predicted that these proteins and their epitopes could be useful antigens for vaccines or diagnostics.

Example 1177

A DNA sequence (GBSx1253) was identified in *S. agalactiae* <SEQ ID 3659> which encodes the amino acid sequence <SEQ ID 3660>. This protein is predicted to be aspartate aminotransferase (aspC). Analysis of this protein sequence reveals the following:

Possible site:47
>>> Seems to have no N-terminal signal sequence
----- Final Results -----
   bacterial cytoplasm --- Certainty = 0.2803 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database.

```
>GP:AAC21948 GB:U32714 aminotransferase [Haemophilus influenzae Rd]
Identities = 142/212 (66%), Positives = 181/212 (84%), Gaps = 1/212 (0%)
Query:   1 MKIFDKSMKLEHVAYDIRGPVLEEADRMRANGEKILRLNTGNPAAFGFEAPDEVIRDLIT    60
            M++F KS KLEHV YDIRGPV +EA R+   G KIL+LN GNPA FGFEAPDE++ D++
Sbjct:   1 MRLFPKSDKLEHVCYDIRGPVHKEALRLEEEGNKILKLNIGNPAPFGFEAPDEILVDVLR    60

Query:  61 NARESEGYSDSKGIFSARKAVMQYYQLQNI-HVDMDDIYIVNGVSEGISMSMQALLDNDD   119
            N    ++GY DSKG++SARKA++QYYQ + I    ++D+YI NGVSE I+M+MQALL++ D
Sbjct:  61 NLPSAQGYCDSKGLYSARKAIVQYYQSKGILGATVNDVYIGNGVSELITMAMQALLNDGD   120

Query: 120 EVLVPMPDYPLWTACVSLAGGNAVHYICDEEANWYPDIDDIKSKITSKTKAIVLINPNNN   179
            EVLVPMPDYPLWTA V+L+GG AVHY+CDE+ANW+P IDDIK+K+  +KTKAIV+INPNNP
Sbjct: 121 EVLVPMPDYPLWTAAVTLSGGKAVHYLCDEDANWFPTIDDIKAKVNAKTKAIVIINPNNP   180

Query: 180 TGAVYPREILQEIVDIARQNDLIIFSDEVYDR                              211
            TGAVY +E+LQEIV+IARQN+LIIF+DE+YD+
Sbjct: 181 TGAVYSKELLQEIVEIARQNNLIIFADEIYDK                              212
```

A related DNA sequence was identified in *S. pyogenes* <SEQ ID 3661> which encodes the amino acid sequence <SEQ ID 3662>. Analysis of this protein sequence reveals the following:

Possible site: 59
>>> Seems to have no N-terminal signal sequence
----- Final Results -----
   bacterial cytoplasm --- Certainty = 0.2936 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

```
Identities = 170/212 (80%), Positives = 193/212 (90%), Gaps = 1/212 (0%)
Query:   1 MKIFDKSMKLEHVAYDIRGPVLEEADRMRANGEKILRLNTGNPAAFGFEAPDEVIRDLIT    60
            MKI +KS KLEHVAYDIRGPVL+EA+RM A+GEKILRLNTGNPAAFGFEAPDEVIRDLI
Sbjct:  13 MKIIEKSSKLEHVAYDIAGPVLDEANRMIASGEKILRLNTGNPAAFGFEAPDEVIRDLIV    72

Query:  61 NARESEGYSDSKGIFSARKAVMQYYQLQNI-HVDMDDIYIVNGVSEGISMSMQALLDNDD   119
            NAR SEGYSDSKGIFSARKA+MQY QL+    VD++DIY+ NGVSE IS+S+QALLDN D
Sbjct:  73 NARLSEGYSDSKGIFSARKAIMQYCQLKGFPDVDIEDINIGNGVSELISISLQALLDNGD   132

Query: 120 EVLVPMPDYPLWTACVSLAGGNAVHYICDEEANWYPDIDDIKSKITSKTKAIVLINPNNN   179
            EVLVPMPDYPLWTACVSL GG AVHY+CDEEA WYPDI DIKSKITS+TKAIV+INPNNP
Sbjct: 133 EVLVPMPDYPLWTACVSLGGGKAVHYLCDEEAGWYPDIADIKSKITSRTKAIVVINPNNP   192
```

```
-continued
Query: 180  TGAVYPREILQEIVDIARQNDLIIFSDEVYDR         211
             TGA+YP+EIL++IV +AR++ LIIF+DE+YDR
Sbjct: 193  TGALYPKEILEDIVALAREHQLIIFADEIYDR         224
```

Based on this analysis, it was predicted that these proteins and their epitopes could be useful antigens for vaccines or diagnostics.

Based on this analysis, it was predicted that these proteins and their epitopes could be useful antigens for vaccines or diagnostics.

Example 1178

A DNA sequence (GBSx1254) was identified in *S. agalactiae* <SEQ ID 3663> which encodes the amino acid sequence <SEQ ID 3664>. Analysis of this protein sequence reveals the following:

Example 1179

A DNA sequence (GBSx1255) was identified in *S. agalactiae* <SEQ ID 3667> which encodes the amino acid sequence <SEQ ID 3668>. Analysis of this protein sequence reveals the following:

```
Possible site: 60
>>> Seems to have no N-terminal signal sequence
INTEGRAL    Likelihood = -14.75    Transmembrane 38-54 (29-60)
----- Final Results -----
    bacterial membrane --- Certainty = 0.6901 (Affirmative) <succ>
    bacterial outside --- Certainty = 0.0000 (Not Clear) <succ>
    bacterial cytoplasm--- Certainty = 0.0000 (Not Clear) <succ>
```

A related GBS nucleic acid sequence <SEQ ID 9389> which encodes amino acid sequence <SEQ ID 9390> was also identified.

The protein has no significant homology with any sequences in the GENPEPT database.

A related DNA sequence was identified in *S. pyogenes* <SEQ ID 3665> which encodes the amino acid sequence <SEQ ID 3666>. Analysis of this protein sequence reveals the following:

```
Possible site: 22
>>> Seems to have no N-terminal signal sequence
----- Final Results -----
    bacterial cytoplasm --- Certainty = 0.0815 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

A related DNA sequence was identified in *S. pyogenes* <SEQ ID 3669> which encodes the amino acid sequence <SEQ ID 3670>. Analysis of this protein sequence reveals the following:

```
Possible site: 43
>>> Seems to have no N-terminal signal sequence
INTEGRAL    Likelihood = -15.97    Transmembrane 35-51 (25-58)
----- Final Results -----
    bacterial membrane --- Certainty = 0.7389 (Affirmative) <succ>
    bacterial outside --- Certainty = 0.0000 (Not Clear) <succ>
    bacterial cytoplasm --- Certainty = 0.0000 (Not Clear) <succ>
```

```
Possible site: 61
>>> Seems to have no N-terminal signal sequence
----- Final Results -----
    bacterial cytoplasm --- Certainty = 0.0107 (Affirmative) <succ>
    bacterialmembrane --- Certainty = 0.0000 (Not Clear) <succ>
    bacterial outside --- Certainty = 0.0000 (Not Clear) <succ>
```

The protein has no significant homology with any sequences in the GENPEPT database.

An alignment of the GAS and GBS proteins is shown below.

An alignment of the GAS and GBS proteins is shown below.

```
Identities = 51/87 (58%), Positives = 63/87 (71%), Gaps = 7/87 (8%)
Query:   1  MAKKPWEKKVVENNSHRKDKITRTSRGVVSSTPWITAFLSAFFVIVVAILFIVFYTSNRG    60
            MAK+PWE+K+V++     +  TR SR    STPW+TA LS FFVI+VAILFI FYTSN G
Sbjct:   1  MAKEPWEEKIVDDTIGTR---TRKSRNAFISTPWLTALLSVFFVIIVAILFIFFYTSNSG   57

Query:  61  EDRAKETSGFYGASSQKVNSSKTKKAS    87
            +R   ET+GFYGAS+ K     KT+KAS
Sbjct:  58  SNRQAETNGFYGASTHK----KTRKAS    80
```

```
Identities = 43/64 (67%), Positives = 53/64 (82%)
Query:   1   MKVALIPEKCIACGLCQTYSNIFDYQDDGIVKFSDTDNLEKEIPSSDQDTVLAVKSCPTK    60
             MKV++IPEKCIACGLCQTYS++FDY D+GIV FS +    + I  SD+D +LAVKSCPTK
Sbjct:   1   MKVSIIPEKCIACGLCQTYSSLFDYHDNGIVTFSSSSETSQSICPSDKDAILAVKSCPTK    60

Query:  61   ALTI                                                          64
             ALT+
Sbjct:  61   ALTL                                                          64
```

Based on this analysis, it was predicted that these proteins and their epitopes could be useful antigens for vaccines or diagnostics.

Example 1180

A DNA sequence (GBSx1256) was identified in *S. agalactiae* <SEQ ID 3671> which encodes the amino acid sequence <SEQ ID 3672>. Analysis of this protein sequence reveals the following:

---

Possible site: 28
>>> Seems to have a cleavable N-term signal seq.
INTEGRAL    Likelihood = –10.61    Transmembrane 47-63 (41-69)
----- Final Results -----
  bacterial membrane --- Certainty = 0.5246 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the GENPEPT database.

```
>GP:AAC36851 GB:L23802 pore-forming peptide [Enterococcus faecalis]
Identities = 42/130 (32%), Positives = 63/130 (48%), Gaps = 9/130 (6%)
Query:   7   KIRYHWQPELSWAIIYWSIAIAPIFIGLSLLYERTE---IPSQVFVLFAIFIVLVGIGFH    63
             K +++WQPEL+  IIYWS    +FI L L E        I + V V F +F  L  G
Sbjct:   3   KQKFYWQPELASTIIYWSCTFCILFISLILALENNGPYLISNLVMVPFFVFAYL---GIA    59

Query:  64   RYFVIEEDGYLRIVSFNFLRRTKFPIEDIAKIEVTKSSVTIKFNNNHE--RIFYMRKWPK   121
             R F + E    L +     + R+    P+  I K+    + S+ I   +  E  ++F M+K
Sbjct:  60   RSFNMTETS-LIVRDVLWFRKKALPLSQIEKVTYNEKSIEIFSSEFKEGSKVFLMKKKTD   118

Query: 122   KYFLDALAIE                                                   131
               FL+AL I+
Sbjct: 119   SLFLEALKIK                                                   128
```

A related DNA sequence was identified in *S. pyogenes* <SEQ ID 3673> which encodes the amino acid sequence <SEQ ID 3674>. Analysis of this protein sequence reveals the following:

---

Possible site: 28
>>> Seems to have no N-terminal signal sequence
INTEGRAL    Likelihood = –9.87    Transmembrane 47-63 (41-69)
INTEGRAL    Likelihood = –3.35    Transmembrane 20-36 (18-37)
----- Final Results -----
  bacterial membrane --- Certainty = 0.4949 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the databases:

```
>GP:AAC36851 GB:L23802 pore-forming peptide [Enterococcus faecalis]
Identities = 42/130 (32%), Positives = 70/130 (53%), Gaps = 12/130 (9%)
Query:   7   KIRYHWQPELSWSIIYWSIAFAPIFVGLSLLYERTE---IPSRVFILFAIFAVLVGIGLH    63
             K +++WQPEL+ +IIYWS  F  +F+ L L E        I + V + F +FA L   G+
Sbjct:   3   KQKFYWQPELASTIIYWSCTFCILFISLILALENNGPYLISNLVMVPFFVFAYL---GIA    59

Query:  64   RYF-IIENNGILRIVSFKLFGPRKLLISTITKIEVTKSTLCL---HVEDKSYLFYMRKWP   119
             R F + E + I+R V +    F  + L +S I K+    + ++ +       ++ S +F M+K
Sbjct:  60   RSFNMTETSLIVRDVLW--FRKKALPLSQIEKVTYNEKSIEIFSSEFKEGSKVFLMKKKT   117

Query: 120   KKYFLDALAV                                                   129
               FL+AL +
Sbjct: 118   DSLFLEALKI                                                   127
```

An alignment of the GAS and GBS proteins is shown below.

```
Identities = 115/162 (70%), Positives = 132/162 (80%), Gaps = 1/162 (0%)
Query:    1 MIKLFGKIRYHWQPELSWAIIYWSIAIAPIFIGLSLLYERTEIPSQVFVLFAIFIVLVGI    60
            MIKLFGKIRYHWQPELSW+IIYWSIA APIF+GLSLLYERTEIPS+VF+LFAIF VLVGI
Sbjct:    1 MIKLFGKIRYHWQPELSWSIIYWSIAFAPIFVGLSLLYERTEIPSRVFILFAIFAVLVGI    60

Query:   61 GFHRYFVIEEDGYLRIVSFNFLRRTKFPIEDIAKIEVIKSSVTIKFNNNHERIFYMRKWP   120
            G HRYF+IE +G LRIVSF      K  I  I KIEVTKS++ +     +  +FYMRKWP
Sbjct:   61 GLHRYFIIENNGILRIVSFKLFGPRKLLISTITKIEVTKSTLCLHVEDK-SYLFYMRKWP   119

Query:  121 KKYFLDALAIEPTFKGEVELLDNLIKMDYFECYRYDKKALTK                    162
            KKYFLDALA+ P F+GEV L DN IK+DYFE Y++DKKALT+
Sbjct:  120 KKYFLDALAVNPYFQGEVILSDNFIKLDYFEVYQHDKKALTR                    161
```

Based on this analysis, it was predicted that these proteins and their epitopes could be useful antigens for vaccines or diagnostics.

Example 1181

A DNA sequence (GBSx1257) was identified in *S. agalactiae* <SEQ ID 3675> which encodes the amino acid sequence <SEQ ID 3676>. This protein is predicted to be peptidase t (pepT). Analysis of this protein sequence reveals the following:

---

Possible site: 49
>>> Seems to have no N-terminal signal sequence
----- Final Results -----
   bacterial cytoplasm --- Certainty = 0.2913 (Affirmative) <succ>
    bacterial membrane --- Certainty = 0.0000 (Not Clear) <succ>
      bacterial outside --- Certainty = 0.0000 (Not Clear) <succ>

---

The protein has homology with the following sequences in the GENPEPT database.

A related DNA sequence was identified in *S. pyogenes* <SEQ ID 3677> which encodes the amino acid sequence <SEQ ID 3678>. Analysis of this protein sequence reveals the following:

---

Possible site: 41
>>> Seems to have no N-terminal signal sequence
----- Final Results -----
   bacterial cytoplasm --- Certainty = 0.2938 (Affirmative) <succ>
    bacterial membrane --- Certainty = 0.0000 (Not Clear) <succ>
      bacterial outside --- Certainty = 0.0000 (Not Clear) <succ>

---

An alignment of the GAS and GBS proteins is shown below.

```
>GP:AAA20627 GB:L27596 tripeptidase [Lactococcus lactis]
Identities = 274/406 (67%), Positives = 334/406 (81%), Gaps = 4/406 (0%)
Query:    1 MSYEKLLERFLTYVKINTRSNPNSTQTPTTQSQVDFALTVLKPEMEAIGLKDVHYLPSNG    60
            M YEKLL RFL YVK+NTRS+ NST TP+TQ+ V+FA   +  +M+A+GLKDVHYL SNG
Sbjct:    1 MKYEKLLPRFLEYVKVNTRSDENSTTTPSTQALVEFAHK-MGEDMKALGLKDVHYLESNG    59

Query:   61 YLVGTLPATSDRLRHKIGFISHMDTADFNAENITPQIVDYKGGD--IELGDSGYILSPKD   118
            Y++GT+PA +D+   KIG ++H+DTADFNAE + PQI++    G+  I+LGD+ + L PKD
Sbjct:   60 YVIGTIPANTDKKVRKIGLLAHIDTADFNAEGVNPQILENYDGESVIQLGDTEFTLDPKD   119

Query:  119 FPNLNNYHGQTLITTDGKTLLGADDKSGIAEIMTAMEYLAS-HPEIEHCEIRVGFGPDEE   177
            FPNL NY GQTL+ TDG TLLG+DDKSG+AEIMT  +YL +  +P+ EH EIRVGFGPDEE
Sbjct:  120 FPNLKNYKGQTLVHTDGTTLLGSDDKSGVAEIMTLADYLLNINPDFEHGEIRVGFGPDEE   179

Query:  178 IGIGADKEDVKDFDVDFAYTVDGGPLGELQYETFSAAGLELTFEGRNVHPGTAKNQMINA   237
            IG+GADKFDV DFDVDFAYTVDGGPLGELQYETFSAAG  + F+G+NVHPGTAKN M+NA
Sbjct:  180 IGVGADKFDVADFDVDFAYTVDGGPLGELQYETFSAAGAVIEFQGKNVHPGTAKNMMVNA   239

Query:  238 LQLAMDFHSQLPENERPEQTDGYQGFYHLYDLSGTVDQAKSSYIIRDFEEVDFLKRKHLA   297
            LQLA+D+H+  LPE +RPE+T+G +GF+HL  L GT ++A++  YIIRD EE  F +RK L
Sbjct:  240 LQLAIDYHNALPEFDRPEKTEGREGFEHLLKLDGTPEEARAQYIIRDHEEGKFNERKALM   299

Query:  298 QDIADNMNEALQSERVKVKLYDQYYNMKKVIEKDMTPINIAKEVMEELDIKPIIEPIRGG   357
            Q+IAD MN  L    RVK + DQYYNM ++IEKDM+ I+IAK+ ME LDI PIIEPIRGG
Sbjct:  300 QEIADKMNAELGQNRVKPVIKDQYYNMAQIIEKDMSIIDIAKKAMENLDIAPIIEPIRGG   359

Query:  358 TDGSKISFMGIPTPNLFAGGENMHGRFEFVSLQTMEKAVDVILGIV                403
            TDGSKISFMG+PTPNLFAGGENMHGRFEFVS+QTMEKAVD +L I+
Sbjct:  360 TDGSKISFMGLPTPNLFAGGENMHGRFEFVSVQTMEKAVDTLLEII                405
```

```
Identities = 305/406 (75%), Positives = 352/406 (86%), Gaps = 1/406 (0%)
Query:   1 MSYEKLLERFLTYVKINTRSNPNSTQTPTTQSQVDFALTVLKPEMEAIGLKDVHYLPSNG   60
             M Y+ LL+RF+ YVK+NTRS P+S   TP+T+SQ  FALT+LKPEMEAIGL+DVHY P NG
Sbjct:   5 MKYDNLLDRFIKYVKVNTRSVPDSETTPSTESQEAFALTILKPEMEAIGLQDVHYNPVNG   64

Query:  61 YLVGTLPATSDRLRHKIGFISHMDTADFNAENITPQIVD-YKGGDIELGDSGYILSPKDF  119
             YL+GTLPA +  L  KIGFI+HMDTADFNAEN+ PQI+D Y+GGDI LG S Y L PK F
Sbjct:  65 YLIGTLPANNPILTRKIGFIAHMDTADFNAENVNPQIIDNYQGGDITLGSSNYKLDPKAF  124

Query: 120 PNLNNYHGQTLITTDGKTLLGADDKSGIAEIMTAMEYLASHPEIEHCEIRVGFGPDEEIG  179
             PNLNNY GQTLITTDG TLLGADDKSGIAEIMTA+E+L S P+IEHC+I+V FGPDEEIG
Sbjct: 125 PNLNNYIGQTLITTDGTTLLGADDKSGIAEIMTAIEFLTSQPQIEHCDIKVAFGPDEEIG  184

Query: 180 IGADKFDVKDFDVDFAYTVDGGPLGELQYETFSAAGLELTFEGRNVHPGTAKNQMINALQ  239
             +GADKF+V DF+VDFAYT+DGGPLGELQYETFSAA LE+TF GRNVHPGTAK+QMINAL+
Sbjct: 185 VGADKFEVADFEVDFAYTMDGGPLGELQYETFSAAALEVTFLGRNVHPGTAKDQMINALE  244

Query: 240 LAMDFHSQLPENERPEQTDGYQGFYHLYDLSGTVDQAKSSYIIRDFEEVDFLKRKHLAQD  299
             LA+DFH +LP  +RPE TDGYQGFYHL L+GTV++A++SYIIRDFEE  F  RK    ++
Sbjct: 245 LAIDFHEKLPAKDRPEYIDGYQGFYHLTGLTGTVEEARASYIIRDFEEASFEARKVKVEN  304

Query: 300 IADNMNEALQSERVKVKLYDQYYNMKKVIEKDMTPINIAKEVMEELDIKPIIEPIRGGTD  359
             IA +MN  L  ++RV V+L DQYYNMKKVIEKDMT I +AKEVMEEL IKP+IEPIRGGTD
Sbjct: 305 IAQSMNAQLGTKRVLVELNDQYYNMKKVIEKDMTAIELAKEVMEELAIKPVIEPIRGGTD  364

Query: 360 GSKISFMGIPTPNLFAGGENMHGRFEFVSLQTMEKAVDVILGIVAK               405
             GSKISFMGIPTPN+FAGGENMHGRFEFVSLQTME+AVDVI+G+V K
Sbjct: 365 GSKISFMGIPTPNIFAGGENMEGRFEFVSLQTMERAVDVIIGLVCK               410
```

Based on this analysis, it was predicted that these proteins and their epitopes could be useful antigens for vaccines or diagnostics.

Example 1182

A DNA sequence (GBSx1258) was identified in *S. agalactiae* <SEQ ID 3679> which encodes the amino acid sequence <SEQ ID 3680>. Analysis of this protein sequence reveals the following:

```
Possible site: 43
>>> Seems to have no N-terminal signal sequence
INTEGRAL    Likelihood = -12.26   Transmembrane 481-497 (477-508)
INTEGRAL    Likelihood = -9.45    Transmembrane 510-526 (506-534)
INTEGRAL    Likelihood = -7.96    Transmembrane 316-332 (310-334)
INTEGRAL    Likelihood = -7.54    Transmembrane 354-370 (351-373)
INTEGRAL    Likelihood = -7.11    Transmembrane 385-401 (383-409)
INTEGRAL    Likelihood = -6.58    Transmembrane 215-231 (211-233)
INTEGRAL    Likelihood = -6.48    Transmembrane 71-87 (69-91)
INTEGRAL    Likelihood = -6.32    Transmembrane 110-126 (106-133)
INTEGRAL    Likelihood = -5.10    Transmembrane 446-462 (443-465)
INTEGRAL    Likelihood = -3.29    Transmembrane 418-434 (418-435)
INTEGRAL    Likelihood = -2.55    Transmembrane 263-279 (263-279)
INTEGRAL    Likelihood = -2.02    Transmembrane 142-158 (141-159)
INTEGRAL    Likelihood = -1.70    Transmembrane 184-200 (184-200)
----- Final Results -----
    bacterial membrane --- Certainty = 0.5904 (Affirmative) <succ>
    bacterial outside --- Certainty = 0.0000 (Not Clear) <succ>
    bacterial cytoplasm --- Certainty = 0.0000 (Not Clear) <succ>
```

A related GBS nucleic acid sequence <SEQ ID 8747> which encodes amino acid sequence <SEQ ID 8748> was also identified. Analysis of this protein sequence reveals the following:

```
Lipop: Possible site: -1   Crend: 6
McG: Discrim Score: -10.58
GvH: Signal Score (-7.5): -1.1
Possible site: 32
>>> Seems to have no N-terminal signal sequence
ALOM program   count: 13 value: -12.26 threshold: 0.0
INTEGRAL    Likelihood = -12.26   Transmembrane 470-486 (466-497)
INTEGRAL    Likelihood = -9.45    Transmembrane 499-515 (495-523)
INTEGRAL    Likelihood = -7.96    Transmembrane 305-321 (299-323)
INTEGRAL    Likelihood = -7.54    Transmembrane 343-359 (340-362)
INTEGRAL    Likelihood = -7.11    Transmembrane 374-390 (372-398)
INTEGRAL    Likelihood = -6.58    Transmembrane 204-220 (200-222)
INTEGRAL    Likelihood = -6.48    Transmembrane 60-76 (58-80)
INTEGRAL    Likelihood = -6.32    Transmembrane 99-115 (95-122)
INTEGRAL    Likelihood = -5.10    Transmembrane 435-451 (432-454)
INTEGRAL    Likelihood = -3.29    Transmembrane 407-423 (407-424)
INTEGRAL    Likelihood = -2.55    Transmembrane 252-268 (252-268)
INTEGRAL    Likelihood = -2.02    Transmembrane 131-147 (130-148)
INTEGRAL    Likelihood = -1.70    Transmembrane 173-189 (173-189)
PERIPHERAL  Likelihood = 1.43    21
modified ALOM score: 2.95
*** Reasoning Step: 3
----- Final Results -----
    bacterial membrane --- Certainty = 0.5904 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:AAC00276 GB:AF008220 YtgP [Bacillus subtilis]
Identities = 178/545 (32%), Positives = 302/545 (54%), Gaps = 26/545 (4%)
Query:  24 QMVKGTAWLTAGNFISRLLGAIYIIPWYAWMGKHAAEANALFGMGYEIYALFLLISTVGI   83
             ++++GT  LT G +ISR+LG +Y+IP+   +G   A   ALF  GY  Y LFL I+T+G
Sbjct:   4 KLLRGTFVLTLGTYISRILGMVYLIPFSIMVG---ATGGALFQYGYNQYTLFLNIATMGF   60

Query:  84 PVAVAKQVSKYNTLGKEEMSIYLVRKILQFMLILGGIFALIMYIGSPLFASLSKGGQE--  141
             P AV+K VSKYN+ G  E S  +++   + ML+ G I   I+Y+ +P+FA +S GG++
Sbjct:  61 PAAVSKFVSKYNSKGDYETSRKMLKAGMSVMLVTGMIAFFILYLSAPMFAEISLGGKDNN  120
```

-continued

```
Query:  142 ------LVPILRSLTLAVLVFPSMSVLRGFFQGFNNLKPYAISQVAEQIIRVIWMLLTAF  195
                  +V ++R ++LA+LV P MS++RGFFQG   + P A+SQV EQI+R+I++L    F
Sbjct:  121 GLTIDHVVYVIRMVSLALLVVPIMSLVRGFFQGHQMMGPTAVSQVVEQIVRIIFLLSATF  180

Query:  196 YIMRLGSGDYIAAVTQSTFAAFVGMFASIAVLLYFLW--RYNMLSALIGKTPKHIKLDTK  253
                I+++ +G  +  AV  +TFAA +G F   + V+LY  W   R   L A++  T      L  K
Sbjct:  181 LILKVFNGGLVIAVGYATFAALIGAFGGL-VVLYIYWNKRKGSLLAMMPNTGPTANLSYK  239

Query:  254 EILIETIKEAIPFIITGAAIQIFKLIDQFSFGNTM--ALFTNYSSEELRVMFAYFSSNPG  311
                ++  E    A P++  G AI ++   ID +F    M  A       S + L ++   Y
Sbjct:  240 KMFFELFSYAAPYVFVGLAIPLYNYIDTNTFNKAMIEAGHQAISQDMLAILTLYVQ----  295

Query:  312 KVTMILIAVATAIAGVGIPLLTENFVKNDKKAAARLVVNNLQMLLMFLLPAVAGSVILAK  371
                K+  MI +++ATA       IP +TE+F   + K   + +     +Q  +L  ++PAV G   +L+
Sbjct:  296 KLVMIPVSLATAFGLTLIPTITESFTSGNYKLLNQQINQTMQTILFLIIPAVVGISLLSG  355

Query:  372 PLYTVFYGL----PQGQALGLFVISLIQTIILSIYTVLAPMLQALFENRKAIIYFLYGLV  427
                P YT  FYG     P+    A  L   S +   I+ S++TV A +LQ + + +  A++   + G+V
Sbjct:  356 PTYTFFYGSESLHPELGANILLWYSPV-AILFSLFTVNAAILQGINKQKFAVVSLVIGVV  414

Query:  428 AKVILQLPSIFLFHAYGPLFSTTVALCIPVILMYLKIHEITGFKRQAIRRTSALVLILTL  487
                 K++L +P I L   AG + +T +        ++ ++ I   G+ + + + +  L+L+L+
Sbjct:  415 IKLVLNVPLIKLMQADGAILATALGYIASLLYGFIMIKRHAGYSYKILVKRTVLMLVLSA  474

Query:  488 LMSFIISMIIWLMNLVI-VPDSRLVSLVYIIVIGAIGLGVYGFMALATHLLDKMIGSRAQ  546
                +M   + ++ W++    I    D ++ + + +++   A+G  VY +             L  K++G  R
Sbjct:  475 IMGIAVKIVQWVLGFFISYQDGQMQAAIVVVIAAAVGGAVYLYCGYRLGFLQKILGRRLP  534

Query:  547 DLRRK  551
                      RK
Sbjct:  535 GFFRK  539
```

A related DNA sequence was identified in *S. pyogenes* <SEQ ID 3681> which encodes the amino acid sequence <SEQ ID 3682>. Analysis of this protein sequence reveals the following:

Possible site: 49
>>> Seems to have no N-terminal signal sequence

| | | |
|---|---|---|
| INTEGRAL | Likelihood = −8.60 | Transmembrane 468-484 (466-493) |
| INTEGRAL | Likelihood = −8.39 | Transmembrane 305-321 (299-323) |
| INTEGRAL | Likelihood = −7.75 | Transmembrane 343-359 (340-362) |
| INTEGRAL | Likelihood = −6.58 | Transmembrane 374-390 (373-398) |
| INTEGRAL | Likelihood = −4.25 | Transmembrane 138-154 (137-157) |
| INTEGRAL | Likelihood = −3.45 | Transmembrane 100-116 (98-122) |
| INTEGRAL | Likelihood = −3.40 | Transmembrane 415-431 (410-432) |
| INTEGRAL | Likelihood = −3.35 | Transmembrane 499-515 (499-519) |
| INTEGRAL | Likelihood = −2.60 | Transmembrane 433-449 (432-451) |
| INTEGRAL | Likelihood = −2.50 | Transmembrane 173-189 (173-190) |
| INTEGRAL | Likelihood = −0.59 | Transmembrane 201-217 (201-220) |

----- Final Results -----
    bacterial membrane --- Certainty = 0.4439 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:AAC00276 GB:AF008220 YtgP [Bacillus subtilis]
Identities = 169/536 (31%), Positives = 295/536 (54%), Gaps = 24/536 (4%)
Query:   14 MVQGAAWSTAGNFISRLLGVLYIIPWYIWMGQYAIQANALFNMGYNVYAYFLLISTTGLN   73
                +++G    T G +ISR+LG++Y+IP+ I +G        ALF GYN Y  FL I+T G
Sbjct:    5 LLRGTFVLTLGTYISRILGMVYLIPFSIMVGA---TGGALFQYGYNQYTLFLNIATMGFP   61

Query:   74 VAIAKQVAKYNSMGQTEHSYQLIRSTLKLMLGLGLIFSAIMYLGSPLFASLS-GGDDT--  130
                 A++K V+KYNS G   E S +++++ + +ML   G+I   I+YL +P+FA +S GG D
Sbjct:   62 AAVSKFVSKYNSKGDYETSRKMLKAGMSVMLVTGMIAFFILYLSAPMFAEISLGGKDNNG  121

Query:  131 -----LVPIMHSLSLAVFIFPVMSVIRGIFQGHNNIKPYAVSQIAEQLIRVIWMLLTTFF  185
                     +V ++  +SLA+ + P+MS++RG FQGH   + P AVSQ+ EQ++R+I++L  TF
Sbjct:  122 LTIDHVVYVIRMVSLALLVVPIMSLVRGFFQGHQMMGPTAVSQVVEQIVRIIFLLSATFL  181

Query:  186 IMKLGSGDYASAVTQSTFAAFIGMVASMGVLGYYLW--KQGLLAAIFSKPDHTVSIDIKG  243
                I+K+ +G    AV +TFAA IG  + VL Y  W   ++G L A+      T ++  K
Sbjct:  182 ILKVFNGGLVIAVGYATFAALIGAFGGLVVL-YIYWNKRKGSLLAMMPNTGPTANLSYKK  240

Query:  244 LLLETLKESIPFIVTGSAIQAFQLIDQWTFVNTMTLFTDYSRSQ--LLVLFGYFNANPAK  301
                +  E    + P++  G AI +   ID  TF   M     + SQ  L +L Y       K
Sbjct:  241 MFFELFSYAAPYVFVGLAIPLYNYIDTNTFNKAMIEAGHQAISQDMLAILTLYVQ----K  296

Query:  302 ITMVLIAVAASIGGVGIALLTENYVKKDMKAAARLIINNIEMLVMFLLPALTGAIILARP  361
                 + M+ +++A  G   I  +TE++   + K   + +I ++ ++  ++PA+ G  +L+ P
Sbjct:  297 LVMIPVSLATAFGLTLIPTITESFTSGNYKLLNQQINQTMQTILFLIIPAVVGISLLSGP  356

Query:  362 LYSVFYGASE---ERAIHLFVAVLFQTLLLALYTLFSPMLQALFENRKAIYYFAYGILIK  418
                 Y+  FYG+      E    ++ +       +L  +L+T+ + +LQ + + +    A+      G++IK
Sbjct:  357 TYTFFYGSESLHPELGANILLWYSPVAILFSLFTVNAAILQGINKQKFAVVSLVIGVVIK  416
```

```
-continued
Query: 419  LVLQIPLIYLLHAYGPLLATTIALVVPIYLMYRRLYQVTHFNRKLLQKRLLLTLIETLLM  478
            LVL +PLI L+ A G +LAT +   +    +  + +   ++ K+L KR +L L+ + +M
Sbjct: 417  LVLNVPLIKLMQADGAILATALGYIASLLYGFIMIKRHAGYSYKILVKRTVLMLVLSAIM  476

Query: 479  GLVVFVANWLLGYAFK-PTGRLTSLLYLLIGGLGMTVYTALTLLTHQLDKLIGSK       533
            G+ V +  W+LG+         G++ + + ++I   +G VY           L K++G +
Sbjct: 477  GIAVKIVQWVLGFFISYQDGQMQAAIVVVIAAAVGGAVYLYCGYRLGFLQKILGRR      532
```

An alignment of the GAS and GBS proteins is shown below.

```
Identities = 320/541 (59%), Positives = 431/541 (79%)
Query:  12  MSQKTTKVSQQEQMVKGTAWLTAGNFISRLLGAIYIIPWYAWMGKHAAEANALFGMGYEI   71
            MS +  +++Q+E MV+G AW TAGNFISRLLG +YIIPWY WMG++A +ANALF MGY +
Sbjct:   1  MSTEKKQLTQEELMVQGAAWSTAGNFISRLLGVLYIIPWYIWMGQYAIQANALFNMGYNV   60

Query:  72  YALFLLISTVGIPVAVAKQVSKYNTLGKEEMSIYLVRKILQFMLILGGIFALIMYIGSPL  131
            YA FLLIST G+ VA+AKQV+KYN++G+ E S   L+R  L+ ML LG IF+ IMY+GSPL
Sbjct:  61  YAYFLLISTTGLNVAIAKQVAKYNSMGQTEHSYQLIRSTLKLMLGLGIFSAIMYLGSPL  120

Query: 132  FASLSKGGQELVPILRSLTLAVLVFPSMSVLRGFFQGFNNLKPYAISQVAEQIIRVIWML  191
            FASLS G    LVPI+  SL+LAV +FP MSV+RG FQG NN+KPYA SQ+AEQ+IRVIWML
Sbjct: 121  FASLSGGDDTLVPIMHSLSLAVFIFPVMSVIRGIFQGHNNIKPYAVSQIAEQLIRVIWML  180

Query: 192  LTAFYIMRLGSGDYIAAVTQSTFAAFVGMFASIAVLLYFLWRYNMLSALIGKTPKHIKLD  251
            LT F+IM+LGSGDY +AVTQSTFAAF+GM AS+ VL Y+LW+   +L+A+  K    + +D
Sbjct: 181  LTTFFIMKLGSGDYASAVTQSTFAAFIGMVASMGVLGYYLWKQGLLAAIFSKPDHTVSID  240

Query: 252  TKEILIETIKEAIPFIITGAAIQIFKLIDQFSFGNTMALFTNYSSEELRVMFAYFSSNPG  311
              K +L+ET+KE+IPFI+TG+AIQ F+LIDQ++F NTM LFT+YS  +L V+F YF++NP
Sbjct: 241  IKGLLLETLKESIPFIVTGSAIQAFQLIDQWTFVNTMTLFTDYSRSQLLVLFGYFNANPA  300

Query: 312  KVTMILIAVATAIAGVGIPLLTENFVKNDKKAAARLVVNNLQMLLMFLLPAVAGSVILAK  371
            K+TM+LIAVA +I GVGI LLTEN+VK D KAAARL++NN++ML+MFLLPA+ G++ILA+
Sbjct: 301  KITMVLIAVAASIGGVGIALLTENYVKKDMKAAARLIINNIEMLVMFLLPALTGAIILAR  360

Query: 372  PLYTVFYGLPQGQALGLFVISLIQTIILSIYTVLAPMLQALFENRKAIIYFLYGLVAKVI  431
            PLY+VFYG  + +A+ LFV  L QT+++L++YT+ +PMLQALFENRKAI YF YG++ K++
Sbjct: 361  PLYSVFYGASEERAIHLFVAVLFQTLLLALYTLFSPMLQALFENRKAIYYFAYGILIKLV  420

Query: 432  LQLPSIFLFHAYGPLFSTTVALCIPVILMYLKIHEITGFKRQAIRRTSALVLILTLLMSF  491
            LQ+P I+L  HAYGPL +TT+AL +P+  LMY +++++T F R+ +++    L LI TLLM
Sbjct: 421  LQIPLIYLLHAYGPLLATTIALVVPIYLMYRRLYQVTHFNRKLLQKRLLLTLIETLLMGL  480

Query: 492  IISMIIWLMNLVIVPDSRLVSLVYIIVIGAIGLGVYGFMALATHLLDKMIGSRAQDLRRKL  552
            ++ +   WL+      P   RL SL+Y+++IG +G+ VY  + L TH LDK+IGS+A  LR+KL
Sbjct: 481  VVFVANWLLGYAFKPTGRLTSLLYLLIIGGLGMTVYTALTLLTHQLDKLIGSKASRLRQKL  541
```

Based on this analysis, it was predicted that these proteins and their epitopes could be useful antigens for vaccines or diagnostics.

Example 1183

A DNA sequence (GBSx1259) was identified in *S. agalactiae* <SEQ ID 3683> which encodes the amino acid sequence <SEQ ID 3684>. Analysis of this protein sequence reveals the following:

Possible site: 40
>>> Seems to have no N-terminal signal sequence
----- Final Results -----
  bacterial cytoplasm --- Certainty = 0.4104 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:BAB06290 GB:AP001515 UDP-N-acetylmuramoylalanyl-D-glutamyl-2,
6-diaminopimelate ligase [Bacillus halodurans]
Identities = 153/468 (32%), Positives = 237/468 (49%), Gaps = 23/468 (4%)
Query:  33  NVTFNALSYDSRQISSDTLFFA-KGATFK-KEYLDSAITAGLSFYVSETDYGADIPVILV   90
            N    +++ DSR++   LFF  KG T     +Y  A++  G     VSE       +PV++V
Sbjct:  21  NPDIHSIHMDSREVVEGGLFFCIKGYTVDGHDYAQQAVSNGAVAVVSERPLELSVPVVVV   80

Query:  91  NDIKKAMSLISMSFYNNPQNKLKLLAFTGTKGKTTAAYFAYHMLKVNHR-PAMLSTMNTT  149
            D  ++AM+ ++  FY  P N L+L+   TGT GKTT  +     +++       +  TM T
Sbjct:  81  RDSRRAMAQVATKFYGEPTNDLQLIGVTGTNGKTTITHLIEKIMQDQGKMTGLIGTMYTK  140

Query: 150  LDGKSFFKSHLTTPESLDLFRMMATAVENQMTHLIMEVSSQAYLTKRVYGLTFDVGVFLN  209
              + G    ++  TTPESL  L R   A    ++ +T +MEVSS A   + RV G FDV VF N
Sbjct: 141  I-GHELKETKNTTPESLVLQRTFADMKKSGVTTAMMEVSSHALQSGRVRGCDFDVAVFSN  199
```

-continued

```
Query: 210  ISPDHIGPIEHPTFEDYFFHKRLLME------NSNAVVVN----SQMDHFNIVKEQVEYI  259
            ++PDH+     H  T  E  Y  F  K  LL              V+N     +  D    +    QV
Sbjct: 200  LTPDHLD--YHGTMERYKFAKGLLFAQLGNTYQGKVAVLNADDPASADFAEMTIAQVVTY  257

Query: 260  PHDFYGDY-SENVITESKAFSFHVKGKLEN-TYDIKLIGKFNQENAIAAGLACLRLGVSI  317
              +    D+ +ENV    S    +F +      E        I LIGKF+  N +AA  A      GV +
Sbjct: 258  GIENEADFQAENVRITSTGTTFELAAFEERMELSIHLIGKFSVYNVLAAAAAAYVSGVPL  317

Query: 318  EDIKNGIAQTT-VPGRMEVLTQTNGAKIFVDYAHNGDSLKKLLAVVEEHQKGDIILVLGA  376
            ++IK   + +    V GR  E  +         + VDYAH   DSL+ +L   V  E   KGD+ +V+G
Sbjct: 318  QEIKKSLEEVKGVAGRFETVKHDQPFTVIVDYAHTPDSLENVLKTVGELAKGDVRVVVGC  377

Query: 377  PGNKGQSRRKDFGDVINQHPNLQVILTADDPNFEDPLVISQEIASHINRPVTIII-DREE  435
             G++ +++R      ++        N  Q  I  T+D+P   E+P+  I  +++            ++I  DR+E
Sbjct: 378  GGDRDKTKRPVMAEIATTFAN-QAIFTSDNPRSEEPMDILRDMEQGAKGDSYLMIEDRKE  436

Query: 436  AIANASTLTNCKLDAIIIAGKGADAYQIIKGNRDNYSGDLEVAKKYLK             483
            AI    A    L       + D  I+IAGKG  + YQ    +        ++    D    VA++  +K
Sbjct: 437  AIFKAIELAK-EDDIIVIAGKGHETYQQFRDRTIDFD-DRIVAQQAIK             482
```

A related DNA sequence was identified in *S. pyogenes* <SEQ ID 3685> which encodes the amino acid sequence <SEQ ID 3686>. Analysis of this protein sequence reveals the following:

---

Possible site: 59
>>> Seems to have no N-terminal signal sequence
----- Final Results -----
bacterial cytoplasm --- Certainty = 0.4717 (Affirmative) <succ>
bacterial membrane --- Certainty = 0.0000 (Not Clear) <succ>
bacterial outside --- Certainty = 0.0000 (Not Clear) <succ>

---

An alignment of the GAS and GBS proteins is shown below.

Based on this analysis, it was predicted that these proteins and their epitopes could be useful antigens for vaccines or diagnostics.

Example 1184

A DNA sequence (GBSx1260) was identified in *S. agalactiae* <SEQ ID 3687> which encodes the amino acid sequence <SEQ ID 3688>. Analysis of this protein sequence reveals the following:

```
Identities = 350/482 (72%), Positives = 399/482 (82%), Gaps = 1/482 (0%)

Query:   1  MITIDKILEILKNDHNFREILFHEHYYYNWTQNVTFNALSYDSRQISSDTLFFAKGATFK   60
            MITI+++L+ILK DHNFRE+L   + Y+Y++ Q   +F   LSYDSRQ+     TLFFAKGATFK Sbjct:   1  MITIEQLLDILKKDHNFREVLDADGYHYHY-QGFSFERLSYDSRQVDGKTLFFAKGATFK   59

Query:  61  KEYLDSAITAGLSFYVSETDYGADIPVILVNDIKKAMSLISMSFYNNPQNKLKLLAFTGT  120
             +YL   AIT GL   Y+SE DY    IPV+LV DIKKAMSLI+M+FY NPQ KLKLLAFTGT
Sbjct:  60  ADYLKEAITNGLQLYISEVDYELGIPVVLVTDIKKAMSLIAMAFYGNPQEKLKLLAFTGT  119

Query: 121  KGKTTAAYFAYHMLKVNHRPAMLSTMNTTLDGKSFFKSHLTTPESLDLFRMMATAVENQM  180
            KGKTTAAYFAYHMLK +++PAM STMNTTLDGK+FFKS LTTPESLDLF MMA   V N M
Sbjct: 120  KGKTTAAYFAYHMLKESYKPAMFSTMNTTLDGKTFFKSQLTTPESLDLFAMMAECVTNGM  179

Query: 181  THLIMEVSSQAYLTKRVYGLTFDVGVFLNISPDHIGPIEHPTFEDYFFHKRLLMENSNAV  240
            THLIMEVSSQAYL   RVYGLTFDVGVFLNISPDHIGPIEHPTFEDYF+HKRLLMENS AV
Sbjct: 180  THLIMEVSSQAYLVDRVYGLTFDVGVFLNISPDHIGPIEHPTFEDYFYHKRLLMENSRAV  239

Query: 241  VVNSQMDHFNIVKEQVEYIPHDFYGDYSENVITESKAFSFHVKGKLENTYDIKLIGKFNQ  300
            V+NS MDHF+ + +QV     H FYG  S+N IT S+AFSF  KG+L    YDI+LIG FNQ
Sbjct: 240  VINSGMDHFSFLADQVADQEHVFYGPLSDNQITTSQAFSFEAKGQLAGHYDIQLIGHFNQ  299

Query: 301  ENAIAAGLACLRLGVSIEDIKNGIAQTTVPGRMEVLTQTNGAKIFVDYAHNGDSLKKLLA  360
            ENA+AAGLACLRLG S+ DI+ GIA+T VPGRMEVLT TN AK+FVDYAHNGDSL+KLL+
Sbjct: 300  ENAMAAGLACLRLGASLADIQKGIAKTRVPGRMEVLTMTNHAKVFVDYAHNGDSLEKLLS  359

Query: 361  VVEEHQKGDIILVLGAPGNKGQSRRKDFGDVINQHPNLQVILTADDPNFEDPLVISQEIA  420
            VVEEHQ G ++L+LGAPGNKG+SRR DFG VI+QHPNL VILTADDPNFEDP   IS+EIA
Sbjct: 360  VVEEHQTGKLMLILGAPGNKGESRRADFGRVIHQHPNLTVILTADDPNFEDPEDISKEIA  419

Query: 421  SHINRPVTIIIDRERAIANASTLTNCKL-                                 482
            DAIIIAGKGADAYQIIKGNRDNYSGDLEVAKKYL
            SHI RPV II DRE+AI   A +L      DA+IIAGKGADAYQI+KG +   Y+GDL +AK YL
Sbjct: 420  SHIARPVEIISDREQAIQKAMSLCQGAK-                                 481
            DAVITAGKGADAYQIVKGQQVAYAGDLAIAKHYL
```

```
Possible site: 29
>>> Seems to have no N-terminal signal sequence
----- Final Results -----
    bacterial cytoplasm --- Certainty = 0.1421 (Affirmative) <succ>
     bacterial membrane --- Certainty = 0.0000 (Not Clear) <succ>
       bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1185

A DNA sequence (GBSx1261) was identified in *S. agalactiae* <SEQ ID 3689> which encodes the amino acid sequence <SEQ ID 3690>. This protein is predicted to be FhuA (fepC). Analysis of this protein sequence reveals the following:

```
Possible site: 54
>>> Seems to have no N-terminal signal sequence
----- Final Results -----
    bacterial cytoplasm --- Certainty = 0.2785 (Affirmative) <succ>
     bacterial membrane --- Certainty = 0.0000 (Not Clear) <succ>
       bacterial outside --- Certainty = 0.0000 (Not Clear) <succ>
```

A related GBS nucleic acid sequence <SEQ ID 9975> which encodes amino acid sequence <SEQ ID 9976> was also identified.

The protein has homology with the following sequences in the GENPEPT database.

```
>GP:AAF98153 GB:AF251216 FhuC [Staphylococcus aureus]
Identities = 141/259 (54%), Positives = 193/259 (74%)
Query:    7 MSHIKAENIIVSYDQKEIINNLSLSILNQKITTIIGANGCGKSTLLKALTRIHKIKDGTI    66
            M+ +  + + + Y    IIN L + I + K+T+IIG NGCGKSTLLKAL+R+  +K+G +
Sbjct:    1 MNRLHGQQVKIGYGDNTIINKLDVEIPDGKVTSIIGPNGCGKSTLLKALSRLLAVKEGEV    60

Query:   67 TIDGHDIAHLPTKEIAKKIALLPQVLEATEGITVYELISYGRFPBQKYLGNLTNDDRSKI   126
            +DG +I    TKEIAKKIA+LPQ  E  +G+TV EL+SYGRFPHQK  G LT +D+ +I
Sbjct:   61 FLDGENIBTQSTKEIAKKIAILPQSPEVADGLTVGELVSYGRFPHQKGFGRLTAEDKKEI   120

Query:  127 HWAMEMTNVAQFANRDVDDLSGGQRQKVWIAMALAQDTDTIFLDEPTTYLDMNHQLEVLE   186
               WAME+T    F +R ++DLSGGQRQ+VWIAMALAQ TD IFLDEPTTYLD+ HQLE+LE
Sbjct:  121 DWAMEVTGTDTFRHRSINDLSGGQRQRVWIAMALAQRTDIIFLDEPTTYLDICHQLEILE   180

Query:  187 LLKELNDETQKTIIMVLHDLNLSARYSDYLVAMKTGKIIYEGSPSQIMTKDIIKDIFKID   246
            L++KLN E    TI+MVLHD+N + R+SD+L+AMK G II  GS    ++T++I++ +F ID
Sbjct:  181 LVQKLNQEQGCTIVMVLHDINQAIRFSDHLIAMKEGDIIATGSTEDVLTQEILEKVFNID   240

Query:  247 AHIIQDPISKQPVLLSYQL                                           265
            +  +DP +  +P+L++Y L
Sbjct:  241 VVLSKDPKTGKPLLVTYDL                                           259
```

A related DNA sequence was identified in *S. pyogenes* <SEQ ID 1929> which encodes the amino acid sequence <SEQ ID 1930>. Analysis of this protein sequence reveals the following:

```
Possible site: 48
>>> Seems to have no N-terminal signal sequence
----- Final Results -----
    bacterial cytoplasm --- Certainty = 0.2970 (Affirmative) <succ>
     bacterial membrane --- Certainty = 0.0000 (Not Clear) <succ>
       bacterial outside --- Certainty = 0.0000 (Not Clear) <succ>
```

An alignment of the GAS and GBS proteins is shown below.

```
Identities = 166/259 (64%), Positives = 208/259 (80%)
Query:    7 MSHIKAENIIVSYDQKEIINNLSLSILNQKITTIIGANGCGKSTLLKALTRIHKIKDGTI    66
            M+ I AE++ ++Y+Q+ II+ LS  I    KITTIIGANGCGKS+LLKALTR+   K G +
Sbjct:    1 MTTISAEDLTIAYEQRTIIDKLSFYIPEGKITTIIGANGCGKSSLLKALTRLLPPKQGVV    60

Query:   67 TIDGHDIAHLPTKEIAKEIALLPQVLEATEGITVYELISYGRFPHQKYLGNLTNDDRSKI   126
            ++G +IA L TKE+AKK +ALLPQV EAT  GITVYEL+SYGRFPHQ Y GNL+  D+  I
Sbjct:   61 YLNGQNIATLETKEVAKKLALLPQVQEATNGITVYELVSYGRFPHQSYFGNLSPADKKAI   120

Query:  127 HWAMEMTNVAQFANRDVDDLSGGQRQKVWIAMALAQDTDTIFLDEPTTYLDMNHQLEVLE   186
             HWAM+ TNV  +A++ VD  LSGGQRQ+VW+AMALAQ TDTIFLDEPTTYLD+NHQLE+LE
Sbjct:  121 HWAMQATNVMAYADQPVDALSGGQRQRVWLAMALAQGTDTIFLDEPTTYLDLNHQLEILE   180
```

-continued

```
Query:  187  LLKKLNDETQKTIIMVLHDLNLSARYSDYLVAMKTGKIIYEGSPSQIMTKDIIKDIFKID  246
             L+K LN +   KTI+MVLHDLNLSARYSD+L+AMK GKI Y G+ + +MT  II+DIF+I
Sbjct:  181  LVKSLNKDAGKTIVMVLNDLNLSARYSDHLIAMKHGKIHYTGTIADVMTSPIIQDIFQIK  240

Query:  247  AHIIQDPISKQPVLLSYQL                                          265
             ++ DPI   P++L+YQL
Sbjct:  241  PVLVDDPIHNCPIVLTYQL                                          259
```

Based on this analysis, it was predicted that these proteins and their epitopes could be useful antigens for vaccines or diagnostics.

Example 1186

A DNA sequence (GBSx1262) was identified in *S. agalactiae* <SEQ ID 3691> which encodes the amino acid sequence <SEQ ID 3692>. This protein is predicted to be ferrichrome ABC transporter. Analysis of this protein sequence reveals the following:

Possible site: 20
>>> Seems to have a cleavable N-term signal seq.
----- Final Results -----
   bacterial outside --- Certainty = 0.3000 (Affirmative) <succ>
   bacterial membrane --- Certainty = 0.0000 (Not Clear) <succ>
     bacterial cytoplasm --- Certainty = 0.0000 (Not Clear) <succ>

The protein has homology with the following sequences in the GENPEPT database.

```
>GP:BAB07609 GB:AP001520 ferrichrome ABC transporter
(ferrichrome-binding protein) [Bacillus halodurans]
Identities = 94/301 (31%), Positives = 177/301 (58%), Gaps = 11/301 (3%)
Query:    6  IIVLTLLTFFLV---SCGQQTKQESTKTTISK--MPKIEGFTYYGKIPENPKKVINFTYS   60
             +++LT+L F L+   +CG  T E        S+  M       E T     ++P NP++V+
Sbjct:    7  LLLLTMLLFALLVVAACGSNTDAEQADELESEDGMITYESETGPIEVPANPQRVV--ALG   64

Query:   61  YTGYLLKLGVNVSSYSLDLEKDSPVFGKQLKEAKKLTADDTEAIAAQKPDLIMVFDQDPN  120
             +TG +L L VNV        K++P + + L++   +++ ++ E I    PDLI+ +   N
Sbjct:   65  FTGNILALDVNVVGVDT-WSKNNPNYEQLLQDVTEVSEENLEQIMELDPDLIIAYSTVQN  123

Query:  121  INTLKKIAPTLVIKYGAQNYLDMMPALGKVFGKEKEANQWVSQWKTKTLAVKKDLHHILK  180
                L++IAPT++  Y   +YL+     +GK+  KE+EA WV  +K +      +++   +
Sbjct:  124  AEQLQEIAPTVLYTYNNLDYLEQHVEIGKLLNKEEEAQAWVDDFKARAEQAGEEIKEKIG  183

Query:  181  PNTTFTIMDFYDKNIYLYGNNFGRGGELIYDSLGYAAPEKVKKDVFKKGWFTVSQEAIGD  240
             + T ++++ ++  +Y++GNN+GRG E++Y ++  A   PE+V++      G++ +S EA+ +
Sbjct:  184  EDATVSVIETFEDQLYVFGNNWGRGTEILYQTMDLAMPERVEEMALADGYYALSFEALPE  243

Query:  241  YVGDYALVNINKTTKKAASSLKESDVWKNLPAVKKGHIIESNYDVFYFSDPLSLEAQLKSF  301
             + GDY +++ N    +A +S +E++  ++++PAV+ G + E+N     FYF+DPLSLE QL+  F
Sbjct:  244  FAGDYIILSKN---DEADNSFQETNTYQSIPAVQNGQVFEANAKEFYFNDPLSLELQLEFF  301
```

A related DNA sequence was identified in *S. pyogenes* <SEQ ID 3693> which encodes the amino acid sequence <SEQ ID 3694>. Analysis of this protein sequence reveals the following:

Possible site: 19
>>> May be a lipoprotein
----- Final Results -----
   bacterial membrane --- Certainty = 0.0000 (Not Clear) <succ>
     bacterial outside --- Certainty = 0.0000 (Not Clear) <succ>
       bacterial cytoplasm --- Certainty = 0.0000 (Not Clear) <succ>

The protein has homology with the following sequences in the databases:

```
>GP:BAB07609 GB:AP001520 ferrichrome ABC transporter
(ferrichrome-binding protein) [Bacillus halodurans]
Identities = 112/306 (36%), Positives = 178/306 (57%), Gaps = 3/306 (0%)
Query:    2  KKLTLLLTLCLTTITLIACGNQATNHSNTASKSLSPMPQIAGVTYYGDIPKQPKRVVSLA   61
             K L LL  L    + + ACG+          +S  M        T    ++P  P+RVV+L
Sbjct:    5  KHLLLLTMLLFALLVVAACGSNTDAEQADELESEDGMITYESETGPIEVPANPQRVVALG   64

Query:   62  STYTGYLKKLDMNLVGVTSYDKKNPILAKTVKKAKQVAATDLEAVTTLKPDLIVVGSTEE  121
                +TG +   LD+N+VGV ++  K NP   + ++    +V+  +LE +   L PDLI+   ST  +
Sbjct:   65  --FTGNILALDVNVVGVDTWSKNNPNYEQLLQDVTEVSEENLEQIMELDPDLIIAYSTVQ  122

Query:  122  NIKQLAEIAPVISIEYRKRDYLQVLSDFGRIFNKEDKAKKWLKDWKTKTAAYEKEVKAVT  181
```

```
                              -continued
              N +QL EIAP +    Y     DYL+    + G++ NKE++A+ W+ D+K +       +E+K
Sbjct:  123   NAEQLQEIAPTVLYTYNNLDYLEQHVEIGKLLNKEEEAQAWVDDFKARAEQAGEEIKEKI    182

Query:  182   GDKATFTIMGLYEKDVYLFGKDWGRGGEITHQAFHYDAPEKVKTEVFKQGYLSLSQEVLP    241
              G+ AT +++   +E  +Y+FG +WGRG EI++Q         PE+V+      GY +LS E LP
Sbjct:  183   GEDATVSVIETFEDQLYVFGNNWGRGTEILYQTMDLAMPERVEEMALADGYYALSFEALP    242

Query:  242   DYIGDYVVVAAEDDKTGSALYESKLWQSIPAVKKHHVIKVNANVFYFTDPLSLEYQLETL    301
              ++ GDY+++ +++D+   ++   E+  +QSIPAV+    V + NA  FYF DPLSLE QLE
Sbjct:  243   EFAGDYIIL-SKNDEADNSFQETNTYQSIPAVQNGQVFEANAKEFYFNDPLSLELQLEFF    301

Query:  302   REAILS                                                          307
              +E  LS
Sbjct:  302   KEHFLS                                                          307
```

An alignment of the GAS and GBS proteins is shown below.

```
Identities = 140/316 (44%), Positives = 212/316 (66%), Gaps = 12/316 (3%)
Query:    1   MKKIGIIV-LTLLTFFLVSCGQQTKQESTKTT--ISKMPKIEGFTYYGKIPENPKKVINF     57
              MKK+ +++  L L  T   L++CG Q     S    + +S MP+I G TYYG IP+ PK+V++
Sbjct:    1   MKKLTLLLTLCLTTITLIACGNQATNHSNTASKSLSPMPQIAGVTYYGDIPKQPKRVVSL    60

Query:   58   TYSYTGYLLKLGVN---VSSYSLDLEKDSPVFGKQLKEAKKLTADDTEAIAAQKPDLIMV    114
              +YTGYL  KL +N    V+SY       +K  +P+    K  +K+AK++  A D  EA+     KPDLI+V
Sbjct:   61   ASTYTGYLKKLDMNLVGVTSY----DKKNPILAKTVKKAKQVAATDLEAVTTLKPDLIVV    116

Query:  115   FDQDPNINTLKKIAPTLVIKYGAQNYLDMMPALGKVFGKEKEANQWVSQWKTKTLAVKKD    174
                + NI   L +IAP + I+Y  ++YL ++      G++F KE +A +W+    WKTKT A +K+
Sbjct:  117   GSTEENIKQLAEIAPVISIEYRKRDYLQVLSDFGRIFNKEDKAKKWLKDWKTKTAAYEKE    176

Query:  175   LHHILKPNTTFTIMDFYDKNIYLYGNNFGRGGELIYDSLGYAAPEKVKKDVFKKGWFTVS    234
              + +          TFTIM  Y+K++YL+G  ++GRGGE+I+ +    Y  APEKVK  +VFK+G+  ++S
Sbjct:  177   VKAVTGDKATFTIMGLYEKDVYLFGKDWGRGGEIIHQAFHYDAPEKVKTEVFKQGYLSLS    236

Query:  235   QEAIGDYVGDYALVNINKTTKKAASSLKESDVWKNLPAVKKGHIIESNYDVFYFSDPLSL    294
              QE + DY+GDY +V        K  S+L ES +W+++PAVKK H+I+ N  +VFYF+DPLSL
Sbjct:  237   QEVLPDYIGDYVVVAAE--DDKTGSALYESKLWQSIPAVKKHHVIKVNANVFYFTDPLSL    294

Query:  295   EAQLKSFTKAIKENTN                                                310
              E  QL++   +AI  +  N
Sbjct:  295   EYQLETLREAILSSEN                                                310
```

Based on this analysis, it was predicted that these proteins and their epitopes could be useful antigens for vaccines or diagnostics.

Example 1187

A DNA sequence (GBSx1263) was identified in S. agalactiae <SEQ ID 3695> which encodes the amino acid sequence <SEQ ID 3696>. Analysis of this protein sequence reveals the following:

Possible site: 26
>>> Seems to have no N-terminal signal sequence
----- Final Results -----
    bacterial cytoplasm --- Certainty = 0.3431 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1188

A DNA sequence (GBSx1264) was identified in S. agalactiae <SEQ ID 3697> which encodes the amino acid sequence <SEQ ID 3698>. This protein is predicted to be ferrichrome transport permease (permease). Analysis of this protein sequence reveals the following:

Possible site: 39
>>> May be a lipoprotein
INTEGRAL    Likelihood = −12.74   Transmembrane 129-145 (123-150)
INTEGRAL    Likelihood = −10.67   Transmembrane 248-264 (240-283)
INTEGRAL    Likelihood = −10.14   Transmembrane 205-221 (196-228)
INTEGRAL    Likelihood = −5.95    Transmembrane 319-335 (317-336)
INTEGRAL    Likelihood = −3.56    Transmembrane 73-89 (73-90)
INTEGRAL    Likelihood = −3.19    Transmembrane 288-304 (288-304)
INTEGRAL    Likelihood = −2.76    Transmembrane 266-282 (265-283)
INTEGRAL    Likelihood = −2.23    Transmembrane 103-119 (101-122)
INTEGRAL    Likelihood = −1.01    Transmembrane 158-174 (158-174)
----- Final Results -----
    bacterial membrane --- Certainty = 0.6095 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:AAF98154 GB:AF251216 FhuB [Staphylococcus aureus]
Identities = 116/313 (37%), Positives = 194/313 (61%), Gaps = 3/313 (0%)
Query:  26  ILFLIGCYASLRFGAINFKTSDLITVLKNPLKNSNAQDVIFDIRLPRIIAAILVGAAMSQ    85
            ++ LI + S   G    + S +I + N    ++  Q++I +IR+PR IAA++VG A++
Sbjct:  28  MILLITLFISTLIGDAKIQASTIIEAIFNYNPSNQQQNIINEIRIPRNIAAVIVGMALAV    87

Query:  86  AGAIMQGVTRNAIADPGLLGINAGAGLALVVAYAFLGSMHYSTILIVCLLGSVISCLLVF   145
            +GAI+QGVTRN +ADP L+G+N+GA  AL + YA L +  +  ++      LG+++   +V
Sbjct:  88  SGAIIQGVTRNGLADPALIGLNSGASFALALTYAVLPNTSFLILMFAGFLGAILGGAIVL   147

Query: 146  TLSYTKQKGYHQLRLILAGAMISTLFTSVGQVVTLYFKLNRTVIGWQAGGLSQINWKMLI   205
            +   +++ G++ +R+ILAGA +S + T++ Q + L F+LN+TV  W AGG+S    W  L
Sbjct: 148  MIGRSRRDGFNPMRIILAGAAVSAMLTALSQGIALAFRLNQTVTFWTAGGVSGTTWSHLK   207

Query: 206  IIAPIIILGLLISQLLAHQLTILSLNESVAKALGQKTQLMTAFLLLIVLFLSASSVALIG   265
                 P+I + L I   ++ QLTIL+L ES+AK LGQ     ++     L+I + L+   +VA+ G
Sbjct: 208  WAIPLIGIALFIILTISKQLTILNLGESLAKGLGQNVTMIRGICLIIAMILAGIAVAIAG   267

Query: 266  TVSFIGLIIPHFIKLFIPKDYRLLLPLIGFSGATFMIWVDLSSRIINPPSETSISSIISI   325
            V+F+GL++PH  +  I   DY  +LPL     G    ++    D+  +R +     E   +  +IIS
Sbjct: 268  QVAFVGLMVPHIARFLIGTDYAKILPLTALLGGILVLVADVIARYL---GEAPVGAIISF   324

Query: 326  VGLPCFLWLIRKG   338
            +G+P  FL+L++KG
Sbjct: 325  IGVPYFLYLVKKG   337
```

A related DNA sequence was identified in *S. pyogenes* <SEQ ID 3699> which encodes the amino acid sequence <SEQ ID 3700>. Analysis of this protein sequence reveals the following:

```
Possible site 54
>>> Seems to have no N-terminal signal sequence
INTEGRAL     Likelihood = -11.09  Transmembrane 256-272 (248-287)
INTEGRAL     Likelihood = -10.67  Transmembrane 26-42 (23-48)
INTEGRAL     Likelihood = -6.90   Transmembrane 137-153 (133-157)
INTEGRAL     Likelihood = -5.10   Transmembrane 167,-183 (166-187)
INTEGRAL     Likelihood = -4.57   Transmembrane 213-229 (210-232)
INTEGRAL     Likelihood = -2.02   Transmembrane 112-128 (110-131)
----- Final Results -----
  bacterial membrane --- Certainty = 0.5437 (Affirmative) <succ>
    bacterial outside --- Certainty = 0.0000 (Not Clear) <succ>
      bacterial cytoplasm --- Certainty = 0.0000 (Not Clear) <succ>
```

The protein has homology with the following sequences in the databases:

```
>GP:AAF98154 GB:AF251216 FhuB [Staphylococcus aureus]
Identities = 99/274 (36%), Positives = 159/274 (57%), Gaps = 1/274 (0%)

Query:  34  LSFSLCVAIYCHLRFGAVALSHQDLNSILFG-KQNGHKANVLLAIRLPRLFGATLTGSAL    92
            LS  L + ++      G   +   +   +F    +  + N++  IR+PR   A + G AL
Sbjct:  26  LSMILLITLFISTLIGDAKIQASTIIEAIFNYNPSNQQQNIINEIRIPRNIAAVIVGMAL    85

Query:  93  AVSGTIMQAITRNPIAEPGLLGINAGAGLALVLAYAFVPHLHYSLIILLSLLGSSLAATL   152
            AVSG I+Q +TRN +A+P L+G+N+GA  AL L YA +P+  + +++     LG+ L    +
Sbjct:  86  AVSGAIIQGVTRNGLADPALIGLNSGASFALALTYAVLPNTSFLILMFAGFLGAILGGAI   145

Query: 153  VFGLSYQSGKGYHQLRLVLAGAMVSILLSALGQGITNYYHLANAVIGWQAGGLVGVNWQM   212
            V +      G++ +R++LAGA VS +L+AL QGI   + L    V  W AGG+ G   W
Sbjct: 146  VLMIGRSRRDGFNPMRIILAGAAVSAMLTALSQGIALAFRLNQTVTFWTAGGVSGTTWSH   205

Query: 213  IGYIAPLIILSLCLAQLLSYHLTVLSLSESQAKALGQKTNLISAVFMILVLILSSAAVAI   272
            + + PLI ++L +    +S  LT+L+L ES AK LGQ   +I + +I+ +IL+    AVAI
Sbjct: 206  LKWAIPLIGIALFIILTISKQLTILNLGESLAKGLGQNVTMIRGICLIIAMILAGIAVAI   265

Query: 273  AGSISFIGLVIPHLMKHFTPHHYRYLLPLCAVSG   306
            AG ++F+GL++PH+  +     Y  +LPL A+ G
Sbjct: 266  AGQVAFVGLMVPHIARFLIGTDYAKILPLTALLG   299
```

An alignment of the GAS and GBS proteins is shown below.

```
Identities = 158/295 (53%), Positives = 214/295 (71%), Gaps = 1/295 (0%)
Query:    6 KKLVQKNKSNHFWLVFFITLILFLIGCYASLRFGAINFKTSDLITVLKNPLKNSNAQDVI   65
            KK     KS+ FWLVF +      + Y LRFGA+      DL ++L    +N + +V+
Sbjct:   16 KKTQIITKSHIFWLVFVLLSFSLCVAIYCHLRFGAVALSHQDLNSILFGK-QNGHKANVL   74

Query:   66 FDIRLPRIIAAILVGAAMSQAGAIMQGVTRNAIADPGLLGINAGAGLALVVAYAFLGSMH  125
            IRLPR+  A L G+A++ +G IMQ +TRN IA+PGLLGINAGAGLALV+AYAF+  +H
Sbjct:   75 LAIRLPRLFGATLTGSALAVSGTIMQAITRNPIAEPGLLGINAGAGLALVLAYAFVPHLH  134

Query:  126 YSTILIVCLLGSVISCLLVFTLSYTKQKGYHQLRLILAGAMISTLFTSVGQVVTLYFKLN  185
            YS I+++ LLGS ++ LVF LSY    KGYHQLRL+LAGAM+S L +++GQ +T Y+ L
Sbjct:  135 YSLIILLSLLGSSLAATLVFGLSYQSGKGYHQLRLVLAGAMVSILLSALGQGITNYYHLA  194

Query:  186 RTVIGWQAGGLSQINWKMLIIIAPIIILGLLISQLLAHQLTILSLNESVAKALGQKTQLM  245
                VIGWQAGGL  +NW+M+   IAP+IIL L ++QLL++  LT+LSL+ES AKALGQKT L+
Sbjct:  195 NAVIGWQAGGLVGVNWQMIGYIAPLIILSLCLAQLLSYHLTVLSLSESQAKALGQKTNLI  254

Query:  246 TAFLLLIVLFLSASSVALIGTVSFIGLIIPHFIKLFIPKDYRLLLPLIGFSGATF       300
            +A   +++VL LS+++VA+ G++SFIGL+IPH +K F P   YR LLPL   SGA+F
Sbjct:  255 SAVFMILVLILSSAAVAIAGSISFIGLVIPHLMKHFTPHHYRYLLPLCAVSGASF       309
```

Based on this analysis, it was predicted that these proteins and their epitopes could be useful antigens for vaccines or diagnostics.

Example 1189

A DNA sequence (GBSx1265) was identified in *S. agalactiae* <SEQ ID 3701> which encodes the amino acid sequence <SEQ ID 3702>. Analysis of this protein sequence reveals the following:

---
Possible site: 13
>>> Seems to have no N-terminal signal sequence
----- Final Results -----
  bacterial cytoplasm --- Certainty = 0.1492 (Affirmative) <succ>
    bacterial membrane --- Certainty = 0.0000 (Not Clear) <succ>
      bacterial outside --- Certainty = 0.0000 (Not Clear) c succ>
---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1190

A DNA sequence (GBSx1266) was identified in *S. agalactiae* <SEQ ID 3703> which encodes the amino acid sequence <SEQ ID 3704>. This protein is predicted to be ferrichrome transport permease (permease). Analysis of this protein sequence reveals the following:

---
Possible site: 30
>>> Seems to have a cleavable N-term signal seq.
INTEGRAL    Likelihood = −10.35   Transmembrane 282-298 (279-309)
INTEGRAL    Likelihood = −7.06    Transmembrane 120-136 (115-141)
INTEGRAL    Likelihood = −7.01    Transmembrane 62-78 (61-80)
INTEGRAL    Likelihood = −6.10    Transmembrane 250-266 (241-272)
INTEGRAL    Likelihood = −5.52    Transmembrane 196-212 (190-215)
INTEGRAL    Likelihood = −5.47    Transmembrane 155-171 (151-174)
INTEGRAL    Likelihood = −4.99    Transmembrane 304-320 (303-322)
INTEGRAL    Likelihood = −3.35    Transmembrane 91-107 (90-110)
----- Final Results -----
  bacterial membrane --- Certainty = 0.5140 (Affirmative) <succ>
    bacterial outside --- Certainty = 0.0000 (Not Clear) <succ>
      bacterial cytoplasm --- Certainty = 0.0000 (Not Clear) <succ>
---

The protein has homology with the following sequences in the GENPEPT database.

```
>GP:AAF98155 GB:AF251216 FhuG [Staphylococcus aureus]
Identities = 122/334 (36%), Positives = 208/334 (61%), Gaps = 3/334 (0%)
Query:    1 MIQKNKAPFVLISSVIILLLLILV---SISLGYANTSVIDVLKLISGKSDDAFLFIITNI   57
            MI  N     LI+ +  +LL L     SI+ G  N  V   K +G+ D     I+ +
Sbjct:    1 MISSNNKRRQLIALAVFSILLFLGCTWSITSGEYNIPVERFFKTLIGQGDAIDELILLDF   60

Query:   58 RLPRIIVCIFGGASLGIAGLLLQTLTKNPLADSGILGINAGAGLVIALTIGTFNVSNPTI  117
            RLPR+++ I   GA+L I+G ++Q++TKNP+A+ GILGINAG G  IAL I     ++
Sbjct:   61 RLPRMMITILAGAALSISGAIVQSVTKNPIAEPGILGINAGGGFAIALFIAIGKINADNF  120

Query:  118 LYFLPLFAMFGGLVTIFLIYLMSYRRNHNISPTRLIVTGIGISTIISGVMILIISQSNNQ  177
            +Y LPL ++ GG+ T  +I++ S+ +N     ++  +++  G+G+ T + G  I I+S+ +++
Sbjct:  121 VYVLPLISILGGITTALIIFISFNKNEGVTPASMVLIGVGLQTALYGGSITIMSKFDDK  180

Query:  178 KMDMIVEWLSGKITISSWTTIITFIPILILLWGLAYSRSRHLNIMNLNEQTALALGLHLK  237
            + D I  W +G I       W +I F+P ++++          +S  LNI++  +  A  LG+ L
Sbjct:  181 QSDFIAAWFAGNIWGDEWPFVIAFLPWVLIIIPYLLFKSNTLNIIHTGDNIARGLGVRLS  240
```

-continued
```
Query: 238  KERIYTLMLTSSLAAISVVLIGNITFIGLLAGHLSRRLLGNNHKIILPSCLLIGAIILLV   297
            +ER+    +    L++ +V + G+I+FIGL+  H+++R++G  H++ LP  +L+GA +L++
Sbjct: 241  RERLILFFIAVMLSSAAVAVAGSISFIGLMGPHIAKRIVGPRHQLFLPIAILVGACLLVI   300

Query: 298  SDTIGRLLLVGTGIPTGLVVSIIGAPYFLWLMTK                            331
            +DTIG+++L    G+P G+VV+IIGAPYFL+LM K
Sbjct: 301  ADTIGKIVLQPGGVPAGIVVAIIGAPYFLYLMYK                            334
```

A related DNA sequence was identified in *S. pyogenes* <SEQ ID 1939> which encodes the amino acid sequence <SEQ ID 1940>. Analysis of this protein sequence reveals the following:

Possible site: 37
>>> Seems to have no N-terminal signal sequence
| | | |
|---|---|---|
| INTEGRAL | Likelihood = −10.93 | Transmembrane 254-270 (252-284) |
| INTEGRAL | Likelihood = −10.46 | Transmembrane 294-310 (292-320) |
| INTEGRAL | Likelihood = −6.74 | Transmembrane 25-41 (18-43) |
| INTEGRAL | Likelihood = −6.26 | Transmembrane 103-119 (102-125) |
| INTEGRAL | Likelihood = −3.66 | Transmembrane 164-180 (164-186) |
| INTEGRAL | Likelihood = −3.03 | Transmembrane 209-225 (207-226) |
| INTEGRAL | Likelihood = −2.71 | Transmembrane 74-90 (74-91) |
| INTEGRAL | Likelihood = −2.13 | Transmembrane 326-342 (325-343) |
| INTEGRAL | Likelihood = −1.97 | Transmembrane 135-151 (135-151) |

----- Final Results -----
 bacterial membrane --- Certainty = 0.5373 (Affirmative) <succ>
 bacterial outside --- Certainty = 0.0000 (Not Clear) <succ>
 bacterial cytoplasm --- Certainty = 0.0000 (Not Clear) <succ>

An alignment of the GAS and GBS proteins is shown below.

There is also homology to SEQ ID 396.

Based on this analysis, it was predicted that these proteins and their epitopes could be useful antigens for vaccines or diagnostics.

Example 1191

A DNA sequence (GBSx1267) was identified in *S. agalactiae* <SEQ ID 3705> which encodes the amino acid sequence <SEQ ID 3706>. Analysis of this protein sequence reveals the following:

Possible site: 44
>>> Seems to have no N-terminal signal sequence
----- Final Results -----
 bacterial cytoplasm --- Certainty = 0.3785 (Affirmative) <succ>
 bacterial membrane --- Certainty = 0.0000 (Not Clear) <succ>
 bacterial outside --- Certainty = 0.0000 (Not Clear) <succ>

```
Identities = 153/322 (47%), Positives = 229/322 (70%), Gaps = 1/322 (0%)
Query:  11  LISSVIILLLLIL-VSISLGYANTSVIDVLKLISGKSDDAFLFIITNIRLPRIIVCIFGG   69
            L +S+I+LL+ ++ +++SLG ++ S +D++ +  GKS   A  FI+ NIRLPRI+     GG
Sbjct:  22  LYTSLILLLVSLMGLALSLGESHLSFLDLVHVFLGKSSHAISFIVINIRLPRILAACLGG   81

Query:  70  ASLGIAGLLLQTLTKNPLADSGILGINAGAGLVIALTIGTFNVSNPTILYFLPLFAMFGG  129
               SL  ++GLLLQ LT+NPLADSG+LGI  GAG+ +A+     +     I ++LPLFAM G
Sbjct:  82  GSLALSGLLLQRLTRNPLADSGVLGITIGAGISLAIVVSFSFFEQAHISHYLPLFAMLGA  141

Query: 130  LVTIFLIYLMSYRRNHNISPTRLIVTGIGISTIISGVMILIISQSNNQKMDMIVEWLSGK  189
            +VT F +Y +S +    I PTRLI+TG+  +T++S +M+ ++    N  K+D+++ WLSG+
Sbjct: 142  IVTTFSVYWLSLTKQGQIDPTRLILTGVAVTTMLSSLMVALVGHINRYKVDLVINWLSGQ  201

Query: 190  ITISSWTTIITFIPILILLWGLAYSRSRHLNIMNLNEQTALALGLHLKKERIYTLMLTSS  249
            +      W T+      P+L+      W L YS++  LNIM L + TA+ LGL L ++R     L+L +
Sbjct: 202  LIGDDWPTLSVIAPLLLCFWLLTYSQAHFLNIMGLADNTAIGLGLPLNRKRRLILVLAAG  261

Query: 250  LAAISVVLIGNITFIGLLAGHLSRRLLGNNHKIILPSCLLIGAIILLVSDTIGRLLLVGT  309
            L A+SV+L+GNI+FIGL+AGH S   L+G+NHKI +P  +LIG I+LLV+DT+GR+  LVG+
Sbjct: 262  LGALSVLLVGNISFIGLIAGHFSTYLVGSNHKITIPISILIGMILLLVADTVGRVYLVGS  321

Query: 310  GIPTGLVVSIIGAPYFLWLMTK                                        331
            I TG++VS+IGAPYFL+LM K
Sbjct: 322  NIQTGILVSLIGAPYFLYLMAK                                        343
```

The protein has homology with the following sequences in the GENPEPT database.

```
>GP:AAC05779 GB:AF051356 unknown [Streptococcus mutans]
Identities = 49/93 (52%), Positives = 63/93 (67%)
Query:   1  MILTFNPGKLERQEFFKELINYLWIHDDVTLRKIKSHFTDYSKIDRLLEEYINHGYILRQ   60
            MI  +N  KL RQ FF +LINYL IHDDVTLR+IK +F D    ++R +E+Y+  GY+LR+
Sbjct:   1  MIKIYNGDKLTRQPFFIKLINYLQIHDDVTLRQIKRNFADTEHLERSIEDYVQAGYVLRE   60

Query:  61  NKRYSLNLPFLSSLDGLVLDDLVFIDSDSQIYQ                              93
            NK Y      L +LDGL LD  +F+D  S IYQ
Sbjct:  61  NKHYYNAFELLENLDGLTLDSQIFVDDQSSIYQ                              93
```

A related DNA sequence was identified in *S. pyogenes* <SEQ ID 3707> which encodes the amino acid sequence <SEQ ID 3708>. Analysis of this protein sequence reveals the following:

```
Possible site: 54
>>> Seems to have no N-terminal signal sequence
----- Final Results -----
   bacterial cytoplasm --- Certainty = 0.3447 (Affirmative) <succ>
     bacterial membrane --- Certainty = 0.0000 (Not Clear) <succ>
       bacterial outside --- Certainty = 0.0000 (Not Clear) <succ>
```

An alignment of the GAS and GBS proteins is shown below.

```
Identities = 108/212 (50%), Positives = 143/212 (66%)
Query:   1  MILTFNPGKLERQEFFKELINYLWIHDDVTLRKIKSHFTDYSKIDRLLEEYINHGYILRQ   60
            MI  F+  KL RQ FF++LINYL  HD V LR+IK  F + + ID+ +E Y+  GYI R+
Sbjct:   1  MITVFHSDKLTRQPFFQDLINYLDQHDHVILREIKKAFPNVTGIDKAIESYVQAGYIRRE   60

Query:  61  NKRYSLNLPFLSSLDGLVLDDLVFIDSDSQIYQLLQKRKFVTNLDNPTNHLVFVEETDFE  120
            NKRY +NLP +SS  L LD ++F+D+ S +Y+ +     F T L N TN ++  E+T+
Sbjct:  61  NKRYGINLPLVSSDQQLALDTMLFVDTCSAMYENILAVVFETQLTNQTNRVMIKEKTNIT  120

Query: 121  RNTLTLSNYFYKLTNGYPLSREQKKLYQLLGDVNSEYALKYMSSFILKFLRKDSVKQKRT  180
            R+  LTL+NYFY+L  G    S EQ  LY LLGDVN EYALKYM++F+LKF RKD V QKR
Sbjct: 121  RDDLTLANYFYRLKRGEKPSAEQMDLYDLLGDVNQEYALKYMTTFLLKFTRKDFVMQKRP  180

Query: 181  VIFIQALELLGYISLNQDTTYRLNAKLDVEAL                             212
             IF++AL  LGY+  + TTY+L  LD E+L
Sbjct: 181  DIFVEALVTLGYLKQVEPTTYQLLMTLDKESL                             212
```

Based on this analysis, it was predicted that these proteins and their epitopes could be useful antigens for vaccines or diagnostics.

Example 1192

A DNA sequence (GBSx1268) was identified in *S. agalactiae* <SEQ ID 3709> which encodes the amino acid sequence <SEQ ID 3710>. Analysis of this protein sequence reveals the following:

```
Possible site: 24
>>> Seems to have no N-terminal signal sequence
----- Final Results -----
   bacterial cytoplasm --- Certainty = 0.0824 (Affirmative) <succ>
     bacterial membrane --- Certainty = 0.0000 (Not Clear) <succ>
       bacterial outside --- Certainty = 0.0000 (Not Clear) <succ>
```

The protein has homology with the following sequences in the GENPEPT database.

```
>GP:AAB39104 GB:U57759 intrageneric coaggregation-relevant adhesin
[Streptococcus gordonii]
Identities = 261/311 (83%), Positives = 283/311 (90%)
Query:   1  MSKILVFGHQNPDSDAIGSSVAFAYLAKEAWGLDTEAVALGTPNEETAYVLDYFGVQAPR   60
            MSKILVFGHQNPDSDAIGSS AFAYLA+EA+GLDTEAVALG PNEETA+VLDYFGV APR
Sbjct:   1  MSKILVFGHQNPDSDAIGSSYAFAYLAREAYGLDTEAVALGEPNEETAFVLDYFGVAAPR   60

Query:  61  VVESAKAEGVETVILTDHNEFQQSISDIKDVTVYGVVDHHRVANFETANPLYMRLEPVGS  120
            V+ SAKAEG E VILTDHNEFQQS++DI +V VYGVVDHHRVANFETANPLYMRLEPVGS
Sbjct:  61  VITSAKAEGAEQVILTDHNEFQQSVADIAEVEVYGVVDHHRVANFETANPLYMRLEPVGS  120

Query: 121  ASSIVYRMFKENGVSVPKELAGLLLSGLISDTLLLKSPTTHASDIPVAKELAELAGVNLE  180
            ASSIVYRMFKE+ V+V KE+AGL+LSGLISDTLLLKSPTTH +D  +A ELAELAGVNLE
Sbjct: 121  ASSIVYRMFKEHSVAVSKEIAGLMLSGLISDTLLLKSPTTHPTDKAIAPELAELAGVNLE  180

Query: 181  EYGLEMLKAGTNLSSKTAAELIDIDAKTFELNGEAVRVAQVNTVDINDILARQEEIEVAI  240
            EYGL MLKAGTNL+SK+A ELIDIDAKTFELNG  VRVAQVNTVDI ++L RQ EIE AI
```

```
                                -continued
Sbjct:  181  EYGLAMLKAGTNLASKSAEELIDIDAKTFELNGNNVRVAQVNTVDIAEVLERQAEIEAAI  240

Query:  241  QEAIVTEGYSDFVLMITDIVNSNSEILALGSNMAKVEAAFEFTLENNHAFLAGAVSRKKQ  300
             ++AI    GYSDFVLMITDI+NSNSEILA+GSNM KVEAAF F LENNHAFLAGAVSRKKQ
Sbjct:  241  EKAIADNGYSDFVLMITDIINSNSEILAIGSNMDKVEAAFNFVLENNHAFLAGAVSRKKQ  300

Query:  301  VVPQLTESYNA                                                  311
             VVPQLTES+NA
Sbjct:  301  VVPQLTESFNA                                                  311
```

A related DNA sequence was identified in *S. pyogenes* <SEQ ID 3711> which encodes the amino acid sequence <SEQ ID 3712>. Analysis of this protein sequence reveals the following:

---

Possible site: 52
>>> Seems to have no N-terminal signal sequence
INTEGRAL     Likelihood = −2.02    Transmembrane 141-157 (141-157)
----- Final Results -----
    bacterial membrane --- Certainty = 0.1808 (Affirmative) <succ>
        bacterial outside --- Certainty = 0.0000 (Not Clear) <succ>
            bacterial cytoplasm --- Certainty = 0.0000 (Not Clear) <succ>

---

A related sequence was also identified in GAS <SEQ ID 9103> which encodes the amino acid sequence <SEQ ID 9104>. Analysis of this protein sequence reveals the following:

---

Possible site: 50
>>> Seems to have no N-terminal signal sequence
INTEGRAL     Likelihood = −2.02    Transmembrane 139-155 (139-155)
----- Final Results -----
    bacterial membrane --- Certainty = 0.181 (Affirmative) <succ>
        bacterial outside --- Certainty = 0.000 (Not Clear) <succ>
            bacterial cytoplasm --- Certainty = 0.000 (Not Clear) <succ>

---

An alignment of the GAS and GBS proteins is shown below.

Based on this analysis, it was predicted that these proteins and their epitopes could be useful antigens for vaccines or diagnostics.

Example 1193

A DNA sequence (GBSx1269) was identified in *S. agalactiae* <SEQ ID 3713> which encodes the amino acid sequence <SEQ ID 3714>. Analysis of this protein sequence reveals the following:

---

Possible site: 20
>>> Seems to have no N-terminal signal sequence
----- Final Results -----
    bacterial cytoplasm --- Certainty = 0.2769 (Affirmative) <succ>
        bacterial membrane --- Certainty = 0.0000 (Not Clear) <succ>
            bacterial outside --- Certainty = 0.0000 (Not Clear) <succ>

---

The protein has homology with the following sequences in the GENPEPT database.

```
Identities = 253/311 (81%), Positives = 283/311 (90%)
Query:    1  MSKILVFGHQNPDSDAIGSSVAFAYLAKEAWGLDTFAVALGTPNEETAYVLDYFGVQAPR   60
             MSKILVFGHQNPD+DAI SS AF YL+++A+GLDTE VALGTPNEETA+ LDYFGV+APR
Sbjct:    3  MSKILVFGHQNPDTDAIASSYAFDYLSQKAFGLDTEVVALGTPNEETAFALDYFGVEAPR   62

Query:   61  VVESAKAEGVETVILTDHNEFQQSISDIKDVTVYGVVDHHRVANFETANPLYMRLEPVGS  120
             VVESAKA+G E VILTDHNEFQQSI+DI++V VYGVVDHHRVANFETANPLYMR+EPVGS
Sbjct:   63  VVESAKAQGSEQVILTDHNEFQQSIADIREVEVYGVVDHHRVANFETANPLYMRVEPVGS  122

Query:  121  ASSIVYRMFKENGVSVPKELAGLLLSGLISDTLLLKSPTTHASDIPVAKELAELAGVNLE  180
             ASSIVYRMFKENG+ VPK +AG+LLSGLISDTLLLKSPTTH SD  VA+ELAELA VNLE
Sbjct:  123  ASSIVYRMFKENGIEVPKAIAGMLLSGLISDTLLLKSPTTHVSDHLVAEELAELAEVNLE  182

Query:  181  EYGLEMLKAGTNLSSKTAAELIDIDAKTFELNGEAVRVAQVNTVDINDILARQEEIEVAI  240
             +YG+ +LKAGTNL+SK+  ELI IDAKTFELNG AVRVAQVNTVDI ++L RQE IE AI
Sbjct:  183  DYGMALLKAGTNLASKSEVELIGIDAKTFELNGNAVRVAQVNTVDIAEVLERQEAIEAAI  242

Query:  241  QEAIVTEGYSDFVLMITDIVNSNSEILALGSNMAKVEAAFEFTLENNHAFLAGAVSRKKQ  300
             ++A+   EGYSDFVLMITDIVNSNSEILA+G+NM KVEAAF FTL+NNHAFLAGAVSRKKQ
Sbjct:  243  KDAMAAEGYSDFVLMITDIVNSNSEILAIGANMDKVEAAFNFTLDNNHAFLAGAVSRKKQ  302

Query:  301  VVPQLTESYNA                                                  311
             VVPQLTES+ A
Sbjct:  303  VVPQLTESFGA                                                  313
```

```
>GP:AAC05773 GB:AF051356 pyruvate-formate lyase activating enzyme
[Streptococcus mutans]
Identities = 184/260 (70%), Positives = 217/260 (82%)
Query:   3 EIDYKKVTGMIHSTESFGSVDGPGIRFIIFMQGCKMRCQYCHNPDTWEMETNNSKERTVE    62
           ++DY+KVTG+++STESFGSVDGPGIRF++FMQGC+MRCQYCHNPDTW M+ + + ERT
Sbjct:   4 KVDYEKVTGLVNSTESFGSVDGPGIRFVVFMQGCQMRCQYCHNPDTWAMKNDRATERTAG   63

Query:  63 DVLKEALRYKHFWGKDGGITVSGGEAMLQIDFITALFIEAKKLGIHTTLDTCGFAYRATP  122
           DV KEALR+K FWG  GGITVSGGEA LQ+DF+ ALF  AK+ GIHTTLDTC   +R TP
Sbjct:  64 DVFKEALRFKDFWGDTGGITVSGGEATLQMDFLIALFSLAKEKGIHTTLDTCALTFRNTP  123

Query: 123 EYHAILEKLLDVTDLVLLDLKEIDSEQHKIVTRQSNKNILQFARYLSDRGTPVWIRHVLV  182
           +Y    EKL+ VTDLVLLD+KEI+ +QHKIVT  SNK IL  ARYLSD G PVWIRHVLV
Sbjct: 124 KYLEKYEKLMAVTDLVLLDIKEINPDQHKIVTGHSNKTILACARYLSDIGKPVWIRHVLV  183

Query: 183 PGLTDIDDHLKRLGEFVQTLDNVDKFEVLPYHTMGEFKWRELGIPYPLAGVKPPTPERVK  242
           PGLTD D+ L +LGE+V+TL NV +FE+LPYHTMGEFKWRELGIPYPL GVKPPTP+RV+
Sbjct: 184 PGLTDRDEDLIKLGEYVKTLKNVQRFEILPYHTMGEFKWRELGIPYPLEGVKPPTPDRVR  243

Query: 243 NAKDIMKTESYTEYLKRIQN                                         262
           NAK +M TE+Y EY KRI +
Sbjct: 244 NAKKLMHTETYEEYKKRINH                                         263
```

A related DNA sequence was identified in *S. pyogenes* <SEQ ID 3715> which encodes the amino acid sequence <SEQ ID 3716>. Analysis of this protein sequence reveals the following:

---

Possible site: 44
>>> Seems to have no N-terminal signal sequence
----- Final Results -----
    bacterial cytoplasm --- Certainty = 0.4614 (Affirmative) <succ>
    bacterial membrane --- Certainty = 0.0000 (Not Clear) <succ>
    bacterial outside --- Certainty = 0.0000 (Not Clear) <succ>

---

An alignment of the GAS and GBS proteins is shown below.

```
Identities = 223/260 (85%), Positives = 239/260 (91%)
Query:   1 MAEIDYKKVTGMIHSTESFGSVDGPGIRFIIFMQGCKMRCQYCHNPDTWEMETNNSKERT    60
           M E DY +VTGM+HSTESFGSVDGPGIRFIIF+QGCK+RCQYCHNPDTWEMETNNSK RT
Sbjct:  25 MTEKDYGQVTGMVHSTESFGSVDGPGIRFIIFLQGCKLACQYCHNPDTWEMETNNSKIRT   84

Query:  61 VEDVLKEALRYKHFWGKDGGITVSGGEAMLQIDFITALFIEAKKLGIHTTLDTCGFAYRA  120
           V DVLKEAL+YKHFWGK GGITVSGGEAMLQIDFITALFIEAKKLGIHTTLDTCGF YR
Sbjct:  85 VNDVLKEALQYKHFWGKKGGITVSGGEAMLQIDFITALFIEAKKLGIHTTLDTCGFTYRP  144

Query: 121 TPEYHAILEKLLDVTDLVLLDLKEIDSEQHKIVTRQSNKNILQFARYLSDRGTPVWIRHV  180
           TPEYH +L+ LL VTDL+LLDLKEID +QHKIVTRQ NKNILQFARYLSD+  PVWIRHV
Sbjct: 145 TPEYHQVLDNLLAVTDLILLDLKEIDEKQHKIVTRQPNKNILQFARYLSDKQIPVWIRHV  204

Query: 181 LVPGLTDIDDHLKRLGEFVQTLDNVDKFEVLPYHTMGEFKWRELGIPYPLAGVKPPTPER  240
           LVPGLTDIDDHL RLGEFV+TL NVDKFEVLPYHTMGEFKWRELGIPY L GVKPPT ER
Sbjct: 205 LVPGLTDIDDHLTRLGEFVKTLKNVDKFEVLPYHTMGEFKWRELGIPYQLEGVKPPTKER  264

Query: 241 VKNAKDIMKTESYTEYLKRI                                         260
           V+NAK++M+TESYTEY+ RI
Sbjct: 265 VQNAKNLMQTESYTEYMNRI                                         284
```

Based on this analysis, it was predicted that these proteins and their epitopes could be useful antigens for vaccines or diagnostics.

Example 1194

A DNA sequence (GBSx1270) was identified in *S. agalactiae* <SEQ ID 3717> which encodes the amino acid sequence <SEQ ID 3718>. Analysis of this protein sequence reveals the following:

---

Possible site: 28
>>> Seems to have a cleavable N-term signal seq.
INTEGRAL    Likelihood = −7.06    Transmembrane 105-121 (103-126)
INTEGRAL    Likelihood = −5.57    Transmembrane 137-153 (136-162)
----- Final Results -----
    bacterial membrane --- Certainty = 0.3824 (Affirmative) <succ>
    bacterial outside --- Certainty = 0.0000 (Not Clear) <succ>
    bacterial cytoplasm --- Certainty = 0.0000 (Not Clear) <succ>

---

The protein has homology with the following sequences in the GENPEPT database.

```
>GP:AAC05772 GB:AF051356 putative hemolysin [Streptococcus mutans]
Identities = 347/445 (77%), Positives = 406/445 (90%), Gaps = 1/445 (0%)
Query:   1  MQDPGSQSLLLQFVILLILTLFNAFFSASEMALVSLNRSKVEQKAEEGDKRYRRLLDVLE   60
            M+DPGSQSL+LQF++LLILTL NAFFSA+EMALVSLNR++VEQKAEEG+K+Y RLL VLE
Sbjct:   1  MEDPGSQSLILQFLLLLILTLCNAFFSATEMALVSLNRARVEQKAEEGEKKYIRLLKVLE   60

Query:  61  NPNNFLSTIQVGITFISLLQGASLSASLGHVISGWLGNSATARTAGSIIALIFLTYVSIV  120
            NPNNFLSTIQVGIT I+LL GASL+ SLG  I+ W GNSATARTAGS+I+L FLTY+SIV
Sbjct:  61  NPNNFLSTIQVGITLITLLSGASLADSLGREIAVWFGNSATARTAGSLISLAFLTYISIV  120

Query: 121  LGELYPKRIAMNLKDRLAIVSAPIIIFLGKIVSPFVWLLSASTNLLSRITPMTFDDADEK  180
            LGELYPKRIAMNLK+ LA++SAP+IIFLGK+VSPFVWLLS STNLLSR+TPMTFDDADEK
Sbjct: 121  LGELYPKRIAMNLKENLAVLSAPVIIFLGKVVSPFVWLLSVSTNLLSRLTPMTFDDADEK  180

Query: 181  MTRDEIEYMLTNSEETLEAEEIEMLQGIFSLDEMMAREVMVPRTDAFMIDINNDAQSNIE  240
            MTRDEIEYMLTNSEETL+A+EIEMLQG+FSLDE+MAREVMVPRTDAFM+DIN+D+   I+
Sbjct: 181  MTRDEIEYMLTNSEETLDADEIEMLQGVFSLDELMAREVMVPRTDAFMVDINDDSSDIIQ  240

Query: 241  GILSQNFSRVPVFDDDKDRVVGVLHTKRLLEAGFKTGFDTIDLRKILQEPLFVPETIFVD  300
             IL++ FSR+PV+DDDKD+++G++HTK LL AGFK GFD I+LR+ILQEPLFVPETI V+
Sbjct: 241  TILNERFSRIPVYDDDKDKIIGIIHTKNLLNAGFKEGFDHINLRRILQEPLFVPETIVVN  300

Query: 301  DLLKALRNTQNQMAILLDEYGGVAGLVTLEDLLEEIVGEIDDETDTAEQFVREIDENIYI  360
            DLL AL+NTQNQMAILLDEYGGVAGLVTLEDLLEEIVGEIDDETD    VREI +N YI
Sbjct: 301  DLLTALKNTQNQMAILLDEYGGVAGLVTLEDLLEEIVGEIDDETDKTAISVREIADNTYI  360

Query: 361  VLGTMTLNEFNDYFETELESDDVDTIAGYYLTGVGSIPNQEEKVAYEVDSKDKHITLIND  420
            VLGTMTLN+FN+YFET+LESD+VDTIAG+YLTGVG+IP+QEEK  +EV+S  KH+ LIND
Sbjct: 361  VLGTMTLNDFNEYFETDLESDNVDTIAGFYLTGVGTIPSQEEKEHFEVESNGKHLELIND  420

Query: 421  KVKDGRITKLKVLLSDIEQ-NIEKD                                    444
            KVKDGR+TKLK+L+S++E+   EKD
Sbjct: 421  KVKDGRVTKLKILVSEVEEKEDEKD                                    445
```

A related DNA sequence was identified in *S. pyogenes* <SEQ ID 3719> which encodes the amino acid sequence <SEQ ID 3720>. Analysis of this protein sequence reveals the following:

---

Possible site: 42
>>> Seems to have no N-terminal signal sequence
INTEGRAL    Likelihood = −8.76    Transmembrane 22-38    (16-47)
INTEGRAL    Likelihood = −5.57    Transmembrane 118-134  (117-138)
INTEGRAL    Likelihood = −3.19    Transmembrane 150-166  (149-169)
----- Final Results -----
  bacterial membrane --- Certainty = 0.4503 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP:AAC05772 GB:AF051356 putative hemolysin [Streptococcus mutans]
Identities = 343/443 (77%), Positives = 401/443 (90%)
Query:  14  MEDPVSQSLVIQFLLLVVLTLLNAFFSASEMALVSLNRSRVEQKAADGDKKYARLLRVLE   73
            MEDP SQSL++QFLLL++LTL NAFFSA+EMALVSLNR+RVEQKA +G+KKY RLL+VLE
Sbjct:   1  MEDPGSQSLILQFLLLLILTLCNAFFSATEMALVSLNRARVEQKAEEGEKKYIRLLKVLE   60

Query:  74  EPNHFLSTIQVGITFISLLSGASLSASLGKVISGWLGNSATARTAGTIISLVFLTYVSIV  133
            PN+FLSTIQVGIT I+LLSGASL+ SLG+ I+ W GNSATARTAG++ISL FLTY+SIV
Sbjct:  61  NPNNFLSTIQVGITLITLLSGASLADSLGREIAVWFGNSATARTAGSLISLAFLTYISIV  120

Query: 134  LGELYPKRIAMNLKDKLAIVSAPIIIGLGRLVSPFVWLLSASTNLLSRLTPMTFDDADEQ  193
            LGELYPKRIAMNLK+ LA++SAP+II LG++VSPFVWLLS STNLLSRLTPMTFDDADE+
Sbjct: 121  LGELYPKRIAMNLKENLAVLSAPVIIFLGKVVSPFVWLLSVSTNLLSRLTPMTEDDADEK  180

Query: 194  MTRDEIEYMLSKSEATLDAEEIEMLQGVFSLDEMMAREVMVPRTDAFMIDINDDPLENIQ  253
            MTRDEIEYML+ SE TLDA+EIEMLQGVFSLDE+MAREVMVPRTDAFM+DINDD  +IQ
Sbjct: 181  MTRDEIEYMLTNSEETLDADEIEMLQGVESLDELMAREVMVPRTDAFMVDINDDSSDIIQ  240

Query: 254  EILKQSFSRIPVYDVDKDKIIGLIHTKRLLESGFRQGFDQINMRKMLQEPLFVPETIFVD  313
             IL + FSRIPVYD DKDKIIG+IHTK LL +GF++GFD IN+R++LQEPLFVPETI V+
Sbjct: 241  TILNERFSRIPVYDDDKDKIIGIIHTKNLLNAGFKEGFDHINLRRILQEPLFVPETIVVN  300

Query: 314  DLLRQLRNTQNQMAILLDEYGGVAGLVTLEDLLEEIVGEIDDETDKAEQFVHEIGDNTYI  373
            DLL L+NTQNQMAILLDEYGGVAGLVTLEDLLEEIVGEIDDETDK     V EI DNTYI
Sbjct: 301  DLLTALKNTQNQMAILLDEYGGVAGLVTLEDLLEEIVGEIDDETDKTAISVREIADNTYI  360

Query: 374  VVGTMTLNEFNDYFDTELESDDVDTIAGFYLTGIGTIPSQEQKEAYEIDNKDKHLVLIND  433
            V+GTMTLN+FN+YF+T+LESD+VDTIAGFYLTG+GTIPSQE+KE +E+++  KHL LIND
Sbjct: 361  VLGTMTLNDFNEYFETDLESDNVDTIAGFYLTGVGTIPSQEEKEHFEVESNGKHLELIND  420
```

```
                                  -continued
Query:  434  KVKDGRITKLKLILSNIEQIIEE                                 456
             KVKDGR+TKLK+++S +E+   +E
Sbjct:  421  KVKDGRVTKLKILVSEVEEKEDE                                 443
```

An alignment of the GAS and GBS proteins is shown below.

```
Identities = 364/444 (81%), Positives = 417/444 (92%)
Query:    1  MQDPGSQSLLLQFVILLILTLFNAFFSASEMALVSLNRSKVEQKAEEGDKRYRRLLDVLE    60
             M+DP SQSL++QF++L++LTL NAFFSASEMALVSLNRS+VEQKA +GDK+Y RLL VLE
Sbjct:   14  MEDPVSQSLVIQPLLLVVLTLLNAFFSASEMALVSLNRSRVEQKAADGDKKYARLLRVLE    73

Query:   61  NPNNFLSTIQVGITFISLLQGASLSASLGHVISGWLGNSATARTAGSIIALIFLTYVSIV   120
              PN+FLSTIQVGITFISLL GASLSASLG VISGWLGNSATARTAG+II+L+FLTYVSIV
Sbjct:   74  EPNHFLSTIQVGITFISLLSGASLSASLGKVISGWLGNSATARTAGTIISLVFLTYVSIV   133

Query:  121  LGELYPKRIAMNLKDRLAIVSAPIIIFLGKIVSPFVWLLSASTNLLSRITPMTFDDADEK   180
             LGELYPKRIAMNLKD+LAIVSAPIII LG++VSPFVWLLSASTNLLSR+TPMTFDDADE+
Sbjct:  134  LGELYPKRIAMNLKDKLAIVSAPIIIGLGRLVSPFVWLLSASTNLLSRLTPMTFDDADEQ   193

Query:  181  MTRDEIEYMLTNSEETLEAEEIEMLQGIFSLDEMMAREVMVPRTDAFMIDINNDAQSNIE   240
             MTRDEIEYML+ SE TL+AEEIEMLQG+FSLDEMMAREVMVPRTDAFMIDIN+D    NI+
Sbjct:  194  MTRDEIEYMLSKSEATLDAEEIEMLQGVFSLDEMMAREVMVPRTDAFMIDINDDPLENIQ   253

Query:  241  GILSQNFSRVPVFDDDKDRVVGVLHTKRLLEAGFKTGFDTIDLRKILQEPLFVPETIFVD   300
              IL Q+FSR+PV+D DKD+++G++HTKRLLE+GF+ GFD I++RK+LQEPLFVPETIFVD
Sbjct:  254  EILKQSFSRIPVYDVDKDKIIGLIHTKRLLESGFRQGFDQINMRKMLQEPLFVPETIFVD   313

Query:  301  DLLKALRNTQNQMAILLDEYGGVAGLVTLEDLLEEIVGEIDDETDTAEQFVREIDENIYI   360
             DLL+ LRNTQNQMAILLDEYGGVAGLVTLEDLLEEIVGEIDDETD AEQFV EI +N YI
Sbjct:  314  DLLRQLRNTQNQMAILLDEYGGVAGLVTLEDLLEEIVGEIDDETDKAEQFVHEIGDNTYI   373

Query:  361  VLGTMTLNEFNDYFETELESDDVDTIAGYYLTGVGSIPNQEEKVAYEVDSKDKHITLIND   420
             V+GTMTLNEFNDYF+TELESDDVDTIAG+YLTG+G+IP+QE+K AYE+D+KDKH+ LIND
Sbjct:  374  VVGTMTLNEFNDYFDTELESDDVDTIAGFYLTGIGTIPSQEQKEAYEIDNKDKHLVLIND   433

Query:  421  KVKDGRITKLKVLLSDIEQNIEKD                                     444
             KVKDGRITKLK++LS+IEQ IE+D
Sbjct:  434  KVKDGRITKLKLILSNIEQIIEED                                     457
```

SEQ ID 3718 (GBS70d) was expressed in *E. coli* as a GST-fusion product. SDS-PAGE analysis of total cell extract is shown in FIG. 120 (lane 8-10; MW 65 kDa). It was also expressed in *E. coli* as a His-fusion product. SDS-PAGE analysis of total cell extract is shown in FIG. 120 (lane 11 & 12; MW 44 kDa) and in FIG. 179 (lane 5; MW 35 kDa).

GBS70d-His was purified as shown in FIG. 231, lane 9-10.

Based on this analysis, it was predicted that these proteins and their epitopes could be useful antigens for vaccines or diagnostics.

Example 1195

A DNA sequence (GBSx1271) was identified in *S. agalactiae* <SEQ ID 3721> which encodes the amino acid sequence <SEQ ID 3722>. Analysis of this protein sequence reveals the following:

Possible site: 46

>>> Seems to have no N-terminal signal sequence

----- Final Results ----- bacterial cytoplasm --- Certainty = 0.1212 (Affirmative) <succ> bacterial membrane --- Certainty = 0.0000 (Not Clear <succ> bacterial outside --- Certainty = 0.0000 (Not Clear) <succ>

The protein has homology with the following sequences in the GENPEPT database.

```
>GP:CAB84230 GB:AL162754 hypothetical protein NMA0960 [Neisseria
meningitidis Z2491]
Identities = 80/184 (43%), Positives = 119/184 (64%), Gaps = 3/184 (1%)
Query:    1  MIKRPIHLSHDFLAEVIDKEAITLDATMGNGNDTVFLAKSSK---KVYAFDIQEEAIAKT    57
             ++K  +  +H  L + + +    LD T GNG+DT+FLA+++     KV+AFDIQ +A+   T
Sbjct:    2  LLKNILPFAHCLLRQALPEGGNALDGTAGNGHDTLFLAQTAGIRGKVWAFDIQPQALNNT    61

Query:   58  KAKLTEQGISNAELILDGHENLEQYVHTPLRAAIFNLGYLPSADKTVITKPHTTIKAIKN   117
             + +L  E G SN   LILDGHENL+QY+    PL AAIFN G+LP  DK++  T+   T+I A+
Sbjct:   62  RCRLQEAGYSNVRLILDGHENLKQYIPKPLDAAIFNFGWLPGGDKSLITRIETSIAALSA   121

Query:  118  VLDILEVGGRLSLMVYYGHDGGKSEKDAVIAFVEQLPQNNFATMLYQPLNQVNTPPFLIM   177
              L +L+     G L  ++Y GH+  GK E +A+   + +  LPQ  FA + Y    N+ N+PP+L+
Sbjct:  122  ALSLLKENGMLIAVLYPGHENGKQEAEAIEQWAKNLPQEQFAVLRYSFTNRKNSPPYLLA   181
```

```
Query:  178  VEKL                                                    181
             EKL
Sbjct:  182  FEKL                                                    185
```

A related DNA sequence was identified in *S. pyogenes* <SEQ ID 3723> which encodes the amino acid sequence <SEQ ID 3724>. Analysis of this protein sequence reveals the following:

Possible site: 55
>>> Seems to have no N-terminal signal sequence
INTEGRAL    Likelihood = −1.44    Transmembrane 127-143 (123-143)
----- Final Results -----
    bacterial membrane --- Certainty = 0.1574 (Affirmative) <succ>
        bacterial outside --- Certainty = 0.0000 (Not Clear) <succ>
        bacterial cytoplasm --- Certainty = 0.0000 (Not Clear) <succ>

A related sequence was also identified in GAS <SEQ ID 9101> which encodes the amino acid sequence <SEQ ID 9102>. Analysis of this protein sequence reveals the following:

Possible site: 46
>>> Seems to have no N-terminal signal sequence
INTEGRAL    Likelihood = −1.44    Transmembrane 118-134 (114-134)
----- Final Results -----
    bacterial membrane --- Certainty = 0.157 (Affirmative) <succ>
        bacterial outside --- Certainty = 0.000 (Not Clear) <succ>
        bacterial cytoplasm --- Certainty = 0.000 (Not Clear) <succ>

An alignment of the GAS and GBS proteins is shown below.

```
Identities = 124/184 (67%), Positives = 156/184 (84%)
Query:    1  MIKRPIHLSHDFLAEVIDKEAITLDATMGNGNDTVFLAKSSKKVYAFDIQEEAIAKTKAK    60
             M+KRPIHLSHDFLAEV+DK ++ +DATMGNGNDT FLA+ +KKVYAFD+QE+AI KT  +
Sbjct:   10  MLKRPIHLSHDFLAEVVDKSSVVVDATMGNGNDTAFLAQLAKKVYAFDVQEQAIRKTSER   69

Query:   61  LTEQGISNAELILDGHENLEQYVHTPLRAAIFNLGYLPSADKTVITKPHTTIKAIKNVLD  120
             L + G+SNAELIL GHE ++QYV  P+RAAIFNLGYLPSADK++IT P+TT++A+  +L
Sbjct:   70  LAQLGLSNAELILAGHEAVDQYVTEPVRAAIFNLGYLPSADKSIITLPNTTLQALSKLLT  129

Query:  121  ILEVGGRLSLMVYYGHDGGKSEKDAVIAFVEQLPQNNFATMLYQPLNQVNTPPFLIMVEK  180
             +L VGGR+++MVYYGHDGG  EKDA++ FV+QL Q   + MLYQPLNQVNTPPFLIM+EK
Sbjct:  130  LLMVGGRIAIMVYYGHDGGSLEKDALLDFVKQLDQRKVSAMLYQPLNQVNTPPFLIMLEK  189

Query:  181  LQSY                                                         184
             L +
Sbjct:  190  LADF                                                         193
```

Based on this analysis, it was predicted that these proteins and their epitopes could be useful antigens for vaccines or diagnostics.

Example 1196

A DNA sequence (GBSx1272) was identified in *S. agalactiae* <SEQ ID 3725> which encodes the amino acid sequence <SEQ ID 3726>. Analysis of this protein sequence reveals the following:

Possible site: 51
>>> Seems to have no N-terminal signal sequence
----- Final Results -----
    bacterial cytoplasm --- Certainty = 0.1948 (Affirmative) <succ>
        bacterial membrane --- Certainty = 0.0000 (Not Clear) <succ>
        bacterial outside --- Certainty = 0.0000 (Not Clear) <succ>

The protein has homology with the following sequences in the GENPEPT database.

```
>GP:AAC00380 GB:AF008220 YtqA [Bacillus subtilis]
Identities = 161/302 (53%), Positives = 220/302 (72%), Gaps = 4/302 (1%)
Query:    2  KKRYRAINDYYRELFGEKIFKLPIDAGFDCPNRDGTVARGGCTFCTVSGSGDAIVAPEAP   61
             +KRY  +N + RE FG K+FK+ +D GFDCPNRDGTVA GGCTFC+ +GSGD
```

-continued
```
Sbjct:  13  EKRYHTLNYHLREHFGHKVFKVALDGGFDCPNRDGTVAHGGCTFCSAAGSGDFAGNRTDD   72

Query:  62  IREQFYKEIDEMHRKWPEVNKYLVYFQNFTNTHAKLEIIKERYEQAINEPGVIGINIGTR  121
            +  QF+    + MH KW +   KY+ YFQ FTNTHA +E+++E++E  +     V+GI+I TR
Sbjct:  73  LITQFHDIKNRMHEKWKD-GKYIAYFQAFTNTHAPVEVLREKFESVLALDDVVGISIATR  131

Query: 122  PDCLPDETIYYLAELSERMHVTLELGLQTTYEATSALINRAHSYDLYKKTVKRIRELAPK  181
            PDCLPD+ + YLAEL+ER ++ +ELGLQT +E T+ LINRAH ++ Y + V ++R+
Sbjct: 132  PDCLPDDVVDYLAELNERTYLWVELGLQTVHERTALLINRAHDFNCYVEGVNKLRKHG--  189

Query: 182  VEIVSHLINGLPGETHDMMVENVRRCVTDNDIQGIKLHLLHLMTNTRMQRDYHEGRLRLL  241
            + + SH+INGLP E  DMM+E  +  V D D+QGIK+HLLHL+   T M+   Y +G+L   L
Sbjct: 190  IRVCSHIINGLPLEDRDMMMETAK-AVADLDVQGIKIHLLHLLKGTPMVKQYEKGKLEFL  248

Query: 242  SQEDYISIICDQLEIIPKHIVIHRITGDAPRHMLIGPMWSLNKWEVLNAIDKEMEKRQSY  301
            SQ+DY+ ++CDQLEIIP   +++HRITGD P   ++IGPMWS+NKWEVL AI+KE+E R SY
Sbjct: 249  SQDDYVQLVCDQLEIIPPEMIVHRITGDGPIELMIGPMWSVNKWEVLGAINKELENRGSY  308

Query: 302  QG                                                           303
            QG
Sbjct: 309  QG                                                           310
```

A related DNA sequence was identified in *S. pyogenes* <SEQ ID 3727> which encodes the amino acid sequence <SEQ ID 3728>. Analysis of this protein sequence reveals the following:

Possible site: 57
>>> Seems to have no N-terminal signal sequence
----- Final Results -----
    bacterial cytoplasm --- Certainty = 0.2023 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below.

Based on this analysis, it was predicted that these proteins and their epitopes could be useful antigens for vaccines or diagnostics.

Example 1197

A DNA sequence (GBSx1273) was identified in *S. agalactiae* <SEQ ID 3729> which encodes the amino acid sequence <SEQ ID 3730>. Analysis of this protein sequence reveals the following:

Possible site: 24
>>> Seems to have an uncleavable N-term signal seq
INTEGRAL    Likelihood = −9.82    Transmembrane 10-26    (6-30)
INTEGRAL    Likelihood = −4.73    Transmembrane 93-109    (87-112)
INTEGRAL    Likelihood = −4.57    Transmembrane 163-179 (161-181)

```
Identities = 260/307 (84%), Positives = 290/307 (93%), Gaps = 1/307 (0%)
Query:   1  MKKRYRAINDYYRELFGEKIFKLPIDAGFDCPNRDGTVARGGCTFCTVSGSGDAIVAPEA   60
            MKKRY+ +N++YR+LFG K+FK+PIDAGFDCPNRDGTVA GGCTFCTVSGSGDAIVAP+A
Sbjct:   7  MKKRYQTLNEHYRQLFGAKMFKVPIDAGFDCPNRDGTVAHGGCTFCTVSGSGDAIVAPDA   66

Query:  61  PIREQFYKEIDFMHRKWPEVNKYLVYFQNFTNTHAKLEIIKERYEQAINEPGVIGINIGT  120
            PI+EQFYKEIDFMHRKWP+VN+YLVYFQNFTNTH   +++I++RYEQAINEPGV+GINIGT
Sbjct:  67  PIKEQFYKEIDFMHRKWPDVNRYLVYFQNFTNTHDTVDVIRDRYEQAINEPGVVGINIGT  126

Query: 121  RPDCLPDETIYYLAELSERMHVTLELGLQTTYEATSALINRAHSYDLYKKTVKRIRELAP  180
            RPDCLPD+TI YLAELSERMHVT+ELGLQTTYE  TS LINRAHSYDLYK+TV+R+R    P
Sbjct: 127  RPDCLPDDTIAYLAELSERMHVTVELGLQTTYEETSRLINRAHSYDLYKETVRRLRHY-P  185

Query: 181  KVEIVSHLINGLPGETHDMMVENVRRCVTDNDIQGIKLHLLHLMTNTRMQRDYHEGRLRL  240
             + IVSHLINGLP ETHDMM+ENVRRCVTDNDIQGIKLHLLHLMTNTRMQRDYHEGRL+L
Sbjct: 186  NINIVSHLINGLPKETHDMMLENVRRCVTDNDIQGIKLHLLHLMTNTRMQRDYHEGRLKL  245

Query: 241  LSQEDYISIICDQLEIIPKHIVIHRITGDAPRHMLIGPMWSLNKWEVLNAIDKEMEKRQS  300
            LSQ+DY+SIICDQLEIIPKHIVIHRITGDAPR MLIGPMWSLNKWEVLNAIDKEME+R S
Sbjct: 246  LSQKDYVSIICDQLEIIPKHIVIHRITGDAPRDMLIGPMWSLNKWEVLNAIDKEMERRGS  305

Query: 301  YQGCKAE                                                      307
            +QGCK +
Sbjct: 306  FQGCKVD                                                      312
```

```
INTEGRAL    Likelihood = −2.97    Transmembrane 189-205 (185-205)
INTEGRAL    Likelihood = −1.97    Transmembrane  58-74   (58-74)
INTEGRAL    Likelihood = −0.75    Transmembrane 130-146 (130-146)
----- Final Results -----
   bacterial membrane --- Certainty = 0.4927 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the GENPEPT database.

```
>GP:CAA79986 GB:Z21972 ORF2 [Bacillus megaterium]
Identities = 62/159 (38%), Positives = 92/159 (56%), Gaps = 3/159 (1%)
Query:   34  ISFDQTIQESVRGQLPNLSTRFFKLITVIGNTVSQIAIAIMSVTFCY--LKKWYPQARFI    91
             + FD+ +     V+G    L T    K  T IG+T S I ++++ + F Y  LK         F
Sbjct:   34  LKFDEDVISLVQGWESPLLTDIMKFFTYIGSTASLIILSLVILFFLYRILKHRLELVLFT    93

Query:   92  AVNAIISGICILSLKLIFQRVRPTLTHLVFAGGYSFPSGHSMGTFMIFGSIIILLQYYMP   151
             AV  + S +   L +KL FQR RP L    L+   GGYSFPSGH+M   F ++G +  LL  ++
Sbjct:   94  AV-MVGSPLLNLMVKLFFQRARPDLHRLIDIGGYSFPSGHAMNAFSLYGILTFLLWRHIT   152

Query:  152  KSIWKLLCQGTLGLLIFLIGLSRIYLGVHFPTDVLAGFI                       190
                 ++L       L+I  IG+SRIYLGVH+P+D++AG++
Sbjct:  153  ARWARILLILFSMLMILSIGISRIYLGVHYPSDIIAGYL                       191
```

A related DNA sequence was identified in *S. pyogenes* <SEQ ID 1851> which encodes the amino acid sequence <SEQ ID 1852>. Analysis of this protein sequence reveals the following:

```
Possible site: 15
>>> Seems to have an uncleavable N-term signal seq
INTEGRAL    Likelihood = −11.30   Transmembrane 154-170 (150-181)
INTEGRAL    Likelihood = −10.88   Transmembrane  65-81   (58-93)
INTEGRAL    Likelihood = −8.97    Transmembrane  10-26    (5-31)
INTEGRAL    Likelihood = −3.77    Transmembrane  86-102  (86-105)
INTEGRAL    Likelihood = −2.71    Transmembrane 185-201 (183-202)
INTEGRAL    Likelihood = −1.54    Transmembrane 130-146 (130-148)
----- Final Results -----
   bacterial membrane --- Certainty = 0.5522 (Affirmative) <succ>
      bacterial outside --- Certainty = 0.0000 (Not Clear) <succ>
         bacterial cytoplasm --- Certainty = 0.0000 (Not Clear) <succ>
```

An alignment of the GAS and GBS proteins is shown below.

Based on this analysis, it was predicted that these proteins and their epitopes could be useful antigens for vaccines or diagnostics.

Example 1198

A DNA sequence (GBSx1274) was identified in *S. agalactiae* <SEQ ID 3731> which encodes the amino acid sequence <SEQ ID 3732>. Analysis of this protein sequence reveals the following:

```
Possible site: 58
>>> Seems to have no N-terminal signal sequence
INTEGRAL    Likelihood = −8.44    Transmembrane  35-51   (33-59)
INTEGRAL    Likelihood = −6.53    Transmembrane 193-209 (179-211)
INTEGRAL    Likelihood = −4.46    Transmembrane  64-80   (60-82)
INTEGRAL    Likelihood = −4.09    Transmembrane 108-124 (103-128)
INTEGRAL    Likelihood = −2.71    Transmembrane 150-166 (148-166)
INTEGRAL    Likelihood = −0.06    Transmembrane 174-190 (174-190)
----- Final Results -----
   bacterial membrane --- Certainty = 0.4376 (Affirmative) <succ>
      bacterial outside --- Certainty = 0.0000 (Not Clear) <succ>
         bacterial cytoplasm --- Certainty = 0.0000 (Not Clear) <succ>
```

A related GBS nucleic acid sequence <SEQ ID 9977> which encodes amino acid sequence <SEQ ID 9978> was also identified.

The protein has homology with the following sequences in the GENPEPT database.

```
Identities = 88/197 (44%), Positives = 134/197 (67%), Gaps = 1/197 (0%)
Query:    1  MLSRQNSKLIQAFIAIILFFSLGLVIKYWPDTVISFDQTIQESVRGQLPNLSTRFFKLIT    60
             M  ++Q     LI +F A+++F  +G  +K++P+ +    D TIQ  +RG LP + T+FF+  +T
Sbjct:    2  MTNKQTHFLIASF-ALLIFVIIGYTVKFFPERLALLDNTIQAEIRGNLPIVLTQFFRGVT    60

Query:   61  VIGNTVSQIAIAIMSVTFCYLKKWYPQARFIAVNAIISGICILSLKLIFQRVRPTLTHLV   120
             V GN ++Q+ + I+SV  +     KW  +A FI   N  I+    I  +LKL +QR RP + HLV
Sbjct:   61  VFGNVMTQVLLVIVSVLVLFFMKWKIEALFILSNGAIAAFLITTLKLFYQRPRPAIEHLV   120

Query:  121  FAGGYSFPSGHSMGTFMIFGSIIILLQYYMPKSIWKLLCQGTLGLLIFLIGLSRIYLGVH   180
             +AGGYSFPSGH+MG+  +IFGS++I+     +  +  + +     +LI LIGLSRIYLGVH
Sbjct:  121  YAGGYSFPSGHAMGSMLIFGSLLIICYQRLHSKLLQFVTSMIFIILLILLIGLSRIYLGVH   180

Query:  181  FPTDVLAGFILAYGILN                                              197
             +P+D+LAGF+L  +GIL+
Sbjct:  181  YPSDILAGFVLGFGILH                                              197
```

```
>GP:AAC83944 GB:L47648 putative [Bacillus subtilis]
Identities = 53/186 (28%), Positives = 109/186 (58%)
Query:   33 RKMVTIAILSALSFVLMMVSFPLIPGAEFLKVDFSILPMLVAFILFDLKSSYGVLLLRSL   92
            +K+V +++LS+++FVLM+++FP     ++LK+DFS +P ++A +++   +  V  ++++
Sbjct:    4 KKLVVVSMLSSIAFVLMLLNFPFPGLPDYLKIDFSDVPAIIAILIYGPLAGIAVEAIKNV  63

Query:   93 LKVILANRGPETFIGLPMNMVALALFLASFAIFWKNRESAKDFIKASLFGTVSLTVSMVA  152
            L+ I+          +G   N +A LF+    A  +K   SAK     + L GT ++T+ M
Sbjct:   64 LQYIIQGSMAGVPVGQVANFIAGTLFILPTAFLFKKLNSAKGLAVSLLLGTAAMTILMSI 123

Query:  153 LNYVFAIPLYAIFANFDIRTFIGVGNYLLTMVIPFNIVEGILISIVFYLTYVACLPILER  212
            LNYV +P Y  F +    +    ++  ++PFN+++GI+I++VF L ++     P +E+
Sbjct:  124 LNYVLILPAYTWFLHSPALSDSALKTAVVAGILPFNMIKGIVITVVFSLIFIKLKPWIEQ 183

Query:  213 YKKTNV                                                        218
             + ++
Sbjct:  184 QRSAHI                                                        189
```

A related DNA sequence was identified in *S. pyogenes* <SEQ ID 3733> which encodes the amino acid sequence <SEQ ID 3734>. Analysis of this protein sequence reveals the following:

```
Possible site: 26
>>> Seems to have a cleavable N-term signal seq.
INTEGRAL    Likelihood = −6.48   Transmembrane  82-98   (74-100)
INTEGRAL    Likelihood = −3.93   Transmembrane 161-177 (152-178)
INTEGRAL    Likelihood = −3.61   Transmembrane 108-124 (107-126)
INTEGRAL    Likelihood = −3.61   Transmembrane  33-49   (31-50)
----- Final Results -----
    bacterial membrane --- Certainty = 0.3590 (Affirmative) <succ>
      bacterial outside --- Certainty = 0.0000 (Not Clear) <succ>
      bacterial cytoplasm --- Certainty = 0.0000 (Not Clear) <succ>
```

The protein has homology with the following sequences in the databases:

```
>GP:AAC83944 GB:L47648 putative [Bacillus subtilis]
Identities = 46/182 (25%), Positives = 97/182 (53%)
Query:    3 KTHKMIMIGILSAISFLLMLVSFAIIPGAAFLKIEFSIIPVLFGLMIMDLKSAYLILLLR   62
            K  K++++ +LS+I+F+LML++F     +LKI+FS +P +  ++I     +    +  ++
Sbjct:    2 KVKKLVVVSMLSSIAFVLMLLNFPFPGLPDYLKIDFSDVPAIIAILIYGPLAGIAVEAIK  61

Query:   63 SLLKLFLNNRGVNDFIGLPMNIIAIALFVTAFALVWNRQKTLSQYVFASLLGTGLLTFGM  122
            ++L+  +          +G   N  IA LF+    A ++ +     +   +  LLGT  +T  M
Sbjct:   62 NVLQYIIQGSMAGVPVGQVANFIAGTLFILPTAFLFKKLNSAKGLAVSLLLGTAAMTILM 121

Query:  123 VVLNYTFAIPLYAIFANIDIRAYIGVTKYMMTMVIPFNLVEGLIFAITFYFVYIASKPIL  182
            +LNY +P Y  F +    +    ++  ++PFN+++G++     +  F ++I   KP +
Sbjct:  122 SILNYVLILPAYTWFLHSPALSDSALKTAVVAGILPFNMIKGIVITVVFSLIFIKLKPWI 181

Query:  183 ER                                                          184
            E+
Sbjct:  182 EQ                                                          183
```

An alignment of the GAS and GBS proteins is shown below.

```
Identities = 110/185 (59%), Positives = 144/185 (77%)
Query:   29 MTNTRKMVTIAILSALSFVLMMVSFPLIPGAEFLKVDFSILPMLVAFILFDLKSSYGVLL   88
            M+  T KM+ I ILSA+SF+LM+VSF +IPGA FLK++FSI+P+L   ++ DLKS+Y +LL
Sbjct:    1 MSKTHKMIMIGILSAISFLLMLVSFAIIPGAAFLKIEFSIIPVLFGLMIMDLKSAYLILL  60

Query:   89 LRSLLKVILANRGPETFIGLPMNMVALALFLASFAIFWKNRESAKDFIKASLFGTVSLTV  148
            LRSLLK+ L NRG    FIGLPMN++A+ALF+ +FA+ W  +++    ++ ASL GT  LT
Sbjct:   61 LRSLLKLFLNNRGVNDFIGLPMNIIAIALFVTAFALVWNRQKTLSQYVFASLLGTGLLTF 120

Query:  149 SMVALNYVFAIPLYAIFANFDIRTFIGVGNYLLTMVIPFNIVEGILISIVFYLTYVACLP  208
               MV LNY FAIPLYAIFAN DIR +IGV  Y++TMVIPFN+VEG++   +I FY  Y+A  P
Sbjct:  121 GMVVLNYTFAIPLYAIFANIDIRAYIGVTKYMMTMVIPFNLVEGLIFAITFYFVYIASKP 180
```

```
Query: 209  ILERY   213
            ILERY
Sbjct: 181  ILERY   185
```

Based on this analysis, it was predicted that these proteins and their epitopes could be useful antigens for vaccines or diagnostics.

Example 1199

A DNA sequence (GBSx1275) was identified in *S. agalactiae* <SEQ ID 3735> which encodes the amino acid sequence <SEQ ID 3736>. Analysis of this protein sequence reveals the following:

---

Possible site: 31
>>> Seems to have a cleavable N-term signal seq.
INTEGRAL    Likelihood = −11.04   Transmembrane 278-294 (270-298)
----- Final Results -----
   bacterial membrane --- Certainty = 0.5416 (Affirmative) <succ>
     bacterial outside --- Certainty = 0.0000 (Not Clear) <succ>
       bacterial cytoplasm --- Certainty = 0.0000 (Not Clear) <succ>

---

The protein has no significant homology with any sequences in the GENPEPT database.

No corresponding DNA sequence was identified in *S. pyogenes*.

SEQ ID 3736 (GBS150) was expressed in *E. coli* as a His-fusion product. SDS-PAGE analysis of total cell extract is shown in FIG. 23 (lane 7; MW 29.7 kDa) and in FIG. 175 (lane 4 & 5; MW 30 kDa).

Figure 110C:
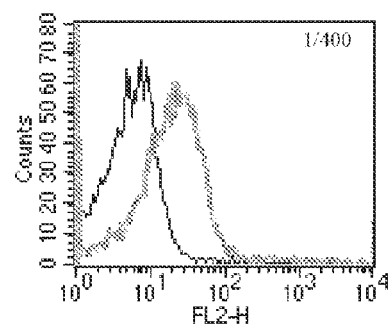
Figure 227:
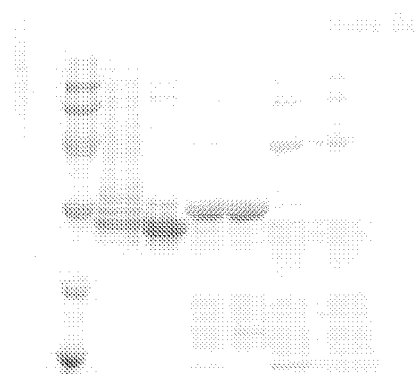

Purified GBS150-His is shown in FIG. 110A, FIG. 199 (lane 5) and FIG. 227 (lanes 6-7).

The purified GBS150-His fusion product was used to immunise mice (lane 1+2 product; 20 µg/mouse). The resulting antiserum was used for Western blot (FIG. 110B), FACS (FIG. 110C), and in the in vivo passive protection assay (Table III). These tests confirm that the protein is immunoaccessible on GBS bacteria and that it is an effective protective immunogen.

Based on this analysis, it was predicted that this protein and its epitopes, could be useful antigens for vaccines or diagnostics.

Example 1200

A DNA sequence (GBSx1276) was identified in *S. agalactiae* <SEQ ID 3737> which encodes the amino acid sequence <SEQ ID 3738>. This protein is predicted to be a fimbria-associated protein. Analysis of this protein sequence reveals the following:

---

Possible site: 40
>>> Seems to have an uncleavable N-term signal seq
INTEGRAL    Likelihood = −15.34   Transmembrane 264-280 (257-285)
INTEGRAL    Likelihood = −7.64    Transmembrane  23-39  (12-41)
----- Final Results -----
   bacterial membrane --- Certainty = 0.7135 (Affirmative) <succ>
     bacterial outside --- Certainty = 0.0000 (Not Clear) <succ>
       bacterial cytoplasm --- Certainty = 0.0000 (Not Clear) <succ>

---

The protein has homology with the following sequences in the GENPEPT database.

```
>GP:AAC13546 GB:AF019629 putative fimbria-associated protein
[Actinomyces naeslundii]
Identities = 95/271 (35%), Positives = 139/271 (51%), Gaps = 16/271 (5%)
Query:  29  VGLLITSYPFISNWYYNIKANNQVTNFDNQTQKLNTKEINRRFELAKAYNRTLDPSRLSD   88
            +GLL +YP ++W     +   ++ Q       +  + E A AYN  L     + +
Sbjct:   1  MGLL--TYPTAASWVSQYNQSKVTADYSAQVDGARP-DAKTQVEQAHAYNDALSAGAVLE   57

Query:  89  PYTE------KEKKGIAEYAHMLEIAE--MIGYIDIPSIKQKLPIYAGTTSSVLEKGAGH  140
                      K    +YA++L+      ++  + IPSI    LP+Y GT     L KG GH
Sbjct:  58  ANNHVPTGAGSSKDSSLQYANILKANNEGLMARLKIPSISLDLPVYHGTADDTLLKGLGH  117

Query: 141  LEGTSLPIGGKSSHTVITAHRGLPKAKLFTDLDKLKKGKIFYIHNIKEVLAYKVDQISVV  200
            LEGTSLP+GG+ +  +VIT HRGL +A +FT+LDK+K  G         EVL Y+V    VV
Sbjct: 118  LEGTSLPVGGEGTRSVITGHRGLAEATMFTNLDKVKTGDSLIVEVFGEVLTYRVTSTKVV  177

Query: 201  KPDNFSKLLVVKGKDYATLLTCTPYSINSHRLLVRGHRIKYVPPVKEKNYLMKELQTHYK  260
            +P+      L V +GKD  TL+TCTP  IN+HR+L+ G RI  Y  P K+       K     +
Sbjct: 178  EPEETEALRVEEGKDLLTLVTCTPLGINTHRILLTGERI-YPTPAKDLAAAGKRPDVPHF  236

Query: 261  LYFLLSILVILILVALLL----YLKRKFKER                              287
            ++  + +   LI+V L L      Y   + KER
Sbjct: 237  PWWAVGLAAGLIVVGLYLWRSGYAAARAKER                              267
```

A related DNA sequence was identified in *S. pyogenes* <SEQ ID 3739> which encodes the amino acid sequence <SEQ ID 3740>. Analysis of this protein sequence reveals the following:

---

Possible site: 49
>>> Seems to have no N-terminal signal sequence
INTEGRAL    Likelihood = −14.01   Transmembrane 225-241 (220-248)
----- Final Results -----
   bacterial membrane --- Certainty = 0.6604 (Affirmative) <succ>
     bacterial outside --- Certainty = 0.0000 (Not Clear) <succ>
       bacterial cytoplasm --- Certainty = 0.0000 (Not Clear) <succ>

---

The protein has homology with the following sequences in the databases:

```
>GP:AAC13546 GB:AF019629 putative fimbria-associated protein
[Actinomyces naeslundii]
Identities = 94/250 (37%), Positives = 133/250 (52%), Gaps = 17/250 (6%)
Query:   1  VECYRDRQLLSTYHKQVTQKKPSEMEEVWQKAKAYNARLGIQPVPDAF--------SFRD    52
            V Y    ++ + Y  QV   +P    +V ++A AYN   L    V +A          S +D
Sbjct:  13  VSQYNQSKVTADYSAQVDGARPDAKTQV-EQAHAYNDALSAGAVLEANNHVPTGAGSSKD    71

Query:  53  GIHDKNYESLLQIENNDIMGYVEVPSIKVTLPIYHYTTDEVLTKGAGHLFGSALPVGGDG   112
                  Y  ++L+   N  +M   +++PSI +  LP+YH  T D+ L  KG GHL G++LPVGG+G
Sbjct:  72  S--SLQYANILKANNEGLMARLKIPSISLDLPVYHGTADDTLLKGLGHLEGTSLPVGGEG   129

Query: 113  THTVISAHRGLPSAEMFTNLNLVKKGDTFYFRVLNKVLAYKVDQILTVEPDQVTSLSGVM   172
            T +VI+  HRGL  A  MFTNL+ VK  GD+     V +VL Y+V      VEP++   +L
Sbjct: 130  TRSVITGHRGLAEATMFTNLDKVKTGDSLIVEVFGEVLTYRVTSTKVVEPEETEALRVEE   189

Query: 173  GKDYATLVTCTPYGVNTKRLLVRGHRIAYHYKKYQQAKKAMKLVDKSRMWAEVVCAAFGV   232
            GKD   TLVTCTP G+NT R+L+ G RI        Y   K +      K         A G+
Sbjct: 190  GKDLLTLVTCTPLGINTHRILLTGERI------YPTPAKDLAAAGKRPDVPHFPWWAVGL   243

Query: 233  VIAIILVFMY                                                    242
                 +I+V +Y
Sbjct: 244  AAGLIVVGLY                                                    253
```

An alignment of the GAS and GBS proteins is shown below.

```
Identities = 93/192 (48%), Positives = 130/192 (67%), Gaps = 2/192 (1%)
Query:  52  VTNFDNQTQKLNTKEINRRFELAKAYNRTLDPSRLSDPYTEKEKKGIAEYAHMLEIA--E   109
            ++ +  Q   +       E+   ++ AKAYN  L    + D ++ ++           Y  +L+I    +
Sbjct:  10  LSTYHKQVTQKKPSEMEEVWQKAKAYNARLGIQPVPDAFSFRDGIHDKNYESLLQIENND    69

Query: 110  MIGYIDIPSIKQKLPIYAGTTSSVLEKGAGHLEGTSLPIGGKSSHTVITAHRGLPKAKLF   169
            ++GY+++PSIK  LPIY  TT   VL KGAGHL G++LP+GG   +HTVI+AHRGLP A++F
Sbjct:  70  IMGYVEVPSIKVTLPIYHYTTDEVLTKGAGHLFGSALPVGGDGTHTVISAHRGLPSAEMF   129

Query: 170  TDLDKLKKGKIFYIHNIKEVLAYKVDQISVVKPDNFSKLLVVKGKDYATLLTCTPYSINS   229
            T+L+ +KKG  FY  + +VLAYKVDQI V+PD + L V GKDYATL+TCTPY +N+
Sbjct: 130  TNLNLVKKGDTFYFRVLNKVLAYKVDQILTVEPDQVTSLSGVMGKDYATLVTCTPYGVNT   189

Query: 230  HRLLVRGHRIKY                                                  241
             RLLVRGHRI Y
Sbjct: 190  KRLLVRGHRIAY                                                  201
```

SEQ ID 3738 (GBS210) was expressed in *E. coli* as a GST-fusion product. SDS-PAGE analysis of total cell extract is shown in FIG. 50 (lane 3; MW 61 kDa).

Figure 152:
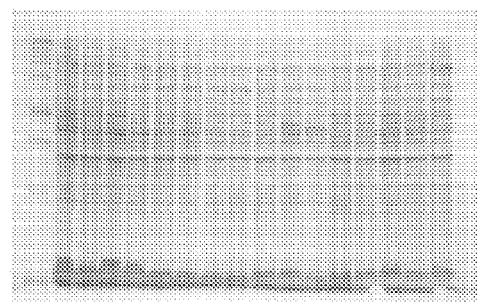

GBS210d was expressed in *E. coli* as a GST-fusion product. SDS-PAGE analysis of total cell extract is shown in FIG. 152 (lane 2-4; MW 54 kDa) and in FIG. 187 (lane 9; MW 54 kDa). It was also expressed in *E. coli* as a His-fusion product. SDS-PAGE analysis of total cell extract is shown in FIG. 154 (lane 2-4; MW 28.7 kDa) and in FIG. 182 (lane 13; MW 29 kDa). Purified GBS210d-GST is shown in lane 4 of FIG. 237.

Based on this analysis, it was predicted that these proteins and their epitopes could be useful antigens for vaccines or diagnostics.

Example 1201

A DNA sequence (GBSx1277) was identified in *S. agalactiae* <SEQ ID 3741> which encodes the amino acid sequence <SEQ ID 3742>. This protein is predicted to be a fimbria-associated protein. Analysis of this protein sequence reveals the following:

Possible site: 42
>>> Seems to have an uncleavable N-term signal seq
INTEGRAL    Likelihood = −10.61    Transmembrane 20-36    (15-40)
INTEGRAL    Likelihood = −7.27    Transmembrane 259-275 (258-277)
----- Final Results -----
    bacterial membrane --- Certainty = 0.5246 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:AAC13546 GB:AF019629 putative fimbria-associated protein
[Actinomyces naeslundii]
Identities = 76/219 (34%), Positives = 120/219 (54%), Gaps = 12/219 (5%)

Query:  28  LSILLYPVVSRFYYTIESNNQTQDFERAAKKLSQKEINRRMALAQAYNDSLN-------N    80
            + +L  YP + +         +  T D+  A    ++   +    ++ A AYND+L+           N
Sbjct:   1  MGLLTYPTAASWVSQYNQSKVTADYS-AQVDGARPDAKTQVEQAHAYNDALSAGAVLEAN    59

Query:  81  VHLEDPYEKKRIQKGVAEYARMLEVSEK--IGTISVPKIGQKLPIFAGSSQEVLSKGAGH   138
```

```
                H+   P        +    +YA +L+ + +    +   + +P I     LP++  G++  + L  KG GH
Sbjct:    60    NHV--PTGAGSSKDSSLQYANILKANNEGLMARLKIPSISLDLPVYHGTADDTLLKGLGH         117

Query:   139    LEGTSLPIGGNSTHTVITAHSGIPDKELFSNLKKLKKGDKFYIQNIKETIAYQVDQIKVV         198
                LEGTSLP+GG  T +VIT H G+ +   +F+NL K+K GD    ++    E + Y+V    KVV
Sbjct:   118    LEGTSLPVGGEGTRSVITGHRGLAEATMFTNLDKVKTGDSLIVEVFGEVLTYRVTSTKVV         177

Query:   199    TPDNFSDLLVVPGHDYATLLTCTPIMINTHRLLVRGHRI                              237
                 P+      L V  G D  TL+TCTP+ INTHR+L+ G RI
Sbjct:   178    EPEETEALRVEEGKDLLTLVTCTPLGINTHRILLTGERI                              216
```

There is also homology to SEQ ID 3740.

A related GBS gene <SEQ ID 8749> and protein <SEQ ID 8750> were also identified. Analysis of this protein sequence reveals the following:

The protein has homology with the following sequences in the databases:

```
33.4/53.0% over 277aa
Actinomyces naeslundii
GP|3036999| putative fimbria-associated protein Insert characterized
ORF00563(382-1179 of 1479)
GP|3036999|gb|AAC13546.1||AF019629(1-278 of 365) putative fimbria-associated
protein {Actinomyces naeslundii}
% Match = 13.4
% Identity = 33.3 % Similarity = 53.0
Matches = 90 Mismatches = 118 Conservative Sub.s = 53

180       210       240       270       300       330       360       390
VVIMKRRQSKEA*G*SLMMYKRS*SCAYDLRVFQ*KYS*IISKSHYLGDDVKTKKIIKKTKKKKKSNLPFIILFLIGLSI
                                                                              : :
                                                                              MGL 420       450       480       510       549       579       609
LLYPVVSRFYYTIESNNQTQDFERAAKKLSQKEINRRMALAQAYNDSLN-------NVHLEDPYEKKRIQKGVAEYARML
|   ||    :  :       |   |  | |:         |:||||:|:      |  | :      :  :||  :|
LTYPTAASWVSQYNQSKVTADYS-AQVDGARPDAKTQVEQAHAYNDALSAGAVLEANNHV--PTGAGSSKDSSLQYANIL
                      20        30        40        50        60        70        80

633       663       693       723       753       783       813       843
EVS--EKIGTISVPKIGQKLPIFAGSSQEVLSKGAGHLEGTSLPIGGNSTHTVITAHSGIPDKELFSNLKKLKKGDKFYI
: :        : :|   |    ||::  |:: :  |  |||||||||||:|| :|||  |   |: :::|| |:|  : :
KANNEGLMARLKIPSISLDLPVYHGTADDTLLKGLGHLEGTSLPVGGEGTRSVITGHRGLAEATMFTNLDKVKTGDSLIV
         90       100       110       120       130       140       150       160

873       903       933       963       993      1023      1053      1083
QNIKETIAYQVDQIKVVTPDNFSDLLVVPGHDYATLLTCTPIMINTHRLLVRGHRIPYKGPIDEKLIKDGHLNTIYRYLF
:  |  : |:|   ||| |:        |  |  |   |   ||:||||: ||||:|: | ||  |   :|         : : :
EVFGEVLTYRVTSTKVVEPEETEALRVEEGKDLLTLVTCTPLGINTHRILLTGERI-YPTPAKD-LAAAGKRPDVPHFPW
                170       180       190       200       210       220       230

1098                1179      1209      1239      1269      1299
Y-----ISLVIIAWLLWL--IKRQRQKNR-LASVRKGIES*WEENFRKTLRNRSF*IDG*M*A*YYCS*LVF**PHILLF
:        |:::    ||           |  |  |  |  ||   :   :         |  |    : :
WAVGLAAGLIVVGLYLWRSGYAAARAKERALARARAAQEEPQPQTWAEQMRIWMDDDAGVEPQRWFTDLPVPPQPSEMEN
       250       260       270       280       290       300       310
```

Lipop Possible site: −1   Crend: 10
McG: Discrim Score: 9.66
GvH: Signal Score (−7.5): −6.53
Possible site: 42
>>> Seems to have an uncleavable N-term signal seq
ALOM program count: 2 value: −10.61 threshold: 0.0
INTEGRAL       Likelihood = −10.61   Transmembrane 20-36  (15-40)
INTEGRAL       Likelihood = −7.27    Transmembrane 259-275 (258-277)
PERIPHERAL     Likelihood = 5.14     216
modified ALOM score: 2.62
*** Reasoning Step: 3
----- Final Results -----
   bacterial membrane --- Certainty = 0.5246 (Affirmative) <succ>
     bacterial outside --- Certainty = 0.0000 (Not Clear) <succ>
       bacterial cytoplasm --- Certainty = 0.0000 (Not Clear) <succ>

SEQ ID 8750 (GBS212) was expressed in *E. coli* as a His-fusion product. SDS-PAGE analysis of total cell extract is shown in FIG. 44 (lane 4; MW 36 kDa). It was also expressed in *E. coli* as a GST-fusion product. SDS-PAGE analysis of total cell extract is shown in FIG. 50 (lane 2; MW 61 kDa).

Purified Thio-GBS212-His is shown in FIG. 244, lane 5.

Based on this analysis, it was predicted that these proteins and their epitopes could be useful antigens for vaccines or diagnostics.

Example 1202

A DNA sequence (GBSx1278) was identified in *S. agalactiae* <SEQ ID 3743> which encodes the amino acid sequence <SEQ ID 3744>. Analysis of this protein sequence reveals the following:

Possible site: 29
>>> Seems to have a cleavable N-term signal seq.
INTEGRAL      Likelihood = −10.40   Transmembrane 680-696 (674-699)
----- Final Results -----
   bacterial membrane --- Certainty = 0.5161 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the GENPEPT database.

```
>GP:CAA57459 GB:X81869 orf2 [Lactobacillus leichmannii]
Identities = 84/325 (25%), Positives = 122/325 (36%), Gaps = 94/325 (28%)
Query:  397  VNVVYTLKDKD----------------KTVASVSLTKTSKGTI---DLGNGIKFEVSGNF    437
             VNV + +KDKD                 TV+    LTK++  T+    D G  + F+ +
Sbjct:  236  VNVPWNIKDKDTFNVVDKPDTGIDIDASTVSIDGLTKSTDYTVNKKDNGYQVVFKTT---    292

Query:  438  SGKFTGLENKSYMISERVSGYGSAINLENGKVTITNTKDSDNPTPLNPTEPKVETHGKKF    497
             S     L  KS I+               K T+TN    D   +  T       +G
Sbjct:  293  SAAVQALAGKSLTITY--------------KATLTNNATPDKA--IGNTATLSIGNGTNI   336

Query:  498  VKTNEQGDRL--AGAQFVVKNSAGKYLALKADQSEGQKTLAAKKIALDEAIAAYNKLSAT   555
                 T   G R+   GAQFV K+S              +  KTLA  +  L +   N +S
Sbjct:  337  TSTPANGPRIYTGGAQFVKKDS------------QSNKTLAGAEFQLVKVDSNGNIVSYA   384

Query:  556  DQKGEKGITAKELIKTKQADYDAAFIEARTAYEWITDKARAITYTSNDQGQFEVTGLADG   615
                 Q +                        +Y W    A TYTS+  G    + GL+
Sbjct:  385  TQASDG----------------------SYTWNDSATEATTYTSDANGLVALKGLSYS    420

Query:  616  -------TYNLEETLAPAGFAKLAGNIKFVVNQGSYITGGNIDYVANSNQKDATRVENKK   668
                    +Y L E  AP G+AKL   +KF + QGS+    G+ + +    N K+
Sbjct:  421  DKLDSGESYALLEIQAPDGYAKLDSPVKFSITQGSF---GDSNKITIDNTKEG-------   470

Query:  669  VTIPQTGGIGTILFTIIGLSIMLGA                                     693
             +P TGG G  +F  IG+ IM+ A
Sbjct:  471  -LLPSTGGKGIYIFLAIGIVIMIVA                                     494
```

No corresponding DNA sequence was identified in *S. pyogenes*.

SEQ ID 3744 (GBS59) was expressed in *E. coli* as a His-fusion product. SDS-PAGE analysis of total cell extract is shown in FIG. 7 (lane 8; MW 120 kDa), in FIG. 11 (lane 9; MW 100 kDa) and in FIG. 13 (lane 6; MW 74 kDa).

GBS59-His was purified as shown in FIG. 193, lane 2.

Based on this analysis, it was predicted that this protein and its epitopes, could be useful antigens for vaccines or diagnostics.

Example 1203

A DNA sequence (GBSx1279) was identified in *S. agalactiae* <SEQ ID 3745> which encodes the amino acid sequence <SEQ ID 3746>. Analysis of this protein sequence reveals the following:

Possible site: 25
>>> Seems to have an uncleavable N-term signal seq
INTEGRAL      Likelihood = −3.13   Transmembrane 870-886 (864-887)
----- Final Results -----
   bacterial membrane --- Certainty = 0.2253 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the GENPEPT database.

```
>GP:AAD33086 GB:AF071083 fibronectin-binding protein I [Streptococcus pyogenes]
Identities = 58/176 (32%), Positives = 83/176 (46%), Gaps = 19/176 (10%)
Query:    6  KFSKILTLSLFCLSQIPLNTNVLGEST---VPENGA--KGKLVVKKTDDQNKPLSKATFV    60
             K S +L+L+ F L  + +   + G S          NGA  +G   +KK D  NKPL  AT
Sbjct:    8  KLSFLLSLTGFILGLLLVFIGLSGVSVGHAETRNGANKQGSFEIKKVDQNNKPLPGATSS    67

Query:   61  LKTTAHPESKIEKVTAELTGEATFDNLIPGDYTLSEETAPEGYKKTNQTWQVKVESNGKT   120
             L +      +  ++  T+   G      NL PG YTL  EETAP+GY KT++TW V V  NG T
Sbjct:   68  LTSKDGKGTSVQTFTSNDKGIVDAQNLQPGTYTLKEETAPDGYDKTSRTWTVTVYENGYT   127

Query:  121  TIQNSGDKNSTIGQNQEELDKQYPPTGIYEDTKESYKLEHVKGSVPN--GKSEAKA       174
              +  +       I +              +D   S +LE+ K SV +   GK+E  +
Sbjct:  128  KLVENPYNGEIISKAGS------------KDVSSSLQLENPKMSVVSKYGKTEVSS       171

Identities = 31/92 (33%), Positives = 49/92 (52%), Gaps = 14/92 (15%)
Query:  725  PTITIKNEKKLGEIEFIKVDKDNNKLLLKGATFELQEFNEDYKLYLPIKNNNSKVVTGEN   784
```

```
                P+IT+ N K++ ++ F K+   DN  + L  A FEL+  N          N+ K+    N
Sbjct: 501      PSITVANLKRVAQLRFKKMSTDN--VPLPEAAFELRSSN---------GNSQKLEASSN   548

Query: 785      --GKISYKDLKDGKYQLIEAVSPEDYQKITNK                              814
                  G++ +KDL  G Y L E  +P+ YQ++T K
Sbjct: 549      TQGEVHFKDLTSGTYDLYETKAPKGYQQVTEK                              580
```

No corresponding DNA sequence was identified in *S. pyogenes*.

SEQ ID 3746 (GBS67) was expressed in *E. coli* as a His-fusion product. SDS-PAGE analysis of total cell extract is shown in FIG. 7 (lane 10; MW 140 kDa), in FIG. 11 (lane 10; MW 150 kDa) and in FIG. 12 (lane 6; MW 95.3 kDa).

GBS67-His was purified as shown in FIG. 192, lane 10.

Based on this analysis, it was predicted that this protein and its epitopes, could be useful antigens for vaccines or diagnostics.

Possible site: 58
>>> Seems to have no N-terminal signal sequence
INTEGRAL    Likelihood = −1.75    Transmembrane 393-409 (392-409)
----- Final Results -----
  bacterial membrane --- Certainty = 0.1702 (Affirmative) <succ>
  bacterial outside --- Certainty = 0.0000 (Not Clear) <succ>
  bacterial cytoplasm --- Certainty = 0.0000 (Not Clear) <succ>

Example 1204

A DNA sequence (GBSx1280) was identified in *S. agalactiae* <SEQ ID 3747> which encodes the amino acid sequence <SEQ ID 3748>. This protein is predicted to be Nra. Analysis of this protein sequence reveals the following:

An alignment of the GAS and GBS proteins is shown below.

```
            Identities = 122/325 (37%), Positives = 186/325 (56%), Gaps = 5/325 (1%)
            Query:   7  LIENYLEKDILNQIKLLTLCY--DYYPSITLDKSCHQLGLSELLIRKYCHDLTTLFNSQL    64
                        LIE YLE  I ++ +L+ L +    Y P  + +    + GL+ L +  YC +L   F    L
            Sbjct:   1  LIEKYLESSIESKCQLIVLFFKTSYLP---ITEVAEKTGLTFLQLNHYCEELNAFFPGSL    57

Query:  65  SLNIEKSTIVYQSNGVTREQAFKYIYHQSHVLQLLKFLITNDSGRLPLTYFSEKFGLSCA   124
                        S+  I+K   I  Q    +E      +Y  S+VLQLL FLI N S    PLT F+    LS +
            Sbjct:  58  SMTIQKRMISCQFTHPFKETYLYQLYASSNVLQLLAFLIKNGSHSRPLTDFARSHFLSNS   117

Query: 125  TAYRIRKHISPLLEKLGFQIVKNTITGDEYRIRYLIAFLNAQFGIEVYPMSKMDKLLIKR   184
                        +AYR+R+ + PLL         ++ KN I G+EYRIRYLIA L ++FGI+VY +++ DK    I
            Sbjct: 118  SAYRMREALIPLLRNFELKLSKNKIVGEEYRIRYLIALLYSKFGIKVYDLTQQDKNTIHS   177

Query: 185  LLLEHSTTFTASHYFPNTFIFFDTLLSLSWKRINYNVVVPYSSLFTELQNIFIYDTLQYC   244
                        L   ST   S +    +F F+D LL+LSWKR   ++V +P + +F  +L+ +F+YD+L+
            Sbjct: 178  FLSHSSTHLKTSPWLSESFSFYDILLALSWKRHQFSVTIPQTRIFQQLKKLFVYDSLKKS   237

Query: 245  VKNVIIDSFKINLKKDDIDYIFLAYLTSHNSFSNPNWTEKRIDNVIAIFENYPKFQKLLQ   304
                        ++I       ++N     D+DY++L Y+T++ NSF++    WT + I       +FE       F+ LL
            Sbjct: 238  SHDIIETYCQLNFSAGDLDYLYLIYITANNSFASLQWTPEHIRQYCQLFEENDTFRLLLN   297

Query: 305  PLKDALPLSGSYHDELVKVAIFFSE                                     329
                        P+    LP        LVK  +FFS+
            Sbjct: 298  PIITLLPNLKEQKASLVEALMFFSK                                     322
```

Based on this analysis, it was predicted that these proteins and their epitopes could be useful antigens for vaccines or diagnostics.

Possible site: 34
>>> Seems to have no N-terminal signal sequence
----- Final Results -----
  bacterial cytoplasm --- Certainty = 0.2020 (Affirmative) <succ>
  bacterial membrane --- Certainty = 0.0000 (Not Clear) <succ>
  bacterial outside --- Certainty = 0.0000 (Not Clear) <succ>

Example 1205

A DNA sequence (GBSx1281) was identified in *S. agalactiae* <SEQ ID 3751> which encodes the amino acid sequence <SEQ ID 3752>. This protein is predicted to be galactosyltransferase. Analysis of this protein sequence reveals the following:

A related GBS nucleic acid sequence <SEQ ID 9979> which encodes amino acid sequence <SEQ ID 9980> was also identified.

A related DNA sequence was identified in *S. pyogenes* <SEQ ID 3749> which encodes the amino acid sequence <SEQ ID 3750>. Analysis of this protein sequence reveals the following:

Possible site: 21
>>> Seems to have no N-terminal signal sequence (or aa 1-22)
----- Final Results -----
  bacterial cytoplasm --- Certainty = 0.1168 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:AAB99071 GB:U67549 galactosyltransferase isolog [Methanococcus
jannaschii]
Identities = 108/395 (27%), Positives = 196/395 (49%), Gaps = 28/395 (7%)
Query:    4 KVKTVAVFSGYYLPFLGGIERYTDKMTADLVK-RGYRVVIVTTNHGDLPIIDEDKGR---     59
              K+K + +F GYY+P +GG+E + D+ T  L +    Y + I   N    +P   E + R
Sbjct:    3 KIKLI-IFPGYYIPHIGGLETHVDEFTKHLSEDENYDIYIFAPN---IPKYKEFEIRHNN    58

Query:   60 -KIYRLPTKNIVKQRYPIINK-NREYNTLMKYVSDENIDFVICNTRFQLTTLEGLSFAKN   117
              K+YR P   I+    YP+ N  N ++   +    + D V+  TRF    TL G  FAK
Sbjct:   59 VKVYRYPAFEIIPN-YPVPNIFNIKFWRMFFNLYKIDFDIVMTRTRFFSNTLLGFIFAKL   117

Query:  118 HHLPS--IVLDHGSSHFSVNNRFLDFFGAIYEHLLTARVKHYRPDFYAVSKRSVEWLKHF   175
                   I  ++HGS+  + + F  +      Y+  +  +       A+SK    ++
Sbjct:  118 RFKKKKLIHVEHGSAFVKLESEFKNLSYFYDKTIGKLIFKKADYVVAISKAVKNFILEN   177

Query:  176 NIEAKGV--IYNSVS----ESLGSDFAGTAYLEKSADDIFITYAGRIIKEKGIELLLEAF   229
              +   K +   IY  +     ES+G D      EK  + I + + GR+ K KG+E +++A+
Sbjct:  178 FVNDKDIPIIYRGLEIEKIESIGED---KKIKEKFKNKIKLCFVGRLYKWKGVENIIKAY   234

Query:  230 S--MSQYSENVYLQIAGDGPELAHLKE---KYQSKQINFLGKLNFEQTMSLMAQTDIFVY   284
                    E + L + G G +L  LK+    Y + I F GK++FE+ ++++   +DI+++
Sbjct:  235 VDLPKDLKEKIILIVVGYGEDLERLKKLAGNYLNNGIYFTGKVDFEKAIAIVKASDIYIH   294

Query:  285 PSMYPEGLPTSILEAGLLSSAIIATDRGGTVEVIDSPELGIIMEENT-QSLHESLDLLVK   343
                 S     GL +S+L+A     AI+A+   G  EV+      GI++++N+ + +   + L++
Sbjct:  295 SSYKGGGLSSSLLQAMCCGKAIVASPYEGADEVVIDGYNGILLKDNSPEEIKRGIIKLIE   354

Query:  344 DKALREKLQQNIAKRIKEHFTWEKTVEKLDYIIQK                           378
              +  LR+   +N    IKE+F W+K+V++   I ++
Sbjct:  355 NNNLRKIYGENAKNFIKENFNWKKSVKEYKKIFER                           389
```

No corresponding DNA sequence was identified in *S. pyogenes*.

Figure 45:
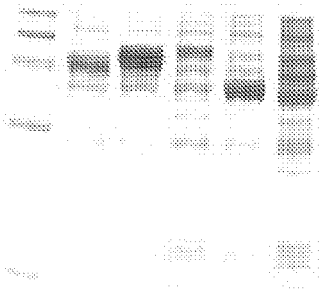

SEQ ID 3752 (GBS258) was expressed in *E. coli* as a His-fusion product. SDS-PAGE analysis of total cell extract is shown in FIG. 45 (lane 2; MW 43 kDa). It was also expressed in *E. coli* as a GST-fusion product. SDS-PAGE analysis of total cell extract is shown in FIG. 48 (lane 7; MW 67.9 kDa).

Based on this analysis, it was predicted that this protein and its epitopes, could be useful antigens for vaccines or diagnostics.

Possible site: 31
>>> Seems to have no N-terminal signal sequence
----- Final Results -----
    bacterial cytoplasm --- Certainty = 0.1182 (Affirmative) <succ>
    bacterial membrane --- Certainty = 0.0000 (Not Clear) <succ>
    bacterial outside --- Certainty = 0.0000 (Not Clear) <succ>

Example 1206

A DNA sequence (GBSx1282) was identified in *S. agalactiae* <SEQ ID 3753> which encodes the amino acid sequence <SEQ ID 3754>. Analysis of this protein sequence reveals the following:

The protein has homology with the following sequences in the GENPEPT database.

```
>GP:CAB52237 GB:Z98171 EpsQ protein [Streptococcus thermophilus]
Identities = 112/278 (40%), Positives = 163/278 (58%), Gaps = 2/278 (0%)
Query:    1 MKYLAGIVTFNPNIERLDQNIRAIYPQVSHIYIVDNGSKNKEEISQLVADYNEEGHLTVD    60
            M   AGIV FNP+I+RL +NI A+  Q +H+Y+VDNGS N +E+  L+   YN+   +++
Sbjct:    1 MDISAGIVLFNPDIKRLKENIDAVIIQCTHLYLVDNGSGNVDEVKGLLNQYNQS-KISIL    59

Query:   61 YLTENKGIAYALNCIGQFAVAQEFDWFLTLDQDSVVLGDLIDNYENYLHLPKVGMLSCLY   120
            +  EN+GIA ALN +   A  + FDW LTLDQDSVV   +++  +E Y++    VG+L  +
Sbjct:   60 WNRENQGIAKALNQLTSAAQKEGFDWILTLDQDSVVPSNIVGEFEKYINNSSVGILCPII   119

Query:  121 QDMNRENLVMQEFDYKEIEECITSAALMKTSVFEETSGFAEEMFIDFVDSEMNYRLSEMG   180
              D N++ +      D   EI+ECITS +L+   +    + E  GF E MFID VD ++  YRL + G
Sbjct:  120 CDRNKDEEIKINEDCTEIDECITSGSLLNIKAWSEIGGFDERMFIDGVDFDICYRLRQRG   179

Query:  181 YKTYQVNFIGLLHEIGHSSRVKKFGHVFHVLNHSPFRKYYMIRNAIYIIKKYGKKKRYKY   240
            YK Y ++ +   LLHE+GH             V NHS FRKYY+ RN IY   KK
Sbjct:  180 YKIYCIHSVVLLHELGHIEYHRFLFWKVLVKNHSAFRKYYIARNIIYTAKKRRSTLLVVK   239

Query:  241 LVFMRNEFVRVLV-AEEQKSKKIVAMIKGLKDGLLMKV                        277
                  +  + +++ EE K  KI  + +G+  DG   KV
Sbjct:  240 GLLQEIKLIGIVIFYEEDKLNKIRCICRGIYDGFKGKV                        277
```

No corresponding DNA sequence was identified in *S. pyogenes*.

Based on this analysis, it was predicted that this protein and its epitopes, could be useful antigens for vaccines or diagnostics.

Example 1207

A DNA sequence (GBSx1283) was identified in *S. agalactiae* <SEQ ID 3755> which encodes the amino acid sequence <SEQ ID 3756>. This protein is predicted to be EpsU protein (rfbX). Analysis of this protein sequence reveals the following:

```
Possible site: 54
>>> Seems to have an uncleavable N-term signal seq
INTEGRAL    Likelihood = -8.44   Transmembrane 357-373 (352-387)
INTEGRAL    Likelihood = -7.59   Transmembrane  88-104  (79-107)
INTEGRAL    Likelihood = -7.32   Transmembrane 440-456 (433-465)
INTEGRAL    Likelihood = -6.48   Transmembrane 246-262 (245-263)
INTEGRAL    Likelihood = -4.78   Transmembrane 294-310 (290-312)
INTEGRAL    Likelihood = -3.88   Transmembrane 164-180 (162-183)
INTEGRAL    Likelihood = -3.56   Transmembrane 144-160 (136-161)
INTEGRAL    Likelihood = -2.87   Transmembrane 317-333 (316-334)
INTEGRAL    Likelihood = -2.71   Transmembrane 374-390 (374-393)
INTEGRAL    Likelihood = -0.96   Transmembrane  44-60   (44-62)
INTEGRAL    Likelihood = -0.80   Transmembrane  15-31   (15-32)
----- Final Results -----
   bacterial membrane --- Certainty = 0.4376 (Affirmative) <succ>
     bacterial outside --- Certainty = 0.0000 (Not Clear) <succ>
   bacterial cytoplasm --- Certainty = 0.0000 (Not Clear) <succ>
```

The protein has homology with the following sequences in the GENPEPT database.

```
>GP:CAB52225 GB:Z98171 EpsU protein [Streptococcus thermophilus]
Identities = 189/462 (40%), Positives = 313/462 (66%)
Query:    1  MKLLKNMFYNTSYQLLTLLLPLVTVPYVSRVLSPQGIGINAYTSSIVMYFTLFGALGISL    60
             M+++KN   YN  YQ+   +++PL+T+PY+SR+L P GIGIN+YT+SIV YF LFG++G+ L
Sbjct:    1  MQIVKNYLYNAIYQVFIIIVPLLTIPYLSRILGPSGIGINSYTNSIVQYFVLFGSIGLGL    60

Query:   61  YGNREIAFVQSNKYKRSKIFWELVVLKLASVSIATLLFFGFVLLTNEWQLFYLIQGINLL   120
             YGNR+IAFV+ N+ K SK+F+E+ +L+L ++ +A  LF  F+++  ++ +YL Q I ++
Sbjct:   61  YGNRQIAFVRDNQVKMSKVFYEIFILRLFTICLAYFLFVAFLIINGQYYAYYLSQSIAIV   120

Query:  121  ATATDISWYFIGVEDFKIIVIRNTIVKLITVVLTFLVVKTPDDLALYMFLIAFASLLGNL   180
             A A DISW F+G+E+FK+IV+RN IVKL+ +    FL VK+ +DL +Y+ +   ++L+GNL
Sbjct:  121  AAAFDISWAFMGIENFKVIVLRNFIVKLLALFSIFLFVKSYNDLNIYILITVLSTLIGNL   180

Query:  181  TVWHHLKHEIIKIPFSRLDILIHLRPTLMLFLPQITMQIYLSLNKSMLGAMDSVVSAGYF   240
             T +  L   ++K+ +   L  + HL+  +L++F+PQI +QIY  LNK+MLG++DSV S+G+F
Sbjct:  181  TFFPSLHRYLVKVNYRELRPIKHLKQSLVMFIPQIALQIYWVLNKTMLGSLDSVTSSGFF   240

Query:  241  DQSDKIIRILFTIVSAIGGVFLPRLSSLFSSGKEKQAKALLLKLVDLSNAISMLMIAGVV   300
             DQSDKI++++   IV+A G V LPR+++ F+  +  + K      +AIS+ M+ G++
Sbjct:  241  DQSDKIVKLVLAIVTATGTVMLPRVANAFAHREYSKIKEYMYAGFSFVSAISIPMMFGLI   300

Query:  301  GVSSTFAVFFFGKGYEAVGPLMAVESLMIICISYGNALGTQYLLASRRTKAYTMSAVIGL   360
             ++   F   FF   +  V P++  +ES+ II I++ NA+G QYLL  + +  K+YT+S +IG
Sbjct:  301  AITPKFVPLFFTSQFSDVIPVLMIESIAIIFIAWSNAIGNQYLLPTNQNKSYTVSVIIGA   360

Query:  361  VANVVLNILLIPILGAMGAIISTVITEFIVSLYQAISLRDVFTFKELTRGMLRYLIAATL   420
             + N++LNI LI   LGA+GA I+TVI+E  V++YQ        L    +  +YLIA  +
Sbjct:  361  IVNLMLNIPLIIYLGAVGASIATVISEMSVTVYQLFIIHKQLNLHTLFSDLSKYLIAGLV   420

Query:  421  SGAVLYYINTQMSVSLVNYVIQSLVAVTIYVGIVFITKAPVI                    462
             +++ I+    S +  +++  V + IY+ ++    KA +I
Sbjct:  421  MFLIVFKISLLTPTSWIFILLEITVGIIIYIVLLIFLKAEII                    462
```

No corresponding DNA sequence was identified in *S. pyogenes*.

Based on this analysis, it was predicted that this protein and its epitopes, could be useful antigens for vaccines or diagnostics.

Example 1208

A DNA sequence (GBSx1284) was identified in *S. agalactiae* <SEQ ID 3757> which encodes the amino acid sequence <SEQ ID 3758>. Analysis of this protein sequence reveals the following:

```
Possible site: 23
>>> Seems to have no N-terminal signal sequence
----- Final Results -----
   bacterial cytoplasm --- Certainty = 0.1742 (Affirmative) <succ>
    bacterial membrane --- Certainty = 0.0000 (Not Clear) <succ>
     bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1209

A DNA sequence (GBSx1285) was identified in *S. agalactiae* <SEQ ID 3759> which encodes the amino acid sequence <SEQ ID 3760>. Analysis of this protein sequence reveals the following:

Possible site: 25
>>> Seems to have an uncleavable N-term signal seq
----- Final Results -----
   bacterial membrane --- Certainty = 0.0000 (Not Clear) <succ>
   bacterial outside --- Certainty = 0.0000 (Not Clear) <succ>
      bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1210

A DNA sequence (GBSx1286) was identified in *S. agalactiae* <SEQ ID 3761> which encodes the amino acid sequence <SEQ ID 3762>. Analysis of this protein sequence reveals the following:

Possible site: 34
>>> Seems to have no N-terminal signal sequence
INTEGRAL    Likelihood = -10.56   Transmembrane 214-230 (210-236)
INTEGRAL    Likelihood = -10.03   Transmembrane 364-380 (361-386)
INTEGRAL    Likelihood = -7.96    Transmembrane 272-288 (271-291)
INTEGRAL    Likelihood = -6.95    Transmembrane 23-39 (20-41)
INTEGRAL    Likelihood = -5.57    Transmembrane 191-207 (189-209)
INTEGRAL    Likelihood = -5.15    Transmembrane 434-450 (425-451)
INTEGRAL    Likelihood = -4.25    Transmembrane 143-159 (138-162)
INTEGRAL    Likelihood = -3.13    Transmembrane 167-183 (166-186)
INTEGRAL    Likelihood = -1.44    Transmembrane 400-416 (400-416)
INTEGRAL    Likelihood = -1.33    Transmembrane 333-349 (333-349)
INTEGRAL    Likelihood = -0.80    Transmembrane 232-248 (232-251)
----- Final Results -----
   bacterial membrane --- Certainty = 0.5225 (Affirmative) <succ>
      bacterial outside --- Certainty = 0.0000 (Not Clear) <succ>
         bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1211

A DNA sequence (GBSx1287) was identified in *S. agalactiae* <SEQ ID 3763> which encodes the amino acid sequence <SEQ ID 3764>. This protein is predicted to be rhamnosyltransferase. Analysis of this protein sequence reveals the following:

Possible site: 17
>>> Seems to have no N-terminal signal sequence
----- Final Results -----
   bacterial cytoplasm --- Certainty = 0.1792 (Affirmative) <succ>
      bacterial membrane --- Certainty = 0.0000 (Not Clear) <succ>
         bacterial outside --- Certainty = 0.0000 (Not Clear) <succ>

A related GBS nucleic acid sequence <SEQ ID 9981> which encodes amino acid sequence <SEQ ID 9982> was also identified.

The protein has homology with the following sequences in the GENPEPT database.

```
>GP:AAF18951 GB:AF155805 Cps9H [Streptococcus suis]
Identities = 53/116 (45%), Positives = 75/116 (63%), Gaps = 4/116 (3%)
Query:   6   VLMATYNGQGFIHDQLDSIRNQTLRPDYVLMRDDGSTDDTVKVVEDYIKEHRLDGWSITS   65
             VLMATYNG  FI  QLDSIRNQ++  D V++ DD STDDT+K+++DYIK++ LD W ++
Sbjct:   4   VLMATYNGSPFIIKQLDSIRNQSVSADKVIIWDDCSTDDTIKIIKDYIKKYSLDSWVVSQ   63

Query:  66   NDKNLGWRLNFRQLLIDVLAYEVDYVFFSDQDDTWYHHKNKMQVDIMEERQDINLL       121
             N  N G    F L       +   VFFSDQDD W  HK +  + I  +R++++++
Sbjct:  64   NKSNQGHYQTFINL---TKLVQEGIVFFSDQDDIWDCHKIETMLPIF-DRENVSMV      115
```

Based on this analysis, it was predicted that these proteins and their epitopes could be useful antigens for vaccines or diagnostics.

Example 1212

A DNA sequence (GBSx1288) was identified in *S. agalactiae* <SEQ ID 3765> which encodes the amino acid sequence <SEQ ID 3766>. This protein is predicted to be rhamnosyltransferase. Analysis of this protein sequence reveals the following:

Possible site: 13
>>> Seems to have no N-terminal signal sequence
----- Final Results -----
   bacterial cytoplasm --- Certainty = 0.1278 (Affirmative) <succ>
      bacterial membrane --- Certainty = 0.0000 (Not Clear) <succ>
         bacterial outside --- Certainty = 0.0000 (Not Clear) <succ>

A related GBS nucleic acid sequence <SEQ ID 9983> which encodes amino acid sequence <SEQ ID 9984> was also identified.

The protein has homology with the following sequences in the GENPEPT database.

```
>GP:AAF18951 GB:AF155805 Cps9H [Streptococcus suis]
Identities = 57/146 (39%), Positives = 81/146 (55%), Gaps = 8/146 (5%)
Query:  10   VLMATYNGEIFISEQLDSIRQQTLKPDYVLLRDDCSTDETVNVVNNYIAKHELEGWKIVK   69
             VLMATYNG  FI  +QLDSIR Q++  D V++ DDCSTD+T+  ++ +YI  K+ L+ W + +
Sbjct:   4   VLMATYNGSPFIIKQLDSIRNQSVSADKVIIWDDCSIDDTIKIIKDYIKKYSLDSWVVSQ   63
```

```
-continued
Query:  70  NDKNLGWRLNFRQLLIDVLAYEVDYVFFSDQDDIWYLDKNERQFAIMSDKPQIEVLSADV  129
            N N G  F L    +  VFFSDQDDIW  K E    I  D+ + +    V
Sbjct:  64  NKSNQGHYQTFINL---TKLVQEGIVFFSDQDDIWDCHKIETMLPIF-DRENVSM----V  115

Query: 130  DIKTMSTEASVPHFLTFSSSDRISQY  155
            K+  + +      +  +SDRI+ Y
Sbjct: 116  FCKSRLIDENGNIISSPDTSDRINTY  141
```

Based on this analysis, it was predicted that these proteins and their epitopes could be useful antigens for vaccines or diagnostics.

Example 1213

A DNA sequence (GBSx1289) was identified in *S. agalactiae* <SEQ ID 3767> which encodes the amino acid sequence <SEQ ID 3768>. This protein is predicted to be dTDP-glucose 4-6-dehydratase (galE). Analysis of this protein sequence reveals the following:

---
Possible site: 44
>>> Seems to have no N-terminal signal sequence
INTEGRAL    Likelihood = −2.02    Transmembrane 250-266 (250-266)
----- Final Results -----
  bacterial membrane --- Certainty = 0.1808 (Affirmative) <succ>
     bacterial outside --- Certainty = 0.0000 (Not Clear) <succ>
       bacterial cytoplasm --- Certainty = 0.0000 (Not Clear) <succ>
---

A related GBS nucleic acid sequence <SEQ ID 9985> which encodes amino acid sequence <SEQ ID 9986> was also identified.

The protein has homology with the following sequences in the GENPEPT database.

Based on this analysis, it was predicted that these proteins and their epitopes could be useful antigens for vaccines or diagnostics.

Example 1214

A DNA sequence (GBSx1290) was identified in *S. agalactiae* <SEQ ID 3769> which encodes the amino acid sequence <SEQ ID 3770>. Analysis of this protein sequence reveals the following:

---
Possible site: 53
>>> Seems to have an uncleavable N-term signal seq
----- Final Results -----
  bacterial membrane --- Certainty = 0.0000 (Not Clear) <succ>
     bacterial outside --- Certainty = 0.0000 (Not Clear) <succ>
       bacterial cytoplasm --- Certainty = 0.0000 (Not Clear) <succ>
---

A related GBS nucleic acid sequence <SEQ ID 9987> which encodes amino acid sequence <SEQ ID 9988> was also identified.

The protein has homology with the following sequences in the GENPEPT database.

```
>GP:CAC14890 GB:AJ295156 d-TDP-glucose dehydratase [Phragmites
australis]

Identities = 108/327 (33%), Positives = 170/327 (51%), Gaps = 22/327 (6%)

Query:  29  ANKGVLISGSNSMLASYMVFLLAYLNETRNYQTQIIATARNIEKARDKFSDLVGKDYFTL  88
            AN +L++G    + S++V L      N + ++I       ++D    +G   F L
Sbjct:  33  ANLRILVTGGAGFIGSHLVDKLM-----ENEKHEVIVADNFFTGSKDNLKKWIGHPRFEL  87

Query:  89  IPYDVEERLEYDGKVDYIIHAASNASPTAILSNPVSIIKANTIGTLNLLDFAKEKTIENF  148
            I +DV + L  +   VD I H A  ASP    NPV  IK N IGTLN+L  AK +
Sbjct:  88  IRHDVTQPLLVE--VDQIYHLACPASPIFYKHNPVKTIKTNVIGTLNMLGLAK-RVGARI  144

Query: 149  LFLSTREVYGTSIKEVIDEEAYGGFDILATRACYPESKRMAETLLQSYYDQYKVPFTIAR  208
            L  ST EVYG ++   E  +G  + +  R+CY E KR+AETL+ Y+ Q+ +    IAR
Sbjct: 145  LLTSTSEVYGDPLEHPQTEAYWGNVNPIGVRSCYDEGKRVAETLMFDYHRQHGIEIRIAR  204

Query: 209  IAHSFGPGMELGNDGRIMNDLLSNVIDGKDIVLKSSGTAERAFCYLADAVSGLFTILLNG  268
            I +++GP M +  +DGR++++ ++   + G  + ++   GT  R+FCY+AD V GL   L+NG
Sbjct: 205  IFNTYGPRMNI-DDGRVVSNFIAQAVRGDPLTVQKPGTQTRSFCYVADMVDGLIK-LMNG  262

Query: 269  EVGQAYNVANEDQPIMIKDLAQKLVDLFSDKNISVVFDIPKTMSAGYSKMGRTR---LTM  325
                N+ N  + M+ +LA+K+ +L +           ++   TM+     R  R    +T
Sbjct: 263  NNTGPINLGNPGEFTML-ELAEKVKELINP-------EVTVTMTENTPDDPRQRKPDITK  314

Query: 326  AKLEALGWKREVSLESGILKTVQAFEE  352
            AK  E  LGW+ +V L   G++       F E
Sbjct: 315  AK-EVLGWEPKVVLRDGLVLMEDDFRE  340
```

```
>GP:CAB11866 GB:Z99104 similar to hypothetical proteins [Bacillus subtilis]
Identities = 77/231 (33%), Positives = 131/231 (56%), Gaps = 6/231 (2%)
Query:   13 VIFAGGVGRRMNTKGKPKQFLEVHGKPIIVHTIDIFQNTEAIDAVVVVCVSDWLDYMNNL        72
            VI A G G+RM   G+ K F+E+ G P+I+HT+ +F +    D +++V      ++  L
Sbjct:    6 VIPAAGQGKRMKA-GRNKLFIELKGDPVIIHTLRVFDSHRQCDKIILVINEQEREHFQQL        64

Query:   73 VERFNLTKVKAVVAGGETGQMSIFKGLEAAEQLATDDAVVLIHDGVRPLINEEVINANIQ       132
            + +            +VAGG+  Q S++KGL+A +Q      + +VL+HDG RP I  E I+   I
Sbjct:   65 LSDYPFQTSIELVAGGDERQHSVYKGLKAVKQ----EKIVLVHDGARPFIKHEQIDELIA       120

Query:  133 SVKETGSAVTSVRAKETVVLVNDSSKISEVVDRTRSFIAKAPQSFYLSDILSVERDAISK       192
              ++TG+A+ +V  K+T+  V D  ++SE ++R+  +   + PQ+F LS ++     +A  K
Sbjct:  121 EAEQTGAAILAVPVKDTIKRVQDL-QVSETIERSSLWAVQTPQAFRLSLLMKAHAEAERK       179

Query:  193 GITDAIDSSTLMGMYNRELTIVEGPYENIKITTPDDFYMFKALYDARENEQ              243
            G     D+S + M    + +VEG Y NIK+TTPDD    +A+ ++      +
Sbjct:  180 GFLGTDDASLVEQMEGGSVRVVEGSYTNIKLTTPDDLTSAEAIMESESGNK              230
```

No corresponding DNA sequence was identified in S. pyogenes.

SEQ ID 3770 (GBS647) was expressed in E. coli as a GST-fusion product. SDS-PAGE analysis of total cell extract is shown in FIG. 130 (lane 9 & 10; MW 55.9 kDa+lane 8; MW 27 kDa) and in FIG. 186 (lane 5; MW 56 kDa). It was also expressed in E. coli as a His-fusion product. SDS-PAGE analysis of total cell extract is shown in FIG. 130 (lane 12; MW 31 kDa), in FIG. 140 (lane 9; MW 31 kDa) and in FIG. 178 (lane 6; MW 31 kDa).

Purified GBS647-GST is shown in FIG. 243, lane 4; purified GBS647-His is shown in FIG. 229, lane 6.

Based on this analysis, it was predicted that these proteins and their epitopes could be useful antigens for vaccines or diagnostics.

Example 1215

A DNA sequence (GBSx1291) was identified in S. agalactiae <SEQ ID 3771> which encodes the amino acid sequence <SEQ ID 3772>. This protein is predicted to be LicD1. Analysis of this protein sequence reveals the following:

Possible site: 41
>>> Seems to have no N-terminal signal sequence
----- Final Results -----
  bacterial cytoplasm --- Certainty = 0.2647 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 9989> which encodes amino acid sequence <SEQ ID 9990> was also identified.

The protein has homology with the following sequences in the GENPEPT database.

```
>GP:AAD37094 GB:AF106539 LicD2 [Streptococcus pneumoniae]
Identities = 85/271 (31%), Positives = 130/271 (47%), Gaps = 15/271 (5%)
Query:    1 MKEMTVSEIREVQLEMLAYIDKVARDNKIEYSLGGGSLLGAMRHKGFIPWDDDIDLMLER        60
            M+ +    EI+E+QL +L YID+ + + I Y L  G++LGA+RHKG IPWDDDID+ L R
Sbjct:    1 MQYLEKKEIKEIQLALLDYIDETCKKHDIPYFLSYGTMLGAIRHKGMIPWDDDIDISLYR        60

Query:   61 SQYERLMKALADANNSDFKLLHHSVEKNLW---PFAKLYHTKSMYLSKTDRIHPWTGIFI       117
               YERL+K + +  N+  +K+L  S + + W     FA +   T ++            T +FI
Sbjct:   61 EDYERLLKIIEEENHPRYKVL--SYDTSSWYFHNFASILDTSTVIEDHVKYKRHDTSLFI       118

Query:  118 DIFPLDRLPESAEERQRFFKKVHSAAANLMCTTYPNFASGSRKLYANARLILGLP-RFIA       176
            D+FP+DR + +  + +   + A    L         G KL    RL         RF+
Sbjct:  119 DVFPIDRFTDLSIVDKSY---KYVALRQLAYIKKSRAVHGDSKLKDFLRLCSWYALRFVN       175

Query:  177 YHGQAKKRAEIVDQVMETYNNQEVPYMGYTD-SRYRLKEYFPREIFSEYEDVMFENIKTR       235
                    KK     +DQ+++          Y G       + +KE   FP + F E           FE
Sbjct:  176 PRYFYKK----IDQLVKNAVTNTPQYEGGVGIGKEGMKEIFPVDTFKELILTEFEGRMLP       231

Query:  236 KIKNEHAYLNQLYGGSYMELPPESKRESHSY                                  266
             K    +L Q+Y G YM  P  +E +S+
Sbjct:  232 VPKKYDQFLTQMY-GDYMTPPSKEMQEWYSH                                  261
```

No corresponding DNA sequence was identified in *S. pyogenes*.

Based on this analysis, it was predicted that these proteins and their epitopes could be useful antigens for vaccines or diagnostics.

Example 1216

A DNA sequence (GBSx1292) was identified in *S. agalactiae* <SEQ ID 3773> which encodes the amino acid sequence <SEQ ID 3774>. Analysis of this protein sequence reveals the following:

---

Possible site: 18
>>> May be a lipoprotein
INTEGRAL    Likelihood = −12.05    Transmembrane 554-570 (547-575)
----- Final Results -----
   bacterial membrane --- Certainty = 0.5819 (Affirmative) <succ>
      bacterial outside --- Certainty = 0.0000 (Not Clear) <succ>
         bacterial cytoplasm --- Certainty = 0.0000 (Not Clear) <succ>

---

The protein has no significant homology with any sequences in the GENPEPT database.

No corresponding DNA sequence was identified in *S. pyogenes*.

SEQ ID 3774 (GBS182d) was expressed in *E. coli* as a His-fusion product. SDS-PAGE analysis of total cell extract is shown in FIG. 184 (lane 8; MW 62 kDa).

Based on this analysis, it was predicted that this protein and its epitopes, could be useful antigens for vaccines or diagnostics.

Example 1217

A DNA sequence (GBSx1293) was identified in *S. agalactiae* <SEQ ID 3775> which encodes the amino acid sequence <SEQ ID 3776>. Analysis of this protein sequence reveals the following:

---

Possible site: 13
>>> Seems to have no N-terminal signal sequence
----- Final Results -----
   bacterial cytoplasm --- Certainty = 0.4653 (Affirmative) <succ>
      bacterial membrane --- Certainty = 0.0000 (Not Clear) <succ>
         bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1218

A DNA sequence (GBSx1294) was identified in *S. agalactiae* <SEQ ID 3777> which encodes the amino acid sequence <SEQ ID 3778>. This protein is predicted to be DOLICHYL-PHOSPHATE MANNOSE SYNTHASE RELATED PROTEIN. Analysis of this protein sequence reveals the following:

---

Possible site: 29
>>> Seems to have an uncleavable N-term signal seq
INTEGRAL    Likelihood = −2.92    Transmembrane 232-248 (231-248)
----- Final Results -----
   bacterial membrane --- Certainty = 0.2168 (Affirmative) <succ>
      bacterial outside --- Certainty = 0.0000 (Not Clear) <succ>
         bacterial cytoplasm --- Certainty = 0.0000 (Not Clear) <succ>

---

A related GBS nucleic acid sequence <SEQ ID 9991> which encodes amino acid sequence <SEQ ID 9992> was also identified.

The protein has homology with the following sequences in the GENPEPT database.

```
>GP:AAC35924 GB:AF071085 putative glycosyl transferase [Enterococcus
faecalis]
Identities = 118/240 (49%), Positives = 152/240 (63%), Gaps = 1/240 (0%)
Query:   14  KILLVIPAYNEEGSIAKTVQTIVDFKASRS-LPFELDYIVINDGSTDGTPELLDRLGLNH    72
             K+LL+IPAYNEE +I +T+ +I  FK   +     ELDY+VINDGSTDGT ++L+   +N
Sbjct:    2  KVLLIIPAYNEEENILRTIASIETFKQEVTHFQHELDYVVINDGSTDGTKQILEVNQINA    61

Query:   73  IDLVQNLGIGGCVQTGYLYANRNHYDVAVQFDGDGQHDIRSIEDVVMPILNDEADFVIGS   132
             I LV NLGIGG VQTGY YA  N YDVA QFDGDG HDI S+  ++ P+     F  GS
Sbjct:   62  IHLVLNLGIGGAVQTGYKYALENEYDVAXQFDGDGXHDIXSLPILLEPLAEGXCXFSXGS   121

Query:  133  RFVDKKHQNFQSTAMRRLGINLISAAIKLTTGHKVYDTTSGYRAANAALIAYLSCHYPVQ   192
             RF+    +FQS MRR GI L+S     G +Y T G RA N +IA+ + YP
Sbjct:  122  RFIPGNXASFQSXKMRRXGIRLLSFCXXXAXGXTIYXVTXGXRAGNRKVIAFFAKRYPTN   181

Query:  193  YPEPESTARILKKGYRLKEVTANMFEREAGTSSISSLKSIFYMTDVLTSIIIAGFIKEDD   252
             YPEPES    ++KK +  + E   NM ER  G SSI +L S+ YM +V ++I+IA F+KE D
Sbjct:  182  YPEPESIVHLIKKRFVIVERPVNMMERLGGVSSIRALASVKYMLEVGSAILIAPFMKEGD   241
```

A related DNA sequence was identified in *S. pyogenes* <SEQ ID 3779> which encodes the amino acid sequence <SEQ ID 3780>. Analysis of this protein sequence reveals the following:

---

Possible site: 56
>>> Seems to have no N-terminal signal sequence
INTEGRAL    Likelihood = −0.80    Transmembrane 211-227 (211-227)
----- Final Results -----
   bacterial membrane --- Certainty = 0.1319 (Affirmative) <succ>
      bacterial outside --- Certainty = 0.0000 (Not Clear) <succ>
         bacterial cytoplasm --- Certainty = 0.0000 (Not Clear) <succ>

---

The protein has homology with the following sequences in the databases:

```
>GP:AAC35924 GB:AF071085 putative glycosyl transferase [Enterococcus
faecalis]
Identities = 104/233 (44%), Positives = 134/233 (56%), Gaps = 9/233 (3%)
Query:   1  VKKLIIIPAYNESSNIVNTIRTIESDAPD-------FDYIIIDDCSTDNTLAICQKQGFN   53
            +K L+IIPAYNE NI+ TI +IE+    +         DY++I+D STD T  I +   N
Sbjct:   1  MKVLLIIPAYNEEENILRTIASIETFKQEVTHFQHELDYVVINDGSTDGTKQILEVNQIN   60

Query:  54  VISLPINLGIGGAVQTGYRYAQRCGYDVAVQVDGDGQHNPCYLEKMVEVLVQSSVNMVIG  113
              I L +NLGIGGAVQTGY+YA      YDVA Q DGDG H+    L  ++E L  +        G
Sbjct:  61  AIHLVLNLGIGGAVQTGYKYALENEYDVAXQFDGDGXHDIXSLPILLEPLAEGXCXFSKG  120

Query: 114  SRFI--TKEGFQSSFARRIGIKYFTWLIALLTGKKITDATSGLRLIDRSLIERFANHYPD  171
            SRFI     FQS   RR GI+  ++       G  I    T G R   +R +I   FA   YP
Sbjct: 121  SRFIPGNXASFQSXKMRRXGIRLLSFCXXXAXGXTIYXVTXGXRAGNRKVIAFFAKRYPT  180

Query: 172  DYPEPETVVDVLVSHFKVKEIPVVMNERQGGVSSISLTKSVYYMIKVTLAILV         224
            +YPEPE++V ++    F + E PV M ER GGVSSI     SV YM++V  AIL+
Sbjct: 181  NYPEPESIVHLIKKRFVIVERPVNMMERLGGVSSIRALASVKYMIEVGSAILI          233
```

An alignment of the GAS and GBS proteins is shown below.

```
Identities = 105/231 (45%), Positives = 142/231 (61%), Gaps = 8/231 (3%)
Query:  14  KILLVIPAYNEEGSIAKTVQTIVDFKASRSLPFELDYIVINDGSTDGTPELLDRLGLNHI   73
            K L++IPAYNE  +I  T++TI        S    + DYI+I+D STD T +    + G N I
Sbjct:   2  KKLIIIPAYNESSNIVNTIRTI------ESDAPDFDYIIIDDCSTDNTLAICQKQGFNVI   55

Query:  74  DLVQNLGIGGCVQTGYLYANRNHYDVAVQFDGDGQHDIRSIEDVVMPILNDEADFVIGSR  133
            L  NLGIGG VQTGY YA R   YDVAVQ DGDGQH+   +E +V ++     + VIGSR
Sbjct:  56  SLPINLGIGGAVQTGYRYAQRCGYDVAVQVDGDGQHNPCYLEKMVEVLVQSSVNMVIGSR  115

Query: 134  FVDKKHQNFQSTAMRRLGINLISAAIKLTTGHKVYDTTSGYRAANAALIAYLSCHYPVQY  193
            F+  K + + FQS+  RR+GI        + I  L TG K+  D TSG R   + +LI    + HYP Y
Sbjct: 116  FITK--EGFQSSFARRIGIKYFTWLIALLTGKKITDATSGLRLIDRSLIERFANHYPDDY  173

Query: 194  PEPESTARILKKGYRLKEVTANMFEREAGTSSISSLKSIFYMTDVLTSIII          244
            PEPE+      +L    +++KE+      M ER+ G SSIS    KS++YM  V   +I++
Sbjct: 174  PEPETVVDVLVSHFKVKEIPVVMNERQGGVSSISLTKSVYYMIKVTLAILV          224
```

A related GBS gene <SEQ ID 8751> and protein <SEQ ID 8752> were also identified. Analysis of this protein sequence reveals the following:

---

Lipop: Possible site: −1 Crend: 9
McG: Discrim Score: 0.29
GvH: Signal Score (−7.5): −4.34
Possible site: 29
>>> Seems to have an uncleavable N-term signal seq
ALOM program count: 1 value: −2.92 threshold: 0.0
INTEGRAL   Likelihood = −2.92   Transmembrane 222-238 (221-238)
PERIPHERAL Likelihood = 4.40    4

-continued modified ALOM score: 1.08

*** Reasoning Step: 3

----- Final Results ----- bacterial membrane --- Certainty = 0.2168 (Affirmative) <succ>
bacterial outside --- Certainty = 0.0000 (Not Clear) <succ>
bacterial cytoplasm --- Certainty = 0.0000 (Not Clear) <succ>

---

The protein has homology with the following sequences in the databases:

```
ORF00548(340-1056 of 1359)
GP|3608398|gb|AAC35924.1||AF071085(2-241 of 241) putative glycosyl transferase
{Enterococcus faecalis}
% Match = 24.7
% Identity = 49.2  % Similarity = 64.2
Matches = 118  Mismatches = 85  Conservative Sub.s = 36

249       279       309       339       369       399       429      456
        L*QD*GGYGNMVIAKINLSIKLCLNG*XQQIIXIRDKMMKKILLVIPAYNEEGSIAKTVQTIVDFKASRS-LPFELDYIV
                                      :|||:||||||| :| :|: :|    ||  :  :  ||||:|
                                      MKVLLIIPAYNEEENILRTIASIETFKQEVTHFQHELDYVV
                                            10        20        30        40

486       516       546       576       606       636       666      696
        INDGSTDGTPELLDRLGLNHIDLVQNLGIGGCVQTGYLYANRNHYDVAVQFDGDGQHDIRSIEDVVMPILNDEADFVIGS
        ||||||||| ::|:   :|  || ||||||| |||||:|| :  |||||| |||||||| |:  ::|:       | ||
        INDGSTDGTKQILEVNQINAIHLVLNLGIGGAVQTGYKYALENEYDVAXQFDGDGXHDIXSLPILLEPLAEGXCXFSXGS
              60        70        80        90       100       110       120
```

-continued

```
726       756       786       816       846       876       906       936
RFVDKKHQNFQSTAMRRLGINLISAAIKLTTGHKVYDTTSGYRAANAALIAYLSCHYPVQYPEPESTARILKKGYRLKEV
||:      :|||     |||   ||   |:|          |:|  |  |  ||   |   :||:::    ||   ||||||      :||    :  :  |
RFIPGNXASFQSXKMRRXGIRLLSFCXXXAXGXTIYXVTXGXRAGNRKVIAFFAKRYPTNYPEPESIVHLIKKRFVIVER
                140       150       160       170       180       190       200

966       996       1026      1056      1086      1116      1146      1176
TANMFEREAGTSSISSLKSIFYMTDVLTSIIIAGFIKEDDK*V*HCKLKCLF*PLSYFI*L*EWLIKTHFLLNVLYLGY*
||  ||    |   |||    :|    |:    ||      :|     ::|:||    |:||    |
PVNMMERLGGVSSIRALASVKYMLEVGSAILIAPFMKEGD
            220       230       240
```

SEQ ID 8752 (GBS355) was expressed in *E. coli* as a His-fusion product. SDS-PAGE analysis of total cell extract is shown in FIG. 74 (lane 4; MW 27 kDa). It was also expressed in *E. coli* as a GST-fusion product. SDS-PAGE analysis of total cell extract is shown in FIG. 81 (lane 7; MW 52 kDa).

GBS355-GST was purified as shown in FIG. 213 (lane 4) and in FIG. 216 (lane 6).

Based on this analysis, it was predicted that these proteins and their epitopes could be useful antigens for vaccines or diagnostics.

Example 1219

A DNA sequence (GBSx1295) was identified in *S. agalactiae* <SEQ ID 3781> which encodes the amino acid sequence <SEQ ID 3782>. Analysis of this protein sequence reveals the following:

```
Possible site: 19
>>> Seems to have no N-terminal signal sequence
INTEGRAL     Likelihood = −1.91   Transmembrane 185-201 (185-201)
----- Final Results -----
   bacterial membrane --- Certainty = 0.1765 (Affirmative) <succ>
     bacterial outside --- Certainty = 0.0000 (Not Clear) <succ>
      bacterial cytoplasm --- Certainty = 0.0000 (Not Clear) <succ>
```

The protein has homology with the following sequences in the GENPEPT database.

```
>GP:BAA32090 GB:AB010970 rhamnosyltransferase [Streptococcus mutans]
Identities = 181/315 (57%), Positives = 244/315 (77%), Gaps = 7/315 (2%)
Query:    1  MKVNILMATYNGEKFLAQQIESIQKQTFKEWNLLIRDDGSSDKTCDIIRNFTAKDSRIRF      60
             MKVNILM+TYNG++F+AQQI+SIQKQTF+ WNLLIRDDGSSD T  II +F   D+RIRF
Sbjct:    1  MKVNILMSTYNGQEFIAQQIQSIQKQTFENWNLLIRDDGSSDGTPKIIADFAKSDARIRF      60

Query:   61  INENEHHNLGVIKSFFTLVNYEVADFYFFSDQDDVWLPEKLSVSLEAAKHKASDVPLLVY     120
             IN ++   N GVIK+F+TL+ YE AD+YFFSDQDDVWLP+KL ++L + + + + +PL+VY
Sbjct:   61  INADKRENFGVIKNFYTLLKYEKADYYFFSDQDDVWLPQKLELTLASVEKENNQIPLMVY     120

Query:  121  TDLKVVNQELNILQDSMIRAQSHHANTTLLPELTENTVTGGTMMINHALAEKW-FTPNDI     179
             TDL VV+++L +L DSMI+ QSHHANT+LL ELTENTVTGGTMM+NH LA++W   +D+
Sbjct:  121  TDLTVVDRDLQVLHDSMIKTQSHHANTSLLEELTENTVTGGTMMVNHCLAKQWKQCYDDL     180

Query:  180  LMHDWFLALLAASLGEIIYLDLPTQLYRQHDNNVLGARTMDKRFK-ILREGPKSIFTRYW     238
             +MHDW+LALLAASLG++IYLD  T+LYRQH++NVLGART  KR K  LR  P  +  +YW
Sbjct:  181  IMHDWYLALLAASLGKLIYLDETTELYRQHESNVLGARTWSKRLKNWLR--PHRLVKKYW     238

Query:  239  KLIHDSQKQASLIVDKYGDIMTANDLELIKCFIKIDKQPFMTRLRWLWKYGYSKNQFKHQ     298
              L+  SQ+QAS +++    D+  AN   +I+ ++ +   Q F+ R++WL +YG++KN+  H
Sbjct:  239  WLVTSSQQQASHLLEL--DLPAANK-AIIRAYVTLLDQSFLNRIKWLKQYGFAKNRAFHT     295

Query:  299  VVFKWLIATNYYNKR                                                  313
             VFK LI T +  +R
Sbjct:  296  FVFKTLIITKFGYRR                                                  310
```

A related DNA sequence was identified in *S. pyogenes* <SEQ ID 817> which encodes the amino acid sequence <SEQ ID 818>. Analysis of this protein sequence reveals the following:

```
Possible site: 43
>>> Seems to have no N-terminal signal sequence
----- Final Results -----
   bacterial cytoplasm --- Certainty = 0.1980 (Affirmative) <succ>
   bacterial membrane --- Certainty = 0.0000 (Not Clear) <succ>
   bacterial outside --- Certainty = 0.0000 (Not Clear) <succ>
```

```
Possible site: 21
>>> Seems to have no N-terminal signal sequence
----- Final Results -----
   bacterial cytoplasm --- Certainty = 0.1881 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below.

```
Identities = 178/314 (56%), Positives = 232/314 (73%), Gaps = 6/314 (1%)
Query:   1 MKVNILMATYNGEKFLAQQIESIQKQTFKEWNLLIRDDGSSDKTCDIIRNFTAKDSRIRF  60
           M +NIL++TYNGE+FLA+QI+SIQ+QT  +W LLIRDDGS+D T DIIR F  +D RI++
Sbjct:   1 MNINILLSTYNGERFLAEQIQSIQRQTVNDWTLLIRDDGSTDGTQDIIRTFVKEDKRIQW  60

Query:  61 INENEHHNLGVIKSFFTLVNYEVADFYFFSDQDDVWLPEKLSVS-LEAAKHKASDVPLLV 119
           INE +  NLGVIK+F+TL+ ++ AD YFFSDQDD+WL  KL V+ LEA KH+ +  PLLV
Sbjct:  61 INEGQTENLGVIKNFYTLLKHQKADVYFFSDQDDIWLDNKLEVTLLEAQKHEMT-APLLV 119

Query: 120 YTDLKVVNQELNILQDSMIRAQSHHANTTLLPELTENTVTGGTMMINHALAEKWFTPNDI 179
           YTDLKVV Q L + DSMI+ QS HANT+LL ELTENTVTGGTMMI HALAE+W T + +
Sbjct: 120 YTDLKVVTQHLAVCHDSMIKTQSGHANTSLLQELTENTVTGGTMMITHALAEEWTTCDGL 179

Query: 180 LMHDWFLALLAASLGEIIYLDLPTQLYRQHDNNVLGARTMDKRFKILREGPKSIFTRYWK 239
           LMHDW+LALLA+++G+++YLD+PT+LYRQHD NVLGART KR K   P +  +YW
Sbjct: 180 LMHDWYLALLASAIGKLVYLDIPTELYRQHDANVLGARTWSKRMKNWLT-PHHLVNKYWW 238

Query: 240 LIHDSQKQASLIVDKYGDIMTANDLELIKCFIKIDKQPFMTRLRWLWKYGYSKNQFKHQV 299
           LI  SQKQA L++D    + ND EL+ ++ +  PF RL  L +YG+ KN+ H
Sbjct: 239 LITSSQKQAQLLLDL---PLKPNDHELVTAYVSLLDMPFTKRLATLKRYGFRKNRIFHTF 295

Query: 300 VFKWLIATNYYNKR 313
           +F+ L+ T + +R
Sbjct: 296 IFRSLVVTLFGYRR 309
```

Based on this analysis, it was predicted that these proteins and their epitopes could be useful antigens for vaccines or diagnostics.

Example 1220

A DNA sequence (GBSx1296) was identified in *S. agalactiae* <SEQ ID 3783> which encodes the amino acid sequence <SEQ ID 3784>. This protein is predicted to be rgpAc. Analysis of this protein sequence reveals the following:

A related GBS nucleic acid sequence <SEQ ID 9993> which encodes amino acid sequence <SEQ ID 9994> was also identified.

The protein has homology with the following sequences in the GENPEPT database.

```
>GP:BAA32089 GB:AB010970 rgpAc [Streptococcus mutans]
Identities = 234/362 (64%), Positives = 284/362 (77%)
Query:  33 VSELINHQKSFDIKYHVACLSDKEHHTHFNFADADCFTINPPQLGPARVIAYDIMAINYA  92
           + EL+ +++S + YHVACLS+ + H HF +   DCFTI P+LGPARVIAYD+MAI YA
Sbjct:   1 MEELVKYKQSQQLTYHVACLSETDQHKHFTYLGVDCFTIKAPKLGPARVIAYDMMAIRYA  60

Query:  93 LDLVKTHDLKEPIFYILGNTIGAFIWHFANKIHKVGGLLYVNPDGLEWKRSKWSRPTQRY 152
           L L+K  +K PIFYILGNTIGAF+  FA KI ++GG  Y+NPDGLEW+RSKWSRP Q Y
Sbjct:  61 LKLIKDQKIKHPIFYILGNTIGAFMGPFARKIKRIGGRFYINPDGLEWRRSKWSRPVQAY 120

Query: 153 LKYAEKCMTKNADLIISDNIGIENYIQSTYSNVKTRFIAYGTEINSRKLSSDDPRVKQLF 212
           LKYAEKCMTK ADL+ISDN GIE YI+  Y   KT FIAYGT+++    L  +D +VK  +
Sbjct: 121 LKYAEKCMTKKADLVISDNTGIEGYIKQMYPWAKTTFIAYGTDLSPSGLLKNDSKVKDFY 180

Query: 213 KKWNIKSKGYYLIVGRFVPENNYETAIREFMASDTKRDLVIICNHQNNPYFEKLSLKTNL 272
           KKW IK KGYYLIVGRFVPENNYETAIREFM S ++RDLVIICN++ N YFE L  KT
Sbjct: 181 KKWAIKDKGYYLIVGRFVPENNYETAIREFMTSSSERDLVIICNYEGNAYFEDLRQKTEF 240

Query: 273 QQDKRVKFVGTLYEKDLLDYVRQQAFAYIHGHEVGGTNPGLLEALANTDLNLVLDVDFNK 332
           +DKR+KFVGT+Y++ LL Y+R+QAFAYIHGHEVGGTNPGLLEALA+TDLNLVL  +FN
Sbjct: 241 DKDKRIKFVGTVYDRPLLTYIREQAFAYIHGHEVGGTNPGLLEALAHTDLNLVLITEFNY 300
```

-continued
```
Query: 333 SVAGLSSFYWAKKEGDLAKLINDSDQQQDLSTYGDRAKAIIQENYTWKKIVEEYEDLFLN 392
            +VA  ++ YW +  G LA+LIN  D+Q++ + YG RAK II    YTW+KIVEEYEDLFL+
Sbjct: 301 TVALDAARYWTQNGSLAQLINQFDKQENFAEYGQRAKEIIVNYYTWEKIVEEYEDLFLH 360

Query: 393 ES                                                           394
            ES
Sbjct: 361 ES                                                           362
```

A related DNA sequence was identified in *S. pyogenes* <SEQ ID 3785> which encodes the amino acid sequence <SEQ ID 3786>. Analysis of this protein sequence reveals the following:

Possible site: 23
>>> Seems to have no N-terminal signal sequence
INTEGRAL    Likelihood = −1.38    Transmembrane 95-111 (95-111)
----- Final Results -----
   bacterial membrane --- Certainty = 0.1553 (Affirmative) <succ>
     bacterial outside --- Certainty = 0.0000 (Not Clear) <succ>
       bacterial cytoplasm --- Certainty = 0.0000 (Not Clear) <succ>

An alignment of the GAS and GBS proteins is shown below.

```
Identities = 250/383 (65%), Positives = 307/383 (79%)
Query:  11 MQDVFIIGSRGLPARYGGFETFVSELINHQKSFDIKYHVACLSDKEHHTHFNFADADCFT  70
           MQDVFIIGSRGLPA+YGGFETFV  ELI+HQ S +I+YHVACLSD +H   HF++   ADCF
Sbjct:   1 MQDVFIIGSRGLPAKYGGFETFVEELISHQSSKNIRYHVACLSDTKHKVHFDYKGADCFY  60

Query:  71 INPPQLGPARVIAYDIMAINYALDLVKTHDLKEPIFYILGNTIGAFIWHFANKIHKVGGL 130
           +NPP+LGPARVIAYD+MAI YAL     H ++ PIFY+LGNT+GAFI  F   +IH  GG
Sbjct:  61 LNPPKLGPARVIAYDMMAITYALSYSDQHQIQNPIFYVLGNTVGAFIAPFVKQIHNRGGR 120

Query: 131 LYVNPDGLEWKRSKWSRPTQRYLKYAEKCMTKNADLIISDNIGIENYIQSTYSNVKTRFI 190
             ++NPDGLEWKRSKWSRP Q YLK++EK MT+ ADL+ISDNIGI+ Y++   Y    KT FI
Sbjct: 121 FFINPDGLEWKRSKWSRPVQAYLKFSEKQMTRQADLVISDNIGIDRYLKQVYPWSKTCFI 180

Query: 191 AYGTEINSRKLSSDDPRVKQLFKKWNIKSKGYYLIVGRFVPENNYETAIREFMASDTKRD 250
           AYGT+     +L++ D  +V+   F+ ++I+ K YYLI+GRFVFENNYETAI+EFMAS TKRD
Sbjct: 181 AYGTQTQPSRLATADSKVRAYFQTFDIREKDYYLILGRFVPENNYETAIKEFMASSTKRD 240

Query: 251 LVIICNHQNNPYFEKLSLKTNLQQDKRVKFVGTLYEKDLLDYVRQQAFAYIHGHEVGGTN 310
           LVIICNH+ N YF++L   +T    +D R+KFVGTLY+K+LL Y+R+QA+AYIHGHEVGGTN
Sbjct: 241 LVIICNHEGNAYFKQLLAETECDKDPRIKFVGTLYDKELLAYIREQAYAYIHGHEVGGTN 300

Query: 311 PGLLEALANTDLNLVLDVDFNKSVAGLSSFYWAKKEGDLAKLINDSDQQQDLSTYGDRAK 370
           PGLLEALA+T+LNLVL VDFN+SVA  ++ YW K++G LA+LIN D      G AK
Sbjct: 301 PGLLEALAHTNLNLVLGVDFNQSVAKSAALYWTKQKGQLAELINQVDAGFDSDHLGKEAK 360

Query: 371 AIIQENYTWKKIVEEYEDLFLNE                                      393
           AIIQE+YTW+KIV EYE LFLNE
Sbjct: 361 AIIQEHYTWEKIVGEYEALFLNE                                      383
```

<SEQ ID 3788>. This protein is predicted to be dTDP-L-rhamnose synthase. Analysis of this protein sequence reveals the following:

Possible site: 61
>>> Seems to have no N-terminal signal sequence
----- Final Results -----
   bacterial cytoplasm --- Certainty = 0.1059 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database.

Based on this analysis, it was predicted that these proteins and their epitopes could be useful antigens for vaccines or diagnostics.

Example 1221

A DNA sequence (GBSx1297) was identified in *S. agalactiae* <SEQ ID 3787> which encodes the amino acid sequence

```
>GP:AAD10184 GB:AF026471 Cps20 [Streptococcus pneumoniae]
Identities = 258/283 (91%), Positives = 274/283 (96%)
Query:   1 MILITGANGQLGSELRHLLDERTQEYVAVDVAEMDITNAEMVDKVFEEVKPSLVYHCAAY  60
           MILITGANGQLG+ELR+LLDER +EYVAVDVAEMDIT+AEMV+KVFEEVKP LVYHCAAY
Sbjct:   1 MILITGANGQLGTELRYLLDERNEEYVAVDVAEMDITDAEMVEKVFEEVKPTLVYHCAAY  60

Query:  61 TAVDAAEDEGKELDFAINVTGTENVAKAAAKHDATLVYISTDYVFDGEKPVGQEWEVDDL 120
           TAVDAAEDEGKELDFAINVTGT+NVAKA+ KH ATLVYISTDYVFDG+KPVGQEWEVDD
```

```
                              -continued
Sbjct:   61  TAVDAAEDEGKELDFAINVTGTKNVAKASEKHGATLVYISTDYVFDGKKPVGQEWEVDDR  120

Query:  121  PDPKTEYGRTKRMGEELVEKYTSKFYTIRTAWVFGNYGKNFVFTMQNLAKTHKTLTVVND  180
             PDP+TEYGRTKRMGEELVEK+ S FY IRTAWVFGNYGKNFVFTMQNLAKTHKTLTVVND
Sbjct:  121  PDPQTEYGRTKRMGEELVEKHVSNFYIIRTAWVFGNYGKNFVFTMQNLAKTHKTLTVVND  180

Query:  181  QHGRPTWTRTLAEFMTYLAENQKDFGYYHLSNDAKEDTTWYDFAVEILKDTDVEVKPVDS  240
             Q+GRPTWTRTLAEFMTYLAEN+K+FGYYHLSNDA EDTTWYDFAVEILKDTDVEVKPVDS
Sbjct:  181  QYGRPTWTRTLAEFMTYLAENRKEFGYYHLSNDATEDTTWYDFAVEILKDTDVEVKPVDS  240

Query:  241  SQFPAKAKRPLNSTMSLEKAKATGFVIPTWQDALKEFYKQEVK                  283
             SQFPAKAKRPLNSTMSL KAKATGFVIPTWQDAL+EFYKQEV+
Sbjct:  241  SQFPAKAKRPLNSTMSLAKAKATGFVIPTWQDALQEFYKQEVR                  283
```

A related DNA sequence was identified in *S. pyogenes* <SEQ ID 3789> which encodes the amino acid sequence <SEQ ID 3790>. Analysis of this protein sequence reveals the following:

```
Possible site: 32
>>> Seems to have no N-terminal signal sequence
----- Final Results -----
   bacterial cytoplasm --- Certainty = 0.0618 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below.

```
Identities = 227/284 (79%), Positives = 248/284 (86%)
Query:    1  MILITGANGQLGSELRHLLDERTQEYVAVDVAEMDITNAEMVDKVFEEVKPSLVYHCAAY   60
             MILITG+NGQLG+ELR+LLDER  +YVAVDVAEMDITN + V+ VF +VKP+LVYHCAAY
Sbjct:   21  MILITGSNGQLGTELRYLLDERGVDYVAVDVAEMDITNEDKVEAVFAQVKPTLVYHCAAY   80

Query:   61  TAVDAAEDEGKELDFAINVTGTENVAKAAAKHDATLVYISTDYVFDGEKPVGQEWEVDDL  120
             TAVDAAEDEGK L+ AINVTG+EN+AKA   K+ ATLVYISTDYVFDG KPVGQEW    D
Sbjct:   81  TAVDAAEDEGKALNEAINVTGSENIAKACGKYGATLVYISTDYVFDGNKPVGQEWVETDH  140

Query:  121  PDPKTEYGRTKRMGEELVEKYTSKFYTIRTAWVFGNYGKNFVFTMQNLAKTHKTLTVVND  180
             PDPKTEYGRTKR+GE  VE+Y   FY IRTAWVFGNYGKNFVFTM+ LA+ H  LTVVND
Sbjct:  141  PDPKTEYGRTKRLGELAVERYAEHFYIIRTAWVFGNYGKWFVFTMEQLAENHSRLTVVND  200

Query:  181  QHGRPTWTRTLAEFMTYLAENQKDFGYYHLSNDAKEDTTWYDFAVEILKDTDVEVKPVDS  240
             QHGRPTWTRTLAEFM YL ENQK FGYYHLSNDAKEDTTWYDFA EILKD  VEV PVDS
Sbjct:  201  QHGRPTWTRTLAEFMCYLTENQKAFGYYHLSNDAKEDTTWYDFAKEILKDKAVEVVPVDS  260

Query:  241  SQFPAKAKRPLNSTMSLEKAKATGFVIPTWQDALKEFYKQEVKK                 284
             S FPAKAKRPLNSTM+L+KAKATGFVIPTWQ+ALK FY+Q +KK
Sbjct:  261  SAFPARAKRPLNSTMNLDKAKATGFVIPTWQEALKAFYQQGLKK                 304
```

Based on this analysis, it was predicted that these proteins and their epitopes could be useful antigens for vaccines or diagnostics.

Example 1222

A DNA sequence (GBSx1298) was identified in *S. agalactiae* <SEQ ID 3791> which encodes the amino acid sequence <SEQ ID 3792>. Analysis of this protein sequence reveals the following:

```
Possible site: 32
>>> Seems to have no N-terminal signal sequence
----- Final Results -----
   bacterial cytoplasm --- Certainty = 0.2554 (Affirmative) <succ>
   bacterial membrane --- Certainty = 0.0000 (Not Clear) <succ>
   bacterial outside --- Certainty = 0.0000 (Not Clear) <succ>
```

The protein has homology with the following sequences in the GENPEPT database.

```
>GP:BAA21508 GB:AB000631 unnamed protein product [Streptococcus mutans]
Identities = 92/108 (85%), Positives = 100/108 (92%)
Query:    5  KQYSEEEVGKIKDRILEALEMVIDPELGIDIVNLGLIYEIRFEDNGRTEIDMTLTTMGCP   64
             K Y+ EE+ KIKDRILEALEMVIDPELGIDIVNLGLIY+IRFED+GRTEIDMTLTTMGCP
Sbjct:    4  KNYTPEEIAKIKDRILEALEMVIDPELGIDIVNLGLIYDIRFEDSGRTEIDMTLTTMGCP   63

Query:   65  LADLLTDQIHDVMKTVPEVTETEVKLVWYPAWSVDKMSRYARIALGIR             112
             LADLLTDQIHD +K VPEV + +VKLVW PAW+VDKMSRYARIALGIR
Sbjct:   64  LADLLTDQIHDALKDVPEVLDIDVKLVWSPAWTVDKMSRYARIALGIR             111
```

A related DNA sequence was identified in *S. pyogenes* <SEQ ID 3793> which encodes the amino acid sequence <SEQ ID 3794>. Analysis of this protein sequence reveals the following:

```
Possible site: 32
>>> Seems to have no N-terminal signal sequence
----- Final Results -----
   bacterial cytoplasm --- Certainty = 0.2818 (Affirmative) <succ>
   bacterial membrane --- Certainty = 0.0000 (Not Clear) <succ>
   bacterial outside --- Certainty = 0.0000 (Not Clear) <succ>
```

```
Possible site: 54
>>> Seems to have no N-terminal signal sequence
----- Final Results -----
   bacterial cytoplasm --- Certainty = 0.3157 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below.

The protein is similar to the sigma-42 protein from *S. mutans*:

```
Identities = 90/112(80%), Positives = 102/112(90%)
Query:   1  MSEVKQYSEEEVGKIKDRILEALEMVIDPELGIDIVNLGLIYEIRFEDNGRTEIDMTLTT   60
            MS+  +Y++++V  IK+RILEALE VIDPELGID+VNLGLIYEIRF DNG TEIDMTLTT
Sbjct:   1  MSDTPKYTQDQVIAIKNRILEALETVIDPELGIDVVNLGLIYEIRFNDNGYTEIDMTLTT   60

Query:  61  MGCPLADLLTDQIHDVMKTVPEVTETEVKLVWYPAWSVDKMSRYARIALGIR         112
            MGCPLADLLTD IHD ++ VPEVT+TEVKLVWYPAW+VDKMSRYARIALGIR
Sbjct:  61  MGCPLADLLTDYIHDALQDVPEVTKTEVKLVWYPAWTVDKMSRYARIALGIR         112
```

Based on this analysis, it was predicted that these proteins and their epitopes could be useful antigens for vaccines or diagnostics.

Example 1223

A DNA sequence (GBSx1299) was identified in *S. agalactiae* <SEQ ID 3795> which encodes the amino acid sequence <SEQ ID 3796>. This protein is predicted to be RNA polymerase sigma factor, sigma-70 family (rpoD). Analysis of this protein sequence reveals the following:

```
>GP:BAA21507 GB:AB000631 sigma 42 protein [Streptococcus mutans]
Identities = 345/367 (94%), Positives = 358/367 (97%)
Query:   14  EKKGNTTFNVQVADFIRNHKKQGTAIDDEVTEKLVIPFVLDADQIDDLLERLTDGGISIT    73
             +KK ++TFNVQVADFIRNHKK+G A+DDEVTEKLVIPF L+A+QIDDLLERLTDGGISIT
Sbjct:    5  KKKTSSTFNVQVADFIRNHKKEGVAVDDEVTEKLVIPFELEAEQIDDLLERLTDGGISIT    64

Query:   74  DKEGNPSTKYVVEGPKPEELTDEELIGSNSAKVNDPVRMYLKEIGVVPLLTNEEEKELAV   133
             D+EGNPSTKY VE  KPEELTDEEL+GSNSAKVNDPVRMYLKEIGVVPLLTNEEEKELA+
Sbjct:   65  DREGNPSTKYAVEEIKPEELTDEELLGSNSAKVNDPVRMYLKEIGVVPLLTNEEEKELAI   124

Query:  134  AVAEGDLMAKQRLAEANLRLVVSIAKRYVGRGMQFLDLIQEGNMGLMKAVDKFDYSKGFK   193
             AV  GDL AKQRLAEANLRLVVSIA+RYVGRGMQFLDLIQEGNMGLMKAVDKFDYSKGFK
Sbjct:  125  AVENGDLEAKQRLAEANLRLVVSIARRYVGRGMQFLDLIQEGNMGLMKAVDKFDYSKGFK   184

Query:  194  FSTYATWWIRQAITRAIADQARTIRIPVHMVETINKLVREQRNLLQELGQDPTPEQIAER   253
             FSTYATWWIRQAITRAIADQARTIRIPVHMVETINKLVREQRNLLQELGQDPTPEQIAER
Sbjct:  185  FSTYATWWIRQAITRAIADQARTIRIPVHMVETINKLVREQRNLLQELGQDPTPEQIAER   244

Query:  254  MDMTPDKVREILKIAQEPVSLETPIGEEDDSHLGDFIEDEVIENPVDYTTRVVLREQLDE   313
             MDMTPDKVREILKIAQEPVSLETPIGEEDDSHLGDFIEDEVIENPVDYTTRVVLREQLDE
Sbjct:  245  MDMTPDKVREILKIAQEPVSLETPIGEEDDSHLGDFIEDEVIENPVDYTTRVVLREQLDE   304

Query:  314  VLDTLTDREENVLRLRFGLDDGKMRTLEDVGKVFNVTRERIRQIEAKALRKLRHPSRSKQ   373
             VLDTLTDREENVLRLRFGLDDGKMRTLEDVGKVF+VTRERIRQIEAKALRKLRHPSRSKQ
Sbjct:  305  VLDTLTDREENVLRLRFGLDDGKMRTLEDVGKVFDVTRERIRQIEAKALRKLRHPSRSKQ   364

Query:  374  LKDFMED   380
             L+DF+ED
Sbjct:  365  LRDFVED   371
```

A related DNA sequence was identified in *S. pyogenes* <SEQ ID 3797> which encodes the amino acid sequence <SEQ ID 3798>. Analysis of this protein sequence reveals the following:

```
Possible site: 43
>>> Seems to have no N-terminal signal sequence
----- Final Results -----
   bacterial cytoplasm --- Certainty = 0.1788 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below.

```
Identities = 351/369 (95%), Positives = 364/369 (98%)
Query:  12  MAEKKGNTTFNVQVADFIRNHKKQGTAIDDEVTEKLVIPFVLDADQIDDLLERLTDGGIS   71
            M ++K  TTENVQVA+FIR+HKK+GTAIDD+VTEKLVIPF LDADQIDDLLERLTDGGIS
Sbjct:   1  MTKQKEITTENVQVAEFIRHHKKEGTAIDDDVTEKLVIPFALDADQIDDLLERLTDGGIS   60

Query:  72  ITDKEGNPSTKYVVEGPKPEELTDEELIGSNSAKVNDPVRMYLKEIGVVPLLTNEEEKEL  131
            ITDKEGNPS+KY+VE PKPEELTDEELIGSNSAKVNDPVRMYLKEIGVVPLLT+EEEKEL
Sbjct:  61  ITDKEGNPSSKYIVEEPKPEELTDEELIGSNSAKVNDPVRMYLKEIGVVPLLTSEEEKEL  120

Query: 132  AVAVAEGDLMAKQRLAEANLRLVVSIAKRYVGRGMQFLDLIQEGNMGLMKAVDKFDYSKG  191
            AVAVA+GDLMAKQRLAEANLRLVVSIAKRYVGRGMQFLDLIQEGNMGLMKAVDKEDYSKG
Sbjct: 121  AVAVAKGDLMAKQRLAEANLRLVVSIAKRYVGRGMQFLDLIQEGNMGLMKAVDKEDYSKG  180

Query: 192  FKFSTYATWWIRQAITRAIADQARTIRIPVHMVETINKLVREQRNLLQELGQDPTPEQIA  251
            FKFSTYATWWIRQAITRAIADQARTIRIPVHMVETINKLVREQRNLLQELGQDPTPEQIA
Sbjct: 181  FKFSTYATWWIRQAITRAIADQARTIRIPVHMVETINKLVREQRNLLQELGQDPTPEQIA  240

Query: 252  ERMDMTPDKVREILKIAQEPVSLETPIGEEDDSHLGDFIEDEVIENPVDYTTRVVLREQL  311
            ERM+MTPDKVREILKIAQEPVSLETPIGEEDDSHLGDFIEDEVIENPVDYTTRVVLREQL
Sbjct: 241  ERMEMTPDKVREILKIAQEPVSLETPIGEEDDSHLGDFIEDEVIENPVDYTTRVVLREQL  300

Query: 312  DEVLDTLTDREENVLRLRFGLDDGKMRTLEDVGKVFNVTRERIRQIEAKALRKLRHPSRS  371
            DEVLDTLTDREENVLRLRFGLDDGKMRTLEDVGKVFNVTRERIRQIEAKALRKLRHPSRS
Sbjct: 301  DEVLDTLTDREENVLRLRFGLDDGKMRTLEDVGKVFNVTRERIRQIEAKALRKLRHPSRS  360

Query: 372  KQLKDFMED                                                    380
            KQL+DF+ED
Sbjct: 361  KQLRDFIED                                                    369
```

Based on this analysis, it was predicted that these proteins and their epitopes could be useful antigens for vaccines or diagnostics.

Example 1224

A DNA sequence (GBSx1300) was identified in *S. agalactiae* <SEQ ID 3799> which encodes the amino acid sequence <SEQ ID 3800>. Analysis of this protein sequence reveals the following:

```
Possible site: 14
>>> Seems to have no N-terminal signal sequence
----- Final Results -----
   bacterial cytoplasm --- Certainty = 0.2853 (Affirmative) <succ>
   bacterial membrane --- Certainty = 0.0000 (Not Clear) <succ>
   bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1225

A DNA sequence (GBSx1301) was identified in *S. agalactiae* <SEQ ID 3801> which encodes the amino acid sequence <SEQ ID 3802>. Analysis of this protein sequence reveals the following:

```
Possible site: 40
>>> Seems to have no N-terminal signal sequence
----- Final Results -----
   bacterial cytoplasm --- Certainty = 0.2198 (Affirmative) <succ>
   bacterial membrane --- Certainty = 0.0000 (Not Clear) <succ>
   bacterial outside --- Certainty = 0.0000 (Not Clear) <succ>
```

The protein has homology with the following sequences in the GENPEPT database.

```
>GP:BAA03516 GB:D14690 DNA primase [Lactococcus lactis]
Identities = 206/398 (51%), Positives = 294/398 (73%), Gaps = 6/398 (1%)
Query:  37  LAIDKEKISEIKNSVNIVDVIGEVVGLTKTGRNHLGLCPFHKEKTPSFNVIEDRQFFHCF   96
            +++D E ++++K+ VNI D+I + V L++TG+N++GLCPFH EKTPSFNV   F+HCF
Sbjct:   2  VSLDTEVVNDLKSKVNIADLISQYVALSRTGKNYIGLCPFHGEKTPSFNVNAEKGFYHCF   61
```

-continued

```
Query:   97 GCGRSGDVFKFVEDYQHISFLDSVQVLAERSGIPLDTNFKGQVPKKPKANQSLLDIHRVA  156
            GCGRSGD +F+++Y    +F+D+V+ LA+ +G+ L  N      +K   N  L +I+  A
Sbjct:   62 GCGRSGDAIEFLKEYNQVGFVDAVKELADFAGVTL--NISDDREEKNNPNAPLFEINNQA  119

Query:  157 SGFYHAYLMTTNDGERARQYLAERGVTEDLIKHFQIGLSPGGQDFLYRRLAKEFDEKTLM  216
            + Y+ LM+T GERAR+YL ERG+T+D+IK F IGL+P   DF+++ L+ +FDE+ +
Sbjct:  120 ARLYNILLMSTELGERARKYLEERGITDDVIKRFNIGLAPEENDFIFKNLSNKFDEEIMA  179

Query:  217 SSGLFNYSENSNQFYDSFNNRIMFPLTNDIGEVIAFSGRVWTQEDIDRKQAKYKNSRATP  276
              SGLF++S  +N+ +D+F NRIMFP+TN+ G+ I FSGR W QE+ D K AKY N+ AT
Sbjct:  180 KSGLFHFS--NNKVFDAFTNRIMFPITNEYGQTIGFSGRKW-QENDDSK-ARYINTSATT  235

Query:  277 IFNKSYELYHLDKARAVINKAHEVYLMEGFMDVIAAYRAGIENVVASMGTALTNEHVRHL  336
            IF+KSYEL++LDKA+  I+K HEVYLMEGFMDVIA+Y+AGI NVVASMGTALT +HVR L
Sbjct:  236 IFDKSYELWNLDKAKPTISKQHEVYLMEGFMDVIASYKAGINNVVASMGTALTEKHVRRL  295

Query:  337 KRFTKKVVLTYDGDRAGQNAIDKSLELLSDMTVDIVRIPNKMDPDEFLQANSAEDFKQLL  396
            K+  KK VL YDGD AGQNAI K+++L+ +  V  IV++P  +DPDE+ +        L+
Sbjct:  296 KQMAKKFVLVYDGDSAGQNAIYKAIDLIGESAVQIVKVPEGLDPDEYSKNYGLKGLSALM  355

Query:  397 ENGRISNTEFYIHYLKPENTDNLQSEIAYVEKIAKLIA  434
            E GRI   EF I YL+PEN  NLQ+++ ++E+I+ +IA
Sbjct:  356 ETGRIQPIEFLIDYLRPENLANLQTQLDFIEQISPMIA  393
```

A related DNA sequence was identified in *S. pyogenes* <SEQ ID 3803> which encodes the amino acid sequence <SEQ ID 3804>. Analysis of this protein sequence reveals the following:

Possible site: 13

>>> Seems to have no N-terminal signal sequence

----- Final Results ----- bacterial cytoplasm --- Certainty = 0.3532 (Affirmative) <succ>

-continued bacterial membrane --- Certainty = 0.0000 (Not Clear) <succ> bacterial outside --- Certainty = 0.0000 (Not Clear) <succ>

An alignment of the GAS and GBS proteins is shown below.

```
Identities = 378/604 (62%), Positives = 477/604 (78%), Gaps = 2/604 (0%)
Query:   28 MGYFCGGHDLAIDKEKISEIKNSVNIVDVIGEVVGLTKTGRNHLGLCPFHKEKTPSFNVI   87
            MG+   GG DLAIDKE IS++KNSVNIVDVIGEVV L+++GR++LGLCPFHKEKTPSFNV+
Sbjct:    1 MGFLWGGDDLAIDKEMISQVKNSVNIVDVIGEVVKLSRSGRHYLGLCPFHKEKTPSFNVV   60

Query:   88 EDRQFFHCFGCGRSGDVFKFVEDYQHISFLDSVQVLAERSGIPLDTNFKGQV--PKKPKA  145
            EDRQFFHCFGCG+SGDVFKF+E+Y++    FL+SVQ++A+++G+ L+         V  +
Sbjct:   61 EDRQFFHCFGCGKSGDVFKFIEEYRQVPFLESVQIIADKTGMSLNIPPSQAVLASQHKHP  120

Query:  146 NQSLLDIHRVASGFYHAYLMTTNDGERARQYLAERGVTEDLIKHFQIGLSPGGQDFLYRR  205
            N +L+ +H  A+ FYHA LMTT  G+ AR+YL +RG+ + LI+HF IGL+P   D+LY++
Sbjct:  121 NHALMTLHEDAAKFYHAVLMTTTIGQEARKYLYQRGLDDQLIEHFNIGLAPDESDYLYQA  180

Query:  206 LAKEFDEKTLMSSGLFNYSENSNQFYDSFNNRIMFPLTNDIGEVIAFSGRVWTQEDIDRK  265
            L+K+++E  L++SGLF+ S+ SN  YD+F NRIMFPL++D G +IAFSGR+WT D++++
Sbjct:  181 LSKKYEEGQLVASGLFHLSDQSNTIYDAFRNRIMFPLSDDRGHIIAFSGRIWTAADMEKR  240

Query:  266 QAKYKNSRATPIFNKSYELYHLDKARAVINKAHEVYLMEGFMDVIAAYRAGIENVVASMG  325
            QAKYKNSR T +FNKSYELYHLDKAR VI K HEV+LMEGFMDVIAAYR+G EN VASMG
Sbjct:  241 QAKYKNSRGTVLFNKSYELYHLDKARPVIAKTHEVFLMEGFMDVIAAYRSGYENAVASMG  300

Query:  326 TALTNEHVRHLKRFTKKVVLTYDGDRAGQNAIDKSLELLSDMTVDIVRIPNKMDPDEFLQ  385
            TALT EHV HLK+ TKKVVL YDGD AGQ+AI KSLELL D  V+IVRIPNKMDPDEF+Q
Sbjct:  301 TALTQEHVNHLKQVTKKVVLIYDGDDAGQHAIAKSLELLKDFVVEIVRIPNKMDPDEFVQ  360

Query:  386 ANSAEDFKQLLENGRISNTEFYIHYLKPENTDNLQSEIAYVEKIAKLIAKSPSITAQNSY  445
             +S E F  LL+  RIS+ EF+I YLKP N DNLQS+I YVEK+A LIA+SPSITAQ+SY
Sbjct:  361 RHSPEAFADLLKQSRISSVEFFIDYLKPTNVDNLQSQIVYVEKMAPLIAQSPSITAQHSY  420

Query:  446 ITKVAELLPDFDYFQVEQSVNNERLHHRSQQQASSSVQTSATVQLPQTGKLSAITKTEMQ  505
            I K+A+LLP+FDYFQVEQSVN  R+   R + Q    S  V LP   L+AI KTE
Sbjct:  421 INKIADLLPNFDYFQVEQSVNALRIQDRQKHQGQIAQAVSNLVTLPMPKSLTAIAKTESH  480

Query:  506 LFHRLLNHPYLLNEFRNRDNFYFDTTEIQVLYELLKESGEITSYDLSQESDKVNRTYYII  565
            L HRLL+H YLLNEFR+RD+FYFDT+ +++LY+ LK+ G ITSYDLS+ S++VNR YY +
Sbjct:  481 LMHRLLHHDYLLNEFRHRDDFYFDTSTLELLYQRLKQQGHITSYDLSEMSEEVNRAYYNV  540
```

```
                                    -continued
Query:  566 LEEQLPVEVSIGEIEAVEKARDRLLKERDLRKQSQLIRQSSNQGDEEGALAALENLIAQK  625
            LEE LP EV++GEI+ +   R +LL ERDL KQ + +R+SSN+GD + AL  LE+ IAQK
Sbjct:  541 LEENLPKEVALGEIDDILSKRAKLLAERDLHKQGKKVRESSNKGDHQAALEVLEHFIAQK  600

Query:  626 RNME                                                          629
            R ME
Sbjct:  601 RKME                                                          604
```

Based on this analysis, it was predicted that these proteins and their epitopes could be useful antigens for vaccines or diagnostics.

Example 1226

A DNA sequence (GBSx1302) was identified in *S. agalactiae* <SEQ ID 3805> which encodes the amino acid sequence <SEQ ID 3806>. Analysis of this protein sequence reveals the following:

---

Possible site: 47
>>> Seems to have no N-terminal signal sequence
INTEGRAL     Likelihood = −6.05     Transmembrane 41-57 (34-58)
INTEGRAL     Likelihood = −5.79     Transmembrane 93-109 (90-112)
----- Final Results -----
   bacterial membrane --- Certainty = 0.3421 (Affirmative) <succ>
     bacterial outside --- Certainty = 0.0000 (Not Clear) <succ>
       bacterial cytoplasm --- Certainty = 0.0000 (Not Clear) <succ>

---

A related GBS nucleic acid sequence <SEQ ID 9995> which encodes amino acid sequence <SEQ ID 9996> was also identified.

The protein has homology with the following sequences in the GENPEPT database.

```
>GP:AAC38560 GB:AF029731 large conductance mechanosensitive channel
[Staphylococcus aureus]
Identities = 64/126 (50%), Positives = 83/126 (65%), Gaps = 8/126 (6%)
Query:   23 MIKELKEFLFKGNVLDLAVAVILGAAFNAIITSLVKDVITPLILNPVLKAAGVSNIA-QL   81
            M+KE KEF  KGNVLDLA+AV++GAAFN II+SLV+++I PLI    K  G  + A +
Sbjct:    1 MLKEFKEFALKGNVLDLAIAVVMGAAFNKIISSLVENIIMPLI----GKIFGSVDFAKEW  56

Query:   82 SWNGVAYGNFLSAVINFLIVGTTLFFIVKAANKVMAKKPAEEEIIEVVEPTQEQLLAEIR  141
            S+ G+ YG F+ +VI+F+I+   LF  VK AN +M K+ AEE   E V     LL EIR
Sbjct:   57 SFWGIKYGLFIQSVIDFIIIAFALFIFVKIANTLMKKEEAEE---EAVVEENVVLLTEIR  113

Query:  142 DLLANK                                                        147
            DLL  K
Sbjct:  114 DLLREK                                                        119
```

A related DNA sequence was identified in *S. pyogenes* <SEQ ID 3807> which encodes the amino acid sequence <SEQ ID 3808>. Analysis of this protein sequence reveals the following:

---

Possible site: 28

>>> Seems to have a cleavable N-term signal seq.

INTEGRAL     Likelihood = −5.95     Transmembrane 71-87 (67-90)

----- Final Results ----- bacterial membrane --- Certainty = 0.3378 (Affirmative) <succ>
     bacterial outside --- Certainty = 0.0000 (Not Clear) <succ>
       bacterial cytoplasm --- Certainty = 0.0000 (Not Clear) <succ>

---

The protein has homology with the following sequences in the databases:

```
>GP:CAB15653 GB:Z99122 similar to large conductance mechanosensitive
channel protein [Bacillus subtilis]
Identities = 61/126 (48%), Positives = 77/126 (60%), Gaps = 7/126 (5%)
Query:    1 MVKELKAFLFRGNIIELAVAVIIGGAFGAIVTSFVNDIITPLILNPALKAANVENITQLS   60
            M  E KAF  RGNI++LA+ V+IGGAFG IVTS VNDII PL+    L    +  ++
Sbjct:    1 MWNEFKAFAMRGNIVDLAIGVVIGGAFGKIVTSLVNDIIMPLV-GLLLGGLDFSGLSFTF  59

Query:   61 WNG-VKYGSFLGAVINFLIIGTSLFFVVKAAEKAMPKKE-----KEAAAPTQEELLTEIR  114
             +  VKYGSF+  ++NFLII  S+F V++         KKE       E A   QEELL EIR
Sbjct:   60 GDAVVKYGSFIQTIVNFLIISFSIFIVIRTLNGLRRKKEAEEEAAEEAVDAQEELLKEIR  119

Query:  115 DLLAQK                                                        120
            DLL Q+
Sbjct:  120 DLLKQQ                                                        125
```

An alignment of the GAS and GBS proteins is shown below.

```
Identities = 86/125 (68%), Positives = 99/125 (78%), Gaps = 5/125 (4%)
Query:  23  MIKELKEFLFKGNVLDLAVAVILGAAFNAIITSLVKDVITPLILNPVLKAAGVSNIAQLS   82
            M+KELK FLF+GN+++LAVAVI+G AF AI+TS V D+ITPLILNP LKAA V NI QLS
Sbjct:   1  MVKELKAFLFRGNIIELAVAVIIGGAFGAIVTSFVNDIITPLILNPALKAANVENITQLS   60

Query:  83  WNGVAYGNFLSAVINFLIVGTTLFFIVKAANKVMAKKPAEEEIIEVVEPTQEQLLAEIRD  142
            WNGV  YG+FL AVINFLI+GT+LFF+VKAA K M KK       E    PTQE+LL EIRD
Sbjct:  61  WNGVKYGSFLGAVINFLIIGTSLFFVVKAAEKAMPKKEK-----EAAAPTQEELLTEIRD  115

Query: 143  LLANK                                                         147
            LLA K
Sbjct: 116  LLAQK                                                         120
```

A related GBS gene <SEQ ID 8753> and protein <SEQ ID 8754> were also identified. Analysis of this protein sequence reveals the following:

Lipop: Possible site: −1    Crend: 10
SRCFLG: 0
McG: Length of UR: 4
Peak Value of UR: 2.96
Net Charge of CR: 1
McG: Discrim Score: 4.39
GvH: Signal Score (−7.5): −1.79
Possible site: 25
>>> Seems to have a cleavable N-term signal seq.
Amino Acid Composition: calculated from 26
ALOM program    count: 1 value: −5.79 threshold: 0.0
INTEGRAL       Likelihood = −5.79   Transmembrane 71-87 (68-90)
PERIPHERAL     Likelihood = 1.06    28
modified ALOM score: 1.66
icml HYPID: 7 CFP: 0.331
*** Reasoning Step: 3
----- Final Results -----
    bacterial membrane --- Certainty = 0.3314 (Affirmative) <succ>
        bacterial outside --- Certainty = 0.0000 (Not Clear) <succ>
            bacterial cytoplasm --- Certainty = 0.0000 (Not Clear) <succ>

The protein has homology with the following sequences in the databases:

SEQ ID 8754 (GBS354) was expressed in *E. coli* as a His-fusion product. SDS-PAGE analysis of total cell extract is shown in FIG. 74 (lane 3; MW 17 kDa).

Based on this analysis, it was predicted that these proteins and their epitopes could be useful antigens for vaccines or diagnostics.

Example 1227

A DNA sequence (GBSx1303) was identified in *S. agalactiae* <SEQ ID 3809> which encodes the amino acid sequence <SEQ ID 3810>. This protein is predicted to be 30S ribosomal protein S21-related protein. Analysis of this protein sequence reveals the following:

Possible site: 29
>>> Seems to have no N-terminal signal sequence
----- Final Results -----
    bacterial cytoplasm --- Certainty = 0.6479 (Affirmative) <succ>
        bacterial membrane --- Certainty = 0.0000 (Not Clear) <succ>
            bacterial outside --- Certainty = 0.0000 (Not Clear) <succ>

A related GBS nucleic acid sequence <SEQ ID 9391> which encodes amino acid sequence <SEQ ID 9392> was

```
ORF00541(367-741 of 1041)
SP|O68285|MSCL_STAAU(1-119 of 120) LARGE-CONDUCTANCE MECHANOSENSITIVE CHANNEL.
GP|3135292|gb|AAC38560.1||AF029731 large conductance mechanosensitive channel
{Staphylococcus aureus}
% Match = 14.9
% Identity = 53.3 % Similarity = 70.5
Matches = 65 Mismatches = 31 Conservative Sub.s = 21

177       207       237       267       297       327       357       387
QVMTSTEITHYSFTFDYIIFSFLCKFFQKLFQGFLLH*FNIKIYR*FETYYLDFSKEICYNERELNNIKELVHMIKELKE
                                                                  |:||:||
                                                                  MLKEFKE 417       447       477       507       537       561       591       621
FLFKGNVLDLAVAVILGAAFNAIITSLVKDVITPLILNPVLKAAGVSNIAQLSWN--GVAYGNFLSAVINFLIVGTTLFF
| :||||||||:||::||||| ||:|||::::| |||    |   | :|:   |:  |: ||  |: :|| :|:|  ||
FALKGNVLDLAIAVVMGAAFNKIISSLVENIIMPLI----GKIFGSVDFAK-EWSFWGIKYGLFIQSVIDFIIIAFALFI
          20        30        40        50        60        70        80

651       681       711       741       771       801       831       861
IVKAANKVMAKKPXEEEIIEVVEPTQEQLLXEIRDLLANK**KTRITEFFY*LIVIIYEKTAQF*TVFSYSI*LEFFTFA
|| ||  :| |:  |||    |||     ||  ||||||  |
FVKIANTLMKKEEAEEE--AVVE-ENVVLLTEIRDLLREKK
              100       110       120
``` also identified. A related GBS nucleic acid sequence <SEQ ID 10799> which encodes amino acid sequence <SEQ ID 10800> was also identified.

The protein is similar to the 30S ribosomal protein S21 from *Listeria monocytogenes*:

```
>GP:BAA82793 GB:AB023064 30S ribosomal protein S21
[Listeria monocytogenes]
Identities = 30/34 (88%), Positives = 34/34 (99%)
Query:   1   MTKAGTLQESRKREFYEKPSVKRKRKSEAARKRK   34
             ++K+GTLQESRKREFYEKPSVKRK+KSEAARKRK
Sbjct:  23   VSKSGTLQESRKREFYEKPSVKRKKKSEAARKRK   56
```

A related DNA sequence was identified in *S. pyogenes* <SEQ ID 3811> which encodes the amino acid sequence <SEQ ID 3812>. Analysis of this protein sequence reveals the following:

---

Possible site: 38
>>> Seems to have no N-terminal signal sequence
----- Final Results -----
    bacterial cytoplasm --- Certainty = 0.4815 (Affirmative) <succ>
    bacterial membrane --- Certainty = 0.0000 (Not Clear) <succ>
    bacterial outside --- Certainty = 0.0000 (Not Clear) <succ>

---

An alignment of the GAS and GBS proteins is shown below.

```
Identities = 35/36 (97%), Positives = 36/36 (99%)
Query:   1   MTKAGTLQESRKREFYEKPSVKRKRKSEAARKRKKF   36
             +TKAGTLQESRKREFYEKPSVKRKRESEAARKRKKF
Sbjct:  35   VTKAGTLQESRKREFYEKPSVKRERKSEAARKRKKF   70
```

Based on this analysis, it was predicted that these proteins and their epitopes could be useful antigens for vaccines or diagnostics.

Example 1228

A DNA sequence (GBSx1304) was identified in *S. agalactiae* <SEQ ID 3813> which encodes the amino acid sequence <SEQ ID 3814>. Analysis of this protein sequence reveals the following:

---

Possible site: 18
>>> Seems to have an uncleavable N-term signal seq
INTEGRAL    Likelihood = −7.06    Transmembrane 5-21 (3-23)
INTEGRAL    Likelihood = −2.28    Transmembrane 191-207 (189-207)
----- Final Results -----
    bacterial membrane --- Certainty = 0.3824 (Affirmative) <succ>
        bacterial outside --- Certainty = 0.0000 (Not Clear) <succ>
            bacterial cytoplasm --- Certainty = 0.0000 (Not Clear) <succ>

---

The protein has no significant homology with any sequences in the GENPEPT database.

No corresponding DNA sequence was identified in S. pyogenes.

A related GBS gene <SEQ ID 8755> and protein <SEQ ID 8756> were also identified. Analysis of this protein sequence reveals the following:

---

Lipop Possible site: −1    Crend: 2
McG: Discrim Score: 8.68
GvH: Signal Score (−7.5): −5.71
Possible site: 18
>>> Seems to have an uncleavable N-term signal seq
ALOM program    count: 2 value: −7.06 threshold: 0.0
INTEGRAL    Likelihood = −7.06    Transmembrane 5-21 (3-23)
INTEGRAL    Likelihood = −2.28    Transmembrane 191-207 (189-207)
PERIPHERAL    Likelihood = 4.35    142
modified ALOM score: 1.91
*** Reasoning Step: 3
----- Final Results -----
    bacterial membrane --- Certainty = 0.3824 (Affirmative) <succ>
        bacterial outside --- Certainty = 0.0000 (Not Clear) <succ>
            bacterial cytoplasm --- Certainty = 0.0000 (Not Clear) <succ>

---

SEQ ID 8756 (GBS259) was expressed in *E. coli* as a His-fusion product. SDS-PAGE analysis of total cell extract is shown in FIG. 45 (lane 4; MW 54 kDa).

Based on this analysis, it was predicted that these proteins and their epitopes could be useful antigens for vaccines or diagnostics.

Example 1229

A DNA sequence (GBSx1305) was identified in *S. agalactiae* <SEQ ID 3815> which encodes the amino acid sequence <SEQ ID 3816>. Analysis of this protein sequence reveals the following:

---

Possible site: 56
>>> Seems to have no N-terminal signal sequence
INTEGRAL    Likelihood = −1.38    Transmembrane 136-152 (135-152)
----- Final Results -----
    bacterial membrane --- Certainty = 0.1553 (Affirmative) <succ>
        bacterial outside --- Certainty = 0.0000 (Not Clear) <succ>
            bacterial cytoplasm --- Certainty = 0.0000 (Not Clear) <succ>

---

The protein has homology with the following sequences in the GENPEPT database.

```
>GP:AAD47593 GB:AF140784 Vexp2 [Streptococcus pneumoniae]
Identities = 117/212 (55%), Positives = 152/212 (71%)
Query:    1   MLELKNIAYRYKGNDNKTLENINYSFQSGVFYTILGNSGSGKTTLLSLMAGLDSPTEGQV    60
              +L+L+++ YRYK       L   INY+F+ G FY+I+G SG+GK+TLLSL+AGLDSP EG +
Sbjct:    3   LLQLQDVTYRYKNTAEAVLYQINYNFEPGKFYSIIGESGAGKSTLLSLLAGLDSPVEGSI    62

Query:   61   LFNKKDIKEAGYAQHRKKNIALVFQNYNLLDYLTPLENVQLVKPTADKQLLLDLGLKEDM   120
              LF  +DI++ GY+ HR   +I+LVFQNYNL+DYL+PLEN++LV   A K  LL+LGL E
Sbjct:   63   LFQGEDIRKKGYSYHRMHHISLVFQNYNLIDYLSPLENIRLVNKKASKNTLLELGLDESQ   122

Query:  121   LTRNILRLSGGQQQRVAIARALVVGTPAILLDEPTGNLDFDISRDITMRLKDFAHKEKRC   180
```

```
               + RN+L+LSGGQQQRVAIAR+LV    P  IL DEPTGNLD    + DI    LK   A K   +C
Sbjct:  123    IKRNVLQLSGGQQQRVAIARSLVSEAPVILADEPTGNLDPKTAGDIVELLKSLAQKTGKC    182

Query:  181    VIMVTHSREIAHMADTALQLIGDNLKELSKES                                 212
               VI+VTHS+E+A   +D   L+L       L E     S
Sbjct:  183    VIVVTHSKEVAQASDITLELKDKKLTETRNTS                                 214
```

SEQ ID 3816 (GBS363) was expressed in *E. coli* as a His-fusion product. SDS-PAGE analysis of total cell extract is shown in FIG. 74 (lane 5; MW 28 kDa). It was also expressed in *E. coli* as a GST-fusion product. SDS-PAGE analysis of total cell extract is shown in FIG. 81 (lane 10; MW 53 kDa).

GBS363-GST was purified as shown in FIG. 216, lane 9.

Based on this analysis, it was predicted that this protein and its epitopes, could be useful antigens for vaccines or diagnostics.

Example 1230

A DNA sequence (GBSx1306) was identified in *S. agalactiae* <SEQ ID 3817> which encodes the amino acid sequence <SEQ ID 3818>. This protein is predicted to be Vexp3. Analysis of this protein sequence reveals the following:

```
Possible site: 47
>>> Seems to have an uncleavable N-term signal seq
INTEGRAL     Likelihood = –14.97     Transmembrane 71-87 (66-97)
INTEGRAL     Likelihood = –3.61      Transmembrane 2-18 (1-18)
----- Final Results -----
    bacterial membrane --- Certainty = 0.6986 (Affirmative) <succ>
    bacterial outside --- Certainty = 0.0000 (Not Clear) <succ>
    bacterial cytoplasm --- Certainty = 0.0000 (Not Clear) <succ>
```

The protein has no significant homology with any sequences in the GENPEPT database.

No corresponding DNA sequence was identified in *S. pyogenes*.

```
Possible site: 45
>>> Seems to have no N-terminal signal sequence
----- Final Results -----
    bacterial cytoplasm --- Certainty = 0.1986 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1232

A DNA sequence (GBSx1308) was identified in *S. agalactiae* <SEQ ID 3821> which encodes the amino acid sequence <SEQ ID 3822>. This protein is predicted to be Vexp3. Analysis of this protein sequence reveals the following:

```
Possible site: 34
>>> Seems to have no N-terminal signal sequence
INTEGRAL    Likelihood = –6.05    Transmembrane 22-38 (17-39)
----- Final Results -----
    bacterial membrane --- Certainty = 0.3421 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:AAD47594 GB:AF140784 Vexp3 [Streptococcus pneumoniae]
Identities = 39/153 (25%), Positives = 67/153 (43%), Gaps = 9/153 (5%)
Query:    3    LFKRSFLYVSRKKRKSITLFVCLWLVASTLISGIAVKNAGLTA-KKTFSRQTGSILHISS    61
               +   +F YV+RK   KSI +F+ +  L+AS   + G+++K A    A  ++TF    T S    +
Sbjct:    1    MLHNAFAYVTRKFFKSIVIFLIILLMASLSLVGLSIKGATAKASQETFKNITNS-FSMQI    59

Query:   62    DSTDLVGDGYGSGEIPEKAIVNIASNPNVKRVNNNLMAYAGLTSEKMVTRPNDKEQYKE-    120
               +       G    G+G I    + I   I  N    ++      + A    LT    ++   P  K+
Sbjct:   60    NRRVNQGTPRGAGNIKGEDIKKITENKAIESYVKRINAIGDLTGYDLIETPETKKNLTAD    119

Query:  121    ------QVLQVHGNSYSDTDPKYTAGMISLKGG                                147
                     L + G + S    + K+ +G     L    G
Sbjct:  120    RAKRFGSSLMITGVNDSSKEDKFVSGSYKLVEG                                152
```

No corresponding DNA sequence was identified in *S. pyogenes*.

Based on this analysis, it was predicted that this protein and its epitopes, could be useful antigens for vaccines or diagnostics.

Example 1231

A DNA sequence (GBSx1307) was identified in *S. agalactiae* <SEQ ID 3819> which encodes the amino acid sequence <SEQ ID 3820>. This protein is predicted to be Vexp3. Analysis of this protein sequence reveals the following:

Example 1233

A DNA sequence (GBSx1309) was identified in *S. agalactiae* <SEQ ID 3823> which encodes the amino acid sequence <SEQ ID 3824>. Analysis of this protein sequence reveals the following:

Possible site: 39
>>> Seems to have an uncleavable N-term signal seq
INTEGRAL    Likelihood = −15.76   Transmembrane 295-311 (287-317)
INTEGRAL    Likelihood = −7.59    Transmembrane 49-65 (46-69)
INTEGRAL    Likelihood = −6.90    Transmembrane 340-356 (339-362)
INTEGRAL    Likelihood = −5.57    Transmembrane 411-427 (404-430)
----- Final Results -----
    bacterial membrane --- Certainty = 0.7305 (Affirmative) <succ>
    bacterial outside --- Certainty = 0.0000 (Not Clear) <succ>
        bacterial cytoplasm --- Certainty = 0.0000 (Not Clear) <succ>

A related GBS nucleic acid sequence <SEQ ID 9695> which encodes amino acid sequence <SEQ ID 9696> was also identified.

The protein has homology with the following sequences in the GENPEPT database.

```
>GP:CAB12182 GB:Z99106 similar to transporter [Bacillus subtilis]
Identities = 95/370 (25%), Positives = 167/370 (44%), Gaps = 41/370 (11%)
Query: 109  ESVEASLSIDVGSRLKSVSPYNSS--------KEENQVTLAGYQSTEDLRAFQTKALVLK   160
            +++E+S S D   S   S + NS         + +++ G ST + F      +
Sbjct: 115  DAIESSSSSDSSSSSSSNAKNSQGGGQGGPQMVQADLSIEGVISTALVDDFSDGDSKIT    174

Query: 161  KGSHLAADNT--KQVLVPLKLAQKNHLSVGNKLRLGK---ENVT----IAGIYDANSA--   209
             G +   +   K   ++    LA++N LSVG+ + +       E+ T    I GIY     S+
Sbjct: 175  DGRAITKSDVGKKVTVINETLAEENDLSVGDSITIESATDEDTTVKLKIVGIYKTTSSGD   234

Query: 210  -KSKNTFNPNIDNTLIAQATLVRKISKQKGYQTV---AVRLSDKRLVDTVIQNIKQWPLD   265
             +++N    N  N L   T    +      T+       + D + +DT ++  K+  +D
Sbjct: 235  DQAQNFSFLNPYNKLYTPYTATAALKGDDYKNTIDSAVYYMDDAKNMDTFVKAAKKTSID   294

Query: 266  FGKLDVQTAKEFYGDSYRNIETLHRLVGRIILIVSLVAMAILVVMLTFWINNRIKETGIL   325
            F   + T  + Y        IE +       ++ +VS+    IL +++    I  R   E G+L
Sbjct: 295  FDTYTLNTNDQLYQQMVGPIENVASFSKNVVYLVSVAGAVILGLIVMMSIRERKYEMGVL   354

Query: 326  LAIGKTKFEIIGHYLIEVLLVAGAAFTLSIIGGVFLGKTFAAGLLSQV------------   373
            +AIG+ ++++IG +L E+L+VA  A   L+ + G   +           LLSQ
Sbjct: 355  MAIGEKRWKLIGQFLTEILIVAVIAIGLASVTGNLVANQLGNQLLSQQISSSTDSTQTAS   414

Query: 374  ------NGGVSSQIVQNSSLIIDRIDNLAVSVGVMDVFRLYAQGALICLFAVVLSSYSIL   427
                     GG+  ++   +SS  +D  ID+L V+V  + D+    L    G LI + A  +L S  S+L
Sbjct: 415  GQMPGGGGMGGKMFGHSSSNVDVIDSLNVAVSMNDMLILGGIGILIAIIATLLPSISVL    474

Query: 428  KLQPKQILSR   437
            +L  PK  IL++
Sbjct: 475  RLHPKTILTK   484
```

No corresponding DNA sequence was identified in *S. pyogenes*.

A related GBS gene <SEQ ID 8757> and protein <SEQ ID 8758> were also identified. Analysis of this protein sequence reveals the following:

Lipop: Possible site: −1   Crend: 9
McG: Discrim Score: 1.50
GvH: Signal Score (−7.5): −8.43
Possible site: 39
>>> Seems to have an uncleavable N-term signal seq
ALOM program   count: 4 value: −15.76 threshold: 0.0
INTEGRAL    Likelihood = −15.76   Transmembrane 295-311 (287-317)
INTEGRAL    Likelihood = −7.59    Transmembrane 49-65 (46-69)
INTEGRAL    Likelihood = −6.90    Transmembrane 340-356 (339-362)
INTEGRAL    Likelihood = −5.57    Transmembrane 411-427 (404-430)
PERIPHERAL  Likelihood = 3.45     386
modified ALOM score: 3.65
*** Reasoning Step: 3
----- Final Results -----
    bacterial membrane --- Certainty = 0.7305 (Affirmative) <succ>
    bacterial outside --- Certainty = 0.0000 (Not Clear) <succ>
        bacterial cytoplasm --- Certainty = 0.0000 (Not Clear) <succ>

The protein has homology with the following sequences in the databases:

```
ORF00687(421-1611 of 1917)
EGAD|108957|BS0375(11-484 of 486) hypothetical protein {Bacillus subtilis}
OMNI|NT01BS0429 membrane transport protein GP|1805444|dbj|BAA09006.1||D50453
homologue of hypothetical protein in a rapamycin synthesis gene cluster of
Streptomyces hygroscopicus
{Bacillus subtilis} GP|2632675|emb|CAB12182.1||Z99106 similar to transporter
{Bacillus subtilis} PIR|F69762|F69762 transporter homolog ycII -
Bacillus subtilis
% Match = 8.6
% Identity = 28.7 % Similarity = 52.2
Matches = 117 Mismatches = 184 Conservative Sub.s = 96

312       342       372       402       432       462       492       522
        VL*NH*LIDNVEVDREYLTTSIVILEIIKIEKGGKIVNLWTLSLAYLKRQKMKTVTLFLVFLTIGTCLISLMSIQHSLEK
              :|   :|   ||:   ::||    |   ::|   ::||    :|
        MNFIKRAFWNMKAKKGKTLLQLFVFTVICVFVLSGLAIQSAAQK
                  10        20        30        40
```

-continued

```
543       573       603                              624       654
N---ILTKQGKSIYLTSKEKAYWPEQAYEALKK--------------------------------AKMVESVEASLSID
 :     :| |:  |      :    :|      |:                            |   :::|:|  | |
SSELARQELGGSVTLQVDRQKQMEKQQDSGEKRTFESTPIKVSDANKLAALDHVKSYNYTTSASANAGNFDAIESSSSSD
           60        70        80        90       100       110       120

684              720       750       780       807       834       864
VGSRLKSVSPYNSS--------KEENQVTLAGYQSTEDLRAFQTKALVLKKGSHLA-ADNTKQV-LVPLKLAQKNHLSVG
  |      |   :   ||           :::  |    ||       :    :|     :|: :|   |||  :|||
SSSSSSSSSNAKNSQGGGQGGPQMVQADLSIEGVISTALVDDFSDGDSKITDGRAITKSDVGKKVTVINETLAEENDLSVG
           140       150       160       170       180       190       200

885       903                954       978      1008                      1065
NKLRL---GKENVTI----AGIYDANSA---KSKNTFNPNIDNTLIA--QATLVRKISKQKGYQTVAVR-LSDKRLVDTV
 : :       |: |:     |||   |:      :::|     |  |    ||    |         ||   : |  : ||
DSITIESATDEDTTVKLKIVGIYKTTSSGDDQAQNFSFLNPYNKLYTPYTATAALKGDDYKNTIDSAVYYMDDAKNMDTF
          220       230       240       250       260       270       280

1095      1125      1155      1185      1215      1245      1275      1305
IQNIKQWPLDFGKLDVQTAKEFYGDSYRNIETLHRLVGRIILIVSLVAMAILVVMLTFWINNRIKETGILLAIGKTKFEI
::     |:  :||    :  |   ::|       ||:   :  ::  :||:    ||  :::   |     |  |:|:|||:  ::::
VKAAKKTSIDFDTYTLNTNDQLYQQMVGPIENVASFSKNVVYLVSVAGAVILGLIVMMSIRERKYEMGVLMAIGEKRWKL
          300       310       320       330       340       350       360

1335      1365      1395                       1431      1461      1491
IGHYLIEVLLVAGAAFTLSIIGGVFLGKTFAAGLLSQV-----------------NGGVSSQIVQNSSLIIDRIDNLAV
||::|  |:|:||  |   :  |       ||||             ||:  :: :| |  :|:|
IGQFLTEILIVAVIAIGLASVTGNLVANQLGNQLLSQQISSSTDSTQTASGQMPGGGGGMGGKMFGHSSSNVDVIDSLNV
          380       390       400       410       420       430       440

1521      1551      1581      1611      1641      1671      1701      1731
SVGVMDVFRLYAQGALICLFAVVLSSYSILKLQPKQILSRMS*EVNMNLFKRSFLYSRKKRKSITLFVCLWLVASTLIS
:|   :  |::  |     | ||  :  |  :|  |  |:|:|:||  ||::
AVSMNDMLILGGIGILIAIIATLLPSISVLRLHPKTOLTKQE
          460       470       480
```

Based on this analysis, it was predicted that these proteins and their epitopes could be useful antigens for vaccines or diagnostics.

Example 1234

A DNA sequence (GBSx1310) was identified in *S. agalactiae* <SEQ ID 3825> which encodes the amino acid sequence <SEQ ID 3826>. Analysis of this protein sequence reveals the following:

```
Possible site: 24
>>> Seems to have a cleavable N-term signal seq.
----- Final Results -----
   bacterial outside --- Certainty = 0.3000 (Affirmative) <succ>
   bacterial membrane --- Certainty = 0.0000 (Not Clear) <succ>
   bacterial cytoplasm --- Certainty = 0.0000 (Not Clear) <succ>
```

The protein has homology with the following sequences in the GENPEPT database.

```
>GP:CAB11993 GB:Z99105 ybdG [Bacillus subtilis]
Identities = 66/224 (29%), Positives = 102/224 (45%), Gaps = 22/224 (9%)
Query:  84 IKEYGQKVEVKGKKMNVYTVGEGKVPIVFIPGQGTVTAKHQYHNLISNLSKTHKVVVVEP  143
           +K  G  V+V GKKMNVY  G GK  VF+ G G       ++   L S  SK +K+ VV+
Sbjct:  41 LKGKGTVVDVDGKKMNVYQEGSGKDTFVFMSGSGIAAPAYEMKGLYSKFSKENKIAVVDR  100

Query: 144 FGSGLSDVIDQPRNLANITSDIHEALQKVGITGKYVIASHSIGGVYALKYISTYPKEVLG  203
             G G S+V  R++  +        +AL K G    Y++  HSI G+ A+ +    YPKE+
Sbjct: 101 AGYGYSEVSHDDRDIDTVLEQTRKALMKSGNKPPYILMPHSISGIEAMYWAQKYPKEIKA  160

Query: 204 LIGLDTSTP---------GMEGGKQVDF-------------AAPVLKELPKIPKVSDDIN  241
           +I +D    P            G++    K     F                +A    E+ +    ++D+
Sbjct: 161 IIAMDIGLPQQYVTYKLSGVDRLKVRGEHLLTSIGFHRFIPSAVYNPEVIRQSFLTDEEK  220

Query: 242 AQFFAIGHKILNNSNMKEEAKNSSNMINESANYKIPKGIPAMYL                 285
            + AI  K  N++M+ E    S    ++S N    PK P+ L
Sbjct: 221 EIYKAINFKQFFNADMEHELLQSYQNGSKSVNLPAPKETPVLIL                 264
```

No corresponding DNA sequence was identified in *S. pyogenes*.

SEQ ID 3826 (GBS121) was expressed in *E. coli* as a His-fusion product. SDS-PAGE analysis of total cell extract is shown in FIG. 24 (lane 9; MW 40 kDa). It was also expressed in *E. coli* as a GST-fusion product. SDS-PAGE analysis of total cell extract is shown in FIG. 31 (lane 6; MW 65 kDa).

GBS121-GST was purified as shown in FIG. 198, lane 6.

Based on this analysis, it was predicted that this protein and its epitopes, could be useful antigens for vaccines or diagnostics.

Example 1235

A DNA sequence (GBSx1311) was identified in *S. agalactiae* <SEQ ID 3827> which encodes the amino acid sequence <SEQ ID 3828>. Analysis of this protein sequence reveals the following:

```
Possible site: 33
>>> Seems to have a cleavable N-term signal seq.
----- Final Results -----
    bacterial outside --- Certainty = 0.3000 (Affirmative) <succ>
      bacterial membrane --- Certainty = 0.0000 (Not Clear) <succ>
        bacterial cytoplasm --- Certainty = 0.0000 (Not Clear) <succ>
```

A related GBS nucleic acid sequence <SEQ ID 8759> which encodes amino acid sequence <SEQ ID 8760> was also identified. Analysis of this protein sequence reveals the following:

```
Lipop: Possible site: -1   Crend: 8
McG: Discrim Score: 3.70
GvH: Signal Score (-7.5): -0.0600004
Possible site: 22
>>> Seems to have a cleavable N-term signal seq.
ALOM program   count: 0 value: 8.01 threshold: 0.0
PERIPHERAL                    Likelihood = 8.01              167
modified ALOM score: -2.10
*** Reasoning Step: 3
----- Final Results -----
    bacterial outside --- Certainty = 0.3000 (Affirmative) <succ>
      bacterial membrane --- Certainty = 0.0000 (Not Clear) <succ>
        bacterial cytoplasm --- Certainty = 0.0000 (Not Clear) <succ>
```

No corresponding DNA sequence was identified in *S. pyogenes*.

SEQ ID 8760 (GBS60) was expressed in *E. coli* as a His-fusion product. SDS-PAGE analysis of total cell extract is shown in FIG. 16 (lane 7; MW 38.6 kDa).

GBS60-His was purified as shown in FIG. 193, lane 3.

Based on this analysis, it was predicted that these proteins and their epitopes could be useful antigens for vaccines or diagnostics.

Example 1236

A DNA sequence (GBSx1312) was identified in *S. agalactiae* <SEQ ID 3829> which encodes the amino acid sequence <SEQ ID 3830>. This protein is predicted to be unnamed protein product. Analysis of this protein sequence reveals the following:

```
Possible site: 21
>>> May be a lipoprotein
----- Final Results -----
    bacterial membrane --- Certainty = 0.0000 (Not Clear) <succ>
      bacterial outside --- Certainty = 0.0000 (Not Clear) <succ>
        bacterial cytoplasm --- Certainty = 0.0000 (Not Clear) <succ>
```

A related GBS nucleic acid sequence <SEQ ID 9693> which encodes amino acid sequence <SEQ ID 9694> was also identified.

No corresponding DNA sequence was identified in *S. pyogenes*.

A related GBS gene <SEQ ID 8761> and protein <SEQ ID 8762> were also identified. Analysis of this protein sequence reveals the following:

```
Lipop: Possible site: 19   Crend: 5
McG: Discrim Score: 9.85
GvH: Signal Score (-7.5): -0.28
Possible site: 21
>>> May be a lipoprotein
ALOM program   count: 0 value: 9.07 threshold: 0.0
PERIPHERAL                    Likelihood = 9.07               99
modified ALOM score: -2.31
----- Final Results -----
    bacterial membrane --- Certainty = 0.0000 (Not Clear) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the databases:

```
37.0/57.2% over 118aa
Bacillus subtilis
EGAD|108627| hypothetical protein Insert characterized
GP|2632485|emb|CAB11993.1||Z99105 ybdG Insert characterized
PIR|D69747|D69747 hypothetical protein ybdG - Insert characterized
ORF00608(553-906 of 1416)
EGAD|108627|BS0200(51-169 of 296) hypothetical protein {Bacillus subtilis}
GP|2632485|emb|CAB11993.1||Z99105 ybdG {Bacillus subtilis} PIR|D69747|D69747
hypothetical protein ybdG - Bacillus subtilis
% Match = 8.7
% Identity = 37.0 % Similarity = 57.1
Matches = 44 Mismatches = 50 Conservative Sub.s = 24

339         369         399         429         459         489         519         549
ITKLSTVALSLLLCTACAASNTSTSKTQSHHPKQTKLTDKQKEEPKNKEAADQEMHPQGAVDLTKYKAKPVKDYGKKIDV

MKTLWKVLKIVFVSLAALVLLVSVSVFIYHHFQLNKEAALLKGKGTVVD
                                            10        20        30        40
```

-continued

```
  579       609       639       669       699       729       759       789
GDGKKMNIYETGQGKIPIVFIPGQAEISPRYAYKNLIERLSKKYKIYTVEPLGYGLSDIPTKPRTLENITKEIHTGLNKI
||||||:|:  |||   ||: |     :|  |    |      ::||: ||  |: ||| |::     |:: : ::    ||
VDGKKMNVYQEGSGKDTFVFMSGSGIAAPAYEMKGLYSKFSKENKIAVVDRAGYGYSEVSHDDRDIDTVLEQTRKALMKS
         60        70        80        90       100       110       120

816       846       876       906       936       966       996      1026
GVKNFY-LAAHSLGGMYSLNYAKNYPEEVRGFIGMDTSTPWMEGEQKTKYDPESAKWAMKXPDVDDKTNEQYLSIAKKIN
|  |    ||:  |: :: :|:  ||:|::  |  ||              |
GNKPPYILMPHSISGIEAMYWAQKYPKEIKAIIAMDIGLPQQYVTYKLSGVDRLKVRGFHLLTSIGFHRFIPSAVYNPEV
        140       150       160       170       180       190       200
```

SEQ ID 8762 (GBS21) was expressed in *E. coli* as a His-fusion product. SDS-PAGE analysis of total cell extract is shown in FIG. 11 (lane 3; MW 31.6 kDa).

GBS21-His was purified as shown in FIG. 192, lane 11.

GBS21L was expressed in *E. coli* as a GST-fusion product. SDS-PAGE analysis of total cell extract is shown in FIG. 124 (lane 8-10; MW 66.5 kDa). It was also expressed in *E. coli* as a His-fusion product. SDS-PAGE analysis of total cell extract is shown in FIG. 124 (lane 11; MW 41.5 kDa) and in FIG. 180 (lane 6; MW 41 kDa). GBS21L-His was purified as shown in FIG. 232 (lanes 3 & 4)

Based on this analysis, it was predicted that these proteins and their epitopes could be useful antigens for vaccines or diagnostics.

Example 1237

A DNA sequence (GBSx1313) was identified in *S. agalactiae* <SEQ ID 3831> which encodes the amino acid sequence <SEQ ID 3832>. This protein is predicted to be endopeptidase O. Analysis of this protein sequence reveals the following:

```
Possible site: 18
>>> Seems to have no N-terminal signal sequence
----- Final Results -----
   bacterial cytoplasm --- Certainty = 0.3854 (Affirmative) <succ>
   bacterial membrane --- Certainty = 0.0000 (Not Clear) <succ>
   bacterial outside --- Certainty = 0.0000 (Not Clear) <succ>
```

The protein has homology with the following sequences in the GENPEPT database.

```
>GP:AAF67832 GB:AF179267 endopeptidase PepO2
[Lactococcus lactis]
Identities = 21/36 (58%), Positives = 26/36 (71%)
Query:   1 MRANIPVRNFQEFYDAFGVKKGDSMYLKPEKRLTLW  36
           +RANIP  N +EFY+ F VK+ D MY  PEKRL +W
Sbjct: 592 LRANIPPTNLEEFYETFDVKETDQMYRAPEKRLKIW 627
```

There is also some homology to SEQ ID 2384:

```
Identities = 13/36 (36%), Positives = 25/36 (69%)
Query:   1 MRANIPVRNFQEFYDAFGVKKGDSMYLKPEKRLTLW  36
           +R N+ + NF  F++ F +K+GD+M+  P+ R+ +W
Sbjct: 596 LRTNVTLTNFDAFHETFDIKEGDAMWRAPKDRVIIW 631
```

Based on this analysis, it was predicted that this protein and its epitopes, could be useful antigens for vaccines or diagnostics.

Example 1238

A DNA sequence (GBSx1314) was identified in *S. agalactiae* <SEQ ID 3833> which encodes the amino acid sequence <SEQ ID 3834>. This protein is predicted to be endopeptidase O. Analysis of this protein sequence reveals the following:

```
Possible site: 47
>>> Seems to have no N-terminal signal sequence
----- Final Results -----
   bacterial cytoplasm --- Certainty = 0.3801 (Affirmative) <succ>
   bacterial membrane --- Certainty = 0.0000 (Not Clear) <succ>
   bacterial outside --- Certainty = 0.0000 (Not Clear) <succ>
```

The protein has homology with the following sequences in the GENPEPT database.

```
>GP:AAA16168 GB:L18760 endopeptidase [Lactococcus lactis]
Identities = 118/268 (44%), Positives = 174/268 (64%), Gaps = 6/268 (2%)
Query:   1 MGDYYGKKYFGEAAKKDVEHMAKKIINVYKTRLKNNTWLSENTKAMAIKKLDNMRLMIGY   60
           +G +YGKKYFGEAAK DV+ M    +I VY+ RL  N WLS+ T    AI+KLD +  IG+
Sbjct: 321 IGLFYGKKYFGEAAKADVKRMVTAMIKVYQVRLSKNEWLSQETAEKAIEKLDAITPFIGF  380

Query:  61 PEDYPDLYRQYQFDSKASFFENNDNYRKLSNKKTFEEFNQSNQREHWQMSANAVNAYNDP  120
           P+  P++Y + +  S   S +E+     + K+    +TFE+F++    +  W M A+ VNAY  P
Sbjct: 381 PDKLPEIYSRLKTTS-GSLYEDALKFDKILTARTFEKFSEDVKTSWHMPAHMVNAYYSP  439

Query: 121 NTNSIVFPAAIFQSPLYDKTKTVSQNYGAIGAIIGHEISHSFDINGMKYDEKGNLHDWWT  180
           ++N+IVFPAAI Q+P Y    ++ SQNYG IGA+I HEISH+FD NG ++D++GNL+ WW
Sbjct: 440 DSNTIVFPAAILQAPFYSLEQSSSQNYGGIGAVIAHEISHAFDNNGAQFDKEGNLNKWWL  499

Query: 181 KEDLKHYKKKTQAMIDQWDGLKADGGKVDGKLTLAENIADNGGVMASLEALKTEKIQTIK  240
           ED + +++K + MI  +DG++ + G   +GKL ++ENIAD GG+ A+L A K EK    +K
Sbjct: 500 DEDYEAFEEKQKEMIALFDGVETEAGPANGKLIVSENIADQGGITAALTAAKDEKDVDLK  559

Query: 241 NFLNHGQVFGVKKQPKNKVSPQFSQMFM                                 268
           F +      K   +K S +F QM +
Sbjct: 560 AFFSQW-----AKIWRMKASKEFQQMLL                                 582
```

There is also homology to SEQ ID 2384:

```
Identities = 110/253 (43%), Positives = 161/253 (63%), Gaps = 1/253 (0%)
Query:   1 MGDYYGKKYFGEAAKKDVEHMAKKIINVYKTRLKNNTWLSENTKAMAIKKLDNMRLMIGY    60
           +G +Y  + F    AK DVE    ++I VYK+RL+    WL+  T+  AI KL++ +  IGY
Sbjct: 324 LGLWYAGQKFSPEAKADVESKVARMIEVYKSRLETADWLAPATREKAITKLNVITPHIGY   383

Query:  61 PEDYPDLRQYQFDSKASFFENNDNYRKLSNKKTFEEFNQSNQREHWQMSANAVNAYNDP   120
           PE  P+ Y  +    D  S   EN  N  K++    T+ ++N+    R   W M A+ VNAY D
Sbjct: 384 PEKLPETYAKKVIDESLSLVENAQNLAKITIAHTWSKWNKPVDRSEWHMPAHLVNAYYDL   443

Query: 121 NTNSIVFPAAIFQSPLYDKTKTVSQNYGAIGAIIGHEISHSFDINGMKYDEKGNLHDWWT   180
              N IVFPAAI Q P Y   ++ S NYG IGA+I HEISH+FD NG  +DE G+L+DWWT
Sbjct: 444 QQNQIVFPAAILQEPFYSLDQSSSANYGGIGAVIAHEISHAFDTNGASFDEHGSLNDWWT   503

Query: 181 KEDLKHYKKKTQAMIDQWDGLKADGGKVDGKLTLAENIADNGGVMASLEALKTEKIQTIK   240
           +ED  +K++T  ++ Q+DGL++  G  KV+GKLT++EN+AD GGV    +LEA ++E+  + +
Sbjct: 504 QEDYAAFKERTDKIVAQFDGLESHGAKVNGKLTVSENVADLGGVACALEAAQSEEDFSAR   563

Query: 241 N-FLNHGQVFGVK                                                252
           + F+N   ++ +K
Sbjct: 564 DFFINFATIWRMK                                                576
```

Based on this analysis, it was predicted that this protein and its epitopes, could be useful antigens for vaccines or diagnostics.

Example 1239

A DNA sequence (GBSx1315) was identified in *S. agalactiae* <SEQ ID 3835> which encodes the amino acid sequence <SEQ ID 3836>. Analysis of this protein sequence reveals the following:

---

Possible site: 39
>>> Seems to have a cleavable N-term signal seq.

-continued

----- Final Results -----
bacterial outside --- Certainty = 0.3000 (Affirmative) <succ>
bacterial membrane --- Certainty = 0.0000 (Not Clear) <succ>
bacterial cytoplasm --- Certainty = 0.0000 (Not Clear) <succ>

A related GBS nucleic acid sequence <SEQ ID 9691> which encodes amino acid sequence <SEQ ID 9692> was also identified.

The protein has homology with the following sequences in the GENPEPT database.

```
>GP:AAC35997 GB:AF019410 endopeptidase O [Lactobacillus helveticus]
Identities = 85/315 (26%), Positives = 146/315 (45%), Gaps = 8/315 (2%)
Query:  46 NVSPRENLYRAVNDNWLANTKLKQGQTSVNSFSEIEDKLKQLLVSDMAKMASGKIETTN-   104
           N   P++NLY AVN  WL+  ++    QTS    +E++ K+++ ++  D A +ASGK +  +
Sbjct:  20 NAKPQDNLYLAVNSEWLSKAEIPADQTSAGVNTELDIKIEKRMMKDFADIASGKEKMPDI    79

Query: 105 DEQKKMVAYYKQGMDFKTRDKNGLKPLKPVLQKLEAVSSMKDFQSLAHDFVMSGFVLPFG   164
           +  K  +A YK  +F  RD     P++   LQK+ +   F+   A  +  M   + LPF
Sbjct:  80 RDFDKAIALYKIAKNFDKRDAEKANPIQNDLQKILDLINFDKFKDNATELFMGPYALPFV   139

Query: 165 LTVETNARDNSQKQLVLRQAPALLESPDQYKKGNKEGEAKLSAYRTSAMALLKQAGKSNI   224
              V+ + ++       L       L     YK     E + L        ++ LL+ AG
Sbjct: 140 FDVDADMKNTDFNVLHFGGPSTFLPDTTTYK--TPEAKKLLDILEKQSINLLEMAGIGKE   197

Query: 225 EDRKLVKQAIAFDRLLSEKTQVDQSKITAESETAAGRYNPESMETVHNYAKEFDFKELIE   284
           E R  V+ A+AFD+ LS+      K T E   A   YNP S+       K FD  + ++
Sbjct: 198 EARVYVQNALAFDQKLSKVV-----KSTEEWSDYAAIYNPVSLTEFLAKFKSFDMADFLK   252

Query: 285 KLVGPTNKAVNVEDKTYFKQVNDVINSKQLANMKAWMMISMLVDQSDFLGEQNRQAASAF   344
           ++      + V V +   +      +++IN        +K WM++  +    + +L +   R AA   F
Sbjct: 253 TILPEKVERVIVMEPRFLDHADELINPANFDEIKGWMLVKYINSVAKYLSQDFRAAAFPF   312

Query: 345 KNVASGLTQIESKEK                                              359
                   SG   ++  S+ K
Sbjct: 313 NQAISGTPELPSQIK                                              327
```

A related GBS gene <SEQ ID 8763> and protein <SEQ ID 8764> were also identified. Analysis of this protein sequence reveals the following:

```
Lipop: Possible site: −1    Crend: 10
McG: Discrim Score: 5.41
GvH: Signal Score (−7.5): −1.39
Possible site: 36
>>> Seems to have a cleavable N-term signal seq.
ALOM program    count: 0 value: 2.76 threshold: 0.0
PERIPHERAL              Likelihood = 2.76              151
modified ALOM score: −1.05
*** Reasoning Step: 3
----- Final Results -----
    bacterial outside --- Certainty = 0.3000 (Affirmative) <succ>
       bacterial membrane --- Certainty = 0.0000 (Not Clear) <succ>
          bacterial cytoplasm --- Certainty = 0.0000 (Not Clear) <succ>
```

SEQ ID 8764 (GBS12) was expressed in *E. coli* as a GST-fusion product. SDS-PAGE analysis of total cell extract is shown in FIG. 1 (lane 7; MW 65 kDa). It was also expressed in *E. coli* as a His-fusion product. SDS-PAGE analysis of total cell extract is shown in FIG. 3 (lane 3; MW 39 kDa).

The GST-fusion protein was purified as shown in FIG. 189, lane 4.

Based on this analysis, it was predicted that these proteins and their epitopes could be useful antigens for vaccines or diagnostics.

Example 1240

A DNA sequence (GBSx1317) was identified in *S. agalactiae* <SEQ ID 3839> which encodes the amino acid sequence <SEQ ID 3840>. Analysis of this protein sequence reveals the following:

```
Possible site: 15
>>> Seems to have no N-terminal signal sequence
INTEGRAL     Likelihood = −1.75    Transmembrane 301-317 (299-317)
----- Final Results -----
    bacterial membrane --- Certainty = 0.1702 (Affirmative) <succ>
       bacterial outside --- Certainty = 0.0000 (Not Clear) <succ >
          bacterial cytoplasm --- Certainty = 0.0000 (Not Clear) <succ>
```

The protein has homology with the following sequences in the GENPEPT database.

```
>GP:CAB42180 GB:A67181 unnamed protein product [unidentified]
Identities = 245/771 (31%), Positives = 410/771 (52%), Gaps = 80/771 (10%)
Query:   22 VRVIVEFNKESILDYATEQKKTVAQLNQADVEKKLQSIKQEQDKVLKNIEKSVHFDSSKV    81
            VRVIV  NK + D+ ++   + A + +   +E+    +K  Q+KV+K +E+      +KV
Sbjct:   97 VRVIVSLNKSAAFDHTSKPTGSAASVKK--IEQASDQVKDGQEKVIKQVEE---ITGNKV   151

Query:   82 KR-YDAIINGVALDIQAQEIEKLKTIADVRRVYVSQEYVQTKPLLSSSGQLIGLPEVWNN   140
            +R +  ++N  ++D+   +I+K+K + V+ V    +  Y      P    S+ Q+  + +VW
Sbjct:  152 RRQFGYLVNAFSIDMDLDDIDKVKDLPQVKNVTPVKVY---HPTDESADQMAQVQDVWQE   208

Query:  141 SQYKGEGTVVAVIDSGVDFKHQALKIKEPNRAKYNKTSIE----KLIHEKNLKGKFYSEK   196
             + KGEG V+++ID+G+D  HQ  LK+         +K+  +E     KL  H      GK+Y+EK
Sbjct:  209 QKLKGEGMVISIIDTGIDSSHQDLKLDSGVSTALSKSEVESDKSKLGH-----GKYYTEK   263

Query:  197 VPYGYNYYDYNDNLKDS-YGVMHGMHVTGIVGANDDNQKLYGVAPNAQILAMKVFSDDQQ   255
            VPYGYNY D ND + D+   G MHG HV  GI GAN      ++ GVAP+AQ+LAMKVFS++ +
Sbjct:  264 VPYGYNYADKNDQIVDNGCGEMHGQHVAGIAGANG---QVKGVAPDAQLLAMKVFSNNAK   320

Query:  256 NPTTFTDVWLKALDDAILLKADVVNMSLGTPAGFVHEGKDYPELEVIARACKAGIVIAVA   315
            N  + D + A++D++  L  ADV+NMSLG+ +   V   G    P+ +  +A+A +AG++    ++
Sbjct:  321 NSGAYDDDIISAIEDSVKLGADVINMSLGSVSSDV--GPSDPQQQAVAKASEAGVINVIS   378

Query:  316 AGNE---GNITDGNTYGVKPLAENYDTALIANPALDDNTLAVASMENLKKHAHVLKFK--   370
            AGN     G+  DGN      +E   + +  P +   + L VAS EN K      +K  +
Sbjct:  379 AGNSGVAGSTADGNPVNNTGTSE---LSTVGTPGVTPDALTVASAENSKVTTDTVKDELG   435

Query:  371 --------DKKSGTEVTEVINLHVAPNASKTIIGLAVDLGAGAPSELS--KHFDLSGKIA   420
                    + K   +VT  +  +        K    + VD+G G  +   + K   ++ G++A
Sbjct:  436 GVTFSSNSELKGAAQVTTQLESNYSVLTKKLKL---VDMGLGGADDYTAEKRAEVKGQLA   492

Query:  421 MLEIPEDNKSNGFLEKVQAITKLNPAAILLYNNAKVKDDLGSQLLVESEAAKFNIARITR   480
            +++     +   + F  KV        A  I++YN+     D L S L +          +++
Sbjct:  493 VVK----RGAYTFSAKVANAKAAGAAGIVIYNSE--DDGLLSMSLDDKTFPTLGMSKADG   546

Query:  481 STY----NNIKNNSNKIITILTERQAIDNSLAGQLSSYSSWGPTPDLRLKPEITAPGGHI   536
             +        ++ + K T L        IDNS AG++S  ++SWGPTP+L    KPEITAPGG I
Sbjct:  547 KFWLKQQKKVRASRLKFGTAL-----IDNSRAGKMSDFTSWGPTPELDFKPEITAPGGKI   601

Query:  537 FSTVEDNQYADKSGTSMAAPQVAGAAAVLKQYITDKKIPV--DNAADFIKLLLMNTAQPI   594
            +S   DN+Y   SGTSMA+P VAG+ A++   Q I  + + +      F  K  MNT+  P+
Sbjct:  602 YSLANDNKYQQMSGTSMASPFVAGSEALILQGIKKQGLNLSGEELVQFAKNSAMNTSHPV   661

Query:  595 IN-KQSKDGKTPYFVRQQGSGAMNLAKALVTTVVATVTGTNDNNADGKLELREL-KEKKF   652
            +  + + +K+   +P    R+QGSG +N+  A+  TV          N +G    L+E+  ++  F
Sbjct:  662 YDTEHTKEIISP---RRQGSGEINVKDAINNTVEVKAA-----NGNGAAALKEIGRQTTF   713

Query:  653 KARILLRNFGKTNKTYIISSEA--IADPVDEKGFRTQNSEHLVSKKADAVTRKVTVEAGK   710
            K    + L N GK  +TY + +       + K     +++ +V  +    T KVTV+ G+
Sbjct:  714 K--VTLTNHGKKAQTYAVDNYGGPYTQATEAKSGEIYDTK-IVKGQLTTETPKVTVQPGE   770
```

```
Query: 711  TLAVDLDVDYSDAEALTRNNFLEGYLNLK-DTEGVADLHLPFLGFYGSWTE       760
            +VD+     +   +  R NF+EGY+  +    +   +L LP++GF+GS+++
Sbjct: 771  --SVDVSFTLTLPYSFQRQNFVEGYVGFEAKDQATPNLVLPYMGFFGSYSQ       819
```

A related GBS gene <SEQ ID 8767> and protein <SEQ ID 8768> were also identified. Analysis of this protein sequence reveals the following:

Lipop: Possible site: −1  Crend: 10
McG: Discrim Score: −8.37
GvH: Signal Score (−7.5): −6.06
Possible site: 15
>>> Seems to have no N-terminal signal sequence
ALOM program   count: 1 value: −1.75 threshold: 0.0

-continued

INTEGRAL   Likelihood = −1.75   Transmembrane 301-317 (299-317)
PERIPHERAL Likelihood = 1.75    614
modified ALOM score: 0.85
*** Reasoning Step: 3
----- Final Results -----
   bacterial membrane --- Certainty = 0.1702 (Affirmative) <succ>
   bacterial outside --- Certainty = 0.0000 (Not Clear) <succ>
      bacterial cytoplasm --- Certainty = 0.0000 (Not Clear) <succ>

The protein has homology with the following sequences in the databases:

```
ORF00677(358-3159 of 3255)
EGAD|139899|149200(95-1541 of 1946) prtB protein {Lactobacillus delbrueckii}
GP|1381114|gb|AAC41529.1||L48487 proteinase precursor {Lactobacillus delbrueckii}
PIR|JC6032|JC6032 lactocepin (EC 3.4.21.96) precursor [similarity] -
Lactobacillus delbrueckii subsp. bulgaricus
% Match = 15.5
% Identity = 33.3 % Similarity = 54.6
Matches = 275 Mismatches = 343 Conservative Sub.s = 176

318       348       378       408       438       468       498       528
KAVTVTKPQGAVAEKATPAVPKPQKVRVIVEFNKESILDYATEQKKTVAQLNQADVEKKLQSIKQEQDKVLKNIEKSVHF
|||||  :||  :   :|:  ::       :  |  :      :|:     :|   |:||:|  :|:
SKFQEAAKEQRQASGQAVSKKNESSVRVIVSLNKSAAFDHTSKPTGSAASV--KKIEQASDQVKDGQEKVIKQVEE---I
              90        100       110       120       130       140

555       585       615       645       675       705       735       765
DSSKVKR-YDAIINGVALDIQAQEIEKLKTIADVRRVYVSQEYVQTKPLLSSSGQLIGLPEVWNNSQYKGEGTVVAVIDS
:||:||  :  :::|  ::|:      :|:|:|  :  |  :  |  : | |:   :||  :  ||||  :|:::||:
TGNKVRRQFGYLVNAFSIDMDLDDIDKVKDLPQVKNVTPVKVYHPT---DESADQMAQVQDVWQEQKLKGEGMVISIIDT
        160       170       180       190       200       210       220

795       825       855       885       915       942       972      1002
GVDFKHQALKIKEPNRAKYNKTSIEKLIHEKNLKGKFYSEKVPYGYNYYDYNDNLKDS-YGVMHGMHVTGIVGANDDNQK
|:|  ||  ||:          :|: :|        |   ||:|:||||||||| || :   | |||  :  :|||  :
GIDSSHQDLKLDSGVSTALSKSEVESDKS-KLGHGKYYTEKVPYGYNYADKNDQIVDNGCGEMHGQHVAGIAGAN---GQ
              240       250       260       270       280       290

1032      1062      1092      1122      1152      1182      1212      1242
LYGVAPNAQILAMKVFSDDQQNPTTFTDVWLKALDDAILLKADVVNMSLGTPAGFVHEGKDYPELEVIARACKAGIVIAV
: ||||:|::| :| :   :|: ::   |  : |::| ::|| ||:|||| ::|| |::      |:: |||||:| :
VKGVAPDAQLLAMKVFSNNAKNSGAYDDDIISAIEDSVKLGADVINMSLGSVSSDV--GPSDPQQQAVAKASEAGVINVI
              310       320       330       340       350       360       370

1272      1302      1326      1356      1386      1416      1656
AAGNEGNITDGNTYGVKPLAENYDTAL--IANPALDDNTLAVASMENLKKHAHVLKFKDKKSGTEVTEV~~~~AAILLYN
:|||  |   |:|  |:        :     |  :   :  :|  ||| ||
SAGNSG--VAGSTADGNPVNNTGTSELSTVGTPGVTPDALTVASAENSK-----------------~~~~~~~~~~~~~~
              390       400       410       420

1686      1716      1746      1776      1806
NAKVKDDLGSQLLVESEAAKFNIARITRSTYNNIKNNSNKIITILTERQA---------------------~~~~~~~~
              | ::   |  :|  |: :  :|   :: ||   :
--------------VTTDTVKDELGGVTFSSNSELKG-AAQVTTQLESNYSVLTKKLKLVDMGLGGADDYT~~~~FWLKQQ
                         430       440       450       460       470       480

1824      1854      1884      1914      1944      1974      2004
--------------IDNSLAGQLSSYSSWGPTPDLRLKPEITAPGGHIFSTVEDNQYADKSGTSMAAPQVAGAAAVLKQY
              ||||  |::|:|||||||||  |:     |||:|  :||||||||||||:  ||:  : |:
KKVRASRLKFGTALIDNSRAGKMSDFTSWGPTPELDFKPEITAPGGKIYSLANDNKYQQMSGTSMASPFVAGSEALILQG
                         570       580       590       600       610       620       630

2058      2088      2115      2145      2175      2205      2235
ITDKKIPV--DNAADFIKLLLMNTAQPIINKQ-SKDGKTPYFVRQQGSGAMNLAKALVTTVVATVTGTNDNNADGKLELR
|  : : :    ||   ||:|::|:     :|  :|   :|||||  |: |:  :|: |:  || ||  :|   |  |:
IKKQGLNLSGEELVQFAKNSAMNTSHPVYDTEHTKEIISP---RRQGSGEINVKDAINNTV--EVKAANGNGA---AALK
                         650       660       670       680       690       700
```

-continued

```
2265        2295            2349      2379      2409      2439      2469
ELKEKKFKARILLRNFGKTNKTYIISSEA--IADPVDEKGFRTQNSEHLVSKKADAVTRKVTVEAGKTLAVDLDVDYSDA
|:   ::    ::   |  |  ||   :||  ::         :  |        :::  :|    :    |  ||||:  |::    ||:        :
EIG-RQTTFKVTLTNHGKKAQTYAVDNYGGPYTQATEAKSGEIYDTK-IVKGQLTTETPKVTVQPGES--VDVSFTLTLP
             720       730       740       750        760       770         780

2499        2526      2556      2586      2616      2646      2676      2706
EALTRNNFLEGYLNLK-DTEGVADLHLPFLGFYGSWTEQKAIDAFEGISEIGNGDKRRVQFYVNKETNKTSSTFTTNGM
 ::  |  ||:|||: ::       :|   ||::||:||::  |  ::  |        :|   ||  :   |       :    |
YSFQRQNFVEGYVGFEAKDQATPNLVLPYMGFFGSYS-QASVSA-PMLYEGGNSNLINTIHSLVGVMFSNNNDMLGHTGY
             800       810       820       830       840       850

2724      2754       2781      2811      2841      2871      2901      2931
----LSLPIYNNTVFFSPNSP-FYDKAGVRIAALRNMEYVQYSIIDPDTNKEVRVLGRSHDVRKLYRLDYRNSFAMMPDS
         |     : :   |||        | |     :    ||       :|  |     ||  |:  ||      :   |
EGDDYSKYTDPDLIAISPNGDGSRDYAYPVLFFDRNYKEYTETITDAQGNK-VKSLGVGKEGTKDYYSSSSGEWTTHSLD
         870       880       890       900       910       920       930

2961      2991      3021      3051      3081      3111
IWDGKIKD*IAKGDKQYIYQIKVQLNNKGVGGDGVQIYQYYIKMDNNKPYLSPKDKTTVEKLEDRWK------------
 |||    |       |  ||||    ||::       :||        |          :|:|:        |    :|        |       ||     :  |
KWDGTDADGQVVKDGQYIY--KVEFT-PAIGGQE-QELNIPVKVDSQAPEVSDLQVTKDGKLRLKAKDSGSGLDMTMFVA
          950       960       970       980       990      1000      1010

3159              3189       3219       3249
------------------------------KITFKVQDTGIGLKDVYLQSVKYVGGGNNNLDLITPPGFKK
                                 |:   ||  ||
AVNGEEQ~~~~VDGKSWTKLDKDTVQVAENGKVEFKYQDVYGNESKVTTYEVKNIVKEVAAQPELKLTPDGEGKVKAELA
          1520      1530      1540      1550      1560      1570      1580
```

Figure 149:
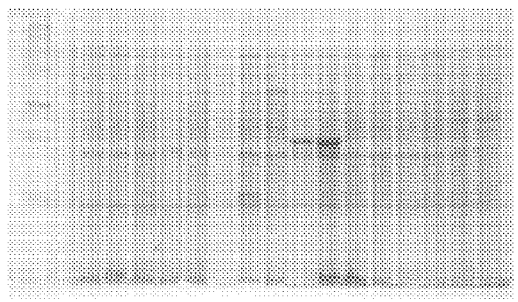
Figure 182:
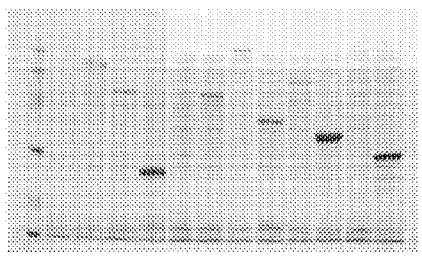

SEQ ID 8768 (GBS362N) was expressed in *E. coli* as a GST-fusion product. SDS-PAGE analysis of total cell extract is shown in FIG. 149 (lane 10; MW 63.5 kDa). It was also expressed in *E. coli* as a His-fusion product. SDS-PAGE analysis of total cell extract is shown in FIG. 182 (lane 9; MW 38 kDa) and in FIG. 149 (lane 11 & 12; MW 38 kDa). Purified GBS362N is shown in FIG. 235, lanes 3 & 4

GBS362C was expressed in *E. coli* as a GST-fusion product. SDS-PAGE analysis of total cell extract is shown in FIG. 149 (lane 14-16; MW 91 kDa). It was also expressed in *E. coli* as a His-fusion product. SDS-PAGE analysis of total cell extract is shown in FIG. 155 (lane 18; MW 66.3 kDa).

Based on this analysis, it was predicted that these proteins and their epitopes could be useful antigens for vaccines or diagnostics.

Possible site: 35
>>> Seems to have no N-terminal signal sequence
INTEGRAL    Likelihood = –4.04    Transmembrane 21-37 (17-38)
----- Final Results -----
    bacterial membrane --- Certainty = 0.2614 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:BAA95000 GB:AB042239 PAa [Streptococcus criceti]
Identities = 55/166 (33%), Positives = 81/166 (48%), Gaps = 24/166 (14%)
Query:     5  KKTDKFGERKSKVCRSLCGALLGTVAVVSLATASTEIHADEATTSPTTVTKVPQPVQADT   64
              K+ + FGFRKSK+ +SLCGALLGT  VVS+  A      A++ TTS T+            DT
Sbjct:     2  KRKETFGERKSKISKSLCGALLGTAIVVSV--AGQRALAEDMTTSTTSA--------VDT   51

Query:    65  TALNTSKTHSTQATTTPVEAKENKVVKSETVQSESRV--MPRD-KVVERPETVKASVNS-  120
              TA+  ++T +         +A   +   ++   Q+E +    MP D    E   E VK++   +
Sbjct:    52  TAVVGTETGNPATNLPEKQADSSSQAEASQAQAEQKTGSMPVDVATTELDEAVKSAAEAG  111

Query:   121  -DVSQPITTTPPTI------NEKTVEIPNLAQDTKKVAPKVTVTPE                159
                VSQ T    T+         +EK+ EI      D   K A   + +T E
Sbjct:   112  VTVSQDETVDKGTVGTSQEADEKSGEI---KADYSKQAETIKITTE                154
``` as a His-fusion product. SDS-PAGE analysis of total cell extract is shown in FIG. 155 (lane 18; MW 66.3 kDa).

Based on this analysis, it was predicted that these proteins and their epitopes could be useful antigens for vaccines or diagnostics.

Example 1241

A DNA sequence (GBSx1318) was identified in *S. agalactiae* <SEQ ID 3841> which encodes the amino acid sequence <SEQ ID 3842>. Analysis of this protein sequence reveals the following:

No corresponding DNA sequence was identified in *S. pyogenes*.

SEQ ID 3842 (GBS222) was expressed in *E. coli* as a His-fusion product. SDS-PAGE analysis of total cell extract is shown in FIG. 44 (lane 6; MW 22 kDa).

Based on this analysis, it was predicted that this protein and its epitopes, could be useful antigens for vaccines or diagnostics.

Example 1242

A DNA sequence (GBSx1319) was identified in *S. agalactiae* <SEQ ID 3843> which encodes the amino acid sequence <SEQ ID 3844>. This protein is predicted to be CylK. Analysis of this protein sequence reveals the following:

```
Possible site: 23
>>> Seems to have no N-terminal signal sequence
----- Final Results -----
    bacterial cytoplasm --- Certainty = 0.3738 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. pyogenes*.

Based on this analysis, it was predicted that this protein and its epitopes, could be useful antigens for vaccines or diagnostics.

Example 1243

A DNA sequence (GBSx1320) was identified in *S. agalactiae* <SEQ ID 3845> which encodes the amino acid sequence <SEQ ID 3846>. This protein is predicted to be CylJ. Analysis of this protein sequence reveals the following:

```
Possible site: 20
>>> Seems to have no N-terminal signal sequence
----- Final Results -----
    bacterial cytoplasm --- Certainty = 0.1143 (Affirmative) <succ>
    bacterial membrane --- Certainty = 0.0000 (Not Clear) <succ>
    bacterial outside --- Certainty = 0.0000 (Not Clear) <succ>
```

A related GBS nucleic acid sequence <SEQ ID 9689> which encodes amino acid sequence <SEQ ID 9690> was also identified.

No corresponding DNA sequence was identified in *S. pyogenes*.

Based on this analysis, it was predicted that this protein and its epitopes, could be useful antigens for vaccines or diagnostics.

Example 1244

A DNA sequence (GBSx1321) was identified in *S. agalactiae* <SEQ ID 3847> which encodes the amino acid sequence <SEQ ID 3848>. Analysis of this protein sequence reveals the following:

```
Possible site: 22
>>> Seems to have no N-terminal signal sequence
----- Final Results -----
    bacterial cytoplasm --- Certainty = 0.0913 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1245

A DNA sequence (GBSx1322) was identified in *S. agalactiae* <SEQ ID 3849> which encodes the amino acid sequence <SEQ ID 3850>. This protein is predicted to be CylI (fabF). Analysis of this protein sequence reveals the following:

```
Possible site: 24
>>> Seems to have an uncleavable N-term signal seq
INTEGRAL    Likelihood = -2.39    Transmembrane 721-737 (721-738)
INTEGRAL    Likelihood = -1.97    Transmembrane 326-342 (326-343)
INTEGRAL    Likelihood = -0.43    Transmembrane 534-550 (534-550)
----- Final Results -----
    bacterial membrane --- Certainty = 0.1956 (Affirmative) <succ>
    bacterial outside --- Certainty = 0.0000 (Not Clear) <succ>
    bacterial cytoplasm --- Certainty = 0.0000 (Not Clear) <succ>
```

A related GBS nucleic acid sequence <SEQ ID 9687> which encodes amino acid sequence <SEQ ID 9688> was also identified.

There is also homology to SEQ ID 3852.

A related GBS gene <SEQ ID 8769> and protein <SEQ ID 8770> were also identified. Analysis of this protein sequence reveals the following:

```
Lipop: Possible site: -1    Crend: 8
McG: Discrim Score: 1.08
GvH: Signal Score (-7.5): -5.97
Possible site: 24
>>> Seems to have an uncleavable N-term signal seq
ALOM program    count: 3 value: -2.39 threshold: 0.0
INTEGRAL    Likelihood = -2.39    Transmembrane 712-728 (712-729)
INTEGRAL    Likelihood = -1.97    Transmembrane 317-333 (317-334)
PERIPHERAL  Likelihood = 3.45     492
modified ALOM score: 0.98
*** Reasoning Step: 3
----- Final Results -----
    bacterial membrane --- Certainty = 0.1956 (Affirmative) <succ>
    bacterial outside --- Certainty = 0.0000 (Not Clear) <succ>
    bacterial cytoplasm --- Certainty = 0.0000 (Not Clear) <succ>
```

SEQ ID 8770 (GBS361) was expressed in *E. coli* as a His-fusion product. SDS-PAGE analysis of total cell extract is shown in FIG. 73 (lane 4; MW 84 kDa).

GBS361-His was purified as shown in FIG. 213, lane 5.

Based on this analysis, it was predicted that these proteins and their epitopes could be useful antigens for vaccines or diagnostics.

Example 1246

A DNA sequence (GBSx1323) was identified in *S. agalactiae* <SEQ ID 3853> which encodes the amino acid sequence <SEQ ID 3854>. This protein is predicted to be CylF. Analysis of this protein sequence reveals the following:

```
Possible site: 44
>>> Seems to have no N-terminal signal sequence
----- Final Results -----
    bacterial cytoplasm --- Certainty = 0.3766 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. pyogenes*.

Based on this analysis, it was predicted that this protein and its epitopes, could be useful antigens for vaccines or diagnostics.

Example 1247

A DNA sequence (GBSx1324) was identified in *S. agalactiae* <SEQ ID 3855> which encodes the amino acid sequence <SEQ ID 3856>. This protein is predicted to be CylE. Analysis of this protein sequence reveals the following:

```
Possible site: 23
>>> Seems to have no N-terminal signal sequence
----- Final Results -----
    bacterial cytoplasm --- Certainty = 0.3498 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. pyogenes*.

Based on this analysis, it was predicted that this protein and its epitopes, could be useful antigens for vaccines or diagnostics.

Example 1248

A DNA sequence (GBSx1325) was identified in *S. agalactiae* <SEQ ID 3857> which encodes the amino acid sequence <SEQ ID 3858>. This protein is predicted to be ABC transporter homolog CylB. Analysis of this protein sequence reveals the following:

Based on this analysis, it was predicted that this protein and its epitopes, could be useful antigens for vaccines or diagnostics.

Example 1249

A DNA sequence (GBSx1326) was identified in *S. agalactiae* <SEQ ID 3859> which encodes the amino acid sequence <SEQ ID 3860>. This protein is predicted to be ABC transporter homolog CylA. Analysis of this protein sequence reveals the following:

```
Possible site: 57
>>> Seems to have no N-terminal signal sequence
----- Final Results -----
    bacterial cytoplasm --- Certainty = 0.4122 (Affirmative) <succ>
    bacterial membrane --- Certainty = 0.0000 (Not Clear) <succ>
    bacterial outside --- Certainty = 0.0000 (Not Clear) <succ>
```

A related GBS nucleic acid sequence <SEQ ID 9683> which encodes amino acid sequence <SEQ ID 9684> was also identified. A further related GBS gene <SEQ ID 8771> and protein <SEQ ID 8772> were also identified. Analysis of this protein sequence reveals homology to membrane protein ABC transporters.

A further related DNA sequence was identified in *S. pyogenes* <SEQ ID 9085> which encodes the amino acid sequence <SEQ ID 9086>. An alignment of the GAS and GBS sequences follows:

```
Score = 85.4 bits (208), Expect = 1e-18
Identities = 68/271 (25%), Positives = 129/271 (47%), Gaps = 17/271 (6%)
Query:  39  KGFTEQHVLKDINFDVYKGDFFGIVGRNGSGKSTLLKIISQIYVPEKGQVT--VDGKMVS    96
            K +    L+DIN   +G F+G++G NG+GK+TL  ++ Q +     G +    VDGK +S
Sbjct:  10  KKYGSFEALRDINLIFEEGKFYGLLGPNGAGKTTLFNLLIQNFKQTSGDIKWEVDGKPLS    69

Query:  97  ----FIELGVGF-----NPELTGRENVYMNGAMLGFTKDEVDDMYNDIVDFAELHHFMNQ   147
                +  +G+ F       + LT EN+   GA+ G +K +V +  D+  + ++       Q
Sbjct:  70  IKDFYRHIGIVFQSNRLDDNLTVEENLISRGALYGLSKSQVRNRLKDLQTYLDITAIKKQ   129

Query: 148  KLKNYSSGMQVRLAFSVAIKAQGDVLILDEVLAVGDEAFQRKCNDYFME-RKDSGKTTIL   206
            K  + S G + ++     + A+  Q  +L+LDE      D   +R   D    +  S T +L
Sbjct: 130  KYGSLSGGQKRKVDIARALLPQPSLLLLDEPTTGLDPQSRRDLWDAIAQLNQQSQMTVVL   189

Query: 207  VTHDMGAVKKYCNRAVLIEDGLVKAYGEPFDVANQYSVDNTETA-EDAMNAEKISVSDIA   265
            +TH + +    C+   ++ +G +    G+        Q+S  N    +    + +++S++D
Sbjct: 190  ITHYLEEMSA-CDVLNVLIEGNIYYSGDIKSFIEQHSTTNLNVVLKPEKSLDQLSIADFV   248

Query: 266  KDLKVSLISNPRITPNDTITFEVSYEVLKDD                               296
            K   ++S   I    D I+ E    +V+ D+
Sbjct: 249  N--KCQVLSEREIVFKD-ISVEEMMQVISDN                               276
```

There is also homology to SEQ IDs 358, 482, 644, 686, 1832, 2529, 2720, 3882, 4028, 4104, 4280, 5090, 5498, 6034, 6500.

SEQ ID 8772 (GBS83) was expressed in *E. coli* as a His-fusion product. SDS-PAGE analysis of total cell extract is shown in FIG. 20 (lane 2; MW 37.6 kDa). It was also expressed in *E. coli* as a GST-fusion product. SDS-PAGE analysis of total cell extract is shown in FIG. 21 (lane 5; MW 62.6 kDa) and in FIG. 28 (lane 3; MW 62.6 kDa).

GBS83-GST was purified as shown in FIG. 195, lane 6.

Based on this analysis, it was predicted that these proteins and their epitopes could be useful antigens for vaccines or diagnostics.

```
Possible site: 56
>>> Seems to have an uncleavable N-term signal seq
INTEGRAL    Likelihood = -13.90    Transmembrane 271-287 (263-291)
INTEGRAL    Likelihood = -10.30    Transmembrane 17-33 (14-43)
INTEGRAL    Likelihood = -8.60     Transmembrane 114-130 (106-138)
INTEGRAL    Likelihood = -6.69     Transmembrane 152-168 (149-178)
INTEGRAL    Likelihood = -1.97     Transmembrane 186-202 (185-202)
----- Final Results -----
    bacterial membrane --- Certainty = 0.6562 (Affirmative) <succ>
    bacterial outside --- Certainty = 0.0000 (Not Clear) <succ>
    bacterial cytoplasm --- Certainty = 0.0000 (Not Clear) <succ>
```

A related GBS nucleic acid sequence <SEQ ID 9685> which encodes amino acid sequence <SEQ ID 9686> was also identified.

No corresponding DNA sequence was identified in *S. pyogenes*.

Example 1250

A DNA sequence (GBSx1327) was identified in *S. agalactiae* <SEQ ID 3861> which encodes the amino acid sequence <SEQ ID 3862>. This protein is predicted to be acyl carrier protein homolog AcpC. Analysis of this protein sequence reveals the following:

```
Possible site: 56
>>> Seems to have no N-terminal signal sequence
----- Final Results -----
    bacterial cytoplasm --- Certainty = 0.3451 (Affirmative) <succ>
       bacterial membrane --- Certainty = 0.0000 (Not Clear) <succ>
          bacterial outside --- Certainty = 0.0000 (Not Clear) <succ>
```

No corresponding DNA sequence was identified in *S. pyogenes*.

Based on this analysis, it was predicted that this protein and its epitopes, could be useful antigens for vaccines or diagnostics.

Example 1251

A DNA sequence (GBSx1328) was identified in *S. agalactiae* <SEQ ID 3863> which encodes the amino acid sequence <SEQ ID 3864>. This protein is predicted to be CylG (fabG). Analysis of this protein sequence reveals the following:

```
Possible site: 39
>>> Seems to have no N-terminal signal sequence
----- Final Results -----
    bacterial cytoplasm --- Certainty = 0.2651 (Affirmative) <succ>
       bacterial membrane --- Certainty = 0.0000 (Not Clear) <succ>
          bacterial outside --- Certainty = 0.0000 (Not Clear) <succ>
```

There is also homology to SEQ ID 3866.

Based on this analysis, it was predicted that this protein and its epitopes, could be useful antigens for vaccines or diagnostics.

Example 1252

A DNA sequence (GBSx1329) was identified in *S. agalactiae* <SEQ ID 3867> which encodes the amino acid sequence <SEQ ID 3868>. This protein is predicted to be CylD. Analysis of this protein sequence reveals the following:

```
Possible site: 60
>>> Seems to have no N-terminal signal sequence
----- Final Results -----
    bacterial cytoplasm --- Certainty = 0.2030 (Affirmative) <succ>
       bacterial membrane --- Certainty = 0.0000 (Not Clear) <succ>
          bacterial outside --- Certainty = 0.0000 (Not Clear) <succ>
```

No corresponding DNA sequence was identified in *S. pyogenes*.

Based on this analysis, it was predicted that this protein and its epitopes, could be useful antigens for vaccines or diagnostics.

Example 1253

A DNA sequence (GBSx1330) was identified in *S. agalactiae* <SEQ ID 3869> which encodes the amino acid sequence <SEQ ID 3870>. Analysis of this protein sequence reveals the following:

```
Possible site: 14
>>> Seems to have no N-terminal signal sequence
----- Final Results -----
    bacterial cytoplasm --- Certainty = 0.3219 (Affirmative) <succ>
       bacterial membrane --- Certainty = 0.0000 (Not Clear) <succ>
          bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1254

A DNA sequence (GBSx1331) was identified in *S. agalactiae* <SEQ ID 3871> which encodes the amino acid sequence <SEQ ID 3872>. Analysis of this protein sequence reveals the following:

```
Possible site: 56
>>> Seems to have no N-terminal signal sequence
INTEGRAL    Likelihood = -8.97    Transmembrane 231-247 (226-251)
INTEGRAL    Likelihood = -7.06    Transmembrane 141-157 (134-164)
INTEGRAL    Likelihood = -2.76    Transmembrane 28-44 (26-44)
INTEGRAL    Likelihood = -1.38    Transmembrane 123-139 (121-139)
INTEGRAL    Likelihood = -0.32    Transmembrane 199-215 (199-215)
----- Final Results -----
    bacterial membrane --- Certainty = 0.4588 (Affirmative) <succ>
       bacterial outside --- Certainty = 0.0000 (Not Clear) <succ>
          bacterial cytoplasm --- Certainty = 0.0000 (Not Clear) <succ>
```

The protein has homology with the following sequences in the GENPEPT database.

```
>GP:CAB88836 GB:AL353832 putative integral membrane transport
protein. [Streptomyces coelicolor A3(2)]
Identities = 68/264 (25%), Positives = 123/264 (45%), Gaps = 10/264 (39%)
Query:    6 RMHFIFIKQYMKQIMEYKIDFFVGVLGVFLTQGLNLLFLNVLFQHIPSLEGWTFQQIAFI    65
            R + +     +++  M Y+  F +   G F    L+ + + ++F  + +L G++  ++AF+
Sbjct:   34 RAYGLIAGMWIRSTMAYRTSFALTAFGNFAMTALDFVAILLMFSRVDALGGYSLPEVAFL    93

Query:   66 YGFSLLPKGIDHLFFDNLWALGQRLIRKGEFDKYLTRPISPLFHVLVETFQVDALGELLV   125
            YG S +  G+  L    ++  LG+R +R G  D   L RP    L  V  + F +  LG ++
Sbjct:   94 YGLSGVSFGLADLAIGSMERLGRR-VRDGTLDTLLVRPAPVLAQVAADRFALRRLGRVVQ   152

Query:  126 GFILL--STTVSSISWTVPKVLLFIFIIPFATLIYISLKIATSSIAFWTKQSGAVIYIF-   182
            G ++L  + V  I WT  KVLL      +   I+ ++ +A + F + + V   F
```

```
                              -continued
Sbjct: 153  GLLVLGYALVVVDIDWTAAKVLLLPVALISGAGIFCAVFVAAGAFQFAAQDASEVANAFT   212

Query: 183  YMFNDFAKYPVAIYNNLLRWIISFVIPFAFTAYYPAAYFLQDRNVYFNIGGVI-----LI   237
            Y   +YP ++    L    +FV+P AF   + PA+Y L   R       ++ G +       L
Sbjct: 213  YGGTTMLQYPPTVFALDLVRGATFVLPLAFVNWLPASYVL-GRPYPLDLPGWVAFTPPLA   271

Query: 238  SLISFMVSLILWHKGVEVYESAGS                                      261
            +      ++ +  W   G+   Y S GS
Sbjct: 272  AAACCALAGLAWRAGLRSYRSTGS                                      295
```

A related DNA sequence was identified in *S. pyogenes* <SEQ ID 3873> which encodes the amino acid sequence <SEQ ID 3874>. Analysis of this protein sequence reveals the following:

```
Possible site: 49
>>> Seems to have no N-terminal signal sequence
INTEGRAL     Likelihood = −8.86    Transmembrane 227-243 (225-251)
INTEGRAL     Likelihood = −7.22    Transmembrane 141-157 (133-164)
INTEGRAL     Likelihood = −6.37    Transmembrane 123-139 (114-140)
INTEGRAL     Likelihood = −2.97    Transmembrane 26-42 (26-49)
----- Final Results -----
    bacterial membrane --- Certainty = 0.4545 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the databases:

```
>GP:CAB88836 GB:AL353832 putative integral membrane transport
protein [Streptomyces coelicolor A3(2)]
Identities = 69/262 (26%), Positives = 125/262 (47%), Gaps = 10/262 (3%)
Query:   8  HAIFIKQYLKQIMEYKVDFVVGVLGVFLTQGLNLLFLSVLFQHIPSLEGWTFEQIAFIYG    67
            + +     +++  M Y+  F +    G F     L+ + +  ++F   + +L G++   ++AF+YG
Sbjct:  36  YGLIAGMWIRSTMAYRTSFALTAFGNFAMTALDFVAILLMFSRVDALGGYSLPEVAFLYG    95

Query:  68  FCLIPKGIDHLFFDNLWALGQRLVRKGEFDKYLTRPISPLFHVLVETFQVDALGELLVGV   127
                 +   G+   L     ++    LG+R VR G   D   L RP   L   V  + F  +    LG ++ G+
Sbjct:  96  LSGVSFGLADLAIGSMERLGRR-VRDGTLDTLLVRPAPVLAQVAADRFALRRLGRVVQGL   154

Query: 128  ILL--VTTAGSIVWTLPKVLLFILVIPFATLIYTSLKIATASISFWTKQSGAVIYIF-YM   184
            ++L       I WT   KVLL + +     I+ ++ +A   +   F  + + V   F Y
Sbjct: 155  LVLGYALVVVDIDWTAAKVLLLPVALISGAGIFCAVFVAAGAFQFAAQDASEVANAFTYG   214

Query: 185  FNDFSKYPMSIYHSFLRWLISFIIPFAFTAYYPASYFLTGQHLLFNIGGLV-----VVSL   239
                 +YP +++   L   +F++P AF   + PASY L G+     ++ G V        + +
Sbjct: 215  GTTMLQYPPTVFALDLVRGATFVLPLAFVNWLPASYVL-GRPYPLDLPGWVAFTPPLAAA   273

Query: 240  LVLALSLKLWKWGLDAYESAGS                                        261
                 AL+    W+  GL +Y S GS
Sbjct: 274  ACCALAGLAWRAGLRSYRSTGS                                        295
```

An alignment of the GAS and GBS proteins is shown below.

```
Identities = 208/261 (79%), Positives = 238/261 (90%)
Query:   1  MTKYQRMHFIFIKQYMKQIMEYKIDFFVGVLGVFLTQGLNLLFLNVLFQHIPSLEGWTFQ    60
            M K  +  MH IFIKQY+KQIMEYK+DF VGVLGVFLTQGLNLLFL+VLFQHIPSLEGWTF+
Sbjct:   1  MAKLRCMHAIFIKQYLKQIMEYKVDFVVGVLGVFLTQGLNLLFLSVLFQHIPSLEGWTFE    60

Query:  61  QIAFIYGFSLLPKGIDHLFFDNLWALGQRLIRKGEFDKYLTRPISPLFHVLVETFQVDAL   120
            QIAFIYGF L+PKGIDHLFFDNLWALGQRL+RKGEFDKYLTRPISPLFHVLVETFQVDAL
Sbjct:  61  QIAFIYGFCLIPKGIDHLFFDNLWALGQRLVRKGEFDKYLTRPISPLFHVLVETFQVDAL   120

Query: 121  GELLVGFILLSTTVSSISWTVPKVLLFIFIIPFATLIYTSLKIATSSIAFWTKQSGAVIY   180
            GELLVG ILL TT  SI WT+PKVLLFI +IPFATLIYTSLKIAT+SI+FWTKQSGAVIY
Sbjct: 121  GELLVGVILLVTTAGSIVWTLPKVLLFILVIPFATLIYTSLKIATASISFWTKQSGAVIY   180

Query: 181  IFYMFNDFAKYPVAIYNNLLRWIISFVIPFAFTAYYPAAYFLQDRNVYFNIGGVILISLI   240
            IFYMFNDF+KYP++IY++ LRW+ISF+IPFAFTAYYPA+YFL   +++ FNIGG+++SL+
Sbjct: 181  IFYMFNDFSKYPMSIYHSFLRWLISFIIPFAFTAYYPASYFLTGQHLLFNIGGLVVVSLL   240
```

```
Query:  241 SFMVSLILWHKGVEVYESAGS                                      261
             +SL LW  G++ YESAGS
Sbjct:  241 VLALSLKLWKWGLDAYESAGS                                      261
```

Based on this analysis, it was predicted that these proteins and their epitopes could be useful antigens for vaccines or diagnostics.

Example 1255

A DNA sequence (GBSx1332) was identified in *S. agalactiae* <SEQ ID 3875> which encodes the amino acid sequence <SEQ ID 3876>. Analysis of this protein sequence reveals the following:

Possible site: 54
>>> Seems to have no N-terminal signal sequence
INTEGRAL    Likelihood = −15.60    Transmembrane 147-163 (134-178)
INTEGRAL    Likelihood = −8.55     Transmembrane 119-135 (114-141)
INTEGRAL    Likelihood = −7.86     Transmembrane 238-254 (235-260)
INTEGRAL    Likelihood = −1.70     Transmembrane 215-231 (212-231)
INTEGRAL    Likelihood = −1.06     Transmembrane 61-77 (61-77)
INTEGRAL    Likelihood = −0.22     Transmembrane 27-43 (27-43)
----- Final Results -----
    bacterial membrane --- Certainty = 0.7241 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:CAB88837 GB:AL353832 putative integral membrane protein.
[Streptomyces coelicolor A3(2)]
Identities = 60/271 (22%), Positives = 118/271 (43%), Gaps = 13/271 (4%)
Query:    6 RRYKPFISTGIQGLITYRVDFILYRIGDVIGAFVAFYLWKAVFDSSSQSLIQGFQLSDMI   65
            R Y    + G +   TYR        + +   + Y + A++D    Q  + G+  +   +
Sbjct:    7 RLYVAVAAGGFRRYATYRAATAAGVFTNTVFGLILVYTYLALWDEKPQ--LGGYDQAQAV   64

Query:   66 LYIIMS-FVTNLLTRTDSSFM--IGDEVKDGSIIMRLLRPVHFAASYLFMEIGSRWLIFL  122
            ++ +   + L        F    + ++  G + + L RP      +L   ++G      L
Sbjct:   65 TFVWLGQALLAALAIGGGGFEDELMERIRTGDVAVDLYRPADLQLWWLAADVGRAVFQLL  124

Query:  123 SIGV-PFLLVITGVRLFLGTDLIQAIVLVVFYIISIILAFLINFFFNICFGFSAFVFKNL  181
             GV PF+      LF    L  + +   ++++++LA ++ F        SAF    +
Sbjct:  125 GRGVVPFVFG----SLFFPVALPREVSVWAAFLVAVVLAMVVGFALRYLVALSAFWLLDG  180

Query:  182 WGSNLLKNSLVAFMSGSLIPLTFFPKIVADILGFLPFSSLIYTPVMIIIGKYDGSQIVQA  241
              G   +       F SG L+PL  FP ++ D++   LP+SSL+  P    +++G+ D       +
Sbjct:  181 TGVTQMAWLAGLFCSGMLLPLNVFPGVLGDVVRALPWSSLLQGPADVLLGEADP---LGT  237

Query:  242 LLLQIFWLIVMVALSQLIWKKVQLHITIQGG                              272
            L Q  W + ++AL +L+       + +QGG
Sbjct:  238 YLFQASWAVALLALGRLVQSAATRRVVVQGG                              268
```

A related DNA sequence was identified in *S. pyogenes* <SEQ ID 3877> which encodes the amino acid sequence <SEQ ID 3878>. Analysis of this protein sequence reveals the following:

Possible site: 50
>>> Seems to have no N-terminal signal sequence
INTEGRAL    Likelihood = −9.18    Transmembrane 252-268 (248-277)
INTEGRAL    Likelihood = −7.22    Transmembrane 161-177 (151-187)
INTEGRAL    Likelihood = −6.10    Transmembrane 133-149 (128-160)
INTEGRAL    Likelihood = −2.81    Transmembrane 213-229 (211-230)
----- Final Results -----
    bacterial membrane --- Certainty = 0.4673 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:AAF11144 GB:AE002002 conserved hypothetical protein
[Deinococcus radiodurans]
Identities = 56/268 (20%), Positives = 113/268 (41%), Gaps = 21/268 (7%)
Query:   15 MWSFWKRYRPFLSAGIQELITYRVNFFLYRIGDVMGAFVAYYLWKAVFDSSKQSLINGFT   74
            M +FW++ R     +    +  YR    ++ +    +   V  +W      S+    ING+T
Sbjct:    1 MTNFWRKVRVLWAVSLASTLEYRAETIIWMLSGTLN-LVMMLVWMTQAKSAPGGQINGYT   59

Query:   75 LSDMTFYIIMSFVTTLLTKSDSSFMIGEEVKDGSIIMRLLRPV-----HFAASYLFMEIG  129
              Y + +++ +  L       + +   +++  G++     LL P+         FAA        +
Sbjct:   60 PQAFAGYFLATWLVSQLLVVWVGWELDYKIRQGTLSPELLHPIDPLWREFAAH--LTDKA  117
```

```
-continued
Query: 130  FRWIVLMSVGFPFLMVLSGIKVMAGLSILQVLASSCLYLVSLLLAFL---INFYFNICFG    186
            FR         P ++VL  + + A L+   Q  +    Y    L LA L   + F +       G
Sbjct: 118  FR--------LPIMLVL--LLIFAALTGAQFTSQWWAYPAVLGLALLGLCVRFLWEYTLG    167

Query: 187  SSAFVFKNLWGSNLLKNALVAFMSGSLIPLAFFPKMVSIVLSFLPFSSLVYTPVMIVIGK    246
              AF ++      +    A    G    PL+F+P   +   + ++ PF   ++   P   ++ GK
Sbjct: 168  LLAFWTESSSSFGEVLWLFYAAFGGMFAPLSFYPGWLQTLAAWTPFPYMLGLPAALLAGK    227

Query: 247  YSLSQIMVALSLQIFWLLVMVVLSQVIW                                  274
              S ++ +      + + WL VM ++ + +W
Sbjct: 228  ASGAEALRGAGVLLGWLAVMWLVRRWVW                                  255
```

An alignment of the GAS and GBS proteins is shown below.

```
Identities = 199/268 (74%), Positives = 236/268 (87%)
Query:   5  WRRYKPFISTGIQGLITYRVDFILYRIGDVIGAFVAFYLWKAVFDSSSQSLIQGFQLSDM    64
            W+RY+PF+S GIQ LITYRV+F LYRIGDV+GAFVA+YLWKAVFDSS QSLI GF LSDM
Sbjct:  19  WKRYRPFLSAGIQELITYRVNFFLYRIGDVMGAFVAYYLWKAVFDSSKQSLINGFTLSDM    78

Query:  65  ILYIIMSFVTNLLTRTDSSFMIGDEVKDGSIIMRLLRPVHFAASYLFMEIGSRWLIFLSI    124
              YIIMSFVT  LLT++DSSFMIG+EVKDGSIIMRLLRPVHFAASYLFMEIG RW++ +S+
Sbjct:  79  TFYIIMSFVTTLLTKSDSSFMIGEEVKDGSIIMRLLRPVHFAASYLFMEIGFRWIVLMSV    138

Query: 125  GVPFLLVITGVRLFLGTDLIQAIVLVVFYIISIILAFLINFFFNICFGFSAFVFKNLWGS    184
            G PFL+V++G+++   G   ++Q +       Y++S++LAFLINF+FNICFG SAFVFKNLWGS
Sbjct: 139  GFPFLMVLSGIKVMAGLSILQVLASSCLYLVSLLLAFLINFYFNICFGSSAFVFKNLWGS    198

Query: 185  NLLKNSLVAFMSGSLIPLTFFPKIVADILGFLPFSSLIYTPVMIIIGKYDGSQIVQALLL    244
            NLLKN+LVAFMSGSLIPL FFPK+V+ +L FLPFSSL+YTPVMI+IGKY  SQI+ AL L
Sbjct: 199  NLLKNALVAFMSGSLIPLAFFPKMVSIVLSFLPFSSLVYTPVMIVIGKYSLSQIMVALSL    258

Query: 245  QIFWLIVNNALSQLIWKKVQLHITIQGG                                  272
            QIFWL+VMV LSQ+IWKKVQ H+TIQGG
Sbjct: 259  QIFWLLVMVVLSQVIWKKVQYHLTIQGG                                  286
```

Based on this analysis, it was predicted that these proteins and their epitopes could be useful antigens for vaccines or diagnostics.

Example 1256

A DNA sequence (GBSx1333) was identified in *S. agalactiae* <SEQ ID 3879> which encodes the amino acid sequence <SEQ ID 3880>. This protein is predicted to be ABC transporter, ATP-binding protein. Analysis of this protein sequence reveals the following:

Possible site: 31
>>> Seems to have no N-terminal signal sequence
----- Final Results -----
   bacterial cytoplasm --- Certainty = 0.2013 (Affirmative) <succ>
     bacterial membrane --- Certainty = 0.0000 (Not Clear) <succ>
       bacterial outside --- Certainty = 0.0000 (Not Clear) <succ>

A related GBS nucleic acid sequence <SEQ ID 9681> which encodes amino acid sequence <SEQ ID 9682> was also identified.

The protein has homology with the following sequences in the GENPEPT database.

```
>GP:AAF09790 GB:AE001882 ABC transporter, ATP-binding protein
[Deinococcus radiodurans]
Identities = 141/331 (42%), Positives = 201/331 (60%), Gaps = 34/331 (10%)
Query:  10 MIEVSHLQKNFIKTVKAPGLKGAFQSFLRPEKHTFEAVKDLTFDVPKGQILGFIGANGAG    69
           MIEV HL K+F +                    AV+D++F +P G+I+G++G NGAG
Sbjct:  46 MIEVRHLCKSFARK--------------------PAVQDISFSIPAGEIVGYLGPNGAG    84

Query:  70 KSTTIKMLTGILKPTSGFCRIDGKLPQENRQNYVKDIGVVFGQRTQLWWDLALQETYTVL   129
           KSTTIK+LTG+L P SG  R+ G +P + R+ +V  +G VFGQRT LWWDL ++E+  +L
Sbjct:  85 KSTTIKVLTGLLVPDSGEVRVGGLVPWKQRRQHVARLGAVFGQRTTLWWDLPVRESLELL   144

Query: 130 KEIYDVPDKEFRKRMAFLNEVLELNDFIKDPVRTLSLGQRMRADIAASLLHNPKVLFLDE   189
           + +Y VP   F + +A   E+LEL  F+  P R LSLGQRMRAD+AA+LLH+P++LFLDE
Sbjct: 145 RHVYRVPAARFAENLAGFTELLELGPFLNTPARALSLGQRMRADLAAALLHDPELLFLDE   204

Query: 190 PTIGLDVSVKDNIRRAITQINQEEETTILLTTHDLSDIEQLCHRIFMIDRGQEIFDGTVS   249
           PT+GLDV K+ IR +   +N E    T+LLTTHDL D+E+L  R+ MID G+ +FDG ++
Sbjct: 205 PTVGLDVVAKERIREFVKAVNAERGVTVLLTTHDLGDVERLARRVMMIDTGRLLFDGPLA   264

Query: 250 QLKETFGKMKTL--SFDLRPGQEHISS-SLIGKSEINIKRNDLVLDIQYDSSRYQTADII   306
           +L+  +G  + L  F+   P Q   +  +L+G+        ++        Y S   A I
Sbjct: 265 ELQARYGGERELWVEFEKAPAQPALPGLTLLGQDGPRVR---------YGFSGAAAAPIA   315

Query: 307 QQTLADFSVRDLKMTDADIEDIIRRFYRNEL                               337
           Q T A   VRDL + + ++E  IRR Y   L
Sbjct: 316 QVT-ALAPVRDLAVKEPEVEATIRRIYEGNL                               345
```

A related DNA sequence was identified in *S. pyogenes* <SEQ ID 3881> which encodes the amino acid sequence <SEQ ID 3882>. Analysis of this protein sequence reveals the following:

Possible site: 60
>>> Seems to have no N-terminal signal sequence
----- Final Results -----
bacterial cytoplasm --- Certainty = 0.3315 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

Based on this analysis, it was predicted that these proteins and their epitopes could be useful antigens for vaccines or diagnostics.

Example 1257

A DNA sequence (GBSx1334) was identified in *S. agalactiae* <SEQ ID 3883> which encodes the amino acid sequence <SEQ ID 3884>. This protein is predicted to be Fmt. Analysis of this protein sequence reveals the following:

```
Identities = 272/330(82%), Positives = 305/330(92%)
Query:   8 MSMIEVSHLQKNFIKTVKAPGLKGAFQSFLRPEKHTFEAVKDLTFDVPKGQILGFIGANG    67
           M MIEVSHLQKNF KT+K PGLKGA +SF+ P +  FEAVKDL+F+VPKGQILGFIGANG
Sbjct:   1 MVMIEVSHLQKNFSKTIKEPGLKGALESFVHPPREIFEAVKDLSFEVPKGQILGFIGANG    60

Query:  68 AGKSTTIKMLTGILKPTSGFCRIDGKLPQENRQNYVKDIGVVFGQRTQLWWDLALQETYT   127
           AGKSTTIKMLTGILKPTSG+CRI+GK+PQ+NRQ YV+DIG VFGQRTQLWWDLALQETY
Sbjct:  61 AGKSTTIKMLTGILKPTSGYCRINGKIPQDNRQYYVRDIGAVFGQRTQLWWDLALQETYV   120

Query: 128 VLKEIYDVPDKEFRKRMAFLNEVLELNDFIKDPVRTLSLGQRMRADIAASLLHNPKVLFL   187
           VLKEIYDVP+K FRKRM FLNEVL+LN+FIKDPVRTLSLGQRMRADIAASLLHNPKVLFL
Sbjct: 121 VLKEIYDVPEKAFRKRMDFLNEVLDLNEFIKDPVRTLSLGQRMRADIAASLLHNPKVLFL   180

Query: 188 DEPTIGLDVSVKDNIRRAITQINQEEETTILLTTHDLSDIEQLCHRIFMIDRGQEIFDGT   247
           DEPTIGLDVSVKDNIRRAITQINQEEETTILLTTHDLSDIEQLC RI MID+GQEIFDGT
Sbjct: 181 DEPTIGLDVSVKDNIRRAITQINQEEETTILLTTHDLSDIEQLCDRIIMIDKGQEIFDGT   240

Query: 248 VSQLKETFGKMKTLSFDLRPGQEHISSSLIGKSEINIKRNDLVLDIQYDSSRYQTADIIQ   307
           V+QLK++FGKMK+LSF+L+PGQE + S  +G  +I ++R++L LDIQYDSSRYQTADIIQ
Sbjct: 241 VTQLKQSFGKMKSLSFELKPGQEQVVSQFMGLPDITVERHELSLDIQYDSSRYQTADIIQ   300

Query: 308 QTLADFSVRDLKMTDADIEDIIRRFYRNEL                                337
           +T+ADF+VRD+KMTD DIEDI+RRFYR EL
Sbjct: 301 KTMADFAVRDVKMTDVDIEDIVRRFYRKEL                                330
```

```
Possible site: 32
>>> Seems to have an uncleavable N-term signal seq
INTEGRAL    Likelihood = -9.39   Transmembrane 21-37 (8-39)
INTEGRAL    Likelihood = -7.75   Transmembrane 360-376 (359-381)
----- Final Results -----
   bacterial membrane --- Certainty = 0.4758 (Affirmative) <succ>
     bacterial outside --- Certainty = 0.0000 (Not Clear) <succ>
       bacterial cytoplasm --- Certainty = 0.0000 (Not Clear) <succ>
```

A related GBS nucleic acid sequence <SEQ ID 8775> which encodes amino acid sequence <SEQ ID 8776> was also identified. Analysis of this protein sequence reveals the following:

```
Lipop: Possible site: -1    Crend: 10
McG: Discrim Score: 8.85
GvH: Signal Score (-7.5): -3.75
Possible site: 25
>>> Seems to have an uncleavable N-term signal seq
ALOM program   count: 2 value: -9.39   threshold: 0.0
INTEGRAL     Likelihood = -9.39   Transmembrane 21-37 (8-39)
INTEGRAL     Likelihood = -7.75   Transmembrane 353-369 (352-374)
PERIPHERAL   Likelihood = 4.24    92
modified ALOM score: 2.38
*** Reasoning Step: 3
----- Final Results -----
   bacterial membrane --- Certainty = 0.4758 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the GENPEPT database.

There is also homology to SEQ ID 3886.

A related GBS gene <SEQ ID 8773> and protein <SEQ ID 8774> were also identified. Analysis of this protein sequence reveals the following:

```
Lipop: Possible site: -1    Crend: 6
McG: Discrim Score: 14.89
GvH: Signal Score (-7.5): -3.75
Possible site: 25
>>> Seems to have an uncleavable N-term signal seq
ALOM program   count: 1 value: -9.39   threshold: 0.0
INTEGRAL     Likelihood = -9.39   Transmembrane 14-30 (1-32)
PERIPHERAL   Likelihood = 4.24    85
modified ALOM score: 2.38
*** Reasoning Step: 3
----- Final Results -----
   bacterial membrane --- Certainty = 0.4758 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP:BAA24012 GB:AB009635 Fmt [Staphylococcus aureus]
Identities = 72/279 (25%), Positives = 125/279 (43%), Gaps = 25/279 (8%)
Query:  49  LHRFMRKNNVNGMMIVSDNTGKPITISHGINRGEVETDIEN--NKLFPMASLQKLMTGII  106
            + ++++ +   NG + + +N GK + +S G     + E   I+N  N +F + S QK  TG++
Sbjct:  79  IDKYLQSSLFNGSVAIYEN-GK-LKMSKGYGYQDFEKGIKNTPNTMFLIGSAQKFSTGLL  136

Query: 107  IQRLIDQDVLSEDDRLSQFFPQVKGSNSITIHQLLTHTSGLREKGVKVSPYLKNEREQLQ  166
            +++L ++   ++ +D +S++ P K S    I+    L+ H SGL +    K S   KN  + ++
Sbjct: 137  LKQLEEEHKININDPVSKYLPWFKTSKPIPLKDLMLHQSGLYK--YKSSKDYKNLDQAVK  194

Query: 167  FCLKHYNFVNK-KSWYYSNINFSFLTGIATQVTGRTYAELVDDVIKNPLRLDDTQSYQSV  225
                K      K K    Y++ N+   L  +    +VTG++YAE      I +PL+L  T    Y
Sbjct: 195  AIQKRGIDPKKYKKHMYNDGNYLVLAKVIEEVTGKSYAENYYTKIGDPLKLQHTAFYD--  252

Query: 226  VNHDLVSPMRKNGKLNKINIF----NQVSTAYGAGDFFTTPLNFWVLMRSFSKGYFFPT-  280
                      + K    N +       N +    YGAG+ + TP +   L+  +       F
Sbjct: 253  -EQPFKKYLAKGYAYNSTGLSFLRPNILDQYYGAGNLYMTPTDMGKLITQIQQYKLFSPK  311

Query: 281  -------DEYTKHQNDAISHYYGGLYMHGRIVNSNGTFF                      312
                   +  TK  D    Y G Y   +   NG FF
Sbjct: 312  ITNPLLHEFGTKQYPD---EYRYGFYAKPTLNRLNGGFF                      347
```

```
29.6/49.6% over 218aa
Bacillus cereus
GP|4127525| D-stereospecific peptide hydrolase Insert characterized
ORF00162(478-1083 of 1644)
GP|4127525|emb|CAA09676.1||AJ011526(67-285 of 389) D-stereospecific peptide
hydrolase {Bacillus cereus}
% Match = 5.8
% Identity = 29.5 % Similarity = 49.5
Matches = 62 Mismatches = 96 Conservative Sub.s = 42
```

-continued

```
     330       360       390       420       450       480       510       540
MILRRLFMVRKFLKSLLSLFLIAVIATGISVACFFFIPENKGNITPILLHRFMRKNNVNGMMIVSDNTGKPITISHGINR
  :::         :        |       :|:   :         :          |        |::  :    ||       :  ||
TCASLALLIAGSSLLYTTPTSIVKAEPTQNVSSSLQTNTQRDRTSVKQAMRDTLQLGYPGILAKTSEGGKTWGYAAGIAD
          20        30        40        50        60        70        80

570       600       630       660             705       735       753
GEVETDIENNKLFPMASLQKLMTGIIIQRLIDQDVLSEDDRLSQFFPQV---KG--SNSITIHQLLTHTSGL----REKG
  :  :::  :     |  :  | :|     | :  :|:  ::  |     ||  :  :|    |   |||:::| ||||: ||
LRTKKPMKTDFRFRIGSVTKTFTATVVLQLVGENRLKLDDHIEDWLPGVIQGNGYDGNKITIQEILNHTSGIAEYSRSKD
        100       110       120       130       140       150       160

807       834       864       894       924       954       978
VKVSPYLKN--EREQLQFCLKHY-NFVNKKSWYYSNINFSFLTGIATQVTGRTYAELVDDVIKNPLRLDDT--QSYQSVV
|  :   |:      |  ::   :         :|    |    |||   :  :|   :|||  :|||  |::    |    ||   :|          ||:
VDFTDTKKSYTAEELVKMGISFPPDFAPGKGWSYSNTGYVLLGILIEKVTGNSYAEEVENRIIEPLELSNTFLPGNSSVI
        180       190       200       210       220       230       240

993      1023      1053      1083      1113      1143      1173      1203
---NH--DLVSPMRKNGKLNKINIFNQVSTAYGAGDFFTTPLNFWVLMRSFSKGYFFPTDEYTKHQNDAISHYYGGLYMH
   ||     ||      |        :|       :|       |        |||    :|       ::      :         |::              :          |
PGTNHARGYVQP-DGASELKDVTYYN-PSAGSSAGDMISTADDLNKFFSYLLGGKLLGEQQLKQMLTTVPTGKEGIDGYG
        260       270       280       290       300       310       320
```

SEQ ID 8776 (GBS61) was expressed in *E. coli* as a GST-fusion product. SDS-PAGE analysis of total cell extract is shown in FIG. 33 (lane 3; MW 68 kDa).

GBS61-GST was purified as shown in FIG. 195, lane 5.

Based on this analysis, it was predicted that these proteins and their epitopes could be useful antigens for vaccines or diagnostics.

Example 1258

A DNA sequence (GBSx1335) was identified in *S. agalactiae* <SEQ ID 3887> which encodes the amino acid sequence <SEQ ID 3888>. Analysis of this protein sequence reveals the following:

Possible site: 32
>>> Seems to have no N-terminal signal sequence
----- Final Results -----
   bacterial cytoplasm --- Certainty = 0.2398 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1259

A DNA sequence (GBSx1336) was identified in *S. agalactiae* <SEQ ID 3889> which encodes the amino acid sequence <SEQ ID 3890>. Analysis of this protein sequence reveals the following:

Possible site: 28
>>> Seems to have an uncleavable N-term signal seq
INTEGRAL    Likelihood = −5.57    Transmembrane 16-32 (13-33)
----- Final Results -----
   bacterial membrane --- Certainty = 0.3230 (Affirmative) <succ>
    bacterial outside --- Certainty = 0.0000 (Not Clear) <succ>
    bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1260

A DNA sequence (GBSx1337) was identified in *S. agalactiae* <SEQ ID 3891> which encodes the amino acid sequence <SEQ ID 3892>. Analysis of this protein sequence reveals the following:

Possible site: 14
>>> Seems to have no N-terminal signal sequence
----- Final Results -----
   bacterial cytoplasm --- Certainty = 0.3910 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1261

A DNA sequence (GBSx1338) was identified in *S. agalactiae* <SEQ ID 3893> which encodes the amino acid sequence <SEQ ID 3894>. Analysis of this protein sequence reveals the following:

```
Possible site: 37
>>> Seems to have no N-terminal signal sequence
----- Final Results -----
    bacterial cytoplasm --- Certainty = 0.4239 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1262

A DNA sequence (GBSx1339) was identified in S. agalactiae <SEQ ID 3895> which encodes the amino acid sequence <SEQ ID 3896>. Analysis of this protein sequence reveals the following:

```
Possible site: 32
>>> Seems to have no N-terminal signal sequence
----- Final Results -----
    bacterial cytoplasm --- Certainty = 0.4349 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1263

A DNA sequence (GBSx1340) was identified in S. agalactiae <SEQ ID 3897> which encodes the amino acid sequence <SEQ ID 3898>. Analysis of this protein sequence reveals the following:

```
Possible site: 16
>>> Seems to have no N-terminal signal sequence
----- Final Results -----
    bacterial cytoplasm --- Certainty = 0.4962 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1264

A DNA sequence (GBSx1341) was identified in S. agalactiae <SEQ ID 3899> which encodes the amino acid sequence <SEQ ID 3900>. Analysis of this protein sequence reveals the following:

```
Possible site: 29
>>> Seems to have no N-terminal signal sequence
----- Final Results -----
    bacterial cytoplasm --- Certainty = 0.4014 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP:AAG38044 GB:AF295925 Orf28
[Streptococcus pneumoniae]
Identities = 23/35 (65%), Positives = 28/35 (79%)
Query:    9 LIHWEGNSGDKLIEHQTSATGWYYQVDRSFSQPKG    43
              L +WEGNSGDKL+E QT AT WYYQ+++ FSQ  G
Sbjct:  180 LTYWEGNSGDKLLERQTRATEWYYQIEKGFSQTNG   214
```

No corresponding DNA sequence was identified in S. pyogenes.

Based on this analysis, it was predicted that this protein and its epitopes, could be useful antigens for vaccines or diagnostics.

Example 1265

A DNA sequence (GBSx1342) was identified in S. agalactiae <SEQ ID 3901> which encodes the amino acid sequence <SEQ ID 3902>. Analysis of this protein sequence reveals the following:

```
Possible site: 26
>>> Seems to have no N-terminal signal sequence
----- Final Results -----
    bacterial cytoplasm --- Certainty = 0.2036 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1266

A DNA sequence (GBSx1343) was identified in S. agalactiae <SEQ ID 3903> which encodes the amino acid sequence <SEQ ID 3904>. Analysis of this protein sequence reveals the following:

```
Possible site: 47
>>> Seems to have a cleavable N-term signal seq.
----- Final Results -----
    bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>
```

A related GBS nucleic acid sequence <SEQ ID 10933> which encodes amino acid sequence <SEQ ID 10934> was also identified.

Figure 25:
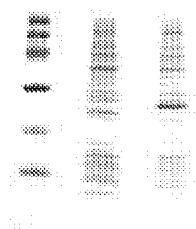

SEQ ID 3904 (GBS153) was expressed in E. coli as a His-fusion product. SDS-PAGE analysis of total cell extract is shown in FIG. 25 (lane 3; MW 22 kDa). It was also expressed in *E. coli* as a GST-fusion product. SDS-PAGE analysis of total cell extract is shown in FIG. 31 (lane 4; MW 47 kDa).

GBS153-GST was purified as shown in FIG. 198, lane 4.

Based on this analysis, it was predicted that these proteins and their epitopes could be useful antigens for vaccines or diagnostics.

Example 1267

A DNA sequence (GBSx1344) was identified in *S. agalactiae* <SEQ ID 3905> which encodes the amino acid sequence <SEQ ID 3906>. Analysis of this protein sequence reveals the following:

```
Possible site: 13
>>> Seems to have no N-terminal signal sequence
----- Final Results -----
    bacterial cytoplasm --- Certainty = 0.2036 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1268

A DNA sequence (GBSx1345) was identified in *S. agalactiae* <SEQ ID 3907> which encodes the amino acid sequence <SEQ ID 3908>. Analysis of this protein sequence reveals the following:

```
Possible site: 19
>>> Seems to have no N-terminal signal sequence
----- Final Results -----
    bacterial cytoplasm --- Certainty = 0.2570 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP:CAA59773 GB:X85787 tasA
[Streptococcus pneumoniae]
Identities = 18/33 (54%), Positives = 28/33 (84%)
Query:   2 DVQSDENFAFKIFKVAKAKGLSLDVFDKLVGRF         34
             + QSD+N  F++FKV+K  KG++LD  FD+++GRF
Sbjct: 320 EYQSDKNPFFEVFKVSKTKGIALDPFDEIIGRF        352
```

A related DNA sequence was identified in *S. pyogenes* <SEQ ID 3909> which encodes the amino acid sequence <SEQ ID 3910>. Analysis of this protein sequence reveals the following:

```
Possible site: 56
>>> Seems to have no N-terminal signal sequence
----- Final Results -----
    bacterial cytoplasm --- Certainty = 0.2405 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
Identities = 18/34 (52%), Positives = 25/34(72%)
Query:  1 MDVQSDENFAFKIFKVAKAKGLSLDVFDKLVGRF        34
            +DVQSDE+F FK+ KV K+KG+ L+  D+ V  F
Sbjct: 31 LDVQSDEDFGFKVVKVLKSKGIVLNALDESVCGF        64
```

Based on this analysis, it was predicted that these proteins and their epitopes could be useful antigens for vaccines or diagnostics.

Example 1269

A DNA sequence (GBSx1346) was identified in *S. agalactiae* <SEQ ID 3911> which encodes the amino acid sequence <SEQ ID 3912>. This protein is predicted to be a fimbria-associated protein. Analysis of this protein sequence reveals the following:

```
Possible site: 52
>>> Seems to have no N-terminal signal sequence
INTEGRAL   Likelihood = -1.17   Transmembrane 169-185 (168-185)
----- Final Results -----
    bacterial membrane --- Certainty = 0.1468 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:AAC13546 GB:AF019629 putative fimbria-associated protein
[Actinomyces naeslundii]
Identities = 53/109 (48%), Positives = 75/109 (68%)
Query:  13 IPKINQDLPIYAGSEEDNLQRGVGHLEGISLPIGGASTHAVLSGQRGMPAARLFADLDKM    72
           IP I+ DLP+Y G+ +D L +G+GHLEG SLP+GG   T +V++G RG+   A +F +LDK+
Sbjct: 93 IPSISLDLPVYHGTADDTLLKGLGHLEGTSLPVGGEGTRSVITGHRGLAEATMFTNLDKV    152

Query:  73 KKGDYFVTNLKETLAYQVDRIMVIEPSQLDAVSIEEDKDYVTLLTCTP                121
           K GD    V    E L Y+V    V+EP + +A+ +EE KD +TL+TCTP
Sbjct: 153 KTGDSLIVEVFGEVLTYRVTSTKVVEPEETEALRVEEGKDLLTLVTCTP               201
```

There is also homology to SEQ ID 3740 and to SEQ ID 3910.

Figure 177:
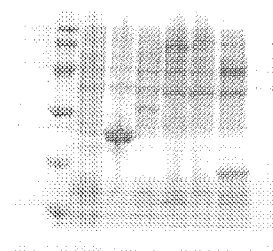

SEQ ID 3912 (GBS194) was expressed in *E. coli* as a His-fusion product. SDS-PAGE analysis of total cell extract is shown in FIG. 177 (lane 2; MW 24 kDa).

Based on this analysis, it was predicted that this protein and its epitopes, could be useful antigens for vaccines or diagnostics.

Example 1270

A DNA sequence (GBSx1347) was identified in *S. agalactiae* <SEQ ID 3913> which encodes the amino acid sequence <SEQ ID 3914>. Analysis of this protein sequence reveals the following:

```
Possible site: 42
>>> Seems to have no N-terminal signal sequence
INTEGRAL   Likelihood = -5.15   Transmembrane 880-896 (876-898)
INTEGRAL   Likelihood = -4.78   Transmembrane 24-40 (23-42)
----- Final Results -----
   bacterial membrane --- Certainty = 0.3060 (Affirmative) <succ>
      bacterial outside --- Certainty = 0.0000 (Not Clear) <succ>
         bacterial cytoplasm --- Certainty = 0.0000 (Not Clear) <succ>
```

A related GBS nucleic acid sequence <SEQ ID 8777> which encodes amino acid sequence <SEQ ID 8778> was also identified. Analysis of this protein sequence reveals the following:

```
Lipop: Possible site: -1   Crend: 8
SRCFLG: 0
McG: Length of UR: 20
Peak Value of UR: 2.80
Net Charge of CR: 5
```

-continued

```
McG: Discrim Score: 10.81
GvH: Signal Score (-7.5): -3.76
Possible site: 29
>>> Seems to have an uncleavable N-term signal seq
Amino Acid Composition: calculated from 1
ALOM program   count: 2 value: -5.15 threshold: 0.0
INTEGRAL      Likelihood = -5.15   Transmembrane 867-883 (863-885)
INTEGRAL      Likelihood = -4.78   Transmembrane 11-27 (10-29)
PERIPHERAL    Likelihood = 7.58    531
modified ALOM score: 1.53
icm1 HYPID: 7   CFP: 0.306
*** Reasoning Step: 3
----- Final Results -----
   bacterial membrane --- Certainty = 0.3060 (Affirmative) <succ>
      bacterial outside --- Certainty = 0.0000 (Not Clear) <succ>
         bacterial cytoplasm --- Certainty = 0.0000 (Not Clear) <succ>
LPXTG motif: 859-863
```

No corresponding DNA sequence was identified in *S. pyogenes*.

SEQ ID 8778 (GBS104) was expressed in *E. coli* as a His-fusion product. SDS-PAGE analysis of total cell extract is shown in FIG. 27 (lane 5; MW 95 kDa).

GBS104-His was purified as shown in FIG. 221, lane 9-10.

Based on this analysis, it was predicted that this protein and its epitopes, could be useful antigens for vaccines or diagnostics.

Example 1271

A DNA sequence (GBSx1348) was identified in *S. agalactiae* <SEQ ID 3915> which encodes the amino acid sequence <SEQ ID 3916>. This protein is predicted to be a fimbria-associated protein. Analysis of this protein sequence reveals the following:

```
Possible site: 40
>>> Seems to have an uncleavable N-term signal seq
INTEGRAL   Likelihood = -15.28   Transmembrane 257-273 (252-280)
INTEGRAL   Likelihood = -7.11    Transmembrane 19-35 (16-39)
----- Final Results -----
   bacterial membrane --- Certainty = 0.7114 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the GENPEPT database.

```
>GP:AAC13546 GB:AF019629 putative fimbria-associated protein
[Actinomyces naeslundii]
Identities = 79/178 (44%), Positives = 112/178 (62%), Gaps = 7/178 (3%)
Query:   65 RIALANAYNETLSRNPLL-----IDPFTSKQKEGLREYARMLEVHEQ--IGHVAIPSIGV   117
            ++  A+AYN+ LS   +L     +        K+    +YA +L+ +  +   + IPSI +
Sbjct:   39 QVEQAHAYNDALSAGAVLEANNHVPTGAGSSKDSSLQYANILKANNEGLMARLKIPSISL    98

Query:  118 DIPIYAGTSETVLQKGSGHLEGTSLPVGGLSTHSVLTAHRGLPTARLFTDLNKVKKGQIF   177
            D+P+Y GT++   L KG GHLEGTSLPVGG   T SV+T HRGL   A +FT+L+KVK G
Sbjct:   99 DLPVYHGTADDTLLKGLGHLEGTSLPVGGEGTRSVITGHRGLAEATMFTNLDKVKTGDSL   158

Query:  178 YVTNIKETLAYKVVSIKVVDPTALSEVKIVNGKDYITLLTCTPYMINSHRLLVKGERI     235
            V     E L Y+V S KVV+P    +++  GKD +TL+TCTP  IN+HR+L+ GERI
Sbjct:  159 IVEVFGEVLTYRVTSTKVVEPEETEALRVEEGKDLLTLVTCTPLGINTHRILLTGERI    216
```

There is also homology to SEQ ID 3740.

SEQ ID 3916 (GBS208) was expressed in *E. coli* as a His-fusion product. SDS-PAGE analysis of total cell extract is shown in FIG. 44 (lane 5; MW 35 kDa). It was also expressed in *E. coli* as a GST-fusion product. SDS-PAGE analysis of total cell extract is shown in FIG. 85 (lane 8; MW 59.7 kDa) and in FIG. 160 (lane 5; MW 60 kDa).

GBS208-GST was purified as shown in FIG. 224, lane 7-8.

Based on this analysis, it was predicted that this protein and its epitopes, could be useful antigens for vaccines or diagnostics.

Example 1272

A DNA sequence (GBSx1349) was identified in *S. agalactiae* <SEQ ID 3917> which encodes the amino acid sequence <SEQ ID 3918>. This protein is predicted to be a fimbria-associated protein. Analysis of this protein sequence reveals the following:

Possible site: 30
>>> Seems to have a cleavable N-term signal seq.
INTEGRAL   Likelihood = −9.13   Transmembrane 265-281 (260-284)
----- Final Results -----
   bacterial membrane --- Certainty = 0.4652 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the GENPEPT database.

```
>GP:AAC13546 GB:AF019629 putative fimbria-associated protein
[Actinomyces naeslundii]
Identities = 96/265 (36%), Positives = 150/265 (56%), Gaps = 10/265 (3%)
Query:   41  QASHANINAFKEAVTKIDRVEINRRLELAYAYNASI-AGAKTNGEYPALKDPYSAEQKQA   99
             Q + + + A     A      R +     ++E A+AYN ++ AGA         P  A   +
Sbjct:   15  QYNQSKVTADYSAQVDGARPDAKTQVEQAHAYNDALSAGAVLEANNHV---PTGAGSSKD   71

Query:  100  GVVEYARMLEVKEQ--IGHVIIPRINQDIPIYAGSAEENLQRGVGHLEGTSLPVGGESTH  157
              ++YA +L+     +   +   + IP I+ D+P+Y G+A++ L +G+GHLEGTSLPVGGE T
Sbjct:   72  SSLQYANILKANNEGLMARLKIPSISLDLPVYHGTADDTLLKGLGHLEGTSLPVGGEGTR  131

Query:  158  AVLTAHRGLPTAKLFTNLDKVTVGDRFYIEHIGGKIAYQVDQIKVIAPDQLEDLYVIQGE  217
              +V+T  HRGL   A +FTNLDKV    GD     +E   G    + Y+V     KV  P++  E L V +G+
Sbjct:  132  SVITGHRGLAEATMFTNLDKVKTGDSLIVEVFGEVLTYRVTSTKVVEPEETEALRVEEGK  191

Query:  218  DHVTLLTCTPYMINSHRLLVRGKRI-PYVEKTVQKDSKTFRQQQYLTYAMWVVVGLILLS  276
             D  +TL+TCTP    IN+HR+L+  G+RI P         K +        K           +    +A+   +  GLI++
Sbjct:  192  DLLTLVTCTPLGINTHRILLTGERIYPTPAKDLAAAGKRPDVPHFPWWAVGLAAGLIVVG  251

Query:  277  LLIW---FKKTKQKKRRKNEKAASQ                                    298
             L  +W    +      + K+R           A+Q
Sbjct:  252  LYLWRSGYAAARAKERALARARAAQ                                    276
```

There is also homology to SEQ ID 3740.

SEQ ID 3918 (GBS209) was expressed in *E. coli* as a GST-fusion product. SDS-PAGE analysis of total cell extract is shown in FIG. 50 (lane 4; MW 62 kDa). It was also expressed in *E. coli* as a His-fusion product. SDS-PAGE analysis of total cell extract is shown in FIG. 85 (lane 3; MW 37.2 kDa).

GBS209-His was purified as shown in FIG. 221, lane 8.

Based on this analysis, it was predicted that this protein and its epitopes, could be useful antigens for vaccines or diagnostics.

Example 1273

A DNA sequence (GBSx1350) was identified in *S. agalactiae* <SEQ ID 3919> which encodes the amino acid sequence <SEQ ID 3920>. Analysis of this protein sequence reveals the following:

Possible site: 27
>>> Seems to have a cleavable N-term signal seq.
INTEGRAL   Likelihood = −9.66   Transmembrane 281-297 (276-300)
----- Final Results -----
   bacterial membrane --- Certainty = 0.4864 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the GENPEPT database.

```
>GP:BAB04080 GB:AP001508 unknown [Bacillus halodurans]
Identities = 45/141 (31%), Positives = 63/141 (43%), Gaps = 20/141 (14%)
Query:   153  TGELDLLKVGVDGDTKKPLAGVVFELYEKNGRTPIRVKNGVHSQDIDAAKHLETDSSGHI   212
              TG L++ KV  D DT + L G  F LY+  G    IR             LET       G
Sbjct:  1084  TGSLEVTKV--DADTGEVLQGATFTLYDSEGEFAIRT--------------LETGEDGKA  1127

Query:   213  RISGLIHGDYVLKEIETQSGYQIGQAETAVTIEKSKTVTVTIENKKVPTPKVPSRGGL-I   271
               L++GDY+LKE    GY +G  +T         +     VT+EN+K      +V + G + +
Sbjct:  1128  TFVNLLYGDYLLKEDSAPEGYLVGINDTQRVTIDTVLHEVTVENEKSDINRVSAVGAVQL  1187

Query:   272  PKTGEQQAMALVIIGGILIAL                                         292
                 K  E+       +L      G L AL
Sbjct:  1188  QKVDEETGESL---QGALFAL                                        1205

Identities = 64/259 (24%), Positives = 113/259 (42%), Gaps = 48/259 (18%)
Query:    16  GTMFGISQT---VLAQTHQLTIVHLEARDIDRPNP----QLEIAPKE-GTPIEGVLYQL   67
              G + GI+ T         +    H++T+ + E  DI+R +        QL+     +E G   ++G L+ L
Sbjct:  1147  GYLVGINDTQRVTIDTVLHEVTVEN-EKSDINRVSAVGAVQLQKVDEETGESLQGALFAL  1205
```

-continued

```
Query:   68 YQLKSTEDGDLLAHWNSLTITELKKQAQQVFEATTNQQGKATFNQLPDGIYYGL----AV    123
             Q   E         +TI E++    + +  A + + G   F +L    + Y L     V
Sbjct: 1206 QQKVDDE---------FVTIAEMETDEEGIVFAGSLEPGDYQFVELNAPVGYKLDETPVV  1256

Query:  124 KAGEKNRNVSAFLVDLSEDKVIYPKIIWSTGELDLLKVGVDGDTKKPLAGVVFELYEENG   183
             E++R  +   ++L ++  + P      G + L+KV D D     L G  F L +   G
Sbjct: 1257 FTVEEDRTET---IELQKENHLIP------GSVQLVKVDAD-DAANTLEGAEFTLLDGEG  1306

Query:  184 RTPIRVKNGVHSQDIDAAKHLETDSSGHIRISGLIHGDYVLKEIETQSGYQIGQAETAVT   243
             V+  G         L TD +G + ++  L   G+Y   E +   +GY++          T
Sbjct: 1307 NV---VQEG----------LTTDENGQVVVTDLKPGEYQFVETKAPAGYELEATPIGFT  1352

Query:  244 IEKS--KTVTVTIENKKVP                                            260
             IE++  +   TV +EN  +P
Sbjct: 1353 IERNQQEVATVAVENHLIP                                           1371
```

No corresponding DNA sequence was identified in *S. pyogenes*.

SEQ ID 3920 (GBS52) was expressed in *E. coli* as a His-fusion product. SDS-PAGE analysis of total cell extract is shown in FIG. 7 (lane 4; MW 30.5 kDa).

GBS52-His was purified as shown in FIG. 192, lane 8.

Based on this analysis, it was predicted that this protein and its epitopes, could be useful antigens for vaccines or diagnostics.

Example 1274

A DNA sequence (GBSx1351) was identified in *S. agalactiae* <SEQ ID 3921> which encodes the amino acid sequence <SEQ ID 3922>. Analysis of this protein sequence reveals the following:

Possible site: 46
>>> Seems to have no N-terminal signal sequence
INTEGRAL    Likelihood = −6.26    Transmembrane 554-570 (551-575)
INTEGRAL    Likelihood = −0.16    Transmembrane 34-50 (34-50)
----- Final Results -----
    bacterial membrane --- Certainty = 0.3506 (Affirmative) <succ>
        bacterial outside --- Certainty = 0.0000 (Not Clear) <succ>
        bacterial cytoplasm --- Certainty = 0.0000 (Not Clear) <succ>

A related GBS nucleic acid sequence <SEQ ID 8779> which encodes amino acid sequence <SEQ ID 8780> was also identified. Analysis of this protein sequence reveals the following:

Lipop: Possible site: −1    Crend: 0
McG: Discrim Score: −5.81
GvH: Signal Score (−7.5): −1.92
Possible site: 37
>>> Seems to have a cleavable N-terminal signal sequence
ALOM program   count: 2 value: −6.26    threshold: 0.0
INTEGRAL       Likelihood = −6.26        Transmembrane 527-543
                                         (524-548)
PERIPHERAL     Likelihood = 5.36          194
modified ALOM score: 1.75
*** Reasoning Step: 3
----- Final Results -----
    bacterial membrane --- Certainty = 0.3506 (Affirmative) <succ>
        bacterial outside --- Certainty = 0.0000 (Not Clear) <succ>
        bacterial cytoplasm --- Certainty = 0.0000 (Not Clear) <succ>

LPXTG motif: 521-525

The protein has homology with the following sequences in the GENPEPT database.

```
>GP:CAA57459 GB:X81869 orf2 [Lactobacillus leichmannii]
Identities = 140/505 (27%), Positives = 220/505 (42%), Gaps = 94/505 (18%)
Query:  102 GEVISNYAKLGDNVKGLQGVQFKRYKVKTDI-----SVDELKKLTTVEAADAKVGTILEE   156
            GE+++++      G     L GV FK Y V        S D  +   T    +DAK     L
Sbjct:   58 GEIMNDFGGTG-----LNGVTFKAYNVTDHYLSLRKSGDSAQDAVTAIQSDAKDSDNLPS   112

Query:  157 --GVSLPQKTNAQGLVVDAL---------DSKSNVR-YLYVEDLKNSPSNITKAYAVPFV   204
              G ++   +T A    D +             DS   N +  YL+VE    +SP+++T+   A P V
Sbjct:  113 YAGSAIATETTATSKGEDGIAAFDNLNLKDSDGNYQTYLFVET--DSPTDVTQQ-AAPIV   169

Query:  205 LELPVANSTGTGFLS-EINIYPKNVVTDEPKTDKDVKKLGQDDAGYTI-----------G   252
            L +P+   ++  T  ++  +I  IYPKNV + P T KD+ +  + D    T+                G
Sbjct:  170 LTMPIYKTSDTSAINHDIQIYPKNVKST-PIT-KDLDEASKKDLAVTLPDGSTIYNAQYG   227

Query:  253 EEFKWFLKSTIPANLGDYEKFEITDKFADGLTYKSVGKIKIGSKTLNRDEHYTIDEPTVD   312
            + F + +     +P N+  D + F + DK    G+   +    +    L +       YT+++
Sbjct:  228 KSFGYNITVNVPWNIKDKDTFNVVDKPDTGI---DIDASTVSIDGLTKSTDYTVNK----   280

Query:  313 NQNTLKITFKPEKFKEIAELLKGMTLVKNQDALDKATANTDDAAFLEIPVASTINEKAVL   372
            N  ++ FK         + L G +L              I   +T+   A
Sbjct:  281 KDNGYQVVFKTTS--AAVQALAGKSLT--------------------ITYKATLTNNATP   318

Query:  373 GKAIENTFELQYDHTPDKADNPKPSNPPRKPEVHTGGKRFVKKDSTETQTLGGAEFDLLA   432
              KAI NT  L  +    +          S  P       P ++TGG +FVKKDS     +TL GAEF L+
Sbjct:  319 DKAIGNTATLSIGNGTNIT-----STPANGPRIYTGGAQFVKKDSQSNKTLAGAEFQLVK   373
```

```
                               -continued
Query: 433  --SDGTAVKWTDALIKANTNKNYIAGEAVTGQPIKLKSHTDGTFEIKGLAYAVDANAEGT   490
              S+G V +         +  N  A EA T         S   +G    +KGL+Y    ++    +
Sbjct: 374  VDSNGNIVSYATQASDGSYTWNDSATEATT-----YTSDANGLVALKGLSY---SDKLDS   425

Query: 491  AVTYKLKETKAPEGYVIPDKEIEFTVSQTSYNTKPTDITVDSADATPDTIKNNKRPSIPN   550
              +Y L E +AP+GY     D   ++F+++Q S+              D+    TI N K    +P+
Sbjct: 426  GESYALLEIQAPDGYAKLDSPVKFSITQGSF----------GDSNKITIDNTKEGLLPS    474

Query: 551  TGGIGTAIFVAIGAAVMAFAVKGMK                                    575
              TGG G   IF+AIG  +M  A  G K
Sbjct: 475  TGGKGIYIFLAIGIVIMIVAFGGYK                                    499
```

No corresponding DNA sequence was identified in *S. pyogenes*.

SEQ ID 8780 (GBS80) was expressed in *E. coli* as a His-fusion product. SDS-PAGE analysis of total cell extract is shown in FIG. 16 (lane 6; MW 56.8 kDa).

The GBS80-His fusion product was purified (FIG. 104A; see also FIG. 194, lane 5) and used to immunise mice (lane 1+2 product; 20µg/mouse). The resulting antiserum was used for Western blot (FIG. 104B), FACS (FIG. 104C), and in the in vivo passive protection assay (Table III). These tests confirm that the protein is immunoaccessible on GBS and that it is an effective protective immunogen.

Based on this analysis, it was predicted that this protein and its epitopes, could be useful antigens for vaccines or diagnostics.

Example 1275

A DNA sequence (GBSx1352) was identified in *S. agalactiae* <SEQ ID 3923> which encodes the amino acid sequence <SEQ ID 3924>. Analysis of this protein sequence reveals the following:

Possible site: 17
>>> Seems to have no N-terminal signal sequence
----- Final Results -----
    bacterial cytoplasm --- Certainty = 0.4043 (Affirmative) <succ>
        bacterial membrane --- Certainty = 0.0000 (Not Clear) <succ>
            bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1276

A DNA sequence (GBSx1353) was identified in *S. agalactiae* <SEQ ID 3925> which encodes the amino acid sequence <SEQ ID 3926>. This protein is predicted to be MsmR. Analysis of this protein sequence reveals the following:

Possible site: 32
>>> Seems to have no N-terminal signal sequence
INTEGRAL    Likelihood = –1.01    Transmembrane 75-91 (75-92)
----- Final Results -----
    bacterial membrane --- Certainty = 0.1404 (Affirmative) <succ>
        bacterial outside ---Certainty = 0.0000 (Not Clear) <succ>
            bacterial cytoplasm --- Certainty = 0.0000 (Not Clear) <succ>

A related GBS nucleic acid sequence <SEQ ID 9679> which encodes amino acid sequence <SEQ ID 9680> was also identified.

SEQ ID 3926 (GBS360) was expressed in *E. coli* as a GST-fusion product. SDS-PAGE analysis of total cell extract is shown in FIG. 81 (lane 9; MW 74 kDa).

GBS360-GST was purified as shown in FIG. 216, lane 8.

Based on this analysis, it was predicted that these proteins and their epitopes could be useful antigens for vaccines or diagnostics.

Example 1277

A DNA sequence (GBSx1354) was identified in *S. agalactiae* <SEQ ID 3927> which encodes the amino acid sequence <SEQ ID 3928>. Analysis of this protein sequence reveals the following:

Possible site: 53
>>> Seems to have no N-terminal signal sequence
----- Final Results -----
    bacterial cytoplasm --- Certainty = 0.1762 (Affirmative) <succ>
        bacterial membrane --- Certainty = 0.0000 (Not Clear) <succ>
            bacterial outside --- Certainty= 0.0000 (Not Clear) <succ>

A related DNA sequence was identified in *S. pyogenes* <SEQ ID 3929> which encodes the amino acid sequence <SEQ ID 3930>. Analysis of this protein sequence reveals the following:

Possible site: 28
>>> Seems to have no N-terminal signal sequence
----- Final Results -----
    bacterial cytoplasm --- Certainty = 0.1640 (Affirmative) <succ>
        bacterial membrane --- Certainty = 0.0000 (Not Clear) <succ>
            bacterial outside --- Certainty = 0.0000 (Not Clear) <succ>

An alignment of the GAS and GBS proteins is shown below.

```
Identities = 93/98 (94%), Positives = 96/98 (97%)
Query:   1   MDKIIKSISASGAFRSYVLDSTETVKLAQEKHHTLSSSTVALGRTLIANQILAANQKGDS    60
             MDKIIKSI+ SGAFR+YVLDSTETV LAQEKH+TLSSSTVALGRTLIANQILAANQKGDS
Sbjct:   1   MDKIIKSIAQSGAFRAYVLDSTETVALAQEKHNTLSSSTVALGRTLIANQILAANQKGDS    60

Query:  61   KITVKVIGDSSFGHIISVADTKGHVKGYIQNTGVDIKK                          98
             KITVKVIGDSSFGHIISVADTKGHVKGYIQNTGVDIKK
Sbjct:  61   KITVKVIGDSSFGHIISVADTKGHVKGYIQNTGVDIKK                          98
```

Based on this analysis, it was predicted that these proteins and their epitopes could be useful antigens for vaccines or diagnostics.

Example 1278

A DNA sequence (GBSx1355) was identified in *S. agalactiae* <SEQ ID 3931> which encodes the amino acid sequence <SEQ ID 3932>. Analysis of this protein sequence reveals the following:

```
Possible site: 17
>>> Seems to have an uncleavable N-term signal seq
----- Final Results -----
  bacterial membrane --- Certainty = 0.0000 (Not Clear) <succ>
    bacterial outside --- Certainty = 0.0000 (Not Clear) <succ>
      bacterial cytoplasm --- Certainty = 0.0000 (Not Clear) <succ>
```

The protein has homology with the following sequences in the GENPEPT database.

```
>GP:AAC98436 GB:L29324 unknown [Streptococcus pneumoniae]
Identities = 34/48 (70%), Positives = 39/48 (80%)
Query:   1   MQEVLIIARENHQVTHEHVSILLTCVQELIVEVNQTQPLSREFREKYM    48
             + EV IIA+ NHQVTHEHVSILLTC+QELI EV +T PLS +F  KYM
Sbjct:  70   VHEVFIIAKTNHQVTHEHVSILLTCIQELIKEVEKTGPLSEDFCNKYM   117
```

No corresponding DNA sequence was identified in *S. pyogenes*.

Based on this analysis, it was predicted that this protein and its epitopes, could be useful antigens for vaccines or diagnostics.

Example 1279

A DNA sequence (GBSx1356) was identified in *S. agalactiae* <SEQ ID 3933> which encodes the amino acid sequence <SEQ ID 3934>. This protein is predicted to be TnpA (orfB). Analysis of this protein sequence reveals the following:

```
Possible site: 13
>>> Seems to have no N-terminal signal sequence
----- Final Results -----
```
  bacterial cytoplasm --- Certainty = 0.5248 (Affirmative) <succ>
    bacterial membrane --- Certainty = 0.0000 (Not Clear) <succ>
      bacterial outside --- Certainty = 0.0000 (Not Clear) <succ>

A related GBS nucleic acid sequence <SEQ ID 9907> which encodes amino acid sequence <SEQ ID 9908> was also identified. A further related GBS nucleic acid sequence <SEQ ID 9677> which encodes amino acid sequence <SEQ ID 9678> was also identified. A further related GBS nucleic acid sequence <SEQ ID 10911> which encodes amino acid sequence <SEQ ID 10912> was also identified.

There is homology to SEQ ID 1336.

Based on this analysis, it was predicted that these proteins and their epitopes could be useful antigens for vaccines or diagnostics.

Example 1280

A DNA sequence (GBSx1357) was identified in *S. agalactiae* <SEQ ID 3935> which encodes the amino acid sequence <SEQ ID 3936>. Analysis of this protein sequence reveals the following:

```
Possible site: 45
>>> Seems to have no N-terminal signal sequence
----- Final Results -----
  bacterial cytoplasm --- Certainty = 0.4489 (Affirmative) <succ>
    bacterial membrane --- Certainty = 0.0000 (Not Clear) <succ>
      bacterial outside --- Certainty = 0.0000 (Not Clear) <succ>
```

The protein has homology with the following sequences in the GENPEPT database.

```
>GP:AAB64982 GB:U43834 Ydr540cp [Saccharomyces cerevisiae]
Identities = 93/171 (54%), Positives = 121/171 (70%), Gaps = 3/171 (1%)
Query:   1   MRVYENKEELKKEISKTFEKYIMEFNNIPENLKDKRIDEVDRTPAANLSYQVGWTNLVLK    60
             MR Y +K+ELK+EI K +EKY  EF  I E+ KD++++ VDRTP+ NLSYQ+GW NL+L+
Sbjct:   1   MREYTSKKELKEEIEKKYEKYDAEFETISESQKDEKVETVDRTPSENLSYQLGWVNLLLE    60

Query:  61   WEEDERKGLQVKTPSDKFKWNQLGELYQWFTDTYAHLSLQELKAKLNENINSIYAMIDLL   120
             WE  E  G  V+TP+  +KWN LG LYQ F    Y   S++E +AKL E +N +Y  I  L
Sbjct:  61   WEAREIAGYNVETPAPGYKWNNLGGLYQSFYKKYGIYSIKEQRAKLREAVNEVYKWISTL   120

Query: 121   SEEELFEAHMRKWADEATKTATWEVYKFIHVNTVAPFGTFRTKIRKWKKIV            171
             S++ELF+A  RKW    AT  A W VYK+IH+NTVAPF  FR KIRKWK++V
Sbjct: 121   SDDELFQAGNRKW---ATTKAMWPVYKWIHINTVAPFTNFRGKIRKWKRLV            168
```

No corresponding DNA sequence was identified in *S. pyogenes*.

Based on this analysis, it was predicted that this protein and its epitopes, could be useful antigens for vaccines or diagnostics.

Example 1281

A DNA sequence (GBSx1358) was identified in *S. agalactiae* <SEQ ID 3937> which encodes the amino acid sequence <SEQ ID 3938>. Analysis of this protein sequence reveals the following:

```
Possible site: 28
>>> Seems to have an uncleavable N-term signal seq
INTEGRAL    Likelihood = -3.45    Transmembrane 10-26 (2-26)
----- Final Results -----
    bacterial membrane --- Certainty = 0.2381 (Affirmative) <succ>
    bacterial outside --- Certainty = 0.0000 (Not Clear) <succ>
        bacterial cytoplasm --- Certainty = 0.0000 (Not Clear) <succ>
```

A related GBS nucleic acid sequence <SEQ ID 8781> which encodes amino acid sequence <SEQ ID 8782> was also identified. Analysis of this protein sequence reveals the following:

```
Lipop: Possible site: -1  Crend: 6
McG: Discrim Score: 8.80
GvH: Signal Score (-7.5): -3.94
Possible site: 28
>>> Seems to have an uncleavable N-term signal seq
ALOM program         count: 1 value: -3.45  threshold: 0.0
INTEGRAL             Likelihood = -3.45     Transmembrane 7-23 (2-26)
PERIPHERAL           Likelihood = 10.40     69
modified ALOM score: 1.19
*** Reasoning Step: 3
----- Final Results -----
    bacterial membrane --- Certainty = 0.2381 (Affirmative) <succ>
    bacterial outside --- Certainty = 0.0000 (Not Clear) <succ>
        bacterial cytoplasm --- Certainty = 0.0000 (Not Clear)
```

The protein has homology with the following sequences in the GENPEPT database.

```
>GP:CAA68889 GB:Y07615 acid phosphatase [Haemophilus influenzae]
Identities = 112/245 (45%), Positives = 148/245 (59%), Gaps = 10/245 (4%)
Query:   5 MKKVLVSSLLVLGITITLQTVVEAKGPKVAYTQEGMTALSDTNKDKVTTISIDEIQKSLE   64
           MK V+  S++ L  +T   V   G    YTQ G A     +  +   IS+D+I++SLE
Sbjct:   1 MKNVMKLSVIAL---LTAAAVPAMAGKTEPYTQSGTNAREMLQEQAIHWISVDQIKQSLE   57

Query:  65 GKKPITVSFDIDDTLLFSSQYFQYGKEYVTPGSFDFLHKQKFWDLVAKRGDQDSIPKEYA  124
           GK  PI VSFDIDDT+LFSS  F +G++   +PG  D+L  Q FW+ V    D+ SIPK+ A
Sbjct:  58 GKAPINVSFDIDDTVLFSSPCFYHGQQKFSPGKHDYLKNQDFWNEVNAGCDKYSIPKQIA  117

Query: 125 KKLIAMHQKRGDKIVFITGRTRGSMYKEGEVDKTAKALAKDFKLDKPIAVNYTGDKPKKP  184
           + LI MHQ RGD++ F TGRT       G+VD    L K F +     V + G + ++
Sbjct: 118 IDLINMHQARGDQVYFFTGRT------AGKVDGVTPILEKTFNIKNMHPVEFMGSR-ERT  170

Query: 185 YKYDKSYYIKKYGSDIHYGDSDDDIHAAREAGARPIRILRAPNSTNLPLPEAGGYGEEVL  244
           KY+K+  I  +    IHYGDSDDD+ AA+EAG R IR++RA NST  P+P  GGYGEEVL
Sbjct: 171 TKYNKTPAIISHKVSIHYGDSDDDVLAAKEAGVRGIRLMRAANSTYQPMPTLGGYGEEVL  230

Query: 245 ENSAY                                                        249
           NS+Y
Sbjct: 231 INSSY                                                        235
```

A related DNA sequence was identified in *S. pyogenes* <SEQ ID 3939> which encodes the amino acid sequence <SEQ ID 3940>. Analysis of this protein sequence reveals the following:

```
Possible site: 56
>>> Seems to have an uncleavable N-term signal seq
INTEGRAL    Likelihood = -3.98    Transmembrane 6-22 (4-25)
----- Final Results -----
    bacterial membrane --- Certainty = 0.2593 (Affirmative) <succ>
    bacterial outside --- Certainty = 0.0000 (Not Clear) <succ>
        bacterial cytoplasm --- Certainty = 0.0000 (Not Clear) <succ>
```

The protein has homology with the following sequences in the databases:

```
>GP:CAA68889 GB:Y07615 acid phosphatase [Haemophilus influenzae]
Identities = 105/237 (44%), Positives = 141/237 (59%), Gaps = 10/237 (4%)
Query:   9 LFTVSFCGIIALPVEASGPKVPYTQEGITA--ISNQATVKLISIADIASSLEGQKPITVS   66
           L ++     A+P  A G   PYTQ G  A    +  +   IS+  I  SLEG+ PI VS
Sbjct:   7 LSVIALLTAAAVPAMA-GKTEPYTQSGTNAREMLQEQAIHWISVDQIKQSLEGKAPINVS   65

Query:  67 FDIDDTLLFTSQYFQYGKEYITPGSFDFLHKQKFWDLVAKRGDQDSIPKEYAKQLIAMHQ  126
           FDIDDT+LF+S  F +G++   +PG  D+L  Q FW+ V    D+ SIPK+ A  LI MHQ
Sbjct:  66 FDIDDTVLFSSPCFYHGQQKFSPGKHDYLKNQDFWNEVNAGCDKYSIPKQIAIDLINMHQ  125
```

```
Query:  127 KRGDKIVFITGRTRGSMYKKGEIDKTAKSLAKDFKLDKPIAINYTGDKAVKPYQYDKTYY   186
             RGD++ F TGRT        G++D     L K F +      + + G +  +   +Y+KT
Sbjct:  126 ARGDQVYFFTGRT------AGKVDGVTPILEKTFNIKNMHPVEFMGSRE-RTTKYNKTPA   178

Query:  187 IKKNGSQIHYGDSDEDINAAKEAGARPIRILRAPNSTNLPLPKAGGYGEEVLENSAY      243
             I  +   IHYGDSD+D+ AAKEAG R IR++RA NST  P+P  GGYGEEVL NS+Y
Sbjct:  179 IISHKVSIHYGDSDDDVLAAKEAGVRGIRLMRAANSTYQPMPTLGGYGEEVLINSSY      235
```

An alignment of the GAS and GBS proteins is shown below.

```
Identities = 196/245 (80%), Positives = 216/245 (88%), Gaps = 2/245 (0%)
Query:    5 MKKVLVSSLLVLGITITLQTVVEAKGPKVAYTQEGMTALSDTNKDKVTTISIDEIQKSLE    64
            MKK   S L  +     +  VEA GPKV YTQEG+TA+S  N+   V  ISI  I   SLE
Sbjct:    1 MKKEFTSILFTVSFCGIIALPVEASGPKVPYTQEGITAIS--NQATVKLISIADIASSLE    58

Query:   65 GKKPITVSFDIDDTLLFSSQYFQYGKEYVTPGSFDFLHKQKFWDLVAKRGDQDSIPKEYA   124
            G+KPITVSFDIDDTLLF+SQYFQYGKEY+TPGSFDFLHKQKFWDLVAKRGDQDSIPKEYA
Sbjct:   59 GQKPITVSFDIDDTLLFTSQYFQYGKEYITPGSFDFLHKQKFWDLVAKRGDQDSIPKEYA   118

Query:  125 KKLIAMHQKRGDKIVFITGRTRGSMYKEGEVDKTAKALAKDFKLDKPIAVNYTGDKPKKP   184
            K+LIAMHQKRGDKIVFITGRTRGSMYK+GE+DKTAK+LAKDFKLDKPIA+NYTGDK  KP
Sbjct:  119 KQLIAMHQKRGDKIVFITGRTRGSMYKKGEIDKTAKSLAKDFKLDKPIAINYTGDKAVKP   178

Query:  185 YKYDKSYYIKKYGSDIHYGDSDDDIHAAREAGARPIRILRAPNSTNLPLPEAGGYGEEVL   244
            Y+YDK+YYIKK GS IHYGDSD+DI+AA+EAGARPIRILRAPNSTNLPLP+AGGYGEEVL
Sbjct:  179 YQYDKTYYIKENGSQIHYGDSDEDINAAKEAGARPIRILRAPNSTNLPLPKAGGYGEEVL   238

Query:  245 ENSAY                                                         249
            ENSAY
Sbjct:  239 ENSAY                                                         243
```

SEQ ID 8782 (GBS100) was expressed in *E. coli* as a His-fusion product. SDS-PAGE analysis of total cell extract is shown in FIG. 16 (lane 5; MW 28 kDa). It was also expressed in *E. coli* as a GST-fusion product. SDS-PAGE analysis of total cell extract is shown in FIG. 33 (lane 2; MW 53 kDa).

The GBS100-GST fusion product was purified (FIG. 106A; see also FIG. 197, lane 4) and used to immunise mice (lane 1 product; 9.9 μg/mouse). The resulting antiserum was used for Western blot (FIG. 106B), FACS (FIG. 106C), and in the in vivo passive protection assay (Table III). These tests confirm that the protein is immunoaccessible on GBS and that it is an effective protective immunogen.

Based on this analysis, it was predicted that these proteins and their epitopes could be useful antigens for vaccines or diagnostics.

Example 1282

A DNA sequence (GBSx1359) was identified in *S. agalactiae* <SEQ ID 3941> which encodes the amino acid sequence <SEQ ID 3942>. Analysis of this protein sequence reveals the following:

Possible site: 19
>>> Seems to have no N-terminal signal sequence
----- Final Results -----
 bacterial cytoplasm --- Certainty = 0.3288 (Affirmative) <succ>
  bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1283

A DNA sequence (GBSx1360) was identified in *S. agalactiae* <SEQ ID 3943> which encodes the amino acid sequence <SEQ ID 3944>. Analysis of this protein sequence reveals the following:

Possible site: 50
>>> Seems to have no N-terminal signal sequence
----- Final Results -----
 bacterial cytoplasm --- Certainty = 0.4004 (Affirmative) <succ>
  bacterial membrane --- Certainty = 0.0000 (Not Clear) <succ>
   bacterial outside --- Certainty = 0.0000 (Not Clear) <succ>

A related GBS nucleic acid sequence <SEQ ID 9675> which encodes amino acid sequence <SEQ ID 9676> was also identified.

The protein has homology with the following sequences in the GENPEPT database.

```
>GP:BAB04406 GB:AP001509 RNA methyltransferase [Bacillus halodurans]
 Identities = 198/452 (43%), Positives = 300/452 (65%)
 Query:   12 KRKIMLHKNDIIETEISDISHEGMGIAKVDGFVFFVENALPGEIIKMRVLKLRKRIGYGK   71
```

```
                K++   ++KND++E   I D++H+G G+ARVDG+   F+   ALPGE +K +V+K++K   G+G+
Sbjct:    3     KQQAPVNKNDVVEVTIEDLTHDGAGVAKVDGYALFIPKALPGERLKAKVVKVKKGYGEGR    62

Query:   72     VEEYLTTSPHRNEGLDYTYLRTGIADLGHLTYEQQLLFKQKQVADNLYKIAHISDVLVEP   131
                V    +  SP R E        + + G    L H++Y+ QL +KQKQV  D L +I   I+ V V P
Sbjct:   63     VLEMIEASPDRVEAPCPVFNQCGGCQLQHMSYDAQLRYKQKQVQDVLERIGKITAVTVRP   122

Query:  132     TLGMTIPLAYRNKAQVPVRRVDGQLETGFERKNSHTLVSIEDYLIQEKEIDALINFTRDL   191
                T+GM  P   YRNKAQVPV    +G L   GF+++ SH ++ +++ +IQ +E D         ++L
Sbjct:  123     TIGMNEPWRYRNKAQVPVGEREGGLIAGFYQERSHRIIDMDECMIQHEENDKVIRQVKEL   182

Query:  192     LRKFDVKPYDEEQQSGLIRNLVVRRGHYTGQLMLVLVTTRPKIFRIDQMIEKLVSAFPSV   251
                 R+    ++ YDEE+   G +R++V R G  TG++M+VL+T    ++      +IE++   A P V
Sbjct:  183     ARELGIRGYDEEKHRGTLRHVVARYGKNTGEIMVVLITRGEELPHKKTLIERIHKAIPHV   242

Query:  252     VSIMQNINDRNSNVIFGKEFRTLYGSDTIEDQMLGNTYAISAQSFYQVNTEMAEKLYQKA   311
                 SI+QN+N  + +NVIFG +  +  L+G +  I D +     +AISA+SFYQVN  E   + LY +A
Sbjct:  243     KSIVQNVNPKRTNVIFGDKTKVLWGEEYIYDTIGDIKFAISARSFYQVNPEQTKVLYDQA   302

Query:  312     IDFSDLNSEDIVIDAYSGIGTIGLSVAKQVKHVYGVEVVEKAVSDAKENATRNGITNSTY   371
                ++F++L    +  VIDAY GIGTI L  +A+Q KHVYGVE+V  +A+SDAK NA   NG   N   +
Sbjct:  303     LEFANLTGSETVIDAYCGIGTISLFLAQQAKHVYGVEIVPEAISDAKRNARLNGFANVQF   362

Query:  372     VADSAENAMAKWLKEGIKPTVIMVDPPRKGLTESFVYSAAQTKADKITYISCNSATMARD   431
                         AE  M    W   +G++  VI+VDPPRKG   E+ +  +       K D++ Y+SCN AT+ARD
Sbjct:  363     ANGDAEKVMPWWYAQGVRADVIVVDPPRKGCDEALLKTILNMKPDRVVYVSCNPATLARD   422

Query:  432     IKLFEELGYHLVKIQPVDLFPMTHHVECVALL                             463
                +++ E+ GY        +QPVD+FP T H+E VA+L
Sbjct:  423     LRVLEDGGYETKDVQPVDMFPWTTHIESVAVL                             454
```

A related DNA sequence was identified in *S. pyogenes* <SEQ ID 3945> which encodes the amino acid sequence <SEQ ID 3946>. Analysis of this protein sequence reveals the following:

Possible site: 33
>>> Seems to have no N-terminal signal sequence

-continued

----- Final Results -----
bacterial cytoplasm --- Certainty = 0.1262 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 332/454 (73%), Positives = 387/454 (85%)
Query:   12     KRKIMLHKNDIIETEISDISHEGMGIAKVDGFVFFVENALPGEIIKMRVLKLRKRIGYGK    71
                KR  ML KNDII+   ISD+SHEG G+AK DGFVFFV+NALP E+I MRVLK+ K   G+GK
Sbjct:    8     KRIRMLKKNDIIQVAISDLSHEGAGVAKHDGFVFFVDNALPEEVIDMRVLKVNKNSGFGK    67

Query:   72     VEEYLTTSPHRNEGLDYTYLRTGIADLGHLTYEQQLLFKQKQVADNLYKIAHISDVLVEP   131
                VE Y     S  RN  ++  TYLRTGIADLGHLTYE  QL  FK+KQV  D+LYKIA  ISDV VE
Sbjct:   68     VEAYHYLSSARNADVNLTYLRTGIADLGHLTYEDQLTFKKKQVQDSLYKIAGISDVTVES   127

Query:  132     TLGMTIPLAYRNKAQVPVRRVDGQLETGFFRKNSHTLVSIEDYLIQEKEIDALINFTRDL   191
                T+GMT  PLAYRNKAQVPVRRV+GQLETGFFRK+SH L+  I DY IQ+KEID LINFTRDL
Sbjct:  128     TIGMTEPLAYRNKAQVPVRRVNGQLETGFFRKHSHDLIPISDYYIQDKEIDRLINFTRDL   187

Query:  192     LRKFDVKPYDEEQQSGLIRNLVVRRGHYTGQLMLVLVTTRPKIFRIDQMIEKLVSAFPSV   251
                LR+FD+KPYDE +Q+GL+RN+VVRRGHY+G++MLVLVTTRPK+FR+DQ+IEK+V AFP+V
Sbjct:  188     LRRFDIKPYDETEQTGLLRNIVVRRGHYSGEMMLVLVTTRPKVFRVDQVIEKIVEAFPAV   247

Query:  252     VSIMQNINDRNSNVIFGKEFRTLYGSDTIEDQMLGNTYAISAQSFYQVNTEMAEKLYQKA   311
                VSI+QNIND+N+N IFGK+F+TLYG DTI D MLGN YAISAQSFYQVNT MAEKLYQ A
Sbjct:  248     VSIIQNINDKNTNAIFGKDFKTLYGKDTITDSMLGNNYAISAQSFYQVNTVMAEKLYQTA   307

Query:  312     IDFSDLNSEDIVIDAYSGIGTIGLSVAKQVKHVYGVEVVEKAVSDAKENATRNGITNSTY   371
                I FSDL+ +DIVIDAYSGIGTIGLS AK VK VYGVEV+E AV DA++NA  NGITN+ +
Sbjct:  308     IAFSDLSKDDIVIDAYSGIGTIGLSFAKTVKAVYGVEVIEAAVRDAQQNAALNGITNAYF   367

Query:  372     VADSAENAMARWLKEGIKPTVIMVDPPRKGLTESFVYSAAQTKADKITYISCNSATMARD   431
                VAD+AE AMA W K+GIKP+VI+VDPPRKGLTESF+ ++        KITY+SCN ATMARD
Sbjct:  368     VADTAEHAMATWAKDGIKPSVILVDPPRKGLTESFIQASVAMGPQKITYVSCNPATMARD   427

Query:  432     IKLFEELGYHLVKIQPVDLFPMTHHVECVALLVK                           465
                IK ++ELGY L K+QPVDLFP THHVECV LL+K
Sbjct:  428     IKRYQELGYKLAKVQPVDLFPQTHHVECVVLLIK                           461
```

Based on this analysis, it was predicted that these proteins and their epitopes could be useful antigens for vaccines or diagnostics.

Example 1284

A DNA sequence (GBSx1361) was identified in *S. agalactiae* <SEQ ID 3947> which encodes the amino acid sequence <SEQ ID 3948>. This protein is predicted to be PSR protein. Analysis of this protein sequence reveals the following:

Possible site: 58
>>> Seems to have no N-terminal signal sequence
INTEGRAL      Likelihood = −12.15   Transmembrane 135-151 (127-155)
----- Final Results -----
   bacterial membrane --- Certainty = 0.5861 (Affirmative) <succ>
   bacterial outside --- Certainty = 0.0000 (Not Clear) <succ>
      bacterial cytoplasm --- Certainty = 0.0000 (Not Clear) <succ>

The protein has homology with the following sequences in the GENPEPT database.

```
>GP:CAB76822 GB:AJ276232 PSR protein [Enterococcus faecalis]
Identities = 143/409 (34%), Positives = 206/409 (49%), Gaps = 56/409 (13%)
Query:  48 QRRTESPP--TNSYYEEPYSDSYYQDDDFYSEPQLTSQGLPIYQEERAPKKKKQRARKEK 105
           + R E P      S   E  Y DSY +D       T  G        ++ P+ KK +  K+K
Sbjct:  31 EHREEEPEELAESLQEPVYEDSYTEDSRRSERRHQTDSGGG-NGSDQPPRGKKDKKPKKK  89

Query: 106 QRVKVMAPFPPPKAITPPRKKKKFKGFLKFIGIILLIVLSGMVFMFVKGMRDVNNGKSHYS 165
                            RKK K K F K++ I+L+++ +    MF+KG      + S
Sbjct:  90 ----------------RKKSKTKRFFKWLVILLILLFAYSTVMFLKGKSAAEHDDS-LP 131

Query: 166 PAIIEDFKGKDAVDGT-NILILGSDKRVSERSTDARTDTIMVANVGNKDNKVKMVSFMRD 224
            +E  F  G  + +G  NILILGSD R  +     R DTIMV   +    K  K++SFMRD
Sbjct: 132 QEKVETFNGVKSSNGAKNILILGSDTRGEDAG---RADTIMVLQLNGPSKKPKLISFMRD 188

Query: 225 LLVNIPNYSTEGYYDMKLNASFNLGEQDNHKGAEYVRQTLKNHFDIDIKYYVMVDFETFA 284
           V+IP       G      K+NA++    G       GAE VR+TLK +F++D KYY   VDF++F
Sbjct: 189 TFVDIP-----GVGPNKINAAYAYG------GAELVRETLKQNFNLDTKYYAKVDFQSFE 237

Query: 285 DAIDTLFPNGVKINAKFGLVGGQSADSVKVPDDLRMKNGVVPSQKIKVGIQYMDGRTLLN 344
           +D++FP GVKI+A+  L    + D V               I+ G Q  MDG   LL
Sbjct: 238 KIVDSMFPKGVKIDAEKSL----NLDGVD---------------IEKGQQVMDGHVLLQ 277

Query: 345 YARFRKDDDGDFGRTQRQQQVMRAIVSQIKDPRRLFTGSAAIGKAYALTSSNLSYSFVLT 404
           YARFR D++GDFGR +RQQQVM A++SQ+K+P   L       ++GK     S+++   SF+LT
Sbjct: 278 YARFRMDEEGDFGRVRRQQQVMSAVMSQMKNPMTLLRTPESLGKLVGYMSTDVPVSFMLT 337

Query: 405 DGIPILSDAKNGIKQMTIPREGDWVDDYDQYGGQGLTIDFAKYKKILKK          453
           +G  +L   K G++  +++P   W      Y G L +D  K    ++K
Sbjct: 338 NGPSLLIKGKTGVESLSVPVPDSWNFGESSYAGSILEVDEQKNADAIEK           386
```

A related DNA sequence was identified in *S. pyogenes* <SEQ ID 3949> which encodes the amino acid sequence <SEQ ID 3950>. Analysis of this protein sequence reveals the following:

Possible site: 49
>>> Seems to have no N-terminal signal sequence
INTEGRAL      Likelihood = −7.96   Transmembrane 159-175 (152-180)
----- Final Results -----
   bacterial membrane --- Certainty = 0.4185 (Affirmative) <succ>
   bacterial outside --- Certainty = 0.0000 (Not Clear) <succ>
      bacterial cytoplasm --- Certainty = 0.0000 (Not Clear) <succ>

The protein has homology with the following sequences in the databases:

```
>GP:CAB76822 GB:AL7276232 PSR protein [Enterococcus faecalis]
Identities = 140/345 (40%), Positives = 195/345 (55%), Gaps = 41/345 (11%)
Query: 140 PRSQK----RKHKKKGCMKWFFNILGLLLMTVLMGLGLMFAKGVFDISTNKANYKPAVSQ 195
           PR +K      +K  +KK    K FF  L  +LL+ +       +MF KG      +  +  V  +
Sbjct:  78 PRGKKDKKPKKKRKKSKTKRFFKWLVILLILLFAYSTVMFLKGKSAAEHDDSLPQEKV-E 136

Query: 196 AFDGQETQDGT-NILILGSDQRVTQGSTDARTDTIMVVNVGNEAKKIKMVSFMRDTLINI 254
            F+G ++ +G  NILILGSD   T+G    R DTIMV+ +    +KK K++SFMRDT ++I
Sbjct: 137 TFNGVKSSNGAKNILILGSD---TRGEDAGRADTIMVLQLNGPSKKPKLISFMRDTFVDI 193

Query: 255 PGYSYNDNSYDLKLNSAFNLGEQEDHHGAEYVRRALKHNFDIDIKYYVMVDFETFAEAID 314
           PG  N        K+N+A+    G        GAE VR  LK NF++D KYY   VDF++F  +D
Sbjct: 194 PGVGPN------KINAAYAYG------GAELVRETLKQNFNLDTKYYAKVDFQSFEKIVD 241
```

```
Query:  315  TLFPNGVKIDAKFATVGGVAVDSVEVPDDLRMKNGVVPNQTIEVGEQRMDGRTLLNYARF  374
             ++FP GVKIDA+ +     + +D V+               IE G+Q MDG LL YARF
Sbjct:  242  SMFPKGVKIDAEKS----LNLDGVD----------------IEKGQQVMDGHVLLQYARF  281

Query:  375  RKDDEGDFGRTVRQQQVMSAVMSQIKDPTKLFTGSAAIGKIYALTSTNVSFPVVKNGVS  434
             R D+EGDFGR RQQQVMSAVMSQ+K+P L      ++GK+     ST+V   F++ NG S
Sbjct:  282  RMDEEGDFGRVRRQQQVMSAVMSQMKNPMTLLRTPESLGKLVGYMSTDVPVSFMLTNGPS  341

Query:  435  VLGSGKNGVEHVTIPENGDWVDEYDMYGGQALYIDFDKYQKTLAK               479
             +L  GK GVE +++P    W       Y G  L   DF  K   + K
Sbjct:  342  LLIKGKTGVESLSVPVPDSWNFGESSYAGSILEVDEQKNADAIEK                386
```

An alignment of the GAS and GBS proteins is shown below.

```
Identities = 273/486 (56%), Positives = 340/486 (69%), Gaps = 32/486 (6%)
Query:    1  MSRNNYGQLNHHEELRYNYLLKNIHYLNEREKMEFQYLHYKKTAVRPQRRTESPPTNSYY   60
             M++   G L+HHEELRY YLL+N+ YL+E EK EF       K     R   ++    S
Sbjct:    1  MTKYPMGGLSHHEELRYFYLLRNLSYLSENEKKEFAFLKSKLEIGRAYAPSKQHYRKSKR   60

Query:   61  EEPY-SDSYY---------QDDDFYSEPQLTSQGLPIYQEERAPKKKKQRARKEKQRVKV  110
             +EPY  D YY         +DDD +      GLPIY +E     KK     K   R   +
Sbjct:   61  QEPYFEDDYYNDYSPNDLLEDDDVNHDSSFVPYGLPIYPKEDRYLNKKT---KLTARRPI  117

Query:  111  MAPFP----------------PKAITPPRKKKK-FKGFLKFIGIILLIVLSGMVFMFVK  152
              AP P                P++     KKK  K F    +G++L+  VL G+   MF K
Sbjct:  118  DAPQPIDEDDAFLTESVARCALPRSQKRKHKKKGCMKWFFNILGLLLMTVLMGLGLMFAK  177

Query:  153  GMRDVNNGKSHYSPAIIEDFKGKDAVDGTNILILGSDKRVSERSTDARTDTIMVANVGNK  212
             G+ D++   K++Y PA+ + F G++  DGTNILILGSD+RV++ STDARTDTIMV NVGN
Sbjct:  178  GVFDISTNKANYKPAVSQAFDGQETQDGTNILILGSDQRVTQGSTDARTDTIMVVNVGNH  237

Query:  213  DNKVKMVSFMRDLLVNIPNYS-TEGYYDMKLNASFNLGEQDNHKGAEYVRQTLKNHFDID  271
              K+KMVSFMRD L+NIP YS    YD+KLN++FNLGEQ++H GAEYVR+ LK++FDID
Sbjct:  238  AKKIKMVSFMRDTLINIPGYSYNDNSYDLKLNSAFNLGEQEDHHGAEYVRRALKHNFDID  297

Query:  272  IKYYVMVDFETFADAIDTLFPNGVKINAKFGLVGGQSADSVKVPDDLRMKNGVVPSQKIK  331
             IKYYVMVDFETFA+AIDTLFPNGVKI+AKF  VGG + DSV+VPDDLRMKNGVVP+Q I+
Sbjct:  298  IKYYVMVDFETFAEAIDTLFPNGVKIDAKFATVGGVAVDSVEVPDDLRMKNGVVPNQTIE  357

Query:  332  VGIQYMDGRTLLNYARFRKDDDGDFGRTQRQQQVMRAIVSQIKDPRRLFTGSAAIGKAYA  391
             VG Q MDGRTLLNYARFRKDD+GDFGRT RQQQVM A++SQIKDP +LFTGSAAIGK YA
Sbjct:  358  VGEQRMDGRTLLNYARFRKDDEGDFGRTVRQQQVMSAVMSQIKDPTKLFTGSAAIGKIYA  417

Query:  392  LTSSNLSYSFVLTDGIPILSDAKNGIKQMTIPREGDWVDDYDQYGGQGLTIDFAKYKKIL  451
             LTS+N+S+ FV+  +G+       KNG++ +TIP GDWVD+YD YGGQ L  IDF KY+K L
Sbjct:  418  LTSTNVSFPFVVKNGVSVLGSGKNGVEHVTIPENGDWVDEYDMYGGQALYIDFDKYQKTL  477

Query:  452  KKMGLR                                                      457
              K+GLR
Sbjct:  478  AKLGLR                                                      483
```

Based on this analysis, it was predicted that these proteins and their epitopes could be useful antigens for vaccines or diagnostics.

Example 1285

A DNA sequence (GBSx1362) was identified in S. agalactiae <SEQ ID 3951> which encodes the amino acid sequence <SEQ ID 3952>. This protein is predicted to be shikimate kinase (aroK). Analysis of this protein sequence reveals the following:

Possible site: 17
>>> Seems to have a cleavable N-term signal seq.
----- Final Results -----
  bacterial outside --- Certainty = 0.3000 (Affirmative) <succ>
  bacterial membrane --- Certainty = 0.0000 (Not Clear) <succ>
  bacterial cytoplasm --- Certainty = 0.0000 (Not Clear) <succ>

The protein has homology with the following sequences in the GENPEPT database.

```
>GP:CAA55181 GB:X78413 shikimate kinase [Lactococcus lactis]
Identities = 65/164 (39%), Positives = 98/164 (59%), Gaps = 8/164 (4%)
Query:    1  MPKVLLGFMGVGKTSVANCLENEVIDMDSLIEKHIGMSISRFFTEEGEASFRALESQFLN   60
             M  +L+GFMG GK++VA  L  E  D+D LIE+ I M I+ FF    GEA FR +E++
Sbjct:    1  MSIILIGFMGAGKSTVAKLLAEEFTDLDKLIEEEIEMPIATFFELFGEADFRKIENEVFE   60

Query:   61  ELLKKKNEGLVIASGGGIVLLEENRRLLTLNRHNNIL-LTGSFEVLYHRIKKDEKNRRPL  119
              ++K    ++IA+GGGI+   E + L  L+R + ++ LT  F+ L+ RI   D +N RP
Sbjct:   61  LAVQK---DIIIATGGGII--ENPKNLNVLDRASVVFLTADFDTLWKRISMDWQNVRP-  114
```

```
Query: 120  FLNHSKEEFYDIYQKRMLLYSGLSDMIIDTDYLTPQKIATVIGE         163
            L  KE   +++KRM YS ++D+ ID    +P++IA  I E
Sbjct: 115  -LAQDKEAAQLLFEKRMKDYSLVADLTIDVTDKSPEQIAEQIRE        157
```

A related DNA sequence was identified in *S. pyogenes* <SEQ ID 3953> which encodes the amino acid sequence <SEQ ID 3954>. Analysis of this protein sequence reveals the following:

Possible site: 43
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

The protein has homology with the following sequences in the databases:

```
>GP:CAA55181 GB:X78413 shikimate kinase [Lactococcus lactis]
Identities = 63/160 (39%), Positives = 97/160 (60%), Gaps = 5/160 (3%)
Query:   1  MTKVLLGFMGVGKITVSKHLSMHCKDMDAIIEAKIGMSIAAFFEQHGEIAFRTIESQVLK   60
            M+ +L+GFMG GK+TV+K L+    D+D +IE +I M IA FFE  GE  FR IE++V +
Sbjct:   1  MSIILIGFMGAGKSTVAKLLAEEFTDLDKLIEEEIEMPIATFFELFGEADFRKIENEVFE   60

Query:  61  DLLFANDNSIIVTGGGVVVLQENRQLLRKNHQHNILLVASFETLYQRLKHDKKSQRPLFL  120
            L    + II TGGG++   +N  +L +    + L A F+TL++R+  D ++ RP   L
Sbjct:  61  --LAVQKDIIIATGGGIIENPKNLNVLDR-ASRVVFLTADFDTLWKRISMDWQNVRP--L  115

Query: 121  KYSKEAFYEFYQQRMVFYEGLSDLVIRVDHRTPEEVANII                     160
                  KEA   +++RM  Y  ++DL I V  ++PE++A   I
Sbjct: 116  AQDKEAAQLLFEKRMKDYSLVADLTIDVTDKSPEQIAEQI                     155
```

An alignment of the GAS and GBS proteins is shown below.

```
Identities = 88/161 (54%), Positives = 120/161 (73%), Gaps = 1/161 (0%)
Query:   1  MPKVLLGFMGVGKTSVANCLENEVIDMDSLIEKHIGMSISRFFTEEGEASFRALESQFLN   60
            M KVLLGFMGVGKT+V+   L    DMD++IE  IGMSI+ FF + GE +FR +ESQ L
Sbjct:   1  MTKVLLGFMGVGKTTVSKHLSMHCKDMDAIIEAKIGMSIAAFFEQHGEIAFRTIESQVLK   60

Query:  61  ELLKKKNEGLVIASGGGIVLLEENRRLLTLNRHNNILLTGSFEVLYHRIKKDEKNRRPLF  120
            +LL   N+  +I +GGG+V+L+ENR+LL   N  +NILL  SFE LY R+K D+K++RPLF
Sbjct:  61  DLLFA-NDNSIIVTGGGVVVLQENRQLLRKNHQHNILLVASFETLYQRLKHDKKSQRPLF  119

Query: 121  LNHSKEEFYDIYQKRMLLYSGLSDMIIDTDYLTPQKIATVI                    161
            L +SKE FY+ YQ+RM+ Y GLSD++I  D+ TP+++A +I
Sbjct: 120  LKYSKEAFYEFYQQRMVFYEGLSDLVIRVDHRTPEEVANII                    160
```

SEQ ID 3952 (GBS152) was expressed in *E. coli* as a His-fusion product. SDS-PAGE analysis of total cell extract is shown in FIG. 25 (lane 2; MW 20 kDa). It was also expressed in *E. coli* as a GST-fusion product. SDS-PAGE analysis of total cell extract is shown in FIG. 37 (lane 2; MW 45.5 kDa).

Based on this analysis, it was predicted that these proteins and their epitopes could be useful antigens for vaccines or diagnostics.

Example 1286

A DNA sequence (GBSx1363) was identified in *S. agalactiae* <SEQ ID 3955> which encodes the amino acid sequence <SEQ ID 3956>. This protein is predicted to be 3-phosphoshikimate 1-carboxyvinyltransferase (aroA). Analysis of this protein sequence reveals the following:

Possible site: 39
>>> Seems to have no N-terminal signal sequence
INTEGRAL    Likelihood = −1.81    Transmembrane 241-257 (240-57)
INTEGRAL    Likelihood = −0.06    Transmembrane 390-406 (390-406)
----- Final Results -----
   bacterial membrane --- Certainty = 0.1723 (Affirmative) <succ>
      bacterial outside --- Certainty = 0.0000 (Not Clear) <succ>
         bacterial cytoplasm --- Certainty = 0.0000 (Not Clear) <succ>

A related GBS nucleic acid sequence <SEQ ID 9673> which encodes amino acid sequence <SEQ ID 9674> was also identified.

The protein has homology with the following sequences in the GENPEPT database.

```
>GP:AAD45819 GB:AF169483 5-enolpyruvylshikimate-3-phosphate synthase
[Streptococcus pneumoniae]
Identities = 288/426 (67%), Positives = 347/426 (80%)
Query:   5 MKLLTNANTLKGTIRVPGDKSISHRAIIFGSISQGVTRIVDVLRGEDVLSTIEAFKQMGV    64
           MKL TN     L G IRVPGDKSISHR+IIFGS+++G T++ D+LRGEDVLST++ F+ +GV
Sbjct:   1 MKLKTNIRHLHGTIRVPGDKSISHRSIIFGSLAEGETKVYDILRGEDVLSTMQVERDLGV    60

Query:  65 LIEDDGEIITIYGKGFAGLTQPNNLLDMGNSGTSMRLIAGVLAGQEFEVTMVGDNSLSKR   124
              IED  +IT+ G G AGL  P N L+MGNSGTS+RLI+GVLAG +FEV M GD+SLSKR
Sbjct:  61 EIEDKDGVITVQGVGMAGLKAPQNALNMGNSGTSIRLISGVLAGADFEVEMFGDDSLSKR   120

Query: 125 PMDRIALPLSKMGARISGVTNRDLPPLKLQGTKKLKPIFYHLPVASAQVKSALIFAALQT   184
           PMDR+ LPL KMG  ISG T RDLPPL+L+GTK L+PI Y LP+ASAQVKSAL+FAALQ
Sbjct: 121 PMDRVTLPLKKMGVSISGQTERDLPPLRLKGTKNLRPIHYELPIASAQVESALMFAALQA   180

Query: 185 KGESLIVEKEQTRNHTEDMIRQFGGHLDIKDKEIRLNGGQSLVGQDIRVPGDISSAAFWI   244
           KGES+I+EKE TRNHTEDM++QFGGHL +   K+I + G Q L GQ + VPGDISSAAFW+
Sbjct: 181 KGESVIIEKEYTRNHTEDMLQQFGGHLSVDGKKITVQGPQKLTGQKVVVPGDISSAAFWL   240

Query: 245 VAGLIIPNSHIILENVGINETRTGILDVVSKMGGKIKLSSVDNQVKSATLTVDYSHLQAT   304
           VAGLI PNS ++L+NVGINETRTGI+DV+  MGGK++++ +D   KSATL V+ S L+ T
Sbjct: 241 VAGLIAPNSRLVLQNVGINETRTGIIDVIRAMGGKLEITEIDPVAKSATLIVESSDLKGT   300

Query: 305 HISGAMIPRLIDELPIIALLATQAQGTTVIADAQELKVKETDRIQVVVESLKQMGADITA   364
              I GA+IPRLIDELPIIALLATQAQG TVI DA+ELKVKETDRIQVV ++L  MGADIT
Sbjct: 301 EICGALIPRLIDELPIIALLATQAQGVTVIKDAEELKVKETDRIQVVADALNSMGADITP   360

Query: 365 TADGMIIRGNTPLHAASLDCHGDHRIGMMIAIAALLVKEGEVDLSGEEAINTSYPNFLEH   424
           TADGMII+G + LH A ++  GDHRIGMM AIAALLV +GEV+L    EAINTSYP+F +
Sbjct: 361 TADGMIIKGKSALHGARVNTFGDHRIGMMTAIAALLVADGEVELDRAEAINTSITSFFDD   420

Query: 425 LEGLVN                                                        430
           LE  L++
Sbjct: 421 LESLIH                                                        426
```

A related DNA sequence was identified in *S. pyogenes* <SEQ ID 3957> which encodes the amino acid sequence <SEQ ID 3958>. Analysis of this protein sequence reveals the following:

Possible site: 36
>>> Seems to have no N-terminal signal sequence

INTEGRAL    Likelihood = −2.18    Transmembrane 240-256 (239-256)
----- Final Results -----
    bacterial membrane --- Certainty = 0.1871 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:AAD45819 GB:AF169483 5-enolpyruvylsbikimate-3-phosphate synthase
[Streptococcus pneumoniae]
Identities = 278/426 (650), Positives = 346/426 (8090)
Query:   4 MKLRTNAGPLQGTIQVPGDKSISHRAVILGAVAKGETRVKGLLKGEDVLSTIQAFRNLGV    63
           MKL+TN     L G I+VPGDKSISHR++I G++A+GET+V  +L+GEDVLST+Q FR+LGV
Sbjct:   1 MKLKTNIRHLHGIIRVPGDKSISHRSIIFGSLAEGETKVYDILRGEDVLSTMQVFRDLGV    60

Query:  64 RIEEKDDQLVIEGQGFQGLNAPCQTLNMGNSGTSMRLIAGLLAGQPFSVKMIGDESLSKR   123
               IE+KD + ++G G  GL AP     LNMGNSGTS+RLI+G+LAG   F V+M GD+SLSKR
Sbjct:  61 EIEDKDGVITVQGVGMAGLKAPQNALNMGNSGTSIRLISGVLAGADFEVEMFGDDSLSKR   120

Query: 124 PMDRIVYPLKQMGVEISGETDRQFPPLQLQGNRNLQPITYTLPISSAQVKSAILLAALQA   183
           PMDR+  PLK+MGV ISG+T+R  PPL+L+G +NL+PI Y LPI+SAQVKSA++ AALQA
Sbjct: 121 PMDRVTLPLKKMGVSISGQTERDLPPLRLKGTKNLRPIHYELPIASAQVKSALMFAALQA   180

Query: 184 KGTTQVVEKEITRNHTEEMIQQFGGRLIVDGKRITLVGPQQLTAQEITVPGDISSAAFWL   243
           KG +  ++EKE TRNHTE+M+QQFGG L VDGK+IT+ GPQ+LT Q++ VPGDISSAAFWL
Sbjct: 181 KGESVIIEKEYTRNHTEDMLQQFGGHLSVDGKKITVQGPQKLTGQKVVVPGDISSAAFWL   240

Query: 244 VAGLIIPGSELLLKNVGVNPTRTGILEVVEKMGAQIVYEDMNKKEQVTSIRVVYSNMKGT   303
           VAGLI P S L+L+NVG+N TRTGI++V+  MG ++    +++     + V  S++KGT
Sbjct: 241 VAGLIAPNSRLVLQNVGINETRTGIIDVIRAMGGKLEITEIDPVAKSATLIVESSDLKGT   300

Query: 304 IISGGLIPRLIDELPIIALLATQAQGTTCIKDAQELRVKETDRIQVVTDILNSMGANIKA   363
              I G LIPRLIDELPIIALLATQAQG T IKDA+EL+VKETDRIQVV D LNSMGA+I
Sbjct: 301 EICGALIPRLIDELPIIALLATQAQGVTVIKDAEELKVKETDRIQVVADALNSMGADITP   360

Query: 364 TADGMIIKGPTVLYGANTSTYGDHRIGMMTAIAALLVKGQVHLDKEEAIMTSYPTFFKD   423
           TADGMIIKG + L+GA  +T+GDHRIGMMTAIAALLV  G+V LD+  EAI TSYP+FF D
Sbjct: 361 TADGMIIKGKSALHGARVNTEGDHRIGMMTAIAALLVADGEVELDRAEAINTSYPSFFDD   420
```

```
Query: 424  LERLCH  429
            LE L H
Sbjct: 421  LESLIH  426
```

An alignment of the GAS and GBS proteins is shown below.

```
Identities = 269/424 (63%), Positives = 331/424 (77%)
Query:   5  MKLLTNANTLKGTIRVPGDKSISHRAIIFGSISQGVTRIVDVLRGEDVLSTIEAFKQMGV   64
            MKL TNA L+GTI+VPGDKSISHRA+I G++++G TR+  +L+GEDVLSTI+AF+ +GV
Sbjct:   4  MKLRTNAGPLQGTIQVPGDKSISHRAVILGAVAKGETRVKGLLKGEDVLSTIQAFRNLGV   63

Query:  65  LIEDDGEIITIYGKGFAGLTQPNNLLDMGMSGTSMRLIAGVLAGQEFEVTMVGDNSLSKR  124
            +IE+  + + I G+GF GL  P    L+MGNSGTSMRLIAG+LAGQ F V M+GD SLSKR
Sbjct:  64  RIEEKDDQLVIEGQGFQGLNAPCQTLNMGNSGTSMRLIAGLLAGQPFSVKMIGDESLSKR  123

Query: 125  PMDRIALPLSKMGARISGVTNRDLPPLKLQGTKKLKPIFYHLPVASAQVKSALIFAALQT  184
            PMDRI  PL +MG  ISG T+R  PPL+LQG + L+PI Y LP++SAQVKSA++ AALQ
Sbjct: 124  PMDRIVYPLKQMGVEISGETDRQFPPLQLQGNRNLQPITYTLPISSAQVKSAILLAALQA  183

Query: 185  KGESLIVEKEQTRNHTEDMIRQFGGHLDIKDKEIRLNGGQSLVGQDIRVPGDISSAAFWI  244
            KG + +VEKE TRNHTE+MI+QFGG L +   K I L GQ L  Q+I VPGDISSAAFW+
Sbjct: 184  KGITQVVEKEITRNHTEEMIQQFGGRLIVDGKRITLVGPQQLTAQEITVPGDISSAAFWL  243

Query: 245  VAGLIIPNSHIILENVGINETRTGILDVVSKMGGKIKLSSVDNQVKSATLTVDYSHLQAT  304
            VAGLIIP S ++L+NVG+N TRTGIL+VV KMG +I   ++ + +  ++ V YS+++ T
Sbjct: 244  VAGLIIPGSELLLKNVGVNPTRTGILEVVEKMGAQIVYEDMNKKEQVTSIRVVYSNMKGT  303

Query: 305  HISGAMIPRLIDELPIIALLATQAQGTTVIADAQELKVKETDRIQVVVESLKQMGADITA  364
             ISG +IPRLIDELPIIALLATQAQGTT I DAQEL+VKETDRIQVV + L  MGA+I A
Sbjct: 304  IISGGLIPRLIDELPIIALLATQAQGTTCIKDAQELRVKETDRIQVVTDILNSMGANIKA  363

Query: 365  TADGMIIRGNTPLHAASLDCHGDHRIGMMIAIAALLVKEGEVDLSGEEAINTSYPNFLEH  424
            TADGMII+G T L+ A+     +GDHRIGMM AIAALLVK+G+V L  EEAI TSYP F +
Sbjct: 364  TADGMIIKGPTVLYGANTSTYGDHRIGMMTAIAALLVKQGQVHLDKEEAIMTSYPTFFKD  423

Query: 425  LEGL  428
            LE L
Sbjct: 424  LERL  427
```

Based on this analysis, it was predicted that these proteins and their epitopes could be useful antigens for vaccines or diagnostics.

Example 1287

A DNA sequence (GBSx1364) was identified in *S. agalactiae* <SEQ ID 3959> which encodes the amino acid sequence <SEQ ID 3960>. Analysis of this protein sequence reveals the following:

```
Possible site: 38
>>> Seems to have an uncleavable N-term signal seq
INTEGRAL   Likelihood = –1.12    Transmembrane 6-22 (6-22)
----- Final Results -----
   bacterial membrane --- Certainty = 0.1447 (Affirmative) <succ>
   bacterial outside --- Certainty = 0.0000 (Not Clear) <succ>
   bacterial cytoplasm --- Certainty = 0.0000 (Not Clear) <succ>
```

The protein has homology with the following sequences in the GENPEPT database.

```
>GP:AAF20148 GE:AF208390 actinin-like protein [Entamoeba histolytica]
Identities = 62/236 (26%), Positives = 107/236 (45%), Gaps = 38/236 (16%)
Query: 144  NYNSTNSSNPESMLFYEKQLKTWLSTH----KNYYLDYK--VTPIYQNNELIPRKIELK-  196
            N N   + N + +        L  W+++         N+  D+K V  +    +I+ +
Sbjct: 116  NANQQKNVNAREEVVENNALLDWVNSFGLNVSNFSSDWKDGVALVKLTEAVSAGQIKFEQ  175

Query: 197  YVGIDKTGKLLPIFIGNKSTQDQFGI------STVTLENTSPNATIDYLSGKAQN-----  245
            + G+D T ++       K   +QF I          + E   P + + Y+S  +
Sbjct: 176  FSGLDNTQMVIDC---QKLAYEQFKIPILMDVKDLVCERPDPKSIMTYVSVYKERYEQLL  232

Query: 246  TVLSAKEQRKLIAKHEEEKRLAEK-----KVEEEKAAAETQKKL-EEEQARLAAEAQ-RK  298
                KE+++ IA+ E+E++   E+      + E+E+  A E Q++L  EEQ RLA E Q RK
Sbjct: 233  VEKEQKEEQERIAREEQERKQKEEQERLAREEQERLAREEQERLAREEQERLAREEQERK  292

Query: 299  QKEEQARLAAETQKKQETLVQEQTSQGYKRDYRGRWHRPNGQYASKAEIAAAGLQW      354
            QKEEQ RLA E Q++++    QE+ +Q            +P Q +    + AA   W
Sbjct: 293  QKEEQERLAREEQERKQREEQERLNQ---------QQPTSQQLTFFSVQAAADAW      338
```

A related DNA sequence was identified in *S. pyogenes* <SEQ ID 3961> which encodes the amino acid sequence <SEQ ID 3962>. Analysis of this protein sequence reveals the following:

```
Possible site: 41
>>> Seems to have a cleavable N-term signal seq.
----- Final Results -----
   bacterial outside --- Certainty = 0.3000 (Affirmative) <succ>
   bacterial membrane --- Certainty = 0.0000 (Not Clear) <succ>
   bacterial cytoplasm --- Certainty = 0.0000 (Not Clear) <succ>
```

The protein has homology with the following sequences in the databases:

```
>GP:CAA03161 GB:A49208 unnamed protein product [Streptococcus pyogenes]
Identities = 54/222 (24%), Positives = 93/222 (41%), Gaps = 39/222 (17%)
Query:  44 HYKNTVSSKLLP--FTANYQLQLGELDNLRA-----TFSHIQLQDRHETKDVRTKINYD   96
            +YK  +S++ P   F       +LD L R         T ++ ++ + +      K N +
Sbjct:  76 YYKTLGTSQITPALFPKAGDILYSKLDELGRTRTARGTLTYANVEGSYGVRQSFGK-NQN  134

Query:  97 PVGWHN------YQFPYGDG-SKSSWVMNRGHLVGYQFCGLNDEPRNLVAMTAWLNTGAY  149
            P GW         Y+ + +G S      NR HL+    G         + + A    T
Sbjct: 135 PAGWTGNPNHVKYKIEWLNGLSYVGDFWNRSHLIADSLGG------DALRVNAVTGTRTQ  188

Query: 150 SGANDSNPEGMLYYENRLDSWLALHPDFWLDYKVTPIYSGNEVVPRQIELQYVGIDSSGE  209
            +        GM Y E R    WL  + D +L Y+V PIY+ +E++PR +
Sbjct: 189 NVGGRDQKGGMRYTEQRAQEWLEANEDGYLYYEVAPTYNADELIPRAV------------  236

Query: 210 LLTIRLNSNKESIDENGVTTVILENSAPNINLDYLNGTATPK                   251
             + + S+  +I+E     V++ N+A      ++Y NGT T K
Sbjct: 237 --VVSMQSSDNTINEK----VLVYNTANGYTINYHNGTPTQK                   272
```

An alignment of the GAS and GBS proteins is shown below.

```
Identities = 117/245 (47%), Positives = 166/245 (67%), Gaps = 4/245 (1%)
Query:   2 KRKQFIKLGIATLLTVISLYTPINLATNHTTENIVTAQEY--KTKENGTLPFKHKRQLVL   59
           K+K  +   LL++         ++ A   T   N+ A    +   T  + LPF QL L
Sbjct:   5 KQKASLLTAVLLLLSLSITTITVDAARVRTYPNVSHANTHYKNTVSSKLLPFTANYQLQL   64

Query:  60 GELDDKGRATFAHIQLKVKDEPKKKRVKRLKTTPVGWHIUKFYYNDGTQKAWLMSRGRLI  119
           GELD+  RATF+HIQL+ +  E K   R K +    PVGWHN++F Y DG++ +W+M+RG L+
Sbjct:  65 GELDNLNRATFSHIQLQDRHETKDVRTK-INYDPVGWHNYQFPYGDGSKSSWVMNRGHLV  123

Query: 120 CHQFSGLNNERKNLVPMTNWLNTGNYNSTNSSNPESMLFYEKQLKTWLSTHKNYYLDYKV  179
             +QF GLN+E +NLV MT WLNTG Y+   N SNPE ML+YE +L +WL+ H +++LDYKV
Sbjct: 124 GYQFCGLNDEPRNLVAMTAWLNTGAYSGANDSNPEGMLYYENRLDSWLALHPDFWLDYKV  183

Query: 180 TPIYQNNELIPRKIELKYVGIDKTGKLLPIFI-GNKSTQDQFGISTVTLENTSPNATIDY  238
           TPIY  NE++PR+IEL+YVGID +G+LL I + NK + D+  G++TVLEN++PN    +DY
Sbjct: 184 TPIYSGNEVVPRQIELQYVGIDSSGELLTIRLNSNKESIDENGVTTVILENSAPNINLDY  243

Query: 239 LSGKA                                                        243
           L+G A
Sbjct: 244 LNGTA                                                        248
```

A related DNA sequence was identified in *S. pyogenes* <SEQ ID 7263> which encodes amino acid sequence <SEQ ID 7264>. An alignment of the GAS and GBS sequences follows:

```
Score = 58.9 bits (140), Expect = 2e-11
Identities = 34/103 (33%), Positives = 55/103 (53%), Gaps = 1/103 (0%)
Query:   1 MPFKTNLKAGILLYAMFMASIFLLVLQVYLSQVTALHKEYQAQTDYVKARLIAEIVYQD-   59
           M   K   LKAGILL A+ +A++F LVLQ YL+++  A   ++Y +Q  + KA L A++ Y+
Sbjct:   1 MILKKKLKAGILLQAIVLAAVFTLVLQFYLARILATERQYHSQIEASKAYLTAQLAYKTI   60

Query:  60 HRYKASNPVFFKGGQVICRERKERWMLIVELDQQRQYQFEYLK                 102
               S   +F GG  +       + V LD+  Y   ++ +
Sbjct:  61 EGDSISGKCYFTGGYASYLQEGNYLQVKVTLDKGGNYNHKFYR                 103
```

Based on this analysis, it was predicted that these proteins and their epitopes could be useful antigens for vaccines or diagnostics.

Example 1288

A DNA sequence (GBSx1365) was identified in *S. agalactiae* <SEQ ID 3963> which encodes the amino acid sequence <SEQ ID 3964>. This protein is predicted to be enolase (eno). Analysis of this protein sequence reveals the following:

Possible site: 43
>>> Seems to have no N-terminal signal sequence
----- Final Results -----
   bacterial cytoplasm --- Certainty = 0.3025 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database.

```
>GP:BAA81815 GB:AB029313 enolase [Streptococcus intermedius]
Identities = 396/435 (91%), Positives = 414/435 (95%), Gaps = 1/435 (0%)
Query:   1 MSIITDVYAREVLDSRGNPTLEVEVYTESGAFGRGMVPSGASTGEHEAVELRDGDKSRYG    60
           MSIITDVYAREVLDSRGNPTLEVEVYTESGAFGRGMVPSGASTGEHEAVELRDGDKSRYG
Sbjct:   1 MSIITDVYAREVLDSRGNPTLEVEVYTESGAFGRGMVPSGASTGEHEAVELRDGDKSRYG    60

Query:  61 GLGTQKAVDNVNNVIAEAIIGYDVRDQQAIDRAMIALDGTPNKGKLGANAILGVSIAVAR   120
           GLGTQKAVDNVNN+IAEA+IGYDVRDQQAIDRAMIALDGTPNKGKLGANAILGVSIAVAR
Sbjct:  61 GLGTQKAVDNVNNIIAEAVIGYDVRDQQAIDRAMIALDGIPNKGKLGANAILGVSIAVAR   120

Query: 121 AAADYLEVPLYSYLGGENTKVLPTPMMNIINGGSHSDAPIAFQEFMIMPVGAPTEKEALR   180
           AAADYLE+PLYSYLGGENTKVLPTPMMNIINGGSHSDAPIAFQEFMI+P GAPTFKEALR
Sbjct: 121 AAADYLEIPLYSYLGGENTKVLPTPMMNIINGGSHSDAPIAFQEFMIVPAGAPTEKEALR   180

Query: 181 WGAEVEHALKKILKERGLETANGDEGGFAPKFEGTEDGVETILKAIEAAGYEAGENGIMI   240
           WGAE+FHALKKILK RGL TAVGDEGGFAP+F+GTEDGVETIL AIEAAGY  G++ + +
Sbjct: 181 WGAEIFHALKKILKSRGLATAVGDEGGFAPREDGTEDGVETILAAIEAAGYVPGKD-VFL   239

Query: 241 GEDCASSEFYDAERKVYDYSKFEGEGGAVRTAAEQIDYLEELVNKYPIITIEDGMDENDW   300
           G FDCASSEFYD ERKVYDY+KFEGEG AVRTA EQIDYLEELVNKYPIITIEDGMDENDW
Sbjct: 240 GFDCASSEFYDKERKVYDYTKFEGEGAAVRTADEQIDYLEELVNKYPIITIEDGMDENDW   299

Query: 301 DGWKALTERLOGRVQLVGDDFFVTNTDYLARGIKEEAANSILIKVNQIGTLTETFEATEM   360
           DGWK LTERLG +VQ VGDDFFVTNT YL +GI E ANSILIKVNQIGTLIETF+AIEM
Sbjct: 300 DGWKKLTERLGKKVQPVGDDFFVTNTSYLEKGINEACANSILIKVNQIGTLTETFDAIEM   359

Query: 361 AKEAGYTAVVSHRSGETEDSTIADIAVATNAGQIKTGSLSRTDRIAKYNQLLRIEDQLGE   420
           AKEAGYTAVVSHRSGETEDSTIADIAVA NAGQIKTGSLSRTDRIAKYNQLLRIEDQLGE
Sbjct: 360 AKEAGYTAVVSHRSGETEDSTIADIAVAANAGQIKTGSLSRTDRIAKYNQLLRIEDQLGE   419

Query: 421 VAQYKGIKSFYNLKK                                               435
           VA+Y+G+KSFYNL K
Sbjct: 420 VAEYRGLKSFYNLSK                                               434
```

Proteins in the glycolysis/gluconeogenesis pathway have been experimentally detected on the surface of Streptococci.

A related DNA sequence was identified in *S. pyogenes* <SEQ ID 3965> which encodes the amino acid sequence <SEQ ID 3966>. Analysis of this protein sequence reveals the following:

Possible site: 43
>>> Seems to have no N-terminal signal sequence
----- Final Results -----
   bacterial cytoplasm --- Certainty = 0.3025 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the databases:

```
>GP:BAA81816 GH:AB029313 enolase [Streptococcus intermedius]
Identities = 396/435 (91%), Positives = 415/435 (95%), Gaps = 1/435 (0%)
Query:   1 MSIITDVYAREVLDSRGNPTLEVEVYTESGAFGRGMVPSGASTGEHEAVELRDGDKSRYL    60
           MSIITDVYAREVLDSRGNPTLEVEVYTESGAFGRGMVPSGASTGEHEAVELRDGDKSRY
Sbjct:   1 MSIITDVYAREVLDSRGNPTLEVEVYTESGAFGRGMVPSGASTGEHEAVELRDGDKSRYG    60

Query:  61 GLGTQKAVDNVNNIIAEAIIGYDVRDQQAIDRAMIALDGTPNKGKLGANAILGVSIAVAR   120
           GLGTQKAVDNVNNIIAEA+IGYDVRDQQAIDRAMIALDGTPNKGKLGANAILGVSIAVAR
Sbjct:  61 GLGTQKAVDNVNNIIAEAVIGYDVRDQQAIDRAMIALDGTPNKGKLGANAILGVSIAVAR   120

Query: 121 AAADYLEVPLYTYLGGENTKVLPTPMMNIINGGSHSDAPIAFQEFMIMPVGAPTFKEGLR   180
           AAADYLE+PLY+YLGGFNTKVLPTPMMNIINGGSHSDAPIAFQEFMI+P GAPTFKE LR
Sbjct: 121 AAADYLEIPLYSYLGGENTKVLPTPMMNIINGGSHSDAPIAFQEFMIVPAGAPTEKEALR   180

Query: 181 WGAEVFHALKKILKERGLVTAVGDEGGFAPKFEGTEDGVETILKAIEAAGYEAGENGIMI   240
           WGAE+FHALKKILK RGL TAVGDEGGFAP+F+GTEDGVETIL AIEAAGY  G++ + +
Sbjct: 181 WGAEIFHALKKILKSRGLATAVGDEGGFAPRFDGTEDGVETILAAIEAAGYVPGKD-VFL   239

Query: 241 GFDCASSEFYDKERKVYDYTKFEGEGAAVRTSAEQVDYLEELVNKYPIITIEDGMDENDW   300
           GFDCASSEFYDKERKVYDYTKFEGEGAAVRT+ EQ+DYLEELVNKYPIITIEDGMDENDW
Sbjct: 240 GFDCASSEFYDKERKVYDYTKFEGEGAAVRTADEQIDYLEELVNKYPIITIEDGMDENDW   299
```

-continued

```
Query:  301  DGWKVLTERLGKRVQLVGDDFFVTNTEYLARGIKENAANSILIKVNQIGTLTETFEAIEM  360
             DGWK LTERLGK+VQ VGDDFFVTNT YL +GI E  ANSILIKVNQIGTLTETF+AIEM
Sbjct:  300  DGWKKLTERLGKKVQPVGDDFFVTNTSYLEKGINEACANSILIKVNQIGTLTETFDAIEM  359

Query:  361  AKEAGYTAVVSHRSGETEDSTIADIAVATNAGQIKTGSLSRTDRIAKYNQLLRIEDQLGE  420
             AKEAGYTAVVSHRSGETEDSTIADIAVA NAGQIKTGSLSRTDRIAKYNQLLRIEDQLGE
Sbjct:  360  AKEAGYTAVVSHRSGETEDSTIADIAVAANAGQIKTGSLSRTDRIAKYNQLLRIEDQLGE  419

Query:  421  VAQYKGIKSFYNLKK                                              435
             VA+Y+G+KSFYNL K
Sbjct:  420  VAEYRGLKSFYNLSK                                              434
```

An alignment of the GAS and GBS proteins is shown below.

```
Identities = 421/435 (96%), Positives = 427/435 (97%)
Query:    1  MSIITDVYAREVLDSRGNPTLEVEVYTESGAFGRGMVPSGASTGEHEAVELRDGDKSRYG   60
             MSIITDVYAREVLDSRGNPTLEVEVYTESGAFGRGMVPSGASTGEHEAVELRDGDKSRY
Sbjct:    1  MSIITDVYAREVLDSRGNPTLEVEVYTESGAFGRGMVPSGASTGEHEAVELRDGDKSRYL   60

Query:   61  GLGTQKAVDNVNNVIAEAIIGYDVRDQQAIDRAMIALDGIPNKGKLGANAILGVSIAVAR  120
             GLGTQKAVDNVNN+IAEAIIGYDVRDQQAIDRAMIALDGTPNKGKLGANAILGVSIAVAR
Sbjct:   61  GLGTQKAVDNVNNIIAEAIIGYDVRDQQAIDRAMIALDGTPNKGKLGANAILGVSIAVAR  120

Query:  121  AAADYLEVPLYSYLGGFNTKVLPTPMMNIINGGSHSDAPIAFQEFMIMPVGAPTFKEALR  180
             AAADYLEVPLY+YLGGFNTKVLPTPMMNIINGGSHSDAPIAFQEFMIMPVGAPTFKE LR
Sbjct:  121  AAADYLEVPLYTYLGGFNTKVLPTPMMNIINGGSHSDAPIAFQEFMIMPVGAPTFKEGLR  180

Query:  181  WGAEVFHALKKILKERGLETAVGDEGGFAPKFEGTEDGVETILKAIEAAGYEAGENGIMI  240
             WGAEVFHALKKILKERGL TAVGDEGGFAPKFEGTEDGVETILKAIEAAGYEAGENGIMI
Sbjct:  181  WGAEVFHALKKILKERGLVTAVGDEGGFAPKFEGTEDGVETILKAIEAAGYEAGENGIMI  240

Query:  241  GFDCASSEFYDAERKVYDYSKFEGEGGAVRTAAEQIDYLEELVNKYPIITIEDGMDENDW  300
             GFDCASSEFYD ERKVYDY+KFEGEG AVRT+AEQ+DYLEELVNKYPIITIEDGMDENDW
Sbjct:  241  GFDCASSEFYDKERKVYDYTKFEGEGAAVRTSAEQVDYLEELVNKYPIITIEDGMDENDW  300

Query:  301  DGWKALTERLGGRVQLVGDDFFVTNTDYLARGIKEEAANSILIKVNQIGTLTETFEAIEM  360
             DGWK LTERLG RVQLVGDDFFVTNT+YLARGIKE AANSILIKVNQIGTLTETFEAIEM
Sbjct:  301  DGWKVLTERLGKRVQLVGDDFFVTNTEYLARGIKENAANSILIKVNQIGTLTETFEAIEM  360

Query:  361  AKEAGYTAVVSHRSGETEDSTIADIANATNAGQIKTGSLSRTDRIAKYNQLLRIEDQLGE  420
             A+EAGYTAVVSHRSGETEDSTIADIAVATNAGQIKTGSLSRTDRIAKYNQLLRIEDQLGE
Sbjct:  361  AKEAGYTAVVSHRSGETEDSTIADIAVATNAGQIKTGSLSRTDRIAKYNQLLRIEDQLGE  420

Query:  421  VAQYKGIKSFYNLKK                                              435
             VAQYKGIKSFYNLKK
Sbjct:  421  VAQYKGIKSFYNLKK                                              435
```

SEQ ID 3964 (GBS311) was expressed in *E. coli* as a His-fusion product. SDS-PAGE analysis of total cell extract is shown in FIG. 45 (lane 3; MW 51 kDa).

GBS311-His was purified as shown in FIG. 203, lane 10.

Based on this analysis, it was predicted that these proteins and their epitopes could be useful antigens for vaccines or diagnostics.

Example 1289

A DNA sequence (GBSx1366) was identified in *S. agalactiae* <SEQ ID 3967> which encodes the amino acid sequence <SEQ ID 3968>. Analysis of this protein sequence reveals the following:

Possible site: 60
>>> Seems to have no N-terminal signal sequence
----- Final Results -----
   bacterial cytoplasm --- Certainty = 0.1998 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1290

A DNA sequence (GBSx1367) was identified in *S. agalactiae* <SEQ ID 3969> which encodes the amino acid sequence <SEQ ID 3970>. This protein is predicted to be di-/tripeptide transporter. Analysis of this protein sequence reveals the following:

Possible site: 54
>>> Seems to have no N-terminal signal sequence
INTEGRAL   Likelihood = −14.33   Transmembrane 93-109 (87-122)
INTEGRAL   Likelihood = −9.02    Transmembrane 117-133 (110-141)
INTEGRAL   Likelihood = −8.44    Transmembrane 333-349 (328-353)
INTEGRAL   Likelihood = −5.84    Transmembrane 19-35 (17-38)
INTEGRAL   Likelihood = −3.08    Transmembrane 151-167 (151-167)
INTEGRAL   Likelihood = −2.55    Transmembrane 264-280 (264-281)
INTEGRAL   Likelihood = −2.28    Transmembrane 44-60 (44-60)
INTEGRAL   Likelihood = −2.02    Transmembrane 238-254 (238-255)
----- Final Results -----
   bacterial membrane --- Certainty = 0.6731 (Affirmative) <succ>

-continued bacterial outside --- Certainty = 0.0000 (Not Clear) <succ>
bacterial cytoplasm --- Certainty = 0.0000 (Not Clear) <succ>

A related GBS nucleic acid sequence <SEQ ID 9395> which encodes amino acid sequence <SEQ ID 9396> was also identified.

The protein has homology with the following sequences in the GENPEPT database.

```
>GP:CAB12175 GB:299106 similar to di-tripeptide ABC transporter
            (membrane protein) [Bacillus subtilis]
Identities = 175/359 (48%), Positives = 254/359 (70%), Gaps = 9/359 (2%)
Query:   1 MVGNLYGENDSRRDAGFSIFVFGINLGAFISPIVVGYLGQEVNFHLGFSLAAIGMFFGLL   60
           +VG+LY + D RRD+GFSIF  GINLG ++P++VG LGQ+ N+HLGF  AA+GM  GL+
Sbjct: 142 VVGDLYTKEDPRRDSGFSIFYMGINLGGLLAPLIVGTLGQKYNYHLGFGAAAVGMLLGLI  201

Query:  61 QYTLDGKKYLTEESLRPNDPLSPEEKSSLYKKVGLILIGIVIVLILLHLMHMLTIEVIID  120
            + L  KK L     +PLS  +KS++    +G+I++ I +++ +     +LTI+  ID
Sbjct: 202 VFPLTRKKNLGLAGSNVPNPLS--KKSAIGTGIGVIIVAIAVIISVQ--TGVLTIKRFID  257

Query: 121 IFSIIAIAIPIIYFIKILSSKKISSVERSRVWAYIPLFIASILFWSIEEQGSVVLALFAD  180
           + SI+ I IP+IYFI + +SKK    E+SR+ AY+PLFI +++FW+I+EQG+ +LA++AD
Sbjct: 258 LVSILGILIPVIYFIIMFTSKKADKTEKSRLAAYVPLFIGAVMFWAIQEQGATILAVYAD  317

Query: 181 EQTKLYLNFFGHHINFPSSYFQSMNPLFIMLYVPFFAWLWAKWGSKQPSSPKKFAYGLFF  240
           E+ +L L  F          SS+FQS+NPLF++++ P FAWLW  K G +QPS+P KF+ G+
Sbjct: 318 ERIRLSLGGF----ELQSSWFQSLNPLFVVIFAPIFAWLWMKLGKRQPSTPVKFSIGIIL  373

Query: 241 AGASFLWMMLPGLLFGVNAKVSPLWLTMSWAIVIVGEMLISPVGLSATSKLAPKAFQAQM  300
           AG SF+ M+ P +  G  A VSPLWL +S+ +V++GE+ +SPVGLS T+KLAP AF AQ
Sbjct: 374 AGLSFIIMVFPAMQ-GKEALVSPLWLVLSFLLVVLGELCLSPVGLSVTTKLAPAAFSAQT  432

Query: 301 MSIWFLSNAAAQAINAQIVKLYTPDTQTLYYGVVGGITVVFGFILLFYVPRIEKLMSGV   359
           MS+WFL+ NAAAQAINAQ+  L+    +T+Y+G +G I++V G ILL    P I++ M GV
Sbjct: 433 MSMWFLTNAAAQAINAQVAGLFDKIPETMYFGTIGLISIVLGGILLLLSPVIKRAMKGV  491
```

No corresponding DNA sequence was identified in S. pyogenes.

Based on this analysis, it was predicted that these proteins and their epitopes could be useful antigens for vaccines or diagnostics.

Example 1291

A DNA sequence (GBSx1369) was identified in S. agalactiae <SEQ ID 3971> which encodes the amino acid sequence <SEQ ID 3972>. Analysis of this protein sequence reveals the following:

Possible site: 37
>>> Seems to have an uncleavable N-term signal seq
----- Final Results -----
  bacterial membrane --- Certainty = 0.0000 (Not Clear) <succ>
  bacterial outside --- Certainty = 0.0000 (Not Clear) <succ>
  bacterial cytoplasm --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1292

A DNA sequence (GBSx1370) was identified in S. agalactiae <SEQ ID 3973> which encodes the amino acid sequence <SEQ ID 3974>. Analysis of this protein sequence reveals the following:

Possible site: 30
>>> Seems to have no N-terminal signal sequence
----- Final Results -----
  bacterial cytoplasm --- Certainty = 0.2485 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:AAF61315 GB:U96166 unknown [Streptococcus cristatus]
Identities = 181/442 (40%), Positives = 270/442 (60%), Gaps = 2/442 (0%)
Query:   1 MINLFDSYTQSSWDLHFSLIKSGYINPTIALNDDGFLPDDVTSPYLYYTGFAKTGAGRPL   60
           MI LFD Y Q+S+DL  SL +G    P + + DDG+L  DV SPY Y+TG    T  GRP+
Sbjct:   1 MICLFDRYDQASFDLLRSLKATGLDCPVVVVQDDGYLSPDVESPYSYFTGDLDTPEGRPI   60

Query:  61 YYNELRVPDTWEIIGFSSGADIVDLGVKKGRIIYANPNHKRLIKEVDWFDEQGRVILKDR  120
           Y+N +  P  WEI +    +I+D+G K+   I Y  P H+R ++ V+W D +G+V    D
Sbjct:  61 YFNLVPKPHLWEIRSSNVNGEILDMGKKRANIFYRQPTHERRVRAVEWLDTEGQVRAADI  120
```

-continued

```
Query:  121  FNKFGFCFAQTFYNADGQAIQTSYYNKDRQEVISENHMTGDYILNDNNQFKVEKSKVEFV  180
             +N+ G FAQ Y+   +   T Y+++     VI ENH+TGD IL    +  +FKSK EFV
Sbjct:  121  YNRKGRLFAQITYDQTQRPTHTRYFDQSNVVVIMENHLTGDIILTLEGKRHIFKSKQEFV  180

Query:  181  INYLQEAKFNLDRIFYNSLSTPFLVSFYL--NRLESKDVLFWQEPLVDDIPGNMRLLLNN  238
             + YLQ   ++ DRI YNSL+TPFLV++ L    ++DVLFWQEP+ + ++PGNM++  +
Sbjct:  181  VFYLQYRGYDTDRIIYNSLATPFLVAYALRPKNGRAEDVLFWQEPIGEALPGNMKVAMKM  240

Query:  239  PSPNTKIVIQSYEAYANAMRLLTDEEQKQVSFLGEMYPLKETEKLHNQALILTNSDQIEA  298
             P  N +I +Q  + Y      L T EE+     +G++Y  +     ++ +ALILTNSDQ+E
Sbjct:  241  PHRNIRIAVQDRQVYEKIQSLATPEEKVYFHNIGYIYDYQRLNNMNPEALILTNSDQLEQ  300

Query:  299  LESLVTSLPNLTFNIGALTEMSSDLMNFGKYDNVVLYPNITTNQIQYLSNICAFYLDINH  358
             +E L+T LPN+ F+IGA+TEMS  LM   +Y NV LYPNI    ++
                  l   C    YLDN
Sbjct:  301  IEQLLTQLPNVHFHIGAITEMSGHLMGLNRYPNVSLYPNIRPAKVAELFERCDLYLDINI  360

Query:  359  HNEILSAVRSAFEHQQLIFAFEETSHQIREVSPKNIFPKKDIFTFISHLQPLIGNKCNIE  418
             +EIL+A R+AFE+  LI +F  T H  RF++  +I+ +++    +  +Q + +    +E
Sbjct:  361  SDEILNACRTAFENNMLILSETNTCHSRRFIADDHIYAPENVSGMVDKIQSALAHSSEME  420

Query:  419  KALKQQLEDCHVSSSTQYQSVI                                        440
             AL +Q +   + +S  QY+++I
Sbjct:  421  AALTRQKQAANQASLEQYKAII                                        442
```

No corresponding DNA sequence was identified in S. pyogenes.

Based on this analysis, it was predicted that this protein and its epitopes, could be useful antigens for vaccines or diagnostics.

Example 1293

A DNA sequence (GBSx1371) was identified in S. agalactiae <SEQ ID 3975> which encodes the amino acid sequence <SEQ ID 3976>. Analysis of this protein sequence reveals the following:

Possible site: 22
>>> Seems to have no N-terminal signal sequence
INTEGRAL    Likelihood = –0.06    Transmembrane 405-421 (404-422)
----- Final Results -----
    bacterial membrane --- Certainty = 0.1022 (Affirmative) <succ>
    bacterial outside --- Certainty = 0.0000 (Not Clear) <succ>
        bacterial cytoplasm --- Certainty = 0.0000 (Not Clear) <succ>

The protein has homology with the following sequences in the GENPEPT database.

```
>GP:BAA94320 GB:AB033763 hypothetical protein [Staphylococcus aureus]
Identities = 66/195 (33%), Positives = 99/195 (49%), Gaps = 9/195 (4%)

Query:  259  NYYDYQFTNANREDFFITSTDKQTELLEQQFKQFTNHNPRIITIPVGSID----NLKMPM  314
             N Y + F N NR+   I ST +Q   +       N+   + TIPVG ID      NLK
Sbjct:   15  NTYKHVFNNLNRYSGIIVSTKQQ----QLDISARINNEIPVHTIPVGYIDEHFTNLKRNN   70

Query:  315  DNRRPYSILTASRLASEKHVDWLVRAVIRIREILPEVTEDIYGSGGEEEKIRNIINAANA  374
             +           I++ +R + EK ++    + V ++ +    P +      +YG G EEEK + +I     N
Sbjct:   71  HSINNNKIISVARYSPEKQLNHQIELVSKLIKEFPNIRLHLYGEGKEEEKYKQLITEYNL  130

Query:  375  TEYIRLMG-HKNLSEVYQNYELYLTASKSEGFGLTLLEAIGAGLPLIGFDVRYGNQTFIK  433
               + L G  +NLS    Q+   + L  S  EGF L LLE I   G+P +G++   +YG     I
Sbjct:  131  ENNVFLRGERRNLSAEIQDAYMSLITSNMEGFNLGLLETITEGIPPVGYNSKYGPSELIL  190

Query:  434  DGENGYLIPRFDMDD                                               448
             + ENGYLI + D  D+
Sbjct:  191  NNENGYLINKNDKDE                                               205
```

SEQ ID 3976 (GBS426) was expressed in E. coli as a His-fusion product. SDS-PAGE analysis of total cell extract is shown in FIG. 80 (lane 4; MW 58.8 kDa). It was also expressed in E. coli as a GST-fusion product. SDS-PAGE analysis of total cell extract is shown in FIG. 173 (lane 3; MW 84 kDa).

GBS426-GST was purified as shown in FIG. 220, lane 5.

Based on this analysis, it was predicted that this protein and its epitopes, could be useful antigens for vaccines or diagnostics.

Example 1294

A DNA sequence (GBSx1372) was identified in S. agalactiae <SEQ ID 3977> which encodes the amino acid sequence <SEQ ID 3978>. This protein is predicted to be preprotein translocase secA subunit (secA). Analysis of this protein sequence reveals the following:

Possible site: 42
>>> Seems to have no N-terminal signal sequence

INTEGRAL   Likelihood = −0.69   Transmembrane 75-91 (75-91)
----- Final Results -----
  bacterial membrane --- Certainty = 0.1277 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

```
>GP:AAC44957 GB:U56901 involved in protein export [Bacillus subtilis]
Identities = 336/794 (42%), Positives = 506/794 (63%), Gaps = 29/794 (3%)
    Query:   5 NSLFSLDKKRLKKLQRTLNTINSLKGQMATLSNEELQAKTTEFRKALVNGETLDDICAEA    64
               N +F    K+ L + ++ N I++++G     LS++ L+ KT EF++RL  G T DD+  EA
    Sbjct:   6 NKMFDPTKRTLNRYEKIANDIDAIRGDYENLSDDALKHKTIEFKERLEKGATTDDLLVEA    65

Query:  65 FAVVREADERVLGLFPYDVQVIGGLVLHQGNTAEMKTGEGKTLTATMPLYLNALEGKGAM   124
               FAVVREA   RV G+FP+  VQ++GG+ LH GN AEMKTGEGKTLT+T+P+YLNAL GKG
    Sbjct:  66 FAVVREASRRVTGMFPFKVQLMGGVALHDGNIAEMKTGEGKTLTSTLPVYLNALTGKGVH   125

Query: 125 LLTNNSYLAIRDAEEMGKVYRFLGLSVGVGVSDNEEEDRDAATKRAVYSSDIVYSTSSAL   184
               ++T N YLA RDAE+MGK++ FLGL+VG+ ++   +++   KR  Y++DI YST++ L
    Sbjct: 126 VVTVNEYLASRDAEQMGKIFEFLGLTVGLNLNSMSKDE-----KREAYAADITYSTNNEL   180

Query: 185 GFDYLIDNLASSKSQKYMPKLHYAIVDEADAVLLDMAQTPLVISGSPRVQSNLYKIADEL   244
               GFDYL DN+    K Q    LH+A++DE D++L+D A+TPL+ISG    + LY   A+
    Sbjct: 181 GFDYLRDNMVLYKEQMVQRPLHFAVIDEVDSILIDEARTPLIISGQAAKSTKLYVQANAF   240

Query: 245 ILSFEEQVDYYFDKERQEVWIENQGVREAERYFRIPHFYKQSNRELVRHLNLSLKAHKLF   304
               + + + + DY +D + + V +   +G+ +AE+  F I + +    L  H+N +LKAH
    Sbjct: 241 VRTLKAEKDYTYDIKTKAVQLTEEGMTKAEKAFGIDNLFDVEEVALNHHINQALKAHVAM   300

Query: 305 ERGKDYVVDDGEIKLLDATNGRVLEGTKLQGGVHQAIEQKEHLNVTPESRAMASITYQNL   364
               ++   DYVV+DG++  ++D+   GR+++G +    G+HQAIE KE L +  ES  +A+IT+QN
    Sbjct: 301 QKDVDYVVEDGQVVIVDSFIGRLMKGRRYSEGLHQAIEAKEGLEIQNESMTLATITFQNY   360

Query: 365 FRMFTKLAGMIGTGKTAEKEFIEVYDMEVVRIPTNSPVRRIDYPDKIYTTLPEKIHATIE   424
               FRM+  KLAGM GT KT E+EF  +Y+M+VV  IPTN PV R D PD IY T+  K  A   E
    Sbjct: 361 FRMYEKLAGMTGTAKTEEEEFRNIYNMQVVTIPTNRPVVRDDRPDLIYRTMEGKFKAVAE   420

Query: 425 FVKQVHDTGQPILLVAGSVRMSELFSELLLLSGIPHSLLNAQSAVREAQMIAEAGQKGAV   484
               V Q + TGQP+L+    +V  SEL  S+LL  GIPH +LNA++  +EAQ+I EAGQKGAV
    Sbjct: 421 DVAQRYMTGQPVLVGTVAVETSELISKLLKNKGIPHQVLNAKNHEREAQIIEEAGQKGAV   480

Query: 485 TVATNMAGRGTDIKLGKGVSELGGLAVIGTERMKSQRMDLQLRGRSGRQGDIGFSQFFVS   544
               T+ATNMAGRGTDIKLG+GV ELGGLAV+GTER +S+R+D QLRGRSGRQGD G +QF++S
    Sbjct: 481 TIATNMAGRGTDIKLGEGVKELGGLAVVGTERHESRRIDNQLRGRSGRQGDPGITQFYLS   540

Query: 545 FEDDLMIESGPKWAQDYFRKNRDKVNPEKPKALGQRRFQKLFQQTQEASDGKGESARSQT   604
                ED+LM   G +       D+      +          +  +Q+    +G       +R Q
    Sbjct: 541 MEDELMRRFGAERTMAML----DRFGMDDSTPIQSKMVSRAVESSQKRVEGNNFDSRKQL   596

Query: 605 IEFDSSVQLQREYVYRERNALINGESGHFSPRQIIDTVISSFI------AYLDGEVEKEEL   659
               +++D  ++ QRE +Y++R  +I+ E      + R+I++   +I S +        AY   E       EE
    Sbjct: 597 LQYDDVLRQQREVIYKQRFEVIDSE----NLREIVENMIKSSLERAIAAYTPREELPEE-   651

Query: 660 IFEVNRFI-FDNMSYNLQGISKEMSL--EEIKNYLFKIADEILREKHNLLGDSFG-----   711
               ++++ +  N +Y +G ++      +E     L   I D  I+  K+N   + FG
    Sbjct: 652 -WKLDGLVDLINTTYLDEGALEKSDIFGKEPDEMLELIMDRII-TKYNEKEEQFGKEQMR   709

Query: 712 DFERTAALKAIDEAWIEEVDYLQQLRTVATARQTAQRNPVFEYHKEAYKSYNIMKKEIRE   771
               +FE+    L+A+D  W++  +D +  QLR     R   AQ  NP+  EY   E + +   M + I +
    Sbjct: 710 EFEKVIVLRAVDSKWMDHIDAMDQLRQGIHLRAYAQTNPLREYQMEGFAMFEHMIESIED   769

Query: 772 QTFRNLLLSEVSFN                                                785
                +   +  ++ +E+   N
    Sbjct: 770 EVAKFVMKAEIENN                                                783
```

There is also homology to SEQ ID 3620.

SEQ ID 3978 (GBS425) was expressed in *E. coli* as a His-fusion product. SDS-PAGE analysis of total cell extract is shown in FIG. 80 (lane 3; MW 91 kDa). It was also expressed in *E. coli* as a GST-fusion product. SDS-PAGE analysis of total cell extract is shown in FIG. 173 (lane 2; MW 116 kDa).

GBS425-GST was purified as shown in FIG. 220, lane 4.

Based on this analysis, it was predicted that this protein and its epitopes, could be useful antigens for vaccines or diagnostics.

Example 1295

A DNA sequence (GBSx1373) was identified in *S. agalactiae* <SEQ ID 3979> which encodes the amino acid sequence <SEQ ID 3980>. Analysis of this protein sequence reveals the following:

---

Possible site: 43
>>> Seems to have no N-terminal signal sequence
----- Final Results -----
   bacterial cytoplasm --- Certainty = 0.3827 (Affirmative) <succ>
     bacterial membrane --- Certainty = 0.0000 (Not Clear) <succ>
       bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1296

A DNA sequence (GBSx1374) was identified in *S. agalactiae* <SEQ ID 3981> which encodes the amino acid sequence <SEQ ID 3982>. Analysis of this protein sequence reveals the following:

---

Possible site: 17
>>> Seems to have no N-terminal signal sequence
----- Final Results -----
   bacterial cytoplasm --- Certainty = 0.2683 (Affirmative) <succ>
     bacterial membrane --- Certainty = 0.0000 (Not Clear) <succ>
       bacterial outside --- Certainty = 0.0000 (Not Clear) <succ>

---

A related GBS nucleic acid sequence <SEQ ID 10001> which encodes amino acid sequence <SEQ ID 10002> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

Example 1297

A DNA sequence (GBSx1375) was identified in *S. agalactiae* <SEQ ID 3983> which encodes the amino acid sequence <SEQ ID 3984>. Analysis of this protein sequence reveals the following:

---

Possible site: 31
>>> Seems to have no N-terminal signal sequence
----- Final Results -----
   bacterial cytoplasm --- Certainty = 0.5410 (Affirmative) <succ>
     bacterial membrane --- Certainty = 0.0000 (Not Clear) <succ>
       bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1298

A DNA sequence (GBSx1376) was identified in *S. agalactiae* <SEQ ID 3985> which encodes the amino acid sequence <SEQ ID 3986>. This protein is predicted to be preprotein translocase secy subunit. Analysis of this protein sequence reveals the following:

---

Possible site: 59
>>> Seems to have an uncleavable N-term signal seq
INTEGRAL   Likelihood = −9.92   Transmembrane 287-303 (278-309)
INTEGRAL   Likelihood = −9.08   Transmembrane 191-207 (186-210)
INTEGRAL   Likelihood = −8.44   Transmembrane 104-120 (101-123)
INTEGRAL   Likelihood = −8.23   Transmembrane 11-27 (9-41)
INTEGRAL   Likelihood = −3.93   Transmembrane 133-149 (129-150)
INTEGRAL   Likelihood = −3.19   Transmembrane 347-363 (344-364)
INTEGRAL   Likelihood = −2.97   Transmembrane 158-174 (155-174)
INTEGRAL   Likelihood = −1.54   Transmembrane 246-262 (245-262)
INTEGRAL   Likelihood = −0.90   Transmembrane 372-388 (372-388)
INTEGRAL   Likelihood = −0.85   Transmembrane 64-80 (64-81)
----- Final Results -----
   bacterial membrane --- Certainty = 0.4970 (Affirmative) <succ>
     bacterial outside --- Certainty = 0.0000 (Not Clear) <succ>
       bacterial cytoplasm --- Certainty = 0.0000 (Not Clear) <succ>

---

The protein has homology with the following sequences in the GENPEPT database.

```
>GP:AAF30659 GB:AE002122 preprotein translocase [Ureaplasma urealyticum]
Identities = 105/422 (24%), Positives = 213/422 (49%), Gaps = 49/422 (11%)
Query:    2 KLLYIFEKNIILRKILITFSLIIIFLLGRYVPIPGVLISAYKGQDNNFATLYSTVTGGNL   61
            +LL IF+   +L   +++T S++I+F +G  +P+P + ++    G    +F ++ + + GG L
Sbjct:   13 QLLMIFKNKKVLVALIVTLSILILFRIGSVIPMPYIKLNGNFGNQGSFFSIINLLGGGGL   72

Query:   62 SQVGVFSLGIGPMMTTMILLRLFT---------IGKYSSGVSQKVQQFRQNVVMLVIAII  112
            SQ  +F++GIGP +T  I+++L +             + K      +K++   + ++ L +A++
Sbjct:   73 SQFSLFAIGIGPYITAQIIMQLLSSELVPPLAKLSKSGERGRKKIEVITR-IITLPLAVM  131

Query:  113 QGLAITISFQYHNGFSL----------TKLLLATMI--LVTGAYIISWIGNINAEYGFG-  159
```

```
                Q + I           NGF           + L    T I   +V G YI    ++  +L ++ G  G
Sbjct: 132  QAVIIINLMTRANGFISIVSNAPFAIGSPLFYVTYIFLMVGGTYISLFLADLISKKGVGN  191

Query: 160  GMTILVVVGMLVGQFNNIPLIFELF------QDGYQLAIILFLLWTLVAMYLMITFERSE  213
            G+T+L++ G++   FN+  IF          +    IL++L+ ++ + ++    S
Sbjct: 192  GITLLILTGIVASLFNHFIAIFSNLGSLTSSKVSQIIGFILYILFYIMILIGVVFVNNST  251

Query: 214  YRIPVMRTS-----IHNRLVDDAYMPIKVNASGGMAFMYVYTLLMFPQYIIILLRSIFPT  268
            +IPV +T       H +L     ++PIK+  +G M  ++  ++L P  +    L
Sbjct: 252  RKIPVQQTGQALILDHEKL---PFLPIKIMTAGVMPVIFASSVLAIPAQVAEFLDK---Q  305

Query: 269  NPDITSYNDYFSLSSIQGVVIYMILMLVLSVAFTFVNIDPIKISEAMRESGDFIPNYRPG  328
            +        ++YF + S    G+ IY++L+L+ +    F++V ++P K++E ++++G FIP   + G
Sbjct: 306  SMGYYVIHNYFIVDSWIGLAIYVVLILLFTFFFSYVQLNPPKMAEDIKKAGRFIPGVQVG  365

Query: 329  KETQSYLSKICYLFGTFSGFFMAFLGGVPLLFALGNDDLR---------TVSSMTGIFMM  379
             +T+ +++K+ Y        +AFL  +P L  AL    +         T+    T I +M
Sbjct: 366  MDTEKHITKVIYRVNWIGAPILAFLACLPHLVALVAKTINHGIPVIQPSTIFGGTSIIIM  425

Query: 380  IT                                                           381
            +T
Sbjct: 426  VT                                                           427
```

There is also homology to SEQ ID 3988.

A related GBS gene <SEQ ID 8783> and protein <SEQ ID 8784> were also identified. Analysis of this protein sequence reveals the following:

```
Lipop: Possible site: -1 Crend: 8
McG: Discrim Score: 6.32
GvH: Signal Score (-7.5): -4.07
Possible site: 59
>>> Seems to have an uncleavable N-term signal seq
ALOM program   count: 10 value: -9.92 threshold: 0.0
INTEGRAL   Likelihood = -9.92   Transmembrane 287-303 (278-309)
INTEGRAL   Likelihood = -9.08   Transmembrane 191-207 (186-210)
INTEGRAL   Likelihood = -8.44   Transmembrane 104-120 (101-123)
INTEGRAL   Likelihood = -8.23   Transmembrane 11-27 (9-41)
INTEGRAL   Likelihood = -3.93   Transmembrane 133-149 (129-150)
INTEGRAL   Likelihood = -3.19   Transmembrane 347-363 (344-364)
INTEGRAL   Likelihood = -2.97   Transmembrane 158-174 (155-174)
INTEGRAL   Likelihood = -1.54   Transmembrane 246-262 (245-262)
INTEGRAL   Likelihood = -0.90   Transmembrane 372-388 (372-388)
INTEGRAL   Likelihood = -0.85   Transmembrane 64-80 (64-81)
PERIPHERAL Likelihood = 8.65    28
modified ALOM score: 2.48
*** Reasoning Step: 3
----- Final Results -----
    bacterial membrane --- Certainty = 0.4970 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the databases:

```
ORF02350(316-1500 of 1827)
EGAD|6621|6420(8-426 of 431) preprotein translocase secy subunit {Bacillus sp.}
SP|P38375|SECY_BACHD PREPROTEIN TRANSLOCASE SECY SUBUNIT.
GP|484251|dbj|BAA01191.1|D10360 secretion protein Y {Bacillus sp.}
PIR|B44859|B44859 preprotein translocase secY - Bacillus sp.
% Match = 12.1
% Identity = 26.8 % Similarity = 55.4
Matches = 109 Mismatches = 165 Conservative Sub.s = 116

57         87        117        147        177        207        237        267
EVWNVVDRCITEGKTIYGIRRARKDNQYISFERTMDDFEYLCDTIKQNR*SRRVMVT*ILKSIFLILKLTKLTI*SYLS*

297        327        357        387                  441        471        501
REQIDREREIPLKLLYIFEKNIILRKILITFSLIIIFLLGRYVPIPGV--LISAYKGQDNNFATLYSTVTGGNLSQVGVF
                   ||    :  ||::  |:  ::|:|  :|  ::|:||     :   |  |   :|   ||        :|
          MFRTISNIFRVGDLRRKVIFTLLMLIVFRIGSFIPVPGTNREVLDFVDQANAFGFL-NTFGGGALGNFSIF
                   10         20         30         40         50         60         70

531                582        594        624        654        681        699
SLGIGPMMTTMILLRLF---TIGKYSSGVSQ------KVQQFRQNVVMLVIAIIQGLAITISFQ-YHNGF----SLTKLL
::||   |  :|    |:::|:        :  |::          |:  ||   ::|:  ||   |::  |    :|    |    |::   |
AMGIMPYITASIVMQLLQMDVVPKFAEWAKEGEAGRRKLAQFTRYGTIVVLGFIQALGMSVGFNNFFPGLIPNPSVSVYL
     80         90        100        110        120        130        140        150

729        759        786        816        846        870        888        918
LATMILVTGAYIISWIGNLNAEYGFG-GMTILVVVGMLVGQFNNIPLIFEL-FQD-GYQL----AIILFLLWTLVAMYLM
:  :: |    |  : |:|     |  |::|:      |  |  |: ||     ||  ||      :|:|   ::|:  ::|: :
FIALVLTAGTAFLMWLGEQITAKGVGNGISIIIFAGIAAGIPNGLNLIYSTRIQDAGEQLFLNIVVILLLALAILAIIVG
     160        170        180        190        200        210        220        230
```

```
966           1023         1053        1083        1113        1143
ITFERSEYR-IPVM---RTSIHNRLVDDA-YMPIKVNASGGMAFMYVYTLLMFPQYIIILLRSIFPTNPDITSYNDYFSL
 :| :     |  |||    |      |  :   : :::|:||||:|  :  ::   :||:||  :  |:  |    :     ||
VIFVQQALRKIPVQYAKRLVGRNPVGGQSTHLPLKVNAAGVIPVIFALSLLIFPPTVAGLFGSDHPVAAWVIETFDY---
           240          250         260         270         280         290         300

1173         1203        1233        1263        1293        1323        1353        1383
SSIQGVVIYMILMLVLSVAFTFVNIDPTKISEAMRESGDFIPNYRPGKETQSYLSKICYLFGTFSGFFMAFLGGVPLLFA
 : :|  :|  :|  | ::  :: |::|  ::: |  ::   |  ||||  ||:::: |  |   :      :|:|   :|::|
THLIGMAVYALRIIGFTYFYAFIQVNPERMAENLKKQGGYIPGIRPGKATQTYITPILYRLTFVGSLFLAVVAILPVFF-
           320          330         340         350         360         370         380

1413         1440        1470        1500        1530        1560        1590        1620
LGNDDLRTVSSMTGI-FMMITGMSFMILDEFQVIRIRKQYTSVFENEEN*CFILFHLGIMKIVLGMIIITCGISSRLMSV
 : ||     : |   : | ::::|::: : : :  |::  |
IKFADLPQAIQIGGTGLLIVVGVALDTMKQIEAQLIKRSYKGFIK
           400          410         420         430
```

Based on this analysis, it was predicted that these proteins and their epitopes could be useful antigens for vaccines or diagnostics.

Example 1299

A DNA sequence (GBSx1377) was identified in *S. agalactiae* <SEQ ID 3989> which encodes the amino acid sequence <SEQ ID 3990>. Analysis of this protein sequence reveals the following:

Possible site: 24
>>> Seems to have no N-terminal signal sequence
----- Final Results -----
    bacterial cytoplasm --- Certainty = 0.3002 (Affirmative) <succ>
        bacterial membrane --- Certainty = 0.0000 (Not Clear) <succ>
        bacterial outside --- Certainty = 0.0000 (Not Clear) <succ>

The protein has homology with the following sequences in the GENPEPT database.

```
>GP:AAF61315 GB:U96166 unknown [Streptococcus cristatus]
Identities = 30/78 (38%), Positives = 41/78 (52%)
Query:  276  ALTVTLIDDIWELEHLLQRCPNTDFHIAAPVYCSDRLKQLVGYPNYYLHEAITEEQFEVL   335
             AL +T +D + ++E LL + PN  FHI A     S  L  L YPN L+ I  +  L
Sbjct:  289  ALILTNSDQLEQIEQLLTQLPNVHFHIGAITEMSGHLMGLNRYPNVSLYPNIRPAKVAEL   348

Query:  336  LLNSDIYLDINHGEEVWN                                             353
             D+YLDIN  +E+ N
Sbjct:  349  FERCDLYLDINISDEILN                                             366
```

No corresponding DNA sequence was identified in *S. pyogenes*.

Based on this analysis, it was predicted that this protein and its epitopes, could be useful antigens for vaccines or diagnostics.

Example 1300

A DNA sequence (GBSx1378) was identified in *S. agalactiae* <SEQ ID 3991> which encodes the amino acid sequence <SEQ ID 3992>. This protein is predicted to be eps7. Analysis of this protein sequence reveals the following:

Possible site: 19
>>> May be a lipoprotein
----- Final Results -----
    bacterial membrane --- Certainty = 0.0000 (Not Clear) <succ>
        bacterial outside --- Certainty = 0.0000 (Not Clear) <succ>
        bacterial cytoplasm --- Certainty = 0.0000 (Not Clear) <succ>

The protein has homology with the following sequences in the GENPEPT database.

```
>GP:CAC07458 GB:AX009404 product = eps7 [Streptococcus thermophilus]
Identities = 87/232 (37%), Positives = 133/232 (56%), Gaps = 22/232 (9%)
Query:   10  VSVIIPVYNAAPYLEGCVNTILGQTYQVFEILLIDDGSTDTSASICDQLSLRDNRIRVFH    69
             +S++IPVYN    Y++ C+++IL QT+   EI+L+DDGSTD S  ICD  S  D RI+V H
Sbjct:    3  ISIVIPVYNVQDYIKKCLDSILSQTFSDLEIILVDDGSTDLSGRICDYYSENDKRIKVIH    62

Query:   70  IENGGASKARNFGLARISPESQFVTFVDSDDWVKENYLEVLLAQQEKYNADIVISNYYIY   129
              NGG S+ARN G+  +   S+++TF+DSDD+V  +Y+E L   + +NADI I+++
Sbjct:   63  TANGGQSEARNVGIKNAT--SEWITFIDSDDYVSSDYIEYLYNLIQVHNADISIASF---   117

Query:  130  RETEDIFGYYITDKDFV------IEEISAQTAIDRQVHWHLNSSVFIVIWGKLYRRELFD   183
                        YIT K +       +  A+TAI R +   LN      + +WGK+YR E F+
Sbjct:  118  --------TYITPKKIIKHGNGEVALMDAKTAIRRML---LNEGFDMGVWGKMYRTEYFN   166
```

```
                                    -continued
Query: 184  TITFPIDKVFEDELVSVLLFIKSKKTILVNGSYYGYRIRPNSIMTSAFSSKR       235
            F   K+FED L++  +F ++   +      Y Y  R NS +   F+ K+
Sbjct: 167  KYKFVSGKLFEDSLITYQIFSEASTIVFGAKDIYFVNRKNSTVNGTFNIKK       218
```

Based on this analysis, it was predicted that this protein and its epitopes, could be useful antigens for vaccines or diagnostics.

Example 1301

A DNA sequence (GBSx1379) was identified in *S. agalactiae* <SEQ ID 3993> which encodes the amino acid sequence <SEQ ID 3994>. Analysis of this protein sequence reveals the following:

---

Possible site: 14
>>> Seems to have no N-terminal signal sequence
----- Final Results -----
    bacterial cytoplasm --- Certainty = 0.1569 (Affirmative) <succ>
      bacterial membrane --- Certainty = 0.0000 (Not Clear) <succ>
        bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1302

A DNA sequence (GBSx1380) was identified in *S. agalactiae* <SEQ ID 3995> which encodes the amino acid sequence <SEQ ID 3996>. Analysis of this protein sequence reveals the following:

---

Possible site: 26
>>> Seems to have no N-terminal signal sequence
----- Final Results -----
    bacterial cytoplasm --- Certainty = 0.1662 (Affirmative) <succ>
      bacterial membrane --- Certainty = 0.0000 (Not Clear) <succ>
        bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1303

A DNA sequence (GBSx1381) was identified in *S. agalactiae* <SEQ ID 3997> which encodes the amino acid sequence <SEQ ID 3998>. This protein is predicted to be a glycosyl transferase (gspA). Analysis of this protein sequence reveals the following:

---

Possible site: 13
>>> Seems to have no N-terminal signal sequence
----- Final Results -----
    bacterial cytoplasm --- Certainty = 0.2606 (Affirmative) <succ>
      bacterial membrane --- Certainty = 0.0000 (Not Clear) <succ>
        bacterial outside --- Certainty = 0.0000 (Not Clear) <succ>

---

The protein has homology with the following sequences in the GENPEPT database.

```
>GP:AAF28363 GB:AF224467 putative glycosyl transferase [Haemophilus
ducreyi]
Identities = 62/177 (35%), Positives = 105/177 (59%), Gaps = 8/177 (4%)
Query:   3  YARYYIPQLIDAEKVLYLDIDTLVVDNLDKLFEIELGDYPIAAILD--GDGIY-----FN    55
            + RY+I    I+ +KV+YLD D +V  +L +L++ ++ +Y +AA+ D    + IY       FN
Sbjct:  89  FFRYFISDFIEQDKVIYLDADIVVNGSLTELYQTDISNYFLAAVKDIISEKIYVNNHIFN   148

Query:  56  SGVMLINSLYWMRYRVTEKLLEITERELDNGIFGDQGVLNLLFDNNWLKLEDKYNAQVGN   115
            +G++LIN+   W    +T+  L ++E+ +++      DQ +LNL+F + WLKL     YN    +G
Sbjct: 149  AGMLLINNKKWREHNITQFCLSLSEKYINSLPDADQSILNLIFKDKWLKLNRGYNYLIGT   208

Query: 116  DLGAFYENWQGYFDRNFES-PTIIHYCTHDKPWNTFSSSRFRETWWQYEQLDWNEVF      171
            D   F       Y +    E+ P IIHY T  KPW      ++RFR  +W Y +L+W +++
Sbjct: 209  DYLFFKYGKTRYLEDLGETIPLIIHYNTEAKPWLNIFNTRFRNIYWFYYELNWQDIY      265
```

No corresponding DNA sequence was identified in *S. pyogenes*.

Based on this analysis, it was predicted that this protein and its epitopes, could be useful antigens for vaccines or diagnostics.

Example 1304

A DNA sequence (GBSx1384) was identified in *S. agalactiae* <SEQ ID 3999> which encodes the amino acid sequence <SEQ ID 4000>. This protein is predicted to be a glycosyl transferase. Analysis of this protein sequence reveals the following:

---

Possible site: 56
>>> Seems to have no N-terminal signal sequence
----- Final Results -----
    bacterial cytoplasm --- Certainty = 0.1157 (Affirmative) <succ>
      bacterial membrane --- Certainty = 0.0000 (Not Clear) <succ>
        bacterial outside --- Certainty = 0.0000 (Not Clear) <succ>

---

The protein has homology with the following sequences in the GENPEPT database.

```
>GP:AAF28363 GB:AF224467 putative glycosyl transferase [Haemophilus
ducreyi]
Identities = 103/259 (39%), Positives = 156/259 (59%), Gaps = 3/259 (1%)
Query:     7  IALAADFGYQEQVKTIIKSICFHNQFIDFYILNDDFPVEWFQMMEYHLSKMDCTISNTKI    66
              I LAA+  Y E + T IKSI  HN+ I FY+LN D+P EWF ++   L K++  I + K+
Sbjct:    10  IVLAANQSYSEYILTTIKSIYLHNKHIRFYLLNRDYPTEWFDILNNKLRKLNSEIIDIKV    69

Query:    67  FNEEIKHFK-FQKPMPYPTYFRYFIPEVIHEDKVLYLDCDMIITSDLTSIFTLDISKYGV   125
              N+ IK+FK +        T+FRYFI + I +DKV+YLD D+++   LT ++  DIS Y +
Sbjct:    70  TNDTIKNFKTYSHISSDTTFFRYFISDFIEQDKVIYLDADIVVNGSLTELYQTDISNYFL   129

Query:   126  AAVRDDLLEEYDGKEDYFNSGLLLINNIFWREQGISQRLLDYTRENQGALQYHDQDVLND   185
              AAV+D + E+        FN+G+LLINN  WRE I+Q  L + +    +L    DQ +LN
Sbjct:   130  AAVKDIISEKIYVNNHIFNAGMLLINNKKWREHNITQFCLSLSEKYINSLPDADQSILNL   189

Query:   186  VLCDNWLELDETYNYHTGADMLYNLFQQSERQLNRRKDLPKVIHY-TATKPWKYLETSVR   244
              +  D WL+L+   YNY G D L+  + ++    + + +P +IHY T  KPW  +  + R
Sbjct:   190  IFKDKWLKLNRGYNYLIGTDYLFFKYGKTRYLEDLGETIPLIIHYNTEAKPWLNI-FNTR   248

Query:   245  WRDIWWEYNRLEWRDIFTR                                           263
              +R+I+W Y  L W+DI+ +
Sbjct:   249  FRNIYWFYYELNWQDIYAK                                           267
```

No corresponding DNA sequence was identified in *S. pyogenes*.

Based on this analysis, it was predicted that this protein and its epitopes, could be useful antigens for vaccines or diagnostics.

Example 1305

A DNA sequence (GBSx1385) was identified in *S. agalactiae* <SEQ ID 4001> which encodes the amino acid sequence <SEQ ID 4002>. This protein is predicted to be a glycosyl transferase. Analysis of this protein sequence reveals the following:

---

Possible site: 28
>>> Seems to have no N-terminal signal sequence
----- Final Results -----
    bacterial cytoplasm --- Certainty = 0.2679 (Affirmative) <succ>
     bacterial membrane --- Certainty = 0.0000 (Not Clear) <succ>
      bacterial outside --- Certainty = 0.0000 (Not Clear) <succ>

---

The protein has homology with the following sequences in the GENPEPT database.

```
>GP:AAF28363 GB:AF224467 putative glycosyl transferase [Haemophilus
ducreyi]

Identities = 94/263 (35%), Positives = 158/263 (59%), Gaps = 4/263 (1%)
Query:     2  KKTIVLGADFQYRDQVMTTIKSIVSHNQHLTIYIINTDFPVEWFNILNHSLEQFDCRVKN    61
              K  IVL A+  Y + ++TTIKSI  HN+H+  Y++N D+P EWF+ILN+ L + +  +
Sbjct:     7  KMNIVLAANQSYSEYILTTIKSIYLHNKHIRFYLLNRDYPTEWFDILNNKLRKLNSEIID    66

Query:    62  IPISSDVFEGIPTLSHISV-AGFFRWFIPIHLEEEIVLYLDSDVIRGSLDPLFDINLEE   120
              I +++D +   T SHIS    FFR+FI    +E++ V+YLD+D++ GSL  L+  ++
Sbjct:    67  IKVTNDTIKNFKTYSHISSDTTFFRYFISDFIEQDKVIYLDADIVVNGSLTELYQTDISN   126

Query:   121  NLLGAVADHFSTLYYGDTAPVSFNSGVMLINNSLWKKEEIYNSLMRIADKG-SAVGVGDQ   179
                L  AV D  S    Y +      FN+G++LINN  W++  I    + +++K  +++   DQ
Sbjct:   127  YFLAAVKDIISEKIYVNNH--IFNAGMLLINNKKWREHNITQFCLSLSEKYINSLPDADQ   184

Query:   180  EYLNILTQNRWIDIGKQYNVQIGQDVNINAYGRPDLYHFYDDCEPVIVHYNSQDKPWNKY   239
                LN++  +++W+ +  + YN  IG D     YG+        + P+I+HYN++ KPW
Sbjct:   185  SILNLIFKDKWLKLNRGYNYLIGTDYLFFKYGKTRYLEDLGETIPLIIHYNTEAKPWLNI   244

Query:   240  SQSRYRSEWWYYFGLEWSVIYAQ                                       262
              +R+R+ +W+Y+ L W  IYA+
Sbjct:   245  FNTRFRNIYWFYYELNWQDIYAK                                       267
```

No corresponding DNA sequence was identified in *S. pyogenes*.

Based on this analysis, it was predicted that this protein and its epitopes, could be useful antigens for vaccines or diagnostics.

Example 1306

A DNA sequence (GBSx1386) was identified in *S. agalactiae* <SEQ ID 4003> which encodes the amino acid sequence <SEQ ID 4004>. Analysis of this protein sequence reveals the following:

---

Possible site: 13
>>> Seems to have no N-terminal signal sequence
----- Final Results -----
    bacterial cytoplasm --- Certainty = 0.2996 (Affirmative) <succ>
     bacterial membrane --- Certainty = 0.0000 (Not Clear) <succ>
      bacterial outside --- Certainty = 0.0000 (Not Clear) <succ>

---

A related GBS nucleic acid sequence <SEQ ID 10003> which encodes amino acid sequence <SEQ ID 10004> was also identified.

The protein has homology with the following sequences in the GENPEPT database.

```
>GP:AAC75095 GB:AE000294 putative Galf transferase [Escherichia coli K12]
Identities = 68/286 (23%), Positives = 122/286 (41%), Gaps = 18/286 (6%)
Query:  77  STRMDGIIAGLGRGDIVVFQVPTWNSTEFDELFLDKLQAYGARIITFVHDIVPLMFESNF  136
            S ++    + GL   D+++F  P         F  +L  +  RI+   +HDI   L
Sbjct:  50  SVKLSTFLCGLENKDVLIFNFPMAKPFWHILSFFHRLLKF--RIVPLIHDIDELRGGGGS  107

Query: 137  YLLDRVIDMYNRSDVVILPTKAMHDYLIEKGMTTSKVLYQEVWDHPVNIDLPRPEC---Q  193
                  D V      D+VI      M  YL  K M+  K+     +++D+ V+ D+   +    Q
Sbjct: 108  ---DSV--RLATCDMVISHNPQMTKYL-SKYMSQDKIKDIKIFDYLVSSDVEHRDVTDKQ  161

Query: 194  KVLSFAGDIQRFPFVNDWKENIPLIYYGDGSRLNSEANVHAQGWKDDVELMLSLSKRG-G  252
            + +  +AG++  R     + E         +G         ++ N      G    D +      ++  G
Sbjct: 162  RGVIYAGNLSRHKCSFIYTEGCDFTLFG--VNYENKDNPKYLG-SFDAQSPEKINLPGMQ  218

Query: 253  FGLCWSEDREELVERR---YSRMNASYKLSTFLAAGLPIIANHDISSRDFIKQHGLGFTV  309
            FGL W  D  E          Y +  N   +K S +L+   LP+       +  DFI  +  +G+ V
Sbjct: 219  FGLIWDGDSVETCSGAFGDYLKFNNPHKTSLYLSMELPVFIWDKAALADFIVDNRIGYAV  278

Query: 310  ETLEEAVEKINNMEKETYDSYVENVEKIATLLRNGYITKKLLIDAV                355
               +++E   E  +++M   ETY        EN + I+    +R G      + +L + +
Sbjct: 279  GSIKEMQEIVDSMTIETYKQISENTKIISQKIRTGSYFRDVLEEVI                324
```

No corresponding DNA sequence was identified in *S. pyogenes*.

Based on this analysis, it was predicted that these proteins and their epitopes could be useful antigens for vaccines or diagnostics.

Example 1307

A DNA sequence (GBSx1387) was identified in *S. agalactiae* <SEQ ID 4005> which encodes the amino acid sequence <SEQ ID 4006>. Analysis of this protein sequence reveals the following:

Possible site: 33
>>> Seems to have no N-terminal signal sequence
----- Final Results -----
   bacterial cytoplasm --- Certainty = 0.3098 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:AAA73093 GB:M76233 [Rabbit smooth muscle myosin light chain
kinase mRNA, complete CDS.], gene product [Oryctolagus
cuniculus]
Identities = 23/63 (36%), Positives = 36/63 (56%)

Query:   5  QPAPALQRVRQCQPAPVLQPVPRCQPALALQRVRQCQPAQVLQQVPRCQPAQVLQQVPRC   64
            +PA   L+ V    +PA   L+PV    +PA   L+ V    +PA+ L+  V     +PA+ L+ V
Sbjct: 225  KPAETLKPVGNAKPAETLKPVGNAKPAETLKPVGNAKPAETLKPVGNAKPAETLKAVANA  284

Query:  65  QPA                                                            67
            +PA
Sbjct: 285  KPA                                                            287
```

No corresponding DNA sequence was identified in *S. pyogenes*.

Based on this analysis, it was predicted that this protein and its epitopes, could be useful antigens for vaccines or diagnostics.

Example 1308

A DNA sequence (GBSx1388) was identified in *S. agalactiae* <SEQ ID 4007> which encodes the amino acid sequence <SEQ ID 4008>. Analysis of this protein sequence reveals the following:

Possible site: 43
>>> Seems to have no N-terminal signal sequence
INTEGRAL   Likelihood = −9.24   Transmembrane 189-205 (173-245)
INTEGRAL   Likelihood = −9.24   Transmembrane 213-229 (206-245)
INTEGRAL   Likelihood = −7.96   Transmembrane 95-111 (83-185)
INTEGRAL   Likelihood = −7.96   Transmembrane 115-131 (112-185)
INTEGRAL   Likelihood = −7.96   Transmembrane 135-151 (132-185)
INTEGRAL   Likelihood = −7.96   Transmembrane 155-171 (152-185)
INTEGRAL   Likelihood = −6.85   Transmembrane 15-31 (8-45)
INTEGRAL   Likelihood = −4.09   Transmembrane 39-55 (35-57)
INTEGRAL   Likelihood = −4.09   Transmembrane 63-79 (59-81)
INTEGRAL   Likelihood = −2.71   Transmembrane 235-251 (235-251)
INTEGRAL   Likelihood = −0.11   Transmembrane 253-269 (253-269)
----- Final Results -----
   bacterial membrane --- Certainty = 0.4694 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database.

```
>GP:AAC16164 GB:AF010496 ice nucleation protein [Rhodobacter apsulatus]
Identities = 85/286 (29%), Positives = 119/286 (40%), Gaps = 17/286 (5%)
Query:    3 ALVLADVDALVETLVLADVVALIEALVLADIEALV----EALVLADIEALVEALVLADID   58
              AL  A   AL  T +    A ++ L  AD+  L      +AL   A I AL  + + A
Sbjct:  523 ALSDAQAGALTSTQIGLLSTAAVKGLSTADMAGLTTAEAQALTSAQIAALSSSQIRAMTT  582

Query:   59 ALVEALVLADIEALVEALVL----ADIDALVEALVLADVEALIEALVLALVEALVLADVE  114
              A + AL  A I+ L  + +L     ADI AL       A   + I AL  +LV A+  AD+
Sbjct:  583 AQIAALGTAQIKGLTASNILGLETADIVALTTTQAPALSSSQIAALSTSLVAAMETADLA  642

Query:  115 ALIEALVLAL----VEALVLADVEAL----IEALVLALVEALVLADVEALIEALVLALVE  166
              L  A       + AL  A    A+     I  +  A ++ L   AD+ AL   A +   +
Sbjct:  643 KLSAATFKGFSSTQITALTTAQAGAIGTDQIAQITTAAIKGLESADIAALANATLAKMTT  702

Query:  167 ALVLADVEALIEALVLADVD-ALVLALVEALVLALVEALILAEVEALVLALVEALVLALV  225
              A V     A + L    ++  L  A V+AL   A +  L   ++ AL       AL    V
Sbjct:  703 AQVAVLGSAQLTGLTTTQINTVLTTAQVKALGAAALAGLGTDDIVALTTGQAAALSSTQV  762

Query:  226 EALILALVEALVLADVDALMEALVLADVEALMEALVLADVDALVEA              271
              AL  A + AL   AD    AL   A +       + AL       +DAL   A
Sbjct:  763 AALSTAQISALQTADFAALSTAAIKGLSSTQITALSTGQIDALTTA              808
```

No corresponding DNA sequence was identified in *S. pyogenes*.

Based on this analysis, it was predicted that this protein and its epitopes, could be useful antigens for vaccines or diagnostics.

Example 1309

A DNA sequence (GBSx1389) was identified in *S. agalactiae* <SEQ ID 4009> which encodes the amino acid sequence <SEQ ID 4010>. Analysis of this protein sequence reveals the following:

---
Possible site: 41
>>> Seems to have no N-terminal signal sequence
----- Final Results -----
    bacterial cytoplasm --- Certainty = 0.2297 (Affirmative) <succ>
     bacterial membrane --- Certainty = 0.0000 (Not Clear) <succ>
      bacterial outside --- Certainty = 0.0000 (Not Clear) <succ>
---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1310

A DNA sequence (GBSx1390) was identified in *S. agalactiae* <SEQ ID 4011> which encodes the amino acid sequence <SEQ ID 4012>. This protein is predicted to be fimbriae-associated protein Fap1. Analysis of this protein sequence reveals the following:

---
Possible site: 50
>>> Seems to have no N-terminal signal sequence
----- Final Results -----
    bacterial cytoplasm --- Certainty = 0.3138 (Affirmative) <succ>
     bacterial membrane --- Certainty = 0.0000 (Not Clear) <succ>
      bacterial outside --- Certainty = 0.0000 (Not Clear) <succ>
---

The protein has homology with the following sequences in the GENPEPT database.

```
>GP:BAA97453 GB:AB029393 streptococcal hemagglutinin [Streptococcus gordonii]
Identities = 388/968 (40%), Positives = 518/968 (53%), Gaps = 68/968 (7%)
Query:   13 VDTKSRVKMHKSEKNWVRTVMSHFNLFKAIKGRATVEADVCIQDVEKEDRLSSGNLTYLK   72
              V+  +R K+ KS K+W+R    S F L + +KG        +V     V +E  +  G L YLK
Sbjct:   13 VERVTRFKLIKSGKHWLRAATSQFGLLRLMKGADISSVEV---KVAEEQSVEKGGLNYLK   69

Query:   73 GILAAGALVGGASLTSR-VYADETPVVQEQSSSVPTLAEQTEVTV--KTTTVQNHQDGTV  129
              GI+A GA++GGA +TS  VYA+E   +++    +   LA + E  +   + T   + +
Sbjct:   70 GIIATGAVLGGAVVTSSSVYAEEEQALEKVIDTRDVLATRGEAVLSEEAATTLSSEGANP  129

Query:  130 SKNIIDSNSVSMSESASTSTSESVSMSMSGSTLTSVSESVSTSALTSASESISTSASESV  189
              +++  D+  S  S  SA+  S S  S+S+S   S S        S  S S+S      S+SES  S  S  SV
Sbjct:  130 VESLSDTLSASESASAN-SVSTSISISESFSVSASASLSSSSSLSQSSSESASASESLSV  188

Query:  190 SKSTSISEVSNILETQASLTDKGRESFSANQIVTESSLVTDAGKNASVSSLIEITKPKSE  249
              S STS  S       TQ+S  +      S  S+N + T  S V+       +NA V +        +E
Sbjct:  189 SASTSQSFSSTTSSTQSSNNESLISSDSSNSLNTNQS-VSARNQNARVRTRRAVAANDTE  247

Query:  250 LQTSKMSNESLITPEKSQVMIASDKTGNESLTPTIRLKSVIQPRSMNLMTLSSEMDLIPL  309
                K  +  + E  +   ++ T N       +  ++                  N+    ++   L P
Sbjct:  248 APQVKSGDYVVYRGESFEYY--AEITDNSGQVNRVVIR--------NVEGGANSTYLSPN  297

Query:  310 EEVSDTEMLGKDVSSELQKVNIALKDNTLSEPGTVKLDSSENLVLNFAFSIASVNEGDVF  369
                 TE  LG+   ++   +Q   L+        E    ++  + ++         +A   G+
Sbjct:  298 WVKYSTENLGRPGNATVQN---PLRTRIFGEVPLNEIVNEKSYYTRYI--VAWDPSGN--  350
```

```
-continued
Query: 370  TVKLSDNLDTQGIGTILKVQDIMDETGQLLATGSYSPLTHNITY--------TWTRYAST  421
            ++ DN + G+  +       +E       Y P   ++TY         T  R A
Sbjct: 351  ATQMVDNANRNGLERFVLTVKSQNE--------KYDPAESSVTYVNNLSNLSTSEREAVA  402

Query: 422  LNNIKARVNMPVWPDQRI-------ISKTTSDKQCFTATLNNQVASIE---ERVQYNSPS  471
                 A  N+P  P  +I         ++ T  DK   T    N V ++       S S
Sbjct: 403  AAVRAANPNIP--PTAKITVSQNGTVTITYPDKSTDTIPANRVVKDLQISKSNSASQSSS  460

Query: 472  VTEHTNVKTNVRSRIMKLDDERQTETYITQINPEGKEMYFASGLGNLYTIIGSDGTSGSP  531
            V+     + T+V + I              ++           +  +  ++ S+  S S
Sbjct: 461  VSASQSASTSVSASI---SASMSASVSVSTSASTSASVSASESASTSASVSASESASTS-  516

Query: 532  VNLLNAEVKILKTNSKNLTDSMDQNYDSPEFEDVTSQYSYTNDGSKITIDWKTNSISSTT  591
                 A V    K++S + + S    ++  +          +   S  +  S        + S+S++T
Sbjct: 517  -----ASVSASKSSSTSASVSASESASTSASVSASESASTSASVSASESASTSASVSAST  571

Query: 592  SYVVLVKIPKQSGVLYSTVSDINQTYGSKYSYGHTNISGDSDANAEIKL-LSESASTSAS  650
            S            +         ST + ++ + + S          ++S     A+       + SESASTSAS
Sbjct: 572  SASTSASVSASESA--STSASVSASESASTS---ASVSASESASTSASVSASESASTSAS  626

Query: 651  TSASTSASMSASTSASTSASMSASTSASTSASTSASMSASTSASTSASTSASTSASTSAS  710
              SAS  S+S SAS  SAS  SAS  SAS  SAS  SASTSAS+SASTSASTSAS  SASTSASTSAS
Sbjct: 627  VSASESSSTSASVSASESASTSASVSASESASTSASVSASTSASTSASVSASTSASTSAS  686

Query: 711  MSASTSASTSASTSASTSASTSASMSASTSASTSASTSASMSASTSASTSAS  770
             +SASTSASTSAS  SAS  SASTSAS  SAS  SASTSAS  SASTSASTSAS+SASTSASTSAS
Sbjct: 687  VSASTSASTSASVSASESASTSASVSASESASTSASVSASTSASTSASVSASTSASTSAS  746

Query: 771  TSASTSASMSASTSASTSASTSASMSASTSASTSASTSASMSASTSASTSAS  830
              SAS  SAS  SAS  SASTSASTSAS  SAS  SASTSAS  SAST  ASTSAS+SAS  SASTSAS
Sbjct: 747  VSASESASTSASVSASTSASTSASVSASESASTSASVSASTYASTSASVSASESASTSAS  806

Query: 831  TSASMSASTSASTSASMSASTSASMSASTSASTSASMSASTSASMSASTSAS  890
              SAS  SASTSAS  SAS  SASTSAS  SAS  SASTSAS  SAS  SASTSAS  SAS  SASTSAS
Sbjct: 807  VSASESASTSASVSASTSASTSASVSASESASTSASVSASESASTSASVSASESASTSAS  866

Query: 891  MSATTSASTSVSTSASTSASTSASTSSSSSVTSNSSKEKVYSALPSTGDQDYSVTATALG  950
             +SA+TSASTS  S  SAS  SASTSAS  S+S  S  ++++S      SA     S         +T+
Sbjct: 867  VSASTSASTSASVSASESASTSASVSASESASTSASVSASESASTSASVSASESASTSAS  926

Query: 951  LGLMTGAT  958
            +   T  A+
Sbjct: 927  VSASTSAS  934
```

There is also homology to SEQ ID 760.

SEQ ID 4012 (GBS68) was expressed in *E. coli* as a GST-fusion product. SDS-PAGE analysis of total cell extract is shown in FIG. 33 (lane 4; MW 131.2 kDa).

Figure 153:
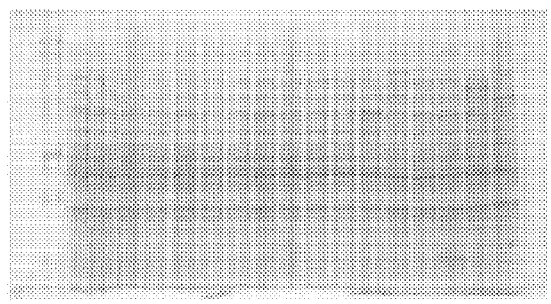

GBS68d was expressed in *E. coli* as a GST-fusion product. SDS-PAGE analysis of total cell extract is shown in FIG. 153 (lane 14; MW 103 kDa) and in FIG. 239 (lane 13; MW 103 kDa). It was also expressed in *E. coli* as a His-fusion product. SDS-PAGE analysis of total cell extract is shown in FIG. 152 (lane 17; MW 78 kDa), in FIG. 153 (lane 17; MW>78 kDa) and in FIG. 184 (lane 10; MW 78 kDa). Purified GBS68d-GST is shown in FIG. 246, lane 5.

Based on this analysis, it was predicted that this protein and its epitopes, could be useful antigens for vaccines or diagnostics.

Example 1311

A DNA sequence (GBSx1391) was identified in *S. agalactiae* <SEQ ID 4013> which encodes the amino acid sequence <SEQ ID 4014>. This protein is predicted to be RofA. Analysis of this protein sequence reveals the following:

Possible site: 30
>>> Seems to have no N-terminal signal sequence
----- Final Results -----
  bacterial cytoplasm --- Certainty = 0.1738 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 10005> which encodes amino acid sequence <SEQ ID 10006> was also identified.

There is also homology to SEQ ID 3750.

Based on this analysis, it was predicted that this protein and its epitopes, could be useful antigens for vaccines or diagnostics.

Example 1312

A DNA sequence (GBSx1392) was identified in *S. agalactiae* <SEQ ID 4015> which encodes the amino acid sequence <SEQ ID 4016>. This protein is predicted to be Nra. Analysis of this protein sequence reveals the following:

Possible site: 16
>>> Seems to have a cleavable N-term signal seq.
----- Final Results -----
  bacterial outside --- Certainty = 0.3000 (Affirmative) <succ>
  bacterial membrane --- Certainty = 0.0000 (Not Clear) <succ>
  bacterial cytoplasm --- Certainty = 0.0000 (Not Clear) <succ>

There is also homology to SEQ ID 3750.

Based on this analysis, it was predicted that this protein and its epitopes, could be useful antigens for vaccines or diagnostics.

Example 1313

A DNA sequence (GBSx1393) was identified in *S. agalactiae* <SEQ ID 4017> which encodes the amino acid sequence <SEQ ID 4018>. Analysis of this protein sequence reveals the following:

Possible site: 19
>>> Seems to have no N-terminal signal sequence
----- Final Results -----
  bacterial cytoplasm --- Certainty = 0.3674 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database.

A related DNA sequence was identified in *S. pyogenes* <SEQ ID 4019> which encodes the amino acid sequence <SEQ ID 4020>. Analysis of this protein sequence reveals the following:

Possible site: 55
>>> Seems to have no N-terminal signal sequence
----- Final Results -----
  bacterial cytoplasm --- Certainty = 0.4386 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
>GP:AAA27020 GB:M80215 uvs402 protein [Streptococcus pneumoniae]
Identities = 577/663 (87%), Positives = 633/663 (95%), Gaps = 1/663 (0%)
Query:     1 MIDRKDTNRFKLVSKYSPSGDQPQAIETLVDNIEGGEKAQILKGATGTGKTYTMSQVIAQ   60
             MI+    N+FKLVSKY PSGDQPQAIE LVDNIEGGEKAQIL GATGTGKTYTMSQVI++
Sbjct:     7 MINHITDNQFKLVSKYQPSGDQPQAIEQLVDNIEGGEKAQILMGATGTGKTYTMSQVISK   66

Query:    61 VNKPTLVIAHNKTLAGQLYGEFKEFFPDNAVEYFVSYYDYYQPEAYVPSSDTYIEKDSSV  120
             VNKPTLVIAHNKTLAGQLYGEFKEFFP+NAVEYFVSYYDYYQPEAYVPSSDTYIEKDSSV
Sbjct:    67 VNKPTLVIAHNKTLAGQLYGEFKEFFPENAVEYFVSYYDYYQPEAYVPSSDTYIEKDSSV  126

Query:   121 NDEIDKLRHSATSSLLERNDVIVVASVSCIYGLGSPKEYADSVVSLRPGQEISRDQLLNN  180
             NDEIDKLRHSATS+LLERNDVIVVASVSCIYGLGSPKEYADSVVSLRPG EISRD+LLN+
Sbjct:   127 NDEIDKLRHSATSALLERNDVIVVASVSCIYGLGSPKEYADSVVSLRPGLEISRDKLLND  186

Query:   181 LVDIQFERNDIDFQRGKFRVRGDVVEVFPASRDEHAFRIEFFGDEIDRIREIESLTGRVL  240
             LVDIQFERNDIDFQRG+FRVRGDVVE+FPASRDEHAFR+EFFGDEIDRIRE+E+LTG+VL
Sbjct:   187 LVDIQFERNDIDFQRGRFRVRGDVVEIFPASRDEHAFRVEFFGDEIDRIREVEALTGQVL  246

Query:   241 GEVEHLAIFPATHFMTNDEHMEEAISKIQAEMENQVELFEKEGKLIEAQRIRQRTEYDIE  300
             GEV+HLAIFPATHF+TND+HME AI+KIQAE+E Q+ +FEKEGKL+EAQR++QRTEYDIE
Sbjct:   247 GEVDHLAIFPATHFVTNDDHMEVAIAKIQAELEEQLAVFEKEGKLLEAQRLKQRTEYDIE  306

Query:   301 MLREMGYTNGVENYSRHMDGRSEGEPPFTLLDFFPEDFLIMIDESHMTMGQIKGMYNGDR  360
             MLREMGYTNGVENYSRHMDGRSEGEPP+TLLDFFP+DFLIMIDESHMTMGQIKGMYNGDR
Sbjct:   307 MLREMGYTNGVENYSRHMDGRSEGEPPYTLLDFFPDDFLIMIDESHMTMGQIKGMYNGDR  366

Query:   361 SRKEMLVNYGFRLPSALDNRPLRREEFESHVHQIVYVSATPGDYEMEQTDTVVEQIIRPT  420
             SRK+MLVNYGFRLPSALDNRPLRREEFESHVHQIVYVSATPGDYE EQT+TV+EQIIRPT
Sbjct:   367 SRKKMLVNYGFRLPSALDNRPLRREEFESHVHQIVYVSATPGDYENEQTETVIEQIIRPT  426

Query:   421 GLLDPEVEVRPSMGQMDDLLGEINLRTEKGERTFITTLTKRMAEDLTDYLKEMGVKVKYM  480
             GLLDPEVEVRP+MGQ+DDLLGEIN R EK ERTFITTLTK+MAEDLTDY KEMG+KVKYM
Sbjct:   427 GLLDPEVEVRPTMGQIDDLLGEINARVEKNERTFITTLTKKMAEDLTDYFKEMGIKVKYM  486

Query:   481 HSDIKTLERTEIIRDLRLGVFDVLIGINLLREGIDVPEVSLVAILDADKEGFLRNERGLI  540
             HSDIKTLERTEIIRDLRLGVFDVL+GINLLREGIDVPEVSLVAILDADKEGFLRNERGLI
Sbjct:   487 HSDIKTLERTEIIRDLRLGVFDVLVGINLLREGIDVPEVSLVAILDADKEGFLRNERGLI  546

Query:   541 QTIGRAARNSNGHVIMYADKITDSMQRAMDETARRRLQMDYNEKHGIVPQTIKKEIRDL   600
             QTIGRAARNS GHVIMYAD +T SMQRA+DETARRR++QM YNE+HGIVPQTIKKEIRDL
Sbjct:   547 QTIGRAARNSEGHVIMYADTVTQSMQRAIDETARRRKIQMAYNEEHGIVPQTIKKEIRDL  606

Query:   601 IAITKSNDSDKPEKVVDYSSLSKKERQAEIKALQQQMQEAAELLDFELAAQIRDVILELK  660
             IA+TK+    ++ +K VD +SL+K+ER+   +K L++QMQEA E+LDFELAAQIRD++LE+K
Sbjct:   607 IAVTKAVAKEE-DKEVDINSLNKQERKELVKKLEKQMQEAVEVLDFELAAQIRDMMLEVK  665

Query:   661 AID                                                           663
             A+D
Sbjct:   666 ALD                                                           668
```

```
Identities = 570/663 (85%), Positives = 625/663 (93%)
Query:   1  MIDRKDTNRFKLVSKYSPSGDQPQAIETLVDNIEGGEKAQILKGATGTGKTYTMSQVIAQ   60
            MID++D   FKL SKY PSGDQPQAIE+LVDNIEGGEKAQIL GATGTGKTYTMSQVI++
Sbjct:   1  MIDKRDDKPFKLKSKYKPSGDQPQAIESLVDNIEGGEKAQILLGATGTGKTYTMSQVISK   60

Query:  61  VNKPTLVIAHNKTLAGQLYGEFKEFFPDNAVEYFVSYYDYYQPEAYVPSSDTYIEKDSSV  120
            VNKPTLVIAHNKTLAGQLYGEFKEFFPDNAVEYFVSYYDYYQPEAYVPSSDTYIEKDSSV
Sbjct:  61  VNKPTLVIAHNKTLAGQLYGEFKEFFPDNAVEYFVSYYDYYQPEAYVPSSDTYIEKDSSV  120

Query: 121  NDEIDKLRHSATSSLLERNDVIVVASVSCIYGLGSPKEYADSVVSLRPGQEISRDQLLNN  180
            NDEIDKLRHSATSSLLERNDVIVVASVSCIYGLGSPKEYADS VSLRPGQEISRD LLN
Sbjct: 121  NDEIDKLRHSATSSLLERNDVIVVASVSCIYGLGSPKEYADSAVSLRPGQEISRDTLLNQ  180

Query: 181  LVDIQFERNDIDFQRGKFRVRGDVVEVFPASRDEHAFRIEFFGDEIDRIREIESLTGRVL  240
            LVDIQFERNDIDFQRG FRVRGDVVEVFPASRDEHAFR+EFFGDEIDRI EIESLTG+ +
Sbjct: 181  LVDIQFERNDIDFQRGCFRVRGDVVEVFPASRDEHAFRVEFFGDEIDRICEIESLTGKTI  240

Query: 241  GEVEHLAIFPATHFMTNDEHMEEAISKIQAEMENQVELFEKEGKLIEAQRIRQRTEYDIE  300
            GEV+HL +FPATHF+TNDEHME++I+KIQAE+  Q++LFE EGKL+EAQR+RQRTEYDIE
Sbjct: 241  GEVDHLVLFPATHFVTNDEHMEQSIAKIQAELAEQLQLFESEGKLLEAQRLRQRTEYDIE  300

Query: 301  MLREMGYTNGVENYSRHMDGRSEGEPPFTLLDFFPEDFLIMIDESHMTMGQIKGMYNGDR  360
            MLREMGYT+GVENYSRHMDGRS GEPP+TLLDFFPEDFLIMIDESHMTMGQIKGMYNGD+
Sbjct: 301  MLREMGYTSGVENYSRHMDGRSPGEPPYTLLDFFPEDFLIMIDESHMTMGQIKGMYNGDQ  360

Query: 361  SRKEMLVNYGFRLPSALDNRPLRREEFESHVHQIVYVSATPGDYEMEQTDTVVEQIIRPT  420
            +RK+MLV+YGFRLPSALDNRPLRREEFESHVHQIVYVSATPG+YEM QT+T++EQIIRPT
Sbjct: 361  ARKQMLVDYGFRLPSALDNRPLRREEFESHVHQIVYVSATPGEYEMSQTNTIIEQIIRPT  420

Query: 421  GLLDPEVEVRPSMGQMDDLLGEINLRTEKGERTFITTLTKRMAEDLTDYLKEMGVKVKYM  480
            GLLDPE++VR SMGQMDDLLGEIN R  + ERTFITTLTK+MAEDLTDYLKEMGVKVKYM
Sbjct: 421  GLLDPEIDVRSSMGQMDDLLGEINQRVARDERTFITTLTKKMAEDLTDYLKEMGVKVKYM  480

Query: 481  HSDIKTLERTEIIRDLRLGVFDVLIGINLLREGIDVPEVSLVAILDADKEGFLRNERGLI  540
            HSDIKTLERTEIIRDLRLGVFDVLIGINLLREGIDVPEVSLVAILDADKEGFLRNERGLI
Sbjct: 481  HSDIKTLERTEIIRDLRLGVFDVLIGINLLREGIDVPEVSLVAILDADKEGFLRNERGLI  540

Query: 541  QTIGRAARNSNGHVIMYADKITDSMQRAMDETARRRLQMDYNEKHGIVPQTIKKEIRDL  600
            QTIGRAARN +GHVIMYADK+TDSMQRA+DETARRR +Q+ YN+ HGIVPQTIKK+IR L
Sbjct: 541  QTIGRAARNVDGHVIMYADKMTDSMQRAIDETARRREIQIAYNKAHGIVPQTIKKDIRGL  600

Query: 601  IAITKSNDSDKPEKVVDYSSLSKKERQAEIKALQQQMQEAAELLDFELAAQIRDVILELK  660
            I+I+K++ +D   ++ +DY S+S+ ER+  I ALQ+QMQEAAELLDFELAAQ+RD+ILELK
Sbjct: 601  ISISKTSHNDISKEEMDYESMSRGERKEAINALQKQMQEAAELLDFELAAQMRDLILELK  660

Query: 661  AID  663
            +D
Sbjct: 661  LMD  663
```

Based on this analysis, it was predicted that these proteins and their epitopes could be useful antigens for vaccines or diagnostics.

Example 1314

A DNA sequence (GBSx1394) was identified in *S. agalactiae* <SEQ ID 4021> which encodes the amino acid sequence <SEQ ID 4022>. Analysis of this protein sequence reveals the following:

Possible site: 31
>>> Seems to have no N-terminal signal sequence

| | | |
|---|---|---|
| INTEGRAL | Likelihood = −11.78 | Transmembrane 284-300 (274-303) |
| INTEGRAL | Likelihood = −10.08 | Transmembrane 20-36 (16-53) |
| INTEGRAL | Likelihood = −5.52 | Transmembrane 117-133 (114-137) |
| INTEGRAL | Likelihood = −5.15 | Transmembrane 203-219 (201-225) |
| INTEGRAL | Likelihood = −3.29 | Transmembrane 183-199 (182-200) |
| INTEGRAL | Likelihood = −1.54 | Transmembrane 74-90 (73-90) |
| INTEGRAL | Likelihood = −0.48 | Transmembrane 37-53 (37-53) |

----- Final Results -----
bacterial membrane --- Certainty = 0.5713 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the GENPEPT database.

```
>GP:CAA22372 GB:AL034446 putative transmembrane protein
[Streptomyces coelicolor A3(2)]
Identities = 58/190 (30%), Positives = 96/190 (50%), Gaps = 11/190 (5%)
Query: 114  GWS--IGFILFSISVITAYILGGLDFHSYDVSK-ATIFYVVTLLPFWLIQSGTEELLTRG  170
            GW   IGF LF +VIT    G     Y+V   ++   + L+ F   + TEE++ RG
Sbjct:  98  GWGTLIGFGLFG-AVITNLFASGY----YEVDGLGSVQGAIGLVGFMAAAAATEEVVFRG  152

Query: 171  WLLPLINHRFHLAVAIGVSSTLFGILHLVNAHVTFLSIVSI-ICSGVLMSLYMIKSGNIW  229
                L  +I    +A+G++  +FG++HL+N  T   ++I I +G +++    + N+W
Sbjct: 153  VLFRIIEEHIGTYLALGLTGLVFGLMHLLNEDATLWGALAIAIEAGFMLAAAYAATRNLW  212
```

-continued

```
Query:  230 SVAALHGAWNFSQGNLYGIAVSGQKAGASLLHFTVKENAPDWISGGAFGIEGSLISIFVL  289
                +H  WNF+ G ++   VSG      LL  T+  + P  ++GG FG EGS+ S+
Sbjct:  213 LTIGVHFGWNFAAGGVFSTVVSGNGDSEGLLDATM--SGPKLLTGGDFGPEGSVYSVGFG  270

Query:  290 LAAIIYLLWL  299
             +   +  LWL
Sbjct:  271 VLLTLVFLWL  280
```

No corresponding DNA sequence was identified in *S. pyogenes*.

Based on this analysis, it was predicted that this protein and its epitopes, could be useful antigens for vaccines or diagnostics.

Example 1315

A DNA sequence (GBSx1395) was identified in *S. agalactiae* <SEQ ID 4023> which encodes the amino acid sequence <SEQ ID 4024>. This protein is predicted to be glutamine-binding periplasmic protein/glutamine transport system perme. Analysis of this protein sequence reveals the following:

---

Possible site: 20
>>> Seems to have a cleavable N-term signal seq.
INTEGRAL    Likelihood = −8.97    Transmembrane 532-548 (523-553)
INTEGRAL    Likelihood = −7.38    Transmembrane 700-716 (696-720)
INTEGRAL    Likelihood = −4.57    Transmembrane 562-578 (558-588)
INTEGRAL    Likelihood = −0.32    Transmembrane 665-681 (665-681)
----- Final Results -----
   bacterial membrane --- Certainty = 0.4588 (Affirmative) <succ>
   bacterial outside --- Certainty = 0.0000 (Not Clear) <succ>
      bacterial cytoplasm --- Certainty = 0.0000 (Not Clear) <succ>

---

The protein has homology with the following sequences in the GENPEPT database.

There is also homology to SEQ ID 1198.

A further related DNA sequence was identified in *S. pyogenes* <SEQ ID 9071> which encodes amino acid sequence <SEQ ID 9072>. Analysis of this protein sequence reveals the following:

---

Possible site: 21
>>> May be a lipoprotein
----- Final Results -----
   bacterial membrane --- Certainty = 0.0000 (Not Clear) <succ>
   bacterial outside --- Certainty = 0.0000 (Not Clear) <succ>
      bacterial cytoplasm --- Certainty = 0.0000 (Not Clear) <succ>

---

```
>GP:AAF16724 GB:AF141644 putative integral membrane protein
[Lactococcus lactis]
Identities = 109/195 (55%), Positives = 156/195 (79%), Gaps = 4/195 (2%)
Query:  466 KMFNNGLASLKKSGEYDKLVKKYLSTASTSSNDKAAKPVDESTILGLISNNYKQLLSGIG  525
            +MFNNGLA+L+ +GEYDK++ KYL++  T +   +AK    E+T  G++ NN++Q+  G+
Sbjct:    1 EMFNNGLANLRANGEYDKIIDKYLAS-DTKTIQSSAK---ENTFFGILQNNWEQIGRGLL   56

Query:  526 TTLSLTLISFAIAMVIGIIFGMMSVSPSNTLRTISMIFVDIVRGIPLMIVAAFIFWGIPN  585
             TL L ++SF +AM++GIIFG+ SV+PS  LRTI+  I+VD+ R IPL+++  FIF+GIPN
Sbjct:   57 VTLELAVLSFILAMIVGIIFGLFSVAPSKILRTIARIYVDLNRSIPLLVLTIFIFYGIPN  116

Query:  586 LIESITGHQSPINDFVAATIALSLNGGAYIAEIVRGGIEAVPSGQMEASRSLGISYGKTM  645
            L++ ITGHQSP+N+F A  IAL+LN  AYIAEIVR G++AVPSGQMEASRSLG++Y  +M
Sbjct:  117 LLQIITGHQSPLNEFTAGVIALTLNSSAYIAEIVRSGVQAVPSGQMEASRSLGVTYLTSM  176

Query:  646 QKVILPQAVRLMLPN  660
            +KVILPQA+++ +P+
Sbjct:  177 RKVILPQAIKITIPS  191
```

An alignment of the GAS and GBS sequences follows:

```
Score = 80.8 bits (196), Expect = 2e-17
Identities = 64/233 (27%), Positives = 113/233 (48%), Gaps = 13/233 (5%)
Query:   34 IKKTRKLVVAVSPDYAPFEFKALVNGKDTIVGADVQLAQAIADELDVDLELSPMSFDNVL   93
            +K + K+V   S  +APFE++   NGK    G D++L + IA +     L++S  FD  L
Sbjct:  268 VKPSYKIVSDSS--FAPFEYQ---NGKGKYTGFDMELIKKIAKQQGFKLDISNPGFDAAL  322

Query:   94 SSLQTGKADLAISGISHTKERAKVYDFSIPYYQAENAIVMRASDAKVTKNISDLNGKKVA  153
            +++Q+G+AD   I+G + T+ R K++DFS PYY      +++        K+  DL GK V
Sbjct:  323 NAVQSGQADGVIAGATITEARQKIFDFSDPYY--TSSVILAVKKGSNVKSYQDLKGKTVG  380

Query:  154 AQKGSIEEGLVKIQLPKANLISLTAMGEA---INELKAGQVYAVTLEAPVAAGFLAQHKD  210
```

-continued

```
                A+ G+      +     K N   + A  EA    + + +G + A+   +  V A  + Q +
Sbjct:  381  AKNGTASYTWLSDHADKYN-YHVKAFDEASTMYDSMNSGSIDALMDDEAVLAYAINQGRK  439

Query:  211  LALAPFSLKTSDGDAKAVALPKNSGDLTKAVNKVIAKLDEQERYKSFIAETIA         263
                P   + S GD              + +L K N  +A L +    Y    + + ++
Sbjct:  440  FE-TPIKGEKS-GDIGFAVKKGANPELIKMFNNGLASLKKSGEYDKLVKKYLS         490

Score = 74.5 bits (180), Expect = 1e-15
Identities = 59/215 (27%), Positives = 102/215 (47%), Gaps = 12/215 (5%)
Query:   48  YAPFEFKALVNGKDTIVGADVQLAQAIADELDVDLELSPMSFDNVLSSLQTGKADLAISG  107
             YAPFEFK    +    T  G DV +    +A        ++ ++    FD  ++++Q+G+AD  ++G
Sbjct:   36  YAPFEFK---DSDQTYKGIDVDIVNEVAKRAGWNVNMTYPGFDAAVNAVQSGQADALMAG   92

Query:  108  ISHTKERAKVYDFSIPYYQAENAIVMRASDAKVTKNISDLNGKKVAAQKGSIEEGLVKIQ  167
               + T+ R  KV++FS   YY     + I+    ++ KVT N     L  GK V   + G+  +  ++
Sbjct:   93  TTVTEARKKVFNFSDTYYDT-SVILYTKNNNKVT-NYKQLKGKVVGVKNGTAAQSFLEEN  150

Query:  168  LPKANLISLTAMGEAI--NELKAGQVYAVTLEAPVAAGFLAQHKDLALAPFSLKTSDGDA  225
                K      T    +   N  L +G  +YA    + PV     + Q K  A+    +++       +
Sbjct:  151  KSKYGYKVKTFDTSDLMNNSLDSGSIYAAMDDQPVVQFAINQGKAYAI---NMEGEAVGS  207

Query:  226  KAVALPKNSG--DLTKAVNKVIAKLDEQERYKSFI                           258
               A A+ K SG    +L K N     A++       Y   +
Sbjct:  208  FAFAVKKGSGHDNLIKEFNTAFAQMKSDGTYNDIM                           242
```

SEQ ID 4024 (GBS154) was expressed in *E. coli* as a His-fusion product. The purified protein is shown in FIG. 199, lane 6.

Based on this analysis, it was predicted that these proteins and their epitopes could be useful antigens for vaccines or diagnostics.

Example 1316

A DNA sequence (GBSx1396) was identified in *S. agalactiae* <SEQ ID 4025> which encodes the amino acid sequence <SEQ ID 4026>. This protein is predicted to be amino acid ABC transporter, ATP-binding protein (glnQ). Analysis of this protein sequence reveals the following:

Possible site: 60
>>> Seems to have no N-terminal signal sequence
----- Final Results -----
   bacterial cytoplasm --- Certainty = 0.4183 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

A related DNA sequence was identified in *S. pyogenes* <SEQ ID 4027> which encodes the amino acid sequence <SEQ ID 4028>. Analysis of this protein sequence reveals the following:

Possible site: 60
>>> Seems to have no N-terminal signal sequence
----- Final Results -----
   bacterial cytoplasm --- Certainty = 0.4149 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the databases:

```
>GP:AAB90561 GB:AE001058 glutamine ABC transporter, ATP-binding
protein (glnQ) [Archaeoglobus fulgidus]
Identities = 147/240 (61%), Positives = 192/240 (79%)
Query:    5  KIDVQDLHKSYGQNEVLKGIDAKFYEGDVVCIIGPSGSGKSTFLRTLNLLESITSGKVVV   64
             ++++ DLHK +G+ EVLKG+    K  +G+VV IIGPSGSGKST LR  +N LE   TSGK+++
Sbjct:    3  QLEIIDLHKRFGELEVLKGVTMKVEKGEVVVIIGPSGSGKSTLLRCINRLEEPTSGKILL   62

Query:   65  DGFELSNPKTDIDKARENIGMVFQHFNLFPHMSVLENITFAPIELGKESKEAAEKHGMEL  124
             DG +++N K  DI+K R+   IG+VFQ  FNLFPH++   L+N+T API++     K SK     AE+ GM L
Sbjct:   63  DGVDITNSKIDINKVRQRIGIVFQQFNLFPHLTALQNVTLAPIKIKKMSKREAEELGMRL  122

Query:  125  LEKVGLADKANAKPDSLSGGQKQRVAIARSLAMNPDILLFDEPTSALDPEMVGDVLNVMK  184
             LEKVGL  DKA+   P   LSGGQ+QRVAIAR+LAMNP+++LFDE  TSALDPE+V  +VL+VMK
Sbjct:  123  LEKVGLEDKADYYPAQLSGGQQQRVAIARALAMNPEVMLFDEVTSALDPELVKEVLDVMK  182

Query:  185  DLAEQGMTMLIVTHEMGFARQVANRVIFTDGGRFLEDGTPEQIFDTPQHPRLQDFLNKVL  244
                 LA    GMTM++VTHEMGFAR V  +RVIF  DGG   +E+G PEQIF    P+H R  +  FL+  +L
Sbjct:  183  QLARDGMTMVVVTHEMGFAREVGDRVIFMDGGVIVEEGKPEQIFSNPKHERTRKFLSMIL  242
```

```
>GP:BAB05180 GB:AP001512 ABC transporter (substrate-binding protein)
[Bacillus halodurans]
Identities = 79/227 (34%), Positives = 126/227 (54%), Gaps = 10/227 (4%)
Query:  35 KKTRKLVVAVSPDYAPFEFKALVNGKDTIVGADVQLAQAIADELDVDLELSPMSFDNVLS   94
            +K   LV+  S DY P+E     G+  IVG DV +A+ I   EL  +L++  M F+ ++
Sbjct:  48 EKKSVLVMGTSADYPPYESVDVTTGE--IVGFDVDIAEYITSELGYELKIQDMDFNGIIP  105

Query:  95 SLQTGKADLAISGISHTKERAKVYDFSIPYYQAENAIVMRASDAKVTKNISDLNGKKVAA  154
            +LQ G+ D A+SG++  T+ER K   DFS   YY A+N +V +  D    ++ DL GK  V
Sbjct: 106 ALQAGRVDFALSGMTPTEERKKSVDFSDVYYDAQNLVVFKEEDG--LSSVEDLAGKTVGV  163

Query: 155 QKGSI-EEGLVKIQ--LPKANLISLTAMGEAINELKAGQVYAVTLEAPVAAGFLAQHKDL  211
            Q  SI EE  V++Q  L    + +   + E + EL AG+V A+ +E  VAAG L  +
Sbjct: 164 QLASIQEEAAVELQEELDGLTIETRNRVPELVQELLAGRVDALIIEDTVAAGHLEANP--  221

Query: 212 ALAPFSLKTSDGDAKAVALPKNSGDLTKAVNKVIAKLDEQERYKSFI              258
             L  F++++      A+A PK+S +LT+  N+ + + ++ E   + I
Sbjct: 222 GLVRFAIESEGETGSAIAFPKDS-ELTEPFNEKLQEMMEDGTMEELI              267
```

An alignment of the GAS and GBS proteins is shown below.

```
Identities = 223/246 (90%), Positives = 238/246 (96%)
Query:   1 MAELKIDVQDLHKSYGQNEVLKGIDAKFYEGDVVCIIGPSGSGKSTFLRTLNLLESITSG   60
            M ELKIDVQDLHKSYGQNEVLKGIDAKFYEGDVVCIIGPSGSGKSTFLRTLNLLE+ITSG
Sbjct:   1 MTELKIDVQDLHKSYGQNEVLKGIDAKFYEGDVVCIIGPSGSGKSTFLRTLNLLETITSG   60

Query:  61 KVVVDGFELSNPKTDIDKARENIGMVFQHFNLFPHMSVLENITFAPIELGKESKEAAEKH  120
            KV+VDGFELS+PKT+IDKARENIGMVFQHFNLFPHM+VLENI FAP+ELGKESKE A+KH
Sbjct:  61 KVMVDGFELSDPKTNIDKARENIGMVFQHFNLFPHMTVLENIIFAPVELGKESKEVAKKH  120

Query: 121 GMELLEKVGLADKANAKPDSLSGGQKQRVAIARSLAMNPDILLFDEPTSALDPEMVGDVL  180
            GM LLEKVGL+DKA+A P SLSGGQKQRVAIARSLAMNPDI+LFDEPTSALDPEMVGDVL
Sbjct: 121 GMALLEKVGLSDKADAFPGSLSGGQKQRVAIARSLAMNPDIMLFDEPTSALDPEMVGDVL  180

Query: 181 NVMKDLAEQGMTMLIVTHEMGFARQVANRVIFTDGGRFLEDGTPEQIFDTPQHPRLQDFL  240
            NVMKDLAEQGMTMLIVTHEMGFARQVANRVIFTDGG+FLEDGTPE+IFD P+HPRL +FL
Sbjct: 181 NVMKDLAEQGMTMLIVTHEMGFARQVANRVIFTDGGQFLEDGTPEEIFDHPKHPRLIEFL  240

Query: 241 NKVLNV                                                       246
            +KVLNV
Sbjct: 241 DKVLNV                                                       246
```

Based on this analysis, it was predicted that these proteins and their epitopes could be useful antigens for vaccines or diagnostics.

Example 1317

A DNA sequence (GBSx1397) was identified in *S. agalactiae* <SEQ ID 4029> which encodes the amino acid sequence <SEQ ID 4030>. Analysis of this protein sequence reveals the following:

Possible site: 18
>>> Seems to have no N-terminal signal sequence
----- Final Results -----
  bacterial cytoplasm --- Certainty = 0.2311 (Affirmative) <succ>
   bacterial membrane --- Certainty = 0.0000 (Not Clear) <succ>
    bacterial outside --- Certainty = 0.0000 (Not Clear) <succ>

The protein has no significant homology with any sequences in the GENPEPT database.

A related DNA sequence was identified in *S. pyogenes* <SEQ ID 4031> which encodes the amino acid sequence <SEQ ID 4032>. Analysis of this protein sequence reveals the following:

Possible site: 28
>>> Seems to have no N-terminal signal sequence
----- Final Results -----
  bacterial cytoplasm --- Certainty = 0.2702 (Affirmative) <succ>
   bacterial membrane --- Certainty = 0.0000 (Not Clear) <succ>
    bacterial outside --- Certainty = 0.0000 (Not Clear) <succ>

An alignment of the GAS and GBS proteins is shown below.

```
Identities = 45/51 (88%), Positives = 49/51 (95%)
Query:   1 MGDKPISFRDKDGNFVSAADVWNAEKLEELFNTLNPNRKLRLEREKLAKEK   51
            MGDKPISF+DKDGNFVSAADVWNAEKLEELFN LNPNR+LRLEREKL K++
Sbjct:  11 MGDKPISFKDKDGNFVSAADVWNAEKLEELFNLLNPNRRLRLEREKLKKDE   61
```

2279

Based on this analysis, it was predicted that these proteins and their epitopes could be useful antigens for vaccines or diagnostics.

Example 1318

A DNA sequence (GBSx1398) was identified in *S. agalactiae* <SEQ ID 4033> which encodes the amino acid sequence <SEQ ID 4034>. This protein is predicted to be spo0b-associated GTP-binding protein (obg). Analysis of this protein sequence reveals the following:

Possible site 14
>>> Seems to have no N-terminal signal sequence
----- Final Results -----
   bacterial cytoplasm --- Certainty = 0.2967 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

2280

A related DNA sequence was identified in *S. pyogenes* <SEQ ID 4035> which encodes the amino acid sequence <SEQ ID 4036>. Analysis of this protein sequence reveals the following:

Possible site: 14
>>> Seems to have no N-terminal signal sequence
----- Final Results -----
   bacterial cytoplasm --- Certainty = 0.2588 (Affirmative) <succ>
   bacterial membrane --- Certainty = 0.0000 (Not Clear) <succ>
   bacterial outside --- Certainty = 0.0000 (Not Clear) <succ>

```
>GP:CAB14752 GB:Z99118 GTPase activity [Bacillus subtilis]
Identities = 297/435 (68%), Positives = 345/435 (79%), Gaps = 7/435 (1%)
Query:     3  MFLDTAKISVKAGRGGDGMVAFRREKYVPNGGPWGGDGGKGGSVIFKVNEGLRTLMDFRY    62
              MF+D  K+ VK G GG+GMVAFRREKYVP GGP GGDGGKGG V+F+V+EGLRTLMDFRY
Sbjct:     1  MFVDQVKVYVKGGDGGNGMVAFRREKYVPKGGPAGGDGGKGGDVVFEVDEGLRTLMDFRY    60

Query:    63  NRNFKAKAGEKGMTKGMHGRGAEDLIVSLPPGTTVRDATTGKVITDLVEHDQEFVVARGG   122
              ++FKA  GE GM+K  HGR A+D+++ +PPGT V D  T +VI DL EH Q  V+ARGG
Sbjct:    61  KKHFKAIRGEHGMSKNQHGRNADDMVIKVPPGTVVTDDDTKQVIADLTEHGQRAVIARGG   120

Query:   123  RGGRGNIRFATPRNPAPEIAENGEPGEERELQLELKILADVGLVGFPSVGKSTLLSVVSA   182
              RGGRGN RFATP NPAP+++ENGEPG+ER + LELK+LADVGLVGFPSVGKSTLLSVVS+
Sbjct:   121  RGGRGNSRFATPANPAPQLSENGEPGKERYIVLELKVLADVGLVGYPSVGKSTLLSVVSS   180

Query:   183  AKPKIGAYHFTTIVPNLGMVRTKSGDSFAMADLPGLIEGASQGVGLGTQFLRHIERTRVI   242
              AKPKI  YHFTT+VPNLGMV T  G SF MADLPGLIEGA QGVGLG QFLRHIERTRVI
Sbjct:   181  AKPKIADYHFTTLVPNLGMVETDDGRSFVNADLPGLIEGAHQGVGLGHQFLRHIERTRVI   240

Query:   243  LHVIDMSASEGRDPYDDYVSINNELETYNLRLMERPQIIVANKMDMPDSEENLAAFKEKL   302
              +HVIDMS  EGRDPYDDY++IN EL  YNLRL ERPQIIVANKMDMP++ ENL AFKEKL
Sbjct:   241  VHVIDMSGLEGRDPYDDYLTINQELSEYNLRLTERPQIIVANKMDMPEAAENLEAFKEKL   300

Query:   303  AANYDEFDDMPMIFPISSLAHQGLENLMDATAELLANTEEFLLYDETDMQEDEAYYGENE   362
                        DD P +FPIS++  +GL  L+    A  L NT EF LYDE ++ ++    Y
Sbjct:   301  T------DDYP-VFPISAVTREGLRELLFEVANQLENTPEFPLYDEEELTQNRVMYTMEN   353

Query:   363  DERPFEITRDDDATWVLYGDKLEKLFVMTNMERDESIMKFARQLRGMGVDEALRERGAKD   422
              +E PF ITRD D  +VL GD LE+LF MT+  RDES+ +FARQ+RGMGVDEALRERGAKD
Sbjct:   354  EEVPFNITRDPDGVFVLSGDSLERLFKMTDFSRDESVKRFARQMRGMGVDEALRERGAKD   413

Query:   423  GDIVRIGNFEFEFVD                                               437
              GDI+R+  FEFEF+D
Sbjct:   414  GDIIRLLEFEFEFID                                               428
```

An alignment of the GAS and GBS proteins is shown below.

```
Identities = 394/437 (90%), Positives = 421/437 (96%)
Query:     1  MSMFLDTAKISVKAGRGGDGMVAFRREKYVPNGGPWGGDGGKGGSVIFKVNEGLRTLMDF    60
              MSMFLDTAKISV+AGRGGDGMVAFRREKYVPNGGPWGGDGGKGGSVIF+V+EGLRTLMDF
Sbjct:     1  MSMFLDTAKISVQAGRGGDGMVAFRREKYVPNGGPWGGDGGKGGSVIFRVDEGLRTLMDF    60

Query:    61  RYNRNFKAKAGEKGMTKGMHGRGAEDLIVSLPPGTTVRDATTGKVITDLVEHDQEFVVAR   120
              RYNR FKAK+GEKGMTKGMHGRGAEDLIV +P GTTVRDA TGKVITDLVEH QE V+A+
Sbjct:    61  RYNRKFKAKSGEKGMTKGMHGRGAEDLIVFVPQGTTVRDAETGKVITDLVEHGQEVVIAK   120

Query:   121  GGRGGRGNIRFATPRNPAPEIAENGEPGEERELQLELKILADVGLVGFPSVGKSTLLSVV   180
              GGRGGRGNIRFATPRNPAPEIAENGEPGEER+L+LELKILADVGLVGFPSVGKSTLLSVV
```

-continued

```
Sbjct: 121  GGRGGRGNIRFATPRNPAPEIAENGEPGEERQLELELKILADVGLVGFPSVGKSTLLSVV   180

Query: 181  SAAKPKIGAYHFTTIVPNLGMVRTKSGDSFAMADLPGLIEGASQGVGLGTQFLRHIERTR   240
            S+AKPKIGAYHFTTIVPNLGMVRTKSGDSFAMADLPGLIEGASQGVGLGTQFLRHIERTR
Sbjct: 181  SSAKPKIGAYHFTTIVPNLGMVRTKSGDSFAMADLPGLIEGASQGVGLGTQFLRHIERTR   240

Query: 241  VILHVIDMSASEGRDPYDDYVSINNELETYNLRLMERPQIIVANKMDMPDSEENLAAFKE   300
            VILHVIDMSASEGRDPY+DYVSINNELETYNLRLMERPQIIVANKMD+P+++ENL AFK+
Sbjct: 241  VILHVIDMSASEGRDPYEDYVSINNELETYNLRLMERPQIIVANKMDIPEAQENLKAFKK   300

Query: 301  KLAANYDEFDDMPMIFPISSLAHQGLENLMDATAELLANTEEFLLYDETDMQEDEAYYGF   360
            KLAA YDEFDD+PMIFPISSLAHQGLENL++ATAELLA T+EFLLYDE+D+ ++EAYYGF
Sbjct: 301  KLAAQYDEFDDLPMIFPISSLAHQGLENLLEATAELLAKTDEFLLYDESDLVDEEAYYGF   360

Query: 361  NEDERPFEITRDDDATWVLYGDKLEKLFVMTNMERDESIMKFARQLRGMGVDEALRERGA   420
             E E+ FEITRDDDATWVL G+KLE+LFVNTNMERDESINKFARQLRGMGVDEALRERGA
Sbjct: 361  AETEKDFEITRDDDATWVLSGEKLERLFVMTNMERDESIMKFARQLRGMGVDEALRERGA   420

Query: 421  KDGDIVRIGNFEFEFVD                                              437
            KDGD VRIG FEFEFVD
Sbjct: 421  KDGDPVRIGKFEFEFVD                                              437
```

Based on this analysis, it was predicted that these proteins and their epitopes could be useful antigens for vaccines or diagnostics.

Example 1319

A DNA sequence (GBSx1399) was identified in *S. agalactiae* <SEQ ID 4037> which encodes the amino acid sequence <SEQ ID 4038>. Analysis of this protein sequence reveals the following:

```
Possible site: 36
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>
```

The protein has no significant homology with any sequences in the GENPEPT database.

A related DNA sequence was identified in *S. pyogenes* <SEQ ID 4039> which encodes the amino acid sequence <SEQ ID 4040>. Analysis of this protein sequence reveals the following:

```
Possible site: 39
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>
```

An alignment of the GAS and GBS proteins is shown below.

```
Identities = 30/42 (71%), Positives = 37/42 (87%)

Query: 1    MAFGDNGQRKKTGFEKLTLFVVILMVLVTVGGLVFGAISAIM     42
            +AFG+NG RKKT FEK+T+FVVILMVLVTVGGL+  A+S +M Sbjct: 1    VAFGENGPRKKTTFEKVTMFVVILMVLVTVGGLIASALSVLM     42
```

Based on this analysis, it was predicted that these proteins and their epitopes could be useful antigens for vaccines or diagnostics.

Example 1320

A DNA sequence (GBSx1401) was identified in *S. agalactiae* <SEQ ID 4041> which encodes the amino acid sequence <SEQ ID 4042>. Analysis of this protein sequence reveals the following:

```
Possible site: 48
>>> Seems to have no N-terminal signal sequence
----- Final Results -----
   bacterial cytoplasm --- Certainty = 0.2484 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database.

```
>GP:AAD28348 GB:AF102860 aminopeptidase PepS [Streptococcus hermophilus]
Identities = 247/413 (59%), Positives = 313/413 (74%)
Query:   1  MVLQDFDNLLKKYAQLIISKGLNVQKGHTLALTIDVEQVHLARLLTEAAYEKGASEVIVD      60
            MVL +F    L+KYA+L+++ G+NVQ GHT+AL+IDVEQ  LA LL  +AY  GA+EVIV
Sbjct:   1  MVLPNFKENLEKYAKLLVTNGINVQPGHTVALSIDVEQAELAHLLVKEAYALGAAEVIVQ     60

Query:  61  YTDDFITRQRLLHASDEVLTNVPQYTVDKSLALLNKKASRLVVKSSNPNAFATVDPKRLS    120
            ++DD I R+R LHA     + VP Y +   LL KKASRL V+SS+P+AF  V P+RLS
Sbjct:  61  WSDDTINRERFLHAEMNRIEEVPAYKKAEMEYLLEKKASRLGVRSSDPDAFNGVAPERLS    120

Query: 121  ETTRATAIALEEQSRAIQANKVSWNVAAAAGREWAALVFPELKTSDQQVDALWDTIFKLN    180
              +A   A +     A Q+NKVSW VAAAAG+EWA  VFP    + ++ VD LW+ IFK
Sbjct: 121  AHAKAIGAAFKPMQVATQSNKVSWTVAAAAGKEWAKKVFPNASSDEEAVDLLWNQIFKTC    180

Query: 181  RIYEDDPIAAWDAHEAKLLEKATRLNQEQFDALHYTAPGTDLTLGMPKNHIWEAAGSLNA    240
            R+YE DP+ AW  H  +L  KA  LN+ QF ALHYTAPGTDLTLG+PKNH+WE+AG++NA
Sbjct: 181  RVYEKDPVRAWKEHADRLDAKARILNEAQFSALHYTAPGTDLTLGLPKNHVWESAGAINA    240

Query: 241  QGETFIANMPTEEIFSAPDYRRADGYVTSTKPLSYAGVIIENMTFTFKDGKIINVTAEKG    300
            QGE+F+ NMPTEE+F+APD+RRA GYV+STKPLSY G IIE +   TFKDG+I+++TA++G
Sbjct: 241  QGESFLPNMPTEEVFTAPDFRRAYGYVSSTKPLSYNGNIIEGIKVTFKDGEIVDITADQG    300

Query: 301  QETVQRLIEENDGARSLGEVALVPHKTPISLSGLIFFNTLFDENASNHLAIGTAYAFNVE    360
             ++ ++ L+  N+GAR+LGE ALVP  +PIS SG+ FFNTLFDENASNHLAIG AYA +VE
Sbjct: 301  EKVMKNLVFNNNGARALGECALVPDSSPISQSGITFFNTLFDENASNHLAIGAAYATSVE    360

Query: 361  GGTEMTSQELDEAGLNRSSTHVDFMIGSEQMDIDGIRADGTAVPIFRNGEWAI          413
            GG +MT +EL  AGLNRS  HVDF+IGS QM+IDGI  DG+ VPIFRNG+W I
Sbjct: 361  GGADMTEEELKAAGLNRSDVHVDFIIGSNQMNIDGIHHDGSRVPIERNGDWVI          413
```

No corresponding DNA sequence was identified in *S. pyogenes*.

Based on this analysis, it was predicted that this protein and its epitopes, could be useful antigens for vaccines or diagnostics.

Example 1321

A DNA sequence (GBSx1403) was identified in *S. agalactiae* <SEQ ID 4045> which encodes the amino acid sequence <SEQ ID 4046>. Analysis of this protein sequence reveals the following:

Possible site: 33
>>> Seems to have a cleavable N-term signal seq.
INTEGRAL    Likelihood = −7.91   Transmembrane 661-677 (657-680)
----- Final Results -----
    bacterial membrane --- Certainty = 0.4163 (Affirmative) <succ>
     bacterial outside --- Certainty = 0.0000 (Not Clear) <succ>
       bacterial cytoplasm --- Certainty = 0.0000 (Not Clear) <succ>

A related GBS nucleic acid sequence <SEQ ID 8787> which encodes amino acid sequence <SEQ ID 8788> was also identified. Analysis of this protein sequence reveals the following:

Lipop: Possible site: −1         Crend: 7
McG: Discrim Score: 6.47
GvH: Signal Score (−7.5): 1.01
Possible site: 29
>>> Seems to have a cleavable N-term signal seq.
ALOM program       count: 1 value: −7.91   threshold: 0.0
INTEGRAL           Likelihood = −7.91       Transmembrane 658-673 (657-680)
PERIPHERAL         Likelihood = 4.35        555
modified ALOM score: 2.08
*** Reasoning Step: 3
----- Final Results -----
    bacterial membrane --- Certainty = 0.4163 (Affirmative) <succ>
     bacterial outside --- Certainty = 0.0000 (Not Clear) <succ>
       bacterial cytoplasm --- Certainty = 0.0000 (Not Clear) <succ>
LPXTG motif: 647-651

The protein has homology with the following sequences in the GENPEPT database.

```
>GP:AAF09821 GB:AE001885 6-aminohexanoate-cyclic-dimer hydrolase
[Deinococcus radiodurans]
Identities = 150/497 (30%), Positives = 233/497 (46%), Gaps = 32/497 (6%)
Query: 110  LTEETYKQKDGQDLANMVRSGQVTSEELVNMAYDIIAKENPSLNAVITTRRQEAIEEARK    169
            LT  Y + D  DLA + R G++++E++     A     N +LNAV+    +  +AR
Sbjct:  45  LTFAEYDRLDALDLAQLFRRGELSAEDMCTAAIHRAQVVNVALNAVVYPLYDQGLAQARA    104

Query: 170  L-------KDTNQPFLGVPLLVYGLGHSIKGGETNNGLIYADGKISTFDSSYVKKYKDLG    222
                     + PF GVP LVK  G +       G      +I +D    V++++   G
Sbjct: 105  TDAARARGEQATGPFAGVPFLVKDFGSRLAGVPHTGGTRAYRDQIPEWDDELVRRWQAAG    164

Query: 223  FIILGQTNEPEYGWRNITDSKLYGLTHNPWDLAHNAGGSSGGSAAAIASGMTPIASGSDA    282
              + LG+TN PE+     +T+ +L+G T NPWDL    GGS+GGSA+A+A+G+ P+A   D
Sbjct: 165  LLPLGKTNTPEFALMGVTEPELHGPTRNPWDLGRTPGGSSGGSASAVAAGIVPLAGAGDG    224

Query: 283  GGSIRIPSSWTGLVGLKPTRGLV---SNEKPDSYSTAVHFPLTKSSRDAETLLTYLKKSD    339
            GGSIRIP+S  GL GLKP+RG V              AV  LT+S RD+   LL   + D
Sbjct: 225  GGSIRIPASCCGLFGLKPSRGRVPCGDGVGEPWQGAAVEHVLTRSVRDSAALLDLEQGPD    284
```

```
Query: 340  QTLVSV------------NDLKSLPIAYTLKSPMGTEVSQDAKNAIMDNVTFLRKQGFK  386
                         +   L I ++  P+G V  +   A+     L   G +
Sbjct: 285  AGAALFLPSPERPYSEEVGREPGRLRIGESTAHPLGRSVHPECVAAVQGAARLLESLGHE  344

Query: 387  VTEIDLPIDGRALMRDYSTLAIGMGGAFSTIEKDLKKHGFTKEDVDPITWAVHVIYQNSD  446
            V E+ LP DG AL + +   L  G  GA     +D          DV+ +TW +  + ++
Sbjct: 345  VEEVALPWDGPALAQAFLMLYFGETGASLAALRDTLGRPARASDVEAVTWLLGQLGRSYS  404

Query: 447  KAELKKSIMEAQKHMDDYRKAMEKLHKQFPIELSPTTASLAPLNTDPY----VTEEDKRA  502
             A+       A+    + + +AM + H+ + + L+P  A+   PL          V    RA
Sbjct: 405  AAD----FAAARASWNVHARAMGRFHQNYDLLLTPVLAT-PPLQIGELQPRGVQAALLRA  459

Query: 503  IYNMENLSQEERIALFNRQWEPMLRRTPFTQIANMTGLPAISIPTYLSESGLPIGTMLMA  562
              M+     R   +      +L + P+TQ+AN+TG PA+S+P + +   GLP+G    +A
Sbjct: 460  AQQMDVSGLLRRSGQVDALATDILEKMPYTQLANLTGQPAMSVPLHWTADGLPVGVQFVA  519

Query: 563  GANYDMVLIKFATFFEK                                            579
                + VL++ A    E+
Sbjct: 520  PLAREDVLLRLAGQLEQ                                            536
```

There is also homology to SEQ ID 4048.

SEQ ID 8788 (GBS173) was expressed in *E. coli* as a GST-fusion product. SDS-PAGE analysis of total cell extract is shown in FIG. 41 (lane 5; MW 96.8 kDa).

The GBS173-GST fusion product was purified (FIG. 116A; see also FIG. 201, lane 7) and used to immunise mice (lane 1+2 product; 15µg/mouse). The resulting antiserum was used for Western blot, FACS, and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 1322

A DNA sequence (GBSx1404) was identified in *S. agalactiae* <SEQ ID 4049> which encodes the amino acid sequence <SEQ ID 4050>. This protein is predicted to be ribosomal large subunit pseudouridine synthase B (rsuA). Analysis of this protein sequence reveals the following:

Possible site: 41

\>\>\> Seems to have no N-terminal signal sequence

----- Final Results ----- bacterial cytoplasm --- Certainty = 0.3674 (Affirmative) <succ> bacterial membrane --- Certainty = 0.0000 (Not Clear) <succ> bacterial outside --- Certainty = 0.0000 (Not Clear) <succ>

The protein has homology with the following sequences in the GENPEPT database.

```
>GP:BAB06992 GB:AP001518 16S pseudouridylate synthase [Bacillus halodurans]
Identities = 110/236 (46%), Positives = 149/236 (62%), Gaps = 4/236 (1%)

Query:   1  MRLDKFLVECGLGSRTQVKLILKKKQISVNGNSETSPKVQVDEYRDEIKYNGTLVSYEKF  60
            MR+DKFL   G GSR  VK +LK   + V G      P   V+   + I   G V Y+ +
Sbjct:   1  MRIDKFLANMGFGSRKDVKKLLKTGAVRVQGQPIKDPSTHVEPESESITVYGEEVEYKPY  60

Query:  61  VYYMLHKPKGVISATDDPSHKTVLDLLDKTARDKAVFPVGRLDIDTTGLLLLTNNGELAH  120
            VY M++KPKGVI AT+D  H+TV+DLL +  R      PVGRLD DT GLLL+TN+G+ H
Sbjct:  61  VYLMMNKPKGVICATEDLEHETVIDLLGEEERHYEPSPVGRLDKDTVGLLLITNDGKFNH  120

Query: 121  KMLSPKKHVDKCYEVKISGIMTEDDILAFDKGIILKD-FTCLPALLEIVEVNQVKKQSLV  179
            ++SPK HV K Y   + G +TE+D+ AF  G++L D +    PA L I+E      +S +
Sbjct: 121  WLMSPKHHVPKTYRALVEGHVTEEDVGAFSHGVVLDDGYVTKPATLHILEAG---ARSHI  177

Query: 180  KITIKEGKFHQVKRMVAACGKEVLELKRLRMGNLQLDKQLESGQWRRLTIKEIEKL      235
            ++ +  EGKFHQVKRM  A GK VLEL+R+++GNL LD +L   G++R LT +EI    L
Sbjct: 178  ELILTEGKFHQVKRMFQAVGKRVLELERIKIGNLLLDPELARGEYRELTKEEIALL      233
```

A related DNA sequence was identified in *S. pyogenes* <SEQ ID 4051> which encodes the amino acid sequence <SEQ ID 4052>. Analysis of this protein sequence reveals the following:

```
Possible site: 40
>>> Seems to have no N-terminal signal sequence
----- Final Results -----
   bacterial cytoplasm --- Certainty = 0.0152 (Affirmative) <succ>
   bacterial membrane --- Certainty = 0.0000 (Not Clear) <succ>
      bacterial outside --- Certainty = 0.0000 (Not Clear) <succ>
```

The protein has homology with the following sequences in the databases:

```
>GP:AAF09821 GB:AE001885 6-aminohexanoate-cyclic-dimer hydrolase
[Deinococcus radiodurans]
Identities = 177/485 (36%), Positives = 259/485 (52%), Gaps = 13/485 (2%)
Query:   5 DATAMAIAVQTGQTTPLELVTQAIYKAKKLNPTLNAITSERFEAALEEAKQRDFSGL---   61
           DA  +A   + G+ +  ++ T AI++A+ +N  LNA+     ++  L +A+  D +
Sbjct:  54 DALDLAQLFRRGELSAEDMCTAAIHRAQVVNVALNAVVYPLYDQGLAQARATDAARARGE  113

Query:  62 ----PFAGVPLFLKDLGQELKGHSSTSGSRLFKEYQATKTDLFVKRLEALGFIILGRSNT  117
               PFAGVP  +KD G  L G   T G+R +++       D  V+R +A G + LG++NT
Sbjct: 114 QATGPFAGVPFLVKDFGSRLAGVPHTGGTRAYRDQIPEWDDELVRRWQAAGLLPLGKTNT  173

Query: 118 PEFGEKNISDSSLHGPVNLPRDNTRNAGGSSSGGAAALVSSGISALATASDGGGSIRIPAS  177
           PEF    +++ LHGP  P D R  GGSSGG+A+ V++GI  LA A DGGGSIRIPAS
Sbjct: 174 PEFALMGVTEPELHGPTRNPWDLGRTPGGSSGGSASAVAAGIVPLAGAGDGGGSIRIPAS  233

Query: 178 FNGLIGLKPSRGRMPVGPGSYRSWQGASVHFALTKSVRDTRNLLYYLQMEQMESPFPLAT  237
            GL GLKPSRGR+P G G    WQGA+V   LT+SVRD+ LL   Q    +  L +
Sbjct: 234 CCGLFGLKPSRGRVPCGDGVGEPWQGAAVEHVLTRSVRDSAALLDLEQGPDAGAALFLPS  293

Query: 238 LTKDSIYQSLQRP--LTIAFYQRLSDGSPVSLDTAKALRQAVTWLREQGHQLVELEEFPV  295
             +    + +P  L I F    G V +   A++ A   L   GH++ E+   P
Sbjct: 294 PERPYSEEVGREPGRLRIGESTAHPLGRSVHPECVAAVQGAARLLESLGHEVEEV-ALPW  352

Query: 296 NMTEVIRHYYIMNSVETAAMFADIEDTFGRPMTKDDMETMTWAIYQSGKDIPAWRYSQVL  355
           +  + + + ++   ET A  A + DT GRP   D+E +TW + Q G+  A  ++
Sbjct: 353 DGPALAQAFLMLYFGETGASLAALRDTLGRPARASDVEAVTWLLGQLGRSYSAADFAAAR  412

Query: 356 QKWDTYSATMASFHETYDLLLTFTTNTPAPKHGELVP---DSKLMANLAQAEIFSSEEQF  412
             W+ ++  M  FH+  YDLLLT     TP + GEL P    + L+    Q ++      +
Sbjct: 413 ASWNVHARAMGRFHQNYDLLLTPVLATPPLQIGELQPRGVQAALLRAAQQMDVSGURRS  472

Query: 413 NLVETMEGKSLAINPYTALPNLTGQPAISLPTYETKEGLSMGIQLIAAKGREDLLLGIAE  472
            V+ +   L   PYT L NLTGQPA+S+P  T +GL +G+Q +A   RED+LL +A
Sbjct: 473 GQVDALATDILEKMPYTQLANLTGQPAMSVPLHWTADGLPVGVQFVAPLAREDVLLRLAG  532

Query: 473 QFEAA                                                         477
           Q E A
Sbjct: 533 QLEQA                                                         537
```

An alignment of the GAS and GBS proteins is shown below.

Based on this analysis, it was predicted that these proteins and their epitopes could be useful antigens for vaccines or diagnostics.

Example 1323

A DNA sequence (GBSx1405) was identified in *S. agalactiae* <SEQ ID 4053> which encodes the amino acid sequence <SEQ ID 4054>. Analysis of this protein sequence reveals the following:

```
Identities = 151/240 (62%), Positives = 183/240 (75%)
Query:   1 MRLDKFLVECGLGSRTQVKLILKKKQISVNGNSETSPKVQVDEYRDEIKYNGTLVSYEKF   60
           MRLDKFLV  G+G+R+QVKL+LKKK I VN   ETS K  +DEY+D + Y GT + YE F
Sbjct:   2 MRLDKFLVATGVGTRSQVKLLLKKKAIFVNQKVETSAKAHIDEYKDLVTYQGTPLVYESF   61

Query:  61 VYYMLHKPKGVISATDDPSHKTVLDLLDKTARDKAVFPVGRLDIDTTGLLLLTNNGELAH  120
           VYY+L+KP G +SAT D    TV++LLD TAR KAVFPVGRLD DT GLLLLTNNG+LAH
Sbjct:  62 VYYLLNKPSGYVSATQDRQQATVMELLDDTARQKAVFPVGRLDKDTRGLLLLTNNGQLAH  121

Query: 121 KMLSPKKHVDKCYEVKISGIMTEDDILAFDKGIILKDFTCLPALLEIVEVNQVKKQSLVK  180
            +LSPKKHV K Y  K++GIMTE D   F +GI LKD  CLPA LE++  +  ++ SLVK
Sbjct: 122 DLLSPKKHVTKEYLAKVAGIMTEADKDYFARGISLKDHQCLPAHLEVLASDLQQQTSLVK  181

Query: 181 ITIKEGKFHQVKRMVAACGKEVLELKRLRMGNLQLDKQLESGQWRRLTIKEIEKLEKYMQ  240
           ITI+EGKFHQVKRMVAACGKEVL+L+RL MG L+LD  L   G++RRLT +E++  L Y Q
Sbjct: 182 ITIQEGKFHQVKRMVAACGKEVLDLQRLSMGPLKLDPSLAEGEFRRLTPEELQSLAPYCQ  241
```

```
Possible site: 46
>>> Seems to have no N-terminal signal sequence
----- Final Results -----
    bacterial cytoplasm --- Certainty = 0.2811 (Affirmative) <succ>
     bacterial membrane --- Certainty = 0.0000 (Not Clear) <succ>
      bacterial outside --- Certainty = 0.0000 (Not Clear) <succ>
```

A related GBS nucleic acid sequence <SEQ ID 10007> which encodes amino acid sequence <SEQ ID 10008> was also identified.

The protein has homology with the following sequences in the GENPEPT database.

```
>GP:AAA57350 GB:J04483 reductase [Leishmania major]
Identities = 129/277 (46%), Positives = 167/277 (59%), Gaps = 3/277 (1%)
Query:  26 TLSNTLNIPKIGFGTWQLTEGEEAYKAVTHALKVGYTHIDTAQIYGNEHSVGRAIRDSGL      85
            TLSN + +P+ G G WQ   GE    AV AL  GY HIDTA IY NE SVG +R SG+
Sbjct:  10 TLSNGVKMPQFGLGVWQSPAGEVTENAVNWALCAGYRHIDTAAIYKNEESVGAGLRASGV     69

Query:  86 ARESIFLTTKIWNDKHDYHLAKASIDESLQKLGVDYIDLLLIHWPNPKALRENDAWKAGN    145
            RE +F+TTK+WN +  Y    A+ +ES QKLGVDYIDL LIHWP K+   + K
Sbjct:  70 PREDVFITTKLWNTEQGYESTLAAFEESRQKLGVDYIDLYLIHWPRGKDILSKEGKKY--   127

Query: 146 AGTWKAMEEAYKEGKVKAIGVSNFMKHHLEALFETAEIKPMVNQIILAPGCAQEDLVRFC    205
             +W+A E+ YKE KV+AIGVSNF  HHLE +       + PMVNQ+ L P   Q DL  FC
Sbjct: 128 LDSWRAFEQLYKEKKVRAIGVSNFHIHHLEDVLAMCTVTPMVNQVELHPLNNQADLRAFC   187

Query: 206 KGNDILLEAYSPFGTGAIFENESIKAIAEKYGKSVAQVALRWSLDNGFLPLPKSATPKNI    265
               I +EA+SP G G +  N  + AI  KY K+ AQV LRW++    + +PKS    + I
Sbjct: 188 DAKQIKVEAWSPLGQGKLLSNPILSAIGAKYNKTAAQVILRWNIQKNLITIPKSVHRERI   247

Query: 266 EANLDIFDFQLNEDDIATLIQLDSGIK-PKDPDNVSF                          301
            E N DIFDF+L  +D+  ++ L++ +    DPD   F
Sbjct: 248 EENADIFDFELGAEDVMSIDALETNSRYGPDPDEAQF                          284
```

A related DNA sequence was identified in *S. pyogenes* <SEQ ID 779> which encodes the amino acid sequence <SEQ ID 780>. Analysis of this protein sequence reveals the following:

```
Possible site: 27
>>> Seems to have no N-terminal signal sequence
----- Final Results -----
    bacterial cytoplasm --- Certainty = 0.0980 (Affirmative) <succ>
     bacterial membrane --- Certainty = 0.0000 (Not Clear) <succ>
      bacterial outside --- Certainty = 0.0000 (Not Clear) <succ>
```

An alignment of the GAS and GBS proteins is shown below.

Based on this analysis, it was predicted that these proteins and their epitopes could be useful antigens for vaccines or diagnostics.

Example 1324

A DNA sequence (GBSx1406) was identified in *S. agalactiae* <SEQ ID 4055> which encodes the amino acid sequence <SEQ ID 4056>. Analysis of this protein sequence reveals the following:

```
Possible site: 26
>>> Seems to have no N-terminal signal sequence
----- Final Results -----
    bacterial cytoplasm --- Certainty = 0.0633 (Affirmative) <succ>
     bacterial membrane --- Certainty = 0.0000 (Not Clear) <succ>
      bacterial outside --- Certainty = 0.0000 (Not Clear) <succ>
```

A related GBS nucleic acid sequence <SEQ ID 10009> which encodes amino acid sequence <SEQ ID 10010> was also identified.

The protein has homology with the following sequences in the GENPEPT database.

```
Identities = 155/282 (54%), Positives = 204/282 (71%), Gaps = 2/282 (0%)
Query:  20 IVMETYTLSNTLNIPKIGFGTWQLTEGEEAYKAVTHALKVGYTHIDTAQIYGNEHSVGRA     79
            +++ T +++   IP +GFGT+Q +GEEAY++    A+K GY HIDTA IY NE SVGRA
Sbjct:   1 VMVTTVKMTSGYEIPVLGFGTYQAADGEEAYQSTLAAIKAGYRHIDTAAIYKNEESVGRA    60

Query:  80 IRDSGLARESIFLTTKIWNDKHDYHLAKASIDESLQKLGVDYIDLLLIHWPNPKALREND    139
           I+DSG+ RE +F+TTK+WND H Y  AK ++   SL +LG+DY+DL LIHWPNPKALR +
Sbjct:  61 IKDSGVLREDLFITTKLWNDAHSYEGAKDALAASLDRLGLDYVDLYLIHWPNPKALR--N   118

Query: 140 AWKAGNAGTWKAMEEAYKEGKVYAIGVSNFMKHHLEALFETAEIKPMVNQIILAPGCAQE    199
            WK  NA    W+ MEEA + G +K+IGVSNFM HHLEAL ETA+I P +NQI LAPGC Q+
Sbjct: 119 TWKEANAQAWQYMEEAVEAGLIKSIGVSNFMVHHLEALQETAKITPAINQIRLAPGCYQK   178

Query: 200 DLVRFCKGNDILLEAYSPFGTGAIFENESIKAIAEKYGKSVAQVALRWSLDNGFLPLPKS    259
            ++V +CK N+ILLEA+SP G G IF+NE+++ +A KY K+VAQVAL WSL  GF+PLPKS
Sbjct: 179 EVVDYCKANEILLEAWSPLGQGEIFDNETMQQLANKYDKTVAQVALAWSLAEGFIPLPKS   238

Query: 260 ATPKNIEANLDIFDFQLNEDDIATLIQLDSGIKPKDPDNVSF                     301
              + I+ N+ IFD  L ++D T+ L    +PD  SF
Sbjct: 239 VHDERIKENMAIFDVSLTQEDKKTIRYLSGMSAIPNPDTTSF                     280
```

```
>GP:CAB12612 GB:Z99108 similar to NAD(P)H-flavin oxidoreductase
[Bacillus subtilis]
Identities = 106/223 (47%), Positives = 150/223 (66%), Gaps = 8/223 (3%)
Query:   29 DIKKQVRRAFDFRMAIRVYN-NNDIPKEDMEYILDTAWLSPSSVGLEGWRFLVLDRQTIA    87
            D+K Q+  A++FR A + ++ N  +   D E+IL+T  LSPSS+GLE W+F+V+
Sbjct:    3 DLKTQILDAYNFRHATKEFDPNKKVSDSDFEFILETGRLSPSSLGLEPWKFVVVQNP---   59

Query:   88 KFRDKLKEVAWGAQYQLDTASHFVLLLAE--KGAYYNADSMINSLIRRGLGDPAALESRI   145
            +FR+KL+E  WGAQ QL TASHFVL+LA   K   YNAD +  L             E  +
Sbjct:   60 EFREKLREYTWGAQKQLPTASHFVLILARTAKDIKYNADYIKRHLKEVKQMPQDVYEGYL   119

Query:  146 PLYKSFQENDMKI-DSERSLWDWTAKQTYIALGNMMTAAAMIGVDSCPIEGFDYEKVNNI   204
              + FQ+ND+ +   +S+R+L+DW +KQTYIALGNMMTAAA IGVDSCPIEGF Y+ ++ I
Sbjct:  120 SKTEEFQKNDLHLLESDRTLFDWASKQTYIALGNMMTAAAQIGVDSCPIEGFQYDHIHRI   179

Query:  205 LSKEGLIDDKKEAISCMVSFGYRLREPKHSRARKERQEVITWV                   247
            L +EGL+++    IS MV+FGYR+R+P+  + R   ++V+ WV
Sbjct:  180 LEEEGLLENGSFDISVMVAFGYRVRDPR-PKTRSAVEDVVKWV                   221
```

A related DNA sequence was identified in S. pyogenes <SEQ ID 4057> which encodes the amino acid sequence <SEQ ID 4058>. Analysis of this protein sequence reveals the following:

Possible site: 47
>>> Seems to have no N-terminal signal sequence
----- Final Results -----
  bacterial cytoplasm --- Certainty = 0.1705 (Affirmative) <succ>
  bacterial membrane --- Certainty = 0.0000 (Not Clear) <succ>
  bacterial outside --- Certainty = 0.0000 Not Clear) <succ>

An alignment of the GAS and GBS proteins is shown below.

```
Identities = 126/222 (56%), Positives = 174/222 (77%), Gaps = 4/222 (1%)
Query:   28 EDIKKQVRRAFDFRMAIRVYNNNDIPKEDMEYILDTAWLSPSSVGLEGWRFLVLDRQTIA    87
             + I  Q+++A FR A+RVY    I   ED+  ILD AWLSPSS+GLEGWRF+VLD + I
Sbjct:    3 QTIHHQIQQALHFRTAVRVYKEEKISDEDLALILDAAWLSPSSIGLEGWRFVVLDNKPI-    61

Query:   88 KFRDKLKEVAWGAQYQLDTASHFVLLLAEKGAYYNADSMINSLIRRGLGDPAALESRIPL   147
             ++++K   AWGAQYQL+TASHF+LL+AEK A Y++ ++ NSL+RRG+ +   L  SR+ L
Sbjct:   62 --KEEIKPFAWGAQYQLETASHFILLIAEKHARYDSPAIKNSLLRRGIKEGDGLNSRLKL   119

Query:  148 YKSFQENDMKI-DSERSLWDWTAKQTYIALGNMMTAAAMIGVDSCPIEGFDYEKVNNILS   206
            Y+SFQ+ DM + D+ R+L+DWTAKQTYIALGNMM  AA++G+D+CPIEGF Y+KVN+IL+
Sbjct:  120 YESFQKEDMDMADNPRALFDWTAKQTYIALGNMMMTAALLGIDTCPIEGFHYDKVNHILA   179

Query:  207 KEGLIDDKKEAISCMVSFGYRLREPKHSRARKERQEVITWVE                    248
            K +ID +KE I+ M+S GYRLR+PKH++ RK ++EVI+ V+
Sbjct:  180 KHNVIDLEKEGIASMLSLGYRLRDPKHAQVRKPKEEVISVVK                    221
```

Based on this analysis, it was predicted that these proteins and their epitopes could be useful antigens for vaccines or diagnostics.

Example 1325

A DNA sequence (GBSx1407) was identified in S. agalactiae <SEQ ID 4059> which encodes the amino acid sequence <SEQ ID 4060>. This protein is predicted to be lactoylglutathione lyase (gloA). Analysis of this protein sequence reveals the following:

Possible site: 25
>>> Seems to have no N-terminal signal sequence
----- Final Results -----
  bacterial cytoplasm --- Certainty = 0.1656 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:AAC21986 GB:U32717 lactoylglutathione lyase (gloA)
[Haemophilus influenzae Rd]
Identities = 59/131 (45%), Positives = 86/131 (65%), Gaps = 2/131 (1%)
Query:    1 MPFLHTCIRVKDLDASIAFYQEALGFKEVRRNDFPENQFTLVYMALEDDPSY-ELELTYN    59
            M  LHT +RV DLD SI FYQ+ LG + +R ++ PE ++TL ++  ED   S  E+ELTYN
Sbjct:    1 MQILHTMLRVGDLDRSIKFYQDVLGMRLLRTSENPEYKYTLAFLGYEDGESAAEIELTYN    60

Query:   60 YDHEAYDLGNGYGHIAVGVDDLETTYDAHQKAGYSVTKISG-LPGKPNMFYFIQDPDGYK   118
             +  + Y+ G  YGHIA+GVDD+  T +A + +G +VT+ +G + G     F++DPDGYK
Sbjct:   61 WGVDKYEHGTAYGHIAIGVDDIYATCEAVRASGGNVTREAGPVKGGSTVIAFVEDPDGYK   120
```

```
Query: 119  IEVIRLSQFKA                                                   129
            IE I     K+
Sbjct: 121  IEFIENKSTKS                                                   131
```

A related DNA sequence was identified in *S. pyogenes* <SEQ ID 4061> which encodes the amino acid sequence <SEQ ID 4062>. Analysis of this protein sequence reveals the following:

Possible site: 23
>>> Seems to have no N-terminal signal sequence
----- Final Results -----
    bacterial cytoplasm --- Certainty = 0.1382 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below.

```
Identities = 80/125 (64%), Positives = 93/125 (74%), Gaps = 1/125 (0%)
Query:   1  MPFLHTCIRVKDLDASIAFYQEALGFKEVRRNDFPENQFTLVYMALEDDPSYELELTYNY    60
            M  LHTCIRVKDLD S+AFY A  FKE R DFP++QFTLVY+ALE + SYELELTYNY
Sbjct:   1  MKALHTCIRVKDLDQSVAFYTSAFPFKENYRKDFPDSQFTLVYLALEGE-SYELELTYNY   59

Query:  61  DHEAYDLGNGYGHIAVGVDDLETTYDAHQKAGYSVTKISGLPGKPNMFYFIQDPDGYKIE   120
               H  YDLGNGYGHIA+G +  E  +  H++AG+ VT I  L K   +YFIQDPDGYKIE
Sbjct:  60  GHGDYDLGNGYGHIALGSEHFEADHKKHRQAGFPVTDIKELADKSARYYFIQDPDGYKIE   119

Query: 121  VIRLS                                                         125
            VI L+
Sbjct: 120  VIDLN                                                         124
```

Based on this analysis, it was predicted that these proteins and their epitopes could be useful antigens for vaccines or diagnostics.

Example 1326

A DNA sequence (GBSx1408) was identified in *S. agalactiae* <SEQ ID 4063> which encodes the amino acid sequence <SEQ ID 4064>. Analysis of this protein sequence reveals the following:

Possible site: 29
>>> Seems to have an uncleavable N-term signal seq

-continued

| | | |
|---|---|---|
| INTEGRAL | Likelihood = −9.02 | Transmembrane 241-257 (229-262) |
| INTEGRAL | Likelihood = −4.94 | Transmembrane 270-286 (264-287) |

----- Final Results -----
    bacterial membrane --- Certainty = 0.4609 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:CAB12688 GB:Z99108 stress response protein [Bacillus subtilis]
Identities = 139/304 (45%), Positives = 200/304 (65%), Gaps = 3/304 (0%)
Query:   3  LLSVIVPCYNEQETVSTFLTEIKKVESEMARYTHFEYIPVNDGSTDRTLELLKKAAKQFD    62
            L+S+I+P YNE    V    +KK E +   Y  +E  F+NDGS D TL+ +K  A
Sbjct:   5  LISIIIPSYNEGYNVKLIHESLKK-EFKNIHYD-YEIFFINDGSVDDTLQQIKDLAATCS   62

Query:  63  NVHYLSFSRHFGKDAALLAGLEHTTGDFITVMDVDLQDPPTLLPEMYLKLQEGYDIVATR   122
             V Y+SFSR+FGK+AA+LAG EH  G+ + VMD DLQ P  LL E      +EGYD V +
Sbjct:  63  RVKYISFSRNFGKEAAILAGFEHVQGEAVIVMDADLQHPTYLLKEFIKGYEEGYDQVIAQ   122

Query: 123  RKDRKGEPLIRSLFAKLFYKLINQVSDTKMVDGARDFRLMTKQVVDSILELNEVNRFSKG   182
            R +RKG+   +RSL + ++YK IN+ +  + DG  DFRL+++Q V+++L+L+E NRFSKG
Sbjct: 123  R-NRKGDSFVRSLLSSMYYKFINKAVEVDLRDGVGDFRLLSRQAVNALLKLSEGNRFSKG   181

Query: 183  IFSWIGYDVAYISYENRERIAGKTSWSFFNLLKYSLDGFINFSEIPLAIATWIGTLSSVL   242
            +F WIG+D  + YEN ER G + WSF +L  Y +DG ++F+  PL +   G     +L
Sbjct: 182  LFCWIGFDQKIVFYENVERKNGTSKWSFSSLFNYGMDGVVSFNHKPLRLCFYTGIFILLL   241
```

```
                                            -continued
Query: 243  SLLAIIFIIIRKLLFGDPVSGWASTVTIVLFMGGIQLLSLGIIGKYISKIFLETKKRPVY   302
            S++ II    ++ L   G   V G+ + ++ VLF+GG+QLLSLGIIG+YI +I+ ETKKRP Y
Sbjct: 242  SIIYIIATFVKILTNGISVPGYFTIISAVLFLGGVQLLSLGIIGEYIGRIYYETKKRPHY   301

Query: 303  IVKE                                                          306
            ++KE
Sbjct: 302  LIKE                                                          305
```

A related DNA sequence was identified in *S. pyogenes* <SEQ ID 4065> which encodes the amino acid sequence <SEQ ID 4066>. Analysis of this protein sequence reveals the following:

Possible site: 56
>>> Seems to have an uncleavable N-term signal seq
INTEGRAL    Likelihood = −9.55    Transmembrane 256-272 (251-282)
INTEGRAL    Likelihood = −5.31    Transmembrane 290-306 (284-307)
----- Final Results -----
  bacterial membrane --- Certainty = 0.4821 (Affirmative) <succ>
    bacterial outside --- Certainty = 0.0000 (Not Clear) <succ>
      bacterial cytoplasm --- Certainty = 0.0000 (Not Clear) <succ>

A related sequence was also identified in GAS <SEQ ID 9113> which encodes the amino acid sequence <SEQ ID 9114>. Analysis of this protein sequence reveals the following:

Possible cleavage site: 36
>>> Seems to have an uncleavable N-term signal seq
----- Final Results -----
  bacterial membrane --- Certainty = 0.482 (Affirmative) <succ>
    bacterial outside --- Certainty = 0.000 (Not Clear) <succ>
      bacterial cytoplasm --- Certainty = 0.000 (Not Clear) <succ>

An alignment of the GAS and GBS proteins is shown below.

Based on this analysis, it was predicted that these proteins and their epitopes could be useful antigens for vaccines or diagnostics.

Example 1327

A DNA sequence (GBSx1409) was identified in *S. agalactiae* <SEQ ID 4067> which encodes the amino acid sequence <SEQ ID 4068>. This protein is predicted to be d-serine/d-alanine/glycine transporter (cycA). Analysis of this protein sequence reveals the following:

Possible site: 49
>>> Seems to have no N-terminal signal sequence
INTEGRAL    Likelihood = −2.44    Transmembrane 50-66 (50-66)
INTEGRAL    Likelihood = −1.49    Transmembrane 27-43 (27-43)
----- Final Results -----
  bacterial membrane --- Certainty = 0.1977 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the GENPEPT database.

```
Identities = 207/307 (67%), Positives = 258/307 (83%)

Query:   1  MALLSVIVPCYNEQETVSTFLTEIKKVESEMARYTHFEYIFVNDGSTDRTLELLKKAAKQ   60
            M LLS+IVPC+NE+  +   E+ ++E+ M      FEYIF++DGS D TL +L++ A +
Sbjct:  21  MTLLSIIVPCFNEEANILPYFEEMHQLETSMTNQLAFEYIFIDDGSKDNTLGILRELAAR   80

Query:  61  FDNVHYLSFSRHFGKDAALLAGLEHTTGDFITVMDVDLQDPPTLLPEMYLKLQEGYDIVA   120
            F NVHYLSFSRHFGK+A LLAGL+    G++ITVMDVDLQDPP LLP MY KL+EGYDIV
Sbjct:  81  FPNVHYLSFSRHFGKEAGLLAGLKEAKGNYITVMDVDLQDPPELLPIMYAKLKEGYDIVG   140

Query: 121  TRRKDRKGEPLIRSLFAKLFYKLINQVSDTKMVDGARDFRLMTKQVVDSILELNEVNRFS   180
            TRR++R+GEPLIRS+ + LFY LI  +SDT+MV+G RD+RLMT+QVVDSILEL EVNRFS
Sbjct: 141  TRRQNRQGEPLIRSMCSNLFYGLIKHLSDTEMVNGVRDYRLMTRQVVDSILELGEVNRFS   200

Query: 181  KGIFSWIGYDVAYISYENRERIAGKTSWSFFNLLKYSLDGFINFSEIPLAIATWIGTLSS   240
            KGIFSW+GY + Y+S+EN++R  GK+  W F+ LL+YSLDGFINFSE+PL IATW GT S
Sbjct: 201  KGIFSWVGYRITYLSFENQKRKYGKSRWHFWELLRYSLDGFINFSEMPLTIATWTGTFSF   260

Query: 241  VLSLLAIIFIIIRKLLFGDPVSGWASTVTIVLFMGGIQLLSLGIIGKYISKIFLETKKRP   300
            ++S+ AI+FIIIRK+LFGDPVSGWASTV+I+LFMGGIQL   +GIIGKYISKIFLETKKRP
Sbjct: 261  LISIFAILFIIIRKILFGDPVSGWASTVSIILFMGGIQLFCMGIIGKYISKIFLETKKRP   320

Query: 301  VYIVKEE                                                       307
            +YI+KE+
Sbjct: 321  LYIIKEK                                                       327
```

```
>GP:CAA83253 GB:Z31377 potential amino acid permease
           [Lactobacillus delbrueckii]
Identities = 34/55 (61%), Positives = 44/55 (79%)
Query: 7   DHTQKSENGMVRGLENRHVQLIAIAGTIGTGLFLGAGRSISLTGPSIVLVYAITG   61
           D + ++ +G +R L NRHVQ+IAI GTIGTGLFLGAG +IS TGPS++ +YAI G
Sbjct: 5   DRSIENTDGTIRSLSNRHVQMIAIGGTIGTGLFLGAGTTISATGPSVIFIYAIMG   59
```

A related DNA sequence was identified in *S. pyogenes* <SEQ ID 4069> which encodes the amino acid sequence <SEQ ID 4070>. Analysis of this protein sequence reveals the following:

Possible site: 53
>>> Seems to have no N-terminal signal sequence
INTEGRAL   Likelihood = −11.15   Transmembrane 170-186 (161-190)
INTEGRAL   Likelihood = −8.44    Transmembrane 256-272 (252-274)
INTEGRAL   Likelihood = −8.33    Transmembrane 352-368 (347-375)
INTEGRAL   Likelihood = −7.54    Transmembrane 139-155 (133-160)
INTEGRAL   Likelihood = −5.73    Transmembrane 420-436 (417-440)

-continued

INTEGRAL   Likelihood = −3.88   Transmembrane 56-72 (54-75)
INTEGRAL   Likelihood = −3.40   Transmembrane 283-299 (282-300)
INTEGRAL   Likelihood = −3.29   Transmembrane 440-456 (439-458)
INTEGRAL   Likelihood = −1.49   Transmembrane 31-47 (31-47)
INTEGRAL   Likelihood = −1.33   Transmembrane 109-125 (109-127)
----- Final Results -----
   bacterial membrane --- Certainty = 0.5458 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the databases:

```
>GP:CAB14651 GB:Z99117 amino acid permease [Bacillus subtilis]

Identities = 210/454 (46%), Positives = 296/454 (64%), Gaps = 11/454 (2%)

Query:  12   DNNELENGMVRGLENRHVQLIAIAGTIGTGLFLGAGRSIALTGPSIIFVYMITGAFMFMM    71
             DN   +  + RGL+NRH+QL+AI G IGTGLFLG+G+SI    GPSI+F Y+ITG F F +
Sbjct:   8   DNFGQQQKLSRGLKNRHIQLMAIGGAIGTGLFLGSGKSIHFAGPSILFAYLITGVFCFFI    67

Query:  72   MRAIGEMLYYDPDQHTFINFISKYIGPGWGYFSGLSYWISLIFIGMAEITAVGAYVQFWF   131
             +R++GE+L  +    H+F++F+  Y+G    + +G +YW   I + MA++TAVG Y Q+W
Sbjct:  68   IRSLGELLLSNAGYHSFVDFVRDYLGNMAAFITGWTYWFCWISLAMADLTAVGIYTQYWL   127

Query: 132   PSWPAWLIQLVFLVLLSSINLIAVRVFGETEFWFAMIKILAILALIATAIFMVLTGFETH   191
             P  P WL L+ L++L  +NL  V++FGE EFWFA+IK++AILALI T I ++   GF
Sbjct: 128   PDVPQWLPGLLALIILLIMNLATVKLFGELEFWFALIKVIAILALIVTGILLIAKGFSAA   187

Query: 192   TGHASLSNIFDHFSMFPNGKLKFFMAFQMVFFAYQAIEFVGITTSETANPRKVLPKAIQE   251
             +G ASL+N++ H  MFPNG     F ++FQMV FA+   IE VG+T  ET NP+KV+PKAI +
Sbjct: 188   SGPASLNNLWSHGGMFPNGWHGFILSFQMVVFAFVGIELVGLTAGETENPQKVIPKAINQ   247

Query: 252   IPTRIVIFYVGALVSIMAIVPWHQLPVDESPFVMVFKLIGIKWAAALINFVVLTSAASAL   311
             IP RI++FYVGAL  IM I PW+ L  +ESPFV VF +GI  AA+LINFVVLTSAASA
Sbjct: 248   IPVRILLFYVGALFVIMCIYPWNVLNPNESPFVQVFSAVGIVVAASLINFVVLTSAASAA   307

Query: 312   NSTLYSTGRHLYQIANE--TPNALTNRLKINTLSRQGVPSRAIIASAVVVGISALINILP   369
             NS L+ST R +Y +A +    P  L      L+    VPS A+ S++ + I   +N L
Sbjct: 308   NSALFSTSRMVYSLAKDHHAPGLL------KKLTSSNVPSNALFFSSIAILIGVSLNYLM   361

Query: 370   GVADAFSLITASSSGVYIAIYALTMIAHWKYRQSK--DFMADGYLMPKYKVTTPLTLAFF   427
                     F+LIT+ S+  +I  I+ +T+I H KYR+++   +   A+ + MP Y ++   LTLAF
Sbjct: 362   -PEQVFTLITSVSTICFIFIWGITVICHLKYRKTRQHEAKANKFKMPFYPLSNYLTLAFL   420

Query: 428   AFVFISLFLQESTYIGAIGATIWIIIFGIYSNVK                           461
             AF+  + L L    T I      +W ++  I     V+
Sbjct: 421   AFILVILALANDTRIALFVTPVWFVLLIILYKVQ                           454
```

An alignment of the GAS and GBS proteins is shown below.

```
Identities = 48/62 (77%), Positives = 51/62 (81%)
Query:  1  MSKNNNDHTQKSENGMVRGLENRHVQLIAIAGTIGTGLFLGAGRSISLTGPSIVLVYAITGA   62
           MS       + ENGMVRGLENRHVQLIAIAGTIGTGLFLGAGRSI+LTGPSI+ VY ITGA
Sbjct:  5  MSIKEQTDNNELENGMVRGLENRHVQLIAIAGTIGTGLFLGAGRSIALTGPSIIFVYMITGA   66
```

Based on this analysis, it was predicted that these proteins and their epitopes could be useful antigens for vaccines or diagnostics.

Example 1328

A DNA sequence (GBSx1411) was identified in *S. agalactiae* <SEQ ID 4071> which encodes the amino acid sequence <SEQ ID 4072>. This protein is predicted to be alkylphosphonate uptake protein (phnA). Analysis of this protein sequence reveals the following:

---

Possible site: 29
>>> Seems to have no N-terminal signal sequence
----- Final Results -----
    bacterial cytoplasm --- Certainty = 0.0965 (Affirmative) <succ>
      bacterial membrane --- Certainty = 0.0000 (Not Clear) <succ>
        bacterial outside --- Certainty = 0.0000 (Not Clear) <succ>

---

The protein has homology with the following sequences in the GENPEPT database.

```
>GP:AAC77069 GB:AE000483 orf, hypothetical protein [Escherichia coli K12]
Identities = 79/110 (71%), Positives = 91/110 (81%), Gaps = 1/110 (0%)
Query:   1  MSLPNCPKCNSEYVYEDGILLVCPECAYEWNPEE-IEEEVGLIVLDSNGTRLSDGDTVTV    59
            MSLP+CPKCNSEY YED  + +CPECAYEWN  E   +E   LIV D+NG  L+DGD+VT+
Sbjct:   1  MSLPHCPKCNSEYTYEDNGMYICPECAYEWNDAEPAQESDELIVKDANGNLLADGDSVTI    60

Query:  60  IKDLKVKGAPKDIKQGTRVKNIRLVDGDHNIDCKIDGFGAMKLKSEFVKK             109
            IKDLKVKG+    +K GT+VKNIRLV+GDHNIDCKIDGFG MKLKSEFVKK
Sbjct:  61  IKDLKVKGSSSMLKIGTKVKNIRLVEGDHNIDCKIDGFGPMKLKSEFVKK             110
```

A related DNA sequence was identified in *S. pyogenes* <SEQ ID 4073> which encodes the amino acid sequence <SEQ ID 4074>. Analysis of this protein sequence reveals the following:

---

Possible site: 14
>>> Seems to have no N-terminal signal sequence
----- Final Results -----
    bacterial cytoplasm --- Certainty = 0.3428 (Affirmative) <succ>
      bacterial membrane --- Certainty = 0.0000 (Not Clear) <succ>
        bacterial outside --- Certainty = 0.0000 (Not Clear) <succ>

---

An alignment of the GAS and GBS proteins is shown below.

```
Identities = 73/85 (85%), Positives = 79/85 (92%), Gaps = 1/85 (19%)
Query: 26  CAYEWNP-EEIEEEVGLIVLDSNGTRLSDGDTVTVIKDLKVKGAPKDIKQGTRVKNIRLV   84
           CA+EW P EE  EE GL+VLDSNG RLSDGDT+TV+KDLKVKGAPKD+KQGTRVKNIRLV
Sbjct:  2  CAFEWTPGEEATEEEGLVVLDSNGVRLSDGDTITVVKDLKVKGAPKDLKQGTRVKNIRLV   61

Query: 85  DGDHNIDCKIDGFGAMKLKSEFVKK                                     109
           +GDHNIDCKIDGFGAMKLKSEFVKK
Sbjct: 62  EGDHNIDCKIDGFGAMKLKSEFVKK                                      86
```

Based on this analysis, it was predicted that these proteins and their epitopes could be useful antigens for vaccines or diagnostics.

Example 1329

A DNA sequence (GBSx1412) was identified in *S. agalactiae* <SEQ ID 4075> which encodes the amino acid sequence <SEQ ID 4076>. Analysis of this protein sequence reveals the following:

---

Possible site: 22
>>> Seems to have no N-terminal signal sequence
----- Final Results -----
    bacterial cytoplasm --- Certainty = 0.3665 (Affirmative) <succ>
      bacterial membrane --- Certainty = 0.0000 (Not Clear) <succ>
        bacterial outside --- Certainty = 0.0000 (Not Clear) <succ>

---

The protein has no significant homology with any sequences in the GENPEPT database, but there is homology to SEQ ID 500.

Based on this analysis, it was predicted that this protein and its epitopes, could be useful antigens for vaccines or diagnostics.

Example 1330

A DNA sequence (GBSx1414) was identified in *S. agalactiae* <SEQ ID 4077> which encodes the amino acid sequence <SEQ ID 4078>. Analysis of this protein sequence reveals the following:

2301

Possible site: 13
\>\>\> Seems to have an uncleavable N-term signal seq
INTEGRAL    Likelihood = −0.11    Transmembrane 558-574 (558-574)
----- Final Results -----
    bacterial membrane --- Certainty = 0.1044 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:CAB11971 GB:Z99105 L-glutamine-D-fructose-6-phosphate
            amidotransferase [Bacillus subtilis]
Identities = 355/604 (58%), Positives = 445/604 (72%), Gaps = 4/604 (0%)
Query:   1  MCGIVGVVGNTNATDILIQGLEKLEYRGYDSAGIFVVGDNKSQLVKSVGRIAEIQAKVGD    60
            MCGIVG +G  +A +IL++GLEKLEYRGYDSAGI V   + K  GRIA+++   V
Sbjct:   1  MCGIVGYIGQLDAKEILLKGLEKLEYRGYDSAGIAVANEQGIHVFKEKGRIADLREVVDA   60

Query:  61  SVSGTTGIGHTRWATHGKPTEGNAHPHTSGSGRFVLVHNGVIENYLQIKETYLTKHNLKG   120
            +V    GIGHTRWATHG+P+  NAHPH S  GRF LVHNGVIENY+Q+K+  YL    LK
Sbjct:  61  NVEAKAGIGHTRWATHGEPSYLNAHPHQSALGRFTLVHNGVIENYVQLKQEYLQDVELKS   120

Query: 121  ETDTEIAIHLVEHFVEEDNLSVLEAFKKALHIIEGSYAFALIDSQDADTIYVAKNKSPLL   180
            +TDTE+ + ++E FV     L    EAF+K L +++GSYA AL D+ +  +TI+VAKNKSPLL
Sbjct: 121  DTDTEVVVQVIEQFVN-GGLETEEAFRKTLTLLKGSYAIALFDNDNRETIFVAKNKSPLL   179

Query: 181  IGLGNGYNMVCSDAMAMIRETSEYMEIHDKELVIVKKDSVEVQDYDGNVIERGSYTAELD   240
            +GLG+ +N+V SDAMAM++ T+EY+E+ DKE+VIV   D V +++ DG+VI R SY AELD
Sbjct: 180  VGLGDTFNVVASDAMAMLQVTNEYVELMDKEMVIVTDDQVVIKNLDGDVITRASYIAELD   239

Query: 241  LSDIGKGTYPFYMLKEIDEQPTVMRKLISTYANESGDMNVDSDIIKSVQEADRLYILAAG   300
             SDI KGTYP YMLKE DEQP VMRK+I TY +E+G ++V DI  +V EADR+YI+  G
Sbjct: 240  ASDIEKGTYPHYMLKETDEQPVVMRKIIQTYQDENGKLSVPGDIAAAVAEADRIYIIGCG   299

Query: 301  TSYHAGFAAKTMIEKLTDTPVELGVSSEWGYNMPLLSKKPMFILLSQSGETADSRQVLVK   360
            TSYHAG   K  IE   + PVE+ V+SE+ YNMPLLSKKP+FI LSQSGETADSR VLV+
Sbjct: 300  TSYHAGLVGKQYIEMWANVPVEVHVASEFSYNMPLLSKKPLFIFLSQSGETADSRAVLVQ   359

Query: 361  ANEMGIPSLTITNVPGSTLSREATYTMLIHAGPEIAVASTKAYTAQVATLAFLAKAVGEA   420
            +  +G  +LTITNVPGSTLSREA YT+L+HAGPEIAVASTKAYTAQ+A LA LA      +
Sbjct: 360  VKALGHKALTITNVPGSTLSREADYTLLLHAGPEIAVASTKAYTAQIAVLAVLASVAADK   419

Query: 421  NGKAEAKDFDLVHELSIVAQSIEATLSEKDVISEKVEQLLISTRNAFYIGRGNDYYVTME   480
            NG      FDLV EL I A  ++EA  +KD +     L  +RNAF+IGRG DY+V +E
Sbjct: 420  NGINIG--FDLVKELGIAANAMEALCDQKDEMEMIAREYLTVSRNAFFIGRGLDYFVCVE   477

Query: 481  AALKLKEISYIQTEGFAAGELKHGTISLIEDNTPVIALISADSTIAAHTRGNIQEVVSRG   540
             ALKLKEISYIQ EGFA GELKHGTI+LIE  TPV AL + +       RGN++EV +RG
Sbjct: 478  GALKLKEISYIQAEGFAGGELKHGTIALIEQGTPVFALATQEH-VNLSIRGNVKEVAARG   536

Query: 541  ANALIIVEEGLEREGDDIIVNKVHPFLSAISMVIPTQLIAYYASLQRGLDVDKPRNLAKA   600
            AN  II +GL+   D   ++  +V+P L+ +    V+P QLIAYYA+L RG DVDKPRNLAK+
Sbjct: 537  ANTCIISLKGLDDADDRFVLPEVNPALAPLVSVVPLQLIAYYAALHRGCDVDKPRNLAKS   596

Query: 601  VTVE                                                         604
            VTVE
Sbjct: 597  VTVE                                                         600
```

A related DNA sequence was identified in *S. pyogenes* <SEQ ID 4079> which encodes the amino acid sequence <SEQ ID 4080>. Analysis of this protein sequence reveals the following:

2302

Possible site: 39
\>\>\> Seems to have no N-terminal signal sequence
INTEGRAL    Likelihood = −1.06    Transmembrane 558-574 (558-574)
----- Final Results -----
    bacterial membrane --- Certainty = 0.1426 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:CAB11971 GB:Z99105 L-glutamine-D-fructose-6-phosphate
            amidotransferase [Bacillus subtilis]
Identities = 353/604 (58%), Positives = 445/604 (73%), Gaps = 4/604 (0%)
Query:   1  MCGIVGVVGNRNATDILMQGLEKLEYRGYDSAGIFVANANQTNLIKSVGRIADLRAKIGI    60
            MCGIVG +G  +A +IL++GLEKLEYRGYDSAGI VAN    ++ K  GRIADLR  +
Sbjct:   1  MCGIVGYIGQLDAKEILLKGLEKLEYRGYDSAGIAVANEQGIHVFKEKGRIADLREVVDA   60

Query:  61  DVAGSTGIGHTRWATHGQSTEDNAHPHTSQTGRFVLVHNGVIENYLHIKTEFLAGHDFKG   120
            +V     GIGHTRWATHG+ +  NAHPH S  GRF LVHNGVIENY+  K E+L   + K
Sbjct:  61  NVEAKAGIGHTRWATHGEPSYLNAHPHQSALGRFTLVHNGVIENYVQLKQEYLQDVELKS   120
```

```
-continued
Query:  121  QTDTEIAVHLIGKFVEEDKLSVLEAFKKSLSIIEGSYAFALMDSQATDTIYVAKNKSPLL   180
             TDTE+ V +I +FV    L    EAF+K+L++++GSYA AL D+   +TI+VARNKSPLL
Sbjct:  121  DTDTEVVVQVIEQFVNGG-LETEEAFRKTLTLLKGSYAIALFDNDNRETIFVAKNKSPLL   179

Query:  181  IGLGEGYNMVCSDAMAMIRETSEFMEIHDKELVILTKDKVTVTDYDGKELIRDSYTAELD   240
             +GLG+ +N+V SDAMAM++ T+E++E+ DKE+VI+T D+V + + DG + R SY AELD
Sbjct:  180  VGLGDTFNVVASDAMAMLQVTNEYVELMDKEMVIVTDDQVVIKNLDGDVITRASYIAELD   239

Query:  241  LSDIGKGTYPFYMLKEIDEQPTVMRQLISTYADETGNVQVDPAIITSIQEADRLYILAAG   300
             SDI KGTYP YMLKE DEQP VMR++I TY DE G + V    I  ++ EADR+YI+ G
Sbjct:  240  ASDIEKGTYPHYMLKETDEQPVVMRKIIQTYQDENGKLSVPGDIAAAVAEADRIYIIGCG   299

Query:  301  TSYHAGFATKNMLEQLTDTPVELGVASEWGYHMPLLSKKPMFILLSQSGETADSRQVLVK   360
             TSYHAG   K  +E    + PVE+ VASE+ Y+MPLLSKKP+FI LSQSGETADSR VLV+
Sbjct:  300  TSYHAGLVGKQYIEMWANVPVEVHVASEFSYNMPLLSKKPLFIFLSQSGETADSRAVLVQ   359

Query:  361  ANAMGIPSLTVTNVPGSTLSREATYTMLIHAGPEIAVASTKAYTAQIAALAFLAKAVGEA   420
                A+G  +LT+TNVPGSTLSREA YT+L+HAGPEIAVASTKAYTAQIA LA LA   +
Sbjct:  360  VKALGHKALTITNVPGSTLSREADYTLLLHAGPEIAVASTKAYTAQIAVLAVLASVAADK   419

Query:  421  NGKQEALDFNLVHELSLVAQSIEATLSEKDLVAEKVQALLATTRNAFYIGRGNDYYVAME   480
             NG    + F+LV EL + A ++EA   +KD +   + L  +RNAF+IGRG DY+V +E
Sbjct:  420  NGIN--IGFDLVKELGIAANAMEALCDQKDEMEMIAREYLTVSRNAFFIGRGLDYFVCVE   477

Query:  481  AALKLKEISYIQCEGFAAGELKHGTISLIEEDTPVIALISSSQLVASHTRGNIQEVAARG   540
              ALKLKEISYIQ EGFA GELKHGTI+LIE+ TPV AL +    + S  RGN++EVAARG
Sbjct:  478  GALKLKEISYIQAEGFAGGELKHGTIALIEQGTPVFALATQEHVNLS-IRGNVKEVAARG   536

Query:  541  AHVLTVVEEGLDREGDDIIVNKVHPFLAPIAMVIPTQLIAYYASLQRGLDVDKPRNLAKA   600
             A+     +GLD   D  ++ +V+P LAP+   V+P QLIAYYA+L RG DVDKPRNLAK+
Sbjct:  537  ANTCIISLKGLDDADDRFVLPEVNPALAPLVSVVPLQLIAYYAALHRGCDVDKPRNLAKS   596

Query:  601  VTVE                                                          604
             VTVE
Sbjct:  597  VTVE                                                          600
```

An alignment of the GAS and GBS proteins is shown below.

```
Identities = 500/604 (82%), Positives = 552/604 (90%)
Query:    1  MCGIVGVVGNTNATDILIQGLEKLEYRGYDSAGIFVVGDNKSQLVKSVGRIAEIQAKVGD   60
             MCGIVGVVGN NATDIL+QGLEKLEYRGYDSAGIFV    N++ L+KSVGRIA+++AK+G
Sbjct:    1  MCGIVGVVGNRNATDILMQGLEKLEYRGYDSAGIFVANANQTNLIKSVGRIADLRAKIGI   60

Query:   61  SVSGTTGIGHTRWATHGKPTEGNAHPHTSGSGRFVLVHNGVIENYLQIKETYLTKHNLKG   120
             V+G+TGIGHTRWATHG+ TE NAHPHTS +GRFVLVHNGVIENYL IK +L  H+ KG
Sbjct:   61  DVAGSTGIGHTRWATHGQSTEDNAHPHTSQTGRFVLVHNGVIENYLHIKTEFLAGHDFKG   120

Query:  121  ETDTEIAIHLVEHFVEEDNLSVLEAFKKALHIIEGSYAFALIDSQDADTIYVAKNKSPLL   180
             +TDTEIA+HL+  FVEED LSVLEAFKK+L IIEGSYAFAL+DSQ  DTIYVAKNKSPLL
Sbjct:  121  QTDTEIAVHLIGKFVEEDKLSVLEAFKKSLSIIEGSYAFALMDSQATDTIYVAKNKSPLL   180

Query:  181  IGLGNGYNMVCSDAMAMIRETSEYMEIHDKELVIVKKDSVEVQDYDGNVIERGSYTAELD   240
             IGLG GYNMVCSDAMAMIRETSE+MEIHDKELVI+ KD V V DYDG + R SYTAELD
Sbjct:  181  IGLGEGYNMVCSDAMAMIRETSEFMEIHDKELVILTKDKVTVTDYDGKELIRDSYTAELD   240

Query:  241  LSDIGKGTYPFYMLKEIDEQPTVMRKLISTYANESGDMNVDSDIIKSVQEADRLYILAAG   300
             LSDIGKGTYPFYMLKEIDEQPTVMR+LISTYA+E+G++ VD II S+QEADRLYILAAG
Sbjct:  241  LSDIGKGTYPFYMLKEIDEQPTVMRQLISTYADETGNVQVDPAIITSIQEADRLYILAAG   300

Query:  301  TSYHAGFAAKTMIEKLTDTPVELGVSSEWGYNMPLLSKKPMFILLSQSGETADSRQVLVK   360
             TSYHAGFA K M+E LTDTPVELGV+SEWGY+MPLLSKKPMFILLSQSGETADSRQVLVK
Sbjct:  301  TSYHAGFATKNMLEQLTDTPVELGVASEWGYHMPLLSKKPMFILLSQSGETADSRQVLVK   360

Query:  361  ANEMGIPSLTITNVPGSTLSREATYTMLIHAGPEIAVASTKAYTAQVATLAFLAKAVGEA   420
             AN MGIPSLT+TNVPGSTLSREATYTMLIHAGPEIAVASTKAYTAQ+A LAFLAKAVGEA
Sbjct:  361  ANAMGIPSLTVTNVPGSTLSREATYTMLIHAGPEIAVASTKAYTAQIAALAFLAKAVGEA   420

Query:  421  NGKAEAKDFDLVHELSIVAQSIEATLSEKDVISEKVEQLLISTRNAFYIGRGNDYYVTME   480
             NGK EA DF+LVHELS+VAQSIEATLSEKD+++EKV LL +TRNAFYIGRGNDYYV ME
Sbjct:  421  NGKQEALDFNLVHELSLVAQSIEATLSEKDLVAEKVQALLATTRNAFYIGRGNDYYVAME   480

Query:  481  AALKLKEISYIQTEGFAAGELKHGTISLIEDNTPVIALISADSTIAAHTRGNIQEVVSRG   540
             AALKLKEISYIQ EGFAAGELKHGTISLIE++TPVIALIS+   +A+HTRGNIQEV +RG
Sbjct:  481  AALKLKEISYIQCEGFAAGELKHGTISLIEEDTPVIALISSSQLVASHTRGNIQEVAARG   540

Query:  541  ANALIIVEEGLEREGDDIIVNKVHPFLSAISMVIPTQLIAYYASLQRGLDVDKPRNLAKA   600
             A+ L +VEEGL+REGDDIIVNKVHPFL+ I+MVIPTQLIAYYASLQRGLDVDKPRNLAKA
```

```
                            -continued
Sbjct: 541  AHVLTVVEEGLDREGDDIIVNKVHPFLAPIAMVIPTQLIAYYASLQRGLDVDKPRNLAKA   600

Query: 601  VTVE                                                          604
            VTVE
Sbjct: 601  VTVE                                                          604
```

Based on this analysis, it was predicted that these proteins and their epitopes could be useful antigens for vaccines or diagnostics.

Example 1331

A DNA sequence (GBSx1415) was identified in *S. agalactiae* <SEQ ID 4081> which encodes the amino acid sequence <SEQ ID 4082>. Analysis of this protein sequence reveals the following:

---

Possible site: 37
>>> Seems to have a cleavable N-term signal seq.
----- Final Results -----
   bacterial outside --- Certainty = 0.3000 (Affirmative) <succ>
     bacterial membrane --- Certainty = 0.0000 (Not Clear) <succ>
         bacterial cytoplasm --- Certainty = 0.0000 (Not Clear) <succ>

---

A related GBS nucleic acid sequence <SEQ ID 9797> which encodes amino acid sequence <SEQ ID 9798> was also identified.

The protein has homology with the following sequences in the GENPEPT database.

A related DNA sequence was identified in *S. pyogenes* <SEQ ID 4083> which encodes the amino acid sequence <SEQ ID 4084>. Analysis of this protein sequence reveals the following:

---

Possible site: 32
>>> Seems to have an uncleavable N-term signal seq'
INTEGRAL    Likelihood = −14.22    Transmembrane 10-26 (4-34)
----- Final Results -----
   bacterial membrane --- Certainty = 0.6689 (Affirmative) <succ>
     bacterial outside --- Certainty = 0.0000 (Not Clear) <succ>
         bacterial cytoplasm --- Certainty = 0.0000 (Not Clear) <succ>

---

```
>GP:AAC44435 GB:U65000 type-I signal peptidase SpsB [Staphylococcus
            aureus]
Identities = 62/185 (33%), Positives = 97/185 (51%), Gaps = 12/185 (6%)
Query:  10  VKRDFIRNIILALIAVLILILLRYFVFATFKVHKDATNSYFSNGDVVVVN----RNRTPK    65
            +K++ +  II  +A +IL ++  F+  + ++ +    +G+ V VN    +    +
Sbjct:   1  MKKELLEWIISIAVAFVILFIVGKFIVTPYTIKGESMDPTLKDGERVAVNIIGYKTGGLE    60

Query:  66  YKDFIVYKVGKIF-YISRVIGEPNQKVRVMDDILYLNDVFKDEPYIEKMKNAYSEKKDGQ   124
             + +V+   K   Y+ RVIG P  KV  +D LY+N  +DEPY+    N    + K G
Sbjct:  61  KGNVVVFHANKNDDYVKRVIGVPGDKVEYKNDTLYVNGKKQDEPYL----NYNLKHKQGD   116

Query: 125  MPFTSDFSVETL--TRNKESRVPKGSYLVLNDNRQNKNDSRKFGLIKEKDIRGVITFKVY   182
                 T  F V+ L       K + +PKG YLVL DNR+   DSR FGLI  E    I G ++F+ +
Sbjct: 117  Y-ITGTFQVKDLPNANPKSNVIPKGKYLVLGDNREVSKDSRAFGLIDEDQIVGKVSFRFW   175

Query: 183  PLSEF   187
            P SEF
Sbjct: 176  PFSEF   180
```

An alignment of the GAS and GBS proteins is shown below.

```
Identities = 99/185 (53%), Positives = 130/185 (69%)
Query:   9  MVKRDFIRNIILALIAVLILILLRYFVFATFKVHKDATNSYFSNGDVVVVNRNRTPKYKD    68
            MVKRDFIRNI+L LI ++   ILLR FVF+TFKV  +  N+Y  +GD+V + +N  PKYKD
Sbjct:   1  MVKRDFIRNILLLLIVIIGAILLRIFVFSTFKVSPETANTYLKSGDLVTIKKNIQPKYKD    60

Query:  69  FIVYKVGKIFYISRVIGEPNQKVRVMDDILYLNDVFKDEPYIEKMKNAYSEKKDGQMPFT   128
            F+VY+VGK  Y+SRVI     V MDDI YLN++ + +  Y+EKMK  Y         +T
Sbjct:  61  FVVYRVGKKDYVSRVIAVEGDSVTYMDDIFYLNNMVESQAYLEKMKAHYLNHAPFGTLYT   120

Query: 129  SDFSVETLTRNKESRVPKGSYLVLNDNRQNKNDSRKFGLIKEKDIRGVITFKVYPLSEFG   188
              DF+V T+T +K   +VPKG YL+LNDNR+N NDSR+FGLI     I G++TF+V PLS+FG
Sbjct: 121  DDFTVATITADKYQKVPKGKYLLLNDNRKNTNDSRRFGLINASQIKGLVTFRVLPLSDFG   180
```

```
Query: 189  FTASE          193
            F   E
Sbjct: 181  FVEVE          185
```

A related GBS gene <SEQ ID 8789> and protein <SEQ ID 8790> were also identified. Analysis of this protein sequence reveals the following:

---

Lipop: Possible site: −1 Crend: 10
McG: Discrim Score: 10.13
GvH: Signal Score (−7.5): 0.45
Possible site: 37
\>>> Seems to have a cleavable N-term signal seq.
ALOM program   count: 0 value: 3.82 threshold: 0.0
PERIPHERAL            Likelihood = 3.82              69
modified ALOM score: −1.26
*** Reasoning Step: 3
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

---

The protein has homology with the following sequences in the databases:

```
36.0/59.9% over 165aa
Bacillus caldolyticus
EGAD|24914| signal peptidase i Insert characterized
ORF00169(364-867 of 1179)
EGAD|24914|25718(15-180 of 182) signal peptidase i {Bacillus caldolyticus}
% Match = 11.9
% Identity = 35.9 % Similarity = 59.9
Matches = 60 Mismatches = 61 Conservative Sub.s = 40

312       342       372       402       432       462       483       510
L*KHDIMEKRLGVVMVKRDFIRNIILALIAVLILILLRYFVFATFKVHKDATNSYFSNGDVVVVNR---NRTPKYK-DFI
            ::||  ::  ||  |||:  :   :  :|::::||:    :  |  :||
         VTKQKEKRGRRWPWFVAVCVVATLRLFVFSNYVVEGKSMMPTLESGNLLIVNKLSYDIGPIRRFDII
              10        20        30        40        50        60

537       567       597       627       657       687       717       747
VYKVGKIF-YISRVIGEPNQKVRVMDDILYLNDVFKDEPYIEKMKNAYSEKKDGQMPFTSDFSVETLTRNKESRVPKGSY
|:   |  |: ||||  |  ::   :||||:|   ||||:  |   : ||::  | ||::|   :: ||| |
VFHANKKEDYVKRVIGLPGDRIAYKNDILYVNGKKVDEPYLRPYKQ---KLLDGRL--TGDFTLEEVT--GKTRVPPGCI
         80        90       100       110       120       130       140

777       807       837       867       897       927       957       987
LVLNDNRQNKNDSRKFGLIKEKDIRGVITFKVYPLSEFGFTASE**KNGII*YHSFYVIKWLRNIFF*DR*NF**RXXN*
:||  |||  :   |||  ||::|    |  |  :  |:  :|  |
FVLGDNRLSSWDDSRHFGFVKINQIVGKVDFRYWPFKQFAFQF
          150       160       170       180
```

---

Figure 262:
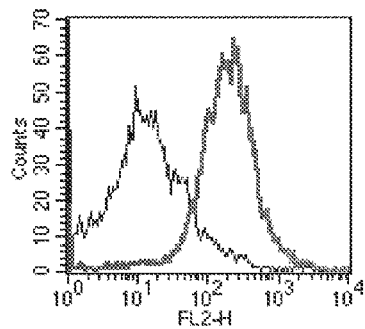

SEQ ID 8790 (GBS7) was expressed in *E. coli* as a GST-fusion product. SDS-PAGE analysis of total cell extract is shown in FIG. 1 (lane 4; MW 46 kDa). It was also expressed in *E. coli* as a His-fusion product. SDS-PAGE analysis of total cell extract is shown in FIG. 2 (lane 4; MW 21 kDa). The GBS7-His fusion product was purified (FIG. 189, lane 6) and used to immunise mice. The resulting antiserum was used for FACS (FIG. 262), which confirmed that the protein is immunoaccessible on GBS bacteria.

Based on this analysis, it was predicted that these proteins and their epitopes could be useful antigens for vaccines or diagnostics.

Example 1332

A DNA sequence (GBSx1416) was identified in *S. agalactiae* <SEQ ID 4085> which encodes the amino acid sequence <SEQ ID 4086>. Analysis of this protein sequence reveals the following:

---

Possible site: 54
\>>> Seems to have no N-terminal signal sequence
----- Final Results -----
   bacterial cytoplasm --- Certainty = 0.1099 (Affirmative) <succ>
      bacterial membrane --- Certainty = 0.0000 (Not Clear) <succ>
         bacterial outside --- Certainty = 0.0000 (Not Clear) <succ>

---

A related GBS nucleic acid sequence <SEQ ID 9795> which encodes amino acid sequence <SEQ ID 9796> was also identified.

The protein has homology with the following sequences in the GENPEPT database.

```
>GP:AAF25804 GB:AF172173 pyruvate kinase [Streptococcus thermophilus]
Identities = 413/500 (82%), Positives = 451/500 (89%)
Query:   1  MNKRVKIVATLGPAVEFRGGKKFGESGYWGESLDVEASAEKIAQLIKEGANVFRFNFSHG   60
            MNKRVKIVATLGPAVE RGGKKFGE GYW E LD +ASA+ IAQLI+EGANVFRFNFSHG
Sbjct:   1  MNKRVKIVATLGPAVEIRGGKKFGEDGYWSEKLDPDASAKNIAQLIEEGANVFRFNFSHG   60
```

```
Query:  61 DHAEQGARMATVRKAEEIAGQKVGFLLDTKGPEIRTELFEDGADFHSYTTGTKLRVATKQ   120
            +HAEQG RM  VR AE IAGQKVGFLLDTKGPEIRTELFE  A  ++Y TG ++R+ATKQ
Sbjct:  61 NHAEQGERMDVVRMAESIAGQKVGFLLDTKGPEIRTELFEGDAKEYAYKTGEQIRIATKQ   120

Query: 121 GIKSTPEVIALNVAGGLDIFDDVEVGKQILVDDGKLGLTVFAKDKDTREFEVVVENDGLI   180
            G+KST +VIALNVAG LDIFDDVEVGKQ+LVDDGKLGL V  KD +  REF V VENDG+I
Sbjct: 121 GLKSTRDVIALNVAGALDIFDDVEVGKQVLVDDGKLGLRVVDKDAEKREFIVEVENDGII   180

Query: 181 GKQKGVNIPYTKIPFPALAERDNADIRFGLEQGLNFIAISFVRTAKDVNEVRAICEETGN   240
              KQKGVNIPYTKIPFPALAERDNADIRFGLEQG+NFIAISFVRTAKDV EVRAICEETGN
Sbjct: 181 AKQKGVNIPYTKIPFPALAERDNADIRFGLEQGINFIAISFVRTAKDVQEVRAICEETGN   240

Query: 241 GHVKLFAKIENQQGIDNIDEIIEAADGIMIARGDMGIEVPFEMVPVYQKMIITKVNAAGK   300
            GHVKL  AKIENQQGIDNIDEIIEAADGIMIARGDMGIEVPFEMVPVYQKMIITKVNAAGK
Sbjct: 241 GHVKLLAKIENQQGIDNIDEIIEAADGIMIARGDMGIEVPFEMVPVYQKMIITKVNAAGK   300

Query: 301 AVITATNMLETMTDKPRATRSEVSDVFNAVIDGTDATMLSGESANGKYPVESVRTMATID   360
             V+TATNMLETMT+KPRATRSEVSDVFNAVIDGTDATMLSGESANG YPVESVRTMATI
Sbjct: 301 IVVTATNMLETMTEKPRATRSEVSDVFNAVIDGTDATMLSGESANGPYPVESVRTMATIH   360

Query: 361 KNAQTLLNEYGRLDSSAFPRNNKTDVIASAVKDATHSMDIKLVVTITETGNTARAISKFR   420
            KNAQTLL EYGRL+SS F R++ T+V+ASAVKDAT+SM I+L+V +TE+GNTA  I  +R
Sbjct: 361 KNAQTLLKEYGRLNSSTFDRSSNTEVVASAVKDATNSMHIQLIVALTESGNTASLIDTYR   420

Query: 421 PDADILAVTFDEKVQRSLMINWGVIPVLADKPASTDDMFEVAERVALEAGFVESGDNIVI   480
            P+ADI A+TFDE  Q+SLM+NWGVIPV+ + P+STDDMFEVAERVALE+G VESGDNIVI
Sbjct: 421 PEADIWAITFDELTQKSLMLNWGVIPVVTETPSSTDDMFEVAERVALESGLVESGDNIVI   480

Query: 481 VAGVPVGTGGTNTMRVRTVK                                         500
            VAGVPVG+G TNTMR+RTVK
Sbjct: 481 VAGVPVGSGNTNTMRIRTVK                                         500
```

A related DNA sequence was identified in *S. pyogenes* <SEQ ID 4087> which encodes the amino acid sequence <SEQ ID 4088>. Analysis of this protein sequence reveals the following:

Possible site: 54

>>> Seems to have no N-terminal signal sequence

----- Final Results ----- bacterial cytoplasm --- Certainty = 0.0915 (Affirmative) <succ> bacterial membrane --- Certainty = 0.0000 (Not Clear) <succ> bacterial outside --- Certainty = 0.0000 (Not Clear) <succ>

RGD motif: 272-274

The protein has homology with the following sequences in the databases:

```
>GP:AAF25804 GB:AF172173 pyruvate kinase [Streptococcus thermophilus]
 Identities = 404/500 (80%), Positives = 457/500 (90%)
 Query:    1 MNKRVKIVATLGPAVEIRGGKKYGEDGYWAGQLDVEESAKKIAELIEAGANVFRFNFSHG    60
             MNKRVKIVATLGPAVEIRGGKK+GEDGYW+ +LD + SAK IA+LIE GANVFRFNFSHG
 Sbjct:    1 MNKRVKIVATLGPAVEIRGGKKFGEDGYWSEKLDPDASAKNIAQLIEEGANVFRFNFSHG    60

Query:   61 DHKEQGDRMATVRLAEEIARQKVGFLLDTKGPEMRTELFADDAKEFSYVTGEKIRVATTQ   120
             +H EQG+RM  VR+AE IA QKVGFLLDTKGPE+RTELF  DAKE++Y TGE+IR+AT Q
 Sbjct:   61 NHAEQGERMDVVRMAESIAGQKVGFLLDTKGPEIRTELFEGDAKEYAYKTGEQIRIATKQ   120

Query:  121 GIQSTRDVIALNVAGSLDIYDEVEVGHTILIDDGKLGLKVIDKDIATRQFIVEVENDGII   180
             G++STRDVIALNVAG+LDI+D+VEVG  +L+DDGKLGL+V+DKD   R+FIVEVENDGII
 Sbjct:  121 GLKSTRDVIALNVAGALDIFDDVEVGKQVLVDDGKLGLRVVDKDAEKREFIVEVENDGII   180

Query:  181 AKQKGVNIPNTKIPFPALAERDNADIRFGLEQGLNFIAISFVRTAKDVEEVREICRETGN   240
             AKQKGVNIP TKIPFPALAERDNADIRFGLEQG+NFIAISFVRTAKDV+EVR IC ETGN
 Sbjct:  181 AKQKGVNIPYTKIPFPALAERDNADIRFGLEQGINFIAISFVRTAKDVQEVRAICEETGN   240

Query:  241 DHVQLFAKIENQQGIDNLDEIIEAADGIMIARGDMGIEVPFEMVPVFQKMIITKVNAAGK   300
               HV+L AKIENQQGIDN+DEIIEAADGIMIARGDMGIEVPFEMVPV+QKMIITKVNAAGK
 Sbjct:  241 GHVKLLAKIENQQGIDNIDEIIEAADGIMIARGDMGIEVPFEMVPVYQKMIITKVNAAGK   300

Query:  301 AVITATNMLETMTEKPRATRSEVSDVFNAVIDGTDATMLSGESANGKYPVESVRTMATID   360
             V+TATNMLETMTEKPRATRSEVSDVFNAVIDGTDATMLSGESANG YPVESVRTMATI
 Sbjct:  301 IVVTATNMLETMTEKPRATRSEVSDVFNAVIDGTDATMLSGESANGPYPVESVRTMATIH   360

Query:  361 RNAQTLLNEYGRLDSSAFPRTNKTDVIASAVKDATHSMDIKLVVTITETGNTARAISKFR   420
             +NAQTLL EYGRL+SS F R++ T+V+ASAVKDAT+SM I+L+V +TE+GNTA  I  +R
 Sbjct:  361 KNAQTLLKEYGRLNSSTFDRSSNTEVVASAVKDATNSMHIQLIVALTESGNTASLIDTYR   420
```

```
                              -continued
Query:  421  PDADILAVTFDEKVQRALMINWGVIPVLAEKPASTDDMFEVAERVAVEAGLVQSGDNIVI  480
             P+ADI A+TFDE  Q++LM+NWGVIPV+ E P+STDDMFEVAERVA+E+GLV+SGDNIVI
Sbjct:  421  PEADIWAITFDELTQKSLMLNWGVIPVVTETPSSTDDMFEVAERVALESGLVESGDNIVI  480

Query:  481  VAGVPVGTGGTNTMRVRTVK                                          500
             VAGVPVG+ GTNTMR+RTVK
Sbjct:  481  VAGVPVGSGNTNTMRIRTVK                                          500
```

An alignment of the GAS and GBS proteins is shown below.

```
Identities = 440/500 (88%), Positives = 462/500 (92%)
Query:    1  MNKRVKIVATLGPAVEFRGGKKFGESGYWGESLDVEASAEKIAQLIKEGANVFRFNFSHG   60
             MNKRVKIVATLGPAVE RGGKK+GE GYW   LDVE SA+KIA+LI+ GANVFRFNFSHG
Sbjct:    1  MNKRVKIVATLGPAVEIRGGKKYGEDGYWAGQLDVEESAKKIAELIEAGANVFRFNFSHG   60

Query:   61  DHAEQGARMATVRKAEEIAGQKVGFLLDTKGPEIRTELFEDGADFHSYTTGTKLRVATKQ  120
             DH EQG RMATVR AEEIA QKVGFLLDTKGPE+RTELF D A   SY TG K+RVAT Q
Sbjct:   61  DHKEQGDRMATVRLAEEIARQKVGFLLDTKGPEMRTELFADDAKEFSYVTGEKIRVATTQ  120

Query:  121  GIKSTPEVIALNVAGGLDIFDDVEVGKQILVDDGKLGLTVFAKDKDTREFEVVVENDGLI  180
             GI+ST +VIALNVAG LDI+D+VEVG  IL+DDGKLGL V  KD  TR+F V VENDG+I
Sbjct:  121  GIQSTRDVIALNVAGSLDIYDEVEVGHTILIDDGKLGLKVIDKDIATRQFIVEVENDGII  180

Query:  181  GKQKGVNIPYTKIPFPALAERDNADIRFGLEQGLNFIAISFVRTAKDVNEVRAICEETGN  240
              KQKGVNIP TKIPFPALAERDNADIRFGLEQGLNFIAISFVRTAKDV EVR IC ETGN
Sbjct:  181  AKQKGVNIPNTKIPFPALAERDNADIRFGLEQGLNFIAISFVRTAKDVEEVREICRETGN  240

Query:  241  GHVKLFAKIENQQGIDNIDEIIEAADGIMIARGDMGIEVPFEMVPVYQKMIITKVNAAGK  300
               HV+LFAKIENQQGIDN+DEIIEAADGIMIARGDMGIEVPFEMVPV+QKMIITKVNAAGK
Sbjct:  241  DHVQLFAKIENQQGIDNLDEIIEAADGIMIARGDMGIEVPFEMVPVFQKMIITKVNAAGK  300

Query:  301  AVITATNMLETMTDKPRATRSEVSDVFNAVIDGTDATMLSGESANGKYPVESVRTMATID  360
             AVITATNMLETMT+KPRATRSEVSDVFNAVIDGTDATMLSGESANGKYPVESVRTMATID
Sbjct:  301  AVITATNMLETMTEKPRATRSEVSDVFNAVIDGTDATMLSGESANGKYPVESVRTMATID  360

Query:  361  KNAQTLLNEYGRLDSSAFPRNNKTDVIASAVKDATHSMDIKLVVTITETGNTARAISKFR  420
             +NAQTLLNEYGRLDSSAFPR NKTDVIASAVKDATHSMDIKLVVTITETGNTARAISKFR
Sbjct:  361  RNAQTLLNEYGRLDSSAFPRTNKTDVIASAVKDATHSMDIKLVVTITETGNTARAISKFR  420

Query:  421  PDADILAVTFDEKVQRSLMINWGVIPVLADKPASTDDMFEVAERVALEAGFVESGDNIVI  480
             PDADILAVTFDEKVQR+LMINWGVIPVLA+KPASTDDMFEVAERVA+EAG V+SGDNIVI
Sbjct:  421  PDADILAVTFDEKVQRALMINWGVIPVLAEKPASTDDMFEVAERVAVEAGLVQSGDNIVI  480

Query:  481  VAGVPVGTGGTNTMRVRTVK                                          500
             VAGVPVGTGGTNTMRVRTVK
Sbjct:  481  VAGVPVGTGGTNTMRVRTVK                                          500
```

A related GBS gene <SEQ ID 8791> and protein <SEQ ID 8792> were also identified. Analysis of this protein sequence reveals the following:

Belongs to Glycolysis/gluconeogenesis pathway. Proteins belonging to this methanolic pathway have been experimentally detected on the surface of Streptococci.

The protein has homology with the following sequences in the databases:

```
>GP|6708108|gb|AAF25804.1|AF172173_2|AF172173 pyruvate kinase
{Streptococcus thermophilus}
Score = 821 bits (2098), Expect = 0.0
Identities = 412/500 (82%), Positives = 450/500 (89%)
Query:    1  MNKRVKIVATLGPAVEFRGGKKFGESGYWGESLDVEASAEKIAQLIKEGANVFRFNFSHG   60
             MNKRVKIVATLGPAVE RGGKKFGE GYW E LD +ASA+ IAQLI+EGANVFRFNFSHG
Sbjct:    1  MNKRVKIVATLGPAVEIRGGKKFGEDGYWSEKLDPDASAKNIAQLIEEGANVFRFNFSHG   60

Query:   61  DHAEQGARMATVRKAEEIAGQKVGFLLDTKGPEIRTELFEDGADFHSYTTGTKLRVATKQ  120
             +HAEQG RM  VR AE IAGQKVGFLLDTKGPEIRTELFE  A   ++Y TG ++R+ATKQ
Sbjct:   61  NHAEQGERMDVVRMAESIAGQKVGFLLDTKGPEIRTELFEGDAKEYAYKTGEQIRIATKQ  120

Query:  121  GIKSTPEVIALNVAGGLDIFDDVEVGKQILVDDGKLGLTVFAKDKDTREFEVVVENDGLI  180
             G+KST +VIALNVAG LDIFDDVEVGKQ+LVDDGKLGL V  KD +  REF V VENDG+I
Sbjct:  121  GLKSTRDVIALNVAGALDIFDDVEVGKQVLVDDGKLGLRVVDKDAEKREFIVEVENDGII  180

Query:  181  GKQKGVNIPYTKIPFPALAERDNADIRFGLEQGLNFIAISFVRTAKDVNEVRAICEETGX  240
```

```
                  KQKGVNIPYTKIPFPALAERDNADIRFGLEQG+NFIAISFVRTAKDV EVRAICEETG
Sbjct:  181       AKQKGVNIPYTKIPFPALAERDNADIRFGLEQGINFIAISFVRTAKDVQEVRAICEETGN    240

Query:  241       GHVKLFAKIENQQGIDNDEIIEAADGIMIARGDMGIEVPFEMVPVYQKMIITKVNAAGK    300
                  GHVKL AKIENQQGIDNDEIIEAADGIMIARGDMGIEVPFEMVPVYQKMIITKVNAAGK
Sbjct:  241       GHVKLLAKIENQQGIDNDEIIEAADGIMIARGDMGIEVPFEMVPVYQKMIITKVNAAGK    300

Query:  301       AVITATNMLETMTDKPRATRSEVSDVFNAVIDGTDATMLSGESANGKYPVESVRTMATID   360
                  V+TATNMLETMT+KPRATRSEVSDVFNAVIDGTDATMLSGESANG YPVESVRTMATI
Sbjct:  301       IVVTATNMLETMTEKPRATRSEVSDVFNAVIDGTDATMLSGESANGPYPVESVRTMATIH   360

Query:  361       KNAQTLLNEYGRLDSSAFPRNNKTDVIASAVKDATHSMDIKLVVTITETGNTARAISKFR   420
                  KNAQTLL EYGRL+SS F R++ T+V+ASAVKDAT+SM I+L+V +TE+GNTA  I   +R
Sbjct:  361       KNAQTLLKEYGRLNSSTFDRSSNTEVVASAVKDATNSMHIQLIVALTESGNTASLIDTYR   420

Query:  421       PDADILAVTFDEKVQRSLMINWGVIPVLADKPASTDDMFEVAERVALEAGFVESGDNIVI   480
                  P+ADI A+TFDE  Q+SLM+NWGVIPV+ +  P+STDDMFEVAERVALE+G VESGDNIVI
Sbjct:  421       PEADIWAITFDELTQKSLMLNWGVIPVVTETPSSTDDMFEVAERVALESGLVESGDNIVI   480

Query:  481       VAGVPVGTGGTNTMRVRTVK                                          500
                  VAGVPVG+G TNTMR+RTVK
Sbjct:  481       VAGVPVGSGNTNTMRIRTVK                                          500
```

SEQ ID 8792 (GBS330) was expressed in *E. coli* as a His-fusion product. SDS-PAGE analysis of total cell extract is shown in FIG. 73 (lane 5; MW 59 kDa).

GBS330-His was purified as shown in FIG. 213, lane 6.

Based on this analysis, it was predicted that these proteins and their epitopes could be useful antigens for vaccines or diagnostics.

Example 1333

A DNA sequence (GBSx1417) was identified in *S. agalactiae* <SEQ ID 4089> which encodes the amino acid sequence <SEQ ID 4090>. Analysis of this protein sequence reveals the following:

Possible site: 18
>>> Seems to have no N-terminal signal sequence
----- Final Results -----
  bacterial cytoplasm --- Certainty = 0.0632 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database.

Proteins in the glycolysis/gluconeogenesis pathway have been experimentally detected on the surface of Streptococci.

A related DNA sequence was identified in *S. pyogenes* <SEQ ID 4091> which encodes the amino acid sequence <SEQ ID 4092>. Analysis of this protein sequence reveals the following:

Possible site: 18
>>> Seems to have no N-terminal signal sequence
----- Final Results -----
  bacterial cytoplasm --- Certainty = 0.0632 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
>GP:AAF25803 GB:AF172173 phosphofructokinase [Streptococcus thermophilus]
Identities = 270/337 (80%), Positives = 302/337 (89%), Gaps = 1/337 (0%)
Query:    1       MKRIAVLTSGGDAPGMNAAIRAVVRKAISEGMEVYGINQGYYGMVTGDIFPLDANSVGDT    60
                  MKRIAVLTSGGDAPGMNAA+RAVV KAISEG+EV+GIN+GY GMV GDIF LDA  V +
Sbjct:    1       MKRIAVLTSGGDAPGMNAAVRAVVLKAISEGIEVFGINRGYAGMVEGDIFKLDAKRVENI   60

Query:   61       INRGGTFLRSARYPEFAELEGQLKGIEQLKKHGIEGVVVIGGDGSYHGAMRLTEHGFPAV   120
                  ++RGGTFL+SARYPEFA+LEGQLKGIEQLKK+GIEGVVVIGGDGSYHGAMRLTEHGFPAV
Sbjct:   61       LSRGGTFLQSARYPEFAQLEGQLKGIEQLKKYGIEGVVVIGGDGSYHGAMRLTEHGFPAV   120

Query:  121       GLPGTIDNDIVGTDYTIGFDTAVATAVENLDRLRDTSASHNRTFVVEVMGRNAGDIALWS   180
                  GLPGTIDNDIVGTDYTIGFDTAVATA E  LD+++DT+ SH RTFVVEVMGRNAGDIALW+
Sbjct:  121       GLPGTIDNDIVGTDYTIGFDTAVATATEALDKIQDTAFSHGRTFVVEVMGRNAGDIALWA   180

Query:  181       GIAAGADQIIVPEEEFNIDEVVSNVRAGYAAG-KHHQIIVLAEGVMSGDEFAKTMKAAGD   239
                  GIA+GADQIIVPEEE++I+EVV  V+ GY +G K H IIVLAEGVM  +EFA  MK AGD
Sbjct:  181       GIASGADQIIVPEEEYDINEVVRKVKEGYESGEKSHHIIVLAEGVMGAEEFAAKMKEAGD   240

Query:  240       DSDLRVTNLGHLLRGGSPTARDRVLASRMGAYAVQLLKEGRGGLAVGVHNEEMVESPILG   299
                  SDLR TNLGH++RGGSPTARDRVLAS MGA+AV LLKEG GG+AVG+HNE++VESPILG
Sbjct:  241       TSDLRATNLGHVIRGGSPTARDRVLASWMGAHAVDLLKEGIGGVAVGIHNEQLVESPILG   300

Query:  300       LAEEGALFSLTDEGKIVVNNPHKADLRLAALNRDLAN                         336
                  +AEEGALFSLT++GKI+VNNPHKA L  A LNR LAN
Sbjct:  301       TAEEGALFSLTEDGKIIVNNPHKARLDFAELNRSLAN                         337
```

```
Identities = 274/336 (81%), Positives = 306/336 (90%), Gaps = 1/336 (0%)
Query:   1  MKRIAVLTSGGDAPGMNAAIRAVVRKAISEGMEVYGINQGYYGMVTGDIFPLDANSVGDT   60
            MKRIAVLTSGGDAPGMNAAIRAVVRKAISEGMEVYGIN+GY GMV GDIFPL + VGD
Sbjct:   1  MKRIAVLTSGGDAPGMNAAIRAVVRKAISEGMEVYGINRGYAGMVDGDIFPLGSKEVGDK   60

Query:  61  INRGGTFLRSARYPEFAELEGQLKGIEQLKKHGIEGVVVIGGDGSYHGAMRLTEHGFPAV  120
            I+RGGTFL SARYPEFA+LEGQL GIEQLKKHGIEGVVVIGGDGSYHGAMRLTEHGFPAV
Sbjct:  61  ISROGTFLYSARYPEFAQLEGQLAGIEQLKKHGIEGVVVIGGDGSYHGAMRLTEHGFPAV  120

Query: 121  GLPGTIDNDIVGTDYTIGFDTAVATAVENLDRLRDTSASHNRTFVVEVMGRNAGDIALWS  180
            G+PGTIDNDI GTDYTIGFDTAV TAVE +D+LRDTS+SH RTFVVEVMGRNAGDIALW+
Sbjct: 121  GIPGTIDNDIAGTDYTIGFDTAVNTAVEAIDKLRDTSSSHGRTFVVEVMGRNAGDIALWA  180

Query: 181  GIAAGADQIIVPEEEFNIDEVVSNVRAGYA-AGKHHQIIVLAEGVMSGDEFAKTMKAAGD  239
            GIA+GADQIIVPEEEF+I++V S ++ +   GK+H IIVLAEGVMSG+ FA+ +K AGD
Sbjct: 181  GIASGADQIIVPEEEFDIEKVASTIQYDFEHKGKNHHIIVLAEGVMSGEAFAQKLKEAGD  240

Query: 240  DSDLRVTNLGHLLRGGSPTARDRVLASRMGAYAVQLLKEGRGGLAVGVHNEEMVESPILG  299
            SDLRVTNLGH+LRGGSPTARDRV+AS MG++AV+LLK+G+GGLAVG+HNEE+VESPILG
Sbjct: 241  KSDLRVTNLGHILRGGSPTARDRVIASWMGSHAVELLKDGKGGLAVGIHNEELVESPILG  300

Query: 300  LAEEGALFSLTDEGKIVVNNPHKADLRLAALNRDLA                         335
            AEEGALFSLT+EGKI+VNNPHKA L  AALNR L+
Sbjct: 301  TAEEGALFSLTEEGKIIVNNPHKARLDFAALNRSLS                         336
```

SEQ ID 4090 (GBS313) was expressed in *E. coli* as a His-fusion product. SDS-PAGE analysis of total cell extract is shown in FIG. 45 (lane 5; MW 41 kDa).

Figure 204:
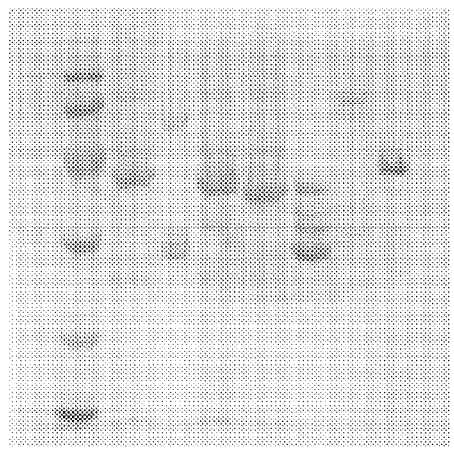

GBS313-His was purified as shown in FIG. 204, lane 4.

Based on this analysis, it was predicted that these proteins and their epitopes could be useful antigens for vaccines or diagnostics.

Example 1334

A DNA sequence (GBSx1418) was identified in *S. agalactiae* <SEQ ID 4093> which encodes the amino acid sequence <SEQ ID 4094>. This protein is predicted to be DNA polymerase III alpha subunit (dnaE). Analysis of this protein sequence reveals the following:

---
Possible site: 55
>>> Seems to have no N-terminal signal sequence
----- Final Results -----
  bacterial cytoplasm --- Certainty = 0.1446 (Affirmative) <succ>
    bacterial membrane --- Certainty = 0.0000 (Not Clear) <succ>
      bacterial outside --- Certainty = 0.0000 (Not Clear) <succ>
---

There is also homology to SEQ ID 4096.

Based on this analysis, it was predicted that this protein and its epitopes, could be useful antigens for vaccines or diagnostics.

Example 1335

A DNA sequence (GBSx1419) was identified in *S. agalactiae* <SEQ ID 4097> which encodes the amino acid sequence <SEQ ID 4098>. This protein is predicted to be YHCF (farR). Analysis of this protein sequence reveals the following:

---
Possible site: 52
>>> Seems to have no N-terminal signal sequence
----- Final Results -----
  bacterial cytoplasm --- Certainty = 0.3316 (Affirmative) <succ>
    bacterial membrane --- Certainty = 0.0000 (Not Clear) <succ>
      bacterial outside --- Certainty = 0.0000 (Not Clear) <succ>
---

The protein has homology with the following sequences in the GENPEPT database.

```
>GP:BAB04102 GB:AP001508 transcriptional regulator (GntR family)
[Bacillus halodurans]
Identities = 51/116 (43%), Positives = 79/116 (67%)
Query:  5  FNEKSPIYSQIAEHIKMQIVSQEIKSGDQLPTVRELAQEAGVNPNTMQRAFTELEREGMV   64
           F+  PIY Q+AE +K QIV  E++ G++LP+VR++  EA VNPNT+QR + ELE   +V
Sbjct:  5  FHSSEPIYLQLAERVKRQIVRGELRLGEKLPSVRDMGIEANVNPNTVQRTYRELEGLKIV   64

Query: 65  FSQRTSGRFVTEDNLLIGKIRQQVAKAELATFVNNMKKIGYKLDEITVALDHFIKE      120
           S+R  G FVTED ++  IR+Q+ + E++ FV  M+++GY  +EI   L+ ++ E
Sbjct: 65  ESKRGQGTFVTEDEQVLQAIREQMKETEISHFVQGMREMGYSDNEIQAGLESYLTE      120
```

A related DNA sequence was identified in *S. pyogenes* <SEQ ID 4099> which encodes the amino acid sequence <SEQ ID 4100>. Analysis of this protein sequence reveals the following:

---
Possible site: 25
>>> Seems to have no N-terminal signal sequence
----- Final Results -----
  bacterial cytoplasm --- Certainty = 0.2075 (Affirmative) <succ>
    bacterial membrane --- Certainty = 0.0000 (Not Clear) <succ>
      bacterial outside --- Certainty = 0.0000 (Not Clear) <succ>
---

An alignment of the GAS and GBS proteins is shown below.

```
Identities = 80/120 (66%), Positives = 100/120 (82%)
Query:   1  MAWEFNEKSPIYSQIAEHIKMQIVSQEIKSGDQLPTVRELAQEAGVNPNTMQRAFTELER    60
            M+W+F EKSPIY+QIA+H+ MQI+SQEIKSGDQLPTVRE A+ AGVNPNTMQRAFTELER
Sbjct:   1  MSWKFEEKSPIYAQIAQHVMMQIISQEIKSGDQLPTVREYAEIAGVNPNTMQRAFTELER    60

Query:  61  EGMVFSQRTSGRFVTEDNLLIGKIRQQVAKAELATFVNNMKKIGYKLDEITVALDHFIKE   120
            EGMV+SQRT+GRFVT+D  LI + R+++A +EL +F+ NM K+G+   EI   L F+KE
Sbjct:  61  EGMVYSQRTAGRFVTDDQKLIARKRRELAISELESFITNMTKMGFSHTEIIPVLTSFLKE   120
```

Based on this analysis, it was predicted that these proteins and their epitopes could be useful antigens for vaccines or diagnostics.

Example 1336

A DNA sequence (GBSx1420) was identified in *S. agalactiae* <SEQ ID 4101> which encodes the amino acid sequence <SEQ ID 4102>. This protein is predicted to be ABC transporter, ATP-binding protein (yhcG). Analysis of this protein sequence reveals the following:

---

Possible site: 26
>>> Seems to have no N-terminal signal sequence
----- Final Results -----
 bacterial cytoplasm --- Certainty = 0.2757 (Affirmative) <succ>
 bacterial membrane --- Certainty = 0.0000 (Not Clear) <succ>
 bacterial outside --- Certainty = 0.0000 (Not Clear) <succ>

---

The protein has homology with the following sequences in the GENPEPT database.

```
>GP:CAB12735 GB:Z99108 similar to glycine betaine/L-proline
transport [Bacillus subtilis]
Identities = 87/228 (38%), Positives = 150/228 (65%), Gaps = 1/228 (0%)
Query:   5  LQLHHVTKKYHKHTAVNDVTVSIPTGKIIGLLGPNGSGKTTIIKMINGLLQPDKGDIVID    64
            ++L  HV+KKY +HTAVNDV++++ +G+I GL+GPNGSGK+T +KM+ GLL P  G + +D
Sbjct:   3  IKLEHVSKKYGRHTAVNDVSITLSSGRIYGLIGPNGSGKSTTLKMMAGLLFPTSGFVKVD    62

Query:  65  GYRPSVETKKIISYLPDTSYLQENMKIKDVVTLFEDFYNDFDSKVAYQLFEDLNLNPRER   124
            + + E +  +YL +       +KD+V ++  + DF +  Y+L ++ LNP ++
Sbjct:  63  EEQVTREMVRQTAYLTELDMFYPHFTVKDMVNFYQSQFPDFHTEQVYKLLNEMQLNPEKK   122

Query: 125  LKNLSKGNKEKVQLILVMSRKARLYILDEPIGGVDPAARDYILKTIISNYSNDAS-VLIS   183
            +K LSKGN+ +++++L ++R+A + +LDEP  G+DP   RD I+ +++S      V+I+
Sbjct: 123  IKKLSKGNRGRLKIVLALARRADVILLDEPFSGLDPMVRDSIVNSLVSYIDFEQQIVVIA   182

Query: 184  THLISDIEPILDEVIFLKEGEIDLQGNADDLREEHNCSIDALFRERFK              231
            TH I +IE +LDEVI L  GE  Q    +D+RE+   S+  F+ + +
Sbjct: 183  THEIDEIETLLDEVIILANGEKVAQREVEDIREQEGMSVLQWFKSKME              230
```

A related DNA sequence was identified in *S. pyogenes* <SEQ ID 4103> which encodes the amino acid sequence <SEQ ID 4104>. Analysis of this protein sequence reveals the following:

---

Possible site: 13
>>> Seems to have no N-terminal signal sequence
----- Final Results -----
 bacterial cytoplasm --- Certainty = 0.1983 (Affirmative) <succ>
 bacterial membrane --- Certainty = 0.0000 (Not Clear) <succ>
 bacterial outside --- Certainty = 0.0000 (Not Clear) <succ>

---

An alignment of the GAS and GBS proteins is shown below.

```
Identities = 171/231 (74%), Positives = 200/231 (86%)
Query:   1  MTQLLQLHHVTKKYHKHTAVNDVTVSIPTGKIIGLLGPNGSGKTTIIKMINGLLQPDKGD    60
            M  LLQLHHV+K Y +  A++D+T++IP GKIIGLLGPNGSGKTT+IK+INGLLQP+KG+
Sbjct:   1  MAHLLQLHHVSKSYREKKAIDDLTITIPNGKIIGLLGPNGSGKTTLIKLINGLLQPNKGE    60

Query:  61  IVIDGYRPSVETKKIISYLPDTSYLQENMKIKDVVTLFEDFYNDFDSKVAYQLFEDLNLN   120
            IVIDGYRP VETKKIISYLPDT+YL ENM+IKD++  F DFY+DFD   A  L  DL L+
Sbjct:  61  IVIDGYRPCVETKKIISYLPDTTYLNENMRIKDMLEFFSDFYSDFDKSKATSLLRDLELD   120

Query: 121  PRERLKNLSKGNKEKVQLILVMSRKARLYILDEPIGGVDPAARDYILKTIISNYSNDASV   180
            P +R K LSKGNKEKVQLILVMSRKARLY+LDEPIGGVDPAARDYILKTII++Y  +ASV
Sbjct: 121  PEDRFKTLSKGNKEKVQLILVMSRKARLYVLDEPIGGVDPAARDYILKTIINSYCENASV   180
```

```
Query:  181  LISTHLISDIEPILDEVIFLKEGEIDLQGNADDLREEHNCSIDALFRERFK      231
             +ISTHLISDIEPILDEVIFLK+G + L GNADDLR+E+  SID+LFRE +K
Sbjct:  181  IISTHLISDIEPILDEVIFLKQGRLFLSGNADDLRQEYQQSIDSLFRETYK      231
```

Based on this analysis, it was predicted that these proteins and their epitopes could be useful antigens for vaccines or diagnostics.

Example 1337

A DNA sequence (GBSx1421) was identified in *S. agalactiae* <SEQ ID 4105> which encodes the amino acid sequence <SEQ ID 4106>. Analysis of this protein sequence reveals the following:

Possible site: 48
>>> Seems to have an uncleavable N-term signal seq
INTEGRAL  Likelihood = −15.39  Transmembrane 120-136  (103-146)
INTEGRAL  Likelihood = −9.98   Transmembrane 55-71    (47-79)
INTEGRAL  Likelihood = −9.45   Transmembrane 22-38    (15-43)
INTEGRAL  Likelihood = −6.05   Transmembrane 192-208  (187-218)
INTEGRAL  Likelihood = −4.94   Transmembrane 230-246  (228-253)
INTEGRAL  Likelihood = −4.78   Transmembrane 157-173  (155-175)
INTEGRAL  Likelihood = −1.44   Transmembrane 103-119  (103-119)
----- Final Results -----
  bacterial membrane --- Certainty = 0.7156 (Affirmative) <succ>
  bacterial outside --- Certainty = 0.0000 (Not Clear) <succ>
  bacterial cytoplasm --- Certainty = 0.0000 (Not Clear) <succ>

The protein has no significant homology with any sequences in the GENPEPT database.

A related DNA sequence was identified in *S. pyogenes* <SEQ ID 4107> which encodes the amino acid sequence <SEQ ID 4108>. Analysis of this protein sequence reveals the following:

Possible site: 28
>>> Seems to have a cleavable N-term signal seq.
INTEGRAL  Likelihood = −11.52  Transmembrane 190-206  (187-215)
INTEGRAL  Likelihood = −10.67  Transmembrane 121-137  (104-141)
INTEGRAL  Likelihood = −5.73   Transmembrane 63-79    (59-82)
INTEGRAL  Likelihood = −4.83   Transmembrane 158-174  (156-181)
INTEGRAL  Likelihood = −1.38   Transmembrane 232-248  (232-248)
INTEGRAL  Likelihood = −0.85   Transmembrane 104-120  (104-120)
----- Final Results -----
  bacterial membrane --- Certainty = 0.5607 (Affirmative) <succ>
  bacterial outside --- Certainty = 0.0000 (Not Clear) <succ>
  bacterial cytoplasm --- Certainty = 0.0000 (Not Clear) <succ>

The protein has no significant homology with any sequences in the GENPEPT database.

An alignment of the GAS and GBS proteins is shown below.

```
Identities = 116/267 (43%), Positives = 165/267 (61%), Gaps = 13/267 (4%)
Query:    1  MFGKLLKYELKSVGKWYLTLNAAVLLVSIILGLVLKALG-----GNFSTDTNSTSAQIFT   55
             MFGKLLKYE +S+GKWY   LNA V+ ++ IL    +K         G F  TN    ++
Sbjct:    1  MFGKLLKYEFRSIGKWYFALNAFVIAIAAILSFTIKLFAQSNSDGLFGVLTN----KMLP   56

Query:   56  IILVLLLAMVISGSLLSTLAIIIKRFYSNIFGRQGYLTLTLPVTTNQIICSKLLASLLWS  115
             + L L      +I+GSLLSTL IIIKRF  ++FG +GYLTLTLPV ++QII SKLLAS + S
Sbjct:   57  LTLGLTFGSLIAGSLLSTLLIIIKRFSKSVFGWEGYLTLTLPVNSHQIILSKLLASFICS  116

Query:  116  IFNIFIVIIGIILVILPLVGIGQFVVAFPEIYKIISSSNAPLFIAYFFLSYVAGTLLIYL  175
             +FN  I+    I +VI+P+    I + +    F   +K+      N    +AY LS      LLIYL
Sbjct:  117  VFNTIILAFAIAIVIVPMFNINELLEGFFNSFKMDYFINMLTVLAYVLLSTFTSILLIYL  176

Query:  176  SIAVGQLFTNKRVLMGIVSYFGISLLITFLTLIIDSIFHIDLFNSHANA-TFSQPVLLY-  233
             SI++GQLF+N+R LM   ++YF + +LI+       + S  HI     N+ A++   F++        +Y
Sbjct:  177  SISIGQLFSNRRGLMAFIAYFILVILISVAATYVHS--HIFNINTSADSFPFTEQKTIYL  234

Query:  234  NILVSIVEIAIFYMLTHSIIKYKLNIQ                                   260
              IL    +E+  +FY+ T+  IIK KLN+Q
Sbjct:  235  LILEQFIEMIMFYLATNFIIKNKLNLQ                                   261
```

Based on this analysis, it was predicted that these proteins and their epitopes could be useful antigens for vaccines or diagnostics.

Example 1338

A DNA sequence (GBSx1422) was identified in *S. agalactiae* <SEQ ID 4109> which encodes the amino acid sequence <SEQ ID 4110>. Analysis of this protein sequence reveals the following:

Possible site: 17
>>> Seems to have no N-terminal signal sequence
----- Final Results -----
  bacterial cytoplasm --- Certainty = 0.5890 (Affirmative) <succ>
  bacterial membrane --- Certainty = 0.0000 (Not Clear) <succ>
  bacterial outside --- Certainty = 0.0000 (Not Clear) <succ>

The protein is similar to ORF24 from *S. faecalis*.

No corresponding DNA sequence was identified in *S. pyogenes*.

Based on this analysis, it was predicted that this protein and its epitopes, could be useful antigens for vaccines or diagnostics.

Example 1339

A DNA sequence (GBSx1423) was identified in *S. agalactiae* <SEQ ID 4111> which encodes the amino acid sequence <SEQ ID 4112>. Analysis of this protein sequence reveals the following:

Possible site: 61
>>> Seems to have no N-terminal signal sequence
----- Final Results -----
 bacterial cytoplasm --- Certainty = 0.3316 (Affirmative) <succ>
 bacterial membrane --- Certainty = 0.0000 (Not Clear) <succ>
 bacterial outside --- Certainty = 0.0000 (Not Clear) <succ>

The protein is similar to ORF23 from *S. faecalis*. No corresponding DNA sequence was identified in *S. pyogenes*.

Based on this analysis, it was predicted that this protein and its epitopes, could be useful antigens for vaccines or diagnostics.

Example 1340

A DNA sequence (GBSx1424) was identified in *S. agalactiae* <SEQ ID 4113> which encodes the amino acid sequence <SEQ ID 4114>. Analysis of this protein sequence reveals the following:

Possible site: 25
>>> Seems to have no N-terminal signal sequence
----- Final Results -----
 bacterial cytoplasm --- Certainty = 0.4256 (Affirmative) <succ>
 bacterial membrane --- Certainty = 0.0000 (Not Clear) <succ>
 bacterial outside --- Certainty = 0.0000 (Not Clear) <succ>

The protein is similar to ORF22 from *S. faecalis*. No corresponding DNA sequence was identified in *S. pyogenes*.

Based on this analysis, it was predicted that this protein and its epitopes, could be useful antigens for vaccines or diagnostics.

Example 1341

A DNA sequence (GBSx1425) was identified in *S. agalactiae* <SEQ ID 4115> which encodes the amino acid sequence <SEQ ID 4116>. Analysis of this protein sequence reveals the following:

Possible site: 39
>>> Seems to have an uncleavable N-term signal seq
 INTEGRAL   Likelihood = −13.37  Transmembrane  62-78  (55-84)
 INTEGRAL   Likelihood = −8.44   Transmembrane  19-35  (14-41)
----- Final Results -----
 bacterial membrane --- Certainty = 0.6349 (Affirmative) <succ>
 bacterial outside --- Certainty = 0.0000 (Not Clear) <succ>
 bacterial cytoplasm --- Certainty = 0.0000 (Not Clear) <succ>

The protein is similar to ORF21 from *S. faecalis*.

A related DNA sequence was identified in *S. pyogenes* <SEQ ID 4117> which encodes the amino acid sequence <SEQ ID 4118>. Analysis of this protein sequence reveals the following:

Possible site: 37
>>> Seems to have no N-terminal signal sequence
----- Final Results -----
 bacterial cytoplasm --- Certainty = 0.2444 (Affirmative) <succ>
 bacterial membrane --- Certainty = 0.0000 (Not Clear) <succ>
 bacterial outside --- Certainty = 0.0000 (Not Clear) <succ>

An alignment of the GAS and GBS proteins is shown below.

```
Identities = 54/236 (22%), Positives = 95/236 (39%), Gaps = 12/236 (5%)
Query: 204 KDGKLRLMKNVWWEYDKLPHMLIAGGTGGGKTYFILTLIEALLHTDSKLYILDPKN---- 259
           + GK+ ++K+     DK  H  IAG +G GK Y  LT    ++L    S L I+DPK
Sbjct:  14 QQGKIPVIKHFELNLDKGSHWAIAGNSGSGKPY-ALTYFLSVLKPKSGLIIIDPKFDTPS  72

Query: 260 --ADLADLGSVMANVYYRKEDLLSCIETFYEEMMKRSEEMKQMKNYKTGKNYAYLGLPAH 317
             A    +  +       + K D +S +      + ++ + +       + +L +
Sbjct:  73 QWARENKIAVIHPVENHSKSDFVSQVNEQLNQCATLIQKRQAILYDNPNHQFTHLTI--- 129

Query: 318 FLIFDEYVAFMEMLGTKENTAVMNKLKQIVMLGRQAGFFLILACQRPDAKYLGDGIRDQF 377
              + DE +A  E +      A  + L QI +LG      L L  QR D   +   +R+Q
Sbjct: 130 --VIDEVLALSEGVNKNIKEAFFSLLSQIALLGHATKIHLFLGSQRFDHNTIPISVREQL 187

Query: 378 NFRVALGRMSEMGYGMMFGSDVQKDFFLKRIKGRGYVDVGTSVISEFYTPLVPKGY     433
           N   +G +++       +F    +       G G + V  + S      PL+     Y
Sbjct: 188 NVLLQIGNINQKTTQFLFPDLDPEGIVIPTGHGTGIIQVVDNEHSYQVLPLLCPTY     243
```

Figure 121:
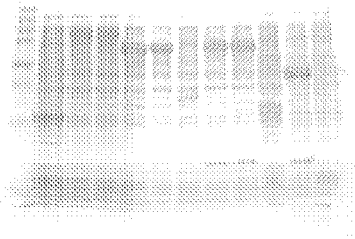

SEQ ID 4116 (GBS109d) was expressed in *E. coli* as a GST-fusion product. SDS-PAGE analysis of total cell extract is shown in FIG. 121 (lane 8 & 9; MW 71 kDa) and in FIG. 184 (lane 2; MW 71 kDa). It was also expressed in *E. coli* as a His-fusion product. SDS-PAGE analysis of total cell extract is shown in FIG. 121 (lane 11; MW 46 kDa), FIG. 128 (lane 4; MW 46 kDa) and FIG. 179 (lane 7; MW 46 kDa). GBS109d-His was purified as shown in FIG. 232 (lanes 7 & 8). GBS109d-GST was purified as shown in FIG. 236, lane 10.

Based on this analysis, it was predicted that these proteins and their epitopes could be useful antigens for vaccines or diagnostics.

Example 1342

A DNA sequence (GBSx1426) was identified in *S. agalactiae* <SEQ ID 4119> which encodes the amino acid sequence <SEQ ID 4120>. Analysis of this protein sequence reveals the following:

Possible site: 22
>>> Seems to have a cleavable N-term signal seq.
----- Final Results -----
 bacterial outside --- Certainty = 0.3000 (Affirmative) <succ>
 bacterial membrane --- Certainty = 0.0000 (Not Clear) <succ>
 bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1343

A DNA sequence (GBSx1427) was identified in *S. agalactiae* <SEQ ID 4121> which encodes the amino acid sequence <SEQ ID 4122>. Analysis of this protein sequence reveals the following:

Possible site: 32
>>> Seems to have no N-terminal signal sequence
----- Final Results -----
  bacterial cytoplasm --- Certainty = 0.4469 (Affirmative) <succ>
    bacterial membrane --- Certainty = 0.0000 (Not Clear) <succ>
      bacterial outside --- Certainty = 0.0000 (Not Clear) <succ>

A related GBS nucleic acid sequence <SEQ ID 9793> which encodes amino acid sequence <SEQ ID 9794> was also identified.

The protein is similar to ORF20 from *S. faecalis*. No corresponding DNA sequence was identified in *S. pyogenes*.

Based on this analysis, it was predicted that these proteins and their epitopes could be useful antigens for vaccines or diagnostics.

Example 1344

A DNA sequence (GBSx1428) was identified in *S. agalactiae* <SEQ ID 4123> which encodes the amino acid sequence <SEQ ID 4124>. Analysis of this protein sequence reveals the following:

Possible site: 14
>>> Seems to have no N-terminal signal sequence
----- Final Results -----
  bacterial cytoplasm --- Certainty = 0.1367 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1345

A DNA sequence (GBSx1429) was identified in *S. agalactiae* <SEQ ID 4125> which encodes the amino acid sequence <SEQ ID 4126>. Analysis of this protein sequence reveals the following:

Possible site: 22
>>> Seems to have no N-terminal signal sequence
INTEGRAL    Likelihood = −10.77    Transmembrane 39-55 (34-64)

-continued

INTEGRAL    Likelihood = −6.32    Transmembrane 16-32 (10-35)
----- Final Results -----
  bacterial membrane --- Certainty = 0.5310 (Affirmative) <succ>
    bacterial outside --- Certainty = 0.0000 (Not Clear) <succ>
      bacterial cytoplasm --- Certainty = 0.0000 (Not Clear) <succ>

The protein is similar to ORF19 from *S. faecalis*. No corresponding DNA sequence was identified in *S. pyogenes*.

Based on this analysis, it was predicted that this protein and its epitopes, could be useful antigens for vaccines or diagnostics.

Example 1346

A DNA sequence (GBSx1430) was identified in *S. agalactiae* <SEQ ID 4127> which encodes the amino acid sequence <SEQ ID 4128>. This protein is predicted to be antirestriction protein. Analysis of this protein sequence reveals the following:

Possible site: 22
>>> Seems to have no N-terminal signal sequence
----- Final Results -----
  bacterial cytoplasm --- Certainty = 0.2918 (Affirmative) <succ>
    bacterial membrane --- Certainty = 0.0000 (Not Clear) <succ>
      bacterial outside --- Certainty = 0.0000 (Not Clear) <succ>

The protein is similar to ORF18 from *S. faecalis*. No corresponding DNA sequence was identified in *S. pyogenes*.

Based on this analysis, it was predicted that this protein and its epitopes, could be useful antigens for vaccines or diagnostics.

Example 1347

A DNA sequence (GBSx1431) was identified in *S. agalactiae* <SEQ ID 4129> which encodes the amino acid sequence <SEQ ID 4130>. Analysis of this protein sequence reveals the following:

Possible site: 27
>>> Seems to have a cleavable N-term signal seq.
INTEGRAL    Likelihood = −3.61    Transmembrane 75-91 (72-94)
----- Final Results -----
  bacterial membrane --- Certainty = 0.2444 (Affirmative) <succ>
    bacterial outside --- Certainty = 0.0000 (Not Clear) <succ>
      bacterial cytoplasm --- Certainty = 0.0000 (Not Clear) <succ>

The protein is similar to ORF17 from *S. faecalis*. No corresponding DNA sequence was identified in *S. pyogenes*.

A related GBS gene <SEQ ID 8793> and protein <SEQ ID 8794> were also identified. Analysis of this protein sequence reveals the following:

Lipop Possible site: −1 Crend: 4
McG: Discrim Score: −7.12
GvH: Signal Score (−7.5): −2.52
Possible site: 43
>>> Seems to have no N-terminal signal sequence
ALOM program    count: 1 value: −3.61 threshold: 0.0
INTEGRAL Likelihood = −3.61 Transmembrane 37-53 (34-56)
PERIPHERAL Likelihood = 3.66 58
modified ALOM score: 1.22

*** Reasoning Step: 3
----- Final Results -----
    bacterial membrane --- Certainty = 0.2444 (Affirmative) <succ>
        bacterial outside --- Certainty = 0.0000 (Not Clear) <succ>
            bacterial cytoplasm --- Certainty = 0.0000 (Not Clear) <succ>

The protein has homology with the following sequences in the databases:

```
100.0/100.0% over 167aa
Enterococcus faecalis
EGAD|14977| hypothetical protein Insert characterized
GP|532550|gb|AAB60016.1||U09422 ORF17 Insert characterized
ORF00720(187-690 of 990)
EGAD|14977|15011(1-168 of 168) hypothetical protein {Enterococcus faecalis}
GP|532550|gb|AAB60016.1||U09422 ORF17 {Enterococcus faecalis}
% Match = 50.3
% Identity = 100.0 % Similarity = 100.0
Matches = 168 Mismatches = 0 Conservative Sub.s = 0

120       150       180       210       240       270       300       330
L*AKYQLVFKTILIIKPMVGI*TFQERLSQPIMGFLKSSIKSVGTLLLADFLFYGVAQSATPIFYERIDYMKKIRSYTSI
                         |||||||||||||||||||||||||||||||||||||||||||||||||||||||||
                         MGFLKSSIKSVGTLLLADFLFYGVAQSATPIFYERIDYMKKIRSYTSI
                             10        20        30        40

360       390       420       450       480       510       540       570
WSVEKVLYSINDFRLPFPITFTQMTWFVVSLFAVMILGNLPPLSMIEGAFLKYFGIPVAFTWFMSTKTFDGKKPYGFLKS
|||||||||||||||||||||||||||||||||||||||||||||||||||||||||||||||||||||||||||||||
WSVEKVLYSINDFRLPFPITFTQMTWFVVSLFAVMILGNLPPLSMIEGAFLKYFGIPVAFTWFMSTKTFDGKKPYGFLKS
          60        70        80        90       100       110       120

600       630       660       690       720       750       780       810
VIAYALRPKLTYAGKKVTLGRNQPQEAITAVRSEFYGISN*IH*KQSRLE*RRGMLCLL*ACSLQLLISKSRTENTSA*F
||||||||||||||||||||||||||||||||||||||||
VIAYALRPKLTYAGKKVTLGRNQPQEAITAVRSEFYGISN
         140       150       160
```

SEQ ID 8794 (GBS223) was expressed in *E. coli* as a His-fusion product. SDS-PAGE analysis of total cell extract is shown in FIG. 44 (lane 7; MW 18 kDa).

Based on this analysis, it was predicted that these proteins and their epitopes could be useful antigens for vaccines or diagnostics.

Example 1348

A DNA sequence (GBSx1432) was identified in *S. agalactiae* <SEQ ID 4131> which encodes the amino acid sequence <SEQ ID 4132>. Analysis of this protein sequence reveals the following:

Possible site: 37
>>> Seems to have no N-terminal signal sequence
----- Final Results -----
    bacterial cytoplasm --- Certainty = 0.4292 (Affirmative) <succ>
        bacterial membrane --- Certainty = 0.0000 (Not Clear) <succ>
            bacterial outside --- Certainty = 0.0000 (Not Clear) <succ>

A related GBS nucleic acid sequence <SEQ ID 9791> which encodes amino acid sequence <SEQ ID 9792> was also identified.

No corresponding DNA sequence was identified in *S. pyogenes*.

Based on this analysis, it was predicted that these proteins and their epitopes could be useful antigens for vaccines or diagnostics.

Example 1349

A DNA sequence (GBSx1433) was identified in *S. agalactiae* <SEQ ID 4133> which encodes the amino acid sequence <SEQ ID 4134>. Analysis of this protein sequence reveals the following:

Possible site: 16
>>> Seems to have no N-terminal signal sequence
INTEGRAL    Likelihood = −6.21    Transmembrane 350-366 (345-368)
INTEGRAL    Likelihood = −0.32    Transmembrane 171-187 (171-188)
----- Final Results -----
    bacterial membrane --- Certainty = 0.3484 (Affirmative) <succ>
        bacterial outside --- Certainty = 0.0000 (Not Clear) <succ>
            bacterial cytoplasm --- Certainty = 0.0000 (Not Clear) <succ>

No corresponding DNA sequence was identified in *S. pyogenes*.

Based on this analysis, it was predicted that this protein and its epitopes, could be useful antigens for vaccines or diagnostics.

Example 1350

A DNA sequence (GBSx1434) was identified in *S. agalactiae* <SEQ ID 4135> which encodes the amino acid sequence <SEQ ID 4136>. Analysis of this protein sequence reveals the following:

Possible site: 45
>>> Seems to have no N-terminal signal sequence
INTEGRAL    Likelihood = −10.30    Transmembrane 154-170 (148-177)
INTEGRAL    Likelihood = −10.30    Transmembrane 21-37 (17-50)
INTEGRAL    Likelihood = −10.03    Transmembrane 320-336 (316-367)
INTEGRAL    Likelihood = −7.43     Transmembrane 346-362 (337-367)

-continued

```
INTEGRAL    Likelihood = −7.01    Transmembrane 186-202 (180-206)
INTEGRAL    Likelihood = −5.36    Transmembrane 411-427 (404-430)
INTEGRAL    Likelihood = −1.17    Transmembrane 386-402 (386-402)
----- Final Results -----
    bacterial membrane --- Certainty = 0.5118 (Affirmative) <succ>
       bacterial outside --- Certainty = 0.0000 (Not Clear) <succ>
          bacterial cytoplasm --- Certainty = 0.0000 (Not Clear) <succ>
```

No corresponding DNA sequence was identified in *S. pyogenes*.

Based on this analysis, it was predicted that this protein and its epitopes, could be useful antigens for vaccines or diagnostics.

Example 1351

A DNA sequence (GBSx1436) was identified in *S. agalactiae* <SEQ ID 4137> which encodes the amino acid sequence <SEQ ID 4138>. Analysis of this protein sequence reveals the following:

```
Possible site: 14
>>> Seems to have no N-terminal signal sequence
----- Final Results -----
    bacterial cytoplasm --- Certainty = 0.6306 (Affirmative) <succ>
      bacterial membrane --- Certainty = 0.0000 (Not Clear) <succ>
         bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1352

A DNA sequence (GBSx1437) was identified in *S. agalactiae* <SEQ ID 4139> which encodes the amino acid sequence <SEQ ID 4140>. Analysis of this protein sequence reveals the following:

```
Possible site: 22
>>> Seems to have no N-terminal signal sequence
----- Final Results -----
    bacterial cytoplasm --- Certainty = 0.2973 (Affirmative) <succ>
      bacterial membrane --- Certainty = 0.0000 (Not Clear) <succ>
         bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1353

A DNA sequence (GBSx1438) was identified in *S. agalactiae* <SEQ ID 4141> which encodes the amino acid sequence <SEQ ID 4142>. Analysis of this protein sequence reveals the following:

```
Possible site: 42
>>> Seems to have no N-terminal signal sequence
----- Final Results -----
    bacterial cytoplasm --- Certainty = 0.3382 (Affirmative) <succ>
      bacterial membrane --- Certainty = 0.0000 (Not Clear) <succ>
         bacterial outside --- Certainty = 0.0000 (Not Clear) <succ>
```

There is also homology to SEQ ID 4144.

A related GBS gene <SEQ ID 8795> and protein <SEQ ID 8796> were also identified. Analysis of this protein sequence reveals the following:

```
Lipop: Possible site: −1 Crend: 3
McG: Discrim Score: 11.12
GvH: Signal Score (−7.5): 0.27
Possible site: 24
>>> Seems to have a cleavable N-term signal seq.
ALOM program count: 0 value: 4.19 threshold: 0.0
PERIPHERAL                Likelihood = 4.19              69
modified ALOM score: −1.34
*** Reasoning Step: 3
----- Final Results -----
    bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>
```

The protein has homology with the following sequences in the databases:

```
100.0/100.0% over 332aa
Enterococcus faecalis
EGAD|36209| hypothetical protein Insert characterized
GP|532547|gb|AAB60019.1||U09422 ORF14 Insert characterized
ORF00727(301-1299 of 1599)
EGAD|36209|37602(1-333 of 333) hypothetical protein {Enterococcus
faecalis}GP|532547|gb|AAB60019.1||U09422 ORF14 {Enterococcus faecalis}
% Match = 61.7
% Identity = 100.0 % Similarity = 100.0
Matches = 333 Mismatches = 0 Conservative Sub.s = 0
```

-continued

```
249       279       309       339       369       399       429       459
CSKSTTTKYKK*TTNQNRHH*ESR*ETMKLKTLVIGGSGLFLMVFSLLLFVAILFSDEQDSGISNIHYGGVNVSAEVLAH
                            ||||||||||||||||||||||||||||||||||||||||||||||||
                            MKLKTLVIGGSGLFLMVFSLLLFVAILFSDEQDSGISNIHYGGVNVSAEVLAH
                                  10        20        30        40        50

489       519       549       579       609       639       669       699
KPMVEKYAKEYGVEEYVNILLAIIQVESGGTAEDVMQSSESLGLPPNSLSTEESIKQGVKYFSELLASSERLSVDLESVI
||||||||||||||||||||||||||||||||||||||||||||||||||||||||||||||||||||||||
KPMVEKYAKEYGVEEYVNILLAIIQVESGGTAEDVMQSSESLGLPPNSLSTEESIKQGVKYFSELLASSERLSVDLESVI
        70        80        90        100       110       120       130

729       759       789       819       849       879       909       939
QSYNYGGGFLGYVANRGNKYTFELAQSFSKEYSGGEKVSYPNPIAIPINGGWRYNYGNMFYVQLVTQYLVTTEFDDDTVQ
||||||||||||||||||||||||||||||||||||||||||||||||||||||||||||||||||||||||
QSYNYGGGFLGYVANRGNKYTFELAQSFSKEYSGGEKVSYPNPIAIPINGGWRYNYGNMFYVQLVTQYLVTTEFDDDTVQ
        150       160       170       180       190       200       210

969       999      1029      1059      1089      1119      1149      1179
AIMDEALKYEGWRYVYGGASPTTSFDCSGLTQWTYGKAGINLPRTAQQQYDVTQHIPLSEAQAGDLVFFHSTYNAGSYIT
||||||||||||||||||||||||||||||||||||||||||||||||||||||||||||||||||||||||
AIMDEALKYEGWRYVYGGASPTTSFDCSGLTQWTYGKAGINLPRTAQQQYDVTQHIPLSEAQAGDLVFFHSTYNAGSYIT
        230       240       250       260       270       280       290

1209      1239      1269      1299      1329      1359      1389      1419
HVGIYLGNNRMFHAGDPIGYADLTSPYWQQHLVGAGRIKQ*ERKI***NLEKIRIKKNRYQRKRNLVSIRSILIKRL*LP
|||||||||||||||||||||||||||||||||||||||
HVGIYLGNNRMFHAGDPIGYADLTSPYWQQHLVGAGRIKQ
        310       320       330
```

SEQ ID 8796 (GBS155) was expressed in *E. coli* as a His-fusion product. SDS-PAGE analysis of total cell extract is shown in FIG. 24 (lane 10; MW 38 kDa). It was also expressed in *E. coli* as a GST-fusion product. SDS-PAGE analysis of total cell extract is shown in FIG. 31 (lane 7; MW 62 kDa).

Figure 111:
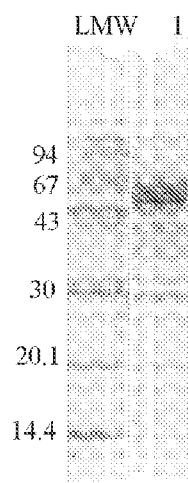

The GBS155-GST fusion product was purified (FIG. 111; see also FIG. 198, lane 74) and used to immunise mice (lane 1 product; 20 μg/mouse). The resulting antiserum was used for Western blot, FACS, and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 1354

A DNA sequence (GBSx1439) was identified in *S. agalactiae* <SEQ ID 4145> which encodes the amino acid sequence <SEQ ID 4146>. Analysis of this protein sequence reveals the following:

Possible site: 52
>>> Seems to have no N-terminal signal sequence
INTEGRAL     Likelihood = –8.60    Transmembrane 37-53 (35-55)
----- Final Results -----
  bacterial membrane --- Certainty = 0.4439 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 9789> which encodes amino acid sequence <SEQ ID 9790> was also identified.

No corresponding DNA sequence was identified in *S. pyogenes*.

Based on this analysis, it was predicted that these proteins and their epitopes could be useful antigens for vaccines or diagnostics.

Example 1355

A DNA sequence (GBSx1440) was identified in *S. agalactiae* <SEQ ID 4147> which encodes the amino acid sequence <SEQ ID 4148>. Analysis of this protein sequence reveals the following:

Possible site: 40
>>> Seems to have an uncleavable N-term signal seq
INTEGRAL     Likelihood = –0.00    Transmembrane 391-407 (391-407)
----- Final Results -----
  bacterial membrane --- Certainty = 0.1001 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 9787> which encodes amino acid sequence <SEQ ID 9788> was also identified.

A related DNA sequence was identified in *S. pyogenes* <SEQ ID 4149> which encodes the amino acid sequence <SEQ ID 4150>. Analysis of this protein sequence reveals the following:

Possible site: 19
>>> Seems to have no N-terminal signal sequence
----- Final Results -----
  bacterial cytoplasm --- Certainty = 0.2027 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 183/669 (27%), Positives = 305/669 (45%), Gaps = 63/669 (9%)
Query:   7 KIINIGVLAHVDAGKTTLTESLLYNSGAITELGSVDKGTTRTDNTLLERQRGITIQTGIT   66
           K  NIG++AHVDAGKTT TE +LY +G I ++G   +G ++ D    E++RGITI +  T
Sbjct:   9 KTRNIGIMAHVDAGKTTTTERILYYTGKIHKIGETHEGASQMDWMEQEQERGITITSAAT   68

Query:  67 SFQWENTKVNIIDTPGHMDFLAEVYRSLSVLDGAILLISAKDGVQAQTRILFHALRKMGI  126
           + QW+  +VNIIDTPGH+DF  EV RSL VLDGA+ ++ ++ GV+ QT  ++   + G+
Sbjct:  69 TAQWDGHRVNIIDTPGHVDFTIEVQRSLRVLDGAVTVLDSQSGVEPQTETVWRQATEYGV  128

Query: 127 PTIFFINKIDQNGIDLSTVYQDIKEKLSAEI------------------VIKQKVELYPN  168
           P I F NK+D+ G D    Q + ++L A                    +IK K E+Y N
Sbjct: 129 PRIVFANKMDKIGADFLYSVQTLHDRLQANAHPIQLPIGAEDDERGIIDLIKMKAEIYTN  188

Query: 169 MCVTNFTES---EQW------------DTVIEGNDDLLEKYMSGKSLEALELEQEESIRF  213
                T+  E    E++           + V E ++DL+ KY+ G+ +     EL
Sbjct: 189 DLGTDILEEDIPEEYLEQAQEYREKLIEAVAETDEDLMMKYLEGEEITNDELIAGIRKAT  248

Query: 214 HNCSLFPVYHGSAKNNIGIDNLIEVI---------------TNKFYSSTHRGPSE----L  254
            N    FPV  GSA  N G+ +++ +               N    +   P+       
Sbjct: 249 INVEFFPVLCGSAFKNKGVQLMLDAVIAYLPSPLDIPAIKGVNPDTDAEEERPASDEEPF  308

Query: 255 CGNVFKIEYTKKRQRLAYIRLYSGVLHLRDSVRVSEKEKI----KVTEMYTSINGELCKI  310
                FKI      RL + R+YSGVL+    V  +K K      ++ +M+ +   E   I
Sbjct: 309 AALAFKIMTDPFVGRLTFFRVYSGVLNSGSYVMNTSKGKRERIGRILQMHANSRQE---I  365

Query: 311 DRAYSGEIVILQN-EFLKLNSVLGDTKLLPQRKKIENPHPLLQTTVEPSKPEQREMLLDA  369
           +  Y+G+I  +       L D K    + IE P P++Q  VEP     ++ +   A
Sbjct: 366 ETVYAGDIAAAVGLKDTTTGDSLTDEKAKVILESIEVPEPVIQLMVEPKSKADQDKMGVA  425

Query: 370 LLEISDSDPLLRYYVDSTTHEIILSFLGKVQMEVISALLQEKYHVEIELKEPTVIYME--  427
           L ++++ DP  R   +  T E +++ +G++ ++V+    ++ ++ VE  +  P V Y E
Sbjct: 426 LQKLAEEDPTFRVETNVETGETVIAGMGELHLDVLVDRMKREFKVEANVGAPQVSYRETF  485

Query: 428 RPLKNAEYTIHIEVPPNPFWASIGLSVSPLPLGSGMQYESSVSLGYLNQSFQNAVMEGIR  487
           R    A  +     +   + ++  +P   G G ++E+++  G + + F   AV +G+
Sbjct: 486 RASTQARGFFKRQSGGKGQFGDVWIEFTPNEEGKGFEFENAIVGGVVPREFIPAVEKGLI  545

Query: 488 YGCEQG-LYGWNVTDCKICFKYGLYYSPVSTPADFRMLAPIVLEQVLKKAGTELLEPYLS  546
                G L G+ + D K      G Y+      S+      F++ A + L++   K A     +LEP +
Sbjct: 546 ESMANGVLAGYPMVDVKAKLYDGSYHDVDSSETAFKIAASLALKEAAKSAQPAILEPMML  605

Query: 547 FKIYAPQEYLSRAYNDAPKYCANIVDTQLKNNEVILSGEIPARCIQEYRSDLTFFTNGRS  606
             I AP++ L              +     +  N I+  +P    + Y  + L    T GR
Sbjct: 606 VTITAPEDNLGDVMGHVTARRGRVDGMEAHGNSQIVRAYVPLAEMFGYATVLRSATQGRG  665

Query: 607 VCLTELKGY                                                      615
             +       Y
Sbjct: 666 TFMMVFDHY                                                      674
```

Based on this analysis, it was predicted that these proteins and their epitopes could be useful antigens for vaccines or diagnostics.

Example 1356

A DNA sequence (GBSx1441) was identified in *S. agalactiae* <SEQ ID 4151> which encodes the amino acid sequence <SEQ ID 4152>. Analysis of this protein sequence reveals the following:

---

Possible site: 33
>>> Seems to have no N-terminal signal sequence
----- Final Results -----
   bacterial cytoplasm --- Certainty = 0.2530 (Affirmative) <succ>
    bacterial membrane --- Certainty = 0.0000 (Not Clear) <succ>
     bacterial outside --- Certainty = 0.0000 (Not Clear) <succ>

---

No corresponding DNA sequence was identified in *S. pyogenes*.

Based on this analysis, it was predicted that this protein and its epitopes, could be useful antigens for vaccines or diagnostics.

Example 1357

A DNA sequence (GBSx1442) was identified in *S. agalactiae* <SEQ ID 4153> which encodes the amino acid sequence <SEQ ID 4154>. Analysis of this protein sequence reveals the following:

---

Possible site: 18
>>> Seems to have no N-terminal signal sequence
----- Final Results -----
   bacterial membrane --- Certainty = 0.0000 (Not Clear) <succ>
    bacterial outside --- Certainty = 0.0000 (Not Clear) <succ>
     bacterial cytoplasm --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1358

A DNA sequence (GBSx1443) was identified in *S. agalactiae* <SEQ ID 4155> which encodes the amino acid sequence <SEQ ID 4156>. Analysis of this protein sequence reveals the following:

---

Possible site: 17
>>> Seems to have no N-terminal signal sequence
----- Final Results -----
  bacterial cytoplasm --- Certainty = 0.1630 (Affirmative) <succ>
    bacterial membrane --- Certainty = 0.0000 (Not Clear) <succ>
      bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1359

A DNA sequence (GBSx1444) was identified in *S. agalactiae* <SEQ ID 4157> which encodes the amino acid sequence <SEQ ID 4158>. This protein is predicted to be excisionase-related protein. Analysis of this protein sequence reveals the following:

---

Possible site: 40
>>> Seems to have no N-terminal signal sequence
----- Final Results -----
  bacterial cytoplasm --- Certainty = 0.4481 (Affirmative) <succ>
    bacterial membrane --- Certainty = 0.0000 (Not Clear) <succ>
      bacterial outside --- Certainty = 0.0000 (Not Clear) <succ>

---

Possible site: 46
>>> Seems to have no N-terminal signal sequence
----- Final Results -----
  bacterial cytoplasm --- Certainty = 0.4626 (Affirmative) <succ>
    bacterial membrane --- Certainty = 0.0000 (Not Clear) <succ>
      bacterial outside --- Certainty = 0.0000 (Not Clear) <succ>

---

The protein is similar the Tn1545 integrase from *S. pneumoniae* and to SEQ ID 578.

Based on this analysis, it was predicted that this protein and its epitopes, could be useful antigens for vaccines or diagnostics.

Example 1361

A DNA sequence (GBSx1446) was identified in *S. agalactiae* <SEQ ID 4161> which encodes the amino acid sequence <SEQ ID 4162>. Analysis of this protein sequence reveals the following:

---

Possible site: 26
>>> Seems to have an uncleavable N-term signal seq
INTEGRAL     Likelihood = −10.72    Transmembrane 18-34 (13-41)
INTEGRAL     Likelihood = −6.10     Transmembrane 58-74 (55-79)
INTEGRAL     Likelihood = −5.04     Transmembrane 97-113 (90-116)
INTEGRAL     Likelihood = −1.81     Transmembrane 78-94 (78-94)
INTEGRAL     Likelihood = −0.85     Transmembrane 145-161 (145-161)
----- Final Results -----
  bacterial membrane --- Certainty = 0.5288 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the GENPEPT database.

```
>GP:AAC74820 GB:AE000270 orf, hypothetical protein [Escherichia coli K12]
Identities = 43/174 (24%), Positives = 84/174 (47%), Gaps = 9/174 (5%)
Query:   24 LIATLVLVVYLYKL------GILNDSNELKDLVHKYEFWGPMIFIVAQIVQIVFPVIPGG  77
            L A L+  + +Y +       +L D   L+ L+ + F+G ++I+  I+  +  ++PG
Sbjct:   24 LFACLIFALVIYAIHAFGLFDLLTDLPHLQTLIRQSGFFGYSLYILLFIIATLL-LLPGS  82

Query:   78 VTTVAGFLIFGPTLGFIYNYIGIIIGSVILFWLVKFYGRKFVLLFM-DQKTFDKYESKLE 136
            +  +AG ++FGP LG + + I   + S   F L ++ GR  +L ++    TF   E  +
Sbjct:   83 ILVIAGGIVFGPLLGTLLSLIAATLASSCSFLLARWLGRDLLLKYVGHSNTFQAIEKGIA 142

Query:  137 TSGYEKFFIFCMASPISPADIMVMITGLSNMSIKRFVTIIMITKPISIIGYSYL       190
            +G + F I    P+ P +I     GL+ ++    + I  +T    I+ Y+ +
Sbjct:  143 RNGID-FLILTRLIPLFPYNIQNYAYGLTTIAFWPYTLISALTTLPGIVIYTVM       195
```

The protein is similar to transposon Tn916 from *S. faecalis*. No corresponding DNA sequence was identified in *S. pyogenes*.

Based on this analysis, it was predicted that this protein and its epitopes, could be useful antigens for vaccines or diagnostics.

Example 1360

A DNA sequence (GBSx1445) was identified in *S. agalactiae* <SEQ ID 4159> which encodes the amino acid sequence <SEQ ID 4160>. This protein is predicted to be transposase. Analysis of this protein sequence reveals the following:

A related DNA sequence was identified in *S. pyogenes* <SEQ ID 4163> which encodes the amino acid sequence <SEQ ID 4164>. Analysis of this protein sequence reveals the following:

---

Possible site: 43
>>> Seems to have an uncleavable N-term signal seq
INTEGRAL     Likelihood = −4.30    Transmembrane 8-24 (6-29)
INTEGRAL     Likelihood = −0.80    Transmembrane 57-73 (57-73)
INTEGRAL     Likelihood = −0.00    Transmembrane 86-102 (86-102)
----- Final Results -----
  bacterial membrane --- Certainty = 0.2720 (Affirmative) <succ> bacterial outside --- Certainty = 0.0000 (Not Clear) <succ>
bacterial cytoplasm --- Certainty = 0.0000 (Not Clear) <succ>

The protein has no significant homology with any sequences in the GENPEPT database.

An alignment of the GAS and GBS proteins is shown below.

```
Identities = 85/114 (74%), Positives = 101/114 (88%)
Query:  89 PTLGFIYNYIGIIIGSVILFWLVKFYGRKFVLLFMDQKTFDKYESKLETSGYEKFFIFCM  148
           P  GFIYNY+GIIIGS+ LF LVK YGRKF+LLF++ KTF KYE +LET GYEK FIFCM
Sbjct:   3 PVTGFIYNYVGIIIGSIALFLLVKTYGRKFILLFVNDKTFYKYERRLETPGYEKLFIFCM   62

Query: 149 ASPISPADIMVMITGLSNMSIKRFVTIIMITKPISIIGYSYLWIYGGDILKNFL         202
           ASP+SPADIMVMITGL++MS+KRFVTI++ITKPISIIGYSYL+I+G D++  FL
Sbjct:  63 ASPVSPADIMVMITGLTDMSLKRFVTILLITKPISIIGYSYLFIFGKDVISWFL         116
```

There is also homology to SEQ ID 1728.

Based on this analysis, it was predicted that these proteins and their epitopes could be useful antigens for vaccines or diagnostics.

Example 1362

A DNA sequence (GBSx1447) was identified in *S. agalactiae* <SEQ ID 4165> which encodes the amino acid sequence <SEQ ID 4166>. This protein is predicted to be chlorAM-Phenicol acetyltransferase (cat). Analysis of this protein sequence reveals the following:

Possible site: 28
>>> Seems to have no N-terminal signal sequence
----- Final Results -----
  bacterial cytoplasm --- Certainty = 0.4725 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:AAA86871 GB:U19459 VAT B [Staphylococcus aureus]
Identities = 57/130 (43%), Positives = 81/130 (61%), Gaps = 4/130 (3%)
Query:  57 IGAFCSIAQNVT--ITGLNHPTDHITTNPFIYYKSRGFINEDRADLIDEKKNGKVIIGND  114
           IG FC+IA+ +   + G NH + ITT PF       G+   +   L D     G  ++GND
Sbjct:  65 IGKFCAIAEGIEFIMNGANHRMNSITTYPF-NIMGNGW-EKATPSLEDLPFKGDTVVGND  122

Query: 115 VWIGTNVTILPSVTIGNGAIIGAGSVITKDIPDYAVVAGTPAKIIKYRFSEEEITLLNAS  174
           VWIG NVT++P + IG+GAI+ A SV+TKD+P Y ++ G P++IIK RF +E I  L
Sbjct: 123 VWIGQNVTVMPGIQIGDGAIVAANSVVTKDVPPYRIIGGNPSRIIKKRFEDELIDYLLQI  182

Query: 175 QWWNWSDEAI                                                    184
           +WW+WS + I
Sbjct: 183 KWWDWSAQKI                                                    192
```

There is also homology to SEQ ID 1944.

Based on this analysis, it was predicted that this protein and its epitopes could be useful antigens for vaccines or diagnostics.

Example 1363

A DNA sequence (GBSx1448) was identified in *S. agalactiae* <SEQ ID 4167> which encodes the amino acid sequence <SEQ ID 4168>. Analysis of this protein sequence reveals the following:

Possible site: 39
>>> Seems to have no N-terminal signal sequence
----- Final Results -----
  bacterial cytoplasm --- Certainty = 0.2398 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1364

A DNA sequence (GBSx1449) was identified in *S. agalactiae* <SEQ ID 4169> which encodes the amino acid sequence <SEQ ID 4170>. This protein is predicted to be cation-transporting P-ATPase PacL. Analysis of this protein sequence reveals the following:

Possible site: 34
>>> Seems to have no N-terminal signal sequence
INTEGRAL    Likelihood = -9.18    Transmembrane 873-889 (866-894)
INTEGRAL    Likelihood = -8.39    Transmembrane 257-273 (251-276)
INTEGRAL    Likelihood = -5.95    Transmembrane 67-83 (65-88)

-continued

INTEGRAL    Likelihood = -5.41    Transmembrane 282-298 (281-301)
INTEGRAL    Likelihood = -1.65    Transmembrane 90-106 (89-107)
INTEGRAL    Likelihood = -0.48    Transmembrane 737-753 (736-753)
INTEGRAL    Likelihood = -0.00    Transmembrane 898-914 (898-914)
----- Final Results -----
  bacterial membrane --- Certainty = 0.4673 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 10963> which encodes amino acid sequence <SEQ ID 10964> was also identified.

The protein has homology with the following sequences in the GENPEPT database.

```
>GP:AAB85991 GB:AE000912 cation-transporting P-ATPase PacL
[Methanothermobacter thermoautotrophicus]
Identities = 409/922 (44%), Positives = 609/922 (65%), Gaps = 22/922 (2%)
Query:  10  TNTRFAKEELEEVFEELGTTQGGLSDEEVAVRQKKYGLNLLSEVKQESIILLFLKNFTSL   69
            T T   + E+EEV + L T++ GL  +E   R K +G N L EVK+  +ILLFL N  ++
Sbjct:   4  TMTAIYELEVEEVLQRLETSESGLDPQEAEKRLKIHGPNKLEEVKRRPLILLFLSNLYNV   63

Query:  70  MAILLWVGGFVAIVSNSLELGLAIWMVNVINGIFSFIQEYRASQATQALEKMLPSYSRVL  129
            +A+LLW+     ++ ++ + +L +AI MV +IN +FSF QEY A +A +AL+  +LP   +V+
Sbjct:  64  LALLLWIAAILSFITGNYQLAVAIVMVIIINALFSFWQEYEAEKAAEALKNILPVMVKVI  123

Query: 130  RKGSEEKILSEQLVPGDIVLIEEGDRISADGRLIKTTDLQVNQSALTGESNPIYKDSNVE  189
            R   E  I +  +V GDI+++EEGD + AD R++++  +L+V+ SALTGES P+ K S+
Sbjct: 124  RASKEVLIPAADVVHGDIIILEEGDTVPADARILESHNLRVDASALTGESKPVRKVSHPV  183

Query: 190  NDQSKTLIECDNMVFAGTTVSSGSATMVVTAIGMQTQFGQIADLTQGMKSEKSPLQRELD  249
             + +   I+  +N++FAGT V+SG+      V A G   T+F +IA LTQ ++ E SPLQR++
Sbjct: 184  RE-ADNYIDTENILFAGTQVTSGTGRAAVFATGRDTEFSRIATLTQEVREEPSPLQRQIS  242

Query: 250  RLTKQISIISITVGIIFFLAATFFVKEPVSKSFIFALGMIVAFIPEGLLPTVTLSLAMAV  309
               + I  +++ +G+I FL    + V+ P+   +FIFA+G++VA +PEGLLP+VTLSLA +
Sbjct: 243  LAARIIGALAVAMGVILFLVNLYIVRLPLETAFIFAIGLMVANVPEGLLPSVTLSLAASA  302

Query: 310  QRMAKEHALVKKLSSVETLGATSVICSDKTGTLTQNEMTVNHLWQNGKSYQVTGLGYAPE  369
            ++MA+E+ ALVK+LSSVETLG+T++IC+DKTGTLT+ EMTV   +W   K  +VTG GY PE
Sbjct: 303  RKMARENALVKRLSSVETLGSTTIICTDKTGTLTRGEMTVRKIWIPHKVIEVTGSGYRPE  362

Query: 370  GQILFEGDNICFGNSDRGDLEKLIRFAHLCSNAQVLPPNDDRSTYTVLGDPTEACLNVLL  429
            GQ LF G+ +    + D +L+ L+R A  C+++ ++      +  ++VLGD TE   L V
Sbjct: 363  GQFLFRGEPV--SHRDMAELKLLMRAATFCNDSALI---HEEGEWSVLGDSTEGALLVAA  417

Query: 430  EKSGINIQENRKFAPRLKELPFDSVRKRMTTIHSLGGDEKDKKISITKGAPKEILDLSDY  489
            EK G + +    K  PR+ ELPFDS RK MT+IH   G        K+++  KGAPK+I+ LS+
Sbjct: 418  EKLGFDAEAELKAMPRITELPFDSRRKSMTSIHEKSG----KRVAYVKGAPKKIIGLSER  473

Query: 490  VLSDGKVIPLNKEERNKIQLANDTFAKDGLRVLAVSYCDIEGFSKEQWTQENLEQHMVFI  549
            +  DG+V L+ +E+ +I   +D A  GLRVLA +Y ++       E     +E+  +V +
Sbjct: 474  ISVDGRVRALHADEKERIIGIHDEMASKGLRVLAFAYRELPE-DLEVRDPGEVERDLVLV  532

Query: 550  GLIAMSDPPREGVREAIDKCHAASIRIIMVTGDYGLTALSIAKNIGIIRNDDAKVISGLE  609
            G+ AM DPPREGV+EA++  C  A IRIIM+TGDYGLTA +IA+ IGI+    ++I G E
Sbjct: 533  GMAAMHDPPREGVKEAVEHCKTAGIRIIMITGDYGLTAEAIAREIGIVEG-ECRIIKGKE  591

Query: 610  LSEMTDSQLKKELSGE--VVFARVAPEQKYRVVTILQEMGEVVAVTGDGVNDAPALKKSD  667
            L ++ D++L+ + +  E  ++FAR  PE K R+ ++L++   E+VA+TGDGVNDAPAL+K+D
Sbjct: 592  LDKLKDTELRGILARERNLIFARAVPEHKMRIASVLEDSDEIVAMTGDGVNDAPALRKAD  651

Query: 668  IGVAMGVTGTDVAKESADMILTDDHFASIVHAVEEGRAVYQNIKKFLTYIFNSNTPEAVP  727
            IGVAMG +GTDVAKE+AD++L DD+FASIV AV EGR VY+NI+KF TYIF+   T E VP
Sbjct: 652  IGVAMG-SGTDVAKEAADIVLADDNFASIVTAVREGRTVYENIRKFITYIFSHETAEIVP  710

Query: 728  SAFFLFSKGFIPLPLTVMQILAVDLGTDMLPALGLGVEPPETDVMNRPPRRLTDRLLDKG  787
                F +    IPLP+T+MQILA+DLGTD LPAL LG   PE+DVM  PPR  ++LL++
Sbjct: 711  --FIMMVLFSIPLPITIMQILAIDLGTDTLPALALGRSLPESDVMKLPPRAPSERLLNRE  768

Query: 788  LLIKSFLWYGTIESVLAMGGFFWAHYLRYGNF---TFFVANGIPYREATTMTLGAIIFSQ  844
            ++++  L+  GTIE+ L M  +F Y  G +       A+  Y  ATT+    I+  +Q
Sbjct: 769  VILRGYLFTGTIEAALIMAAYFLVLY--SGGWLPGQELSASDPLYMRATTVVFAGIVMAQ  826

Query: 845  IGMVMNSRTSYQSIKALSIFGNKLINFGIIMEILAFLVLVYVPLFHNLFNTASLGLSHWL  904
            +G +++S+T   S     +  + N+  I  G++   I   L+++Y P   +F TA  G+   W
Sbjct: 827  LGNLLSSQTLRSSALEAGLLRNRWILAGMVFAISVMLLVIYLPPLQPIFGTAPPGILEWF  886

Query: 905  YLISCPFIMIGLDEVRKLFSSR                                       926
               LI    I+   DE+RK   R
Sbjct: 887  ILILFTPIVFLTDEMRKFIQRR                                       908
```

There is also homology to SEQ ID 4172.

Based on this analysis, it was predicted that these proteins and their epitopes could be useful antigens for vaccines or diagnostics.

Example 1365

A DNA sequence (GBSx1450) was identified in *S. agalactiae* <SEQ ID 4173> which encodes the amino acid sequence <SEQ ID 4174>. Analysis of this protein sequence reveals the following:

---

Possible site: 25
>>> Seems to have no N-terminal signal sequence
----- Final Results -----
   bacterial cytoplasm --- Certainty = 0.3740 (Affirmative) <succ>
     bacterial membrane --- Certainty = 0.0000 (Not Clear) <succ>
       bacterial outside --- Certainty = 0.0000 (Not Clear) <succ>

---

The protein has homology with the following sequences in the GENPEPT database.

```
>GP:CAB46979 GB:AJ243482 CSRA protein [Enterococcus faecalis]
Identities = 85/132 (64%), Positives = 105/132 (79%)
Query:    2  KETQEELRQRIGHTAYQVTQNSATEHAFTGKYDDFFEEGIYVDIVSGEVLFSSLDKFQSG   61
             K T+EEL+Q +    Y VTQ +ATE  F+G+YDDF+++GIYVDIVSGE LFSSLDK+ +G
Sbjct:    3  KPTEEELKQTLTDLQYAVTQENATERPFSGEYDDFYQDGIYVDIVSGEPLFSSLDKYDAG   62

Query:   62  CGWPAFSKPIENRMVTNHQDHSHGMHRIEVRSRQADSHLGHVFNDGPVDAGGLRYCINSA  121
             CGWP+F+KPIE R V    D SHGMHR+EVRS++ADSHLGHVF DGP+  GGLRYCIN+A
Sbjct:   63  CGWPSFTKPIEKRGVKEKADFSHGMHRVEVRSQEADSHLGHVFTDGPLQEGGLRYCINAA  122

Query:  122  ALDFIPYDQMAK                                                 133
             AL F+P   + K
Sbjct:  123  ALRFVPVADLEK                                                 134
```

A related DNA sequence was identified in *S. pyogenes* <SEQ ID 4175> which encodes the amino acid sequence <SEQ ID 4176>. Analysis of this protein sequence reveals the following:

---

Possible site: 24
>>> Seems to have no N-terminal signal sequence
----- Final Results -----
   bacterial cytoplasm --- Certainty = 0.3692 (Affirmative) <succ>
     bacterial membrane --- Certainty = 0.0000 (Not Clear) <succ>
       bacterial outside --- Certainty = 0.0000 (Not Clear) <succ>

---

An alignment of the GAS and GBS proteins is shown below.

```
Identities = 109/142 (76%), Positives = 126/142 (87%)

Query:    3  ETQEELRQRIGHTAYQVTQNSATEHAFTGKYDDFFEEGIYVDIVSGEVLFSSLDKFQSGC   62
             ET +EL+QRIG  +Y+VTQ++ATE  FTG+YD+FFE+GIYVDIVSGEVLFSSLDKF SGC
Sbjct:    2  ETSDELKQRIGDLSYEVTQHAATESPFTGEYDNFFEKGIYVDIVSGEVLFSSLDKFNSGC   61

Query:   63  GWPAFSKPIENRMVTNHQDHSHGMHRIEVRSRQADSHLGHVFNDGPVDAGGLRYCINSAA  122
             GWPAFSKPIENRMVTNH D S+GM R+EV+SR+A SHLGHVF+DGP +AGGLRYCINSAA
Sbjct:   62  GWPAFSKPIENRMVTNHDDSSYGMRRVEVKSREAGSHLGHVFSDGPKEAGGLRYCINSAA  121

Query:  123  LDFIPYDQMAKRGYGDYLSLFD                                       144
             L FIPYDQM K GY  +L+LFD
Sbjct:  122  LKFIPYDQMEKEGYAQWLTLFD                                       143
```

Based on this analysis, it was predicted that these proteins and their epitopes could be useful antigens for vaccines or diagnostics.

Example 1366

A DNA sequence (GBSx1451) was identified in *S. agalactiae* <SEQ ID 4177> which encodes the amino acid sequence <SEQ ID 4178>. Analysis of this protein sequence reveals the following:

---

Possible site: 25
>>> Seems to have no N-terminal signal sequence
----- Final Results -----
   bacterial cytoplasm --- Certainty = 0.1674 (Affirmative) <succ>
     bacterial membrane --- Certainty = 0.0000 (Not Clear) <succ>
       bacterial outside --- Certainty = 0.0000 (Not Clear) <succ>

---

The protein has homology with the following sequences in the GENPEPT database.

```
>GP:BAB05127 GB:AP001511 unknown [Bacillus halodurans]
Identities = 48/152 (31%), Positives = 77/152 (50%), Gaps = 1/152 (0%)
Query:   1  MIRRAKEKDLPDIAELLKQILMLHHEVRPDIFHTRGSKFSKEQLKEMLIDESKPIFVYES   60
            +IR A  +D  ++A L  Q+    H + R DIF +     +    +  +  E   + V+
Sbjct:   2  IIREATVQDYEEVARLHTQVHEAHVKERGDIFRSNEPTLNPSFFQAAVQGEKSTVLVFVD   61

Query:  61  DEGKVVAHLFLQLQEKRDLPR-KSFKTLYIDDLCIDEEVRGQQIGQKLMDFARQYAKKHG  119
             + K+ A+ + L +   LP  + KT+YI DLC+DE  RG  IG+ + +     Y K H
Sbjct:  62  EREKIGAYSVIHLVQTPLLPTMQQRKTVYISDLCVDETRRGGGIGRLIFEAIISYGKAHQ  121

Query: 120  CYNITLNVWNDNQRAVSFYEKLGFKPQQTQME                             151
              I L+V++ N RA +FY  LG + Q+   ME
Sbjct: 122  VDAIELDVYDFNDRAKAFYHSLGMRCQKQTME                             153
```

No corresponding DNA sequence was identified in *S. pyogenes*.

Based on this analysis, it was predicted that this protein and its epitopes, could be useful antigens for vaccines or diagnostics.

Example 1367

A DNA sequence (GBSx1452) was identified in *S. agalactiae* <SEQ ID 4179> which encodes the amino acid sequence <SEQ ID 4180>. Analysis of this protein sequence reveals the following:

---

Possible site: 52
>>> Seems to have no N-terminal signal sequence
----- Final Results -----
    bacterial cytoplasm --- Certainty = 0.3285 (Affirmative) <succ>
    bacterial membrane --- Certainty = 0.0000 (Not Clear) <succ>
    bacterial outside --- Certainty = 0.0000 (Not Clear) <succ>

---

A related GBS nucleic acid sequence <SEQ ID 9785> which encodes amino acid sequence <SEQ ID 9786> was also identified.

The protein has homology with the following sequences in the GENPEPT database.

```
>GP:BAB06554 GB:AP001516 unknown conserved protein [Bacillus halodurans]
Identities = 108/211 (51%), Positives = 149/211 (70%)
Query:   7  EDVILNATENMVHHKLKNDPSGHDWFHIVRVRNLAVELAHKEGANTFICQMAALLHDIID   66
            E  IL + E  V  +L ++ SGHDW+HI RV   +A  +   +E   + F+ Q+AAL HD+ID
Sbjct:   3  EQAILQSAEAWVKKQLMDEYSGHDWYHIRRVTLMAKAIGEQEKVDVFVVQIAALFHDLID   62

Query:  67  DKICQDSKQASYELTQWLYSQDLAIAEVEHILDILENISFKAGTGLTMKTLEGQIVQDAD  126
            DK+  D + A  +L W+ + +    +++H +DI+  ISFK G G ++  T E   +VQDAD
Sbjct:  63  DKLVDDPETAKQQLIDWMEAAGVPSQKIDHTMDIINTISFKGGHGQSLATREAMVVQDAD  122

Query: 127  RLDAMGAIGIARTMAYSGSKGRLIHDPNLKPRENLTLEEYRNGQDTAIIHFYEKLLKLKD  186
            RLDA+GAIGIART AYSG+KG+ I+DP L  RE +T+EEYR+G+ TAI HFYEKL KLKD
Sbjct: 123  RLDALGAIGIARTFAYSGNKGQPIYDPELPIRETMTVEEYRHGKSTAINHFYEKLFKLKD  182

Query: 187  LMNTKQGKMLAQKRHDFLELYLAEFYAEWNG                              217
            LMNT+ GK LA++RH F+E ++   F +EWNG
Sbjct: 183  LMNTETGKQLAKERHVFMEQFIERFLSEWNG                              213
```

No corresponding DNA sequence was identified in *S. pyogenes*.

Based on this analysis, it was predicted that these proteins and their epitopes could be useful antigens for vaccines or diagnostics.

Example 1368

A DNA sequence (GBSx1453) was identified in *S. agalactiae* <SEQ ID 4181> which encodes the amino acid sequence <SEQ ID 4182>. Analysis of this protein sequence reveals the following:

---

Possible site: 21
>>> May be a lipoprotein
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>

---

The protein has homology with the following sequences in the GENPEPT database.

```
!GB:U25448 internalin [Listeria monocytogenes]
!GB:U25448 internalin [Listeria monocytogenes]
!GB:U25448 internalin [Listeria monocytogenes]
!GB:U25448 internalin [Listeria monocytogenes]
>GP:AAA69530 GB:U25448 internalin [Listeria monocytogenes]
Identities = 78/253 (30%), Positives = 132/253 (51%), Gaps = 2/253 (0%)
Query: 531  LKQLWMTNTGITDYSFLDKMPLLEGLDISQNGIKDLSFLTKYKQLSLIAAANNGITSLKP  590
            L Q+  +N +TD + L  + L + ++ N I D++ L    L+ +   NN IT + P
Sbjct: 26   LTQINFSNNQLTDITPLKDLTKLVDILMNNNQIADITPLANLSNLTGLTLFNNQITDIDP  85

Query: 591  LAELPNLQFLVLSHNNISDLTPLSNLTKLQELYLDHNNVKNLSALSGKKDLKVLDLSNNK  650
            L  L NL  L LS N ISD++ LS LT LQ+L L  N V +L    L+   LD+S+NK
Sbjct: 86   LKNLTNLNRLELSSNTISDISALSGLTSLQQLSLG-NQVTDLKPLANLTTLERLDISSNK  144

Query: 651  SADLSTL-KTTSLETLLLNETNTSNLSFLKQNPKVSNLTINNAKLASLDGIEESDEIVKV  709
            +D+S L K T+LE+L+     S+++ L    + L++N +L + +      + +
Sbjct: 145  VSDISVLAKLTNLESLIATNNQISDITPLGILTNLDELSLNGNQLKDIGTLASLTNLTDL  204

Query: 710  EAEGNQIKSLVLKNKQGSLKFLNVTNNQLTSLEGVNNYTSLETLSVSKNKLESLDIKTPN  769
            +  NQI +L        L L + NQ++++   +  T+L  L +++N+LE +    +
Sbjct: 205  DLANNQISNLAPLPGLTKLTELKLGANQISNIXPLAGLTALTNLELNENQLEDISPISNL  264

Query: 770  KTVTNLDFSHNNV  782
            K +T L     NN+
Sbjct: 265  KNLTYLTLYFNNI  277

Identities = 91/300 (30%), Positives = 141/300 (46%), Gaps = 42/300 (14%)
Query: 519  INDMTPVLQFKKLKQLWMTNTGITDYSFLDKMPLLEGLDISQNGIKD---LSFLTKYKQL  575
            I D+TP+     L  L + N   ITD   L + L L++S N I D   LS LT +QL
Sbjct: 58   IADITPLANLSNLTGLTLFNNQITDIDPLKNLTNLNRLELSSNTISDISALSGLTSLQQL  117

Query: 576  SLIAAANNGITSLKPLA---------------------ELPNLQFLVLSHNNISDLTPL  613
            SL    N +T LKPLA                     +L NL+ L+ ++N ISD+TPL
Sbjct: 118  SL----GNQVTDLKPLANLTTLERLDISSNKVSDISVLAKLTNLESLIATNNQISDITPL  173

Query: 614  SNLTKLQELYLDHNNVKNLSALSGKKDLKVLDLSNNKSADLSTLK-TTSLETLLLNETNT  672
                LT L EL L+ N +K++  L+   +L LDL+NN+ ++L+ L     T L    L
Sbjct: 174  GILTNLDELSLNGNQLKDIGTLASLTNLTDLDLANNQISNLAPLPGLTKLTELKLGANQI  233

Query: 673  SNLSFLKQNPKVSNLTINNAKLASLDGIEESDEIVKVEAEGNQIKSLVLKNKQGSLKFLN  732
            SN+  L       ++NL +N +L + I   +   N I +       L+ L
Sbjct: 234  SNIXPLAGLTALTNLELNENQLEDISPISNLKNLTYLTLYFNNISDISPVSSLTKLQRLF  293

Query: 733  VTNNQLTSLEGVNNYTSLETLSVSKNKLESLDIKTPNKTVTNLDFSHNNVPTSQLKLNEK  792
                NN+++ +  + N T++ LS    N++   L  TP  +T  +         +QL LN++
Sbjct: 294  FYNNKVSDVSSLANLTNINWLSAGHNQISDL---TPLANLTRI---------TQLGLNDQ  341

Identities = 73/253 (28%), Positives = 124/253 (48%), Gaps = 4/253 (1%)
Query: 540  GITDYSFLDKMPLLEGLDISQNGIKDLSFLTKYKQLSLIAAANNGITSLKPLAELPNLQF  599
            GI    L+ + L  ++ S N + D++ L    +L I    NN I + + PLA L NL
Sbjct: 13   GIKSIDGLEYLNNLTQINFSNNQLTDITPLKDLTKLVDILMNNNQIADITPLANLSNLTG  72

Query: 600  LVLSHNNISDLTPLSNLTKLQELYLDHNNVKNLSALSGKKDLKVLDLSNNKSADLSTLKT  659
            L L +N I+D+ PL NLT L  L L  N + ++SALSG   L+  L L N +
Sbjct: 73   LTLFNNQITDIDPLKNLTNLNRLELSSNTISDISALSGLTSLQQLSLGNQVTDLKPLANL  132

Query: 660  TSLETLLLNETNTSNLSFLKQNPKVSNLTINNAKLASLDGIEESDEIVKVEAEGNQIKSL  719
            T+LE L ++    S++S L +       +L  N +++ +      + ++   GNQ+K +
Sbjct: 133  TTLERLDISSNKVSDISVLAKLTNLESLIATNNQISDITPLGILTNLDELSLNGNQLKDI  192

Query: 720  VLKNKQGSLKFLNVTNNQLTSLEGVNNYTSLETLSVSKNKLESLDIKTPNKTVTNLDFSH  779
             L  L++ NNQ+++L +    T L  L + N++           +TNL+ +
Sbjct: 193  GTLASLTNLTDLDLANNQISNLAPLPGLTKLTELKLGANQISNIXPLAGLTALTNLELNE  252

Query: 780  NNV----PTSQLK  788
            N +    P S LK
Sbjct: 253  NQLEDISPISNLK  265

Identities = 56/209 (26%), Positives = 115/209 (54%), Gaps = 2/209 (0%)
Query: 575  LSLIAAANNGITSLKPLAELPNLQFLVLSHNNISDLTPLSNLTKLQELYLDHNNVKNLSA  634
            ++ + A   GI S+   L NL + S+N ++D+TPL +LTKL ++ +++N + +++
Sbjct: 4    VTTLQADRLGIKSIDGLEYLNNLTQINFSNNQLTDITPLKDLTKLVDILMNNNQIADITP  63

Query: 635  LSGKKDLKVLDLSNNKSADLSTLKT-TSLETLLLNETNTSNLSFLKQNPKVSNLTINNAK  693
            L+   +L   L L NN+ +D+  LK T+L  L L+    S++S L       +L++N +
Sbjct: 64   LANLSNLTGLTLFNNQITDIDPLKNLTNLNRLELSSNTISDISALSGLTSLQQLSLGN-Q  122

Query: 694  LASLDGIEESDEIVKVEAEGNQIKSLVLKNKQGSLKFLNVTNNQLTSLEGVNNYTSLETL  753
            + +L      +  + +   N++    + L TNNQ++    +    T+L+ L
Sbjct: 123  VTDLKPLANLTTLERLDISSNKVSDISVLAKLTNLESLIATNNQISDITPLGILTNLDEL  182
```

```
                              -continued
Query:  754  SVSKNKLESLDIKTPNKTVTNLDFSHNNV                              782
             S++ N+L+ +         +T+LD ++N +
Sbjct:  183  SLNGNQLKDIGTLASLTNLTDLDLANNQI                              211

Identities = 61/228 (26%), Positives = 118/228 (51%), Gaps = 3/228 (1%)
Query:  483  LATVTKINIGQRTNPFQRFGLSLMPNIEVLGIGFTPINDMTPVLQFKKLKQLWMTNTGIT   542
             L ++ ++++G +   +   L+ +  +E L I    ++D++ + +    L+ L  TN  I+
Sbjct:  111  LTSLQQLSLGNQVTDLKP--LANLTTLERLDISSNKVSDISVLAKLTNLESLIATNNQIS   168

Query:  543  DYSFLDKMPLLEGLDISQNGIKDLSFLTKYKQLSLIAAANNGITSLKPLAELPNLQFLVL   602
             D + L  +  L+ L ++ N +KD+  L        L+ +  ANN I++L PL   L  LL
Sbjct:  169  DITPLGILTNLDELSLNGNQLKDIGTLASLTNLTDLDLANNQISNLAPLPGLTKLTELKL   228

Query:  603  SHNNISDLTPLSNLTKLQELYLDHNNVKNLSALSGKKDLKVLDLSNNKSADLSTLKT-TS   661
                N IS++ PL+ LT L  L L+ N ++++S +S  K+L  L L  N  +D+S + + T
Sbjct:  229  GANQISNIXPLAGLTALTNLELNENQLEDISPISNLKNLTYLTLYFNNISDISPVSSLTK   288

Query:  662  LETLLLNETNTSNLSFLKQNPKVSNLTINNAKLASLDGIEESDEIVKV              709
             L+ L        S++S L      ++ L+ +  +++ L +        I ++
Sbjct:  289  LQRLFFYNNKVSDVSSLANLTNINWLSAGHNQISDLTPLANLTRITQL              336

Identities = 60/286 (20%), Positives = 129/286 (44%), Gaps = 24/286 (8%)
Query:  369  SNKLSDEDQKKLIYLAEKLGLNPNQIEVLTSEDGSIIFKYPHDDHSHTIASKDIEIGKPI   428
             +N+++D D  K +    +L L+ N I  +++ G             + + + +G +
Sbjct:   77  NNQITDIDPLKNLTNLNRLELSSNTISDISALSG-------------LTSLQQLSLGNQV   123

Query:  429  PDGHHDHSHAKDKVGMATLKQIGFDDEIIQDILHADAPTPFPSNETNPEKMRQW--LATV   486
               D       K    + TL+++      + DI     T   S     ++     L  +
Sbjct:  124  TD-------LKPLANLTTLERLDISSNKVSDISVLAKLTNLESLIATNNQISDITPLGIL   176

Query:  487  TKIN-IGQRTNPFQRFG-LSLMPNIEVLGIGFTPINDMTPVLQFKKLKQLWMTNTGITDY   544
             T ++ +    N + G L+ + N+ L +    I+++ P+    KL +L +     I++
Sbjct:  177  TNLDELSLNGNQLKDIGTLASLTNLTDLDLANNQISNLAPLPGLTKLTELKLGANQISNI   236

Query:  545  SFLDKMPLLEGLDISQNGIKDLSFLTKYKQLSLIAAANNGITSLKPLAELPNLQFLVLSH   604
              L + L  L++++N ++D+S ++  K L+ +      N I+ + P++ L  LQ L   +
Sbjct:  237  XPLAGLTALTNLELNENQLEDISPISNLKNLTYLTLYFNNISDISPVSSLTKLQRLFFYN   296

Query:  605  NNISDLTPLSNLTKLQELYLDHNNVKNLSALSGKKDLKVLDLSNNK                650
             N +SD++ L+NLT +  L   HN +  +L+ L+       +  L  L++ +
Sbjct:  297  NKVSDVSSLANLTNINWLSAGHNQISDLTPLANLTRITQLGLNDQE                342
```

A related DNA sequence was identified in *S. pyogenes* <SEQ ID 4183> which encodes the amino acid sequence <SEQ ID 4184>. Analysis of this protein sequence reveals the following:

```
Possible site: 21
>>> May be a lipoprotein
```

----- Final Results -----
bacterial membrane --- Certainty = 0.0000 (Not Clear) <succ>
bacterial outside --- Certainty = 0.0000 (Not Clear) <succ>
bacterial cytoplasm --- Certainty = 0.0000 (Not Clear) <succ>

The protein has homology with the following sequences in the databases:

```
>GP:AAA69530 GB:U25448 internalin [Listeria monocytogenes]
Identities = 88/279 (31%), Positives = 149/279 (52%), Gaps = 2/279 (0%)
Query:  419  LPNLETLGIGFTPIKDISPVLQFKKLKQLLMTKTGVTDYRFLDNMPQLEGIDISQNNLKD   478
             L + TL   IK I +      L Q+ +   +TD   L ++ +L  I ++ N + D
Sbjct:    1  LDXVTTLQADRLGIKSIDGLEYLNNLTQINFSNNQLTDITPLKDLTKLVDILMNNNQIAD    60

Query:  479  ISFLSKYKNLTLVAAADNGIEDIRPLGQLPNLKFLVLSNNKISDLSPLASLHQLQELHID   538
             I+ L+    NLT +   +N I DI PL  L NL  L LS+N ISD+S L+ L  LQ+L +
Sbjct:   61  ITPLANLSNLTGLTLFNNQITDIDPLKNLTNLNRLELSSNTISDISALSGLTSLQQLSL-   119

Query:  539  NNQITDLSPVSHKESLTVVDLSRNADVDLATL-QAPKLETLMVNDTKVSHLDFLKNNPNL   597
             N Q+TDL P+++  +L +D+S N   D++ L +   LE+L+ +   ++S + +    NL
Sbjct:  120  GNQVTDLKPLANLTTLERLDISSNKVSDISVLAKLTNLESLIATNNQISDITPLGILTNL   179

Query:  598  SSLSINRAQLQSLEGIEASSVIVRVEAEGNQIKSLVLKDKQGSLTFLDVTGNQLTSLEGV   657
             +LS+N  QL+ + +  + + ++   ++ NQI +L      L+ L + ++   + +  +
Sbjct:  180  DELSLNGNQLKDIGTLASLTNLTDLDLANNQISNLAPLPGLTKLTELKLGANQISNIXPL   239

Query:  658  NNFTALDILSVSKNQLTNVNLSKPNKTVTNIDISHNNIS                        696
                 TAL  L   +++NQL  ++++   K +T  +  NNIS
Sbjct:  240  AGLTALTNLELNENQLEDISPISNLKNLTYLTLYFNNIS                        278
```

An alignment of the GAS and GBS proteins is shown below.

```
Identities = 346/753 (45%), Positives = 472/753 (61%), Gaps = 63/753 (8%)
Query: 187  SRLGNQSNSHYRVNSSK--------IAGLHYPTSNGFLFNGRG-IKGTTPTGILVEHHNH  237
            SR G  SN    + SK         +AG+ +PT +GF+      I   T  GI+V+H  H
Sbjct:  38  SRKGMTSNKIKPIKKSKKTNKTHKGVAGVDFPTDDGFILTKDSKILSKTDQGIVVDHDGH   97

Query: 238  LHFISFADLRKGGW------GSIADRYQPQKKADSKKQSPSSKKPRTENTLPKDI--KDK  289
             HFI +ADL+    +      G+  +  ++A S+  S   +         P DI   +D
Sbjct:  98  SHFIFYADLKGSPFEYLIPKGASLAKPAVAQRAASQGTSKVADPHHHYEFNPADIVAEDA  157

Query: 290  LAYLARE---LHLDI---------------------SRIRVLKTLNGEIGFEYPHDDHT  324
            L Y  R    H  +                      S +   T NG   G  +P  D
Sbjct: 158  LGYTVRHDDHFHYILKSSLSGQTQAQAKQVATRLPQTSSLVSTATANGIPGLHFPTSDGF  217

Query: 325  HVIMAKDIDLSKPIPNPHHDDEDH-------------HKGHHHD---ESDHKHEEHEHTK  368
                + ++K      HD   H              H    +D   +++  E  H+  +
Sbjct: 218  QFNGQGIVGVTKDSILVDHDGHLHPISFADLRQGGWAHVADQYDPAKKAEKPAETHQTPE  277

Query: 369  SNKLSDEDQKKLIYLAEKLGLNPNQIEVLTSEDGSIIFKYPHDDHSHTIASKDIEIGKPI  428
             ++    E Q+KL  YLAEKLG++P+ I+ + ++DG  + +YPH DH+H  +   DIEIGK  I
Sbjct: 278  LSEREKEYQEKLAYLAEKLGIDPSTIKRVETQDGKLGLEYPHHDHAHVLMLSDIEIGKDI  337

Query: 429  PDGH---HDHSHAKDKVGMATLKQIGFDDEIIQDILHA-DAPTPFPSNETNPEKMRQWLA  484
            PD H   H     K KVGM TL+  +GFD+E+I DI+   DAPTPFPSNE +P M++WLA
Sbjct: 338  PDPHAIEHARELEKHKVGMDTLRALGFDEEVILDIVRTHDAPTPFPSNEKDPNMMKEWLA  397

Query: 485  TVTKINIGQRTNPFQRFGLSLMPNIEVLGIGFTPINDMTPVLQFKKLKQLWMTNTGITDY  544
            TV K+++G R +P QR GLSL+PN+E LGIGFTPI D++PVLQFKKLKQL MT TG+TDY
Sbjct: 398  TVIKLDLGSRKDPLQRKGLSLLPNLETLGIGFTPIKDISPVLQFKKLKQLLMTKTGVTDY  457

Query: 545  SFLDKMPLLEGLDISQNGIKDLSFLTKYKQLSLIAAANNGITSLKPLAELPNLQFLVLSH  604
             FLD MP LEG+DISQN +KD+SFL+KYK L+L+AAA+NGI   ++PL +LPNL+FLVLS+
Sbjct: 458  RFLDNMPQLEGIDISQNNLKDISFLSKYKNLTLVAAADNGIEDIRPLGQLPNLKFLVLSN  517

Query: 605  NNISDLTPLSNLTKLQELYLDHNNVKNLSALSGKKDLKVLDLSNNKSADLSTLKTTSLET  664
            N ISDL+PL++L +LQEL++D+N +   +LS +S K+ L V+DLS N     DL+TL+   LET
Sbjct: 518  NKISDLSPLASLHQLQELHIDNNQITDLSPVSHKESLTVVDLSRNADVDLATLQAPKLET  577

Query: 665  LLLNETNTSNLSFLKQNPKVSNLTINNAKLASLDGIEESDEIVKVEAEGNQIKSLVLKNK  724
            L++N+T  S+L   FLK NP  +S+L+IN  A+L   SL+GIE  S    IV+VEAEGNQIKSLVLK+K
Sbjct: 578  LMVNDTKVSHLDFLKNNPNLSSLSINRAQLQSLEGIEASSVIVRVEAEGNQIKSLVLKDK  637

Query: 725  QGSLKFLNVTNNQLTSLEGVNNYTSLETLSVSKNKLESLDIKTPNKTVTNLDFSHNNVPT  784
            QGSL FL+VT NQLTSLEGVNN+T+L+  LSVSKN+L ++++  PNKTVTN+D SHNN+
Sbjct: 638  QGSLTFLDVTGNQLTSLEGVNNFTALDILSVSKNQLTNVNLSKPNKTVTNIDISHNNISL  697

Query: 785  SQLKLNEKNIPEAVAKNFPAVVEGSMVGNGSLAEKAAMASKEDKQVSD-NTNHQKNTEKS  843
            + LKLNE++IPEA+AKNFPAV EGSMVGNG+  EKAAMA+K +   + + +H  N  +
Sbjct: 698  ADLKLNEQHIPEAIAKNFPAVYEGSMVGNGTAEEKAAMATKAKESAQEASESHDYNHNHT  757

Query: 844  AQANADSKKENPKTHDEHHDHEETDHAHVGHHH                            876
             +           E+    D  H+HE+ + A    +H
Sbjct: 758  YEDEEGHAHEHRDKDDHDHEHEDENEAKDEQNH                            790
```

SEQ ID 4182 (GBS84) was expressed in *E. coli* as a His-fusion product. SDS-PAGE analysis of total cell extract is shown in FIG. 16 (lane 9; MW 97.6 kDa).

GBS84-His was purified as shown in FIG. 194, lane 7.

Based on this analysis, it was predicted that these proteins and their epitopes could be useful antigens for vaccines or diagnostics.

Possible site: 30
>>> Seems to have no N-terminal signal sequence
----- Final Results -----
bacterial cytoplasm --- Certainty = 0.1962 (Affirmative) <succ>
bacterial membrane --- Certainty = 0.0000 (Not Clear) <succ>
bacterial outside --- Certainty = 0.0000 (Not Clear) <succ>

Example 1369

A DNA sequence (GBSx1454) was identified in *S. agalactiae* <SEQ ID 4185> which encodes the amino acid sequence <SEQ ID 4186>. This protein is predicted to be GTP-binding protein lepa (lepA). Analysis of this protein sequence reveals the following:

The protein has homology with the following sequences in the GENPEPT database.

```
>GP:CAB14493 GB:Z299117 GTP-binding protein [Bacillus subtilis]
Identities = 464/603 (76%), Positives = 540/603 (88%)
Query:   8 KRQEKIRNFSIIAHIDHGKSTLADRILEKTETVSSREMQAQLLDSMDLERERGITIKLNA    67
           +RQ +IRNFSIIAHIDHGKSTLADRILEKT  ++ REM+ QLLDSMDLERERGITIKLN+
Sbjct:   9 ERQSRIRNFSIIAHIDHGKSTLADRILEKTSAITQREMKEQLLDSMDLERERGITIKLNS    68

Query:  68 IELNYTAKDGETYIFHLIDTPGHVDFTYEVSRSLAACEGAILVVDAAQGIEAQTLANVYL   127
           ++L Y AKDGE YIFHLIDTPGHVDFTYEVSRSLAACEGAILVVDAAQGIEAQTLANVYL
Sbjct:  69 VQLKYKAKDGEEYIFHLIDTPGHVDFTYEVSRSLAACEGAILVVDAAQGIEAQTLANVYL   128

Query: 128 ALDNDLEILPVINKIDLPAADPERVRAEVEDVIGLDASEAVLASAKAGIGIEEILEQIVE   187
           ALDNDLEILPVINKIDLP+A+PERVR EVEDVIGLDASEAVLASAKAGIGIEEILEQIVE
Sbjct: 129 ALDNDLEILPVINKIDLPSAEPERVRQEVEDVIGLDASEAVLASAKAGIGIEEILEQIVE   188

Query: 188 KVPAPTGEVDAPLQALIFDSVYDAYRGVILQVRIVNGMVKPGDKIQMMSNGKTFDVTEVG   247
           KVPAPTG+ +APL+ALIFDS+YDAYRGV+  +R+V G VKPG KI+MM+ GK F+VTEVG
Sbjct: 189 KVPAPTGDPEAPLKALIFDSLYDAYRGVVAYIRVVEGTVKPGQKIKMMATGKEFEVTEVG   248

Query: 248 IFTPKAVGRDFLATGDVGYIAASIKTVADTRVGDTITLANNPAIEPLHGYKQMNPMVFAG   307
           +FTPKA   + L  GDVG++ ASIK V DTRVGDTIT A NPA E L GY+++NPMV+ G
Sbjct: 249 VFTPKATPTNELTVGDVGFLTASIKNVGDTRVGDTITSAANPAEEALPGYRKLNPMVYCG   308

Query: 308 LYPIESNKYNDLREALEKLQLNDASLQFEPETSQALGFGFRCGFLGLLHMDVIQERLERE   367
           LYPI++ KYNDLREALEKL+LND+SLQ+E ETSQALGFGFRCGFLG+LHM++IQER+ERE
Sbjct: 309 LYPIDTAKYNDLREALEKLELNDSSLQYEAETSQALGFGFRCGFLGMLHMEIIQERIERE   368

Query: 368 FNIDLIMTAPSVVYHVNTTDGEMLEVSNPSEFPDPTRVDSIEEPYVKAQIMVPQEFVGAV   427
           FNIDLI TAPSV+Y V  TDGE + V NPS  PDP +++ +EEPYVKA +MVP ++VGAV
Sbjct: 369 FNIDLITTAPSVIYDVYMTDGEKVVVDNPSNMPDPQKIERVEEPYVKATMMVPNDYVGAV   428

Query: 428 MELAQRKRGDFVTMDYIDDNRVNVIYQIPLAEIVFDFFDKLKSSTRGYASFDYEISEYRR   487
           MEL Q KRG+F+ M Y+D NRV++IY +PLAEIV++FFD+LKSST+GYASFDYE+   Y+
Sbjct: 429 MELCQGKRGNFIDMQYLDANRVSIIYDMPLAEIVYEFFDQLKSSTKGYASFDYELIGYKP   488

Query: 488 SQLXKMDILLNGDKVDALSFIVHKEFAYERGKLIVDKLKKIIPRQQFEVPIQAAIGQKIV   547
           S+L  KMDI+LNG+K+DALSFIVH+++AYERGK+IV+KL+++IPRQQFEVP+QAAIGQKIV
Sbjct: 489 SKLVKMDIMLNGEKIDALSFIVHRDYAYERGKVIVEKLKELIPRQQFEVPVQAAIGQKIV   548

Query: 548 ARSDIKALRKNVLAKCYGGDVSRKRKLLEKQKAGKKRMKAIGSVEVPQEAFLSVLSMDDD   607
           ARS IKA+RKNVLAKCYGGD+SRKRKLLEKQK GK+RMK +GSVEVPQEAF++VL MDD
Sbjct: 549 ARSTIKAMRKNVLAKCYGGDISRKRKLLEKQKEGKRRMKQVGSVEVPQEAFMAVLKMDDS   608

Query: 608 DKK                                                           610
              KK
Sbjct: 609 PKK                                                           611
```

A related GBS sequence was identified <SEQ ID 10775> which encodes the amino acid sequence <SEQ ID 10776>. A further related GBS nucleic acid sequence <SEQ ID 10955> which encodes amino acid sequence <SEQ ID 10956> was also identified.

A related DNA sequence was identified in *S. pyogenes* <SEQ ID 4187> which encodes the amino acid sequence <SEQ ID 4188>. Analysis of this protein sequence reveals the following:

Possible site: 30
>>> Seems to have no N-terminal signal sequence

----- Final Results -----
bacterial cytoplasm --- Certainty = 0.1829 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the databases:

```
>GP:CAB14493 GB:Z99117 GTP-binding protein [Bacillus subtilis]
Identities = 463/603 (76%), Positives = 542/603 (89%)
Query:   8 KRQEKIRNFSIIAHIDHGKSTLADRILEKTETVSSREMQAQLLDSMDLERERGITIKLNA    67
           +RQ +IRNFSIIAHIDHGKSTLADRILEKT  ++ REM+ QLLDSMDLERERGITIKLN+
Sbjct:   9 ERQSRIRNFSIIAHIDHGKSTLADRILEKTSAITQREMKEQLLDSMDLERERGITIKLNS    68

Query:  68 IELNYTAKDGETYIFHLIDTPGHVDFTYEVSRSLAACEGAILVVDAAQGIEAQTLANVYL   127
           ++L Y AKDGE YIFHLIDTPGHVDFTYEVSRSLAACEGAILVVDAAQGIEAQTLANVYL
Sbjct:  69 VQLKYKAKDGEEYIFHLIDTPGHVDFTYEVSRSLAACEGAILVVDAAQGIEAQTLANVYL   128

Query: 128 ALDNDLEILPVINKIDLPAADPERVRHEVEDVIGLDASEAVLASAKAGIGIEEILEQIVE   187
           ALDNDLEILPVINKIDLP+A+PERVR EVEDVIGLDASEAVLASAKAGIGIEEILEQIVE
Sbjct: 129 ALDNDLEILPVINKIDLPSAEPERVRQEVEDVIGLDASEAVLASAKAGIGIEEILEQIVE   188
```

-continued

```
Query: 188  KVPAPTGDVDAPLQALIFDSVYDAYRGVILQVRIVNGIVKPGDKIQMMSNGKTFDVTEVG   247
            KVPAPTGD +APL+ALIFDS+YDAYRGV+  +R+V G VKPG KI+MM+ GK F+VTEVG
Sbjct: 189  KVPAPTGDPEAPLKALIFDSLYDAYRGVVAYIRVVEGTVKPGQKIKMMATGKEFEVTEVG   248

Query: 248  IFTPKAVGRDFLATGDVGYVAASIKTVADTRVGDTVTLANNPAKEALHGYKQMNPMVFAG   307
            +FTPKA    + L  GDVG++ ASIK V DTRVGDT+T A NPA+EAL GY+++NPMV+ G
Sbjct: 249  VFTPKATPTNELTVGDVGFLTASIKNVGDTRVGDTITSAANPAEEALPGYRKLNPMVYCG   308

Query: 308  IYPIESNKYNDLREALEKLQLNDASLQFEPETSQALGFGFRCGFLGLLHMDVIQERLERE   367
            +YPI++ KYNDLREALEKL+LND+SLQ+E ETSQALGFGFRCGFLG+LHM++IQER+ERE
Sbjct: 309  LYPIDTAKYNDLREALEKLELNDSSLQYEAETSQALGFGFRCGFLGMLHMEIIQERIERE   368

Query: 368  FNIDLIMTAPSVVYHVHTTDEDMIEVSNPSEFPDPTRVAFIEEPYVKAQIMVPQEFVGAV   427
            FNIDLI TAPSV+Y V+ TD + + V NPS  PDP ++ +EEPYVKA +MVP ++VGAV
Sbjct: 369  FNIDLITTAPSVIYDVYMTDGEKVVVDNPSNMPDPQKIERVEEPYVKATMMVPNDYVGAV   428

Query: 428  MELSQRKRGDFVTMDYIDDNRVNVIYQIPLAEIVFDFFDKLKSSTRGYASFDYDMSEYRR   487
            MEL Q KRG+F+ M Y+D NRV++IY +PLAEIV++FFD +LKSST+GYASFDY++  Y+
Sbjct: 429  MELCQGKRGNFIDMQYLDANRVSIIYDMPLAEIVYEFFDQLKSSTKGYASFDYELIGYKP   488

Query: 488  SQLVKMDILLNGDKVDALSFIVHKEFAYERGKIIVEKLKKIIPRQQFEVPIQAAIGQKIV   547
            S+LVKMDI+LNG+K+DALSFIVH+++AYERGK IVEKLK++IPRQQFEVP +QAAIGQKIV
Sbjct: 489  SKLVKMDIMLNGEKIDALSFIVHRDYAYERGKVIVEKLKELIPRQQFEVPVQAAIGQKIV   548

Query: 548  ARSDIKALRKNVLAKCYGGDVSRKRKLLEKQKAGKKRMKAIGSVEVPQEAFLSVLSMDDD   607
            ARS IKA+RKNVLAKCYGGD+SRKRKLLEKQK GK+RMK +GSVEVPQEAF++VL MDD
Sbjct: 549  ARSTIKAMRKNVLAKCYGGDISRKRKLLEKQKEGKRRMKQVGSVEVPQEAFMAVLKMDDS   608

Query: 608  TKK                                                          610
              KK
Sbjct: 609  PKK                                                          611
```

An alignment of the GAS and GBS proteins is shown below.

```
Identities = 587/610 (96%), Positives = 601/610 (98%)
Query:   1  MNIEDLKKRQEKIRNFSIIAHIDHGKSTLADRILEKTETVSSREMQAQLLDSMDLERERG   60
            MN +DLKKRQEKIRNFSIIAHIDHGKSTLADRILEKTETVSSREMQAQLLDSMDLERERG
Sbjct:   1  MNSQDLKKRQEKIRNFSIIAHIDHGKSTLADRILEKTETVSSREMQAQLLDSMDLERERG   60

Query:  61  ITIKLNAIELNYTAKDGETYIFHLIDTPGHVDFTYEVSRSLAACEGAILVVDAAQGIEAQ   120
            ITIKLNAIELNYTAKDGETYIFHLIDTPGHVDFTYEVSRSLAACEGAILVVDAAQGIEAQ
Sbjct:  61  ITIKLNAIELNYTAKDGETYIFHLIDTPGHVDFTYEVSRSLAACEGAILVVDAAQGIEAQ   120

Query: 121  TLANVYLALDNDLEILPVINKIDLPAADPERVRAEVEDVIGLDASEAVLASAKAGIGIEE   180
            TLANVYLALDNDLEILPVINKIDLPAADPERVR EVEDVIGLDASEAVLASAKAGIGIEE
Sbjct: 121  TLANVYLALDNDLEILPVINKIDLPAADPERVRHEVEDVIGLDASEAVLASAKAGIGIEE   180

Query: 181  ILEQIVEKVPAPTGEVDAPLQALIFDSVYDAYRGVILQVRIVNGMVKPGDKIQMMSNGKT   240
            ILEQIVEKVPAPTG+VDAPLQALIFDSVYDAYRGVILQVRIVNG+VKPGDKIQMMSNGKT
Sbjct: 181  ILEQIVEKVPAPTGDVDAPLQALIFDSVYDAYRGVILQVRIVNGIVKPGDKIQMMSNGKT   240

Query: 241  FDVTEVGIFTPKAVGRDFLATGDVGYIAASIKTVADTRVGDTITLANNPAIEPLHGYKQM   300
            FDVTEVGIFTPKAVGRDFLATGDVGY+AASIKTVADTRVGDT+TLANNPA E LHGYKQM
Sbjct: 241  FDVTEVGIFTPKAVGRDFLATGDVGYVAASIKTVADTRVGDTVTLANNPAKEALHGYKQM   300

Query: 301  NPMVFAGLYPIESNKYNDLREALEKLQLNDASLQFEPETSQALGFGFRCGFLGLLHMDVI   360
            NPMVFAG+YPIESNKYNDLREALEKLQLNDASLQFEPETSQALGFGFRCGFLGLLHMDVI
Sbjct: 301  NPMVFAGIYPIESNKYNDLREALEKLQLNDASLQFEPETSQALGFGFRCGFLGLLHMDVI   360

Query: 361  QERLEREFNIDLIMTAPSVVYHVNTTDGEMLEVSNPSEFPDPTRVDSIEEPYVKAQIMVP   420
            QERLEREFNIDLIMTAPSVVYHV+TTD +M+EVSNPSEFPDPTRV  IEEPYVKAQIMVP
Sbjct: 361  QERLEREFNIDLIMTAPSVVYHVHTTDEDMIEVSNPSEFPDPTRVAFIEEPYVKAQIMVP   420

Query: 421  QEFVGAVMELAQRKRGDFVTMDYIDDNRVNVIYQIPLAEIVFDFFDKLKSSTRGYASFDY   480
            QEFVGAVMEL+QRKRGDFVTMDYIDDNRVNVIYQIPLAEIVFDFFDKLKSSTRGYASFDY
Sbjct: 421  QEFVGAVMELSQRKRGDFVTMDYIDDNRVNVIYQIPLAEIVFDFFDKLKSSTRGYASFDY   480

Query: 481  EISEYRRSQLXKMDILLNGDKVDALSFIVHKEFAYERGKLIVDKLKKIIPRQQFEVPIQA   540
            ++SEYRRSQL KMDILLNGDKVDALSFIVHKEFAYERGK+IV KLKKIIPRQQFEVPIQA
Sbjct: 481  DMSEYRRSQLVKMDILLNGDKVDALSFIVHKEFAYERGKIIVEKLKKIIPRQQFEVPIQA   540

Query: 541  AIGQKIVARSDIKALRKNVLAKCYGGDVSRKRKLLEKQKAGKKRMKAIGSVEVPQEAFLS   600
            AIGQKIVARSDIKALRKNVLAKCYGGDVSRKRKLLEKQKAGKKRMKAIGSVEVPQEAFLS
Sbjct: 541  AIGQKIVARSDIKALRKNVLAKCYGGDVSRKRKLLEKQKAGKKRMKAIGSVEVPQEAFLS   600
```

```
Query: 601  VLSMDDDDKK                                               610
            VLSMDDD KK
Sbjct: 601  VLSMDDDTKK                                               610
```

Based on this analysis, it was predicted that these proteins and their epitopes could be useful antigens for vaccines or diagnostics.

Example 1370

A DNA sequence (GBSx1455) was identified in *S. agalactiae* <SEQ ID 4189> which encodes the amino acid sequence <SEQ ID 4190>. This protein is predicted to be awd gene product (ndk). Analysis of this protein sequence reveals the following:

---

Possible site: 42
>>> Seems to have no N-terminal signal sequence
----- Final Results -----
  bacterial cytoplasm --- Certainty = 0.2097 (Affirmative) <succ>
    bacterial membrane --- Certainty = 0.0000 (Not Clear) <succ>
      bacterial outside --- Certainty = 0.0000 (Not Clear) <succ>

---

The protein has homology with the following sequences in the GENPEPT database.

```
>GP:AAF57188 GB:AE003779 awd gene product [Drosophila melanogaster]
Identities = 73/136 (53%), Positives = 100/136 (72%), Gaps = 5/136 (3%)

Query:   2  EQTFFMIKPDGVKRGFIGEVISRIERRGFSIDRLEVRYADADILKRHYAELTDRPFFPTL   61
            E+TF M+KPDGV+RG +G++I R E++GF +  L+   +A  ++L++HYA+L+ RPFFP L
Sbjct:  25  ERTFIMVKPDGVQRGLVGKIIERFEQKGFKLVALKFTWASKELLEKHYADLSARPFFPGL   84

Query:  62  VDYMTSGPVIIGVISGEEVISTWRTMMGSTNPKDALPGTIRGDFAQAPSPNQATCNIVHG  121
            V+YM SGPV+  V  G V+ T R M+G+TNP D+LPGTIRGDF        Q    NI+HG
Sbjct:  85  VNYMNSGPVVPMVWEGLNVVKTGRQMLGATNPADSLPGTIRGDFC-----IQVGRNIIHG  139

Query: 122  SDSPESATREIAIWFN                                             137
            SD+ ESA +EIA+WFN
Sbjct: 140  SDAVESAEKEIALWFN                                             155
```

A related DNA sequence was identified in *S. pyogenes* <SEQ ID 4191> which encodes the amino acid sequence <SEQ ID 4192>. Analysis of this protein sequence reveals the following:

---

Possible site: 22
>>> Seems to have no N-terminal signal sequence
----- Final Results -----
  bacterial cytoplasm --- Certainty = 0.2913 (Affirmative) <succ>
    bacterial membrane --- Certainty = 0.0000 (Not Clear) <succ>
      bacterial outside --- Certainty = 0.0000 (Not Clear) <succ>

---

An alignment of the GAS and GBS proteins is shown below.

```
Identities = 30/48 (62%), Positives = 35/48 (72%)
Query:  87  MMGSTNPKDALPGTIRGDFAQAPSPNQATCNIVHGSDSPESATREIAI   134
            MM  TNPKDAL GTIR +FAQAP +    N+VHGS S +SA REIA+
Sbjct:   1  MMRVTNPKDALCGTIRENFAQAPGDDGGIFNMVHGSHSRDSARREIAL    48
```

Based on this analysis, it was predicted that these proteins and their epitopes could be useful antigens for vaccines or diagnostics.

Example 1371

A DNA sequence (GBSx1456) was identified in *S. agalactiae* <SEQ ID 4193> which encodes the amino acid sequence <SEQ ID 4194>. Analysis of this protein sequence reveals the following:

---

Possible site: 15
>>> Seems to have no N-terminal signal sequence
----- Final Results -----
  bacterial cytoplasm --- Certainty = 0.2734 (Affirmative) <succ>
    bacterial membrane --- Certainty = 0.0000 (Not Clear) <succ>
      bacterial outside --- Certainty = 0.0000 (Not Clear) <succ>

---

The protein has no significant homology with any sequences in the GENPEPT database.

A related DNA sequence was identified in *S. pyogenes* <SEQ ID 4195> which encodes the amino acid sequence <SEQ ID 4196>. Analysis of this protein sequence reveals the following:

---

Possible site: 16
>>> Seems to have no N-terminal signal sequence
----- Final Results -----
  bacterial cytoplasm --- Certainty = 0.1985 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 22/34 (64%), Positives = 26/34 (75%)
Query:  28   SFGTIRNSTALKQLTLDSLNLLSFGTIRNSTALK    61
             SFGTI+NS ALKQ    + +N  SFGTI+NS ALK
Sbjct:   7   SFGTIQNSIALKQKAQEEINQRSFGTIQNSIALK    40

Identities = 22/34 (64%), Positives = 26/34 (75%)
Query:   6   SFGTIRNSTALKLYAKQSPAFRSFGTIRNSTALK    39
             SFGTI+NS ALK  A++     RSFGTI+NS ALK
Sbjct:   7   SFGTIQNSIALKQKAQEEINQRSFGTIQNSIALK    40
```

Based on this analysis, it was predicted that these proteins and their epitopes could be useful antigens for vaccines or diagnostics.

Example 1372

A DNA sequence (GBSx1457) was identified in *S. agalactiae* <SEQ ID 4197> which encodes the amino acid sequence <SEQ ID 4198>. Analysis of this protein sequence reveals the following:

---

Possible site: 16
>>> Seems to have no N-terminal signal sequence
----- Final Results -----
  bacterial cytoplasm --- Certainty = 0.1407 (Affirmative) <succ>
    bacterial membrane --- Certainty = 0.0000 (Not Clear) <succ>
    bacterial outside --- Certainty = 0.0000 (Not Clear) <succ>

---

The protein has no significant homology with any sequences in the GENPEPT database.

A related DNA sequence was identified in *S. pyogenes* <SEQ ID 4199> which encodes the amino acid sequence <SEQ ID 4200>. Analysis of this protein sequence reveals the following:

---

Possible site: 37
>>> Seems to have no N-terminal signal sequence
----- Final Results -----
  bacterial cytoplasm --- Certainty = 0.2055 (Affirmative) <succ>
    bacterial membrane --- Certainty = 0.0000 (Not Clear) <succ>
    bacterial outside --- Certainty = 0.0000 (Not Clear) <succ>

---

An alignment of the GAS and GBS proteins is shown below.

```
Identities = 154/221 (69%), Positives = 187/221 (83%)
Query:    1  MIKINFPILDEPLVLSNATILTIEDVSVYSSLVKHFYQYDVDEHLKLFDDKQKSLKATEL    60
             ++ +NF +LDEP+ L   TIL +EDV V+S +V++ YQY+ D  LK FD K K++K +E+
Sbjct:    8  LMNLNFSLLDEPIPLRGGTILVLEDVCVFSKIVQYCYQYEEDSELKFFDHKMKTIKESEI    67

Query:   61  MLVTDILGYDVNSAPILKLIHGDLENQFNEKPEVKSMVEKLAATITELIAFECLENELDL   120
             MLVTDILG+DVNS+ ILKLIH DLE+QFNEKPEVKSM++KL ATITELI FECLENELDL
Sbjct:   68  MLVTDILGFDVNSSTILKLIHADLESQFNEKPEVKSMIDKLVATITELIVFECLENELDL   127

Query:  121  EYDEIKILELIKALGVKIETQSDTIFEKCFEIIQVYHYLTKKNLLVFVNSGAYLTKDEVI   180
             EYDEI ILELIK+LGVK+ETQSDTIFEKC EI+Q++ YLTKK LL+FVNSGA+LTKDEV
Sbjct:  128  EYDEITILELIKSLGVKVETQSDTIFEKCLEILQIFKYLTKKKLLIFVNSGAFLTKDEVA   187

Query:  181  KLCEYINLMQKSVLFLEPRRLYDLPQYVIDKDYFLIGENMV                     221
             L EYI+L   +VLFLEPR LYD PQY++D+DYFLI +NMV
Sbjct:  188  SLQEYISLTNLTVLFLEPRELYDFPQYILDEDYFLITKNMV                     228
```

Based on this analysis, it was predicted that these proteins and their epitopes could be useful antigens for vaccines or diagnostics.

Example 1373

A DNA sequence (GBSx1458) was identified in *S. agalactiae* <SEQ ID 4201> which encodes the amino acid sequence <SEQ ID 4202>. Analysis of this protein sequence reveals the following:

---

Possible site: 18
>>> Seems to have no N-terminal signal sequence
----- Final Results -----
  bacterial cytoplasm --- Certainty = 0.0842 (Affirmative) <succ>
    bacterial membrane --- Certainty = 0.0000 (Not Clear) <succ>
    bacterial outside --- Certainty = 0.0000 (Not Clear) <succ>

---

A related GBS nucleic acid sequence <SEQ ID 9783> which encodes amino acid sequence <SEQ ID 9784> was also identified.

The protein has homology with the following sequences in the GENPEPT database.

```
>GP:CAB83918 GB:AL162753 hypothetical protein NMA0629 [Neisseria
meningitidis Z2491]
Identities = 45/104 (43%), Positives = 65/104 (62%), Gaps = 2/104 (1%)
Query:    4  RYMRMILMFDMPTETAEERKAYRKFRKFLLSEGFIMHQFSVYSKLLLNNTANNAMIGRLK    63
```

-continued

```
            ++MR+I+ FD+P   TA +RKA   +FR+FLL  +G+ M Q SVYS+++      +         RL
Sbjct:   5  KFMRIIVFFDLPVITAAKRKAANQFRQFLLKDGYQMLQLSVYSRIVKGRDSLQKHHNRLC    64

Query:  64  VNNPKKGNITLLTVTEKQFARMVYLHGERNT--SVANSDSRLVF                    105
            N P++G+I  L +TEKQ+A M  L GE  T     NSD  L+F
Sbjct:  65  ANLPQEGSIRCLEITEKQYAAMKLLLGELKTQEKKVNSDQLLLF                    108
```

A related DNA sequence was identified in *S. pyogenes* <SEQ ID 4203> which encodes the amino acid sequence <SEQ ID 4204>. Analysis of this protein sequence reveals the following:

Possible site: 18
>>> Seems to have no N-terminal signal sequence
----- Final Results -----
   bacterial cytoplasm --- Certainty = 0.0822 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

```
Identities = 97/112 (86%), Positives = 107/112 (94%)
Query:   1  MSYRYMRMILMFDMPTETAEERKAYRKFRKFLLSEGFIMHQFSVYSKLLLNNTANNAMIG    60
            MSYRYMRMILMFDMPT+TAEERKAYRKFRKFLLSEGFIMHQFS+YSKLLLNNTANNAMIG
Sbjct:   1  MSYRYMRMILMFDMPTDTAEERKAYRKFRKFLLSEGFIMHQFSIYSKLLLNNTANNAMIG    60

Query:  61  RLKVNNPKKGNITLLTVTEKQFARMVYLHGERNTSVANSDSRLVFLGDSYDQ            112
            RL+ +NP KGNITLLTVTEKQFARM+YLHGERN  +ANSD RLVFLG+++D+
Sbjct:  61  RLREHNPNKGNITLLTVTEKQFARMIYLHGERNNCIANSDERLVFLGEAFDE            112
```

Based on this analysis, it was predicted that these proteins and their epitopes could be useful antigens for vaccines or diagnostics.

Example 1374

A DNA sequence (GBSx1459) was identified in *S. agalactiae* <SEQ ID 4205> which encodes the amino acid sequence <SEQ ID 4206>. Analysis of this protein sequence reveals the following:

Possible site: 13
>>> Seems to have no N-terminal signal sequence
----- Final Results -----
   bacterial cytoplasm --- Certainty = 0.3185 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database.

```
>GP:CAB83919 GB:AL162753 hypothetical protein NMA0630 [Neisseria
meningitidis Z2491]

Identities = 71/224 (31%), Positives = 122/224 (53%)

Query:    4  WRTVVVNTHSKLSYKNNHLIFKDSYQTEMIHLSEIDILIMETTDIVLSTMLIKRLVDENI    63
             WR++++    KLS +    L+ + + ++  + L +I ++I+E  + +++   L+   L +
Sbjct:    3  WRSLLIQNGGKLSLQRRQLLIQQNGESHTVPLEDIAVIIENRETLITAPLLSALAEHGA    62

Query:   64  LVIFCDDKRLPTAMLPYYARHDSSLQLSRQMSWIEDVKADVWTSIIAQKILNQSFYLGE    123
             ++ CD++ LP    +PY   H     L Q++  E +K  +W  I+ QKILNQ+F    E
Sbjct:   63  TLLTCDEQFLPCGQWLPYAQYHRQLKILKLQLNISEPLKKQLWQHIVRQKILNQAFVADE    122

Query:  124  CSFFEKSQSIMNLYHDLEPFDPSNREGHAARIYFNTLFGNDFSREQDNPINAGLDYGYSL    183
                  ++ + L  ++     D  NRE  AA +YF  LFG  F+R   +N +NA L+Y Y++
Sbjct:  123  TGNDLAAKRLRTLASEVRSGDTGNREAQAAALYFQALFGEKFTRNDNNAVNAALNYTYAV    182

Query:  184  LLSMFAREVVKCGCMTQFGLKHANQFNQFNLASDIMEPFRPIVD                    227
             L +   AR +    G +   GL H ++ N FNLA D +EP RP+ D
Sbjct:  183  LRAAVARALTLYGWLPALGLFHRSELNPFNLADDFIEPLRPLAD                    226
```

A related DNA sequence was identified in *S. pyogenes* <SEQ ID 4207> which encodes the amino acid sequence <SEQ ID 4208>. Analysis of this protein sequence reveals the following:

```
Possible site: 13
>>> Seems to have no N-terminal signal sequence
----- Final Results -----
   bacterial cytoplasm --- Certainty = 0.3185 (Affirmative) <succ>
      bacterial membrane --- Certainty = 0.0000 (Not Clear) <succ>
         bacterial outside --- Certainty = 0.0000 (Not Clear) <succ>
```

An alignment of the GAS and GBS proteins is shown below.

```
Identities = 239/289 (82%), Positives = 271/289 (93%)
Query:   1 MAGWRTVVVNTHSKLSYKNNHLIFKDSYQTEMIHLSEIDILIMETTDIVLSTMLIKRLVD    60
           MAGWRTVVVNTHSKLSYKNNHLIFKD+Y+TE+IHLSEIDIL++ETTDIVLSTML+KRLVD
Sbjct:   1 MAGWRTVVVNTHSKLSYKNNHLIFKDAYKTELIHLSEIDILLLETTDIVLSTMLVKRLVD    60

Query:  61 ENILVIFCDDKRLPTAMLMPYYARHDSSLQLSRQMSWIEDVKADVWTSIIAQKILNQSFY   120
           EN+LVIFCDDKRLPTAMLMP+Y RHDSSLQL +QMSW E VK+ VWT+IIAQKILNQS Y
Sbjct:  61 ENVLVIFCDDKRLPTAMLMPFYGRHDSSLQLGKQMSWSETVKSQVWTTIIAQKILNQSCY   120

Query: 121 LGECSFFEKSQSIMNLYHDLEPFDPSNREGHAARIYFNTLFGNDFSREQDNPINAGLDYG   180
           LG CS+FEKSQSIM+LYH LE FDPSNREGHAARIYFNTLFGNDFSR+ ++PINAGLDYG
Sbjct: 121 LGACSYFEKSQSIMDLYHGLENFDPSNREGHAARIYFNTLFGNDFSRDLEHPINAGLDYG   180

Query: 181 YSLLLSMFAREVVKCGCMTQFGLKHANQFNQFNLASDIMEPFRPIVDRIIYENRQSDFVK   240
           Y+LLLSMFAREVV  GCMTQFGLKHANQFNQFN ASDIMEPFRP+VD+I+YENR   F K
Sbjct: 181 YTLLLSMFAREVVVSGCMTQFGLKHANQFNQFNFASDIMEPFRPLVDKIVYENRNQPFPK   240

Query: 241 MKRELFSMFSETYSYNGKEMYLSNIVSDYTKKVIKSLNSDGNGIPEFRI             289
           +KRELF++FS+T+SYNGKEMYL+NI+SDYTKKV+K+LN++G G+PEFRI
Sbjct: 241 IKRELFTLFSDTFSYNGKEMYLTNIISDYTKKVVKALNNEGKGVPEFRI             289
```

Based on this analysis, it was predicted that these proteins and their epitopes could be useful antigens for vaccines or diagnostics.

Example 1375

A DNA sequence (GBSx1460) was identified in *S. agalactiae* <SEQ ID 4209> which encodes the amino acid sequence <SEQ ID 4210>. Analysis of this protein sequence reveals the following:

```
Possible site: 59
>>> Seems to have no N-terminal signal sequence
----- Final Results -----
   bacterial cytoplasm --- Certainty = 0.1109 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database.

```
>GP:CAB73943 GB:AL139078 hyopthetical protein Cj1523c [Campylobacter
jejuni]
Identities = 165/746 (22%), Positives = 291/746 (38%), Gaps = 115/746 (15%)
Query: 318 LSASMIQRYDEHREDLKQLKQFVKASLPEKYQEI--FADSSKDGYAGYIEGKTNQEAFYK    375
           L+ S  +R   + L LK +         Y++   F +S    Y G +     E   ++
Sbjct:  50 LARSARKRLARRKARLNHLKHLIANEFKLNYEDYQSFDESLAKAYKGSLISP--YELRFR   107

Query: 376 YLSKLLTKQEDSENFLE--KIKNEDFLRKQRTFDNGSIPHQVHLTELKAIIRRQS-----   428
           L++LL+KQ+ +   L    K + D ++        + G+I    +   E K +    QS
Sbjct: 108 ALNELLSKQDFARVILHIAKRRGYDDIKNSDDKEKGAILKAIKQNEEK-LANYQSVGEYL   166

Query: 429 --EYYPFLKENQDRIEKILTFRIPYY-----------IGPLAREKSDFAW-MTRKTDDSI   474
             EY+   KEN     +   + Y               +   +++ +F + ++K ++ +
Sbjct: 167 YKEYFQKFKENSKEFTNVRNKKESYERCIAQSFLKDELKLIFKKQREFGFSFSKKFEEEV   226

Query: 475 RPWNFEDLVDKEKSAEAFIHRMTNNDFYLPEEKVLPKHSLIYEKFTVYNELTKV--RYKN   532
            F        +++ + F H + N  F+  +EK PK+S +      F    +  KN
Sbjct: 227 LSVAFY-----KRALKDFSHLVGNCSFFT-DEKRAPKNSPLAFMFVALTRIINLLNNLKN   280

Query: 533 EQGETYFFDSNIKQEIFDGVFKEHRKVSK--KKLLDFLAKEYEEFRIVDVIGLDKENKAF   590
           +G  Y D      + +V K    K   KKLL L+ +YE          E    +
Sbjct: 281 TEGILYTKDD--LNALLNEVLKNGTLTYKQTKKLLG-LSDDYE---------FKGEKGTY   328
```

```
Query: 591 NASLGTYHDLEKILDKDFLDNPDNESILEDIVQTLTLFEDREMIKKRLENYKDLFTESQL    650
             Y +  KL + L    D    L +I + +TL +D  +KK L  Y     ++Q+
Sbjct: 329 FIEFKKYKEFIKALGEHNLSQDD----LNEIAKDITLIKDEIKLKKALAKYD--LNQNQI    382

Query: 651 KKLYRRHYTGWGRLSAKLINGIRDK--ESQKTILDYLIDDGRSNRNFMQLINDDGLSFKS    708
             L + +    +S K + +     E +K     D+ +   N    IN+D  F
Sbjct: 383 DSLSKLEFKDHLNISFKALKLVTPLMLEGKK------YDEACNELNLKVAINEDKKDFLP    436

Query: 709 IISKAQAGSHSDNLKEVVGELAGSPAIKKGILQSLKIVDELVKVMGYEPEQIVVEMAREN    768
             ++         N           P + + I +  K+++ L+K  G +   +I +E+ARE
Sbjct: 437 AFNETYYKDEVTN-----------PVVLRAIKEYRKVLNALLKKYG--KVHKINIELAREV    484

Query: 769 QTTNQGR----RNSRQRYKLLDDG---VKNLASDLNG-NILKEYPTDNQALQNERLFLYY    820
              + R   +   + YK    D      + L   +N  NILK              L L+
Sbjct: 485 GKNHSQRAKIEKEQNENYKAKKDAELECEKLGLKINSKNILK-------------LRLFK    531

Query: 821 LQNGRDMYTGEALDIDNLSQ---YDIDHIIPQAFIKDDSIDNRVLVSSAKNRGKSDDVPS    877
              Q       Y+GE + I +L      +IDHI  P +     DDS  N+VLV + +N+ K + P
Sbjct: 532 EQKEFCAYSGEKIKISDLQDEKMLEIDHIYPYSRSFDDSYMNKVLVFTKQNQEKLNQTP-    590

Query: 878 LEIVKDCKVFWKKL--LDAKLMSQRKYDNLTKAERGGLTSDDKARFIQRQLVETRQITKH    935
              E  +   W+K+   L   L ++++  L K          ++  F   R L +TR I +
Sbjct: 591 FEAFGNDSAKWQKIEVLAKNLPTKKQKRILDK----NYKDKEQKNFKDRNLNDTRYIARL    646

Query: 936 VARI---------LDERFNNELDSKGRRIRKVKIVTLKSNLVSNFRKEFGFYKIREVNNY    986
              V           L +  N +L+      ++  KV +      L S R    +GF       N+
Sbjct: 647 VLNYTKDYLDFLPLSDDENTKLNDT-QKGSKVHVEAKSGMLTSALRHTWGFSAKDRNNHL    705

Query: 987 HHAHDAYLNAVVAKAILTKYPQLEPE                                  1012
             HHA DA + A    +I+ +    + E
Sbjct: 706 HHAIDAVIIAYANNSIVKAFSDFKKE                                   731
```

A related DNA sequence was identified in *S. pyogenes* <SEQ ID 4211> which encodes the amino acid sequence <SEQ ID 4212>. Analysis of this protein sequence reveals the following:

Possible site: 61
>>> Seems to have no N-terminal signal sequence

----- Final Results -----
bacterial cytoplasm --- Certainty = 0.0973 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 881/1380 (63%), Positives = 1088/1380 (78%), Gaps = 22/1380 (1%)
Query:   1 MNKPYSIGLDIGTNSVGWSIITDDYKVPAKKMRVLGNTDKEYIKKNLIGALLFDGGNTAA     60
             M+K YSIGLDIGTNSVGW++ITD+YKVP+KK +VLGNTD+  IKKNLIGALLFD G TA
Sbjct:   1 MDKKYSIGLDIGTNSVGWAVITDEYKVPSKKFKVLGNTDRHSIKKNLIGALLFDSGETAE     60

Query:  61 DRRLKRTARRRYTRRRNRILYLQEIFAEEMSKVDDSFFHRLEDSFLVEEDKRGSKYPIFA    120
              RLKRTARRRYTRR+NRI YLQEIF+ EM+KVDDSFFHRLE+SFLVEEDK+    ++PIF
Sbjct:  61 ATRLKRTARRRYTRRKNRICYLQEIFSNEMAKVDDSFFHRLEESFLVEEDKKHERHPIFG    120

Query: 121 TLQEEKDYHEKFSTIYHLRKELADKKEKADLRLIYIALAHIIKFRGHFLIEDDSFDVRNT    180
                + +E  YHEK+ TIYHLRK+L D  +KADLRLIY+ALAH+IKERGHFLIE D   N+
Sbjct: 121 NIVDEVAYHEKYPTIYHLRKKLVDSTDKADLRLIYLALAHMIKFRGHFLIEGD-LNPDNS    179

Query: 181 DISKQYQDFLEIFNTTFENNDLLSQNVDVEAILTDKISKSAKKDRILAQYPNQKSTGIFA    240
             D+  K +   ++ +N FE N + +   VD +AIL+  ++SKS + + ++AQ P +K  G+F
Sbjct: 180 DVDKLFIQLVQTYNQLFEENPINASGVDAKAILSARLSKSRRLENLIAQLPGEKKNGLFG    239

Query: 241 EFLKLIVGNQADFKKYFNLEDKTPLQFAKDSYDEDLENLLGQIGDEFADLFSAAKKLYDS    300
              + L +G   +FK  F+L +    LQ +KD+YD+DL+NLL QIGD++ADLF AAK L D+
Sbjct: 240 NLIALSLGLTPNFKSNFDLAEDAKLQLSKDTYDDDLDNLLAQIGDQYADLFLAAKNLSDA    299

Query: 301 VLLSGILTVIDLSTKAPLSASMIQRYDEHREDLKQLKQFVKASLPEKYQEIFADSSKDGY    360
              +LLS IL V    TKAPLSASMI+RYDEH +DL  LK  V+  LPEKY+EIF D SK+GY
Sbjct: 300 ILLSDILRVNTEITKAPLSASMIKRYDEHHQDLTLLKALVRQQLPEKYKEIFFDQSKNGY    359

Query: 361 AGYIEGKTNQEAFYKYLSKLLTKQEDSENFLEKIKNEDFLRKQRTFDNGSIPHQVHLTEL    420
             AGYI+G   +QE FYK++   +L K +  +E  L K+  ED LRKQRTFDNGSIPHQ+HL EL
Sbjct: 360 AGYIDGGASQEEFYKFIKPILEKMDGTEELLVKLNREDLLRKQRTFDNGSIPHQIHLGEL    419

Query: 421 KAIIRRQSEYYPFLKENQDRIEKILTFRIPYYIGPLAREKSDFAWMTRKTDDSIRPWNFE    480
              AI+RRQ ++YPFLK+N++ IEKILTFRIPY++GPLAR  S FAWMTRK++++I PWNFE
Sbjct: 420 HAILRRQEDFYPFLKDNREKIEKILTFRIPYYVGPLARGNSRFAWMTRKSEETITPWNFE    479
```

-continued

```
Query:   481  DLVDKEKSAEAFIHRMTNNDFYLPEEKVLPKHSLIYEKFTVYNELTKVRYKNE-QGETYF   539
              ++VDK  SA++FI RMTN D  LP EKVLPKHSL+YE FTVYNELTKV+Y   E   +  F
Sbjct:   480  EVVDKGASAQSFIERMTNFDKNLPNEKVLPKHSLLYEYFTVYNELTKVKYVTEGMRKPAF   539

Query:   540  FDSNIKQEIFDGVFKEHRKVSKKKLLDFLAKEYEEFRIVDVIGLDKENKAFNASLGTYHD   599
                     K+ I D  +FK +RKV+ K+L +    K+ E F  V++ G++       FNASLGTYHD
Sbjct:   540  LSGEQKKAIVDLLFKTNRKVTVKQLKEDYFKKIECFDSVEISGVEDR---FNASLGTYHD   596

Query:   600  LEKIL-DKDFLDNPDNESILEDIVQTLTLFEDREMIKKRLENYKDLFTESQLKKLYRRHY   658
              L KI+ DKDFLDN +NE ILEDIV TLTLFEDREMI++RL+ Y  LF +  +K+L RR Y
Sbjct:   597  LLKIIKDKDFLDNEENEDILEDIVLTLTLFEDREMIEERLKTYAHLFDDKVMKQLKRRRY   656

Query:   659  TGWGRLSAKLINGIRDKESQKTILDYLIDDGRSNRNFMQLINDDGLSFKSIISKAQAGSH   718
              TGWGRLS KLINGIRDK+S KTILD+L  DG +NRNFMQLI+DD L+FK  I KAQ
Sbjct:   657  TGWGRLSRKLINGIRDKQSGKTILDFLKSDGFANRNFMQLIHDDSLTFKEDIQKAQVSGQ   716

Query:   719  SDNLKEVVGELAGSPAIKKGILQSLKIVDELVKVMG-YEPEQIVVEMARENQTTNQGRRN   777
                 D+L E +  LAGSPAIKKGILQ++K+VDELVKVMG ++PE IV+EMARENQTT +G++N
Sbjct:   717  GDSLHEHIANLAGSPAIKKGILQTVKVVDELVKVMGRHKPENIVIEMARENQTTQKGQKN   776

Query:   778  SRQRYKLLDDGVKNLASDLNGNILKEYPTDNQALQNERLFLYYLQNGRDMYTGEALDIDN   837
              SR+R  K +++G+K L S       ILKE+P +N  LQNE+L+LYYLQNGRDMY   + LDI+
Sbjct:   777  SRERMKRIEEGIKELGS----QILKEHPVENTQLQNEKLYLYYLQNGRDMYVDQELDINR   832

Query:   838  LSQYDIDHIIPQAFIKDDSIDNRVLVSSAKNRGKSDDVPSLEIVKDCKVFWKKLLDAKLM   897
              LS YD+DHI+PQ+F+KDDSIDN VL  S KNRGKSD+VPS E+VK  K +W++LL+AKL+
Sbjct:   833  LSDYDVDHIVPQSFLKDDSIDNKVLTRSDKNRGKSDNVPSEEVVKKMKNYWRQLLNAKLI   892

Query:   898  SQRKYDNLTKAERGGLTSDDKARFIQRQLVETRQITKHVARILDERFNNELDSKGRRIRK   957
              +QRK+DNLTKAERGGL+   DKA FI+RQLVETRQITKHVA+ILD R N + D    + IR+
Sbjct:   893  TQRKFDNLTKAERGGLSELDKAGFIKRQLVETRQITKHVAQILDSRMNTKYDENDKLIRE   952

Query:   958  VKIVTLKSNLVSNFRKEFGFYKIREVNNYHHAHDAYLNAVVAKAILTKYPQLEPEFVYGD   1017
              VK++TLKS LVS+FRK+F FYK+RE+NNYHHAHDAYLNAVV  A++ KYP+LE EFVYGD
Sbjct:   953  VKVITLKSKLVSDFRKDFQFYKVREINNYHHAHDAYLNAVVGTALIKKYPKLESEFVYGD   1012

Query:   1018 YPKYN-------SYKTRKSATEKLFFYSNIMNFFKTKVTLADGTVVVKDDIEVNNDTGEI   1070
              Y  Y+       S +       AT K FFYSNIMNFFKT++TLA+G +  +    IE N +TGEI
Sbjct:   1013 YKVYDVRKMIAKSEQEIGKATAKYFFYSNIMNFFKTEITLANGEIRKRPLIETNGETGEI   1072

Query:   1071 VWDKKKHFATVRRKVLSYPQNNIVKKTEIQTGGFSKESILAHGNSDKLIPRKTKDIYLDPK   1130
              VWDK + +FATVRKVLS PQ NIVKKTE+QTGGFSKESIL   NSDKLI RK  KD   DPK
Sbjct:   1073 VWDKGRDFATVRKVLSMPQVNIVKKTEVQTGGFSKESILPKRNSDKLIARK-KD--WDPK   1129

Query:   1131 KYGGFDSPIVAYSVLVVADIKKGKAQKLKTVTELLGITIMERSRFEKNPSAFLESKGYLN   1190
              KYGGFDSP VAYSVLVVA ++KGK++KLK+V ELLGITIMERS FEKNP    FLE+KGY
Sbjct:   1130 KYGGFDSPTVAYSVLVVAKVEKGKSKKLKSVKELLGITIMERSSFEKNPIDFLEAKGYKE   1189

Query:   1191 IRADKLIILPKYSLFELENGRRRLLASAGELQKGNELALPTQFMKFLYLASRYNESKGKP   1250
              ++ D +I LPKYSLFELENGR+R+LASAGELQKGNELALP++++  FLYLAS Y + KG P
Sbjct:   1190 VKKDLIIKLPKYSLFELENGRKRMLASAGELQKGNELALPSKYVNFLYLASHYEKLKGSP   1249

Query:   1251 EEIEKKQEFVNQHVSYFDDILQLINDFSKRVILADANLEKINKLYQDNKENISVDELANN   1310
              E+ E+KQ FV QH Y D+I++   I++FSKRVILADANL+K+    Y +++   + E AN
Sbjct:   1250 EDNEQKQLFVEQHKHYLDEIIEQISEFSKRVILADANLDKVLSAYNKHRDK-PIREQAEN   1308

Query:   1311 IINLFTFTSLGAPAAFKFFDKIVDRKRYTSTKEVLNSTLIHQSITGLYETRIDLGKLGED   1370
              II+LFT T+LGAPAAFK+FD  +DRKRYTSTKEVL++TLIHQSITGLYETRIDL +LG D
Sbjct:   1309 IIHLFTLTNLGAPAAFKYFDTTIDRKRYTSTKEVLDATLIHQSITGLYETRIDLSQLGGD   1368
```

SEQ ID 4210 (GBS317) was expressed in *E. coli* as a GST-fusion product. SDS-PAGE analysis of total cell extract is shown in FIG. 27 (lane 2; MW 179.3 kDa) and in FIG. 159 (lane 5 & 6; MW 180 kDa). It was also expressed in *E. coli* as a His-fusion product. SDS-PAGE analysis of total cell extract is shown in FIG. 27 (lane 3; MW 154.3 kDa) and in FIG. 159 (lane 9 & 10; MW 154 kDa).

GBS317-GST was purified as shown in FIG. 224, lane 9-10. GBS317-His was purified as shown in FIG. 222, lane 9.

GBS317N was expressed in *E. coli* as a GST-fusion product. SDS-PAGE analysis of total cell extract is shown in FIG. 149 (lane 2-4; MW 116 kDa).

Figure 166:
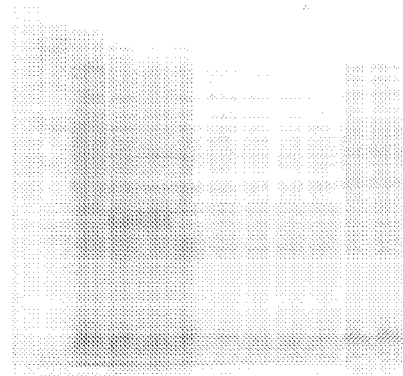

GBS317C was expressed in *E. coli* as a GST-fusion product. SDS-PAGE analysis of total cell extract is shown in FIG. 166 (lane 6-8; MW 92 kDa).

Figure 187:
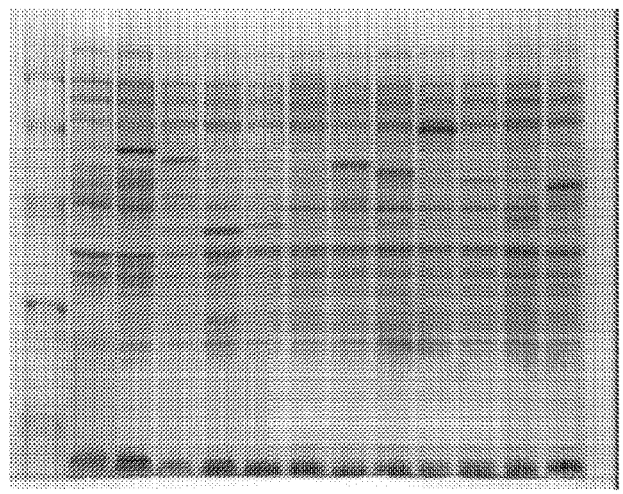

GBS317dN was expressed in *E. coli* as a GST-fusion product. SDS-PAGE analysis of total cell extract is shown in FIG. 187 (lane 7; MW 116 kDa). Purified GBS317dN-GST is shown in FIG. 245, lane 8.

GBS317C was expressed in *E. coli* as a GST-fusion product. SDS-PAGE analysis of total cell extract is shown in FIG. 188 (lane 13; MW 92 kDa). Purified GBS317dC-GST is shown in FIG. 245, lane 9.

Based on this analysis, it was predicted that these proteins and their epitopes could be useful antigens for vaccines or diagnostics.

Example 1376

A DNA sequence (GBSx1461) was identified in *S. agalactiae* <SEQ ID 4213> which encodes the amino acid sequence <SEQ ID 4214>. Analysis of this protein sequence reveals the following:

```
Possible site: 25
>>> Seems to have a cleavable N-term signal seq.
INTEGRAL    Likelihood = -11.94   Transmembrane 132-148 (123-156)
INTEGRAL    Likelihood = -11.09   Transmembrane 190-206 (183-209)
INTEGRAL    Likelihood = -4.94    Transmembrane 95-111 (94-115)
----- Final Results -----
    bacterial membrane --- Certainty = 0.5776 (Affirmative) <succ>
       bacterial outside --- Certainty = 0.0000 (Not Clear) <succ>
       bacterial cytoplasm --- Certainty = 0.0000 (Not Clear) <succ>
```

The protein has no significant homology with any sequences in the GENPEPT database.

A related sequence was also identified in GAS <SEQ ID 9133> which encodes the amino acid sequence <SEQ ID 9134>. Analysis of this protein sequence reveals the following:

```
Possible site: 22
>>> Seems to have a cleavable N-term signal seq.
INTEGRAL    Likelihood = -7.32    Transmembrane 126-142
INTEGRAL    Likelihood = -6.90    Transmembrane 178-194
----- Final Results -----
    bacterial membrane --- Certainty = 0.3930 (Affirmative) <succ>
       bacterial outside --- Certainty = 0.0000 (Not Clear) <succ>
       bacterial cytoplasm --- Certainty = 0.0000 (Not Clear) <succ>
```

An alignment of the GAS and GBS proteins is shown below.

```
Identities = 94/204 (46%), Positives = 139/204 (68%)
Query:    5  LMKDKLLVVLTWIWIISLATLATIYIAWLIYPIEIQFLKLEKVVYLKAETIYYNFNKLMI      64
             +M +    ++ +W+W+++LA L TIY  WL YP+E+  LKLE+VV++  + I +N+N L+
Sbjct:    4  VMVENTKLLCSWVWLLALAILITIYSTWLWYPLEVDHLKLEQVVFMSKDAILHNYNGLLN      63

Query:   65  YLTHPFISDLNMPSFPSSEDGLKHFADVKYLFTLAHGLFVILTFPVIYFLRRGWKQKSIF     124
             YLT+PF++  L   +F SS DGLKHFADVK+LF L    +F+ L +P +      + K K    +
Sbjct:   64  YLTNPFVTRLEFANFHSSADGLKHFADVKWLFHLTQVVFLGLLYPTLKTFTQRLKTKRFW     123

Query:  125  LYEGFFKIAIMLPIFIVVCAFLLGFDQFFTLFHEVLFPGDSTWQFNPLTDPVIWILPETF     184
             L +     +A + P+ I + A  +GF+ FFTLFH+VLF GDS+W F+PL D VIWILPE F
Sbjct:  124  LLQKPLILAALFPLMIGLMASFIGFEHFFTLFHQVLFVGDSSWLFDPLKDSVIWILPEVF     183

Query:  185  FLHCFIIFLLIYETITIILLIIGR                                         208
             FLHCF+ F+++YE I    L+ + R
Sbjct:  184  FLHCFLFFMIVYEIILWSLVGLAR                                         207
```

SEQ ID 4214 (GBS167) was expressed in and purified from *E. coli*. The purified protein is shown in lanes 5 & 6 of FIG. 223.

Based on this analysis, it was predicted that these proteins and their epitopes could be useful antigens for vaccines or diagnostics.

Example 1377

A DNA sequence (GBSx1462) was identified in *S. agalactiae* <SEQ ID 4217> which encodes the amino acid sequence <SEQ ID 4218>. This protein is predicted to be p-nitrophenyl phosphatase (pho2). Analysis of this protein sequence reveals the following:

```
Possible site: 48
>>> Seems to have no N-terminal signal sequence
----- Final Results -----
    bacterial cytoplasm --- Certainty = 0.3925 (Affirmative) <succ>
       bacterial membrane --- Certainty = 0.0000 (Not Clear) <succ>
       bacterial outside --- Certainty = 0.0000 (Not Clear) <succ>
```

The protein has homology with the following sequences in the GENPEPT database.

```
>GP:CAB15219 GB:Z99120 similar to N-acetyl-glucosamine catabolism
[Bacillus subtilis]
Identities = 121/249 (48%), Positives = 172/249 (68%)
Query:    3  YKGYLIDLDGTIYKGKSRIPAGERFIERLQEKGIPYMLVTNNTTRTPESVQEMLRGFNVE      62
             YKGYLIDLDGT+Y G  +I       F+  L+++G+PY+ VTNN++RTP+ V + L  F++
Sbjct:    4  YKGYLIDLDGTMYNGTEKIEEACEFVRTLKDRGVPYLFVTNNSSRTPKQVADKLVSFDIP      63

Query:   63  TPLETIYTATMATVDYMNDMNRGKTAYVIGEEGLKKAIADAGYVEDTKNPAYVVVGLDWN     122
                 E ++T +MAT ++      + + YVIGEEG+++AI + G     +N +VVVG+D +
Sbjct:   64  ATEEQVFTTSMATAQHIAQQKKDASVYVIGEEGIRQAIEENGLTFGGENADFVVVGIDRS     123
```

```
Query: 123 VTYDKLATATLAIQNGALFIGTNPDLNIPTERGLLPGAGSLNALLEAATRIKPVFIGKPN     182
            +TY+K A   LAI+NGA FI TN D+ IPTERGLLPG GSL ++L  +T ++PVFIGKP
Sbjct: 124 ITYEKFAVGCLAIRNGARFISTNGDIAIPTERGLLPGNGSLTSVLTVSTGVQPVFIGKPE     183

Query: 183 AIIMNKALEILNIPRNQAVMVGDNYLTDIMAGINNDIDTLLVTTGFTTVEEVPDLPIQPS     242
            +IIM +A+ +L    ++ +MVGDNY TDIMAGIN +DTLLV TG T  E + D   +P+
Sbjct: 184 SIIMEQAMRVLGTDVSETLMVGDNYATDIMAGINAGMDTLLVHTGVTKREHMTDDMEKPT     243

Query: 243 YVLASLDEW                                                        251
            + + SL EW
Sbjct: 244 HAIDSLTEW                                                        252
```

A related DNA sequence was identified in *S. pyogenes* <SEQ ID 4219> which encodes the amino acid sequence <SEQ ID 4220>. Analysis of this protein sequence reveals the following:

```
Possible site: 48
>>> Seems to have no N-terminal signal sequence
INTEGRAL    Likelihood = –0.53   Transmembrane 128-144 (128-144)
----- Final Results -----
    bacterial membrane --- Certainty = 0.1213 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the databases:

```
>GP:CAB15219 GB:Z99120 similar to N-acetyl-glucosamine catabolism
[Bacillus subtilis]
Identities = 121/250 (48%), Positives = 166/250 (66%), Gaps = 1/250 (0%)
Query:   3 YKGYLIDLDGTIYQGKNRIPAGERFIKRLQERGIPYLLVTNNTTRTPEMVQSMLANQFHV      62
           YKGYLIDLDGT+Y G  +I     F++ L++RG+PYL VTNN++RTP+ V   L + F +
Sbjct:   4 YKGYLIDLDGTMYNGTEKIEEACEFVRTLKDRGVPYLFVTNNSSRTPKQVADKLVS-FDI      62

Query:  63 ETSIETIYTATMATVDYMNDMNRGKTAYVIGETGLKSAIAAAGYVEELENPAYVVVGLDS     122
           + E ++T +MAT ++    + + YVIGE G++ AI   G    EN +VVVG+D
Sbjct:  63 PATEEQVFTTSMATAQHIAQQKKDASVYVIGEEGIRQAIEENGLTFGGENADFVVVGIDR     122

Query: 123 QVTYEMLAIATLAIQKGALFIGTNPDLNIPTERGLMPGAGALNALLEAATRVKPVFIGKP     182
              +TYE  A+  LAI+ GA FI TN D+ IPTERGL+PG G+L ++L  +T  V+PVFIGKP
Sbjct: 123 SITYEKFAVGCLAIRNGARFISTNGDIAIPTERGLLPGNGSLTSVLTVSTGVQPVFIGKP     182

Query: 183 NAIIMNKSLEVLGIQRSEAVMVGDNYLTDIMAGIQNDIATILVTTGFTRPEEVPTLPIQP     242
            +IIM +++ VLG   SE +MVGDNY TDIMAGI   + T+LV TG T+ E +    +P
Sbjct: 183 ESIIMEQAMRVLGTDVSETLMVGDNYATDIMAGINAGMDTLLVHTGVTKREHMTDDMEKP     242

Query: 243 DHVLSSLDEW                                                       252
           H + SL EW
Sbjct: 243 THAIDSLTEW                                                       252
```

An alignment of the GAS and GBS proteins is shown below.

```
Identities = 207/250 (82%), Positives = 227/250 (90%), Gaps = 1/250 (0%)
Query:   3 YKGYLIDLDGTIYKGKSRIPAGERFIERLQEKGIPYMLVTNNTTRTPESVQEMLRG-FNV      61
           YKGYLIDLDGTIY+GK+RIPAGERFI+RLQE+GIPY+LVTNNTTRTPE VQ ML   F+V
Sbjct:   3 YKGYLIDLDGTIYQGKNRIPAGERFIKRLQERGIPYLLVTNNTTRTPEMVQSMLANQFHV      62

Query:  62 ETPLETIYTATMATVDYMNDMNRGKTAYVIGEEGLKKAIADAGYVEDTKNPAYVVVGLDW     121
           ET +ETIYTATMATVDYMNDMNRGKTAYVIGE GLK AIA AGYVE+ +NPAYVVVGLD
Sbjct:  63 ETSIETIYTATMATVDYMNDMNRGKTAYVIGETGLKSAIAAAGYVEELENPAYVVVGLDS     122

Query: 122 NVTYDKLATATLAIQNGALFIGTNPDLNIPTERGLLPGAGSLNALLEAATRIKPVFIGKP     181
             VTY+  LA ATLAIQ GALFIGTNPDLNIPTERGL+PGAG+LNALLEAATR+KPVFIGKP
Sbjct: 123 QVTYEMLAIATLAIQKGALFIGTNPDLNIPTERGLMPGAGALNALLEAATRVKPVFIGKP     182

Query: 182 NAIIMNKALEILNIPRNQAVMVGDNYLTDIMAGINNDIDTLLVTTGFTTVEEVPDLPIQP     241
           NAIIMNK+LE+L I R++AVMVGDNYLTDIMAGI NDI T+LVTTGFT  EEVP LPIQP
Sbjct: 183 NAIIMNKSLEVLGIQRSEAVMVGDNYLTDIMAGIQNDIATILVTTGFTRPEEVPTLPIQP     242
```

```
                              -continued
Query: 242  SYVLASLDEW                                                  251
            +VL+SLDEW
Sbjct: 243  DHVLSSLDEW                                                  252
```

A similar DNA sequence was identified in *S. pyogenes* <SEQ ID 4215> which encodes amino acid sequence <SEQ ID 4216>. An alignment of the GAS and GBS sequences follows:

```
Identities = 94/204 (46%), Positives = 139/204 (68%)
Query:   4  VMVENTKLLCSWVWLLALAILITIYSTWLWYPLEVDHLKLEQVVFMSKDAILHNYNGLLN    63
            +M +    ++ +W+W+++LA L TIY  WL YP+E+  LKLE+VV++  + I +N+N L+
Sbjct:   5  LMKDKLLVVLTWIWIISLATLATIYIAWLIYPIEIQFLKLEKVVYLKAETIYYNFNKLMI    64

Query:  64  YLTNPFVTRLEFANFHSSADGLKHFADVKWLFHLTQVVFLGLLYPTLKTFTQRLKTKRFW   123
            YLT+PF++  L   +F SS DGLKHFADVK+LF L   +F+ L +P +    +  K K  +
Sbjct:  65  YLTHPFISDLNMPSFPSSEDGLKHFADVKYLFTLAHGLFVILTFPVIYFLRRGWKQKSIF   124

Query: 124  LLQKPLILAALFPLMIGLMASFIGFEHFFTLFHQVLFVGDSSWLFDPLKDSVIWILPEVF   183
            L +    +A + P+ I + A  +GF+ FFTLFH+VLF GDS+W F+PL D VIWILPE F
Sbjct: 125  LYEGFFKIAIMLPIFIVVCAFLLGFDQFFTLFHEVLFPGDSTWQFNPLTDPVIWILPETF   184

Query: 184  FLHCFLFFMIVYEIILWSLVGLAR                                       207
            FLHCF+ F+++YE I   L+ + R
Sbjct: 185  FLHCFIIPFLLIYETITIILLIIGR                                      208
```

Based on this analysis, it was predicted that these proteins and their epitopes could be useful antigens for vaccines or diagnostics.

Example 1378

A DNA sequence (GBSx1463) was identified in *S. agalactiae* <SEQ ID 4221> which encodes the amino acid sequence <SEQ ID 4222>. This protein is predicted to be oleoyl-acyl carrier protein thioesterase. Analysis of this protein sequence reveals the following:

---
Possible site: 39
>>> Seems to have no N-terminal signal sequence
----- Final Results -----
  bacterial cytoplasm --- Certainty = 0.3332 (Affirmative) <succ>
    bacterial membrane --- Certainty = 0.0000 (Not Clear) <succ>
     bacterial outside --- Certainty = 0.0000 (Not Clear) <succ>
---

The protein has homology with the following sequences in the GENPEPT database.

A related DNA sequence was identified in *S. pyogenes* <SEQ ID 4223> which encodes the amino acid sequence <SEQ ID 4224>. Analysis of this protein sequence reveals the following:

---
Possible site: 54
>>> Seems to have no N-terminal signal sequence
INTEGRAL     Likelihood = −3.88    Transmembrane 21-37 (21-38)
----- Final Results -----
  bacterial membrane --- Certainty = 0.2550 (Affirmative) <succ>
   bacterial outside --- Certainty = 0.0000 (Not Clear) <succ>
  bacterial cytoplasm --- Certainty = 0.0000 (Not Clear) <succ>
---

The protein has homology with the following sequences in the databases:

```
>GP:BAB02069 GB:AB026647 acyl carrier protein thioesterase
[Arabidopsis thaliana]
Identities = 59/248 (23%), Positives = 104/248 (41%), Gaps = 30/248 (12%)
Query:   2  GLLYRETYEVPFYESDTNHYMKLPQLLALALQISAKQSLKLGIGDD-----IVFKRYGLV    56
            GL Y+E + V  YE  +N    + + L ++      +G  D        ++   L+
Sbjct:  81  GLSYKEKFVVRSYEVGSNKTATVETIANLLQEVGCNHAQSVGFSTDGFATTTTMRKLHLI   140

Query:  57  WVVTDYIIDIERLPKHAEKIVIETEAKAHNKLLCYRYFYIYGE-DGQKIITISSAFVLMD   115
            WV       I+I + P  + + IET ++  ++   R + +    G+     +S +V+M+
Sbjct: 141  WVTARMHIEIYKYPAWGDVVEIETWCQSEGRIGTRRDWILKDSVTGEVTGRATSKWVMMN   200

Query: 116  FKTRKIHPVLDDITSIY---------------QSQRIKKVIRGPKYHPIGDSKVKQYHVR   160
            TR++  V DD+   Y                ++ +KK+    PK        +     R
Sbjct: 201  QDTRRLQKVSDDVRDEYLVFCPQEPRLAFPEENNRSLKKI---PKLEDPAQYSMIGLKPR   257

Query: 161  YFDLDMNGHVNNSKYLEWMYDVLDLDFLSSHIPKKIDLKYIKEIQYGTDIKSHWYQDGLV   220
               DLDMN HVNN  Y+ W+ + +   + +H + I L Y +E Q    +    D  L
Sbjct: 258  RADLDMNQHVNNVTYIGWVLESIPQEIVDTHELQVITLDYRRECQQDDVV------DSLT   311

Query: 221  TRHDIIGG                                                       228
            T    IGG
Sbjct: 312  TTTSEIGG                                                       319
```

```
>GP:AAB71730 GB:U65643 acyl-ACP thioesterase [Myristica fragrans]
Identities = 41/128 (32%), Positives = 67/128 (52%), Gaps = 11/128 (8%)
Query:   33 FIFMIKRGGLLVDILAYFALLNPDTRKVATIPEDLVAPFETDFVKKLHRV-----PKMPL      87
            F+    K G +L   + + ++N TR+++ IPE++    E FV+ H V         K+P
Sbjct:  147 FLRDCKTGEILTRATSVWVMMNKRTRRLSKIPEEVRVEIEPYFVE--HGVLDEDSRKLPK   204

Query:   88 LEQS----IDRDYYVRYFDIDMNGHVNNSKYLDWMYDVLGCEFLKTHQPLKMTLKYVKEV    143
            L +     I R   R+ D+D+N HVNN KY+ W+ + +    L++H+   MTL+Y KE
Sbjct:  205 LNDNTANYIRRGLAPRWSDLDVNQHVNNVKYIGWILESVPSSLLESHELYGMTLEYRKEC   264

Query:  144 SPGGQITS                                                       151
              G + S
Sbjct:  265 GKDGLLQS                                                       272
```

An alignment of the GAS and GBS proteins is shown below.

```
Identities = 62/144 (43%), Positives = 94/144 (65%)
Query:  101 GQKIITISSAFVLMDFKTRKIHPVLDDITSIYQSQRIKKVIRGPKYHPIGDSKVKQYHVR    160
            G  ++ I + F L++   TRK+ + +D+ + +++  +KK+ R PK    + S   + Y+VR
Sbjct:   40 GGLLVDILAYFALLNPDTRKVATIPEDLVAPFETDFVKKLHRVPKMPLLEQSIDRDYYVR     99

Query:  161 YFDLDMNGHVNNSKYLEWMYDVLDLDFLSSHIPKKIDLKYIKEIQYGTDIKSHWYQDGLV    220
            YFD+DMNGHVNNSKYL+WMYDVL  +FL +H P K+ LKY+KE+   G    I S ++ D L
Sbjct:  100 YFDIDMNGHVNNSKYLDWMYDVLGCEFLKTHQPLKMTLKYVKEVSPGGQITSSYHLDQLT    159

Query:  221 TRHDIIGGDAIHAQARIEWQEKKE                                       244
            + H I     ++AQA IEW+   K+
Sbjct:  160 SYHQITSDGQLNAQAMIEWRAIKQ                                       183
```

Based on this analysis, it was predicted that these proteins and their epitopes could be useful antigens for vaccines or diagnostics.

Example 1379

A DNA sequence (GBSx1464) was identified in *S. agalactiae* <SEQ ID 4225> which encodes the amino acid sequence <SEQ ID 4226>. This protein is predicted to be coproporphyrinogen III oxidase. Analysis of this protein sequence reveals the following:

Possible site: 40

>>> Seems to have no N-terminal signal sequence

----- Final Results ----- bacterial cytoplasm --- Certainty = 0.1484 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:BAB05062 GB:AP001511 coproporphyrinogen III oxidase [Bacillus halodurans]
Identities = 173/375 (46%), Positives = 248/375 (66%), Gaps = 5/375 (1%)
Query:    5 PTSAYVHIPFCTQICYYCDFSKVFIKNQPVDAYLQALIREFR----SYDITELRTLYIGG     60
            P +AY+HIPFC  ICYYCDF+K ++KNQPV+ YLQAL E             L+TLY+GG
Sbjct:    2 PKAAYIHIPFCEHICYYCDFNKFYLKNQPVNEYLQALETEMAMVVAEQPTKSLQTLYVGG     61

Query:   61 GTPTSISAVQLDYLLTELSRDLNLNTLEEFTIEANPGDLTVDKIEVLQKSAVNRVSLGVQ    120
            GTPT+++A QL   LL   + R L L+ LEEFT E NP +   +K++VL+   V+R+S+GVQ
Sbjct:   62 GTPTALTADQLAQLLASIKRTLPLSDLEEFTFEVNPDSIDEEKLDVLRSYGVDRLSIGVQ    121

Query:  121 TFNDKHLKRIGRSHNEAQIYSTIDALKTAGFQNISIDLIYALPGQTMDDVRSNVAKALSL    180
              F    LK IGR+H++  +    ++  + AGF N+S+DL+  LP QT +     + +A +L
Sbjct:  122 AFQPLLLKEIGRTHDQKSVEQAVEKSRQAGFANLSLDLMLGLPKQTPEMFAETLKEAFAL    181

Query:  181 NIPHLSLYSLILEHHTVFMNKMRRGKLHLPTEDLEAEMFEYIISEMERNGFEHYEISNFT    240
            + HLS YSL +E   TVF N+ R+G+L LP ED E +M+   + E E++GF+ YEISNF
Sbjct:  182 EVEHLSCYSLKVEAKTVFYNRQRQGRLTLPPEDDEVKMYRQLCYETEKHGFKQYEISNFA    241

Query:  241 KPGFESRHNLMYWDNVEYYGVGAGASGYLDGIRYRNRGPIQHYLKGVSEGNARLSE-EVL    299
            K G+ESRHNL+YW+N EYYG GAGA GY+ G+RY N GP+ YL+ + EG     +E  +
Sbjct:  242 KKGYESRHNLVYWNNDEYYGFGAGAHGYVGGVRYMNHGPLPKYLQAMEEGRRPVFESHHV    301

Query:  300 SKNEMMEEELFLGLRKKEGVSIGKFEQKFGTSFEKRYGQIVQELQSDGLLKENNGFIQMT    359
            S+  E MEE++FLGLRK+ GV     F  ++FG S    Y + +L +   LL+ +  +++T
Sbjct:  302 SRVEQMEEQMFLGLRKRSGVEERVFVERFGVSMFSLYEKQIAQLVARCLLERTDDRVRLT    361

Query:  360 KKGLFLGDTVAEKFI                                                374
            + GL LG+ V E+F+
Sbjct:  362 DEGLLLGNEVFEQFL                                                376
```

A related DNA sequence was identified, in *S. pyogenes* <SEQ ID 4227> which encodes the amino acid sequence <SEQ ID 4228>. Analysis of this protein sequence reveals the following:

Possible site: 34
>>> Seems to have no N-terminal signal sequence
----- Final Results -----
    bacterial cytoplasm --- Certainty = 0.3202 (Affirmative) <succ>
        bacterial membrane --- Certainty = 0.0000 (Not Clear) <succ>
            bacterial outside --- Certainty = 0.0000 (Not Clear) <succ>

An alignment of the GAS and GBS proteins is shown below.

```
Identities = 304/376 (80%), Positives = 343/376 (90%)
Query:    1 MLKKPTSAYVHIPFCTQICYYCDFSKVFIKNQPVDAYLQALIREFRSYDITELRTLYIGG      60
            M KKPTSAYVHIPFCTQICYYCDFSKVFI+NQPVDAYL+ALI+EF SY I +L+TLYIGG
Sbjct:   33 MSKKPTSAYVHIPFCTQICYYCDFSKVFIQNQPVDAYLKALIQEFDSYGIRDLKTLYIGG      92

Query:   61 GTPTSISAVQLDYLLTELSRDLNLNTLEEFTIEANPGDLTVDKIEVLQKSAVNRVSLGVQ     120
            GTPT+I+A QL+YLL  L R+LNL+ LEEFTIEANPGDLT +KI VLQ+SAVNR+SLGVQ
Sbjct:   93 GTPTAITAKQLEYLLNHLERNLNLDDLEEFTIEANPGDLTPEKIAVLQRSAVNRISLGVQ     152

Query:  121 TFNDKHLKRIGRSHNEAQIYSTIDALKTAGFQNISIDLIYALPGQTMDDVRSNVAKALSL     180
            TFN+K LK+IGRSHNE QIYSTI  LKTAGF NISIDLIYALPGQT+D V+ NVAKAL+L
Sbjct:  153 TFNNKQLKQIGRSHNEEQIYSTIANLKTAGFHNISIDLIYALPGQTLDQVKENVAKALAL     212

Query:  181 NIPHLSLYSLILEHHTVFMNKMRRGKLHLPTEDLEAEMFEYIISEMERNGFEHYEISNFT     240
            +IPHLSLYSLILEHHTVFMNKMRRGKL+LPTEDLEAEMFEYIISEME NGFEHYEISNFT
Sbjct:  213 DIPHLSLYSLILEHHTVFMNKMRRGKLNLPTEDLEAEMFEYIISEMEANGFEHYEISNFT     272

Query:  241 KPGFESRHNLMYWDNVEYYGVGAGASGYLDGIRYRNRGPIQHYLKGVSEGNARLSEEVLS     300
            KPGFESRHNLMYWDNVEY+G GAGASGYL+GIRY+NR PIQHYLK V  GNARL+EEVL
Sbjct:  273 KPGFESRHNLMYWDNVEYFGCGAGASGYLNGIRYQNRVPIQHYLKAVEAGNARLNEEVLR     332

Query:  301 KNEMMEEELFLGLRKKEGVSIGKFEQKFGTSFEKRYGQIVQELQSDGLLKENNGFIQMTK     360
            K EMMEEELFLGLRKK GVSI +F++KFG SFE+RYG IV+ELQ+ GLL +++ F++MTK
Sbjct:  333 KEEMMEEELFLGLRKKTGVSIQRFQEKFGMSFEERYGNIVRELQNQGLLVKDDAFVRMTK     392

Query:  361 KGLFLGDTVAEKFIVE                                                 376
            KGLFLGD+VAE+FI++
Sbjct:  393 KGLFLGDSVAERFILD                                                 408
```

Based on this analysis, it was predicted that these proteins and their epitopes could be useful antigens for vaccines or diagnostics.

Example 1380

A DNA sequence (GBSx1465) was identified in *S. agalactiae* <SEQ ID 4229> which encodes the amino acid sequence <SEQ ID 4230>. Analysis of this protein sequence reveals the following:

Possible site: 52
>>> Seems to have no N-terminal signal sequence
----- Final Results -----
    bacterial cytoplasm --- Certainty = 0.3729 (Affirmative) <succ>
        bacterial membrane --- Certainty = 0.0000 (Not Clear) <succ>
            bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1381

A DNA sequence (GBSx1466) was identified in *S. agalactiae* <SEQ ID 4231> which encodes the amino acid sequence <SEQ ID 4232>. Analysis of this protein sequence reveals the following:

Possible site: 61
>>> Seems to have no N-terminal signal sequence
----- Final Results -----
    bacterial cytoplasm --- Certainty = 0.2989 (Affirmative) <succ>

-continued bacterial membrane --- Certainty = 0.0000 (Not Clear) <succ>
            bacterial outside --- Certainty = 0.0000 (Not Clear) <succ>

The protein has no significant homology with any sequences in the GENPEPT database.

A related DNA sequence was identified in *S. pyogenes* <SEQ ID 4233> which encodes the amino acid sequence <SEQ ID 4234>. Analysis of this protein sequence reveals the following:

Possible site: 57
>>> Seems to have no N-terminal signal sequence
----- Final Results -----
    bacterial cytoplasm --- Certainty = 0.2993 (Affirmative) <succ>
        bacterial membrane --- Certainty = 0.0000 (Not Clear) <succ>
            bacterial outside --- Certainty = 0.0000 (Not Clear) <succ>

An alignment of the GAS and GBS proteins is shown below.

```
Identities = 36/109 (33%), Positives = 58/109 (53%), Gaps = 6/109 (5%)
Query:   9  WAKHKYLVLSKSQKIYLDIRQTLKSPNCT---VLDVQSLIDQAVLLEESPSQVTNAYMHI   65
            WA KY V++ SQ+ Y +R+ K     +  VL   LI++A +  +   + AY H+
Sbjct:  13  WAYQKYWVMAHSQQHYNALRELFKGNQWSEEKVLTFHCLIEEAQAIPPTVKSLRTAYQHV   72

Query:  66  WGYFKNKAERQEKEEFLTLLEKYRKTGYQRRKLLAFLKQLLAKYPNSYL            114
            WGYFK  A ++EK+ F  L  +      +  ++L FL+++ A Y  SYL
Sbjct:  73  WGYFKKVASQEEKDHFKDLDAQLET---KSEEMLCFLQEMTAHYQPSYL            118
```

Based on this analysis, it was predicted that these proteins and their epitopes could be useful antigens for vaccines or diagnostics.

Example 1382

A DNA sequence (GBSx1467) was identified in *S. agalactiae* <SEQ ID 4235> which encodes the amino acid sequence <SEQ ID 4236>. This protein is predicted to be mrsA (mrsA). Analysis of this protein sequence reveals the following:

---

Possible site: 35
>>> Seems to have no N-terminal signal sequence
INTEGRAL    Likelihood = –0.96    Transmembrane 56-72 (56-72)
----- Final Results -----
  bacterial membrane --- Certainty = 0.1383 (Affirmative) <succ>
  bacterial outside --- Certainty = 0.0000 (Not Clear) <succ>
  bacterial cytoplasm --- Certainty = 0.0000 (Not Clear) <succ>

---

A related DNA sequence was identified in *S. pyogenes* <SEQ ID 4237> which encodes the amino acid sequence <SEQ ID 4238>. Analysis of this protein sequence reveals the following:

---

Possible site: 35
>>> Seems to have no N-terminal signal sequence
INTEGRAL    Likelihood = –0.96    Transmembrane 56-72 (56-72)
----- Final Results -----
  bacterial membrane --- Certainty = 0.1383 (Affirmative) <succ>
  bacterial outside --- Certainty = 0.0000 (Not Clear) <succ>
  bacterial cytoplasm --- Certainty = 0.0000 (Not Clear) <succ>

---

The protein has homology with the following sequences in the GENPEPT database.

The protein has homology with the following sequences in the databases:

```
>GP:CAB11970 GB:Z99105 similar to phosphoglucomutase (glycolysis)
          [Bacillus subtilis]
 Identities = 284/451 (62%), Positives = 353/451 (77%), Gaps = 4/451 (0%)
Query:   1  MGKYFGTDGVRGEANVELTPELAFKLGRFGGYVLSQHETDRPRVFVARDTRISGEMLESA   60
            MGKYFGTDGVRG AN ELTPELAFK+GRFGGYVL++ +  RP+V + RDTRISG MLE A
Sbjct:   1  MGKYFGTDGVRGVANSELTPELAFKVGRFGGYVLTK-DKQRPKVLIGRDTRISGHMLEGA   59

Query:  61  LIAGLLSVGIEVYKLGVLATPGVSYLVRTEKASAGVMISASHNPALDNGIKFFGSDGFKL  120
            L+AGLLS+G EV +LGV++TPGVSYL +    A AGVMISASHNP DNGIKFFG DGFKL
Sbjct:  60  LVAGLLSIGAEVMRLGVISTPGVSYLTKAMDAEAGVMISASHNPVQDNGIKFFGGDGFKL  119

Query: 121  DDDRELEIEALLDAKEDTLPRPSAQGLGTLVDYPEGLRKYEKFMESTGI-DLEGMKVALD  179
            D++E EIE L+D ED  LPRP    LG + DY EG +KY +F++  T    D  G+ VALD
Sbjct: 120  SDEQEAEIERLMDEPEDKLPRPVGADLGLVNDYFEGGQKYLQFLKQTADEDFTGIHVALD  179

Query: 180  TANGAATASARNIFLDLNADISVIGDQPDGLNINDGVGSTHPEQLSLVRENGSDIGLAF  239
                ANGA ++ A ++F DL+AD+S +G  P+GLNINDGVGSTHPE L + V+E +D+GLAF
Sbjct: 180  CANGATSSLATHLFADLDADVSTMGTSPNGLNINDGVGSTHPEALSAFVKEKNADLGLAF  239

Query: 240  DGDSDRLIAVDENGEIVDGDKIMFIIGKYLSDKGQLAQNTIVTTVMSNLGFHKALDREGI  299
            DGD DRLIAVDE G IVDGD+IM+I    K+L  +G+L    +T+V+TVMSNLGF+KAL +EGI
Sbjct: 240  DGDGDRLIAVDEKGNIVDGDQIMYICSKHLKSEGRLKDDTVVSTVMSNLGFYKALEKEGI  299

Query: 300  HKAITAVGDRYVVEEMRKSGYNLGGEQSGHVIIMDYNTTGDGQLTAIQLTKVMKETGKKL  359
                 TAVGDRYVVE M+K GYN+GGEQSGH+I +DYNTTGDG L+AI L    +K TGK L
Sbjct: 300  KSVQTAVGDRYVVEAMKKDGYNVGGEQSGHLIFLDYNTTGDGLLSAIMLMNTLKATGKPL  359

Query: 360  SELASEVTIYPQKLVNIRVENNMKDKAMEVPAIAEIIAKMEEEMDGNGRILVRPSGTEPL  419
            SELA+E+  +PQ LVN+RV +   K K E  +    +I+++E+EM+G+GRILVRPSGTEPL
Sbjct: 360  SELAAEMQKFPQLLVNVRVTD--KYKVEENEKVKAVISEVEKEMNGDGRILVRPSGTEPL  417

Query: 420  LRVMAEAPTNEAVDYYVDTIADVVRTEIGLD                              450
            +RVMAEA T E   D YV+ I  +VVR+E+GL+
Sbjct: 418  VRVMAEAKTKELCDEYVNRIVEVVRSEMGLE                              448
```

```
>GP:CAB11970 GB:Z99105 similar to phosphoglucomutase (glycolysis)
           [Bacillus subtilis]
 Identities = 287/451 (63%), Positives = 346/451 (76%), Gaps = 4/451 (0%)
Query:   1 MGKYFGTDGVRGEANVELTPELAFKLGRFGGYVLSQHETERPKVFVARDTRISGEMLESA  60
           MGKYFGTDGVRG AN ELTPELAFK+GRFGGYVL++ + +RPKV + RDTRISG MLE A
Sbjct:   1 MGKYFGTDGVRGVANSELTPELAFKVGRFGGYVLTK-DKQRPKVLIGRDTRISGHMLEGA  59

Query:  61 LIAGLLSVGIEVYKLGVLATPGVSYLVRTEKASAGVMISASHNPALDNGIKFFGNDGFKL 120
           L+AGLLS+G EV +LGV++TPGVSYL +    A GVMISASHNP  DNGIKFFG DGFKL
Sbjct:  60 LVAGLLSIGAEVMRLGVISTPGVSYLTKAMDAEAGVMISASHNPVQDNGIKFFGGDGFKL 119

Query: 121 ADDQELEIEALLDAPEDTLPRPSAEGLGTLVDYPEGLRKYEKFLVTTGT-DLSGMTVALD 179
           +D+QE EIE L+D PED LPRP    LG +DY EG +KY +FL   T   D +G+ VALD
Sbjct: 120 SDEQEAEIERLMDEPEDKLPRPVGADLGLVNDYFEGGQKYLQFLKQTADEDFTGIHVALD 179

Query: 180 TANGAASVSARDVFLDLNAEIAVIGEKPNGLNINDGVGSTRPEQLQELVKETGADLGLAF 239
             ANGA  S  A   +F DL+A+++ +G  PNGLNINDGVGST  PE L    VKE  ADLGLAF
Sbjct: 180 CANGATSSLATHLFADLDADVSTMGTSPNGLNINDGVGSTHPEALSAFVKEKNADLGLAF 239

Query: 240 DGDSDRLIAVDETGEIVDGDRIMFIIGKYLSEKGLLAHNTIVTTVMSNLGFHKALDKQGI 299
           DGD DRLIAVDE G  IVDGD+IM+I  K+L  +G  L   +T+V+TVMSNLGF+KAL+K+GI
Sbjct: 240 DGDGDRLIAVDEKGNIVDGDQIMYICSKHLKSEGRLKDDTVVSTVMSNLGFYKALEKEGI 299

Query: 300 NKAITAVGDRYVVEEMRSSGYNIGGEQSGHVIIMDYNTTGDGQLTAIQLAKVMKETGKSL 359
              TAVGDRYVVE M+  GYN+GGEQSGH+I +DYNTTGDG L+AI L   +K TGK L
Sbjct: 300 KSVQTAVGDRYVVEAMKKDGYNVGGEQSGHLIFLDYNTTGDGLLSAIMLMNTLKATGKPL 359

Query: 360 SELAAEVTIYPQKLVNIRVENSMKERAMEVPAIANIIAKMEDEMAGNGRILVRPSGTEPL 419
           SELAAE+  +PQ LVN+RV + K+  E       +I+++E EM G+GRILVRPSGTEPL
Sbjct: 360 SELAAEMQKFPQLLVNVRVTD--KYKVEENEKVKAVISEVEKEMNGDGRILVRPSGTEPL 417

Query: 420 LRVMAEAPTDAEVDYYVDTIADVVRTEIGCD                             450
           +RVMAEA T    D YV+ I +VVR+E+G +
Sbjct: 418 VRVMAEAKTKELCDEYVNRIVEVVRSEMGLE                             448
```

An alignment of the GAS and GBS proteins is shown below.

```
Identities = 400/450 (88s), Positives = 429/450 (94%)
Query:   1 MGKYFGTDGVRGEANVELTPELAFKLGRFGGYVLSQHETDRPRVFVARDTRISGEMLESA  60
           MGKYFGTDGVRGEANVELTPELAFKLGRFGGYVLSQHET+RP+VEVARDTRISGEMLESA
Sbjct:   1 MGKYFGTDGVRGEANVELTPELAFKLGRFGGYVLSQHETERPKVFVARDTRISGEMLESA  60

Query:  61 LIAGLLSVGIEVYKLGVLATPGVSYLVRTEKASAGVMISASHNPALDNGIKFFGSDGFKL 120
           LIAGLLSVGIEVYKLGVLATPGVSYLVRTEKASAGVMISASHNPALDNGIKFFG+DGFKL
Sbjct:  61 LIAGLLSVGIEVYKLGVLATPGVSYLVRTEKASAGVMISASHNPALDNGIKFFGNDGFKL 120

Query: 121 DDDRELEIEALLDAKEDTLPRPSAQGLGTLVDYPEGLRKYEKFMESTGIDLEGMKVALDT 180
           DD+ELEIEALLDA  EDTLPRPSA+GLGTLVDYPEGLRKYEKF+ +TG DL GM VALDT
Sbjct: 121 ADDQELEIEALLDAPEDTLPRPSAEGLGTLVDYPEGLRKYEKFLVTTGTDLSGMTVALDT 180

Query: 181 ANGAATASARNIFLDLNADISVIGDQPDGLNINDGVGSTHPEQLSLVRENGSDIGLAFD 240
           ANGAA+ SAR++FLDLNA+I+VIG++P+GLNINDGVGST PEQLQ LV+E G+D+GLAFD
Sbjct: 181 ANGAASVSARDVFLDLNAEIAVIGEKPNGLNINDGVGSTRPEQLQELVKETGADLGLAFD 240

Query: 241 GDSDRLIAVDENGEIVDGDKIMFIIGKYLSDKGQLAQNTIVTTVMSNLGFHKALDREGIH 300
           GDSDRLIAVDE GEIVDGD+IMFIIGKYLS+KG LA NTIVTTVMSNLGFH+ALD++GI+
Sbjct: 241 GDSDRLIAVDETGEIVDGDRIMFIIGKYLSEKGLLAHNTIVTTVMSNLGFHKALDKQGIN 300

Query: 301 KAITAVGDRYVVEEMRKSGYNLGGEQSGHVIIMDYNTTGDGQLTAIQLTKVMKETGKKLS 360
           KAITAVGDRYVVEEMR SGYNLGGEQSGHVIIMDYNTTGDGQLTAIQL KVMKETGK LS
Sbjct: 301 KAITAVGDRYVVEEMRSSGYNLGGEQSGHVIIMDYNTTGDGQLTAIQLAKVMKETGKSLS 360

Query: 361 ELASEVTIYPQKLVNIRVENNMKDKAMEVPAIAEIIARMEEEMDGNGRILVRPSGTEPLL 420
           ELA+EVTIYPQKLVNIRVEN+MK++AMEVPAIA IIAKME+EM GNGRILVRPSGTEPLL
Sbjct: 361 ELAAEVTIYPQKLVNIRVENSMKERAMEVPAIANIIAKMEDEMAGNGRILVRPSGTEPLL 420

Query: 421 RVMAEAPTNEAVDYYVDTIADVVRTEIGLD                               450
           RVMAEAPT+  VDYYVDTIADVVRTEIG D
Sbjct: 421 RVMAFAPTDAEVDYYVDTIADVVRTEIGCD                               450
```

SEQ ID 4236 (GBS402) was expressed in *E. coli* as a GST-fusion product. SDS-PAGE analysis of total cell extract is shown in FIG. 84 (lane 5; MW 78 kDa).

GBS402-GST was purified as shown in FIG. 218, lane 3-5.

Based on this analysis, it was predicted that these proteins and their epitopes could be useful antigens for vaccines or diagnostics.

Example 1383

A DNA sequence (GBSx1468) was identified in *S. agalactiae* <SEQ ID 4239> which encodes the amino acid sequence <SEQ ID 4240>. Analysis of this protein sequence reveals the following:

Possible site: 28
>>> Seems to have a cleavable N-term signal seq.
----- Final Results -----
   bacterial outside --- Certainty = 0.3000 (Affirmative) <succ>
    bacterial membrane --- Certainty = 0.0000 (Not Clear) <succ>
     bacterial cytoplasm --- Certainty = 0.0000 (Not Clear) <succ>

The protein has homology with the following sequences in the GENPEPT database.

```
>GP:CAB11969 GB:Z99105 ybbR [Bacillus subtilis]
 Identities = 90/324 (27%), Positives = 167/324 (50%), Gaps = 18/324 (5%)
Query:   1 MKKFFTNKFWLGVVSLFLAILLFLTATATSMNHQDNSKIAG-----ASETYTHTLTDVPI   55
           M KF  N++ + +++L  A+LL++   A + N      K  G      S T   TLTD+P+
Sbjct:   1 MDKFLNNRWAVKIIALLFALLLYV---AVNSNQAPTPKKPGESFFPTSTTDEATLTDIPV   57

Query:  56 DIKYDSDDYFISGYSYGADVYMS-SVNRVKLDSEINEDTRKFKVVADLTNMKPGTHKVPL  114
             YD ++Y ++G    +V +  S + VK    +    T+ F++ AD+ ++K GTHKV L
Sbjct:  58 KAYYDDENYVVTGVPQTVNVTIKGSTSAVKKARQ----TKNFEIYADMEHLKTGTHKVEL  113

Query: 115 KVVNLPSGVNATVSPTTITVTMGKKKTKEFPV-YGHVNDKQIKAGYAVDKMSVDVSKVKV  173
           K  N+  G+   +++P+  TVT+ ++ TK FPV   + N  ++K GY+ ++    V   V++
Sbjct: 114 KAKNVSDGLTISINPSVTTVTIQERTTKSFPVEVEYYNKSKMKKGYSPEQPIVSPKNVQI  173

Query: 174 TSDESIIDRIDHVAANIPDDKVLDDDFNKTVTLQAVTADGTVLASIIHPSKATLSVKVKK  233
           T   +++ID I   A++  +   D+    K    +  DG L    + PS   ++V V
Sbjct: 174 TGSKNVIDNISLHKASVNLENA-DETIEKEAKVTVYDKDGNALPVDVEPSVIKITVPVTS  232

Query: 234 LTKTVPINLIPVGQFSDSISKINYKLSQEKAVISGTKEALEAISVIN-AEVDISDVTKNT  292
           +K VP +   G    D +S  N + S +  + G+++ L+++   I+    +D+S  + K++
Sbjct: 233 PSKKVPFKIERTGSLPDGVSIANIESSPSEVTVYGSQDVLDSLEFIDGVSLDLSKINKDS  292

Query: 293 --EKKINLSANNVSVDPAQVTVQL                                     314
             E   I L      +    P++VT+  +
Sbjct: 293 DIEADIPLPDGVKKISPSKVTLHI                                     316
```

A related DNA sequence was identified in *S. pyogenes* <SEQ ID 4241> which encodes the amino acid sequence <SEQ ID 4242>. Analysis of this protein sequence reveals the following:

Possible site: 29
>>> Seems to have a cleavable N-term signal seq.
----- Final Results -----
   bacterial outside --- Certainty = 0.3000 (Affirmative) <succ>
    bacterial membrane --- Certainty = 0.0000 (Not Clear) <succ>
     bacterial cytoplasm --- Certainty = 0.0000 (Not Clear) <succ>

The protein has homology with the following sequences in the databases:

```
>GP:CAB11969 GB:Z99105 ybbR [Bacillus subtilis]
 Identities = 81/322 (25%), Positives = 154/322 (47%), Gaps = 15/322 (4%)
Query:   1 MKRFLNSRPWLGMVSVFFAILLFLTAASSNH----NNSSSQIYSPIETYTHSLKDVPIDM   56
           M +FLN+R  + ++++ FA+LL++ A +SN             +   T   +L D+P+
Sbjct:   1 MDKFLNNRWAVKIIALLFALLLYV-AVNSNQAPTFKKPGESFEPTSTTDEATLTDIPVKA   59

Query:  57 KYDSDKYFISGYSYGAEVYLT-STNRIKLDSEVNNDTRNFKIVADLTHSHPGTVSVNLRV  115
            YD + Y ++G     V +  ST+ +K    +    T+NF+I AD+  H   GT   V L+
Sbjct:  60 YYDDENYVVTGVPQTVNVTIKGSTSAVKKARQ----TKNFEIYADMEHLKTGTHKVELKA  115

Query: 116 ENLPSGVTATVSPDKISVTIGKKESKVFPVRGS-VDAKQIANGYEISKIETGVNKVEVTS  174
           +N+   G+T  +++P+   +VTI ++  +K FPV        +  ++ GY    +  V++T
Sbjct: 116 KNVSDGLTISINPSVTTVTIQERTTKSFPVEVEYYNKSKMKKGYSPEQPIVSPKNVQITG  175
```

```
                                       -continued
Query:  175 DESTIALIDHVVAKLPDDQVLDRNYSSRVTLQAVSADGTILASAIDPAKTNLSVAVKKIT 234
            ++I    I   A+ +  D     +       DG L   ++P+    ++V V   +
Sbjct:  176 SKNVIDNISLHKASVNLENA-DETIEKEAKVTVYDKDGNALPVDVEPSVIKITVPVTSPS 234

Query:  235 KSVPIRVEAVGMMDDSLSDIQYKLSKQTAVISGSREVLEDIDEII-AEVNISDVTKNT-- 291
            K VP ++E  G + D +S    + S      + GS++VL+ ++ I    +++S  +K++
Sbjct:  235 KKVPFKIERTGSLPDGVSIANIESSPSEVTVYGSQDVLDSLEFIDGVSLDLSKINKDSDI 294

Query:  292 SKTVSLSSSQVSIEPSVVTVQL                                       313
              + L        I PS VT+ +
Sbjct:  295 EADIPLPDGVKKISPSKVTLHI                                       316
```

An alignment of the GAS and GBS proteins is shown below.

```
 Identities = 198/319 (62%), Positives = 251/319 (78%), Gaps = 1/319 (0%)
 Query:    1 MKKFFTNKFWLGVVSLFLAILLFLTATATSMNHQDNSKIAGASETYTHTLTDVPIDIKYD  60
             MK+F  ++ WLG+VS+F AILLFLTA A+S ++  +S+I    ETYTH+L DVPID+KYD
 Sbjct:    1 MKRFLNSRPWLGMVSVFFAILLFLTA-ASSNHNNSSSQIYSPIETYTHSLKDVPIDMKYD  59

Query:   61 SDDYFISGYSYGADVYMSSVNRVKLDSEINEDTRKFKVVADLTNMKPGTHKVPLKVVNLP 120
             SD YFISGYSYGA+VY++S NR+KLDSE+N DTR FK+VADLT+  PGT  V L+V NLP
 Sbjct:   60 SDKYFISGYSYGAEVYLTSTNRIKLDSEVNNDTRNFKIVADLTHSHPGTVSVNLRVENLP 119

Query:  121 SGVNATVSPTTITVTMGKKKTKEFPVYGHVNDKQIKAGYAVDKMSVDVSKVRVTSDESII 180
             SGV ATVSP  I+VT+GKK++K FPV G V+ KQI  GY + K+    V+KV+VTSDES I
 Sbjct:  120 SGVTATVSPDKISVTIGKKESKVFPVRGSVDAKQIANGYEISKIETGVNKVEVTSDESTI 179

Query:  181 DRIDHVAANIPDDKVLDDDFNKTVTLQAVTADGTVLASIIHPSKATLSVKVKKLTKTVPI 240
                 IDHV A +PDD+VLD +++   VTLQAV+ADGT+LAS I P+K  LSV VKK+TK+VPI
 Sbjct:  180 ALIDHVVAKLPDDQVLDRNYSSRVTLQAVSADGTILASAIDPAKTNLSVAVKKITKSVPI 239

Query:  241 NLIPVGQFSDSISKINYKLSQEKAVISGTKEALEAISVINAEVDISDVTKNTEKKINLSA 300
              +   VG   DS+S I YKLS++ AVISG++E LE I  I AEV+ISDVTKNT K ++LS+
 Sbjct:  240 RVEAVGMMDDSLSDIQYKLSKQTAVISGSREVLEDIDEIIAEVNISDVTKNTSKTVSLSS 299

Query:  301 NNVSVDPAQVTVQLTTTKK                                          319
             + VS++P+  VTVQLTTTKK
 Sbjct:  300 SQVSIEPSVVTVQLTTTKK                                          318
```

SEQ ID 4240 (GBS99) was expressed in *E. coli* as a His-fusion product. SDS-PAGE analysis of total cell extract is shown in FIG. 17 (lane 6; MW 35.7 kDa). It was also expressed in *E. coli* as a GST-fusion product. SDS-PAGE analysis of total cell extract is shown in FIG. 21 (lane 9; MW 60.7 kDa).

Figure 293:
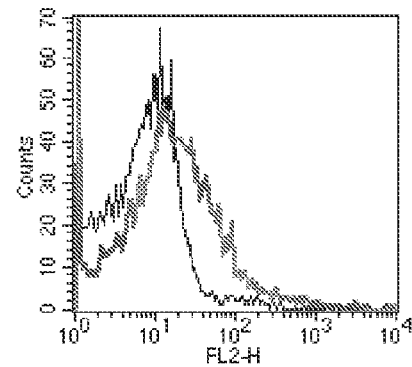

The GBS99-GST fusion product was purified (FIG. 197, lane 9) and used to immunise mice. The resulting antiserum was used for FACS (FIG. 293), which confirmed that the protein is immunoaccessible on GBS bacteria.

Based on this analysis, it was predicted that these proteins and their epitopes could be useful antigens for vaccines or diagnostics.

Example 1384

A DNA sequence (GBSx1469) was identified in *S. agalactiae* <SEQ ID 4243> which encodes the amino acid sequence <SEQ ID 4244>. Analysis of this protein sequence reveals the following:

Possible site: 16
>>> Seems to have no N-terminal signal sequence
----- Final Results -----
  bacterial cytoplasm --- Certainty = 0.0503 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1385

A DNA sequence (GBSx1470) was identified in *S. agalactiae* <SEQ ID 4245> which encodes the amino acid sequence <SEQ ID 4246>. Analysis of this protein sequence reveals the following:

Possible site: 15
>>> Seems to have no N-terminal signal sequence
INTEGRAL    Likelihood = −9.50    Transmembrane 20-36 (18-46)
INTEGRAL    Likelihood = −7.64    Transmembrane 48-64 (42-68)
INTEGRAL    Likelihood = −3.40    Transmembrane 80-96 (80-96)
----- Final Results -----
  bacterial membrane --- Certainty = 0.4800 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the GENPEPT database.

```
>GP:CAB11968 GB:Z99105 alternate gene name: ybbQ~similar to
          hypothetical proteins [Bacillus subtilis]
 Identities = 125/253 (49%), Positives = 186/253 (73%), Gaps = 5/253 (1%)
 Query:  27 MDIIIVAVLIYKFIKALAGTKIMSLIQGVILFIIIREVSEWIGLTTITFLMNQIVTYGVI  86
            +DI++V  +IYK I  + GTK + L++G+++ +++R  S+++GL+T+ +LM+Q +T+G +
 Sbjct:  16 VDILLVWYVIYKLIMVIRGTKAVQLLKGIVVIVLVRMASQYLGLSTLQWMLDQAITWGFL  75

Query:  87 AGVVIFAPEIRTGLEKFGRTPQLFTQRSQLSSDE---KLVDALVKAVAYMSPRKIGALIS 143
            A ++IF PE+R  LE+ GR    F  RS    +E    K ++A+ KA+ YM+ R+IGAL++
 Sbjct:  76 AIIIIFQPELRRALEQLGRGR--FFSRSGTPVEEAQQKTIEAITKAINYMARRRIGALLT 133

Query: 144 IERTQTLQEYIATGIPLDADISSELLINIFIPNTPLHDGAVIVKDKKIATACSYLPLSES 203
            IER    + +YI TGIPL+A +SSELLINIFIPNTPLHDGAVI+K+ +IA A  YLPLSES
 Sbjct: 134 IERDTGMGDYIETGIPLNAKVSSELLINIFIPNTPLHDGAVIMKNNEIAAAACYLPLSES 193

Query: 204 SSISKEFGTRHRAAIGLSENSDALTVIVSEETGGISVALKGEFLHDLSKDSFEAILRTQL 263
             ISKE GTRHRAA+G+SE +D+LT+IVSEETGG+SVA   G+   +L++++ + +L  +
 Sbjct: 194 PFISKELGTRHRAAVGISEVTDSLTIIVSEETGGVSVAKNGDLHRELTEEALKEMLEAEF 253

Query: 264 IQNQEENSKLAWY                                                276
            +N  +S   WY
 Sbjct: 254 KKNTRDTSSNRWY                                                266
```

A related DNA sequence was identified in *S. pyogenes* <SEQ ID 4247> which encodes the amino acid sequence <SEQ ID 4248>. Analysis of this protein sequence reveals the following:

```
Possible site: 23
>>> Seems to have no N-terminal signal sequence
INTEGRAL      Likelihood = -6.64    Transmembrane 20-36 (19-40)
INTEGRAL      Likelihood = -6.21    Transmembrane 48-64 (47-68)
INTEGRAL      Likelihood = -2.07    Transmembrane 76-92 (76-92)
----- Final Results -----
   bacterial membrane --- Certainty = 0.3654 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP:BAB03984 GB:AP001507 unknown conserved protein [Bacillus halodurans]
 Identities = 117/255 (45%), Positives = 178/255 (68%), Gaps = 6/255 (2%)
 Query:  19 PWL-LAVHLLDILIVAYLIYRFIKALTGTKIMSLVQGVIFFLVLRFIAEWIGETTITYLM  77
            PWL     +LDIL+V Y+IY+ I  + GT+ + L++G+   L++  I+ +     T+ +++
 Sbjct:   8 PWLNYLTQILDILVVTYVIYKAIMIIRGTRAVQLLKGITVILIVYAISIFFNLRTLGWIV  67

Query:  78 NQVITYGVIAGVVIFTPEIRAGLEKFGRSTQVFLQKQYVSSESAL---VDALIKSVAYMG 134
            NQ ITYG++A ++IF PE+R  LE+ GR    F   + +  E +    +DA++K+  YMG
 Sbjct:  68 NQAITYGLLAVIIIFQPELRRALEQLGRGR--FFASRTANEEETMKKTIDAIVKASTYMG 125

Query: 135 PRKIGALIAIEQTQTLQEYIATGIPLNADISSQLLINIFIPNTPLHDGAVIVGQNKIVAA 194
            R+IGALI++E+   + +Y+ TGIP+NA+++S+LLIN FIPNTPLHDGAVI    + I+AA
 Sbjct: 126 KRRIGALISMERETGMTDYVETGIPMNANLTSELLINTFIPNTPLHDGAVIINNDTILAA 185

Query: 195 CAYLPLSESKAISKEFGTRHRAAIGLSENSDALTIIVSEETGAISVTRKGQFLHDLSTDE 254
            YLPLSE+  ISKE GTRHRAA+G+SE +D LTI+VSEETG IS+T+ G+    DL  ++
 Sbjct: 186 ACYLPLSENPFISKELGTRHRAALGVSEVTDCLTIVVSEETGHISLTKNGELHRDLDEEQ 245

Query: 255 FETVLRTYLMSNSNV                                              269
            ++L    L+S + +
 Sbjct: 246 LRSLLEAELISEAKM                                              260
```

An alignment of the GAS and GBS proteins is shown below.

```
 Identities = 201/283 (71%), Positives = 239/283 (84%), Gaps = 2/283 (0%)
 Query:   1 MDIFSAIDSKFWASIMENPWMILIHLMDIIIVAVLIYKFIKALAGTKIMSLIQGVILFII  60
            M+  S+ID KF  S+  +PW++  +HL+DI+VA LIY+FIKAL GTKIMSL+QGVI F++
 Sbjct:   1 MNNLSSIDIKFLLSLFADPWLLAVHLLDILIVAYLIYRFIKALTGTKIMSLVQGVIFFLV  60
```

```
Query:   61 IRFVSEWIGLTTITFLMNQIVTYGVIAGVVIFAPEIRTGLEKFGRTPQLFTQRSQLSSDE 120
            +RF++EWIG TTIT+LMNQ++TYGVIAGVVIF PEIR GLEKFGR+ Q+F Q+  +SS+
Sbjct:   61 LRFIAEWIGFTTITYLMNQVITYGVIAGVVIFTPEIRAGLEKFGRSTQVFLQKQYVSSES 120

Query:  121 KLVDALVKAVAYMSPRKIGALISIERTQTLQEYIATGIPLDADISSELLINIFIPNTPLH 180
            LVDAL+K+VAYM PRKIGALI+IE+TQTLQEYIATGIPL+ADISS+LLINIFIPNTPLH
Sbjct:  121 ALVDALIKSVAYMGPRKIGALIAIEQTQTLQEYIATGIPLNADISSQLLINIFIPNTPLH 180

Query:  181 DGAVIVKDKKIATACSYLPLSESSSISKEFGTRHRAAIGLSENSDALTVIVSEETGGISV 240
            DGAVIV   KI  AC+YLPLSES +ISKEFGTRHRAAIGLSENSDALT+IVSEETG ISV
Sbjct:  181 DGAVIVGQNKIVAACAYLPLSESKAISKEFGTRHRAAIGLSENSDALTIIVSEETGAISV 240

Query:  241 ALKGEFLHDLSKDSFEAILRTQLIQNQEENSKLAWYNQLLRRK                  283
               KG+FLHDLS D FE +LRT L+ N    N   L WY ++L  K
Sbjct:  241 TRKGQFLHDLSTDEFETVLRTYLMSN--SNVTLPWYKKILGGK                  281
```

Based on this analysis, it was predicted that these proteins and their epitopes could be useful antigens for vaccines or diagnostics.

Example 1386

A DNA sequence (GBSx1471) was identified in *S. agalactiae* <SEQ ID 4249> which encodes the amino acid sequence <SEQ ID 4250>. Analysis of this protein sequence reveals the following:

---

Possible site: 25
>>> Seems to have no N-terminal signal sequence
INTEGRAL    Likelihood = −2.60    Transmembrane 33-49 (33-49)
----- Final Results -----
  bacterial membrane --- Certainty = 0.2041 (Affirmative) <succ>
  bacterial outside --- Certainty = 0.0000 (Not Clear) <succ>
  bacterial cytoplasm --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1387

A DNA sequence (GBSx1472) was identified in *S. agalactiae* <SEQ ID 4251> which encodes the amino acid sequence <SEQ ID 4252>. Analysis of this protein sequence reveals the following:

---

Possible site: 15
>>> Seems to have no N-terminal signal sequence
----- Final Results -----
  bacterial cytoplasm --- Certainty = 0.1001 (Affirmative) <succ>
  bacterial membrane --- Certainty = 0.0000 (Not Clear) <succ>
  bacterial outside --- Certainty = 0.0000 (Not Clear) <succ>

---

A related GBS nucleic acid sequence <SEQ ID 9781> which encodes amino acid sequence <SEQ ID 9782> was also identified.

The protein has homology with the following sequences in the GENPEPT database.

```
>GP:AAC84012 GB:AF080002 UDP-N-acetylmuramyl tripeptide synthetase
            MurC [Heliobacillus mobilis]
 Identities = 143/442 (32%), Positives = 229/442 (51%), Gaps = 17/442 (3%)
 Query:   12 GKSAHYLLSKMGRGST-YPGSLALKFDKDILDTIAKDYE--IVVVTGTNGKTLTTALTVG  68
             GK+A +L  + G G T +PG +  +   IL  +A+ +    +VVTGTNGKT T+ +
 Sbjct:    2 GKTAIWLNRRFGHGGTSFPGGIGRRVAPQILTALARQLKRGAMVVTGTNGKTTTSKMLAA  61

Query:   69 ILKEAFGQVVTNPSGANMITGIVSTFLTAKKSKSG--KKIAVLEIDEASLPRITQYIKPS 126
             I++++    +  N  +GAN++ GI +  F+ +       + ++E+DEA++P++ + ++P
 Sbjct:   62 IVEKSSLTLTHNRAGANLVGGITTAFIDSATIGGSITSDLGIIEVDEATIPQLVREVQPK 121

Query:  127 LFVFTNIFRDQMDRYGEIYTTYQMILDGAANAP-QATILANGDSPLENS--KSVTNPVQF 183
                V  TN  FRDQ+DR+GE+   T ++          P Q+   +N D PL  S  K      V +
 Sbjct:  122 GVVVTNFFRDQLDRFGELDKTVSLVGEALRLLPVQSIAVLNADDPLVASLGKDFPGRVLY 181

Query:  184 YGFNTDKHEPRLAHYNTEGILCPKCQAILTYRLNTYANLGDYTCPNCDFERPNLDYALTR 243
             +G +    + R   +E   C   C    LTY   +  LG Y C +C FERP        +T
 Sbjct:  182 FGIDDRSYGAREMLQSAETRFCRLCGHPLTYDWFFFGQLGHYRCSHCGFERPEPKIKVTG 241

Query:  244 LTHLTNTSSGFVIDGQ----QYNINVGGLYNIYNALAAVSVAEYFGVEPSQIKDGFDKSR 299
             +             S F ++      Q  ++  G YNIYNALAA++  A       +   I+ G    R
 Sbjct:  242 IQLKGEEGSAFTVETPRGTWQLELSTPGFYNIYNALAAIASAIRLDLPEKAIRAGLQGYR 301

Query:  300 AVFGRQETFTIGN-KKCTLVLIKNPVGASQALDMIKLAPYPFSLSVLLNANYADGIDTSW 358
                FGR E   + ++  L LIKNP  G + +  +       P     L V++N N  ADG D SW
 Sbjct:  302 TNFGRMERIELEDGRRAFLALIKNPTGCDEVIRTLVQNRGPKRLLVIINDNAADGRDISW 361

Query:  359 IWDANFETI--LTMNIPEIFAGGVRHSEIARRLRVTGYDEKRIK-QADKLQDIMTMIEQQ 415
             +WDA+FE++   +   +   +F   G+R  ++A RL TG     + I+   +A+  I  + +E
 Sbjct:  362 LWDADFESLEPVYPELRSVFTSGLRGEDMALRLNYTGIPAESIRYEANVESAIRSALEMT 421
```

```
                         -continued
Query: 416 ET-EHAYILATYTAMLEFREIL                              436
           E  E  YIL TYTA+LE +  L
Sbjct: 422 EPGETLYILPTYTALLESKAAL                              443
```

A related DNA sequence was identified in *S. pyogenes* <SEQ ID 4253> which encodes the amino acid sequence <SEQ ID 4254>. Analysis of this protein sequence reveals the following:

---

Possible site: 35
>>> Seems to have an uncleavable N-term signal seq
----- Final Results -----
   bacterial membrane --- Certainty = 0.0000 (Not Clear) <succ>
     bacterial outside --- Certainty = 0.0000 (Not Clear) <succ>
       bacterial cytoplasm --- Certainty = 0.0000 (Not Clear) <succ>

---

An alignment of the GAS and GBS proteins is shown below.

```
Identities = 343/446 (76%), Positives = 393/446 (87%)
Query:   1 MKINTALGVAAGKSAHYLLSKMGRGSTYPGSLALKFDKDILDTIAEDYEIVVVTGTNGKT  60
           MK+ T LG+AGK+A    +L+K+GRGSTYPG LAL  DKDIL  ++KDY+IVVVTGTNGKT
Sbjct:   1 MKMKTLLGIIAGKAAQSILTKLGRGSTYPGRLALACDKDILKDLSKDYDIVVVTGTNGKT  60

Query:  61 LTTALTVGILKEAFGQVVTNPSGANMITGIVSTFLTAKKSKSGKKIAVLEIDEASLPRIT 120
           LTTALTVGILKEAFG+++TNPSGANMITGI STFL AKK KS ++IAVLEIDEASLPRIT
Sbjct:  61 LTTALTVGILKEAFGEIITNPSGANMITGITSTFLAAKKGKSERQIAVLEIDEASLPRIT 120

Query: 121 QYIKPSLFVFTNIFRDQMDRYGEIYTTYQMILDGAANAPQATILANGDSPLENSKSVTNP 180
           Y+KPSLFV+TNIFRDQMDRYGEIYTTYQMI+DGA NAP+ATILANGDSP+F+SK + NP
Sbjct: 121 TYLKPSLFVYTNIFRDQMDRYGEIYTTYQMIVDGARNAPKATILANGDSPIFSSKDIVNP 180

Query: 181 VQFYGFNTDKHEPRLAHYNTEGILCPKCQAILTYRINTYANLGDYTCPNCDFERPNLDYA 240
           VQ+YGF+T KH P+LAHYNTEGILCPKC+ IL YRLNTYANLGD+ C NC F+RP LDY
Sbjct: 181 VQYYGFDTAKRAPQLAHYNTEGILCPKCEHILQYRLNTYANLGDFVCLNCQFQRPTLDYQ 240

Query: 241 LTRLTHLTNTSSGFVIDGQQYNINVGGLYNIYNALAAVSVAEYFGVEPSQIKDGFDKSRA 300
           LT LT +T+ SS FVIDGQ Y INVGGLYNIYNALAAVSVAE+FGV P +IK GF+KS+A
Sbjct: 241 LTELTAITHQSSEFVIDGQNYKINVGGLYNIYNALAAVSVAEFFGVSPEKIKAGFNKSKA 300

Query: 301 VFGRQETFTIGNKKCTLVLIKNPVGASQALDMIKLAPYPFELSVLLNANYADGIDTSWIW 360
           VFGRQETFT+G+K CTL+LIKNPVGASQAL+MI+LA YPFSLSVLLNANYADGIDTSWIW
Sbjct: 301 VFGRQETFTVGDKSCTLILIKNPVGASQALEMIQLADYPFSLSVLLNANYADGIDTSWIW 360

Query: 361 DANFETILTMNIPEIFAGGVRHSEIARKLRVTGYDEKRIKQADKLQDIMTMIEQQETEHA 420
           DANFE I  M I EI AGGVRHSEIARRLRVTG+D+ +IKQA+KL+ I+  IE+QE +HA
Sbjct: 361 DANFELITQMPITEINAGGVRHSEIARRLRVTGFDDTKIKQAEKLEQIIETIEKQEAKHA 420

Query: 421 YILATYTAMLEFREILANHNAIRKEM                                  446
           YILATYTAMLEFR +LA+ + +  KEM
Sbjct: 421 YILATYTAMLEFRSLLADRHVVEKEM                                  446
```

Based on this analysis, it was predicted that these proteins and their epitopes could be useful antigens for vaccines or diagnostics.

Example 1388

A DNA sequence (GBSx1473) was identified in *S. agalactiae* <SEQ ID 4255> which encodes the amino acid sequence <SEQ ID 4256>. Analysis of this protein sequence reveals the following:

---

Possible site: 32
>>> Seems to have no N-terminal signalsequence
----- Final Results -----
   bacterial cytoplasm --- Certainty = 0.3010 (Affirmative) <succ>
     bacterial membrane --- Certainty = 0.0000 (Not Clear) <succ>
       bacterial outside --- Certainty = 0.0000 (Not Clear) <succ>

---

The protein has homology with the following sequences in the GENPEPT database.

```
>GP:AAC84011 GB:AF080002 cobyric acid synthase CobQ [Heliobacillus mobilis]
   Identities = 89/250 (35%), Positives = 129/250 (51%), Gaps = 9/250 (3%)
   Query:  11 TKDYKYTLNVAHLYGNLLNTYGDNGNILMMKYVGEKLGCQMTFDIVSLEDRFDPNYYQMA  70
              +K    TL +HLY +LLN YGD GNI+ ++   E  G  +   SL ++  +    +
   Sbjct:   2 SKTSNRTLTLIHLYPDLLNLYGDRGNIITLRRRCEWRGITLQVHSASLGEKAAFDDADLV  61
```

```
                            -continued
Query:  71 FFGGGQDYEQAIVARDLPSKKEDINKFIQNNGV-VLAICGGFQLLGQYYIQANGERIEGI 129
           F GGG D EQ ++ +D    K           G+ +L++CGG+QLLG YY    GE +G+
Sbjct:  62 FMGGGSDREQTLLFQDFQQHKGPALVEAAEGGLPLLSVCGGYQLLGLYYRTHTGEEMPGL 121

Query: 130 GVMGHYTLNQNNNRYIGDIKIHNDEFNE--TYYGFENHQGRTFLSEDE--KPLGTVIYGN 185
           G+    +T    + R IG++         E  T GFENH GRTFL      +PL  V G
Sbjct: 122 GLFDAWT-EAGSTRLIGNVVAQAPLLGEQATLVGFENHSGRTFLGSRGGIQPLAQVTAGF 180

Query: 186 GNNKEDGTEGVHYKNVFGSYFHGPILSRNANLAYRLVATALRNKYG---KEIVLPSYEEI 242
           GNN +D  EG   YKN  G+Y HGP+L +N  LA  L++ AL  +YG     +  ++E
Sbjct: 181 GNNGDDQGEGAVYKNAVGTYLHGPVLPKNPALADWLLSKALERRYGGGSLSTLQDTWENR 240

Query: 243 LSLEIPEEYG                                                   252
           L  +   +G
Sbjct: 241 AHLSVAQRFG                                                   250
```

A related DNA sequence was identified in *S. pyogenes* <SEQ ID 4257> which encodes the amino acid sequence <SEQ ID 4258>. Analysis of this protein sequence reveals the following:

---

Possible site: 32
>>> Seems to have no N-terminal signal sequence
----- Final Results -----
  bacterial cytoplasm --- Certainty = 0.2586 (Affirmative) <succ>
    bacterial membrane --- Certainty = 0.0000 (Not Clear) <succ>
      bacterial outside --- Certainty = 0.0000 (Not Clear) <succ>

---

An alignment of the GAS and GBS proteins is shown below.

```
Identities = 197/260 (75%), Positives = 224/260 (85%)
Query:   1 MTYTSLKSPTTKDYKYTLNVAHLYGNLLNTYGDNGNILMMKYVGEKLGCQMTFDIVSLED   60
           MTYTSLKSP  +DY Y L +AHLYGNL+NTYGDNGNILM+KYV EKLG ++T DIVS+ D
Sbjct:   1 MTYTSLKSPENQDYIYDLTIAHLYGNLMNTYGDNGNILMLKYVAEKLGARVTVDIVSIND   60

Query:  61 RFDPNYYQMAFFGGGQDYEQAIVARDLPSKKEDINKFIQNNGVVLAICGGFQLLGQYYIQ  120
           F+ + Y + FFGGGQDYEQ+IVA+DLPSKK  +  +I NN VVLAICGGFQLLGQYY+Q
Sbjct:  61 TFEQDDYDIVFFGGGQDYEQSIVAKDLPSKKAALADYIANNKVVLAICGGFQLLGQYVQ  120

Query: 121 ANGERIEGIGVMGHYTLNQNNNRYIGDIKIHNDEFNETYYGFENHQGRTFLSEDEKPLGT  180
           ANG +I+G+G+MGHYTLNQ+ NR+IGDIKIHNDEFNETYYGFENHQGRTFLS DEKPLG
Sbjct: 121 ANGVKIDGLGIMGHYTLNQHQNRFIGDIKIHNDEFNETYYGFENHQGRTFLSGDEKPLGR  180

Query: 181 VIYGNGNNKEDGTEGVHYKNVFGSYFHGPILSRNANLAYRLVATALRNKYGKEIVLPSYE  240
           V+YGNGNNKED TEGVHYKNV+GSYFHGPILSRN NLAYRLV TAL+ KYG  I LPSY+
Sbjct: 181 VVYGNGNNKEDQTEGVHYKNVYGSYFHGPILSRNVNLAYRLVTTALKKKYGSAISLPSYD  240

Query: 241 EILSLEIPEEYGDVKSKADF                                          260
           +IL   EI EEY D+KSKA F
Sbjct: 241 DILKQEITEEYADLKSKASF                                          260
```

Based on this analysis, it was predicted that these proteins and their epitopes could be useful antigens for vaccines or diagnostics.

Example 1389

A DNA sequence (GBSx1474) was identified in *S. agalactiae* <SEQ ID 4259> which encodes the amino acid sequence <SEQ ID 4260>. Analysis of this protein sequence reveals the following:

---

Possible site: 21
>>> Seems to have no N-terminal signal sequence
----- Final Results -----
  bacterial cytoplasm --- Certainty = 0.1701 (Affirmative) <succ>
    bacterial membrane --- Certainty = 0.0000 (Not Clear) <succ>
      bacterial outside --- Certainty = 0.0000 (Not Clear) <succ>

---

The protein has homology with the following sequences in the GENPEPT database.

```
>GP:BAB04402 GB:AP001509 lipoate-protein ligase [Bacillus halodurans]
 Identities = 153/316 (48%), Positives = 212/316 (66%), Gaps = 3/316 (0%)
 Query:  10 DPAYNVALEAYAFQKLTDIDEIFIL-WINEPAIIGRHQNTIQEINKEFIDKNGIHVVRR   68
            DP   N+A+E YA + L DI+E  ++L +INEP+IIGR+QNTI+EIN E+++ NGIHVVRR
 Sbjct:  11 DPRINLAIEEYALKNL-DINETYLLFYINEPSIIGRNQNTIEEINTEYVESNGIHVVRR   69
```

```
-continued
Query:  69 LSGGGAVYHDLNNLNYTIISNNTQEGAFDFQTFSKPVIDTLAKLGVKAEFTGRNDL-EIN 127
           LSGGGAVYHD  NLN++ I+ +  E   +FQ F+ PVI   LAKLGV AE  GRND+   +
Sbjct:  70 LSGGGAVYHDHGNLNFSFITKDDGESFSNFQKFTDPVIKALAKLGVTAELKGRNDIIASD 129

Query: 128 GQKFAGNAQAYYKGRMMHHGCLLFDVDMSVLGQALKVSKDKIESKGIKSVRARVTNIVDH 187
           G+K +GNAQ    KGRM  HG LLFD ++   +  AL VSKDKIESKGIKS+R+RV NI +
Sbjct: 130 GRKISGNAQFSTKGRMFSHGTLLFDSEIDHVVSALNVSKDKIESKGIKSIRSRVANISEF 189

Query: 188 LSDKITVQEFSDAILAQMKEEYPEMDEYVLSDAELSEIQAMRDNQFATWDWTYGKAPEYT 247
           L++KI++ +F    +L + +   + EY L+  + +EI   +  ++ WDW YGK+P +
Sbjct: 190 LTEKISIDQFRSLLLESIFDGQANIQEYKLTADDWAEIHELSKERYQNWDWNYGKSPAFN 249

Query: 248 IERGVRYPAGKITTYANVENSTIKSVKIFGDFFGVKPVDDIEKMLEGVRYDYKDVLAALK 307
           ++   R+P G I     V+   TI+  KIFGDFFG   V D+E  L G+RY+   D+  AL
Sbjct: 250 LQHSRFPVGNIDIRLEVKGGTIQQCKIFGDFFGTGDVRDLEDRLVGIRYERADIEQALA 309

Query: 308 TVDTSQYFSRMTPEEI                                            323
           VD    YF ++  ++I
Sbjct: 310 DVDVKTYFGQVEKDDI                                            325
```

A related DNA sequence was identified in *S. pyogenes* <SEQ ID 4261> which encodes the amino acid sequence <SEQ ID 4262>. Analysis of this protein sequence reveals the following:

---

Possible site: 23
>>> Seems to have no N-terminal signal sequence
----- Final Results -----
  bacterial cytoplasm --- Certainty = 0.1271 (Affirmative) <succ>
   bacterial membrane --- Certainty = 0.0000 (Not Clear) <succ>
     bacterial outside --- Certainty = 0.0000 (Not Clear) <succ>

---

An alignment of the GAS and GBS proteins is shown below.

```
Identities = 249/328 (759.0, Positives = 292/328 (88%)
Query:   1 MKYIVNTSNDPAYNVALEAYAFQKLTDIDEIFILWINEPAIIIGRHQNTIQEINKEFIDK  60
           MKYIVN S++PA+N+ALEAYAF++L  +DE+FILWINEPAIIIG+HQNTIQEINKE+ID+
Sbjct:   1 MKYIVNKSHNPAFNIALEAYAFRELVEEDELFILWINEPAIIIGKHQNTIQEINKEYIDE  60

Query:  61 NGIHVVRRLSGGGAVYHDLNNLNYTIISNNTQEGAFDFQTFSKPVIDTLAKLGVKAEFTG 120
           +GIHVVRRLSGGGAVYHDLNNLNYTIISN T EGAFDF+TFS+PVI  TLA LGV A FTG
Sbjct:  61 HGIHVVRRLSGGGAVYHDLNNLNYTIISNKTAEGAFDEKTESQPVIATLADLGVTANFTG 120

Query: 121 RNDLEINGQKFAGNAQAYYKGRMMHHGCLLFDVDMSVLGQALKVSKDKIESKGIKSVRAR 180
           RND+EI+G+K   GNAQAYYKGRMMHHGCLLFDVDM+VLG ALKVSKDKIESKG+KSVRAR
Sbjct: 121 RNDIEIDGKKICGNAQAYYKGRMMHHGCLLFDVDMTVLGDALKVSKDKIESKGVKSVRAR 180

Query: 181 VTNIVDHLSDKITVQEFSDAILAQMKEEYPEMDEYVLSDAELSEIQAMRDNQFATWDWTY 240
           VTNI++  L +KITV+EFSD ILA+MKE YP+M EYVLS+ EL++I+    QF +WDWTY
Sbjct: 181 VTNILNELPEKITVEEFSDKILAKMKETYPDMTEYVLSEDELAKIEQSAKEQFGSWDWTY 240

Query: 241 GKAPEYTIERGVRYPAGKITTYANVENSTIKSVKIFGDFFGVKPVDDIEKMLEGVRYDYK 300
           GKAPEYTIER VRYPAGKI+T+ANVENS IK++KI+GDFFG+K V DIE +L G +Y+Y+
Sbjct: 241 GKAPEYTIERNVRYPAGKISTFANVENSIIKNLKIYGDFFGIKDVQDIENLLIGCKYEYR 300

Query: 301 DVLAALKTVDTSQYFSRMTPEEITKAIV                                328
           DV   LKT+DT+QYFSRMT EE+ KAIV
Sbjct: 301 DVFERLKTIDTTQYFSRMTVEEVAKAIV                                328
```

Based on this analysis, it was predicted that these proteins and their epitopes could be useful antigens for vaccines or diagnostics.

Example 1390

A DNA sequence (GBSx1475) was identified in *S. agalactiae* <SEQ ID 4263> which encodes the amino acid sequence <SEQ ID 4264>. Analysis of this protein sequence reveals the following:

Possible site: 46
>>> Seems to have no N-terminal signal sequence
INTEGRAL    Likelihood = −1.70   Transmembrane 294-310 (294-312)
----- Final Results -----
    bacterial membrane --- Certainty = 0.1680 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:AAA21748 GB:L31844 dihydrolipoamide dehydrogenase
[Clostridium magnum]
Identities = 229/589 (38%), Positives = 339/589 (56%), Gaps = 25/589 (4%)
Query:   1 MAFDVIMPKLGVDMQEGEILEWKKNEGDTVNEGDVLLEIMSDKTNMEIEAEDTGVLLKIV    60
             MA  V+MPKLG+ M EG ++ WKK EGD V  G++L E+ +DK   E+E+ D G++ K++
Sbjct:   1 MAKIVVMPKLGLTMTEGTLVTWKKAEGDQVKVGEILFEVSTDKLTNEVESSDEGIVRKLL    60

Query:  61 HQAGDVVPVTEVIAYIGEEGEEVGTSSPSADATITAEDGQSVSGPAAPSQETVAAATPKE   120
              GDVV    +A IG  E++ +           +G S     +A   +T A    PK+
Sbjct:  61 VNEGDVVECLNPVAIIGSADEDISSLL----------NGSSEGSGSAEQSDTKA---PKK   107

Query: 121 ELAADEY--DIVVVGGGPAGYYAAIRGAQLGGKIAIVEKTEFGGTCLNVGCIPTKTYLKN   178
             E+ A +   ++VV+GGGP GY AAIR AQLG K+ ++EK   GGTCLNVGCIPTK  L +
Sbjct: 108 EVEAVKGGDNLVVIGGGPGGYVAAIRAAQLGAKVTLIEKESLGGTCLNVGCIPTKVLLHS   167

Query: 179 AEILDGLKVAAGRGINLASTNYAIDMDKTVAFKNSVVKTLTGGVRGLLKANKVEIFNGLG   238
             +++L  +K    GI++ +  ++        K   V+K L  GV GLL   NKV++   G
Sbjct: 168 SQLLTEMKEGDKLGIDIEGS-IVVNWKHIQKRKKIVIKKLVSGVSGLLTCNKVKVIKGTA   226

Query: 239 QVNPDKSVVIGDK-----VIKGRNVVLATGSKVSRINIPGIESPLVLTSDDILDLREIPK   293
             +    ++++ +      +    N ++ATGS    I G +  V+ S   L L   P+
Sbjct: 227 KFESKDTILVTKEDGVAEKVNFDNAIIATGSMPFIPEIEGNKLSGVIDSTGALSLESNPE   286

Query: 294 SLAVMGGGVVGIELGLVWASYGVDVTVIEMADRIIPAMDKEVSLELQKILAKKGMKIKTS   353
             S+A++GGGV+G+E   ++ S G   V++IEM    I+P MD+E+S    + L + G+  I   +
Sbjct: 287 SIAIIGGGVIGVEFASIFNSLGCKVSIIEMLPHILPPMDREISEIAKAKLIRDGININNN   346

Query: 354 VGVSEIVEANNQLTLKL--NNGEEVV-ADKALLSIGRVPQMNGLENLEPELEMERGRIKV   410
             V+ I +  + L +     + GEE + +K L+++GR      + GL+  +   ++ E G I V
Sbjct: 347 CKVTRIEQGEDGLKVSFIGDKGEESIDVEKVLIAVGRRSNIEGLDVEKIGVKTEGGSIIV   406

Query: 411 NAYQETSIPGIYAPGDVNGTRMLAHAAYRMGEVAAENALGGNKRKAHLDFTPAAVYTHPE   470
             N    ET++  GIYA GD  G   MLAH A   G VAAEN +G NK K       PA VYT PE
Sbjct: 407 NDKMETNVEGIYAIGDCTGKIMLAHVASDQGVVAAENIMGQNK-KMDYKTVPACVYTKPE   465

Query: 471 VAMVGMTEEQAREQYGDILVGKNSFTGNGRAIASNEAHGFVKVIAEPKYKEILGVHIIGP   530
             +A  VG+TEEQA+E+  D  VGK    NG+++  NE   G  +K+I + KY+EILGVHI+GP
Sbjct: 466 LASVGLTEEQAKEKGIDYKVGKFQLAANGKSLIMNETGGVIKIITDKKYEEILGVHILGP   525

Query: 531 AAAELINEASTIMENELTVYDVAQSIHGHPTFSEVMYEAFLDVLGEAIH             579
              A +LI EA+   E T+ ++  ++H HPT  E M EA L V  +AIH
Sbjct: 526 RATDLITEAALALRLEATLEEIITTVHAHPTVGEAMKEAALAVNNQAIH             574
```

A related DNA sequence was identified in *S. pyogenes* <SEQ ID 1819> which encodes the amino acid sequence <SEQ ID 1820>. Analysis of this protein sequence reveals the following:

Possible site: 50
>>> Seems to have no N-terminal signalsequence
INTEGRAL    Likelihood = −1.70   Transmembrane 297-313 (297-315)
----- Final Results -----
    bacterial membrane --- Certainty = 0.1680 (Affirmative) <succ>
    bacterial outside --- Certainty = 0.0000 (Not Clear) <succ>
    bacterial cytoplasm --- Certainty = 0.0000 (Not Clear) <succ>

An alignment of the GAS and GBS proteins is shown below.

```
Identities = 497/591 (84%), Positives = 538/591 (90%), Gaps = 10/591 (1%)
Query:   1 MAFDVIMPKLGVDMQEGEILEWKKNEGDTVNEGDVLLEIMSDKTNMEIEAEDTGVLLKIV    60
             MA ++IMPKLGVDMQEGEI+EWKK EGDTVNEGD+LLEIMSDKTNME+EAED+GVLLKI
Sbjct:   1 MAVEIIMPKLGVDMQEGEIIEWKKQEGDTVNEGDILLEIMSDKTNMELEAEDSGVLLKIT    60

Query:  61 HQAGDVVPVTEVIAYIGEEGEEVGTSSPSA---DATITAEDGQS--VSGPAAPSQETVAA   115
              QAG+ VPVTEVI YIG EGE V SSP+A      T ED ++     P AP+Q    A+
Sbjct:  61 RQAGETVPVTEVIGYIGAEGESVEVSSPAASDVNVARTTEDLEAAGLEVPKAPAQ--AAS   118

Query: 116 ATPKEELAADEYDIVVVGGGPAGYYAAIRGAQLGGKIAIVEKTEFGGTCLNVGCIPTKTY   175
              A PK  LA DEYDI+VVGGGPAGYYAAIRGAQLGGKIAIVEK+EFGGTCLNVGCIPTKTY
Sbjct: 119 AAPKAALADDEYDIIVVGGGPAGYYAAIRGAQLGGKIAIVEKSEFGGTCLNVGCIPIKTY   178
```

-continued

```
Query:  176  LKNAEILDGLKVAAGRGINLASTNYAIDMDKTVAFKNSVVKTLTGGVRGLLKANKVEIFN  235
             LKNAEILDG+K+AAGRGINLASTNY IDMDKTV FKN+VVKTLTGGV+GLLKANKV IFN
Sbjct:  179  LKNAEILDGIKIAAGRGINLASTNYTIDMDKTVDFKNTVVKTLTGGVQGLLKANKVTIFN  238

Query:  236  GLGQVNPDKSVVIGDKVIKGRNVVLATGSKVSRINIPGIESPLVLTSDDILDLREIPKSL  295
             GLGQVNPDK+V IG  +IKGRNV+LATGSKVSRINIPGI+S LVLTSDDILDLRE+PKSL
Sbjct:  239  GLGQVNPDKTVTIGSQTIKGRNVILATGSKVSRINIPGIDSKLVLTSDDILDLREMPKSL  298

Query:  296  AVMGGGVVGIELGLVWASYGVDVTVIEMADRIIPAMDKEVSLELQKILAKKGMKIKTSVG  355
             AVMGGGVVGIELGLVWASYGVDVTVIEMADRIIPAMDKEVSLELQKIL+KKGMKIKTSVG
Sbjct:  299  AVMGGGVVGIELGLVWASYGVDVTVIEMADRIIPAMDKEVSLELQKILSKKGMKIKTSVG  358

Query:  356  VSEIVEANNQLTLKLNNGEEVVADKALLSIGRVPQMNGLENLEPELEMERGRIKVNAYQE  415
             VSEIVEANNQLTLKLNNGEEVVA+KALLSIGRV QMNGLENL   LEM+R RIKVN YQE
Sbjct:  359  VSEIVEANNQLTLKLNNGEEVVAEKALLSIGRVSQMNGLENL--NLEMDRNRIKVNDYQE  416

Query:  416  TSIPGIYAPGDVNGTRMLAHAAYRMGEVAAENALGGN-KRKAHLDFTPAAVYTHPEVAMV  474
             TSIPGIYAPGDVNGT+MLAHAAYRMGEVAAENA+ GN RKA+L  +TPAAVYTHPEVAMV
Sbjct:  417  TSIPGIYAPGDVNGTKMLAHANYRMGEVAAENAMHGNTTRKANLKYTPAAVYTHPEVAMV  476

Query:  475  GMTEEQAREQYGDILVGKNSFTGNGRAIASNEAHGFVKVIAEPKYKEILGVHIIGPAAAE  534
             G+TEEQAREQYGD+L+GKNSFTGNGRAIASNEAHGFVKVIA+ KY EILGVHIIGPAAAE
Sbjct:  477  GLTEEQAREQYGDVLIGKNSFTGNGRAIASNEAHGFVKVIADAKYHEILGVHIIGPAAAE  536

Query:  535  LINEASTIMENELTVYDVAQSIHGHPTFSEVMYEAFLDVLGEAIHNPPKRK           585
             +INEA+TIME+ELTV ++   SIHGHPTFSEVMYEAF DVLGEAIHNPPKRK
Sbjct:  537  MINEAATIMESELTVDELLLSIHGHPTFSEVMYEAFADVLGEAIHNPPKRK           587
```

Figure 165:
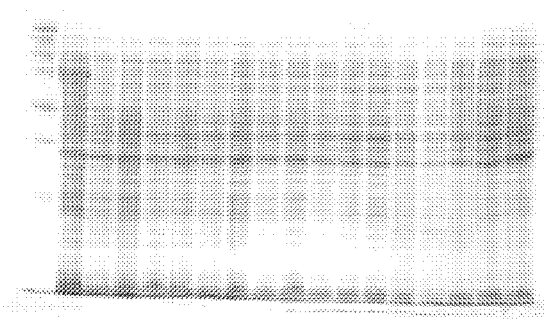

SEQ ID 4264 (GBS681) was expressed in *E. coli* as a His-fusion product. SDS-PAGE analysis of total cell extract is shown in FIG. 165 (lane 2; MW 68.3 kDa) and in FIG. 188 (lane 10; MW 68 kDa).

Figure 240:
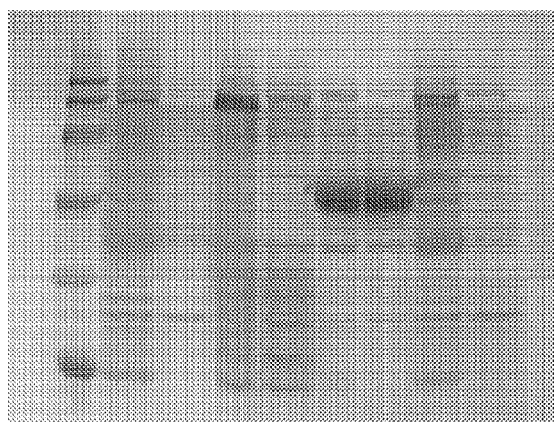

Purified GBS681-His is shown in FIG. 240, lane 5-6.

Based on this analysis, it was predicted that these proteins and their epitopes could be useful antigens for vaccines or diagnostics.

Example 1391

A DNA sequence (GBSx1476) was identified in *S. agalactiae* <SEQ ID 4265> which encodes the amino acid sequence <SEQ ID 4266>. This protein is predicted to be dihydrolipoamide acetyltransferase. Analysis of this protein sequence reveals the following:

Possible site: 46

>>> Seems to have no N-terminal signal sequence

----- Final Results ----- bacterial cytoplasm --- Certainty = 0.4466 (Affirmative) <succ> bacterial membrane --- Certainty = 0.0000 (Not Clear) <succ> bacterial outside --- Certainty = 0.0000 (Not Clear) <succ>

The protein has homology with the following sequences in the GENPEPT database.

```
>GP:BAB04497 GB:AP001509 dihydrolipoamide S-acetyltransferase
[Bacillus halodurans]
Identities = 187/462 (40%), Positives = 266/462 (57%), Gaps = 26/462 (5%)
Query:    1  MAVEIIMPKLGVDMQEGEILEWKKQVGDVVNEGDVLLEIMSDKTNMEIEAEDSGVLLKIT   60
             MA EI MPKL   MQEG +L+W K+ GD V  G+ L EIM+DK N+E+EA  +G LLK
Sbjct:    1  MAKEIFMPKLSSTMQEGTLLQWFKEEGDRVEVGEPLFEIMTDKINIEVEAYEEGTLLKRY   60

Query:   61  HGNGDVVPVTETIGYIGAEGEEVTEASSSENTSVEENATQVTSEPEKVEETSEPSVPAAT  120
             +G  D +PV  IGYIG   E V    +E    E     T E     T+    P++
Sbjct:   61  YGEDDEIPVNHVIGYIGTPDESVP----TEPPGASEITASSTDEAGDHRTTAVKKAPSSD  116

Query:  121  SGEKVRATPAARKLAREMSIDLALVSGTGANGRVHREDVENFKGAQPRITPLARRIAEDQ  180
               E VRATPAAR++A+E  IDL  V G+G  GRV    DV FK    + TPLA+++AE +
Sbjct:  117  R-ENVRATPAARRIAKEKRIDLRQVEGSGPEGRVQAVDVATFKKKGQKATPLAKKVAEVK  175

Query:  181  GVDIAEITGSGIRGKIVENDVLAAMSPQAAEAPVETKATPTTEEKQLPEGVEVIKMSAMR  240
             GV + ++ GSG  GK+ + DV  A    A +PVE K              +K+S +R
Sbjct:  176  GVALEKVQGSGPYGKVYREDVEHAQ----AASPVEDKGNR-------------VKLSGLR  218

Query:  241  KAISKGMTNSYLTAPSFTLNYDIDMTEMMALRKKLIDPIMAKTGLKVSFTDLIGMAVVKT  300
             K ++K M +S  +AP  T+  +IDM+   +R +L+  I   +TG ++S+T+++  AV
Sbjct:  219  KVVAKRMVDSAFSAPHVTITTEIDMSSTIKIRSQLLGMIEQETGYRLSYTEIVMKAVAHA  278

Query:  301  LMKPEHRYLNASLINDAQEIELHNFVNIGIAVGLDDGLIVPVVHNADQMSLSDFVIASKD  360
             LM   H  +NAS +    EI  H V+IG+AV ++ GL+VPVV + D+ L+       K
Sbjct:  279  LMS--HPTINASFFEN--EIVYHEDVHIGLAVAVEGGLVVPVVKHVDKKGLAQLTNECKT  334

Query:  361  VIKKTQEGKLKSAEMSGSTFSITNLGMFGTKTFNPIINQPNSAILGVGATIPTPTVVDGE  420
             V    ++ +L   MSG TF+I+NLGM+     F P+INQP SAILGVG    P  +DG+
Sbjct:  335  VAMAARDNRLSQEMMSGGTFTISNLGMYAIDVFTPVINQPESAILGVGRIQEKPVGIDGQ  394
```

```
-continued
Query: 421  IVARPIMAMCLTIDHRIVDGMNGAKFMVDLKNLMENPFGLLI                      462
            I  RP+M    L+ DHR++DG   A F+ D+K+++E PF LL+
Sbjct: 395  IELRPMMTASLSFDHRVIDGAPAAAFLTDVKSMLEQPFQLLM                      436
```

A related DNA sequence was identified in *S. pyogenes* <SEQ ID 4267> which encodes the amino acid sequence <SEQ ID 4268>. Analysis of this protein sequence reveals the following:

---

Possible site: 50
>>> Seems to have no N-terminal signal sequence
----- Final Results -----
   bacterial cytoplasm --- Certainty = 0.4774 (Affirmative) <succ>
   bacterial membrane --- Certainty = 0.0000 (Not Clear) <succ>
   bacterial outside --- Certainty = 0.0000 (Not Clear) <succ>

---

An alignment of the GAS and GBS proteins is shown below.

<SEQ ID 4270>. This protein is predicted to be acetoin dehydrogenase (TPP-dependent) beta chain (pdhB). Analysis of this protein sequence reveals the following:

---

Possible site: 18
>>> Seems to have no N-terminal signal sequence
----- Final Results -----
   bacterial cytoplasm --- Certainty = 0.1267 (Affirmative) <succ>
   bacterial membrane --- Certainty = 0.0000 (Not Clear) <succ>
   bacterial outside --- Certainty = 0.0000 (Not Clear) <succ>

---

```
Identities = 354/473 (74%), Positives = 390/473 (81%), Gaps = 15/473 (3%)
Query:   1  MAVEIIMPKLGVDMQEGEILEWKKQVGDVVNEGDVLLEIMSDKTNMEIEAEDSGVLLKIT     60
            MA EIIMPKLGVDMQEGEI+EWKKQ GD VNEGD+LLEIMSDKTNME+EAEDSGVLLKIT
Sbjct:   1  MAFEIIMPKLGVDMQEGEIIEWKKQEGDTVNEGDILLEIMSDKTNMELEAEDSGVLLKIT     60

Query:  61  HGNGDVVPVTETIGYIGAEGEEVTEASSSENTS-----VEENATQVTSEPEKVEETSEPS    115
                GD VPVTE IGYIGAEGE V   +SSE T+       +A    + E V    +P
Sbjct:  61  RQAGDTVPVTEVIGYIGAEGESVDTIASSEKTTEIPVASADAGPAVAPKENVASPA-PQ    119

Query: 116  VPAAT----SGEKVRATPAARKLAREMSIDLALVSGTGANGRVHREDVENFKGAQPRITP    171
            V A      +G KVRATPAARK A EM IDL  V GTG   GRVH+EDVENFKGAQP+ +P
Sbjct: 120  VAATAIPQGNGGKVRATPAARKAAAEMGIDLGQVPGTGPKGRVHKEDVENFKGAQPKASP    179

Query: 172  LARRIAEDQGVDIAEITGSGIRGKIVKNDVLAAMSPQAAEAPVETKATPTTEEK--QLPE    229
            LAR+IA D+G+D+A ++G+G  GK++K D++A +      A  P E KA    EEK   LPE
Sbjct: 180  LARKIAADKGIDLATVSGTGFNGKVMKEDIMAILE---AAKPAEAKAPAAKEEKVVDLPE    236

Query: 230  GVEVIKMSAMRKAISKGMTNSYLTAPSFTLNYDIDMTEMMALRKKLIDPIMAKTGLKVSF    289
            GVE    MSAMRKAISKGMTNSYLTAP+FTLNYDIDMTEM+ALRKKLIDPIMAKTGLKVSF
Sbjct: 237  GVEHKPMSAMRKAISKGMTNSYLTAPTFTLNYDIDMTEMIALRKELIDPIMAKTGLKVSF    296

Query: 290  TDLIGMAVVKTLMKPEHRYLNASLINDAQEIELHNFVNIGIAVGLDDGLIVPVVHNADQM    349
            TDLIGMAVVKTLMKPEH Y+NASLINDA +IELH FVN+GIAVGLDDGLIVPV+H A++M
Sbjct: 297  TDLIGMAVVKTLMKPEHEYMNASLINDANDIELHRFVNLGIAVGLDDGLIVPVIHGANKM    356

Query: 350  SLSDFVIASKDVIKKTQEGKLKSAEMSGSTFSITNLGMFGTKTFNPIINQPNSAILGVGA    409
             LSDFV+ASKDVIKK Q GKLK+AEMSGSTFSITNLGMFGTKTFNPIINQPNSAILGVGA
Sbjct: 357  CLSDFVLASKDVIKKAQTGKLKAAEMSGSTFSITNLGMFGTKTFNPIINQPNSAILGVGA    416

Query: 410  TIPTPTVVDGEIVARPIMAMCLTIDHRIVDGMNGAKFMVDLKNLMENPFGLLI          462
            TIPTPTVVDGEIV+RPIMAMCLTIDHR+VDGMNGAKFMVDLK LMENPF LLI
Sbjct: 417  TIPTPTVVDGEIVSRPIMAMCLTIDHRLVDGMNGAKFMVDLKKLMENPFELLI          469
```

Based on this analysis, it was predicted that these proteins and their epitopes could be useful antigens for vaccines or diagnostics.

Example 1392

A DNA sequence (GBSx1477) was identified in *S. agalactiae* <SEQ ID 4269> which encodes the amino acid sequence A related GBS nucleic acid sequence <SEQ ID 9779> which encodes amino acid sequence <SEQ ID 9780> was also identified.

The protein has homology with the following sequences in the GENPEPT database.

```
>GP:BAB04496 GB:AP001509 acetoin dehydrogenase (TPP-dependent) beta
chain [Bacillus halodurans]
Identities = 189/319 (59%), Positives = 249/319 (77%), Gaps = 1/319 (0%)
Query:  11  EAINVAMSEEMRKDEKVFLMGEDVGVYGGDFGTSVGMLEEFGAKRVRDTPISEAAIAGSA     70
            EAI  AM+  EMRK+E VF++GED+GVYGG FG + GM+EEFG++RVR+TPISEAAI+G+A
Sbjct:   8  EAIREAMTLEMRKNEDVFILGEDIGVYGGAFGVTRGMIEEFGSERVRNTPISEAAISGTA     67

Query:  71  IGAAQTGLRPIVDLTFMDFVTIAMDAIVNQGAKTNYMFGGGLSTPVTFRVASGSGIGSAA    130
```

```
                             -continued
            IGAA TG+RPI++L F DF+TIAMD +VNQ AK  YM+GG     P+  R  +GSG G+AA
Sbjct:  68  IGAALTGMRPILELQFSDFITIAMDNMVNQAAKLRYMYGGKAKVPMVLRTPAGSGTGAAA  127

Query: 131  QHSQSLEAWLTHIPGLKVVAPGTVNESKALLKSSILDNNPVIFLEPKALYGKKEEVNMDP  190
            QHSQSLEAW+THIPGLKVV P T  ++K LLK++I DNNPVIF E K  Y K  V  +
Sbjct: 128  QHSQSLEAWMTHIPGLKVVQPATAYDAKGLLKAAIDDNNPVIFYEHKLCYRTKCHV-PEE  186

Query: 191  DFYIPLGKGDIKREGTDLTIVSYGRMLERVMQAAEEVAEEGINVEVVDPRTLIPLDKELI  250
            ++ IPLGK D+KR+GTD+T+V+   M+ +  ++AA E+  +EGI+VEV+DPRTL+PLD+E I
Sbjct: 187  EYSIPLGRADVKRKGTDVTVVATAVMVHKALEAAVELEKEGISVEVIDPRTLVPLDEETI  246

Query: 251  IDSVKKTGKLILVNDAYKTGGFTGEIATMVAESEAFDYLDHPIVRLASEDVPVPYSRVLE  310
            I SVKKT +LI+V++A K GGF GEIA+++AESEAFDYLD PI RL   + VP+PY+  LE
Sbjct: 247  IRSVKKTSRLIVVHEAVKRGGFGGEIASIIAESEAFDYLDAPIKRLGGKPVPIPYNPTLE  306

Query: 311  QGILPDVAKIKDAIYKVVN                                          329
            +  +P V  I +A+ + +N
Sbjct: 307  RAAIPQVPDIIEAVKETLN                                          325
```

A related DNA sequence was identified in *S. pyogenes* <SEQ ID 4271> which encodes the amino acid sequence <SEQ ID 4272>. Analysis of this protein sequence reveals the following:

```
Possible site: 18
>>> Seems to have no N-terminal signal sequence
INTEGRAL      Likelihood = –0.00    Transmembrane 81-97 (81-97)
----- Final Results -----
   bacterial membrane --- Certainty = 0.1001 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the databases:

```
>GP:BAB04496 GB:AP001509 acetoin dehydrogenase (TPP-dependent) beta
chain [Bacillus halodurans]
Identities = 187/319 (58%), Positives = 244/319 (75%), Gaps = 1/319 (0%)
Query:  11  EAVNLAMTEEMRKDENIFLMGEDVGVYGGDFGTSVGMIEEFGPKRVKDTPISEAAISGAA   70
            EA+  AMT EMRK+E++F++GED+GVYGG FG + GMIEEFG +RV++TPISEAAISG A
Sbjct:   8  EAIREAMTLEMRKNEDVFILGEDIGVYGGAFGVTRGMIEEFGSERVRNTPISEAAISGTA   67

Query:  71  IGAAITGLRPIVDVTFMDFLTIMMDAIVNNGAKNNYMFGGGLITPVTFRVASGSGIGSAA  130
            IGAA+TG+RPI+++ F DF+TI MD +VN  AK   YM+GG    P+  R  +GSG G+AA
Sbjct:  68  IGAALTGMRPILELQFSDFITIAMDNMVNQAAKLRYMYGGKAKVPMVLRTPAGSGTGAAA  127

Query: 131  QHSQSLEAWLTHIPGIKVVAPGNANDAKGLLKSAIRDNNIVLFMEPKALYGKKEEVNQDP  190
            QHSQSLEAW+THIPG+KVV P  A DAKGLLK+AI DNN V+F E K  Y K  V ++
Sbjct: 128  QHSQSLEAWMTHIPGLKVVQPATAYDAKGLLKAAIDDNNPVIFYEHKLCYRTKCHVPEE-  186

Query: 191  DFYIPLGKGDIKREGTDLTIVSYGRMLERVLQAAEEVAADGINVEVVDPRTLIPLDKELI  250
            ++ IPLGK D+KR+GTD+T+V+   M+ + L+AA E+  +GI+VEV+DPRTL+PLD+E I
Sbjct: 187  EYSIPLGKADVKRKGTDVTVVATAVMVHKALEAAVELEKEGISVEVIDPRTLVPLDEETI  246

Query: 251  IESVKKTGKLMLVNDAYKTGGFIGEIATMITESEAFDYLDHPIVRLASEDVPVPYARVLE  310
            I SVKKT +L++V++A K GGF GEIA++I ESEAFDYLD PI RL   + VP+PY   LE
Sbjct: 247  IRSVKKTSRLIVVHEAVKRGGFGGEIASIIAESEAFDYLDAPIKRLGGKPVPIPYNPTLE  306

Query: 311  QAILPDVEKIKAAIVKMAN                                          329
            +A +P V  I  A+  +  N
Sbjct: 307  RAAIPQVPDIIEAVKETLN                                          325
```

An alignment of the GAS and GBS proteins is shown below.

```
Identities = 286/331 (86%), Positives = 310/331 (93%)
Query:   1  MSETKVMALREAINVAMSEEMRKDEKVFLMGEDVGVYGGDFGTSVGMLEEFGAKRVRDTP   60
            MSETK+MALREA+N+AM+EEMRKDE +FLMGEDVGVYGGDFGTSVGM+EEFG KRV+DTP
Sbjct:   1  MSETKLMALREAVNLAMTEEMRKDENIFLMGEDVGVYGGDFGTSVGMIEEFGPKRVKDTP   60
```

-continued
```
Query:   61 ISEAAIAGSAIGAAQTGLRPIVDLTFMDFVTIAMDAIVNQGAKTNYMFGGGLSTPVTFRV 120
            ISEAAI+G+AIGAA TGLRPIVD+TFMDF+TI MDAIVN GAK NYMFGGGL TPVTFRV
Sbjct:   61 ISEAAISGAAIGAAITGLRPIVDVTFMDFLTIMMDAIVNNGAKNNYMFGGGLITPVTFRV 120

Query:  121 ASGSGIGSAAQHSQSLEAWLTHIPGLKVVAPGTVNESKALLKSSILDNNPVIFLEPKALY 180
            ASGSGIGSAAQHSQSLEAWLTHIPG+KVVAPG  N++K LLKS+I DNN V+F+EPKALY
Sbjct:  121 ASGSGIGSAAQHSQSLEAWLTHIPGIKVVAPGNANDAKGLLKSAIRDNNIVLFMEPKALY 180

Query:  181 GKKEEVNMDPDFYIPLGKGDIKREGTDLTIVSYGRMLERVMQAAEEVAEEGINVEVVDPR 240
            GKKEEVN DPDFYIPLGKGDIKREGTDLTIVSYGRMLERV+QAAEEVA +GINVEVVDPR
Sbjct:  181 GKKEEVNQDPDFYIPLGKGDIKREGTDLTIVSYGRMLERVLQAAEEVAADGINVEVVDPR 240

Query:  241 TLIPLDKELIIDSVKKTGKLILVNDAYKTGGFTGEIATMVAESEAFDYLDHPIVRLASED 300
            TLIPLDKELII+SVKKTGKL+LVNDAYKTGGF GEIATM+ ESEAFDYLDHPIVRLASED
Sbjct:  241 TLIPLDKELIIESVKKTGKLMLVNDAYKTGGFIGEIATMITESEAFDYLDHPIVRLASED 300

Query:  301 VPVPYSRVLEQGILPDVAKIKDAIYKVVNKG                             331
            VPVPY+RVLEQ ILPDV KIK AI K+ NKG
Sbjct:  301 VPVPYARVLEQAILPDVEKIKAAIVKMANKG                             331
```

Based on this analysis, it was predicted that these proteins and their epitopes could be useful antigens for vaccines or diagnostics.

Example 1393

A DNA sequence (GBSx1478) was identified in *S. agalactiae* <SEQ ID 4273> which encodes the amino acid sequence <SEQ ID 4274>. Analysis of this protein sequence reveals the following:

---

Possible site: 48
>>> Seems to have no N-terminal signal sequence
INTEGRAL    Likelihood = –3.03    Transmembrane 161-177 (161-178)
----- Final Results -----
  bacterial membrane --- Certainty = 0.2211 (Affirmative) <succ>
    bacterial outside --- Certainty = 0.0000 (Not Clear) <succ>
      bacterial cytoplasm --- Certainty = 0.0000 (Not Clear) <succ>

---

A related GBS nucleic acid sequence <SEQ ID 9777> which encodes amino acid sequence <SEQ ID 9778> was also identified.

The protein has homology with the following sequences in the GENPEPT database.

A related DNA sequence was identified in *S. pyogenes* <SEQ ID 4275> which encodes the amino acid sequence <SEQ ID 4276>. Analysis of this protein sequence reveals the following:

---

Possible site: 51
>>> Seems to have no N-terminal signal sequence
----- Final Results -----
  bacterial cytoplasm --- Certainty = 0.3502 (Affirmative) <succ>
    bacterial membrane --- Certainty = 0.0000 (Not Clear) <succ>
      bacterial outside --- Certainty = 0.0000 (Not Clear) <succ>

---

An alignment of the GAS and GBS proteins is shown below.

```
>GP:BAB04495 GB:AP001509 acetoin dehydrogenase (TPP-dependent) alpha
chain [Bacillus halodurans]
Identities = 148/317 (46%), Positives = 214/317 (66%), Gaps = 1/317 (0%)
Query:    8 LSKEQHLDMFLKMQRIRDVDMKENKLVRRGFVQGMTHFSVGEEAASVGAIQDLTDSDIIF  67
            +++++ +D+F +M   IR  + K ++    +G + G TH +VG+EA++VG+I  L + D +
Sbjct:   10 MTEKKLVDLFKQMWLIRYFEEKVDEFFAKGMIHGTTHLAVGQEASAVGSIAVLEERDKLT  69

Query:   68 SNHRGHGQTIAKGIDIGGMFAELAGKATGTSKGRGGSMHLANLEKGNYGTNGIVGGGYAL 127
            S HRGHG  IAKG D+  M AEL G+ TG  KG+GGSMH+A++E+GN G NGIVGGG+++
Sbjct:   70 STHRGHGHCIAKGADVNRMMAELFGRETGYCKGKGGSMHIADVERGNLGANGIVGGGFSI 129

Query:  128 AVGAALTQQYEGTDNIVIAFSGDSATNEGSFHESVNLAAVWNLPVIFFIINNRYGISTDI 187
            A GAALT + +      +V+ F GD A+NEGSFHE+VNLA++W LPV+F   NN+YG+S  +
Sbjct:  130 ATGAALTSKMKKEGYVVLCFFGDGASNEGSFHEAVNLASIWKLPVVFICENNQYGMSGSV 189

Query:  188 TYSTKIPHLYMRADAYGIPGHYVEDGNDLMAVYEKMHEVINYVRSGNGPAIVEVESYRWF 247
                 I H+  RA YGIPG  V DGND+ AV  +   ++  R G GP IVE ++YRW
Sbjct:  190 KEMINIEHISDRAAGYGIPG-MVVDGNDVFAVMNVVGRAVDRARRGEGPTIVEAKTYRWK 248

Query:  248 GHSTADAGVYRTKEEVDSWKAKDPVKRYRAYLIENEIATEEELAAIEAQVIKEVEEGVKF 307
            GHS +DA  YRT+EE   W+ KDP+ R RA L++  I TEEE +I+ +  +++E+ V+F
Sbjct:  249 GHSKSDAKKYRTREEEKEWREKDPIARLRATLVKEGIVTEEEADSIQEEAKQKIEDSVQF 308

Query:  308 AEEESPFPDMSVAFEDVF                                           324
            A  SP P++    EDV+
Sbjct:  309 ARNSPEPEIESLLEDVY                                            325
```

```
Identities = 244/326 (74%), Positives = 278/326 (84%)
Query:   1  MEVRMVTLSKEQHLDMFLKMQRIRDVDMKFNKLVRRGFVQGMTHFSVGEEAASVGAIQDL    60
            ME  MVT+SKEQHLDMELKM+RIR+ D + NKLVRRGFVQGMTHFSVGEEAA+VGA+  L
Sbjct:   1  MEAEMVTVSKEQHLDMELKMERIREFDSRINKLVRRGFVQGMTHFSVGEEAANVGAVHL    60

Query:  61  TDSDIIFSNHRGHGQTIAKGIDIGGMFAELAGKATGTSKGRGGSMHLANLEKGNYGTNGI   120
            +  DIIFSNHRGHGQ+IAK +D+  M AELAGKATG SKGRGGSMHLA+ EKGNYGTNGI
Sbjct:  61  SYDDIIFSNHRGHGQSIAKDMDLNKMMAELAGKATGVSKGRGGSMHLADFEKGNYGTNGI   120

Query: 121  VGGGYALAVGAALTQQYEGTDNIVIAFSGDSATNEGSFHESVNLAAVWNLPVIFFIINNR   180
            VGGGYALAVGAALTQQY+GT+NI +AFSGD ATNEGSFHESVN+AA W LPVIFFIINNR
Sbjct: 121  VGGGYALAVGAALTQQYKGTNNIAVAFSGDGATNEGSFHESVNMAATWKLPVIFFIINNR   180

Query: 181  YGISTDITYSTKIPHLYMRADAYGIPGHYVEDGNDLMAVYEKMHEVINYVRSGNGPAIVE   240
            YGIS  I  +T  PHLY RA+AYG+PG Y EDGND+MAVYE M + + +VR GNGPAIVE
Sbjct: 181  YGISMSINNATNTPHLYTRAEAYGVPGFYCEDGNDVMAVYETMGKAVEHVRGGNGPAIVE   240

Query: 241  VESYRWFGHSTADAGVYRTKEEVDSWKAKDPVKRYRAYLIENEIATEEELAAIEAQVIKE   300
            VESYRWFGHSTADAG YRTKEEVD WK KDP+ +YR YL    IAT++EL AI+AQV KE
Sbjct: 241  VESYRWFGHSTADAGKYRTKEEVDEWKEKDPMIKYRTYLTSEGIATDDELDAIQAQVKKE   300

Query: 301  VEEGVKFAEESPFPDMSVAFEDVFVD                                    326
            V++  +FA+ SP P++SVAFEDV+VD
Sbjct: 301  VDDAYEFAQNSPDPELSVAFEDVWVD                                    326
```

A related GBS gene <SEQ ID 8797> and protein <SEQ ID 8798> were also identified. Analysis of this protein sequence reveals the following:

Lipop: Possible site: −1 Crend: 10
McG: Discrim Score: −14.75
GvH: Signal Score (−7.5): −4.24
Possible site: 48
>>> Seems to have no N-terminal signal sequence
ALOM program   count: 1 value: −3.03 threshold: 0.0

-continued

INTEGRAL    Likelihood = −3.03   Transmembrane 161-177 (161-178)
PERIPHERAL  Likelihood = 3.55    117
modified ALOM score: 1.11
*** Reasoning Step: 3
----- Final Results -----
    bacterial membrane --- Certainty = 0.2211 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
ORF01791(298-1278 of 1578)
EGAD|108208|BS0806(3-327 of 333) acetoin dehydrogenase E1 component {Bacillus subtilis}
OMNI|NT01BS0951 acetoin:DCPIP oxidoreductase alpha subunit
GP|2780395|dbj|BAA24296.1||D78509 YfjK {Bacillus subtilis}
GP|2633130|emb|CAB12635.1||Z99108 acetoin dehydrogenase E1 component (TPP-dependent alpha
subunit) {Bacillus subtilis} GP|2957146|gb|AAC05582.1||AF006075 TPP-dependent acetoin
dehydrogenase, E1 alpha-subunit {Bacillus subtilis} PIR|D69581|D69581 acetoin dehydrogenase
E1 component (TPP-dependent alpha subuni) acoA-Ba
% Match = 26.3
% Identity = 45.3 % Similarity = 65.7
Matches = 148 Mismatches = 109 Conservative Sub.s = 67

231        261        291        321        351        381        411        441
         F*IEMPFTKTKKAVQILASCEKNLYNN*VIKIFLEVRMVTLSKEQHLDMFLKMQRIRDVDMKFNKLVRRGFVQGMTHFSV
                                        :|:     ::|::|:    | |:  ||    || :   | ::|    :| :  |  |:
                                        MKLLKREGLSLTEEKALWMYQKMLEIRGFEDKVHELFAQGVLPGFVHLYA
                                                 10         20         30         40         50

471        501        531        561        591        621        651        681
         GEEAASVGAIQDLTDSDIIFSNHRGHGQTIAKGIDIGGMFAELAGKATGTSKGRGGSMHLANLEKGNYGTNGIVGGGYAL
         ||||  :||    |  || |||||||| |||| | :|| |||:|||||| ||||||||||:||  |   || ||||| :|
         GEEAVAVGVCAHLHDGDSITSTHRGHGHCIAKGCDLDGMMAEIFGKATGLCKGKGGSMHIADLDKGMLGANGIVGGGFTL
                   60         70         80         90        100        110        120        130

711        741        771        801        831        861        891        921
         AVGAALTQQYEGTDNIVIAFSGDSATNEGSFHESVNLAAVWNLPVIFFIINNRYGISTDITYSTKIPHLYMRADAYGIPG
         | |:|||  :|:  | |: :  || | |:|||  :|||||||||:| || ||  ||   |: |::      || || :||
         ACGSALTAKYKQTKNVSVCFFGDGANNQGTFHEGLNLAAVWNLPVVFVAENNGYGEATPFEYASACDSIADRAAAYNMPG
                   140        150        160        170        180        190        200        210

951        981       1011       1041       1071       1098       1128       1158
         HYVEDGNDLMAVYEKMHEVINYVRSGNGPAIVEVESYRWFGHSTADAGVYRTKEE-VDSWKAKDPVKRYRAYLIENEIAT
             || |:|||     |  |  |:|  ||:::|      :||   ||     ||  |  : || :: ||::       |
         -VTVDGKDILAVYQAAEEAIERARNGGGPSLIECMTYRNYGHFEGDAQTYKTKDERVEHLEEKDAIQGFKNYLLKETDAN
                   220        230        240        250        260        270        280
```

-continued

```
1188       1218       1248       1278       1308       1338       1368       1398
EEELAAIEAQVIKEVEEGVKFAEESPFPDMSVAFEDVFVD*NNLK*MRFISFYYSID*KTDIRRK**AKLKLWLCAKRLM
 :|:  ||  :|  :  :|:  |  ||:||:|    |   :  ||:|
--KLSDIEQRVSESIEKAVSFSEDSPYPKDSELLTDVYVSYEKGGM
           300        310        320        330
```

SEQ ID 8798 (GBS403) was expressed in *E. coli* as a GST-fusion product. SDS-PAGE analysis of total cell extract is shown in FIG. 171 (lane 2; MW 64.4 kDa). It was also expressed in *E. coli* as a His-fusion product. SDS-PAGE analysis of total cell extract is shown in FIG. 76 (lane 4; MW 39.5 kDa).

GBS403-GST was purified as shown in FIG. 218, lane 6.

Based on this analysis, it was predicted that these proteins and their epitopes could be useful antigens for vaccines or diagnostics.

Example 1394

A DNA sequence (GBSx1479) was identified in *S. agalactiae* <SEQ ID 4277> which encodes the amino acid sequence <SEQ ID 4278>. This protein is predicted to be ABC transporter. Analysis of this protein sequence reveals the following:

```
Possible site: 22
>>> Seems to have no N-terminal signal sequence
----- Final Results -----
  bacterial cytoplasm --- Certainty = 0.2464 (Affirmative) <succ>
   bacterial membrane --- Certainty = 0.0000 (Not Clear) <succ>
    bacterial outside --- Certainty = 0.0000 (Not Clear) <succ>
```

A related GBS nucleic acid sequence <SEQ ID 9775> which encodes amino acid sequence <SEQ ID 9776> was also identified.

The protein has homology with the following sequences in the GENPEPT database.

```
>GP:CAB12414 GB:Z99107 similar to ABC transporter (ATP-binding
protein) [Bacillus subtilis]
Identities = 328/643 (51%), Positives = 443/643 (68%), Gaps = 9/643 (1%)
Query:    9 MIILQGNKIERSFSGDVLFDNINIQVDQRDRIALVGRNGAGKSTLLKILVGEEAPTKGEI    68
            M+ILQ N++ +SF  D + +NI ++V RDRIA+VGRNGAGKSTLLKI+ G+ + KGEI
Sbjct:    1 MMILQANQLSKSFGADTILNNIKLEVRNRDRIAIVGRNGAGKSTLLKIIAGQLSYEKGEI    60

Query:   69 NKKRDLSLSYLAQDSRFQSENTIFQEMLQVFDSLREVEKRLRELELQMGQVSGSDLEQLM   128
            K +D+++ YLAQ +   S+ TI +E+L VFD L+ +EK +R +E +M      +LE +M
Sbjct:   61 IKPIDITMGYLAQHTGLDSKLTIKEELLTVEDHLKAMEKEMRAMEEKMAAADPGELESIM   120

Query:  129 KTYDILSEEFREKGGFTYESDIKAILNGFKFNSDMWEMPISELSGGQNTRLALAKMLLEK   188
            KTYD L +EF++KGG+ YE+D++++L+G  F+        + LSGGQ TRLAL K+LL +
Sbjct:  121 KTYDRLQQEFKDKGGYQYEADVRSVLHGLGFSHFDDSTQVQSLSGGQKTRLALGKLLLTQ   180

Query:  189 PELLVLDEPTNHLDIDTIAWLENYLVNYQGALIIVSHDRYFLDKVATVTYDLTTHSLDRY   248
            P+LL+LDEPTNHLDIDT+  WLE+YL  Y GA++IVSHDRYFLDKV      Y+++    +Y
Sbjct:  181 PDLLILDEPTNHLDIDTLTWLEHYLQGYSGAILIVSHDRYFLDKVVNQVYEVSRAESKKY   240

Query:  249 VGNYSKFMDLKAEKIATEEKNFEKQQKEIAKLEDFVQRNIVRASTTKRAQARRKQLEKME   308
             GNYS ++D KA  +   K +EKQQ EIAKL+DFV RN+ RASTTKRAQ+RRKQLE+M+
Sbjct:  241 HGNYSAYLDQKAAQYEKDLKMYEKQQDEIAKLQDFVDRNLARASTTKRAQSRRKQLERMD   300

Query:  309 RLDKPNVEQKSANMTFHAGKVSGNVVLTLENAAIGYEG-VSLSEPIDLDVKKFDAIAIVG   367
             + KP  ++KSAN F   K SGN VL +++  I YE   L   +   + ++ A+VG
Sbjct:  301 VMSKPLGDEKSANFHFDITKQSGNEVLRVQDLTISYENQPPLLTEVSFMLTRGESAALVG   360

Query:  368 PNGIGKSTLIKSLVGQIPFIKGEAKLGANVETGYYDQSQSNLTKTNTVLDELWDAFSTTP   427
            PNGIGKSTL+K+L+ +    +G    G+NV  GYYDQ Q+ LT +  VLDELWD + P
Sbjct:  361 PNGIGKSTLLKTLIDTLKPDQGTISYGSNVSVGYYDQEQAELTSSKRVLDELWDEYPGLP   420

Query:  428 EVEIRNRLGAFLFSGDDVKKSVSMLSGGERARLLLAKLSMENNNFLILDEPTNHLDIDSK   487
            E EIR  LG FLFSGDDV K V  LSGGE+ARL LAKL ++  NFLILDEPTNHLD+DSK
Sbjct:  421 EKEIRTCLGNFLFSGDDVLKPVHSLSGGEKARLALAKLMLQKANFLILDEPTNHLDLDSK   480

Query:  488 EVLENALIEFDGTLLFVSHDRYFINRVATKVLEISDKGSTLYLGDYDYYLTKKAELEELA   547
            EVLENALI++  GTLLFVSHDRYFINR+AT+VLE+S         YLGDYDYY  KK E  EL
Sbjct:  481 EVLENALIDYPGTLLFVSHDRYFINRIATRVLELSSSHIEEYLGDYYTEKKTEQLELE   540

Query:  548 RLNEEEVSASKTEIDVTSD----YETQKANQKEFRKITRRVVEIEARLEVLENDENNING   603
             ++N++E    KT   V SD    YE +K   +K+ R+   RR+ EIE   ++ +E + +  +
Sbjct:  541 KMNQQE-ETDKTPATVKSDSKRSYEEEKEWKKKERQRLRRIEEIETTVQTIEENISRNDE   599

Query:  604 LMLET---NDIGKLSDLQKELESIQEEQLLLMEEWENLNMRLD                   643
            L+ +      D  K+ +   + E + +E   L+ EWE L+     D
Sbjct:  600 LLCDPEVYQDHEKVQAIHADNEKLNQELESLLSEWEELSTEED                   642
```

A related DNA sequence was identified in *S. pyogenes* <SEQ ID 4279> which encodes the amino acid sequence <SEQ ID 4280>. Analysis of this protein sequence reveals the following:

Possible site: 56
>>> Seems to have no N-terminal signal sequence
----- Final Results -----
   bacterial cytoplasm --- Certainty = 0.2042 (Affirmative) <succ>
     bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 473/635 (74%), Positives = 545/635 (85%), Gaps = 1/635 (0%)
Query:   9 MIILQGNKIERSFSGDVLFDNINIQVDQRDRIALVGRNGAGKSTLLKILVGEEAPTKGEI  68
           MIILQGNK+ERSFSGDVLF NI++QVD+RDRIALVG NGAGKSTLLK+LVGEE PT GE+
Sbjct:   1 MIILQGNKLERSFSGDVLFQNISLQVDERDRIALVGPNGAGKSTLLKLLVGEETPTSGEV  60

Query:  69 NKKRDLSLSYLAQDSRFQSENTIFQEMLQVFDSLREVEKRLRELELQMGQVSGSDLEQLM  128
           N K+DL+LSYLAQ+SRF+S+ TI++EML+VF++LR+ EKRLR++E+ M  VSG  L +LM
Sbjct:  61 NTKKDLTLSYLAQNSRFESDQTIYEEMLKVFEALRQDEKRLRQMEMDMATVSGQVLTRLM  120

Query: 129 KTYDILSEEFREKGGFTYESDIKAILNGFKFNSDMWEMPISELSGGQNTRLALAKMLLEK  188
              YD+L+E FR++GGFTYESDIKAILNGFKF+  MW+M I+ELSGGQNTRLALAKMLLEK
Sbjct: 121 TDYDLLTEHFRQQGGFTYESDIKAILNGFKFDESMWQMTIAELSGGQNTRLALAKMLLEK  180

Query: 189 PELLVLDEPTNHLDIDTIAWLENYLVNYQGALIIVSHDRYFLDKVATVTYDLTTHSLDRY  248
           PELLVLDEPTNHLDI+TIAWLENYL NYQGALIIVSHDRYFLDKVATVT DLT + LDRY
Sbjct: 181 PELLVLDEPTNHLDIETIAWLENYLANYQGALIIVSHDRYFLDKVATVTLDLTPNGLDRY  240

Query: 249 VGNYSKFMDLKAEKIATEEKNFEKQQKEIAKLEDFVQRNIVRASTTKRAQARRKQLEKME  308
            GNYS+FM LKAEK+  EEK F+KQQKEIAKLEDFVQ+NIVRASTTKRAQARRKQLEK+E
Sbjct: 241 SGNYSRFMALKAEKLVAEEKQFDKQQKEIAKLEDFVQKNIVRASTTKRAQARRKQLEKIE  300

Query: 309 RLDKPNVEQKSANMTFHAGKVSGNVVLTLENAAIGYEGVSLSEPIDLDVKKFDAIAIVGP  368
           RLDKP  +KSA+MTFHA K SGNVVL +E AAIGY    LSEPI++D+ K DAIA+VGP
Sbjct: 301 RLDKPTGGRKSAHMTFHAEKPSGNVVLRVEEAAIGYGDQVLSEPINVDINKLDAIAVVGP  360

Query: 369 NGIGKSTLIKSLVGQIPFIKGEAKLGANVETGYYDQSQSNLTKTNTVLDELWDAFSTTPE  428
           NGIGKSTLIKS++GQ+P +KG+ K GANVETGYYDQ+QS+LT +NTVL+ELW FSTTPE
Sbjct: 361 NGIGKSTLIKSIIGQLPLLKGQLKYGANVETGYYDQTQSHLTSSNTVLEELWQDFSTTPE  420

Query: 429 VEIRNRLGAFLFSGDDVKKSVSMLSGGERARLLLAKLSMENNNFLILDEPTNHLDIDSKE  488
           V+IRNRLGAFLFSGDDVKKSV+MLSGGE+ARLLLAKLSMENNNFL+LDEPTNHLDIDSKE
Sbjct: 421 VDIRNRLGAFLFSGDDVKKSVAMLSGGEKARLLLAKLSMENNNFLVLDEPTNHLDIDSKE  480

Query: 489 VLENALIEFDGTLLFVSHDRYFINRVATKVLEISDKGSTLYLGDYDYYLTKKAELEELAR  548
           VLENALI+FDGTLLFVSHDRYFINR+ATKVLEI++ GSTLYLGDYDYYL KKAELEELAR
Sbjct: 481 VLENALIDFDGTLLEVSHDRYFINRLATKVLEITENGSTLYLGDYDYYLEKKAELEELAR  540

Query: 549 LNEEEVSASKTEIDVTSDYETQKANQKEFRKITRRVVEIEARLEVLENDENNINGLMLET  608
           L  E    E   T DY+ QKANQKE R++TRR  EIEARLE +E    I    M   +
Sbjct: 541 LAAGETVEETKEASAT-DYQLQKANQKERRRLTRRYEEIEARLETIEERIGAIQEDMHAS  599

Query: 609 NDIGKLSDLQKELESIQEEQLLLMEEWENLNMRLD                          643
           ND  +L   QKE + + +EQ  LMEEWE +   +++
Sbjct: 600 NDTAQLIAWQKEWDQLDQEQEALMEEWETIAEQIE                          634
```

Based on this analysis, it was predicted that these proteins and their epitopes could be useful antigens for vaccines or diagnostics.

Example 1395

A DNA sequence (GBSx1480) was identified in *S. agalactiae* <SEQ ID 4281> which encodes the amino acid sequence <SEQ ID 4282>. This protein is predicted to be thiophene degradation protein F (thdF). Analysis of this protein sequence reveals the following:

Possible site: 22
>>> Seems to have no N-terminal signal sequence
----- Final Results -----
   bacterial cytoplasm --- Certainty = 0.0876 (Affirmative) <succ>
     bacterial membrane --- Certainty = 0.0000 (Not Clear) <succ>
      bacterial outside --- Certainty = 0.0000 (Not Clear) <succ>

A related GBS nucleic acid sequence <SEQ ID 9773> which encodes amino acid sequence <SEQ ID 9774> was also identified.

A related DNA sequence was identified in *S. pyogenes* <SEQ ID 4283> which encodes the amino acid sequence <SEQ ID 4284>. Analysis of this protein sequence reveals the following:

Possible site: 34
>>> Seems to have no N-terminal signal sequence
----- Final Results -----
   bacterial cytoplasm --- Certainty = 0.0795 (Affirmative) <succ>
     bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 384/458 (83%), Positives = 427/458 (92%)
Query:  12 MSITKEFDTIAAISTPLGEGAIGIVRISGTDALKIASKIYRGKDLSAIQSHTLNYGHIVD   71
           MSITKEFDTI AISTPLGEGAIGIVR+SGTDAL IA   +++GKI+L + SHT+NYGHI++
Sbjct:   1 MSITKEFDTITAISTPLGEGAIGIVRLSGTDALAIAQSVFKGKNLEQVASHTINYGHIIN   60

Query:  72 PDKNEILDEVMLGVMLAPKTFTREDVIEINTHGGIAVTNEILQLILRHGARMAEPGEFTK  131
           P    I+DEVM+ VMLAPKTFTRE+V EINTHGGIAVTNEILQL++R GARMAEPGEFTK
Sbjct:  61 PKTGTIIDEVMVSVMLAPKTFTRENVVEINTHGGIAVTNEILQLLIRQGARMAEPGEFTK  120

Query: 132 RAFLNGRVDLTQAEAVMDLIRAKTDKAMDIAVKQLDGSLKTLINNTRQEILNTLAQVEVN  191
           RAFLNGRVDLTQAEAVMD+IRAKTDKAM IAVKQLDGSL  LIN+TRQEILNTLAQVEVN
Sbjct: 121 RAFLNGRVDLTQAEAVMDIIRAKTDKAMTIAVKQLDGSLSQLINDTRQEILNTLAQVEVN  180

Query: 192 IDYPEYDDVEEMTTTLMREKTQEFQALMENLLRTARRGKILREGLSTAIIGRPNVGKSSL  251
           IDYPEYDDVEEMTT L+REKTQEFQ+L+E+LLRTA+RGKILREGLSTAIIGRPNVGKSSL
Sbjct: 181 IDYPEYDDVEEMTTALLREKTQEFQSLLESLLRTAKRGKILREGLSTAIIGRPNVGKSSL  240

Query: 252 LNNLLREEKAIVTDIEGTTRDVIEEYVNIKGVPLKLVDTAGIRDTDDIVEKIGVERSKKA  311
           LNNLLRE+KAIVTDI GTIRDVIEEYVNIKGVPLKLVDTAGIR+TDD+VE+IGVERSKKA
Sbjct: 241 LNNLLREDKAIVTDIAGTTRDVIEEYVNIKGVPLKLVDTAGIRETDDLVEQIGVERSKKA  300

Query: 312 LEEADLVLLVLNSSEPLTLQDRSLLELSKESNRIVLLNKTDLPQKIEVNELPKNVIPISV  371
           L+EADLVLLVLN+SE LT QDR+LL LS++SNRI+LLNKTDL QKIE+ +LP + IPISV
Sbjct: 301 LQEADLVLLVLNASEKLTDQDRALLNLSQDSNRIILLNKTDLEQKIELEQLPDDYIPISV  360

Query: 372 LENENIDKIEERINDIFFDNAGMVEHDATYLSNARHISLIEKAVDSLKAVNEGLELGMPV  431
           L N+NI+ IE+RIN +FFDNAG+VE DATYLSNARHISLIEKAV SL+AVN+GL LGMPV
Sbjct: 361 LTNQNINLIEDRINQLFFDNAGLVEQDATYLSNARHISLIEKAVQSLEAVNDGLALGMPV  420

Query: 432 DLLQVDMTRTWEILGEITGDAAPDELITQLFSQFCLGK                       469
           DLLQVD+TRTWEILGEITGDAAPDELITQLFSQFCLGK
Sbjct: 421 DLLQVDLTRTWEILGEITGDAAPDELITQLFSQFCLGK                       458
```

Based on this analysis, it was predicted that these proteins and their epitopes could be useful antigens for vaccines or diagnostics.

Example 1396

A DNA sequence (GBSx1481) was identified in *S. agalactiae* <SEQ ID 4285> which encodes the amino acid sequence <SEQ ID 4286>. Analysis of this protein sequence reveals the following:

Possible site: 41
>>> Seems to have no N-terminal signal sequence
INTEGRAL    Likelihood = –9.18    Transmembrane 280-296 (276-299)

-continued

INTEGRAL    Likelihood = –4.83    Transmembrane 249-265 (243-266)
----- Final Results -----
bacterial membrane --- Certainty = 0.4673 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the GENPEPT database.

```
>GP:AAD40365 GB:AF036485 hypothetical protein [Plasmid pNZ4000]
Identities = 88/306 (28%), Positives = 149/306 (47%), Gaps = 17/306 (5%)
Query:   1 MIVEQKFGNGFTWIN---IEAEQLRTETSEIQAKY-LDSEIITYALDDYERAFMECSHIK   56
           MI  +K NG  WI    I AE+  T    ++ +Y +D +II Y  D+ E        I
Sbjct:   1 MIKPEKTINGTKWIETIQINAEERAT----LEDQYGIDEDIIEYVTDNDESTNYVYD-IN   55

Query:  57 GKEVLTIIFNTIDLKQKESYYETVPMTFCLSHDRLITVTRSRNSYMLELLQKYLDRNPDV  116
           + L I    L+   +   Y T P    L    L T  +S   +   L      LD NP+V
Sbjct:  56 EDDQLFIFLAPYALDKDALRYITQPFGMLLHKGVLFTFNQSGIPEVNTALYSALD-NPEV  114

Query: 117 -SPKKFLFAALTLITKQYFNVVSKIDREKDILNRQLREQTTNKRLLAMSDLETGSVYLLT  175
            S    F+  L  +  +    I  ++++ L  +T N  L+++S L+     +L +
Sbjct: 115 KSVDAFILETLFTVVVSFIPISRAITKKRNYLDKMLNRKTKNSDLVSLSYLQQTLTFLSS  174

Query: 176 AANQNALVLEQLDVHPSQRFNSEVEKEQLS---DALIEAHQLVSMTQLNSQVLSQLSSTF  232
           A    N   L +LD  P    F        +++++  D   IE   Q+  M     +QV+  ++  T
Sbjct: 175 AVQTN---LSELDRLPKTHFGVGADQDKIDLFEDVQIEGEQVQRMFEIETQVVDRIDHTL  231

Query: 233 NNVLNNNLNENLTGLNIISINLAIIAAITGFFGMNIPLPLTESRSSWLIVIATSVLLWVI  292
           N++ NNNLN+ +  L  I S+ +A+    I+GF+GMN+ LPL   +W++ +   SV+L V
Sbjct: 232 NSLANNNLNDTMKFLTIWSLTMAVPTIISGFYGMNVKLPLAGMQYAWMLTLGISVVLIVA  291

Query: 293 IAQILK                                                       298
           +  +LK
Sbjct: 292 MLIMLK                                                       297
```

Based on this analysis, it was predicted that this protein and its epitopes, could be useful antigens for vaccines or diagnostics.

Example 1397

A DNA sequence (GBSx1482) was identified in *S. agalactiae* <SEQ ID 4287> which encodes the amino acid sequence <SEQ ID 4288>. Analysis of this protein sequence reveals the following:

```
Possible site: 38
>>> Seems to have no N-terminal signal sequence
----- Final Results -----
    bacterial cytoplasm --- Certainty = 0.1437 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1398

A DNA sequence (GBSx1483) was identified in *S. agalactiae* <SEQ ID 4289> which encodes the amino acid sequence <SEQ ID 4290>. This protein is predicted to be exonuclease RexA. Analysis of this protein sequence reveals the following:

```
Possible site: 52
>>> Seems to have no N-terminal signal sequence
----- Final Results -----
    bacterial cytoplasm --- Certainty = 0.3165 (Affirmative) <succ>
    bacterial membrane --- Certainty = 0.0000 (Not Clear) <succ>
    bacterial outside --- Certainty = 0.0000 (Not Clear) <succ>
```

A related GBS nucleic acid sequence <SEQ ID 9771> which encodes amino acid sequence <SEQ ID 9772> was also identified.

The protein has homology with the following sequences in the GENPEPT database.

```
>GP:AAC12966 GB:U76424 exonuclease RexA [Lactococcus lactis]
Identities = 522/1211 (43%), Positives = 747/1211 (61%), Gaps = 73/1211 (6%)
Query:    28 KRTPEQIEAIYTFGNNVLVSASAGSGKTFVMVERILDKLLRGVPIDSLFISTFTVKAAGE    87
             K TPEQ EAI++ G N+LVSASAGSGKTFVM +RI++K+ +G+ ID LFISTFT KAA E
Sbjct:     5 KLTPEQNEAIHSSGKNILVSASAGSGKTFVMAQRIVEKVKQGIEIDRLFISTFTKKAASE   64

Query:    88 LKERLEKKINESLKSAESDDLKQFLTQQLVGIQTADIGTMDAFTQKIVNQYGYTLGISPI  147
             L+ RLE+ + ++ + + D+    LT L + ADIGTMD+FTQK+      + I P
Sbjct:    65 LRMRLERDLKKARQESSDDEEAHRLTLALQNLSNADIGTMDSFTQKLTKANFNRVNIDPN  124

Query:   148 FRILQDKNEQDVIKNEVYADLFSDYMTGKNAAS-----FIKLVKNFSGNRKDSKAFREMV  202
             FRIL D+ E D+I+ EV+ L  Y++   + +     F KL+KNFS +R +   F+++V
Sbjct:   125 FRILADQTESDLIRQEVFEQLVESYLSADESLNISKDKFEKLIKNFSKDR-NILGFQKVV  183

Query:   203 YKVYAFSQSTDNPKRWMQTVFLKGAQTYTDFEAIPDQEVSSLLNVMQT--TANQLRDLTD  260
             Y +Y F+ +T+NP  W++  FLKG +TY +++ D     +NV + T +L +
Sbjct:   184 YTIYRFASATENPISWLENQFLKGFETY---KSLTDLSEDFTVNVKENLLTFFELLEAIS  240

Query:   261 QEDYKQLTAKGVPTANYKKHLKIIENL-VHWSQDFNLLYGKKGLTNLARDITNVIPSGND  319
             ++D+   TA          L I  ++ V  S+D L   KK +   +D+
Sbjct:   241 KKDFVTCTAL---------FLSIDTDIRVGSSKDEALSALKKDFSAQKQDL---------  282

Query:   320 VTVAGVKYPIFKQLHNRIVGLKHLEVIFKYQGESLFLLELLQSFVLDFSEQYLQEKIQEN  379
             V    P   +L   + +KH ++I KYQ ++ +   LQ F++DF + YL+ K  EN
Sbjct:   283 --VGSKSKP--GELRKFVDKIKHGQLIEKYQNQAFEIASDLQKFIIDFYKTYLERKKNEN  338

Query:   380 AFEFSDIAHFAIQILEENHDIRQLYQDKYHEVMVDEYQDNNHTQERMLELLSNGHNRFMV  439
             AFE+SDIAHFAI+ILEEN DIR+   ++ Y E+M+DEYQD +HTQERMLELLSNGHN FMV
Sbjct:   339 AFEYSDIAHFAIEILEENPDIRENLREHYDEIMIDEYQDTSHTQERMLELLSNGHNLFMV  398

Query:   440 GDIKQSIYRFRQADPQIFNDKYKAYQDNPSQGKLIILKENFRSQSEVLDSTNSVFTHLMD  499
             GDIKQSIY FR ADP +F +KYK+Y   +  +LI LKENFRS+ EVL+ TN +F HLMD
Sbjct:   399 GDIKQSIYGFRLADPGLFLEKYKSYDQAENPNQLIRLKENFRSRGEVLNFTNDIFKHLMD  458

Query:   500 EEVGDILYDESHQLKAGS----PRQQERHPNNKTQVLLLDTDEDDIDDSDSQQYDISPAE  555
             E++G++ Y +   L  G+    P + E+     +   +T E++I+DS+ +   IS E
Sbjct:   459 EKLGEMTYGKEEALVQGNISDYPVEAEKDFYPELLLYKENTSEEEIEDSEVK---ISDGE  515

Query:   556 AKLVAKEIIRLHKEENVPFQDITLLVSSRTRNDGILQTFDRYGIPLVTDGGEQNYLKSVE  615
             K  A+EI +L  E V  +DI +LV S++ N+ I    Y IP+V D G  ++LKS+E
Sbjct:   516 IKGAAQEIKKL-IEYGVEPKDIAILVRSKSNNNKIEDILLSYDIPVVLDEGRVDFLKSME  574

Query:   616 VMVMLDTLRSIDNPLNDYALVALLRSPMFGFNEDDLTRIAIQDVK-MAFYHKVKLSYHKE  674
             V++MLD LR+IDNPL D +LVA+LRSP+FGFNED+LTRI++Q + + F+ K+ LS  KE
Sbjct:   575 VLIMLDVLRAIDNPLYDLSLVAMLRSPLFGFNEDELTRISVQGSRDLRFWDKILLSLKKE  634

Query:   675 GHHSDLITPELSSKIDHFMKTFQTWRDFAKWHSLYDLIWKIYNDRFYYDYVGALPKAEQR  734
             G + +LI   L  K+  F + F  WR     ++ L+WKIY  +Y+DYVGAL   E R
Sbjct:   635 GKNPELINLSLEQKLKAFNQKFTEWRKLVNKIPIHRLLWKIYTETYYFDYVGALKNGEMR  694
```

```
Query:  735 QANLYALALRANQFEKTGFKGLSRFIRMIDKVLENENDLADVEVALPQNAVNLMTIHKSK   794
             QANL AL++RA  +E +G+KGL +F+R+I+K +E  NDLA V + LPQNAV +MT HKSK
Sbjct:  695 QANLQALSVRAESYESSGYKGLFKFVRLINKFMEQNNDLASVNIKLPQNAVRVMTFHKSK   754

Query:  795 GLEFKYVFILMIDKKFSMVDITSPLILSRNQGIGIKYVADMRHELEE-EILPAVKVSMET   853
             GLEF YVF++M+  +F+  D+    +ILSR  G+G+KY+AD++ E +       P   V MET
Sbjct:  755 GLEFDYVFLMNLQSRFNDRDLKEDVILSREHGLGMKYIADLKAEPDVITDFPYALVKMET   814

Query:  854 LPYQLNKRELRLATLSEQMRLLYVAMTRAEKKLYLVGKASQT---KWADHYDLVS-ENNH   909
              PY +NK   + A LSE+MR+LYVA TRA++KKLYLVGK   T      + YD   + E
Sbjct:  815 FPYMVNKDLKQRAALSEEMRVLYVAFTRAKKKLYLVGKIKDTDKKAGLELYDAATLEGKI   874

Query:  910 LPLASRETFVTFQDWLLAVHETYKKQELFYDINFVSLEELTDHHIGMVNPSLPFNPDNK-   968
             L    R +   FQ W+LA+    K    L    +N + +EL         +     PD K
Sbjct:  875 LSDKFRNSSRGFQHWILALQNATK---LPMKLNVYTKDELETEKLEFTS-----QPDFKK   926

Query:  969 -VENRQSEDIVRAIS--VLESVEQINQTY--KAAIELPTVRTPSQVKK-IYEPILDIEGV  1022
              VE  +  D + + S   + E+ + +N   Y    +AA EL +++TPSQVKK   YE  L +   V
Sbjct:  927 LVEESEKFDNIMSFSDEIKEAQKIMNYQYPHQAATELSSIQTPSQVKKRSYEKQLQVGEV   986

Query: 1023 D-VMETITKTSVDFKLPDFSTSKKQDPAALGSAVHELMQRIEMSSHVKMEDIQKALTEVN  1081
              V E +    ++DF   DF    KK   A  +GSA H  MQ   +  S    +   Q  L E+
Sbjct:  987 QPVSEFVRVKNLDFS--DFG-PKKITAAEMGSATHSFMQYADF-SQADLFSFQATLDEMG  1042

Query: 1082 AETSVKAAIQIEKINYFFQETSLGKYIQEEVEHLHREAPFAMLKEDPESGEKFVVRGIID  1141
              +   +K   I  I KI    F +T  G+++  E V+   +EAPF+ML+ D  +  E+++VRGI D
Sbjct: 1043 FDEKIKNQIDITKILTLF-DTEFGQFLSENVDKTVKEAPFSMLRTDEFAKEQYIVRGICD  1101

Query: 1142 GYLLLENRIILFDYKTDKFVNP---LELKERYQGQMALYAEALKKSYEIEKIDKYLILLG  1198
              G++  L  ++IILFDYKTD+F N       E+KERY+ QM LY+EAL+K+Y  +IDKYLILLG
Sbjct: 1102 GFVKLADKIILFDYKTDRFTNVSAISEIKERYKDQMNLYSEALQKAYHVNQIDKYLILLG  1161

Query: 1199 G-KQLEVVKMD                                                 1208
              G +++ V K+D
Sbjct: 1162 GPRKVFVEKID                                                 1172
```

A related DNA sequence was identified in *S. pyogenes* <SEQ ID 4291> which encodes the amino acid sequence <SEQ ID 4292>. Analysis of this protein sequence reveals the following:

Possible site: 61
>>> Seems to have an uncleavable N-term signal seq

----- Final Results -----
bacterial membrane --- Certainty = 0.0000 (Not Clear) <succ>
bacterial outside --- Certainty = 0.0000 (Not Clear) <succ>
bacterial cytoplasm --- Certainty = 0.0000 (Not Clear) <succ>

The protein has homology with the following sequences in the databases:

```
>GP:AAC12966 GB:U76424 exonuclease RexA [Lactococcus lactis]
Identities = 478/1206 (39%), Positives = 700/1206 (57%), Gaps = 65/1206 (5%)
Query:   40 KRTAQQIEAIYTSGQNILVSASAGSGKTFVMVERILDKILRGVSIDRLFISTFTVKAATE    99
             K T +Q EAI++SG+NILVSASAGSGKTFVM +RI++K+ +G+ IDRLFISTFTKAA+E
Sbjct:    5 KLTPEQNEAIHSSGKNILVSASAGSGKTFVMAQRIVEKVKQGIEIDRLFISTFTKKAASE    64

Query:  100 LRERIENKLYSQIAQTTDFQMKVYLTEQLQSLCQADIGTMDAFAQKVVSRYGYSIGISSQ   159
             LR R+E  L   +++D +    LT  LQ+L   ADIGTMD+F QK+      + I
Sbjct:   65 LRMRLERDLKKARQESSDDEEAHRLTLALQNLSNADIGTMDSFTQKLTKANFNRVNIDPN   124

Query:  160 FRIMQDKAEQDVLKQEVFSKLFNEFMNQKEA-----PVFRALVKNFSGNCKDTSAFRELV   214
             FRI+ D+ E D+++QEVF +L   +++  E+       F  L+KNFS +++    F+++V
Sbjct:  125 FRILADQTESDLIRQEVFEQLVESYLSADESLNISKDKFEKLIKNFSKD-RNILGFQKVV   183

Query:  215 YTCYSFSQSTENPKIWLQENFLSAAKTYQRLEDIPDHDIELLLLAMQDTANQLRDVTDME   274
             YT Y F+ +TENP  WL+  FL    +TY+ L D+ +   + +        T  +L +     +
Sbjct:  184 YTIYRFASATENPISWLENQFLKGFETYKSLTDLSE-DFTVNVKENLLTFFELLEAISKK   242

Query:  275 DYGQLTKAG-SRSAKYTKHLTIIEKLSDWVRDFKCLYGKAGLDRLIRDVTGLIPSGNDVT   333
              D+  T       S          +  E LS  +DF                       D+
Sbjct:  243 DFVTCTALFLSIDTDIRVGSSKDEALSALKKDFSA------------------QKQDLV   283

Query:  334 VSKVKYPVFKTLHQKLKQFRHLETILMYQKDCFSLLEQLQDFVLAFSEAYLAVKIQESAF   393
              +SK K   +      K+K   H + I  YQ     F +   LQ F++  F + YL K    E+AF
Sbjct:  284 GSKSKPGELRKFVDKIK---HGQLIEKYQNQAFEIASDLQKFIIDFYKTYLERKKNENAF   340

Query:  394 EFSDIAHFAIKILEENTDIRQSYQQHYHEVMVDEYQDNNHMQERLLTLLSNGHNRFMVGD   453
             E+SDIAHFAI+ILEEN DIR++ ++HY E+M+DEYQD +H QER+L LLSNGHN FMVGD
Sbjct:  341 EYSDIAHFAIEILEENPDIRENLREHYDEIMIDEYQDTSHTQERMLELLSNGHNLFMVGD   400
```

```
-continued
Query:  454  IKQSIYRFRQADPQIFNQKFRDYQKKPEQGKVILLKENFRSQSEVLNVSNAVFSHLMDES  513
             IKQSIY FR ADP +F +K++ Y +     ++I LKENFRS+ EVLN +N +F HLMDE
Sbjct:  401  IKQSIYGFRLADPGLFLEKYKSYDQAENPNQLIRLKENFRSRGEVLNFTNDIFKHLMDEK  460

Query:  514  VGDVLYDEQHQLIAG--SHAQTVPYLDRRAQLLLYNSDKDDGNAPSDSEGISFSEVTIVA  571
             +G++ Y ++ L+ G  S           D  +LLLY + +           IS  E+  A
Sbjct:  461  LGEMTYGKEEALVQGNISDYPVEAEKDFYPELLLYKENTSEEEIEDSEVKISDGEIKGAA  520

Query:  572  KEIIKLHNDKGVPFEDITLLVSSRTRNDIISHTFNQYGIPIATDGGQQNYLKSVEVMVML  631
             +EI KL + GV +DI +LV S++ N+ I        Y IP+  D G+ ++LKS+EV++ML
Sbjct:  521  QEIKKL-IEYGVEPKDIAILVRSKSNNNKIEDILLSYDIPVVLDEGRVDFLKSMEVLIML  579

Query:  632  DTLRTINNPRNDYALVALLRSPMFAFDEDDLARIALQKDNELDKDCLYDKIQRAVIGRGA  691
             D LR I+NP D +LVA+LRSP+F +ED+L RI++Q    +L    +DKI ++      G
Sbjct:  580  DVLRAIDNPLYDLSLVAMLRSPLFGFNEDELTRISVQGSRDLR---FWDKILLSLKKEGK  636

Query:  692  HPELIHDTLLGKLNVFLKTLKSWRRYAKLGSLYDLIWKIFNDRFYFDFVASQAKAEQAQA  751
             +PELI+ +L  KL  F +    WR+      ++ L+WKI+ +YFD+V +     E QA
Sbjct:  637  NPELINLSLEQKLKAFNQKFTEWRKLVNKIPIHRLLWKIYTETYYFDYVGALKNGEMRQA  696

Query:  752  NLYALALRANQFEKSGYKGLYRFIKMIDKVLETQNDLADVEVATPKQAVNLMTIHKSKGL  811
             NL AL++RA  +E SGYKGL++F+++I+K +E   NDLA V +   P+ AV +MT HKSKGL
Sbjct:  697  NLQALSVRAESYESSGYKGLFKFVRLINKFMEQNNDLASVNIKLPQNAVRVMTFHKSKGL  756

Query:  812  QFPYVFILNCDKRFSMTDIHKSFILNRQHGIGIKYLADIKGLLGE-TTLNSVKVSMETLP  870
             +F YVF++N   RF+  D+ + IL+R+HG+G+KY+AD+K      T    V  MET P
Sbjct:  757  EFDYVFLMNLQSRFNDRDLKEDVILSREHGLGMKYIADLKAEPDVITDFPYALVKMETFP  816

Query:  871  YQLNKQELRLATLSEEMRLLYVAMTRAEKKVYFIGK---ASKSKSQEITDPKKL-GKLLP  926
             Y +NK +  A LSEEMR+LYVA TRA+KK+Y +GK    K     E+ D    L GK+L
Sbjct:  817  YMVNKDLKQRAALSEEMRVLYVAFTRAKKKLYLVGKIKDTDKKAGLELYDAATLEGKILS  876

Query:  927  LALREQLLTFQDWLLAIADIFSTEDLYEDVRFIEDSDLTQESVGRLQTP---QLLNPDDL  983
                  R   FQ W+LA+ +   L +      +L E+     P    +L+   +
Sbjct:  877  DKFRNSSRGFQHWILALQ---NATKLPMKLNVYTKDELETEKLEFTSQPDFKKLVEESEK  933

Query:  984  KDNRQSETIARALDMLEAVSQLNANY--EAAIHLPTVRTPSQL-KATYEPLLEPIGVDII  1040
              DN   S +      ++ EA +N Y  +AA L +++TPSQ+ K +YE L+   V    +
Sbjct:  934  FDNIMSFSD----EIKEAQKIMNYQYPHQAATELSSIQTPSQVKKRSYEKQLQVGEVQPV  989

Query: 1041  EKSSRSLSDFTLPHFSKKAKVEASHIGSALHQLMQVLPLSKP--INQQTLLDALRGIDSN  1098
              + R + +    F  K K+ A+ +GSA H  MQ     S+    + Q  LD + G D
Sbjct:  990  SEFVR-VKNLDFSDFGPK-KITAAEMGSATHSFMQYADFSQADLFSFQATLDEM-GFD--  1044

Query: 1099  EEVKTALDLKKIESFFCDTSLGQFFQTYQKHLYREAPFAILKLDPISQEEYVLRGIIDAY  1158
             E++K +D+ KI + F DT GQF          +EAPF++L+ D +++EY++RGI D +
Sbjct: 1045  EKIKNQIDITKILTLF-DTEFGQFLSENVDKTVKEAPFSMLRTDEFAKEQYIVRGICDGF  1103

Query: 1159  FLFDDHIVLVDYKTDKYKQP---IELKKRYQQQLELYAEALTQTYKLPVTKRYLVLMGGG  1215
                 D  I+L  DYKTD++                E+K+RY+ Q+ LY+EAL + Y +    +YL+L+GG
Sbjct: 1104  VKLADKIILFDYKTDRFTNVSAISEIKERYKDQMNLYSEALQKAYHVNQIDKYLILLGGP  1163

Query: 1216  KPEIVE                                                        1221
             +   VE
Sbjct: 1164  RKVFVE                                                        1169
```

An alignment of the GAS and GBS proteins is shown below.

```
Identities = 728/1211 (60%), Positives = 916/1211 (75%), Gaps = 5/1211 (0%)
Query:    1  MMTFKPFLNPEDIAVIQTEEKNSDKKQKRTPEQIEAIYTFGNNVLVSASAGSGKTFVMVE  60
             +++F PFL+PE I  +Q  E+  D+ QKRT +QIEAIYT G N+LVSASAGSGKTFVMVE
Sbjct:   13  VISFAPFLSPEAIKHLQENERCRDQSQKRTAQQIEAIYTSGQNILVSASAGSGKTFVMVE  72

Query:   61  RILDKLLRGVPIDSLFISTFTVKAAGELKERLEKKINESLKSAESDDLKQFLTQQLVGIQ  120
             RILDK+LRGV ID LFISTFTVKAA EL+ER+E K+      +K +LT+QL +
Sbjct:   73  RILDKILRGVSIDRLFISTFTVKAATELRERIENKLYSQIAQTTDFQMKVYLTEQLQSLC  132

Query:  121  TADIGTMDAFTQKIVNQYGYTLGISPIFRILQDKNEQDVIKNEVYADLFSDYMTGKNAAS  180
              ADIGTMDAF QK+V++YGY++GIS    FRI+QDK EQDV+K EV++  LF+++M   K A
Sbjct:  133  QADIGTMDAFAQKVVSRYGYSIGISSQFRIMQDKAEQDVLKQEVFSKLFNEFMNQKEAPV  192

Query:  181  FIKLVKNFSGNRKDSKAFREMVYKVYAFSQSTDNPKRWMQTVFLKGAQTYTDFEAIPDQE  240
             F  LVKNFSGN KD+ AFRE+VY  Y+FSQST+NPK W+Q  FL  A+TY   E IPD +
Sbjct:  193  FRALVKNFSGNCKDTSAFRELVYTCYSFSQSTENPKIWLQENFLSAAKTYQRLEDIPDHD  252

Query:  241  VSSLLNVMQTTANQLRDLTDQEDYKQLTAKGVPTANYKKHLKIIENLVHWSQDFNLLYGK  300
             +  LL  MQ TANQLRD+TD EDY QLT  G  +A Y KHL IIE L W +DF  LYGK
```

```
-continued
Sbjct: 253   IELLLLAMQDTANQLRDVTDMEDYGQLTKAGSRSARYTKHLTIIEKLSDWVRDFKCLYGK   312

Query: 301   KGLTNLARDITNVIPSGNDVTVAGVKYPIFKQLHNRIVGLKHLEVIFKYQGESLFLLELL   360
             GL  L RD+T +IPSGNDVTV+ VKYP+FK LH ++    +HLE I  YQ +   LLE L
Sbjct: 313   AGLDRLIRDVTGLIPSGNDVTVSKVKYPVFKTLHQKLKQFRHLETILMYQKDCFSLLEQL   372

Query: 361   QSFVLDFSEQYLQEKIQENAFEFSDIAHFAIQILEENHDIRQLYQDKYHEVMVDEYQDNN   420
             Q FVL FSE YL  KIQE+AFEFSDIAHFAI+ILEEN DIRQ YQ  YHEVMVDEYQDNN
Sbjct: 373   QDFVLAFSEAYLAVKIQESAFEFSDIAHFAIKILEENTDIRQSYQQHYHEVMVDEYQDNN   432

Query: 421   HTQERMLELLSNGHNRFMVGDIKQSIYRFRQADPQIENDKYKAYQDNPSQGKLIILKENF   480
             H QER+L LLSNGHNRFMVGDIKQSIYRFRQADPQIFN K++ YQ  P QGK+I+LKENF
Sbjct: 433   HMQERLLTLLSNGHNRFMVGDIKQSIYRFRQADPQIFNQKFRDYQKKPEQGKVILLKENF   492

Query: 481   RSQSEVLDSTNSVFTHLMDEEVGDILYDESHQLKAGSPRQQERHPNNKTQVLLLDTDEDD   540
             RSQSEVL+ +N+VF+HLMDE VGD+LYDE HQL AGS Q   + + + Q+LL ++D+DD
Sbjct: 493   RSQSEVLNVSNAVFSHLMDESVGDVLYDEQHQLIAGSHAQTVPYLDRRAQLLLYNSDKDD   552

Query: 541   IDDSDSQQYDISPAEAELVAKEIIRLHKEENVPFQDITLLVSSRTRNDGILQTFDRYGIP   600
             ++ S    IS +E  +VAKEII+LH ++ VPF+DITLLVSSRTRND I  TF++YGIP
Sbjct: 553   -GNAPSDSEGISFSEVTIVAKEIIKLHNDKGVPFEDITLLVSSRTRNDIISHTFNQYGIP   611

Query: 601   LVTDGGEQNYLKSVEVMNMLDTLRSIDNPLNDYALVALLRSPMFGFNEDDLTRIAIQD--   658
             + TDGG+QNYLKSVEVM+MLDTLR+I+NP NDYALVALLRSPMF F+EDDL RIA+Q
Sbjct: 612   INIDGGQQNYLKSVEVMMILDTLATINNPRNDYALVALLRSPMFAFDEDDLARIALQKDN   671

Query: 659   --VKMAFYHKVKLSYHKEGHHSDLITPELSSKIDHFMKTFQTWRDFAKWHSLYDLIWKIY   716
               K   Y K++ +   G H +LI  L K++  F+KT ++WR +AK  SLYDLIWKI+
Sbjct: 672   ELDKDCLYDKIQRAVIGRGAHPELIHDILLGKLNVFLKTLKSWRRYAKLGSLYDLIWKIF   731

Query: 717   NDRFYYDYVGALPKAEQRQANLYALALRANQFEKTGFKGLSRFIRMIDKVLENENDLADV   776
             NDRFY+D+V +  KAEQ QANLYALALRANQFEK+G+KGL RFI+MIDKVLE +NDLADV
Sbjct: 732   NDRFYFDFVASQAKAEQAQANLYALALRANQFEKSGYKGLYRFIKMIDKVLETQNDLADV   791

Query: 777   EVALPQNAVNLMTIHKSKGLEFKYVFILNIDKKFSMVDITSPLILSRNQGIGIKYVADMR   836
             EVA P+ AVNLMTIHKSKGL+F YVFILN DK+FSM DI   IL+R  GIGIKY+AD++
Sbjct: 792   EVATPKQAVNLMTIHKSKGLQFPYVFILNCDKRFSMIDIHKSFILNRQHGIGIKYLADIK   851

Query: 837   HELEEEILPAVKVSMETLPYQLNKRELRLATLSEQMRLLYVAMTRAEKKLYLVGKASQTK   896
              L  E  L +VKVSMETLPYQLNK+ELRLATLSE+MRLLYVAMTRAEKK+Y +GKAS++K
Sbjct: 852   GLLGETTLNSVKVSMETLPYQLNKQELRLATLSEEMRLLYVAMTRAEKKVYFIGKASKSK   911

Query: 897   WADHYDLVSENNHLPLASRETFVTFQDWLLAVHETYKKQELFYDINFVSLEELTDHHIGM   956
               + D     LPLA RE +TFQDWLLA+ + +  ++L++D+ F+   +LT   +G
Sbjct: 912   SQEITDPKKLGKLLPLALREQLLIFQDWLLAIADIFSTEDLYFDVRFIEDSDLIQESVGR   971

Query: 957   VNPSLPFNPDNKVENRQSEDIVRAISVLESVEQINQTYKAAIELPTVRTPSQVKKIYEPI   1016
             +       NPD+  +NRQSE I RA+ +LE+V Q+N  Y+AAI LPTVRTPSQ+K  YEP+
Sbjct: 972   LQTPQLLNPDDLKDNRQSETIARALDMLEAVSQLNANYEAAIHLPTVRIPSQLKATYEPL   1031

Query: 1017  LDIEGVDVMETITKTSVDFKLPDFSTSKKQDPAALGSAVHELMQRIEMSSHVKMEDIQKA   1076
             L+  GVD++E +++    DF LP FS   K +  +GSA+H+LMQ + +S +   + + A
Sbjct: 1032  LEPIGVDIIEKSSRSLSDFTLPHFSKKAKVEASHIGSALHQLMQVLPLSKPINQQTLLDA   1091

Query: 1077  LTEVNAETSVKAAIQIEKINYFFQETSLGKYIQEEVEHLHREAPFAMLKEDPESGEKFVV   1136
             L +++   VK A+ ++KI  FF +TSLG++ Q   +HL+REAPFA+LK DP S E+++V+
Sbjct: 1092  LRGIDSNEEVKTALDLKKIESFFCDTSLGQFFQTYQKHLYREAPFAILKLDPISQEEYVL   1151

Query: 1137  RGIIDGYLLLENRIILFDYKTDKFVNPLELKERYQGQMALYAEALKKSYEIEKIDKYLIL   1196
             RGIID Y L ++  I+L DYKTDK+  P+ELK+RYQ Q+ LYAEAL ++Y++      +YL+L
Sbjct: 1152  RGIIDAYFLFDDHIVLVDYKIDKYKQPIELKKRYQQQLELYAEALTQTYKLPVTKRYLVL   1211

Query: 1197  LGGKQLEVVKM                                                   1207
             +GG + E+V++
Sbjct: 1212  MGGGKPEIVEV                                                   1222
```

Based on this analysis, it was predicted that these proteins and their epitopes could be useful antigens for vaccines or diagnostics.

Possible site: 23
>>> Seems to have no N-terminal signal sequence
----- Final Results -----
    bacterial cytoplasm --- Certainty = 0.0660 (Affirmative) <succ>
    bacterial membrane --- Certainty = 0.0000 (Not Clear) <succ>
    bacterial outside --- Certainty = 0.0000 (Not Clear) <succ>

Example 1399

A DNA sequence (GBSx1484) was identified in *S. agalactiae* <SEQ ID 4293> which encodes the amino acid sequence <SEQ ID 4294>. This protein is predicted to be exonuclease RexB. Analysis of this protein sequence reveals the following:

The protein has homology with the following sequences in the GENPEPT database.

```
>GP:AAC12965 GB:U76424 exonuclease RexB [Lactococcus lactis]
Identities = 363/1093 (33%), Positives = 604/1093 (55%), Gaps = 67/1093 (6%)
Query:    1 MKLLYTDINHDMTEILVNQAAHAAEAGWRIFYIAPNSLSFEKERAVLENLPQ---EASFA   57
            M++LYT+I D+TE L+ A    E    +++YI P+S+SFEKE +LE L +    A F
Sbjct:    1 MEILYTEITQDLTEGLLEIALEELEKNRKVYYIVPSSMSFEKEKEILERLAKGSDTAVFD   60

Query:   58 ITITRFAQLARYFTLNQP-NQKESLNDIGLAMIFYRALASFEDGQLKVFGRLKQDASFIS  116
            + +TRF QL  YF +    K  L +GL+M+F R L SF+ ++ ++    L+  A F+
Sbjct:   61 LLVTRFKQLPYYFDKREKATMKTELGTVGLSMLFRRVLRSFKKDEIPLYFSLQDSAGFLE  120

Query:  117 QLVDLYKELQTANLSILELKYLHSPEKFEDLLAIFLVVSDLLREGEYDNQSKIAFFTEQV  176
            L+ L EL TANLS+ L      ++  +LA F    +   EY N S+   FT ++
Sbjct:  121 MLIQLRAELLTANLSVENLPDNPKNQELKKILAKFEAELSV----EYANYSEFGDFTNRL  176

Query:  177 RSGQLDVDLKNTILIVDGFTRFSAEEEALIKSLSSRCQEIIIGAYASQKAYKANFTNGNI  236
              G+ D  LK+ +I+DG+TRFSAREE  I+S+ +    ++G Y+ + +   A  + I
Sbjct:  177 VDGEFDQQLKDVTIIIDGYTRFSAEEELFIESIQEKVARFVVGTYSDENSLTAG--SETI  234

Query:  237 YSAGVDFLRYLATTFQTKPEFILSKWESKSGFEMISK-----NIEGKHDFTNSSHILDDT  291
            Y      +    T F+ K    L K  S + E+ SK      +++ +   T+     L
Sbjct:  235 YVGTSQMI----TRFRNKFPVELRKIASSAVNEVYSKLTRILDLDSRFVITDEKIELKAE  290

Query:  292 AKDCITIWECINQKDEVEHVARAIRQKLYQGYRYKDILVLLGDVDSYKLQLSKIFEQYDI  351
             +    IWE  NQK E+E VA+ IRQK+ QG  +KD  VL+GD  +Y++ L ++F+ Y+I
Sbjct:  291 DEKYFRIWEAENQKVEIERVAKEIRQKIIQGAFFKDFTVLVGDPAAYEITLKEVFDLYEI  350

Query:  352 PYYFGKAETMAAHPLVHFMDSLSRIKRYRFRAEDVLNLFKTGIYGEISQDD--LDYFEAY  409
            P+++  + E+M+ HPLV F +SL  IK+ +R +DV+NL K+ +Y + + D+  +DYFE Y
Sbjct:  351 PFFYAQEESMSQHPLVIFFESLFAIKKNNYRTDDVVNLLKSKVYTDANLDEEVIDYFEYY  410

Query:  410 ISYADIKGPKKFFTDFVVGAKKFDLGRLNTIRQSLL---TPLESFV-KTKKQDGIKTLNQ  465
            +    I G KKF  +F+ + +  +N +R+ LL   +PL F+ +K+  G K ++
Sbjct:  411 VQKYKISGRKKFTEEFIE-SEFSQIELVNEMREKLLGSESPLQVFLGNNRKKTGKKWVSD  469

Query:  466 FMFFLTQVGLSDNLSRLVGQMS-ENEQ---KHQEVWKTFTDILEQFQTIFGQEKLNLDE  521
              L  + N++        +NE +   KH++VW+     L +F +F EKL   E
Sbjct:  470 LQGLLENGNVMTNMNAYFSAAELQNEHQMADKHEQVWQMLISTLNEFLAVFSDEKLKSVE  529

Query:  522 FLSLLNSGMMQAEYRMVPATVDVVTVKSYDLVEPHSNQFVYALGMTQSHFPKIAQNKSLI  581
            FL +L +G+  A+YR +PA VDVV VK Y+LVEP +N+++YA+G++Q++FP+I +N +L+
Sbjct:  530 FLDILLAGLKNAKYRQIPANVDVVNVKDYELVEPKTNKYIYAIGLSQTNFPRIKKNSTLL  589

Query:  582 SDIERQLINDANDTDGHFDIMTQENLKKNHFAALSLFNAAKQELVLTIPQLLNESEDQMS  641
            SD ER IN D+ + +  N +KN F LSL N+AK+ LVL++PQ++  + + S
Sbjct:  590 SDEERLEINQTTDENQFIEQLNVANYQKNQFTVLSLINSAKESLVLSMPQIMANEQGEFS  649

Query:  642 P-YLVELRDIGVPFNHKGR-QSLKEEADNIGNYKALLSRVVDLYRSAIDKEMTKEELQTF  698
            P + + L+D      K+  +L E  ++IGN ++++ +  + R  ++ E T E+ + F
Sbjct:  650 PVFQLFLKDADEKILQKIQGVNLFESLEHIGNSRSVIAMIGQIERELVESEETSEDKRVF  709

Query:  699 WSVAVRYLRRQLTSKGIEIPIITDSLDTVTVSSDVMTRRFPEDDPLKLSSSALTTFYNNQ  758
            WS   R L +       + +  +DTV ++ D + +    D +  S S+   FYN +
Sbjct:  710 WSSIFRILVKSNADFQKILLDLAKDIDTVNLAPDTLEQIY--GDKIYASVSSFERFYNCE  767

Query:  759 YKYFLQYVLGLEEQDSIHPDMRHHGTYLHRVFEILMKNQGI--ESFEEKLNSAINKTNQE  816
            Y+YFL+   L LE ++I + + G + H VFE +MK    E+F+EKL + +
Sbjct:  768 YQYFLENTLSLETFENIDINSKIVGNFFHEVFEKVMKETDLSAENFDEKLTLVLQEVDKN  827

Query:  817 DVFKSLYSEDAESRYSLEILEDIARATATILR----QDSQMTVESE-------EERFELM  865
             +    +++DA +R++    LE+I R TAT+L+       D   T+ +E           E
Sbjct:  828 --YSRYFTQDATARFTWSNLEEIVRQTATVLKATVSTDELKTLLTESSFGLPKSELGNFS  885

Query:  866 IDNTIKINGIIDRIDRLSDGSLGVVDYKSSAQKFDIQKFYNGLSPQLVTYIDAISRDKEV  925
            +D+ I + G IDR+D+LS  LG +DYKSSA   F Q+ Y GLS Q +TY+D I   K+
Sbjct:  886 VDD-IYLRGRIDRLDQLSTDYLGAIDYKSSAHSFKLQEAYDGLSLQFMTYLDVI---KQA  941

Query:  926 EQKPPIFGAMYLHMQEPRQDLSKIKNLDDLVTKNHQALTYKGLFSEAEKEFLANGKYHL-  984
                I+GA+YL +     +LS+I L ++             +++ Y+GL  E  E + G ++
Sbjct:  942 FPNQKIWGALYLQFKNQPINLSEINQLSEIANILKESMRYEGLVLEDAAEQI-KGIENIA  1000

Query:  985 --KDSLYSETEIAILQAHNQSLYKKASETIKSGKFLINPYTEDAKTVDGD---------Q  1033
              K  ++Y+E E   L  N+    Y+ A + +K GK  INP    + ++ +D
Sbjct: 1001 LKKTNIYNEEEFEQLLKLNEEHYRAAGQRLKKGKIAINPIMKRSEGIDQSGEVRGCRYCP  1060

Query: 1034 FKSITGFEADRHM                                               1046
             KSI   FEA+ HM
Sbjct: 1061 LKSICRFEANIHM                                               1073
```

A related DNA sequence was identified in *S. pyogenes* <SEQ ID 4295> which encodes the amino acid sequence <SEQ ID 4296>. Analysis of this protein sequence reveals the following:

Possible site: 23
>>> Seems to have no N-terminal signal sequence

----- Final Results -----
bacterial cytoplasm --- Certainty = 0.1891 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 546/1075 (50%), Positives = 758/1075 (69%), Gaps = 11/1075 (1%)
Query:   1 MKLLYTDINHDMTEILVNQAAHAAEAGWRIFYIAFNSLSFEKERAVLENLPQEASFAITI   60
           MKL+YT++++ MTEILVN+A  AA+ G+R+FYIAPNSLSFEKER VL  LP+  +F+I +
Sbjct:   1 MKLIYTEMSYSMTEILVNEARKAADQGYRVFYIAPNSLSFEKEREVLTLLPERGTFSIIV   60

Query:  61 TRFAQLARYFTLNQPNQKESLNDIGLAMIFYRALASFEDGQLKVFGRLKQDASFISQLVD  120
           TRF Q++RYFT+      K+ L+D  LAMIFYRAL    +   L  +GRL+ ++ FI QLV+
Sbjct:  61 TRFVQMSRYFTVESSPSKQHLDDITLAMIFYRALMQLKPEDLPSYGRLQNNSVFIEQLVE  120

Query: 121 LYKELQTANLSILELKYLHSPEKFEDLLAIFLVVSDLLREGEYDNQSKIAFFTEQVRSGQ  180
           LYKEL+ A LS+ +L   L   P+K EDL+ I  +     ++ + +Y+  S +  F   ++ G
Sbjct: 121 LYKELKNAQLSVHDLTGLDHPQKQEDLIKIIELAETIMIQQDYNQDSPLQSFARAIKLGL  180

Query: 181 LDVDLKNTILIVDGFTRFSAEEEALIKSLSSRCQEIIIGAYASQKAYKANFINGNIYSAG  240
           L+  L   T++++DGF+RFSAEE+ L+  L++ CQE+IIG+Y SQKAY+ +F  GNIY A
Sbjct: 181 LNNQLSKTVVVIDGFSRFSAEEDYLLSLLNNNCQEVIIGSYVSQKAYQKSFIKGNIYEAS  240

Query: 241 VDFLRYLATTFQTKPEFILSKWESKSGFEMISKNIEGKHDFTNSSHILDDTAKDCITIWE  300
           + FL+ LA + KP F S    K F +++ E HDF+   L  + D  ++W+
Sbjct: 241 LHFLQDLAQKYHIKPVFATSNQVFKPAFSRLTQLFEATHDFSQVDWQLQKSDLDHFSLWQ  300

Query: 301 CINQKDEVEHVARAIRQKLYQGYRYKDILVLLGDVDSYKLQLSKIFEQYDIPTYFGKAET  360
           C +QK+E+EHVA++IRQKLY+GYRYKDILVLLGD+D+Y+LQ+   IF++++IPYY GKAE
Sbjct: 301 CHHQKEEIEHVAKSIRQKLYEGYRYKDILVLLGDMDAYQLQIGPIFDKFEIPYYLGKAEP  360

Query: 361 MAAHPLVHFMDSLSRIKRYRFRAEDVLNLFKTGIYGEISQDDLDYFEAYISYADIKGPKK  420
           MAAHPLV F++SL R +RY +R ED+LN+ K+G++G    D+D FE Y +ADIKG  K
Sbjct: 361 MAAHPLVQFIESLERSQRYNWRREDILNMLKSGLFGCFDDSDIDRFEEYTQFADIKGFTK  420

Query: 421 FFTDFVV-GAKKFDLGRLNTIRQSLLTPLESFVKTKKQDGIKTLNQFMFFLTQVGLSDNL  479
           F    F +  ++++ L  LN +RQ ++ PL+   K++KQ G  +++ + FL ++ L++N+
Sbjct: 421 FSKPFTINSSRQYPLDFLNEMRQDIVLPLQELFKSQKQLGASLVDKLILFLKKIRLAENM  480

Query: 480 SRLVGQMSENEQEKHQEVWKTFTDILEQFQTIFGQEKLNLDEFLSLLNSGMMQAEYRMVP  539
              L    S+ E EK++EVWK FTDIL  F  IFGQEKL L + L+L+ +GM  A+YR+VP
Sbjct: 481 QGLA--QSQLEVEKNEEVWKRFTDILTSFHHIFGQEKLRLSDCLALIKTGMKSAQYRVVP  538

Query: 540 ATVDVVTVKSYDLVEPHSNQFVYALGMTQSHFPKIAQNKSLISDIERQLINDANDTDGHF  599
           AT+DVVT+KSYDLV+PHS  FVYA+G+TQSHFPK   +  L+SD ER  IN+  +   HF
Sbjct: 539 ATLDVVTIKSYDLVQPHSKPFVYAIGLTQSHFPKQIHHSGLLSDQERARINEIRNY-RHF  597

Query: 600 DIMTQENLKKNHFAALSLFNAAKQELVLTIPQLLNESEDQMSPYLVELRDIGVPFNHKGR  659
           DI + EN KKNH ALSLFNAA +ELVL++   ++NE+ D +SPYL EL + G+P   KG+
Sbjct: 598 DIASAENSKKNHQTALSLFNAATKELVLSVSTVINETFDDLSPYLKELINFGLPLLDKGK  657

Query: 660 QSLKEEADNIGNYKALLSRVVDLYRSAIDKEMTKEEQTFWSVAVRYLRRQLTSKGIEIPI  719
           + L + +IGNYKALLS+++ + R  + EM+ +++ FW+V +RYLR+QL  + +E+P
Sbjct: 658 NYLSYDNSDIGNYKALLSQIIAINRQDL-IEMSDQDKMFWTVVLRYLRKQLRKQQLELPT  716

Query: 720 ITDSLDTVTVSSDVMTRRFPEDDPLKLSSSALTTFYNNQYKYFLQYVLGLEEQDSIHPDM  779
              L T  +S +V+   FP+  PLKLS+++ALT FYNNQY YFL+YVL L + +SIHPD
Sbjct: 717 SDYRLSTKPLSKEVIEVCFPKGIPLKLSATALTVFYNNQYNYFLKYVLNLNKTESIHPDS  776

Query: 780 RHHGTYLHRVFEILMKNQGIESFEEKLNSAINKTNQEDVFKSLYSEDAESRYSLEILEDI  839
           R HG YLHRVFE LMK+   E F+ KL  AI  TNQE F+ +Y ++AE+ YSL ILEDI
Sbjct: 777 RIHGQYLHRVFERLMKDHTQEPFDNKLKQAIYHTNQESFFQQVYQDNAEAEYSLAILEDI  836

Query: 840 ARATATILRQDSQMTVESEEERFELMIDNTIKINGIIDRIDRLSDGSLGVVDYKSSAQKF  899
           +R+TA IL+ +  + V  +E+ F+L + N I ++GIIDRID+LSDGSLG VDYKSSA +F
Sbjct: 837 VRSTAPILQLNQNIQVIDQEKNFQLDMGNEILVHGIIDRIDQLSDGSLGIVDYKSSANQF  896

Query: 900 DIQKFYNGLSPQLVTYIDAISR--DKEVEQKPPIFGAMYLHMQEPRQDLSKIKNLDD-LV  956
           DI  FYNGLSPQL+TY+ A+ +       ++ Q  +FGAMYLH+Q+P+ DL  K +D+ LV
Sbjct: 897 DIGTFYNGLSPQLMTYLAALKQIAPHDINQ---LFGAMYLHLQDPKLDLVTFKQIDNTLV  953

Query: 957 TKNHQALTYKGLFSEAEKEFLANGKYHLKDSLYSETEIAILQAHNQSLYKKASETIKSGK 1016
           ++ALTYKG+FSE EKE L+ G Y  K++LYS E+ L +N+ LY KA++ IK G
Sbjct: 954 ESIYKALTYKGIFSEVEKEHLSTGAYQTKNALYSNDELETLLNYNKYLYLKAAKHIKKGH 1013
```

```
Query: 1017  FLINPYTEDAKTVDGDQFKSITGFEADRHMARARALYKLPAKEKRQGFLTLMQQE       1071
             FLINPYT D KTV GDQ K+IT FEAD M +AR L  LPAKEK++ FLTLM++E
Sbjct: 1014  FLINPYTSDGKTVQGDQLKAITRFEADLDMGQARRLVTLPAKEKKECFLTLMRKE       1068
```

Based on this analysis, it was predicted that these proteins and their epitopes could be useful antigens for vaccines or diagnostics.

Example 1400

A DNA sequence (GBSx1485) was identified in *S. agalactiae* <SEQ ID 4297> which encodes the amino acid sequence <SEQ ID 4298>. Analysis of this protein sequence reveals the following:

Possible site: 31
>>> Seems to have no N-terminal signal sequence
INTEGRAL    Likelihood = −7.80    Transmembrane 51-67 (44-69)
----- Final Results -----
  bacterial membrane --- Certainty = 0.4121 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 8799> which encodes amino acid sequence <SEQ ID 8800> was also identified. Analysis of this protein sequence reveals the following:

Lipop: Possible site: −1    Crend: 10
McG: Discrim Score: −20.62
GvH: Signal Score (−7.5): −6.25
Possible site: 31
>>> Seems to have no N-terminal signal sequence
ALOM program   count: 1 value: −7.80 threshold: 0.0
INTEGRAL       Likelihood = −7.80    Transmembrane 47-63 (40-65)
PERIPHERAL     Likelihood = 3.34     26
modified ALOM score: 2.06
*** Reasoning Step: 3
----- Final Results -----
  bacterial membrane --- Certainty = 0.4121 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the GENPEPT database.

```
>GP:AAC75528 GB:AE000334 orf, hypothetical protein [Escherichia coli K12]

Identities = 138/297 (46%), Positives = 193/297 (64%), Gaps = 16/297 (5%)

Query:   5  MKIDDLRKSDNVEDRRSSSGGSFSSGGSGLPILQLLLLRGSWKTKLVVLIILLLLG--GG    62
            M+     R+SDNVEDRR+SSGG  S GG G   +       S K  L++LI++L+ G  G
Sbjct:   1  MRWQGRRESDNVEDRRNSSGGP-SMGGPGFRL-------PSGKGGLILLIVVLVAGYYGV    52

Query:  63  GLTSIFNDSSSPSSYQSQNVSRSVDNSAIREQIDFVNKVLGSTEDFWSQEFQTQGFGNYK   122
            LT +            ++++S + D +A       F + +L +TED W Q+F+  G   Y+
Sbjct:  53  DLTGLMTGQPVSQQQSTRSISPNEDEAAK-----FTSVILATTEDTWGQQFEKMG-KTYQ   106

Query: 123  EPKLVLYTNSIQTGCGIGESASGPFYCSADKKIYLDISFYNELSHKYGATGDFAMAYVIA   182
            +PKLV+Y    +TGCG G+S  GPFYC AD   +Y+D+SFY+++   K GA GDFA  YVIA
Sbjct: 107  QPKLVMYRGMTRTGCGAGQSIMGPFYCPADGTVYIDLSFYDDMKDKLGADGDFAQGYVIA   166

Query: 183  HEVGHHIQTELGIMDKYNRMRHGLTKKEANALNVRLELQADYYAGVWAHYIRGKNLLEQG   242
            HEVGHH+Q  LGI  K  +++     T+ E N L+VR+ELQAD +AGVW H ++ + +LE G
Sbjct: 167  HEVGHHVQKLLGIEPKVRQLQQNATQAEVNRLSVRMELQADCFAGVWGHSMQQQGVLETG   226

Query: 243  DFEEAMNAAHAVGDDTLQKETYGKLVPDSFTHGTAEQRQRWFNKGFQYGDIQHGDTF       299
            D EEA+NAA A+GDD LQ+++  G++VPDSFTHGT++QR   WF +GF   GD     +TF
Sbjct: 227  DLEEALNAAQAIGDDRLQQQSQGRVVPDSFTHGTSQQRYSWFKRGFDSGDPAQCNTF       283
```

A related DNA sequence was identified in *S. pyogenes* <SEQ ID 4299> which encodes the amino acid sequence <SEQ ID 4300>. Analysis of this protein sequence reveals the following:

```
Possible site: 41
>>> Seems to have no N-terminal signal sequence
INTEGRAL    Likelihood = -6.42    Transmembrane 48-64 (41-67)
----- Final Results -----
   bacterial membrane --- Certainty = 0.3569 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the databases:

```
>GP:AAC75528 GB:AE000334 orf, hypothetical protein [Escherichia coli]
Identities = 143/301 (47%), Positives = 195/301 (64%), Gaps = 21/301 (6%)
Query:    1  MKTDDLRESQQVEDRRGQSSG-SPFGGGLGGGLLLQLLFSRGGWKTKLVILLLLLVMG--    57
             M+     RES  VEDRR  S G S GG G        +L   +GG   L++L+++LV G
Sbjct:    1  MRWQGRRESDNVEDRRNSSGGPSMGGPGF------RLPSGKGG----LILLIVVLVAGYY    50

Query:   58  GGGLSGVLGGKPSSTNNNAYQSSQVTRTNGDKASQEQVSFVSKVFASTEDYWTKTFREKG   117
             G  L+G++ G+P S      QS++     N D+A++    F S + A+TED W + F + G
Sbjct:   51  GVDLTGLMTGQPVSQQ----QSTRSISPNEDEAAK----FTSVILATTEDTWGQQFEKMG   102

Query:  118  LTYHKPTLVLYTGATQTACGRGQASSGPFYCPGDQKVYLDISFYNELSTKYGAKGDFAMA   177
              TY +P LV+Y G T+T CG GQ+  GPFYCP D  VY+D+SFY+++   K GA GDFA
Sbjct:  103  KTYQQPKLVMYRGMTRTGCGAGQSIMGPFYCPADGTVYIDLSFYDDMKDKLGADGDFAQG   162

Query:  178  YVIAHEVGHHIQNELGIMDNYASARQGKSKAKANQLNVKLELQADYYAGAWANYVQGQGL   237
             YVIAHEVGHH+Q  LGI        +Q   ++A+ N+L+V++ELQAD  +AG W + +Q QG+
Sbjct:  163  YVIAHEVGHHVQKLLGIEPKVRQLQQNATQAEVNRLSVRMELQADCFAGVWGHSMQQQGV   222

Query:  238  LEKGDIEEAMAAAHAVGDDTLQEETYGRTVPDSFTHGTSKQRQRWFDRGYQYGDFEHGDTF   298
             LE GD+EEA+ AA A+GDD LQ+++  GR VPDSFTHGTS+QR  WF RG+   GD   +TF
Sbjct:  223  LETGDLEEALNAAQAIGDDRLQQQSQGRVVPDSFTHGTSQQRYSWFKRGFDSGDPAQCNTF   283
```

An alignment of the GAS and GBS proteins is shown below.

```
Identities = 191/303 (63%), Positives = 241/303 (79%), Gaps = 5/303 (1%)
Query:    5  MKIDDLRKSDNVEDRRSSSGGSFSSGG-SGLPILQLLLLRGSWKTKLVVLIILLLLGGGG    63
             MK DDLR+S  VEDRR  S GSF  GG  G  +LQLL  RG WKTKLV+L++LL++GGGG
Sbjct:    1  MKTDDLRESQQVEDRRGQSSGSFGGGLGGGLLLQLLFSRGGWKTKLVILLLLLVMGGGG    60

Query:   64  LTSIFN---DSSSPSSYQSQNVSRSVDNSATREQIDFVNKVLGSTEDFWSQEFQTQGFGN   120
             L+ +       S++ ++YQS  V+R+   + A++EQ+  FV+KV  STED+W++   F+ +G
Sbjct:   61  LSGVLGGKPSSTNNNAYQSSQVTRTNGDKASQEQVSFVSKVFASTEDYWTKTFREKGL-T   119

Query:  121  YKEPKLVLYTNSIQTGCGIGESASGPFYCSADKKIYLDISFYNELSHKYGATGDFAMAYV   180
             Y +P LVLYT + QT CG+G+++SGPFYC  D+K+YLDISFYNELS KYGA GDFAMAYV
Sbjct:  120  YHKPTLVLYTGATQTACGRGQASSGPFYCPGDQKVYLDISFYNELSTKYGAKGDFAMAYV   179

Query:  181  IAHEVGHHIQTELGIMDKYNRMRHGLTKKEANALNVRLELQADYYAGVWAHYIRGKNLLE   240
             IAHEVGHHIQ ELGIMD Y    R G +K +AN LNV+LELQADYYAG WA+Y++G+ LLE
Sbjct:  180  IAHEVGHHIQNELGIMDNYASARQGKSKAKANQLNVKLELQADYYAGAWANYVQGQGLLE   239

Query:  241  QGDFEEAMNAAHAVGDDTLQKETYGKLVPDSFTHGTAEQRQRWFNKGFQYGDIQHGDTFS   300
             +GD EEAM AAHAVGDDTLQ+ETYG+ VPDSFTHGT++QRQRWF++G+QYGD +HGDTFS
Sbjct:  240  KGDIEEAMAAAHAVGDDTLQEETYGRTVPDSFTHGTSKQRQRWFDRGYQYGDFEHGDTFS   299

Query:  301  VEH                                                          303
             + +
Sbjct:  300  IPY                                                          302
```

SEQ ID 8800 (GBS404) was expressed in *E. coli* as a GST-fusion product. SDS-PAGE analysis of total cell extract is shown in FIG. 171 (lane 3; MW 62 kDa).

GBS404-GST was purified as shown in FIG. 218, lane 7.

Based on this analysis, it was predicted that these proteins and their epitopes could be useful antigens for vaccines or diagnostics.

Example 1401

A DNA sequence (GBSx1486) was identified in *S. agalactiae* <SEQ ID 4301> which encodes the amino acid sequence <SEQ ID 4302>. This protein is predicted to be phenylalanyl-tRNA synthetase beta chain (pheT). Analysis of this protein sequence reveals the following:

```
Possible site: 19
>>> Seems to have no N-terminal signal sequence
----- Final Results -----
   bacterial cytoplasm --- Certainty = 0.2617 (Affirmative) <succ>
```

-continued

```
   bacterial membrane --- Certainty = 0.0000 (Not Clear) <succ>
      bacterial outside --- Certainty = 0.0000 (Not Clear) <succ>
```

The protein has homology with the following sequences in the GENPEPT database.

```
>GP:CAB14823 GB:Z99118 phenylalanyl-tRNA synthetase (beta subunit)
[Bacillus subtilis]
Identities = 376/805 (46%), Positives = 523/805 (64%), Gaps = 6/805 (0%)
Query:   1  MLVSYKWLKELVDVD-VTTAELAEKMSTTGIEVEGVETPAEGLSKLVVGHIVSCEDVPDT      59
            M VSYKWL++ VD+ + A LAEK++ GIEVEG+E   EG+ +V+GH++ E  P+
Sbjct:   1  MFVSYKWLEDYVDLKGMDPAVLAEKITRAGIEVEGIEYKGEGIKGVVIGHVLEREQHPNA     60

Query:  60  H-LHLCQVDTGDDELRQVVCGAPNVKTGINVIVAVPGARIADNYKIKKGKIRGMESLGMI    118
            L+ C VD G +   Q++CGAPNV  G  V  VA  GA +  N+KIKK K+RG ES GMI
Sbjct:  61  DKLNKCLVDIGAEAPVQIICGAPNVDKGQKVAVATVGAVLPGNFKIKKAKLRGEESNGMI    120

Query: 119  CSLQELGLSESIIPKEFSDGIQILPEGAIPGDSIFSYLDLDDEIIELSITPNRADALSMR    178
            CSLQELG+   ++ KE+++GI + P  G    + L LDD I+EL +TPNRADA++M
Sbjct: 121  CSLQELGIESKLVAKEYAEGIFVFPNDAETGSDALAALQLDDAILELGLTPNRADAMNML    180

Query: 179  GVAHEVAAIYGKKVHFEEKNLIEEAERAADKISVVIESDKVLS-YSARIVKNVTVAPSPQ    237
            GVA+EVAAI   +V  + +   +E+A+D ISV IE +     Y+A+I+KNVT+APSP
Sbjct: 181  GVAYEVAAILDTEVKLPQTDYPAASEQASDYISVKIEDQEANPLYTAKIIKNVTIAPSPL    240

Query: 238  WLQNKLMNAGIRPINNVVDVTNYVLLTYGQPMHAFDFDKEDGTTIVARNAENGEKLITLD    297
            W+Q KLMNAGIRP NNVVD+TN+VLL YGQP+HAFD+D+ F   +V R A  E ++TLD
Sbjct: 241  WMQTKLMNAGIRPHNNVVDITNEVLLEYGQPLHAFDYDREGSKEVVVRKAAENEMIVTLD    300

Query: 298  GEERDLIADDLVIAVNDQPVALAGVMGGQSTEIGSSSKTVVLEAAVENGTSIRKTSGRLN    357
            +ER L AD LVI  + A+AGVMGG +E+   +KT++LEAA ENG  +RK S  L
Sbjct: 301  DQERKLSADHLVITNGTKAQAVAGVMGGAESEVQEDTKTILLEAAYENGQKVRKASKDLG    360

Query: 358  LASESSSRFEKGINYDTVSEAMDFAAAMLQELAGGQVLSGQVTEGVLPTEPVEVSTTLGY    417
            LRSESS RFEKGI+   V A + AA ++   AGG+VL+G V E  L E   +
Sbjct: 361  LRSESSVRFEKGIDPARVRLAAERAAQLIHLYAGGEVLAGTVEEDHLTIEANNIHVSADK    420

Query: 418  VNTRLGTELTYTDIEEVFEKLGFAISGSEVKFTVLVPRRRWDIAIQADLVEEIARIYGYE    477
            V++ LG ++ ++  ++++LGF + ++    V VP RR DI I+ DL+EE AR+YGY+
Sbjct: 421  VSSVLGLTISKEELISIYKRLGFTVGEADDLLVVTVPSRRGDITIEEDLIEEAARLYGYD    480

Query: 478  KLPTTLPEAGATAGELTSMQRLRRRVRTVAEGAGLSEIITYALTTPEKAVQFSTQATNIT    537
            +P+TLPE   T G LT Q  RR+VR  EGAGLS+ ITY+LT  +KA F+ + + T
Sbjct: 481  NIPSTLPETAGTTGGLTPYQAKRRKVRRFLEGAGLSQAITYSLTNEKKATAFAIEKSLNT    540

Query: 538  ELMWPMTVDRSALRQNVVSGMLDTIAYNVARKNSNLAVYEIGKVFEQTGNPKEDLPTEVE    597
            L  PM+ +RS LR ++V  +LD+++YN+AR+  ++A+YE+G VF       ++  P E E
Sbjct: 541  VLALPMSEERSILRHSLVPNLLDSVSYNLARQTDSVALYEVGSVF--LTKEEDTKPVETE    598

Query: 598  TFTFALTGLVEEKDFQTKSKPVDFFYAKGIVEALFIKLK-LDVTFVAQKGLASMHPGRTA    656
            +TGL ++ +Q + KPVDFF   KGIVE L  KL  LD    Q   +HPGRTA
Sbjct: 599  RVAGAVTGLWRKQLWQGEKKPVDFFVVKGIVEGLLDKLNVLDSIEFVQSERKQLHPGRTA    658

Query: 657  TILLDGKEIGFVGQVHPQTAKQYDIPETYVAEINLSTIESQMNQALIFEDITKYPSVSRD    716
            ILL+G  IGF+GQVHP   K+ DI ETYV E++L   +    L++  I  KYPSV+RD
Sbjct: 659  NILLNGSLIGFIGQVHPSLEKELDIKETYVFELDLHALLAAETAPLVYTAIPKYPSVTRD    718

Query: 717  IALLLAESVSHHDIVSAIETSGVKRLTAIKLFDVYAGNNIAEGYKSMAYSLTFQNPNDNL    776
            IAL+ ++V+  + S I+ +G K L  + +FDVY G ++  EG KS+A+SL + NP    L
Sbjct: 719  IALVTDKTVTSGQLESVIKEAGGKLLKEVTVFDVYEGEHMEEGKKSVAFSLQYVNPEQTL    778

Query: 777  TDEEVAKYMEKITKSLVEKVNAEIR                                      801
            T+EEV K   K+ K+L +   A +R
Sbjct: 779  TEEEVTKAHSKVLKALEDTYQAVLR                                      803
```

A related DNA sequence was identified in *S. pyogenes* <SEQ ID 4303> which encodes the amino acid sequence <SEQ ID 4304>. Analysis of this protein sequence reveals the following:

Possible site: 27
>>> Seems to have no N-terminal signal sequence

----- Final Results -----
bacterial cytoplasm --- Certainty = 0.1283 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 595/801 (74%), Positives = 687/801 (85%)
Query:   1  MLVSYKWLKELVDVDVTTAELAERMSTTGIEVEGVETPAEGLSKLVVGHIVSCEDVPDTH     60
            MLVSYKWLKELVD+DVT A LAEKMSTTGIEVEG+E PA+GLSKLVVGH++SCEDVP+TH
Sbjct:   6  MLVSYKWLKELVDIDVTPAALAEKMSTTGIEVEGIEVPADGLSKLVVGHVLSCEDVPETH     65

Query:  61  LHLCQVDTGDDELRQVVCGAPNVKTGINVIVAVPGARIADNYKIKKGKIRGMESLGMICS    120
            LHLCQVDTGD+  RQ+VCGAPNVK GI VIVAVPGARIADNYKIKKGKIRGMESLGMICS
```

```
                        -continued
Sbjct:  66  LHLCQVDTGDETPRQIVCGAPNVKAGIKVIVAVPGARIADNYKIKKGKIRGMESLGMICS  125

Query: 121  LQELGLSESIIPKEFSDGIQILPEGAIPGDSIFSYLDLDDEIIELSITPNRADALSMRGV  180
            LQELGLS+SIIPKEFSDGIQILPE A+PGD+IF YLDLDD IIELSITPNRADALSMRGV
Sbjct: 126  LQELGLSDSIIPKEFSDGIQILPEEAVPGDAIFKYLDLDDHIIELSITPNRADALSMRGV  185

Query: 181  AHEVAAIYGKKVHFEEKNLIEEAERAADKISVVIESDKVLSYSARIVKNVTVAPSPQWLQ  240
            AHEVAAIYGK V F +KNL E  +  ++ I V I SD VL+Y++R+V+NV V PSPQWLQ
Sbjct: 186  AHEVAAIYGKSVSFPQKNLQESDKATSEAIEVAIASDNVLTYASRVVENVKVKPSPQWLQ  245

Query: 241  NKLMNAGIRPINNVVDVTNYVLLTYGQPMHAFDFDKFDGTTIVARNAENGEKLITLDGEE  300
            N LMNAGIRPINNVVDVTNYVLL +GQPMHAFD+DKF+  IVAR A GE L+TLDGE+
Sbjct: 246  NLLMNAGIRPINNVVDVTNYVLLYFGQPMHAFDYDKFEDHKIVARAARQGESLVTLDGEK  305

Query: 301  RDLIADDLVIAVNDQPVALAGVMGGQSTEIGSSSKTVVLEAAVFNGTSIRKTSGRLNLRS  360
            RDL  +DLVI V D+PVALAGVMGGQ+TEI ++S+TVVLEAAVF+G SIRKTSGRLNLRS
Sbjct: 306  RDLTTEDLVITVADKPVALAGVMGGQATEIDANSQTVVLEAAVFDGKSIRKTSGRLNLRS  365

Query: 361  ESSSRFEKGINYDTVSEAMDFAAAMLQELAGGQVLSGQVTEGVLPTEPVEVSTTLGYVNT  420
            ESSSRFEKG+NY TV EA+DFAAAMLQELA GQVLSG V  G LPTEPVEVST+L YVN
Sbjct: 366  ESSSRFEKGVNYATVLEALDFAAAMLQELAEGQVLSGHVQAGQLPTEPVEVSTSLDYVNV  425

Query: 421  RLGTELTYTDIEEVFEKLGFAISGSEVKFTVLVPRRRWDIAIQADLVEEIARIYGYEKLP  480
            RLGTELT+ DI+ +F++LGF ++G E  FTV VPRRRWD++I ADLVEEIARIYGY+KLP
Sbjct: 426  RLGTELTFADIQRIFDQLGFGLTGDETSFTVAVPRRRWDVSIPADLVEEIARIYGYDKLP  485

Query: 481  TTLPEAGATAGELTSMQRLRRRVRTVAEGAGLSEIITYALTTPEKAVQFSTQATNITELM  540
            TTLPEAG TA ELT  Q LRR+VR +AEG GL+EII+YALTTPEKAV+F+   +++TELM
Sbjct: 486  TTLPEAGGTAAELTPTQALRRKVRGLAEGLGLTEIISYALTTPEKAVEFAVAPSHLTELM  545

Query: 541  WPMTVDRSALRQNVVSGMLDTIAYNVARKNSNLAVYEIGKVFEQTGNPKEDLPTEVETFT  600
            WPM+V+RSALRQN+VSGMLDT+AYNVARK SNLA+YEIGK+FEQ  NPKEDLP EV  F
Sbjct: 546  WPMSVERSALRQNMVSGMLDTVAYNVARKQSNLALYEIGKIFEQEANPKEDLPNEVNHFA  605

Query: 601  FALTGLVEEKDFQTKSKPVDFFYAKGIVEALFIKLKLDVTFVAQKGLASMHPGRTATILL  660
            FA+ GLV +KDFQT+++ VDF++AKG ++ LF  L  V +V  K LA+MHPGRTA ILL
Sbjct: 606  FAICGLVAQKDFQTQAQAVDFYHAKGNLDTLFANLNLKVQYVPTKDLANMHPGRTALILL  665

Query: 661  DGKEIGFVGQVHPQTAKQYDIPETYVAEINLSTIESQMNQALIFEDITKYPSVSRDIALL  720
            D + IGFVGQVHP TAK Y IPETYVAE++++ +E+ +     F +ITK+P+++RD+ALL
Sbjct: 666  DEQVIGFVGQVHPGTAKAYSIPETYVAELDMAALEAALPSDQTFAEITKFPAMTRDVALL  725

Query: 721  LAESVSHHDIVSAIETSGVKRLTAIKLFDVYAGNNIAEGYKSMAYSLTFQNPNDNLTDEE  780
            L   VSH  IV+AIE++GVKRLT+IKLFDVY G  I  G KSMAYSLTFQNPNDNLTDEE
Sbjct: 726  LDREVSHQAIVTAIESAGVKRLTSIKLFDVYEGATIQAGKKSMAYSLTFQNPNDNLTDEE  785

Query: 781  VAKYMEKITKSLVEKVNAEIR                                         801
            VAKYMEKITK+L E+V AE+R
Sbjct: 786  VAKYMEKITKALTEQVGAEVR                                         806
```

Based on this analysis, it was predicted that these proteins and their epitopes could be useful antigens for vaccines or diagnostics.

Example 1402

A DNA sequence (GBSx1487) was identified in *S. agalactiae* <SEQ ID 4305> which encodes the amino acid sequence <SEQ ID 4306>. Analysis of this protein sequence reveals the following:

---
Possible site: 43
>>> Seems to have no N-terminal signal sequence

---
----- Final Results -----
bacterial cytoplasm --- Certainty = 0.0653 (Affirmative) <succ>
bacterial membrane --- Certainty = 0.0000 (Not Clear) <succ>
bacterial outside --- Certainty = 0.0000 (Not Clear) <succ>

---

A related GBS nucleic acid sequence <SEQ ID 9769> which encodes amino acid sequence <SEQ ID 9770> was also identified.

The protein has homology with the following sequences in the GENPEPT database.

```
>GP:CAB15205 GB:Z99120 transcriptional regulator [Bacillus subtilis]
Identities = 60/169 (35%), Positives = 100/169 (58%)
Query:  17  ITFKKVGLDNVNILQNIAIETFRQTFSHDNSEEQLQAFFNESYTLPVLKSEITHAESDTY  76
            +   KK   +++ LQ ++IETF  TF   NS E ++A+    ++   L+ E+++ S  +
Sbjct:   3  VKMKKCSREDLQTLQQLSIETFNDTFKEQNSPENMKAYLESAFNTEQLEKELSNMSSQFF  62

Query:  77  FVYLDTDLVGYLKVNWGSQQTEKDLDKAFEIQRIYLLDAYQGQGIGKATFEFALDLAYKS  136
            F+Y D ++ GY+KVN   Q+E+   ++ EI+RIY+ +++Q  G+GK    A+++A +
Sbjct:  63  FIYFDHEIAGYVKVNIDDAQSEEMGAESLEIERIYIKNSFQKHGLGKHLLNKAIEIALER  122
```

```
Query: 137 GLDWAWLGVWEFNHKAQAFYAKYGFEKFSEHQFSVGDKVDTDWLLRKSL          185
            WLGVWE N  A AFY K GF +    H F +GD+   TD ++ K+L
Sbjct: 123 NKKNIWLGVWEKNENAIAFYKKMGFVQTGAHSFYMGDEEQTDLIMAKTL          171
```

No corresponding DNA sequence was identified in S. pyogenes.

Based on this analysis, it was predicted that these proteins and their epitopes could be useful antigens for vaccines or diagnostics.

Example 1403

A DNA sequence (GBSx1488) was identified in S. agalactiae <SEQ ID 4307> which encodes the amino acid sequence <SEQ ID 4308>. This protein is predicted to be phenylalanyl-tRNA synthetase (alpha subunit) (pheS). Analysis of this protein sequence reveals the following:

```
Possible site: 45
>>> Seems to have no N-terminal signal sequence
----- Final Results -----
    bacterial cytoplasm --- Certainty = 0.3937 (Affirmative) <succ>
    bacterial membrane --- Certainty = 0.0000 (Not Clear) <succ>
    bacterial outside --- Certainty = 0.0000 (Not Clear) <succ>
```

A related GBS nucleic acid sequence <SEQ ID 9339> which encodes amino acid sequence <SEQ ID 9340> was also identified.

The protein has homology with the following sequences in the GENPEPT database.

A related DNA sequence was identified in S. pyogenes <SEQ ID 4309> which encodes the amino acid sequence <SEQ ID 4310>. Analysis of this protein sequence reveals the following:

```
Possible site: 19
>>> Seems to have no N-terminal signal sequence
----- Final Results -----
    bacterial cytoplasm --- Certainty = 0.2806 (Affirmative) <succ>
    bacterial membrane --- Certainty = 0.0000 (Not Clear) <succ>
    bacterial outside --- Certainty = 0.0000 (Not Clear) <succ>
```

```
>GP:CAB14824 GB:Z99118 phenylalanyl-tRNA synthetase (alpha subunit)
[Bacillus subtilis]
Identities = 209/338 (61%), Positives = 270/338 (79%), Gaps = 2/338 (0%)
Query:   1 MKISTQEKLKEM-TGNHTKELQDLRVQVLGKKGSLTELLKGLKDLSNDLRPVVGKQVNEV   59
           +K    QE L+++   +   K + D+RVQ LGKKG +TE+L+G+  LS + RP +G   NEV
Sbjct:   5 LKQLEQEALEQVEAASSLKVVNDIRVQYLGKKGPITEVLRGMGKLSAEERPKMGALANEV   64

Query:  60 RDILTKAFEEQAKVVEAAKIQAQLESESVDVTLPGRQMTLGHRHVLTQTSEEIEDIFLGM  119
           R+ +  A   + +E  +++ +L  +++DVTLPG    +G RH LT     EEIED+F+GM
Sbjct:  65 RERIANAIADKNEKLEEEEMKQKLAGQTIDVTLPGNPVAVGGRHPLTVVIEEIEDLFIGM  124

Query: 120 GFQVVDGFEVEKDYYNFERMNLPKDHPARDMQDTFYITEEILLRTHTSPVQARTMDQHDF  179
           G+ V +G EVE DYYNFE +NLPK+HPARDMQD+FYITEE L+RT TSPVQ RTM++H+
Sbjct: 125 GYTVEEGPEVETDYYNFESLNLPKEHPARDMQDSFYITEETLMRTQTSPVQTRTMEKHE-  183

Query: 180 SKGPLKMISPGRVFRRDTDDATHSHQFHQIEGLVVGENISMGDLKGTLQLISQKMFGAER  239
             KGP+K+I PG+V+RRD DDATHSHQF QIEGLVV +NISM DLKGTL+L+++KMFG +R
Sbjct: 184 GKGPVKIICPGKVYRRDNDDATHSHQFMQIEGLVVDKNISMSDLKGTLELVAREMFGQDR  243

Query: 240 KIRLRPSYFPFTEPSVEVDVSCFKCGGKGCNVCKQTGWIEILGAGMVHPSVLEMSGIDSE  299
           +IRLRPS+FPFTEPSVEVDV+CFKCGG GC+VCK TGWIEILGAGMVHP+VL+M+G D +
Sbjct: 244 EIRLRPSFFPFTEPSVEVDVTCFKCGGNGCSVCKGTGWIEILGAGMVHPNVLKMAGFDPK  303

Query: 300 KYSGFAFGLGQERIAMLRYGINDIRGFYQGDVRFTDQF                       337
           +Y GFAFG+G ERIAML+YGI+DIR FY  DVRF  QF
Sbjct: 304 EYQGFAFGMGVERIAMLKYGIDDIRHFYTNDVRFISQF                       341
```

An alignment of the GAS and GBS proteins is shown below.

```
Identities = 305/337 (90%), Positives = 327/337 (96%)
Query:   1 MKISTQEKLKEMTGNHTKELQDLRVQVLGKKGSLTELLKGLKDLSNDLRPVVGKQVNEVR   60
           +K   T E L+ +TGN+TKELQDLRV VLGKKGSLTELLKGLKDLSNDLRPVVGKQVNEVR
Sbjct:  36 LKTKTLETLQSLTGNETKELQDLRVAVLGKKGSLTELLKGLKDLSNDLRPVVGKQVNEVR   95
```

```
                              -continued
Query:  61  DILTKAFEEQAKVVEAAKIQAQLESESVDVTLPGRQMTLGHRHVLTQTSEEIEDIFLGMG  120
            D+LTKAFEEQAK+VEAAKIQAQL++ES+DVTLPGRQMTLGHRHVLTQTSEEIEDIFLGMG
Sbjct:  96  DLLTKAFEEQAKIVEAAKIQAQLDAESIDVTLPGRQMTLGHRHVLTQTSEEIEDIFLGMG  155

Query: 121  FQVVDGFEVEKDYYNFERMNLPKDHPARDMQDTFYITEEILLRTHTSPVQARTMDQHDFS  180
            FQ+VDGFEVEKDYYNFERMNLPKDHPARDMQDTFYITEEILLRTHTSPVQART+DQHDFS
Sbjct: 156 FQIVDGFEVEKDYYNFERMNLPKDHPARDMQDTFYITEEILLRTHTSPVQARTLDQHDFS  215

Query: 181  KGPLKMISPGRVFRRDTDDATHSHQFHQIEGLVVGENISMGDLKGTLQLISQKMFGAERK  240
            KGPLKM+SPGRVFRRDTDDATHSHQFHQIEGLVVG+NISMGDLKGTL++I +KMFG ER
Sbjct: 216 KGPLKMVSPGRVFRRDTDDATHSHQFHQIEGLVVGKNISMGDLKGTLEMIIKKMFGDERS  275

Query: 241  IRLRPSYFPFTEPSVEVDVSCFKCGGKGCNVCKQTGWIEILGAGMVHPSVLEMSGIDSEK  300
            IRLRPSYFPFTEPSVEVDVSCFKCGGKGCNVCK+TGWIEILGAGMVHPSVLEMSG+D+++
Sbjct: 276 IRLRPSYFPFTEPSVEVDVSCFKCGGKGCNVCKKTGWIEILGAGMVHPSVLEMSGVDAKE  335

Query: 301  YSGFAFGLGQERIAMLRYGINDIRGFYQGDVRFTDQF                        337
            YSGFAFGLGQERIAMLRYGINDIRGFYQGD RF++QF
Sbjct: 336 YSGFAFGLGQERIAMLRYGINDIRGFYQGDQRFSEQF                        372
```

Based on this analysis, it was predicted that these proteins and their epitopes could be useful antigens for vaccines or diagnostics.

Example 1404

A DNA sequence (GBSx1489) was identified in *S. agalactiae* <SEQ ID 4311> which encodes the amino acid sequence <SEQ ID 4312>. Analysis of this protein sequence reveals the following:

Possible site: 13
>>> Seems to have no N-terminal signal sequence
----- Final Results -----
    bacterial cytoplasm --- Certainty = 0.2834 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1405

A DNA sequence (GBSx1490) was identified in *S. agalactiae* <SEQ ID 4313> which encodes the amino acid sequence <SEQ ID 4314>. Analysis of this protein sequence reveals the following:

Possible site: 18
>>> Seems to have no N-terminal signal sequence
----- Final Results -----
    bacterial cytoplasm --- Certainty = 0.2762 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1406

A DNA sequence (GBSx1491) was identified in *S. agalactiae* <SEQ ID 4315> which encodes the amino acid sequence <SEQ ID 4316>. This protein is predicted to be DNA-entry nuclease. Analysis of this protein sequence reveals the following:

Possible site: 13
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>

A related GBS nucleic acid sequence <SEQ ID 8801> which encodes amino acid sequence <SEQ ID 8802> was also identified. Analysis of this protein sequence reveals the following:

Lipop Possible site: −1    Crend: 5
McG: Discrim Score: 10.13
GvH: Signal Score (−7.5): −5.07
Possible site: 23
>>> Seems to have an uncleavable N-term signal seq
ALOM program    count: 1 value: −6.79 threshold: 0.0
INTEGRAL        Likelihood = −6.79    Transmembrane 8-24 (6-27)
PERIPHERAL      Likelihood = 6.26     258
modified ALOM score: 1.86
*** Reasoning Step: 3
----- Final Results -----
    bacterial membrane --- Certainty = 0.3718 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
GP:CAA38134 GB:X54225 membrane nuclease [Streptococcus pneumoniae]
Identities = 154/232 (66%), Positives = 180/232 (77%), Gaps = 1/232 (0%)
Query:   41 KNVSGTPSRELSESVLTSNVKKQLGTNIAWNQSGAFIINQNKTDLNAKVSSAPYAINEIK   100
            K  S   PS+ L+ESVLT   VK Q+  ++ WN SGAFI+N NKT+L+AKVSS PYA N+ K
Sbjct:   43 KQASEAPSQALAESVLTDAVKSQIKGSLEWNGSGAFIVNGNKTNLDAKVSSKPYADNKTK   102

Query:  101 KVNNQIVPTKANALLTKATRQYRNREETGNGRTYWKPAGWHQINGLKGSYNHAVDRGHLI   160
             V  + VPT ANALL+KATRQY+NR+ETGNG T W P GWHQ+  LKGSY HAVDRGHL+
Sbjct:  103 TVGKETVPTVANALLSKATRQYKNRKETGNGSTSWTPPGWHQVKNLKGSYTHAVDRGHLL   162

Query:  161 GYALVGSLRGFDASTSNPKNIATQAAWANQANSNQSTGQNYYETLVRKALDRHKTVRYRV   220
            GYAL+G L GFDASTSNPKNIA Q AWANQA +  STGQNYYE+ VRKALD++K VRYRV
Sbjct:  163 GYALIGGLDGFDASTSNPKNIAVQTAWANQAQAEYSTGQNYYESKVRKALDQNKRVRYRV   222

Query:  221 TLIY-DRDNLLSSGSHIEAKSSDGSLEFNVFIPNVQSGLLFDYATGKVKQTK            271
            TL Y  ++L+ S S IEAKSSDG LEFWV +PNVQ GL  DY TG+V  T+
Sbjct:  223 TLYYASNEDLVPSASQIEAKSSDGELEFNVLVPNVQKGLQLDYRTGEVTVTQ            274
```

There is also homology to SEQ IDs 368 and 1302.

SEQ ID 8802 (GBS285) was expressed in *E. coli* as a His-fusion product. SDS-PAGE analysis of total cell extract is shown in FIG. 56 (lane 6; MW 32 kDa). It was also expressed in *E. coli* as a GST-fusion product. SDS-PAGE analysis of total cell extract is shown in FIG. 60 (lane 7; MW 57.5 kDa).

GBS285-GST was purified as shown in FIG. 208 (lane 7) and FIG. 225 (lane 8).

Figure 134:
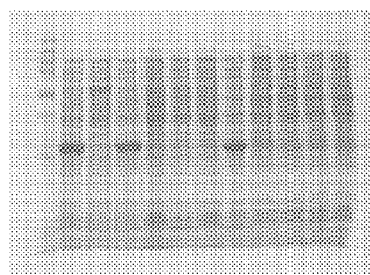

GBS658 was expressed in *E. coli* as a GST-fusion product. SDS-PAGE analysis of total cell extract is shown in FIG. 134 (lane 8 & 9; MW 27 kDa).

Based on this analysis, it was predicted that this protein and its epitopes, could be useful antigens for vaccines or diagnostics.

Example 1407

A DNA sequence (GBSx1492) was identified in *S. agalactiae* <SEQ ID 4317> which encodes the amino acid sequence <SEQ ID 4318>. Analysis of this protein sequence reveals the following:

---
Possible site: 27
>>> Seems to have a cleavable N-term signal seq.
----- Final Results -----
    bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>
---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1408

A DNA sequence (GBSx1493) was identified in *S. agalactiae* <SEQ ID 4319> which encodes the amino acid sequence <SEQ ID 4320>. This protein is predicted to be UDP-N-acetylglucosamine (murA). Analysis of this protein sequence reveals the following:

---
Possible site: 43
>>> Seems to have no N-terminal signal sequence
----- Final Results -----
    bacterial cytoplasm --- Certainty = 0.1814 (Affirmative) <succ>
    bacterial membrane --- Certainty = 0.0000 (Not Clear) <succ>
    bacterial outside --- Certainty = 0.0000 (Not Clear) <succ>
---

A related GBS nucleic acid sequence <SEQ ID 9767> which encodes amino acid sequence <SEQ ID 9768> was also identified.

The protein has homology with the following sequences in the GENPEPT database.

```
?+0GP:CAB15693 GB:Z99122 UDP-N-acetylglucosamine 1-carboxyvinyltransferase
[Bacillus subtilis]
Identities = 248/423 (58%), Positives = 323/423 (75C, Gaps = 5/423 (1%)
Query:    5 MDKIIVEGGQTQLQGQVVIEGAKNAVLPLLAATILPSQGKTLLTNVPILSDVFTMNNVVR    64
            M+KIIV GGQ +L G V +EGAKNAVLP++AA++L S+ K+++ +VP LSDV+T+N V+R
Sbjct:    1 MEKIIVRGGQ-KLNGTVEVEGAKNAVLPVIAASLLASEEKSVICDVPTLSDVYTINEVLR    59

Query:   65 GLDIQVDFNCDKKEILVDASGDILDVAPYEFVSQMRASIVVLGPILARNGHAKVSMPGGC   124
              L  V F +   E+ V+AS    AP+E+V +MRAS++V+GP+LAR GHA+V++PGGC
Sbjct:   60 HLGADVHF--ENNEVTVNASYALQTEAPFEYVRKMRASVLVMGPLLARTGHARVALPGGC   117

Query:  125 TIGSRPIDLHLKGLEAMGATITQNGGDITAQAE-KLKGANIYMDFPSVGATQNLMMAATL   183
             IGSRPID HLKG EAMGA I    G I A+ + +L+GA IY+DFPSVGAT+NL+MAA L
Sbjct:  118 AIGSRPIDQHLKGFEAMGAEIKVGNGFIEAEVKGRLQGAKIYLDFPSVGATENLIMAAAL   177

Query:  184 ASGTTTIENAAREPEIVDLAQLLNKMGAKVKGAGTETLTIIGVDALHGTEHDVVQDRIEA   243
            A GTTT+EN A+EPEIVDLA  +N MG K++GAGT T+ I GV+ LHG +H ++ DRIEA
Sbjct:  178 AEGTTTLENVAKEPEIVDLANYINGMGGKIRGAGTGTIKIEGVEKLHGVKHHIIPDRIEA   237

Query:  244 GTFMVAAAMTSGNVLVKDAIWEHNRPLISKLMEMGVEVSEEEDGIRVKADTKKLKPVTVK   303
            GTFMVAAA+T GNVLVK A+ EH   LI+K+ EMGV + +E +G+RV     K+LKP+ +K
```

```
Sbjct:  238  GTFMVAAAITEGNVLVKGAVPEHLTSLIAKMEEMGVTIKDEGEGLRV-IGPKELKPIDIK   296

Query:  304  TLPHPGFPTDMQAQFTALMAVVNGESTMIETVFENRFQHLEEMRRMGLQTEILRDTAMIH   363
             T+PHPGFPTDMQ+Q  AL+    +G S +  ETVFENRF H EE RRM    +I   + +I+
Sbjct:  297  TMPHPGFPTDMQSQMMALLLRASGTSMITETVFENRFMHAEEFRRMNGDIKIEGRSVIIN   356

Query:  364  GGRALQGAPVMSTDLRASAALILAGMVAQGQTVVGQLTHLDRGYYQFHEKLAALGANIKR   423
             G    LQGA V +TDLRA AALILAG+VA+G T V +L HLDRGY  FH+KLAALGA+I+R
Sbjct:  357  GPVQLQGAEVAATDLRAGAALILAGLVAEGHTRVTELKELDRGYVDFHQKLAALGADIER   416

Query:  424  VSE                                                          426
             V++
Sbjct:  417  VND                                                          419
```

A related DNA sequence was identified in *S. pyogenes* <SEQ ID 4321> which encodes the amino acid sequence <SEQ ID 4322>. Analysis of this protein sequence reveals the following:

Possible site: 39
>>> Seems to have no N-terminal signal sequence

```
INTEGRAL    Likelihood = –3.03    Transmembrane 377-393 (376-394)
----- Final Results -----
    bacterial membrane --- Certainty = 0.2211 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the databases:

```
>GP:CAB15693 GB:Z99122 UDP-N-acetylglucosamine 1-carboxyvinyltransferase
[Bacillus subtilis]
Identities = 248/423 (58%), Positives = 318/423 (74%), Gaps +325/423 (1%)
Query:    1  VDKIIIEGGQTRLEGEVVIEGAKNAVLPLLAASILPSKGKTILRNVPILSDVFTMNNVVR    60
             ++KII+ GGQ +L G V +EGAKNAVLP++AAS+L S+ K+++ +VP LSDV+T+N V+R
Sbjct:    1  MEKIIVRGGQ-KLNGTVKVEGAKNAVLPVIAASLLASEEKSVICDVPTLSDVYTINEVLR    59

Query:   61  GLDIRVDFNEAANEITVDASGHILDEAPYEYVSQMRASIVVLGPILARNGHAKVSMPGGC   120
                L   V F   NE+TV+AS  +    EAP+EYV +MRAS++V+GP+LAR GHA+V++PGGC
Sbjct:   60  HLGADVHFEN--NEVTVNASYALQTEAPFEYVRKMRASVLVMGPLLARTGHARVALPGGC   117

Query:  121  TIGSRPINLHLKGLEAMGATITQKGGDITAQAD-RLQGAMIYMDEPSVGATQNLMMAATL   179
                IGSRPI+ HLKG EAMGA I    G I A+     RLQGA IY+DFPSVGAT+NL+MAA L
Sbjct:  118  AIGSRPIDQHLKGFEAMGAEIKVGNGFIEAEVKGRLQGAKIYLDEPSVGATENLIMAAAL   177

Query:  180  ADGVTTIENAAREPEIVDLAQFLNKMGARIRGAGTETLTITGVTHLRGVEHDVVQDRIEA   239
             A+G TT+EN A+EPEIVDLA ++N MG +IRGAGT T+ I GV  L GV+H ++ DRIEA
Sbjct:  178  AEGTTTLENVAKEPEIVDLANYINGMGGKIRGAGTGTIKIEGVEKLHGVKHHIIPDRIEA   237

Query:  240  GTEMVAAAMTSGNVLIRDAVWEHNRPLISKLMEMGVSVTEEEYGIRVQANTPKLKPVTVK   299
             GTFMVAAA+T GNVL++  AV EH    LI+K+ EMGV++  +E     G+RV        +LKP+ +K
Sbjct:  238  GTFMVAAAITEGNVLVKGAVPEHLTSLIAKMEEMGVTIKDEGEGLRV-IGPKELKPIDIK   296

Query:  300  TLPHPGFPTDMQAQFTALMAVVNGESTMVETVFENREQHLEEMRRMGLQSEILRETAMIH   359
             T+PHPGFPTDMQ+Q  AL+    +G S +  ETVFENRF H EE RRM    +I   + +I+
Sbjct:  297  TMPHPGFPTDMQSQMMALLLRASGTSMITETVFENRFMHAEEFRRMNGDIKIEGRSVIIN   356

Query:  360  GGRQLQGAPVMSTDLRASAALILTGIVAQGVTIVNNLVHLDRGYYQFHEKLAKLGATISR   419
             G   QLQGA V +TDLRA AALIL G+VA+G T V    L HLDRGY  FH+KLA LGA I R
Sbjct:  357  GPVQLQGAEVAATDLRAGAALILAGLVAEGHTRVTELEHLDRGYVDFHQKLAALGADIER   416

Query:  420  SSE                                                          422
                ++
Sbjct:  417  VND                                                          419
```

An alignment of the GAS and GBS proteins is shown below.

```
Identities = 363/422 (86%), Positives = 391/422 (92%)
Query:    5  MDKIIVEGGQTQLQGQVVIEGAKNAVLPLLAATILPSQGKTLLTNVPILSDVFTMNNVVR    64
             +DKII+EGGQT+L+G+VVIEGAKNAVLPLLAA+ILPS+GKT+L NVPILSDVFTMNNVVR
Sbjct:    1  VDKIIIEGGQTRLEGEVVIEGAKNAVLPLLAASILPSKGKTILRNVPILSDVFTMNNVVR    60

Query:   65  GLDIQVDFNCDKKEILVDASGDILDVAPYEFVSQMRASIVVLGPILARNGHAKVSMPGGC   124
             GLDI+VDFN      EI VDASG ILD APYE+VSQMRASIVVLGPILARNGHAKVSMPGGC
Sbjct:   61  GLDIRVDFNEAANEITVDASGHILDEAPYEYVSQMRASIVVLGPILARNGHAKVSMPGGC   120

Query:  125  TIGSRPIDLHLKGLEAMGATITQNGGDITAQAEKLKGANIYMDFPSVGATQNLMMAATLA   184
             TIGSRPI+LHLKGLEAMGATITQ GGDITAQA++L+GA IYMDFPSVGATQNLMMAATLA
Sbjct:  121  TIGSRPINLHLKGLEAMGATITQKGGDITAQADRLQGAMIYMDFPSVGATQNLMMAATLA   180

Query:  185  SGTTTIENAAREPEIVDLAQLLNKMGAKVKGAGTETLTIIGVDALHGTEHDVVQDRIEAG   244
              G  TTIENAAREPEIVDLAQ LNKMGA+++GAGTETLTI  G  EHDVVQDRIEAG
Sbjct:  181  DGVTTIENAAREPEIVDLAQFLNKMGARIRGAGTETLTITGVTHLRGVEHDVVQDRIEAG   240

Query:  245  TFMVAAAMTSGNVLVKDAIWEHNRPLISKLMEMGVEVSEEEDGIRVKADTKKLKPVTVKT   304
             TFMVAAAMTSGNVL++DA+WEHNRPLISKLMEMGV V+EEE GIRV+A+T KLKPVTVKT
Sbjct:  241  TFMVAAAMTSGNVLIRDAVWEHNRPLISKLMEMGVSVTEEEYGIRVQANTPKLKPVTVKT   300

Query:  305  LPHPGFPTDMQAQFTALMAVVNGESTMIETVFENRFQHLEEMRRMGLQTEILRDTAMIHG   364
             LPHPGFPTDMQAQFTALMAVVNGESTM+ETVFENRFQHLEEMRRMGLQ+EILR+TAMIHG
Sbjct:  301  LPHPGFPTDMQAQFTALMAVVNGESTMVETVFENRFQHLEEMRRMGLQSEILRETAMIHG   360

Query:  365  GRALQGAPVMSTDLRASAALILAGMVAQGQTVVGQLTHLDRGYYQFHEKLAALGANIKRVSE   426
             GR LQGAPVMSTDLRASAALIL G+VAQG T+V  L HLDRGYYQFHEKLA LGA I RSSE
Sbjct:  361  GRQLQGAPVMSTDLRASAALILTGIVAQGVTIVNNLVHLDRGYYQFHEKLAKLGATISRSSE   422
```

Based on this analysis, it was predicted that these proteins and their epitopes could be useful antigens for vaccines or diagnostics.

Example 1409

A DNA sequence (GBSx1494) was identified in *S. agalactiae* <SEQ ID 4323> which encodes the amino acid sequence <SEQ ID 4324>. Analysis of this protein sequence reveals the following:

---
Possible site: 49
>>> Seems to have no N-terminal signal sequence
----- Final Results -----
   bacterial cytoplasm --- Certainty = 0.2096 (Affirmative) <succ>
   bacterial membrane --- Certainty = 0.0000 (Not Clear) <succ>
   bacterial outside --- Certainty = 0.0000 (Not Clear) <succ>
---

The protein has homology with the following sequences in the GENPEPT database.

A related DNA sequence was identified in *S. pyogenes* <SEQ ID 4325> which encodes the amino acid sequence <SEQ ID 4326>. Analysis of this protein sequence reveals the following:

---
Possible site: 49
>>> Seems to have no N-terminal signal sequence
----- Final Results -----
   bacterial cytoplasm --- Certainty = 0.2539 (Affirmative) <succ>
   bacterial membrane --- Certainty = 0.0000 (Not Clear) <succ>
   bacterial outside --- Certainty = 0.0000 (Not Clear) <succ>
---

An alignment of the GAS and GBS proteins is shown below.

```
>GP:BAA23756 GB:AB009314 proton-translocating ATPase, epsiron
subunit [Streptococcus bovis]
Identities = 102/138 (73%), Positives = 121/138 (86%), Gaps = 1/138 (0%)

Query:    1  MAQLTVQVVTPDGIRYDHHASLITVRTPDGEMGILPGHINLIAPLNVHQMKINRSHQEG-    59
             M  +TVQVVTPDGIRYDHHA+ I+V+TPDGEMGILP HINLIAPL VH+MKI+R+
Sbjct:    1  MTFMTVQVVTPDGIRYDHHANFISVKTPDGEMGILPEHINLIAPLTVHEMKIHRTDDPNH    60

Query:   60  VDWVAVNGGIIEVNEDQVTIVADSAERARDIDLNRAERAKERAERALEKAQTTQNIDEMR   119
             VDWVA+NGGIIE+ ++ VTIVADSAER RDID++RAERAK RAER LE+AQ+T +IDE+R
Sbjct:   61  VDWVAINGGIIEIKDNLVTIVADSAERERDIDVSRAERAKIRAERKLEQAQSTHDIDEVR   120

Query:  120  RAEVALRRAINRISVGKK                                             137
             RA+VALRRA+NRISVG K
Sbjct:  121  RAQVALRRALNRISVGNK                                             138
```

```
Identities = 100/138 (72%), Positives = 119/138 (85%), Gaps = 1/138 (0%)

Query:     1  MAQLTVQVVTPDGIRYDHHASLITVRTPDGEMGILPGHINLIAPLNVHQMKINRSHQ-EG   59
              M Q+TVQVVTPDGI+YDHHA  I+V TPDGEMGILP HINLIAPL VH+MKI R  + E
Sbjct:     1  MTQMTVQVVTPDGIKYDHHAKFISVTTPDGEMGILPNHINLIAPLQVHEMKIRRGGEDEK  60

Query:    60  VDWVAVNGGIIEVNEDQVTIVADSAERARDIDLNRAERAKERAERALEKAQTTQNIDEMR  119
              VDW+A+NGGIIE+ ++ VTIVADSAER RDID++RAERAK RAER + +A+TT NIDE+R
Sbjct:    61  VDWIAINGGIIEIKDNVVTIVADSAERDRDIVSRAERAKLRAEREIAQAETTHNIDEVR   120

Query:   120  RAEVALRRAINRISVGKK                                            137
              RA+VALRRA+NRI+V KK
Sbjct:   121  RAKVALRRALNRINVSKK                                            138
```

Based on this analysis, it was predicted that these proteins and their epitopes could be useful antigens for vaccines or diagnostics.

Example 1410

A DNA sequence (GBSx1495) was identified in *S. agalactiae* <SEQ ID 4327> which encodes the amino acid sequence <SEQ ID 4328>. Analysis of this protein sequence reveals the following:

Possible site: 60
>>> Seems to have an uncleavable N-term signal seq
----- Final Results -----
   bacterial membrane --- Certainty = 0.0000 (Not Clear) <succ>
     bacterial outside --- Certainty = 0.0000 (Not Clear) <succ>
       bacterial cytoplasm --- Certainty = 0.0000 (Not Clear) <succ>

The protein is similar to the beta subunit of the *S. mutans* ATPase:

A related DNA sequence was identified in *S. pyogenes* <SEQ ID 4329> which encodes the amino acid sequence <SEQ ID 4330>. Analysis of this protein sequence reveals the following:

Possible site: 60
>>> Seems to have no N-terminal signal sequence
----- Final Results -----
   bacterial cytoplasm --- Certainty = 0.0275 (Affirmative) <succ>
   bacterial membrane --- Certainty = 0.0000 (Not Clear) <succ>
     bacterial outside --- Certainty = 0.0000 (Not Clear) <succ>

An alignment of the GAS and GBS proteins is shown below.

```
>GP:AAD13383 GB:U31170 ATPase, beta subunit [Streptococcus mutans]
Identities = 435/466 (93%), Positives = 455/466 (97%)

Query:     1  MSSGKIAQVVGPVVDVVFASGDKLPEINNALIVYKNGDKSQKVVLEVALELGDGLVRTIA   60
              MS+GKIAQVVGPVVDV FA+ DKLPEINNAL+VYK+GDKSQ++VLEVALELGDGLVRTIA
Sbjct:     1  MSTGKIAQVVGPVVDVAFATDDKLPEINNALVVYKDGDKSQRIVLEVALELGDGLVRTIA   60

Query:    61  MESTDGLTRGLEVLDTGRAISVPVGKDTLGRVFNVLGDAIDLEEPFAEDAERQPIHKKAP  120
              MESTDGLTRGLEV DTGRAISVPVGK+TLGRVFNVLGD IDL++PFAEDAERQPIHKKAP
Sbjct:    61  MESTDGLTRGLEVFDTGRAISVPVGKETLGRVFNVLGDTIDLDKPFAEDAERQPIHKKAP  120

Query:   121  SFDELSTSSEILETGIKVIDLLAPYLKGGKVGLFGGAGVGKTVLIQELIHNIAQEHGGIS  180
              SFD+LSTS+EILETGIKVIDLLAPYLKGGKVGLFGGAGVGKTVLIQELIHNIAQEHGGIS
Sbjct:   121  SFDDLSTSTEILETGIKVIDLLAPYLKGGKVGLFGGAGVGKTVLIQELIHNIAQEHGGIS  180

Query:   181  VFTGVGERTREGNDLYWEMKESGVIEKTAMVFGQMNEPPGARMRVALTGLTIAEYFRDVE  240
              VFTGVGERTREGNDLYWEMKESGVIEKTAMVFGQMNEPPGARMRVALTGLTIAEYFRDVE
Sbjct:   181  VFTGVGERTREGNDLYWEMKESGVIEKTAMVFGQMNEPPGARMRVALTGLTIAEYFRDVE  240

Query:   241  GQDVLLFIDNIFRFTQAGSEVSALLGRMPSAVGYQPTLATEMGQLQERITSTKKGSVTSI  300
              GQDVLLFIDNIFRFTQAGSEVSALLGRMPSAVGYQPTLATEMGQLQERITSTKKGSVTSI
Sbjct:   241  GQDVLLFIDNIFRFTQAGSEVSALLGRMPSAVGYQPTLATEMGQLQERITSTKKGSVTSI  300

Query:   301  QAIYVPADDYTDPAPATAFAHLDSTTNLERKLTQMGIYPAVDPLASSSRALTPEIVGDEH  360
              QAIYVPADDYTDPAPATAFAHLDSTTNLER+LTQMGIYPAVDPLASSSRAL+PEIVG EH
Sbjct:   301  QAIYVPADDYTDPAPATAFAHLDSTTNLERRLTQMGIYPAVDPLASSSRALSPEIVGQEH  360

Query:   361  YEVATEVQRVLQRYRELQDIIAILGMDELSDEEKTLVGRARRIQFFLSQNFNVAETFTGQ  420
              Y+VATEVQ VLQRYRELQDIIAILGMDELSDEEKTLVGRARRIQFFLSQNFNVAE FTGQ
Sbjct:   361  YDVATEVQHVLQRYRELQDIIAILGMDELSDEEKTLVGRARRIQFFLSQNFNVAEQFTGQ  420

Query:   421  PGSYVPVEETVRGFKEILDGKHDQIPEDAFRMVGGIEDVIAKAEKM                466
              PGSYVPV ETVRGFKEIL+GK+D++PEDAFR VG IEDV+ KA+KM
Sbjct:   421  PGSYVPVAETVRGFKEILEGKYDELPEDAFRSVGAIEDVVEKAKKM                466
```

```
Identities = 440/468 (94%), Positives = 456/468 (97%)

Query:    1  MSSGKIAQVVGPVVDVVFASGDKLPEINNALIVYKNGDKSQKVVLEVALELGDGLVRTIA    60
             MSSGKIAQVVGPVVDV+FASGDKLPEINNALIVYK+ DK QK+VLEVALELGDG+VRTIA
Sbjct:    1  MSSGKIAQVVGPVVDVMFASGDKLPEINNALIVYKDSDKKQKIVLEVALELGDGMVRTIA    60

Query:   61  MESTDGLTRGLEVLDTGRAISVPVGKDTLGRVFNVLGDAIDLEEPFAEDAERQPIHKKAP   120
             MESTDGLTRGLEVLDTGRAISVPVGK+TLGRVFNVLG+ IDLEEPFAED +RQPIHKKAP
Sbjct:   61  MESTDGLTRGLEVLDTGRAISVPVGKETLGRVFNVLGETIDLEEPFAEDVDRQPIHKKAP   120

Query:  121  SFDELSTSSEILETGIKVIDLLAPYLKGGKVGLFGGAGVGKTVLIQELIHNIAQEHGGIS   180
             SFDELSTSSEILETGIKVIDLLAPYLKGGKVGLFGGAGVGKTVLIQELIHNIAQEHGGIS
Sbjct:  121  SFDELSTSSEILETGIKVIDLLAPYLKGGKVGLFGGAGVGKTVLIQELIHNIAQEHGGIS   180

Query:  181  VFTGVGERTREGNDLYWEMKESGVIEKTAMVFGQMNEPPGARMRVALTGLTIAEYFRDVE   240
             VFTGVGERTREGNDLYWEMKESGVIEKTAMVFGQMNEPPGARMRVALTGLTIAEYFRDVE
Sbjct:  181  VFTGVGERTREGNDLYWEMKESGVIEKTAMVFGQMNEPPGARMRVALTGLTIAEYFRDVE   240

Query:  241  GQDVLLFIDNIFRFTQAGSEVSALLGRMPSAVGYQPTLATEMGQLQERITSTKKGSVTSI   300
             GQDVLLFIDNIFRFTQAGSEVSALLGRMPSAVGYQPTLATEMGQLQERITST+KGSVTSI
Sbjct:  241  GQDVLLFIDNIFRFTQAGSEVSALLGRMPSAVGYQPTLATEMGQLQERITSTQKGSVTSI   300

Query:  301  QAIYVPADDYTDPAPATAFAHLDSTTNLERKLTQMGIYPAVDPLASSSRALTPEIVGDEH   360
             QAIYVPADDYTDPAPATAFAHLDST NLERKLTQMGIYPAVDPLASSSRAL+PEIVG EH
Sbjct:  301  QAIYVPADDYTDPAPATAFAHLDSTTNLERKLTQMGIYPAVDPLASSSRALSPEIVGEEH   360

Query:  361  YEVATEVQRVIQRYRELQDIIAILGMDELSDEEKTLVGRARRIQFFLSQNFNVAETFTGQ   420
             Y VATEVQRVLQRYRELQDIIAILGMDELSDEEKTLVGRARRIQFFLSQNFNVAE FTG
Sbjct:  361  YAVATEVQRVLQRYRELQDIIAILGMDELSDEEKTLVGRARRIQFFLSQNFNVAEQFTGL   420

Query:  421  PGSYVPVEETVRGFKEILDGKHDQIPEDAFRMVGGIEDVIAKAEKMNY              468
             PGSYVPV +TVRGFKEIL+GK+D++PEDAFR VG IEDVI KAEKM +
Sbjct:  421  PGSYVPVADTVRGFKEILEGKYDELPEDAFRSVGPIEDVIKKAEKMGF              468
```

Based on this analysis, it was predicted that these proteins and their epitopes could be useful antigens for vaccines or diagnostics.

Example 1411

A DNA sequence (GBSx1496) was identified in *S. agalactiae* <SEQ ID 4331> which encodes the amino acid sequence <SEQ ID 4332>. Analysis of this protein sequence reveals the following:

Possible site: 31
>>> Seems to have no N-terminal signal sequence
----- Final Results -----
   bacterial cytoplasm --- Certainty = 0.1889 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:BAA23754 GB:AB009314 proton-translocating ATPase, gamma subunit
[Streptococcus bovis]
Identities = 252/293 (86%), Positives = 278/293 (94%), Gaps = 2/293 (0%)

Query:    1  MAGSLSEIKDKILSTEKTSKITSAMQMVSSAKLVKSEQAARDFQVYASKIRQITTNLLKS    60
             MAGSLSEIK KI+ST+KTS IT AMQMVS+AKL KSEQAA+DFQVYASKIRQITT+LLKS
Sbjct:    1  MAGSLSEIKGKIISTQKTSHITGAMQMVSAAKLTKSEQAAKDFQVYASKIRQITTDLLKS    60

Query:   61  DLVSGSDNPMLSSRPVKKTGYIVITSDKGLVGGYNSKILKAMMDTITDYHTENDDYAIIS   120
             +LV+GS NPML++RPVKKTGYIVITSDKGLVGGYNSKILKAMMD I +YH ++ +YAII+
Sbjct:   61  ELVNGSKNPMLAARPVKKTGYIVITSDKGLVGGYNSKILKAMMDLIEEYH-QDGNYAIIA   119

Query:  121  IGSVGSDFFKARGMNVSFELRGLEDQPSFDQVGKIIAQAVEMYKNELFDELYVCYNHHVN   180
             IG +G+DFFKARGMNV FELRGLEDQPSF+QVG IIA++VEMYKNELFDELYVCYNHHVN
Sbjct:  120  IGGIGADFFKARGMNVVFELRGLEDQPSFEQVGNIIAKSVEMYKNELFDELYVCYNHHVN   179

Query:  181  SLTSQVRMQQMLPIKELDAEEASEDRVITGFELEPNREVILEQLLPQYTESLIYGAIIDA   240
             SLTSQVR+QQMLPI ELDA+EA+E+ V +GFELEPNRE+ILEQLLPQYTESLIYGAI+DA
Sbjct:  180  SLTSQVRVQQMLPIAELDADEAAEEGV-SGFELEPNREMILEQLLPQYTESLIYGAIVDA   238

Query:  241  KTAEHAAGMTAMQTATDNAKNVINDLTIQYNRARQAAITQEITEIVAGANALE          293
             KTAEHAAGMTAMQTATDNAKNVINDLTIQYNRARQAAITQEITEIVAGANALE
Sbjct:  239  KTAEHAAGMTAMQTATDNAKNVINDLTIQYNRARQAAITQEITEIVAGANALE          291
```

A related DNA sequence was identified in *S. pyogenes* <SEQ ID 4333> which encodes the amino acid sequence <SEQ ID 4334>. Analysis of this protein sequence reveals the following:

```
Possible site: 31
>>> Seems to have no N-terminal signal sequence
----- Final Results -----
   bacterial cytoplasm --- Certainty = 0.1969 (Affirmative) <succ>
      bacterial membrane --- Certainty = 0.0000 (Not Clear) <succ>
       bacterial outside --- Certainty = 0.0000 (Not Clear) <succ>
```

An alignment of the GAS and GBS proteins is shown below.

```
Identities = 251/293 (85%), Positives = 275/293 (93%), Gaps = 2/293 (0%)

Query:    1   MAGSLSEIKDKILSTEKTSKITSAMQMVSSAKLVKSEQAARDFQVYASKIRQITTNLLKS     60
              MAGSLSEIK KI+STEKTSKITSAM+MVSSAKLVKSEQAARDFQ+YASKIRQITT+LLKS
Sbjct:    1   MAGSLSEIKAKIISTEKTSKITSAMRMVSSAKLVKSEQAARDFQIYASKIRQITTDLLKS     60

Query:   61   DLVSGSDNPMLSSRPVKKTGYIVITSDKGLVGGYNSKILKAMMDTITDYHTENDDYAIIS    120
              +L  GSDNPML SRPVKKTGYIVITSDKGLVGGYNSKILK++MD IT+YH +  DY IIS
Sbjct:   61   ELTIGSDNPMLVSRPVKKTGYIVITSDKGLVGGYNSKILKSVMDMITEYHADG-DYEIIS    119

Query:  121   IGSVGSDFFKARGMNVSFELRGLEDQPSFDQVGKIIAQAVEMYKNELFDELYVCYNHHVN    180
              IGSVGSDFFKARGMNV+FELRGL DQPSF+QV +II+Q+V+M+ NE+FDELYVCYNHHVN
Sbjct:  120   IGSVGSDFFKARGMNVAFELRGLADQPSFEQVRQIISQSVDMFVNEIFDELYVCYNHHVN    179

Query:  181   SLTSQVRMQQMLPIKELDAEEASEDRVITGFELEPNREVILEQLLPQYTESLIYGAIIDA    240
              SLTSQVR+QQMLPI +L A+EA+E+ V TGFELEPNR  IL+QLLPQ+TESLIYGAIIDA
Sbjct:  180   SLTSQVRVQQMLPISDLVADEAAEEGV-TGFELEPNRHDILDQLLPQFTESLIYGAIIDA    238

Query:  241   KTAEHAAGMTAMQTATDNAKNVINDLTIQYNRARQAAITQEITEIVAGANALE         293
              KTAEHAAGMTAMQTATDNAKNVINDLTIQYNRARQAAITQEITEIVAGANALE
Sbjct:  239   KTAEHAAGMTAMQTATDNAKNVINDLTIQYNRARQAAITQEITEIVAGANALE         291
```

Based on this analysis, it was predicted that these proteins and their epitopes could be useful antigens for vaccines or diagnostics.

Example 1412

A DNA sequence (GBSx1497) was identified in *S. agalactiae* <SEQ ID 4335> which encodes the amino acid sequence <SEQ ID 4336>. Analysis of this protein sequence reveals the following:

```
Possible site: 25
>>> Seems to have no N-terminal signal sequence
----- Final Results -----
   bacterial cytoplasm --- Certainty = 0.1963 (Affirmative) <succ>
      bacterial membrane --- Certainty = 0.0000 (Not Clear) <succ>
       bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1413

A DNA sequence (GBSx1498) was identified in *S. agalactiae* <SEQ ID 4337> which encodes the amino acid sequence <SEQ ID 4338>. Analysis of this protein sequence reveals the following:

```
Possible site: 61
>>> Seems to have no N-terminal signal sequence
----- Final Results -----
   bacterial cytoplasm --- Certainty = 0.3146 (Affirmative) <succ>
      bacterial membrane --- Certainty = 0.0000 (Not Clear) <succ>
       bacterial outside --- Certainty = 0.0000 (Not Clear) <succ>
```

The protein is similar to the alpha subunit of the proton-translocating ATPase from *S. bovis*:

```
>GP:BAA23753 GB:AB009314 proton-translocating ATPase, alpha subunit
[Streptococcus bovis] Length = 501
Identities = 482/501 (96%), Positives = 497/501 (98%)

Query:    1   MAINAQEISALIKKQIEDFQPNFDVTETGIVTYIGDGIARARGLDNAMSGELLEFSNGAY     60
              MAINAQEISALIKKQIE+FQPNFDVTETG+VTYIGDGIARARGLDNAMSGELLEFSNGA+
Sbjct:    1   MAINAQEISALIKKQIENFQPNFDVTETGVVTYIGDGIARARGLDNAMSGELLEFSNGAF     60

Query:   61   GMAQNLESNDVGIIILGDFSEIREGDVVKRTGKIMEVPVGEAMIGRVVNPLGQPVDGLGE    120
              GMAQNLESNDVGIIILGDFS IREGD VERTGKIMEVPVGEA+IGRVVNPLGQPVDGLG+
Sbjct:   61   GMAQNLESNDVGIIILGDFSTIREGDEVKRTGKIMEVPVGEALIGRVVNPLGQPVDGLGD    120
```

-continued

```
Query:   121 IETTATRPVETPAPGVMQRKSVFEPLQTGLKAIDALVPIGRGQRELIIGDRQTGKTSVAI   180
             I+TTATRPVETPAPGVMQRKSV EPLQTGLKAIDALVPIGRGQRELIIGDRQTGKTSVAI
Sbjct:   121 IKTTATRPVETPAPGVMQRKSVSEPLQTGLKAIDALVPIGRGQRELIIGDRQTGKTSVAI   180

Query:   181 DAILNQKGQDMICIYVAIGQKESTVRTQVETLRKYGALDYTIVVTASASQPSPLLFIAPY   240
             DAILNQKGQDMICIYVAIGQKESTVRTQVETLRKYGALDYTIVVTASASQPSPLL+IAPY
Sbjct:   181 DAILNQKGQDMICIYVAIGQKESTVRTQVETLRKYGALDYTIVVTASASQPSPLLYIAPY   240

Query:   241 AGVAMAEEFMYNGKHVLIVYDDLSKQAVAYRELSLLLRRPPGREAYPGDVFYLHSRLLER   300
             AGVAMAEEFMYNGKHVLIVYDDLSKQAVAYRELSLLLRRPPGREAYPGDVFYLHSRLLER
Sbjct:   241 AGVAMAEEFMYNGKHVLIVYDDLSKQAVAYRELSLLLRRPPGREAYPGDVFYLHSRLLER   300

Query:   301 SAKVSDALGGGSITALPFIETQAGDISAYIATNVISITDGQIFLQENLFNSGIRPAIDAG   360
             SAKVSDALGGGSITALPFIETQAGDISAYIATNVISITDGQIFLQENLFNSGIRPAIDAG
Sbjct:   301 SAKVSDALGGGSITALPFIETQAGDISAYIATNVISITDGQIFLQENLFNSGIRPAIDAG   360

Query:   361 SSVSRVGGAAQIKAMKRVAGTLRLDLASYRELEAFTQFGSDLDAATQAKLNRGRRTVEVL   420
             SSVSRVGG+AQIKAMK+VAGTLRLDLASYRELEAFTQFGSDLDAATQAKLNRGRRTVEVL
Sbjct:   361 SSVSRVGGSAQIKAMKKVAGTLRLDLASYRELEAFTQFGSDLDAATQAKLNRGRRTVEVL   420

Query:   421 KQPLHKPLPVEKQVVILYALTHGFLDDVPVNDILAFEEALYDYFDAHYDNLFETIRTTKD   480
             KQP+HKPLPVEKQVVILYALTHGFLDDVPVNDILAFEEALYDYFDAHY+++FETIRTTKD
Sbjct:   421 KQPVHKPLPVEKQVVILYALTHGFLDDVPVNDILAFEEALYDYFDAHYESIFETIRTTKD   480

Query:   481 LPEEAELDAAIQAFKDQSQFK                                         501
             LPEE+ LDAAIQAFKDQS+FK
Sbjct:   481 LPEESVLDAAIQAFKDQSEFK                                         501
```

Possible site: 61
\>>> Seems to have no N-terminal signal sequence
----- Final Results -----
   bacterial cytoplasm --- Certainty = 0.3654 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

Based on this analysis, it was predicted that these proteins and their epitopes could be useful antigens for vaccines or diagnostics.

Example 1414

A DNA sequence (GBSx1499) was identified in *S. agalactiae* <SEQ ID 4341> which encodes the amino acid sequence <SEQ ID 4342>. Analysis of this protein sequence reveals the following:

```
Identities = 477/501 (95%), Positives = 490/501 (97%)

Query:     1 MAINAQEISALIKKQIEDFQPNFDVTETGIVTYIGDGIARARGLDNAMSGELLEFSNGAY    60
             +AINAQEISALIKKQIE+FQPNFDVTETGIVTYIGDGIARARGLDNAMSGELLEF NGAY
Sbjct:     1 LAINAQEISALIKKQIENFQPNFDVTETGIVTYIGDGIARARGLDNAMSGELLEFENGAY    60

Query:    61 GMAQNLESNDVGIIILGDFSEIREGDVVKRIGKIMEVPVGEAMIGRVVNPLGQPVDGLGE   120
             GMAQNLESNDVGIIILGDFS IREGDVVKRTGKIMEVPVGEA+IGRVVNPLGQPVDGLG+
Sbjct:    61 GMAQNLESNDVGIIILGDFSAIREGDVVKRTGKIMEVPVGEALIGRVVNPLGQPVDGLGD   120

Query:   121 IETTATRPVETPAPGVMQRKSVFEPLQTGLKAIDALVPIGRGQRELIIGDRQTGKTSVAI   180
             IETT  RPVETPAPGVMQRKSV EPLQTGLKAIDALVPIGRGQRELIIGDRQTGKTSVAI
Sbjct:   121 IETTGFRPVETPAPGVMQRKSVSEPLQTGLKAIDALVPIGRGQRELIIGDRQTGKTSVAI   180

Query:   181 DAILNQKGQDMICIYVAIGQKESTVRTQVETLRKYGALDYTIVVTASASQPSPLLFIAPY   240
             DAILNQKGQDMICIYVAIGQKESTVRTQVETLR+YGALDYTIVVTASASQPSPLLFIAPY
Sbjct:   181 DAILNQKGQDMICIYVAIGQKESTVRTQVETLRRYGALDYTIVVTASASQPSPLLFIAPY   240

Query:   241 AGVAMAEEFMYNGKHVLIVYDDLSKQAVAYRELSLLLRRPPGREAYPGDVFYLHSRLLER   300
             AGVAMAEEFMY GKHVLIVYDDLSKQAVAYRELSLLLRRPPGREAYPGDVFYLHSRLLER
Sbjct:   241 AGVAMAEEFMYQGKHVLIVYDDLSKQAVAYRELSLLLRRPPGREAYPGDVFYLHSRLLER   300

Query:   301 SAKVSDALGGGSITALPFIETQAGDISAYIATNVISITDGQIFLQENLFNSGIRPAIDAG   360
             SAKVSD LGGGSITALPFIETQAGDISAYIATNVISITDGQIFLQENLFNSGIRPAIDAG
Sbjct:   301 SAKVSDDLGGGSITALPFIETQAGDISAYIATNVISITDGQIFLQENLFNSGIRPAIDAG   360

Query:   361 SSVSRVGGAAQIKAMKRVAGTLRLDLASYRELEAFTQFGSDLDAATQAKLNRGRRIVEVL   420
             SSVSRVGG+AQIKAMK+VAGTLRLDLASYRELEAFTQFGSDLDAATQAKLNRGRRTVE+L
Sbjct:   361 SSVSRVGGSAQIKAMKKVAGTLRLDLASYRELEAFTQFGSDLDAATQAKLNRGRRTVEIL   420

Query:   421 KQPLHKPLPVEKQVVILYALTHGFLDDVPVNDILAFEEALYDYFDAHYDNLFETIRTTKD   480
             KQPLHKPLPVEKQVVILYALTHGFLDDVPV+DILAFEEALYDYFD HY++LFETIRTTKD
Sbjct:   421 KQPLHKPLPVEKQVVILYALTHGFLDDVPVDDILAFEEALYDYFDVHYNDLFETIRTTKD   480

Query:   481 LPEEAELDAAIQAFKDQSQFK                                         501
             LPEEA LDAAI+AFK+ S FK
Sbjct:   481 LPEEAALDAAIKAFKEHSNFK                                         501
```

Possible site: 55
>>> Seems to have no N-terminal signal sequence
----- Final Results -----
   bacterial cytoplasm --- Certainty = 0.1896 (Affirmative) <succ>
      bacterial membrane --- Certainty = 0.0000 (Not Clear) <succ>
         bacterial outside --- Certainty = 0.0000 (Not Clear) <succ>

The protein has homology with the following sequences in the GENPEPT database.

```
>GP:BAA23752 GB:AB009314 proton-translocating ATPase, delta subunit
[Streptococcus bovis]
Identities = 98/178 (55%), Positives = 127/178 (71%)

Query:    1  MNKKTQALIEQYSKSLVEVAIEHKIVEKIQQEVAALIDIFETSELEGVLSSLAVSHDEKQ    60
             M+KKTQAL+EQY+KSLVE+AIE   + ++Q E  AL+ +FE + L    LSSL VS DEK
Sbjct:    1  MDKKTQALVEQYAKSLVEIAIEKDSLAELQSETEALLSVFEETNLADFLSSLVVSRDEKV   60

Query:   61  HFVKTLQTSCSTYLVNFLEVIVQNEREALLYPILKSVDQELIKVNGQYPIQITTAVALSP   120
                V+  LQ S S Y+ NFLEVI+QNEREA L   IL+ V ++ +    Q+ I +TTAVAL+
Sbjct:   61  KLVRLLQESSSVYMNNFLEVILQNEREAFLKAILEGVQKDFVIATNQHDIVVTTAVALTD  120

Query:  121  EQKERLFDIAKTKLALPNGQLVEHIDPSIVGGFVVNANNKVIDASVRNQLHQFKMKLK    178
             EQKER+  +    K  +   G+LVE+ID SI+GGFV+N NNKVID S+R QL +FKM LK
Sbjct:  121  EQKERILALVAEKFGVKAGKLVENIDESILGGFVINVNNKVIDTSIRRQLQEFKMNLK   178
```

A related DNA sequence was identified in *S. pyogenes* <SEQ ID 4343> which encodes the amino acid sequence <SEQ ID 4344>. Analysis of this protein sequence reveals the following:

Possible site: 53
>>> Seems to have no N-terminal signal sequence
----- Final Results -----
   bacterial cytoplasm --- Certainty = 0.1668 (Affirmative) <succ>
      bacterial membrane --- Certainty = 0.0000 (Not Clear) <succ>
         bacterial outside --- Certainty = 0.0000 (Not Clear) <succ>

An alignment of the GAS and GBS proteins is shown below.

```
Identities = 86/178 (48%), Positives = 125/178 (69%)

Query:    1  MNKKTQALIEQYSKSLVEVAIEHKIVEKIQQEVAALIDIFETSELEGVLSSLAVSHDEKQ    60
             M KK QALIEQY+KSLVEVA EH  ++ +Q +V A+++ F T+ L+  LSS AV H EK
Sbjct:    1  MTKKEQALIEQYAKSLVEASEHHSLDALQADVLAILETFVTTNLDQSLSSQAVPHAEKI   60

Query:   61  HFVKTLQTSCSTYLVNFLEVIVQNEREALLYPILKSVDQELIKVNGQYPIQITTAVALSP   120
              +  L+ +  S Y+ NFL +I+QNEREA LY +L++V   E+   V+ QY + +T+++ L+
Sbjct:   61  KLLTLLKGNNSVYMNNFLNLILQNEREAYLYQMLQAVLNEIAIVSNQYDVTVTSSLPLTE  120

Query:  121  EQKERLFDIAKTKLALPNGQLVEHIDPSIVGGFVVNANNKVIDASVRNQLHQFKMKLK    178
             EQK R+       K A+  G+L+E +DPS++GGF+++  NNKVID S+R QL  FKM LK
Sbjct:  121  EQKSRVRAVVAKKFAVTAGRLIEKVDPSLIGGFIISVNNKVIDTSIRRQLQAFKMNLK   178
```

Based on this analysis, it was predicted that these proteins and their epitopes could be useful antigens for vaccines or diagnostics.

<SEQ ID 4346>. This protein is predicted to be ATP synthase b chain (atpF). Analysis of this protein sequence reveals the following:

Possible site: 33
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

The protein has homology with the following sequences in the GENPEPT database.

Example 1415

A DNA sequence (GBSx1500) was identified in *S. agalactiae* <SEQ ID 4345> which encodes the amino acid sequence

```
>GP:AAD13379 GB:U31170 ATPase, b subunit [Streptococcus mutans]
Identities = 103/165 (62%), Positives = 130/165 (78%)
```

```
-continued
Query:    1  MSILINSTTIGDIIIVSGSVLLLFILIKTFAWKQITGIFEAREQKIANDIDTAEQARQQA   60
             MS LIN T++G+++IV+GS +LL +L+K FAW Q+  IF+ RE+KIA DID AE +RQ A
Sbjct:    1  MSTLINGTSLGNLLIVTGSFILLLLLVKKFAWSQLAAIFKTREEKIAKDIDDAENSRQNA   60

Query:   61  EAFATKREEELSNAKTEANQIIDNAKETGLAKGDQIISEAKTEADRLKEKAHQDIAQNKA  120
             +    KR+ EL+ AK EA QIIDNAKETG A+  +II+EA  EA RLK+KA+QDIA +KA
Sbjct:   61  QVLENKRQVELNQAKDEAAQIIDNAKETGKAQESKIITEAHEEAGRLKDKANQDIATSKA  120

Query:  121  EALADVKGEVADLTVLLAEKIMVSNLDKEAQSNLIDSYIKKLGDA                165
             EAL+  VK +VADL+VLLAEKIM  NLDK AQ +LIDSY+  KLGDA
Sbjct:  121  EALSSVKADVADLSVLLAEKIMAKNLDKTAQGDLIDSYLDKLGDA                165
```

A related DNA sequence was identified in *S. pyogenes* <SEQ ID 4347> which encodes the amino acid sequence <SEQ ID 4348>. Analysis of this protein sequence reveals the following:

```
Possible site: 32
>>> Seems to have a cleavable N-term signal seq.
----- Final Results -----
   bacterial outside --- Certainty = 0.3000 (Affirmative) <succ>
   bacterial membrane --- Certainty = 0.0000 (Not Clear) <succ>
      bacterial cytoplasm --- Certainty = 0.0000 (Not Clear) <succ>
```

The protein has homology with the following sequences in the databases:

```
>GP:AAD13379 GB:U31170 ATPase, b subunit [Streptococcus mutans]
Identities = 88/159 (55%), Positives = 122/159 (76%)

Query:    6  GELVGNFILVTGSVIVLLLLIKKFAWGAIESILQTRSQQISRDIDQAEQSRLSAQQLEAK   65
             G +GN ++VTGS I+LLLL+KKFAW  + +I +TR ++I++DID AE SR +AQ LE K
Sbjct:    7  GTSLGNLLIVTGSFILLLLLVKKFAWSQLAAIFKTREEKIAKDIDDAENSRQNAQVLENK   66

Query:   66  SQANLDASRLQASKIISDAKEIGQLQGDKLVAEATDEAKRLKEKALTDIEQSKSDAISAV  125
             Q  L+ ++ +A++II +AKE G+ Q  K++ EA +EA RLK+KA  DI   SK++A+S+V
Sbjct:   67  RQVELNQAKDEAAQIIDNAKETGKAQESKIITEAHEEAGRLKDKANQDIATSKAEALSSV  126

Query:  126  KTEMSDLTVLLAEKIMGANLDKTAQSQLIDSYLDDLGEA                      164
             K +++DL+VLLAEKIM  NLDKTAQ  LIDSYLD LG+A
Sbjct:  127  KADVADLSVLLAEKIMAKNLDKTAQGDLIDSYLDKLGDA                      165
```

An alignment of the GAS and GBS proteins is shown below.

```
Identities = 81/156 (51%), Positives = 115/156 (72%)

Query:   10  IGDIIIVSGSVLLLFILIKTFAWKQITGIFEAREQKIANDIDTAEQARQQAEAFATKREE   69
             +G+ I+V+GSV++L +LIK FAW  I   I + R Q+I+ DID AEQ+R  A+    K +
Sbjct:    9  VGNFILVIGSVIVLLLLIKKFAWGAIESILQTRSQQISRDIDQAEQSRLSAQQLEAKSQA   68

Query:   70  ELSNAKTEANQIIDNAKETGLAKGDQIISEAKTEADRLKEKAHQDIAQNKAEALADVKGE  129
             L  ++ +A++II +AKE G  +GD++++EA  EA RLKEKA  DI Q+K++A++ VK E
Sbjct:   69  NLDASRLQASKIISDAKEIGQLQGDKLVAEATDEAKRLKEKALTDIEQSKSDAISAVKTE  128

Query:  130  VADLTVLLAEKIMVSNLDKEAQSNLIDSYIKKLGDA                         165
             ++DLTVLLAEKIM +NLDK AQS LIDSY+  LG+A
Sbjct:  129  MSDLTVLLAEKIMGANLDKTAQSQLIDSYLDDLGEA                         164
```

SEQ ID 4346 (GBS169) was expressed in *E. coli* as a His-fusion product. SDS-PAGE analysis of total cell extract is shown in FIG. 34 (lane 6; MW 18 kDa).

The GBS169-His fusion product was purified (FIG. 200, lane 11) and used to immunise mice. The resulting antiserum was used for Western blot (FIG. 250). These tests confirm that the protein is immunoaccessible on GBS bacteria.

Based on this analysis, it was predicted that these proteins and their epitopes could be useful antigens for vaccines or diagnostics.

Example 1416

A DNA sequence (GBSx1501) was identified in *S. agalactiae* <SEQ ID 4349> which encodes the amino acid sequence <SEQ ID 4350>. Analysis of this protein sequence reveals the following:

```
Possible site: 29
>>> Seems to have no N-terminal signal sequence
INTEGRAL    Likelihood = -11.73   Transmembrane 20-36 (14-42)
INTEGRAL    Likelihood = -5.20    Transmembrane 207-223 (206-228)
INTEGRAL    Likelihood = -4.35    Transmembrane 78-94 (73-97)
INTEGRAL    Likelihood = -4.09    Transmembrane 113-129 (113-133)
```

-continued

```
INTEGRAL    Likelihood = -2.39    Transmembrane 174-190 (174-190)
----- Final Results -----
   bacterial membrane --- Certainty = 0.5692 (Affirmative) <succ>
   bacterial outside --- Certainty = 0.0000 (Not Clear) <succ>
      bacterial cytoplasm --- Certainty = 0.0000 (Not Clear) <succ>
```

The protein has homology with the following sequences in the GENPEPT database.

```
>GP:BAA23750 GB:AB009314 proton-translocating ATPase, a subunit
[Streptococcus bovis]
Identities = 149/238 (62%), Positives = 180/238 (75%)

Query:    1  MESTSNPTVSFLGIDFDLTILAMSLLTITIIFILVFWASRKMTIKPKGKQNVLEYVYELV    60
             ME++ NPT    GI+FDLTILAMSLLT+ I F ++FWA+RKMT+KPKGKQN +EYVYE V
Sbjct:    1  METSVNPTAHVFGIEFDLTILAMSLLTVIISFGIIFWATRKMTLKPKGKQNFIEYVYEFV    60

Query:   61  NNTISQNLGHYTKNYSLLMFILFSFVFIANNLGLMTSLKTHEHNFWTSPTANFGVDITLS   120
               NTI  NLG YT  YSLLMF  F F+ IANNLGL+   L++ ++NFWTSPT+    VD T S
Sbjct:   61  QNTIKPNLGEYTPKYSLLMFTFFFFILIANNLGLLVKLESEDYNFWTSPTSTIMVDCTWS   120

Query:  121  LLVAFICHIEGIRKKGIGGYLKGFLSPTPAMLPMNLLEEVTNVASLALRLFGNIFSGEVV   180
             L+VA + H+EG+RKKG+   YLKG+LSP P MLPMN+LE+ TNV SLALRLFGNI++GEVV
Sbjct:  121  LIVAIVVHVEGVRKKGVKAYLKGYLSPFPMMLPMNILEQFTNVLSLALRLFGNIYAGEVV   180

Query:  181  TGLLLQLAVLSPFTGPLAFALNIVWTAFSMFIGFIQAYVFIILSSSYIGHKVHGDEEE     238
             T L++    S      P A ALN+ W AFS FIG IQAYVF ILSS YI  K+  DE+E
Sbjct:  181  TALIVGFGTKSLIFAPFALALNLAWVAFSAFIGCIQAYVFTILSSKYISEKLPEDEDE    238
```

A related DNA sequence was identified in *S. pyogenes* <SEQ ID 4351> which encodes the amino acid sequence <SEQ ID 4352>. Analysis of this protein sequence reveals the following:

Possible site: 33
>>> Seems to have a cleavable N-term signal seq.
INTEGRAL    Likelihood = −4.73    Transmembrane 79-95 (72-97)
INTEGRAL    Likelihood = −4.35    Transmembrane 115-131 (112-132)
INTEGRAL    Likelihood = −2.13    Transmembrane 200-216 (197-216)
----- Final Results -----
    bacterial membrane --- Certainty = 0.2890 (Affirmative) <succ>
    bacterial outside --- Certainty = 0.0000 (Not Clear) <succ>
    bacterial cytoplasm --- Certainty = 0.0000 (Not Clear) <succ>

A related GBS gene <SEQ ID 8803> and protein <SEQ ID 8804> were also identified. Analysis of this protein sequence reveals the following:

Lipop: Possible site: −1    Crend: 1
McG: Discrim Score: −3.50
GvH: Signal Score (−7.5): −3.36
Possible site: 29
>>> Seems to have no N-terminal signal sequence
ALOM program    count: 5 value: −11.73 threshold: 0.0
INTEGRAL    Likelihood = −11.73    Transmembrane 20-36 (14-42)
INTEGRAL    Likelihood = −5.20     Transmembrane 207-223 (206-228)
INTEGRAL    Likelihood = −4.35     Transmembrane 78-94 (73-97)
INTEGRAL    Likelihood = −4.09     Transmembrane 113-129 (113-133)
INTEGRAL    Likelihood = −2.39     Transmembrane 174-190 (174-190)
PERIPHERAL  Likelihood = 5.30      156
modified ALOM score: 2.85
*** Reasoning Step: 3
----- Final Results -----
    bacterial membrane --- Certainty = 0.5692 (Affirmative) <succ>
    bacterial outside --- Certainty = 0.0000 (Not Clear) <succ>
    bacterial cytoplasm --- Certainty = 0.0000 (Not Clear) <succ>

An alignment of the GAS and GBS proteins is shown below.

The protein has homology with the following sequences in the databases:

```
Identities = 124/239 (51%), Positives = 169/239 (69%), Gaps = 3/239 (1%)

Query:    1  MESTSNPTVSFLGIDFDLTILAMSLLTITIIFILVFWASRKMTIKPKGKQNVLEYVYELV    60
             ME   P +    I F+LT+LA+ ++TI I+F  VFWASR+M +KP+GKQ LEY+     V Sbjct:    1  MEEAKIPMLKLGPITFNLTLLAVCIVTIAIVFAFVFWASRQMKLKPEGKQTALEYLISFV    60

Query:   61  NNTISQNLGH-YTKNYSLLMFILFSFVFIANNLGLMTSLKT-HEHNFWTSPTANFGVDIT   118
             +    ++L H   K+YSLL+F +F FV +ANNLGL T L+T + +N WTSPTAN    D+

Sbjct:   61  DGIGEEHLDHNLQKSYSLLLFTIFLFVAVANNLGLFTKLETVNGYNLWTSPTANLAFDLA   120

Query:  119  LSLLVAFICHIEGIRKKGIGGYLKGFLSPTPAMLPMNLLEEVTNVASLALRLFGNIFSGE   178
             LSL +  + HIEG+R++G+  +LK   +P P M PMNLLEE TN  SLA+RLFGNIF+GE Sbjct:  121  LSLFITLMVHIEGVRRRGLVAHLKRLATPWP-MTPMNLLEEFTNFLSLAIRLFGNIFAGE   179

Query:  179  VVTGLLLQLAVLSPFTGPLAFALNIVWTAFSMFIGFIQAYVFIILSSSYIGHKVHGDEE    237
             VVTGL++QLA     +   P+AF +N+ WTAFS+FI  IQA+VF L+++Y+G KV   EE Sbjct:  180  VVTGLIVQLANYRVYWWPIAFLVNMAWTAFSVFISCIQAFVFTKLTATYLGKKVNESEE   238
```

```
ORF01818(301-1014 of 1314)
GP|2662321|dbj|BAA23750.1||AB009314(1-238 of 239) proton-translocating ATPase,
a subunit {Streptococcus bovis}
% Match = 35.0
% Identity = 62.2 % Similarity = 78.6
Matches = 148 Mismatches = 51 Conservative Sub.s = 39

204        234        264        294        324        354        384        414
XANCQTLMLPGVGFIERYFLRSICVYILSKIDDNLEKKEG*GLESTSNPTVSFLGIDFDLTILAMSLLTITIIFILVFWA
                                        :|::  |||     :||:||||||||||||:  | |  ::|||
                                        METSVNPTAHVFGIEFDLTILAMSLLTVIISFGIIFWA
                                                10         20         30

444        474        504        534        564        594        624        654
SRKMTIKPGKGKQNVLEYVYELVNNTISQNLGHYTKNYSLLMFILFSFVFIANNLGLMTSLKTHEHNFWTSPTANFGVDIT
:||||:||||||| :|||||:||||   ||| ||  ||||||  :| |::||||||:    |:: ::||||||||:   || |
TRKMTLKPKGKQNFIEYVYEFVQNTIKPNLGEYTPKYSLLMFTFFFFILIANNLGLLVKLESEDYNFWTSPTSTIMVDCT
           50         60         70         80         90        100        110

684        714        744        774        804        834        864        894
LSLLVAFICHIEGIRKKGIGGYLKGFLSPTPAMLPMNLLEEVTNVASLALRLFGNIFSGEVVTGLLLQLAVLSPFTGPLA
 ||:|| : |:||:||||:   ||||:|||  |  ||||:||: |||  ||||||||||::|||||  |:: :   |    |:|
WSLIVAIVVHVEGVRKKGVKAYLKGYLSPFPMMLPMNILEQFTNVLSLALRLFGNIYAGEVVTALIVGFGTKSLIFAPFA
          130        140        150        160        170        180        190

924        954        984       1014       1044       1074       1104       1134
FALNIVWTAFSMFIGFIQAYVFIILSSSYIGHKVHGDEEE*EKRGEICQYLLIVQRLVISLSYLALCFSYLS*LRLLHGN
:|||:  |  |||  |||  ||||||| ||||  ||   |:   ||:|
LALNLAWVAFSAFIGCIQAYVFTILSSKYISEKLPEDEDET
          210        220        230
```

Based on this analysis, it was predicted that these proteins and their epitopes could be useful antigens for vaccines or diagnostics.

Example 1417

A DNA sequence (GBSx1502) was identified in *S. agalactiae* <SEQ ID 4353> which encodes the amino acid sequence <SEQ ID 4354>. This protein is predicted to be ATP synthase c subunit (atpE). Analysis of this protein sequence reveals the following:

```
Possible site: 29
>>> Seems to have a cleavable N-term signal seq.
INTEGRAL    Likelihood = –4.62    Transmembrane 48-64 (42-65)
----- Final Results -----
   bacterial membrane --- Certainty = 0.2848 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the GENPEPT database.

```
>GP:BAA23749 GB:AB009314 proton-translocating ATPase, c subunit
[Streptococcus bovis]
Identities = 56/65 (86%), Positives = 59/65 (90%)
Query:   1 MNLAILALGFAVMGVSIGEGILVANIAKSAARQPEMFSKLQTLMFTGVAFIEGTFFVLFA   60
           +NL ILALG AV+GVS+GEGILVANIAKSAARQPEMFSKLQTLMF GVAFIEGTFFVL A
Sbjct:   2 LNLKILALGLAVLGVSLGEGILVANIAKSAARQPEMFSKLQTLMFLGVAFIEGTFFVLLA   61

Query:  61 FTFLV                                                         65
           TF V
Sbjct:  62 STFFV                                                         66
```

A related DNA sequence was identified in *S. pyogenes* <SEQ ID 4355> which encodes the amino acid sequence <SEQ ID 4356>. Analysis of this protein sequence reveals the following:

Possible site: 17
>>> Seems to have a cleavable N-term signal seq.
INTEGRAL      Likelihood = –5.26     Transmembrane 47-63 (41-64)
----- Final Results -----
    bacterial membrane --- Certainty = 0.3102 (Affirmative) <succ>
      bacterial outside --- Certainty = 0.0000 (Not Clear) <succ>
        bacterial cytoplasm --- Certainty = 0.0000 (Not Clear) <succ>

The protein has homology with the following sequences in the databases:

```
>GP:AAD00920 GB:AF001955 UncE [Streptococcus sanguinis]
Identities = 50/66 (75%), Positives = 58/66 (87%), Gaps = 1/66 (1%)
Query:   1 MNPIF-ALALACFGVSLAEGFLMANLFKAASRQPEIIGQLRSLMILGVAFIEGTFFVTLV  59
            MN  F  L  ACFGVS+AEG +M+NLFKAASRQPEIIGQLRSL+ILG+AF+EGTFFVTL
Sbjct:   1 MNLTFLGLCFACFGVSIAEGLIMSNLFKAASRQPEIIGQLRSLLILGIAFVEGTFFVTLA  60

Query:  60 MAFILK                                                       65
            MAF++K
Sbjct:  61 MAFVIK                                                       66
```

An alignment of the GAS and GBS proteins is shown below.

```
Identities = 33/62 (53%), Positives = 45/62 (72%)
Query:  5 ILALGFAVMGVSIGEGILVANIAKSAARQPEMFSKLQTLMFTGVAFIEGTFFVLFAFTFLVR  66
           I AL  A  GVS+ EG L+AN+ K+A+RQPE+   +L++LM  GVAFIEGTFFV     F+++
Sbjct:  4 IFALALACFGVSLAEGFLMANLFKAASRQPEIIGQLRSLMILGVAFIEGTFFVTLVMAFILK  65
```

Based on this analysis, it was predicted that these proteins and their epitopes could be useful antigens for vaccines or diagnostics.

Example 1418

A DNA sequence (GBSx1503) was identified in S. agalactiae <SEQ ID 4357> which encodes the amino acid sequence <SEQ ID 4358>. Analysis of this protein sequence reveals the following:

Possible site: 47
>>> Seems to have no N-terminal signal sequence
----- Final Results -----
    bacterial cytoplasm --- Certainty = 0.2562 (Affirmative) <succ>
      bacterial membrane --- Certainty = 0.0000 (Not Clear) <succ>
        bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1419

A DNA sequence (GBSx1504) was identified in S. agalactiae <SEQ ID 4359> which encodes the amino acid sequence <SEQ ID 4360>. This protein is predicted to be bacterial glycogen synthase (gigA). Analysis of this protein sequence reveals the following:

Possible site: 16
>>> Seems to have no N-terminal signal sequence
----- Final Results -----
    bacterial cytoplasm --- Certainty = 0.1574 (Affirmative) <succ>
      bacterial membrane --- Certainty = 0.0000 (Not Clear) <succ>
        bacterial outside --- Certainty = 0.0000 (Not Clear) <succ>

The protein has homology with the following sequences in the GENPEPT database.

```
>GP:BAA19591 GB:D87026 bacterial glycogen synthase [Bacillus
stearothermophilus]
Identities = 220/475 (46%), Positives = 312/475 (65%), Gaps = 1/475 (0%)
Query:    1 MKIMFVAAEGAPFAKTGGLGDVIGALPKSLSKKGHDVAVVMPYYDMVDQKFGDQIENLMY   60
             MK++F   +E  APFAK+GGL DV GALPK L + G D   V++P Y+ +   ++  +++ +
Sbjct:    1 MKVLFAVSECAPFAKSGGLADVAGALPKELRRLGIDARVMLPKYETIAPEWKKKMKKVAE   60

Query:   61 FYTDVGWRHQYVGVKRLSQDNVTFYFIDNQYYFYRGHVYGDWDDGERFAYFQLAALELME  120
                VGWR  QY GV+ L   D V +YFIDN+YYF R   +YG +DDGERFAYF  A LE++
Sbjct:   61 LIVPGWRRQYCGVEELRHDGVIYYFIDNEYYFKRPQLYGHYDDGERFAYFCRAVLEVLP  120

Query:  121 KIDFIPDVLHVHDYHTAMIPFLLKEKYHWIQAYNNIRAVFTIHNIEFQGQFGPEMLGDLF  180
             +I F  PDV+H  HD+HT M+PFLL+E+Y       Y ++R VFTIHN++FQG F    +L DL
Sbjct:  121 EIQFQPDVIHCHDWHTGMVPFLLREQYRHELFYVDMRTVFTIHNLQFQGLFPRGILEDLL  180

Query:  181 GVGAERYEDGILRWNNCLNWMKAAILYSDRVTTVSPSYANEIKTPEFGKGLDQIMRMEAG  240
              +     +      L +  C+++MK A++  SD  +TTVSP+Y   EI+T   +G+   LD  ++R
Sbjct:  181 NLDGRYFTVDHLEFYGCVSFMKGALVASDLITTVSPTYKEEIQTAYYGERLDGLLRARRD  240
```

```
-continued
Query: 241 KLSGIVNGIDSDLLNPETDAFLPYHFSKSNLEGKIKNKLALQENLGLPQDKNVPLIGIVS 300
            L GI+NGID +  NPE D FL   +S     E K  NK ALQ    GLP+ +VPLI +V+
Sbjct: 241 DLLGILNGIDDEFYNPEADPFLTATYSVHTRERKQLNKRALQRQFGLPEWDDVPLIAMVT 300

Query: 301 RLTDQKGFDIIASELDNMLQQDIQMVILGTGYHHFEETFSYFASRYPEKLSANITFDLRL 360
            R+T QKG D++         M+ +D+Q+V+LGTG   FE+ FS  A+ YP K+   I F   L
Sbjct: 301 RMTAQKGLDLVTCVFHEMMSEDMQLVVLGTGDWRFEQFFSQMAAAYPGKVGVYIGFHEPL 360

Query: 361 AQQIYAASDIFMMPSAFEPCGLSQMMAMRYGSLPLVHEVGGLKDTVVAFNQFDGSGTGFS 420
            A QIYA +D+F++PS FEPCGLSQM+A+RYG++P+V E GGL DTV ++N+    G GFS
Sbjct: 361 AHQIYAGADLFLIPSLFEPCGLSQMIALRYGTIPIVRETGGLNDTVQSYNEITKEGNGFS 420

Query: 421 FNHFSGYWLMQTLKLALEVYNDYPEAWKKLQWQAMSKDFSWDTACVAYEQLYQQL     475
            F +F+ + ++ T++ AL Y    P  W++L  +AM  D+SW  +    Y+Q Y+QL
Sbjct: 421 FTNFNANDMLYTIRRALSFYRQ-PSVWEQLTERAMRGDYSWRRSANQYKQAYEQL     474
```

No corresponding DNA sequence was identified in *S. pyogenes*.

Based on this analysis, it was predicted that this protein and its epitopes, could be useful antigens for vaccines or diagnostics.

Example 1420

A DNA sequence (GBSx1505) was identified in *S. agalactiae* <SEQ ID 4361> which encodes the amino acid sequence <SEQ ID 4362>. This protein is predicted to be a subunit of ADP-glucose pyrophosphorylase. Analysis of this protein sequence reveals the following:

---

Possible site: 14
>>> Seems to have no N-terminal signal sequence
----- Final Results -----
  bacterial cytoplasm --- Certainty = 0.3492 (Affirmative) <succ>
    bacterial membrane --- Certainty = 0.0000 (Not Clear) <succ>
      bacterial outside --- Certainty = 0.0000 (Not Clear) <succ>

---

The protein has homology with the following sequences in the GENPEPT database.

```
>GP:BAA19590 GB:D87026 subunit of ADP-glucose pyrophosphorylase
[Bacillus stearothermophilus]
Identities = 59/178 (33%), Positives = 111/178 (62%), Gaps = 1/178 (0%)
Query:  37 SAEIYVIDTPWLIEKMEEEAQNNEPRKLRFLLRDLIVESNALAFEYTGYLSNISSIKSYY  96
            S  E+Y+++T L++ + +  +N+      +  ++RD      +EY+GY + I S++ Y+
Sbjct: 157 SLEMYLLETSLLLDLIADY-KNEGYYSIVDVIRDYHRSLSICEYEYSGYAAVIDSVEQYF 215

Query:  97 DANMDMLTPNKFYSLFFSNQKVYTKVENEEATYFDKQSNVSNSQLASGSIIKGYLDHSIV 156
            ++M++L  + +   LF +    +YTKVK+E  T + ++ NV   S +A+G +I+G +++S++
Sbjct: 216 RSSMELLDRDVWEQLFLPSHPIYTKVKDEPPTKYGREGNVKRSMIANGCVIEGTVENSVL 275

Query: 157 SRNCLLEKGTRVVNSIIFPKVKIGEGATIENTIIDKCVKVASGVTLKGSLDKPLVIPK   214
            R+   + KG  V NSII  K +IG+G ++   IIDK   KV   GV LKG+ ++P ++ K
Sbjct: 276 FRSVKIGKGAVVRNSIIMQKCQIGDGCVLDGVIIDKDAKVEPGVVLKGTKEQPFIVRK   333
```

No corresponding DNA sequence was identified in *S. pyogenes*.

Based on this analysis, it was predicted that this protein and its epitopes, could be useful antigens for vaccines or diagnostics.

Example 1421

A DNA sequence (GBSx1506) was identified in *S. agalactiae* <SEQ ID 4363> which encodes the amino acid sequence <SEQ ID 4364>. This protein is predicted to be subunit of ADP-glucose pyrophosphorylase (glgC-1). Analysis of this protein sequence reveals the following:

```
Possible site: 32
>>> Seems to have an uncleavable N-term signal seq
----- Final Results -----
    bacterial membrane --- Certainty = 0.0000 (Not Clear) <succ>
      bacterial outside --- Certainty = 0.0000 (Not Clear) <succ>
        bacterial cytoplasm --- Certainty = 0.0000 (Not Clear) <succ>
```

A related GBS nucleic acid sequence <SEQ ID 9765> which encodes amino acid sequence <SEQ ID 9766> was also identified.

The protein has homology with the following sequences in the GENPEPT database.

```
>GP:BAA19589 GB:D87026 subunit of ADP-glucose pyrophosphorylase
[Bacillus stearothermophilus]
Identities = 195/352 (55%), Positives = 259/352 (73%)
Query:   7  MKNEMLALILAGGQGTRLGKLTQSIAKPAVQFGGRYRIIDFALSNCANSGINNVGVITQY    66
            MK + +A++LAGGQG+RL  LT +IAKPAV FGG+YRIIDF LSNC NSGI+ VGV+TQY
Sbjct:   1  MKKKCIAMLLAGGQGSRLRSLTTNIAKPAVPFGGKYRIIDFTLSNCTNSGIDTVGVLTQY    60

Query:  67  QPLELNTHIGNGSSWGLDGIDSGVTVLQPYSATEGNRWFQGTSHAIYQNIDYIDRINPEY   126
            QPL L+++IG GS+W LD  + GVTVL PYS + G +W++GT++A+YQNI+YI++ NP+Y
Sbjct:  61  QPLLLHSYIGIGSAWDLDRRNGGVTVLPPYSVSSGVKWYEGTANAVYQNINYIEQYNPDY   120

Query: 127  VLILSGDHIYKMNYDDMLQTHKDNLASLTVAVLDVPLKEASRFGIMNTDSNDRIVEFEEK   186
            VL+LSGDHIYKM+Y  ML H  A +T++V++VP +EASRFGIMNT+    IVEF EK
Sbjct: 121  VLVLSGDHIYKMDYQHMLDYHIAKQADVTISVIEVPWEEASRFGIMNTNEEMEIVEFAEK   180

Query: 187  PEHPKSTKASMGIYIFDWKRLRTVLIDGEKNGIDMSDFGKNVIPAYLESGERVYTYNFDG   246
            P  PKS ASMGIYIF+W L+ L    N     DFGK+VIP L   +R + Y F+G
Sbjct: 181  PAEPKSNLASMGIYIFNWPLLKQYLQIDNANPHSSHDFGKDVIPMLLREKKRPFAYPFEG   240

Query: 247  YWKDVGTIESLWEANMEYIGEDNKLHSRDRSWKIYSKNLIAPPNFMTEDANVKDSLVVDG   306
            YWKDVGT++SLWEANM+ + E+N+L    DRSW+IYS N   PP +++ +A V DSLV +G
Sbjct: 241  YWKDVGTVKSLWEANMDLLDENNELDLFDRSWRIYSVNPNQPPQYISPEAEVSDSLVNEG   300

Query: 307  CFVAGNVEHSILSTNVQVKPNAIIKDSFVMSGATIGEGAKINRAIIGEDAVI          358
            C V G VE S+L   V++   A++K+S +M GA + EGA + RAI+  D++I
Sbjct: 301  CVVEGTVERSVLFQGVRIGKGAVVKESVIMPGAAVSEGAYVERAIVTPDSII          352
```

There is also homology to SEQ ID 2660.

Based on this analysis, it was predicted that these proteins and their epitopes could be useful antigens for vaccines or diagnostics.

Example 1422

A DNA sequence (GBSx1507) was identified in *S. agalactiae* <SEQ ID 4365> which encodes the amino acid sequence <SEQ ID 4366>. Analysis of this protein sequence reveals the following:

```
Possible site: 37
>>> Seems to have no N-terminal signal sequence
----- Final Results -----
    bacterial cytoplasm --- Certainty = 0.2844 (Affirmative) <succ>
      bacterial membrane --- Certainty = 0.0000 (Not Clear) <succ>
        bacterial outside --- Certainty = 0.0000 (Not Clear) <succ>
```

The protein has homology with the following sequences in the GENPEPT database.

```
>GP:CAA78440 GB:Z14057 1,4-alpha-glucan branching enzyme [Bacillus
caldolyticus]
Identities = 272/616 (44%), Positives = 371/616 (60%), Gaps = 14/616 (2%)
Query:   6  ELYTFGIGENFHLQNYLGVHSENGSFC----FRVWAPNAENVQVIGDFTDWRNRPLQMNK    61
            E+Y F G +    GH  G         F VWAP+A V+++G F DW     + K
Sbjct:  10  EVYLFHEGRLYQSYELFGAHVIRGGGAVGTRFCVWAPHAREVRLVGSFNDWNGTNSPLTK    69
```

-continued

```
Query:  62  -NQAGVWEANSLDAREGDLYKYLVTRKGGQVVEKIDPMAVYMERRPGTASVIKVLRNKRW  120
              N  GVW     + EG LYKY +      G+V+ K DP A Y  ERP TAS++  L+  +W
Sbjct:  70  VNDEGVWTIVVPENLEGHLYKYEITTPDGRVLLKADPYAFYSELRPHTASIVYDLKGYEW  129

Query: 121  EDGLWMGRRKRLGFQKRPINIYEVHAGSWKKDDFGHPMTFSQLKDYLIPYLVEMNYTHVE  180
              D W  +++R     +P+ IYE+H GSWKK      G    T+ ++ D LIPY++E  +TH+E
Sbjct: 130  NDSPWQRKKRRKRIYDQPMVIYELHFGSWKKKPDGRFYTYREMADELIPYVLERGFTHIE  189

Query: 181  FMPLMAHPLDMSWGYQLMGYFAFEHTYGTPEEFQDFVEACHKNNIGVLVDWVPGHFIQND  240
              +PL+ HPLD SWGYQ  GY++        YGTP  +F  FV+ CH+    +GV++DMVPGHF ++
Sbjct: 190  LLPLVEHPLDRSWGYQGTGYYSVTSRYGTPHDFMYFVDRCHQAGLGVIIDWVPGHFCKDA  249

Query: 241  DALAYFDGTATYEYQNHDRAHNYRWGALNFDLGKNQVQSFLISSALFWIEHYHIDGIRVD  300
                  L  FDG   TYEY N      NY WG   NFDLGK +V+SFLIS+ALFW+E+YH+DG RVD
Sbjct: 250  HGLYMFDGAPTYEYANEKDRENYVWGTANFDLGKPEVRSFLISNALFWLEYYHVDGFRVD  309

Query: 301  AVSNMLYLDYDEGPWEANQFGDNRNLEGYHFLRKLNKVIKERHPNVMMIAEESTASTPIT  360
              AV+ NMLY  ++  +E       N       FLR+LN+ +      PNV MIAE+ST      +T
Sbjct: 310  AVANMLYWPNNDRLYE--------NPYAVEFLRQLNEAVFAYDPNVWMIAEDSTDWPRVT  361

Query: 361  KDLESGGLGFDFKWNMGWMNDILRFYEEDPLYRQYDFNLVTFSFMYIFNENFVLAFSHDE  420
                   GGLGF++KWNMGWMND+L++     E   P   R+Y   N V+FS  +Y ++ENF+L FSHDE
Sbjct: 362  APTYDGGLGENYRNNMGWMNDMLKYMETPPHERKYAHNQVSFSLLYAYSENFILPFSHDE  421

Query: 421  VVHGKKSMMHKMWGDRYNQFAGLRNLYAYQMCHPGKKLLFMGSEFGQFLEWKYNDQLEWE  480
              VVHGKKS+++KM  G        +FA LR  LY  Y M HPGKKLLFMGSEF QF EWK  ++L+W
Sbjct: 422  VVHGKKSLLNKMPGSYEEKFAQLRLLYGYMMAHPGKKLLFMGSEFAQFDEWKFAEELDWV  481

Query: 481  NLNDDMNQKMQRYTKQLNQFYKDHKCLWRIDDSFDGLEIIDADNKSETVLSFIRKDDK-G  539
              +  ++++KM  Y KQL   YK +K  + +D    G E ID  N   +++ SFIR+  K G
Sbjct: 482  LFDFELHRKMDEYVKQLIACYKRYKPFYELDHDPRGFEWIDVHNAEQSIFSFIRRGKKEG  541

Query: 540  DLLLCVFNMTPVERPNFTIGVPQAGIYEEVLNTEMEEFGGVWKNHNPVTKTQVATWKDYD  599
              D+L+ V N T      ++ + VP     Y EVLN++ EFGG  +          +
Sbjct: 542  DVLVIVCNFTNQAYDDYKVSVPLLAPYREVLNSDAAEFGGSGHVNGKRLPAFSEPFHGKP  601

Query: 600  HTLSFTLPALGASVWR                                             615
              + +   T+P   G S+  R
Sbjct: 602  YHVRMTIPPFGISILR                                             617
```

Based on this analysis, it was predicted that this protein and its epitopes, could be useful antigens for vaccines or diagnostics.

Example 1423

A DNA sequence (GBSx1508) was identified in *S. agalactiae* <SEQ ID 4367> which encodes the amino acid sequence <SEQ ID 4368>. This protein is predicted to be pullulanase (pulA). Analysis of this protein sequence reveals the following:

Possible site: 45
>>> Seems to have no N-terminal signal sequence
----- Final Results -----
    bacterial cytoplasm --- Certainty = 0.3194 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database.

```
>GP:AAC44685 GB:U67061 pullulanase [Bacteroides thetaiotaomicron]
Identities = 223/597 (37%), Positives = 331/597 (55%), Gaps = 55/597 (9%)
Query: 139  EYSETKTAFRLWAPTAERVELILYHSTDETASVSKVLSMKRGTAVNYKNHKENTHGVWFT  198
              EY+    T F LW+PTA+ V L+LY +  E         + +M+ G              G W
Sbjct:  46  EYTPEATKFTLWSPTADEVRLMLYEA-GEGGHAYETVKMQSGE-----------EGTWTA  93

Query: 199  ELEGNYNYQAYTYRVYYRRRTFKITRDPYSIATTANGKRSIVIAPEALTPEGFKISHGKE  258
              +   +     + YT+ V   +      T    + A    NGKR+  +I   ++  P+G++       +
Sbjct:  94  VVSKDLIGKFYTFNVKIDDKWQGDTPGINARAVGVNGKRAAIIDWQSTNPDGWE----SD  149

Query: 259  AKWRLENPNQAVIYEMHVRDFSISETSGVKTDYHGKFKGLHQKGTVNQHGDKTTFDYVQD  318
              +  L++P   +IYEMH RDFS+    TSGVK    GK+   L +  GT+N       T  D++ +
Sbjct: 150  TRPPLKSPADMIIYEMHHRDFSVDSTSGVKNK--GKYLALTEHGTMNSDKLLTGIDHLIE  207

Query: 319  LGVNYIQLQPIFDHHQTFDDD-GHYAYNWGYDPENYNVPEASFSSNPHEPATRILELKSA  377
              LGV ++ L P FD+        +         +YNWGYDP+NYNVP   S++++P++PATR+  E K
Sbjct: 208  LGVTHVHLLPSFDYASVDETRLNENSYNWGYDPQNYNVPDGSYATDPYQPATRVKEFKQM  267

Query: 378  IQAYHDAGIGVIMDVVYNHTFSSTDSAFQLTVPDYYYRMNHNGTFQNGSGCGNETASEKE  437
              +QA H AGI VIMDVVYNHTF++  +S F+   TVP Y+YR   +  T NGSGCGNETASE+
Sbjct: 268  VQALHKAGIRVIMDVVYNHTFNTDESNFERTVPGYFYRQKEDKTLANGSGCGNETASERL  327
```

```
                              -continued
Query: 438  MCRKYILDSVLYWVKEYNIDGFRFDLMGLHDVETMNIIRNELNKIDPRILVYGEGWDMGA  497
            M RK++++SVLYW+KEY++DGFRFDLMG+HD+ETMN IR  +N +DP I +YGEGW   A
Sbjct: 328  MMRKFMVESVLYWIKEYHVDGFRFDLMGIHDIETMNEIRKAVNAVDPTICIYGEGWAAEA  387

Query: 498  GLTPQNK-AKKDNAYQMPGIGFFNDDVRDAV---KGAEIYGEFKKGLVSGNSTEDIVAKG  553
               P  +  A K N  Q+PG+  F+D++RD +    G +  GF G+  G   E V  G
Sbjct: 388  PQYPADSLAMKGNIAQIPGVAVFSDELRDGLCGPVGDKRKGAFLAGIPGG---EMSVKFG  444

Query: 554  ILGSDE-------LVSYI------DPSQVLNYVEAHDNYNLNDLLWELHPNDNEKQHIYR  600
            I G+ E        V+Y        P Q+++YV HD   L D L   P+    +Q I
Sbjct: 445  IAGAIEHPQVQCDSVNYTQKPWAKQPVQMISYVSCHDGLCLVDRLKASMPDITPEQLIRL  504

Query: 601  VEVASAMNLLMQGMAFMQLGQEFLRTKCYPTGDKGQLTQADKERAMNSYNAPDQVNQVNW  660
             ++A A+     QG+ F+  G+E +R              DK+    NSY +PD VN ++W
Sbjct: 505  DKLAQAVVFTSQGIPFIYAGEEIMR---------------DKQGVDNSYKSPDAVNAIDW  549

Query: 661  DNVTFHKSTINFIRKIITLKTNSPYFSYSSFEEIRKHVFVESAQYHSGFISFTVEEH     717
              T       + +++I L+ + P F       ++RKH+      + S  I+F +++H
Sbjct: 550  RRKTTSADVFMYYKRLIDLRKSHPAFRMGDAGQVRKHLEFLPVE-GSNLIAFRLKDH     605
```

Based on this analysis, it was predicted that this protein and its epitopes, could be useful antigens for vaccines or diagnostics.

Example 1424

A DNA sequence (GBSx1509) was identified in *S. agalactiae* <SEQ ID 4369> which encodes the amino acid sequence <SEQ ID 4370>. Analysis of this protein sequence reveals the following:

---

Possible site: 40
>>> Seems to have no N-terminal signal sequence
----- Final Results -----
    bacterial cytoplasm --- Certainty = 0.2368 (Affirmative) <succ>
    bacterial membrane --- Certainty = 0.0000 (Not Clear) <succ>
    bacterial outside --- Certainty = 0.0000 (Not Clear) <succ>

---

The protein has homology with the following sequences in the GENPEPT database.

A related DNA sequence was identified in *S. pyogenes* <SEQ ID 4371> which encodes the amino acid sequence <SEQ ID 4372>. Analysis of this protein sequence reveals the following:

---

Possible site: 40
>>> Seems to have no N-terminal signal sequence
----- Final Results -----
    bacterial cytoplasm --- Certainty = 0.2501 (Affirmative) <succ>
    bacterial membrane --- Certainty = 0.0000 (Not Clear) <succ>
    bacterial outside --- Certainty = 0.0000 (Not Clear) <succ>

---

An alignment of the GAS and GBS proteins is shown below.

```
>GP:CAB12492 GB:Z99107 similar to hypothetical proteins [Bacillus subtilis]
Identities = 151/293 (51%), Positives = 193/293 (65%), Gaps = 5/293 (1%)
Query:   5  KKARLIYNPTSGQEIMKKNVAEVLDILEGFGYETSAFQTTPTKNSARDEATRAAQAGFDL   64
            K+AR+IYNPTSG+EI KK++A+VL   E  GYETS   TT    A   A  AA    FDL
Sbjct:   2  KRARIIYNPTSGREIFKKHLAQVLQKFEQAGYETSTHATT-CAGDATHAAKEAALREFDL   60

Query:  65  IVAAGGDGTINEVVNGIAPLKRRPKMAIIPTGTTNDFARALKIPRGNPIEATKLIGKNQI  124
            I+AAGGDGTINEVVNG+APL  RP + +IP GTTNDFARAL IPR + ++A      +
Sbjct:  61  IIAAGGDGTINEVVNGLAPLDNRPTLGVIPVGTTNDFARALGIPREDILKAADTVINGVA  120

Query: 125  VKMDIGQAQEDNYFINIAAAGSLTELTYSVPSQLKTTFGYLAYLAKGVELLPRVRKVPVK  184
             +DIGQ      YFINIA  G  LTELTY VPS+LKT   G LAY   KG+E+LP +R    V+
Sbjct: 121  RPIDIGQVN-GQYFINIAGGGELTELTYDVPSKLKTMLGQLAYYLKGMEMLPSLRPTEVE  179

Query: 185  ITHDKGEFIGDASMIFVAITNSVGGFEQIAPDAKLDDGKFTLILVKTANLIEIMHLIRLV  244
            I +D    F G+ +   V +TNSVGGFE++APD+ L+DG F L+++K ANL E + +   +
Sbjct: 180  IEYDGKLFQGEIMLFLVTLTNSVGGFEKLAPDSSLNDGMFDLMILKKANLAEFIRVATMA  239

Query: 245  LAGGKHINDERVEYIKTSYLTIEPLSDERMMINLDGEYGGDAPITLANLKNHI         297
            L  G+HIND+ + Y K + +     E+M +NLDGEYGG  P    NL  HI
Sbjct: 240  LR-GEHINDQHIIYTKANRVKVN--VSEKMQLNLDGEYGGMLPGEFVNLYRHI         289
```

```
Identities = 272/334 (81%), Positives = 300/334 (89%)
Query:   1  MKKQKKARLIYNPTSGQEIMKKMVAEVLDILEGFGYETSAFQTTPTKNSARDEATRAAQA   60
            MKKQ +ARLIYNPTSGQE+M+K+V EVLDILEGFGYETSAFQTT  KNSA +EA RAA+A
Sbjct:   1  MKKQLRARLIYNPTSGQELMRKSVPEVLDILEGFGYETSAFQTTAQKNSALNEARRAAKA   60

Query:  61  GFDLIVAAGGDGTINEVVNGIAPLKARPKMAIIPTGTTNDFARALKIPRGNPIEATKLIG  120
            GFDL++AAGGDGTINEVVNGIAPLK+RPKMAIIPTGTTNDFARALK+PRGNP +A KLIG
Sbjct:  61  GFDLLIAAGGDGTINEVVNGIAPLKNRPKMAIIPTGTTNDFARALKVPRGNPSQAAKLIG  120

Query: 121  KNQIVKMDIGQAQEDNYFINIAAAGSLTELTYSVPSQLKTTFGYLAYLAKGVELLPRVRK  180
            KNQ ++MDIG+A++D YFINIAAAGSLTELTYSVPSQLKT FGYLAYLAKGVELLPRV
Sbjct: 121  KNQTIQMDIGRAKKDTYFINIAAAGSLTELTYSVPSQLKTMFGYLAYLAKGVELLPRVSN  180

Query: 181  VPVKITHDKGEFIGDASMIGVAITNSVGGFEQIAPDAKLDDGKFTLILVKTANLIEIMHL  240
            VPVKITHDKG F G  SMIF AITNSVGGFE IAPDAKLDDG FTLIL+KTANL EI+HL
Sbjct: 181  VPVKITHDKGVFEGQVSMIFAAITNSVGGFEMIAPDAKLDDGMFTLILIKTANLFEIVHL  240

Query: 241  IRLVLAGGKHINDKRVEYIKTSYLTIEPLSDERMMINLDGEYGGDAPITLANLKNHIRFF  300
            +RL+L GGKHI D+RVEYIKTS + IEP  +RMMINLDGEYGGDAPITL NLKNHI FF
Sbjct: 241  LRLILDGGKHITDRRVEYIKTSKIVIEPQCGKRMMINLDGEYGGDAPITLENLKNHITFF  300

Query: 301  ANTDEISDDALVLDKDELAIEAIAQKFANEVDDL                           334
            A+TD ISDDALVLD+DEL IE I +KFA+EV+DL
Sbjct: 301  ADTDLISDDALVLDQDELEIEEIVKKFAHEVEDL                           334
```

Based on this analysis, it was predicted that these proteins and their epitopes could be useful antigens for vaccines or diagnostics.

Example 1425

A DNA sequence (GBSx1510) was identified in *S. agalactiae* <SEQ ID 4373> which encodes the amino acid sequence <SEQ ID 4374>. This protein is predicted to be DNA ligase (ligA-1). Analysis of this protein sequence reveals the following:

---
Possible site: 16
>>> Seems to have no N-terminal signal sequence

---

INTEGRAL    Likelihood = –0.27    Transmembrane 363-379 (363-379)

----- Final Results ----- bacterial membrane --- Certainty = 0.1107 (Affirmative) <succ>
bacterial outside --- Certainty = 0.0000 (Not Clear) <succ>
bacterial cytoplasm --- Certainty = 0.0000 (Not Clear) <succ>

---

A related GBS nucleic acid sequence <SEQ ID 9763> which encodes amino acid sequence <SEQ ID 9764> was also identified.

The protein has homology with the following sequences in the GENPEPT database.

```
>GP:CAB12482 GB:Z99107 similar to DNA ligase [Bacillus subtilis]
Identities = 346/657 (52%), Positives = 462/657 (69%), Gaps = 8/657 (1%)
Query:   2  ENRMNELVSLLNQYAKEYYTQDNPTVSDSQYDQLYRELVELEKQHPENILPNSPTHRVGG   61
            + R   EL    +N+Y+ EYYT D P+V D++YD+L +EL+ +E++HP+   P+SPT RVGG
Sbjct:   7  KQRAEELRRTINKYSYEYYTLDEPSVPDAEYDRLMQELIAIEEEHPDLRTPDSPTQRVGG   66

Query:  62  LVLEGFEKYQHEYPLYSLQDAFSKEELIAFDKRVKAEF-PTAAYMAELKIDGLSVSLTYV  120
             VLE F+K  H  P+ SL +AF+ ++L  FD+RV+      AY  ELKIDGL+VSL Y
Sbjct:  67  AVLEAFQKVTHGTPMLSLGNAFNADDLRDFDRRVRQSVGDDVAYNVELKIDGLAVSLRYE  126

Query: 121  NGVLQVGATRGDGNIGENITENLKRVHDIPLHLDQSLDITVRGECYLPKESFEAINIEKR  180
            +G    GATRGDG  GE+ITENLK + +IPL +++ L I VRGE Y+PK SFEA+N E+
Sbjct: 127  DGYFVRGATRGDGTTGEDITENLKTIRNIPLKMNRELSIEVRGEAYMPKRSFEALNEERI  186

Query: 181  ANGEQEFANPRNAAAGTLRQLNTGIVAKRKLATFLYQEASPTQK--ETQDDVLKELESYG  238
             N E+ FANPRNAAAG+LRQL+  I AKR L F+Y A  +   ETQ  L L+  G
Sbjct: 187  KNEEEPFANPRNAAAGSLRQLDPKIAAKRNLDIFVYSIAELDEMGVETQSQGLDFLDELG  246

Query: 239  FSVNHHRLISSSMEKIWDFIQTIEKDRVSLPYDIDGIVIKVNSIAMQEELGFTVKAPRWA  298
            F N  R    S+E++   I   ++  R  LPY+IDGIVIKV+S+  QEELGFT K+PRWA
Sbjct: 247  FKTNQERKKCGSIEEVITLIDELQAKRADLPYEIDGIVIKVDSLDQQEELGFTAKSPRWA  306

Query: 299  IAYKFPAEEKEAEILSVDWTVGRTGVVTPTANLTPVQLAGTTVSRATLHNVDYIAEKDIR  358
            IAYKFPAEE    ++L  ++   VGRTGV+TPTA L  PV++ AGTTVSRA+LHN D I EKDIR
Sbjct: 307  IAYKFPAEEVVTKLLDIELNVGRTGVITPTAILEPVEVAGTTVSRASLHNEDLIKEKDIR  366

Query: 359  IGDTVVVYKAGDIIPAVLNVVMSKRNQQEVML-IPKLCPSCGSELVHFEGEVALRCINPL  417
            I D VVV KAGDIIP V+NV++ +R  +E    +P  CP CGSELV  EGEVALRCINP
Sbjct: 367  ILDKVVVKKAGDIIPEVVNVLVDQRTGEEKEFSMPTECPECGSELVRIEGEVALRCINPE  426

Query: 418  CPNQIKERLAHFASRDAMNITGFGPSLVEKLFDAHLIADVADIYRLSIENLLTLDGIKEK  477
            CP QI+E L HF SR+AMNI G G   ++LF+ +L+ +VAD+Y+L+ E ++ L+ + EK
Sbjct: 427  CPAQIREGLIHFVSRNAMNIDGLGERVITQLFEENLVRNVADLYKLTKERVIQLERMGEK  486
```

```
-continued
Query:  478   SATKIYHAIQSSKENSAEKLLFGLGIRHVGSKASRLLLEEFGNLRQLSQASQESIASIDG   537
              S    +  +IQ SKENS E+LLFGLGIR +GSKA++ L    F +L   L +AS+E +  ++D
Sbjct:  487   STENLISSIQKSKENSLERLLFGLGIRFIGSKAAKTLAMHFESLENLKKASKEELLAVDE   546

Query:  538   LGGVIAKSLHTFFEKEEVDKLLEELTSYNVNFNYLG----KRVSTDAQLSGLTVVLTGKL   593
              +G  +A ++ T+F KEE+ +LL EL     VN  Y G      K   +D+   +G T+VLTGKL
Sbjct:  547   IGEKMADAVITYFHKEEMLELLNELQELGVNTLYKGPKKVKAEDSDSYFAGKTIVLTGKL   606

Query:  594   EKMTRNEAKEKLQNLGAKVTGSVSKKTDLIVAGSDAGSKLTKAQDLGITIQDEDWLL      650
              E+++RNEAK +++ LG K+TGSVSK TDL++AG  AGSKLTKAQ+L I +  +E+ L+
Sbjct:  607   EELSRNEAKAQIEALGGKLTGSVSKNTDLVIAGEAAGSKLTKAQELNIEVWNEEQLM     663
```

A related DNA sequence was identified in *S. pyogenes* <SEQ ID 4375> which encodes the amino acid sequence <SEQ ID 4376>. Analysis of this protein sequence reveals the following:

Possible site: 61
>>> Seems to have no N-terminal signal sequence
INTEGRAL      Likelihood = −0.43      Transmembrane 363-379 (363-379)
----- Final Results -----
 bacterial membrane --- Certainty = 0.1171 (Affirmative) <succ>
  bacterial outside --- Certainty = 0.0000 (Not Clear) <succ>
   bacterial cytoplasm --- Certainty = 0.0000 (Not Clear) <succ>

An alignment of the GAS and GBS proteins is shown below.

Based on this analysis, it was predicted that these proteins and their epitopes could be useful antigens for vaccines or diagnostics.

Example 1426

A DNA sequence (GBSx1511) was identified in *S. agalactiae* <SEQ ID 4377> which encodes the amino acid sequence <SEQ ID 4378>. Analysis of this protein sequence reveals the following:

Possible site: 32
>>> Seems to have a cleavable N-term signal seq.

```
Identities = 472/652 (72%), Positives = 556/652 (84%)
Query:    1   MENRMNELVSLLNQYAKEYYTQDRPTVSDSQYDQLYRELVELEKQHPENILPNSPTHRVG    60
              M+ R+ EL  LLN+Y  +YYT+D P+VSDS YD+LYRELV LE+ +PE +L +SPT +VG
Sbjct:    1   MKKRIKELTDLLNRYRYDYYTKDAPSVSDSDYDKLYRELVTLEQSYPEYVLQDSPTQQVG    60

Query:   61   GLVLEGFEKYQHEYPLYSLQDAFSKEELIAFDKRVKAEFPTAAYMAELKIDGLSVSLTYV   120
              G +L+GFEKY+H+YPL+SLQDAFS+EEL AFDKRVKAEFP A Y+AELKIDGLS+SL+Y
Sbjct:   61   GTILKGFEKYRHQYPLFSLQDAFSREELDAFDKRVKAEFPNATYLAELKIDGLSISLSYE   120

Query:  121   NGVLQVGATRGDGNIGENITENLKRVHDIPLHLDQSLDITVRGECYLPKESFEAINIEKR   180
              NG LQVGATRGDGNIGENITEN+K++ DIP  L + L ITVRGE Y+ ++SF+AIN  ++
Sbjct:  121   NGFLQVGATRGDGNIGENITENIKKIKDIPYQLSEPLTITVRGEAYMSRQSFKAINEARQ   180

Query:  181   ANGEQEFANPRNAAAGTLRQLNTGIVAKRKLATFLYQEASPTQKETQDDVLKELESYGFS   240
                NGE EFANPRNAAAGTLRQL+T +VAKR+LATFLYQEASPT + Q++VL EL   GFS
Sbjct:  181   ENGETEFANPRNAAAGTLRQLDTSVVAKRQLATFLYQEASPTARNQQNEVLAELADLGFS   240

Query:  241   VNHHRLISSSMEKIWDFIQTIEKDRVSLPYDIDGIVIKVNSIAMQEELGFTVKAPRWAIA   300
              VN +    ++SSM++IWDFI+TIE   R L YDIDG+VIKVNS+AMQEELGFTVKAPRWAIA
Sbjct:  241   VNPYYQLTSSMDEIWDFIKTIEAKRDQLAYDIDGVVIKVNSLAMQEELGFTVKAPRWAIA   300

Query:  301   YKFPAEEKEAEILSVDWTVGRTGVVTPTANLTPVQLAGTTVSRATLHNVDYIAEKDIRIG   360
              YKFPAEEKEAEILSVDWTVGRTGVVTPTANLTPVQLAGTTVSRATLHNVDYIAEKDIRIG
Sbjct:  301   YKFPAEEKEAEILSVDWTVGRTGVVTPTANLTPVQLAGTTVSRATLHNVDYIAEKDIRIG   360

Query:  361   DTVVVYKAGDIIPAVINVVMSKRNQQEVMLIPKLCPSCGSELVHFEGEVALRCINPLCPN   420
              DTV+VYKAGDIIPAVI VVMSKRNQQEVMLIPKLCPSCGSELVHFE EVALRCINPLCP+
Sbjct:  361   DTVIVYKAGDIIPAVLNVVMSKRNQQEVMLIPKLCPSCGSELVHFEDEVALRCINPLCPS   420

Query:  421   QIKERLAHFASRDAMNITGFGPSLVEKLFDAHLIADVADIYRLSIENLLTLDGIKEKSAT   480
               I+   L HFASRDAMNITG GP++VEKLF A   + DVADIY+L+ E+ + LDGIKEKSA
Sbjct:  421   LIQRSLEHFASRDAMNITGLGPAIVEKLFLAGFVHDVADIYQLTKEDFMQLDGIKEKSAD   480

Query:  481   KIYHAIQSSKENSAEKLLFGLGIRHVGSKASRLLLEEFGNLRQLSQASQESIASIDGLGG   540
              K+   AI++SK NSAEKLLFGLGIRH+GSK SRL+LE +G++    L  A +E IA IDGLG
Sbjct:  481   KLLAAIEASKSNSAEKLLFGLGIRHIGSKVSRLILEVYGDISALLTAKEEEIARIDGLGS   540

Query:  541   VIAKSLHTFFEKEEVDKLLEELTSYNVNFNYLGKRVSTDAQLSGLTVVLTGKLEKMTRNE   600
                IA+SL  +FE++    L++EL +    VN  +Y G++V++DA L GLTVVLTGKL ++ RNE
Sbjct:  541   TIAQSLTQYFEQKTAAILVDELKTAGVNMHYSGQKVNSDAALFGLTVVLTGKLNQLNRNE   600

Query:  601   AREKLQNLGAKVTGSVSKKTDLIVAGSDAGSKLTKAQDLGITIQDEDWLLNL            652
              A++KL+ LGAKVTGSVSKKTDL++AGSDAGSKL KA+ LGI I+DEDWL  L
Sbjct:  601   AKDKLEALGAKVTGSVSKKTDLVIAGSDAGSKLEKAKSLGIRIEDEDWLRQL            652
```

| | | |
|---|---|---|
| INTEGRAL | Likelihood = −5.63 | Transmembrane 110-126 (108-128) |
| INTEGRAL | Likelihood = −2.13 | Transmembrane 142-158 (141-159) |
| INTEGRAL | Likelihood = −1.12 | Transmembrane 75-91 (75-93) |

----- Final Results -----
   bacterial membrane --- Certainty = 0.3251 (Affirmative) <succ>
     bacterial outside --- Certainty = 0.0000 (Not Clear) <succ>
       bacterial cytoplasm --- Certainty = 0.0000 (Not Clear) <succ>

The protein has homology with the following sequences in the GENPEPT database.

```
>GP:CAA68244 GB:X99978 citrulline cluster-linked gene [Lactobacillus
plantarum]
Identities = 56/158 (35%), Positives = 91/158 (57%), Gaps = 8/158 (5%)
Query:  13  AIVTAIYIVLTITPPFNAIAYGAYQFRVSEMLNFLAFYHRKYLFAVTLGCMISNLYSFG-  71
            A+V A+Y+VL + P   ++A GA QFRVSE LN LA ++RKY++ +  G ++ + +  G
Sbjct:  13  ALVAAMYVVLCLGPAAFSLASGAIQFRVSEGLNHLAVFNRKYIWGIVAGVILFDAFGPGA  72

Query:  72  -MIDVFVGGGSTLLFVYLGTILFKQYQKDYLFNGLINRAFFFFSFFFAASMITVAVELKI  130
             +++V   GGG +LL + + T L  +  K       L+N A F   S F   A MIT+      +
Sbjct:  73  SLLNVLFGGGQSLLALLVLTWLAPKL-KTVWQRMLLNIALFTVSMFMIALMITM-----M  126

Query: 131  VAGLPLLLTWLTTAVGELASLLVGAVLVDKLSRHVDFT                       168
             +G+    T+LTTA+ EL + + A ++   L R + F+
Sbjct: 127  SSGVAFWPTYLTTALSELIIMSITAPIMYSLDRVLHFS                       164
```

A related DNA sequence was identified in *S. pyogenes* <SEQ ID 4379> which encodes the amino acid sequence <SEQ ID 4380>. Analysis of this protein sequence reveals the following:

Possible site: 32
>>> Seems to have an uncleavable N-term signal seq

| | | |
|---|---|---|
| INTEGRAL | Likelihood = −4.41 | Transmembrane 75-91 (70-94) |
| INTEGRAL | Likelihood = −3.82 | Transmembrane 12-28 (8-28) |
| INTEGRAL | Likelihood = −2.28 | Transmembrane 141-157 (140-158) |
| INTEGRAL | Likelihood = −0.64 | Transmembrane 110-126 (110-126) |
| INTEGRAL | Likelihood = −0.59 | Transmembrane 55-71 (54-73) |

----- Final Results -----
   bacterial membrane --- Certainty = 0.2763 (Affirmative) <succ>
     bacterial outside --- Certainty = 0.0000 (Not Clear) <succ>
       bacterial cytoplasm --- Certainty = 0.0000 (Not Clear) <succ>

An alignment of the GAS and GBS proteins is shown below.

```
Identities = 114/167 (68%), Positives = 137/167 (81%), Gaps = 1/167 (0%)

Query:   1  MNTFTTRDYAHMAIVTAIYIVLTITPPFNAIAYGAYQFRVSEMLNFLAFYHRKYLFAVTL  60
            M   T   DY H+ +V A+Y+VLTITPP NAI+YG YQFR+SEM+NFLAFYHRKY+ AVTL
Sbjct:   1  MTKLTVHDYVHIGLVAALYVVLTITPPLNAISYGMYQFKISEMMNFLAFYHRKYIIAVTL  60

Query:  61  GCMISNLYSFGMIDVFVGGGSTLLFVYLGTILFKQYQKDYLFNGLINKAFFFFSFFFAAS  120
            GCMI+N YSFG+IDVFVGGGSTL+FV LG ILF +YQKDYLFNG+ NKAF +FSFFFA S
Sbjct:  61  GCMIANFYSFGLIDVFVGGGSTLIFVTLGVILFSKYQKDYLFNGIFNKAFVYFSFFFATS  120

Query: 121  MITVAVELKIVAGLPLLLTWLTTAVGELASLLVGAVLVDKLSRHVDF              167
            M    VA+EL    G P LLTW TTA+GEL SLL+G++++DKLS+ + F
Sbjct: 121  MFNVAIELYFF-GAPFLLTWFTTALGELVSLLIGSLIIDKLSQRISF              166
```

Based on this analysis, it was predicted that these proteins and their epitopes could be useful antigens for vaccines or diagnostics.

Example 1427

A DNA sequence (GBSx1513) was identified in *S. agalactiae* <SEQ ID 4381> which encodes the amino acid sequence <SEQ ID 4382>. Analysis of this protein sequence reveals the following:

Possible site: 53
>>> Seems to have no N-terminal signal sequence

| | | |
|---|---|---|
| INTEGRAL | Likelihood = −11.20 | Transmembrane 255-271 (245-281) |
| INTEGRAL | Likelihood = −10.72 | Transmembrane 141-157 (132-165) |
| INTEGRAL | Likelihood = −8.17 | Transmembrane 189-205 (185-208) |
| INTEGRAL | Likelihood = −7.01 | Transmembrane 36-52 (33-60) |

----- Final Results -----
   bacterial membrane --- Certainty = 0.5479 (Affirmative) <succ>
     bacterial outside --- Certainty = 0.0000 (Not Clear) <succ>
       bacterial cytoplasm --- Certainty = 0.0000 (Not Clear) <succ>

The protein has homology with the following sequences in the GENPEPT database.

```
>GP:AAC35915 GB:AF071085 Orfde2 [Enterococcus faecalis]
Identities = 83/276 (30%), Positives = 157/276 (56%), Gaps = 3/276 (1%)
Query:  17 RPIQVFMRHFQSAEMDLSAIAVAYYLLVTAFPLLVIAANIFPYFHINVSDLLSLMQKNLP   76
            R I+     H +AE+ S++ VAYYLL++ FPLL+    N+ PY I+ + +L + + +P
Sbjct:  15 RFIETTQSHMVTAEIGNSSVVVAYYLLLSLFPLLIAVGNVLPYLRIDPNSVLPYIAEAIP   74

Query:  77 KNIYEPASRLAVDAFSKPSTGILGFASLTAFWTMSKSLTSLQKAINKAYGVDQHRDFVIS  136
            K++Y+         ++ S G+L   ++L AFW+ S+S+ +LQ A+NKA+GV+Q ++F++
Sbjct:  75 KDVYKNLEPAIRSLLTQRSGGLLSVSALAAFWSASQSINALQNAMNKAFGVEQRKNFILV  134

Query: 137 RLVGVGTGLIILFLLTFVLIFSTFSKPVLQIIVNMYDLGDTLTAWLLNLAQPVTFLTIFL  196
            R+V    L+ + + V++    + +++++  ++      ++       L  P+T + + +
Sbjct: 135 RVVSFLVILLFMVAIVGVVVILGLGQYIIELLQPIFHYSTSVIDTFQALKWPLTTVVLLV  194

Query: 197 GIGILYFILPNARIRKVRYVIPGTLFSTFVIGFFSNLISQYVLNRVEKMVDIKTFGSVVI  256
            + ++Y ++PN ++   +R ++PG +FST      S +    YV      ++  + GS +
Sbjct: 195 IMCLIYAVVPNRKL-SLRSILPGAIFSTVGWMLLSQIFGLYVKYFSSRIASYQIIGSFI-  252

Query: 257 FILMLWFIFLAHIMILGAILNASVQEIATGKIESRR                         292
            ILMLW  F A I+ILGAI+NA V E    G  E ++
Sbjct: 253 -ILMLWLNFAATIIILGAIVNAVVDEYLXGXKEKKQ                         287
```

A related DNA sequence was identified in *S. pyogenes* <SEQ ID 4383> which encodes the amino acid sequence <SEQ ID 4384>. Analysis of this protein sequence reveals the following:

---

Possible site: 53
>>> Seems to have no N-terminal signal sequence
INTEGRAL    Likelihood = –12.58   Transmembrane 141-157 (132-168)
INTEGRAL    Likelihood = –12.15   Transmembrane 189-205 (177-210)

-continued

INTEGRAL    Likelihood = –11.68   Transmembrane 256-272 (245-280)
INTEGRAL    Likelihood = –7.54    Transmembrane 36-52 (33-60)
----- Final Results -----
bacterial membrane --- Certainty = 0.6031 (Affirmative) <succ>
bacterial outside --- Certainty = 0.0000 (Not Clear) <succ>
bacterial cytoplasm --- Certainty = 0.0000 (Not Clear) <succ>

---

The protein has homology with the following sequences in the databases:

```
>GP:CAA68244 GB:X99978 citrulline cluster-linked gene [Lactobacillus
plantarum]
Identities = 53/170 (31%), Positives = 92/170 (53%), Gaps = 11/170 (6%)
Query:   1 MTKLTVHDYVHIGLVAALYVVLTITPPLNAISYGMYQFRISEMMNFLAFYHRKYIIAVTL   60
            MT+   +  ++   LVAA+YVVL + P    +++ G  QFR+SE +N LA ++RKYI  +
Sbjct:   1 MTQSKIRPWIINALVAAMYVVLCLGPAAFSLASGAIQFRVSEGLNHLAVFNRKYIWGIVA   60

Query:  61 GCMIANFYSFG--LIDVFVGGGSTLIFVTLGVILFSKYQKDYLFNGIFNKAFVYFSFFFA  118
            G ++ + +  G  L++V  GGG +L+ + +    L K+         ++ + + + F
Sbjct:  61 GVILFDAFGPGASLLNVLFGGGQSLLALLVLTWLAPKLKT------VWQRMLLNIA-LFT  113

Query: 119 TSMFNVA--IELYFFGAPFLLTWFTTALGELVSLLIGSLIIDKLSQRISF            166
            SMF +A   I +    G F  T+ TTAL EL+ + I + I+   L + + F
Sbjct: 114 VSMFMIALMITMMSSGVAFWPTYLTTALSELIIMSITAPIMYSLDRVLHF            163

!GB:AF071085 Orfde2 [Enterococcus faecalis]176 2e-43
>GP:AAC35915 GB:AF071085 Orfde2 [Enterococcus faecalis]
Identities = 90/271 (33%), Positives = 155/271 (56%), Gaps = 3/271 (1%)
Query:  19 IQVFMRHLQSAEMDLSAIAVAYYLILTAFPLIVIAANIFPYLNIDIADLLRLMKQNLPKD   78
            I+     H+ +AE+ S++ VAYYL+L+ FPL++    N+ PYL ID     +L + + +PKD
Sbjct:  17 IETTQSHMVTAEIGNSSVVVAYYLLLSLFPLLIAVGNVLPYLRIDPNSVLPYIAEAIPKD   76

Query:  79 IFRPASAIVENIFSKPSGSVLGVATLTGLWTMSRSLTSLQKAINKAYGASQHRDFFIGHL  138
            +++       + ++ ++ SG +L V+  L   W+ S+S+ +LQ A+NKA+G  Q ++F + +
Sbjct:  77 VYKNLEPAIRSLLTQRSGGLLSVSALAAFWSASQSINALQNAMNKAFGVEQRKNFILVRV  136

Query: 139 VGLLTSLIILFLLAFALIFSIFSKAAIQVLDKHYHLSDNITTIFLLLIQPITVLIIFVGL  198
            V  L L+ +  +      ++      +  I++L    +H S ++      F L P+T +++ V +
Sbjct: 137 VSFLVILLFMVAIVGVVVILGLGQYIIELLQPIFHYSTSVIDTFQALKWPLTIVVLLVIM  196

Query: 199 MLLYFLLPNVKIKKIRYILPGTLFTSFVMTFLSNLVGNYVVYNVERMVDIKMFGSVMIFI  258
            L+Y ++PN K+   +R ILPG +F++      LS + G YV Y  R+      ++ GS    I
Sbjct: 197 CLIYAVVPNRKL-SLRSILPGAIFSTVGWMLLSQIFGLYVKYFSSRIASYQIIGS--FII  253

Query: 259 IMLWFIFLARILILGAIFNATYQEMSLGKLE                               289
            +MLW  F A I+ILGAI NA     E    G  E
Sbjct: 254 LMLWLNFAATIIILGAIVNAVVDEYLXGXKE                               284
```

An alignment of the GAS and GBS proteins is shown below.

```
Identities = 188/302 (62%), Positives = 244/302 (80%)
Query:    1 MKLKKFFEDLLAKLEYRPIQVFMRHFQSAEMDLSAIAVAYYLLVTAFPLLVIAANIFPYF   60
            M  KK+F+ +L+K +Y PIQVFMRH QSAEMDLSAIAVAYYL+ TAFPL+VIAANIFPY
Sbjct:    1 MAEKKWFDKVLSKWQYEPIQVFMRHLQSAEMDLSAIAVAYYLILTAFPLIVIAANIFPYL   60

Query:   61 HINVSDLLSLMQKNLPKNIYEPASRLAVDAFSKPSTGILGFASLTAFWTMSKSLTSLQKA  120
            +I+++DLL LM++NLPK+I+ PAS +  + FSKPS  +LG A+LT  WTMS+SLTSLQKA
Sbjct:   61 NIDIADLLRLMKQNLPKDIFRPASAIVENIFSKPSGSVLGVATLTGLWTMSRSLTSLQKA  120

Query:  121 INKAYGVDQHRDFVISRLVGVGTGLIILFLLTFVLIFSTFSKPVLQIIVNMYDLGDTLTA  180
            INKAYG  QHRDF I  LVG+ T LIILFLL F LIFS FSK  +Q++    Y L D +T
Sbjct:  121 INKAYGASQHRDFFIGHLVGLLTSLIILFLLAFALIFSIFSKAAIQVLDKHYHLSDNITT  180

Query:  181 WLLNLAQPVTFLTIFLGIGILYFILPNARIRKVRYVIPGTLFSTFVIGFFSNLISQYVLN  240
              L L QP+T L IF+G+ +LYF+LPN +I+K+RY++PGTLF++FV+ F SNL+  YV+
Sbjct:  181 IFLLLIQPITVLIIFVGLMLLYFLLPNVKIKKIRYILPGTLFTSFVMTFLSNLVGNYVVY  240

Query:  241 RVEKMVDIKTFGSVVIFILMLWFIFLAHIMILGAILNASVQEIATGKIESRRGDIMSLIQ  300
             VE+MVDIK FGSV+IFI+MLWFIFLA I+ILGAI NA+ QE++ GK+E R GD++++++
Sbjct:  241 NVERMVDIKMFGSVMIFIIMLWFIFLARILILGAIFNATYQEMSLGKLEGRSGDMIAILK  300

Query:  301 KS                                                            302
            K+
Sbjct:  301 KT                                                            302
```

Based on this analysis, it was predicted that these proteins and their epitopes could be useful antigens for vaccines or diagnostics.

Example 1428

A DNA sequence (GBSx1514) was identified in *S. agalactiae* <SEQ ID 4385> which encodes the amino acid sequence <SEQ ID 4386>. Analysis of this protein sequence reveals the following:

Possible site: 22
>>> Seems to have no N-terminal signal sequence
----- Final Results -----
   bacterial cytoplasm --- Certainty = 0.4200 (Affirmative) <succ>
     bacterial membrane --- Certainty = 0.0000 (Not Clear) <succ>
       bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1429

A DNA sequence (GBSx1515) was identified in *S. agalactiae* <SEQ ID 4387> which encodes the amino acid sequence <SEQ ID 4388>. This protein is predicted to be methionine aminopeptidase (map). Analysis of this protein sequence reveals the following:

Possible site: 14
>>> Seems to have no N-terminal signal sequence
----- Final Results -----
   bacterial cytoplasm --- Certainty = 0.2342 (Affirmative) <succ>
     bacterial membrane --- Certainty = 0.0000 (Not Clear) <succ>
       bacterial outside --- Certainty = 0.0000 (Not Clear) <succ>

A related GBS nucleic acid sequence <SEQ ID 9761> which encodes amino acid sequence <SEQ ID 9762> was also identified.

The protein has homology with the following sequences in the GENPEPT database.

```
>GP:AAC35914 GB:AF071085 methionine aminopeptidase A [Enterococcus
faecalis]
Identities = 101/207 (48%), Positives = 128/207 (61%), Gaps = 31/207 (14%)
Query:    1 MITLKSAREIEAMDRAGDFLASIHIGLRDIIKPGVDMWEVEEYVRRRCKEENVLPLQIGV   60
            MITLKS REIE MD +G+ LA +H  LR  IKPG+ W++E +VR  +   + QIG
Sbjct:    1 MITLKSPREIEMMDESGELLADVHRHLRTFIKPGITSWDIEVFVRDFIESHGGVAAQIGY   60

Query:   61 DGAVMDYPYATCCGLNDEVAHAFPRHYTLKQGDLLKVDMVLSEPLDKSIVDVSSLNFDNV  120
            +G    Y YATCC +NDE+ H FPR   LK GDL+KVDM +
Sbjct:   61 EG----YKYATCCSINDEICHGFPRKKVLKDGDLIKVDMCVD------------------   98

Query:  121 AQMKKYTETYSGGLADSCWAYAVGEVSQEVKDLMSVTREAMYIGIEKAVIGNRIGDIGAA  180
                G ++DSCW+Y VGE + E+  LM VT++A+Y+GIE+A +GNRIGDIG A
Sbjct:   99 ---------LKGAISDSCWSYVVGESTPEIDRLMEVTKKALYLGIEQAQVGNRIGDIGHA  149
```

```
                                     -continued
Query: 181  IQDYAESRGYGVVRDLVGHGVGPTMHE                    207
            IQ Y E  GYGVVRD VGHG+GPT+HE
Sbjct: 150  IQTYVEGEGYGVVRDFVGHGIGPTIHE                    176
```

A related DNA sequence was identified in *S. pyogenes* <SEQ ID 4389> which encodes the amino acid sequence <SEQ ID 4390>. Analysis of this protein sequence reveals the following:

Possible site: 42
>>> Seems to have no N-terminal signal sequence
----- Final Results -----
   bacterial cytoplasm --- Certainty = 0.2082 (Affirmative) <succ>
    bacterial membrane --- Certainty = 0.0000 (Not Clear) <succ>
     bacterial outside --- Certainty = 0.0000 (Not Clear) <succ>

An alignment of the GAS and GBS proteins is shown below.

```
Identities = 256/286 (89%), Positives = 273/286 (94%)
Query:   1  MITLKSAREIEAMDRAGDFLASIHIGLRDIIKPGVDMWEVEEYVRRRCKEENVLPLQIGV   60
            MITLKSAREIEAMDRAGDFLA IHIGLRDIIKPGVDMWEVE YVARRCKE+NVLPLQIGV
Sbjct:   1  MITLKSAREIEAMDRAGDFLAGIHIGLRDIIKPGVDMWEVEAYVRRRCKEDNVLPLQIGV   60

Query:  61  DGAVMDYPYATCCGLNDEVAHAFPRHYTLKQGDLLKVDMVLSEPLDKSIVDVSSLNFDNV  120
            DG +MDYPYATCCGLNDEVAHAFPRHY LK+GDLLKVDMVLSEPLDKSIVDV++L+FDNV
Sbjct:  61  DGHMMDYPYATCCGLNDEVAHAFPRHYILKEGDLLKVDMVLSEPLDKSIVDVAALDFDNV  120

Query: 121  AQMKKYTETYSGGLADSCWAYAVGEVSQEVKDLMSVTREAMYIGIEKAVIGNRIGDIAA   180
             +MKK+T +Y+GGLADSCWAYAVG  S E+K LM VT+EAMY GIEKAVIGNRIGDIAA
Sbjct: 121  PEMKKWTGSYTGGLADSCWAYAVGTPSDEIKQLMDVTKEAMYRGIEKAVIGNRIGDIAA   180

Query: 181  IQDYAESRGYGVVRDLVGHGVGPTMHEEPMVPNYGTAGRGLRLREGMVLTIEPMINTGTW  240
            +Q+YAES GYGVVRDLVGHGVGPTMHEEPMVPNYGTAGRGLRL+EGMVLT+EPMINTGTW
Sbjct: 181  VQEYAESEGYGVVRDLVGHGVGPTMHEEPMVPNYGTAGRGLRLKEGMVLTVEPMINTGTW  240

Query: 241  EIDTDMKTGWAHKTLDGGLSCQYEHQFVITKDGPVILTSQGEERTY               286
            EIDTD+KTGWAHKTLDGGLSCQYEHQFVITKDGPVILTSQGEERTY
Sbjct: 241  EIDTDIKTGWAHKTLDGGLSCQYEHQFVITKDGPVILTSQGEERTY               286
```

Based on this analysis, it was predicted that these proteins and their epitopes could be useful antigens for vaccines or diagnostics.

Example 1430

A DNA sequence (GBSx1516) was identified in *S. agalactiae* <SEQ ID 4391> which encodes the amino acid sequence <SEQ ID 4392>. Analysis of this protein sequence reveals the following:

Possible site: 30
>>> Seems to have no N-terminal signal sequence

----- Final Results -----
   bacterial cytoplasm --- Certainty = 0.3473 (Affirmative) <succ>
    bacterial membrane --- Certainty = 0.0000 (Not Clear) <succ>
     bacterial outside --- Certainty = 0.0000 (Not Clear) <succ>

A related GBS nucleic acid sequence <SEQ ID 9759> which encodes amino acid sequence <SEQ ID 9760> was also identified.

The protein has homology with the following sequences in the GENPEPT database.

```
>GP:BAB06894 GB:AP001518 unknown conserved protein [Bacillus halodurans]
Identities = 158/431 (36%), Positives = 270/431 (61%), Gaps = 6/431 (1%)
Query:   6  SKHQEILEYLENLAVGKRVSVRSISNHLKVSDGTAYRAIKEAENRGIVETRPRSGTVRVA   65
            +KH++IL+Y+ NL VG+++SVR I+  L+VS+GTAYRAIKEAEN+G+V  T   R GT+R+
Sbjct:   3  TKHEQILQYITNLEVGEKISVRRIAKDLQVSEGTAYRAIKEAENQGLVSTIERVGTIRIE   62

Query:  66  QKAKVNIEKLTYAEIARISDSQVVAGIEGLSKEFSKFSIGAMTHRNIEKYLVQGGLLIVG  125
            +K K NIEKLTYAE+  I D QV+ G +GL K   ++F IGAM     + +Y+  G LLIVG
Sbjct:  63  KKQKENIEKLTYAEVVNIVDGQVLGGRDGLHKTLNRFVIGAMKLDAMMRYVEPGNLLIVG  122

Query: 126  DRDEIQHLALQHQNAILVTGGFNVSPSVCRLADKLQIPVMVTHYDTFTVSTMINHTLSNA  185
            +R ++   +AL+    A+L+TGGF+ S     +LAD+L +PV+ T YDTFTV+TMIN  +  +
```

```
Sbjct: 123  NRYQVHQIALEAGAAVLITGGFDTSDEAIKLADELDLPVISTSYDTFTVATMINRAIYDQ  182

Query: 186  KIRTDLKTVEQVYQSQMDYGFLAQDDTVKEFNLLVKQTKNVRFPIVNQANVVVGVVSVQD  245
            I+ ++  V+ +       D  ++  ++ V +++ L ++T + R+P++++   + G+V+ +D
Sbjct: 183  LIKKEITLVDDILIPLQDTYYMTTENVVGKWHELNEKTGHSRYPVIDENMKIQGMVAAKD  242

Query: 246  ILGKDKEVELATVMSKNIIVAKPRMSLANISQKMIFEDLNMMPVVSDDFELLGVITRRQA  305
            +L   +     VM+KN I     R S+A ++   M++E + ++PV+       +L+GV++R+
Sbjct: 243  VLNASRHTPIEKVMTKNPITVSERTSVAAVAHVMVWEGIELLPVIDSHRKLIGVVSRQDV  302

Query: 306  VENLSMSQ-----GTDLYTYSDQILSNLQIEDG-HFSFLVEPAMIDHTGSLTQGVLTEFL  359
            ++ L M Q     G +          L+    + G +    + P M +  G+++ GV+T +
Sbjct: 303  LKALQMIQRQPHVGETIEDLMTNGLNESSSDQGDSYEVEITPQMTNQLGTISHGVMTSLV  362

Query: 360  KEICIRVLTRKHQRSIVVKQMTLYFLQPVQIDEIIMVTPTIISEKRREATLDLELKLENK  419
                E   RVL +  +  +VV+ +TLYFL+PVQID   + + P ++     R+    +D+E+  E +
Sbjct: 363  IESGSRVLRKYKKGDLVVENITLYFLKPVQIDSRLTIRPRVLEIGRKHGKIDVEMYHEGE  422

Query: 420  IIAKAMIAVKI                                                  430
            I+ KA+    +I
Sbjct: 423  IVGKALFMAQI                                                  433
```

A related DNA sequence was identified in *S. pyogenes* <SEQ ID 4393> which encodes the amino acid sequence <SEQ ID 4394>. Analysis of this protein sequence reveals the following:

---
Possible site: 30
>>> Seems to have no N-terminal signal sequence
----- Final Results -----
  bacterial cytoplasm --- Certainty = 0.3011 (Affirmative) <succ>
    bacterial membrane --- Certainty = 0.0000 (Not Clear) <succ>
    bacterial outside --- Certainty = 0.0000 (Not Clear) <succ>

---

An alignment of the GAS and GBS proteins is shown below.

```
Identities = 267/431 (61%), Positives = 351/431 (80%)
Query:   1  MIIVMSKHQEILEYLENLAVGKRVSVRSISNHLKVSDGTAYRAIKEAENRGIVETRPRSG   60
            +II+MSKHQ+IL+YLE LA+GK+VSVRSISNHLKVSDGTAYRAIKEAENRGIVET+PRSG
Sbjct:   1  VIIIMSKHQDILDYLEKLAIGKKVSVRSISNHLKVSDGTAYRAIKEAENRGIVETKPRSG   60

Query:  61  TVRVAQKAKVNIEKLTYAEIARISDSQVVAGIEGLSKEFSKFSIGAMTHRNIEKYLVQGG  120
            TVR+ +K +V I++LTY+EIARISDS+V+AG  GL   EFS+FSIGAMT +NI +YLV+GG
Sbjct:  61  TVRIEKKGRVRIDRLTYSEIARISDSEVLAGHAGLGHEFSRFSIGAMTQQNIRRYLVKGG  120

Query: 121  LLIVGDRDEIQHLALQHQNAILVTGGFNVSPSVCRLADKLQIPVMVTHYDTFTVSTMINH  180
            LLIVGDR+ IQ LAL++ NAILVTGGF VS  V  +A+   +IPVMVTHYDTFTV+TMINH
Sbjct: 121  LLIVGDRETIQLLALENHNAILVTGGFPVSKRVIEMANNQRIPVMVTHYDTFTVATMINH  180

Query: 181  TLSNAKIRTDLKTVEQVYQSQMDYGFLAQDDTVKEFNLLVKQTKNVRFPIVNQANVVVGV  240
             LSN +I+TDLKTVEQV    DYG+L +D +V+EFN L+K+T+ VRFP+++    V+GV
Sbjct: 181  ALSNIRIKTDLKTVEQVMIPITDYGYLCEDSSVEEFNTLIKKTRQVRFPVLDYKRKVIGV  240

Query: 241  VSVQDILGKDKEVKLATVMSKNIIVAKPRMSLANISQKMIFEDLNMMPVVSDDFELLGVI  300
            VS++D++ +     KL  VMSKN I A+P  SLANISQKMIFEDLNM+PV  ++  LLG+I
Sbjct: 241  VSMRDVVDQLPTTKLTKVMSKNPITARPNTSLANISQKMIFEDLNMLPVTDEENNLLGMI  300

Query: 301  TRRQAVENLSMSQGTDLYTYSDQILSNLQIEDGHFSFLVEPAMIDHTGSLTQGVLTEFLK  360
            TRRQA+ENL  Q + YTYS+QILSNL+    ++    +VEP MID  G+++ GV++EFLK
Sbjct: 301  TRRQAMENLPNHQPNNPYTYSEQILSNLEETVDYYQVVVEPTMIDSAGNMSNGVISEFLK  360

Query: 361  EICIRVLTRKHQRSIVVKQMTLYFLQPVQIDEIIMVTPTIISEKRREATLDLELKLENKI  420
            EI  IR  LT+KHQ++I+++QM +YFL  +QI++  + + P II+E RR +T+D+E+ +++++
Sbjct: 361  EISIRALTKKHQKNIIIEQMMVYFLHAIQIEDELKIYPKIITENRRSSTIDIEIFVDDQV  420

Query: 421  IAKAMIAVKIN                                                  431
            IAKA+I  KIN
Sbjct: 421  IAKAIITTKIN                                                  431
```

Based on this analysis, it was predicted that these proteins and their epitopes could be useful antigens for vaccines or diagnostics.

Example 1431

A DNA sequence (GBSx1517) was identified in *S. agalactiae* <SEQ ID 4395> which encodes the amino acid sequence <SEQ ID 4396>. Analysis of this protein sequence reveals the following:

```
Possible site: 55
>>> Seems to have no N-terminal signal sequence
----- Final Results -----
    bacterial cytoplasm --- Certainty = 0.2837 (Affirmative) <succ>
    bacterial membrane --- Certainty = 0.0000 (Not Clear) <succ>
    bacterial outside  --- Certainty = 0.0000 (Not Clear) <succ>
```

The protein has homology with the following sequences in the GENPEPT database.

```
>GP:BAB04556 GB:AP001510 unknown conserved protein [Bacillus halodurans]
Identities = 56/185 (30%), Positives = 86/185 (46%), Gaps = 4/185 (2%)
Query:   7  MDIWTNLGRFAFIETEHVNLRPVAYTDREAFWRIASKRTNLQFI-FPVQTSKKESDFLLV   65
            M+I     G   +ETE + LR     D  A + AS     +++ +     S K+S+   L
Sbjct:   1  MEIEDIYGDLPTLETERLRLRKFYKDDAAAIYDYASNEQVTKYVLWETHQSIKDSEAFLA   60

Query:  66  HSFMK---EPLGVWAIEDKVSHKMFGVIRFENIDLSKKTAEIGYFLKESSWGQGIMTECL  122
              +  K    + +   WAIE K + +M G + F       KTAE+GY L  E   WGQGIMTE  +
Sbjct:  61  FALNKYDEKDVSPWAIELKRNERMIGTVDFVWWKPKDKTAELGYVLSEPYWGQGIMTEAV  120

Query: 123  KTLSFFAFREFGMDKLIIVTHKENIASQKVALKAHFKQSRSFKGSDRYTRRIRDYIEFQL  182
              L  F F    ++++       ENI+S +V  KA       + + +       RD+  + +
Sbjct: 121  NALVEFGFNNMELERIQAKCFAENISSARVMEKAGLIYEGTHRRAIYVKGAHRDFKVYAI  180

Query: 183  TRGDY  187
             R DY
Sbjct: 181  IREDY  185
```

A related DNA sequence was identified in *S. pyogenes* <SEQ ID 667> which encodes the amino acid sequence <SEQ ID 668>. Analysis of this protein sequence reveals the following:

```
Possible site: 52
>>> Seems to have no N-terminal signal sequence
----- Final Results -----
    bacterial cytoplasm --- Certainty = 0.1096 (Affirmative) <succ>
    bacterial membrane --- Certainty = 0.0000 (Not Clear) <succ>
    bacterial outside  --- Certainty = 0.0000 (Not Clear) <succ>
```

An alignment of the GAS and GBS proteins is shown below.

```
Identities = 94/177 (53%), Positives = 117/177 (65%)
Query:   7  MDIWTNLGRFAFIETEHVNLRPVAYTDREAFWRIASKRTNLQFIFPVQTSKKESDFLLVH   66
            MDIWT L  FAF ET  V LRP   Y D   F+ + +   NL ++FP Q +K  SD+LLVH
Sbjct:   1  MDIWTKLAVFAFFETPKVILRPFRYEDHWDFYSMVNDTKNLYYVFPEQKTKAASDYLLVH   60

Query:  67  SFMKEPLGVWAIEDKVSHKMFGVIRFENIDLSKKTAEIGYFLKESSWGQGIMTECLKTLS  126
            SF+K PLG  WAIEDK +H++  G IR E+  D   + A+IGYFL  +  WGQGIMTE  +   L
Sbjct:  61  SFIKFPLGQWAIEDKATHQVIGSIRIEHYDAKTRCADIGYFLNYAFWGQGIMTEVVIKLV  120

Query: 127  FFAFREFGMDKLIIVTHKENIASQKVALKAHFKQSRSFKGSDRYTRRIRDYIEFQLT     183
              + +F EFG+   L  I+TH EN ASQKVA KA F+      FKGSDR T +I  Y  +QLT
Sbjct: 121  YLSFHEFGLKTLRIITHLENKASQKVAKKAGFQLKTCFKGSDRNTHKICIYKMYQLT     177
```

Based on this analysis, it was predicted that these proteins and their epitopes could be useful antigens for vaccines or diagnostics.

Example 1432

A DNA sequence (GBSx1518) was identified in *S. agalactiae* <SEQ ID 4397> which encodes the amino acid sequence <SEQ ID 4398>. This protein is predicted to be UDP-N-acetylglucosamine-1-carboxyvinyl transferase (murA). Analysis of this protein sequence reveals the following:

```
Possible site: 61
>>> Seems to have no N-terminal signal sequence
INTEGRAL      Likelihood = -5.63    Transmembrane 25-41 (24-42)
----- Final Results -----
```

-continued

```
    bacterial membrane --- Certainty = 0.3251 (Affirmative) <succ>
    bacterial outside  --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:AAF86297 GB:AF072894 UDP-N-acetylglucosamine-1-carboxyvinyl
transferase [Listeria monocytogenes]
```

```
Identities = 240/412 (58%), Positives = 303/412 (73%), Gaps = 2/412 (0%)
Query:   3 KIIINGGKQLTGEVAVSGAKNSVVALIPATILADDVVVLDGVPAISDVDSLVDIMETMGA  62
           K+II GGK+L G + V GAKNS VALIPA ILA+  VVL+G+P ISDV +L +I+E +G
Sbjct:  20 KLIIRGGKKLAGTLQVDGAKNSAVALIPAAILAESEVVLEGLPDISDVHTLYNILEELGG  79

Query:  63 KIKRYGETLEIDPCGVKDIPMPYGKINSLRASYYFYGSLLGRYGQATLGLPGGCDLGPRP  122
           ++   +T IDP +  +P+P G +  LRASYY G++LGR+ +A +GLPGGC LGPRP
Sbjct:  80 TVRYDNKTAVIDPIDMISMPLPSGNVKKLRASYYLMGAMLGRFKKAVIGLPGGCYLGPRP  139

Query: 123 IDLHLKAFEAMGASVSYEGDSMRLATNGKPLQGANIYMDTVSVGATINTIIAAAKANGRT  182
           ID H+K FEA+GA V+ E  ++ L +    L+GA IY+D VSVGATIN ++AA +A G+T
Sbjct: 140 IDQHIKGFEALGAKVTNEQGAIYLRAD--ELKGARIYLDVVSVGATINIMLAAVRAKGKT  197

Query: 183 VIENAAREPEIIDVATLLNNMGAHIRGAGTDVITIEGVKSLHGTRHQVIPDRIEAGTYIA  242
           VIENAA+EPEIIDVATLL NMGA I+GAGTD I I GV+ LHG  H +IPDRIEAGT++
Sbjct: 198 VIENAAKEPEIIDVATLLTNMGAIIKGAGTDTIRITGVEHLHGCHHTIIPDRIEAGTFMV  257

Query: 243 MAAAIGRGIKVINVLYEHLESFIAKLDEMGVRMTVEEDSIFVEEQERLKAVSIKTSPYPG  302
           +AAA G+G+++ NV+  HLE  IAKL EMGV M +EED+IFV E E++K V IKT  YPG
Sbjct: 258 LAAASGKGVRIENVIPTHLEGIIAKLTEMGVPMDIEEDAIFVGEVEKIKKVDIKTYAYPG  317

Query: 303 FATDLQQPLTPLLLTAEGNGSLLDTIYEKRVNHVPELARMGANISTLGGKIVYSGPNQLS  362
           F TDLQQPLT LL  AEG+  + DTIY  R  H+ E+ RMG    G   V +GP QL
Sbjct: 318 FPIDLQQPLTALLTRAEGSSVITDTIYPSRFKHIAEIERMGGKFKLEGRSAVINGPVQLQ  377

Query: 363 GAPVKATDLRAGAALVIAGLMAEGRTEITNIEFILRGYSNIIEKLTSLGADI          414
           G+ V ATDLRAGAALVIA L+A+G TEI  +E I RGYS IIEKL+++GA+I
Sbjct: 378 GSKVTATDLRAGAALVIAALLADGETEIHGVEHIERGYSKIIEKLSAIGANI          429
```

A related DNA sequence was identified in *S. pyogenes* <SEQ ID 4399> which encodes the amino acid sequence <SEQ ID 4400>. Analysis of this protein sequence reveals the following:

Possible site: 21
>>> Seems to have no N-terminal signal sequence

```
INTEGRAL    Likelihood = -8.70    Transmembrane 25-41 (23-45)
----- Final Results -----
   bacterial membrane --- Certainty = 0.4482 (Affirmative) <succ>
   bacterial outside --- Certainty = 0.0000 (Not Clear) <succ>
   bacterial cytoplasm --- Certainty = 0.0000 (Not Clear) <succ>
```

The protein has homology with the following sequences in the databases:

```
>GP:AAF86297 GB:AF072894 UDP-N-acetylglucosamine-1-carboxyvinyl
transferase [Listeria monocytogenes]
Identities = 244/412 (59%), Positives = 302/412 (73%), Gaps = 2/412 (0%)
Query:   3 KIIINGGKALSGEVAVSGAKNSVVALIPAIILADDIVILDGVPAISDVDSLIEIMELMGA  62
           K+II GGK L+G + V GAKNS VALIPA ILA+  V+L+G+P ISDV +L  I+E +G
Sbjct:  20 KLIIRGGKKLAGTLQVDGAKNSAVALIPAAILAESEVVLEGLPDISDVHTLYNILEELGG  79

Query:  63 TVNYHGDTLEIDPRGVQDIPMPYGKINSLRASYYFYGSLLGRFGQAVVGLPGGCDLGPRP  122
           TV Y   T IDP +  +P+P G +  LRASYY G++LGRF +AV+GLPGGC LGPRP
Sbjct:  80 TVRYDNKTAVIDPTDMISMPLPSGNVKKLRASYYLMGAMLGRFKKAVIGLPGGCYLGPRP  139

Query: 123 IDLHLKAFEAMGVEVSYEGENMELSTNGQKIHGAHIYMDTVSVGATINTMVAATKAQGKT  182
           ID H+K FEA+G +V+ E   + L +  ++ GA IY+D VSVGATIN M+AA +A+GKT
Sbjct: 140 IDQHIKGFEALGAKVTNEQGAIYLRAD--ELKGARIYLDVVSVGATINIMLAAVRAKGKT  197

Query: 183 VIENAAREPEIIDVATLLNNMGAHIRGAGTDIITIQGVQKLHGTRHQVIPDRIEAGTYIA  242
           VIENAA+EPEIIDVATLL NMGA I+GAGTD I I GV+ LHG  H +IPDRIEAGT++
Sbjct: 198 VIENAAKEPEIIDVATLLTNMGAIIKGAGTDTIRITGVEHLHGCHHTIIPDRIEAGTFMV  257

Query: 243 LAAAIGKGVKITNVLYEHLESFIAKLEEMGVRMTVEEDAIFVEKQESLKAITIKTSPYPG  302
           LAAA GKGV+I NV+  HLE  IAKL EMGV M +EEDAIFV + E +K  IKT  YPG
Sbjct: 258 LAAASGKGVRIENVIPTHLEGIIAKLTEMGVPMDIEEDAIFVGEVEKIKKVDIKTYAYPG  317

Query: 303 FATDLQQPLTPLLLKADGRGTIIDTIYEKRINHVPELMRMGADISVIGGQIVYQGPSRLT  362
           F TDLQQPLT LL +A+G   I DTIY  R  H+ E+ RMG     G   V  GP +L
Sbjct: 318 FPTDLQQPLTALLTRAEGSSVITDTIYPSRFKHIAEIERMGGKFKLEGRSAVINGPVQLQ  377

Query: 363 GAQVKATDLRAGAALVTAGLIAEGKTEITNIEFILRGYASIIAKLTALGADI          414
           G++V ATDLRAGAALV  L+A+G+TEI  +E I RGY+ II KL+A+GA+I
Sbjct: 378 GSKVTATDLRAGAALVIAALLADGETEIHGVEHIERGYSKIIEKLSAIGANI          429
```

An alignment of the GAS and GBS proteins is shown below.

```
Identities = 344/419 (82%), Positives = 394/419 (93%)
Query:   1 MRKIIINGGKQLTGEVAVSGAKNSVVALIPATILADDVVVLDGVPAISDVDSLVDIMETM  60
           MRKIIINGGK L+GEVAVSGAKNSVVALIPA ILADD+V+LDGVPAISDVDSL++IME M
Sbjct:   1 MRKIIINGGKALSGEVAVSGAKNSVVALIPAIILADDIVILDGVPAISDVDSLIEIMELM  60

Query:  61 GAKIKRYGETLEIDPCGVKDIPMPYGKINSLRASYYFYGSLLGRYGQATLGLPGGCDLGP 120
           GA +   +G+TLEIDP GV+DIPMPYGKINSLRASYYFYGSLLGR+GQA +GLPGGCDLGP
Sbjct:  61 GATVNYHGDTLEIDPRGVQDIPMPYGKINSLRASYYFYGSLLGRFGQAVVGLPGGCDLGP 120

Query: 121 RPIDLHLKAFEAMGASVSYEGDSMRLATNGKPLQGANIYMDTVSVGATINTIIAAAKANG 180
           RPIDLHLKAFEAMG  VSYEG++M L+TNG+ + GA+IYMDTVSVGATINT++AA KA G
Sbjct: 121 RPIDLHLKAFEAMGVEVSYEGENNNLSTNGQKIHGAHIYMDTVSVGATINTMVAATKAQG 180

Query: 181 RTVIENAAREPEIIDVATLLNNMGAHIRGAGTDVITIEGVKSLHGTRHQVIPDRIEAGTY 240
           +TVIENAAREPEIIDVATLLNNMGAHIRGAGTD+ITI+GV+ LHGTRHQVIPDRIEAGTY
Sbjct: 181 KTVIENAAREPEIIDVATLLNNMGAHIRGAGTDIITIQGVQKLHGTRHQVIPDRIEAGTY 240

Query: 241 IAMAAAIGRGIKVTNVLYEHLESFIAKLDEMGVRMTVEEDSIFVEEQERLKAVSIKTSPY 300
           IA+AAAIG+G+K+TNVLYEHLESFIAKL+EMGVRMTVEED+IFVE+QE LKA++IKTSPY
Sbjct: 241 IALAAAIGKGVKITNVLYEHLESFIAKLEEMGVRMTVEEDAIFVEKQESLKAITIKTSPY 300

Query: 301 PGFATDLQQPLTPLLLTAEGNGSLLDTIYEKRVNHVPELARMGANISTLGGKIVYSGPNQ 360
           PGFATDLQQPLTPLLL A+G G+++DTIYEKR+NHVPEL RMGA+IS +GG+IVY GP++
Sbjct: 301 PGFATDLQQPLTPLLLKADGRGTIIDTIYEKRINHVPELMRMGADISVIGGQIVYQGPSR 360

Query: 361 LSGAPVKATDLRAGAALVIAGLMAEGRTEITNIEFILRGYSNIIEKLTSLGADIQLVEE  419
           L+GA VKATDLRAGAALV AGL+AEG+TEITNIEFILRGY++II KLT+LGADIQL+E+
Sbjct: 361 LTGAQVKATDLRAGAALVTAGLIAEGKTEITNIEFILRGYASIIAKLTALGADIQLIED  419
```

Based on this analysis, it was predicted that these proteins and their epitopes could be useful antigens for vaccines or diagnostics.

Example 1433

A DNA sequence (GBSx1519) was identified in *S. agalactiae* <SEQ ID 4401> which encodes the amino acid sequence <SEQ ID 4402>. This protein is predicted to be thiamine phosphate pyrophosphorylase (thiE). Analysis of this protein sequence reveals the following:

---
Possible site: 55
>>> Seems to have no N-terminal signal sequence
----- Final Results -----
   bacterial cytoplasm --- Certainty = 0.0422 (Affirmative) <succ>
      bacterial membrane --- Certainty = 0.0000 (Not Clear) <succ>
         bacterial outside --- Certainty = 0.0000 (Not Clear) <succ>
---

The protein has homology with the following sequences in the GENPEPT database.

```
>GP:AAF25544 GB:AF109218 ThiE [Staphylococcus carnosus]
Identities = 98/200 (49%), Positives = 140/200 (70%), Gaps = 1/200 (0%)
Query:   5 LKLYFVCGTVDCSR-KNILTVVEEALQAGITLFQFREKGFTALQGKEKIAMAKQLQILCK  63
           L +YF+CGT D    + I V++EAL+ GITL+QFREKG A  G++K+A+AK+LQ LCK
Sbjct:   7 LNVYFICGTQDIPEGRTIQEVLKEALEGGITLYQFREKGNGAKTGQDKVALAKELQALCK  66

Query:  64 QYQVPFIIDDDIDLVELIDADGLHIGQNDLPVDEARRRLPDKIIGLSVSTMDEYQKSQLS 123
              Y VPFI++DD+ L E IDADG+H+GQ+D VD+   R   KIIGLS+  ++E   S L+
Sbjct:  67 SYNVPFIVNDDVALAEEIDADGIHVGQDDEAVDDFNNRFEGKIIGLSIGNLEELNASDLT 126

Query: 124 VVDYIGIGPFNPTQSKADAKPAVGNRTTKAVREINQDIPIVAIGGITSDFVHDIIESGAD 183
           VDYIG+GP   T SK DA   VG + + +R+   D+PIVAIGGI+ D V ++ ++ AD
Sbjct: 127 YVDYIGVGPIFATPSKDDASEPVGPKMIETLRKEVGDLPIVAIGGISLDNVQEVAKTSAD 186

Query: 184 GIAVISAISKANHIVDATRQ                                         203
           G++VISAI+++ H+ +   +
Sbjct: 187 GVSVISAIARSPHVTETVHK                                         206
```

No corresponding DNA sequence was identified in *S. pyogenes*.

Based on this analysis, it was predicted that this protein and its epitopes, could be useful antigens for vaccines or diagnostics.

Example 1434

A DNA sequence (GBSx1520) was identified in *S. agalactiae* <SEQ ID 4403> which encodes the amino acid sequence <SEQ ID 4404>. This protein is predicted to be hydroxyethylthiazole kinase (b2104). Analysis of this protein sequence reveals the following:

---
Possible site: 54
>>> Seems to have a cleavable N-term signal seq.
INTEGRAL     Likelihood = −4.94    Transmembrane 198-214 (194-217)
----- Final Results -----
   bacterial membrane --- Certainty = 0.2975 (Affirmative) <succ>
      bacterial outside --- Certainty = 0.0000 (Not Clear) <succ>
         bacterial cytoplasm --- Certainty = 0.0000 (Not Clear) <succ>
---

A related GBS nucleic acid sequence <SEQ ID 8805> which encodes amino acid sequence <SEQ ID 8806> was also identified. Analysis of this protein sequence reveals the following:

---

Lipop: Possible site: −1 Crend: 7
McG: Discrim Score: −2.93
GvH: Signal Score (−7.5): 1.61
Possible site: 39
>>> Seems to have no N-terminal signal sequence
ALOM program    count: 1 value: −4.94 threshold: 0.0
INTEGRAL      Likelihood = −4.94   Transmembrane 183-199 (179-202)
PERIPHERAL    Likelihood = 2.49    151
modified ALOM score: 1.49
*** Reasoning Step: 3
----- Final Results -----
   bacterial membrane --- Certainty = 0.2975 (Affirmative) <succ>
     bacterial outside --- Certainty = 0.0000 (Not Clear) <succ>
       bacterial cytoplasm --- Certainty = 0.0000 (Not Clear) <succ>

---

The protein has homology with the following sequences in the GENPEPT database.

```
>GP:AAF25543 GB:AF109218 ThiM [Staphylococcus carnosus]
Identities = 114/253 (45%), Positives = 160/253 (63%), Gaps = 1/253 (0%)
Query:  18 LEQLKEVNPLTICITNNVVKNFTANGLLALGASPAMSECIEDLEDLLKVADALLINIGTL   77
           L+Q++   +PL IC TN+VVKNFTANGLL+LGASP MSE   ++ ED    VA ++LINIGTL
Sbjct:   5 LDQIRTEHPLVICYTNDVVKNFTANGLLSLGASPTMSEAPQEAEDFYPVAGSVLINIGTL   64

Query:  78 TKESWQLYQEAIKIANKNQVPVVLDPVAAGASRFRLEVSLDLLKNYSISLLTGNGSEIAA  137
           TK     E   KIAN+ + P+V DPVA GAS++R +     LK    +++ GN SEI A
Sbjct:  65 TKHHEHAMLENAKIANETETPLVFDPVAVGASKYRKDFCKYFLKKIKPTVIKGNASEILA  124

Query: 138 LIGEKQASKGADGGKVADLESIAVKANQVFDVPVVVTGETDAIAVRGEVRLLQNGSPLMP  197
           LI +   KG D    D+ IA KA + +   +++TGETD I    +V  L NGS  +
Sbjct: 125 LIDDTATMKGTDSADNLDVVDIAEKAYKEYQTAIILTGETDVIVQDNKVVKLSNGSHFLA  184

Query: 198 LVTGTGCLLGAVLAAFIGSSDRSDDLACLTEAMTVYNVAGEIAEKVAKGKGVGSFQVAFL  257
           +TG GCLLGAV+ AF+   +    + L EA++VYN+A E AE+++  KG G+F  F+
Sbjct: 185 KITGAGCLLGAVVGAFL-FRNTHPSIETLIEAVSVYNIAAERAEQLSDSKGPGTFLTQFI  243

Query: 258 DALSQMKSEMIMD                                                270
           DAL ++ S+ + +
Sbjct: 244 DALYRIDSDAVAE                                                256
```

No corresponding DNA sequence was identified in *S. pyogenes*.

SEQ ID 8806 (GBS398) was expressed in *E. coli* as a His-fusion product. SDS-PAGE analysis of total cell extract is shown in FIG. 75 (lane 6; MW 31.8 kDa).

Figure 314:
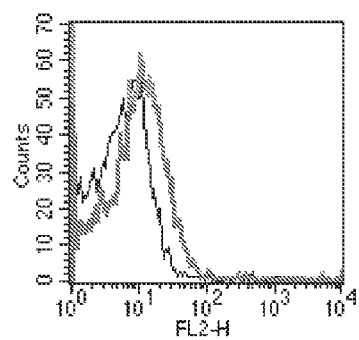

The GBS398-His fusion product was purified (FIG. 214, lane 5) and used to immunise mice. The resulting antiserum was used for FACS (FIG. 314), which confirmed that the protein is immunoaccessible on GBS bacteria.

Based on this analysis, it was predicted that these proteins and their epitopes could be useful antigens for vaccines or diagnostics.

Example 1435

A DNA sequence (GBSx1521) was identified in *S. agalactiae* <SEQ ID 4405> which encodes the amino acid sequence <SEQ ID 4406>. This protein is predicted to be ThiD (thiD). Analysis of this protein sequence reveals the following:

---

Possible site: 44
>>> Seems to have an uncleavable N-term signal seq
----- Final Results -----
   bacterial membrane --- Certainty = 0.0000 (Not Clear) <succ>
     bacterial outside --- Certainty = 0.0000 (Not Clear) <succ>
       bacterial cytoplasm --- Certainty = 0.0000 (Not Clear) <succ>

---

The protein has homology with the following sequences in the GENPEPT database.

```
>GP:AAF25542 GB:AF109218 ThiD [Staphylococcus carnosus]
Identities = 139/258 (53%), Positives = 186/258 (71%), Gaps = 4/258 (1%)
Query:   8 LTIAGTDPSGGAGIMADLKTFQARRTYGMAVVTSVVAQNTCGVRGVQHIETAIIDQQLAC   67
           LTIAGTDP+GGAG+MADLK+F A    YGMA +TS+VAQNT GV+ + +++    + +QL
Sbjct:   8 LTIAGTDPTGGAGVMADLKSFHACGVYGMAAITSIVAQNTKGVQHIHNLDITWLKEQLDS   67

Query:  68 VYDDIKPKAVKTGMLAERETISLVASYLKKYPQ-PYVLDPVMVATSGHRLIDSDAVEALK  126
           ++DD   P+A+KTGM+A +E + L+ SYL+KYP  PYV+DPVM+A SG  L+D      AL+
Sbjct:  68 IFDDELPQAIKTGMIATKEMMELIRSYLEKYPDIPYVIDPVMLAKSGDSLMDDAGKHALQ  127

Query: 127 EDLLPLATIITPNLPEAEVLVGYDLSDEVSIIKAGYDIQKQYSVRNVLIKGGHLD--GLA  184
           E LLPLA + TPNLPEAE +VG+ L  E +I KAG     +   + V+IKGGH++    +A
Sbjct: 128 EILLPLADVATPNLPEAEEIVGFKLDTEEAIKKAGDIFINEIGSKGVVIKGGHIEDKNIA  187

Query: 185 KDYLFLEKEGLITLSNQRINTIHTHGTGCTFAAVVAAELAKGQSILNAVSTAKSFITSAI  244
           KDYLF  K+GL    ++R +T HTHGTGCTF+AV+  AELAKG++I    AV  AK FI   +I
Sbjct: 188 KDYLF-TKDGLEVFESERYDTKHTHGTGCTFSAVITAELAKGKTIYEAVKKAKDFIALSI  246
```

```
Query: 245  ETAPELGLGNGPVNHTSY            262
            +   PE+G G GPVNH +Y
Sbjct: 247  KYTPEIGQGRGPVNHFAY            264
```

There is also homology to SEQ ID 4408.

Based on this analysis, it was predicted that this protein and its epitopes, could be useful antigens for vaccines or diagnostics.

Example 1436

A DNA sequence (GBSx1522) was identified in *S. agalactiae* <SEQ ID 4409> which encodes the amino acid sequence <SEQ ID 4410>. This protein is predicted to be TenA (tenA). Analysis of this protein sequence reveals the following:

---

Possible site: 42
>>> Seems to have no N-terminal signal sequence
----- Final Results -----
   bacterial cytoplasm --- Certainty = 0.2242 (Affirmative) <succ>
   bacterial membrane --- Certainty = 0.0000 (Not Clear) <succ>
     bacterial outside --- Certainty = 0.0000 (Not Clear) <succ>

---

The protein has homology with the following sequences in the GENPEPT database.

```
>GP:AAF25541 GB:AF109218 TenA [Staphylococcus carnosus]
Identities = 78/213 (36%), Positives = 127/213 (59%), Gaps = 6/213 (2%)
Query:  14  IQSIYQDPFIQGIIKGRLDHDVICHYLQADNIYLGKFADIYALCLAKSDNLRDKQFFLEQ   73
            I  IYQD FIQ ++KG +  + +  YL+AD  YL +FA+IYAL +    +L   +F ++Q
Sbjct:  15  IDEIYQDHFIQELLKGDIKKEALRQYLRADASYLREFANIYALLIPIMPDLESVRELVDQ   74

Query:  74  IDFTLNRELADGEGPHQALAAYTNRSYQDIIEKGVWYPSADHYIKHMYFHFY-ENGIAGA  132
            I F +N E+      H+ +A Y   +Y +I++K VW PS DHYIKHMY++ Y    A A
Sbjct:  75  IQFIVNGEVE----AHEYMADYIGENYNEIVQKKVWPPSGDHYIKHMYYNVYAHENAAYA  130

Query: 133  LAAMSPCPWIYHQLAKKIIEENQFLNGNPFNNWITFYANDTVEELMENYFRMMDYYAQNL  192
            +AAM+PCP++Y  +AK+ +++       +   W  FY N  ++ L+E    +M+   N+
Sbjct: 131  IAAMAPCPYVYAMIAKRAMKDPNLNKSSILAKWEEFY-NTEMDPLIEVLDDLMNQLTANM  189

Query: 193  SKEKQADLVDAFVKSCQHERRFFQMAINQEKWE                            225
            S+ ++ ++ +   +++S  HE  FF MA   EKW+
Sbjct: 190  SETEKNEVRENYLQSTVHELNFFNMAYTSEKWQ                            222
```

No corresponding DNA sequence was identified in *S. pyogenes*.

Based on this analysis, it was predicted that this protein and its epitopes, could be useful antigens for vaccines or diagnostics.

Example 1437

A DNA sequence (GBSx1523) was identified in *S. agalactiae* <SEQ ID 4411> which encodes the amino acid sequence <SEQ ID 4412>. Analysis of this protein sequence reveals the following:

---

Possible site: 35
>>> Seems to have a cleavable N-term signal seq.
INTEGRAL   Likelihood = −7.06   Transmembrane 43-59 (36-63)
INTEGRAL   Likelihood = −2.55   Transmembrane 92-108 (92-112)
INTEGRAL   Likelihood = −1.49   Transmembrane 135-151 (135-151)
INTEGRAL   Likelihood = −1.06   Transmembrane 69-85 (69-85)
INTEGRAL   Likelihood = −0.22   Transmembrane 216-232 (216-232)
----- Final Results -----
   bacterial membrane --- Certainty = 0.3824 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the GENPEPT database.

```
>GP:CAA91230 GB:Z56283 orf2 [Lactobacillus helveticus]
Identities = 46/215 (21%), Positives = 96/215 (44%), Gaps = 3/215 (1%)
Query:  21  AITFLCLLIPTFSFSFTLRLRTSLLFLIIVVTLQCFVKVSLKTWAKVNLISFVMGLSLFL   80
            ++ F+   I +   S    L T+L+ +          ++ +K   +  +  F+   ++F
Sbjct:   4  SLKFILAFIISLEISLKASLTTNLIVIAFALIYLLVTRIKIKELILLIAVPFIASFTIFA   63

Query:  81  GTYFWGKLPHQFVLASLVACRPLIFMNVGLLFHASHSNYDFIESLYQTFKVPSHFAYGIF  140
            +++   P  +  +L + R +++       + +   DF  SL Q  +PS FAYG+
Sbjct:  64  TLFWFSPTPDAYYAWNL-STRVYVYTLTIACVTRNTTATDFARSLEQNLHLPSKFAYGVL  122

Query: 141  AVFNLLPLIKLQYQRNRLAFRLKNQVTWALSPRLILSVLLKTIYWVEQLELAMLSKGFEV  200
            A   N++P +K   ++ R  +        SP L    +L +   + L   M S G+
Sbjct: 123  AAINIIPRMKTAVKQIRTSAMMRGMYLSFWSPVLYFKAILVALNSADNLAQGMESHGYVE  182

Query: 201  GKERTHASTYPVRFRDYSL-LGMSILLSIGM-IFK                           233
            G++R     P+  +D+ +    IL++I + IFK
Sbjct: 183  GQKRATIVAIPLTKKDWLIFFTLLILVNISLFIFK                           217
```

No corresponding DNA sequence was identified in *S. pyogenes*.

A related GBS gene <SEQ ID 8807> and protein <SEQ ID 8808> were also identified. Analysis of this protein sequence reveals the following:

---

Lipop: Possible site: −1   Crend: 0
McG: Discrim Score: 4.50
GvH: Signal Score (−7.5): −0.2
Possible site: 35
>>> Seems to have a cleavable N-term signal seq.
ALOM program count: 5 value: −7.06 threshold: 0.0
INTEGRAL    Likelihood = −7.06   Transmembrane 43-59 (36-63)
INTEGRAL    Likelihood = −2.55   Transmembrane 92-108 (92-112)
INTEGRAL    Likelihood = −1.49   Transmembrane 135-151 (135-151)
INTEGRAL    Likelihood = −1.06   Transmembrane 69-85 (69-85)
INTEGRAL    Likelihood = −0.22   Transmembrane 216-232 (216-232)
PERIPHERAL  Likelihood = 2.65    170
modified ALOM score: 1.91
*** Reasoning Step: 3
----- Final Results -----
    bacterial membrane --- Certainty = 0.3824 (Affirmative) <succ>
       bacterial outside --- Certainty = 0.0000 (Not Clear) <succ>
       bacterial cytoplasm --- Certainty = 0.0000 (Not Clear) <succ>

---

Based on this analysis, it was predicted that these proteins and their epitopes could be useful antigens for vaccines or diagnostics.

Example 1438

A DNA sequence (GBSx1524) was identified in *S. agalactiae* <SEQ ID 4413> which encodes the amino acid sequence <SEQ ID 4414>. Analysis of this protein sequence reveals the following:

---

Possible site: 24
>>> Seems to have no N-terminal signal sequence
----- Final Results -----
    bacterial cytoplasm --- Certainty = 0.3007 (Affirmative) <succ>
    bacterial membrane --- Certainty = 0.0000 (Not Clear) <succ>
    bacterial outside --- Certainty = 0.0000 (Not Clear) <succ>

---

The protein has homology with the following sequences in the GENPEPT database.

```
>GP:CAA91229 GB:Z56283 orf1 [Lactobacillus helveticus]
Identities = 123/424 (29%), Positives = 200/424 (47%), Gaps = 48/424 (11%)
Query:  17 LFDEVTFSLNPGERILISGYSGCGKSTLALLLSGL--KESGK--GQVLLNGSLIEPSDVG    72
           L +++  ++ PG +LI G +GCGKSTL   +GL   K +GK  G++ L+G
Sbjct:  12 LINQLNMNIAPGFNLLI-GPTGCGKSTLLKIIAGLYPKYAGKLTGKIDLHGQ-----KAA    65

Query:  73 FLFQNPDLQFCMDTVAHELYFILENLQIEPEQMQDRSEFVLAQVGLKGFQNRLIYTLSQG   132
           +FQN   QF M T   E+ F LENLQI+ +    +   +     ++ I TLS G
Sbjct:  66 MMFQNAAEQFTMTTPREEIIFALENLQIKAKDYDLHIKKAVEFTKIADLLDQKINTLSGG   125

Query: 133 EKQRLALATIFLKSPKLIILDEAFANLDQESASQLLQLVLNYQANNQSMLIVIDHLITYY   192
           ++Q +ALA +       + +LDE FA+ D +   L++ + +     ++ +I+ DH++  Y
Sbjct: 126 QQQHVALAVLIAMDVDVFLLDEPFASCDPNTRHFLIEKLASLAETGRT-IILSDHVLDDY   184

Query: 193 QDIMDHYFWLEKRLTRVNFDYMLNRLNVFELEKKSHN--------TGDKLLSIKDFQVK-   243
           + I DH + E + +      N+L F+ K+ H         TG  +  Q+K
Sbjct: 185 EKICDHLYQFEGKTVKELSANEKNKL--FKQNKQFHEQSYSFALPTGTPVFELNKTQIKQ   242

Query: 244 ----LSKNKFISYLDFDLASGERLCLDGPSGVGKSSLFMGLLGLYRTKGK--------KQ   291
               L +NK Y       G+    + G +GVGK+SLF +   +    KG          +
Sbjct: 243 NRLLLKQNKLKIY-------GKTTLITGSNGVGKTSLFKAMTKMIPYKGNFTYLDNEISK   295

Query: 292 FTHRKQIP-ISFLFQNPLDQFIFSTVYDEIFQVCKDSN------KARDILETINLWDKKQ   344
           +  RK + I+  FQ  DQF+ TV DEI   KD N      K  + LE + L
Sbjct: 296 IKYRKYLSQIAQFFQKASDQFLTVTVKDEIELSKKDRNNFFTDAKIDEWLEKLQLKQHLD   355

Query: 345 FSPFQLSQGQQRRLAIGSILASDSKLLLLDEPTYGQDAYHANMITTLLLLSYCHKNHCGVI   404
            + LS GQQ++L I  +L +    +LL+DEP   G D   +++  L+        K   +
Sbjct: 356 QVVYSLSGGQQKKLQILLMLMTKHNVLLIDEPLSGLDHESVDLVLQLMQECQEKLQQTFL   415

Query: 405 FTSH   408
           SH
Sbjct: 416 IISH   419

Identities = 44/185 (23%), Positives = 83/185 (44%), Gaps = 24/185 (12%)
Query:  28 GERILISGYSGCGKSTLALLLSGLKESGKGQVLLNGSLIEP------SDVGFLFQNPDLQ    81
           G+ LI+G +G GK++L    + +   +     L+   + +       S +  FQ     Q
Sbjct: 256 GKTTLITGSNGVGKTSLFKAMTKMIPYKGNFTYLDNEISKIKYRKYLSQIAQFFQKASDQ   315

Query:  82 FCMDTVAHELYFILENLQIEPEQMQDRSEFV--------LAQVGLKGFQNRLIYTLSQGE   133
           F     TV E+            +DR+ F        L ++ LK    ++++Y+LS G+
Sbjct: 316 FLTVTVKDEIEL----------SKKDRNNFFTDAKIDEWLEKLQLKQHLDQVVYSLSGGQ   365

Query: 134 KQRLALATIFLKSPKLIILDEAFANLDQESASQLLQLVLNYQANNQSMLIVIDHLITYYQ   193
           +++L + +  +       ++DE + LD ES   +QL+   Q  Q    ++I H I
```

-continued

```
Sbjct: 366  QKKLQILLMLMTKHNVLLIDEPLSGLDHESVDLVLQLMQECQEKLQQTFLIISHQIDALA  425

Query: 194  DIMDH                                                         198
            D  D+
Sbjct: 426  DFCDY                                                         430
```

A related DNA sequence was identified in *S. pyogenes* <SEQ ID 4415> which encodes the amino acid sequence <SEQ ID 4416>. Analysis of this protein sequence reveals the following:

Possible site: 30
>>> Seems to have no N-terminal signal sequence
----- Final Results -----
   bacterial cytoplasm --- Certainty = 0.3093 (Affirmative) <succ>
   bacterial membrane --- Certainty = 0.0000 (Not Clear) <succ>
   bacterial outside --- Certainty = 0.0000 (Not Clear) <succ>

Possible site: 42
>>> Seems to have an uncleavable N-term signal seq
INTEGRAL   Likelihood = −11.62   Transmembrane 8-24 (1-30)
INTEGRAL   Likelihood = −8.17   Transmembrane 145-161 (143-163)
INTEGRAL   Likelihood = −6.32   Transmembrane 66-82 (62-84)
INTEGRAL   Likelihood = −3.77   Transmembrane 112-128 (111-132)
INTEGRAL   Likelihood = −2.66   Transmembrane 43-59 (43-59)
----- Final Results -----
   bacterial membrane --- Certainty = 0.5649 (Affirmative) <succ>
   bacterial outside --- Certainty = 0.0000 (Not Clear) <succ>
   bacterial cytoplasm --- Certainty = 0.0000 (Not Clear) <succ>

An alignment of the GAS and GBS proteins is shown below.

The protein has homology with the following sequences in the GENPEPT database.

```
Identities = 120/455 (26%), Positives = 203/455 (44%), Gaps = 47/455 (10%)
Query:   1  MLSVEKLACTHGDSHYLFDEV-TFSLNPGERILISGYSGCGKSTLALLLSGLKE---SGK   56
            M+S E+L  T+ D       ++ T  +  G+ I++ G SG GKST   LL+G+    +GK
Sbjct:  21  MISAEQLVFTYHDQKNPACQISTCQIASGQFIVLCGPSGSGKSTFLKLLNGIIPDYYAGK   80

Query:  57  GQVLLNGSLIEPS---------DVGFLFQNPDLQFCMDTVAHELYFILENLQIEPEQMQD  107
            +   L+ +  +           V  +FQNP  QF     V HEL F  EN ++ +  +
Sbjct:  81  YEGRLDVADCQAGRDSVETFSRSVASVFQNPASQFFYREVQHELVFPCENQGLDAKVIMK  140

Query: 108  RSEFVLAQVGLKGFQNRLIYTLSQGEKQRLALATIFLKSPKLIILDEAFANLDQESASQL  167
            R  +           N+ ++ LS G+KQR+A+AT ++   +++ DE  ANLD    + +
Sbjct: 141  RLWTLAEDFAFAELLNKDMFGLSGGQKQRVAIATAIMQGTNIMLFDEPTANLDSAGIAAV  200

Query: 168  LQLVLNYQANNQSMLIVIDHLITYYQDIMDHYFW-----LEKRLTRVNF---------DY  213
             +   +A  ++IV +H + Y  D+ D++F+      L  +LT  N          D
Sbjct: 201  KAYLTQLKAAGKT-IIVAEHRLHYLMDLADNFFYFKNGRLTDKLTTQNLLALTDEQRQDM  259

Query: 214  MLNRLNVFELE-------KKSHNTGDKLLSIKDFQVKLSKNKFISYLDFDLASGERLCLD  266
              L RL++ +L+       +   H   D L I+    V+          A G       +
Sbjct: 260  GLRRLDLSDLKPVLAGKIESQHYRPDDSLCIEHLTVRAGSKILRCIEQLSFAVSSISGIT  319

Query: 267  GPSGVGKSSLFMGLLGLYRTKGKKQFTHRKQIPISFLFQNPLDQFIFSTVYDEIF--QVC  324
            G +G+GKS L   + G+    KK     +  + IP+S       +     V ++F   V
Sbjct: 320  GSNGLGKSQLVYYIAGI--LDDKKATIKFQGIPLSAKQRLSKTSIVLQEVSLQLFAESVS  377

Query: 325  KDSN-------KARDILETINLWDKKQFSPFQLSQGQQRRLAIGSILASDSKLLLLDEPT  377
            K+ N         +   +++E  ++L    +  P  LS G+Q+R+ I + L +D  +L+ DEP+
Sbjct: 378  KEVNLGHERHPRTTEVIERLSLTTLLERHPASLSGGEQQRVMIAASLLADKDILIFDEPS  437

Query: 378  YGQDAYHANMITTLLLSYCHKNHCGVIFTSHDPHL                           412
                G D     + LL+      H   VI   SHD L
Sbjct: 438  SGLDLLQMKALANLLMQ-LKTQHKVVILISHDEEL                          471
```

Based on this analysis, it was predicted that these proteins and their epitopes could be useful antigens for vaccines or diagnostics.

Example 1439

A DNA sequence (GBSx1525) was identified in *S. agalactiae* <SEQ ID 4417> which encodes the amino acid sequence <SEQ ID 4418>. Analysis of this protein sequence reveals the following:

```
>GP:CAB13180 GB:Z99110 ykoE [Bacillus subtilis]
Identities = 68/177 (38%), Positives = 117/177 (65%), Gaps = 1/177 (0%)
Query:   5  LKDVLLIALLAVVLGVVYFGAGYISNAFVPFVGPIAHEVIYGIWFVAGPMALYILRKPGT   64
            +K+++++++++V VVY  +   N      GPIA+E IYGIWF+   +A Y++RKPG
Sbjct:   6  VKEIVIMSVISIVFAVVYLLFTHFGNVLAGMFGPIAYEPIYGIWFIVSVIAAYMIRKPGA   65
```

```
Query:   65 AIVAELLAALIEVLIGSIYGPSVLVIGTLQGLGSELGFTLFRYHNYKLPAFILSAILTSI  124
             A+V+E++AAL+E L+G+  GP V+VIG +QGLG+E  F    R+  Y LP  +L+ + +S+
Sbjct:   66 ALVSEIIAALVECLLGNPSGPMVIVIGIVQGLGAEAVFLATRWKAYSLPVLMLAGMGSSV  125

Query:  125 FSFAWSFYANGLSAFSFSYNILMLIVRTVS-SIIFFLLTKNICDQLHRSGVLNAYGI     180
             SF +  + +G +A+S  Y ++ML++R +S +++   LL K +    L  +GVLN    +
Sbjct:  126 ASFIYDLFVSGYAAYSPGYLLIMLVIRLISGALLAGLLGKAVSGSLAYTGVLNGMAL    182
```

No corresponding DNA sequence was identified in *S. pyogenes*.

Based on this analysis, it was predicted that this protein and its epitopes, could be useful antigens for vaccines or diagnostics.

Example 1440

A DNA sequence (GBSx1526) was identified in *S. agalactiae* <SEQ ID 4419> which encodes the amino acid sequence <SEQ ID 4420>. Analysis of this protein sequence reveals the following:

---

Possible site: 47
>>> Seems to have no N-terminal signal sequence
INTEGRAL    Likelihood = -6.69    Transmembrane 65-81 (53-95)
INTEGRAL    Likelihood = -6.37    Transmembrane 34-50 (31-54)
INTEGRAL    Likelihood = -6.10    Transmembrane 176-192 (169-195)
INTEGRAL    Likelihood = -3.66    Transmembrane 130-146 (130-151)
INTEGRAL    Likelihood = -1.97    Transmembrane 3-19 (3-19)
INTEGRAL    Likelihood = -0.90    Transmembrane 88-104 (88-104)
----- Final Results -----
   bacterial membrane --- Certainty = 0.3675 (Affirmative) <succ>
      bacterial outside --- Certainty = 0.0000 (Not Clear) <succ>
         bacterial cytoplasm --- Certainty = 0.0000 (Not Clear) <succ>

---

A related GBS nucleic acid sequence <SEQ ID 9757> which encodes amino acid sequence <SEQ ID 9758> was also identified.

The protein has no significant homology with any sequences in the GENPEPT database.

No corresponding DNA sequence was identified in *S. pyogenes*.

A related GBS gene <SEQ ID 8809> and protein <SEQ ID 8810> were also identified. Analysis of this protein sequence reveals the following:

---

Lipop: Possible site: -1   Crend: 8
McG: Discrim Score: -4.09
GvH: Signal Score (-7.5): -4.38
Possible site: 47
>>> Seems to have no N-terminal signal sequence
ALOM program  count: 6 value: -6.69  threshold: 0.0
INTEGRAL    Likelihood = -6.69    Transmembrane 65-81 (53-95)
INTEGRAL    Likelihood = -6.37    Transmembrane 34-50 (31-54)
INTEGRAL    Likelihood = -6.10    Transmembrane 176-192 (169-195)
INTEGRAL    Likelihood = -3.66    Transmembrane 130-146 (130-151)
INTEGRAL    Likelihood = -1.97    Transmembrane 3-19 (3-19)
INTEGRAL    Likelihood = -0.90    Transmembrane 88-104 (88-104)
PERIPHERAL  Likelihood = 5.30     158
modified ALOM score: 1.84
*** Reasoning Step: 3
----- Final Results -----
   bacterial membrane --- Certainty = 0.3675 (Affirmative) <succ>
      bacterial outside --- Certainty = 0.0000 (Not Clear) <succ>
         bacterial cytoplasm --- Certainty = 0.0000 (Not Clear) <succ>

---

Based on this analysis, it was predicted that these proteins and their epitopes could be useful antigens for vaccines or diagnostics.

Example 1441

A DNA sequence (GBSx1527) was identified in *S. agalactiae* <SEQ ID 4421> which encodes the amino acid sequence <SEQ ID 4422>. Analysis of this protein sequence reveals the following:

---

Possible site: 23
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

A related GBS gene <SEQ ID 8811> and protein <SEQ ID 8812> were also identified. Analysis of this protein sequence reveals the following:

---

Lipop: Possible site: -1   Crend: 2
McG: Discrim Score: 6.01
GvH: Signal Score (-7.5): 0.45
Possible site: 23
>>> Seems to have a cleavable N-term signal seq.
ALOM program   count: 0 value: 10.66    threshold: 0.0
PERIPHERAL     Likelihood = 10.66       80
modified ALOM score: -2.63
*** Reasoning Step: 3
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

---

SEQ ID 4422 (GBS19) was expressed in *E. coli* as a His-fusion product. SDS-PAGE analysis of total cell extract is shown in FIG. 4 (lane 4; MW 24 kDa). It was also expressed in *E. coli* as a GST-fusion product. SDS-PAGE analysis of total cell extract is shown in FIG. 9 (lane 6; MW 46.1 kDa).

The GST-fusion protein was purified as shown in FIG. 190, lane 10.

Example 1442

A DNA sequence (GBSx1528) was identified in *S. agalactiae* <SEQ ID 4423> which encodes the amino acid sequence <SEQ ID 4424>. Analysis of this protein sequence reveals the following:

```
Possible site: 30
>>> Seems to have a cleavable N-term signal seq.
----- Final Results -----
    bacterial outside --- Certainty = 0.3000 (Affirmative) <succ>
      bacterial membrane --- Certainty = 0.0000 (Not Clear) <succ>
        bacterial cytoplasm --- Certainty = 0.0000 (Not Clear) <succ>
```

A related GBS nucleic acid sequence <SEQ ID 8813> which encodes amino acid sequence <SEQ ID 8814> was also identified. Analysis of this protein sequence reveals the following:

```
Lipop: Possible site: -1    Crend: 6
SRCFLG: 0
McG: Length of UR: 23
Peak Value of UR: 2.61
Net Charge of CR: 3
McG: Discrim Score: 9.08
GvH: Signal Score (-7.5): -0.76
Possible site: 22
>>> Seems to have a cleavable N-term signal seq.
Amino Acid Composition: calculated from 23
ALOM program           count: 0 value: 5.14        threshold: 0.0
PERIPHERAL             Likelihood = 5.14           365
modified ALOM score: -1.53
*** Reasoning Step: 3
Rule gpol
----- Final Results -----
    bacterial outside --- Certainty = 0.3000 (Affirmative) <succ>
      bacterial membrane --- Certainty = 0.0000 (Not Clear) <succ>
        bacterial cytoplasm --- Certainty = 0.0000 (Not Clear) <succ>
```

The protein has homology with the following sequences in the GENPEPT database.

```
>GP:CAA34476 GB:X16457 precursor polypeptide (AA -26 to 632)
[Staphylococcus aureus]
Identities = 93/372 (25%), Positives = 160/372 (43%), Gaps = 46/372 (12%)

Query: 9     MKKQFLKSAAILSLAVTAVSTSQPVGAIVGKDETKLRQQLGYIDSKKSGKKIDERWGEKI     68
             MKKQ +   A L++A + +         AIV KD +K +     + KG + + + KI
Sbjct: 1     MKKQIISLGA-LAVASSLFTWDNKADAIVTKDYSK---ESRVNEKSKKGATVSDYYYWKI   56

Query: 69    YNYLSYELIEANEWINRSEFQEPEYRTILSEFKDKIDSIEYYLINLS----NIAKEDAHQ    124
             + L +   A + +   ++ +P Y+       ++    + YL+        + K+
Sbjct: 57    IDSLEAQFTGAIDLLENYKYGDPIYKEAKDRLMTRVLGEDQYLLKKKIDEYELYKKWYKS   116

Query: 125   RNILQSLDKYEKSGIYNLDQGVYNYIYQEISSAKHKFSDGVDKIYRLDSTLFPFSVWYDK   184
             N  ++  + K  +YNL    YN I+  +   A ++F+  V +I     +  L    F
Sbjct: 117   SNKNTNMLTFHKYNLYNLTMNEYNDIFNSLKDAVYQFNKEVKEIEHKNVDLKQF------   170

Query: 185   HLDNNDNYKDNKDFKEYIALLNEITRKARLGYQIVNNHKD-GEHKDEAEI-LDILIRDIT   242
                    D    ++K   KE    L++EI         Y       KD GEH   E        LD+++  D
Sbjct: 171   -----DKDGEDKATKEVYDLVSEIDTLVVTYYA----DKDYGEHAKELRAKLDLILGDTD   221

Query: 243   FVSKDAPGYKYIPNKRIAAKIIEDLDGIINDFFKNTGKDKP-SLEKLKDTEFHKKYLNST   301
                K        I N+RI   ++I+DL+  II+DFF   T   +++P S+  K    T+ + K   +
Sbjct: 222   NPHK-------ITNERIKKEMIDDLNSIIDDFFMETKQNRPNSITKYDPTKHNEKEKSEN   274

Query: 302   EPYSIETNLPSNYKELKEKQIKKLEYGYK-KSSKIY--TSAHYALYSEEIDAAKELLQKV   358
             +P    N     +E K K +K+ +    +K K+  K Y  T          +  EE     +  L KV
Sbjct: 275   KP-----NFDKLVEETK-KAVKEADESWKNKTVKKYEETVTKSPVVKEEKKVEEPQLPKV   328

Query: 359   KIAKDNYNEIKS                                                  370
              N   E+K+
Sbjct: 329   ----GNQQEVKT                                                  336
```

No corresponding DNA sequence was identified in *S. pyogenes*.

SEQ ID 8814 (GBS119) was expressed in *E. coli* as a His-fusion product. SDS-PAGE analysis of total cell extract is shown in FIG. 29 (lane 2; MW 84.3 kDa). It was also expressed in *E. coli* as a GST-fusion product. SDS-PAGE analysis of total cell extract is shown in FIG. 35 (lane 5; 2 bands).

The GBS119-GST fusion product was purified (FIG. 109A; see also FIG. 201, lane 6) and used to immunise mice (lane 1+2+3 product; 20 μg/mouse). The resulting antiserum was used for Western blot, FACS (FIG. 109B), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 1443

A DNA sequence (GBSx1529) was identified in *S. agalactiae* <SEQ ID 4425> which encodes the amino acid sequence <SEQ ID 4426>. This protein is predicted to be s-adenosyl-methionine synthetase (metK). Analysis of this protein sequence reveals the following:

```
Possible site: 41
>>> Seems to have no N-terminal signal sequence
----- Final Results -----
    bacterial cytoplasm --- Certainty = 0.3609 (Affirmative) <succ>
``` bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:BAB07019 GB:AP001518 S-adenosylmethionine synthetase [Bacillus halodurans]
Identities = 266/390 (68%), Positives = 324/390 (82%), Gaps = 1/390 (0%)
Query:     4  RKLFTSESVSEGHPDKIADQISDAILDAILEQDPDAHVAAETAVYTGSVHVFGEISTTAY      63
              R+LFTSESV+EGHPDKI DQISD+ILD IL++DP+A VA ET+V TG V V GEI+T+ Y
Sbjct:     7  RRLFTSESVTEGHPDKICDQISDSILDEILKEDPNARVACETSVTTGLVLVAGEITTSTY      66

Query:    64  VDINRVVRNTIAEIGYDKAEYGFSAESVGVHPSLVEQSPDIAQGVNEALEVR-GSLEQDP     122
              VDI +VVR+TI   IGY +A+YGF +E+   V  S+ EQSPDIAQGVN+ALE R G +
Sbjct:    67  VDIPKVVRDTIRNIGYTRAKYGFDSETCAVLTSIDEQSPDIAQGVNQALEAREGQMTDAE     126

Query:   123  LDLIGAGDQGLMFGFAVDETPELMPLPISLAHQLVKKLTDLRKSGELTYLRPDAKSQVTV     182
              ++ IGAGDQGLMFG+A +ETPELMPLPISL+H+L ++L++ RK    L YLRPD K+QVTV
Sbjct:   127  IEAIGAGDQGLMFGYANNETPELMPLPISLSHKLARRLSEARKGEILPYLRPDGKTQVTV     186

Query:   183  EYDENDQPIRVDAVVISTQHDPNVTNDQLHKDVIEKVINEVIPSHYLDDQTKFFINPTGR     242
              EYDENDQ +R+D +VISTQH P VT +Q+  D+ + VI   V+P    +D++TK+FINPTGR
Sbjct:   187  EYDENDQSVRIDTIVISTQHHPEVTLEQIESDLKQHVIRSVVPEELIDEETKYFINPTGR     246

Query:   243  FVIGGPQGDSGLTGRKIIVDTYGGYSRHGGGAFSGKDATKVDRSASYAARYIAKNIVAAD     302
              FVIGGPQGD+GLTGRKIIVDTYGGY+RHGGGAFSGKD TKVDRS +YAARY+AKNIVAA
Sbjct:   247  FVIGGPQGDAGLTGRKIIVDTYGGYARHGGGAFSGKDPTKVDRSGAYAARYVAKNIVAAG     306

Query:   303  LAKKVEVQLAYAIGVAQPVSVRVDTFGTGVIAEADLEAAVRQIFDLRPAGIINMLDLKRP     362
              LA K EVQLAYAIGVA+PVS+ +DTFGTG ++EA L    VR+ FDLRPAGII MLDL+RP
Sbjct:   307  LADKCEVQLAYAIGVAKPVSISIDTFGTGQVSEARLVELVREHFDLRPAGIIKMLDLRRP     366

Query:   363  IYRQTAAYGHMGRTDIDLPWERVDKVQALK                                 392
              IY+QTAAYGH GRTD++LPWE+ DK + L+
Sbjct:   367  IYKQTAAYGHFGRTDVELPWEQTDKAEILR                                 396
```

A related DNA sequence was identified in *S. pyogenes* <SEQ ID 4427> which encodes the amino acid sequence <SEQ ID 4428>. Analysis of this protein sequence reveals the following:

Possible site: 43
>>> Seems to have no N-terminal signal sequence
----- Final Results ----- bacterial cytoplasm --- Certainty = 0.3389 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 333/395 (84%), Positives = 361/395 (91%), Gaps = 1/395 (0%)
Query:     1  MSERKLFTSESVSEGHPDKIADQISDAILDAILEQDPDAHVAAETAVYTGSVHVFGEIST      60
              MSERKLFTSESVSEGHPDKIADQISDAILDAIL +DP+AHVAAET VYTGSVHVFGEIST
Sbjct:     1  MSERKLFTSESVSEGHPDKIADQISDAILDAILAEDPEAHVAAETCVYTGSVHVFGEIST      60

Query:    61  TAYVDINRVVRNTIAEIGYDKAEYGFSAESVGVHPSLVEQSPDIAQGVNEALEVRGSLEQ     120
              TAY+DINRVVR+TIAEIGY +AEYGFSAESVGVHPSLVEQS DIAQGVNEA E R   +
Sbjct:    61  TAYIDINRVVRDTIAEIGYTEAEYGFSAESVGVHPSLVEQSGDIAQGVNEAFESREG-DT     119

Query:   121  DPLDLIGAGDQGLMFGFAVDETPELMPLPISLAHQLVEKLTDLRKSGELTYLRPDAKSQV     180
              D L  IGAGDQGLMFGFA++ETPELMPLPISL+HQLV++L  +LRKSGE++YLRPDAKSQV
Sbjct:   120  DDLSHIGAGDQGLMFGFAINETPELMPLPISLSHQLVRRLAELRKSGEISYLRPDAKSQV     179

Query:   181  TVEYDENDQPIRVDAVVISTQHDPNVTNDQLHKDVIEKVINEVIPSHYLDDQTKFFINPT     240
              TVEYDE+D+P+RVD VVISTQHDP  TNDQ+ +DVIEKVI  VIP+ YLDD TKFFINPT
Sbjct:   180  TVEYDEHDKPVRVDTVVISTQHDPEATNDQIRQDVIEKVIKAVIPADYLDDDTKFFINPT     239

Query:   241  GRFVIGGPQGDSGLTGRKIIVDTYGGYSRHGGGAFSGKDATKVDRSASYAARYIAKNIVA     300
              GRFVIGGPQGDSGLTGRKIIVDTYGGYSRHGGGAFSGKDATKVDRSASYAARYIAKN+VA
Sbjct:   240  GRFVIGGPQGDSGLTGRKIIVDTYGGYSRHGGGAFSGKDATKVDRSASYAARYIAKNLVA     299

Query:   301  ADLAKKVEVQLAYAIGVAQPVSVRVDTFGTGVIAEADLEAAVRQIFDLRPAGIINMLDLK     360
              A L   K EVQLAYAIGVAQPVSVRVDTFGT   + EA LEAAVRQ+FDLRPAGII MLDLK
Sbjct:   300  AGLVTKAEVQLAYAIGVAQPVSVRVDTFGTSTVPEAVLEAAVRQVFDLRPAGIIQMLDLK     359

Query:   361  RPIYRQTAAYGHMGRTDIDLPWERVDKVQALKDFI                             395
              RPIY+QTAAYGHMGRTDIDLPWER++KV AL+ +
Sbjct:   360  RPIYKQTAAYGHMGRTDIDLPWERLNKVDALVEAV                             394
```

Based on this analysis, it was predicted that these proteins and their epitopes could be useful antigens for vaccines or diagnostics.

Example 1444

A DNA sequence (GBSx1530) was identified in *S. agalactiae* <SEQ ID 4429> which encodes the amino acid sequence <SEQ ID 4430>. This protein is predicted to be a transcriptional repressor of the biotin operon. Analysis of this protein sequence reveals the following:

Possible site: 24
>>> Seems to have no N-terminal signal sequence
INTEGRAL    Likelihood = −0.16    Transmembrane 188-204 (188-204)
----- Final Results -----
   bacterial membrane --- Certainty = 0.1065 (Affirmative) <succ>
   bacterial outside --- Certainty = 0.0000 (Not Clear) <succ>
   bacterial cytoplasm --- Certainty = 0.0000 (Not Clear) <succ>

A related GBS nucleic acid sequence <SEQ ID 9755> which encodes amino acid sequence <SEQ ID 9756> was also identified.

The protein has homology with the following sequences in the GENPEPT database.

```
>GP:BAB05404 GB:AP001512 transcriptional repressor of the biotin operon
[Bacillus halodurans]
Identities = 102/315 (32%), Positives = 169/315 (53%), Gaps = 18/315 (5%)
Query:  10  ILSKNNNFISGETMANQLNISRTAIWKGIKTLEELGLEIESVTNKGYRLVSG-DILLPEQ    68
            +L+  ++F+SGE ++   +  SRTA+WK I+ L + G E+E+V  KGYR+V    D + P
Sbjct:   9  LLTAGDDFVSGEKISQAIGCSRTAVWKHIEELRKSGYEVEAVQRKGYRIVKRPDQIKPHD    68

Query:  69  LE-----QEIGIKVSLNNNSASTQLDAKMGIESKLKTPHLFLAPNQKKAKGRFDRPFFTS   123
            ++     + G +++   ++ASTQ  A     +  K H+ LA  Q   KGR  R +++
Sbjct:  69  IQVVLETERFGREITYLESTASTQTVALKLAQEGAKEGHIVLANEQTSGKGRMGRGWYSP   128

Query: 124  NQGGIYMSLLLQPNVPIEDIKPYTVMVASSAVKAISRLTGITPEIKWVNDIYLDNKKIAG   183
              I MS++ +P +P +      T++ A + V+AI    TG+    +IKW ND+ +D KKI G
Sbjct: 129  PGSSISMSIIFRPQLPPQKAPQLTLLTAVAIVRAIKETTGLDSDIKWPNDLLIDGKKIVG   188

Query: 184  ILTEAIASVESGLVTNVIIGLGINFYIKE--FPRALTKRAGSLFTEQ-PTITRNQLITEI   240
            ILTE  A +S  V +VI G+GIN +E F       + K A SL ++     I R   LI    I
Sbjct: 189  ILTEMQADQDS--VHSVIQGIGINVNHQEEAFAEEIRKIATSLAIKKGEPIQRAPLIAAI   246

Query: 241  W---NLFFNIPLEDHLK----VYREKSLVLDRTVSFMDGQTMYSGKAIDITDKGYLVVEL   293
                 LF+++ L+         ++   ++ + + +       +  G A  ITD G L++E
Sbjct: 247  LKNIELFYDLYLQHGFSRIKPLWEAHAISIGKRIRARMLNDVKFGVAKGITDDGVLLLED   306

Query: 294  DDGQLKTLRSGEISL                                               308
            DDG+L ++ S +I +
Sbjct: 307  DDGKLHSIYSADIEI                                               321
```

A related DNA sequence was identified in *S. pyogenes* <SEQ ID 4431> which encodes the amino acid sequence <SEQ ID 4432>. Analysis of this protein sequence reveals the following:

Possible site: 34
>>> Seems to have no N-terminal signal sequence
INTEGRAL    Likelihood = −1.49    Transmembrane 194-210 (194-211)
----- Final Results -----
   bacterial membrane --- Certainty = 0.1595 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the databases:

```
>GP:BAB05404 GB:AP001512 transcriptional repressor of the biotin operon
[Bacillus halodurans]
Identities = 98/315 (31%), Positives = 165/315 (52%), Gaps = 18/315 (5%)
Query:  10  LLSQTDDEVSGEYLADQLSISRTSVWKSIKSLENQGIQIDSLKHKGYRMVQG-DILLPKT    68
            LL+  DDFVSGE ++   +  SRT+VWK I+ L   G ++++++ KGYR+V+   D + P
Sbjct:   9  LLTAGDDFVSGEKISQAIGCSRTAVWKHIEELRKSGYEVEAVQRKGYRIVKRPDQIKPHD    68

Query:  69  I-----SQGLGMPVTYTPHSQSTQLDAKQGIEAHNSAPRLYLAPSQEAAKGRLDRQFFSA   123
            I       ++ G +TY   + STQ  A  +          + LA  Q + KGR+ R ++S
Sbjct:  69  IQVVLETERFGREITYLESTASTQTVALKLAQEGAKEGHIVLANEQTSGKGRMGRGWYSP   128

Query: 124  STGGIYMSMYLKPNVPYADMPPYTMMVASSIVKAISRLTGIDTEIKWVNDIYLGNHKVAG   183
              I MS+ +P +P   P    T++ A +IV+AI    TG+D++IKW ND+ +   K+ G
```

```
                              -continued
Sbjct: 129  PGSSISMSIIFRPQLPPQKAPQLTLLTAVAIVRAIKETTGLDSDIKWPNDLLIDGKKIVG   188

Query: 184  ILTEAITSVETGLITDVIIGVGLNFFVTD--FPEAIAQKAGSLFTEK-PTITRNDLIIDI   240
            ILTE     +  + VI G+G+N       +   F E I + A SL  +K    I R LI  I
Sbjct: 189  ILTE--MQADQDSVHSVIQGIGINVNHQEEAFAEEIRKIATSLAIKKGEPIQRAPLIAAI   246

Query: 241  WK-------LFLSIPVKDHVKVYKEKSLVLNKQVTFIENSQEKRAIAIDLTDQGHLIVQF   293
             K         L+L             +++   ++ + K++       +   K    +A   +TD G  L+++
Sbjct: 247  LKNIELFYDLYLQHGFSRIKPLWEAHAISIGKRIRARMLNDVKFGVAKGITDDGVLLLED   306

Query: 294  ENGDLQTLRSGEISL                                               308
            ++G  L ++  S +I +
Sbjct: 307  DDGKLHSIYSADIEI                                               321
```

An alignment of the GAS and GBS proteins is shown below.

```
Identities = 191/311 (61%), Positives = 257/311 (82%)
Query:   1  MKTYEKIYQILSKNNNFISGETMANQLNISRTAIWKGIKTLEELGLEIESVTNKGYRLVS    60
            MKT EKIYQ+LS+ ++F+SGE +A+QL+ISRT++WK IK+LE   G++I+S+ +KGYR+V
Sbjct:   1  MKTSEKIYQLLSQTDDFVSGEYLADQLSISRTSVWKSIKSLENQGIQIDSLKHKGYRMVQ    60

Query:  61  GDILLPEQLEQEIGIKVSLNNNSASTQLDAKMGIESKLKTPHLFLAPNQKKAKGRFDRPF   120
            GDILLP+ + Q +G+ V+    +S STQLDAK GIE+      P L+LAP+Q+ AKGR DR F
Sbjct:  61  GDILLPKTISQGLGMPVTYTPHSQSTQLDAKQGIEAHNSAPRLYLAPSQEAAKGRLDRQF   120

Query: 121  FTSNQGGIYMSLLLQPNVPIEDIKPYTVMVASSAVKAISRLTGITPEIKWVNDIYLDNKK   180
            F+++  GGIYMS+ L+PNVP   D+  PYT+MVASS VKAISRLTGI   EIKWVNDIYL N K
Sbjct: 121  FSASTGGIYMSMYLKPNVPYADMPPYTMMVASSIVKAISRLTGIDTEIKWVNDIYLGNHK   180

Query: 181  IAGILTEAIASVESGLVTNVIIGLGINFYIKEFPRALTKRAGSLFTEQPTITRNQLITEI   240
            +AGILTEAI  SVE+GL+T+VIIG+G+NF++  +FP A+ ++AGSLFTE+PTITRN LI +I
Sbjct: 181  VAGILTEAITSVETGLITDVIIGVGLNFFVTDFPEAIAQKAGSLFTEKPTITRNDLIIDI   240

Query: 241  WNLFFNIPLEDHLKVYREKSLVLDRTVSFMDGQTMYSGKAIDITDKGYLVVELDDGQLKT   300
            W LF +IP++DH+KVY+EKSLVL++ V+F++           AID+TD+G+L+V+ ++G L+T
Sbjct: 241  WKLFLSIPVKDHVKVYKEKSLVLNKQVTFIENSQEKRAIAIDLTDQGHLIVQFENGDLQT   300

Query: 301  LRSGEISLSSW                                                   311
            LRSGEISLSSW
Sbjct: 301  LRSGEISLSSW                                                   311
```

Based on this analysis, it was predicted that these proteins and their epitopes could be useful antigens for vaccines or diagnostics.

Example 1445

A DNA sequence (GBSx1531) was identified in *S. agalactiae* <SEQ ID 4433> which encodes the amino acid sequence <SEQ ID 4434>. Analysis of this protein sequence reveals the following:

---

Possible site: 15
>>> Seems to have an uncleavable N-term signal seq
INTEGRAL    Likelihood = −2.76    Transmembrane 3-19 (3-20)
----- Final Results -----
    bacterial membrane --- Certainty = 0.2105 (Affirmative) <succ>
    bacterial outside --- Certainty = 0.0000 (Not Clear) <succ>
        bacterial cytoplasm --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1446

A DNA sequence (GBSx1532) was identified in *S. agalactiae* <SEQ ID 4435> which encodes the amino acid sequence <SEQ ID 4436>. Analysis of this protein sequence reveals the following:

---

Possible site: 19
>>> Seems to have a cleavable N-term signal seq.
INTEGRAL    Likelihood = −2.28    Transmembrane 24-40 (24-40)
----- Final Results -----
    bacterial membrane --- Certainty = 0.1914 (Affirmative) <succ>
    bacterial outside --- Certainty = 0.0000 (Not Clear) <succ>
        bacterial cytoplasm --- Certainty = 0.0000 (Not Clear) <succ>

---

The protein has no significant homology with any sequences in the GENPEPT database.

A related DNA sequence was identified in *S. pyogenes* <SEQ ID 4437> which encodes the amino acid sequence <SEQ ID 4438>. Analysis of this protein sequence reveals the following:

---

Possible site: 49
>>> Seems to have a cleavable N-term signal seq.
INTEGRAL    Likelihood = −1.91    Transmembrane 58-74 (58-75)
----- Final Results -----
    bacterial membrane --- Certainty = 0.1765 (Affirmative) <succ>

An alignment of the GAS and GBS proteins is shown below.

```
Identities = 37/67 (55%), Positives = 54/67 (80%), Gaps = 3/67 (4%)
Query:   1  MTKRQFIFMALLCSFETYFFNQSVMDGSWIFAIFWGVLLLRDLQKVYAISKFTKELIK--   58
            MT RQF+FMA +C+FETYFFN  ++ G+++FA+FWG+LL RDL++V+ I++ TK ++K
Sbjct:  36  MTIRQFLFMAFVCAFETYFFNDLLLSGNYLFALFWGLLLFRDLRRVHTINQLTKTILKTA   95

Query:  59  -STKKKD                                                        64
             S KKKD
Sbjct:  96  NSPKKKD                                                       102
```

Based on this analysis, it was predicted that these proteins and their epitopes could be useful antigens for vaccines or diagnostics.

Example 1447

A DNA sequence (GBSx1533) was identified in *S. agalactiae* <SEQ ID 4439> which encodes the amino acid sequence <SEQ ID 4440>. This protein is predicted to be DNA polymerase III, gamma subunit (dnaZX). Analysis of this protein sequence reveals the following:

Possible site:60
>>> Seems to have no N-terminal signal sequence
----- Final Results -----
  bacterial cytoplasm --- Certainty = 0.1567 (Affirmative) <succ>
  bacterial membrane --- Certainty = 0.0000 (Not Clear) <succ>
  bacterial outside --- Certainty = 0.0000 (Not Clear) <succ>

A related DNA sequence was identified in *S. pyogenes* <SEQ ID 4441> which encodes the amino acid sequence <SEQ ID 4442>. Analysis of this protein sequence reveals the following:

Possible site: 60
>>> Seems to have no N-terminal signal sequence
INTEGRAL    Likelihood = −0.59    Transmembrane 232-248 (232-249)
----- Final Results -----
  bacterial membrane --- Certainty = 0.1235 (Affirmative) <succ>
  bacterial outside --- Certainty = 0.0000 (Not Clear) <succ>
  bacterial cytoplasm --- Certainty = 0.0000 (Not Clear) <succ>

An alignment of the GAS and GBS proteins is shown below.

```
Identities = 408/558 (73%), Positives = 473/558 (84%), Gaps = 6/558 (1%)
Query:   1  MYQALYRKYRSQTFDEMVGQSVISTTLKQAVSSKKISHAYLFSGPRGTGKTSAAKIFAKA   60
            MYQALYRKYRSQTFDEMVGQSVISTTLKQAV S KISHAYLFSGPRGTGKTSAAKIFAKA
Sbjct:   1  MYQALYRKYRSQTFDEMVGQSVISTTLKQAVESGKISHAYLFSGPRGTGKTSAAKIFAKA   60

Query:  61  MNCPNQINGEPCNHCDICRDITNGSLEDVIEIDAASNNGVDEIRDIRDKSTYAPSRATYK  120
            MNCPNQ++GEPCN CDICRDITNGSLEDVIEIDAASNNGVDEIRDIRDKSTYAPSRATYK
Sbjct:  61  MNCPNQVDGEPCNQCDICRDITNGSLEDVIEIDAASNNGVDEIRDIRDKSTYAPSRATYK  120

Query: 121  VYIIDEVHMLSTGAFNALLKTLEEPTENVVFILATTELHKIPATILSRVQRFEFKAIKLL  180
            VYIIDEV MLSTGAFNALLKTLEEPTENVVFILATTELHKIPATILSRVQRFEFKAIK
Sbjct: 121  VYIIDEVHMLSTGAFNALLKTLEEPTENVVFILATTELHKIPATILSRVQRFEFKAIKQK  180

Query: 181  AIRDHLAQILDKEAISYDLDALTLVARRAEGGMRDALSILDQALSLAKDNHISLDVAEEI  240
            AIR+HLA +LDKE I+Y++DAL L+ARRAEGGMRDALSILDQALSL+ DN +++ +AEEI
Sbjct: 181  AIREHLAWVLDKEGIAYEVDALNLIARRAEGGMRDALSILDQALSLSPDNQVAIAIAEEI  240

Query: 241  TGSISLSAIDDYVSNILAHDTTEALAKLEVIFDSGKSMSRFATDLLMYLRDLLVVQAGGE  300
            TGSIS+ A+ DYV +    T+ALA LE I+DSGKSMSRFATDLL YLRDLLVV+AGG+
Sbjct: 241  TGSISILALGDYVRYVSQEQATQALAALETIYDSGKSMSRFATDLLLTYLRDLLVVKAGGD  300

Query: 301  DSHSSDTFIANLNVKQDILFEMIDKVTSVLPEIKNGSHPKVYAEMMTIQLSEMVEKNSS-  359
            +   S F  NL++  D +F+MI  VTS LPEIK G+HP++YAEMMTIQL++   + S
Sbjct: 301  NQRQSAVFDTNLSLSIDRIFQMITVVTSHLPEIKKGTHPRIYAEMMTIQLAQKEQILSQV  360

Query: 360  NIPADVTAELDSLRRELKSLKNEMSQL-SRADQSSSTQKVKVNNKTFTFKVDRTKILTIM  418
            N+  ++ +E+++L+  EL  LK ++SQL SR D   + K K    KT +++VDR  IL IM
Sbjct: 361  NLSGELISEIETLKNELAQLKQQLSQLQSRPDSLARSDKTK--PKTTSYRVDRVTILKIM  418
```

```
                            -continued
Query: 419  EETVVDSQRSREYLEALKSAWNEILDNITAQDRALLMGSEPVLANSENAILAFDAAFNAE   478
            EETV +SQ+SR+YL+ALK+AWNEILDNI+AQDRALLMGSEPVLANSENAILAF+AAFNAE
Sbjct: 419  EETVRNSQQSRQYLDALKNAWNEILDNISAQDRALLMGSEPVLANSENAILAFEAAFNAE   478

Query: 479  QAMKRTDLNDIFGNIMSKAAGFSPNILAVPRNDFNQIRSDFAKKMKAQK--TETEPEVNH   536
            Q M R +LND+FGNIMSKAAGFSPNILAVPR DF  IR +FA++MK+QK    + E EV
Sbjct: 479  QVMSRNNLNDMFGNIMSKAAGFSPNILAVPRTDFQHIRKEFAQQMKSQKDSVQEEQEVAL   538

Query: 537  QIPEDFSYLAERIAIVED                                            554
               IPE F +L ++I  ++D
Sbjct: 539  DIPEGFDFLLDKINTIDD                                            556
```

Based on this analysis, it was predicted that these proteins and their epitopes could be useful antigens for vaccines or diagnostics.

Example 1448

A DNA sequence (GBSx1534) was identified in *S. agalactiae* <SEQ ID 4443> which encodes the amino acid sequence <SEQ ID 4444>. Analysis of this protein sequence reveals the following:

Possible site: 40
>>> Seems to have no N-terminal signal sequence (or aa 1-19)
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:BAB06927 GB:AP001518 unknown conserved protein [Bacillus halodurans]
Identities = 67/143 (46%), Positives = 96/143 (66%)
Query:   8  ENYQLLLLQAQALFSDETNALANLSNASAMLNAMLPNSVFTGFYLFDGEELILGPFQGGV    67
            E Y L+ Q  AL   E++A+ANL+NASA+L   L   + GFYL    EL+LGPFQG
Sbjct:  13  EKYSLVTKQLAALLEGESDAIANLANASALLYHFLEEVNWVGFYLIKEGELVLGPFQGLP    72

Query:  68  SCVHITLGKGVCGESAQTAKTLIVDDVTKHANYISCDSKAMSEIVVPMFKNGKLLGVLDL   127
            +CV I +G+GVCG +A+  +T+ V+DV +    +I+CD+ + SEIV+P+F+NG L GVLD+
Sbjct:  73  ACVRIPIGRGVCGTAAKEEQTVRVEDVHQFPGHIACDAASRSEIVIPLFQNGVLYGVLDI   132

Query: 128  DSSLVADYDEIDQEYLEKFVGIL                                       150
            DS  +  + E +Q  LE FV +L
Sbjct: 133  DSPSLNRFSEEEQALLESFVDVL                                       155
```

A related DNA sequence was identified in *S. pyogenes* <SEQ ID 4445> which encodes the amino acid sequence <SEQ ID 4446>. Analysis of this protein sequence reveals the following:

Possible site: 27
>>> Seems to have no N-terminal signal sequence
----- Final Results -----
    bacterial cytoplasm --- Certainty = 0.1753 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below.

```
Identities = 122/164 (74%), Positives = 144/164 (87%)
Query:   1  MNKSKKIENYQLLLLQAQALFSDETNALANLSNASAMLNAMLPNSVFTGFYLFDGEELIL    60
            MNKSKKIE YQL++ QA+ LF++E+NALANLSNASA+LN   LPNSVFTGFYLFDG+ELIL
Sbjct:   1  MNKSKKIEQYQLMIAQAKELFANESNALANLSNASALLNMTLPNSVFTGFYLFDGQELIL    60
```

```
                                     -continued
Query:   61 GPFQGGVSCVHITLGKGVCGESAQTAKTLIVDDVTKHANYISCDSKAMSEIVVPMFKNGK   120
            GPFQG VSCVHI LGKGVCGESAQ+ +T+I++DV +HANYISCD+ AMSEIVVPM K G
Sbjct:   61 GPFQGRVSCVHIKLGKGVCGESAQSRRTIIINDVKQHANYISCDAAAMSEIVVPMVKEGH   120

Query:  121 LLGVLDLDSSLVADYDEIDQEYLEKFVGILVEHTIWNLDMFGVE                   164
            L+GVLDLDSSLVADYDE+DQEYLE FV + +E T + +MFGV+
Sbjct:  121 LIGVLDLDSSLVADYDEVDQEYLEAFVDLFLEKTTFTFNMFGVK                   164
```

SEQ ID 4444 (GBS282) was expressed in *E. coli* as a His-fusion product. SDS-PAGE analysis of total cell extract is shown in FIG. 52 (lane 9; MW 19.8 kDa). It was also expressed in *E. coli* as a GST-fusion product. SDS-PAGE analysis of total cell extract is shown in FIG. 60 (lane 6; MW 44.8 kDa) and in FIG. 63 (lane 7; MW 47 kDa).

Figure 269:
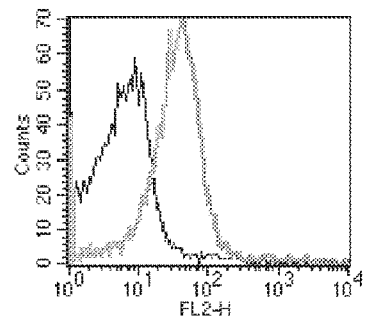

The GBS282-GST fusion product was purified (FIG. 211, lane 4; see also FIG. 225, lane 6) and used to immunise mice. The resulting antiserum was used for FACS (FIG. 269), which confirmed that the protein is immunoaccessible on GBS bacteria.

Based on this analysis, it was predicted that these proteins and their epitopes could be useful antigens for vaccines or diagnostics.

Example 1449

A DNA sequence (GBSx1535) was identified in *S. agalactiae* <SEQ ID 4447> which encodes the amino acid sequence <SEQ ID 4448>. This protein is predicted to be uridine kinase (udk). Analysis of this protein sequence reveals the following:

---

Possible site 24
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>

---

The protein has homology with the following sequences in the GENPEPT database.

A related DNA sequence was identified in *S. pyogenes* <SEQ ID 4449> which encodes the amino acid sequence <SEQ ID 4450>. Analysis of this protein sequence reveals the following:

---

Possible site: 39
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>

---

A related sequence was also identified in GAS <SEQ ID 9151> which encodes the amino acid sequence <SEQ ID 9152>. Analysis of this protein sequence reveals the following:

---

Possible site: 35
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>

---

```
>GP:CAB14675 GB:Z99117 uridine kinase [Bacillus subtilis]
Identities = 133/207 (64%), Positives = 167/207 (80%)
Query:    1 MRKKPIIIGVTGGSGGGKTSVSRAILSNFPDQKITMIEHDSYYKDQSHLTFEERVKTNYD   60
            M K P++IG+ GGSG GKTSV+R+I  F    I MI+ D YYKDQSHL FEER+ TNYD
Sbjct:    1 MGKNPVVIGIAGGSGSGKTSVTRSIYEQFKGHSILMIQQDLYYKDQSHLPFEERLNTNYD   60

Query:   61 HPLAFDTNLMIEQLNELIEGRPVDIPVYDYTKHTRSDRTIRQEPQDVIIVEGILVLEDQR   120
            HPLAFD + +IE + +L+ RP++ P+YDY  HTRS+ T+  EP+DVII+EGILVLED+R
Sbjct:   61 HPLAFDNDYLIEHIQDLLNYRPIEKPIYDYKLHTRSEETVHVEPKDVIILEGILVLEDKR   120

Query:  121 LRDLMDIKLFVDTDDDIRIIRRIKRDMEERDRSLDSIIEQYTEVVKPMYHQFIEPTKRYA   180
            LRDLMDIKL+VDTD D+RIIRRI RD+ ER RS+DS+IEQY  VV+PM++QF+EPTKRYA
Sbjct:  121 LRDLMDIKLYVDTDADLRIIRRIMRDINERGRSIDSVIEQYVSVVRPMHNQFVEPTKRYA   180

Query:  181 DIVIPEGVSNIVAIDLINTKVASILNE                                   207
            DI+IPEG  N VAIDL+ TK+ +IL +
Sbjct:  181 DIIIPEGGQNHVAIDLMVTKIQTILEQ                                   207
```

An alignment of the GAS and GBS proteins is shown below.

```
Identities = 173/207 (83%), Positives = 193/207 (92%)
Query:    1 MRKKPIIIGVTGGSGGGKTSVSRAILSNFPDQKITMIEHDSYYKDQSHLTFEERVKTNYD   60
            M KKPIIIGVTGGSGGGKTSVSRAIL +FP+ +I MI+HDSYYKDQSH++FEERVKTNYD
Sbjct:    5 MLKKPIIIGVTGGSGGGKTSVSRAILDSFPNARIAMIQHDSYYKDQSHMSFEERVKTNYD   64
```

```
Query:   61  HPLAFDTNLMIEQLNELIEGRPVDIPVYDYTKHTRSDRTIRQEPQDVIIVEGILVLEDQR  120
             HPLAFDT+ MI+QL EL+ GRPVDIP+YDY KHTRS+ T RQ+PQDVIIVEGILVLED+R
Sbjct:   65  HPLAFDTDFMIQQLKELLAGRPVDIPIYDYKKHTRSNTTFRQDPQDVIIVEGILVLEDER  124

Query:  121  LRDLMDIKLFVDTDDDIRIIRRIKRDMEERDRSLDSIIEQYTEVVKPMYHQFIEPTKRYA  180
             LRDLMDIKLFVDTDDDIRIIRRIKRDM ER RSL+SII+QYT VVKPMYHQFIEP+KRYA
Sbjct:  125  LRDLMDIKLFVDTDDDIRIIRRIKRDMMERGRSLESIIDQYTSVVKPMYHQFIEPSKRYA  184

Query:  181  DIVIPEGVSNIVAIDLINTKVASILNE                                 207
             DIVIPEGVSN+VAID+IN+K+ASIL E
Sbjct:  185  DIVIPEGVSNVVAIDVINSKIASILGE                                 211
```

Based on this analysis, it was predicted that these proteins and their epitopes could be useful antigens for vaccines or diagnostics.

Example 1450

A DNA sequence (GBSx1536) was identified in *S. agalactiae* <SEQ ID 4451> which encodes the amino acid sequence <SEQ ID 4452>. Analysis of this protein sequence reveals the following:

---

Possible site: 51
>>> Seems to have no N-terminal signal sequence
----- Final Results -----
  bacterial cytoplasm --- Certainty = 0.5083 (Affirmative) <succ>
  bacterial membrane --- Certainty = 0.0000 (Not Clear) <succ>
  bacterial outside --- Certainty = 0.0000 (Not Clear) <succ>

---

The protein has homology with the following sequences in the GENPEPT database.

A related DNA sequence was identified in *S. pyogenes* <SEQ ID 4453> which encodes the amino acid sequence <SEQ ID 4454>. Analysis of this protein sequence reveals the following:

---

Possible site: 39
>>> Seems to have no N-terminal signal sequence
----- Final Results -----
  bacterial cytoplasm --- Certainty = 0.3847 (Affirmative) <succ>
  bacterial membrane --- Certainty = 0.0000 (Not Clear) <succ>
  bacterial outside --- Certainty = 0.0000 (Not Clear) <succ>

---

```
>GP:CAB12572 GB:Z99108 similar to RNA helicase [Bacillus subtilis]
Identities = 140/343 (40%), Positives = 202/343 (58%), Gaps = 9/343 (2%)
Query:   10  QDKLTQRQFDDLTDIQNKLFQPITDGDNILGISPTGTGKTLAYLFPTLLKLQPK-KSQQL   68
             Q+       F    T +Q +  Q I DG +++ SPTGTGKTLAY  P L +++P+ K Q
Sbjct:   16  QENWNASGFQKPTPVQEQAAQLIMDGKDVIAESPTGTGKTLAYALPVLERIKPEQKHPQA   75

Query:   69  LILAPNSELAGQIFDVTKEWAEPLGLTAQLFLSGSSQKRQIERLKKGPEILIGTAGRVFE  128
             +ILAP+ EL  QIF V ++W     L A  +  G++ K+Q+E+LKK P I++GT GRVFE
Sbjct:   76  VILAPSRELVMQIFQVIQDWKAGSELRAASLIGGANVKKQVEKLKKHPHIIVGTPGRVFE  135

Query:  129  LVKLKKIKMMNINTIVLDEFDELLGDSQYHFVDNIINRVPRDQQMIYISATNKLDNS---  185
             L+K KK+KM  + TIVLDE D+L+      + II    RD+Q++  SAT K +
Sbjct:  136  LIKAKKLKMHEVKTIVLDETDQLVLPEHRETMKQIIKTTLRDQLLCFSATLKKETEDVL  195

Query:  186  -KLADNTITIDLSNQKLDT--IKHYYITVDKRERTDLLRKESNIPDFRGLVFFNSLSDLG  242
              +LA    + +  K +   +KH Y+  D+R++  LL+K S +    + LVF   + +L
Sbjct:  196  RELAQEPEVLKVQRSKAEAGKVKHQYLICDQRDKVKLLQKLSRLEGMQALVFVRDIGNLS  255

Query:  243  ACEERLQFNRASAVSLASDINIKFRKVILEKFKNHDISLLLGTDLVARGIDIDNLEYVIN  302
                E+L ++      L S+    R  I+  F++ +  LLL TD+ ARG+DI+NL YVI+
Sbjct:  256  VYAEKLAYHHVELGVLHSEAKKMERAKIIATFEDGEFPLLLATDIAARGLDIENLPYVIH  315

Query:  303  FDIARDKETYTHRSGRTGRMGKEGCVITFVTHKEELKQLKKYA                  345
              DI  D++  Y HRSGRTGR GKEG V++ VT   EE K LKK A
Sbjct:  316  ADIP-DEDGYVHRSGRTGRAGKEGNVLSLVTKLEESK-LKKMA                  356
```

An alignment of the GAS and GBS proteins is shown below.

```
Identities = 273/358 (76%), Positives = 312/358 (86%)
Query:    1  MITKFPDQWQDKLTQRQFDDLTDIQNKLFQPITDGDNILGISPTGTGKTLAYLFPTLLKL   60
             MITKFP QWQ+KL Q  F  LT IQ +  FQPI DG N LGISPTGTGKTLAY+FP LL L
Sbjct:   12  MITKFPPQWQEKLDQVAFTHLTPIQEQAFQPIVDOKNFLGISPTGTGKTLAYVFPNLLAL   71
```

```
Query:  61 QPKKSQQLLILAPNSELAGQIFDVTKEWAEPLGLTAQLFLSGSSQKRQIERLKKGPEILI 120
            PKKSQQLLILAPN ELAGQIF+VTK+WA+PLGLTAQLF+SG+SQKRQIERLKKGPEILI
Sbjct:  72 TPKKSQQLLILAPNTELAGQIFEVTKDWAQPLGLTAQLFISGTSQKRQIERLKKGPEILI 131

Query: 121 GTAGRVFELVKLKKIKMMNINTIVLDEFDELLGDSQYHFVDNIINRVPRDQQMIYISATN 180
            GT GR+FEL+KLKKIKMM++NTIVLDE+DELLGDSQY FV  I + VPRD QM+Y+SATN
Sbjct: 132 GTPGRIFELIKLKKIKMMSVNTIVLDEYDELLGDSQYDEVQKISHYVPRDHQMVYMSATN 191

Query: 181 KLDNSKLADNTITIDLSNQKLDTIKHYYITVDKRERTDLLRKFSNIPDFRGLVFFNSLSD 240
            K+D + LA NT  IDLS Q  D I+H+Y+ VDKRERTDLLRKF+NIP FR LVFFNSLSD
Sbjct: 192 KVDQTSLAPNTFCIDLSEQTNDAIQHFYLMVDKRERTDLLRKFTNIPHFRALVFFNSLSD 251

Query: 241 LGACEERLQFNRASAVSLASDINIKFRKVILEKFKNHDISLLLGTDLVARGIDIDNLEYV 300
            LGA EERLQ+N A+AVSLASDIN+KFRK ILEKFK+H +SLLL TDLVARGIDIDNL+YV
Sbjct: 252 LGATEERLQYNGAAAVSLASDINVKFRKTILEKFKSHQLSLLLATDLVARGIDIDNLDYV 311

Query: 301 INFDIARDKETYTHRSGRTGRMGKEGCVITFVTHKEELKQLKKYATVTELVLHNQKLH  358
            I+FD+ARDKE YTHR+GRTGRMGK G VITFV+H E+LK+LKK+A V+E+ L NQ+LH
Sbjct: 312 IHFDVARDKENYTHRAGRTGRMGKSGIVITFVSHPEDLKKLKKFAKVSEISLKNQQLH  369
```

Based on this analysis, it was predicted that these proteins and their epitopes could be useful antigens for vaccines or diagnostics.

Example 1451

A DNA sequence (GBSx1537) was identified in *S. agalactiae* <SEQ ID 4455> which encodes the amino acid sequence <SEQ ID 4456>. Analysis of this protein sequence reveals the following:

Possible site: 25
>>> Seems to have an uncleavable N-term signal seq
INTEGRAL    Likelihood = −1.38    Transmembrane 15-31 (13-31)
----- Final Results -----
  bacterial membrane --- Certainty = 0.1553 (Affirmative) <succ>
  bacterial outside --- Certainty = 0.0000 (Not Clear) <succ>
  bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1452

A DNA sequence (GBSx1538) was identified in *S. agalactiae* <SEQ ID 4457> which encodes the amino acid sequence <SEQ ID 4458>. This protein is predicted to be peptidoglycan GlcNAc deacetylase. Analysis of this protein sequence reveals the following:

Possible site: 28
>>> Seems to have an uncleavable N-term signal seq
INTEGRAL    Likelihood = −8.92    Transmembrane 4-20 (1-26)
----- Final Results -----
  bacterial membrane --- Certainty = 0.4567 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

```
>GP:CAB96552 GB:AJ251472 peptidoglycan GlcNAc deacetylase
            [Streptococcus pneumoniae]
Identities = 133/431 (30%), Positives = 228/431 (52%), Gaps = 20/431 (4%)
Query:   5 IIGIFSLIIIAILAWQGFSFLKHK--EIKLQQAVVEKEIRIAEKTVEVVKRQKTERVLFL  62
           +IGI ++ I + + F  + K   E K++     EK+ +++E   +  RQ    V+
Sbjct:  21 LIGILAISICLLGGFIAFKIYQQKSFEQKIESLKKEKDDQLSEGNQKEHFRQGQAEVIAY  80

Query:  63 EPKGYDKSLSADILKWNQKSFEHKKFYDNQYIILRPQLADSNFANVKKLSIYQILYQKEK 122
           P   +K +S+     NQ   +  + DN         Q  +S    V   ++ + +Y
Sbjct:  81 YPLQGEKVISSVRELINQDVKDKLESKDNLVFYYTEQ-EESGLKGVVNRNVIKQIYDLVA 139

Query: 123 GSMFQKSSRLLRTYLLDQNKKPFELDELLAHNISGFKAILENIAPGTQLK--EHDSNKEF 180
           + +     L     L ++ +PF LD+L +        + +++ +    + K   E D +++
Sbjct: 140 FKIEETEKTSLGKVHLTEDGQPFTLDQLFSDASKAKEQLIKELTSFIEDKKIEQDQSEQI 199

Query: 181 LKTGRVTD----GLDVKDGKLII---------NDLKLPLDKLYNVIDESYLKSSDLDLVS 227
           +K    D     D   KD ++I+          ++ LP+    ++VI SYL    D   L
```

-continued

```
Sbjct: 200  VKNFSDQDLSAWNFDYKDSQIILYPSPVVENLEEIALPVSAFFDVIQSSYLLEKDAALYQ  259

Query: 228  NLKAKAPR--VALTFDDGPNEKTTPKALEILKRYNAKATFFVMGQSAVGHTDILQRMHAE  285
            + K    +  VALTFDDGPN  TTP+ LE L +Y+ KATFFV+G++   G+ D+++R+ +E
Sbjct: 260  SYFDKKHQKVVALTFDDGPNPATTPQVLETLARYDIKATFFVLGKNVSGNEDLVKRIKSE  319

Query: 286  GHEIGNHTWDHPNLTKLPAEKIKEEIHKTNDLIMKATGQKPVYLRPPYGATNATVKTVTG  345
            GH +GNH+W HP L++L  ++ K++I  T D++ K G      +RPPYGA   ++
Sbjct: 320  GHVVGNHSWSHPILSQLSLDEAKKQITDTEDVLTKVLGSSSKLMRPPYGAITDDIRNSLD  379

Query: 346  LKEMLWSVDTEDWKNHNTQAMMTNIKKQLRPGGVILMHDIHQTTIDALPTIMDYLTIQGY  405
            L  ++W VD+ DWK+ N   +++T I+ Q+   G ++LMHDIH   T+ALP   +++YL   QGY
Sbjct: 380  LSFIMWDVDSLDWKSKNEASILTEIQHQVANGSIVLMHDIHSPTVNALPRVIEYLKNQGY  439

Query: 406  YFVTVGELYST                                                  416
             FVT+ E+ +T
Sbjct: 440  TFVTIPEMLNT                                                  450
```

A related DNA sequence was identified in *S. pyogenes* <SEQ ID 4459> which encodes the amino acid sequence <SEQ ID 4460>. Analysis of this protein sequence reveals the following:

---

Possible site: 22
>>> Seems to have an uncleavable N-term signal seq
INTEGRAL      Likelihood = –12.58      Transmembrane 6-22 (1-27)
----- Final Results -----
    bacterial membrane --- Certainty = 0.6031 (Affirmative) <succ>
       bacterial outside --- Certainty = 0.0000 (Not Clear) <succ>
          bacterial cytoplasm --- Certainty = 0.0000 (Not Clear) <succ>

---

The protein has homology with the following sequences in the databases:

```
!GB:AJ251472 peptidoglycan GlcNAc deacetylase [Strep ... 239 4e-62
>GP:CAB96552 GB:AJ251472 peptidoglycan GlcNAc deacetylase
            [Streptococcus pneumoniae]

Identities = 136/438 (31%), Positives = 230/438 (52%), Gaps = 23/438 (5%)
Query:   3  KLNVILVGLLSILMLSLAI----VFINRWKLNEDSQRIVIAEKKKNTSDLVIKAVKHIKK   58
            K  +L+ L+ IL +S+ +        +       Q+I    +K+K+          +H ++
Sbjct:  13  KTRHVLLALIGILAISICLLGGFIAFKIYQQKSFEQKIESLKKEKDDQLSEGNQKEHFRQ   72

Query:  59  DQKDYYYFSPIK--QADDFFVDNLPVSLYKKKNSDKELILVRPKLQSSHLRSVNTLTISK  116
            Q +    + P++  +       + +  +  K  S   L+    + +S L+ V    ++K
Sbjct:  73  GQAEVIAYYPLQGEKVISSVRELINQDVKDKLESKDNLVFYYTEQEESGLKGVVNRNVTK  132

Query: 117  IVYQKKFFHLAKKSEKVISTYHVTDDLKPFQVKDLVSGHL---ERIQEEVEKKYPDAGFN  173
             +Y     F  + +  +  H+T+D +PF +  L S     E++ +E+     D
Sbjct: 133  QIYDLVAFKIEETEKTSLGKVHLTEDGQPFTLDQLFSDASKAKEQLIKELTSFIEDKKIE  192

Query: 174  SDKYNGLKESNS---LLSDGFEVKSGNLIFD--------KKLTIPLTTLFDVINPDFLAN  222
            D+    + ++ S     L  +  F+ K   +I         +++ +P++   FDVI   +L
Sbjct: 193  QDQSEQIVKNFSDQDLSAWNFDYKDSQIILYPSPVVENLEEIALPVSAFFDVIQSSYLLE  252

Query: 223  SDRAAYDNYRTYKEQHPKKLVALTFDDGPDPTTTPQVLDILAKYQAKGTFFMIGSKVVNN  282
              D A Y +Y    K Q   K+VALTFDDGP+P TTPQVL+ LAKY  K TFF++G V   N
Sbjct: 253  KDAALYQSYFDKKHQ---KVVALTFDDGPNPATTPQVLETLAKYDIKATFFVLGKNVSGN  309

Query: 283  ENLTKRVSDAGHEIANHTWDHPNLTNLSVSEIQHQVNMTNQAIEKACGKKPRYLRPPYGA  342
            E+L KR+     GH + NH+W HP L+ LS+  E Q+  T    + K   G      + +RPPYGA
Sbjct: 310  EDLVKRIKSEGHVVGNHSWSHPILSQLSLDEAKKQITDTEDVLTKVLGSSSKLMRPPYGA  369

Query: 343  TNATVQQSSGLTQMLWTVDTRDWENHSTDGIMTNVKNQLQPGGVVLMHDIHQTTINALPT  402
              ++ S   L+ ++W VD+ DW++  +   I+T +++Q+    G +VLMHDIH   T+NALP
Sbjct: 370  ITDDIRNSLDLSFIMWDVDSLDWKSKNEASILTEIQHQVANGSIVLMHDIHSPTVNALPR  429

Query: 403  VMEYLKAEGYECVTVSEL                                           420
            V+EYLK +GY   VT+ E+
Sbjct: 430  VIEYLKNQGYTFVTIPEM                                           447
```

An alignment of the GAS and GBS proteins is shown below.

```
Identities = 169/420 (40%), Positives = 259/420 (61%), Gaps = 12/420 (2%)
Query:    4 LIIGIFSLIIIAILAWQGFSFLKHKEIKLQQAVVEKEIRIAEKTVEVVKRQKTER--VLF   61
              +++G+ S+++++ LA     + K E    +  + EK+    ++ ++ VK K ++     +
Sbjct:    7 ILVGLLSILMLS-LAIVFINRWKLNEDSQRIVLAEKEENTSDLVIKAVEHIKEDQKDYYY   65

Query:   62 LEPKGYDKSLSADILKWNQKSFEHKKEYDNQYIILRPQLADSNPANVKKLSIYQILYQKE  121
                     P        D L     S     KK  D + I++RP+L   S+   +V   L+I +I+YQK+
Sbjct:   66 FSPIKQADDFFVDNLP---VSLYKKKNSDKELILVRPKLQSSHLRSVNTLTISKIVYQKK  122

Query:  122 KGSMFQKSSRLLRTYLLDQNKKPFELDELLAHNISGFKAILENIAPGTQLKEHDSNKEFL  181
                 + +KS +++ TY +   + KPF++ +L++ ++     +  +E     P              N
Sbjct:  123 FFHLAKESEKVISTYHVTDDLKPFQVKDLVSGHLERIQEEVEKKYPDAGENSDKYNGLKE  182

Query:  182 KTGRVTDGLDVKDGKLIIND-LKLPLDKLYNVIDESYLKSSDLDLVSNL---KAKAPR--  235
                 ++DG +VK G LI +    L +PL L++VI+      +L +SD        N      K + P+
Sbjct:  183 SNSLLSDGFEVESGNLIFDKKLTIPLTTLFDVINPDFLANSDRAAYDNYRTYKEQHPKKL  242

Query:  236 VALTEDDGPNEKTTPKALEILKRYNAKATFFVMGQSAVGHTDILQRMHAEGHEIGNHTWD  295
              VALTEDDGP+   TTP+ L+IL +Y AK TFF++G   V + ++ +R+    GHEI NHTWD
Sbjct:  243 VALTEDDGPDPTTTPQVLDILAKYQAKGTFFMIGSKVVNNENLTKRVSDAGHEIANHTWD  302

Query:  296 HPNLTKLPAEKIKEEIHKTNDLIMKATGQKPVYLRPPYGATNATVKTVTGLKEMLWSVDT  355
              HPNLT L    +I+ +++ TN    I  KA G+KP YLRPPYGATNATV+   +GL +MLW+VDT
Sbjct:  303 HPNLTNLSVSEIQHQVNMTNQAIEKACGKKPRYLRPPYGATNATVQQSSGLTQMLWTVDT  362

Query:  356 EDWENHNTQAMMTNIKKQLRPGGVILMHDIHQTTIDALPTIMDYLTTQGYYFVTVGELYS  415
                 DW+NH+T   +MTN+K QL+PGGV+LMHDIHQTTI+ALPT+M+YL   +GY   VTV ELY+
Sbjct:  363 RDWENHSTDGIMTNVKNQLQPGGVVLMHDIHQTTINALPTVMEYLKAEGYECVTVSELYA  422
```

GBS281d was expressed in *E. coli* as a GST-fusion product. SDS-PAGE analysis of total cell extract is shown in FIG. 152 (lane 8-10; MW 71.5 kDa) and in FIG. 187 (lane 10; MW 71 kDa). It was also expressed in *E. coli* as a His-fusion product. SDS-PAGE analysis of total cell extract is shown in FIG. 152 (lane 12; MW 46.5 kDa) and in FIG. 183 (lane 2; MW 46 kDa). Purified GBS281d-GST is shown in lane 6 of FIG. 237.

Based on this analysis, it was predicted that these proteins and their epitopes could be useful antigens for vaccines or diagnostics.

Example 1453

A DNA sequence (GBSx1539) was identified in *S. agalactiae* <SEQ ID 4461> which encodes the amino acid sequence <SEQ ID 4462>. Analysis of this protein sequence reveals the following:

Possible site: 57
>>> Seems to have no N-terminal signal sequence

----- Final Results -----
bacterial cytoplasm --- Certainty = 0.2488 (Affirmative) <succ>
bacterial membrane --- Certainty = 0.0000 (Not Clear) <succ>
bacterial outside --- Certainty = 0.0000 (Not Clear) <succ>

A related DNA sequence was identified in *S. pyogenes* <SEQ ID 4463> which encodes the amino acid sequence <SEQ ID 4464>. Analysis of this protein sequence reveals the following:

Possible site: 40
>>> Seems to have no N-terminal signal sequence
----- Final Results -----
bacterial cytoplasm --- Certainty = 0.2799 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 311/475 (650), Positives = 389/475 (810)
Query:    1 MTKEYQNYVNGEWKSSVNQIEILSPIDDSSLGFVPAMTREEVDHAMKAGREALPAWAALT   60
              + K+Y+N VNGEWK S N+I I +P      LG VPAMT+ EVD     +  ++AL  W AL+
Sbjct:    1 LAKQYKNLVNGEWKLSENEITIYAPATGEELGSVPAMTQAEVDAVYASAKKALSDWRALS   60

Query:   61 VYERAQYLHKAADIIERDKEEIATVLAEEISKAYNASVTEVVRTADLIRYAAEEGIRLST  120
                  ERA YLHKAADI+ RD E+I   +L+KE++K  A+V+EV+RTA++I YAAEEG+R+
Sbjct:   61 YVERAAYLHKAADILVRDAEKIGAILSKEVAKGHKAAVSEVIRTAEIINYAAEEGLRMEG  120

Query:  121 SADEGGKMDASTGHKLAVIRRQPVGIVLAIAPYNYPVNLSGSKIAPALIGGNVVMFKPPT  180
                       EGG   +A++   K+A++RR+PVG+VLAI+P+NYPVNL+GSKIAPALI GNVV   KPPT
Sbjct:  121 EVLEGGSFEAASKKKIAIVRREPVGLVLAISPFNYPVNLAGSKIAPALIAGNVVALKPPT  180

Query:  181 QGSVSGLVLAKAFAEAGLPAGVFNTITGRGSEIGDYIVEHEEVNFINFTGSTPVGKRIGK  240
              QGS+SGL+LA+AFAEAG+PAGVFNTITGRGS IGDYIVEHE V+FINFTGSTP+G+ IGK
Sbjct:  181 QGSISGLLLAHAFAEAGIPAGVENTITGRGSVIGDYIVEHEAVSFINFTGSTPIGEGIGK  240
```

-continued

```
Query: 241  LAGMRPIMLELGGKDAGVVLADADLDNAAKQIVAGAYDYSGQRCTAIKRVINVEEVADEL  300
            LAGMRPIMLELGGKD+ +VL DADL   AAK IVAGA+ YSGQRCTA+KRVLV+++VAD+L
Sbjct: 241  LAGMRPIMLELGGKDSAIVLEDADLALAAENIVAGAFGYSGQRCTAVKRVLVMDKVADQL  300

Query: 301  AEKISENVAKLSVGDPFDNATVTPVIDDNSADFIESLVVDARQKGAKELNEFKRDGRLLT  360
            A +I   V KLSVG P D+A +TP+ID ++ADF+E L+ DA  KGA   L  F R+G L++
Sbjct: 301  AAEIKTLVEKLSVGMPEDDADITPLIDTSAADFVEGLIKDATDKGATALTAFNREGNLIS  360

Query: 361  PGLFDHVTLDMKLAWEEPFGPILPIIRVKDAEEEAVAIANKSDFGLQSSVFTRDFQKAFDI  420
            P LFDHVT DM+LAWEEPFGP+LPIIRV   EEA+ I+N+S++GLQ+S+FT +F KAF I
Sbjct: 361  PVLFDHVTTDMRLAWEEPFGPVLPIIRVTTVEEAIKISNESEYGLQASIFTTNFPKAFGI  420

Query: 421  ANKLEVGTVHINNKTGRGPDNFPFLGLKGSGAGVQGIRYSIEAMTNVKSIVFDMK  475
            A +LEVGTVH+NNKT RG DNFPFLG K SGAGVQG++YSIEAMT VKS+VFD++
Sbjct: 421  AEQLEVGTVHLNNKTQRGTDNFPFLGAKKSGAGVQGVKYSIEAMTTVKSVVFDIQ  475
```

A related GBS gene <SEQ ID 8815> and protein <SEQ ID 8816> were also identified. Analysis of this protein sequence reveals the following:

Lipop: Possible site: −1   Crend: 3
McG: Discrim Score: −15.11
GvH: Signal Score (−7.5) : 0.17
Possible site: 57
>>> Seems to have no N-terminal signal sequence
ALOM program       count: 0   value: 1.22   threshold: 0.0

PERIPHERAL          Likelihood = 1.22          187
modified ALOM score: −0.74
*** Reasoning Step: 3
----- Final Results -----
  bacterial cytoplasm --- Certainty = 0.2488 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the databases:

```
66.8/82.6% over 474aa
Streptococcus mutans
EGAD|42413| NADP-dependent glyceraldehyde-3-phosphate dehydrogenase Insert characterized
EGAD|42413|110509 NADP-dependent glyceraldehyde-3-phosphate dehydrogenase Insert
characterized
SP|Q59931|GAPN_STRMU NADP-DEPENDENT GLYCERALDEHYDE-3-PHOSPHATE DEHYDROGENASE (EC 1.2.1.9)
(NON-PHOSPHORYLATING GLYCERALDEHYDE 3-PHOSPHATE DEHYDROGENASE) (GLYCERALDEHYDE-3-PHOSPHATE
DEHYDROGENASE [NADP+]) (TRIOSEPHOSPHATE DEHYDROGENASE). Edit characterized
GP|642667|gb|AAA91091.1|L38521 NADP-dependent glyceraldehyde-3-phosphate dehydro Insert
characterized
ORF01688(301-1725 of 2025)
EGAD|42413|44796(1-475 of 475) NADP-dependent glyceraldehyde-3-phosphate dehydrogenase
{Streptococcus mutans}EGAD|42413|110509 NADP-dependent glyceraldehyde-3-phosphate
dehydrogenase {Streptococcus mutans}SP|Q59931|GAPN_STRMU NADP-DEPENDENT GLYCERALDEHYDE-3-
PHOSPHATE DEHYDROGENASE (EC 1.2.1.9) (NON-PHOSPHORYLATING GLYCERALDEHYDE 3-PHOSPHATE
DEHYDROGENASE) (GLYCERALDEHYDE-3-PHOSPHATE DEHYDROGENASE [NADP+]) (TRIOSEPHOSPHATE
DEHYDROGENASE).GP|642667|gb|AAA91091.1|L38521 NADP-dependent glyceraldehyde-3-phosphate
dehydro
% Match = 49.3
% Identity = 66.7 % Similarity = 82.5
Matches = 317 Mismatches = 83 Conservative Sub.s = 75

195       225       255       285       315       345       375       405
         *GLKNLYFFIESLDIVKFLRKICQIIEINR*SDRINLLQCKRRFTLTKEYQNYVNGEWKSSVNQIEILSPIDDSSLGFVP
                                       :||:|:|||||||| | |:|:|  |  : || ||
                                       MTKQYKNYVNGEWKLSENEIKIYEPASGAELGSVP
                                            10        20        30

435       465       495       525       555       585       615       645
         AMTREEVDHAMKAGREALPAWAALTVYERAQYLHKAADIIERDKEEIATVLAKEISKAYNASVTEVVRTADLIRYAAEEG
         ||  ||||   : ::|  ||||  ||  ||  |||:   : |:|::|  |  |  |: ::|||||||:|  ||||||
         AMSTEEVDYVYASAKKAQPAWRALSYIERAAYLHKVADILMRDKEKIGAILSKEVAKGYKSAVSEVVRTAEIINYAAEEG
               50        60        70        80        90       100       110

675       705       735       765       795       825       855       885
         IRLSTSADEGGKMDASTGHKLAVIRRQPVGIVLAIAPYNYPVNLSGSKIAPALIGGNVVMFKPPTQGSVSGLVLAKAFAE
         :|:     |||   :|::   |:|||:||:||||||:|:|||||||||||||| |||:  ||||||||||:|||:||||||
         LRMEGEVLEGGSFEAASKKKIAVVRREPVGLVLAISPFNYPVNLAGSKIAPALIAGNVIAFKPPTQGSISGLLLAEAFAE
              130       140       150       160       170       180       190

915       945       975      1005      1035      1065      1095      1125
         AGLPAGVFNTITGRGSEIGDYIVEHEEVNFINFTGSTPVGKRIGKLAGMRPIMLELGGKDAGVVLADADLDNAAKQIVAG
         ||||||||||||||||||||||||:  |||||||||| ||||:||:|||||||||||||||||:||  :|| ||||:  ||  |:||
         AGLPAGVFNTITGRGSEIGDYIVEHQAVNFINFTGSTGIGERIGKMAGMRPIMLELGGKDSAIVLEDADLELTAKNIIAG
              210       220       230       240       250       260       270
```

```
      1155      1185      1215      1245      1275      1305      1335      1365
   AYDYSGQRCTAIKRVLVVEEVADELAEKISENVAKLSVGXPFDNATVTPVIDDNSADFIESLVVDARQKGAKELNEFKRD
   |: ||||||:||||||:| |||||| ||| | |::| :|:: | |||::| |: || |||| | || |:
   AFGYSGQRCTAVKRVLVMESVADELVEKIREKVLALTIGNPEDDADITPLIDTKSADYVEGLINDANDKGATALTEIKRE
             290       300       310       320       330       340       350

1395      1425      1455      1485      1515      1545      1575      1605
   GRLLTPGLFDHVTLDMKLAWEEPFGPILPIIRVKDAEEAVAIANKXDFGLQSSVFTRDFQKAFDIANKLEVGTVHINNKT
   | |: | ||| || ||:|||||||:||||||     |||: |:|| ::||:|:|| || :|| || :|||||||||||
   GNLICPILFDKVTTDMRLAWEEPFGPVLPIIRVTSVEEAIEISNKSEYGLQASIFTNDFPRAFGIAEQLEVGTVHINNKT
             370       380       390       400       410       420       430

1635      1665      1695      1725      1755      1785      1815      1845
   GRGPDNFPFLGLKGSGAGVQGIRYSIEAMTNVKSIVFDMK*T*NDSTIVS*VVL*TSFTLKIKNYIIF*SGFIFVI*LS*
   || ||||||| | ||||:||::||||||| |||:|||:|
   QRGTDNFPFLGAKKSGAGIQGVKYSIEAMTTVKSVVFDIK
             450       460       470
```

SEQ ID 8816 (GBS127) was expressed in *E. coli* as a His-fusion product. SDS-PAGE analysis of total cell extract is shown in FIG. 29 (lane 10; MW 55.9 kDa).

Figure 200:
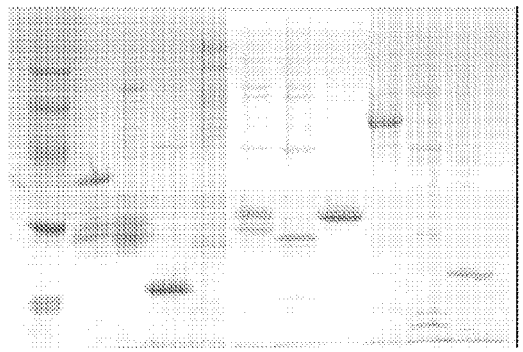

GBS127-His was purified as shown in FIG. 200, lane 9.

Based on this analysis, it was predicted that these proteins and their epitopes could be useful antigens for vaccines or diagnostics.

Example 1454

A DNA sequence (GBSx1540) was identified in *S. agalactiae* <SEQ ID 4465> which encodes the amino acid sequence <SEQ ID 4466>. Analysis of this protein sequence reveals the following:

Possible site: 17

>>> Seems to have no N-terminal signal sequence

INTEGRAL    Likelihood = –0.37    Transmembrane 427-443 (427-443)

----- Final Results ----- bacterial membrane --- Certainty = 0.1150 (Affirmative) <succ> bacterial outside --- Certainty = 0.0000 (Not Clear) <succ> bacterial cytoplasm --- Certainty = 0.0000 (Not Clear) <succ>

The protein has homology with the following sequences in the GENPEPT database.

```
>GP:BAA78049 GB:AB027569 phosphoenolpyruvate-protein
            phosphotransferase [Streptococcus bovis]
Identities = 534/577 (92%), Positives = 559/577 (96%)
    Query:   1  MTEMLKGIAASDGVAVAKAYLLVQPDLSFETVTVEDTNAEEARLDVALQASQDELSVIRE    60
                MTEMLKGIAASDGVAVAKAYLLVQPDLSFETVIVEDT+AEEARLD AL+ASQDELS+IRE
    Sbjct:   1  MTEMLKGIAASDGVAVAKAYLLVQPDLSFETVTVEDTSAEEARLDAALKASQDELSIIRE    60

Query:  61  KAVESLGEEAAAVFDAHLMVLSDPEMINQIKETIRAKQVNAETGLKEVTDMFITIFEGME   120
                KAVE+LGEEAAAVFDAHLMVL+DPEMI+QIKETIRAKQ NAE GLKEVTDMFITIFEGME
    Sbjct:  61  KAVETLGEEAAAVFDAHLMVLADPEMISQIKETIRAKQTNAEAGLKEVTDMFITIFEGME   120

Query: 121  DNPYMQERAADIRDVAKRVLAHLLGVKLPNPATINEESIVIAHDLTPSDTAQLNKQFVKA   180
                DNPYMQERAADIRDVAKRVLAHLLG KLPNPATI+EESIVIAHDLTPSDTAQLNKQFVKA
    Sbjct: 121  DNPYMQERAADIRDVAKRVLAHLLGAKLPNPATIDEESIVIAHDLTPSDTAQLNKQFVKA   180

Query: 181  FVTNIGGRTSHSAIMARTLEIAAVLGTNDITERVQDGQLIANNGITGEVIIEPTEAQISA   240
                FVTNIGGRTSHSAIMARTLEIAAVLGTNDIT RV+DG ++AVNGITGEVII PT+ Q++
    Sbjct: 181  FVTNIGGRTSHSAIMARTLEIAAVLGTNDITSRVKDGDIAVNGITGEVIINPTDEQVAE   240

Query: 241  FKAAGEAYAKQKAEWALLKDAQTVTADGKHFELAANIGTPKDVEGVNENGAEAVGLYRTE   300
                FKAAGEAYAKQKAEWALLKDA+TVTADGKHFELAANIGTPKDVEGVN NGAEAVGLYRTE
    Sbjct: 241  FKAAGEAYAKQKAEWALLKDAKTVTADGKHFELAANIGTPKDVEGVNANGAEAVGLYRTE   300

Query: 301  FLYMDSQDFPTEDEQYEAYKAVLEGMNGKPVVVRTMDIGGDKELPYFDLPKEMNPFLGFR   360
                FLYMDSQDFPTEDEQYEAYKAVLEGMNGKPVVVRTMDIGGDKELPY DLPKEMNPFLGFR
    Sbjct: 301  FLYMDSQDFPTEDEQYEAYKAVLEGMNGKPVVVRTMDIGGDKELPYLDLPKEMNPFLGFR   360

Query: 361  ALRISISETGDAMFRTQIRALLRASVHGQLRIMFPMVALLKEFRAAKAIFEEEKANLLAD   420
                ALRISISETG+AMFRTQIRALLRASVHGQLRIMFPMVALLKEFRAAKAIF+EEKANL A+
    Sbjct: 361  ALRISISETGNAMFRTQIRALLRASVHGQLRIMFPMVALLKEFRAAKAIFDEEKANLKAE   420

Query: 421  GVAVAEGIEVGIMIEIPAAAMLADQFAKEVDFFSIGTNDLIQYTMAADRMNEQVSYLYQP   480
                GVAV++ I+VGIMIEIPAAAMLADQFAKEVDFFSIGTNDLIQYTMAADRMNEQVSYLYQP
    Sbjct: 421  GVAVSDDIQVGIMIEIPAAAMLADQFAKEVDFFSIGTNDLIQYTMAADRMNEQVSYLYQP   480

Query: 481  YNPSILRLINNVIKAAHAEGKWAGMCGEMAGDQTAVPLLVGMGLDEFSMSATSVLRTRSL   540
                YNPSILRLINNVIKAAHAEGKW GMCGEMAGDQ AVPLLV MGLDEFSMSATS+LRTRSL
```

```
-continued
Sbjct: 481  YNPSILRLINNVIKAAHAEGKWVGMCGEMAGDQKAVPLLVEMGLDEFSMSATSILRTRSL  540

Query: 541  MKKLDTAKMEEYANRALSECSTMEEVIELQKEYVDFD                         577
            MKKLDTAKM+EYANRAL+ECSTMEEV+EL KEYV+ D
Sbjct: 541  MKKLDTAKMQEYANRALTECSTMEEVLELSKEYVNVD                         577
```

A related DNA sequence was identified in *S. pyogenes* <SEQ ID 4467> which encodes the amino acid sequence <SEQ ID 4468>. Analysis of this protein sequence reveals the following:

Possible site: 39
>>> Seems to have no N-terminal signal sequence
----- Final Results -----
    bacterial cytoplasm ---Certainty = 0.0875 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below.

Based on this analysis, it was predicted that these proteins and their epitopes could be useful antigens for vaccines or diagnostics.

Example 1455

A DNA sequence (GBSx1541) was identified in *S. agalactiae* <SEQ ID 4469> which encodes the amino acid sequence <SEQ ID 4470>. Analysis of this protein sequence reveals the following:

Possible site: 30
>>> Seems to have no N-terminal signal sequence
----- Final Results -----
    bacterial cytoplasm --- Certainty = 0.1421 (Affirmative) <succ>
      bacterial membrane --- Certainty = 0.0000 (Not Clear) <succ>
        bacterial outside --- Certainty = 0.0000 (Not Clear) <succ>

The protein is similar to a protein from *S. bovis*:

```
Identities = 540/577 (93%), Positives = 561/577 (96%)
Query:   1  MTEMLKGIAASDGVAVAKAYLLVQPDLSFETVTVEDTNAEEARLDVALQASQDELSVIRE   60
            MTEMLKGIAASDGVAVAKAYLLVQPDLSFETVTV DTNAEEARLDVALQA+QDELSVIRE
Sbjct:   1  MTEMLKGIAASDGVAVAKAYLLVQPDLSFETVTVADTNAEEARLDVALQAAQDELSVIRE   60

Query:  61  KAVESLGEEAAAVFDAHLMVLSDPEMINQIKETIRAKQVNAETGLKEVTDMFITIFEGME  120
             AVESLGEEAAAVFDAHLMVL+DPEMI+Q+KETIRAKQ NAETGLKEVTDMFITIFEGME
Sbjct:  61  NAVESLGEEAAAVFDAHLMVLADPEMISQVKETIRAKQTNAETGLKEVTDMFITIFEGME  120

Query: 121  DNPYMQERAADIRDVAKRVLAHLLGVKLPNPATINEESIVIAHDLTPSDTAQLNKQFVKA  180
            DNPYMQERAADIRDVAKRVLAHLLGVKLPNPATINEESIVIAHDLTPSDTAQLNKQFVKA
Sbjct: 121  DNPYMQERAADIRDVAKRVLAHLLGVKLPNPATINEESIVIAHDLTPSDTAQLNKQFVKA  180

Query: 181  FVTNIGGRTSHSAIMARTLEIAAVLGTNDITERVQDGQLIAVNGITGEVIIEPTEAQISA  240
            FVTNIGGRTSHSAIMARTLEIAAVLGTNDIT+RV+DG +IAVNGITGEVII+P+E Q+ A
Sbjct: 181  FVTNIGGRTSHSAIMARTLEIAAVLGTNDITKRVKDGDVIAVNGITGEVIIDPSEDQVLA  240

Query: 241  FKAAGEAYAKQKAEWALLKDAQTVTADGKHFELAANIGTPKDVEGVNENGAEAVGLYRTE  300
            FK AG AYAKQKAEW+LLKDA T TADGKHFELAANIGTPKDVEGVN+NGAEAVGLYRTE
Sbjct: 241  FKEAGAAYAKQKAEWSLLKDAHTETADGKHFELAANIGTPKDVEGVNDNGAEAVGLYRTE  300

Query: 301  FLYMDSQDFPTEDEQYEAYKAVLEGMNGKPVVVRTMDIGGDKELPYFDLPKEMNPFLGFR  360
            FLYMDSQDFPTEDEQYEAYKAVLEGMNGKPVVVRTMDIGGDKELPYFDLPKEMNPFLGFR
Sbjct: 301  FLYMDSQDFPTEDEQYEAYKAVLEGMNGKPVVVRTMDIGGDKELPYFDLPKEMNPFLGFR  360

Query: 361  ALRISISETGDAMFRTQIRALLRASVHGQLRIMFPMVALLKEFRAAKAIFEEEKANLLAD  420
            ALRISISETGDAMFRTQ+RALLRASVHGQLRIMFPMVALLKEFRAAKA+F+EEKANLLA+
Sbjct: 361  ALRISISETGDAMFRTQMRALLRASVHGQLRIMFPMVALLKEFRAAKAVFDEEKANLLAE  420

Query: 421  GVAVAEGIEVGIMIEIPAAAMLADQFAKEVDFFSIGTNDLIQYTMAADRMNEQVSYLYQP  480
            GVAVA+ I+VGIMIEIPAAAMLADQFAKEVDFFSIGTNDLIQYTMAADRMNEQVSYLYQP
Sbjct: 421  GVAVADDIQVGIMIEIPAAAMLADQFAKEVDFFSIGTNDLIQYTMAADRMNEQVSYLYQP  480

Query: 481  YNPSILRLINNVIKAAHAEGKWAGMCGEMAGDQTAVPLLVGMGLDEFSMSATSVLRTRSL  540
            YNPSILRLINNVIKAAHAEGKWAGMCGEMAGDQ AVPLLVGMGLDEFSMSATSVLRTRSL
Sbjct: 481  YNPSILRLINNVIKAAHAEGKWAGMCGEMAGDQQAVPLLVGMGLDEFSMSATSVLRTRSL  540

Query: 541  MKKLDTAEMEEYANRALSECSTMEEVIELQKEYVDFD                         577
            MKKLD+AKMEEYANRAL+ECST EEV+EL KEYV  D
Sbjct: 541  MKKLDSAKMEEYANRALTECSTAEEVLELSKEYVSED                         577
```

```
>GP:BAA78048 GB:AB027569 histidine containing protein [Streptococcus bovis]
Identities = 86/87 (9850, Positives = 87/87 (9990
Query:    1    MASKDFHIVAETGIHARPATLLVQTASKFASDITLDYKGKAVNLKSIMGVMSLGVGQGAD    60
               MASKDFHIVAETGIHARPATLLVQTASKFASDITLDYKGKAVNLKSIMGVMSLGVGQGAD
Sbjct:    1    MASKDFHIVAETGIHARPATLLVQTASKFASDITLDYKGKAVNLKSIMGVMSLGVGQGAD    60

Query:   61    VTISAEGADADDAIAAIEETMTKEGLA                                   87
               VTISAEGADADDA+AAIEETMTKEGLA
Sbjct:   61    VTISAEGADADDALAAIEETMTKEGLA                                   87
```

A related DNA sequence was identified in *S. pyogenes* <SEQ ID 4471> which encodes the amino acid sequence <SEQ ID 4472>. Analysis of this protein sequence reveals the following:

```
Possible site: 30
>>> Seems to have no N-terminal signal sequence
----- Final Results -----
   bacterial cytoplasm --- Certainty = 0.1421 (Affirmative) <succ
      bacterial membrane --- Certainty = 0.0000 (Not Clear) <succ>
         bacterial outside --- Certainty = 0.0000 (Not Clear) <succ>
```

An alignment of the GAS and GBS proteins is shown below.

```
Identities = 86/87(98%), Positives = 87/87 (99%)
Query:    1    MASEDFHIVAETGIHARPATLLVQTASKFASDITLDYKGKAVNLKSIMGVMSLGVGQGAD    60
               MASKDFHIVAETGIHARPATLLVQTASKFASDITLDYKGKAVNLKSIMGVMSLGVGQGAD
Sbjct:    1    MASKDFHIVAETGIHARPATLLVQTASKFASDITLDYKGKAVNLKSIMGVMSLGVGQGAD    60

Query:   61    VTISAEGADADDAIAAIEETMTKEGLA                                   87
               VTISAEGADA+DAIAMEETVITKEGLA
Sbjct:   61    VTISAEGADAEDAIAAIEETMTKEGLA                                   87
```

Based on this analysis, it was predicted that these proteins and their epitopes could be useful antigens for vaccines or diagnostics.

Example 1456

A DNA sequence (GBSx1542) was identified in *S. agalactiae* <SEQ ID 4473> which encodes the amino acid sequence <SEQ ID 4474>. This protein is predicted to be glutaredoxin-like protein nrdh (b2673). Analysis of this protein sequence reveals the following:

```
Possible site: 56
>>> Seems to have no N-terminal signal sequence
----- Final Results -----
   bacterial cytoplasm --- Certainty = 0.4532 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database.

A related DNA sequence was identified in *S. pyogenes* <SEQ ID 4475> which encodes the amino acid sequence <SEQ ID 4476>. Analysis of this protein sequence reveals the following:

```
Possible site: 17
>>> Seems to have no N-terminal signal sequence
----- Final Results -----
   bacterial cytoplasm --- Certainty = 0.4606 (Affirmative) <succ>
      bacterial membrane --- Certainty = 0.0000 (Not Clear) <succ>
         bacterial outside --- Certainty = 0.0000 (Not Clear) <succ>
```

An alignment of the GAS and GBS proteins is shown below.

```
>GP:CAA63372 GB:X92690 glutaredoxin-like protein [Lactococcus lactis]
Identities = 42/70 (60%), Positives = 53/70 (75%)
Query:    4    ITVESKNNCMQCKMTKKELDQHGADFEEINIDEKPEKIEYVKNLGESAAPVIEAGNVVFS    63
               +TV+SKNNCMQCKM KK+L +H   F EINIDE+PE +E V  +GF AAPVI   +  FS
Sbjct:    2    VTVYSKNNCMQCKMVKKWLSEHEIAFNEINIDEQPEFVEKVIEMGFRAAPVITKDDFAFS    61

Query:   64    GFQPSKLKEL                                                    73
               GF+PS+L +L
Sbjct:   62    GFRPSELAKL                                                    71
```

```
Identities = 56/71 (78%), Positives = 68/71 (94%)
Query:   4   ITVESKNNCMQCKMIKKELDQHGADFEEINIDEKPEKIEYVKNLGESAAPVIEAGNVVFS  63
             ITV+SKNNCMQCKMTKKFL+QHG +F+EINIDE PEK++YVK+LGF++APVIEA N+VFS
Sbjct:  13   ITVYSKNNCMQCKMIKKFLEQHGVNFQEINIDEHPEKVDYVKSLGETSAPVIEADNLVFS  72

Query:  64   GFQPSKLKELV                                                  74
             GFQP+KLKEL+
Sbjct:  73   GFQPAKLKELI                                                  83
```

Based on this analysis, it was predicted that these proteins and their epitopes could be useful antigens for vaccines or diagnostics.

Example 1457

A DNA sequence (GBSx1543) was identified in *S. agalactiae* <SEQ ID 4477> which encodes the amino acid sequence <SEQ ID 4478>. This protein is predicted to be ribonucleotide reductase subunit R1E (nrdE). Analysis of this protein sequence reveals the following:

```
Possible site: 49
>>> Seems to have no N-terminal signal sequence
----- Final Results -----
   bacterial cytoplasm --- Certainty = 0.3676 (Affirmative) <succ>
   bacterial membrane --- Certainty = 0.0000 (Not Clear) <succ>
   bacterial outside --- Certainty = 0.0000 (Not Clear) <succ>
```

The protein has homology with the following sequences in the GENPEPT database.

```
>GP:AAD41036 GB:AF112535 ribonucleotide reductase alpha-chain
[Corynebacterium glutamicum]
Identities = 366/701 (52%), Positives = 488/701 (69%), Gaps = 19/701 (2%)
Query:  23   NGQIPLHKDKEALTAFFKENVQPNSKAFDSITDKIAYLLKYDYLEEAFLNKYRPEFIEEL   82
             NG+I    KD+EA   +F  ++V  N+   F ++  +KI YL++   Y +    L+KY  +FI++L
Sbjct:  22   NGKIQFEKDREAANQYFLQHVNQNTVFFHNLQEKIDYLVENKYYDPIVLDKYDFQFIKDL   81

Query:  83   STKLFDKKFRFKSFMAAYKFYQQYALKTNDGEYYLESIEDRVLFNALYFADGDEELATDL  142
             + +    KFRF+SF+   AYK+Y  Y LKT DG   YLE   EDRV    AL   ADGD    LA +L
Sbjct:  82   FKRAYGFKFRFQSFLGAYKYYTSYTLKTFDGRRYLERFEDRVCMVALTLADGDRALAENL  141

Query: 143   ALEMISQRYQPATPSFLNAGRSRRGELVSCFLIQVTDDMNAIGRSINSALQLSRIGGGVG  202
              E++S  R+QPATP+FLN+G+++RGE VSCFL+++   D+M   +IGRSINSALQLS+ GGGV
Sbjct: 142   VDEIMSGRFQPATPTFLNSGKAQRGEPVSCFLLRIEDNMESIGRSINSALQLSKRGGGVA  201

Query: 203   ISLSNLREAGAPIKGFAGAASGVVPVMKLFEDSFSYSNQLGQRQGAGVVYLDVFHPDIIS  262
             + LSNLREAGAPIK       +SGV+PVMKL ED+FSY+NQLG RQGAG VYL+  HPDI+S
Sbjct: 202   LLLSNLREAGAPIKKIENQSSGVIPVMKLLEDAFSYANQLGARQGAGAVYLNAHHPDILS  261

Query: 263   FLSTKKENADEKVRVKTLSLGITVPDKFYELARNNQEMYLFSPYSIEREYGVPFSYIDIT  322
             FL TK+ENADEK+R+KTLSLG+  +PD  +ELA+ N +MYLFSPY +ER  YG PF+ +    IT
Sbjct: 262   FLDTKRENADEKIRIKTLSLGVVIPDITFELAKRNDDMYLFSPYDVERIYGKPFADVSIT  321

Query: 323   EKYDELVANPNITKTKINARDLETEISKLQQESGYPYIINIDTANRTNPVDGKIIMSNLC  382
             E YDE+V +    I  KTKINAR     ++++Q ESGYPYI+  DT N +NP++G+I SNLC
Sbjct: 322   EHYDEMVDDDRIRKTKINARQFFQTLAEIQFESGYPYIMYEDTVNASNPIEGRITHSNLC  381

Query: 383   SEILQVQKPSLINDAQEYLEMGTDISCNLGSTNVLNMMTSPDFGKSIKTMTRALTFVTDS  442
             SEILQV   PS   ND    Y E+G DISCNLGS NV   M  SP+F K+I+T  R LT V++
Sbjct: 382   SEILQVSTPSEFNDDLTYAEVGEDISCNLGSLNVAMAMDSPNFEKTIETAIRGLTAVSEQ  441

Query: 443   SNIEAVPTIKNGNAQAHTFGLGAMGLHSYLAKNHIEYGSPESIEFTDIYFMLMNYWTLVE  502
             ++I++VP+I+  GN  AH    GLG M LH Y   + H+ YGS E+++FT+ YF  + Y   L
Sbjct: 442   TSIDSVPSIRKGNEAAHAIGLGQMNLHGYFGREHMHYGSEEALDFTNAYFAAVLYQCLRA  501

Query: 503   SNNIARERQTTFVGFEKSKYADGTYFDKYVSGKFVPQSDKVKSLFA--NHFIPEAKDWEN  560
             SN  IA ER    F  FE SKYA G YFD + +    F P+SDKVK LFA  N    P  +DW
Sbjct: 502   SNKIATERGERFKNFENSKYATGEYFDDFDANDFAPKSDKVKELFAKSNIHTPTVEDWAA  561

Query: 561   LRYAVMKDGLYHQNRLAVAPNGSISYINDCSASIHPITQRIEERQEKKIGKIYYPANGLA  620
             L+   VM+ GL+++N   AV P GSISYIN+ ++SIHPI   +IE R+E KIG++YYPA  +
Sbjct: 562   LKADVMEHGLFNRNLQAVPPTGSISYINNSTSSIHPIASKIEIRKEGKIGRVYYPAPHMD  621

Query: 621   TDTIPYYTSAYDMDRKVIDVYAAATEHVDQGLSMTLFLRSELPKELYEWKTESKQTTRD   680
                  D + Y+    AY++      K+ID YA  AT++VDQGL++TLF +                 TTRD
Sbjct: 622   NDNLEYFEDAYEIGYEKIIDTYAVATKYVDQGLSLTLFFK-------------DTATTRD  668

Query: 681   LSILRNYAFMKGVKSIYYI--RTFTDDGSEVGANQCESCVI                    719
             ++ +  + YA+ KG+K++YYI  R      +G+EV  + C SC++
Sbjct: 669   INRAQIYAWRKGIKTLYYIRLRQVALEGTEV--DGCVSCML                    707
```

A related DNA sequence was identified in *S. pyogenes* <SEQ ID 4479> which encodes the amino acid sequence <SEQ ID 4480>. Analysis of this protein sequence reveals the following:

---

Possible site: 39
>>> Seems to have no N-terminal signal sequence
----- Final Results -----
  bacterial cytoplasm --- Certainty = 0.4241 (Affirmative) <succ>
    bacterial membrane --- Certainty = 0.0000 (Not Clear) <succ>
    bacterial outside --- Certainty = 0.0000 (Not Clear) <succ>

---

An alignment of the GAS and GBS proteins is shown below.

otide reductase subunit R2F (nrdB). Analysis of this protein sequence reveals the following:

---

Possible site: 44
>>> Seems to have no N-terminal signal sequence
----- Final Results -----
  bacterial cytoplasm --- Certainty = 0.4583 (Affirmative) <succ>
    bacterial membrane --- Certainty = 0.0000 (Not Clear) <succ>
    bacterial outside --- Certainty = 0.0000 (Not Clear) <succ>

---

```
Identities = 628/719 (87%), Positives = 682/719 (94%)
Query:   1  MSLKNIGDVSYFRLNNEINRPVNGQIPLHKDKEALTAFFKENVQPNSKAFDSITDKIAYL   60
            MSLK++GD+SYFRLNNEINRPVNG+IPLHKDKEAL AF ENV  PN+ +F SIT+KI YL
Sbjct:   1  MSLKDLGDISYFRLNNEINRPVNGKIPLHKDKEALKAFSAENVLPNTMSFTSITEKIEYL   60

Query:  61  LKYDYLEEAFLNKYRPEFIEELSTKLFDKKFRFKSFMAAYKFYQQYALKTNDGEYYLESI  120
            +  DY+E AF+ KYRPEFI EL + +  + FREKSFMAAYKFYQQYALKTNDGE+YLE++
Sbjct:  61  ISNDYIESAFIQKYRPEFITELDSIIKSENFRFKSFMAAYKFYQQYALKTNDGEHYLENL  120

Query: 121  EDRVLENALYFADGDEELATDLALEMISQRYQPATPSFLNAGRSRRGELVSCFLIQVTDD  180
            EDRVLFNALYFADG E+LA DLA+EMI+QRYQPATPSFLNAGRSRRGELVSCFLIQVTDD
Sbjct: 121  EDRVLFNALYFADGQEDLAKDLAVEMINQRYQPATPSFLNAGRSRRGELVSCFLIQVTDD  180

Query: 181  MNAIGRSINSALQLSRIGGGVGISLSNLREAGAPIKGFAGAASGVVPVMKLFEDSFSYSN  240
            MN+IGRSINSALQLSRIGGGVGI+LSNLREAGAPIKG+AGAASGVVPVMKLFEDSFSYSN
Sbjct: 181  MNSIGRSINSALQLSRIGGGVGITLSNLREAGAPIKGYAGAASGVVPVMKLFEDSFSYSN  240

Query: 241  QLGQRQGAGVVYLDVFHPDIISFLSTKKENADEKVRVKTLSLGITVPDKFYELARNNQEM  300
            QLGQRQGAGVVYL+VFHPDII+FLSTKKENADEKVRVKTLSLGITVPDKFYELAR N++M
Sbjct: 241  QLGQRQGAGVVYLNVFHPDIIAFLSTKKENADEKVRVKTLSLGITVPDKFYELARKNEDM  300

Query: 301  YLFSPYSIEREYGVPFSYIDITEKYDELVANPNITKTKINARDLETEISKLQQESGYPYI  360
            YLFSPY++E+EYG+PF+Y+DIT  YDELVANP ITKTKI ARDLETEISKLQQESGYPYI
Sbjct: 301  YLFSPYNVEKEYGIPFNYLDITNMYDELVANPKITKTKIKARDLETEISKLQQESGYPYI  360

Query: 361  INIDTANRTNPVDGKIIMSNLCSEILQVQKPSLINDAQEYLEMGTDISCNLGSTNVLNMM  420
            INIDTAN+ NP+DGKIIMSNLCSEILQVQ PSLINDAQE++EMGTDISCNLGSTN+LNMM
Sbjct: 361  INIDTANKANPIDGKIIMSNLCSEILQVQTPSLINDAQEFVEMGTDISCNLGSTNILNMM  420

Query: 421  TSPDFGKSIKTMTRALTFVTDSSNIEAVPTIKNGNAQAHTFGLGAMGLHSYLAKNHIEYG  480
            TSPDFG+SIKTMTRALTFVTDSS+IEAVPTIK+GN+QAHTFGLGAMGLHSYLA++HIEYG
Sbjct: 421  TSPDFGRSIKTMTRALTFVTDSSSIEAVPTIKHGNSQAHTFGLGAMGLHSYLAQHHIEYG  480

Query: 481  SPESIEFTDIYFMLMNYWTLVESNNIARERQTTFVGFEKSKYADGTYFDKYVSGKFVPQS  540
            SPESIEFTDIYFML+NYWTLVESNNIARERQTTFVGFE SKYA+G+YFDKYV+G FVP+S
Sbjct: 481  SPESIEFTDIYFMLLNYWTLVESNNIARERQTTFVGFENSKYANGSYFDKYVTGHFVPKS  540

Query: 541  DKVKSLFANHFIPEAKDWENLRYAVMKDGLYHQNRLAVAPNGSISYINDCSASIHPITQR  600
            D VK LF +HFIP+A DWE LR AV KDGLYHQNRLAVAPNGSISYINDCSASIHPITQR
Sbjct: 541  DLVKDLFKDHFIPQASDWEALRDAVQKDGLYHQNRLAVAPNGSISYINDCSASIHPITQR  600

Query: 601  IEERQEKKIGKIYYPANGLATDTIPYYTSAYDMDMRKVIDVYAAATEHVDQGLSMTLFLR  660
            IEERQEKKIGKIYYPANGL+TDTIPYYTSAYDMDMRKVIDVYAAATEHVDQGLS+TLFLR
Sbjct: 601  IEERQEKKIGKIYYPANGLSTDTIPYYTSAYDMDMRKVIDVYAAATEHVDQGLSLTLFLR  660

Query: 661  SELPKELYEWKTESKQTTRDLSILRNYAENKGVKSIYYIRTFTDDGSEVGANQCESCVI   719
            SELP ELYEWKT+SKQTTRDLSILRNYAFNKG+KSIYYIRTFTDDG EVGANQCESCVI
Sbjct: 661  SELPMELYEWKTQSKQTTRDLSILRNYAFNKGIKSIYYIRTFTDDGEEVGANQCESCVI   719
```

Based on this analysis, it was predicted that these proteins and their epitopes could be useful antigens for vaccines or diagnostics.

Example 1458

A DNA sequence (GBSx1544) was identified in *S. agalactiae* <SEQ ID 4481> which encodes the amino acid sequence <SEQ ID 4482>. This protein is predicted to be ribonucle- A related GBS nucleic acid sequence <SEQ ID 9753> which encodes amino acid sequence <SEQ ID 9754> was also identified.

The protein has homology with the following sequences in the GENPEPT database.

```
>GP:AAC14561 GB:AF050168 ribonucleoside diphosphate reductase small subunit
[Corynebacterium ammoniagenes]
Identities = 166/313 (53%), Positives = 215/313 (68%), Gaps = 1/313 (0%)
Query:  10  EAINWNEIEDVIDKSTWEKLTEQFWLDTRIPLSNDLDDWRKLSAQEKDLVGKVFGGLTLL   69
            +AINWN I  D  D    W++LT  FWL +IP+SND+  W K++ QE+    +VF GLTLL
Sbjct:  17  KAINWNVIPDEKDLEVWDRLTGNFWLPEKIPVSNDIQSWNKMTPQEQLATMRVFTGLTLL   76

Query:  70  DTMQSETGVEAIRADVRTPHEEAVLNNIQFMESVHAKSYSSIFSTLNTKSEIEEIFEWTN  129
            DT+Q    G  ++   DV T HEE V  NI FMESVHAKSYS+IF TL +  +I E F W+
Sbjct:  77  DTIQGTVGAISLLPDVETMHEEGVYTNIAFMESVHAKSYSNIFMTLASTPQINEAFRWSE  136

Query: 130  NNEFLQEKARIINDIYANGNALQKKVASTYLETFLFYSGFFTPLYYLGNNKLANVAEIIK  189
              NE LQ KA+II   Y   + L+KKVAST LE+FLFYSGF+ P+Y     KL N A+II+
Sbjct: 137  ENENLQRKAKIIMSYYNGDDPLKKKVASTLLESFLFYSGFYLPMYLSSRAKLTNTADIIR  196

Query: 190  LIIRDESVHGTYIGYKFQLGFNELPEDEQENFRDWMYDLLYQLYENEEKYTKTLYDGVGW  249
            LIIRDESVHG YIGYK+Q G  +L E EQE ++ +  +DL+Y LYENE +YT+ +YD +GW
Sbjct: 197  LIIRDESVHGYYIGYKYQQGVKKLSEAEQEEYKAYTFDLMYDLYENEIEYTEDIYDDLGW  256

Query: 250  TEEVMTFLRYNANKALMNLGQDPLFPDTANDVNPIVMNGIS-TGTSNHDFFSQVGNGYLL  308
            TE+V   FLRYNANKAL  NLG + LFP       V+P +++ +S       NHDFFS  G+ Y++
Sbjct: 257  TEDVKRFLRYNANKALNNLGYEGLFPTDETKVSPAILSSLSPNADENHDFFSGSGSSYVI  316

Query: 309  GSVEAMHDDDYNY                                                321
            G  E    DDD+++
Sbjct: 317  GKAEDTTDDDWDF                                                329
```

A related DNA sequence was identified in *S. pyogenes* <SEQ ID 4483> which encodes the amino acid sequence <SEQ ID 4484>. Analysis of this protein sequence reveals the following:

---

Possible site: 40
>>> Seems to have no N-terminal signal sequence
----- Final Results -----
   bacterial cytoplasm --- Certainty = 0.4583 (Affirmative) <succ>
      bacterial membrane --- Certainty = 0.0000 (Not Clear) <succ>
         bacterial outside --- Certainty = 0.0000 (Not Clear) <succ>

---

An alignment of the GAS and GBS proteins is shown below.

Based on this analysis, it was predicted that these proteins and their epitopes could be useful antigens for vaccines or diagnostics.

Example 1459

A DNA sequence (GBSx1545) was identified in *S. agalactiae* <SEQ ID 4485> which encodes the amino acid sequence <SEQ ID 4486>. Analysis of this protein sequence reveals the following:

---

Possible site: 53
>>> Seems to have no N-terminal signal sequence
INTEGRAL    Likelihood = −0.27    Transmembrane 50-66 (50-66)
----- Final Results -----
   bacterial membrane ---Certainty = 0.1107 (Affirmative) <succ>

---

```
Identities = 315/319 (98%), Positives = 316/319 (98%)
Query:   5  MTTYYEAINWNEIEDVIDKSTWEKLTEQFWLDTRIPLSNDLDDWRKLSAQEKDLVGKVFG   64
            MTTYYEAINWNEIEDVIDKSTWEKLTEQFWLDTRIPLSNDLDDWRKLS QEKDLVGKVFG
Sbjct:   1  MTTYYEAINWNEIEDVIDKSTWEKLTEQFWLDTRIPLSNDLDDWRKLSLQEKDLVGKVFG   60

Query:  65  GLTLLDTMQSETGVEAIRADVRTPHEEAVLNNIQFMESVHAKSYSSIFSTLNTKSEIEEI  124
            GLTLLDTMQSETGVEAIRADVRTPHEEAVINNIQFMESVHAKSYSSIFSTLNTK EIEEI
Sbjct:  61  GLTLLDTMQSETGVEAIRADVRTPHEEAVLNNIQFMESVHAKSYSSIFSTLNTKKEIEEI  120

Query: 125  FEWTNNNEFLQEKARIINDIYANGNALQKKVASTYLETFLFYSGFFTPLYYLGNNKLANV  184
            FEWTNNNEFLQEKARIINDIYANG+ALQKKVASTYLETFLEYSGEFTPLYYLGNNKLANV
Sbjct: 121  FEWTNNNEFLQEKARIINDIYANGDALQKKVASTYLETFLEYSGEFTPLYYLGNNKLANV  180

Query: 185  AEIIKLIIRDESVHGTYIGYKFQLGFNELPEDEQENFRDWMYDLLYQLYENEEKYTKTLY  244
            AEIIKLIIRDESVHGTYIGYKFQLGFNELPEDEQENFRDWMYDLLYQLYENEEKYTKTLY
Sbjct: 181  AEIIKLIIRDESVHGTYIGYKFQLGFNELPEDEQENFRDWMYDLLYQLYENEEKYTKTLY  240

Query: 245  DGVGWTEEVMTFLRYNANKALMNLGQDPLEPDTANDVNPIVMNGISTGTSNHDFFSQVGN  304
            DGVGWTEEVMTFLRYNANKALMELGQDPLFPDTANDVNPIVMNGISTGTSNHDFFSQVGN
Sbjct: 241  DGVGWTEEVMTFLRYNANKALMNLGQDPLFPDTANDVNPIVMNGISTGTSNHDFFSQVGN  300

Query: 305  GYLLGSVEAMHDDDYNYGL                                          323
            GYLLGSVEAM DDDYNYGL
Sbjct: 301  GYLLGSVEAMSDDDYNYGL                                          319
```

-continued bacterial outside ---Certainty = 0.0000 (Not Clear) <succ>
bacterial cytoplasm ---Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1460

A DNA sequence (GBSx1546) was identified in *S. agalactiae* <SEQ ID 4487> which encodes the amino acid sequence <SEQ ID 4488>. Analysis of this protein sequence reveals the following:

Possible site: 35
>>> Seems to have no N-terminal signal sequence
INTEGRAL    Likelihood = –14.38    Transmembrane 176-192 (168-201)
INTEGRAL    Likelihood = –4.57     Transmembrane 25-41 (22-42)
INTEGRAL    Likelihood = –3.88     Transmembrane 94-110 (94-112)
INTEGRAL    Likelihood = –1.49     Transmembrane 70-86 (70-86)
INTEGRAL    Likelihood = –1.01     Transmembrane 128-144 (128-144)
----- Final Results -----
  bacterial membrane --- Certainty = 0.6753 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 9751> which encodes amino acid sequence <SEQ ID 9752> was also identified.

The protein has homology with the following sequences in the GENPEPT database.

```
>GP:CAB15077 GB:Z99119 similar to hypothetical proteins [Bacillus subtilis]
Identities = 55/184 (29%), Positives = 98/184 (52%), Gaps = 4/184 (2%)
Query:   16 MSKNNNTTCLIETAIFAALAMALSMIP----DFASWFTPSFGAIPLILFALRRGTKYGLF    71
             M+++      LIE AI  A A+ L ++        + S   IP+ L + R G K GL
Sbjct:    1 MNQSKQLVRLIEIAIMTAAAVILDIVSGMFLSMPQGGSVSIMMIPIFLISFRWGVKAGLT    60

Query:   72 AGLIWGLLHFVLSKVYYLSLSQVFIEYILAFISMGLAGVFSAKFKDALSSSSKTKALSLA   131
              GL+ GL+   + ++     Q+ ++YI+AF ++G++G F++   + A  S +K K +
Sbjct:   61 TGLLTGLVQIAIGNLFAQHPVQLLLDYIVAFAAIGISGCFASSVRKAAVSKTKGKLIVSV   120

Query:  132 LSGAILATLVRYVWHYIAGVIFWASYAPKGMSATLYSLSVNGTAGLLTLFFVVISIIILV   191
             +S   +L+RY  H I+G +F+ S+APKG      +YSL+ N T   +     I + +L
Sbjct:  121 VSAVFIGSLLRYAAHVISGAVFFGSFAPKGTPVWIYSLTYNATYMVPSFIICAIVLCLLF   180

Query:  192 ISYP                                                         195
             ++ P
Sbjct:  181 MTAP                                                         184
```

A related DNA sequence was identified in *S. pyogenes* <SEQ ID 4489> which encodes the amino acid sequence <SEQ ID 4490>. Analysis of this protein sequence reveals the following:

Possible site: 20
>>> Seems to have a cleavable N-term signal seq.
INTEGRAL    Likelihood = –9.34    Transmembrane 162-178 (156-183)
INTEGRAL    Likelihood = –9.34    Transmembrane 110-126 (107-130)
INTEGRAL    Likelihood = –1.22    Transmembrane 55-71 (55-71)
----- Final Results -----
  bacterial membrane --- Certainty = 0.4736 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the databases:

```
>GP:CAB15077 GB:Z99119 similar to hypothetical proteins [Bacillus subtilis]
Identities = 55/189 (29%), Positives = 100/189 (52%), Gaps = 10/189 (5%)
Query:    1 MSPNTNVKYLIEAAIFAALAMTLSFIPDFAGWF--SPSYGAIALV-----IFSLRRGLKY   53
             M+ +  + LIE AI  A A+ L +   +G F  P   G+++++    + S R G+K
Sbjct:    1 MNQSKQLVRLIEIAIMTAAAVILDIV---SGMFLSMPQGGSVSIMMIPIFLISFRWGVKA   57

Query:   54 GMLAGLIWGLLHFVLGKVYYLSMSQVFIEYILAFTSMGLAGSFSDSLIKTLRRQQTFFAV  113
             G+  GL+ GL+   +G ++     Q+ ++YI+AF ++G++G F+ S+ K     +    +
```

```
-continued
Sbjct:  58  GLTTGLLTGLVQIAIGNLFAQHPVQLLLDYIVAFAAIGISGCFASSVRKAAVSKTKGKLI  117

Query: 114  FLAIMASLLAVTVRYLWHFLAGIIFWGSYAPKGMSAVWYSFSVNGTAGVLTFLITCLALM  173
              + A +     +RY H ++G +F+GS+APKG      YS + N T  V +F+I  + L
Sbjct: 118  VSVVSAVFIGSLLRYAAHVISGAVFFGSFAPKGTPVWIYSLTYNATYMVPSFIICAIVLC  177

Query: 174  IALPIHPQL                                                    182
             +       P+L
Sbjct: 178  LLFMTAPRL                                                    186
```

An alignment of the GAS and GBS proteins is shown below.

```
Identities = 116/186 (62%), Positives = 138/186 (73%)
Query:  16  MSKNNNTTCLIETAIFAALAMALSMIPDFASWFTPSFGAIPLILFALERGTKYGLFAGLI   75
            MS N N    LIE AIFAALAM LS IPDFA WF+PS+GAI L++F+LRRG KYG+ AGLI
Sbjct:   1  MSPNTNVKYLIEAAIFAALAMTLSFIPDFAGWFSPSYGAIALVIFSLRRGLKYGMLAGLI   60

Query:  76  WGLLHFVLSKVYYLSLSQVFIEYILAFISMGLAGVFSAKFKDALSSSSKTKALSLALSGA  135
            WGLLHFVL  KVYYLS+SQVFIEYILAF SMGLAG FS       L         A+ LA+  +
Sbjct:  61  WGLLHFVLGKVYYLSMSQVFIEYILAFTSMGLAGSFSDSLIKTLRRQQTFFAVFLAIMAS  120

Query: 136  ILATLVRYVWHYIAGVIFWASYAPKGMSATLYSLSVNGTAGLLTLFFVVISIIILVISYP  195
             +LA  VRY+WH++AG+IFW SYAPKGMSA  YS SVNGTAG+LT    ++++I +  +P
Sbjct: 121  LLAVTVRYLWHFLAGIIFWGSYAPKGMSAVWYSFSVNGTAGVLTFLITCLALMIALPIHP  180

Query: 196  SFFLPK                                                       201
              F PK
Sbjct: 181  QLFDPK                                                       186
```

Based on this analysis, it was predicted that these proteins and their epitopes could be useful antigens for vaccines or diagnostics.

Example 1461

A DNA sequence (GBSx1547) was identified in *S. agalactiae* <SEQ ID 4491> which encodes the amino acid sequence <SEQ ID 4492>. Analysis of this protein sequence reveals the following:

---
Possible site: 34
>>> Seems to have no N-terminal signal sequence
INTEGRAL   Likelihood = −7.43   Transmembrane 206-222 (199-223)
INTEGRAL   Likelihood = −6.64   Transmembrane 24-40 (19-42)
INTEGRAL   Likelihood = −6.58   Transmembrane 61-77 (51-78)
INTEGRAL   Likelihood = −6.58   Transmembrane 134-150 (132-154)
INTEGRAL   Likelihood = −4.62   Transmembrane 226-242 (224-245)
INTEGRAL   Likelihood = −3.72   Transmembrane 107-123 (106-125)
----- Final Results -----
   bacterial membrane --- Certainty = 0.3972 (Affirmative) <succ>
   bacterial outside --- Certainty = 0.0000 (Not Clear) <succ>
   bacterial cytoplasm --- Certainty = 0.0000 (Not Clear) <succ>
---

A related GBS nucleic acid sequence <SEQ ID 9749> which encodes amino acid sequence <SEQ ID 9750> was also identified.

The protein has no significant homology with any sequences in the GENPEPT database.

A related DNA sequence was identified in *S. pyogenes* <SEQ ID 4493> which encodes the amino acid sequence <SEQ ID 4494>. Analysis of this protein sequence reveals the following:

---
Possible site: 23
>>> Seems to have no N-terminal signal sequence
INTEGRAL   Likelihood = −10.46   Transmembrane 134-150 (131-159)
INTEGRAL   Likelihood = −7.59    Transmembrane 107-123 (103-128)
INTEGRAL   Likelihood = −7.48    Transmembrane 225-241 (213-248)
INTEGRAL   Likelihood = −7.22    Transmembrane 205-221 (199-224)
INTEGRAL   Likelihood = −3.56    Transmembrane 50-66 (50-73)
INTEGRAL   Likelihood = −1.28    Transmembrane 16-32 (16-33)
----- Final Results -----
   bacterial membrane --- Certainty = 0.5182 (Affirmative) <succ>
   bacterial outside --- Certainty = 0.0000 (Not Clear) <succ>
   bacterial cytoplasm --- Certainty = 0.0000 (Not Clear) <succ>
---

The protein has no significant homology with any sequences in the GENPEPT database.

An alignment of the GAS and GBS proteins is shown below.

```
Identities = 82/253 (32%), Positives = 149/253 (58%), Gaps = 5/253 (1%)
Query:   6  IKQSDTTFVRIIKSLLIGGFIGAILGSVGALFIIF--GQDKYLSEI--NIVQYFLWVSRI   61
            +K+    +F+R++K  L+       G I+G +   F+ +  G+   +L+  +   +++   + ++R+
Sbjct:   1  MKKKKNSFLRLLKMSLLSSLAGGIIGGMVGAFLGYHGGRLDHLTFLKDDVINLIILLNRL   60

Query:  62  VVIITALFSLIYLYQIQKYQKVFFNVDESQ-SEEIYRQINLRHSYGMTFVSISIVLSIVN  120
            VV+        S ++L Q++K    V+   ++E    SE    YRQ+N +H+Y M ++++ +LS+  N
Sbjct:  61  VVVTDLTLSFVFLTQLKKETAVYNTIEEDDISENGYRQLNKKHAYTMLLIAVASILSMCN  120

Query: 121  TLFNYKLNIFDDSVTLVIPIYDLSLLFVLLGLHIYFLKVYRNIRGIKMTVAPTLKELKNN  180
              L    L    L IP+ D+  LL +++         +K Y  IRG  +    P LKELK+N
```

```
                              -continued
Sbjct: 121  VLLGLTLTNDSQHAMLAIPLLDILLLLMVIPFQALAMKRYNAIRGTDVPYFPNLKELKHN  180

Query: 181  VLQLDEAELESNYKMCFDIVMNLSGFIFPTIYFVLFFISFVFQKVEIVAIIITTSIHIYI  240
            ++ LDEAEL++ +K  F+ V++L+G I P++Y +LFF+     +VE+ AI++   I +Y+
Sbjct: 181  IMALDEAELQAYHKTSFESVLSLNGVIIPSLYVILFFVYLFTGQVELTAILVLVLIQLYL  240

Query: 241  LIKSLKAARHFYR                                                253
            L+KS    R FYR
Sbjct: 241  LVKSATMTRQFYR                                                253
```

Based on this analysis, it was predicted that these proteins and their epitopes could be useful antigens for vaccines or diagnostics.

Example 1462

A DNA sequence (GBSx1548) was identified in S. agalactiae <SEQ ID 4495> which encodes the amino acid sequence <SEQ ID 4496>. Analysis of this protein sequence reveals the following:

---

Possible site: 26
>>> Seems to have no N-terminal signal sequence
----- Final Results -----
   bacterial cytoplasm --- Certainty = 0.2059 (Affirmative) <succ>
   bacterial membrane --- Certainty = 0.0000 (Not Clear) <succ>
   bacterial outside --- Certainty = 0.0000 (Not Clear) <succ>

---

The protein has homology with the following sequences in the GENPEPT database.

```
>GP:AAC76650 GB:AE000440 UDP-D-glucose:(galactosyl)lipopolysaccharide
glucosyltransferase [Escherichia coli K12]
Identities = 70/256 (27%), Positives = 121/256 (46%), Gaps = 14/256 (5%)
Query:   1  MNLLFSIDDMYVDHFKVMLYSLVRQTKNRKLEIYVLQKT----LLKRHTELIQYTQNLEV   56
            +N+ + +D  Y+D    V + S+V    ++  L+ Y++           ++   +L + Q
Sbjct:  28  LNVAYGVDANYLDGVGVSITSIVLNNRHINLDFYIIADVYNDGFFQKIAKLAEQNQLRIT   87

Query:  57  GYHPIIVGTEVFAQAPTTDRYPDTIYYRLLAHKFLPETLDRILYLDADMLCLNDFSSLYD  116
            Y       + T+      P T  +    +Y+RL A + L   TLDR+LYLDAD++C  D S L
Sbjct:  88  LYR---INTDKLQCLPCTQVWSRAMYFRLFAFQLLGLTLDRLLYLDADVVCKGDISQLLH  144

Query: 117  MELGDQLYAAASHNTDGKFLDYVNKLRLKNVELESSYFNTGVLLMNLPAIRKVVHQQTIL  176
            + L     A A+   D + +        RL + EL    YFN+GV+ ++L           + L
Sbjct: 145  LGLNG---AVAAVVKDVEPMQEKAVSRLSDPELLGQYFNSGVVYLDLKKWADAKLTEKAL  201

Query: 177  DYIMQNRGRLILPDQDILNGLYANLVKPIPDEIYNYDARYSLIYQLKSRNEWDLEWVINH  236
            +M          PDQD++N L   +    +P E   Y+    Y++  +LK +   + + +I
Sbjct: 202  SILMSKDNVYKYPDQDVMNVLLKGMTLFLPRE---YNTIYTIKSELKDKTHQNYKKLITE  258

Query: 237  -TVFLHFAGRDKPWKK                                             251
             T+ +H+  G  KPW K
Sbjct: 259  STLLIHYTGATKPWHK                                             274
```

---

Possible site: 57
>>> Seems to have no N-terminal signal sequence
----- Final Results -----
   bacterial cytoplasm --- Certainty = 0.5172 (Affirmative) <succ>
   bacterial membrane --- Certainty = 0.0000 (Not Clear) <succ>
   bacterial outside --- Certainty = 0.0000 (Not Clear) <succ>

---

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1463

A DNA sequence (GBSx1549) was identified in S. agalactiae <SEQ ID 4497> which encodes the amino acid sequence <SEQ ID 4498>. Analysis of this protein sequence reveals the following:

No corresponding DNA sequence was identified in S. pyogenes.

Based on this analysis, it was predicted that this protein and its epitopes, could be useful antigens for vaccines or diagnostics.

Example 1464

A DNA sequence (GBSx1550) was identified in S. agalactiae <SEQ ID 4499> which encodes the amino acid sequence <SEQ ID 4500>. Analysis of this protein sequence reveals the following:

---

Possible site: 20
>>> Seems to have no N-terminal signal sequence
----- Final Results -----
   bacterial cytoplasm --- Certainty = 0.1406 (Affirmative) <succ>
   bacterial membrane --- Certainty = 0.0000 (Not Clear) <succ>
   bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1465

A DNA sequence (GBSx1551) was identified in *S. agalactiae* <SEQ ID 4501> which encodes the amino acid sequence <SEQ ID 4502>. Analysis of this protein sequence reveals the following:

```
Possible site: 54
>>> Seems to have an uncleavable N-term signal seg
INTEGRAL    Likelihood = -10.72   Transmembrane 7-23 (1-28)
INTEGRAL    Likelihood = -4.30    Transmembrane 222-238 (216-238)
INTEGRAL    Likelihood = -3.66    Transmembrane 151-167 (140-170)
INTEGRAL    Likelihood = -3.50    Transmembrane 35-51 (34-58)
INTEGRAL    Likelihood = -3.35    Transmembrane 71-87 (69-88)
INTEGRAL    Likelihood = -3.29    Transmembrane 113-129 (113-132)
INTEGRAL    Likelihood = -2.81    Transmembrane 170-186 (168-190)
INTEGRAL    Likelihood = -2.71    Transmembrane 198-214 (197-217)
----- Final Results -----
    bacterial membrane --- Certainty = 0.5288 (Affirmative) <succ>
      bacterial outside --- Certainty = 0.0000 (Not Clear) <succ>
       bacterial cytoplasm --- Certainty = 0.0000 (Not Clear) <succ>
```

The protein has homology with the following sequences in the GENPEPT database.

```
>GP:BAB07774 GB:AP001520 unknown conserved protein [Bacillus halodurans]
Identities = 84/242 (34%), Positives = 147/242 (60%), Gaps = 16/242 (6%)
Query:   1 MVGLGTVINVILIIVGGFVGLFLKNFLKESLQKSLMQAMGVAVLFISISGVLEKMMLVEK    60
           MV +GTV+N   I++    +GL +KN + E ++ +LMQA+G+A++ + +     KM L +
Sbjct:   1 MVLIGTVVNGAAIVIAALIGLLVKN-IPERVKTTLMQAIGLAIVLLGV-----KMGLQTE    54

Query:  61 SHLISNHTNMMIITLALGTVLGELLSLDSYIDKFGNYLKQKTGSGNDIKFVEAFVTSTCT   120
              LI      +I +L +G V+GE+++L+  +D   G +++ K G     D       AFVT+T
Sbjct:  55 QFLI------VICSLVIGGVIGEMINLEKRLDHLGRWIESKVGGKKDGSIATAFVTTTLI   108

Query: 121 VCIGAMAVVGSIQDGIAADHSILFAKGMLDMIIIAIMTVSLGKGALFSALPVALLQGSLT   180
           +GAMAV+G++   G+   DHS+L  K +LD   +  +T +LG G LFSA+PV L QGS+
Sbjct: 109 YVVGAMAVLGALDSGLRGDHSVLLTKALLDGFLAILFTSTLGIGVLFSAIPVVLYQGSIA   168

Query: 181 IVAF----FMGSLLNPSSLDYLNLVGNMLIFCVGVNLLFNLNIKVINMLPAIILAILWGS   236
           + A      ++ + L  S +    ++ G ++I  +G+NLL  +NI+V N+LP++++ +  +
Sbjct: 169 LFASQIDQYVPTALMDSFITEMSATGGVMIVAIGLNLLNVVNIRVANLLPSLVIVAVLVT   228

Query: 237 FI                                                            238
           F+
Sbjct: 229 FV                                                            230
```

No corresponding DNA sequence was identified in *S. pyogenes*.

Example 1466

Based on this analysis, it was predicted that this protein and its epitopes, could be useful antigens for vaccines or diagnostics.

A DNA sequence (GBSx1552) was identified in *S. agalactiae* <SEQ ID 4503> which encodes the amino acid sequence <SEQ ID 4504>. This protein is predicted to be alanyl-tRNA synthetase (alaS). Analysis of this protein sequence reveals the following:

```
Possible site: 49
>>> Seems to have no N-terminal signal sequence
INTEGRAL    Likelihood = -4.41    Transmembrane 805-821 (804-822)
----- Final Results -----
    bacterial membrane --- Certainty = 0.2763 (Affirmative) <succ>
      bacterial outside --- Certainty = 0.0000 (Not Clear) <succ>
       bacterial cytoplasm --- Certainty = 0.0000 (Not Clear) <succ>
```

The protein has homology with the following sequences in the GENPEPT database.

```
>GP:BAB04986 GB:AP001511 alanyl-tRNA synthetase [Bacillus halodurans]
Identities = 482/885 (54%), Positives = 618/885 (69%), Gaps = 27/885 (3%)
Query:   1 MKELSSAQIRQMWLDFWKSKGHSVEPSANLVPVNDPTLLWINSGVATLKKYEDGSVIPEN    60
           MK L+SAQ+RQM+LDF+K KGH VEPSA+LVP +DP+LLWINSGVATLKKYFDG VIPEN
Sbjct:   1 MKYLTSAQVRQMFLDFFKEKGHDVEPSASLVPHDDPSLLWINSGVATLKKYFDGRVIPEN    60

Query:  61 PRITNAQKSIRTNDIENVGKTAREHTMFEMLGNFSIGDYFRDEAIEWGFELLTSPEWFDF   120
           PRITNAQKSIRTNDIENVGKTARHHT FEMLGNFSIGDYF++EAIEW +E LTS +W  F
Sbjct:  61 PRITNAQKSIRTNDIENVGKTARHHTFFEMLGNFSIGDYFKEEAIEWAWEFLTSEKWIGF   120

Query: 121 PKDKLYMTYYPDDKDSYNRWIA-CGVEPSHLVPIEDNFWEIGAGPSGPDTEIFFDRGEDF   179
              K+KL +T +P+D ++Y+ W    G+    ++ +E NFW+IG GPSGP+TEIF+DRG ++
Sbjct: 121 DKEKLSVTVHPEDDEAYSYWKEKIGIPEERIIRLEGNFWDIGEGPSGPNTEIFYDRGPEY   180

Query: 180 -----DPENIGLRLLAEDIENDRYIEIWNIVLSQFNADPAVPRSEYKELPNKNIDTGAGL   234
                DPE    L    ENDRY+E+WN+V SQFN +P        Y  LP KNIDTG GL
```

```
                      -continued
Sbjct: 181  GDQPNDPE------LYPGGENDRYLEVWNLVFSQFNHNPD---GSYTPLPKKNIDTGMGL  231

Query: 235  ERLAAVMQGAKTNFETDLFMPIIREVEKLSGKTYDPDGD-NMSFKVIADHIRALSFAIGD  293
            ER+ +V+Q  TNFETDLFMPIIR EK+SG Y   + ++SFKVIADHIR ++FAIGD
Sbjct: 232  ERMVSVIQNVPTNFETDLFMPIIRATEKISGTEYGSHHEADVSFKVIADHIRTVTFAIGD  291

Query: 294  GALPGNEGRGYVLRRLLRRAVMHGRRLGINETFLYKLVPTVGQIMESYYPEVLEKRDFIE  353
            GALP NEGRGYVLRRLLRRAV + +++GI+  F+Y+LVP VG IM +YPEV EK  FI+
Sbjct: 292  GALPSNEGRGYVLRRLLRRAVRYAKQIGIDRPFMYELVPVVGDIMVDFYPEVKEKAAFIQ  351

Query: 354  KIVKREEETFARTIDAGSGHLDSLLAQLKAEGKDTLEGKDIFKLYDTYGFPVELTEELAE  413
            K+VK EEE F  T++ G    L+ ++ + K+EG  T+ G D+F+LYDTYGFPV+ LTEE  E
Sbjct: 352  KVVKTEEERFHETLNEGLSILEKVIDKAKSEGASTISGSDVFRLYDTYGFPVDLTEEYVE  411

Query: 414  DAGYKIDHEGFKSAMKEQQDRARAAVVKGGSMGMQNETLAGIVEESRF-EYDTYSLESSL  472
            + G  ++D +GF++ M+ Q++RAR A  + GSM +Q+E L  I  +S F    Y     S E+++
Sbjct: 412  EQGLQVDLDGFEAEMERQRERARTARQQAGSMQVQDEVLGQITVDSTFIGYKQLSTETTI  471

Query: 473  SVIIADNERTEAVSEGQ-ALLVFAQTPFYAEMGGQVADHGVIKNDKGDTVAEVVDVQKAP  531
              I+ D    + V GQ A ++  +TPFYAE GGQVAD G+I+    G  V  V DVQKAP
Sbjct: 472  ETIVLDKTVADYVGAGQEAKVILKETPFYAESGGQVADKGIIRGANGFAV--VSDVQKAP  529

Query: 532  NGQPLHTVNVL-ASLSVGTNYTLEINKERRLAVEKNHTATHLLHAALHNVIGEHATQAGS  590
            NGQ LHTV V  +L V      + +  R  + KNHTATHLLH AL +V+GEH  QAGS
Sbjct: 530  NGQHLHTVIVKEGTLQVNDQVQAIVEETERSGIVKNHTATHLLHRALKDVLGEHVNQAGS  589

Query: 591  LNEEEFLRFDFTHFEAVSNEELRHIEQEVNEQIWNDLTITTTETDVETAKEMGAMALFGE  650
            L  EE LRFDF+HF  V++EE   IE+ VNE+IW + +   ++ AK +GAMALFGE
Sbjct: 590  LVSEERLRFDFSHFGQVTDEEKEKIERIVNEKIWQAIKVNISTKTLDEAKAIGAMALFGE  649

Query: 651  KYGKVVRVVQIGNYSVELCGGTHLNNSSEIGLFKIVKEEGIGSGTRRIIAVTGRQAFEAY  710
            KYG +VRVV++G+YS+ELCGG H+ N+SEIGLFKIV E GIG+G RRI AVTG++AF
Sbjct: 650  KYGDIVRVVEVGDYSIELCGGCHVTNTSEIGLFKIVSESGIGAGVRRIEAVTGKEAFLFM  709

Query: 711  RNQEDALKEIAATVKAPQLKDAAAKVQALSDSLRDLQKENVELKEKAAAAAAGDVFKDIQ  770
             Q D LKE AATVKA  +KD  +V+AL   +R+LQ+EN  L K    AG +  ++Q
Sbjct: 710  AKQLDLLKETAATVKAKNVKDVPVRVEALQQQIRELQRENESLNAKLGNMEAGSLVNEVQ  769

Query: 771  EAKGVRFIASQVDVADAGALRTFADNWKQKDYSDVLVLVAAIGEKVNVLVASKTKDV---  827
            + +GV +A +  AD  LR+  D  KQ+  S V+VL  A    KVN+ VA   TKD+
Sbjct: 770  KIEGVPVLAKAISGADMDGLRSIVDKLKQEIPSVVIVLGTASEGKVNI-VAGVTKDLINK  828

Query: 828  --HAGNMIKGLAPIVAGRGGGKPDMAMAGGSDASKIAELLAAVAE             870
              HAG ++K +A   G GGG+PDMA AGG   K+ + L+ V E
Sbjct: 829  GYHAGKLVKEVATRCGGGGGRPDMAQAGGKQPEKLQDALSFVYE             873
```

A related DNA sequence was identified in *S. pyogenes* <SEQ ID 4505> which encodes the amino acid sequence <SEQ ID 4506>. Analysis of this protein sequence reveals the following:

Possible site: 21
>>> Seems to have no N-terminal signal sequence
INTEGRAL    Likelihood = −4.41    Transmembrane 805-821 (804-822)
----- Final Results -----
    bacterial membrane --- Certainty = 0.2763 (Affirmative) <succ>
    bacterial outside --- Certainty = 0.0000 (Not Clear) <succ>
    bacterial cytoplasm --- Certainty = 0.0000 (Not Clear) <succ>

An alignment of the GAS and GBS proteins is shown below.

```
Identities = 862/870 (99%), Positives = 864/870 (99%)
Query:   1  MKELSSAQIRQMWLDFWKSKGHSVEPSANLVPVNDPTLLWINSGVATLKKYFDGSVIPEN   60
            MKELSSAQIRQMWLDFWKSKGH VEPSANLVPVNDPTLLWINSGVATLKKYFDGSVIPEN
Sbjct:   1  MKELSSAQIRQMWLDFWKSKGHCVEPSANLVPVNDPTLLWINSGVATLKKYFDGSVIPEN   60

Query:  61  PRITNAQKSIRTNDIENVGKTARHHTMFEMLGNFSIGDYFRDEAIEWGFELLTSPEWFDF  120
            PRITNAQKSIRTNDIENVGKTARHHTMFEMLGNFSIGDYFRDEAIEWGFELLTSP+WFDF
Sbjct:  61  PRITNAQKSIRTNDIENVGKTARHHTMFEMLGNFSIGDYFRDEAIEWGFELLTSPDWFDF  120

Query: 121  PKDKLYMTYYPDDKDSYNRWIACGVEPSHLVPIEDNFWEIGAGPSGPDTEIFFDRGEDFD  180
            PKDKLYMTYYPDDKDSYNRWIACGVEPSHLVPIEDNFWEIGAGPSGPDTEIFFDRGEDFD
Sbjct: 121  PKDKLYMTYYPDDKDSYNRWIACGVEPSHLVPIEDNFWEIGAGPSGPDTEIFFDRGEDFD  180

Query: 181  PENIGLRLLAEDIENDRYIEIWNIVLSQFNADPAVPRSEYKELPNKNIDTGAGLERLAAV  240
            PENIGLRLLAEDIENDRYIEIWNIVLSQFNADPAVPRSEYKELPNKNIDTGAGLERLAAV
Sbjct: 181  PENIGLRLLAEDIENDRYIEIWNIVLSQFNADPAVPRSEYKELPNKNIDTGAGLERLAAV  240
```

```
Query:  241  MQGAKTNFETDLFMPIIREVEKLSGKTYDPDGDNMSFKVIADHIRALSFAIGDGALPGNE     300
             MQGAKTNFETDLFMPIIREVEKLSGKTYDPDGDNMSFKVIADHIRALSFAIGDGALPGNE
Sbjct:  241  MQGAKTNFETDLFMPIIREVEKLSGKTYDPDGDNMSFKVIADHIRALSFAIGDGALPGNE     300

Query:  301  GRGYVLRRLLRRAVMHGRRLGINETFLYKLVPTVGQIMESYYPEVLEKRDFIEKIVKREE     360
             GRGYVLRRLLRRAVMHGRRLGINETFLYKLVPTVGQIMESYYPEVLEKRDFIEKIVKREE
Sbjct:  301  GRGYVLRRLLRRAVMHGRRLGINETFLYKLVPTVGQIMESYYPEVLEKRDFIEKIVKREE     360

Query:  361  ETFARTIDAGSGHLDSLLAQLKAEGKDTLEGKDIFKLYDTYGFPVELTEELAEDAGYKID     420
             ETFARTIDAGSGHLDSLLAQLKAEGKDTLEGKDIFKLYDTYGFPVELTEELAEDAGYKID
Sbjct:  361  ETFARTIDAGSGHLDSLLAQLKAEGKDTLEGKDIFKLYDTYGFPVELTEELAEDAGYKID     420

Query:  421  HEGEKSAMKEQQDRARAAVVKGGSMGMQNETLAGIVEESRFEYDTYSLESSLSVIIADNE     480
             HEG KSAMKEQQDRARAAVVKGGSMGMQNETLAGIVEESRFEYDTYSLESSLSVIIADNE
Sbjct:  421  HEGFKSAMKEQQDRARAAVVKGGSMGMQNETLAGIVEESRFEYDTYSLESSLSVIIADNE     480

Query:  481  RTEAVSEGQALLVFAQTPFYAEMGGQVADHGVIKNDKGDTVAEVVDVQKAPNGQPLHTVN     540
             RTEAVSEGQALLVFAQTPFYAEMGGQVAD G IKNDKGDTVAEVVDVQKAPNGQPLHTVN
Sbjct:  481  RTEAVSEGQALLVFAQTPFYAEMGGQVADTGRIKNDKGDTVAEVVDVQKAPNGQPLHTVN     540

Query:  541  VLASLSVGTNYTLEINKERRLAVEKNHTATHLLHAALHNVIGEHATQAGSLNEEEFLRED     600
             VLASLSVGTNYTLEINKERRLAVEKNHTATHLLHAALHNVIGEHATQAGSLNEEEFLRED
Sbjct:  541  VLASLSVGTNYTLEINKERRLAVEKNHTATHLLHAALHNVIGEHATQAGSLNEEEFLRED     600

Query:  601  FTHFEAVSNEELRHIEQEVNEQIWNDLTITTTETDVETAKEMGAMALFGEKYGKVVRVVQ     660
             FTHFEAVSNEELRHIEQEVNEQIWN LTITTTETDVETAKEMGAMALFGEKYGKVVRVVQ
Sbjct:  601  FTHFEAVSNEELRHIEQEVNEQIWNALTITTTETDVETAKEMGAMALFGEKYGKVVRVVQ     660

Query:  661  IGNYSVELCGGTHLNNSSEIGLFKIVKEEGIGSGTRRIIAVTGRQAFEAYRNQEDALKEI     720
             IGNYSVELCGGTHLNNSSEIGLFKIVKEEGIGSGTRRIIAVTGRQAFEAYRNQEDALKEI
Sbjct:  661  IGNYSVELCGGTHLNNSSEIGLFKIVKEEGIGSGTRRIIAVTGRQAFEAYRNQEDALKEI     720

Query:  721  AATVKAPQLKDAAAKVQALSDSLRDLQKENVELKEKAAAAAAGDVFKDIQEAKGVRFIAS     780
             AATVKAPQLKDAAAKVQALSDSLRDLQKEN ELKEKAAAAAAGDVFKD+QEAKGVRFIAS
Sbjct:  721  AATVKAPQLKDAAAKVQALSDSLRDLQKENAELKEKAAAAAAGDVEKDVQEAKGVRFIAS     780

Query:  781  QVDVADAGALRTFADNWKQKDYSDVLVLVAAIGEKVNVLVASKTKDVHAGNMIKGLAPIV     840
             QVDVADAGALRTFADNWKQKDYSDVLVLVAAIGEKVNVLVASKTKDVHAGNMIK LAPIV
Sbjct:  781  QVDVADAGALRTFADNWKQKDYSDVLVLVAAIGEKVNVLVASKTKDVHAGNMIKELAPIV     840

Query:  841  AGRGGGKPDMAMAGGSDASKIAELLAAVAE                                 870
             AGRGGGKPDMAMAGGSDASKIAELLAAVAE
Sbjct:  841  AGRGGGKPDMAMAGGSDASKIAELLAAVAE                                 870
```

Based on this analysis, it was predicted that these proteins and their epitopes could be useful antigens for vaccines or diagnostics.

Example 1467

A DNA sequence (GBSx1553) was identified in *S. agalactiae* <SEQ ID 4507> which encodes the amino acid sequence <SEQ ID 4508>. Analysis of this protein sequence reveals the following:

Possible site: 56
>>> Seems to have no N-terminal signal sequence
----- Final Results -----
  bacterial cytoplasm --- Certainty = 0.2974 (Affirmative) <succ>
  bacterial membrane  --- Certainty = 0.0000 (Not Clear) <succ>
  bacterial outside   --- Certainty = 0.0000 (Not Clear) <succ>

A related GBS nucleic acid sequence <SEQ ID 9747> which encodes amino acid sequence <SEQ ID 9748> was also identified.

The protein has homology with the following sequences in the GENPEPT database.

```
>GP:CAB15920 GB:Z99123 yxjI [Bacillus subtilis]
Identities = 42/144 (29%), Positives = 73/144 (50%), Gaps = 2/144 (1%)
Query:   17  IKEKMFSLGGKFTITDLTGLPCYHVEGSLFPLPKTFKVFDEEEHLISQIEKKVLSFLPKF     76
             +K+KMFS    F  D    + VEG  F L + ++ D     +  IE+K++S LP++
Sbjct:    6  MKQKMFSFKDAFHIYDRDEQETFKVEGRFFSLGDSLQMTDSSGKTLVSIEQKLMSLLPRY     65

Query:   77  NVTLANGNHFTIKKDFSFLKPHYTIEDLDMEVKGNFWDMDFQLLKDNQVIANISQQWFRM    136
             +++        + K  +F KP + I  L+ E+ G+ W  +FQL   V  ++S++W
Sbjct:   66  EISIGGKTVCEVTKKVTFSKPKFVISGLNWEIDGDLWRDEFQLTDGENVRMSVSKEWLSW    125

Query:  137  TSTYQVEVYSETYNDLTISLVIAI                                       160
             +Y  +++   E    D+ I     IAI
Sbjct:  126  GDSYHLQIAYE--EDVLICTAIAI                                       147
```

No corresponding DNA sequence was identified in *S. pyogenes*.

Based on this analysis, it was predicted that these proteins and their epitopes could be useful antigens for vaccines or diagnostics.

Example 1468

A DNA sequence (GBSx1554) was identified in *S. agalactiae* <SEQ ID 4509> which encodes the amino acid sequence <SEQ ID 4510>. Analysis of this protein sequence reveals the following:

```
Possible site: 30
>>> Seems to have no N-terminal signal sequence
----- Final Results -----
    bacterial cytoplasm --- Certainty = 0.3833 (Affirmative) <succ>
    bacterial membrane --- Certainty = 0.0000 (Not Clear) <succ>
      bacterial outside --- Certainty = 0.0000 (Not Clear) <succ>
```

The protein has homology with the following sequences in the GENPEPT database.

```
>GP:BAA36674 GB:AB016282 ORF17 [bacteriophage phi-105]
Identities = 45/133 (33%), Positives = 74/133 (54%), Gaps = 5/133 (3%)
Query:    2 KYTYLALFEVDKENGGYNISFPDFHGAFSEADSLNEAIFNAREVLEIYTIMFEDEGKEFP   61
            +Y Y ALF+ D +  G  ++FPD  G  +  +S  EA+  A+E + ++   FE +G   P
Sbjct:    5 RYIYPALFDYDDD--GITVTFPDLPGCITFGNSGGEALTMAKEAMALHLYGFEQDGDIIP   62

Query:   62 KASSFKALASNLASDEDVIQAISVDTELVRERERSKIVNKTVTLPSWLVEVGKENKVNFS  121
            +A+  K +    A +  + I       R   +   V KT+T+P W+ ++ KE+KVN+S
Sbjct:   63 EATPSKEIK---AEESQSVVLIETWMPPFRHDMENAAVKKTLTIPRWMDDIAKEHKVNYS  119

Query:  122 QLLQKAIREELQV                                                134
            QLLQ+AI+E L +
Sbjct:  120 QLLQEAIKEHLGI                                                132
```

No corresponding DNA sequence was identified in *S. pyogenes*.

Based on this analysis, it was predicted that this protein and its epitopes, could be useful antigens for vaccines or diagnostics.

Example 1469

A DNA sequence (GBSx1555) was identified in *S. agalactiae* <SEQ ID 4511> which encodes the amino acid sequence <SEQ ID 4512>. Analysis of this protein sequence reveals the following:

```
Possible site: 26
>>> Seems to have no N-terminal signal sequence
----- Final Results -----
    bacterial cytoplasm --- Certainty = 0.1484 (Affirmative) <succ>
    bacterial membrane --- Certainty = 0.0000 (Not Clear) <succ>
      bacterial outside --- Certainty = 0.0000 (Not Clear) <succ>
```

The protein has homology with the following sequences in the GENPEPT database.

```
>GP:BAA25696 GB:AB010712 NADH oxidase/alkyl hydroperoxidase reductase
[Streptococcus mutans]
Identities = 383/509 (75%), Positives = 441/509 (86%)
Query:    1 MVLDKEIKAQLAQYLDLLESDIVLQADLGDNDNSQKVKDFLDEIVAMSDRISLESTHLKR   60
            M LD EIK QL QYL LLES+IVLQA L D+ NSQKVK+FL EIVAMS  ISLE   L R
Sbjct:    1 MALDAEIKEQLGQYLQLLESEIVLQAQLKDDANSQKVKEFLQEIVAMSPMISLEEKELPR   60

Query:   61 QPSFGIAKKGHESRVIFSGLPMGHEFTSFILALLQVSGRAPKVDEDIIKRIKGIEKTINL  120
             PSF IAKKG ES V F+GLP+GHEFTSFILALLQVSGR PKV+ DI+KRI+ +++ ++
Sbjct:   61 TPSFRIAKKGQESGVEFAGLPLGHEFTSFILALLQVSGRPPKVETDIVERIQAVDEPMHF  120

Query:  121 ETYVSLTCHNCPDVVQAFNIMAVLNPNITHTMIEGGMYQDEVKSKGIMSVPTVYKDQEEF  180
            ETYVSLTCHNCPDVVQAFNIM+V+NPNI+HTM+EGGM++DE+++KGIMSVPTVYKD  EF
Sbjct:  121 ETYVSLTCHNCPDVVQAFNIMSVVNPNISHTMVEGGMFKDEIEAKGIMSVPTVYKDGTEF  180

Query:  181 TSGRATIEQLLEQLDGPLDAEAFADKGVYDVLVIGGGPAGNSAAIYAARKGLKTGILAET  240
            TSGRA+IEQLL+ + GPL  +AF DKGV+DVLVIGGGPAGNSAAIYAARKG+KTG+LAET
Sbjct:  181 TSGRASIEQLLDLIAGPLKEDAFDDKGVFDVLVIGGGPAGNSAAIYAARKGVKTGLLAET  240

Query:  241 FGGQVIETVGIENMIGTLYTEGPKLMAQIEEHTKSYDIDIIKSQLATGIEKKELVEVTLA  300
             GGQV+ETVGIENMIGT Y EGP+LMAQ+EEHTKSY +DI+K+  A  I+K +LVEV L
Sbjct:  241 MGGQVMETVGIENMIGTPYVEGPQLMAQVEEHTKSYSVDIMKAPRAKSIQKTDLVEVELD  300

Query:  301 NGAILQAKTAILALGAKWRNINVPGEEEFRNKGVTYCPHCDGPLFEGKDVAVIGGGNSGM  360
            NGA L+AKTA+LALGAKWR INVPGE+EF NKGVTYCPHCDGPLF  K VAVIGGGNSG+
Sbjct:  301 NGAHLKAKTAVLALGAKWRKINVPGEKEFFNKGVTYCPHCDGPLFTDKKVAVIGGGNSGL  360

Query:  361 EAALDLAGVTKHVTVLEFLPELKADQVLQERAAKTDNLTILKNVATKDIVGEDHVTGLNY  420
            EAA+DLAG+  HV +LEFLPELKAD++LQ+RA   DN+TIL NVATK+I+G DHV GL Y
Sbjct:  361 EAAIDLAGLASHVYILEFLPELKADKILQDRAEALDNITILTNVATKEIIGNDHVEGLRY  420

Query:  421 TDRDTNEEKHIDLEGVFVQIGLVPSTSWLKDSGIELNERQEIVVDKFGSTNIPGIFAAGD  480
```

```
                      -continued
         +DR TNEE  +DLEGVFVQIGLVPST WLKDSG+ LNE+ EI+V K G+TNIP IFAAGD
Sbjct: 421 SDRTTNEEYLLDLEGVFVQIGLVPSTDWLKDSGLALNEKGEIIVAKDGATNIPAIFAAGD  480

Query: 481 CTDAAYKQIIISMGSGATAAIGAFDYLIR                                509
           CTD+AYKQIIISMGSGATAA+GAFDYLIR
Sbjct: 481 CTDSAYKQIIISMGSGATAALGAFDYLIR                                509
```

A related DNA sequence was identified in *S. pyogenes* <SEQ ID 4513> which encodes the amino acid sequence <SEQ ID 4514>. Analysis of this protein sequence reveals the following:

---

Possible site: 29
>>> Seems to have no N-terminal signal sequence
----- Final Results -----
  bacterial cytoplasm --- Certainty = 0.0654 (Affirmative) <succ>
   bacterial membrane --- Certainty = 0.0000 (Not Clear) <succ>
     bacterial outside --- Certainty = 0.0000 (Not Clear) <succ>

---

An alignment of the GAS and GBS proteins is shown below.

Based on this analysis, it was predicted that these proteins and their epitopes could be useful antigens for vaccines or diagnostics.

Example 1470

A DNA sequence (GBSx1556) was identified in *S. agalactiae* <SEQ ID 4515> which encodes the amino acid sequence <SEQ ID 4516>. Analysis of this protein sequence reveals the following:

---

Possible site: 15
>>> Seems to have no N-terminal signal sequence
----- Final Results -----
  bacterial cytoplasm --- Certainty = 0.2906 (Affirmative) <succ>
   bacterial membrane --- Certainty = 0.0000 (Not Clear) <succ>
     bacterial outside --- Certainty = 0.0000 (Not Clear) <succ>

---

The protein has homology with the following sequences in the GENPEPT database.

```
Identities = 419/510 (82%), Positives = 472/510 (92%)
Query:   1 MVLDKEIKAQLAQYLDLLESDIVLQADLGDNDNSQKVKDFLDEIVAMSDRISLESTHLKR   60
           M L  +IK QLAQYL LLE+D+VLQ  LGDN+ SQKVKDF++EI AMS+RIS+E+  L R
Sbjct:   1 MALSPDIKEQLAQYLTLLEADLVLQVSLGDNEQSQKVKDFVEEIAAMSERISIENITLDR   60

Query:  61 QPSFGIAKKGHESRVIFSGLPMGHEFTSFILALLQVSGRAPKVDEDIIKRIKGIEKTINL  120
           QPSF +AKKGH S V+F+GLP+GHE TSFILALLQVSGRAPKVD+D+I RIK I++ ++
Sbjct:  61 QPSFKVAKKGHGSGVVFAGLPLGHELTSFILALLQVSGRAPKVDQDVIDRIKAIDRPLHF  120

Query: 121 ETYVSLTCHNCPDVVQAFNIMAVLNPNITHTMIEGGMYQDEVKSKGIMSVPTVYKDQEEF  180
           ETYVSLTCHNCPDVVQA NIM+VLN   I+HTM+EGGM+QDEVK+KGIMSVPTV+ D EEF
Sbjct: 121 ETYVSLTCHNCPDVVQALNIMSVLNDKISHTMVEGGMFQDEVKAKGIMSVPTVFLDGEEF  180

Query: 181 TSGRATIEQLLEQLDGPLDAEAFADKGVYDVLVIGGGPAGNSAAIYAARKGLKTGILAET  240
           TSGRATIEQLLEQ+ GPL  EAFADKG+YDVLVIGGGPAGNSAAIYAARKGLKTG+LAET
Sbjct: 181 TSGRATIEQLLEQIAGPLSEEAFADKGLYDVLVIGGGPAGNSAAIYAARKGLKTGLLAET  240

Query: 241 FGGQVIETVGIENMIGTLYTEGPKLMAQIEEHTKSYDIDIIKSQLATGIEKKELVEVTLA  300
           FGGQV+ETVGIENMIGTLYTEGPKLMA++E HTKSYD+DIIK+QLAT IEKKE +EVTLA
Sbjct: 241 FGGQVMETVGIENMIGTLYTEGPKLMAEVEAHTKSYDVDIIKAQLATSIEKKENIEVTLA  300

Query: 301 NGAILQAKTAILALGAKWRNINVPGEEEFRNKGVTYCPHCDGPLFEGKDVAVIGGGNSGM  360
           NGA+LQAKTAILALGAKWRNINVPGE+EFRNKGVTYCPHCDGPLFEGKDVAVIGGGNSG+
Sbjct: 301 NGAVLQAKTAILALGAKWRNINVPGEDEFRNKGVTYCPHCDGPLFEGKDVAVIGGGNSGL  360

Query: 361 EAALDLAGVTKHVTVLEFLPELKADQVLQERAAKTDNLTILKNVATKDIVGEDHVTGLNY  420
           EAALDLAG+ KHV VLEFLPELKAD+VLQ+RAAKT+N TI+KNVATKDIVGEDHVTGLNY Sbjct: 361 EAALDLAGLAKHVYVLEFLPELKADKVLQDRAAKTNNMTIIKNVATKDIVGEDHVTGLNY  420

Query: 421 TDRDTNEEKHIDLEGVFVQIGLVPSTSWLKDSGIELNERQEIVVDKFGSTNIPGIFAAGD  480
           T+RD+ E+KH+DLEGVFVQIGLVP+T+WLKDSG+ L +R EI+VDK GSTNIPGIFAAGD
Sbjct: 421 TERDSGEDKHLDLEGVFVQIGLVPNTAWLKDSGVNLTDRGEIIVDKHGSTNIPGIFAAGD  480

Query: 481 CTDAAYKQIIISMGSGATAAIGAFDYLIRQ                               510
           CTD+AYKQIIISMGSGATAAIGAFDYLIRQ
Sbjct: 481 CTDSAYKQIIISMGSGATAAIGAFDYLIRQ                               510
```

```
>GP:BAA25695 GB:AB010712 alkyl hydroperoxidase [Streptococcus mutans]
Identities = 167/186 (89%), Positives = 179/186 (95%)
Query:   1  MSLVGKEIIEFSAQAYHDGKFITVTNEDVKGKWAVFCFYPADFSFVCPTELGDLQEQYET    60
            MSLVGKE++EFSAQAYH G+F+TV NEDVKGKWAVFCFYPADFSFVCPTELGDLQEQY T
Sbjct:   1  MSLVGKEMVEFSAQAYHQGEFVTVNNEDVKGKWAVFCFYPADFSFVCPTELGDLQEQYAT    60

Query:  61  LKSLDVEVYSVSTDTHFVHKAWHDDSDVVGTITYPMIGDPSHLISQGFDVLGQDGLAQRG   120
            L+SL VEVYSVSTDTHFVHKAWHDDSDVVGTITY MIGDPSH++SQGF+VLG+DGLAQRG
Sbjct:  61  LQSLGVEVYSVSTDTHFVHKAWHDDSDVVGTITYTMIGDPSHVLSQGFEVLGEDGLAQRG   120

Query: 121  TFIIDPDGVIQMMEINADGIGRDASTLIDKVRAAQYIRQHTGEVCPAKWKEGAETLTPSL   180
            TFI+DPDG+IQMME+NADGIGRDASTLIDKVRAAQYIRQH GEVCPAKWKEGAETL PSL
Sbjct: 121  TFIVDPDGIIQMMEVNADGIGRDASTLIDKVRAAQYIRQHPGEVCPAKWKEGAETLKPSL   180

Query: 181  DLVGKI   186
            DLVGKI
Sbjct: 181  DLVGKI   186
```

A related DNA sequence was identified in *S. pyogenes* <SEQ ID 4517> which encodes the amino acid sequence <SEQ ID 4518>. Analysis of this protein sequence reveals the following:

---

Possible site: 15
>>> Seems to have no N-terminal signal sequence
----- Final Results -----
    bacterial cytoplasm --- Certainty = 0.3022 (Affirmative) <succ>
    bacterial membrane --- Certainty = 0.0000 (Not Clear) <succ>
    bacterial outside --- Certainty = 0.0000 (Not Clear) <succ>

---

An alignment of the GAS and GBS proteins is shown below.

```
Identities = 173/186 (93%), Positives = 181/186 (97%)
Query:   1  MSLVGKEIIEFSAQAYHDGKFITVTNEDVKGKWAVFCFYPADFSFVCPTELGDLQEQYET    60
            MSL+GKEI EFSAQAYHDGKFITVTNEDVKGKWAVFCFYPADFSFVCPTELGDLQEQYET
Sbjct:   1  MSLIGKEIAEFSAQAYHDGKFITVTNEDVKGKWAVFCFYPADFSFVCPTELGDLQEQYET    60

Query:  61  LKSLDVEVYSVSTDTHFVHKAWHDDSDVVGTITYPMIGDPSHLISQGFDVLGQDGLAQRG   120
            LKSL VEVYSVSTDTHFVHKAWHDDSDVVGTITYPMIGDPSHLISQ F+VLG+DGLAQRG
Sbjct:  61  LKSLGVEVYSVSTDTHFVHKAWHDDSDVVGTITYPMIGDPSHLISQAFEVLGEDGLAQRG   120

Query: 121  TFIIDPDGVIQMMEINADGIGRDASTLIDKVRAAQYIRQHTGEVCPAKWKEGAETLTPSL   180
            TFI+DPDG+IQMMEINADGIGRDASTLIDK+ AAQY+R+H GEVCPAKWKEGAETLTPSL
Sbjct: 121  TFIVDPDGIIQMMEINADGIGRDASTLIDKIHAAQYVRKHPGEVCPAKWKEGAETLTPSL   180

Query: 181  DLVGKI   186
            DLVGKI
Sbjct: 181  DLVGKI   186
```

Based on this analysis, it was predicted that these proteins and their epitopes could be useful antigens for vaccines or diagnostics.

Example 1471

A DNA sequence (GBSx1557) was identified in *S. agalactiae* <SEQ ID 4519> which encodes the amino acid sequence <SEQ ID 4520>. This protein is predicted to be 30S ribosomal protein S2 (rpsB). Analysis of this protein sequence reveals the following:

---

Possible site: 60
>>> Seems to have no N-terminal signal sequence
----- Final Results -----
    bacterial cytoplasm --- Certainty = 0.4462 (Affirmative) <succ>
    bacterial membrane --- Certainty = 0.0000 (Not Clear) <succ>
    bacterial outside --- Certainty = 0.0000 (Not Clear) <succ>

---

The protein has homology with the following sequences in the GENPEPT database.

```
>GP:CAA50276 GB:X70925 30S ribosomal protein [Pediococcus
acidilactici]
Identities = 190/260 (73%), Positives = 226/260 (86%), Gaps = 4/260 (1%)
Query:   1  MAVISMKQLLEAGVHFGHQTRRWNPKMAKYIFTERNGIHVIDLQQTVKLADQAYEFVRDA    60
            M+VISMKQLLEAGVHFGHQTRRWNPKM  +IFTERNGI++IDLQ+TVKL D AY FV+D
Sbjct:   1  MSVISMKQLLEAGVHFGHQTRRWNPKMKPFIFTERNGIYIIDLQKTVKLIDNAYNFVKDV    60

Query:  61  AANDAVILFVGTKKQAAEAVAEEEAKRAGQYFINHRWLGGTLTNWGTIQKRIARLKEIKRM   120
            AAND V+LFVGTKKQA  A+ EEAKRAGQ+++NHRWLGGTLTNW TIQKRI RLK++K+M
Sbjct:  61  AANDGVVLFVGTKKQAQTAIEEEAKRAGQFYVNHRWLGGTLTNWNTIQKRIKRLKDLKKM   120
```

```
                       -continued
Query: 121  EEEGTFELLPKKEVALLNKQRARLEKFLGGIEDMPRIPDVMYVVDPHKEQIAVKEAKKLG  180
            EE+GTF+ LPKKEVALLNKQ+ +LEKFLGGIEDMP IPDV++VVDP KEQIA+KEA+KL
Sbjct: 121  EEDGTFDRLPKKEVALLNKQKDKLEKFLGGIEDMPHIPDVLFVVDPRKEQIAIKEAQKLN  180

Query: 181  IPVVAMVDTNADPDDIDVIIPANDDAIRAVKLITSKLADAVIEGRQGEDADV----DFAQ  236
            IPVVAMVDTN DPD +DVIIP+NDDAIRAV+LITSK+ADAV+EGRQGED +    + A+
Sbjct: 181  IPVVAMVDTNTDPDQVDVIIPSNDDAIRAVRLITSKMADAVVEGRQGEDDEAVQQEEVAE  240

Query: 237  EAQADSIEEIVEVVEGSNND                                          256
              DS+E++ + VE  +N+
Sbjct: 241  GVSKDSLEDLKKTVEEGSNE                                          260
```

A related DNA sequence was identified in *S. pyogenes* <SEQ ID 4521> which encodes the amino acid sequence <SEQ ID 4522>. Analysis of this protein sequence reveals the following:

Possible site: 60
>>> Seems to have no N-terminal signal sequence
----- Final Results -----
    bacterial cytoplasm --- Certainty = 0.4462 (Affirmative) <succ>
    bacterial membrane --- Certainty = 0.0000 (Not Clear) <succ>
    bacterial outside --- Certainty = 0.0000 (Not Clear) <succ>

Possible site: 49
>>> Seems to have no N-terminal signal sequence
----- Final Results -----
    bacterial cytoplasm --- Certainty = 0.2648 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below.

The protein has homology with the following sequences in the GENPEPT database.

```
Identities = 241/254 (94%), Positives = 248/254 (96%)
Query:   1  MAVISMKQLLEAGVHFGHQTRRWNPKMAKYIFTERNGIHVIDLQQTVKLADQAYEFVRDA   60
            MAVISMKQLLEAGVHFGHQTRRWNPKMAKYIFTERNGIHVIDLQQTVKLADQAYEFVRDA
Sbjct:   1  MAVISMKQLLEAGVHFGHQTRRWNPKMAKYIFTERNGIHVIDLQQTVKLADQAYEFVRDA   60

Query:  61  AANDAVILFVGTKKQAAEAVAEEAKRAGQYFINHRWLGGTLTNWGTIQKRIARLKEIKRM  120
            AANDAVILFVGTKKQAAEAVA+EA RAGQYFINHRWLGGTLTNWGTIQKRIARLKEIKRM
Sbjct:  61  AANDAVILFVGTKKQAAEAVADEATRAGQYFINHRWLGGTLTNWGTIQKRIARLKEIKRM  120

Query: 121  EEEGTFELLPKKEVALLNKQRARLEKFLGGIEDMPRIPDVMYVVDPHKEQIAVKEAKKLG  180
            EEEGTF++LPKKEVALLNKQRARLEKFLGGIEDMPRIPDVMYVVDPHKEQIAVKEAKKLG
Sbjct: 121  EEEGTFDVLPKKEVALLNKQRARLEKFLGGIEDMPRIPDVMYVVDPHKEQIAVKEAKKLG  180

Query: 181  IPVVAMVDTNADPDDIDVIIPANDDAIRAVKLITSKLADAVIEGRQGEDADVDFAQEAQA  240
            IPVVAMVDTNADPDDID+IIPANDDAIRAVKLIT+KLADA+IEGRQGEDADV F  + QA
Sbjct: 181  IPVVAMVDTNADPDDIDIIIPANDDAIRAVKLITAKLADAIIEGRQGEDADVAFEADTQA  240

Query: 241  DSIEEIVEVVEGSN                                                254
            DSIEEIVEVVEG N
Sbjct: 241  DSIEEIVEVVEGDN                                                254
```

Based on this analysis, it was predicted that these proteins and their epitopes could be useful antigens for vaccines or diagnostics.

Example 1472

A DNA sequence (GBSx1558) was identified in *S. agalactiae* <SEQ ID 4523> which encodes the amino acid sequence <SEQ ID 4524>. Analysis of this protein sequence reveals the following:

```
>GP:CAB73435 GB:AL139077 elongation factor TS [Campylobacter jejuni]
Identities = 169/358 (47%), Positives = 226/358 (62%), Gaps = 19/358 (5%)
Query:   1  MAEITAKLVKELREKSGAGVMDAKKALVETDGDLDKAIELLREKGMAKAAKKADRVAAEG   60
            M EITA +VKELRE +GAG+MD K AL ET+GD DKA++LLREKG+ KAAKKADR+AAEG
Sbjct:   1  MTEITAAMVKELRESTGAGMMDCKNALSETNGDFDKAVQLLREKGLGKAAKKADRLAAEG   60

Query:  61  LTGVYV--DGNVAAVIEVNAETDFVAKNDQFVTLVNETAKVIAEGRPSNNEEALALTMPS  118
            L  V V  D   A V E+N+ETDFVAKNDQF+ L +T I     + EE  + T+ +
Sbjct:  61  LVSVKVSDDFTSATVSEINSETDFVAKNDQFIALTKDTTAHIQSNSLQSVEELHSSTI-N  119

Query: 119  GETLEQAFVTATATIGEKISFRRFALVEKTDEQHFGAYQHNGGRIGVITV-------VEG  171
```

```
                 G   E+   +   ATIGE +  RRFA ++            Y H  GR+GV+            V
Sbjct: 120  GVKFEEYLKSQIATIGENLVVRRFATLKAGANGVVNGYIHTNGRVGVVIAAACDSAEVAS   179

Query: 172  GDDALAKQVSMHVAAMKPTVLSYTELDAQFVHDELAQLNHKIEQDNESRAMV---NKPAL   228
               L +Q+ MH+AAM+P+ LSY +LD  FV +E    L  ++E++NE R   +   NKP
Sbjct: 180  KSRDLLRQICMHIAAMRPSYLSYEDLDMTFVENEYKALVAELEKENEERRRLKDPNKPEH   239

Query: 229  PFLKYGSKAQLTDEVIAQAEEDIKAELAAEGKPEKIWDKIVPGKMDRFMLDNTKVDQEYT   288
               ++ S+ QL+D ++ +AEE IK EL A+GKPEKIWD I+PGKM+ F+ DN+++D + T
Sbjct: 240  KIPQFASRKQLSDAILKEAEEKIKEELKAQGKPEKIWDNIIPGKMNSFIADNSQLDSKLT   299

Query: 289  LLAQVYIMDDSKTVEAYLESV------NAKAVAFVRFEVGEGIEKASNDFEAEVAATM    340
               L+ Q Y+MDD KTVE +            K V F+ FEVGEG+EK + DF AEVAA +
Sbjct: 300  LMGQFYVMDDKKTVEQVIAEKEKEFGGKIKIVEFICFEVGEGLEKKTEDFAAEVAAQL    357
```

A related DNA sequence was identified in *S. pyogenes* <SEQ ID 4525> which encodes the amino acid sequence <SEQ ID 4526>. Analysis of this protein sequence reveals the following:

Possible site: 38
>>> Seems to have no N-terminal signal sequence
----- Final Results -----
   bacterial cytoplasm --- Certainty = 0.3942 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

```
Identities = 307/344 (89%), Positives = 327/344 (94%)
Query:   1  MAEITAKLVKELREKSGAGVMDAKKALVETDGDLDKAIELLREKGMAKAAKKADRVAAEG    60
            MAEITAKLVKELREKSGAGVMDAKKALVETDGD+DKA+ELLREKGMAKAAKKADRVAAEG
Sbjct:  33  MAEITAKLVKELREKSGAGVMDAKKALVETDGDMDKAVELLREKGMAKAAKKADRVAAEG    92

Query:  61  LTGVYVDGNVAAVIEVNAETDFVAKNDQFVTLVNETAKVIAEGRPSNNEEALALTMPSGE   120
            LTGVYV GNVAAV+EVNAETDFVAKN QFV LVN TAKVIAEG+P+NN+EALAL MPSGE
Sbjct:  93  LTGVYVHGNVAAVVEVNAETDFVAKNAQFVELVNATAKVIAEGKPANNDEALALVMPSGE   152

Query: 121  TLEQAFVTATATIGEKISFRRFALVEKTDEQHFGAYQHNGGRIGVITVVEGGDDALAKQV   180
            TL +A+V ATATIGEKISFRRFAL+EK DEQHFGAYQHNGGRIGVI+VVEGGDDALAKQV
Sbjct: 153  TLAEAYVNATATIGEKISFRRFALIEKADEQHFGAYQHNGGRIGVISVVEGGDDALAKQV   212

Query: 181  SMHVAAMKPTVLSYTELDAQFVHDELAQLNHKIEQDNESRAMVNKPALPFLKYGSKAQLT   240
            SMH+AAMKPTVLSYTELDAQF+ DELAQLNH IE DNESRAMV+KPALPFLKYGSKAQL+
Sbjct: 213  SMHIAAMKPTVLSYTELDAQFIKDELAQLNHAIELDNESRAMVDKPALPFLKYGSKAQLS   272

Query: 241  DEVIAQAEEDIKAELAAEGKPEKIWDKIVPGKMDRFMLDNTKVDQEYTLLAQVYIMDDSK   300
            D+VI  AE DIKAELAAEGKPEKIWDKI+PGKMDRFMLDNTKVDQ YTLLAQVYIMDDSK
Sbjct: 273  DDVITAAEADIKAELAAEGKPEKIWDKIIPGKMDRFMLDNTKVDQAYTLLAQVYIMDDSK   332

Query: 301  TVEAYLESVNAKAVAFVRFEVGEGIEKASNDFEAEVAATMAAAL                 344
            TVEAYL+SVNAKA+AF RFEVGEGIEK +NDFE+EVAATMAAAL
Sbjct: 333  TVEAYLDSVNAKAIAFARFEVGEGIEKKANDFESEVAATMAAAL                 376
```

Based on this analysis, it was predicted that these proteins and their epitopes could be useful antigens for vaccines or diagnostics.

Example 1473

A DNA sequence (GBSx1559) was identified in *S. agalactiae* <SEQ ID 4527> which encodes the amino acid sequence <SEQ ID 4528>. Analysis of this protein sequence reveals the following:

Possible site: 21
>>> Seems to have no N-terminal signal sequence
----- Final Results -----
   bacterial cytoplasm --- Certainty = 0.1312 (Affirmative) <succ>
     bacterial membrane --- Certainty = 0.0000 (Not Clear) <succ>
       bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1474

A DNA sequence (GBSx1560) was identified in *S. agalactiae* <SEQ ID 4529> which encodes the amino acid sequence <SEQ ID 4530>. Analysis of this protein sequence reveals the following:

Possible site: 26
>>> Seems to have a cleavable N-term signal seq.
INTEGRAL   Likelihood = −7.86   Transmembrane 128-144 (124-152)
INTEGRAL   Likelihood = −4.57   Transmembrane 35-51 (33-53)
INTEGRAL   Likelihood = −4.04   Transmembrane 92-108 (87-111)
----- Final Results -----
   bacterial membrane --- Certainty = 0.4142 (Affirmative) <succ> bacterial outside --- Certainty = 0.0000 (Not Clear) <succ>
bacterial cytoplasm--- Certainty = 0.0000 (Not Clear) <succ>

The protein has homology with the following sequences in the GENPEPT database.

```
>GP:BAB04953 GB:AP001511 small multidrug export related protein
[Bacillus halodurans]
Identities = 47/137 (34%), Positives = 71/137 (51%), Gaps = 5/137 (3%)
Query:  12 IPLVELRGAVPFAIANGIPLWEALAIGVVGNMLPVPIIFFFARKVLEWGADKPYTGKFFT    71
           +P+VELRG +P +   G+  WEAL G++GN+LP+ I    R + W      +  +  +
Sbjct:   1 MPIVELRGGIPLGVVLGLSPWEALLFGIIGNLLPIVPILLLFRPISGWMLRFKWYQRLYD   60

Query:  72 WCLKKGHSGGQKLEKVAGEKGLFIALLLFVGIPLPGTGAWTGTLAASLLDWEFKHSVIAV   131
           W   +      +EK         I L+LF  +PLP TGA++  LAA L     F+ +  AV
Sbjct:  61 WLYNRTMKKSNNVEKFGA-----IGLILFTAVPLPTTGAYSACLAAVLFFIPFRFAFFAV   115

Query: 132 MLGVILAGCIMGTLSII                                             148
              GV++AG +M   S I
Sbjct: 116 SAGVVIAGIVMTLFSYI                                             132
```

No corresponding DNA sequence was identified in *S. pyogenes*.

A related GBS gene <SEQ ID 8817> and protein <SEQ ID 8818> were also identified. Analysis of this protein sequence reveals the following:

The protein has homology with the following sequences in the databases:

```
          186       216       246       276       306       336       366       396
          LTIIISNF*KIRK*NLSKDSKTRMTADFSCHY*KDKIKWNNTIERFYLMNYIITFLISMIPLVELRGAVPFAIANGIPLW
                                                                :|: ||||||:|:|:   |
                                                                MPFSELRGAIPLALYFGFSPA
                                                                10                 20

426       456       486       516       546       576       591       621
          EALAIGVVGNMLPVPIIFFFARKVLEWGADKPYTGKFFTWCLKKGHSGGQKLEKVAGEKGL-----FIALLLFVGIPLPG
          ||    :  |:||:||||  :::|    ::             :  : :|:    ||:       |:  |  :||  ||||
          EAYLLSVLGNILPVPFLLLFLDYLVRIATKVELLARIYR---------RVVERVERRKGVVERYGYLGLTIFVAIPLPV
                         40        50        60                   70        80        90

651       681       711       741       771       801       831       861
          TGAWTGTLAASLLDWEFKHSVIAVMLGVILAGCIMGTLSIIGFNLF*KS*GEMTVSPF*YLPIHQFDSKIRHLT*AKCLI
          |||||||| | ||       :  :    ||  :||  ::      ||    |:
          TGAWTGTLLAFLLQLNRLKAFLFISAGVCIAGVVVLLASIGIIRLL
                           110       120       130
```

Based on this analysis, it was predicted that these proteins and their epitopes could be useful antigens for vaccines or diagnostics.

Example 1475

A DNA sequence (GBSx1561) was identified in *S. agalactiae* <SEQ ID 4531> which encodes the amino acid sequence <SEQ ID 4532>. This protein is predicted to be CtsR protein (ctsR). Analysis of this protein sequence reveals the following:

Lipop: Possible site: −1    Crend: 0
McG: Discrim Score: 3.98
GvH: Signal Score (−7.5): −2.35
Possible site: 26
>>> Seems to have a cleavable N-term signal seq.
ALOM program count: 3 value: −7.86 threshold: 0.0
INTEGRAL     Likelihood = −7.86    Transmembrane 128-144 (124-152)
INTEGRAL     Likelihood = −4.57    Transmembrane 35-51 (33-53)
INTEGRAL     Likelihood = −4.04    Transmembrane 92-108 (87-111)
PERIPHERAL   Likelihood = 12.20    109
modified ALOM score: 2.07
*** Reasoning Step: 3
----- Final Results -----
  bacterial membrane --- Certainty = 0.4142 (Affirmative) <succ>
    bacterial outside --- Certainty = 0.0000 (Not Clear) <succ>
      bacterial cytoplasm --- Certainty = 0.0000 (Not Clear) <succ>
LPXTG motif: 105-109

Possible site: 34
>>> Seems to have no N-terminal signal sequence
----- Final Results -----
  bacterial cytoplasm --- Certainty = 0.3672 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:CAB91548 GB:AJ249133 CtsR protein [Lactococcus lactis]
Identities = 74/146 (50%), Positives = 103/146 (69%), Gaps = 3/146 (2%)
Query:    4 KNTSDNIEEYIKSLLEQSGIAEIKRSNLADTFQVVPSQINYVIKTRFTESRGYVVESKRG   63
            KNTSD IE Y++ LLE++ + EIKR++LA+ F VVPSQINYVIKTRFT S+G+ VESKRG
Sbjct:    5 KNTSDIIEAYLRQLLEEAQVIEIKRADLANQFDVVPSQINYVIKTRFTASKGFDVESKRG   64

Query:   64 GGGYIRIAKVHFSDQHQLFGNMLSTIGERISEQVFDDLIQLLFDEEIITEREGNLILATS  123
            GGGYI+I K  +S +H+    +    +S +    D++QLLFDE+++TEREGNL+L
Sbjct:   65 GGGYIKIVKYQYSARHEFLTALYQKVPANLSSKAAHDIVQLLFDEKVLTEREGNLLLLVI  124

Query:  124 GDDVLGEQASVIRARMLRKLLQRLDR                                    149
              D  G  +   R  M++ ++ RLDR
Sbjct:  125 TD---GAISPFTRGIMMKSIINRLDR                                    147
```

A related DNA sequence was identified in *S. pyogenes* <SEQ ID 4533> which encodes the amino acid sequence <SEQ ID 4534>. Analysis of this protein sequence reveals the following:

Possible site: 34
>>> Seems to have no N-terminal signal sequence
----- Final Results -----
   bacterial cytoplasm --- Certainty = 0.2514 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 117/151 (77%), Positives = 131/151 (86%)
Query:    1 MAIKNTSDNIEEYIKSLLEQSGIAEIKRSNLADTFQVVPSQINYVIKTRFTESRGYVVES   60
            M  KNTSD+IEEYIK LL +SGIAEIKRS LAD+FQVVPSQINYVIKTRFTESRGY VES
Sbjct:    1 MPTKNISDSIEEYIKELLAKSGIAEIKRSMLADSFQVVPSQINYVIKTRFTESRGYEVES   60

Query:   61 KRGGGGYIRIAKVHFSDQHQLFGNMLSTIGERISEQVFDDLIQLLFDEEIITEREGNLIL  120
            KRGGGGYIRIA+VHFSD+H L GN+++TI + ISEQVF D IQLLFDE ++TEREGN+IL
Sbjct:   61 KRGGGGYIRIAKVHFSDKHHLIGNLMATIEDCISEQVFTDSIQLLFDEHLLTEREGNIIL  120

Query:  121 ATSGDDVLGEQASVIRARMLRKLLQRLDRKG                               151
            A + DDVLG    S IRARML +LLQR+DRKG
Sbjct:  121 AVASDDVLGTDGSTIRARMLYRLLQRIDRKG                               151
```

Based on this analysis, it was predicted that these proteins and their epitopes could be useful antigens for vaccines or diagnostics.

Example 1476

A DNA sequence (GBSx1562) was identified in *S. agalactiae* <SEQ ID 4535> which encodes the amino acid sequence <SEQ ID 4536>. This protein is predicted to be ClpC (clpB-1). Analysis of this protein sequence reveals the following:

Possible site: 49
>>> Seems to have no N-terminal signal sequence
INTEGRAL    Likelihood = –2.34   Transmembrane 32-48 (32-49)
----- Final Results -----
    bacterial membrane --- Certainty = 0.1935 (Affirmative) <succ>
      bacterial outside --- Certainty = 0.0000 (Not Clear) <succ>
        bacterial cytoplasm --- Certainty = 0.0000 (Not Clear) <succ>

The protein has homology with the following sequences in the GENPEPT database.

```
>GP:AAD01783 GB:AF023422 ClpC [Lactococcus lactis]
Identities = 401/831 (48%), Positives = 571/831 (68%), Gaps = 52/831 (6%)
Query:    4 YSIKLQEVFRLAQFQAARYESHYLESWHLLLAMVLVHDSVAGLTFAEYE---SEVAIEEY    60
            Y+  L +F  A  +Y+  +ES HLL AM      S+A  A       S++ I+
Sbjct:    8 YTPTLDRIFEKAAEYAHQYQYGTIESAHLLAAMATTSGSIAYSILAGMNVDSSDLLIDLE   67

Query:   61 EAATILALGRAPKEEITNYQFLEQSPALKKILKLAENISIVVGAEDVGTEHVLLAMLVNK  120
            + ++ + + R+            L  SP ++++ +A  +++   AE VGTEH+L A+L +
Sbjct:   68 DLSSHVKVKRSE---------LRFSPRAEEVVTVASFLAVHNNAEAVGTEHLLYALLQVE  118

Query:  121 DLLATRILELVGFRGQDDGESVRMVDLRKALERHAGF-TKDDIKAIYELRNPKKAKSGAS  179
            D   ++L+L        + + +V LRK +E+ G    ++ KA+ +   K AK A
Sbjct:  119 DGFGLQLLKL---------QKINIVSLRKEIEKRTGLIVPENKKAVTPMSKRKMAKGVAE  169

Query:  180 FSDMMKPPSTAGDLADFTRDLSQMAVDGEIEPVIGRDKEISRMVQVLSRKTKNNPVLVGD  239
                      S+  L   + DL++ A  G+++P+IGR+ E+ R++ +LSR+TKNNPVLVG+
Sbjct:  170 -------NSSTPTLDSVSSDLTEAARSGKLDPMIGREAEVDRLIHILSRRTKNNPVLVGE  222

Query:  240 AGVGKTALAYGLAQRIANGNIPYELRDMRVLELDMMSVVAGTRFRGDFEERMNQIIADIE  299
             GVGK+A+  GLAQRI NG +P  L + R++ L+M +VVAGT+FRG+FE+R+   I+ ++
Sbjct:  223 PGVGKSAIIEGLAQRIVNGQVPIGLMNSRIMALNMATVVAGTKFRGEFEDRLTAIVEEVS  282

Query:  300 EDGHIILFIDELHTIMGSGSGIDSTLDAANILKPALARGTLRTVGATTQEEYQKHIEKDA  359
            +D  +I+FIDELHTI+G+G G+DS  DAANILKPALARG + VGATT EYQK+IEKD
Sbjct:  283 ADPDVIIFIDELHTIIGAGGGMDSVNDAANILKPALARGDFQMVGATTYHEYQKYIEKDE  342

Query:  360 ALSRRFAKVLVEEPNLEDAYEILLGLKPAYEAFHNVTISDEAVMTAVKVAHRYLTSKNLP  419
            AL RR A++ V+EP+ ++A  IL GL+  +E +H V  +D+A+ +AV ++ RY+TS+ LP
Sbjct:  343 ALERRLARINVDEPSPDEAIAILQGLREKFEDYHQVKFTDQAIKSAVTLSVRYMTSRKLP  402

Query:  420 DSAIDLLDEASATVQMMIKKNAPSLLT----------EVDQAILDDDMKSA--------  460
            D AIDLLDEA+A V++++K      ++           E+  +A++  D+K++
Sbjct:  403 DKAIDLLDEAAARVKILLKTKKQNVFELEKDFVKAQEELAEAVIKLDVKASRIKEKAVEK  462

Query:  461 --SKALKASYKGKKRKPIAVTEDHIMATLSRLSGIPVEKLTQADSKKYLNLEKELHKRVI  518
                K  K SK +KR+    VT+    ++A  S L+G+P+  ++T+++S  + +NLEKELHKRV+
Sbjct:  463 ISDKIYKFSIKEEKRQE--VTDQAVIAVASTLTGVPITQMTKSESDRLINLEKELHKRVV  520

Query:  519 GQDDAVTAISRAIRRNQSGIRTGKRPIGSFMFLGPTGVGKTELAKALAEVLFDDESALIR  578
            GQ++A++A+SRAIRR  +SG+    +RP+GSFMFLGPTGVGKTELAKALA+  F  E   +IR
Sbjct:  521 GQEEAISAVSRAIRRARSGVADSRRPMGSFMFLGPTGVGKTELAKALADSVFGSEDNMIR  580

Query:  579 FDMSEYMEKFAASHLNGAPPGYVGYDEGGELTEKVRNKPYSVLLFDEVEKAHPDIFNVLL  638
             DMSE+MEK +  S L  GAPPGYVGYDEGG LTE+VRNKPYSV+L DEVEKAH D+FN++L
Sbjct:  581 VDMSEFMEKHSTSRLIGAPPGYVGYDEGGQLTERVRNKPYSVVLLDEVEKAHLDVFNIML  640

Query:  639 QVLDDGVLTDSRGRKVDFSNTIIIMTSNLGATALRDDKTVGFGAKDISHDYTAMQKRIME  698
            Q+LDDG +TD++GRKVDF NTIIIMTSNLGATALRDDKTVGFGAK+I+ DY+AMQ RI+E
Sbjct:  641 QILDDGFVTDTKGRKVDFRNTIIIMTSNLGATALRDDKTVGFGAKNITADYSAMQSRILE  700

Query:  699 ELKKAYRPEFINRIDEKVVFHSLSQDNMREVVKIMVKPLILALKDKGMDLKFQPSALKHL  758
            ELK+ YRPEF+NRIDE +VFHSL   + ++V KIM K LI  L ++ +  +K  PSA+K +
Sbjct:  701 ELKRHYRPEFLNRIDENIVFHSLESQEIEQIVKIMSKSLIKRLAEQDIHVKLTPSAIKLI  760

Query:  759 AEDGYDIEMGARPLRRTIQTQVEDHLSELLLANQVKEGQVIKIGVSKGKLK           809
            AE G+D E GARPLR+ +Q +VED LSE LL+ ++K G  I  IG S  K+K
Sbjct:  761 AEVGFDPEYGARPLRKALQKEVEDLLSEQLLSGEIKAGNHISIGASNKKIK           811
```

A related DNA sequence was identified in *S. pyogenes* <SEQ ID 4537> which encodes the amino acid sequence <SEQ ID 4538>. Analysis of this protein sequence reveals the following:

Possible site: 44
>>> Seems to have no N-terminal signal sequence
INTEGRAL    Likelihood = −1.75   Transmembrane 32-48 (32-48)

----- Final Results -----
bacterial membrane --- Certainty = 0.1702 (Affirmative) <succ>
bacterial outside --- Certainty = 0.0000 (Not Clear) <succ>
bacterial cytoplasm --- Certainty = 0.0000 (Not Clear) <succ>
RGD motif: 285-287

An alignment of the GAS and GBS proteins is shown below.

```
Identities = 618/814 (75%), Positives = 716/814 (87%), Gaps = 1/814 (0%)
Query:    1 MSHYSIKLQEVFRLAQFQAARYESHYLESWHLLLAMVLVHDSVAGLTFAEYESEVAIEEY   60
            M  YS K+Q++FR AQFQAAR++SH LE+WH+LLAMV V +S+A +  +EY+++VAIEEY
Sbjct:    1 MIMYSTKMQDIFRQAQFQAARFDSHCLETWHVLLAMVAVDNSLANMILSEYDAQVAIEEY   60

Query:   61 EAATILALGRAPKEEITNYQFLEQSPALKKILKLAENISIVVGAEDVGTEHVLLAMLVNK  120
            EAA ILA+G+ PKE+++   F QS L +L A+ IS +   ++VG+EHVL A+L+N
```

```
-continued
Sbjct:   61  EAAAILAMGKTPKEQLSRVDFRPQSKTLTNLLAFAQAISQITRDQEVGSEHVLFAILLNP  120

Query:  121  DLLATRILELVGFRGQDDGESV-RMVDLRKALERHAGFTKDDIKAIYELRNPKKAKSGAS  179
             D++A+R+LE+ G++ +D+G    R+ DLRKA+ERHAG++K+ IKAI+ELR PKK K+  +
Sbjct:  121  DIMASRLLEIAGYQIKDNGNGQPRLADLRKAIERHAGYSKEMIKAIHELRKPKKTKTQGT  180

Query:  180  FSDMMKPPSTAGDLADFTRDLSQMAVDGEIEPVIGRDKEISRMVQVLSRKTKNNPVLVGD  239
             FSDMMKPPSTAG+L+DFTRDL++MA  G +E VIGRD+E+SRM+QVLSRKTKNNPVLVGD
Sbjct:  181  FSDMMKPPSTAGELSDFTRDLTEMARQGLLESVIGRDQEVSRMIQVLSRKTKNNPVLVGD  240

Query:  240  AGVGKTALAYGLAQRIANGNIPYELRDMRVLELDMMSVVAGTRFRGDFEERMNQIIADIE  299
             AGVGKTALAYGLAQRIANG IPYEL++MRVLELDMMSVVAGTRFRGDFEERMNQII DIE
Sbjct:  241  AGVGKTALAYGLAQRIANGAIPYELKEMRVLELDMMSVVAGTRFRGDFEERMNQIIDDIE  300

Query:  300  EDGHIILFIDELHTIMGSGSGIDSTLDAANILKPALARGTLRTVGATTQEEYQKHIEKDA  359
                DG IILF+DELHTIMGSGSGIDSTLDAANILKPAL+RGTL  VGATTQEEYQKHIEKDA
Sbjct:  301  ADGQIILFVDELHTIMGSGSGIDSTLDAANILKPALSRGTLHMVGATTQEEYQKHIEKDA  360

Query:  360  ALSRRFAKVLVEEPNLEDAYEILLGLKPAYEAFHNVTISDEAVMTAVKVAHRYLTSKNLP  419
             ALSRRFAK+L+EEPN EDAY+IL+GLK +YE +HNV+IS EAV TAVK+AHRYLTSKNLP
Sbjct:  361  ALSRRFAKILIEEPNTEDAYQILMGLKLSYETYHNVSISNEAVKTAVKMAHRYLTSKNLP  420

Query:  420  DSAIDLLDEASATVQMMIKKNAPSLLTEVDQAILDDDMKSASKALKASYKGKKRKPIAVT  479
             DSAIDLLDEASA VQ M+KK+AP  LT +DQA+++ DMK  S+ L    KG+ RKP  VT
Sbjct:  421  DSAIDLLDEASAAVQNMVKKSAPETLTPIDQALINGDMKKVSRLLAKEAKGQMRKPTPVT  480

Query:  480  EDHIMATLSRLSGIPVEKLTQADSKKYLNLEKELHKRVIGQDDAVTAISRAIRRNQSGIR  539
             ED I+ATLS+LSGIP+EKLTQADSKKYLNLEKELHKRVIGQD AVTAISRAIRRNQSGIR
Sbjct:  481  EDDILATLSKLSGIPLEKLTQADSKKYLNLEKELHKRVIGQDAAVTAISRAIRRNQSGIR  540

Query:  540  TGKRPIGSFMFLGPTGVGKTELAKALAEVLFDDESALIRFDMSEYMEKFAASHLNGAPPG  599
             TGKRPIGSFMFLGPTGVGKTELAKALAEVLFDDE+ALIRFDMSEYMEKFAAS LNGAPPG
Sbjct:  541  TGKRPIGSFMFLGPTGVGKTELAKALAEVLFDDEAALIRFDMSEYMEKFAASRLNGAPPG  600

Query:  600  YVGYDEGGELTEKVRNKPYSVLLFDEVEKAHPDIFNVLLQVLDDGVLTDSRGRKVDFSNT  659
             YVGYDEGGELT+KVRNKPYSVLLFDEVEKAHPDIFNVLLQVLDDG+LTDSRGRKVDFSNT
Sbjct:  601  YVGYDEGGELTQKVRNKPYSVLLFDEVEKAHPDIFNVLLQVLDDGILTDSRGRKVDFSNT  660

Query:  660  IIIMTSNLGATALRDDKTVGFGAKDISHDYTAMQKRIMEELKKAYRPEFINRIDEKVVFH  719
             IIIMTSNLGATALRDDKTVGFG KDI  D+ AM+KRI+EEL+K YRPEFINRIDEKVVFH
Sbjct:  661  IIIMTSNLGATALRDDKTVGFGVKDIHQDHQAMEKRILEELRKTYRPEFINRIDEKVVFH  720

Query:  720  SLSQDNMREVVKIMVKPLILALKDKGMDLKFQPSALKHLAEDGYDIEMGARPLRRTIQTQ  779
             SL+QDNMR+VVKIMV+PLI  L +KG+ LK QP ALKHL+E GYD  MGARPLRRT+QT+
Sbjct:  721  SLTQDNMRDVVKIMVQPLITTLAEKGITLKIQPLALKHLSEVGYDEHMGARPLRRTLQTE  780

Query:  780  VEDHLSELLLANQVKEGQVIKIGVSKGKLKFDIA                           813
             +ED LSEL+L+ ++  G  +KIG+S GKL F IA
Sbjct:  781  IEDKLSELILSRELTSGHTLKIGLSHGKLTFHIA                           814
```

A related GBS gene <SEQ ID 8819> and protein <SEQ ID 8820> were also identified. Analysis of this protein sequence reveals the following:

Lipop: Possible site: −1   Crend: 9
McG: Discrim Score: −13.52
GvH: Signal Score (−7.5): −2.1
Possible site: 49
>>> Seems to have no N-terminal signal sequence
ALOM program   count: 1 value: −2.34 threshold: 0.0

-continued

INTEGRAL      Likelihood = −2.34   Transmembrane 32-48 (32-49)
PERIPHERAL    Likelihood = 0.95    112
modified ALOM score: 0.97
*** Reasoning Step: 3
----- Final Results -----
   bacterial membrane --- Certainty = 0.1935 (Affirmative) <succ>
   bacterial outside  --- Certainty = 0.0000 (Not Clear)  <succ>
   bacterial cytoplasm --- Certainty = 0.0000 (Not Clear)  <succ>

The protein has homology with the following sequences in the databases:

```
47.4/69.6% over 804aa
Listeria monocytogenes
EGAD|136761|  ClpC ATPase Insert characterized
GP|1314297|gb|AAC44446.1||U40604 ClpC ATPase Insert characterized
ORF00207(298-2727 of 3045)
EGAD|136761|145854(2-806 of 825) ClpC ATPase {Listeria monocytogenes}
GP|1314297|gb|AAC44446.1||U40604 ClpC ATPase {Listeria monocytogenes}
% Match = 33.6
% Identity = 47.4 % Similarity = 69.6
Matches = 372 Mismatches = 229 Conservative Sub.s = 174

87        117       147       177       207       237       267       297
```

```
SFF*STPIIWKYVINDWRAYQ*TSF**FDSIIIR*RDNYRT*RKFDSGDIR**RLRRASLCY*SSYAP*IITTIR*KRIP
                                                                              M 327       357       387       417       447       477       507       537
      FMSHYSIKLQEVFRLAQFQAARYESHYLESWHLLLAMVLVHDSVAGLTFAEYESEVAIEEYEAATILALGRAPKEEITNY
      ::  : |:|: |:|  :|  |      | :|| :|    : :|    | ||  :: |::        :|   :: :|
      MFGRFTQRAQKVLALSQEEAMRLNHSNLGTEHILLGLVREGEGIAA--KALYELGISSEKVQQEVEGLIGHG-EKAVTTI
                20        30        40          50        60        70

567       597       627       657       687       717       744       774
      QFLEQSPALKKILKLAENISIVVGAEDVGTEHVLLAMLVNKDLLATRILXLVGFRGQDDGESV-RMVDLRKALERHAGFT
      |:    |  ||:::|:  : :|  ||||||:|| ::  :| |:|   :     | |::        |
      QYT---PRAKKVIELSMDEARKLGHTYVGTEHILLGLIREGEGVAARVLSNLGISLNKARQQVLQLLGGGDA--------
             90        100       110       120       130       140

804       834       864       894       924       954       984       1014
      KDDIKAIYELRNPKKAKSGASFSDMMKPPSTAGDLADFTRDLSQMAVDGEIEPVIGRDKEISRMVQVLSRKTKNNPVLVG
                       :||      :    |  ||  |||: :|  :::|||||  ||| |:::||||:||||||||:|
      ----------------TGAGRQTNTQATPTLDSLA---RDLTVIAREDNLDPVIGRSKEIQRVIEVLSRRTKNNPVLIG
                      150       160       170       180       190       200

1044      1074      1104      1134      1164      1194      1224      1254
      DAGVGKTALAYGLAQRIANGNIPYELRDMRVLELDMMSVVAGTRFRGDFEERMNQIIADIEEDGHIILFIDELHTIMGSG
      : ||||||:| ||||:|    :|   ||  ||: ||| :||||::|:||:|: ::: :|  |::||||||||||::|:|
      EPGVGKTAIAEGLAQQIVRNEVPETLRGKRVMTLDMGTVVAGTKYRGEFEDRLKKVMDEIRQAGNVILFIDELHTLIGAG
                220       230       240       250       260       270       280

1284      1314      1344      1374      1404      1434      1464      1494
      SGIDSTLDAANILKPALARGTLRTVGATTQEEYQKHIEKDAALSRRFAKVLVEEPNLEDAYEILLGLKPAYEAFHNVTIS
      |  : ||:||||||  ||||  : :|||  |::|:|||| |:||||   | :|| ||  ||| ::  || ||| ::  |
      -GAEGAIDASNILKPPLARGELQCIGATTLDEYRKYIEKDRALERRFQPIKVDEPTVEESIQILHGLRDRYEAHHRVAIT
                300       310       320       330       340       350       360

1524      1554      1584             1614      1644      1674      1704
      DEAVMTAVKVAHRYLTSKNLPDSAIDLLLDEASATVQM----------MIKKNAPSLLTEVDQAILDDDMKSASKALKASY
      |||:  ||::: ||::  :  |||  ||||::||: : |::          ::  |   |  |||:    : :|:
      DEALEAAVRLSDRYISDRFLPDKAIDVIDESGSKVRLKSFTTPKNVKEMENNLSDLKKEKDAAVQGQEFEKAASLRDKEQ
                380       390       400       410       420       430       440

1725         1737      1767      1797      1827      1857      1887
      KGKK---RKPIA----------------VTEDHIMATLSRLSGIPVEKLTQADSKKYLNLEKELHKRVIGQDDAVTAISR
      |  ||   : |                 ||||  :: ::    || |:::|   : ||:|| ||||  |||:::| :|
      KLKKSLDKKSLEETKANWQEKQGLDHSEVTEDIVAEVVASWTGIPVAKLAETETNKLLNMEKLLHERVIGQDAAVKAVSL
                460       470       480       490       500       510       520

1917      1947      1977      2007      2037      2067      2097      2127
      AIRRNQSGIRTGKRPIGSFMFLGPTGVGKTELAKALAEVLFDDESALIRFDMSEYMEKFAASHLNGAPPGYVGYDEGGEL
      |:|| ::|::   |||||||:|||||||||||| |||:| ||: |  |:|| ||||||||:: :  ||||||||:|||:|
      AVRRARAGLKDPKRPIGSFIFLGPTGVGKTELARALAESMFGDEDSMIRIDMSEYMEKFSTARLVGAPPGYVGYEEGGQL
                540       550       560       570       580       590       600

2157      2187      2217      2247      2277      2307      2337      2367
      TEKVRNKPYSVLLFDEVEKAHPDIFNVLLQVLDDGVLTDSRGRKVDFSNTIIIMTSNLGATALRDDKTVGFGAKDISHDY
      |||||  ||||:|:|||:|:||||:||||||||||:|||:|||:||||:|| ||||||:|:  ||::||  |    |:
      TEKVRQKPYSVVLLDEIEKAHPDVFNMLLQVLDDGRLTDSKGRVVDFRNTVIIMTSNIGAQEMKQDKSMGFNVTDPLKDH
                620       630       640       650       660       670       680

2397      2427      2457      2487      2517      2547      2577      2607
      TAMQKRIMEELKKAYRPEFINRIDEKVVFHSLSQDNMREVVKIMVKPLILALKDKGMDLKFQPSALKHLAEDGYDIEMGA
       ||: |:::||||||:|:||||||||||:|  |: ::::     :| : |:|:  :  ::  |:|| ||:|  ||| ||
      KAMEHRVLQDLKQAFRPEFINRIDETIVFHSLQEKELKQIVTLLTAQLTKRLAERDIHVKLTEGAKSKIAKDGYDPEYGA
                700       710       720       730       740       750       760

2637      2667      2697      2727      2757      2787      2817      2847
      RPLRRTIQTQVEDHLSELLLANQVKEGQVIKIGVSKGKLKFDIAKS*NIPVPMGTGILI*KENVQNILDIFL*IYEK*KD
      |||:| || :||| |||  ||  | :   :|||   :||  |||:         :
      RPLKRAIQKEVEDMLSEELLRGNIKVGDYVEIGVKDGKLEVRKKDAPKKKTTSKKVKAK
                780       790       800       810       820
```

There is also homology to SEQ ID 258.

SEQ ID 8820 (GBS26) was expressed in E. coli as a His-fusion product. SDS-PAGE analysis of total cell extract is shown in FIG. 7 (lane 9; MW 93.3 kDa), in FIG. 167 (lane 16 & 17; MW 108 kDa) and in FIG. 239 (lane 14; MW 108 kDa).

It was also expressed in E. coli as a GST-fusion product. SDS-PAGE analysis of total cell extract is shown in FIG. 15 (lane 7; MW 118 kDa).

Based on this analysis, it was predicted that these proteins and their epitopes could be useful antigens for vaccines or diagnostics.

Example 1477

A DNA sequence (GBSx1563) was identified in *S. agalactiae* <SEQ ID 4539> which encodes the amino acid sequence <SEQ ID 4540>. Analysis of this protein sequence reveals the following:

Possible site: 17
>>> Seems to have a cleavable N-term signal seq.
----- Final Results -----
    bacterial outside --- Certainty = 0.3000 (Affirmative) <succ>
      bacterial membrane --- Certainty = 0.0000 (Not Clear) <succ>
        bacterial cytoplasm --- Certainty = 0.0000 (Not Clear) <succ>

A related DNA sequence was identified in *S. pyogenes* <SEQ ID 4541> which encodes the amino acid sequence <SEQ ID 4542>. Analysis of this protein sequence reveals the following:

Possible site: 17
>>> Seems to have a cleavable N-term signal seq.
----- Final Results -----
    bacterial outside --- Certainty = 0.3000 (Affirmative) <succ>
      bacterial membrane --- Certainty = 0.0000 (Not Clear) <succ>
        bacterial cytoplasm --- Certainty = 0.0000 (Not Clear) <succ>

An alignment of the GAS and GBS proteins is shown below.

```
Identities = 178/213 (83%), Positives = 199/213 (92%)
Query:   1  MLIVLAGTIGAGKSSLAAALGQHLGTDVFYEAVDNNPVLDLYYQDPQKYAFLLQIFFLNK   60
            MLIVLAGTIGAGKSSLAAALG+HLGTDVFYEAVDNNPVLDLYYQDP+KYAFLLQI+FLNK
Sbjct:   1  MLIVLAGTIGAGKSSLAAALGEHLGTDVFYEAVDNNPVLDLYYQDPKKYAFLLQIYFLNK   60

Query:  61  RFQSIKEAYKANNNVLDRSIFEDELFLTLNYKNGNVTKTELDIYKELLANMLEELEGMPK  120
            RF+SIKEAY+A+NN+LDRSIFEDELFL LNYKNGNVTKTELDIY+ELLANMLEELEGMPK
Sbjct:  61  RFKSIKEAYQADNNILDRSIFEDELFLKLNYKNGNVTKTELDIYQELLANMLEELEGMPK  120

Query: 121  KRPDLLVYIDVSFDKMLERIDKRGRSFEQVDSNPELYDYYKQVHSEYPEWYENYDVSPKI  180
            KRPDLL+YIDVSFDKMLERI++RGRSFEQVD NP L  YY QVH EYP WYE+Y+VSPK+
Sbjct: 121  KRPDLLIYIDVSFDKMLERIERRGRSFEQVDGNPSLEQYYHQVHGEYPTWYEDYEVSPKM  180

Query: 181  RIDGNKLDFVKNPEDLQHVLDTIDSELQKLDLL                            213
            +IDGN LDFV+NP+DL  VL  ID++L++L LL
Sbjct: 181  KIDGNSLDFVQNPQDLATVLKMIDTKLKELHLL                            213
```

A related GBS gene <SEQ ID 8821> and protein <SEQ ID 8822> were also identified. Analysis of this protein sequence reveals the following:

Lipop: Possible site: −1    Crend: 0
McG: Discrim Score: 3.94
GvH: Signal Score (−7.5): 1.42
Possible site: 17
>>> Seems to have a cleavable N-term signal seq.
ALOM program           count: 0 value: 7.69    threshold: 0.0
PERIPHERAL             Likelihood = 7.69      49
modified ALOM score: −2.04
*** Reasoning Step: 3
----- Final Results -----
    bacterial outside --- Certainty = 0.3000 (Affirmative) <succ>
      bacterial membrane --- Certainty = 0.0000 (Not Clear) <succ>
        bacterial cytoplasm --- Certainty = 0.0000 (Not Clear) <succ>

Figure 318:
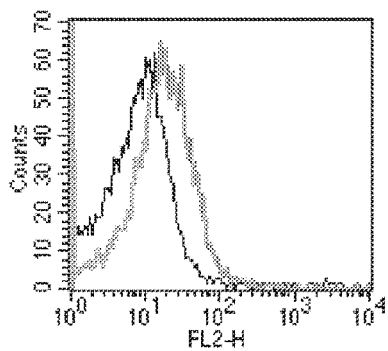

SEQ ID 4540 (GBS9) was expressed in *E. coli* as a GST-fusion product. SDS-PAGE analysis of total cell extract is shown in FIG. 1 (lane 5; MW 52 kDa) and FIG. 12 (lane 2 & 3; MW 50.3 kDa). It was also expressed in *E. coli* as a His-fusion product. SDS-PAGE analysis of total cell extract is shown in FIG. 2 (lane 6; MW 27 kDa) and FIG. 3 (lane 2; MW 25 kDa). The GBS9-GST fusion product was purified (FIG. 191, lane 6) and used to immunise mice. The resulting antiserum was used for FACS (FIG. 318), which confirmed that the protein is immunoaccessible on GBS bacteria.

Based on this analysis, it was predicted that these proteins and their epitopes could be useful antigens for vaccines or diagnostics.

Example 1478

A DNA sequence (GBSx1564) was identified in *S. agalactiae* <SEQ ID 4543> which encodes the amino acid sequence <SEQ ID 4544>. Analysis of this protein sequence reveals the following:

Possible site: 36
>>> Seems to have no N-terminal signal sequence
----- Final Results -----
    bacterial cytoplasm --- Certainty = 0.1182 (Affirmative) <succ>
      bacterial membrane --- Certainty = 0.0000 (Not Clear) <succ>
        bacterial outside --- Certainty = 0.0000 (Not Clear) <succ>

A related DNA sequence was identified in *S. pyogenes* <SEQ ID 4545> which encodes the amino acid sequence <SEQ ID 4546>. Analysis of this protein sequence reveals the following:

Possible site: 60
>>> Seems to have no N-terminal signal sequence
----- Final Results -----
    bacterial membrane --- Certainty = 0.0000 (Not Clear) <succ>
      bacterial outside --- Certainty = 0.0000 (Not Clear) <succ>
        bacterial cytoplasm --- Certainty = 0.0000 (Not Clear) <succ>

An alignment of the GAS and GBS proteins is shown below.

```
Identities = 281/323 (86%), Positives = 305/323 (93%)
Query:   3  QLNSSFMIGKVEIPHRTVLAPMAGITNSAFRTIAKEFGAGLVVMEMISEKGLLYNNEKTL   62
            +LNSSF IG VEIPHRTVLAPMAG+TNSAFRTIAKEFGAGLVVMEMISEKGLLYNNEKTL
Sbjct:  27  KLNSSFRIGDVEIPHRTVLAPMAGVTNSAFRTIAKEFGAGLVVMEMISEKGLLYNNEKTL   86

Query:  63  HMLHIDENEHPMSIQLFGGDAEGLKRAADFIQSNTKADIVDINMGCPVNKVVKNEAGAKW  122
            HMLHIDENEHPMSIQLFGGDAEGLKRAADFIQ+NTKADIVDINMGCPVNKVVKNEAGAKW
Sbjct:  87  HMLHIDENEHPMSIQLFGGDAEGLKRAADFIQTNTKADIVDINMGCPVNKVVKNEAGAKW  146

Query: 123  LRDPEKIYHIVKEVTSVLDIPLTVKMRTGWSDSSNAIENALAAESAGVSALAMHGRTREQ  182
            LRDP+KIYHIVKEVTSVLDIPLTVKMRTGW+DSS A+ENALAAESAGVSALAMHGRTREQ
Sbjct: 147  LRDPDKIYHIVKEVTSVLDIPLTVKMRTGWADSSLAVENALAAESAGVSALAMHGRTREQ  206

Query: 183  MYTGTCDHETLGKVAKAVTSIPFIANGDIRTVHDAKFMIEEIGADAIMVGRGARSNPYIF  242
            MYTGTCDHETL +V+KA+T IPFI NGD+R+V DAKFMIEEIG DA+M+GR A +NPY+F
Sbjct: 207  MYTGTCDHETLARVSKAITKIPFIGNGDVRSVQDAKFMIEEIGVDAVMIGRAAMNNPYLF  266

Query: 243  TQINHFFETGEILPDLPFEKMLDVAEDHLTRLVNLKGETIAVREFRGLAPHYLRGKSGAA  302
            TQINHFFETG+ LPDLPF K LD+A+DHL RL+NLKGETIAVREFRGLAPHYLRG +GAA
Sbjct: 267  TQINHFFETGQELPDLPFAKKLDIAKDHLKRLINLKGETIAVREFRGLAPHYLRGTAGAA  326

Query: 303  KIRGAVSRAETLAEVQELFAGLR                                      325
            K+RGAVSRAETLAEV+ +F  +R
Sbjct: 327  KVRGAVSRAETLAEVEAIFETVR                                      349
```

Based on this analysis, it was predicted that these proteins and their epitopes could be useful antigens for vaccines or diagnostics.

Example 1479

A DNA sequence (GBSx1565) was identified in *S. agalactiae* <SEQ ID 4547> which encodes the amino acid sequence <SEQ ID 4548>. Analysis of this protein sequence reveals the following:

---
Possible site: 53
>>> Seems to have no N-terminal signal sequence
----- Final Results -----
  bacterial cytoplasm --- Certainty = 0.2164 (Affirmative) <succ>
    bacterial membrane --- Certainty = 0.0000 (Not Clear) <succ>
    bacterial outside --- Certainty = 0.0000 (Not Clear) <succ>

---

There is also homology to SEQ ID 3930:

```
Identities = 235/288 (81%), Positives = 259/288 (89%)
Query:   1  MDKIIKSISTSGSFRAYVLDCTETVRTAQEKHQTLSSSTVALGRTLIANQILAANQKGNS   60
            MDKIIKSI+ SG+FRAYVLD TETV  AQEKH TLSSSTVALGRTLIANQILAANQKG+S
Sbjct:   1  MDKIIKSIAQSGAFRAYVLDSTETVALAQEKHNTLSSSTVALGRTLIANQILAANQKGDS   60

Query:  61  KVTVKVIGDSSFGHIISVADTKGNVKGYIQNTGVDIKKTATGEVLVGPFMGNGHFVVITD  120
            K+TVKVIGDSSFGHIISVADTKG+VKGYIQNTGVDIKKTATGEVLVGPFMGNGHFV I D
Sbjct:  61  KITVKVIGDSSFGHIISVADTKGHVKGYIQNTGVDIKKTATGEVLVGPFMGNGHFVTIID  120

Query: 121  YATGQPYTSTTPLITGEIGEDFAYYLTESEQTPSAVGLNVLLDDEDKVKVAGGFMLQVLP  180
            Y TG PYTSTTPLITGEIGEDFAYYLTESEQTPSA+GLNVLLD+ DKVKVAGGFM+QVLP
Sbjct: 121  YGTGNPYTSTTPLITGEIGEDFAYYLTESEQTPSAIGLNVLLDENDKVKVAGGFMVQVLP  180

Query: 181  GASDEEISRYEKRIQEMPSISSLLESENHIESLLSAIYGEDDYKRLSEDSLAFYCDCSKE  240
            GAS+EEI+RYEKR+QEMP+IS LL S+NH+++LL AIYG++ YKRLSE+ L+F CDCS+E
Sbjct: 181  GASEEEIARYEKRLQEMPAISHLLASKNHVDALLEAIYGDEPYKRLSEEPLSFQCDCSRE  240

Query: 241  RFEAALLTLGTKELQAMKDEDKGVEITCQFCNQTYYFTEEDLEKIIND             288
            RFEAAL+TL  +LQAM DEDKG EI CQFC  Y F E DLE II+D
Sbjct: 241  RFEAALMTLPKADLQAMIDEDKGAEIVCQFCGTKYQFNESDLEAIISD             288
```

Based on this analysis, it was predicted that this protein and its epitopes, could be useful antigens for vaccines or diagnostics.

Example 1480

A DNA sequence (GBSx1566) was identified in *S. agalactiae* <SEQ ID 4549> which encodes the amino acid sequence <SEQ ID 4550>. This protein is predicted to be surface-located membrane protein 1 (lmp1). Analysis of this protein sequence reveals the following:

---
Possible site: 51
>>> Seems to have no N-terminal signal sequence
----- Final Results -----
  bacterial cytoplasm --- Certainty = 0.4312 (Affirmative) <succ>
    bacterial membrane --- Certainty = 0.0000 (Not Clear) <succ>
    bacterial outside --- Certainty = 0.0000 (Not Clear) <succ>

---

The protein has homology with the following sequences in the GENPEPT database.

```
>GP:AAB93480 GB:AF019377 tellurite resistance protein [Rhodobacter
sphaeroides]
Identities = 64/350 (18%), Positives = 146/350 (41%), Gaps = 7/350 (2%)
Query:  44  LTPAQKSAISEKTPALVDTFVGDQNALLDFGQSAVEGVNTTVNHILSEQKKIQIPQVDDL  103
            L  A     E  + + V D +++ FG  A  + T   +L++ K   +    D
Sbjct:  34  LASAPPEKAQEIRRRMAELNVSDSQSIIGFGSKAQAELQTISQQMLADVKNKDVGPAGDS   93

Query: 104  LKNANRELNGFIAKYKDATPAELEKKPNLIQKLFKQSKTSLQEFYFDSQNIEQKMDMMAA  163
            L+    + GF       + ++ +K +  ++L ++         F     ++++Q++D +
Sbjct:  94  LREVVSTIRGF-----SVSEFDVRRKASWWERLLGRT-APFARFVARYEDVQQQIDRITQ  147

Query: 164  NVVKQEDTLARNIVSAEMLIEDNTKSIENLVGVIAFIESSQAEAANRASHLQQEILALDS  223
            +++   E  L ++I   ++L      + L    IA +   A+  R    ++  +A
Sbjct: 148  SLLTHEHRLLKDIKGLDILYARTLDFYDELALYIAAGDEVLADLDGRVIPAKEAEVAATP  207

Query: 224  QTSEYQIKSNQLARMTEVINTLEQQHPEYVSRLYVAWATTPQMRNLVKVSSDMRQKLGML  283
            +  +   IK+ +L  +     + LE++  +         V    + P  +R + +     + ++
Sbjct: 208  E-GDRMIKAQELRDLRAARDDLERRVHDLKLTRQVTMQSLPSIRLVQENDKALVTRINST  266

Query: 284  RRNTIPTMKLSIAQLGMMQQSVKSGVTADAIVNANNAALQMLAETSKEAIPMLEKTAQSP  343
               NT+P  +   +AQ    +Q+S ++        + N  L   AE  ++A ++  K  +
Sbjct: 267  LVNTVPLWETQLAQAVTIQRSREAAEAVRGASDLTNELLTANAENLQQANKIVRKEMERG  326

Query: 344  TVSIKSVTALAESLVAQNNGIIAAIDKGRKERAQLESAVIKSAETINDSV            393
                I++V      +L+A   N   +A  D+GR  RA  E+ + +      + D++
Sbjct: 327  VFDIEAVKKANATLIATINESLAIADEGRARRATAETELQRMEAELRDTL            376
```

A related DNA sequence was identified in S. pyogenes <SEQ ID 4551> which encodes the amino acid sequence <SEQ ID 4552>. Analysis of this protein sequence reveals the following:

Possible site: 55
>>> Seems to have no N-terminal signal sequence
----- Final Results -----
   bacterial cytoplasm --- Certainty = 0.3230 (Affirmative) <succ>
    bacterial membrane --- Certainty = 0.0000 (Not Clear) <succ>
     bacterial outside --- Certainty = 0.0000 (Not Clear) <succ>

An alignment of the GAS and GBS proteins is shown below.

Figure 304:
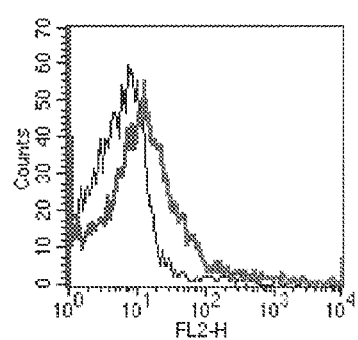

SEQ ID 4550 (GBS201) was expressed in E. coli as a His-fusion product. SDS-PAGE analysis of total cell extract is shown in FIG. 49 (lane 5; MW 49 kDa). It was also expressed in E. coli as a GST-fusion product. SDS-PAGE analysis of total cell extract is shown in FIG. 54 (lane 3; MW 74.5 kDa) and in FIG. 62 (lane 8 & 9; MW 74.5 kDa). The GBS201-GST fusion product was purified (FIG. 209, lane 9) and used to immunise mice. The resulting antiserum was used for FACS (FIG. 304), which confirmed that the protein is immunoaccessible on GBS bacteria.

Based on this analysis, it was predicted that these proteins and their epitopes could be useful antigens for vaccines or diagnostics.

Example 1481

A DNA sequence (GBSx1567) was identified in S. agalactiae <SEQ ID 4553> which encodes the amino acid sequence

```
Identities = 333/413 (80%), Positives = 379/413 (91%)
Query:   5  FNFDIDQIADNAITKTDKTTEIISNQTTSQTGQIAFFEKLTPAQKSAISEKTPALVDTFV   64
            FNFDIDQIADNA+ KTDKTT+IIS+  T   GQI+FFEKL+  Q++AI+ K PALVDTF+
Sbjct:   4  FNFDIDQIADNAVIKTDKTTDIISDLPTDTNGQISFFEKLSADQQTAITAKAPALVDTFL   63

Query:  65  GDQNALLDFGQSAVEGVNTTVNHILSEQKKIQIPQVDDLLKNANRELNGFIAKYKDATPA  124
             DQNALLDFGQSAVEGVN  TVNHIL+EQKK+QIPQVDDLLK+ NRELNGFIAKYKDATP
Sbjct:  64  ADQNALLDFGQSAVEGVNATVNHILAEQKKLQIPQVDDLLKSTNRELNGFIAKYKDATPV  123

Query: 125  ELEKKPNLIQKLFKQSKTSLQEFYFDSQNIEQKMDMMAANVVKQEDTLARNIVSAEMLIE  184
            +L+KKPN +QKLFKQS+  LQEFYFDSQNIEQKMD MAA VVKQEDTLARNIVSAE+LIE
Sbjct: 124  DLDKKPNFLQKLFKQSRDTLQEFYFDSQNIEQKMDSMAAAVVKQEDTLARNIVSAELLIE  183

Query: 185  DNTKSIENLVGVIAFIESSQAEAANRASHLQQEILALDSQTSEYQIKSNQLARMTEVINT  244
            DNTKSIE+LVGVIAFIE+SQ EA+ RA+ LQ+++    DS T +YQIK++ LAR TEVINT
Sbjct: 184  DNTKSIEHLVGVIAFIEASQKEASQRAAALQKDLKTKDSATPDYQIKADLLARTTEVINT  243

Query: 245  LEQQHPEYVSRLYVAWATTPQMRNLVKVSSDMRQKLGMLRRNTIPTMKLSIAQLGMMQQS  304
            LEQQH  EY+SRLYVAWATTPQMRNLVKVSSDMRQKLGMLRRNTIPTMKLSIAQLGMMQQS
Sbjct: 244  LEQQHTEYLSRLYVAWATTPQMRNLVKVSSDMRQKLGMLRRNTIPTMKLSIAQLGMMQQS  303

Query: 305  VKSGVTADAIVNANNAALQMLAETSKEAIPMLEKTAQSPTVSIKSVTALAESLVAQNNGI  364
            VKSG+TADAI+NANNAALQMLAETSKEAIP LE++AQ+PT+S+KSVT LAESLVAQNNGI
Sbjct: 304  VKSGMTADAIINANNAALQMLAETSKEAIPALEQSAQNPTLSMKSVTSLAESLVAQNNGI  363

Query: 365  IAAIDKGRKERAQLESAVIKSAETINDSVKIRDKKIVEALLNEGKSTQEKVDE          417
            IAAID GRKERAQLESA+I+SAETINDSVK+RD+ IV+ALL+EGK TQ+ +D+
Sbjct: 364  IAAIDHGRKERAQLESAIIRSAETINDSVKLRDQNIVQALLSEGKETQKTIDK          416
```

<SEQ ID 4554>. This protein is predicted to be rhoptry protein. Analysis of this protein sequence reveals the following:

```
Possible site: 27
>>> Seems to have an uncleavable N-term signal seq
INTEGRAL    Likelihood = -6.58    Transmembrane 13-29 (10-31)
INTEGRAL    Likelihood = -1.54    Transmembrane 33-49 (33-49)
----- Final Result -----
   bacterial membrane --- Certainty = 0.3633 (Affirmative) <succ>
      bacterial outside --- Certainty= 0.0000 (Not Clear) <succ>
         bacterial cytoplasm --- Certainty = 0.0000 (Not Clear) <succ>
```

The protein has no significant homology with any sequences in the GENPEPT database.

A related DNA sequence was identified in *S. pyogenes* <SEQ ID 4555> which encodes the amino acid sequence <SEQ ID 4556>. Analysis of this protein sequence reveals the following:

```
Possible site: 37
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>
```

The protein has no significant homology with any sequences in the GENPEPT database.

An alignment of the GAS and GBS proteins is shown below.

SEQ ID 4554 (GBS265) was expressed in *E. coli* as GST-fusion product. SDS-PAGE analysis of total cell extract is shown in FIG. 54 (lane 2; MW 56 kDa) and in FIG. 62 (lane 6; MW 56.3 kDa).

The GBS265-GST fusion product was purified (FIG. 207, lane 5) and used to immunise mice. The resulting antiserum was used for Western blot (FIG. 258A) and FACS (FIG. 258B). These tests confirm that the protein is immunoaccessible on GBS bacteria.

Based on this analysis, it was predicted that these proteins and their epitopes could be useful antigens for vaccines or diagnostics.

Example 1482

A DNA sequence (GBSx1568) was identified in *S. agalactiae* <SEQ ID 4557> which encodes the amino acid sequence <SEQ ID 4558>. This protein is predicted to be glutamate-cysteine ligase (gshA). Analysis of this protein sequence reveals the following:

```
Possible site: 40
>>> Seems to have no N-terminal signal sequence
INTEGRAL    Likelihood = -1.70    Transmembrane 575-591 (575-591)
----- Final Results -----
   bacterial membrane --- Certainty = 0.1680 (Affirmative) <succ>
      bacterial outside --- Certainty = 0.0000 (Not Clear) <succ>
         bacterial cytoplasm --- Certainty = 0.0000 (Not Clear) <succ>
```

```
Identities = 115/239 (48%), Positives = 162/239 (67%), Gaps = 3/239 (1%)
Query:  32 EVIATLLIIGGGYCAYYVYD-KKRLKRFTSNQRIEALKSDIKETDQDIRHLEILKKDNRS    90
            +++  + I G GY  + V   +KRL +    +++E LK+ I+  D+ +R L+     D+
Sbjct:  42 DILPAIAIGGIGYAIFRVRSHQKRLAKAKIAKQLEDLKAKIQLADRKVRLLDTYLADHDD   101

Query:  91 KEYIKLAHQILPQLDLIRNEANQLQKAIEPNIYKRITKKANTFSNEINEQLIKLHASPEL   150
            +Y   LA Q+LPQL  I+ +A  L+  ++P IY+RITKKAN    ++I  QL  L  + L
Sbjct: 102 FQYNVLAQQLLPQLSDIKAKAITLKDQLDPQIYRRITKKANDVESDITLQLETLQIATTL   161

Query: 151 --EPISDQEDEMIRIAPELKPFYHNIQDDHFAILKKIEEADNKAELAAIHQANMKRFTDV   208
              +P+     +I  APELKP+Y NIQ DH AIL KI+ ADN+ EL A+H ANM+RF D+
Sbjct: 162 NPQPLKTPSPNLINKAPELKPYYDNIQTDHQAILAKIQGADNQEELLALHDANMRRFEDI   221

Query: 209 LAGYIRIKQSPKNFNNAKERLEQALQAIKKFNLDLDETLRQLNESDMKDFDVSLRMMQG    267
            L GY++IK+ PKN+ NA  RLEQA QAI++F+ DLDETLR+LNESD+KDFD+SLR+MQG
Sbjct: 222 LTGYLKIKEEPKNYYNAAARLEQAKQAIQQFDEDLDETLRRLNESDLKDFDISLRIMQG    280
```

The protein has homology with the following sequences in the GENPEPT database.

```
>GP:AAG08588 GB:AE004933 glutamate--cysteine ligase [Pseudomonas aeruginosa]
Identities = 142/468 (30%), Positives = 220/468 (46%), Gaps = 62/468 (13%)
Query:  12 SHLPIL-QATFGLERESLRIHQPTQRVAQTPHPKTLGSRNYHPYIQTDYSEPQLELITPI    70
            ++LP+L +    G+ERE LR+       ++A TPHP+ LGS   HP I TDYSE  LE ITP
Sbjct:  16 ANLPLLTECLHGIERECLRVDSDG-KLALTPHPRALGSTLTHPQITTDYSEALLEFITPT    74

Query:  71 AKDSQEAIRFLKAISDVAGRSINHDEYLWPLSMPPKV-REEDIQIAQLEDA----FEYDY   125
            D  +  L+ I   A   ++  EYLW  SMP ++  EE I IA+   +    +Y Y
Sbjct:  75 ETDVADTLGDLERIHRFASSKLD-GEYLWSPSMPCELPDEESIPIARYGSSMIGRLKYVY   133

Query: 126 RKYLEKTYGKLIQSISGIHYNLGLGQELLTSLFELSQAD-NAIDFQNQLYMKLSQNFLRY   184
            RK L   YGK +Q I+GIHYN L + L     L +   ++ +  D+Q+  Y+ L +NF RY
Sbjct: 134 RKGLALRYGKTMQCIAGIHYNFSLPERLWPLLRQAEGSELSERDYQSAAYIALIRNFRRY   193
```

-continued

```
Query: 185  RWLLTYLYGASPVAEEDFLDQKLNNPVR------------SLRNSHLGYVNHKDIRIS--   230
            WLL YL+GASP   + FL + +   R            SLR S LGY N+     ++
Sbjct: 194  SWLLMYLFGASPALDAGFLRGRPSQLERLDEHTLYLPYATSLRMSDLGYONAQAGLTPC   253

Query: 231  YTSLKDYVNDLENAV--------------------KSGQLIAEKEFYSPVRLR-----G   264
            Y   L+ Y++ L AV                     + L  E E+YS +R +      G
Sbjct: 254  YNDLQSYIDSLRQAVSTPYPPYEKVGTKQDGEWVQLNTNILQIENEYYSSIRPKRVTYTG   313

Query: 265  SKACRNYLEKGITYLEFRTFDLNPFSPIGITQETVDTVHLFLLALLWIDS----------   314
              + +    +G+ Y+E R  D+NPF P+GI +    +  FLL      + DS
Sbjct: 314  ERPVQALAARGVQYVEVRCLDINPFLPLGIDLDEARFLDAFLLFCAFSDSPLLNGECSDA   373

Query: 315  SSHIDQDIKEANRLN-DLIALSHPLEKLPNQAPVSDLVDAMQSVIQHFNLSPYYQDLLES   373
            + +    +KE   R  L     P+E        + + +++            +  L +
Sbjct: 374  TDNFLAVVKEGRRPGLQLQRRGQPVELQVWANELLERIADTAALLDRARGGEAHAAALAA   433

Query: 374  VKRQIQSPELTVAGQLLEMI--EGLSLETFGQRQGQIYHDYAWEAPYA              419
            + ++      ELT + Q+L+++    G S  E F  RQ + + +Y  + P A
Sbjct: 434  QRAKVADAELTPSAQVLKVMRERGESFEAFSLRQSREHAEYFRQHPLA              481
```

There is also homology to SEQ ID 4560.

Based on this analysis, it was predicted that this protein and its epitopes, could be useful antigens for vaccines or diagnostics.

Example 1483

A DNA sequence (GBSx1569) was identified in *S. agalactiae* <SEQ ID 4561> which encodes the amino acid sequence <SEQ ID 4562>. Analysis of this protein sequence reveals the following:

---

Possible site: 59
>>> Seems to have no N-terminal signal sequence
----- Final Results -----
  bacterial cytoplasm --- Certainty = 0.1504 (Affirmative) <succ>
    bacterial membrane --- Certainty = 0.0000 (Not Clear) <succ>
    bacterial outside --- Certainty = 0.0000 (Not Clear) <succ>

---

The protein has homology with the following sequences in the GENPEPT database.

```
>GP:CAB73814 GB:AL139078 helix-turn-helix containing protein
[Campylobacter jejuni]
Identities = 107/223 (47%), Positives = 148/223 (65%), Gaps = 7/223 (3%)
Query:   1  MDKEKLDYWKTIITFLHNVLGDNYEIVLHVVDENDIYIGELVNSHISGRTISSPLTTFAL    60
            MD+ +   +  +  FL  VLG+ YEIV HV+ E+  YI  + NSHISGR++ SPLT FA
Sbjct:   1  MDEGQKQQFIKLTYFLGEVLGEQYEIVFHVITEDGAYIAAIANSHISGRSLDSPLTAFAS    60

Query:  61  DLIKNKVYKEKDFVTNYKAIVSPLNKEVRGSTFFIKNAQNELEGMLCINLDISAYQNIAL   120
            +L++NK Y EKDF+ +YKA+V   +K +RGSTFFIKN ++L G+LCIN D S  +++
Sbjct:  61  ELMQNKKYLEKDFLCDYKALVGK-SKLIRGSTFFIKN-HDKLVGILCINHDTSIMRDLIC   118

Query: 121  DILDLVNL-NVNKILPKSPQKISLPQQEEPVEVLSGNIQDIISEIVDPSLLNQNIHLSQE   179
               ++DL + ++  IL        IS  Q +   +E LS +I+DI+ +  VD S LN +   LS
Sbjct: 119  KMIDLEKIGDMGDIL----GNISFSQNDSSIETLSHSIEDILVQSVDSSYLNSDYQLSIT   174

Query: 180  VKVEIVSKLHEKGVFQLKGAVSKVAEVLNISEPSVYRYLKKIE                  222
             K EI   KL+EKG+F +KGAV  VA+ L ISEPSVYRYLKK +
Sbjct: 175  QKEEIAEKLYEKGIFNIKGAVPIVAKFLKISEPSVYRYLKKFK                  217
```

A related DNA sequence was identified in *S. pyogenes* <SEQ ID 4563> which encodes the amino acid sequence <SEQ ID 4564>. Analysis of this protein sequence reveals the following:

---

Possible site: 21
>>> Seems to have no N-terminal signal sequence
----- Final Results -----
  bacterial cytoplasm --- Certainty = 0.1636 (Affirmative) <succ>
    bacterial membrane --- Certainty = 0.0000 (Not Clear) <succ>
    bacterial outside --- Certainty = 0.0000 (Not Clear) <succ>

---

An alignment of the GAS and GBS proteins is shown below.

```
Identities = 169/224 (75%), Positives = 198/224 (87%), Gaps = 3/224 (1%)
Query:   1  MDKEKLDYWKTIITFLHNVLGDNYEIVLHVVDENDIYIGELVNSHISGRTISSPLTTFAL    60
            MDKE L+YWKT+ITFLH+VLGDNYEI+LHV+D+NDIYIGELVNSHISGR+  SPLTTFAL
Sbjct:   1  MDKETLNYWKTVITFLHDVLGDNYEIILHVIDKNDIYIGELVNSHISGRSKQSPLTTFAL    60
```

-continued

```
Query:   61 DLIKNKVYKEKDFVTNYKAIVSPLNKEVRGSTFFIKNAQNELEGMLCINLDISAYQNIAL  120
            DLI NKVYKEKDFVTNYKAIVSP +KEVRGSTFFIK+ +  LEGMLCINLDISAYQ +A
Sbjct:   61 DLITNKVYKEKDFVTNYKAIVSPQHKEVRGSTFFIKDKKGNLEGMLCINLDISAYQGVAR  120

Query:  121 DILDLVNLNVNKILP--KSPQKISLPQQEEPVEVLSGNIQDIISEIVDPSLLNQNIHLSQ  178
            D+L LVNLN+    +P  K P+ ++ PQ EE VE+L+ NIQDII +I+DPSLL  N+HLSQ
Sbjct:  121 DLLKLVNLNLEHFIPTAKEPKTVT-PQPEEAVEILTSNIQDIIGQIIDPSLLRHNVHLSQ  179

Query:  179 EVKVEIVSKLHEKGVFQLKGAVSKVAEVLNISEPSVYRYLKKIE                 222
            +VK++IV+KL+EKGVFQLKGAVSKVA++L ISEPSVYRYLKKIE
Sbjct:  180 DVKIDIVAKLYEKGVFQLKGAVSKVADILCISEPSVYRYLKKIE                 223
```

Based on this analysis, it was predicted that these proteins and their epitopes could be useful antigens for vaccines or diagnostics.

Example 1484

A DNA sequence (GBSx1570) was identified in *S. agalactiae* <SEQ ID 4565> which encodes the amino acid sequence <SEQ ID 4566>. This protein is predicted to be regulatory protein pfoR. Analysis of this protein sequence reveals the following:

Possible site: 37
>>> Seems to have a cleavable N-term signal seq.
INTEGRAL    Likelihood = −7.80    Transmembrane 299-315 (296-325)
INTEGRAL    Likelihood = −7.54    Transmembrane 172-188 (169-193)
INTEGRAL    Likelihood = −7.17    Transmembrane 71-87 (66-98)
INTEGRAL    Likelihood = −4.99    Transmembrane 261-277 (260-278)
INTEGRAL    Likelihood = −2.81    Transmembrane 128-144 (127-149)
INTEGRAL    Likelihood = −2.18    Transmembrane 101-117 (101-119)
INTEGRAL    Likelihood = −0.53    Transmembrane 198-214 (197-214)
----- Final Results -----
    bacterial membrane --- Certainty = 0.4121 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:CAA60239 GB:X86525 pfoS [Clostridium perfringens]
Identities = 96/147 (65%), Positives = 122/147 (82%)
Query:  100 GTGIIPGFLAGYLVGFLVKWMERNIPGGLDLISIIIIGAPLTRLVAELLTPLINSTLLTI  159
            G GI+PGF+AGYL  F++K++E+ IP GLDLI II++GAPL R +A +  PL+ +TL I
Sbjct:    1 GFGILPGFIAGYLGSFVIKFLEKKIPAGLDLIVIIVLGAPLVRGIAAISNPLVETTLQNI   60

Query:  160 GDILTSGAHSNPILMGIILGGTIVVVATAPLSSMALTAMLGLTGMPMAIGALSVFGSSFM  219
            G ++T+ +  ++PI+MGIILGG + VVATAPLSSMALTAMLGLTG+PMAIGAL+VFGSSFM
Sbjct:   61 GGVITATSTASPIMMGIILGGIVTVVATAPLSSMALTAMLGLTGLPMAIGALAVFGSSFM  120

Query:  220 NGVLFHKLKLGSRKDNIAFAVEPLTQA                                  246
            N V F K+K GS+KD IA A+EPLTQA
Sbjct:  121 NLVFFGKMKFGSKKDTIAVAIEPLTQA                                  147
```

A related DNA sequence was identified in *S. pyogenes* <SEQ ID 4567> which encodes the amino acid sequence <SEQ ID 4568>. Analysis of this protein sequence reveals the following:

Possible site: 37
>>> Seems to have a cleavable N-term signal seq.
INTEGRAL    Likelihood = −8.70    Transmembrane 303-319 (296-325)
INTEGRAL    Likelihood = −7.11    Transmembrane 70-86 (66-98)
INTEGRAL    Likelihood = −6.53    Transmembrane 172-188 (169-193)
INTEGRAL    Likelihood = −4.83    Transmembrane 261-277 (260-278)
INTEGRAL    Likelihood = −2.55    Transmembrane 101-117 (101-119)
INTEGRAL    Likelihood = −2.28    Transmembrane 124-140 (124-140)
INTEGRAL    Likelihood = −1.91    Transmembrane 198-214 (197-215)
----- Final Results -----
    bacterial membrane --- Certainty = 0.4482 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:CAA60239 GB:X86525 pfoS [Clostridium perfringens]
Identities = 95/147 (64%), Positives = 123/147 (83%)
Query:  100 GTGIIPGFVAGYVVSFLIKWMEKNIPGGLDLISIIIVGAPLTRFLAQLITPVINSTLLTI  159
            G GI+PGF+AGY+ SF+IK++EK IP GLDLI II++GAPL R +A +  P++ +TL I
Sbjct:    1 GFGILPGFIAGYLGSFVIKFLEKKIPAGLDLIVIIVLGAPLVRGIAAISNPLVETTLQNI   60

Query:  160 GDILTSSANSNPIIMGMILGGTIVVVATAPLSSMALTAMLGLTGIPMAIGALSVFGSSFM  219
            G ++T+++ ++PI+MG+ILGG + VVATAPLSSMALTAMLGLTG+PMAIGAL+VFGSSFM
Sbjct:   61 GGVITATSTASPIMMGIILGGIVTVVATAPLSSMALTAMLGLIGLPMAIGALAVFGSSFM  120
```

-continued

```
Query: 220  NGVLFYRLKLGERKDNIAFAIEPLTQA                              246
            N V F ++K G +KD IA AIEPLTQA
Sbjct: 121  NLVFFGKMKFGSKRDTIAVAIEPLTQA                              147
```

An alignment of the GAS and GBS proteins is shown below.

```
Identities = 302/339 (89%), Positives = 330/339 (97%)
Query:   1  MNIIIGTSLLILVLAIFTLFNYKAPYGTKAMGALASAACASFLVEAFQDSFFGKVLGFQF   60
            M+IIIGTSLLILVLAIF+LFNYKAP+G KAMGALASAACASFLVEAFQDSFFGKVLGFQF
Sbjct:   1  MDIIIGTSLLILVLAIFSLFNYKAPHGAKAMGALASAACASFLVEAFQDSFFGKVLGFQF   60

Query:  61  LSEVGGANGSLSGVAAAILVAIAIGVTPGYAVLIGLSVSGTGIIPGFLAGYLVGFLVKWM  120
            LSEVGGANGSLSGVAAAILVAIAIGV+PGYAVLIGLSVSGTGIIPGF+AGY+V FL+KWM
Sbjct:  61  LSEVGGANGSLSGVAAAILVAIAIGVSPGYAVLIGLSVSGTGIIPGFVAGYVVSFLIKWM  120

Query: 121  ERNIPGGLDLISIIIIGAPLTRLVAKLLTPLINSTLLTIGDILTSGAHSNPILMGIILGG  180
            E+NIPGGLDLISIII+GAPLTR +A+L+TP+INSTLLTIGDILTS A+SNPI+MG+ILGG
Sbjct: 121  EKNIPGGLDLISIIIVGAPLTRFLAQLITPVINSTLLTIGDILTSSANSNPIIMGMILGG  180

Query: 181  TIVVVATAPLSSMALTAMLGLTGMPMAIGALSVFGSSFMNGVLFHKLKLGSRKDNIAFAV  240
            TIVVVATAPLSSMALTAMLGLTG+PMAIGALSVFGSSFMNGVLF++LKLG RKDNIAFA+
Sbjct: 181  TIVVVATAPLSSMALTAMLGLTGIPMAIGALSVFGSSFMNGVLFYRLKLGERKDNIAFAI  240

Query: 241  EPLTQADVTSANPIPIYVTNFVGGAACGILIALMKLVNDTPGTATPIAGFAVMFAYNPMI  300
            EPLTQADVTSANPIPIYVTNFVGGAACG+LIALMKLVNDTPGTATPIAGFAVMFAYNP+
Sbjct: 241  EPLTQADVTSANPIPIYVTNFVGGAACGVLIALMKLVNDTPGTATPIAGFAVMFAYNPVA  300

Query: 301  KVLITALGCIILSLLAGYFGGIVFKDYKLVTKEELQARD                      339
            KVLITALGCII+SL+ GY GG VFK+Y+LVTK+ELQAR+
Sbjct: 301  KVLITALGCIIISLIVGYIGGSVFKNYRLVTKQELQARN                      339
```

Based on this analysis, it was predicted that these proteins and their epitopes could be useful antigens for vaccines or diagnostics.

Example 1485

A DNA sequence (GBSx1571) was identified in *S. agalactiae* <SEQ ID 4569> which encodes the amino acid sequence <SEQ ID 4570>. This protein is predicted to be adenylosuccinate synthetase (purA). Analysis of this protein sequence reveals the following:

Possible site: 27
>>> Seems to have no N-terminal signal sequence

----- Final Results -----
bacterial cytoplasm --- Certainty = 0.0560 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:CAB16079 GB:Z99124 adenylosuccinate synthetase [Bacillus subtilis]
Identities = 320/427 (74%), Positives = 378/427 (87%)
Query:   1  MTSVVVVGTQWGDEGKGKITDFLSADAEVIARYQGGDNAGHTIVIDNKKFKLHLIPSGIF   60
            M+SVVVVGTQWGDEGKGKITDFLS +AEVIARYQGG+NAGHTI  D   +KLHLIPSGIF
Sbjct:   1  MSSVVVVGTQWGDEGKGKITDFLSENAEVIARYQGGNNAGHTIKFDGITYKLHLIPSGIF   60

Query:  61  FKEKISVIGNGVVVNPKSLVKELAYLHGEGVTTDNLRISDRAHVILPYHIKLDQLQEDAK  120
            +K+K  VIGNG+VV+PK+LV ELAYLH   V+TDNLRIS+RAHVILPYH+KLD+++E+ K
Sbjct:  61  YKDKTCVIGNGMVVDPKALVTELAYLHERNVSTDNLRISNRAHVILPYHLKLDEVEEERK  120

Query: 121  GDNKIGTTIKGIGPAYMDKAARVGIRIADLLDREVFAERLKINLAEKNRLFEKMYDSTPL  180
            G NKIGTT KGIGPAYMDKAAR+GIRIADLLDR+ FAE+L+ NL EKNRL EKMY++
Sbjct: 121  GANKIGTTKKGIGPAYMDKAARIGIRIADLLDRDAFAEKLERNLEEKNRLLEKMYETEGF  180

Query: 181  EFDDIFEEYYEYGQQIKQYVTDTSVILNDALDAGKRVLFEGAQGVMLDIDQGTYPFVTSS  240
            + +DI +EYYEYGQQIK+YV DTSV+LNDALD G+RVLFEGAQGVMLDIDQGTYPFVTSS
Sbjct: 181  KLEDILDEYYEYGQQIKKYVCDTSVVINDALDEGRRVLFEGAQGVMLDIDQGTYPFVTSS  240

Query: 241  NPVAGGVTIGSGVGPSKINKVVGVCKAYTSRVGDGPFPTELFDEVGDRIREIGKEYGTTT  300
            NPVAGGVTIGSGVGP+KI  VVGV KAYT+RVGDGPFPTEL DE+GD+IRE+G+EYGTTT
Sbjct: 241  NPVAGGVTIGSGVGPTKIKHVVGVSKAYTTRVGDGPFPTELKDEIGDQIREVGREYGTTT  300
```

-continued

```
Query: 301  GRPRRVGWFDSVVMRHSRRVSGITNLSLNSIDVLSGLDTVKICVAYDLDGKRIDYYPASL   360
            GRPRRVGWFDSVV+RH+RRVSGIT+LSLNSIDVL+G++T+KICVAY   G+ I+ +PASL
Sbjct: 301  GRPRRVGWFDSVVVRHARRVSGITDLSLNSIDVLAGIETLKICVAYRYKGEIIEEFPASL   360

Query: 361  EQLKRCKPIYEELPGWSEDITACRSLDDLPENARNYVRRVGELVGVRISTFSVGPGREQT   420
            + L  C+P+YEE+PGW+EDIT   +SL +LPENAR+Y+ RV +L G+ +S FSVGP R QT
Sbjct: 361  KALAECEPVYEEMPGWTEDITGAKSLSELPENARHYLERVSQLTGIPLSIFSVGPDRSQT   420

Query: 421  NILESVW   427
            N+L SV+
Sbjct: 421  NVLRSVY   427
```

A related DNA sequence was identified in *S. pyogenes* <SEQ ID 4571> which encodes the amino acid sequence <SEQ ID 4572>. Analysis of this protein sequence reveals the following:

Possible site: 27
>>> Seems to have no N-terminal signal sequence
----- Final Results -----
   bacterial cytoplasm --- Certainty = 0.0560 (Affirmative) <succ>
     bacterial membrane --- Certainty = 0.0000 (Not Clear) <succ>
        bacterial outside --- Certainty = 0.0000 (Not Clear) <succ>

Possible site: 46
>>> Seems to have no N-terminal signal sequence
INTEGRAL   Likelihood = −9.29   Transmembrane 30-46 (22-55)
INTEGRAL   Likelihood = −2.97   Transmembrane 110-126 (109-126)
INTEGRAL   Likelihood = −0.11   Transmembrane 89-105 (89-106)
----- Final Results -----
   bacterial membrane --- Certainty = 0.4715 (Affirmative) <succ>
     bacterial outside --- Certainty = 0.0000 (Not Clear) <succ>
        bacterial cytoplasm --- Certainty = 0.0000 (Not Clear) <succ>

An alignment of the GAS and GBS proteins is shown below.

A related GBS nucleic acid sequence <SEQ ID 8823> which encodes amino acid sequence <SEQ ID 8824> was also identified. Analysis of this protein sequence reveals the following:

```
Identities = 406/430 (94%), Positives = 421/430 (97%)
Query:   1  MTSVVVVGTQWGDEGKGKITDFLSADAEVIARYQGGDNAGHTIVIDNKKFKLHLIPSGIF    60
            MTSVVVVGTQWGDEGKGKITDFLSADAEVIARYQGGDNAGHTIVID KKFKLHLIPSGIF
Sbjct:   1  MTSVVVVGTQWGDEGKGKITDFLSADAEVIARYQGGDNAGHTIVIDGKKFKLHLIPSGIF    60

Query:  61  FKEKISVIGNGVVVNPKSLVKELAYLHGEGVTTDNLRISDRAHVILPYHIKLDQLQEDAK   120
            F +KISVIGNGVVVNPKSLVKELNYLH EGVTTDNLRISDRAHVILPYHI+LDQLQEDAK
Sbjct:  61  FPQKISVIGNGVVVNPKSLVKELAYLHDEGVTTDNLRISDRAHVILPYHIQLDQLQEDAK   120

Query: 121  GDNKIGTTIKGIGPAYMDKAARVGIRIADLLDREVFAERLKINLAEKNRLFEKMYDSTPL   180
            GDNKIGTTIKGIGPAYMDKAARVGIRIADLLD+++FAERL+INLAEKNRLFEKMYDSTPL
Sbjct: 121  GDNKIGTTIKGIGPAYMDKAARVGIRIADLLDKDIFAERLRINLAEKNRLFEKMYDSTPL   180

Query: 181  EFDDIFEEYYEYGQQIKQYVTDTSVILNDALDAGKRVLFEGAQGVMLDIDQGTYPFVTSS   240
            +FD IFEEYY YGQ+IKQYVTDTSVILNDALDAGKRVLFEGAQGVMLDIDQGTYPFVTSS
Sbjct: 181  DFDAIFEEYYAYGQEIKQYVTDTSVILNDALDAGKRVLFEGAQGVMLDIDQGTYPFVTSS   240

Query: 241  NPVAGGVTIGSGVGPSKINKVVGVCKAYTSRVGDGPFPTELFDEVGDRIREIGKEYGTTT   300
            NPVAGGVTIGSGVGP+KINKVVGVCKAYTSRVGDGPFPTELFDEVG+RIRE+G EYGTTT
Sbjct: 241  NPVAGGVTIGSGVGPNKINKVVGVCKAYTSRVGDGPFPTELFDEVGERIREVGHEYGTTT   300

Query: 301  GRPRRVGWFDSVVMRHSRRVSGITNLSLNSIDVLSGLDTVKICVAYDLDGKRIDYYPASL   360
            GRPRRVGWFDSVVMRHSRRVSGITNLSLNSIDVLSGLDTVKICVAYDLDGKRIDYYPA+L
Sbjct: 301  GRPRRVGWFDSVVMRHSRRVSGITNLSLNSIDVLSGLDTVKICVAYDLDGKRIDYYPANL   360

Query: 361  EQLKRCKPIYEELPGWSEDITACRSLDDLPENARNYVRRVGELVGVRISTFSVGPGREQT   420
            EQLKRCKPIYEELPGW EDIT   RSLD+LPENARNYVRRVGELVGVRISTFSVGPGREQT
Sbjct: 361  EQLKRCKPIYEELPGWQEDITGVRSLDELPENARNYVRRVGELVGVRISTFSVGPGREQT   420

Query: 421  NILESVWSNI   430
            NILESVW++I
Sbjct: 421  NILESVWASI   430
```

Based on this analysis, it was predicted that these proteins and their epitopes could be useful antigens for vaccines or diagnostics.

Example 1486

A DNA sequence (GBSx1572) was identified in *S. agalactiae* <SEQ ID 4573> which encodes the amino acid sequence <SEQ ID 4574>. Analysis of this protein sequence reveals the following:

Lipop Possible site: −1   Crend: 10
SRCFLG: 0
McG: Length of UR: 5
Peak Value of UR: 3.05
Net Charge of CR: 0
McG: Discrim Score: 4.64
GvH: Signal Score (−7.5): −1.66
Possible site: 36
>>> Seems to have a cleavable N-term signal seq.
Amino Acid Composition: calculated from 37
ALOM program   count: 2 value: −2.97 threshold: 0.0

INTEGRAL    Likelihood = −2.97    Transmembrane 100-116 (99-116)
PERIPHERAL  Likelihood = 1.38     56
modified ALOM score:   1.09
icm1 HYPID: 7    CFP: 0.219
*** Reasoning Step: 3
----- Final Results -----
    bacterial membrane --- Certainty = 0.2190 (Affirmative) <succ>
        bacterial outside --- Certainty = 0.0000 (Not Clear) <succ>
            bacterial cytoplasm --- Certainty = 0.0000 (Not Clear) <succ>

The protein has no significant homology with any sequences in the GENPEPT database and no corresponding DNA sequence was identified in *S. pyogenes*.

Based on this analysis, it was predicted that these proteins and their epitopes could be useful antigens for vaccines or diagnostics.

Example 1487

A DNA sequence (GBSx1573) was identified in *S. agalactiae* <SEQ ID 4575> which encodes the amino acid sequence <SEQ ID 4576>. Analysis of this protein sequence reveals the following:

Possible site: 15
>>> Seems to have no N-terminal signal sequence
----- Final Results -----
    bacterial cytoplasm --- Certainty = 0.0967 (Affirmative) <succ>
        bacterial membrane --- Certainty = 0.0000 (Not Clear) <succ>
            bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1488

A DNA sequence (GBSx1574) was identified in *S. agalactiae* <SEQ ID 4577> which encodes the amino acid sequence <SEQ ID 4578>. This protein is predicted to be SgaT protein (sgaT). Analysis of this protein sequence reveals the following:

Possible site: 43
>>> Seems to have no N-terminal signal sequence
INTEGRAL    Likelihood = −7.80    Transmembrane 441-457 (436-464)
INTEGRAL    Likelihood = −7.64    Transmembrane 344-360 (339-376)
INTEGRAL    Likelihood = −6.58    Transmembrane 403-419 (392-422)
INTEGRAL    Likelihood = −6.48    Transmembrane 237-253 (235-261)
INTEGRAL    Likelihood = −5.79    Transmembrane 105-121 (99-127)
INTEGRAL    Likelihood = −5.52    Transmembrane 138-154 (137-155)
INTEGRAL    Likelihood = −4.78    Transmembrane 18-34 (14-38)
INTEGRAL    Likelihood = −2.97    Transmembrane 365-381 (365-383)
INTEGRAL    Likelihood = −0.69    Transmembrane 41-57 (41-57)
INTEGRAL    Likelihood = −0.16    Transmembrane 160-176 (160-176)
----- Final Results -----
    bacterial membrane --- Certainty = 0.4121 (Affirmative) <succ>
        bacterial outside --- Certainty = 0.0000 (Not Clear) <succ>
            bacterial cytoplasm --- Certainty = 0.0000 (Not Clear) <succ>

The protein has homology with the following sequences in the GENPEPT database.

```
>GP:AAC77150 GB:AE000491 orf, hypothetical protein [Escherichia coli K12]
Identities = 181/451 (40%), Positives = 274/451 (60%), Gaps = 25/451 (5%)
Query:   11  FSQNILQNPAFFVGLLVLIGYLLLKKPLHDVFAGFIKATVGYLILNVGAGGLVNTFRPIL      70
             F    ++ N    +G++   +GY+LL+K +   +   G IK  +G+++L   G+G L  +TF+P++
Sbjct:   30  FFNQVMTNAPLLLGIVTCLGYILLRKSVSVIIKGTIKTIIGFMLLQAGSGILTSTFKPVV      89

Query:   71  VALAKKFNLEAAVIDPYFGLASANAKLETMG-FISVATTALLIGFGINILLVALRKVTKV     129
             +++ + +   A+ D Y   AS   A ++ MG    S    A+L+   +NI    V LR++T +
Sbjct:   90  AKMSEVYGINGAISDTY---ASMMATIDRMGDAYSWVGYAVLLALALNICYVLLRRITGI     146

Query:  130  RTLFITGHIMVQQAATISVFVLLLIPQLRNGFGAWAV----GIICGLYWAVSSNMTVEAT     185
             RT+ +TGHIM QQA   I+V + +           G+    W        I+   LYW ++SNM  +   T
Sbjct:  147  RTIMLTGHIMFQQAGLIAVTLFIF------GYSMWTTIICTAILVSLYWGITSNMMYKPT     200

Query:  186  QRLTGGGGFAIGHQQQFAIWFVDKVAPFFGKKEENLDNLKLPTFLNIFHDTVVASATLML     245
             Q +T G  GF+IGHQQQFA W   KVAPF GKKEE++++LKLP +LNIFHD +V++A +M
Sbjct:  201  QEVTDGCGFSIGHQQQFASWIAYKVAPFLGKKEESVEDLKLPGWLNIFHDNIVSTAIVMT     260

Query:  246  VFFGGILAVLGPDIMSNVKLIGPGAFVPTKQAFFMYILQTSLTFSVYLFILMQGVRMFVT     305
             +FFG IL    G D +              +  K  + +YILQT  +F+V  +FI+ QGVRMFV
Sbjct:  261  IFFGAILLSFGIDTVQ---------AMAGKVHWTVYILQTGFSFAVAIFIITQGVRMFVA     311

Query:  306  ELTNAFQGISNKLLPGSFPAVDVAASYGFGSSNAVLSGFAFGLIGQLITIALLVVFKNPI     365
             EL+  AF GIS +L+PG+    A+D AA  Y F +  NAV+ GF  +G IGQLI  +  +LV      +  I
Sbjct:  312  ELSEAFNGISQRLIPGAVLAIDCAAIYSF-APNAVVWGFPMWGTIGQLIAVGILVACGSSI     370

Query:  366  LIITGFVPVFFDNAAIAVYADKRGGWKAAVALSFISGIIQVALGAVAVGLLGLAGGYHGN     425
             LII  GF+P+FF  NA I V+AA   GGW+AA+  +    +  G+I++         AV L  G++   +  G
Sbjct:  371  LIIPGFIPMFFSNATIGVFANHFGGWRAALKICLVMGMIEIFGCVWAVKLTGMS-AWMGM     429

Query:  426  IDFEFPWLAFGYIFKYLGIAGYVIVCLFFLA                              456
                D+         F   +GIA  ++    + LA
Sbjct:  430  ADWSILAPPMMQGFFSIGIAFMAVIIVIALA                              460
```

A related DNA sequence was identified in *S. pyogenes* <SEQ ID 4579> which encodes the amino acid sequence <SEQ ID 4580>. Analysis of this protein sequence reveals the following:

Possible site: 43
>>> Seems to have no N-terminal signal sequence

| | | |
|---|---|---|
| INTEGRAL | Likelihood = −10.51 | Transmembrane 441-457 (435-465) |
| INTEGRAL | Likelihood = −7.80 | Transmembrane 344-360 (339-376) |
| INTEGRAL | Likelihood = −7.64 | Transmembrane 238-254 (235-261) |
| INTEGRAL | Likelihood = −5.63 | Transmembrane 105-121 (100-127) |
| INTEGRAL | Likelihood = −5.52 | Transmembrane 138-154 (137-155) |
| INTEGRAL | Likelihood = −5.20 | Transmembrane 400-416 (392-422) |
| INTEGRAL | Likelihood = −4.78 | Transmembrane 18-34 (14-39) |
| INTEGRAL | Likelihood = −2.97 | Transmembrane 365-381 (365-383) |
| INTEGRAL | Likelihood = −1.49 | Transmembrane 160-176 (160-177) |
| INTEGRAL | Likelihood = −0.53 | Transmembrane 41-57 (41-57) |

----- Final Results -----
bacterial membrane --- Certainty = 0.5203 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the databases:

```
>GP:AAC77150 GB:AE000491 orf, hypothetical protein [Escherichia coli]
Identities = 182/461 (39%), Positives = 279/461 (60%), Gaps = 25/461 (5%)
Query:   1 MEMLLAPLNWFSQNILQNPAFFVGLLVLIGYLLLKKPIYEVFAGFVKATVGYLILNVGAG    60
           ME+L       F   ++ N   +G++   +GY+LL+K   +    G +K  +G+++L   G+G
Sbjct:  20 MEILYNIFTVFFNQVMTNAPLLLGIVTCLGYILLRKSVSVIIKGTIKTIIGFMLLQAGSG    79

Query:  61 GLVTTFRPILVALAKKFELKAAVIDPYFGLAAANTKLEEMG-FISVATTALLIGFGVNIL   119
           L +TF+P++   +++ + +    A+  D Y   + A     ++ MG   S    A+L+   +NI
Sbjct:  80 ILTSTFKPVVAKMSEVYGINGAISDTYASMMAT---IDRMGDAYSWVGYAVLLALALNIC   136

Query: 120 LVALRKVTKVRTLFITGHIMVQQAATISVFVLLLIPQFQNAFGAWAV----GIICGLYWA   175
             V LR++T +RT+ +TGHIM QQA  I+V + +      + W          I+   LYW
Sbjct: 137 YVLLRRITGIRTIMLTGHIMFQQAGLIAVTLFIF------GYSMWTTIICTAILVSLYWG   190

Query: 176 ISSNMTVEATQRLTGGGGFAIGHQQQFAIWFVDKVAPFFGKKEENLDNLKLPTFLNIFHD   235
           I+SNM   + TQ +T G GF+IGHQQQFA W    KVAPF GKKEE++++LKLP +LNIFHD
Sbjct: 191 ITSNMMYKPTQEVTDGCGFSIGHQQQFASWIAYKVAPFLGKKEESVEDLKLPGWLNIFHD   250

Query: 236 TVVASATLMLVFFGAILAVLGPDIMSDVDLIGPGAFNPAKQAFFMYILQTSLTFSVYLFI   295
           +V++A +M +FFGAIL    G D +  +               K  + +YILQT  +F+V  +FI
Sbjct: 251 NIVSTAIVMTIFFGAILLSFGIDTVQAM---------AGKVHWTVYILQTGFSFAVAIFI   301

Query: 296 LMQGVRMFVSELTNAFQGISSKLLPGSFPAVDVAASYGFGSSNAVLSGFAFGLIGQLITI   355
           + QGVRMFV+EL+ AF GIS +L+PG+  A+D AA Y F + NAV+ GF +G IGQLI +
Sbjct: 302 ITQGVRMFVAELSEAFNGISQRLIPGAVLAIDCAAIYSF-APNAVVWGFMWGTIGQLIAV   360

Query: 356 ALLVIFKNPILIITGFVPVFFDNAAIAVYADKRGGWKAAVALSFISGILQVALGAVAVGL   415
            +LV   + ILII GF+P+FF NA I V+A+     GGW+AA+  +   + G++++       AV L
Sbjct: 361 GILVACGSSILIIPGFIPMFFSNATIGVFANHFGGWRAALKICLVMGMIEIFGCVWAVKL   420

Query: 416 LGLTGGYHGNIDLVLPWLPFGYLFKFLGIAGYVLVCIFLLA                       456
           G++    + G D   +   P     F   +GIA    ++ +    LA
Sbjct: 421 TGMS-AWMGMADWSILAPPMMQGFFSIGIAFMAVIIVIALA                       460
```

An alignment of the GAS and GBS proteins is shown below.

```
Identities = 437/476 (91%), Positives = 457/476 (95%)
Query:   1 MENFLAPLNWFSQNILQNPAFFVGLLVLIGYLLLKKPLHDVFAGFIKATVGYLILNVGAG    60
           ME  LAPLNWFSQNILQNPAFFVGLLVLIGYLLLKKP+++VFAGF+KATVGYLILNVGAG
Sbjct:   1 MEMLLAPLNWFSQNILQNPAFFVGLLVLIGYLLLKKPIYEVFAGFVKATVGYLILNVGAG    60

Query:  61 GLVNTFRPILVALAKKFNLEAAVIDPYFGLASANAKLETMGFISVATTALLIGFGINILL   120
           GLV TFRPILVALAKKF L+AAVIDPYFGLA+AN KLE MGFISVATTALLIGFG+NILL
Sbjct:  61 GLVTTFRPILVALAKKFELKAAVIDPYFGLAAANTKLEEMGFISVATTALLIGFGVNILL   120

Query: 121 VALRKVTKVRTLFITGHIMVQQAATISVFVLLLIPQLRNGFGAWAVGIICGLYWAVSSNM   180
           VALRKVTKVRTLFITGHIMVQQAATISVFVLLLIPQ +N FGAWAVGIICGLYWA+SSNM
Sbjct: 121 VALRKVTKVRTLFITGHIMVQQAATISVFVLLLIPQFQNAFGAWAVGIICGLYWAISSNM   180

Query: 181 TVEATQRLTGGGGFAIGHQQQFAIWFVDKVAPFFGKKEENLDNLKLPTFLNIFHDTVVAS   240
           TVEATQRLTGGGGFAIGHQQQFAIWFVDKVAPFFGKKEENLDNLKLPTFLNIFHDTVVAS
Sbjct: 181 TVEATQRLTGGGGFAIGHQQQFAIWFVDKVAPFFGKKEENLDNLKLPTFLNIFHDTVVAS   240

Query: 241 ATLMLVFFGGILAVLGPDIMSNVELIGPGAFVPTKQAFFMYILQTSLTFSVYLFILMQGV   300
           ATLMLVFFG ILAVLGPDIMS+V LIGPGAF P KQAFFMYILQTSLTFSVYLFILMQGV
Sbjct: 241 ATLMLVFFGAILAVLGPDIMSDVDLIGPGAFNPAKQAFFMYILQTSLTFSVYLFILMQGV   300

Query: 301 RMFVTELTNAFQGISNKLLPGSFPAVDVAASYGFGSSNAVLSGFAFGLIGQLITIALLVV   360
           RMFV+ELTNAFQGIS+KLLPGSFPAVDVAASYGFGSSNAVLSGFAFGLIGQLITIALLV+
Sbjct: 301 RMFVSELTNAFQGISSKLLPGSFPAVDVAASYGFGSSNAVLSGFAFGLIGQLITIALLVI   360
```

```
Query: 361  FKNPILIITGFVPVFFDNAAIAVYADKRGGWKAAVALSFISGIIQVALGAVAVGLLGLAG    420
            FKNPILIITGFVPVFFDNAAIAVYADKRGGWKAAVALSFISGI+QVALGAVAVGLLGL G
Sbjct: 361  FKNPILIITGFVPVFFDNAAIAVYADKRGGWKAAVALSFISGILQVALGAVAVGLLGLTG    420

Query: 421  GYHGNIDFEFPWLAFGYIFKYLGIAGYVIVCLFFLAIPQLQFMKSKDKEAYYRGDA        476
            GYHGNID  PWL FGY+FK+LGIAGYV+VC+F LAIPQLQF K+KDKEAYYRG+A
Sbjct: 421  GYHGNIDLVLPWLPFGYLFKFLGIAGYVLVCIFLLAIPQLQFAKAKDKEAYYRGEA        476
```

Based on this analysis, it was predicted that these proteins and their epitopes could be useful antigens for vaccines or diagnostics.

Example 1489

A DNA sequence (GBSx1575) was identified in *S. agalactiae* <SEQ ID 4581> which encodes the amino acid sequence <SEQ ID 4582>. Analysis of this protein sequence reveals the following:

Possible site: 37
>>> Seems to have no N-terminal signal sequence
----- Final Results -----
bacterial cytoplasm --- Certainty = 0.1225 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:AAG34743 GB:AE000033 similar to PTS system: EIIB
[Mycoplasma pneumoniae]
Identities = 40/89 (44%), Positives = 62/89 (68%), Gaps = 1/89 (1%)
Query:  4  VLTACGNGMGSSMVIKMKVENALRQLGVSNFESASCSVGEAKGLAANYDIVVASNHLIHE  63
           ++ ACGNGMG+SM+IK+KVE   +++LG +    A  S+G+ KG+  + DI+++S HL  E
Sbjct:  8  IIAACGNGMGTSMLIKIKVEKIMKELGYTAKVEA-LSMGQTKGMEHSADIIISSIHLTSE  66

Query: 64  LDGRTKGHLVGLDNLMDDNEIKTKLQEIL                                92
           +   K  +VG+ NLMD+NEIK   L ++L
Sbjct: 67  FNPNAKAKIVGVLNLMDENEIKQALSKVL                                95
```

A related DNA sequence was identified in *S. pyogenes* <SEQ ID 4583> which encodes the amino acid sequence <SEQ ID 4584>. Analysis of this protein sequence reveals the following:

Possible site: 42
>>> Seems to have no N-terminal signal sequence
----- Final Results -----
bacterial cytoplasm --- Certainty = 0.0977 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 85/92 (92%), Positives = 90/92 (97%)
Query:  1  MVKVLTACGNGMGSSMVIKMKVENALRQLGVSNFESASCSVGEAKGLAANYDIVVASNHL  60
           MVKVLTACGNGMGSSMVIKMKVENALRQLGV++ +SASCSVGEAKGLA+ YDIVVASNHL
Sbjct:  1  MVKVLTACGNGMGSSMVIKMKVENALRQLGVTDIQSASCSVGEAKGLASGYDIVVASNHL  60

Query: 61 IHELDGRTKGHLVGLDNLMDDNEIKTKLQEIL                              92
          IHELDGRTKGHLVGLDNLMDDNEIKTKLQE+L
Sbjct: 61 IHELDGRTKGHLVGLDNLMDDNEIKTKLQEVL                              92
```

Based on this analysis, it was predicted that these proteins and their epitopes could be useful antigens for vaccines or diagnostics.

Example 1490

A DNA sequence (GBSx1576) was identified in *S. agalactiae* <SEQ ID 4585> which encodes the amino acid sequence <SEQ ID 4586>. This protein is predicted to be a pentitol phosphotransferase enzyme ii, a component (ptxA). Analysis of this protein sequence reveals the following:

Possible site: 38
>>> Seems to have no N-terminal signal sequence
----- Final Results -----
bacterial cytoplasm --- Certainty = 0.3309 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:AAC77152 GB:AE000491 putative PTS system enzyme II A component
[Escherichia coli K12]
Identities = 64/150 (42%), Positives = 97/150 (64%), Gaps = 2/150 (1%)
Query:   1 MNLKQAFIENDSIRLKLSASDWKEAIKLSIDPLIESGAVDAEYYDAIIESTEEFGPYYIL    60
           M L+ +  EN SIRL+  A  W+EA+K+ +D L+ +  V+  YY AI++  E+FGPY+++
Sbjct:   1 MKLRDSLAENKSIRLQAEAETWQEAVKIGVDLLVAADVVEPRYYQAILDGVEQFGPYFVI    60

Query:  61 MPGMAMPHARPEAGVKRDAFSLITLTEPVVF--PDGKEVSVLLALAATSSAIHTSVAIPQ   118
           PG+AMPH RPE GVK+  FSL+TL +P+ F   D   V +L+  +AA  + H  V I Q
Sbjct:  61 APGLAMPHGRPEEGVKKTGFSLVTLKKPLEFNHDDNDPVDILITMAAVDANTHQEVGIMQ   120

Query: 119 IIALFELENSIQRLTECQEAKEVLAMVEES                                148
           I+ LFE E +  RL   C+   +EVL +++ +
Sbjct: 121 IVNLFEDEENFDRLRACRTEQEVLDLIDRT                                150
```

A related DNA sequence was identified in *S. pyogenes* <SEQ ID 4587> which encodes the amino acid sequence <SEQ ID 4588>. Analysis of this protein sequence reveals the following:

Possible site: 42
>>> Seems to have no N-terminal signal sequence
----- Final Results -----
  bacterial cytoplasm --- Certainty = 0.2287 (Affirmative) <succ>
  bacterial membrane --- Certainty = 0.0000 (Not Clear) <succ>
  bacterial outside --- Certainty = 0.0000 (Not Clear) <succ>

Possible site: 19
>>> Seems to have no N-terminal signal sequence
----- Final Results -----
  bacterial cytoplasm --- Certainty = 0.1584 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

The protein has homology with the following sequences in the GENPEPT database.

```
Identities = 113/161 (70%), Positives = 137/161 (84%)
Query:   1 MNLKQAFIENDSIRLKLSASDWKEAIKLSIDPLIESGAVDAEYYDAIIESTEEFGPYYIL    60
           MNLKQAFI+N+SIRL LSA  W+EA++L++ PLI+S AV + YYDAII STE++GPYY+L
Sbjct:   1 MNLKQAFIDNNSIRLGLSADTWQEAVRLAVQPLIDSKAVTSAYYDAIIASTEKYGPYYVL    60

Query:  61 MPGMAMPHARPEAGVKRDAFSLITLTEPVVFPDGKEVSVLLALAATSSAIHTSVAIPQII   120
           MPGMAMPHA   GV R+AF+LITLT+PV F DGKEVSVLL LAAT   +IHT+VAIPQI+
Sbjct:  61 MPGMAMPHAEAGLGVNRNAFALITLTKPVTFSDGKEVSVLLTLAATDPSIHTTVAIPQIV   120

Query: 121 ALFELENSIQRLTECQEAKEVLAMVEESKNSPYLEGLDLES                     161
           ALFEL+N+I+RL   CQ  KEVL MVEESK+SPYLEG+DL +
Sbjct: 121 ALFELDNAIERLVACQSPKEVLEMVEESKDSPYLEGMDLNA                     161
```

Based on this analysis, it was predicted that these proteins and their epitopes could be useful antigens for vaccines or diagnostics.

Example 1491

A DNA sequence (GBSx1577) was identified in *S. agalactiae* <SEQ ID 4589> which encodes the amino acid sequence <SEQ ID 4590>. This protein is predicted to be probable hexylose-6-phosphate synthase. Analysis of this protein sequence reveals the following:

```
>GP:AAC77153 GB:AE000491 probable hexulose-6-phosphate synthase
[Escherichia coli K12]
Identities = 108/217 (49%), Positives = 141/217 (64%), Gaps = 3/217 (1%)
Query:   5 LPNLQVALDHSDLQGAIKAAVSVGHEVDVIEAGTVCLLQVGSELVEVLRSLFPDKIIVAD    64
           LP LQVALD+ + A +    EVD+IE GT+ + G  V L++L+P KI++AD
Sbjct:   3 LPMLQVALDNQTMDSAYETTRLIAEEVDIIEVGTILCVGEGVRAVRDLKALYPHKIVLAD    62

Query:  65 TKCADAGGTVAKNNAVRGADWMTCICCCATIPTMEAALKAIKEERGDRGEIQIELYGDWTY   124
           K  ADAG +++        ADW+T ICCA I T + AL   KE  GD  +QIEL G WT+
Sbjct:  63 AKIADAGKILSRMCFEANADWVTVICCADINTAKGALDVAKEFNGD---VQIELTGYWTW   119

Query: 125 EQAQQWLDAGISQAIYHQSRDALLAGETWGEKDLNKVKKLIDMGFRVSVTGGLSTDTLQL   184
           EQAQQW  DAGI Q +YH+SRDA   AG  WGE D+   +K+L  DMGF+V+VTGGL+ + L L
Sbjct: 120 EQAQQWRDAGIGQVVYHRSRDAQAAGVAWGEADITAIKRLSDMGFKVTVTGGLALEDLPL   179
```

```
Query: 185 FEGVDVFTFIAGRGITEADDPAAAARAFKDEIKRIWG              221
            F+G+ +  FIAGR I +A P  AAR FK I  +WG
Sbjct: 180 FKGIPIHVFIAGRSIRDAASPVEAARQFKRSIAELWG              216
```

A related DNA sequence was identified in *S. pyogenes* <SEQ ID 4591> which encodes the amino acid sequence <SEQ ID 4592>. Analysis of this protein sequence reveals the following:

Possible site: 27
>>> Seems to have no N-terminal signal sequence
----- Final Results -----
   bacterial cytoplasm --- Certainty = 0.1473 (Affirmative) <succ>
    bacterial membrane --- Certainty = 0.0000 (Not Clear) <succ>
     bacterial outside --- Certainty = 0.0000 (Not Clear) <succ>

An alignment of the GAS and GBS proteins is shown below.

```
Identities = 206/217 (94%), Positives = 212/217 (96%)
Query:   5 LPNLQVALDHSDLQGAIKAAVSVGHEVDVIEAGTVCLLQVGSELVEVLRSLFPDKIIVAD   64
           +PNLQVALDHSDLQGA+KAAV+VGHEVDVIEAGTVCLLQVGSELVEVLRSLFP+KIIVAD
Sbjct:   4 IPNLQVALDHSDLQGAVKAAVAVGHEVDVIEAGTVCLLQVGSELVEVLRSLFPEKIIVAD   63

Query:  65 TKCADAGGTVAKNNAVRGADWMTCICCATIPTMEAALKAIKEERGDRGEIQIELYGDWTY  124
           TKCADAGGTVAKNNA RGADWMTCICCATIPTMEAALKAIKEERGDRGEIQIELYGDWTY
Sbjct:  64 TKCADAGGTVAKNNAKRGADWMTCICCATIPTMEAALKAIKEERGDRGEIQIELYGDWTY  123

Query: 125 EQAQQWLDAGISQAIYHQSRDALLAGETWGEKDLNKVKKLIDMGFRVSVTGGLSTDTLQL  184
           EQAQ WLDAGISQAIYHQSRDALLAGETWGEKDLNKVK LIDMGFRVSVTGGL  DTL+L
Sbjct: 124 EQAQLWLDAGISQAIYHQSRDALLAGETWGEKDLNKVKTLIDMGFRVSVTGGLDVDTLRL  183

Query: 185 FEGVDVFTFIAGRGITEADDPAAAARAFKDEIKRIWG                        221
           FEGVDVFTFIAGRGITEA+DPAAAARAFKDEIKRIWG
Sbjct: 184 FEGVDVFTFIAGRGITEAEDPAAAARAFKDEIKRIWG                        220
```

Based on this analysis, it was predicted that these proteins and their epitopes could be useful antigens for vaccines or diagnostics.

Example 1492

A DNA sequence (GBSx1578) was identified in *S. agalactiae* <SEQ ID 4593> which encodes the amino acid sequence <SEQ ID 4594>. Analysis of this protein sequence reveals the following:

Possible site: 36
>>> Seems to have no N-terminal signal sequence
----- Final Results -----
   bacterial cytoplasm --- Certainty = 0.4179 (Affirmative) <succ>
    bacterial membrane --- Certainty = 0.0000 (Not Clear) <succ>
     bacterial outside --- Certainty = 0.0000 (Not Clear) <succ>

The protein has homology with the following sequences in the GENPEPT database.

```
>GP:AAC22686 GB:U32783 hexulose-6-phosphate isomerase, putative
[Haemophilus influenzae Rd]
Identities = 143/282 (50%), Positives = 199/282 (69%), Gaps = 3/282 (1%)
Query:   5 IGIYEKATPKHFNWLERLQFAKELGFDFVELSIDESDERLARLEWSKEERLELVKAIFET   64
           IGIYEKA PK+  W ERL  AK  GF+F+E+SIDES++RL+RL W+K ER+ L ++I ++
Sbjct:   6 IGIYEKALPKNITWQERLSLAKACGFEFIEMSIDESNDRLSRLNWTKSERIALHQSIIQS   65

Query:  65 GVRVPTITFSGHRRFPMGSNNPEKEARAMDMMKKCIVFAQDIGIRNIQLAGYDVYYEEKS  124
           G+ +P++  S HRRFP GS + +    ++ ++M+K I  + ++GIR IQLAGYDVVYE++
Sbjct:  66 GITIPSMCLSAHRRFPFGSKDKKIRQKSFEIMEKAIDLSVNLGIRTIQLAGYDVYYEKQD  125

Query: 125 PETRARFIKNLRQACTWAEEAQVILSIEIMDDPFMNSIEKYLAVEKEIDSPYLFVYPDTG  184
              ET    F + +   A  T A   AQV L++EIMD PFM+SI ++   + I+SP+   VYPD G
Sbjct: 126 EETIKYFQEGIEFAVTLAASAQVTLAVEIMDTPFMSSISRWKKWDTIINSPWFTVYPDIG  185
```

-continued

```
Query: 185 NVSAWHNDLWSEFYNGHRSIAALHIKDTYAVTETSKGQFRDVPFGQGCVDWEEMFAVIKK 244
            N+SAW+N++  E   G    I+A+H+KDTY VTETSKGQFRDVPFGQGCVD+   F+++KK
Sbjct: 186 NLSAWNNNIEEELTLGIDKISAIHLKDTYPVTETSKGQFRDVPFGQGCVDFVHFFSLLKK 245

Query: 245 TNYNGPFLIEMWSENCETVEETRAAIKEAQDFLYPLMEKTGV                    286
            NY G FLIEMW+E       EE    I +A+ ++    MEK G+
Sbjct: 246 LNYRGAFLIEMWTEK---NEEPLLEIIQARKWIVQQMEKAGL                    284
```

A related DNA sequence was identified in *S. pyogenes* <SEQ ID 4595> which encodes the amino acid sequence <SEQ ID 4596>. Analysis of this protein sequence reveals the following:

Possible site: 50
>>> Seems to have no N-terminal signal sequence
----- Final Results -----
 bacterial cytoplasm --- Certainty = 0.1489 (Affirmative) <succ>
 bacterial membrane --- Certainty = 0.0000 (Not Clear) <succ>
 bacterial outside --- Certainty = 0.0000 (Not Clear) <succ>

Possible site: 23
>>> Seems to have no N-terminal signal sequence
----- Final Results -----
 bacterial cytoplasm --- Certainty = 0.2559 (Affirmative) <succ>
 bacterial membrane --- Certainty = 0.0000 (Not Clear) <succ>
 bacterial outside --- Certainty = 0.0000 (Not Clear) <succ>

An alignment of the GAS and GBS proteins is shown below.

The protein has homology with the following sequences in the GENPEPT database.

```
Identities = 240/286 (83%), Positives = 271/286 (93%)
Query:   1 MTRPIGIYEKATPKHFNWLERLQFAKELGFDFVELSIDESDERLARLEWSKEERLELVKA   60
           M RPIGIYEKATPK F W ERLQFAK+LGFDFVE+S+DESD RLARLEW+KEERL+LVKA
Sbjct:  15 MARPIGIYEKATPKQFTWRERLQFAKDLGFDFVEMSVDESDARLARLEWTKEERLDLVKA   74

Query:  61 IFETGVRVPTITFSGHRRFPMGSNNPEKEARAMDMMKKCIVFAQDIGIRNIQLAGYDVYY  120
           I+ETG+R+PTI FSGHRR+P+GSN+P  EA+++ +MK+CI  AQD+G+R IQLAGYDVYY
Sbjct:  75 IYETGIRIPTICFSGHRRYPLGSNDPAIEAKSLKLMKQCIELAQDLGVRTIQLAGYDVYY  134

Query: 121 EEKSPETRARFIKNLRQACTWAEEEAQVILSIEIMDDPFMNSIEKYLAVEKEIDSPYLFVY  180
           E+KSPETRARFIKNLRQ+C WAEEEAQV+LSIEIMDDPF+NSIEKYLAVEKEIDSPYLFVY
Sbjct: 135 EEKSPETRARFIKNLRQSCDWAEEEAQVMLSIEIMDDPFINSIEKYLAVEKEIDSPYLFVY  194

Query: 181 PDTGNVSAWHNDLWSEFYNGHRSIAALHIKDTYAVTETSKGQFRDVPFGQGCVDWEEMFA   240
           PD GNVSAWHNDLWSEFYNGH+SIAALH+KDTYAVTETSKGQFRDVPFGQGCVDW+E+FA
Sbjct: 195 PDAGNVSAWHNDLWSEFYNGHKSIAALHLKDTYAVTETSKGQFRDVPFGQGCVDWQELFA  254

Query: 241 VIKKTNYNGPFLIEMWSENCETVEETRAAIKEAQDFLYPLMEKTGV                286
           V+KKTNYNGPFLIEMWSENC+TVEET+AAIKEAQDFLYPL+EK G+
Sbjct: 255 VLKKTNYNGPFLIEMWSENCDTVEETKAAIKEAQDFLYPLIEKAGL                300
```

Based on this analysis, it was predicted that these proteins and their epitopes could be useful antigens for vaccines or diagnostics.

Example 1493

A DNA sequence (GBSx1579) was identified in *S. agalactiae* <SEQ ID 4597> which encodes the amino acid sequence <SEQ ID 4598>. This protein is predicted to be L-ribulose 5-phosphate 4-epimerase. Analysis of this protein sequence reveals the following:

```
>GP:AAD45716 GB:AF160811 L-ribulose 5-phosphate 4-epimerase
[Bacillus stearothermophilus]
Identities = 143/229 (62%), Positives = 176/229 (76%), Gaps = 2/229 (0%)
Query:   5 LQEMRERVCEANKSLPVHSLVKFTWGNVSEVDREAGLIVIKPSGVDYDQLTPENMVVTDL   64
           L+E+++ V EAN  LP + LV FTWGNVS +DRE GL+VIKPSGV YD+LT ++MVV DL
Sbjct:   2 LEELKQAVLEANLQLPQYRLVTFTWGNVSGIDRERGLVVIKPSGVAYDKLTIDDMVVVDL   61

Query:  65 EGNIVEGDLNPSSDLPTHVQLYKAWPEVGGIVHTHSTEAVGWAQAGRDIPFYGTTHADYF  124
            GN+VEGDL PSSD PTH+ LYK +P +GGIVHTHST A  WAQAG+ IP  GTTHADYF
Sbjct:  62 TGNVVEGDLKPSSDTPTHLWLYKQFPGIGGIVHTHSTWATVWAQAGKGIPALGTTHADYF  121

Query: 125 YGPVPCARSLSEDEVNTAYEKETGSVIIEEFERRDLDPMAVPGIVVRNHGPFTWGKDPAQ  184
           YG +PC R ++  +E+   AYE ETG VI E F    R LDP+  +PG++V  HGPF WGKDPA
```

```
                              -continued
Sbjct: 122  YGEIPCTRPMTNEEIQGAYELETGKVITETF--RFLDPLQMPGVLVHGHGPFAWGKDPAN  179

Query: 185  AVYHSVVLEEVAKMNRFTEQINPRVEPAPKYIMDKHYLRKHGPNAYYGQ            233
            AV+++VVLEEVAEM   T  +NP  +P   +  ++D+HYLRKHG NAYYGQ
Sbjct: 180  AVHNAVVLEEVAEMAARTYMLNPNAKPISQTLLDRHYLRKHGANAYYGQ            228
```

A related DNA sequence was identified in *S. pyogenes* <SEQ ID 4599> which encodes the amino acid sequence <SEQ ID 4600>. Analysis of this protein sequence reveals the following:

Possible site: 14
>>> Seems to have no N-terminal signal sequence
----- Final Results -----
bacterial cytoplasm --- Certainty = 0.2257 (Affirmative) <succ>
bacterial membrane --- Certainty = 0.0000 (Not Clear) <succ>
bacterial outside --- Certainty = 0.0000 (Not Clear) <succ>

Possible site: 45
>>> Seems to have no N-terminal signal sequence
----- Final Results -----
bacterial cytoplasm --- Certainty = 0.4232 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

A related GBS nucleic acid sequence <SEQ ID 10149> which encodes amino acid sequence <SEQ ID 10150> was also identified.

The protein has homology with the following sequences in the GENPEPT database.

```
Identities = 207/234 (88%), Positives = 220/234 (93%)
Query:   1  MAKSLQEMRERVCEANKSLPVHSLVKFTWGNVSEVDREAGLIVIKPSGVDYDQLTPENMV   60
            MAK+LQEMRERVC ANKSLP H LVKFTWGNVSEV RE G IVIKPSGVDYD LTPENMV
Sbjct:   1  MAKNLQEMRERVCAANKSLPQHGLVKFTWGNVSEVCRELGRIVIKPSGVDYDLLTPENMV   60

Query:  61  VTDLEGNIVEGDLNPSSDLPTHVQLYKAWPEVGGIVHTHSTEAVGWAQAGRDIPFYGTTH  120
            VTDL+GN+VEGDLNPSSDLPTHV+LYKAWPEVGGIVHTHSTEAVGWAQAGRDIPFYGTTH
Sbjct:  61  VTDLDGNVVEGDLNPSSDLPTHVELYKAWPEVGGIVHTHSTEAVGWAQAGRDIPFYGTTH  120

Query: 121  ADYFYGPVPCARSLSEDEVNTAYEKETGSVIIEEFERRDLDPMAVPGIVVRNHGPFTWGK  180
            ADYFYGPVPCARSL++ EV+ AYE+ETG+VI+EEF +R LDPMAVPGIVVRNHGPFTWGK
Sbjct: 121  ADYFYGPVPCARSLTKAEVDGAYEQETGNVILEEFSKRGLDPMAVPGIVVRNHGPFTWGK  180

Query: 181  DPAQAVYHSVVLEEVAKMNRFTEQINPRVEPAPKYIMDKHYLRKHGPNAYYGQK        234
             P QAVYHSVVLEEVA+MNR TEQINPRVEPAP+YIMDKHYLRKHGPNAYYGQK
Sbjct: 181  TPEQAVYHSVVLEEVARMNRLTEQINPRVEPAPRYIMDKHYLRKHGPNAYYGQK        234
```

Based on this analysis, it was predicted that these proteins and their epitopes could be useful antigens for vaccines or diagnostics.

Example 1494

A DNA sequence (GBSx1580) was identified in *S. agalactiae* <SEQ ID 4601> which encodes the amino acid sequence <SEQ ID 4602>. This protein is predicted to be transaldolase (tal). Analysis of this protein sequence reveals the following:

```
>GP:AAB98962 GB:U67539 transaldolase [Methanococcus jannaschii]
Identities = 124/214 (57%), Positives = 157/214 (72%)
Query:  19  MKYFLDTADVSEIRRLNRLGIVDGVITNPTIISREGRDFKEVINEICQIVDGPVSAEVTG   78
            MK+FLDTA+V EI++   LG+VDGVTTNPT++++EGRDF EV+ EIC+IV+GPVSAEV
Sbjct:   1  MKFFLDTANVEEIKKYAELGLVDGVTTNPTLVAKEGRDFYEVVKEICEIVEGPVSAEVIS   60

Query:  79  LTCDEMVTEAREIAKWSPNVVVKIPMTEEGLAAVSQLSKEGIKTNVTLIFTVAQGLSAMK  138
             + MV EARE+AK + N+V+KIPMT++G+ AV  LS EGIKTNVTL+F+  Q L A K
Sbjct:  61  TDAEGMVKEARELAKLADNIVIKIPMTKDGMKAVKILSAEGIKTNVTLVFSPLQALVAAK  120

Query: 139  AGATFISPFVGRLEDIGTDAYALIRDLRHIIDFYGFQSEIIAASIRGLAHVEGVAKCGAH  198
            AGAT++SPFVGRL+DIG    LI D+  I   Y  ++E+I AS+R   HV    AK GA
Sbjct: 121  AGATYVSPFVGRLDDIGHVGMKLIEDVVKIYKNYDIKTEVIVASVRHPWHVLEAAKIGAD  180

Query: 199  IATIPDKTFASLFTHPLTDKGIETFLKDWDSFKK                            232
            IAT+P      LF HPLTD G+E FLKDWD + K
Sbjct: 181  IATMPPAVMDKLFNHPLTDIGLERFLKDWDEYLK                            214
```

A related DNA sequence was identified in *S. pyogenes* <SEQ ID 4603> which encodes the amino acid sequence <SEQ ID 4604>. Analysis of this protein sequence reveals the following:

Possible site: 15
>>> Seems to have no N-terminal signal sequence
----- Final Results -----
  bacterial cytoplasm --- Certainty = 0.1902 (Affirmative) <succ>
    bacterial membrane --- Certainty = 0.0000 (Not Clear) <succ>
      bacterial outside --- Certainty = 0.0000 (Not Clear) <succ> bacterial cytoplasm --- Certainty = 0.1263 (Affirmative) <succ>
    bacterialmembrane --- Certainty = 0.0000 (Not Clear) <succ>
      bacterialoutside --- Certainty = 0.0000 (Not Clear) <succ>

An alignment of the GAS and GBS proteins is shown below.

The protein has homology with the following sequences in the GENPEPT database.

```
Identities = 162/214 (75%), Positives = 180/214 (83%)
Query:  19 MKYFLDTADVSEIRRLNRLGIVDGVTTNPTIISREGRDFKEVINEICQIVDGPVSAEVTG   78
            MK+FLDTA+V+ I+ +N LG+VDGVTTNPTIISREGRDF+ VI EIC IVDGP+SAEVTG
Sbjct:   1 MKFFLDTANVAAIKAINELGVVDGVTTNPTIISREGRDFETVIKEICDIVDGPISAEVTG   60

Query:  79 LTCDEMVTEAREIAKWSPNVVVKIPMTEEGLAAVSQLSKEGIKTNVTLIFTVAQGLSAMK  138
            LT D MV EAR IAKW  NVVVKIPMT EGL A + LSKEGIKTNVTLIFTV+QGL AMK
Sbjct:  61 LTADAMVEEARSIAKWEDNVVVKIPMTTEGLKATNILSKEGIKTNVTLIFTVSQGLMAMK  120

Query: 139 AGATFISPFVGRLEDIGTDAYALIRDLRHIIDFYGFQSEIIAASIRGLAHVEGVAKCGAH  198
            AGAT+ISPF+GRLEDIGTDAY LI DLR IID Y FQ+EIIAASIR  AHVE VAK GAH
Sbjct: 121 AGATYISPFIGRLEDIGTDAYQLISDLREIIDLYDFQAEIIAASIRTTAHVEAVAKLGAH  180

Query: 199 IATIPDKTFASLFTHPLTDKGIETFLKDWDSFKK                           232
            IATIPD  FA +  HPLT  G++TF++DW SFKK
Sbjct: 181 IATIPDPLFAKMTQHPLTTNGLKTFMEDWASFKK                           214
```

Based on this analysis, it was predicted that these proteins and their epitopes could be useful antigens for vaccines or diagnostics.

Example 1495

A DNA sequence (GBSx1581) was identified in *S. agalactiae* <SEQ ID 4605> which encodes the amino acid sequence <SEQ ID 4606>. Analysis of this protein sequence reveals the following:

Possible site: 22
>>> Seems to have no N-terminal signal sequence
----- Final Results -----

```
>GP:CAB14129 GB:Z99115 transcriptional regulator (LacI family)
[Bacillus subtilis]
Identities = 108/331 (32%), Positives = 188/331 (56%), Gaps = 12/331 (3%)
Query:   6 TISDIANLVGVSKATVSYYLNGNYKKMSLQTKEKIRLAIKETGYQPSKIAQSLVTKNTRT   65
            TI D+A   GVSK+TVS Y+NG   +S +  + I+ AI E  Y+PSK+AQ L  K ++
Sbjct:  10 TIKDVAECAGVSKSTVSRYINGKIDAISPEKVKNIKKAIAELNYRPSKMAQGLKIKKSKL   69

Query:  66 IGVVIADITNPFISSVMKGIHDTCQQFGYSVNFTNSDNDIDIELENLNRLNQQNVSGIIL  125
            IG V+ADITNPF  +  +G+ + C Q+GYS+    N+DN  + E E L +L    +V G+IL
Sbjct:  70 IGFVVADITNPFSVAAFRGVEEVCDQYGYSIMVCNTDNSPEKEREMLLKLEAHSVEGLIL  129

Query: 126 DSVDPNHSFIETLSNDRL--VMVDRQAKDIKVDTVASDNKESTQIFLEKMQEAGYHDIYF  183
            ++   N  +  +  ++ +++DR+  D+K+DTV +DN+   T+  L+K+   GY D+
Sbjct: 130 NATGENKDVLRAFAEQQIPTILIDRKLPDLKLDTVTTDNRWITKEILQKVYSKGYTDVAL  189

Query: 184 VTYPIEGISTRELRYEGFKEVVS-SNPDKLIIITE-DGSTQRILDI------IEHSEQKP  235
              T PI  IS R  R    ++E+ S N + L+ + ED     + L        E EQK
Sbjct: 190 FTEPISSISPRAERAAVYQEMASVQNVNGLVRLHEIDVKDKEQLKAELRSFHKEMPEQKK  249

Query: 236 GFLMMNGPTLLNFMKKLNQSTVSYPEDYGLGSYEDLEWMQVLTPNVSCIKQDSYGIGCLA  295
```

-continued
```
              L +NG  +L  +  + +    P+D G+   ++D EW +++ P ++ I Q S+ +G  A
Sbjct: 250 AILALNGLIMLKIISCMEELGLRIPQDIGIAGFDDTEWYKLIGPGITTIAQPSHDMGRTA 309

Query: 296 AQCLIEKISQGNEPTTARLLEVYNQIVIRQS                              326
              + ++++I      +     + +E++ ++++R+S
Sbjct: 310 MERVLKRIE--GDKGAPQTIELEAKVIMRKS                              338
```

There is also homology to SEQ ID 2366.

Based on this analysis, it was predicted that this protein and its epitopes, could be useful antigens for vaccines or diagnostics.

Example 1496

A DNA sequence (GBSx1582) was identified in *S. agalactiae* <SEQ ID 4607> which encodes the amino acid sequence <SEQ ID 4608>. Analysis of this protein sequence reveals the following:

---

Possible site: 40
>>> Seems to have no N-terminal signal sequence
----- Final Results -----
   bacterial cytoplasm --- Certainty = 0.1661 (Affirmative) <succ>
   bacterial membrane --- Certainty = 0.0000 (Not Clear) <succ>
   bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1497

A DNA sequence (GBSx1583) was identified in *S. agalactiae* <SEQ ID 4609> which encodes the amino acid sequence <SEQ ID 4610>. This protein is predicted to be GLYCERATE DEHYDROGENASE. Analysis of this protein sequence reveals the following:

---

Possible site: 29
>>> Seems to have an uncleavable N-term signal seq
----- Final Results -----
   bacterial membrane --- Certainty = 0.0000 (NotClear) <succ>
   bacterial outside --- Certainty = 0.0000 (NotClear) <succ>
   bacterial cytoplasm --- Certainty = 0.0000 (NotClear) <succ>

---

The protein has homology with the following sequences in the GENPEPT database.

```
>GP:CAB50351 GB:AJ248287 GLYCERATE DEHYDROGENASE [Pyrococcus abyssi]
Identities = 123/325 (37%), Positives = 192/325 (58%), Gaps = 8/325 (2%)
Query:   1 MDKKKILVTGIVPKEGLRKLMDRFDVTYSED-RPFSRDYVLEHLSEYDGWLLM-GQKGDK  58
             M K ++ +T    +P+ G+  L     F+V    ED R    R+ +LE + + D  + M  ++ D+
Sbjct:   1 MSKPRVFITREIPEVGIEMLEKEFEVEVWEDEREIPREILLEKVKDVDALVTMLSERIDR  60

Query:  59 EMIDAGENLQIISLNAVGFDHVDTAYAKEKGIIVSNSPQAVRVPTAEMTFALILAASKRL 118
             E+ +       L+I++  AVG+D++D    A ++GI V+N+P +    TA++ FAL+LA ++ L
Sbjct:  61 EVFERAPRLRIVANYAVGYDNIDVEEATKRGIYVTNTPGVLIDATADLAFALLLATARHL 120

Query: 119 AFYDSIVRSGEW----IDPSEQRYQGLTLQGSTLGIYGMRIGLTVANFAKAFGMTVVYN 174
                D     RSGEW      + + G   + G T+GI G GRIG    +A   A+ F M ++Y
Sbjct: 121 VKGDKFTRSGEWKKRGVAWHPKWFLGYDVYGKTIGIIGFGRIGQAIAKRARGFDMRILYY 180

Query: 175 DVYRLPEDKEKELGVTYLEFDQLIKTADVITIHAPALPSTIHKFNKDVFAKMKNRSYLIN 234
                R PE  EKEL    +   D+L++ +D + +    P    T H   N++      MK    + LIN
Sbjct: 181 SRTRKPE-VEKELNAEFKPLDELLRESDFVVLAVPLNKETYHMINEERLKMMKRTAILIN 239

Query: 235 AARGPIVSEEALIEALKEGEIAGAGLDVFENEPQVSEGLRSLDNVIMSPHAGTGTIEGRR 294
             ARG ++   +ALI+ALKEG IAGAGLDV+E EP   +E L SLDNV+++PH G+ T    R
Sbjct: 240 VARGKVIDTKALIKALKEGWIAGAGLDVYEEEPYYNEELFSLDNVVLTPHIGSATFGARE 299

Query: 295 TLAEEAADNIIAFFDGK-PQNIVNK                                   318
             +A+  A+N+IAF G+ P  +VN+
Sbjct: 300 GMAKLVAENLIAFKRGEVPPTLVNR                                   324
```

There is also homology to SEQ ID 124.

Based on this analysis, it was predicted that this protein and its epitopes, could be useful antigens for vaccines or diagnostics.

Example 1498

A DNA sequence (GBSx1585) was identified in *S. agalactiae* <SEQ ID 4611> which encodes the amino acid sequence <SEQ ID 4612>. Analysis of this protein sequence reveals the following:

---

Possible site: 34
>>> Seems to have no N-terminal signal sequence
----- Final Results -----
   bacterial cytoplasm --- Certainty = 0.1898 (Affirmative) <succ>
   bacterial membrane --- Certainty = 0.0000 (Not Clear) <succ>
   bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1499

A DNA sequence (GBSx1586) was identified in *S. agalactiae* <SEQ ID 4613> which encodes the amino acid sequence <SEQ ID 4614>. This protein is predicted to be PTS system, galactitol specific TIC component. Analysis of this protein sequence reveals the following:

```
Possible site: 25
>>> Seems to have no N-terminal signal sequence
INTEGRAL    Likelihood = -13.27   Transmembrane 254-270 (245-277)
INTEGRAL    Likelihood = -9.24    Transmembrane 77-93 (71-100)
INTEGRAL    Likelihood = -9.24    Transmembrane 367-383 (364-386)
INTEGRAL    Likelihood = -8.28    Transmembrane 32-48 (26-54)
INTEGRAL    Likelihood = -7.38    Transmembrane 186-202 (182-215)
INTEGRAL    Likelihood = -6.26    Transmembrane 158-174 (151-180)
INTEGRAL    Likelihood = -5.79    Transmembrane 279-295 (276-296)
INTEGRAL    Likelihood = -1.12    Transmembrane 342-358 (342-359)
INTEGRAL    Likelihood = -0.00    Transmembrane 308-324 (308-324)
----- Final Results -----
   bacterial membrane --- Certainty = 0.6307 (Affirmative) <succ>
      bacterial outside --- Certainty = 0.0000 (Not Clear) <succ>
         bacterial cytoplasm --- Certainty = 0.0000 (Not Clear) <succ>
```

A related GBS nucleic acid sequence <SEQ ID 8825> which encodes amino acid sequence <SEQ ID 8826> was also identified. Analysis of this protein sequence reveals the following:

```
Lipop: Possible site: -1   Crend: 9
MCG: Discrim Score: 8.30
GvH: Signal Score (-7.5) : 2.97
Possible site: 58
>>> Seems to have a cleavable N-term signal seq.
ALOM program  count: 9 value: -13.27   threshold: 0.0
INTEGRAL    Likelihood = -13.27   Transmembrane 321-337 (312-344)
INTEGRAL    Likelihood = -9.24    Transmembrane 144-160 (138-167)
INTEGRAL    Likelihood = -9.24    Transmembrane 434-450 (431-453)
INTEGRAL    Likelihood = -8.28    Transmembrane 99-115 (93-121)
INTEGRAL    Likelihood = -7.38    Transmembrane 253-269 (249-282)
INTEGRAL    Likelihood = -6.26    Transmembrane 225-241 (218-247)
INTEGRAL    Likelihood = -5.79    Transmembrane 346-362 (343-363)
INTEGRAL    Likelihood = -1.12    Transmembrane 409-425 (409-426)
INTEGRAL    Likelihood = -0.00    Transmembrane 375-391 (375-391)
PERIPHERAL  Likelihood = 0.69     188
modified ALOM score: 3.15
*** Reasoning Step: 3
----- Final Results -----
   bacterial membrane --- Certainty = 0.6307 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the GENPEPT database.

```
>GP:BAB03909 GB:AP001507 PTS system, galactitol-specific enzyme II,
C component [Bacillus halodurans]
Identities = 92/347 (26%), Positives = 173/347 (49%), Gaps = 15/347 (4%)
Query:    1 MVKTTGLHLPIVDIGWQAGSLTAFSSEIGLSFFVFGLLIELGLFLLGITRVFVPSNLWNN  60
            MV   G+ L ++D+GW A S  A++S +      GL++ + +   T+ +  ++WN
Sbjct:   70 MVDRLGVDLNVIDVGWPATSSIAWASVVAAFIIPLGLIVNVIMLVTKTTKT-MNVDIWNF 128

Query:   61 FGYMIWGTMAYAATGNFILSFAFMVFVLLYSLVMSEVLADRWSEYYGVKNATINSIHNIE 120
             + Y   + Y ++ I +   V   +L +++  A   SE+Y +   +I +    I
Sbjct:  129 WHYTFMAAVVYTVSDSIIQALIAAVMFQIVALKVADWTAPMVSEFYELPGVSIATGSTIS 188

Query:  121 TLIPALILDPLWNLLGVNKVKLNPESLKTKLGIFGEPMTLGFILGVIIGVLGSLRNLASI 180
             ++   +  G+     +P++++ + GIFGE + +G  ILG  IG+L
Sbjct:  189 YAPGIWLVKGIQKIPGIKHWNADPDTIQRRFGIFGESIFIGLILGAAIGLLAGYNV---- 244

Query:  181 DTWGGILGFAVALAAVMTIFPLITGVFASAFAPLAEAVERNKKKESQAEQGALDKKRWFI 240
              G ++   +A+AAVM + P +  +        P++E+      K          +  I
Sbjct:  245 ---GEVIEIGMAMAAVMVLMPRMVKILMEGLMPVSESAREWLNKR-------FGDREIHI 294

Query:  241 AVDDGVGFGEPATIIAGLILVPIMVVISLILPGNEALPVVDLIAIPFMIEAMIAVSKGNI 300
             +D  V  G P+ I    LILVP+ V++++ILPGN  LP   DL   IPF++  ++  ++GNI
Sbjct:  295 GLDAAVLLGHPSVISTALILVPLTVLLAVILPGNALLPFGDLATIPFIVAFIVGAARGNI 354

Query:  301 LKAILNGIIWFSLGLYAASALGPIYTEAVKHFGTALPAGVTLIMSFN             347
             + ++L  G I  +L LY A+ +   P++T+  ++     +P G  LI S +
Sbjct:  355 IHSVLAGAIMIALSLYMATDIAPVFTKMAENSNFNMPEGSALISSID             401
```

Based on this analysis, it was predicted that this protein and its epitopes, could be useful antigens for vaccines or diagnostics.

Example 1500

A DNA sequence (GBSx1587) was identified in *S. agalactiae* <SEQ ID 4615> which encodes the amino acid sequence <SEQ ID 4616>. Analysis of this protein sequence reveals the following:

Possible site: 52
>>> Seems to have no N-terminal signal sequence
----- Final Results -----
  bacterial cytoplasm --- Certainty = 0.1013 (Affirmative) <succ>

-continued bacterial membrane --- Certainty = 0.0000 (Not Clear) <succ>
  bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1501

A DNA sequence (GBSx1588) was identified in *S. agalactiae* <SEQ ID 4617> which encodes the amino acid sequence <SEQ ID 4618>. Analysis of this protein sequence reveals the following:

Possible site: 43
>>> Seems to have no N-terminal signal sequence
----- Final Results -----
  bacterial cytoplasm --- Certainty = 0.1294 (Affirmative) <succ>
    bacterial membrane --- Certainty = 0.0000 (Not Clear) <succ>
    bacterial outside --- Certainty = 0.0000 (Not Clear) <succ>

A related GBS nucleic acid sequence <SEQ ID 10147> which encodes amino acid sequence <SEQ ID 10148> was also identified.

The protein has homology with the following sequences in the GENPEPT database.

```
>GP:AAC76604 GB:AE000435 L-xylulose kinase, cryptic [Escherichia
coli K12]
Identities = 156/496 (31%), Positives = 261/496 (52%), Gaps = 18/496 (3%)
Query:   16 YYLSIDYGGTNTKALIFDKLGHQIAVSSFETLKNETQSGHRQVNLVKTWNAITSAIREVI   75
            Y+L +D GG+  KA ++D+ G +  V           Q G  + ++ + W    + IR ++
Sbjct:    4 YWLGLDCGGSWLKAGLYDREGREAGVQRLPLCALSPQPGWAERDMAELWQCCMAVIRALL   63

Query:   76 QISKLSPEQISAVACIGHGKGLYLLDNKLEPLEQGILSTDNRAKDLAQYFESK--LDNIW  133
               S +S EQI +      GKGL+LLD   +PL    ILS+D RA ++ + ++      + ++
Sbjct:   64 THSGVSGEQIVGIGISAQGKGLFLLDKNDKPLGNAILSSDRRAMEIVRRWQEDGIPEKLY  123

Query:  134 ELTRQHIFPSQSPVILRWLKDYQPETYKSIGAVLSAKDFIRYKLTGKVQQEYGDASGNHW  193
            LTRQ ++      +LRWLK+++PE Y  IG V+   D++R+ LTG    E  + S ++
Sbjct:  124 PLTRQTLWTGHPVSLLRWLKEHEPERYAQIGCVMMTHDYLRWCLTGVKGCEESNISESNL  183

Query:  194 INFQTGTYDPAILDFFGIREIENSLPELIDSADLVPGGISSQAAKETGLVEGTPVVGGLF  253
            N    G YDP + D+ GI EI ++LP ++ SA++  G I++Q A   TGL  GTPVVGGLF
Sbjct:  184 YNMSLGEYDPCLTDWLGIAEINHALPPVVGSAEIC-GEITAQTAALTGLKAGTPVVGGLF  242

Query:  254 DIDACALGSGVLESDTFSVISGTWNINT--YPSLKPAKQDSGLMTSYFPDRRYLLEASSP  311
            D+ +  AL +G+ +  T + + GTW + +      L+ +    +   Y D  +++ +SP
Sbjct:  243 DVVSTALCAGIEDEFTLNAVMGTWAVTSGITRGLRDGEAHPYVYGRYVNDGEFIVHEASP  302

Query:  312 TSAGNLNFMLKMLMHQEIDNAKSSGGSIYDNLEEFLTHTDATHHGLIFFPFLYGSNTSQD  371
            TS+GNL +            G    +D + + +         L F PFLYGSN    +
Sbjct:  303 TSSGNLEWF----------TAQWGEISFDEINQAVASLPKAGGDLFFLPFLYGSNAGLE  351

Query:  372 ASACFFGLTTKSTKSQMIRAVYEGIAFAHKQHITDLIKSRGSVPKIIRFSGGATNSPAWM  431
             ++ F+G+     T++ +++A+YEG+ F+H  H+ +  ++ R +     +R +GG  +S   WM
Sbjct:  352 MTSGFYGMQAIHTRAHLLQAIYEGVVFSHMTHL-NRMRERFTDVHILRVTGGPAHSDVWM  410

Query:  432 QMFSDILNFPIETVEGTELGGLGGAILARHALDKI-SLKEAVQDMVRVKAIYKPQLSEVK  490
            QM +D+    IE +   E G  G A+ AR         + EA +D+      P ++    +
Sbjct:  411 QMLADVSGLRIELPQVEETGCFGAALAARVGTGVYHNFSEAQRDLRHPVRTLLPDMTAHQ  470

Query:  491 GYKKKYHAYQKLLETL                                            506
            Y+KKY   YQ L+  L
Sbjct:  471 LYQKKYQRYQHLIAAL                                            486
```

Based on this analysis, it was predicted that these proteins and their epitopes could be useful antigens for vaccines or diagnostics.

Example 1502

A DNA sequence (GBSx1589) was identified in *S. agalactiae* <SEQ ID 4619> which encodes the amino acid sequence <SEQ ID 4620>. Analysis of this protein sequence reveals the following:

Possible site: 59
>>> Seems to have an uncleavable N-term signal seq

----- Final Results -----
  bacterial membrane --- Certainty = 0.0000 (NotClear) <succ>
    bacterial outside --- Certainty = 0.0000 (NotClear) <succ>
      bacterial cytoplasm --- Certainty = 0.0000 (NotClear) <succ>

The protein has homology with the following sequences in the GENPEPT database.

```
>GP:AAG05648 GB:AE004652 hypothetical protein [Pseudomonas aeruginosa]
Identities = 59/235 (25%), Positives = 104/235 (44%), Gaps = 9/235 (3%)
Query:   23 QVQLIKLVKDLGESRFEIRQELLQDPDRELPALKAEADFYDINLYYSANEDLIK-GGKVN   81
            Q    +L+    G  RE+R+EL    P  +  AL A       +   +S+  +L +  G++N
Sbjct:   23 QASFLPLLAMAGAQRVELREELFAGPP-DTEALTAAIQLQGLECVFSSPLELWREDGQLN   81

Query:   82 PYLNKGLKEASQLGAPFIKLNVGQTRNLSKEELEPLKEILKSQTIGIKVENNQDPKAATV  141
            P L    L+ A    GA ++K+++G           + +L    L       + + VEN+Q P+    +
Sbjct:   82 PELEPTLRRAEACGAGWLKVSLGLLPE--QPDLAALGRRLARHGLQLLVENDQTPQGGRI  139

Query:  142 ENCQYFMTLVKELQIPISFVFDTANWAFINQDLYQAVNNLACDTTYLHCKNFIQVAGKPH  201
            E   + F  L +  Q+ ++        FD  NW +    Q     +A    L         Y+HCK  I+
Sbjct:  140 EVLERFERLAERQQLDLAMTFDIGNWRWQEQAADEAALRLGRYVGYVHCKAVIRNRDGKL  199

Query:  202 LSKSLFEGEINLTD-LLKSFSNCEYLALEYPTE----LEILKRDVQRLISISNSQ       251
            ++          ++         LL+ F         A+EYP +        L  +R +    L  +    Q
Sbjct:  200 VAVPPSAADLQYWQRLLQHFPEGVARAIEYPLQGDDLLSLSRRHIAALARLGQPQ       254
```

No corresponding DNA sequence was identified in *S. pyogenes*.

Based on this analysis, it was predicted that this protein and its epitopes, could be useful antigens for vaccines or diagnostics.

Example 1503

A DNA sequence (GBSx1590) was identified in *S. agalactiae* <SEQ ID 4621> which encodes the amino acid sequence <SEQ ID 4622>. Analysis of this protein sequence reveals the following:

Possible site: 30
>>> Seems to have no N-terminal signal sequence
----- Final Results -----
  bacterial cytoplasm --- Certainty = 0.0430 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:BAB03939 GB:AP001507 unknown conserved protein [Bacillus halodurans]
Identities = 136/511 (26%), Positives = 234/511 (45%), Gaps = 29/511 (5%)
Query:    4 LDKKSYDLLFYLLKLEEPETVMAIANALNQSRRKVYYHLEKINDALPSDVPQIVSYPRV-   62
            LD++S  +L   LL       +   +   LN SRR VY  LEKIN  L      + V   R
Sbjct:    3 LDQRSTFILTQLLHARSYLPIQELTQKLNVSRRTVYNDLEKINSWLEEQGLKAVYKVRSQ   62

Query:   63 GILLTEKQKAACRLLLDEVTDYSYVMKSSERLQLSLVSIVVAKDRVTIDRLMQLNDVSRN  122
            G++L E+ K        L +   Y   + ER   ++ ++     + ++ LM    VSRN
Sbjct:   63 GLILDERAKEEIPTKLRSLKSWHYEYSAQERKAWVVIYLLTRLEPLFLEHLMDRTGVSRN  122

Query:  123 TILNDLNELRSELAEKEYNLQLQSTKCRGYFLDGHPL----SIIQYLYKLLDDIYHNGSS  178
            T ++D+  L+ EL     ++L L+   +   GY + G         +++  YL + L
Sbjct:  123 TTIDDIKCLKDEL--NNFHLALEFERKDGYTISGDETDKRKALVYYLSQALPQQNWETEL  180

Query:  179 SFIDLFNHKLSQAFGASTYFSKEVLDYFHHYLFISQRSLGKKINSQDGQFMIQILPFILM  238
            S I +F   L         F+ E L    +  S++ L  KI     D        L F+L
Sbjct:  181 SPIRIF---LRTKRDNGRIFTIEELQKVYDVISESEKVL--KIQYTDDVLHSLSLRFLLF  235

Query:  239 AYRK-----MRLSPEVQTSLNSDFSLVWQRKEYEIAKELADELEENFQLSLDEIEVGLVA  293
             R          +++ P  + L            KEYE AK ++ +LE+ F +      + EV   +
Sbjct:  236 MKRVAKGKFIKVHPLEKQVLKGT-------KEYEAAKVMSFKLEQAFGVHYPDEEVLYLT  288

Query:  294 MLMLSFRKDRDN-HLESQ-DYDDMRATLTSFLKELEERYHLHFVHKKDLLRQLLTHCKAL  351
            +LS + +   N  +ES+  +   ++      +TS + + ++     + F  K+  L  + L   H K
Sbjct:  289 THILSSKINYANGEIESRKESQELTHIVTSMVNDFQKYACVVFEEKELLEKNLFFHIKPA  348

Query:  352 LYRKRYGIFSVNPLTEHIKDKYEELFAITSSSVYLLEKAWQIKLTDDDVAYLTIHLGGEL  411
            +YR +YG+      N  + IK    Y ELF  +T    V    LE+         + D++VA++T+H   G +
Sbjct:  349 FYRIKYGLEVENNIAESIKTSYPELFLLTRKVVHYLERYVGKSVNDNEVAFITMHFVGWM  408

Query:  412 RNSQQSPNK-LKLVIVSDEGIAIQKLLLKQCQRYLTNSDIEAVFTTEQYQSVSDLMHVDM  470
            R     P K  K  +IV   G+       + L  Q +           DI   +  +Y+    + VD
Sbjct:  409 RREGTIPTKRKKALIVCANGVGISQFLKNQLEGLEPAVDIIKTCSIREYEKTP--VEVDF  466
```

```
                                        -continued
Query: 471  VVSTSDALESRFPMLVVHPVLTDDDIIRLIR                          501
            ++ST+    E    P+ +V+P+LT+ +  RL++
Sbjct: 467  IISTTSIPEKNVPIFIVNPILTETEKERLLK                          497
```

A related DNA sequence was identified in *S. pyogenes* <SEQ ID 4623> which encodes the amino acid sequence <SEQ ID 4624>. Analysis of this protein sequence reveals the following:

---

Possible site: 30
>>> Seems to have no N-terminal signal sequence
----- Final Results -----
    bacterial cytoplasm --- Certainty = 0.0745 (Affirmative) <succ>
      bacterial membrane --- Certainty = 0.0000 (Not Clear) <succ>
      bacterial outside --- Certainty = 0.0000 (Not Clear) <succ>

---

An alignment of the GAS and GBS proteins is shown below.

```
Identities = 368/548 (67%), Positives = 456/548 (83%)

Query:   1  MIILDKKSYDLLFYLLKLEEPETVMAIANALNQSRRKVYYHLEKINDALPSDVPQIVSYP   60
            M+ILDKKSYDLL YLLKLE PETVMAI++ALNQSRRKVYY L+KIN ALP  V QI+SYP
Sbjct:   1  MMILDKKSYDLLSYLLKLETPETVMAISHALNQSRRKVYYQLDKINQALPKGVDQIISYP   60

Query:  61  RVGILLTEKQKAACRLLLDEVTDYSYVMKSSERLQLSLVSIVVAKDRVTIDRLMQLNDVS  120
            R+GILLT  QKAACRLLL+EVTDY+YVMKS ER +LS + I V+ +RVTID+LMQ+NDVS
Sbjct:  61  RLGILLTADQKAACRLLLEEVTDYNYVMKSDERRRLSSIYIAVSTERVTIDKLMQINDVS  120

Query: 121  RNTILNDLNELRSELAEKEYNLQLQSTKCRGYFLDGHPLSIIQYLYKLLDDIYHNGSSSF  180
            RNTILNDL ELR EL +K+Y +QL +TK RGY+   HP+++IQYLYKLL D+Y  G++SF
Sbjct: 121  RNTILNDLTELREELEDKQYKIQLHATKARGYYFGCHPMALIQYLYKLLVDVYQGGNTSF  180

Query: 181  IDLFNHKLSQAFGASTYFSKEVLDYFHHYLFISQRSLGKKINSQDGQFMIQILPFILMAY  240
            ID+FN KLS+   G S YFSK++L YFH YLF+SQ SLGK IN+QD QFM+QILPF+L++Y
Sbjct: 181  IDIFNRKLSEIQGLSVYFSKDILTYFHEYLFLSQASLGKTINTQDSQFMLQILPFMLLSY  240

Query: 241  RKMRLSPEVQTSLNSDFSLVWQRKEYEIAKELADELEENFQLSLDEIEVGLVAMLMLSFR  300
            R MRL E +++L    +F L+W+RKEY IA++LA EL   NF+L LD+IEV +VAMLMLSFR
Sbjct: 241  RNMRLDSETKSALKQEFHLIWKRKEYHIAQDLARELYHNFKLHLDDDIEVSMVAMLMLSFR  300

Query: 301  KDRDNHLESQDYDDMRATLTSFLKELEERYHLHFVHKKDLLRQLLTHCKALLYRKRYGIF  360
            KD+D+H+ESQDYDDMRAT++  F+  +LE RY LHF HK+DLL++L THCKAL+YRK YGIF
Sbjct: 301  KDQDHHVESQDYDDMRATISHFIDQLESRYQLHFTHKQDLLKRLTTHCKALVYRKAYGIF  360

Query: 361  SVNPLTEHIKDKYEELFAITSSSVKLLEKAWQIKLTDDDVAYLTIHLGGELRNSQQSPNK  420
               VNPLT+H+K+KYEELFA+T S    +LE+ W I LTDDD+AYLTIHLGGELR++       K
Sbjct: 361  LVNPLTDHVKEKYEELFAMTQSCATILEQDWTISLTDDDIAYLTIHLGGELRHNNTEQEK  420

Query: 421  LKLVIVSDEGIAIQKLLLKQCQRYLTNSDIEAVFTTEQYQSVSDLMHVDMVVSTSDALES  480
             KLVIVSD+GI IQKLL KQCQRYL N   IEAVFTTEQYQSV DL+ VDM+V+T+D L++
Sbjct: 421  TKLVIVSDDGIGIQKLLFKQCQRYLANGQIEAVFTTEQYQSVDLLAVDMIVATTDTLKT  480

Query: 481  RFPMLVVHPVLTDDDIIRLIRFSKKGNCANSNQFTNELEKTIAQYVKEDSERYVLKSKIE  540
            +  PML+V+P+L+DDDII+LIRFSK+G   +  ++F+ EL K I   VK++S+RY L SKIE
Sbjct: 481  KIPMLIVNPILSDDDIIKLIRFSKQGRLSEHSRFSTELTKAIEAVVKDESDRYALVSKIE  540

Query: 541  KLIHQELL                                                      548
            KLIH+ELL
Sbjct: 541  KLIHRELL                                                      548
```

Based on this analysis, it was predicted that these proteins and their epitopes could be useful antigens for vaccines or diagnostics.

Example 1504

A DNA sequence (GBSx1591) was identified in *S. agalactiae* <SEQ ID 4625> which encodes the amino acid sequence <SEQ ID 4626>. Analysis of this protein sequence reveals the following:

Possible site: 50
>>> Seems to have no N-terminal signal sequence
----- Final Results -----
    bacterial cytoplasm --- Certainty = 0.2692 (Affirmative) \<succ\>
    bacterial membrane --- Certainty = 0.0000 (Not Clear) \<succ\>
    bacterial outside --- Certainty = 0.0000 (Not Clear) \<succ\>

Possible site: 35
>>> Seems to have no N-terminal signal sequence
----- Final Results -----
    bacterial cytoplasm --- Certainty = 0.3298 (Affirmative) \<succ\>
    bacterialmembrane --- Certainty = 0.0000 (Not Clear) \<succ\>
    bacterialoutside --- Certainty = 0.0000 (Not Clear) \<succ\>

The protein has homology with the following sequences in the GENPEPT database.

An alignment of the GAS and GBS proteins is shown below.

```
>GP:AAC77149 GB:AE000491 orf, hypothetical protein [Escherichia coli K12]
Identities = 211/363 (58%), Positives = 270/363 (74%), Gaps = 9/363 (2%)
Query:   1 MPNVKDITRESWILSTFPEWGTWLNEEIEEEVVAEGNFAMWWLGNCGVWIKTPGGANVVM    60
           M  VK ITRESWILSTFPEWG+WLNEEIE+E VA G FAMWWLG  G+W+K+ GG NV +
Sbjct:   3 MSKVKSITRESWILSTFPEWGSWLNEEIEQEQVAPGTFAMWWLGCTGIWLKSEGGTNVCV    62

Query:  61 DLWSNRGKSTKKVKDMVRGHQMANMAGVRKLQPNLRAQPMVIDPFAINELDYYLVSHFHS   120
           D W   GK +      M +GHQM  MAGV+KLQPNLR   P V+DPFAI ++D L +H H+
Sbjct:  63 DFWCGTGKQSHGNPLMKQGHQMQRMAGVKKLQPNLRTTPFVLDPFAIRQIDAVLATHDHN   122

Query: 121 DHIDINTAAAIINNPNLDHVKFVGPYECGEIWKKWGVPEERIIVIKPGESFEFKDIKVTA   180
           DHID+N AAA++ N    D V F+GP  C ++W  WGVP+ER IV+KPG+  + KDI++ A
Sbjct: 123 DHIDVNVAAAVMQNC-ADDVPFIGPKTCVDLWIGWGVPKERCIVVKPGDVVKVKDIEIHA   181

Query: 181 VESFDRTCLVTLPVDGAEEHDGELAGLAVTDEEMARKAVNYIFETPGGTIYHGADSHFSN   240
           +++FDRT L+TLP D       + AG  V  + M  +AVNY+F+TPGG++YH  DSH+SN
Sbjct: 182 LDAFDRTALITLPADQ------KAAG--VLPDGMDDRAVNYLEKTPGGSLYHSGDSHYSN   233

Query: 241 YFAKHGKDYKIDVAINNYGDNPVGIQDKMTSIDLLRMAENLRAKVIIPVHYDIWSNFMAS   300
           Y+AKHG +++IDVA+ +YG+NP GI DKMTS D+LRM E L  AKV+IP H+DINSNE A
Sbjct: 234 YYAKHGNEHQIDVALGSYGENPRGITDKMTSADMLRMGEALNAKVVIPFHHDIWSNFQAD   293

Query: 301 TDEILQLWKMRKERLQYDFHPFIWEVGGKYTYPQDKDRIEYHHPRGFDDCFEQESNIQFK   360
                EI   LW+M+K+RL+Y F  PFIW+VGGK+T+P DKD   EYH+PRGFDDCF  E ++ FK
Sbjct: 294 PQEIRVLWEMKKDRLKYGEKPFIWQVGGKFTWPLDKDNFEYHYPRGFDDCFTIEPDLPFK   353

Query: 361 ALL                                                            363
           + L
Sbjct: 354 SFL                                                            356
```

A related DNA sequence was identified in *S. pyogenes* \<SEQ ID 4627\> which encodes the amino acid sequence \<SEQ ID 4628\>. Analysis of this protein sequence reveals the following:

```
Identities = 315/363 (86%), Positives = 348/363 (95%)
Query:   1 MPNVKDITRESWILSTFPEWGTWLNEEIEEEVVAEGNFAMWWLGNCGVWIKTPGGANVVM    60
           M  V+DITRESWIL+TFPEWGTWLNEEIE+EVV   NFAMWWLGNCG+WIKTPGGANVVM
Sbjct:   1 MTKVQDITRESWILNTFPEWGTWLNEEIEQEVVPADNFAMWWLGNCGIWIKTPGGANVVM    60

Query:  61 DLWSNRGKSTKKVKDMVRGHQMANMAGVRKLQPNLRAQPMVIDPFAINELDYYLVSHFHS   120
           DLWSNRGK+TK+VKDMVRGHQMANMAG RKLQPNLRAQPMVIDPF INELDYYLVSH+HS
Sbjct:  61 DLWSNRGKATKQVKDMVRGHQMANMAGARKLQPNLRAQPMVIDPFMINELDYYLVSHYHS   120

Query: 121 DHIDINTAAAIINNPNLDHVKFVGPYECGEIWKKWGVPEERIIVIKPGESFEFKDIKVTA   180
           DHIDINTAAAIINNP L+HVKFVGPYECGE+WK WGVP++RI+++KPG+SFEFKDIK+TA
Sbjct: 121 DHIDINTAAAIINNPKLNHVKFVGPYECGEVWKNWGVPKDRIMILKPGDSFEFKDIKITA   180

Query: 181 VESFDRTCLVTLPVDGAEEHDGELAGLAVTDEEMARKAVNYIFETPGGTIYHGADSHFSN   240
           VESFDRTCLVTLP+ GA+  DG+LAGLA+TD++MARKAVNYIFETPGGTIYHGADSHFSN
Sbjct: 181 VESFDRTCLVTLPIQGADAQDGDLAGLAITDDDMARKAVNYIFETPGGTIYHGADSHFSN   240

Query: 241 YFAKHGKDYKIDVAINNYGDNPVGIQDKMTSIDLLRMAENLRAKVIIPVHYDIWSNFMAS   300
           YFAKHG+DY IDV +NNYG+NP GIQDKMTS+DLLRMAENLRAKV+IPVHYDIWSNFMAS
Sbjct: 241 YFAKHGRDYDIDVVLNNYGENPIGIQDKMTSVDLLRMAENLRAKVVIPVHYDIWSNFMAS   300

Query: 301 TDEILQLWKMRKERLQYDFHPFIWEVGGKYTYPQDKDRIEYHHPRGFDDCFEQESNIQFK   360
           TDEIL LWKMRKERLQYDFHPFIWEVGGKYTYPQD++RIEYHHPRGFDDCF ++SNIQFK
Sbjct: 301 TDEILELWKMRKERLQYDFHPFIWEVGGKYTYPQDQNRIEYHHPRGFDDCFLEDSNIQFK   360

Query: 361 ALL                                                            363
           ALL
Sbjct: 361 ALL                                                            363
```

Based on this analysis, it was predicted that these proteins and their epitopes could be useful antigens for vaccines or diagnostics.

Example 1505

A DNA sequence (GBSx1592) was identified in *S. agalactiae* <SEQ ID 4629> which encodes the amino acid sequence <SEQ ID 4630>. Analysis of this protein sequence reveals the following:

---

Possible site: 38
>>> Seems to have no N-terminal signal sequence

---

----- Final Results -----
bacterial cytoplasm --- Certainty = 0.3988 (Affirmative) <succ>
bacterial membrane --- Certainty = 0.0000 (Not Clear) <succ>
bacterial outside --- Certainty = 0.0000 (Not Clear) <succ>

---

A related GBS nucleic acid sequence <SEQ ID 10145> which encodes amino acid sequence <SEQ ID 10146> was also identified.

The protein has homology with the following sequences in the GENPEPT database.

```
>GP:BAA18808 GB:D90917 hypothetical protein [Synechocystis sp.]
Identities = 358/785 (45%), Positives = 494/785 (62%), Gaps = 15/785 (1%)
Query:  22 LEKLDAWWRAANYISAAQMYLKDNPLLRRELVENDLKVHPIGHWGTVPGQNFIYAHLNRA   81
           L ++  +WRAANY++   +YL+DNPLLR L    +K  +GHWG+ PG +F+Y HLNR
Sbjct:  44 LNQMHGFWRAANYLAVGMIYLRDNPLLREPLQPEQIKHRLLGHWGSSPGISFLYTHLNRI  103

Query:  82 INKYDLDMFYIEGPGHGGQVMVSNSYLDGSYTELNPNIEQTEDGFKQLCKIFSFPCGIAS  141
           I K+D DM Y+ GPGHG       YL+GSY+       + EDG K+  K FSFP GI S
Sbjct: 104 IRKFDQDMLYMVGPGHGAPGFLGPCYLEGSYSRFFAECSEDEDGMKRFFKQESFPGGIGS  163

Query: 142 HAAPETPGSIHEGGELGYALSHATGAILDNPDVIAATVIGDGEGETGPLMAGWLSNTFIN  201
           H   PETPGSIHEGGELGY LSHA GA  DNP++I  + GDGE ETGPL  W SN FIN
Sbjct: 164 HCTPETPGSIHEGGELGYCLSHAYGAAFDNPNLIVVGLAGDGESETGPLATSWHSNKFIN  223

Query: 202 PVNDGAVLPIFYLNGGKIHNPTIFERKTDEELSQFFEGLGWKPIFADVVELSEDHAAAHA  261
           P+ DGAVLP+ +LNG KI+NP++  R + EEL   FEG G+ P F +     D  + H
Sbjct: 224 PIRDGAVLPVLHLNGYKINNPSVLSRISHEELKALFEGYGYTPYFVE----GSDPESMHQ  279

Query: 262 LFAEKLDQAIQEIKTIQSEARQKPAEEAIQAKFPVLVARIPKGWTGPKAWEGTPIEGGFR  321
             A  LD + EI  IQ EAR       A++ ++P++V R PKGWTGP   +G  +EG +R
Sbjct: 280 AMAATLDHCVSEIHQIQQEARSTGI--AVRPRWPMVVMRTPKGWTGPDYVDGHKVEGFWR  337

Query: 322 AHQVPIPVDAHHMEHVDSLLSWLQSYRPEELFDENGKIVDEIAAISPKGDRRMSMNPITN  381
           +HQVP+      H+  L +W++SY+PEELFDE G +    AI+P+GD+R+    P N
Sbjct: 338 SHQVPMGGMHENPAHLQQLEAWMRSYKPEELFDEQGTLKPGFKAIAPEGDKRLGSTPYAN  397

Query: 382 AGIV-KAMDTADWKKFALDINVPGQIMAQDMIEFGKYAADLVDANPDNFRIFGPDETKSN  440
            G++ + +     D++++ +D++ PG I A +    G +  D++  N  NFR+FGPDE   SN
Sbjct: 398 GGLLRRGLKMPDFRQYGIDVDQPGTIEAPNTAPLGVFLRDVMANNMTNFRLFGPDENSSN  457

Query: 441 RLQEVFIRTSRQWLGRRKPDYDEA--LSPAGRVIDSQLSEHQAEGFLEGYVLTGRHGFFA  498
           +L  V+ + + W+    + +  LSP GRV++  LSEH  EG+LE Y+LTGRHGFFA
Sbjct: 458 KLHAVYEVSKKFWIAEYLEEDQDGGELSPDGRVME-MLSEHTLEGWLEAYLLTGRHGFFA  516

Query: 499 SYESFLRVVDSMVTQHFKWLRKSKTHTTWRKNYPALNLIAASTVFQQDHNGYTHQDPGIL  558
           +YESF  V+ SMV QH KWL   + H  WR +   +LN++   STV++QDHNG+THQDPG L
Sbjct: 517 TYESFAHVITSMVNQHAKWLDICR-HLNWRADISSLNILMTSTVWRQDHNGFTHQDPGFL  575

Query: 559 THLAEKTPEYIREYLPADTNSLLAVMDKAFKAEDKINLIVTSKHPRPQFYSIAEAEELVA  618
              + K+P+ +R YLP D NSLL+V D    ++++ IN+IV  K    Q+    + A
Sbjct: 576 DVILNKSPDVVRIYLPPDVNSLLSVADHCLQSKNYINIIVCDKQAHLQYQDMTSAIRNCT  635

Query: 619 EGYKVIDWASNVSLNQEPDVVFAAAGTEPNLEALAAISILHKAFPELKIRFVNVLDILKL  678
           +G  + +WASN       EPDVV AAAG  P  EALAA ++L + FP L+IRFV+V+D+LKL
Sbjct: 636 KGVDIWEWASN-DAGTEPDVVMAAAGDIPTKEALAATAMLRQFFPNLRIRFVSVIDLLKL  694

Query: 679 RHPSQDARGLSDEEFNKVFTTDKPVIFAFHGYEDMIRDIFFSRHNH-NLHTHGYRENGDI  737
               +  S+    GLSD +F+  +FTTDKP+IF  FH Y   +I   + + R NH  NLH   GY+E G+I
Sbjct: 695 QPESEHPHGLSDRDFDSLFTTDKPIIFNFHAYPWLIHRLTYRRTNHGNLHVRGYKEKGNI  754

Query: 738 TTPFDMRVMSELDREHLAQDA--ALASLGNKAQAFSDEMNQMVAYHKDYIREHGDDIPEV  795
           T P D+ +   +++DRF LA D    L  L        ++ + M     +Y  EHG D+PE+
Sbjct: 755 NTPMDLAIQNQIDRFSLAIDVIDRLPQLRVAGAHIKEMLKDMQIDCTNYAYEHGIDMPEI  814

Query: 796 QNWKW                                                         800
           NW+W
Sbjct: 815 VNWRW                                                         819
```

No corresponding DNA sequence was identified in *S. pyogenes*.

Based on this analysis, it was predicted that these proteins and their epitopes could be useful antigens for vaccines or diagnostics.

Example 1506

A DNA sequence (GBSx1593) was identified in *S. agalactiae* <SEQ ID 4631> which encodes the amino acid sequence <SEQ ID 4632>. Analysis of this protein sequence reveals the following:

```
Possible site: 32
>>> Seems to have no N-terminal signal sequence
----- Final Results -----
   bacterial cytoplasm --- Certainty = 0.3509 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database.

```
>GP:AAF37878 GB:AF234619 OpuAA [Lactococcus lactis]
Identities = 274/402 (68%), Positives = 338/402 (83%)
Query:   5  LEVKNLTKIFGKKQKAALEMVKQGKSKTEILEKTGATVGVYDASFEIKEGEIFVIMGLSG    64
            +++++LTKIFGK+ K AL MV++G+ K EIL+KTGATVGVYD +FEI EGEIFVIMGLSG
Sbjct:   5  IKIEHLTKIFGKRIKTALTMVEKGEPKNEILKKTGATVGVYDTNFEINEGEIFVIMGLSG    64

Query:  65  SGKSTLVRMLNRLIDPSSGNIYLDGKDIAKMNVEDLRNIRRHDINMVFQNFGLFPHRTIL   124
            SGKSTL+R+LNRLI+P+SG I++D +D+A +N EDL   +RR  ++MVFQNFGLFPHRTIL
Sbjct:  65  SGKSTLLRLLNRLIEPTSGKIFIDNQDVATLNKEDLLQVRRKTMSMVFQNFGLFPHRTIL   124

Query: 125  ENTEFGLEMRGVSKEERTTLAEKALDNAGLLPFKDQYPSQLSGGMQQRVGLARALANSPK   184
            ENTE+GLE++ V KEER   AEKALDNA LL FKDQYP QLSGGMQQRVGLARALAN P+
Sbjct: 125  ENTEYGLEVQNVPKEERRKRAEKALDNANLLDFKDQYPKQLSGGMQQRVGLARALANDPE   184

Query: 185  ILLMDEAFSALDPLIRREMQDELLDLQDTNKQTIIFISHDLNEALRIGDRIALMKDGEIM   244
            ILLMDEAFSALDPLIRREMQDELL+LQ    ++TIIF+SHDLNEALRIGDRIA+MKDG+IM
Sbjct: 185  ILLMDEAFSALDPLIRREMQDELLELQAKFQKTIIFVSHDLNEALRIGDRIAIMKDGKIM   244

Query: 245  QIGTGEEILTNPANDFVREFVEDVDRSKVLTAQNIMIKPLTTVLEIDGPQVALTRMHREE   304
            QIGTGEEILTNPAND+V+ FVEDVDR+KV+TA+NIMI  LTT +++DGP VAL +M  EE
Sbjct: 245  QIGTGEEILTNPANDYVKTFVEDVDRAKVITAENIMIPALTTNIDVDGPSVALKKMKTEE   304

Query: 305  VSMLMATNRRRQLLGSLTADAAIEARKKDLPLSEVIDKDVVTVSKDTVITDIMPLIYDSS   364
            VS LMA +++RQ  G +T++ AI ARK + PL +V+  DV TVSK+ ++ DI+P+IYD+
Sbjct: 305  VSSLMAVDKKRQFRGVVTSEQAIAARKNNQPLKDVMTTDVGTVSKEMLVRDILPIIYDAP   364

Query: 365  APIAVTDDNDRLLGVIIRGRVIEALANVQDETVVESPKETVE                     406
             P+AV DDN  L GV+IRG V+EALA++ DE  VE  ++  E
Sbjct: 365  TPLAVVDDNGFLKGVLIRGSVLEALADIPDEDEVEEIEKEEE                     406
```

A related DNA sequence was identified in *S. pyogenes* <SEQ ID 4633> which encodes the amino acid sequence <SEQ ID 4634>. Analysis of this protein sequence reveals the following:

```
Possible site: 53
>>> Seems to have no N-terminal signal sequence
----- Final Results -----
   bacterial cytoplasm --- Certainty = 0.3761 (Affirmative) <succ>
      bacterial membrane --- Certainty = 0.0000 (Not Clear) <succ>
         bacterial outside --- Certainty = 0.0000 (Not Clear) <succ>
```

An alignment of the GAS and GBS proteins is shown below.

```
Identities = 344/395 (87%), Positives = 374/395 (94%)
Query:   1 MTNILEVKNLTKIFGKKQKAALEMVKQGKSKTEILEKTGATVGVYDASFEIKEGEIFVIM   60
           M  ILEVK+L+KIFGKKQKAALEMVK GK+K+EI +KTGATVGVYDASFE+K+GEIFVIM
Sbjct:   1 METILEVKHLSKIEGKKQKAALEMVKTGKNKSEIFKKTGATVGVYDASFEVKKGEIFVIM   60

Query:  61 GLSGSGKSTLVRMLNRLIDPSSGNIYLDGKDIAKMNVEDLRNIRRHDINMVFQNFGLFPH  120
           GLSGSGKSTLVRMLNRLI+PS+G+I L+GKDI+ M+ + LR +RRHDINMVFQ+F LFPH
Sbjct:  61 GLSGSGKSTLVRMLNRLIEPSAGSILLEGKDISTMSADQLREVRRHDINMVFQSFALFPH  120

Query: 121 RTILENTEFGLEMRGVSKEERTTLAEKALDNAGLLPFKDQYPSQLSGGMQQRVGLARALA  180
           +TILENTEFGLE+RGV KEER  LAEKALDN+GLL FKDQYP+QLSGGMQQRVGLARALA
Sbjct: 121 KTILENTEFGLELRGVPKEERQRLAEKALDNSGLLDFKDQYPNQLSGGMQQRVGLARALA  180

Query: 181 NSPKILLMDEAFSALDPLIRREMQDELLDLQDTNKQTIIFISHDLNEALRIGDRIALMKD  240
           NSPKILLMDEAFSALDPLIRREMQDELLDLQD+ KQTIIFISHDLNEALRIGDRIALMKD
Sbjct: 181 NSPKILLMDEAFSALDPLIRREMQDELLDLQDSMKQIIIFISHDLNEALRIGDRIALMKD  240

Query: 241 GEIMQIGTGEEILTNPANDFVREFVEDVDRSKVLTAQNIMIKPLTTVLEIDGPQVALTRM  300
           G+IMQIGTGEEILTNPANDFVREFVEDVDRSKVLTAQNIMIKPLIT +E+DGPQVAL RM
Sbjct: 241 GQIMQIGTGEEILTNPANDFVREFVEDVDRSKVLTAQNIMIKPLITTVELDGPQVALNRM  300

Query: 301 HREEVSMLMATNRRRQLLGSLTADAAIEARKKDLPLSEVIDKDVVTVSKDTVITDIMPLI  360
           H EEVSMLMATNRRRQL+GSLTADAAIEARKK LPLSEVID+DV TVSKDT+ITDI+PLI
Sbjct: 301 HNEEVSMLMATNRRRQLVGSLTADAAIEARKKGLPLSEVIDRDVRTVSKDTIITDILPLI  360

Query: 361 YDSSAPIAVTDDNDRLLGVIIRGRVIEALANVQDE                          395
           YDSSAPIAVTDDN+RLLGVIIRGRVIEALAN+ DE
Sbjct: 361 YDSSAPIAVTDDNNRLLGVIIRGRVIEALANISDE                          395
```

Based on this analysis, it was predicted that these proteins and their epitopes could be useful antigens for vaccines or diagnostics.

Example 1507

A DNA sequence (GBSx1594) was identified in *S. agalactiae* <SEQ ID 4635> which encodes the amino acid sequence <SEQ ID 4636>. This protein is predicted to be OpuABC (opuAB). Analysis of this protein sequence reveals the following:

Possible site: 41
>>> Seems to have no N-terminal signal sequence

-continued

| INTEGRAL | Likelihood = −10.67 | Transmembrane 48-64 (43-72) |
| INTEGRAL | Likelihood = −9.24 | Transmembrane 101-117 (93-122) |
| INTEGRAL | Likelihood = −7.54 | Transmembrane 296-312 (290-316) |
| INTEGRAL | Likelihood = −6.21 | Transmembrane 252-268 (250-273) |
| INTEGRAL | Likelihood = −5.57 | Transmembrane 141-157 (138-170) |
| INTEGRAL | Likelihood = −0.53 | Transmembrane 220-236 (220-237) |

----- Final Results ------
bacterial membrane --- Certainty = 0.5267 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the GENPEPT database.

```
>GP:AAF37879 GB:AF234619 OpuABC [Lactococcus lactic]
Identities = 345/578 (59%), Positives = 429/578 (73%), Gaps = 8/578 (1%)
Query:   1 MENLLQHKLPVAPFVESTTNWITKTFSGLFDFIQTIGNALMDWMTKTLLFINPLLFIVLI   60
           M +L   ++P+A +V S T+WIT TFS  FD IQ  G  LM+ +T  L  +   LI ++
Sbjct:   1 MIDLAIGQVPIANWVSSATDWITSTFSSGFDVIQKSGTVLMNGITGALTAVPFWLMIAVV   60

Query:  61 TIAVFFLAKKKWQLPTFTFIGLLFIYNQGLWEQLINTFNLVLVASLISIIIGVPLGIWMA  120
           TI    ++ KK   P FTFIGL  I NQGLW  L++T  LVL++SL+SIIIGVPLGIWMA
Sbjct:  61 TILAILVSGKKIAFPLFTFIGLSLIANQGLWSDLMSTITLVLLSSLLSIIIGVPLGIWMA  120

Query: 121 KSDKVKQVVNPILDFMQTMPAFVYLIPAVAFFGIGMVPGVFASVVFALPPTVRFTNLAIR  180
           KSD V ++V PILDFMQTMP FVYLIPAVAFFGIG+VPGVFASV+FALPPTVR TNL IR
Sbjct: 121 KSDLVAKIVQPILDFMQTMPGFVYLIPAVAFFGIGVVPGVFASVIFALPPTVRMTNLGIR  180

Query: 181 EIPLELIEASDSFGSTVKQKLFKVELPLAKNTIMAGINQTMMLALSMVVTGSMIGAPGLG  240
           ++  EL+EA+DSFGST +QKLFK+E PLAK TIMAG+NQT+MLALSMVV  SMIGAPGLG
Sbjct: 181 QVSTELVEAADSEGSTARQKLFKLEFPLAKGTIMAGVNQTIMLALSMVVIASMIGAPGLG  240

Query: 241 REVLSALQHADIGTGEVSGLSVILAIVLDRVSQFFNSKPGEKQAKTSKVKKW---VGLG  297
           R VL+A+Q ADIG GFVSG+SLVILAI++DR +Q  N  P EKQ   + VKKW    + L
Sbjct: 241 RGVLAAVQSADIGKGFVSGISLVILAIIIDRFTQKLNVSPLEKQGNPT-VKKWKRGIALV  299

Query: 298 ALALFILAALGRIVVNMTSGNEAKGQKVKIAYVQWDSEVASTNVIAEVLKSKGYDVELTP  357
           +L   I+ A      M+ G  A   +KV + Y+ WDSEVAS NV+ + +K  G+DV+ T
Sbjct: 300 SLLALIIGAFS----GMSFGKTASDKKVDLVYMNWDSEVASINVLTQAMKEHGFDVKTTA  355

Query: 358 LDNAVMWQTVANGNADFTTSAWLPKTHGQYFNKYKNSLDDLGPHVENVKIGLVVPKYMNV  417
           LDNAV WQTVANG AD   SAWLP TH  + KY  S+D LGP+++ K+G VVP YMNV
Sbjct: 356 LDNAVAWQTVANGQADGMVSAWLPNTHKTQWQKYGKSVDLLGPNLKGAKVGFVVPSYMNV  415
```

```
Query:  418  NSIEELSNQADKQITGIEPGAGIMKSAKQSLKDYPNLSSWKLLSASTGAMTTTLGKAIKN    477
             NSIE+L+NQA+K ITGIEPGAG+M +++++L   Y NL  WKL+ +S+GAMT  LG+AIK
Sbjct:  416  NSIEDLTNQANKTITGIEPGAGVMAASEKTLNSYDNLKDWKLVPSSSGAMTVALGEAIKQ    475

Query:  478  KDQVVITGWSPHWMFAKYDLKYLKDPKKSFGGEEHINTIARKNLKKDMPKVYKIIDKFKW    537
                +VITGWSPHWMF KYDLKYL DPK + G  E+INTI RK LKK+ P+ YK++DKF W
Sbjct:  476  HKDIVITGWSPHWMENKYDLKYLADPKGTMGTSENINTIVRKGLKKENPEAYKVLDKFNW    535

Query:  538  TKEDMESIMLDMDKGMEPAKAAQKWIKNHKKEVSEWTK                         575
             T +DME++MLD+   G  P +AA+ WIK+H+KEV +W K
Sbjct:  536  TTKDMEAVMLDIQNGKTPEEAAKNWIKDHQKEVDKWFK                         573
```

A related DNA sequence was identified in *S. pyogenes* <SEQ ID 4637> which encodes the amino acid sequence <SEQ ID 4638>. Analysis of this protein sequence reveals the following:

```
Possible site: 47
>>> Seems to have no N-terminal signal sequence
INTEGRAL    Likelihood = -8.86    Transmembrane 101-117  (93-121)
INTEGRAL    Likelihood = -7.54    Transmembrane 252-268  (250-273)
INTEGRAL    Likelihood = -6.85    Transmembrane  48-64   (43-70)
INTEGRAL    Likelihood = -5.57    Transmembrane 141-157  (138-170)
INTEGRAL    Likelihood = -5.26    Transmembrane 295-311  (289-315)
INTEGRAL    Likelihood = -0.53    Transmembrane 220-236  (220-237)
----- Final Results -----
   bacterial membrane --- Certainty = 0.4545 (Affirmative) <succ>
   bacterial outside  --- Certainty = 0.0000 (Not Clear)  <succ>
   bacterial cytoplasm --- Certainty = 0.0000 (Not Clear)  <succ>
```

The protein has homology with the following sequences in the databases:

```
>GP:AAF37879 GB:AF234619 OpuABC [Lactococcus lactis]
Identities = 340/571 (59%), Positives = 418/571 (72%), Gaps = 8/571 (1%)
Query:    8  KLPVAQLVEQLTEWLTKTFSGLFDIMQVVGSFLMDWMTKTLLFIHPLLFIVLVTAGMFFL     67
             ++P+A  V    T+W+T TFS  FD++Q  G+ LM+ +T  L  +   L I +VT    +
Sbjct:    8  QVPIANWVSSATDWITSTFSSGFDVIQKSGTVLMNGITGALTAVPFWLMIAVVTILAILV     67

Query:   68  AKKKWPLPTFTLLGLLFIYNQGLWKQLMNTFTLVLVASLISVLIGIPLGIWMAKNATVRQ    127
             +  KK   P FT +GL  I NQGLW   LM+T TLVL++SL+S++IG+PLGIWMAK+  V +
Sbjct:   68  SGKKIAFPLFTFIGLSLIANQGLWSDLMSTITLVLLSSLLSIIIGVPLGIWMAKSDLVAK    127

Query:  128  IVNPILDFMQTMPAFVYLIPAVAFFGIGMVPGVFASVIFALPPTVRFTNLAIRDIPTELI    187
             IV PILDFMQTMP FVYLIPAVAFFGIG+VPGVFASVIFALPPTVR TNL IR + TEL+
Sbjct:  128  IVQPILDFMQTMPGFVYLIPAVAFFGIGVVPGVFASVIFALPPTVRMTNLGIRQVSTELV    187

Query:  188  EASDAFGSTGKQKLFKVELPLAKNTIMAGVNQTMMLALSMVVTGSMIGAPGLGREVLSAL    247
             EA+D+FGST +QKLFK+E PLAK TIMAGVNQT+MLALSMVV  SMIGAPGLGR VL+A+
Sbjct:  188  EAADSFGSTARQKLFKLEFPLAKGTIMAGVNQTIMLALSMVVIASMIGAPGLGRGVLAAV    247

Query:  248  QHADIGSGFVSGLALVILAIVLDRMTQLFNSKPQEKAKAGKTNKW---IGLAALAVFLIA    304
             Q ADIG GFVSG++LVILAI++DR TQ  N  P EK          KW   I L +L  +I
Sbjct:  248  QSADIGKGFVSGISLVILAIIIDRFTQKLNVSPLEKQGNPTVKKWKRGIALVSLLALIIG    307

Query:  305  ALGRGIMAMTSGMADKGETVNIAYVQWDSEVASTHVIAEVLKNEGYHVTLTPLDNAVMWQ    364
             A          M+ G        + V++ Y+ WDSEVAS +V+   +K G+ V T LDNAV WQ
Sbjct:  308  AFS----GMSFGKTASDKKVDLVYNNWDSEVASINVLTQAMKEHGFDVKTTALDNAVAWQ    363

Query:  365  TVANGNADFSTSAWLPVTHGQQYQKYKSKLDDLGPNLKGTKLGLAVPKYMTDVNSIEDLS    424
             TVANG  AD     SAWLP TH  Q+QKY    +D LGPNLKG K+G  VP YM +VNSIEDL+
Sbjct:  364  TVANGQADGMVSAWLPNTHKTQWQKYGKSVDLLGPNLKGAKVGFVVPSYM-NVNSIEDLT    422

Query:  425  KQADQKITGIEPGAGIMAAAQKTLKEYHNLSSWELVAASTGAMTTSLDQAIKKKDPIVVT    484
              QA++  ITGIEPGAG+MAA++KTL  Y NL  W+LV +S+GAMT +L +AIK+    IV+T
Sbjct:  423  NQANKTITGIEPGAGVMAASEKTLNSYDNLKDWKLVPSSSGAMTVALGEAIKQHKDIVIT    482

Query:  485  AWSPHWMFAKYDLKYLKDPKEIFGSTENINTIARKGLKKELPNVYKIIDKFHWTQKDMEA    544
              WSPHWMF KYDLKYL DPK   G++ENINTI RKGLKKE P  YK++DKF+WT KDMEA
Sbjct:  483  GWSPHWMFNKYDLKYLADPKGTMGTSENINTIVRKGLKKENPEAYKVLDKFNWTTKDMEA    542

Query:  545  VMLDINKGMSPEAAAKKWVEANKSKVSSWTK                               575
             VMLDI  G +PE AAK W++   ++ +V  W K
Sbjct:  543  VMLDIQNGKTPEEAAKNWIKDHQKEVDKWFK                               573
```

An alignment of the GAS and GBS proteins is shown below.

```
Identities = 439/576 (76%), Positives = 513/576 (88%), Gaps = 2/576 (0%)
Query:   1 MENLLQHKLPVAPFVESTTNWITKTFSGLFDFIQTIGNALMDWMTKTLLFINPLLFIVLI    60
           +E +LQ KLPVA  VE  T W+TKTFSGLFD +Q +G+ LMDWMTKTLLFI+PLLFIVL+
Sbjct:   1 LETILQTKLPVAQLVEQLTEWLTKTFSGLFDIMQVVGSFLMDWMTKTLLFIHPLLFIVLV   60

Query:  61 TIAVFFLAKKKWQLPTFTFIGLLFIYNQGLWEQLINTFNLVLVASLISIIIGVPLGIWMA  120
           T  +FFLAKKKW LPTFT +GLLFIYNQGLW+QL+NTF LVLVASLIS++IG+PLGIWMA
Sbjct:  61 TAGMFFLAKKKWPLPTFTLLGLLFIYNQGLWKQLMNTFTLVLVASLISVLIGIPLGIWMA  120

Query: 121 KSDKVKQVVNPILDFMQTMPAFVYLIPAVAFFGIGMVPGVFASVVFALPPTVRFTNLAIR  180
           K+   V+Q+VNPILDFMQTMPAFVYLIPAVAFFGIGMVPGVFASV+FALPPTVRFTNLAIR
Sbjct: 121 KNATVRQIVNPILDFMQTMPAFVYLIPAVAFFGIGMVPGVFASVIFALPPTVRFTNLAIR  180

Query: 181 EIPLELIEASDSFGSTVKQKLFKVELPLAKNTIMAGINQTMMLALSMVVTGSMIGAPGLG  240
           +IP ELIEASD+FGST KQKLFKVELPLAKNTIMAG+NQTMMLALSMVVTGSMIGAPGLG
Sbjct: 181 DIPTELIEASDAFGSTGKQKLFKVELPLAKNTIMAGVNQTMMLALSMVVTGSMIGAPGLG  240

Query: 241 REVLSALQHADIGTGFVSGLSLVILAIVLDRVSQFFNSKPGEKQAKTSKVKKWVGLGALA  300
           REVLSALQHADIG+GFVSGL+LVILAIVLDR++Q FNSKP EK AK  K  KW+GL ALA
Sbjct: 241 REVLSALQHADIGSGFVSGLALVILAIVLDRMTQLFNSKPQEK-AKAGKTNKWIGLAALA  299

Query: 301 LFILAALGRIVVNMTSGNEAKGQKVKIAYVQWDSEVASTNVIAEVLKSKGYDVELTPLDN  360
           +F++AALGR ++ MTSG   KG+ V IAYVQWDSEVAST+VIAEVLK++GY V LTPLDN
Sbjct: 300 VFLIAALGRGIMAMTSGMADKGETVNIAYVQWDSEVASTHVIAEVLKNEGYHVTLTPLDN  359

Query: 361 AVMWQTVANGNADFTTSAWLPKTHGQYFNKYKNSLDDLGPHVENVKIGLVVPKYM-NVNS  419
           AVMWQTVANGNADF+TSAWLP THGQ + KYK+ LDDLGP+++  K+GL VPKYM +VNS
Sbjct: 360 AVMWQTVANGNADFSTSAWLPVTHGQQYQKYKSKLDDLGPNLKGTKLGLAVPKYMTDVMS  419

Query: 420 IEELSNQADKQITGIEPGAGIMKSAKQSLKDYPNLSSWKLLSASTGAMTTTLGKAIKNKD  479
           IE+LS QAD++ITGIEPGAGIM +A+++LK+Y NLSSW+L++ASTGAMTT+L +AIK KD
Sbjct: 420 IEDLSKQADQKITGIEPGAGIMAAAQKTLKEYHNLSSWELVAASTGAMTTSLDQAIKKKD  479

Query: 480 QVVITGWSPHWMFAKYDLKYLKDPKKSFGGEEHINTIARKNLKKDMPKVYKIIDKFKWTK  539
            +V+T WSPHWMFAKYDLKYLKDPK+ FG  E+INTIARK LKK++P VYKIIDKF WT+
Sbjct: 480 PIVVTAWSPHWMFAKYDLKYLKDPKEIFGSTENINTIARKGLKKELPNVYKIIDKFHWTQ  539

Query: 540 EDMESIMLDMDKGMEPAKAAQKWIKNHKKEVSEWTK                         575
           +DME++MLD++KGM P  AA+KW++ +K +VS WTK
Sbjct: 540 KDMEAVMLDINKGMSPEAAAKKWVEANKSKVSSWTK                         575
```

A related GBS gene <SEQ ID 8827> and protein <SEQ ID 8828> were also identified. Analysis of this protein sequence reveals the following:

Lipop: Possible site: –1   Crend: 7
McG: Discrim Score: –6.57
GvH: Signal Score (–7.5): –5.37
Possible site: 41
>>> Seems to have no N-terminal signal sequence
ALOM program count: 6 value: –10.67 threshold: 0.0
INTEGRAL    Likelihood = –10.67   Transmembrane 48-64     (43-72)
INTEGRAL    Likelihood = –9.24    Transmembrane 101-117   (93-122)
INTEGRAL    Likelihood = –7.54    Transmembrane 296-312   (290-316)
INTEGRAL    Likelihood = –6.21    Transmembrane 252-268   (250-273)
INTEGRAL    Likelihood = –5.57    Transmembrane 141-157   (138-170)
INTEGRAL    Likelihood = –0.53    Transmembrane 220-236   (220-237)
PERIPHERAL  Likelihood = 2.44     159
modified ALOM score: 2.63
*** Reasoning Step: 3
----- Final Results -----
    bacterial membrane --- Certainty = 0.5267 (Affirmative) <succ>
     bacterial outside --- Certainty = 0.0000 (Not Clear) <succ>
      bacterial cytoplasm --- Certainty = 0.0000 (Not Clear) <succ>

The protein has homology with the following sequences in the databases:

```
ORF00938(322-2025 of 2325)
GP|7188801|gb|AAF37879.1|AF234619_2|AF234619(8-573 of 573) OpuABC {Lactococcus lactis}
% Match = 44.7
% Identity = 60.2  % Similarity = 75.7
Matches = 342 Mismatches = 136 Conservative Sub.s = 88

255       285       315       345       375       405       435       465
ANVQDETVVESPKETVEA**RGQIILENLLQHKLPVAPFVESTTNWITKTFSGLFDFIQTIGNALMDWMTKTLLFINPLL
                     ::|: :|  | |:||| ||| || |   ||: :|    :    |
                    MIDLAIGQVPIANWVSSATDWITSTFSSGFDVIQKSGTVLMNGITGALTAVPFWL
                     10        20        30        40        50
```

```
495        525        555        585        615        645        675        705
FIVLITIAVFFLAKKKWQLPTFTFIGLLFIYNQGLWEQLINTFNLVLVASLISIIIGVPLGIWMAKSDKVKQVVNPILDF
   |  :||    :::  ||  :|  |||||| :| |||||  |::  |||::||:|||||||||||||  | ::| |||||
MIAVVTILAILVSGKKIAFPLFTFIGLSLIANQGLWSDLMSTITLVLLSSLLSIIIGVPLGIWMAKSLDVAKIVQPILDF
            70        80        90        100       110       120       130

735        765        795        825        855        885        915        945
MQTMPAFVYLIPAVAFFGIGMVPGVFASVVFALPPTVRFTNLAIREIPLELIEASDSFGSTVKQKLFKVELPLAKNTIMA
||||| |||||||||||||:||||||||||| ||:::  ||::||||||  :|||::|:|||| |||:||||||
MQTMPGFVYLIPAVAFFGIGVVPGVFASVIFALPPTVRMTNLGIRQVSTELVEAADSFGSTARQKLFKLEFPLAKGTIMA
            150       160       170       180       190       200       210

975        1005       1035       1065       1095       1125       1155       1185
GINQTMMLALSMVVTGSMIGAPGLGREVLSALQHADIGTGFVSGLSLVILAIVLDRVSQFFNSKPGEKQAKTSKVKKWVG
|:|||:||||||||  |||||||||||| ||:|: |||| |||||:|||||||::|| :| :|  |  |||    ||||
GVNQTIMLALSMVVIASMIGAPGLGRGVLAAVQSADIGKGFVSGISLVILAIIIDRFTQKLNVSPLEKQG-NPTVKKW-K
            230       240       250       260       270       280       290

1215       1245       1275       1305       1335       1365       1395       1425
LGALALFILAALGRIVVNMTSGNEAKGQKVKIAYVQWDSEVASTNVIAEVLKSKGYDVELTPLDNAVMWQTVANGNADFT
|   :  :||  :    |:|  |  |  :|| | |: ||||||||| ||: : :| :||| | ||||| |||||||| ||
RGIALVSLLALIIGAFSGMSFGKTASDKKVDLVYMNWDSEVASINVLTQAMKEHGFDVKTTALDNAVAWQTVANGQADGM
            310       320       330       340       350       360       370

1455       1485       1515       1545       1575       1605       1635       1665
TSAWLPKTHGQYFNKYKNSLDDLGPHVENVKIGLVVPKYMNVNSIEELSNQADKQITGIEPGAGIMKSAKQSLKDYPNLS
||||| ||   : ||  |:|  |||::   |:|:|||  ||||||||||:|:| |  ||||||||||:|:::::|  | |
VSAWLPNTHKTQWQKYGKSVDLLGPNLKGAKVGFVVPSYMNVNSIEDLTNQANKTITGIEPGAGVMAASEKTLNSYDNLK
            390       400       410       420       430       440       450

1695       1725       1755       1785       1815       1845       1875       1905
SWKLLSASTGAMTTTLGKAIKNKDQVVITGWSPHWMFAKYDLKYLKDPKKSFGGEEHINTIARKNLKKDMPKVYKIIDKF
|||: :|:||||  ||:|||     :|||||||||||||| |||||||| |||||   |||:|  :  |:||||  ||||
DWKLVPSSSGAMTVALGEAIKQHKDIVITGWSPHWMFNKYDLKYLADPKGTMGTSENINTIVRKGLKKENPEAYKVLDKF
            470       480       490       500       510       520       530

1935       1965       1995       2025       2055       2085       2115       2145
KWTKEDMESIMLDMDKGMEPAKAAQKWIKNHKKEVSEWTK*YRKKHVSFRACFLM*LKSF*LFNISFILF*YIKSERMKE
 || :|||::|||:   |    |  |  ::||  |||:|:|||  :|||| |
NWTTKDMEAVMLDIQNGKTPEEAAKNWIKDHQKEVDKWFK
            550       560       570
```

Based on this analysis, it was predicted that these proteins and their epitopes could be useful antigens for vaccines or diagnostics.

Example 1508

A DNA sequence (GBSx1596) was identified in *S. agalactiae* <SEQ ID 4639> which encodes the amino acid sequence <SEQ ID 4640>. This protein is predicted to be a transposase. Analysis of this protein sequence reveals the following:

Possible site: 45
>>> Seems to have no N-terminal signal sequence
INTEGRAL    Likelihood = −1.65   Transmembrane 223-239 (223-240)

----- Final Results -----
bacterial membrane --- Certainty = 0.1659 (Affirmative) <succ>
bacterial outside --- Certainty = 0.0000 (Not Clear) <succ>
bacterial cytoplasm --- Certainty = 0.0000 (Not Clear) <succ>

A related GBS nucleic acid sequence <SEQ ID 10057> which encodes amino acid sequence <SEQ ID 10058> was also identified. A related GBS nucleic acid sequence <SEQ ID 10031> which encodes amino acid sequence <SEQ ID 10032> was also identified. A related GBS nucleic acid sequence <SEQ ID 10801> which encodes amino acid sequence <SEQ ID 10802> was also identified.

The protein has homology with the following sequences in the GENPEPT database.

```
>GP:CAA50689 GB:X71844 putative transposase [Clostridium perfringens]
Identities = 94/364 (25%), Positives = 160/364 (43%), Gaps = 35/364 (9%)
Query:    8  KHKHLTLLDRNDIQSGLDRGETFKAIGLNLLKHPTTIAKEVKRN--KQLRESTKDCLDCP   65
             K+KHL + +R    ++  L  G +         L +    T+  E++R    KQ+++   +    +
Sbjct:   12  KNKHLNMKERMIVEIRLKDGFSAYKNTKELNRPINTVLNEIRRGTTKQIKQGKEFHVYFA   71

Query:   66  LLRKAPYVCNGCPKRRINCGYKKTFYLAKQAQRNYEKLLVESREGIPLNKETFWKIDRVL  125
                +A Y  N    + +N    YK        ++ K +V+       K    W +D +
Sbjct:   72  DTGEAVYKKN---RLKSNRKYKLL------ECSDFIKYVVDKV------KNDHWSLDACV  116

Query:  126  SNGVKKGQRIYHILKTNDLEVSSSTVYRHIKKGYLSITPIDLPRAVKFKKRRKSTLPPIP  185
                   G+ ++      +    +S+  T+Y ++     G L I    IDLP  K    + +KST
Sbjct:  117  ------GEALHSSRFSPSQIISTKTLYNYVDLGLLPIKNIDLP--AKLHRNKKSTRVRNN  168
```

-continued

```
Query: 186  KAIKEGRRYEDFIEHM-NQSELNSWLEMDTVIGRIGGK--VLLTFNVAFCNFIFAKLMDS  242
            K  KG    D    + N+ E   W E+D V+G     K  VLLT      +     M S
Sbjct: 169  KK-KLGTSISDRPNSIENREEFGHW-EIDCVLGEKSNKDKVLLTLVERKTRYAIISEMSS  226

Query: 243  KTAIETAKHIQVIKRTLYDNKRDFFELFPVILTDNGGEFARVDDIEIDVCGQSQLFFCDP  302
            + I    K +  IK  L       F E+F  I  DNG EFA + + E+     +++++F P
Sbjct: 227  HSTISVTKALDKIKEFLGSK---FSEVFKSITADNGSEFADLSEFELKT--KTKVYFTHP  281

Query: 303  NRSDQKARIEKNHTLVRDILPKGTSFDNLTQEDINLALSHINSVKRQALNGKTAYELFSF  362
               S +K    E+++ L+R  +PKG    + +  E I+    + +N++ R+ L+ KT   ELF
Sbjct: 282  YSSFEKGTNERHNGLIRRFIPKGKRISDYSLETISFIENWMNTLPRKLLDYKTPEELFEI  341

Query: 363  TYGK  366
            K
Sbjct: 342  HLDK  345
```

No corresponding DNA sequence was identified in *S. pyogenes*.

Based on this analysis, it was predicted that these proteins and their epitopes could be useful antigens for vaccines or diagnostics.

Example 1509

A DNA sequence (GBSx1597) was identified in *S. agalactiae* <SEQ ID 4641> which encodes the amino acid sequence <SEQ ID 4642>. Analysis of this protein sequence reveals the following:

Possible site: 33
>>> Seems to have an uncleavable N-term signal seq
INTEGRAL    Likelihood = −11.30   Transmembrane  56-72    (48-79)
INTEGRAL    Likelihood = −6.85    Transmembrane  11-27    (6-30)
INTEGRAL    Likelihood = −6.69    Transmembrane  129-145  (126-158)
INTEGRAL    Likelihood = −6.53    Transmembrane  94-110   (90-117)
INTEGRAL    Likelihood = −1.54    Transmembrane  216-232  (215-232)
INTEGRAL    Likelihood = −1.22    Transmembrane  147-163  (147-165)
----- Final Results -----
    bacterial membrane --- Certainty = 0.5522 (Affirmative) <succ>
    bacterial outside --- Certainty = 0.0000 (Not Clear) <succ>
    bacterial cytoplasm --- Certainty = 0.0000 (Not Clear) <succ>

A related GBS nucleic acid sequence <SEQ ID 9431> which encodes amino acid sequence <SEQ ID 9432> was also identified.

The protein has homology with the following sequences in the GENPEPT database.

No corresponding DNA sequence was identified in *S. pyogenes*.

Based on this analysis, it was predicted that these proteins and their epitopes could be useful antigens for vaccines or diagnostics.

Example 1510

A DNA sequence (GBSx1599) was identified hi *S. agalactiae* <SEQ ID 4643> which encodes the amino acid sequence <SEQ ID 4644>. This protein is predicted to be Na/H antiporter homolog (WM. Analysis of this protein sequence reveals the following:

Possible site: 17
>>> Seems to have an uncleavable N-term signal seq
INTEGRAL    Likelihood = −10.14   Transmembrane  176-192  (171-203)
INTEGRAL    Likelihood = −9.34    Transmembrane  353-369  (348-373)
INTEGRAL    Likelihood = −9.24    Transmembrane  3-19     (1-26)
INTEGRAL    Likelihood = −7.17    Transmembrane  145-161  (142-168)
INTEGRAL    Likelihood = −7.01    Transmembrane  86-102   (81-108)
INTEGRAL    Likelihood = −6.53    Transmembrane  52-68    (51-72)
INTEGRAL    Likelihood = −5.79    Transmembrane  24-40    (23-49)
INTEGRAL    Likelihood = −5.52    Transmembrane  214-230  (209-233)
INTEGRAL    Likelihood = −4.04    Transmembrane  260-276  (258-278)
INTEGRAL    Likelihood = −3.66    Transmembrane  287-303  (287-308)
INTEGRAL    Likelihood = −2.71    Transmembrane  113-129  (112-129)
INTEGRAL    Likelihood = −2.66    Transmembrane  332-348  (330-349)
----- Final Results -----
    bacterial membrane --- Certainty = 0.5055 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:BAB07666 GB:AP001520 unknown conserved protein [Bacillus halodurans]
Identities = 112/224 (50%), Positives = 150/224 (66%), Gaps = 2/224 (0%)
Query:   8  IKDILWFIIPSLFGVLLLMTPFKYNGMTTVAVSVISKTINQWINAVFPIHYIILLIIFIS  67
            +KD LWF+IPS+ GV L M P + +    T+ V+ ++K +    ++   P     I+L I +
Sbjct:  19  LKDYLWFLIPSIIGVGLFMVPIQKDNAITIPVAFLAKQLQGALDDHLPAILTIMLAIVV-  77

Query:  68  CVLALCYRLFRPSFIEKNDLLKEISDITIFWLIIRLIGLALGLMTVLHIGPEMVWGKETG  127
              VL+    LF+P+    KN LLK +  I    WL++R++G       MT+L +GPE VW +  TG
Sbjct:  78  -VLSCVATLFKPNLFMKNGLLKSLFVIHPMWLVVRVLGFIFAFMTLLQLGPEAVWSEGTG  136

Query: 128  GLILFDLIGGLFTIFLAAGFILPFLTEFGLLEFVGVFLTPIMRPFFQLPGRSAVNCVASF  187
             L+L+DL+   LFTIFL AG  LPFL   FGLLE   GV L    MRP F LPGRS+++C+AS+
Sbjct: 137  ALLLYDLLPLLFTIFLFAGLFLPFLLNFGLLELFGVLLNKFMRPVFTLPGRSSIDCLASW  196

Query: 188  VGDGTIGIALTDKQYVEGYYTSREAATISTTFSAVSITFCLXXL  231
            +GDGTIG+  LT+KQY EG+YT REAA ISTTFS VSITF +  L
Sbjct: 197  MGDGTIGVLLTNKQYEEGFYTQREAAVISTITSVVSITFSIVVL  240
```

```
>GP:CAA51756 GB:X73329 Na/H antiporter homolog [Lactococcus lactis]
Identities = 208/376 (55%), Positives = 285/376 (75%), Gaps = 3/376 (0%)
Query:   1 MHIIIQITIILLASVLATLISKRIGIPAVVGQLLVGIIIGPAMLGLVHQNQVLHVLSEIG     60
           M+ I+Q+TI+L+AS++ATL S+R+ IPAV+GQ+LVGI+I P++LGLVH   VL V+SEIG
Sbjct:   1 MNDILQLTIVLIASLIATLASRRLKIPAVIGQMLVGILIAPSVLGLVHSGHVLEVMSEIG     60

Query:  61 VILLMFLAGLEANFDLLKKYLKPSLLVAITGVIVPMALFYFLTRLFGFQINTAIFYGLVF    120
           VILLMFLAGLE++  +LKK  K S+LVAI GVIVP+ +F  +   FG+ ++T+ FYG+VF
Sbjct:  61 VILLMFLAGLESDLTVLKKNFKASMLVAIGGVIVPLIVFGLVAFSFGYGMSTSFFYGIVF    120

Query: 121 AATSISITVEVLQEYNRVKTDTGAIILGAANADDVLAVLLLSVFIA--TNGSSSNIGLQI    178
           AATS+SITVEVLQEY ++ T  G+IILGAAV DD+LAVL+LS+F +    GS +++  Q
Sbjct: 121 AATSVSITVEVLQEYGKLSTRAGSIILGAAVVDDILAVLILSIFTSFKNGGSGTHLFFQF    180

Query: 179 IIQLLFFVFLFICMKYLVPALFKLIEKVHFFEKYTILAILICFSLSILADKVGMSSIIGS    238
           +++LLFF FLF+  K L+P  +K ++K+     K TI+A++IC  LS+LAD VGMS++IGS
Sbjct: 181 LLELLFFAFLFVVHK-LIPRFWKFVQKLPIANKNTIVALIICLGLSLLADSVGMSAVIGS    239

Query: 239 FFAGLAIGQTSFVDKVEHKISLLSYTFFIPIFFASIALPLKFDGMMSHLHTILIFTALAV    298
           FFAGLAI QT   K+E  S + Y  FIP+FF IA+ ++FD ++ H   IL+FT LA+
Sbjct: 240 FFAGLAISQTEVSHKIEEYTSAIGYVIFIPVFFVLIAISVQFDSLIHHPWIILLFTLLAI    299

Query: 299 LSKLIPGYFVGRGFNFSKLESLTIGGGMVSRGEMALIIVQVGLAAKIISSTTYSELVIVV    358
           L+K IP YFVG+    S  ES+ IG GM+SRGEMALI+ Q+GL + II+   YSELVIV+
Sbjct: 300 LTKFIPAYFVGKSNKLSTGESMLIGTGMISRGEMALIVAQIGLTSAIITDEVYSELVIVI    359

Query: 359 ILSTIIAPFILKYSFK                                              374
           IL+T++APF++K   K
Sbjct: 360 ILATVLAPFLIKLVLK                                              375
```

No corresponding DNA sequence was identified in *S. pyogenes*.

Based on this analysis, it was predicted that this protein and its epitopes, could be useful antigens for vaccines or diagnostics.

Example 1511

A DNA sequence (GBSx1600) was identified in *S. agalactiae* <SEQ ID 4645> which encodes the amino acid sequence <SEQ ID 4646>. Analysis of this protein sequence reveals the following:

Possible site: 22
>>> Seems to have a cleavable N-term signal seq.
----- Final Results -----
   bacterial outside --- Certainty = 0.3000 (Affirmative) <succ>
   bacterial membrane --- Certainty = 0.0000 (Not Clear) <succ>
   bacterial cytoplasm --- Certainty = 0.0000 (Not Clear) <succ>

The protein has homology with the following sequences in the GENPEPT database.

```
>GP:CAB14269 GB:Z99116 ypuA [Bacillus subtilis]
Identities = 86/319 (26%), Positives = 147/319 (45%), Gaps = 34/319 (10%)
Query:   3 IKKLLFAGLAFILFTLASPAYAASDVQKVIDETYVQPDYVLGYSLNQEQRAQTLQLLNYD     62
           +KK+    LA + L  P  +D    + V   LG L++ + + L  +N
Sbjct:   1 MKKIWIGMLAAAVLLLMVPKVSLADA--AVGDVIV----TLGADLSESDKQKVLDEMNVP     54

Query:  63 ESRDTKVKTLNTSSYAKIMNIADDASIQLY----SSVKIKKLGSNDTLAVNIVTPENITK    118
           ++  T V  N  +     +A I      SS+ I K GS     +N+ T   NI+
Sbjct:  55 DNATT-VTVTNKEEHEYLGKYISNAQIGSRAISSSSITIAKKGSG----LNVET-HNISG    108

Query: 119 VTEDMYRNAAVTLGIEHATISVAAPIKVTGESALAGIYYSLE-KNGASVSSENKQLAQEE    177
           +T++MY NA +T G++  A + AP +V+G +AL G+ + E + ++S + KQ+A +E
Sbjct: 109 ITDEMYLNALMTAGVKDAKVYVTAPFEVSGTAALTGLIKAYEVSSDEAISEDVKQVANQE    168

Query: 178 LSTLSGINAENKGKEGYDADKLNVALTDIKSAVAKGGSDLSKDDIRKIVEETLKNYHLDN    237
           L T S +   G E  A     + IK   AK G   +K DI K V++    + L+
Sbjct: 169 LVTTSEL-GDKIGNENAAA-----LIAKIKEEFAKNGVPDNKADIEKQVDDAASD--LNV    220

Query: 238 AVTENQINLIVNFAVNLSQSNVIKNSDFTNTLNNLKDNIVSKAGSKFKNINVNFNANKAV    297
           +T++Q N +V    S N +KN+D       + D +  KA K    +     +
Sbjct: 221 TLTDSQKNQLV------SLFNKMKNADI--DWGQVSDQL-DKAKDKITKFIESDEGKNFI    271

Query: 298 ESGKGFLANIWQQIVNFFQ                                           316
           +    F  +IW  IV+ F+
Sbjct: 272 QKVIDFFVSIWNAIVSIFK                                           290
```

No corresponding DNA sequence was identified in *S. pyogenes*.

Based on this analysis, it was predicted that this protein and its epitopes, could be useful antigens for vaccines or diagnostics.

Example 1512

A repeated DNA sequence (GBSx1602) was identified in *S. agalactiae* <SEQ ID 4647> which encodes the amino acid sequence <SEQ ID 4648>. Analysis of this protein sequence reveals the following:

```
Possible site: 19
>>> Seems to have no N-terminal signal sequence
----- Final Results -----
    bacterial cytoplasm --- Certainty = 0.0603 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP:CAB15719 GB:Z99122 similar to hypothetical proteins [Bacillus subtilis]
Identities = 76/138 (55%), Positives = 91/138 (65%), Gaps = 12/138 (8%)
Query:    1 MKLKAVHHIAIIVSDYEKSKDFYVNKLGFEIIRENHRPERHDYKLDLRC-GDIELEIFGN    59
            M LK++HHIAII SDYEKSK FYV+KLGF++I+E +R ER  YKLDL  G   +E+F
Sbjct:    1 MLLKSIHHIAIICSDYEKSKAFYVHKLGFQVIQETYREERGSYKLDLSLNGSYVIELF--   58

Query:   60 RLDDPEYETPPQRIGRPNWPREACGLRHLAFYVPDVEAYKVELENLGIFVEPIRYDDYTG  119
               +  PP+R  RP    EA GLRHLAF V ++    EL   GI EPIR D   TG
Sbjct:   59 -----SFPDPPERQTRP----EAAGLRHLAFTVGSLDKAVQELHEKGIETEPIRTDPLTG  109

Query:  120 KKMTFFFDPDGLPLELHE                                           137
            K+ TFFFDPD LPLEL+E
Sbjct:  110 KRFTFFFDPDQLPLELYE                                           127
```

A related DNA sequence was identified in *S. pyogenes* <SEQ ID 4649> which encodes the amino acid sequence <SEQ ID 4650>. Analysis of this protein sequence reveals the following:

```
Possible site: 20
>>> Seems to have no N-terminal signal sequence
----- Final Results -----
    bacterial cytoplasm --- Certainty = 0.1205 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
Identities = 99/137 (72%), Positives = 116/137 (84%)
Query:    1 MKLKAVHHIAIIVSDYEKSKDFYVNKLGFEIIRENHRPERHDYKLDLRCGDIELEIFGNR   60
            MKL A+HH+AIIVSDY SKDFYVNKLGFEIIREN+RP++HDYKLDL CG IELEIFG
Sbjct:    2 MKLNAIHHVAIIVSDYHLSKDFYVNKLGFEIIRENYRPDKHDYKLDLSCGRIELEIEGKV   61

Query:   61 LDDPEYETPPQRIGRPNWPREACGLRHLAFYVPDVEAYKVELENLGIFVEPIRYDDYTGK  120
             DP Y+ PP+R+  P +   EACGLRHLAF V ++E+Y  +L++LGI VEPIR+DDYTG+
Sbjct:   62 TSDPNYQAPPKRVSEPEEKSEACGLRHLAFRVTNIESYVDDLKSLGIPVEPIRHDDYTGE  121

Query:  121 KMTFFFDPDGLPLELHE                                            137
            KMTFFFDPDGLPLELHE
Sbjct:  122 KMTFFFDPDGLPLELHE                                            138
```

Based on this analysis, it was predicted that these proteins and their epitopes could be useful antigens for vaccines or diagnostics.

Example 1513

A DNA sequence (GBSx1603) was identified in *S. agalactiae* <SEQ ID 4651> which encodes the amino acid sequence <SEQ ID 4652>. This protein is predicted to be alpha-amylase. Analysis of this protein sequence reveals the following:

```
Possible site: 40
>>> Seems to have an uncleavable N-term signal seq
INTEGRAL    Likelihood = -11.62    Transmembrane 14-30 (7-36)
----- Final Results -----
    bacterial membrane --- Certainty = 0.5649 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:AAG41778 GB:AF213261 sortase [Streptococcus gordonii]
Identities = 136/247 (55%), Positives = 174/247 (70%), Gaps = 2/247 (0%)
Query:   2  RNKKKSHGFFNFVRWLLVVLLIIVGLALVFNKPIRNAFIAHQSNHYQISRVSKKTIEKNK  61
            R  KK     N +  +L V+L++V LAL+FN  IRN  +   +N YQ+S+VSKK IEKNK
Sbjct:   6  RRAKKKRSRRNIILNILSVILLLVALALIFNSSIRNMIMVWHTNKYQVSKVSKKEIEKNK  65

Query:  62  KSKTSYDFSSVKSISTESILSAQTKSHNLPVIGGIAIPDVEINLPIFKGLGNTELSYGAG  121
             SK S++F  V+ +STE++L+AQ K+  LPVIGGIAIP++ +NLPIF GL N  L YGAG
Sbjct:  66  ASKGSFNFEKVEPLSTEAVLNAQWKAQQLPVIGGIAIPELSLNLPIFNGLENAGLYYGAG  125

Query: 122  TMKENQIMGGPNNYALASHHVFGLTGSSKMLFSPLEHAKKGMKVYLTDKSKVYTYTITEI  181
            TMKE Q M G  NYALASHHVFG+TG+++MLFSPL+ AK GMK+YLTDK KVYTY+IT +
Sbjct: 126  TMKETQEM-GKGNYALASHHVFGITGANEMLFSPLDRAKAGMKIYLTDKEKVYTYSITSV  184

Query: 182  SKVTPEHVEVIDD-TPGKSQLTLVTCTDPEATERIIVHAELEKTGEFSTADESILKAFSK  240
                V PE V+V+DD    G +++TLVTC D  AT R IV   LE    +    + IL  F+K
Sbjct: 185  ENVEPERVDVVDDAADGTAEVTLVTCEDAAATSRTIVKGVLESETPYKETPKKILNYFNK  244

Query: 241  KYNQINL  247
            YNQ+ L
Sbjct: 245  SYNQMQL  251
```

A related DNA sequence was identified in *S. pyogenes* <SEQ ID 4653> which encodes the amino acid sequence <SEQ ID 4654>. Analysis of this protein sequence reveals the following:

---

Possible site: 34
>>> Seems to have an uncleavable N-term signal seq
INTEGRAL    Likelihood = −8.12    Transmembrane 18-34  (13-38)
INTEGRAL    Likelihood = −0.32    Transmembrane 94-110 (94-110)
----- Final Results -----
   bacterial membrane --- Certainty = 0.4248 (Affirmative) <succ>
      bacterial outside --- Certainty = 0.0000 (Not Clear) <succ>
         bacterial cytoplasm ---Certainty = 0.0000 (Not Clear) <succ>

---

The protein has homology with the following sequences in the databases:

```
>GP:AAA73122 GB:M77279 alpha-amylase [unidentified cloning vector]
Identities = 60/122 (49%), Positives = 85/122 (69%)
Query:   7  RRKIKSMSWARKLLIAVLLILGLALLFNKPIRNTLIARNSNKYQVTKVSKKQIKKNKEAKS  67
            + K +  +W    L+ +L I+GLAL+FN  IR+ ++ +NS  Y V+K+    +KKN   ++
Sbjct:   4  KEKKRGKNWLINSLLVLLFIIGLALIFNNQIRSWVVQQNSRSYAVSKLKPADVKKNMARET  64

Query:  68  TFDFQAVEPVSTESVLQAQMAAQQLPVIGGIAIPELGINLPIFKGLGNTELIYGAGTMKEE 127
            TFDF +VE +STE+V++AQ   + LPVIG IAIP + INLPIFKGL N  L+ GAGTMKE+
Sbjct:  65  TFDFDSVESLSTEAVMKAQFENKNLPVIGAIAIPSVEINLPIFKGLSNVALLTGAGTMKED 124
```

An alignment of the GAS and GBS proteins is shown below.

```
Identities = 147/245 (60%), Positives = 192/245 (78%)
Query:   2  RNKKKSHGFFNFVRWLLVVLLIIVGLALVFNKPIRNAFIAHQSNHYQISRVSKKTIEKNK  61
            + K++     ++ R LL+ +L+I+GLAL+FNKPIRN  IA   SN YQ+++VSKK I+KNK
Sbjct:   4  KQKRRKIKSMSWARKLLIAVLLILGLALLFNKPIRNTLIARNSNKYQVTKVSKKQIKKNK  63

Query:  62  KSKTSYDFSSVKSISTESILSAQTKSHNLPVIGGIAIPDVEINLPIFKGLGNTELSYGAG  121
            ++K+++DF +V+ +STES+L AQ  +  LPVIGGIAIP++ INLPIFKGLGNTEL YGAG
Sbjct:  64  EAKSTFDFQAVEPVSTESVLQAQMAAQQLPVIGGIAIPELGINLPIFKGLGNTELIYGAG  123

Query: 122  TMKENQIMGGPNNYALASHHVFGLTGSSKMLFSPLEHAKKGMKVYLTDKSKVYTYTITEI  181
            TMKE Q+MGG NNY+LASHH+FG+TGSS+MLFSPLE A+ GM SYLTDK K+Y Y I ++
Sbjct: 124  TMKEEQVMGGENNYSLASHHIFGITGSSQMLFSPLERAQNGMSIYLTDKEKIYEYIIKDV  183

Query: 182  SKVTPEHVEVIDDTPGKSQLTLVTCTDPEATERIIVHAELEKTGEFSTADESILKAFSKK  241
                V PE V+VIDDT G  ++TLVTCTD EATER IIV   EL+    +F  A   +LKAF+
Sbjct: 184  FTVAPERVDVIDDTAGLKEVTLVTCTDIEATERIIVKGELKTEYDFDKAPADVLKAFNHS  243

Query: 242  YNQIN  246
            YNQ++
Sbjct: 244  YNQVS  248
```

SEQ ID 4652 (GBS266) was expressed in *E. coli* as a His-fusion product. SDS-PAGE analysis of total cell extract is shown in FIG. 49 (lane 11; MW 26 kDa).

Figure 205:
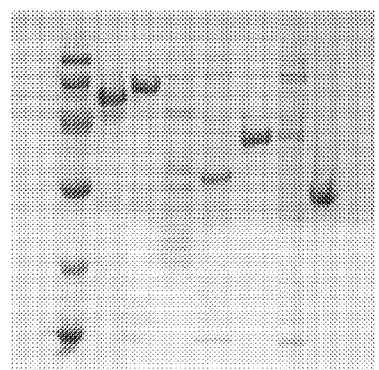

GBS266-His was purified as shown in FIG. 205, lane 10.

Based on this analysis, it was predicted that these proteins and their epitopes could be useful antigens for vaccines or diagnostics.

Example 1514

A DNA sequence (GBSx1604) was identified in *S. agalactiae* <SEQ ID 4655> which encodes the amino acid sequence <SEQ ID 4656>. Analysis of this protein sequence reveals the following:

Possible site: 31
>>> Seems to have no N-terminal signal sequence
----- Final Results -----
   bacterial cytoplasm --- Certainty = 0.1934 (Affirmative) <succ>
   bacterial membrane --- Certainty = 0.0000 (Not Clear) <succ>
   bacterial outside --- Certainty = 0.0000 (Not Clear) <succ>

A related DNA sequence was identified in *S. pyogenes* <SEQ ID 4657> which encodes the amino acid sequence <SEQ ID 4658>. Analysis of this protein sequence reveals the following:

Possible site: 31
>>> Seems to have no N-terminal signal sequence
----- Final Results -----
   bacterial cytoplasm --- Certainty = 0.1934 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 711/819 (86%), Positives = 767/819 (92%)
Query:   1  MQDKNLVDVNLTSEMKTSFIDYAMSVIVARALPDVRDGLKPVHRRILYGMNELGVTPDKP   60
            MQD+NL+DVNLTSEMKTSFIDYAMSVIVARALPDVRDGLKPVHRRILYGMNELGVTPDKP
Sbjct:   1  MQDRNLIDVNLTSEMKTSFIDYAMSVIVARALPDVRDGLKPVHRRILYGMNELGVTPDKP   60

Query:  61  HKKSARITGDVMGKYHPHGDSSIYEAMVRMAQWWSYRHMLVDGHGNFGSMDGDGAAAQRY  120
            HKKSARITGDVMGKYHPHGDSSIYEAMVRMAQWWSYRHMLVDGHGNFGSMDGDGAAAQRY
Sbjct:  61  HKKSARITGDVMGKYHPHGDSSIYEAMVRMAQWWSYRHMLVDGHGNFGSMDGDGAAAQRY  120

Query: 121  TEARMSKIALEMLRDINKNTVDFQDNYDGSEREPLVLPARFPNLLVNGATGIAVGMATNI  180
            TEARMSKIALE+LRDINKNTV+FQDNYDGSEREP+VLPARFPNLLVNGATGIAVGMATNI
Sbjct: 121  TEARMSKIALELLRDINKNTVNFQDNYDGSEREPVVLPARFPNLLVNGATGIAVGMATNI  180

Query: 181  PPHNLGESIDAVKLVMDNPDVTTRELMEVIPGPDFPTGALVMGRSGIHRAYETGKGSIVL  240
            PPHNL ESIDAVK+VM++PD TTRELMEVIPGPDFPTGALVMGRSGIHRAY+TGKGSIVL
Sbjct: 181  PPHNLAESIDAVKMVMEHPDCTTRELMEVIPGPDFPTGALVMGRSGIHRAYDTGKGSIVL  240

Query: 241  RSRTEIETTSNGKERIVVTEFPYGVNKTKVHEHIVRLAQEKRIEGITAVRDESSREGVRF  300
            RSRTEIETT  G+ERIVVTEFPYGVNKTKVHEHIVRLAQEKR+EGITAVRDESSREGVRF
Sbjct: 241  RSRTEIETTQTGRERIVVTEFPYGVNKTKVHEHIVRLAQEKRLEGITAVRDESSREGVRF  300

Query: 301  VIEVRRAASANVILNNLFKLTSLQTNFSFNMLAIEKGVPKILSLRQIIDNYIEHQKEVIV  360
            VIE+RR ASA VILNNLFKLTSLQTNFSFNMLAIE GVPKILSLRQIIDNYI HQKEVI+
Sbjct: 301  VIEIRREASATVILNNLFKLTSLQTNFSFNMLAIENGVPKILSLRQIIDNYISHQKEVII  360

Query: 361  RRTQFDKAKAGARAHILEGLLVALDHLDEVITIIRNSETDTIAQAELMSRFELSERQSQA  420
            RRT+FDK KA ARAHILEGLL+ALDHLDEVI IIRNSETD IAQ ELMSRF+LSERQSQA
Sbjct: 361  RRTRFDKDKAEARAHILEGLLIALDHLDEVIAIIRNSETDVIAQTELMSRFDLSERQSQA  420

Query: 421  ILDMRLRRLTGLERDKIQSEYNDLLALIADLADILAKPERVVTIIKEEMDEVKRKYADAR  480
            ILDMRLRRLTGLERDKIQSEY+DLLALIADL+DILAKPER++TIIKEEMDE+KRKYA+ R
Sbjct: 421  ILDMRLRRLTGLERDKIQSEYDDLLALIADLSDILAKPERIITIIKEEMDEIKRKYANPR  480

Query: 481  RTELMIGEVLSLEDEDLIEEEDVLITLSNKGYIKRLAQDEFRAQKRGGRGIQGTGVNNDD  540
            RTELM+GEVLSLEDEDLIEEEDVLITLSNKGYIKRLAQDEFRAQKRGGRG+QGTGVNNDD
Sbjct: 481  RTELMVGEVLSLEDEDLIEEEDVLITLSNKGYIKRLAQDEFRAQKRGGRGVQGTGVNNDD  540

Query: 541  FVRELVSTSTHDTVLFFTNLGRVYRLKAYEIPEYGRTAKGLPIVNLLKLDEGETIQTIIN  600
            FVREL+STSTHDT+LFFTN GRVYRLKAYEIPEYGRTAKGLPIVNLLKL++GETIQTIIN
Sbjct: 541  FVRELISTSTHDTLLFFTNFGRVYRLKAYEIPEYGRTAKGLPIVNLLKLEDGETIQTIIN  600

Query: 601  ARKEDVANKYFFFTTQQGIVKRTSVSEFSNIRQNGLRAINLKENDELINVLLIDENEDVI  660
            ARKE+ A K FFFTT+QGIVKRT VSEF+NIRQNGLRA+ LKE D+LINVLL    +D+I
Sbjct: 601  ARKEETAGKSFFFTTKQGIVKRTEVSEFNNIRQNGLRALKLKEGDQLINVLLTSGQDDII  660

Query: 661  IGTRTGYSVRFKVNAVRNMGRTATGVRGVNLREGDKVVGASRIVNGQEVLIITEKGYGKR  720
            IGT +GYSVRF   ++RNMGR+ATGVRGV LRE D+VVGASRI + QEVL+ITE G+GKR
Sbjct: 661  IGTHSGYSVRFNEASIRNMGRSATGVRGVKLREDDRVVGASRIQDNQEVLVITENGFGKR  720

Query: 721  TEASEYPTKGRGGKGIKTANITAKNGPLARLVTINGNEDIMVITDTGVIIRTNVANISQT  780
            T A++YPTKGRGGKGIKTANIT KNG LA LVT++G EDIMVIT+ GVIIRTNVANISQT
Sbjct: 721  TSATDYPTKGRGGKGIKTANITPKNGQLAGLVTVDGTEDIMVITNKGVIIRTNVANISQT  780

Query: 781  GRSTMGVKVMRLDQEAKIVTVALVEQEIEDKSNIEDTKE                      819
            GR+T+GVK+M+LD +AKIVT  LV+ E    + I   +E
Sbjct: 781  GRATLGVKIMKLDADAKIVTFTLVQPEDSSIAEINTDRE                      819
```

Based on this analysis, it was predicted that these proteins and their epitopes could be useful antigens for vaccines or diagnostics.

Example 1515

A DNA sequence (GBSx1605) was identified in *S. agalactiae* <SEQ ID 4659> which encodes the amino acid sequence <SEQ ID 4660>. Analysis of this protein sequence reveals the following:

Possible site: 25
>>> Seems to have no N-terminal signal sequence
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:CAA04010 GB:AJ000336 L-lactate dehydrogenase [Streptococcus pneumoniae]
Identities = 290/329 (88%), Positives = 313/329 (94%), Gaps = 1/329 (0%)
Query:   1  MTATKQHKKVILVGDGAVGSSYAFALVNQGIAQELGIIEIPALFDKAVGDAEDLSHALAF   60
            MT+TKQHKKVILVGDGAVGSSYAFALVNQGIAQELGIIEIP L +KAVGDA DLSHALAF
Sbjct:   1  MTSTKQHKKVILVGDGAVGSSYAFALVNQGIAQELGIIEIPQLHEKAVGDALDLSHALAF   60

Query:  61  TSPKKIYAATYADCADADLVVITAGAPQKPGETRLDLVGKNLAINKSIVTQVVESGFNGI  120
            TSPKKIYAA Y+DCADADLVVITAGAPQKPGETRLDLVGKNLAINKSIVTQVVESGF GI
Sbjct:  61  TSPKKIYAAQYSDCADADLVVITAGAPQKPGETRLDLVGKNLAINKSIVTQVVESGFKGI  120

Query: 121  FLVAANPVDVLTYSTWKFSGFPKERVIGSGTSLDSARFRQALADKIGVDARSVHAYIMGE  180
            FLVAANPVDVLTYSTWKFSGFPKERVIGSGTSLDSARFRQALA+K+ VDARSVHAYIMGE
Sbjct: 121  FLVAANPVDVLTYSTWKFSGFPKERVIGSGTSLDSARFRQALAEKLDVDARSVHAYIMGE  180

Query: 181  HGDSEFAVWSHANVAGVQLEQWLQENRDIDEQGLVDLFISVRDAAYSIINKKGATYYGIA  240
            HGDSEFAVWSHAN+AGV LE++L++ +++ E  L++LF  VRDAAY+IINKKGATYYGIA
Sbjct: 181  HGDSEFAVWSHANIAGVNLEEFLKDTQNVQEAELIELFEGVRDAAYTIINKKGATYYGIA  240

Query: 241  VALARITKAILDDENAVLPLSVYQEGQYGDVKDVFIGQPAIVGAHGIVRPVNIPLNDAEL  300
            VALARITKAILDDENAVLPLSV+QEGQYG V++VFIGQPA+VGAHGIVRPVNIPLNDAE
Sbjct: 241  VALARITKAILDDENAVLPLSVFQEGQYG-VENVFIGQPAVVGAHGIVRPVNIPLNDAET  299

Query: 301  QKMQASAEQLKDIIDEAWKNPEFQEASKN                                329
            QKMQASA++L+ IIDEAWKNPEFQEASKN
Sbjct: 300  QKMQASAKELQAIIDEAWKNPEFQEASKN                                328
```

A related DNA sequence was identified in *S. pyogenes* <SEQ ID 4661> which encodes the amino acid sequence <SEQ ID 4662>. Analysis of this protein sequence reveals the following:

Possible site: 25
>>> Seems to have no N-terminal signal sequence
INTEGRAL    Likelihood = −1.17   Transmembrane 106-122 (106-122)
----- Final Results -----
    bacterial membrane --- Certainty = 0.1468 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:AAB81558 GB:U60997 L(+)-lactate dehydrogenase [Streptococcus
bovis]
Identities = 278/329 (84%), Positives = 297/329 (89%), Gaps = 2/329 (0%)
Query:    1  MTATKQHKKVILVGDGAVGSSYAFALVTQNIAQELGIIDIFK--EKTQGDAEDLSHALAF   58
             MTATKQHKKVILVGDGAVGSSYAFALV Q IAQELGII+I +   K  GDAEDLSHALAF
Sbjct:    1  MTATKQHKKVILVGDGAVGSSYAFALVNQGIAQELGIIEIPQLFNKAVGDAEDLSHALAF   60

Query:   59  TSPKKIYAADYSDCHDADLVVLTAGAPQKPGETRLDLVEKNLRINKEVVTQIVASGFKGI  118
             TSPKKIYAA Y DC DADLVV+TAGAPQKPGETRLDLV KNL INK +VT++V SGFKGI
Sbjct:   61  TSPKKIYAAKYEDCADADLVVITAGAPQKPGETRLDLVGKNLAINKSIVTEVVKSGFKGI  120

Query:  119  FLVAANPVDVLTYSTWKFSGFPKERVIGSGTSLDSARFRQALAAKIGVDARSVHAYIMGE  178
             FLVAANPVDVLTYSTWKFSGFPKERVIGSGTSLDSARFRQALA K+ VDARSVHAYIMGE
Sbjct:  121  FLVAANPVDVLTYSTWKFSGFPKERVIGSGTSLDSARFRQALAEKLDVDARSVHAYIMGE  180

Query:  179  HGDSEFAVWSHANVAGVGLYDWLQANRDIDEQGLVDLFISVRDAAYSIINKKGATFYGIA  238
             HGDSEFAVWSHANVAGV L  +L+  ++++E  LV+LF  VRDAAYSIINKKGATYYGIA
Sbjct:  181  HGDSEFAVWSHANVAGVNLESYLKDVQNVEEAELVELFEGVRDAAYSIINKKGATYYGIA  240
```

```
                         -continued
Query:  239 VALARITKAILDDENAVLPLSVFQEGQYEGVEDCYIGQPAIVGAYGIVRPVNIPLNDAEL 298
            VALARITKAIL+DENAVLPLSVFQEGQY   V DCYIGQPAIVGA+GIVRPVNIPLNDAE
Sbjct:  241 VALARITKAILNDENAVLPLSVFQEGQYANVTDCYIGQPAIVGAHGIVRPVNIPLNDAEQ 300

Query:  299 QKMQASANQLKAIIDEAFAKEEFASAAKN                                327
            QKM+ASA +LKAIIDEAF+KEEFASA KN
Sbjct:  301 QKMEASAKELKAIIDEAFSKEEFASACKN                                329
```

An alignment of the GAS and GBS proteins is shown below.

```
Identities = 286/329 (86%), Positives = 299/329 (89%), Gaps = 2/329 (0%)
Query:    1 MTATKQHKKVILVGDGAVGSSYAFALVNQGIAQELGIIEIPALFDKAVGDAEDLSHALAF  60
            MTATKQHKKVILVGDGAVGSSYAFALV Q IAQELGII+I   +K  GDAEDLSHALAF
Sbjct:    1 MTATKQHKKVILVGDGAVGSSYAFALVTQNIAQELGIIDI--FKEKTQGDAEDLSHALAF  58

Query:   61 TSPKKIYAATYADCADADLVVITAGAPQKPGETRLDLVGKNLAINKSIVTQVVESGFNGI 120
            TSPKKIYAA Y+DC DADLVV+TAGAPQKPGETRLDLV KNL INK +VTQ+V SGF GI
Sbjct:   59 TSPKKIYAADYSDCHDADLVVLTAGAPQKPGETRLDLVEKNLRINKEVVTQIVASGFKGI 118

Query:  121 FLVAANPVDVLTYSTWKFSGFPKERVIGSGTSLDSARFRQALADKIGVDARSVHAYIMGE 180
            FLVAANPVDVLTYSTWKFSGFPKERVIGSGTSLDSARFRQALA KIGVDARSVHAYIMGE
Sbjct:  119 FLVAANPVDVLTYSTWKFSGFPKERVIGSGTSLDSARFRQALAAKIGVDARSVHAYIMGE 178

Query:  181 HGDSEFAVWSHANVAGVQLEQWLQENRDIDEQGLVDLFISVRDAAYSIINKKGATYYGIA 240
            HGDSEFAVWSHANVAGV L  WLQ NRDIDEQGLVDLFISVRDAAYSIINKKGAT+YGIA
Sbjct:  179 HGDSEFAVWSHANVAGVGLYDWLQANRDIDEQGLVDLFISVRDAAYSIINKKGATFYGIA 238

Query:  241 VALARITKAILDDENAVLPLSVYQEGQYGDVKDVFIGQPAIVGAHGIVRPVNIPLNDAEL 300
            VALARITKAILDDENAVLPLSV+QEGQY  V+D +IGQPAIVGA+GIVRPVNIPLNDAEL
Sbjct:  239 VALARITKAILDDENAVLPLSVFQEGQYEGVEDCYIGQPAIVGAYGIVRPVNIPLNDAEL 298

Query:  301 QKMQASAEQLKDIIDEAWKNPEFQEASKN                                329
            QKMQASA QLK IIDEA+  EF  A+KN
Sbjct:  299 QKMQASANQLKAIIDEAFAKEEFASAAKN                                327
```

SEQ ID 4660 (GBS312) was expressed in *E. coli* as a His-fusion product. SDS-PAGE analysis of total cell extract is shown in FIG. 49 (lane 7; MW 40 kDa).

GBS312-His was purified as shown in FIG. 205, lane 9.

Based on this analysis, it was predicted that these proteins and their epitopes could be useful antigens for vaccines or diagnostics.

Example 1516

A DNA sequence (GBSx1606) was identified in *S. agalactiae* <SEQ ID 4663> which encodes the amino acid sequence <SEQ ID 4664>. This protein is predicted to be NADH oxidase (nox). Analysis of this protein sequence reveals the following:

Possible site: 27

>>> Seems to have no N-terminal signal sequence

----- Final Results ----- bacterial cytoplasm --- Certainty = 0.1888 (Affirmative) <succ> bacterial membrane --- Certainty = 0.0000 (Not Clear) <succ> bacterial outside --- Certainty = 0.0000 (Not Clear) <succ>

The protein has homology with the following sequences in the GENPEPT database.

```
>GP:AAC26485 GB:AF014458 NADH oxidase [Streptococcus pneumoniae]
(ver 2)
Identities = 363/458 (79%), Positives = 408/458 (88%), Gaps = 3/458 (0%)
Query:    1 MSKIVVVGTNHAGTAAIKTMLSNYGEANEIVTFDQNSNISFLGCGMALWIGEQIDGPEGL  60
            MSKIVVVG NHAGTA I TML N+G  NEIV FDQNSNISFLGCGMALWIGEQIDG EGL
Sbjct:    1 MSKIVVVGANHAGTACINTMLDNFGNENEIVVFDQNSNISFLGCGMALWIGEQIDGAEGL  60

Query:   61 FYSDKEQLESMGAKVYMNSPVLNIDYDKKEVTALVDGKEHVESYEKLILATGSQPIIPPI 120
            FYSDKE+LE+ GAKVYMNSPVL+IDYD K VTA V+GKEH ESYEKLI ATGS PI+PPI
Sbjct:   61 FYSDKEKLEAKGAKVYMNSPVLSIDYDNKVVTAEVEGKEHKESYEKLIFATGSTPILPPI 120

Query:  121 KGVEIQEGSREFKATLENLQFVKLYQNSEEVIEKLAKPG--INRVAVVGAGYIGVELAEA 178
            +GVEI +G+REFKATLEN+QFVKLYQN+EEVI KL+     ++R+AVVG GYIGVELAEA
Sbjct:  121 EGVEIVKGNREFKATLENVQFVKLYQNAEEVINKLSDKSQHLDRIAVVGGGYIGVELAEA 180

Query:  179 FQRIGKEVTLVDVADTCMGGYYDRDFTDMMSKNLEDHGIRLAFGQAVQAVEGDGKVERLV 238
            F+R+GKEV LVD+ DT + GYYD+DFT MM+KNLEDH IRLA GQ V+A+EGDGKVERL+
Sbjct:  181 FERLGKEVVLVDIVDTVLNGYYDKDFTQMMAKNLEDHNIRLALGQTVKAIEGDGKVERLI 240
```

```
                                    -continued
Query: 239   TDKETFDVDMVILAVGFRPNTELGAGKLDTFRNGAWVVDKKQETSVKDVYAIGDCATIWD   298
             TDKE+FDVDMVILAVGFRPNT L  GK++ FRNGA++VDKKQETS+  VYA+GDCAT++D
Sbjct: 241   TDKESFDVDMVILAVGFRPNTALADGKIELFRNGAFLVDKKQETSIPGVYAVGDCATVYD   300

Query: 299   NSRDDINYIALASNAVRTGIVAAHNACGTELEGAGVQGSNGISIYGLNMVSTGLTLEKAK   358
             N+R D +YIALASNAVRTGIV A+NACG ELEG GVQGSNGISIYGL+MVSTGLTLEKAK
Sbjct: 301   NARKDTSYIALASNAVRTGIVGAYNACGHELEGIGVQGSNGISIYGLHMVSTGLTLEKAK   360

Query: 359   QAGYNAVETGFNDLQKPEFIKHNNHEVAIKIVYDKDSRVILGCQMVSHE-DVSMGIHMFS   417
              AGYNA ETGFNDLQKPEF+KH+NHEVAIKIV+DKDSR ILG QMVSH+  +SMGIHMFS
Sbjct: 361   AAGYNATETGFNDLQKPEFMKHDNHEVAIKIVFDKDSREILGAQMVSHDIAISMGIHMFS   420

Query: 418   LAIQEKVTIEKLALTDIFFLPHFNKPYNYITMAALGAK                        455
             LAIQE VTI+KLALTD+FFLPHFNKPYNYITMAAL A+
Sbjct: 421   LAIQEHVTIDKLALTDLFFLPHFNKPYNYITMAALTAE                        458
```

A related DNA sequence was identified in *S. pyogenes* <SEQ ID 4665> which encodes the amino acid sequence <SEQ ID 4666>. Analysis of this protein sequence reveals the following:

---

Possible site: 14
>>> Seems to have no N-terminal signal sequence
----- Final Results -----
   bacterial cytoplasm --- Certainty = 0.2068 (Affirmative) <succ>
   bacterial membrane --- Certainty = 0.0000 (Not Clear) <succ>
   bacterial outside --- Certainty = 0.0000 (Not Clear) <succ>

---

An alignment of the GAS and GBS proteins is shown below.

```
Identities = 362/456 (79%), Positives = 403/456 (87%)
Query:   1   MSKIVVVGTNHAGTAAIKTMLSNYGEANEIVTFDQNSNISFLGCGMALWIGEQIDGPEGL    60
             MSKIVVVG NHAGTA IKTML+NYG+ANEIV FDQNSNISFLGCGMALWIGEQI GPEGL
Sbjct:   1   MSKIVVVGANHAGTACIKTMLTNYGDANEIVVFDQNSNISFLGCGMALWIGEQIAGPEGL    60

Query:  61   FYSDKEQLESMGAKVYMNSPVLNIDYDKKEVTALVDGKEHVESYEKLILATGSQPIIPPI   120
             FYSDKE+LES+GAKVYM SPV +IDYD K VTALVDGK HVE+Y+KLI ATGSQPI+PPI
Sbjct:  61   FYSDKEELESLGAKVYMESPVQSIDYDAKTVTALVDGKNHVETYDKLIFATGSQPILPPI   120

Query: 121   KGVEIQEGSREFKATLENLQFVKLYQNSEEVIEKLAKPGINRVAVVGAGYIGVELAEAFQ   180
             KG EI+EGS EF+ATLENLQFVKLYQNS +VI KL   I RVAVVGAGYIGVELAEAFQ
Sbjct: 121   KGAEIKEGSLEFEATLENLQFVKLYQNSADVIAKLENKDIKRVAVVGAGYIGVELAEAFQ   180

Query: 181   RIGKEVTLVDVADTCMGGYYDRDFTDMMSKNLEDHGIRLAFGQAVQAVEGDGKVERLVTD   240
             R GKEV L+DV DTC+ GYYDRD TD+M+KN+E+HGI+LAFG+ V+ V G+KVE+++TD
Sbjct: 181   RKGKEVVLIDVVDTCLAGYYDRDLTDLMAKNMEEHGIQLAFGETVKEVAGNGKVEKIITD   240

Query: 241   KETFDVDMVILAVGFRPNTELGAGKLDTFRNGAWVVDKKQETSVKDVYAIGDCATIWDNS   300
             K  +DVDMVILAVGFRPNT LG GK+D FRNGA++V+K+QETS+  VYAIGDCATI+DN+
Sbjct: 241   KNEYDVDMVILAVGFRPNTTLGNGKIDLFRNGAFLVNKRQETSIPGVYAIGDCATIYDNA   300

Query: 301   RDDINYIALASNAVRTGIVAAHNACGTELEGAGVQGSNGISIYGLNMVSTGLTLEKAKQA   360
              D NYIALASNAVRTGIVAAHNACGT+LEG GVQGSNGISIYGL+MVSTGLTLEKAK+
Sbjct: 301   TRDTNYIALASNAVRTGIVAAHNACGTDLEGIGVQGSNGISIYGLHMVSTGLTLEKAKRL   360

Query: 361   GYNAVETGFNDLQKPEFIKHNNHEVAIKIVYDKDSRVILGCQMVSHEDVSMGIHMFSLAI   420
             G++A  T + D QKPEFI+H N  V IKIVYDKDSR ILG QM + EDVSMGIHMFSLAI
Sbjct: 361   GFDAAVTEYTDNQKPEFIEHGNFPVTIKIVYDKDSRRILGAQMAAREDVSMGIHMFSLAI   420

Query: 421   QEKVTIEKLALTDIFFLPHFNKPYNYITMAALGAKD                          456
             QE VTIEKLALTDIFFLPHFNKPYNYITMAALGAKD
Sbjct: 421   QEGVTIEKLALTDIFFLPHFNKPYNYITMAALGAKD                          456
```

Based on this analysis, it was predicted that these proteins and their epitopes could be useful antigens for vaccines or diagnostics.

Example 1517

A DNA sequence (GBSx1607) was identified in *S. agalactiae* <SEQ ID 4667> which encodes the amino acid sequence <SEQ ID 4668>. Analysis of this protein sequence reveals the following:

---

Possible site: 26
>>> Seems to have no N-terminal signal sequence
----- Final Results -----
   bacterial cytoplasm --- Certainty = 0.2319 (Affirmative) <succ>
   bacterial membrane --- Certainty = 0.0000 (Not Clear) <succ>
   bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1518

A DNA sequence (GBSx1608) was identified in *S. agalactiae* <SEQ ID 4669> which encodes the amino acid sequence <SEQ ID 4670>. Analysis of this protein sequence reveals the following:

```
Possible site: 22
>>> Seems to have a cleavable N-term signal seq.
INTEGRAL    Likelihood = -7.75    Transmembrane 160-176 (157-179)
INTEGRAL    Likelihood = -7.38    Transmembrane  73-89  (70-97)
INTEGRAL    Likelihood = -5.47    Transmembrane 289-305 (284-312)
INTEGRAL    Likelihood = -4.09    Transmembrane 107-123 (106-124)
INTEGRAL    Likelihood = -3.24    Transmembrane  43-59  (43-59)
INTEGRAL    Likelihood = -1.91    Transmembrane 258-274 (258-275)
INTEGRAL    Likelihood = -1.33    Transmembrane 234-250 (233-251)
INTEGRAL    Likelihood = -0.00    Transmembrane 209-225 (209-225)
----- Final Results -----
     bacterial membrane --- Certainty = 0.4100 (Affirmative) <succ>
     bacterial outside --- Certainty = 0.0000 (Not Clear) <succ>
        bacterial cytoplasm --- Certainty = 0.0000 (Not Clear) <succ>
```

A related GBS nucleic acid sequence <SEQ ID 9805> which encodes amino acid sequence <SEQ ID 9806> was also identified.

The protein has homology with the following sequences in the GENPEPT database.

```
>GP:CAB15146 GB:Z99120 similar to hypothetical proteins [Bacillus subtilis]
Identities = 172/318 (54%), Positives = 234/318 (73%)
Query:    5 LSLTTIFALLFSSMLIYATPLIFTSIGGTFSERGGIVNVGLEGIMVIGAFSGVVFNLEFA    64
            + +   I +++  + L+YA PLI T++GG FSER G+VN+GLEG+M+IGAF+ V+FNL F
Sbjct:    1 MDIVQILSIIVPATLVYAAPLILTALGGVFSERSGVVNIGLEGLMIIGAFTSVLFNLFFG    60

Query:   65 SVFGDATPWISVLVGGLVGLIFSVIHAVATVNFRADHIISGTVLNLMAPSLAVFLIKVLY   124
               G A PW+S+L    G +FS+IHA A ++FRAD  +SG  +N++A    +F++K++Y
Sbjct:   61 QELGAAAPWLSLLAAMAAGALFSLIHAAAAISFRADQTVSGVAINMLALGATLFIVKLIY   120

Query:  125 NKGQTDNIQESFGKFNFPILSDIPFVGDIFFKGTSLVGYIAILFSFLAWFILYKTRFGLR   184
              K QTD I E F K    P L DIP +G IFF        +AI  +F++WFIL+KT FGLR
Sbjct:  121 GKAQTDKIPEPFYKTKIPGLGDIPVLGKIFFSDVYYTSILAIALAFISWFILFKTPFGLR   180

Query:  185 LRSVGEHPQAADTLGINVYLMRYSGVLISGFLGGIGGAVYAQSISVNFAATTILGPGFIS   244
            +RSVGEHP AADT+GINVY MRY GV+ISG   GG+GG VYA  +I+++F  +TI G GFI+
Sbjct:  181 IRSVGEHPMAADTMGINVYKMRYIGVMISGLFGGLGGGVYASTIALDFTHSTISGQGFIA   240

Query:  245 LAAMIFGKWNPIGAMLASLFFGLSQSLAVIGSHLPLLSNIPTVYLQIAPYVLTIIVLAAF   304
            LAA++FGKW+PIGA+ A+LFFG +QSL++IGS LPL   +IP VY+ +APY+LTI+  L  F
Sbjct:  241 LAALVFGKWHPIGALGAALFFGFAQSLSIIGSLLPLFKDIPNVYMLMAPYILTILALTGF   300

Query:  305 FGQAVAPKADGINYIKTK                                           322
            G+A APKA+G+ YIK K
Sbjct:  301 IGRADAPKANGVPYIKGK                                           318
```

A related DNA sequence was identified in *S. pyogenes* <SEQ ID 4671> which encodes the amino acid sequence <SEQ ID 4672>. Analysis of this protein sequence reveals the following:

```
Possible site: 22
>>> Seems to have a cleavable N-term signal seq.
INTEGRAL    Likelihood  = -8.92    Transmembrane  73-89  (69-97)
INTEGRAL    Likelihood  = -5.04    Transmembrane 160-176 (158-177)
INTEGRAL    Likelihood  = -4.62    Transmembrane 289-305 (284-312)
INTEGRAL    Likelihood  = -3.98    Transmembrane 234-250 (232-251)
INTEGRAL    Likelihood  = -2.13    Transmembrane 107-123 (106-123)
INTEGRAL    Likelihood  = -2.02    Transmembrane  43-59  (43-59)
INTEGRAL    Likelihood  = -0.53    Transmembrane 258-274 (258-274)
----- Final Results -----
     bacterial membrane --- Certainty = 0.4567 (Affirmative) <succ>
     bacterial outside --- Certainty = 0.0000 (Not Clear) <succ>
        bacterial cytoplasm ---Certainty = 0.0000 (Not Clear) <succ>
```

The protein has homology with the following sequences in the databases:

```
>GP:CAB15146 GB:Z99120 similar to hypothetical proteins [Bacillus subtilis]
Identities = 176/318 (55%), Positives = 239/318 (74%)
Query:    5 MSLVTIFALLMSSMLIYATPLIFTSIGGTFSERSGVVNVGLEGIMVMGAFSGIVFNLEFA    64
            M +V I ++++ + L+YA PLI T++GG FSERSGVVN+GLEG+M++GAF+ ++FNL F
Sbjct:    1 MDIVQILSIIVPATLVYAAPLILTALGGVFSERSGVVNIGLEGLMIIGAFTSVLFNLFFG    60

Query:   65 ETFGKATPWIAVLVGGIVGLIFSLIHAVATINFRADHIVSGTVLNLLAPSFAVFLVKAMY   124
            +   G A PW+++L    G +FSLIHA A I+FRAD  VSG  +N+LA     +F+VK +Y
Sbjct:   61 QELGAAAPWLSLLAAMAAGALFSLIHAAAAISFRADQTVSGVAINMLALGATLFIVKLIY   120

Query:  125 GKGQTDNIQQSFGKFDFPGLSQIPVIGDIFFKNTSLIGYFAIAFSFFAWFLLYKTRFGLR   184
            GK QTD I + F K   PGL   IPV+G IFF +      +AIA +F +WF+L+KT FGLR
Sbjct:  121 GKAQTDKIPEPFYKTKIPGLGDIPVLGKIFFSDVYYTSILAIALAFISWFILFKTPFGLR   180
```

-continued

```
Query:  185  LRSVGEHPQAADTLGINVYLMKYYGVMISGFLGGIGGAVYAQSISVNFAVTTILGPGFIA  244
             +RSVGEHP AADT+GINVY M+Y GVMISG  GG+GG VYA +I+++F  +TI G GFIA
Sbjct:  181  IRSVGEHPMAADTMGINVYKMRYIGVMISGLFGGLGGGVYASTIALDFTHSTISGQGFIA  240

Query:  245  LAAMIFGKWNPVGAMLSSLFFGLSQSLAVIGAQLPLLEKIPTVYLQIAPYMVTIIILAAF  304
             LAA++FGKW+P+GA+ ++LFFG +QSL++IG+ LPL + IP VY+ +APY++TI+ L  F
Sbjct:  241  LAALVFGKWHPIGALGAALFFGFAQSLSIIGSLLPLFKDIPNVYMLMAPYILTILALTGF  300

Query:  305  FGQAVAPKADGINYIKSK                                           322
               G+A APKA+G+ YIK K
Sbjct:  301  IGRADAPKANGVPYIKGK                                           318
```

An alignment of the GAS and GBS proteins is shown below.

```
Identities = 272/322 (84%), Positives = 301/322 (93%)
Query:    1  MVSKLSLTTIFALLFSSMLIYATPLIFTSIGGTFSERGGIVNVGLEGIMVIGAFSGVVFN   60
             +V+K+SL TIFALL SSMLIYATPLIFTSIGGTFSER G+VNVGLEGIMV+GAFSG+VFN
Sbjct:    1  VVNKMSLVTIFALLMSSMLIYATPLIFTSIGGTFSERSGVVNVGLEGIMVMGAFSGIVFN   60

Query:   61  LEFASVFGDATPWISVLVGGLVGLIFSVIHAVATVNFRADHIISGTVLNLMAPSLAVFLI  120
             LEFA  FG ATPWI+VLVGG+VGLIFS+IHAVAT+NFRADHI+SGTVLNL+APS AVFL+
Sbjct:   61  LEFAETFGKATPWIAVLVGGIVGLIFSLIHAVATINFRADHIVSGTVLNLLAPSFAVFLV  120

Query:  121  KVLYNKGQTDNIQESFGKFNFPILSDIPFVGDIFFKGTSLVGYIAILFSFLAWFILYKTR  180
             K +Y KGQTDNIQ+SFGKF+FP LS IP +GDIFFK TSL+GY AI FSF AWF+LYKTR
Sbjct:  121  KAMYGKGQTDNIQQSFGKFDFPGLSQIPVIGDIFFKNTSLIGYFAIAFSFFAWFLLYKTR  180

Query:  181  FGLRLRSVGEHPQAADTLGINVYLMRYSGVLISGFLGGIGGAVYAQSISVNFAATTILGP  240
             FGLRLRSVGEHPQAADTLGINVYLM+Y GV+ISGFLGGIGGAVYAQSISVNFA TTILGP
Sbjct:  181  FGLRLRSVGEHPQAADTLGINVYLMKYYGVMISGFLGGIGGAVYAQSISVNFAVTTILGP  240

Query:  241  GFISLAAMIFGKWNPIGAMLASLFFGLSQSLAVIGSHLPLLSNIPTVYLQIAPYVLTIIV  300
             GFI+LAAMIFGKWNP+GAML+SLFFGLSQSLAVIG+ LPLL  IPTVYLQIAPY++TII+
Sbjct:  241  GFIALAAMIFGKWNPVGAMLSSLFFGLSQSLAVIGAQLPLLEKIPTVYLQIAPYMVTIII  300

Query:  301  LAAFFGQAVAPKADGINYIKTK                                       322
             LAAFFGQAVAPKADGINYIK+K
Sbjct:  301  LAAFFGQAVAPKADGINYIKSK                                       322
```

A related GBS gene <SEQ ID 8829> and protein <SEQ ID 8830> were also identified. Analysis of this protein sequence reveals the following:

---

Lipop: Possible site: −1 Crend: 3
McG: Discrim Score: 8.61
GvH: Signal Score (−7.5): −1.53
Possible site: 22
>>> Seems to have a cleavable N-term signal seq.
ALOM program    count: 8 value: −7.75 threshold: 0.0
INTEGRAL    Likelihood = −7.75    Transmembrane 160-176 (157-179)
INTEGRAL    Likelihood = −7.38    Transmembrane 73-89 (70-97)
INTEGRAL    Likelihood = −5.47    Transmembrane 289-305 (284-312)
INTEGRAL    Likelihood = −4.09    Transmembrane 107-123 (106-124)
INTEGRAL    Likelihood = −3.24    Transmembrane 43-59 (43-59)
INTEGRAL    Likelihood = −1.91    Transmembrane 258-274 (258-275)

-continued

INTEGRAL    Likelihood = −1.33    Transmembrane 234-250 (233-251)
INTEGRAL    Likelihood = −0.00    Transmembrane 209-225 (209-225)
PERIPHERAL  Likelihood = 3.34     139
modified ALOM score: 2.05
Reasoning Step: 3
----- Final Results -----
    bacterial membrane --- Certainty = 0.4100 (Affirmative) <succ>
    bacterial outside --- Certainty = 0.0000 (Not Clear) <succ>
    bacterial cytoplasm --- Certainty = 0.0000 (Not Clear) <succ>

---

The protein has homology with the following sequences in the databases:

---

ORF00914(313-1266 of 1566)
EGAD|108729|BS3151(1-318 of 319) hypothetical protein {Bacillus subtilis}
GP|1934814|emb|CAB07939.1||Z93937 unknown {Bacillus subtilis}
GP|2635653|emb|CAB15146.1||Z99120 similar to hypothetical proteins {Bacillus subtilis}
PIR|F70009|F70009 conserved hypothetical protein yufQ - Bacillus subtilis
% Match = 34.9
% Identity = 54.1  % Similarity = 76.4
Matches = 172 Mismatches = 75 Conservative Sub.s = 71

-continued

```
216        246        276        306        336        366        396        426
TLQVFHLS*LKL*QLQSSSS*VSITLLSMLLNLKNK*KVVSKLSLTTIFALLFSSMLIYATPLIFTSIGGTFSERGGIVN
                                  :  :   |::::   |  |:||  |||:|::||  ||||  |:||
                                 MDIVQILSIIVPATLVYAAPLILTALGGVFSERSGVVN
                                         10         20         30

456        486        516        546        576        606        636        666
VGLEGIMVIGAFSGVVFNLEFASVFGDATPWISVLVGGLVGLIFSVIHAVATVNFRADHIISGTVLNLMAPSLAVFLIKV
:||||:|||||:  |:||  |  ||:|:|   :|  ||:|||  |  ::|||| |||: ||||  |::|    :|::|:
IGLEGLMIIGAFTSVLFNLFFGQELGAAAPWLSLLAAMAAGALFSLIHAAAAISFRADQTVSGVAINMLALGATLFIVKL
       50         60         70         80         90        100        110

696        726        756        786        816        846        876        906
LYNKGQTDNIQESFGKFNFPILSDIPFVGDIFFKGTSLVGYIAILFSFLAWFILYKTRFGLRLRSVGEHPQAADTLGINV
:| ||| | |  | |  |   | ||| :| |||       :|| :: |:: ||||:| |||| :||||||  ||||:||||
IYGKAQTDKIPEPFYKTKIPGLGDIPVLGKIFFSDVYYTSILAIALAFISWFILFKTPFGLRIRSVGEHPMAADTMGINV
       130        140        150        160        170        180        190

936        966        996       1026       1056       1086       1116       1146
YLMRYSGVLISGFLGGIGGAVYAQSISVNFAATTILGPGFISLAAMIFGKWNPIGAMLASLFFGLSQSLAVIGSHLPLLS
| |||  ||:|||::||:||  |||   :|:::|    :||   |||:|||::||||||:   |:||||::|||::||| |||:
YKMRYIGVMISGLFGGLGGGVYASTIALDFTHSTISGQGFIALAALVFGKWHPIGALGAALFFGFAQSLSIIGSLLPLFK
       210        220        230        240        250        260        270

1176       1206       1236       1266       1296       1326       1356       1386
NIPTVYLQIAPYVLTIIVLAAFFGQAVAPKADGINYIKTK*IKRN*YKLVSFYCL*ICEKILCENFT*IIIQ*Q*NIKK*
:||  ||:  :|||:|||:    |  |   |:|  |||||:  |   |:|   ||||:|:  |||  ||| :
DIPNVYMLMAPYILTILALTGFIGRADAPKANGVPYIKGKR
       290        300        310
```

Based on this analysis, it was predicted that these proteins and their epitopes could be useful antigens for vaccines or diagnostics.

Example 1519

A DNA sequence (GBSx1609) was identified in *S. agalactiae* <SEQ ID 4673> which encodes the amino acid sequence <SEQ ID 4674>. This protein is predicted to be ribose/galactose ABC transporter, permease protein (rbsC-1). Analysis of this protein sequence reveals the following:

Possible site: 55
>>> Seems to have an uncleavable N-term signal seq
INTEGRAL    Likelihood = −14.59   Transmembrane 205-221 (200-228)
INTEGRAL    Likelihood = −13.69   Transmembrane 21-37 (13-45)
INTEGRAL    Likelihood = −7.27    Transmembrane 302-318 (290-321)
INTEGRAL    Likelihood = −7.17    Transmembrane 115-131 (111-138)
INTEGRAL    Likelihood = −4.25    Transmembrane 251-267 (250-268)
INTEGRAL    Likelihood = −2.97    Transmembrane 63-79 (63-80)
INTEGRAL    Likelihood = −2.87    Transmembrane 333-349 (328-349)
----- Final Results -----
  bacterial membrane --- Certainty = 0.6838 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 8831> which encodes amino acid sequence <SEQ ID 8832> was also identified. Analysis of this protein sequence reveals the following:

Lipop: Possible site: −1 Crend: 6
SRCFLG: 0
McG: Length, of UR: 24
Peak Value of UR: 3.06
Net Charge of CR: 3
McG: Discrim Score: 12.53
GvH: Signal Score (−7.5): −5.31
Possible site: 46
>>> Seems to have an uncleavable N-term signal seq
Amino Acid Composition: calculated from 1
ALOM program    count: 7 value: −14.59 threshold: 0.0
INTEGRAL    Likelihood = −14.59   Transmembrane 196-212 (191-219)
INTEGRAL    Likelihood = −13.69   Transmembrane 12-28 (4-36)
INTEGRAL    Likelihood = −7.27    Transmembrane 293-309 (281-312)
INTEGRAL    Likelihood = −7.17    Transmembrane 106-122 (102-129)
INTEGRAL    Likelihood = −4.25    Transmembrane 242-258 (241-259)
INTEGRAL    Likelihood = −2.97    Transmembrane 54-70 (54-71)
INTEGRAL    Likelihood = −2.87    Transmembrane 324-340 (319-340)
PERIPHERAL  Likelihood = 0.16     133
modified ALOM score: 3.42
icml HYPID: 7 CFP: 0.684
*** Reasoning Step: 3
----- Final Results -----
  bacterial membrane --- Certainty = 0.6838 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the GENPEPT database.

```
>GP:CAB15145 GB:Z99120 similar to hypothetical proteins [Bacillus subtilis]
Identities = 154/349 (44%), Positives = 220/349 (62%), Gaps = 6/349 (1%)
Query:  10   MSKKAQKIAVPLISVVLGIILGAIIMLIFGYDPLWGYEGLFQTAFGSIKNIGEIFRAMGP   69
             M K+   + VPLI+++LG+  GA+IML+ GY    GY  L+    FG I  +GE  R + P
```

-continued

```
Sbjct:   1  MVKRLSHLLVPLIAIILGLAAGALIMLVSGYSVASGYSALWNGIFGEIYYVGETIRQITP   60

Query:  70  LILIALGFSVASRAGFFNIGLPGQALSGWIAAGWFALSHPDMPRPAMILCTIIIGIVAGG  129
            IL L + A R G FNIG+ GQ L GW AA W   + D P   +   +I    AGG
Sbjct:  61  YILSGLAVAFAFRTGLFNIGVEGQLLVGWTAAVWVGTAF-DGPAYIHLPLALITAAAAGG  119

Query: 130  ITGAIPGILRAYLGTSEVIVTIMMNYIVLYSGNAIVQRVFPKSIMRTSDSSVYVSANASY  189
            + G IPGIL+A       EVIVTIMMNYI L+  N I+  V         D +   +AS
Sbjct: 120  LWGFIPGILKARFYVHEVIVTIMMNYIALHMTNYIISNVLTDH----QDKTGKIHESASL  175

Query: 190  QTDWLSSLTNNSRINIGIFIAIIAVVLVWFLLNKTTLGFEIRSVGLNPNASEYAGMSAKR  249
            ++ +L  +T+ SR+++GI +A++A V++WF++NK+T GFE+R+VG N +AS+YAGMS ++
Sbjct: 176  RSPFLEQITDYSRLHLGIIVALLAAVIMWFIINKSTKGFELRAVGFNQHASQYAGMSVRK  235

Query: 250  TIILSMIISGAFAGLGGVVEGLGTFENVFVQPSSLAIGFDGMAVSLLAANSPIGILFAAF  309
            I+ SM+ISGAFAGL G +EGLGTFE   V+ +    +GFDG+AV+LL  N+ +G++ AA
Sbjct: 236  NIMTSMLISGAFAGLAGAMEGLGTFEYAAVKGAFTGVGFDGIAVALLGGNTAVGVVLAAC  295

Query: 310  LFGVLSVGAPGMNI-AGIPPELIKVVTASIIFFVGVHYIIEYVIKPKKQ            357
            L G L +GA  M I +G+P E++ +V A II FV    Y I +V+    K+
Sbjct: 296  LLGGLKIGALNMPIESGVPSEVVDIVIAIIILFVASSYAIRFVMGKLKK            344
```

A related DNA sequence was identified in *S. pyogenes* <SEQ ID 2149> which encodes the amino acid sequence <SEQ ID 2150>. Analysis of this protein sequence reveals the following:

Possible site: 39
>>> Seems to have an uncleavable N-term signal seq
INTEGRAL    Likelihood = −12.74    Transmembrane 205-221 (200-228)
INTEGRAL    Likelihood = −12.42    Transmembrane 21-37 (14-45)
INTEGRAL    Likelihood = −7.22     Transmembrane 115-131 (111-135)
INTEGRAL    Likelihood = −4.78     Transmembrane 251-267 (249-269)
INTEGRAL    Likelihood = −2.50     Transmembrane 70-86 (69-86)
INTEGRAL    Likelihood = −2.34     Transmembrane 302-318 (300-318)
INTEGRAL    Likelihood = −1.44     Transmembrane 148-164 (147-165)
INTEGRAL    Likelihood = −1.33     Transmembrane 326-342 (326-342)
----- Final Results -----
   bacterial membrane --- Certainty = 0.6095 (Affirmative) <succ>
   bacterial outside --- Certainty = 0.0000 (Not Clear) <succ>
   bacterial cytoplasm --- Certainty = 0.0000 (Not Clear) <succ>

An alignment of the GAS and GBS proteins is shown below.

```
Identities = 293/358 (81%), Positives = 333/358 (92%), Gaps = 1/358 (0%)

Query:   6  RRREMSKKAQKIAVPLISVVLGIILGAIIMLIFGYDPLWGYEGLFQTAFGSIKNIGEIFR   65
            RR+ MSK AQKIAVPLISV+LG +LGAIIM+IFGYDP+WGYEGLFQ AFGS+KNIGEIFR
Sbjct:   6  RRKVMSKNAQKIAVPLISVLLGFLLGAIIMVIFGYDPIWGYEGLFQIAFGSVKNIGEIFR   65

Query:  66  AMGPLILIALGFSVASRAGFFNIGLPGQALSGWIAAGWFALSHPDMPRPAMILCTIIIGI  125
            +MGPLILIALGF+VASRAGFFN+GL GQAL+GWI+AGWFAL +PDMPRP +IL T +IG+
Sbjct:  66  SMGPLILIALGFTVASRAGFFNVGLSGQALAGWISAGWFALLNPDMPRPLLILMTALIGM  125

Query: 126  VAGGITGAIPGILRAYLGTSEVIVTIMMNYIVLYSGNAIVQRVFPKSIMRTSDSSVYVSA  185
            +AGGI GAIPGILRAYLGTSEVIVTIMMNYI+LY GNAIVQR +P+S+  ++ DS++ VS
Sbjct: 126  IAGGIAGAIPGILRAYLGTSEVIVTIMMNYIILYVGNAIVQRGYPESVKQSIDSTIQVSD  185

Query: 186  NASYQTDWLSSLTNNSRINIGIFIAIIAVVLVWFLLNKTTLGFEIRSVGLNPNASEYAGM  245
            NASYQT WLS+LTNNSRINIGIF AIIA+ L+WFLLNKTTLGFEIRSVGLNP+ASEYAGM
Sbjct: 186  NASYQTHWLSALTNNSRINIGIFFAIIAIALIWFLLNKTTLGFEIRSVGLNPHASEYAGM  245

Query: 246  SAKRTIILSMIISGAFAGLGGVVEGLGTFENVFVQPSSLAIGFDGMAVSLLAANSPIGIL  305
            S+KRTIILSMIISGA AGLGGVVEGLGTFENVFVQ SSLA+GFDGMAVSLLAANSP+GI
Sbjct: 246  SSKRTIILSMIISGALAGLGGVVEGLGTFENVFVQGSSLAVGFDGMAVSLLAANSPLGIF  305

Query: 306  FAAFLFGVLSVGAPGMNIAGIPPELIKVVTASIIFFVGVHYIIE-YVIKPKKQMKGGK    362
            F++FLFGVL++GAPGMNIAGIPPEL+KVVTASIIFFVG HY+IE Y+I+PKK +KGGK
Sbjct: 306  FSSFLFGVLNIGAPGMNIAGIPPELVKVVTASIIFFVGSHYLIERYIIRPKKLVKGGK    363
```

Based on this analysis, it was predicted that these proteins and their epitopes could be useful antigens for vaccines or diagnostics.

Example 1520

A DNA sequence (GBSx1610) was identified in *S. agalactiae* <SEQ ID 4675> which encodes the amino acid sequence <SEQ ID 4676>. This protein is predicted to be sugar ABC transporter, ATP-binding protein (mglA). Analysis of this protein sequence reveals the following:

Possible site: 57
>>> Seems to have no N-terminal signal sequence
----- Final Results -----
   bacterial cytoplasm --- Certainty = 0.3851 (Affirmative) <succ>
   bacterial membrane --- Certainty = 0.0000 (Not Clear) <succ>
   bacterial outside --- Certainty = 0.0000 (Not Clear) <succ>

A related GBS nucleic acid sequence <SEQ ID 9803> which encodes amino acid sequence <SEQ ID 9804> was also identified.

The protein has homology with the following sequences in the GENPEPT database.

\>GP:CAB15144 GB:Z99120 similar to ABC transporter (ATP-binding
protein) [Bacillus subtilis]
Identities = 311/497 (62%), Positives = 396/497 (79%), Gaps = 1/497 (0%)

```
Query:  14  VIEMKEITKKFGDFVANDHINLTVEKGEIHALLGENGAGKSTLMNMLAGLLEPTDGQIFI    73
            VIEM  I K F    VAND+INL V+KGEIHALLGENGAGKSTLMN+L GL +P  G+I +
Sbjct:   4  VIEMLNIRKAFPGIVANDNINLQVKKGEIHALLGENGAGKSTLMNVLFGLYQPERGEIRV    63

Query:  74  NGQPVTIDSPSKSSQLGIGMVHQHFMLVEAFTVAENIVLGNETTQNGVLDIKTAAKEIKE   133
            G+ V  I+SP+K++ LGIGMVHQHFMLV+ FTVAENI+LG E  + G +D K A +E+++
Sbjct:  64  RGEKVHINSPNKANDLGIGMVHQHFMLVDTFTVAENIILGKEPKKFGRIDRKRAGQEVQD   123

Query: 134  LSEKYGLSVNPNAKISDISVGAQQRVEILKTLYRGADILIFDEPTAVLTPSEIKELMTIM   193
            +S++YGL ++P AK +DISVG QQR EILKTLYRGADILIFDEPTAVLTP EIKELM IM
Sbjct: 124  ISDRYGLQIHPEAKAADISVGMQQRAEILKTLYRGADILIFDEPTAVLTPHEIKELMQIM   183

Query: 194  KSLVKEGKSIILITHKLDEIRAVADKVTVIRRGKSIETVPVAGASSQQLAEMMVGRSVSF   253
            K+LVKEGKSIILITHKL EI   + D+VTVIR+GK I+T+ V   +  +LA +MVGR VSF
Sbjct: 184  KNLVKEGKSIILITHKLKEIMEICDRVTVIRKGKGIKTLDVRDTNQDELASLMVGREVSF   243

Query: 254  RTEKKEANPTDIILSVKDLVVEENRGGVLAVKNLSLDVRAGEIVGIAGIDGNGQSELIQA   313
            +TEK+ A P   +L++  + V++ R G+  V++LSL V+AGEIVGIAG+DGNGQSELI+A
Sbjct: 244  KTEKRAAQPGAEVLAIDGITVKDTR-GIETVRDLSLSVKAGEIVGIAGVDGNGQSELIEA   302

Query: 314  ITGLRKVTSGQIVIKGKDVTKFSSRQITELSVGHVPEDRHRDGLVLDMTMAENLALQTYY   373
            +TGLRK  SG I + GK +    + R+ITE  +GH+P+DRH+ GLVLD  + EN+ LQ+YY
Sbjct: 303  VTGLRKTDSGTITLNGKQIQNLTPRKITESGIGHIPQDRHKHGLVLDFPIGENILLQSYY   362

Query: 374  KEPLSHKGILNFAKIKEYARQLMTEFDVRGAGEHVLARGFSGGNQQKAIIAREVDRDPDL   433
            K+P  S  G+L+  ++ +  AR L+TE+DVR    E+   AR  SGGNQQKAII RE+DR+PDL
Sbjct: 363  KKPYSALGVLHKGEMYKKARSLITEYDVRTPDEYTHARALSGGNQQKAIIGREIDRNPDL   422

Query: 434  LIVSQPTRGLDVGAIEYIHKRLIEERDKGKAVLVVSFELDEILNLSDRIAVIHDGKIQGI   493
            LI +QPTRGLDVGAIE++HK+LIE+RD GKAVL++SFEL+EI+NLSDRIAVI +G+I
Sbjct: 423  LIAAQPTRGLDVGAIEFVHKKLIEQRDAGKAVLLLSFELEEIMNLSDRIAVIFEGRIIAS   482

Query: 494  VKPDQTNKQELGILMAG                                             510
            V P +T +QELG+LMAG
Sbjct: 483  VNPQETTEQELGLLMAG                                             499
```

Identities = 75/242 (30%), Positives = 128/242 (51%), Gaps = 24/242 (9%)

```
Query: 280  GVLAVKNLSLDVRAGEIVGIAGIDGNGQSELIQAITGLRKVTSGQIVIKGKDVTKFSSRQ   339
            G++A  N++L V+ GEI + G +G G+S L+ +   GL +    G+I ++G+ V   S +
Sbjct:  16  GIVANDNINLQVKKGEIHALLGENGAGKSTLMNVLFGLYQPERGEIRVRGEKVHINSPNK    75

Query: 340  ITELSVGHVPEDRHRDGLVLD-MTMAENLALQTYYKEPLSHKGILNFAKI--KEYARQLM   396
            +L +G V      H+  +++D  T+AEN+ L     KEP        F +I K   +++
Sbjct:  76  ANDLGIGMV----HQHFMLVDTFTVAENIILG---KEPKK------FGRIDRKRAGQEVQ   122

Query: 397  TEFDVRGAGEHVLARG--FSGGNQQKAIIAREVDRDPDLLIVSQPTRGL---DVGAIEYI   451
             +  D   G H  A+   S G QQ+A I + + R  D+LI  +PT  L   ++   + I
Sbjct: 123  DISDRYGLQIHPEAKAADISVGMQQRAEILKTLYRGADILIFDEPTAVLTPHEIKELMQI   182

Query: 452  HKRLIEERDKGKAVLVVSFELDEILNLSDRIAVIHDGKIQGIVKPDQTNKQELGILMAGG   511
             K L++E   GK++++++ +L EI+ + DR+ VI  GK +       TN+ EL  LM G
Sbjct: 183  MKNLVKE---GKSIILITHKLKEIMEICDRVTVIRKGKGIKTLDVRDTNQDELASLMVGR   239

Query: 512  KI                                                            513
            ++
Sbjct: 240  EV                                                            241
```

A related DNA sequence was identified in *S. pyogenes* <SEQ ID 4677> which encodes the amino acid sequence <SEQ ID 4678>. Analysis of this protein sequence reveals the following:

Possible site: 60
\>\>\> Seems to have no N-terminal signal sequence

----- Final Results -----
bacterial cytoplasm --- Certainty = 0.3558 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

Identities = 431/511 (84%), Positives = 467/511 (91%), Gaps = 1/511 (0%)

```
Query:  10  MTQNVIEMKEITKKFGDEVANDHINLTVEKGEIHALLGENGAGKSTLMNMLAGLLEPTDG    69
            MTQ+VIEM+EITKKEGD VANDHINL V KGEIHALLGENGAGKSTLMNMLAGLLEPT G
Sbjct:   7  MTQHVIEMREITKKEGDEVANDHINLNVRKGEIHALLGENGAGKSTLMNMLAGLLEFTSG    66

Query:  70  QIFINGQPVTIDSPSKSSQLGIGMVHQHFMLVEAFTVAENIVLGNETTQNGVLDIKTAAK   129
```

```
                +I IN +PV IDSPSKS++LGIGMVHQHFMLVEAFTVAENI+LGNE  +NG LD+  A+K
Sbjct:  67      EIVINDKPVQIDSPSKSAELGIGMVHQHFMLVEAFTVAENIILGNEVVKNGCLDLNQASK    126

Query: 130      EIKELSEKYGLSVNPNAKISDISVGAQQRVEILKTLYRGADILIFDEPTAVLTPSEIKEL    189
                +IK LSEKYGL++NP+AK+SDISVGAQQRVEILKTLYRGADILIFDEPTAVLTP+EIKEL
Sbjct: 127      DIKVLSEKYGLAINPSAKVSDISVGAQQRVEILKTLYRGADILIFDEPTAVLTPAEIKEL    186

Query: 190      MTIMKSLVEEGKSIILITHKLDEIRAVADKVTVIRRGKSIETVPVAGASSQQLAEMMVGR    249
                MTIMK+LVKEGKSIILITHKLDEIRAVAD+VTVIRRGKSIETV VAGA+SQ LAEMMVGR
Sbjct: 187      MTIMKNLVKEGKSIILITHKLDEIRAVADRVTVIRRGKSIETVDVAGATSQDLAEMMVGR    246

Query: 250      SVSFRTEKKEANPTDIILSVKDLVVEENRGGVLAVKNLSLDVRAGEIVGIAGIDGNGQSE    309
                SVSF T KK A P D++LS+K+L V+ENR GV AVK LSLDVRAGEIVGIAGIDGNGQSE
Sbjct: 247      SVSFTTSKKAAEPKDVVLSIKNIEVDENR-GVPAVKGLSLDVRAGEIVGIAGIDGNGQSE    305

Query: 310      LIQAITGLRKVTSGQIVIKGKDVTKESSRQITELSVGHVPEDRHRDGLVLDMTMAENLAL    369
                LIQAITGLRKV SG I+IK  +VT   SSR+ITELSVGHVPEDRHRDGL+LD+++AEN AL
Sbjct: 306      LIQAITGLRKVKSGSIMIKNNEVTHLSSRKITELSVGHVPEDRHRDGLILDLSLAENTAL    365

Query: 370      QTYYKEPLSHKGILNFAKIKEYARQLMTEFDVRGAGEHVLARGESGGNQQKAIIAREVDR    429
                QTYYK+PLS  GILN+ KI +YARQLM EFDVRGA E V ARGFSGGNQQKAIIAREVDR
Sbjct: 366      QTYYKQPLSQNGILNYTKINDYARQLMKEEDVRGANELVPARGESGGNQQKAIIAREVDR    425

Query: 430      DPDLLIVSQPTRGLDVGAIEYIHKRLIEERDKGKAVLVVSFELDEILNLSDRIAVIHDGK    489
                DPDLLIVSQPTRGLDVGAIEYIHKRLI+ERDKGKAVLVVSFELDEILNLSDRIAVIHDGK
Sbjct: 426      DPDLLIVSQPTRGLDVGAIEYIHKRLIKERDKGKAVLVVSFELDEILNLSDRIAVIHDGK    485

Query: 490      IQGIVKPDQTNKQELGILMAGGKIEKEERDV                                 520
                IQGIV P+ TNKQELGILMAGG I KEE  V
Sbjct: 486      IQGIVSPENTNKQELGILMAGGSIHKEEGHV                                 516
```

Based on this analysis, it was predicted that these proteins and their epitopes could be useful antigens for vaccines or diagnostics.

Example 1521

A DNA sequence (GBSx1612) was identified in *S. agalactiae* <SEQ ID 4679> which encodes the amino acid sequence <SEQ ID 4680>. Analysis of this protein sequence reveals the following:

```
Possible site: 22
>>> May be a lipoprotein
----- Final Results -----
   bacterial membrane --- Certainty = 0.0000 (Not Clear) <succ>
   bacterial outside  --- Certainty = 0.0000 (Not Clear) <succ>
   bacterial cytoplasm --- Certainty = 0.0000 (Not Clear) <succ>
```

The protein has homology with the following sequences in the GENPEPT database.

```
>GP:CAB15143 GB:Z99120 similar to ABC transporter (lipoprotein)
[Bacillus subtilis]
Identities = 164/335 (48%), Positives = 224/335 (65%), Gaps = 10/335 (2%)
Query:  18      LAACGHRGASKSGGKS-DSLKVAMVTDTGGVDDKSFNQSGWEGMQAWGKKNGLKKGA-GF    75
                L ACG+  S   G+ +    VAMVTD GGVDDKSFNQS WEG+QA+GK+NGLKKG  G+
Sbjct:  11      LGACGNSEKSSGSGEGKNKFSVAMVTDVGGVDDKSFNQSAWEGIQAFGKENGLKKGKNGY    70

Query:  76      DYFQSASESDYATNLDTAVSSGYKLIFGIGFSLHDAIDKAADNNKDVNYVIVDDVIKGKD    135
                DY QS S++DY TNL+     + LI+G+G+ + D+I + AD  K+ N+ I+D V+  KD
Sbjct:  71      DYLQSKSDADYTTNLNKLARENFDLIYGVGYLMEDSISEIADQRKNTNFAIIDAVVD-KD    129

Query: 136      NVASVVFADNESAYLAGIAAAKTTKTKTVGFVGGMESEVITRFEKGFEAGVKSVDKSIKI    195
                NVAS+ F + E ++L G+AAA ++K+  +GFVGGMESE+ +FE GF AGV++V+      +
Sbjct: 130      NVASITFKEQEGSFLVGVAAALSSKSGKIGFVGGMESELIKKFEVGFRAGVQAVNPKAVV    189

Query: 196      KVDYAGSFGDAAKGKTIAAAQYASGADIVYQVAGGTGAGVFSEAKSRNESLKEADKVWVL    255
                +V YAG F  A  GK  A + Y SG D++Y AG TG GVF+EAK+    +  D VWV+
Sbjct: 190      EVKYAGGFDKADVGKATAESMYKSGVDVIYHSAGATGTGVFTEAKNLKKEDPKRD-VWVI    248

Query: 256      GVDRDQAAEGKYTSKDGKASNFVLASSIKEVGKSVELIATKTSKGKFPGGNVTTYGLKDG    315
                GVD+DQ AEG+     +G  N  L S +K+V  VE +  K S GKFPGG     TYGL
Sbjct: 249      GVDKDQYAEGQV---EGTDDNVTLTSMVEKVDTVVEDVTKKASDGKFPGGETLTYGLDQD    305

Query: 316      GVDIATT--NLSDDAVKAIKEAKAKIISGDIKVPS                             348
                GV I+ +   NLSDD +KA+ + K KII G +++P+
Sbjct: 306      GVGISPSKQNLSDDVIKAVDKWKKKIIDG-LEIPA                             339
```

A related DNA sequence was identified in *S. pyogenes* <SEQ ID 861> which encodes the amino acid sequence <SEQ ID 862>. Analysis of this protein sequence reveals the following:

```
Possible site: 19
>>> May be a lipoprotein
----- Final Results -----
    bacterial membrane --- Certainty = 0.0000 (Not Clear) <succ>
    bacterial outside --- Certainty = 0.0000 (Not Clear) <succ>
       bacterial cytoplasm --- Certainty = 0.0000 (Not Clear) <succ>
```

An alignment of the GAS and GBS proteins is shown below.

```
Identities = 275/351 (78%), Positives = 312/351 (88%), Gaps = 3/351 (0%)
Query: 1    MNKKIAGIGLASIAVLSLAACGHRGASKSG--GKSDSLKVAMVTDTGGVDDKSENQSGWE    58
            MNKK G+GLAS+AVLSLAACG+RGASK G  GK+D LKVAMVTDTGGVDDKSFNQS WE
Sbjct: 1    MNKKFIGLGLASVAVLSLAACGNRGASKGGASGKTD-LKVAMVTDTGGVDDKSENQSAWE    59

Query: 59   GMQAWGKKNGLKKGAGFDYFQSASESDYATNLDTAVSSGYKLIEGIGFSLHDAIDKAADN   118
            G+Q+WGK+ GL+KG GFDYFQS SES+YATNLDTAVS GY+LI+GIGF+L DAI KAA +
Sbjct: 60   GLQSWGKEMGLQKGTGEDYFQSTSESEYATNLDTAVSGGYQLIYGIGFALKDAIAKAAGD   119

Query: 119  NKDVNYVIVDDVIKGKDNVASVVFADNESAYLAGIAAAKTTKTKTVGFVGGMESEVITRF   178
            N+ V +VI+DD+I+GKDNVASV FAD+E+AYLAGIAAAKTTKTKTVGFVGGME  VITRF
Sbjct: 120  NEGVKFVIIDDIIEGKDNVASVTFADHEAAYLAGIAAAKTTKTKTVGFVGGMEGTVITRF   179

Query: 179  EKGFEAGVKSVDKSIKIKVDYAGSFGDAAKGKTIAAAQYASGADIVYQVAGGTGAGVFSE   238
            EKGFEAGVKSVD +I++KVDYAGSFGDAAKGKTIAAAQYA+GAD++YQ AGGTGAGVF+E
Sbjct: 180  EKGFEAGVKSVDDTIQVKVDYAGSFGDAAKGKTIAAAQYAAGADVIYQAAGGTGAGVFNE   239

Query: 239  AKSRNESLKEADKVWVLGVDRDQAAEGKYTSKDGKASNEVLASSIKEVGKSVELIATKTS   298
            AK+ NE  EADKVWV+GVDRDQ  EGKYTSKDGK +NFVLASSIKEVGK+V+LI  + +
Sbjct: 240  AKAINEKRSEADKVWVIGVDRDQKDEGKYTSKDGKEANFVLASSIKEVGKAVQLINKQVA   299

Query: 299  KGKFPGGNVTTYGLKDGGVDIATTNLSDDAVKAIKEAKAKIISGDIKVPSK           349
               KFPGG  T YGLKDGGV+IATTN+S +AVKAIKEAKAKI SGDIKVP K
Sbjct: 300  DKKFPGGKTTVYGLKDGGVEIATTNVSKEAVKAIKEAKAKIKSGDIKVPEK           350
```

A related DNA sequence was identified in *S. pyogenes* <SEQ ID 9061> which encodes amino acid sequence <SEQ ID 9062>. Analysis of this protein sequence reveals the following:

```
Possible site: 17
>>> May be a lipoprotein
----- Final Results -----
    bacterial membrane --- Certainty = 0.0000 (Not Clear) <succ>
    bacterial outside --- Certainty = 0.0000 (Not Clear) <succ>
       bacterial cytoplasm --- Certainty = 0.0000 (Not Clear) <succ>
```

An alignment of the GAS and GBS sequences follows:

```
Score = 414 bits (1052), Expect = e-117
Identities = 196/347 (56%), Positives = 253/347 (72%), Gaps = 2/347 (0%)
Query: 1    MNKKVMSLGLVSTALFTLGGCTNNSAKQT--TDNSLKIAMITNQTGIDDKSFNQSAWEGL    58
            MNKK+  +GL S A+ +L  C + A ++    +SLK+AM+T+  G+DDKSFNQS WEG+
Sbjct: 1    MNKKIAGIGLASIAVLSLAACGHRGASKSGGKSDSLKVAMVTDTGGVDDKSFNQSGWEGM    60

Query: 59   QAWGKENKLEKGKGYDYFQSANESEFTTNLESAVTNGYNLVFGIGFPLHDAVEKVAANNP   118
            QAWGK+N L+KG G+DYFQSA+ES++ TNL++AV++GY L+FGIGF LHDA++K A NN
Sbjct: 61   QAWGKKNGLKKGAGFDYFQSASESDYATNLDTAVSSGYKLIFGIGFSLHDAIDKAADNNK   120

Query: 119  DNHFAIVDDVIKGQKNVASITFSDHEAAYLAGVXXXXXXXXXXQVGFVGGMEGDVVKRFEK   178
            D ++ IVDDVIKG+ NVAS+ F+D+E+AYLAG+          VGFVGGME +V+ RFEK
Sbjct: 121  DVNYVIVDDVIKGKDNVASVVFADNESAYLAGIAAAKTTKTKTVGFVGGMESEVITRFEK   180

Query: 179  GFEAGVKSVDDTIKVRVAYAGSFXXXXXXXXXXXXXXXXXEGADVIYHAAGGTGAGVFSEAK   238
            GFEAGVKSVD +IK++V YAGSF                 GAD++Y AGGTGAGVF+EAK
Sbjct: 181  GFEAGVKSVDKSIKIKVDYAGSFGDAAKGKTIAAAQYASGADVIYQVAGGTGAGVFSEAK   240

Query: 239  SINEKRKEEDKVWVIGVDRDQSEDGKYTTKDGKSANFVLTSSIKEVGKALVKVAVKTSED   298
            S NE  KE DKVWV+GVDRDQ+ +GKYT+KDGK +NFVL SSIKEVGK++  +A KTS+
Sbjct: 241  SRNESLKEADKVWVLGVDRDQAAEGKYTSKDGKASNFVLASSIKEVGKSVELIATKTSKG   300

Query: 299  QFPGGQITTFGLKEGGVSLTTDALTQDXXXXXXXXXXXXXTGTITVP              345
            +FPGG +TT+GLK+GGV + T L+ D               G I VP
Sbjct: 301  KFPGGNVTTYGLKDGGVDIATTNLSDDAVKAIKEAKAKIISGDIKVP              347
```

SEQ ID 4680 (GBS211) was expressed in *E. coli* as a His-fusion product. SDS-PAGE analysis of total cell extract is shown in FIG. 49 (lane 6; MW 40 kDa).

Figure 259A:
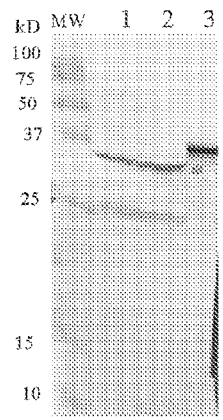
Figure 259B:
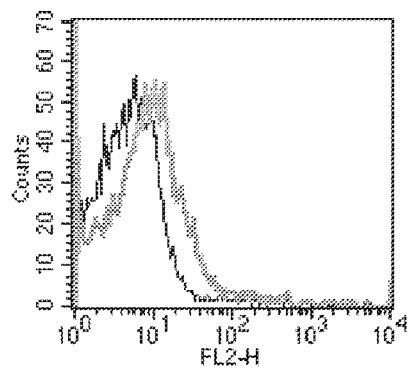

The GBS211-His fusion product was purified (FIG. 205, lane 8) and used to immunise mice. The resulting antiserum was used for Western blot (FIG. 259A) and FACS (FIG. 259B). These tests confirm that the protein is immunoaccessible on GBS bacteria.

Based on this analysis, it was predicted that these proteins and their epitopes could be useful antigens for vaccines or diagnostics.

Example 1522

A DNA sequence (GBSx1613) was identified in *S. agalactiae* <SEQ ID 4681> which encodes the amino acid sequence <SEQ ID 4682>. This protein is predicted to be cytidine deaminase (cdd). Analysis of this protein sequence reveals the following:

Possible site: 42
>>> Seems to have no N-terminal signal sequence
----- Final Results -----
    bacterial cytoplasm --- Certainty = 0.2112 (Affirmative) <succ>
      bacterial membrane --- Certainty = 0.0000 (Not Clear) <succ>
        bacterial outside --- Certainty = 0.0000 (Not Clear) <succ>

A related GBS nucleic acid sequence <SEQ ID 9801> which encodes amino acid sequence <SEQ ID 9802> was also identified.

The protein has homology with the following sequences in the GENPEPT database.

```
>GP:CAB51906 GB:A.7237978 cytidine deaminase [Bacillus psychrophilus]
Identities = 66/114 (57%), Positives = 81/114 (70%)
Query:  26   KASENAYVPYSKFPVGAALRTAEGKIFTGCNVENISYGLANCAERTAIFKAVSEGYKDFS        85
             KA E AYVPYSKFPVGAAL  +G I+ GCN+EN +Y + NCAERTA FKAVS+G + F
Sbjct:  12   KAREQAYVPYSKFPVGAALLAEDGTIYHGCNIENSAYSMTNCAERTAFFKAVSDGVRSKF        71

Query:  86   EIAIYGNTEEPISPCGACRQVMVEFFNKNAKVTLIAKNGKTVETTVGELLPYSF            139
             +A+  +TE P+SPCGACRQV+ EF N +   V L   G    ETTV +LLP +F
Sbjct:  72   ALAVVADTEGPVSPCGACRQVIAEFCNGSMPVYLTNLKGDIEETTVAKLLPGAF            125
```

A related DNA sequence was identified in *S. pyogenes* <SEQ ID 4683> which encodes the amino acid sequence <SEQ ID 4684>. Analysis of this protein sequence reveals the following:

Possible site: 13
>>> Seems to have no N-terminal signal sequence
----- Final Results -----
    bacterial cytoplasm --- Certainty = 0.0041 (Affirmative) <succ>
      bacterial membrane --- Certainty = 0.0000 (Not Clear) <succ>
        bacterial outside --- Certainty = 0.0000 (Not Clear) <succ>

The protein has homology with the following sequences in the databases:

```
>GP:CAB15143 GB:Z99120 similar to ABC transporter (lipoprotein)
[Bacillus subtilis]
Identities = 152/339 (44%), Positives = 223/339 (64%), Gaps = 11/339 (3%)
Query:   8   LGLVSTALFTLGGCTNN---SAKQTTDNSLKIAMITNQTGIDDKSFNQSAWEGLQAWGKE         64
             + LV  A   LG C N+    S      N  +AM+T+  G+DDKSFNQSAWEG+QA+GKE
Sbjct:   1   MSLVIAAGTILGACGNSEKSSGSGEGKNKFSVAMVTDVGGVDDKSFNQSAWEGIQAFGKE         60

Query:  65   NKLEKGK-GYDYFQSANESEFTTNLESAVTNGYNLVEGIGFPLHDAVEKVAANNPDNHFA        123
             N L+KGK GYDY QS +++++TTNL     ++L++G+G+ + D++ ++A   + +FA
Sbjct:  61   NGLKKGKNGYDYLQSKSDADYTTNLNKLARENFDLIYGVGYLMEDSISEIADQRKNTNFA        120

Query: 124   IVDDVIKGQKNVASITFSDHEAAYLAGVAAAKTTKTKQVGFVGGMEGDVVKRFEKGFEAG        183
             I+D V+  + NVASITF + E ++L GVAAA ++K+ ++GFVGGME +++K+FE GF AG
Sbjct: 121   IIDAVVD-KDNVASITFKEQEGSFLVGVAAALSSKSGKIGFVGGMESELIKKFEVGFRAG        179

Query: 184   VKSVDDTIKVRVAYAGSFADAAKGKTIAAAQYAEGADVIYHAAGGTGAGVFSEAKSINEK        243
             V++V+    V V YAG F  A   GK   A + Y   G DVIYH+AG TG GVF+EAK++ ++
Sbjct: 180   VQAVNPKAVVEVKYAGGFDKADVGKATAESMYKSGVDVIYHSAGATGTGVFTEAKNLKKE        239

Query: 244   RKEEDKVWVIGVDRDQSEDGKYTTKDGKSANFVLTSSIKEVGKALVKVAVKTSEDQFPGG        303
             + D VWVIGVD+DQ  +G+    +G  N   LTS +K+V  +  V K S+ +FPGG
Sbjct: 240   DPKRD-VWVIGVDKDQYAEGQV---EGTDDNVTLTSMVKKVDTVVEDVTKKASDGKFPGG        295

Query: 304   QITTFGLKEGGVSLTTDA--LTQDTKKAIEAAKKAIIEG                           340
             +  T+GL + GV ++       L+ D   KA++  KK II+G
Sbjct: 296   ETLTYGLDQDGVGISPSKQNLSDDVIKAVDKWKKKIIDG                           334
```

An alignment of the GAS and GBS proteins is shown below.

```
Identities = 88/128 (68%), Positives = 107/128 (82%)
Query: 15    MGNIELKKLAVKASENAYVPYSKFPVGAALRTAEGKIFTGCNVENISYGLANCAERTAIF    74
             MG  +L    AV+ASE AYVPYS FPVGAAL+T +G I+TGCN+EN+S+GL NC ERTAIF
Sbjct: 1     MGTTDLVSCAVQASEYAYVPYSHFPVGAALKTKDGTIYTGCNIENVSFGLTNCGERTAIF    60

Query: 75    KAVSEGYKDFSEIAIYGNTEEPISPCGACRQVMVEFFNKNAKVTLIAKNGKTVETTVGEL    134
             KA+S+G+K+   EIAIYG T +P+SPCGACRQVM EFF+ ++ VTLIAKNG+TVE TVG+L
Sbjct: 61    KAISDGHKELVEIAIYGETMQPVSPCGACRQVMAEFFDPSSLVTLIAKNGQTVEMTVGDL    120

Query: 135   LPYSFVDL    142
             L YSF DL
Sbjct: 121   LLYSFTDL    128
```

Based on this analysis, it was predicted that these proteins and their epitopes could be useful antigens for vaccines or diagnostics.

Example 1523

A DNA sequence (GBSx1614) was identified in *S. agalactiae* <SEQ ID 4685> which encodes the amino acid sequence <SEQ ID 4686>. Analysis of this protein sequence reveals the following:

---

Possible site: 34
>>> Seems to have no N-terminal signal sequence
----- Final Results -----
    bacterial cytoplasm --- Certainty = 0.2979 (Affirmative) <succ>
      bacterial membrane --- Certainty = 0.0000 (Not Clear) <succ>
        bacterial outside --- Certainty = 0.0000 (Not Clear) <succ>

---

A related GBS nucleic acid sequence <SEQ ID 9799> which encodes amino acid sequence <SEQ ID 9800> was also identified.

The protein has homology with the following sequences in the GENPEPT database.

A related DNA sequence was identified in *S. pyogenes* <SEQ ID 4687> which encodes the amino acid sequence <SEQ ID 4688>. Analysis of this protein sequence reveals the following:

---

Possible site: 49
>>> Seems to have no N-terminal signal sequence
----- Final Results -----
    bacterial cytoplasm --- Certainty = 0.4232 (Affirmative) <succ>
      bacterial membrane --- Certainty = 0.0000 (Not Clear) <succ>
        bacterial outside --- Certainty = 0.0000 (Not Clear) <succ>

---

```
>GP:CAB11882 GB:Z99104 alternate gene name: ybaA-similar to
hypothetical proteins [Bacillus subtilis]
Identities = 90/201 (44%), Positives = 144/201 (70%), Gaps = 5/201 (2%)
Query: 1     MANMYYTENPNVEHDIHELNVKLLGESFSFLTDAGVFSKRMIDYGSQVLLNSLHF-EKMX    59
             M+  YY+E P+V+ +   + +L  + F+F +D+GVFSK+ +D+GS++L++S      E
Sbjct: 1     MSEHYYSEKPSVXSNKQTWSFRLENKDFTFTSDSGVFSKKEVDFGSRLLIDSFEEPEVEG    60

Query: 60    SLLDLGCYGPLGISLAK-VQGVKATMVDINTRALELAKKNATRNGVV-VEVFQSNIYEN    117
             +LD+GCGYGP+G+SLA   +     M+D+N RA+EL+ +NA +NG+  V+++QS+++ N
Sbjct: 61    GILDVGCGYGPIGLSLASDFKDRTIHMIDVNERAVELSNENAEQNGITNVKIYQSDLFSN    120

Query: 118   I--SKTFDYIISNPPIRAGKQVVHSIIEESICYLNTGGSLTIVIQKKQGAPSAKAKMLDT    175
             +  ++TF   I++NPPIRAGK+VVH+I E+S   +L   G L IVIQKKQGAPSA  K+ +
Sbjct: 121   VDSAQTFASILTNPPIRAGKEVVHAIFEKSAEHLKASGELWIVIQKKQGAPSAIEKLEEL    180

Query: 176   FGNCDILKKDKGYYILRSEKV    196
             F    +++K KGYYI++++KV
Sbjct: 181   FDEVSVVQKKKGYYIIKAKKV    201
```

An alignment of the GAS and GBS proteins is shown below.

```
Identities = 139/195 (71%), Positives = 165/195 (84%)
Query: 1     MANMYYTENPNVEHDIHELNVKLLGESFSFLTDAGVFSKRMIDYGSQVLLNSLHFEKNKS    60
             M  MYY ENP+  HDIHE+ V+LL    F+FLTD+GVFSK+M+D+GSQVLL +L+F++N+
Sbjct: 12    MTKMYYDENPDSLHDIHEVKVELLNHPFTFLTDSGVFSKKMVDFGSQVLLKTLNFKENER    71
```

```
Query:  61  LLDLGCYGPLGISLAKVQGVKATMVDINTRALELAKKNATRNGVVVEVFQSNIYENISK      120
            +LDLGCYGPLGISLAKVQ V AT+VDIN RAL+LA+KNAT N V V +FQSNIYENIS
Sbjct:  72  VLDLGCYGPLGISLAKVQRVDATLVDINNRALDLARKNATNNQVAVTIFQSNIYENISG      131

Query: 121  TFDYIISNPPIRAGKQVVHSIIEESICYLNTGGSLTIVIQKKQGAPSAKAKMLDTFGNCD     180
             F++IISNPPIRAGK+VVHSIIE+SI +L   G LTIVIQKKQGAPSAKAKM   FGN +
Sbjct: 132  HFEHIISNPPIRAGKRVVHSIIEKSIDFLVVNGDLTIVIQKKQGAPSAKAKMATIFGNVE     191

Query: 181  ILKKDKGYYILRSEK                                                 195
            IL+KDKGYY+LRS K
Sbjct: 192  ILRKDKGYYVLRSIK                                                 206
```

Based on this analysis, it was predicted that these proteins and their epitopes could be useful antigens for vaccines or diagnostics.

Example 1524

A DNA sequence (GBSx1615) was identified in *S. agalactiae* <SEQ ID 4689> which encodes the amino acid sequence <SEQ ID 4690>. This protein is predicted to be pantothenate kinase (coaA). Analysis of this protein sequence reveals the following:

Possible site: 28
>>> Seems to have no N-terminal signal sequence
----- Final Results -----
   bacterial cytoplasm --- Certainty = 0.5021 (Affirmative) <succ>
    bacterial membrane --- Certainty = 0.0000 (Not Clear) <succ>
     bacterial outside --- Certainty = 0.0000 (Not Clear) <succ>

A related DNA sequence was identified in *S. pyogenes* <SEQ ID 4691> which encodes the amino acid sequence <SEQ ID 4692>. Analysis of this protein sequence reveals the following:

Possible site: 28
>>> Seems to have no N-terminal signal sequence
----- Final Results -----
   bacterial cytoplasm --- Certainty = 0.4790 (Affirmative) <succ>
    bacterial membrane --- Certainty = 0.0000 (Not Clear) <succ>
     bacterial outside --- Certainty = 0.0000 (Not Clear) <succ>

The protein has homology with the following sequences in the GENPEPT database.

```
>GP:BAB06594 GB:AP001516 pantothenate kinase [Bacillus halodurans]
Identities = 140/307 (45%), Positives = 203/307 (65%), Gaps = 5/307 (1%)
Query:   4  EFINFDRISRENWKDLHQQSQALLTEKELESIKSLNDNINIQDVIDIYLPLINLIQIYKR     63
            +F +  +SR  WK L + S   + E+ELE +  LN+ I + +V DIY+PL  L+ ++
Sbjct:   8  DFFPYTVLSRSQWKSLRKASSLPINEQELEQLVGLNEPITLNEVADIYVPLAELLHVAT      67

Query:  64  SQENLSFSKAIFLKKENYQRPFIIGISGSVAVGKSTTSRLLQLLISRTFKDSHVELVTTD    123
             + + L   K  F     + PFIIG++GSVAVGKSTT+RLLQ L+     + HV+LVTTD
Sbjct:  68  AYQRLQQQKRGFFHHGKNRSPFIIGLAGSVAVGKSTTARLLQKLLKAWPEHHHVDLVTTD    127

Query: 124  GFLYPNEKLIQNGILNRKGFPESYDMESLLNFLDTIKNGIT-AKIPIYSHEIYDIVPNQL    182
            GFLYPNE L   G++++KGFPESYD+ +L+ FL  +K G   K P+YSH  Y+IV
Sbjct: 128  GFLYPNETLEARGLMDKKGFPESYDLPALIRFLSDVKAGEPYVKAPVYSHLTYNIVEGDY    187

Query: 183  QTIETPDFLILEGINVFQ-NQQNHRL---YMNDYFDFSIYIDAENKQIEEWYLQRFNSLL    238
            Q +  PD +I+EGINV Q N++NH +    +++D+FDFSIY+DA+ +QI +WY++RF  L
Sbjct: 188  QVVHEPDIVIVEGINVLQVNKRNHHIPNVFVSDFFDFSIYVDAKEEQILQWYIERFKLLQ    247

Query: 239  QLAEADPSNYYHKFTQIPPHKAMELAKDIWKTINLVNLEKYIEPTRNRADFIIHKGKHHK    298
              A  DP++Y+H+F  +   +A + A  IWK IN VNL + I PT++RAD ++ KG HH
Sbjct: 248  NTAFQDPNSYFHRFRHLSEVEAEQFATSIWKNINGVNLHENILPTKHRADLVLQKGPHHF    307

Query: 299  IDEIYLK                                                        305
            IDE+ L+
Sbjct: 308  IDEVKLR                                                        314
```

An alignment of the GAS and GBS proteins is shown below.

```
Identities = 219/306 (71%)4 Positives = 269/306 (87%)
Query:   1  MNNEFINFDRISRENWKDLHQQSQALLTEKELESIKSLNDNINIQDVIDIYLPLINLIQI     60
            M+NEFINF++ISRE+WK LHQ+++ALLT++EL+SI SLNDNI+I DVIDIYLPLINLIQ+
Sbjct:   1  MSNEFINFEKISRESWKTLHQKAKALLTQEELKSITSLNDNISINDVIDIYLPLINLIQV     60
```

-continued

```
Query:  61  YKRSQENLSFSKAIFLKKENYQRPFIIGISGSVAVGKSTTSRLLQLLISRTFKDSHVELV   120
            YK +QENLSFSK++FLKK+   RPFIIGISGSVAVGKSTTSRLLQLL+SRT +S VELV
Sbjct:  61  YKIAQENLSFSKSLFLKKDIQLRPFIIGISGSVAVGKSTTSRLLQLLLSRTHPNSQVELV   120

Query: 121  TTDGFLYPNEKLIQNGILNRKGFPESYDMESLLNFLDTIKNGITAKIPIYSHEIYDIVPN   180
            TTDGFLYPN+ LI+ G+LNRKGFPESY+ME LL+FLD+IKNG TA P+YSH+IYDI+PN
Sbjct: 121  TTDGFLYPNQFLIEQGLLNRKGFPESYNMELLLDFLDSIKNGQTAFAPVYSHDIYDIIPN   180

Query: 181  QLQTIETPDFLILEGINVFQNQQNHRLYMNDYFDFSIYIDAENKQIEEWYLQRFNSLLQL   240
            Q Q+    PDFLI+EGINVFQNQQN+RLYM+DYFDFSIYIDA++  IE WY++RF S+L+L
Sbjct: 181  QKQSFNNPDFLIVEGINVFQNQQNNRLYMSDYFDFSIYIDADSSHIETWYIERFLSILKL   240

Query: 241  AEADPSNYYHKFTQIPPHKAMELAKDIWKTINLVNLEKYIEPTRNRADFIIHKGKHHKID   300
            A+ DP NYY ++ Q+P  +A+  A+++WKT+NL NLEK+IEPTRNRA+ I+HK   HKID
Sbjct: 241  AERDPHNYYAQYAQLPRSEAIAFARNVWKTVNLENLEKFIEPTRNRAELILHKSADHKID   300

Query: 301  EIYLKK                                                        306
            EIYLKK
Sbjct: 301  EIYLKK                                                        306
```

Based on this analysis, it was predicted that these proteins and their epitopes could be useful antigens for vaccines or diagnostics.

Example 1525

A DNA sequence (GBSx1616) was identified in *S. agalactiae* <SEQ ID 4693> which encodes the amino acid sequence <SEQ ID 4694>. Analysis of this protein sequence reveals the following:

Possible site: 59
>>> Seems to have no N-terminal signal sequence
----- Final Results -----
   bacterial cytoplasm --- Certainty = 0.3866 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:BAB05058 GB:A2001511 ribosomal protein S20 (BS20) [Bacillus halodurans]
Identities = 47/86 (54%), Positives = 59/86 (67%), Gaps = 7/86 (8%)
Query:   3  VKTLANIKSAIKRAELNVKQNEKNSAQKSAMRTAIKAFEA---NPSEELYRA----ASSS   55
            +K  ANIKSAIKR + N K+  +N++ KSA+RTAIK FEA    N   E  +A    A+
Sbjct:   1  MKGNANIKSAIKRVKTNEKRRIQNASVKSALRTAIKQFEAKVENNDAEAAKAAFVEATKK   60

Query:  56  IDKAASKGLIHTNKASRDKARLATKL                                    81
            +DKAA+KGLIH N ASR K+RLA KL
Sbjct:  61  LDKAANKGLIHKNAASRQKSRLAKKL                                    86
```

A related DNA sequence was identified in *S. pyogenes* <SEQ ID 4695> which encodes the amino acid sequence <SEQ ID 4696>. Analysis of this protein sequence reveals the following:

Possible site: 59
>>> Seems to have no N-terminal signal sequence
----- Final Results -----
   bacterial cytoplasm --- Certainty = 0.3872 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 76/82 (92%), Positives = 78/82 (94%)
Query:   1  MEVKTLANIKSAIKRAELNVKQNEKMSAQKSAMRTAIKAFEANPSEELYRAASSSIDKAA   60
            +EVKTLANIKSAIKRAELNVK NEKNSAQKSAMRTAIKAFEANPSEEL+RAASSSIDKA
Sbjct:   1  LEVKTLANIKSAIKRAELNVKANEENSAQKSAMRTAIKAFEANPSEELFRAASSSIDKAE   60

Query:  61  SKGLIHTNKASRDKARLATKLG                                        82
            SKGLIH NKASRDKARLA KLG
Sbjct:  61  SKGLIHKNKASRDKARLAAKLG                                        82
```

Based on this analysis, it was predicted that these proteins and their epitopes could be useful antigens for vaccines or diagnostics.

Example 1526

A DNA sequence (GBSx1617) was identified in *S. agalactiae* <SEQ ID 4697> which encodes the amino acid sequence <SEQ ID 4698>. Analysis of this protein sequence reveals the following:

```
Possible site: 48
>>> Seems to have no N-terminal signal sequence
INTEGRAL     Likelihood = -10.99  Transmembrane 31-47 (25 -51)
----- Final Results -----
    bacterial membrane --- Certainty = 0.5394 (Affirmative) <succ>
    bacterial outside --- Certainty = 0.0000 (Not Clear) <succ>
       bacterial cytoplasm --- Certainty = 0.0000 (Not Clear) <succ>
```

The protein has homology with the following sequences in the GENPEPT database.

```
>GP:AAC35851 GB:AF086736 amino acid-binding protein Abp [Streptococcus uberis]
Identities = 169/269 (62%), Positives = 203/269 (74%), Gaps = 2/269 (0%)
Query: 29    KNILLTIIFGLFMIILSACGMSNKEMAGIDNWEHYQKEKKITIGFDNTFVPMGFESRSGD      88
             K ILLT +     + L ACG S+   A   D W+ Y+KEK IT+GFDNTFVPMGF+  SG
Sbjct: 4     KKILLTTLALASTLFLVACGKSSA--AKTDQWDTYKKEKSITLGFDNTFVPMGFKDESGK    61

Query: 89    YTGFDIDLANAVFKEYGISVKWQPINWDMKETELNNGNIDLIWNGYSKTAERAKKVAFTN     148
              TGFD++LA AVF+EYGI VK+QPINWD+KETEL NG ID+IWNGYS T ER   KVAF+
Sbjct: 62    NTGFDVELAKAVFQEYGIKVKFQPINWDLKETELKNGKIDMIWNGYSVTKERQAKVAFST    121

Query: 149   PYMNNHQVIVTKTSSHINSIKDMKGKKLGAQSGSSGFDAFNAKPDILKKFVKGKEAVQYD     208
             PYM N QV+VTK SS+I S    MKGK LGAQSGSSG+DAF + P +LK  VK  +A QY+
Sbjct: 122   PYMKNEQVLVTKKSSNITSFAANKGKVLGAQSGSSGYDAFTSNPKVLKDIVKDNDATQYE   181

Query: 209   TFTQALIDLKNNRIDGLLIDEVYANYYLKQEGNIKAYYFVKTAYQGENFVVGARKVDRRL     268
             TF QA IDLKN+RIDGLLID+VYANYYLKQEG +  Y  VK+ + GE+F VG RK D+ L
Sbjct: 182   TFIQAFIDLKNDRIDGLLIDKVYANYYLKQEGELTNYNIVKSEFDGEDFAVGVRKEDKIL   241

Query: 269   IEKINKAFKQLHNKGRFQKISYKWFGEDV    297
             ++ IN AF +L+   G+FQ+IS KWFGEDV
Sbjct: 242   LKNINSAFTKLYKTGKFQEISQKWFGEDV    270
```

A related DNA sequence was identified in *S. pyogenes* <SEQ ID 4699> which encodes the amino acid sequence <SEQ ID 4700>. Analysis of this protein sequence reveals the following:

```
Possible site: 21
>>> May be a lipoprotein
----- Final Results -----
    bacterial membrane --- Certainty = 0.0000 (Not Clear) <succ>
    bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP:AAC35851 GB:AF086736 amino acid-binding protein Abp [Streptococcus uberis]
Identities = 176/277 (63%), Positives = 220/277 (78%), Gaps = 1/277 (0%)
Query: 1     MIIKKRTVAILAIASSFFLVACQATKSLKSGDAWGVYQKQKSITVGFDNTFVPMGYKDES       60
             M +KK+   LA+AS+ FLVAC   + K+ D W   Y+K+KSIT+GFDNTFVPMG+KDES
Sbjct: 1     MNLKKILLTTLALASTLFLVACGKSSAAKT-DQWDTYKKEKSITLGFDNTFVPMGFKDES     59

Query: 61    GRCKGFDIDLAKEVFHQYGLKVNFQAINWDMKEAELNNGKIDVIWNGYSITKERQDKVAF    120
             G+   GFD++LAK VF +YG+KV FQ INWD+KE EL NGKID+IWNGYS+TKERQ KVAF
Sbjct: 60    GKNTGFDVELAKAVFQEYGIKVKFQPINWDLKETELKNGKIDMIWNGYSVTKERQAKVAF    119

Query: 121   TDSYMRNEQIIVVKKRSDIKTISDMKHKVLGAQSASSGYDSLLRTPKLLKDFIKNKDANQ    180
             +  YM+NEQ++V KK S+I + +  MK KVLGAQS SSGYD+    PK+LKD +K+  DA Q
Sbjct: 120   STPYMKNEQVLVTKKSSNITSFAANKGKVLGAQSGSSGYDAFTSNPKVLKDIVKDNDATQ    179

Query: 181   YETFTQAFIDLKSDRIDGILIDKVYANYYLAKEGQLENYRMIPTTFENEAFSVGLRKEDK    240
             YETF QAFIDLK+DRIDG+LIDKVYANYYL +EG+L NY ++   F+ E F+VG+RKEDK
Sbjct: 180   YETFIQAFIDLKNDRIDGLLIDKVYANYYLKQEGELTNYNIVESEFDGEDFAVGVRKEDK    239

Query: 241   TLQAKINRAFRVLYQNGKFQAISEKWFGDDVATANIK    277
              L   IN AF  LY+  GKFQ IS+KWFG+DVAT N+K
Sbjct: 240   ILLKNINSAFTKLYKTGKFQEISQKWFGEDVATENVK    276
```

An alignment of the GAS and GBS proteins is shown below.

```
Identities = 151/266 (56%), Positives = 189/266 (70%), Gaps = 4/266 (1%)
Query: 32   LLTIIFGLFMIILSACGMSNKEMAGIDNWEHYQKEKKITIGFDNTFVPMGFESRSGDYTG   91
            +L I    F++    AC  + K +   D W  YQK+K IT+GFDNTFVPMG++  SG   G
Sbjct: 10   ILAIASSFFLV---AC-QATKSLKSGDAWGVYQKQKSITVGFDNTFVPMGYKDESGRCKG   65

Query: 92   FDIDLANAVFKEYGISVKWQPINWDMKETELNNGNIDLIWNGYSKTAERAKKVAFTNPYM   151
            FDIDLA  VF +YG+ V +Q INWDMKE ELNNG ID+IWNGYS T ER  KVAFT+ YM
Sbjct: 66   FDIDLAKEVFHQYGLKVNFQAINWDMKEAELNNGKIDVIWNGYSITKERQDKVAFTDSYM   125

Query: 152  NNHQVIVTKTSSHINSIKDMKGKKLGAQSGSSGFDAFNAKPDILKKFVKGKEAVQYDTFT   211
              N Q+IV K  S I +I DMK K LGAQS SSG+D+      P +LK F+K K+A QY+TFT
Sbjct: 126  RNEQIIVVKKRSDIKTISDMKHKVLGAQSASSGYDSLLRTPKLLKDFIKNKDANQYETFT   185

Query: 212  QALIDLKNNRIDGLLIDEVYANYYLKQEGNIKAYYFVKTAYQGENFVVGARKVDRRLIEK   271
            QA IDLK++RIDG+LID+VYANYYL +EG ++ Y  + T ++ E F VG RK D+ L  K
Sbjct: 186  QAFIDLKSDRIDGILIDKVYANYYLAKEGQLENYRMIPTTFENEAFSVGLRKEDKTLQAK   245

Query: 272  INKAFKQLHNKGRFQKISYKWFGEDV                                     297
            IN+AF+ L+  G+FQ IS KWFG+DV
Sbjct: 246  INRAFRVLYQNGKFQAISEKWFGDDV                                     271
```

A related GBS gene <SEQ ID 8833> and protein <SEQ ID 8834> were also identified. Analysis of this protein sequence reveals the following:

Lipop Possible site: 22   Crend: 4
Sequence Pattern: CGMS
SRCFLG: 0
McG: Length of UR: 22
Peak Value of UR: 3.05
Net Charge of CR: 2
McG: Discrim Score: 11.16
GvH: Signal Score (−7.5): −1.96
Possible site: 24

-continued

>>> May be a lipoprotein
Amino Acid Composition: calculated from 23
ALOM program  count: 0  value: 8.96  threshold: 0.0
PERIPHERAL             Likelihood = 8.96                68
modified ALOM score: −2.29
*** Reasoning Step: 3
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>

The protein has homology with the following sequences in the databases:

```
62.2/75.8% over 270aa
Streptococcus uberis
GP|3603430| amino acid-binding protein Abp Insert characterized
ORF00904(385-1203 of 1503)
GP|3603430|gb|AAC35851.1||AF086736(4-274 of 277) amino acid-binding protein Abp
{Streptococcus uberis}
% Match = 34.8
% Identity = 62.1 % Similarity = 75.7
Matches = 169 Mismatches = 65 Conservative Sub.s = 37

153         183         213         243         273         303         333         363
FHYLGGKSNVSH*LVR**LIHRLLVMMSQLALLIQSCVKK*KN*FYKIEKQV*HKL**HMIFNLLKVYLIRFSKLILSRL 393         423         453         483         513         543         573         603
GGRLLTHKNILLTIIFGLFMIILSACGMSNKEMAGIDNWEHYQKEKKITIGFDNTFVPMGFESRSGDYTGFDIDLANAVF
             :  | |||| :       :  | ||| |:    |    | |: |:||| ||||||||||:  ||  ||||::|| |||
            MNLKKILLTTLALASTLFLVACGKSS--AAKTDQWDTYKKEKSITLGFDNTFVPMGFKDESGKNTGFDVELAKAVF
                       10          20          30          40          50          60          70

633         663         693         723         753         783         813         843
KEYGISVKWQPINWDMKETELNNGNIDLIWNGYSKTAERAKKVAFTNPYMNNHQVIVTKTSSHINSIKDMKGKKLGAQSG
:||||  ||:|||||| :|||||  ||  ||:||||||  ||  ||||: |||  ||  |  ||:||| ||:|  |||| ||||||
QEYGIKVKFQPINWDLKETELKNGKIDMIWNGYSVTKERQAKVAFSTPYMKNEQVLVTKKSSNITSFAAMKGKVLGAQSG
             90         100         110         120         130         140         150

873         903         933         963         993        1023        1053        1083
SSGFDAFNAKPDILKKFVKGKEAVQYDTFTQALIDLKNNRIDGLLIDEVYANYYLKQEGNIKAYYFVKTAYQGENFVVGA
|||:|||  :  :||   ||   :| :|:||  ||:|||||||:|||||||||||||:  |   ||: : ||: ||
SSGYDAFTSNPKVLKDIVKDNDATQYETFIQAFIDLKNDRIDGLLIDKVYANYYLKQEGELTNYNIVKSEFDGEDPAVGV
             170         180         190         200         210         220         230
```

```
1113        1143        1173        1203        1233        1263        1293        1323
RKVDRRLIEKINKAFKQLHNKGRFQKISYKWFGEDVYSKE*KTRNFS*SFILRKN*IKNIDISDVF*VN*PSLVARRALS
|| |: |:: || || :|:  |:||:||  ||||||| :: |
RKEDKILLKNINSAFTKLYKTGKFQEISQKWFGEDVATENVKK
         250        260        270
```

Figure 266:
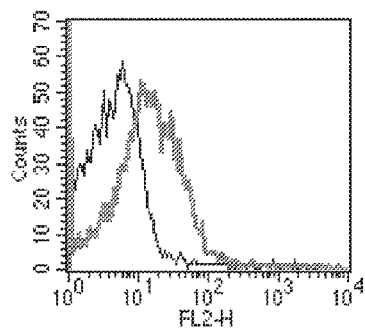

SEQ ID 8834 (GBS225) was expressed in E. coli as a His-fusion product. SDS-PAGE analysis of total cell extract is shown in FIG. 49 (lane 10; MW 32 kDa). The GBS225-His fusion product was purified (FIG. 205, lane 7) and used to immunise mice. The resulting antiserum was used for FACS (FIG. 266), which confirmed that the protein is immunoaccessible on GBS bacteria.

Based on this analysis, it was predicted that these proteins and their epitopes could be useful antigens for vaccines or diagnostics.

Example 1527

A DNA sequence (GBSx1618) was identified in S. agalactiae <SEQ ID 4701> which encodes the amino acid sequence <SEQ ID 4702>. This protein is predicted to be arginine ABC transporter, ATP-binding protein (glnQ). Analysis of this protein sequence reveals the following:

Possible site: 39
>>> Seems to have no N-terminal signal sequence
----- Final Results -----
   bacterial cytoplasm --- Certainty = 0.3229 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:AAB49429 GB:U73111 glutamine transport ATP-binding protein GLNQ
[Salmonella typhimurium]
Identities = 94/210 (44%), Positives = 146/210 (68%), Gaps = 3/210 (1%)
Query:   1  MLELKNISKCYGQKEIFKDFNLTVEEGKILSLVGPSGGGKTTLLRMLAGLEKIDSGTIVH    60
            M+E KN+SK +G   ++  + +L + +G+++ ++GPSG GK+TLLR +  LE+I SG ++
Sbjct:   1  MIEFKNVSKHFGPTQVLHNIDLNIRQGEVVVIIGPSGSGKSTLLRCINKLEEITSGDLIV   60

Query:  61  DGKEVS---VDHLETLNLLGFVFQDFQLFPHLTVLDNLILSPVKTMGLSKELAKEKALVL   117
            DG +V+   VD     G VFQ F LFPHLT L+N++  P++  G+ KE A+++A   L
Sbjct:  61  DGLKVNDPKVDERLIRQEAGMVFQQFYLFPHLTALENVMFGPLRVRGVKKEEAEKQAKAL  120

Query: 118  LERLGLKDHALVYPFSLSGGQKQRVALARAMMIDPQIIGYDEPTSALDPELRQEVEKLIL   177
            L ++GL + A  YP   LSGGQ+QRVA+ARA+ + P+++ +DEPTSALDPELR EV K++
Sbjct: 121  LAKVGLAERAHHYPSELSGGQQQRVAIARALAVKPKMMLFDEPTSALDPELRHEVLKVMQ  180

Query: 178  QNRETGMTQIVVTHDLQFAESISDTILKIN                                207
            + GMT ++VTH++ FAE ++  ++ I+
Sbjct: 181  DLAEEGMTMVIVTHEIGFAEKVASRLIFID                                210
```

A related DNA sequence was identified in S. pyogenes <SEQ ID 4703> which encodes the amino acid sequence <SEQ ID 4704>. Analysis of this protein sequence reveals the following:

Possible site: 39
>>> Seems to have no N-terminal signal sequence
----- Final Results -----
   bacterial cytoplasm --- Certainty = 0.2146 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 164/209 (78%), Positives = 183/209 (87%)
Query:   1  MLELKNISKCYGQKEIFKDFNLTVEEGKILSLVGPSGGGKTTLLRMLAGLEKIDSGTIVH    60
            MLELKNISK +GQK IF  FNLTV++G++LSLVGPS GGKTTLLRMLAGLE IDSG + +
Sbjct:   1  MLELKNISKQFGQKTIEDGFNLTVQDGEVLSLVGPSSGGKTTLLRMLAGLESIDSGQVFY   60

Query:  61  DGKEVSVDHLETLNLLGFVFQDFQLFPHLTVLDNLILSPVKTMGLSKELAKEKALVLLER  120
            +G++V +DHLE  NLLGFVFQDFQLFPHLTVLDNL SP  TMG K  AKEKAL LL R
Sbjct:  61  NGEDVGIDHLENRNLLGFVFQDFQLFPHLTVLDNLTLSPTITMGKQADAKEKALDLLAR  120

Query: 121  LGLKDHALVYPFSLSGGQKQRVALARAMMIDPQIIGYDEPTSALDPELRQEVEKLILQNR  180
            LGLK+HA VYP+SLSGGQKQRVALARAMMIDPQIIGYDEPTSALDPELRQ VE LI+QNR
Sbjct: 121  LGLKEHAQVYPYSLSGGQKQRVALARAMMIDPQIIGYDEPTSALDPELRQTVEALIVQNR  180
```

```
Query: 181 ETGMTQIVVTHDLQFAESISDTILKINPK                209
            E G+TQIVVTHDL FAE+ISD I+++NPK
Sbjct: 181 EMGITQIVVTHDLVFAEAISDRIIRVNPK                 209
```

Based on this analysis, it was predicted that these proteins and their epitopes could be useful antigens for vaccines or diagnostics.

Example 1528

A DNA sequence (GBSx1619) was identified in *S. agalactiae* <SEQ ID 4705> which encodes the amino acid sequence <SEQ ID 4706>. This protein is predicted to be amino acid ABC transporter, permease protein (glnP). Analysis of this protein sequence reveals the following:

Possible site: 16
>>> Seems to have a cleavable N-term signal seq.
INTEGRAL    Likelihood = −8.12   Transmembrane 102-118 (96-120)
----- Final Results -----
   bacterial membrane --- Certainty = 0.4248 (Affirmative) <succ>
      bacterial outside --- Certainty = 0.0000 (Not Clear) <succ>
         bacterial cytoplasm --- Certainty = 0.0000 (Not Clear) <succ>

A related GBS nucleic acid sequence <SEQ ID 9341> which encodes amino acid sequence <SEQ ID 9342> was also identified.

The protein has homology with the following sequences in the GENPEPT database.

A related DNA sequence was identified in *S. pyogenes* <SEQ ID 4707> which encodes the amino acid sequence <SEQ ID 4708>. Analysis of this protein sequence reveals the following:

Possible site: 34
>>> Seems to have no N-terminal signal sequence
INTEGRAL    Likelihood = −11.57   Transmembrane 21-37 (7-44)
INTEGRAL    Likelihood = −10.93   Transmembrane 185-201 (178-206)
INTEGRAL    Likelihood = −3.29    Transmembrane 63-79 (62-81)
----- Final Results -----
   bacterial membrane --- Certainty = 0.5628 (Affirmative) <succ>
      bacterial outside --- Certainty = 0.0000 (Not Clear) <succ>
         bacterial cytoplasm --- Certainty = 0.0000 (Not Clear) <succ>

```
>GP:BAA98402 GB:AP002545 ABC amino acid transporter permease
[Chlamydophila pneumoniae J138]
Identities = 55/127 (43%), Positives = 83/127 (65%), Gaps = 1/127 (0%)
Query:   3  AAIIAFTMNYAAYFAEIFRGGIESIPKGQYEAAKVLKFSKFQTVWYIVLPQVFKIVLPSV    62
            A IIA +MN AAY AE  RGGI S+  GQ+E+A VL + K+Q   YI+ PQVFK +LPS+
Sbjct:  89  AGIIALSMNSAAYLAENIRGGINSLSIGQWESAMVLGYKKYQIFVYIIYPQVFKNILPSL   148

Query:  63  FNETITLVKDSSLVYILGVGDLLLESKTAANRDATLAPMF-IAGGIYLLLIGLLTILSKQ   121
            NE ++L+K+SS++ ++GV +L   +K    +R+    M+ I  G+Y L+    + +S+
Sbjct: 149  TNEFVSLIKESSILMVVGVPELTKVTKDIVSRELNPMEMYLICAGLYFLMTSSFSCISRL   208

Query: 122  VEKRFNY                                                       128
            EKR +Y
Sbjct: 209  SEKRRSY                                                       215
```

The protein has homology with the following sequences in the databases:

```
>GP:BAB05181 GB:AP001512 ABC transporter (permease) [Bacillus halodurans]
Identities = 86/206 (41%), Positives = 126/206 (60%), Gaps = 1/206 (0%)
Query:   4  IQQVLPSLLDGALVTLQVFFIVIILSIPLGAILAFLMKIPFKPLQWFLTLYVWMMRGTPL    63
            IQ +P +L+G  VTLQ  + ++ +  LG +LA      ++ +WF  Y + RGTPL
Sbjct:   8  IQPFMPFMLEGVWVTLQFVSVSLLFGLVLGIVLAIFKISKYRLFRWFADFYTSIFRGTPL    67

Query:  64  LLQLIFFYYVLPSVGISFDRMPAAILAFTLNYAAYFAEIFRGGIEAIPKGQYEAAKVLKL   123
            +LQL+  Y  LP G+    +  AA LAF LN AAY +EI R GI+A+ KGQ EAA+ L +
Sbjct:  68  ILQLLMIYLALPQFGVDISQFQAAFLAFGLNSAAYVSEIIRAGIQAVDKGQREAAEALGI   127

Query: 124  KPLQTIRYIILPQVFKIVLPSVFNEVINLVKDSSLVYVLGVGDLL-LASKTAANRDATLA   182
                 + IILPQ  +LP++FNE INL K+S++V V+GV DL+    A  T+A      L
Sbjct: 128  PYRPMMLRIILPQAMRNILPALFNEFINLTKESAIVSVIGVTDLMRRAQITSAETYLYLE   187

Query: 183  PMFIAGLIYLLLIGLVTIISKQVEKR                                    208
            P+   GLIY +L+  +T+I +  +E+R
Sbjct: 188  PLLFVGLIYYVLVMGLTVIGRLLERR                                    213
```

An alignment of the GAS and GBS proteins is shown below.

```
Identities= 112/130 (86%), Positives = 121/130 (92%)
Query:   1   MPAAIIAFTMNYAAYFAEIFRGGIESIPKGQYEAAKVLKFPKFQTVWYIVLPQVFKIVLP    60
             MPAAI+AFT+NYAAYFAEIFRGGIE+IPKGQYEAAKVLK   QT+ YI+LPQVFKIVLP
Sbjct:  84   MPAAILAFTLNYAAYFAEIFRGGIEAIPKGQYEAAKVLKLKPLQTIRYIILPQVFKIVLP   143

Query:  61   SVFNETITLVKDSSLVYILGVGDLLLESKTAANRDATLAPMFIAGGIYLLLIGLLTILSK   120
             SVFNE I LVKDSSLVY+LGVGDLLL SKTAANRDATLAPMFIAG IYLLLIGL+TI+SK
Sbjct: 144   SVFNEVINLVKDSSLVYVLGVGDLLLASKTAANRDATLAPMFIAGLIYLLLIGLVTIISK   203

Query: 121   QVEKRFNYYK                                                   130
             QVEKRFNYY+
Sbjct: 204   QVEKRFNYYQ                                                   213
```

Based on this analysis, it was predicted that these proteins and their epitopes could be useful antigens for vaccines or diagnostics.

Example 1529

A DNA sequence (GBSx1620) was identified in S. agalactiae <SEQ ID 4709> which encodes the amino acid sequence <SEQ ID 4710>. This protein is predicted to be minidiscs. Analysis of this protein sequence reveals the following:

---

Possible site: 61
>>> Seems to have an uncleavable N-term signal seq
INTEGRAL    Likelihood = −9.66    Transmembrane 44-60 (39-66)
INTEGRAL    Likelihood = −7.96    Transmembrane 129-145 (123-147)
INTEGRAL    Likelihood = −5.15    Transmembrane 13-29 (9-33)
INTEGRAL    Likelihood = −2.39    Transmembrane 94-110 (94-110)
----- Final Results -----
   bacterial membrane --- Certainty = 0.4864 (Affirmative) <succ>
      bacterial outside --- Certainty = 0.0000 (Not Clear) <succ>
         bacterial cytoplasm --- Certainty = 0.0000 (Not Clear) <succ>

---

The protein has homology with the following sequences in the GENPEPT database.

```
>GP:AAF49688 GB:AE003532 mnd gene product [Drosophila melanogaster]
Identities = 48/145 (33%), Positives = 78/145 (53%), Gaps = 8/145 (5%)
Query:   7   IKQTYGLMTTIAMIVGVVIGSGIYFKVDDILKFTGGDVFLGMVILVLGSFSIVFGSLSIS    66
             +K+  GL+  +A+IVGV++GSGI+     +LKF+ G  +++ VL    + G+L  +
Sbjct:  39   LKKQIGLLDGVAIIVGVIVGSGIFVSPKGVLKFS-GSIGQSLIVWVLSGVLSMVGALCYA    97

Query:  67   ELAIRTSESGGIFSYYEKYVSPALAATLGLFASFLYL-PTLTAIVSWVAAFYTLGE----   121
             EL   +SGG ++Y     P L A L+ + L L PT AI +    A Y L
Sbjct:  98   ELGTMIPKSGGDYAYIGTAFGP-LPAFLYLWVALLILVPTGNAITALTFAIYLLKPFWPS   156

Query: 122   -SSSLESQIILAAVYILALSLMNIF                                    145
              + +E+  +LAA  I  L+L+N +
Sbjct: 157   CDAPIEAVQLLAAAMICVLTLINCY                                    181
```

No corresponding DNA sequence was identified in S. pyogenes.

Based on this analysis, it was predicted that this protein and its epitopes, could be useful antigens for vaccines or diagnostics.

Example 1530

A DNA sequence (GBSx1621) was identified in S. agalactiae <SEQ ID 4711> which encodes the amino acid sequence <SEQ ID 4712>. Analysis of this protein sequence reveals the following:

---

Possible site: 21
>>> Seems to have an uncleavable N-term signal seq
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>

---

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1531

A DNA sequence (GBSx1622) was identified in S. agalactiae <SEQ ID 4713> which encodes the amino acid sequence <SEQ ID 4714>. This protein is predicted to be TRK potassium uptake system protein. Analysis of this protein sequence reveals the following:

---

Possible site: 27
>>> Seems to have no N-terminal signal sequence
INTEGRAL    Likelihood = −0.06    Transmembrane 232-248 (232-248)
----- Final Results -----
   bacterial membrane --- Certainty = 0.1022 (Affirmative) <succ>
      bacterial outside --- Certainty = 0.0000 (Not Clear) <succ>
         bacterial cytoplasm --- Certainty = 0.0000 (Not Clear) <succ>

---

A related GBS nucleic acid sequence <SEQ ID 8835> which encodes amino acid sequence <SEQ ID 8836> was also identified. Analysis of this protein sequence reveals the following:

Lipop: Possible site: −1    Crend: 5
McG: Discrim Score: −4.65
GvH: Signal Score (−7.5): −3.64
Possible site: 27
>>> Seems to have no N-terminal signal sequence
ALOM program count: 1 value: −0.06 threshold: 0.0
INTEGRAL    Likelihood = −0.06    Transmembrane 228-244 (228-244)
PERIPHERAL    Likelihood = 1.27    428
modified ALOM score: 0.51

*** Reasoning Step: 3
----- Final Results -----
  bacterial membrane --- Certainty = 0.1022 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

```
>GP:AAB90401 GB:AE001046 TRK potassium uptake system protein
(trkA-2) [Archaeoglobus fulgidus]
Identities = 136/446 (30%), Positives = 238/446 (52%), Gaps = 12/446 (2%)
Query: 5    MRIIVVGGGKVGTALCRSLVAEKHDVVLIEKKENVLKRVTKQHDIMGIVGNGANYKILEQ     64
            MRI++ G G+VG  L  SL A  HDV++IEK +  +RV++  D++ I GN AN K+L
Sbjct: 1    MRIVIAGAGEVGYHLAMSL-APNHDVIIIEKDVSRFERVSEL-DVVAINGNAANMKVLRD    58

Query: 65   AEVKNCDIFIAITDRDEVNMISAVLAKKMGAKETVVRMRNPEYSNPYFKDKNFLGFSSVV    124
            A V+  D+F+A+T  DEVN++S + AKK+GAK +VR+ NPEY +     ++ LG+  ++
Sbjct: 59   AGVERADVFLAVTGNDEVNLLSGLAAKKVGAKNVIVRVENPEYVDRPIVKEHPLGYDVLI   118

Query: 125  NPELLAAQYIANTIEFPNATSVEHFANGRVMLMEFKILEGNKLCHTSMSQIRKKFGNIVI    184
               P+L  AQ  A  I  P  A V   F+  G+V ++E +++EG+K    +++  +    N+VI
Sbjct: 119  CPQLSLAQEAARLIGIPGAIEVVTFSGGKVEMIELQVMEGSKADGKAIADLYLP-QNVVI   177

Query: 185  CAIERDGKLIIPDGDATIQVKDKIFVTGNRIEMILFHNYVENKVVKNLMVIGAGRIAYYL    244
             +I R+G + IP GD ++  D++ +       ++  +             V + + + GAG I Y
Sbjct: 178  ASIYRNGHIEIPRGDTVLRAGDRVAIVSKTEDVEMLKGIFGPPVTRRVTIFGAGTIGSYT   237

Query: 245  LNILKNTNTHVKLVELNQEQAEYFSQEFPNVPVVHGDGTAKNILLEESVTSFDAVATLTG    304
                  IL    T VKL+E + E+  E S E     V +V GD T    L+EE+    DAV   T
Sbjct: 238  AKILAKGMTSVKLIESSMERCEALSGELEGVRIVCGDATDIEFLIEEEIGKSDAVLAATE   297

Query: 305  VDEENIITSMFLESIGIPKNITKVNRTSLLEIIDDKQLSSIITPKRIAVDHVMHFVRGRV    364
             DE+N++ S+   +++G    I KV +  +++ +  +   +   + P+ +    + V   +R
Sbjct: 298  SDEKNLLISLLSKNLGARIAIAKVEKREYVKLFEAVGVDVALNPRSVTYNEVSKLLR---   354

Query: 365  NAQDSNLEAMHHIANDRIETLQFEIKETSKLANRSLASLKLKQNILIAAIIRNNKTIFPT    424
                +E + I    +  +    ++L  ++L  L L ++ +I AI+R  N+ +  P
Sbjct: 355  ---TMRIETLAEIEGTAVVEV---VVRNTRLVGKALKDLPLPKDAIIGAIVRGNECLIPR   408

Query: 425  GEDVLTVGDRIVVITLLKNITRTSDM    450
            G+  +    DR++V  I +  ++
Sbjct: 409  GDTTIEYEDRLLVFAKWDEIEKIEEI    434

Identities = 48/212 (22%), Positives = 99/212 (46%), Gaps = 15/212 (7%)
Query: 3    VKMRIIVVGGGKVGTALCRSLVAEKHDVVLIEKKENVLKRVTKQHDIMGIV-GNGANYKI     61
            V  R+ + G G +G+      + L    V LIE      + ++ + + IV G+   +
Sbjct: 221  VTRRVTIFGAGTIGSYTAKILAKGMTSVKLIESSMERCEALSGELEGVRIVCGDATDIEF   280

Query: 62   LEQAEVKNCDIFIAITDRDEVNMISAVLAKKMGAKETVVRMRNPEYSNPYFKDKNFLGFS    121
            L + E+   D  +A T+ DE N++ ++L+K +GA+      + ++   EY    +    +G
Sbjct: 281  LIEEEIGKSDAVLAATESDEKNLLISLLSKNLGARIAIAEVEKREYVKLF----EAVGVD   336

Query: 122  SVVNPELLAAQYIA---NTIEFPNATSVEHFANGRVMLMEFKILEGNKLCHTSMSQIRKK    178
            +  +NP +  +  ++    T+        +E A V++      +++ G L    + +
Sbjct: 337  VAINPRSVTYNEVSKLLRTMRIETLAEIEGTAVVEVVVRNTRLV-GKALKDLPLPK----   391

Query: 179  FGNIVICAIERDGKLIIPDGDATIQVKDKIFV    210
              + +I AI R   + +IP GD TI+ +D++ V
Sbjct: 392  --DAIIGAIVRGNECLIPRGDTTIEYEDRLLV    421
```

There is also homology to SEQ ID 4716.

SEQ ID 8836 (GBS384) was expressed in *E. coli* as a His-fusion product. SDS-PAGE analysis of total cell extract is shown in FIG. 69 (lane 2; MW 53 kDa). It was also expressed in *E. coli* as a GST-fusion product. SDS-PAGE analysis of total cell extract is shown in FIG. 72 (lane 6; MW 78 kDa).

Figure 279:
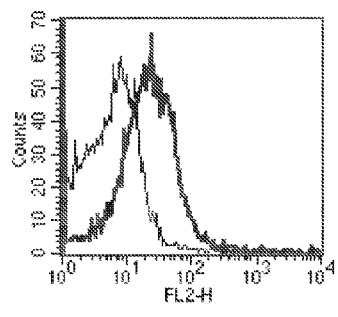

The GBS384-GST fusion product was purified (FIG. 212, lane 9) and used to immunise mice. The resulting antiserum was used for FACS (FIG. 279), which confirmed that the protein is immunoaccessible on GBS bacteria.

Based on this analysis, it was predicted that this protein and its epitopes, could be useful antigens for vaccines or diagnostics.

Example 1532

A DNA sequence (GBSx1623) was identified in *S. agalactiae* <SEQ ID 4717> which encodes the amino acid sequence <SEQ ID 4718>. Analysis of this protein sequence reveals the following:

---
Possible site: 52
>>> Seems to have no N-terminal signal sequence
----- Final Results -----
   bacterial cytoplasm --- Certainty = 0.4948 (Affirmative) <succ>
    bacterial membrane --- Certainty = 0.0000 (Not Clear) <succ>
     bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1533

A DNA sequence (GBSx1624) was identified in *S. agalactiae* <SEQ ID 4719> which encodes the amino acid sequence <SEQ ID 4720>. Analysis of this protein sequence reveals the following:

---
Possible site: 22
>>> Seems to have an uncleavable N-term signal seq
  INTEGRAL   Likelihood = -12.58   Transmembrane 37-53 (33-61)
  INTEGRAL   Likelihood = -11.57   Transmembrane 183-199 (179-214)
  INTEGRAL   Likelihood = -10.03   Transmembrane 397-413 (392-424)
  INTEGRAL   Likelihood = -6.79   Transmembrane 14-30 (5-31)
  INTEGRAL   Likelihood = -6.42   Transmembrane 71-87 (69-93)
  INTEGRAL   Likelihood = -4.99   Transmembrane 278-294 (274-295)
  INTEGRAL   Likelihood = -4.19   Transmembrane 133-149 (132-152)
  INTEGRAL   Likelihood = -4.09   Transmembrane 327-343 (324-344)
  INTEGRAL   Likelihood = -2.44   Transmembrane 236-252 (234-252)
  INTEGRAL   Likelihood = -0.59   Transmembrane 456-472 (456-472)
----- Final Results -----
    bacterial membrane --- Certainty = 0.6031 (Affirmative) <succ>
     bacterial outside --- Certainty = 0.0000 (Not Clear) <succ>
   bacterial cytoplasm --- Certainty = 0.0000 (Not Clear) <succ>

---

A related GBS nucleic acid sequence <SEQ ID 10065> which encodes amino acid sequence <SEQ ID 10066> was also identified.

The protein has homology with the following sequences in the GENPEPT database.

```
>GP:AAB90400 GB:AE001046 TRK potassium uptake system protein (trkH)
[Archaeoglobus fulgidus]
Identities = 166/480 (34%), Positives = 262/480 (54%), Gaps = 10/480 (2%)
Query:   1  MNKSMIRFLLSKLLLIEAALLAIPLTVGLIYREP-QSVMMSIVITMIILIILGLLGSLFK   59
            MN +    +L KLL++ +    +PL    ++ EP    ++    +++++  +LG  G   +
Sbjct:   1  MNLRLTASILGKLLMLFSFSFILPLIAAHVFEEPYHPFLIPAALSLLVGAVLGY-GIKTE   59

Query:  60  PKNYHIYTKEGMLIVALCWILWSFFGALPFVISGQIPNIIDAFFEVSSGFTITGATILDD  119
             +   +   KE    IVAL W+  S FG++P++I G  P  +DAFFE  SGFTTTGA++L
Sbjct:  60  SEFDSLRHKESFAIVALIWLFMSIFGSIPYIIFGISP--VDAFFESMSGFTTTGASVLTP  117

Query: 120  VSVLSPALLFWRSFTHLIGGMGVLVFALAIMENSKNSHLEVMRAEVPGPVFGKVVSKLKK  179
                L  +LL WRS T   IGGMG++V  LAI  N        + +AE PG     K+  +++
Sbjct: 118  EE-LPKSLLLWRSLTQWIGGMGIIVLFLAIFPNVAKRSTVLFQAEYPGVSLSKLKPRIRD  176

Query: 180  TAQILYLLYLLMFAVFAVILYFAGMPFFDSIIIAMGTAGTGGFAVYNDSIAHYNSPLITN  239
            TA  LY  +YLL+       +LY  G+     FD+I         T  TGG++  +++SIA +        +
Sbjct: 177  TALSLYKVYLLLTIAEVALLYALGLSLFDAINHTFTTLSTGGYSTHSESIAFFKDVRVEA  236

Query: 240  LVSIGMLIFGVNFNLYYLLLLRKIKAFFGDEELKTYLRIVAIATFMIALNVIGMYDNFRQ  299
             +V+      + G NF L Y LL     K     F + E +  Y+      +A+A+  +IA       +    Y  F +
Sbjct: 237  VVAFFAFLGGANFALIYFLLSGK-PVIFRNTEFRAYVCFLALASVVIAAVNLDRYSIF-E  294

Query: 300  GLEHIFFEVSAIITTTGFGVTDITRWPLFSQVILLFLMFIGGSAGSTAGGFKVMRSLILA  359
              L +   F+    +I+TTTGF          D     W    +++IL+  LMFIGGS+GST  GG  KV+R    +L
Sbjct: 295  SLRYSIFQAVSIMITTGFITADFDAWSDSAKLILVVLMFIGGSSGSTGGGIKVIRIYLLI  354

Query: 360  KIARNQVLSTLYPNRVMSLHINKSVLDKNTQHGVLKYLTIYLAIFMALVLVLTLDINDFL  419
             K A  +Q+L      P  V ++       +  K        + +Y++  IF       ++++L     D +
Sbjct: 355  KYAVHQILRAAEPRTVRAVEFEGRAIKKEILDDIAAFFVLYILIFAVSSILVSLSGYDIV  414

Query: 420  VVISAAASCFNNIGP---LLGSNETFSFFSPFSKLLLSFAMIAGRLEIYPVLLMFIPKTW  476
              ISA A+       N+GP      L G+ E ++ F     +K+LL+  M   GRLEI+  V+ +FIP   W
Sbjct: 415  TSISATAATLGNVGPGLGLAGAAENYASFPSLTKILLAVNMWIGRLEIFTVVSLFIPTFW  474
```

No corresponding DNA sequence was identified in *S. pyogenes*.

Based on this analysis, it was predicted that this protein and its epitopes, could be useful antigens for vaccines or diagnostics.

Example 1534

A DNA sequence (GBSx1625) was identified in *S. agalactiae* <SEQ ID 4721> which encodes the amino acid sequence <SEQ ID 4722>. Analysis of this protein sequence reveals the following:

```
Possible site: 22
>>> Seems to have no N-terminal signal sequence (or as 1-20)
----- Final Results -----
    bacterial cytoplasm --- Certainty = 0.2870 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP:AAD36530 GB:AE001797 conserved hypothetical protein
[Thermotoga maritima]
Identities = 43/75 (57%), Positives = 57/75 (75%), Gaps = 1/75 (1%)
Query: 2   LKSFLIFLVRFYQKNISPAFPASCRYRPTCSTYMIEAIQKHG-LKGVLMGIARILRCHPL 60
           +K  LI L+RFYQ+ ISP  P +CR+ PTCS Y I+A++KHG LKG  +G+ RILRC+PL
Sbjct: 1   MKKLLIMLIRFYQRYISPLKPPTCRFTPTCSNYFIQALEKHGLLKGTFLGLRRILRCNPL 60

Query: 61  AHGGNDPVPDHFSLR                                              75
           + GG DPVP+ FS +
Sbjct: 61  SKGGYDPVPEEFSFK                                              75
```

A related DNA sequence was identified in *S. pyogenes* <SEQ ID 4723> which encodes the amino acid sequence <SEQ ID 4724>. Analysis of this protein sequence reveals the following:

```
Possible site: 38
>>> Seems to have no N-terminal signal sequence
----- Final Results -----
    bacterial cytoplasm --- Certainty = 0.3639 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
Identities = 53/78 (67%), Positives = 60/78 (75%)
Query: 1   MLKSFLIFLVRFYQKNISPAFPASCRYRPTCSTYMIEAIQKHGLKGVLMGIARILRCHPL 60
           M+K  LI  V+ YQK ISP  P SCRY+PTCS YM+ AI+KHG KG+LMGIARILRCHP
Sbjct: 1   MMKKLLIVSVKAYQKYISPLSPPSCRYKPTCSAYMLTAIEKHGTKGILMGIARILRCHPF 60

Query: 61  AHGGNDPVPDHFSLRRNK                                           78
            GG DPVP+ FSL RNK
Sbjct: 61  VAGGVDPVPEDFSLMRNK                                           78
```

SEQ ID 4722 (GBS233) was expressed in *E. coli* as a GST-fusion product. SDS-PAGE analysis of total cell extract is shown in FIG. 58 (lane 3; MW 35.6 kDa).

Figure 280:
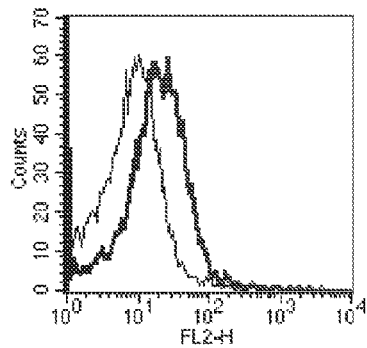

The GBS233-GST fusion product was purified (FIG. 207, lane 10) and used to immunise mice. The resulting antiserum was used for FACS (FIG. 280), which confirmed that the protein is immunoaccessible on GBS bacteria.

Based on this analysis, it was predicted that these proteins and their epitopes could be useful antigens for vaccines or diagnostics.

Example 1535

A DNA sequence (GBSx1626) was identified in *S. agalactiae* <SEQ ID 4725> which encodes the amino acid sequence <SEQ ID 4726>. This protein is predicted to be ribosomal large subunit pseudouridine synthase B (rluB). Analysis of this protein sequence reveals the following:

```
Possible site: 18
>>> Seems to have no N-terminal signal sequence
----- Final Results -----
    bacterial cytoplasm --- Certainty = 0.2957 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP:BAB05295 GB:AP001512 pseudouridylate synthase [Bacillus halodurans]
Identities = 130/239 (54%), Positives = 175/239 (72%), Gaps = 2/239 (0%)
```

```
                          -continued
Query: 2    RINKYIAHAGIASRRKAEELIKQGMVTINGQVVNELATQVKAG-DLVEIEGSPIYNEEKV    60
            R+ K IA AGIASRRKAE+LI +G V +NGQVV EL  +V   D +E+EG P+  EE V
Sbjct: 3    RLQKVIAQAGIASRRKAEQLILEGKVKVNGQVVEELGIKVNPNQDDIEVEGVPVEKEEPV    62

Query: 61   YYLLNKPRGVISSVSDDKGRKTVIDLLPQVKERIYPVGRLDWDTTGLLILTNDGDFTDKM   120
            Y+LL KP GVISSV DDKGRK V D L ++++R+YPVGRLD+DT+GLL+LTNDG+F + +
Sbjct: 63   YFLLYKPTGVISSVKDDKGRKVVTDFL-EIEQRVYPVGRLDYDTSGLLLLTNDGEFANLL   121

Query: 121  IHPRNEIDKVYLARVKGIATKENLRPLTRGVVIDGKKTKPARYTIIKVDHEKNRSVVELT   180
            +HPR++I+KVY+A+VKGI T++ L+ L RGV ++    T PA+  ++ VD  K   ++V+LT
Sbjct: 122  MHPRHKIEKVYVAKVKGIPTRDQLKLLARGVKLEDGPTAPAKVKMLSVDRRKQTAIVKLT   181

Query: 181  IHEGRNHQVKKMFEQVGLLVDKLSRTQFGTLDLTGLRPGEARRLNKKEISQLHNAAINK   239
            IHEGRN QV++MFE +G  V KL R QF  LDL+G+ PG+ R L   E+  L   A+ K
Sbjct: 182  IHEGRNRQVRRMFETIGCEVMKLKREQFAFLDLSGMNPGDVRPLKPIEVKHLRELAVTK   240
```

A related DNA sequence was identified in *S. pyogenes* <SEQ ID 4727> which encodes the amino acid sequence <SEQ ID 4728>. Analysis of this protein sequence reveals the following:

Possible site: 18
>>> Seems to have no N-terminal signal sequence
----- Final Results -----
bacterial cytoplasm --- Certainty = 0.1587 (Affirmative) <succ>
bacterial membrane --- Certainty = 0.0000 (Not Clear) <succ>
bacterial outside --- Certainty = 0.0000 (Not Clear) <succ>

Possible site: 15
>>> Seems to have no N-terminal signal sequence
----- Final Results -----
bacterial cytoplasm --- Certainty = 0.1476 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

The protein has homology with the following sequences in the GENPEPT database.

```
Identities = 210/239 (87%), Positives = 228/239 (94%)
Query: 1    MRINKYIAHAGIASRRKAEELIKQGMVTINGQVVNELATQVKAGDLVEIEGSPIYNEEKV    60
            MRINKYIAHAGIASRRKAEELIKQG+VT+NGQV+ +LAT VK+GD+VEIEGSPIYNEEKV
Sbjct: 9    MRINKYIAHAGIASRRKAEELIKQGLVTLNGQVITDLATTVKSGDVVEIEGSPIYNEEKV    68

Query: 61   YYLLNKPRGVISSVSDDKGRKTVIDLLPQVKERIYPVGRLDWDTTGLLILTNDGDFTDKM   120
            YYLLNKPRG ISSVSDDKGRKTV+DLLPQVKERIYPVGRLDWDT+G+LILTNDGDFTD M
Sbjct: 69   YYLLNKPRGAISSVSDDKGRKTVLDLLPQVKERIYPVGRLDWDTSGVLILTNDGDFTDTM   128

Query: 121  IHPRNEIDKVYLARVKGIATKENLRPLTRGVVIDGKKTKPARYTIIKVDHEKNRSVVELT   180
            IHPRNEIDKVYLARVKGIATKENLRPLTRG+VIDGKKTKPARY I++V+ +K+RS+VELT
Sbjct: 129  IHPRNEIDKVYLARVKGIATKENLRPLTRGIVIDGKKTKPARYNIVRVEADKSRSIVELT   188

Query: 181  IHEGRNHQVKKMFEQVGLLVDKLSRTQFGTLDLTGLRPGEARRINKKEISQLHNAAINK   239
            IHEGRNHQVKKMFE VGLLVDKLSRT+FGT+DL GLRPGEARRLNKKEISQLHN A  K
Sbjct: 189  IHEGRNHQVKKMFESVGLLVDKLSRTRFGTVDLKGLRPGEARRLNKKEISQLHNLANTK   247
```

Based on this analysis, it was predicted that these proteins and their epitopes could be useful antigens for vaccines or diagnostics.

Example 1536

A DNA sequence (GBSx1627) was identified in *S. agalactiae* <SEQ ID 4729> which encodes the amino acid sequence <SEQ ID 4730>. Analysis of this protein sequence reveals the following:

```
>GP:BAB05280 GB:AP001512 unknown conserved protein [Bacillus halodurans]
Identities = 75/180 (41%), Positives = 107/180 (58%), Gaps = 10/180 (5%)
Query: 6    SIEALLFVAGEDGLSLRQMAELLSLTPSALIQQLEKLAKRYEEDDDSSLLLLETAQTYKL    65
            +IE +LFV G++G++L ++ +LL L+  +    LE+L  Y D+   L + E A  ++L
Sbjct: 9    AIEGILFVRGDEGVTLEELCDLLELSTDVVYAALEELRLSYT-DEARGLRIEEVAHAFRL    67

Query: 66   VTKDSYMTLLRDYAKAPINQSLSRASLEVLSIIAYKQPITRIEIDDIRGVNSSGAITRLI   125
            TK     + A + +   LS+A+LE L+IIAY+QPITRIE+D++RGV S   AI   L
Sbjct: 68   STKPELAPYFKKLALSTLQSGLSQAALETLAIIAYRQPITRIEVDEVRGVYSEKAIQTLT   127
```

```
Query: 126  AFGLIKEAGKKEVLGRPNLYETTNYFLDYMGINQLDDL------IDASSIELVDEEVSLF   179
            +  LIKE G+ + GRP LY  TT FLD+ G+  L +L      ID SSI    EE  LF
Sbjct: 128  SRLLIKEVGRAQGTGRPILYGTTPQFLDHFGLKSLKELPPLPEDIDESSI---GEEADLF   184
```

A related DNA sequence was identified in *S. pyogenes* <SEQ ID 4731> which encodes the amino acid sequence <SEQ ID 4732>. Analysis of this protein sequence reveals the following:

Possible site: 31
>>> Seems to have no N-terminal signal sequence
----- Final Results -----
   bacterial cytoplasm --- Certainty = 0.1062 (Affirmative) <succ>
    bacterial membrane --- Certainty = 0.0000 (Not Clear) <succ>
     bacterial outside --- Certainty = 0.0000 (Not Clear) <succ>

Possible site: 47
>>> Seems to have no N-terminal signal sequence
----- Final Results -----
   bacterial cytoplasm --- Certainty = 0.1012 (Affirmative) <succ>
   bacterial membrane --- Certainty = 0.0000 (Not Clear) <succ>
    bacterial outside --- Certainty = 0.0000 (Not Clear) <succ>

An alignment of the GAS and GBS proteins is shown below.

The protein has homology with the following sequences in the GENPEPT database.

```
Identities = 130/179 (72%), Positives = 159/179 (88%)
Query: 1    MTYLGSIEALLFVAGEDGLSRQMAELLSLTPSALIQQLEKLAKRYEEDDDSSLLLLETA    60
            MTYL  IEALLFVAGE+GLSLR +A +LSLTP+AL QQLEKL+++YE+D  SSL L+ETA
Sbjct: 1    MTYLSQIEALLFVAGEEGLSLRHLASMLSLTPTALQQQLEKLSQKYEKDQHSSLCLIETA    60

Query: 61   QTYKLVTKDSYMTLLRDYAKAPINQSLSRASLEVLSIIAYKQPITRIEIDDIRGVNSSGA   120
              TY+LVTK+ +  LLR YAK P+NQSLSRASLEVLSI+AYKQPITRIEIDDIRGVNSSGA
Sbjct: 61   NTYRLVTKEGFAELLRAYAKTPMNQSLSRASLEVLSIVAYKQPITRIEIDDIRGVNSSGA   120

Query: 121  ITRLIAFGLIKEAGKKEVLGRPNLYETTNYFLDYMGINQLDDLIDASSIELVDEEVSLF   179
            +++L+AF LI+EAGKK+V+GRP+LY TT+YFLDYMGIN LD+LI+ S++E  DEE++LF
Sbjct: 121  LSKLLAFDLIREAGKKDVVGRPHLYATTDYFLDYMGINHLDELIEVSAVEPADEEIALF   179
```

Based on this analysis, it was predicted that these proteins and their epitopes could be useful antigens for vaccines or diagnostics.

Example 1537

A DNA sequence (GBSx1628) was identified in *S. agalactiae* <SEQ ID 4733> which encodes the amino acid sequence <SEQ ID 4734>. Analysis of this protein sequence reveals the following:

```
>GP:CAB14254 GB:Z99116 similar to hypothetical proteins [Bacillus subtilis]
Identities = 89/246 (36%), Positives = 145/246 (58%), Gaps = 19/246 (7%)
Query:    3  IKLKDFEGPLDLLLHLVSKYEVDIYDVPIVEVIEQYLAYIATLQAMRLEVAGEYMLMASQ    62
             +K+  FEGPLDLLLHL+++ E+DIYD+P+ ++ EQYL Y+ T++ + L++A EY++MA+
Sbjct:    6  VKIDTFEGPLDLLLHLINRLEIDIYDIPVAKITEQYLLVHTMRVLELDIASEYLVMAAT    65

Query:   63  LMLIKSRNLLPK----VVESNPI-EDDPEMELLSQLEEYRRFKVLSEELANQHQERAKYF   117
             L+ IKSR LLPK     + E   + E+DP  EL+ +L EYR++K    +++L   +ER K F
Sbjct:   66  LLSIKSRMLLPKQEEELFEDELLEEEDPREELIEKLIEYRKYKDAAKDLKEREEERQKSF   125

Query:  118  SKPKQEVIFEDAILLHDKSVMDLFLTFSQMMSQKQKELSNS------QTVIEKEDYRIED   171
             +KP  ++  +   +S  L +T  M+  QK L          +T I ++D  IE
Sbjct:  126  TKPPSDL--SEYAKEVKQSEQKLSVTVYDMIGAFQKVLKRKKINRPMETTITRQDIPIEA   183

Query:  172  MMIVIERHFNLKKKTT---LQEVFADCQTKSEMITLFLAMLELIKLHQITVEQDSNFSQV   228
              M  I    +LK + T    ++F   + K  ++ FLA+LEL+K  +  +EQ+ NFS +
Sbjct:  184  RMNEIVH--SLKSRGTRINFMDLF-PYEQKEHLVVTFLAVLELMKNQLVLIEQEHNFSDI   240

Query:  229  ILRKEE                                                        234
             +   E
Sbjct:  241  YITGSE                                                        246
```

A related DNA sequence was identified in *S. pyogenes* <SEQ ID 4735> which encodes the amino acid sequence <SEQ ID 4736>. Analysis of this protein sequence reveals the following:

Possible site: 60
>>> Seems to have no N-terminal signal sequence
INTEGRAL    Likelihood = −3.61    Transmembrane 199-215 (199-218)
----- Final Results -----
  bacterial membrane --- Certainty = 0.2444 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the databases:

```
>GP:CAB14254 GB:Z99116 similar to hypothetical proteins [Bacillus subtilis]
Identities = 86/239 (35%), Positives = 145/239 (59%), Gaps = 15/239 (6%)
Query:    3 IKLKDFEGPLDLLLHLVSQYKVDIYEVPIVEVIEQYLNYIETLQVMKLEVAGDYMLMASQ   62
            +K+  FEGPLDLLLHL+++ ++DIY++P+ ++ EQYL Y+ T++V++L++A +Y++MA+
Sbjct:    6 VKIDTFEGPLDLLLHLINRLEIDIYDIPVAKITEQYLLYVHTMRVLELDIASEYLVMAAT   65

Query:   63 LMLIKSRRLLPKVVEHI-------EEDLEQDLLEKIEEYSRFKAVSQALAKQHDQRAKWY  115
            L+ IKSR LLPK  E +        EED ++L+EK+ EY ++K  ++ L ++ ++R K +
Sbjct:   66 LLSIKSRMLLPKQEEELFEDELLEEEDPREELIEKLIEYRKYKDAAKDLKEREEERQKSF  125

Query:  116 SKPKQELI-FEDAILQEDK----TVMDLFLAFSNIMAAKRAVLKNNHTVIERDDYKIEDM  170
            +KP  +L +   + Q ++    TV D+ AF ++  K+ + +   T I R D  IE
Sbjct:  126 TKPPSDLSEYAKEVKQSEQKLSVTVYDMIGAFQKVLKRKK-INRPMETTITRQDIPIEAR  184

Query:  171 MASIKQRLEKENV-IRLSAIFEECQTLNEVISIFLASLELIKLHVVFVEQLSNFGAIIL   228
            M  I   L+    I   +F   Q  + V++ FLA LEL+K  +V +EQ  NF   I +
Sbjct:  185 MNEIVHSLKSRGTRINFMDLFPYEQKEHLVVT-PLAVLELMKNQLVLIEQEHNFSDIYI   242
```

An alignment of the GAS and GBS proteins is shown below.

```
Identities = 156/235 (66%), Positives = 191/235 (80%), Gaps = 2/235 (0%)
Query:    1 MDIKLKDFEGPLDLLLLHLVSKYEVDIYDVPIVEVIEQYLAYIATLQAMRLEVAGEYMLMA    60
            MDIKLKDFEGPLDLLLHLVS+Y+VDIY+VPIVEVIEQYL YI TLQ M+LEVAG+YMLMA
Sbjct:    1 MDIKLKDFEGPLDLLLHLVSQYKVDIYEVPIVEVIEQYLNYIETLQVMKLEVAGDYMLMA    60

Query:   61 SQLMLIKSRNLLPKVVESNPIEDDPEMELLSQLEEYRREKVLSEELANQHQERAKYFSKP  120
            SQLMLIKSR LLPKVVE    IE+D E +LL ++EEY RFK +S+ LA QH +RAK++SKP
Sbjct:   61 SQLMLIKSRRLLPKVVEH--IEEDLEQDLLEKIEEYSRFKAVSQALAKQHDQRAKWYSKP  118

Query:  121 KQEVIFEDAILLHDKSVMDLFLTFSQMMSQKQKELSNSQTVIEKEDYRIEDMMIVIERHF  180
            KQE+IFEDAIL  DK+VMDLFL FS +M+ K+   L N+ TVIE++DY+IEDMM  I++
Sbjct:  119 KQELIFEDAILQEDKTVMDLFLAFSNIMAAKRAVLKNNHTVIERDDYKIEDMMASIKQRL  178

Query:  181 NLKKKTTLQEVFADCQTKSEMITLFLAMLELIKLHQITVEQDSNESQVILRKEEK       235
            +    L +F +CQT +E+I++FLA LELIKLH + VEQ SNF   +ILRKE+K
Sbjct:  179 EKENVIRLSAIFEECQTLNEVISIFLASLELIKLHVVFVEQLSNFGAIILRKEKK       233
```

Based on this analysis, it was predicted that these proteins and their epitopes could be useful antigens for vaccines or diagnostics.

Example 1538

A DNA sequence (GBSx1629) was identified in *S. agalactiae* <SEQ ID 4737> which encodes the amino acid sequence <SEQ ID 4738>. This protein is predicted to be pXO1-18. Analysis of this protein sequence reveals the following:

Possible site: 15
>>> Seems to have no N-terminal signal sequence
INTEGRAL    Likelihood = −4.14    Transmembrane 128-144 (127-145)
----- Final Results -----
  bacterial membrane --- Certainty = 0.2657 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the GENPEPT database.

```
>GP:BAB05248 GB:AP001512 integrase/recombinase [Bacillus halodurans]
Identities = 67/271 (24%), Positives = 117/271 (42%), Gaps = 35/271 (12%)
Query:   11 LKTMINDINNFIESKK----LSLNSRKSYHYDLKQFYKII--------GGHVNSEKLALY    58
            ++T+ N++  F+  +K    LS N+ +SY  DLKQ+ + +              ++ E + Y
Sbjct:    1 METVNNNLQQFLHFQKVERGLSNNTIQSYGRDLKQYIQYVERVEEIRSARNITRETILHY    60

Query:   59 QQSLSEFKL--TARKRKLSAVNQFLFFLYNRGTLKEFYRL-----QETEKITLAQTKSQI   111
```

```
                    L E      T+   R ++A+    F   FL             +       + T+++  A T   ++
Sbjct:   61  LYHLREQGRAETSIARAVAAIRSFHQFLLREKLSDSDPTVHVEIPKATKRLPKALTIEEV  120

Query:  112  MDLSNFYQDTDYPSGRLIALLIL--SLGLTPAEIANLKKADFDTTFNILS-IEKSQMKRI  168
                L  N    Q   D   SR   A+L L   + G+  +E+  L  +D    +    + K   +RI
Sbjct:  121  EALLNSPQGRDPFSLRNKAMLELLYATGMRVSELIGLTLSDIHLSMGFVRCLGKGNKERI  180

Query:  169  LKLPEDLLPFLLESLEEDG---------DLVF-EHNGKPYSRQWFFNQLTDFLNEKN-E  216
                + + + +    +ES   +G              D VF  H+G+P SRQ F+  L          N +
Sbjct:  181  IPIGQ-VATEAVESYLANGRGKLMKKQSHDHVFVNHHGRPLSRQGFWKMLKQLAKNVNID  239

Query:  217  QQLTAQLLREQFILKQKENGKTMTELSRLLG                              247
                + LT    LR  F       ENG  +  +  +LG
Sbjct:  240  KPLTPHTLRHSFATHLLENGADLRAVQEMLG                              270
```

A related DNA sequence was identified in *S. pyogenes* <SEQ ID 4739> which encodes the amino acid sequence <SEQ ID 4740>. Analysis of this protein sequence reveals the following:

---

Possible site: 20
>>> Seems to have no N-terminal signal sequence
INTEGRAL     Likelihood = –0.90     Transmembrane 111-127 (110-127)
----- Final Results -----
   bacterial membrane --- Certainty = 0.1362 (Affirmative) <succ>
      bacterial outside --- Certainty = 0.0000 (Not Clear) <succ>
         bacterial cytoplasm --- Certainty = 0.0000 (Not Clear) <succ>

---

The protein has no significant homology with any sequences in the GENPEPT database.

An alignment of the GAS and GBS proteins is shown below.

```
Identities = 117/243 (48%), Positives = 167/243 (68%), Gaps = 1/243 (0%)
Query:   18  INNFIESKKLSLNSRKSYHYDLKQFYKIIGGHVNSEKLALYQQSLSEFKLTARKRKLSAV   77
              I  FI SK LS NS+K+Y YDL+QF ++IG  VN +KL LYQ S++    L+A+KRKLS
Sbjct:    5  IEPFIASKALSQNSQKAYRYDLQQFCQLIGERVNQDKLLLYQNSIANLSLSAKKRKLSTA   64

Query:   78  NQFLFFLYNRGTLKEFYRLQETEKITLAQTK-SQIMDLSNFYQDTDYPSGRLIALLILSL  136
              NQFL++LY     L   ++RL +T K+    + + + I++    FYQ T  +  G+LI+LLIL  L
Sbjct:   65  NQFLYYLYQIKYLNSYFRLTDTMKVMRTEKQQAAIINTDIFYQKTPFVWGQLISLLILEL  124

Query:  137  GLTPAEIANLKKADFDTTFNILSIEKSQMKRILKLPEDLLPFLLESLEEDGDLVFEHNGK  196
              GLTP+E+A ++ A+  D   F  +L+++    +   R+L  L  + L+PFL  +  L         +FEH  G
Sbjct:  125  GLTPSEVAGIEVANLDLNFQMLTLKTKKGVRVLPLSQILIPFLEQQLVGKEVYLFEHRGI  184

Query:  197  PYSRQWFFNQLTDFLNEKNEQQLTAQLLREQFILKQKENGKTMTELSRLLGLKTPITLER  256
              P+SRQWFFN  L  F+    +  LTAQ  LREQFILK+K    GK++ ELS +LGLK+P+TLE+
Sbjct:  185  PFSRQWFFNHLKTFVRSIGYEGLTAQKLREQFILKEKLAGKSIIELSDILGLKSPMTLEK  244

Query:  257  YYR                                                          259
              YY+
Sbjct:  245  YYK                                                          247
```

SEQ ID 4738 (GBS383) was expressed in *E. coli* as a His-fusion product. SDS-PAGE analysis of total cell extract is shown in FIG. 68 (lane 7; MW 32 kDa). It was also expressed in *E. coli* as a GST-fusion product. SDS-PAGE analysis of total cell extract is shown in FIG. 72 (lane 5; MW 57.1 kDa).

Figure 308:
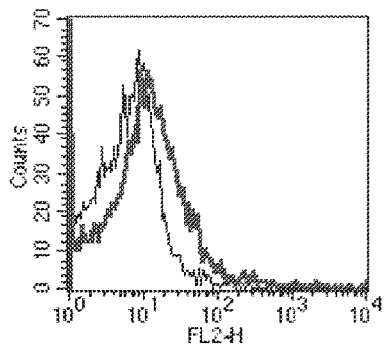

The GBS383-GST fusion product was purified (FIG. 212, lane 8) and used to immunise mice. The resulting antiserum was used for FACS (FIG. 308), which confirmed that the protein is immunoaccessible on GBS bacteria.

Based on this analysis, it was predicted that these proteins and their epitopes could be useful antigens for vaccines or diagnostics.

Example 1539

A DNA sequence (GBSx1630) was identified in *S. agalactiae* <SEQ ID 4741> which encodes the amino acid sequence <SEQ ID 4742>. Analysis of this protein sequence reveals the following:

---

Possible site: 21
>>> Seems to have no N-terminal signal sequence

----- Final Results -----
   bacterial cytoplasm --- Certainty = 0.2465 (Affirmative) <succ>
      bacterial membrane --- Certainty = 0.0000 (Not Clear) <succ>
         bacterial outside --- Certainty = 0.0000 (Not Clear) <succ>

---

The protein has homology with the following sequences in the GENPEPT database.

```
>GP:BAB05201 GB:AP001512 unknown conserved protein in B. subtilis
[Bacillus halodurans]
Identities = 38/136 (27%), Positives = 73/136 (52%), Gaps = 1/136 (0%)
Query:    7  ESFLLNHLDHYLIPAEDVAIFVDTHNADHVMLLLASNGFSRVPVITKEKKYVGTISISDI   66
              ++  + N L    +IP E VA      ++  +H +L+L    +G++  +PV+  +      K   G  IS S  I
Sbjct:    7  QNIMDNDLKELVIPFEKVAHVHLSNPLEHALLVLIKSGYTAIPVLDEHSKLHGVISKSLI   66
```

```
Query:   67  MGYQSKGQLTDWE-MAQTDIVEMVNTKIEPINEAATLTAIMHKIVDYPFLPVISDQNDFR   125
              +      +  + E +A    + +++N +I  I+  A+ + +   + +PF+ ++ D    F
Sbjct:   67  LDALLGVERIEMERLAHLVVKDVMNPEIPTIHHKASFSRALKVSIAHPFICILDDDGSFL   126

Query:  126  GIITRKSILKAINSLL                                               141
             GI+TR +IL  IN L
Sbjct:  127  GILTRSTILSFINRQL                                               142
```

A related DNA sequence was identified in *S. pyogenes* <SEQ ID 4743> which encodes the amino acid sequence <SEQ ID 4744>. Analysis of this protein sequence reveals the following:

Possible site: 47
>>> Seems to have no N-terminal signal sequence
----- Final Results -----
   bacterial cytoplasm --- Certainty = 0.3539 (Affirmative) <succ>
    bacterial membrane --- Certainty = 0.0000 (Not Clear) <succ>
     bacterial outside --- Certainty = 0.0000 (Not Clear) <succ>

An alignment of the GAS and GBS proteins is shown below.

```
Identities = 119/153 (77%), Positives = 137/153 (88%)
Query:    1  MIAKEFESFLLNHLDHYLIPAEDVAIFVDTHNADHVMLLLASNGFSRVPVITKEKKYVGT   60
             MIAKEFE+FL++HLD+YLIP +D+AIF+DTHNADHVMLLL SNGFSRVPVIT+EKKYVGT
Sbjct:    1  MIAKEFETFLMSHLDNYLIPEQDLAIFIDTHNADHVMLLLVSNGESRVPVITREKKYVGT   60

Query:   61  ISISDIMGYQSKGQLTDWEMAQTDIVEMVNTKIEPINEAATLTAIMHKIVDYPFLPVISD   120
             ISISDIM YQSK QLTDWEM+QTDI EMVNTKIE I+   ++LT IMHK++D+PFLPV+
Sbjct:   61  ISISDIMMYQSKRQLTDWEMSQTDIGEMVNTKIETISITSSLTEIMHKLIDFPFLPVVDR  120

Query:  121  QNDFRGIITRKSILKAINSLLHDFTDEYTITPK                              153
              N F GIITRKSILKA+NSLLHDFTD+YTI  K
Sbjct:  121  ANRFVGIITRKSILKAVNSLLHDFTDDYTIIKK                              153
```

Based on this analysis, it was predicted that these proteins and their epitopes could be useful antigens for vaccines or diagnostics.

Example 1540

A DNA sequence (GBSx1631) was identified in *S. agalactiae* <SEQ ID 4745> which encodes the amino acid sequence <SEQ ID 4746>. Analysis of this protein sequence reveals the following:

Possible site: 14
>>> Seems to have no N-terminal signal sequence
----- Final Results -----
   bacterial cytoplasm --- Certainty = 0.4421 (Affirmative) <succ>
    bacterial membrane --- Certainty = 0.0000 (Not Clear) <succ>
     bacterial outside --- Certainty = 0.0000 (Not Clear) <succ>

The protein has homology with the following sequences in the GENPEPT database.

```
>GP:BAB06785 GB:AP001517 unknown conserved protein [Bacillus halodurans]
Identities = 55/169 (32%), Positives = 95/169 (55%), Gaps = 1/169 (0%)
Query:    5  KLVVMSDSHGDRDIVKDIKNHYLGKVDAIFHNGDSELPSSDPIWEGIHVVTGNCDYDSGY   64
             KL+++SDSHG  D +K + + +  +VDAI H GDSELP  D    EG+++V GNCD+   +
Sbjct:    2  KLLILSDSHGWSDELKAVADKHRQEVDAIIHCGDSELPRDDRALEGMNIVRGNCDFGVDF   61

Query:   65  PEVLVTKIDNAVIVQTHGHLHQINFTWDKLDLLAQQEDADICLYGHLHRADAWKNGKTIF   124
             PE   +  + +   +  THGHL+ +  ++   L    A++  A +  +GH H A +++      +F
Sbjct:   62  PEDFIKTVGDFNVYVTHGHLYNVKMSYVSLTYRAEEVGAQLVCFGHSHVATSFQENGIVF   121

Query:  125  INPGSVLQPRGPINEKLYAVVTITDSKVLVEYYTRQHQPYPNLTKELSR              173
             +NPGS+   PR     E+ Y +   + D ++  +    R         +L +      R
Sbjct:  122  VNPGSLRLPRNR-KEQTYCLAYVRDDQIELTFLDRDGHEVTDLQRTYLR              169
```

A related DNA sequence was identified in *S. pyogenes* <SEQ ID 4747> which encodes the amino acid sequence <SEQ ID 4748>. Analysis of this protein sequence reveals the following:

Possible site: 14
>>> Seems to have no N-terminal signal sequence
----- Final Results -----
   bacterial cytoplasm --- Certainty = 0.3835 (Affirmative) <succ>
      bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 117/173 (67%), Positives = 143/173 (82%)
Query:    1 MAIRKLVVMSDSHGDRDIVKDIKNHYLGKVDAIFHNGDSELPSSDPIWEGIHVVTGNCDY    60
            MA + ++VMSDSHGDRDIV+ IK+ YLG+VDAIFHNGDSEL SSDPIW GI+VV GNCDY
Sbjct:    1 MASKTIIVMSDSHGDRDIVQAIKDKYLGQVDAIFHNGDSELNSSDPIWAGIYVVGGNCDY    60

Query:   61 DSGYPEVLVTKIDNAVIVQTHGHLHQINFTWDKLDLLAQQEDADICLYGHLHRADAWKNG   120
            D+GYP+ LVT++    I QTHGHL+ INFTWDKLD AQ+  ADICLYGHLHR  AW+ G
Sbjct:   61 DTGYPDRLVTQLGTVTIAQTHGHLYHINFTWDKLDYFAQEVVADICLYGHLHRPAAWQVG   120

Query:  121 KTIFINPGSVLQPRGPINEKLYAVVTITDSKVLVEYYTRQHQPYPNLTKELSR         173
            +T+F+NPGSV QPRG INEKLYA V +TD+++ V+Y+TR H+ YP+L+KE  R
Sbjct:  121 QTLFMNPGSVTQPRGEINEKLYARVELTDTQIKVDYFTRDHKLYPSLSKEFKR         173
```

Based on this analysis, it was predicted that these proteins and their epitopes could be useful antigens for vaccines or diagnostics.

A related DNA sequence was identified in *S. pyogenes* <SEQ ID 4751> which encodes the amino acid sequence <SEQ ID 4752>. Analysis of this protein sequence reveals the following:

Possible site: 39
>>> Seems to have no N-terminal signal sequence
----- Final Results -----
   bacterial cytoplasm --- Certainty = 0.2590 (Affirmative) <succ>
      bacterial membrane --- Certainty = 0.0000 (Not Clear) <succ>
      bacterial outside --- Certainty = 0.0000 (Not Clear) <succ>

An alignment of the GAS and GBS proteins is shown below.

Example 1541

A DNA sequence (GBSx1632) was identified in *S. agalactiae* <SEQ ID 4749> which encodes the amino acid sequence <SEQ ID 4750>. This protein is predicted to be HAM1 family protein. Analysis of this protein sequence reveals the following:

Possible site: 23
>>> Seems to have no N-terminal signal sequence
----- Final Results -----
   bacterial cytoplasm --- Certainty = 0.1218 (Affirmative) <succ>
      bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:CAB14796 GB:Z99118 similar to hypothetical proteins [Bacillus subtilis]
Identities = 96/189 (50%), Positives = 130/189 (67%), Gaps = 1/189 (0%)
Query:  128 LIATHNEGKTKEFRELFGKLGLKVENLNDYPDLPEVEETGMTFEENARLKAETISKLTGK   187
            +IATHN GK KEF+E+     G V++L +    E+EETG TFEENA +KAE ++K    K
Sbjct:    8 IIATHNPGKVKEFKEILEPRGYDVKSLAEIGFTEEIEEGTHTFEENAIMKAEAVAKAVNK    67

Query:  188 MVISDDSGLKVDALGGLPGVWSARFSGPDATDARNNAKLLHELAMVFDKERRSAQFHTTL   247
            MVI+DDSGL +D LGG PGV+SAR++G     D  N  K+L EL  + +KE+R+A+F   L
Sbjct:   68 MVIADDSGLSIDNLGGRPGVYSARYAGEQKDDQANIEKVLSELKGI-EKEQRTARFRCAL   126

Query:  248 VVSAPNKESLVVEAEWPGYIGTEPKGENGFGYDPLFIVGEGSRTAAELSAQEKNELSHRG   307
             VS P +E+  VE    GYI   EP+GE GFGYDP+FIV +  +T AEL++ EKN +SHR
Sbjct:  127 AVSIPGEETKTVEGHVEGYIAEEPRGEYGFGYDPIFIVKDKDKTMAELTSDEKNKISHRA   186

Query:  308 QAVRKLMEV                                                     316
            A++KL ++
Sbjct:  187 DALKKLSKL                                                     195
```

```
Identities = 214/325 (65%), Positives = 253/325 (77%), Gaps = 5/325 (1%)
Query:   1  MTKTIFESKTEGNWFLGSFQAFNYFTCFG-NDESYEAIQDVFHRLLSTLKVE---GLQLH   56
            M++ I+E K E NWF+G      N  + +G     + + I D+    + +TL E   G    +
Sbjct:  14  MSEKIYEYKDENNWFIGKMTGHNLISGWGVYHTTIKKIDDLLDGIAATLDWENPKGYDVS   73

Query:  57  VVQMTSDFQLLAFLVDMINQEYSRHIKVTQHKGAILVSEDDQLFLVHLPKEGTSLEKFFD  116
            VV+  S    L+ F++DMINQE  R IKVT H G IL+ E+ +L  V+LP+ G S    FF
Sbjct:  74  VVRHQSPLSLITFIIDMINQETQREIKVTPHAGTILLMENAKLLAVYLPEGGVSTATFF-  132

Query: 117  LKNDNNFGDTILIATHNEGKTKEFRELFGKLGLKVENLNDYPDLPEVEETGMTFEENARL  176
                 ++   FGD ILIAT NEGKTKEFR LFG+LG +VENLNDYP+LPEV ETG TFEENARL
Sbjct: 133  ATSEQGFGDIILIATRNEGKTKEFRNLFGQLGYRVENLNDYPELPEVAETGTTFEENARL  192

Query: 177  KAETISKLTGKMVISDDSGLKVDALGGLPGVWSARFSGPDATDARNNAKLLHELAMVFDK  236
            KAETIS+LTGKMV++DDSGLKVDALGGLPGVWSARFSGPDATDA+NNAKLLHELAMVFD+
Sbjct: 193  KAETISRLTGKMVLADDSGLKVDALGGLPGVWSARFSGPDATDAKNNAKLLHELAMVFDQ  252

Query: 237  ERRSAQFHTTLVVSAPNKESLVVEAEWPGYIGTEPKGENGFGYDPLFIVGEGSRTAAELS  296
            ++RSAQFHTTLVV+APNK+SLVVEA+WPGYI T+PKGENGFGYDP+FIVGE     AAEL
Sbjct: 253  KKRSAQFHTTLVVAAPNKDSLVVEADWPGYIATQPKGENGFGYDPVFIVGETGHHAAELE  312

Query: 297  AQEKNNLSHRGQAVRKLMEVFPKWQ                                    321
            A +KN LSHRGQAVRKLMEVFP WQ
Sbjct: 313  ADQKNQLSHRGQAVRKLMEVFPAWQ                                    337
```

Based on this analysis, it was predicted that these proteins and their epitopes could be useful antigens for vaccines or diagnostics.

Example 1542

A DNA sequence (GBSx1633) was identified in *S. agalactiae* <SEQ ID 4753> which encodes the amino acid sequence <SEQ ID 4754>. This protein is predicted to be glutamate racemase (murI). Analysis of this protein sequence reveals the following:

Possible site: 45
>>> Seems to have no N-terminal signal sequence
INTEGRAL    Likelihood = –1.86    Transmembrane 114-130 (114-130)
----- Final Results -----
   bacterial membrane --- Certainty = 0.1744 (Affirmative) <succ>
     bacterial outside --- Certainty = 0.0000 (Not Clear) <succ>
        bacterial cytoplasm --- Certainty = 0.0000 (Not Clear) <succ>

A related GBS nucleic acid sequence <SEQ ID 10067> which encodes amino acid sequence <SEQ ID 10068> was also identified.

The protein has homology with the following sequences in the GENPEPT database.

A related DNA sequence was identified in *S. pyogenes* <SEQ ID 4755> which encodes the amino acid sequence <SEQ ID 4756>. Analysis of this protein sequence reveals the following:

Possible site: 19
>>> Seems to have an uncleavable N-term signal seq
INTEGRAL    Likelihood = –1.70    Transmembrane 88-104 (86-104)
----- Final Results -----
   bacterial membrane --- Certainty = 0.1680 (Affirmative) <succ>
     bacterial outside --- Certainty = 0.0000 (Not Clear) <succ>
        bacterial cytoplasm --- Certainty = 0.0000 (Not Clear) <succ>

The protein has homology with the following sequences in the databases:

```
>GP:AAF72713 GB:AF263927 glutamate racemase [Carnobacterium sp. St2]
Identities = 160/267 (59%), Positives = 202/267 (74%), Gaps = 3/267 (1%)
Query:  27  MDSRPIGFLDSGVGGLTVVKEMFRQLPEEEVIFIGDQARAPYGPRPAQQIREFTWQMVNF   86
            M +   IGF+DSGVGGLTVVKE RQLP E + ++GD AR  PYGPRP  Q+R+FTW+M +F
Sbjct:   1  MKKQAIGFIDSGVGGLTVVKEAMRQLPNESIYYVGDTARCPYGPRPEDQVRKFTWEMTHF   60

Query:  87  LLTKNVKMIVIACNTATAVAWQEIKEKLDIPVLGVILPGASAAIKSTNLGKVGIIGTPMT  146
            LL KN+KM+VIACNTATA A  ++IK+KL IPV+GVILPG+ AAIK+T+  ++G+IGT  T
Sbjct:  61  LLDKNIKMLVIACNTATAAALKDIKKKLAIPVIGVILPGSRAAIKATHTNRIGVIGTEGT  120

Query: 147  VKSDAYRQKIQALSPNTAVVSLACPKFVPIVESNQMSSSLAKKVVYETLSPLVGK-LDTL  205
            VKS+ Y++  I  +      V SLACPKFVP+VESN+  SS++AKKVV ETL PL  + LDTL
Sbjct: 121  VKSNQYKKMIHSKDTKALVTSLACPKFVPLVESNEYSSAIAKKVVAETLRPLKNEGLDTL  180

Query: 206  ILGCTHYPLLRPIIQNVMGAEVKLIDSGAETVRDISVLLNYFEINHNWQNKH-GGHHFYT  264
            ILGCTHYPLLRPIIQN +G  V LIDSGAETV ++S +L+YF +  + QNK      +FYT
Sbjct: 181  ILGCTHYPLLRPIIQNTLGDSVTLIDSGAETVSEVSTILDYFNLAVDSQNKEKAERNFYT  240

Query: 265  TASPKGFKEIAEQWLS-QEINVERIVL                                  290
            T S + F   IA +WL    ++ VE I L
Sbjct: 241  TGSSQMFHAIASEWLQLDDLAVEHITL                                  267
```

```
>GP:AAF72713 GB:AF263927 glutamate racemase [Carnobacterium sp. St2]
Identities = 149/267 (55%), Positives = 202/267 (74%), Gaps = 3/267 (1%)
Query:   1  MDTRPIGFLDSGVGGLTVVCELIRQLPHEKIVYIGDSARAPYGPRPKKQIKEYTWELVNF    60
            M + IGF+DSGVGGLTVV E +RQLP+E I Y+GD+AR PYGPRP+ Q++++TWE+ +F
Sbjct:   1  MKKQAIGFIDSGVGGLTVVKEAMRQLPNESIYYVGDTARCPYGPRPEDQVRKFTWEMTHF    60

Query:  61  LLTQNVKMIVFACNTATAVAWEEVKAALDIPVLGVVLPGASAAIKSTTKGQVGVIGTPMT   120
            LL +N+KM+V ACNTATA A +++K  L IPV+GV+LPG+ AAIK+T    ++GVIGT  T
Sbjct:  61  LLDKNIKMLVIACNTATAAALKDIKKKLAIPVIGVILPGSRAAIKATHTNRIGVIGTEGT   120

Query: 121  VASDIYRKKIQLLAPSIQVRSLACPKFVPIVESNEMCSSIAKKIVYDSLAPLVGK-IDTL   179
            V S+ Y+K I         V SLACPKFVP+VESNE  S+IAKK+V ++L PL  + +DTL
Sbjct: 121  VKSNQYKKMIHSKDTKALVTSLACPKFVPLVESNEYSSAIAKKVVAETLRPLKNEGLDTL   180

Query: 180  VLGCTHYPLLRPIIQNVMGPSVKLIDSGAECVRDISVLLNYFDIN-GNYHQKAVEHRFFT   238
            +LGCTHYPLLRPIIQN +G SV LIDSGAE V ++S +L+YF++   +   +++   E   F+T
Sbjct: 181  ILGCTHYPLLRPIIQNTLGDSVTLIDSGAETVSEVSTILDYFNLAVDSQNKEKAERNFYT   240

Query: 239  TANPEIFQEIASIWLK-QKINVEHVTL                                   264
            T + ++F  IAS WL+   + VEH+TL
Sbjct: 241  TGSSQMFHAIASEWLQLDDLAVEHITL                                   267
```

An alignment of the GAS and GBS proteins is shown below.

```
Identities = 195/264 (73%), Positives = 231/264 (86%)
Query:  27  MDSRPIGFLDSGVGGLTVVKEMFRQLPEEEVIFIGDQARAPYGPRPAQQIREFTWQMVNF    86
            MD+RPIGFLDSGVGGLTVV E+ RQLP E++++IGD ARAPYGPRP +QI+E+TW++VNF
Sbjct:   1  MDTRPIGFLDSGVGGLTVVCELIRQLPHEKIVYIGDSARAPYGPRPKKQIKEYTWELVNF    60

Query:  87  LLTKNVKMIVIACNTATAVANQEIKEKLDIPVLGVILPGASAAIKSTNLGKVGIIGTPMT   146
            LLT+NVKMIV ACNTATAVAW+E+K  LDIPVLGV+LPGASAAIKST  G+VG+IGTPMT
Sbjct:  61  LLTQNVKMIVFACNTATAVAWEEVKAALDIPVLGVVLPGASAAIKSTTKGQVGVIGTPMT   120

Query: 147  VKSDAYRQKIQALSPNTAVVSLACPKFVPIVESNQMSSSLAKKVVYETLSPLVGKLDTLI   206
            V SD YR+KIQ L+P+  V SLACPKFVPIVESN+M SS+AKK+VY++L+PLVGK+DTL+
Sbjct: 121  VASDIYRKKIQLLAPSIQVRSLACPKFVPIVESNEMCSSIAKKIVYDSLAPLVGKIDTLV   180

Query: 207  LGCTHYPLLRPIIQNVMGAEVKLIDSGAETVRDISVLLNYFEINHNWQNKHGGHHFYTTA   266
            LGCTHYPLLRPIIQNVMG  VKLIDSGAE VRDISVLLNYF+IN N+  K   H F+TTA
Sbjct: 181  LGCTHYPLLRPIIQNVMGPSVKLIDSGAECVRDISVLLNYFDINGNYHQKAVEHRFFTTA   240

Query: 267  SPKGFKEIAEQWLSQEINVERIVL                                      290
            +P+ F+EIA  WL Q+INVE + L
Sbjct: 241  NPEIFQEIASIWLKQKINVEHVTL                                      264
```

Based on this analysis, it was predicted that these proteins and their epitopes could be useful antigens for vaccines or diagnostics.

Example 1543

A DNA sequence (GBSx1634) was identified in *S. agalactiae* <SEQ ID 4757> which encodes the amino acid sequence <SEQ ID 4758>. Analysis of this protein sequence reveals the following:

Possible site: 21
>>> Seems to have an uncleavable N-term signal seq
INTEGRAL     Likelihood = –11.36     Transmembrane 3-19 (1-27)

----- Final Results -----
bacterial membrane --- Certainty = 0.5543 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the GENPEPT database.

```
>GP:CAB13675 GB:Z99113 alternate gene name: yoxG [Bacillus subtilis]
Identities = 26/72 (36%), Positives = 42/72 (58%)
Query:   1  MSITIWILLIIVALFGGLVGGIFIARKQIEKEIGEHPRLTPDAIREMMSQMGQKPSEAKV    60
            M++ + IL+ +VAL G+  G FIARK +    + ++P +     +R MM QMG KPS+ K+
Sbjct:   1  MTLWVGILVGVVALLIGVALGFFIARKYMMSYLKKNPPINEQMLRMMMMQMGMKPSQKKI    60

Query:  61  QQTYRNIVKHAK                                                   72
            Q ++    K
Sbjct:  61  NQMMKAMNNQTK                                                   72
```

A related DNA sequence was identified in *S. pyogenes* <SEQ ID 4759> which encodes the amino acid sequence <SEQ ID 4760>. Analysis of this protein sequence reveals the following:

```
Possible site: 15
>>> Seems to have an uncleavable N-term signal seq
INTEGRAL     Likelihood = -10.72    Transmembrane 7-23 (1-27)
----- Final Results -----
    bacterial membrane --- Certainty = 0.5288 (Affirmative) <succ>
       bacterial outside --- Certainty = 0.0000 (Not Clear) <succ>
          bacterial cytoplasm --- Certainty = 0.0000 (Not Clear) <succ>
```

An alignment of the GAS and GBS proteins is shown below.

```
Identities = 62/79 (78%), Positives = 69/79 (86%)

Query:   1    MSITIWILLIIVALFGGLVGGIFIARKQIEKEIGEHPRLTPDAIREMMSQMGQKPSEAKV    60
              MS IWILL+IVAL  G+ GGIFIARKQIEKEIGEHPRLTP+AIREMMSQMGQKPSEAK+
Sbjct:   1    MSTAIWILLLIVALGVGVFGGIFIARKQIEKEIGEHPRLTPEAIREMMSQMGQKPSEAKI    60

Query:   61   QQTYRNIVKHAKTAIKTKK                                             79
              QQTYRNI+K +K A+   K
Sbjct:   61   QQTYRNIIKQSKAAVSKGK                                             79
```

Based on this analysis, it was predicted that these proteins and their epitopes could be useful antigens for vaccines or diagnostics.

Example 1544

A DNA sequence (GBSx1635) was identified in *S. agalactiae* <SEQ ID 4761> which encodes the amino acid sequence <SEQ ID 4762>. Analysis of this protein sequence reveals the following:

```
Possible site: 57
>>> Seems to have no N-terminal signal sequence
INTEGRAL     Likelihood = -7.86    Transmembrane 82-98 (79-103)
----- Final Results -----
    bacterial membrane --- Certainty = 0.4142 (Affirmative) <succ>
       bacterial outside --- Certainty = 0.0000 (Not Clear) <succ>
          bacterial cytoplasm --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1545

A DNA sequence (GBSx1636) was identified in *S. agalactiae* <SEQ ID 4763> which encodes the amino acid sequence <SEQ ID 4764>. Analysis of this protein sequence reveals the following:

```
Possible site: 30
>>> Seems to have no N-terminal signal sequence
INTEGRAL     Likelihood = -10.83    Transmembrane 56-72 (50-105)
INTEGRAL     Likelihood = -7.27     Transmembrane 27-43 (17-48)
INTEGRAL     Likelihood = -6.26     Transmembrane 76-92 (73-105)
INTEGRAL     Likelihood = -4.83     Transmembrane 119-135 (118-141)
INTEGRAL     Likelihood = -1.65     Transmembrane 160-176 (160-176)
----- Final Results -----
    bacterial membrane --- Certainty = 0.5331 (Affirmative) <succ>
       bacterial outside --- Certainty = 0.0000 (Not Clear) <succ>
          bacterial cytoplasm --- Certainty = 0.0000 (Not Clear) <succ>
```

A related GBS nucleic acid sequence <SEQ ID 8837> which encodes amino acid sequence <SEQ ID 8838> was also identified.

The protein has no significant homology with any sequences in the GENPEPT database.

A related DNA sequence was identified in *S. pyogenes* <SEQ ID 4765> which encodes the amino acid sequence <SEQ ID 4766>. Analysis of this protein sequence reveals the following:

```
Possible site: 19
>>> Seems to have a cleavable N-term signal seq.
INTEGRAL     Likelihood = -10.99    Transmembrane 45-61 (37-94)
INTEGRAL     Likelihood = -7.06     Transmembrane 74-90 (62-94)
INTEGRAL     Likelihood = -3.45     Transmembrane 110-126 (108-130)
INTEGRAL     Likelihood = -2.18     Transmembrane 149-165 (149-165)
INTEGRAL     Likelihood = -1.91     Transmembrane 21-37 (20-37)
----- Final Results -----
    bacterial membrane --- Certainty = 0.5394 (Affirmative) <succ>
       bacterial outside --- Certainty = 0.0000 (Not Clear) <succ>
          bacterial cytoplasm --- Certainty = 0.0000 (Not Clear) <succ>
```

The protein has no significant homology with any sequences in the GENPEPT database.

An alignment of the GAS and GBS proteins is shown below.

```
Identities = 111/173 (64%), Positives = 145/173 (83%)

Query:     12  MSKKTTQMVSYTSILVAFAIMIPIIMPAKIIGPASFTLASHVPLFLSIFISVPVAILVA     71
               M+KK TQ+++YTSILVAFAI+IPIIMP K+IIGPASFTLASHVPLFL+IF+S+PVAILVA
Sbjct:      1  MTKKPTQLIAYTSILVAFAILIPIIMPLKLIIGPASFTLASHVPLFLAIFMSIPVAILVA     60

Query:     72  LGTGLGFLLAGFPIVIVLRALSHIGFALIAAFLIKSKPSLLMSKWQTLLFAVAINIIHGL    131
               LGT LGFLLAG P++IVLRALSH+ FA++AA+ +  KP L+ S  +   FA  IN+IHGL
Sbjct:     61  LGTTLGFLLAGLPLIIVLRALSHLLFAILAAWWLSRKPQLMTSAVKCFSFAFFINVIHGL    120

Query:    132  LEFITVYIITMTSNSSSTYLWSLFSLIGLGSLLHGLVDFYIALFIWKWMTQKL          184
                EF+ VYI+T T+ +S +Y WS+  LIGLGSL+HG++DFY+AL +W+++ + L
Sbjct:    121  AEFLVVYILTATTATSMSYFWSMLGLIGLGSLIHGILDFYLALVLWRFLAKNL          173
```

A related GBS gene <SEQ ID 10789> and protein <SEQ ID 10790> were also identified. Analysis of this protein sequence reveals the following:

Based on this analysis, it was predicted that these proteins and their epitopes could be useful antigens for vaccines or diagnostics.

Lipop: Possible site: −1 Crend: 3
SRCFLG: 0
McG: Length of UR: 24
Peak Value of UR: 3.16
Net Charge of CR: 2
McG: Discrim Score: 12.56
GvH: Signal Score (−7.5): −0.16
Possible site: 19
>>> Seems to have a cleavable N-term signal seq.
Amino Acid Composition: calculated from 20
ALOM program    count: 5 value: −10.83 threshold: 0.0
INTEGRAL     Likelihood = −10.83   Transmembrane 45-61 (39-94)
INTEGRAL     Likelihood = −6.26    Transmembrane 65-81 (62-94)
INTEGRAL     Likelihood = −4.83    Transmembrane 108-124 (107-130)
INTEGRAL     Likelihood = −1.65    Transmembrane 149-165 (149-165)
INTEGRAL     Likelihood = −0.27    Transmembrane 24-40 (24-40)
PERIPHERAL   Likelihood = 0.42     86
modified ALOM score: 2.67
icml HYPID: 7 CFP: 0.533
*** Reasoning Step: 3
----- Final Results -----
  bacterial membrane --- Certainty = 0.5331 (Affirmative) <succ>
     bacterialoutside --- Certainty = 0.0000 (Not Clear) <succ>
       bacterial cytoplasm --- Certainty = 0.0000 (Not Clear) <succ>

Example 1546

A DNA sequence (GBSx1637) was identified in *S. agalactiae* <SEQ ID 4767> which encodes the amino acid sequence <SEQ ID 4768>. This protein is predicted to be transcriptional regulator, biotin repressor family. Analysis of this protein sequence reveals the following:

Possible site: 27
>>> Seems to have no N-terminal signal sequence
----- Final Results -----
  bacterial cytoplasm --- Certainty = 0.2237 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database.

```
>GP:CAB14749 GB:Z99118 yrxA [Bacillus subtilis]

Identities = 72/165 (43%), Positives = 112/165 (67%), Gaps = 2/165 (1%)

Query:      6  RRENILTTLKGTKEAISASTLAKIFSVSRQVIVGDIALLRAQQCDIISTPKGYL-MSSAL     64
               RR+ +L  LK +K  ++    LAK   +VSRQVIV DI+LL+A+     II+T +GY+ M +A
Sbjct:     12  RRDQLLLWLKESKSPLTGGELAKKANVSRQVIVQDISLLKAKNVPIIATSQGYVYMDAAA     71

Query:     65  STHQFTARLV-CQHGIEQTEEELEIILRYQGIIMNVEVEHPIYGMLTAPLNIQSQKDIDN    123
                 HQ    R++  C HG E+TEEEL++I+       + +V++EHP+YG LTA + + ++K++ +
Sbjct:     72  QQHQQAERIIACLHGPERTEEELQLIVDEGVTVKDVKIEHPVYGDLTAAIQVGTRKEVSH    131

Query:    124  FTAKLKVSNAELLSSLTDGLHTHMISCQDQSVFDQICEALKKAGI                 168
               F   K+  +NA  LS LTDG+H H ++  D+    DQ C+AL++AGI
Sbjct:    132  FIKKINSTNAAYLSQLTDGVHLHTLTAPDEHRIDQACQALEEAGI                 176
```

A related DNA sequence was identified in *S. pyogenes* <SEQ ID 4769> which encodes the amino acid sequence <SEQ ID 4770>. Analysis of this protein sequence reveals the following:

```
Possible site: 38
>>> Seems to have no N-terminal signal sequence
----- Final Results -----
   bacterial cytoplasm --- Certainty = 0.2971 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below.

```
Identities = 109/170 (64%), Positives = 136/170 (79%)

Query:    1  MKAQERRENILTTLKGTKEAISASTLAKIFSVSRQVIVGDIALLRAQQCDIISTPKGYLM    60
             MKA++RR+ I+  L    ++A+SA+ L K+   VSRQVIVGDIALLRAQQ DIISTPKGY+M
Sbjct:    1  MKAEDRRQKIIECLNSEQKAVSATRLGKLLGVSRQVIVGDIALLRAQQIDIISTPKGYIM    60

Query:   61  SSALSTHQFTARLVCQHGIEQTEEELEIILRYQGIIMNVEVEHPIYGMLTAPLNIQSQKD   120
             S+AL +HQF AR+VCQH +E+T++ELEIIL +QGII   VEVEHPIYGM+TAPLNI++  D
Sbjct:   61  STALYSHQFCARIVCQHNVEETKKELEIILAHQGIITTVEVEHPIYGMITAPLNIKTHSD   120

Query:  121  IDNFTAKLKVSNAELLSSLTDGLHTHMISCQDQSVFDQICEALKKAGILY            170
             + NF +KL  S AELLSSLT+GLH+H+ISC  Q  F  I   L+ AGILY
Sbjct:  121  VTNFMSKLSQSKAELLSSLTEGLHSHLISCPSQEAFLAIKHDLELAGILY            170
```

Based on this analysis, it was predicted that these proteins and their epitopes could be useful antigens for vaccines or diagnostics.

Example 1547

A DNA sequence (GBSx1638) was identified in *S. agalactiae* <SEQ ID 4771> which encodes the amino acid sequence <SEQ ID 4772>. Analysis of this protein sequence reveals the following:

```
Possible site: 37
>>> Seems to have no N-terminal signal sequence
INTEGRAL    Likelihood = -8.44    Transmembrane 143-159 (138-165)
```

```
INTEGRAL    Likelihood = -8.17    Transmembrane 164-180 (160-184)
INTEGRAL    Likelihood = -7.17    Transmembrane 56-72 (53-78)
INTEGRAL    Likelihood = -5.63    Transmembrane 24-40 (21-44)
INTEGRAL    Likelihood = -4.94    Transmembrane 113-129 (108-131)
INTEGRAL    Likelihood = -2.39    Transmembrane 86-102 (86-103)
INTEGRAL    Likelihood = -1.06    Transmembrane 203-219 (203-219)
----- Final Results -----
   bacterial membrane --- Certainty = 0.4376 (Affirmative) <succ>
   bacterial outside --- Certainty = 0.0000 (Not Clear) <succ>
   bacterial cytoplasm --- Certainty = 0.0000 (Not Clear) <succ>
```

A related GBS nucleic acid sequence <SEQ ID 10069> which encodes amino acid sequence <SEQ ID 10070> was also identified.

The protein has homology with the following sequences in the GENPEPT database.

```
>GP:AAC18360 GB:AF064763 putative membrane spanning protein
[Lactococcus lactis subsp. cremoris]
Identities = 97/188 (51%), Positives = 133/188 (70%)

Query:   38  IMLYMFPQNMIAIMQKMPGLYFGAIILELVLVFVASGAARRNTPAALPLFLIYSALNGFT    97
             IM+  F  NM AI+Q      I+ LV+V   G A +N+  ALP+F+ Y+A  GF
Sbjct:    1  IMITFFLDNMRAILQSGSLFLLVLWIIPLVMVVSLQGLAMKNSKMALPIFIGYAAFMGFL    60

Query:   98  LSFIIARYTQTTVLQAFITSAAVFFAMALIGAKTKKDLSGMRKALMAALIGILIASLVNL   157
             +SF +  YT T +  AFIT++A+FF +++ G  TK++LSGM KAL  A+ G+++A L+NL
Sbjct:   61  ISFTLLMYTATDITLAFITASAMFFGLSVYGRFTKRNLSGMGKALGVAVWGLIVAMLLNL   120

Query:  158  FIGSGGMSYIISIVCVIIFSGLIAYDNQMIKYVYNSQGGQVADGWAVSMALSLYLDFINL   217
             F  S G++ +IS+V V+IFSGLIA+DNQ I   VYN+  GQV+DGWA+SMALSLYLDFIN+
Sbjct:  121  FFASTGLTILISLVGVVIFSGLIAWDNQKITQVYNAHNGQVSDGWAISMALSLYLDFINM   180

Query:  218  FLNILRLF                                                    225
             FL +LRLF
Sbjct:  181  FLFLLRLF                                                    188
```

A related DNA sequence was identified in *S. pyogenes* <SEQ ID 4773> which encodes the amino acid sequence <SEQ ID 4774>. Analysis of this protein sequence reveals the following:

```
Possible site: 40
>>> Seems to have no N-terminal signal sequence
INTEGRAL    Likelihood = -8.97    Transmembrane 143-159 (138-165)
INTEGRAL    Likelihood = -5.89    Transmembrane 164-180 (160-184)
INTEGRAL    Likelihood = -5.68    Transmembrane 56-72 (55-77)
INTEGRAL    Likelihood = -4.78    Transmembrane 113-129 (110-130)
INTEGRAL    Likelihood = -2.81    Transmembrane 203-219 (203-222)
INTEGRAL    Likelihood = -2.76    Transmembrane 24-40 (23-41)
INTEGRAL    Likelihood = -2.76    Transmembrane 86-102 (86-104)
----- Final Results -----
    bacterial membrane --- Certainty = 0.4588 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the databases:

```
>GP:AAC18360 GB:AF064763 putative membrane spanning protein
[Lactococcus lactis subsp. cremoris]
Identities = 90/189 (47%), Positives = 133/189 (69%)

Query:     38  LMLYPFRENLISILVNQPMIYYGAAIIELILVFVASSAARKNTPAALPIFLIYSALNGFT    97
               +M+  F +N+ +IL +  +     II L++V    A KN+  ALPIF+ Y+A  GF
Sbjct:      1  IMITFFLDNMRAILQSGSLFLLVLWIIPLVMVVSLQGLAMKNSKMALPIFIGYAAFMGFL   60

Query:     98  LSFIIVAYAQTTVFQAFLSSAAVFFAMSIIGVKTKRDMSGLRKAMFAALIGVVVASLINL  157
               +SF ++  Y  T  +  AF++++A+FF +S+ G   TKR++SG+ KA+  A+ G++VA L+NL
Sbjct:     61  ISFTLLMYTATDITLAFITASAMFFGLSVYGRFTKRNLSGMGKALGVAVWGLIVAMLLNL  120

Query:    158  FIGSGMMSYVISVISVLIFSGLIASDNQMIKRVYQATNGQVGDGWAVAMALSLYLDFINL  217
               F  S  ++ +IS++ V+IFSGLIA DNQ I +VY A NGQV DGWA++MALSLYLDFIN+
Sbjct:    121  FFASTGLTILISLVGVVIFSGLIAWDNQKITQVYNAHNGQVSDGWAISMALSLYLDFINM  180

Query:    218  FISLLRIFG   226
               F+ LLR+FG
Sbjct:    181  FLFLLRLFG   189
```

An alignment of the GAS and GBS proteins is shown below.

```
Identities = 167/229 (72%), Positives = 202/229 (87%)

Query:      1  MNDNVIYTQSDSGLNQFFAKIYGLVGIGVGLSAAVSAIMLYMFPQNMIAIMQKMPGLYFG    60
               MND+VIYTQSD GLNQFFAKIY LVG+GVGLSA VS +MLY F +N+I+I+    P +Y+G
Sbjct:      1  MNDHVIYTQSDVGLNQFFAKIYSLVGMGVGLSAFVSYLMLYPFRENLISILVNQPMIYYG    60

Query:     61  AIILELVLVFVASGAARRNTPAALPLFLIYSALNGFTLSFIIARYTQTTVLQAFITSAAV  120
               A I+EL+LVFVAS AAR+NTPAALP+FLIYSALNGFTLSFI  Y QTTV QAF++SAAV
Sbjct:     61  AAIIELILVFVASSAARKNTPAALPIFLIYSALNGFTLSFIIVAYAQTTVFQAFLSSAAV  120

Query:    121  FFAMALIGAKTKKDLSGMRKALMAALIGILIASLVNLFIGSGGMSYIISIVCVIIFSGLI  180
               FFAM++IG KTK+D+SG+RKA+ AALIG+++ASL+NLFIGSG MSY+IS++ V+IFSGLI
Sbjct:    121  FFAMSIIGVKTKRDMSGLRKAMFAALIGVVVASLINLFIGSGMMSYVISVISVLIFSGLI  180

Query:    181  AYDNQMIKYVYNSQGGQVADGWAVSMALSLYLDFINLFLNILRLFARND             229
               A DNQMIK VY +  GQV DGWAV+MALSLYLDFINLF+++LR+F RND
Sbjct:    181  ASDNQMIKRVYQATNGQVGDGWAVAMALSLYLDFINLFISLLRIFGRND             229
```

Based on this analysis, it was predicted that these proteins and their epitopes could be useful antigens for vaccines or diagnostics.

Example 1548

A DNA sequence (GBSx1639) was identified in *S. agalactiae* <SEQ ID 4775> which encodes the amino acid sequence <SEQ ID 4776>. Analysis of this protein sequence reveals the following:

```
Possible site: 44
>>> Seems to have no N-terminal signal sequence
----- Final Results -----
    bacterial cytoplasm --- Certainty = 0.2495 (Affirmative) <succ>
    bacterial membrane --- Certainty = 0.0000 (Not Clear) <succ>
    bacterial outside --- Certainty = 0.0000 (Not Clear) <succ>
```

A related GBS nucleic acid sequence <SEQ ID 10071> which encodes amino acid sequence <SEQ ID 10072> was also identified.

The protein has no significant homology with any sequences in the GENPEPT database.

A related DNA sequence was identified in *S. pyogenes* <SEQ ID 4777> which encodes the amino acid sequence <SEQ ID 4778>. Analysis of this protein sequence reveals the following:

```
Possible site: 60
>>> Seems to have no N-terminal signal sequence
----- Final Results -----
    bacterial cytoplasm --- Certainty = 0.3277 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
Identities = 127/163 (77%), Positives = 141/163 (85%)

Query:     7  YQDDKDFMDLVGHLIDHPRFQKLEAIVQHHHSTRLEHSINVSYTSYKIAKKFGWDASSTA    66
              Y +DK++M+ VGHLI HPRFQKL  IVQH HSTRLEHSINVSY+SYK+AK+FGWDA STA
Sbjct:     3  YTEDKEYMEHVGHLIAHPRFQKLSHIVQHQHSTRLEHSINVSYSSYKLAKRFGWDAKSTA    62

Query:    67  RGGLLHDFFYYDWRVTKFNKSHAWVHPRIAVRNARKLTDLNAREEDIILKHMWGATIAPP   126
              RGGLLHDFFYYDWRVTKFNK HAWVHPRIAVRNA+KLT+LN +EEDIILKHMWGATIA P
Sbjct:    63  RGGLLHDFFYYDWRVTKFNKGHAWVHPRIAVRNAKKLTELNKKEEDIILKHMWGATIAFP   122

Query:   127  RYKESYIVTMVDKYWAVREASRPLKRIFKKPIRFSRKFLGSHN                   169
              RYKESYIVTMVDKYWAV+EA  PL++ +     RK L SHN
Sbjct:   123  RYKESYIVTMVDKYWAVKEAVTPLRQKWSNRRFLRRKTLQSHN                   165
```

Based on this analysis, it was predicted that these proteins and their epitopes could be useful antigens for vaccines or diagnostics.

Example 1549

A DNA sequence (GBSx1640) was identified in *S. agalactiae* <SEQ ID 4779> which encodes the amino acid sequence <SEQ ID 4780>. Analysis of this protein sequence reveals the following:

Possible site: 37
>>> Seems to have no N-terminal signal sequence
INTEGRAL     Likelihood = −3.03     Transmembrane 213-229 (212-229)
----- Final Results -----
  bacterial membrane --- Certainty = 0.2211 (Affirmative) <succ>
  bacterial outside --- Certainty = 0.0000 (Not Clear) <succ>
  bacterial cytoplasm --- Certainty = 0.0000 (Not Clear) <succ>

A related GBS nucleic acid sequence <SEQ ID 9413> which encodes amino acid sequence <SEQ ID 9414> was also identified.

The protein has homology with the following sequences in the GENPEPT database.

A related DNA sequence was identified in *S. pyogenes* <SEQ ID 4781> which encodes the amino acid sequence <SEQ ID 4782>. Analysis of this protein sequence reveals the following:

Possible site: 61
>>> Seems to have no N-terminal signal sequence
INTEGRAL     Likelihood = −2.97     Transmembrane 229-245 (228-245)
----- Final Results -----
  bacterial membrane --- Certainty = 0.2190 (Affirmative) <succ>
  bacterial outside --- Certainty = 0.0000 (Not Clear) <succ>
  bacterial cytoplasm --- Certainty = 0.0000 (Not Clear) <succ>

An alignment of the GAS and GBS proteins is shown below.

```
>GP:CAB14825 GB:Z99118 similar to rRNA methylase [Bacillus subtilis]
Identities = 96/228 (42%), Positives = 143/228 (62%), Gaps = 5/228 (2%)

Query:     3  QKKYRKSSYLIEGWHLFEEAEKYGAQFLNIFVT-ETAIDR-LRKPERAIVVTDDVLKELT    60
              +++ + +++LIEG HL EEA K      I V  ET I   L   + ++++D    +T
Sbjct:    22  KERTKTNTFLIEGEHLVEEALKSPGIVKEILVKDETRIPSDLETGIQCYMLSEDAFSAVT    81

Query:    61  DSQTPQGIVAEIAFQETRWTDIKKGRFLVLEDVQDPGNLGTMVRTADAANFDAVFLSQKS   120
              +++TPQ I A    E +   +K  L+++ VQDPGNLGTM+RTADAA  DAV L    +
Sbjct:    82  ETETPQQIAAVCHMPEEKLATARK--VLLIDAVQDPGNLGTMIRTADAAGLDAVVLGDGT   139

Query:   121  ADLYNQKTLRSMQGSHFHLPVFRVEIEQFVNFCKAEGITMIATTLSEQSVNYKNLPKYDY   180
              AD +N KTLRS QGSHFH+PV R  + +V+  KAEG+ +  T L +    Y+ +P+ +
Sbjct:   140  ADAFNGKTLRSAQGSHFHIPVVRRNLPSYVDELKAEGVKVYGTAL-QNGAPYQEIPQSES   198

Query:   181  FALIMGNEGQGISKTMTEEADVLAHIEMPGQAESLNVAVAAGVVIFSL              228
              FALI+GNEG G+    + E+ D+  ++ + GQAESLNVAVAA ++++ L
Sbjct:   199  FALIVGNEGAGVDAALLEKTDLNLYVPLYGQAESLNVAVAAAILVYHL              246
```

```
Identities = 141/229 (61%), Positives = 178/229 (77%)

Query:     1  MLQKKYRKSSYLIEGWHLFEEAEKYGAQFLNIFVTETAIDRLRKPERAIVVTDDVLKELT      60
              +LQKK+RK SYLIEGWHLFEEA+K G  F +IFV E  ++RL    +  ++V+ VLKELT
Sbjct:    17  LLQKKHRKQSYLIEGWHLFEEAQKSGQVFRHIFVLEEMVERLAGEQELVIVSPQVLKELT      76

Query:    61  DSQTPQGIVAEIAFQETRWTDIKKGRFLVLEDVQDPGNLGTMVRTADAANFDAVFLSQKS     120
              DS +PQGIVAE+   +  +   KG++LVLEDVQDPGNLGT++RTADAA FD VFLS+KS
Sbjct:    77  DSPSPQGIVAEVEIPKLAFPSDYKGKYLVLEDVQDPGNLGTIIRTADAARFDGVFLSEKS     136

Query:   121  ADLYNQKTLRSMQGSHFHLPVFRVEIEQFVNFCKAEGITMIATTLSEQSVNYKNLPKYDY     180
              AD+YNQKTLRSMQGSHFHLP++R ++ Q        ++ATTLS++SV+YK+L   ++
Sbjct:   137  ADIYNQKTLRSMQGSHFHLPIWRTDVYQLCRELQEYETPILATTLSKKSVDYKSLTHHER     196

Query:   181  FALIMGNEGQGISKTMTEEADVIAHIEMPGQAESLNVAVAAGVVIFSLI               229
              +AL++GNEGQGIS   M   AD L HI MPGQAESLNVAVAAG++IFSLI
Sbjct:   197  LALVLGNEGQGISAEMAALADQLVHITMPGQAESLNVAVAAGILIFSLI               245
```

Based on this analysis, it was predicted that these proteins and their epitopes could be useful antigens for vaccines or diagnostics.

A related GBS gene <SEQ ID 8839> and protein <SEQ ID 8840> were also identified. Analysis of this protein sequence reveals the following:

Lipop: Possible site: −1 Crend: 7
McG: Discrim Score: −7.98
GvH: Signal Score (−7.5): −3.86
Possible site: 37
>>> Seems to have no N-terminal signal sequence
ALOM program   count: 1 value: −3.03 threshold: 0.0
INTEGRAL      Likelihood = −3.03    Transmembrane 213-229 (212-229)
PERIPHERAL    Likelihood = 5.14     149
modified ALOM score: 1.11
*** Reasoning Step: 3
----- Final Results -----
    bacterial membrane --- Certainty = 0.2211 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
ORF02468(259-984 of 1287)
EGAD|107730|BS2859(4-246 of 248) hypothetical protein {Bacillus subtilis}
GP|1770029|emb|CAA99602.1||Z75208 hypothetical protein {Bacillus subtilis}
GP|2635330|emb|CAB14825.1||Z99118 similar to rRNA methylase {Bacillus subtilis}
PIR|G69984|G69984 rRNA methylase homolog ysgA - Bacillus subtilis
% Match = 20.3
% Identity = 43.0 % Similarity = 62.3
Matches = 105 Mismatches = 87 Conservative Sub.s = 47

186       216       246       276       306       330       360       390
A*RNPTP*TRPETIK*TFFIT*PLF*YNRXMTTIITSKSNNLIKKTKKLLQKKYR--KSSYLIEGWHLFEEAEKYGAQFL
                                          |  |  :|   |||    || |  :::||||  ||  |||  |
                                        MKQIESAKNQKVKDWKKLHTKKERTKTNTFLIEGEHLVEEALKSPGIVK
                                          10         20        30        40

417       444       474       504       534       564       594       624
NIFVT-ETAI-DRLRKPERAIVVTDDVLKELTDSQTPQGIVAEIAFQETRWTDIKKGRFLVLEDVQDPGNLGTMVRTADA
|:|   || |  |      :   ::::|  :   :|::::|||| |    |:        :  |::: ||||||||:|||||
EILVKDETRIPSDLETGIQCYMLSEDAFSAVTETETPQQIAAVCHMPEEKLA--TARKVLLIDAVQDPGNLGTMIRTADA
   60        70        80        90       100       110       120

654       684       714       744       774       804       834       864
ANFDAVFLSQKSADLYNQKTLRSMQGSHFHLPVFRVEIEQFVNFCKAEGITMIATTLSEQSVNYKNLPKYDYFALIMGNE
| :|||   :|| :| |||||| ||||||:||    :  :|:   ||||  |  :  |: :|: : ||||:|||
AGLDAVVLGDGTADAFNGKTLRSAQGSHFHIPVVRRNLPSYVDELKAEGVKVYGTAL-QNGAPYQEIPQSESFALIVGNE
  140       150       160       170       180       190       200

894       924       954       984      1014      1044      1074      1104
GQGISKTMTEEADVLAHIEMPGQAESLNVAVAAGVVIFSLI*VHML*YPQRGDYNEKVSRR*GLHGFGRSPY*PSTFPKT
| |:   : |: |:    ::  : |||||||||||| :::: |
GAGVDAALLEKTDLNLYVPLYGQAESLNVAVAAAILVYHLRG
                220       230       240
```

SEQ ID 8840 (GBS430) was expressed in *E. coli* as a His-fusion product. SDS-PAGE analysis of total cell extract is shown in FIG. 77 (lane 5; MW 29 kDa).

GBS430-GST was purified as shown in FIG. 220, lane 8.

Example 1550

A DNA sequence (GBSx1641) was identified in *S. agalactiae* <SEQ ID 4783> which encodes the amino acid sequence <SEQ ID 4784>. This protein is predicted to be acylphosphatase (acyP). Analysis of this protein sequence reveals the following:

Possible site: 48
>>> Seems to have an uncleavable N-term signal seq
----- Final Results -----
    bacterial membrane --- Certainty = 0.0000 (Not Clear) <succ>
      bacterial outside --- Certainty = 0.0000 (Not Clear) <succ>
        bacterial cytoplasm --- Certainty = 0.0000 (Not Clear) <succ>

A related GBS nucleic acid sequence <SEQ ID 10073> which encodes amino acid sequence <SEQ ID 10074> was also identified.

The protein has homology with the following sequences in the GENPEPT database.

```
>GP:AAD36630 GB:AE001801 acylphosphatase, putative [Thermotoga maritima]
Identities = 35/88 (39%), Positives = 52/88 (58%), Gaps = 3/88 (3%)

Query:   24   MKKVHLIVSGRVQGVGFRYATYSLALEIGDIYGRVWNNDDGTVEILAQSTDSNKMTQFIQ    83
              MK + + V G VQGVGFRY T  +A  +G + G V N DDG+V I A+   D N + +F+
Sbjct:    1   MKALKIRVEGIVQGVGFRYFTRRVAKSLG-VKGYVMNMDDGSVFIHAEG-DENALRRFLN   58

Query:   84   KIRKGPSKWSKVTYVDIKLDNFDDFNDF                                111
              ++ KGP   + VT V ++     + + DF
Sbjct:   59   EVAKGPPA-AVVTNVSVEETTPEGYEDF                                 85
```

A related DNA sequence was identified in *S. pyogenes* <SEQ ID 4785> which encodes the amino acid sequence <SEQ ID 4786>. Analysis of this protein sequence reveals the following:

Possible site: 34
>>> Seems to have no N-terminal signal sequence
----- Final Results -----
    bacterial cytoplasm --- Certainty = 0.2433 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below.

```
Identities = 69/95 (72%), Positives = 85/95 (88%)

Query:   19   KRGQVMKKVHLIVSGRVQGVGFRYATYSLALEIGDIYGRVWNNDDGTVEILAQSTDSNKM    78
              K    +M+KV LIVSGRVQGVGFRYAT++LAL+IGDIYGRVWNN+DGTVEILAQS DS+K+
Sbjct:    7   KEALLMQKVRLIVSGRVQGVGFRYATHTLALDIGDIYGRVWNNNDGTVEILAQSKDSDKI   66

Query:   79   TQFIQKIRKGPSKWSKVTYVDIKLDNFDDFNDFKM                          113
              FIQ++RKGPSKW+KVTYVD+ + NF+DF DF++
Sbjct:   67   ATFIQEVRKGPSKWAKVTYVDVTMANFEDFQDFQI                          101
```

Based on this analysis, it was predicted that these proteins and their epitopes could be useful antigens for vaccines or diagnostics.

Example 1551

A DNA sequence (GBSx1642) was identified in *S. agalactiae* <SEQ ID 4787> which encodes the amino acid sequence <SEQ ID 4788>. This protein is predicted to be membrane protein homolog (yidC). Analysis of this protein sequence reveals the following:

Possible site: 16
>>> May be a lipoprotein
    INTEGRAL    Likelihood = −12.52    Transmembrane 60-76 (54-83)
    INTEGRAL    Likelihood = −3.66    Transmembrane 178-194 (177-196)
    INTEGRAL    Likelihood = −2.76    Transmembrane 140-156 (137-157)
    INTEGRAL    Likelihood = −2.60    Transmembrane 216-232 (213-232)
----- Final Results -----
    bacterial membrane --- Certainty = 0.6010 (Affirmative) <succ>
      bacterial outside --- Certainty = 0.0000 (Not Clear) <succ>
        bacterial cytoplasm --- Certainty = 0.0000 (Not Clear) <succ>

A related GBS nucleic acid sequence <SEQ ID 10075> which encodes amino acid sequence <SEQ ID 10076> was also identified.

The protein has homology with the following sequences in the GENPEPT database.

```
>GP:AAF03934 GB:AF139908 membrane protein homolog [Listeria monocytogenes]
Identities = 82/222 (36%), Positives = 133/222 (58%), Gaps = 4/222 (1%)

Query:   44 PMANLITYFAQHQGLGFGVAIIIVTVIVRVVILPLGLYQSWKASYQAEKMAYFKPLFEPI    103
            P + I + A+  G  +G+AIII T+++R +I+PL L  +        KMA  KP  + I
Sbjct:    3 PFTSFIMFVAKFVGGNYGIAIIITTLLIRALIMPLNLRTAKAQMGMQSKMAVAKPEIDEI     62

Query:  104 NERLRNAKTQEEKLAAQTELMTAQRENGLSMFGGIGCLPLLIQMPFFSAIFFAARYTPGV    163
             RL+ A ++EE+   Q E+M   +  ++    +GCLPLLIQMP   A ++A R +  +
Sbjct:   63 QARLKRATSKEEQATIQKEMMAVYSKYNINPMQ-MGCLPLLIQMPILMAFYYAIRGSSEI    121

Query:  164 SSATFLGLNLGQKSLTLTVIIAILYFVQSWLSMQGVPDEQRQQMKTMMYLMPIMMVFMSI    223
            +S TFL  NLG  + L +I  ++Y Q ++SM G   EQ++QMK +  + PIM++F+S
Sbjct:  122 ASHTFLWFNLGSPDMVLAIIAGLVYLAQYFVSMIGYSPEQKKQMKIIGLMSPIMILFVSF    181

Query:  224 SLPASVALYWFIGGIFSIIQQLVT--TYVLK-PKLRRKVEEE                    262
            + P+++ALYW +GG+F   Q L+T   Y+ K P+++   +EE
Sbjct:  182 TAPSALALYWAVGGLFLAGQTLLTKKLYMNKHPEIKVMEQEE                    223
```

A related DNA sequence was identified in *S. pyogenes* <SEQ ID 4789> which encodes the amino acid sequence <SEQ ID 4790>. Analysis of this protein sequence reveals the following:

Possible site: 31
>>> May be a lipoprotein

| | | |
|---|---|---|
| INTEGRAL | Likelihood = −9.55 | Transmembrane 62-78 (54-82) |
| INTEGRAL | Likelihood = −2.81 | Transmembrane 178-194 (177-195) |
| INTEGRAL | Likelihood = −0.90 | Transmembrane 216-232 (215-232) |

----- Final Results -----
  bacterial membrane --- Certainty = 0.4821 (Affirmative) <succ>
  bacterial outside --- Certainty = 0.0000 (Not Clear) <succ>
  bacterial cytoplam --- Certainty = 0.0000 (Not Clear) <succ>

```
>GP:AAF03934 GB:AF139908 membrane protein homolog [Listeria monocytogenes]
Identities = 89/218 (40%), Positives = 132/218 (59%), Gaps = 2/218 (0%)

Query:   43 KPMSYFIDYFANNAGLGYGLAIIIVTIIVRTLILPLGLYQSWKASYQSEKMAFLKPVFEP    102
            +P + FI + A   G  YG+AIII T+++R LI+PL L  +        KMA  KP  +
Sbjct:    2 QPFTSFIMFVAKFVGGNYGIAIIITTLLIRALIMPLNLRTAKAQMGMQSKMAVAKPEIDE     61

Query:  103 INKRIKQANSQEEKMAAQTELMAAQRAHGINPLGGIGCLPLLIQMPFFSAMYFAAQYTKG    162
            I  R+K+A S+EE+   Q E+MA    +  INP+  +GCLPLLIQMP      A Y+A + +
Sbjct:   62 IQARLKRATSKEEQATIQKEMMAVYSKYNINPMQ-MGCLPLLIQMPILMAFYYAIRGSSE    120

Query:  163 VSTSTFMGIDLGSRSLVLTAIIAALYFFQSWLSMMAVSEEQREQMKTMMYTMPIMMIFMS    222
            +++ TF+  +LGS +VL I   +Y Q ++SM+  S EQ++QMK +    PIM++F+S
Sbjct:  121 IASHTFLWFNLGSPDMVLAIIAGLVYLAQYFVSMIGYSPEQKKQMKIIGLMSPIMILFVS    180

Query:  223 FSLPAGVGLYWLVGGFFSIIQQLITTYLLKPRLHKQIK                        260
            F+ P+ + LYW VGG F   Q L+T  L  + H +IK
Sbjct:  181 FTAPSALALYWAVGGLFLAGQTLLTKKLYMNK-HPEIK                        217
```

An alignment of the GAS and GBS proteins is shown below.

The protein has homology with the following sequences in the databases:

```
Identities = 203/309 (65%), Positives = 254/309 (81%), Gaps = 2/309 (0%)

Query:    1 MKKTLKRILFSSLSLSMLLLLTGCVSVDKAGKPYGVIWNTLGVPMANLITYFAQHQGLGF     60
            +K TL RILFS L+LS+LL LTGCV  D   G  G+IW  LG PM+  I YFA + GLG+
Sbjct:    1 LKLTLNRILFSGLALSILLTLTGCVGRDAHGNPKGMIWEFLGKPMSYFIDYFANNAGLGY     60

Query:   61 GVAIIIVTVIVRVVILPLGLYQSWKASYQAEKMAYFKPLFEPINERLRNAKTQEEKLAAQ    120
            G+AIIIVT+IVR +ILPLGLYQSWKASYQ+EKMA+ KP+FEPIN+R++  A +QEEK+AAQ
Sbjct:   61 GLAIIIVTIIVRTLILPLGLYQSWKASYQSEKMAFLKPVFEPINKRIKQANSQEEKMAAQ    120

Query:  121 TELMTAQRENGLSMFGGIGCLPLLIQMPFFSAIFFAARYTPGVSSATFLGLNLGQKSLTL    180
            TELM AQR +G++   GGIGCLPLLIQMPFFSA++FAA YT GVS++TF+G++LG +SL L
Sbjct:  121 TELMAAQRAHGINPLGGIGCLPLLIQMPFFSAMYFAAQYTKGVSTSTFMGIDLGSRSLVL    180

Query:  181 TVIIAILYFVQSWLSMQGVPDEQRQQMKTMMYLMPIMMVFMSISLPASVALYWFIGGIFS    240
            T IIA LYF QSWLSM   V +EQR+QMKTMMY MPIMM+FMS SLPA V LYW +GG FS
Sbjct:  181 TAIIAALYFFQSWLSMMAVSEEQREQMKTMMYTMPIMMIFMSFSLPAGVGLYWLVGGFFS    240
```

-continued

```
Query:  241  IIQQLVTTYVLKPKLRRKVEEEYTKNPPKAYKANNARKDVTNSTKATESNQAIITSKKTN   300
             IIQQL+TTY+LKP+L ++++EEY KNPPKAY++ ++RKDVT S    ++N +    K+N
Sbjct:  241  IIQQLITTYLLKPRLHKQIKEEYAKNPPKAYQSTSSRKDVTPSQNMEQAN--LPKKIKSN   298

Query:  301  RNAGKQKRR                                                     309
             RNAGKQ++R
Sbjct:  299  RNAGKQRKR                                                     307
```

A related GBS gene <SEQ ID 8841> and protein <SEQ ID 8842> were also identified. Analysis of this protein sequence reveals the following:

Lipop: Possible site: 23 Crend: 6
McG: Discrim Score: 8.74
GvH: Signal Score (-7.5): -1.47
Possible site: 16
>>> May be a lipoprotein
ALOM program    count: 4 value: -12.52 threshold: 0.0
INTEGRAL    Likelihood = -12.52    Transmembrane 60-76 (54-83)
INTEGRAL    Likelihood = -3.66    Transmembrane 178-194 (177-196)
INTEGRAL    Likelihood = -2.76    Transmembrane 140-156 (137-157)
INTEGRAL    Likelihood = -2.60    Transmembrane 216-232 (213-232)
PERIPHERAL    Likelihood = 0.74    235
modified ALOM score: 3.00
** Reasoning Step: 3
----- Final Results -----
    bacterial membrane --- Certainty = 0.6010 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
37.9/63.7% over 193aa
Bacillus subtilis
EGAD|45886| hypothetical 30.7 kd lipoprotein in glnq-ansr intergenic region precursor
Insert characterized
SP|P54544|YQJG_BACSU HYPOTHETICAL 30.7 KDA LIPOPROTEIN IN GLNQ-ANSR INTERGENIC REGION
PRECURSOR. Insert characterized
GP|1303958|dbj|BAA12613.1||D84432 YqjG Insert characterized
GP|2634823|emb|CAB14320.1||Z99116 similar to lipoprotein SpoIIIJ-like Insert
characterized
PIR|G69963|G69963 lipoprotein SpoIIIJ-like homolog yqjG - Insert characterized
ORF02470(478-1038 of 1530)
EGAD|45886|BS2384(63-256 of 275) hypothetical 30.7 kd lipoprotein in glnq-ansr intergenic
region precursor {Bacillus subtilis}SP|P54544|YQJG_BACSU HYPOTHETICAL 30.7 KDA LIPOPROTEIN
IN GLNQ-ANSR INTERGENIC REGION PRECURSOR.GP|1303958|dbj|BAA12613.1||D84432 YqjG {Bacillus
subtilis}GP|2634823|emb|CAB14320.1||Z99116 similar to lipoprotein SpoIIIJ-like {Bacillus
subtilis}PIR|G69963|G69963 lipoprotein SpoIIIJ-like homolog yqjG - Bacillus subtilis
% Match = 13.0
% Identity = 37.9 % Similarity = 63.7
Matches = 72 Mismatches = 65 Conservative Sub.s = 49

252       282       312       342       372       402       432       462
FCGSIV*FLKKK*NR*VY*KLEELKTLKKTLKRILFSSLSLSMLLLLTGCVSVDKAGKPYGVIWNTLGVPMANLITYFAQ

MLKTYQKLLAMGIFLIVLCSGNAAFAATNQVGGLSNVGFFHDYLIEPFSALLKGVAG
                             10        20        30        40        50

492       522       552       582       612       642       672       702
HQGLGFGVAIIIVTVIVRVVILPLGLYQSWKASYQAEKMAYFKPLFEPINERLRNAKTQEEKLAAQTELMTAQRENGLSM
 :|::||:||:|:|||:|||  :  |    ||||  ||  :  |:|   |: |   |   |  :  | :   :  ::
LFHGEYGLSIILVTIIVRIVVLPLFVNQFKKQRIFQEKMAVIKPQVDSIQVKLKKTKDPEKQKELQMEMMKLYQEHNINP
           70        80        90        100       110       120       130

732       762       792       822       852                 894       918
FGGIGCLPLLIQMPFFSAIFFAARYTPGVSSATFLGLNLGQKSLTLTVIIAILYFVQSW----LSMQ--GVPDE--QRQQ
 :||||||  |  :::  : ||  |  |:|  ::|  ::|||     |:|||||:||    :|:|| ||:   :|
-LAMGCLPMLIQSPIMIGLYYAIRSTPEIASHSFLWFSLGQSDILMSLSAGIMYFVQAYIAQKLSAKYSAVPQNPAAQQS
         150       160       170       180       190       200       210

948       978       1008      1038      1068      1098      1128      1158
MKTMMYLMPIMMVFMSISLPASVALYWFIGGIFSIIQQLVTTYVLKPKLRRKVEEEYTKNPPKAYKANNARKDVTNSTKA
 |  |:::  :||     |:::||||    |:|  |:|  :|     :| |   |         | |
AKLMVFIFPVMMTIFSLNVPAALPLYWFTSGLFLTVQNIVLQMTHHKSKKTAALTESVK
         230       240       250       260       270
```

```
37.2/62.0% over 220aa
Listeria monocytogenes
GP|6117974| membrane protein homolog Insert characterized
ORF02470(430-1086 of 1530)
GP|6117974|gb|AAF03934.1|AF139908_4|AF139908(3-223 of 237) membrane protein homolog
{Listeria monocytogenes}
% Match = 14.6
% Identity = 37.1 % Similarity = 62.0
Matches = 82 Mismatches = 81 Conservative Sub.s = 55

285       315       345       375       405       435       465       495
K*NR*VY*KLEELKTLKKTLKRILFSSLSLSMLLLLTGCVSVDKAGKPYGVIWNTLGVPMANLITYFAQHQGLGFGVAII
                                                        | ::| : |:  |  :|:|||
                                                        IQPFTSFIMFVAKFVGGNYGIAII
                                                               10        20

525       555       585       615       645       675       705       735
IVTVIVRVVILPLGLYQSWKASYQAEKMAYFKPLFEPINERLRNAKTQEEKLAAQTELMTAQRENGLSMFGGIGCLPLLI
| |:::|  :|:|| |  :        ||| || : |  ||: |  ::||:   |  |:   :   ::   :||||||
ITTLLIRALIMPLNLRTAKAQMGMQSKMAVAKPEIDEIQARLKRATSKEEQATIQKEMMAVYSKYNINP-MQMGCLPLLI
              40        50        60        70        80        90       100

765       795       825       855       885       915       945       975
QMPFFSAIFFAARYTPGVSSATFLGLNLGQKSLTLTVIIAILYFVQSWLSMQGVPDEQRQQMKTMMYLMPIMMVFMSISL
|||  : |::|  | :  ::| ||| :|||   : |  :|:: | |::|| |   ||::|||  : :  ||::|:|  :
QMPILMAFYYAIRGSSEIASHTFLWFNLGSPDMVLAIIAGLVYLAQYFVSMIGYSPEQKKQMKIIGLMSPIMILFVSFTA
        120       130       140       150       160       170       180

1005      1035           1086      1116      1146      1176      1206
PASVALYWFIGGIFSIIQQLVTT--YVLK-PKLRRKVEEEYTKNPPKAYKANNARKDVTNSTKATESNQAIITSKKTNRN
|:::||||  :||:|     |  |:    |:  | |:::      :||
PSALALYWAVGGLFLAGQTLLTKKLYMNKHPEIKVMEQEEKEFEQIVEEQKKEK
          200       210       220       230
```

Based on this analysis, it was predicted that these proteins and their epitopes could be useful antigens for vaccines or diagnostics.

Example 1552

A DNA sequence (GBSx1644) was identified in *S. agalactiae* <SEQ ID 4791> which encodes the amino acid sequence <SEQ ID 4792>. This protein is predicted to be amino acid ABC transporter, permease protein. Analysis of this protein sequence reveals the following:

```
----- Final Results -----
  bacterial membrane --- Certainty = 0.4991(Affirmative) <succ>
  bacterial outside --- Certainty = 0.0000 (Not Clear) <succ>
  bacterial cytoplasm --- Certainty = 0.0000 (Not Clear) <succ>
```

The protein has homology with the following sequences in the GENPEPT database.

```
>GP:CAB12131 GB:Z99105 similar to amino acid ABC transporter
(permease) [Bacillus subtilis]
Identities = 116/217 (53%), Positives = 168/217 (76%)
Query:   2 INWDAIFNLELAVKAFPSVIQGLPYTIGLSLVGFILGAIVGFFVALMKMSHFRLLRYLAN  61
             I W+ IFN +LA+++FP VI+G+ YT+ +S V    G ++G F++L +MS    LLR+ A
Sbjct:   5 IQWEYIFNTKLAIESFPYVIKGIGYTLLISFVSMFAGTVIGLFISLARMSKLALLRWPAK  64

Query:  62 IHISLMRGIPLMVLLFLIYFGLPFIGIQLDAVTASIVGFTMMSSAYISEIIRAALLAVDH 121
             ++IS MRG+P++V+LF++YFG P+IGI+   AVTA+++GF++ S+AYI+EI R+A+ +V+
Sbjct:  65 LYISFMRGVPILVILFILYFGFPYIGIEFSAVTAALIGFSLNSAAYIAEINRSAISSVEK 124

Query: 122 GQWEAARALGLKTPTIYRGIIIPQATRIALPSLSNVLLDMVKSSSLTAMITVPDIFNNAK 181
             GQWEAA +LGL       RGII+PQ+ RIALP L+NVLLD++K+SSL AMITVP++  +AK
Sbjct: 125 GQWEAASSLGLSYWQTMRGIILPQSIRIALPPLANVLLDLIKASSLAAMITVPELLQHAK 184

Query: 182 IVGGTYSDYMTAYILVALIYWVICTLYAIIQDWWEKR                        218
             I+GG    DYMT YIL ALIYW IC++ A+ Q+   EK+
Sbjct: 185 IIGGREFDYMTMYILTALIYWAICSIAAVFQNILEKK                        221
```

A related DNA sequence was identified in *S. pyogenes* <SEQ ID 4793> which encodes the amino acid sequence <SEQ ID 4794>. Analysis of this protein sequence reveals the following:

Possible site: 48
>>> Seems to have no N-terminal signal sequence
INTEGRAL    Likelihood = −9.98    Transmembrane 32-48 (23-53)
INTEGRAL    Likelihood = −9.18    Transmembrane 195-211 (189-213)
INTEGRAL    Likelihood = −8.70    Transmembrane 72-88 (62-93)

Possible site: 23
>>> Seems to have an uncleavable N-term signal seq

| INTEGRAL | Likelihood = −6.79 | Transmembrane 186-202 (184-205) |
| --- | --- | --- |
| INTEGRAL | Likelihood = −5.84 | Transmembrane 26-42 (21-43) |
| INTEGRAL | Likelihood = −4.78 | Transmembrane 57-73 (56-84) |
| INTEGRAL | Likelihood = −1.59 | Transmembrane 86-102 (86-103) |

----- Final Results -----
  bacterial membrane --- Certainty = 0.3718 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP:CAB12131 GB:Z99105 similar to amino acid ABC transporter
(permease) [Bacillus subtilis]
Identities = 113/214 (52%), Positives = 157/214 (72%)
Query:   1 MINIPLMKDSLGFVLSGLPYTLGISLLSFFTGLFLGLGLALLGRSRQPLIHYLVRAYISI   60
           + N  L  +S  +V+ G+ YTL IS +S F G  +GL ++L    S+  L+ +   + YIS
Sbjct:  10 IFNTKLAIESFPYVIKGIGYTLLISFVSMFAGTVIGLFISLARMSKLALLRWPAKLYISF   69

Query:  61 MRGVPMIVVLFVLYFGLPYYGLELPALLCAYLGFSMVSAAYISEVFRSSIEAIDKGQWEA  120
           MRGVP++V+LF+LYFG PY G+E   A+   A +GFS+  SAAYI+E+ RS+I +++KGQWEA
Sbjct:  70 MRGVPILVILFILYFGFPYIGIEFSAVTAALIGFSLNSAAYIAEINRSAISSVEKGQWEA  129

Query: 121 AKALGLPYALMVKKIILPQAFRIAVPPLGNVIIDMVKSSSLAAMITVPDIFQNAKIIGGR  180
           A +LGL Y    ++ IILPQ+ RIA+PPL NV++D++K+SSLAAMITVP++  Q+AKIIGGR
Sbjct: 130 ASSLGLSYWQTMRGIILPQSIRIALPPLANVLLDLIKASSLAAMITVPELLQHAKIIGGR  189

Query: 181 EWDYMSMYILVAFIYWLIAFLLERYQEFLENKLA                            214
           E+DYM+MYIL A IYW I  +    +Q  LE K A
Sbjct: 190 EFDYMTMYILTALIYWAICSIAAVFQNILEKKYA                            223
```

An alignment of the GAS and GBS proteins is shown below.

```
Identities = 110/213 (51%), Positives = 156/213 (72%)
Query:   7 IFNLELAVKAFPSVIQGLPYTIGLSLVGFILGAIVGFFVALMKMSHFRLLRYLANIHISL   66
           + N+ L   +   V+  GLPYT+G+SL+ F  G  +G  +AL+    S    L+ YL   +IS+
Sbjct:   1 MINIPLMKDSLGFVLSGLPYTLGISLLSFFTGLFLGLGLALLGRSRQPLIHYLVRAYISI   60

Query:  67 MRGIPLMVLLFLIYFGLPFIGIQLDAVTASIVGFTMMSSAYISEIIRAALLAVDHGQWEA  126
           MRG+P++V+LF++YFGLP+ G++L A+   +GF+M+S+AYISE+ R+++ A+D GQWEA
Sbjct:  61 MRGVPMIVVLFVLYFGLPYYGLELPALLCAYLGFSMVSAAYISEVFRSSIEAIDKGQWEA  120

Query: 127 ARALGLKTPTIYRGIIIPQATRIALPSLSNVLLDMVKSSSLTAMITVPDIFNNAKIVGGT  186
           A+ALGL     + + II+PQA RIA+P L NV++DMVKSSSL AMITVPDIF NAKI+GG
Sbjct: 121 AKALGLPYALMVKKIILPQAFRIAVPPLGNVIIDMVKSSSLAAMITVPDIFQNAKIIGGR  180

Query: 187 YSDYMTAYILVALIYWVICTLYAIIQDWWEKRL                            219
              DYM+ YILVA IYW+I  L    Q++ E +L
Sbjct: 181 EWDYMSMYILVAFIYWLIAFLLERYQEFLENKL                            213
```

Based on this analysis, it was predicted that these proteins and their epitopes could be useful antigens for vaccines or diagnostics.

Example 1553

A DNA sequence (GBSx1645) was identified in *S. agalactiae* <SEQ ID 4795> which encodes the amino acid sequence <SEQ ID 4796>. Analysis of this protein sequence reveals the following:

Possible site: 18
>>> May be a lipoprotein
----- Final Results -----
  bacterial membrane --- Certainty = 0.0000 (Not Clear) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

```
>GP:CAB12132 GB:Z99105 similar to amino acid ABC transporter
(binding protein) [Bacillus subtilis]
```

```
Identities = 127/276 (46%), Positives = 183/276 (66%), Gaps = 12/276 (4%)
Query:    3 KTILLGLVGLSAMTLAACS--NGQSSKETTWDNIKKDGVLKVATPATLYPTSYYDDHK--   58
            K ++       + LAACS  N   SK+T W+ IK  G + VAT TLYPTSY+D
Sbjct:    8 KAVIFSFTMAFFLILAACSGKNEADSKDTGWEQIKDKGKIVVATSGTLYPTSYHDTDSGS   67

Query:   59 -KLTGYEIDMMKAIAKKLKIKVKFVEVGVAESFTSVDSGKVDVAVNNFDTTPERLKKYNF  117
             KLTGYE+++++  AK+L +KV+F E+G+    T+V+SG+VD A N+ D T +R +K+ F
Sbjct:   68 DKLTGYEVEVVREAAKRLGLKVEFKEMGIDGMLTAVNSGQVDAAANDIDVTKDREEKFAF  127

Query:  118 SQPYKYSVGGMIVRADGSSKITAKDLSDWKGKKAGGGAGTQYMKIAKQQGAEPVIYDNVT  177
            S PYKYS G   IVR D  S I  K L D KGKKA G A T YM++A++ GA+ VIYDN T
Sbjct:  128 STPYKYSYGTAIVRKDDLSGI--KTLKDLKGKKAAGAATTVYMEVARKYGAKEVIYDNAT  185

Query:  178 NDVYLRDVSTGRTDFIPNDYYTQVIAVKYVTKQYPDIKVKM-GDVKYNPTEQGIVMSKKD  236
            N+ YL+DV+ GRTD I NDYY Q +A+        +PD+ + +   D+KY P +Q +VM K +
Sbjct:  186 NEQYLKDVANGRTDVILNDYYLQTLAL----AAFPDLNITIHPDIKYMPNKQALVMKKSN  241

Query:  237 KSLKTKIDAAIKDMKKDGSLKKISEKYYAGQDLTKE                         272
            +L+ K++ A+K+M KDGSL K+S++++   D++K+
Sbjct:  242 AALQKKMNEALKEMSKDGSLTKLSKQFFNKADVSKK                         277
```

There is also homology to SEQ ID 1190.

SEQ ID 4796 (GBS183) was expressed in *E. coli* as a His-fusion product. SDS-PAGE analysis of total cell extract is shown in FIG. 26 (lane 2; MW 33 kDa).

GBS183-His was purified as shown in FIG. 199, lane 7.

Based on this analysis, it was predicted that this protein and its epitopes, could be useful antigens for vaccines or diagnostics.

Example 1554

A DNA sequence (GBSx1646) was identified in *S. agalactiae* <SEQ ID 4797> which encodes the amino acid sequence <SEQ ID 4798>. Analysis of this protein sequence reveals the following:

Possible site: 61
>>> Seems to have no N-terminal signal sequence
----- Final Results -----
  bacterial cytoplasm --- Certainty = 0.1514 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:AAF09821 GB:AE001885  6-aminohexanoate-cyClic-dimer hydrolase
[Deinococcus radiodurans]
Identities = 178/488 (36%), Positives = 265/488 (53%), Gaps = 17/488 (3%)
Query:    5 DATAMVQAIKQHKISSQELVEQAIYKIEEQNVSVNAVVSKQYNEARQAAKYANESNA---   61
            DA + Q  ++ ++S++++   AI++ + NV++NAVV   Y++    A+  + + A
Sbjct:   54 DALDLAQLFRRGELSAEDMCTAAIHRAQVVNVALNAVVYPLYDQGLAQARATDAARARGE  113

Query:   62 ----PFAGVPILLKDLGQNQKGQLSTSGSQLFKHYHAKQTDYLVQSFEKLGFIILGRTNT  117
                PFAGVP L+KD G    G    T G++ ++       + D LV+ ++   G + LG+TNT
Sbjct:  114 QATGPFAGVPFLVKDFGSRLAGVPHTGGTRAYRDQIPEWDDELVRRWQAAGLLPLGKTNT  173

Query:  118 PEFGFKNISDGQLHGNVNLPFDHSRNAGGSSGGAAAAVSSGMVPIAGASDGGGSIRIPAS  177
            PEF    +++ +LHG       P+D   R   GGSSGG+A+AV++G+VP+AGA DGGGSIRIPAS
Sbjct:  174 PEFALMGVTEPELHGPTRNPWDLGRTPGGSSGGSASAVAAGIVPLAGAGDGGGSIRIPAS  233

Query:  178 FNGLIGLKPSRGRIPVGPSSYRGWQGASSHFALTKSVRDTKRLLYYLQSYQVES----PF  233
            GL  GLKPSRGR+P G       WQGA+    LT+SVRD+ LL   Q   +    P
Sbjct:  234 CCGLFGLKPSRGRVPCGDGVGEPWQGAAVEHVLTRSVRDSAALLDLEQGPDAGAALFLPS  293

Query:  234 PLKKLSKESLFEFSVSKPKLKLAVLMDSPLKTKVSSEAKAAIKEAADFLSQKGNHLELVEQ  293
            P +  S+E   E    L+I      PL    V  E   AA++ AA  L    G+ +E V
Sbjct:  294 PERPYSEEVGRE---PGRLRIGFSTAHPLGRSVHPECVAAVQGAARLLESLGHEVEEVAL  350

Query:  294 PLDGIHSMKTYCMMNSVETAAMFDDIEKSLGRSMEFSDMELMTWAMYQSGQRVLAKDYSK  353
            P DG    + + M+   ET A   +     +LGR     SD+E +TW + Q G+    A D++
Sbjct:  351 PWDGPALAQAFLMLYFGETGASLAALRDTLGRPARASDVEAVTWLLGQLGRSYSAADFAA  410

Query:  354 LLDSWDQFAATMARFHENYDLILTAATNQPAPFHGQFD---LDETLQKQLRHMGEFSVSE  410
                SW+  A  M  RFH+NYDL+LT       P    G+     +     L +   + M      +
Sbjct:  411 ARASWNVHARAMGRFHQNYDLLLTPVLATPPLQIGELQPRGVQAALLRAAQQMDVSGLLR  470

Query:  411 QQDLIWKMFEDSMAWTPFTHQPNLTGQPSLAIPTHLTKEGLPLGVQLTAAKGREDLLLAV  470
              +   +  + D  +    P+T    NLTGQP++++P H T +GLP+GVQ  A   RED+LL +
Sbjct:  471 RSGQVDALATDILEKMPYTQLANLTGQPAMSVPLHWTADGLPVGVQFVAPLAREDVLLRL  530

Query:  471 AELFEKEK                                                      478
            A   E+ +
Sbjct:  531 AGQLEQAR                                                      538
```

A related DNA sequence was identified in *S. pyogenes* <SEQ ID 4047> which encodes the amino acid sequence <SEQ ID 4048>. Analysis of this protein sequence reveals the following:

```
Possible site: 15
>>> Seems to have an uncleavable N-term signal seq
----- Final Results -----
   bacterial membrane --- Certainty = 0.0000 (Not Clear) <succ>
   bacterial outside --- Certainty = 0.0000 (Not Clear) <succ>
   bacterial cytoplasm --- Certainty = 0.0000 (Not Clear) <succ>
```

An alignment of the GAS and GBS proteins is shown below.

```
Identities = 277/484 (57%), Positives = 348/484 (71%), Gaps = 2/484 (0%)
Query:   1 MVFKDATAMVQAIKQHKISSQELVEQAIYKIEEQNVSVNAVVSKQYNEARQAAKYANESN   60
           M ++DATAM A++ + +  ELV QAIYK ++ N ++NA+ S+++  A + AK  + S
Sbjct:   1 MTYQDATAMAIAVQTGQTTPLELVTQAIYKAKKLNPTLNAITSERFEAALEEAKQRDFSG   60

Query:  61 APFAGVPILLKDLGQNQKGQLSTSGSQLFKHYHAKQTDYLVQSFEKLGFIILGRTNTPEF  120
              PFAGVP+ LKDLGQ  KG  STSGS+LFK Y A +TD  V+  E LGFIILGR+NTPEF
Sbjct:  61 LPFAGVPLFLKDLGQELKGHSSTSGSRLFKEYQATKTDLFVKRLEALGFIILGRSNTPEF  120

Query: 121 GFKNISDGQLHGNVNLPFDHSRNAGGSSGGAAAAVSSGMVPIAGASDGGGSIRIPASFNG  180
           GFKNISD  LHG VNLP D++RNAGGSSGGAAA VSSG+  +A ASDGGGSIRIPASFNG
Sbjct: 121 GFKNISDSSLHGPVNLPRDNTRNAGGSSGGAAALVSSGISALATASDGGGSIRIPASFNG  180

Query: 181 LIGLKPSRGRIPVGPSSYRGWQGASSHFALTKSVRDTKRLLYYLQSYQVESPFPLKKLSK  240
           LIGLKPSRGR+PVGP SYR WQGAS HFALTKSVRDT+ LLYYLQ  Q+ESPFPL  L+K
Sbjct: 181 LIGLKPSRGRMPVGPGSYRSWQGASVHFALTKSVRDTRNLLYYLQMEQMESPFPLATLTK  240

Query: 241 ESLFEFSVSKPLKIAVLMDSPLKTKVSSEAKAAIKEAADFLSQKGNHL-ELVEQPLDGIH  299
           +S+++ S+ +PL IA       + VS +  A+++A +L ++G+ L EL E P++
Sbjct: 241 DSIYQ-SLQRPLTIAFYQRLSDGSPVSLDTAKALRQAVTWLREQGHQLVELEEFPVNMTE  299

Query: 300 SMKTYCMMNSVETAAMFDDIEKSLGRSMEFSDMELMTWAMYQSGQRVLAKDYSKLLDSWD  359
           ++ Y +MNSVETAAMF DIE + GR M  DME MTWA+YQSG+  + A  YS++L  WD
Sbjct: 300 VIRHYYIMNSVETAAMFADIEDTFGRPMTKDDMETMTWAIYQSGKDIPAWRYSQVLQKWD  359

Query: 360 QFAATMARFHENYDLILTAATNQPAPFHGQFDLDETLQKQLRHMGEFSVSEQQDLIWKMF  419
            ++ATMA FHE YDL+LT  TN PAP HG+  D L  L    FS  EQ +L+ MF
Sbjct: 360 TYSATMASFHETYDLLLTFTTNTPAPKHGELVPDSKLMANLAQAEIFSSEEQFNLVETMF  419

Query: 420 EDSMAWTPFTHQPNLTGQPSLAIPTHLTKEGLPLGVQLTAAKGREDLLLAVAELFEKEKQ  479
             S+A  P+T  PNLTGQP++++PT+ TKEGL +G+QL AAKGREDLLL +AE FE
Sbjct: 420 GKSLAINPYTALPNLTGQPAISLPTYETKEGLSMGIQLIAAKGREDLLLGIAEQFEAAGL  479

Query: 480 FKGP  483
             K P
Sbjct: 480 LKIP  483
```

Based on this analysis, it was predicted that these proteins and their epitopes could be useful antigens for vaccines or diagnostics.

Example 1555

A DNA sequence (GBSx1647) was identified in *S. agalactiae* <SEQ ID 4799> which encodes the amino acid sequence <SEQ ID 4800>. This protein is predicted to be transcription elongation factor (greA). Analysis of this protein sequence reveals the following:

```
Possible site: 53
>>> Seems to have no N-terminal signal sequence
----- Final Results -----
   bacterial cytoplasm --- Certainty = 0.5003 (Affirmative) <succ>
   bacterial membrane --- Certainty = 0.0000 (Not Clear) <succ>
   bacterial outside --- Certainty = 0.0000 (Not Clear) <succ>
```

The protein has homology with the following sequences in the GENPEPT database.

```
>GP:CAB14674 GB:Z99117 transcription elongation factor [Bacillus subtilis]
Identities = 86/154 (55%), Positives = 114/154 (73%), Gaps = 1/154 (0%)
Query:   3 EKTYPMTQVEKDQLEKELEELKLVRRPEVVERIKIARSYGDLSENSEYDAAKDEQAFVEG   62
           EK +PMT  K +LE+ELE LK V+R EVVERIKIARS+GDLSENSEYD+AK+EQAFVEG
Sbjct:   4 EKVFPMTAEGKQKLEQELEYLKTVKRKEVVERIKIARSEGDLSENSEYDSAKEEQAFVEG   63

Query:  63 QIQILETKIRYAEIIDSDAVAKDEVAIGKTVLVQEVGTNDKDTYHIVGAAGADIFSGKIS  122
           ++  LE  IR A+II+ D   + V +GKTV    E+  D+++Y IVG+A AD F GKIS
Sbjct:  64 RVTTLENMIRNAKIIEDDG-GSNVVGLGKTVTFVELPDGDEESYTIVGSAEADPFEGKIS  122
```

```
Query: 123 NESPIAHALIGKKTGDLATIESPAGSYQVEIISV           156
            N+SPIA +L+GKK  +  T+++P G    V+I+ +
Sbjct: 123 NDSPIAKSLLGKRVDEEVTVQTPGGEMLVKIVKI           156
```

A related DNA sequence was identified in *S. pyogenes* <SEQ ID 4801> which encodes the amino acid sequence <SEQ ID 4802>. Analysis of this protein sequence reveals the following:

Possible site: 27
>>> Seems to have no N-terminal signal sequence
----- Final Results -----
   bacterial cytoplasm --- Certainty = 0.4434 (Affirmative) <succ>
      bacterial membrane --- Certainty = 0.0000 (Not Clear) <succ>
         bacterial outside --- Certainty = 0.0000 (Not Clear) <succ>

Possible site: 58
>>> Seems to have no N-terminal signal sequence
INTEGRAL     Likelihood = –13.64   Transmembrane 238-254 (230-260)
----- Final Results -----
   bacterial membrane --- Certainty = 0.6456 (Affirmative) <succ>
      bacterial outside --- Certainty = 0.0000 (Not Clear) <succ>
         bacterial cytoplasm --- Certainty = 0.0000 (Not Clear) <succ>

An alignment of the GAS and GBS proteins is shown below.

The protein has homology with the following sequences in the GENPEPT database.

```
Identities = 145/160 (90%), Positives = 149/160 (92%)
Query:   1 MAEKTYPMTQVEKDQLEKELEELKLVRRPEVVERIKIARSYGDLSENSEYDAAKDEQAFV   60
           MAEKTYPMT  EK+QLEKELEELKLVRRPE+VERIKIARSYGDLSENSEYDAAKDEQAFV
Sbjct:  17 MAEKTYPMTLTEKEQLEKELEELKLVRRPEIVERIKIARSYGDLSENSEYDAAKDEQAFV   76

Query:  61 EGQIQILETKIRYAEIIDSDAVAKDEVAIGKTVLVQEVGTNDKDTYHIVGAAGADIFSGK  120
           EGQI  LETKIRYAEIIDSDAVAKDEVAIGKTV+VQEVGT DKDTYHIVGAAGADIFSGK
Sbjct:  77 EGQISTLETKIRYAEIIDSDAVAKDEVAIGKTVIVQEVGTTDKDTYHIVGAAGADIFSGK  136

Query: 121 ISNESPIAHALIGKKTGDLATIESPAGSYQVEIISVEKTN                      160
           ISNESPIA ALIGKKTGD   IESPA +Y VEIISVEKTN
Sbjct: 137 ISNESPIAQALIGKKTGDKVRIESPAATYDVEIISVEKTN                      176
```

Based on this analysis, it was predicted that these proteins and their epitopes could be useful antigens for vaccines or diagnostics.

Example 1556

A DNA sequence (GBSx1648) was identified in *S. agalactiae* <SEQ ID 4803> which encodes the amino acid sequence

```
>GP:AAF77615 GB:AF151720 aminodeoxychorismate lyase-like protein
[Streptococcus thermophilus]

Identities = 135/210 (64%), Positives = 171/210 (81%)
Query: 373 KTTSTPYKADDFLKLVQDETFIKKMVAKYPNLLGSLPDKSKAIYQLEGYLFPATYNYYKD  432
           K +ST  K  DFLKL++D+ FI KM AKYP LL +LP+ + A Y LEGYLFPATYN + D
Sbjct:   5 KHSSTGLKEKDFLKLMKDDAFITKMKAKYPTLLANLPNSTDAKYVLEGYLFPATYNIHDD   64

Query: 433 TTLEGLVEDMISTMNTKMAPYYNTIKAKNMSVNDVLTLSSLVEKEGSTDEDRRKIASVFY  492
           TT+E L E+M+ TM+T ++PYY TI + N +VN++LTL+SLVEKEG+TD+DR+ IASVFY
Sbjct:  65 TTVESLAEEMLFTMDTHLSPYYATILSSNHNVNEILTLASLVEKEGATDDDRKNIASVFY  124

Query: 493 NRLSAGQALQSNIAILYAMGKLGDKTSLAEDAQINTSIKSPYNIYTNTGLMPGPVDSPSI  552
           NRL++  ALQSNIA+LY +GKLG +T+L EDA I+T+I SPYN Y + GLMPGPVDSPS+
Sbjct: 125 NRLNSDMALQSNIAVLYVLGKLGQETTLKEDATIDTNIDSPYNDYVHKGLMPGPVDSPSL  184

Query: 553 SAIEATIKPASTDYLYFVADVKTGNVYYAK                                582
           SAIEA I P+ST Y+YFVADV TGNVY+A+
Sbjct: 185 SAIEAVINPSSTKYMYFVADVSTGNVYFAE                                214
```

<SEQ ID 4804>. This protein is predicted to be aminodeoxychorismate lyase-like protein. Analysis of this protein sequence reveals the following:

A related DNA sequence was identified in *S. pyogenes* <SEQ ID 4805> which encodes the amino acid sequence <SEQ ID 4806>. Analysis of this protein sequence reveals the following:

```
Possible site: 59
>>> Seems to have no N-terminal signal sequence
INTEGRAL      Likelihood = -7.91    Transmembrane 161-177 (155-183)
----- Final Results -----
   bacterial membrane --- Certainty = 0.4163 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the databases:

```
>GP:AAF77615 GB:AF151720 aminodeoxychorismate lyase-like protein
[Streptococcus thermophilus]
Identities = 135/212 (63%), Positives = 161/212 (75%)
Query: 295  KTKKAKTPFNEKDFLDLVTDEAFIQDMVKRYPKLLATIPTKEKAIYRLEGYLFPATYNYY  354
            K K + T    EKDFL L+ D+AFI  M  +YP LLA +P    A Y LEGYLFPATYN +
Sbjct:   3  KGKHSSTGLKEKDFLKLMKDDAFITKMKAKYPTLLANLPNSTDAKYVLEGYLFPATYNTH   62

Query: 355  KETTMRELVEDMLAAMDATLVPYYDKIAASGKTVNEVLTLASLVEKEGSTDDDRRQIASV  414
             +TT+  L E+ML MD  L PYY  I +S    VNE+LTLASLVEKEG+TDDDR+ IASV
Sbjct:  63  DDTTVESLAEEMLFTMDTHLSPYYATILSSNHNVNEILTLASLVEKEGATDDDRKNIASV  122

Query: 415  FYNRLNSGMALQSNIAILYAMGKLGEKTTLAEDATIDTTINSPYNIYTNTGLMPGPVASS  474
            FYNRLNS MALQSNIA+LY +GKLG++TTL EDATIDT I+SPYN Y + GLMPGPV S
Sbjct: 123  FYNRLNSDMALQSNIAVLYVLGKLGQETTLKEDATIDTNIDSPYNDYVHKGLMPGPVDSP  182

Query: 475  GVSAIEATLNPASTDYLYFVANVHTGEVYYAK                             506
            +SAIEA +NP+ST Y+YFVA+V TG VY+A+
Sbjct: 183  SLSAIEAVINPSSTKYMYFVADVSTGNVYFAE                             214
```

An alignment of the GAS and GBS proteins is shown below.

```
Identities = 310/603 (51%), Positives = 403/603 (66%), Gaps = 86/603 (14%)
Query:   1  MTEFNDDQHSNHDQKSFKEQILAELEEANRLRKLREEELYQKEQEAKEAARRTAQLMADY   60
            +T+F D    + Q+SFKEQILAELE+AN++RK +EEEL+
Sbjct:   3  LTDFKDKDQQDQ-QRSFKEQILAELEKANQIRKEKEEELF--------------------   41

Query:  61  EAQRLKDEREARAKALETKQRLEEQEKARIEAKLLAEAAREEERRQAEQALASQEEQVIN  120
                              ++ LE +E AR  A+L AE  R++        A Q+E + +
Sbjct:  42  -----------------QKELEAREAARRTAQLYAEYKRQD---------AFQKESIAH   74

Query: 121  QGMEPSRELDSGSKSSEFRTTENVPDIDLKADKTDVATAVPNQETEEIFLVRATDIPTEG  180
                         +T ++       +A K  V T+   + T         + +E
Sbjct:  75  NN---------------KTAKH-----FQAIKGAVMTSEALKPT----------LLSEK  103

Query: 181  ENVKLGEISELEPVAKEPIRVEDLSKEEEGIALSAKNKHNKRER---RQKADNVAKRIAR  237
            EN  L  ++     A E   +++ + +E  + L+ +   H+ R +    RQ+ +   AK+I+
Sbjct: 104  ENSSLKTINKRVVQANE---LQETASKESQVPLTIEKGHSVRRKLSKRQQTERAAKKIST  160

Query: 238  ILISIIILVLLLTAFVGYRFVDSAIKPVDSNSNKFVQVEIPIGSGNKLIGQILEKAGVIK  297
            +LIS II+ LL     G  +V SA+ PVD NS+ FVQVEIP GSGNKLIGQIL+K G+IK
Sbjct: 161  VLISSIIIILLAVTLAGAGYVYSALNPVDKNSDAFVQVEIPSGSGNKLIGQILQKKGLIK  220

Query: 298  SATVFNYYSKFKNYSNFQSGYYNDKKSMTLDQIAAELEKGGTAEPTKPALGKILITEGYT  357
            ++TVF++Y+ +KFKN++NFQSGYYNL+KSM+L++IA+  L++GGTAEPTKP LGKILI  EGYT
Sbjct: 221  NSTVFSFYIKFKNFINFQSGYYNLQKSMSLEEIASALQEGGTAEPTKPSLGKILIPEGYT  280

Query: 358  IKQIAKAIESN-KIDTKITSTPYKADDFLKLVQDETFIKKMVAKYPNLLGSLPDKSKAIY  416
            IKQIAKA+E N K  TK    TP+   DFL LV DE FI+ MV +YP LL ++P K KAIY
Sbjct: 281  IKQIAKAVEHNSKGKTKKAKTPFNEKDFLDLVTDEAFIQDMVKRYPKLLATIPTKEKAIY  340

Query: 417  QLEGYLFPATYNYYKDTTLEGLVEDMISTMNIKMAPYYNTIKAKNMSVNDVLTLSSLVEK  476
            +LEGYLFPATYNYYK+TT+   LVEDM++  M+   + PYY+  I A     +VN+VLTL+SLVEK
Sbjct: 341  RLEGYLFPATYNYYKETTMRELVEDMLAAMDATLVPYYDKIAASGKIVNEVLTLASLVEK  400

Query: 477  EGSTDEDRRKIASVFYNRLSAGQALQSNIAILYAMGKLGDKTSLAEDAQINTSIKSPYNI  536
            EGSTD+DRR+IASVFYNRL++G ALQSNIAILYAMGKLG+KT+LAEDA I+T+I SPYNI
Sbjct: 401  EGSTDDDRRQIASVFYNRLNSGMALQSNIAILYAMGKLGEKTTLAEDATIDTTINSPYNI  460

Query: 537  YTNTGLMPGPVDSPSISAIEATIKPASTDYLYFVADVKIGNVYYAKDFETHKANVEKYIN  596
            YTNTGLMPGPV S  +SAIEAT+ PASTDYLYFVA+V  TG VYYAK FE H  ANVEKY+N
Sbjct: 461  YTNTGLMPGPVASSGVSAIEATLNPASTDYLYFVANVHIGEVYYAKTFEEHSANVEKYVN  520
```

Query: 597 SQI 599
          SQI
Sbjct: 521 SQI 523

A related GBS gene <SEQ ID 8843> and protein <SEQ ID 8844> were also identified. Analysis of this protein sequence reveals the following:

Lipop: Possible site: -1  Crend: 8
McG: Discrim Score: -17.88
GvH: Signal Score (-7.5): -3.51
Possible site: 58
>>> Seems to have no N-terminal signal sequence
ALOM program    count: 1 value: -13.64   threshold: 0.0
INTEGRAL        Likelihood = -13.64      Transmembrane 238-254
                                         (230-260)
PERIPHERAL      Likelihood = 5.78        285
modified ALOM score: 3.23
*** Reasoning Step: 3
----- Final Results -----
    bacterial membrane --- Certainty = 0.6456 (Affirmative) <succ>
       bacterial outside --- Certainty = 0.0000 (Not Clear) <succ>
          bacterial cytoplasm --- Certainty = 0.0000 (Not Clear) <succ>

The protein has homology with the following sequences in the databases:

```
ORF00931(1417-2046 of 2400)
GP|8574530|gb|AAF77615.1|AP151720_1|AF151720(5-214 of 214) aminodeoxychorismate
lyase-like protein {Streptococcus thermophilus}
% Match = 17.5
% Identity = 64.3 % Similarity = 81.4
Matches = 135 Mismatches = 39 Conservative Sub.s = 36

1236      1266      1296      1326      1356      1386      1416      1446
NYYSKFKNYSNFQSGYYNLKKSMTLDQIAAELEKGGTAEPTKPALGKILITEGYTIKQIAKAIESNKIDTKTTSTPYKAD
                                                                 |  :||    |
                                                                 AKKGKHSSTGLKEK
                                                                        10

1476      1506      1536      1566      1596      1626      1656      1686
DFLKLVQDETFIKKMVAKYPNLLGSLPDKSKAIYQLEGYLFPATYNYYKDTTLEGLVEDMISTMNTKMAPYYNTIKAKNM
|||||::|:  ||  ||  ||||  ||  :||:  :  |  | |||||||||||  :  |||:|  |  |:|:  ||:|  ::|||  ||  :  |
DFLKLMKDDAFITKMKAKYPTLLANLPNSTDAKYVLEGYLFPATYNIHDDTTVESLAEEMLFTMDTHLSPYYATILSSNH
         30        40        50        60        70        80        90

1716      1746      1776      1806      1836      1866      1896      1926
SVNDVLTLSSLVEKEGSTDEDRRKIASVFYNRLSAGQALQSNIAILYAMGKLGDKTSLAEDAQINTSIKSPYNIYTNTGL
:||::|||:|||||||:||:||: ||||||||||::  ||||||||:||  :||||  :|:|  |||  |:|:|  ||||  |  :  ||
NVNEILTLASLVEKEGATDDDRKNIASVFYNRLNSDMALQSNIAVLYVLGKLGQETTLKEDATIDTNIDSPYNDYVHKGL
         110       120       130       140       150       160       170

1956      1986      2016      2046      2076      2106      2136      2166
MPGPVDSPSISAIEATIKPASTDYLYFVADVKTGNVYYAKDFETHKANVEKYINSQIN*AYKHGASHHVYIFDLKK*KEK
||||||||||:||||||  |:|| |:||||||  |||||:|:
MPGPVDSPSLSAIEAVINPSSTKYMYFVADVSTGNVYFAE
         190       200       210
```

SEQ ID 8844 (GBS370) was expressed in *E. coli* as a His-fusion product. SDS-PAGE analysis of total cell extract is shown in FIG. 64 (lane 6; MW 70 kDa).

GBS370-His was purified as shown in FIG. 209, lane 10.

Based on this analysis, it was predicted that these proteins and their epitopes could be useful antigens for vaccines or diagnostics.

Example 1557

A DNA sequence (GBSx1649) was identified in *S. agalactiae* <SEQ ID 4807> which encodes the amino acid sequence <SEQ ID 4808>. Analysis of this protein sequence reveals the following:

Possible site: 53
>>> Seems to have no N-terminal signal sequence
----- Final Results -----
    bacterial cytoplasm --- Certainty = 0.0183 (Affirmative) <succ>
       bacterial membrane --- Certainty = 0.0000 (Not Clear) <succ>
          bacterial outside --- Certainty = 0.0000 (Not Clear) <succ>

A related GBS nucleic acid sequence <SEQ ID 10077> which encodes amino acid sequence <SEQ ID 10078> was also identified.

The protein has homology with the following sequences in the GENPEPT database.

```
>GP:CAA98889 GB:Z74367 ORF YDR071c [Saccharomyces cerevisiae]
Identities = 52/174 (29%), Positives = 81/174 (45%), Gaps = 18/174 (10%)
```

```
Query:   27  MSMIIRMGCLEDLQQVISIEQINFSEAEAASKKAMQERLTIMTDT---FLVAEINGR---   80
             + M IR  +EDL+Q++++E   F   E AS++ + RL     +  + EI G+
Sbjct:   10  LHMYIRPLIIEDLKQILNLESQGFPPNERASEEIISFRLINCPELCSGLFIREIEGKEVK   69

Query:   81  ---LAGYIEGPVIKGRYLTDDLFHKVSEFPVRVGGFIGITSLSIHPDFKGQGIGTALLAA  137
                 L G+I G  I   Y+T +   K+    V   IGI S+ I P+++ + + T LL
Sbjct:   70  KETLIGHIMGTKIPHEYITIESMGKLQ---VESSNHIGIHSVVIKPEYQKKNLATLLLTD  126

Query:  138  MKDLVVSQE-RDGISLTCHDDLISFYEMNGFKDEGES-----DSKHGGSLWYNM        185
             + +QE  + I L  H+ LI FYE   GFK   E+       D         W +M
Sbjct:  127  YIQKLSNQEIGNKIVLIAHEPLIPFYERVGFKIIAENTNVAKDKNFAEQKWIDM       180
```

A related DNA sequence was identified in *S. pyogenes* <SEQ ID 4809> which encodes the amino acid sequence <SEQ ID 4810>. Analysis of this protein sequence reveals the following:

Possible site: 15
>>> Seems to have no N-terminal signal sequence
----- Final Results -----
   bacterial cytoplasm --- Certainty = 0.2576 (Affirmative) <succ>
       bacterial membrane --- Certainty = 0.0000 (Not Clear) <succ>
          bacterial outside --- Certainty = 0.0000 (Not Clear) <succ>

An alignment of the GAS and GBS proteins is shown below.

```
Identities = 87/159 (54%), Positives = 117/159 (72%), Gaps = 1/159 (0%)
Query:   29  MIIRNGCLEDLQQVISIEQINFSEAEAASKKAMQERLTIMIDTFLVAEINGRLAGYIEGP   88
             M+IR    DL+ + +IE  NFS  EA ++  ++E + ++ DTFLVA I+  + GYIEGP
Sbjct:    1  MLIRQVQGSDLEVIATIESDNFSPQEATTRAVLEEHIRLIPDTFLVALIDQEIVGYIEGP   60

Query:   89  VIKGRYLTDDLFHKVSEFPVRVGGFIGITSLSIHPDFKGQGIGTALLAAMKDLVVSQERD  148
             V+      L D LFH V++ P + GG+I ITSLSI    F+ QG+GTALLAA+KDLVV+Q+R
Sbjct:   61  VVTTPILEDSLFHGVTKNP-KTGGYIAITSLSIARHFQQQGVGTALLAALKDLVVAQQRT  119

Query:  149  GISLTCHDDLISFYEMNGFKDEGESDSKHGGSLWYNMIW                      187
             G+ LTCHD LIS+YEMNGF ++G S+S+HGG+LWY MIW
Sbjct:  120  GLILTCHDYLISYYEMNGFINQGISESQHGGTLWYQMIW                      158
``` muramate-alanine ligase (murC/ddlA). Analysis of this protein sequence reveals the following:

Possible site: 31
>>> Seems to have a cleavable N-term signal seq.
INTEGRAL    Likelihood = –2.60    Transmembrane 272-288 (270-288)
----- Final Results -----
   bacteria membrane --- Certainty = 0.2041 (Affirmative) <succ>
       bacterial outside --- Certainty = 0.0000 (Not Clear) <succ>
          bacterial cytoplasm --- Certainty = 0.0000 (Not Clear) <succ>

The protein has homology with the following sequences in the GENPEPT database.

Based on this analysis, it was predicted that these proteins and their epitopes could be useful antigens for vaccines or diagnostics.

Example 1558

A DNA sequence (GBSx1650) was identified in *S. agalactiae* <SEQ ID 4811> which encodes the amino acid sequence <SEQ ID 4812>. This protein is predicted to be udp-n-acetyl-

```
>GP:AAC00294 GB:AF008220 putative UDP-N-acetylmuramate-alanine
ligase [Bacillus subtilis]
Identities = 238/432 (55%), Positives = 315/432 (72%), Gaps = 3/432 (0%)
Query:    5  YHFIGIKGSGMSALALMLHQMGHNVQGSDVDKYYFTQRGLEQAGVTILPFSPNNISEDLE   64
             YHF+GIKG+GMS LA +LH  G+ VQGSD++K+ FTQ  LE+  +TILPFS NI    +
Sbjct:    4  YHFVGIKGTGMSPLAQILHDNGYTVQGSDIEKFIFTQTALEKRNITILPFSAENIKPGMT   63

Query:   65  IIAGNAFRPDNNEELAYVIEKGYQFKRYHEFLGDFMRQFTSLGVAGAHGKTSTTGLLAHV  124
             +IAGNAF PD + E+    + +G    RYH+FLGD+M++FTS+ V GAHGKTSTTGLLAHV
Sbjct:   64  VIAGNAF-PDTHPEIEKAMSEGIPVIRYHKFLGDYMKKFTSVAVTGAHGKTSTTGLLAHV  122

Query:  125  LKNITDTSFLIGDGTGRGSANANYFVFEADEYERHFMPYHPEYSIITNIDFDHPDYFTGL  184
             ++N    TSFLIGDGTG+G+ N+  YFVFEA EY RHF+ Y P+Y+I+TNIDFDHPDYF +
Sbjct:  123  IQNAKPTSFLIGDGTGQGNENSEYFVFEACEYRRHFLSYQPDYAIMTNIDFDHPDYFSSI  182

Query:  185  EDVFNAFNDYAKQVQKGLFIYGEDPKLHEITSEAPIYYYGFEDSNDFIAKDITRTVNGSD  244
             +DVF+AF + A QV KG+    G+D  L +I +   P+ YYG  +NDF A++I ++  G+
Sbjct:  183  DDVFDAFQEMALQVNKGIIACGDDEHLPKIHANVPVVYYGTGEENDFQARNIVKSTEGTT  242
```

-continued

```
Query: 245  FKVFYNQEEIGQFHVPAYGKHNILNATAVIANLYIMGIDMALVAEHLKTFSGVKRRFTEK  304
            F VF        F++PAYG HN+LN+ AVIA  +   ID +++    LK+F GVKRRF EK
Sbjct: 243  FDVFVRNTFYDTFYIPAYGHHNVLNSLAVIALCHYEEIDSSIIKHALKSFGGVKRRFNEK  302

Query: 305  IIDDTVIIDDFAHHPTEIIATLDAARQKYPSKEIVAIFQPHTFTRTIALLDEFAHALSQA  364
             + D V+IDD+AHHPTEI   T++AARQKYP +EIVA+FQPHTFTRT    LDEFA +LS A
Sbjct: 303  QLGDQVLIDDYAHHPTEIKVTIEAARQKYPDREIVAVFQPHTFTRTQQFLDEFAESLSGA  362

Query: 365  DSVYLAQIYGSAREVDNGEVKVEDLAAKIVKHSDLVTVENVSPLLNHDNAVYVFMGAGDI  424
            D VYL  I+GSARE + G++ + DL   KI   ++ L+   ++ S L   HD AV +FMGAGDI
Sbjct: 363  DCVYLCDIFGSARE-NAGKLTIGDLQGKI-HNARLIEEDDTSVLKAHDKAVLIFMGAGDI  420

Query: 425  QLYERSFEELLA                                                 436
            Q Y R++E ++A
Sbjct: 421  QKYMRAYENVMA                                                 432
```

A related DNA sequence was identified in *S. pyogenes* <SEQ ID 4813> which encodes the amino acid sequence <SEQ ID 4814>. Analysis of this protein sequence reveals the following:

```
Possible site: 31
>>> Seems to have a cleavable N-term signal seq.
INTEGRAL      Likelihood = –4.57    Transmembrane 271-287 ( 269-288)
----- Final Results -----
   bacterial membrane --- Certainty = 0.2826 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the databases:

An alignment of the GAS and GBS proteins is shown below.

```
>GP:AAC00294 GB:AF008220 putative UDP-N-acetylmuramate-alanine
ligase [Bacillus subtilis]
Identities = 236/431 (54%), Positives = 310/431 (71%), Gaps = 2/431 (0%)
Query:   5  YHFIGIKGSGMSALALMLHQMGHKVQGSDVEKYYFTQRGLEQAGITILPFSEDNITPDME   64
            YHF+GIKG+GMS LA +LH  G+ VQGSD+EK+ FTQ  LE+   ITILPFS +NI P M
Sbjct:   4  YHFVGIKGIGMSPLAQILHDNGYTVQGSDIEKFIFTQTALEKRNITILPFSAENIKPGMT   63

Query:  65  LIVGNAFRENNKEVAYALRHQIPFKRYHDFLGDFMKSFISFAVAGAHGKTSTTGLLSHVL  124
            +I GNAF + + E+  A+   IP  RYH FLGD+MK F S AV GAHGKTSTTGLL+HV+
Sbjct:  64  VIAGNAFPDTHPEIEKAMSEGIPVIRYHKFLGDYMKKFTSVAVTGAHGKTSTTGLLAHVI  123

Query: 125  KNITDTSYLIGDGTGRGSANAQYFVFESDEYERHFMPYHPEYSIITNIDFDHPDYFTGIA  184
            +N     TS+LIGDGTG+G+ N++YFVFE+ EY RHF+ Y P+Y+I+TNIDFDHPDYF+ I
Sbjct: 124  QNAKPTSFLIGDGTGQGNENSEYFVFEACEYRRHFLSYQPDYAIMTNIDFDHPDYFSSID  183

Query: 185  DVRNAFNDYAKQVKKALFVYGEDDELKKIEAPAPIYYYGFEEGNDFIAYDITRTTNGSDF  244
            DV +AF + A QV K +    G+D+ L KI A  P+ YYG  E NDF A +I ++T G+ F
Sbjct: 184  DVFDAFQEMALQVNKGIIACGDDEHLPKIHANVPVVYYGTGEENDFQARNIVKSTEGTTF  243

Query: 245  KVKHQGEVIGQFHVPAYGKHNILNATAVIANLFVAGIDMALVADHLKTFSGVKRRFTEKI  304
             V +        F++PAYG HN+LN+ AVIA       ID +++    LK+F GVKRRF EK
Sbjct: 244  DVFVRNTFYDTFYIPAYGHHNVLNSLAVIALCHYEEIDSSIIKHALKSFGGVKRRFNEKQ  303

Query: 305  INDTIIIDDFAHHPTEIVATIDAARQKYPSKEIVAIFQPHTFIRTIALLEDFACALNEAD  364
             + D ++IDD+AHHPTEI   TI+AARQKYP +EIVA+FQPHTFTRT    L++FA +L+ AD
Sbjct: 304  LGDQVLIDDYAHHPTEIKVTIEAARQKYPDREIVAVFQPHTFTRTQQFLDEFAESLSGAD  363

Query: 365  SVYLAQIYGSAREVDKGEVKVEDLAAKIIKPSQVVTVENVSPLLDHDNAVYVFMGAGDIQ  424
              VYL  I+GSARE + G++ + DL  K I  ++++   ++ S L   HD AV +FMGAGDIQ
Sbjct: 364  CVYLCDIFGSARE-NAGKLTIGDLQGK-IHNAKLIEEDDTSVLKAHDKAVLIFMGAGDIQ  421

Query: 425  LYEHSFEELLA                                                  435
              Y   ++E ++A
Sbjct: 422  KYMRAYENVMA                                                  432
```

```
Identities = 369/443 (83%), Positives = 406/443 (91%), Gaps = 1/443 (0%)
Query:   1   MSKTYHFIGIKGSGMSALALMLHQMGHNVQGSDVDKYYFTQRGLEQAGVTILPFSPNNIS    60
             MSKTYHFIGIKGSGMSALALMLHQMGH VQGSDV+KYYFTQRGLEQAG+TILPFS +NI+
Sbjct:   1   MSKTYHFIGIKGSGMSALALMLHQMGHKVQGSDVEKYYFTQRGLEQAGITILPFSEDNIT    60

Query:  61   EDLEIIAGNAFRPDNNEELAYVIEKGYQFKRYHEFLGDFMRQFTSLGVAGAHGKTSTTGL   120
                D+E+I GNAFR +NN+E+AY +    FKRYH+FLGDFM+ F S   VAGAHGKTSTTGL
Sbjct:  61   PDMELIVGNAFR-ENNKEVAYALRHQIPFKRYHDFLGDFMKSFISFAVAGAHGKTSTTGL   119

Query: 121   LAHVLKNITDTSFLIGDGTGRGSANANYFVFEADEYERHFMPYHPEYSIITNIDFDHPDY   180
             L+HVLKNITDTS+LIGDGTGRGSANA YFVFE+DEYERHFMPYHPEYSIITNIDFDHPDY
Sbjct: 120   LSHVLKNITDTSYLIGDGTGRGSANAQYFVFESDEYERHFMPYHPEYSIITNIDFDHPDY   179

Query: 181   FTGLEDVFNAFNDYAKQVQKGLFIYGEDPKLHEITSEAPIYYYGFEDSNDFIAKDITRTV   240
             FTG+ DV NAFNDYAKQV+K LF+YGED +L +I + APIYYYGFE+ NDFIA DITRT
Sbjct: 180   FTGIADVRNAFNDYAKQVKKALFVYGEDDELKKIEAPAPIYYYGFEEGNDFIAYDITRTT   239

Query: 241   NGSDFKVFYNQEEIGQFHVPAYGKHNILNATAVIANLYIMGIDMALVAEHLKTFSGVKRR   300
             NGSDFKV + E IGQFHVPAYGKHNILNATAVIANL++ GIDMALVA+HLKTFSGVKRR
Sbjct: 240   NGSDFKVKHQGEVIGQFHVPAYGKHNILNATAVIANLFVAGIDMALVADHLKTFSGVKRR   299

Query: 301   FTEKIIDDTVIIDDFAHHPTEIIATLDAARQKYPSKEIVAIFQPHTFTRTIALLDEFAHA   360
             FTEKII+DT+IIDDFAHHPTEI+AT+DAARQKYPSKEIVAIFQPHTFTRTIALL++FA A
Sbjct: 300   FTEKIINDTIIIDDFAHHPTEIVATIDAARQKYPSKEIVAIFQPHTFTRTIALLEDFACA   359

Query: 361   LSQADSVYLAQIYGSAREVDNGEVKVEDLAAKIVKHSDLVTVENVSPLLNHDNAVYVFMG   420
             L++ADSVYLAQIYGSAREVD GEVKVEDLAAKI+K S +VTVENVSPLL+HDNAVYVFMG
Sbjct: 360   LNEADSVYLAQIYGSAREVDKGEVKVEDLAAKIIKPSQVVTVENVSPLLDHDNAVYVFMG   419

Query: 421   AGDIQLYERSFEELLANLTKNTQ                                       443
             AGDIQLYE SFEELLANLTKN Q
Sbjct: 420   AGDIQLYEHSFEELLANLTKNNQ                                       442
```

SEQ ID 4812 (GBS157) was expressed in E. coli as a His-fusion product. SDS-PAGE analysis of total cell extract is shown in FIG. 24 (lane 11; MW 49 kDa). It was also expressed in E. coli as a GST-fusion product. SDS-PAGE analysis of total cell extract is shown in FIG. 31 (lane 8; MW 74 kDa), FIG. 33 (lane 8; MW 74 kDa) and FIG. 37 (lane 3; MW 74 kDa).

The GBS157-GST fusion product was purified (FIG. 112A; see also FIG. 200, lane 3) and used to immunise mice (lane 1+2 product; 19.5μg/mouse). The resulting antiserum was used for Western blot (FIG. 112B), FACS, and in the in vivo passive protection assay (Table III). These tests confirm that the protein is immunoaccessible on GBS bacteria and that it is an effective protective immunogen.

SEQ ID 4812 (GBS157) was expressed in E. coli as a GST-fusion product. SDS-PAGE analysis of total cell extract is shown in FIG. 183 (lane 11-13; MW 74 kDa).

Based on this analysis, it was predicted that these proteins and their epitopes could be useful antigens for vaccines or diagnostics.

Example 1559

A DNA sequence (GBSx1651) was identified in S. agalactiae <SEQ ID 4815> which encodes the amino acid sequence <SEQ ID 4816>. Analysis of this protein sequence reveals the following:

Possible site: 19
>>> Seems to have no N-terminal signal sequence
----- Final Results -----
  bacterial cytoplasm --- Certainty = 0.1980 (Affirmative) <succ>
   bacterial membrane --- Certainty = 0.0000 (Not Clear) <succ>
    bacterial outside --- Certainty = 0.0000 (Not Clear) <succ>

The protein has no significant homology with any sequences in the GENPEPT database.

A related DNA sequence was identified in S. pyogenes <SEQ ID 4817> which encodes the amino acid sequence <SEQ ID 4818>. Analysis of this protein sequence reveals the following:

Possible site: 25
>>> Seems to have no N-terminal signal sequence
----- Final Results -----
  bacterial cytoplasm --- Certainty = 0.2731 (Affirmative) <succ>
   bacterial membrane --- Certainty = 0.0000 (Not Clear) <succ>
    bacterial outside --- Certainty = 0.0000 (Not Clear) <succ>

An alignment of the GAS and GBS proteins is shown below.

```
Identities = 80/201 (39%), Positives = 126/201 (61%), Gaps = 9/201 (4%)
Query:   7   RFPLIADDEPVMSPLVKMNLYDNEDLINNIRDFYQEKTYQSMNYSNYEHEEISHPKVIEN    66
             +FPL+AD   + P  +M LY+NEDLI NIR +YQ+K Y  + ++     EE +
Sbjct:   5   QFPLVADGIAISDPAKQMALYENEDLITNIRGYYQDKEYDDIARN----EEFTAKATSRQ    60

Query:  67   DPVPPQ--SFVKKATELSKSRQEAKRSVREKRQAYYAKQEFKAPSKEAFQQQLKATVPKK   124
               P    + S +K  + ++RQ+AK+ ++EKRQAY AK+    P + +QQ    + P +
Sbjct:  61   TPSSKRFCSNDEKHHYVKEARQKAKQDLKEKRQAYLAKEMAYVPKQVSKKQQPADSSPSQ   120

Query: 125   QTQRKVTELSHLSDRLQQESYILAEIPIIFQEPDNTPNP-KTKKNNFDFLKRSQVYNKQD   183
               +  TE+S  +L Q++YILAE+P  ++EP N P    TKKNN+DFLK SQ+YN ++
Sbjct: 121   K--QATTEMSRFTKKLHQDNYILAELPKEYKEPENLPQQGTTKKNNYDFLKSSQTYNNKE   178
```

```
Query: 184  NQFHKERAKAQELNLTRFKDI                                          204
            +  +E+  AQELNL+RF+D+
Sbjct: 179  MRQQREKTIAQELNLSRFEDL                                          199
```

Based on this analysis, it was predicted that these proteins and their epitopes could be useful antigens for vaccines or diagnostics.

Example 1560

A DNA sequence (GBSx1652) was identified in *S. agalactiae* <SEQ ID 4819> which encodes the amino acid sequence <SEQ ID 4820>. Analysis of this protein sequence reveals the following.

Possible site: 29
>>> Seems to have no N-terminal signal sequence
----- Final Results -----
  bacterial cytoplasm --- Certainty = 0.4959 (Affirmative) <succ>
  bacterial membrane --- Certainty = 0.0000 (Not Clear) <succ>
  bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1561

A DNA sequence (GBSx1653) was identified in *S. agalactiae* <SEQ ID 4821> which encodes the amino acid sequence <SEQ ID 4822>. This protein is predicted to be SNF. Analysis of this protein sequence reveals the following:

Possible site: 28
>>> Seems to have no N-terminal signal sequence
INTEGRAL    Likelihood = −0.32    Transmembrane 743-759 (743-759)
----- Final Results -----
  bacterial membrane --- Certainty = 0.1128 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

```
>GP:CAA67095 GB:X98455 SNF [Bacillus cereus]
Identities = 259/678 (38%), Positives = 406/678 (59%), Gaps = 21/678 (3%)
Query: 369  QNEILLQMVFDYGNDLTVHNRQELEQLTFASHFKHEEKVFKLLEKYGFAPHFSTSHPAYS    428
            +N +L  + F YGN +       ++ +   F    K E+++ ++ + FA      +  ++
Sbjct: 388  KNRLLAGLEFHYGNVVINPLEEDGQPSVFNRDEKKEKEILDIMSESAFAKT-EGGYFMHN    446

Query: 429  AQELYDFYTYMLPQFKKMGTV--SLSAKLESYRLIERPQIDIEAKGSL--LDISFDFSDL    484
            + Y+F +++P K +  + + + KL   ++  P I + K + L   FD  +
Sbjct: 447  EEAEYNFLYHIVPTLKGLVDIYATTAIKLRIHKGDTAPLIRVRRKERIDWLSFRFDIKGI    506

Query: 485  LENDVDQALVALFDNNPYFVNKSGQLVIFD-EETKKVSATLQ--GLRARRAKNGHIELDN    541
            E ++    L AL +     Y+    +G L+  + +E  +++   ++  G+R         + +
Sbjct: 507  PEAEIKGVLAALEEKRKYYRLANGSLLSLESKEFNEINQFVKESGIRKEFLHGEEVNVPL    566

Query: 542  IAAFQLSELFANQDNVSFSQHFYQLIEDLRHPEKFK--IPGLSVSASLRDYQLTGVRWLS    599
            I  + +         + +S   +    L+E +++P+K  K   +P   ++ A  +R+YQ+  G    W+
Sbjct: 567  IRSVKWMNGLHEGNVLSLDESVQDLVESIQNPKKLKFTVPP-TLHAVMREYQVYGFEWMK    625

Query: 600  MLDHYGFAGILADDMGLGKTLQTISFLSTKLT--RDSR--VLILSPSSLIYNWQDEFHKF    655
            L +Y F  GILADDMGLGKTLQ+I+++ + L       R+ +   +L++SPSSL+YNW  E   KF
Sbjct: 626  TLAYYRFGGILADDMGLGKTLQSIAYIDSVLPEIREKKLPILVVSPSSLVYNWFSELKKF    685

Query: 656  APDVDVAVAYGSKIRRDEIIAE--RHQVIITSYSSFRQDFETYSEGNYDYLILDEAQVMK    713
            AP +     +A G++  R  +I+  +     V+ITSY   R+D   +Y+  +    L LDEAQ   K
Sbjct: 686  APHIRAVIADGNQTERRKILKDVAEFDVVITSYPLLRRDVRSYARP-FHTLFLDEAQAFK    744

Query: 714  NAQTKIAHSLRSFEVKNCFALSGTPIENKLLEIWSIFQIILPGLLPGKKEFLKLNPKQVA    773
            N  T+ A ++++ + +    F  L+GTP+EN  L  E+WSIF ++   P  LLPG+KEF   L+     +A
Sbjct: 745  NPTTQTARAVKTIQAEYRFGLTGTPVENSLEELWSIFHVVFPELLPGRKEFGDLRREDIA    804

Query: 774  RYIKPFVMRRRKEEVLPELPDLIEMNYPNEMTDSQKVIYLAQLRQI-QESIQHSSDADLN    832
             +KPFV+RR KE+VL ELPD  IE     +E+      QK +Y A L ++  +E+++H      L
Sbjct: 805  NAVKPFVLRRLKEDVLQELPDKIEHLQSSELLPDQKRLYAAYLAKLREETLKHLDKDTLR    864

Query: 833  RRKIEILSGITRLRQICDTPRLFMD-YDGESGKLESLRQLLTQIKENGHRALIFSQFRGM    891
            + KI  IL+G+TRLRQIC+  P LF+D  Y G S  KLE  L   +L + +    G R LIFSQF  M
Sbjct: 865  KNKIRILAGLTRLRQICNHPALFVDDYKGSSAKLEQLLDILEECRSTGKRILIFSQFTKM    924

Query: 892  LDIAEREMVAMGLTTYKITGSTPANERHEMTRAFNAGSKDAFLISLKAGGVGLNLTGADT    951
            L I   RE+       + +  + + G+TP+ ER  + +     FN G   D  FLISLKAGG GLNLTGADT
Sbjct: 925  LSIIGRELNRQAIPYFYLDGNTPSQERVELCNRFNEGEGDLFLISLKAGGTGLNLTGADT    984

Query: 952  VVLIDLWWNPAVEMQAISRAHRLGQKENVEVYRLITRGTIEEKILEMQETKKHLVTTVLD   1011
            V+L DLWWNPAVE QA   RA+R+GQK  V+V +L+   GTIEEK+ E+QE+KKHL+   V++
Sbjct: 985  VILYDLWWNPAVEQQAADRAYRMGQENTVQVIKLVAHGTIEEKMHELQESKKHLIAEVIE   1044
```

```
Query: 1012  -GNETHASMSVDDIREIL     1028
              G E  +S++ ++IR+IL
Sbjct: 1045  PGEEKLSSITEEEIRDIL     1062
```

A related DNA sequence was identified in *S. pyogenes* <SEQ ID 4823> which encodes the amino acid sequence <SEQ ID 4824>. Analysis of this protein sequence reveals the following:

Possible site: 26
>>> Seems to have no N-terminal signal sequence

----- Final Results -----
bacterial cytoplasm --- Certainty = 0.3909 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 674/1031 (65%), Positives = 834/1031 (80%), Gaps = 2/1031 (0%)
Query:   1  MSRMIPGRIRNQGIELYEQGLVSLISQEGNLLKAKVGDCQIEYSLVTEETKCSCDFFARK   60
            M+R+IPGR+RN GI+LYEQGLVS     +L+ +V   Q++Y   E+  C CD F  K
Sbjct:   2  MARLIPGRVRNEGIKLYEQGLVSFQDDNKGILQIEVETYQVQYGADDEDITCQCDTFHMK  61

Query:  61  GYCQHLAALEHFLKNDPEGKAILSKVQVQQESQQETKKKTSFGSVFLDSLIINEDDTIKY  120
            YC+H+AA+E+FLKND +GK L ++  Q + ++ TKK TSFGS+FLDSL +NEDD++KY
Sbjct:  62  HYCKHIAAVEYFLKNDQKGKLFLKQLTNQTKIKETTKKMTSFGSLELDSLAMNEDDSVKY  121

Query: 121  QLSAQGEQNPYANDIWWTLKIRRLPDDRSYVIRDIKAFLNTVRKEAYYQIGKQYFETLSL  180
            +LSA G ++P+++D WW+LKI RLPDDRSYVIRDIK FL  ++KE +YQIGK YFE LS
Sbjct: 122  RLSALGSRSPFSSDYWWSLKINRLPDDRSYVIRDIKGFLQLIKKEGFYQIGKNYFEQLSW  181

Query: 181  IQFDETSQELIEFLWRLIPSHSSKIDLEFILPNQGRHLSLTRGFFEEGVTLMNALENFSF  240
            +QFD +SQ LIEFLWRL  S + KD EI PN  RHL L GFFEEG+  + +L +F+F
Sbjct: 182  LQFDPSSQALIEFLWRLA-SDTDKGDNENIFPNHARHLRLPSGFFEEGIHYLTSLYDFTF  240

Query: 241  ESDFHQFNHLYFKELEGEDHLYQFKVIVHRQSIELEIKEKDLKPLFANSYLFYRDTFYHL  300
            E    ++HL+ + LE E  LY+FKV VHR+SIEL+I EK+++ LF N YL Y+DTFYHL
Sbjct: 241  EGPSQTYHHLFVRSLEAEAGLYEFKVEVHRKSIELQIAEKNVQYLFDNDYLLYQDTFYHL  300

Query: 301  NLKQEKMVTAIRSLPIEGDLAKHIHFDLDDQDKLAAHLLDFKEIGLVDAPRSFSIHDFKV  360
             LKQ KMV AIRSLPIE DLAKHIHFDLDD  KLAA L DFK+IGLV+AP+SF+I DF+V
Sbjct: 301  TLKQRKMVQAIRSLPIEADLAKHIHFDLDDHAKLAASLSDFKQIGLVEAPKSFAIRDFEV  360

Query: 361  NFEFDINSQNEILLQMVFDYGNDLTVHNRQELEQLTFASHFKHEEKVFKLLEKYGFAPHF  420
             F+FD+ +++EI  Q++FDYGN    V ++  LE L FASH K EEK+ + L  +GF+P F
Sbjct: 361  TFQFDLLNRDEISCQLMFDYGN-YQVSDKASLEALPFASHLKKEEKINRSLLAFGFSPQF  419

Query: 421  STSHPAYSAQELYDFYTYMLPQFKKMGTVSLSAKLESYRLIERPQIDIEAKGSLLDISFD  480
            +     SA+ELY F+   +P F+++G V+LS  +++ ++ E P+I I     LLDISFD
Sbjct: 420  YSKKRLTSAKELYTFFEETVPCFERLGNVALSTAIQALQVKEMPKIAIRRNQGLLDISFD  479

Query: 481  FSDLLENDVDQALVALFDNNPYFVNKSGQLVIFDEETKKVSATLQGLRARRAKNGHIELD  540
            FS ++END+DQA+ ALF NNPYFV+++GQLV+FD+ET+KVS +LQ LRAR+ KNGH++LD
Sbjct: 480  FSTIIENDIDQAVTALFQNNPYFVSQTGQLVVFDDETQKVSKSLQELRARQLKNGHLQLD  539

Query: 541  NIAAFQLSELFANQDNVSFSQHFYQLIEDLRHPEKFKIPGLSVSASLRDYQLTGVRWLSM  600
             I A Q+S+LF   +V FS+     +L   L+HPE F I  L V A +RDYQ  GV+WLSM
Sbjct: 540  GIRALQVSKLFEGMTSVHFSKELEELAYHLQHPETFSIKPLPVKAQMRDYQRNGVQWLSM  599

Query: 601  LDHYGFAGILADDMGLGKTLQTISFLSTKLTRDSRVLILSPSSLIYNWQDEFHKFAPDVD  660
            L+HYGF GILADDMGLGKTLQT++FL++  L  DS+VLILSPSSLIYNW DE  KF P +D
Sbjct: 600  LNHYGFGGILADDMGLGKTLQTLAFLASHLKSDSKVLILSPSSLIYNWFDECQKFTPQLD  659

Query: 661  VAVAYGSKIRRDEIIAERHQVIITSYSSFRQDFETYSEGNYDYLILDEAQVMKNAQTKIA  720
            V V+YG K +RD+II E HQ+ ITSYSSFRQDFETY   +YDYLILDEAQV+KNAQTKI+
Sbjct: 660  VVVSYGLKQIRDQIIEEGHQITITSYSSFRQDFETYQAFHYDYLILDEAQVIKNAQTKIS  719

Query: 721  HSLRSFEVKNCFALSGTPIENKLLEIWSIFQIILPGLLPGKKEFLKLNPKQVARYIKPFV  780
            H LR+F   NCFALSGTPIENK+LEIWSIFQI+LPGLLP KKEFLKL  +QV+RYIKPFV
Sbjct: 720  HCLRAFNTANCFALSGTPIENKMLEIWSIFQIVLPGLLPTKKEFLKLTAEQVSRYIKPFV  779

Query: 781  MRRRKEEVLPELPDLIEMNYPNEMTDSQKVIYLAQLRQIQESIQHSSDADLNRRKIEILS  840
            MRR+KE+VLPELPDLIE+NY NEMTD QK IYLAQLRQ+Q+ I++SSD D++R+KIEILS
Sbjct: 780  MRRKKEDVLPELPDLIEINYSNEMTDEQKAIYLAQLRQMQDQIRNSSDVDISRQKIEILS  839

Query: 841  GITRLRQICDTPRLFMDYDGESGKLESLRQLLTQIKENGHRALIFSQFRGMLDIAEREMV  900
            GITRLRQICDTP LFMDY G+SGKL+SLR  LLTQIKENGHRALIFSQFRGMLD+A++EM
Sbjct: 840  GITRLRQICDTPSLFMDYQGKSGKLDSLRILLTQIKENGHRALIFSQFRGMLDLAKQEMT  899
```

```
            -continued
Query:  901 AMGLTTYKITGSTPANERHEMTRAFNAGSKDAFLISLKAGGVGLNLTGADTVVLIDLWWN  960
            A+GLT+Y++TGSTPANER EMTRAFN GSKDAFLISLKAGGVG+NLTGADTV+LIDLWWN
Sbjct:  900 ALGLTSYQMTGSTPANERQEMTRAFNNGSKDAFLISLKAGGVGINLTGADTVILIDLWWN  959

Query:  961 PAVEMQAISRAHRLGQKENVEVYRLITRGTIEEKILEMQETKKHLVTTVLDGNETHASMS 1020
            PAVEMQAISRA+R+GQKENVEVYRLITRGTIEEKILE+QE+K++LVTTVLDGNE+ ASMS
Sbjct:  960 PAVEMQAISRAYRIGQKENVEVYRLITRGTIEEKILELQESKRNLVTTVLDGNESRASMS 1019

Query: 1021 VDDIREILGVS                                                 1031
            +++I+EILG++
Sbjct: 1020 IEEIKEILGLN                                                 1030
```

SEQ ID 4822 (GBS369) was expressed in *E. coli* as a His-fusion product. SDS-PAGE analysis of total cell extract is shown in FIG. 64 (lane 5; MW 120 kDa). It was also expressed in *E. coli* as a GST-fusion product. SDS-PAGE analysis of total cell extract is shown in FIG. 69 (lane 6; MW 142 kDa).

Figure 303:
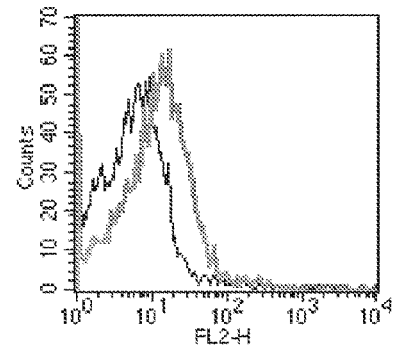

The GBS369-GST fusion product was purified (FIG. 215, lane 7) and used to immunise mice. The resulting antiserum was used for FACS (FIG. 303), which confirmed that the protein is immunoaccessible on GBS bacteria.

Based on this analysis, it was predicted that these proteins and their epitopes could be useful antigens for vaccines or diagnostics.

Example 1562

A DNA sequence (GBSx1654) was identified in *S. agalactiae* <SEQ ID 4825> which encodes the amino acid sequence <SEQ ID 4826>. Analysis of this protein sequence reveals the following:

Possible site: 41
>>> Seems to have no N-terminal signal sequence
----- Final Results -----
    bacterial cytoplasm --- Certainty = 0.3391 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

There is also homology to SEQ ID 1034:

```
Identities = 34/38 (89%), Positives = 37/38 (96%)
Query:  1 MEKEAKQIIDLKRNLFKIDVRAQKDEEKVFMRTACQFS 38
          +EKEAKQ+IDLKRNLFKIDVRAQKDEEKVFMRTAC+ S
Sbjct:  1 LEKEAKQMIDLKRNLFKIDVRAQKDEEKVFMRTACRQS 38
```

Based on this analysis, it was predicted that this protein and its epitopes, could be useful antigens for vaccines or diagnostics.

Example 1563

A DNA sequence (GBSx1656) was identified in *S. agalactiae* <SEQ ID 4827> which encodes the amino acid sequence <SEQ ID 4828>. This protein is predicted to be phosphoglycerate dehydrogenase (era2). Analysis of this protein sequence reveals the following:

Possible site: 31
>>> Seems to have no N-terminal signal sequence
----- Final Results -----
    bacterial cytoplasm --- Certainty = 0.3709 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database.

```
>GP:BAA88823 GB:AB016077 phosphoglycerate dehydrogenase
[Streptococcus mutans]
Identities = 377/436 (86%), Positives = 414/436 (94%)
Query:   1 MVLPTVAIVGRPNVGKSTLFNRIAGERISIVEDVEGVTRDRIYTTGEWLNRKFSLIDTGG  60
           M LPTVAIVGRPNVGKS LFNRIAGERISIVEDVEGVTRDRIYT  EWLNR+FS+IDTGG
Sbjct:   1 MALPTVAIVGRPNVGKSALFNRIAGERISIVEDVEGVTRDRIYTKAEWLNRQFSIIDTGG  60

Query:  61 IDDVDAPFMEQIKHQADIAMTEADVIVFVVSGKEGVTDADEYVSRILYKTNKPVILAVNK 120
           IDDVDAPFMEQIKHQADIAMTEADVIVFVVS KEG+TDADEYV++ILY+T+KPVILAVNK
Sbjct:  61 IDDVDAPFMEQIKHQADIAMTEADVIVFVVSAKEGITDADEYVAKILYRTHKPVILAVNK 120

Query: 121 VDNPEMRNDIYDFYSLGLGDPYPLSSVHGIGTGDILDAIVENLPVEEENENPDIIRFSLI 180
           VDNPEMR+ IYDFY+LGLGDPYP+SS HGIGTGD+LDAIV+NLP E + E+ DII+FSLI
Sbjct: 121 VDNPEMRSAIYDFYALGLGDPYPVSSAHGIGTGDVLDAIVDNLPAEAQEESSDIIKFSLI 180

Query: 181 GRPNVGKSSLINAILGEDRVIASPVAGTTRDAIDTNFVDSQGQEYTMIDTAGMRKSGKVY 240
           GRPNVGKSSLINAILGEDRVIASPVAGTTRDAIDT F D +GQE+TMIDTAGMRKSGKVY
Sbjct: 181 GRPNVGKSSLINAILGEDRVIASPVAGTIRDAIDTTFFTDEEGQEFTMIDTAGMRKSGKVY 240

Query: 241 ENTEKYSVMRSMRAIDRSDVVLMVINAEEGIREYDKRIAGFAHETGKGIIIVVNKWDTIE 300
           ENTEKYSVMR+MRAIDRSD+VLMV+NAEEGIREYDKRIAGFAHE GKGI++VVNKWD I+
Sbjct: 241 ENTEKYSVMRAMRAIDRSDIVLMVLNAEEGIREYDKRIAGFAHEAGKGIVVVVNKWDAIK 300

Query: 301 KDNHTVSQWEADIRDNFQFLSYAPIIFVSAETKQRLHKLPDMIKRISESQNKRIPSAVLN 360
           KDN TV+QWE DIRDNFQ++ YAPI+FVSA TKQRLHKLPD+IK++S+SQN RIPS+VLN
Sbjct: 301 KDNRTVAQWETDIRDNFQYIPYAPIVFVSAVTKQRLHKLPDVIKQVSQSQNTRIPSSVLN 360
```

```
Query:  361  DVIMDAIAINPTPTDKGKRLKIFYATQVAVKPPTFVVFVNEEELMHFSYLRFLENQIREA  420
             DV+MDA+AINPTPTDKGKRLKIFYATQV+VKPPTFV+FVNEEELMHFSYLRFLENQIR+A
Sbjct:  361  DVVMDAVAINPTPTDKGKRLKIFYATQVSVKPPTFVIEVNEEELMHFSYLRFLENQIRQA  420

Query:  421  FVFEGTPINLIARKRK                                              436
             FVFEGTPI LIARKRK
Sbjct:  421  FVFEGTPIRLIARKRK                                              436
```

A related DNA sequence was identified in *S. pyogenes* <SEQ ID 4829> which encodes the amino acid sequence <SEQ ID 4830>. Analysis of this protein sequence reveals the following:

Possible site: 46
>>> Seems to have no N-terminal signal sequence
----- Final Results -----
   bacterial cytoplasm --- Certainty = 0.3463 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

```
Identities = 403/436 (92%), Positives = 422/436 (96%)
Query:    1  MVLPTVAIVGRPNVGKSTLFNRIAGERISIVEDVEGVIRDRIYTTGEWLNRKFSLIDTGG   60
             MVLPTVAIVGRPNVGKSTLFNRIAGERISIVEDVEGVTRDRIY TGEWLNR+FSLIDTGG
Sbjct:    1  MVLPTVAIVGRPNVGKSTLFNRIAGERISIVEDVEGVTRDRIYATGEWLNRQFSLIDTGG   60

Query:   61  IDDVDAPFMEQIKHQADIAMTEADVIVFVVSGKEGVTDADEYVSRILYKTNKPVILAVNK  120
             IDDVDAPFMEQIKHQA IAM EADVIVFVVSGKEGVTDADEYVS+ILY+TN PVILAVNK
Sbjct:   61  IDDVDAPFMEQIKHQAQIAMEEADVIVFVVSGKEGVTDADEYVSKILYRTNTPVILAVNK  120

Query:  121  VDNPEMRNDIYDFYSLGLGDPYPLSSVHGIGTGDILDAIVENLPVEEENENPDIIRFSLI  180
             VDNPEMRNDIYDFYSLGLGDPYP+SSVHGIGTGD+LDAIVENLPVEE  EN DIIRFSLI
Sbjct:  121  VDNPEMRNDIYDFYSLGLGDPYPVSSVHGIGTGDVLDAIVENLPVEEAEENDDIIRFSLI  180

Query:  181  GRPNVGKSSLINAILGEDRVIASPVAGTTRDAIDTNFVDSQGQEYTMIDTAGMRKSGKVY  240
             GRPNVGKSSLINAILGEDRVIASPVAGTTRDAIDT+F D+ GQE+TMIDTAGM-
             RKSGK+Y
Sbjct:  181  GRPNVGKSSLINAILGEDRVIASPVAGTTRDAIDTHFTDADGQEFTMIDTAGMRKSGKIY  240

Query:  241  ENTEKYSVMRSMRAIDRSDVVLMVINAEEGIREYDKRIAGFAHETGKGIIIVVNKWDTIE  300
             ENTEKYSVMR+MRAIDRSDVVLMVINAEEGIREYDKRIAGFAHE GKG+IIVVNKWDTI+
Sbjct:  241  ENTEKYSVMRAMRAIDRSDVVLMVINAEEGIREYDKRIAGFAHEAGKGMIIVVNKWDTID  300

Query:  301  KDNHTVSQWEADIRDNFQFLSYAPIIFVSAETKQRLHKLPDMIKRISESQNKRIPSAVLN  360
             KDNHTV++WEADIRD FQFL+YAPIIFVSA TKQRL+KLPD+IKRISESQNKRIPSAVLN
Sbjct:  301  KDNHTVAKWEADIRDQFQFLTYAPIIFVSALTKQRLNKLPDLIKRISESQNKRIPSAVLN  360

Query:  361  DVIMDAIAINPIPTDKGKRLKIFYATQVAVKPPTFVVFVNEEELMHFSYLRFLENQIREA  420
             DVIMDAIAINPIPTDKGKRLKIFYATQV+VKPPTFVVFVNEEELMHFSYLRFLENQIR A
Sbjct:  361  DVIMDAIAINPIPTDKGKRLKIFYATQVSVKPPTFVVFVNEEELMRFSYLRFLENQIRAA  420

Query:  421  FVFEGTPINLIARKRK                                              436
             F FEGTPI+LIARKRK
Sbjct:  421  FTFEGTPIHLIARKRK                                              436
```

Based on this analysis, it was predicted that these proteins and their epitopes could be useful antigens for vaccines or diagnostics.

Example 1564

A DNA sequence (GBSx1657) was identified in *S. agalactiae* <SEQ ID 4831> which encodes the amino acid sequence <SEQ ID 4832>. Analysis of this protein sequence reveals the following:

Possible site: 51
>>> Seems to have no N-terminal signal sequence
----- Final Results -----
   bacterial cytoplasm --- Certainty = 0.2734 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:AAC00359 GB:AF008220 DnaI [Bacillus subtilis]
Identities = 105/313 (33%), Positives = 191/313 (60%), Gaps = 17/313 (5%)
Query:   1   MKSVGQALENQGRVP--RNTNDELIQMILADAQVAEFIKTHQ--LSQREINISMSKFNQF    56
             M+ +G++L+       P +   +++ + ++ D  V  F+K ++   + Q+ I   S++K   ++
Sbjct:   1   MEPIGRSLQGVTGRPDFQKRLEQMKEKVMKDQDVQAFLKENEEVIDQKMIEKSLNKLYEY    60

Query:  57   LIERQK-----FKNKDSQYIAKGYEPILVMNEGYADVSYLE--TRELIEAQKKQAISDRI   109
             IE+ K      ++++   + +GY P LV+N    D+ Y E     + ++ QKKQ       +
Sbjct:  61   -IEQSKNCSYCSEDENCNNLLEGYHPKLVVNGRSIDIEYYECPVKRKLDQQKKQ--QSLM   117

Query: 110   NLVNLPKSYRNIRMTDFDINNESRMKAMSQLLDFVETYPSYNH-KGLYLYGDMGVGKSYL   168
              + + +            DI++ SR+     + DF+++Y        KGLYLYG  GVGK+++
Sbjct: 118   KSMYIQQDLLGATFQQVDISDPSRLAMFQHVTDFLKSYNETGKGKGLYLYGKFGVGKTFM   177

Query: 169   MAAMARELSERKGVSTTLLHEPSFAIDVKNAISSGTVKDEIDAVKSVPILILDDIGAEQA   228
             +AA+A EL+E++   S+ +++ P F  ++KN++    T++++++ VK+ P+L+LDDIGAE
Sbjct: 178   LAAIANELAEKE-YSSMIVYVPEFVRELKNSLQDQTLEEKLNMVKTTPVLMLDDIGAESM   236

Query: 229   TSWVRDEILQVILQHRMLEELPTFFTSNYSFNDLERKWA-NIKGSDETWQAKRVMERVRY   287
             TSWVRDE++   +LQHRM ++LPTFF+SN+S ++L+  +   +G  E  +A R+MER+ Y
Sbjct: 237   TSWVRDEVIGTVLQHRMSQQLPTFFSSNESPDELKHHETYSQRGEKEEVKAARLMERILY   296

Query: 288   LAIEFHLEGPNRR                                                 300
             LA     L+G NRR
Sbjct: 297   LAAPIRLDGENRR                                                 309
```

A related DNA sequence was identified in *S. pyogenes* <SEQ ID 4833> which encodes the amino acid sequence <SEQ ID 4834>. Analysis of this protein sequence reveals the following:

Possible site: 19
>>> Seems to have no N-terminal signal sequence
----- Final Results -----
   bacterial cytoplasm --- Certainty = 0.1944 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

Based on this analysis, it was predicted that these proteins and their epitopes could be useful antigens for vaccines or diagnostics.

Example 1565

A DNA sequence (GBSx1658) was identified in *S. agalactiae* <SEQ ID 4835> which encodes the amino acid sequence <SEQ ID 4836>. Analysis of this protein sequence reveals the following:

Possible site: 37
>>> Seems to have no N-terminal signal sequence
----- Final Results -----
   bacterial cytoplasm --- Certainty = 0.2660 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

A related DNA sequence was identified in *S. pyogenes* <SEQ ID 4837> which encodes the amino acid sequence <SEQ ID 4838>. Analysis of this protein sequence reveals the following:

```
Identities = 228/300 (76%), Positives = 264/300 (88%)
Query:   1   MKSVGQALENQGRVPRNTNDELIQMILADAQVAEFIKTHQLSQREINISMSKENQFLIER    60
             M+ +G+ +    G+  R  +D+LIQ ILAD +VA FI  H LSQ +IN+S+SKFNQFL+ER
Sbjct:   1   MEKIGETMAKLGQNTRVNSDQLIQTILADPEVASFISQHHLSQEQINLSLSKENQFLVER    60

Query:  61   QKFKNKDSQYIAKGYEPILVMNEGYADVSYLETRELIEAQKKQAISDRINLVNLPKSYRN   120
             QK++ KD   YIAKGY+PIL MNEGYADVSYLET+EL+EAQK+ AIS+RI LV+LPKSYR+
Sbjct:  61   QKYQLKDPSYIAKGYQPILAMNEGYADVSYLETKELVEAQKQAAISERIQLVSLPKSYRH   120

Query: 121   IRMTDFDINNESRMKAMSQLLDFVETYPSYNHKGLYLYGDMGVGKSYLMAAMARELSERK   180
             I ++D D+NN SRM+A S +LDFVE YPS   KGLYLYGDMG+GKSYL+AAMA+ELSE+K
Sbjct: 121   IHLSDIDVNNASRMEAFSAILDFVEQYPSAEQKGLYLYGDMGIGKSYLLAAMAHELSEKK   180

Query: 181   GVSTTLLHEPSFAIDVKNAISSGTVKDEIDAVKSVPILILDDIGAEQATSWVRDEILQVI   240
             GVSTTLLHEPSFAIDVKNAIS+G+VK+EIDAVK+VP+LILDDIGAEQATSWVRDE+LQVI
Sbjct: 181   GVSTTLLHEPSFAIDVKNAISNGSVKEEIDAVKNVPVLILDDIGAEQATSWVRDEVLQVI   240

Query: 241   LQHRMLEELPTFFTSNYSFNDLERKWANIKGSDETWQAKRVMERVRYLAIEFHLEGPNRR   300
             LQ+RMLEELPTFFTSNYSF DLERKWA IKGSDETWQAKRVMERVRYLA EFHLEG NRR
Sbjct: 241   LQYRMLEELPTFFTSNYSFADLERKWATIKGSDETWQAKRVMERVRYLAREFHLEGANRR   300
```

Possible site: 35
>>> Seems to have no N-terminal signal sequence
----- Final Results -----
   bacterial cytoplasm --- Certainty = 0.2135 (Affirmative) <succ>
    bacterial membrane --- Certainty = 0.0000 (Not Clear) <succ>
     bacterial outside --- Certainty = 0.0000 (Not Clear) <succ>

An alignment of the GAS and GBS proteins is shown below.

```
Identities = 217/391 (55%), Positives = 309/391 (78%)
Query: 1    MMSPIDEFTYIKQNKIVYDSNSLIQLYFPIMGSDAMALYDYFVHFFDDGIRRHKFSEVLN    60
            MM PID FTY+K+NK+  DS +LIQLYFPI+GSDA+++Y YF+HFFDDG++RHKFS++LN
Sbjct: 1    MMKPIDTFTYLKRNKVTLDSVTLIQLYFPIIGSDAVSIYQYFIHFFDDGLQRHKFSDILN    60

Query: 61   HLQYGMPRFQDALVMLTALDLLTVYQATGTYLVKLNQAMSNELFLSNPIYRRLLEKRIGE   120
            HLQ+GM RF+DAL +LTA++L++VYQ + TYL+ L+Q +S +LF  +P Y RLLE++IGE
Sbjct: 61   HLQFGMKRFEDALAILTAMELVSVYQLSDTYLITLHQPLSRDLFFQHPAYSRLLEQKIGE   120

Query: 121  VAVAELDMKIPKNARDISKKFTDVFSDLGQPKQEVNRSKNVFDLESFKRLMMRDGLRFNN   180
            VAV+EL + +P  AR+ISK+F+D+F   G         + +  FDL SF++LM+RDGL+F +
Sbjct: 121  VAVSELQVTVPSQARNISKRFSDIFGVQGDLTNVPQKPQKNFDLSSFQQLMVRDGLQFED   180

Query: 181  EKDDVLGIYSVSELYHLNWYDTYQLAKQTAINGMIAPQRMKVQQNEGQHIKDNQSFTNNE   240
               + D++ +YS++E Y + W+DTYQ+AK TA+NG I P+R+    ++N+        ++F+  E
Sbjct: 181  NQKDIISLYSIAEQYDMTWFDTYQIAKATAVNGKIRPERLLAKKNQSMTKPSKENFSQAE   240

Query: 241  KVILRESKNDSALVFLEKIKRSRKAVTTSGEKTLLEDLAKMNFLDEVINVMVLYTLNKTK   300
            ++ILRE+K DSALVFLEKIK++R+A  T   E+ LL+ LAKMNFLD+VINVMVLYT NKTK
Sbjct: 241  QIILREAKQDSALVFLEKIKKARRATITKDERILLQTLAKMNFLDDVINVMVLYTFNKTK   300

Query: 301  SANLNKAYIMKVANDFAFQNVMTAEDAVLKIRDFSDQKVRTKTETKKKQSNVPEWSNPDY   360
            SANL K+Y++K+ANDFA+Q V TAE+A++ +R F+D++ R +++ K  QSNVP+WSNPDY
Sbjct: 301  SANLQKSYVLKMANDFAYQKVSTAEEAIVVLRAFTDRQSRRQSKVKTSQSNVPKWSNPDY   360

Query: 361  KDEVSPEKEIELEQFKTDALKRLERLGKDGE                              391
            ++  S E++ +L+QFK  ALKRLE LGK G+
Sbjct: 361  QETTSQEEQAKLDQFKQAALKRLENLGKGGD                              391
```

Based on this analysis, it was predicted that these proteins and their epitopes could be useful antigens for vaccines or diagnostics.

Example 1566

A DNA sequence (GBSx1659) was identified in *S. agalactiae* <SEQ ID 4839> which encodes the amino acid sequence <SEQ ID 4840>. Analysis of this protein sequence reveals the following:

```
>GP:BAB06865 GB:AP001517 unknown conserved protein [Bacillus halodurans]
Identities = 80/150 (53%), Positives = 115/150 (76%)
Query: 1    MRCPKCGYNKSSVVDSRQAEEGTTIRRRRECEKCGNRFTTFERLEELPLLVIKKDGTREQ    60
            MRCP C +N + V+DSR A EG +IRRRRECE C +RFTTFE +EE+PL+V+KKDGTR++
Sbjct: 1    MRCPACHHNGTRVLDSRPAHEGRSIRRRRECESCNHRFTTFEMIEEVPLIVVKKDGTRQE    60

Query: 61   FSRDKILNGIIQSAQKRPVSSEDIENCILRIERKIRSEYEDEVSSITIGNLVMDELAELD   120
            FS DKIL G+I++ +KRPV  E +E  +  +ER++R +  ++EV S  IG LVM+ LA +D
Sbjct: 61   FSSDKILRGLIRACEKRPVPLETLEGIVNEVERELRGQGKNEVDSKEIGELVMERLANVD   120

Query: 121  EITYVRFASVYKSFKDVDEIEELLQQITKR                               150
            ++  YVRFASVY+ FKD++    + L+++ +R
Sbjct: 121  DVAYVRFASVYRQFKDINVFIQELKELMER                               150
```

Possible site: 19
>>> Seems to have no N-terminal signal sequence
----- Final Results -----
   bacterial cytoplasm --- Certainty = 0.4485 (Affirmative) <succ>
    bacterial membrane --- Certainty = 0.0000 (Not Clear) <succ>
     bacterial outside --- Certainty = 0.0000 (Not Clear) <succ>

The protein has homology with the following sequences in the GENPEPT database.

A related DNA sequence was identified in *S. pyogenes* <SEQ ID 4841> which encodes the amino acid sequence <SEQ ID 4842>. Analysis of this protein sequence reveals the following:

Possible site: 19
>>> Seems to have no N-terminal signal sequence
----- Final Results -----
   bacterial cytoplasm --- Certainty = 0.4365 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

```
Identities = 131/155 (84%), Positives = 143/155 (91%)
Query: 1    MRCPKCGYNKSSVVDSRQAEEGTTIRRRRECEKCGNRFTTFERLEELPLLVIKKDGTREQ   60
            +RCPKC Y+KSSVVDSRQAE+G TIRRRRECE+C  RFTTFER+EELPLLVIKKDGTREQ
Sbjct: 1    VRCPKCNYHKSSVVDSRQAEDGNTIRRRRECEQCHTRFTTFERVEELPLLVIKKDGTREQ   60

Query: 61   FSRDKILNGIIQSAQKRPVSSEDIENCILRIERKIRSEYEDEVSSITIGNLVMDELAELD  120
            FSRDKILNG++QSAQKRPVSS DIEN I RIE+++R+ YE+EVSS  IGNLVMDELAELD
Sbjct: 61   FSRDKILNGVVQSAQKRPVSSTDIENVISRIEQEVRTTYENEVSSTAIGNLVMDELAELD  120

Query: 121  EITYVRFASVYKSFKDVDEIEELLQQITKRVRSKK                           155
            EITYVRFASVYKSFKDVDEIEELLQQIT RVR KK
Sbjct: 121  EITYVRFASVYKSFKDVDEIEELLQQITNRVRGKK                           155
```

Based on this analysis, it was predicted that these proteins and their epitopes could be useful antigens for vaccines or diagnostics.

Example 1567

A DNA sequence (GBSx1660) was identified in *S. agalactiae* <SEQ ID 4843> which encodes the amino acid sequence <SEQ ID 4844>. This protein is predicted to be CsrS (mtrB). Analysis of this protein sequence reveals the following:

Possible site: 35
>>> Seems to have no N-terminal signal sequence
INTEGRAL    Likelihood = –11.30    Transmembrane 22-38 (18-43)
INTEGRAL    Likelihood = –9.66    Transmembrane 189-205 (187-212)
----- Final Results -----
   bacterial membrane --- Certainty = 0.5522 (Affirmative) <succ>
     bacterial outside --- Certainty = 0.0000 (Not Clear) <succ>
       bacterial cytoplasm --- Certainty = 0.0000 (Not Clear) <succ>

A related DNA sequence was identified in *S. pyogenes* <SEQ ID 2109> which encodes the amino acid sequence <SEQ ID 2110>. Analysis of this protein sequence reveals the following:

Possible site: 35
>>> Seems to have a cleavable N-term signal seq.
INTEGRAL    Likelihood = –6.32    Transmembrane 196-212 (189-214)
----- Final Results -----
   bacterial membrane --- Certainty = 0.3527 (Affirmative) <succ>
     bacterial outside --- Certainty = 0.0000 (Not Clear) <succ>
       bacterial cytoplasm --- Certainty = 0.0000 (Not Clear) <succ>

An alignment of the GAS and GBS proteins is shown below.

```
Identities = 248/501(49%), Positives = 363/501 (71%), Gaps = 4/501 (0%)
Query: 1    MKNKKDQFIGVKQPLSKKLSQLVFILFFSLFTVFSVLVYTSATRYVLHREKINVGRSLEK   60
            M+N+K +    K  L K+LS + F+LFF +F+ F+++ Y+S    ++L +EK +V +++
Sbjct: 1    MENQKQKQKKYKNSLPKRLSNIFFVLFFCIFSAFTLIAYSSTNYFLLKKEKQSVFQAVNI   60

Query: 61   TRVRLSQANSSLTSDDILEILYNQVFADDIYPHKRQNGIVRTGESIDSILYVNQEMTLYD  120
            RVRLS+ +S+ T +++ E+LY         ++ + ++R+   I + L  NQ++ +Y+
Sbjct: 61   VRVRLSEVDSNFTLENLAEVLYKNDKTHLRIDDRKGSRVIRSERDITNTLDANQDIYVYN  120

Query: 121  VNRKPVFST-LRTGMPTIGKSMGKVIISKVADM-EGFVGTKAIYSQKTGQLLGYVQIFYN  178
            ++++ +F+T       P +   +G+V   + D    GF   T+ +YS +TG+ +GYVQ+F++
Sbjct: 121  IDKQMIFTTDNEESSPGLHGPIGRVYHDHIEDQYRGFSMTQKVYSNRTGKFVGYVQVFHD  180

Query: 179  LGRYYSMRQNIIVFLIMMEVLGTVLALVVINSATKRIVRPVENLHDLMHQISENPSNLEI  238
            LG YY +R  ++ +L+++E+ GT LA ++I   T+R ++P+ NLH++M  ISENP+NL +
Sbjct: 181  LGNYYVIRARLLFWLLVVELFGTSLAYLIILITTRRFLKPLHNLHEVMRNISENPNNLNL  240

Query: 239  RSKVRSEDEIGELSRIFDGMLDQLEDYTRRQSQFISDVSHELRTPVAVVKGHIGLLQRWG  298
            RS + S DEI ELS IFD MLD+LE +T+ QS+FISDVSHELRTPVA++KGHIGLLQRWG
Sbjct: 241  RSDISSGDEIEELSVIFDNMLDKLETHTKLQSRFISDVSHELRTPVAIIKGHIGLLQRWG  300

Query: 299  KDDPEILEESLAAAYHEADRMSLMINDMLNMIRVQGSLELHQDEVTDLSSSISVVIENFR  358
            KDD +ILEESL A   HEADRM++MINDML+MIRVQGS E HQ+++T L  SI  V+ NFR
```

-continued
```
Sbjct: 301  KDDSDILEESLTATAHEADRMAIMINDMLDMIRVQGSFEGHQNDMTVLEDSIETVVGNFR  360

Query: 359  ILREDFQFIFENNISDIVWGKIYKIHFEQALMILIDNAIKYSPSYKEVSVVLSVDNDFAT  418
            +LREDF F +++      +  +IYK HFEQALMILIDNA+KYS   K++++ LSV
Sbjct: 361  VLREDFIFTWQSENPKTI-ARIYKNHFEQALMILIDNAVKYSRKEKKIAINLSVTGKQEA  419

Query: 419  VV-VKDKGEGISDEDIEFIFDRFYRTDKSRNRESTQAGLGIGLSVFKQIMDAYHLKVDIK  477
            +V V+DKGEGIS EDIE IF+RFYRTDKSRNR STQAGLGIGLS+ KQI+D YHL++ ++
Sbjct: 420  IVRVQDKGEGISKEDIEHIFERFYRTDKSRNRTSTQAGLGIGLSILKQIVDGYHLQMKVE  479

Query: 478  SELNQGTEFIVRIPIKKFEET                                        498
            SELN+G+ FI+ IP+ + +E+
Sbjct: 480  SELNEGSVFILHIPLAQSKES                                        500
```

A related GBS gene <SEQ ID 8845> and protein <SEQ ID 8846> were also identified. Analysis of this protein sequence reveals the following:

Lipop: Possible site: −1   Crend: 5
SRCFLG: 0
McG: Length of UR: 5
Peak Value of UR: 0.74
Net Charge of CR: 2
McG: Discrim Score: −10.19
GvH: Signal Score (−7.5): −3.66
Possible site: 35
>>> Seems to have no N-terminal signal sequence
Amino Acid Composition: calculated from 1
ALOM program   count: 2 value: −11.30 threshold: 0.0
INTEGRAL      Likelihood = −11.30  Transmembrane 22-38 (18-43)
INTEGRAL      Likelihood = −9.66   Transmembrane 189-205 (187-212)
PERIPHERAL   Likelihood = 2.86    405
modified ALOM score: 2.76
icml HYPID: 7 CFP: 0.552
*** Reasoning Step: 3
----- Final Results -----
   bacterial membrane --- Certainty = 0.5522 (Affirmative) <succ>
      bacterial outside --- Certainty = 0.0000 (Not Clear) <succ>
        bacterial cytoplasm --- Certainty = 0.0000 (Not Clear) <succ>

SEQ ID 8846 (GBS321) was expressed in *E. coli* as a GST-fusion product. SDS-PAGE analysis of total cell extract is shown in FIG. 173 (lane 6; MW 84 kDa). It was also expressed in *E. coli* as a His-fusion product. SDS-PAGE analysis of total cell extract is shown in FIG. 80 (lane 2; MW 58.7 kDa).

GBS321-GST was purified as shown in FIG. 220, lane 3.

Based on this analysis, it was predicted that these proteins and their epitopes could be useful antigens for vaccines or diagnostics.

Example 1568

A DNA sequence (GBSx1661) was identified in *S. agalactiae* <SEQ ID 4845> which encodes the amino acid sequence <SEQ ID 4846>. This protein is predicted to be CsrR (trcR). Analysis of this protein sequence reveals the following:

Possible site: 61
>>> Seems to have no N-terminal signal sequence
----- Final Results -----
   bacterial cytoplasm --- Certainty = 0.2649 (Affirmative) <succ>
      bacterial membrane --- Certainty = 0.0000 (Not Clear) <succ>
        bacterial outside --- Certainty = 0.0000 (Not Clear) <succ>

A related DNA sequence was identified in *S. pyogenes* <SEQ ID 3259> which encodes the amino acid sequence <SEQ ID 3260>. Analysis of this protein sequence reveals the following:

Possible site: 61
>>> Seems to have no N-terminal signal sequence
----- Final Results -----
   bacterial cytoplasm --- Certainty = 0.3226 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below.

```
Identities = 193/229 (84%), Positives = 211/229 (91%), Gaps = 1/229 (0%)
Query:   1  MGKKILIIEDEKNLARFVSLELLHEGYDVVVETNGREGLDTALEKDFDLILLDLMLPEMD   60
            M KKILIIEDEKNLARFVSLEL HEGY+V+VE NGREGL+TALEK+FDLILLDLMLPEMD
Sbjct:   1  MTKKILIIEDEKNLARFVSLELQHEGYEVIVEVNGREGLETALEKEFDLILLDLMLPEMD   60

Query:  61  GFEITRRLQAEKTTYIMMMTARDSVMDIVAGLDRGADDYIVKPFAIEELLARVRAIFRRQ  120
            GFE+TRRLQ EKTTYIMMMTARDS+MD+VAGLDRGADDYIVKPFAIEELLAR+RAIFRRQ
Sbjct:  61  GFEVTRRLQTEKTTYIMMMTARDSIMDVVAGLDRGADDYIVKPFAIEELLARIRAIFRRQ  120

Query: 121  EIETKTKEKGDSGSFRDLSLNTHNRSAMRGDEEISLTKREFDLLNVLMTNMERVMTREEL  180
            +IE++ K+    G +RDL LN  NRS  RGD+EISLTKRE+DLLN+LMTNMNRVMTREEL
Sbjct: 121  DIESE-KKVPSQGIYRDLVLNPQNRSVNRGDDEISLTKREYDLLNILMTNMNRVMTREEL  179

Query: 181  LEHVWKYDVAAETNVVDVYIRYLRGKIDIPGRESYIQTVRGMGYVIREK            229
            L +VWKYD A ETNVVDVYIRYLRGKIDIPG+ESYIQTVRGMGYVIREK
Sbjct: 180  LSNVWKYDEAVETNVVDVYIRYLRGKIDIPGKESYIQTVRGMGYVIREK            228
```

Based on this analysis, it was predicted that these proteins and their epitopes could be useful antigens for vaccines or diagnostics.

Example 1569

A DNA sequence (GBSx1662) was identified in *S. agalactiae* <SEQ ID 4847> which encodes the amino acid sequence <SEQ ID 4848>. Analysis of this protein sequence reveals the following:

```
Possible site: 60
>>> Seems to have no N-terminal signal sequence
----- Final Results -----
    bacterial cytoplasm --- Certainty = 0.3864 (Affirmative) <succ>
    bacterial membrane --- Certainty = 0.0000 (Not Clear) <succ>
    bacterial outside--- Certainty = 0.0000 (Not Clear) <succ>
```

The protein has homology with the following sequences in the GENPEPT database.

```
>GP:AAG32547 GB:U12643 YlbN-like hypothetical protein [Streptococcus gordonii]
Identities = 91/174 (52%), Positives = 133/174 (76%), Gaps = 3/174 (1%)
Query:   3    LTEIKKSPEGLYFDKKIDIKESLMERHSEIMDISDIQVSGHVVYEDGLYLLDYNMAYDIT    62
              + EI+K+P+GL F+KK+D+ E L ER++EI+D+ DI  SG   YEDGLY LDY ++Y IT
Sbjct:   4    IQEIRKNPDGLAFEKELDLAEELKERNAEILDVQDIVASGRAQYEDGLYFLDYELSYTIT    63

Query:  63    LPSSRSMKPVVLSEKQTINEVFIEAENVSTKKELVDQELVLILEEDDINLEESVIDNILL   122
              L SSRSM+PV  E   +NE+F+E   V++ +E++DQ+LVL +E  +IN+ ESV DNILL
Sbjct:  64    LASSRSMEPVERKESYLVNEIFMEDGQVAS-QEMIDQDLVLPIENGEINVAESVADNILL   122

Query: 123    NIPLRVL-AADEVGVEADLSGKNWSLMTEKQYEEKQAKEKEKSNPFAALEGMFD         175
              NIPL+VL AA+E G +    +G++W +MTE   Y++ QA++KE+++PFA L+G+FD
Sbjct: 123    NIPLKVLTAAEEAGSDLP-TGRDWQVMTEDDYQKYQAEKKEENSPFAGLQGLFD         175
```

A related DNA sequence was identified in *S. pyogenes* <SEQ ID 4849> which encodes the amino acid sequence <SEQ ID 4850>. Analysis of this protein sequence reveals the following:

```
Possible site: 42
>>> Seems to have no N-terminal signal sequence
----- Final Results -----
    bacterial cytoplasm --- Certainty = 0.3032 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
Identities = 86/175 (49%), Positives = 135/175 (77%)

Query:    1   MLLTEIKKSPEGLYFDKKIDIKESLMERHSEIMDISDIQVSGHVVYEDGLYLLDYNMAYD    60
              +  ++EI+K P+GL FD+  D+K  L+ER  +I+DI  ++  G+V Y+ GLYLLDY ++Y+
Sbjct:    3   LAISEIRKHPDGLSFDRLCDVKSMLLERDQQIIDIKAVKAVGNVRYDKGLYLLDYQLSYE    62

Query:   61   ITLPSSRSMKPVVLSEKQTINEVFIEAENVSTKKELVDQELVLILEEDDINLEESVIDNI   120
              +  LPSSRSM PV LSE Q I E+FIEA +++ KKELV+  LVL+L++D INLEES++DNI
Sbjct:   63   VILPSSRSMVPVCLSEVQHIQELFIEATDLADKKELVEDNLVLVLDKDAINLEESIVDNI   122

Query:  121   LLNIPLRVLAADEVGVEADLSGKNWSLMTEKQYEEKQAKEKEKSNPFAALEGMFD        175
              LL  IP++VL  +E +    +G+NW+++TE+ Y+  +  +++++NPFA+L+G+FD
Sbjct:  123   LLAIPVQVLTEEEKKSKELPAGQNWAVLTEEDYQCLKEEKQKENNPFASLQGLFD        177
```

Based on this analysis, it was predicted that these proteins and their epitopes could be useful antigens for vaccines or diagnostics.

Example 1570

A DNA sequence (GBSx1663) was identified in *S. agalactiae* <SEQ ID 4851> which encodes the amino acid sequence <SEQ ID 4852>. This protein is predicted to be heat shock protein (htpX). Analysis of this protein sequence reveals the following:

```
Possible site: 25
>>> Seems to have a cleavable N-term signal seq.
INTEGRAL    Likelihood = -11.30  Transmembrane 195-211 (190-221)
INTEGRAL    Likelihood = -11.09  Transmembrane 43-59 (31-62)
INTEGRAL    Likelihood = -3.61   Transmembrane 153-169 (153-174)
----- Final Results -----
   bacterial membrane --- Certainty = 0.5522 (Affirmative) <succ>
     bacterial outside --- Certainty = 0.0000 (Not Clear) <succ>
   bacterial cytoplasm --- Certainty = 0.0000 (Not Clear) <succ>
```

The protein has homology with the following sequences in the GENPEPT database.

```
>GP:AAB70525 GB:AF017421 putative heat shock protein HtpX [Streptococcus gordonii]
Identities = 220/297 (74%), Positives = 261/297 (87%), Gaps = 1/297 (0%)

Query:    1  MLYQQIASNKRKTVVLLIVFFCLLAAIGAAVGYLVLGSYQFGLVLALIIGVIYAVSMIFQ    60
             ML++QIA+NKR+T  LL+ FF LLA IGAA GYL + S  G+++A  IIG+IYA++MIFQ
Sbjct:    1  MLFEQIAANKRRTWFLLVAFFALLALIGAAAGYLWMNSPLGGVIIAFIIGLIYAITMIFQ    60

Query:   61  STNVVMSMNNAREVTEDEAPNYFHIVEDMAMIAQIPMPRVFIVEDDSLNAFATGSKPENA   120
             ST VVMSMN AR+V+E EAP  +HIV+DMAM+AQIPMPRV+IVEDDS NAFATGS PENA
Sbjct:   61  STEVVMSMNGARQVSEQEAPELYHIVQDMAMVAQIPMPRVYIVEDDSPNAFATGSNPENA   120

Query:  121  AVAATTGLLAVMNREELEGVIGHEVSHIRNYDIRISTIAVALASAVTLISSIGSRMLFYG   180
             AVAATTGLL +MNREELEGVIGHEVSHIRNYDIRISTIAVALASA+T+ISS+  RM++YG
Sbjct:  121  AVAATTGLLRLMNREELEGVIGHEVSHIRNYDIRISTIAVALASAITMISSVAGRMMWYG   180

Query:  181  GGRRRDDDREDGG-NILVLIFSILSLILAPLAASLVQLAISRQREYLADASSVELTRNPQ   239
             GGRRR+D  +D G  +L+L+FS++++ILAPLAA+LVQLAISRQRE+LADASSVELTRNPQ
Sbjct:  181  GGRRRNDRDDDSGLGLLMLVFSLIAIILAPLAATLVQLAISRQREFLADASSVELTRNPQ   240

Query:  240  GMISALEKLDRSEPMGHPVDDASAALYINDPTKKEGLKSLFYTHPPIADRIERLRHM      296
             GMI AL+KLD SEPM   VDDASAALYI+DP KK GL+ LFYTHPPI++R+ERLR M
Sbjct:  241  GMIRALQKLDNSEPMHRHVDDASAALYISDPKKKGGLQKLFYTHPPISERVERLRKM      297
```

A related DNA sequence was identified in *S. pyogenes* <SEQ ID 4853> which encodes the amino acid sequence <SEQ ID 4854>. Analysis of this protein sequence reveals the following:

```
Possible site: 31
>>> Seems to have a cleavable N-term signal seq.
INTEGRAL    Likelihood = -9.77   Transmembrane 197-213 (192-223)
INTEGRAL    Likelihood = -8.33   Transmembrane 43-59 (33-61)
INTEGRAL    Likelihood = -3.82   Transmembrane 153-169 (153-174)
----- Final Results -----
   bacterial membrane --- Certainty = 0.4906 (Affirmative) <succ>
     bacterial outside --- Certainty = 0.0000 (Not Clear) <succ>
   bacterial cytoplasm --- Certainty = 0.0000 (Not Clear) <succ>
```

The protein has homology with the following sequences in the databases:

```
>GP:AAB70525 GB:AF017421 putative heat shock protein HtpX [Streptococcus gordonii]
Identities = 208/298 (69%), Positives = 257/298 (85%), Gaps = 1/298 (0%)

Query:    1  MLYQQISQNKQRTVVLLVGFFALLALIGASAGYLLLDNYAMGLVLALVIGVIYATSMIFQ    60
             ML++QI+ NK+RT LLV FFALLALIGA+AGYL +++    G+++A +IG+IYA +MIFQ
Sbjct:    1  MLFEQIAANKRRTWFLLVAFFALLALIGAAAGYLWMNSPLGGVIIAFIIGLIYAITMIFQ    60

Query:   61  STSLVMSMNNAREVTEKEAPGFEHIVEDMAMVAQIPMPRVFIIEDPSLNAFATGSSPQNA   120
             ST +VMSMN AR+V+E+EAP  +HIV+DMAMVAQIPMPRV+I+ED S NAFATGS+P+NA
Sbjct:   61  STEVVMSMNGARQVSEQEAPELYHIVQDMAMVAQIPMPRVYIVEDDSPNAFATGSNPENA   120

Query:  121  AVAATTGLLEVMNREELEGVIGHEISHIRNYDIRISTIAVALASAVTVISSIGGRMLWYG   180
             AVAATTGLL +MNREELEGVIGHE+SHIRNYDIRISTIAVALASA+T+ISS+ GRM+WYG
Sbjct:  121  AVAATTGLLRLMNREELEGVIGHEVSHIRNYDIRISTIAVALASAITMISSVAGRMMWYG   180

Query:  181  GGSRRQRDDGDDDVLRIITLLLSLLSLLLAPLVASLIQLAISRQREYLADASSVELTRNP   240
             GG RR+ D  DD  L ++ L+ SL++++LAPL A+L+QLAISRQRE+LADASSVELTRNP
Sbjct:  181  GG-RRRNDRDDDSGLGLLMLVFSLIAIILAPLAATLVQLAISRQREFLADASSVELTRNP   239

Query:  241  QGMIKALEKLQLSQPMKHPVDDASAALYINEPRKERSFSSLFSTHPPIEERIERLKNM     298
             QGMI+AL+KL  S+PM   VDDASAALYI++P+KK    LF THPPI ER+ERL+ M
Sbjct:  240  QGMIRALQKLDNSEPMHRHVDDASAALYISDPKKKGGLQKLFYTHPPISERVERLRKM     297
```

An alignment of the GAS and GBS proteins is shown below.

```
Identities = 233/298 (78%), Positives = 262/298 (87%), Gaps = 2/298 (0%)

Query:     1  MLYQQIASNKRKTVVLLIVFFCLLAAIGAAVGYLVLGSYQFGLVLALIIGVIYAVSMIFQ    60
              MLYQQI+ NK++TVVLL+ FF LLA IGA+ GYL+L +Y GLVLAL+IGVIYA SMIFQ
Sbjct:     1  MLYQQISQNKQRTVVLLVGFFALLALIGASAGYLLLDNYAMGLVLALVIGVIYATSMIFQ    60

Query:    61  STNVVMSMNNAREVTEDEAPNYFHIVEDMAMIAQIPMPRVFIVEDDSLNAFATGSKPENA   120
              ST++VMSMNNAREVTE EAP +FHIVEDMAM+AQIPMPRVFI+ED SLNAFATGS P+NA
Sbjct:    61  STSLVMSMNNAREVTEKEAPGFFHIVEDMAMVAQIPMPRVFIIEDPSLNAFATGSSPQNA   120

Query:   121  AVAATTGLLAVMNREELEGVIGHEVSHIRNYDIRISTIAVALASAVTLISSIGSRMLFYG   180
              AVAATTGLL VMNREELEGVIGHE+SHIRNYDIRISTIAVALASAVT+ISSIG RML+YG
Sbjct:   121  AVAATTGLLEVMNREELEGVIGHEISHIRNYDIRISTIAVALASAVTVISSIGGRMLWYG   180

Query:   181  GG--RRRDDDREDGGNILVLIFSILSLILAPLAASLVQLAISRQREYLADASSVELTRNP   238
              GG  R+RDD  +D   I+ L+ S+LSL+LAPL ASL+QLAISRQREYLADASSVELTRNP
Sbjct:   181  GGSRRQRDDGDDDVLRIITLLLSLLSLLLAPLVASLIQLAISRQREYLADASSVELTRNP   240

Query:   239  QGMISALEKLDRSEPMGHPVDDASAALYINDPTKKEGLKSLFYTHPPIADRIERLRHM     296
              QGMI ALEKL  S+PM HPVDDASAALYIN+P KK    SLF THPPI +RIERL++M
Sbjct:   241  QGMIKALEKLQLSQPMKHPVDDASAALYINEPRKKRSFSSLFSTHPPIEERIERLKNM     298
```

A related GBS gene <SEQ ID 8847> and protein <SEQ ID 8848> were also identified. Analysis of this protein sequence reveals the following:

Lipop: Possible site: −1  Crend: 10
McG: Discrim Score: 9.61
GvH: Signal Score (−7.5): −0.97
Possible site: 25
>>> Seems to have a cleavable N-term signal seq.
ALOM program  count: 3 value: −11.30 threshold: 0.0
INTEGRAL  Likelihood = −11.30  Transmembrane 195-211 (190-221)
INTEGRAL  Likelihood = −11.09  Transmembrane 43-59 (31-62)
INTEGRAL  Likelihood = −3.61  Transmembrane 153-169 (153-174)
PERIPHERAL  Likelihood = 5.89  87
modified ALOM score: 2.76
\*\*\* Reasoning Step: 3
----- Final Results -----
  bacterial membrane --- Certainty = 0.5522 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
73.8/88.3% over 296aa
imported SP|O30795|PUTATIVE HEAT SHOCK PROTEIN HTPX. Insert characterized
GP|2407215|gb|AAB70525.1||AF017421 putative heat shock protein HtpX
{Streptococcus gordonii} Insert characterized
PIR|T48855|T48855 probable heat shock protein HtpX-Streptococcus gordonii
Insert characterized
ORF02338(301-1188 of 1488)
SP|O30795|HTPX_STRGC(1-297 of 297) PUTATIVE HEAT SHOCK PROTEIN
HTPX.GP|2407215|gb|AAB70525.1||AF017421 putative heat shock protein HtpX
{Streptococcus gordonii}PIR|T48855|T48855 probable heat shock protein HtpX
[imported]-
Streptococcus gordonii
% Match = 44.0
% Identity = 73.7 % Similarity = 88.2
Matches = 219 Mismatches = 34 Conservative Sub.s = 43

141       171       201       231       261       291       321       351
     NFLFTSVI*HNNIQL*CEIRNFPK*YCWKTIWVQTKPILRNS*RRKRSAKSFL*LLIEKGERLLLYQQIASNKRKTVVLL
                                                                 :|::|||:|||:|   ||
                                                                 MLFEQIAANKRRTWFLL
                                                                         10

381       411       441       471       501       531       561       591
     IVFFCLLAAIGAAVGYLVLGSYQFGLVLALIIGVIYAVSMIFQSTNVVMSMNNAREVTEDEAPNYFHIVEDMAMIAQIPM
     :  ||  |||  ||| ||||  :  |      |:::|:|||  |||||  |||||  ||||:|  |  |||||:|||||
     VAFFALLALIGAAAGYLWMNSPLGGVIIAFIIGLIYAITMIFQSTEVVMSMNGARQVSEQEAPELYHIVQDMAMVAQIPM
              30        40        50        60        70        80        90

621       651       681       711       741       771       801       831
     PRVFIVEDDSLNAFATGSKPENAAVAATTGLLAVMNREELEGVIGHEVSHIRNYDIRISTIAVALASAVTLISSIGSRML
     ||:||||||| |||||||:|||||||||||| :||||||||||||||||||||||||||||||||||:|:|||   ||:
     PRVYIVEDDSPNAFATGSNPENAAVAATTGLLRLMNREELEGVIGHEVSHIRNYDIRISTIAVALASAITMISSVAGRMM
              110       120       130       140       150       160       170
```

```
861       888       918       948       978      1008      1038      1068
FYGGGRRRDDDREDGG-NILVLIFSILSLILAPLAASLVQLAISRQREYLADASSVELTRNPQGMISALEKLDRSEPMGH
:|||||||:|   :|   |   :|:|:||::::|||||||:||||||||||:||||||||||||||||| ||:||| ||||
WYGGGRRRNDRDDDSGLGLLMLVFSLIAIILAPLAATLVQLAISRQREFLADASSVELTRNPQGMIRALQKLDNSEPMHR
          190       200       210       220       230       240       250

1098      1128      1158      1188      1218      1248      1278      1308
PVDDASAALYINDPTKKEGLKSLFYTHPPIADRIERLRHM*SLTKRRVAMPCVLFF*DKACKT*YNMTYTIKGDGTCYLQ
|||||||||||:||  || ||:  |||||||||::|:||||  |
HVDDASAALYISDPKKGGLQKLFYTHPPISERVERLRKM
          270       280       290
```

SEQ ID 8848 (GBS179) was expressed in *E. coli* as a GST-fusion product. SDS-PAGE analysis of total cell extract is shown in FIG. 175 (lane 11; MW 58 kDa).

GBS179-GST was purified as shown in FIG. 227, lane 5.

Based on this analysis, it was predicted that these proteins and their epitopes could be useful antigens for vaccines or diagnostics.

Example 1571

A DNA sequence (GBSx1665) was identified in *S. agalactiae* <SEQ ID 4855> which encodes the amino acid sequence <SEQ ID 4856>. Analysis of this protein sequence reveals the following:

Possible site: 20
>>> Seems to have an uncleavable N-term signal seq
INTEGRAL    Likelihood = –15.44    Transmembrane 4-20 (1-27)
----- Final Results -----
   bacterial membrane --- Certainty = 0.7177 (Affirmative) <succ>
   bacterial outside --- Certainty = 0.0000 (Not Clear) <succ>
   bacterial cytoplasm --- Certainty = 0.0000 (Not Clear) <succ>

A related DNA sequence was identified in *S. pyogenes* <SEQ ID 4857> which encodes the amino acid sequence <SEQ ID 4858>. Analysis of this protein sequence reveals the following:

Possible site: 15
>>> Seems to have a cleavable N-term signal seq.
----- Final Results -----
   bacterial outside --- Certainty = 0.3000 (Affirmative) <succ>
   bacterial membrane --- Certainty = 0.0000 (Not Clear) <succ>
   bacterial cytoplasm --- Certainty = 0.0000 (Not Clear) <succ>

The protein has homology with the following sequences in the GENPEPT database.

```
>GP:AAG23700 GB:AF017421 LemA-like protein [Streptococcus gordonii]
Identities = 124/182 (68%), Positives = 152/182 (83%)

Query:    1  MGTMILIAIIALFVIWLIVAYNSLVRSRMHTKESWSQIDVQLKRRNDLIPNLIETVKGYA    60
             M  +I IA+I + V+++I  YNSLVR+RM T+E+WSQIDVQLKRRNDL+PNLIETVKGY
Sbjct:    1  MSFIITIAVIVVIVLFVISVYNSLVRARMQTQEAWSQIDVQLKRANDLLPNLIETVKGYG   60

Query:   61  AYEGKTLEKIAELRAQVAKANTPAEAMTASNELTRQLSSILAVAENYPDLKANNSFVKLQ   120
              YE  TLEK+ +LRAQVA A++PA+AM AS+ LTRQ+S I AVAE+YPDLKAN +++KLQ
Sbjct:   61  KYEQATLEKVTQLRAQVASASSPADAMKASDALTRQISGIFAVAESYPDLKANENYLKLQ  120

Query:  121  EELTNTENKISYSRQLYNTTTSNYNVKLETFPSNIVGKLFGFKPSQFLETPEEEKEVPKV  180
             EELTNTENKISYSRQLYN+    NYNVKL+ FPSN++  +F F+P+ FL TPEEEK VPKV
Sbjct:  121  EELTNTENKISYSRQLYNSVAGNYNVKLQAFPSNVIAGMFAFRPADFLSTPEEEKAVPKV  180

Query:  181  SF                                                            182
             F
Sbjct:  181  DF                                                            182
```

The protein has homology with the following sequences in the databases:

```
>GP:AAC44350 GB:U66186 LemA [Listeria monocytogenes]
Identities = 91/181 (50%), Positives = 121/181 (66%), Gaps = 2/181 (1%)

Query:    5  LIILVVLGVLALWLMISYNSLVKSRMHTKEAWSQIDVQLKRRNDLIPNLIETVKGYASYE   64
             +I + V+ +L L    YNSLVK R    E W+QIDVQLKRR DLIPNL+ETVKGYA +E
```

```
-continued
Sbjct:    5  IIAIAVVVILVLIYFGLYNSLVKYRNRVDETWAQIDVQLKRRFDLIPNLVETVKGYAKHE   64

Query:   65  QKTFEKITDLRARVAN--ASTPQETMAASNELSKQVTSLFAVAENYPDLKANENFLKLQE  122
             ++T ++ + R ++      A   Q  ++ A N LS  +  S+FA+ E YPDLKAN +F++LQ
Sbjct:   65  KETLTQVIEARNKMMEVPADNRQGQIEADNMLSGALKSIFALGEAYPDLKANTSFIELQH  124

Query:  123  ELTNTENKISYSRQLYNSTTSNYNLQLESFPSNIAGKLFGFKPSEFLQTPEAEKEVPKVEF  183
             ELT TENK++YSRQLYN+T   YN +++S P+NI  KL F   + L  PE E+  PKVEF
Sbjct:  125  ELTTTENKVAYSRQLYNTTVMTYNTKVQSVPTNIVAKLHNFTERDMLSIPEVERVAPKVEF  185
```

An alignment of the GAS and GBS proteins is shown below.

```
Identities = 135/181 (74%), Positives = 165/181 (90%)

Query:    4  MILIAIIALFVIWLIVAYNSLVRSRMHTKESWSQIDVQLKRRNDLIPNLIETVKGYAAYE   63
             +I++ ++ +    +WL+++YNSLV+SRMHTKE+WSQIDVQLKRRNDLIPNLIETVKGYA+YE
Sbjct:    5  LIILVVLGVLALWLMISYNSLVKSRMHTKEAWSQIDVQLKRRNDLIPNLIETVKGYASYE   64

Query:   64  GKTLEKIAELRAQVAKANTPAEAMTASNELTRQLSSILAVAENYPDLKANNSFVKLQEEL  123
                KT  EKI +LRA+VA A+TP E M ASNEL++Q++S+ AVAENYPDLKAN +F+KLQEEL
Sbjct:   65  QKTFEKITDLRARVANASTPQETMAASNELSKQVTSLFAVAENYPDLKANENFLKLQEEL  124

Query:  124  TNTENKISYSRQLYNTTTSNYNVKLETFPSNIVGKLFGFKPSQFLETPEEEKEVPKVSFDF  184
             TNTENKISYSRQLYN+TTSNYN++LE+FPSNI GKLFGFKPS+FL+TPE EKEVPKV F+F
Sbjct:  125  TNTENKISYSRQLYNSTTSNYNLQLESFPSNIAGKLFGFKPSEFLQTPEAEKEVPKVEFNF  185
```

A related GBS gene <SEQ ID 8849> and protein <SEQ ID 8850> were also identified. Analysis of this protein sequence reveals the following:

Lipop: Possible site: −1   Crend: 0
McG: Discrim Score: 14.63
GvH: Signal Score (−7.5): −3.19
Possible site: 20
>>> Seems to have an uncleavable N-term signal seq
ALOM program   count: 1 value: −15.44 threshold: 0.0

INTEGRAL      Likelihood = −15.44   Transmembrane 4-20 (1-27)
PERIPHERAL    Likelihood = 8.86     146
modified ALOM score: 3.59
*** Reasoning Step: 3
----- Final Results -----
   bacterial membrane --- Certainty = 0.7177 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the databases:

```
51.4/68.9% over 183aa
Listeria monocytogenes
EGAD|149857| LemA protein Insert characterized
GP|1519287|gb|AAC44350.1||U66186 LemA Insert characterized
ORF01545(301-846 of 1152)
EGAD|149857|159923(2-185 of 185) LemA protein {Listeria monocytogenes}
GP|1519287|gb|AAC44350.1||U66186 LemA {Listeria monocytogenes}
% Match = 23.8
% Identity = 51.4 % Similarity = 68.9
Matches = 94  Mismatches = 56  Conservative Sub.s = 32
   42         72        102        132        162        192        222        252
CFK*TSSLSVIAVRLIFSFHSTRSLK*VSNCFFCLSVSVIPCSIRTNAWGVIVNLNFYIVLYFITNTNNGNNRTFL 282        312        342        372        402        432        462        492
I*RKLL*WKKCKGATTMGTMILIAIIALFVIWLIVAYNSLVRSRMHTKESWSQIDVQLKRRNDLIPNLIETVKGYAAYEG
                :|  :|  ||::  ::|:       ||||:    |:|:||||||||   ||:||||||: ||||||  :|
                MIGWIIAIAVVVILVLIYFGLYNSLVKYRNRVDETWAQIDVQLKRRFDLIPNLVETVKGYAKHEK
                        10        20        30        40        50        60

522        546        576        606        636        666        696        726
KTLEKIAELRAQVAK--ANTPAEAMTASNELTRQLSSILAVAENYPDLKANNSFVKLQEELTNTENKISYSRQLYNTTTS
:||  ::  |  ||::  :   :|||  |  |||:|  | |||||:||  |||  |||||:|||  ||||||||||||
ETLTQVIEARNKMMEVPADNRQGQIEADNMLSGALKSIFALGEAYPDLKANTSFIELQHELTTTENKVAYSRQLYNTTVM
         80        90       100       110       120       130       140

756        786        816        846        876        906        936        966
NYNVKLETFPSNIVGKLFGFKPSQFLETPEEEKEVPKVSFDF*LRRERGFCCINKLQVIREKQLSC*LSSSVF*QLLEQL
||| |:::  |:||| ||     |   ||| :|||||: |||  |
TYNTKVQSVPTNIVAKLHNFTERDMLSIPEVERVAPKVEF
         160       170       180
```

SEQ ID 4856 (GBS42) was expressed in *E. coli* as a His-fusion product. SDS-PAGE analysis of total cell extract is shown in FIG. 5 (lane 2; MW 21.8 kDa) and in FIG. 168 (lane 5-7; MW 36 kDa). It was also expressed in *E. coli* as a GST-fusion product. SDS-PAGE analysis of total cell extract is shown in FIG. 13 (lane 8; MW 46 kDa). Purified Thio-GBS42-His is shown in FIG. 244, lane 11.

Based on this analysis, it was predicted that these proteins and their epitopes could be useful antigens for vaccines or diagnostics.

Example 1572

A DNA sequence (GBSx1666) was identified in *S. agalactiae* <SEQ ID 4859> which encodes the amino acid sequence <SEQ ID 4860>. This protein is predicted to be glucose inhibited division protein b (gidB). Analysis of this protein sequence reveals the following:

```
Possible site: 47
>>> Seems to have no N-terminal signal sequence
----- Final Results -----
    bacterial cytoplasm --- Certainty = 0.2430 (Affirmative) <succ>
    bacterial membrane --- Certainty = 0.0000 (Not Clear) <succ>
    bacterial outside --- Certainty = 0.0000 (Not Clear) <succ>
```

A related GBS nucleic acid sequence <SEQ ID 10079> which encodes amino acid sequence <SEQ ID 10080> was also identified.

The protein has homology with the following sequences in the GENPEPT database.

```
>GP:CAB16137 GB:Z99124 glucose-inhibited division protein [Bacillus subtilis]
Identities = 130/239 (54%), Positives = 170/239 (70%), Gaps = 4/239 (1%)

Query:     5  MTPQAFYQVLIEHGITLTDKQKKQFETYFRLLVEWNEKINLTAITDKEEVYLKHFYDSIA   64
              M + F   L E GI+L+ +Q +QFE Y+ +LVEWNEKINLT+IT+K+EVYLKHFYDSI
Sbjct:     1  MNIEEFTSGLAEKGISLSPRQLEQFELYYDMLVEWNEKINLTSITEKKEVYLKHFYDSIT   60

Query:    65  PILQGYID-NSPLSILDIGAGAGFPSIPMKILYPEIDITIIDSLNKRINFLNILANELEL  123
                     Y+D N   +I D+GAGAGFPS+P+KI +P + +TI+DSLNKRI FL   L+  L+L
Sbjct:    61  AAF--YVDFNQVNTICDVGAGAGFPSLPIKICFPHLHVTIVDSLNKRITFLEKLSEALQL  118

Query:   124  SGVHFFHGRAEDFGQDRVFRAKFDIVTARAVARMQVLAELTIPFLKVNGRLIALKAAAAE  183
                 F H RAE FGQ +  R  +DIVTARAVA++ VL+EL +P +K NG +ALKAA+AE
Sbjct:   119  ENTTFCHDRAETFGQRKDVRESYDIVTARAVARLSVLSELCLPLVKKNGLFVALKAASAE  178

Query:   184  EELISAEKALKTLFSQVTVNKNYKLP-NGDDRNITIVSKKKETPNKYPRKAGTPNKKPL   241
              EEL +  +KA+ TL  ++   ++KLP    DRNI ++ K K TP KYPRK GTPNK P+
Sbjct:   179  EELNAGKKAITTLGGELENIHSFKLPIEESDRNIMVIRKIKNTPKKYPRKPGTPNKSPI  237
```

A related DNA sequence was identified in *S. pyogenes* <SEQ ID 4861> which encodes the amino acid sequence <SEQ ID 4862>. Analysis of this protein sequence reveals the following:

```
Possible site: 21
>>> Seems to have no N-terminal signal sequence
----- Final Results -----
    bacterial cytoplasm --- Certainty = 0.4862 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
Identities = 170/237 (71%), Positives = 202/237 (84%)

Query:     5  MTPQAFYQVLIEHGITLTDKQKKQFETYFRLLVEWNEKINLTAITDKEEVYLKHFYDSIA   64
              MTPQ FY+ L E G +L+ KQK+QF+TYF+ LVEWN KINLTAIT++ EVYLKHFYDSIA
Sbjct:     1  MTPQDFYRTLEEDGFSLSSKQKEQFDTYFKSLVEWNTKINLTAITEENEVYLKHFYDSIA   60

Query:    65  PILQGYIDNSPLSILDIGAGAGFPSIPMKILYPEIDITIIDSLNKRINFLNILANELELS  124
              PILQG++ N P+ +LDIGAGAGFPS+PMKIL+P +++TIIDSLNKRI+FL +LA EL L
Sbjct:    61  PILQGFLANEPIKLLDIGAGAGFPSLPMKILFPNLEVTIIDSLNKRISFLTLLAQELGLE  120

Query:   125  GVHFFHGRAEDFGQDRVFRAKFDIVTARAVAKMQVLAELTIPFLKVNGRLIALKAAAAEE  184
                VHFFHGRAEDFGQD+ FR +FD+VTARAVA+MQVL+ELTIPFLK  G+LIALKA AA++
Sbjct:   121  NVHFFHGRAEDFGQDKAFRGQFDVVTARAVARMQVLSELTIPFLKIGGKLIALKAQAADQ  180

Query:   185  ELISAEKALKTLFSQVTVNKNYKLPNGDDRNITIVSKKKETPNKYPRKAGTPNKKPL     241
              EL  A+ AL  LF +V N +Y+LPNGD R ITIV KKKETPNKYPRKAG PNKKPL
Sbjct:   181  ELEEAKNALCLLFGKVIKNHSYQLPNGDSRFITIVEKKKETPNKYPRKAGLPNKKPL     237
```

Based on this analysis, it was predicted that these proteins and their epitopes could be useful antigens for vaccines or diagnostics.

Example 1573

A DNA sequence (GBSx1667) was identified in *S. agalactiae* <SEQ ID 4863> which encodes the amino acid sequence <SEQ ID 4864>. Analysis of this protein sequence reveals the following:

```
Possible site: 13
>>> Seems to have a cleavable N-term signal seq.
----- Final Results -----
    bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>
```

The protein has no significant homology with any sequences in the GENPEPT database.

No corresponding DNA sequence was identified in *S. pyogenes*.

```
Possible site: 45
>>> Seems to have a cleavable N-term signal seq.
INTEGRAL    Likelihood = -10.14    Transmembrane 371-387 (362-391)
INTEGRAL    Likelihood = -7.48     Transmembrane 200-216 (190-217)
INTEGRAL    Likelihood = -4.94     Transmembrane 425-441 (423-446)
INTEGRAL    Likelihood = -4.67     Transmembrane 327-343 (325-349)
INTEGRAL    Likelihood = -3.77     Transmembrane 81-97 (81-98)
INTEGRAL    Likelihood = -2.66     Transmembrane 140-156 (139-157)
INTEGRAL    Likelihood = -1.33     Transmembrane 55-71 (53-71)
INTEGRAL    Likelihood = -0.27     Transmembrane 247-263 (247-263)
INTEGRAL    Likelihood = -0.11     Transmembrane 165-181 (165-181)
----- Final Results -----
    bacterial membrane --- Certainty = 0.5055 (Affirmative) <succ>
    bacterial outside --- Certainty = 0.0000 (Not Clear) <succ>
    bacterial cytoplasm --- Certainty = 0.0000 (Not Clear) <succ>
```

A related GBS nucleic acid sequence <SEQ ID 10081> which encodes amino acid sequence <SEQ ID 10082> was also identified.

The protein has homology with the following sequences in the GENPEPT database.

```
>GP:BAA04279 GB:D17462 Na+ -ATPase subunit J [Enterococcus hirae]
Identities = 170/461 (36%), Positives = 262/461 (55%), Gaps = 28/461 (6%)

Query:    12  KTMSVARKLSISFIAVILLGSILLSLPIFQYANAPKTHYIDHLFTTVSMVCVTGLSVFPI   71
              K +S  + ++   F  +IL G  LL+LP F   +    TH+ID LFT   S VCVTGL+
Sbjct:    10  KRLSPVQLIAAGFFILILFGGSLLTLPFFS-RSGESTHFIDALFTATSAVCVTGLTTLNT   68

Query:    72  SKVYNGWGQIVAILLMQTGGLGLVTMSLSYYTLRRKMSLNDQTLLQSAITYNSSTDLKK   131
              ++ +N  GQ + + L++ GGLG + + L +    ++K+S + + +L+ A+     + + K
Sbjct:    69  AEHWNSAGQFLIMTLIEIGGLGFMMIPILFFAIAKKKISFSMRIVLKEALNLEEMSGVIK   128

Query:   132  YLYMIFKVTLTLEVLAASILAIDFIPRFGLGHGIFNSIFLAVSAFCNAGFDNLEATSLAQ   191
              +  I K  ++V+ A  L++ FIP FG    GI+ SIF AVS+FCNAGFD L   + LA
Sbjct:   129  LMIYILKFAVVIQVIGAVALSVVFIPEFGWAKGIWFSIFHAVSSFCNAGFDLLGDSLLAD   188

Query:   192  FKLNPLVNIIVCFLIISGGLGFAVWKDLIEATIQTSHKGPKLIKTFPKRLSNHSKLVLKT   251
              + N  + ++V  LII+GGLGF VW+D++     + H+           K+++ HSK+ L
Sbjct:   189  -QTNVYLIMVVSALIIAGGLGFIVWRDIL-----SYHR--------VKKITLHSKVALSV   234

Query:   252  TTIILLTGTLLSWLLEFGNFRTIANLSLPKQLMVSFFQTVTMRTAGFSTIDYTQTDFATN   311
              T ++L+ G +L +L+    N  T+   +  ++L  +FF +VT RTAG+ +IDY Q   A
Sbjct:   235  TALLLIGGFIL-FLITERNGLTLVKGTFTERLANTFFMSVTPRTAGYYSIDYLQMSHAGL   293

Query:   312  LVYIIQMLIGGAPGGTAGGFKVTVIAILLLLFKAELSGQSQVTFHYRTIPSSIIKQTLSI   371
              ++ +  M IGG  G TAGG K T + ILL+      A    G+++       RTI + +   L
Sbjct:   294  ILTMFLMYIGGTSGSTAGGLKTTTLGILLIQMHAMFKGKTRAEAFGRTIRQAAV---LRA   350

Query:   372  LTFFFII--LISGYLLLLELNPHIDPFS----LFFEASSALATVGVTMNTTNQLTLGGRI   425
              LT FF+   L    +++L +   I   S      + FE  SA  TVG+TM  T  LTL G++
Sbjct:   351  LTLFFVTLSLCVVAIMVLSVTETIPKTSGIEYIAFEVFSAFGTVGLTMGLTPDLTLIGKL   410

Query:   426  VIMFLMFIGRVGPITVLLSILQK---KEKEIHYAETEIILG                    463
              VI+ LM+IGRVG +TV+LS+L K     E  Y    E   I+LG
Sbjct:   411  VIISLMYIGRVGIMTVVLSLLVKANRAEANYKYPEESIMLG                    451
```

Based on this analysis, it was predicted that this protein and its epitopes, could be useful antigens for vaccines or diagnostics.

Example 1574

A DNA sequence (GBSx1668) was identified in *S. agalactiae* <SEQ ID 4865> which encodes the amino acid sequence <SEQ ID 4866>. This protein is predicted to be v-type sodium ATP synthase subunit j. Analysis of this protein sequence reveals the following:

A related DNA sequence was identified in *S. pyogenes* <SEQ ID 4867> which encodes the amino acid sequence <SEQ ID 4868>. Analysis of this protein sequence reveals the following:

```
Possible site: 42
>>> Seems to have no N-terminal signal sequence
INTEGRAL    Likelihood = -15.12    Transmembrane 371-387 (364-396)
INTEGRAL    Likelihood = -7.32     Transmembrane 20-36 (18-42)
INTEGRAL    Likelihood = -6.53     Transmembrane 425-441 (417-446)
INTEGRAL    Likelihood = -6.16     Transmembrane 89-105 (81-106)
```

-continued

| | | | |
|---|---|---|---|
| INTEGRAL | Likelihood = −5.79 | Transmembrane 200-216 (196-223) | |
| INTEGRAL | Likelihood = −3.35 | Transmembrane 140-156 (139-157) | |
| INTEGRAL | Likelihood = −3.03 | Transmembrane 55-71 (53-74) | |
| INTEGRAL | Likelihood = −3.03 | Transmembrane 247-263 (246-264) | |
| INTEGRAL | Likelihood = −1.12 | Transmembrane 393-409 (393-409) | |
| INTEGRAL | Likelihood = −0.11 | Transmembrane 165-181 (165-181) | |

----- Final Results -----
   bacterial membrane --- Certainty = 0.7050 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the databases:

```
>GP:BAA04279 GB:D17462 Na+ -ATPase subunit J [Enterococcus hirae]
Identities = 168/466 (36%), Positives = 260/466 (55%), Gaps = 26/466 (5%)

Query:    6  MKRSFIKSLSVTQRLTFSFAIVILIGTLLLSMPFTHYQNGPNTVYLDHFFNVVSMVCVTG    65
             MK+   K LS  Q +    F I+IL G  LL++PF   ++G +T ++D  F   S VCVTG
Sbjct:    4  MKKRVRKRLSPVQLIAAGFFILILFGGSLLTLPFFS-RSGESTHFIDALFTATSAVCVTG    62

Query:   66  LSVVPVAEVYNGIGQTIAMALMQIGCLGLVTLIAVSTFAL-KRKMRLSDQTLLQSALNRG   124
             L+ +  AE +N GQ + M L++IG LG + +I +   FA+ K+K+   S + +L+ ALN
Sbjct:   63  LTTLNTAEHWNSAGQFLIMTLIEIGGLGFM-MIPILFFAIAKKKISFSMRIVLKEALNLE   121

Query:  125  DSKDLKHYLFFAYKVTFSLEAFAAIVIMIDFIPRFGWKNGIFNSIFLAVSAFCNAGFDNL   184
             +  +   + + K    ++    A+ + + FIP FGW GI+ SIF AVS+FCNAGFD L
Sbjct:  122  EMSGVIKLMIYILKFAVVIQVIGAVALSVVFIPEFGWAKGIWFSIFHAVSSFCNAGFDLL   181

Query:  185  GSSSLKDFMLNPTLNVIITFLIISGGLGFAVWVDLGVAFKKYFFERPHCYGATFRKLSNQ   244
             G S L D   N  L ++++ LII+GGLGF VW D+ +++ +         +K++
Sbjct:  182  GDSLLAD-QTNVYLIMVVSALIIAGGLGFIVWRDI-LSYHR------------VKKITLH   227

Query:  245  SRLVLQTTAVILFLGTFLTWFLEKDNSKTIANFSLHQQLMVSFFQTVTMRTAGFATISYN   304
             S++ L  TA++L +G F+ + + + N  T+    + ++L  +FF +VT RTAG+ +I Y
Sbjct:  228  SKVALSVTALLL-IGGFILFLITERNGLTLVKGTFTERLANTFFMSVTPRTAGYYSIDYL   286

Query:  305  DTLAPTNILYMIQMVIGGAPGGTAGGIKVTTAAITFLLFKAELSGQSEVTFRNRIIANKT   364
                       IL M  M IGG  G TAGG+K TT I  +    A   G++          R I
Sbjct:  287  QMSHAGLILTMFLMYIGGTSGSTAGGLKTTTLGILLIQMHAMFKGKTRAEAFGRTIRQAA   346

Query:  365  IKQTMTVLIFFFAVLMIGFILLLSVEPHIAPIP----LLFESISAIATVGVSMDLTPQLS   420
             + + +T L F    L + I++LSV  I         + FE  SA   TVG++M LTP L+
Sbjct:  347  VLRALT-LFFVTLSLCVVAIMVLSVTETIPKTSGIEYIAFEVFSAFGTVGLTMGLTPDLT   405

Query:  421  TAGRLIVIVLMFVGRVGPITVLISLI---QRKEKTIQYATTDILVG                463
               G+L++I LM++ GRVG +TV++SL+      R E    +Y    I++G
Sbjct:  406  LIGKLVIISLMYIGRVGIMTVVLSLLVKANRAEANYKYPEESIMLG                451
```

An alignment of the GAS and GBS proteins is shown below.

```
Identities = 275/462 (59%), Positives = 351/462 (75%), Gaps = 1/462 (0%)

Query:    2  GASMKHFFDYKTMSVARKLSISFIAVILLGSILLSLPIFQYANAPKTHYIDHLFTTVSMV    61
             G +MK  F   K++SV ++L+ SF  VIL+G++LLS P     Y N P T Y+DH F  VSMV
Sbjct:    3  GGNMKRSF-IKSLSVTQRLTFSFAIVILIGTLLLSMPFTHYQNGPNTVYLDHFFNVVSMV    61

Query:   62  CVTGLSVFPISKVYNGWGQIVAILLMQTGGLGLVTLMSLSYYTLRRKMSLNDQTLLQSAI   121
             CVTGLSV P+++VYNG GQ +A+ LMQ G LGLVTL+++S + L+RKM L+DQTLLQSA+
Sbjct:   62  CVTGLSVVPVAEVYNGIGQTIAMALMQIGCLGLVTLIAVSTFALKRKMRLSDQTLLQSAL   121

Query:  122  TYNSSTDLKKYLYMIFKVTLTLEVLAASILAIDFIPRFGLGHGIFNSIFLAVSAFCNAGF   181
                  S  DLK  YL+  +KVT LE  AA ++  IDFIPRFG  +GIFNSIFLAVSAFCNAGF
Sbjct:  122  NRGDSKDLKHYLFFAYKVTFSLEAFAAIVIMIDFIPRFGWKNGIFNSIFLAVSAFCNAGF   181

Query:  182  DNLEATSLAQFKLNPLVNIIVCFLIISGGLGFAVWKDLIEATIQTSHKGPKLIKTFPKRL   241
             DNL ++SL  F LNP +N+I+  FLIISGGLGFAVW DL  A  +     + P       ++L
Sbjct:  182  DNLGSSSLKDFMLNPTLNVIITFLIISGGLGFAVWVDLGVAFKKYFFERPHCYGATFRKL   241

Query:  242  SNHSKLVLKTTTIILLTGTLLSWLLEFGNFRTIANLSLPKQLMVSFFQTVTMRTAGFSTI   301
             SN S+LVL+TT +IL  GT L+W LE   N +TIAN SL +QLMVSFFQTVTMRTAGF+TI
Sbjct:  242  SNQSRLVLQTTAVILFLGTFLTWFLEKDNSKTIANFSLHQQLMVSFFQTVTMRTAGFATI   301
```

```
Query:  302  DYTQTDFATNLVYIIQMLIGGAPGGTAGGFKVTVIAILLLLFKAELSGQSQVTFHYRTIP  361
             Y  T   TN++Y+IQM+IGGAPGGTAGG KVT  AI  LLFKAELSGQS+VTF  R I
Sbjct:  302  SYNDTLAPTNILYMIQMVIGGAPGGTAGGIKVTTAAITFLLFKAELSGQSEVTFRNRIIA  361

Query:  362  SSIIKQTLSILTFFFIILISGYLLLLELNPHIDPFSLFFEASSALATVGVTMNTTNQLTL  421
             +  IKQT+++L FFF +L+ G++LLL + PHI P  L FE+ SA+ATVGV+M+  T QL+
Sbjct:  362  NKTIKQTMTVLIFFFAVLMIGFILLLSVEPHIAPIPLLFESISAIATVGVSMDLTPQLST  421

Query:  422  GGRIVIMFLMFIGRVGPITVLLSILQKKEKEIHYAETEIILG  463
             GR++++ LMF+GRVGPITVL+S++Q+KEK  I YA T+I++G
Sbjct:  422  AGRLIVIVLMFVGRVGPITVLISLIQRKEKTIQYATTDILVG  463
```

A related GBS gene <SEQ ID 8851> and protein <SEQ ID 8852> were also identified. Analysis of this protein sequence reveals the following:

Lipop: Possible site: −1 Crend: 9
McG: Discrim Score: 0.86
GvH: Signal Score (−7.5): 0.64
Possible site: 45
>>> Seems to have a cleavable N-term signal seq.
ALOM program   count: 9 value: −10.14 threshold: 0.0
INTEGRAL   Likelihood = −10.14   Transmembrane 371-387 (362-391)
INTEGRAL   Likelihood = −7.48    Transmembrane 200-216 (190-217)
INTEGRAL   Likelihood = −4.94    Transmembrane 425-441 (423-446)
INTEGRAL   Likelihood = −4.67    Transmembrane 327-343 (325-349)
INTEGRAL   Likelihood = −3.77    Transmembrane 81-97 (81-98)
INTEGRAL   Likelihood = −2.66    Transmembrane 140-156 (139-157)
INTEGRAL   Likelihood = −1.33    Transmembrane 55-71 (53-71)
INTEGRAL   Likelihood = −0.27    Transmembrane 247-263 (247-263)
INTEGRAL   Likelihood = −0.11    Transmembrane 165-181 (165-181)
PERIPHERAL Likelihood = 2.49     308
modified ALOM score: 2.53

*** Reasoning Step: 3
----- Final Results -----
    bacterial membrane --- Certainty = 0.5055 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
ORF02334(334-1689 of 1989)
EGAD|22151|22827(10-451 of 451) v-type sodium ATP synthase subunit j
{Enterococcus hirae}
SP|P43440|NTPJ_ENTHR V-TYPE SODIUM ATP SYNTHASE SUBUNIT J (EC 3.6.1.34) (NA(+)-
TRANSLOCATING ATPASE SUBUNIT J). GP|487282|dbj|BAA04279.1||D17462 Na+ -ATPase
subunit J {Enterococcus hirae}
% Match = 18.8
% Identity = 38.5 % Similarity = 60.4
Matches = 170 Mismatches = 166 Conservative Sub.s = 97

186       216       246       276       306       336       366       396
TIFTSNCK*KL*VT*W**PKYHNR*QEKRNA**IPS*SWYSKQEAFVKLGASMKHFFDYKTMSVARKLSISFIAVILLGS
                                                         | :|  : ::   |  :||:|
                                                         MTIMKKRVRKRLSPVQLIAAGFFILILFGG
                                                              10        20        30

426       456       486       516       546       576       606       636
ILLSLPIFQYANAPKTHYIDHLFTTVSMVCVTGLSVFPISKVYNGWGQIVAILLMQTGGLGLVTLMSLSYYTLRRKMSLN
||:||  |           ||:||  |||    |  ||||||| :  :: :| || : |:: ||||:: :   |   ::|:|::
SLLTLPFFSRSGES-THFIDALFTATSAVCVTGLTTLNTAEHWNSAGQFLIMTLIEIGGLGFMMIPILFFAIAKKKISFS
        40        50        60        70        80        90        100

666       696       726       756       786       816       846       876
DQTLLQSAITYNSSTDLKKYLYMIFKVTLTLEVLAASILAIDFIPRFGLGHGIFNSIFLAVSAFCNAGFDNLEATSLAQF
: :|: |:     : :  |: |:| : :: |   | |:: |||  ||   ||: |||  ||||||||  |     ||
MRIVLKEALNLEEMSGVIKLMIYILKFAVVIQVIGAVALSVVFIPEFGWAKGIWFSIFHAVSSFCNAGFD-LLGDSLLAD
        120       130       140       150       160       170       180

906       936       966       996      1026      1056      1086      1116
KLNPLVNIIVCFLIISGGLGFAVWKDLIEATIQTSHKGPKLIKTFPKRLSNHSKLVLKTTTIILLTGTLLSWLLEFGNFR
:  |   :  ::|    |||:|||||  ||:|:       |     |::: |||: |   :|| | :: :|      |
QTNVYLIMVVSALIIAGGLGFIVWRDI-----------LSYHRVKKITLHSKVALSVTA-LLLIGGFILFLITERNGL
        200       210                         220       230       240       250

1146      1176      1206      1236      1266      1296      1326      1356
TIANLSLPKQLMVSFFQTVTVMRTAGFSTIDYTQTDFATNLVYIIQMLIGGAPGGTAGGFKVTVIAILLLLFKAELSGQSQ
|:   :: ::|   :||  :|| :||| ||||| |    |   ::   |||  |  |    |||| |  :|||    |  |   | :|:::
TLVKGTFTERLANTFFMSVTPRTAGYYSIDYLQMSHAGLILTMFLMYIGGTSGSTAGGLKTTTLGILLIQMHAMFKGKTR
        270       280       290       300       310       320       330
```

```
1386        1416                1461      1491      1518      1548      1578
VTFHYRTIPSSIIKQTLSILTFFFIIL----ISGYLL-LLELNPHIDPFS-LFFEASSALATVGVTMNTTNQLTLGGRIV
 |||  : :    |  ||:||:  |     :: :| : |    |    : ||  || : |||:||  |   |||  |::|
AEAFGRTIRQAAV---LRALTLFFVTLSLCVVAIMVLSVTETIPKTSGIEYIAFEVFSAFGTVGLTMGLTPDLTLIGKLV
              350       360       370       380       390       400       410

1608      1638      1659      1689      1719      1749      1779      1809
IMFLMFIGRVGPITVLLSILQK---KEKEIHYAETEIILG*KRSFMKTKIIGVLGLGIFGQTLAQELSNFEQDVIAIDSN
|: ||:||||| :||:||:|   |      |   ||  | :||
IISLMYIGRVGIMTVVLSLLVKANRAEANYKYPEESIMLG
                430       440       450
```

Based on this analysis, it was predicted that these proteins and their epitopes could be useful antigens for vaccines or diagnostics.

Example 1575

A DNA sequence (GBSx1669) was identified in *S. agalactiae* <SEQ ID 4869> which encodes the amino acid sequence <SEQ ID 4870>. This protein is predicted to be TrkA. (ktrA). Analysis of this protein sequence reveals the following:

Possible site: 19
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

A related DNA sequence was identified in *S. pyogenes* <SEQ ID 4715> which encodes the amino acid sequence <SEQ ID 4716>. Analysis of this protein sequence reveals the following:

Possible site: 20
>>> Seems to have an uncleavable N-term signal seq
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>

The protein has homology with the following sequences in the GENPEPT database.

```
>GP:AAC46144 GE:AF001974 putative TrkA [Thermoanaerobacter ethanolicus]
Identities = 69/177 (38%), Positives = 110/177 (61%), Gaps = 2/177 (1%)

Query:     8  VLGLGIFGQTLAQELSNFEQDVIAIDSNPEN--VQAVAEVVTKAAIGDITDLAFLKHIGI    65
              V+GLG FG +LA+ L     DV+ ID + E   VQA+  +VT A   D TD    LK + +
Sbjct:     6  VIGLGSFGISLAKTLYEMGNDVLVIDEDEEEELVQAMNGLVTHAVRADATDENVLKSLRV    65

Query:    66  SDCDTVIIATGNSLESSVLAVMHCKKLGVPQVIAKARNLVYEEVLYEIGADLVISPERES   125
               + D   I+A G ++ESS++  M  K+LGV   VIAKA N ++   VLY++GAD V+ PE++
Sbjct:    66  KNFDVAIVAIGKNMESSIMVTMLVKELGVKYVIAKAHNELHARVLYKVGADRVVMPEKDM   125

Query:   126  GQNVAANLMRNKITDVFQIESDISVIEFKIPKSWVGKTVEQLNIRHKFDLNLIGIRK      182
              G  VA N+  + +D+ +    + S+ E    + W GKT++++N+R K+ LN++  ++K
Sbjct:   126  GIRVARNVFSSNLIDLIEFSKEYSIAEILPIEEWFGKTLKEINVREKYGLNVVAVKK     182
```

An alignment of the GAS and GBS proteins is shown below.

```
Identities = 132/221 (59%), Positives = 176/221 (78%)

Query:     1  MKTKIIGVLGLGIFGQTLAQELSNFEQDVIAIDSNPENVQAVAEVVTKAAIGDITDLAFL    60
              +K K +GVLGLGIFG+T+A+ELSNF+QDVIAID   +V+ VA++VTKAA+GDITD  FL
Sbjct:     2  LKRKTVGVLGLGIFGRTVARELSNFDQDVIAIDIRESHVKEVADLVTKAAVGDITDKEFL    61

Query:    61  KHIGISDCDTVIIATGNSLESSVLAVMHCKKLGVPQVIAKARNLVYEEVLYEIGADLVIS   120
               +GI   CDTV+IA+GN+LESSVLAVMHCKKLGVP +IAKA+N  ++EEVLY IGA  VI+
Sbjct:    62  LAVGIEHCDTVVIASGNNLESSVLAVMHCKKLGVPTIIAKAKNKIFEEVLYGIGATKVIT   121

Query:   121  PERESGQNVAANLMRNKITDVFQIESDISVIEFKIPKSWVGKTVEQLNIRHKFDLNLIGI   180
              PER+SG+ VA+NL+R+ I    +E  IS+IEF IPKSW G+++ +L++R K++LN+IG+
Sbjct:   122  PERDSGKRVASNLLRRHIESIIYLEHGISMIEFVIPKSWEGQSLSELDVRRKYELNVIGM   181
```

```
Query:   181  RKAKNKPVDTEVPINSPLEEGIILVAIANSDAFQRYDYLGY            221
              R+ + K +DT V    PLE  I+VAIAN   F+++DYLGY
Sbjct:   182  RQKEVKTLDTNVKPFEPLEPNTIIVAIANDHTFEKFDYLGY            222
```

A related GBS gene <SEQ ID 8853> and protein <SEQ ID 8854> were also identified. Analysis of this protein sequence reveals the following:

---

Lipop: Possible site: −1 Crend: 3
McG: Discrim Score: 5.14
GvH: Signal Score (−7.5): −0.860001
Possible site: 19
>>> Seems to have a cleavable N-term signal seq.
ALOE program   count: 0 value: 1.06 threshold: 0.0
PERIPHERAL              Likelihood = 1.06           192
modified ALOM score: −0.71
*** Reasoning Step: 3
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear)

---

The protein has homology with the following sequences in the databases:

```
38.0/61.6% over 182aa
Thermoanaerobacter ethanolicus
GP|2581796| putative TrkA Insert characterized
ORF02030(322-864 of 1269)
GP|2581796|gb|AAC46144.1||AF001974(6-188 of 195) putative TrkA
{Thermoanaerobacter ethanolicus}
% Match = 15.5
% Identity = 37.9 % Similarity = 61.5
Matches = 69 Mismatches = 69 Conservative Sub.s = 43
60        90        120       150       180       210       240       270
LISGYLLLLELNPHIDPFSLFFEASSALATVGVTMNTTNQLTLGGRIVIMFLMFIGRVGPITVLLSILQKKEKEIHYAET 300       330       360       390           444       474       504
EIILG*KRSFMKTKIIGVLGLGIFGQTLAQELSNFEQDVIAIDSNPEN--VQAVAEVVTKAAIGDITDLAFLKHIGISDC
           |:|||  || :||:  |      ||: || :    ||  :|||   ||  : : :
          MKQFVVIGLGSFGISLAKTLYEMGNDVLVIDEDEEEELVQAMNGLVTHAVRADATDENVLKSLRVKNF
           10        20        30        40        50        60

534       564       594       624       654       684       714       744
DTVIIATGNSLESSVLAVMHCKKLGVPQVIAKARNLVXEEVLYEIGADLVISPERESGQNVAANLMRNKITDVFQIESDI
|  |:|  | ::|||::    |  |:||| |||||  |:  |||:||| |: ||:: |  || |: : :|:  :   :
DVAIVAIGKNMESSIMVTMLVKELGVKYVIAKAHNELHARVLYKVGADRVVMPEKDMGIRVARNVFSSNLIDLIEFSKEY
   80        90        100       110       120       130       140

774       804       834       864       894       924       954       984
SVIEFKIPKSWVGKTVEQLNIRHKFDLNLIGIRKAKNKPVDTEVPINSPLEEXIILVAIANSDAFQRYDYLRYFY*RK*K
|: |     : | |||:::::|:|  |: ||:: ::|     :: : :
SIAEILPIEEWFGKTLKEINVREKYGLNVVAVKKFNDEIIVSPGAGL
    160       170       180       190
```

---

SEQ ID 8854 (GBS57) was expressed in *E. coli* as a His-fusion product. SDS-PAGE analysis of total cell extract is shown in FIG. 19 (lane 6; MW 26 kDa). It was also expressed in *E. coli* as a GST-fusion product. SDS-PAGE analysis of total cell extract is shown in FIG. 21 (lane 11; MW 51.1 kDa) and in FIG. 183 (lane 9 & 10; MW 51 kDa).

The GBS57-GST fusion product was purified (FIG. 99A; see also FIG. 195, lane 8) and used to immunise mice (lane 1 product; 20 μg/mouse). The resulting antiserum was used for Western blot (FIG. 99B), FACS (FIG. 99C), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 1576

A DNA sequence (GBSx1670) was identified in *S. agalactiae* <SEQ ID 4871> which encodes the amino acid sequence <SEQ ID 4872>. Analysis of this protein sequence reveals the following:

---

Possible site: 40
>>> Seems to have no N-terminal signal sequence
INTEGRAL   Likelihood = −11.62   Transmembrane 73-89 (68-96)
INTEGRAL   Likelihood = −11.30   Transmembrane 254-270 (248-274)
INTEGRAL   Likelihood = −4.73    Transmembrane 127-143 (124-144)
INTEGRAL   Likelihood = −4.19    Transmembrane 50-66 (47-67)
INTEGRAL   Likelihood = −3.29    Transmembrane 25-41 (25-45)

----- Final Results -----
   bacterial membrane --- Certainty = 0.5649 (Affirmative) <succ>
      bacterial outside --- Certainty = 0.0000 (Not Clear) <succ>
         bacterial cytoplasm --- Certainty = 0.0000 (Not Clear) <succ>

---

A related GBS nucleic acid sequence <SEQ ID 8855> which encodes amino acid sequence <SEQ ID 8856> was also identified. Analysis of this protein sequence reveals the following:

```
Lipop Possible site: −1 Crend: 9
McG: Discrim Score: −10.49
GvH: Signal Score (−7.5): −1.14
Possible site: 40
>>> Seems to have no N-terminal signal sequence
ALOM program    count: 5 value: −11.62 threshold: 0.0
INTEGRAL      Likelihood = −11.62  Transmembrane 73-89 (68-96)
INTEGRAL      Likelihood = −11.30  Transmembrane 254-270 (248-274)
INTEGRAL      Likelihood = −4.73   Transmembrane 127-143 (124-144)
INTEGRAL      Likelihood = −4.19   Transmembrane 50-66 (47-67)
PERIPHERAL    Likelihood = 3.76    201
modified ALOM score: 2.82
*** Reasoning Step: 3
----- Final Results -----
    bacterial membrane --- Certainty = 0.5649 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the GENPEPT database.

```
>GP:CAB13178 GB:Z99110 ykoC [Bacillus subtilis]
Identities = 61/226 (26%), Positives = 108/226 (46%), Gaps = 12/226 (5%)

Query:   49  FLIVVSLGSLVLFRLAKIKWQQVSFVMTLVVVFAVLNIIMVYLFAPHYGDKIYGSSSLLL   108
             F I++  G L+   +   KW       +  F +L    V+  A     K+   +    L
Sbjct:   36  FYIIIVAGVLLAAGIPLKKW------LLFTIPFLILAFGCVWTAAVF--GKVPTTPDNFL    87

Query:  109  KGIGPYDVTSQELFYLFNLILKYFCTVPLALLFLMTTNPSQFASSL-NQLGLSYKIAYAV   167
                 GP  + S   +    +L  + C    L+++F+ TT+P  F   SL  Q  LS K+AY V
Sbjct:   88  FQAGPISINSDNVSVGISLGFRILCFSALSMMFVFTTDPILFMLSLVQQCRLSPKLAYGV   147

Query:  168  SLTLRYIPDVQEEFYTIRRAQEARGIELSKKSNLVARIKGNLQIVTPLIFSSLERIDTVA   227
                 R++P +++E     I++A +  RG    + +S ++ +I       +   PL+ S++ + +  A
Sbjct:  148  IAGFRLPLLKDEVQLIQQAHKIRGG--AAESGIINKISALKRYTIPLLASAIRKAERTA   205

Query:  228  TAMELRRFGKNKRRTWYSKQSLEKSDIVLIILALASLFVSLYLIHL   273
                 AME + F   ++ RT+Y   S+ + D V    L L  LF    +L+ L
Sbjct:  206  LAMESKGFTGSRNRTYYRTLSVNRRDWVFFCLVLL-LFAGSFLVSL   250
```

Based on this analysis, it was predicted that this protein and its epitopes, could be useful antigens for vaccines or diagnostics.

Example 1577

A DNA sequence (GBSx1671) was identified in *S. agalactiae* <SEQ ID 4873> which encodes the amino acid sequence <SEQ ID 4874>. This protein is predicted to be cobalt ABC transporter, ATP-binding protein (cbiO). Analysis of this protein sequence reveals the following:

```
Possible site: 49
>>> Seems to have no N-terminal signal sequence
INTEGRAL     Likelihood = −1.91    Transmembrane 436-452 (435-452)
----- Final Results -----
    bacterial membrane --- Certainty = 0.1765 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the GENPEPT database.

```
>GP:CAB13179 GB:Z99110 similar to cation ABC transporter
(ATP-binding protein) [Bacillus subtilis]
Identities = 151/483 (31%), Positives = 248/483 (51%), Gaps = 19/483 (3%)
Query:    8  KDFTFQYDVQSEPTLKGINLSIPKGEKVLILGPSGSGKSTLGHCLNGIIPNTHKGQYSGI    67
             +  +F Y+   +P  + I+   + KGE VL+LGPSG GKS+L  CLNG+ P    G  SG
Sbjct:   11  EQLSFSYEEDEKPVFQDISFELQKGECVLLLGPSGCGKSSLALCLNGLYPEACDGIQSGH    70

Query:   68  FTINHKNAFDLSIYDK-SHLVSTVLQDPDGQFIGLTVAEDIAFALENDVVAQEEMASIVE   126
                + K  D    +  +    V QDPD QF  LTV ++IAF LEN    + +EEM      +
Sbjct:   71  VFLFQKPVTDAETSETITQHAGVVFQDPDQQFCMLTVEDEIAFGLENLQIPKEEMTEKIN   130

Query:  127  MWAKRLEIAPLLSKRPQDLSGGQKQRVSLAGVLVDDSPILLFDEPLANLDPQSGQDIMAL   186
             +L  I   L  K       LSGGQKQ+V+LA +L +     +++DEP + LDP S ++ + L
Sbjct:  131  AVLGKLRITHLKEKMISTLSGGQKQKVALACILAMEPELIILDEPTSLLDPFSAREFVHL   190

Query:  187  VDRIHQEQDATTIIIEHRLED--VFYERVDRVVLFSDGQIIYNGEPDQLL--KTNFLSEY   242
             +  + +E+   +  ++IEH+L++    + ER   +VL    G+      +G    L   + L   +
Sbjct:  191  MKDLQREKGFSLLVIEHQLDEWAPWIERT--IVLDKSGKKALDGLTKNLFQHEAETLKKL   248

Query:  243  GIREPLYISALKNLGYDFEKQNTMTSIDDFDFSELLIPKMRALDLDKHTDKLLSVQHLSV   302
             GI  P      +L   F      M        +   K +A       +L V LS
Sbjct:  249  GIAIPKVCHLQEKLSMPFTLSKEMLFKEPIPAGH--VKKKKA----PSGESVLEVSSLSF   302
```

-continued

```
Query: 303  SYDLENNTLDDVSFDLYKGQRLAIVGKNGAGKSTLAKALCQFI-PNNATLIYNNEDVSQD  361
            +    +       D+SF L +G   A+VG NG GKSTL    L   + P +  ++ ++ + +
Sbjct: 303  ARG-QQAIFKDISFSLREGSLTALVGPNGTGKSTLLSVLASLMKPQSGKILLYDQPLQKY  361

Query: 362  SIKERAERIGYVLQNPNQMISQAMVFDEVALGLRLRGFSDNDIESRVYDILKVCGLYQFR  421
              KE  +R+G+V QNP         V+DE+  G +    ++ + E +   +L+  GL
Sbjct: 362  KEKELRKRMGFVFQNPEHQFVTDTVYDELLFGQK----ANAETEKKAQHLLQRFGLAHLA  417

Query: 422  NWPISALSFGQKKRVTIASILILNPEVIILDEPTAGQDMKHYTEMMSFLDKLSCDGHTIV  481
            +    A+S GQK+R+++A++L+ +  +V++LDEPT GQD +   E M  + ++  +G  ++
Sbjct: 418  DHHPFAISQGQKRRLSVATMLMHDVKVLLLDEPTFGQDARTAAECMEMIQRIKAEGTAVL  477

Query: 482  MIT  484
            MIT
Sbjct: 478  MIT  480
```

There is also homology to SEQ ID 4416.

SEQ ID 4874 (GBS424d) was expressed in *E. coli* as a GST-fusion product. SDS-PAGE analysis of total cell extract is shown in FIG. 146 (lane 2 & 4; MW 77 kDa) and in FIG. 239 (lane 10; MW 77 kDa). It was also expressed in *E. coli* as a His-fusion product. SDS-PAGE analysis of total cell extract is shown in FIG. 146 (lane 5 & 7; MW 52 kDa) and in FIG. 182 (lane 4; MW 52 kDa). Purified GBS424d-His is shown in FIG. 241, lanes 6 & 7. Purified GBS424d-GST is shown in FIG. 246, lane 12.

Based on this analysis, it was predicted that this protein and its epitopes, could be useful antigens for vaccines or diagnostics.

Example 1578

A DNA sequence (GBSx1672) was identified in *S. agalactiae* <SEQ ID 4875> which encodes the amino acid sequence <SEQ ID 4876>. Analysis of this protein sequence reveals the following:

Possible site: 58
>>> Seems to have no N-terminal signal sequence
INTEGRAL    Likelihood = −8.12    Transmembrane 39-55 (35-63)
INTEGRAL    Likelihood = −3.98    Transmembrane 72-88 (71-90)
INTEGRAL    Likelihood = −3.66    Transmembrane 108-124 (106-127)
INTEGRAL    Likelihood = −2.34    Transmembrane 182-198 (181-198)
INTEGRAL    Likelihood = −1.44    Transmembrane 141-157 (139-158)
----- Final Results -----
    bacterial membrane --- Certainty = 0.4248 (Affirmative) <succ>
      bacterial outside --- Certainty = 0.0000 (Not Clear) <succ>
        bacterial cytoplasm --- Certainty = 0.0000 (Not Clear) <succ>

The protein has homology with the following sequences in the GENPEPT database.

No corresponding DNA sequence was identified in *S. pyogenes*.

A related GBS gene <SEQ ID 8857> and protein <SEQ ID 8858> were also identified. Analysis of this protein sequence reveals the following:

Lipop: Possible site: −1 Crend: 6
McG: Discrim Score: −5.01
GvH: Signal Score (−7.5): −5.9
Possible site: 50
>>> Seems to have no N-terminal signal sequence
ALOM program count: 5 value: −8.12 threshold: 0.0
INTEGRAL    Likelihood = −8.12    Transmembrane 31-47 (27-55)
INTEGRAL    Likelihood = −3.98    Transmembrane 64-80 (63-82)
INTEGRAL    Likelihood = −3.66    Transmembrane 100-116 (98-119)
INTEGRAL    Likelihood = −2.34    Transmembrane 174-190 (173-190)
INTEGRAL    Likelihood = −1.44    Transmembrane 133-149 (131-150)
PERIPHERAL  Likelihood = 5.78     9
modified ALOM score: 2.12
*** Reasoning Step: 3
----- Final Results -----
    bacterial membrane --- Certainty = 0.4248 (Affirmative) <succ>
      bacterial outside --- Certainty = 0.0000 (Not Clear) <succ>
        bacterial cytoplasm --- Certainty = 0.0000 (Not Clear) <succ>

The protein has homology with the following sequences in the databases:

```
>GP:CAB59830 GB:AJ012388 hypothetical protein [Lactococcus lactis]
Identities = 109/182 (59%), Positives = 141/182 (76%)
Query:  31  MMTNTIKKVVATGIGAALFIIIGMLVNIPTPIPNTNIQLQYAVLALFAVIYGPGVGFFTG   90
            M  N++K VVATGIGAALF+IIG L+NIPTPIPNT+IQLQYAVLALF+ ++GP  GF  G
Sbjct:   1  MKNNSVKIVVATGIGAALFVIIGWLINIPTPIPNTSIQLQYAVLALFSALFGPLAGFLIG   60

Query:  91  FIGHALKDSIQYGSPWWTWVLVSGLLGLMIGFFAKKLAIQLSGMTKKDLLLFNVVQVIAN  150
            FIGHALKDS  YG+PWWTWVL SGL+GL +GF  K+ ++        K+++ FN+VQ +AN
Sbjct:  61  FIGHALKDSFLYGAPWWTWVLGSGLMGLFLGFGVKRESLTQGIFGNKEIIRFNIVQFLAN  120

Query: 151  LIGWSVVAPYGDIFFYSEPASKVFAQGFLSSLVNSITIGVGGTLLLLAYAKSRPQKGSLS  210
            ++ W  ++AP GDI   YSEPA+KVF QG ++ LVN++TI V GTLLL   YA +R + G+L
Sbjct: 121  VVVWGLIAPIGDILVYSEPANKVFTQGVVAGLVNALTIAVAGTLLLKLYAATRTKSGTLD  180

Query: 211  KD  212
            K+
Sbjct: 181  KE  182
```

```
ORF02330 (367-912 of 1212)
GP|6165407|emb|CAB59830.1||AJ012388(1-182 of 182) hypothetical protein
{Lactococcus lactis}
% Match = 28.1
% Identity = 59.9 % Similarity = 78.6
Matches = 109 Mismatches = 39 Conservative Sub.s = 34
       102       132       162       192       222       252       282       312
       MQVVGVGFIVGVIQDSCETALNSSTDVLFTAVAEKSVFGKK*TNEGLRYSI*DLFWYLILFSIVFQFFLSIRFQISLKYD 342       372       402       432       462       492       522       552
       KIEQIVSDCLSLFFREVFMNTNTIKKVVATGIGAALFIIIGMLVNIPTPIPNTNIQLQYAVLALFAVIYGPGVGFFTGFI
                    | |::|  ||||||||||||:|||  |:||||||||||:||||||||||:  ::||   ||: |||
                    MKNNSVKIVVATGIGAALFVIIGWLINIPTPIPNTSIQLQYAVLALFSALFGPLAGFLIGFI
                              10        20        30        40        50        60

582       612       642       672       702       732       762       792
       GHALKDSIQYGSPWWTWVLVSGLLGLMIGFFAKKLAIQLSGMTKKDLLLFNVVQVIANLIGWSVVAPYGDIFFYSEPASK
       ||||||| ||:||||||| |||:|| :||  |:  ::    |::: ||:|| :||:: |  ::||  |||: |||||:|
       GHALKDSFLYGAPWWTWVLGSGLMGLFLGFGVKRESLTQGIFGNKEIIRFNIVQFLANVVVWGLIAPIGDILVYSEPANK
                  80        90       100       110       120       130       140

822       852       882       912       942       972      1002      1032
       VFAQGFLSSLVNSITIGVGGTLLLLAYAKSRPQKGSLSKD*DKRVIYERFY*MEGFYLSI*RSI*TNFKRD*LKHS*R*K
       || ||  ::  |||::|| |  ||||| ||  |:   |:| |:
       VFTQGVVAGLVNALTIAVAGTLLLKLYAATRTKSGTLDKE
                160       170       180
```

Based on this analysis, it was predicted that these proteins and their epitopes could be useful antigens for vaccines or diagnostics.

Example 1579

A DNA sequence (GBSx1673) was identified in S. *agalactiae* <SEQ ID 4877> which encodes the amino acid sequence <SEQ ID 4878>. Analysis of this protein sequence reveals the following:

Possible site: 42
>>> Seems to have no N-terminal signal sequence
INTEGRAL    Likelihood = –6.85    Transmembrane 86-102 (80-106)
----- Final Results -----
    bacterial membrane --- Certainty = 0.3739 (Affirmative) <succ>
        bacterial outside --- Certainty = 0.0000 (Not Clear) <succ>
            bacterial cytoplasm --- Certainty = 0.0000 (Not Clear) <succ>

The protein has no significant homology with any sequences in the GENPEPT database.

No corresponding DNA sequence was identified in S. *pyogenes*.

Based on this analysis, it was predicted that this protein and its epitopes, could be useful antigens for vaccines or diagnostics.

Example 1580

A DNA sequence (GBSx1674) was identified in S. *agalactiae* <SEQ ID 4879> which encodes the amino acid sequence <SEQ ID 4880>. Analysis of this protein sequence reveals the following:

Possible site: 47
>>> Seems to have a cleavable N-term signal seq.
INTEGRAL    Likelihood = –3.61    Transmembrane 107-123 (96-124)
INTEGRAL    Likelihood = –1.86    Transmembrane 124-140 (124-142)
INTEGRAL    Likelihood = –1.38    Transmembrane 83-99 (83-100)
INTEGRAL    Likelihood = –1.12    Transmembrane 142-158 (142-160)
----- Final Results -----
    bacterial membrane --- Certainty = 0.2444 (Affirmative) <succ>
        bacterial outside --- Certainty = 0.0000 (Not Clear) <succ>
            bacterial cytoplasm --- Certainty = 0.0000 (Not Clear) <succ>

A related GBS nucleic acid sequence <SEQ ID 9415> which encodes amino acid sequence <SEQ ID 9416> was also identified.

The protein has homology with the following sequences in the GENPEPT database.

```
>GP:AAC76124 GB:AE000391 putative transport protein [Escherichia coli K12]
Identities = 139/178 (78%), Positives = 159/178 (89%)
Query:   1 MVGTMLFVALVVNPIIAFVMMRKNPYPLVLRCLKDSGITAFFTRSSAANIPVNMRLCEDL    60
           +VG ML VALVVNP++ +  +R+NP+PLVL CL++SG+ AFFTRSSAANIPVNM LCE L
Sbjct: 222 LVGCMLLVALVVNPLLVWWKIRRNPFPLVLLCLRESGVYAFFTRSSAANIPVNMALCEKL   281

Query:  61 GLDKDTYSVSIPLGAAINMAGAAITINILTLAAVNTLGITVDFPTAFLLSVVAAVSACGA   120
           LD+DTYSVSIPLGA INMAGAAITI +LTLAAVNTLGI VD PTA LLSVVA++ ACGA
Sbjct: 282 NLDRDTYSVSIPLGATINMAGAAITITVLTLAAVNTLGIPVDLPTALLLSVVASLCACGA   341

Query: 121 SGVTGGSLLLIPVACSLFGISNDVAMQVVGVGFIVGVIQDSCETALNSSTDVLFTAVA    178
           SGV GGSLLLIP+AC++FGISND+AMQVV VGFI+GV+QDSCETALNSSTDVLFTA A
Sbjct: 342 SGVAGGSLLLIPLACNMFGISNDIAMQVVAVGFIIGVLQDSCETALNSSTDVLFTAAA    399
```

A related DNA sequence was identified in *S. pyogenes* <SEQ ID 4881> which encodes the amino acid sequence <SEQ ID 4882>. Analysis of this protein sequence reveals the following:

```
Possible site: 58
>>> Seems to have an uncleavable N-term signal seq
INTEGRAL    Likelihood = −13.69   Transmembrane 212-228 (202-239)
INTEGRAL    Likelihood = −7.38    Transmembrane 78-94 (74-108)
INTEGRAL    Likelihood = −6.53    Transmembrane 179-195 (175-200)
INTEGRAL    Likelihood = −6.10    Transmembrane 315-331 (312-341)
INTEGRAL    Likelihood = −5.36    Transmembrane 44-60 (42-61)
INTEGRAL    Likelihood = −4.41    Transmembrane 13-29 (11-41)
INTEGRAL    Likelihood = −3.19    Transmembrane 340-356 (333-358)
INTEGRAL    Likelihood = −3.08    Transmembrane 145-161 (144-162)
INTEGRAL    Likelihood = −0.90    Transmembrane 358-374 (358-376)
----- Final Results -----
    bacterial membrane --- Certainty = 0.6477 (Affirmative) <succ>
    bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP:AAF95950 GB:AE004347 sodium/dicarboxylate symporter [Vibrio cholerae]
Identities = 243/385 (63%), Positives = 299/385 (77%), Gaps = 2/385 (0%)
Query:    9 VRVSLIKKIGIGVVIGVMLGILAPDLTG-FSILGKLFVGGLKAIAPLLVFALVSQAISHQ   67
            VR +L+ +I  G+++G  +  +P+        ++G LFVG LKA+AP+LVF LV+ +I++Q
Sbjct:   11 VRGNLVLQILAGILLGAAMATFSPEYAQKVGLIGNLFVGALKAVAPVLVFILVASSIANQ   70

Query:   68 KKGKQTNMTLIIVLYLFGTFASALVAVLTAYLFPLTLVLNTPVNTELSPPQGVAEVFQSL  127
            KK + T M  I+VLYLFGTF++AL AV+ ++LFP TLVL T    +PPQG+AEV  +L
Sbjct:   71 KKNQHTYMRPIVVLYLFGTFSAALTAVILSFLFPTTLVLATGAEGA-TPPQGIAEVLNTL  129

Query:  128 LLKLVDNPINALATANYIGVLSWAIIFGLALKAASKETKHLIKTAAEVTSQIVVWIINLA  187
            L KLVDNP++AL  ANYIG+L+W +  GLAL +S  TK + +    SQIV +II LA
Sbjct:  130 LFKLVDNPVSALMNANYIGILAWGVGLGLALHHSSSTTKAVFEDLSHGISQIVRFIIRLA  189

Query:  188 PIGIMSLVFTTISENGVGILSDYAFLILVLVGTMLFVALVVNPLIAVLITRQNPYPLVLR  247
            P GI   LV +T +  G   L+ YA L+ VL+G M F+ALVVNP+I      R+NP+PLVL+
Sbjct:  190 PFGIFGLVASTFATTGFDALAGYAQLLAVLLGAMAFIALVVNPMIVYYKIRRNPFPLVLQ  249

Query:  248 CLRESGLTAFFTRSSAANIPVNMQLCQKIGLSKDTYSVSIPLGATINMGGAAITINVLTL  307
            CLRESG+TAFFTRSSAANIPVNM LC+K+ L +DTYSVSIPLGATINM GAAITI VLTL
Sbjct:  250 CLRESGVTAFFTRSSAANIPVNMALCEKLKLDEDTYSVSIPLGATINMAGAAITITVLTL  309

Query:  308 AAVHTFGIPIDFLTALLLSVVAAVSACGASGVAGGSLLLIPVACSLFGISNDLAMQVVGV  367
            AAVHT GI +D +TALLLSV+AAVSACGASGVAGGSLLLIP+AC LFGISND+AMQVV V
Sbjct:  310 AAVHTMGIEVDLMTALLLSVVAAVSAEGASGVAGGSLLLIPLACGLFGISNDIAMQVVAV  369

Query:  368 GFIVGVIQDSCETALNSSTDVLFTA                                    392
            GFI+GVIQDS ETALNSSTDVLFTA
Sbjct:  370 GFIIGVIQDSAETALNSSTDVLFTA                                    394
```

An alignment of the GAS and GBS proteins is shown below.

Based on this analysis, it was predicted that these proteins and their epitopes could be useful antigens for vaccines or diagnostics.

Example 1581

A DNA sequence (GBSx1675) was identified in *S. agalactiae* <SEQ ID 4883> which encodes the amino acid sequence <SEQ ID 4884>. This protein is predicted to be acid phosphatase. Analysis of this protein sequence reveals the following:

```
Possible site: 40
>>> Seems to have no N-terminal signal sequence
----- Final Results -----
    bacterial cytoplasm --- Certainty = 0.2436 (Affirmative) <succ>
     bacterial membrane --- Certainty = 0.0000 (Not Clear) <succ>
      bacterial outside --- Certainty = 0.0000 (Not Clear) <succ>
```

A related GBS nucleic acid sequence <SEQ ID 9427> which encodes amino acid sequence <SEQ ID 9428> was also identified.

The protein has homology with the following sequences in the GENPEPT database.

```
Identities = 153/186 (82%), Positives = 172/186 (92%)
Query:    1 MVGTMLFVALVVNPIIAFVMMRKNPYPLVLRCLKDSGITAFFTRSSAANIPVNMRLCEDL   60
            +VGTMLFVALVVNP+IA ++ R+NPYPLVLRCL++SG+TAFFTRSSAANIPVNM LC+ +
Sbjct:  217 LVGTMLFVALVVNPLIAVLITRQNPYPLVLRCLRESGLTAFFTRSSAANIPVNMQLCQKI  276

Query:   61 GLDKDTYSVSIPLGAAINMAGAAITINILTLAAVNTLGITVDFPTAFLLSVVAAVSACGA  120
            GL KDTYSVSIPLGA INM GAAITIN+LTLAAV+T GI +DF TA LLSVVAAVSACGA
Sbjct:  277 GLSKDTYSVSIPLGATINMGGAAITINVLTLAAVHTFGIPIDFLTALLLSVVAAVSACGA  336

Query:  121 SGVTGGSLLLIPVACSLFGISNDVAMQVVGVGFIVGVIQDSCETALNSSTDVLFTAVAEK  180
            SGV GGSLLLIPVACSLFGISND+AMQVVGVGFIVGVIQDSCETALNSSTDVLFTA+AE
Sbjct:  337 SGVAGGSLLLIPVACSLFGISNDLAMQVVGVGFIVGVIQDSCETALNSSTDVLFTAIAEN  396

Query:  181 SVFGKK                                                       186
            + + +K
Sbjct:  397 AFWKRK                                                       402
```

```
>GP:CAA73175 GB:Y12602 acid phosphatase [Streptococcus equisimilis]
Identities = 167/251 (66%), Positives = 209/251 (82%)
Query:   7  EQKTKEKNISLSSNKLLAKENTMSVLWYQNSAEAKALYLQGYNVAKMKLDDWLQKPSEKP   66
            ++  K    ++ S  +L + ENTMSVLWYQ +AEAKALYLQGY +A   +L + L + ++KP
Sbjct:  34  KETVKQTKVTYSDEQLRSNENTMSVLWYQRAAEAKALYLQGYQLATDRLKNQLGQATDKP   93

Query:  67  YSIILDLDETVLDNSPYQAKNIKDGSSFTPESWDKWVQKKSAKAVAGAKEFLKYANEKGI  126
            YSI+LD+DETVLDNSPYQAKNI +G+SFTPESWD WVQKK AK VAGAKEFL++A++ G+
Sbjct:  94  YSIVLDIDETVLDNSPYQAKNILEGTSFTPESWDVWVQKKEAKPVAGAKEFLQFADQNGV  153

Query: 127  KIYYVSDRTDAQVDATKENLEKEGIPVQGKDHLLFLKKGMKSKESRRQAVQKDTNLIMLF  186
            +IYY+SDR  +QVDAT ENL+KEGIPVQG+DHLLFL++G+KSKE+RRQ V++ TNLIMLF
Sbjct: 154  QIYYISDRAVSQVDATMENLQKEGIPVQGRDHLLFLEEGVKSKEARRQKVKETTNLIMLF  213

Query: 187  GDNLVDFADFSKSSSTDREQLLTKLQSEFGSKFIVFPNPMYGSWESAIYQGKHLDVQKQL  246
            GDNLVDFADFSK S   DR  LL++LQ EFG +FI+FPNPMYGSWESA+Y+G  LD    QL
Sbjct: 214  GDNLVDFADFSKKSEEDRTALLSELQEEFGRQFIIFPNPMYGSWESAVYKGDKLDASHQL  273

Query: 247  KERQKMLHSYD                                                  257
            KER+K L S++
Sbjct: 274  KERRKALESFE                                                  284
```

A related DNA sequence was identified in *S. pyogenes* <SEQ ID 4885> which encodes the amino acid sequence <SEQ ID 4886>. Analysis of this protein sequence reveals the following:

```
Possible site: 25
>>> May be a lipoprotein
----- Final Results -----
    bacterial membrane --- Certainty = 0.0000 (Not Clear) <succ>
        bacterial outside --- Certainty = 0.0000 (Not Clear) <succ>
            bacterial cytoplasm --- Certainty = 0.0000 (Not Clear) <succ>
```

The protein has homology with the following sequences in the databases:

```
>GP:CAA73175 GB:Y12602 acid phosphatase [Streptococcus equisimilis]
Identities = 234/284 (82%), Positives = 261/284 (91%)
Query:   1  MKSKKVVSVISLTLSLFLVTGCAKVDNNKSVNLKPATKQTYNSYSDDQLRSRENTMSVLW   60
            MK+K+V SVISL LSLFLVTGCA++D+  +VN K   KQT +YSD+QLRS ENTMSVLW
Sbjct:   1  MKTKQVASVISLALSLFLVTGCAQLDHKANVNSKETVKQTKVTYSDEQLRSNENTMSVLW   60

Query:  61  YQRAAETQALYLQGYQLATDRLKEQLNKPTDKPYSIVLDIDETVLDNSPYQAKNVLEGTG  120
            YQRAAE +ALYLQGYQLATDRLK QL + TDKPYSIVLDIDETVLDNSPYQAKN+LEGT
Sbjct:  61  YQRAAEAKALYLQGYQLATDRLKNQLGQATDKPYSIVLDIDETVLDNSPYQAKNILEGTS  120

Query: 121  FTPESWDYWVQKKEAKPVAGAKDFLQFADQNGVQIYYISDRSTTQVDATMENLQKEGIPV  180
            FTPESWD WVQKKEAKPVAGAK+FLQFADQNGVQ+YYISDR+ +QVDATMENLQKEGIPV
Sbjct: 121  FTPESWDVWVQKKEAKPVAGAKEFLQFADQNGVQTYYISDRAVSQVDATMENLQKEGIPV  180

Query: 181  QGRDHLLFLEKGVKSKESRRQKVKETTNVTMLFGDNLLDFADFSKKSQEDRTALLSDLQE  240
            QGRDHLLFLE+GVKSKE+RRQKVKETTN+ MLFGDNL+DFADFSKKS+EDRTALLS+LQE
Sbjct: 181  QGRDHLLFLEEGVKSKEARRQKVKETTNLIMLFGDNLVDFADFSKKSEEDRTALLSELQE  240

Query: 241  EFGRRFIIFPNPMYGSWEGAIYKGEKLDVLKQLEERRKSLKSFK                 284
            EFGR+FIIFPNPMYGSWE A+YKG+KLD   QL+ERR+L+SF+
Sbjct: 241  EFGRQFIIFPNPMYGSWESAVYKGDKLDASHQLKERRKALESFE                 284
```

An alignment of the GAS and GBS proteins is shown below.

```
Identities = 166/247 (67%), Positives = 207/247 (83%)
Query:  10  TKFKNISLSSNKLLAKENTMSVLWYQNSAEAKALYLQGYNVAKMKLDDWLQKPSEKPYSI   69
            TK    S S ++L ++ENTMSVLWYQ +AE +ALYLQGY +A   +L KP++KPYSI
Sbjct:  37  TKQTYNSYSDDQLRSRENTMSVLWYQRAAETQALYLQGYQLATDRLKEQLNKPTDKPYSI   96

Query:  70  ILDLDETVLDNSPYQAKNIKDGSSFTPESWDKWVQKKSAKAVAGAKEFLKYANEKGIKIY  129
            +LD+DETVLDNSPYQAKN+ +G+ FTPESWD WVQKK AK VAGAK+FL++A++ G++IY
Sbjct:  97  VLDIDETVLDNSPYQAKNVLEGTGFTPESWDYWVQKKEAKPVAGAKDFLQFADQNGVQIY  156
```

```
                              -continued
Query: 130  YVSDRTDAQVDATKENLEKEGIPVQGKDHLLFLKKGMKSKESRRQAVQKDTNLIMLFGDN   189
            Y+SDR+   QVDAT ENL+KEGIPVQG+DHLLFL+KG+KSKESRRQ V++ TN+ MLFGDN
Sbjct: 157  YISDRSTTQVDATMENLQKEGIPVQGRDHLLFLEKGVKSKESRRQKVKETTNVTMLFGDN   216

Query: 190  LVDFADFSKSSSTDREQLLTKLQSEFGSKFIVFPNPMYGSWESAIYQGKHLDVQKQLKER   249
            L+DFADFSK S  DR  LL+ LQ EFG +FI+FPNPMYGSWE AIY+G+ LDV KQL+ER
Sbjct: 217  LLDFADFSKKSQEDRTALLSDLQEEFGRRFIIFPNPMYGSWEGAIYKGEKLDVLKQLEER   276

Query: 250  QKMLHSY                                                       256
            +K L S+
Sbjct: 277  RKSLKSF                                                       283
```

Figure 136:
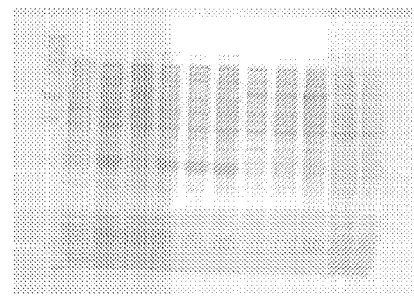

SEQ ID 9428 (GBS661) was expressed in *E. coli* as a GST-fusion product. SDS-PAGE analysis of total cell extract is shown in FIG. 136 (lane 2 & 4; MW 61 kDa+lane 3; MW 27 kDa) and in FIG. 186 (lane 11; MW 61 kDa). It was also expressed in *E. coli* as a His-fusion product. SDS-PAGE analysis of total cell extract is shown in FIG. 136 (lane 5-7; MW 25 kDa).

Figure 237:
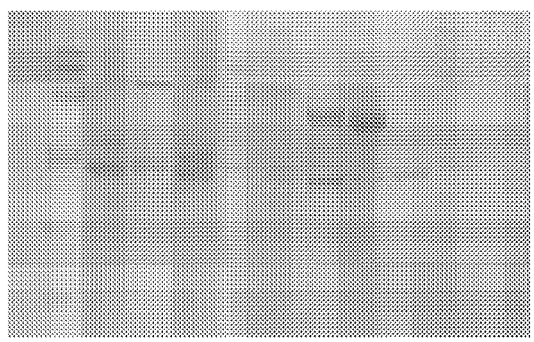

GBS661-GST was purified as shown in FIG. 237, lane 5.

Based on this analysis, it was predicted that these proteins and their epitopes could be useful antigens for vaccines or diagnostics.

Example 1582

A DNA sequence (GBSx1676) was identified in *S. agalactiae* <SEQ ID 4887> which encodes the amino acid sequence <SEQ ID 4888>. This protein is predicted to be unnamed protein product. Analysis of this protein sequence reveals the following:

Possible site: 58
>>> Seems to have no N-terminal signal sequence
----- Final Results -----
  bacterial cytoplasm --- Certainty = 0.3462 (Affirmative) <succ>
  bacterial membrane --- Certainty = 0.0000 (Not Clear) <succ>
  bacterial outside --- Certainty = 0.0000 (Not Clear) <succ>

A related DNA sequence was identified in *S. pyogenes* <SEQ ID 4889> which encodes the amino acid sequence <SEQ ID 4890>. Analysis of this protein sequence reveals the following:

Possible site: 58
>>> Seems to have no N-terminal signal sequence
----- Final Results -----
  bacterial cytoplasm --- Certainty = 0.3462 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

```
Identities = 395/398 (99%), Positives = 398/398 (99%)
Query:   1  MAKLTVKDVDLKGKKVLVRVDFNVPLKDGVITNDNRITAALPTIKYIIEQGGRAILFSHL   60
            MAKLTVKDVDLKGKKVLVRVDFNVPLKDGVITNDNRITAALPTIKYIIEQGGRAILFSHL
Sbjct:   1  MAKLTVKDVDLKGKKVLVRVDFNVPLKDGVITNDNRITAALPTIKYIIEQGGRAILFSHL   60

Query:  61  GRVKEEADKEGKSLAPVAADLAAKLGQDVVFPGVTRGAKLEEAINALEDGQVLLVENTRF  120
            GRVKEEADKEGKSLAPVAADLAAKLGQDVVFPGVTRG+KLEENINALEDGQVLLVENTRF
Sbjct:  61  GRVKEEADKEGKSLAPVAADLAAKLGQDVVFPGVTRGSKLEEAINALEDGQVLLVENTRF  120

Query: 121  EDVDGKKESKNDEELGKYWASLGDGIFVNDAFGTAHRAHASNVGISANVEKAVAGFLLEN  180
            EDVDGKKESKNDEELGKYWASLGDGIFVNDAFGTAHRAHASNVGISANVEKAVAGFLLEN
Sbjct: 121  EDVDGKKESKNDEELGKYWASLGDGIFVNDAFGTAHRAHASNVGISANVEKAVAGFLLEN  180

Query: 181  EIAYIQEAVETPERPFVAILGGSKVSDKIGVIENLLEKADKVLIGGGMTYTFYKAQGIEI  240
            EIAYIQEAVETPERPFVAILGGSKVSDKIGVIENLLEKADKVLIGGGMTYTFYKAQGIEI
Sbjct: 181  EIAYIQEAVETPERPFVAILGGSKVSDKIGVIENLLEKADKVLIGGGMTYTFYKAQGIEI  240

Query: 241  GNSLVEEDKLDVAKDLLEKSNGKLILPVDSKEANAFAGYTEVRDTEGEAVSEGFLGLDIG  300
            GNSLVEEDKLDVAKDLLEKSNGKLILPVDSKEANAFAGYTEVRDTEGEAVSEGFLGLDIG
Sbjct: 241  GNSLVEEDKLDVAKDLLEKSNGKLILPVDSKEANAFAGYTEVRDTEGEAVSEGFLGLDIG  300

Query: 301  PKSIAKFDEALTGAKTVVWNGPMGVFENPDFQAGTIGVMDAIVKQPGVKSIIGGGDSAAA  360
            PKSIA+FD+ALTGAKTVVWNGPMGVFENPDFQAGTIGVMDAIVKQPGVKSIIGGGDSAAA
Sbjct: 301  PKSIAEFDQALTGAKTVVWNGPMGVFENPDFQAGTIGVMDAIVKQPGVKSIIGGGDSAAA  360

Query: 361  AINLGRADKFSWISTGGGASMELLEGKVLPGLAALTEK                        398
            AINLGRADKFSWISTGGGASMELLEGKVLPGLAALTEK
Sbjct: 361  AINLGRADKFSWISTGGGASMELLEGKVLPGLAALTEK                        398
```

Based on this analysis, it was predicted that these proteins and their epitopes could be useful antigens for vaccines or diagnostics.

Example 1583

A DNA sequence (GBSx1677) was identified in *S. agalactiae* <SEQ ID 4891> which encodes the amino acid sequence <SEQ ID 4892>. Analysis of this protein sequence reveals the following:

```
Possible site: 53
>>> Seems to have no N-terminal signal sequence
INTEGRAL    Likelihood = -8.39    Transmembrane 97-113 (93-118)
INTEGRAL    Likelihood = -3.66    Transmembrane 25-41 (24-48)
INTEGRAL    Likelihood = -3.40    Transmembrane 121-137 (121-140)
INTEGRAL    Likelihood = -3.24    Transmembrane 72-88 (72-88)
INTEGRAL    Likelihood = -2.07    Transmembrane 143-159 (143-160)
----- Final Results -----
    bacterial membrane --- Certainty = 0.4354 (Affirmative) <succ>
       bacterial outside --- Certainty = 0.0000 (Not Clear) <succ>
          bacterial cytoplasm --- Certainty = 0.0000 (Not Clear) <succ>
```

The protein has no significant homology with any sequences in the GENPEPT database.

A related DNA sequence was identified in *S. pyogenes* <SEQ ID 4893> which encodes the amino acid sequence <SEQ ID 4894>. Analysis of this protein sequence reveals the following:

```
Possible site: 53
>>> Seems to have no N-terminal signal sequence
INTEGRAL    Likelihood = -8.23    Transmembrane 97-113 (93-118)
INTEGRAL    Likelihood = -7.17    Transmembrane 121-137 (119-140)
INTEGRAL    Likelihood = -4.19    Transmembrane 25-41 (24-48)
INTEGRAL    Likelihood = -3.24    Transmembrane 72-88 (72-88)
INTEGRAL    Likelihood = -2.55    Transmembrane 154-170 (154-170)
----- Final Results -----
    bacterial membrane --- Certainty = 0.4291 (Affirmative) <succ>
       bacterial outside --- Certainty = 0.0000 (Not Clear) <succ>
          bacterial cytoplasm --- Certainty = 0.0000 (Not Clear) <succ>
```

The protein has no significant homology with any sequences in the GENPEPT database.

An alignment of the GAS and GBS proteins is shown below.

```
Identities = 155/178 (87%), Positives = 169/178 (94%)
Query:    1  MKTLKKLLSNYKFDIKKFKLGMRTFKTGLSVFLVLLVFHLFGWKGLQIGALTAVFSLRED    60
             MKTL+KLLSNYKFDIKKFKLGMRT KTGLSVFLVLLVFHLFGWKGLQIGALTAVFSLRED
Sbjct:    1  MKTLRKLLSNYKFDIKKFKLGMRTLKTGLSVFLVLLVFHLFGWKGLQIGALTAVFSLRED    60

Query:   61  FDKSVHFGFSRIIGNSIGGLLSLVFFAFNEIFHQAFWVTLLIVPICTMLCIMINVACNNK   120
             FDKSVHFGFSRIIGNSIGGLLSLVFFAFNEIFHQAFWVTLLIVPICTMLCIM+NVACNNK
Sbjct:   61  FDKSVHFGFSRIIGNSIGGLLSLVFFAFNEIFHQAFWVTLLIVPICTMLCIMVNVACNNK   120

Query:  121  SGIIGGTAALLIITLSIPSGETILYVFARIFETFCGVFIAMMVNTDIEILRKKLKNNK    178
             SGIIG  AALLIITLSIP+G+T +YV +R+FETFCGVF+A++VNTD+E+++ K   N K
Sbjct:  121  SGIIGAVAALLIITLSIPTGQTFIYVTSRVFETFCGVFVAILVNTDVELIKNKWFNKK    178
```

Based on this analysis, it was predicted that these proteins and their epitopes could be useful antigens for vaccines or diagnostics.

Example 1584

A DNA sequence (GBSx1678) was identified in *S. agalactiae* <SEQ ID 4895> which encodes the amino acid sequence <SEQ ID 4896>. This protein is predicted to be regulatory protein glnr (glnR). Analysis of this protein sequence reveals the following:

```
Possible site: 17
>>> Seems to have an uncleavable N-term signal seq
----- Final Results -----
    bacterial membrane --- Certainty = 0.0000 (Not Clear) <succ>
       bacterial outside --- Certainty = 0.0000 (Not Clear) <succ>
          bacterial cytoplasm --- Certainty = 0.0000 (Not Clear) <succ>
```

The protein has homology with the following sequences in the GENPEPT database.

```
>GP:BAA00402 GB:D00513 ORF129 [Bacillus cereus]
Identities = 59/123 (47%), Positives = 89/123 (71%), Gaps = 5/123 (4%)
Query:    4  RELRRTMAVFPIGAVMKLTDLTARQIRYYEDQGLITPERTEGNRRMFSLNDMDRLLEIKD    63
             +E RR+  +FPIG VM LT L+ARQIRYYE+  L++P RT+GNRR+FS ND+D+LLEIKD
Sbjct:    2  KEDRRSAPLFPIGIVMDLTQLSARQIRYYEEHNLVSPTRTKGNRRLFSFNDVDKLLEIKD    61

Query:   64  FISDGLHISDIKNEYMQRQH-----KSKEKQKSLSDAEVRRLLQDELRNQGRFSSPSQHI   118
             +  GL+++ IK   +++     K KE+ K +S  E+R++L+DEL++ GRF+  S
Sbjct:   62  LLDQGLNMAGIKQVLLMKENQTEAVKVKEETKEISKTELRKILRDELQHTGRFNRISLRQ   121
```

```
Query:  119  GNM                                                      121
             G++
Sbjct:  122  GDI                                                      124
```

A related DNA sequence was identified in *S. pyogenes* <SEQ ID 4897> which encodes the amino acid sequence <SEQ ID 4898>. Analysis of this protein sequence reveals the following:

Possible site: 20
>>> Seems to have an uncleavable N-term signal seq
----- Final Results -----
    bacterial membrane --- Certainty = 0.0000 (Not Clear) <succ>
      bacterial outside --- Certainty = 0.0000 (Not Clear) <succ>
        bacterial cytoplasm --- Certainty = 0.0000 (Not Clear) <succ>

The protein has homology with the following sequences in the databases:

```
>GP:BAA00402 GB:D00513 ORF129 [Bacillus cereus]
Identities = 59/122 (48%), Positives = 83/122 (67%), Gaps = 5/122 (4%)
Query:    4  KELRRSMAVFPIGTVMTLTDLSARQIRYYEDQGLIKPERTQGNRRMFSLNDMDRLLEIKD   63
             KE RRS  +FPIG VM LT LSARQIRYYE+   L+ P RT+GNRR+FS ND+D+LLEIKD
Sbjct:    2  KEDRRSAPLFPIGIVMDLTQLSARQIRYYEEHNLVSPTRTKGNRRLFSENDVDKLLEIKD   61

Query:   64  FLSEGLNIAAIKREYVERQG-----KLMQKQKALTDADVRRILHDEMLTQSGFSTPSQHI  118
             L +GLN+A IK+  + ++       K+ ++ K ++   ++R+IL DE+      F+   S
Sbjct:   62  LLDQGLNMAGIKQVLLMKENQTEAVKVKEETKEISKTELRKILRDELQHTGRFNRTSLRQ  121

Query:  119  GN                                                             120
             G+
Sbjct:  122  GD                                                             123
```

An alignment of the GAS and GBS proteins is shown below.

```
Identities = 90/123 (73%), Positives = 108/123 (87%)
Query:    1  MKERELRRTMAVFPIGAVMKLTDLTARQIRYYEDQGLITPERTEGNRRMFSLNDMDRLLE   60
             MKE+ELRR+MAVFPIG VM LTDL+ARQIRYYEDQGLI PERT+GNRRMFSLNDMDRLLE
Sbjct:    1  MKEKELRRSMAVFPIGTVMTLTDLSARQIRYYEDQGLIKPERTQGNRRMFSLNDMDRLLE   60

Query:   61  IKDFISDGLHISDIKNEYMQRQHKSKEKQKSLSDAEVRRLLQDELRNQGRFSSPSQHIGN  120
             IKDF+S+GL+I+ IK EY++RQ K  +KQK+L+DA+VRR+L DE+    Q  FS+PSQHIGN
Sbjct:   61  IKDFLSEGLNIAAIKREYVERQGKLMQKQKALTDADVRRILHDEMLTQSGFSTPSQHIGN  120

Query:  121  MHL                                                            123
               +
Sbjct:  121  FRI                                                            123
```

Based on this analysis, it was predicted that these proteins and their epitopes could be useful antigens for vaccines or diagnostics.

Example 1585

A DNA sequence (GBSx1679) was identified in *S. agalactiae* <SEQ ID 4899> which encodes the amino acid sequence <SEQ ID 4900>. This protein is predicted to be glutamine synthetase (ginA). Analysis of this protein sequence reveals the following:

Possible site: 29
>>> Seems to have no N-terminal signal sequence
----- Final Results -----
    bacterial cytoplasm --- Certainty = 0.2157 (Affirmative) <succ>
    bacterial membrane --- Certainty = 0.0000 (Not Clear) <succ>
      bacterial outside --- Certainty = 0.0000 (Not Clear) <succ>

A related DNA sequence was identified in *S. pyogenes* <SEQ ID 4901> which encodes the amino acid sequence <SEQ ID 4902>. Analysis of this protein sequence reveals the following:

Possible site: 29
>>> Seems to have no N-terminal signal sequence
INTEGRAL Likelihood = –0.00 Transmembrane 347-363 (347-363)
----- Final Results -----
    bacterial membrane --- Certainty = 0.1001 (Affirmative) <succ>
      bacterial outside --- Certainty = 0.0000 (Not Clear) <succ>
        bacterial cytoplasm --- Certainty = 0.0000 (Not Clear) <succ>

An alignment of the GAS and GBS proteins is shown below.

```
Identities = 392/448 (87%), Positives = 421/448 (93%)
Query:    1  MTITAEDIRREVKEKNVTFLRLMFTDILGVMKNVEIPATDEQLDKVLSNKAMFDGSSIEG   60
             M IT  DIRREVKEKNVTFLRLMFTDI+GVMKNVEIPAT EQLDKVLSNK MFDGSSIEG
Sbjct:    1  MAITVADIRREVKEKNVTFLRLMFTDIMGVMKNVEIPATKEQLDKVLSNKVMFDGSSIEG   60

Query:   61  FVRINESDMYLYPDLDTWIVFPWGDENGAVAGLICDIYTAEGEPFAGDPRGNLKRNMKRM  120
             FVRINESDMYLYPDLDTWIVFPWGDENGAVAGLICDIYTAEG+PFAGDPRGNLKR +K M
Sbjct:   61  FVRINESDMYLYPDLDTWIVFPWGDENGAVAGLICDIYTAEGKPFAGDPRGNLKRALKHM  120

Query:  121  QEMGYKSFNLGPEPEFFLFKMDENGNPTLDVNDKGGYFDLAPIDLADNTRREIVNVLTQM  180
              E+GYKSFNLGPEPEFFLFKMD+ GNPTL+VND GGYFDLAP DLADNTRREIVN+LT+M
Sbjct:  121  NEIGYKSFNLGPEPEFFLFKMDDKGNPTLEVNDNGGYFDLAPIDLADNTRREIVNILTKM  180

Query:  181  GFEVEASHHEVAVGQHEIDFKYDDVLKACDNIQLFKLVVKTIARKHGLYATFMAKPKFGI  240
             GFEVEASHHEVAVGQHEIDFKY DVLKACDNIQ+FKLVVKTIAR+HGLYATFMAKPKFGI
Sbjct:  181  GFEVEASHHEVAVGQHEIDFKYADVLKACDNIQIFKLVVKTIAREHGLYATFMAKPKFGI  240

Query:  241  NGSGMHCNMSLFDNEGNNAFFDPEDPRGMQLSEDAYYFLGGLMKHAYNYTAIINPTVNSY  300
              GSGMHCNMSLFDN+GNNAF+D  D RGMQLSEDAYYFLGGLMKHAYNYTAI NPTVNSY
Sbjct:  241  AGSGMHCNMSLFDNQGNNAFYDEADKRGMQLSEDAYYFLGGLMKHAYNYTAITNPTVNSY  300

Query:  301  KRLVPGYEAPVYVAWAGRNRSPLIRVPASRGMGTRLELRSVDPTANPYLALSVLLGSGLE  360
             KRLVPGYEAPVYVAWAG NRSPLIRVPASRGMGTRLELRSVDPTANPYLAL+VLL +GL+
Sbjct:  301  KRLVPGYEAPVYVAWAGSNRSPLIRVPASRGMGIRLELRSVDPTANPYLALAVLLEAGLD  360

Query:  361  GIENKIEAPEPIETNIYAMTVEERRQAGIVDLPSTLHNALEALEEDEVVKAALGTHIYTN  420
             GI NKIEAPEP+E NIY MT+EER +AGI+DLPSTLHNAL+AL++D+VV+ ALG HIYTN
Sbjct:  361  GIINKIEAPEPVEANIYTMTMEERNEAGIIDLPSTLHNALKALQKDDVVQKALGYHIYTN  420

Query:  421  FLDAKRIEWASYATYVSQWEIDNYLDLY                                 448
             FL+AKRIEW+SYAT+VSQWEID+Y+  Y
Sbjct:  421  FLEAKRIEWSSYATFVSQWEIDHYIHNY                                 448
```

Based on this analysis, it was predicted that these proteins and their epitopes could be useful antigens for vaccines or diagnostics.

Example 1586

A DNA sequence (GBSx1680) was identified in *S. agalactiae* <SEQ ID 4903> which encodes the amino acid sequence <SEQ ID 4904>. This protein is predicted to be SceB precursor. Analysis of this protein sequence reveals the following:

Possible site: 28
>>> Seems to have no N-terminal signal sequence
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>

The protein has homology with the following sequences in the GENPEPT database.

A related DNA sequence was identified in *S. pyogenes* <SEQ ID 1013> which encodes the amino acid sequence <SEQ ID 1014>. Analysis of this protein sequence reveals the following:

Possible site: 17
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

An alignment of the GAS and GBS proteins is shown below.

```
>GP:CAA66624 GB:X97985 ORF1 [Staphylococcus aureus]
Identities = 44/119 (36%), Positives = 66/119 (54%), Gaps = 4/119 (3%)
Query:   26  SFASTNADANTYNYAVDVDYLASAEEIAQAHPA-SNTFPLGQCTWGVKE-MATWAGNWWG   83
             S AS + +N +          ++    I+ + + SN +  GQCT+ V + +    G+ WG
Sbjct:  117  SGASYSTTSNNVHVTTTAAPSSNGRSISNGYASGSNLYTSGQCTYYVFDRVGGKIGSTWG  176

Query:   84  NGGDWAASAASADYTVGTQPRVGSIVCWTDGSYGHVAYVTAVDPVTNKIQVLESNYAGH  142
             N +WA +AAS+ YTV   P+VG+I+  T G YGHVAYV   V+   ++V E NY GH
Sbjct:  177  NASNWANAAASSGYTVNNTPKVGAIMQTTQGYYGHVAYVEGVNS-NGSVRVSEMNY-GH  233
```

```
Identities = 60/115 (52%), Positives = 81/115 (70%), Gaps = 7/115 (6%)
Query:  55 AHPASNTFPLGQCTWGVKEMATWAGNWWGNGGDWAASAASADYTVGTQPRVGSIVCWTDG  114
           ++ +SNT+P+GQCTWG K +A WAGN WGNGG WA SA +A Y  G+ P VG+I  W DG
Sbjct: 291 SYDSSNTYPVGQCTWGAKSLAPWAGNNWGNGGQWAYSAQAAGYRTGSTPMVGAIAVWNDG  350

Query: 115 SYGHVAYVTAVDPVTNKIQVLESNYAGHQWIDNYRGWFDPQNTVTPGVVSYIYPN       169
           YGHVA V V   ++ I+V+ESNY+G Q+I ++RGWF+P       V++IYP+
Sbjct: 351 GYGHVAVVVEVQSASS-IRVMESNYSGRQYIADHRGWFNPTG------VTFIYPH       398
```

A related GBS gene <SEQ ID 8859> and protein <SEQ ID 8860> were also identified. Analysis of this protein sequence reveals the following:

```
Lipop: Possible site: –1   Crend: 8
McG: Discrim Score: 5.85
GvH: Signal Score (–7.5) : 3.11
Possible site: 24
>>> Seems to have a cleavable N-term signal seq.
ALOM program      count: 0 value: 6.74        threshold: 0.0
PERIPHERAL        Likelihood = 6.74            115
modified ALOM score: –1.85
*** Reasoning Step: 3
----- Final Results -----
   bacterial outside --- Certainty = 0.3000 (Affirmative) <succ>
      bacterial membrane--- Certainty = 0.0000 (Not Clear) <succ>
         bacterial cytoplasm--- Certainty = 0.0000 (Not Clear) <succ>
```

The protein has homology with the following sequences in the databases:

```
37.5/56.7% over 200aa
Staphylococcus aureus
GP|1340128|ORF1 Insert characterized
ORF00255(376-726 of 1107)
GP|1340128|emb|CAA66624.1||X97985(33-233 of 255) ORF1 {Staphylococcus aureus}
% Match = 9.0
% Identity = 37.5 % Similarity = 56.7
Matches = 45 Mismatches = 47 Conservative Sub.s = 23

294        324        354        384        414
SVIWI**TRSHQMEENMNIKQLKSKTMLGTVALVSAFSFASTNADANTYNYAVDVD----------------------~~~~
      : :              |   :    :  | :|  :  :| | :|
    MKKIVTATIATAGLATIAFAGHDAQAAEQNNNGYNSNDAQSYSYTYTIDAQGNYHYTWTGNWNPSQLTQNN~~~~
       10         20         30         40         50         60         70

462       489        516        546        576        606
-------------------YLASAEEIAQAHPA-SNTFPLGQCTWGV-KEMATWAGNWWGNGGDWAASAASADYTVGTQ
                    ::    |:   : :|| :   ||||:  |    :   |: |||   :||  :|||: |||
GSGASYSTTSNNVHVTTTAAPSSNGRSISNGYASGSNLYTSGQCTYYVFDRVGGKIGSTWGNASNWANAAASSGYTVNNT
           130        140        150        160        170        180        190

636        666        696        726        756        786        816        846
PRVGSIVCWTDGSYGHVAYVTAVDPVTNKIQVLESNYAGHQWIDNYRGWFDPQNTVTPGVVSYIYPN*SIKNSSHRRYKS
|:||:|:  |  |  ||||||||  |:      ::|  |||  ||                    :
PKVGAIMQTTQGYYGHVAYVEGVNS-NGSVRVSEMNY-GHGAGVVTSRTISANQAGSYNFIH
           210        220        230        240        250
```

SEQ ID 8860 (GBS30) was expressed in *E. coli* as a His-fusion product. SDS-PAGE analysis of total cell extract is shown in FIG. 8 (lane 2; MW 19.2 kDa). It was also expressed in *E. coli* as a GST-fusion product. SDS-PAGE analysis of total cell extract is shown in FIG. 16 (lane 2; MW 44.2 kDa).

GBS30-GST was purified as shown in FIG. 193, lane 8.

Based on this analysis, it was predicted that these proteins and their epitopes could be useful antigens for vaccines or diagnostics.

Example 1587

A DNA sequence (GBSx1681) was identified in *S. agalactiae* <SEQ ID 4905> which encodes the amino acid sequence <SEQ ID 4906>. Analysis of this protein sequence reveals the following:

```
Possible site: 14
>>> Seems to have an uncleavable N-term signal seq
INTEGRAL Likelihood = –3.93 Transmembrane 2-18 (1-18)
----- Final Results -----
   bacterial membrane --- Certainty = 0.2572 (Affirmative) <succ>
      bacterial outside --- Certainty = 0.0000 (Not Clear) <succ>
         bacterial cytoplasm --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1588

A DNA sequence (GBSx1682) was identified in *S. agalactiae* <SEQ ID 4907> which encodes the amino acid sequence <SEQ ID 4908>. Analysis of this protein sequence reveals the following:

Possible site: 28
>>> Seems to have no N-terminal signal sequence
----- Final Results -----
   bacterial cytoplasm --- Certainty = 0.2160 (Affirmative) <succ>
     bacterial membrane --- Certainty = 0.0000 (Not Clear) <succ>
      bacterial outside --- Certainty = 0.0000 (Not Clear) <succ>

Possible site: 28
>>> Seems to have no N-terminal signal sequence
INTEGRAL Likelihood = −0.11 Transmembrane 468-484 (468-484)
----- Final Results -----
   bacterial membrane --- Certainty = 0.1044 (Affirmative) <succ>
    bacterial outside --- Certainty = 0.0000 (Not Clear) <succ>
   bacterial cytoplasm --- Certainty = 0.0000 (Not Clear) <succ>

The protein has homology with the following sequences in the GENPEPT database.

```
>GP:BAB06381 GB:AP001516 unknown conserved protein [Bacillus halodurans]
Identities = 353/550 (64%), Positives = 443/550 (80%)
Query:   6 LKPEEVGVYAIGGLGEIGKNTYGIEYQDEIIIVDAGIKFPEDDLLGIDYVIPDYSYIVEN  65
             LK +  VYA+GGLGEIGKNTY +++QDEII++DAGIKFPED+LLGIDYVIPDYSY+V+N
Sbjct:   4 LKNNQTAVYALGGLGEIGKNTYAVQFQDEIILIDAGIKFPEDELLGIDYVIPDYSYLVKN  63

Query:  66 IDRIKALVITHGHEDHIGGIPPFLLKQANLPIYAGPLALALIKGKLEEHGLLRDATLYEIH 125
             ++IK L ITHGHEDHIGGIP+LL++ N+PIY G LAL L++GKLEEHGLLR A L++I
Sbjct:  64 ENKIKGLFITHGHEDHIGGIPYLLREVNIPIYGGKLALGLLRGKLEEHGLLRKAKLHDIQ 123

Query: 126 ANTELTFKNLSVIFFRTTHSIPEPLGIVIHTPQGKVICTGDFKFDFTPVGEPADLHRMAA 185
             +   + F    SV+FERTTHSIP+   GIV+ TP G ++ TGDFKFDFTPVGEPA+L +MA
Sbjct: 124 EDDIIKFAKTSVSFERTTHSIPDSYGIVVKTPPGNIVHTGDFKFDFTPVGEPANLTKMAK 183

Query: 186 LGEDGVLCLLSDSTNAEVPTFTNSEKIVGQSIMKIIEGIEGRIIFASFASNIFRLQQAAE 245
             +GE+GVLCLLSDSTN+E+P FT SE+ VG+SI  I     +EGRIIFA+FASNI RLQQA E
Sbjct: 184 IGEEGVLCLLSDSTNSEIPEFTMSERKVGESIDHIFRRVEGRIIFATFASNIHRLQQAVE 243

Query: 246 AAVKTGRKIAVFGRSMEKAIVNGIELGYIKVPKGTFIEPSELKNLHASEVLIMCTGSQGE 305
             +AV+ GRK+AVFGRSME AI  G ELGYIK PK  TFIEP++L  L  +EV+I+CTGSQGE
Sbjct: 244 SAVRYGRKVAVFGRSMESAINIGQELGYIKAPKNTFIEPNQLNKLPDNEVMILCTGSQGE 303

Query: 306 SMAALARIANGTHRQVTLQPGDTVIFSSSPIPGNTTSVNKLINTIQEAGVDVIHGKINNI 365
              MAAL+R+A GTHRQ+ +  PGDTVIFSSSPIPGNT SV+K IN +  +AG +VIHG +N+I
Sbjct: 304 PMAALSRVAFGTHRQIQIIPGDTVIFSSSPIPGNTLSVSKTINQLYKAGANVIHGSLNDI 363

Query: 366 HTSGHGGQQEQKLMLRLIKPKYFMPVHGEYRMQKVHAGLAVDTGIPKENIFIMENGDVLA 425
             HTSGHGGQ+EQKLMLRLIKPKYEMP+HGEYRM K+H  LA D G+P EN FIM+NGDVLA
Sbjct: 364 HTSGHGGQEEQKLMLRLIKPKYEMPIHGEYRMLKMHTKLAEDCGVPAENCFIMDNGDVLA 423

Query: 426 LTSDSARIAGHFNAQDIYVDGNGIGDIGAAVLRDRHDLSEDGVVLAVATVDFDSKMILAG 485
             L   D A IAG +   +YVDGNGIGDIG  VLRDR  LSE+G+V+ V +++       + AG
Sbjct: 424 LHPDEAGIAGKIPSGSVYVDGNGIGDIGNIVLRDRRILSEEGLVVVVVSLNMKEYKVTAG 483

Query: 486 PDILSRGFIYMRESGDLIRESQHILFNAIRIALKNKDASIQSVNGAIVNALRPPFLYEKTE 545
             PD++SRGF+YMRESGDLI+E+Q +L N ++  ++ K     +   I + L PFLY++T+
Sbjct: 484 PDLISRGFVYMRESGDLIQEAQRLLANHLQEVMERKTNQWSEIKNEITDVLGPFLYDRTK 543

Query: 546 REPIIIPMVL                                                   555
             R+P+I+P+++
Sbjct: 544 RKPMILPIIM                                                   553
```

A related DNA sequence was identified in *S. pyogenes* <SEQ ID 4909> which encodes the amino acid sequence <SEQ ID 4910>. Analysis of this protein sequence reveals the following:

The protein has homology with the following sequences in the databases:

```
>GP:BAB06381 GB:AP001516 unknown conserved protein [Bacillus halodurans]
Identities = 353/550 (64%), Positives = 444/550 (80%)
Query:   6 LKPNEVGVFAIGGLGEIGKNTYGIEYQDEIIIVDAGIKFPEDDLLGIDYVIPDYSYIVDN  65
             LK N+  V+A+GGLGEIGKNTY +++QDEII++DAGIKFPED+LLGIDYVIPDYSY+V N
Sbjct:   4 LKNNQTAVYALGGLGEIGKNTYAVQFQDEIILIDAGIKFPEDELLGIDYVIPDYSYLVKN  63

Query:  66 LDRVKALVITHGHEDHIGGIPPFLLKQANIPIYAGPLALALIRGKLEEHGLWREATVYEIN 125
             +++K L ITHGHEDHIGGIP+LL++ NIPIY G LAL L+RGKLEEHGL R+A +++I
Sbjct:  64 ENKIKGLFITHGHEDHIGGIPYLLREVNIPIYGGKLALGLLRGKLEEHGLLRKAKLHDIQ 123

Query: 126 HNTELTFKNMSVTFFKTTHSIPEPVGIVIHTPQGKIICTGDFKFDFTPVGDPADLQRMAA 185
             +   + F    SV+FF+TTHSIP+  GIV+ TP G I+ TGDFKFDFTPVG+PA+L +MA
Sbjct: 124 EDDIIKFAKTSVSFFRTTHSIPDSYGIVVKTPPGNIVHTGDFKFDFTPVGEPANLTKMAK 183

Query: 186 LGEEGVLCLLSDSTNAEIPTFTNSEKVVGQSILKIIEGIHGRIIFASFASNIYRLQQAAE 245
             +GEEGVLCLLSDSTN+EIP FT SE+ VG+SI  I   +  + GRIIFA+FASNI+RLQQA E
```

-continued

```
Sbjct: 184  IGEEGVLCLLSDSTNSEIPEFTMSERKVGESIDHIFRRVEGRIIFATFASNIHRLQQAVE  243

Query: 246  AAVKTGRKIAVFGRSMEKAIVNGIELGYIKVPKGTFIEPSELKNLHASEVLIMCTGSQGE  305
            +AV+ GRK+AVFGRSME AI G ELGYIK PK TFIEP+L   L  +EV+I+CTGSQGE
Sbjct: 244  SAVRYGRKVAVFGRSMESAINIGQELGYIKAPKNTFIEPNQLNKLPDNEVMILCTGSQGE  303

Query: 306  SMAALARIANGTHRQVTLQPGDTVIFSSSPIPGNTTSVNKLINTIQEAGVDVIHGKVNNI  365
              MAAL+R+A GTHRQ+ + PGDTVIFSSSPIPGNT SV+K IN + +AG +VIHG +N+I
Sbjct: 304  PMAALSRVAFGTHRQIQIIPGDTVIFSSSPIPGNTLSVSKTINQLYKAGANVIHGSLNDI  363

Query: 366  HTSGHGGQQEQKLMLSLIKPKYFMPVHGEYRMQKVHAGLAMDIGIPKENIFIMENGDVLA  425
            HTSGHGGQ+EQKLML LIKPKYFMP+HGEYRM K+H  LA D G+P EN FIM+NGDVLA
Sbjct: 364  HTSGHGGQEEQKLMLRLIKPKYFMPIHGEYRMLKMHTKLAEDCGVPAENCFIMDNGDVLA  423

Query: 426  LTSDSARIAGHFNAQDIYVDGNGIGDIGAAVLRDRRDLSEDGVVLAVATVDFNTQMILAG  485
            L  D A IAG   + +YVDGNGIGDIG  VLRDRR LSE+G+V+ V +++    + AG
Sbjct: 424  LHPDEAGIAGKIPSGSVYVDGNGIGDIGNIVLRDRRILSEEGLVVVVVSLNMKEYKVTAG  483

Query: 486  PDILSRGFIYMRESGDLIRESQRVLFNAIRIALKNKDASIQSVNGAIVNALRPFLYEKTE  545
            PD++SRGF+YMRESGDLI+E+QR+L N ++  ++ K      +    I + L PFLY++T+
Sbjct: 484  PDLISRGFVYMRESGDLIQEAQRLLANHLQEVMERKTNQWSEIKNEITDVLGPFLYDRTK  543

Query: 546  REPIIIPMVL                                                    555
            R+P+I+P+++
Sbjct: 544  RKPMILPIIM                                                    553
```

An alignment of the GAS and GBS proteins is shown below.

```
Identities = 523/559 (93%), Positives = 550/559 (97%)
Query:   1  MSNINLKPEEVGVYAIGGLGEIGKNTYGIEYQDEIIIVDAGIKFPEDDLLGIDYVIPDYS   60
            M+NI+LKP EVGV+AIGGLGEIGKNTYGIEYQDEIIIVDAGIKFPEDDLLGIDYVIPDYS Sbjct:   1  MTNISLKPNEVGVFAIGGLGEIGKNTYGIEYQDEIIIVDAGIKFPEDDLLGIDYVIPDYS   60

Query:  61  YIVENIDRIKALVITHGHEDHIGGIPFLLKQANLPIYAGPLALALIKGKLEEHGLLRDAT  120
            YIV+N+DR+KALVITHGHEDHIGGIPFLLKQAN+PIYAGPLALALI+GKLEEHGL R+AT
Sbjct:  61  YIVDNLDRVKALVITHGHEDHIGGIPFLLKQANIPIYAGPLALALIRGKLEEHGLWREAT  120

Query: 121  LYEIHANTELTFKNLSVTFFRTTHSIPEPLGIVIHTPQGKVICTGDFKFDFTPVGEPADL  180
            +YEI+ NTELTFKN+SVTFF+TTHSIPEP+GIVIHTPQGK+ICTGDFKFDFTPVG+PADL
Sbjct: 121  VYEINHNTELTFKNMSVTFFKTTHSIPEPVGIVIHTPQGKIICTGDFKFDFTPVGDPADL  180

Query: 181  HRMAALGEDGVLCLLSDSTNAEVPTFTNSEKIVGQSIMKIIEGIEGRIIFASFASNIFRL  240
             RMAALGE+GVLCLLSDSTNAE+PTFTNSEK+VGQSI+KIIEGI GRIIFASFASNI+RL
Sbjct: 181  QRMAALGEEGVLCLLSDSTNAEIPTFTNSEKVVGQSILKIIEGIHGRIIFASFASNIYRL  240

Query: 241  QQAAEAAVKTGRKIAVFGRSMEKAIVNGIELGYIKVPKGTFIEPSELKNLHASEVLIMCT  300
            QQAAEAAVKTGRKIAVFGRSMEKAIVNGIELGYIKVPKGTFIEPSELKNLHASEVLIMCT
Sbjct: 241  QQAAEAAVKTGRKIAVFGRSMEKAIVNGIELGYIKVPKGTFIEPSELKNLHASEVLIMCT  300

Query: 301  GSQGESMAALARIANGTHRQVTLQPGDTVIFSSSPIPGNTTSVNKLINTIQEAGVDVIHG  360
            GSQGESMAALARIANGTHRQVTLQPGDTVIFSSSPIPGNTTSVNKLINTIQEAGVDVIHG
Sbjct: 301  GSQGESMAALARIANGTHRQVTLQPGDTVIFSSSPIPGNTTSVNKLINTIQEAGVDVIHG  360

Query: 361  KINNIHTSGHGGQQEQKLMLRLIKPKYFMPVHGEYRMQKVHAGLAVDTGIPKENIFIMEN  420
            K+NNIHTSGHGGQQEQKLML LIKPKYFMPVHGEYRMQKVHAGLA+D GIPKENIFIMEN
Sbjct: 361  KVNNIHTSGHGGQQEQKLMLSLIKPKYFMPVHGEYRMQKVHAGLAMDIGIPKENIFIMEN  420

Query: 421  GDVLALTSDSARIAGHFNAQDIYVDGNGIGDIGAAVLRDRHDLSEDGVVLAVATVDFDSK  480
            GDVLALTSDSARIAGHFNAQDIYVDGNGIGDIGAAVLRDR DLSEDGVVLAVATVDF+++
Sbjct: 421  GDVLALTSDSARIAGHFNAQDIYVDGNGIGDIGAAVLRDRRDLSEDGVVLAVATVDFNTQ  480

Query: 481  MILAGPDILSRGFIYMRESGDLIRESQHILFNAIRIALKNKDASIQSVNGAIVNALRPFL  540
            MILAGPDILSRGFIYMRESGDLIRESQ +LFNAIRIALKNKDASIQSVNGAIVNALRPFL
Sbjct: 481  MILAGPDILSRGFIYMRESGDLIRESQRVLFNAIRIALKNKDASIQSVNGAIVNALRPFL  540

Query: 541  YEKTEREPIIIPMVLTPDK                                           559
            YEKTEREPIIIPMVLTPDK
Sbjct: 541  YEKTEREPIIIPMVLTPDK                                           559
```

Based on this analysis, it was predicted that these proteins and their epitopes could be useful antigens for vaccines or diagnostics.

Example 1589

A DNA sequence (GBSx1683) was identified in *S. agalactiae* <SEQ ID 4911> which encodes the amino acid sequence <SEQ ID 4912>. Analysis of this protein sequence reveals the following:

```
Possible site: 32
>>> Seems to have no N-terminal signal sequence
----- Final Results -----
   bacterial cytoplasm --- Certainty = 0.2932 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database.

```
>GP:CAB13327 GB:Z99111 ykzG [Bacillus subtilis]
Identities = 27/75 (36%), Positives = 44/75 (58%), Gaps = 7/75 (9%)
Query:  1 MIYKVFYQETKERNPRREQTKTLYVTIDAANELEGRIAARKLVEENTAYNIEFIELLSDK 60
          MIYKVFYQE  + P RE+T +LY+   + ++ ++ +K        +NIEFI  +
Sbjct:  1 MIYKVFYQEKADEVPVREKTDSLYIEGVSERDVRTKLKEKK-------FNIEFITPVDGA 53

Query: 61 HLEYEKETGVFELTE 75
          LEYE+++  F++ E
Sbjct: 54 FLEYEQQSENFKVLE 68
```

A related DNA sequence was identified in *S. pyogenes* <SEQ ID 4913> which encodes the amino acid sequence <SEQ ID 4914>. Analysis of this protein sequence reveals the following:

```
Possible site: 32
>>> Seems to have no N-terminal signal sequence
----- Final Results -----
   bacterial cytoplasm --- Certainty = 0.3428 (Affirmative) <succ>
      bacterial membrane --- Certainty = 0.0000 (Not Clear) <succ>
         bacterial outside --- Certainty = 0.0000 (Not Clear) <succ>
```

An alignment of the GAS and GBS proteins is shown below.

```
Identities = 60/76 (78%), Positives = 70/76 (91%)
Query:  1 MIYKVFYQETKERNPRREQTKTLYVTIDAANELEGRIAARKLVEENTAYNIEFIELLSDK 60
          MIYKVFYQETK+++PRRE TK LY+ IDA +EL+GRI AR+LVE+NT YN+EFIELLSDK
Sbjct:  1 MIYKVFYQETKDQSPRRESTKALYLNIDATDELDGRIKARRLVEDNTYYNVEFIELLSDK 60

Query: 61 HLEYEKETGVFELTEF 76
          HL+YEKETGVFELTEF
Sbjct: 61 HLDYEKETGVFELTEF 76
```

Based on this analysis, it was predicted that these proteins and their epitopes could be useful antigens for vaccines or diagnostics.

Example 1590

A DNA sequence (GBSx1684) was identified in *S. agalactiae* <SEQ ID 4915> which encodes the amino acid sequence <SEQ ID 4916>. This protein is predicted to be glycoprotein endopeptidase. Analysis of this protein sequence reveals the following:

```
Possible site: 13
>>> Seems to have no N-terminal signal sequence (or aa 1-17)
----- Final Results -----
   bacterial cytoplasm --- Certainty = 0.0430 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database.

```
>GP:CAA76861 GB:Y17797 hypothetical protein [Enterococcus faecalis]
Identities = 94/182 (51%), Positives = 127/182 (69%), Gaps = 6/182 (3%)
```

```
-continued
Query:    2  MKVLAFDTSSKALSVAVLNNMECLATVTINIKKNHSINLMPAIDFLMQSIDLEPQDLDRI     61
             +++LA DTS++ LS+AV  N + L + T  +K+NHS+ LMPAID+LM  ++L P  +DR
Sbjct:   13  VRILAIDTSNQTLSIAVCENQKILGSYTATVKRNHSLTLMPAIDYLMSQLNLAPTAIDRF    72

Query:   62  VVAEGPGSYTGLRVAVATAKMLAYTLKIDLVGVSSLYAL-TNGFSENDLLVPLIDARRNN   120
             VVAEGPGSYTGLR+ V TAK LAYTLK +LVG+SSL AL  N    + L+VPL DARR N
Sbjct:   73  VVAEGPGSYTGLRLGVTTAKTLAYTLKKELVGISSLQALAANCVGQTGLIVPLFDARRKN   132

Query:  121  VYVGFYQNGDTV----KPDCHTSLEEVLQEVGNKANVHFVGE-VAAFFDQIKKALPHAKI   175
             VY G Y+  D V       PD H SL E+L+++ N+ N+ FVGE V  F ++I   +PH +I
Sbjct:  133  VYAGAYRFVDGVWQNELPDQHISLRELLEQLKNEPNLFFVGEDVEKFTEEIAQIIPHGEI   192

Query:  176  TE                                                            177
             +
Sbjct:  193  CD                                                            194
```

A related DNA sequence was identified in *S. pyogenes* <SEQ ID 4917> which encodes the amino acid sequence <SEQ ID 4918>. Analysis of this protein sequence reveals the following:

---

Possible site: 36
>>> Seems to have no N-terminal signal sequence
INTEGRAL      Likelihood = –1.38    Transmembrane 99-115 (99-115)
----- Final Results -----
  bacterial membrane --- Certainty = 0.1553 (Affirmative) <succ>
    bacterial outside --- Certainty = 0.0000 (Not Clear) <succ>
      bacterial cytoplasm --- Certainty = 0.0000 (Not Clear) <succ>

---

A related sequence was also identified in GAS <SEQ ID 9159> which encodes the amino acid sequence <SEQ ID 9160>. Analysis of this protein sequence reveals the following:

---

Possible site: 25
>>> Seems to have no N-terminal signal sequence
INTEGRAL      Likelihood = –1.38    Transmembrane 88-104 (88-104)
----- Final Results -----
  bacterial membrane --- Certainty = 0.1553 (Affirmative) <succ>
    bacterial outside --- Certainty = 0.0000 (Not Clear) <succ>
      bacterial cytoplasm --- Certainty = 0.0000 (Not Clear) <succ>

---

An alignment of the GAS and GBS proteins is shown below.

```
Identities = 134/232 (57%), Positives = 172/232 (73%), Gaps = 3/232 (1%)
Query:    2  MKVLAFDTSSKALSVAVLNNMECLATVTINIKKNHSINLMPAIDFLMQSIDLEPQDLDRI     61
             MK LAFDTS+K LS+A+L++    LA +T+NI+K HS++LMPAIDFLM   DL+PQDL+RI
Sbjct:   12  MKTLAFDTSNKTLSLAILDDETLLADMTLNIQKKHSVSLMPAIDFLMTCTDLKPQDLERI    71

Query:   62  VVAEGPGSYTGLRVAVATAKMLAYTLKIDLVGVSSLYALTNGFSE---NDLLVPLIDARR   118
             VVA+GPGSYTGLRVAVATAK LAY+L I LVG+SSLYAL       +  N L+VPLIDARR
Sbjct:   72  VVAKGPGSYTGLRVAVATAKTLAYSLNIALVGISSLYALAASTCKQYPNTLVVPLIDARR   131

Query:  119  NNVYVGFYQNGDTVKPDCHTSLEEVLQEVGNKANVHFVGEVAAFFDQIKKALPHAKITET   178
              N YVG+Y+ G +V P  H SLE +++++  +   +  + FVGE A F ++I+K LP A + T
Sbjct:  132  QNAYVGYYRQGKSVMPQAHASLEVIIEQLVEEGQLIFVGETAPFAEKIQKKLPQAILLPT   191

Query:  179  LPCAVAIGRKGQKMKSVNVDAFVPRYLKRVEAEENWLKNHCETNTEEYIKRV           230
             LP A    G GQ +       NVDAFVP+YLKRVEAEENWLK++       Y+KR+
Sbjct:  192  LPSAYECGLLGQSLAPENVDAFVPQYLKRVEAEENWLKDNEIKDDSHYVKRI           243
```

SEQ ID 4916 (GBS69) was expressed in *E. coli* as a His-fusion product. SDS-PAGE analysis of total cell extract is shown in FIG. 17 (lane 9; MW 28.9 kDa). It was also expressed in *E. coli* as a GST-fusion product. SDS-PAGE analysis of total cell extract is shown in FIG. 20 (lane 4; MW 53.9 kDa).

Figure 285:
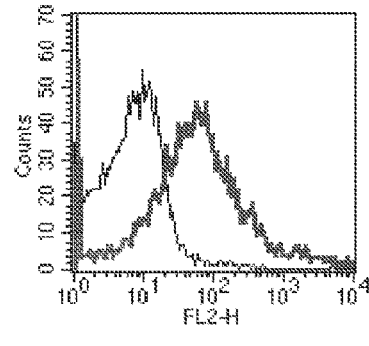

The GBS69-GST fusion product was purified (FIG. 197, lane 6) and used to immunise mice. The resulting antiserum was used for FACS (FIG. 285), which confirmed that the protein is immunoaccessible on GBS bacteria.

Based on this analysis, it was predicted that these proteins and their epitopes could be useful antigens for vaccines or diagnostics.

Example 1591

A DNA sequence (GBSx1685) was identified in *S. agalactiae* <SEQ ID 4919> which encodes the amino acid sequence <SEQ ID 4920>. This protein is predicted to be ribosomal-protein-alanine acetyltransferase. Analysis of this protein sequence reveals the following:

---

Possible site: 22
>>> Seems to have a cleavable N-term signal seq.
----- Final Results -----
  bacterial outside --- Certainty = 0.3000 (Affirmative) <succ>
    bacterial membrane --- Certainty = 0.0000 (Not Clear) <succ>
      bacterial cytoplasm --- Certainty = 0.0000 (Not Clear) <succ>

---

A related GBS nucleic acid sequence <SEQ ID 10137> which encodes amino acid sequence <SEQ ID 10138> was also identified.

The protein has homology with the following sequences in the GENPEPT database.

```
>GP:AAC06803 GB:AE000696 ribosomal-protein-alanine acetyltransferase
[Aquifex aeolicus]
Identities = 44/141 (31%), Positives = 74/141 (52%), Gaps = 8/141 (5%)
Query:    9 LREFEMESSEQALAIWSVLSDVYDKSPWSLSQISEDLKKDSTDYFFVYNDGEVIGFLALQ    68
            +RE E  E+    ++ +  + +       WS        +D +    + F  DG+V+G++
Sbjct:    4 VREMEREDVER---VYEINRESFTTDAWSRFSFEKDFENKFSRRFVLEEDGKVVGYVIFW    60

Query:   69 QLVGEVEITNIAVKKNYQGKGYAYQLM----SMIADIEVPVFLEVRYSNIVAQKLYERCG   124
            +  E  I    A+   Y+GKGY +L+      S + D    V L+VR SN+ A   LY++  G
Sbjct:   61 VVKEEATIMTFAIAPGYRGKGYGEKLLREAISRLGDKVKRVVLDVRKSNLRAINLYKKLG   120

Query:  125 FVVLRKRKNYYHDPIEDAIVM                                         145
            F V+ +RK YY D  E+A++M
Sbjct:  121 FKVVTERKGYYSDG-ENALLM                                         140
```

A related DNA sequence was identified in *S. pyogenes* <SEQ ID 4921> which encodes the amino acid sequence <SEQ ID 4922>. Analysis of this protein sequence reveals the following:

---

Possible site: 35
>>> Seems to have no N-terminal signal sequence
----- Final Results -----
 bacterial cytoplasm --- Certainty = 0.3800 (Affirmative) <succ>
  bacterial membrane --- Certainty = 0.0000 (Not Clear) <succ>
   bacterial outside --- Certainty = 0.0000 (Not Clear) <succ>

---

An alignment of the GAS and GBS proteins is shown below.

```
Identities = 65/140 (46%), Positives = 96/140 (68%), Gaps = 1/140 (0%)
Query:    9 LREFEMES-SEQALAIWSVLSDVYDKSPWSLSQISEDLKKDSTDYFFVYNDGEVIGFLAL    67
            L E  M++  EQA I+ +L  VY  SPW+L Q+  D+++D TDYF +Y+  +++GFLA+
Sbjct:    6 LSESNMKTVEEQAKNIYQLLEMVYGTSPWTLEQVLIDIRRDQTDYFLLYDHDKLLGFLAI    65

Query:   68 QQLVGEVEITNIAVKKNYQGKGYAYQLMSMIADIEVPVFLEVRYSNIVAQKLYERCGFVV   127
            Q L GEVE+T IA+  ++Q  G A QLM+ +    IE  +FLEVR SN  AQ LY++ GF
Sbjct:   66 QDLAGEVEMTQIAILPSHQELGLASQLMTHLDSIESDIFLEVRESNHRAQGLYQKFGFKF   125

Query:  128 LRKRKNYYHDPIEDAIVMRK                                         147
            + KR +YY +PIE A++M++
Sbjct:  126 IGKRPDYYRNPIETALLMKR                                         145
```

Based on this analysis, it was predicted that these proteins and their epitopes could be useful antigens for vaccines or diagnostics.

Example 1592

A DNA sequence (GBSx1686) was identified in *S. agalactiae* <SEQ ID 4923> which encodes the amino acid sequence <SEQ ID 4924>. Analysis of this protein sequence reveals the following:

---

Possible site: 21
>>> Seems to have no N-terminal signal sequence
----- Final Results -----
 bacterial cytoplasm --- Certainty = 0.0334 (Affirmative) <succ>
  bacterial membrane --- Certainty = 0.0000 (Not Clear) <succ>
   bacterial outside --- Certainty = 0.0000 (Not Clear) c succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1593

A DNA sequence (GBSx1687) was identified in *S. agalactiae* <SEQ ID 4925> which encodes the amino acid sequence <SEQ ID 4926>. Analysis of this protein sequence reveals the following:

---

Possible site: 38
>>> Seems to have no N-terminal signal sequence
INTEGRAL    Likelihood = −1.75    Transmembrane 86-102 (86-104)
----- Final Results -----
 bacterial membrane --- Certainty = 0.1702 (Affirmative) <succ>
  bacterial outside--- Certainty = 0.0000 (Not Clear) <succ>
   bacterial cytoplasm --- Certainty = 0.0000 (Not Clear) <succ>

---

The protein has homology with the following sequences in the GENPEPT database.

```
>GP:BAB04267 GB:AP001508 glycoprotein endopeptidase [Bacillus halodurans]
Identities = 194/331 (58%), Positives = 263/331 (78%), Gaps = 1/331 (0%)
Query:    6 ILAVESSCDETSVAILKNDKELLANIIASQVESHKRFGGVVPEVASRHHVEVVTTCFEDA    65
            ILA+E+SCDETS A+++N   +L+N+++SQ++SHKRFGGVVPE+ASRHHVE  +T  E+A
```

-continued

```
Sbjct:  12 ILAIETSCDETSAAVIENGTTILSNVVSSQIDSHKRFGGVVPEIASRHHVEQITVIVEEA   71

Query:  66 LQEAGIVASDLDAVAVTYGPGLVGALLVGMAAAKAFAWANKLPLIPINHMAGHLMAARDV  125
           + EAG+  +DL AVAVT GPGLVGALL+G+ AAKA A+A++LPLI ++H+AGH+ A R +
Sbjct:  72 MHEAGVDFADLAAVAVTEGPGLVGALLIGVNAAKAIAFAHQLPLIGVHHIAGHIYANRLL  131

Query: 126 KELQYPLLALLVSGGHTELVYVSEPGDYKIVGETRDDAVGEAYDKVGRVMGLTYPAGREI  185
           KEL++PLLAL+VSGGHTEL+Y+    G+++++GETRDDAVGEAYDKV R +GL YP G  I
Sbjct: 132 KELEFPLLALVVSGGHTELIYMENHGEFEVIGETRDDAVGEAYDKVARTLGLPYPGGPHI  191

Query: 186 DQLAHKGQDTYHFPRAMIKEDHLEFSFSGLKSAFINLHHNAEQKGEALVLEDLCASFQAA  245
           D+LA  G+DT  FPRA ++ D +FSFSGLKSA IN  HNA+Q+GE +   ED+ ASFQA+
Sbjct: 192 DRLAVNGEDTLQFPRAWLEPDSFDFSFSGLKSAVINTLHNAKQRGENVQAEDVAASFQAS  251

Query: 246 VLDILLAKTQKALLYPVKTLVVAGGVAANQGLRERLATDISPD-IDVVIPPLRLCGDNA  304
           V+D+L  KT+KA  +Y V+ +++AGGVAAN+GLR  L       + ID+VIPPL LC DNA
Sbjct: 252 VIDVLVTKTKKAAEEYKVRQVLLAGGVAANKGLRTALEEAFFKEPIDLVIPPLSLCTDNA  311

Query: 305 GMIALAAAIEFEKENFASLKLNAKPSLAFES                              335
           MI  AA+I+F+++ FA + LN +PSL  E+
Sbjct: 312 AMIGAAASIKFKQQTFAGMDLNGQPSLELEN                              342
```

A related DNA sequence was identified in *S. pyogenes* <SEQ ID 4927> which encodes the amino acid sequence <SEQ ID 4928>. Analysis of this protein sequence reveals the following:

---
Possible site: 38
>>> Seems to have no N-terminal signal sequence
INTEGRAL     Likelihood = −2.76    Transmembrane 86-102 (85-104)
----- Final Results -----
  bacterial membrane--- Certainty = 0.2105 (Affirmative) <succ>
    bacterial outside --- Certainty = 0.0000 (Not Clear) <succ>
      bacterial cytoplasm --- Certainty = 0.0000 (Not Clear) <succ>
---

The protein has homology with the following sequences in the databases:

```
>GP:BAB04267 GB:AP001508 glycoprotein endopeptidase [Bacillus halodurans]
Identities = 196/330 (59%), Positives = 255/330 (76%), Gaps = 2/330 (0%)
Query:   6 ILAVESSCDETSVAILKNESTLLSNVIASQVESHKRFGGVVPEVASRHHVEVITTCFEDA   65
           ILA+E+SCDETS A+++N +T+LSNV++SQ++SHKRFGGVVPPE+AARHHVE IT  E+A
Sbjct:  12 ILAIETSCDETSAAVIENGTTILSNVVSSQIDSHKRFGGVVPEIASRHHVEQITVIVEEA   71

Query:  66 LQEAGISASDLSAVAVTYGPGLVGALLVGLAAAKAFAWANHLPLIPVNHMAGHLMAAREQ  125
           + EAG+  +DL+AVAVT+GPGLVGALL+G+ AAKA A+A+ LPLI V+H+AGH+ A R
Sbjct:  72 MHEAGVDFADLAAVAVTEGPGLVGALLIGVNAAKAIAFAHQLPLIGVHHIAGHIYANRLL  131

Query: 126 KPLVYPLIALLVSGGHTELVYVPEPGDYHIIGETRDDAVGEAYDKVGRVMGLTYPAGREI  185
           K L  +PL+AL+VSGGHTEL+Y+    G++ +IGETRDDAVGEAYDKV R +GL YP G  I
Sbjct: 132 KELEFPLLALVVSGGHTELIYMENHGEFEVIGETRDDAVGEAYDKVARTLGLPYPGGPHI  191

Query: 186 DQLAHKGQDTYRFPRAMITEDHLEFSFSGLKSAFINLHHNAKQKGDELILEDLCASFQAA  245
           D+LA  G+DT  FPRA +  D +FSFSGLKSA IN  HNAKQ+G+  +  ED+ ASFQA+
Sbjct: 192 DRLAVNGEDTLQFPRAWLEPDSFDFSFSGLKSAVINTLHNAKQRGENVQAEDVAASFQAS  251

Query: 246 VLDILLAKTKKALSRYPAKMLVVAGGVAANQGLRDRLAQEI--THIEVVIPKLRLCGDNA  303
           V+D+L+ KTKKA    Y + +++AGGVAAN+GLR  L +       I++VIP L LC DNA
Sbjct: 252 VIDVLVTKTKKAAEEYKVRQVLLAGGVAANKGLRTALEEAFFKEPIDLVIPPLSLCTDNA  311

Query: 304 GMIALAAAIEYDKQHFANMSLNAKPSLAFD                                333
           MI  AA+I++  +Q FA M LN +PSL  +
Sbjct: 312 AMIGAAASIKFKQQTFAGMDLNGQPSLELE                                341
```

An alignment of the GAS and GBS proteins is shown below.

```
Identities = 288/334(86%), Positives = 313/334 (93%), Gaps = 1/334 (0%)
Query:   1 MKDRYILAVESSCDETSVAILKNDKELLANIIASQVESHKRFGGVVPEVASRHHVEVVTT   60
           M DRYILAVESSCDETSVAILKN+  LL+N+IASQVESHKRFGGVVPEVASRHHVEV+TT
Sbjct:   1 MTDRYILAVESSCDETSVAILKNESTLLSNVIASQVESHKRFGGVVPEVASRHHVEVITT   60
```

```
Query:  61  CFEDALQEAGIVASDLDAVAVTYGPGLVGALLVGMAAAKAFAWANKLPLIPINHMAGHLM  120
            CFEDALQEAGI ASDL AVAVTYGPGLVGALLVG+AAAKAFAWAN LPLIP+NHMAGHLM
Sbjct:  61  CFEDALQEAGISASDLSAVAVTYGPGLVGALLVGLAAAKAFAWANHLPLIPVNHMAGHLM  120

Query: 121  AARDVKELQYPLLALLVSGGHTELVYVSEPGDYKIVGETRDDAVGEAYDKVGRVMGLTYP  180
            AAR+ K L YPL+ALLVSGGHTELVYV EPGDY I+GETRDDAVGEAYDKVGRVMGLTYP
Sbjct: 121  AAREQKPLVYPLIALLVSGGHTELVYVPEPGDYHIIGETRDDAVGEAYDKVGRVMGLTYP  180

Query: 181  AGREIDQLAHKGQDTYHFPRAMIKEDHLEFSFSGLKSAFINLHHNAEQKGEALVLEDLCA  240
            AGREIDQLAHKGQDTYHFPRAMI EDHLEFSFSGLKSAFINLHHNA+QKG+ L+LEDLCA
Sbjct: 181  AGREIDQLAHKGQDTYHFPRAMITEDHLEFSFSGLKSAFINLHHNAKQKGDELILEDLCA  240

Query: 241  SFQAAVLDILLAKTQKALLKYPVKTLVVAGGVAANQGLRERLATDISPDIDVVIPPLRLC  300
            SFQAAVLDILLAKT+KAL +YP K LVVAGGVAANQGLR+RLA +I+  I+VVIP LRLC
Sbjct: 241  SFQAAVLDILLAKTKKALSRYPAKMLVVAGGVAANQGLRDRLAQEIT-HIEVVIPKLRLC  299

Query: 301  GDNAGMIALAAAIEFEKENFASLKLNAKPSLAFE                           334
            GDNAGMIALAAAIE++K++FA++ LNAKPSLAF+
Sbjct: 300  GDNAGMIALAAAIEYDKQHFANMSLNAKPSLAFD                           333
```

Figure 170:
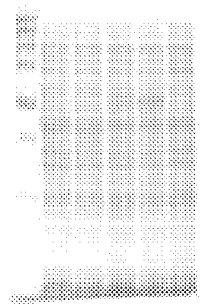

SEQ ID 4926 (GBS371) was expressed in *E. coli* as a His-fusion product. SDS-PAGE analysis of total cell extract is shown in FIG. 64 (lane 7; MW 41 kDa), in FIG. 170 (lane 4 & 5; MW 55 kDa) and in FIG. 239 (lane 6; MW 55 kDa). It was also expressed in *E. coli* as a GST-fusion product. SDS-PAGE analysis of total cell extract is shown in FIG. 69 (lane 7; MW 65 kDa).

Based on this analysis, it was predicted that these proteins and their epitopes could be useful antigens for vaccines or diagnostics.

Example 1594

A DNA sequence (GBSx1688) was identified in *S. agalactiae* <SEQ ID 4929> which encodes the amino acid sequence <SEQ ID 4930>. Analysis of this protein sequence reveals the following:

---

Possible site: 33
>>> Seems to have no N-terminal signal sequence
----- Final Results -----
   bacterial cytoplasm --- Certainty = 0.1027 (Affirmative) <succ>
      bacterial membrane --- Certainty = 0.0000 (Not Clear) <succ>
      bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1595

A DNA sequence (GBSx1689) was identified in *S. agalactiae* <SEQ ID 4931> which encodes the amino acid sequence <SEQ ID 4932>. Analysis of this protein sequence reveals the following:

---

Possible site: 20
>>> Seems to have no N-terminal signal sequence
----- Final Results -----
   bacterial cytoplasm --- Certainty = 0.1307 (Affirmative) <succ>
      bacterial membrane --- Certainty = 0.0000 (Not Clear) <succ>
      bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1596

A DNA sequence (GBSx1690) was identified in *S. agalactiae* <SEQ ID 4933> which encodes the amino acid sequence <SEQ ID 4934>. This protein is predicted to be L4171-60 protein. Analysis of this protein sequence reveals the following:

---

Possible site: 36
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
      bacterial cytoplasm --- Certainty = 0.0000 (Not Clear) <succ>

---

A related GBS nucleic acid sequence <SEQ ID 10135> which encodes amino acid sequence <SEQ ID 1,0136> was also identified.

The protein has homology with the following sequences in the GENPEPT database.

```
>GP:AAC24656 GB:AE001274 L4171.5 [Leishmania major]
 Identities = 118/282 (41%), Positives = 167/282 (58%), Gaps = 4/282 (1%)
 Query:   2  GGTQTNQVVISSMLASYEGVIAAETGHVSSHEAGAIEFSGHKVLTLPSHNGKLLASEVAT  61
```

-continued

```
                  GGTQTN +  S   L   +E VIA +  GH+S+HE GAIE +GHKV+T P   +GKL  ++
Sbjct:   74   GGTQTNLIACSLALRPWEAVIATQLGHISTHETGAIEATGHKVVTAPCPDGKLRVAD---   130

Query:   62   YIETFYADGNYQHMVFPGMVYISHPTEYGTLYSKAELEELSKICKHYQIPLFIDGARLGY   121
              IE+    +  +HMV P +VYIS+ TE GT Y+K ELE++S  CK + + LF+DGARL
Sbjct:  131   -IESALHENRSEHMVIPKLVYISNTTEVGTQYTKQELEDISASCKEHGLYLFLDGARLAS   189

Query:  122   GLAAKDTDVDFPTIAALSDVFYIGGTKMGALAGEAVVFTKKNRPKQFTTIVKQHGALLAK   181
              L++ D+      IA L+D+FYIG TK G + GEA++             ++KQ GAL+AK
Sbjct:  190   ALSSPVNDLTLADIARLTDMFYIGATKAGGMFGEALIILNDALKPNARHLIKQRGALMAK   249

Query:  182   GRLLGLAFDRFFTDNLYLKIGKHAIDLAEELKIILEEKGYSFYLKSPTNQQFIIVENTKL   241
              G LLG+ F+      DNL+ ++G H+  +A  LK  LE  G       S +NQ F I+ENT +
Sbjct:  250   GWLLGIQFEVLMKDNLFFELGAHSNKMAAILKAGLEACGIRLAWPSASNQLFPILENTMI   309

Query:  242   ADLAKNVAYSFWEKYDDHHTVIRLATSWSTSREDVTALRNVL                   283
              A+L   +      E    D   ++RL TSW+T  ++        VL
Sbjct:  310   AELNNDFDMYTVEPLKDGTCIMRLCTSWATEEKECHRFVEVL                    351
```

No corresponding DNA sequence was identified in *S. pyogenes*.

SEQ ID 4934 (GBS648) was expressed in *E. coli* as a GST-fusion product. SDS-PAGE analysis of total cell extract is shown in FIG. 131 (lane 8-10; MW 60 kDa) and in FIG. 186 (lane 6; MW 60 kDa). It was also expressed in *E. coli* as a His-fusion product. SDS-PAGE analysis of total cell extract is shown in FIG. 131 (lane 12; MW 35 kDa), in FIG. 140 (lane 10; MW 35 kDa) and in FIG. 178 (lane 7; MW 35 kDa).

Purified GBS648-GST is shown in FIG. 243, lane 6; purified GBS648-His is shown in FIG. 229, lane 7.

Based on this analysis, it was predicted that this protein and its epitopes, could be useful antigens for vaccines or diagnostics.

Example 1597

A DNA sequence (GBSx1691) was identified in *S. agalactiae* <SEQ ID 4935> which encodes the amino acid sequence <SEQ ID 4936>. Analysis of this protein sequence reveals the following:

Possible site: 13
>>> Seems to have no N-terminal signal sequence
----- Final Results -----
  bacterial cytoplasm --- Certainty = 0.2279 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1598

A DNA sequence (GBSx1692) was identified in *S. agalactiae* <SEQ ID 4937> which encodes the amino acid sequence <SEQ ID 4938>. This protein is predicted to be ribosomal protein S14 (rpsN). Analysis of this protein sequence reveals the following:

Possible site: 60
>>> Seems to have no N-terminal signal sequence
----- Final Results -----
  bacterial cytoplasm --- Certainty = 0.3848 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:CAB12716 GB:Z99108 similar to ribosomal protein S14 [Bacillus subtilis]
Identities = 67/89 (75%), Positives = 76/89 (85%)
Query:   1   MAKKSKIAKFQKQQKLVEQYAELRRELKEKGDYEALRKLPKDSNPNRLKNRDLIDGRPHA   60
             MAKKSK+AK  K+Q+LVEQYA +RRELKEKGDYEAL KLP+DS P RL NR ++ GRP A
Sbjct:   1   MAKKSKVAKELKRQQLVEQYAGIRRELKEKGDYEALSKLPRDSAPGRLHNRCMVTGRPRA   60

Query:  61   YMRKFGMSRINFRNLAYKGQIPGIKKASW                                 89
             YMRKF MSRI FR LA+KGQIPG+KKASW
Sbjct:  61   YMRKFKMSRIAFRELAHKGQIPGVKKASW                                 89
```

A related DNA sequence was identified in *S. pyogenes* <SEQ ID 4939> which encodes the amino acid sequence <SEQ ID 4940>. Analysis of this protein sequence reveals the following:

Possible site: 31
>>> Seems to have no N-terminal signal sequence
----- Final Results -----
  bacterial cytoplasm --- Certainty = 0.3799 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 73/89 (82%), Positives = 85/89 (95%)
Query:   1  MAKKSKIAKFQKQQKLVEQYAELRRELKEKGDYEALRKLPKDSNPNRLKNRDLIDGRPHA    60
            MAKKSKIAK+QKQ +L+EQYA+LRR+LK KGDYE+LRKLP+DSNPNRLKNRD IDGRPHA
Sbjct:   1  MAKKSKIAKYQKQLQLIEQYADLRRDLKAKGDYESLRKLPRDSNPNRLKNRDKIDGRPHA    60

Query:  61  YMRKFGMSRINFRNLAYKGQIPGIKKASW    89
            YMRKFG+SRINFR+LA+KGQ+PG+ KASW
Sbjct:  61  YMRKFGVSRINFRDLAHKGQLPGVTKASW    89
```

Based on this analysis, it was predicted that these proteins and their epitopes could be useful antigens for vaccines or diagnostics.

Example 1599

A DNA sequence (GBSx1693) was identified in *S. agalactiae* <SEQ ID 4941> which encodes the amino acid sequence <SEQ ID 4942>. Analysis of this protein sequence reveals the following:

---

Possible site: 58
>>> Seems to have no N-terminal signal sequence
----- Final Results -----
    bacterial cytoplasm --- Certainty = 0.5183 (Affirmative) <succ>
    bacterial membrane --- Certainty = 0.0000 (Not Clear) <succ>
    bacterial outside --- Certainty = 0.0000 (Not Clear) <succ>

---

The protein has homology with the following sequences in the GENPEPT database.

```
>GP:CAB95931 GB:AL359989 galactose-1-phosphate uridylyltransferase
[Streptomyces coelicolor A3(2)]
Identities = 31/105 (29%), Positives = 51/105 (48%), Gaps = 4/105 (3%)
Query:  27  DKCPFC--DKSQLGKILDVKDDMIWVENKYPTL--EETYQTLVIESNDHNGDISVYSESK    82
            D+CP C   D  +L +I D   D++  EN++P+L        +V  ++DH+     SE +
Sbjct:  68  DQCPLCPSDGERLSEIPDSAYDVVVFENRFPSLAGDSGRCEVVCFTSDHDASFADLSEEQ   127

Query:  83  MRQLLDYLLSKWQLMEESGHYRSVVLYRNFGPLSGGSLRHPHSQI   127
            R +LD  +   +        V  + N G    G +L HPH QI
Sbjct: 128  ARLVLDAWTDRTSELSHLPSVEQVFCFENRGAEIGVTLGHPHGQI   172
```

No corresponding DNA sequence was identified in *S. pyogenes*.

Example 1600

A DNA sequence (GBSx1694) was identified in *S. agalactiae* <SEQ ID 4943> which encodes the amino acid sequence <SEQ ID 4944>. Analysis of this protein sequence reveals the following:

---

Possible site: 18
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>

---

A related GBS nucleic acid sequence <SEQ ID 10133> which encodes amino acid sequence <SEQ ID 10134> was also identified.

Based on this analysis, it was predicted that this protein and its epitopes, could be useful antigens for vaccines or diagnostics.

The protein has homology with the following sequences in the GENPEPT database.

```
>GP:BAB06998 GB:AP001518 unknown conserved protein [Bacillus halodurans]
Identities = 186/410 (45%), Positives = 258/410 (62%), Gaps = 27/410 (6%)
Query:   4  YDTIIIGGGPAGMMAAISSNFYGNKTLLIEKNKRLGKKLAGTGGGRCNVTNNGNLDELLA    63
            ++ I+IGGGPAG+MA++S+  +G + LL++K  +LG+KLA +GGGRCNVTN   LDEL+A
Sbjct:   2  HEVIVIGGGPAGLMASVSAAEHGARVLLLDKGDKLGRKLAISGGGRCNVTNRMPLDELIA    61

Query:  64  GIPGNGRFLYSVFSQFDNHDIINFFQDNGVTLKEEDHGRMFPTTDKSRTIINALENKIKE   123
            IPGNGRF+YS FS F+N DII FF+  G+ LKEED GRMFP +DK+ T++  L  +I +
Sbjct:  62  HIPGRGREMYSPFSVFNNEDIIRFFERLGIALKEEDRGRMFPVSDKATTVVQTLLKRIND   121

Query: 124  LGGQIMTDTEVVSVK-KIGDSFYIKTKDTQFASDK-LIVTTGGKSYPSTGSTGFGHDIAR   181
            LG  + T+T V S++     G    ++ K+ +    K +IV TGG+S P TGSTG  +A+
Sbjct: 122  LGVTVRTNTAVASLEYDDGRIAMVQLKNGERLKTKTVIVATGGQSVPHTGSTGDAYPWAK   181

Query: 182  HFKLEVTDMEAAESPLLTDFP---HKKLQGISLDDVTLSF----EKHIITH--DLLFTHF   232
                 +T++     E P+ +  P    KKLQG+SL D+ LS         K I TH  D++FTHF
Sbjct: 182  AAGHTITELYPTEVPITSAEPFIQEKKLQGLSLRDIELSVYAPNGKQIKTHDGDMIFTHF   241

Query: 233  GLSGPAALRISSFVKGGETIY--------LDVLPNISVKEL-EIHFQN---EREKSLKNA   280
            GLSGPAALR S +V       Y        +D+ P I  + L +     QN    E +K+LK
Sbjct: 242  GLSGPAALRCSQYVVKALKKYKQPTIEMRIDLRPTIPAEALFQETIQNIKAEPKKALKTV   301

Query: 281  LKILLPERLAEFYAEDL--PEKVKQVSVKD--LEMLIQKLKKLPILVTGKMSLAKSFVTK   336
            L+  + PER ++  E L      SV+   +   ++Q+LK     V G +S+  K+FVT
Sbjct: 302  LRGIAPERFLQYIYERLRIDSNLPCASVRHEVIREIVQQLKSFSFHVNGTLSIEKAFVTG   361
```

```
Query: 337  GGVDLKEINPKTLESKKVAGLHFAGEVLDINAHTGGFNITSALCTGWVAG            386
            GGV +KEI PKT+ SKK AGL F GEVLDI+ +TGG+NIT A  TG+ AG
Sbjct: 362  GGVSVKEIEPKTMHSKKKAGLFFCGEVLDIHGYTGGYNITCAFSTGYTAG            411
```

A related DNA sequence was identified in *S. pyogenes* <SEQ ID 4945> which encodes the amino acid sequence <SEQ ID 4946>. Analysis of this protein sequence reveals the following:

```
Possible site: 23
 >>> Seems to have no N-terminal signal sequence
 ----- Final Results -----
     bacterial cytoplasm --- Certainty = 0.0448 (Affirmative) <succ>
     bacterial membrane --- Certainty = 0.0000 (Not Clear) <succ>
     bacterial outside --- Certainty = 0.0000 (Not Clear) <succ>
```

An alignment of the GAS and GBS proteins is shown below.

```
Identities = 308/386 (79%), Positives = 344/386 (88%)
Query:   1  MKHYDTIIIGGGPAGMMAAISSNFYGNKTLLIEKNKRLGKKLAGTGGGRCNVTNNGNLDE   60
            M  YDTIIIGGGPAGMMAAISS++YG KTLLIEKN+RLGKKLAGTGGGRCNVTN+GNLD
Sbjct:   1  MTQYDTIIIGGGPAGMMAAISSSYYGYKTLLIEKNRRLGKKLAGTGGGRCNVTNSGNLDV   60

Query:  61  LLAGIPGNGRFLYSVFSQFDNHDIINFFQDNGVTLKEEDHGRMFPTTDKSRTIINALENK  120
            L+AGIPGNGRFLYSVFSQFDNHDII FF++NGV LKEEDHGRMFPTTDKSRTII+ALE K
Sbjct:  61  LMAGIPGNGRFLYSVFSQFDNHDIIAFFEENGVELKEEDHGRMFPTTDKSRTIIDALEKK  120

Query: 121  IKELGGQIMTDTEVVSVKKIGDSFYIKTKDTQFASDKLIVTTGGKSYPSTGSTGFGHDIA  180
            IK LGGQ++T TEVVSVKK D FT+K+ D  F    KLIVTTGGKSYPSTGSTGFGHDIA
Sbjct: 121  IKALGGQVLTSTEVVSVKKQDDLFYLKSADQTFTCQKLIVTTGGKSYPSTGSTGFGHDIA  180

Query: 181  RHFKLEVTDMEAAESPLLTDFPHKKLQGISLDDVTLSFEKHIITHDLLFTHFGLSGPAAL  240
            RHFKL VTD+EAAESPLLTDFPHK LQGISLDDVTLS++KH+ITHDLLFTHFGLSGPAAL
Sbjct: 181  RHFKLTVTDLEAAESPLLTDFPHKVLQGISLDDVTLSYDKHVITHDLLFTHFGLSGPAAL  240

Query: 241  RISSFVKGGETIYLDVLPNISVKELEIHFQNEREKSLKNALKILLPERLAEFYAEDLPEK  300
            R+SSFVKGGE   LD LP++S  +L +  ++R+K++KNALK LLPER+A+F +ED PEK
Sbjct: 241  RLSSFVKGGEIAELDFLPHLSTDDLTAYLSDQRDKNIKNALKGLLPERVADFLSEDYPEK  300

Query: 301  VKQVSVKDLEMLIQKLKKLPILVTGKMSLAKSFVTKGGVDLKEINPKTLESKKVAGLHFA  360
            VKQ+S K  + L+ KLK L I +TGKMSLAKSFVTKGGVDLKEINPKTLESKKV GL+FA
Sbjct: 301  VKQLSPKQEKELLDKLKHLQIPITGKMSLAKSFVTKGGVDLKEINPKTLESKKVPGLYFA  360

Query: 361  GEVLDINAHTGGFNITSALCTGWVAG                                   386
            GEVLDINAHTGGFNITSALC+GW+AG
Sbjct: 361  GEVLDINAHTGGFNITSALCSGWIAG                                   386
```

SEQ ID 4944 (GBS196) was expressed in *E. coli* as a His-fusion product. SDS-PAGE analysis of total cell extract is shown in FIG. 26 (lane 3; MW 44.5 kDa). It was also expressed in *E. coli* as a GST-fusion product. SDS-PAGE analysis of total cell extract is shown in FIG. 37 (lane 4; MW 69.5 kDa).

Based on this analysis, it was predicted that these proteins and their epitopes could be useful antigens for vaccines or diagnostics.

Example 1601

A DNA sequence (GBSx1695) was identified in *S. agalactiae* <SEQ ID 4947> which encodes the amino acid sequence <SEQ ID 4948>. Analysis of this protein sequence reveals the following:

```
Possible site: 36
 >>> Seems to have no N-terminal signal sequence
 ----- Final Results -----
     bacterial cytoplasm --- Certainty = 0.1550 (Affirmative) <succ>
```

-continued

```
     bacterial membrane --- Certainty = 0.0000 (Not Clear) <succ>
     bacterial outside --- Certainty = 0.0000 (Not Clear) <succ>
```

A related GBS nucleic acid sequence <SEQ ID 10131> which encodes amino acid sequence <SEQ ID 10132> was also identified.

The protein has homology with the following sequences in the GENPEPT database.

```
>GP:CAA73267 GB:Y12736 orfX [Lactococcus lactis subsp. cremoris]
Identities = 51/173 (29%), Positives = 87/173 (49%), Gaps = 20/173 (11%)
Query:  19  KTVSELAEILGVSRQAMNNRV-KTLPEECVEK---NSKGVTVVNRDGLIKLEEIYKKTIL   74
            KT+ ELA+ LGVS+Q + N++ K    E+ V+          V+N  G      + KKT+
Sbjct:   6  KTIKELADELGVSKQTIRNKIDKDFREKFVQTIKIKGENTLVINNAGY----SLLKKTLQ   61

Query:  75  EEEPIDEEASRRELLEILVDEKNTEITRLYEQLKAKDIQIASKDEQLHVKDIQIAEKDKQ  134
             +     + ++ + +          I  L EQL  K+ Q++ KD+QL   KD QI++
Sbjct:  62  NDTAQTAKTLQNDTAQTKL------ICFLEEQLDKKEQQLSVKDKQLENKDTQISQMQNL  115
```

```
                                       -continued
Query: 135  LDQQQQLTLTAMEDTQRLQLELNEAKA------EVEEIQEAKEEKIQELEAVK        181
            LDQQQ+L L   +  +  + E+NE KA        ++++    + E  +E+E +K
Sbjct: 116  LDQQQRLALQDKKLLEEYKSEINELKALKMPREDMKDGSSIRGEAQEEIERLK        168
```

A related DNA sequence was identified in *S. pyogenes* <SEQ ID 4949> which encodes the amino acid sequence <SEQ ID 4950>. Analysis of this protein sequence reveals the following:

---
Possible site: 14
>>> Seems to have no N-terminal signal sequence
----- Final Results -----
   bacterial cytoplasm --- Certainty = 0.3951 (Affirmative) <succ>
   bacterial membrane --- Certainty = 0.0000 (Not Clear) <succ>
   bacterial outside --- Certainty = 0.0000 (Not Clear) <succ>
---

An alignment of the GAS and GBS proteins is shown below.

```
Identities = 132/194 (68%), Positives = 154/194 (79%), Gaps = 4/194 (2%)
Query:   1  MIFFYKKI---STKEEVMTVEKTVSELAEILGVSRQAMNNRVKTLPEECVEKNSKGVTVV    57
            M+ F  +I    S KEE M +EKTVSELA+ILGVSRQA+NNRVK+LPEE  ++KN KGVTVV
Sbjct:   1  MVLFLIRIFSDSDKEENMGIEKTVSELADILGVSRQAVNNRVKSLPEEDLKNEKGVTVV    60

Query:  58  NRDGLIKLEEIYKKTILEEEPIDEEASRRELLEILVDEKNTEITRLYEQLKAKDIQIASK   117
             R GL+KLEEIYKKTI ++EPI EE   +RELLEILVDEKNTEITRLYEQLKAKD Q+ASK
Sbjct:  61  KRSGLVKLEEIYKKTIFDDEPISEETKQRELLEILVDEKNTEITRLYEQLKAKDAQLASK   120

Query: 118  DEQLHVKDIQIAEKDKQLDQQQQLTLTAMEDTQRLQLELNEAKAEVEEIQEAKEEKIQEL   177
            DEQ+ VKD+ QIAEKDKQLDQQQQLT  AM D + L+LEL EAKAE + +  + E++Q
Sbjct: 121  DEQMRVKDVQIAEKDKQLDQQQQLTAKAMADKETLKLELEEAKAEANQAR-LQVEEVQAE   179

Query: 178  EAVKKSFFGRFFNK                                               191
               KK FF R F K
Sbjct: 180  VGPKKGFFTRLFAK                                               193
```

Based on this analysis, it was predicted that these proteins and their epitopes could be useful antigens for vaccines or diagnostics.

Example 1602

A DNA sequence (GBSx1697) was identified in *S. agalactiae* <SEQ ID 4951> which encodes the amino acid sequence <SEQ ID 4952>. Analysis of this protein sequence reveals the following:

---
Possible site: 53
>>> Seems to have no N-terminal signal sequence
----- Final Results -----
   bacterial cytoplasm --- Certainty = 0.2157 (Affirmative) <succ>
   bacterial membrane --- Certainty = 0.0000 (Not Clear) <succ>
   bacterial outside --- Certainty = 0.0000 (Not Clear) <succ>
---

The protein has homology with the following sequences in the GENPEPT database.

```
>GP:BAB06137 GB:AP001515 DNA polymerase III (alpha subunit)
[Bacillus halodurans]

Identities = 31/87 (35%), Positives = 52/87 (59%), Gaps = 1/87 (1%)
Query:  13  EYIAFDLEFNTVGE-HSHIIQVSAVKYSNHQEIALFDTYVHTKVPLQSFINGLTGITARD    71
            E++ FD+E   +     ++ II+++AVK  N + I F+ +      PL + I  LTGIT Sbjct: 418  EFVVFDVETTGLSAVYNKIIELAAVEVKNGEIIDRFERFADPHEPLTNTIIELTGITDDM   477

Query:  72  IIGAPKIEIVLTDFQSFVGDTPLIGYN                                   98
             + G P++E VL +F +F+GD  L+ +N
Sbjct: 478  LKGQPEVEQVLNEFHAFIGDAVLVAHN                                  504
```

A related DNA sequence was identified in *S. pyogenes* <SEQ ID 4953> which encodes the amino acid sequence <SEQ ID 4954>. Analysis of this protein sequence reveals the following:

```
Possible site: 29
>>> Seems to have no N-terminal signal sequence
----- Final Results -----
   bacterial cytoplasm --- Certainty = 0.3427 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below.

```
Identities = 136/200 (68%), Positives = 159/200 (79%)
Query:   3  FLGEIMKQLQEYIAFDLEFNTVGEHSHIIQVSAVKYSNHQEIALFDTYVHTKVPLQSFIN    62
            FL E MK L  YIAFDLEFNTV + SHIIQVSAVKY +H+E+  FDTYV+T VPLQSFIN
Sbjct:   9  FLEENMKHLDTYIAFDLEFNTVNDVSHIIQVSAVKYDHHKEVDSFDTYVYTDVPLQSFIN    68

Query:  63  GLTGITARDIIGAPKIEIVLIDFQSFVGDTPLIGYNGYKSDLPLLVENGLDLTSQYQVDL   122
            GLTGIT+  I  PK+E V+  F++FVG+ PLIGYN KSDLP+L ENGLDL QYQ+DL
Sbjct:  69  GLTGITSDKIAAEPKVEEVMAAFKNFVGELPLIGYNAQKSDLPILAENGLDLRDQYQIDL   128

Query: 123  YDEAFVRRSTDLNGIVNLKLTTVADFLGIKGKAHNSLEDARMTARVYEKFLDLDENKIYL   182
            +DEA+ RRS DLNGI NL+L TVA FLGIKG+ HNSLEDARMTA +Y+ FL+ D NK YL
Sbjct: 129  FDEAYDRRSADLNGIANLRLQTVATFLGIKGRGHNSLEDARMTAVIYKSFLETDTNKAYL   188

Query: 183  KQQKEVAVDSPFATLGNLFD                                          202
            QQ+EV  D+PFA LG+ FD
Sbjct: 189  SQQEEVTTDNPFAALGDFFD                                          208
```

Based on this analysis, it was predicted that these proteins and their epitopes could be useful antigens for vaccines or diagnostics.

Example 1603

A DNA sequence (GBSx1698) was identified in *S. agalactiae* <SEQ ID 4955> which encodes the amino acid sequence <SEQ ID 4956>. Analysis of this protein sequence reveals the following:

```
Possible site 46
>>> Seems to have no N-terminal signal sequence
INTEGRAL    Likelihood = -12.10   Transmembrane 143-159 (136-166)
INTEGRAL    Likelihood =  -4.73   Transmembrane 169-185 (168-188)
----- Final Results -----
   bacterial membrane --- Certainty = 0.5840 (Affirmative) <succ>
   bacterial outside --- Certainty = 0.0000 (Not Clear) <succ>
   bacterial cytoplasm --- Certainty = 0.0000 (Not Clear) <succ>
```

The protein has homology with the following sequences in the GENPEPT database.

There is also homology to SEQ ID 1712.

SEQ ID 4956 (GBS372) was expressed in *E. coli* as a GST-fusion product. SDS-PAGE analysis of total cell extract is shown in FIG. 69 (lane 8; MW 55 kDa).

GBS372-GST was purified as shown in FIG. 215, lane 8.

Based on this analysis, it was predicted that this protein and its epitopes, could be useful antigens for vaccines or diagnostics.

Example 1604

A DNA sequence (GBSx1699) was identified in *S. agalactiae* <SEQ ID 4957> which encodes the amino acid sequence <SEQ ID 4958>. This protein is predicted to be cyclopropane-fatty-acyl-phospholipid synthase (mma2). Analysis of this protein sequence reveals the following:

```
Possible site: 53
>>> Seems to have no N-terminal signal sequence
----- Final Results -----
   bacterial cytoplasm --- Certainty = 0.3145 (Affirmative) <succ>
   bacterial membrane --- Certainty = 0.0000 (Not Clear) <succ>
   bacterial outside --- Certainty = 0.0000 (Not Clear) <succ>
```

The protein has homology with the following sequences in the GENPEPT database.

```
>GP:CAB42766 GB:AL049841 transcriptional regulator
[Streptomyces coelicolor A3(2)]
Identities = 46/141 (32%), Positives = 71/141 (49%), Gaps = 11/141 (7%)
Query:   5  YSTGDLAKEAGVTVRTVQYYDKRGILSPSELSEGGRRVYSIADLEKLRQIIYLRDLDFSI    64
            YS G +A  AGVTVRT+ +YD  G+L PSE S   G R YS ADL++L+QI++ R+L F+
Sbjct:   3  YSVGQVAGFAGVTVRTLHHYDDIGLLVPSERSHAGHRRYSDADLDRLQQILFYRELGFPL    62

Query:  65  DNIKNLFTEDNASQILELFLQVQIRELRL--------AIDSKKDKLDKAVNLLKTVEKQD   116
            D + L + A     L Q ++  R+         A++  +  +NL     ++
Sbjct:  63  DEVAALLDDPAADPRAHLRRQHELLSARIGKLQKMAANVEQAMEARSMGINL---TPEEK   119

Query: 117  SKTLGYLSDIVLMEENKRKWG                                         137
             +  G        EE + +WG
Sbjct: 120  FEVFGDFDPDQYEEEVRERWG                                         140
```

```
>GP:AAD07482 GB:AE000557 cyclopropane fatty acid synthase (cfa)
[Helicobacter pylori 26695]
Identities = 167/397 (42%), Positives = 254/397 (63%), Gaps = 14/397 (3%)
Query:   2  VMDSLIIKQLIKSTFDIPLQVTYPNGNIETYNGSNPHVKLKLNKNFSVSELSKDPSIVLG    61
            ++   ++K + K  +    QV + + ++        +P   LK+++    S++ KD S+ +
Sbjct:   1  MISKFLLKSMFKQWKNGDYQVVFWDNSVYRNGEHSPKFTLKIHRPLKFSDIKKDMSLTIA    60

Query:  62  EAVMDGDIEIYGSIQELILSAY-RCGDSFLRNSKFSKLIPKQFHDKKHSKSDIQKHYDIG   120
            EA MDG I+I GS+ E++ S Y +      L    +K I K   +     S+I KHYD+G
Sbjct:  61  EAYMDGVIDIEGSMDEVMHSLYLQTNYEHLHKHDNAKAIQKPIKES----SNISKHYDLG   116

Query: 121  NDFYKLWLDDTMTYSCAYFKHENDSLEQAQLNKVHHILNKLNAQPGGKLLDIGCGWGTLI   180
            NDFY +WLD+T++YSCAYFK ++D+L  AQL K+ H L KL+ +PG KLLDIGCGWG L
Sbjct: 117  NDFYSIWLDETLSYSCAYFKKDDDTLHAAQLQKLDHTLKKLHLKPGEKLLLDIGCGWGYLS   176

Query: 181  ITAAKEYGLNATGITLSEEQASFITKRIKEEGLENKVTVLIKDYRDI---RETYDYITSV   237
            + AA+EYG    GIT+S EQ    KR++E GLE+KVT+ + +Y+D+      +D + SV
Sbjct: 177  VKAAQEYGAEVMGITISSEQYKQANKRVQELGLEDKVTIKLLNYQDLDGRLYRFDKVVSV   236

Query: 238  GMFEHVGKENLSQYFQTISKRLNINGLALIHGITGQVGGNHGSGTNSWINKYIFPGGYIP   297
            GMFEHVGK+NL  YF+ + + L   G+ L+H i    G     TN+W++KYIFPGGY+P
Sbjct: 237  GMFEHVGKDNLPFYFKKVKEVLKRGGMFLLHSILCCFEGK----TNAWVDKYIFPGGYLP   292

Query: 298  RLTENLNHIASAGLQIADLEPLRRHYQKTLELWTKNFHNALPEVQK-THDKRFINMWDLY   356
              L E ++ ++      +    E LR HY KTL++W  NF++ L +V++ ++D+RFI MWDLY
Sbjct: 293  SLREVMSVMSECDFHLLMAESLRIHYAKTLDIWRNNFNUNLDQVKRLSYDERFIRMWDLY   352

Query: 357  LQSCAASFESGNIDIFQYLLSKGVSKDTMPMTRDYMY                         393
            L++CA++F  G+ D+FQ LL+   V   +T P+T++Y+Y
Sbjct: 353  LRTCASAFRVGSADLFQLLLTNSVD-NTFPLTKEYIY                         388
```

No corresponding DNA sequence was identified in *S. pyogenes*.

Based on this analysis, it was predicted that this protein and its epitopes, could be useful antigens for vaccines or diagnostics.

Example 1605

A DNA sequence (GBSx1700) was identified in *S. agalactiae* <SEQ ID 4959> which encodes the amino acid sequence <SEQ ID 4960>. Analysis of this protein sequence reveals the following:

Possible site: 35
>>> Seems to have no N-terminal signal sequence
----- Final Results -----
  bacterial cytoplasm --- Certainty = 0.4903 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:CAB11796 GB:Z99104 similar to hypothetical proteins [Bacillus subtilis]
Identities = 44/97 (45%), Positives = 60/97 (61%)
Query:   1  MMNMQNMMRQAQKLQKQMEQKQADLAASQFTGKSAQELVTVTFTGDKKLISIDYKEAVVD    60
            M NMQ MM+Q QK+QK M + Q +LA      G +     +VTV  G K+++ +  KE VVD
Sbjct:   5  MGNMQKMMKQMQKMQKDMAKAQEELAEKVVEGTAGGGMVTVKANGQKEILDVIIKEEVVD    64

Query:  61  PEDIETLQDMTTQAINDALSQVDDATKKIMGAFAGKM                         97
            PEDI+ LQD+   A N+AL +VD+ T + MG F   M
Sbjct:  65  PEDIDMLQDLVLAATNEALKKVDEITNETMGQFTKGM                        101
```

A related DNA sequence was identified in *S. pyogenes* <SEQ ID 4961> which encodes the amino acid sequence <SEQ ID 4962>. Analysis of this protein sequence reveals the following:

```
Possible site: 35
>>> Seems to have no N-terminal signal sequence
----- Final Results -----
    bacterial cytoplasm --- Certainty = 0.4451 (Affirmative) <succ>
    bacterial membrane --- Certainty = 0.0000 (Not Clear) <succ>
      bacterial outside --- Certainty = 0.0000 (Not Clear) <succ>
```

An alignment of the GAS and GBS proteins is shown below.

```
Identities = 84/99 (84%), Positives = 94/99 (94%)
Query:  1   MMNMQNMMRQAQKLQKQMEQKQADLAASQFTGKSAQELVTVTFTGDKKLISIDYKEAVVD   60
            MMNMQNMM+QAQKLQKQMEQKQADLAA QFTGKSAQ+LVT TFTGDKKL+ ID+KEAVVD
Sbjct:  1   MMNMQNMMKQAQKLQKQMEQKQADLAAMQFTGKSAQDLVTATFTGDKKLVGIDFKEAVVD   60

Query: 61   PEDIETLQDMTTQAINDALSQVDDATKKIMGAFAGKMPF   99
            PED+ETLQDMTTQAINDAL+Q+D+ TKK +GAFAGK+PF
Sbjct: 61   PEDVETLQDMTTQAINDALTQIDETTKKTLGAFAGKLPF   99
```

Based on this analysis, it was predicted that these proteins and their epitopes could be useful antigens for vaccines or diagnostics.

Example 1606

A DNA sequence (GBSx1701) was identified in S. agalactiae <SEQ ID 4963> which encodes the amino acid sequence <SEQ ID 4964>. Analysis of this protein sequence reveals the following:

```
Possible site: 17
>>> Seems to have no N-terminal signal sequence
----- Final Results -----
    bacterial cytoplasm --- Certainty = 0.3963 (Affirmative) <succ>
    bacterial membrane --- Certainty = 0.0000 (Not Clear) <succ>
      bacterial outside --- Certainty = 0.0000 (Not Clear) <succ>
```

The protein has no significant homology with any sequences in the GENPEPT database.

No corresponding DNA sequence was identified in S. pyogenes.

Based on this analysis, it was predicted that this protein and its epitopes could be useful antigens for vaccines or diagnostics.

Example 1607

A DNA sequence (GBSx1702) was identified in S. agalactiae <SEQ ID 4965> which encodes the amino acid sequence <SEQ ID 4966>, Analysis of this protein sequence reveals the following:

```
Possible site: 48
>>> Seems to have no N-terminal signal sequence
INTEGRAL    Likelihood = -2.76    Transmembrane 21-37 (19-39)
----- Final Results -----
    bacterial membrane --- Certainty = 0.2105 (Affirmative) <succ>
      bacterial outside --- Certainty = 0.0000 (Not Clear) <succ>
    bacterial cytoplasm --- Certainty = 0.0000 (Not Clear) <succ>
```

A related GBS nucleic acid sequence <SEQ ID 10129> which encodes amino acid sequence <SEQ ID 10130> was also identified.

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1608

A DNA sequence (GBSx1703) was identified in S. agalactiae <SEQ ID 4967> which encodes the amino acid sequence <SEQ ID 4968>. Analysis of this protein sequence reveals the following:

```
Possible site: 36
>>> Seems to have no N-terminal signal sequence
----- Final Results -----
    bacterial cytoplasm --- Certainty = 0.1783 (Affirmative) <succ>
    bacterial membrane --- Certainty = 0.0000 (Not Clear) <succ>
      bacterial outside --- Certainty = 0.0000 (Not Clear) <succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1609

A DNA sequence (GBSx1704) was identified in S. agalactiae <SEQ ID 4969> which encodes the amino acid sequence <SEQ ID 4970>. This protein is predicted to be probable 1,4-dihydroxy-2-naphthoate octaprenyltransferase. Analysis of this protein sequence reveals the following:

```
Possible site: 32
>>> Seems to have no N-terminal signal sequence
INTEGRAL    Likelihood = -8.76    Transmembrane 239-255 (219-260)
INTEGRAL    Likelihood = -8.33    Transmembrane 221-237 (219-238)
INTEGRAL    Likelihood = -6.74    Transmembrane 91-107 (89-113)
INTEGRAL    Likelihood = -6.32    Transmembrane 39-55 (35-59)
INTEGRAL    Likelihood = -3.77    Transmembrane 111-127 (111-132)
INTEGRAL    Likelihood = -2.97    Transmembrane 144-160 (143-161)
INTEGRAL    Likelihood = -1.28    Transmembrane 275-291 (275-291)
INTEGRAL    Likelihood = -0.59    Transmembrane 177-193 (177-193)
----- Final Results -----
    bacterial membrane --- Certainty = 0.4503 (Affirmative) <succ>
      bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:CAB15875 GB:Z99123 alternate gene name: ipa-6d-similar to
quinone biosynthesis [Bacillus subtilis]
Identities = 75/290 (25%), Positives = 139/290 (47%), Gaps = 15/290 (5%)
Query:   5 IFLELVEMKAKTASVLPFLIGLCFSAYYYNSVHPVYVGLFFVAMFLFNMFVDIWNNYNDY    64
             I  +L     TAS +P L+G   + +Y      +++ F +++  +  +++N Y D+
Sbjct:  21 ILWQLTRPHTLTASFVPVLLGTVLAMFYVKVDLLLFLAMLFSCLWI-QIATNLFNEYYDF    79

Query:  65 RNAVDL-DYKNDTNIIGRENLSLRQIEVIMASLVITSSMIGLVLVSQVGLPLLWMGLFCF   123
             +  +D +       IR + +I + +     + ++G+ + +      L  +GL
Sbjct:  80 KRGLDTAESVGIGGAIVRHGMKPKTILQLALASYGIAILLGVYICASSSWWLALIGLVGM   139

Query: 124 GIGVLYSFGPRPLSSLPLGEVFSGLTMGFMISLICVYLNTYQNFSWDILNLSKIFLISLP   183
             IG LY+ GP P++  P GE+FSG+ MG + LI ++ T     D +N+   I LIS+P
Sbjct: 140 AIGYLYTGGPLPIAYTPFGELFSGICMGSVFVLISFFIQT------DKINMQSI-LISIP   192

Query: 184 NTLWIANLMLANNLCDKEEDEKNHRYTLVHYTGIRGGLLLFAISNSIALLAIVFEFLFGL   243
              + +  + L+NN+ D EED+K  R TL     G +G + L A S ++A +  +V    + G
Sbjct: 193 IAILVGAINLSNNIRDIEEDKKGGRKTLAILMGHKGAVTLLAASFAVAYIWVVGLVITGA   252

Query: 244 APVTVLLSLLLIPFIYKQTKLLWQKQVKRETFVCAVRILALGSATQVLTY           293
             A   + +  L +P  +  K   Q ++            I+A+ S Q  T+
Sbjct: 253 ASPWLFVVFLSVPKPVQAVKGFVQNEMPMN------MIVAMKSTAQTNTF           296
```

No corresponding DNA sequence was identified in *S. pyogenes*.

Based on this analysis, it was predicted that this protein and its epitopes, could be useful antigens for vaccines or diagnostics.

Example 1610

A DNA sequence (GBSx1705) was identified in *S. agalactiae* <SEQ ID 4971> which encodes the amino acid sequence <SEQ ID 4972>. Analysis of this protein sequence reveals the following:

Possible site: 16
>>> Seems to have no N-terminal signal sequence
INTEGRAL     Likelihood = –0.22    Transmembrane 155-171 (154-171)
----- Final Results -----
  bacterial membrane --- Certainty = 0.1086 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

```
>GP:CAB15200 GB:Z99120 similar to NADH dehydrogenase [Bacillus subtilis]
Identities = 178/403 (44%), Positives = 249/403 (61%), Gaps = 7/403 (1%)
Query:   3 EILVLGAGYAGLKAVRNLQKQSG--DFHITLVDMNDYHYEATELHEVAAGSQPKEKITFP    60
             +I++LGAGY GL V L K G   D  ITLV+ ++YHYE T +HE +AG+     ++ +
Sbjct:   7 KIVILGAGYGGLMTVTRLTKYVGPNDADITLVNKHNYHYETTWMHEASAGTLHHDRCRYQ    66

Query:  61 IKDVINTNKVNFMQDEVLRVDAENKTVTVKNNGELHYDYVVVALGFVSETFGIKGAMENA   120
             IKDVIN ++VNF+QD V  +  + K V + N GEL YDY+V+ LG V  ETFGIKG   E A
Sbjct:  67 IKDVINQSRVNFVQDTVKAIKIDEKKVVLAN-GELQYDYLVIGLGAVPETFGIKGLKEYA   125

Query: 121 LQMTNISQAENIHNHIVNTMKLYRETKDE--NLLKLLVCGAGFTGIELAGAMVDERPKYA   178
               + NI+ + + HI     Y      ++  + L ++V GAGFTGIE   G +    P+
Sbjct: 126 FPIANINTSRLLREHIELQFATYNTEAEKRPDRLTIVVGGAGFTGIEFLGELAARVPELC   185

Query: 179 ALAGVKPEQIEIICVEAATRILPMFDDELAQYGVNLIKDLGINLMLGSMIKEIKPGEVVY   238
                   V   + IICVEAA  +LP FD EL  Y V+ +++   G+   +G+ ++E  P  V
Sbjct: 186 KEYDVDRSLVRIICVEAAPTVLPGFDPELVDYAVHYLEENGVEFKIGTAVQECTPEGVRV   245

Query: 239 GTSKEDEELKSITAGTIIWTTGVSGSPVMGESGFDQRRGRVMVNSDLRDPKYDNVYVIGD   298
             G  K+DEE + I + T++W  GV G P++  E+GF+    RGRV VN  DLR P +DNV+++GD
Sbjct: 246 G--KKDEEPEQIKSQTVVWAAGURGHPIVEEAGFENMRGRVKVNPDLRAPGHDNVFILGD   303

Query: 299 VSAFMDTESGRPFPTTAQIATRMGAHVAKNLLHQIKGEATEDFSYSPQGTVASVGNTHGL   358
              S FM+ ++ RP+P TAQIA + G  VAKNL   IKG   E+F        +GTVAS+G  + +
Sbjct: 304 SSLFMNEDTERPYPPTAQIAMQQGITVAKNLGRLIKGGELEEFKPDIKGTVASLGEHNAV   363

Query: 359 GVVGKTKIKKYPASVMKKIIMNKSLVDMGGLKELLAKGRFDLY                  401
             GVV   K+K  PAS MKK+I N+SL  +GGL  L KG+F +
Sbjct: 364 GVVYGRKLKGTPASFMKKVIDNRSLFMIGGLGLTLKKGKFKFF                  406
```

There is also homology to SEQ ID 4666.

Based on this analysis, it was predicted that this protein and its epitopes, could be useful antigens for vaccines or diagnostics.

Example 1611

A DNA sequence (GBSx1706) was identified in *S. agalactiae* <SEQ ID 4973> which encodes the amino acid sequence <SEQ ID 4974>. This protein is predicted to be cytochrome d ubiquinol oxidase, subunit I (cydA-1). Analysis of this protein sequence reveals the following:

```
Possible site: 42
>>> Seems to have no N-terminal signal sequence
INTEGRAL    Likelihood = -6.64    Transmembrane 19-35 (15-38)
INTEGRAL    Likelihood = -5.73    Transmembrane 226-242 (222-244)
INTEGRAL    Likelihood = -4.94    Transmembrane 130-146 (126-149)
INTEGRAL    Likelihood = -4.83    Transmembrane 429-445 (422-446)
INTEGRAL    Likelihood = -3.77    Transmembrane 55-71 (53-74)
INTEGRAL    Likelihood = -3.56    Transmembrane 342-358 (340-359)
INTEGRAL    Likelihood = -1.06    Transmembrane 89-105 (89-106)
INTEGRAL    Likelihood = -0.59    Transmembrane 186-202 (186-202)
----- Final Results -----
   bacterial membrane --- Certainty = 0.3654 (Affirmative) <succ>
   bacterial outside --- Certainty = 0.0000 (Not Clear) <succ>
   bacterial cytoplasm --- Certainty = 0.0000 (Not Clear) <succ>
```

The protein has homology with the following sequences in the GENPEPT database.

No corresponding DNA sequence was identified in *S. pyogenes*.

Based on this analysis, it was predicted that this protein and its epitopes, could be useful antigens for vaccines or diagnostics.

Example 1612

A DNA sequence (GBSx1707) was identified in *S. agalactiae* <SEQ ID 4975> which encodes the amino acid sequence <SEQ ID 4976>. This protein is predicted to be cytochrome oxidase subunit II (cydB-1). Analysis of this protein sequence reveals the following:

```
Possible site: 22
>>> Seems to have an uncleavable N-term signal seq
INTEGRAL    Likelihood = -14.49    Transmembrane 226-242 (220-250)
INTEGRAL    Likelihood = -8.12     Transmembrane 254-270 (250-282)
INTEGRAL    Likelihood = -7.64     Transmembrane 198-214 (196-218)
INTEGRAL    Likelihood = -6.95     Transmembrane 85-101 (76-103)
INTEGRAL    Likelihood = -6.74     Transmembrane 6-22 (1-27)
INTEGRAL    Likelihood = -6.16     Transmembrane 300-316 (298-322)
INTEGRAL    Likelihood = -5.36     Transmembrane 119-135 (117-143)
INTEGRAL    Likelihood = -4.04     Transmembrane 159-175 (155-178)
----- Final Results -----
   bacterial membrane --- Certainty = 0.6795 (Affirmative) <succ>
   bacterial outside --- Certainty = 0.0000 (Not Clear) <succ>
   bacterial cytoplasm --- Certainty = 0.0000 (Not Clear) <succ>
```

The protein has homology with the following sequences in the GENPEPT database.

```
>GP:CAB15902 GB:Z99123 cytochrome bd ubiquinol oxidase (subunit I)
[Bacillus subtilis]

Identities = 246/470 (52%), Positives = 319/470 (67%), Gaps = 12/470 (2%)
Query:    6  LARFQFAMTTVFHFFFVPFTIGTCLVVAIMETMYVITKNEEYKKLTKFWGNIMLLSFAVG      65
             LAR QFA TT+FHF FVP +IG   +VA+MET+Y++ KNE Y K+ KFWG++ L++FAVG
Sbjct:    6  LARIQFASTTLFHFLFVPMSIGLVFMVALMETLYLVKKNELYLKMAKFWGHLFLINFAVG      65

Query:   66  VVTGIIQEFQFGMNWSDYSRFVGDIFGAPLAIEALLAFFMESTFLGLWMFTWDNKKISKK     125
             VVTGI+QEFQFG+NWSDYSRFVGD+FGAPLAIEALLAFFMES F+GLW+F WD   ++ KK
Sbjct:   66  VVTGILQEFQFGLNWSDYSRFVGDVFGAPLAIEALLAFFMESIFIGLWIFGWD--RLPKK     123

Query:  126  LHVTFIWLVVFGSLMSAMWILTANSFMQHPVGYEVVNGRAQMTDFLALVKNPQFFYEFTH     185
              +H    IWLV FG++MS+ WILTANSFMQ  PVG+ +  NGRA+M DF AL+ NPQ + EF H
Sbjct:  124  IHALCIWLVSFGTIMSSFWILTANSFMQEPVGFTIKNGRAEMNDFGALITNPQLWVEFPH     183

Query:  186  VIFGAITMGGTVVAGMSAFRLLKSEQLKDTTVELYKKSVRIGLVVALLGSISVMGVGDLQ     245
             VIFGA+   G   +AG+SAF+LLK ++       V   +K+S ++ ++V L    + V   G  +Q
Sbjct:  184  VIFGALATGAFFIAGVSAFKLLKKKE-----VPFFKQSFKLAMIVGLCAGLGVGLSGHMQ     238

Query:  246  MKALIHDQPMKFAAMEGDYEDSGDPAAWSVVAWANEAEHKQVFGIKIPYMLSILSYGKPS     305
                + L+   QPMK AA EG +EDSGDPAAW+   A  +   K     IK+PY LS L+Y K S
Sbjct:  239  AEHLMESQPMKMAASEGLWEDSGDPAANTAPATIDTKNEKSSNEIKVPYALSYLAYQKFS     298

Query:  306  GSVKGMDTANKELVAKYGKDNYYPMVNLLFYGFRTMAAMGTAIMGVSVLGLFLTRKKKPI     365
             GSVKGM  T    E     YGK +Y P V    F+  FR M    G   ++     ++ GL+L R+KK
Sbjct:  299  GSVKGMKTLQAEYEKIYGKGDYIPPVKTTFWSFRIMVGAGVVMILAALGGLWLNRRKK--     356

Query:  366  LYKHKWMLWIVALTTFAPPFLANTFGWIVTEQGRYPWTVYGLFKIKDSVSPNVSVASLFVS     425
             L   KW L I+        PFLAN+ GWI+TE GR PWTV GL    SVSPNV+  SL  S
Sbjct:  357  LENSKWYLRIMIALISFPPFLANSAGWIMTEIGRQPWTVMGLMTTAQSVSPNVTAGSLLFS     416

Query:  426  NTVYFLLFGGLAVMMISLTIRELKKGPEYEDEHGHHGAYTSIDPFEEGAY             475
             + +++   L   +++ L  IRE+KKG E+++     HH    S DPF +  Y
Sbjct:  417  IIAFGVMYMILGALLVFLFIREIKKGAEHDN---HHDVPVSTDPFSQEVY             463
```

```
>GP:CAB15901 GB:Z99123 cytochrome bd ubiquinol oxidase (subunit II)
[Bacillus subtilis]
Identities = 158/331 (47%), Positives = 223/331 (66%), Gaps = 1/331 (0%)
Query:   1  MSALQFFWFFLIGLLFSGFFFLEGFDFGVGMAVQTLTHNEHEKDQVVETIGPVWDGNEVW   60
            M++L    WF L+ +LF GFFFLEGFDFGVGMA + L HNE E+   ++ TIGP WD NEVW
Sbjct:   1  MASLHDLWFILVAVLFVGFFFLEGFDFGVGMATRFLGHNELERRVLINTIGPFWDANEVW   60

Query:  61  LLTGGGAMFASFPYWYASLFSGYYLILLTILFGLIIRGVSFEFRHKVPAEK-KQFWNWIL  119
            LLTG GA+FA+FP WYA++ SGYY+  + +L  L+ RGV+FEFR KV    K + W+W +
Sbjct:  61  LLTGAGAIFAAFPNWYATMLSGYYIPFVIVLLALMGRGVAFEFRGKVDHLKWVKVWDWVV  120

Query: 120  TIGSAIVPFFFGIMFISLIQGMPLDASGNLSAQFSDYFNIFSLVGGVAMVLLAYLHGLNY  179
               GS I PF  G++F +L +GMP+DA  N+ A  SAY N++S++GGV + LL + HGL +
Sbjct: 121  FFGSLIPPFVLGVLFTTLFRGMPIDADMNIHAHVSDYINVYSILGGVTVTLLCFQHGLMF  180

Query: 180  IALKTEGPIRERARNYAQLLYWVLYLGLALFAVLLYFKTDFFSNHPIVTTIMVLVIVVLA  239
            I L+T G ++ RAR  AQ +  V+++ +  FA L  ++TD F+     +T  +  ++IV+
Sbjct: 181  ITLRTIGDLQNRARKMAQKIMGVVFVAVLAFAALSAYQTDMFTRRGEITIPLAVLIVICF  240

Query: 240  VLAHASTFKGAEMTAFLASGLSLVSVVVLLFQGLFPRVMISSISPKYDLLIQNASSTPYT  299
            +LA       K +     F +G L    V ++F  LFPRVM+SS+    YDL + NASS Y+
Sbjct: 241  MLAAVFIRKKKDGWTFGMTGAGLALTVGMIFISLFPRVMVSSLHSAYDLTVANASSGDYS  300

Query: 300  LKVMSIVAITLVPFVLAYTAWAYYIFRKRIT                              330
            LKVMSI A+TL+PFV+      W+YY+FRKR++
Sbjct: 301  LKVMSIAALTLLPFVIGSQIWSYYVFRKRVS                              331
```

No corresponding DNA sequence was identified in *S. pyogenes*.

Based on this analysis, it was predicted that this protein and its epitopes, could be useful antigens for vaccines or diagnostics.

Example 1613

A DNA sequence (GBSx1708) was identified in *S. agalactiae* <SEQ ID 4977> which encodes the amino acid sequence <SEQ ID 4978>. Analysis of this protein sequence reveals the following:

---
Possible site: 29
>>> Seems to have an uncleavable N-term signal seq
----- Final Results -----
   bacterial membrane --- Certainty = 0.0000 (Not Clear) <succ>
   bacterial outside --- Certainty = 0.0000 (Not Clear) <succ>
   bacterial cytoplasm --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1614

A DNA sequence (GBSx1709) was identified in *S. agalactiae* <SEQ ID 4979> which encodes the amino acid sequence <SEQ ID 4980>. This protein is predicted to be transport ATP-binding protein cydc (cydD). Analysis of this protein sequence reveals the following:

---
Possible site: 27
>>> Seems to have an uncleavable N-term signal seq
INTEGRAL    Likelihood = -16.82   Transmembrane 158-174 (144-182)
INTEGRAL    Likelihood = -6.48    Transmembrane 15-31 (14-34)
INTEGRAL    Likelihood = -5.31    Transmembrane 243-259 (238-266)
INTEGRAL    Likelihood = -2.55    Transmembrane 136-152 (134-152)
INTEGRAL    Likelihood = -0.48    Transmembrane 263-279 (263-279)
----- Final Results -----
   bacterial membrane --- Certainty = 0.7729 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the GENPEPT database.

```
>GP:CAB15900 GB:Z99123 ABC membrane transporter (ATP-binding
protein) [Bacillus subtilis]
Identities = 279/569 (49%), Positives = 401/569 (70%), Gaps = 6/569 (1%)
Query:   2  LDKAVMRLSGIHKLLGLLAGLDVLQAIFIIGQAYYLSLSITGLWEGQKLSSQTVYILLFM   61
            + K + R  G+ ++L L+  L  L ++Q   II QA +LS ++TGL+ G+ ++S   I  F+
Sbjct:   1  MGKDLFRYKGMKRILTLITCLTLIQTAAIIMQAEWLSEAVTGLFNGKGITSLLPVIGFFL   60

Query:  62  VSYLGRHVIDYIKNRKLDDFSTAQSSLLRRQLLDKLFDLGPKVVQEQGTGNVVTMALDGV  121
            ++++ RH +   + + ++    + LR+  LD+LF LGP+  +++GTG +VT+A++G+
Sbjct:  61  IAFIARHGMTVARQKIVYQYAARTGADLRKSFLDQLFRLGPRFAKKEGTGQMVTLAMEGI  120

Query: 122  SLVENYLRLVLNKMINMSIIPWIILAYIFYLDIESGAILLIVFPLIIIFMIILGYAAQAK  181
            S     YL L L KM++M+I+P   ++ Y+F+ D   S   IL+    P++IFMI+LG   AQ K
Sbjct: 121  SQFRRYLELFLPKMVSMAIVPAAVVIYVFFQDRTSAIILVAAMPILIIFMILLGLVAQRK  180

Query: 182  ADKQYESYQVLSNHFLDSLRGIDTLKYFGLSKRYGKSIYQTSESFRKATMSTLKIGILST  241
            AD+Q++SYQ LSNHF+DSLRG++TL++ GLSK + K+I+   SE +RKATMSTL++  LS+
Sbjct: 181  ADRQWKSYQRLSNHFVDSLRGLETLRFLGLSKSHSKNIFYVSERYRKATMSTLRVAFLSS  240
```

-continued

```
Query:  242  FALDFFTTLSIAIVAVFLGLRLLNEQIYLLPALTILILSPEYFLPVRDFSSDYHATLDGK  301
             FALDFFT LS+A VAVFLGLRL++  I L PALT LIL+PEYFLPVR+  +DYHATL+G+
Sbjct:  241  FALDFFTMLSVATVAVFLGLRLIDGDILLGPALTALILAPEYFLPVREVGNDYHATLNGQ  300

Query:  302  NAFQAIQKVLNKTGIKGE-QLVIDDWSKESRLDLENIAIAYDQKRVVEDVTLRFGHQKV   360
             A + IQ++L++ G K E  L ++ WS +  L L  +++       R V D+ L F+G +K+
Sbjct:  301  EAGKTIQEILSQPGFKEETPLQLEAWSDQDELKLSGVSVG----RSVSDIHLSFKGKKKI  356

Query:  361  ALVGVSGSGKSSLINLLSGFLGPDNGSLKVDGREVTNLDQEDWHKQMIYIPQTPYVFEMS   420
             ++G SG+GKS+LI++L GFL PD G ++V+G     ++L    W K ++YIPQ PY+F+ +
Sbjct:  357  GIIGASGAGKSTLIDILGGFLEPDGGMIEVNGTSRSHLQDGSWQKNLLYIPQHPYIFDDT  416

Query:  421  LRDNITFYTPNASDEEVVRAIHMVGLDSLLSELPDGLETRIGNGARPLSGGQAQRIALAR  480
             L +NI FY P+AS E+  RA    GL  L++ LPDGLE RIG G R LSGGQAQR+ALAR
Sbjct:  417  LGNNIRFYHPSASAEDTTRAAASAGLTELVNNLPDGLEGRIGEGGRALSGGQAQRVALAR  476

Query:  481  AFLDQNRRIMVFDEPTAHLDIETELELKEKMLPLMSDRLVIFATHRLHWLNQMDVIVVME  540
             AFL  NR I++ DEPTAHLDIETE E+KE ML L  D+LV  ATHRLHW+  MD I+V++
Sbjct:  477  AFLG-NRPILLLDEPTAHLDIETEYEIKETMLDLFEDKLVFLATHRLHWMLDMDEIIVLD  535

Query:  541  KGRVAEVGSYQELLAKKGYLYQLKHAMGG                               569
             GRVAE+G++ ELL K G   +L  A  G
Sbjct:  536  GGRVAEIGTHNELLEKNGVYTKLVKAQLG                               564
```

A related DNA sequence was identified in S. pyogenes <SEQ ID 4981> which encodes the amino acid sequence <SEQ ID 4982>. Analysis of this protein sequence reveals the following:

---

Possible site: 53
>>> Seems to have no N-terminal signal sequence
INTEGRAL    Likelihood = −10.61    Transmembrane 159-175 (154-190)
INTEGRAL    Likelihood = −10.03    Transmembrane 70-86 (63-91)

-continued

INTEGRAL    Likelihood = −3.03    Transmembrane 282-298 (282-301)
INTEGRAL    Likelihood = −1.44    Transmembrane 261-277 (260-278)
----- Final Results -----
  bacterial membrane --- Certainty = 0.5246 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP:AAC22320 GB:U32749 ATP-binding transport protein (cydD)
[Haemophilus influenzae Rd]
Identities = 167/544 (30%), Positives = 279/544 (50%), Gaps = 15/544 (2%)
Query:   46  MISFYLIAKTFSTFILGHAIALGRLAGLLLLLNVVGFVLAILGK---QLQGIASQFARDS  102
             + S+ L A F   L A+ LG +    L L         A  GK    Q     AS    +
Sbjct:   17  VFSYILQAAYFHELSLLSAVILGIVLIAALALR------AFAGKKSVQASYFASTKVKHE   70

Query:  103  LKQSFFEAFIDLDGQFDAHASDADILTLASQGIDSLDTYYGYYL-SLSMRTKWNCTTIMI  161
             L+   +    +        S + I+  +AS+G++  L+ Y+G  YL   L         T
Sbjct:   71  LRSLIYRKLASMPLNQVNQQSTSSIIQVASEGVEQLEIYFGRYLPQLFYSLLAPLTLFAF  130

Query:  162  LVFLIYPLAGLVFLGVLPLIPLSIVAMQKRSQPNMSHYWSSYMDVGNLFMDDLKGLNTLY  221
             L+F  +  A ++ L +PLIP+SI+A+  K ++   ++ YWS Y+ +G+ F+D+L+GL TL
Sbjct:  131  LIFFSFKTA-IILLICVPLIPMSIIAVNKIAKKLLAKYWSIYVGLGSSFLDNLQGLITLK  189

Query:  222  SYQATERYEQEFSGKAEQFRKATMSLLGFQLQAVGYMDAVMYLGIGLSGFLAVQALATGQ  281
                 YQ       +AE FRK TM +L  QL  +V  MD + Y G +   A+         Q
Sbjct:  190  IYQDDAYKAKAMDKEAEHFRKITMKVLTMQLNSVSLMDLLAYGGAAIGILTALLQFQNAQ  249

Query:  282  LSFFNFLFFLLIATEFFFTPIREQGYGMHLVMMNTKMADRIFSFLDS-VPARKENKSKTAI  340
             LS   + F+L+++EFF  P+R  G   H+ M         +D+IF+ LD+ V  ++         A
Sbjct:  250  LSVLGVILFILLSSEFFIPLRLLGSFFHVAMNGKAASDKIFTLLDTPVETQQSAVDFEAK  309

Query:  341  NFNQIDIQNISLAY-EKKTVLSGVTMTLTKGQLTAIAGVSGQGKTSLAQLLLKRQSATTG  399
             N Q++I+++ +Y E+K ++G+  +++   QL+   G SG GK+L  LL+     A  G
Sbjct:  310  NNVQVEIKDLHFSYSEEKPAITGLNLSILPNQLSVFVGKSGCGKSTLVSLLMGFNKAQQG  369

Query:  400  HILFDGLDSDNLSQETINQQVLYVSDQSTLLNRSIYDNLRLA-ANLSKKEILDWIDQHGL  458
             IL F+G  ++N+ + +  Q+V  VS   S +       +N+  +A + + ++I   ++Q   L
Sbjct:  370  EILFNGQNALNIDRTSFYQKVSLVSHSSYVFKGTLRENMTMAKIDATDEQIYACLEQVNL  429

Query:  459  LSFINWLPDGLDTIVGENGNLLSPGQKQQVICARALLSKRSLYIFDEATSSLDAENERII  518
                F+    GLD    +  G LS GQ Q++  ARALL      LYIFDEATS++D E+E II
Sbjct:  430  AQFVR-DNGGLDMQLLSRGANLSGGQIQRLALARALLHNAELYIFDEATSNIDVESEEII  488

Query:  519  DNLITRLAKTAIVIVITHKMSRLKGANQVLFLNTGQPACLGKPCDLYRDQPTYRHLVDTQ  578
             I +  +     +++I+H+++       A+ +  L+ G+      G   +L   Q   Y  +  Q
Sbjct:  489  LQFIQQFKQQKTIVMISHRLANAVNADCINVLDQGKLIEQGTHKELMEKQGAYAEMFQQQ  548
```

-continued

```
Query: 579 ARLE                                                     582
             LE
Sbjct: 549 KDLE                                                     552
```

An alignment of the GAS and GBS proteins is shown below.

```
Identities = 143/552 (25%), Positives = 260/552 (46%), Gaps = 12/552 (2%)
Query:   1 MLDKAVMRLSGIHKLLGLLAGLDVLQAIFIIGQAYYLSLSITGLWEGQKLSSQTVYILLF    60
           +L +   R++    LL + A L LQ +  +   Y ++ + +     G  ++   + LL
Sbjct:  16 LLKRLRERIAPKRYLLYVSAFLSWLQFVMRMISFYLIAKTESTFILGHAIALGRLAGLLL    75

Query:  61 MVSYLGRHVIDYIKNRKLDDFSTAQSSLLRRQLLDKLFDLGPKVVQEQGTGNVVTMALDG   120
           +++ +G  V+ +  +      S       L++   +  DL +          +++T+A  G
Sbjct:  76 LLNVVG-FVLAILGKQLQGIASQFARDSLKQSFFEAFIDLDGQFDAHASDADILTLASQG   134

Query: 121 VSLVENYLRLVLNKMINMSIIPWIILAYIFYLDIESGAILLIVFPLIIIFMIILGYAAQA   180
           +  ++ Y    L+ +              I+  +F +   +G + L V PLI + ++ +    +Q
Sbjct: 135 IDSLDTYYGYYLSLSMRTKWNCTTIMILVFLIYPLAGLVFLGVLPLIPLSIVAMQKRSQP   194

Query: 181 KADKQYESYQVLSNHFLDSLRGIDTLKYFGLSKRYGKSIYQTSESFRKATMSTLKIGILS   240
             +  SY    + N F+D L+G++TL  +  ++RY  +       +E FRKATMS L    + +
Sbjct: 195 NMSHYWSSYMDVGNLFMDDLKGLNTLYSYQATERYEQEFSGKAEQFRKATMSLLGFQLQA   254

Query: 241 TFALDFFTTLSIAIVAVFLGLRLLNEQIYLLPALTILILSPEYFLPVRDFSSDYHATLDG   300
            +D     L I +       L    Q+      L   L+++ E+F P+R+      H  +
Sbjct: 255 VGYMDAVMYLGIGLSGFLAVQALATGQLSFFNFLFFLLIATEFFTPIREQGYGMHLVMMN   314

Query: 301 KNAFQAIQKVLNKTGIKGEQLVIDDWSKE----SRLDLENIAIAYDQKRVVEDVTLRFRG   356
                 I   L+    +        D+ SK      +++D++NI++AY++K V+   VT+
Sbjct: 315 TKMADRIFSFLDSVPARK-----DNKSKTAINFNQIDIQNISLAYEKKTVLSGVTMTLTK   369

Query: 357 HQKVALVGVSGSGKSSLINLLSGFLGPDNGSLKVDGREVTNLDQEDWHKQMIYIPQTPYV   416
             Q  A+ GVSG GK+SL LL          G +  DG +  NL QE ++Q++Y+     +
Sbjct: 370 GQLTAIAGVSGQGKTSLAQLLLKRQSATTGHILFDGLDSDNLSQETINQQVLYVSDQSTL   429

Query: 417 FEMSLRDNITFYTPNASDEEVVRAIHMVGLDSLLSELPDGLETRIGNGARPLSGGQAQRI   476
              S+  DN+      N S +E++    I    GL S ++ LPDGL+T +G      LS GQ Q++
Sbjct: 430 LNRSIYDNLRL-AANLSKKEILDWIDQHGLLSFINWLPDGLDTIVGENGNLLSPGQKQQV   488

Query: 477 ALARAFLDQNRRIMVFDEPTAHLDIETELELKEKMLPLMSDRLVIFATHRLHWLNQMDVI   536
            ARA L + R + +FDE T+ LD E E   +   + L   +VI TH++  L    + +
Sbjct: 489 ICARALLSK-RSLYIFDEATSSLDAENERIIDNLITRLAKTAIVIVITHKMSRLKGANQV   547

Query: 537 VVMEKGRVAEVG                                                  548
            + +    G+ A +G
Sbjct: 548 LFLNTGQPACLG                                                  559
```

Based on this analysis, it was predicted that these proteins and their epitopes could be useful antigens for vaccines or diagnostics.

Example 1615

A DNA sequence (GBSx1710) was identified in *S. agalactiae* <SEQ ID 4983> which encodes the amino acid sequence <SEQ ID 4984>. This protein is predicted to be transport ATP-binding protein cydd (cydC). Analysis of this protein sequence reveals the following:

Possible site: 49
>>> Seems to have no N-terminal signal sequence
INTEGRAL    Likelihood = −12.84   Transmembrane 260-276 (258-284)

-continued

| | | |
|---|---|---|
| INTEGRAL | Likelihood = −9.34 | Transmembrane 172-188 (147-199) |
| INTEGRAL | Likelihood = −6.53 | Transmembrane 150-166 (147-171) |
| INTEGRAL | Likelihood = −6.05 | Transmembrane 31-47 (29-52) |
| INTEGRAL | Likelihood = −3.35 | Transmembrane 68-84 (67-84) |
| INTEGRAL | Likelihood = −1.17 | Transmembrane 293-309 (292-310) |
| INTEGRAL | Likelihood = −0.69 | Transmembrane 494-510 (493-510) |

----- Final Results -----
  bacterial membrane --- Certainty = 0.6137 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 10127> which encodes amino acid sequence <SEQ ID 10128> was also identified.

The protein has homology with the following sequences in the GENPEPT database.

```
>GP:CAB15899 GB:Z99123 ABC membrane transporter (ATP-binding
protein) [Bacillus subtilis]
Identities = 262/573 (45%), Positives = 389/573 (67%), Gaps = 14/573 (2%)
Query:  16 LKTDQWIKPFFKQYKVSLVIALFLGFMTFFSASALMFNSGYLISKSASLPSNILLVYVPI    75
           +K ++WI P+ KQ     V+ +FLG +T FSA+ LMF SG+LISK+A+ P NILL+YVPI
Sbjct:   1 MKKEEWILPYIKQNARLFVLVIFLGAVTIFSAAFLMFTSGFLISKAATRPENILLIYVPI    60
```

-continued

```
Query:  76 VLTRAFGIGRPVFRYIERLTSHNWVLRMTSQLRLKLYHSLESNAIFMKRDFRLGDVMGLL  135
            V R FGI R V RY+ERL  H+ +L++ S +R++LY+ LE  A+ ++  FR GD++G+L
Sbjct:  61 VAVRTFGIARSVSRYVERLVGHHIILKIVSDMRVRLYNMLEPGALMLRSRFRTGDMLGIL  120

Query: 136 AEDINYLQNLYLRTIFPTIIAWILYSFIIATGFFSLWFALMMLLYLAIMIFLFPLWSIL   195
           +EDI +LQ+ +L+TIFP I A +LY+  +IA GFFS  FA+++ LYL +++ LFP+ S+L
Sbjct: 121 SEDIEHLQDAFLKTIFPAISALLLYAVSVIALGFFSWPFAILLALYLFVLVVLFPVVSLL  180

Query: 196 ANGARQTREKELKNHLYTDLTDNVLGISDWIFSQRGQEYVALHERSESELMAVQKKIRSF  255
              A+  + K  +N LY+ LTD V+G+SDW+FS R    ++  +E+ E +   +++K + F
Sbjct: 181 VTRAKNAKLKSGRNVLYSRLTDAVMGVSDWMFSGRRHAFIDAYEKEERDWFELERKKQRF  240

Query: 256 DNRRALIVELVFGFLAILVIIWASNQFIGHRGGEA--NWIAAFVLTVFPLSEAFAGLSAA  313
              R  ++ L +L++ W + Q     GE     IAAFVL VFPL+EAF  LS A
Sbjct: 241 TRWRDFAAQCLVAGLILLMLFWTAGQ---QADGELAKTMIAAFVLVVFPLTEAFLPLSDA  297

Query: 314 AQETNKYSDSIHRLN------ELSETYFETTQNQLPNKPYDFSVKNLSFQYKPQEKWVLH  367
              E  Y DSI R+N        E S+T E+      L +     + ++++F Y    + VLH
Sbjct: 298 LGEVPGYQDSIRRMNNVAPQPEASQT--ESGDQILDLQDVTLAFRDVTFSYDNSSQ-VLH  354

Query: 368 HLDLDIKEGEKIAILGRSGSGKSTLASLLRGDLKASQGEITLGDADVSIVGDCISNYIGV  427
           +    +++GEK+A+LGRSGSGKST +L+ G LK   G +TL   + +++ D I++ + V
Sbjct: 355 NFSFTLRQGEKMALLGRSGSGKSTSLALIEGALKPDSGSVTLNGVETALLKDQIADAVAV  414

Query: 428 IQQAPYLFNTTLLNNIRIGNQDASEEDVWKVLERVGLKEMVTDLSDGLYTMVDEAGLRFS  487
           + Q P+LF+T++LNNIR+GN +AS+EDV +    ++V L + +   L DG +T V E G+RFS
Sbjct: 415 LNQKPHLFDTSILNNIRLGNGEASDEDVRRAAKQVKLHDYIESLPDGYHTSVQETGIRFS  474

Query: 488 GGERHRIALARILLKDVPIVILDEPTVGLDPITEQALLRVFMKELEGKTLVWITHHLKGI  547
           GGER RIALARILL+D PI+ILDEPTVGLDPITE+ L+    + L+GKT++WITHHL G+
Sbjct: 475 GGERQRIALARILLQDTPIIILDEPTVGLDPITERELMETVFEVLKGKTILWITHHLAGV  534

Query: 548 EHADRILFIENGQLELEGSPQELSQSSQRYRQL                            580
           E AD+I+F+ENG+ E+EG+ +EL    +++RYR+L
Sbjct: 535 EAADKIVFLENGKTEMEGTHEELLAANERYRRL                            567
```

A related GBS gene <SEQ ID 8861> and protein <SEQ ID 8862> were also identified. Analysis of this protein sequence reveals the following:

Lipop: Possible site: –1    Crend: 8
McG: Discrim Score: –15.90
GvH: Signal Score (–7.5): 1.97
Possible site: 49
>>> Seems to have no N-terminal signal sequence
ALOM program   count: 7 value: –12.84 threshold: 0.0

| | | |
|---|---|---|
| INTEGRAL | Likelihood = –12.84 | Transmembrane 260-276 (258-284) |
| INTEGRAL | Likelihood = –9.34 | Transmembrane 172-188 (147-199) |
| INTEGRAL | Likelihood = –6.53 | Transmembrane 150-166 (147-171) |
| INTEGRAL | Likelihood = –6.05 | Transmembrane 31-47 (29-52) |
| INTEGRAL | Likelihood = –3.35 | Transmembrane 68-84 (67-84) |
| INTEGRAL | Likelihood = –1.17 | Transmembrane 293-309 (292-310) |
| INTEGRAL | Likelihood = –0.69 | Transmembrane 494-510 (493-510) |
| PERIPHERAL | Likelihood = 3.29 | 412 | modified ALOM score: 3.07
*** Reasoning Step: 3
----- Final Results -----
  bacterial membrane --- Certainty = 0.6137 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
ORF00997(346-2052 of 2364)
EGAD|98910|BS3866(1-571 of 575) transport ATP-binding protein cydd
{Bacillus subtilis}
OMNI|NT01BS4517 ABC transporter CydC, putative SP|P94367|CYDD_BACSU TRANSPORT
ATP-BINDING PROTEIN CYDD. GP|1783253|dbj|BAA11730.1||D83026
homologous to many ATP-binding transport proteins; hypothetical
{Bacillus subtilis}GP|2636408|emb|CAB15899.1||Z99123 ABC membrane transporter
(ATP-binding protein) {Bacillus subtilis} PIR|D6961|D69611| ABC transporter
required for expression of cytochrome bd (ATP-) cydD-Bacillus subtilis
% Match = 31.9
% Identity = 45.2 % Similarity = 69.1
Matches = 257 Mismatches = 172 Conservative Sub.s = 136

300       330       360       390       420       450       480       510
           LKKDISIN*SMLWEEMMFKIPLFKELKTDQWIKPFFKQYKVSLVIALFLGFMTFFSASALMFNSGYLISKSASLPSNILL
           :|  ::||  | :||    :|: :|||   :| |||  ||:||||| ||:|||||:|:  ||||
           MKKEEWILPYIKQNARLFVLVIFGAVTIFSAAFLMFTSGFLISKAATRPENILL
            10        20        30        40        50
```

```
540        570        600        630        660        690        720        750
VYVPIVLTRAFGIGRPVFRYIERLTSHNWVLRMTSQLRLKLYHSLESNAIFMKRDFRLGDVMGLLAEDINYLQNLYLRTI
:|||||    |  |||  |  |  ||:|||   |: :|:: |  :|::||:  ||   |:  ::    ||  ||::|:|:|||   :||:   :|:||
IYVPIVAVRTFGIARSVSRYVERLVGHHIILKIVSDMRVRLYNMLEPGALMLRSRFRTGDMLGILSEDIEHLQDAFLKTI
           70         80         90        100        100        120        130

780        810        840        870        900        930        960        990
FPTIIAWILYSPIIIATGFFSLWFALMMLLYLAIMIFLFPPLWSILANGARQTREKELKNHLYTDLTDNVLGISDWIFSQR
||  |  |  :||:  |:  :|| ||||    ||::: |||  |:|     |   :|  ||      |  |:  |:|||:||  |
FPAISALLLYAVSVIALGFFSWPFAILLALYLFVLVVLFPVVSLLVTRAKNAKLKSGRNVLYSRLTDAVMGVSDWMFSGR
          150        160        170        180        190        200        210

1020       1050       1080       1110       1140                 1194       1224
GQEYVALHERSESELMAVQKKIRSFDNRRALIVELVFGFLAILVIIWASNQFIGHRGGE--ANWIAAFVLTVFPLSEAFA
: ::    :|:  |  :  :::|  :  |    |   :  :  |:|::   |: |     :  ||     ||||||   ||||:|||
RHAFIDAYEKEERDWFELERKKQRFTRWRDFAAQCLVAGLILLMLFWTAGQ---QADGELAKTMIAAFVLVVFPLTEAFL
          230        240        250        260        270        280        290

1254       1284       1302       1332       1362       1392       1422       1452
GLSAAAQETNKYSDSIHRLNELS----ETYFETTQNQLPNKPYDFSVKNLSFQYKPQEKWVLHHLDLDIKEGEKIAILGR
|| |    |||  |:  ::      |  :    |:      |       :: :::|     |||::   : :::|||:||| |
PLSDALGEVPGYQDSIRRMNNVAPQPEASQTESGDQILDLQDVTLAFRDVTFSY-DNSSQVLHNFSFTLRQGEKMALLGR
          310        320        330        340        350        360        370

1482       1512       1542       1572       1602       1632       1662       1692
SGSGKSTLASLLRGDLKASQGEITLGDADVSIVGDCISNYIGVIQQAPYXFNTTLLLNTFRIGNQDASEEDVWKVLERVGL
|||||||     :|:  | | |   |  :||    :  :::  |  |::  :  |:  |  |:  |:|::||  |:|  :||:|||   :  ::|  |
SGSGKSTSLALIEGALKPDSGSVTLNGVETALLKDQIADAVAVLNQKPHLFDTSILNNIRLGNGEASDEDVRRAAKQVKL
          390        400        410        420        430        440        450

1722       1752       1782       1812       1842       1872       1902       1932
KEMVTDLSDGLYTMVDEAGLRFSGGERHRIALARILLKDVPIVILDEPTVGLDPITEQALLRVFMKELEGKTLVWITHHL
: :    |  || :|  |    |:|||||||:|||||||||||:|  ||:||||||||||||||:  |:       |:|||::|||||
HDYIESLPDGYHTSVQETGIRFSGGERQRIALARILLQDTPIIILDEPTVGLDPITERELMETVFEVLKGKTILWITHHL
          470        480        490        500        510        520        530

1962       1992       2022       2052       2082       2112       2142       2172
KGIEHADRILFIENGQLELEGSPQELSQSSQRYRQLKASDDGDLLIGAINK*KNIP*LLF*HCGMFFYYLNFAF*K
|:|  ||:|::|:|||:  |:|||:  :||   :::|||:|       |
AGVEAADKIVFLENGKTEMEGTHEELLAANERYRRLYHLDVPVK
          550        560        570
```

There is also homology to SEQ ID 478.

Based on this analysis, it was predicted that these proteins and their epitopes could be useful antigens for vaccines or diagnostics.

Example 1616

A DNA sequence (GBSx1711) was identified in *S. agalactiae* <SEQ ID 4987> which encodes the amino acid sequence <SEQ ID 4988>. This protein is predicted to be spore germination protein C3 (ispB). Analysis of this protein sequence reveals the following:

Possible site: 45
>>> Seems to have no N-terminal signal sequence
INTEGRAL   Likelihood = −1.06   Transmembrane 111-127 (111-128)
----- Final Results -----
  bacterial membrane --- Certainty = 0.1426 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

```
>GP:CAB14190 GB:Z99115 heptaprenyl diphosphate synthase component II
[Bacillus subtilis]
Identities = 101/318 (31%), Positives = 184/318 (57%), Gaps = 5/318 (1%)
Query:   8 YPELKKNIDETNQLIQERIQVRNKDIEAALSQLTAAGGKQLRPAFFYLFSQLGNKENQDT   67
           Y L +ID   + +++ ++    +  A   L AGGK++RP F  L    G+    D
Sbjct:  35 YSFLNDDIDVIERELEQTVRSDYPLLSEAGLHLLQAGGKRIRPVFVLLSGMFGD---YDI  91

Query:  68 QQLKKIAASLEILHVATLIHDDVIDDSPLRRGNMTIQSKFGKDIAVYTGDLLFTVFFDLI  127
           ++K +A +LE++H+A+L+HDDVIDD+ LRRG  TI++K+   IA+YTGD +      +++
Sbjct:  92 NKIKYVAVTLEMIHMASLVHDDVIDDAELRRGKPTIKAKWDNRIAMYTGDYMLAGSLEMM  151

Query: 128 LESMADTPFMRINAKSMRKILMGELDQMHLRYNQQQGIHHYLRAISGKTAELFKLASKEG  187
           + +      RI ++++ ++ +GE++Q+   +YN +Q +    YLR I   KTA L ++ + G
Sbjct: 152 TR-INEPKAHRILSQTIVEVCLGEIEQIKDKYNMEQNLRTYLRRIKRKTALLIAVSCQLG  210

Query: 188 AYFGGAEKEVVRLAGHIGENIGMTFQILDDILDYTADKKTENKPVLEDLAQGIYSLPLLL  247
            A    GA++++ +    G+  +GM++QI+DD+LD+T+ ++     KPV  DL  QG  +LP+L
Sbjct: 211 AIASGADEKIHKALYWFGYYVGMSYQIIDDILDFTSTEEELGKPVGGDLLQGNVTLPVLY  270
```

-continued

```
Query: 248  AIEENPDIFKPILDKKTDMATEDMEKIAYLVVSHRGVDKARHLARKFTEKAISDINKLPQ  307
            A+ +NP +  +   ++   E +E I  +   ++ + ++  + +KA   +N LP+
Sbjct: 271  AL-KNPALKNQLKLINSETTQEQLEPIIEEIKKTDAIEASMAVSEMYLQKAFQKLNTLPR  329

Query: 308  SSAKKQLLQLTNYLLKRK                                           325
            A+  L  +  Y+ KRK
Sbjct: 330  GRARSSLAAIAKYIGKRK                                           347
```

There is also homology to SEQ ID 284. An alignment of the GAS and GBS proteins is shown below:

```
Identities = 65/227 (28%), Positives = 98/227 (42%), Gaps = 9/227 (3%)
Query:  43  AGGKQLRPAFFYLFSQLGNKENQDTQQLKKIAASLEILHVATLIHDDV--IDDSPLRRGN  100
            +GGK++RP      +     Q+       +AA+LE++H +LIHDD+  +D+   RAG
Sbjct:  36  SGGKRIRPLILLEMIEGFGVSLQNAHF--DLAAALEMIHTGSLIHDDLPAMDNDDYRRGR  93

Query: 101  MTIQSKFGKDIAVYTGDLLFTVFFDLILESM--ADTPFMRINAKSMRKILMGELDQMHLR  158
            +T   +FG+  A+  GD LF   F LI ++   ++    I   S+   G +   L
Sbjct:  94  LTNHKQFGEATAILAGDSLFLDPFGLIAQAELNSEVKVALIQELSLASGTFGMVGGQMLD  153

Query: 159  Y---NQQQGIRHYLRAISGKTAELFKLASKEGAYFGGAEKEVVRLAGHIGFNIGMTFQIL  215
                NQ +        KT +L   K A      V +    G  IG FQI
Sbjct: 154  MKGENQALSLPQLSLIHLNKTGKLLAFPFKAAALITEQAMTVRQQLEQAGMLIGHAFQIR  213

Query: 216  DDILDYTADKKTFNKPVLEDLAQGIYSLPLLLAIEENPDIFKPILDK              262
            DDILD TA  +   K   +DL      + P LL +E +  +   LD+
Sbjct: 214  DDILDVTASFEDLGKTPKKDLFAEKATYPSLLGLEASYQLLTESLDQ              260
```

Based on this analysis, it was predicted that these proteins and their epitopes could be useful antigens for vaccines or diagnostics.

Example 1617

A DNA sequence (GBSx1712) was identified in *S. agalactiae* <SEQ ID 4989> which encodes the amino acid sequence <SEQ ID 4990>. Analysis of this protein sequence reveals the following:

Possible site: 49
>>> Seems to have no N-terminal signal sequence
----- Final Results -----
  bacterial cytoplasm --- Certainty = 0.3995 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:AAA25232 GB:M58315 dipeptidyl peptidase IV [Lactococcus lactis]
Identities = 385/767 (50%), Positives = 504/767 (65%), Gaps = 21/767 (2%)
Query:   1  MRYNQFSYIPTKPNEAFEELKGLGFPLNKKNSDKANLEAFLRHSFLNQTDTDYALSLLIV   60
            MR+N FS +   +E    EL  LGF +     +K  L+ FL  S  + TD         L
Sbjct:   1  MRFNHFSIVDKNFDEQLAELDQLGFRWSVFWDEKKILKDFLIQSPSDMTD-------LQA   53

Query:  61  DAKTDALTFFKSNSDLTLENLQWIYLQLLGFIPFVDFKDPKAF-------LQDINFPVSY  113
            +A+  D  + F KS+ +L  E    I LQLL F+P  DF+ KAF         L  I  ++
Sbjct:  54  TAELDVIEFLKSSIELDWEIFWNIALQLLDFVPNFDFEIGKAFEYAKNSNLPQIEAEMTT  113

Query: 114  DNIFQSLHHLLACRGKSGNTLIDQLVADGLLHADNHYHFFNGKSLATFNTNQLIREVVYV  173
            +NI  +  + ++LL  R  K+G  L++    V++GLL    DNHYHFFN KSLATF+++  L REV++V
Sbjct: 114  ENIISAFYYLLCTRRKNGMILVEHWVSEGLLPLDNHYHFFNDKSLATFDSSLLEREVLWV  173

Query: 174  ETSLDTMSSGEHDLVKVNIIRPTTEHTIPTMMTASPYHQGINDPAADQKTYQMEGALAVK  233
            E+ +D+   GE+DL+K+ IIRP +    +P +MTASPYH GIND A D    + M   L  K
Sbjct: 174  ESPVDSEQRGENDLIKIQIIRPKSTEKLPVVMTASPYHLGINDKANDLALHDMNVELEEK  233

Query: 234  QPKHIQVDTKPFKEEVKHPSKLPI-SPATESFTHIDSYSLNDYFLSRGFANIYVSGVGTA  292
                 I V+  K    ++         +LPI     A    FTH  +YSLNDYFL+RGFA+IYV+GVGT
Sbjct: 234  TSHEIHVEQKLPQKLSAKAKELPIVDKAPYRFTHGWTYSLNDYFLTRGFASIYVAGVGTR  293

Query: 293  GSTGFMTSGDYQQIQSFKAVIDWLNGKVTAFTSHKRDKQVKANWSNGLVATTGKSYLGTM  352
              S GF TSGDYQQI S  AVIDWLNG+   A+TS K+   ++KA+W+NG VA TGKSYLGTM
Sbjct: 294  SSDGFQTSGDYQQIYSMTAVIDWLNGRARAYTSRKKTHEIKASWANGKVAMTGKSYLGTM  353

Query: 353  STGLATTGVEGLKVIIAEAAISTWYDYYRENGLVCSPGGYPGEDLDVLTELTYSRNLLAG  412
            +  G ATTGVEGL+VI+AEA  IS+WY+YYRENGLV SPGG+PGEDLDVL   LTYSRNL
Sbjct: 354  AYGAATTGVEGLEVILAEAGISSWYNYYRENGLVRSPGGFPGEDLDVLAALTYSRNLDGA  413

Query: 413  DYIKNNDCYQALLNEQSKAIDRQSGDYNQYWHDRNYLTHVNNVKSRVVYTHGLQDWNVKP  472
            D++K N  Y+  L E +A +DR+SGDYNQ+WHDRNYL + +  VK+  V+   HGLQDWNV P
Sbjct: 414  DFLKGNAEYEKRLAEMTAALDRKSGDYNQFWHDRNYLINTDKVKADVLIVHGLQDWNVTP  473
```

```
Query: 473  RHVYKVFNALPQTIKKHLFLHQGQHVYMHNWQSIDFRESMNALLSQELLGIDNHFQLEEV  532
              Y  + ALP+     KH FLH+G H+YM++WQSIDF E++NA      +LL  D +  L  V
Sbjct: 474  EQAYNFWKALPEGHAKHAFLHRGAHIYMNSWQSIDFSETINAYFVAKLLDRDLNLNLPPV  533

Query: 533  IWQDNTTEQTWQVLDAFGGNHQEQIGLGD---SKKLIDNHYDKEAFDTYCKDFNVFKNDL  589
            I Q+N+ +Q W +++ FG N Q ++ LG     S    DNHYD  E  F  Y KDFNVFK DL
Sbjct: 534  ILQENSKDQVWTMMNDFGANTQIKLPLGKTAVSFAQFDNHYDDETFKKYSKDFNVFKKDL  593

Query: 590  FKGNNKTNQITINLPLKKNYLLNGQCKLHLRVKTSDKKAILSAQILDYGPKKRFKDTPTI  649
            F+   NK N+   I+L L       +NG   +L LR+K +D K  LSAQILD+G KKR  +D      +
Sbjct: 594  FE--NKANEAVIDLELPSMLTINGPVELELRLKLNDTKGFLSAQILDFGQKKRLEDKARV  651

Query: 650  KFLNSLDNGKNFAREALRELPPFTKDHYRVISKGVLNLQNRTDLLTIEAIEPEQWFDIEFS  709
            K       LD G+NF   + L ELP  +   Y++I+KG  NLQN+ +LLT+  ++  ++WF I+F
Sbjct: 652  KDFKVLDRGRNFMLDDLVELPLVESPYQLITKGFTNLQNQ-NLLTVSDLKADEWFTIKFE  710

Query: 710  LQPSIYQLSKGDNLRIILYTTDFEHTIRDNASYSITVDLSQSYLTIP              756
            LQP+IY L K D LR+ILY+TDFEHT+RDN     +   +DLSQS  L IP
Sbjct: 711  LQPTIYHLEKADKLRVILYSTDFEHTVRDNRKVTYEIDLSQSKLIIP              757
```

A related DNA sequence was identified in *S. pyogenes* <SEQ ID 4991> which encodes the amino acid sequence <SEQ ID 4992>. Analysis of this protein sequence reveals the following:

Possible site: 16
>>> Seems to have no N-terminal signal sequence

----- Final Results -----
bacterial cytoplasm --- Certainty = 0.2553 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 481/758 (63%), Positives = 587/758 (76%), Gaps = 4/758 (0%)
Query:   1  MRYNQFSYIPTKPNEAFEELKGLGFPLNKKNSDKANLEAFLRHSFLNQTDTDYALSLLIV   60
            MRYNQFSYIPT    A  EELK LGF L+ + +   KA+LE+FLR   F  +  D+Y LS LI
Sbjct:   1  MRYNQFSYIPTSLERAAEELKELGFDLDLQKTAKASLESFLRKLFFHYPDSDYPLSHLIA   60

Query:  61  DAKTDALTFFKSNSDLTLENLQWIYLQLLGFIPFVDFKDPKAFLQDINFPVSYDN--IFQ  118
                DAL+FF+S  +L+ E    + LQ+LGFIP VDF +  AFL   +FP+ +D    I +
Sbjct:  61  KNDMDALSFFQSEQELSKEVFDLLALQVLGFIPGVDFTEADAFLDKLAFPIHFDETEIIK  120

Query: 119  SLHHLLACRGKSGNTLIDQLVADGLLHADNHYHFFNGKSLATFNTNQLIREVVYVETSLD  178
             +HHLLA R KSG M LID LV+ G+L  DN YHFFNGKSLATF+T+QLIREVVYVE  LD
Sbjct: 121  HIHHLLATRCKSGMTLIDDLVSQGMLTMDNDYHFFNGKSLATFDTSQLIREVVYVEAPLD  180

Query: 179  TMSSGEHDLVKVNIIRPTTEHTIPTMMTASPYHQGINDPAADQKTYQMEGALAVKQPKHI  238
            T    G+  DL+KVNIIRP ++   +PT+MT SPYHQGIN+ A D+K Y+ME  L VK+ + I
Sbjct: 181  TDQDGQLDLIKVNIIRPQSQKPLPTLMTPSPYHQGINEVANDKKLYRMEKELVVKKRRQI  240

Query: 239  QVDTKPFKEEVKHPSKLPISPATESFTHIDSYSINDYFLSRGFANIYVSGVGTAGSTGFM  298
             V+ +  F       P KLPI     ESF++I++SYSINDYFL+RGFANIYVSGVGTAGSTGFM
Sbjct: 241  TVEDRDFIPLETQPCKLPIGQNLESFSYINSYSINDYFLARGFANIYVSGVGTAGSTGFM  300

Query: 299  TSGDYQQIQSFKAVIDWLNGKVTAFTSHKRDKQVKANWSNGLVATTGKSYLGTMSTGLAT  358
            TSG+Y QI SFKAVIDWLNG+ TA+TSH    QV+A+W+NGLV TTGKSYLGTMSTGLAT
Sbjct: 301  TSGNYAQIESFKAVIDWLNGRATAYTSHSKTHQVRADWANGLVCTTGKSYLGTMSTGLAT  360

Query: 359  TGVEGLKVIIAEAAISTWYDYYRENGLVCSPGGYPGEDLDVLTELTYSRNLLAGDYIKNN  418
            TGV+GL  +IIAE+AIS+WY+ YYRENGLVCSPGGYPGEDLDV+TELTYSRNLLAGDY+++N
Sbjct: 361  TGVDGLAMIIAESAISSWYNYYRENGLVCSPGGYPGEDLDVLTELTYSRNLLAGDYLRHN  420

Query: 419  DCYQALLNEQSKAIDRQSGDYNQYWHDRNYLTHVNNVKSRVVYTHGLQDWNVKPRHVYKV  478
            D YQ LLN+QS+A+DRQSGDYNQ+WHDRNYL + +  +K  VVYTHGLQDWNVKPR VY++
Sbjct: 421  DRYQELLNQQSQALDRQSGDYNQFWHDRNYLKNAHQIKCDVVYTHGLQDWNVKPRQVYEI  480

Query: 479  FNALPQTIKKHLFLHQGQHVYMHNWQSIDFRESMNALLSQELLGIDNHFQLEEVIWQDNT  538
            FNALP  TI  KHLFLHQG+HVYMHNWQSIDFRESMNALL Q+LLG+  N F L E+IWQDNT
Sbjct: 481  FNALPSTINKHLFLHQGEHVYMHNWQSIDFRESMNALLCQKLLGLANDFSLPEMIQWDNT  540

Query: 539  TEQTWQVLDAFGGNHQEQIGLGDSKKLIDNHYDKEAFDTYCKDFNVFKNDLFKGNNKTNQ  598
              Q  WQ      FG +  +++ LG      LIDNHY ++   F  Y KDF  FK  LFKG   K  NQ
Sbjct: 541  CPQNWQERKVFGTSTIKELDLGQELLLIDNHYGEDEFKAYGKDFRAFKAALFKG--KANQ  598

Query: 599  ITINLPLKKNYLLNGQCKLHLRVKTSDKKAILSAQILDYGPKKRFKDTPTIKFLNSLDNG  658
             I++   L+++    +NG+   L  L+VK+S+ K  +LSAQILDYG KKR  D   P    +S+DNG
Sbjct: 599  ALIDILLEEDLPINGEIVLQLKVKSSENKGLLSAQILDYGKKKRLGDLPIALTQSSIDNG  658
```

```
Query: 659  KNFAREALRELPFTKDHYRVISKGVLNLQNRTDLLTIEAIEPEQWFDIEFSLQPSIYQLS  718
            +NF+RE L+ELPF +D YRVISKG +NLQNR +L +IE I   +W    LQP+IY L
Sbjct: 659  QNFSREPLKELPFREDSYRVISKGFMNLQNRNNLSSIETIPNNKWMTVRLPLQPTIYHLE  718

Query: 719  KGDNLRIILYTTDFEHTIRDNASYSITVDLSQSYLTIP                       756
            KGD LR+ILYTTDFEHT+RDN++Y++T+DLSQS L +P
Sbjct: 719  KGDTLRVILYTTDFEHTVRDNSNYALTIDLSQSQLIVP                       756
```

Based on this analysis, it was predicted that these proteins and their epitopes could be useful antigens for vaccines or diagnostics.

Example 1618

A DNA sequence (GBSx1713) was identified in *S. agalactiae* <SEQ ID 4993> which encodes the amino acid sequence <SEQ ID 4994>. This protein is predicted to be PrfA. Analysis of this protein sequence reveals the following:

```
Possible site: 54
>>> Seems to have no N-terminal signal sequence
----- Final Results -----
    bacterial cytoplasm --- Certainty = 0.3976 (Affirmative) <succ>
      bacterial membrane --- Certainty = 0.0000 (Not Clear) <succ>
       bacterial outside --- Certainty = 0.0000 (Not Clear) <succ>
```

A related GBS nucleic acid sequence <SEQ ID 10125> which encodes amino acid sequence <SEQ ID 10126> was also identified.

The protein has homology with the following sequences in the GENPEPT database.

A related DNA sequence was identified in *S. pyogenes* <SEQ ID 4995> which encodes the amino acid sequence <SEQ ID 4996>. Analysis of this protein sequence reveals the following:

```
Possible site: 13
>>> Seems to have no N-terminal signal sequence
----- Final Results -----
    bacterial cytoplasm --- Certainty = 0.4088 (Affirmative) <succ>
      bacterial membrane --- Certainty = 0.0000 (Not Clear) <succ>
       bacterial outside --- Certainty = 0.0000 (Not Clear) <succ>
```

```
>GP:CAA65740 GB:X97014 PrfA [Listeria seeligeri]
Identities = 54/181 (29%), Positives = 95/181 (51%), Gaps = 1/181 (0%)
Query:  38  DYTYILKDGIVKQSVLSKYGTEFNLRYVTGLEITSILNTDYSQHMGEPYNVRIESETAHF   97
            +Y    L +G+ K + +S+ G    NL+Y  G I     D  + +G  YN+ + SE A
Sbjct:  36  EYCIFLHEGVAKLTSISESGDILNLQYYKGAFIIMTGFIDTEKSLGY-YNLEVVSEQAAA   94

Query:  98  YKVRRSTFLKDINNDIELQGYVKDFYHNRLEKSMKKMQCMLTNGRIGAISTQLYDLSKMF  157
            Y ++ S   + ++ D++     Y+ D       ++  S+ K       +NG++G+I Q     L+ ++
Sbjct:  95  YIIKISDLKELVSKDLKQLFYIIDTLQKQVSYSLAKFNDFSSNGKVGSICGQFLILAYVY  154

Query: 158  GEERDNGDIYINFVITNEELGKFCGISTGSSVSRILKQLKDDHIIRIEKQHIIITNVEKLK  218
            GEE  NG         +T +ELG  GI+  S+VSRI+ +LK +++I  +   + I N+   LK
Sbjct: 155  GEETPNGIKITLEKLTMQELGCSSGIAHSSAVSRIISKLKQENVIEYKDSYFYIKNIAYLK  215
```

An alignment of the GAS and GBS proteins is shown below.

```
Identities = 186/223 (83%), Positives = 203/223 (90%)
Query:   1  MEEVMNHQILQNYINSHNLPIIEKDYHKYLTFESLEEDYTYILKDGIVKQSVLSKYGTEF   60
            +E+ +NH ILQ  YI++HN PIIEK YHKYLTFESLEED+TYILKDGIVKQSVLSKYG EF
Sbjct:  17  LEKSVNHHILQRYIDNHNFPIIEKSYHKYLTFESLEEDFTYILKDGIVKQSVLSKYGMEF   76

Query:  61  NLRYVTGLEITSILNTDYSQHMGEPYNVRIESETAHFYKVRRSTFLKDINNDIELQGYVK  120
            NLRYVTGLEITS+LNT YS+ MGEPYNVRIESE A FYKVRRS FLKDIN DIELQGYVK
Sbjct:  77  NLRYVTGLEITSVLNTGYSKDMGEPYNVRIESEKASFYKVRRSAFLKDINEDIELQGYVK  136

Query: 121  DFYHNRLEKSMKKMQCMLTNGRIGAISTQLYDLSKMFGEERDNGDIYINFVITNEELGKF  180
            DFYHNRL+KSMKKMQCMLTNGRIGAISTQ+YDL  +FGEE  NG I INFVITNEELGKF
Sbjct: 137  DFYHNRLQKSMKKMQCMLTNGRIGAISTQIYDLMTLFGEELPNGQILINFVITNEELGKF  196

Query: 181  CGISTGSSVSRILKQLKDDHIIRIEKQHIIITNVEKLKDHIVF                 223
            CGIST SSVSRILKQLK+ +IIRI+KQHIIITN++KLKD+IVF
Sbjct: 197  CGISTASSVSRILKQLKEKNIIRIDKQHIIITNLDKLKDNIVF                 239
```

Based on this analysis, it was predicted that these proteins and their epitopes could be useful antigens for vaccines or diagnostics.

Example 1619

A DNA sequence (GBSx1714) was identified in *S. agalactiae* <SEQ ID 4997> which encodes the amino acid sequence <SEQ ID 4998>. Analysis of this protein sequence reveals the following:

```
Possible site: 46
>>> Seems to have an uncleavable N-term signal seq
INTEGRAL    Likelihood = -14.33   Transmembrane 167-183 (159-193)
INTEGRAL    Likelihood = -7.96    Transmembrane 18-34 (10-37)
INTEGRAL    Likelihood = -7.75    Transmembrane 373-389 (369-392)
INTEGRAL    Likelihood = -5.68    Transmembrane 214-230 (212-234)
INTEGRAL    Likelihood = -4.78    Transmembrane 243-259 (241-262)
INTEGRAL    Likelihood = -2.71    Transmembrane 48-64 (47-65)
INTEGRAL    Likelihood = -2.60    Transmembrane 283-299 (283-300)
----- Final Results -----
    bacterial membrane --- Certainty = 0.6731 (Affirmative) <succ>
       bacterial outside --- Certainty = 0.0000 (Not Clear) <succ>
          bacterial cytoplasm --- Certainty = 0.0000 (Not Clear) <succ>
```

The protein has homology with the following sequences in the GENPEPT database.

A related DNA sequence was identified in *S. pyogenes* <SEQ ID 4999> which encodes the amino acid sequence <SEQ ID 5000>. Analysis of this protein sequence reveals the following:

```
Possible site: 35
>>> Seems to have an uncleavable N-term signal seq
INTEGRAL    Likelihood = -12.31   Transmembrane 202-218 (194-225)
INTEGRAL    Likelihood = -7.80    Transmembrane 53-69 (44-71)
INTEGRAL    Likelihood = -7.17    Transmembrane 407-423 (404-426)
INTEGRAL    Likelihood = -5.26    Transmembrane 249-265 (247-269)
INTEGRAL    Likelihood = -3.77    Transmembrane 279-295 (276-297)
INTEGRAL    Likelihood = -2.23    Transmembrane 11-27 (10-27)
INTEGRAL    Likelihood = -2.13    Transmembrane 83-99 (82-99)
INTEGRAL    Likelihood = -1.91    Transmembrane 312-328 (311-328)
----- Final Results -----
    bacterial membrane --- Certainty = 0.5925 (Affirmative) <succ>
       bacterial outside --- Certainty = 0.0000 (Not Clear) <succ>
          bacterial cytoplasm --- Certainty = 0.0000 (Not Clear) <succ>
```

```
>GP:CAB15662 GB:Z99122 similar to antibiotic resistance protein
[Bacillus subtilis]
Identities = 106/401 (26%), Positives = 199/401 (49%), Gaps = 21/401 (5%)
Query:     3 DKLFNKHFIGITILNFIVYMVYYLFTVIIAFIATKELGVSTSQAGLATGIYIVGTLIARL    62
             D ++ K FI + ++N  V++ +Y F  ++     +ELG + SQ GL    ++++   +I R
Sbjct:     5 DAIWTKDFIMVLLVNLFVFVFFYTFLTVLPIYTLQELGGTESQGGLLISLFLLSAIITRP    64

Query:    63 IFGKQLEVLGRKLVLRGGAIFYLLTTLAYFYMPSIGVMYLVRFLNGFGYGVVSTATNTIV   122
              G  +E  G+K +     +  L++  Y +  ++   +RF  G   + +++T  T   I
Sbjct:    65 FSGAIVERFGKKRMAIVSMALFALSSFLYMPIHNFSLLLGLRFFQGIWFSILTTVTGAIA   124

Query:   123 TAYIPADKRGEGINFYGLSTSLAAAIGPFVGIFMLDNLHINFKMVIVLCSILIAIVVLGA   182
                 IPA +RGEG+ ++ +S +LA  AIGPF+G  ++      ++F +      ++ +   +L +
Sbjct:   125 ADIIPAKRRGEGLGYFAMSMNLAMAIGPFLGLNLMRV--VSFPVFFTAFALFMVAGLLVS   182

Query:   183 FVFPVKNITLNPEQLAKSKSWTIDSF-----IEKKAIFITIIAFLMGISYASVLGFQKLY   237
             F+  V          +K    T+  F       EK A+ I  +      Y++V   +   ++
Sbjct:   183 FLIKVPQ--------SKDSGTTVFRFAFSDMFEKGALKIATVGLFISFCYSTVTSYLSVF   234

Query:   238 TTEINLMTVGAYFFIVYALVITLTRPSMGRLMDAKGDKWVLYPSYLFLTLGLALLGSAMG   297
                ++L  +   YFF+ +A+ + +  RP   G+L  D  G         V+YPS L    ++GL +L
Sbjct:   235 AKSVDLSDISGYFFVCFAVTMMIARPFTGKLFDKVGPGIVIYPSILIFSVGLCMLSFTHS   294

Query:   298 SVTYLLSGALIGFGYGTFMSCGQAASIKGVEEHRFNTAMSTYMIGLDLGLGAGPYILGLV   357
             +   LLSGA+IG GYG+ + C Q   +I+     HR   A +T+       D G+   G Y+ GL
Sbjct:   295 GLMLLLSGAVIGLGYGSIVPCMQTLAIQKSPAHRSGFATATFFTFFDSGIAVGSYVFGL-   353

Query:   358 KDGFLGAGVQSFRELFWIAAIIPVVCGILYFLKSSRQVETK                     398
             F+ +     F  ++  A +  ++   +LY      +  E +
Sbjct:   354 ---FVASA--GFSAIYLTAGLFVLIALLLYTWSQKKPAEAE                     389
```

The protein has homology with the following sequences in the databases:

```
>GP:CAB15662 GB:Z99122 similar to antibiotic resistance protein
[Bacillus subtilis]
Identities = 110/390 (28%), Positives = 194/390 (49%), Gaps = 11/390 (2%)
Query:    38 EKLFNKHFVAITVINFIVYMVYYLFTVIIAFVATRELGAQTSQAGLATGIYILGTLLARL    97
             + ++ K F+ + ++N  V++ +Y F  ++        +ELG    SQ GL    +++L  ++ R
Sbjct:     5 DAIWTKDFIMVLLVNLFVFVFFYTFLTVLPIYTLQELGGTESQGGLLISLFLLSAIITRP    64

Query:    98 IFGKQLEVFGRRLVLRGGAIFYLLTTLAYFYMPTISMMYLVRFLNGFGYGVVSTATNTIV   157
```

-continued
```
                G  +E FG++ +            + L++  Y  +    S++  +RF  G   + +++T T   I
Sbjct:  65 FSGAIVERFGKKRMAIVSMALFALSSFLYMPIHNFSLLLGLRFFQGIWFSILTTVTGAIA 124

Query: 158 TAYIPARKRGEGINFYGLSTSLAAAIGPFVGTFMLDNLHIDFRMIIVLCSVLIGCVVVGA 217
               IPA++RGEG+ ++ +S +LA AIGPF+G  ++     + F +    ++ +   ++ +
Sbjct: 125 ADIIPAKRRGEGLGYFAMSMNLAMAIGPFLGLNLMRV--VSFPVFFTAFALFMVAGLLVS 182

Query: 218 FAFPVKNMSLNAEQLAKTKSWTVDSFIEKKALFITAIAFLMGIAYASVLGFQKLYTSEIH 277
            F   V    +   + +         EK AL I  +  +  Y++V  +  ++      +
Sbjct: 183 FLIKVPQSKDSGTTVFR---FAFSDMFEKGALKIATVGLFISFCYSTVTSYLSVFAKSVD 239

Query: 278 LTTVGAYFFVVYALIITITRPAMGRLMDAKGDKWVLYPSYLFLAMGLFLLGSVSSGGSYL 337
            L+ +   YFFV +A+ + I RP  G+L D  G     V+YPS L  ++GL +L   SG    L
Sbjct: 240 LSDISGYFFVCFAVTMMIARPFTGKLFDKVGPGIVIYPSILIFSVGLCMLSFTHSGLMLL 299

Query: 338 LSGALIGFGYGTFMSCGQAASIQGVDEHRFNTAMSTYMIGLDLGLGAGPYLLGLIKDLAL 397
            LSGA+IG GYG+ + C Q  +IQ      HR    A +T+     D G+   G Y+ GL
Sbjct: 300 LSGAVIGLGYGSIVPCMQTLAIQKSPAHRSGFATATFFTFFDSGIAVGSYVFGLF----- 354

Query: 398 GSGVASFRHLFWLAAVIPLICTLLYLLKTK                               427
                  A F ++  A + LI   LLY   K
Sbjct: 355 -VASAGFSAIYLTAGLFVLIALLLYTWSQK                               383
```

20

An alignment of the GAS and GBS proteins is shown below.

```
Identities = 328/396 (82%), Positives = 370/396 (92%), Gaps = 1/396 (0%)
Query:   1 MEDKLFNKHFIGITILNFIVYMVYYLFTVIIAFIATKELGVSTSQAGLATGIYIVGTLIA  60
           ME+KLFNKHF+ IT++NFIVYMVYYLFTVIIAF+AT+ELG   TSQAGLATGIYI+GTL+A
Sbjct:  36 MEEKLFNKHFVAITVINFIVYMVYYLFTVIIAFVATRELGAQTSQAGLATGIYILGTLLA  95

Query:  61 RLIFGKQLEVLGRKLVLRGGAIFYLLTTLAYFYMPSIGVMYLVRFLNGFGYGVVSTATNT 120
           RLIFGKQLEV GR+LVLRGGAIFYLLTTLAYFYMP+I +MYLVRFLNGFGYGVVSTATNT
Sbjct:  96 RLIFGKQLEVFGRRLVLRGGAIFYLLTTLAYFYMPTISMMYLVRFLNGFGYGVVSTATNT 155

Query: 121 IVTAYIPADKRGEGINFYGLSTSLAAAIGPFVGTFMLDNLHINFKMVIVLCSILIAIVVL 180
           IVTAYIPA KRGEGINFYGLSTSLAAAIGPFVG+FMLDNLHI+F+M+IVLCS+LI  VV+
Sbjct: 156 IVTAYIPARKRGEGINFYGLSTSLAAAIGPFVGIFMLDNLHIDFRMIIVLCSVLIGCVVV 215

Query: 181 GAFVFPVKNITLNPEQLAKSKSWIIDSFIEKKAIFITIIAFLMGISYASVLGFQKLYTTE 240
           GAF FPVKN++LN EQLAK+KSWT+DSFIEKKA+FIT IAFLMGI+YASVLGFQKLYT+E
Sbjct: 216 GAFAFPVKNMSLNAEQLAKIKSWTVDSFIEKKALFITAIAFLMGIAYASVLGFQKLYTSE 275

Query: 241 INLMTVGAYFFIVYALVITLTRPSMGRLMDAKGDKWVLYPSYLFLTLGLALLGSAMGSVT 300
           I+L TVGAYFF+VYAL+IT+TRP+MGRLMDAKGDKWVLYPSYLFL +GL LLGS     +
Sbjct: 276 IHLTTVGAYFFVVYALIITITRPAMGRLMDAKGDKWVLYPSYLFLAMGLFLLGSVSSGGS 335

Query: 301 YLLSGALIGFGYGTFMSCGQAASIKGVEEHRFNTAMSTYMIGLDLGLGAGPYILGLVKDG 360
           YLLSGALIGFGYGTFMSCGQAASI+GV EHRFNTAMSTYMIGLDLGLGAGPY+LGL+KD
Sbjct: 336 YLLSGALIGFGYGTFMSCGQAASIQGVDEHRFNTAMSTYMIGLDLGLGAGPYLLGLIKDL 395

Query: 361 FLGAGVQSFRELFWIAAIIPVVCGILYFLKS-SRQV                         395
           L +GV SFR LFW+AA+IP++C +LY LK+ +RQV
Sbjct: 396 ALGSGVASFRHLFWLAAVIPLICTLLYLLKTKTRQV                         431
```

A related GBS gene <SEQ ID 8863> and protein <SEQ ID 8864> were also identified. Analysis of this protein sequence reveals the following:

Lipop: Possible site:-1  Crend: 8
McG: Discrim Score: 8.26
GvH: Signal Score (-7.5) :-5.21
Possible site: 46
>>> Seems to have an uncleavable N-term signal sequence
ALOM program count: 7 value: -14.33  threshold: 0.0
INTEGRAL   Likelihood = -14.33  Transmembrane 167-183 (159-193)
INTEGRAL   Likelihood = -7.96   Transmembrane 18-34 (10-37)
INTEGRAL   Likelihood = -7.75   Transmembrane 373-389 (369-392)
INTEGRAL   Likelihood = -5.68   Transmembrane 214-230 (212-234)
INTEGRAL   Likelihood = -4.78   Transmembrane 243-259 (241-262)
INTEGRAL   Likelihood = -2.71   Transmembrane 48-64 (47-65)
INTEGRAL   Likelihood = -2.60   Transmembrane 283-299 (283-300)
PERIPHERAL Likelihood = 0.69    341
modified ALOM score: 3.37
*** Reasoning Step: 3
----- Final Results -----
   bacterial membrane --- Certainty = 0.6731 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the databases:

```
ORF01003(307-1494 of 1800)
EGAD|108032|BS3640(5-389 of 396) hypothetical protein {Bacillus subtilis}
GP|1684651|emb|CAB05383.1||Z82987 unknown similar to quinolon resistance
protein NorA {Bacillus subtilis} GP|2636170|emb|CAB15662.1||Z99122
similar to antibiotic resistance protein {Bacillus subtilis} PIR|B70065|870065
antibiotic resistance protein homolog ywoG-Bacillus subtilis
% Match = 14.9
% Identity = 26.3 % Similarity = 53.4
Matches = 102 Mismatches = 178 Conservative Sub.s = 105

204       234       264       294       324       354       384       414
TTLTFVNAV*Y*HLYYTIEISYLLIFL*NVYENEIEKKEPFALEDKLFNKHFIGITILNFIVYMVYYLFTVIIAFIATKE
                                  |  ::  |  ||  :  ::|: |:::| |  ::       :|
                                  MKKADAIWTKDFIMVLLVNLFVFVFFYTFLTVLPIYTLQE
                                           10        20        30        40

444       474       504       534       564       594       624       654
LGVSTSQAGLATGIYIVGTLIARLIFGKQLEVLGRKLVLRGGAIFYLLTTLAYFYMPSIGVMYLVRFLNGFGYGVVSTAT
|| : || ||     ::::   :|  |     |:| :|:|  :       :: |:::  |  :  ::    :||:  |   :  :::||  |
LGGTESQGGLLISLFLLSAIITRPFSGAIVERFGKKRMAIVSMALFALSSFLYMPIHNFSLLLGLRFFQGIWFSILTTVT
        50        60        70        80        90       100       110       120

684       714       744       774       804       834       864       894
NTIVTAYIPADKRGEGINFYGLSTSLAAAIGPFVGTFMLDNLHINFKMVIVLCSILIAIVVLGAFVFPVKNITLNPEQLA
|       |||  :: :|  :||   ||||||:|    ::       ::|    :::|    |      |:|  |    |:
GAIAADIIPAKRRGEGLGYFAMSMNLAMAIGPFLGLNLM--RVVSFPVFFTAFALFMVAGLLVSFLIKVPQSKDSGTTVF
       130       140       150       160       170       180       190

924       954       984      1014      1044      1074      1104      1134
KSKSWTIDSFIEKKAIFITIIAFLMGISYASVLGFQKLYTTEINLMTVGAYFFIVYALVITLTRPSMGRLMDAKGDKWVL
:   :       || |: |  : :::       |::|   :   ::|   :    ||| :|: : ||   |:|     |    |:
R---FAFSDMFEKGALKIATVGLFISFCYSTVTSYLSVFAKSVDLSDISGYFFVCFAVTMMIARPFTGKLFDKVGPGIVI
          210       220       230       240       250       260       270

1164      1194      1224      1254      1284      1314      1344      1374
YPSYLFLTLGLALLGSAMGSVTYLLSGALIGFGYGTFMSCGQAASIKGVEEHRFNTAMSTYMIGLDLGLGAGPYILGLVK
|||  |   :::||   :|          :    ||||||:||:|||: :  |       |:        ||     |   |:    :|  |:     |  |::||
YPSILIFSVGLCMLSFTHSGLMLLLSGAVIGLGYGSIVPCMQTLAIQKSPAHRSGFATATFFTFFDSGIAVGSYVFGL--
        290       300       310       320       330       340       350

1404      1434      1464      1494      1524      1554      1584      1614
DGFLGAGVQSFRELFWIAAIIPVVCGILYFLKSSRQVETKTI*KGGIKL*HKNMSCFLLLLMGLTSQNWR*KKG*MLLFV
    |   ::    |   :   | ::   ||         :    |:
----FVASAGFSAIYLTAGLFVLIALLLYTWSQKKPAEAEGKVSIAE
        360       370       380       390
```

Based on this analysis, it was predicted that these proteins and their epitopes could be useful antigens for vaccines or diagnostics.

Example 1620

A DNA sequence (GBSx1715) was identified in *S. agalactiae* <SEQ ID 5001> which encodes the amino acid sequence <SEQ ID 5002>. Analysis of this protein sequence reveals the following:

Possible site: 46
>>> Seems to have no N-terminal signal sequence
----- Final Results -----
    bacterial cytoplasm --- Certainty = 0.0151 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database.

```
>GP:BAB06903 GB:AP001518 unknown conserved protein [Bacillus halodurans]
Identities = 52/143 (36%), Positives = 84/143 (58%)
Query:   5 YERILIAIDGSYESELAVEKGINVALRNDAELLLTHVIDAHAYQSEGVFSDYVFDRQEQE   64
           Y  IL+A+DGS +++ A+ K  N A    A+L + HVID+ ++ +    +  V    E +
Sbjct:   2 YNHILVAVDGSTQAKRALYKAFNYAKEFKADLFICHVIDSRSFATVEQYDRTVVGAAELD   61

Query:  65 SADVLAYFEKLAHSKGLTKIKKITEIGNPKTLLAKDIPIREKADLIMVGATGLNTFERLL  124
           +L  + + A    G+ K+   I + G+PK    ++K I  +   DLI+ GATGLN   ER L
Sbjct:  62 GKKLLQRYSEEAEKAGVDKVHTILDFGSPKANISKTIAQKYDIDLIITGATGLNAVERFL  121

Query: 125 IGSTSEYILRHSKVDMLVVRDSK                                      147
           +GS SE + RH+K D+L+VR+ +
Sbjct: 122 MGSVSESVARHAKCDVLIVRNDQ                                      144
```

There is also homology to SEQ ID 3658:

```
Identities = 105/150 (70%), Positives = 121/150 (80%)
Query:   1   MTQKYERILIAIDGSYESELAVEKGINVALRNDAELLLTHVIDAHAYQSEGVFSDYVFDR    60
             M+ KY+RIL+AIDGSYESELA  KG+NVALRNDA LLL HVID  A QS   F  Y++++
Sbjct:  31   MSLKYKRILVAIDGSYESELAFNKGVNVALRNDATLLLVHVIDTRALQSVATFDTYIYEK    90

Query:  61   QEQESADVLAYFEKLAHSKGLTKIKKITEIGNPKTLLAKDIPIREKADLIMVGATGLETF   120
              EQE+ DVL  FEK A   G+T IK+I E GNPK LLA DIP RE ADLIMVGATGLNTF
Sbjct:  91   LEQEAKDVLDDFEKQAQIAGITNIKQIIEFGNPKNLLAHDIPDRENADLIMVGATGLNTF   150

Query: 121   ERLLIGSTSEYILRHSKVDMLVVRDSKKTL                                150
             ERLLIGS+SEYI+RH+K+D+LVVRDS KTL
Sbjct: 151   ERLLIGSSSEYIMRHAKIDLLVVRDSTKTL                                180
```

Based on this analysis, it was predicted that this protein and its epitopes, could be useful antigens for vaccines or diagnostics.

Example 1621

A DNA sequence (GBSx1716) was identified in *S. agalactiae* <SEQ ID 5003> which encodes the amino acid sequence <SEQ ID 5004>. This protein is predicted to be glycerol uptake facilitator protein (glpF). Analysis of this protein sequence reveals the following:

```
Possible site: 29
>>> Seems to have an uncleavable N-term signal sequence
INTEGRAL    Likelihood = -8.65   Transmembrane 261-277 (257-281)
INTEGRAL    Likelihood = -5.73   Transmembrane 201-217 (199-222)
INTEGRAL    Likelihood = -4.51   Transmembrane 92-108 (91-110)
INTEGRAL    Likelihood = -4.30   Transmembrane 44-60 (42-62)
INTEGRAL    Likelihood = -2.18   Transmembrane 15-31 (11-31)
INTEGRAL    Likelihood = -1.54   Transmembrane 150-166 (149-166)
----- Final Results -----
    bacteria membrane --- Certainty = 0.4461 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the GENPEPT database.

A related DNA sequence was identified in *S. pyogenes* <SEQ ID 5005> which encodes the amino acid sequence <SEQ ID 5006>. Analysis of this protein sequence reveals the following:

```
Possible site: 16
>>> Seems to have an uncleavable N-term signal sequence
INTEGRAL    Likelihood = -9.18   Transmembrane 293-309 (288-314)
INTEGRAL    Likelihood = -7.43   Transmembrane 2-18 (1-20)
INTEGRAL    Likelihood = -7.38   Transmembrane 233-249 (228-256)
INTEGRAL    Likelihood = -5.57   Transmembrane 124-140 (123-142)
INTEGRAL    Likelihood = -2.87   Transmembrane 76-92 (75-93)
INTEGRAL    Likelihood = -2.18   Transmembrane 47-63 (43-63)
INTEGRAL    Likelihood = -1.54   Transmembrane 182-198 (181-198)
----- Final Results -----
    bacterial membrane --- Certainty = 0.4673 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP:AAA25231 GB:M58315 putative [Lactococcus lactis]
Identities = 183/290 (63%), Positives = 228/290 (78%), Gaps = 10/290 (3%)
Query:   2   IEITWTVKYITEFIATAFLIILGNGAVANVDLKGTKGNNSGWIIIAIGYGLGVMMPALMF    61
             +++TWTVKYITEF+ TA LII+GNGAVANV+LKGTK +    W+II  GYGLGVM+PA+ F Sbjct:   1   MDVTWTVKYITEFVGTALLIIMGNGAVANVELKGTKAHAQSWMIIGWGYGLGVMLPAVAF    60

Query:  62   GNVSGNHINPAFTLGLAFSGLFPWAHVGQYILAQILGAMFGQLVVVMVYQPYFVKTENPN   121
             GN++ +   INPAFTLGLA SGLFPWAHV QYI+AQ+LGAMFGQL++VMVY+PY++KT+NPN
Sbjct:  61   GNIT-SQINPAFTLGLAASGLFPWAHVAQYIIAQVLGAMFGQLLIVMVYRPYYLKTQNPN   119

Query: 122   HVLGSFSTISALDDGQKSSRKAAYINGFLNEFVGSFVLFFGALALTKNYFGVE----LVG   177
              +LG+FSTI +DD  + +R  A INGFLNEF+GSFVLFFGA+A T  +FG +       +
Sbjct: 120   AILGTFSTIDNVDDNSEKTRLGATINGFLNEFLGSFVLFFGAVAATNIFFGSQSITWMTN   179

Query: 178   KLVQAGYDQTTAATRISPYVTGSLA-----VAHLGIGFLVMTLVASLGGPTGPALNPARD   232
                L   G D +++        +V  S A      +AHL +GFLVM LV +LGGPTGP LNPARD
Sbjct: 180   YLKGQGADVSSSDVMNQIWVQASGASASKMIAHLFLGFLVMGLVVALGGPTGPGLNPARD   239

Query: 233   LGPRIVHRLLPKQILGQAKEDSKWWYAWVPVLAPIVASILAVALFKLLYL            282
             GPR+VH LLPK +LG+AK  SKWWYAWVPVLAPI+AS+ AVALFK++YL
Sbjct: 240   FGPRLVHSLLPKSVLGEAKGSSKWWYAWVPVLAPILASLAAVALFKMIYL            289
```

```
>GP:AAA25231 GB:M58315 putative [Lactococcus lactis]
Identities = 176/290 (60%), Positives = 228/290 (77%), Gaps = 10/290 (3%)
Query:  34  MEMTWIVKYITEFIATAFLIILGNGAVANVDLKGTKGHNSGWLVIANGYGLGVMMPALMF   93
            M++TWTVKYITEF+ TA LII+GNGAVANV+LKGTK H    W++I +GYGLGVM+PA+ F
Sbjct:   1  MDVTNTVKYITEFVGTALLIIMGNGAVANVELKGTKAHAQSWMIIGWGYGLGVMLPAVAF   60

Query:  94  GNVSGNHINPAFTVGLAVSGLFPWAHVLQYVVAQLLGAIFGQLVVVMVYKPYFMKTENPN  153
            GN++ + INPAFT+GLA SGLFPWAHV QY++AQ+LGA+FGQL++VMVY+PY++KT+NPN
Sbjct:  61  GNIT-SQINPAFTLGLAASGLFPWAHVAQYIIAQVLGAMFGQLLIVMVYRPYYLKIQNPN  119

Query: 154  HVLGSFSTISSLDNGQKDSHKASYINGFLNEFVGSFVLFFGALALTKNYFGVELVGKLIE  213
             +LG+FSTI ++D+   + +    + INGFLNEF+GSFVLFFGA+A T  +FG + +  +
Sbjct: 120  AILGTFSTIDNVDDNSEKTRLGATINGFLNEFLGSFVLFFGAVAATNIFFGSQSITWMTN  179

Query: 214  ------AGYDQTTAATQISPYVTGSLA---VAHIGIGFLVMVLVTSLGGPTGPALNPARD  264
                  A   +  QI   +G+ A    +AH+ +GFLVM LV +LGGPTGP LNPARD
Sbjct: 180  YLKGQGADVSSSDVMNQIWVQASGASASKMIAHLFLGFLVMGLVVALGGPTGPGLNPARD  239

Query: 265  FGPRLLHHFLPKSVLGQAKGDSKWWYAWVPVVAPILAAIVAVAAFKYLYI            314
            FGPRL+H  LPKSVLG+AKG SKWWYAWVPV+APILA++ AVA FK +Y+
Sbjct: 240  FGPRLVHSLLPKSVLGEAKGSSKWWYAWVPVLAPILASLAAVALFKMIYL            289
```

An alignment of the GAS and GBS proteins is shown below.

```
Identities = 240/281 (85%), Positives = 267/281 (94%)
Query:   2  IEITWTVKYITEFIATAFLIILGNGAVANVDLKGTKGNNSGWIIIAIGYGLGVMMPALMF   61
            +E+TWTVKYITEFIATAFLIILGNGAVANVDLKGTKG+NSGW++IA GYGLGVMMPALMF
Sbjct:  34  MEMTWTVKYITEFIATAFLIILGNGAVANVDLKGTKGHNSGWLVIAFGYGLGVMMPALMF   93

Query:  62  GNVSGNHINPAFTLGLAFSGLFPWAHVGQYILAQILGAMFGQLVVVMVYQPYFVKTENPN  121
            GNVSGNHINPAFT+GLA SGLFPWAHV QY++AQ+LGA+FGQLVVVMVY+PYF+KTENPN
Sbjct:  94  GNVSGNHINPAFTVGLAVSGLFPWAHVLQYVVAQLLGAIFGQLVVVMVYKPYFMKTENPN  153

Query: 122  HVLGSFSTISALDDGQKSSRKAAYINGFLNEFVGSFVLFFGALALTKNYFGVELVGKLVQ  181
            HVLGSFSTIS+LD+GQK S KA+YINGFLNEFVGSFVLFFGALALTKNYFGVELVGKL++
Sbjct: 154  HVLGSFSTISSLDNGQKDSHKASYINGFLNEFVGSFVLFFGALALTKNYFGVELVGKLIE  213

Query: 182  AGYDQTTAATRISPYVTGSLAVAHLGIGFLVMTLVASLGGPTGPALNPARDLGPRIVHRL  241
            AGYDQTTAAT+ISPYVTGSLAVAH+GIGFLVM LV SLGGPTGPALNPARD GPR++H
Sbjct: 214  AGYDQTTAATQISPYVTGSLAVAHIGIGFLVMVLVTSLGGPTGPALNPARDFGPRLLHHF  273

Query: 242  LPKQILGQAKEDSKWWYAWVPVLAPIVASILAVALFKLLYL                    282
            LPK +LGQAK DSKWWYAWVPV+API+A+I+AVA FK LY+
Sbjct: 274  LPKSVLGQAKGDSKWWYAWVPVVAPILAAIVAVAAFKYLYI                    314
```

A related GBS gene <SEQ ID 8865> and protein <SEQ ID 8866> were also identified. Analysis of this protein sequence reveals the following:

Lipop: Possible site: −1    Crend: 8
McG: Discrim Score: 2.81
GvH: Signal Score (−7.5) :−3.6
Possible site: 29
>>> Seems to have an uncleavable N-term signal sequence
ALOM program  count: 6 value:−8.65  threshold: 0.0
INTEGRAL     Likelihood = −8.65    Transmembrane 261-277 (257-281)
INTEGRAL     Likelihood = −5.73    Transmembrane 201-217 (199-222)
INTEGRAL     Likelihood = −4.51    Transmembrane 92-108 (91-110)
INTEGRAL     Likelihood = −4.30    Transmembrane 44-60 (42-62)
INTEGRAL     Likelihood = −2.18    Transmembrane 15-31 (11-31)
INTEGRAL     Likelihood = −1.54    Transmembrane 150-166 (149-166)
PERIPHERAL   Likelihood = 2.92     72
modified ALOM score: 2.23
*** Reasoning Step: 3
----- Final Results -----
    bacterial membrane --- Certainty = 0.4461 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

ORF01006(304-1146 of 1446)
EGAD|14239|14211(1-289 of 289) hypothetical 30.9 kd protein in pepx 5'region
{Lactococcus lactis} SP|P22094|YDP1_LACLC HYPOTHETICAL 30.9 KDA PROTEIN IN PEPX
5'REGION (ORF1).
GP|455286|gb|AAA25206.1||M35865 ORF1 (put.); putative {Lactococcus lactis}
GP|149527|gb|AAA25231.1||M58315 putative {Lactococcus lactis} PIR|B43747|B43747
hypothetical protein (pepXP 5'region)-Lactococcus lactis subsp. cremoris
PIR|B43748|B43748 hypothetical protein (pepX 5'region)-Lactococcus lactis subsp.
lactis -continued

```
% Match = 37.5
% Identity = 64.4  % Similarity = 81.3
Matches = 183 Mismatches = 49 Conservative Sub.s = 48

123       153       183       213       243       273       303       333
*YARSRS***ENLIN*IK*STR*SEPSTLFFIKYIWLKILLILFCDKLYNIKLTW*NG*CCKYFFGRKQGLIEITWTVKYI
                                                                   :::|||||||
                                                                   MDVTWTVKYI
                                                                           10

363       393       423       453       483       513       543       573
TEFIATAPFLIILGNGAVANVDLKGTKGNNSGWIIIAIGYGLGVMMPALMFGNVSGNHINPAFTLGLAFSGLFPWAHVGQY
|||: ||:|||:|||||||||:|||||  :   |:||  ||||||||:||: ::: ::||||||||| |||||||| ||
TEFVGTALLIIMGNGAVANVELKGTKAHAQSWMIIGWGYGLGVMLPAVAFGNIT-SQINPAFTLGLAASGLFPWAHVAQV
          20        30        40        50        60        70        80

603       633       663       693       723       753       783       813
ILAQILGAMFGQLVVVMVYQPYFVKTENPNHVLGSFSTISALDDGQKSSRKAAYINGFLNEFVGSFVLFFGALALTKNYF
|:||:||||||||::||||:|::||:|||  :||:||||   :||  ::|  |  ||||||||:|||||||||:| | :|
IIAQVLGAMFGQLLIVMVYRPYYLKTQNPNAILGTFSTIDNVDDNSEKTRLGATINGFLNEFLGSFVLFFGAVAATNIFF
          100       110       120       130       140       150       160

831       861       885       906       936       966       996       1026
G----VELVGKLVQAGYDQTTA--ATRISPYVTG---SLAVAHLGIGFLVMTLVASLGGPTGPALNPARDLGPRIVHRLL
|     :     |  |   |:: :  :|   :|  : ||| :||||| || :||||||| ||||||||:|||:|| ||
GSQSITWMTNYLKGQGADVSSSDVMNQIWVQASGASASKMIAHLFLGFLVMGLVVALGGPTGPGLNPARDFGPRLVHSLL
          180       190       200       210       220       230       240

1056      1086      1116      1146      1176      1206      1236      1266
PKQILGQAKEDSKWWYAWVPVLAPIVASILAVALFKLLYL**LKKDRFTGLFLF*I*KSASLAS*FRLMMTFGHSFFKGR
|| :||:|| |||||||||||||||:||: |||||::||
PKSVLGEAKGSSKWWYAWVPVLAPILASLAAVALFKMIYL
          260       270       280
```

Based on this analysis, it was predicted that these proteins and their epitopes could be useful antigens for vaccines or diagnostics.

Example 1622

A DNA sequence (GBSx1717) was identified in *S. agalactiae* <SEQ ID 5007> which encodes the amino acid sequence <SEQ ID 5008>. Analysis of this protein sequence reveals the following:

Possible site: 44
>>> Seems to have an uncleavable N-term signal sequence
INTEGRAL    Likelihood = −8.70    Transmembrane 266-282 (262-290)
INTEGRAL    Likelihood = −7.96    Transmembrane 25-41 (24-50)
INTEGRAL    Likelihood = −6.42    Transmembrane 110-126 (105-140)
INTEGRAL    Likelihood = −6.26    Transmembrane 194-210 (190-215)
INTEGRAL    Likelihood = −5.47    Transmembrane 290-306 (289-310)
INTEGRAL    Likelihood = −4.35    Transmembrane 128-144 (127-147)
INTEGRAL    Likelihood = −3.29    Transmembrane 157-173 (156-174)
INTEGRAL    Likelihood = −2.76    Transmembrane 221-237 (221-240)
----- Final Results -----
   bacterial membrane --- Certainty = 0.4482 (Affirmative) <succ>
   bacterial outside --- Certainty = 0.0000 (Not Clear) <succ>
   bacterial cytoplasm --- Certainty = 0.0000 (Not Clear) <succ>

The protein has no significant homology with any sequences in the GENPEPT database.

A related sequence was also identified in GAS <SEQ ID 9177> which encodes the amino acid sequence <SEQ ID 9178>. Analysis of this protein sequence reveals the following:

Possible cleavage site: 21
>>> Seems to have a cleavable N-term signal sequence
INTEGRAL    Likelihood = −10.77    Transmembrane 139-155 (133-161)
INTEGRAL    Likelihood = −8.28     Transmembrane 245-261 (240-269)
INTEGRAL    Likelihood = −7.48     Transmembrane 269-285 (263-289)
INTEGRAL    Likelihood = −7.06     Transmembrane 97-213 (83-125)
INTEGRAL    Likelihood = −6.10     Transmembrane 173-189 (169-194)
INTEGRAL    Likelihood = −1.44     Transmembrane 200-216 (200-217)
----- Final Results -----
   bacterial membrane --- Certainty = 0.531 (Affirmative) <succ>
   bacterial outside --- Certainty = 0.0000 (Not Clear) <succ>
   bacterial cytoplasm --- Certainty = 0.0000 (Not Clear) <succ>

An alignment of the GAS and GBS proteins is shown below.

```
Identities = 225/301 (74%), Positives = 263/301 (86%)
Query:  10    LTVSLFFCRLDIMNETLLLHGIQLILIIAMIITFYQIVRHIRSQKINPFKRFFTGLWIGF    69
              LT  +FFC+L  MNE L+L  IQ +L+ AM+   F+ +V+H++   KINPFKRF+TG WIG
Sbjct:   1    LTAKVFFCKLVFMNEMLILRLIQALLVSAMLFIFFMLVKHLKKNKINPFKRFWTGFWIGL    60

Query:  70    VTDALDTLGIGSFATTTTFFKLTKLVEDDRKIPATMTAAHVLPVLLQSLCFIFVVKVEAL   129
              +TDALDTLGIGSFATTTT FKLTKLV DDR++P TMT  ABVLPVL+QSLCFIFVVKVE L
Sbjct:  61    LTDALDTLGIGSFATTTTCFKLTKLVTDDRQLPGTMTVAHVLPVLIQSLCFIFVVKVEVL   120
```

```
                                -continued
Query: 130 TLITMAGAAFIGAFVGAKMTKNWHAPTVQRILGTLLITAAIIMLYRMITNPGAGISDSVH  189
           TL+ MA AAFIGA+ G  +TKNWHAPTVQRILG+LLI AAIIM+ R+I +PG  +SD++H
Sbjct: 121 TLLAMAAAAFIGAYFGTHITKNWHAPTVQRILGSLLIIAAIIMIIRIIYHPGEHLSDTIH  180

Query: 190 GLHGIWLFVGIGFNFIIGVLMTMGLGNYAPELIFFSLMGLSPAVAMPVMMLDAAMIMTAS  249
           GLHGIWLFVGIGFNFI+GVLMTMGLGNYAPELIFFSLMGLSP VAMPVMMLDAAMIMTAS
Sbjct: 181 GLHGIWLFVGIGFNFIVGVLMTMGLGNYAPELIFFSLMGLSPTVAMPVMMLDAAMIMTAS  240

Query: 250 STQFIKSGRVNWNGFAGLVTGGILGVIVAVLFLTNLDLNSLKTLVVGIVLFTGAMLIRSSF  310
           S+QFIK+ RV+W+GFAG+V+GGI+GV++AV FLTNLD+NSLK LV+ IV FTG MLIRSSF
Sbjct: 241 SSQFIKANRVSWDGFAGIVSGGIIGVLLAVFFLTNLDINSLKLLVIAIVFFTGGMLIRSSF  301
```

A related GBS gene <SEQ ID 8867> and protein <SEQ ID 8868> were also identified. Analysis of this protein sequence reveals the following:

Lipop: Possible site: −1  Crend: 8
McG: Discrim Score: 2.32
GvH: Signal Score (−7.5) :−5.59
Possible site: 44

>>> Seems to have an uncleavable N-term signal sequence
ALOM program count: 8 value:-8.70  threshold: 0.0
INTEGRAL    Likelihood = −8.70  Transmembrane 266-282 (262-290)
INTEGRAL    Likelihood = −7.96  Transmembrane 25-41 (24-50)

Possible site: 33
>>> Seems to have no N-terminal signal sequence
INTEGRAL    Likelihood = −10.77  Transmembrane 151-167 (145-173)
INTEGRAL    Likelihood = −9.13   Transmembrane 22-38 (15-42)
INTEGRAL    Likelihood = −8.28   Transmembrane 257-273 (252-281)
INTEGRAL    Likelihood = −7.48   Transmembrane 281-297 (275-301)
INTEGRAL    Likelihood = −7.06   Transmembrane 109-125 (95-137)
INTEGRAL    Likelihood = −6.10   Transmembrane 185-201 (181-206)
INTEGRAL    Likelihood = −1.44   Transmembrane 212-228 (212-229)
INTEGRAL    Likelihood = −0.27   Transmembrane 5-21 (5-21)
----- Final Results -----
    bacterial membrane --- Certainty = 0.5310 (Affirmative) <succ>
    bacterial outside --- Certainty = 0.0000 (Not Clear) <succ>
    bacterial cytoplasm --- Certainty = 0.0000 (Not Clear) <succ>

An alignment of the GAS and GBS sequences follows:

```
Score = 405 bits (1029), Expect = e-115
Identities = 198/301 (65%), Positives = 228/301 (74%)
Query:   1 LTAKVFFCKLVFMNEMLILRLIQALLVSAMLFIFFMLVKHLKKNKINPFKRFWTGFWIGL   60
           LT +FFC+L  MNE L+L  IQ +L+ AM+  F+ +V+H++  KINPFKRF+TG WIG
Sbjct:  10 LTVSLFFCRLDIMNETLLLHGIQLILIIAMIITFYQIVRHIRSQKINPFKRFFTGLWIGF   69

Query:  61 LTDALDTLGIGSFATTITCFKLTKLVTDDRQLPGTMTVAHVLPVLIQSLCFIFVVKVEVX  120
           +TDALDTLGIGSFATTTT FKLTKLV DDR++P TMT ARVLPVL+QSLCFIFVVKVE
Sbjct:  70 VTDALDTLGIGSFATTTTFFKLTKLVEDDRKIPATMTAAHVLPVLLQSLCFIFVVKVEAL  129

Query: 121 XXXXXXXXXXFIGAYFGTHITKNWHAPTVQRILGSLLXXXXXXXXXXXXXYHPGEHLSDTIH  180
                     FIGA+ G  +TKNWHAPTVQRILG+LL             +PG  +SD++H
Sbjct: 130 TLITMAGAAFIGAFVGAKMTKNWRAPTVQRILGTLLITAAIIMLYRMITNPGAGISDSVH  189

Query: 181 GLHGIWLFVGIGFNFIVGVLMTMGLGNYAPELIFFSLMGLSPTVAMPVMMLDAAMIMTAS  240
           GLHGIWLFVGIGFNFI+GVLMTMGLGNYAPELIFFSLMGLSP VAMPVMMLDAAMIMTAS
Sbjct: 190 GLHGIWLFVGIGFNFIIGVLMTMGLGNYAPELIFFSLMGLSPAVAMPVMMLDAAMIMTAS  249

Query: 241 SSQFIKANRVSWDXXXXXXXXXXXXXXXXXXFFLTNLDINSLKLLVIAIVFFTGGMLIRSSF  301
           S+QFIK+ RV+W+                  FLTNLD+NSLK LV+ IV FTG MLIRSSF
Sbjct: 250 STQFIKSGRVNWNGFAGLVTGGILGVIAVLFLTNLDLNSLKTLVVGIVLFTGAMLIRSSF  310
```

-continued
INTEGRAL    Likelihood = −6.42  Transmembrane 110-126 (105-140)
INTEGRAL    Likelihood = −6.26  Transmembrane 194-210 (190-215)
INTEGRAL    Likelihood = −5.47  Transmembrane 290-306 (289-310)
INTEGRAL    Likelihood = −4.35  Transmembrane 128-144 (127-147)
INTEGRAL    Likelihood = −3.29  Transmembrane 157-173 (156-174)
INTEGRAL    Likelihood = −2.76  Transmembrane 221-237 (221-240)
PERIPHERAL  Likelihood = 3.87   67
modified ALOM score: 2.24
*** Reasoning Step: 3
----- Final Results -----
    bacterial membrane --- Certainty = 0.4482 (Affirmative) <succ>
    bacterial outside --- Certainty = 0.0000 (Not Clear) <succ>
    bacterial cytoplasm --- Certainty = 0.0000 (Not Clear) <succ>

A related DNA sequence was identified in S. pyogenes <SEQ ID 5009> which encodes amino acid sequence <SEQ ID 5010>:

Based on this analysis, it was predicted that these proteins and their epitopes could be useful antigens for vaccines or diagnostics.

Example 1623

A DNA sequence (GBSx1718) was identified in S. agalactiae <SEQ ID 5011> which encodes the amino acid sequence <SEQ ID 5012>. This protein is predicted to be C3-degrading proteinase. Analysis of this protein sequence reveals the following:

Possible site: 45
>>> Seems to have no N-terminal signal sequence
----- Final Results -----
    bacterial cytoplasm --- Certainty = 0.2851 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database.

```
>GP:AAD37110 GB:AF112358 C3-degrading proteinase [Streptococcus pneumoniae]
Identities = 92/240 (38%), Positives = 142/240 (58%), Gaps = 11/240 (4%)
Query:  12   PVLRVNNRDLNIAFYQESLGFKLISEENAIAVFSAWQNKEASFIIEESPTYRTRAVNGTK     71
             P L+ NNR LN  FY E+LG K +  EE+A              E    ++EE+P+ RTR V G K
Sbjct:  11   PTLKANNRKLNETFYIETLGMKALLEESAFLSLGDQTGLE-KLVLEEAPSMRTRKVEGRK      69

Query:  72   KLAKIIVKSQDAKDIEKLLANGAQAIQVYQGQNGYAYETVSPEGDLFLLHAEDDLSQLVA     131
             KLA++IVK ++   +IE +L+        ++Y+GQNGYA+E   SPE  DL  L+HAEDD++  LV
Sbjct:  70   KLARLIVKVENPLEIEGILSKTDSIHRLYKGQNGYAFEIFSPEDDLILIHAEDDIASLVE    129

Query: 132   I-ERPELEKKDDTTGLSNFAFQSISLNVPDAVKAEAFYDKVFAGKFPINLSFKEAQGQDL    190
              + E+PE +      +  LS F   S+ L++P  +  E+F +   + +    +L  F  AQGQDL
Sbjct: 130   VGEKPEFQTDLASISLSKFEI-SMELHLPTDI--ESFLE---SSEIGASLDFIPAQGQDL    183

Query: 191   QIAPNETWDIEILECCVNEDTNLNDLKSTFESLGLDVYLDSKEKILVISDTSNIEIWISK    250
                +     TWD+ +L+   VNE  ++   L+   FES   +  ++    EK  +   D +N+E+W   +
Sbjct: 184   TVDNTVTWDLSMLKFLVNE-LDIASLRQKFES--TEYFIPKSEKFFLGKDRNNVELWFEE    240
```

A related DNA sequence was identified in *S. pyogenes* <SEQ ID 5013> which encodes the amino acid sequence <SEQ ID 5014>. Analysis of this protein sequence reveals the following:

Possible site: 42
>>> Seems to have no N-terminal signal sequence
----- Final Results -----
  bacterial cytoplasm --- Certainty = 0.3267 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

```
Identities = 130/250 (52%), Positives = 177/250 (70%)
Query:   1   MTLFHSLTFKHPVLRVNNRDLNIAFYQESLGFKLISEENAIAVFSAWQNKEASFIIEESP     60
             MTL  ++TFK PVLRVN+RDLNIAFYQ +LG  +L+SEENAIA+FS+W   +    F+IEESP
Sbjct:   1   MTLMENITFKTPVLRVNDRDLNIAFYQNNLGLRLVSEENAIAIFSSWGEGQECFVIEESP     60

Query:  61   TYRTRAVNGTKKLAKIIVKSQDAKDIEKLLANGAQAIQVYQGQNGYAYETVSPEGDLFLL    120
             + RTRAV G KK+  I++K+     K+IE+LLA+GA       +++GQNGYA+ET+SPEGD FLL
Sbjct:  61   SVRTRAVEGPKKVNTIVIKTNQPKEIEQLLAHGAHYDALFKGQNGYAFETISPEGDRFLL    120

Query: 121   HAEDDLSQLVAIERPELEKKDDTTGLSNFAFQSISLNVPDAVKAEAFYDKVFAGKFPINL    180
             HAE D+   L   + P  LEK      GL++ F  F   I LNV   +++AFY  +F+ +  PI +
Sbjct: 121   HAEQDIKHLQGTDLPSLEKDATFKGLTQFKFDIIVLNVISEERSKAFYRDLFSDQLPITM    180

Query: 181   SFKEAQGQDLQIAPNETWDIEILECCVNEDTNLNDLKSTFESLGLDVYLDSKEKILVISD    240
               F + +G DL  I  P+  WD+EILE  V++D ++   LK+T  E  G    VY+D K  K+LV+SD
Sbjct: 181   DFIQEEGPDLAIDPHIAWDLEILEFQVSKDYDMKVLKATLEEDGHKVYIDKKHKVLVLSD    240

Query: 241   TSNIEIWISK    250
              S  IE+W +K
Sbjct: 241   PSQIEVWFTK    250
```

Based on this analysis, it was predicted that these proteins and their epitopes could be useful antigens for vaccines or diagnostics.

Example 1624

A DNA sequence (GBSx1719) was identified in *S. agalactiae* <SEQ ID 5015> which encodes the amino acid sequence <SEQ ID 5016>. Analysis of this protein sequence reveals the following:

Possible site: 31
>>> Seems to have no N-terminal signal sequence
----- Final Results -----
  bacterial cytoplasm --- Certainty = 0.2510 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:CAC16441 GB:AL450165 putative esterase [Streptomyces coelicolor]
Identities = 89/323 (27%), Positives = 143/323 (43%), Gaps = 51/323 (15%)
Query:  10   NTVLELIKEQIKDNLYHGASLAIY-ENGEWHEHYLGT-------IDGNEKVKAGLVYDLA     61
             +T+ EL+ E  +  +  GA+ ++   G        + GT          +DG++    V+DLA
Sbjct:   2   STLAELLAEGREQRICSGAAWSVGGPQGPLDRGWTGTRCWDGPPLDGDD------VWDLA     55
```

-continued

```
Query:   62  SVSKVVGVGTLLAKLVYQGTIDIDKPLRYYYPTFH---HQTLTVRQLATHSSGIDPFIP-     117
             SV+K +   G ++  LV +G + +D  + Y P +      LTVRQL  H+SGI   +P
Sbjct:   56  SVTKPIA-GLVVMALVERGALGLDDTVGGYLPDYRGGDKAELTVRQLLAHTSGIPGQVPL    114

Query:  118  NRDQLNATQLKDAINHIKVLEDKSFK--YTDINFLLLGFMLEEVLGDSLDKLFKRYIFTP    175
             RD      L +A+ + +     + Y+   F++LG + E    G+ L+ L +R +  P
Sbjct:  115  YRDHPTRAALLEAVRLLPLTAQPGTRVQYSSQGFIVLGLIAEAAAGEPLEALVERLVCAP    174

Query:  176  FQMKETSFGPRVEAVPTVVGIND---------GIVHDPKAVLGKHTGSAGLFSTIDDLQ     226
             +++T F P           V   D         G VHD  A VLG   G AGLFST+ D++
Sbjct:  175  LGLRDTVFRPDAGRRARAVATEDCPWRGRRVVGEVHDENAVVLGGVGGHAGLFSTLADME    234

Query:  227  RFSIHYL--------KDDFA-KPLWNNYSLSKSRSLAWD------------IDKDWINHT    265
             R              + FA   + L+ R+LAW                +    HT
Sbjct:  235  RLGAALAAGGRGLLRPETFALMTAAHTDGLALRRALAWQGRDPVGSPAGEVFGPESYGHT    294

Query:  266  GYTGPFIALNYQKQAAAIFLTNR                                        288
             G+TG  + ++    + A+ LTNR
Sbjct:  295  GFTGTSLWVDPATRRYAVLLTNR                                        317
```

A related DNA sequence was identified in *S. pyogenes* <SEQ ID 3885> which encodes the amino acid sequence <SEQ ID 3886>. Analysis of this protein sequence reveals the following:

---

Possible site: 28
>>> Seems to have no N-terminal signal sequence
INTEGRAL Likelihood = −1.33 Transmembrane 57-73 (57-74)
----- Final Results -----
   bacterial membrane --- Certainty = 0.1532 (Affirmative) <succ>
      bacterial outside --- Certainty = 0.0000 (Not Clear) <succ>
         bacterial cytoplasm --- Certainty = 0.0000 (Not Clear) <succ>

---

An alignment of the GAS and GBS proteins is shown below.

Based on this analysis, it was predicted that these proteins and their epitopes could be useful antigens for vaccines or diagnostics.

Example 1625

A DNA sequence (GBSx1720) was identified in *S. agalactiae* <SEQ ID 5017> which encodes the amino acid sequence <SEQ ID 5018>. Analysis of this protein sequence reveals the following:

---

Possible site: 31
>>> Seems to have no N-terminal signal sequence

```
Identities = 174/302 (57%), Positives = 229/302 (75%), Gaps = 1/302 (0%)

Query:    9  TNTVLELIKEQIKDNLYHGASLAIYENGEWHEHYLGTIDGNEKVKAGLVYDLASVSKVVG    68
             T  V++ I+  +    +Y GASLA++++G W E+++GTIDG   V A LVYDLASVSKVVG Sbjct:    6  TLAVIKCIENHLHKKVYKGASLALFQSGRWQEYHIGTIDGRRPVDANLVYDLASVSKVVG    65

Query:   69  VGTLLAKLVYQGTIDIDKPLRYYYPTFHHQTLTVRQLATHSSGIDPFIPNRDQLNATQLK   128
             V T+     L+    GT+ +D PL+ YYP+      T+T+RQL TH+SG+DP+IPNRD LNA QL+
Sbjct:   66  VATICNILLNNGTLALDDPLKVYYPSIADATVTIRQLLTHTSGLDPYIPNRDVLNAQQLR   125

Query:  129  DAINHIKVLEDKSFKYTDINFLLLGFMLEEVLGDSLDKLFKRYIFTPFQMKETSFGPRVE   188
             +A+NH+    E+K+F YTD+NFLLLGFMLEE+   +SLD++F  + IFTPF M   TSFGPR E
Sbjct:  126  KALNHLTQKENKNFYYTDVNFLLLGFMLEELFSESLDQIFDKTIFTPFGMYHTSFGPRPE   185

Query:  189  AVPTVVGINDGIVHDPKAVLGKHTGSAGLFSTIDDLQRFSIHYLKDDFAKPLWNNYSLS    248
             AVPT+  G++DG VHDPKAK+L  KH+GSAGLFST+  DL+ FS  HYL D  F+   LW NYS
Sbjct:  186  AVPTLKGVSDGEVHDPKAKILKKHSGSAGLFSTLADLESFSNHYLNDPFSDCLWRNYSQQ   245

Query:  249  K-SRSLAWDIDKDWINHTGYTGPFIALNYQKQAAAIFLTNRTFSYDDRPLWIKKRRHVQE   307
                RSL W++D DWI+HTGYTGPF+ LN ++Q AAIFLTNRT+  DD+  W+K+R+ +
Sbjct:  246  TIERSLGWNLDGDWISHTGYTGPFLMLNKKEQTAAIFLTNRTYDEDDKSKWLKERQLLYN   305

Query:  308  AI                                                             309
             A+
Sbjct:  306  AL                                                             307
```

----- Final Results -----
   bacterial cytoplasm --- Certainty = 0.0935 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database.

```
>GP:BAA25177 GB:D21804 FMN-binding protein [Desulfovibrio vulgaris]
Identities = 53/124 (42%), Positives = 76/124 (60%), Gaps = 2/124 (1%)
Query: 1    MLNHKFLQVLKYEGVVSITSWIELAPHVTNTWNSYLTITDDQRILAPAAGMTHLENDLNN    60
            ML    F +VLK EGVV+I +  E   PH+ NTWNSYL + D   RI+ P   GM    E ++
Sbjct: 1    MLPGTFFEVLKNEGVVAIATQGEDGPHLVNTWNSYLKVLDGNRIVVPVGGMHKTEANVAR    60

Query: 61   NSKIIMTLGSREVEGRDGYQGTGFRIEGTAKLLEAGSDFEIVKEKYPFLRKVLEVTPINV    120
            + +++MTLGSR+V GR+G  GTGF I G+A       G +FE +  ++ + R  L +T ++
Sbjct: 61   DERVLMTLGSRKVAGRNG-PGTGFLIRGSAAFRTDGPEFEAI-ARFKWARAALVITVVSA    118

Query: 121  IQLL    124
              Q L
Sbjct: 119  EQTL    122
```

No corresponding DNA sequence was identified in *S. pyogenes*.

Based on this analysis, it was predicted that this protein and its epitopes, could be useful antigens for vaccines or diagnostics.

Example 1626

A DNA sequence (GBSx1721) was identified in *S. agalactiae* <SEQ ID 5019> which encodes the amino acid sequence <SEQ ID 5020>. Analysis of this protein sequence reveals the following:

Possible site: 30
>>> Seems to have no N-terminal signal sequence
----- Final Results -----
   bacterial cytoplasm --- Certainty = 0.3799 (Affirmative) <succ>
     bacterial membrane --- Certainty = 0.0000 (Not Clear) <succ>
       bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1627

A DNA sequence (GBSx1722) was identified in *S. agalactiae* <SEQ ID 5021> which encodes the amino acid sequence <SEQ ID 5022>. Analysis of this protein sequence reveals the following:

Possible site: 56
>>> Seems to have no N-terminal signal sequence
----- Final Results -----
   bacterial cytoplasm --- Certainty = 0.3175 (Affirmative) <succ>
     bacterial membrane --- Certainty = 0.0000 (Not Clear) <succ>
       bacterial outside --- Certainty = 0.0000 (Not Clear) <succ>

A related GBS nucleic acid sequence <SEQ ID 10123> which encodes amino acid sequence <SEQ ID 10124> was also identified.

The protein has homology to a pyruvate formate-lyase from *S. mutans*:

```
>GP:BAA09085 GB:D50491 Pyruvate formate-lyase [Streptococcus mutans]
Identities = 709/770 (92%), Positives = 750/770 (97%)
Query: 7    MATVKTNTDIFEQAWEGFKGVDWKEKASIARFVQANYAPYDGDESFLAGATERSLHIKKV    66
            MATVKTNTD+FE+AWEGFKG DWK++ASI+RFVQ NY PYDG ESFLAG TERSLHIKKV
Sbjct: 1    MATVKTNTDVFEKAWEGFKGTDWKDRASISRFVQDNYTPYDGGESFLAGPTERSLHIKKV    60

Query: 67   IEETKAHYEETRFPMDTRVASISELPAGFIDKDNELIFGIQNDELFKLNFMPKGGIRMAE    126
            +EETKAHYEETRFPMDTR+  SI+++PAG+IDK+NELIFGIQNDELFKLNFMPKGGIRMAE
Sbjct: 61   VEETKAHYEETRFPMDTRITSIADIPAGYIDKENELIFGIQNDELFKLNFMPKGGIRMAE    120

Query: 127  TTLKENGYEPDPAVHEIFTKYATTVNDGIFRAYTSNIRRARHAHTVTGLPDAYSRGRIIG    186
            T LKE+GYEPDPAVHEIFTKYATTVNDGIFRAYTSNIRRARHAHTVTGLPDAYSRGRIIG
Sbjct: 121  TALKERGYEPDPAVHEIFTKYATTVNDGIFRAYTSNIRRARHAHTVTGLPDAYSRGRIIG    180

Query: 187  VYARLAVYGADYLMQEKVNDWNALNDIDEESIRLREEINLQYQALGEVVKLGDLYGVDVR    246
            VYARLA+YGADYLMQEKVNDWN++  +IDEESIRLREEINLQYQALGEVV+LGDLYG+DVR
Sbjct: 181  VYARLALYGADYLMQEKVNDWNSIAEIDEESIRLREEINLQYQALGEVVRLGDLYGLDVR    240

Query: 247  KPAMNTKEAIQWVNIAFMAVCRVINGAATSLGRVPIVLDIFAERDLARGTFTESEIQEFV    306
            KPAMN  KEAIQW+NIAFMAVCRVINGAATSLGRVPIVLDIFAERDLARGTFTESEIQEFV
Sbjct: 241  KPANNVEEAIQWINIAFMAVCRVINGAATSLGRVPIVLDIFAERDLARGTFTESEIQEFV    300
```

```
Query:  307  DDFVLKLRTVKFARTKAYDALYSGDPTFITTSMAGMGADGRHRVTKMDYRFLNTLDNIGN  366
             DDFV+KLRTVKFARTKAYD LYSGDPTFITTSMAGMGADGRHRVTKMDYRFLNTLDNIGN
Sbjct:  301  DDFVMKLRTVKFARTKAYDELYSGDPTFITTSMAGMGADGRHRVTKMDYRFLNTLDNIGN  360

Query:  367  SPEPNLTVLWSDQLPYAFRRYCMSMSHKHSSIQYEGVSTMAKEGYGEMSCISCCVSPLDP  426
             +PEPNLTVLWS +LPY+FR YCMSMSHKHSSIQYEGV+TMAKEGYGEMSCISCCVSPLDP
Sbjct:  361  APEPNLTVLWSSKLPYSFRHYCMSMSHKHSSIQYEGVTTMAKEGYGEMSCISCCVSPLDP  420

Query:  427  ENEDKRHNLQYFGARVNVMKALLTGLNGGYDDVHKDYKVFDIDPIRDEVLNFDTVKANFE  486
             ENED+RHNLQYFGARVNV+KALLTGLNGGYDDVHKDYKVFD++PIRDEVL+F+TVKANFE
Sbjct:  421  ENEDRRHNLQYFGARVNVLKALLTGLNGGYDDVHKDYKVFDVEPIRDEVLDFETVKANFE  480

Query:  487  KSLDWLTDTYVDAMNIIHYMTDKYNYEAVQMAFLPSHVRANMGFGICGFANTVDSLSAIK  546
             K+LDWLTDTYVDAMNIIHYMTDKYNYEAVQMAFLP+ V+ANMGFGICGF+NTVDSLSAIK
Sbjct:  481  KALDWLTDTYVDAMNIIHYMTDKYNYEAVQMAFLPTRVKANMGFGICGFSNTVDSLSAIK  540

Query:  547  YATVKPIRDEDGYIYDYETVGDFPRYGEDDDRVDSIAEWLLEAFHGRLAKHKLYKDAEAT  606
             YATVKPIRDEDGYIYDYETVG+FPRYGEDDDRVDSIAEWLLEAFH RLA+HKLYKD+EAT
Sbjct:  541  YATVKPIRDEDGYIYDYETVGNFPRYGEDDDRVDSIAEWLLEAFHTRLARHKLYKDSEAT  600

Query:  607  VSLLTITSNVAYSKQTGNSPVHKGVYLNEDGSVNLSKVEFFSPGANPSNKAKGGWLQNLN  666
             VSLLTITSNVAYSKQTGNSPVHKGVYLNEDGSVNLSKVEFFSPGANPSNKA GGWLQNLN
Sbjct:  601  VSLLTITSNVAYSKQTGNSPVHKGVYLNEDGSVNLSKVEFFSPGANPSNKASGGWLQNLN  660

Query:  667  SLSKLDFAHANDGISLTTQVSPRALGKTFDEQVDNLVTVLDGYFENGGQHVNLNVMDLKD  726
             SL KLDFAHANDGISLTTQVSP+ALGKTFDEQV NLVT+LDGYFE GGQHVNLNVMDLKD
Sbjct:  661  SLKKLDFAHANDGISLTTQVSPKALGKTFDEQVANLVTILDGYFEGGGQHVNLNVMDLKD  720

Query:  727  VYDKIMNGEDVIVRISGYCVNTKYLTPEQKTELTQRVFHEVLSMDDALTN            776
             VYDKIMNGEDVIVRISGYCVNTKYLT EQKTELTQRVFHEVLSMDDA T+
Sbjct:  721  VYDKIMNGEDVIVRISGYCVNTKYLTKEQKTELTQRVFHEVLSMDDAATD            770
```

A related DNA sequence was identified in *S. pyogenes* <SEQ ID 5023> which encodes the amino acid sequence <SEQ ID 5024>. Analysis of this protein sequence reveals the following:

----- Final Results -----
bacterial cytoplasm --- Certainty = 0.3184 (Affirmative) <succ>
bacterial membrane --- Certainty = 0.0000 (Not Clear) <succ>
bacterial outside --- Certainty = 0.0000 (Not Clear) <succ>

Possible site: 59
>>> Seems to have no N-terminal signal sequence

An alignment of the GAS and GBS proteins is shown below.

```
Identities = 701/773 (90%), Positives = 742/773 (95%), Gaps = 1/773 (0)
Query:    2  FKEKTMATVKTNTDIFEQAWEGFKGVDWKEKASIARFVQANYAPYDGDESFLAGATERSL   61
             FKEK MATVKTNTD+FE+AWEGFKG DWKEKAS++RFVQANY PYDGDESFLAGATERSL
Sbjct:    5  FKEKFMATVKTNTDVFEKAWEGFKGTDWKEKASVSREVQANYTPYDGDESFLAGATERSL   64

Query:   62  HIKKVIEETKAHYEETRFPMDTRVASISELPAGFIDKDNELIFGIQNDELFKLNEMPKGG  121
             HIKKVIEETKAHYE TRFP DTR  SI+++PAGFIDK+NELI+GIQNDELFKLNEMPKGG
Sbjct:   65  HIKKVIEETKAHYEATREPYDTRPTSIADIPAGFIDKENELIYGIQNDELFKLNEMPKGG  124

Query:  122  IRMAETTLKENGYEPDPAVHEIFTKYATTVNDGIFRAYTSNIRRARHAHTVTGLPDAYSR  181
             IRMAETTLKENGYEPDPAVHEIFTKY TTVNDGIFRAYTSNIRRARHAHTVTGLPDAYSR
Sbjct:  125  IRMAETTLKENGYEPDPAVHEIFTKYVTTVNDGIFRAYTSNIRRARHAHTVTGLPDAYSR  184

Query:  182  GRIIGVYARLAVYGADYLMQEKVNDWNALNDIDEESIRLREEINLQYQALGEVVKLGDLY  241
             GRIIGVYARLA+YGADYLMQEKVNDWNA+ +IDEESIRLREE+NLQYQALGEVVKLGDLY
Sbjct:  185  GRIIGVYARLALYGADYLMQEKVNDWNAITEIDEESIRLREEVNLQYQALGEVVKLGDLY  244

Query:  242  GVDVRKPAMNTKEAIQWVNIAFMAVCRVINGAATSLGRVPIVLDIFAERDLARGTFTESE  301
             GVDVR+PA N KEAIQWVNIAFMAVCRVINGAATSLGRVPIVLDIFAERDLARGTFTESE
Sbjct:  245  GVDVRRPAQNVKEAIQWVNIAFMAVCRVINGAATSLGRVPIVLDIFAERDLARGTFTESE  304

Query:  302  IQEFVDDFVLKLRTVKFARTKAYDALYSGDPTFITTSMAGMGADGRHRVTKMDYRFLNTL  361
             IQEFVDDFVLKLRTVKF RTKAYDALYSGDPTFITTSMAGMG DGRHRVTKMDYRFLNTL
Sbjct:  305  IQEFVDDFVLKLRTVKFGRTKAYDALYSGDPTFITTSMAGMGNDGRHRVTKMDYRFLNTL  364

Query:  362  DNIGNSPEPNLTVLWSDQLPYAFRRYCMSMSHKHSSIQYEGVSTMAKEGYGEMSCISCCV  421
             DNIGNSPEPNLTVLW+DQLP  FRRYCM MSHKHSSIQYEGV+TMAKEGYGEMSCISCCV
Sbjct:  365  DNIGNSPEPNLTVLWTDQLPETFRRYCMKMSHKHSSIQYEGVTTMAKEGYGEMSCISCCV  424

Query:  422  SPLDPENEDKRHNLQYFGARVNVMKALLTGLNGGYDDVHKDYKVFD-IDPIRDEVLNFDT  480
             SPLDPENE++RHN+QYFGARVNV+KALLTGLNGGYDDVH+DYKVF+ ++PI   EVL +D
Sbjct:  425  SPLDPENEEQRHNIQYFGARVNVLKALLTGLNGGYDDVHRDYKVFNVVEPITSEVLEYDE  484

Query:  481  VKANFEKSLDWLTDTYVDAMNIIHYMTDKYNYEAVQMAFLPSHVRANMGFGICGFANTVD  540
```

```
                V ANFEKSLDWLTDTYVDA+NIIHYMTDKYNYEAVQMAFLP+H RANMGFGICGFANTVD
Sbjct: 485      VMANFEKSLDWLTDTYVDALNIIHYMTDKYNYEAVQMAFLPTHQRANMGFGICGFANTVD    544

Query: 541      SLSAIKYATVKPIRDEDGYIYDYETVGDFPRYGEDDDRVDSIAEWLLEAFHGRLAKHKLY    600
                +LSAIKYATVK IRDE+GYIYDYE  GDFPRYGEDDDRVD IA+WL+EA+H RLA HKLY
Sbjct: 545      TLSAIKYATVKTIRDENGYIYDYEVTGDFPRYGEDDDRVDDIAKWLMEAYHTRLASHKLY    604

Query: 601      KDAEATVSLLTITSNVAYSKQTGNSPVHKGVYLNEDGSVNLSKVEFFSPGANPSNKAKGG    660
                K+AEA+VSLLTITSNVAYSKQTGNSPVH+GV+LNEDG+VN S+VEFFSPGANPSNKAKGG
Sbjct: 605      KNAEASVSLLTITSNVAYSKQTGNSPVHRGVFLNEDGTVNTSQVEFFSPGANPSNKAKGG    664

Query: 661      WLQNLNSLSKLDFAHANDGISLTTQVSPRALGKTFDEQVDNLVTVLDGYFENGGQHVNLN    720
                WLQNLNSL+KL+F+HANDGISLTTQVSPRALGKTFDEQVDNLVTVLDGYFENGGQHVNLN
Sbjct: 665      WLQNLNSLAKLEFSHANDGISLTTQVSPRALGKTFDEQVDNLVTVLDGYFENGGQHVNLN    724

Query: 721      VMDLKDVYDKIMNGEDVIVRISGYCVNTKYLTPEQKTELTQRVFHEVLSMDDA         773
                VMDL DVYDKIMNGEDVIVRISGYCVNTKYLTPEQKTELTQRVFHEVLSMDDA
Sbjct: 725      VMDLNDVYDKIMNGEDVIVRISGYCVNTKYLTPEQKTELTQRVFHEVLSMDDA         777
```

Based on this analysis, it was predicted that these proteins and their epitopes could be useful antigens for vaccines or diagnostics.

Example 1628

A DNA sequence (GBSx1723) was identified in *S. agalactiae* <SEQ ID 5025> which encodes the amino acid sequence <SEQ ID 5026>. This protein is predicted to be DNA-damage inducible protein P (dinP). Analysis of this protein sequence reveals the following:

---

Possible site: 31
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
        bacterial cytoplasm --- Certainty = 0.0000 (Not Clear) <succ>

---

A related GBS nucleic acid sequence <SEQ ID 10121> which encodes amino acid sequence <SEQ ID 10122> was also identified.

The protein has homology with the following sequences in the GENPEPT database.

A related DNA sequence was identified in *S. pyogenes* <SEQ ID 5027> which encodes the amino acid sequence <SEQ ID 5028>. Analysis of this protein sequence reveals the following:

---

Possible site:27
>>> Seems to have no N-terminal signal sequence
----- Final Results -----
    bacterial cytoplasm --- Certainty = 0.1921 (Affirmative) <succ>
    bacterial membrane --- Certainty = 0.0000 (Not Clear) <succ>
    bacterial outside --- Certainty = 0.0000 (Not Clear) <succ>

---

An alignment of the GAS and GBS proteins is shown below.

```
>GP:AAF95431 GB:AE004300 DNA-damage-inducible protein P [Vibrio cholerae]
Identities = 136/349 (38%), Positives = 210/349 (59%), Gaps = 14/349 (4%)
Query: 12       INDTSRKIIHIDMDAFFASVEERDNPSLKGKPVIIGSDPRKTGGRGVVSTCNYEARKFGV    71
                + D  RKIIH+DMD FFA+VE RDNP+ +    + +G      ++   RGV+STCNY+ARKFGV
Sbjct: 1        MQDRIRKIIHVDMDCFFAAVEMRDNPAYREIALAVGGHEKQ---RGVISTCNYQARKFGV    57

Query: 72       HSAMSSKEAYERCPQAIFISGNYQKYRQVGMEVRDIFKKYTDLVEPMSIDEAYLDVTENK    131
                 SAM + +A +  CPQ    + G    Y+ V  +++ IF++YT L+EP+S+DEAYLDV+E+
Sbjct: 58       RSAMPTAQALKLCPQLHVVPGRMSVYKSVSQQIQTIFQRYTSLIEPLSLDEAYLDVSEST    117

Query: 132      MGIKSAVKLAKMIQYDIWNDVHLTCSAGISYNKFLAKLASDFEKPKGLTLILPDQAQDFL    191
                   SA  +A+ I+ DIW +++LT SAG++  KFLAK+ASD  KP GL  ++ PD+ Q+ +
Sbjct: 118      AYQGSATLIAQAIRRDIWQELNLTASAGVAPIKFLAKVASDLNKPDGLYVVTPDKVQEMV    177

Query: 192      KPLPIEKFHGVGKRSVEKLHALGVYTGEDLLSLSEISLIDMFGRFGYDLYRKARGINASP    251
                  LP+EK  GVGK ++EKLH  G+Y G D+        L+  FGR G   L++K+ GI+
Sbjct: 178      DSLPLEKIPGVGKVALEKLHQAGLYVGADVRRADYRKLLHQFGRLGASLWKKSHGIDERE    237

Query: 252      VKPDRVRKSIGSEKTYGKLLYNEADIKAEISKNVQRVVASLEKNKKVGKTIV---LKVRY    308
                V +R RKS+G E T+  + +    I + +       + I+    +KV++
Sbjct: 238      VVTERERKSVGVEYTFSQNISTFQECWQVIEQKLYPELDARLSRAHPQRGIIKQGIKVKF    297

Query: 309      ADFETLTKRMTLEEYTQDF--QIIDQVAKAIFDTLEESVFGIRLLGVTV            355
                ADF+  T         D+  ++++QV       +      IRLLG++V
Sbjct: 298      ADFQQTTIEHVHPALELDYFHELLEQV------LTRQQGREIRLLGLSV            340
```

```
Identities = 276/363 (76%), Positives = 323/363 (88%)
Query:   6  MLIFPLINDTSRKIIHIDMDAFFASVEERDNPSLKGKPVIIGSDPRKTGGRGVVETCNYE   65
            MLIFPLINDTSRKIIHIDMDAFFA+VEERDNP+LKGKPV+IG DPR+TGGRGVVSTCNYE
Sbjct:   1  MLIFPLINDTSRKIIHIDMDAFFAAVEERDNPALKGKPVVIGKDPRETGGRGVVSTCNYE   60

Query:  66  ARKFGVHSAMSSKEAYERCPQAIFISGNYQKYRQVGMEVRDIFKKYTDLVEPMSIDEAYL  125
            ARK+G+HSAMSSKEAYERCP+AIFISGNY+KYR VG ++R IFK+YTD+VEPMSIDEAYL
Sbjct:  61  ARKYGINSAMSSKEAYERCPKAIFISGNYEKYRTVGDQIRRIFKRYTDVVEPMSIDEAYL  120

Query: 126  DVTENKMGIKSAVKLAKMIQYDIWNDVHLTCSAGISYNKFLAKLASDFEKPKGLTLILPD  185
            DVT+NK+GIKSAVK+AK+IQ+DIW +V LTCSAG+SYNKFLAKLASDFEKP GLTL+L +
Sbjct: 121  DVTDNKLGIKSAVKIAKLIQHDIWKEVGLTCSAGVSYNKFLAKLASDFEKPHGLTLVLKE  180

Query: 186  QAQDFLKPLPIEKFHGVGKRSVEKLHALGVYTGEDLLSLSEISLIDMFGRFGYDLYRKAR  245
              A  FL  LPIEKFHGVGK+SV+KLH +G+YTG+DLL++ E++LID FGRFG+DLYRKAR
Sbjct: 181  DALCFLAKLPIEKFHGVOKKSVKKLHDMGIYTGQDLLAVPEMTLIDHFGRFGFDLYRKAR  240

Query: 246  GINASPVKPDRVRKSIGSEKTYGKLLYNEADIKAEISKNVQRVVASLEKNKKVGKTIVLK  305
            GI+ SPVK DR+RKSIGSE+TY KLLY E DIKAEISKNV+RV A L+ +KK+GKTIVLK
Sbjct: 241  GISNSPVKYDRIRKSIGSERTYAKLLYQETDIKAEISKNVKRVAALLQDHKKLGKTIVLK  300

Query: 306  VRYADFETLTKRMTLEEYTQDFQIIDQVAKAIFDTLEESVFGIRLLGVTVTTLENEHEAI  365
            VRYADF TLTKR+TL E T++   I+QVA  IFD+L E+  GIRLLGVT+T LE++   I
Sbjct: 301  VRYADFTTLTKRVTLPELTRNAAQIEQVAGDIFDSLSENPAGIRLLGVTMINLEDKVADI  360

Query: 366  YLD                                                          368
            LD
Sbjct: 361  SLD                                                          363
```

Based on this analysis, it was predicted that these proteins and their epitopes could be useful antigens for vaccines or diagnostics.

Example 1629

A DNA sequence (GBSx1724) was identified in *S. agalactiae* <SEQ ID 5029> which encodes the amino acid sequence <SEQ ID 5030>. Analysis of this protein sequence reveals the following:

Possible site: 41
>>> Seems to have an uncleavable N-term signal seq
INTEGRAL    Likelihood = −13.11    Transmembrane 70-86 (58-92)
INTEGRAL    Likelihood = −5.20     Transmembrane 105-121 (100-123)
INTEGRAL    Likelihood = −4.25     Transmembrane 126-142 (123-144)
INTEGRAL    Likelihood = −2.71     Transmembrane 18-34 (18-34)
----- Final Results -----
   bacterial membrane --- Certainty = 0.6243 (Affirmative) <succ>
   bacterial outside --- Certainty = 0.0000 (Not Clear) <succ>
   bacterial cytoplasm --- Certainty = 0.0000 (Not Clear) <succ>

Possible site:32
>>> Seems to have an uncleavable N-term signal seq
INTEGRAL    Likelihood = −13.00    Transmembrane 69-85 (62-93)
INTEGRAL    Likelihood = −6.85     Transmembrane 16-32 (11-37)
INTEGRAL    Likelihood = −4.30     Transmembrane 99-115 (96-121)
INTEGRAL    Likelihood = −3.66     Transmembrane 126-142 (121-143)
----- Final Results -----
   bacterial membrane --- Certainty = 0.6201 (Affirmative) <succ>
   bacterial outside --- Certainty = 0.0000 (Not Clear) <succ>
   bacterial cytoplasm --- Certainty = 0.0000 (Not Clear) <succ>

The protein has no significant homology with any sequences in the GENPEPT database.

An alignment of the GAS and GBS proteins is shown below.

```
Identities = 57/155 (36%), Positives = 96/155 (61%), Gaps = 5/155 (3%)
Query:   1  MVSYEKVRRSLRTATITIIVLNSLSLVFRLFTGISVQLAKTEI-NKGNTGNLPKEHIEAV   59
            M+SYEKVR++L+T+TI II+LN L +V  L      +++ N+     L  E +  +
Sbjct:   1  MISYEKVRQALKTSTIAIIILNGLGVVLSLMGFAGIFYLQSQLKNEAFRAQLTTEQLAQL   60

Query:  60  LSATTPFMLFVTALIVLVNIAIVIFCIKNLRAIKRNQTVNYLPYYLGFAITVGLVILGFL  119
              S+ TPFM+F++ L VL  IAI++FC +NL  +K+  TV+Y+PY LG   ++V ++ F
Sbjct:  61  QSSMTPFMIFLSVLNVLAIIAIIVFCAQNLSKLKQGLTVSYIPYILGLILSVIGLVNQFT  120

Query: 120  TTKAPWAIAINIVFQAIFGLLYFHAYQKAQKLNER                          154
            TT +    + ++ A++G    A+ KA+ LNE+
Sbjct: 121  TTMSMVGTILILIQAALYGF----AFYKAKTLNEK                          151
```

The protein has no significant homology with any sequences in the GENPEPT database.

Figure 119:
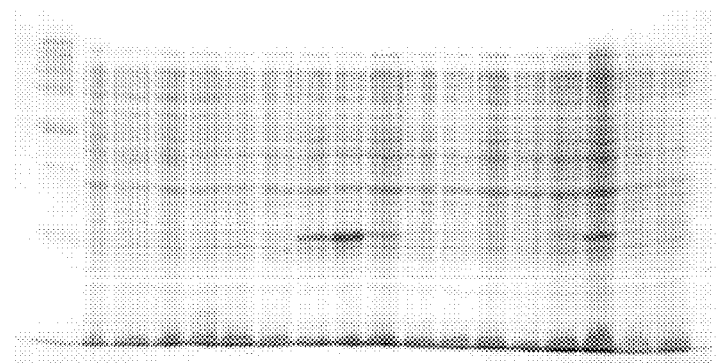

A related DNA sequence was identified in *S. pyogenes* <SEQ ID 5031> which encodes the amino acid sequence <SEQ ID 5032>. Analysis of this protein sequence reveals the following:

SEQ ID 5030 (GBS227) was expressed in *E. coli* as a His-fusion product. SDS-PAGE analysis of total cell extract is shown in FIG. 119 (lane 5; MW 21.2 kDa).

GBS227-His was purified as shown in FIG. 227, lane 8-9

Based on this analysis, it was predicted that these proteins and their epitopes could be useful antigens for vaccines or diagnostics. .

Example 1630

A DNA sequence (GBSx1725) was identified in *S. agalactiae* <SEQ ID 5033> which encodes the amino acid sequence <SEQ ID 5034>. Analysis of this protein sequence reveals the following:

Possible site: 47
>>> Seems to have no N-terminal signal sequence
----- Final Results -----
   bacterial cytoplasm --- Certainty = 0.1224 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database.

A related DNA sequence was identified in *S. pyogenes* <SEQ ID 5035> which encodes the amino acid sequence <SEQ ID 5036>. Analysis of this protein sequence reveals the following:

Possible site: 47
>>> Seems to have an uncleavable N-term signal seq
----- Final Results -----
   bacterial membrane --- Certainty = 0.0000 (Not Clear) <succ>
   bacterial outside --- Certainty = 0.0000 (Not Clear) <succ>
   bacterial cytoplasm --- Certainty = 0.0000 (Not Clear) <succ>

RGD motif: 232-234

The protein has homology with the following sequences in the databases:

```
>GP:CAE14706 GB:Z99118 similar to conjugation transfer protein
         [Bacillus subtilis]
Identities = 328/754 (43%), Positives = 484/754 (63%), Gaps = 25/754 (3%)
Query:   2 EVFFTGTIERIIFENASNFFKILLLEIEDTDSDFDDVEVIITGTMADVIEGEEYTFWGTL   61
           E +  GT+  +I+ N +N + +L +++ +T    +D  V +TG    + E E YTF+G +
Sbjct:  13 EPYLKGTVNTVIYHNDTNLYTVLKVKVTETSEAIEDKAVSVTGYFPALQEEETYTFYGKI   72

Query:  62 TQHPKYGEQLQSVRYERAKPTSG-GLVKYFSSEQFKGIGKKTAQRIVELYGDNTIDKILE  120
              HPK+G  Q Q+   +++   PT+   G+++Y SS+ F+GIGKKTA+ IV+   GD+ I+KIL
Sbjct:  73 VTHPKFGLQFQAEHFKKEIPTTKEGIIQYLSSDLFEGIGKKTAEEIVKKLGDSAINKILA  132

Query: 121 SPEQLSTISGLSKINREAFIAKLKLNYGTEQVLAKLAEYGLSNRAAIQIFDHYKEESLEV  180
              L  + LSK  +      L+ + G EQ++ L  ++G  +  +++I+  Y+ E+LE
Sbjct: 133 DASVLYDVPRLSKKKADTLAGALQRHQGLEQIMISLNQFGFGPQLSMKIYQAYESETLEK  192

Query: 181 INENPYQLVEDIQGIGFKIADQLAEQVGIESDSPKRFRAAIIHTLVESSMEQGDTYIEAR  240
           I ENPYQLV+D++GIGF   AD+L  ++G+  +  P+R +AAI++TL  +  +G TYIE
Sbjct: 193 IQENPYQLVKDVEGIGFGKADELGSRMGLSGNHPERVKAAILYTLETTCLSEGHTYIETE  252

Query: 241 TLLEKTITLLEEA-----RQIELDPS---IVAKELTNLIAEDKVQHIGTKIFSNTLFFAE  292
            L+  T +LL ++     R  E+D +   I   E  +++ ED        + +  +LF+AE
Sbjct: 253 QLIIDTQSLLNQSAREGQRITEMDAANAIIALGENKDIVIEDG------RCYFPSLFYAE  306

Query: 293 EGIKKNLQRILNQP-LDKQLNHKDIDREIRDIQKSLNIHYDNIQEKAIREALLSKVFILT  351
           + + K ++ I +Q  + Q    +     + ++++ +++  +++ Y   Q++AI++AL S + +LT
Sbjct: 307 QNVAKRVKHIASQTEYENQFPESEFLLALGELEERMDVQYAPSQKEAIQKALSSPMLLLT  366

Query: 352 GGPGTGKTTVINGIIEAYSELHHIDLN----KND--IPIVLAAPTGRAARRMNELTGLPS  405
           GGPGTGKTTVI GI+E Y ELH  + L+       K D    PIVLAAPTGRAA+RM+E TGLP+
Sbjct: 367 GGPGTGKTTVIRGIVELYGELHGVSLDPSAYKKDEAFPIVLAAPTGRAAKRMSESTGLPA  426

Query: 406 ATIHRHLGLNGDSDYQSLDDY-LDCSLIIIDEFSMVDTWLANQLFDALDSHTQVIIVGDS  464
             TIHR LG NG     +D   +D   L+IIDE SM+D WLAN LF A+  H Q+IIVGD
Sbjct: 427 VTIHRLLGWNGAEGFTHTEDQPIEGKLLIIDEASMLDIWLANHLFKAIPDHIQIIIVGDE  486

Query: 465 DQLPSVGPGQVLADLLNINALPHVKLEKIFRQSEESTIVTLANQMRQGFLPEDFTAKKAD  524
           DQLPSVGPGQVL DLL   +P V+L  I+RQ+E S+IV LA+QM+  G LP + TA    D
Sbjct: 487 DQLPSVGPGQVLRDLLASQVIPTVRLTDIYRQAEGSSIVELAHQMKNGLLPNNLTAPTKD  546

Query: 525 RSYFEASANIIPNMISKIVQSALKSGIEAHEIQILAPMYRGQAGINNLNLIMQNLLNPLK  584
           RS+     + I   ++ K+V +ALK G  A +IQ+LAPMYRG AGIN LN+++Q++LNP K
Sbjct: 547 RSFIRCGGSQIKEVVEKVVANALKKGYTAKDIQVLAPMYRGKAGINELNVMLQDILNPPK  606

Query: 585 D-NNQFTFNDINFRIGDKVLHLVNDTELNVFNGDIGYITDLIPAKYTESKQDEIYMTFDG  643
           +   +   F D+ +R GDK+L  VN  E NVFNGDIG  T   AK    K+D   ++FDG
Sbjct: 607 EKRRELKFGDVVYRTGDKILQLVNQPENNVFNGDIGEITSIFYAKENTEKEDMAVVSFDG  666

Query: 644 QEVIYQRKEWLKITLAYAMSIHKSQGSEFQVVILPITRQSGRMLQRNLIYTAITRSKSKL  703
            E+ + ++ + K+   + T AY  SIHKSQGSEF +V+LP+ +     RML+RNL YTAITR+K  L
Sbjct: 667 NEMTFTKKDFNQFTHAYCCSIHKSQGSEFPIVVLPVVKGYYRMLRRNLLYTAITRAKKFL  726

Query: 704 ILLGEIGAFDFAVKNEGAK-RNTYLIERFENKQE                           736
           IL GE  A ++ VKN  A   R T L  R   + E
Sbjct: 727 ILCGEEEALEWGVKNNDATVRQTSLKNRLSVQVE                           760
```

```
>GP:CAB14706 GB:Z99118 similar to conjugation transfer protein
    [Bacillus subtilis]
Identities = 318/769 (41%), Positives = 473/769 (61%), Gaps = 29/769 (3%)
Query:   7 GTVDRIIFENQANFFKILLLAIEDTDSDIDDFEIIITGIMADIIEGDDYTFWGELTQHPK  66
           GTV+ +I+ N  N + +L + + +T   I+D  + +TG    + E + YTF+G++  HPK
Sbjct:  18 GTVNTVIYHNDTNLYTVLKVKVTETSEAIEDKAVSVTGYFPALQEEETYTFYGKIVTHPK  77

Query:  67 YGQQLKLSRYQKIKPSSS-GLVNYFSSDHFKGIGKKTAEKIIALYGHNTIDHILEDPSKL 125
           +G Q +   ++K P++  G++ Y SSD F+GIGKKTAE+I+    G + I+ IL D S L
Sbjct:  78 FGLQFQAEHFKKEIPTTKEGIIQYLSSDLFEGIGKKTAEEIVKKLGDSAINKILADASVL 137

Query: 126 ETISGLSKANRQAFVAKLKLNYGTEQLIAGLVELGLSNRFALQAFEKYKEEALDLVKENP 185
            + LSK      L+ + G EQ++   L + G   + +++ ++ Y+ E L+ ++ENP
Sbjct: 138 YDVPRLSKKKADTLAGALQRHQGLEQIMISLNQFGFGPQLSMKIYQAYESETLEKIQENP 197

Query: 186 YQLVEDLQGFGFKMADALAENLGIESDSPKRFRAALLHCLLEESINRGDTYVQARQLLDF 245
           YQLV+D++G GF  AD L  +G+  + P+R +AA+L+ L    ++  G TY++ QL+
Sbjct: 198 YQLVKDVEGIGFGKADELGSRMGLSGNHPERVKAAILYTLETTCLSEGHTYIETEQLIID 257

Query: 246 AITLL-----EDARQVECDPAAVAEQLSE---LIIEGKIKNSDTKLFDASLYFAEEGIAN 297
           +LL       E R  EDA    L E    ++IE   D + +   SL++AE+ +A
Sbjct: 258 TQSLLNQSAREGQRITEMDAANAIIALGENKDIVIE------DGRCYFPSLFYAEQNVAK 311

Query: 298 NISRLLD-TPLSQSFSHDTIQTTIQAVQKDFAITYDQVQQEAITKALTSKVFLLTGGPGT 356
             +  +   T     F          + +++  + Y    Q+EAI KAL+S  LLTGGPGT
Sbjct: 312 RVKHIASQTEYENQFPESEFLLALGELEERMDVQYAPSQKEAIQKALSSPMLLLTGGPGT 371

Query: 357 GKTTVIRGILQAYANLHQIDLD----KKD--LPILLAAPTGRAARRMNELTGLPSATIHR 410
           GKTTVIRGI++ Y  LH + LD     KKD  PI+LAAPTGRAA+RM E TGLP+ TIHR
Sbjct: 372 GKTTVIRGIVELYGELHGVSLDPSAYKKDEAFPIVLAAPTGRAAKRMSESTGLPAVTIHR 431

Query: 411 HLGLNGDNDYQAMEDY-LDCDLLIVDEFSMVDTWLANQLLGAINSTTQVIIVGDSDQLPS 469
            LG NG   +   ED   ++ LLI+DE SM+D WLAN L  AI    Q+IIVGD DQLPS
Sbjct: 432 LLGWNGAEGFTHTEDQPIEGKLLIIDEASMLDIWLANHLFKAIPDHIQIIIVGDEDQLPS 491

Query: 470 VGPGQVLSDLLKVNSLPQIALQKIFRQSQESTIVNLADQMRRGILAADFRDKKADRSYFE 529
           VGPGQVL DLL    +P + L  I+RQ++ S+IV LA QM+ G+L +      DRS+
Sbjct: 492 VGPGQVLRDLLASQVIPTVRLTDIYRQAEGSSIVELAHQMKNGLLPNNLTAPTKDRSFIR 551

Query: 530 AQAAFIPDMIQKIVLSAIKSGIPAEEIQILAPMYKGQAGINHLNQLMQELLN-PLQGQTE 588
            + I ++++K+V +A+K G  A++IQ+LAPMY+G+AGIN LN ++Q++LN P + E
Sbjct: 552 CGGSQIKEVVEKVVANALKKGYTAKDIQVLAPMYRGKAGINELNVMLQDILNPPKEKRRE 611

Query: 589 FLFNDTHFRKGDKVLHLVNDAQLNVFNGDIGYITDLIPAKYTESKQDELILDFDGSEVTY 648
            F D +R GDK+L LVN + NVFNGDIG IT +  AK    K+D ++ FDG E+T+
Sbjct: 612 LKFGDVVYRTGDKILQLVNQPENNVFNGDIGEITSIFYAKENTEKEDMAVVSFDGNEMTF 671

Query: 649 PRNEWLKLTLAYAMSIHKSQGSEFQVVILPITRQSGRLLQRNVIYTAITRSKSKLILLGE 708
             + + + T AY  SIHKSQGSEF +V+LP+ +    R+L+RN++YTAITR+K  LIL GE
Sbjct: 672 TKKDFNQFTHAYCCSIHKSQGSEFPIVVLPVVKGYYRMLRRNLLYTAITRAKKFLILCGE 731

Query: 709 YTAFEYAIK-HEGDKRQTYLIERFQEQSDLASSQPNQELKSKEQTSLFS             756
              A E+ +K ++   RQT L R   Q +     + EL++ ++    FS
Sbjct: 732 EEALEWGVKNNDATVRQTSLKNRLSVQVE----EMDAELEALQKELPFS            776
```

An alignment of the GAS and GBS proteins is shown below.

```
Identities = 544/816 (66%), Positives = 665/816 (80%), Gaps = 10/816 (1%)
Query:   1 MEVFFTGTIERIIFENASNFFKILLLEIEDTDSDFDDVEVIITGTMADVIEGEEYTFWGT  60
           ME  FTGT++RIIFEN +NFFKILLL IEDTDSD DD E+IITGTMAD+IEG++YTFWG
Sbjct:   1 MEYVFTGTVDRIIFENQANFFKILLLAIEDTDSDIDDFEIIITGTMADIIEGDDYTFWGE  60

Query:  61 LTQHPKYGEQLQSVRYERAKPTSGGLVKYFSSEQFKGIGKKTAQRIVELYGDNTIDKILE 120
           LTQHPKYG+QL+  RY++ KP+S GLV YFSS+ FKGIGKKTA++I+  LYG NTID ILE
Sbjct:  61 LTQHPKYGQQLKLSRYQKIKPSSSGLVNYFSSDHFKGIGKKTAEKIIALYGHNTIDHILE 120

Query: 121 SPEQLSTISGLSKINREAFIAKLKLNYGTEQVLAKLAEYGLSNRAAIQIFDHYKEESLEV 180
            P +L TISGLSK NR+AF+AKLKLNYGTEQ++A L E GLSNR A+Q F+ YKEE+L++
Sbjct: 121 DPSKLETISGLSKANRQAFVAKLKLNYGTEQLIAGLVELGLSNRFALQAFEKYKEEALDL 180

Query: 181 INENPYQLVEDIQGIGFKIADQLAEQVGIESDSPKRFRAAIIHTLVESSMEQGDTYIEAR 240
           + ENPYQLVED+QG GFK AD LAE +GIESDSPKRFRAA++H L+E S+ +GDTY++AR
Sbjct: 181 VKENPYQLVEDLQGFGFKMADALAENLGIESDSPKRFRAALLHCLLEESINRGDTYVQAR 240

Query: 241 TLLEKTITLLEEARQIELDPSIVAKELTNLIAEDKVQHIGTKIFSNTLFFAEEGIKKNLQ 300
            LL+   ITLLE+ARQ+E DP++ A++L  LI E K++    TK+F ++L++AEEGI  N+
Sbjct: 241 QLLDFAITLLEDARQVECDPAAVAEQLSELIIEGKIKNSDTKLFDASLYFAEEGIANNIS 300
```

-continued

```
Query: 301  RILNQPLDKQLNHKDIDREIRDIQKSLNIHYDNIQEKAIREALLSKVFILTGGPGTGKTT  360
            R+L+ PL +  +H  I   I+ +OK    I YD +Q++AI +AL SKVF+LTGGPGTGKTT
Sbjct: 301  RLLDTPLSQSFSHDTIQTTIQAVQKDFAITYDQVQQEAITKALTSKVFLLTGGPGTGKTT  360

Query: 361  VINGIIEAYSELHHIDLNKNDIPIVLAAPTGRAARRMNELTGLPSATIHRHLGLNGDSDY  420
            VI GI++AY+ LH IDL+K D+PI+LAAPTGRAARRMNELTGLPSATIHRHLGLNGD+DY
Sbjct: 361  VIRGILQAYANLHQIDLDKKDLPILLAAPTGRAARRMNELTGLPSATIHRHLGLNGDNDY  420

Query: 421  QSLDDYLDCSLIIIDEFSMVDTWLANQLFDALDSHTQVIIVGDSDQLPSVGPGQVLADLL  480
            Q+++DYLDC L+I+DEFSMVDTWLANQL  A++S TQVIIVGDSDQLPSVGPGQVL+DLL
Sbjct: 421  QAMEDYLDCDLLIVDEFSMVDTWLANQLLGAINSTTQVIIVGDSDQLPSVGPGQVLSDLL  480

Query: 481  NINALPHVKLEKIFRQSEESTIVTLANQMRQGFLPEDFTAKKADRSYFEASANIIPNMIS  540
             +N+LP + L+KIFRQS+ESTIV LA+QMR+G L  DF KKADRSYFEA A  IP+MI
Sbjct: 481  KVNSLPQIALQKIFRQSQESTIVNLADQMRRGILAADFRDKKADRSYFEAQAAFIPDMIQ  540

Query: 541  KIVQSALKSGIEAHEIQILAPMYRGQAGINNLNLIMQNLLNPLKDNNQFTFNDINFRIGD  600
            KIV SA+KSGI A EIQILAPMY+GQAGIN+LN +MQ LLNPL+    +F FND +FR GD
Sbjct: 541  KIVLSAIKSGIPAEEEIQILAPMYKGQAGINHLNQLMQELLNPLQGQTEFLFNDTHFRKGD  600

Query: 601  KVLHLVNDTELNVFNGDIGYITDLIPAKYTESKQDEIYMTFDGQEVIYQRKEWLKITLAY  660
            KVLHLVND +LNVFNGDIGYITDLIPAKYTESKQDE+ + FDG EV Y R EWLK+TLAY
Sbjct: 601  KVLHLVNDAQLNVFNGDIGYITDLIPAKYTESKQDELILDFDGSEVTYPRNEWLKLTLAY  660

Query: 661  AMSIHKSQGSEFQVVILPITRQSGRMLQRNLIYTAITRSKSKLILLGEIGAFDFAVKNEG  720
            AMSIHKSQGSEFQVVILPITRQSGR+LQRN+IYTAITRSKSKLILLGE  AF++A+K+EG
Sbjct: 661  AMSIHKSQGSEFQVVILPITRQSGRLLQRNVIYTAITRSKSKLILLGEYTAFEYAIKHEG  720

Query: 721  AKRNTYLIERFENKQEIANSQKIEDSSIDQKI----------DNTIINTSIPKTATPIEQ  770
             KR TYLIERF+ + ++A+SQ ++     ++           D++  ++S   + P E
Sbjct: 721  DKRQTYLIERFQEQSDLASSQPNQELKSKEQTSLFSNTATLEDDSQKSSSQSTNSNPTEN  780

Query: 771  TNLSKITYRLTEENYLTIDPMIGINQQDISAIFDSK                          806
            +      +RLT ENY  TID MIG+ + DI+  F  K
Sbjct: 781  SQSDNDDFRLTPENYSTIDSMIGLTESDIALFFQKK                          816
```

Based on this analysis, it was predicted that these proteins and their epitopes could be useful antigens for vaccines or diagnostics.

Example 1631

A DNA sequence (GBSx1726) was identified in *S. agalactiae* <SEQ ID 5037> which encodes the amino acid sequence <SEQ ID 5038>. Analysis of this protein sequence reveals the following:

Possible site: 35
>>> Seems to have an uncleavable N-term signal seq
INTEGRAL    Likelihood = −8.23    Transmembrane 9-25 (7-29)
----- Final Results -----
   bacterial membrane --- Certainty = 0.4291 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database.

```
>GP:AAB69116 GB:U90721 signal peptidase I [Streptococcus pneumoniae]

Identities = 120/201 (59%), Positives = 144/201 (70%), Gaps = 9/201 (4%)
Query:   2  KEFIKEWGVFILILSLFLLSRIFLWQFVKVDGHSMDPTLADKEQLVVLKQTKINRFDIVV   61
            K F+KEWG+F+LILSL LSRIF W V+V+GHSMDPTLAD E L V+K   I+RFDIVV
Sbjct:   5  KNFLKEWGLFLLILSLLALSRIFFWSNVRVEGHSMDPTLADGEILFVVKHLPIDRFDIVV   64

Query:  62  ANEEEGGQKKKIVKRVIGMPGDVIKYKNDTLTINNKKTEEPYLKEYTKLFKKDKLQEKYS  121
            A+EE+G   K IVKRVIGMPGD I+Y+ND L IN+K+T+EPYL +Y K FK DKLQ  YS
Sbjct:  65  AHEEDG--NKDIVKRVIGMPGDTIRYENDKLYINDKETDEPYLADYIKRFKDDKLQSTYS  122

Query: 122  -------YNPLFQDLAQSSTAFTTDSNGSSEFTTVVPKGHYYLVGDDRIVSKDSRAVGPF  174
                    F+  +AQ + AFT D N ++ F+ VP+G Y L+GDDR+VS DSR VG F
Sbjct: 123  GKGFEGNKGTFFRSIAQKAQAFTVDVNYNTNFSFTVPEGEYLLLGDDRLVSSDSRHVGTF  182

Query: 175  KKSTIVGEVKFRFWPIRRFGT                                          195
            K    I GE KFRFWPI R GT
Sbjct: 183  KAKDITGEAKFRFWPITRIGT                                          203
```

A related DNA sequence was identified in S. pyogenes <SEQ ID 5039> which encodes the amino acid sequence <SEQ ID 5040>. Analysis of this protein sequence reveals the following:

```
Possible site: 52
>>> Seems to have no N-terminal signal sequence
INTEGRAL     Likelihood = -2.50    Transmembrane 35-51 (35-51)
----- Final Results -----
   bacterial membrane --- Certainty = 0.1999 (Affirmative) <succ>
      bacterial outside --- Certainty = 0.0000 (Not Clear) <succ>
         bacterial cytoplasm --- Certainty = 0.0000 (Not Clear) <succ>
```

A related sequence was also identified in GAS <SEQ ID 9157> which encodes the amino acid sequence <SEQ ID 9158>. Analysis of this protein sequence reveals the following:

```
Possible site: 43
>>> Seems to have a cleavable N-term signal seq.
----- Final Results -----
   bacterial outside --- Certainty = 0.300 (Affirmative) <succ>
      bacterial membrane --- Certainty = 0.000 (Not Clear) <succ>
         bacterial cytoplasm --- Certainty = 0.000 (Not Clear) <succ>
```

An alignment of the GAS and GBS proteins is shown below.

```
Identities = 131/197 (66%), Positives = 152/197 (76%)
Query:    1 MKEFIKEWGVFILILSLFLLSRIFLWQFVKVDGHSMDPTLADKEQLVVLKQTKINRFDIV   60
            MK+FIKEWG F L L LF LSR+FLWQ VKVDGHSMDPTLA  E+L+V  Q +I+RFDIV
Sbjct:   23 MKQFIKEWGPFTLFLILFGLSRLFLWQAVKVDGHSMDPTLAHGERLIVFNQARIDRFDIV   82

Query:   61 VANEEEGGQKKKIVKRVIGMPGDVIKYKNDTLTINNKKTEEPYLKEYTKLFKKDKLQEKY  120
            VA EEE GQKK+IVKRVIG+PGD I Y +DTL IN KKT EPYL EY K FK DKLQ+ Y
Sbjct:   83 VAQEEENGQKKEIVKRVIGLPGDTISYNDDTLYINGKKTVEPYLAEYLKQFKNDKLQKTY  142

Query:  121 SYNPLFQDLAQSSTAFTTDSNGSSEFTTVVPKGHYYLVGDDRIVSKDSRAVGPFKKSTIV  180
            +YN LFQ LA++S AFTT+S G + F     VPKG Y L+GDDRIVS+DSR VG FKK ++
Sbjct:  143 AYNTLFQQLAETSDAFTTNSEGQTRFEMSVPKGEYLLLGDDRIVSRDSREVGSFKKENLI  202

Query:  181 GEVKFRFWPIRRFGTIN                                            197
            GEVK RFWP+ +     N
Sbjct:  203 GEVKARFWPLNKMTVFN                                            219
```

SEQ ID 5038 (GBS268) was expressed in *E. coli* as a GST-fusion product. SDS-PAGE analysis of total cell extract is shown in FIG. 54 (lane 4; MW 50.3 kDa). It was also expressed in *E. coli* as a His-fusion product. SDS-PAGE analysis of total cell extract is shown in FIG. 85 (lane 9; MW 25.3 kDa) and in FIG. 160 (lane 2-4; MW 25.3 kDa).

GBS268-His was purified as shown in FIG. 222, lane 8.

Based on this analysis, it was predicted that these proteins and their epitopes could be useful antigens for vaccines or diagnostics.

Example 1632

A DNA sequence (GBSx1727) was identified in *S. agalactiae* <SEQ ID 5041> which encodes the amino acid sequence <SEQ ID 5042>. This protein is predicted to be ribonuclease HIII (mhB). Analysis of this protein sequence reveals the following:

```
Possible site: 37
>>> Seems to have no N-terminal signal sequence
----- Final Results -----
   bacterial cytoplasm --- Certainty = 0.4728 (Affirmative) <succ>
      bacterial membrane --- Certainty = 0.0000 (Not Clear) <succ>
         bacterial outside --- Certainty = 0.0000 (Not Clear) <succ>
```

A related GBS nucleic acid sequence <SEQ ID 10119> which encodes amino acid sequence <SEQ ID 10120> was also identified.

The protein has homology with the following sequences in the GENPEPT database.

```
>GP:AAC45437 GB:U93576 ribonuclease HII [Streptococcus pneumoniae]
Identities = 176/282 (62%), Positives = 219/282 (77%), Gaps = 13/282 (4%)
Query:   16 EKIRTDLAQHHISNNNPYVVFSAKISGATVLLYTSGKLVFQGSNASHIAQKYGF--IEQK   73
            E  +T LA     + NPY+ +  K+ ATV +YTSGK++ QG  A    A  +G+  +EQ
Sbjct:   18 EHYQTSLAP----SKNPYIRYFLKLPQATVSIYTSGKILLQGEGAEKYASFFGYQAVEQ-   72

Query:   74 ESCSSESQDIPIIGTDEVGNGSYFGGLAVVASFVTPKDHAYLKKLGVGDSKTLTDQKIKQ  133
              +    Q++P+IGTDEVGNGSYFGGLAVVA+FVTP  H +L+KLGVGDSKTLTDQKI+Q
Sbjct:   73 ----TSGQNLPLIGTDEVGNGSYFGGLAVVAAFVTPDQHDFLRKLGVGDSKTLTDQKIRQ  128

Query:  134 IAPLLEKAIPHKALLLSPQKYNQVVSPNNKHNAVSVKVALHNQAIFLLLQDGFEPEKIVI  193
            IAP+L++  I H+ALLLSP KYN+V+      +++NAVSVKVALHNQAI+LLLQ G +PEKIVI
Sbjct:  129 IAPILKEKIQHQALLLSPSKYNEVIG--DRYNAVSVKVALHNQAIYLLLQKGVQPEKIVI  186

Query:  194 DAFTSSKNYQNYLKNEKNQFKQTITLEEKAENKYLAVAVSSIIARNLFLENLNKLSDDVG  253
            DAFTS+KNY   YL  E N+F   I+LEEKAE KYLAVAVSS+IAR+LFLENL  L   ++G
Sbjct:  187 DAFTSAKNYDKYLAQETNRFSNPISLEEKAEGKYLAVAVSSVIARDLFLENLENLGRELG  246
```

```
Query: 254  YKLPSGAGHQSDKVASQLLKAYGISSLEHCAKLHFANTKKAQ             295
            Y+LPSGAG SDKVASQ+L+AYG+  L  CAKLHF NT+KA+
Sbjct: 247  YQLPSGAGTASDKVASQILQAYGMQGLNFCAKLHFKNTEKAK             288
```

A related DNA sequence was identified in *S. pyogenes* <SEQ ID 5043> which encodes the amino acid sequence <SEQ ID 5044>. Analysis of this protein sequence reveals the following:

Possible site: 35
>>> Seems to have no N-terminal signal sequence
----- Final Results -----
    bacterial cytoplasm --- Certainty = 0.2148 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below.

```
Identities = 194/298 (65%), Positives = 240/298 (80%), Gaps = 2/298 (0%)
Query:   3  MNTIVMQADKKLQEKIRTDLAQHHISNNNPYVVFSAKISGATVLLYTSGKLVFQGSNASH   62
            MNT+V++ D  L + ++  LA + IS+ N YV F+AK +G TVLLY SGKLV QG+ A+
Sbjct:   1  MNTLVLKIDAILSKHLKKQLAPYTISSQNTYVAFAAKKNGVTVLLYKSGKLVLQGNGANA   60

Query:  63  IAQKYGFIEQKE--SCSSESQDIPIIGTDEVGNGSYFGGLAVVASFVTPKDHAYLKKLGV  120
            +AQ+      K     S+ SQDIPIIG+DEVGNGSYFGG+AVVASFV PKDH++LKKLGV
Sbjct:  61  LAQELNLPVAKTVFEASNNSQDIPIIGSDEVGNGSYFGGIAVVASFVDPKDHSFLKKLGV  120

Query: 121  GDSKTLTDQKIKQIAPLLEKAIPHKALLLSPQKYNQVVSPNNKHNAVSVKVALHNQAIFL  180
             DSK L+D+ I+QIAPLLEK IPH++LLLSP+KYN++V  +    +NA+S+KVALHNQAIFL
Sbjct: 121  DDSKKLSDKTIQQIAPLLEKQIPHQSLLLSPKKYNELVGKSKPYNAISIKVALHNQAIFL  180

Query: 181  LLQDGFEPEKIVIDAFTSSKNYQNYLKNEKNQFKQTITLEEKAENKYLAVAVSSIIARNL  240
            LLQ G +P++IVIDAFTS  NY+ +LK EKN F   +T +EKAE+ YLAVAVSSIIARNL
Sbjct: 181  LLQKGIQPKQIVIDAFTSQSNYEKHLKKEKNHFPNPLTFQEKAESHYLAVAVSSIIARNL  240

Query: 241  FLENLNKLSDDVGYKLPSGAGHQSDKVASQLLKAYGISSLEHCAKLHFANTKKAQALL    298
            FL+NL++L  D+GY+LPSGAG  SDKVASQLL AYG+SSLE+ AKLHFANT KAQALL
Sbjct: 241  FLDNLDQLGQDLGYQLPSGAGSASDKVASQLLAAYGMSSLEYSAKLHFANTHKAQALL    298
```

Based on this analysis, it was predicted that these proteins and their epitopes could be useful antigens for vaccines or diagnostics.

Example 1633

A DNA sequence (GBSx1728) was identified in *S. agalactiae* <SEQ ID 5045> which encodes the amino acid sequence <SEQ ID 5046>. This protein is predicted to be heat shock protein 70. Analysis of this protein sequence reveals the following:

Possible site: 25
>>> Seems to have no N-terminal signal sequence
----- Final Results -----
    bacterial cytoplasm --- Certainty = 0.3874 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

A related DNA sequence was identified in *S. pyogenes* <SEQ ID 5047> which encodes the amino acid sequence <SEQ ID 5048>. Analysis of this protein sequence reveals the following:

Possible site: 58
>>> Seems to have no N-terminal signal sequence
----- Final Results -----
    bacterial cytoplasm --- Certainty = 0.3442 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below.

```
Identities = 65/92 (70%), Positives = 76/92 (81%)
Query: 11  NRYKFVFGDKPLTLTTDKDNLFMEEIERVATEKYEAIKEKLPNADNETIAILMAINALSV  70
           NRYKF FG+K LTLTTDKDNLFMEE+ERVA EKY+A+K  LP AD+ETIAILMAIN LS
Sbjct:  5  NRYKFTFGEKTLTLTTDKDNLFMEEVERVAKEKYQALKNHLPEADDETIAILMAINTLST  64

Query: 71  QLSREIDIEKMEDELNKLRSKTISDIKEKVSE                            102
           QLSREI IEKME E+  LR KT+  ++EK ++
Sbjct: 65  QLSREIAIEKMEAEILDLRQKTLVGLQEKANQ                            96
```

Based on this analysis, it was predicted that these proteins and their epitopes could be useful antigens for vaccines or diagnostics.

Example 1634

A DNA sequence (GBSx1729) was identified in *S. agalactiae* <SEQ ID 5049> which encodes the amino acid sequence <SEQ ID 5050>. Analysis of this protein sequence reveals the following:

```
Possible site: 48
>>> Seems to have an uncleavable N-term signal seq
INTEGRAL    Likelihood = -10.99   Transmembrane 124-140 (114-148)
INTEGRAL    Likelihood =  -5.84   Transmembrane  22-38  (21-40)
INTEGRAL    Likelihood =  -4.88   Transmembrane   2-18  (1-20)
INTEGRAL    Likelihood =  -1.97   Transmembrane  84-100 (84-100)
----- Final Results -----
     bacterial membrane --- Certainty = 0.5394 (Affirmative) <succ>
       bacterial outside --- Certainty = 0.0000 (Not Clear) <succ>
     bacterial cytoplasm --- Certainty = 0.0000 (Not Clear) <succ>
```

The protein has homology with the following sequences in the GENPEPT database.

```
>GP:BAB06827 GB:AP001517 unknown conserved protein in B. subtilis
        [Bacillus halodurans]
Identities = 59/182 (32%), Positives = 98/182 (53%), Gaps = 14/182 (7%)
Query:   1 MLSLLLLIIVIWHFYIGYSRGIFLQVFYVLMSMVSLMIASQFYQELASQITLWVPYS--N   58
           MLS++LL I++  F+IG  RG+ LQ+ ++L  +   +A ++Y   +A+ I LW+PY   +
Sbjct:   1 MLSVILLFILLCSFFIGKRRGLILQLVHLLGFVAAFFVAYKYYAPVATYIRLWIPYPQFS   60

Query:  59 PVQGVEVYFFKDISKFQLSHVYYAGVAFVFIY----SLSYLVGRLLGVLLHLAPVEHFDS  114
           P  V +    I  F   +VYY+G+AF ++      L ++VG +L  L HL +
Sbjct:  61 PDSPVTML----IEAFNFENVYYSGIAFALLFIGTKILLHIVGSMLDFLTHLPILRSV--  114

Query: 115 LQNNIISGFLAVLVCLLFMSMCLTILATVPMSFVQEKLWNSLFVRFLINDLPFFSQFLVR  174
              N  + GL  +   LM+L+ A +P+  VQ  L   SL  +F++N  PF  S+F+
Sbjct: 115 --NGWLGGILGFVEVYLIMFVLLYVGALLPIETVQTHLNQSLVAQFIMNHTPFLSEFIRN  172

Query: 175 TW                                                           176
           W
Sbjct: 173 LW                                                           174
```

A related DNA sequence was identified in *S. pyogenes* <SEQ ID 5051> which encodes the amino acid sequence <SEQ ID 5052>. Analysis of this protein sequence reveals the following:

```
Possible site: 59
>>> Seems to have a cleavable N-term signal seq.
INTEGRAL    Likelihood = -8.17   Transmembrane 124-140 (117-148)
INTEGRAL    Likelihood = -4.73   Transmembrane  84-100 (78-105)
INTEGRAL    Likelihood = -0.00   Transmembrane 156-172 (156-172)
----- Final Results -----
     bacterial membrane --- Certainty = 0.4270 (Affirmative) <succ>
       bacterial outside --- Certainty = 0.0000 (Not Clear) <succ>
     bacterial cytoplasm --- Certainty = 0.0000 (Not Clear) <succ>
```

The protein has homology with the following sequences in the databases:

```
>GP:BAB06827 GB:A2001517 unknown conserved protein in B. subtilis
        [Bacillus halodurans]
Identities = 57/177 (32%), Positives = 98/177 (55%), Gaps = 2/177 (1%)
Query:   1 MLSLLIVLILTWNFYIGYSRGIILQSFYVLGALLSLLVANRFYIGLAHKLTLWIPYSNPV   60
           MLS++++ IL  +F+IG  RG+ILQ  ++LG + +  VA ++Y  +A   + LWIPY Sbjct:   1 MLSVILLFILLCSFFIGKRRGLILQLVHLLGFVAAFFVAYKYYAPVATYIRLWIPYPQFS   60

Query:  61 EGTSVFFFKSVDIFVLDKVYYAGLAFFIIFLLGYALSRFLGIFVHFLLLNYFDNQWTKCL  120
           + V      ++ F  + VYY+G+AF ++F+       L    +G    +FL         L Sbjct:  61 PDSPVTML--IEAFNFENVYYSGIAFALLFIGTKILLHIVGSMLDFLTHLPILRSVNGWL  118

Query: 121 SGGLAFLVSLLFLNMLLSIFATVPMPFLQHYLHSSFLARLVIEHLPPLTIIIQKLWI     177
             G L F+    L + +LL + A +P+   +Q  +L+  S +A+  ++ H P L+   I+ LWI Sbjct: 119 GGILGFVEVYLIMFVLLYVGALLPIETVQTHLNQSLVAQFIMNHTPFLSEFIRNLWI    175
```

An alignment of the GAS and GBS proteins is shown below.

```
Identities = 87/176 (49%), Positives = 123/176 (69%)
Query:   1 MLSLLLLIIVIWHFYIGYSRGIFLQVFYVLMSMVSLMIASQFYQELASQITLWVPYSNPV   60
           MLSLL+++I+ W+FYIGYSRGI LQ FYVL +++SL++A++FY  LA ++TLW+PYSNPV
Sbjct:   1 MLSLLIVLILTWNFYIGYSRGIILQSFYVLGALLSLLVANRFYIGLAHKLTLWIPYSNPV   60

Query:  61 QGVEVYFFKDISKFQLSHVYYAGVAFVFIYSLSYLVGRLLGVLLHLAPVEHFDSLQNNII  120
           +G  V+FFK +  F L  VYYAG+AF   I+ L Y + R LG+ +H   + +FD+     +
Sbjct:  61 EGTSVFFFKSVDIFVLDKVYYAGLAFFIIFLLGYALSRFLGIFVHFLLLNYFDNQWTKCL  120

Query: 121 SGFLAVLVCLLFMSMCLTILATVPMSFVQEKLWNSLFVRFLINDLPFFSQFLVRTW      176
           SG LA LV LLF++M L+I ATVPM F+Q   L +S    R +I  LP  +  + W
Sbjct: 121 SGGLAFLVSLLFLNMLLSIFATVPMPFLQHYLHSSFLARLVIEHLPPLTIIIQKLW      176
```

Based on this analysis, it was predicted that these proteins and their epitopes could be useful antigens for vaccines or diagnostics.

Example 1635

A DNA sequence (GBSx1730) was identified in *S. agalactiae* <SEQ ID 5053> which encodes the amino acid sequence <SEQ ID 5054>. Analysis of this protein sequence reveals the following:

Possible site: 49
>>> Seems to have no N-terminal signal sequence

----- Final Results -----
bacterial cytoplasm --- Certainty = 0.4176 (Affirmative) <succ>
bacterial membrane --- Certainty = 0.0000 (Not Clear) <succ>
bacterial outside --- Certainty = 0.0000 (Not Clear) <succ>

A related GBS nucleic acid sequence <SEQ ID 10117> which encodes amino acid sequence <SEQ ID 10118> was also identified.

The protein has homology with the following sequences in the GENPEPT database.

```
>GP:CAB14818 GB:Z99118 similar to DNA mismatch repair protein
             [Bacillus subtilis]
Identities = 320/790 (40%), Positives = 466/790 (58%), Gaps = 18/790 (2%)
Query:  10 MNNKILEQLEFNKVKELILPYLKTEQSQEELSELEPMTEAPKIEKSFNEISDMEQIFVEH   69
           M  K+L  LEF+KVKE ++ +    +E L EL+P       +I+K  +E+ +    I
Sbjct:   1 MQQKVLSALEFHKVKEQVIGHAASSLGKEMLLELKPSASIDEIKKQLDEVDEASDIIRLR   60

Query:  70 HSFGIVSLSSSISESLKRLELSADLNIQELLAIKKVLQSSSDMIHFYSDL--DNVSFQSLD  127
                L  I  +L+R E+ + L+ E   I  +L +    M HF + + D V     +
Sbjct:  61 GQAPFGGLVDIRGALRRAEIGSVLSPSEFTEISGLLYAVKQMKHFITQMAEDGVDIPLIH  120

Query: 128 RLFENLEQFPNLQGSFQA-INDGGFLEHFASPELERIRRQLTNSERRVRQILQDMLKEKA  186
           +  E L    +L+     + I+D G +  AS  L  IR QL  E RVR L+ ML+  +
Sbjct: 121 QHAEQLITLSDLERDINSCIDDHGEVLDHASETLRGIRTQLRTLESRVRDRLESMLRSSS  180

Query: 187 --ELLSENLIASRSGRSVLPVKNTYRNRISGVVHDISSSGSTVYIEPRAVVTLNEEITQL  244
             ++LS+ ++    R+ R V+PVK   YR+     G+VHD SSSG+T++IEP+A+V +N   Q
Sbjct: 181 ASKMLSDTIVTIRNDRFVIPVKQEYRSSYGGIVHDTSSSGATLFIEPQAIVDMNNSLQQA  240

Query: 245 RADERHEESRILHAFSDLLRPHVATIRNNAWILGHLDFVRAKYLFMSDNKATIPEISNDS  304
           +   E+ E  RIL  ++       +  +     +L  LDF+ AK +     KAT P +++
Sbjct: 241 KVKEKQEIERILRVLTEKTAEYTEELFLDLQVLQTLDFIFAKARYAKAVKATKPIMNDTG  300

Query: 305 TLALINVRHPLL--SNPVANDLHFDQDLTAIVITGPNTGGKTIMLKTLGLAQLMGQSGLP  362
           + L   RHPLL     VAND+   +D + IVITGPNTGGKT+ LKTLGL  LM QSGL
Sbjct: 301 FIRLKKARHPLLPPDQVVANDIELGRDFSTIVITGPNTGGKTVTLKTLGLLTLMAQSGLH  360

Query: 363 VLADKGSKIAVFNNIFADIGDEQSIEQSLSTFSSHMTHIVSILNEADHNSLVLFDELGAG  422
           + AD+GS+ AVF ++FADIGDEQSIEQSLSTFSSHM +IV IL + + NSLVLFDELGAG
Sbjct: 361 IPADEGSEAAVFEHVFADIGDEQSIEQSLSTFSSHMVNIVGILEQVNENSLVLFDELGAG  420

Query: 423 TDPQEGASLAMAILEHLRLSNIKTMATTHYPELKAYGIETNFVENASMEFDAETLSPTYR  482
           TDPQEGA+LAM+IL+ +   +N +  +ATTHYPELKAYG    V NAS+EFD  ETLSPTY+
Sbjct: 421 TDPQEGAALAMSILDDVHRTNARVLATTHYPELKAYGYNREGVMNASVEFDIETLSPTYK  480

Query: 483 FMQGVPGRSNAFEIASRLGLAPFIVKQAK-QMTDSDSDVNRIIEQLEAQTLETRRRLDHI  541
           +  GVPGRSNAFEI+ RLGL    I++ QAK +MT    ++V+ +I  LE            L
Sbjct: 481 LLIGVPGRSNAFEISKRLGLPDHIIGQAKSEMTAEHNEVDTMIASLEQSKKRAEEELSET  540

Query: 542 KEVEQENLKFNRAVKKLYNEFSHERDKELEKIYQEAQEIVDMALNESDTILKKL----ND  597
           + + +E  K ++ +++      E + ++DK LE+  Q+A E V  A+ E++ I+ +L       +
Sbjct: 541 ESIRKEAEKLHKELQQQIIELNSKKDKMLEEAEQQAAEKVKAAMKEAEDIIHELRTIKEE  600
```

```
Query: 598  KSQLKPHEIIDAKAQIKKLAPQVDLSKNKVLNKAKKIKAARAPRIGDDIIVTSYGQRGTL  657
            K HE+I+AK +++   P  + SK     K +K    R  + GD++ V ++GQ+GTL
Sbjct: 601  HKSFKDHELINAKKRLEGAMPAFEKSKKPEKPKTQK----RDFKPGDEVKVLTFGQKGTL  656

Query: 658  TSQLKDGRWEAQVGIIKMTLTQDEFTLVRVQEEQKVKSKQINVVKKADSSGPRARLDLRG  717
             +     W Q+GI+KM + + +   ++   E KKKI  VK  D       LDLRG
Sbjct: 657  LEKTGGNEWNVQIGILKMKVKEKDLEFIKSAPEPK-KEKMITAVKGKDYH-VSLELDLRG  714

Query: 718  KRYEEAMQELDNFIDQALLNNMGQVDIIHGIGTGVIREGVTKYLRRNKHVKHFAYAPQNA  777
            +RYE A+  ++  ++D A+L    +V IIHG GTG +R+GV  L+ ++ VK    +
Sbjct: 715  ERYENALSRVEKYLDDAVLAGYPRVSIIHGKGTGALRKGVQDLLKNHRSVKSSRFGEAGE  774

Query: 778  GGSGATIVTL                                                   787
            GGSG T+V L
Sbjct: 775  GGSGVTVVEL                                                   784
```

A related DNA sequence was identified in *S. pyogenes* <SEQ ID 5055> which encodes the amino acid sequence <SEQ ID 5056>. Analysis of this protein sequence reveals the following:

Possible site: 20
>>> Seems to have no N-terminal signal sequence

----- Final Results -----
bacterial cytoplasm --- Certainty = 0.3843 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 775/787 (98%), Positives = 781/787 (98%)
Query:   2  INLGIMKSMNNKILEQLEFNKVKELILPYLKTEQSQEELSELEPMTEAPKIEKSFNEISD   61
            I LGIMKSMNNKILEQLEFNKVKEL+LPYLKTEQSQEEL ELEPMTEAPKIEKSFNEISD
Sbjct:  32  IILGIMKSMNNKILEQLEFNKVKELLLPYLKTEQSQEELLELEPMTEAPKIEKSFNEISD   91

Query:  62  MEQIFVEHHSFGIVSLSSISESLKRLELSADLNIQELLAIKKVLOSSSDMIHFYSDLDNV  121
            MEQIFVEHHSFGIVSLSSISESLKRLELS DLNIQELLAIKKVLQSSSDMIHFYSDLDNV
Sbjct:  92  MEQIFVEHHSFGIVSLSSISESLKRLELSTDLNIQELLAIKKVLQSSSDMIHFYSDLDNV  151

Query: 122  SFQSLDRLFENLEQFPNLQGSFQAINDGGFLEHFASPELERIRRQLTNSERRVRQILQDM  181
            SFQSLDRLFENLEQFPNLQGSFQAINDGGFLEHFASPELERIRRQLTNSERRVRQILQDM
Sbjct: 152  SFQSLDRLFENLEQFPNLQGSFQAINDGGFLEHFASPELERIRRQLTNSERRVRQILQDM  211

Query: 182  LKEKAELLSENLIASRSGRSVLPVKNTYRNRISGVVHDISSSGSTVYIEPRAVVTLNEEI  241
            LKEKAELLSENLIASRSGRSVLPVKNTYRNRISGVVHDISSSGSTVYIEPRAVVTLNEEI
Sbjct: 212  LKEKAELLSENLIASRSGRSVLPVKNTYRNRISGVVHDISSSGSTVYIEPRAVVTLNEEI  271

Query: 242  TQLRADERHEESRILHAFSDLLRPHVATIRNNAWILGHLDFVRAKYLFMSDNKATIPEIS  301
            TQLRADERHEE RILHAFSDLLRPHVATIRNNAWILGHLDFVRAKYLFMSDNKATIP+IS
Sbjct: 272  TQLRADERHEEGRILHAFSDLLRPHVATIRNNAWILGHLDFVRAKYLFMSDNKATIPKIS  331

Query: 302  NDSTLALINVRHPLLSNPVANDLHFDQDLTAIVITGPNTGGKTIMLKTLGLAQLMGQSGL  361
            NDSTLALINVRHPLLSNPVANDLHFD DLTAIVITGPNTGGKTIMLKTLGLAQLMGQSGL
Sbjct: 332  NDSTLALINVRHPLLSNPVANDLHFDHDLTAIVITGPNTGGKTIMLKTLGLAQLMGQSGL  391

Query: 362  PVLADKGSKIAVFNNIFADIGDEQSIEQSLSTFSSHMTHIVSILNEADHNSLVLFDELGA  421
            PVLADKGSKIAVFNNIFADIGDEQSIEQSLSTFSSHMTHIVSILNEADHNSLVLFDELGA
Sbjct: 392  PVLADKGSKIAVFNNIFADIGDEQSIEQSLSTFSSHMTHIVSILNEADHNSLVLFDELGA  451

Query: 422  GTDPQEGASLAMAILEHLRLSNIKTMATTHYPELKAYGIETNFVENASMEFDAETLSPTY  481
            GTDPQEGASLAMAILEHLRLS+IKTMATTHYPELKAYGIETNFVENASMEFDAETLSPTY
Sbjct: 452  GTDPQEGASLAMAILEHLRLSHIKTMATTHYPELKAYGIETNFVENASMEFDAETLSPTY  511

Query: 482  RFMQGVPGRSNAFEIASRLGLAPFIVKQAKQMTDSDSDVNRIIEQLEAQTLETRRRLDHI  541
            RFMQGVPGRSNAFEIASRLGLAPFIVKQAKQMTDSDSDVNRIIEQLEAQTLETRRRLDHI
Sbjct: 512  RFMQGVPGRSNAFEIASRLGLAPFIVKQAKQMTDSDSDVNRIIEQLEAQTLETRRRLDHI  571

Query: 542  KEVEQENLKFNRAVKKLYNEFSHERDKELEKIYQEAQEIVDMALNESDTILKKLNDKSQL  601
            KEVEQENLKFNRAVKKLYNEFSHERDKELEKIYQEAQEIVDMALNESDTILKKLNDKSQL
Sbjct: 572  KEVEQENLKFNRAVKKLYNEFSHERDKELEKIYQEAQEIVDMALNESDTILKKLNDKSQL  631

Query: 602  KPHEIIDAKAQIKKLAPQVDLSKNKVLNKAKKIKAARAPRIGDDIIVTSYGQRGTLTSQL  661
            KPHEIIDAKAQIKKLAPQVDLSKNKVLNKAKKIKAARAPRIGDDIIVTSYGQRGTLTSQL
Sbjct: 632  KPHEIIDAKAQIKKLAPQVDLSKNKVLNKAKKIKAARAPRIGDDIIVTSYGQRGTLTSQL  691

Query: 662  KDGRWEAQVGIIKMTLTQDEFTLVRVQEEQKVKSKQINVVKKADSSGPRARLDLRGKRYE  721
            KDGRWEAQVGIIKMTLTQDEF+LVRVQEEQKVK+KQINVVKKAD SGPRARLDLRGKRYE
Sbjct: 692  KDGRWEAQVGIIKMTLTQDEFSLVRVQEEQKVKNKQINVVKKADGSGPRARLDLRGKRYE  751

Query: 722  EAMQELDNFIDQALLNNMGQVDIIHGIGTGVIREGVTKYLRRNKHVKHFAYAPQNAGGSG  781
```

```
                                       -continued
            EAMQELD+FIDQALLNNMGQVDIIHGIGTGVIREGVTKYLRRNKHVKHFAYAPQNAGGSG
Sbjct: 752  EAMQELDHFIDQALLNNMGQVDIIHGIGTGVIREGVTKYLRRNKHVKHFAYAPQNAGGSG  811

Query: 782  ATIVTLG                                                      788
            ATIVTLG
Sbjct: 812  ATIVTLG                                                      818
```

Based on this analysis, it was predicted that these proteins and their epitopes could be useful antigens for vaccines or diagnostics.

Example 1636

A DNA sequence (GBSx1731) was identified in *S. agalactiae* <SEQ ID 5057> which encodes the amino acid sequence <SEQ ID 5058>. This protein is predicted to be thioredoxin (trxA). Analysis of this protein sequence reveals the following:

```
Possible site: 48
>>> Seems to have no N-terminal signal sequence
----- Final Results -----
    bacterial cytoplasm --- Certainty = 0.2721 (Affirmative) <succ>
      bacterial membrane --- Certainty = 0.0000 (Not Clear) <succ>
       bacterial outside --- Certainty = 0.0000 (Not Clear) <succ>
```

A related GBS nucleic acid sequence <SEQ ID 10115> which encodes amino acid sequence <SEQ ID 10116> was also identified.

The protein has homology with the following sequences in the GENPEPT database.

```
>GP:CAB40815 GB:AJ133006 thioredoxin [Listeria monocytogenes] (ver
            2)
Identities = 64/100 (64%), Positives = 78/100 (78%), Gaps = 1/100 (1%)
Query:  15  MALEVTDATFVEETKEGLVLIDFWATWCGPCRMQAPILEQLSQEIDEDELKILKMDVDEN   74
            M  E+TDATF +ET EGLVL DFWATWCGPCRM AP+LE++ +E  E  LKI+KMDVDEN
Sbjct:   1  MVKEITDATFEQETSEGLVLTDFWATWCGPCRMVAPVLEEIQEERGE-ALKIVKMDVDEN   59

Query:  75  PETARQFGIMSIPTLMFKKDGEVVKQVAGVHTKDQLKAII                      114
            PET   FG+MSIPTL+ KKDGEVV+ + G   K++L  +I
Sbjct:  60  PETPGSFGVMSIPTLLIKKDGEVVETIIGYRPKEELDEVI                       99
```

A related DNA sequence was identified in *S. pyogenes* <SEQ ID 5059> which encodes the amino acid sequence <SEQ ID 5060>. Analysis of this protein sequence reveals the following:

```
Possible site: 48
>>> Seems to have no N-terminal signal sequence
----- Final Results -----
    bacterial cytoplasm --- Certainty = 0.2721 (Affirmative) <succ>
```

```
      bacterial membrane --- Certainty = 0.0000 (Not Clear) <succ>
       bacterial outside --- Certainty = 0.0000 (Not Clear) <succ>
```

Based on this analysis, it was predicted that these proteins and their epitopes could be useful antigens for vaccines or diagnostics.

Example 1637

A DNA sequence (GBSx1732) was identified in *S. agalactiae* <SEQ ID 5061> which encodes the amino acid sequence <SEQ ID 5062>. Analysis of this protein sequence reveals the following:

```
Possible site: 33
>>> Seems to have no N-terminal signal sequence
INTEGRAL    Likelihood = -7.54    Transmembrane 170-186 (167-191)
INTEGRAL    Likelihood = -5.52    Transmembrane 87-103 (86-107)
INTEGRAL    Likelihood = -4.62    Transmembrane 105-121 (104-126)
----- Final Results -----
    bacterial membrane --- Certainty = 0.4015 (Affirmative) <succ>
       bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:CAA60798 GB:X87369 ORF3 [Clostridium perfringens]
Identities = 27/67 (40%), Positives = 52/67 (77%)
Query:   1  MEIGQQIIRYRKQQALSQEELAEKVYVSRQSISNWENDKTYPDIHSLLLLSQIFQVSLDQ   60
            M++  +++   RK++ LSQE+LAEK+ +SRQ++S WE+ ++ PD++ L++LS+++ V++D
Sbjct:   1  MKLAEKLQLMRKREGLSQEDLAEKLGISRQAVSKWESGQSVPDLNKLIILSELYNVTIDY   60

Query:  61  LIKGDIE                                                       67
            L+K  E
Sbjct:  61  LVKETYE                                                       67
```

A related DNA sequence was identified in *S. pyogenes* <SEQ ID 1739> which encodes the amino acid sequence <SEQ ID 1740>. Analysis of this protein sequence reveals the following:

```
Possible site: 36
>>> Seems to have no N-terminal signal sequence
INTEGRAL    Likelihood = -8.86   Transmembrane 173-189 (169-194)
INTEGRAL    Likelihood = -5.52   Transmembrane 90-106 (89-110)
INTEGRAL    Likelihood = -4.62   Transmembrane 108-124 (107-129)
----- Final Results -----
    bacterial membrane --- Certainty = 0.4545 (Affirmative) <succ>
     bacterial outside --- Certainty = 0.0000 (Not Clear) <succ>
       bacterial cytoplasm --- Certainty = 0.0000 (Not Clear) <succ>
```

An alignment of the GAS and GBS proteins is shown below.

```
Identities = 187/195 (95%), Positives = 191/195 (97%)
Query:   1  MEIGQQIIRYRKQQALSQEELAEKVYVSRQSISNWENDKTYPDIHSLLLLSQIFQVSLDQ   60
            MEIGQQIIRYRKQQALSQE+LAEKVYVSRQSISNWENDKTYPDIHSLLLLSQIFQVSLDQ
Sbjct:   4  MEIGQQIIRYRKQQALSQEKLAEKVYVSRQSISNWENDKTYPDIHSLLLLSQIFQVSLDQ   63

Query:  61  LIKGDIEKMKYTITQVDKKNFERDTKVMVTLMILLMISSYPLVYFLEWLGLGIFVLLSII  120
            LIKGDIEKMKYTITQVDKKNF+RDTKVMVTLMILLMISSYPLVYFLEWLGLGIFVLLSII
Sbjct:  64  LIKGDIEKMKYTITQVDKKNFKRDTKVMVTLMILLMISSYPLVYFLEWLGLGIFVLLSII  123

Query: 121  TMTYANRVERFKKKYDVQTYKEILAVSSGKLLDEIEKREERAKLPYQKPLIVTVFFLITV  180
            TMTYANRVERFKKKYDVQ YKEILAVS+GKLLDEIEKREERA LPYQKPLIVTVFFLITV
Sbjct: 124  TMTYANRVERFKKKYDVQPYKEILAVSNGKLLDEIEKREERATLPYQKPLIVTVFFLITV  183

Query: 181  ATFFASRFIFTWLFH                                              195
            A  FASRF+FTWLFH
Sbjct: 184  AFAFASRFMFTWLFH                                              198
```

```
Possible site: 30
>>> Seems to have no N-terminal signal sequence
----- Final Results -----
    bacterial cytoplasm --- Certainty = 0.2385 (Affirmative) <succ>
    bacterial membrane --- Certainty = 0.0000 (Not Clear) <succ>
     bacterial outside --- Certainty = 0.0000 (Not Clear) <succ>
```

A related GBS nucleic acid sequence <SEQ ID 9425> which encodes amino acid sequence <SEQ ID 9426> was also identified.

The protein has homology with the following sequences in the GENPEPT database.

Based on this analysis, it was predicted that these proteins and their epitopes could be useful antigens for vaccines or diagnostics.

Example 1638

A DNA sequence (GBSx1733) was identified in *S. agalactiae* <SEQ ID 5063> which encodes the amino acid sequence <SEQ ID 5064>. This protein is predicted to be adenine glycosylase (mutY). Analysis of this protein sequence reveals the following:

```
>GP:BAB04650 GB:AP001510 adenine glycosylase [Bacillus halodurans]
Identities = 130/331 (39%), Positives = 190/331 (57%), Gaps = 15/331 (4%)
Query:   1  MLQQTQVNTVIPYYKRFLEWFPQIKDLADAPEEQLLKAWEGLGYYSRVRNMQKAAQQVMV   60
            MLQQT+V+TVIPYY+ F+  FP ++ LA A E+Q+LKAWEGLGYYSR RN+Q A ++V+
Sbjct:  45  MLQQTRVDTVIPYYQAFMRQFPTLETLAYAEEDQVLKAWEGLGYYSRARNLQSAVREVVE  104

Query:  61  DFGGIFPHTYDDIASLKGIGPYTAGAIASISFNLPEPAVDGNVMRVMARLFEVNYDIGDP  120
            +GG  P T  +I+ LKG+GPYTAGAI SI+++ PEPAVDGNVMRV++R+  +  DI
Sbjct: 105  SYGGEVPSTRKEISKLKGVGPYTAGAILSIAYDQPEPAVDGNVMRVLSRVLYIEEDIAKV  164

Query: 121  KNRKIFQAIMEILIDPDRPGDFNQALMDLGTDIESAKTPRPDESPIRFFNAAYLNGTYSK  180
            K R +F++++ LI  + P  FNQ LM+LG  + +  +P      P+R    A+ G   +
Sbjct: 165  KTRTLFESLLYDLISKENPSFFNQGLMELGALVCTPTSPGCLLCPVRDHCRAFAAGVQEQ  224

Query: 181  YPIKNTKKKPKPMRIQAFVIRNQNGQYLLEKNTKGRLLGGFWSFPIIETSPLSQQLDLFD  240
             PIK   KKKPK  ++ A VIRN+ GQ L+E+   LL    W FP +E          L
Sbjct: 225  LPIKAKKKKPKAKQLIAAVIRNEKGQVLIERRPEKGLLAKLWQFPNVE---------LES  275

Query: 241  DNQSNPIIWQTQNETFQREYQLKPQWTDNHFPNIKHTFSHQKWTIELIEGVVKAT-DLPN  299
               +  +     +E F  + +        + ++H FSH  W I + E  VK   L +
Sbjct: 276  TKNAQQVLGDYIHERFHLDAAV-----GEYVQTVEHVFSHLIWNIRVYEATVKGVPSLND  330

Query: 300  APHLKWVAIEDFSLYPFATPQKKMLETYLKQ                              330
                WV      Y F     +K+++ L++
Sbjct: 331  KYEADWVDDRTIENYAFPVSHQKIIQGNLRK                              361
```

A related DNA sequence was identified in *S. pyogenes* <SEQ ID 5065> which encodes the amino acid sequence <SEQ ID 5066>. Analysis of this protein sequence reveals the following:

```
Possible site: 60
>>> Seems to have no N-terminal signal sequence
----- Final Results -----
    bacterial cytoplasm --- Certainty = 0.3579 (Affirmative) <succ>
      bacterial membrane --- Certainty = 0.0000 (Not Clear) <succ>
       bacterial outside --- Certainty = 0.0000 (Not Clear) <succ>
```

An alignment of the GAS and GBS proteins is shown below.

```
Identities = 330/333 (99%), Positives = 331/333 (99%)
Query:   1  MLQQTQVNTVIPYYKRFLEWFPQIKDLADAPEEQLLKAWEGLGYYSRVRNMQKAAQQVMV   60
            MLQQTQVNTVIPYYKRFLEWFPQIKDLADAPEEQLLKAWEGLGYYSRVRNMQKAAQQVMV
Sbjct:  52  MLQQTQVNTVIPYYKRFLEWFPQIKDLADAPEEQLLKAWEGLGYYSRVRNMQKAAQQVMV  111

Query:  61  DFGGIFPHTYDDIASLKGIGPYTAGAIASISFNLPEPAVDGNVMRVMARLFEVNYDIGDP  120
            DFGGIFPHTYDDIASLKGIGPYTAGAIASISFNLPEPAVDGNVMRVMARLFEVNYDIGDP
Sbjct: 112  DFGGIFPHTYDDIASLKGIGPYTAGAIASISFNLPEPAVDGNVMRVMARLFEVNYDIGDP  171

Query: 121  KNRKIFQAIMEILIDPDRPGDFNQALMDLGTDIESAKTPRPDESPIRFFNAAYLNGTYSK  180
            KNRKIFQAIMEILIDPDRPGDFNQALMDLGTDIESAKTPRPDESPIRFFNAAYLNGTY K
Sbjct: 172  KNRKIFQAIMEILIDPDRPGDFNQALMDLGTDIESAKTPRPDESPIRFFNAAYLNGTYGK  231

Query: 181  YPIKNTKKKPKPMRIQAFVIRNQNGQYLLEKNTKGRLLGGFWSFPIIETSPLSQQLDLFD  240
            YPIKN KKKPKPMRIQAFVIRNQNGQYLLEKNTKGRLLGGFWSFPIIETSPLSQQLDLFD
Sbjct: 232  YPIKNPKKKPKPMRIQAFVIRNQNGQYLLEKNTKGRLLGGFWSFPIIETSPLSQQLDLFD  291

Query: 241  DNQSNPIIWQTQNETFQREYQLKPQWTDNHFPNIKHTFSHQKWTIELIEGVVKATDLPNA  300
            DNQSNPIIWQTQNETF+REYQLKPQWTDNHFPNIKHTFSHQKWTIELIEGVVKATDLPNA
Sbjct: 292  DNQSNPIIWQTQNETFEREYQLKPQWTDNHFPNIKHTFSHQKWTIELIEGVVKATDLPNA  351

Query: 301  PHLKWVAIEDFSLYPFATPQKKMLETYLKQKNA  333
            PHLKWVAIEDFSLYPFATPQKKMLETYLKQKNA
Sbjct: 352  PHLKWVAIEDFSLYPFATPQKKMLETYLKQKNA  384
```

Based on this analysis, it was predicted that these proteins and their epitopes could be useful antigens for vaccines or diagnostics.

Example 1639

A DNA sequence (GBSx1734) was identified in *S. agalactiae* <SEQ ID 5067> which encodes the amino acid sequence <SEQ ID 5068>. This protein is predicted to be maltose/maltodextrin transport system (malG). Analysis of this protein sequence reveals the following:

```
Possible site: 52
>>> Seems to have an uncleavable N-term signal seq
INTEGRAL    Likelihood = -10.30   Transmembrane 14-30 (5-35)
INTEGRAL    Likelihood =  -6.95   Transmembrane 248-264 (242-267)
INTEGRAL    Likelihood =  -5.15   Transmembrane 75-91 (74-94)
INTEGRAL    Likelihood =  -3.19   Transmembrane 110-126 (110-127)
INTEGRAL    Likelihood =  -2.13   Transmembrane 141-157 (138-157)
INTEGRAL    Likelihood =  -0.32   Transmembrane 188-204 (188-204)
----- Final Results -----
    bacterial membrane --- Certainty = 0.5118 (Affirmative) <succ>
     bacterial outside --- Certainty = 0.0000 (Not Clear) <succ>
   bacterial cytoplasm --- Certainty = 0.0000 (Not Clear) <succ>
```

The protein has homology with the following sequences in the GENPEPT database.

```
>GP:BAB06643 GB:AP001517 maltose/maltodextrin transport system
(permease) [Bacillus halodurans]
Identities = 117/281 (41%), Positives = 169/281 (590), Gaps = 5/281 (1%)
Query:   1  MNKK--KRLNLTFVYILLIVLSIMWLFPIVWVVLTSFRGEGSAFVNYFIPKTWTLDNYAK   58
            MNKK    RL +T +Y+ L+V+ I+ L+P++W V  S    S F +  IP+T +  +Y
Sbjct:   1  MNKKVKSRLEVTAIYLFLLVMGIVILYPLLWTVGLSLNPGTSLFSSRMIPETISFRHYEW   60

Query:  59  LFTQNTFPFGQWFLNTLFVATCTCILSTLITVAMAYSLSRIKFKHRNGFLKLALVLNMFP  118
            LF       + QW+ NTL VA+ T + ST +    AY+ SR +F  R   L    L+L MFP
Sbjct:  61  LFFDPRSNYLQWYKNTLIVASVTSVCSTFLVALTAYAFSRYRFVGRTYGLYGFLLLQMFP  120

Query: 119  GFMSMIAVYYILKALNLDQTLTALIFVY-SAGAALTFYIAKGFFDTIPYSLDESAMIDGA  177
                M+M+A+Y +L  +NL  TL  LI +Y         +  ++ KG+FDTIP  LDESA +DGA
Sbjct: 121  VLMAMVALYILLNTVNLLDTLLGLILIYVGTSIPMNAFLVKGYFDTIPRELDESAKLDGA  180

Query: 178  TRLDIFLKITLPLSKPIIVYTALIAFMGPWMDFIFAKVILGDATSKYTVAIGLFSMLQQD  237
                  IF    I LPL+KPI+    AL FM P+MDFI ++ IL +       YT+A+GLF+ +
Sbjct: 181  GHFRIFFTIMLPLAKPILAVVALFNFMSPFMDFILPRIIL-RSPENYTLALGLFNFVNDQ  239

Query: 238  TINQWFMSFTAGSVIIAIPITILFMFMQKYYVEGITGGSVK   278
               N  F  F AG+++IAIPI  +F+F+Q+Y + G+T G+ K
Sbjct: 240  FANN-FTRFAAGAILIAIPIATVFLFLQRYLISGLTTGATK  279
```

A related DNA sequence was identified in *S. pyogenes* <SEQ ID 5069> which encodes the amino acid sequence <SEQ ID 5070>. Analysis of this protein sequence reveals the following:

```
Possible site: 39
>>> Seems to have a cleavable N-term signal seq.
INTEGRAL    Likelihood = -6.42    Transmembrane 76-92 (71-97)
INTEGRAL    Likelihood = -6.05    Transmembrane 248-264 (242-267)
INTEGRAL    Likelihood = -3.50    Transmembrane 110-126 (110-127)
INTEGRAL    Likelihood = -1.33    Transmembrane 129-145 (129-145)
INTEGRAL    Likelihood = -1.33    Transmembrane 188-204 (188-204)
----- Final Results -----
    bacterial membrane --- Certainty = 0.3569 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the databases:

```
>GP:CAA60006 GB:X86014 cymG [Klebsiella oxytoca]
Identities = 119/270 (44%), Positives = 172/270 (63%), Gaps = 7/270 (2%)
Query:  11  LVYATLIILSIIWLFPIAWVILTSFRSEGTAYVNYFIPKTFTLNHYINLFTNETFPFGKW    70
            LVY  L++ +++ L P+ W +++S +      + + F   +FTL HY NL T    P+ KW
Sbjct:  12  LVYLFLLLNALVVLGPVIWTVMSSLKPGNNLFSSGFTEISFTLEHYHNLLTGT--PYLKW    69

Query:  71  FMNTLIVATFTCIISTFITVAIAYSLSRIKFKFRNGFLKLALILNMFPGFMSMIAIYYIL   130
            + NT I+AT   +IS +    A+  SR +FK +   L    L+L MFP F+SM AIY +L
Sbjct:  70  YKNTFILATCNMLISLVVVTITAFIFSRYRFKAKKKILMSILVLQMFPAFLSMTAIYILL   129

Query: 131  KALGLTQTLTALVLVYSSGAALGF--YIAKGFFDTIPYSLDESAMIDGATRMDIFFKITL   188
             + L  T    L+LVY +G+ L F  ++ KG+FD IP SLDE+A IDGA  + IFF+I L
Sbjct: 130  SKMNLIDTYIGLLLVYVTGS-LPFMTWLVKGYFDAIPTSLDEAAKIDGAGHLTIFFEIIL   188

Query: 189  PLAKPIIVYTALLAFMGPWIDFIFAQVILGDATSKYTVAIGLFSMLQPDTINNWFMAFTA   248
            PLAKPI+V+ AL++F GPW+DFI   +IL  +  K T+AIG+FS + ++  N F    A
Sbjct: 189  PLAKPILVFVALVSFTGPWMDFILPTLIL-RSEDKMTLAIGIFSWISSNSAEN-FTLFAA   246

Query: 249  GSVLIAVPITLLFMFMQKYYVEGITGGSVK                                278
            G++L+AVPITLLF+ QK+   G+  G+VK
Sbjct: 247  GALLVAVPITLLFIVTQKHITTGLVSGAVK                                276
```

An alignment of the GAS and GBS proteins is shown below.

Based on this analysis, it was predicted that these proteins and their epitopes could be useful antigens for vaccines or diagnostics.

Example 1640

A DNA sequence (GBSx1735) was identified in *S. agalactiae* <SEQ ID 5071> which encodes the amino acid sequence <SEQ ID 5072>. This protein is predicted to be cymF protein (malF). Analysis of this protein sequence reveals the following:

```
Possible site: 36
>>> Seems to have no N-terminal signal sequence
INTEGRAL    Likelihood = -11.46   Transmembrane 427-443 (417-447)
INTEGRAL    Likelihood = -10.24   Transmembrane 99-115 (96-121)
INTEGRAL    Likelihood = -9.39    Transmembrane 166-182 (154-185)
```

```
Identities = 227/278 (81%), Positives = 253/278 (90%)
Query:   1  MNKKKRLNLTFVYILLIVLSIMWLFPIVWVVLTSFRGEGSAFVNYFIPKTFTLDNYAKLF    60
            M K+R  L  VY LI+LSI+WLFPI WV+LTSFR EG+A+VNYFIPKT TL++ Y  LF
Sbjct:   1  MKNKRRFQLGLVYATLIILSIIWLFPIAWVILTSFRSEGTAYVNYFIPKTFTLNHYINLF    60

Query:  61  TQNTFPFGQWFLNTLFVATCTCILSTLITVAMAYSLSRIKFKHRNGFLKLALVLNMFPGF   120
            T   TFPFG+WF+NTL VAT TCI+ST ITVA+AYSLSRIKFK RNGFLKLAL+LNMFPGF
Sbjct:  61  TNETFPFGKWFMNTLIVATFTCIISTFITVAIAYSLSRIKFKFRNGFLKLALILNMFPGF   120

Query: 121  MSMIAVYYILKALNLDQTLTALIFVYSAGAALIFYIAKGFFDTIPYSLDESAMIDGATRL   180
            MSMIA+YYILKAL L QTLTAL+ VYS+GAAL FYIAKGFFDTIPYSLDESAMIDGATR+
Sbjct: 121  MSMIAIYYILKALGLTQTLTALVLVYSSGAALGFYIAKGFFDTIPYSLDESAMIDGATRM   180

Query: 181  DIFLKITLPLSKPIIVYTALIAFMGPWMDFIFAKVILGDATSKYTVAIGLFSMLQQDTIN   240
            DIF KITLPL+KPIIVYTAL+AFMGPW+DFIFA+VILGDATSKYTVAIGLFSMLQ DTIN
Sbjct: 181  DIFFKITLPLAKPIIVYTALLAFMGPWIDFIFAQVILGDATSKYTVAIGLFSMLQPDTIN   240

Query: 241  QWFMSFTAGSVIIAIPITILFMFMQKYYVEGITGGSVK                        278
             WFM+FTAGSV+IA+PIT+LFMFMQKYYVEGITGGSVK
Sbjct: 241  NWFMAFTAGSVLIAVPITLLFMFMQKYYVEGITGGSVK                        278
```

```
INTEGRAL    Likelihood = -6.21    Transmembrane 259-275 (257-276)
INTEGRAL    Likelihood = -6.21    Transmembrane 229-245 (223-247)
INTEGRAL    Likelihood = -6.10    Transmembrane 44-60 (40-66)
INTEGRAL    Likelihood = -4.51    Transmembrane 314-330 (312-331)
----- Final Results -----
    bacterial membrane --- Certainty = 0.5585 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:CAA60005 GB:X86014 cymF [Klebsiella oxytoca]
Identities = 174/428 (40%), Positives = 263/428 (60%), Gaps = 21/428 (4%)
Query:   27 SFLIMGLANLKNKQIVKGLLFLISEILFLITFVYQVIPAVKGLISLGTQEQGMTTKTVDG   86
            SFLIMG    L +   +KG +FL+ +I+ +I+ +  ++ A +GLI+LGT  Q      T  G
Sbjct:   15 SFLIMGATQLISGHWIKGSVFLLFQIV-VISNINLLLNATQGLITLGTVAQ-----TRSG   68

Query:   87 IKIQVATQGDNSMLMLIFGLASLIFCCVFAYIYWSNIKSAAHLLTLKEEGREIPSFKKDI  146
              I     GDNS+ ML+ G+ + IF      ++YW NIK A        + SF + +
Sbjct:   69 FDI---VAGDNSIFMLVEGVVAFIFLFFSIFVYWLNIKDAQVCEKCHQ------SFTEQL  119

Query:  147 KSLTDGRFHMTLMSIPLIGVLLFTILPLVYMICLAFTNYDH-NHLPPKSLFDWVGFANFG  205
            +++ D RF   +++   I + F I+P++ + ++ TNY   +H+PPK+L DWVG  NF
Sbjct:  120 RTIYDNRFATIMLAPAFIACIAFIIMPMIITVLVSLTNYSAPHHIPPKNLVDWVGLKNFI  179

Query:  206 NIFSGRMAS-TFFPVLSWTLIWAVFATVTNFFFGIILALLINTKGLKFKKMWRTIFVITM  264
             +F  R+ S TF +  WT++WA FAT+     FG +LAL +  K +  KK WR +F++
Sbjct:  180 TLFELRIWSKTFVGIGVWTVLWAFFATLCTCSFGFLLALALENKKIIAKKAWRVVFILPY  239

Query:  265 AVPQFISLLIMRNLLSDAGPVNALLIKWGLISSAHPLPFLSDPVWAKFSIIFVNMWVGIP  324
            A+P F++LLI R LL+  GPVN+ L  WG+ S    + FLSDP+ AK ++I V++WVG P
Sbjct:  240 AIPAFVTLLIFRLLLNGIGPVNSTLNSWGIDS----IGFLSDPLIAKMTVIAVSVWVGAP  295

Query:  325 VTMLVATGIIMNLPAEQIEAAEIDGANKFQVFQSITFPQILLIMTPTLIQQFIGNINNFN  384
              ML+ TG  N+P +  EA+E+DGA+KFQ F+ IT P +L + P+L+  F   N NNF
Sbjct:  296 YFMLLITGAMTNIPRDLYEASEVDGASKFQQFREITLPMVLHQVAPSLVMTFAHNFNNFG  355

Query:  385 VIYLLTQGGPTNSTYYQAGSTDLLVTWLYNLTVTAADYNLASVVGILIFILSAVFSLLAY  444
             IYLLT+GGP N  Y  AG TD+L+TW+Y LT+    Y +ASV+ I+IF+ ++F++  +
Sbjct:  356 AIYLLTEGGPINPEYRFAGHTDILITWIYKLTLDFQQYQIASVSIIIFLFLSIFAIWQF  415

Query:  445 TRTNSYKE                                                      452
             R  S+KE
Sbjct:  416 RRMKSFKE                                                      423
```

A related DNA sequence was identified in *S. pyogenes* <SEQ ID 5073> which encodes the amino acid sequence <SEQ ID 5074>. Analysis of this protein sequence reveals the following:

```
Possible site: 36
>>> Seems to have no N-terminal signal sequence
```

```
INTEGRAL    Likelihood = -10.93   Transmembrane 98-114 (95-122)
INTEGRAL    Likelihood = -9.55    Transmembrane 165-181 (152-184)
INTEGRAL    Likelihood = -9.24    Transmembrane 424-440 (419-443)
INTEGRAL    Likelihood = -7.91    Transmembrane 43-59 (39-71)
INTEGRAL    Likelihood = -7.59    Transmembrane 258-274 (256-275)
INTEGRAL    Likelihood = -6.21    Transmembrane 228-244 (222-246)
INTEGRAL    Likelihood = -4.09    Transmembrane 311-327 (309-328)
----- Final Results -----
    bacterial membrane --- Certainty = 0.5373 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the databases:

```
>GP:CAA60005 GB:X86014 cymF [Klebsiella oxytoca]
Identities = 179/426 (42%), Positives = 266/426 (62%), Gaps = 19/426 (4%)
Query:   26 SSIIMGFANFANKQFIKGILFLISELIPLVAFVSQIIPAIRGLVTLGTQTQGMTIKTIDG   85
            S +IMG       +IKG +FL+ +++ +++ ++ ++ A +GL+TLGT  Q      T  G
Sbjct:   15 SFLIMGATQLISGHWIKGSVFLLFQIV-VISNINLLLNATQGLITLGTVAQ-----TRSG   68

Query:   86 INIQVAVDGDNSMLMLIFGLASLIFCLVFAYIYWCNLKSARNLYLFKQKGQKIPSFKEDL  145
            +I   V GDNS+ ML+ G+ + IF      ++YW N+K A+       Q      SF E L
Sbjct:   69 FDI---VAGDNSIFMLVEGVVAFIFLFFSIFVYWLNIKDAQVCEKCHQ------SFTEQL  119

Query:  146 ATLTNGRFHMTLMAIPLIGVLLFTILPLIYMICLAFTNFDH-NHLPPKSLFDWVGLANFG  204
             T+ + RF   ++A   I + F I+P+I + ++ TN+   +H+PPK+L DWVGL NF
Sbjct:  120 RTIYDNRFATIMLAPAFIACIAFIIMPMIITVLVSLTNYSAPHHIPPKNLVDWVGLKNFI  179

Query:  205 NVLSGRM-AGTFFPIFSWTLIWAVFATVTNFFFGIILALLINTKGLKWKKMWRTIFVITI  263
              +  R+   TF I  WT++WA FAT+     FG +LAL +  K +  KK WR +F++
```

```
-continued
Sbjct: 180  TLFELRIWSKTFVGIGVWTVLWAFFATLCTCSFGFLLALALENKKIIAKKAWRVVFILPY  239

Query: 264  AVPQFISLLIMRNLLNDEGPLNALLNKIGLINGSLPFLSDPLWAKFSIIFVNMWIGIPFT  323
            A+P F++LLI R LLN  GP+N+ LN   G+    S+ FLSDPL AK ++I V++W+G P+
Sbjct: 240  AIPAFVTLLIFRLLLNGIGPVNSTLNSWGI--DSIGFLSDPLIAKMTVIAVSVWVGAPYF  297

Query: 324  MLIATGIIMNLPSEQIEAAEIDGASKFQVFKSITFPQILLIMTPNLIQQFIGNINNFNVI  383
            ML+ TG + N+P +   EA+E+DGASKFQ F+ IT P +L   + P+L+   F  N NNF  I
Sbjct: 298  MLLITGAMTNIPRDLYEASEVDGASKFQQFREITLPMVLHQVAPSLVMTFAHNFNNFGAI  357

Query: 384  YLLTGGGPTNSEYYQAGTTDLLVTWLYKLTVTAADYNLASVIGILIFTVSAIFSLLAYTR  443
            YLLT GGP N EY   AG TD+L+TW+YKLT+        Y +ASVI I+IF   +IF++   + R
Sbjct: 358  YLLTEGGPINPEYRFAGHTDILITWIYKLTLDFQQYQIASVISIIIFLFLSIFAIWQFRR  417

Query: 444  TASYKE  449
            S+KE
Sbjct: 418  MKSFKE  423
```

An alignment of the GAS and GBS proteins is shown below.

```
Identities = 357/446 (80%), Positives = 404/446 (90%), Gaps = 2/446 (0%)
Query:  11  MSLKEVFQKGDLATKLSFLIMGLANLKNKQIVKGLLFLISEILFLITFVYQVIPAVKGLI  70
            +S+ E  ++G    KLS +IMG AN  NKQ +KG+LFLISE++FL+ FV Q+IPA++GL+
Sbjct:  10  ISVIEALKRGSWDIKLSSIIMGFANFANKQFIKGILFLISELIFLVAFVSQIIPAIRGLV  69

Query:  71  SLGTQEQGMTTKTVDGIKIQVATQGDNSMLMLIFGLASLIFCCVFAYIYWSNIKSAAHLL  130
            +LGTQ QGMTTKT+DGI IQVA  GDNSMLMLIFGLASLIFC VFAYIYW N+KSA +L
Sbjct:  70  TLGTQTQGMTTKTIDGINIQVAVDGDNSMLMLIFGLASLIFCLVFAYIYWCNLKSARNLY  129

Query: 131  TLKEEGREIPSFKKDIKSLTDGRFHMTLMSIPLIGVLLFTILPLVYMICLAFTNYDHNHL  190
              K++G++IPSFK+D+  +LT+GRFHMTLM+IPLIGVLLFTILPL+YMICLAFTN+DHNHL
Sbjct: 130  LFKQKGQKIPSFKEDLATLTNGRFHMTLMAIPLIGVLLFTILPLIYMICLAFTNFDHNHL  189

Query: 191  PPKSLFDWVGFANFGNIFSGRMASTFFPVLSWTLIWAVFATVTNFFFGIILALLINTKGL  250
            PPKSLFDWVG ANFGN+ SGRMA TFFP+ SWTLIWAVFATVTNFFFGIILALLINTKGL
Sbjct: 190  PPKSLFDWVGLANFGNVLSGRMAGTFFPIFSWTLIWAVFATVTNFFFGIILALLINTKGL  249

Query: 251  KFKKMWRTIFVITMAVPQFISLLIMANLLSDAGPVNALLIKWGLISSAHPLPFLSDPVWA  310
            K+KKMWRTIFVIT+AVPQFISLLIMRNLL+D GP+NALL K GLI+ +   LPFLSDP+WA
Sbjct: 250  KWKKMWRTIFVITIAVPQFISLLIMRNLLNDEGPLNALLNKIGLINGS--LPFLSDPLWA  307

Query: 311  KFSIIFVNMWVGIPVTMLVATGIIMNLPAEQIEAAEIDGANKFQVFQSITFPQILLIMTP  370
            KFSIIFVNMW+GIP TML+ATGIIMNLP+EQIEAAEIDGA+KFQVF+SITFPQILLIMTP
Sbjct: 308  KFSIIFVNMWIGIPFTMLIATGIIMNLPSEQIEAAEIDGASKFQVFKSITFPQILLIMTP  367

Query: 371  TLIQQFIGNINNFNVIYLLTQGGPTNSTYYQAGSTDLLVTWLYNLTVTAADYNLASVVGI  430
             LIQQFIGNINNFNVIYLLT GGPTNS YYQAG+TDLLVTWLY LTVTAADYNLASV+GI
Sbjct: 368  NLIQQFIGNINNFNVIYLLTGGGPTNSEYYQAGTTDLLVTWLYKLTVTAADYNLASVIGI  427

Query: 431  LIFILSAVFSLLAYTRTNSYKEGAAK  456
            LIF +SA+FSLLAYTRT SYKEGAAK
Sbjct: 428  LIFTVSAIFSLLAYTRTASYKEGAAK  453
```

A related GBS gene <SEQ ID 8869> and protein <SEQ ID 8870> were also identified. Analysis of this protein sequence reveals the following:

Lipop: Possible site: −1  Crend: 8
McG: Discrim Score: −12.73
GvH: Signal Score (−7.5): −6.04
Possible site: 36
>>> Seems to have no N-terminal signal sequence
ALOM program count: 7 value: −11.46 threshold: 0.0
INTEGRAL    Likelihood = −11.46   Transmembrane 427-443 (417-447)
INTEGRAL    Likelihood = −9.87    Transmembrane 99-115 (96-121)
INTEGRAL    Likelihood = −9.39    Transmembrane 166-182 (154-185)
INTEGRAL    Likelihood = −6.21    Transmembrane 259-275 (257-276)
INTEGRAL    Likelihood = −6.21    Transmembrane 229-245 (223-247)
INTEGRAL    Likelihood = −6.10    Transmembrane 44-60 (40-66)

-continued

INTEGRAL    Likelihood = −4.51    Transmembrane 314-330 (312-331)
PERIPHERAL  Likelihood = 0.90     212
modified ALOM score: 2.79
*** Reasoning Step: 3
----- Final Results -----
   bacterial membrane --- Certainty = 0.5585 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the databases:

```
ORF01027(379-1656 of 1968)
EGAD|33392|34706(15-423 of 427) cymF protein {Klebsiella oxytoca}
GP|854233|emb|CAA60005.1||X86014 cymF {Klebsiella oxytoca} PIR|S63615|S63615
malF protein homolog cymF-Klebsiella oxytoca
% Match = 23.8
% Identity = 41.3 % Similarity = 64.5
Matches = 171 Mismatches = 140 Conservative Sub.s = 96
132       162       192       222       252       282       312       342
VLLFLAILTVVKSNLAITLNV*NNSIKTSLKQNSTSRVMR*GEYSSFQLRVLPISYFVK*QLKETIMNKKLISLDGMSLK

ML 372       402       432       462       492       522       552       582
EVFQKGDLATKLSFLIMGLANLKNKQIVKGLLFLISEILFLITFVYQVIPAVKGLISLGTQEQGMTTKTVDGIKIQVATQ
      ||||||    |  :  :||  :||:  :|    :|:  :    ::   |  :|||:|||    |    |  |  |
LSEGKSMRIFPASFLIMGATQLISGHWIKGSVFLLFQI-VVISNINLLLNATQGLITLGTVAQ-----TRSGFDI---VA
          20        30        40        50        60        70

612       642       672       702       732       762       792       822
GDNSMLMLIFGLASLIFXCVFAYIYWSNIXSAAHLLTLKEEGREIPSFKKDIKSLTDGRFHMTLMSIPLIGVLLFTILPL
||||::||:  |:  ::||       ::||  ||          :  ||   ::::  ||         ::|     |  |:|:
GDNSIFMLVEGVVAFIFLFFSIFVYWLNI------KDAQVCEKCHQSFTEQLRTIYDNRFATIMLAPAFIACIAFIIMPM
          90        100       110       120       130       140

852   879       909       939       966       996       1026      1056
VYMICLAFTNYDH-NHLPPKSLFDWVGFANFGNIFSGRMAS-TFFPVLSWTLIWAVFATVTNPFFGIILALLINTKGLKF
 :   :  :::|||    :|:|||:|  ||||  ||    :|    |:  | ||    :   ||::||  |||     || :|||  :    |:
IITVLVSLTNYSAPHHIPPKNLVDWVGLKNFITLFELRIWSKTFVGIGVWTVLWAFFATLCTCSFGFLLALALENKKIIA
          160       170       180       190       200       210       200

1086      1116      1146      1176      1206      1236      1266      1296
KKMWRTIFVITMAVPQFISLLIMRNLLSDAGPVNALLIKWGLISSAHPLPFLSDPVWAKFSIIFVNMWVGIPVTMLVATG
||  ||  :|::     |:|   |::|||   |  ||:    ||||:  ||   ||     :  |||||:   ||   ::|   |::||||     ||:  ||
KKAWRVVFILPYAIPAFVTLLIFRLLLNGIGPVNSTLNSWG----IDSIGFLSDPLIAKMTVIAVSVWVGAPYFMLLITG
          240       250       260       270       280       290       300

1326      1356      1386      1416      1446      1476      1506      1536
IIMNLPAEQIEAAEIDGANKFQVFQSITFPQILLIMTPTLIQQFIGNINNFNVIYLLTQGGPTNSTYYQAGSTDLLVTWL
 :  |:|   :   ||:|:|||||:|||  |:   ||:||   |    |  |  ||| |  :|:|       ||||||  ::|:  :|:
AMTNIPRDLYEASEVDGASKFQQFREITLPMVLHQVAPSLVMTFAHNFNNFGAIYLLTEGGPINPEYRFAGHTDILITWI
          320       330       340       350       360       370       380

1566      1596      1626      1656      1686      1716      1746      1776
YNLTVTAADYNLASVVGILIFILSAVFSLLAYTRTNSYKEGAAKIRKNVLTLLLFIFYYYQLCGSFPLFGSFSQAS
|  ||:      |  :|||:  |:||::    ::|::     :  |    |:||
YKLTLDFQQYQIASVISIIIFLFLSIFAIWQFRRMKSFKEDVGM
          400       410       420
```

Based on this analysis, it was predicted that these proteins and their epitopes could be useful antigens for vaccines or diagnostics.

Example 1641

A DNA sequence (GBSx1736) was identified in *S. agalactiae* <SEQ ID 5075> which encodes the amino acid sequence <SEQ ID 5076>. This protein is predicted to be maltose/maltodextrin-binding protein precursor. Analysis of this protein sequence reveals the following:

Possible site: 41
>>> Seems to have no N-terminal signal sequence

INTEGRAL    Likelihood = −3.98    Transmembrane 25-41 (24-43)
----- Final Results -----
bacterial membrane --- Certainty = 0.2593 (Affirmative) <succ>
bacterial outside --- Certainty = 0.0000 (Not Clear) <succ>
bacterial cytoplasm --- Certainty = 0.0000 (Not Clear) <succ>

A related GBS nucleic acid sequence <SEQ ID 9999> which encodes amino acid sequence <SEQ ID 10000> was also identified.

The protein has homology with the following sequences in the GENPEPT database.

```
>GP:AAA26925 GB:L08611 MalX [Streptococcus pneumoniae]
Identities = 117/418 (27%), Positives = 186/418 (43%), Gaps = 43/418 (10%)
Query:  15 TKMEKNTWKKLLVSTAALSVVAGGAIAATHSNSVDAASKTTIKLWVPTDSKASYKAIVKK  74
           +K   K+T      V+ A+L +VA G+  A            ++       + ++V    K+  + + K
Sbjct:   3 SKFMKSTAVLGTVTLASLLLVACGSKTADKPADSGSSEVKELTVYVDEGYKSYIEEVAKA  62

Query:  75 FZKE-NKGVTVKMIESNDSKAQENVKKDPSKAADVFSLPHDQLGQLVESGVIQEIPEQYS 133
           ++KE     VT+K  ++        + ++            DV    P+D++G L    G + E+   + S
```

```
Sbjct:   63 YEKEAGVKVTLKTGDALGGLDKLSLDNQSGNVPDVMMAPYDRVGSLGSDGQLSEV--KLS  120

Query:  134 KEIAKNDTKQSLTGAQYKGKTYAFPFGIESQVLYYNKTKLTADDVKSYETITSKGKFGXQ  193
                +DT +SL  A    GK Y  P  IES V+YYNK  L  D  K++ + +   K
Sbjct:  121 DGAKTDDTTKSLVTAA-NGKVYGAPAVIESLVMYYNKD-LVKDAPKTFADLENLAKDSKY  178

Query:  194 LKAA-------------NSYVTGPXFLSVGDTLFGKSGEDAKGTNWGNEAGVSVL-----  235
              A             N Y T     G  +FG++G+DAK    N+ ++ +
Sbjct:  179 AFAGEDGKTTAFLADWINFYYTYGLLAGNGAYVEGQNGKDAKDIGLANDGSIAGINYAKS  238

Query:  236 ---KWIADQKKNDGFVNLTAENTMSKFGDGSVHAFESGPWDYDAAKKAVGEDKIGVAVYP  292
                 KW   +  +G NL    ++F +G  A    GPW    A K A  +   GVA  P
Sbjct:  239 WYEKWPKGMQDTEGAGNLI----QTQFQEGKTAAIIDGPWKAQAFKDA--KVNYGVATIP  292

Query:  293 TMKIGDKEVQQKAFLGVKLYAVNQAPAGSNTKRISASYKLAAYLTNAESQKIQFEKRHIV  352
              T+  G    + AF G K + + QA        K + AS K   +L    E  QK+ ++K + +
Sbjct:  293 TLPNGK---EYAAFGGGKAWVIPQA-----VKNLEASQKFVDFLVATEQQKVLYDKTNEI  344

Query:  353 PANSSIQSSDSVQKDELAKAVIEMGSSDKYTTVMPKLSQMSTFWTESAAILSDTYSGK    410
              PAN+  +S   + DEL  AVI+      K T  +P +SQMS  W +   +L D   SG+
Sbjct:  345 PANTEARSYAEGKNDELTTAVIK---QFKNTQPLPNISQMSAVWDPAKNMLFDAVSGQ    399
```

A related DNA sequence was identified in *S. pyogenes* <SEQ ID 5077> which encodes the amino acid sequence <SEQ ID 5078>. Analysis of this protein sequence reveals the following:

Possible site: 28

---

>>> May be a lipoprotein
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>

---

The protein has homology with the following sequences in the databases:

```
>GP:AAA26925 GB:L08611 MalX [Streptococcus pneumoniae]
Identities = 126/423 (29%), Positives = 191/423 (44%), Gaps = 50/423 (11%)
Query:   13 SLTLASTLLVGCSGSKDK--KEAGADSKTIKLWVPTGSKKSYADTIAK-FEKDSGYTVK   69
            ++TLAS LLV CGS + DK       ++ K + ++V  G  KSY +  +AK  +EK++G    V
Sbjct:   14 TVTLASLLLVACGSKTADKPADSGSSEVKELTVYVDEG-YKSYIEEVAKAYEKEAGVKVT   72

Query:   70 VVESEDPKAQEKIKKD--ASTAADVFSLPHDQLGQLVESGTIQEVPEKYNKEIAATSTDQ  127
              +   +   +K+  D  +     DV   P+D++G L    G  + EV   K +           T  +
Sbjct:   73 LKTGDALGGLDKLSLDNQSGNVPDVMMAPYDRVGSLGSDGQLSEV--KLSDGAKTDDTTK  130

Query:  128 ALVGAQYKGKTYAFPFGIESQVINYNKSKLAAEDVTSYD----TITTKATFGGTFKQ---  180
            +LV A   GK Y  P  IES V++YNK  +      T    D           +K   F G    +
Sbjct:  131 SLVTAA-NGKVYGAPAVIESLVMYYNKDLVKDAPKTFADLENLAKDSKYAFAGEDGKTTA  189

Query:  181 -----ANTYATGPLFMSVGNTLFGENGEDVKGTNWGNEKGAAVL--------KWIADQAS  227
                   N Y T  L     G  +FG+NG+D K     N+  A +              KW
Sbjct:  190 FLADWTNFYYTYGLLAGNGAYVFGQNGKDAKDIGLANDGSIAGINYAKSWYEKWPKGMQD  249

Query:  228 NKGFVSLDANNVMSKFGDGSVASFESGPWDYEAAQKAIGKENLGVAIYPKVTIGGETVQQ  287
              +G     N + ++F +G  A+    GPW    +A + A  K N GVA  P  +   G E
Sbjct:  250 TEG----AGNLIQTQFQEGKTAAIIDGPWKAQAFKDA--KVNYGVATIPTLPNGKE---Y  300

Query:  288 KAFLGVKLYAVNQAPAKGDTKRIAASYKLASYLTNAESQENQFKTRNIVPANKEVQSSEA  347
              AF G K + + QA  K       + AS K   +L    E  Q+  +    N  +PAN  E +S
Sbjct:  301 AAFGGGKAWVIPQA-----VKNLEASQKFVDELVATEQQKVLYDKTNEIPANTEARSYAE  355

Query:  348 VQSNELAKTVITMGSSSDYTVVMPKLSQMGTFWTESAAILSDAFNG----KIKENDYLTK  403
              +++EL    VI +    +  T  +P +SQM  W +   +L DA +G         K  ND +T Sbjct:  356 GKNDELTTAVIKQFKN---TQPLPNISQMSAVWDPAKNMLFDAVSGQKDAKTAANDAVTL  412

Query:  404 LQQ                                                           406
            +++
Sbjct:  413 IKE                                                           415
```

An alignment of the GAS and GBS proteins is shown below.

```
Identities = 278/415 (66%), Positives = 334/415 (79%), Gaps = 6/415 (1%)
Query:  21  TWKKLLVSTAALSVVAGGAIAATHSNSVD----AASKTTIKLWVPTDSKASYKAIVKKFZ   76
            +W+K++V A+L++ A   +    S S D    A   TIKLWVPT SK SY    + KF+
Sbjct:   3  SWQKVIVGGASLTL-ASTLLVGCGSGSKDKKEAGADSKTIKLWVPTGSKKSYADTIAKFE   61

Query:  77  KENKGVTVKMIESNDSKAQENVKKDPSKAADVFSLPHDQLGQLVESGVIQEIPEQYSKEI  136
            K++ G TVK++ES D KAQE +KKD S AADVFSLPHDQLGQLVESG IQE+PE+Y+KEI
Sbjct:  62  KDS-GYTVKVVESEDPKAQEKIKKDASTAADVFSLPHDQLGQLVESGTIQEVPEKYNKEI  120

Query: 137  AKNDTKQSLTGAQYKGKTYAFPFGIESQVLYYNKTKLTADDVKSYETITSKGKFGXQLKA  196
            A    T Q+L GAQYKGKTYAFPFGIESQVL+YNK+KL A+DV SY+TIT+K   FG   K
Sbjct: 121  AATSTDQALVGAQYKGKTYAFPFGIESQVLFYNKSKLAAEDVTSYDTITTKATFGGTFKQ  180

Query: 197  ANSYVTGPXFLSVGDTLFGKSGEDAKGTNWGNEAGVSVLKWIADQKENDGFVNLTAENTM  256
            AN+Y TGP F+SVG+TLFG++GED KGTNWGNE G +VLKWIADQ  N GFV+L A N M
Sbjct: 181  ANTYATGPLFMSVGNTLFGENGEDVKGTNWGNEKGAAVLKWIADQASNKGFVSLDANNVM  240

Query: 257  SKFGDGSVHAFESGPWDYDAAKKAVGEDKIGVAVYPTMKIGDKEVQQKAFLGVKLYAVNQ  316
            SKFGDGSV +FESGPWDY+AA+KA+G++ +GVA+YP + IG + VQQKAFLGVKLYAVNQ
Sbjct: 241  SKFGDGSVASFESGPWDYEAAQKAIGKENLGVAIYPKVTIGGETVQQKAFLGVKLYAVNQ  300

Query: 317  APAGSNTKRISASYKLAAYLTNAESQKIQFEKRHIVPANSSIQSSDSVQKDELAKAVIEM  376
            APA  +TKRI+ASYKLA+YLTNAESQ+ QF+ R+IVPAN  +QSS++VQ +ELAK VI M
Sbjct: 301  APAKGDTKRIAASYKLASYLTNAESQENQFKTRNIVPANKEVQSSEAVQSNELAKTVITM  360

Query: 377  GSSDKYTTVMPKLSQMSTFWTESAAILSDTYSGKIKSSDYLKRLKQFDKDIAKTK       431
            GSS  YT VMPKLSQM TFWTESAAILSD ++GKIK +DYL +L+QFDKDIA TK
Sbjct: 361  GSSSDYTVVMPKLSQMGTFWTESAAILSDAFNGKIKENDYLTKLQQFDKDIAATK       415
```

Figure 132:
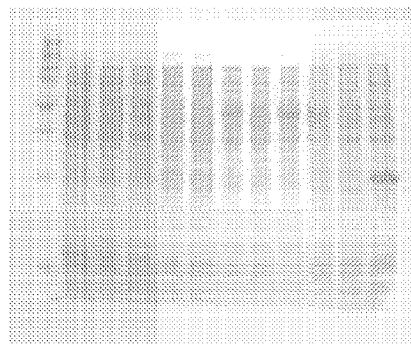

SEQ ID 5076 (GBS649) was expressed in *E. coli* as a GST-fusion product. SDS-PAGE analysis of total cell extract is shown in FIG. 132 (lane 2 & 3; MW 76 kDa) and in FIG. 186 (lane 7; MW 76 kDa). It was also expressed in *E. coli* as a His-fusion product. SDS-PAGE analysis of total cell extract is shown in FIG. 132 (lane 7; MW 51 kDa) and in FIG. 178 (lane 8; MW 51 kDa).

GBS649-His was purified as shown in FIG. 229, lane 8. Purified GBS649-GST is shown in FIG. 245, lanes 6 &73.

Based on this analysis, it was predicted that these proteins and their epitopes could be useful antigens for vaccines or diagnostics.

Example 1642

A DNA sequence (GBSx1737) was identified in *S. agalactiae* <SEQ ID 5079> which encodes the amino acid sequence <SEQ ID 5080>. Analysis of this protein sequence reveals the following:

Possible site: 51
>>> Seems to have no N-terminal signal sequence
----- Final Results -----
  bacterial cytoplasm --- Certainty = 0.2462 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:AAD02112 GB:AF039082 putative maltose operon transcriptional
repressor [Lactococcus lactis]
Identities = 43/61 (70%), Positives = 49/61 (79%)
Query:   2  VTIKDVAAKAGVNPSTVSRVLKDNASISSKTKERVKKAMEELGYVPNVAAQMLASGLTQN   61
            VTIKDVA KAGVN STVSRV+KD++ IS KTK +V+KAM ELGY  N AAQ+LASG T
Sbjct:   3  VTIKDVAKKAGVNASTVSRVIKDSSEISDKTKVKVRKAMHELGYRRMAAAQILASGKTNT   62

Query:  62  I                                                             62
            I
Sbjct:  63  I                                                             63
```

A related DNA sequence was identified in *S. pyogenes* <SEQ ID 5081> which encodes the amino acid sequence <SEQ ID 5082>. Analysis of this protein sequence reveals the following:

Possible site: 44
>>> Seems to have no N-terminal signal sequence
INTEGRAL    Likelihood = −3.93    Transmembrane 269-285 (266-287)
----- Final Results -----
  bacterial membrane --- Certainty = 0.2572 (Affirmative) <succ>
    bacterial outside --- Certainty = 0.0000 (Not Clear) <succ>
    bacterial cytoplasm --- Certainty = 0.0000 (Not Clear) <succ>

An alignment of the GAS and GBS proteins is shown below.

```
Identities = 53/62 (85%), Positives = 57/62 (91%)
Query:   1  MVTIKDVAAKAGVNPSTVSRVLKDNASISSKTKERVKKAMEELGYVPNVAAQMLASGLTQ   60
            MVTIKDVA KAGVNPSTVSRVLKDN SIS KTKE+V+KAM +LGYVPNVAAQ+LASGLT
Sbjct:  26  MVTIKDVAQKAGVNPSTVSRVLKDNRSISMKTKEKVRKAMADLGYVPNVAAQILASGLTH   85

Query:  61  NI   62
            NI
Sbjct:  86  NI   87
```

Based on this analysis, it was predicted that these proteins and their epitopes could be useful antigens for vaccines or diagnostics.

Example 1643

A DNA sequence (GBSx1738) was identified in *S. agalactiae* <SEQ ID 5083> which encodes the amino acid sequence <SEQ ID 5084>. Analysis of this protein sequence reveals the following:

```
Possible site: 56
>>> Seems to have an uncleavable N-term signal seq
INTEGRAL    Likelihood = -7.70    Transmembrane 14-30 (8-34)
INTEGRAL    Likelihood = -6.90    Transmembrane 66-82 (63-85)
INTEGRAL    Likelihood = -6.69    Transmembrane 110-126 (105-128)
INTEGRAL    Likelihood = -3.93    Transmembrane 132-148 (129-149)
----- Final Results -----
    bacterial membrane --- Certainty = 0.4079 (Affirmative) <succ>
    bacterial outside --- Certainty = 0.0000 (Not Clear) <succ>
      bacterial cytoplasm --- Certainty = 0.0000 (Not Clear) <succ>
```

A related GBS nucleic acid sequence <SEQ ID 9443> which encodes amino acid sequence <SEQ ID 9444> was also identified.

The protein has homology with the following sequences in the GENPEPT database.

```
>GP:AAC67260 GB:AF017113 YvjA [Bacillus subtilis]
Identities = 83/227 (36%), Positives = 140/227 (61%)
Query:   9    FGWDSAFFIMIINIPLLLLCYFGLGKQTFLKTVYGSWIFPVFIKLTQSVPTLTHNPLLAA    68
              +G+++A+    IINIPL +    LG +  LKT+ GS    P+ + LT+ +    TH+ LLAA
Sbjct:  52    YGFEAAYVQWIINIPLFIAGVILLGGKFGLKTLAGSVFLPLVVFLTRDIQPATHHELLAA   111

Query:  69    LFGGVIVGCGLGIVFWSDSSTGGTGIIIQFLGKYTPISLGQGVILIDGLVTIVGFLAFDS   128
              +FGGV +G G+GIV+     STGGT +  Q + KY+ +SLG+ + +IDG++ +    + F+
Sbjct: 112    IFGGVGIGIGIGIVYLGKGSTGGTALAAQIIHKYSGLSLGKCLAIIDGMIVVTAMIVFNI   171

Query: 129    DTVMFSIIGLITISYIINAIQTGFTTLSTVLIVSQEHQKIKTYINTVADRGVTEIPVKGG   188
              +   +++++G+   S  I+ +Q GF       LI++++ Q +K  +    DRGVT+I   GG
Sbjct: 172    EQGLYAMLGVYVSSKTIDVVQVGFNRSKMALIITKQEQAVKEAVLQKIDRGVTKISAVGG   231

Query: 189    YSGTNQIMLMTTIAGYEFAKLQEAIAEIDETAFITVTPTSQASGRGF   235
              Y+  ++ +LM +    EF KL++ + +IDE+AF+ V    S+   G GF
Sbjct: 232    YTDDDRPILMCVVGQTEFTKLKQIVKQIDESAFVIVADASEVLGEGF   278
```

A related DNA sequence was identified in *S. pyogenes* <SEQ ID 5085> which encodes the amino acid sequence <SEQ ID 5086>. Analysis of this protein sequence reveals the following:

```
Possible site: 57
>>> Seems to have a cleavable N-term signal seq.
INTEGRAL    Likelihood = -6.21    Transmembrane 104-120 (101-123)
INTEGRAL    Likelihood = -3.93    Transmembrane 147-163 (142-167)
INTEGRAL    Likelihood = -3.29    Transmembrane 169-185 (169-186)
----- Final Results -----
    bacterial membrane --- Certainty = 0.3484 (Affirmative) <succ>
    bacterial outside --- Certainty = 0.0000 (Not Clear) <succ>
      bacterial cytoplasm --- Certainty = 0.0000 (Not Clear) <succ>
```

The protein has homology with the following sequences in the databases:

```
>GP:AAC67260 GB:AF017113 YvjA [Bacillus subtilis]
Identities = 106/267 (39%), Positives = 169/267 (62%), Gaps = 1/267 (0%)
Query:   7    DLLLVTIGSFITAIGFNTMFVDNHIASGGMVGIAVVIKALFGISPSLFLMASNIPLLLMC    66
              D + +  IG+ ITA+ FN   + N IA+GG+ GI+ ++++ +G   +      NIPL +
Sbjct:  13    DYVYILIGAAITAVSFNVFLLPNKIAAGGVSGISTILQS-YGFEAAYVQWIINIPLFIAG    71

Query:  67    YFFLGKQNFIKTLYGSWIYPIAIRSTNSLPTLTHNQLLAAIFGGIICGIGLGMVFWGNSS   126
                  LG +  +KTL GS    P+ +  T  +     TH++LLAAIFGG+  GIG+G+V+ G  S
Sbjct:  72    VILLGGKFGLKTLAGSVFLPLVVFLTRDIQPATHHELLAAIFGGVGIGIGIGIVYLGKGS   131
```

-continued

```
Query: 127    TGGTGILTQILHKYSPLSLGVAMTIVDGISVLMGFIALSADDVMYSTIGLFVIGYVISVM   186
              TGGT +  QI+HKYS LSLG + I+DG+ V+    I  + +  +Y+ +G++V    I   V+
Sbjct: 132    TGGTALAAQIIHKYSGLSLGKCLAIIDGMIVVTAMIVFNIEQGLYAMLGVYVSSKTIDVV   191

Query: 187    ENGFDSSKNVMIISKDYQAIREYITTVMDRGVTKLPIRGGYTTSDKIMLMAIVSSHELPT   246
              + GF+ SK  +II+K QA++E +   +DRGVTK+    GGYT  D+ +LM +V    E
Sbjct: 192    QVGFERSKMALIITKQEQAVKEAVLQKIDRGVTKISAVGGYTDDDRPILMCVVGQTEFTK   251

Query: 247    LQEKILEIDDTAFIVVMPAAQVMGRGF                                   273
              L++ +  +ID++AF++V   A++V+G GF
Sbjct: 252    LKQIVKQIDESAFVIVADASEVLGEGF                                   278
```

An alignment of the GAS and GBS proteins is shown below.

```
Identities = 135/252 (53%), Positives = 190/252 (74%)
Query: 1      MAVSFHEVFGWDSAFFIMIINIPLLLLCYFGLGKQTFLKTVYGSWIFPVFIKLTQSVPTL    60
              +AV    +FG   + F+M  NIPLLL+CYF LGKQ F+KT+YGSWI+P+ I+  T S+PTL
Sbjct: 39     IAVVIKALFGISPSLFLMASNIPLLLMCYFFLGKQNFIKTLYGSWIYPIAIRSTNSLPTL    98

Query: 61     THNPLLAALFGGVIVGCGLGIVFWSDSSTGGTGIIIQFLGKYTPISLGQGVILIDGLVTI   120
              THN LLAA+FGG+I G  GLG+VFW +SSTGGTGI+ Q L  KY+P+SLG + ++DG+   +
Sbjct: 99     THNQLLAAIFGGIICGIGLGMVFWGNSSTGGTGILTQILHKYSPLSLGVAMTIVDGISVL   158

Query: 121    VGFLAFDSDTVMFSIIGLITISYIINAIQTGFTTLSTVLIVSQEHQKIKTYINTVADRGV   180
              +GF+A  +D VM+S IGL  I Y+I+ ++ GF +    V+I+S+++Q I+ YI  TV DRGV
Sbjct: 159    MGFIALSADDVMYSTIGLFVIGYVISVMENGFDSSKNVMIISKDYQAIREYITTVMDRGV   218

Query: 181    TEIPVKGGYSGTNQIMLMTTIAGYEFAKLQEAIAEIDETAFITVTPTSQASGRGFSLQKN   240
              T++P++GGY+ +++IMLM  ++ +E   LQE I EID+TAFI V P +Q  GRGFSL K
Sbjct: 219    TKLPIRGGYTTSDKIMLMAIVSSHELPTLQEKILEIDDTAFIVVMPAAQVMGRGFSLTKQ   278

Query: 241    HGRLDEDILMPM                                                 252
              + R D+D+L+PM
Sbjct: 279    YKREDKDVLLPM                                                 290
```

A related GBS gene <SEQ ID 8871> and protein <SEQ ID 8872> were also identified. Analysis of this protein sequence reveals the following:

Lipop: Possible site: -1 Crend: 6
McG: Discrim Score: 1.57
GvH: Signal Score (-7.5): -2.56
Possible site: 56
>>> Seems to have an uncleavable N-term signal seq
ALOM program count: 4 value: -7.70 threshold: 0.0
INTEGRAL    Likelihood = -7.70    Transmembrane 14-30 (8-34)
INTEGRAL    Likelihood = -6.90    Transmembrane 66-82 (63-85)
INTEGRAL    Likelihood = -6.69    Transmembrane 110-126 (105-128)
INTEGRAL    Likelihood = -3.93    Transmembrane 132-148 (129-149)

-continued

PERIPHERAL    Likelihood = 3.71    37
modified ALOM score: 2.04
*** Reasoning Step: 3
----- Final Results -----
    bacterial membrane --- Certainty = 0.4079 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
ORF02139(118-1008 of 1356)
OMNI|NT01BS4111 (51-325 of 327) conserved hypothetical protein
% Match = 19.3
% Identity = 37.1 % Similarity = 62.1
Matches = 101 Mismatches = 99 Conservative Sub.s = 68

27          57          87         117            165
                   ARAIPSFIVGSALTGALVGLAGIKLMAPHGGIFVIALTSNPLLYIL----FILIGAVVSGVLFGLF---
                                                        |  |:||     :||||  ::   |   |  :|
       VCFFISYILDFTAALAYYHCIWVLFTSNQGRIKMLSESIGRNGGYMMDVRNKTLWILRDYVYILIGAAITAVSFNVFLLP
            10          20          30          40          50          60          70          80

216         246         276         306         336         366         396         426
       RKIK*LISTYPNLH*IKGE*XIVILXXLIN*XXGGISGLAVSFXEVFGWDSAFFIMIINIPLLLLCYFGLGKQTFLKTVY
       ||                                                      ||:||::   : :|:::|:   ||||||:: || :  |||:
       NKI------------------------AAGGVSGIST-ILQSYGFEAAYVQWIINIPLFIAGVILLGGKFGLKTLA
                                        90         100         110         120         130
```

```
456       486       516       546       576       606       636       666
GSWIFPVFIKLTQSVPTLTHNPLLAALFGGVIVGCLGIVFWSDSSTGGTGIIIQFLGKYTPISLGQGVILIDGLVTIVG
 ||  :|: :  ||:  :    ||: ||||:||||   :|  |:|||:    |||||   :    |  ||: :|||: :  :|||:: :
GSVFLPLVVFLTRDIQPATHHELLAAIFGGVGIGIGIVYLGKGSTGGTALAAQIIHKYSGLSLGKCLAIIDHMIVVTA
           150       160       170       180       190       200       210

696       726       756       786       816       846       876       906
FLAFDSDTVMFSIIGLITISYIINAIQTGFTTLSTVLIVSQEHQKIKTYINTVADRGVTEIPVKGGYSGTNQIMLMTTIA
 :  |: :  :::::|:   |   |: :|| ||   ||:::  |||||:    |||   :: ::|| :
MIVFNIEQGLYAMLGVYVSSKTIDVVQVGFNRSKMALIITKQEQAVKEAVLQKIDRGVTKISAVGGYTDDDRPILMCVVG
           230       240       250       260       270       280       290

936       966       996      1026      1056      1086      1116
GYEFAKLQEAIAEIDETAFITVTPTSQASGRGFSLQKNHGRLDEDILMPM*SIDN*SFF**NSR*NIHKR*QNC
 ||  ||:: :  :|||:||:  |   |:   |  ||
QTEFTKLKQIVKQIDESAFVIVADASEVLGEGFKRA
           310       320
```

Based on this analysis, it was predicted that these proteins and their epitopes could be useful antigens for vaccines or diagnostics.

Example 1644

A DNA sequence (GBSx1739) was identified in *S. agalactiae* <SEQ ID 5087> which encodes the amino acid sequence <SEQ ID 5088>. This protein is predicted to be ABC transporter, ATP-binding protein (b0820). Analysis of this protein sequence reveals the following:

Possible site: 56
>>> Seems to have no N-terminal signal sequence
----- Final Results -----
  bacterial cytoplasm --- Certainty = 0.3122 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:AAC24918 GB:AF012285 YkpA [Bacillus subtilis]
Identities = 355/540 (65%), Positives = 451/540 (82%), Gaps = 4/540 (0%)
Query: 1     MLTVSDVSLRFSDRKLFDEVNINFTAGNTYGLIGANGAGKSTFLKILAGDIEPTTGHIAL    60
             M+ V++VSLRF+DRKLF++VNI FT GN YGLIGANGAGKSTFLK+L+G+IEP TG + +
Sbjct: 1     MIAVNNVSLRFADRKLFEDVNIKFTPGNCYGLIGANGAGKSTFLKVLSGEIEPQTGDVHM    60

Query: 61    GPDERLSVLRQNHFDYEDERVIDVVIMGNETLYSIMKEKDAIYMKEDFSDEDGVRAAELE   120
              P ERL+VL+QNHF+YE+  V+ VVIMG++ LY +M+EKDAIYMK DFSDEDG+RAAELE
Sbjct: 61    SPGERLAVLKQNHFEYEEYEVLKVVIMGHKRLYEVMQEKDAIYMKPDFSDEDGIRAAELE   120

Query: 121   GEFAELGGWEAESEASQLLQNLNISEELHYQNMSELANGDKVKVLLAKALFGKPDVLLLD   180
             GEFAEL GWEAESEA+ LL+ L ISE+LH + M++L   +KVKVLLA+ALFGKPDVLLLD
Sbjct: 121   GEFAELNGWEAESEAAILLKGLGISEDLHTKKMADLGGSEKVKVLLAQALFGKPDVLLLD   180

Query: 181   EPTNGLDIQSITWLEDFLIDFENTVIVVSHDRHFLNKVCTHMADLDFGKIKLFVGNYDFW   240
             EPTN LD+Q+I WLE+FLI+FENTVIVVSHDRHFLNKVCTH+ADLDF KI+++VGNYDFW
Sbjct: 181   EPTNHLDLQAIQWLEEFLINFENTVIVVSHDRHFLNKVCTHIADLDFNKIQIYVGNYDFW   240

Query: 241   KESSELAARLQADRNAKAEEKIKQLQEFVARFSANASKSKQATSRKKMLDKIELEEIVPS   300
               ESS+LA +L  + N K EE+IKQLQEFVARFSANASKSKQATSRKK+L+KI  L++I PS
Sbjct: 241   YESSQLALKLSQEANKKKEEQIKQLQEFVARFSANASKSKQATSRKKLLEKITLDDIKPS   300

Query: 301   SRKYPFVNFKAEREMGNDLLTVENLSVTIDGEKILDNISFILRPGDKTALIGQNDIQTTA   360
             SR+YP+VNF  ERE+GND+L VE L+ TIDG K+LDN+SFI+   DK A  G+N++   T
Sbjct: 301   SRRYPYVNFTPEREIGNDVLRVEGLTKTIDGVKVLDNVSFIMNREDKIAFTGRNELAVTT   360

Query: 361   LIRALMGDIEYE-GTIKWGVTTSRSYLPKDNSRDFASGE-SILEWLRQFASKEEDDNTFL   418
             L + + G++E + GT KWGVTTS++Y PKDNS  F    + ++++WLRQ+ S +    +FL
Sbjct: 361   LFKIISGEMEADSGTFKWGVTTSQAYFPKDNSEYFEGSDLNLVDWLRQY-SPHDQSESFL   419

Query: 419   RGFLGRMLFSGDEVNKSVNVLSGGEKVRVMLSKLMLLKSNVLVLDDPTNHLDLESISSLN   478
             RGFLGRMLFSG+EV+K  NVLSGGEKVR MLSK ML  +N+L+LD+PTNHLDLESI++LN
Sbjct: 420   RGFLGRMLFSGEEVHKKANVLSGGEKVRCMLSKAMLSGANILILDEPTNHLDLESITALN   479

Query: 479   DGLKDFKESIIFASHDHEFIQTLANHIIVLSKNGVIDRIDETYDEFLENTEVQAKVAQLW   538
             +GL  FK +++F SHDH+F+QT+AN II ++ NG++D+   +YDEFLEN +VQ K+ +L+
Sbjct: 480   NGLISFKGAMLFTSHDHQFVQTIANRIIEITPNGIVDK-QMSYDEFLENADVQKKLTELY   538
```

A related DNA sequence was identified in *S. pyogenes* <SEQ ID 5089> which encodes the amino acid sequence <SEQ ID 5090>. Analysis of this protein sequence reveals the following:

```
Possible site: 56
>>> Seems to have no N-terminal signal sequence
----- Final Results -----
   bacterial cytoplasm --- Certainty = 0.3124 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below.

```
Possible site: 30
>>> Seems to have an uncleavable N-term signal seq
   INTEGRAL    Likelihood = -9.71    Transmembrane 14-30 (8-35)
   INTEGRAL    Likelihood = -7.70    Transmembrane 384-400 (382-403)
   INTEGRAL    Likelihood = -7.22    Transmembrane 412-428 (408-433)
   INTEGRAL    Likelihood = -5.73    Transmembrane 163-179 (155-180)
   INTEGRAL    Likelihood = -5.52    Transmembrane 322-338 (320-344)
   INTEGRAL    Likelihood = -5.10    Transmembrane 297-313 (290-314)
   INTEGRAL    Likelihood = -4.41    Transmembrane 360-376 (357-377)
   INTEGRAL    Likelihood = -4.35    Transmembrane 438-454 (437-455)
   INTEGRAL    Likelihood = -4.09    Transmembrane 136-152 (136-153)
   INTEGRAL    Likelihood = -3.35    Transmembrane 110-126 (106-128)
   INTEGRAL    Likelihood = -2.28    Transmembrane 232-248 (232-248)
   INTEGRAL    Likelihood = -1.81    Transmembrane 832-848 (832-848)
   INTEGRAL    Likelihood = -1.12    Transmembrane 200-216 (200-216)
```

```
Identities = 497/539 (92%), Positives = 525/539 (97%)
Query: 1     MLTVSDVSLRFSDRKLFDEVNINFTAGNTYGLIGANGAGKSTFLKILAGDIEPTTGHIAL    60
             +LTVSDVSLRFSDRKLFD+VNI FTAGNTYGLIGANGAGKSTFLKILAGDIEP+TGHI+L
Sbjct: 1     LLTVSDVSLRFSDRKLFDDVNIKFTAGNTYGLIGANGAGKSTFLKILAGDIEPSTGHISL    60

Query: 61    GPDERLSVLRQNHFDYEDERVIDVVIMGNETLYSIMKEKDAIYMKEDFSDEDGVRAAELE   120
             GPDERLSVLRQNHFDYE+ER IDVVIMGNE LY+IMKEKDAIYMK DFS+EDGVRAAELE
Sbjct: 61    GPDERLSVLRQNHFDYEEERAIDVVIMGNEQLYNIMKEKDAIYMKADFSEEDGVRAAELE   120

Query: 121   GEFAELGGWEAESEASQLLQNLNISEELHYQNMSELANGDKVKVLLAKALFGKPDVLLLD   180
             G FAELGGWEAESEASQLLQNLNI E+LHYQNMSELANGDKVKVLLAKALFGKPDVLLLD
Sbjct: 121   GIFAELGGWEAESEASQLLQNLNIPEDLHYQNMSELANGDKVKVLLAKALFGKPDVLLLD   180

Query: 181   EPTNGLDIQSITWLEDFLIDFENTVIVVSHDRHFLNKVCTHMADLDFGKIKLFVGNYDFW   240
             EPTNGLDIQSI+WLEDFLIDFENTVIVVSHDRHELNKVCTHMADLDFGKIKLFVGNYDFW
Sbjct: 181   EPTNGLDIQSISWLEDFLIDFENTVIVVSHDRHFLNKVCTHMADLDFGKIKLFVGNYDFW   240

Query: 241   KESSELAARLQADRNAKAEEEKIKQLQEFVARFSANASKSKQATSRKKMLDKIELEEIVPS   300
             K+SSELAARLQADRNAKAEEEKIK+LQEFVARFSANASKSKQATSRKKMLDKIELEEIVPS
Sbjct: 241   KQSSELAARLQADRNAKAEEEKIKELQEFVARFSANASKSKQATSRKKMLDKIELEEIVPS   300

Query: 301   SRKYPFVNFKAEREMGNDLLTVENLSVTIDGEKILDNISFILRPGDKTALIGQNDIQTTA   360
             SRKYPF+NFKAEREMGND LTVENLSVTIDGEKI+DNISFILRPGDK A+IGQNDIQTTA
Sbjct: 301   SRKYPFINFKAEREMGNDFLTVENLSVTIDGEKIIDNISFILRPGDKAAIIGQNDIQTTA   360

Query: 361   LIRALMGDIEYEGTIKWGVTTSRSYLPKDNSRDFASGESILEWLRQFASKEEDDNTFLRG   420
             L+RAL  DI+YEGTIKWGVTTSRSYLPKDNS+DFA+ ESILEWLRQFASK EDD+TFLRG
Sbjct: 361   LMRALADDIDYEGTIKWGVTTSRSYLPKDNSKDFATEESILEWLRQFASKGEDDDTFLRG   420

Query: 421   FLGRMLFSGDEVNKSVNVLSGGEKVRVMLSKLMLLKSNVLVLDDPTNHLDLESISSLNDG   480
             FLGRMLFSGDEV KSVNVLSGGEKVRVMLSKLMLLKSNVL+LDDPTNHLDLESISSLNDG
Sbjct: 421   FLGRMLFSGDEVKKSVNVLSGGEKVRVMLSKLMLLKSNVLILDDPTNHLDLESISSLNDG   480

Query: 481   LKDFKESIIFASHDHEFIQTLANHIIVLSKNGVIDRIDETYDEFLENTEVQAKVAQLWK   539
             +KDFKES+IFASHDHEFIQT+ANHI+V+SKNGVIDRIDETYDEFL+N EVQA+VA+LWK
Sbjct: 481   IKDFKESVIFASHDHEFIQTIANHIVVISKNGVIDRIDETYDEFLDNPEVQARVAELWK   539
```

Based on this analysis, it was predicted that these proteins and their epitopes could be useful antigens for vaccines or diagnostics.

Example 1645

A DNA sequence (GBSx1740) was identified in *S. agalactiae* <SEQ ID 5091> which encodes the amino acid sequence <SEQ ID 5092>. Analysis of this protein sequence reveals the following:

*-continued*

```
----- Final Results -----
   bacterial membrane --- Certainty = 0.4885 (Affirmative) <succ>
   bacterial outside --- Certainty = 0.0000 (Not Clear) <succ>
   bacterial cytoplasm --- Certainty = 0.0000 (Not Clear) <succ>
```

The protein has homology with the following sequences in the GENPEPT database.

```
>GP:AAC14608 GB:U95840 transmembrane protein Tmp5 [Lactococcus lactis]
Identities = 140/260 (53%), Positives = 182/260 (69%), Gaps = 6/260 (2%)
Query: 16    SFLLPFIIIVCILFTKNIYWGSPTTILASDGFHQYVIFNQALRNILH--GSNSLFYTFTS    73
             SF +P I++V +L    IYWGS +ILA D +HQYV +  RNILH GS    YTFTS
Sbjct: 14    SFFIPLILMVIVLAMTGIYWGSSRSILAGDAYHQYVAIHSLYRNILHSGGSQGFLYTFTS    73

Query: 74    GLGLNFYALSSYYLGSFLSPIVYFFNLKNMPDAIYLLTICKIGLIGLSMFVTLCKRHCKV   133
             GLGLN  YA S+YY+GSFL P  +FF++K+MPDA+YL TI K GLIGLS FV+    + K+
Sbjct: 74    GLGLNLYAFSAYYMGSFLMPFTFFFDVKSMPDALYLFTIIKFGLIGLSSFVSFKNMYQKL   133
```

-continued

```
Query: 134   NRVLLLVISTCYSLMSFSISQIEINMWLDVFILIPLVVLGVDQLLWERKPILYFLSLTAL   193
              + + +L IST ++LMSF  SQ+EI MWLDVFIL+PL++ G+ +L+ ERK  LYF+SL   L
Sbjct: 134   SNLTVLSISTAFALMSFLTSQLEITMWLDVFILLPLIIWGLHRLMDERKRWLYFVSLLIL   193

Query: 194   FIQNYYFGFMTAIFTSLYFIVQITRNTDSKVAFKQFLHFTFLSLLAGMTSSIMILPTYFD   253
             FIQNYYFGFM AIF  LYF   + R T  K ++ + L F   S LAG+ S IM+LP Y D
Sbjct: 194   FIQNYYFGFMVAIFLVLYF---LARMTYEKWSWTKVLDFVVSSTLAGIASLIMLLPMYLD   250

Query: 254   L-TTHGEKLTKVSKMFTENS                                          272
             L + + + L+ +S +FTENS
Sbjct: 253   LKSNNSDALSTLSGIFTENS                                          270
```

A related DNA sequence was identified in *S. pyogenes* <SEQ ID 5093> which encodes the amino acid sequence <SEQ ID 5094>. Analysis of this protein sequence reveals the following:

---

Possible site: 51
>>> Seems to have an uncleavable N-term signal seq
INTEGRAL    Likelihood = −9.29    Transmembrane 15-31 (6-35)
INTEGRAL    Likelihood = −8.81    Transmembrane 201-217 (196-220)
INTEGRAL    Likelihood = −6.79    Transmembrane 410-426 (402-428)
INTEGRAL    Likelihood = −6.05    Transmembrane 230-246 (227-252)
INTEGRAL    Likelihood = −5.57    Transmembrane 161-177 (153-178)
INTEGRAL    Likelihood = −4.46    Transmembrane 291-307 (290-311)
INTEGRAL    Likelihood = −3.82    Transmembrane 133-149 (130-151)
INTEGRAL    Likelihood = −3.77    Transmembrane 380-396 (376-400)
INTEGRAL    Likelihood = −3.61    Transmembrane 105-121 (103-124)
INTEGRAL    Likelihood = −3.45    Transmembrane 832-848 (830-848)
INTEGRAL    Likelihood = −2.66    Transmembrane 436-452 (435-453)
INTEGRAL    Likelihood = −2.13    Transmembrane 318-334 (314-336)
INTEGRAL    Likelihood = −1.54    Transmembrane 356-372 (355-372)
INTEGRAL    Likelihood = −0.27    Transmembrane 80-96 (80-96)
----- Final Results -----
   bacterial membrane --- Certainty = 0.4715 (Affirmative) <succ>
   bacterial outside --- Certainty = 0.0000 (Not Clear) <succ>
      bacterial cytoplasm --- Certainty = 0.0000 (Not Clear) <succ>

---

The protein has homology with the following sequences in the databases:

```
>GP:AAC14608 GB:U95840 transmembrane protein TmpS [Lactococcus lactis]
Identities = 134/269 (49%), Positives = 183/269 (67%), Gaps = 8/269 (2%)
Query: 5     NKWIIAGLASFLFPLSIIFIILLSMGIYYNSDKTILASDAFHQYVIFAQNFRNIMH--GS    62
             NKW +  LASF  PL ++ I+L   GIY+ S ++ILA DA+HQYV     +RNI+H  GS
Sbjct: 7     NKWAL--LASFFIPLILMVIVLAMTGIYWGSSRSILAGDAYHQYVAIHSLYRNILHSGGS    64

Query: 63    DSFFYTFTSGLGINFYALMCYYLGSFFSPLLFFFNLTSMPDAIYLFTLIKFGLIGLAACY   122
                F YTFTSGLG+N YA   YY+GSF  P  FFF++ SMPDA+YLFT+IKFGLIGL++
Sbjct: 65    QGFLYTFTSGLGLNLYAFSAYYMGSFLMPFTFFFDVKSMPDALYLFTIIKFGLIGLSSFV   124

Query: 123   SFHRLYPKISAFLMISISVFYSLMSFLTSQMELNSWLDVFILLPLVILGLNKLITENKTR   182
             SF  +Y K+S    ++SIS  ++LMSFLTSQ+E+  WLDVFILLPL+I GL++L+ E K
Sbjct: 125   SFKNMYQKLSNLTVLSISTAFALMSFLTSQLEITMWLDVFILLPLIIWGLHRLMDERKRW   184

Query: 183   TYYLSISLLFIQNYYFGYMIALFCILYALVCLLRLNDFNKMFIAFVRFTAVSICAALTSA   242
              Y++S+ +LFIQNYYFG+M+A+F  +LY L    R+        +    + F  S A + S
Sbjct: 185   LYFVSLLILFIQNYYFGFMVAIFLVLYFLA---RMTYEKWSWTKVLDFVVSSTLAGIASL   241

Query: 243   LVILPTYLDL-STYGENLSPIKQLVTNNA                                  270
             +++LP YLDL S   + LS +  + T N+
Sbjct: 242   IMLLPMYLDLKSNNSDALSTLSGIFTENS                                  270
```

An alignment of the GAS and GBS proteins is shown below.

```
Identities = 432/836 (51%), Positives = 569/836 (67%), Gaps = 2/836 (0%)
Query: 16   SFLLPFIIIVCILFTKNIYWGSPTTILASDGFHQYVIFNQALRNILHGSNSLFYTFTSGL   75
            SFL P II    IL +  IY+ S  TILASD FHQYVIF Q  RNI+HGS+S FYTFTSGL
Sbjct: 14   SFLFPLSIIFIILLSMGIYYNSDKTILASDAFHQYVIFAQNFRNIMHGSDSFFYTFTSGL   73

Query: 76   GLNFYALSSYYLGSFLSPIVYFFNLKNMPDAIYLLTICKIGLIGLSMFVTLCKRHCKVNR   135
            G+NFYAL   YYLGSF SP+++FFNL +MPDAIYL T+ K GLIGL+   +  + K++
Sbjct: 74   GINFYALMCYYLGSFFSPLLFFFNLTSMPDAIYLFTLIKFGLIGLAACYSFHRLYPKISA   133

Query: 136  VLLLVISTCYSLMSFSISQIEINMWLDVFILIPLVVLGVDQLLWERKPILYFLSLTALFI   195
            L++  IS   YSLMSF  SQ+E+N WLDVFIL+PLV+LG+++L+ E K    Y+LS++ LFI
Sbjct: 134  FLMISISVFYSLMSFLTSQMELNSWLDVFILLPLVILGLNKLITENKTRTYYLSISLLFI   193

Query: 196  QNYYFGFMTAIFTSLYFIVQITRNTDSKVAFKQFLHFTFLSLLAGMTSSIMILPTYFDLT   255
            QNYYFG+M A+F  LY +V + R  D      F  F+ FT +S+ A +TS+++ILPTY DL+
Sbjct: 194  QNYYFGYMIALFCILYALVCLLRLNDFNKMFIAFVRFTAVSICAALTSALVILPTYLDLS   253

Query: 256  THGEKLTKVSKMFTENSWYMDLFAKNMIGAYDTTKFGSIPMIYVGLLPLLLSLLYFTIKE   315
            T+GE L+ +  ++  T N+W++D+ AK   IG  YDTTKF ++PMIYVGL PL+LS++YFT++
Sbjct: 254  TYGENLSPIKQLVTNNAWFLDIPAKLSIGVYDTTKFNALPMIYVGLFPLMLSVIYFTLES   313

Query: 316  VPRRTRLAYGFLIIFVIASFYITPLDLFWQGMHAPNMFLHRYSWVLSVLICLLAAECLEY   375
            +P + +LA   L+ F+I SFY+  PLDLFWQGMH+PNMFLHRY+W  S++I LLA E L
Sbjct: 314  IPLKIKLANACLLTFIIISFYLQPLDLFWQGMHSPNMFLHRYAWSFSIVILLLACETLSR   373

Query: 376  LDNISWKKILGVNLILVSGFIITFLFKKHYHYLNLELLLLTLTFLSAYIILTISFVSKQI   435
            L  ++ K     + L+    + + F  Y++L L L  LL++  L  Y I    SF + QI
Sbjct: 374  LKEVTQIKAGFAFIFLIILTSLPYSFSQQYNFLPLTLFLLSVFLLLGYTISLFSFRNSQI   433

Query: 436  PKLVFYPFLIGFVVLEMTLNTFYQLNSLNDEWIFPSRQGYAKYNHSISKLVRKTERNNST   495
            P       F++ F +LE LNT+YQL  +N EW FPSRQ Y      I+ LV    +N+
Sbjct: 434  PSTFISAFILIFSLLESGLNTYYQLQGINKEWGFPSRQIYNSQLKDINNLVNSVSKNSQP   493

Query: 496  FFRTERWLGQTGNDSMKYNYNGISQFSSIRNRSSSQVLDRLGFKSDGTNLNLRYQNNTLI   555
            FFR ER L QTGNDSMK+NY GISQFSS+RNR SS +LDRLGF+S GTNLNLRYQNNT+I
Sbjct: 494  FFRMERLLPQTGNDSMKFNYYGISQFSSVRNRLSSSLLDRLGFQSKGTNLNLRYQNNTII   553

Query: 556  ADSLFGVKYNLTEYPFDKFGFIKKAQDKQTILYKNQFASQLAILTNQVYQDKPFTVNTLD   615
              DSL G+KYNL+E P +KFGF K       T LY+N ++S LAILT RNVY+D   VNTLD
Sbjct: 554  MDSLLGIKYNLSEGPPNKFGFTKLKTSGNTTLYQNHYSSPLAILTRNVYKDVNLNVNTLD   613

Query: 616  NQTTLLNQLSGLKETYFEHLIPNSVSGQTTLNKQVFVK-KNKQGNTEITYNITIPKNSQL   674
            NQT LLNQLSG   TYF       +SG    N Q+ +    + Q +    + Y I IPK+SQL
Sbjct: 614  NQTKLLNQLSGKSLTYFNLQPAQLISGANQFNGQISAQASDYQNSVTLNYQINIPKHSQL   673

Query: 675  YVSMPFINFNNEENKIVQISVNNGPFVPNTLDNAYSFFNIGSFAENSRIKVKFQFPHNDQ   734
            YVS+P I F+N + K ++I   +N   F+     T DNAYSFF++G FA+        F FP N Q
Sbjct: 674  YVSIPNIIFSNPDAKEMRIQTDNHNFI-YTTDNAYSFFDLGYFADAKVATFSFVFPKNKQ   732

Query: 735  VSFPIPHFYGLKLEAYQKAMTVINKRKVKVRTDHNKVIANYTSPNRSSLFFTIPYDRGWK   794
            +SF   PHFY L +E+Y +AM   I ++ V        N VI +Y S    + SL FT+PYD+GW
Sbjct: 733  ISFKEPHFYSLSIESYLEAMNSIKQKNVHTYAKSNTVITDYNSKTKGSLIFTLPYDKGWS   792

Query: 795  AYQNNKEIKIFKAQKGFMKINIPKGKGKVTLIFIPYGFKFGVGLSITGIVLFTVYY       850
            A ++ K + + KAQ GF+ + IPKGKG+V L FIP GFK GV LS   GI+ +  + Y
Sbjct: 793  AQKDGKNLPVKKAQGGFLSVTIPKGKGRVILTFIPNGFKLGLSLSCVGIIAYMLLY       848
```

Based on this analysis, it was predicted that these proteins and their epitopes could be useful antigens for vaccines or diagnostics.

Example 1646

A DNA sequence (GBSx1741) was identified in *S. agalactiae* <SEQ ID 5095> which encodes the amino acid sequence <SEQ ID 5096>. Analysis of this protein sequence reveals the following:

Possible site: 50
>>> Seems to have no N-terminal signal sequence
----- Final Results -----
   bacterial cytoplasm --- Certainty = 0.4624 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GB:AAC45340 GB:AF000658 ORF1 [Streptococcus pneumoniae]
Identities = 111/159 (69%), Positives = 136/159 (84%)
Query: 1    MKLKIITVGKLKEKYLKEGVAEYQKRLNRFSKIETIELADEKTPDKASISENQRILDIEG   60
            MK+K++TVGKLKEKYLK+G+AEY KR++RF+K E IEL+DEKTPDKAS SENQ+IL+IEG
Sbjct: 1    MKIKVVTVGKLKEKYLKDGIAEYSKRISRFAKFEMIELSDEKTPDKASESENQKILEIEG   60

Query: 61   ERILSKIGERDYVIGLAIEGKQLPSESFSHLIDQKMISGYSTITFVIGGSLGLSQKVKKR  120
            +RILSKI +RD+VI LAIEGK   SE FS  +++  I G+ST+TF+IGGSLGLS  VK R
Sbjct: 61   QRILSKIADRDFVIVLAIEGKTFFSEEFSKQLEETSIKGFSTLTFIIGGSLGLSSSVKNR  120

Query: 121  ADYLMSFGLLTLPHQLMKLVLMEQIYRAFMIRQGTPYHK                      159
            A+   +SFG LTLPHQLM+LVL+EQIYRAF I+QG PYHK
Sbjct: 121  ANLSVSFGRLTLPHQLMRLVLVEQIYRAFTIQQGFPYHK                      159
```

A related DNA sequence was identified in *S. pyogenes* <SEQ ID 5097> which encodes the amino acid sequence <SEQ ID 5098>. Analysis of this protein sequence reveals the following:

---

Possible site: 50
>>> Seems to have no N-terminal signal sequence
----- Final Results -----
    bacterial cytoplasm --- Certainty = 0.4462 (Affirmative) <succ>
    bacterial membrane --- Certainty = 0.0000 (Not Clear) <succ>
    bacterial outside --- Certainty = 0.0000 (Not Clear) <succ>

---

An alignment of the GAS and GBS proteins is shown below.

```
Identities = 112/159 (70%), Positives = 133/159 (83%)
Query: 1    MKLKIITVGKLKEKYLKEGVAEYQKRLNRFSKIETIELADEKTPDKASISENQRILDIEG   60
            MK+K+I VGKLKE+YLK+G++EYQKRL+RF + E IEL DE+TPDKAS ++NQ I+  E
Sbjct: 1    MKVKLICVGKLKERYLKDGISEYQKRLSRFCQFEMIELTDERTPDKASFADNQLIMSKEA   60

Query: 61   ERILSKIGERDYVIGLAIEGKQLPSESFSHLIDQKMISGYSTITFVIGGSLGLSQKVKKR  120
            +RI  KIGERD+VI LAIEGKQ PSE+FS LI    +  GYSTITF+IGGSLGL   +KKR
Sbjct: 61   QRIHKKIGERDFVIALAIEGKQFPSETFSELISGVTVKGYSTITFIIGGSLGLDSIIKKR  120

Query: 121  ADYLMSFGLLTLPHQLMKLVLMEQIYRAFMIRQGTPYHK                      159
            A+ LMSFGLLTLPHQLM+LVL EQIYRAFMI QG+PYHK
Sbjct: 121  ANMLMSFGLLTLPHQLMRLVLTEQIYRAFMITQGSPYHK                      159
```

Based on this analysis, it was predicted that these proteins and their epitopes could be useful antigens for vaccines or diagnostics.

Example 1647

A DNA sequence (GBSx1742) was identified in *S. agalactiae* <SEQ ID 5099> which encodes the amino acid sequence <SEQ ID 5100>. Analysis of this protein sequence reveals the following:

---

Possible site: 24
>>> Seems to have no N-terminal signal sequence
----- Final Results -----
    bacterial cytoplasm --- Certainty = 0.3785 (Affirmative) <succ>
    bacterial membrane --- Certainty = 0.0000 (Not Clear) <succ>
    bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1648

A DNA sequence (GBSx1743) was identified in *S. agalactiae* <SEQ ID 5101> which encodes the amino acid sequence <SEQ ID 5102>. This protein is predicted to be a serine protease. Analysis of this protein sequence reveals the following:

---

Possible site: 29
>>> Seems to have no N-terminal signal sequence
----- Final Results -----
    bacterial cytoplasm --- Certainty = 0.4533 (Affirmative) <succ>
    bacterial membrane --- Certainty = 0.0000 (Not Clear) <succ>
    bacterial outside --- Certainty = 0.0000 (Not Clear) <succ>

---

A related GBS nucleic acid sequence <SEQ ID 9445> which encodes amino acid sequence <SEQ ID 9446> was also identified.

The protein has homology with the following sequences in the GENPEPT database.

```
>GP:AAC45334 GB:AF000658 putative serine protease [Streptococcus pneumoniae]
Identities = 215/370 (58%), Positives = 278/370 (75%), Gaps = 20/370 (5%)
Query: 4    NDNIPNGGVTKTSKVNYNNITPTTKAVKKVQNSVVSVINYKQQESRSDLSDFYSHFFGNQ   63
            N++  N  +T+T+   Y N  TT+AV KV+++VVSVI Y     S        FGN
Sbjct: 46   NNSNNNSTITQTA---YKNENSTTQAVNKVKDAVVSVITYSANRQNS--------VFGND   94
```

```
-continued
Query:  64  GGNTDKGLQVYGEGSGVIYKKDGKNAYVVTNNHVIDGAKQIEIQLADGSKAVGKLVGSDT   123
            +TD    ++   EGSGVIYKK+ K AY+VTNNHVI+GA +++I+L+DG+K  G++VG+DT
Sbjct:  95  DTDTDSQ-RISSEGSGVIYKKNDKEAYIVTNNHVINGASKVDIRLSDGTKVPGEIVGADT   153

Query: 124  YSDLAVVKIPSDKVSNIAEFADSSKLNIGETAIAIGSPLGTEYANSVTQGIVSSLKRTVT   183
            +SD+AVVKI S+KV+ +AEF DSSKL +GETAIAIGSPLG EYAN+VTQGIVSSL R V+
Sbjct: 154  FSDIAVVKISSEKVTTVAEFGDSSKLTVGETAIAIGSPLGSEYANTVTQGIVSSLNRNVS   213

Query: 184  MTNEEGQTVSTNAIQTDAAINPGNSGGALINIEGQVIGINSSKISSTSNQTSGQSSGNSV   243
            + +E+GQ +ST AIQTD AINPGNSGG LINI+GQVIGI SSKI++         + G SV
Sbjct: 214  LKSEDGQAISTKAIQTDTAINPGNSGGPLINIQGQVIGITSSKIAT--------NGGTSV   265

Query: 244  EGMGFAIPSNDVVKIINQLESNGQVERPALGISMAGLSNLPSDVISKLKIPSNVTNGIVV   303
            EG+GFAIP+ND + II QLE NG+V RPALGI M  LSN+ +  I +L IPSNVT+G++V
Sbjct: 266  EGLGFAIPANDAINIIEQLEKNGKVTRPALGIQMVNLSNVSTSDIRRLNIPSNVTSGVIV   325

Query: 304  ASIQSGMPAQGKLKKYDVITKVDDKEVVSPSDLQSLLYGHQVGDSITVTFYRGENKQTVT   363
            S+QS MPA G L+KYDVITKVDDKE+ S +DLQS LY H +GD+I +T+YR   ++T +
Sbjct: 326  RSVQSNMPANGHLEKYDVITKVDDKEIASSTDLQSALYNHSIGDTIKITYYRNGKEETTS   385

Query: 364  IKLTKTSKDL                                                    373
            IKL K+S DL
Sbjct: 386  IKLNKSSGDL                                                    395
```

A related DNA sequence was identified in *S. pyogenes* <SEQ ID 5103> which encodes the amino acid sequence <SEQ ID 5104>. Analysis of this protein sequence reveals the following:

A related GBS gene <SEQ ID 8873> and protein <SEQ ID 8874> were also identified. Analysis of this protein sequence reveals the following:

Possible site: 24
>>> Seems to have an uncleavable N-term signal seq
INTEGRAL      Likelihood = −8.76      Transmembrane 11-27 (6-31)
----- Final Results -----
   bacterial membrane --- Certainty = 0.4503 (Affirmative) <succ>
   bacterial outside --- Certainty = 0.0000 (Not Clear) <succ>
   bacterial cytoplasm --- Certainty = 0.0000 (Not Clear) <succ>

Lipop: Possible site: −1      Crend: 10
McG: Discrim Score: 12.68
GvH: Signal Score (−7.5): −1.33
Possible site: 21
>>> Seems to have a cleavable N-term signal seq.
ALOM program          count: 0 value: 4.56 threshold: 0.0
PERIPHERAL            Likelihood = 4.56           301
modified ALOM score: −1.41
*** Reasoning Step: 3
----- Final Results -----
   bacterial outside --- Certainty = 0.3000 (Affirmative) <succ>
   bacterial membrane --- Certainty = 0.0000 (Not Clear) <succ>
   bacterial cytoplasm --- Certainty = 0.0000 (Not Clear) <succ>

An alignment of the GAS and GBS proteins is shown below.

The protein has homology with the following sequences in the databases:

```
Identities = 250/375 (66%), Positives = 299/375 (79%), Gaps = 5/375 (1%)
Query:   3  HNDNIPNGGVTKTSKVNYNNITPTTKAVKKVQNSVVSVINYKQQESRSDLSDFYSHFFGN    62
            H+ +   N G    TS + +NN T TTKAVK VQN+VVSINY+    S SLS+ Y+  FG
Sbjct:  34  HSPSKINSGKATTSNMVFNNTTNTTKAVKAVQNAVVSVINYQDNPS-SSLSNPYTKLFGE    92

Query:  63  QGG--NTDKGLQVYGEGSGVIYKKDGKNAYVVTNNHVIDGAKQIEIQLADGSKAVGKLVG   120
                  N D  L ++ EGSGVIY+KDG +AYVVTNNHVIDGAK+IEI +ADGSK VG+LVG
Sbjct:  93  GRSKENKDAELSIFSEGSGVIYRKDGNSAYVVTNNHVIDGAKRIEILMADGSKVVGELVG   152

Query: 121  SDTYSDLAVVKIPSDKVSNIAEFADSSKLNIGETAIAIGSPLGTEYANSVTQGIVSSLKR   180
            +DTYSDLAVVKI SDK+   +AEFADS+KLN+GE AIAIGSPLGT+YANSVTQGIVSSL R
Sbjct: 153  ADTYSDLAVVKISSDKIKTVAEFADSTKLNVGEVAIAIGSPLGTQYANSVTQGIVSSLSR   212

Query: 181  TVTMTNEEGQTVSTNAIQTDAAINPGNSGGALINIEGQVIGINSSKISSTSNQTSGQSSG   240
            TVT+ NE G+TVSTNAIQTDAAINPGNSGG LINIEGQVIGINSSKISST  ++G S
Sbjct: 213  TVTLKNENGETVSTNAIQTDAAINPGNSGGPLINIEGQVIGINSSKISSTPTGSNGNS--   270

Query: 241  NSVEGMGFAIPSNDVVKIINQLESNGQVERPALGISMAGLSNLPSDVISKLKIPSNVTNG   300
             +VEG+GFAIPS DV+KII QLE+NG+V RPALGISM  L++ ++ +S++ IP++VT G
Sbjct: 271  GAVEGIGFAIPSTDVIKIIKQLETNGEVIRPALGISMVNLNDLSTNALSQINIPTSVTGG   330

Query: 301  IVVASIQSGMPAQGKLKKYDVITKVDDKEVVSPSDLQSLLYGHQVGDSITVTFYRGENKQ   360
            IVVA ++  GMPA GKL +YDVIT++D K V S SDLQS LYGH + D+I VTFYRG  K+
Sbjct: 331  IVVAEVKEGMPASGKLAQYDVITEIDGKTVNSISDLQSSLYGHDINDTIKVTFYRGTTKK   390

Query: 361  TVTIKLTKTSKDLAK                                               375
                IKLTKT++DL K
Sbjct: 391  KADIKLTKTTQDLTK                                               405
```

```
57.4/75.6% over 386aa
Streptococcus pneumoniae
GP|2109443|putative serine protease Insert characterized
ORF02135(307-1506 of 1827)
GP|2109443|gb|AAC45334.1||AF000658(9-395 of 397) putative serine protease
{Streptococcus pneumoniae}
% Match = 34.6
% Identity = 57.3 % Similarity = 75.6
Matches = 223 Mismatches = 89 Conservative Sub.s = 71

228       258       288       318       348       378       399       429
RLSTSCGYFLFLAFKV*LRSLS*D*YKNLRR*LFVKKKLVSSLLKCSLIIIVSFAGGAFASFVMNH---NDNIPNGGVTK
              :         :     ::  ::|::||    ||:  || ::      ::   |
                              MEANMKHLKTFYKKWFQLLVVIVISFFSGALGSFSITQLTQKSSVNNSNNNS
                              10        20        30        40        50

456       486       516       546       576       606       636       666
T-SKVNYNNITPTTKAVKKVQNSVVSVINYKQQESRSDLSDFYSHFFGNQGGNTDKGLQVYGEGSGVIYKKDGKNAYVVT
|   ::   ||    ||:||  ||:::||||| |        |||    :||     ::  ||||||||||: | ||:||
TITQTAYKNENSTTQAVNKVKDAVVSVITYSANRQNS-------VFGNDDTDTDS-QRISSEGSGVIYKKNDKEAYIVT
         70        80                   90       100       110       120

696       726       756       786       816       746       876       906
NNHVIDGAKQIEIQLADGSKAVGKLVGSDTYSDLAVVKIPSDKVSNIAEFADSSKLNIGETAIAIGSPLGTEYANSVTQG
||||:|| ::::|:|:||:|   |:::|:|::|||||| |:||: :||| ||||| :||||||||||||||:||||:||||
NNHVINGASKVDIRLSDGTKVPGEIVGADTFSDIAVVKISSEKVTTVAEFGDSSKLTVGETAIAIGSPLGSEYANTVTQG
         140       150       160       170       180       190       200

936       966       996      1026      1056      1086      1116      1146
IVSSLKRTVTMTNEEGQTVSTNAIQTDAAINPGNSGGALINIEGQVIGINSSKISSTSNQTSGQSSGNSVEGMGFAIPSN
|||||  | |::  :|:||  :|| ||||| ||||||||||  |:||||||  ||||:     |:|  | ||||:|||||:|
IVSSLNRNVSLKSEDGQAISTKAIQTDTAINPGNSGGPLINIQGQVIGITSSKIA-----TNG---GTSVEGLGFAIPAN
         220       230       240       250             260          270

1176      1206      1236      1266      1296      1326      1356      1386
DVVKIINQLESNGQVERPALGISMAGLSNLPSDVISKLKIPSNVTNGIVVASIQSGMPAQGKLKKYDVITKVDDKEVVSP
| : ||  ||| ||:| ||||||  |||::   |  :| |||||||:::| |:|| |||  |:||||||||||||||: |
DAINIIEQLEKNGKVTRPALGIQMVNLSNVSTSDIRRLNIPSNVTSGVIVRSVQSNMPANGHLEKYDVITKVDDKEIASS
         290       300       310       320       330       340       350

1416      1446      1476      1506      1536      1566      1596      1626
SDLQSLLYGHQVGDSITVTFYRGENKQTVTIKLTKTSKDLAKQRANN*INSSYFN*DIVKLKGLVR*TNPFSKSIESEV*
:||||  || |  : ||:|   :|:||      ::  |    :|||  |:|  ::||
TDLQSALYNHSIGDTIKITYYRNGKEETTSIKLNKSSGDLES
         370       380       390
```

Based on this analysis, it was predicted that these proteins and their epitopes could be useful antigens for vaccines or diagnostics.

Example 1649

A DNA sequence (GBSx1744) was identified in *S. agalactiae* <SEQ ID 5105> which encodes the amino acid sequence <SEQ ID 5106>. This protein is predicted to be SPSpoJ (spo0J). Analysis of this protein sequence reveals the following:

Possible site: 53
>>> Seems to have no N-terminal signal sequence
----- Final Results -----
  bacterial cytoplasm --- Certainty = 0.4152 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:AAC45335 GB:AF000658 SPSpoJ [Streptococcus pneumoniae]
Identities = 138/257 (53%), Positives = 188/257 (72%), Gaps = 5/257 (1%)
Query:   1  MEYLETININHIAPNPYQPRLEFNTKELEELANSIKINGLIQPIIVRPSAVFGYELVAGE    60
            ME E  I+I   I  NPYQPR EF+ ++L+ELA SIK NG+IQPIIVR S V GYE++AGE
Sbjct:   1  MEKFEMISITDIQKNPYQPRKEFDREKLDELAQSIKENGVIQPIIVRQSPVIGYEILAGE    60

Query:  61  RRLRAAKLAKLESIPAIIKSYNNDDSMQLAIVENLQRSNLSPIEEAKAYSQLLQKKSMTH   120
            RR RA+ LA L SIPA++K  ++ + M  +I+ENLQR NL+PIEEA+AY  L++  K  TH
Sbjct:  61  RRYRASLLAGLRSIPAVVKQISDQEMMVQSIIENLQRENLNPIEEARAYVSLVE-KGFTH   119

Query: 121  EELAKYMGKSRPYISNTIRLLNLPPLITSAIEEGKLSSGHARALLSLPDASQQKDWYQRI   180
            E+A   GKSRPYISN+IRLL+LP  I S +E GKLS  HAR+L+ L +  QQ  ++QRI
Sbjct: 120  AEIADKEGKSRPYISNSIRLLSLPEQILSEVENGKLSQAHARSLVGL-NKEQQDYFFQRI   178
```

```
-continued
Query: 181  LTEDISVRRLEKLLKQEKKTNHKSLQNKDVFLKHQENELAQFLGSKVKLTINKDGAGNIK  240
            + EDISVR+LE LL ++K+    K  Q  + F++++E +L + LG  V++ ++K  +G I
Sbjct: 179  IEEDISVRKLEALLTEKKQ---KKQQKTNHFIQNEEKQLRKLLGLDVEIKLSKKDSGKII  235

Query: 241  IAFANQEELNRIINTLK                                             257
            I+F+NQEE +RIIN+LK
Sbjct: 236  ISFSNQEEYSRIINSLK                                             252
```

A related DNA sequence was identified in *S. pyogenes* <SEQ ID 5107> which encodes the amino acid sequence <SEQ ID 5108>. Analysis of this protein sequence reveals the following:

---

Possible site: 51
>>> Seems to have no N-terminal signal sequence
----- Final Results -----
   bacterial cytoplasm --- Certainty = 0.1758 (Affirmative) <succ>
     bacterial membrane --- Certainty = 0.0000 (Not Clear) <succ>
       bacterial outside --- Certainty = 0.0000 (Not Clear) <succ>

---

An alignment of the GAS and GBS proteins is shown below.

```
Identities = 146/256 (57%), Positives = 191/256 (74%), Gaps = 1/256 (0%)
Query:   2  EYLETININHIAPNPYQPRLEFNTKELEELANSIKINGLIQPIIVRPSAVFGYELVAGER   61
            E L + I  I  NPYQPR++FN +EL++LA SIR NGLIQPIIVR S +FGYELVAGER
Sbjct:  14  ELLIDLPIEDIVTNPYQPRIQFNQRELQDLATSIKSNGLIQPIIVRKSDIFGYELVAGER   73

Query:  62  RLRAAKLAKLESIPAIIKSYNNDDSMQLAIVENLQRSNLSPIEEAKAYSQLLQKKSMTHE  121
            RL+A+K+A L+ +PAIIK +   +SMQ AIVENLQRSNL+ IEEAKAY L++KK MTH+
Sbjct:  74  RLKASKMAGLKKVPAIIKKISTLESMQQAIVENLQRSNLNAIEEAKAYQLLVEKKHMTHD  133

Query: 122  ELAKYMGKSRPYISNTIRLLNLPPLITSAIEEGKLSSGHARALLSLPDASQQKDWYQRIL  181
            E+AKYMGKSRPYISNT+RLL LP  I  AIEEGK+S+GHARALL+L D  QQ     +I
Sbjct: 134  EIAKYMGKSRPYISNTLRLLQLPAPIIKAIEEGKISAGHARALLTLSDDKQQLYLTHKIQ  193

Query: 182  TEDISVRRLEKLLKQEKKTNHKSLQNKDVFLKHQENELAQFLGSKVKLTINKDGAGNIKI  241
              E +SVR++E+L+        ++ S + K++F       E +LA+ LG  V + +  + +G ++I
Sbjct: 194  NEGLSVRQIEQLV-TSTPSSKLSKKTKNIFATSLEKQLAKSLGLSVNMKLTANHSGYLQI  252

Query: 242  AFANQEELNRIINTLK                                              257
            +F+N +ELNRIIN LK
Sbjct: 253  SFSNDDELNRIINKLK                                              268
```

Based on this analysis, it was predicted that these proteins and their epitopes could be useful antigens for vaccines or diagnostics.

Example 1650

A DNA sequence (GBSx1745) was identified in *S. agalactiae* <SEQ ID 5109> which encodes the amino acid sequence <SEQ ID 5110>. Analysis of this protein sequence reveals the following:

---

Possible site: 54
>>> Seems to have no N-terminal signal sequence
INTEGRAL    Likelihood = −0.37    Transmembrane 2-18 (1-18)
----- Final Results -----
   bacterial membrane --- Certainty = 0.1150 (Affirmative) <succ>
     bacterial outside --- Certainty = 0.0000 (Not Clear) <succ>
       bacterial cytoplasm --- Certainty = 0.0000 (Not Clear) <succ>

---

A related GBS nucleic acid sequence <SEQ ID 10297> which encodes amino acid sequence <SEQ ID 10298> was also identified.

A related DNA sequence was identified in *S. pyogenes* <SEQ ID 5111> which encodes the amino acid sequence <SEQ ID 5112>. Analysis of this protein sequence reveals the following:

---

Possible site: 23
>>> Seems to have no N-terminal signal sequence
----- Final Results -----
   bacterial cytoplasm --- Certaintym = 0.3646 (Affirmative) <succ>
     bacterial membrane --- Certainty = 0.0000 (Not Clear) <succ>
       bacterial outside --- Certainty = 0.0000 (Not Clear) <succ>

---

An alignment of the GAS and GBS proteins is shown below.

```
Identities = 353/455 (77%), Positives = 401/455 (87%), Gaps = 6/455 (1%)
Query:  32  MTENEQLFWNRVLELSRSQIAPAAYEFFVLEARLLKIEHQTAVITLDNIEMKKLFWEQNL   91
            MTENEQ+FWNRVLEL++SQ+  A YEFFV +ARLLK++   A  I LD  +MK+LFWE+NL
Sbjct:   1  MTENEQIEWNRVLELAQSQLKQATYEFFVHDARLLKVDKHIATIYLD--QMKELFWEKNL   58
```

```
Query:   92  GPVILTAGFEIFNAEITANYV-SNDLHLQETSFS-NYQQSSNEVNTLPIRKIDSNLKEKY    149
             VILTAGFE++NA+I+ +YV   DL +++    N +    +N+LP   + S+L  KY
Sbjct:   59  KDVILTAGFEVYNAQISVDYVFEEDLMIEQNQTKINQKPKQQALNSLPT--VTSDLNSKY    116

Query:  150  TFANFVQGDENRWAVSASIAVADSPGTTYNPLFIWGGPGLGKTHLLNAIGNQVLRDNPNA    209
             +F NF+QGDENRWAV+ASIAVA++PGTTYNPLFIWGGPGLGKTHLLNAIGN VL +NPNA
Sbjct:  117  SFENFIQGDENRWAVAASIAVANTPGTTYNPLFIWGGPGLGKTHLLNAIGNSVLLENPNA    176

Query:  210  RVLYITAENFINEFVSHIRLDSMEELKEKFRNLDLLLIDDIQSLAKKTLGGTQEEFFNTF    269
             R+ YITAENFINEFV HIRLD+M+ELKEKFRNLDLLLIDDIQSLAKKTL GTQEEFFNTF
Sbjct:  177  RIKYITAENFINEFVIHIRLDTMDELKEKFRNLDLLLIDDIQSLAKKTLSGTQEEFFNTF    236

Query:  270  NALHTNDKQIVLTSDRNPNQLNDLEERLVTRFSWGLPVNITPPDFETRVAILTNKIQEYP    329
             NALH N+KQIVLTSDR P+ LNDLE+RLVTRF WGL VNITPPDFETRVAILTNKIQEY
Sbjct:  237  NALHNNNKQIVLTSDRTPDHLNDLEDRLVTRFKWGLTVNITPPDFETRVAILTNKIQEYN    296

Query:  330  YDFPQDTIEYLAGEFDSNVRELEGALKNISLVADFKHAKTITVDIAAEAIRARKNDGPIV    389
             + FPQDTIEYLAG+FDSNVR+LEGALK+ISLVA+FK    TITVDIAAEAIRARK DGP +
Sbjct:  297  FIFPQDTIEYLAGQFDSNVRDLEGALKDISLVANFKQIDTITVDIAAEAIRARKQDGPKM    356

Query:  390  TVIPIEEIQIQVGKFYGVTVKEIKATKRTQDIVLARQVAMYLAREMTDNSLPKIGKEFGG    449
             TVIPIEEIQ QVGKFYGVTVKEIKATKRTQ+IVLARQVAM+LAREMTDNSLPKIGKEFGG
Sbjct:  357  TVIPIEEIQAQVGKFYGVTVKEIKATKRTQNIVLARQVAMFLAREMTDNSLPKIGKEFGG    416

Query:  450  RDHSTVLHAYNKIKNMVAQDDNLRIEIETIKNKIR                            484
             RDHSTVLHAYNKIKNM++QD++LRIEIETIKNKI+
Sbjct:  417  RDHSTVLHAYNKIKNMISQDESLRIEIETIKNKIK                            451
```

Based on this analysis, it was predicted that these proteins and their epitopes could be useful antigens for vaccines or diagnostics.

Example 1651

A DNA sequence (GBSx1746) was identified in *S. agalactiae* <SEQ ID 5113> which encodes the amino acid sequence <SEQ ID 5114>. Analysis of this protein sequence reveals the following:

Possible site: 14
>>> Seems to have no N-terminal signal sequence
----- Final Results -----
bacterial cytoplasm --- Certainty = 0.0556 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:AAC45337 GB:AF000658 beta subunit of DNA polymerase III
[Streptococcus pneumoniae]
Identities = 278/378 (73%), Positives = 324/378 (85%)
Query:    1  MIHFSINKNFFLHALTVTKRAISHKNAIPILSTVKIEVTRDAIILTGSNGQISIENTIPA    60
             MIHFSINKN FL AL +TKRAIS KNAIPILSTVKI+VT + + L GSNGQISIEN I
Sbjct:    1  MIHFSINKNLFLQALNITKRAISSKNAIPILSTVKIDVTNEGVTLIGSNGQISIENFISQ    60

Query:   61  SNENAGLLVTNPGSILLEAGFFINIISSLPDVTLEFTEIEQHQIVLTSGKSEITLKGKDV    120
             +NE AGLL+T+ GSILLEA FFIN++SSLPDVTL+F EIEQ+QIVLTSGKSEITLKGKD
Sbjct:   61  KNEDAGLLITSLGSILLEASFFINVVSSLPDVTLDFKEIEQNQIVLTSGKSEITLKGKDS    120

Query:  121  DQYPRLQEMTTDTPLTLETKLLKSIINETAFAASQQESRPILTGVHLVISQNKYFKAVAT    180
             +QYPR+QE++   TPL LETKLLK IINETAFAAS QESRPILTGVH V+SQ+K  K VAT
Sbjct:  121  EQYPRIQEISASTPLILETKLLKKIINETAFAASTQESRPILTGVHFVLSQHKELKTVAT    180

Query:  181  DSHRMSQRTFQLEKSANNFDLVVPSKSLREFSAVFTDDIETVEVFFSDSQMLFRSENISF    240
             DSHR+SQ+    LEK++++FD+V+PS+SLREFSAVETDDIETVE+FF+++Q+LFRSENISF
Sbjct:  181  DSHRLSQKKLTLEKNSDDFDVVIPSRSLREFSAVFTDDIETVEIFFANNQILFRSENISF    240

Query:  241  YTRLLEGNYPDTDRLLTNQFETEIIFNTNALRHAMERAYLISNATQNGTVRLEIQNETVS    300
             YTRLLEGNYPDTDRL+   F T I FN   LR +MERA L+S+ATQNGTV+LEI++  VS
Sbjct:  241  YTRLLEGNYPDTDRLIPTDFNTTITFNVVNLRQSMERARLLSSATQNGTVKLEIKDGVVS    300

Query:  301  AHVNSPEVGKVNEELDTVSLKGDSLNISFNPTYLIESLKAVKSETVTIRFISPVRPFTLT    360
             AHV+SPEVGKVNEE+DT + G+ L ISFNPTYLI+SLKA+ SE VTI FIS VRPFTL
Sbjct:  301  AHVHSPEVGKVNEEIDTDQVTGEDLTISFNPTYLIDSLKALNSEKVTISFISAVRPFTLV    360

Query:  361  PGEDTEDFIQLITPVRTN                                             378
             P +  EDF+QLITPVRTN
Sbjct:  361  PADTDEDFMQLITPVRTN                                             378
```

A related DNA sequence was identified in *S. pyogenes* <SEQ ID 5115> which encodes the amino acid sequence <SEQ ID 5116>. Analysis of this protein sequence reveals the following:

Possible site: 14
>>> Seems to have no N-terminal signal sequence
INTEGRAL    Likelihood = –1.70    Transmembrane 67-83 (67-83)
----- Final Results -----
    bacterial membran --- Certainty = 0.1680 (Affirmative) <succ>
      bacterial outside --- Certainty = 0.0000 (Not Clear) <succ>
        bacterial cytoplasm --- Certainty = 0.0000 (Not Clear) <succ>

An alignment of the GAS and GBS proteins is shown below.

Possible site: 19
>>> Seems to have no N-terminal signal sequence
----- Final Results -----
    bacterial cytoplasm --- Certainty = 0.0857 (Affirmative) <succ>
      bacterial membrane --- Certainty = 0.0000 (Not Clear) <succ>
        bacterial outside --- Certainty = 0.0000 (Not Clear) <succ>

A related GBS nucleic acid sequence <SEQ ID 10299> which encodes amino acid sequence <SEQ ID 10300> was also identified.

The protein has homology with the following sequences in the GENPEPT database.

```
Identities = 295/378 (78%), Positives = 334/378 (88%)
Query:    1 MIHFSINKNFFLHALTVTKRAISHKNAIPILSTVKIEVTRDAIILTGSNGQISIENTIPA    60
            MI FSIN+  F+HAL  TKRAIS KMAIPILS++KIEVT   + LTGSNGQISIENTIP
Sbjct:    1 MIQFSINRTLFIHALNTTKRAISTKNAIPILSSIKIEVTSTGVTLTGSNGQISIENTIPV    60

Query:   61 SNENAGLLVTNPGSILLEAGFFINIISSLPDVTLEFTEIEQHQIVLTSGKSEITLKGKDV   120
            SNENAGLL+T+PG+ILLEA FFINIISSLPD+++    EIEQHQ+VLTSGKSEITLKGKDV
Sbjct:   61 SNENAGLLITSPGAILLEASFFINIISSLPDISINVKEIEQHQVVLTSGKSEITLKGKDV   120

Query:  121 DQYPRLQEMTTDTPLTLETKLLKSIINETAFAASQQESRPILTGVHLVISQNKYFKAVAT   180
            DQYPRLQE++T+ PL L+TKLLKSII ETAFAAS QESRPILTGVH+V+S +K FKAVAT
Sbjct:  121 DQYPRLQEVSTENPLILKTKLLKSIIAETAFAASLQESRPILTGVHIVLSNHKDFKAVAT   180

Query:  181 DSHRMSQRTFQLEKSANNFDLVVPSKSLREFSAVFTDDIETVEVFFSDSQMLFRSENISF   240
            DSHRMSQR    L+ ++ +FD+V+PSKSLREFSAVFTDDIETVEVFFS SQ+LFRSE+ISF
Sbjct:  181 DSHRMSQRLITLDNTSADFDVVIPSKSLREFSAVFTDDIETVEVFFSPSQILFRSEHISF   240

Query:  241 YTRLLEGNYPDTDRLLTNQFETEIIFNTNALRHAMERAYLISNATQNGTVRLEIQNETVS   300
            YTRLLEGNYPDTDRLL  +FETE++FNT +LRHAMERA+LISNATQNGTV+LEI    +S
Sbjct:  241 YTRLLEGNYPDTDRLLMTEFETEVVFNTQSLRHAMERAFLISNATQNGTVKLEITQNHIS   300

Query:  301 AHVNSPEVGKVNEELDTVSLKGDSLNISFNPTYLIESLKAVKSETVTIRFISPVRPFTLT   360
            AHVNSPEVGKVNE+LD VS  G   L ISFNPTYLIESLKA+KSETV I F+SPVRPFTLT
Sbjct:  301 AHVNSPEVGKVNEDLDIVSQSGSDLTISFNPTYLIESLKAIKSETVKIHFLSPVRPFTLT   360

Query:  361 PGEDTEDFIQLITPVRTN                                           378
            PG++ E FIQLITPVRTN
Sbjct:  361 PGDEEESFIQLITPVRTN                                           378
```

Based on this analysis, it was predicted that these proteins and their epitopes could be useful antigens for vaccines or diagnostics.

Example 1652

A DNA sequence (GBSx1747) was identified in *S. agalactiae* <SEQ ID 5117> which encodes the amino acid sequence <SEQ ID 5118>. Analysis of this protein sequence reveals the following:

```
>GP:AAC00282 GB:AF008220 Yt1R [Bacillus subtilis]
Identities = 83/298 (27%), Positives = 138/298 (45%), Gaps = 35/298 (11%)
Query:   19 YIIANPHAGNKNASTIVGKIQE--LYHTEDISVFYTEQKDDEK--KQVINILRSFKESDH    74
            + I NP AG++N   +  IQ+  +     F TE    +   + I+ ++ +K
Sbjct:    5 FFIINPTAGHRNGLRVWKSIQKELIKRKVEHRSFLTEHPGHAEVLARQISTIQEYKLK-R    63

Query:   75 LMIIGGDGTLSKVMTYLPQ--HIPCTYYPVGSGNDFARALKIPNL---------KETLTA   123
            L++IGGDGT+ +V+ L     I  ++ P G+ NDF+R   I  +            K LT
Sbjct:   64 LIVIGGDGTMHEVVNGLKDVDDIELSFVPAGAYNDFSRGFSIKKIDLIQEIKKVKRPLT-   122

Query:  124 IQTERLKEINCFIYDKGLIL---NSLDLGFAAYVVWKASNSKIKNILNRYRLGKITYIVI   180
            +T  L  +N F+  DK  IL   N + +GF AYV   KA   ++ +    RL + Y +
Sbjct:  123 -RTFHLGSVN-FLQDKSQILYFMNHIGIGFDAYVNKKAMEFPLRRVFLFLRLRFLVYPL-   179

Query:  181 AIKSLLHSSK------VQVLVEGETGQQIKLNDLYFFALANNTYFGGGITIWPKASALTA   234
                  S LH+S         +   E ET +    +D++F ++N+ ++GGG+    P A+
```

```
                        -continued
Sbjct:  180  ---SHLHASATFKPFTLACTTEDETRE---FHDVWFAVVSNHPFYGGGMKAAPLANPREK    233

Query:  235  ELDMVYAKGHTFLKRLSILLSLVFKRHTTSKSIKHQTFKAMTVYFPKNSLIEIDGEIV      292
             D+V  +    FLK+   +L  + F +HT     +   K +T Y         DGEI+
Sbjct:  234  TFDIVIVENQPFLKKYWLLCLMAFGKHTKMDGVTMFKAKDITFYTKDKIPFHADGEIM      291
```

Based on this analysis, it was predicted that these proteins and their epitopes could be useful antigens for vaccines or diagnostics.

Example 1653

A DNA sequence (GBSx1748) was identified in *S. agalactiae* <SEQ ID 5121> which encodes the amino acid sequence <SEQ ID 5122>. Analysis of this protein sequence reveals the following:

Possible site:15
>>> Seems to have no N-terminal signal sequence
----- Final Results -----
    bacterial cytoplasm --- Certainty = 0.3792 (Affirmative) <succ>
      bacterial membrane --- Certainty = 0.0000 (Not Clear) <succ>
        bacterial outside --- Certainty = 0.0000 (Not Clear) <succ>

The protein has homology with the following sequences in the GENPEPT database.

```
>GP:AAC45338 GB:AF000658 ORFX [Streptococcus pneumoniae]
Identities = 46/63 (73%), Positives = 57/63 (90%)
Query:  1   MYQVGSLVEMKKPHACVIKETGKKANQWKVLRVGADIKIQCTNCQHVIMMSRYDFERKLK    60
            MYQVG++ VEMKKPHAC IK TGKKAN+W++ RVGADIKI+C+NC+HV+MM RYDFERK+
Sbjct:  1   MYQVGNFVEMKKPHACTIKSTGKKANRWEITRVGADIKIKCSNCEHVVMMGRYDFERKMN    60

Query:  61  KVL                                                           63
            K++
Sbjct:  61  KII                                                           63
```

A related DNA sequence was identified in *S. pyogenes* <SEQ ID 5123> which encodes the amino acid sequence <SEQ ID 5124>. Analysis of this protein sequence reveals the following:

Possible site: 56
>>> Seems to have no N-terminal signal sequence
----- Final Results -----
    bacterial cytoplasm --- Certainty = 0.4038 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below.

```
Identities = 63/65 (96%), Positives = 64/65 (97%)
Query:  1   MYQVGSLVEMKKPHACVIKETGKKANQWKVLRVGADIKIQCTNCQHVIMMSKYDFERKLK    60
            MYQ+GS VEMKKPHACVIKETGKKANQWKVLRVGADIKIQCTNCQHVIMMSKYDFERKLK
Sbjct:  1   MYQIGSFVEMKKPHACVIKETGKKANQWKVLRVGADIKIQCTNCQHVIMMSKYDFERKLK    60

Query:  61  KVLQP                                                         65
            KVLQP
Sbjct:  61  KVLQP                                                         65
```

Based on this analysis, it was predicted that these proteins and their epitopes could be useful antigens for vaccines or diagnostics.

Example 1654

A DNA sequence (GBSx1749) was identified in *S. agalactiae* <SEQ ID 5125> which encodes the amino acid sequence <SEQ ID 5126>. Analysis of this protein sequence reveals the following:

Possible site: 15
>>> Seems to have no N-terminal signal sequence
INTEGRAL    Likelihood = −4.99    Transmembrane 48-64 (47-66)
----- Final Results -----
    bacterial membrane --- Certainty = 0.2996 (Affirmative) <succ>
      bacterial outside --- Certainty.0.0000 (Not Clear) <succ>
        bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1655

A DNA sequence (GBSx1750) was identified in *S. agalactiae* <SEQ ID 5127> which encodes the amino acid sequence <SEQ ID 5128>. Analysis of this protein sequence reveals the following:

Possible site: 15
\>>> Seems to have no N-terminal signal sequence
----- Final Results -----
   bacterial cytoplasm --- Certainty = 0.4171(Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1656

A DNA sequence (GBSx1751) was identified in *S. agalactiae* <SEQ ID 5129> which encodes the amino acid sequence <SEQ ID 5130>. This protein is predicted to be GTP-binding protein. Analysis of this protein sequence reveals the following:

Possible site: 41
\>>> Seems to have no N-terminal signal sequence
----- Final Results -----
   bacterial cytoplasm --- Certainty = 0.3952 (Affirmative) <succ>
   bacterial membrane --- Certainty = 0.0000 (Not Clear) <succ>
   bacterial outside --- Certainty = 0.0000 (Not Clear) <succ>

A related GBS nucleic acid sequence <SEQ ID 8875> which encodes amino acid sequence <SEQ ID 8876> was also identified. Analysis of this protein sequence reveals the following:

Lipop: Possible site: -1     Crend: 0
McG: Discrim Score: 0.53
GvH: Signal Score (-7.5): -0.13
Possible site: 29
\>>> Seems to have a cleavable N-term signal seq.
ALOM program     count: 0 value: 1.48 threshold: 0.0
PERIPHERAL     Likelihood = 1.48     195
modified ALOM score: -0.80
** Reasoning Step: 3
----- Final Results -----
   bacterial outside --- Certainty = 0.3000 (Affirmative) <succ>
   bacterial membrane --- Certainty = 0.0000 (Not Clear) <succ>
   bacterial cytoplasm --- Certainty = 0.0000 (Not Clear) <succ>

The protein has homology with the following sequences in the GENPEPT database.

```
>GP:BAB07770 GB:AP001520 GTP-binding protein [Bacillus halodurans]
Identities = 223/329 (67%), Positives = 273/329 (82%), Gaps = 5/329 (1%)
Query:     1 MVEVPDERLQKLTELITPKKTVPTTFEFTDIAGIVKGASKGEGLGNKFLANIREVDAIVH    60
             +VEVPD RLQKLTEL+ PKKTVPT FEFTDIAGIV+GASKGEGLGN+FL++IR+VDAI H
Sbjct:    43 IVEVPDPRLQKLTELVNPKKTVPTAFEFTDIAGIVEGASKGEGLGNQFLSHIRQVDAISH   102

Query:    61 VVRAFDDENVMREQGREDAFVDPIADIDTINLELILADLESINKRYARVEKMARTQKDKE   120
             VVR FDDEN+    G    VDPI DI  INLELILADLES++KR++RV+K+A+T KDKE
Sbjct:   103 VVRCFDDENITHVSGS----VDPIRDISVINLELILADLESVDKRFSRVQKLAKT-KDKE   157

Query:   121 SVAEFNVLQKIKPVLEDGKSARTIEFTEEEAKVVKGLFLLTTKPVLYVANVDEDKVADPD   180
             +VAE   VL+K+K   E+ K AR+IEFTEE+ K+VKGL LLT+KPVLYVANV ED V  PD
Sbjct:   158 AVAELEVLEKLKDAFENEKPARSIEFTEEQQKIVKGLHLLTSKPVLYVANVSEDDVLSPD   217

Query:   181 DIDYVNQIRAFAETENAEVVVISARAEEEISELDDEDKLEFLEAIGLTESGVDKLTRAAY   240
             D  +V +++AFA  EN+EV+V+SA+ EEEI+ELD E+K  FLE +G+ ESG+D+L RAAY
Sbjct:   218 DNPFVQKVKAFAAEENSEVIVVSAKIEEEIAELDGEEKAMFLEELGIQESGLDQLIRAAY   277

Query:   241 HLLGLGTYFTAGEKEVRAWTFKRGIKAPQAASIIHSDFERGFIRAVTMSYDDLIQYGSEK   300
             LLGL TYFTAGE+EVRAWTF++G KAPQAA IIHSDFE+GFIRA T+SY+DL++ GS
Sbjct:   278 SLLGLQTYFTAGEQEVRAWTERKGTKAPQAAGIIHSDFEKGFIRAETVSYNDLVEAGSMA   337

Query:   301 AVKEAGRLREEGKEYIVQDGDIMEFRFNV                                329
             KE G++R EGKEY+VQDGD++ FRFNV
Sbjct:   338 VARERGKVRLEGKEYVVQDGDVIHFRFNV                                366
```

A related DNA sequence was identified in *S. pyogenes* <SEQ ID 5131> which encodes the amino acid sequence <SEQ ID 5132>. Analysis of this protein sequence reveals the following:

Possible site: 29
\>>> Seems to have a cleavable N-term signal seq.
----- Final Results -----
   bacterial outside --- Certainty = 0.3000 (Affirmative) <succ>
   bacterial membrane --- Certainty = 0.0000 (Not Clear) <succ>
   bacterial cytoplasm --- Certainty = 0.0000 (Not Clear) <succ>

The protein has homology with the following sequences in the databases:

```
>GP:BAB07770 GB:AP001520 GTP-binding protein [Bacillus halodurans]
Identities = 259/371 (69%), Positives = 314/371 (83%), Gaps = 5/371 (1%)
Query:     1 MALTAGIVGLPNVGKSTLFNAITKAGAEAANYPFATIDPNVGMVEVPDERLQKLTELITP    60
             MALT GIVGLPNVGKSTLFNAIT+AGAE+ANYPF TIDPNVG+VEVPD RLQKLTEL+ P
Sbjct:     1 MALTTGIVGLPNVGKSTLFNAITQAGAESANYPECTIDPNVGIVEVPDPRLQKLTELVNP    60
```

```
Query:   61 KKTVPTTFEFTDIAGIVKGASRGEGLGNKFLANIREIDAIVHVVRAFDDENVMREQGRED  120
             KKTVPT FEFTDIAGIV+GAS+GEGLGN+FL++IR++DAI HVVR FDDEN+     G
Sbjct:   61 KKTVPTAFEFTDIAGIVEGASKGEGLGNQFLSHIRQVDAISHVVRCFDDENITHVSGS--  118

Query:  121 AFVDPIADIDTINLELILADLESINKRYARVEKMARTQKDKESVAEFNVLQKIKPVLEDG  180
                VDPI DI   INLELILADLES++KR++RV+K+A+T KDKE+VAE  VL+K+K    E+
Sbjct:  119 --VDPIRDISVINLELILADLESVDKRFSRVQKLAKT-KDKEAVAELEVLEKLKDAFENE  175

Query:  181 KSARTIEFTEDEAKVVKGLFLLTTKPVLYVANVDEDKVANPDGIDYVKQIRDFAATENAE  240
             K AR+IEFTE++ K+VKGL LLT+KPVLYVANV ED V +PD      +V++++ FAA EN+E
Sbjct:  176 KPARSIEFTEEQQKIVKGLHLLTSKPVLYVANVSEDDVLSPDDNPFVQKVKAFAAEENSE  235

Query:  241 VVVISARAEEEISELDDEDKEEFLEAIGLTESGVDKLTRAAYHLLGLGTYFTAGEKEVRA  300
             V+V+SA+ EEEI+ELD E+K   FLE +G+ ESG+D+L RAAY LLGL TYFTAGE+EVRA
Sbjct:  236 VIVVSAKIEEEIAELDGEEKAMFLEELGIQESGLDQLIRAAYSLLGLQTYFTAGEQEVRA  295

Query:  301 WTFKRGIKAPQAAGIIHSDFERGFIRAVTMSYDDLMTYGSEKAVKEAGRLREEGKEYVVQ  360
             WTF++G KAPQAAGI IHSDFE+GFIRA T+SY+DL+   GS       KE G++R EGKEYVVQ
Sbjct:  296 WTFRKGTKAPQAAGIIHSDFEKGFIRAETVSYNDLVEAGSMAVAKERGKVRLEGKEYVVQ  355

Query:  361 DGDIMEFRFNV                                                  371
             DGD++ FRFNV
Sbjct:  356 DGDVIHFRFNV                                                  366
```

An alignment of the GAS and GBS proteins is shown below.

```
Identities = 316/329 (96%), Positives = 322/329 (97%)
Query:    1 MVEVPDERLQKLTELITPKKTVPTTFEFTDIAGIVKGASKGEGLGNKFLANIREVDAIVH   60
            MVEVPDERLQKLTELITPKKTVPTTFEFTDIAGIVKGAS+GEGLGNKFLANIRE+DAIVH
Sbjct:   43 MVEVPDERLQKLTELITPKKTVPTTFEFTDIAGIVKGASRGEGLGNKFLANIREIDAIVH  102

Query:   61 VVRAFDDENVMREQGREDAFVDPIADIDTINLELILADLESINKRYARVEKMARTQKDKE  120
            VVRAFDDENVMREQGREDAFVDPIADIDTINLELILADLESINKRYARVEKMARTQKDKE
Sbjct:  103 VVRAFDDENVMREQGREDAFVDPIADIDTINLELILADLESINKRYARVEKMARTQKDKE  162

Query:  121 SVAEFNVLQKIKPVLEDGKSARTIEFTEEEAKVVKGLFLLTTKPVLYVANVDEDKVADPD  180
            SVAEFNVLQKIKPVLEDGKSARTIEFTE+EAKVVKGLELLTTKPVLYVANVDEDKVA+PD
Sbjct:  163 SVAEFNVLQKIKPVLEDGKSARTIEFTEDEAKVVKGLFLLTTKPVLYVANVDEDKVANPD  222

Query:  181 DIDYVNQIRAFAETENAEVVVISARAEEEISELDDEDKLEFLEAIGLTESGVDKLTRAAY  240
              IDYV QIR FA TENAEVVVISARAEEEISELDDEDK EFLEAIGLTESGVDKLTRAAY
Sbjct:  223 GIDYVKQIRDFAATENAEVVVISARAEEEISELDDEDKEEFLEAIGLTESGVDKLTRAAY  282

Query:  241 HLLGLGTYFTAGEKEVRAWTFKRGIKAPQAASIIHSDFERGFIRAVTMSYDDLIQYGSEK  300
            HLLGLGTYFTAGEKEVRAWTFKRGIKAPQAA IIHSDFERGFIRAVTMSYDDL+ YGSEK
Sbjct:  283 HLLGLGTYFTAGEKEVRAWTFKRGIKAPQAAGIIHSDFERGFIRAVTMSYDDLMTYGSEK  342

Query:  301 AVKEAGRLREEGKEYIVQDGDIMEFRFNV                                329
            AVKEAGRLREEGKEY+VQDGDIMEFRFNV
Sbjct:  343 AVKEAGRLREEGKEYVVQDGDIMEFRFNV                                371
```

SEQ ID 8876 (GBS177) was expressed in *E. coli* as a His-fusion product. SDS-PAGE analysis of total cell extract is shown in FIG. 38 (lane 4; MW 41.2 kDa).

Figure 118:
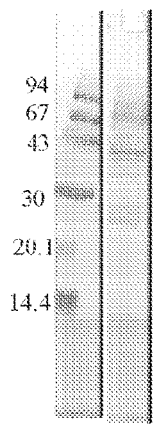

The GBS177-His fusion product was purified (FIG. 118A; see also FIG. 202, lane 7) and used to immunise mice (lane 1 product; 20 μg/mouse). The resulting antiserum was used for Western blot, FACS, and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 1657

A DNA sequence (GBSx1752) was identified in *S. agalactiae* <SEQ ID 5133> which encodes the amino acid sequence <SEQ ID 5134>. This protein is predicted to be stage V sporulation protein C (pth). Analysis of this protein sequence reveals the following:

---

Possible site: 19

>>> Seems to have no N-terminal signal sequence

----- Final Results ----- bacterial cytoplasm --- Certainty = 0.2212 (Affirmative) <succ> bacterial membrane --- Certainty = 0.0000 (Not Clear) <succ> bacterial outside --- Certainty = 0.0000 (Not Clear) <succ>

---

A related GBS nucleic acid sequence <SEQ ID 10301> which encodes amino acid sequence <SEQ ID 10302> was also identified.

The protein has homology with the following sequences in the GENPEPT database.

```
>GP:BAB03787 GB:AP001507 stage V sporulation protein C
(peptidyl-tRNA hydrolase) [Bacillus halodurans]
Identities = 89/187 (47%), Positives = 127/187 (67%), Gaps = 2/187 (1%)
Query:   6 VKMIVGLGNPGSKYNDTKHNIGFMAVDRIVKDLDVNFTEDKNFKAEIGSDFINGEKIYFI    65
           +K+IVGLGNPG+KY+ T+HN+GF VD + + L++   + K      G    I+GEKI+ +
Sbjct:   1 MKLIVGLGNPGAKYDGTRHNVGFDVVDAVARRLNIEIKQSKA-NGLYGEGRIDGEKIFLL    59

Query:  66 KPITFMNNSGIAVKALLTYYNISIKDMIIYDDLDMEVGKIRFRQKGSAGGHNGIKSIIA   125
           KP TFMN SG +V+  L YYN+ ++D+++IYDDLD+ VGKIR RQKGSAGGHNG+KS+IA
Sbjct:  60 KPQTFMNRSGESVRPFLEYYNMEVEDLLVIYDDLDLPVGKIRLRQKGSAGGHNGMKSLIA   119

Query: 126 HLGTQEFDRIKVGIGRPNGRMTVINHVLGKFDKNDEIMILNTLDKVDNAVNYYLQTNDFQ   185
           HLGT +F RI+VG+ RP     TV+ HVLG++    ++   I    +D    A   + +    F
Sbjct: 120 HLGTSDFKRIRVGVDRPAPGETVVQHVLGRYRPEEKDAISEAIDLSAEAAEAFTK-KPFL   178

Query: 186 KTMQKYN   192
           + M   +N
Sbjct: 179 EVMNTFN   185
```

A related DNA sequence was identified in *S. pyogenes* <SEQ ID 5135> which encodes the amino acid sequence <SEQ ID 5136>. Analysis of this protein sequence reveals the following:

---
Possible site: 30
>>> Seems to have no N-terminal signal sequence
----- Final Results -----
   bacterial cytoplasm --- Certainty = 0.2840 (Affirmative) <succ>
   bacterial membrane --- Certainty = 0.0000 (Not Clear) <succ>
   bacterial outside --- Certainty = 0.0000 (Not Clear) <succ>
---

An alignment of the GAS and GBS proteins is shown below.

```
Identities = 148/189 (78%), Positives = 166/189 (87%)
Query:   5 MVKMIVGLGNPGSKYNDTKHNIGFMAVDRIVKDLDVNFTEDKNFKAEIGSDFINGEKIYF    64
           MVKMIVGLGNPGSKY  TKHNIGFMA+D IVK+LDV FT+DKNFKA+IGS FIN EK+YF
Sbjct:  16 MVKMIVGLGNPGSKYEKTKHNIGFMAIDNIVKNLDVTFTDDKNFKAQIGSTFINHEKVYF    75

Query:  65 IKPTTFMNNSGIAVKALLTYYNISIKDMIIYDDLDMEVGKIRFRQKGSAGGHNGIKSII   124
           +KPTTFMNNSGIAVKALLTYYNI I D+I+IYDDLDMEV K+R R KGSAGGHNGIKSII
Sbjct:  76 VKPTTFMNNSGIAVKALLTYYNIDITDLIVIYDDLDMEVSKLRLRSKGSAGGHNGIKSII   135

Query: 125 AHLGTQEFDRIKVGIGRPNGRMTVINEVLGKFDKNDEIMILNTLDKVDNAVNYYLQTNDF   184
           AH+GTQEF+RIKVGIGRP    MTVINHV+G+F+  D I I   TLD+V NAV +YLQ NDF
Sbjct: 136 AHIGTQEFNRIKVGIGRPLKGMTVINHVMGQFNTEDNIAISLTLDRVVNAVKFYLQENDF   195

Query: 185 QKTMQKYNG   193
           +KTMQK+NG
Sbjct: 196 EKTMQKFNG   204
```

Based on this analysis, it was predicted that these proteins and their epitopes could be useful antigens for vaccines or diagnostics.

Example 1658

A DNA sequence (GBSx1753) was identified in *S. agalactiae* <SEQ ID 5137> which encodes the amino acid sequence <SEQ ID 5138>. This protein is predicted to be transcription-repair coupling factor (mfd). Analysis of this protein sequence reveals the following:

---
Possible site: 37
>>> Seems to have no N-terminal signal sequence
----- Final Results -----
   bacterial cytoplasm --- Certainty = 0.2456 (Affirmative) <succ>
   bacterial membrane --- Certainty = 0.0000 (Not Clear) <succ>
   bacterial outside --- Certainty = 0.0000 (Not Clear) <succ>
---

The protein has homology with the following sequences in the GENPEPT database.

```
>GP:AAD03810 GB:AF054624 transcription-repair coupling factor
[Lactobacillus sakei]
Identities = 523/1051 (49%), Positives = 733/1051 (68%), Gaps = 20/1051 (1%)
Query:    1 MNIIELFSQNKVVRTWHSGLVTNSRQLVMGFSGASKAIAIASAYEKLSKKIMVVTATQTD    60
            M++I +    + V++          RQL+ G SG++K +A+ Y++  + ++++ +
Sbjct:    1 MDLISMLGNTQQVQSVLENQKPGVRQLLTGLSGSAKTLFLATIYKQQRQPLLIIESNMFQ    60

Query:   61 SDKLSSDISSLIGEDNVYQFFADDVPAAEFIFSSLDKSISRLSALRFLKDPEKNGVLITS   120
            +++++ D+++ + D +Y F ++V AAE    SS +    R+  L FL    +K G+++TS
Sbjct:   61 ANQVAEDLANQLNGDQIYTFPVEEVMAAEIAVSSPESRAERVRTLSFLATGKK-GIVVTS   119

Query:  121 ISGLRLLLPNPEVFSKSQYKFEIGQECYLDKLCKNLVNLGYQKVSQVFSPGEFSQRGDIL   180
            ++G+R LLP   + SQ + E+G E    L   L +GY + V  PGEF+ RGDI+
Sbjct:  120 VAGMRRLLPTVRQWRDSQTQIEMGGEVDPKILGAQLAEMGYHRDKLVGKPGEFAMRGDII   179

Query:  181 DIFEMTQEYPYRLEFFGDEIDGIRQFDIDTQKSLKQLESVQISPADDIILQDADFERAKK   240
            DIF +  E P R+E F  E+D IR F+ DTQ+S++ LESV I PA D++   A  E A +
Sbjct:  180 DIFPLDTENPVRIELFDTEVDAIRSFEADTQRSIENLESVAIMPATDLLANAAQLEMAGE   239

Query:  241 KLEG-YLVTASEVQ------------RTYLSEVLSTTENHFKHSDIRRFLSIFYEKEWGI   287
             L+  Y  TA+++             T +S +L+   + ++  F+  Y     +
Sbjct:  240 ALQADYQQTAAKITAKDDQKALAVNFETPISRLLAGE----RLENLALFVDYLYPDHTSL   295

Query:  288 LDYIPEGTPLFVDDFQKIVDRNAKLDLEIASLLTEDLQQGKSHSSLNYFSDPYKQLRQYQ   347
            +DY    + DD+ +I +  L E A+ T+ L  +    + D + ++Q Q
Sbjct:  296 IDYFKNSGLVVFDDYPRIQETQRVLAEEEAANWQTDMLGSRRLLPAQKLLVDVHHLMKDQ   355

Query:  348 -PATFFSNFHKGLGNLKFDKLHHFTQYGMQEFFNQFPLLVDEINRYKKSGATVLLQVDSQ   406
             P  + S F KG+G LK D L +     +Q+FF+Q PLL  E++R++K   TV++ V
Sbjct:  356 HPHLYLSLFQKGMGKLKDTLGNMPTRNVQQFFSQMPLLKTEMSRWQKQQQTVVVLVSDA   415

Query:  407 KGLNLLQENLKEYGLDLIISDKNDIVQKESQLIVGHLSNGFYFADEKIVLITEREIYHRR   466
            K + ++   ++ ++  ++ K +V + Q++ G L NGF     D K+V++TE+E+++
Sbjct:  416 KRVKKIDQTFHDFEIEATVTTKTKLVAGQIQIVQGSLQNGFELPDLKLVVLTEKELFNTA   475

Query:  467 VKRKIRRSNISNAERLKDYNELSVGDYVVHNVHGVGKFLGIETIEIQGIHRDYLTIQYQN   526
             K+K+RR  ++NAERLK Y+EL  GDYVVH  HG+G+++G ET+E+   G+H+DY+TI Y++
Sbjct:  476 PKKKVRRQTLANAERLKSYSELKPGDYVVHVNHGIGEYVGMETLEVDGVHQDYITILYRD   535

Query:  527 ADRISIPVEQIELLTKYVSADGKEPKINTLNDGRFKKAKQRVAKQVEDIADDLLKLYAER   586
             ++ IPV Q++++ KYVSA+ K PKIN L    ++K K +V+ ++EDIADDL++LYA+R
Sbjct:  536 NGKLFIPVTQLDMVQKYVSAESKTPKINKLGGAEWQKTKSKVSAKIEDIADDLIELYAQR   595

Query:  587 SQLQGFAFSPDDNMQNDFDNDFAYVETEDQLRSIKEIKQDMEGNRPMDRLLVGDVGFGKT   646
                +G+AF  DD +Q DF+N FAY ET+DQLRS  EIK DME  RPMDRLLVGDVGFGKT
Sbjct:  596 EAEKGYAFPKDDQLQADFENQFAYPETDDQLRSTAEIKHDMEKVRPMDRLLVGDVGFGKT   655

Query:  647 EVAMRAAFKAVNDHKQVVVLVPTTVLAQQHFENFKERFSNYPVTVDVLSRFRSKKEQTDT   706
            EVA+RAAFKAV   KQV  LVPTT+LAQQH+EN  RF+++PV + +LSRF++KE T T
Sbjct:  656 EVALRAAFKAVAAGKQVAELVPTTILAQQHYENMLARFADEPVELGLLSRFKTRKEVTAT   715

Query:  707 LKRLSKGQVDIIIGTHRLLSQDVVFSDLGLIVIDEEQRFGVKHKEKLKELKTKVDVLTLT   766
            LK L +KGQVDI+IGTHRLLS+DVVF DLGL+++DEEQRFGVKHKE+LK+LK +VDVLTLT
Sbjct:  716 LKGLEKGQVDIVIGTHRLLSKDVVFKDLGLLIVDEEQRFGVKHKERLKQLKAQVDVLTLT   775

Query:  767 ATPIPRTLHMSMLGIRDLSVIETPPTNRYPVQTYVLETNPGLVREAIIREIDRGGQVFYV   826
            ATPIPRTLHMSMLG+RDLSVIETPPTNRYP+QTYV+E N G +REAI RE++ GQVFY+
Sbjct:  776 ATPIPRTLHMSMLGVRDLSVIETPPTNRYPIQTYVMEQNAGAMREAIERELERNGQVFYL   835

Query:  827 YNKVDTIDQKVSELQELVPEASIGFVHGQMSEIQLENTLIDFINGDYDVLVATTIIETGV   886
             +N+V  I+Q V E+Q LVPEA++G+ HGQM+E QLE  + DF+ G YDVLV TTIIETGV
Sbjct:  836 HNRVSDIEQTVDEIQALVPEATVGYAHGQMTEAQLEGVIYDFVQGKYDVLVTTTIIETGV   895

Query:  887 DISNVNTLFVENADHMGLSTLYQLRGRVGRSNRIAYAYLMYRPDKVLTEISEKRLDAIKG   946
            D+ NVNT+ VE+ADH GLS LYQLRGR+GRS+R+AY Y MY+PDKVLTE+SEKRL AIK
Sbjct:  896 DMPNVNTMIVEDADHYGLSLYQLRGRIGRSSRVAYGYFMYKPDKVLTEVSEKRLQAIKD   955

Query:  947 FTELGSGFKIAMRDLSIRGAGNILGASQSGFIDSVGFEMYSQLLEQAIATKQGKSLIRQK  1006
            FTELGSGFKIAMRDLSIRGAGN+LG  Q GFIDSVGF++YSQ+L +A+A KQGK   +K
Sbjct:  956 FTELGSGFKIAMRDLSIRGAGNLLGKQQHGFIDSVGFDLYSQMLSEAVAKKQGKK-VAAK  1014

Query: 1007 GNAELALQIDAYLPAEYISDERQKIEIYKRI                              1037
             NAE+ L+++AYLP +YI+D+RQKIEIYKRI
Sbjct: 1015 TNAEIDLKLEAYLPDDYINDQRQKIEIYKRI                              1045
```

A related DNA sequence was identified in *S. pyogenes* <SEQ ID 5139> which encodes the amino acid sequence <SEQ ID 5140>. Analysis of this protein sequence reveals the following:

Possible site: 39
>>> Seems to have no N-terminal signal sequence

----- Final Results -----
bacterial cytoplasm --- Certainty = 0.2826 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 875/1161 (75%), Positives = 1032/1161 (88%)
Query:     1 MNIIELFSQNKVVRTWHSGLVTNSRQLVMGFSGASKAIAIASAYEKLSKKIMVVTATQTD    60
             M+I+ELFSQNK V++WHSGL T  RQLVMG SG+SK +AIASAY    KKI+VVT+TQ +
Sbjct:     1 MDILELFSQNKKVQSWHSGLTTLGRQLVMGLSGSSKTLAIASAYLDDQKKIVVVTSTQNE    60

Query:    61 SDKLSSDISSLIGEDNVYQFFADDVPAAEFIFSSLDKSISRLSALRFLKDPEKNGVLITS   120
             +KL+SD+SSL+ E+ V+QFFADDV AAEFIF+S+DK++SR+ L+FL++P+  GVLI S
Sbjct:    61 VEKLASDLSSLLDEELVFQFFADDVAAAEFIFASMDKALSRIETLQFLRNPKSQGVLIVS   120

Query:   121 ISGLRLLLPNPEVFSKSQYKFEIGQECYLDKLCKNLVNLGYQKVSQVFSPGEFSQRGDIL   180
             +SGLR+LLPNP+VF+KSQ +    +G++    D L K L+ +GYQKVSQV SPGEFS+RGDIL
Sbjct:   121 LSGLRILLPNPDVFTKSQIQLTVGEDYDSDILTKQLMTIGYQKVSQVISPGEFSRRGDIL   180

Query:   181 DIFEMTQEYPYRLEFFGDEIDGIRQFDIDTQKSLKQLESVQISPADDIILQDADFERAKK   240
             DI+E+TQE PYRLEFFGD+ID IRQF  +TQKS +QLE I+PA D+I + +DF+R  +
Sbjct:   181 DIYEITQELPYRLEFFGDDIDSIRQFHPETQKSFEQLEGIFINPASDLIFEVSDFQRGIE   240

Query:   241 KLEGYLVTASEVQRTYLSEVLSTTENHFKHSDIRRFLSIFYEKEWGILDYIPEGTPLFVD   300
             +LE  L  TA +  +++YL +VL+ ++N FKH DIR+F S+FYEKEW +LDYIP+GTP+F D
Sbjct:   241 QLEKALQTAQDDKKSYLEDVLAVSKNGFKHKDIRKFQSLFYEKEWSLLDYIPKGTPIFFD   300

Query:   301 DFQKIVDRNAELDLEIASLLTEDLQQGKSHSSLNYFSDPYKQLRQYQPATFFSNFHKGLG   360
             DFQK+VD+NA+ DLEIA+LLTEDLQQGK+ S+LNYF+D Y++LR Y+PATFFSNFHKGLG
Sbjct:   301 DFQKLVDKNARFDLEIANLLTEDLQQGKALSNLNYFIDNYRELRHYKPATFFSNFHKGLG   360

Query:   361 NLKFDKLHHFTQYGMQEFFNQFPLLVDEINRYKKSGATVLLQVDSQKGLNLLQENLKEYG   420
             N+KFD++H  TQY MQEFFNQFPLL+DEI RY+K+   TV++QV+SQ       L+++ ++Y
Sbjct:   361 NIKFDQMHQLTQYAMQEFFNQFPLLIDEIKRYQKNQTTVIVQVESQYAYERLEKSFQDYQ   420

Query:   421 LDLIISDKNDIVQKESQLIVGHLSNGFYFADEKIVLITEREIYHRRVKRKIRRSNISNAE   480
             L +    N IV +ESQ+++G +S+GFYFADEK+ LITE EIYH+++KR+ RRSNISNAE
Sbjct:   421 FRLPLVSANQIVSRESQIVIGAISSGFYFADEKLALITEHEIYHKKIKRRARRSNISNAE   480

Query:   481 RLKDYNELSVGDYVVENVHGVGKFLGIETIEIQGIHRDYLTIQYQNADRISIPVEQIELL   540
             RLKDYNEL+VGDYVVENVHG+G+FLGIETI+IQGIHRDY+TIQYQN+DRIS+P++QI  L
Sbjct:   481 RLKDYNELAVGDYVVENVHGIGRFLGIETIQIQGIHRUYVTIQYQNSDRISLPIDQISSL   540

Query:   541 TKYVSADGKEPKINTLNDGRFKKAKQRVAKQVEDIADDLLKLYAERSQLQGFAFSPDDNM   600
             +KYVSADGKEPKIN LNDGRF+K KQ+VA+QVEDIADDLLKLYAERSQ +GF+FSPDD++
Sbjct:   541 SKYVSADGKEPKINKLNDGRFQKTKQKVARQVEDIADDLLKLYAERSQQKGFSFSPDDDL   600

Query:   601 QNDFDNDFAYVETEDQLRSIKEIKQDMEGNRPMDRLLVGDVGFGKTEVAMRAAFKAVNDH   660
             Q  FD+DFA+VETEDQLRSIKEIK DME   +PMDRLLVGDVGFGKTEVAMRAAFKAVNDH
Sbjct:   601 QRAFDDDFAFVETEDQLRSIKEIKADMESMQPMDRLLVGDVGFGKTEVAMRAAFKAVNDH   660

Query:   661 KQVVVLVPTTVLAQQHFENFKERFSNYPVTVDVLSRFRSKKEQTDTLKRLSKGQVDIIIG   720
             KQV VLVPTTVLAQQH+ENFK RF NYPV VDVLSRFRSKKEQ +TL+R+ KGQ+DIIIG
Sbjct:   661 KQVAVLVPITVLAQQHYENFKARFENYPVEVDVLSRERSKKEQAETLERVRKGQIDIIIG   720

Query:   721 THRLLSQDVVFSDLGLIVIDEEQRFGVKHKEKLKELKTKVDVLTLTATPIPRTLHMSMLG   780
             THRLLS+DVVFSDLGLIVIDEEQRFGVKHKE LKELKTKVDVLTLTATPIPRTLHMSMLG
Sbjct:   721 THRLLSKDVVFSDLGLIVIDEEQRFGVKHKETLKELKTKVDVLTLTATPIPRTLHMSMLG   780

Query:   781 IRDLSVIETPPTNRYPVQTYVLETNPGLVREAIIREIDRGGQVFYVYNKVDTIDQKVSEL   840
             IRDLSVIETPPTNRYPVQTYVLE NPGLVREAIIRE+DRGGQ+FYVYNKVDTI++KV+EL
Sbjct:   781 IRDLSVIETPPTNRYPVQTYVLENNPGLVREAIIREMDRGGQIFYVYNKVDTIEKKVAEL   840

Query:   841 QELVPEASIGFVHGQMSEIQLENTLIDFINGDYDVLVATTIIETGVDISNVNTLFVENAD   900
             QELVPEASIGFVHGQMSEIQLENTLIDFINGDYDVLVATTIIETGVDISNVNTLF+ENAD
Sbjct:   841 QELVPEASIGFVHGQMSEIQLENTLIDFINGDYDVLVATTIIETGVDISNVNTLFIENAD   900

Query:   901 HMGLSTLYQLRGRVGRSNRIAYAYLMYRPDKVLTEISEKRLDAIKGFTELGSGFKIAMRD   960
             HMGLSTLYQLRGRVGRSNRIAYAYLMYRPDKVLTE+SEKRL+AIKGFTELGSGFKIAMRD
Sbjct:   901 HMGLSTLYQLRGRVGRSNRIAYAYLMYRPDKVLTEVSEKRLEAIKGFTELGSGFKIAMRD   960

Query:   961 LSIRGAGNILGASQSGFIDSVGFEMYSQLLEQAIATKQGKSLIRQKGNAELALQIDAYLP  1020
             LSIRGAGNILGASQSGFIDSVGFEMYSQLLEQAIA+KQGK+ +RQKGN E+ LQIDAYLP
Sbjct:   961 LSIRGAGNILGASQSGFIDSVGFEMYSQLLEQAIASKQGKTTVRQKGNTEINLQIDAYLP  1020
```

```
Query: 1021 AEYISDERQKIEIYKRIRELETRADYEALQDELIDREGEYPDQVAYLLEIGLLKAYLDLA    1080
             +YI+DERQKI+IYKRIRE+++R DY  LQDEL+DRFGEYPDQVAYLLEI LLK Y+D A
Sbjct: 1021 DDYIADERQKIDIYKRIREIQSREDYLNLQDELMDRFGEYPDQVAYLLEIALLKHYMDNA    1080

Query: 1081 FTELVERKGNEISILFEKASLKYFLTQDYFEALSKTQLKARISETNGKMEVVFNIKHKKN    1140
             F ELVERK N++ + FE  SL YFLTQDYFEALSKT LKA+ISE  GK+++VF+++H+K+
Sbjct: 1081 FAELVERKNNQVIVRFEVTSLTYFLTQDYFEALSKTHLKAKISEHQGKIDIVFDVRHQKD    1140

Query: 1141 YEIIEELLKFAECFIEIKSRK                                          1161
             Y I+EEL+ F E    EIK RK
Sbjct: 1141 YRILEELMLFGERLSEIKIRK                                          1161
```

Based on this analysis, it was predicted that these proteins and their epitopes could be useful antigens for vaccines or diagnostics.

Example 1659

A DNA sequence (GBSx1754) was identified in *S. agalactiae* <SEQ ID 5141> which encodes the amino acid sequence <SEQ ID 5142>. Analysis of this protein sequence reveals the following:

Possible site: 39
>>> Seems to have no N-terminal signal sequence
----- Final Results -----
   bacterial cytoplasm --- Certainty = 0.4347 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

A related DNA sequence was identified in *S. pyogenes* <SEQ ID 5143> which encodes the amino acid sequence <SEQ ID 5144>. Analysis of this protein sequence reveals the following:

Possible site: 27
>>> Seems to have no N-terminal signal sequence
----- Final Results -----
   bacterial cytoplasm --- Certainty = 0.2963 (Affirmative) <succ>
   bacterial membrane --- Certainty = 0.0000 (Not Clear) <succ>
   bacterial outside --- Certainty = 0.0000 (Not Clear) <succ>

```
>GP:CAB11835 GB:Z99104 similar to hypothetical proteins [Bacillus subtilis]
Identities = 50/84 (59%), Positives = 70/84 (82%)
Query:   1  MRLDKYLKVSRIIKRRPVAKEVADKGRVKVNGVLAKSSTDLKLNDQVEIRFGNKLLTVKV    60
            MRLDK+LKVSR+IKRR +AKEVAD+GR+ +NG  AK+S+D+K  D++ +RFG KL+TV+V
Sbjct:   1  MRLDKFLKVSRLIKRRTLAKEVADQGRISINGNQAKASSDVYPGDELTVRFGQKLVTVQV    60

Query:  61  LEMKDSTKKEDAIKMYEIINETRI                                        84
            E+KD+TKKE+A  MY I+ E ++
Sbjct:  61  NELKDTTKKEEAANMYTILKEEKL                                        84
```

An alignment of the GAS and GBS proteins is shown below.

```
            Identities = 72/90 (80%), Positives = 85/90 (94%)

Query:   1  MRLDKYLKVSRIIKRRPVAKEVADKGRVKVNGVLAKSSTDLKLNDQVEIRFGNKLLTVKV    60
                        MRLDKYLKVSR+IKRR VAKEVADKGR+KVNG+LAKSST++KLND +EI FGNKLLTV+V
            Sbjct:   9  MRLDKYLKVSRLIKRRSVAKEVADKGRIKVNGILAKSSTNIKLNDHIEISFGNKLLTVRV    68

Query:  61  LEMKDSTKKEDAIKMYEIINETRIETDEQA                                  90
                        +E+KDSTKKEDA+KMYEII+ETRI  +E+A
            Sbjct:  69  IEIKDSTKKEDALKMYEIISETRITLNEEA                                  98
```

Based on this analysis, it was predicted that these proteins and their epitopes could be useful antigens for vaccines or diagnostics.

Example 1660

A DNA sequence (GBSx1755) was identified in *S. agalactiae* <SEQ ID 5145> which encodes the amino acid sequence <SEQ ID 5146>. This protein is predicted to be DivIC homolog. Analysis of this protein sequence reveals the following:

```
Possible site: 50
>>> Seems to have no N-terminal signal sequence
INTEGRAL   Likelihood = -8.12   Transmembrane 34-50 (31-56)
----- Final Results -----
   bacterial membrane --- Certainty = 0.4248 (Affirmative) <succ>
   bacterial outside --- Certainty = 0.0000 (Not Clear) <succ>
      bacterial cytoplasm --- Certainty = 0.0000 (Not Clear) <succ>
```

The protein has homology with the following sequences in the GENPEPT database.

```
>GP:AAC98903 GB:AF023181 DivIC homolog [Listeria monocytogenes]
Identities = 36/119 (30%), Positives = 65/119 (54%), Gaps = 2/119 (1%)
Query:   2   SKPNVVQLNNQYINDE-NLKKRYEAEELRRKNRLMGWVLIFVMLLFILPTYNLVKSYRTL   60
             +K  V ++ N+YI D  +KK        +     RL    +IF ++  +L T     K    TL
Sbjct:   4   AKSKVARIENRYIKDTATMKKTRSRRRIALFRRLAFMAIIFAVVGGLL-TITYTKQVLTL   62

Query:  61   QERRQEVVKLTKDYQTLTNRTENQKLLAKQLKNPDYVQKYARAKYYFSKTGEMIYPLPD    119
             +E++++ V++ K      + +  ++      K+L N DY+ K AR++YY SK GE+I+ +P+
Sbjct:  63   KEKKEKQVQVDKKMVAMKDEQDSLNEQIKKLHNDDYIAKLARSEYYLSKDGEIIFNIPE    121
```

A related DNA sequence was identified in *S. pyogenes* <SEQ ID 5147> which encodes the amino acid sequence <SEQ ID 5148>. Analysis of this protein sequence reveals the following:

```
Possible site: 50
>>> Seems to have no N-terminal signal sequence
INTEGRAL   Likelihood = -3.93   Transmembrane 34-50 (32-51)
----- Final Results -----
   bacterial membrane --- Certainty = 0.2572 (Affirmative) <succ>
   bacterial outside --- Certainty = 0.0000 (Not Clear) <succ>
      bacterial cytoplasm --- Certainty = 0.0000 (Not Clear) <succ>
```

The protein has homology with the following sequences in the databases:

```
>GP:AAC98903 GB:AF023181 DivIC homolog [Listeria monocytogenes]
Identities = 27/116 (23%), Positives = 59/116 (50%)
Query:   3   KPSIVQLNNHYIKKENLKKKFEEEESQKRNRFMGWILVSMMFLFILPTYNLVKSYVDFEK   62
             K  + ++ N YIK       KK          R + ++ +     + L T      K  + ++
Sbjct:   5   KSKVARIENRYIKDTATMKKTRSRRRIALFRRLAFMAIIFAVVGGLLTITYTKQVLTKE   64

Query:  63   QNQQVVKLKKEYNELSESTKKEKQLAERLKDDNFVKKYARAKYYLSREGEMIYPIP     118
             +  ++ V++ K+   + +        +  ++L +D+++ K AR++YYLS++GE+I+  IP
Sbjct:  65   KKEKQVQVDKKMVAMKDEQDSLNEQIKKLHNDDYIAKLARSEYYLSKDGEIIFNIP     120
```

An alignment of the GAS and GBS proteins is shown below.

```
Identities = 73/123 (59%), Positives = 99/123 (80%)
Query:   1   MSKPNVVQLNNQYINDENLKKRYEAEEELRRKNRLMGWVLIFVMLLFILPTYNLVKSYRTL   60
             M KP++VQLNN YI   ENLKK++E EE +++NR MGW+L+  +M LFILPTYNLVKSY
```

```
                                    -continued
Sbjct:    1  MKKPSIVQLNNHYIKKENLKKKFEEEESQKRNRFMGWILVSMMFLFILPTYNLVKSYVDF    60

Query:   61  QERRQEVVKLTKDYQTLTNRTENQKLLAKQLKNPDVQKYARAKYYFSKTGEMIYPLPDL   120
             +++ Q+VVKL K+Y  L+   T+ +K LA++LK+ ++V+KYARAKYY S+ GEMIYP+P L
Sbjct:   61  EKQNQQVVKLKKEYNELSESTKKEKQLAERLKDDNFVKKYARAKYYLSREGEMIYPIPGL   120

Query:  121  LPK                                                            123
             LPK
Sbjct:  121  LPK                                                            123
```

SEQ ID 5146 (GBS418) was expressed in *E. coli* as a GST-fusion product. SDS-PAGE analysis of total cell extract is shown in FIG. 172 (lane 3; MW 42 kDa).

GBS418-GST was purified as shown in FIG. 219, lane 4-5.

Based on this analysis, it was predicted that these proteins and their epitopes could be useful antigens for vaccines or diagnostics.

Example 1661

A DNA sequence (GBSx1756) was identified in *S. agalactiae* <SEQ ID 5149> which encodes the amino acid sequence <SEQ ID 5150>. Analysis of this protein sequence reveals the following:

---
Possible site: 15
>>> Seems to have no N-terminal signal sequence
----- Final Results -----
    bacterial cytoplasm --- Certainty = 0.4355 (Affirmative) <succ>
    bacterial membrane --- Certainty = 0.0000 (Not Clear) <succ>
    bacterial outside --- Certainty = 0.0000 (Not Clear) <succ>
---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1662

A DNA sequence (GBSx1757) was identified in *S. agalactiae* <SEQ ID 5151> which encodes the amino acid sequence <SEQ ID 5152>. Analysis of this protein sequence reveals the following:

---
Possible site: 21
>>> Seems to have an uncleavable N-term signal seq
INTEGRAL   Likelihood = –5.52   Transmembrane 4-20 (3-22)
----- Final Results -----
    bacterial membrane --- Certainty = 0.3208 (Affirmative) <succ>
    bacterial outside --- Certainty = 0.0000 (Not Clear) <succ>
    bacterial cytoplasm --- Certainty = 0.0000 (Not Clear) <succ>
---

The protein has no significant homology with any sequences in the GENPEPT database.

A related DNA sequence was identified in *S. pyogenes* <SEQ ID 5153> which encodes the amino acid sequence <SEQ ID 5154>. Analysis of this protein sequence reveals the following:

---
Possible site: 21
>>> Seems to have a cleavable N-term signal seq.
----- Final Results -----
    bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>
---

The protein has no significant homology with any sequences in the GENPEPT database.

An alignment of the GAS and GBS proteins is shown below.

```
Identities = 205/428 (47%), Positives = 285/428 (65%)
Query:    1  MKKVLTFLLCSLYFVSIPAISTEEPLTLSQNRRYALTQTVVDKEMYFDAIPERPTTKIEI    60
             M+K+L  +L + +   +P ISTE+ L  S+N  Y L Q VV     +++ IP  P    E
Sbjct:    1  MRKLLAAMLMTFFLTPLPVISTEKKLIFSKNAVYQLKQDVVQSTQFYNQIPSNPNLYQET    60

Query:   61  SSFQDEALTITGETLVPNTLLSIVSLTINSNGIPVFTLSNGQFIKASREAIFNDLVSKQQ   120
             +++D  LT+     L  N   L I SL +N    +PVF L++G +++A+R+ I++D+V  Q
Sbjct:   61  CAYKDSDLTLPAGRLGVNQPLLIKSLVLNKESLPVFELADGTYVEANRQLIYDDIVLNQV   120

Query:  121  SVSLDYWLKPSFVTYEAPYTNGVSEVKNNLKPYSRVHLVEQAETEHGIYYKTDSGFWISV   180
             +    +W +       Y APY   G   + ++      +VH  + A+T HG YY   D    W S
Sbjct:  121  DIDSYFWTQKKLRLYSAPYVLGTQTIPSSFLFAQKVHATQMAQTNHGTYYLIDDKGWASQ   180

Query:  181  EDLSVADNRMAKVQEVLLEKYNKDKYGIYIKQLNTQTVAGINIDRSMYSASIAKLATLYA   240
             EDL   DNRM KVQE+LL+KYN    Y  I++KQLNTQT AGIN D+  MY+ASI+KLA LY
Sbjct:  181  EDLVQFDNRMLKVQEMLLQKYNNPNYSIFVKQLNTQTSAGINADKKMYAASISKLAPLYI   240

Query:  241  SQEQVKLGKLSLDSKFEYKDNVNQFPNSYDPSGSGKLEKKADHKLYTVKELLEATAKESD   300
             +Q+Q++   KL+ +      Y  +VN F    YDP GSGK+ K  AD+K Y V++LL+A A++SD
Sbjct:  241  VQKQLQKKKLAENKTLTYTKDVNHFYGDYDPLGSGKISKIADNKDYRVEDLLKAVAQQSD   300
```

-continued
```
Query: 301 NVATNMLGYYVNNQYDSMFQTQVDTISGMHWDMKKRQISPQAAGKMMEAIYYQNGDIVNY 360
            NVATN+LGYY+ +QYD  F++++   +SG+ WDM++R ++ ++A  MMEAIY+Q G I++Y
Sbjct: 301 NVATNILGYYLCHQYDKAFRSEIKALSGIDWDMEQRLLTSRSAANMMEAIYHQKGQIISY 360

Query: 361 LSKTDFDNTRIPKNIPVKVAHKIGDAYDYKHDAAIVYAEQPFIMIIFTDKSSYDDITKIA 420
            LS T+FD  RI KNI V VAHKIGDAYDYKHD AIVY   PFI+ IFT+KS+Y+DIT IA
Sbjct: 361 LSNTEFDQQRITKNITVPVAHKIGDAYDYKHDVAIVYGNTPFILSIFTNKSTYEDITAIA 420

Query: 421 DDVYQVLK 428
            DDVY +LK
Sbjct: 421 DDVYGILK 428
```

Figure 316:
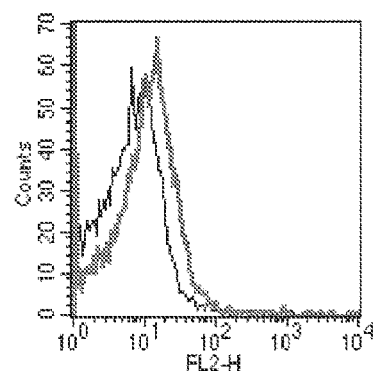

SEQ ID 5152 (GBS116) was expressed in *E. coli* as a His-fusion product. SDS-PAGE analysis of total cell extract is shown in FIG. 38 (lane 3; MW 48.5 kDa). The GBS116-His fusion product was purified (FIG. 202, lane 6) and used to immunise mice. The resulting antiserum was used for FACS (FIG. 316), which confirmed that the protein is immunoaccessible on GBS bacteria.

Based on this analysis, it was predicted that these proteins and their epitopes could be useful antigens for vaccines or diagnostics.

Example 1663

A DNA sequence (GBSx1758) was identified in *S. agalactiae* <SEQ ID 5155> which encodes the amino acid sequence <SEQ ID 5156>. Analysis of this protein sequence reveals the following:

Possible site: 28
>>> Seems to have no N-terminal signal sequence
----- Final Results -----
   bacterial cytoplasm --- Certainty = 0.2260 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

A related DNA sequence was identified in *S. pyogenes* <SEQ ID 5157> which encodes the amino acid sequence <SEQ ID 5158>. Analysis of this protein sequence reveals the following:

Possible site: 33
>>> Seems to have no N-terminal signal sequence
----- Final Results -----
   bacterial cytoplasm --- Certainty = 0.2187 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
>GP:AAD35664 GB:AE001733 conserved hypothetical protein [Thermotoga maritima]
Identities = 100/404 (24%), Positives = 181/404 (44%), Gaps = 61/404 (15%)
Query:  19 QKVLIAVSGGIDSINLLQFLYQYQKELSISIGIAHINHGQRKESEKEEEYIRQWGQIHDV  78
           + VL+AVSGGIDS+ LL  L ++    L I I  AH++H  R+ S ++ E++ +  +  ++
Sbjct:   6 EHVLVAVSGGIDSMTLLYVLRKFSPLLKIKITAAHLDHRIRESSRRDREFVERICRQWNI  65

Query:  79 PVFISYF--------QGIFSEDRARNHRYNFFSKVMREEGYTALVTAHHADDQAETVFMR 130
           PV  S          G    E+ AR  RY+F  +   ++G + +   AHH +D  ETV R
Sbjct:  66 PVETSEVDVPSLWKDSGKTLEEIAREVRYDFLKRTAKKVGASKIALAHHKNDLLETVVHR 125

Query: 131 ILRGSRLRYLSGIKQVSAFANGQLIRPFLPYKKELLP------NIFHFEDASNASSDYLR 184
           ++RG+    L+ I       +   IRPFL +K+ +        N+ + D +N +   Y R
Sbjct: 126 LIRGTPLGLACISP----KREEFIRPFLVFKRSEIEEYARKNNVPYVVDETNYNVKYTR 181

Query: 185 NRIRNVYFPALERENNQLKDSLITLSEETECLFTALTDLTRSIEVTNCYDF--------- 235
           N IR+  P ++ N ++D++  L  T  L    +    N Y +
Sbjct: 182 NFIRHRIVPLMKELNPTVEDAVYRLVSVTHLLRNFVERTVQDFVERNVYFYKDYAVFVEP 241

Query: 236 --LRQTHSVQEFLLQDYISKFPDLQVSKEQFRVILKLIRTKANIDYTIKSGYFLHKDYES 293
              L   V  ++L++   + P+ +            KLI T   +  SG F+ + +
Sbjct: 242 EDLFLFLEVTRWVLKEMYGRVPEYE----------KLIGTLKSKRVELWSGIFVERSFGY 291

Query: 294 FHITKIHPKTDSFKVEKRLELHNIQIFSQYLFSYGKFISQADITIPIYDT---SPIILRR 350
           + K      FK + R+E+        G +       I + +               +R
Sbjct: 292 VAVGK-----TVFKKKYRVEVK------------GDMLEMEGFKIRVVNNRNDMKFWVRN 334

Query: 351 RKEGDRIFLGNHTKKIRRLFIDEKIT--LKEREEAVIGEQNKEL                392
           RKEGDRI +   +K++ +FI++K+    ++R ++ E+++ L
Sbjct: 335 RKEGDRIIVNGRERKLKDVFIEKKVPTFYRDRVPLLVDEEDRVL                378
```

```
Identities = 218/424 (51%), Positives = 290/424 (67%), Gaps = 2/424 (0%)
Query:   2 YNTILKDTLSKGLFTAHQKVLIAVSGGIDSINLLQFLYQYQKELSISIGIAHINHGQRKE  61
            Y I  +  +K  F  H+ VLIAVSGG+DS+NLL FLY +Q +L I IGIAH+NH QR E
Sbjct:   4 YQEIFNEIKNKAYFKNHRHVLIAVSGGVDSMNLLHFLYLFQDKLKIRIGIAHVNHKQRSE  63

Query:  62 SEKEEEYIRQWGQIHDVPVFISYFQGIFSEDRARNHRYNFFSKVMREEGYTALVTAHHAD  121
            S+ EE Y++ W + HD+P+++S F+GIFSE  AR+ RY FF  +M +  Y+ALVTAHH+D
Sbjct:  64 SDSEEAYLKCWAKKHDIPIYVSNFEGIFSEKAARDWRYAFFKSIMLKNNYSALVTAHHSD  123

Query: 122 DQAETVFMRILRGSRLRYLSGIKQVSAFANGQLIRPFLPYKKELLPNIFHFEDASNASSD  181
            DQAET+  MR++RGSRLR+LSGIK V   FANGQLIRPFL + K+ LP IFHFED+SN
Sbjct: 124 DQAETILMLRLIRGSRLRHLSGIKSVQPFANGQLIRPFLTFSKKDLPEIFHFEDSSNRELS  183

Query: 182 YLRNRIRNVYFPALERENNQLKDSLITLSEETECLFTALTDLTRSIEVTNCYDFLRQTHS  241
            +LRNR+RN Y P L++EN +     L  L+ E   LF A  +LT  I  T+  +F Q+ S
Sbjct: 184 FLRNRVRNNYLPLLKQENPRFIQGLNQLALENSLLFQAFKELTNHITTTDLTEFNEQSKS  243

Query: 242 VQEFLLQDYISKFPDLQVSKEQFRVILKLIRTKANIDYTIKSGYFLHKDYESFHITKIHP  301
            +Q FLLQDY+  FPDL + K QF  +L++I+T    Y +K Y++  D  SF ITKI P
Sbjct: 244 IQYFLLQDYLEGFPDLDLKKSQFTQLLQIIQTAKQGYYYLKKDYYIFIDKFSFKITKIVP  303

Query: 302 KTDSFKVEKRLELHNIQIFSQYLFSY--GKFISQADITIPIYDTSPIILRRRKEGDRIFL  359
            KT+  K EK LE +   +  Y FS+          Q  ++IP++   S I LR R+ GD I
Sbjct: 304 KTELVKEEKMLEYDSNLCYRDYYFSFMPKSNEDQGQVSIPLFSLSSIKLRSRQSGDYISF  363

Query: 360 GNHTKKIRRLFIDEKITLKEREEAVIGEQNKELIFVIVAGRTYLRKPSEHDIMKGKLYIE  419
            G+ +KKIRRLFIDEK T+ ER+ A+IGEQ++++IFV++   +TYLRK  +HDIM  KLYI+
Sbjct: 364 GHFSKKIRRLFIDEKFTIAERQNAIIGEQDEQIIFVLIGNKTYLRKACKHDIMLAKLYID  423

Query: 420 NLEK                                                         423
            LEK
Sbjct: 424 KLEK                                                         427
```

Based on this analysis, it was predicted that these proteins and their epitopes could be useful antigens for vaccines or diagnostics.

Example 1664

A DNA sequence (GBSx1759) was identified in *S. agalactiae* <SEQ ID 5159> which encodes the amino acid sequence <SEQ ID 5160>. This protein is predicted to be hypoxanthine-guanine phosphoribosyltransferase (hpt). Analysis of this protein sequence reveals the following:

Possible site: 50
>>> Seems to have no N-terminal signal sequence
INTEGRAL   Likelihood = −0.32   Transmembrane 37-53 (37-53)
----- Final Results -----
  bacterial membrane--- Certainty = 0.1128 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

A related DNA sequence was identified in *S. pyogenes* <SEQ ID 5161> which encodes the amino acid sequence <SEQ ID 5162>. Analysis of this protein sequence reveals the following:

Possible site: 52
>>> Seems to have no N-terminal signal sequence
----- Final Results -----
  bacterial cytoplasm --- Certainty = 0.4095 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

```
>GP:CAA48876 GB:X69123 hypoxanthine guanine
phosphoribosyltransferase [Lactococcus lactis]
Identities = 121/179 (67%), Positives = 152/179 (84%), Gaps = 1/179 (0%)
Query:   2 LENDIKKVLYSEEDIILKTKELGAKLTADYAGKNPLLVGVLKGSVPFMAELLKHIDTHVE  61
            L+  I+KVL SEE+II K+KELG  LT +Y GKNPL++G+L+GSVPF+AEL+KHID H+E
Sbjct:   6 LDKAIEKVLVSEEEIIEKSKELGEILTKEYEGKNPLVLGILRGSVPFLAELIKHIDCHLE  65

Query:  62 IDFMVVSSYHGGTTSSGEVKILKDVDTNIEGRDVIFIEDIIDTGRTLKYLRDMFKYRQAN  121
             DFM VSSYHGGT SSGEVK++ DVDT ++GRD++ +EDIIDTGRTLKYL+++  ++R AN
Sbjct:  66 TDFMTVSSYHGGTKSSGEVKLILDVDTAVKGRDILIVEDIIDTGRTLKYLKELLEHRGAN  125

Query: 122 SVKVATLFDKPEGRLVDIDADYVCYDIPNEFIVGFGLDYAENYRNLPYVGVLKEEIYSK  180
            VK+  TL DKPEGR+V+I  DY +   IPNEF+VGFGLDY ENYRNLPYVGVLK E+Y K
Sbjct: 126 -VKIVTLLDKPEGRIVEIKPDYSGFTIPNEFVVGFGLDYEENYRNLPYVGVLKPEVYNK  183
```

```
Identities = 153/180 (85%), Positives = 171/180 (95%)
Query:   1  MLENDIKKVLYSEEDIILKTKELGAKLTADYAGKNPLLVGVLKGSVPFMAELLKHIDTHV    60
            MLE DI+K+LYSE DII KTK+LG +LT DY  KNPL++GVLKGSVPFMAEL+KHIDTHV
Sbjct:   1  MLEQDIQKILYSENDIIRKTKKLGEQLTKDYQEKNPLMIGVLKGSVPFMAELMKHIDTHV    60

Query:  61  EIDFMVVSSYHGGTTSSGEVKILKDVDTNIEGRDVIFIEDIIDTGRTLKYLRDMFKYRQA   120
            EIDFMVVSSYHGGT+SSGEVKILKDVDTNIEGRD+I +EDIIDTGRTLKYLRDMFKYR+A
Sbjct:  61  EIDFMVVSSYHGGTSSSGEVKILKDVDTNIEGRDIIIVEDIIDTGRTLKYLRDMFKYRKA   120

Query: 121  NSVKVATLFDKPEGRLVDIDADYVCYDIPNEFIVGFGLDYAENYRNLPYVGVLKEEIYSK   180
            N++K+ATLFDKPEGR+V I+ADYVCY+IPNEFIVGFGLDYAENYRNLPYVGVLKEE+YSK
Sbjct: 121  NTIKIATLFDKPEGRVVKIEADYVCYNIPNEFIVGFGLDYAENYRNLPYVGVLKEEVYSK   180
```

Based on this analysis, it was predicted that these proteins and their epitopes could be useful antigens for vaccines or diagnostics.

Example 1665

A DNA sequence (GBSx1760) was identified in *S. agalactiae* <SEQ ID 5163> which encodes the amino acid sequence <SEQ ID 5164>. This protein is predicted to be cell division protein FtsH (ftsH). Analysis of this protein sequence reveals the following:

```
Possible site: 25
>>> Seems to have an uncleavable N-term signal seq
INTEGRAL    Likelihood = −7.11    Transmembrane 139-155 (133-158)
INTEGRAL    Likelihood = −4.62    Transmembrane 8-24 (7- 31)
----- Final Results ----
   bacterial membrane ---Certainty = 0.3845 (Affirmative) <succ>
   bacterial outside --- Certainty = 0.0000 (Not Clear) <succ>
   bacterial cytoplasm ---Certainty = 0.0000 (Not Clear) <succ>
```

The protein has homology with the following sequences in the GENPEPT database.

```
>GP:AAC16243 GB:AF061748 cell division protein FtsH [Streptococcus
pneumoniae] (ver 2)
Identities = 490/652 (75%), Positives = 561/652 (85%), Gaps = 5/652 (0%)
Query:   5  KNNGFLKNSFIYILLIIAVITTFQYYLKGTSSQ-NQQISYTKLVKQLKAGEIKSISYQPS    63
            +NNG +KN F+++L I  ++T FQY+  G +S  +QQI+YT+LV+++  G +K ++YQP+
Sbjct:   4  QNNGLIKNPFLWLLFIFFLVTGFQYFYSGNNSGGSQQINYTELVQEITDGNVKELTYQPN    63

Query:  64  GGVVEVSGTYKKAKTIKSANSFTFLGGSVATKVTGFNSVILPNDSSIKSLVSAAEENNTN   123
            G V+EVSG YK  KT K     F   SV TKV F S ILP D+++  L   A ++
Sbjct:  64  GSVIEVSGVYKNPKTSKEGTGIQFFTPSV-TKVEKFTSTILPADTTVSELQKLATDHKAE   122

Query: 124  IQVKHESSSGTWISYIASFLPLVIMIGFFMMMMNQGGGGGARGAMSFGKNKARSSSKDEV   183
            + VKHESSSG WI+ + S +P  I+  F    MM   GGG R  MSFG++KA++++K+++
Sbjct: 123  VTVKHESSSGIWINLLVSIVPFGILFFFLFSMMGNMGGGNGRNPMSFGRSKAKAANKEDI   182

Query: 184  KVRFSDVAGAEEEKQELIEVVDFLKDPKRYKSLGARIPAGVLLEGPPGTGKTLLAKAVAG   243
            KVRFSDVAGAEEEKQEL+EVV+FLKDPKR+  LGARIPAGVLLEGPPGTGKTLLAKAVAG
Sbjct: 183  KVRFSDVAGAEEEKQELVEVVEFLKDPKRFTKLGARIPAGVLLEGPPGTGKTLLAKAVAG   242

Query: 244  EAGVPFFSISGSDFVEMFVGVGASRVRSLFEDAKKAERAIIFIDEIDAVGRRRGAGMGGG   303
            EAGVPFFSISGSDFVEMFVGVGASRVRSLFEDAKKA  AIIFIDEIDAVGR+RG G+GGG
Sbjct: 243  EAGVPFFSISGSDFVEMFVGVGASRVRSLFEDAKKAAPAIIFIDEIDAVGRQRGVGLGGG   302

Query: 304  NDEREQTLNQLLIEMDGFEGNESIIVIAATNRSDVLDPALLRPGRFDRKVLGQPDVKGR   363
            NDEREQTLNQLLIEMDGFEGNE IIVIAATNRSDVLDPALLRPGRFDRKVLG+PDVKGR
Sbjct: 303  NDEREQTLNQLLIEMDGFEGNEGIIVIAATNRSDVLDPALLRPGRFDRKVLGRPDVKGR   362

Query: 364  EAILRVHAKNKPLADNVDLKVVAQQTPGFVGADLENVLNEAALVAARRNKKVIDASDIDE   423
            EAIL+VHAKNKPLA++VDLK+VAQQTPGFVGADLENVLNEAALVAARRNK +IDASDIDE
Sbjct: 363  EAILKVHAKNKPLAEDVDLKLVAQQTPGFVGADLENVLNEAALVAARRNKSIIDASDIDE   422

Query: 424  AEDRVIAGPSKKDRTISERERAMVAYHEAGHTIVGLILSNARVVHKVTIVPRGRAGGYMI   483
            AEDRVIAGPSKKD+T+S++ER +VAYHEAGHTIVGL+LSNARVVHKVTIVPRGRAGGYMI
Sbjct: 423  AEDRVIAGPSKKDKTVSQKERELVAYHEAGHTIVGLVLSNARVVHKVTIVPRGRAGGYMI   482

Query: 484  ALPKEDQMLLSKDDMKEQLAGLMGGRVAEEIIFNAQTTGASNDFEQATAMARAMVTEYGM   543
            ALPKEDQMLLSK+DMKEQLAGLMGGRVAEEIIFN QTTGASNDFEQAT MARAMVTEYGM
Sbjct: 483  ALPKEDQMLLSKEDMKEQLAGLMGGRVAEEIIFNVQTTGASNDFEQATQMARAMVTEYGM   542

Query: 544  SEKLGPVQYEGNHAMMAGQMSPEKSYSAQTAQLIDDEVRHLLNEARNKAADIINENRDTH   603
            SEKLGPVQYEGNHAM+ G  SP+KS S QTA  ID+EVR LLNEARNKAA+II  NR+TH
Sbjct: 543  SEKLGPVQYEGNHAML-GAQSPQKSISEQTAYEIDEEVRSLLNEARNKAAEIIQSNRETH   601

Query: 604  KLIAEALLKYETLDAAQIKSIFETGKMPETENDEDKARALSYDEIKEKMQEE           655
            KLIAEALLKYETLD+ QIK+++ETGKMPE    E+++ ALSYDE+K KM +E
Sbjct: 602  KLIAEALLKYETLDSTQIKALYETGKMPEAV--EEESHALSYDEVKSKMNDE           651
```

A related DNA sequence was identified in *S. pyogenes* <SEQ ID 5165> which encodes the amino acid sequence <SEQ ID 5166>. Analysis of this protein sequence reveals the following:

```
Possible site: 38
>>> Seems to have a cleavable N-term signal seq.
INTEGRAL      Likelihood = -7.38   Transmembrane 138-154 (132-158)
----- Final Results -----
   bacterial membrane --- Certainty = 0.3951 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP:AAC16243 GB:AF061748 cell division protein FtsH [Streptococcus
pneumoniae] (ver 2)
Identities = 487/654 (74%), Positives = 565/654 (85%), Gaps = 7/654 (1%)
Query:    5 KNNGFVKNSFIYILMIIVVITGFQFYLKGTSTQ-SQQISYSKLIKHLKAGDIKSLSYQPS    63
            +NNG +KN F+++L I  ++TGFQ++  G ++   SQQI+Y++L++ +   G++K L+YQP+
Sbjct:    4 QNNGLIKNPFLWLLFIFFLVTGFQYFYSGNNSGGSQQINYTELVQEITDGNVKELTYQPN    63

Query:   64 GSIIEVKGKYEKPQKVTVNSGLSFLGGRASTQVTEFSSLVLPSDTILKEMTAAADKNGTE   123
            GS+IEV G Y+ P+     +G+ F       T+V +F+S +LP+DT + E+    A + E
Sbjct:   64 GSVIEVSGVYKNPKTSKEGTGIQFFTPSV-TKVEKFTSTILPADTTVSELQKLATDHKAE   122

Query:  124 LTVKQESSSGTWITFLMSFLPIVIFAAFMMMMM-NQGGGGARGAMSFGKNKAKSQSKGNV   182
            +TVK ESSSG WI  L+S +P  I    F+  MM N GGG  R  MSFG++KAK+ +K ++
Sbjct:  123 VTVKHESSSGIWINLLVSIVPFGILFFFLFSMMGNMGGGNGRNPMSFGRSKAKAANKEDI   182

Query:  183 KVRFTDVAGAEEEKQELVEVVDFLKNPKKYKSLGARIPAGVLLEGPPGTGKTLLAKAVAG   242
            KVRF+DVAGAEEEKQELVEVV+FLK+PK++   LGARIPAGVLLEGPPGTGKTLLAKAVAG
Sbjct:  183 KVRFSDVAGAEEEKQELVEVVEFLKDPKRFTKLGARIPAGVLLEGPPGTGKTLLAKAVAG   242

Query:  243 EAGVPFFSISGSDFVEMFVGVGASRVRSLFEDAKKAERAIIFIDEIDAVGRRRGAGMGGG   302
            EAGVPFFSISGSDFVEMFVGVGASRVRSLFEDAKKA  AIIFIDEIDAVGR+RG G+GGG
Sbjct:  243 EAGVPFFSISGSDFVEMFVGVGASRVRSLFEDAKKAAPAIIFIDEIDAVGRQRGVGLGGG   302

Query:  303 NDEREQTLNQLLIEMDGFEGNENIIVIAATNRSDVLDPALLRPGRFDRKVLVGRPDVKGR   362
            NDEREQTLNQLLIEMDGFEGNE  IVIAATNRSDVLDPALLRPGRFDRKVLVGRPDVKGR
Sbjct:  303 NDEREQTLNQLLIEMDGFEGNEGIIVIAATNRSDVLDPALLRPGRFDRKVLVGRPDVKGR   362

Query:  363 EAILRVHAKNKPLANDVNLKVVAQQTPGFVGADLENVLNEAALVAARRNKIKIDASDIDE   422
            EAIL+VHAKNKPLA DV+LK+VAQQTPGFVGADLENVLNEAALVAARRNK  IDASDIDE
Sbjct:  363 EAILKVHAKNKPLAEDVDLKLVAQQTPGFVGADLENVLNEAALVAARRNKSIIDASDIDE   422

Query:  423 AEDRVIAGPSKKDRTISQKEREMVAYHEAGHTIVGLVLSNARVVHKVTIVPRGRAGGYMI   482
            AEDRVIAGPSKKD+T+SQKERE+VAYHEAGHTIVGLVLSNARVVHKVTIVPRGRAGGYMI
Sbjct:  423 AEDRVIAGPSKKDKTVSQKERELVAYHEAGHTIVGLVLSNARVVHKVTIVPRGRAGGYMI   482

Query:  483 ALPKEDQMLLSKEDLKEQLAGLMGGRVAEEIVFNAQTSGASNDFEQATQIARAMVTEYGM   542
            ALPKEDQMLLSKED+KEQLAGLMGGRVAEEI+FN QT+GASNDFEQATQ+ARAMVTEYGM
Sbjct:  483 ALPKEDQMLLSKEDMKEQLAGLMGGRVAEEIIFNVQTTGASNDFEQATQMARAMVTEYGM   542

Query:  543 SEKLGPVQYEGNHAMMPGQISPEKAYSAQTAQMIDDEVRELLNQARNQAADIINENRDTH   602
            SEKLGPVQYEGNHAM+   Q SP+K+ S QTA   ID+EVR LLN+ARN+AA+II   NR+TH
Sbjct:  543 SEKLGPVQYEGNHAMLGAQ-SPQKSISEQTAYEIDEEVRSLLNEARNKAAEIIQSNRETH   601

Query:  603 KLIAEALLKYETLDAAQIKSIYETGKMPVDLETDDNEAHALSYDEIKNKMTESE         656
            KLIAEALLKYETLD+ QIK++YETGKMP    E  + E+HALSYDE+K+KM + +
Sbjct:  602 KLIAEALLKYETLDSTQIKALYETGKMP---EAVEEESHALSYDEVKSKMNDEK         652
```

An alignment of the GAS and GBS proteins is shown below.

```
Identities = 550/657 (83%), Positives = 612/657 (92%), Gaps = 2/657 (0%)
Query:    1 MKNNKNNGFLKNSFIYILLIIAVITTFQYYLKGTSSQNQQISYTKLVKQLKAGEIKSISY    60
            MKNNKNNGF+KNSFIYIL+II VIT FQ+YLKGTS+Q+QQISY+KL+K LKAG+IKS+SY
Sbjct:    1 MKNNKNNGFVKNSFIYILMIIVVITGFQFYLKGTSTQSQQISYSKLIKHLKAGDIKSLSY    60

Query:   61 QPSGGVVEVSGTYKKAKTIKSANSFTFLGGSVATKVTGFNSVILPNDSSIKSLVSAAEEN   120
            QPSG ++EV G Y+K + +    + +FLGG +T+VT F+S++LP+D+ +K +  +AA++N
```

-continued

```
Sbjct:  61 QPSGSIIEVKGKYEKPQKVTVNSGLSFLGGRASTQVTEFSSLVLPSDTILKEMTAAADKN 120

Query: 121 NTNIQVKHESSSGTWISYIASFLPLVIMIGFFMMMMNQGGGGGARGAMSFGKNKARSSSK 180
              T + VK ESSSGTWI+++ SFLP+VI   F MMMMNQGGGG ARGAMSFGKNKA+S SK
Sbjct: 121 GTELTVKQESSSGTWITFLMSFLPIVIFAAFMMMMNQGGGG-ARGAMSFGKNKAKSQSK 179

Query: 181 DEVKVRFSDVAGAEEEKQELIEVVDFLKDPKRYKSLGARIPAGVLLEGPPGTGKTLLAKA 240
              VKVRF+DVAGAEEEKQEL+EVVDFLK+PK+YKSLGARIPAGVLLEGPPGTGKTLLAKA
Sbjct: 180 GNVKVRFTDVAGAEEEKQELVEVVDFLKNPKKYKSLGARIPAGVLLEGPPGTGKTLLAKA 239

Query: 241 VAGEAGVPFFSISGSDFVEMFVGVGASRVRSLFEDAKKAERAIIFIDEIDAVGRRRGAGM 300
              VAGEAGVPFFSISGSDFVEMFVGVGASRVRSLFEDAKKAERAIIFIDEIDAVGRRRGAGM
Sbjct: 240 VAGEAGVPFFSISGSDFVEMFVGVGASRVRSLFEDAKKAERAIIFIDEIDAVGRRRGAGM 299

Query: 301 GGGNDEREQTLNQLLIEMDGFEGNESIIVIAATNRSDVLDPALLRPGRFDRKVLVGQPDV 360
              GGGNDEREQTLNQLLIEMDGFEGNE+IIVIAATNRSDVLDPALLRPGRFDRKVLVG+PDV
Sbjct: 300 GGGNDEREQTLNQLLIEMDGFEGNENIIVIAATNRSDVLDPALLRPGRFDRKVLVGRPDV 359

Query: 361 KGREAILRVHAKNKPLADNVDLKVVAQQTPGFVGADLENVLNEAALVAARRNKKVIDASD 420
              KGREAILRVHAKNKPLA++V+LKVVAQQTPGFVGADLENVLNEAALVAARRNK  IDASD
Sbjct: 360 KGREAILRVHAKNKPLANDVNLKVVAQQTPGFVGADLENVLNEAALVAARRNKIKIDASD 419

Query: 421 IDEAEDRVIAGPSKKDRTISERERAMVAYHEAGHTIVGLILSNARVVHKVTIVPRGRAGG 480
              IDEAEDRVIAGPSKKDRTIS++ER MVAYHEAGHTIVGL+LSNARVVHKVTIVPRGRAGG
Sbjct: 420 IDEAEDRVIAGPSKKDRTISQKEREMVAYHEAGHTIVGLVLSNARVVHKVTIVPRGRAGG 479

Query: 481 YMIALPKEDQMLLSKDDMKEQLAGLMGGRVAEEIIFNAQTTGASNDFEQATAMARAMVTE 540
              YMIALPKEDQMLLSK+D+KEQLAGLMGGRVAEEI+FNAQT+GASNDFEQAT +ARAMVTE
Sbjct: 480 YMIALPKEDQMLLSKEDLKEQLAGLMGGRVAEEIVFNAQTSGASNDFEQATQIARAMVTE 539

Query: 541 YGMSEKLGPVQYEGNHAMMAGQMSPEKSYSAQTAQLIDDEVRHLLNEARNKAADIINENR 600
              YGMSEKLGPVQYEGNHAMM GQ+SPEK+YSAQTAQ+IDDEVR LLN+ARN+AADIINENR
Sbjct: 540 YGMSEKLGPVQYEGNHAMMPGQISPEKAYSAQTAQMIDDEVRELLNQARNQAADIINENR 599

Query: 601 DTHKLIAEALLKYETLDAAQIKSIFETGKMP-ETENDEDKARALSYDEIKEKMQEED    656
              DTHKLIAEALLKYETLDAAQIKSI+ETGKMP + E D+++A ALSYDEIK KM E +
Sbjct: 600 DTHKLIAEALLKYETLDAAQIKSIYETGKMPVDLETDDNEAHALSYDEIKNKMTESE    656
```

SEQ ID 5164 (GBS115) was expressed in *E. coli* as a His-fusion product. SDS-PAGE analysis of total cell extract is shown in FIG. 35 (lane 8; MW 73 kDa) and in FIG. 39 (lane 3; MW 73.3 kDa).

Based on this analysis, it was predicted that these proteins and their epitopes could be useful antigens for vaccines or diagnostics.

Example 1666

A DNA sequence (GBSx1769) was identified in *S. agalactiae* <SEQ ID 5167> which encodes the amino acid sequence <SEQ ID 5168>. Analysis of this protein sequence reveals the following:

---
Possible site: 28
>>> Seems to have no N-terminal signal sequence
----- Final Results -----
  bacterial cytoplasm --- Certainty = 0.2983 (Affirmative) <succ>
    bacterial membrane --- Certainty = 0.0000 (Not Clear) <succ>
     bacterial outside --- Certainty = 0.0000 (Not Clear) <succ>
---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1667

A DNA sequence (GBSx1770) was identified in *S. agalactiae* <SEQ ID 5169> which encodes the amino acid sequence <SEQ ID 5170>. Analysis of this protein sequence reveals the following:

---
Possible site: 14
>>> Seems to have no N-terminal signal sequence
----- Final Results -----
  bacterial cytoplasm --- Certainty = 0.2424 (Affirmative) <succ>
    bacterial membrane --- Certainty = 0.0000 (Not Clear) <succ>
     bacterial outside --- Certainty = 0.0000 (Not Clear) <succ>
---

A related GBS nucleic acid sequence <SEQ ID 9547> which encodes amino acid sequence <SEQ ID 9548> was also identified.

The protein has homology with the following sequences in the GENPEPT database.

```
>GP:CAB12187 GB:Z99106 similar to homoserine dehydrogenase [Bacillus subtilis]
Identities = 223/448 (49%), Positives = 313/448 (69%)
Query:   1 MKVVKFGGSSLASSQQLYKVLNIIKSDYTRRFVVVSAPGKRYEEDLKMTDALIQYYQNYI  60
             MKVVKFGGSSLAS  QL KV +I+ SD  R+ VVVSAPGK Y ED K+TD LI   + Y+
Sbjct:   1 MKVVKFGGSSLASGAQLDKVFHIVTSDPARKAVVVSAPGKHYAEDTKVTDLLIACAEQYL  60

Query:  61 NGKDIVKDQTWIINRYQEIISDLSLGSTIAEEITRSIEQLASLPIENNQFLYDCFLAAGE 120
                    ++ RY  I ++L LG +I E+I   + L     N +  D   A+GE
```

-continued

```
Sbjct:   61 ATGSAPELAEAVVERYALIANELQLGQSIIEKIRDDLFTLLEGDKSNPEQYLDAVKASGE 120

Query:  121 DNNAKLVATFFNQNDIPARYVHPNEAGIIVTKEPCNARIIPGSYDKIENLCLYNEVLVIP 180
            DNNAKL+A +F    + A YV+P +AG+ VT EP NA+++P SY  +   L    + +++ P
Sbjct:  121 DNNAKLIAAYFRYKGVKAEYVNPKDAGLFVTNEPGNAQVLPESYQNLYRLRERDGLIIFP 180

Query:  181 GFFGVTEDNQICTFSRGGSDITGSLIAAGIKADLYENFTDVDGIFAAHPGVVKNPHAIPE 240
            GFFG ++D   + TFSR GSDITGS++A G++ADLYENFTDVD +++ +P  V+NP  I E
Sbjct:  181 GFFGFSKDGDVITFSRSGSDITGSILANGLQADLYENFTDVDAVYSVNPSFVENPKEISE 240

Query:  241 LTYKEMRELAYAGFSVLHDEALLPAYRGRIPLVIKNTNNPQQPGTKIVLKHTRSNIAVTG 300
            LTY+EMREL+YAGFSV HDEAL+PA+R  IP+ IKNTNNP   GT++V K    +N  V G
Sbjct:  241 LTYREMRELSYAGFSVFHDEALIPAFRAGIPVQIKNTNNPSAEGTRVVSKRDNTNGPVVG 300

Query:  301 IASDSRFASINVSKYLMNREVGFGRKVLQILEDLNISFEHMPTGIDDLSIVLREKELTPI 360
            IASD+ F SI +SKYLMNRE+GFGR+ LQILE+   +++EH+P+GIDD++I+LR+ ++
Sbjct:  301 IASDTGFCSIYISKYLMNREIGFGRRALQILEEHGLTYEHVPSGIDDMTIILRQGQMDAA 360

Query:  361 KEQEILNYLTRKLEVDYVDIQHNLSTIVIVGENMKSQIGVTATATQALSREKINITMISQ 420
             E+ ++  +    L   D V ++H+L+  I++VGE M+   +G TA A +ALS   ++NI MI+Q
Sbjct:  361 TERSVIKRIEEDLHADEVIVEHHLALIMVVGEAMRHNVGTTARAAKALSEAQVNIEMINQ 420

Query:  421 GSSEVSIMFVINSKDEKRAIKALYETFF                                 448
            GSSEVS+MF +    +E++A++ALY+ FF
Sbjct:  421 GSSEVSMMFGVKEAEERKAVQALYQEFF                                 448
```

No corresponding DNA sequence was identified in *S. pyogenes*.

Based on this analysis, it was predicted that this protein and its epitopes, could be useful antigens for vaccines or diagnostics.

Example 1668

A DNA sequence (GBSx1771) was identified in *S. agalactiae* <SEQ ID 5171> which encodes the amino acid sequence <SEQ ID 5172>. This protein is predicted to be CbbY family protein. Analysis of this protein sequence reveals the following:

Possible site: 59
>>> Seems to have no N-terminal signal sequence
----- Final Results -----
  bacterial cytoplasm --- Certainty = 0.2699 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

There is also homology to SEQ ID 448.

Based on this analysis, it was predicted that this protein and its epitopes, could be useful antigens for vaccines or diagnostics.

Example 1669

A DNA sequence (GBSx1772) was identified in *S. agalactiae* <SEQ ID 5173> which encodes the amino acid sequence <SEQ ID 5174>. This protein is predicted to be *Pseudomonas putida* enoyl-CoA hydratase II homologue (b1394). Analysis of this protein sequence reveals the following:

Possible site: 45
>>> Seems to have an uncleavable N-term signal seq
INTEGRAL    Likelihood = −2.18    Transmembrane 128-144 (128-145)
INTEGRAL    Likelihood = −1.06    Transmembrane 154-170 (154-170)
----- Final Results -----
  bacterial membrane --- Certainty = 0.1871 (Affirmative) <succ>
  bacterial outside --- Certainty = 0.0000 (Not Clear) <succ>
  bacterial cytoplasm --- Certainty = 0.0000 (Not Clear) <succ>

A related GBS nucleic acid sequence <SEQ ID 9549> which encodes amino acid sequence <SEQ ID 9550> was also identified.

```
>GP:AAF96016 GB:AE004353 CbbY family protein [Vibrio cholerae]
Identities = 59/190 (31%), Positives = 93/190 (48%), Gaps = 10/190 (5%)
Query:    4 YKAIIFDMDGVLFDTELFYYKRRERFLKQHGITIDHLPMNFFIGGNMKQVWKSVLGDQYD  63
            ++A IFDMDG+L DTE    +   +    G+         IG N K +    +L    Y
Sbjct:    6 FQAAIFDMDGLLLDTERVCMRVFQEACTACGLPFRQEVYLSVIGCNAKTI-NGILSQAYG  64

Query:   64 TWDIDKL----QQDYSRYKEDNPLPYKDLIFQDCKRVIEKLHHKGYLLGLASSSTRHDIM 119
            D+ +L    +Q Y+       +P+KD +      ++E L  +   + +A+S+ +    +
Sbjct:   65 E-DLPRLHNEWRQRYNAVVMHEAIPHKDGVIA----LLEWLKARSIPVAVATSTQKEVAL 119

Query:  120 LALESFNLDTYFKVILSGEEFSESKPNPAIYNRAAELLDIPKQQILIVEDSEKGITAGIA 179
             + L+    LD YF  I +G E ++   KP+P IY  AAE L +   QQ L   EDS   GI A +A
Sbjct:  120 IKLQLAGLDHYFANITTGCEVTQGKPHPEIYLLAAERLGVEPQQCLAFEDSNNGIKAAMA 179

Query:  180 AGIDVWAIED                                                   189
            A +   + I D
Sbjct:  180 AQMHAFQIPD                                                   189
```

A related DNA sequence was identified in *S. pyogenes* <SEQ ID 5175> which encodes the amino acid sequence <SEQ ID 5176>. Analysis of this protein sequence reveals the following:

Possible site: 27
>>> Seems to have no N-terminal signal sequence
INTEGRAL    Likelihood = −3.08    Transmembrane 110-126 (109-128)
----- Final Results -----
    bacterial membrane --- Certainty = 0.2232 (Affirmative) <succ>
    bacterial outside --- Certainty = 0.0000 (Not Clear) <succ>
    bacterial cytoplasm --- Certainty = 0.0000 (Not Clear) <succ>

An alignment of the GAS and GBS proteins is shown below.

```
Identities = 150/263 (57%), Positives = 197/263 (74%)
Query:  19 LKFENIIYGIDGNVATIMLNRPDISNGFNIPMCQEIIDAIRLVSENKDVMFLVIEAQGPI   78
           ++F++II+ +   ++AT+ LNRP++SNGFNIP+CQEI+ A+  V   +  V FL+I+A G +
Sbjct:   1 MQFKHIIFDVVDDLATLTLNRPEVSNGFNIPICQEILVALAEVKRDTSVRFLLIKAVGKV   60

Query:  79 FSIGGDLKVMKAAVESDDISSLTKIAELVNQISYDLLQLEKPVVMCVDGAVAGAAANIAL  138
           FS+GGDL  M+ AV  D++ SL KIAELV +IS+ +   L KPV++C DGAVAGAA NIAL
Sbjct:  61 FSVGGDLVEMQEAVAKDNVQSLVKIAELVQEISFAIKHLPKPVILCADGAVAGAAFNIAL  120

Query: 139 AADFVIASKKSKFIQAFVGVGLAPDAGGLLLLSKSIGITRAVQLALTGESLSAEKAEALG  198
           A DF IAS ++KFIQAFV VGLAPDAGGL LL++++G+ RA  L +TGE ++A+K    G
Sbjct: 121 AVDFCIASTQTKFIQAFVNVGLAPDAGGLFLLTRAVGLNRATHLVMTGEGITADKGLDYG  180

Query: 199 IVYKLCESDKIGKIKDQLLKRLSRHSINSYQAIKSLAWEAAFKDWEQYKKLELQLQESLA  258
              VY+  ESDK+ K+  QLLKRL R S NSY  +KSL W++ F   WE Y K EL +QE LA
Sbjct: 181 FVYRTAESDKLDKVCLQLLKRLRRGSSNSYAGMKSLVWQSFFTGWEDYAKAELAIQEELA  240

Query: 259 FKQDFKEGVRAHADRRRPNFLGK                                     281
           FK+DFKEGV A  +RRRPNF GK
Sbjct: 241 FKEDFKEGVIAFGERRRPNFQGK                                     263
```

A related GBS gene <SEQ ID 8877> and protein <SEQ ID 8878> were also identified. Analysis of this protein sequence reveals the following:

Lipop: Possible site: −1   Crend: 10
SRCFLG: 0
McG: Length of UR: 9
Peak Value of UR: 1.45

Net Charge of CR: −1
McG: Discrim Score: −5.99
GvH: Signal Score (−7.5): −4.37
Possible site: 27
>>> Seems to have no N-terminal signal sequence
Amino Acid Composition: calculated from 1
ALOM program   count: 2 value: −2.18 threshold: 0.0
INTEGRAL    Likelihood = −2.18    Transmembrane 110-126 (110-127)
INTEGRAL    Likelihood = −1.06    Transmembrane 136-152 (136-152)
PERIPHERAL  Likelihood = 1.32    49
modified ALOM score: 0.94
icm1 HYPID: 7  CFP: 0.187
*** Reasoning Step: 3
----- Final Results -----
    bacterial membrane --- Certainty = 0.1871 (Affirmative) <succ>

-continued bacterial outside --- Certainty = 0.0000 (Not Clear) <succ>
    bacterial cytoplasm --- Certainty = 0.0000 (Not Clear) <succ>

The protein has homology with the following sequences in the databases:

```
ORF01047(355-1143 of 1443)
GP|3253198|gb|AAC24330.1||AF029714(1-263 of 263) PhaB {Pseudomonas putida}
% Match = 15.4
% Identity = 33.3 % Similarity = 56.4
Matches = 88 Mismatches = 113 Conservative Sub.s = 61
     96        126       156       186       216       246       276       306
*KTVRRGLQLVLQPVLMCGLLKINTLE*ISRRLMY**AI*VNFL*N*ITIKNGKFNSVFLFFILP*KLGL**NTKHDNLI 336       366       396       426       456       486       516       546
IKLFFIFLSLLKRGDILKFENIIYGIDGNVATIMLNRPDISNGFNIPMCQEIIDAIRLVSENKDVMFLVIEAQGPIFSIG
 :  |::|:: |:   ||  : ||||:   | ||    |  |: :|::   |::  |    |:: :| |  |
     MTFQHILFSIEDGVAFLSLNRPEQLNSFNAAMHLEVREALKQVRQSSDARVLLLTAEGRGFCAG
                      10        20        30        40        50        60

576       606       636       666       696       726       756       786
GDLKVMKAAVESDDISSLTKIAELVNQISYDLLQLEKPVVMCVDGAVAGAAANIALAADFVIASKKSKFIQAFVGVGLAP
|| |   | :::  |   |: |:    |   || :|  ||| ||| ||  :|:|  : : |||| :|| |
QDLSDRNVAPDAEVPDLGESIDKFYNPLVRTLRDLPLPVICAVNGVAAGAGANIPLACDLVLAGRSASFIQAFCKIGLVP
              80        90        100       110       120       130       140
```

```
816       846       876       906       936       966       996      1026
DAGGLLLLSKSIGITRAVQLALTGESLSAEKAEALGIVYKLCESDKIGKIKDQLLKRLSRHSINSYQAIKSLAWEAAFKD
|:||   ||  : :|: ||   ||: || |||:|:  |::::: :    :   |::|: :   || : |:| :
DSGGTWLLPRLVGMARAKALAMLGERLGAEQAQQWGLIHRVVDDAALRDEALTLARQLASQPTYGLALIK-RSLNASFDN
          160       170       180       190       200       210       220

1053      1083      1113      1143      1173      1203      1233      1263
-WEQYKKLELQLQESLAFKQDFKEGVRAHADRRRPNFLGK*FENQII*D*SLANKFEL*YNLIIKV*CEVVISWNTIRLI
 :::   :||   ||       :|::|||  |   ::|  |  |  |  |:
GFDEQLELERDLQRLAGRSEDYREGVSAFMNKRTPAFKGR
          240       250       260
```

SEQ ID 8878 (GBS374) was expressed in *E. coli* as a His-fusion product. SDS-PAGE analysis of total cell extract is shown in FIG. 64 (lane 8; MW 32 kDa). It was also expressed in *E. coli* as a GST-fusion product. SDS-PAGE analysis of total cell extract is shown in FIG. 71 (lane 2; MW 57 kDa).

Figure 307:
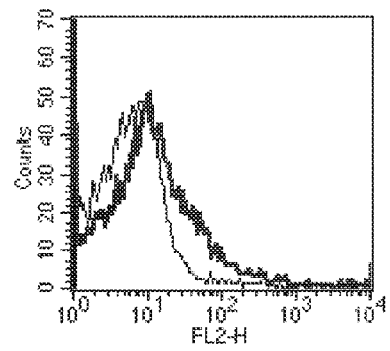

The GBS374-GST fusion product was purified (FIG. 215, lane 9) and used to immunise mice. The resulting antiserum was used for FACS (FIG. 307), which confirmed that the protein is immunoaccessible on GBS bacteria.

Based on this analysis, it was predicted that these proteins and their epitopes could be useful antigens for vaccines or diagnostics.

Example 1670

A DNA sequence (GBSx1773) was identified in *S. agalactiae* <SEQ ID 5177> which encodes the amino acid sequence <SEQ ID 5178>. This protein is predicted to be a 16.1 kDa transcriptional regulator. Analysis of this protein sequence reveals the following:

Possible site: 56
>>> Seems to have no N-terminal signal sequence
----- Final Results -----
    bacterial cytoplasm --- Certainty = 0.1738 (Affirmative) <succ>
       bacterial membrane --- Certainty = 0.0000 (Not Clear) <succ>
          bacterial outside --- Certainty = 0.0000 (Not Clear) <succ>

The protein has homology with the following sequences in the GENPEPT database.

```
>GP:AAD05186 GB:AF110185 unknown [Burkholderia pseudomallei]
Identities = 30/102 (29%), Positives = 60/102 (58%)
Query: 32   DVSLKEMHTIEIIGKHSEVTPSDVARELMLTLGTVTTSLNKLEKKGYIERKRSSIDRRVV   91
            +++ +++  I ++ +    TP +++R+L    G++T  L++LEKKG++ R RS  DRRV+
Sbjct: 39   ELTAQQISVILLLARGYARTPFELSRKLSYDSGSMTRMLDRLEKKGFVVRARSESDRRVI   98

Query: 92   HLSLTKRGRLLDRLHSKFHKSMVSHIIEDLGEEDIKMLTSAL                    133
            L+LT+RG     R      + ++  +E     +++ +LT L
Sbjct: 99   ELALTERGAHAARALPALIATELNAQLEGFSADELALLTDLL                    140
```

A related DNA sequence was identified in *S. pyogenes* <SEQ ID 5179> which encodes the amino acid sequence <SEQ ID 5180>. Analysis of this protein sequence reveals the following:

Possible site: 42
>>> Seems to have no N-terminal signal sequence
----- Final Results -----
    bacterial cytoplasm --- Certainty = 0.1412 (Affirmative) <succ>
       bacterial membrane --- Certainty = 0.0000 (Not Clear) <succ>
          bacterial outside --- Certainty = 0.0000 (Not Clear) <succ>

An alignment of the GAS and GBS proteins is shown below.

```
Identities = 111/144 (77%), Positives = 129/144 (89%)
Query:    1   MEYDQINSYLVDIFNRIMIIEEMSLKTSQFSDVSLKEMHTIEIIGKHSEVTPSDVARELM   60
              +EYD+I   YLVDIFNRI++IEEMSLKTSQFSDVSLKEMHTIEIIGK+ +VTPSD+ARELM
Sbjct:    7   LEYDKIYPYLVDIFNRILVIEEMSLKTSQFSDVSLKEMHTIEIIGKYDQVTPSDIARELM   66

Query:   61   LTLGTVTTSLNKLEKKGYIERKRSSIDRRVVHLSLTKRGRLLDRLHSKFHKSMVSHIIED  120
```

-continued

```
                +TLGTVTTSLNKLE KGYI R RS    DRRVV+LSLTKRGRLLDRLH+KFHK+MV H+I D
Sbjct:  67      VTLGTVTTSLNKLEAKGYIARTRSRSDRRVVYLSLTKRGRLLDRLHAKFHKNMVGHVIAD   126

Query: 121      LGEEDIKMLTSALGNLHKFLEDLV                                       144
                + +E+++ L    LGNLH+FLEDLV
Sbjct: 127      MSDEEMQALVRGLGNLHQFLEDLV                                       150
```

Based on this analysis, it was predicted that these proteins and their epitopes could be useful antigens for vaccines or diagnostics.

Example 1671

A DNA sequence (GBSx1774) was identified in *S. agalactiae* <SEQ ID 5181> which encodes the amino acid sequence <SEQ ID 5182>. This protein is predicted to be 3-oxoacyl-(acyl-carrier-protein) synthase III (fabH-2). Analysis of this protein sequence reveals the following:

Possible site: 15
>>> Seems to have no N-terminal signal sequence
INTEGRAL    Likelihood = −1.12   Transmembrane 103-119 (103-119)
----- Final Results -----
   bacterial membrane --- Certainty = 0.1447 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database.

```
>GP:AAF98271 GB:AF197933 beta-ketoacyl-ACP synthase III
[Streptococcus pneumoniae]
Identities = 225/324 (69%), Positives = 276/324 (84%), Gaps = 1/324 (0%)
Query:   1      MVFAKISQLAHYAPSQIIKNEDLSLIMDTSDDWISSRTGIKQRHISKNETTADLANKVAE   60
                M FAKISQ+AHY P Q++ N DL+ IMDT+D+WISSRTGI+QRHIS+ E+T+DLA +VA+
Sbjct:   1      MAFAKISQVAHYVPEQVVTNHDLAQIMDTNDEWISSRTGIRQRHISRTESTSDLATEVAK   60

Query:  61      QLIEKSGYSASQIDFIIVATMTPDSMMPSTAARVQAHIGASNAFAFDLSAACSGFVFALS  120
                +L+ K+G +   ++DFII+AT+TPDSMMPSTARRVQA+IGA+ AFAFDL+AACSGFVFALS
Sbjct:  61      KLMAKAGITGEELDFIILATITPDSMMPSTAARVQANIGANKAFAFDLTAACSGFVFALS  120

Query: 121      TAEKLISSGSYQKGLVIGAETVSKVLDWTDRGTAVLFGDGAGGVLLEASKEKHFLAESLN  180
                TAEK I+SG +QKGLVIG+ET+SK +DW+DR TAVLFGDGAGGVLLEAS+++HFLAESLN
Sbjct: 121      TAEKFIASGRFQKGLVIGSETLSKAVDWSDRSTAVLFGDGAGGVLLEASEQEHFLAESLN  180

Query: 181      TDGSR-QGLQSSQVGLNSPFSDEVLDDKFLKMDGRAIFDFAIKEVSKSINHLIETSYLEK  239
                +DGSR + L     GL+SPFSD+  D FLKMDGR +FDFAI++V+KSI   I+  S +E
Sbjct: 181      SDGSRSECLTYGHSGLHSPFSDQESADSFLKMDGRTVFDFAIRDVAKSIKQTIDESPIEV  240

Query: 240      EDIDYLFLHQANRRILDKMSRKIDIARDKFPENMMDYGNTSAASIPILLSESYENGLLKL  299
                 D+DYL LHQAN RILDKM+RKI + R K P NMM+YGNTSAASIPILLSEE   GL+ L
Sbjct: 241      TDLDYLLLHQANDRILDKMARKIGVDRAKLPANMMEYGNTSAASIPILLSECVEQGLIPL  300

Query: 300      DGNQTILLSGFGGGLTWGSLIVKI                                     323
                DG+QT+LLSGFGGGLTWG+LI+ I
Sbjct: 301      DGSQTVLLSGFGGGLTWGTLILTI                                     324
```

A related DNA sequence was identified in *S. pyogenes* <SEQ ID 5183> which encodes the amino acid sequence <SEQ ID 5184>. Analysis of this protein sequence reveals the following:

Possible site: 61
>>> Seems to have no N-terminal signal sequence
INTEGRAL    Likelihood = −0.16   Transmembrane 103-119 (103-120)
----- Final Results -----
   bacterial membrane --- Certainty = 0.1065 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the databases:

```
>GP:AAF98271 GB:AF197933 beta-ketoacyl-ACP synthase III
[Streptococcus pneumoniae]
Identities = 212/324 (65%), Positives = 263/324 (80%)
Query:   1      MIFSKISQVAHYVPQQLVTNNDLASIMDTSHEWIFSRTGIAERHISRDEMTSDLAIQVAD   60
                M F+KISQVARYVP+Q+VTN+DLA IMDT+ EWI SRTGI +RHISR E TSDLA +VA
Sbjct:   1      MAFAKISQVAHYVPEQVVTNHDLAQIMDINDEWISSRTGIRQRHISRTESTSDLATEVAK   60

Query:  61      QLLTQSGLKADAIDFIIVATISPDATMPSTAAKVQAAIAATSAFAFDMTAACSGFVFALA  120
```

-continued

```
                +L+ ++G+   +  +DFII+ATI+PD+ MPSTAA+VQA I A  AFAFD+TAACSGFVFAL+
Sbjct:  61      KLMAKAGITGEELDFIILATITPDSMMPSTAARVQANIGANKAFAFDLTAACSGFVFALS  120

Query: 121      MADKLIASGAYQNGMVIGAETLSKLVNWQDRATAVLFGDGAGGVLLEASKDKHVLAETLH  180
                A+K IASG +Q G+VIG+ETLSK V+W DR+TAVLFGDGAGGVLLEAS+ +H LAE+L+
Sbjct: 121      TAEKFIASGRFQKGLVIGSETLSKAVDWSDRSTAVLFGDGAGGVLLEASEQEHFLAESLN  180

Query: 181      TDGARCQSLISGETSLSSPYSIGKKAIATIQMDGRAIFDFAIRDVSKSILTLMAQSDITK  240
                +DG+R + L  G + L SP+S  + A +  ++MDGR +FDFAIRDV+KSI   + +S I
Sbjct: 181      SDGSRSECLTYGHSGLHSPFSDQESADSFLKMDGRTVFDFAIRDVAKSIKQTIDESPIEV  240

Query: 241      DDIDYCLLHQANRRILDKIARKIDVPREKFLENMMRYGNISAASIPILLSEAVQKGQIRL  300
                 D+DY LLHQAN RILDK+ARKI V R K   NMM YGNTSAASIPILLSE V++G I L
Sbjct: 241      TDLDYLLLHQANDRILDKMARKIGVDRAKLPANMMEYGNISAASIPILLSECVEQGLIPL  300

Query: 301      DGTQKILLSGFGGGLTWGSLIVRI                                      324
                DG+Q +LLSGFGGGLTWG+LI+ I
Sbjct: 301      DGSQTVLLSGFGGGLTWGTLILTI                                      324
```

An alignment of the GAS and GBS proteins is shown below.

```
Identities = 216/324 (66%), Positives = 271/324 (82%), Gaps = 1/324 (0%)
Query:   1      MVFAKISQLAHYAPSQIIKNEDLSLIMDTSDDWISSRTGIKQRHISKNETTADLANKVAE   60
                M+F+KISQ+AHY P Q++ N DL+ IMDTS +WI SRTGI +RHIS++E T+DLA +VA+
Sbjct:   1      MIFSKISQVAHYVPQQLVTNNDLASIMDTSHEWIFSRTGIAERHISRDEMTSDLAIQVAD   60

Query:  61      QLIEKSGYSASQIDFIIVATMTPDSMMPSTAARVQAHIGASNAFAFDLSAACSGFVFALS  120
                QL+ +SG  A   IDFIIVAT++PD+ MPSTAA+VQA  I A++AFAFD++AACSGFVFAL+
Sbjct:  61      QLLTQSGLKADAIDFIIVATISPDATMPSTAAKVQAAIAATSAFAFDMTAACSGFVFALA  120

Query: 121      TAEKLISSGSYQKGLVIGAETVSKVLDWTDRGTAVLFGDGAGGVLLEASKEKHFLAESLN  180
                 A+KLI+SG+YQ G+VIGAET+SK+++W DR TAVLFGDGAGGVLLEASK+KH LAE+L+
Sbjct: 121      MADKLIASGAYQNGMVIGAETLSKLVNWQDRATAVLFGDGAGGVLLEASKDKEVLAETLH  180

Query: 181      TDGSR-QGLQSSQVGLNSPFSDEVLDDKFLKMDGRAIFDFAIKEVSKSINHLIETSYLEK  239
                TDG+R  Q L  S +  L+SP+S         ++MDGRAIFDFAI++VSKSI  L+  S + K
Sbjct: 181      TDGARCQSLISGETSLSSPYSIGKEAIATIQMDGRAIFDFAIRDVSKSILTLMAQSDITK  240

Query: 240      EDIDYLFLHQANRRILDKMSRKIDIARDKFPENMMDYGNTSAASIPILLSESYENGLLKL  299
                 +DIDY  LHQANRRILDK++RKID+ R+KF ENMM YGNTSAASIPILLSE+ + G ++L
Sbjct: 241      DDIDYCLLHQANRRILDKIARKIDVPREKFLENMMRYGNTSAASIPILLSEAVQKGQIRL  300

Query: 300      DGNQTILLSGFGGGLTWGSLIVKI                                      323
                DG Q ILLSGFGGGLTWGSLIV+I
Sbjct: 301      DGTQKILLSGFGGGLTWGSLIVRI                                      324
```

Based on this analysis, it was predicted that these proteins and their epitopes could be useful antigens for vaccines or diagnostics.

Example 1672

A DNA sequence (GBSx1775) was identified in *S. agalactiae* <SEQ ID 5185> which encodes the amino acid sequence <SEQ ID 5186>. This protein is predicted to be acyl carrier protein (acpP). Analysis of this protein sequence reveals the following:

Possible site: 59
>>> Seems to have no N-terminal signal sequence
----- Final Results -----
  bacterial cytoplasm --- Certainty = 0.3083 (Affirmative) <succ>
   bacterial membrane --- Certainty = 0.0000 (Not Clear) <succ>
    bacterial outside --- Certainty = 0.0000 (Not Clear) <succ>

A related GBS nucleic acid sequence <SEQ ID 9551> which encodes amino acid sequence <SEQ ID 9552> was also identified.

The protein has homology with the following sequences in the GENPEPT database.

```
>GP:AAF98272 GB:AF197933 acyl carrier protein [Streptococcus pneumoniae]
Identities = 64/74 (86%), Positives = 67/74 (90%)
Query:  17      MAVFEKVQEIIVEELGKDAEEVTLNTTFDDLDADSLDVFQVISEIEDAFDIQIETEEGLN   76
                MAVFEKVQEIIVEELGKDA EVTL +TFDDLDADSLD+FQVISEIEDAFDIQIE  E L
Sbjct:   1      MAVFEKVQEIIVEELGKDASEVTLESTFDDLDADSLDLFQVISEIEDAFDIQIEAENDLK   60

Query:  77      TVGDLVAYVEEKVK                                                90
                TVGDLVAYVEE+ K
Sbjct:  61      TVGDLVAYVEEQAK                                                74
```

A related DNA sequence was identified in *S. pyogenes* <SEQ ID 5187> which encodes the amino acid sequence <SEQ ID 5188>. Analysis of this protein sequence reveals the following:

Possible site: 43
>>> Seems to have no N-terminal signal sequence
----- Final Results -----
   bacterial cytoplasm --- Certainty = 0.2995 (Affirmative) <succ>
     bacterial membrane --- Certainty = 0.0000 (Not Clear) <succ>
       bacterial outside --- Certainty = 0.0000 (Not Clear) <succ>

Possible site: 31
>>> Seems to have no N-terminal signal sequence
INTEGRAL Likelihood = −0.27 Transmembrane 156-172 (156-173)
----- Final Results -----
   bacterial membrane --- Certainty = 0.1107 (Affirmative) <succ>
    bacterial outside --- Certainty = 0.0000 (Not Clear) <succ>
      bacterial cytoplasm --- Certainty = 0.0000 (Not Clear) <succ>

An alignment of the GAS and GBS proteins is shown below.

The protein has homology with the following sequences in the GENPEPT database.

```
Identities = 70/74 (94%), Positives = 71/74 (95%)
Query:  17   MAVFEKVQEIIVEELGKDAEEVTLNTTFDDLDADSLDVFQVISEIEDAFDIQIETEEGLN   76
             MAVFEKVQEIIVEELGK+ EEVTL TTFDDLDADSLDVFQVISEIEDAFDIQIETEEGLN
Sbjct:   1   MAVFEKVQEIIVEELGKETEEVTLETTFDDLDADSLDVFQVISEIEDAFDIQIETEEGLN   60

Query:  77   TVGDLVAYVEEKVK                                                 90
             TVGDLVAYVEEK K
Sbjct:  61   TVGDLVAYVEEKSK                                                 74
```

Based on this analysis, it was predicted that these proteins and their epitopes could be useful antigens for vaccines or diagnostics.

Example 1673

A DNA sequence (GBSx1777) was identified in *S. agalactiae* <SEQ ID 5189> which encodes the amino acid sequence <SEQ ID 5190>. Analysis of this protein sequence reveals the following:

```
>GP:AAF98273 GB:AF197933 trans-2-enoyl-ACP reductase II
[Streptococcus pneumoniae]
Identities = 257/318 (80%), Positives = 277/318 (86%), Gaps = 1/318 (0%)
Query:   1   MKTRITELLNIKYPIFQGGMAWVADGDLAGAVSKAGGLGIIGGGNAPKEVVKANIDKIKS    60
             MKTRITELL I YPIFQGGMAWVADGDLAGAVSKAGGLGIIGGGNAPKEVVKANIDKIKS
Sbjct:   1   MKTRITELLKIDYPIFQGGMAWVADGDLAGAVSKAGGLGIIGGGNAPKEVVKANIDKIKS    60

Query:  61   MTDKPFGVNIMLLSPFVDDIVDLVIEEGVKVVTTGAGNPGKYMERFHEAGITVIPVVPSV   120
             +TDKPFGVNIMLLSPFV+DIVDLVIEEGVKVVTTGAGNP KYMERFHEAGI VIPVVPSV
Sbjct:  61   LTDKPFGVNIMLLSPFVEDIVDLVIEEGVKVVTTGAGNPSKYMERFHEAGIIVIPVVPSV   120

Query: 121   ALAKRMEKLGADAIITEGMEAGGHIGKLTTMTLVRQVVDAVTIPVIAAGGIADGRGAAAG   180
             ALAKRMEK+GADA+I EGMEAGGHIGKLTTMTLVRQV A++IPVIAAGGIADG GAAAG
Sbjct: 121   ALAKRMEKIGADAVIAEGMEAGGHIGKLTTMTLVRQVATAISIPVIAAGGIADGEGAAAG   180

Query: 181   FMLGADAVQVGTRFVVAKESNAHPNYKAKILKAKDIDTAVSAQVVGHPVRALKNKLVTTY   240
             FMLGA+AVQVGTRFVVAKESNAHPNYK KILKA+DIDT +SAQ  GH VRA+KN+L   +
Sbjct: 181   FMLGAEAVQVGTRFVVAKESNAHPNYKEKILKARDIDTTISAQHFGHAVRAIKNQLTRDF   240

Query: 241   SQAEKDYLAGRISINEI-EELGAGALRNAVVDGDVINGSVMAGQIAGLIKSEETCQEILE   299
                 AEKD        EI E++GAGAL  AVV GDV  GSVMAGQIAGL+   EET +EIL+
Sbjct: 241   ELAEKDAFKQEDPDLEIFEQMGAGALAKAVVHGDVDGGSVMAGQIAGLVSKEETAEEILK   300

Query: 300   DIYSGARQVILSEASRWS                                            317
             D+Y GA + I  EASRW+
Sbjct: 301   DLYYGAAKKIQEEASRWT                                            318
```

A related DNA sequence was identified in *S. pyogenes* <SEQ ID 5191> which encodes the amino acid sequence <SEQ ID 5192>. Analysis of this protein sequence reveals the following:

Possible site: 35
>>> Seems to have no N-terminal signal sequence
INTEGRAL Likelihood = −1.70 Transmembrane 106-122 (106-124)
INTEGRAL Likelihood = −0.22 Transmembrane 156-172 (156-173)
----- Final Results -----
    bacterial membrane --- Certainty = 0.1680 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:AAF98273 GB:AF197933 trans-2-enoyl-ACP reductase II
[Streptococcus pneumoniae]
Identities = 252/320 (78%), Positives = 276/320 (85%), Gaps = 1/320 (0%)
Query: 1     MKTRITELLNIDYPIFQGGMAWVADGDLAGAVSNAGGLGIIGGGNAPKEVVKANIDRVKA    60
             MKTRITELL IDYPIFQGGMAWVADGDLAGAVS AGGLGIIGGGNAPKEVVKANID++K+
Sbjct: 1     MKTRITELLKIDYPIFQGGMAWVADGDLAGAVSKAGGLGIIGGGNAPKEVVKANIDKIKS    60

Query: 61    ITDRPFGVNIMLLSPFADDIVDLVIEEGVKVVTTGAGNPGKYMERLHQAGIIVVPVVPSV   120
             +TD+PFGVNIMLLSPF +DIVDLVIEEGVKVVTTGAGNP KYMER H+AGIIV+PVVPSV
Sbjct: 61    LTDKPFGVNIMLLSPFVEDIVDLVIEEGVKVVTTGAGNPSKYMERFHEAGIIVIPVVPSV   120

Query: 121   ALAKRMEKLGVDAVIAEGMEAGGHIGKLTTMSLVRQVVEAVSIPVIAAGGIADGHGAAAA   180
             ALAKRMEK+G DAVIAEGMEAGGHIGKLTTM+LVRQV  A+SIPVIAAGGIADG GAAA
Sbjct: 121   ALAKRMEKIGADAVIAEGMEAGGHIGKLTTMTLVRQVATAISIPVIAAGGIADGEGAAAG   180

Query: 181   FMLGAEAVQIGTRFVVAKESNAHQNFKDKILAAKDIDTVISAQVVGHPVRSIKNKLTSAY   240
             FMLGAEAVQ+GTRFVVAKESNAH N+K+KIL A+DIDT ISAQ  GH VR+IKN+LT  +
Sbjct: 181   EMLGAEAVQVGTREVVAKESNAHPNYKEKILKARDIDTTISAQHFGHAVRAIKNQLTRDF   240

Query: 241   AKAEK-AFLIGQKTATDIEEMGAGSLRHAVIEGDVVNGSVMAGQIAGLVRKEESCETILK   299
                AEK AF            E+MGAG+L  AV+ GDV  GSVMAGQIAGLV KEE+ E ILK
Sbjct: 241   ELAEKDAFKQEDPDLEIFEQMGAGALAKAVVEGDVDGGSVMAGQIAGLVSKEETAEEILK   300

Query: 300   DIYYGAARVIQNEAKRWQSV                                          319
             D+YYGAA+ IQ EA RW  V
Sbjct: 301   DLYYGAAKKIQEEASRWTGV                                          320
```

Based on this analysis, it was predicted that these proteins and their epitopes could be useful antigens for vaccines or diagnostics.

Example 1674

A DNA sequence (GBSx1778) was identified in *S. agalactiae* <SEQ ID 5193> which encodes the amino acid sequence <SEQ ID 5194>. This protein is predicted to be MCAT (fabD). Analysis of this protein sequence reveals the following:

Possible site: 19
>>> Seems to have no N-terminal signal sequence

An alignment of the GAS and GBS proteins is shown below.

```
Identities = 253/319 (79%), Positives = 291/319 (90%)
Query: 1     MKTRITELLNIKYPIFQGGMAWVADGDLAGAVSKAGGLGIIGGGNAPKEVVKANIDKIKS    60
             MKTRITELLNI YPIFQGGMAWVADGDLAGAVS AGGLGIIGGGNAPKEVVKANID++K+
Sbjct: 1     MKTRITELLNIDYPIFQGGMAWVADGDLAGAVSNAGGLGIIGGGNAPKEVVKANIDRVKA    60

Query: 61    MTDKPFGVNIMLLSPFVDDIVDLVIEEGVKVVTTGAGNPGKYMERFHEAGITVIPVVPSV   120
             +TD+PFGVNIMLLSPF DDIVDLVIEEGVKVVTTGAGNPGKYMER H+AGI V+PVVPSV
Sbjct: 61    ITDRPFGVNIMLLSPFADDIVDLVIEEGVKVVTTGAGNPGKYMERLHQAGIIVVPVVPSV   120

Query: 121   ALAKRMEKLGADAIITEGMEAGGHIGKLTTMTLVRQVVDAVTIPVIAAGGIADGRGAAAG   180
             ALAKRMEKLG DA+I EGMEAGGHIGKLTTM+LVRQVV+AV+IPVIAAGGIADG  AAA
Sbjct: 121   ALAKRMEKLGVDAVIAEGMEAGGHIGKLTTMSLVRQVVEAVSIPVIAAGGIADGHGAAAA   180

Query: 181   FMLGADAVQVGTREVVAKESNAHPNYKAKILKAKDIDTAVSAQVVGHPVRALKNKLVTTY   240
             FMLGA+AVQ+GTRFVVAKESNAH N+K KIL AEDIDT +SAQVVGHPVR++KNKL + Y
Sbjct: 181   FMLGAEAVQIGTREVVAKESNAHQNFKDKILAAKDIDTVISAQVVGHPVRSIKNKLTSAY   240

Query: 241   SQAEKDYLAGRISINEIEELGAGALRNAVVDGDVINGSVMAGQIAGLIKSEETCQEILED   300
             ++AEK +L G+ +  +IEE+GAG+LR AV++GDV NGSVMAGQIAGL++ EE+C+ IL+D
Sbjct: 241   AEAEKAFLIGQKTATDIEEMGAGSLRHAVIEGDVVNGSVMAGQIAGLVRKEESCETILKD   300

Query: 301   IYSGARQVILSEASRWSDL                                           319
             IY GA +VI +EA RW  +
Sbjct: 301   IYYGAARVIQNEAKRWQSV                                           319
```

```
----- Final Results -----
    bacterial cytoplasm --- Certainty = 0.1276 (Affirmative) <succ>
    bacterial membrane --- Certainty = 0.0000 (Not Clear) <succ>
     bacterial outside --- Certainty = 0.0000 (Not Clear) <succ>
```

The protein has homology with a S. pneumoniae sequence:

```
Identities = 203/306 (66%), Positives = 242/306 (78%), Gaps = 1/306 (0%)
Query: 1     MNKVSFLFAGQGAQKLGMARDLYETFPIVKETFDKASHVLGYDLRELIDKDLDKLNQTKY   60
             M K +FLFAGQGAQ LGM RD Y+ +PIVKET D+AS VLGYDLR LID + DKLNQT+Y
Sbjct: 1     MTKTAFLFAGQGAQYLGMGRDFYDQYPIVKETIDRASQVLGYDLRYLIDTEEDKLNQTRY   60

Query: 61    TQPAILTTSTAIYRLILKEIELRPDMVAGLSLGEYSALVASGAIRFEDAVVLVARRGQLM   120
             TQPAIL TS AIYRL L+E    +PDMVAGLSLGEYSA+VASGA+ FEDAV LVA+RG  M
Sbjct: 61    TQPAILATSVAIYRL-LQEKGYQPDMVAGLSLGEYSALVASGALDFEDAVALVAKRGAYM   119

Query: 121   EAAAPAGSGKMVAVLNADRQIIEDACKKASQFGIVSPANYNTPKQIVIGGESIAVNAAVE   180
             E AAPA SGKMVAVLN   ++IE+AC+KAS+ G+V+PANYNTP QIVI GE +AV+ AVE
Sbjct: 120   EEAAPADSGKMVAVLNTPVEVIEEACQKASELGVVTPANYNTPAQIVIAGEVVAVDRAVE   179

Query: 181   ELKQQGVKRLIPLNVSGPFHTALLKPASQKLSDVLDKVHFSVSEIPVIGNTEAQIMKKDD   240
             L++ G KRLIPL VSGPFHTALL+PASQKL++ L +V FS     P++GNTEA +M+K+D
Sbjct: 180   LLQEAGAKRLIPLKVSGPFHTALLEPASQKLAETLAQVSFSDFTCPLVGNTEAAVMQKED   239

Query: 241   IKSLLARQVMEPVRFDESIETMKKMGMTQVVEIGPGKVLSGFLKKIDSSLSVHSVEDKIG   300
             I  LL RQV EPVRF ESI  M++ G++   +EIGPGKVLSGF+KKID +    VED+
Sbjct: 240   IAQLLTRQVKEPVRFYESIGVMQEAGISNFIEIGPGKVLSGFVKKIDQTAHLAHVEDQAS   299

Query: 301   FNNLKE                                                        306
                L E
Sbjct: 300   LVALLE                                                        305
```

A related DNA sequence was identified in S. pyogenes <SEQ ID 5195> which encodes the amino acid sequence <SEQ ID 5196>. Analysis of this protein sequence reveals the following:

```
Possible site: 19
>>> Seems to have no N-terminal signal sequence
----- Final Results -----
    bacterial cytoplasm --- Certainty = 0.1602 (Affirmative) <succ>
    bacterial membrane --- Certainty = 0.0000 (Not Clear) <succ>
     bacterial outside --- Certainty = 0.0000 (Not Clear) <succ>
```

An alignment of the GAS and GBS proteins is shown below.

Based on this analysis, it was predicted that these proteins and their epitopes could be useful antigens for vaccines or diagnostics.

Example 1675

A DNA sequence (GBSx1779) was identified in S. agalactiae <SEQ ID 5197> which encodes the amino acid sequence <SEQ ID 5198>. This protein is predicted to be beta-ketoacyl-ACP reductase (fabG). Analysis of this protein sequence reveals the following:

```
Possible site: 29
>>> Seems to have no N-terminal signal sequence
----- Final Results -----
    bacterial cytoplasm --- Certainty = 0.0930 (Affirmative) <succ>
    bacterial membrane --- Certainty = 0.0000 (Not Clear) <succ>
     bacterial outside --- Certainty = 0.0000 (Not Clear) <succ>
```

The protein has homology with the following sequences in the GENPEPT database.

```
Identities = 201/299 (67%), Positives = 248/299 (82%), Gaps = 1/299 (0%)
Query: 1     MNKVSFLFAGQGAQKLGMARDLYETFPIVKETFDKASHVLGYDLRELIDKDLDKLNQTKY   60
             M K +FLFAGQGAQKLGMARD Y+ F IV++TFD+AS VLGYDLR LID D KLNQT  Y Sbjct: 3     MTKTAFLFAGQGAQKLGMARDFYDNFAIVRKTFDQASQVLGYDLRRLIDSDELKLNQTSY   62

Query: 61    TQPAILTISTAIYRLILKEIELRPDMVAGLSLGEYSALVASGAIRFEDAVVLVARRGQLM   120
             TQPAILT+S AIYR +L      ++PDMVAGLSLGEYSALVASGA+ FED + LVA+RG LM
Sbjct: 63    TQPAILTSSIAIYR-VLGLHHVKPDMVAGLSLGEYSALVASGALSFEDTLSLVAKRGRLM   121

Query: 121   EAAAPAGSGKMVAVLNADRQIIEDACKKASQFGIVSPANYNTPKQIVIGGESIAVNAAVE   180
             E AAP GSGKMVAV+N D Q+IE+ C+ A++ G+V+PANYNTP QIVIGG++ AVN AVE
Sbjct: 122   EEAAPQGSGKMVAVMNTDVQVIEEVCQIAAKHGVVAPANYNTPSQIVIGGQTDAVNVAVE   181

Query: 181   ELKQQGVKRLIPLNVSGPFHTALLKPASQKLSDVLDKVHFSVSEIPVIGNTEAQIMKKDD   240
                LK++GVKRLIPLNVSGPFHTALL+PAS+ L+   L++ +FS   +IP++GNTEA IM+KD
Sbjct: 182   LLKERGVKRLIPLNVSGPFHTALLEPASRLLAKELERYNFSDFKIPLVGNTEANIMEKDR   241

Query: 241   IKSLLARQVMEPVRFDESIETMKKMGMTQVVEIGPGKVLSGFLKKIDSSLSVHSVEDKI    299
             I  LLARQVMEPVRF +S+ T+ + G+TQ +E+GPGKVL+GF+KKID +L     SVE+ +
Sbjct: 242   IPELLARQVMEPVRFYDSVATLVESGITQFIEVGPGKVLIGFVKKIDKNLLCTSVENMV    300
```

```
>GP:AAF98275 GB:AF197933 beta-ketoacyl-ACP reductase
[Streptococcus pneumoniae]
Identities = 184/243 (75%), Positives = 212/243 (86%)
Query:   1   MQLKDKNIFITGSSRGIGLAIAHQFAQLGANIVLNGRSEISEDLIAEFADYGVKVIAISG   60
             M+L+ KNIFITGSSRGIGLAIAH+FAQ GANIVLN R  ISE+L+AEF++YG+KV+ ISG
Sbjct:   1   MKLEHKNIFITGSSRGIGLAIAHKFAQAGANIVLNSRGAISEELLAEFSNYGIKVVPISG   60

Query:  61   DVSSFEDANRMIKEAIASLGSVDVLVNNAGITNDKLMLKMTVEDFESVLKINLTGAFNMT  120
             DVS F DA RMI +AIA LGSVDVLVNNAGIT D LMLKMT  DFE VLK+NLTGAFNMT
Sbjct:  61   DVSDFADAKRMIDQAIAELGSVDVLVNNAGITQDTLMLKMTEADFEKVLKVNLIGAFNMT  120

Query: 121   QSVLKPMTKARQGAIINISSVVGLTGNVGQANYAASKAGLIGFTKSVAREVAARGIRVNA  180
             QSVLKPM KAR+GAIIN+SSVVGL GN+GQANYAASKAGLIGFTKSVAREVA+R IRVN
Sbjct: 121   QSVLKPMMKAREGAIINMSSVVGLMGNIGQANYAASKAGLIGFTKSVAREVASRNIRVNV  180

Query: 181   IAPGFIESDMTDVIPEKMQEAILAQIPMKRIGKGKEVAQVASFLAEQEYLTGQVIAIDGG  240
             IAPG IESDMT ++ +K++EA LAQIPMK  G+ ++VA +  FLA Q+YLTGQV+AIDGG
Sbjct: 181   IAPGMIESDMTAILSDKIKEATLAQIPMKEFGQAEQVADLTVFLAGQDYLTGQVVAIDGG  240

Query: 241   MTM                                                          243
             ++M
Sbjct: 241   LSM                                                          243
```

A related DNA sequence was identified in *S. pyogenes* <SEQ ID 3865> which encodes the amino acid sequence <SEQ ID 3866>. Analysis of this protein sequence reveals the following:

---
Possible site: 29
>>> Seems to have no N-terminal signal sequence
----- Final Results -----
  bacterial cytoplasm --- Certainty = 0.1088 (Affirmative) <succ>
  bacterial membrane --- Certainty = 0.0000 (Not Clear) <succ>
  bacterial outside --- Certainty = 0.0000 (Not Clear) <succ>
---

An alignment of the GAS and GBS proteins is shown below.

```
Identities = 201/244 (82%), Positives = 220/244 (89%)
Query:   1   MQLKDKNIFITGSSRGIGLAIAHQFAQLGANIVLNGRSEISEDLIAEFADYGVKVIAISG   60
             M++K KNIFITGS+RGIGLA+AHQFA L ANIVLNGRS ISE+L+A F DYGV V+ ISG
Sbjct:   1   MEIKGKNIFITGSTRGIGLAMAHQFASLEANIVLNGRSAISEELVASFIDYGVTVVTISG   60

Query:  61   DVSSFEDANRMIKEAIASIGSVDVLVNNAGITNDKLMLKMTVEDFESVLKINLTGAFNMT  120
             DVS   +A RM+ EAI SLGS+DVLVNNAGITNDKLMLKMT EDFE VLKINLTGAFNMT
Sbjct:  61   DVSEASEAKRMVNEAIESLGSIDVLVNNAGITNDKLMLKMTEEDFERVLKINLTGAFNMT  120

Query: 121   QSVLKPMTKARQGAIINISSVVGLTGNVGQANYAASKAGLIGFTKSVAREVAARGIRVNA  180
             QSVLKPM KARQGAIIN+SSVVGLTGN+GQANYAASKAG+IGFTKSVAREVAAR I VNA
Sbjct: 121   QSVLKPMIKARQGAIINVSSVVGLTGNIGQANYAASKAGMIGFTKSVAREVAARNICVNA  180

Query: 181   IAPGFIESDMTDVIPEKMQEAILAQIPMKRIGKGKEVAQVASFLAEQEYLTGQVIAIDGG  240
             IAPGFIESDMT V+PEKMQE IL+QIPMKRIGK +EVA +ASFL EQ+Y+TGQVIAIDGG
Sbjct: 181   IAPGFIESDMTGVLPEKMQEQILSQIPMKRIGKAQEVAHLASFLVEQDYITGQVIAIDGG  240

Query: 241   MTMQ                                                         244
             MTMQ
Sbjct: 241   MTMQ                                                         244
```

Based on this analysis, it was predicted that these proteins and their epitopes could be useful antigens for vaccines or diagnostics.

Example 1676

A DNA sequence (GBSx1780) was identified in *S. agalactiae* <SEQ ID 5199> which encodes the amino acid sequence <SEQ ID 5200>. This protein is predicted to be 3-oxoacyl-(acyl-carrier-protein) synthase II (fabF). Analysis of this protein sequence reveals the following:

---
Possible site: 51
>>> Seems to have no N-terminal signal sequence
INTEGRAL Likelihood = −0.37 Transmembrane 338-354 (338-354)
----- Final Results -----
  bacterial membrane --- Certainty = 0.1150 (Affirmative) <succ>
  bacterial outside --- Certainty = 0.0000 (Not Clear) <succ>
  bacterial cytoplasm --- Certainty = 0.0000 (Not Clear) <succ>
---

The protein has homology with the following sequences in the GENPEPT database.

```
>GP:AAF98276 GB:AF197933 beta-ketoacyl-ACP synthase II
[Streptococcus pneumoniae]
```

```
Identities = 340/410 (82%), Positives = 375/410 (90%)
Query: 1    MTLQRVVVTGYGVTSPIGNTPEEFWNSLKEGNVGIGPITKFDSSDFMVKNAAEIHDFPFD    60
            M L RVVVTGYGVTSPIGNTPEEFWNSL  G +GIG ITKFD SDF V NAAEI DFPFD
Sbjct: 1    MKLNRVVVTGYGVTSPIGNTPEEFWNSLATGKIGIGGITKFDHSDFDVENAAEIQDFPFD    60

Query: 61   KYFVKKDLNRFDMYSLYALYASSEAIQHANLNLDEIDADRFGVIVASGIGGIQEIEEQVI   120
            KYFVKKD NRFD YSLYALYA+ EA+ HANL+++ ++ DRFGVIVASGIGGI+EIE+QV+
Sbjct: 61   KYFVKKDTNRFDNYSLYALYAAQEAVNHANLDVEALNRDRFGVIVASGIGGIKEIEDQVL   120

Query: 121  RLHEKGPKRVKPMTLPKALPNMAAGNVAMRLGAHGVCKSINTACASSNDAIGDAFRNIKF   180
            RLHEKGPKRVKPMTLPKALPNMA+GNVAMR GA+GVCKSINTAC+SSNDAIGDAFR+IKF
Sbjct: 121  RLHEKGPKRVKPMTLPKALPNMASGNVAMRFGANGVCKSINTACSSSNDAIGDAFRSIKF   180

Query: 181  GIQDIMVVGGAEAAITKFAIAGFQSLTALSTTEDPSRASIPFDKDRNGFIMGEGSGMLVL   240
            G QD+M+VGG EA+IT FAIAGFQ+LTALSTTEDP+RASIPFDKDRNGF+MGEGSGMLVL
Sbjct: 181  GFQDVMLVGGTEASITPFAIAGFQALTALSTTEDPTRASIPFDKDRNGFVMGEGSGMLVL   240

Query: 241  ESLEHAEKRGATILAEVVGYGNTCDAYHMTSPHPEGLGATKAIQLALVEANIKPEEVNYV   300
            ESLEHAEKRGATILAEVVGYGNTCDAYHMTSPHPEG GA KAI+LAL EA I PE+V YV
Sbjct: 241  ESLEHAEKRGATILAEVVGYGNTCDAYHMTSPHPEGQGAIKAIKLALEEAEISPEQVAYV   300

Query: 301  NAHGTSTPANEKGESQAIVAALGTDVPVSSTKSFTGHLLGAAGAVEAIATIEAIRHSYVP   360
            NAHGTSTPANEKGES AIVA LG +VPVSSTKSFTGHLLGAAGAVEAI TIEA+RH++VP
Sbjct: 301  NAHGTSTPANEKGESGAIVAVLGKEVPVSSTKSFTGHLLGAAGAVEAIVTIEAMRHNFVP   360

Query: 361  MTAGTTELSEDITANVIFGQGQDADIRYAISNIFGFGGHNAVLAFKRWED            410
            MTAGT+E+S+ I ANV++GQG + +I YAISNTFGFGGHNAVLAFKRWE+
Sbjct: 361  MTAGTSEVSDYIEANVVYGQGLEKEIPYAISNTFGFGGHNAVLAFKRWEN            410
```

A related DNA sequence was identified in *S. pyogenes* <SEQ ID 3851> which encodes the amino acid sequence <SEQ ID 3852>. Analysis of this protein sequence reveals the following:

Possible site: 51
>>> Seems to have no N-terminal signal sequence
----- Final Results -----
    bacterial cytoplasm --- Certainty = 0.0890 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below.

Based on this analysis, it was predicted that these proteins and their epitopes could be useful antigens for vaccines or diagnostics.

Example 1677

A DNA sequence (GBSx1781) was identified in *S. agalactiae* <SEQ ID 5201> which encodes the amino acid sequence <SEQ ID 5202>. Analysis of this protein sequence reveals the following:

```
Identities = 346/410 (84%), Positives = 377/410 (91%)
Query: 1    MTLQRVVVTGYGVTSPIGNTPEEFWNSLKEGNVGIGPITKFDSSDFMVENAAEIHDFPFD    60
            MT +RVVVTGYG+TSPIG+ PE FWN+LK G +GIGPITKFD++D+ VKNAAEI DFPFD
Sbjct: 1    MTFKRVVVTGYGLTSPIGHDPETFWNNLKAGQIGIGPITKFDTTDYAVKNAAEIQDFPFD    60

Query: 61   KYFVKKDLNRFDMYSLYALYASSEAIQHANLNLDEIDADRFGVIVASGIGGIQEIEEQVI   120
            KYFVKKDLNRFD YSLYALYA+ EAI HA+LN++ +D+DRFGVIVASGIGGI EIEEQVI
Sbjct: 61   KYFVKKDLNRFDRYSLYALYAAKEAINHADLNIEMVDSDRFGVIVASGIGGIAEIEEQVI   120

Query: 121  RLHEKGPKRVKPMTLPKALPNMAAGNVAMRLGAHGVCKSINTACASSNDAIGDAFRNIKF   180
            RLHEKGPKRVKPMTLPKALPNMAAGNVAM L A GVCKSINTACASSNDAIGDAFR IKF
Sbjct: 121  RLHEKGPKRVKPMTLPKALPNMAAGNVAMSLKAQGVCKSINTACASSNDAIGDAFRAIKF   180

Query: 181  GIQDIMVVGGAEAAITKFAIAGFQSLTALSTTEDPSRASIPFDKDRNGFIMGEGSGMLVL   240
            G QD+M+VGG+EAAITKFAIAGFQSLTALSTTEDPSR+SIPFDKDRNGFIMGEGSGMLVL
Sbjct: 181  GTQDVMIVGGSEAAITKFAIAGFQSLTALSTTEDPSRSSIPFDKDRNGFIMGEGSGMLVL   240

Query: 241  ESLEHAEKRGATILAEVVGYGNTCDAYHMTSPHPEGLGATKAIQLALVEANIKPEEVNYV   300
            ESLEHA++RGATILAE+VGYGNTCDAYHMTSP+PEGLGA KAI LAL EA I+   +NYV
Sbjct: 241  ESLEHAQERGATILAEIVGYGNTCDAYHMTSPNPEGLGARKAIHLALQEAGIEASAINYV   300

Query: 301  NAHGTSTPANEKGESQAIVAALGTDVPVSSTKSFTGHLLGAAGAVEAIATIEAIRHSYVP   360
            NAHGTSTPANEKGESQAIVA LG DVPVSSTKSFTGHLLGAAGA+EAIATIEA+RH+YVP
Sbjct: 301  NAHGTSTPANEKGESQAIVAVLGKDVPVSSIKSFIGHLLGAAGAIEAIATIEAMRHNYVP   360

Query: 361  MTAGTTELSEDITANVIFGQGQDADIRYAISNIFGFGGHNAVLAFKRWED            410
            MTAGT  LSEDI ANVIFG+G++  I YAISNTFGFGGHNAVLAFK WE+
Sbjct: 361  MTAGTQALSEDIEANVIFGEGKETAINYAISNTFGEGGENAVLAFKCWEE            410
```

Possible site: 14
>>> Seems to have no N-terminal signal sequence
----- Final Results -----
   bacterial cytoplasm --- Certainty = 0.3052 (Affirmative) <succ>
     bacterial membrane --- Certainty = 0.0000 (Not Clear) <succ>
       bacterial outside --- Certainty = 0.0000 (Not Clear) <succ>

A related GBS nucleic acid sequence <SEQ ID 9553> which encodes amino acid sequence <SEQ ID 9554> was also identified.

The protein has homology with the following sequences in the GENPEPT database.

```
>GP:AAF98277 GB:AF197933 biotin carboxyl carrier protein
[Streptococcus pneumoniae]
Identities = 103/169 (60%), Positives = 127/169 (74%), Gaps = 11/169 (6%)
Query:  19    LDIQEIKDLMTQFDESSLREFSFKTSDGELSFSKNEGKAPLVPTMSPMSHQPEATPTIAT    78
              +++ +IKDLMTQFD+SSLREFS+K     EL FSKNE +   VP ++    Q    P +AT
Sbjct:   1    MNLNDIKDLMTQFDQSSLREFSYKNGTDELQFSKNEARP--VPEVAT---QVAPAPVLAT    55

Query:  79    PVSNEAGEQTKQATEVVSEIP---ESTVTVAEGDVVESPLVGVAYLASGPDKPNFVSVGD   135
              P  +      + A V E+P   E++V    EG++VESPLVGV YLA+GPDKP FV+VGD
Sbjct:  56    P--SPVAPTSAPAETVAEEVPAPAEASVAT-EGNLVESPLVGVVYLAAGPDKPAFVTVGD   112

Query: 136    SVKKGQTLMIIEAMKVMNEVPAPHDGVVTEILVANEEVIEFGKGLVRIK             184
              SVKKGQTL+IIEAMKVMNE+PAP DGVVTEILV+NEE++EFGKGLVRIK
Sbjct: 113    SVKKGQTLVIIEAMKVMNEIPAPKDGVVTEILVSNEEMVEFGKGLVRIK             161
```

A related DNA sequence was identified in *S. pyogenes* <SEQ ID 5203> which encodes the amino acid sequence <SEQ ID 5204>. Analysis of this protein sequence reveals the following:

Possible site: 49
>>> Seems to have no N-terminal signal sequence
----- Final Results -----
   bacterial cytoplasm --- Certainty = 0.3132 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

<SEQ ID 5206>. This protein is predicted to be beta-hydroxyacyl-ACP dehydratase (fabZ). Analysis of this protein sequence reveals the following:

Possible site: 59
>>> Seems to have no N-terminal signal sequence
----- Final Results -----
   bacterial cytoplasm --- Certainty = 0.2267 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database.

```
Identities = 107/171 (62%), Positives = 126/171 (73%), Gaps = 10/171 (5%)
Query:  19    LDIQEIKDLMTQFDESSLREFSFKTSDGELSFSKNEGKAPLVPTMSPMSHQPEATPT---    75
              L+IQEIKDLM QFD SSLREF FKT++GEL IFSKNE       +  S+Q   A P
Sbjct:   1    LNIQEIKDLMAQFDTSSLREFLFKTNEGELIFSKNEQHLN-----ASTSNQEHAVPVPQV    55

Query:  76    --IATPVSNEAGEQTKQATEVVSEIPESTVTVAEGDVVESPLVGVAYLASGPDKPNFVSV   133
                + P ++EA         V E P++    VAEGD+VESPLVGVAYLA+ PDKP FV+V
Sbjct:  56    QLVPNPTASEASSPASVKDVPVEEQPQAESFVAEGDIVESPLVGVAYLAASPDKPPFVAV   115

Query: 134    GDSVKKGQTLMIIEAMKVMNEVPAPHDGVVTEILVANEEVIEFGKGLVRIK             184
              GD+VKKGQTL+IIEAMKVMNEVPAP DGV+TEILV+NE+VIEFG+GLVRIK
Sbjct: 116    GDTVKKGQILVIIEAMKVMNEVPAPCDGVITEILVSNEDVIEFGQGLVRIK             166
```

Based on this analysis, it was predicted that these proteins and their epitopes could be useful antigens for vaccines or diagnostics.

Example 1678

A DNA sequence (GBSx1782) was identified in *S. agalactiae* <SEQ ID 5205> which encodes the amino acid sequence

```
>GP:AAF98278 GB:AF197933 beta-hydroxyacyl-ACP dehydratase
[Streptococcus pneumoniae]
```

```
-continued
Identities = 130/140 (92%), Positives = 135/140 (95%)
Query:   1  MIDIKEIREALPHRYPMLLVDRVLEVSEDEIVAIKNVSINEPFFNGHFPEYPVMPGVLIM   60
            MIDI+ I+EALPHRYPMLLVDRVLEVSED IVAIKNV+INEPFENGHFP+YPVMPGV+IM
Sbjct:   1  MIDIQGIKEALPHRYPMLLVDRVLEVSEDTIVAIKNVTINEPFENGHFPQYPVMPGVVIM   60

Query:  61  EALAQTAGVLELSKEENKGKLVFYAGMDKVKFKKQVVPGDQLVMTAKFVKRRGTIAVVEA  120
            EALAQTAGVLELSK ENKGKLVFYAGMDKVKFKKQVVPGDQLVMTA FVKRRGTIAVVEA
Sbjct:  61  EALAQTAGVLELSKPENKGKLVFYAGMDKVKFKKQVVPGDQLVMTATFVKRRGTIAVVEA  120

Query: 121  IAEVDGKLAASGTLTFAIGN                                         140
             AEVDGKLAASGTLTFAIGN
Sbjct: 121  KAEVDGKLAASGTLTFAIGN                                         140
```

A related DNA sequence was identified in *S. pyogenes* <SEQ ID 5207> which encodes the amino acid sequence <SEQ ID 5208>. Analysis of this protein sequence reveals the following:

---

Possible site: 59
>>> Seems to have no N-terminal signal sequence
----- Final Results -----
  bacterial cytoplasm --- Certainty = 0.1882 (Affirmative) <succ>
    bacterial membrane --- Certainty = 0.0000 (Not Clear) <succ>
      bacterial outside --- Certainty = 0.0000 (Not Clear) <succ>

---

An alignment of the GAS and GBS proteins is shown below.

```
Identities = 127/139 (91%), Positives = 133/139 (95%)
Query:   1  MIDIKEIREALPHRYPMLLVDRVLEVSEDEIVAIKNVSINEPFFNGHFPEYPVMPGVLIM   60
            M+DI+EI+ ALPHRYPMLLVDRVLEVS+D IVAIKNV+INEPFFNGHFP YPVMPGVLIM
Sbjct:   1  MMDIREIQAALPHRYPMLLVDRVLEVSDDHIVAIKNVTINEPFFNGHFPHYPVMPGVLIM   60

Query:  61  EALAQTAGVLELSKEENKGKLVFYAGMDKVKFKKQVVPGDQLVMTAKFVKRRGTIAVVEA  120
            EALAQTAGVLELSKEENKGKLVFYAGMDKVKFKKQVVPGDQLVMTA F+KRRGTIAVVEA
Sbjct:  61  EALAQTAGVLELSKEENKGKLVFYAGMDKVKFKKQVVPGDQLVMTATFIKRRGTIAVVEA  120

Query: 121  IAEVDGKLAASGTLTFAIG                                          139
             AEVDGKLAASGTLTFA G
Sbjct: 121  RAEVDGKLAASGTLTFACG                                          139
```

Based on this analysis, it was predicted that these proteins and their epitopes could be useful antigens for vaccines or diagnostics.

Example 1679

A DNA sequence (GBSx1783) was identified in *S. agalactiae* <SEQ ID 5209> which encodes the amino acid sequence <SEQ ID 5210>. This protein is predicted to be acetyl-coenzyme A carboxylase, biotin carboxylase (accC). Analysis of this protein sequence reveals the following:

---

Possible site: 30
>>> Seems to have no N-terminal signal sequence
----- Final Results -----
  bacterial cytoplasm --- Certainty = 0.1203 (Affirmative) <succ>
    bacterial membrane --- Certainty = 0.0000 (Not Clear) <succ>
      bacterial outside --- Certainty = 0.0000 (Not Clear) <succ>

---

The protein has homology with the following sequences in the GENPEPT database.

```
>GP:AAF98279 GB:AF197933 acetyl-CoA carboxylase biotin carboxylase
subunit [Streptococcus pneumoniae]
Identities = 361/451 (80%), Positives = 405/451 (89%)
Query:   1  MFKKILIANRGEIAVRIIRAAREMGISTVAIYSEADKESLHTILADEAICVGPAKSAESY   60
            MF+KILIANRGEIAVRIIRAARE+GI+TVA+YS ADKE+LHT+LADEA+C+GP K+ ESY
Sbjct:   1  MFRKILIANRGEIAVRIIRAARELGIATVAVYSTADKEALHTLLADEAVCIGPGKATESY   60

Query:  61  LNVNAILSAAIVTGAEAVHPGEGFLSENSKFATMCEEMNLKFIGPSGEVMDKMGDKINAR  120
            LN+NA+LSAA++T AEA+HPGFGFLSENSKFATMCEE+ +KFIGPSG VMD MGDKINAR
Sbjct:  61  LNINAVLSAAVLTEAEAIHPGFGFLSENSKFATMCEEVGIKFIGPSGHVMDMMGDKINAR  120

Query: 121  TEMIKADVPVIPGSDGQVTSVEEAVSIAEEIGYPLMLKASAGGGGKGIRKVKSADELKPA  180
             +MIKA VPVIPGSDG+V + EEA+ +AE+IGYP+MLKASAGGGGKGIRKV+ D+L   A
Sbjct: 121  AQMIKAGVPVIPGSDGEVHNSEEALIVAEKIGYPVMLKASAGGGGKGIRKVEKPDDLVSA  180

Query: 181  FESASQEALAAFGNGAMYIEKVIYPARHIEVQILGDSFGKIVHLGERDCSLQRNNQKVLE  240
            FE+AS EA A +GNGANYIE+VIYPARHIEVQILGD  G ++HLGERDCSLQRNNQKVLE
```

```
                             -continued
Sbjct:  181  FETASSEAKANYGNGAMYIERVIYPARHIEVQILGDEHGHVIHLGERDCSLQRNNQKVLE   240

Query:  241  ESPSVAIGNTLRQQIGEAAVPAAEAVSYENAGTIEFLLDENSGQFYFMEMNTRVQVEHPV   300
             ESPS+AIG TLR +IG AAVRAAE V YENAGTIEFLLDE S  FYFMEMNTRVQVEHPV
Sbjct:  241  ESPSIAIGKTLRHEIGAAAVRAAEFVGYENAGTIEFLLDEASSNFYFMEMNTRVQVEHPV   300

Query:  301  TEFVTGVDIVKEQIRIAAGIPLSVSQNDIKLTGHAIECRINAENPQFNFAPCPGTINGLH   360
             TEFV+GVDIVKEQI IAAG PLSV Q DI L GHAIECRINAENP FNFAP PG I  L+
Sbjct:  301  TEFVSGVDIVKEQICIAAGQPISVKQEDIVLRGHAIECRINAENPAFNFAPSPGKITNLY   360

Query:  361  LPAGGMGLRVDSAVYTGYTIPPYYDSMIAKVIVHGENRFDALMKMQRALYELEIDGIVTN   420
             LP+GG+GLRVDSAVY GYTIPPYYDSMIAK+IVHGENRFDALMKMQRALYELEI+G+ TN
Sbjct:  361  LPSGGVGLRVDSAVYPGYTIPPYYDSMIAKIIVHGENRFDALMKMQRALYELEIEGVQTN   420

Query:  421  TEFQMDLISDKKVLAGDYDTSFLMEDFLPRY                               451
             +FQ+DLISD+ V+AGDYDTSFLME FLP+Y
Sbjct:  421  ADFQLDLISDRNVIAGDYDTSFLMETFLPKY                               451
```

A related DNA sequence was identified in *S. pyogenes* <SEQ ID 5211> which encodes the amino acid sequence <SEQ ID 5212>. Analysis of this protein sequence reveals the following:

Possible site: 48
>>> Seems to have no N-terminal signal sequence
----- Final Results -----
   bacterial cytoplasm --- Certainty = 0.1784 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

Based on this analysis, it was predicted that these proteins and their epitopes could be useful antigens for vaccines or diagnostics.

Example 1680

A DNA sequence (GBSx1784) was identified in *S. agalactiae* <SEQ ID 5213> which encodes the amino acid sequence <SEQ ID 5214>. This protein is predicted to be acetyl-CoA carboxylase beta subunit (accD). Analysis of this protein sequence reveals the following:

Possible site: 60
>>> Seems to have no N-terminal signal sequence
----- Final Results -----
   bacterial cytoplasm --- Certainty = 0.3571 (Affirmative) <succ>
     bacterial membrane --- Certainty = 0.0000 (Not Clear) <succ>
       bacterial outside --- Certainty = 0.0000 (Not Clear) <succ>

```
Identities = 369/451 (81%), Positives = 421/451 (92%)
Query:    1  MFKKILIANRGEIAVRIIRAAREMGISTVAIYSEADKESLHTILADEAICVGPAKSAESY    60
             MFKKILIANRGEIAVRIIRAARE+GISTVA+YSEADKE+LHTILADEAIC+GPA+S ESY
Sbjct:   17  MFKKILIANRGEIAVRIIRAARELGISTVAVYSEADKEALHTILADEAICIGPARSKESY    76

Query:   61  LNVNAILSAAIVTGAEAVHPGFGELSENSKFATMCEEMNLKFIGPSGEVMDKMGDKINAR   120
             LN+N++LSAAIVTGA+A+HPGFGELSENSKFATMCEEMN+KFIGPS  VMDKMGDKINAR
Sbjct:   77  LNMNSVLSAAIVTGAQAIHPGFGELSENSKFATMCEEMNIKFIGPSASVMDKMGDKINAR   136

Query:  121  TEMIKADVPVIPGSDGQVTSVEEAVSIAEEIGYPLMLKASAGGGGKGIRKVKSADELKPA   180
             +EMIKA VPVIPGSDG+V + +EA++IA +IGYP+MLKASAGGGGKGIRKV++  +L+ A
Sbjct:  137  SEMIKAGVPVIPGSDGEVYNAQEALAIANKIGYPVMLKASAGGGGKGIRKVETEADLEAA   196

Query:  181  FESASQEALAAFGNGAMYIEKVIYPARHIEVQILGDSFGKIVHLGERDCSLQRNNQKVLE   240
             F +ASQEAL AFGNGAMY+EKVIYPARHIEVQILGD++G I+HLGERDCSLQRNNQKVLE
Sbjct:  197  FNAASQEALGAFGNGAMYLEKVIYPARHIEVQILGDAYGNIIHLGERDCSLQRNNQKVLE   256

Query:  241  ESPSVAIGNTLRQQIGEAAVRAAEAVSYENAGTIEFLLDENSGQFYFMEMNTRVQVEHPV   300
             ESPS+AIGNTLR  +G+AAVRAAEAV+YENAGTIEFLLDE+S +FYFMEMNTR+QVEHPV
Sbjct:  257  ESPSIAIGNTLRHEMGQAAVRAAEAVAYENAGTIEFLLDEDSEKEYFMEMNTRIQVEHPV   316

Query:  301  TEFVTGVDIVKEQIRIAAGIPLSVSQNDIKLTGHAIECRINAENPQFNFAPCPGTINGLH   360
             TEFVTGVDIVKEQI+IAAG PL+++Q DI +TGHAIECRINAEN  FNFAP PG I  L+
Sbjct:  317  TEFVTGVDIVKEQIKIAAGQPLAINQEDITITGHAIECRINAENTAFNFAPSPGKITDLY   376

Query:  361  LPAGGMGLRVDSAVYTGYTIPPYYDSMIAKVIVHGENRFDALMKMQRALYELEIDGIVTN   420
             +P+GG+GLRVDSAVY GY IPPYYDSMIAK+IVHG NRFDALMKMQRAL ELEI+GI+TN
Sbjct:  377  MPSGGVGLRVDSAVYNGYAIPPYYDSMIAKIIVHGSNRFDALMKMQRALVELEIEGIITN   436

Query:  421  TEFQMDLISDKKVLAGDYDTSFLMEDFLPRY                               451
             T+FQ+DLISDK+V+AGDYDTSFLME FLP Y
Sbjct:  437  TDFQLDLISDKRVIAGDYDTSFLMETFLPHY                               467
```

The protein has homology with the following sequences in the GENPEPT database.

```
>GP:AAF98280 GB:AF197933 acetyl-CoA carboxylase beta subunit
[Streptococcus pneumoniae]
Identities = 221/285 (77%), Positives = 248/285 (86%), Gaps = 1/285 (0%)
Query:   1 MALFSKKDKYIRISPNKALGSSDKRSLPEVPDELFAKCPSCKHMIYQKDLGLAKICPACS    60
           MALFSKKDKYIRI+PN+++    +   PEVPDELF++CP CKH IYQKDLG  +ICP CS
Sbjct:   1 MALFSKKDKYIRINPNRSVREKPQAK-PEVPDELFSQCPGCKHTIYQKDLGSERICPHCS    59

Query:  61 YNFRISAQERLLLTVDEDSFEELFTGIETKDPLEFPNYREKLAATRQKTNLDEAVVTGLA   120
           Y FRISAQERL LT+D  +F+ELFTGIE+KDPL+FP Y++KLA+ R+KT L EAVVTG A
Sbjct:  60 YTFRISAQERLALTIDMGTFKELFTGIESKDPLHFPGYQKKLASMREKTGLHEAVVTGTA   119

Query: 121 KIKGQTTALAIMDSHFIMASMGTVVGEKLTRLFELATEKKLPIVIFTASGGARMQEGIMS   180
            IKGQT AL IMDS+FIMASMGTVVGEK+TRLFE AT +KLP+V+FTASGGARMQEGIMS
Sbjct: 120 LIKGQTVALGIMDSNFIMASMGTVVGEKITRLFEYATVEKLPVVLFTASGGARMQEGIMS   179

Query: 181 LMQMAKVSAAVKRHSNQGLFYLTILTDPTTGGVTASFAMEGDIILAEPQALVGFAGRRVI   240
           LMQMAK+SAAVKRHSN GLFYLTILTDPTTGGVTASFAMEGDIILAEPQ+LVGFAGRRVI
Sbjct: 180 LMQMAKISAAVKRHSNAGLFYLTILTDPTTGGVTASFAMEGDIILABPQSLVGFAGRRVI   239

Query: 241 ETTVREDLPEGFQKAEFLLEHGFVDAIINRTELRDCIAQLIAFHG                285
           E TVRE LPE FQKAEFLLEHGFVDAI+ R +L D IA L+  HG
Sbjct: 240 ENTVRESLPEDFQKAEFLLEHGFVDAIVKRRDLPDTIASLVRLHG                284
```

A related DNA sequence was identified in *S. pyogenes* <SEQ ID 5215> which encodes the amino acid sequence <SEQ ID 5216>. Analysis of this protein sequence reveals the following:

Possible site: 60
>>> Seems to have no N-terminal signal sequence
----- Final Results -----
bacterial cytoplasm --- Certainty = 0.4092 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

Based on this analysis, it was predicted that these proteins and their epitopes could be useful antigens for vaccines or diagnostics.

Example 1681

A DNA sequence (GBSx1785) was identified in *S. agalactiae* <SEQ ID 5217> which encodes the amino acid sequence <SEQ ID 5218>. This protein is predicted to be acetyl-CoA carboxylase alpha subunit (accA). Analysis of this protein sequence reveals the following:

Possible site: 50
>>> Seems to have no N-terminal signal sequence

```
Identities = 232/285 (81%), Positives = 253/285 (88%)

Query:   1 MALFSKKDKYIRISPNKALGSSDKRSLPEVPDELFAKCPSCKHMIYQKDLGLAKICPACS    60
           MALF KKDKYIRI+PN +L  S    ++PEVPDELFAKCP+CKHMIY+KDLGLAKICP CS Sbjct:   1 MALFRKKDKYIRITPNNSLKGSVSHNVPEVPDELFAKCPACKHMIYKKDLGLAKICPTCS    60

Query:  61 YNFRISAQERLLLTVDEDSFEELFTGIETKDPLNFPNYREKLAATRQKTNLDEAVVTGLA   120
           YNFRISAQERL LTVDE SF+ELFT IETKDPL FP Y+EKL   ++ T L EAV+TG A Sbjct:  61 YNFRISAQERLTLTVDEGSFQELFTSIETKDPLRFPGYQEKLQKAKETTGLHEAVLTGKA   120

Query: 121 KIKGQTTALAIMDSHFIMAEMGTVVGEKLTRLFELATEKKLPIVIFTASGGARMQEGIMS   180
            +K Q  ALAIMDSHFIMASMGTVVGEK+TRLFELA E+ LP+VIFTASGGARMQEGIMS
Sbjct: 121 MVKEQKIALAIMDSHFIMASMGTVVGEKITRLFELAIEENLPVVIFTASGGARMQEGIMS   180

Query: 181 LMQMAKVSAAVKRHSNQGLFYLTILTDPTTGGVTASFAMEGDIILAEPQALVGFAGRRVI   240
           LMQMAKVSAAVKRHSN GLFYLTILTDPTTGGVTASFAMEGDIILAEPQ+LVGFAGRRVI
Sbjct: 181 LMQMAKVSAAVKRHSNAGLFYLTILTDPTTGGVTASFAMEGDIILAEPQSLVGFAGRRVI   240

Query: 241 ETTVREDLPEGFQKAEFLLEHGFVDAIINRTELRDCIAQLIAFHG                285
           ETTVRE+LP+ FQKAEFL +HGFVDAI+ RTELRD IA L+AFHG
Sbjct: 241 ETTVRENLPDDFQKAEFLQDHGFVDAIVKRTELRDKIAHLVAFHG                285
```

```
INTEGRAL     Likelihood = -1.22   Transmembrane 149-165 (149-165)
----- Final Results -----
    bacterial membrane --- Certainty = 0.1489 (Affirmative) <succ>
    bacterial outside --- Certainty = 0.0000 (Not Clear) <succ>
    bacterial cytoplasm --- Certainty = 0.0000 (Not Clear) <succ>
```

A related GBS nucleic acid sequence <SEQ ID 9555> which encodes amino acid sequence <SEQ ID 9556> was also identified.

The protein has homology with the following sequences in the GENPEPT database.

```
>GP:AAF98281 GB:AF197933 acetyl-CoA carboxylase alpha subunit
[Streptococcus pneumoniae]
Identities = 186/254 (73%), Positives = 222/254 (87%)
Query:  13 DVTRILKDARDQGRLTALDYAELIFDNFMELHGDRQFADDKSIIGGLGYLAGRPVTIVGI    72
           ++ +I+++AR+Q RLT LD+A  IFD F++LHGDR F DD +++GG+G+L  + VT+VGI
Sbjct:   2 NIAKIVREAREQSRLTILDFATGIFDEFIQLHGDRSFRDDGAVVGGIGWLGDQAVTVVGI    61

Query:  73 QKGKNLQDNLDRHFGQPHPEGYRKALRLMKQAEKFGRPVITFINTAGAYPGVGABERGQG   132
           QKGK+LQDNL R+FGQPHPEGYRKALRLMKQAEKFGRPV+TFINTAGAYPGVGABERGQG
Sbjct:  62 QKGKSLQDNLKRNFGQPHPEGYRKALRLMKQAEKFGRPVVTFINTAGAYPGVGABERGQG   121

Query: 133 EAIARNLLEMSDLKVPIIAIIIGEGGSGGALALAVADKVWMLEHTVYSILSPEGFASILW   192
           EAIARNL+EMSDLKVPIIAI IGEGGSGGALALAVAD+VWMLE+++Y+ILSPEGFASILW
Sbjct: 122 EAIARNLMEMSDLKVPIIAIIIGEGGSGGALALAVADRVWMLENSIYAILSPEGFASILW   181

Query: 193 KDGTRTTEAAQLMKMTAGELYHMEVVDKVIPEHGYFSSEIVDMIKTSLISELEVLSQLSL   252
           KDGTR  EAA+LMK+T+ EL  M+VVDKVI E G  S E++  +K  L +EL  LSQ  L
Sbjct: 182 KDGTRAMEAAELMKITSHELLEMDVVDKVISEIGLSSKELIKSVKKELQTELARLSQKPL   241

Query: 253 EDLLEQRYQRFRKY   266
           E+LLE+RYQRFRKY
Sbjct: 242 EELLEERYQRFRKY   255
```

A related DNA sequence was identified in *S. pyogenes* <SEQ ID 5219> which encodes the amino acid sequence <SEQ ID 5220>. Analysis of this protein sequence reveals the following:

```
Possible site: 61
>>> Seems to have no N-terminal signal sequence
INTEGRAL     Likelihood = -1.22   Transmembrane 139-155 (139-155)
----- Final Results -----
    bacterial membrane --- Certainty = 0.1489 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the databases:

```
>GP:AAF98281 GB:AF197933 acetyl-CoA carboxylase alpha subunit
[Streptococcus pneumoniae]
Identities = 189/254 (74%), Positives = 225/254 (88%)
Query:   3 DVSRILKEARDQGRLTTLDYANLIFDDFMELHGDRHFSDDGAIVGGLAYLAGQPVTVIGI    62
           ++++I++EAR+Q RLTTLD+A  IFD+F++LHGDR F DDGA+VGG+ +L  Q VTV+GI
Sbjct:   2 NIAKIVREAREQSRLTTLDFATGIFDEFIQLHGDRSFRDDGAVVGGIGWLGDQAVTVVGI    61

Query:  63 QKGKNLQDNLARNFGQPNPEGYRKALRLMKQAEKFGRPVVTFINTAGAYPGVGAEERGQG   122
           QKGK+LQDNL RNFGQP+PEGYRKALRLMKQAEKFGRPVVTFINTAGAYPGVGAEERGQG
Sbjct:  62 QKGKSLQDNLKRNFGQPHPEGYRKALRLMKQAEKFGRPVVTFINTAGAYPGVGAEERGQG   121

Query: 123 EAIAKNLMEMSDLKVPIIAIIIGEGGSGGALALAVADQVWMLENTMYAVLSPEGFASILW   182
           EAIA+NLMEMSDLKVPIIAIIIGEGGSGGALALAVAD+VWMLEN++YA+LSPEGFASILW
Sbjct: 122 EAIARNLMEMSDLKVPIIAIIIGEGGSGGALALAVADRVWMLENSIYAILSPEGFASILW   181

Query: 183 KDGSRATEAAELMKITAGELYKMGIVDRIIPEHGYFSSEIVDIIKANLIEQITSLQAKPL   242
           KDG+RA EAAELMKIT+ EL +M +VD++I E G  S E++  +K  L  ++ L  KPL
Sbjct: 182 KDGTRAMEAAELMKITSHELLEMDVVDKVISEIGLSSKELIKSVKKELQTELARLSQKPL   241

Query: 243 DQLLDERYQRFRKY   256
           ++LL+ERYQRFRKY
Sbjct: 242 EELLEERYQRFRKY   255
```

An alignment of the GAS and GBS proteins is shown below.

No corresponding DNA sequence was identified in *S. pyogenes*.

```
Identities = 204/254 (80%), Positives = 236/254 (92%)
Query:  13  DVTRILKDARDQGRLTALDYAELIFDNFMELHGDRQFADDKSIIGGLGYLAGRPVTIVGI   72
            DV+RILK+ARDQGRLT LDYA LIFD+FMELHGDR F+DD +I+GGL YLAG+PVT++GI
Sbjct:   3  DVSRILKEARDQGRLTTLDYANLIFDDFMELHGDRHFSDDGAIVGGLAYLAGQPVTVIGI   62

Query:  73  QKGKNLQDNLDRHFGQPHPEGYRKALRLMKQAEKFGRPVITFINTAGAYPGVGAEERGQG  132
            QKGKNLQDNL R+FGQP+PEGYRKALRLMKQAEKFGRPV+TFINTAGAYPGVGAEERGQG
Sbjct:  63  QKGKNLQDNLARNFGQPNPEGYRKALRLMKQAEKFGRPVVTFINTAGAYPGVGAEERGQG  122

Query: 133  EAIARNLLEMSDLKVPIIAIIIGEGGSGGALALAVADKVWMLEHTVYSILSPEGFASILW  192
            EAIA+NL+EMSDLKVPIIAIIIGEGGSGGALALAVAD+VWMLE+T+Y++LSPEGFASILW
Sbjct: 123  EAIAKNLMEMSDLKVPIIAIIIGEGGSGGALALAVADQVWMLENTMYAVLSPEGFASILW  182

Query: 193  KDGTRTTEAAQLMKMTAGELYHMEVVDKVIPEHGYFSSEIVDMIKTSLISELEVLSQLSL  252
            KDG+R TEAA+LMK+TAGELY M +VD++IPEHGYFSSEIVD+IK +LI ++   L       L
Sbjct: 183  KDGSRATEAAELMKITAGELYKMGIVDRIIPEHGYFSSEIVDIIKANLIEQITSLQAKPL  242

Query: 253  EDLLEQRYQRFRKY                                               266
            + LL++RYQRFRKY
Sbjct: 243  DQLLDERYQRFRKY                                               256
```

Based on this analysis, it was predicted that these proteins and their epitopes could be useful antigens for vaccines or diagnostics.

Based on this analysis, it was predicted that this protein and its epitopes, could be useful antigens for vaccines or diagnostics.

Example 1682

A DNA sequence (GBSx1786) was identified in *S. agalactiae* <SEQ ID 5221> which encodes the amino acid sequence <SEQ ID 5222>. This protein is predicted to be sakacin A production response regulator. Analysis of this protein sequence reveals the following:

Example 1683

A DNA sequence (GBSx1787) was identified in *S. agalactiae* <SEQ ID 5223> which encodes the amino acid sequence <SEQ ID 5224>. This protein is predicted to be seryl-tRNA synthetase (serS). Analysis of this protein sequence reveals the following:

---

Possible site: 56
>>> Seems to have no N-terminal signal sequence
----- Final Results -----
   bacterial cytoplasm --- Certainty = 0.3304 (Affirmative) <succ>
     bacterial membrane --- Certainty = 0.0000 (Not Clear) <succ>
       bacterial outside --- Certainty = 0.0000 (Not Clear) <succ>

---

Possible site: 60
>>> Seems to have no N-terminal signal sequence
----- Final Results -----
   bacterial cytoplasm --- Certainty = 0.1866 (Affirmative) <succ>
     bacterial membrane --- Certainty = 0.0000 (Not Clear) <succ>
       bacterial outside --- Certainty = 0.0000 (Not Clear) <succ>

---

A related GBS nucleic acid sequence <SEQ ID 9557> which encodes amino acid sequence <SEQ ID 9558> was also identified.

The protein has homology with the following sequences in the GENPEPT database.

The protein has homology with the following sequences in the GENPEPT database.

```
>GP:BAA88824 GB:AB016077 sakacin A production response regulator
[Streptococcus mutans]

Identities = 76/142 (53%), Positives = 99/142 (69%)

Query:  36  MQTFKAKGQLARNSFTELSRALEQRMDGFKMQRVSNWANQAQVGRPHFWVYYRKDTDQLD   95
            M   K GQ AR  FTE+++ L ++    F+M RVSNWANQAQV RPHFW YY++  D  D
Sbjct:   1  MIALKTLGQSARAEFTEIAKVLALKVSPFEMMRVSNWANQAQVVRPHEWCYYKQPEDNQD   60

Query:  96  DVAVALRVYGVKDSFGVSLEVSFVERQKSDKTLEKQARVLSIPIASPLYFMVQRQGETHR  155
            DV +A+R+YG   +FG+S+EVSF+ER+KS  TL KQ +VL IPIA PLY+  Q + E+HR
Sbjct:   1  DVGLAIRLYGNSANFGISVEVSFIERKKSKATLAKQHKVLDIPIAEPLYYFAQEKSESHR  120

Query: 156  EEGNEENRQRLMQEIKSGKVRK                                       177
              G E   RQ L Q++   G+VRK
Sbjct: 121  VSGTEAYRQMLRQKVADGQVRK                                       142
```

```
>GP:CAB11789 GB:Z99104 seryl-tRNA synthetase [Bacillus subtilis]
Identities = 262/425 (61%), Positives = 322/425 (75%), Gaps = 1/425 (0%)
Query:   1  MLDLKRIRTDFDVVAKKLATRGVDQBTLTTLKELDIKRRELLIKAEEAKAQRNVASAAIA   60
            MLD K +R +F +  KL  +G D       + LD +RREL+ K EE K +RN  S  +A
Sbjct:   1  MLDTKMLRANFQEIKAKLVHKGEDLTDFDKFEALDDRRRELIGKVEELKGKRNEVSQQVA  60

Query:  61  QAKRNKENADEQIAAMQTLSADIKAIDAELADVDANLQSMVTVLPNTPADDVPLGADEDE  120
            KR K++AD  I   M+ +  +IK +D EL   V+A L +++  +PN P + VP+G  ED+
Sbjct:  61  VLKREKKDADHIIKEMREVGEEIKKLDEELRTVEAELDTILLSIPNIPHESVPVGETEDD  120

Query: 121  NVEVRRWGTPREFDFETKAHWDLGESLGILDWERGAKVTGSRFLFYKGLGARLERAIYSF  180
            NVEVR+WG    F +E K HWD+ + LGILD+ER AKVTGSRF+FYKGLGARLERA+Y+F
Sbjct: 121  NVEVRKWGEKPSFAYEPKPHWDIADELGILDFERAAKVTGSRFVFYKGLGARLERALYNF  180

Query: 181  MLDEHAKE-GYTEVIPPYMVNHDSMFGTGQYPKFKEDTFELADSPFVLIPTAEVPLTNYY  239
            MLD H  E  YTEVIPPYMVN  SM GTGQ PKF+ED F++ +  + LIPTAEVP+TN +
Sbjct: 181  MLDLHVDEYNYTEVIPPYMVNRASMTGTGQLPKFEEDAFKIREEDYFLIPTAEVPITNMH  240

Query: 240  RDEIIDGKELPIYFTAMSPSFRSEAGSAGRDTRGLIRLHQFHKVEMVKFAKPEESYQELE  299
            RDEI+ G  LPI + A S  FRSEAGSAGRDTRGLIR HQF+KVE+VKF KPE+SY+ELE
Sbjct: 241  RDEILSGDSLPINYAAFSACFRSEAGSAGRDTRGLIRQHQFNKVELVKFVKPEDSYEELE  300

Query: 300  KMTANAENILQKLNLPYRVITLCTGDMGFSAAKTYDLEVWIPAQNTYREISSCSNTEDFQ  359
            K+T   AE +LQ L LPYRV+++CTGD+GF+AAK YD+EVWIP Q+TYREISSCSN E FQ
Sbjct: 301  KLTNQAERVLQLLELPYRVMSMCTGDLGETAAKEYDIEVWIPSQDTYREISSCSNFEAFQ  360

Query: 360  ARRAQIRYRDEVDGKVRLLHTLNGSGLAVGRTVAAILENYQNEDGSVTIPEVLRPYMGNI  419
            ARRA IR+R E  GK   +HTLNGSGLAVGRTVAAILENYQ EDGSV IP+VLRPYMGN
Sbjct: 361  ARRANIRFRREAKGKPEHVHTLNGSGLAVGRTVAAILENYQQEDGSVVIPKVLRPYMGNR  420

Query: 420  DIIKP  424
            +++KP
Sbjct: 421  EVMKP  425
```

A related DNA sequence was identified in *S. pyogenes* <SEQ ID 5225> which encodes the amino acid sequence <SEQ ID 5226>. Analysis of this protein sequence reveals the following:

Possible site: 60
>>> Seems to have no N-terminal signal sequence

----- Final Results -----
bacterial cytoplasm --- Certainty = 0.2453 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 357/424 (84%), Positives = 386/424 (90%)
Query:   1  MLDLKRIRTDFDVVAKKLATRGVDQETLTTLKELDIKRRELLIKAEEAKAQRNVASAAIA   60
            MLDLKRIRTDFD VA KL  RGV ++TLT LKELD KRR LL+++EE KA+RN+ASAAIA
Sbjct:   1  MLDLKRIRTDFDTVAAKLKNRGVSEDTLTHLKELDEKRRALLVQSEELKAERNIASAAIA  60

Query:  61  QAKRNKENADEQIAAMQTLSADIKAIDAELADVDANLQSMVTVLPNTPADDVPLGADEDE  120
            QAKR  KE+A +QIA MQ  +SADIK  ID +L  +D  +  ++TVLPNTP D VP+GADE++
Sbjct:  61  QAKRQKEDATQQIADMQKVSADIKTIDNQLVAIDQQVTDIITVLPNTPHDSVPVGADEED  120

Query: 121  NVEVRRWGTPREFDFETKAHWDLGESLGILDWERGAKVTGSRFLFYKGLGARLERAIYSF  180
            NVE+RRWGTPR+FDFE  KAHWDLGE L  ILDWERGAKVTG+RFLFYK LGARLERA+Y+F
Sbjct: 121  NVEIRRWGTPRDFDFEVKAHWDLGEDLDILDWERGAKVTGARFLFYKNLGARLERALYNF  180

Query: 181  MLDEHAKEGYTEVIPPYMVNHDSMFGTGQYPKFKEDTFELADSPFVLIPTAEVPLTNYYR  240
            MLDEH  KEGY +I  PYMVNHDSMFGTGQYPKFKEDTFELAD+  FVLIPTAEVPLTNYYR
Sbjct: 181  MLDEHIKEGYQEITTPYMVNHDSMFGTGQYPKFKEDTFELADTNFVLIPTAEVPLTNYYR  240

Query: 241  DEIIDGKELPIYFTAMSPSFRSEAGSAGRDTRGLIRLHQFHKVEMVKFAKPEESYQELEK  300
              EI+DGKELPIYFTAMSPSFRSEAGSAGRDTRGLIRLHQFHKVEMVKFAKPEESYQELEK
Sbjct: 241  GEILDGKELPIYFTAMSPSFRSEAGSAGRDTRGLIRLHQFHKVEMVKFAKPEESYQELEK  300

Query: 301  MTANAENILQKLNLPYRVITLCTGDMGFSAAKTYDLEVWIPAQNTYREISSCSNTEDFQA  360
            MTANAENILQKL  LPYRVI+LCTGDMGFSAAKTYDLEVWIPAQNTYREISSCSNTEDFQA
Sbjct: 301  MTANAENILQKLGLPYRVISLCTGDMGFSAAKTYDLEVWIPAQNTYREISSCSNTEDFQA  360

Query: 361  RRAQIRYRDEVDGKVRILHTLNGSGLAVGRTVAAILENYQNEDGSVTIPEVLRPYMGNID  420
            RRAQIRYRDE  DGKV +LLHTLNGSGLAVGRTVAAILENYQNEDGSVTIPEVLRPYMG
Sbjct: 361  RRAQIRYRDEADGKVKLLHTINGSGLAVGRTVAAILENYQNEDGSVTIPEVLRPYMGGET  420

Query: 421  IIKP  424
            +I P
Sbjct: 421  VISP  424
```

Based on this analysis, it was predicted that these proteins and their epitopes could be useful antigens for vaccines or diagnostics.

Example 1684

A DNA sequence (GBSx1788) was identified in *S. agalactiae* <SEQ ID 5227> which encodes the amino acid sequence <SEQ ID 5228>. Analysis of this protein sequence reveals the following:

```
Possible site: 36
>>> Seems to have no N-terminal signal sequence
INTEGRAL     Likelihood = -11.36   Transmembrane 313-329 (306-332)
INTEGRAL     Likelihood = -9.24    Transmembrane 159-175 (155-179)
INTEGRAL     Likelihood = -4.19    Transmembrane 20-36 (16-37)
INTEGRAL     Likelihood = -3.29    Transmembrane 271-287 (271-287)
INTEGRAL     Likelihood = -2.97    Transmembrane 210-226 (209-227)
INTEGRAL     Likelihood = -2.87    Transmembrane 242-258 (241-258)
INTEGRAL     Likelihood = -2.13    Transmembrane 52-68 (50-68)
----- Final Results -----
    bacterial membrane --- Certainty = 0.5543 (Affirmative) <succ>
       bacterial outside --- Certainty = 0.0000 (Not Clear) <succ>
         bacterial cytoplasm --- Certainty = 0.0000 (Not Clear) <succ>
```

A related GBS nucleic acid sequence <SEQ ID 9559> which encodes amino acid sequence <SEQ ID 9560> was also identified.

The protein has homology with the following sequences in the GENPEPT database.

No corresponding DNA sequence was identified in *S. pyogenes*.

Based on this analysis, it was predicted that this protein and its epitopes, could be useful antigens for vaccines or diagnostics.

Example 1685

A DNA sequence (GBSx1789) was identified in *S. agalactiae* <SEQ ID 5229> which encodes the amino acid sequence <SEQ ID 5230>. Analysis of this protein sequence reveals the following:

```
Possible site: 59
>>> Seems to have no N-terminal signal sequence
----- Final Results -----
    bacterial cytoplasm --- Certainty = 0.2752 (Affirmative) <succ>
      bacterial membrane --- Certainty = 0.0000 (Not Clear) <succ>
         bacterial outside --- Certainty = 0.0000 (Not Clear) <succ>
```

A related GBS nucleic acid sequence <SEQ ID 9561> which encodes amino acid sequence <SEQ ID 9562> was also identified.

The protein has homology with the following sequences in the GENPEPT database.

```
>GP:CAA07406 GB:AJ006986 transmembrane protein [Streptococcus pneumoniae]
Identities = 72/330 (21%), Positives = 143/330 (42%), Gaps = 32/330 (9%)

Query:   14  RHYGLDLLRIISMFMIVITHVLGKGGLRSSVEGHADSYFIVTWIIQVLVYGAVNCYALIS     73
             R+  LDLL++++   +V+ H    GG + +    +Y      + ++  VN Y L+

Sbjct:    5  RNINLDLLKVLACVGVVLLHTT-MGGFKETGAWNFLTYLYYLGTYSIPLFFMVNGYLLL-    62

Query:   74  GYVGINSRYRYSKLLSIWAQVFFYTFTITALFAITGHE------VTLLNWRDAFFPIVSG   127
              G    I   Y  K+  +  V +TF I  LF     E        + L  + FF Sbjct:   63  GKREITYSYILQKIKWLLITVSSWTF-IVWLFKRDFTENLIKKIIGSLIQKGYFF-----   116

Query:  128  QYWYITAYFGLLVFMPVINNGLNALTDKQLKQLVLLMFI--IFSILPAVLNNRVPEFSLS   185
             Q+W+  A  + + +P++   LN+      L   L LLM I  IF +   +L   + +

Sbjct:  117  QFWFFGALILIYLCLPILRQFLNS-KRSYLYSLSLLMTIGLIFELSNILLQMPIQTYVIQ   175

Query:  186  KGFEMTWLLILYIIGAYLKRIDL----NIFKTSYLLIIYLLSLVATYAMKFSVGDIW---   238
                  TW   Y++G Y+ +  +    + FK    ++ LL L++   + F     I+

Sbjct:  176  TFRLWTW-FFYYLLGGYIAQFTIEEIESRFKNWMKIVSILLLLISPIILFFIAKTIYHNL   234

Query:  239  ---YWYVSPTLTLGAVSLFILFARASIKPSGFLKKIIVVLAPSTLGVYLCHLHPLIVKYF   295
                Y+Y +   +   +F+     ++    +   ++ IV L+  T+GV++   +H  I+K +

Sbjct:  235  FAEYFYDTLFVKVSTLGIFLTILMLTLNEN--RRESIVSLSNQTMGVFI--IHTYIMKVW   290

Query:  296  VRDFAETFVYESIYLYPFLILGAGILIYLL                                325
              +      FV     F +   I++  +L Sbjct:  291  EKVLGFNFVGAYLLFALFTLSVSFIIVGML                                320
```

```
>GP:AAD46488 GB:AF130465 unknown [Streptococcus salivarius]
Identities = 88/112 (78%), Positives = 96/112 (85%)
Query:   1  MAQSLNKTVEFQTTGVSYLGMGNKVGKFLVGDQALEFYNDKNVNDYIQIPWTSINQIGAN    60
            MAQSLNKTVE  TTGVSY+ +G KVGKFL+GD ALEFY D NV  YIQIPWTSI QIGAN
Sbjct:   1  MAQSLNKTVELHTTGVSYMAIGGKVGKFLIGDVALEFYPDVNVEQYIQIPWTSITQIGAN    60

Query:  61  VSRKKISRHFEVFTDQGKFLFASKDSGTILKHARRHIGDDKVVKLPTLIQTI         112
            VS K+ISRHFEV TD+ KFLFASKDSG ILK AR H+G++KVVKLPTLIQTI
Sbjct:  61  VSGKRISRHFEVLTDKSKFLFASKDSGKILKIAREHLGNEKVVKLPTLIQTI         112
```

A related DNA sequence was identified in *S. pyogenes* <SEQ ID 5231> which encodes the amino acid sequence <SEQ ID 5232>. Analysis of this protein sequence reveals the following:

Possible site: 59
>>> Seems to have no N-terminal signal sequence
----- Final Results -----
   bacterial cytoplasm --- Certainty = 0.3301 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

```
Identities = 87/116 (75%), Positives = 101/116 (87%)
Query:   1  MAQSLNKTVEFQTTGVSYLGMGNKVGKFLVGDQALEFYNDKNVNDYIQIPWTSINQIGAN    60
            MAQSLN +VE++T VSYLGMG KVG L+GD+ALEFYNDKNVNDYIQIPWT+IN IGAN
Sbjct:   1  MAQSLNTSVEYKTKAVSYLGMGGKVGHILLGDKALEFYNDKNVNDYIQIPWTAINHIGAN    60

Query:  61  VSRKKISRHFEVFTDQGKFLFASKDSGTILKHARRHIGDDKVVKLPTLIQTILKIF      116
            VSRKK+SRHFE+FTDQGKFLFAS DSG ILK R+HIG++KV+ LPTL+QT +  F
Sbjct:  61  VSRKKVSRHFEIFTDQGKFLFASGDSGKILKITRQHIGNEKVITLPTLMQTFINKF      116
```

Based on this analysis, it was predicted that these proteins and their epitopes could be useful antigens for vaccines or diagnostics.

Example 1686

A DNA sequence (GBSx1790) was identified in *S. agalactiae* <SEQ ID 5233> which encodes the amino acid sequence <SEQ ID 5234>. This protein is predicted to be mannose-specific phosphotransferase system component IID (manZ). Analysis of this protein sequence reveals the following:

Possible site: 39
>>> Seems to have no N-terminal signal sequence
INTEGRAL    Likelihood = −8.92    Transmembrane 281-297 (279-302)
INTEGRAL    Likelihood = −4.88    Transmembrane 187-203 (185-205)
INTEGRAL    Likelihood = −4.35    Transmembrane 260-276 (257-277)
INTEGRAL    Likelihood = −1.01    Transmembrane 129-145 (129-145)
----- Final Results -----
   bacterial membrane --- Certainty = 0.4567 (Affirmative) <succ>
     bacterial outside --- Certainty = 0.0000 (Not Clear) <succ>
       bacterial cytoplasm --- Certainty = 0.0000 (Not Clear) <succ>

The protein has homology with the following sequences in the GENPEPT database.

```
>GP:AAD46487 GB:AF130465 mannose-specific phosphotransferase system
component IID [Streptococcus salivarius]
Identities = 247/303 (81%), Positives = 276/303 (90%)
Query:    1  MTEQIKLSKSDRQKVWWRSQFLQGSWNYERMQNMGWAYALIPALKKLYTTKEDRAAALER    60
             M E+I+LS++DR+KVWWRSQFLQGSWNYERMQN+GWAY+LIPA+KYLT KED+AAAL+R
Sbjct:    1  MAEKIQLSQADRKKVWWRSQFLQGSWNYERMQNLGWAYSLIPAIKKLYTNKEDQAAALKR    60

Query:   61  HMEFFNTHPYVAAPIIGVTLALEEEKASGTPVEDKAIQGVKIGMMGPLAGIGDPVFWFTV   120
             H+EFFNTHPYVAAPI+GVTLALEEEKA+GT +ED AIQGVKIGMMGPLAGIGDPVFWFTV
Sbjct:   61  HLEFFNTHPYVAAPIMGVTLALEEEKANGTDIEDAAIQGVKIGMMGPLAGIGDPVFWFTV   120

Query:  121  RPILGALGASLASAGNILGPIIFFVGWNLIRMSFLWYTQELGYKSGKEITKDMSGGILQD   180
             RPILGALGASLA AGNI GP+IFF+GWNLIRM+FLWYTQELGYK+G EITKDMSGGIL+D
Sbjct:  121  RPILGALGASLAQAGNIAGPLIFFIGWNLIRMAFLWYTQELGYKAGSEITKDMSGGILKD   180

Query:  181  ITKGASILGMFILAVLVKRWVAINFTVDLPKKTLSEGAYINFPKDHVSGQQLHDILGQVQ   240
             ITKGASILGMFILAVLV+RWV+I FTV+LP K LS+GAYI +PK +VSG QL  ILGQV
Sbjct:  181  ITKGASILGMFILAVLVERWVSIVFTVNLPGKVLSKGAYIEWPKGNVSGDQLKTILGQVN   240

Query:  241  SGLSLDKMQPQTLQGQLDSLIPGLAGLLLTFFCMWLLKKKKVSPITIIIGLFIVGILARLA   300
                LS DK+Q  TLQ QLDSLIPGL GLLLTF CMWLLKKKVSPITIIIGLF+VGI+A
Sbjct:  241  DKLSFDKIQVDTLQKQLDSLIPGLMGLLLTFACMWLLKKKVSPITIIIGLFVVGIVASFF   300

Query:  301  GVM                                                          303
             G+M
Sbjct:  301  GIM                                                          303
```

A related DNA sequence was identified in *S. pyogenes* <SEQ ID 5235> which encodes the amino acid sequence <SEQ ID 5236>. Analysis of this protein sequence reveals the following:

```
Possible site: 55
>>> Seems to have no N-terminal signal sequence
INTEGRAL    Likelihood = -8.39    Transmembrane 284-300 (279-302)
INTEGRAL    Likelihood = -4.88    Transmembrane 261-277 (257-278)
INTEGRAL    Likelihood = -4.51    Transmembrane 181-197 (180-198)
----- Final Results -----
    bacterial membrane --- Certainty = 0.4354 (Affirmative) <succ>
    bacterial outside --- Certainty = 0.0000 (Not Clear) <succ>
        bacterial cytoplasm --- Certainty = 0.0000 (Not Clear) <succ>
```

The protein has homology with the following sequences in the databases:

```
>GP:AAD46487 GB:AF130465 mannose-specific phosphotransferase system
component IID [Streptococcus salivarius]
Identities = 239/303 (78%), Positives = 268/303 (87%)

Query:   1 MTEQIKLTKSDRQRVWWRSQFLQGSWNYERMQNMGWAYALIPALKKLYTSPEDRAAALER    60
           M E+I+L+++DR++VWWRSQFLQGSWNYERMQN+GWAY+LIPA+KKLYT+ ED+AAAL+R
Sbjct:   1 MAEKIQLSQADRKKVWWRSQFLQGSWNYERMQNLGWAYSLIPAIKKLYTNKEDQAAALKR    60

Query:  61 HMEFFNTHPYVAAPIIGVTLALEEERANGTPIDDKAIQGVKIGMMGPLAGIGDPVFWFTI   120
           H+EFFNTHPYVAAPI+GVTLALEEE+ANGT I+D AIQGVKIGMMGPLAGIGDPVFWFT+
Sbjct:  61 HLEFFNTHPYVAAPIMGVTLALEEEKANGTDIEDAAIQGVKIGMMGPLAGIGDPVFWFTV   120

Query: 121 RPILGALGASLASTGNIVGPLLFFFGWNLIRMAFLWYTQEFGYKAGSEITKDMSGGILQD   180
           RPILGALGASLA  GNI GPL+FF GWNLIRMAFLWYTQE GYKAGSEITKDMSGGIL+D
Sbjct: 121 RPILGALGASLAQAGNIAGPLIFFIGWNLIRMAFLWYTQELGYKAGSEITKDMSGGILKD   180

Query: 181 ITKGASILGMFILAVLVQRWVSINFTIDLPGKQLSDGAYVVFPDGAVKGAELKTILANAI   240
           ITKGASILGMFILAVLV+RWVSI FT++LPGK LS GAY+ +P G V G +LKTIL
Sbjct: 181 ITKGASILGMFILAVLVERWVSIVFTVNLPGKVLSKGAYIEWPKGMVSGDQLKTILGQVN   240

Query: 241 GGMSLDKVQAQTLQGQLDSLIPGLAGLLLTFLCMWLLKKKVSPIAIIIGLFAFGILAHLA   300
              +S DK+Q  TLQ QLDSLIPGL GLLLTF CMWLLKKKVSPI IIIGLF GI+A
Sbjct: 241 DKLSFDKIQVDTLQKQLDSLIPGLMGLLLTFACMWLLKKKVSPITIIIGLFVVGIVASFF   300

Query: 301 GIM   303
           GIM
Sbjct: 301 GIM   303
```

An alignment of the GAS and GBS proteins is shown below.

```
Identities = 255/303 (84%), Positives = 277/303 (91%)

Query:   1 MTEQIKLSKSDRQKVWWRSQFLQGSWNYERMQNMGWAYALIPALKKLYTTKEDRAAALER    60
           MTEQIKL+KSDRQ+VWWRSQFLQGSWNYERMQNMGWAYALIPALKKLYT+ EDRAAALER
Sbjct:   1 MTEQIKLTKSDRQRVWWRSQFLQGSWNYERMQNMGWAYALIPALKKLYTSPEDRAAALER    60

Query:  61 HMEFFNTHPYVAAPIIGVTLALEEEKASGTPVEDKAIQGVKIGMMGPLAGIGDPVFWFTV   120
           HMEFFNTHPYVAAPIIGVTLALEEE+A+GTP++DKAIQGVKIGMMGPLAGIGDPVFWFT+
Sbjct:  61 HMEFFNTHPYVAAPIIGVTLALEEERANGTPIDDKAIQGVKIGMMGPLAGIGDPVFWFTI   120

Query: 121 RPILGALGASLASAGNILGPIIFFVQWNLIRMSFLWYTQELGYKSGKEITKDMSGGILQD   180
           RPILGALGASLAS GNI+GP++FF GWNLIRM+FLWYTQE GYK+G EITKDMSGGILQD
Sbjct: 121 RPILGALGASLASTGNIVGPLLFFFGWNLIRMAFLWYTQEFGYKAGSEITKDMSGGILQD   180

Query: 181 ITKGASILGMFILAVLVKRWVAINFTVDLPKKTLSEGAYINFPKDHVSGQQLHDILGQVQ   240
           ITKGASILGMFILAVLV+RWV+INFT+DLP K LS+GAY+ FP   V G +L  IL
Sbjct: 181 ITKGASILGMFILAVLVQRWVSINFTIDLPGKQLSDGAYVVFPDGAVKGAELKTILANAI   240

Query: 241 SGLSLDKMQPQTLQGQLDSLIPGLAGLLLTFFCMWLLKKKVSPITIIIGLFIVGILARLA   300
            G+SLDK+Q QTLQGQLDSLIPGLAGLLLTF CMWLLKKKVSPI IIIGLF  GILA LA
Sbjct: 241 GGMSLDKVQAQTLQGQLDSLIPGLAGLLLTFLCMWLLKKKVSPIAIIIGLFAFGILAHLA   300

Query: 301 GVM   303
           G+M
Sbjct: 301 GIM   303
```

Based on this analysis, it was predicted that these proteins and their epitopes could be useful antigens for vaccines or diagnostics.

Example 1687

A DNA sequence (GBSx1791) was identified in *S. agalactiae* <SEQ ID 5237> which encodes the amino acid sequence <SEQ ID 5238>. Analysis of this protein sequence reveals the following:

```
Possible site: 22
>>> Seems to have no N-terminal signal sequence
----- Final Results -----
    bacterial cytoplasm --- Certainty = 0.2580 (Affirmative) <succ>
```

-continued bacterial membrane --- Certainty = 0.0000 (Not Clear) <succ>
bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1688

A DNA sequence (GBSx1792) was identified in *S. agalactiae* <SEQ ID 5239> which encodes the amino acid sequence <SEQ ID 5240>. This protein is predicted to be mannose-specific phosphotransferase system component IIC (manY). Analysis of this protein sequence reveals the following:

Possible site: 39
>>> Seems to have a cleavable N-term signal seq.
INTEGRAL    Likelihood = −5.95   Transmembrane 142-158 (137-165)
INTEGRAL    Likelihood = −2.60   Transmembrane 65-81 (61-81)
INTEGRAL    Likelihood = −1.97   Transmembrane 103-119 (103-122)
----- Final Results -----
   bacterial membrane --- Certainty = 0.3378 (Affirmative) <succ>
      bacterial outside --- Certainty = 0.0000 (Not Clear) <succ>
         bacterial cytoplasm --- Certainty = 0.0000 (Not Clear) <succ>

A related GBS nucleic acid sequence <SEQ ID 9301> which encodes amino acid sequence <SEQ ID 9302> was also identified.

The protein has homology with the following sequences in the GENPEPT database.

A related DNA sequence was identified in *S. pyogenes* <SEQ ID 5241> which encodes the amino acid sequence <SEQ ID 5242>. Analysis of this protein sequence reveals the following:

Possible site: 36
>>> Seems to have an uncleavable N-term signal seq
INTEGRAL    Likelihood = −11.30   Transmembrane 4-20 (1-28)
INTEGRAL    Likelihood = −7.64    Transmembrane 226-242 (212-247)
INTEGRAL    Likelihood = −4.14    Transmembrane 102-118 (101-123)
INTEGRAL    Likelihood = −3.77    Transmembrane 71-87 (69-87)
INTEGRAL    Likelihood = −3.40    Transmembrane 150-166 (146-167)
INTEGRAL    Likelihood = −2.13    Transmembrane 186-202 (186-202)
INTEGRAL    Likelihood = −0.37    Transmembrane 37-53 (37-53)

----- Final Results -----
   bacterial membrane --- Certainty = 0.5522 (Affirmative) <succ>
      bacterial outside --- Certainty = 0.0000 (Not Clear) <succ>
         bacterial cytoplasm --- Certainty = 0.0000 (Not Clear) <succ>

```
>GP:AAD46486 GB:AF130465 mannose-specific phosphotransferase system
component IIC [Streptococcus salivarius]
Identities = 134/186 (72%), Positives = 154/186 (82%), Gaps = 1/186 (0%)
Query:     1 MVKSGDFTQKGINFAFSTAVPLAIAGLFLTMIVRTISTALVHAGDKAASEGNFAAIERFH      60
             +VK G+FT +GI  A +TA+PLA+AGLFLTM+VRT S ALVHA DKAA  GN A +ER H
Sbjct:    86 LVKGGNFTTEGIGVATATAIPLAVAGLFLTMLVRTASVALVHAADKAAESGNIAGVERAH    145

Query:    61 FIALLLQGLRIAFPAALLLAIPSSSVQSILEAMPDWLNGGMQVGGAMVVAVGYAMVINMM    120
             ++ALLLQGLRIA  PAALLLAIP+ SVQ  L  MP WLN GM VGG MVVAVGYAMVINMM
Sbjct:   146 YLALLLQGLRIAVPAALLLAIPAESVQHALGLMPSWLNHGMVVGGGMVVAVGYAMVINMM    205

Query:   121 ATREVWPFFALGFALAALNQLTLIAMGTIGVAIALIYISLSKMGGSK-GTSNAGSNDPIG    179
             ATREVWPFFA+GFA AA++QLTLIA+G IGVAIA IY++LSK GG   G +++GS DPIG
Sbjct:   206 ATREVWPFFAIGFAFAAISQLTLIALGAIGVAIAFIYLNLSKQGGGNGGGTSSGSGDPIG    265

Query:   180 DILEDY    185
             DILEDY
Sbjct:   266 DILEDY    271
```

The protein has homology with the following sequences in the databases:

```
>GP:AAD46486 GB:AF130465 mannose-specific phosphotransferase system
component IIC [Streptococcus salivarius]
Identities = 211/271 (77%), Positives = 237/271 (86%), Gaps = 2/271 (0%)
Query:     1 MSDISIISAILVVIIAFFAGLEGILDQFQMHQPLVACTLIGLVTGHLEAGVILGGTLQML     60
             MSD+SIISAILVV++AF AGLEGILDQFQ HQPLVACTLIG  TG+L AG++LGG+LQM+
Sbjct:     1 MSDMSIISAILVVVVAFLAGLEGILDQFQFHQPLVACTLIGAATGNLTAGIMLGGSLQMI     60

Query:    61 ALGWANIGAAVAPDAALASVAAAIIMVKSGDFTQKGITFAYSTAIPLAVAGLFLTMIVRT    120
```

```
                AL WANIGAAVAPDAALASVAAAII+VK G+FT +GI  A +TAIPLAVAGLFLTM+VRT
Sbjct:   61     ALAWANIGAAVAPDAALASVAAAIILVKGGNFTTEGIGVATATAIPLAVAGLFLTMLVRT      120

Query:  121     LSTALVHAGDKAAAEGNFAGIERFHFIALLLQGLRIAVPAALLVAVPTSAVQSVLNAMPN      180
                S ALVHA DKAA  GN AG+ER H++ALLLQGLRIAVPAALL+A+P  +VQ  L  MP+
Sbjct:  121     ASVALVHAADKAAESGNIAGVERAHYLALLLQGLRIAVPAALLLAIPAESVQHALGLMPS      180

Query:  181     WLNEGMQIGGAMVVAVGYAMVINMMATREVWPFFALGFALAAISQLTLIAMGVIGVAIAF      240
                WLN GM +GG MVVAVGYAMVINMMATREVWPFFA+GFA AAISQLTLIA+G IGVAIAF
Sbjct:  181     WLNHGMVVGGGMVVAVGYAMVINMMATREVWPFFAIGFAFAAISQLTLIALGAIGVAIAF      240

Query:  241     IYLNLSKKGG--NGGNAAGSADPIGDILEDY                                  269
                IYLNLSK+GG   GG ++GS DPIGDILEDY
Sbjct:  241     IYLNLSKQGGGNGGGTSSGSGDPIGDILEDY                                  271
```

An alignment of the GAS and GBS proteins is shown below.

```
Identities = 155/185 (83%), Positives = 173/185 (92%), Gaps = 1/185 (0%)
Query:    1     MVKSGDFTQKGINFAFSTAVPLAIAGLFLTMIVRTISTALVHAGDKAASEGNFAAIERFH       60
                MVKSGDFTQKGI FA+STA+PLA+AGLFLTMIVRT+STALVHAGDKAA+EGNFA IERFH
Sbjct:   86     MVKSGDFTQKGITFAYSTAIPLAVAGLFLTMIVRTLSTALVHAGDKAAAEGNFAGIERFH      145

Query:   61     FIALLLQGLRIAFPAALLLAIPSSSVQSILEAMPDWLNGGMQVGGAMVVAVGYAMVINMM      120
                FIALLLQGLRIA PAALL+A+P+S+VQS+L AMP+WLN GMQ+GGAMVVAVGYAMVINMM
Sbjct:  146     FIALLLQGLRIAVPAALLVAVPISAVQSVLNAMPNWLNEGMQIGGAMVVAVGYAMVINMM      205

Query:  121     ATREVWPFFALGFALAALNQLTLIAMGTIGVAIALIYISLSKMGGSKGTSNAGSNDPIGD      180
                ATREVWPFFALGFALAA++QLTLIAMG IGVAIA IY++LSK GG+ G + AGS DPIGD
Sbjct:  206     ATREVWPFFALGFALAAISQLTLIAMGVIGVAIAFIYLNLSKKGGNGGNA-AGSADPIGD      264

Query:  181     ILEDY                                                            185
                ILEDY
Sbjct:  265     ILEDY                                                            269
```

Based on this analysis, it was predicted that these proteins and their epitopes could be useful antigens for vaccines or diagnostics.

Example 1689

A DNA sequence (GBSx1793) was identified in *S. agalactiae* <SEQ ID 5243> which encodes the amino acid sequence <SEQ ID 5244>. Analysis of this protein sequence reveals the following:

---
Possible site: 37
>>> Seems to have no N-terminal signal sequence
----- Final Results -----
  bacterial cytoplasm --- Certainty = 0.3171 (Affirmative) <succ>
    bacterial membrane --- Certainty = 0.0000 (Not Clear) <succ>
      bacterial outside --- Certainty = 0.0000 (Not Clear) <succ>
---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1690

A DNA sequence (GBSx1794) was identified in *S. agalactiae* <SEQ ID 5245> which encodes the amino acid sequence <SEQ ID 5246>. This protein is predicted to be pseudouridine synthase (rluC). Analysis of this protein sequence reveals the following:

---
Possible site: 28
>>> Seems to have no N-terminal signal sequence
----- Final Results -----
  bacterial cytoplasm --- Certainty = 0.2717 (Affirmative) <succ>
    bacterial membrane --- Certainty = 0.0000 (Not Clear) <succ>
      bacterial outside --- Certainty = 0.0000 (Not Clear) <succ>
---

The protein has homology with the following sequences in the GENPEPT database.

```
>GP:BAB06566 GB:AP001516 unknown conserved protein [Bacillus halodurans]
Identities = 124/281 (44%), Positives = 171/281 (60%), Gaps = 8/281 (2%)
Query:   16     LLKSHDVSRGLLAKIKYRGGKIFVNGEEQNAIFLLEIGDVVTIDIPDE-PSHETL-EPVP       73
                L +   VS+  LA IK++GG I +NGEE      + + D VT+++P E PS   + EPVP
Sbjct:   24     LREGKHVSKRSLAAIKFKGGTILLNGEEVTVRETVHVNDQVTLELPHEYPSPSMIAEPVP       83

Query:   74     HDLDIIYEDDHFLILNKPFGFASIPSSIH-SNTIANFIKHYYVSNNYANQQVHIVTRLDR      132
                 D+IYE+DH+L++NKP G  +IPS H      T+AN + +Y+     A     H V RLD+
Sbjct:   84     --FDVIYENDHYLVVNKPAGVPTIPSRDHPQGTLANGLLNYFQRQKMA-ATFHAVNRLDK      140

Query:  133     DTSGLMLFAKHGYAHARLDKQLQAKAIEKRYYALVSGSGDLADSGDIIAPIARDVDSIIT      192
```

-continued
```
             DTSGL++ AKH   AH +L KQ +     I++ Y A+V G  +   + G I APIAR   +S+IT
Sbjct: 141   DTSGLLIVAKHQLAHDQLSKQQRQGNIKRTYMAIVQGEIEQQE-GTITAPIARKEESLIT     199

Query: 193   RRVHESGKYAHTSYQVVARYGDVRLVDIKLHTGRTHQIRVHFAHIGFPLLGDDLYGGRMD     252
             R V E G+ A T ++V+ R       +V ++L TGRTHQIRVHF+++G+PL GDDLYGG
Sbjct: 200   REVREDGQLAITHFKVIDRLNQGTIVQVQLETGRTHQIRVHFSYLGYPLFGDDLYGGERK     259

Query: 253   LGINRQALHCHSLSFYDPFMGKINKQTLDLTDDFDSVIMEL                        293
              GI RQALH     L+ + PF           T  L  D   +I  L
Sbjct: 260   -GIERQALHSTELTIHCPFTEVEQTFTEGLPPDMKELIRHL                        299
```

A related DNA sequence was identified in *S. pyogenes* <SEQ ID 5247> which encodes the amino acid sequence <SEQ ID 5248>. Analysis of this protein sequence reveals the following:

Possible site: 28
>>> Seems to have no N-terminal signal sequence
----- Final Results -----
   bacterial cytoplasm --- Certainty = 0.2786 (Affirmative) <succ>
     bacterial membrane --- Certainty = 0.0000 (Not Clear) <succ>
       bacterial outside --- Certainty = 0.0000 (Not Clear) <succ>

Possible site: 33
>>> Seems to have no N-terminal signal sequence
----- Final Results -----
   bacterial cytoplasm --- Certainty = 0.1521 (Affirmative) <succ>
     bacterial membrane --- Certainty = 0.0000 (Not Clear) <succ>
       bacterial outside --- Certainty = 0.0000 (Not Clear) <succ>

A related GBS nucleic acid sequence <SEQ ID 9845> which encodes amino acid sequence <SEQ ID 9846> was also identified.

An alignment of the GAS and GBS proteins is shown below.

The protein has homology with the following sequences in the GENPEPT database.

```
Identities = 223/294 (75%), Positives = 251/294 (84%), Gaps = 1/294 (0%)
Query:   1   MKFEYVAKERCKVKTLLKSHDVSRGLLAKIKYRGGKIFVNGEEQNAIFLLEIGDVVTIDI     60
             M+FE+VA +R KVKTLLKS+DVS+GLLAKIKY+GG I VNG EQNAI+LL++GDVVTIDI
Sbjct:   1   MRFEFVADKRIKVKTLLKSYDVSKGLLAKIKYKGGNILVNGIEQNAIYLLQVGDVVTIDI     60

Query:  61   PDEPSHETLEPVPHDLDIIYEDDHFLILNKPFGFASIPSSIHSNTIANFIKHYYVSNNYA    120
             P+E    E LE +P DLDI++EDDHFL++NKP GFASIPS+IHSNTIANFIK YYV N+Y
Sbjct:  61   PNEEPFEKLEAIPFDLDIVHEDDHFLVINKPIGFASIPSAIHSNTIANFIKAYYVDNHYL    120

Query: 121   NQQVHIVTRLDRDTSGLMLFAKHGYAHARLDKQLQAKAIEKRYYALVSGSGDLADSGDII    180
             +QQVHIVTRLDRDTSGLMLFAKHGYAHARLDKQLQ ++IEKRY+ALVSG+G L D GDII
Sbjct: 121   DQQVHIVTRLDRDTSGLMLFAKHGYAHARLDKQLQTRSIEKRYFALVSGNGMLPDEGDII    180

Query: 181   APIARDVDSIITRRVHESGKYAHTSYQVVARYGD-VRLVDIKLHTGRTHQIRVHFAHIGF    239
             API R  DSIITR V   GKYA TSY+VVARY + V LVDIKLHTGRTHQIRVHFAHIGF
Sbjct: 181   APIGRSKDSIITRAVDPMGKYAKTSYKVVARYSENVHLVDIKLHTGRTHQIRVHFAHIGF    240

Query: 240   PLLGDDLYGGRMDLGINRQALHCHSLSFYDPFMGKINKQTLDLTDDFDSVIMEL          293
             PLLGDDLYGGR+DLGI RQALHCH L+F DPF          + LTDDFDSVI+ L
Sbjct: 241   PLLGDDLYGGRLDLGITRQALHCHYLNFKDPFTESDCSYAIHLTDDFDSVIIGL          294
```

Based on this analysis, it was predicted that these proteins and their epitopes could be useful antigens for vaccines or diagnostics.

Example 1691

A DNA sequence (GBSx1795) was identified in *S. agalactiae* <SEQ ID 5249> which encodes the amino acid sequence <SEQ ID 5250>. Analysis of this protein sequence reveals the following:

```
>GP:CAB13018 GB:Z99110 similar to hypothetical proteins [Bacillus subtilis]
Identities = 120/267 (44%), Positives = 174/267 (64%), Gaps = 3/267 (1%)
Query:  13   RVAIIANGKYQSKRVASKLFAAFKHDPDFYLSKKDPDIVISIGGDGMLLSAFHMYEKQLD     72
             + A+ + G   S   + SK+   A+  D D  L + +P+IVIS+GGDG LL AFH Y   +LD
Sbjct:   2   KFAVSSKGDQVSDTLKSKI-QAYLLDFDMELDENEPEIVISVGGDGTLLYAFHRYSDRLD     60

Query:  73   KVRFVGVHTGHLGFYTDYRDFEVDTLINNLKNDKGEQISYPILKVTITL-EDGRVIRARA    131
             K  FVGVHTGHLGFY  D+   E++  L+   +         +  YP+L+V +T  E+R  R   A
Sbjct:  61   KTAFVGVHTGHLGFYADWVPHEIEKLVLAIAKTPYHTVEYPLLEVIVTIHENEREERYLA    120

Query: 132   LNESTIKRIEKTMVADVVINQVVFERFRGDGILVSTPTGSTAYNKSLGGAVLHPTIEALQ    191
             LNE TIK  IE ++VADV I    +FE  FRGDG+ +STP+GSTAYNK+LGGA++HP+I A+Q
```

```
                             -continued
Sbjct:  121   LNECTIKSIEGSLVADVEIKGQLFETFRGDGLCLSTPSGSTAYNKALGGAIIHPSIRAIQ    180

Query:  192   LTEISSLNNRVYRTLGSSVIIPKKDAIEIVPKRVGVYTISIDNKTVHYKNVTKIEYSIDE    251
              L E++S+NNRV+RT+GS +++P       I P+    + ++ID+ T+ +K+V  I    +
Sbjct:  181   LAEMASINNRVFRTVGSPLLLPSHHDCMIKPRNEVDFQVTIDHLTLLHKDVKSIRCQVAS    240

Query:  252   KSINFVSTPSHTSFWERVNDAFIGEPE                                     278
              + + F         FW+RV D+FIG+ E
Sbjct:  241   EKVRFARFRPF-PFWKRVQDSFIGKGE                                     266
```

A related sequence was also identified in GAS <SEQ ID 9137> which encodes the amino acid sequence <SEQ ID 9138>. Analysis of this protein sequence reveals the following:

---

Possible site: 16
>>> Seems to have no N-terminal signal sequence
----- Final Results -----
   bacterial cytoplasm --- Certainty = 0.2190 (Affirmative) <succ>
   bacterial membrane --- Certainty = 0.0000 (Not Clear) <succ>
   bacterial outside --- Certainty = 0.0000 (Not Clear) <succ>

---

RGD motif: 155-157

An alignment of the GAS and GBS proteins is shown below.

```
Identities = 232/276 (84%), Positives = 257/276 (93%)
Query:    1   MMTQMNFTDRATRVAIIANGKYQSKRVASKLFAAFKHDPDFYLSKKDPDIVISIGGDGML    60
              +MTQMN+T +  RVAIIANGKYQSKRVASKLF+ FK DPDFYLSKK+PDIVISIGGDGML
Sbjct:    1   VMTQMNYTGKVKRVAIIANGKYQSKRVASKLFSVFKDDPDFYLSKKNPDIVISIGGDGML    60

Query:   61   LSAFHMYEKQLDKVRFVGVHTGHLGFYTDYRDFEVDTLINNLKNDKGEQISYPILKVTIT   120
              LSAFHMYEK+LDKVRFVG+HTGHLGFYTDYRDFEVD LI+NL+ DKGEQISYPILKV IT
Sbjct:   61   LSAFHMYEKELDKVRFVGIHTGHLGFYTDYRDFEVDKLIDNLRKDKGEQISYPILKVAIT   120

Query:  121   LEDGRVIRARALNESTIKRIEKTMVADVVINQVVFERFRGDGILVSTPTGSTAYNKSLGG   180
              L+DGRV++ARALNE+T+KRIEKTMVADV+IN V FE FRGDGI VSTPTGSTAYNKSLGG
Sbjct:  121   LDDGRVVKARALNEATVKRIEKTMVADVIINHVKFESFRGDGISVSTPTGSTAYNKSLGG   180

Query:  181   AVLHPTIEALQLTEISSLNNRVYRTLGSSVIIPKKDAIEIVPKRVGVYTISIDNKTVHYK   240
              AVLHPTIEALQLTEISSLNNRV+RTLGSS+IIPKKD IE+VPKR+G+YTISIDNKT   K
Sbjct:  181   AVLHPTIEALQLTEISSLNNRVFRTLGSSIIIPKKDKIELVPKRLGIYTISIDNKTYQLK   240

Query:  241   NVTKIEYSIDEKSINFVSTPSHTSFWERVNDAFIGE                           276
              NVTK+EY ID++ I+FVS+PSHTSFWERV DAFIGE
Sbjct:  241   NVTKVEYFIDDEKIHFVSSPSHTSFWERVKDAFIGE                           276
```

A related GBS gene <SEQ ID 8879> and protein <SEQ ID 8880> were also identified. Analysis of this protein sequence reveals an RGD motif at residues 159-161.

The protein has homology with the following sequences in the databases:

---

```
45.0/65.6% over 264aa
Bacillus subtilis
EGAD|107338|hypothetical protein Insert characterized OMNI|NT01BS1363 BC541A
protein-related Insert characterized
SP|031612|YJBN_BACSU HYPOTHETICAL 30.0 KDA PROTEIN IN MECA-TENA INTERGENIC
REGION. Insert characterized
GP|2633515|emb|CAB13018.1||Z99110 similar to hypothetical proteins Insert
characterized
PIR|F69844|F69844 conserved hypothetical protein yjbN-Insert characterized
ORF02026(337-1134 of 1437)
EGAD|107338|BS1162(2-266 of 266) hypothetical protein {Bacillus subtilis}
OMNI|NT01BS1363
BC541A protein-related SP|031612|YJBN_BACSU HYPOTHETICAL 30.0 KDA PROTEIN IN
MECA-TENA INTERGENIC REGION. GP|2633515|emb|CAB13018.1||Z99110
similar to hypothetical proteins
{Bacillus subtilis} PIR|F69844|F69844 conserved hypothetical protein yjbN-
Bacillus subtilis
% Match = 22.8
```

```
% Identity = 44.9 % Similarity = 65.5
Matches = 120 Mismatches = 89 Conservative Sub.s = 55
87         117        147        177        207        237        267        297
RKF*QKYKSELWL*IFGQPSNIH*ITSIRGTSLKKLNKDWRKQQKSL*NWMKKCVRFAKIFVEHSFYLIL*IEN*AMV*E 327        357        387        417        447        477        507        537
IVMTQMNFTDRATRVAIIANGKYQSKRVASKLFAAFKHDPDFYLSKKDPDIVISIGGDGMLLSAFHMYEKQLDKVRFVGV
              : |:   |     |    : ||:  |:    |     |   : :|:||||:|||| || ||| :  :|||   ||||
              MKFAVSSKGDQVSDTLKSKIQA-YLLDFDMELDENEPEIVISVGGDGTLLYAFHRYSDRLDKTAFVGV
              10         20         30         40         50         60

567        597        627        657        684        714        744        774
HTGHLGFYTDYRDFEVDTLINNLKNDKGEQISYPILKVTITL-EDGRVIRARALNESTIKRIEKTMVADVVINQVVFERF
||||||||| |:   |:: |:   :        :  ||:|:|  :|  |: |    ||||  ||  |  ::||||  :  :|| |
HTGHLGFYADWVPHEIEKLVLAIAKTPYHTVEYPLLEVIVTYHENEREERYLALNECTIKSIEGSLVADVEIKGQLFETF
              80         90         100        110        120        130        140

804        834        864        894        924        954        984        1014
RGDGILVSTPTGSTAYNKSLGGAVLHPTIEALQLTEISSLNNRVYRTLGSSVIIPKKDAIEIVPKRVGVYTISIDNKTVH
||||: :|||:||||||||:|||::||:|  |:||  |::|:|||||:||:||    :::|  |   | |: |:    : ::||: |:
RGDGLCLSTPSGSTAYNKALGGAIIHPSIRAIQLAEMASINNRVFRTVGSPLLLPSHHDCMIKPRNEVDFQVTIDHLTLL
              160        160        180        190        200        210        220

1044       1074       1104       1134       1164       1194       1224       1254
YKNVTKIEYSIDEKSINFVSTPSHTSFWERVNDAFIGEPEH*NLNT*QKKGAKLKHF*KVMMFQGGY*QRLSTEVVRFLL
:|:|      |   :    :   :   |  :            ||:||  |:|||:  |
HKDVKSIRCQVASEKVRF-ARFRPFPFWKRVQDSFIGKGE
              240        250        260
```

A related DNA sequence was identified in *S. pyogenes* <SEQ ID 5251> which encodes the amino acid sequence <SEQ ID 5252>. Analysis of this protein sequence reveals the following:

Possible site: 20
>>> Seems to have no N-terminal signal sequence
----- Final Results -----
   bacterial cytoplasm --- Certainty = 0.2190 (Affirmative) <succ>
      bacterial membrane --- Certainty = 0.0000 (Not Clear) <succ>
         bacterial outside --- Certainty = 0.0000 (Not Clear) <succ>

An alignment of the GAS and GBS sequences follows:

```
Score = 481 bits (1224), Expect = e-138
Identities = 233/276 (84%), Positives = 257/276 (92%)
Query:   1  VMTQMNYTGKVKRVAIIANGKYQSKRVASKLFSVFKDDPDFYLSKKNPDIVISIGGDGML   60
            VMTQMN+T +  RVAIIANGKYQSKRVASKLF+ FK DPDFYLSKK+PDIVISIGGDGML
Sbjct:   1  VMTQMNFTDRATRVAIIANGKYQSKRVASKLFAAFKHDPDFYLSKKDPDIVISIGGDGML   60

Query:  61  LSAFHMYEKELDKVRFVGIHTGHLGFYTDYRDFEVDKLIDNLRKDKGEQISYPILKVAIT  120
            LSAFHMYEK+LDKVRFVG+HTGHLGFYTDYRDFEVD LI+NL+ DKGEQISYPILKV IT
Sbjct:  61  LSAFHMYEKQLDKVRFVGVHTGHLGFYTDYRDFEVDTLINNLKNDKGEQISYPILKVTIT  120

Query: 121  LDDGRVVKARALNEATVKRIEKTMVADVIINHVKFESFRGDGISVSTPTGSTAYNKSLGG  180
            L+DGRV++ARALNE+T+KRIEKTMVADV+IN V FE FRGDGI VSTPTGSTAYNKSLGG
Sbjct: 121  LEDGRVIRARALNESTIKRIEKTMVADVVINQVVFERFRGDGILVSTPTGSTAYNKSLGG  180

Query: 181  AVLHPTIEALQLTEISSLNNRVFRTLGSSIIIPKKDKIELVPKRLGIYTISIDNKTYQLK  240
            AVLHPTIEALQLTEISSLNNRV+RTLGSS+IIPKKD IE+VPKR+G+YTISIDNKT   K
Sbjct: 181  AVLHPTIEALQLTEISSLNNRVYRTLGSSVIIPKKDAIEIVPKRVGVYTISIDNKTVHYK  240

Query: 241  NVTKVEYFIDDEKIHFVSSPSHTSFWERVKDAFIGE                         276
            NVTK+EY ID++ I+FVS+PSHTSFWERV DAFIGE
Sbjct: 241  NVTKIEYSIDEKSINFVSTPSHTSFWERVNDAFIGE                         276
```

SEQ ID 8880 (GBS308) was expressed in *E. coli* as a His-fusion product. SDS-PAGE analysis of total cell extract is shown in FIG. 57 (lane 4; MW 34 kDa). It was also expressed in *E. coli* as a GST-fusion product. SDS-PAGE analysis of total cell extract is shown in FIG. 77 (lane 3; MW 59 kDa).

GBS308-GST was purified as shown in FIG. 226, lane 8.

Based on this analysis, it was predicted that these proteins and their epitopes could be useful antigens for vaccines or diagnostics.

Example 1692

A DNA sequence (GBSx1796) was identified in *S. agalactiae* <SEQ ID 5253> which encodes the amino acid sequence <SEQ ID 5254>. This protein is predicted to be permease. Analysis of this protein sequence reveals the following:

Possible site: 17
>>> Seems to have no N-terminal signal sequence
----- Final Results -----
   bacterial cytoplasm --- Certainty = 0.3653 (Affirmative) <succ> bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:BAB06568 GB:AP001516 GTP pyrophosphokinase [Bacillus halodurans]
Identities = 115/208 (55%), Positives = 159/208 (76%), Gaps = 3/208 (1%)
Query:    4 DWETFLDPYIQTVGELKIKLRGIRKQFRKQNRHSPIEFVTGRVKSVESIQEKMVLRGISE    63
            +W+ FL PY Q V ELK+KL+GIR+Q++K ++H+PIEFVTGRVK + SI +K + + I
Sbjct:    3 NWDVFLTPYKQAVEELKVKLKGIREQYQKSSKHTPIEFVTGRVKPISSILDKAIRKNIPL   62

Query:   64 ENLAQDLQDIAGLRIMVQFVDDVDEVLALLRKRHDMTVVQERDYITHMKSSGYRSYHVVV   123
            + L + +QD+AGLRI+ QFV+D++ V+ L+R R D  +V+ERDY+   K SGYRSYH+V+
Sbjct:   63 DQLEEKMQDLAGLRIVTQFVEDIETVVQLIRSRSDFEIVEERDYVEQKKDSGYRSYHLVL   122

Query:  124 EYPVDTIDGQKKVLAEIQIRTLAMNFWATIEHSLNYKYQGDFPEEIKQRLEKTAKIALEL   183
               YPV TI+G+K++L E+QIRTLAMNFWATIEHSLNYKY G+ P  IK RL++ A+ A  L
Sbjct:  123 RYPVQTIEGEKRILVELQIRTLAMNFWATIEHSLNYKYSGEIPLNIKTRLQRAAEAAFRL   182

Query:  184 DEEMRKIREDIREAQLLFDPLNRKLSDG                                  211
            DEEM +IR+++REAQ +   + RK    G
Sbjct:  183 DEEMSQIRDEVREAQQI---ITRKQEQG                                  207
```

A related DNA sequence was identified in *S. pyogenes* <SEQ ID 5255> which encodes the amino acid sequence <SEQ ID 5256>. Analysis of this protein sequence reveals the following:

Possible site: 17
>>> Seems to have no N-terminal signal sequence
----- Final Results -----
  bacterial cytoplasm --- Certainty = 0.4064 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 196/223 (87%), Positives = 213/223 (94%)
Query:    1 MSMDWETFLDPYIQTVGELKIKLRGIRKQFRKQNRHSPIEFVTGRVKSVESIQEKMVLRG   60
            M++DWE FLDPYIQTVGELKIKLRGIRKQ+RKQNR+SPIEFVTGRVKS+ESI+EKM+LRG
Sbjct:    1 MTLDWEEFLDPYIQTVGELKIKLRGIRKQYRKQNRYSPIEFVTGRVKSIESIKEKMILRG   60

Query:   61 ISEENLAQDLQDIAGLRIMVQFVDDVDEVLALLRKRHDMTVVQERDYITHMKSSGYRSYH  120
            +  EEN+AQD+QDIAGLRIMVQFVDDV+EVLALLR+R DMT+V ERDYI +MKSSGYRSYH
Sbjct:   61 VIEENIAQDIQDIAGLRIMVQFVDDVEEVLALLRQRQDMTIVYERDYIRNMKSSGYRSYH  120

Query:  121 VVVEYPVDTIDGQKKVLAEIQIRTLAMNFWATIEHSLNYKYQGDFPEEIKQRLEKTAKIA  180
            VVVEYPVDTI+GQKKVLAEIQIRTLAMNFWATIEHSLNYKY GDFPEEIK+RLE TAKIA
Sbjct:  121 VVVEYPVDTIEGQKKVLAEIQIRTLAMNFWATIEHSLNYKYGGDFPEEIKKRLEVTAKIA  180

Query:  181 LELDEEMRKIREDIREAQLLFDPLNRKLSDGVGNSDDTDEFYR                   223
            LELDEEMRKIREDIREAQLLFDP+ R LSDGVGNSDDTDE YR
Sbjct :181 LELDEEMRKIREDIREAQLLFDPVTRNLSDGVGNSDDTDELYR                   223
```

Based on this analysis, it was predicted that these proteins and their epitopes could be useful antigens for vaccines or diagnostics.

Example 1693

A DNA sequence (GBSx1797) was identified in *S. agalactiae* <SEQ ID 5257> which encodes the amino acid sequence <SEQ ID 5258>. Analysis of this protein sequence reveals the following:

Possible site: 33
>>> Seems to have no N-terminal signal sequence
----- Final Results -----
    bacterial cytoplasm --- Certainty = 0.2266 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database.

```
>GP:CAB13015 GB:Z99110 yjbK [Bacillus subtilis]
Identities = 63/184 (34%), Positives = 99/184 (53%), Gaps = 10/184 (5%)
Query:    4 LEIEYKTLLNKDEFNRLTSLFSHVQP--ITQTNYYFDTETFEMKAHRMSLRIRTLPNRAE    61
            +EIE+K +L K EF  + S      +       Q N+YFDT++F +K    +LRIR     +
Sbjct:    5 IEIEFKNMLTKQEFKNIASALQLTEKDFTDQKNHYFDTDSFALKQKHAALRIRRKNGKYV   64

Query:   62 LTLKIPREVGNLEHNHDLT--LEEAKYIVKNGQFPEDTEIASLILEKGVDPTKLAVFGQL   119
            LTLK P +VG LE +  L+     + A + V  G P  ++  L     +D   +  FG L
Sbjct:   65 LTLKEPADVGLLETHQQLSEVSDLAGFSVPEG--PVKDQLHKL----QIDTDAIQYFGSL   118

Query:  120 TTTRREMETSIGLMALDSNIYADIKDYELELEVKQPKQGKRDFDQFLKENNINFKYAKSK   179
               T R E ET   GL+ LD + Y + +DYE+E  E       +G++ F++ L++ +I +   K+K
Sbjct:  119 ATNRAEKETEKGLIVLDHSRYLNKEDYEIEFEAADWHEGRQAFEKLLQQFSIPQRETKNK   178

Query:  180 VARF   183
            + RF
Sbjct:  179 ILRF   182
```

A related DNA sequence was identified in *S. pyogenes* <SEQ ID 5259> which encodes the amino acid sequence <SEQ ID 5260>. Analysis of this protein sequence reveals the following:

Possible site: 59
>>> Seems to have no N-terminal signal sequence
----- Final Results -----
    bacterial cytoplasm --- Certainty = 0.3470 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below.

```
Identities = 114/188 (60%), Positives = 139/188 (73%), Gaps = 1/188 (0%)
Query:   1 MTHLEIEYKTLLNKDEFNRLTSLFSHVQPITQTNYYFDTETFEMKAHRMSLRIRTLPNRA    60
           MT++LEIEYKTLL K+E+NRL S   HV P+TQTNYY DT+ F++KA++MSLRIRT  N A
Sbjct:   1 MTNLEIEYKTLLTKNEYNRLLSQMKHVTPVTQTNYYIDTKAFDLKANKMSLRIRTFVNSA    60

Query:  61 ELTLKIPREVGNLEHNHDLTLEEAKYIVKNGQFPEDTEIASLILEKGVDPTKLAVFGQLT   120
           ELTLK+P +VGN E+N   L  LE+AK ++K+G  PE T +   +I+ KG+ P+  L   FG LT
Sbjct:  61 ELTLKVPEKVGNREYNVPLFLEQAKDMIKHGNLPESTAL-DIIISKGIKPSALVTFGNLT   119

Query: 121 TTRREMETSIGLMALDSNIYADIKDYELELEVKQPKQGKRDFDQFLKENNINFKYAKSKV   180
           T  RRE    IG +ALD N+YA+ KDYELELEV    QGK DFD  FL E +I FKYAKSKV
Sbjct: 120 TVRRETVIPIGKLALDYNLYANTKDYELELEVSDALQGKIDFDSFLSEYHITFKYAKSKV   179

Query: 181 ARFSATLK   188
           AR    TLK
Sbjct: 180 ARCINTLK   187
```

Based on this analysis, it was predicted that these proteins and their epitopes could be useful antigens for vaccines or diagnostics.

Example 1694

A DNA sequence (GBSx1798) was identified in *S. agalactiae* <SEQ ID 5261> which encodes the amino acid sequence <SEQ ID 5262>. Analysis of this protein sequence reveals the following:

Possible site: 30
>>> Seems to have no N-terminal signal sequence
----- Final Results -----
    bacterial cytoplasm --- Certainty = 0.1815 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1695

A DNA sequence (GBSx1799) was identified in *S. agalactiae* <SEQ ID 5263> which encodes the amino acid sequence <SEQ ID 5264>. Analysis of this protein sequence reveals the following:

Possible site: 38
>>> Seems to have no N-terminal signal sequence
----- Final Results -----
    bacterial cytoplasm --- Certainty = 0.0621 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1696

A DNA sequence (GBSx1800) was identified in *S. agalactiae* <SEQ ID 5265> which encodes the amino acid sequence <SEQ ID 5266>. This protein is predicted to be ribose-phosphate pyrophosphokinase (prsA). Analysis of this protein sequence reveals the following:

Possible site: 22
>>> Seems to have no N-terminal signal sequence
----- Final Results -----
   bacterial cytoplasm --- Certainty = 0.3369 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:CAB11827 GB:Z99104 phosphoribosyl pyrophosphate synthetase
[Bacillus subtilis]
Identities = 166/319 (52%), Positives = 231/319 (72%), Gaps = 4/319 (1%)
Query: 1     MAEQYADKQIKLFSLTANREIAEKISQASGIPLGKMSSRQFSDGEIMINIEETVRGDDIY    60
             M+ QY DK +K+FSL +N E+A++I+   G+ LGK S  +FSDGE+ INIEE++RG D Y
Sbjct: 1     MSNQYGDKNLKIFSLNSNPELAKEIADIVGVQLGKCSVTRFSDGEVQINIEESIRGCDCY    60

Query: 61    IIQSTSFPVNDNLWELLIMIDACKRASANTVNIVVPYFGYSRQDRIAASREPITAKLVAN   120
             IIQSTS PVN+++ ELLIM+DA KRASA T+NIV+PY+GY+RQDR A SREPITAKL AN
Sbjct: 61    IIQSTSDPVNEHIMELLIMVDALKRASAKTININVIPYYGYARQDRKARSREPITAKLFAN   120

Query: 121   MLVKAGVDRVLTLDLHAVQVQGFFDIPVDNLFTVPLFAEHYNQLGLSGEDVVVVSPKNSG   180
             +L  AG  RV+ LDLHA Q+QGFFDIP+D+L  VP+   E++    G + ED+V+VSP + G
Sbjct: 121   LLETAGATRVIALDLHAPQIQGFFDIPIDHLMGVPILGEYFE--GKNLEDIVIVSPDHGG   178

Query: 181   IKRARSLAEYLDSPIAIIDYAQD-DSEREEGYIIGEVEGKKAIIDDILNTGKTFAEAAK    239
             + RAR LA+ L +PIAIID   +   E    I+G +EGK AI+IDDI++T  T    AA
Sbjct: 179   VTRARKLADRLKAPIAIIDKRRPRPNVAEVMNIVGNIEGKTAILIDDIIDTAGTITLAAN   238

Query: 240   ILERGGATEIYAVASHGLFAGGAADILESAPIREIIVTDSV-LSKERIPSNIKYLTASHL   298
             L   GA E+YA  +H  +G A + + ++ I+E++VT+S+ L +E+    K L+     L
Sbjct: 239   ALVENGAKEVYACCTHPVLSGPAVERINNSTIKELVVTNSIKLPEEKKIERFKQLSVGPL   298

Query: 299   IADAIIRIHERKPLSPLFS                                           317
             +A+AIIR+HE++ +S LFS
Sbjct: 299   LAEAIIRVHEQQSVSYLFS                                           317
```

A related DNA sequence was identified in *S. pyogenes* <SEQ ID 5267> which encodes the amino acid sequence <SEQ ID 5268>. Analysis of this protein sequence reveals the following:

Possible site: 22
>>> Seems to have no N-terminal signalsequence
----- Final Results -----
   bacterial cytoplasm --- Certainty = 0.1830 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 278/324 (85%), Positives = 305/324 (93%)
Query: 1     MAEQYADKQIKLFSLTANREIAEKISQASGIPLGKMSSRQFSDGEIMINIEETVRGDDIY    60
             M E+YADKQIKLFSLT+N  IAEKI++A+GIPLGKMSSRQFS+GEIMINIEETVRGDDIY
Sbjct: 1     MTERYADKQIKLFSLTSNLPIAEKIAKAAGIPLGKMSSRQFSNGEIMINIEETVRGDDIY    60

Query: 61    IIQSTSFPVNDNLWELLIMIDACKRASANTVNIVVPYFGYSRQDRIAASREPITAKLVAN   120
             IIQSTSFPVNDNLWELLIMIDACKRASANTVNIV+PYFGYSRQDR A  REPITAKLVAN
Sbjct: 61    IIQSTSFPVNDNLWELLIMIDACKRASANTVNIVLPYFGYSRQDRVAKPREPITAKLVAN   120

Query: 121   MLVKAGVDRVLTLDLHAVQVQGFFDIPVDNLFTVPLFAEHYNQLGLSGEDVVVVSPKNSG   180
             ML KAG+DRV TLDLHAVQVQGFFDIPVDNLFTVPLFAE Y++LGLSG DVVVVSPKNSG
Sbjct: 121   MLTKAGIDRVVTLDLHAVQVQGFFDIPVDNLFTVPLFAERYSKLGLSGSDVVVVSPKNSG   180
```

```
-continued
Query: 181    IKRARSLAEYLDSPIAIIDYAQDDSEREEGYIIGEVEGKKAIIIDDILNTGKTFAEAAKI   240
              IKRARSLAEYLDSPIAIIDYAQDDSERE+GYIIG+V GKRAI+IDDILNTGKTFAEAAKI
Sbjct: 181    IKRARSLAEYLDSPIAIIDYAQDDSEREQGYIIGDVSGKKAILIDDILNTGKTFAEAAKI   240

Query: 241    LERGGATEIYAVASHGLFAGGAADILESAPIREIIVTDSVLSKERIPSNIKYLTASHLIA   300
              LER GAT+ YAVASHGLFAGGAAD+LE+API+EIIVTDSV +K R+P N+ YL+AS LIA
Sbjct: 241    LERSGATDTYAVASHGLFAGGAADVLETAPIKEIIVTDSVKTKNEVPENVTYLSASDLIA   300

Query: 301    DAIIRIHERKPLSPLFSYRSDKKD                                     324
              +AIIRIHER+PLSPLFSY+    K+
Sbjct: 301    EAIIRIHERRPLSPLFSYQPKGKN                                     324
```

Based on this analysis, it was predicted that these proteins and their epitopes could be useful antigens for vaccines or diagnostics.

Example 1697

A DNA sequence (GBSx1801) was identified in *S. agalactiae* <SEQ ID 5269> which encodes the amino acid sequence <SEQ ID 5270>. This protein is predicted to be Fe—S cluster formation protein. Analysis of this protein sequence reveals the following:

---
Possible site: 16
>>> Seems to have no N-terminal signal sequence
----- Final Results -----
   bacterial cytoplasm --- Certainty = 0.1981 (Affirmative) <succ>
    bacterial membrane --- Certainty = 0.0000 (Not Clear) <succ>
     bacterial outside --- Certainty = 0.0000 (Not Clear) <succ>
---

The protein has homology with the following sequences in the GENPEPT database.

A related DNA sequence was identified in *S. pyogenes* <SEQ ID 5271> which encodes the amino acid sequence <SEQ ID 5272>. Analysis of this protein sequence reveals the following:

---
Possible site: 19
>>> Seems to have no N-terminal signal sequence
----- Final Results ----
   bacterial cytoplasm --- Certainty = 0.1477 (Affirmative) <succ>
    bacterial membrane --- Certainty = 0.0000 (Not Clear) <succ>
     bacterial outside --- Certainty = 0.0000 (Not Clear) <succ>
---

An alignment of the GAS and GBS proteins is shown below.

```
>GP:BAB04979 GB:AP001511 Fe-S cluster formation protein [Bacillus halodurans]
Identities = 174/373 (46%), Positives = 237/373 (62%), Gaps = 6/373 (1%)

Query: 3      IYLDNAATTALTPSVIEKMTNVMTSNYGNPSSIHTFGRQANQLLRECRQIIAEYLNVNSR    62
              IYLD+AAT+ + P VI+ M       +GNPSSIH FGR+A Q + E R  IA  L  +

Sbjct: 4      IYLDHAATSPVHPEVIQAMLPYYEEQFGNPSSIHQFGRRARQGVDEARGTIARLLQADPS    63

Query: 63     EIIFTSGGTESNNTAIKGYALANQLKGKHIITSEIEHHSVLHTMTYLSERFGFDITYLKP   122
              E IFTSGGTE++N AI GYA  ++ KG HIITS++EHH+VLH    L E  GF++TY+

Sbjct: 64     EFIFTSGGTEADNLAIFGYAYQHRGKGNHIITSQVEHHAVLHACQEL-EHQGFEVTYVPV   122

Query: 123    NH-GQITAKDVQEALRDDTIMVSLMFVNNETGDFLPIQEIGQLLRNHQAVEHVDAVQFS    181
              +  G+++ +DV++ALRDDTI+V+LM+ NNE G   PI EIG LL++HQAV H DAVQ F
Sbjct: 123    DQTGRVSVEDVRQALRDDTILVTLMYGNNEVGTIQPIAEIGALLQDHQAVLHTDAVQAFG   182

Query: 182    KMELDPHSLGIDFLAASAHKFHGPKGVGILYCAPH-HEDSLLHGGDQEEKRRASTENIIG   240
              + ++   L +D L+ SAHK +GPKGVG+LY       L+GG+QE K+RA TEN+
Sbjct: 183    AISIELDHLPVDMLSVSAHKINGPKGVGLLYVRDGIVLKPALYGGEQERKKRAGTENVAA   242

Query: 241    IAGMSQALTDATTNTLKNWTHISQLRTTFLDAISD--LDFYLNNGQDC-LPHVLNIGFPG   297
              I G ++A+ A N +        TF D      + F +N Q   LPH+ N+ FPG
Sbjct: 243    IIGFARAMEIAIANREERQKAYFDYCQTFFDQFQQEGVQFVMNGHQTWRLPHIENVSFPG   302

Query: 298    QNNGLLLTQLDLAGFAVSTGSACTAGTVEPSHVLTSLYGANSPRLNESIRISFSELNTQE   357
              +   LL  LDLAG A S+GSACTAG++EPSHVL +++G++S +    +R SF   NT+E
Sbjct: 303    VHVEALLVNLDLAGIAASSGSACTAGSIEPSHVLVAMHGSDSELVTSGVRFSEGLGNTKE   362

Query: 358    EILELAKTLRKII                                                370
              +     AK    KI+
Sbjct: 363    HVQWAAKETAKIV                                                375
```

```
Identities = 235/370 (63%), Positives = 285/370 (76%)
Query: 2     MIYLDNAATTALTPSVIEKMTNVMTSNYGNPSSIHTFGRQANQLLRECRQIIAEYLNVNS    61
             M Y DNAATT L+P+VI  MT  M  N+GNPSSIH +GR+AN++LRECRQ IA  L   +
Sbjct: 1     MTYFDNAATTPLSPNVIRAMTAAMQDNFGNPSSIHFYGERANKILRECRQAIARNLGASE   60

Query: 62    REIIFTSGGTESNNTAIKGYALANQLKGKHIITSEIEHHSVLHTMTYLSERFGFDITYLK    121
             ++II TSGGTESNN AIKGYALA+Q KGKH+IT+ IEHHSVLHTM YL ERFGF++TYL
Sbjct: 61    QQIIVTSGGTESNNMAIKGYALAHQAKGKHLITTTIEHHSVLHTMAYLEERFGFEVTYLP   120

Query: 122   PNHGQITAKDVQEALRDDTIMVSLMFVNNETGDFLPIQEIGQLLENHQAVFHVDAVQVFS    181
               +GQI   D+++ALRDDTI+VS+M+ NNETGD LPI++IG LL++HQA FHVDAVQ
Sbjct: 121   CQNGQINLSDLKQALRDDTILVSIMYANNETGDLLPIKDIGNLLKDHQAAFHVDAVQAVG   180

Query: 182   KMELDPHSLGIDFLAASAHKFHGPKGVGILYCAPHHFDSLLHGGDQEEKRRASTENIIGI    241
             K+++ P  LGIDFL+ASAHKFHGPKG G LY     D LLHGGDQE KRRASTEN++GI
Sbjct: 181   KLKIIPSELGIDFLSASAHKFHGPKGCGFLYSNGQPIDPLLHGGDQEGKRRASTENMLGI   240

Query: 242   AGMSQALTDATTNTLKNWTHISQLRTTFLDAISDLDFYLNNGQDCLPHVLNIGFPGQNNG    301
               GM+QALTDA T   ++  HI  LR   +   L +Y+N G    LPHVLNIGF G  N
Sbjct: 241   IGMAQALTDAMTCLDQSTDHIISLRHHLISLLEGLPYYINQGTHYLPHVLNIGFLGYQNT   300

Query: 302   LLLTQLDLAGFAVSTGSACTAGTVEPSHVLTSLYGANSPRLNESIEISFSELNTQEEILE    361
             +LLTQLDLAG AVSTGSACTAG V PSHVL + YG +S RL ESIRISFS+ N+ E++ +
Sbjct: 301   ILLTQLDLAGIAVSTGSACTAGAVNPSHVLAAYYGDDSSRLKESIRISFSDQNSIEDVNQ   360

Query: 362   LAKTLRKIIG    371
             LA+TL+ I+G
Sbjct: 361   LAQTLKNILG    370
```

Based on this analysis, it was predicted that these proteins and their epitopes could be useful antigens for vaccines or diagnostics.

Example 1698

A DNA sequence (GBSx1802) was identified in *S. agalactiae* <SEQ ID 5273> which encodes the amino acid sequence <SEQ ID 5274>. Analysis of this protein sequence reveals the following:

Possible site: 43
>>> Seems to have no N-terminal signal sequence
----- Final Results -----
   bacterial cytoplasm --- Certainty = 0.2753 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

>GP:CAB12416 GB:Z99107 ydiH [*Bacillus subtilis*]

A related DNA sequence was identified in *S. pyogenes* <SEQ ID 5275> which encodes the amino acid sequence <SEQ ID 5276>. Analysis of this protein sequence reveals the following:

Possible site: 43
>>> Seems to have no N-terminal signal sequence
----- Final Results -----
   bacterial cytoplasm --- Certainty = 0.2313 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 96/202 (47%), Positives = 140/202 (68%), Gaps = 4/202 (1%)

Query: 7     IPKATAKRLSLYYRIFKRFNTDGIEKASSKQIADALGIDSATVRRDFSYFGELGRRGFGY    66
             IP+ATAKRL LYYR  K  +  G ++ SS +++DA+ +DSAT+RRDFSYFG LG++G+GY
Sbjct: 8     IPQATAKRLPLYYRFLKNLHASGKQRVSSAELSDAVKVDSATIRRDFSYFGALGKKGYGY    67

Query: 67    DVKKLMNFFAEILNDHSTTNVNLVGCGNIGRALLHYRFHDRNKMQISMAFDLDSNDLVGR    126
             +V  L++FF + L+     T+V+L+G GN+G A LHY F   N  +ISMAFD++ + +
Sbjct: 68    NVDYLLSFFRKTLDQDEMTDVILIGVGNLGTAFLHYNFTKNNNTKISMAFDINESKI--G    125

Query: 127   TTEDGIPVYGISTINDHLIDSDIETAILTVPSTEAQEVADILVKAGIKGILSFSPVHLTL    186
             T   G+PVY +  + H+ D  +  AILTVP+  AQ + D LV  GIKGIL+F+P  L  +
Sbjct: 126   TEVGGVEVYNLDDLEQHVEDESV--AILTVPAVAAQSITDRLVALGIKGILNETPARLNV    183

Query: 187   PKDIIVQYVDLTSELQTLLYFM    208
             P+ I + ++DL  ELQ+L+YF+
Sbjct: 184   PEHIRIHHIDLAVELQSLVYFL    205
```

```
Identities = 167/210 (79%), Positives = 189/210 (89%)
Query: 1    MIMDKSIPKATAKRLSLYYRIFKRFNTDGIEKASSKQIADALGIDSATVRRDFSYFGELG    60
            +++DKSIPKATAKRLSLYYRIFKRF+ D +EKASSKQIADA+GIDSATVRRDFSYFGELG
Sbjct: 1    VVIDKSIPKATAKRLSLYYRIFKRFHADQVEKASSKQIADAMGIDSATVRRDFSYFGELG    60

Query: 61   RRGFGYDVKKLMNFFAEILNDHSTTNVMLVGCGNIGRALLHYRFHDRNKMQISMAFDLDS   120
            RRGFGYDV KLMNFFA++LNDHSTTNV+LVGCGNIGRALLHYRFHDRNKMQI+M FD D
Sbjct: 61   RRGFGYDVTKLMNFFADLLNDHSTTNVILVGCGNIGRALLHYRFHDRNKMQIAMGFDTDD   120

Query: 121  NDLVGKTTEDGIPVYGISTINDHLIDSDIETAILTVPSTEAQEVADILVKAGIKGILSFS   180
            N LVG   T D IPV+GIS++ + + ++DIETAILTVPS  AQEV D L++AGIKGILSF+
Sbjct: 121  NALVGTKTADNIPVHGISSVKERIANTDIETAILTVPSIHAQEVTDQLIEAGIKGILSFA   180

Query: 181  PVHLTLPKDIIVQYVDLTSELQTLLYFMNQ                                210
            PVHL +PK +IVQ VDLTSELQTLLYFMNQ
Sbjct: 181  PVHLQVPKGVIVQSVDLTSELQTLLYFMNQ                                210
```

Based on this analysis, it was predicted that these proteins and their epitopes could be useful antigens for vaccines or diagnostics.

Example 1699

A DNA sequence (GBSx1803) was identified in *S. agalactiae* <SEQ ID 5277> which encodes the amino acid sequence <SEQ ID 5278>. Analysis of this protein sequence reveals the following:

Possible site: 43
>>> Seems to have no N-terminal signal sequence
----- Final Results -----
   bacterial cytoplasm --- Certainty = 0.2966 (Affirmative) <succ>
   bacterial membrane --- Certainty = 0.0000 (Not Clear) <succ>
   bacterial outside --- Certainty = 0.0000 (Not Clear) <succ>

A related GBS nucleic acid sequence <SEQ ID 9847> which encodes amino acid sequence <SEQ ID 9848> was also identified.

The protein has homology with the following sequences in the GENPEPT database.

A related DNA sequence was identified in *S. pyogenes* <SEQ ID 5279> which encodes the amino acid sequence <SEQ ID 5280>. Analysis of this protein sequence reveals the following:

Possible site: 59
>>> Seems to have no N-terminal signal sequence
----- Final Results -----
   bacterial cytoplasm --- Certainty = 0.3307 (Affirmative) <succ>
   bacterial membrane --- Certainty = 0.0000 (Not Clear) <succ>
   bacterial outside --- Certainty = 0.0000 (Not Clear) <succ>

```
>GP:CAB14764 GB:Z99118 similar to DNA repair protein [Bacillus subtilis]
Identities = 90/210 (42%), Positives = 136/210 (63%)
Query: 24   PRERLVDLGADRLSNQELLAILLRTGIKEKPVLEISTQILENISSLADFGQLSLQELQSI    83
            PRERL+ +GA+ L+N ELLAILLRTG K + VL++S ++L +     L     + S++EL SI
Sbjct: 19   PRERLLKVGAENLANHELLAILLRTGTKHESVLDLSNRLLRSFDGLRLLKEASVEELSSI    78

Query: 84   KGIGQVKSVEIKAMLELAKRIHKAEYDRKEQILSSEQLARKMMLELGDKKQEHLVAIYMD   143
             GIG VK+++I A +EL  RIHK  +    I S E A  +M ++   QEH V +Y++
Sbjct: 79   PGIGMVKAIQILAAVELGSRIHKLANEEHFVIRSPEDGANLVMEDMRFLTQEHFVCLYLN   138

Query: 144  TQNRIIEQRTIFIGTVRRSVAEPREILHYACKNMATSLIIIHNHPSGSPKPSESDLSFTK   203
            T+N++I +RT+FIG++  S+  PRE+   A K  AS I +HNHPSG P PS  D+  T+
Sbjct: 139  TKNQVIHKRTVFIGSLNSSIVHPREVFKEAFKRSAASFICVHNHPSGDPTPSREDIEVTR   198

Query: 204  KIKRSCDHLGIVCLDHIIVGKNKYYSFREE                                233
            ++    + +GI  LDH+++G  K+ S +E+
Sbjct: 199  RLFECGNLIGIELLDHLVIGDKKFVSLKEK                                228
```

An alignment of the GAS and GBS proteins is shown below.

```
Identities = 145/225 (64%), Positives = 182/225 (80%)
Query: 12   MYHIELKKEALLPRERLVDLGADRLSNQELLAILLRTGIKEKPVLEISTQILENISSLAD    71
            MY I+       +PRERL+ LGA+ LSNQELLAILLRTG KEK VLE+S+ +L ++ SLAD
Sbjct: 1    MYSIKCDDNKAMPRERLMRLGAESLSNQELLAILLRTGNKEKHVLELSSYLLSHLDSLAD    60
```

-continued
```
Query:  72  FGQLSLQELQSIKGIGQVKSVEIKAMLELAKRIHKAEYDRKEQILSSEQLARKMMLELGD   131
            F ++SLQELQ + GIG+VK++EIKAM+EL  RI    +   +L+S Q+A KMM  LGD
Sbjct:  61  FKKMSLQELQHLAGIGKVKAIEIKAMIELVSRILATDKTLTDSVLTSVQVAEKMMAALGD   120

Query: 132  KKQEHLVAIYMDTQNRIIEQRTIFIGTVRRSVAEPREILHYACKNMATSLIIIRNHPSGS   191
            KKQEHLV +Y+D QNRII++TIFIGTVRRS+AEPREIL+YACKNMATSLI+IHNHPSG+
Sbjct: 121  KKQEHLVVLYLDNQNRIIEEKTIFIGTVRRSLAEPREILYYACKNMATSLIVIHNHPSGN   180

Query: 192  PKPSESDLSFTKKIKRSCDHLGIVCLDHIIVGKNKYYSFREEADI                 236
            +PS +D  FT+KIKRSC+ LGI+CLDHIIV     YYSFRE++ +
Sbjct: 181  IEPSSNDYCFTEKIKRSCEDLGIICLDHIIVSYKDYYSFREKSTL                 225
```

Based on this analysis, it was predicted that these proteins and their epitopes could be useful antigens for vaccines or diagnostics.

Example 1700

A DNA sequence (GBSx1804) was identified in *S. agalactiae* <SEQ ID 5281> which encodes the amino acid sequence <SEQ ID 5282>. This protein is predicted to be a permease. Analysis of this protein sequence reveals the following:

---

Possible site: 29
>>> Seems to have an uncleavable N-term signal seq
INTEGRAL    Likelihood = −7.86    Transmembrane 258-274 (255-290)
INTEGRAL    Likelihood = −7.32    Transmembrane 89-105 (79-109)
INTEGRAL    Likelihood = −4.88    Transmembrane 176-192 (170-194)
INTEGRAL    Likelihood = −4.78    Transmembrane 339-355 (326-359)
INTEGRAL    Likelihood = −4.57    Transmembrane 237-253 (236-257)
INTEGRAL    Likelihood = −3.98    Transmembrane 39-55 (38-59)
INTEGRAL    Likelihood = −3.40    Transmembrane 292-308 (282-308)
INTEGRAL    Likelihood = −1.38    Transmembrane 317-333 (317-333)
INTEGRAL    Likelihood = −0.27    Transmembrane 8-24 (8-24)
----- Final Results -----
   bacterial membrane --- Certainty = 0.4142 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the GENPEPT database.

A related DNA sequence was identified in *S. pyogenes* <SEQ ID 5283> which encodes the amino acid sequence <SEQ ID 5284>. Analysis of this protein sequence reveals the following:

---

Possible site: 55
>>> Seems to have an uncleavable N-term signal seq
INTEGRAL    Likelihood = −8.70    Transmembrane 87-103 (83-116)
INTEGRAL    Likelihood = −7.27    Transmembrane 178-194 (166-202)
INTEGRAL    Likelihood = −6.74    Transmembrane 278-294 (256-297)
INTEGRAL    Likelihood = −5.41    Transmembrane 299-315 (295-321)
INTEGRAL    Likelihood = −4.46    Transmembrane 14-30 (13-32)
INTEGRAL    Likelihood = −3.56    Transmembrane 340-356 (333-366)
INTEGRAL    Likelihood = −3.35    Transmembrane 258-274 (256-277)
----- Final Results -----
   bacterial membrane --- Certainty = 0.4482 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the databases:

```
>GP:AAC05771 GB:AF051356 putative permease [Streptococcus mutans]

Identities = 88/366 (24%), Positives = 175/366 (47%), Gaps = 27/366 (7%)

Query:   3  FEKRQVYYVVITFAICYAIQAYW---GAVSNILTTLHKAIF-PFLMGAGIAYIINIVMSV    58
            F+  ++++  +   +   I  W    G++ N   ++ K F PFL+G + YI N +++
Sbjct:   2  FKSSKLFFWTVEILLVTLILFIWRQMGSIFNPFFSVAKTFFLPFLLGGFLYYITNPIVTF    61

Query:  59  YERLYIKLFKGSRLLMAIKRSVSMILSYATFIGLIVWLFSIVIPDLISSLSSLLVIDTGA   118
             E +              IKR  + L +A   + V+    +IP+LI+ L+ L+
Sbjct:  62  LENRF----------KIKRIWGITLIFAVLLSLLVFSITSLIPNLINQLTDLISASQNI   110

Query: 119  LAKLVNNLNENKQISEVLNYMGTDKDLVSTLSGYSQQILKQVLSVLTNLLTSVSSIAATL   178
              L + NE K    N    D+  L ++   + +VL ++   SVSSI     +
Sbjct: 111  YVGLQDLFNEWKSNPAFKNI-----DIPVLLKQFNLSYVDILTNVLDSVTVSVSSIVYMI   165

Query: 179  LNVFVSFIFS----IYVLANKEQLGRQFNLLIDTYLGSTGKTFHYVRHILHQRFHGFFVS   234
             N + ++       Y+L +K+ L      +L  T L +         + + +++    +
Sbjct: 166  TNTVMILVLTPVILFYLLKDKDGL---MPMLDRTILKNDRHNISQLLNQMNKTISRYISG   222

Query: 235  QTLEAMILGSLTVIGMLIFQFPYALTVGVLVAFTALIPVVGAYIGVTIGFILIATESLTE   294
             ++A  +      +IG I   YA     ++    T +IP VG Y+G+T    +     +
Sbjct: 223  VAIDAAFIFVFALIGYQIMGVQYAFLFALVAGITNVIPYVGPYLGTPVVLAYVVSDPKK   282

Query: 295  AFLFVLFLILLQQFEGNVIYPKVVGGSIGLPSMWVLMAITIGGALWGILGMLLAVPVAAT   354
             + +++++ LQQ +GN++YP+VVG ++ +  + +++ + +GG + G++GML+AVP   A
Sbjct: 283  MIIAIIYIMTLQQIDGNIVYPRVVGSTMKIHPLTIMVLLVLGGNIAGLVGMLVAVPAYAI   342

Query: 355  IYQIVK                                                       360
            I +IVK
Sbjct: 343  IKEIVK                                                       348
```

```
>GP:AAC05771 GB:AF051356 putative permease [Streptococcus mutans]
Identities = 87/373 (23%), Positives = 168/373 (44%), Gaps = 41/373 (10%)
Query:  10  FEKKQVFYLVLTFILCYGILANWRNGTAIVTTIYKTS----LPFFYGAAGAYIVNIVMSA    65
            F+  ++F+   +L    IL  WR  +I    +     LPF  G   YI  N +++
Sbjct:   2  FKSSKLFFWTVEILLVTLILFIWRQMGSIFNPFFSVAKTFFLPFLLGGFLYYITNPIVTF   61

Query:  66  YEKVYVYIFKDWSHVLKVKRGICLLLAYLTFFILITWIISIVIPDLITSISTLTKFDT--  123
            E  +              K+KR   + L +      L+ + I+ +IP+LI  ++ L
Sbjct:  62  LENRF----------KIKRIWGITLIFAVLLSLLVFSITSLIPNLINQLTDLISASQNT  110

Query: 124  -ITIQEVVNNLEHNKLLARTIQYIGGDGKLTETIANYSQQLLKQFLTVLTNILTSVTVIA  182
             + +Q++ N  + N                  I    +Q     ++ +LTN+L SVTV
Sbjct: 111  YVGLQDLFNEWKSNPAFKNI------------DIPVLLKQFNLSYVDILTNVLDSVTVSV  158

Query: 183  SAIINLFISFVFSL--------YVLASKEDLCRQGNTLVDTYTGKYAKRIHYLLELLHQR  234
            S+I+ +  + V  L        Y+L  K+ L       L   T        I   LL  +++
Sbjct: 159  SSIVYMITNTVMILVLTPVILFYLLKDKDGLMPM---LDRTILKNDRHNISQLLNQMNKT  215

Query: 235  FHGFFVSQTLEAMILGSLTASGMFILRLPFAGTIGVLVAFTALIPVIGASIGAAIGFILI  294
                 +    ++A +     G  I+ +  +A    ++  T +IP +G  +G      +
Sbjct: 216  ISRYISGVAIDAAFIFVFALIGYQIMGVQYAFLFALVAGITNVIPYVGPYLGLIPVVLAY  275

Query: 295  MIQSMSQAIIFIIFLIILQQIEGNFIYPKVVGGSIGLPAMWVLMAITIGASLKGIVGMII  354
            +    + II II+++ LQQI+GN +YP+VVG ++  +  +++  +  +G ++  G+VGM++
Sbjct: 276  VVSDPKKMIIAIIYIMTLQQIDGNIVYPRVVGSTMKIHPLTIMVLLVLGGNIAGLVGMLV  335

Query: 355  AVPLAATLYQVIK                                                367
            AVP  A +  +++K
Sbjct: 336  AVPAYAIIKEIVK                                                348
```

An alignment of the GAS and GBS proteins is shown below.

```
Identities = 218/370 (58%), Positives = 291/370 (77%)
Query:   1  MKFEKRQVYYVVITFAICYAIQAYWGAVSNILTTLHKAIPPFLMGAGIAYIINIVMSVYE   60
            MKFEK+QV+Y+V+TF +CY I A W    + I+TT++K   PF  GA  AYI+NIVMS YE
Sbjct:   8  MKFEKKQVFYLVLTFILCYGILANWRNGTAIVTTIYKTSLPFFYGAAGAYIVNIVMSAYE   67

Query:  61  RLYIKLFKGSRLLMAIKRSVSMILSYATFIGLIVWLFSIVIPDLISSLSSLLVIDTGALA  120
            ++Y+ +FK     ++ +KR  ++L+Y TF   LI W+ SIVIPDLI+S+S+L    DT +
Sbjct:  68  KVYVYIFKDWSHVLKVKRGICLLLAYLTFFILITWIISIVIPDLITSISTLTKFDTITIQ  127

Query: 121  KLVNNLNENKQISEVLNYMGTDKDLVSTLSGYSQQILKQVLSVLTNLLTSVSSIAATLLN  180
            ++VNNL  NK ++   + Y+G D  L   T++ YSQQ+LKQ L+VLTN+LTSV+ IA+ ++N
Sbjct: 128  EVVNNLEHNKLLARTIQYIGGDGKLTETIANYSQQLLKQFLTVLTNILTSVTVIASAIIN  187

Query: 181  VFVSFIFSIYVLANKEQLGRQFNLLIDTYLGSTGKTFHYVRHILHQRFHGFFVSQTLEAM  240
            +F+SF+FS+YVLA+KE L RQ N L+DTY G  K  HY+  +LHQRFHGFFVSQTLEAM
Sbjct: 188  LFISFVFSLYVLASKEDLCRQGNTLVDTYTGKYAKRIHYLLELLHQRFHGFFVSQTLEAM  247

Query: 241  ILGSLTVIGMLIFQFPYALTVGVLVAFTALIPVVGAYIGVTIGFILIATESLTEAFLFVL  300
            ILGSLT  GM I +  P+A T+GVLVAFTALIPV+GA IG  IGFILI T+S+++A +F++
Sbjct: 248  ILGSLTASGMFILRLPFAGTIGVLVAFTALIPVIGASIGAAIGFILIMTQSMSQAIIFII  307

Query: 301  FLILLQQFEGNVIYPKVVGGSIGLPSMWVLMAITIGGALWGILGMLLAVPVAATIYQIVK  360
            FLI+LQQ EGN IYPKVVGGSIGL+ MWVLMAITIG +L GI+GM++AVP+AAT+YQ++K
Sbjct: 308  FLIILQQIEGNFIYPKVVGGSIGLPAMWVLMAITIGASLKGIVGMIIAVPLAATLYQVIK  367

Query: 361  DHIIKRQTLR                                                  370
            D+I KRQ ++
Sbjct: 368  DNIQKRQAIQ                                                  377
```

Based on this analysis, it was predicted that these proteins and their epitopes could be useful antigens for vaccines or diagnostics.

Example 1701

A DNA sequence (GBSx1805) was identified in *S. agalactiae* <SEQ ID 5285> which encodes the amino acid sequence <SEQ ID 5286>. Analysis of this protein sequence reveals the following:

Possible site: 18
>>> Seems to have no N-terminal signal sequence
----- Final Results -----
  bacterial cytoplasm --- Certainty = 0.1081 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 9849> which encodes amino acid sequence <SEQ ID 9850> was also identified.

The protein has homology with the following sequences in the GENPEPT database.

```
>GP:AAA69226 GB:U29579 6-phospho-beta-glucosidase [Escherichia coli]
Identities = 290/478 (60%), Positives = 369/478 (76%), Gaps = 2/478 (0%)
Query:   2    MVKQVFPKGFLWGGATAANQCEGAYNVDGRGLANVDVVPTGEDRFAIISGQKKMFDFEEG     61
              M   VFP+ FLWGGA AANQ EGA+     +GL VD++P GE R A+  G +K F   +
Sbjct:   1    MKMSVFPESFLWGGALAANQSEGAFREGDKGLTTVDMIPHGEHRMAVKLGLEKRFQLRDD    60

Query:  62    YFYPAKESIDFYHHYKEDLALLAEMGFKTYRMSIAWTRIFPKGDELYPNEAGLQFYENIF   121
                FYP+ E+ DFYH YKED+AL+AEMGEK +R SIAW+R+FP+GDE+ PN+ G+ FY ++F
Sbjct:  61    EFYPSHEATDFYHRYKEDIALMAEMGEKVFRTSIAWSRLFPQGDEITPNQQGIAFYRSVF   120

Query: 122    KECRKYGIEPLVTITHFDCPIYLIKHYGGWRSRKMIGFYERLVRALFTRFKGLVKYWLTF   181
              +EC+KYGIEPLVT+ HFD P++L+  YG WR+RK++ F+ R   R  F  F GLVKYWLTF
Sbjct: 121    EECKKYGIEPLVTLCHFDVPMHLVTEYGSWRNRKLVEFFSRYARTCFEAFDGLVKYWLTF   180

Query: 182    NEINMILHAPFMGAGLYFEDGENQEQIKYQAAHHELVASAIAVKIAHEVDPNNQIGCMLA   241
              NEIN++LH+PF GAGL FE+GENQ+Q+KYQAAHH+LVASA+A KIAHEV+P NQ+GCMLA
Sbjct: 181    NEINIMLHSPFSGAGLVFEEGENQDQVKYQAAHHQLVASALATKIAHEVNPQNQVGCMLA   240

Query: 242    AGQYYPNTCHPQDYWASMQKNRENYFFIDVQARGKYPNYAKKHFEHLGISIQMTAEDLAL   301
              G +YP +C P+D WA+++K+REN FFIDVQARG YP Y+ + F  G++I      D  +
Sbjct: 241    GGNFYPYSCKPEDVWAALEKDRENLFFIDVQARGTYPAYSARVFREKGVTINKAPGDDEI   300

Query: 302    LRDYTVDFISFSYYSSRVABGNPTVSEQVQENIFASLKNPYLKSSEWGWQIDPLGLRITL   361
              L++ TVDF+SFSYY+SR AS       +     N+  SL+NPYL+ S+WGW IDPLGLRIT+
Sbjct: 301    LKN-TVDEVSFSYYASRCASAEMNANNSSAANVVKSLRNPYLQVSDWGWGIDPLGLRITM   359

Query: 362    NAIWDRYQKPMFIVENGLGAVDIPDENGYVEDDYRIDYLRQHIAAMRDAIYVDGVNLIGY   421
              N ++DRYQKP+F+VENGLGA D    NG + DDYRI YLR+HI AM +AI  DG+ L+GY
Sbjct: 360    NMMYDRYQKPLELVENGLGAKDEFAANGEINDDYRISYLREHIRAMGEAI-ADGIPLMGY   418

Query: 422    TTWGCIDLVSAGTGEMEKRYGFIYVDRNNKGEGTLKRYKKKSFYWYKKVIASNGSQIE    479
              TTWGCIDLVSA TGEM KRYGF++VDR++ G GTL R +KKSF+WYKKVIASNG  +E
Sbjct: 419    TTWGCIDLVSASTGEMSKRYGFVFVDRDDAGNGTLTRTRKKSFWWYKKVIASNGEDLE    476
```

There is also homology to SEQ ID 5288.

Based on this analysis, it was predicted that this protein and its epitopes, could be useful antigens for vaccines or diagnostics.

Example 1702

A DNA sequence (GBSx1806) was identified in *S. agalactiae* <SEQ ID 5289> which encodes the amino acid sequence <SEQ ID 5290>. This protein is predicted to be platelet-activating factor acetylhydrolase isoform Ib beta subunit, pu. Analysis of this protein sequence reveals the following:

Possible site: 30
>>> Seems to have no N-terminal signal sequence
----- Final Results -----
  bacterial cytoplasm --- Certainty = 0.5323 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database.

A related DNA sequence was identified in *S. pyogenes* <SEQ ID 5291> which encodes the amino acid sequence <SEQ ID 5292>. Analysis of this protein sequence reveals the following:

Possible site: 35
>>> Seems to have no N-terminal signal sequence
----- Final Results -----
  bacterial cytoplasm --- Certainty = 0.5979 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
>GP:AAC27974 GB:AF016048 platelet-activating factor acetylhydrolase
alpha 2 subunit [Rattus norvegicus]
Identities = 43/177 (24%), Positives = 84/177 (47%), Gaps = 9/177 (5%)
Query:  28    QEGAIVFTGDSIVEF---FPLKKHLGRDYPLVNRGVAGSDTYWLLENLRTQVWELLPSKV     84
              +E  ++F GDS+V+     + + L    +N G+ G  T  +L L+    E +    KV
Sbjct:  38    KEPDVLFVGDSMVQLMQQYEIWRELFSPLHALNEGIGGDTTRHVLWRLKNGELENIKPKV     97

Query:  85    FIL-IGTNDIGLGHSQSEIIANITDIIAEIRAESYMTEINILSVLPVSEEDDYIERVKVR    143
              ++  +GTN+      ++  E+    I  I+     +I +L +LP E+ + + +
Sbjct:  98    IVVWVGTNNHE--NTAEEVAGGIEAIVQLINTRQPQAKIIVLGLLPRGEKPNPLRQKNAK   155

Query: 144    NNQTIKALNKTLSVISGINYIELYDLLVDEKGQLASSETKDGLHLTDQAYAKISETI     200
              NQ +K   +L ++ +++      V  G ++    D LHLT   YAKI + +
Sbjct: 156    VNQLLKV---SLPKLANVQLLDIDGGFVHSDGAISCHDMFDFLHLTGGGYAKICKPL     209
```

```
Identities = 92/204 (45%), Positives = 133/204 (65%)
Query:   1   MLEVIDKALRDYQMKREQFFEINNQTVQEGAIVFTGDSIVEFFPLKKHLGRDYPLVNRGV    60
             MLE++ + LR YQ ++   +    NQ   +G IVF GDS++EFFPLKK  G    P++NRG+
Sbjct:   1   MLEIVSEELRHYQEQKLIEYRNKNQLAPKGGIVFAGDSLIEFFPLKKAFGSCLPIINRGI    60

Query:  61   AGSDTYWLLENLRTQVWELLPSKVFILIGTNDIGLGHSQSEIIANITDIIAEIRAESYMT   120
             AG D+ WLL +   Q+ +L P  +F+LIG NDIGLG+ +   I+   I ++I++IR+     +
Sbjct:  61   AGIDSQWLLRHFSVQITDLEPKHIFLLIGCNDIGLGYDKCHIVKTIVELISQIRSHCVYS   120

Query: 121   EINILSVLPVSEEDDYIERVKVRNNQTIKALNKTLSVISGINYIELYDLLVDEKGQLASS   180
             +I +LS+LPVS    Y + VK+R N   I A+NK L++I  + +I L    L DEKG L+
Sbjct: 121   QIYLLSLLPVSNNPRYQKTVKIRTNAMIDAINKDLAMIPTVEFINLNTCLKDEKGGLSDE   180

Query: 181   FTKDGLHLTDQAYAKISETIKLYL                                      204
              T DGLHL    AYAK++E IK Y+
Sbjct: 181   NTLDGLHLNFPAYAELAEIIKSYI                                      204
```

Based on this analysis, it was predicted that these proteins and their epitopes could be useful antigens for vaccines or diagnostics.

Example 1703

A DNA sequence (GBSx1807) was identified in *S. agalactiae* <SEQ ID 5293> which encodes the amino acid sequence <SEQ ID 5294>. Analysis of this protein sequence reveals the following:

---

Possible site: 43
>>> Seems to have no N-terminal signal sequence
----- Final Results -----
    bacterial cytoplasm --- Certainty = 0.5226 (Affirmative) <succ>
      bacterial membrane --- Certainty = 0.0000 (Not Clear) <succ>
        bacterial outside --- Certainty = 0.0000 (Not Clear) <succ>

---

A related GBS nucleic acid sequence <SEQ ID 9851> which encodes amino acid sequence <SEQ ID 9852> was also identified.

The protein has homology with the following sequences in the GENPEPT database.

There is also homology to SEQ ID 1158.

Based on this analysis, it was predicted that this protein and its epitopes, could be useful antigens for vaccines or diagnostics.

Example 1704

A DNA sequence (GBSx1808) was identified in *S. agalactiae* <SEQ ID 5295> which encodes the amino acid sequence <SEQ ID 5296>. This protein is predicted to be transcriptional regulator (AraC/XylSfamily). Analysis of this protein sequence reveals the following:

---

Possible site: 50
>>> Seems to have no N-terminal signal sequence
----- Final Results -----
    bacterial cytoplasm --- Certainty = 0.4984 (Affirmative) <succ>
      bacterial membrane --- Certainty = 0.0000 (Not Clear) <succ>
        bacterial outside --- Certainty = 0.0000 (Not Clear) <succ>

---

The protein has homology with the following sequences in the GENPEPT database.

```
>GP:BAA35556 GB:D90723 Hypothetical 30.2 kd protein in idh-deoR
intergenic region. [Escherichia coli]

Identities = 104/265 (39%), Positives = 154/265 (57%), Gaps = 4/265 (1%)
Query:   2   IKLIATDMDGTFLRSDKTYDKARFSSLLTLMEKYDIKFVAASGNLYDQLLLNFLEYPNRI    61
             IKLIA DMDGTFL   KTY++ RF +    M+   I+FV ASGN Y QL+  F E   N I
Sbjct:   4   IKLIAVDMDGTFLSDQKTYNRERFMAQYQQMKAQGIRFVVASGNQYYQLISFFPEIANEI    63

Query:  62   AYVAENGGRVIDQDGTLLKETYLSNDTVAAVLSYLYQNYPETLISLSGEKRSYLERRTPI   121
             A+VAENGG V+ + G +     LS D  A V+ +L    PE I    G+ +Y  +Y  ++
Sbjct:  64   AFVAENGGWVVSE-GKDVFNGELSKDAFATVVEHLLTR-PEVEIIACGKNSAYTLKKYDD   121

Query: 122   NRRTELEYYMPNFIYKDHLLPLDDDRYFQMTLWVNENLVSEMLLDISEHFKNHHIRLTSS   181
                 +T  E Y     Y D+    L+D  +F+  L +++ L+ ++     + E      +    +    +
Sbjct: 122   AMKTVAEMYYHRLEYVDNFDNLEDI-FFKFGLNLSDELIPQVQKALHEAIGDIMVSV-HT   179

Query: 182   GFGCIDVLPADVNKADGIAILLEKWGLKQDQVMVFGDGGNDVEMLRAANISYAMSNAPEE   241
                G  G ID++    V+KA+G+  L + WG+     +V+VFGDGGND+EMLR  A   S+AM NA
Sbjct: 180   GNGSIDLIIPGVHKANGLRQLQKLWGIDDSEVVVFGDGGNDIEMLRQAGFSFAMENAGSA   239

Query: 242   IKAIAKYQTVSNDQDGVLETIENFL                                     266
             + A AKY+  SN+++GVL+ I+  L
Sbjct: 240   VVAAAKYRAGSNNREGVLDVIDKVL                                     264
```

```
>GP:AAF89977 GB:AF206272 transcriptional regulator [Streptococcus mutans]
Identities = 195/287 (67%), Positives = 237/287 (81%)
Query:   5  DNLLSHNLEDNRHLLPYEHMHTEVRNGYPDILFHWHPELEISYVHEGTARYHIDYDFFNS    64
            D    H +  + LLPY+    T + NGYPD LFHWHPELEISY++EGTA+YHIDYD+FNS
Sbjct:  10  DENFKHEINFDNDLLPYKIYQTTIANGYPDTLFHWHPELEISYIYEGTAQYHIDYDYFNS    69

Query:  65  QSGDIILIRPNGMHSIHPIENKEHITDSIKFHLDLIGYSIVDQVSLRYLQPLQTSSFKFI   124
            Q+ DIIL+RPNGMHSIHPI+NK      ++ FHLDL+GYS++DQ+SLRYLQPLQ S+FK +
Sbjct:  70  QTDDIILVRPNGMHSIHPIKNKMQKAQTLLFHLDLVGYSLLDQISLRYLQPLQNSTFKLV   129

Query: 125  QCIKPSMTGYNDIKNCLFDIFNISKEENRHFELLLKAKLNELLYLLYYHQYVIKKHTDDT   184
             CIKP M GY DIKNCLF IF+I + + RHFELLLKAKL EL+YLLY+HQYV++KH+DD
Sbjct: 130  PCIKPDMLGYQDIKNCLFAIFDIYQRQGRHFELLLKAKLQELIYLLYFHQYVLRKHSDDM   189

Query: 185  YRKNERIRDLIDYINNNYQQNLTIEFLADYMGYSKTHFMTVFKQHTGSCTEFIIQVRLN    244
            YRKNE+IR+LIDYI+  +YQ+ L+I   LAD +GYSKTHFMTVFKQHTGTSCT+FIIQ RL+
Sbjct: 190  YRKNEKIRELIDYIHQHYQEKLSIISLADIIGYSKTHFMTVFKQHTGTSCTDFIIQFRLS   249

Query: 245  KASEHLINSTTAIIDIANSVGFNNLSNFNRQFKRYYHTTPRQYRKQF                291
            KA + L+NS    I+++A+ VGF NLSNFNRQFKRYY  TP QYRKQF
Sbjct: 250  KACDLLVNSIKPILEVASEVGFTNLSNFNRQFKRYYQITPSQYRKQF                296
```

A related DNA sequence was identified in S. pyogenes <SEQ ID 5297> which encodes the amino acid sequence <SEQ ID 5298>. Analysis of this protein sequence reveals the following:

Possible site: 28
>>> Seems to have no N-terminal signal sequence
----- Final Results -----
    bacterial cytoplasm --- Certainty = 0.1000 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below.

```
Identities = 43/169 (25%), Positives = 83/169 (48%), Gaps = 16/169 (9%)
Query: 136  DIKNCLFDIFNISKEENRHFELLLKAKLNELLYLLYYHQYV------IKKHTDDTYRKN-   188
            D+K+  F +F+   + R F +L K     ++ ++   Q +       +KK  D T + N
Sbjct: 319  DVKHVSFLLFS---DIYRQFPILDKMTYLSMVKTIHDSQSIDCILRELKKVLDVTNQNNS   375

Query: 189  ------ERIRDLIDYINNNYQQNLTIEFLADYMGYSKTHFMTVFKQHTGSCTEFIIQVR    242
                  + + + ID I   Y Q LT++ +AD +   +    FK  T  S T+++  VR
Sbjct: 376  PEKRYSDLVSETIDCIRKEYHQELTLKAIADRLHVNGVYLGQCFKNETERSFTQYLNHVR   435

Query: 243  LNKASEHLINSTTAIIDIANSVGFNNLSNFNRQFKRYYHTTPRQYRKQF             291
            + KA + L+ +    +I +IA    G+N     F + FK+       +P+++R ++
Sbjct: 436  IQKAQQLLLYTNQSINEIAYETGYNTNHYFIKMFKKLNGLSPKEFRDRY             484
```

Based on this analysis, it was predicted that these proteins and their epitopes could be useful antigens for vaccines or diagnostics.

Example 1705

A DNA sequence (GBSx1809) was identified in S. agalactiae <SEQ ID 5299> which encodes the amino acid sequence <SEQ ID 5300>. Analysis of this protein sequence reveals the following:

Possible site: 34
>>> Seems to have no N-terminal signal sequence
----- Final Results -----
    bacterial cytoplasm --- Certainty = 0.3705 (Affirmative) <succ>
      bacterial membrane --- Certainty = 0.0000 (Not Clear) <succ>
        bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1706

A DNA sequence (GBSx1810) was identified in S. agalactiae <SEQ ID 5301> which encodes the amino acid sequence <SEQ ID 5302>. Analysis of this protein sequence reveals the following:

Possible site: 39
>>> Seems to have no N-terminal signal sequence
INTEGRAL    Likelihood = −11.25    Transmembrane 59-75 (56-82)
INTEGRAL    Likelihood = −7.48    Transmembrane 23-39 (12-41)
INTEGRAL    Likelihood = −6.64    Transmembrane 231-247 (225-255)
INTEGRAL    Likelihood = −5.15    Transmembrane 335-351 (333-355)
INTEGRAL    Likelihood = −4.19    Transmembrane 309-325 (305-327)
INTEGRAL    Likelihood = −4.14    Transmembrane 272-288 (268-292)
INTEGRAL    Likelihood = −4.04    Transmembrane 402-418 (400-419)
INTEGRAL    Likelihood = −3.88    Transmembrane 191-207 (190-208)
INTEGRAL    Likelihood = −2.71    Transmembrane 365-381 (364-381)
INTEGRAL    Likelihood = −1.86    Transmembrane 165-181 (164-182)
----- Final Results -----
    bacterial membrane --- Certainty = 0.5501 (Affirmative) <succ>
      bacterial outside --- Certainty = 0.0000 (Not Clear) <succ>
        bacterial cytoplasm --- Certainty = 0.0000 (Not Clear) <succ>

The protein has homology with the following sequences in the GENPEPT database.

```
>GP:AAF96429 GB:AE004383 conserved hypothetical protein [Vibrio cholerae]
Identities = 142/443 (32%), Positives = 241/443 (54%), Gaps = 20/443 (4%)
Query:   6  NEFQFSLESILGFVWRGIVVGLIAGFVVSIFRLAIEKIFLVVMELYKS--AHYQPIILLS      63
            N+F       ++      ++  ++VG++AG V + F  A+  +       + KS    + P+ L +
Sbjct:  21  NQFLSKDKTPFSVLFLSLLVGILAGLVGTYFEQAVHLVSETRTDWLKSEIGSFLPLWLAA     80

Query:  64  ITVTSIIAAVIIGFFI--KSDPDIKGSGIPHVEGELKGMLSPDWFSIVWKKFIAGILAIS    121
            +++ +A   IG+F+ +    P+  GSGIP +EG + GM      W+ ++  KF  G+ A+
Sbjct:  81  FLISAFLA--FIGYFLVHRFAPEAAGSGIPEIEGAMDGMRPVRWWRVLPVKFFGGMGALG    138

Query: 122  SGLMLGREGPSIQLGAMTGKGIAQYLNASRMEKR-VLIASGAAAGLSAAFNAPIAGLLFV    180
            SG++LGREGP++Q+G     G+ I+           + R   L+A+GAA GL+AAFNAP+AG++FV
Sbjct: 139  SGMVLGREGPTVQMGGAVGRMISDIFRVKNEDTRHSLLAAGAAGGLAAAFNAPLAGIMFV    198

Query: 181  VEEIYHHFS-RLVWITALVASLV-ANFVSLNIFGLTPVLALPSELPSLNLNFYWIFLLMG    238
            +EE+    F    L+ + A++ S V AN V    I G    V+ +P +  + L+    +FLL+G
Sbjct: 199  IEEMRPQFRYTLISVRAVIISAVAANIVFRVINGQDAVITMP-QYDAPELSTLGLFLLLG    257

Query: 239  LFLGILGFIYEWVIL----RFHVIYDYLGKLFHLPSHLYGILAVIFILPIGYYFPQLLGG    294
              G+ G ++  ++I           F  +    K + L   + G       + +L  Y P+L  GG
Sbjct: 258  ALFGVFGVLFNYLITLAQDLFVKFHRNDRKRYLLTGSMIGGCFGLLLL----YVPELTGG    313

Query: 295  GNGLIVSLPRSNLSLMMLGLFFLIRFLWSMLSYSSGLPGGIFLPILALGSLAG-AFFAVG    353
             G  LI ++            +L L F+ R     ++L + SG PGGIF P+LALG+L G AF +
Sbjct: 314  GISLIPTITNGGYGAGILLLLFVGRIFTTLLCFGSGAPGGIFAPMLALGTLFGYAFGLIA    373

Query: 354  MQYFGIISHQQISLFVVLGMAGYFGAISKAPLTAMILVTEMVGDLKQLMAIGIVTMVSYI    413
             +F  ++ +    +F + GM      F A   +AP+T ++LV EM +    ++ + I ++ + I
Sbjct: 374  KMWFPELNIEP-GMFAIAGMGALFAATVRAPITGILLVIEMTNNYHLILPLIITSLGAVI    432

Query: 414  VMDLLKGEPIYEAMLAKMTFNPK                                        436
              LL G+PIY  +L +    N K
Sbjct: 433  FAQLLGGQPIYSQLLHRTLKNQK                                        455
```

A related DNA sequence was identified in *S. pyogenes* <SEQ ID 5303> which encodes the amino acid sequence <SEQ ID 5304>. Analysis of this protein sequence reveals the following:

Possible site: 31
>>> Seems to have no N-terminal signal sequence
INTEGRAL    Likelihood = −11.68   Transmembrane 71- 87 (66-95)
INTEGRAL    Likelihood = −9.45    Transmembrane 36-52 (26-56)
INTEGRAL    Likelihood = −5.63    Transmembrane 346-362 (342-367)
INTEGRAL    Likelihood = −5.36    Transmembrane 376-392 (375-393)
INTEGRAL    Likelihood = −5.15    Transmembrane 413-429 (410-432)
INTEGRAL    Likelihood = −5.10    Transmembrane 321-337 (318-340)
INTEGRAL    Likelihood = −4.19    Transmembrane 203-219 (202-220)
INTEGRAL    Likelihood = −4.19    Transmembrane 244-260 (242-265)
INTEGRAL    Likelihood = −4.19    Transmembrane 284-300 (280-304)
INTEGRAL    Likelihood = −1.86    Transmembrane 177-193 (176-194)
----- Final Results -----
  bacterial membrane --- Certainty = 0.5670 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP:AAF96429 GB:AE004383 conserved hypothetical protein [Vibrio cholerae]
Identities = 144/442 (32%), Positives = 236/442 (52%), Gaps = 30/442 (6%)
Query:  18  NEFTFSNKSIIAYVWRGVVVGIIAGVIVSLFRLLIEVTADWVIEWYRYAHINSLLLLPIL    77
            N+F    +K+   +     ++VGI+AG++ + F     + ++      +W + + I S L L +
Sbjct:  21  NQFLSKDKTPFSVLFLSLLVGILAGLVGTYFEQAVHLVSETRTDWLK-SEIGSFLPLWLA     79

Query:  78  SVSLLAVL-FVGFLV--KSDSDIKGSGIPHVEGELKGMLSPDWWSVLWKKFLGGIMAISM    134
            +    + A L F+G+  +     +    GSGIP +EG + G+      WW VL    KF GG+ A+
Sbjct:  80  AFLISAFLAFIGYFLVHRFAPEAAGSGIPEIEGAMDGMRPVRWWRVLPVKFFGGMGALGS    139

Query: 135  GFMLGREGPSIQLGAMSAKGLAKFLKSSRLEKR-VLIASGAAAGLSAAFNAPIAGLLFVV    193
            G +LGREGP++Q+G      +  ++     + R   L+A+GAA GL+AAFNAP+AG++FV+
Sbjct: 140  GMVLGREGPTVQMGGAVGRMISDIFRVKNEDTRHSLLAAGAAGGLAAAFNAPLAGIMFVI    199

Query: 194  EEIYHHFS-RLIWITALVASLV-ANFISLNIFGLKPVLAMSEAMPFLGLNQYWLLLLLGL    251
            EE+    F   LI + A++ S V AN +    I G    V+ M +          L+   L LLLG
Sbjct: 200  EEMRPQFRYTLISVRAVIISAVAANIVFRVINGQDAVITMPQ-YDAPELSTLGLFLLLGA    258

Query: 252  FLGCLGYLYEIVIL----------NFNKLYVILGSWLHLPDYFYGIIMVFLILPIGYYL    300
              G  G L+  +I              N  K Y++ GS +           +G++++       Y+
Sbjct: 259  LFGVFGVLFNYLITLAQDLFVKFHRNDRKRYLLTGSMI---GGCFGLLLL--------YV    307

Query: 301  PQLLGGGHGLILSLSNQQLPLMTIFFYFIIRFIVSMFSYGSGLPGGIFLPILTLGALAGL    360
            P+L  GG  LI +++N        +   F+ R    ++ +GSG PGGIF P+L LG L G
Sbjct: 308  PELTGGGISLIPTITNGGYGAGILLLLFVGRIFTTLLCFGSGAPGGIFAPMLALGTLFGY    367

Query: 361  LFGQIASQLGLLNQSFLSLFLILGMAGYFAAISKAPLTGMILVTEMVGDLKPLMAIAVVT    420
```

```
                  FG IA           +F I GM     FAA   +AP+TG++LV EM  +   ++ + + +
Sbjct: 368  AFGLIAKMWFPELNIEPGMFAIAGMGALFAATVRAPITGILLVIEMTNNYHLILPLIITS   427

Query: 421  FVSYLVMDLLNGQPIYEAMLDK                                         442
              + +    LL GQPIY  +L +
Sbjct: 428  LGAVIFAQLLGGQPIYSQLLHR                                         449
```

An alignment of the GAS and GBS proteins is shown below.

```
Identities = 343/510 (67%), Positives = 410/510 (80%)
Query:   1  MENHKNEFQFSLESILGFVWRGIVVGLIAGFVVSIFRLAIEKIFLVVMELYKSAHYQPII    60
            MENHKNEF  FS +SI+ +VWRG+VVG+IAG +VS+FRL IE     V+E Y+ AH   ++
Sbjct:  13  MENHKNEFTFSNKSIIAYVWRGVVVGIIAGVIVSLFRLLIEVTADWVIEWYRYAHINSLL    72

Query:  61  LLSITVTSIIAAVIIGFFIKSDPDIKGSGIPHVEGELKGMLSPDWFSIVWKKFIAGILAI   120
            LL I   S++A + +GF +KSD DIKGSGIPHVEGELKG++SPDW+ S++WKKF+ GI+AI
Sbjct:  73  LLPILSVSLLAVLFVGFLVKSDSDIKGSGIPHVEGELKGLMSPDWWSVLWKKFLGGIMAI   132

Query: 121  SSGLMLGREGPSIQLGAMTGKGIAQYLNASRMEKRVLIASGAAAGLSAAFNAPIAGLLFV   180
            S G MLGREGPSIQLGAM+ KG+A++L +SR+EKRVLIASGAAAGLSAAFNAPIAGLLFV
Sbjct: 133  SMGFMLGREGPSIQLGAMSAKGLAKFLKSSRLEKRVLIASGAAAGLSAAFNAPIAGLLFV   192

Query: 181  VEEIYHHFSRLVWITALVASLVANFVSLNIFGLTPVLALPSELPSLNLNFYWIFLLMGLF   240
            VEEIYHHFSRL+WITALVASLVANF+SLNIFGL PVLA+    +P L LN YW+ LL+GLF
Sbjct: 193  VEEIYHHFSRLIWITALVASLVANFISLNIFGLKPVLAMSEAMPFLGLNQYWLLLLLGLF   252

Query: 241  LGILGFIYEWVILRFHVIYDYLGKLFHLPSHLYGILAVIFILPIGYYFPQLLGGGNGLIV   300
            LG LG++YE VIL F+ +Y  LG   HLP + YGI+ V  ILPIGYY PQLLGG+GLI+
Sbjct: 253  LGCLGYLYEIVILNFNKLYVILGSWLHLPDYFYGIIMVFLILPIGYYLPQLLGGGHGLIL   312

Query: 301  SLPRSNLSLMMLGLFFLIRFLWSMLSYSSGLPGGIFLPILALGSLAGAFFAVGMQYFGII   360
            SL   L LM +  +F+IRF+ SM SY SGLPGGIFLPIL LG+LAG  F       G++
Sbjct: 313  SLSNQQLPLMTIFFYFIIRFIVSMFSYGSGLPGGIFLPILTLGALAGLLFGQIASQLGLL   372

Query: 361  SHQQISLFVVLGMAGYFGAISKAPLTAMILVTEMVGDLKQLMAIGIVTMVSYIVMDLLKG   420
            +   +SLF++LGMAGYF AISKAPLT MILVTEMVGDLK LMAI +VT VSY+VMDLL G
Sbjct: 373  NQSFLSLFLILGMAGYFAAISKAPLTGMILVTEMVGDLKPLMAIAVVTFVSYLVMDLLNG   432

Query: 421  EPIYEAMLAKMTFNPKDKVMTPTLIELTVSDKISGKYVRDLELPENVLITTQIHHKTSAV   480
            +PIYEAML  KM       ++ PTLIELTV DKI+GKYV++L+LPENVLITTQIHH+  S V
Sbjct: 433  QPIYEAMLDKMAMKHPTNLVEPTLIELTVGDKIAGKYVKELKLPENVLITTQIHHQKSQV   492

Query: 481  VSGNTILNAGDTIFLVVNESEIKEVREQLM                                510
            VSGNT L +G TIFLVVNE++   VRE LM
Sbjct: 493  VSGNTRLLSGATIFLVVNEADTGFVREVLM                                522
```

Based on this analysis, it was predicted that these proteins and their epitopes could be useful antigens for vaccines or diagnostics.

Example 1707

A DNA sequence (GBSx1811) was identified in *S. agalactiae* <SEQ ID 5305> which encodes the amino acid sequence <SEQ ID 5306>. This protein is predicted to be spermidine/putrescine-binding periplasmic protein precursor (potD-1). Analysis of this protein sequence reveals the following:

Possible site: 38
>>> Seems to have an uncleavable N-term signal seq
INTEGRAL    Likelihood = −9.02    Transmembrane 20-36 (14-40)
----- Final Results -----
  bacterial membrane --- Certainty = 0.4609 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 8881> which encodes amino acid sequence <SEQ ID 8882> was also identified. Analysis of this protein sequence reveals the following:

Lipop: Possible site: −1    Crend: 2
SRCFLG: 0
McG: Length of UR: 22
Peak Value of UR: 4.16
Net Charge of CR: 2
McG: Discrim Score: 18.94
GvH: Signal Score (−7.5): −3.29
Possible site: 25
>>> Seems to have an uncleavable N-term signal seq
Amino Acid Composition: calculated from 1
ALOM program    count: 1 value: −9.02 threshold: 0.0
INTEGRAL       Likelihood = −9.02    Transmembrane 7-23 (1-27)
PERIPHERAL     Likelihood = 6.05       170
modified ALOM score: 2.30
icml HYPID: 7 CFP: 0.461
*** Reasoning Step: 3
----- Final Results -----
  bacterial membrane --- Certainty = 0.4609 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the GENPEPT database.

```
>GP:AAF94581 GB:AE004221 spermidine/putrescine ABC transporter,
periplasmic spermidine/putrescine-binding protein [Vibrio cholerae]
Identities = 126/327 (38%), Positives = 196/327 (59%), Gaps = 2/327 (0%)
Query:  42  SSSTPNSDKLVIYNWGDYIDPALLKKFTKETGIEVQYETFDSNEAMHTKIKQGGTTYDIA    101
            +++     +L  YNW +YI   +L+ FTKETGI+V Y T++SNE+M+ K+K  G  YD+
Sbjct:  18  TNAMAKDQELYFYNWSEYIPSEVLEDFTKETGIKVIYSTYESNESMYAKLKTQGAGYDLV    77

Query: 102  VPSDYMIDKMIKENLLVKLDHSKIANWDAIGARFKNLSFDPKNKYSIPYFWGTVGIVYN-    160
            VPS Y + KM KE +L ++DHSK++++  +    + N  FDP NK+SIPY WG  GI  N
Sbjct:  78  VPSTYFVSKMRKEGMLQEIDHSKLSHFKDLDPNYLNKPFDPGNKFSIPYIWGATGIGINT   137

Query: 161  DQLVKTPPKHWDDLWRPEFRNKIMLVDSAREVIGVGLNSLGYGLNTKNISELKAASKKLD    220
            D L K    K+W DLW  ++  ++ML+D AREV  + L+ LGY  NT N  E+KAA ++L
Sbjct: 138  DMLDKKSLKNWGDLWDAKWAGQLMLMDDAREVFHIALSKLGYSPNTTNPKEIKAAYRELK    197

Query: 221  ALTPNVKAIVADEMKGYMIQGDAAIGVTFSGEAREMLDGNKHLHYVVPSEGSNLWFDNIV    280
              L PNV   +D    + G+ ++G+ ++G A    +   + P +G+  W D+I
Sbjct: 198  KLMPNVLVFNSDFPANPYLAGEVSLGMLWNGSAYMARQEGAPIQIIWPEKGTIFWMDSIS   257

Query: 281  IPKTVKHRKEAYAFINFMMEPKNAAQNAEYIGYATPNLKAKALLPADIKNDKAFYPPDKT    340
            IP    K+ + A+   I+F++ P+NAA+ A   IGY TP   A   LLP +  ND + YPP
Sbjct: 258  IPAGAKNIEAAHKMIDFLLRPENAAKIALEIGYPTPVKTAHDLLPKEFANDPSIYPPQSV   317

Query: 341  IDHLEVYNNLGQKWLGIYNDLYLQFKM                                   367
            ID+ E   +G+   +Y++  + + K+
Sbjct: 318  IDNGEWQDEVGEASV-LYDEYFQKLKV                                   343
```

A related DNA sequence was identified in *S. pyogenes* <SEQ ID 5307> which encodes the amino acid sequence <SEQ ID 5308>. Analysis of this protein sequence reveals the following:

Possible site: 22
>>> Seems to have an uncleavable N-term signal seq

-continued

INTEGRAL    Likelihood = –8.44    Transmembrane 8-24 (1-27)
----- Final Results -----
  bacterial membrane --- Certainty = 0.4376 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP:AAC74207 GB:AE000212 spermidine/putrescine periplasmic transport
protein [Escherichia coli]
Identities = 134/342 (39%), Positives = 199/342 (58%), Gaps = 3/342 (0%)
Query:  17  ILTSLSFILQKKSGSGSQSDKLVIYNWGDYIDPALLKKFTKETGIEVQYETFDSNEAMYT    76
            +L + +  L  +        ++  L  YNW +Y+ P  LL++FTKETGI+V Y T++SNE MY
Sbjct:   8  LLAAGALALGMSAAHADDNNTLYFYNWTEYVPPGLLEQFTKETGIKVIYSTYESNETMYA    67

Query:  77  KIKQ-GGTTYDIAVPSDYTIDKMIKENLLNKLDKSKLVGMDNIGKEFLGKSFDPQNDYSL    135
            K+K      YD+ VPS Y +DKM KE ++  K+DKSKL     N+   + L K FDP NDYS+
Sbjct:  68  KLKTYKDGAYDLVVPSTYYVDKMRKEGMIQKIDKSKLTNFSNLDPDMLNKPFDPNNDYSI    127

Query: 136  PYFWGTVGIVYNDQLVD-KAPMHWEDLWRPEYKNSIMLIDGAREMLGVGLTTFGYSVNSK    194
            PY WG    I  N  VD K+    W DLW+PEYK S++L D ARE+    + L   GYS N++
Sbjct: 128  PYIWGATAIGVNGDAVDPKSVTSWADLWKPEYKGSLLLTDDAREVFQMALRKLGYSGNTT    187

Query: 195  NLEQLQAAERKLQQLTPNVKAIVADEMKGYMIQGDAAIGITFSGEASEMLDSNEHLHYIV    254
            + ++++AA +L++L PNV A  +D      ++G+ +G+ ++G A        +  +  +
Sbjct: 188  DPKEIEAAYNELKKLMPNVAAFNSDNPANPYMEGEVNLGMIWNGSAFVARQAGTPIDVVW    247

Query: 255  PSEGSNLWFDNLVLPKTMKHEKEAYAFLNFINRPENAAQNAAYIGYATPNKKAKALLPDE    314
            P EG   W D+L +P  K+++  A   +NF+ RP+ A Q A   IGY TPN  A+ LL E
Sbjct: 248  PKEGGIFWMDSLAIPANAKNKEGALKLINFLLRPDVAKQVAETIGYPTPNLAARKLLSPE    307

Query: 315  IKNDPAFYPTDDIIKKLEVYDNLGSRWLGIYNDLYLQFKMYR                    356
             + ND     YP +  IK E +++G+      IY + Y + K  R
Sbjct: 308  VANDKTLYPDAETIKNGEWQNDVGAA-SSIYEEYYQKLKAGR                    348
```

An alignment of the GAS and GBS proteins is shown below.

```
Identities = 270/357 (75%), Positives = 306/357 (85%)
Query:  14  MRRVYSFLGGIVLVILILFGLTTYLEKKSSSTPNSDKLVIYNWGDYIDPALLKKFTKETG    73
            MR++YSFL G++  VI+IL  L+     L+KKS S    SDKLVIYNWGDYIDPALLKKFTKETG
Sbjct:   1  MRKLYSFLAGVLGVIVILTSLSFILQKKSGSGSQSDKLVIYNWGDYIDPALLKKFTKETG    60

Query:  74  IEVQYETFDSNEAMHTKIKQGGTTYDIAVPSDYMIDKMIKENLLVKLDHSKIANWDAIGA   133
```

-continued

```
            IEVQYETFDSNEAM+TKIKQGGTTYDIAVPSDY IDKMIKENLL KLD SK+    D IG
Sbjct:  61  IEVQYETFDSNEAMYTKIKQGGTTYDIAVPSDYTIDKMIKENLLNKLDKSKLVGMDNIGK   120

Query: 134  RFKNLSFDPKNKYSIPYFWGTVGIVYNDQLVKTPPKHWDDLWRPEFRNKIMLVDSAREVI   193
               F   SFDP+N YS+PYFWGTVGIVYNDQLV   P HW+DLWRPE++N IML+D ARE++
Sbjct: 121  EFLGKSFDPQNDYSLPYFWGTVGIVYNDQLVDKAPMHWEDLWRPEYKNSIMLIDGAREML   180

Query: 194  GVGLNSLGYGLNTKNISELKAASKKLDALTPNVKAIVADEMKGYMIQGDAAIGVTFSGEA   253
            GVGL + GY +N+KN+ +L+AA +KL  LTPNVKAIVADEMKGYMIQGDAAIG+TFSGEA
Sbjct: 181  GVGLTTFGYSVNSKNLEQLQAAERKLQQLTPNVKAIVADEMKGYMIQGDAAIGITFSGEA   240

Query: 254  REMLDGNKHLHYVVPSEGSNLWFDNIVIPKTVKHRKEAYAFINFMMEPKNAAQNAEYIGY   313
             EMLD N+HLHY+VPSEGSNLWFDN+V+PKT+KH KEAYAF+NF+   P+NAAQNA YIGY
Sbjct: 241  SEMLDSNEHLHYIVPSEGSNLWFDNLVLPKTMKHEKEAYAFLNFINRPENAAQNAAYIGY   300

Query: 314  ATPNLKAKALLPADIKNDKAFYPPDKTIDHLEVYNNLGQKWLGIYNDLYLQFKMYRK      370
            ATPN KAKALLP +IKND AFYP D  I   LEVY+NLG +WLGIYNDLYLQFKMYRK
Sbjct: 301  ATPNKKAKALLPDEIKNDPAFYPTDDIIKKLEVYDNLGSRWLGIYNDLYLQFKMYRK      357
```

SEQ ID 8882 (GBS135) was expressed in *E. coli* as a His-fusion product. SDS-PAGE analysis of total cell extract is shown in FIG. 35 (lane 6; MW 40 kDa).

GBS135-His was purified as shown in FIG. 201, lane 10.

Based on this analysis, it was predicted that these proteins and their epitopes could be useful antigens for vaccines or diagnostics.

Example 1708

A DNA sequence (GBSx1812) was identified in *S. agalactiae* <SEQ ID 5309> which encodes the amino acid sequence <SEQ ID 5310>. This protein is predicted to be spermidine/putrescine ABC transporter, permease protein (potC). Analysis of this protein sequence reveals the following:

---

Possible site: 51
>>> Seems to have an uncleavable N-term signal seq
INTEGRAL    Likelihood = −12.05    Transmembrane 17-33 (10-37)
INTEGRAL    Likelihood = −8.65     Transmembrane 236-252 (232-259)
INTEGRAL    Likelihood = −7.75     Transmembrane 137-153 (132-158)
INTEGRAL    Likelihood = −7.17     Transmembrane 63-79 (60-92)
INTEGRAL    Likelihood = −6.32     Transmembrane 108-124 (107-136)
----- Final Results -----
   bacterial membrane --- Certainty = 0.5819 (Affirmative) <succ>
      bacterial outside --- Certainty = 0.0000 (Not Clear) <succ>
         bacterial cytoplasm --- Certainty = 0.0000 (Not Clear) <succ>

---

A related GBS nucleic acid sequence <SEQ ID 8883> which encodes amino acid sequence <SEQ ID 8884> was also identified. Analysis of this protein sequence reveals the following:

Lipop: Possible site: −1   Crend: 2
SRCFLG: 0
McG: Length of UR: 26
Peak Value of UR: 3.65
Net Charge of CR: 2
McG: Discrim Score: 16.58
GvH: Signal Score (−7.5): −6.17
Possible site: 43
>>> Seems to have an uncleavable N-term signal seq
Amino Acid Composition: calculated from 1
ALOM program   count: 4 value: −12.05 threshold: 0.0
INTEGRAL    Likelihood = −12.05    Transmembrane 9-25 (2-29)
INTEGRAL    Likelihood = −7.75     Transmembrane 129-145 (124-150)
INTEGRAL    Likelihood = −7.17     Transmembrane 55-71 (52-84)
INTEGRAL    Likelihood = −6.32     Transmembrane 100-116 (99-128)
PERIPHERAL  Likelihood = 0.53      174
modified ALOM score: 2.91
icml HYPID: 7 CFP: 0.582
*** Reasoning Step: 3
----- Final Results -----
   bacterial membrane --- Certainty = 0.5819 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the GENPEPT database.

```
>GP:AAB91527 GB:AE001165 spermidine/putrescine ABC transporter,
permease protein (potC) [Borrelia burgdorferi]
Identities = 97/249 (38%), Positives = 159/249 (62%), Gaps = 3/249 (1%)
Query:  10  KKFANIYLALVFIILYIPIIYLIFYSFNKGGDMNSFTGFTFSHYGELFQDSRLMLILVQT   69
             + F NI+L L+    +Y+PII LI YSFN G       + GF+   Y E+F  S++   + T
Sbjct:   3  RAFKNIFLFLILSFIYLPIIILIIYSFNSGDSGFIWQGFSLKWYKEIFASSQIKSAIFNT   62

Query:  70  FFLAFLSALLATIIGTFGAIWIYQVRRRH-QTSILSLNNILLVAPDVMIGASFLLVFTVI   128
              +A +S+L + +IG  GA  IY+   +   +T +LS+N I ++ PD++ G S +   ++ I
Sbjct:  63  ILIAIISSLTSVVIGIIGAYAIYKSENKKLKTILLSVNKITIINPDIVTGISLMTFYSAI   122

Query: 129  GLQLGFTSVLLSHVAFSIPIVVLMVLPRLKEMNDDMINASYDLGASTWQMLKEVMLPYLS   188
             +QLGF+++L+SH+ FS P VV+++LP+L  +   ++I+A+ DLGAS  Q+    ++ P ++
Sbjct: 123  KMQLGFSTMLISHIIFSTPYVVIIILPKLYSLPKNIIDAAKDLGASEIQIFFNIIYPEIA   182

Query: 189  SGIISGFFMAFTYSLDDFAVTFFVTGNGFSTLSVEIYSRARRGISLEINALSTIVF--LF   246
             I +G  +AFT S+DDF ++FF TG GF+ LS+ I S   +RGI    INA+S I+F  +
Sbjct: 183  GSIATGALIAFTLSIDDFLISFFTTGQGFNNLSILINSLTKRGIKPVINAISAILFFTIL   242
```

```
Query: 247  SILLVIGYY                                                  255
            S+L +I  +
Sbjct: 243  SLLFIINKF                                                  251
```

A related DNA sequence was identified in *S. pyogenes* <SEQ ID 5311> which encodes the amino acid sequence <SEQ ID 5312>. Analysis of this protein sequence reveals the following:

```
Possible site: 49
>>> Seems to have an uncleavable N-term signal seq
INTEGRAL    Likelihood = -8.17   Transmembrane 9-25 (4-29)
INTEGRAL    Likelihood = -8.12   Transmembrane 228-244 (224-250)
INTEGRAL    Likelihood = -7.91   Transmembrane 129-145 (124-150)
INTEGRAL    Likelihood = -7.06   Transmembrane 62-78 (54-87)
INTEGRAL    Likelihood = -3.93   Transmembrane 100-116 (99-118)
----- Final Results -----
   bacterial membrane --- Certainty = 0.4270 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the databases:

Based on this analysis, it was predicted that these proteins and their epitopes could be useful antigens for vaccines or diagnostics.

Example 1709

A DNA sequence (GBSx1813) was identified in *S. agalactiae* <SEQ ID 5313> which encodes the amino acid sequence <SEQ ID 5314>. This protein is predicted to be spermidine/putrescine ABC transporter, permease protein (potB). Analysis of this protein sequence reveals the following:

```
Possible site: 35
>>> Seems to have a cleavable N-term signal seq.
INTEGRAL    Likelihood = -9.55   Transmembrane 250-266 (244-269)
INTEGRAL    Likelihood = -3.93   Transmembrane 148-164 (146-166)
INTEGRAL    Likelihood = -3.35   Transmembrane 65-81 (64-85)
```

```
>GP:AAB91527 GB:AE001165 spermidine/putrescine ABC transporter,
permease protein (potC) [Borrelia burgdorferi]
Identities = 91/249 (36%), Positives = 154/249 (61%), Gaps = 3/249 (1%)
Query:   2  KKFANLYLASVFVLLYIPIFYLIFYSFNKGGDMNGFTGFTLEHYQTMFEDSRLMTILLQT   61
            + F N++L  +  +Y+PI LI YSFN G    + GF+L+ Y+ +F  S++ + +  T
Sbjct:   3  RAFKNIFLFLILSFIYLPIIILIIYSFNSGDSGFIWQGFSLKWYKEIFASSQIKSAIFNT   62

Query:  62  FVLAFSSALLATIIGIFGAIFIHHVRGK-YQNAMLSANNVLMVSPDVMIGASFLILFTSL  120
            ++A  S+L + +IGI GA  I+    K  +  +LS N + +++PD++ G S +  ++++
Sbjct:  63  ILIAIISSLTSVVIGIIGAYAIYKSENKKLKTILLSVNKITIINPDIVTGISLMTFYSAI  122

Query: 121  KFQLGMSSVLLSHIAFSIPIVVLMVLPRLKEMNQDMVNAAYDLGANYFQMLKEVMLPYFT  180
            K QLG S++L+SHI FS P VV+++LP+L  + +++++AA DLGA+  Q+   ++ P
Sbjct: 123  KMQLGFSTMLISHIIFSTPYVVIIILPKLYSLPKNIIDAAKDLGASEIQIFFNIIYPEIA  182

Query: 181  PGIIAGYFMAFTYSLDDFAVTFFLTGNSVTTLSVEIYSRARQGISLDINALSTIVFF--F  238
              I    G  +AFT S+DDF ++FF TG    LS+ I S   ++GI    INA+S I+FF
Sbjct: 183  GSIATGALIAFTLSIDDFLISFFTTGQGFNNLSILINSLTKRGIKPVINAISAILFFTIL  242

Query: 239  SILLVIGYY                                                    247
            S+L +I  +
Sbjct: 243  SLLFIINKF                                                    251
```

An alignment of the GAS and GBS proteins is shown below.

```
Identities = 196/258 (75%), Positives = 231/258 (88%)
Query:   9  MKKFANIYLALVFIILYIPIIYLIFYSFNKGGDMNSFTGFTFSHYGELFQDSRLMLILVQ   68
            MKKFAN+YLA VF++LYIPI YLIFYSFNKGGDMN FTGFT   HY  +F+DSRLM IL+Q
Sbjct:   1  MKKFANLYLASVFVLLYIPIFYLIFYSFNKGGDMNGFTGFTLEHYQTMFEDSRLMTILLQ   60

Query:  69  TFFLAFLSALLATIIGTFGAIWIYQVRRRHQTSILSLNNILLVAPDVMIGASFLLVFTVI  128
            TF LAF SALLATIIG FGAI+I+  VR  ++Q  ++LS NN+L+V+PDVMIGASFL++FT +
Sbjct:  61  TFVLAFSSALLATIIGIFGAIFIHHVRGKYQNAMLSANNVLMVSPDVMIGASFLILFTSL  120

Query: 129  GLQLGFTSVLLSHVAFSIPIVVLMVLPRLKEMNDDMINASYDLGASTWQMLKEVMLPYLS  188
             QLG +SVLLSH+AFSIPIVVLMVLPRLKEMN DM+NA+YDLGA+ +QMLKEVMLPY +
Sbjct: 121  KFQLGMSSVLLSHIAFSIPIVVLMVLPRLKEMNQDMVNAAYDLGANYFQMLKEVMLPYFT  180

Query: 189  SGIISGFFMAFTYSLDDFAVTFFVTGNGFSTLSVEIYSRARRGISLEINALSTIVFLFSI  248
              GII+G+FMAFTYSLDDFAVTFF+TGN  +TLSVEIYSRAR+GISL+INALSTIVF FSI
Sbjct: 181  PGIIAGYFMAFTYSLDDFAVTFFLTGNSVTTLSVEIYSRARQGISLDINALSTIVFFFSI  240

Query: 249  LLVIGYYYISKEKGEKNA                                           266
            LLVIGYYY+S++K EK+A
Sbjct: 241  LLVIGYYYMSQDKEEKHA                                           258
```

| INTEGRAL | Likelihood = −1.97 | Transmembrane 96-112 (96-115) |

----- Final Results -----
    bacterial membrane --- Certainty = 0.4821 (Affirmative) <succ>
      bacterial outside --- Certainty = 0.0000 (Not Clear) <succ>
        bacterial cytoplasm --- Certainty = 0.0000 (Not Clear) <succ>

A related GBS nucleic acid sequence <SEQ ID 9853> which encodes amino acid sequence <SEQ ID 9854> was also identified.

The protein has homology with the following sequences in the GENPEPT database.

| INTEGRAL | Likelihood = −7.38 | Transmembrane 19-35 (11-40) |
| INTEGRAL | Likelihood = −6.79 | Transmembrane 250-266 (245-268) |
| INTEGRAL | Likelihood = −4.83 | Transmembrane 65-81 (63-85) |
| INTEGRAL | Likelihood = −1.97 | Transmembrane 96-112 (96-115) |
| INTEGRAL | Likelihood = −1.91 | Transmembrane 148-164 (148-165) |

----- Final Results -----
    bacterial membrane --- Certainty = 0.3951 (Affirmative) <succ>
      bacterial outside --- Certainty = 0.0000 (Not Clear) <succ>
        bacterial cytoplasm --- Certainty = 0.0000 (Not Clear) <succ>

```
>GP:AAC22990 GB:U32813 spermidine/putrescine ABC transporter,
permease protein (potB) [Haemophilus influenzae Rd]
Identities = 90/255 (35%), Positives = 153/255 (59%), Gaps = 11/255 (4%)
Query:    21 AWLFLFVLAPVALIAWNSFFDINGH------FTLANYQTFFSSGTYLKMSFNSVLYAGIV     74
             +WL  FVL P L+    SF  +G         T+ NY  F+   Y ++ +NS+  +GI
Sbjct:    18 SWLIFFVLIPNLLVLAVSFLTRDGSNFYAFPITIENYTNLFNP-LYAQVVWNSLSMSGIA   76

Query:    75 SFITLLISYPAAYLLTKL--KHKQLWLMLVILPTWINLLLKAYAFMGIFGQQGGINAFLT    132
             + I LLI YP A++++K+   K++ L L LV+LP W N L++ Y     G +G +N  L
Sbjct:    77 TIICLLIGYPFAFMMSKIHPKYRPLLLFLVVLPFWTNSLIRIYGMKVFLGVKGILNTMLI   136

Query:   133 FIGI--GPKQILFTDFSFLFVAAYIELPFMLLPIFNALDDIDQNLIYASDDLGANAWQTF    190
              +GI    P +IL T+ + +    Y+ LPFM+LP+++A++ +D  L+ A+ DLGAN +Q F
Sbjct:   137 DMGILSAPIRILNTEIAVIIGLVYLLLPFMILPLYSAIEKLDNRLLEAARDLGANTFQRF   196

Query:   191 QKVIFPLSLNGVRAGVQSVFIPSLSLFMLTRLIGGNRVITLGTAIEQHFLITQNKGMGST    250
              +VI PL++ G+ AG   V +P++ +F +  L+GG +V+ +G  I+   FLI++N   GS
Sbjct:   197 FRVILPLTMPGIIAGCLLVLLPAMGMFYVADLLGGAKVLLVGNVIKSEFLISRNWPFGSA   256

Query:   251 IGVILILVMVAIMWL                                              265
             + +  L ++M   ++++
Sbjct:   257 VSIGLTVLMALLIFV                                              271
```

A related DNA sequence was identified in *S. pyogenes* <SEQ ID 5315> which encodes the amino acid sequence <SEQ ID 5316>. Analysis of this protein sequence reveals the following:

The protein has homology with the following sequences in the databases:

---

Possible site: 31
>>> Seems to have an uncleavable N-term signal seq

```
>GP:AAC22990 GB:U32813 spermidine/putrescine ABC transporter,
permease protein (potB) [Haemophilus influenzae Rd]

Identities = 91/262 (34%), Positives = 158/262 (59%), Gaps = 11/262 (4%)
Query:    20 FLWILFFVVAPVTLLFYKSFFDIEGR------VTLANYETFFSSWTYLRMSVNSILYAGI    73
             F W++FFV+ P  L+     SF   +G         +T+ NY  F+   Y ++  NS+  +GI
Sbjct:    17 FSWLIFFVLIPNLLVLAVSFLTRDGSNFYAFPITIENYTNLFNP-LYAQVVWNSLSMSGI     75

Query:    74 ITLVTLLISYPTALFLTRL--KHKQLWLMLIILPTWVNLLLKAYAFMGIFGQQGGINSFL    131
             T++ LLI YP A   ++++    K++ L L L++LP W N L++ Y     G +G +N+ L
Sbjct:    76 ATIICLLIGYPFAFMMSKIHPKYRPLLLFLVVLPFWTNSLIRIYGMKVFLGVKGILNTML   135

Query:   132 TFMGI--GPQQILFTDFSFIFVASYIELPFMMLPIFNALDDIDHNVINASRDLGASEFQA    189
              MGI    P +IL T+ + I    Y+ LPFM+LP+++A++ +D+ ++  A+EDLGA+  FQ
Sbjct:   136 IDMGILSAPIRILNTEIAVIIGLVYLLLPFMILPLYSAIEKLDNRLLEAARDLGANTFQR   195

Query:   190 FSKVIFPLSLNGVRAGVQSVFIPSLSLFMLTRLIGGNRVITLGTAIEQHFLTTQNWGMGS    249
             F +VI PL++ G+ AG   V +P++ +F +  L+GG +V+ +G  I+    FL ++NW  GS
Sbjct:   196 FFRVILPLTMPGIIAGCLLVLLPAMGMFYVADLLGGAKVLLVGNVIKSEFLISRNWPFGS   255

Query:   250 TIGVVLILTMVAIMWLTKEKSK                                        271
             + + +  L +M   ++++      +K
Sbjct:   256 AVSIGLTVLMALLIFVYYRANK                                        277
```

An alignment of the GAS and GBS proteins is shown below.

```
Identities = 215/266 (80%), Positives = 239/266 (89%)
Query:   4  RRREMKKTSSLFSIPYMAWLFLFVLAPVALIAWNSFFDINGHFTLANYQTFFSSGTYLKM   63
            RR  MKKTSSLFSIPY W+  FV+APV L+ + SFFDI G  TLANY+TFFSS TYL+M
Sbjct:   4  RRSVMKKTSSLFSIPYFLWILFFVVAPVTLLFYKSFFDIEGRVTLANYETFFSSWTYLRM   63

Query:  64  SFNSVLYAGIVSFITLLISYPAAYLLTKLKHKQLWLMLVILPTWINLLLKAYAFMGIFGQ  123
            S NS+LYAGI++ +TLLISYP A   LT+LKHKQLWLML+ILPTW+NLLLKAYAFMGIFGQ
Sbjct:  64  SVNSILYAGIITLVTLLISYPTALFLTRLKHKQLWLMLIILPTWVNLLLKAYAFMGIFGQ  123

Query: 124  QGGINAFLTFIGIGPKQILFTDFSFLFVAAYIELPFMLLPIFNALDDIDQNLIYASDDLG  183
            QGGIN+FLTF+GIGP+QILFTDFSF+FVA+YIELPFM+LPIFNALDDID N+I AS DLG
Sbjct: 124  QGGINSFLTFMGIGPQQILFTDFSFIFVASYIELPFMMLPIFNALDDIDHNVINASRDLG  183

Query: 184  ANAWQTFQKVIFPPLSLNGVRAGVQSVFIPSLSLFMLTRLIGGNRVITLGTAIEQHFLITQ  243
            A+ +Q F KVIFPPLSLNGVRAGVQSVFIPSLSLFMLTRLIGGNRVITLGTAIEQHFL TQ
Sbjct: 184  ASEFQAFSKVIFPPLSLNGVRAGVQSVFIPSLSLFMLTRLIGGNRVITLGTAIEQHFLTTQ  243

Query: 244  NKGMGSTIGVILILVMVAIMWLTKER                                    269
            N GMGSTIGV+LIL MVAIMWLTKE+
Sbjct: 244  NWGMGSTIGVVLILTMVAIMWLTKEK                                    269
```

Based on this analysis, it was predicted that these proteins and their epitopes could be useful antigens for vaccines or diagnostics.

Example 1710

A DNA sequence (GBSx1814) was identified in *S. agalactiae* <SEQ ID 5317> which encodes the amino acid sequence <SEQ ID 5318>. This protein is predicted to be spermidine/putrescine ABC transporter, ATP-binding protein (potA). Analysis of this protein sequence reveals the following:

Possible site: 47
>>> Seems to have no N-terminal signal sequence
----- Final Results -----
  bacterial cytoplasm --- Certainty = 0.3031 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

There is also homology to SEQ ID 1292

Based on this analysis, it was predicted that this protein and its epitopes, could be useful antigens for vaccines or diagnostics.

Example 1711

A DNA sequence (GBSx1815) was identified in *S. agalactiae* <SEQ ID 5319> which encodes the amino acid sequence <SEQ ID 5320>. Analysis of this protein sequence reveals the following:

Possible site: 53
>>> Seems to have no N-terminal signal sequence
----- Final Results -----
  bacterial cytoplasm --- Certainty = 0.4990 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:AAB91525 GS:AE001165 spermidine/putrescine ABC transporter,
ATP-binding protein (potA) [Borrelia burgdorferi]
Identities = 166/345 (48%), Positives = 240/345 (69%), Gaps = 1/345 (0%)
Query:   1  MTNPIIAFKNVSKVFEDSNTVVLKDINFELEEGKFYTLLGASGSGKSTILNIIAGLLEAS   60
            M N I+  KN+S  ++++     L +IN ++++ +F TLLG SG GK+T++ I+ G L
Sbjct:   1  MDNCILEIKNLSHYYDNNGNKTLDNINLKIKKNEFITLLGPSGCGKTTLIKILGGFLSQK   60

Query:  61  TGDIYLDGKRINDVPTNKRDVHTVFQNYALFPHMTVFENVAFPLKLKKMDKKEIQKRVQE  120
            G+IY  K I+    NKR+++TVFQNYALFPHM VF+N++F L++KK   K  I+++V+
Sbjct:  61  NGEIYFFSKEISKTSPNKREINTVFQNYALFPHMNVFDNISFGLRMKKTPKDIIKEKVKT  120

Query: 121  TLKMVRLEGFEKRAIQKLSGGQRQRVAIARAIINQPKVVLLDEPLSALDLKLRTEMQYEL  180
            +L ++ +  +   R I +LSGGQ+QRVAIARA++ +PK++LLDEPLSALDLK+R EMQ EL
Sbjct: 121  SLSLIGMPKYAYRNINELSGGQKQRVAIARAMVMEPKLLLLDEPLSALDLKMRQEMQKEL  180

Query: 181  RELQQRLGITFVFVTHDQEEALAMSDWIFVMNEGEIVQSGTPVDIYDEPINHFVATFIGE  240
            +++Q++LGITF++VTHDQEEAL MSD I VMNEG I+Q GTP +IY+EP    FVA FIGE
Sbjct: 181  KKIQRQLGITFIYVTHDQEEALTMSDRIVVMNEGIILQIGTPEEIYNEPKTKFVADFIGE  240

Query: 241  SNILSGKMIEDYLVEFNGKRFEAVDGGMRPNESVQVVIRPEDLQITLPDEGKLQVKVDTQ  300
            SNI  G   ++ +V   G  FE +D G    E+V +VIRPED+++   +G L   + +
Sbjct: 241  SNIFDGTYKKELVVSLLGHEFECLDKGFEAEEAVDLVIRPEDVELLPKGKGHLSGTITSA  300

Query: 301  LFRGVHYEIIAYDDLGNEWMIHSTRKAIEGEVIGLDFTPEDIHIM                 345
            +F+GVHYE+       N W++ STR   GE +   P+DIH+M
Sbjct: 301  IFQGVHYEMTLEIQKTN-WIVQSTRLTKVGEEVDIFLEPDDIHVM                 344
```

```
>GP:BAB06283 GB:AP001515 UDP-N-acetylenolpyruvoylglucosamine
reductase [Bacillus halodurans]
Identities = 119/286 (41%), Positives = 166/286 (57%), Gaps = 1/286 (0%)
Query: 13    DIRFDEPLKKYTYTKVGGPADYLAFPRNRLELSRIVKFANSQNIPWMVLGNASNIIVRDG    72
             ++R +E L  +T K+GGPAD      P +      L    +K       W V+G  SNI+V D
Sbjct: 15    EVRVNESLAHHTTWKIGGPADVFVIPNDIEGLKNTMKLIQETGCKWRVIGRGSNILVSDK    74

Query: 73    GIRGFVIMFDK-LSTVTVNGYVIEAEAGANLIETTRIARYHSLTGFEFACGIPGSVGGAV    131
             G+RG  I  DK L  + VNG  I    AG +++   +      L G EFA GIPGSVGGAV
Sbjct: 75    GLRGVTIKLDKGLDHLEVNGESITVGAGFPVVKLATVISRQGLAGLEFAAGIPGSVGGAV    134

Query: 132   FMNAGAYGGEIAHILLSAQVLTPQGELKTIEARNMQFGYRHSVIQESGDIVISAKFALKP    191
             FMNAGA+G +I+  IL  A VL P G L+ +      M F  YR S++Q++   I + A F+L
Sbjct: 135   FMNAGAHGSDISQILTKAHVLFPDGTLRWLTNEEMAFSYRTSLLQKNDGICVEAIFSLTR    194

Query: 192   GDHLMITQEMDRLTYLRELKQPLEYPSCGSVFKRPPGHFAGQLISEAHLKGQRIGGVEVS    251
             GD    I +++ +      R    QP  +P+CGSVF+ P    +AGQLI  +A LKG +IGG ++S
Sbjct: 195   GDKEDIKKKLQKNKDYRRDTQPWNHPTCGSVFRNPLPEYAGQLIEKAGLKGYQIGGAQIS    254

Query: 252   QKHAGFMVNIAEGSAQDYENLIEHVINIVESTSGVHLEPEVRIIGE    297
                 HA F+VN  +  A D    LI HV +T++     +++E EV +IGE
Sbjct: 255   TMHANFIVNTGDAKAADVLALIHHVKDTIQKQYQMNMETEVELIGE    300
```

A related DNA sequence was identified in S. pyogenes <SEQ ID 5321> which encodes the amino acid sequence <SEQ ID 5322>. Analysis of this protein sequence reveals the following:

---
Possible site: 47
>>> Seems to have no N-terminal signal sequence
----- Final Results -----
     bacterial cytoplasm --- Certainty = 0.4557 (Affirmative) <succ>
     bacterial membrane --- Certainty = 0.0000 (Not Clear) <succ>
     bacterial outside --- Certainty = 0.0000 (Not Clear) <succ>
---

An alignment of the GAS and GBS proteins is shown below.

```
Identities = 229/292 (78%), Positives = 267/292 (91%)
Query: 8     ELEGLDIRFDEPLKKYTYTKVGGPADYLAFPRNRLELSRIVKFANSQNIPWMVLGNASNI    67
             EL G+DIR +EPLK YTYTKVGGPAD+LAFPRN  ELSRIV +AN +N+PW+VLGNASN+
Sbjct: 4     ELHGIDIRENEPLKHYTYTKVGGPADFLAFPRNHYELSRIVAYANKENMPWLVGNASNL    63

Query: 68    IVRDGGIRGFVIMFDKLSTVTVNGYVIEAEAGANLIETTRIARYHSLTGFEFACGIPGSV    127
             IVRDGGIRGFVIMFDKL+ V +NGY +EAEAGANLIETT+IA++HSLTGFEFACGIPGS+
Sbjct: 64    IVRDGGIRGFVIMFDKLNAVHLNGYTLEAEAGANLIETTKIAKFHSLTGFEFACGIPGSI    123

Query: 128   GGAVFMNAGAYGGEIAHILLSAQVLTPQGELKTIEARNMQFGYRHSVIQESGDIVISAKF    187
             GGAVFMNAGAYGGEI+HI LSA+VLTP GE+KTI AR+M FGYRHS IQE+GDIVISAKF
Sbjct: 124   GGAVFMNAGAYGGEISHIFLSAKVLTPSGEIKTISARDMAFGYRHSAIQETGDIVISAKF    183

Query: 188   ALKPGDHLMITQEMDRLTYLRELKQPLEYPSCGSVFKRPPGHFAGQLISEAHLKGQRIGG    247
             ALKPG++   I+QEM+RL +LR+LKQPLE+PSCGSVFKRPPGHFAGQLI EA+LKG RIGG
Sbjct: 184   ALKPGNYDTISQEMNRLNHLRQLKQPLEFPSCGSVFKRPPGHFAGQLIMEANLKGHRIGG    243

Query: 248   VEVSQKHAGFMVNIAEGSAQDYENLIEHVINTVESTSGVHLEPEVRIIGESL    299
             VEVS+KH GFM+N+A+G+A+DYE+LI +VI TVE+ SGV LEPEVRIIGE+L
Sbjct: 244   VEVSEKHTGFMINVADGTAKDYEDLIAYVIETVENHSGVRLEPEVRIIGENL    295
```

Based on this analysis, it was predicted that these proteins and their epitopes could be useful antigens for vaccines or diagnostics.

Example 1712

A DNA sequence (GBSx1816) was identified in S. agalactiae <SEQ ID 5323> which encodes the amino acid sequence <SEQ ID 5324>. This protein is predicted to be 2-amino-4-hydroxy-6-hydroxymethyldihydropterin pyrophosphokinase/dihyd. Analysis of this protein sequence reveals the following:

---
Possible site: 47
>>> Seems to have no N-terminal signal sequence
----- Final Results -----
     bacterial cytoplasm --- Certainty = 0.1122 (Affirmative) <succ>
     bacterial membrane --- Certainty = 0.0000 (Not Clear) <succ>
     bacterial outside --- Certainty = 0.0000 (Not Clear) <succ>
---

The protein has homology with the following sequences in the GENPEPT database.

```
>GP:BAB03814 GB:AP001507
2-amino-4-hydroxy-6-hydroxymethyldihydropteridine
```

```
                          -continued
pyrophosphokinase [Bacillus halodurans]
Identities = 64/146 (43%), Positives = 94/146 (63%)
Query:  5    YLSLGSNIGDRETFLKQALFSIDHLQKTKVAQISAIYETAAWGNTNQEDFFNICCQVETD    64
             Y++LGSNIGDR FL++A+  +    K V  S+IYET  G T+Q  F N+  +V T
Sbjct:  6    YIALGSNIGDRSRFLEEAIQQLAEHDKVTVTCCSSIYETDPVGYTDQSPFLNMVVEVSTS    65

Query: 65    LAPFELLDYCQEIEKCLKRVRHEHWGPRTIDIDILLFGNQVINQEDLVVPHPYMTKRAFV   124
             L   +LL+  Q+IE+    R RH  WGPRT+D+DILL+  +      E+L++PHP M +RAFV
Sbjct: 66    LPVEQLLEVTQKIERYCGRERHIRWGPRTLDLDILLYDQENREMENLIIPHPRMWERAFV   125

Query: 125   LVPLLEIAPQLSLPNGSKLEDYLEKL                                   150
             L+PL+E+ P +  P+G  +E  + +L
Sbjct: 126   LIPLMELNPSIVAPSGKTIEQVVREL                                   151
```

A related DNA sequence was identified in *S. pyogenes* <SEQ ID 5325> which encodes the amino acid sequence <SEQ ID 5326>. Analysis of this protein sequence reveals the following:

Possible site: 45
>>> Seems to have no N-terminal signal sequence
----- Final Results -----
bacterial cytoplasm --- Certainty = 0.0479 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 85/156 (54%), Positives = 111/156 (70%), Gaps = 1/156 (0%)
Query:  1    MTTVYLSLGSNIGDRETFLKQALFSIDHLQKTKVAQISAIYETAAWGNTNQEDFFNICCQ    60
             MT VYLSLG+N+GDR  +L++AL ++   L +T++   S+IYET AWG T Q DF N+ CQ
Sbjct:  1    MTIVYLSLGTNMGDRAAYLQKALEALADLPQTRLLAQSSIYETTAWGKTGQADFLNMACQ    60

Query: 61    VETDLAPFELLDYCQEIEKCLKRVRHEHWGPRTIDIDILLFGNQVINQEDLVVPHPYMTK   120
             ++T L   + L   Q IE+ L RVRHE WG RTIDIDILLFG +V +  ++L VPHPYMT+
Sbjct: 61    LDTQLTAADFLKETQAIEQSLGRVRHEKWGSRTIDIDILLFGEEVYDTKELKVPHPYMTE   120

Query: 121   RAFVLVPLLEIAPQLSLPNGSK-LEDYLEKLNLGEV                         155
             RAFVL+PLLE+  P L LP    K  L DYL  L+  ++
Sbjct: 121   RAFVLIPLLELQPDLKLPPNHKFLRDYLAALDQSDI                         156
```

Based on this analysis, it was predicted that these proteins and their epitopes could be useful antigens for vaccines or diagnostics.

Example 1713

A DNA sequence (GBSx1817) was identified in *S. agalactiae* <SEQ ID 5327> which encodes the amino acid sequence <SEQ ID 5328>. Analysis of this protein sequence reveals the following:

Possible site: 44
>>> Seems to have no N-terminal signal sequence
----- Final Results -----
bacterial cytoplasm --- Certainty = 0.2826 (Affirmative) <succ>
bacterial membrane --- Certainty = 0.0000 (Not Clear) <succ>
bacterial outside --- Certainty = 0.0000 (Not Clear) <succ>

A related DNA sequence was identified in *S. pyogenes* <SEQ ID 5329> which encodes the amino acid sequence <SEQ ID 5330>. Analysis of this protein sequence reveals the following:

Possible site: 50
>>> Seems to have no N-terminal signal sequence
----- Final Results -----
bacterial cytoplasm --- Certainty = 0.3547 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 75/119 (63%), Positives = 92/119 (77%)
Query:  1    MDKIYLNKCRFYGYHGAFSEEQTLGQVFQVDAVLSLDLAKASQTDDLIDTVHYGEVFDCI    60
             MDKI L   CRFYGYHGAF EEQTLGQ+F VD  LS+DL  AS +D L DTVHYG VFD +
Sbjct:  1    MDKIVLEGCRFYGYHGAFKEEQTLGQIFLVDLELSVDLQAASLSDQLTDTVHYGMVFDSV    60

Query: 61    KNHVENEQYQLIEKLAGVIVEDIFLQFHPVQAITLKITKDNPPINGHYESVGIELERRR   119
             +  VE E++ LIE+LAG I E +F +F P++AI + I K+NPPI GHY++VGIELER+R
Sbjct: 61    RQLVEGEKFILIERLAGAICEQLFNEFPPIEAIKVAIKKENPPIAGHYKAVGIELERQR   119
```

Based on this analysis, it was predicted that these proteins and their epitopes could be useful antigens for vaccines or diagnostics.

Example 1714

A DNA sequence (GBSx1818) was identified in *S. agalactiae* <SEQ ID 5331> which encodes the amino acid sequence <SEQ ID 5332>. Analysis of this protein sequence reveals the following:

Possible site: 26
>>> Seems to have an uncleavable N-term signal seq
----- Final Results -----
  bacterial membrane --- Certainty = 0.0000 (Not Clear) <succ>
    bacterial outside --- Certainty = 0.0000 (Not Clear) <succ>
      bacterial cytoplasm --- Certainty = 0.0000 (Not Clear) <succ>

A related DNA sequence was identified in *S. pyogenes* <SEQ ID 5333> which encodes the amino acid sequence <SEQ ID 5334>. Analysis of this protein sequence reveals the following:

Possible site: 26
>>> Seems to have an uncleavable N-term signal seq
----- Final Results -----
  bacterial membrane --- Certainty = 0.0000 (Not Clear) <succ>
    bacterial outside --- Certainty = 0.0000 (Not Clear) <succ>
      bacterial cytoplasm --- Certainty = 0.0000 (Not Clear) <succ>

Possible site: 19
>>> Seems to have no N-terminal signal sequence
----- Final Results -----
  bacterial cytoplasm --- Certainty = 0.2429 (Affirmative) <succ>
    bacterial membrane --- Certainty = 0.0000 (Not Clear) <succ>
      bacterial outside --- Certainty = 0.0000 (Not Clear) <succ>

A related DNA sequence was identified in *S. pyogenes* <SEQ ID 5337> which encodes the amino acid sequence <SEQ ID 5338>. Analysis of this protein sequence reveals the following:

Possible site: 32
>>> Seems to have no N-terminal signal sequence
----- Final Results -----
  bacterial cytoplasm --- Certainty = 0.1590 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

An alignment of the GAS and GBS proteins is shown below.

```
Identities = 181/267 (67%), Positives = 224/267 (83%), Gaps = 1/267 (0%)
Query: 1     MKIGQYDITGKACIMGILNVTPDSFSDGGSYTTIDSALNQVGEMLEQGVAIVDIGGESTR  60
             MKIG++  I G A IMGILNVTPDSFSDGGSYTT+  AL+ V +M+  G  I+D+GGESTR
Sbjct: 1     MKIGKFVIEGNAAIMGILNVTPDSFSDGGSYTTVQKALDHVEQMIADGAKIIDVGGESTR  60

Query: 61    PGAVFVTAEEEIKRVVPMIKAIREVYPDLLLSIDTYKTEVAQAALDAGVHILNDVWSGLY  120
             PG  FV+A +EI RVVP+IKAI+E Y D+L+SIDTYKTE A+AAL+AG  ILNDVW+GLY
Sbjct: 61    PGCQFVSATDEIDRVVPVIKAIKENY-DILISIDTYKTETARAALEAGADILNDVWAGLY  119

Query: 121   DGKMLSLAAERNVPIILMHNQEEAVYQDIKKEVCEFLLERAERALEAGVSKDNIWIDPGF  180
             DG+M +LAAE + PIILMHNQ+E VYQ++ ++VC+FL  RA+ AL+AGV K+NIW+DPGF
Sbjct: 120   DGQMFALAAEYDAPIILMHNQDEEVYQEVTQDVCDFLGNRAQAALDAGVPKNNIWVDPGF  179

Query: 181   GFAKTEEQNLELLKGLEQVCDLGYPVLFGISRKRTVNYLLGGNREVTERDMGTAALSAWA  240
             GFAK+ +QN ELLKGL++VC LGYPVLFGISRKR V+ LLGGN +  ERD  TAALSA+A
Sbjct: 180   GFAKSVQQNTELLKGLDRVCQLGYPVLFGISRKRVVDALLGGNTKAKERDGATAALSAYA  239

Query: 241   IAKGCQIVRVHNVEVNKDIVTVISQLV                                  267
             + KGCQIVRVH+V+ N+DIV V+SQL+
Sbjct: 240   LGKGCQIVRVHDVKANQDIVAVLSQLM                                  266
```

Based on this analysis, it was predicted that these proteins and their epitopes could be useful antigens for vaccines or diagnostics.

Example 1715

A DNA sequence (GBSx1819) was identified in *S. agalactiae* <SEQ ID 5335> which encodes the amino acid sequence <SEQ ID 5336>. Analysis of this protein sequence reveals the following:

```
Identities = 151/184 (82%), Positives = 166/184 (90%)
Query: 3     NQEKMEKAIYQFLEALGENPNREGLKDTPKRVAKMYIEMFSGLNQDPKEQFTAVFSENHE  62
             N+EK E AIYQFLEA+GENPNREGL DTPKRVAKMY EMF GL +DPKE+FTAVF E HE
Sbjct: 16    NKEKAEAAIYQFLEAIGENPNREGLLDTPKRVAKMYAEMFLGLGKDPKEEFTAVEKEQHE  75

Query: 63    EVVIVKDIPFYSMCEHHLVPFYGKAHIAYLPNDGRVTGLSKLARAVEVASKRPQLQERLT  122
```

```
             +VVIVKDI FYS+CEHHLVPFYGKAHIAYLP+DGRVTGLSKLARAVEVASKRPQLQERLT
Sbjct:  76   DVVIVKDISFYSICEHHLVPFYGKAHIAYLPSDGRVTGLSKLARAVEVASKRPQLQERLT  135

Query: 123   AQVAQALEDALAPKGIFVMIEAEHMCMTMRGIKKPGSKTITTVARGLYKDDRYERQEILS  182
             +Q+A AL +AL PKG  VM+EAEHMCMTMRGIKKPGSKTITT ARGLYK+ R ERQE++S
Sbjct: 136   SQIADALVEALNPKGTLVMVEAEHMCMTMRGIKKPGSKTITTTARGLYKESRAERQEVIS  195

Query: 183   LIQK                                                          186
             L+ K
Sbjct: 196   LMTK                                                          199
```

Based on this analysis, it was predicted that these proteins and their epitopes could be useful antigens for vaccines or diagnostics.

Example 1716

A DNA sequence (GBSx1820) was identified in *S. agalactiae* <SEQ ID 5339> which encodes the amino acid sequence <SEQ ID 5340>. This protein is predicted to be folylpolyglutamate synthase (folC). Analysis of this protein sequence reveals the following:

---
Possible site: 17
>>> Seems to have no N-terminal signal sequence
----- Final Results -----
   bacterial cytoplasm --- Certainty = 0.2836 (Affirmative) <succ>
     bacterial membrane --- Certainty = 0.0000 (Not Clear) <succ>
       bacterial outside --- Certainty = 0.0000 (Not Clear) <succ>

---

A related GBS nucleic acid sequence <SEQ ID 9855> which encodes amino acid sequence <SEQ ID 9856> was also identified.

The protein has homology with the following sequences in the GENPEPT database.

A related DNA sequence was identified in *S. pyogenes* <SEQ ID 5341> which encodes the amino acid sequence <SEQ ID 5342>. Analysis of this protein sequence reveals the following:

---
Possible site: 26
>>> Seems to have an uncleavable N-term signal seq
INTEGRAL    Likelihood = −1.28   Transmembrane 12-28 (12-28)
----- Final Results -----
   bacterial membrane --- Certainty = 0.1510 (Affirmative) <succ>
     bacterial outside --- Certainty = 0.0000 (Not Clear) <succ>
       bacterial cytoplasm --- Certainty = 0.0000 (Not Clear) <succ>

---

An alignment of the GAS and GBS proteins is shown below.

```
>GP:CAB14768 GB:Z99118 folyl-polyglutamate synthetase [Bacillus subtilis]
Identities= 154/426 (36%), Positives = 245/426 (57%), Gaps = 17/426 (3%)
Query:   3   YQEALEWIHSKLAFGIKPGLERMRWMLEQLGNPQNNLSAIHVVGTNGKGSTTSYLQHIFT   62
             YQ+A  WIH +L FG+KPGL RM+ ++ +LG+P+   A HV GTNGKGST ++++ +
Sbjct:   5   YQDARSWIHGRLKFGVKPGLGRMKQLMARLGHPEKKIRAFHVAGTNGKGSTVAFIRSMLQ   64

Query:  63   NSGYQVGTFTSPYIVDFRERISIDGQMIPESDFIKLVETVRPVVERLHLETNLEPATEFE  122
              +GY VGTFTSPYI+ F ERIS++G  I + ++  LV  ++P VE L   +T    TEFE
Sbjct:  65   EAGYTVGTFTSPYIITFNERISVNGIPISDEEWTALVNQMKPHVEALD-QTEYGQPTEFE  123

Query: 123   VITVLMFYYFGNSCPVDIVIIEAGMGGYYDSTNMFKALAVTCPSIGLDHQEVLGRTYVDI  182
             ++T   F YF    VD VI E G+GG +DSTN+ + L    SIG DH  +LG T  +I
Sbjct: 124   IMTACAFLYFAEFHKVDFVIFETGLGGRFDSTNVVEPLLTVITSIGHDHMNILGNTIEEI  183

Query: 183   AEQKVGVLKKGVPFVYANDRQDVEEVFQIKAKETHSQTYRLHNDFYIKEEE-----NYFN  237
             A +K G++K+G+P V A  + +V + +A+   +    LH+  I  EE        F+
Sbjct: 184   AGEKAGIIKEGIPIVTAVTQPEALQVIRHEAERHAAPFQSLHDACVIFNEEEALPAGEQFS  243

Query: 238   YIGPQANIDHIQLQMPGHHQVSNASIAI-TTSLLLRDKYPKLTLQTIKDGLEMTKWVGRT  296
              +    + I+  + G HQ  NA+++I     L ++      ++ + ++ GL   W GR
Sbjct: 244   FKTEEKCYEDIRTSLIGTHQRQNAALSILAAEWLNKENIAHISDEALRSGLVKAAWPGRL  303

Query: 297   ELI--FPNVMIDGAHNNESVDALVQVIK-KYQQKNVHILFAAINTKPIESMLESLSSIA-  352
             EL+     P V +DGAHN E V+ L + +K ++      + ++F+A+  KP ++M++ L  +IA
Sbjct: 304   ELVQEHPPVYLDGAHNEEGVEKLAETMKQRFANSRISVVFSALKDKPYQNMIKRLETIAH  363

Query: 353   PVSVTSFDYPK-SINLDKYPKAYTRVSDWKKWLHDI-----NLTSDKDFYVITGSLYFIS  406
              +   SFD+P+ S+    D Y +       W + D+        +     +ITGSLYFIS
Sbjct: 364   AIHFASFDFPPRASLAKDLYDASEISNKSWSEDPDDVIKFIESKKGSNEIVLITGSLYFIS  423

Query: 407   QVRQEL                                                        412
             +R+  L
Sbjct: 424   DIRKRL                                                        429
```

```
Identities = 230/411 (55%), Positives = 295/411 (70%), Gaps = 1/411 (0%)
Query:   1  MTYQEALEWIHSKLAFGIKPGLERMRWMLEQLGNPQNNLSAIHVVGTNGKGSTTSYLQHI  60
            MTY+E LEWIH  L FGIKPGL+RM W+L QLGNPQ N+  +H+VGTNGKGST ++LQHI
Sbjct:  34  MTYEETLEWIHDHLVFGIKPGLKRMLWVLGQLGNPQKNVKGVHIVGTNGKGSTVNHLQHI  93

Query:  61  FTNSGYQVGTFTSPYIVDFRERISIDGQMIPESDFIKLVETVRPVVERLHLETNLEPATE  120
            FT +GY+VGTFTSPYI+DF+ERISI+G+MI E D +    +RP+ ERL  ET+    TE
Sbjct:  94  FTTAGYEVGTFTSPYIMDFKERISINGRMISEKDLVIAANRIRPLTERLVQETDFGEVTE  153

Query: 121  FEVITVLMFYYFGNSCPVDIVIIEAGMGGYYDSTNMFKALAVTCPSIGLDHQEVLGRTYV  180
            FEVIT++MF YFG+  PVDI IIEAG+GG YDSTN+F+A+ V CPSIGLDHQ +LG TY
Sbjct: 154  FEVITLIMFLYFGDMHPVDIAIIEAGLGGLYDSTNVFQAMVVVCPSIGLDHQAILGETYA  213

Query: 181  DIAEQKVGVLKKGVPFVYANDRQDVEEVFQIKAKETHSQTYRLHNDFYIKEEENYFNYIG  240
            +IA QK GVL+ G   V+A +    EVF KA++ +  +    F + E   + +
Sbjct: 214  NIAAQKAGVLEGGETLVFAVENPSAREVFLTKAEQVGASIWEWQEQFQMAENASGYRFTS  273

Query: 241  PQANIDHIQLQMPGHHQVSNASIAITTSLLLRDKYPKLTLQTIKDGLEMTKWVGRTELIF  300
            P   I  I + MPGHHQVSNA++AI T L L+D+YP+LT    I++GL   + W+GRTEL+
Sbjct: 274  PLGVISDIHIAMPGHHQVSNAALAIMTCLTLQDRYPRLTPDHIREGLANSLWLGRTELLA  333

Query: 301  PNVMIDGAHNNESVDALVQVIK-KYQQKNVHILFAAINTKPIESMLESLSSSIAPVSVTSF  359
            PN+MIDGAHNNESV ALV V+K  Y  K +HILF AI+TKPI  ML +L  I  + VTSF
Sbjct: 334  PNLMIDGAHNNESVAALVAVLKNNYNDKKLHILFGAIDTKPIADMLVALEQIGDLQVTSF  393

Query: 360  DYPKSINLDKYPKAYTRVSDWKKWLHDINLTSDKDFYVITGSLYFISQVRQ          410
            YP +   L+KYP+ + RV+D+K +L         DF+VITGSLYFIS++RQ
Sbjct: 394  HYPNAYPLEKYPERFGRVADFKDFLALRKHAKADDFFVITGSLYFISEIRQ          444
```

Based on this analysis, it was predicted that these proteins and their epitopes could be useful antigens for vaccines or diagnostics.

Example 1717

A DNA sequence (GBSx1821) was identified in *S. agalactiae* <SEQ ID 5343> which encodes the amino acid sequence <SEQ ID 5344>. This protein is predicted to be rarD. Analysis of this protein sequence reveals the following:

Possible site: 38
>>> Seems to have a cleavable N-term signal seq.
INTEGRAL    Likelihood = −12.31   Transmembrane 130-146 (125-151)

-continued

| | | |
|---|---|---|
| INTEGRAL | Likelihood = −10.24 | Transmembrane 269-285 (262-291) |
| INTEGRAL | Likelihood = −7.75 | Transmembrane 212-228 (207-233) |
| INTEGRAL | Likelihood = −5.52 | Transmembrane 80-96 (75-99) |
| INTEGRAL | Likelihood = −4.14 | Transmembrane 106-122 (104-125) |
| INTEGRAL | Likelihood = −3.50 | Transmembrane 182-198 (180-204) |
| INTEGRAL | Likelihood = −2.44 | Transmembrane 40-56 (39-57) |
| INTEGRAL | Likelihood = −0.96 | Transmembrane 153-169 (152-169) |
| INTEGRAL | Likelihood = −0.32 | Transmembrane 251-267 (250-267) |

----- Final Results -----
bacterial membrane --- Certainty = 0.5925 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the GENPEPT database.

```
>GP:BAB07585 GB:AP001520 unknown conserved protein [Bacillus halodurans]
Identities = 109/288 (37%), Positives = 185/288 (63%), Gaps = 6/288 (2%)
Query:   7  GIILGLSAYVLWGLLSLYWKLLSGIEAYSTFAYRIIFTVLTMLIYMLVSGRKTVYLKDLK  66
            G+I  +SAY++WG L LYWKL+  + A    A+RI++++ M+I + V +     ++++
Sbjct:   8  GVIAAISAYLIWGFLPLYWKLVDEVPASEMLAHRIVWSLGFMVILLAVMKKNRQVMREIL  67

Query:  67  GLVNNKKSFWTMFVASILISINWLVYIFAVTHGHATEASLGYYMMPIISILLSVLVLREH  126
            + NKK+ + +  VA+ILIS+NW ++I+AV+       EASLGYY+ P+I++LL+++ LRE
Sbjct:  68  DTLANKKTAFGITVAAILISMNWFIFIYAVSSDKVIEASLGYYINPLINVLLAIVFLRES  127

Query: 127  LARVVSLAILIAIMGVGILVYQTGHFPLISLTLALSFGFYGLLKKSISLSSDFSMLVESS  186
            L++   + L+A GV +    G FP ++  LA+SFG YGL+KK +SLS+   S+ +E+
Sbjct: 128  LSKWEVASFLLAAAGVLNITLHYGSFPWVAFALAISFGVYGLIKKVVSLSAWASLTIETL  187

Query: 187  FIAPPFALIYIVFF-----AKDFLTDYNILQLVLLSLSGIITAVPLLLFAEAIKRAPLNII  241
            +   PFAL+++++     A   F  ++ +    L+    SG   TA+PLLLFA   KR   ++I
Sbjct: 188  IMTPFALLFLLYIPLSGGASAFSLNH-LSTAWLIIASGAATALPLLLFATGAKRISFSLI  246

Query: 242  GFIQYINPTIQLLLALFIFKETIVSGEVIGFIFIWLAILVFSIGQVHT             289
            GF+QY+  PTI L+L +F+F+E     +   + F+ IW +++F+I +   T
Sbjct: 247  GFLQYLAPTIMLMLGVFLFQEPPFSRVQFVSFLLIWTGLIIFTISRSRT             294
```

No corresponding DNA sequence was identified in *S. pyogenes*.

A related GBS gene <SEQ ID 8885> and protein <SEQ ID 8886> were also identified. Analysis of this protein sequence reveals the following:

---

Lipop: Possible site: −1 Crend: 3
McG: Discrim Score: 5.30
GvH: Signal Score (−7.5): −1.64
Possible site: 38
>>> Seems to have a cleavable N-term signal seq.
ALOM program    count: 9 value: −12.31 threshold: 0.0
INTEGRAL    Likelihood = −12.31    Transmembrane 130-146 (125-151)
INTEGRAL    Likelihood = −10.24    Transmembrane 269-285 (262-291)
INTEGRAL    Likelihood = −7.75    Transmembrane 212-228 (207-233)
INTEGRAL    Likelihood = −5.52    Transmembrane 80-96 (75-99)
INTEGRAL    Likelihood = −4.14    Transmembrane 106-122 (104-125)
INTEGRAL    Likelihood = −3.50    Transmembrane 182-198 (180-204)
INTEGRAL    Likelihood = −2.44    Transmembrane 40-56 (39-57)
INTEGRAL    Likelihood = −0.96    Transmembrane 153-169 (152-169)
INTEGRAL    Likelihood = −0.32    Transmembrane 251-267 (250-267)
PERIPHERAL    Likelihood = 7.96    229
modified ALOM score: 2.96
*** Reasoning Step: 3
----- Final Results -----
    bacterial membrane --- Certainty = 0.5925 (Affirmative) <succ>
    bacterial outside --- Certainty = 0.0000 (Not Clear) <succ>
        bacterial cytoplasm --- Certainty = 0.0000 (Not Clear) <succ>

---

The protein has homology with the following sequences in the databases:

Based on this analysis, it was predicted that these proteins and their epitopes could be useful antigens for vaccines or diagnostics.

Example 1718

A DNA sequence (GBSx1822) was identified in *S. agalactiae* <SEQ ID 5345> which encodes the amino acid sequence <SEQ ID 5346>. Analysis of this protein sequence reveals the following:

---

Possible site: 34
>>> Seems to have no N-terminal signal sequence
----- Final Results -----
    bacterial cytoplasm --- Certainty = 0.5200 (Affirmative) <succ>
        bacterial membrane --- Certainty = 0.0000 (Not Clear) <succ>
            bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1719

A DNA sequence (GBSx1823) was identified in *S. agalactiae* <SEQ ID 5347> which encodes the amino acid sequence <SEQ ID 5348>. Analysis of this protein sequence reveals the following:

---

```
ORF02052(319-1152 of 1485)
GP|9654601|gb|AAF93371.1||AE004110(13-289 of 302) rarD protein {Vibrio cholerae}
% Match = 20.4
% Identity = 37.7 % Similarity = 66.3
Matches = 104 Mismatches = 89 Conservative Sub.s = 79

117         147         177         207         237         267         297         327
KDIVNLW*RNLK**NKSALKMVRMLLICLEQDRR*WFCVRKKKNKQLSQS*VNYV*VDRFKCLILSEKE*ELRKDNLGII
                                                                           |||:
                                                                    MFMTPDQQDAKKGIL
                                                                           10

357         387         417         441         471         501         531         561
LGLSAYVLWGLLSLYWKLLSGIEAYSTFAYRII--FTVLTMLIYMLVSGRKTVYLKDLKGLVNNKKSFWTMFVASILISI
|:|||  :||: :|:| |   :::|::   |  :|||: |   |:| : || ::|:
LAISAYTMWGIAPIYFKALGAVSALEILSHRVVWSFVLLAVLIHLGRRWRSVV------GVVHTPRKFWLLLLVTALLVGG
        30          40          50          60                70          80

591         621         651         681         711         741         771         801
NWLVYIFAVTHGHATEASLGYYMMPIISILLSVLVLREHLARVVSLAILIAIMGVGILVYQTGHFPLISLTLALSFGFYG
|||::|:::     |   :||||||: |:::||  :|   |   |  :  :|  :|||  |    |:::  || ||||||
NWLIFIWSINANHMLDASLGYYINPLLNVLLGMLFLGERLRKLQWFAVALAAIGVGIQLVVFGSVPIVAIALATSFGFYG
        100         110         120         130         140         150         160

831         861         891         921         942         972         1002        1032
LLKKSISLSSDFSMLVESSFIAPFALIYIVFFAKDFLTDY--NILQL-VLLSLSGIITAVPLLLFAEAIKRAPLNIIGFI
||:|  :  :   :::|: |: | | | | | |::::|   :|    |   || :|| :|||  |  |  |: :||
LLRKKIQVDAQTGLFLETLFMLPAAAIYLIWLADTPTSDMALNTWQLNLLLVCAGVVTTLPLLCFTGAAARLKLSTLGFF
        180         190         200         210         220         230         240

1062        1092        1122        1152        1182        1212        1242        1272
QYINPTIQLLLALFIFKETIVSGEVIGFIFIWLAILVFSIGQVHTMLKKGK*DDLSRSARMDS**ISFWY*TRFGTYEMD
|||   |::|||:::     |   |   |  |||  |:::||
QYIGPSLMFLLAVLVYGEAFTSDKAITFAFIWSALVIFSVDGLKAGHAARRAR
        260         270         280         290         300
```

---

Possible site: 20
>>> Seems to have no N-terminal signal sequence
----- Final Results -----
   bacterial cytoplasm --- Certainty = 0.0881 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database.

```
>GP:AAC44297 GB:U41735 homoserine kinase homolog [Streptococcus pneumoniae]
Identities = 188/289 (65%), Positives = 232/289 (80%), Gaps = 1/289 (0%)
Query: 1     MRIIVPATSANIGPGFDSIGVALSKYLIIEVLEESTEWLVEHNLVN-IPKDHTNLLIQTA  59
             M+IIVPATSANIGPGFDS+GVA++KYL IEV EE  EWL+EH +   IP D  NLL + A
Sbjct: 1     MKIIVPATSANIGPGFDSVGVAVTKYLQIEVSEERDEWLIEHQIGKWIPHDERNLLLTIA  60

Query: 60    LHVKSDLAPHRLKMFSDIPLARGLGSSSSVIVAGIELANQLGNLALSQKEKLEIATRLEG  119
             L +  DL P RLKM SD+PLARGLGSSSSVIVAGIELANQLG L LS  EKL++AT++EG
Sbjct: 61    LQIVPDLQPRRLKMTSDVPLARGLGSSSSVIVAGIELANQLGQLNLSDHEKLQLATKIEG  120

Query: 120   HPDNVAPAIFGDLVISSIVKNDIKSLEVMFPDSSFIAFIPNYELKTSDSRNVLPQKLSYE  179
             HPDNVAPAI+G+LVI+S V+  + ++   FP+  F+A+IPNYEL+T DSR+VLP+KLSY+
Sbjct: 121   HPDNVAPAIYGNLVIASSVEGQVSAIVADFPECDFLAYIPNYELRTRDSRSVLPKKLSYK  180

Query: 180   DAVASSSVANVMVASLLKGDLVTAGWAIERDLFHERYRQPLVKEFEVIKQISTQNGAYAT  239
             +AVA+SS+ANV VA+LL GD+VTAG AIE DLFHERYRQ LV+EF +IKQ++ +NGAYAT
Sbjct: 181   EAVAASSIANVAVAALLAGDMVTAGQAIEGDLFHERYRQDLVREFAMIKQVTKENGAYAT  240

Query: 240   YLSGAGPTVMVLCSKEKEQAIVTELSKLCLGGQIQVLNIERKGVRVEKR            288
             YLSGAGPTVMVL S +K   I  EL K    G++  L ++ +GVRVE +
Sbjct: 241   YLSGAGPTVMVLASHDKMPTIKAELEKQPFKGKLHDLRVDTQGVRVEAK            289
```

No corresponding DNA sequence was identified in *S. pyogenes*.

Based on this analysis, it was predicted that this protein and its epitopes, could be useful antigens for vaccines or diagnostics.

Example 1720

A DNA sequence (GBSx1824) was identified in *S. agalactiae* <SEQ ID 5349> which encodes the amino acid sequence <SEQ ID 5350>. This protein is predicted to be homoserine dehydrogenase (hom). Analysis of this protein sequence reveals the following:

Possible site: 30
>>> Seems to have no N-terminal signal sequence
----- Final Results -----
   bacterial membrane --- Certainty = 0.0000 (Not Clear) <succ>
     bacterial outside --- Certainty = 0.0000 (Not Clear) <succ>
       bacterial cytoplasm --- Certainty = 0.0000 (Not Clear) <succ>

A related GBS nucleic acid sequence <SEQ ID 9857> which encodes amino acid sequence <SEQ ID 9858> was also identified.

The protein has homology with the following sequences in the GENPEPT database.

```
>GP:CAA65713 GB:X96988 hom [Lactococcus lactis]
Identities = 221/432 (51%), Positives = 307/432 (70%), Gaps = 11/432 (2%)
Query: 15    MTIKIALLGFGTVAKGIPYLLKENQHKLLSLEGEDIVIDKVLVRDNESRQRFINQGFTYN  74
             M + IA+LGFGTV  G+P LL EN+ KL  +  E+IVI KVL+RDN++ ++  +QGF Y+
Sbjct: 1     MAVNIAILGFGTVGTGLPTLLSENKEKLAKILDEEIVISKVLMRDNKAIEKARSQGFNYD  60

Query: 75    FVTEINTILQDSQIDIVVELMGGIEPAKTYLSQALGFGKHIVTANKDLIALHGKELMDLA  134
             FV  ++ IL DS+I IVVELMG IEPAKTY++QA+   GK++VTANKDL+A+HG EL  LA
Sbjct: 61    FVLNLDDILADSEISIVVELMGRIEPAKTYITQAIEAGKNVVTANKDLLAVHGVELRSLA  120

Query: 135   DARGLALEYEGAVAGGIPILRTLSHSFASDKMTRLLGILNGTSNFMLTKMFEEGWSYEQA  194
              +AL+YE AVAGGIPILRTL++SF+SDK+T LLGILNGTSNFM+TKM EEGW+Y+++
Sbjct: 121   QKHHVALYYEAAVAGGIPILRTLANSFSSDKITHLLGILNGTSNFMMTKMSEEGWTYDES  180

Query: 195   LKKAQELGYAESDPTNDVEGIDTAYKATILSQFGFGMPIDFDDVNYKGISSIRSEDVEVA  254
             L KAQELGYAESDPTNDV+GID +YK  ILS+F GM +  DD+   G+ SI+  DVE+A
Sbjct: 181   LAKAQELGYAESDPTNDVDGIDASYKLAILSEFAFGMTLAPDDIAKSGLRSIQKTDVEIA  240

Query: 255   QEMGFAIKLVADLRETPTGISVDVSPTLISQKHPLAAVNHVMNAVFIESIGIGQSLFYGP  314
             Q+ G+ +KL   + E  +GI  +VSPT + + HPLA+VN VMNAVFIES GIG S+FYG
Sbjct: 241   QQFGYVLKLTGEINEVDSGIFAEVSPTFLPKSHPLASVNGVMNAVFIESEGIGDSVFYGA  300

Query: 315   GAGQNPTATSVLADIIDISRSIRSQIKIKPMNTYHCPCRLSMQSDIFNEYYLAISLRNAE  374
             GAGQ PTATSVLADI+ I + ++    K NY    L+  DI N+YY ++       E
Sbjct: 301   GAGQKPTATSVLADIVRIVKRVKDGTIGKSFNEYARSTSLANPHDIENKYYFSV-----E  355
```

```
Query: 375   DSDTLGR------YFEQENIGLKNVIEKALGDKQQEIYVLTDEVSQEKITQFIEEFPESG 428
             D+ G+         F  EN+  + V+++    K+  + +++ ++++ +++   ++  +
Sbjct: 356   TPDSTGQLLLLVELFTSENVSFEQVLQQKGNGKRAVVVIISHKINRVQLSAIQDKLNQEK 415

Query: 429   VIQLINVFKVIG                                                 440
             +L+N FKV+G
Sbjct: 416   DFKLLNRFKVLG                                                 427
```

No corresponding DNA sequence was identified in *S. pyogenes*.

Based on this analysis, it was predicted that this protein and its epitopes, could be useful antigens for vaccines or diagnostics.

Example 1721

A DNA sequence (GBSx1825) was identified in *S. agalactiae* <SEQ ID 5351> which encodes the amino acid sequence <SEQ ID 5352>. Analysis of this protein sequence reveals the following:

Possible site: 21
>>> Seems to have no N-terminal signal sequence
----- Final Results -----

Possible site: 29
>>> Seems to have an uncleavable N-term signal seq
INTEGRAL    Likelihood = −12.79    Transmembrane 20-36 (14-41)
----- Final Results -----
   bacterial membrane --- Certainty = 0.6116 (Affirmative) 21 succ>
      bacterial outside --- Certainty = 0.0000 (Not Clear) <succ>
         bacterial cytoplasm --- Certainty = 0.0000 (Not Clear) <succ>

The protein has homology with the following sequences in the GENPEPT database.

```
>GP:CAB15906  GB:Z99123 similar to hypothetical proteins [Bacillus subtilis]
Identities = 105/272 (38%), Positives = 149/272 (54%), Gaps = 20/272 (7%)
Query: 25    FLLIALIGIFLFFNNRSKQEIKT-----KTNASSHRKIVTSIKKKK-----WIKQKTPVK  74
             FL I L+G  L     + QE     K       K    ++KK+      WIK + P K
Sbjct: 5     FLSIFLLGSCLALAACADQEANAEQPMPKAEQKKPEKKAVQVQKKEDDTSAWIKTEKPAK  64

Query: 75    IPILMYHAVHVMDPSEAASANLIVAPDIFESHIKRLKKEGYYFLAPNEAYRALNENALPE 134
             +PILMYH++         ++  +L V    FE+H+K L   GY   L PEA    L ++  P
Sbjct: 65    LPILMYHSI-------SSGNSLRVPKKEFEAHMKWLHDNGYQTLTPKEASLMLTQDKKPS 117

Query: 135   KKVIWITFDDGNADFYTKAYPILKKYKVKATNNIITGFVQEGRESNLNVQQMLEMKQNGM 194
             +K + ITFDDG  D Y  AYP+LKKY +KAT  +I   +  G + +L  +QM EM Q+G+
Sbjct: 118   EKCVLITFDDGYTDNYQDAYPVLKKYGMKATIFMIGKSI--GHKHHLTEEQMKEMAQHGI 175

Query: 195   SFQGHTVTHPNLSLLTPELQTQEMTLSKQFLDQKLSQDTLAIAYPSGRYNPTTLDIASQY 254
             S + HT+ H   L+ LTP+ Q  EM  SK+  D     Q T  I+YP GRYN   TL  A +
Sbjct: 176   SIESHTIDHLELNGLTPQQQQSEMADSKKLFDNMFHQQTTIISYPVGRYNEETLKAAEKT 235

Query: 255   -YKLGLTTNEGVATKDNGLLSLNRIRILPTTS                             285
              Y++G+TT   G A++D G+  +L+R+R+   P    S
Sbjct: 236   GYQMGVTTEPGAASRDQGMYALHRVRVSPGMS                             267
```

-continued bacterial cytoplasm --- Certainty = 0.4548 (Affirmative) <succ>
      bacterial membrane --- Certainty = 0.0000 (Not Clear) <succ>
         bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1722

A DNA sequence (GBSx1826) was identified in *S. agalactiae* <SEQ ID 5353> which encodes the amino acid sequence <SEQ ID 5354>. Analysis of this protein sequence reveals the following:

A related DNA sequence was identified in *S. pyogenes* <SEQ ID 5355> which encodes the amino acid sequence <SEQ ID 5356>. Analysis of this protein sequence reveals the following:

Possible site:24
>>> May be a lipoprotein
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>

The protein has homology with the following sequences in the databases:

```
>GP:CAB15906 GB:Z99123 similar to hypothetical proteins [Bacillus subtilis]
Identities = 97/240 (40%), Positives = 140/240 (57%), Gaps = 9/240 (3%)
Query: 71    KKTHFDSSKSQKKAHSKLTWTKQETPVKIPILMYHAIHVMSPEETANANLIVNPDLFDQQ 130
             KK   + + QKK       W K E P K+PILMYH+I       ++  +L V   F+
Sbjct: 37    KKPEKKAVQVQKKEDDTSAWIKTEKPAKLPILMYHSI-------SSGNSLRVPKKEFEAH 89

Query: 131   LQKMKDEGYYFLSPEEVYRALSNNELPAKKVVWLTFDDSMIDFYNVAYPILKKYDAKATN 190
             ++ + D GY L+P+E     L+ ++ P++K V +TFDD   D Y  AYP+LKKY  KAT
Sbjct: 90    MKWLHDNGYQTLTPKEASLMLTQDKKPSEKCVLITFDDGYTDNYQDAYPVLKKYGMKATI 149

Query: 191   NVITGLTEMGSAANLTLKQMKEMKQVGMSFQDHTVNHPDLEQASPDVQTTEMKDSKDYLD 250
             +I     +G    +LT +QMKEM Q G+S + HT++H +L   +P  Q +EM DSK   D
Sbjct: 150   FMIG--KSIGHKHHLTEEQMKEMAQHGISIESHTIDHLELNGLTPQQQQSEMADSKKLFD 207

Query: 251   KQLNQNTIAIAYPSGRYNDTTLQIAARLNYKLGVTTNEGIASAANGLLSLNRIRILPNMS 310
              +Q T   I+YP GRYN+ TL+ A +   Y++GVTT  G AS    G+ +L+R+R+ P MS
Sbjct: 208   NMFHQQTTIISYPVGRYNEETLKAAEKTGYQMGVTTEPGAASRDQGMYALHRVRVSPGMS 267
```

An alignment of the GAS and GBS proteins is shown below.

```
Identities = 153/265 (57%), Positives = 199/265 (74%), Gaps = 4/265 (1%)
Query: 33    IFLFFNNRSKQEIKTK---TNASSHRKIVTSIKKKKWIKQKTPVKIPILMYHAVHVMDPS 89
             I LF + ++ ++   TK    T+ S +    +  K  W KQ+TPVKIPILMYHA+HVM P
Sbjct: 54    ISLFHHKKTAKKETTKLKKTHFDSSKSQKKAHSKLTWTKQETPVKIPILMYHAIHVMSPE 113

Query: 90    EAASANLIVAPDIFESHIKRLKKEGYYFLAPNEAYRALNENALPEKKVIWITFDDGNADF 149
             E A+ANLIV PD+F+   ++++K EGYYFL+P E YRAL+ N LP KKV+W+TFDD   DF
Sbjct: 114   ETANANLIVNPDLFDQQLQKMKDEGYYFLSPEEVYRALSNNELPAKKVVWLTFDDSMIDF 173

Query: 150   YTKAYPILKKYKVKATNNIITGFVQEGRESNLNVQQMLEMKQNGMSFQGHTVTHPNLSLL 209
             Y  AYPILKKY  KATNN+ITG  + G   +NL ++QM EMKQ GMSFQ HTV HP+L
Sbjct: 174   YNVAYPILKKYDAKATNNVITGLTEMGSAANLTLKQMKEMKQVGMSFQDHTVNHPDLEQA 233

Query: 210   TPELQTQEMTLSKQFLDQKLSQDTLAIAYPSGRYNPTTLDIASQY-YKLGLTTNEGVATK 268
             +P++QT EM   SK +LD++L+Q+T+AIAYPSGRYN TTL IA++   YKLG+TTNEG+A+
Sbjct: 234   SPDVQTTEMKDSKDYLDKQLNQNTIAIAYPSGRYNDTTLQIAARLNYKLGVTTNEGIASA 293

Query: 269   DNGLLSLNRIRILPTTSDDDLIKTI                                    293
              NGLLSLNRIRILP  S  ++L++T+
Sbjct: 294   ANGLLSLNRIRILPNMSPENLLQTM                                    318
```

SEQ ID 5354 (GBS287d) was expressed in *E. coli* as a GST-fusion product. SDS-PAGE analysis of total cell extract is shown in FIG. 145 (lane 3 & 4; MW 57 kDa) and in FIG. 185 (lane 2; MW 57 kDa). It was also expressed in *E. coli* as a His-fusion product. SDS-PAGE analysis of total cell extract is shown in FIG. 145 (lane 6; MW 32 kDa) and in FIG. 181 (lane 5; MW 32 kDa).

Purified GBS287d-GST is shown in FIG. 243, lanes 10-11; purified GBS287d-His is shown in FIG. 234, lanes 7-8.

Based on this analysis, it was predicted that these proteins and their epitopes could be useful antigens for vaccines or diagnostics.

Example 1723

A DNA sequence (GBSx1828) was identified in *S. agalactiae* <SEQ ID 5357> which encodes the amino acid sequence <SEQ ID 5358>. Analysis of this protein sequence reveals the following:

---

Possible site: 21
>>> Seems to have no N-terminal signal sequence
----- Final Results -----
  bacterial membrane --- Certainty = 0.0000 (Not Clear) <succ>
  bacterial outside --- Certainty = 0.0000 (Not Clear) <succ>
  bacterial cytoplasm --- Certainty = 0.0000 (Not Clear) <succ>

---

The protein has no significant homology with any sequences in the GENPEPT database.

Based on this analysis, it was predicted that this protein and its epitopes, could be useful antigens for vaccines or diagnostics.

Example 1724

A DNA sequence (GBSx1829) was identified in *S. agalactiae* <SEQ ID 5359> which encodes the amino acid sequence <SEQ ID 5360>. Analysis of this protein sequence reveals the following:

---

Possible site: 40
>>> Seems to have no N-terminal signal sequence
----- Final Results -----
  bacterial cytoplasm --- Certainty = 0.3352 (Affirmative) <succ>
  bacterial membrane --- Certainty = 0.0000 (Not Clear) <succ>
  bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1725

A DNA sequence (GBSx1830) was identified in *S. agalactiae* <SEQ ID 5361> which encodes the amino acid sequence <SEQ ID 5362>. This protein is predicted to be glycine betaine transporter BetL (opuD). Analysis of this protein sequence reveals the following:

```
Possible site: 61
>>> Seems to have an uncleavable N-term signal seq
INTEGRAL    Likelihood = -12.68   Transmembrane 439-455 (435-491)
INTEGRAL    Likelihood = -12.10   Transmembrane 256-272 (249-281)
INTEGRAL    Likelihood = -11.30   Transmembrane 464-480 (456-491)
INTEGRAL    Likelihood = -10.83   Transmembrane 49-65 (44-74)
INTEGRAL    Likelihood = -10.40   Transmembrane 11-27 (5-34)
INTEGRAL    Likelihood = -9.98    Transmembrane 396-412 (390-419)
INTEGRAL    Likelihood = -9.29    Transmembrane 224-240 (220-247)
INTEGRAL    Likelihood = -7.11    Transmembrane 347-363 (341-366)
INTEGRAL    Likelihood = -2.87    Transmembrane 143-159 (143-159)
INTEGRAL    Likelihood = -2.60    Transmembrane 192-208 (191-208)
INTEGRAL    Likelihood = -1.44    Transmembrane 86-102 (86-105)
----- Final Results -----
   bacterial membrane --- Certainty = 0.6074 (Affirmative) <succ>
    bacterial outside --- Certainty = 0.0000 (Not Clear) <succ>
      bacterial cytoplasm --- Certainty = 0.0000 (Not Clear) <succ>
```

The protein has homology with the following sequences in the GENPEPT database.

```
>GP:AAD30266 GB:AF102174 glycine betaine transporter BetL [Listeria
monocytogenes]

Identities = 277/503 (55%), Positives = 365/503 (72%), Gaps = 1/503 (0%)
Query:    4  KHITPVFTGSLIVSLILVLLGIIVPRGFQSWTQILREQVSTNFGWLYLLLVISILALCVF    63
             K +T VF GS  + L+ VL G  +P  F+++T   +++ +++NFGW YL++V  I+   C+F
Sbjct:    2  KKLTNVFWGSGFLVLLAVLFGAFLPEQFETFTNHIQKFLTSNFGWYYLIVVAIIIIFCLF    61

Query:   64  FIMSPLGQIRLGQPHSRPEYSTVSWIAMMFSAGMGIGLVFYGAAEPLSHFAISTPGAPKE   123
             ++SP+G  IRLG+P     P YS   SW AM+FSAGMGIGLVF+GAAEPLSH+A+   PG
Sbjct:   62  LVLSPIGSIRLGKPGEEPGYSNKSWFAMLFSAGMGIGLVFWGAAEPLSHYAVQAPGGEVG   121

Query:  124  SQTALADAFRFTFFHWGIHAWAVYALVALALAYFGFRKQEKYLLSVTLKPLFGDKTDGWL   183
             +Q A+ DA R++FFHWGI AW++YA+VALALAYF FRK      L+S TL P+ G    G +
Sbjct:  122  TQAAMKDALRYSFFHWGISAWSIYAIVALALAYFKFRKNAPGLISATLYPILGKHAKGPI   181

Query:  184  GKIVDITTVVATVIGVATTLGFGAAQINGGLSFLLGVPNNAFVQIVIILITTALFVMSAL   243
             G+++DI  V ATVIGVATTLG GA QINGGL++L GVPNN   VQ   II+I T LF++SA+
Sbjct:  182  GQLIDIIAVFATVIGVATTLGLGAQQINGGLTYLFGVPNNFTVQFTIIVIVTILFMLSAM   241

Query:  244  SGLGKGVKILSNLNLILAVALLALVIVLGPTVRIFDTLTESLGSYLQNFFGMSFRAAAFD   303
             SGL KG+++LSN+N+  +A  LL L ++LGPT+ I +   T S G YLQN    MSF+ A
Sbjct:  242  SGLDKGIQLLSNVNIYVAGVLLVLTLILGPTLFIMNNFTNSFGDYLQNIIQMSFQTAPDA   301

Query:  304  NTKRSWIDNWTIFYWAWWISWSPFVGVFIARISKGRSIREFLTVVLLIPTLLSFVWFAAF   363
               R WID+WTIFYWAWW+SWSPFVG+FIARIS+GR+IR+FL  V+++P L+S  WFA F
Sbjct:  302  PDARKWIDSWTIFYWAWWLSWSPFVGIFIARISRGRTIRQFLLGVIVLPALVSVFWFAVF   361

Query:  364  GTLSTQVQQLG-TNLTKFATEEVLFATFNHYTLGWLLSIIAIILIFSFFITSADSATYVL   422
             G  +   V+Q G + L+   ATE+VLF   FN +  G +LSI+A+ILI FFITSADSAT+VL
Sbjct:  362  GGSAIFVEQHGNSGLSSLATEQVLFGVFNEFPGGMMLSIVAMILIAVFFITSADSATFVL   421

Query:  423  AMLTEDGNLNPKNRTKVIWGLVLAVIAIVLLLSGGLLALQNVLIIVALPFSFVMILMMLA   482
              M T   G+LNP N   KV WGL+ A  IA VLL +GGL ALQN  II A PFS V+ILM+++
Sbjct:  422  GMQTTGGSLNPPNSVKVTWGLLQAGIASVLLYAGGLTALQNASIIAAPFSIVIILMIVS   481

Query:  483  LLVELFHEKKEMGLSISPDRYPR                                       505
             L V L   E++++GL + P +  R
Sbjct:  482  LFVSLTREQEKLGLYVRPKKSQR                                       504
```

No corresponding DNA sequence was identified in *S. pyogenes*.

A related GBS gene <SEQ ID 8887> and protein <SEQ ID 8888> were also identified. Analysis of this protein sequence reveals the following:

```
Lipop: Possible site: -1   Crend: 4
McG: Discrim Score: 15.28
GvH: Signal Score (-7.5): -4.24
Possible site: 61
>>> Seems to have an uncleavable N-term signal seq
ALOM program   count: 11 value: -12.68 threshold: 0.0
INTEGRAL    Likelihood = -12.68   Transmembrane 439-455 (435-491)
INTEGRAL    Likelihood = -12.10   Transmembrane 256-272 (249-281)
INTEGRAL    Likelihood = -11.30   Transmembrane 464-480 (456-491)
INTEGRAL    Likelihood = -10.83   Transmembrane 49-65 (44-74)
INTEGRAL    Likelihood = -10.40   Transmembrane 11-27 (5-34)
INTEGRAL    Likelihood = -9.98    Transmembrane 396-412 (390-419)
INTEGRAL    Likelihood = -9.29    Transmembrane 224-240 (220-247)
INTEGRAL    Likelihood = -7.11    Transmembrane 347-363 (341-366)
INTEGRAL    Likelihood = -2.87    Transmembrane 143-159 (143-159)
INTEGRAL    Likelihood = -2.60    Transmembrane 192-208 (191-208)
INTEGRAL    Likelihood = -1.44    Transmembrane 86-102 (86-105)
PERIPHERAL  Likelihood = 3.50     319
modified ALOM score: 3.04
*** Reasoning Step: 3
----- Final Results -----
   bacterial membrane --- Certainty = 0.6074 (Affirmative) <succ>
    bacterial outside --- Certainty = 0.0000 (Not Clear) <succ>
      bacterial cytoplasm --- Certainty = 0.0000 (Not Clear) <succ>
```

The protein has homology with the following sequences in the databases:

```
ORF02057(310-1821 of 2145)
GP|4835822|gb|AAD30266.1|AF102174_1|AF102174(2-506 of 507) glycine betaine transporter
BetL {Listeria monocytogenes} PIR|T48645|T48645 glycine betaine transport protein betL
[validated] - Listeria monocytogenes
% Match = 38.7
% Identity = 54.9 % Similarity = 74.7
Matches = 277 Mismatches = 127 Conservative Sub.s = 100

54        84       114       144       174       204       234       264
IQGGHHYRNYRLEVLKIQDMVVS*ANLDLMPLSTNIWYLHQIVINH*VKHKNQIMLFGSFLLRRQGEVLIQVVKMRGVFI 294       324       354       384       414       444       474       504
KVCYTILV*EEILSKKHITPVFTGSLIVSLILVLLGIIVPRGFQSWTQILREQVSTNFGWLYLLLVTSILALCVFFIMSP
                       |:|  ||  ||   :  |:  ||:|    :|    |:::  ::: ::::||||  ||::|   |:  :|:|:::||
            MKKLTNVFWGSGFLVLLAVLFGAFLPEQFETFTNHIQKFLTSNFGWYYLIVVAIIIIFCLFLVLSP
                    10        20        30        40        50        60

534       564       594       624       654       684       714       744
LGQIRLGQPHSRPEYSTVSWIAMMFSAGMGIGLVFYGAAEPLSHFAISTPGAPKESQTALADAFRFTFFHWGIHAWAVYA
:|  ||||:|   |  ||   ||  ||::||||||||||||:||||||||:|:  ||      :|  |:  ||:|::||||||  ||::||
IGSIRLGKPGEEPGYSNKSWFAMLFSAGMGIGLVFWGAAEPLSHYAVQAPGGEVGTQAAMKDALRYSFFHWGISAWSIYA
             80        90       100       110       120       130       140

774       804       834       864       894       924       954       984
LVALALAYFGFRKQEKYLLSVTLKPLFGDKTDGWLGKIVDITTVVATVIGVATTLGFGAAQINGGLSFLLGVPNNAFVQI
:||||||||||  |||   |:|  || |::|    |  :|::::||  |||||||||||:||   |:|::|:|||||   ||
IVALALAYFKFRKNAPGLISATLYPILGKHAKGPIGQLIDIIAVFATVIGVATTLGLGAQQINGGLTYLFGVPNNFTVQF
            160       170       180       190       200       210       220

1014      1044      1074      1104      1134      1164      1194      1224
VIILITTALFVMSALSGLGKGVKILSNLNLILAVALLALVIVLGPTVRIFDTLTESLGSYLQNFFGMSFRAAAFDNTKRS
||:|  |  ||::||:|||  ||::::|||:|: :|    ||  |  ::||||:   |  : :| :|  ||||     |||: |            |
TIIVIVTILFMLSAMSGLDKGIQLLSNVNIYVAGVLLVLTLILGPTLFIMNNFTNSFGDYLQNIIQMSFQTAPDAPDARK
            240       250       260       270       280       290       300

1254      1284      1314      1344      1374      1404      1431      1461
WIDNWTIFYWAWWISWSPFVGVFIARISKGRSIREFLTVVLLIPTLLSFVWFAAFGTLSTQVQQLGTN-LTKFATEEVLF
|||:|||||||||:|||||||:||||||:||:||:||   |:::|  |:|   |||  ||    :    |:|   |  :  :|||:|||
WIDSWTIFYWAWWLSWSPFVGIFIARISRGRTIRQFLLGVIVLPALVSVFWFAVFGGSAIFVEQHGNSGLSSLATEQVLF
            320       330       340       350       360       370       380

1491      1521      1551      1581      1611      1641      1671      1701
ATFNHYTLGWLLSIIAIILIFSFFITSADSATYVLAMLTEDGNLNPKNRTKVIWGLVLAVIAIVLLLSGGLLALQNVLII
|| :  |  :|||:|:|||  ||||||||||||:||   |  |:||| |  || |||: | || |||   :|||  ||||     ||
GVFNEFPGGMMLSIVAMILIAVFFITSADSATFVLGMQTTGGSLNPPNSVKVTWGLLQAGIASVLLYAGGLTALQNASII
            400       410       420       430       440       450       460

1731      1761      1791      1821      1851      1881      1911      1941
VALPFSFVMILMMLALLVELFHEKKEMGLSISPDRYPRKNEPFKSYEE*KEARRLLFIG*SS*SDHHR**LVRYEFD*EK
|:|||  |:|||:::|:|  |    |::::||  :  |:    |
AAFPFSIVIILMIVSLFVSLTREQEKLGLYVRPKKSQRSQL
            480       490       500
```

Based on this analysis, it was predicted that these proteins and their epitopes could be useful antigens for vaccines or diagnostics.

Example 1726

A DNA sequence (GBSx1831) was identified in *S. agalactiae* <SEQ ID 5363> which encodes the amino acid sequence <SEQ ID 5364>. This protein is predicted to be succinic semialdehyde dehydrogenase (gabD-1). Analysis of this protein sequence reveals the following:

Possible site: 43
>>> Seems to have no N-terminal signal sequence

----- Final Results -----
bacterial cytoplasm --- Certainty = 0.2733 (Affirmative) <succ>
bacterial membrane --- Certainty = 0.0000 (Not Clear) <succ>
bacterial outside --- Certainty = 0.0000 (Not Clear) <succ>

A related GBS nucleic acid sequence <SEQ ID 9859> which encodes amino acid sequence <SEQ ID 9860> was also identified.

The protein has homology with the following sequences in the GENPEPT database.

```
>GP:AAD19405 GB:AF102543 succinic semialdehyde dehydrogenase
[Zymomonas mobilis]
Identities = 229/455 (50%), Positives = 305/455 (66%), Gaps = 5/455 (1%)
Query:   10 MAYKTIYPYTNEVLHEFDNISDSDLEQSLDIAHALYKTWRKEDNVEERQNQLHKVADLLR   69
            MAY+++ P T E + ++ + SD  ++ S+D A  ++K   +  + ER   LHK A++ R
Sbjct:    1 MAYESVNPATGETVKKYPDFSDKQVKDSVDRAATVFKNDWSQRTIAERSKVLHKAAEIFR   60

Query:   70 KDRDKYAEVMTKDMGKLFTEAQGEVDLCADIADYYADNGQKFLKPVPLESPNGEAYYLKQ  129
             D DKYA+++T DMGK   EA+GEV+L ADI DYYA NG+KFL P  +E    G A
Sbjct:   61 SDVDKYAKLLTIDMGKKIAEARGEVNLSADILDYYAKNGEKFLAPQKVEEKPG-AVVKAF  119

Query:  130 AVGVLLAVEPWNFPFYQIMRVFAPNFIVGNTMLLKHASICPASAQAFEDLVREAGAPEGA  189
             +G+LLA EPWNFP+YQ+ R+  P  I GN +L+KH+S  P SA AFE ++ EAGAP+G
Sbjct:  120 PLGLLLAIEPWNFPYYQLARIAGPYLIAGNALLVEHSSSVPQSAHAFEAVLEEAGAPKGI  179

Query:  190 FKNIFASYDQVSNLISDPRVAGVCLTGSERGGASIAAEAGKNLKKSSMELGGNDAFLILD  249
             + N+ AS DQVS +I DPRV GV +TGS   GA +AA+AGK  KKS MELGG+DAF++LD
Sbjct:  180 YTNLDASPDQVSQIIEDPRVRGVTVTGSASVGAELAAKAGKMWKKSVMELGGSDAFIVLD  239

Query:  250 DADFD--LLSKTIFFARLYNAGQVCTSSKRFIVMADKYDE-FVNMVVETFKSAKWGDPMD  306
             D D  L+ K + RL+NAGQV ++KRFI++   K  E F    + + F++ K GDPMD
Sbjct:  240 GVDIDDKLIDKAAY-GRLFNAGQVFCAAKRFIIVGQKRAELFTEKLKQRFEALKIGDPMD  298

Query:  307 SETTLAPLSSAGAKDDVLKQIKLAVDHGAEVVFGNDTIDHPGNFVMPTVLTNITKANPIY  366
              T L PLSS  GA+D V+KQ++ AV +GA++V G    I+   G F+    +LT+I + NP Y
Sbjct:  299 ESTDLGPLSSVGARDQVVKQVEKAVQNGAKLVCGGKAIEGKGAFMKAGILTDIKRENPAY  358

Query:  367 NQEIFGPVASIYKVDTEEEAIALANDSSYGLGSTVFSSDPEHAKKVAAQIETGMTFINSG  426
             +E FGP+A IY V  E EAI LANDS YGLG  VF+ D E  +KVA QIETGM  IN
Sbjct:  359 FEEFFGPIAQIYAVEDEAEAIELANDSPYGLGGAVFAPDVEQGRKVAEQIETGMVAINKP  418

Query:  427 WTSLPELPFGGIKNSGYGRELSQLGFDAFVNEHLV                          461
              + PELPFGG+K+SGYGRELS  G    F+N  L+
Sbjct:  419 LWTAPELPFGGVKHSGYGRELSHFGIQEFINWKLI                          453
```

A related DNA sequence was identified in *S. pyogenes* <SEQ ID 5365> which encodes the amino acid sequence <SEQ ID 5366>. Analysis of this protein sequence reveals the following:

Possible site: 27
>>> Seems to have no N-terminal signal sequence

----- Final Results -----
bacterial cytoplasm --- Certainty = 0.2887 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 335/457 (73%), Positives = 397/457 (86%)
Query:    9 IMAYKTIYPYTNEVLHEFDNISDSDLEQSLDIAHALYKTWRKEDNVEERQNQLHKVADLL   68
            +MAY+TIYPYTNEVLH FDN++D   L   AH LYK WRKED+++EER+ QLH+VA++L
Sbjct:    1 VMAYQTIYPYTNEVLHTFDNMTDQGLADVLERAHLLYKKWRKEDHLEERKAQLHQVANIL   60

Query:   69 RKDRDKYAEVMTKDMGKLFTEAQGEVDLCADIADYYADNGQKFLKPVPLESPNGEAYYLK  128
            R+DRDKYAE+MTKDMGKLFTEAQGEV+LCADIADYYAD   +FL    PLE+  +G+AYYLK
Sbjct:   61 RRDRDKYAEIMTKDMGKLFTEAQGEVNLCADIADYYADKADEFLMSTPLETDSGQAYYLK  120

Query:  129 QAVGVLLAVEPWNFPFYQIMRVFAPNFIVGNTMLLKHASICPASAQAFEDLVREAGAPEG  188
            Q+ GV+LAVEPWNFP+YQIMRVFAPNFIVGN M+LKHASICP SAQ+FE+LV EAGA  G
Sbjct:  121 QSTGVILAVEPWNFPYYQIMRVFAPNFIVGNPMVLKHASICPRSAQSFEELVLEAGAEAG  180

Query:  189 AFKNIFASYDQVSNLISDPRVAGVCLTGSERGGASIAAEAGKNLKKSSMELGGNDAFLIL  248
             +  N+F SYDQVS +I+D RV GVCLTGSERGGASIA EAGKNLKK+++ELGG+DAF IL
Sbjct:  181 SITNLFISYDQVSQVIADKRVVGVCLTGSERGGASIAEEAGKNLKKTTLELGGDDAFIIL  240

Query:  249 DDADFDLLSKTIFFARLYNAGQVCTSSKRFIVMADKYDEFVNMVVETFKSAKWGDPMDSE  308
            DDAD+D L K  +F+RLYNAGQVCTSSKRFIV+   YD F  ++  + FK+AKWGDPMD E
Sbjct:  241 DDADWDQLEKVLYFSRLYNAGQVCTSSKRFIVLDKDYDREKELLTKVFKTAKWGDPMDPE  300

Query:  309 TTLAPLSSAGAKDDVLKQIKLAVDHGAEVVEGNDTIDHPGNFVMPTVLTNITKANPIYNQ  368
            TTLAPLSSA AK DVL QIKLA+DHGAE+V +   IDHPG+FVMPT++   +TK NPIY Q
Sbjct:  301 TTLAPLSSAQAKADVLDQIKLALDHGAELVYGGFAIDHPGHFVMPTIIAGLTKDNPIYYQ  360

Query:  369 EIFGPVASIYKVDTEEEAIALANDSSYGLGSTVFSSDPEHAKKVAAQIETGMTFINSGWT  428
            EIFGPV  IYKV +EEEAI +ANDS+YGLG T+FS+ EHAK VAA+IETGM+FINSGWT
Sbjct:  361 EIFGPVGEIYKVSSEEEAIEVANDSNYGLGGTIFSSNQEHAKAVAAKIETGMSFINSGWT  420
```

```
-continued
Query: 429  SLPELPFGGIKNSGYGRELSQLGFDAFVNEHLVFTPN        465
            SLPELPFGGIK+SGYGRELS+LGF +FVNEHL++ PN
Sbjct: 421  SLPELPFGGIKHSGYGRELSELGFTSFVNEHLIYIPN        457
```

Based on this analysis, it was predicted that these proteins and their epitopes could be useful antigens for vaccines or diagnostics.

Example 1727

A DNA sequence (GBSx1832) was identified in *S. agalactiae* <SEQ ID 5367> which encodes the amino acid sequence <SEQ ID 5368>. Analysis of this protein sequence reveals the following:

---

Possible site: 31
>>> Seems to have a cleavable N-term signal seq.
----- Final Results -----
  bacterial outside --- Certainty = 0.3000 (Affirmative) <succ>
  bacterial membrane --- Certainty = 0.0000 (Not Clear) <succ>
  bacterial cytoplasm --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1728

A DNA sequence (GBSx1833) was identified in *S. agalactiae* <SEQ ID 5369> which encodes the amino acid sequence <SEQ ID 5370>. Analysis of this protein sequence reveals the following:

---

Possible site: 41
>>> Seems to have a cleavable N-term signal seq.
INTEGRAL    Likelihood = −7.91    Transmembrane 94-110 (86-115)
INTEGRAL    Likelihood = −7.75    Transmembrane 154-170 (150-176)
INTEGRAL    Likelihood = −7.11    Transmembrane 316-332 (312-339)
INTEGRAL    Likelihood = −6.16    Transmembrane 258-274 (253-278)
INTEGRAL    Likelihood = −2.71    Transmembrane 218-234 (217-234)
INTEGRAL    Likelihood = −1.49    Transmembrane 286-302 (283-302)
INTEGRAL    Likelihood = −0.96    Transmembrane 73-89 (73-89)
INTEGRAL    Likelihood = −0.27    Transmembrane 121-137 (121-137)
----- Final Results -----
  bacterial membrane --- Certainty = 0.4163 (Affirmative) <succ>
  bacterial outside --- Certainty = 0.0000 (Not Clear) <succ>
  bacterial cytoplasm --- Certainty = 0.0000 (Not Clear) <succ>

---

A related GBS nucleic acid sequence <SEQ ID 9861> which encodes amino acid sequence <SEQ ID 9862> was also identified.

The protein has homology with the following sequences in the GENPEPT database.

```
>GP:AAC75219 GB:AE000305 orf, hypothetical protein [Escherichia coli K12]
Identities = 102/331 (30%), Positives = 172/331 (51%), Gaps = 26/331 (7%)
Query:  12  IPGLILCFIIA-IPSWLLGLYLPLIGAPVF-----AILIGIIVGSFYQNR--QLFNKGIA   63
            IPGL L  +I  +  W G +P +      F        AIL+G+++G+     + + G+
Sbjct:  17  IPGLALSAVITGVALW--GGSIPAVAGAGFSALTLAILLGMVLGNTIYPHIWKSCDGGVL   74

Query:  64  FTSKYILQTAVVLLGFGLNLMQVMKVGISSLPIIIMTISISLIIAYVL-QKLFKLDKTIA  122
            F  +Y+L+   ++L GF L    Q+  VGIS + I  ++T+S + ++A   L QK+F LDK   +
Sbjct:  75  FAKQYLLRLGIILYGFRLTFSQIADVGISGIIIDVLTLSSTFLLACFLGQKVFGLDKHTS  134

Query: 123  TLIGVGSSICGGSAIAATAPVINAKDDEVAQAISVIFLFNILAALIFPTLGNFIG--LSD  180
            +LIG GSSICG +A+  AT PV+ A+  +V  A++ + +F  +A   ++P +   +   S
Sbjct: 135  WLIGAGSSICGAAAVLATEPVVKAEASKVTVAVATVVIFGTVAIFLYPAIYPLMSQWFSP  194

Query: 181  HGFALFAGTAVNDTSSVTAT--ATAWDAINHSNTLGGATIVKLTRTLAIIPITIVLSIYH  238
                F ++ G+ V++ +  + V A       A + DA N       A I K+ R + +P  I+L+
Sbjct: 195  ETFGIYIGSTVHEVAQVVAAGHAISPDAEN------AAVISKMLRVMMLAPFLILLAA-R  247

Query: 239  MKQTQKEQSVSVTKI-FPKFVLYFILASLLTTIVASLGFSLRIFEPLKVLSKFFIVMAMG  297
            +KQ         S    +KI  P F + FI+ ++          +      L   L F + MAM
Sbjct: 248  VKQLSGANSGEKSKITIPWFAILFIVVAIFMSFHL---LPQSVVNMLVTLDTFLLAMAMA  304

Query: 298  AIGINTNVSKLIKTGGKSILLGAACWLGIII                               328
            A+G+  T+VS L K G K +L+       + I+
Sbjct: 305  ALGLTTHVSALKKAGAKPLLMALVLFAWLIV                               335
```

A related DNA sequence was identified in *S. pyogenes* <SEQ ID 5371> which encodes the amino acid sequence <SEQ ID 5372>. Analysis of this protein sequence reveals the following:

---

Possible site: 37
>>> Seems to have an uncleavable N-term signal seq
INTEGRAL    Likelihood = −9.29    Transmembrane 30-46 (22-50)
INTEGRAL    Likelihood = −8.12    Transmembrane 314-330 (311-338)
INTEGRAL    Likelihood = −6.05    Transmembrane 8-24 (7-29)
INTEGRAL    Likelihood = −6.00    Transmembrane 150-166 (146-172)

| INTEGRAL | Likelihood = −5.57 | Transmembrane 257-273 (252-277) |
| INTEGRAL | Likelihood = −3.50 | Transmembrane 91-107 (87-108) |
| INTEGRAL | Likelihood = −2.60 | Transmembrane 69-85 (68-87) |
| INTEGRAL | Likelihood = −2.55 | Transmembrane 289-305 (289-305) |

----- Final Results -----
bacterial membrane --- Certainty = 0.4715 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the databases:

```
>GP:AAC75219 GB:AE000305 orf, hypothetical protein [Escherichia coli]
Identities = 100/329 (30%), Positives = 173/329 (52%), Gaps = 21/329 (6%)
Query:   8 LPGLLLCLLLALPAWCLGRLFPIIGAP----VFAILLGMLLA-LFYEHRDKTKEG-ISFT   61
             +PGL L  ++    A   G +   + GA         AILLGM+L      Y H  K+ +G + F
Sbjct:  17 IPGLALSAVITGVALWGGSIPAVAGAGFSALTLAILLGMVLGNTIYPHIWKSCDGGVLFA   76

Query:  62 SKYILQTAVVLLGFGLNLTQVMAVGMQSLPIIISTIATALLVAYGL-QKWLRLDVNTATL  120
             +Y+L+   ++L GF L  +Q+   VG+   + I  T+++   L+A   L   QK      LD +T+  L
Sbjct:  77 KQYLLRLGIILYGFRLTFSQIADVGISGIIIDVLTLSSTFLLACFLGQKVFGLDKHTSWL  136

Query: 121 VGVGSSICGGSAVAATAPVIKAKDDEVAKAISVIFLFNMLAALLFPSLGQLLG--LSNEG  178
             +G GSSICG +AV AT  PV+KA+   +V   A++ + +F  +A  L+P++    L+     S  E
Sbjct: 137 IGAGSSICGAAAVLATEPVVKAEASKVTVAVATVVIFGTVAIFLYPAIYPLMSQWFSPET  196

Query: 179 FAIFAGTAVNDTSSVTATATAWDALHHSNTLDGATIVKLTRTLAILPITLGLSLYRAKKE  238
             F I+ G+ V++ + V A    A         +  + A I K+ R + +P   + L+    R K+
Sbjct: 197 FGIYIGSTVHEVAQVVAAGHAIS----PDAENAAVISKMLRVMMLAPFLILLAA-RVKQL  251

Query: 239 HDIVTEENFSLRKSFPRFILFFLLASLITTLMTSLGVSADSFHYLKILSKFFIVMAMAAI  298
                + E   + +P F + F++ ++   +         +  L TL   F  + MAMAA+
Sbjct: 252 SGANSGEKSKI--TIPWFAILFIVVAIFNSFHL---LPQSVVNMLVTLDTFLLAMAMAAL  306

Query: 299 GLNTNLVKLIKTGGQAILLGAI--CWVAI                                325
              GL T++   L K G + +L+  +     W+ +
Sbjct: 307 GLTTHVSALKKAGAKPLLMALVLFAWLIV                                335
```

An alignment of the GAS and GBS proteins is shown below.

```
Identities = 225/333 (67%), Positives = 277/333 (82%), Gaps = 3/333 (0%)
Query:  11 KIPGLILCFIIAIPSWLLGLYLPLIGAPVFAILIGIIVGSFYQNRQLFNKGIAFTSKYIL   70
             K+PGL+LC  ++A+P+W LG    P+IGAPVFAIL+G+++   FY++R      +GI+FTSKYIL
Sbjct:   7 KLPGLLLCLLLALPAWCLGRLFPIIGAPVFAILLGMLLALFYEHRDKTKEGISFTSKYIL   66

Query:  71 QTAVVLLGFGLNLMQVMKVGISSLPIIIMTISISLIIAYVLQKLFKLDKTIATLGIVGSS  130
             QTAVVLLGFGLNL QVM VG+  SLPIII TI+ +L++AY LQK  +LD    ATL+GVGSS
Sbjct:  67 QTAVVLLGFGLNLTQVMAVGMQSLPIIISTIATALLVAYGLQKWLRLDVNTATLVGVGSS  126

Query: 131 ICGGSAIAATAPVINAKDDEVAQAISVIFLFNILAALIFPTLGNFIGLSDHGFALFAGTA  190
             ICGGSA+AATAPVI AKDDEVA AISVIFLFN+LAAL+FP+LG  +GLS+  GFA+FAGTA
Sbjct: 127 ICGGSAVAATAPVIKAKDDEVAKAISVIFLFNMLAALLFPSLGQLLGLSNEGFAIFAGTA  186

Query: 191 VNDTSSVTATATAWDAINHSNTLGGATIVKLTRTLAIIPITIVLSIYHMKQTQ---KEQS  247
             VNDTSSVTATATAWDA++HSNTL GATIVKLTRTLAI+PIT+ LS+Y  K+       E++
Sbjct: 187 VNDTSSVTATATAWDALHHSNTLDGATIVKLTRTLAILPITLGLSLYRAKKEHDIVTEEN  246

Query: 248 VSVTKIFPKEVLYFILASLLTTIVASLGFSLRIFEPLKVLSKFFIVMAMGAIGINTNVSK  307
             +S+ K  FP+++L+F+LASL+TT++  SLG S   F     LK LSKFFIVMAM AIG+NTN+ K
Sbjct: 247 FSLRKSFPRFILFFLLASLITTLMTSLGVSADSFHYLKTLSKFFIVMAMAAIGLNTNLVK  306

Query: 308 LIKTGGKSILLGAACWLGIIIVSLTMQAILGTW                            340
             LIKTGG++ILLGA CW+  I  +VSL MQ   LG W
Sbjct: 307 LIKTGGQAILLGAICWVAITLVSLAMQLSLGIW                            339
```

A related GBS gene <SEQ ID 8889> and protein <SEQ ID 8890> were also identified. Analysis of this protein sequence reveals the following:

Lipop: Possible site: −1   Crend: 10
McG: Discrim Score: 22.17
GvH: Signal Score (−7.5): −0.429999

Possible site: 41
>>> Seems to have a cleavable N-term signal seq.
ALOM program   count: 8 value: −7.91 threshold: 0.0

| INTEGRAL | Likelihood = −7.91 | Transmembrane 94-110 (86-115) |
| INTEGRAL | Likelihood = −7.75 | Transmembrane 154-170 (150-176) |
| INTEGRAL | Likelihood = −7.11 | Transmembrane 316-332 (312-339) |
| INTEGRAL | Likelihood = −6.16 | Transmembrane 258-274 (253-278) |
| INTEGRAL | Likelihood = −2.71 | Transmembrane 218-234 (217-234) |
| INTEGRAL | Likelihood = −1.49 | Transmembrane 286-302 (283-302) |
| INTEGRAL | Likelihood = −0.96 | Transmembrane 73-89 (73-89) |
| INTEGRAL | Likelihood = −0.27 | Transmembrane 121-137 (121-137) |

PERIPHERAL   Likelihood = 3.29   175
modified ALOM score: 2.08
*** Reasoning Step: 3
----- Final Results -----
bacterial membrane --- Certainty = 0.4163 (Affirmative) <succ>

-continued bacterial outside --- Certainty = 0.0000 (Not Clear) <succ>
bacterial cytoplasm --- Certainty = 0.0000 (Not Clear) <succ>

The protein has homology with the following sequences in the databases:

```
ORF02059(334-1284 of 1620)
EGAD|10465|EC2158(17-335 of 349) hypothetical 36.9 kd protein in lysp-nfo intergenic
region {Escherichia coli} OMNI|NT01EC2574 conserved hypothetical protein
SP|P33019|YEIH_ECOLI HYPOTHETICAL 36.9 KDA PROTEIN IN LYSP-NFO INTERGENIC REGION.
GP|405879|gb|AAA60511.1||U00007 yeiH {Escherichia coli} GP|1788482|gb|AAC75219.1||AE000305
orf, hypothetical protein {Escherichia coli} PIR|E64984|E64984 hypothetical 36.9 kD protein
in lysP-nfo intergenic region - Escherichia coli (strain K-12)
% Match = 12.7
% Identity = 32.3 % Similarity = 57.1
Matches = 103 Mismatches = 125 Conservative Sub.s = 79

270       300       330       360       390               435       462
YSGPLSVFLSRFKACDIIVNVRRTIMLFKEKIPGLILCFIIAIPSWLLGLYLPLI-----GAPVFAILIGIIVG-SFYQN
                ||||  |   :|            |   |  | :|       |  :|||:|:::|   :  | :
             MTNITLQKQHRTLWHFIPGLALSAVIT-GVALWGGSIPAVAGAGFSALTLAILLGMVLGNTIYPH
                10        20        30        40        50        60

489       519       549       579       609       636       666       696
R-QLFNKGIAFTSKYILQTAVVLLGFGLNLMQVMKVGISSLPIIIMTISISLIIAYVL-QKLFKLDKTIATLIGVGSSIC
 :   :  |:  |   :|:|:   :::|  ||| |  |:    ||||  :  | ::|  ::::|   ||:|  |||   :  ||| |||||
IWKSCDGGVLFAKQYLLRLGIILYGFRLTFSQIADVGISGIIIDVLTLSSTFLLACFLGQKVFGLDKHTSWLIGAGSSIC
       80        90       100       110       120       130       140

726       756       786       816       840       870       900       930
GGSAIAATAPVINAKDDEVAQAISVIFLFNILAALIFPTLGNFIG--LSDHGFALFAGTAVNDTSSVTATATAWDAINHS
|  :|:  ||  ||:  |:    :|    :|     :|   :::|   :   ::   :|  | :: |:  |:: :  | |      |  ||
GAAAVLATEPVVKAEASKVTVAVATVVIFGTVAIFLYPAIYPLMSQWFSPETFGIYIGSTVHEVAQVVA---AGHAI-SP
      160       170       180       190       200       210       220

960       990       1020      1050      1077      1107      1134      1164
NTLGGATIVKLTRTLAIIPITIVLSIYHMKQTQKEQSVSVTKI-FPKFVLYFILASLLTTIVASLGF-SLRIFEPLKVLS
   |  |  |:  |  : :    |  |:|     :||        |    :||  |    ||:  :::      |: :      :       |   |
DAENAAVISKMLRVMMLAPFLILLAA-RVKQLSGANSGEKSKITIPWFAILFIVVAIF----NSFHLLPQSVVNMLVTLD
      230       240       250       260       270       280       290

1194      1224      1254      1284      1314      1344      1374      1404
KFFIVMAMGAIGINTNVSKLIKTGGKSILLGAACWLGIIIVSLTMQAILGTW*SCLKLNICNRFHKCYNEDIKRREHYGI
 |::  |||   |:|:  |:|||    |   |   |:|:        :|:          :    :|:
TFLLAMAMAALGLTTHVSALKKAGAKPLLMALVLFAWLIVGGGAINYVIQSVIA
      310       320       330       340
```

Based on this analysis, it was predicted that these proteins and their epitopes could be useful antigens for vaccines or diagnostics.

Example 1729

A DNA sequence (GBSx1834) was identified in *S. agalactiae* <SEQ ID 5373> which encodes the amino acid sequence <SEQ ID 5374>. Analysis of this protein sequence reveals the following:

Possible site: 57
>>> Seems to have an uncleavable N-term signal seq
INTEGRAL   Likelihood = −10.93   Transmembrane 7-23 (1-27)
----- Final Results -----
  bacterial membrane --- Certainty = 0.5373 (Affirmative) <succ>
    bacterial outside --- Certainty = 0.0000 (Not Clear) <succ>
    bacterial cytoplasm --- Certainty = 0.0000 (Not Clear) <succ>

The protein has no significant homology with any sequences in the GENPEPT database.

A related DNA sequence was identified in *S. pyogenes* <SEQ ID 5375> which encodes the amino acid sequence <SEQ ID 5376>. Analysis of this protein sequence reveals the following:

Possible site: 40
>>> Seems to have an uncleavable N-term signal seq
INTEGRAL   Likelihood = −16.34   Transmembrane 22-38 (13-42)
----- Final Results -----
  bacterial membrane --- Certainty = 0.7538 (Affirmative) <succ>
    bacterial outside --- Certainty = 0.0000 (Not Clear) <succ>
    bacterial cytoplasm --- Certainty = 0.0000 (Not Clear) <succ>

The protein has no significant homology with any sequences in the GENPEPT database.

An alignment of the GAS and GBS proteins is shown below.

```
Identities = 56/215 (26%), Positives = 111/215 (51%), Gaps = 5/215 (2%)
Query:   7 VFLTVLVLILIVGAGGLYFWNNHQSLEGKWRTVSLEKQVEKEIEQQLGSQAADMGISAAD   66
           +F+ ++ LIL+    G+ + N+  S+EG WRT S+++++  +  ++L         I +
Sbjct:  22 LFVFIIFLILLAVLEGVRYRNS--SIEGIWRTTSIDQKLGDDFAKRLTGLHQSPLIDDS-   78

Query:  67 LVKGANMHMNVKNDEAKITVTAQIDEVKFHQAIKTFIDKALEKQLKDQGLTYNDLSEAGK  126
           L+  + M + VKN+   ++ + Q++   F + +  +   L K LK+  L   DLS    +
Sbjct:  79 LLTSSQMILTVKNNNVDLSFSVQVERDIFVKRLAAYHQNELLKTLKENHLVVGDLSSKER 138

Query: 127 KIFDETKITDQQIDQQIDRSFQSAAQAAGGKYNTNTGEMTLPVMDGKVHRLTSVIKV-SH 185
           +I + +     +++ +D++F+  A    GGKYN  TG ++   V+ GKV+R+   I +
Sbjct: 139 QIIENSMPASHELEMILDQAFEKLASQIGGKYNQKTGHLSAVVLKGKVNRILHTIDIKEE 198

Query: 186 INKKANAFYGNIVKNGEKTAYKKEGSKL-ILGNEK                          219
           +     +F   ++         Y + G KL +LG+EK
Sbjct: 199 VAAGHTSFSKGLLTPNGYFDYTRFGKKLELLGDEK                          233
```

SEQ ID 5374 (GBS288) was expressed in *E. coli* as a GST-fusion product. SDS-PAGE analysis of total cell extract is shown in FIG. 59 (lane 3; MW 53.7 kDa).

GBS288d was expressed in *E. coli* as a His-fusion product. SDS-PAGE analysis of total cell extract is shown in FIG. 154 (lane 8-10; MW 26 kDa) and in FIG. 183 (lane 3; MW 26 kDa). It was also expressed in *E. coli* as a GST-fusion product. SDS-PAGE analysis of total cell extract is shown in FIG. 187 (lane 11; MW 51 kDa). Purified GBS288d-GST is shown in lane 8 of FIG. 237.

Based on this analysis, it was predicted that these proteins and their epitopes could be useful antigens for vaccines or diagnostics.

Example 1730

A DNA sequence (GBSx1835) was identified in *S. agalactiae* <SEQ ID 5377> which encodes the amino acid sequence <SEQ ID 5378>. Analysis of this protein sequence reveals the following:

Possible site: 51
>>> Seems to have no N-terminal signal sequence
----- Final Results -----
  bacterial cytoplasm --- Certainty = 0.3885 (Affirmative) <succ>
  bacterial membrane --- Certainty = 0.0000 (Not Clear) <succ>
  bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1731

A DNA sequence (GBSx1836) was identified in *S. agalactiae* <SEQ ID 5379> which encodes the amino acid sequence <SEQ ID 5380>. Analysis of this protein sequence reveals the following:

Possible site: 51
>>> Seems to have no N-terminal signal sequence
INTEGRAL    Likelihood = -12.37    Transmembrane 67-83 (63-89)
INTEGRAL    Likelihood = -3.72     Transmembrane 139-155 (137-158)
INTEGRAL    Likelihood = -1.54     Transmembrane 115-131 (114-131)
----- Final Results -----

-continued bacterial membrane --- Certainty = 0.5946 (Affirmative) <succ>
  bacterial outside --- Certainty = 0.0000 (Not Clear) <succ>
  bacterial cytoplasm --- Certainty = 0.0000 (Not Clear) <succ>

A related GBS nucleic acid sequence <SEQ ID 10905> which encodes amino acid sequence <SEQ ID 10906> was also identified.

The protein has no significant homology with any sequences in the GENPEPT database.

No corresponding DNA sequence was identified in £pyogenes.

Based on this analysis, it was predicted that this protein and its epitopes, could be useful antigens for vaccines or diagnostics.

Example 1732

A DNA sequence (GBSx1837) was identified in *S. agalactiae* <SEQ ID 5381> which encodes the amino acid sequence <SEQ ID 5382>. Analysis of this protein sequence reveals the following:

Possible site: 38
>>> Seems to have no N-terminal signal sequence
----- Final Results -----
  bacterial cytoplasm --- Certainty = 0.4709 (Affirmative) <succ>
  bacterial membrane --- Certainty = 0.0000 (Not Clear) <succ>
  bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1733

A DNA sequence (GBSx1838) was identified in *S. agalactiae* <SEQ ID 5383> which encodes the amino acid sequence <SEQ ID 5384>. Analysis of this protein sequence reveals the following:

Possible site: 29
>>> Seems to have no N-terminal signal sequence

-continued

```
----- Final Results -----
    bacterial cytoplasm --- Certainty = 0.2191 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP:AAC98427 GB:M63481 20-kDa protein [Streptococcus sanguinis]
Identities = 119/163 (73%), Positives = 146/163 (89%)
Query:   1 MTTFLGNPVTFTGKQLQVGDIAKDFLLIATDLSQKSLKDFEGKKKVISVVPSIDTGICSK   60
           MTTFLGNPVTFTGKQLQVGD A DF L ATDLS+K+L DF GKKKV+S++PSIDTG+CS
Sbjct:   1 MTTFLGNPVTFTGKQLQVGDTAHDFSLTATDLSKKTLADFAGKKKVLSIIPSIDTGVCST   60

Query:  61 QTRTFNEELSELDNTVVITVSMDLPFAQKRWCSAEGLDNVILLSDFYDHSFGQEYALLMN  120
           QTR FN+ELS+LDNTVVITVS+DLPFAQ +WC+AEG++N ++LSD++DHSFG++YA+L+N
Sbjct:  61 QTRRFNQELSDLDNTVVITVSVDLPFAQGKWCAAEGIENAVMLSDYFDHSFGRDYAVLIN  120

Query: 121 EWHLLTRAVLILDEHNKVTYTEYVDNVNSDVDYEAAINAAKIL                  163
           EWHLL RAVL+LDE+N VTY EYVDN+N++ DY+AAI A K L
Sbjct: 121 EWHLLARAVLVLDENNTVTYAEYVDNINTEPDYDAAIAAVKSL                  163
```

No corresponding DNA sequence was identified in *S. pyogenes*.

Based on this analysis, it was predicted that this protein and its epitopes, could be useful antigens for vaccines or diagnostics.

Example 1734

A DNA sequence (GBSx1839) was identified in *S. agalactiae* <SEQ ID 5385> which encodes the amino acid sequence <SEQ ID 5386>. This protein is predicted to be DNA alkylation repair enzyme. Analysis of this protein sequence reveals the following:

```
Possible site: 15
>>> Seems to have no N-terminal signal sequence
----- Final Results -----
    bacterial cytoplasm --- Certainty = 0.4729 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP:CAB40581 GB:AJ010128 DNA alkylation repair enzyme [Bacillus cereus]
Identities = 67/217 (30%), Positives = 119/217 (53%), Gaps = 5/217 (2%)
Query:   6 SLERKFKAASDKEVSKQQEAYLRHHFKCYGIKSPERRMLYKELIKAAKRQAKIDWQLLDK   65
           +L  +F A  + E ++    Y+++HF  GI++PERR L K++I+      + D+Q++ +
Sbjct:   7 ALQEHFIANQNPEKAEPMARYMKNHFPFLGIQTPERRQLLKDVIQIHTLPDQKDFQVIVR   66

Query:  66 -CWQSDYREYHHFVLDYLLAMSQFLTYNDCSRLEFYARHQQWWDSIDVLTKIF-GNLSLK  123
            W    RE+    LD +      +     LE    + WWD++D +   F GN+ L+
Sbjct:  67 ELWDLPEREFQAAALDMMQKYKMHINETHIPFLEELIVTKSWWDTVDSIVPTFLGNIFLQ  126

Query: 124 DDKVMNL-LSEWSLDQDFWMRRLAIEHQLGFKEKTNTDILSLFILRNTGSQEFFINKAIG  182
           ++++  +  +W   + W++R AI   QL +K+K + ++L   I +   S+EFFI KAIG
Sbjct: 127 HPELISAYIPKWIASDNIWLQRAAILFQLKYKQKMDEELLFWVIGQLHSSKEFFIQKAIG  186

Query: 183 WALRDYSKYNKVWVKDFISNHCDELSTLSIREGSKYL                        219
           W LR+Y+K       V +++ N  +EL+ LS RE   K++
Sbjct: 187 WVLREYAKTKSDVVWEYVQN--NELAPLSRREAIKHI                        221
```

No corresponding DNA sequence was identified in *S. pyogenes*.

Based on this analysis, it was predicted that this protein and its epitopes, could be useful antigens for vaccines or diagnostics.

Example 1735

A DNA sequence (GBSx1841) was identified in *S. agalactiae* <SEQ ID 5387> which encodes the amino acid sequence <SEQ ID 5388>. Analysis of this protein sequence reveals the following:

```
Possible site: 19
>>> Seems to have no N-terminal signal sequence
----- Final Results -----
    bacterial cytoplasm --- Certainty = 0.2117 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP:CLA81648 GB:Z27121 unknown [Mycoplasma hominis]
Identities = 67/281 (23%), Positives = 113/281 (39%), Gaps = 52/281 (18%)
Query:    3 FVFDIDGTLCFDGMS--LSKEIQGILERAQIDYGHRVTFATARSYRDTIGILGDKLSLSK     60
            F  D+DGTL D    +  + ++  +++A +  GH V+  T R +R T+ +  +KL L+
Sbjct:   14 FAIDLDGTLLADSANGTVHPKTEEAIKKA-VAQGHIVEIITGRPWRSTLPVY-EKLGLNA    71

Query:   61 IIG-LNGATLHENGHLVDSYYLQSDFFSTIISYCHRHQIPYFVD------EVFNYATYQA   113
            I+G  NGA +H                FF  I+Y   +++ Y +       E+ NYA
Sbjct:   72 IVGNYNGAHIHNPA---------DPFFIPAITYLDLNEVLYILGDEKVKKEITNYAIEGP   122

Query:  114 SKIPFIAYVDPQ-----------KRGELLEVSKIE----------KPIKMVLYFGDQLGR   152
             + + + DP            K  E + + KI            KP   VL    L R
Sbjct:  123 DWVQLM-HRDPNLERVFGFNQATKFRECINLEKIPLKPTGIVFDVKPDTDVLELLTYLKR   181

Query:  153 ADQMLAELNRFGLSSHFFHEFEKCLYINPIAVDKGKATKKLFG------NRFIAFGNDKN   206
                  L E + +        F+    I  I +DKGK   +       + +A G+ N
Sbjct:  182 RYGDLGEFSSWSKGEGLSPVFD----ITSIGIDKGKVISLIMRYYNIDIDDTVAMGDSYN   237

Query:  207 DISMFDAAHYSVQVGDFDELTPYANLRVSRESVHEGITTLF                    247
            D+SM++ A+ V   + + L    + V +++ EG    F
Sbjct:  238 DLSMYNVANVCVSPANAEPLIKKMSTVVMKQTNKEGAVGYF                    278
```

Based on this analysis, it was predicted that this protein and its epitopes, could be useful antigens for vaccines or diagnostics.

Example 1736

A DNA sequence (GBSx1842) was identified in *S. agalactiae* <SEQ ID 5389> which encodes the amino acid sequence <SEQ ID 5390>. Analysis of this protein sequence reveals the following:

Possible site: 27
>>> Seems to have no N-terminal signal sequence
----- Final Results -----
   bacterial cytoplasm --- Certainty = 0.2383 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:AAB90005 GB:AE001018 A. fulgidus predicted coding region AF1244
[Archaeoglobus fulgidus]
Identities = 22/48 (45%), Positives = 35/48 (72%)
Query: 150 GKSIGELNVWHQTGATIVAIEHEGKFIVSPGPFSVIEQGDHIFFVGDE   197
           GKSIGEL +  +TGAT++A+  + K I+SP P +V+E GD +  +G++
Sbjct: 102 GKSIGELGIRSKTGATVIAVLKKEKTIISPSPETVLEPGDKVVVIGEK   149
```

A related DNA sequence was identified in *S. pyogenes* <SEQ ID 5391> which encodes the amino acid sequence <SEQ ID 5392>. Analysis of this protein sequence reveals the following:

Possible site: 27
>>> Seems to have no N-terminal signal sequence
----- Final Results -----
   bacterial cytoplasm --- Certainty = 0.2446 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 163/213 (76%), Positives = 196/213 (91%)
Query:   1 MVSEQSEIVTSKYQKIAVAVAQRIANGDYEVGEKLKSRTTIASTFNVSPETARKGLNILA    60
           ++S + EI +SKYQKIA++VAQRIANG+YEVGEKLKSRTTIASTFNVSPETARKGLNILA
Sbjct:   1 VISPKKEITSSKYQKIAISVAQRIANGEYEVGEKLKSRTTIASTFNVSPETARKGLNILA    60

Query:  61 DLQILTLKHGSGAIILSKEKAIEFLNQYETSHSVAILKGKIRDNIKAQQQEMEELATLVD   120
           DL+ILTLKHGSGAI+LSKE+AIEF+NQYE++HS+A+LK KIR+  I  Q + ME++A LV+
Sbjct:  61 DLKILTLKHGSGAIVLSKERAIEFINQYESTHSIAVLKEKIRETINDQGKAMEKMAVLVN   120

Query: 121 DFLLQTRAVSKQYPLAPYEIIVSEDSEHLGKSIGELNVWHQTGATIVAIEHEGKFIVSPG   180
           DFL+Q+++VSKQYPLAPYEII  ++DSEH GKSIG LN+WHQTGATIVAIEH G+FIVSPG
Sbjct: 121 DFLMQSQSVSKQYPLAPYEIICNQDSEHFGKSIGVLNIWHQTGATIVAIEHAGQFIVSPG   180

Query: 181 PFSVIEQGDHIFFVGDEDVYARMKTYFNLRMGL                             213
```

```
          P+SVIE+GDHI+FVGDE V +RMKT+FNLR GL
Sbjct: 181 PYSVIEKGDHIYFVGDESVISRMKTFFNLRKGL              213
```

Based on this analysis, it was predicted that these proteins and their epitopes could be useful antigens for vaccines or diagnostics.

Example 1737

A DNA sequence (GBSx1844) was identified in *S. agalactiae* <SEQ ID 5393> which encodes the amino acid sequence <SEQ ID 5394>. This protein is predicted to be gls24. Analysis of this protein sequence reveals the following:

Possible site:16
>>> Seems to have no N-terminal signal sequence
----- Final Results -----
  bacterial cytoplasm --- Certainty = 0.2855 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 9361> which encodes amino acid sequence <SEQ ID 9362> was also identified.

The protein has homology with the following sequences in the GENPEPT database.

```
>GP:AAA86383 GB:U23376 putative 20-kDa protein [Lactococcus lactis]
Identities = 63/124 (50%), Positives = 84/124 (66%)
Query:   1 MSGGFFSNLKNSVVNSDSVTDGVNVEVGTKEVAVDLDIVVEYGKDIPAIVESIKAIVSQN   60
           + GGFFSNL  ++N+D VT GV+VEVG  +VAVDL +V EY K++P I E IK ++ +
Sbjct:  55 VEGGFFSNLTGKLINTDDVTTGVDVEVGKTQVAVDLKVVTEYRKNVPDIYEKIKEVIRKE  114

Query:  61 VEVMTHLKVVELNANVVDIKTKAEHEADSVTVQDRVSDAAQATGNFASEQAGKAKAAISS  120
           V  MT L+VVE+N  V DIKTK + + D V++QDRV+ AAQ TG F SEQ  K K   +
Sbjct: 115 VAAMTELEVVEVNVTVTDIKTKEQQKEDDVSIQDRVTSAAQTTGKFTSEQVDKVKDKVED  174

Query: 121 GAEK                                                         124
             +K
Sbjct: 175 NTDK                                                         178
```

A related DNA sequence was identified in *S. pyogenes* <SEQ ID 5395> which encodes the amino acid sequence <SEQ ID 5396>. Analysis of this protein sequence reveals the following:

Possible site: 43
>>> Seems to have no N-terminal signal sequence
----- Final Results -----
  bacterial cytoplasm --- Certainty = 0.2534 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

```
Identities = 94/137 (68%), Positives = 108/137 (78%), Gaps = 8/137 (5%)
Query:   1 MSGGFFSNLKNSVVNSDSVTDGVNVEVGTKEVAVDLDIVVEYGKDIPAIVESIKAIVSQN   60
           ++GGFFSN+KN++VNS+SVTDGV+VEVG+KEVAVDL I+VEYGKDIPAI ESIKAIVSQN
Sbjct:  35 VTGGFFSNIKNNLVNSESVTDGVSVEVGSKEVAVDLATIVEYGKDIPAIAESIKAIVSQN   94

Query:  61 VEVMTHLKVVELNANVVDIKTKAEHEADSVTVQDRVSDAAQATGNFASEQAGKAKAAISS  120
           V+ MTHLKVVE+N NVVDI+TK EHEA SVTVQDRV+ AA +T  F SEQ  K K   IS
Sbjct:  95 VDSMTHLKVVEVNVNVVDIRTKEEHEAASVTVQDRVTSAASSTSQFVSEQTEKLKDTISD  154

Query: 121 GAEKTKEAVSNGTEAAK                                            137
                    N   EAAK
Sbjct: 155 --------TVNSDEAAK                                            163
```

Based on this analysis, it was predicted that these proteins and their epitopes could be useful antigens for vaccines or diagnostics.

Example 1738

A DNA sequence (GBSx1845) was identified in *S. agalactiae* <SEQ ID 5397> which encodes the amino acid sequence <SEQ ID 5398>. Analysis of this protein sequence reveals the following:

```
Possible site: 21
>>> Seems to have no N-terminal signal sequence
----- Final Results -----
    bacterial cytoplasm --- Certainty = 0.3393 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1739

A DNA sequence (GBSx1846) was identified in *S. agalactiae* <SEQ ID 5399> which encodes the amino acid sequence <SEQ ID 5400>. Analysis of this protein sequence reveals the following:

```
Possible site: 16
>>> Seems to have no N-terminal signal sequence
----- Final Results -----
    bacterial cytoplasm --- Certainty = 0.3168 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1740

A DNA sequence (GBSx1847) was identified in *S. agalactiae* <SEQ ID 5401> which encodes the amino acid sequence <SEQ ID 5402>. This protein is predicted to be gls24. Analysis of this protein sequence reveals the following:

```
Possible site: 61
>>> Seems to have no N-terminal signal sequence
----- Final Results -----
    bacterial cytoplasm --- Certainty = 0.2718 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP:AAA86383 GB:U23376 putative 20-kDa protein [Lactococcus lactic]
Identities = 95/157 (60%), Positives = 120/157 (75%)
Query:   18  VRGELTFEDKVIEKIVGIAIEHVDGLLAVNGGFFSNLKNSVVNSDSVTDGVNVEVGKKQV      77
             ++G LT+EDKV++KIVG+A+E VDGLL+V GGFFSNL   ++N+D VT GV+VEVGK QV
Sbjct:   27  IKGALTYEDKVVQKIVGLALESVDGLLSVEGGFFSNLTGKLINTDDVTTGVDVEVGKTQV      86

Query:   78  AVDLDIVAEYQKHVPTIFADIKKVVEAEVKRMTDLEVVEVNVNVVDIKTRAQHEEDSVTL     137
             AVDL +V EY+K+VP I+  IK+V+  EV   MT+LEVVEVNV V DIKT+ Q +ED V++
Sbjct:   87  AVDLKVVTEYRKNVPDIYEKIKEVIRKEVAAMTELEVVEVNVTVTDIKTKEQQKEDDVSI     146

Query:  138  QDRVTSAAQATGEFASNQVSNVKSAVGSGVDKVEDMK                          174
             QDRVTSAAQ TG+F S QV  VK  V   DK   +K
Sbjct:  147  QDRVTSAAQTTGKFTSEQVDKVKDKVEDNTDKEARVK                          183
```

A related DNA sequence was identified in *S. pyogenes* <SEQ ID 5403> which encodes the amino acid sequence <SEQ ID 5404>. Analysis of this protein sequence reveals the following:

```
Possible site: 53
>>> Seems to have no N-terminal signal sequence
----- Final Results -----
    bacterial cytoplasm --- Certainty = 0.3896 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
Identities = 123/180 (68%), Positives = 158/180 (87%), Gaps = 1/180 (0%)
Query:    1  MTETYIKNTTNNSGTTAVRGELTFEDKVIEKIVGIAIEHVDGLLAVNGGFFSNLKNSVVN      60
             MTETYIKNT+ +   T+A+RG+LT+++DKVIEKIVG+A+E+VDGLL VNGGFF+NLK+ +VN
Sbjct:    1  MTETYIKNTSKDL-TSAIRGQLTYDDKVIEKIVGLALENVDGLLGVNGGFFANLKDKLVN      59

Query:   61  SDSVTDGVNVEVGKKQVAVDLDIVAEYQKHVPTIFADIKKVVEAEVKRMTDLEVVEVNVN     120
             ++SV DGVNVEVGKKQVAVDLDIVAEYQKHVPTI+  IK +VE EVERMTDL+V+EVNV
```

```
                            -continued
Sbjct:  60   TESVRDGVNVEVGKKQVAVDLDIVAEYQKHVPTIYDSIKSIVEEEVKRMTDLDVIEVNVK    119

Query: 121   VVDIKTRAQHEEDSVTLQDRVTSAAQATGEFASNQVSNVKSAVGSGVDKVEDMKSEPRVQ    180
             VVDIKT+ Q E + V+LQD+V+  A++T EF S+QV NVK++V +GV+K++D k+EPRV+
Sbjct: 120   VVDIKTKEQFEAEKVSLQDKVSDMARSTSEFTSHQVENVKASVDNGVEKLQDQKAEPRVK    179
```

Based on this analysis, it was predicted that these proteins and their epitopes could be useful antigens for vaccines or diagnostics.

Example 1741

A DNA sequence (GBSx1848) was identified in *S. agalactiae* <SEQ ID 5405> which encodes the amino acid sequence <SEQ ID 5406>. This protein is predicted to be a 6-kDa protein. Analysis of this protein sequence reveals the following:

```
Possible site: 22
>>> Seems to have a cleavable N-term signal seq.
INTEGRAL     Likelihood = -9.29    Transmembrane 25-41 (23-52)
----- Final Results -----
    bacterial membrane --- Certainty = 0.4715 (Affirmative) <succ>
      bacterial outside --- Certainty = 0.0000 (Not Clear) <succ>
      bacterial cytoplasm --- Certainty = 0.0000 (Not Clear) <succ>
```

The protein has homology with the following sequences in the GENPEPT database.

```
>GP:AAA86382 GB:U23376 putative 6-kDa. protein [Lactococcus lactis]

Identities = 27/61 (44%), Positives = 45/61 (73%)

Query:  3    EFVRKYRYPLGGAVIGLVLAAMIVTIGFFKTILALVIIVLGAYAGLYVQRTGMLDQFFNK    62
             ++  K RYP+ G ++G ++A    I TIGF+K IL L +I LG Y GL+++++G++DQF N+
Sbjct:  2    DYFEKNRYPIIGGIVGALIAVCIFTIGFWKMILVLFLIGLGIYIGLFLKKSGIIDQFINR    61

Query: 63    R    63
             +
Sbjct: 62    K    62
```

A related DNA sequence was identified in *S. pyogenes* <SEQ ID 5407> which encodes the amino acid sequence <SEQ ID 5408>. Analysis of this protein sequence reveals the following:

```
Possible site: 28
>>> Seems to have an uncleavable N-term signal seq
INTEGRAL     Likelihood = -11.73   Transmembrane 11-27 (6-50)
INTEGRAL     Likelihood = -7.11    Transmembrane 33-49 (27-50)
----- Final Results -----
    bacterial membrane --- Certainty = 0.5692 (Affirmative) <succ>
      bacterial outside --- Certainty = 0.0000 (Not Clear) <succ>
      bacterial cytoplasm --- Certainty = 0.0000 (Not Clear) <succ>
```

An alignment of the GAS and GBS proteins is shown below.

A related GBS gene <SEQ ID 8891> and protein <SEQ ID 8892> were also identified. Analysis of this protein sequence reveals the following:

```
Lipop: Possible site: -1   Crend: 8
McG: Discrim Score: 12.56
GvH: Signal Score (-7.5): -1.11
Possible site: 22
>>> Seems to have a cleavable N-term signal seq.
ALOM program   count: 1 value: -9.29 threshold: 0.0
INTEGRAL     Likelihood = -9.29    Transmembrane 25-41 (23-52)
PERIPHERAL   Likelihood = 12.25    44
modified ALOM score: 2.36
*** Reasoning Step: 3
----- Final Results -----
    bacterial membrane --- Certainty = 0.4715 (Affirmative) <succ>
      bacterial outside --- Certainty = 0.0000 (Not Clear) <succ>
      bacterial cytoplasm --- Certainty = 0.0000 (Not Clear) <succ>
```

The protein has homology with the following sequences in the databases:

```
Identities = 28/61 (450), Positives = 48/61 (77%)
Query:  3    EFVRKYRYPLGGAVIGLVLAAMIVTIGFFKTILALVIIVLGAYAGLYVQRTGMLDQFFNKR    63
             EF  K++YP+ G ++GL++A  +++  G FKT+LA++ I+LG Y GLY ++TG++DQF N++
Sbjct:  2    EFYEKFKYPIIGGLVGLIIAILLMAFGLFKTLLAIIFIILGIYGGLYAKKTGIIDQFLNRK    62
```

```
44.3/73.8% over 60aa
Lactococcus lactis
EGAD|42618| putative 6-kDa protein Insert characterized
GP|727435|gb|AAA86382.1||U23376 putative 6-kDa protein Insert characterized
ORF01006(307-489 of 792)
EGAD|42618|45008(2-62 of 62) putative 6-kDa protein {Lactococcus
lactis}GP|727435|gb|AAA86382.1||U23376 putative 6-kDa protein
{Lactococcus lactis}
% Match = 11.6
% Identity = 44.3 % Similarity = 73.8
Matches = 27 Mismatches = 16 Conservative Sub.s = 18

159       189       219       249       279       309       339       369
TNVPEQLEHIQSDVELGLKEFFGLEKKMNTRVFVKQVEEENVGNAKTNKSRVE*ESNMSEFVRKYRYPLGGAVIGLVLAA
                                                     :: | |||: | ::| ::|
                                                     MDYFEKNRYPIIGGIVGALIAV
                                                                 10        20

399       429       459       489       519       549       579       609
MIVTIGFFKTILALVIIVLGAYAGLYVQRTGMLDQFFNKRK*NFSFIFILHYLNKRKRNYYD*NLHQKHN*QFWHDSCSW
| |||| :| || | :| || | ||:::::|::||| |::
CIFTIGFWKMILVLFLIGLGIYIGLFLKKSGIIDQFINRK
             40        50        60
```

Figure 263:
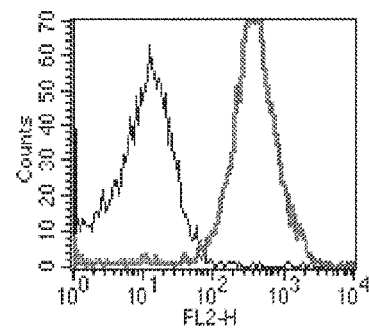

SEQ ID 5406 (GBS14) was expressed in *E. coli* as a GST-fusion product. SDS-PAGE analysis of total cell extract is shown in FIG. 9 (lane 4; MW 33.3 kDa). The GBS14-GST fusion product was purified (FIG. 190, lane 8) and used to immunise mice. The resulting antiserum was used for FACS (FIG. 263), which confirmed that the protein is immunoaccessible on GBS bacteria.

Based on this analysis, it was predicted that these proteins and their epitopes could be useful antigens for vaccines or diagnostics.

Example 1742

A DNA sequence (GBSx1849) was identified in *S. agalactiae* <SEQ ID 5409> which encodes the amino acid sequence <SEQ ID 5410>. Analysis of this protein sequence reveals the following:

Possible site: 27
>>> Seems to have an uncleavable N-term signal seq
INTEGRAL    Likelihood = –18.63    Transmembrane 61-77 (51-83)
INTEGRAL    Likelihood = –7.91    Transmembrane 10-26 (7-28)
----- Final Results -----
   bacterial membrane --- Certainty = 0.8451 (Affirmative) <succ>

-continued bacterial outside --- Certainty = 0.0000 (Not Clear) <succ>
   bacterial cytoplasm--- Certainty = 0.0000 (Not Clear) <succ>

The protein has no significant homology with any sequences in the GENPEPT database.

A related DNA sequence was identified in *S. pyogenes* <SEQ ID 5411> which encodes the amino acid sequence <SEQ ID 5412>. Analysis of this protein sequence reveals the following:

Possible site: 29
>>> Seems to have a cleavable N-term signal seq.
INTEGRAL    Likelihood = –16.19    Transmembrane 71-87 (63-93)
----- Final Results -----
   bacterial membrane --- Certainty = 0.7474 (Affirmative) <succ>
   bacterial outside --- Certainty = 0.0000 (Not Clear) <succ>
   bacterial cytoplasm --- Certainty = 0.0000 (Not Clear) <succ>

The protein has no significant homology with any sequences in the GENPEPT database.

An alignment of the GAS and GBS proteins is shown below.

```
Identities = 87/193 (45%), Positives = 127/193 (65%), Gaps = 4/193 (2%)
Query:   1  MSKGLKSLYTLLGLISLTLLGFVAVISKQHIYLP-SFNWLDWDFN-LPSPIDVGMYHYFF    58
            MSK LK  Y L+GL+ L++ G+V   I+  +IYLP S+ WL W  +  P+ +D  + +Y+F
Sbjct:   9  MSKLLKISYCLVGLVLLSVFGWVVGITGGYIYLPYSYRWLSWGMDSFPNLLDSALSYYYF    68

Query:  59  WGALVLFVIVLLAILVVLFYPRRYTEYKLA--DKTGKLMLKKSAIEGFVKTEVLKTGLMK   116
            W ALVLFVI   LA+LV++ YPR YTE +L    +K G L+LKKSAIE +V T +   GLM
Sbjct:  69  WTALVLFVITFLALLVIILYPRIYTEVQLRHKNKKGTLLLKKSAIESYVATAIQTAGLMP   128

Query: 117  SPSVTAHLYKKKVKVDVKGLLTSRTNVPEQLEHIQSDVELGLKEFFGLEKKMNTRVFVKQ   176
            +P+VTA LYK+K  + VKG L SR  V +Q+  ++ +E GL EFFG+    +N +V+VK
Sbjct: 129  NPTVTAKLYKRKFNIIVKGRLASRVAVADQISGVKEGIEKGLTEFFGINYPVNFKVYVKD   188

Query: 177  VEEENVGNAKTNK                                                 189
            + + +    N+
Sbjct: 189  IADSDRKHITRNR                                                 201
```

Based on this analysis, it was predicted that these proteins and their epitopes could be useful antigens for vaccines or diagnostics.

Example 1743

A DNA sequence (GBSx1850) was identified in *S. agalactiae* <SEQ ID 5413> which encodes the amino acid sequence <SEQ ID 5414>. Analysis of this protein sequence reveals the following:

```
Possible site: 17
>>> Seems to have an uncleavable N-term signal seq
INTEGRAL    Likelihood = -9.82   Transmembrane 56-72 (52-81)
INTEGRAL    Likelihood = -6.42   Transmembrane 4-20 (1-23)
----- Final Results -----
   bacterial membrane --- Certainty = 0.4927 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the GENPEPT database.

```
>GP:CAB12244 GB:Z99106 similar to hypothetical proteins from B. subtilis
[Bacillus subtilis]
Identities = 31/76 (40%), Positives = 48/76 (62%)
Query:  1     MSLIWSLIVGAIIGAIAGAVTNKGGSMGWIANILAGLVGSFVGQSLLGTWGPKLAGMALI     60
              +S + SL+V +IG I A+      G   +++AGL+G+++G  LLGTWGP LAG A+
Sbjct:  2     LSFLVSLVVAIVIGLIGSAIVGNRLPGGIFGSMIAGLIGAWIGHGLLGTWGPSLAGFAIF    61

Query: 61     PSIVGAIIVVIVTSFV                                              76
              P+I+GA I V +   +
Sbjct: 62     PAIIGAAIFVFLLGLI                                              77
```

A related DNA sequence was identified in *S. pyogenes* <SEQ ID 5415> which encodes the amino acid sequence <SEQ ID 5416>. Analysis of this protein sequence reveals the following:

```
Possible site: 55
>>> Seems to have a cleavable N-term signal seq.
INTEGRAL    Likelihood = -7.59   Transmembrane 60-76 (56-80)
----- Final Results -----
   bacterial membrane --- Certainty = 0.4036 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP:CAB12244 GB:Z99106 similar to hypothetical proteins from B. subtilis
[Bacillus subtilis]

Identities = 28/76 (36%), Positives = 47/76 (61%)

Query:  1     MGLIWTLIVGALIGVIAGALTKKGGSMGWIANIAAGLVGSSVGQALLGSWGPSLAGMSLI     60
              +  + +L+V +IG+I  A+     G   ++ AGL+G+ +G  LLG+WGPSLAG ++
Sbjct:  2     LSFLVSLVVAIVIGLIGSAIVGNRLPGGIFGSMIAGLIGAWIGHGLLGTWGPSLAGFAIF    61

Query: 61     PSVIGAVIVVMITSFV                                              76
              P++IGA I V +   +
Sbjct: 62     PAIIGAAIFVFLLGLI                                              77
```

An alignment of the GAS and GBS proteins is shown below.

```
Identities = 63/82 (76%), Positives = 74/82 (89%)
Query:  1    MSLIWSLIVGAIIGAIAGAVTNKGGSMGWIANILAGLVGSFVGQSLLGTWGPKLAGMALI    60
             M LIW+LIVGA+IG IAGA+T KGGSMGWIANI AGLVGS VGQ+LLG+WGP LAGM+LI
Sbjct:  1    MGLIWTLIVGALIGVIAGALTKKGGSMGWIANIAAGLVGSSVGQALLGSWGPSLAGMSLI    60

Query: 61    PSIVGAIIVVIVTSFVLGKMNN                                        82
             PS++GA+IVV++TSFVL K NN
Sbict: 61    PSVIGAVIVVMITSFVLNKTNN                                        82
```

Based on this analysis, it was predicted that these proteins and their epitopes could be useful antigens for vaccines or diagnostics.

Example 1744

A DNA sequence (GBSx1851) was identified in *S. agalactiae* <SEQ ID 5417> which encodes the amino acid sequence <SEQ ID 5418>. Analysis of this protein sequence reveals the following:

---

Possible site: 59
>>> Seems to have no N-terminal signal sequence
INTEGRAL    Likelihood = –9.82    Transmembrane 88-104 (84-111)
INTEGRAL    Likelihood = –8.07    Transmembrane 29-45 (27-54)
----- Final Results -----
  bacterial membrane --- Certainty = 0.4927 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the GENPEPT database.

```
>GP:CAB12244 GB:Z99106 similar to hypothetical proteins from B. subtilis
[Bacillus subtilis]
Identities = 29/77 (37%), Positives = 47/77 (60%)
Query: 31    IMGLIWSLIVGAIIGAIAGAITNKGGSMGWIANILAGLVGSFVGQSLLGTWGPKLADMAL    90
             ++  + SL+V  +IG I AI       G   +++AGL+G+++G   LLGTWGP LA  A+
Sbjct:  1    MLSFLVSLVVAIVIGLIGSAIVGNRLPGGIFGSMIAGLIGAWIGHGLLGTWGPSLAGFAI    60

Query: 91    IPSIVGAIIVIIVTSFV                                            107
              P+I+GA I + +   +
Sbjct: 61    FPAIIGAAIFVFLLGLI                                            77
```

There is also homology to SEQ ID 5416:

```
Identities = 60/79 (75%), Positives = 72/79 (90%)
Query: 32    MGLIWSLIVGAITGAIAGAITNKGGSMGWIANILAGLVGSFVGQSLLGTWGPKLADMALI    91
             MGLIW+LIVGA+IG IAGA+T KGGSMGWIANI AGLVGS VGQ+LLG+WGP LA M+LI
Sbjct:  1    MGLIWTLIVGALIGVIAGALTKKGGSMGWIANIAAGLVGSSVGQALLGSWGPSLAGMSLI    60

Query: 92    PSIVGAIIVIIVTSFVLGK                                          110
             PS++GA+IV++TSFVL K
Sbjct: 61    PSVIGAVIVVMITSFVLNK                                          79
```

Based on this analysis, it was predicted that these proteins and their epitopes could be useful antigens for vaccines or diagnostics.

Example 1745

A DNA sequence (GBSx1852) was identified in *S. agalactiae* <SEQ ID 5419> which encodes the amino acid sequence <SEQ ID 5420>. This protein is predicted to be ATP-dependent DNA helicase Rep (uvrD). Analysis of this protein sequence reveals the following:

---

Possible site: 22
>>> Seems to have no N-terminal signal sequence
----- Final Results -----
  bacterial cytoplasm --- Certainty = 0.1364 (Affirmative) <succ>
    bacterial membrane --- Certainty = 0.0000 (Not Clear) <succ>
      bacterial outside --- Certainty = 0.0000 (Not Clear) <succ>

---

A related GBS nucleic acid sequence <SEQ ID 9863> which encodes amino acid sequence <SEQ ID 9864> was also identified.

The protein has homology with the following sequences in the GENPEPT database.

```
>GP:AAD51119 GB:AF176554 DNA helicase PcrA [Leuconostoc citreum]
Identities = 414/764 (54%), Positives = 537/764 (70%), Gaps = 23/764 (3%)
Query:    6 VEMNPLIIGMNDKQAEAVQTTDGPLLIMAGAGSGKTRVLTHRIAYLIDEKYVNPWNILAI    65
            + +  L  GMN+KQAEAVQTT+GPLLIMAGAGSGKTRVLTHRIA+L+ +  V PW ILAI
Sbjct:    1 MSVETLTNGMNNKQAEAVQTTEGPLLIMAGAGSGKTRVLTHRIAHLVQDLNVFPWRILAI    60

Query:   66 TFTNKAAREMRERAIAL--NPATQDTLIATFHSMCVRILRREADYIGYNRNFTIVDPGEQ   123
            TFTNKAAREMRER  AL   +D  ++TFH++ VRILRR+ + IG  +NFTI+D   Q
Sbjct:   61 TFTNKAAREMRERIAALLSEDVARDIWVSTFHALAVRILRRDGEAIGLAKNFTIIDTSAQ   120

Query:  124 RTLMKRIIKQLNLDTKKWNERSILGTISNAKNDLLDEIAYEKQAGDMYTQVIAKCYKAYQ   183
            RTLMKR+I  LNLDT +++  R+ILG ISNAKND+L     Y K A + + + +A+ Y AYQ
Sbjct:  121 RTLMKRVINDLNLDTNQYDPRTILGMISNAKNDMLQPRDYAKAADNAFQETVAEVYTAYQ   180

Query:  184 EELRRSEAMDFDDLIMMTLRLFDQNKDVLAYYQQRYQYIHVDEYQDTNHAQYQLVKLLAS   243
            EL+RS+++DFDDLIM+T+ LF    DVLA YQQ+++Y+HVDEYQDTN AQY +V LLA
Sbjct:  181 AELKRSQSVDFDDLIMLTIDLFQSAPDVLARYQQQFEYLHVDEYQDTNDAQYTIVNLLAQ   240

Query:  244 RFKNICVVGDADQSIYGWRGADMQNILDFEKDYPQAKVVLLEENYRSTKKILQAANNVIN   303
            R KN+ VVGDADQSIYGWRGA+M NIL+FEKDYP A   V+LE+NYRST+  IL AAN VIN
Sbjct:  241 RSKNLAVVGDADQSIYGWRGANMNNILNFEKDYPNAHTVMLEQNYRSTQNILDAANAVIN   300

Query:  304 HNKNRRPKELWTQNDEGEQIVYHRANNEQEEAVFVASTIDNIVREQGKNFKDFAVLYRTN   363
            HN  R  PKKLWT+N +G+QI Y+RA  E +EA F+ S I  +  +    + DFAVLYRTN
Sbjct:  301 HNNERVPKKLWTENGKGDQITYYRAQTEHDEANFILSNIQQLRETKHMAYSDFAVLYRTN   360

Query:  364 AQSRTIEEALLKSNIPYTMVGGTKFYSRKEIRDVIAYLNILANTSDNISFERIVNEPKRG   423
            AQSR IEE+L+K+N+PY+MVGG KFY RKEI D++AY++++  N  DN  +FER+VNEPKRG
Sbjct:  361 AQSRNIEESLVKANKPYSMVGGHKFYERKEILDIMAYMSLITNPDDNAAFERVVNEPKRG   420

Query:  424 VGPGTLEKIRSFAYEQSMSLLDASSNVMMSP-LKGKAAQAVWDLANLILTLRSNLDSLTV   482
            +G  +L ++R A    ++S + A  ++  ++P +  KAA      A ++   LR    + L V
Sbjct:  421 LGATSLTRLRELANRLNVSYMKAIGSIELAPSITTKAASKFLTFAEMMHNLRQQSEFLNV   480

Query:  483 TEITENLLDKTGYLEALQVQNTLESQARIENIEEFLSVTKNFDDNPEITVEGETGLDRLS   542
            TE+TE ++ ++GY + L  +N  +SQAR+EN+EEFLSVTK FDD    E    +D ++
Sbjct:  481 TELTELVMTQSGYRQMLAEKNDPDSQARLENLEEFLSVTKEFDD--KYQPEDPESIDPVT   538

Query:  543 RFLNDLALIADTDDSATETAEVTLMTLHAAKGLEFPVVFLIGMEEGVFPLSRAIEDADEL   602
               FL    AL++D DD         VTLMTLHAAKGLEFPVVFLIG++EG+FPLSRA+  D D L
Sbjct:  539 DFLGTTALMSDLDDFEEGDGAVTLMTLHAAKGLEFPVVFLIGLKEGIFPLSRAMMDEDLL   598

Query:  603 EEERRLAYVGITRAEQILFLTNANTRTLFGKTSYNRPTRFIREIDDELIQ--YQGLARPV   660
            EEERRLAYVGITRA + LFLTNA  +R  L+G+T   N  P+RFI  EI    EL++   Y  GL+R
Sbjct:  599 EEERRLAYVGITRAMKKLFLTNAFSRLLYGRTQANEPSRFIAEISPELLETAYSGLSRDK   658

Query:  661 NSSFGVKYSKEQPTQFGQGMSLQQALQARKSNSQSQVTAQLQALN-ANNSHETSWEIGDV   719
             + + ++            R + +  Q T   + N      +TSW  GD
Sbjct:  659 TQKKTLPFDRK---------------MQRATATTYQATPVTKITNGVTGGDQTSWSTGDK   703

Query:  720 ATHKKWGDGTVLEVSGSGKTQELKINFPGIGLKKLLASVAPISK                   763
            +HKKWG  GTV+ VSG    QELK+ FP  G+K+LLA+ API K
Sbjct:  704 VSHKKWGVGTVISVSGRADDQELKVAFPSEGVKQLLAAFAPIQK                   747
```

A related DNA sequence was identified in *S. pyogenes* <SEQ ID 5421> which encodes the amino acid sequence <SEQ ID 5422>. Analysis of this protein sequence reveals the following:

Possible site: 15
>>> Seems to have no N-terminal signal sequence

----- Final Results -----
bacterial cytoplasm --- Certainty = 0.0214 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 622/772 (80%), Positives = 699/772 (89%), Gaps = 15/772 (1%)
Query:    8 MNPLIIGMNDKQAEAVQTTDGPLLIMAGAGSGKTRVLTHRIAYLIDEKYVNPWNILAITF    67
            MNPL+ GMND+QA+AVQTT+GPLLIMAGAGSGKTRVLTHRIAYLIDEK+VNPWNILAITF
Sbjct:    1 MNPLLNGMNDRQAQAVQTTEGPLLIMAGAGSGKTRVLTHRIAYLIDEKEVNPWNILAITF    60

Query:   68 TNKAAREMRERAIALNPATQDTLIATEHSMCVRILRREADYIGYNRNFTIVDPGEQRTLM   127
            TNKAAREM+ERA+ALNPAT+DTLIATEHSMCVRILRREAD+IGYNRNFTIVDPGEQRTLM
Sbjct:   61 TNKAAREMKERALALNPATKDTLIATEHSMCVRILRREADHIGYNRNFTIVDPGEQRTLM   120

Query:  128 KRIIKQLNLDTKKWNERSILGTISNAKNDLLDEIAYEKQAGDMYTQVIAKCYKAYQEELR   187
            KRI+KQLN+D KKWNERSILGTISNAKNDLLDE   YE QA DMY+Q++A+CYKAYQEELR
Sbjct:  121 KRILKQLNIDPKKWNERSILGTISNAKNDLLDEKGYEAQAADMYSQIVARCYKAYQEELR   180
```

```
Query:  188  RSEAMDFDDLIMMTLRLFDQNKDVLAYYQQRYQYIHVDEYQDTNHAQYQLVKLLASREKN  247
             RSEA+DFDDLIMMTLRLFD N DVLAYYQQRYQYIHVDEYQDTNHAQYQL+KLLASREKN
Sbjct:  181  RSEALDFDDLIMMTLRLFDANPDVLAYYQQRYQYIHVDEYQDTNHAQYQLIKLLASREKN  240

Query:  248  ICVVGDADQSIYGWRGADMQNILDFEKDYPQAKVVLLEENYRSTKKILQAANNVINHNKN  307
             ICVVGDADQSIYGWRGADMQNILDFEKDYP AKVVLLEENYRSTKKILQAAN+VIN+N+N
Sbjct:  241  ICVVGDADQSIYGWRGADMQNILDFEKDYPDARVVLLEENYRSTKKILQAANDVINNNRN  300

Query:  308  RRPKKLWTQNDEGEQIVYHRANNEQEEAVFVASTIDNIVREQGKNFKDFAVLYRTNAQSR  367
             RRPKKLWTQN +GEQ+VY+RAN+E++EAVEVASTI N+ +E GKNFKDFAVLYRTNAQSR
Sbjct:  301  RRPKELWTQNADGEQLVYYRANDERDEAVFVASTISNMSQELGKNEKDFAVLYRTNAQSR  360

Query:  368  TIEEALLKSNIPYTMVGGTKEYSRKEIRDVIAYLNILANTSDNISFERIVNEPKRGVGPG  427
             TIEEALLKSNIPYTMVGGTK+YSRKEIRD+IAYL I+AN +DNISFERIVNEPKRGVGPG
Sbjct:  361  TIEEALLKSNIPYTMVGGTKEYSRKEIRDLIAYLTIVANPADNISFERIVNEPKRGVGPG  420

Query:  428  TLEKIRSFAYEQSMSLLDASSNVMMSPLKGKAAQAVWDLANLILTLRSNLDSLTVTEITE  487
             TL+K+R FAYE   SLL+A+SN++MSPLKGKAAQA+ DLAN++  LR +LD +++T++ E
Sbjct:  421  TLDKLRQFAYESDQSLLEAASNLLMSPLKGKAAQAIMDLANILGQLRQDLDQMSITDLAE  480

Query:  488  NLLDKTGYLEALQVQNTLESQARIENIEEFLSVTKNFDDNPEITVEGETGLDRLSRFLND  547
                LL+KTGYL++L++QNTLESQARIENIEEFLSVTKNFD++      E ETG+DRL RFLND
Sbjct:  481  ALLEKTGYLDSLRLQNTLESQARIENIEEFLSVTKNEDESSASQEEDETGVDRLGRELND  540

Query:  548  LALIADTDDSATETAEVTLMILHAAKGLEFPVVFLIGMEEGVFPLSRAIEDADELEEERR  607
             LALIADTDDS  E AEVTLMT+HAAKGLEFPVVFLIGMEEGVFPLSRA ED DELEEERR
Sbjct:  541  LALIADTDDSQAEAAEVTLMTLHAAKGLEFPVVFLIGMEEGVFPLSRASEDPDELEEERR  600

Query:  608  LAYVGITRAEQILFLTNANTRTLFGKTSYNRPTRFIREIDDELIQYQGLARPVNSSFGVK  667
             LAYVGITRAE++LF+TNANTRTLFGK+SYNRPTRF++EI +EL+ Y+GLARP  SSFGV+
Sbjct:  601  LAYVGITRAEEVLFMTNANTRTLFGKSSYNRPTRELKEISEELLSYKGLARPAQSSEGVR  660

Query:  668  YSKEQPTQFGQGMSLQQALQARKSNSQSQVTAQ-LQA-------------LNANNS-HET  712
             +S E  TQFGQGMSL +ALQARK+ +Q + +AQ +QA              +N+S  E
Sbjct:  661  FSTETHTQFGQGMSLSEALQARKAQAQVRQSAQPMQAHTIPSASTSSVLPFGSNSSVEEV  720

Query:  713  SWEIGDVATHKKWGDGTVLEVSGSGKTQELKINFPGIGLKKLLASVAPISKK          764
             +W+IGD+A HKKWGDGTVLEVSGSGKT ELKI FP +GLKKLLASVAPI KK
Sbjct:  721  TWQIGDIAHHKKWGDGTVLEVSGSGKTMELKIKEPEVGLKKLLASVAPIEKK          772
```

Based on this analysis, it was predicted that these proteins and their epitopes could be useful antigens for vaccines or diagnostics.

Example 1746

A DNA sequence (GBSx1853) was identified in *S. agalactiae* <SEQ ID 5423> which encodes the amino acid sequence <SEQ ID 5424>. Analysis of this protein sequence reveals the following:

Possible site: 43
>>> Seems to have no N-terminal signal sequence
----- Final Results -----
  bacterial cytoplasm --- Certainty = 0.4741 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database.

A related DNA sequence was identified in *S. pyogenes* <SEQ ID 5425> which encodes the amino acid sequence <SEQ ID 5426>. Analysis of this protein sequence reveals the following:

Possible site: 48
>>> Seems to have no N-terminal signal sequence
----- Final Results -----
  bacterial cytoplasm --- Certainty = 0.1210 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
>GP:AAA88579 GB:M14339 unknown [Streptococcus pneumoniae]
Identities = 43/57 (75%), Positives = 50/57 (870)
Query:   41  AHGGYLFTLCDQVSGLVAISTGYRAVTLQSNINYLRAGRLDDLLTVIGTCVHNGRTT   97
             AHGGYLFTLCDQ+SGLV IS G + VTLQS+INYL+AG+LDD+LT+ G CVH GRTT
Sbjct:    1  AHGGYLFTLCDQISGLVVISLGLDGVTLQSSINYLKAGKLDDVLTIKGECVHQGRTT   57
```

```
Identities = 57/97 (58%), Positives = 74/97 (75%)
Query:   2   KFNLEQVKVFENYEIENWEEGQVTLTTKVVDSSLNYYGNAHGGYLFTLCDQVSGLVAIST         61
             +  L  +  +F+NY+IE   E+G +  L+T+V +++LNYYGNAHGGYLFTLCDQV GLVA +T
Sbjct:   7   EMTLNVISIFDNYQIELAEKGHLILSTEVTETALNYYGNAHGGYLFTLCDQVGGLVARTT         66

Query:  62   GYEAVTLQSNINYLRAGRLDDLLTVIGTCVHNGRTTK                                98
             G E+VTLQ+N NYL+AG   D L V G  VH GRTT+
Sbjct:  67   GVESVTLQANANYLKAGHKGDKLMVEGRLVHGGRTTQ                              103
```

Based on this analysis, it was predicted that these proteins and their epitopes could be useful antigens for vaccines or diagnostics.

Example 1747

A DNA sequence (GBSx1854) was identified in *S. agalactiae* <SEQ ID 5427> which encodes the amino acid sequence <SEQ ID 5428>. Analysis of this protein sequence reveals the following:

---
Possible site: 22
>>> Seems to have no N-terminal signal sequence
----- Final Results -----
  bacterial cytoplasm --- Certainty = 0.3187 (Affirmative) <succ>
   bacterial membrane --- Certainty = 0.0000 (Not Clear) <succ>
     bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1748

A DNA sequence (GBSx1855) was identified in *S. agalactiae* <SEQ ID 5429> which encodes the amino acid sequence <SEQ ID 5430>. This protein is predicted to be uracil permease (uraA). Analysis of this protein sequence reveals the following:

---
Possible site: 54
>>> Seems to have no N-terminal signal sequence
   INTEGRAL     Likelihood = –8.65    Transmembrane 122-138 (117-146)
   INTEGRAL     Likelihood = –8.65    Transmembrane 212-228 (204-233)
   INTEGRAL     Likelihood = –7.32    Transmembrane 60-76 (49-80)
   INTEGRAL     Likelihood = –6.53    Transmembrane 149-165 (145-172)
   INTEGRAL     Likelihood = –6.48    Transmembrane 402-418 (401-420)
   INTEGRAL     Likelihood = –4.04    Transmembrane 422-438 (420-445)
   INTEGRAL     Likelihood = –3.72    Transmembrane 365-381 (364-385)
   INTEGRAL     Likelihood = –3.40    Transmembrane 184-200 (182-202)
   INTEGRAL     Likelihood = –3.08    Transmembrane 346-362 (345-363)
   INTEGRAL     Likelihood = –1.38    Transmembrane 260-276 (260-276)
----- Final Results -----
   bacterial membrane --- Certainty = 0.4461 (Affirmative) <succ>
      bacterial outside --- Certainty = 0.0000 (Not Clear) <succ>
        bacterial cytoplasm --- Certainty = 0.0000 (Not Clear) <succ>

---

A related GBS nucleic acid sequence <SEQ ID 9865> which encodes amino acid sequence <SEQ ID 9866> was also identified.

The protein has homology with the following sequences in the GENPEPT database.

```
>GP:CAA53697 GB:X76083 uracil permease [Bacillus caldolyticus]
Identities = 208/416 (50%), Positives = 291/416 (69%), Gaps = 11/416 (2%)
Query:   32   LLDIDEKPELFQGLLLSFQHVFAMFGATILVPLILGMPVSVALFASGCGTLIYQVATKFK        91
              +LDI ++P + Q + LS QH+FAMFGATILVP ++G+   S+AL  SG GTL + + TK++
Sbjct:    5   VLDIQDRPTVGQWITLSLQHLFAMFGATILVPYLVGLDPSIALLTSGLGTLAFLLITKWQ        64

Query:   92   VPVYLGSSFAYITAMALAMKQMHGDISAAQTGILFVGLIYVVVATVIKFVGNSWVDKILP       151
              VP YLGSSFAYI + A +  G    AA  G      GL+Y VVA +IK  G  WV K+LP
Sbjct:   65   VPAYLGSSFAYIAPIIAA--KTAGGPGAAMIGSFLAGLVYGVVALIIKKAGYRWVMKLLP       122

Query:  152   PIIIGPMIIVIGLGLANSAVTNA--GFVAKGDWRKMLVAVVTFLIAAFINTKGKGFIKII       209
              P+++GP+IIVIGLGLA +AV  A   G   K        VA+VT       +G + +I
Sbjct:  123   PVVVGPVIIVIGLGLAGTAVGMAMNGPDGKYSLLHFSVALVTLAATIVCSVLARGMLSLI       182

Query:  210   PFLFAIIGGYILSIILGLVDLSPVEKAAWFELPKFYLPFKTGLFHSYKLYFGPEMLAIL-       268
              P L  I+ GY+ ++ +GLVDLS V  A WFE P F +PF      Y +    E++ ++
Sbjct:  183   PVLVGIVVGYLYALAVGLVDLSKVAAAKWFEWPDFLIPFA-----DYPVRVTWEIVMLMV       237

Query:  269   PISIVTIAENIGDHTVLGQICGRNFLKKPGLNRLLIGDGLATAFSALIGGPAETTYGENT       328
              P++IVT++E+IG    VL ++  GR+ ++KPGL+R  ++GDG AT  SAL+GGP +TTYGEN
Sbjct:  238   PVAIVTLSEHIGHQLVLSKVVGRDLIQKPGLHRSILGDGTATMISALLGGPPKTTYGENI       297

Query:  329   GVIGMTRIASVTVIRNAAFIAIAFSFFGKFTALISTIPSAVLGGMAILLYGVIASNGLKV       388
              GV+ +TR+ SV V+  AA IAIAF F GK TALIS+IP+ V+GG++ILL+G+IAS+GL++
Sbjct:  298   GVLAITRVYSVYVLAGAAVIAIAFGFVGKITALISSIPTPVMGGVSILLFGIIASSGLRM       357

Query:  389   LIENRVNFAEVRNLIIASSMLVLGLGGAVLDLG-ALTLSGTALSAIVGIILNLILP       443
              LI++RV+F +  RNL+IAS +LV+G+GGAVL +    +   ALSAIVG++LNLILP
Sbjct:  358   LIDSRVDFGQTRNLVIASVILVIGIGGAVLKISDSFQITGMALSAIVGVLLNLILP       413
```

A related DNA sequence was identified in *S. pyogenes* <SEQ ID 5431> which encodes the amino acid sequence <SEQ ID 5432>. Analysis of this protein sequence reveals the following:

```
Possible site: 27
>>> Seems to have no N-terminal signal sequence
INTEGRAL    Likelihood = -10.72   Transmembrane 177-193 (171-206)
INTEGRAL    Likelihood =  -8.55   Transmembrane 313- 329 (304-339)
INTEGRAL    Likelihood =  -8.17   Transmembrane 154-170 (152-175)
INTEGRAL    Likelihood =  -7.91   Transmembrane 376-392 (374-395)
INTEGRAL    Likelihood =  -7.48   Transmembrane 25-41 (22-43)
INTEGRAL    Likelihood =  -5.84   Transmembrane 120-136 (116-142)
INTEGRAL    Likelihood =  -4.99   Transmembrane 96-112 (90-117)
INTEGRAL    Likelihood =  -3.29   Transmembrane 339-355 (338-360)
INTEGRAL    Likelihood =  -1.91   Transmembrane 396-412 (396-413)
----- Final Results -----
   bacterial membrane --- Certainty = 0.5288 (Affirmative) <succ>
     bacterial outside --- Certainty = 0.0000 (Not Clear) <succ>
        bacterial cytoplasm --- Certainty = 0.0000 (Not Clear) <succ>
```

The protein has homology with the following sequences in the databases:

```
>GP:CAB89870 GB:AJ132624  uracil transporter [Lactococcus lactis]
Identities = 294/421 (69%), Positives = 359/421 (84%), Gaps = 5/421 (1%)
Query:   3  DVIYDVEEVPKAGMLVGLSFQHLFAMFGATVLVPILVGIDPSVALLSSGLGTLAHLSVTK   62
            D+I  V+E P A    GLSFQHLFAMFG+TVLVPILVGI+P++ALLSSGLGTLAH+SVTK
Sbjct:   5  DIILKVDEKPAASQWFGLSFQHLFAMFGSTVLVPILVGINPAIALLSSGLGTLAHMSVTK   64

Query:  63  FKIPAYMGSSFAYIAAMQLLMKTNGIGAVAQGAMTGGLVYLIVALIVKAIGNDWIDNILP  122
            FK+PAYMGSSFAYI AM LLMK G+ A+AQGAMTGGLVYLIVALIVK  G  WID +LP
Sbjct:  65  FKVPAYMGSSFAYIGAMTLLMKNGGMPAIAQGAMTGGLVYLIVALIVKFAGKGWIDKVLP  124

Query: 123  PIVVGPIVMVIGLSLASTAVNDVMLKN----GNYNLTYLVIGLVTLLSVIFFNIYGKGIV  178
            PIVVGPIVMVIGLSLA TA+ND M        Y+L Y++I L+T+LS++ ++IYGKG +
Sbjct: 125  PIVVGPIVMVIGLSLAPTAINDAMYTDVANLKGYSLAYIIIALITVLSIVVYSIYGKGFL  184

Query: 179  AIVPLLLGLLVGYVVALLVGVLTGQEIVDFTNVAQAKWFSIPSVEIPFLTYGVKFYPSAI  238
            ++VP+LLG++ GYV A+++G +TG   IV FT ++QAKW ++P +EIPF +Y    FYPSAI
Sbjct: 185  SVVPILLGIITGYVAAMIIGKITGMNIVSFTGISQAKWLTLPPMEIPFASYKWAFYPSAI  244

Query: 239  LTMAPIAFVTMTEHFGHIMVLNSLTKRDYFKDPGLEKTLTGDGFAQIIAGFLGAPPVTSY  298
            LTMAPIAFVTMTEHFGHIMVLNSLTK+DYFK+PGLEKTLTGDG AQIIAGF+GAPPVTSY
Sbjct: 245  LTMAPIAFVTMTEHFGHIMVLNSLTKKDYFKEPGLEKTLTGDGLAQIIAGFIGAPPVTSY  304

Query: 299  GENIGVMALNKIFSVYVIAGAAVIAALLSFIGKVSALIQSIPTPVIGGISVALFGVIASS  358
            GENIGVMA+ KI S+YVIAGAAV+A ++SF+GK++AL+QSIP PVIGG S+ALFGVIA+S
Sbjct: 305  GENIGVMAITKIHSIYVIAGAAVLAIVVSFVGKITALLQSIPAPVIGGASIALFGVIAAS  364

Query: 359  GLKILIESKVDMDNKKNLLIASVILVSGIGGLMLQV-NGLQISGVAFSTLLGIILYQVLPE  418
            GLKIL+E+KVD D K+NLLI+SV+LV GIGG+++ +   LQIS VA +T+LGI+L  VLP+
Sbjct: 365  GLKILVENKVDFDIKRNLLISSVVLVIGIGGMIINITQNLQISSVAIATILGIVLNLVLPK  425
```

An alignment of the GAS and GBS proteins is shown below.

```
Identities = 186/425 (43%), Positives = 282/425 (65%), Gaps = 17/425 (4%)
Query:  30  NLLLDIDEKPELFQGLLLSFQHVFAMFGATILVPLILGMPVSVALFASGCGTLIYQVATK   89
            +++ D++E P+    + LSFQH+FAMFGAT+LVP++G+  SVAL +SG GTL +   TK
Sbjct:   3  DVIYDVEEVPKAGMLVGLSFQHLFAMFGATVLVPILVGIDPSVALLSSGLGTLAHLSVTK   62

Query:  90  FKVPVYLGSSFAYITAMALAMKQMHGDISAAQTGILFVGLIYVVVATVIKFVGNSWVDKI  149
            FK+P Y+GSSFAYI AM L MK    I A   G +  GL+Y++VA ++K +GN W+D I
Sbjct:  63  FKIPAYMGSSFAYIAAMQLLMKT--NGIGAVAQGAMTGGLVYLIVALIVKAIGNDWIDNI  120

Query: 150  LPPIIIGPMIIVIGLGLANSAVTNAGFVAKGDWRK--MLVAVVTFLIAAFINTKGKGFIK  207
            LPPI++GP+++VIGL LA++AV +    +  G++      +++ +VT L   F N GKG +
Sbjct: 121  LPPIVVGPIVMVIGLSLASTAVNDV-MLKNGNYNLTYLVIGLVTLLSVIFFNIYGKGIVA  179

Query: 208  IIPFLFAIIGGYILSIILG------LVDLSPVEKAAWFELPKFYLPFKTGLFHSYKLYFG  261
            I+P L  ++ GY++++++G      +VD + V +A WF +P   +PF T     Y + F
Sbjct: 180  IVPLLLGLLVGYVVALLVGVLTGQEIVDFTNVAQAKWFSIPSVEIPFLT-----YGVKFY  234
```

-continued

```
Query: 262  PE-MLAILPISIVTIAENIGDHTVLGQICGRNFLKKPGLNRLLIGDGLATAFSALIGGPA  320
            P  +L + PI+ VT+ E+ G    VL  +  R++ K PGL + L GDG A   +  +G P
Sbjct: 235  PSAILTMAPIAFVTMTEHFGHIMVLNSLTKRDYFKDPGLEKTLTGDGFAQIIAGFLGAPP  294

Query: 321  ETTYGENTGVIGMTRIASVTVIRNAAFIAIAFSFFGKFTALISTIPSAVLGGMAILLYGV  380
              T+YGEN GV+ + +I SV VI  AA IA   SF GK +ALI +IP+ V+GG+++ L+GV
Sbjct: 295  VTSYGENIGVMALNKIFSVYVIAGAAVIAALLSFIGKVSALIQSIPTPVIGGISVALFGV  354

Query: 381  IASNGLKVLIENRVNFAEVRNLIIASSMLVLGLGGAVLDLGALTLSGTALSAIVGIILNL  440
            IAS+GLK+LIE++V+      +NL+IAS +LV G+GG +L +    L +SG A S ++GIIL
Sbjct: 355  IASSGLKILIESKVDMDNKKNLLIASVILVSGIGGLMLQVNGLQISGVAFSTLLGIILYQ  414

Query: 441  ILPKE  445
            +LP++
Sbjct: 415  VLPEK  419
```

Based on this analysis, it was predicted that these proteins and their epitopes could be useful antigens for vaccines or diagnostics.

Example 1749

A DNA sequence (GBSx1856) was identified in *S. agalactiae* <SEQ ID 5433> which encodes the amino acid sequence <SEQ ID 5434>. Analysis of this protein sequence reveals the following:

---

Possible site: 20
>>> Seems to have no N-terminal signal sequence
----- Final Results -----
    bacterial cytoplasm --- Certainty = 0.3863 (Affirmative) <succ>
    bacterial membrane --- Certainty = 0.0000 (Not Clear) <succ>
    bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1750

A DNA sequence (GBSx1857) was identified in *S. agalactiae* <SEQ ID 5435> which encodes the amino acid sequence <SEQ ID 5436>. This protein is predicted to be sodium/alanine symporter. Analysis of this protein sequence reveals the following:

---

Possible site: 22
>>> Seems to have no N-terminal signal sequence
INTEGRAL    Likelihood = −10.88   Transmembrane 191-207 (184-214)
INTEGRAL    Likelihood = −8.97    Transmembrane 151-167 (148-171)
INTEGRAL    Likelihood = −8.39    Transmembrane 217-233 (216-238)
INTEGRAL    Likelihood = −6.74    Transmembrane 312-328 (310-333)
INTEGRAL    Likelihood = −6.26    Transmembrane 357-373 (349-376)
INTEGRAL    Likelihood = −5.10    Transmembrane 424-440 (422-441)
INTEGRAL    Likelihood = −5.04    Transmembrane 396-412 (390-417)
INTEGRAL    Likelihood = −0.37    Transmembrane 25-41 (25-41)
----- Final Results -----
    bacterial membrane --- Certainty = 0.5352 (Affirmative) <succ>
    bacterial outside --- Certainty = 0.0000 (Not Clear) <succ>
    bacterial cytoplasm --- Certainty = 0.0000 (Not Clear) <succ>

---

A related GBS nucleic acid sequence <SEQ ID 9867> which encodes amino acid sequence <SEQ ID 9868> was also identified.

The protein has homology with the following sequences in the GENPEPT database.

```
>GP:AAC22541 GB:U32770 amino acid carrier protein, putative
 [Haemophilus influenzae Rd]
 Identities = 255/443 (57%), Positives = 333/443 (74%), Gaps = 4/443 (0%)
Query: 11   TLFTHINSFVWGPPLLALLVGTGIYLSFRLGFIQLRQLSRAFKLIFREDNG-QGDISSYA   69
            ++ + I+SF+WG PLL LL GTG+YL+ RLGFIQ+R L RA    +F++D G +GD+SS+A
Sbjct: 5    SILSAIDSFIWGAPLLILLSGTGLYLTLRLGFIQIRYLPRALGYLFKKDKGGKGDVSSFA   64

Query: 70   ALATALAATVGTGNIVGVATAIKSGGPGALFWMWVAAFFGMATKYAEGLLAIKYRTKDTN  129
            AL  TALAAT+GTGNIVGVATA+++GGPGA+FWMW+  A  GMATKYAE LLA+KYR +D N
Sbjct: 65   ALCTALAATIGTGNIVGVATAVQAGGPGAIFWMWLVALLGMATKYAECLLAVKYRVRDKN  124

Query: 130  GEISGGPMYYIINGMGQKWKPLAVFFSAAGILVALLGIGTFTQVNAIASSLEHTFKISTR  189
            G ++GGPMYYI   G+G +W   LA  F+  G++VA   GIGTF QVNAI   +++ TF I
Sbjct: 125  GFMAGGPMYYIERGLGIRW--LAKLFALFGVMVAFFGIGTFPQVNAITHAMQDTFNIPVL  182

Query: 190  FTSLILAVIVLFIIFGGIKSISKVSEKIVPFMAISYILATLIIIAVNYNKIPHTFQLIFS  249
                 T++I+ ++V   II GG+K I+  S   IVPFMAI Y+  +L+II +N  K+P     LI
Sbjct: 183  VTAIIVTLLVGLIILGGVKRIATASSVIVPFMAILYVTTSLVIILLNIEKVPDAILLIID  242

Query: 250  GAFSGTAAIGGFSGAIVKEAIQKGIARGVFSNESGLGSAPIAAAAAKTKEPVEQGLISMT  309
             AF    AA+GG   G V +AIQ G+ARG+FSNESGLGSAPIAAAAA+T+EPV QGLISMT
Sbjct: 243  SAFDPQAALGGAVGLTVMKAIQSGVARGIFSNESGLGSAPIAAAAAQTREPVRQGLISMT  302
```

-continued

```
Query: 310  GTFIDTIVICTLTGIAILVTGKWLEFDLQGAPLTQASFNTVFG-SLGSFALTFCLVLFAF  368
            GTF+DTI++CT+TGI +++TG W   +L GA +T  +F    G S+G+    +T  L+ FAF
Sbjct: 303  GTFLDTIIVCTMTGIVLVLTGAWNNPELAGATVTNYAFAQGLGTSIGATIVTVGLLFFAF  362

Query: 369  TTILGWSYYGERCFEYLFGTKFINAYRIIFVIMVGLGGFLQLDLIWVIADIVNGLMALPN  428
            TTILGW YYGERCF  YL G + +   YR+ ++++VGLG FL L+LIW+IADIVNGLMA PN
Sbjct: 363  TTILGWCYYGERCFVYLVGIRGVKLYRLAYIMLVGLGAFLHLNLIWIIADIVNGLMAFPN  422

Query: 429  LIALLALSPIIVKETQKYFSETK  451
            LIAL+ L  +I++ET+ YF   K
Sbjct: 423  LIALIGLRKVIIEETKDYFQRLK  445
```

A related DNA sequence was identified in *S. pyogenes* <SEQ ID 5437> which encodes the amino acid sequence <SEQ ID 5438>. Analysis of this protein sequence reveals the following:

```
Possible site: 45
>>> Seems to have an uncleavable N-term signal seq
INTEGRAL    Likelihood = -11.36   Transmembrane 183-199 (175-206)
INTEGRAL    Likelihood = -7.80    Transmembrane 143-159 (140-163)
INTEGRAL    Likelihood = -7.11    Transmembrane 209-225 (208-229)
INTEGRAL    Likelihood = -5.95    Transmembrane 416-432 (413-434)
INTEGRAL    Likelihood = -5.15    Transmembrane 304-320 (302-324)
INTEGRAL    Likelihood = -4.46    Transmembrane 387-403 (382-408)
INTEGRAL    Likelihood = -3.35    Transmembrane 348-364 (345-366)
INTEGRAL    Likelihood = -1.17    Transmembrane 11-27 (10-28)
----- Final Results -----
   bacterial membrane --- Certainty = 0.5543 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the databases:

```
>GP:AAF94579 GB:AE004221 sodium/alanine symporter [Vibrio cholerae]

Identities = 261/441 (59%), Positives = 328/441 (74%), Gaps = 7/441 (1%)

Query: 3    ALVKLIDNLVWGPPLLILLVGTGIYLTSHLGLIQILKLPRAFKLIFSDDEG---HGDISS  59
            + ++  +D+LVWGPPLLILLVGTG+Y T  LGL+Q  +LP A  ++F  ++       GD+SS
Sbjct: 6    SFLQTVDSLVWGPPLLILLVGTGVYFTFRLGLLQFRRLPTALAMVFGREKSSDKQGDVSS  65

Query: 60   FAALATALAATVGTGNIVGVATAIKSGGPGALFWMWVAAFFGMATKYAEGVLAIKYRTKD  119
            FAAL TAL+AT+GTGNIVGVATAIK GGPGALFWMW+AA FGMATKYAE +LA+KYR  D
Sbjct: 66   FAALCTALSATIGTGNIVGVATAIKLGGPGALFWMWLAALFGMATKYAECLLAVKYRQID  125

Query: 120  ANGHISGGPMYYIVNGMGTKWKPLAVLFAGSGILVALFGIGTFAQVNSITSSLGHSFGLS  179
              G + GGPMYY+ +G+ +K    LAVLFA   + VA FGIGTF QVN+I  +    SFG+
Sbjct: 126  DKGQMVGGPMYYLRDGVSSK--TLAVLFAVFAVGVACFGIGTFPQVNAILDATQISFGVP  183

Query: 180  PQMVSIVLAIFVAAIIFGGIHSISKVAEKVVPFMAIFYILSSLAVIFSHYQQLLPVIRLV  239
               +  ++VL + VA + GGI SI+KVA KVVP MA+FYI++ L+VI ++    +L  + LV
Sbjct: 184  REASAVVLTVLVAIVTIGGIQSIAKVAGKVVPAMALFYIIACLSVIVTNADKLADAVELV  243

Query: 240  FQSAFTPTAAIGGFAGSLMKDAIQKGIARGVFSNESGLRSAPIAAAAAKTNEPVEQGLIS  299
                SAFT  TAA GGF G+ +    AIQ GIARGVFSNESGL SAP+AAAAAKT+  VEQGLIS
Sbjct: 244  LVSAFTSTAATGGFLGASIMLAIQSGIARGVFSNESGLGSAPMAAAAAKTDSCVEQGLIS  303

Query: 300  MTGTFIDTIIICTLTGLSILVTGQWTGQLEGAPLTQSAFATVFG--NLGTFGLTFSLVLF  357
            MTGTF DTIIICT+TGL+++++TG W   L GA +T  AFAT        +G    ++  L+ F
Sbjct: 304  MTGTFFDTIIICTMTGLALILTGAWQSDLSGAAMTTYAFATGLNAQTIGPMLVSIGLMFF  363

Query: 358  AFTTILGWSYYGERCFEFLFGITHLTYFRIVFILMVGLGGFLKLELIWVLADIVNGLMAL  417
            AFTTILGW+YYGERC  FLFG  +   ++IVFI ++   G FL L+LIW++ADIVNGLMA+
Sbjct: 364  AFTTILGWNYYGERCMVFLFGTKAVLPYKIVFIGLIASGAFLHLDLIWIIADIVNGLMAI  423

Query: 418  PNLIALLALSPVVILETKHYF  438
            PNLI L+AL   VV+ ETK YF
Sbjct: 424  PNLIGLVALRHVVVEETKQYF  444
```

An alignment of the GAS and GBS proteins is shown below.

```
Identities = 323/439 (73%), Positives = 380/439 (85%), Gaps = 1/439 (0%)
Query:   9   MLTLFTHINSFVWGPPLLALLVGTGIYLSFRLGFIQLRQLSRAFKLIFREDNGQGDISSY    68
             M+ L   I++ VWGPPLL LLVGTGIYL+  LG IQ+ +L RAFKLIF +D G GDISS+
Sbjct:   1   MIALVKLIDNLVWGPPLLILLVGTGIYLTSHLGLIQILKLPRAFKLIFSDDEGHGDISSF    60

Query:  69   AALATALAATVGTGNIVGVATAIKSGGPGALFWMWVAAFFGMATKYAEGLLAIKYRTKDT   128
             AALATALAATVGTGNIVGVATAIKSGGPGALFWMWVAAFFGMATKYAEG+LAIKYRTKD
Sbjct:  61   AALATALAATVGTGNIVGVATAIKSGGPGALFWMWVAAFFGMATKYAEGVLAIKYRTKDA   120

Query: 129   NGEISGGPMYYIINGMGQKWKPLAVFFSAAGILVALLGIGTFTQVNAIASSLEHTFKIST   188
             NG ISGGPMYYI+NGMG KWKPLAV F+ +GILVAL GIGTF QVN+I SSL H+F +S
Sbjct: 121   NGHISGGPMYYIVNGMGTKWKPLAVLFAGSGILVALFGIGTFAQVNSITSSLGHSFGLSP   180

Query: 189   RFTSLILAVIVLFIIFGGIKSISKVSEKIVPFMAISYILATLIIIAVNYNKIPHTFQLIF   248
             +  S++LA+ V  IIFGGI SISKV+EK+VPFMAI YIL++L +I  +Y ++      +L+F
Sbjct: 181   QMVSIVLAIFVAAIIFGGIHSISKVAEKVVPFMAIFYILSSLAVIFSHYQQLLPVIRLVF   240

Query: 249   SGAFSGTAAIGGFSGAIVKEAIQKGIARGVFSNESGLGSAPIAAAAAKTKEPVEQGLISM   308
                AF+ TAAIGGF+G+++K+AIQKGIARGVFSNESGL SAPIAAAAAKT EPVEQGLISM
Sbjct: 241   QSAFTPTAAIGGFAGSLMKDAIQKGIARGVFSNESGLRSAPIAAAAAKTNEPVEQGLISM   300

Query: 309   TGTFIDTIVICTLTGIAILVTGKWLEFDLQGAPLTQASFNTVFGSLGSFALTFCLVLFAF   368
             TGTFIDTI+ICTLTG++ILVTG+W    L+GAPLTQ++F TVFG+LG+F LTF LVLFAF
Sbjct: 301   TGTFIDTIIICTLTGLSILVTGQWTG-QLEGAPLTQSAFATVFGNLGTFGLTFSLVLFAF   359

Query: 369   TTILGWSYYGERCFEYLFGTKFINAYRIIFVIMVGLGGFLQLDLIWVIADIVNGLMALPN   428
             TTILGWSYYGERCFE+LFG   +  +RI+F++MVGLGGFL+L+LIWV+ADIVNGLMALPN
Sbjct: 360   TTILGWSYYGERCFEFLFGITHLTYFRIVFILMVGLGGFLKLELIWVLADIVNGLMALPN   419

Query: 429   LIALLALSPIIVKETQKYF                                            447
             LIALLALSP+++ ET+ YF
Sbjct: 420   LIALLALSPVVILETKHYF                                            438
```

Based on this analysis, it was predicted that these proteins and their epitopes could be useful antigens for vaccines or diagnostics.

Example 1751

A DNA sequence (GBSx1858) was identified in *S. agalactiae* <SEQ ID 5439> which encodes the amino acid sequence <SEQ ID 5440>. Analysis of this protein sequence reveals the following:

Possible site: 33
>>> Seems to have a cleavable N-term signal seq.

-continued

| INTEGRAL | Likelihood = −6.16 | Transmembrane 85-101 (80-108) |
| INTEGRAL | Likelihood = −5.36 | Transmembrane 118-134 (115-137) |
| INTEGRAL | Likelihood = −2.81 | Transmembrane 177-193 (177-193) |
| INTEGRAL | Likelihood = −0.48 | Transmembrane 49-65 (49-65) |

----- Final Results -----
bacterial membrane --- Certainty = 0.3463 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the GENPEPT database.

```
>GP:CAB12451 GB:Z99107 alternate gene name: ydxT-similar to cation
efflux system membrane protein [Bacillus subtilis]
Identities = 118/282 (41%), Positives = 181/282 (63%)
Query:   6   ENLQLAKRGPIISIIAYITLAVAKLAAGYWFDATSLVADGFNNLSDILGNVALLIGLHLA    65
             + L+  + G ++SI AY+ L+  KL  GY F + +L ADG NN +DI+ +VA+LIGL ++
Sbjct:   5   DELKKGESGALVSIAAYLVLSAIKLIIGYLFHSEALTADGLNNTTDIIASVAVLIGLRIS    64

Query:  66   SQPADSNHRFGHWKIEDLASLITSFIMFVVGIQVFIQTVTKIINNTDTNIDPLGAIVGAI   125
             +P D +H +GH++ E +ASLI SFIM VVG+QV      I +     D + A   A
Sbjct:  65   QKPPDEDHPYGHFRAETIASLIASFIMMVVGLQVLFSAGESIFSAKQETPDMIAAWTAAG   124

Query: 126   SALVMLGVYFYNKQLSQRVKSSALVAASKDNLSDAVTSIGTSIAIIAASLNFPIIDRLAA   185
             +A++ML VY YNK+L+++VKS AL+AA+ DN SDA   SIGT I I+AA   +   ID + A
Sbjct: 125   GAVLMLIVYRYNKRLAKKVKSQALLAAAADNKSDAFVSIGTFIGIVAAQFHLAWIDTVTA   184

Query: 186   IIITYFILKTAYDIFIESAFSLSDGFDDYQLKQYEKAILTIPKISAVKSQRGRTYGSNIY   245
             +I   I KTA+DIF ES+ SL+DGFD   Y++ I   I   +S +K   R GS ++
Sbjct: 185   FVIGLLICKTAWDIFKESSHSLTDGFDIKDISAYKQTIEKISGVSRLKDIKARYLGSTVH   244

Query: 246   LDIVLEMNPDLSVFESHAITERVEKLLSDKFSVYDIDIHVEP                      287
             +D+V+E++ DL++ ESH I  +E+ + ++        +H+EP
Sbjct: 245   VDVVVEVSADLNITESHDIANEIERRMKEEHAIDYSHVMEP                       286
```

A related DNA sequence was identified in *S. pyogenes* <SEQ ID 5441> which encodes the amino acid sequence <SEQ ID 5442>. Analysis of this protein sequence reveals the following:

```
Possible site: 46
>>> Seems to have a cleavable N-term signal seq.
INTEGRAL    Likelihood = -8.01    Transmembrane 121-137 (114-139)
INTEGRAL    Likelihood = -5.41    Transmembrane 86-102 (84-109)
INTEGRAL    Likelihood = -5.04    Transmembrane 178-194 (176-197)
INTEGRAL    Likelihood = -0.69    Transmembrane 50-66 (50-66)
INTEGRAL    Likelihood = -0.64    Transmembrane 158-174 (158-174)
----- Final Results -----
    bacterial membrane --- Certainty = 0.4206 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the databases:

```
>GP:CAB12451 GB:Z99107 alternate gene name: ydxT-similar to cation
efflux system membrane protein [Bacillus subtilis]
Identities = 127/280 (45%), Positives = 187/280 (66%)
Query:   9  LKLARKGPIVSIIVYLSLSVAKLLAGYLLNASSLIADGFNNLSDIVGNVALLIGLHLASQ    68
            LK   G +VSI  YL LS  KL+ GYL ++ +L ADG NN +DI+ +VA+LIGL ++ +
Sbjct:   7  LKKGESGALVSIAAYLVLSAIKLIIGYLFHSEALTADGLNNTTDIIASVAVLIGLRISQK    66

Query:  69  PADANHKFGHWKIEDLSSLVTSFIMFLVGFQVLIHTIKSIFSGQQVDIDPLGAIVGIVSA   128
            P D +H +GH++ E ++SL+ SFIM +VG QVL    +SIFS +Q   D + A     A
Sbjct:  67  PPDEDHPYGHFRAETIASLIASFIMMVVGLQVLFSAGESIFSAKQETPDMIAAWTAAGGA   126

Query: 129  FVMLGVYVFNKRLSKRVKSSALVAASKDNLADAVTSIGTSIAIIAASLHLPVIDHIAAMI   188
            +ML VY +NKRL+K+VKS AL+AA+ DN +DA SIGT I I+AA HL  ID + A +
Sbjct: 127  VLMLIVYRYNKRLAKKVKSQALLAAAADNKSDAFVSIGTFIGIVAAQFHLAWIDTVTAFV   186

Query: 189  ITFFILKTAFDIFMESSFSLSDGFDSRHLKKYEKAILEIPKIVAVKSQRARTYGSNVYLD   248
            I   I KTA+DIF ESS SL+DGFD + +  Y++ I +I  +   +K  +AR  GS V++D
Sbjct: 187  IGLLICKTAWDIFKESSHSLTDGFDIKDISAYKQTIEKISGVSRLKDIKARYLGSTVHVD   246

Query: 249  IVLEMNPDLSVYESHSITEKVEQLLSDQFSIYDIDIHVEP                      288
            +V+E++ DL++ ESH I  ++E+ + ++ +I    +H+EP
Sbjct: 247  VVVEVSADLNITESHDIANEIERRMKEEHAIDYSHVHMEP                      286
```

Based on this analysis, it was predicted that these proteins and their epitopes could be useful antigens for vaccines or diagnostics.

Example 1752

A DNA sequence (GBSx1859) was identified in *S. agalactiae* <SEQ ID 5443> which encodes the amino acid sequence <SEQ ID 5444>. Analysis of this protein sequence reveals the following:

```
Possible site: 55
>>> Seems to have no N-terminal signal sequence
INTEGRAL    Likelihood = -8.12    Transmembrane 171-187 (161-194)
INTEGRAL    Likelihood = -6.32    Transmembrane 118-134 (113-138)
INTEGRAL    Likelihood = -5.89    Transmembrane 59-75 (53-77)
INTEGRAL    Likelihood = -5.52    Transmembrane 231-247 (226-252)
```

An alignment of the GAS and GBS proteins is shown below.

```
Identities = 274/406 (67%), Positives = 340/406 (83%), Gaps = 4/406 (0%)
Query:   7  NLQLAKRGPIISIIAYITLAVAKLAAGYWFDATSLVADGFNNLSDILGNVALLIGLHLAS    66
            NL+LA++GPI+SII Y++L+VAKL AGY  +A+SL+ADGFNNLSDI+GNVALLIGLHLAS
Sbjct:   8  NLKLARKGPIVSIIVYLSLSVAKLLAGYLLNASSLIADGFNNLSDIVGNVALLIGLHLAS    67

Query:  67  QPADSNHRFGHWKIEDLASLITSFIMFVVGIQVFIQTVTKIINNTDTNIDPLGAIVGAIS   126
            QPAD+NH+FGHWKIEDL+SL+TSFIMF VG QV I T+   I +    +IDPLGAIVG +S
Sbjct:  68  QPADANHKFGHWKIEDLSSLVTSFIMFLVGFQVLIHTIKSIFSGQQVDIDPLGAIVGIVS   127

Query: 127  ALVMLGVYFYNKQLSQRVKSSALVAASKDNLSDAVTSIGTSIAIIAASLNFPIIDRLAAI   186
            A VMLGVY +NK+LS+RVKSSALVAASKDNL+DAVTSIGTSIAIIAASL+ P+ID +AA+
Sbjct: 128  AFVMLGVYVFNKRLSKRVKSSALVAASKDNLADAVTSIGTSIAIIAASLHLPVIDHIAAM   187

Query: 187  IITYFILKTAYDIFIESAFSLSDGFDDYQLKQYEKAILTIPKISAVKSQRGRTYGSNIYL   246
            IIT+FILKTA+DIF+ES+FSLSDGFD   LK+YEKAIL IPKI AVKSQR RTYGSN+YL
Sbjct: 188  IITFFILKTAFDIFMESSFSLSDGFDSRHLKKYEKAILEIPKIVAVKSQRARTYGSNVYL   247

Query: 247  DIVLEMNPDLSVFESHAITERVEKLLSDKFSVYDIDIHVEPASIPEDEIFDNVYQKLYKN   306
            DIVLEMNPDLSV+ESH+ITE+VE+LLSD+FS+YDIDIHVEPA IPE+EIFDNV +KLY+
Sbjct: 248  DIVLEMNPDLSVYESHSITEKVEQLLSDQFSIYDIDIHVEPAMIPEEEIFDNVAKKLYRY   307

Query: 307  EKIILAKIPGYETFISPDFYMINEKGNIITSDMLTNATNHSLASNFKYFNVKSISQKTKL   366
            EK+IL+K+P Y+ +I+  F ++   G  +   N  +  SNF +F ++SISQKT L
Sbjct: 308  EKLILSKVPDYDHYIAKSFQLIDANGQTVNYEQFLNQEIY-YPSNFNHFQIESISQKTML   366

Query: 367  VSYELEGKRHTSIWRRNEKWFLIYHQIT--AKSSPYKTRRYQITSL                410
            V+Y+L G + TSIWRR+E W L++HQIT   AK    T  Y+I +
Sbjct: 367  VTYQLNGNQRTSIWRRHESWSLLFHQITPIAKKQLHHT-HYRIVKM                411
```

INTEGRAL   Likelihood = −3.24   Transmembrane 86-102 (84-103)
INTEGRAL   Likelihood = −0.32   Transmembrane 31-47 (31-47)
----- Final Results -----
    bacterial membrane --- Certainty = 0.4248 (Affirmative) <succ>
    bacterial outside --- Certainty = 0.0000 (Not Clear) <succ>
    bacterial cytoplasm --- Certainty = 0.0000 (Not Clear) <succ>

A related GBS nucleic acid sequence <SEQ ID 9869> which encodes amino acid sequence <SEQ ID 9870> was also identified.

The protein has homology with the following sequences in the GENPEPT database.

```
>GP:CAB14850 GB:Z99118 similar to hypothetical proteins [Bacillus subtilis]
Identities = 80/226 (35%), Positives = 136/226 (59%), Gaps = 1/226 (0%)
Query:  27   TNNPIFGIMLTVWAYYIGIRIFRKYPSPAT-TPLLLATILLIAFLKLTHISYKDYYNGGS   85
             T +P FGI++++ A+ IG  +F+K      TPL +A +L IAFLK+   SY DY NGG
Sbjct:   4   TMSPYFGIVVSLAAFGIGTFLFKKTKGFFLFTPLFVAMVLGIAFLKIGGFSYADYNNGGE  63

Query:  86   FLTMLITPSTVVLAIPLYRTFHLMKHHIKSISISIILASVINTVFTAIVAKFFGMKYFLA  145
             +   + P+T+  AIPLY+   +K +   I  SII  S+ +     ++AK   +
Sbjct:  64   IIKFFLEPATIAFAIPLYKQRDKLKKYWWQIMASIIAGSICSVTIVYLLAKGIHLDSAVM  123

Query: 146   ISLFPKSVTTAMAVGITSKAGGLATITLVVVVITGILTSVLGPIFLKLLRIEDPVAIGLA  205
             S+ P++ TTA+A+ ++    GG++ IT   V+   ++   LG +FLK+ ++++P++ GLA
Sbjct: 124   KSMLPQAATTAIALPLSKGIGGISDITAFAVIFNAVIVYALGALFLKVFKVKNPISKGLA  183

Query: 206   LGGTGHAIGTGQALKYGQVQGAMAGLAIGITGICYVIVSPLVAGLI                251
             LG +GHA+G    ++ G+V+ AMA +A+ + G+  V+V P+   LI
Sbjct: 184   LGTSGHALGVAVGIEMGEVEAAMASIAVVVVGVVTVLVIPVFVQLI               229
```

No corresponding DNA sequence was identified in *S. pyogenes*.

A related GBS gene <SEQ ID 8893> and protein <SEQ ID 8894> were also identified. Analysis of this protein sequence reveals the following:

Lipop: Possible site: −1 Crend: 0
SRCFLG: 0
McG: Length of UR: 22
Peak Value of UR: 2.57
Net Charge of CR: 0
McG: Discrim Score: 6.51
GvH: Signal Score (−7.5): −5.91

Possible site: 33
>>> Seems to have an uncleavable N-term signal seq
Amino Acid Composition: calculated from 1
ALOM program   count: 6 value: −8.12 threshold: 0.0
INTEGRAL   Likelihood = −8.12   Transmembrane 149-165 (139-172)
INTEGRAL   Likelihood = −6.32   Transmembrane 96-112 (91-116)
INTEGRAL   Likelihood = −5.89   Transmembrane 37-53 (31-55)
INTEGRAL   Likelihood = −5.52   Transmembrane 209-225 (204-230)
INTEGRAL   Likelihood = −3.24   Transmembrane 64-80 (62-81)
INTEGRAL   Likelihood = −0.32   Transmembrane 9-25 (9-25)
PERIPHERAL Likelihood = 1.06    121
modified ALOM score: 2.12 icml HYPID: 7 CFP: 0.425
*** Reasoning Step: 3
----- Final Results -----
    bacterial membrane --- Certainty = 0.4248 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
ORF01066(325-999 of 1305)
EGAD|107753|BS2884(4-229 of 231) hypothetical protein {Bacillus subtilis} OMNI|NT01BS3363
LrgB GP|1770004|emb|CAA99613.1||Z75208 hypothetical protein {Bacillus subtilis}
GP|2635355|emb|CAB14850.1||Z99118 similar to hypothetical proteins {Bacillus subtilis}
PIR|D69983|D69983 conserved hypothetical protein ysbB - Bacillus subtilis
% Match = 17.2
% Identity = 35.4 % Similarity = 62.4
Matches = 80 Mismatches = 84 Conservative Sub.s = 61

192       222       252       282       312       342       372       402
       WSTFKT*SPIFLG*LSLS*ERYFSIF*LLDWYPNGSKRDMKEIIQKLEVKMATLTNNPIFGIMLTVWAYYIGIRIFRKYP
                                                              | :| |||::::  |: ||   :|:|
                                                              MESTMSPYFGIVVSLAAFGIGTFLFKKTK
                                                                       10        20

429       459       489       519       549       579       609       639
       SPAT-TPLLLATILLIAFLKLTHISYKDYYNGGSFLTMLITPSTVVLAIPLYRTFHLMKHHIKSISISIILASVINTVFT
       |||::|  :|  ||||||  ||  || |||   :   :: |:|: :||||:       :|  :   |||  |:  :
       GFFLFTPLFVAMVLGIAFLKIGGFSYADYNNGGEIIKFFLEPATIAFAIPLYKQRDKLKKYWWQIMASIIAGSICSVTIV
           40        50        60        70        80        90       100
```

```
                669       699       729       759       789       819       849       879
              AIVAKFFGMKYFLAISLFPKSVTTAMAVGITSKAGGLATITLVVVVITGILTSVLGPIFLKLLRIEDPVAIGLALGGTGH
                ::||     :    :   |::|::  |||:|: :: :     ||:: ||     |:   ::   ||  :|||::::::|::  |||||  :||
              YLLAKGIHLDSAVMKSMLPQAATTAIALPLSKGIGGISDITAFAVIFNAVIVYALGALFLKVFKVKNPISKGLALGTSGH
                         120       130       140       150       160       170       180

909       939       969       999       1029      1059      1089      1119
              AIGTGQALKYGQVQGAMAGLAIGITGICYVIVSPLVAGLILK*G*GK*TQNNYVIIFKNRI*DK*L*YR*KK*LLERLSV
              |:|       ::  |:|:  |||   :|:   :    |:|   |:         ||
              ALGVAVGIEMGEVEAAMASIAVVVVGVVTVLVIPVFVQLIGG
                         200       210       220       230
```

Based on this analysis, it was predicted that these proteins and their epitopes could be useful antigens for vaccines or diagnostics.

Example 1753

A DNA sequence (GBSx1860) was identified in *S. agalactiae* <SEQ ID 5445> which encodes the amino acid sequence <SEQ ID 5446>. Analysis of this protein sequence reveals the following:

Possible site: 28
>>> May be a lipoprotein
----- Final Results -----
   bacterial membrane --- Certainty = 0.0000 (Not Clear) <succ>
    bacterial outside --- Certainty = 0.0000 (Not Clear) <succ>
     bacterial cytoplasm --- Certainty = 0.0000 (Not Clear) <succ>

The protein has homology with the following sequences in the GENPEPT database.

```
>GP:CAA76857 GB:Y17797 hypothetical protein [Enterococcus faecalis]
Identities = 44/194 (22%), Positives = 90/194 (45%), Gaps = 13/194 (6%)
Query:  21   TACSSSNTQQTSTSKSNVSQHKNIKADHEELRLKFNKVKLGVKANNFKGGTSLAELKQLF    80
             T   S ++T++ S+ K +    + K     D+ +L+  ++K+ +G     N+ +GG++   E+K +
Sbjct:  60   TNSSKNDTKKESSEKKSEDKSK----DNSDLKATYDKINVGDIMNSSEGGSTEDEVKAIL   115

Query:  81   GGEPNEKFDTPAGNVTLKGYRW-NVDD----ISITIQLLNDSSIVRSISNFKFIRDANIT   135
              GEP      T    ++    W NV        SIT+  +  +  +S+S  K  +   +T
Sbjct: 116   -GEPASSSTTDIQGISTTTLSWTNVKGGDLLASITVSFSDGKAASKSVSGLKVAKHDKVT   174

Query: 136   TKDYNSLKNGMSYN--KVKELLGEPDDISQAVSSDKEELQAAWISGIQSSDSDPGINLTF   193
                   N++      SY+  + ++ LG+P   I+     + ++     W+  +    D    + ++F
Sbjct: 175   ADQVNNIATDGSYSEEQARKDLGDPTGITSTNINGEKNDTLIWMKNL-DGDLGATVTVSF   233

Query: 194   ENDKLTNKQQHGLK                                                207
              N   +K  GLK
Sbjct: 234   SNGNAISKSSSGLK                                                247
```

A related DNA sequence was identified in *S. pyogenes* <SEQ ID 5447> which encodes the amino acid sequence <SEQ ID 5448>. Analysis of this protein sequence reveals the following:

Possible site: 21
>>> May be a lipoprotein
----- Final Results -----
   bacterial membrane --- Certainty = 0.0000 (Not Clear) <succ>
    bacterial outside --- Certainty = 0.0000 (Not Clear) <succ>
     bacterial cytoplasm --- Certainty = 0.0000 (Not Clear) <succ>

The protein has homology with the following sequences in the databases:

```
>GP:CAA76857 GB:Y17797 hypothetical protein [Enterococcus faecalis]
Identities = 34/166 (20%), Positives = 74/166 (44%), Gaps = 8/166 (4%)
Query:  47   HQDKRANFEKIKLATVDSSFTGGTSLEELISLFGEPSQHDPKTAGEVTIDAYTWQFDQ--   104
             + D +A ++KI +   + +S  GG++  +E+ ++ GEP+           ++     +W       +
Sbjct:  83   NSDLKATYDKINVGDIMNSSEGGSTEDEVKAILGEPASSSTTDIQGISTTTLSWTNVKGG   142

Query: 105   ---VTLTVNLYQNSSIVKTISNFTFARELGLSQKEYQQLQKGMSY--EDVKKILTEPDNY   159
                ++TV+     + K++S  A+   ++   +         SY  E  +K L +P
Sbjct: 143   DLLASITVSFSDGKAASKSVSGLKVAKHDKVTADQVNNIATDGSYSEEQARKDLGDPTGI   202

Query: 160   SQASSSDHQTLQAIWVSGLKTDTSGANISLVFENNQLTEMSQVGLE                205
             +  +++  +      IW+  L  D   GA +++  F N         S    GL+
Sbjct: 203   TSTNINGEKNDTLIWMKNLDGDL-GATVTVSFSNGNAISKSSSGLK                247
```

An alignment of the GAS and GBS proteins is shown below.

```
Identities = 84/199 (42%), Positives = 126/199 (63%), Gaps = 3/199 (1%)
Query: 11    TIVCLSFLG--LTACSSSNTQQTSTSKSNVSQHKNIKADHEELRLKFNKVKLGVKANNFK   68
             T++ +SF     L ACS++  ++    S S +    +  +A H++ R   F  K+KL       ++F
Sbjct: 8     TLLLISFFTSFLVACSTTKDKEPQPSDSEIITPRLHQAAHQDKRANFEKIKLATVDSSFT   67

Query: 69    GGTSLAELKQLFGGEPNEKFDTPAGNVTLKGYRWNVDDISITIQLLNDSSIVRSISNFKF   128
             GGTSL  EL  LFG EP++         AG VT+   Y W   D +++T+ L   +SSIV++ISNF F
Sbjct: 68    GGTSLEELISLFG-EPSQHDPKTAGEVTIDAYTWQFDQVTLTVNLYQNSSIVKTISNFTF   126

Query: 129   IRDANITTKDYNSLKNGMSYNKVKELLGEPDDISQAVSSDKEELQAAWISGIQSSDSDPG   188
              R+   ++ K+Y L+ GMSY  VK++L EPD+ SQA SSD + LQA W+SG+++   S
Sbjct: 127   ARELGLSQKEYQQLQKGMSYEDVKKILTEPDNYSQASSSDHQTLQAIWVSGLKTDTSGAN   186

Query: 189   INLTFENDKLTNKQQHGLK                                          207
             I+L FEN++LT    Q GL+
Sbjct: 187   ISLVFENNQLTEMSQVGLE                                          205
```

Figure 178:
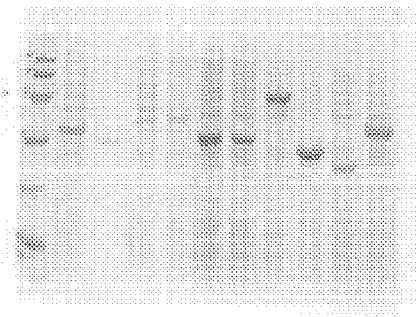

SEQ ID 5446 (GBS650) was expressed in *E. coli* as a His-fusion product. SDS-PAGE analysis of total cell extract is shown in FIG. 178 (lane 9; MW 28 kDa).

Based on this analysis, it was predicted that these proteins and their epitopes could be useful antigens for vaccines or diagnostics.

Possible site: 46
>>> Seems to have no N-terminal signal sequence
----- Final Results -----
    bacterial cytoplasm --- Certainty = 0.2950 (Affirmative) <succ>
    bacterial membrane --- Certainty = 0.0000 (Not Clear) <succ>
    bacterial outside --- Certainty = 0.0000 (Not Clear) <succ>

Example 1754

A DNA sequence (GBSx1861) was identified in *S. agalactiae* <SEQ ID 5449> which encodes the amino acid sequence <SEQ ID 5450>. This protein is predicted to be ribosomal protein S1 homolog; Sequence specific DNA-binding protein (r. Analysis of this protein sequence reveals the following:

A related GBS nucleic acid sequence <SEQ ID 9363> which encodes amino acid sequence <SEQ ID 9364> was also identified.

The protein has homology with the following sequences in the GENPEPT database.

```
>GP:AAA97575 GB:U27517 ribosomal S1 protein [Homo sapiens]

Identities = 156/305 (51%), Positives = 214/305 (70%), Gaps = 7/305 (2%)

Query: 1     MEARKAWDKLVGREGEVVTVKGTRAVKGGLSVEFEGLRGFIPASMIDTRFVRNTEKFVGQ   60
             ++ARKAW+ L     EG+ V  K      AV+GGL V+   G+RGF+PASM+   RFV +   +F  +
Sbjct: 53    LDARKAWENLSFAEGDTVDAKVINAVRGGLIVDVNGVRGFVPASMVAERFVSDLNQFKNK   112

Query: 61    EFDAKIKEVDAAENRFILSRREVVEESAAAARKEVFSNIEVGSVVTGKVARLTSFGAFID   120
             +   A++  E+D A   R ILSR+ V   +  AA    EVFS + VG VV G VARLT  FGAF+D
Sbjct: 113   DIKAQVIEIDPANARLILSRKAVAAQERAAQLAEVFSKLSVGEVVEGTVARLTDFGAFVD   172

Query: 121   LGGVDGLVHVTELSHERNVSPKSVVTVGEEVEVKVLSIDEEAGRVSLSLKATTPGPWDGV   180
             LGGVDGLVHV+E+SH+R   +P   V+T G++V+VK+L++D E  GR+SLS+KAT  GPWD
Sbjct: 173   LGGVDGLVHVSEISHDRVKNPADVLTKGDKVDVKILALDTEKGRISLSIKATQRGPWDEA   232

Query: 181   EQKLAAGDVIEGKVKRLTDFGAFVEVLPGIDGLVHISQISHKRVENPKDVLSAGQEVTVK   240
             +     ++AAG V+EG VKR+  DFGAFVE+LPGI +GLVH SQIS +KR+ENP +VL +G +V VK
Sbjct: 233   ADQIAAGSVLEGTVKRVKDFGAFVEILPGIEGLVHVSQISNKRIENPSEVLKSGDKVQVK   292

Query: 241   VLEVNSDAERVSLSMKALEERPAQAEGEKEEKRQSRPRRPRRQEKRDYELPETQTGFSMA   300
             VL++          ER+SLSMKALEE+P         + E R+         R +     Y+ +   + ++
Sbjct: 293   VLDIKPAEERISLSMKALEEKP------EREDRRGNDGSASRADIAAYK-QQDDSAATLG   345

Query: 301   DLFGD                                                         305
             D+FGD
Sbjct: 346   DIFGD                                                         350
```

A related DNA sequence was identified in *S. pyogenes* <SEQ ID 5451> which encodes the amino acid sequence <SEQ ID 5452>. Analysis of this protein sequence reveals the following:

```
Possible site: 26
>>> Seems to have no N-terminal signal sequence
----- Final Results -----
   bacterial cytoplasm --- Certainty = 0.3312 (Affirmative) <succ>
   bacterial membrane --- Certainty = 0.0000 (Not Clear) <succ>
     bacterial outside --- Certainty = 0.0000 (Not Clear) <succ>
```

An alignment of the GAS and GBS proteins is shown below.

```
Identities = 284/309 (91%), Positives = 296/309 (94%), Gaps = 1/309 (0%)
Query:   1   MEARKAWDKLVGREGEVVTVKGTRAVKGGLSVEFEGLRGFIPASMIDTRFVRNTEKFVGQ    60
             +EARKAWDKLVGREGEVVTVKGTRAVKGGLSVEFEGLRGFIPASMIDTRFVRNTEKFVGQ
Sbjct:  93   LEARKAWDKLVGREGEVVTVKGTRAVKGGLSVEFEGLRGFIPASMIDTRFVRNTEKFVGQ   152

Query:  61   EFDAKIKEVDAAENRFILSRREVVEESAAAARKEVFSNIEVGSVVTGKVARLTSFGAFID   120
             EFDAKIKEVDAAENRFILSRREV+EE+A  AR EVFS I  G+VVTG VARLTSFGAFID
Sbjct: 153   EFDAKIKEVDAAENRFILSRREVIEEAAKEARAEVFSKISEGAVVTGTVARLTSFGAFID   212

Query: 121   LGGVDGLVHVTELSHERNVSPKSVVTVGEEVEVKVLSIDEEAGRVSLSLKATTPGPWDGV   180
             LGGVDGLVHVTELSHERNVSPKSVV+VGEEVEVKVLSIDEEAGRVSLSLKATTPGPWDGV
Sbjct: 213   LGGVDGLVHVTELSHERNVSPKSVVSVGEEVEVKVLSIDEEAGRVSLSLKATTPGPWDGV   272

Query: 181   EQKLAAGDVIEGKVKRLTDFGAFVEVLPGIDGLVHISQISHKRVENPKDVLSAGQEVTVK   240
             EQKLA GDV+EGKVKRLTDFGAFVEVLPGIDGLVHISQISHKRVENPKDVLS GQEVTVK
Sbjct: 273   EQKLAQGDVVEGKVKRLTDFGAFVEVLPGIDGLVHISQISHKRVENPKDVLSVGQEVTVK   332

Query: 241   VLEVNSDAERVSLSMKALEERPAQAEGE-KEEKRQSRPRRPRRQEKRDYELPETQTGFSM   299
             VLEVN+   ERVSLS+KALEERPAQAEG+ KEEKRQSRPRRP+R+ +RDYELPETQTGFSM
Sbjct: 333   VLEVNAADERVSLSIKALEERPAQAEGDNKEEKRQSRPRRPKRESRRDYELPETQTGFSM   392

Query: 300   ADLFGDIEL                                                    308
             ADLFGDIEL
Sbjct: 393   ADLFGDIEL                                                    401
```

Possible site: 33
>>> Seems to have no N-terminal signal sequence
----- Final Results -----
   bacterial cytoplasm --- Certainty = 0.1708 (Affirmative) <succ>
   bacterial membrane --- Certainty = 0.0000 (Not Clear) <succ>
     bacterial outside --- Certainty = 0.0000 (Not Clear) <succ>

The protein has homology with the following sequences in the GENPEPT database.

Based on this analysis, it was predicted that these proteins and their epitopes could be useful antigens for vaccines or diagnostics.

Example 1755

A DNA sequence (GBSx1862) was identified in *S. agalactiae* <SEQ ID 5453> which encodes the amino acid sequence <SEQ ID 5454>. This protein is predicted to be dihydroorotate dehydrogenase a (pyrD). Analysis of this protein sequence reveals the following:

```
>GP:CAB51330 GB:AJ7131985 dihydroorotate dehydrogenase [Streptococcus
pneumoniae] Identities = 227/310 (73%), Positives = 268/310 (86%)
Query:   1   MVSLKTEIAGFSFDNCLMNAAGIYCMTKEELLAIENSEAGSFVTKTGTLEAREGNPQPRY    60
             MVS KT+IAGF FDNCLMNAAG+ CMT EEL  ++NS AG+FVTKT TL+ R+GNP+PRY
Sbjct:   1   MVSTKTQIAGFEFDNCLMNAAGVACMTIEELEEVKNSAAGTFVTKTATLDFRQGNPEPRY    60

Query:  61   ADTDWGSINSMGLPNKGIDYYLDFVTELQDQDNSKNHVLSLVGLSPEETHIILKKVENSS   120
               D   GSINSMGLPN G+DYYLD++ +LQ++++++    LSLVG+SPEETH ILKKV+ S
Sbjct:  61   QDVPLGSINSMGLPNNGLDYYLDYLLDLQEKESNRTFFLSLVGMSPEETHTILKKVQESD   120

Query: 121   YNGLIELNLSCPNVPGKPQIAYDFEMTDLILSEIFSYYQKPLGIKLPPYFDIVHFDQAAT   180
             + GL ELNLSCPNVPGKPQIAYDFE TD IL+E+F+Y+ KPLGIKLPPYFDIV+FDQAA
Sbjct: 121   FRGLTELNLSCPNVPGKPQIAYDFETTDRILAEVFAYFTKPLGIKLPPYFDIVYFDQAAA   180

Query: 181   IFNKYPLAFINCVNSIGNGLVIDDETVVIKPKNGFGGIGGDFIKPTALANVHAFYKRLNP   240
             IFNKYPL F+NCVNSIGNGL I+DE+VVI+PKNGFGGIGG++IKPTALANVHAFY+RLNP
Sbjct: 181   IFNKYPLKFVNCVNSIGNGLYIEDESVVIRPKNGFGGIGGEYIKPTALANVHAFYQRLNP   240

Query: 241   SIKIIGTGGVKNGRDAFEHILCGASMVQIGTALQKEGPEIFQRVSRELKEIMADKGYQSL   300
             +I+IIGTGGV  GRDAFEHILCGASMVQ+GT L KEG   F R++ ELK IM +KGY+SL
```

```
                            -continued
Sbjct:  241  QIQIIGTGGVLTGRDAFEHILCGASMVQVGTTLHKEGVSAFDRITNELKAIMVEKGYESL  300

Query:  301  EDFRGQLNYL                                                    310
             EDFRG+L Y+
Sbjct:  301  EDFRGKLRYI                                                    310
```

A related DNA sequence was identified in *S. pyogenes* <SEQ ID 5455> which encodes the amino acid sequence <SEQ ID 5456>. Analysis of this protein sequence reveals the following:

---

Possible site: 33
>>> Seems to have no N-terminal signal sequence
----- Final Results -----
   bacterial cytoplasm --- Certainty = 0.2689 (Affirmative) <succ>
    bacterial membrane --- Certainty = 0.0000 (Not Clear) <succ>
     bacterial outside --- Certainty = 0.0000 (Not Clear) <succ>

---

An alignment of the GAS and GBS proteins is shown below.

```
Identities = 239/309 (77%), Positives = 262/309 (84%)
Query:    1  MVSLKTEIAGFSFDNCLMNAAGIYCMTKEELLAIENSEAGSFVTKTGTLEAREGNPQPRY   60
             MVS  T+I  FSFDNCLMNAAG+YCMTKEEL+ +E S+A SFVTKTGTLE R GNP+PRY
Sbjct:    5  MVSTATQIGHFSFDNCLMNAAGVYCMTKEELMEVEKSQAASFVTKTGTLEVRPGNPEPRY   64

Query:   61  ADTDWGSINSMGLPNKGIDYYLDFVTELQDQDNSKNHVLSLVGLSPEETHIILKKVENSS  120
             ADT  GSINSMGLPN G   YYLDFV++L      K H LS+VGLSP ET   ILK + S
Sbjct:   65  ADTRLGSINSMGLPNNGFRYYLDFVSDLAKTGQHKPHFLSVVGLSPTETETILKAIMASD  124

Query:  121  YNGLIELNLSCPNVPGKPQIAYDFEMTDLILSEIFSYYQKPLGIKLPPYFDIVHFDQAAT  180
             Y GL+ELNLSCPNVPGKPQIAYDFE TD +L  IF+YY KPLGIKLPPYFDIVHFDQAA
Sbjct:  125  YEGLVELNLSCPNVPGKPQIAYDFETTDQLLENIFTYYTKPLGIKLPPYFDIVHFDQAAA  184

Query:  181  IFNKYPLAFINCVNSIGNGLVIDDETVVIKPKNGFGGIGGDFIKPTALANVHAFYKRLNP  240
             IFNKYPL+F+NCVNSIGNGLVI DE V+IKPKNGFGGIGGD+IKPTALANVHAFYKRL P
Sbjct:  185  IFNKYPLSFVNCVNSIGNGLVIKDEQVLIKPKNGFGGIGGDYIKPTALANVHAFYKRLKP  244

Query:  241  SIKIIGTGGVKNGRDAFEHILCGASMVQIGTALQKEGPEIFQRVSRELKEIMADKGYQSL  300
             SI  IIGTGGVK GRDAFEHILCGASMVQIGTAL +EGP IF+RV++ELK IM +KGYQSL
Sbjct:  245  SIHIIGTGGVKTGRDAFEHILCGASMVQIGTALHQEGPAIFERVTKELKTIMVEKGYQSL  304

Query:  301  EDFRGQLNY                                                    309
             +DFRG L Y
Sbjct:  305  DDFRGNLRY                                                    313
```

Based on this analysis, it was predicted that these proteins and their epitopes could be useful antigens for vaccines or diagnostics.

Example 1756

A DNA sequence (GBSx1863) was identified in *S. agalactiae* <SEQ ID 5457> which encodes the amino acid sequence <SEQ ID 5458>. This protein is predicted to be beta-lactam resistance factor. Analysis of this protein sequence reveals the following:

---

Possible site: 30
>>> Seems to have no N-terminal signal sequence
----- Final Results -----
   bacterial cytoplasm --- Certainty = 0.4437 (Affirmative) <succ>
    bacterial membrane --- Certainty = 0.0000 (Not Clear) <succ>
     bacterial outside --- Certainty = 0.0000 (Not Clear) <succ>

---

The protein has homology with the following sequences in the GENPEPT database.

```
>GP:CAB89121 GB:AJ277485 beta-lactam resistance factor
[Streptococcus pneumoniae]
Identities = 238/410 (58%), Positives = 304/410 (74%)
Query:    1  MALKELTAKEFESYSGNYDLQSFMQTPEMAELLKKRGYDITYMGYQIDGKMEIISIVYTI   60
             MAL  LT +EF++YS     +SFMQ+ +M  LL+KRG  I Y+  + +G++++  ++VY++
Sbjct:    1  MALTTLTKEEFQTYSDQVSSRSFMQSVQMGDLLEKRGARIVYLALKQEGEIQVAALVYSL   60

Query:   61  PMTGGLHMEVNSGPAHSNSKYLKHFYKELQNYAKSQGALELLIKPYDTYQEFTGEGKPKG  120
             PM GGLHME+NSGP ++     L FY EL+ YAK G LELL+KPY+TYQ F  +G P
Sbjct:   61  PMLGGLHMELNSGPIYTQQDALPVFYAELKEYAKQNGVLELLVKPYETYQTFDSQGNPID  120

Query:  121  APNTYLIDDLTSIGYHHDGLHIGYPGGEPDWHYVKNLEGITPQNLLKSFSKKGRPLVKKA  180
             A    +I DLT +GY  DGL  GYPGGEPDW Y K+L  +T ++LLKSFSKKG+PLVKKA
Sbjct:  121  AEKKSIIQDLTDLGYQFDGLTTGYPGGEPDWLYYKDLTELTEKSLLKSFSKKGKPLVKKA  180
```

-continued
```
Query: 181 MSFGIKIRVLKREELHIFKDITSSTSDRRDYMDKSLDYYQDFYDSFGDKAEFVIATLNFR 240
            +FGI+++ LKREEL IFK+IT  TS+RR+Y DKSL+YY+ FYD+FG++AEF+IA+LNF
Sbjct: 181 ETFGIRLKKLKREELSIFKNITKETSERREYSDKSLEYYEHFYDTFGEQAEFLIASLNFS 240

Query: 241 EYDHNLQLNAKKLEEQITVLDNRHQNNTDSAKYHRQTELVNQLASLDKRRKEVEPFIQK  300
            +Y   LQ   KLEE + L     N  S K   Q  E  +Q  + + R+ E    I+K
Sbjct: 241 DYMSKLQGEQSKLEENLDKLRLDLSKNPHSEKKQNQLREYSSQFETFEVRKAEARDLIEK 300

Query: 301 FGNQDVVLAGSLFIYSPKETVYLFSGSYTEFNKFYAPAVLQEYVMQEALKRQSTFYNFLG 360
            +G +D+VLAGSLF+Y P+ET YLFSGSYTEFNKFYAPA+LQ+YVM E++KR     YNFLG
Sbjct: 301 YGEEDIVLAGSLFVYMPQETTYLFSGSYTEFNKFYAPALLQKYVMLESIKRGIPKYNFLG 360

Query: 361 IQGNFDGSDGVLRFKQNFNGYIVRKMGTFRYYPNPLKYKSIQLLKKILRR          410
            IQG FDGSDGVLRFKQNFNGYIVRK GTFRY+P+PLKYK+IQLLKKI+ R
Sbjct: 361 IQGIFDGSDGVLRFKQNFRGYIVRKAGTFRYHPSPLKYKAIQLLKKIVGR          410
```

A related DNA sequence was identified in *S. pyogenes* <SEQ ID 5459> which encodes the amino acid sequence <SEQ ID 5460>. Analysis of this protein sequence reveals the following:

---

Possible site: 34
>>> Seems to have no N-terminal signal sequence
----- Final Results -----
    bacterial cytoplasm --- Certainty = 0.2652 (Affirmative) <succ>
    bacterial membrane --- Certainty = 0.0000 (Not Clear) <succ>
    bacterial outside --- Certainty = 0.0000 (Not Clear) <succ>

---

An alignment of the GAS and GBS proteins is shown below.

```
Identities = 216/410 (52%), Positives = 291/410 (70%)
Query:   1 MALKELTAKEFESYSGNYDLQSFMQTPEMAKLLKKRGYDITYMGYQIDGKMEIISIVYTI  60
           MAL E++ ++F+ Y +    SF+QT EMA L+ KRG   ++G + DG++++ ++V++
Sbjct:   1 MALIEISQEQFDHYCHSLVHHSFIQTSEMASLMAKRGAKPQFLGLEKDGELKVAAMVFSQ  60

Query:  61 PMTGGLHMEVNSGPAHSNSKYLKHFYKELQNYAKSQGALELLIKPYDTYQEFTGEGKPKG 120
            + GG  ME+N+GP ++   L+HFY +L++YAK   +EL++KPYD YQ F  +G P
Sbjct:  61 KVAGGWRMELNAGPNTNHPEELEHFYTQLKDYAKQKDVIELILKPYDNYQSFDTDGIPIS 120

Query: 121 APNTYLIDDLTSIGYHHDGLHIGYPGGEPDWHYVKNLEGITPQNLLKSFSKKGRPLVKKA 180
             PNT LI  LT++GY HDGL  GYP GEP WHYVK LEGI   L +SFSKKG+ L+KKA
Sbjct: 121 RPNTDLISLLTALGYKHDGLKTGYPEGEPVWHYVKKLEGIDSSRLTRSFSKKGKALIKKA 180

Query: 181 MSFGIKIRVLKREELHIFKDITSSTSDRRDYMDKSLDYYQDFYDSFGDKAEFVIATLNFR 240
            +FGIK+R LKR+ELH FK+IT +TSDRRDY+DKSL YYQDFYDSFGD EF++ATLNF
Sbjct: 181 NTFGIKLRQLKRDELHHFKEITEATSDRRDYLDKSLSYYQDFYDSFGDSCEFMVATLNFE 240

Query: 241 EYDHNLQLNAKKLEEQITVLDNRHQNNTDSAKYHRQTELVNQLASLDKRRKEVEPFIQK  300
            +Y +NL+      +L  I   +     N  S K      +EL +Q  +  R  E   F+++
Sbjct: 241 DYLNNLKQRQLQLATSINKVKGDLGKNPHSEKKQNRLKELSSQFETFQVRISEALHFLEE 300

Query: 301 FGNQDVVLAGSLFIYSPKETVYLFSGSYTEFNKFYAPAVLQEYVMQEALKRQSTFYNFLG 360
            +G +DV LAGSLFIY+ +E VYLFSGSY +FNKFY+PA+LQE+ M +A+ +     YNFLG
Sbjct: 301 YGTKDVFLAGSLFIYTEQEAVYLFSGSYPKFNKFYSPALLQEHAMLKAIHKGIKQYNFLG 360

Query: 361 IQGNFDGSDGVLRFKQNFNGYIVRKMGTFRYYPNPLKYKSIQLLKKILRR          410
            I G FDGSDGVLRFKQNFNG+I++K GTFR YP P+KY  I+L KK+L R
Sbjct: 361 ITGKFDGSDGVLRFKQNFNGFILQKPGTFRCYPFPIKYHFIRLAKKLLNR          410
```

A related GBS gene <SEQ ID 8895> and protein <SEQ ID 8896> were also identified. Analysis of this protein sequence reveals the following:

Homology to resistance proteins

The protein has homology with the following sequences in the databases:

---

57.4/74.9% over 409aa
*Streptococcus pneumoniae*
GP|7649683| beta-lactam resistance factor Insert characterized
ORF01118(301-1530 of 1833)
GP|7649683|emb|CAB89121.1||AJ277485(1-410 of 410) beta-lactam resistance factor
{*Streptococcus pneumoniae*}

-continued

```
% Match = 39.0
% Identity = 57.3 % Similarity = 74.9
% Matches = 235 Mismatches = 103 Conservative Sub.s = 72

240       270       300       330       360       390       420       450
IPVNRLLYKASNYVYALRKKRNS*LGKDTFMALKELTAKEFESYSGNYDLQSFMQTPEMAKLLKKRGYDITYMGYQIDGK
                       |||   ||  :||::||    :||||: :|   ||:|||   ||  :   :  :|:
                       MALTTLTKEEFQTYSDQVSSRSFMQSVQMGDLLEKRGARIVYLALKQEGE
                             10        20        30        40        50

480       510       540       570       600       630       660       690
MEIISIVYTIPMTGGLHMEVNSGPAHSNSKYLKHFYKELQNYAKSQGALELLIKPYDTYQEFTGEGKPKGAPNTYLIDDL
:::  ::||::||  |||||:|||| :::       |    ||  ||:  |||||:|||   :|  |    :   :|  ||
IQVAALVYSLPMLGGLHMELNSGPIYTQQDALPVFYAELKEYAKQNGVLELLVKPYETYQTFDSQGNPIDAEKKSIIQDL
    60        70        80        90       100       110       120       130

720       750       780       810       840       870       900       930
TSIGYHHDGLHIGYPGGEPDWHYVKNLEGITPQNLLKSFSKKGRPLVKKAMSFGIKIRVLKREELHIFKDITSSTSDRRD
| :||: |||   ||||||||||  | |:|   :| ::|||||||||:|||||| :|||::: |||||| |||:||   ||:||:
TDLGYQFDGLTTGYPGGEPDWLYYKDLTELTEKSLLKSFSKKGKPLVKKAETFGIRLKKLKREELSIFKNITKETSERRE
   140       150       160       170       180       190       200       210

960       990      1020      1050      1080      1110      1140      1170
YMDKSLDYYQDFYDSFGDKAEFVIATLNFREYDHNLQLNAKKLEEQITVLDNRHQNNTDSAKYHRQRTELVNQLASLDKR
| |||:||: |||:||::|||:||:|||  :|    ||    ||||  :   |     |  |  | :|: ::: |
YSDKSLEYYEHFYDTFGEQAEFLIASLNFSDYMSKLQGEQSKLEENLDKLRLDLSKNPHSEKKQNQLREYSSQFETFEVR
   220       230       240       250       260       270       280       290

1200      1230      1260      1290      1320      1350      1380      1410
RKEVEPFIQKFGNQDVVLAGSLFIYSPKETVYLFSGSYTEFNKFYAPAVLQEYVMQEALKRQSTFYXFLGIQGNFDGS G
:   |   :|:|| :|:||||||||:|  |:||  |||||||||||||||||::||||: ::||    ||||||  ||||:|
KAEARDLIEKYGEEDIVLAGSLFVYMPQETTYLFSGSYTEFNKFYAPALLQKYVMLESIKRGIPKYNFLGIQGIFDGSDG
   300       310       320       330       340       350       360       370

1440      1470      1500      1530      1560      1590      1620      1650
VLXFKQNFNGYIVRKMGTFRYYPNPLKYKSIQLLKKILRRT*KISLHKLIFYAL*KASFISLLLLFIQTIMFVI*RNFIT
|| ||||||||||||| |||||::|:||||||:||||||||:  |
VLRFKQNFNGYIVRKAGTFRYHPSPLKYKAIQLLKKIVGR
   380       390       400       410
```

SEQ ID 8896 (GBS198) was expressed in *E. coli* as a His-fusion product. SDS-PAGE analysis of total cell extract is shown in FIG. 26 (lane 6; MW 48.8 kDa). It was also expressed in *E. coli* as a GST-fusion product. SDS-PAGE analysis of total cell extract is shown in FIG. 85 (lane 6; MW 73.8 kDa).

GBS198-GST was purified as shown in FIG. 223, lane 4.

Based on this analysis, it was predicted that these proteins and their epitopes could be useful antigens for vaccines or diagnostics.

Example 1757

A DNA sequence (GBSx1864) was identified in *S. agalactiae* <SEQ ID 5461> which encodes the amino acid sequence <SEQ ID 5462>. This protein is predicted to be MurM protein. Analysis of this protein sequence reveals the following:

Possible site: 52
>>> Seems to have no N-terminal signal sequence
----- Final Results -----
bacterial cytoplasm --- Certainty = 0.4418 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:CAB89539 GB:AJ250767 MurM protein [Streptococcus pneumoniae]
Identities = 204/410 (49%), Positives = 286/410 (69%), Gaps = 17/410 (4%)
Query:   1 MYRE---ITAVEHDRFVSESNQTNLLQSSNWPKVKDNWGSQLLGFFDGETQIASASILIK   57
           MYR    I  +E+D+FV E   N+LQSS W KVK +W   +LG ++GE +A AS+LIK
Sbjct:   1 MYRYQIGIPTLEYDQFVKEHELANVLQSSAWEKVKSDWNHERLGVYEGENLLAVASVLIK   60

Query:  58 SLPLGFSMLYIPRGPIMDYSNLDIVTKVLKDLKAFGKKQRALFIKCDPLIYLK--MVNAK  115
           SLPLG+ M YIPRGPI+DY + +++  VL+ +K++ + +RA+F+  DP I L   +VN
Sbjct:  61 SLPLGYKMFYIPRGPILDYMDKELLKFVLQSIKSYARSKRAVFVTFDPSICLSQHLVN--  118

Query: 116 DFENSPDEKEGLIAIDHLQRAGADWTGRTTDLAHTIQPRFQANLYANQFGLDKMSKKTRQ  175
           ++  +  E L  ++ L + G  W+G+TT++   TIQPR QA  +Y   F  DK+SK TRQ
Sbjct: 119 --QDKREYPENLAIVEILGQLGVKWSGQTTEMDDTIQPRIQAKIYKENFEEDKLSKSTRQ  176

Query: 176 AIRTSKNKGVDIQFGSHELLEDFAELMKKTEDRKGINLRGIDYYQKLLDTYPNNSYITMA  235
           AIRT++NKG++IQ+G  ELL+ F+ELMKKTE RK  I+LR   YY+KLLD +  +SYIT+
```

```
                         -continued
Sbjct: 177  AIRTARNKGLEIQYGGLELLDSFSELMKKTEKRKEIHLRNEAYYRKLLDNFKEDSYITLT  236

Query: 236  SLDVAKRLEKIEKECQIAQSERIKS--LELNREKKVKQHQGTIDRLNKEIDFLKEAQKAY  293
            +LDV+KRL ++E+  Q+A+++ ++    E  R  KV+  +    +RL +EIDFL +
Sbjct: 237  NLDVSKRLRELEE--QLAKNKALEEAFTESTRTSKVEAQKKEKERLVEEIDFL-QGYMNM  293

Query: 294  DRDIIPLAATLTLEFGNTSENIYAGMDDYFKSYSAPIYTWFETAQRAFERGNIWQNMGGI  353
            ++  IPLAATL+LEFG TS N+YAGMDD FK Y+API TW+ETA+ AFERG +WQN+GG+
Sbjct: 294  EKSNIPLAATLSLEFGTTSVNLYAGMDDDFKRYNAPILTWYETARYAFERGMVWQNLGGV  353

Query: 354  ENDLSGGLYHFKSKFEPIIEEFIGEFNIPVN---RLLYKASNYVYALRKK           400
            EN L+GGLYHFK KF P IEE++GEF +P +    LL  A ++  LRKK
Sbjct: 354  ENSLNGGLYHFKEKFNPTIEEYLGEFTMPTHPLYPLLRLALDFRKTLRKK           403
```

A related DNA sequence was identified in *S. pyogenes* <SEQ ID 5463> which encodes the amino acid sequence <SEQ ID 5464>. Analysis of this protein sequence reveals the following:

---
Possible site: 60
>>> Seems to have no N-terminal signal sequence
----- Final Results -----
   bacterial cytoplasm --- Certainty = 0.2239 (Affirmative) <succ>
   bacterial membrane --- Certainty = 0.0000 (Not Clear) <succ>
      bacterial outside --- Certainty = 0.0000 (Not Clear) <succ>
---

An alignment of the GAS and GBS proteins is shown below.

```
Identities = 203/399 (50%), Positives = 274/399 (67%), Gaps = 4/399 (1%)
Query:   5  ITAVEHDRFVSESNQTNLLQSSNWPKVKDNWGSQLLGFFDGETQIASASILIKSLPLGFS   64
            I+  EHD+FV    Q   LLQSS W KVKDNW  + +  F++   Q+A+A+ LI+ LPLGF+
Sbjct:  13  ISPEEHDQFVLAQPQAGLLQSSKWGKVKDNWKHERISFYENGVQVAAAACLIRKLPLGFT   72

Query:  65  MLYIPRGPIMDYSNLDIVTKVLKDLKAFGKKQRALFIKCDPLIYLKMVNAKDFENSPDEK  124
            M+YIPRGPIMDY+N +++   V+K LK FGK +RALFIK DP +K      + + S +
Sbjct:  73  MIYIPRGPIMDYANFELLDFVIKTLKTFGKSKRALFIKIDPSLVIKQT--LEGKESKEND  130

Query: 125  EGLIAIDHLQRAGADWTGRTTDLAHTIQPRFQANLYANQFGLDKMSKKTRQAIRTSKNKG  184
                L  I  L++ G +W+GRT +L   TIQPR QAN+YA  F  D  + KK  +Q+IRT+ NKG
Sbjct: 131  VTLSIIAFLKKLGVEWSGRTKELEDTIQPRIQANIYAKDFDFDSLPKKAKQSIRTATNKG  190

Query: 185  VDIQFGSHELLEDFAELMKKTEDRKGINLRGIDYYQKLLDTYPNNSYITMASLDVAKRLE  244
            V++  G  ELL+DF+  LMKKTE+RKGI LRG  YYQKLL   Y    SYITMASLD+ ++ +
Sbjct: 191  VNVTIGGSELLDDFSALMKKTENRKGIILRGKSYYQKLLGIYAGQSYITMASLDLPEQKK  250

Query: 245  KIEKECQIAQSERIKSLELNREKKVKQHQGTIDRLNKEIDFLKEAQKAYDRDIIPLAATL  304
            +  ++   A +E+  +   ++ KV ++Q TI RL K++  L E Q A +   IPLAATL
Sbjct: 251  LLIQQLDKALAEQARLTDKSKPSKVAENQKTIARLQKDLTILSE-QLATGQTRIPLAATL  309

Query: 305  TLEFGNTSENIYAGMDDYFKSYSAPIYTWFETAQRAFERGNIWQNMGGIENDLSGGLYHF  364
            TL +G TSEN+YAGMDD +++Y AP+ TW+ETA+ AF+RG  W N+GG+EN   GGLYHF
Sbjct: 310  TLIYGETSENLYAGMDDDYRNYQAPLLTWYETAKEAFKRGCRWHNLGGVENQQDGGLYHF  369

Query: 365  KSKFEPIIEEFIGEFNIPVNRLLYKASNYVYALRKKRNS                      403
            K++  P IEEF GEFNIPV  L+   +   Y LRKK  S
Sbjct: 370  KARLNPTIEEFAGEFNIPVG-LVSSLAILTYNLRKKLRS                      407
```

Based on this analysis, it was predicted that these proteins and their epitopes could be useful antigens for vaccines or diagnostics.

Example 1758

A DNA sequence (GBSx1865) was identified in *S. agalactiae* <SEQ ID 5465> which encodes the amino acid sequence <SEQ ID 5466>. Analysis of this protein sequence reveals the following:

---
Possible site: 28
>>> Seems to have no N-terminal signal sequence
----- Final Results -----
   bacterial cytoplasm --- Certainty = 0.2669 (Affirmative) <succ>
   bacterial membrane --- Certainty = 0.0000 (Not Clear) <succ>
      bacterial outside --- Certainty = 0.0000 (Not Clear) <succ>
---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1759

A DNA sequence (GBSx1866) was identified in *S. agalactiae* <SEQ ID 5467> which encodes the amino acid sequence <SEQ ID 5468>. This protein is predicted to be beta-lactam resistance factor. Analysis of this protein sequence reveals the following:

Possible site: 41
>>> Seems to have no N-terminal signal sequence
INTEGRAL    Likelihood = −2.07    Transmembrane 56-72 (55-74)
----- Final Results -----
    bacterial membrane --- Certainty = 0.1829 (Affirmative) <succ>
    bacterial outside --- Certainty = 0.0000 (Not Clear) <succ>
    bacterial cytoplasm --- Certainty = 0.0000 (Not Clear) <succ>

A related GBS nucleic acid sequence <SEQ ID 9625> which encodes amino acid sequence <SEQ ID 9626> was also identified.

The protein has homology with the following sequences in the GENPEPT database.

```
>GP:CAB89120 GB:AJ277484 beta-lactam resistance factor
[Streptococcus pneumoniae]
Identities = 166/410 (40%), Positives = 250/410 (60%), Gaps = 10/410 (2%)
Query:    6 MYHVTVGISEKEYDAFAIASSQTNLLHSSKWAQVKSNWQNERLGFYKDDQLVAVASILIK    65
            MY   +GI    EYD F      N+L SS W +VKSNWQ+E+ G Y++++L+A ASILI+
Sbjct:    1 MYRYQIGIPTLEYDQFVKEHELANVLQSSAWEEVKSNWQHEKFGVYREEKLLATASILIR    60

Query:   66 SLPLGFTMLYIPRGPIMDYSNKELVNFVLKTLKNFGRKKRAVFAKFDPALLLRQYHLKEE   125
            +LPLG+ M YIPRGPI+DY +KEL+NF ++++K++ R KRAVF  FDP++ L Q  + +E
Sbjct:   61 TLPLGYKMFYIPRGPILDYGDKELLNFAIQSIKSYARSKRAVFVTFDPSICLSQSLINQE   120

Query:  126 NVAEEIDESRQAIDNLKSAGAQWIGPTKAISETIQPRFQANIYTKANIEENFPKHTKRLI   185
                E   E+    ID+L+  G +W G T+ + +TIQPR QA IY +     E+   K TK+ I
Sbjct:  121 KT--EFPENLAIIDSLQQMGVRWSGKTEEMGDTIQPRIQAKIYKENFEEDKLSKSTKQAI   178

Query:  186 KDAKHRGVQIYRANIDDLPKFATVVALTENRKGVALRNENYFHQLMTIYGEDAYLYLAKV   245
            + A+++G++I    ++ L  F+ ++   TE RK + LRNE Y+ +L+ + + AY+ LA +
Sbjct:  179 RTARNKGLEIQYGGLELLDSFSELMKKTEKRKEIHLRNEAYYKKLLDNFKDKAYITLATL   238

Query:  246 NLPKRLAQFKEQLLQIQKDLSETPSHQKSRLTRLNQQEASVKQYILEFQEFSKKYPD---   302
            ++ KR   +EQL +   + L ET + + +R +++  Q+     K+ +LE    F ++Y D
Sbjct:  239 DVSKRSQELEEQLAK-NRALEETFT-ESTRTSKVEAQKKE-KERLLEELTFLQEYIDVGQ   295

Query:  303 -EPVIAGILSIRFGNVLEMLYAGMDDSFRKFYPQYLLNARVFEDAFKNDIVSANLGGVEG   361
             +A  LS+ FG      +YAGMDD F+++       L       AF+   ++ NLGGVE
Sbjct:  296 ARVPLAATLSLEFGTTSVNIYAGMDDDFKRYNAPILTWYETARYAFERGMIWQNLGGVEN   355

Query:  362 SLNDGLTKFKSNFNPMFEEYIGEFNLAINPLLYKLANLAYTIRKKQRHSH            411
            SLN  GL  FK   FNP  EEY+GEF +  +P LY L  LA    RK   R   H
Sbjct:  356 SLNGGLYHFKEKFNPTIEEYLGEFTMPTHP-LYPLLRLALDFRKTLRKKH            404
```

A related DNA sequence was identified in *S. pyogenes* <SEQ ID 5469> which encodes the amino acid sequence <SEQ ID 5470>. Analysis of this protein sequence reveals the following:

Possible site: 32
>>> Seems to have no N-terminal signal sequence
INTEGRAL    Likelihood = −0.32    Transmembrane 59-75 (59-75)
----- Final Results -----
    bacterial membrane --- Certainty = 0.1128 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:CAB89120 GB:AJ277484 beta-lactam resistance factor
[Streptococcus pneumoniae]
Identities = 166/402 (41%), Positives = 255/402 (63%), Gaps = 5/402 (1%)
Query:    9 KIGISEEEHDSFVEEHQQISVLQGSDWAKIKNQWQNERIGIYKEEKQVASLSLLIKLLPL    68
            +IGI    E+D FVKEH+  +VLQ S W  ++K+ WQ+E+ G+Y+EEK +A+ S+LI+ LPL
Sbjct:    5 QIGIPTLEYDQFVKEHELANVLQSSAWEEVKSNWQHEKFGVYREEKLLATASILIRTLPL    64

Query:   69 GRSIIYIPRGPVMDYLDRDLVAFTMKTLKDYGKTKKALFIKYDPAILLKQYALGQEEEEK   128
            G   YIPRGP++DY D++L+ F ++++K Y ++K+A+F+  +DP+I L Q   + QE+ E
Sbjct:   65 GYKMFYIPRGPILDYGDKELLNFAIQSIKSYARSKRAVFVTFDPSICLSQSLINQEKTEF   124

Query:  129 PLALAAIKNLQEAGVHWTGLTMEIADSIQPRFQANIYTQENLEMQFPKHTRRLIKDAKQR   188
            P   LA I +LQ+  GV W+G T E+  D+IQPR QA IY +     E+    K T++ I+ A+ +
Sbjct:  125 PENLAIIDSLQQMGVRWSGKTEEMGDTIQPRIQAKIYKENFEEDKLSKSTKQAIRTARNK   184

Query:  189 GVKTYRVSQSELHKFSKIVSLTEKRKNISLRNEAYFQKLMTTYGDKAYLHLAKVNIPQKL   248
            G++        L  FS+++   TEKRK I LRNEAY++KL+  +   DKAY+ LA +++ ++
Sbjct:  185 GLEIQYGGLELLDSFSELMKKTEKRKEIHLRNEAYYKKLLDNFKDKAYITLATLDVSKRS   244

Query:  249 DQYRQQLILINQDITRTQAHQKKRLKKLEDQKASLERYITE---FEGFTDQYPEEVVVAG   305
             + +QL  +N+ +  T +   R  K+E QK     ER + E     + +D     V  +A
Sbjct:  245 QELEEQLAK-NRALEETFT-ESTRTSKVEAQKKEKERLLEELTFLQEYIDVGQARVPLAA   302
```

-continued
```
Query: 306  ILSISYGNVMEMLYAGMNDDFKKFYPQYLLYPNVFQDAYQDGIIWANMGGVEGSLDDGLT  365
            LS+ +G    +YAGM+DDFK++    L +    + A++ G+IW N+GGVE SL+ GL
Sbjct: 303  TLSLEFGTTSVNIYAGMDDDFKRYNAPILTWYETARYAFERGMIWQNLGGVENSLNGGLY  362

Query: 366  KFKANFAPTIEEFIGEFNLPVSPLYHIANTMYKIRKQLKNKH                   407
            FK  F PTIEE++GEF +P  PLY +         RK L+ KH
Sbjct: 363  HFKEKFNPTIEEYLGEFTMPTHPLYPLLRLALDFRKTLRKKH                   404
```

An alignment of the GAS and GBS proteins is shown below.

```
Identities = 226/407 (55%), Positives = 318/407 (77%), Gaps = 3/407 (0%)
Query:   5  LMYHVTVGISEKEYDAFAIASSQTNLLHSSKWAQVKSNWQNERLGFYKDDQLVAVASILI   64
            L ++ +GISE+E+D+F    Q ++L  S WA++K+ WQNER+G YK+++ VA  S+LI
Sbjct:   4  LTFYAKIGISEEEHDSFVKEHQQISVLQGSDWAKIKNQWQNERIGIYKEEKQVASLSLLI   63

Query:  65  KSLPLGFTMLYIPRGPIMDYSNKELVNFVLKTLKNFGRKKRAVFAKFDPALLLRQYHLKE  124
            K LPLG +++YIPRGP+MDY +++LV F +KTLK++G+ K+A+F K+DPA+LL+QY L +
Sbjct:  64  KLLPLGRSIIYIPRGPVMDYLDRDLVAFTMKTLKDYGKTKKALFIKYDPAILLKQYALGQ  123

Query: 125  ENVAEEIDESRQAIDNLKSAGAQWIGPTKAISETIQPRFQANIYTKANIEENFPKHTKRL  184
            E   EE   + AI NL+ AG  W G T  I+++IQPRFQANIYT+ N+E  FPKHT+RL
Sbjct: 124  EE--EEKPLALAAIKNLQEAGVHWTGLTMEIADSIQPRFQANIYTQENLEMQFPKHTRRL  181

Query: 185  IKDAKHRGVQIYRANIDDLPKFATVVALTENRKGVALRNENYFHQLMTIYGEDAYLYLAK  244
            IKDAK RGV+ YR +  +L KF+ +V+LTE RK ++LRNE YF +LMT YG+ AYL+LAK
Sbjct: 182  IKDAKQRGVKTYRVSQSELHKFSKIVSLTEKRKNISLRNEAYFQKLMTTYGDKAYLHLAK  241

Query: 245  VNLPKRLAQFKEQLLQIQKDLSETPSHQKSRLTRLNQQEASVKQYILEFQEFSKKYPDEP  304
            VN+P++L Q+++QL+ I +D++ T +HQK RL +L  Q+AS+++YI EF+ F+ +YP+E
Sbjct: 242  VNIPQKLDQYRQQLILINQDITRTQAHQKKRLKKLEDQKASLERYITEFEGFTDQYPEEV  301

Query: 305  VIAGILSIRFGNVLEMLYAGMDDSFRKFYPQYLLNARVFEDAFKNDIVSANLGGVEGSLN  364
            V+AGILSI +GNV+EMLYAGM+D F+KFYPQYLL   VF+DA+++ I+ AN+GGVEGSL+
Sbjct: 302  VVAGILSISYGNVMEMLYAGMNDDFKKFYPQYLLYPNVFQDAYQDGIIWANMGGVEGSLD  361

Query: 365  DGLTKFKSNFNPMFEEYIGEFNLAINPLLYKLANLAYTIRKKQRHSH              411
            DGLTKFK+NF P EE+IGEFNL ++P LY +AN  Y IRK+ ++ H
Sbjct: 362  DGLTKFKANFAPTIEEFIGEFNLPVSP-LYHIANTMYKIRKQLKNKH              407
```

SEQ ID 5468 (GBS377) was expressed in *E. coli* as a His-fusion product. SDS-PAGE analysis of total cell extract is shown in FIG. 65 (lane 4; MW 49 kDa). It was also expressed in *E. coli* as a GST-fusion product. SDS-PAGE analysis of total cell extract is shown in FIG. 71 (lane 4; MW 74 kDa).

GBS377-GST was purified as shown in FIG. 212, lane 4.

Based on this analysis, it was predicted that these proteins and their epitopes could be useful antigens for vaccines or diagnostics.

Example 1760

A DNA sequence (GBSx1867) was identified in *S. agalactiae* <SEQ ID 5471> which encodes the amino acid sequence <SEQ ID 5472>. Analysis of this protein sequence reveals the following:

Possible site: 22

>>> Seems to have no N-terminal signal sequence

----- Final Results ----- bacterial cytoplasm --- Certainty = 0.2073 (Affirmative) <succ> bacterial membrane --- Certainty = 0.0000 (Not Clear) <succ> bacterial outside --- Certainty = 0.0000 (Not Clear) <succ>

A related GBS nucleic acid sequence <SEQ ID 9627> which encodes amino acid sequence <SEQ ID 9628> was also identified.

The protein has homology with the following sequences in the GENPEPT database.

```
>GP:AAC76720 GB:AE000446 orf, hypothetical protein [Escherichia coli K12]
Identities = 127/269 (47%), Positives = 189/269 (70%), Gaps = 1/269 (0%)
Query:   7  SIKLVAVDIDGTLLNSKREITPEVAKAVQEAKSKGVKIVIATGRPIIGVQDLLEELKLNE   66
            +IKL+A+D+DGTLL       I+P V  A+   A+++GV +V+ TGRP  GV + L+EL + +
Sbjct:   2  AIKLIAIDMDGTLLLPDHTISPAVKNAIAAARARGVNVVLTTGRPYAGVHNYLKELHMEQ   61

Query:  67  EGDYVITFNGGLVQDTATGDDIIKETLTYEDYLDFELLARKLGVHMHAITKEGIYTANRD  126
              GDY IT+NG LVQ  A G + + L+Y+DY  E L+R++G H HA+  +  +YTANRD
Sbjct:  62  PGDYCITYNGALVQKAADGSTVAQTALSYDDYRFLEKLSREVGSHFHALDRTTLYTANRD  121

Query: 127  IGKYTIHEVTLVNMPLFYRTPEEMG-DKEIIKLMMIDQPDILDAAIAKIPKKVLDNYTIV  185
            I  YT+HE +  +PL +   E+M  +  + +K+MMID+P ILD AIA+IP++V + YT++
Sbjct: 122  ISYYTVHESFVATIPLVFCEAEKMDPNTQFLKVMMIDEPAILDQAIARIPQEVKEKYTVL  181
```

```
Query: 186 KSTPFYLEILPKNVNKGTALLHLAEKMGLTVDQTMAIGDEENDRAMLEVVGNPVVMQNGN  245
            KS P++LEIL K VNKGT +  LA+ +G+  ++ MAIGD+END AM+E  G  V M N
Sbjct: 182 KSAPYFLEILDKRVNKGTGVKSLADVLGIKPEEIMAIGDQENDIAMIEYAGVGVAMDNAI  241

Query: 246 PELKKIARYITKSNEESGVAYALREWVIN                               274
            P +K++A ++TKSN E GVA+A+ ++V+N
Sbjct: 242 PSVKEVANFVTKSNLEDGVAFAIEKYVLN                               270
```

A related DNA sequence was identified in *S. pyogenes* <SEQ ID 3407> which encodes the amino acid sequence <SEQ ID 3408>. Analysis of this protein sequence reveals the following:

---

Possible site: 36
>>> Seems to have no N-terminal signal sequence
----- Final Results -----
    bacterial cytoplasm --- Certainty = 0.3474 (Affirmative) <succ>
    bacterial membrane --- Certainty = 0.0000 (Not Clear) <succ>
    bacterial outside --- Certainty = 0.0000 (Not Clear) <succ>

---

An alignment of the GAS and GBS proteins is shown below.

```
Identities = 197/268 (73%), Positives = 235/268 (87%)
Query:   7 SIKLVAVDIDGTLLNSKREITPEVAKAVQEAKSKGVKIVIATGRPIIGVQDLLEELKLNE   66
           SIKLVAVDIDGTLL    R IT +V +AVQEAK++GV +VIATGRPI GV  LLE+L+LN
Sbjct:   2 SIKLVAVDIDGTLLTDDRRITDDVFQAVQEAKAQGVHVVIATGRPIAGVISLLEQLELNH   61

Query:  67 EGDYVITFNGGLVQDTATGDDIIKETLTYEDYLDFELLARKLGVHMHAITKEGIYTANRD  126
           +G++VITFNGGLVQD  TG++I+KE +TY+DYL+E  L+RKLGVHMHAITKEGIYTANR+
Sbjct:  62 KGNHVITFNGGLVQDAETGEEIVKELMTYDDYLETEFLSRKLGVHMHAITKEGIYTANRN  121

Query: 127 IGKYTIHEVTLVNMPLFYRTPEEMGDKEIIKLMMIDQPDILDAAIAKIPKKVLDNYTIVK  186
           IGKYT+HE TLVNMP+FYRTPEEM +KEIIK+MMID+PD+LDAAI +IP+   D YTIVK
Sbjct: 122 IGKYTVHESTLVNMPIFYRTPEEMTNKEIIKMMMIDEPDLLDAAIKQIPQHFFDKYTIVK  181

Query: 187 STPFYLEILPKNVNKGTALLHLAEKMGLTVDQTMAIGDEENDRAMLEVVGNPVVMQNGNP  246
           STPFYLE +PK V+KG A+ HLA+K+GL + QTMAIGD ENDRAMLEVV NPVVM+NG P
Sbjct: 182 STPFYLEFMPKTVSKGNAIKHLAKKLGLDMSQTMAIGDAENDRAMLEVVANPVVMENGVP  241

Query: 247 ELKKIAKYITKSNEESGVAYALREWVIN                                274
           ELKKIAKYITKSN +SGVA+A+R+WV+N
Sbjct: 242 ELKKIAKYITKSNNDSGVAHAIRKWVLN                                269
```

Based on this analysis, it was predicted that these proteins and their epitopes could be useful antigens for vaccines or diagnostics.

Example 1761

A DNA sequence (GBSx1868) was identified in *S. agalactiae* <SEQ ID 5473> which encodes the amino acid sequence <SEQ ID 5474>. Analysis of this protein sequence reveals the following:

---

Possible site: 48
>>> Seems to have no N-terminal signal sequence
----- Final Results ----- bacterial cytoplasm --- Certainty = 0.2360 (Affirmative) <succ>
    bacterial membrane --- Certainty = 0.0000 (Not Clear) <succ>
    bacterial outside --- Certainty = 0.0000 (Not Clear) <succ>

---

The protein has homology with the following sequences in the GENPEPT database.

```
>GP:BAB07537 GB:AP001520 unknown conserved protein [Bacillus halodurans]
     Identities = 211/423 (49%), Positives = 285/423 (66%), Gaps = 5/423 (1%)
     Query:   3 EKVFRDPVHTYIHVNNQVIYDLINTKEFQRLRRIKQTSTTSFTFHGAEHSRFSHCLGVYE   62
                EKVF+DPVH YIHV +++I+ LI TKEFQRLRR++Q  TT  TFHGAEH+RF+H LGVYE
     Sbjct:  12 EKVFKDPVHRYIHVRDELIWALIGTKEFQRLRRVRQLGTTFLTFHGAEHTRFNHSLGVYE   71
```

-continued

```
Query:   63 LARKVTEIFDEHYSDLWNKNESLLTMAAALLHDIGHGAYSHTFERLFNTDHEAYTQEIIT 122
            + R++ E+F      WN+ E LLT+ AALLHDIGHG +SH+FE++F+TDHE +T+ +I
Sbjct:   72 ITRRIIEVFQGR--PYWNEEERLLTLCAALLHDIGHGPFSHSFEKVFDTDHEEWTRRMIV 129

Query:  123 NPTTEINAILRKVAPDFPDKVASVINHSYPNKQVVQLISSQIDCDRMDYLLRDSYYTAAS 182
               T EI+ +L K+  DFP KVA VI +YPNK V +ISSQID DRMDYL RD+YYT S
Sbjct:  130 GDT-EIHNVLLKMGDDFPQKVADVIEKTYPNKLVTSIISSQIDADRMDYLQRDAYYTGVS 188

Query:  183 YGQFDLTRILRVIRPTDSGIAFARNGMHAVEDYIVSRFQMYMQVYFHPASRAMELLLQNL 242
            YG FD+ RILRV+RP +  +   ++GMHAVEDYI+SR+QMY QVYFHP +R+ E++L  +
Sbjct:  189 YGHFDMERILRVMRPMEDQVVIKQSGMHAVEDYIMSRYQMYWQVYFHPVTRSAEVILSKV 248

Query:  243 LKRARFLFDTHRDFFEQTSPNLIPFFTDQYDLQDYLALDDGVMNTYFQSWMQADDNILAD 302
              KR + L++       F+Q +    F      L DYL LD+ +   YFQ W + +D IL+D
Sbjct:  249 FKRVKDLYEQGYK-FKQEPKHFYSLFEGNMSLDDYLRLDESITMYYFQIWQEEEDRILSD 307

Query:  303 LANRFINRKVFKSITFEESDKEN-LVKMKELVSQVGFDPDYYTGVHANFDLPYDVYRPEH 361
            L   RFINR++FK I F + + N    ++++L +Q    DP+YY   V ++ DLPYD YRP
Sbjct:  308 LCVRFINRQLFKYIEFNPNLQMNDWPRLQQLFAQAEIDPEYYLVVDSSSDLPYDFYRPGE 367

Query:  362 SNPRTEIQIIQKNGQLAELSSLSPIVKALTGSNYGDQRFYFPKEMLTLDSLFSSTKEEFQ 421
                R  I +I    NG+L ELS  S +V+A++G    D + YFP + LT  S      K+E
Sbjct:  368 EEERLPIHLIMPNGKLRELSRESDVVEAISGKKRTDHKLYFPMDCLTDQSDHKEIKQEIL 427

Query:  422 SYI 424
            S +
Sbjct:  428 SLL 430
```

A related DNA sequence was identified in *S. pyogenes* <SEQ ID 5475> which encodes the amino acid sequence <SEQ ID 5476>. Analysis of this protein sequence reveals the following:

Possible site: 55
>>> Seems to have no N-terminal signal sequence

----- Final Results -----
bacterial cytoplasm --- Certainty = 0.2220 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 321/428 (75%), Positives = 379/428 (88%)
Query:    1 MNEKVFRDPVHTYIHVNNQVIYDLINTKEFQRLRRIKQTSTTSFTFHGAEHSRFSHCLGV  60
            MNEKVFRDPVH YIH++N +IYDLINTKEFQRLRRIKQ  TT+FTFHGAEHSRFSHCLGV
Sbjct:    1 MNEKVFRDPVHNYIHIDNPLIYDLINTKEFQRLRRIKQVPTTAFTFHGAEHSRFSHCLGV  60

Query:   61 YELARKVTEIFDEHYSDLWNKNESLLTMAAALLHDIGHGAYSHTFERLFNTDHEAYTQEI 120
            YE+AR+VT IF+E Y+D+WNK+ESL+TM AALLHDIGHGAYSHTFE LF+TDHEA+TQEI
Sbjct:   61 YEIARRVTAIFEEKYADIWNKDESLVTMTAALLHDIGHGAYSHTFEVLFHTDHEAFTQEI 120

Query:  121 ITNPTTEINAILRKVAPDFPDKVASVINHSYPNKQVVQLISSQIDCDRMDYLLRDSYYTA 180
            ITNP TEINAIL   +APDFPDKVASVINH+YPNKQVVQLISSQIDCDRMDYLLRDSY++A
Sbjct:  121 ITNPETEINAILVRHAPDFPDKVASVINHTYPNKQVVQLISSQIDCDRMDYLLRDSYFSA 180

Query:  181 ASYGQFDLTRILRVIRPTDSGIAFARNGMHAVEDYIVSRFQMYMQVYFHPASRAMELLLQ 240
            A+YGQFDL RILRVIRP +  GI F   +GMHAVEDYIVSRFQMYMQVYFHPASRA+EL+LQ
Sbjct:  181 ANYGQFDLMRILRVIRPVEDGIVFEHSGMHAVEDYIVSRFQMYMQVYFHPASRAVELILQ 240

Query:  241 NLLKRARFLFDTHRDFFEQTSPNLIPFFTDQYDLQDYLALDDGVMNTYFQSWMQADDNIL 300
            NLLKRA+ L+   + +F++T+P LIPFF  + +L DY+ALDDGVMNTYFQ WM ++D+IL
Sbjct:  241 NLLKRAQHLYPEQQAYFQKTAPGLIPFFEKKANLADYIALDDGVMNTYFQVWMASEDHIL 300

Query:  301 ADLANRFINRKVFKSITFEESDKENLVKMKELVSQVGFDPDYYTGVHANFDLPYDVYRPE 360
            +DLA+RFINRK+ KS TF++   +  L ++++LV  VGFDPDYYTG+H NFDLPYD+YRPE
Sbjct:  301 SDLASRFINRKILKSVTFDQDSQGELERLRQLVESVGFDPDYYTGIHINFDLPYDIYRPE 360

Query:  361 HSNPRTEIQIIQKNGQLAELSSLSPIVKALTGSNYGDQRFYFPKEMLTLDSLFSSTKEEF 420
               NPRT+I+++QK+G LAELS LSPIVKALTG+ YGD+RFYFPKEML LD LF+ +KE F
Sbjct:  361 LENPRTQIEMMQKDGSLAELSQLSPIVKALTGTTYGDRRFYFPKEMLELDDLFAPSKETF 420

Query:  421 QSYITNEH 428
            +SYI+N H
Sbjct:  421 MSYISNGH 428
```

Example 1762

A DNA sequence (GBSx1869) was identified in *S. agalactiae* <SEQ ID 5477> which encodes the amino acid sequence <SEQ ID 5478>. Analysis of this protein sequence reveals the following:

```
Possible site: 46
>>> Seems to have no N-terminal signal sequence
----- Final Results -----
    bacterial cytoplasm --- Certainty = 0.4789 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

A related DNA sequence was identified in *S. pyogenes* <SEQ ID 5479> which encodes the amino acid sequence <SEQ ID 5480>. Analysis of this protein sequence reveals the following:

```
Possible site: 57
>>> Seems to have no N-terminal signal sequence
----- Final Results -----
    bacterial cytoplasm --- Certainty = 0.3650 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
Identities = 64/127 (50%), Positives = 89/127 (69%)

Query:     5  MKLEINNNIQIDNETEMIHEIHDCQFIEKGSYVYLNYINAEGERVVIKANHEELLMTRFS   64
              MKL++ N+I+  +ETE+I EIHDC++ EKG Y YL Y N + E+VVIK N  EL M+RFS
Sbjct:     1  MKLQLTNHIRFGDETEIIQEIHDCEWREKGGYQYLIYQNTDKEKVVIKYNETELTMSRFS   60

Query:    65  NPKSVMRFHRETPALVNIPTPLGVQHLITETSHYQFDLSQQRLHINYVLKQTETGDCFAN  124
              NP+S+M+F    L+ +PTP+GVQ  +T+TSHY  D S Q+L ++Y L Q +T    FA+
Sbjct:    61  NPQSIMKFFAGKKVLIALPTPMGVQQFLTDTSHYHLDCSCQKLDLHYHLLQAQTEMLFAS  120

Query:   125  YELRIQW                                                      131
              Y L + W
Sbjct:   121  YHLELSW                                                      127
```

Based on this analysis, it was predicted that these proteins and their epitopes could be useful antigens for vaccines or diagnostics.

Example 1763

A DNA sequence (GBSx1870) was identified in *S. agalactiae* <SEQ ID 5481> which encodes the amino acid sequence <SEQ ID 5482>. This protein is predicted to be cation-transporting ATPase PacL (ctpF). Analysis of this protein sequence reveals the following:

```
Possible site: 14
>>> Seems to have no N-terminal signal sequence
INTEGRAL    Likelihood = -13.27   Transmembrane 256-272 (246-276)
INTEGRAL    Likelihood = -9.02    Transmembrane 64-80 (58-85)
INTEGRAL    Likelihood = -8.49    Transmembrane 833-849 (828-855)
INTEGRAL    Likelihood = -8.17    Transmembrane 89-105 (81-107)
INTEGRAL    Likelihood = -7.48    Transmembrane 864-880 (860-884)
INTEGRAL    Likelihood = -3.29    Transmembrane 287-303 (284-306)
INTEGRAL    Likelihood = -2.55    Transmembrane 754-770 (753-773)
INTEGRAL    Likelihood = -0.85    Transmembrane 695-711 (694-711)
INTEGRAL    Likelihood = -0.75    Transmembrane 793-809 (792-809)
----- Final Results -----
    bacterial membrane --- Certainty = 0.6307 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:CAB13439 GB:Z99112 similar to calcium-transporting ATPase
[Bacillus subtilis]
Identities = 380/888 (42%), Positives = 545/888 (60%), Gaps = 49/888 (5%)
Query:  10 FYTQGQEEVLTSLESS-REGLSTTEAKNRLEMYGRNELEEGKKRSLIAKFFDQFKDLMII  68
           F+  GQ ++L +  +S ++GL+   E K RL+ +G NEL+EGKK S   +FF QFKD M++
Sbjct:   3 FHEMGQTDLLEATNTSMKQGLTEKEVKKRLDKHGPNELQEGKKTSALLLFFAQFKDFMVL  62

Query:  69 ILLVAAALSVITEGMHG-LTDALIILAVVILNAAFGVYQEGQAEAAIEALKDMSSPIARV 127
           +LL A  +S    G  G    DA+ I+A+V +N   G +QE +AE +++ALK++S+P
Sbjct:  63 VLLAATLIS----GFLGEYVDAVAIIAIVFVNGILGFFQERRAEQSLQALKELSTPHVMA 118

Query: 128 RRDGHTIEVDSKELVPGDLVMLEAGDVVPADLRLLEAASLKIEEAALTGESVPVEKDISQ 187
           R+G    ++ SKELVPGD+V   +GD + AD+R++EA SL+IEE+ALTGES+PV K   +
Sbjct: 119 LREGSWTKIPSKELVPGDIVKFTSGDRIGADVRIVEARSLEIEESALTGESIPVVKHADK 178

Query: 188 VVAEDAGIGDRVNMAYQNSNVTYGRGYGVVTNTGMYTEVGKIADMLANADESETPLKQSL 247
           +   D +GD   NMA+  + VT G G GVV  TGM T +GKIADML +A       TPL++ L
Sbjct: 179 LKKPDVSLGDITNMAFMGTIVTRGSGVGVVVGTGMNTAMGKIADMLESAGTLSTPLQRRL 238

Query: 248 VQLSKLLTYLIVIIAVITFLVGIFVRKEGWIEGLMTSVALAVAAIPEGLPAIVTIVLSMG 307
           QL K+L  +  +++ V+   VG+ ++           +  V+LAVAAIPEGLPAIVT+ LS+G
Sbjct: 239 EQLGKILIVVALLLTVLVVAVGV-IQGHDLYSMFLAGVSLAVAAIPEGLPAIVTVALSLG 297

Query: 308 TKTLAKRNSIVRKLPAVETLGSTEIIASDKTGTLTMNQMTVEKVYT-------------- 353
           + +  K+ SIVRKLPAVETLG    II SDKTGT+T N+MTV V++
Sbjct: 298 VQRMIKQKSIVRKLPAVETLGCASIICSDKTGTMTQNKMTVTHVWSGGKTWRVAGAGYEP 357

Query: 354 NGVLQSSSEEISVDNNTL--------RIMNFSNDTKIDPSGKLIGDPTETALVQFGLDKN 405
           G   + +EISV+ +         + N SN  K D     L GDPTE AL+
Sbjct: 358 KGSFTLNEKEISVNEHKPLQQMLLFGALCNNSNIEKRDGEYVLDGDPTEGALLTAARKGG 417

Query: 406 FDVREVLKNEPRVAELPFDSDRKLMSTIHKESDGRYFIAVKGAPDQLLKRVTKIEDNGLV 465
           F    V N   + E PFDS RK+M+ I + D + +I  KGAPD L++R ++I   +G
Sbjct: 418 FSKEFVESNYRVIEEFPFDSARKMMTVIVENQDRKRYIITKGAPDVLMQRSSRIYYDGSA 477

Query: 466 RDITAEDKEAILNTNKELAKQALRVLMMAYK--YETQIPSLETDIVESDLVFSGLVGMID 523
           + E K     + LA QALR + +AY+      + PS+E    E DL    GL G+ID
Sbjct: 478 ALFSNERKAETEAVLRHLASQALRTIAVAYRPIKAGETPSMEQ--AEKDLTMLGLSGIID 535

Query: 524 PERPEAAEAVRVAKEAGIRPIMITGDHQDTAEAIAKRLGIIDANDTEDHVFTGAELNELS 583
           P RPE +A++  +EAGI+ +MITGDH +TA+AIAK L ++ +      + G  LNELS
Sbjct: 536 PPRPEVRQAIKECREAGIKTVMITGDHVETAKAIAKDLRLLPKS---GKIMDGKMLNELS 592

Query: 584 DEEFQKVFKQYSVYARVSPEHKVRIVKAWQNDGKVVAMTGDGVNDAPSLKTADIGIGMGI 643
           +EE    V +   V+ARVSPEHK++IVKA+Q +G +VAMTGDGVNDAP++K ADIG+ MGI
Sbjct: 593 QEELSHVVEDVYVFARVSPEHKLKIVKAYQENGHIVAMTGDGVNDAPAIKQADIGVSMGI 652

Query: 644 TGTEVSKGASDMVLADDNFATIIVAVEEGRKVFSNIQKSIQYLLSANMAEVFTIFFATLL 703
           TGT+V+K AS +VL DDNFATI  A++EGR ++ NI+K I+YLL++N+ E+    FA LL
Sbjct: 653 TGTDVAKEASSLVLVDDNFATIKSAIKEGRNIYENIRKFIRYLLASNVGEILVMLFAMLL 712

Query: 704 GWDV-LAPVHLLWINLVTDTLPAIALGVEPAEPGVMTHKPRGRQSNFFDGGVMGAIIYQG 762
             + L P+ +LW+NLVTD LPA+ALG++  E  VM KPR +       F  +   ++ +G
Sbjct: 713 ALPLPLVPIQILWVNLVTDGLPAMALGMDQPEGDVMKRKPRHPKEGVFARKLGWKVVSRG 772

Query: 763 ILQTILVLGVYGWALMY---PEHAGYRMIHADALTMAFATLGLIQLVHAFNVKSVYQSIF 819
           L  I V +  + ++Y   PE+   Y     A T+AFATL  L QL+H F +S    S+F
Sbjct: 773 FL--IGVATILAFIIVYHRNPENLAY------AQTIAFATLVLAQLIHVFDCRS-ETSVF 823

Query: 820 TVGAFKNRTENWSIPVAFILLMVTIVVPGFNKLFHVTHLSSTQWLTVV             867
           +   F+N     ++  + +L++V I  P    +FH   ++    W+ V+
Sbjct: 824 SRNPFQNLYLIGAVLSSILLMLVVIYYPPLQPIFHTVAITPGDWMLVI             871
```

A related DNA sequence was identified in *S. pyogenes* <SEQ ID 4171> which encodes the amino acid sequence <SEQ ID 4172>. Analysis of this protein sequence reveals the following:

Possible site: 34
>>> Seems to have no N-terminal signal sequence
INTEGRAL    Likelihood = −12.47    Transmembrane 863-879 (856-883)
INTEGRAL    Likelihood = −10.08    Transmembrane 64-80 (58-86)
INTEGRAL    Likelihood = −8.97     Transmembrane 256-272 (249-275)
INTEGRAL    Likelihood = −8.55     Transmembrane 89-105 (81-107)
INTEGRAL    Likelihood = −5.84     Transmembrane 832-848 (827-850)
INTEGRAL    Likelihood = −3.13     Transmembrane 287-303 (284-307)

-continued

INTEGRAL    Likelihood = −2.66    Transmembrane 762-778 (761-779)
INTEGRAL    Likelihood = −0.37    Transmembrane 685-701 (685-701)
----- Final Results -----
   bacterial membrane --- Certainty = 0.5989 (Affirmative) <succ>
   bacterial outside --- Certainty = 0.0000 (Not Clear) <succ>
   bacterial cytoplasm --- Certainty = 0.0000 (Not Clear) <succ>

An alignment of the GAS and GBS proteins is shown below.

```
Identities = 735/892 (82%), Positives = 813/892 (90%), Gaps = 1/892 (0%)
Query:   3  KEQKKSLFYTQGQEEVLTSLESSREGLSTTEAKNRLEMYGRNELEEGKKRSLIAKFFDQF   62
            KEQ+  FYTQ +E VL  LE+SREGL++ +AK RL YGRNEL+EG+KRSL  KF DQF
Sbjct:   3  KEQRHEAFYTQSEETVLAQLETSREGLTSAQAKERLAEYGRNELDEGEKRSLFMKELDQF   62

Query:  63  KDLMIIILLVAAALSVITEGMHGLTDALIILAVVILNAAFGVYQEGQAEAAIEALKDMSS  122
            KDLMIIIL+VAA LSV+TEGM GLTDA+IILAVVILNAAFGVYQEGQAEAAIEALK MSS
Sbjct:  63  KDLMIIILIVAALLSVLTEGMEGLTDAIIILAVVILNAAFGVYQEGQAEAAIEALKSMSS  122

Query: 123  PIARVRRDGHTIEVDSKELVPGDLVMLEAGDVVPADLRLLEAASLKIEEAALTGESVPVE  182
            P+AR+RRDGH  E+DSKELVPGD+V+LEAGDVVPADLRLLEA SLKIEEAALTGESVPVE
Sbjct: 123  PLARIRRDGHVTEIDSKELVPGDIVLLEAGDVVPADLRLLEANSLKIEEAALTGESVPVE  182

Query: 183  KDISQVVAEDAGIGDRVNMAYQNSNVTYGRGYGVVTNTGMYTEVGKIADMLANADESETP  242
            KD+S  V+EDAGIGDRVNM YQNSNVTYGRG GV+TNTGMYTEVG IA MLANADE++TP
Sbjct: 183  KDLSTAVSEDAGIGDRVNMGYQNSNVTYGRGIGVITNTGMYTEVGHIAGMLANADETDTP  242

Query: 243  LKQSLVQLSKLLTYLIVIIAVITFLVGIFVRKEGWIEGLMTSVALAVAAIPEGLPAIVTI  302
            LKQ+L  LSK+LTY I++IA +TF VG+F+R +  +EGLMTSVALAVAAIPEGLPAIVT+
Sbjct: 243  LKQNLDNLSKILTYAILVIAAVTFAVGVFLRGQHPLEGLMTSVALAVAAIPEGLPAIVTV  302

Query: 303  VLSMGTKTLAKRNSIVRKLPAVETLGSTEIIASDKIGTLTMNQMTVEKVYTNGVLQSSSE  362
            VLS+GT+ LAKRN+I+RKLPAVETLGSTEIIASDK GTLTMNQMTVEKVYTNG LQSSS
Sbjct: 303  VLSLGTQVLAKRNAIIRKLPAVETLGSTEIIASDKTGTLTMNQMTVEKVYTNGTLQSSSA  362

Query: 363  EISVDNNTLRIMNFSNDTKIDPSGKLIGDPTETALVQFGLDKNFDVREVLKNEPRVAELP  422
            +I+  DN TLR+MNF+NDTK+DPSGKLIGDPTETALV+FGLD NFDVRE +  EPRVAELP
Sbjct: 363  DIAFDNITLRVMNFANDTKVDPSGKLIGDPIETALVEFGLDHNFDVREAMVAEPRVAELP  422

Query: 423  FDSDRKLMSTIHKESDGRYFIAVKGAPDQLLKRVTKIEDNGLVRDITAEDKEAILNTNKE  482
            FDSDRKLMSTIHK++DG+YFIAVKGAPDQLL+RVT+IE+NG +R IT  DK+ IL+TNK
Sbjct: 423  FDSDRKLMSTIHKQADGKYFIAVKGAPDQLLRVTQIEENGQIRPITDADKKTILDTNKS  482

Query: 483  LAKQALRVLMMAYKYETQIPSLETDIVESDLVFSGLVGMIDPERPEAAEAVRVAKEAGIR  542
            LAKQALRVLMMAYKY   +P+LET+IVE++LVFSGLVGMIDPERPEAA+AV+VA+EAGIR
Sbjct: 483  LAKQALRVLMMAYKYSDALPTLETEIVEANLVFSGLVGMIDPERPEAAQAVKVAKEAGIR  542

Query: 543  PIMITGDHQDTAEAIAKRLGIIDANDTEDHVFTGAELNELSDEEFQKVFKQYSVYARVSP  602
            PIMITGDHQDTA+AIAKRLGII+   D   DHVFTGAELNELSDEEFQKVFKQYSVYARVSP
Sbjct: 543  PIMITGDHQDTAKAIAKRLGIIE-EDGVDHVFTGAELNELSDEEFQKVFKQYSVYARVSP  601

Query: 603  EHKVRIVKAWQNDGKVVAMTGDGVNDAPSLKTADIGIGMGITGTEVSKGASDMVLADDNF  662
            EHKVRIVKAWQN+GKVVAMTGDGVNDAPSLKTADIGIGMGITGTEVSKGASDMVLADDNF
Sbjct: 602  EHKVRIVKAWQNEGKVVAMTGDGVNDAPSLKTADIGIGMGITGTEVSKGASDMVLADDNF  661

Query: 663  ATIIVAVEEGRKVESNIQKSIQYLLSANMAEVFTIFFATLLGWDVLAPVHLLWINLVTDT  722
            ATIIVAVEEGRKVESNIQK+IQYLLSANMAEVFTIF  ATL GWDVL PVHLLWINLVTDT
Sbjct: 662  ATIIVAVEEGRKVFSNIQKTIQYLLSANMAEVFTIFLATLFGWDVLQPVHLLWINLVTDT  721

Query: 723  LPAIALGVEPAEPGVMTHKPRGRQSNFFDGGVMGAIIYQGILQTILVLGVYGWALMYPEH  782
            LPAIALGVEPAEPGVM HKPRGR+S+FFDGGV  AI+YQG  QTILVLGVYG+ALM+PEH
Sbjct: 722  LPAIALGVEPAEPGVMKHKPRGRKSSFFDGGVKEAILYQGAFQTILVLGVYGFALMFPEH  781

Query: 783  AGYRMIHADALTMAFATLGLIQLVHAFNVKSVYQSIFTVGAFKNRTFNWSIPVAFILLMV  842
              Y  +HADALTMA+ TLGLIQLVHA+NVKSVYQSIFTVG FKN+  FN+SIPVAF+ LM
Sbjct: 782  TSYHDVHADALTMAYVTLGLIQLVHAYNVKSVYQSIFTVGLEKNKLFNYSIPVAFVALMA  841

Query: 843  TIVVPGFNKLFHVTHLSSTQWLTVVIGSLLMVVLTEIVKFIQRKLGQDEKAI          894
            T+VVPGFN+ FHVTHL+ TQWL V+IGSLLMVVL E+VK +QR LGQDEKAI
Sbjct: 842  TVVVPGFNQFFHVTHLTITQWLVVIGSLLMVVLVELVKAVQRSLGQDEKAI          893
```

A related GBS gene <SEQ ID 8897> and protein <SEQ ID 8898> were also identified. Analysis of this protein sequence reveals the following:

Lipop: Possible site: −1   Crend: 6
McG: Discrim Score: −9.88
GvH: Signal Score (−7.5): −6.96
Possible site: 14
>>> Seems to have no N-terminal signal sequence
ALOM program    count: 9 value: −13.27 threshold: 0.0
INTEGRAL     Likelihood = −13.27   Transmembrane 256-272 (246-276)
INTEGRAL     Likelihood = −9.02    Transmembrane 64-80 (58-85)
INTEGRAL     Likelihood = −8.49    Transmembrane 833-849 (828-855)
INTEGRAL     Likelihood = −8.17    Transmembrane 89-105 (81-107)
INTEGRAL     Likelihood = −7.48    Transmembrane 864-880 (860-884)
INTEGRAL     Likelihood = −3.29    Transmembrane 287-303 (284-306)
INTEGRAL     Likelihood = −2.55    Transmembrane 754-770 (753-773)
INTEGRAL     Likelihood = −0.85    Transmembrane 695-711 (694-711)
INTEGRAL     Likelihood = −0.75    Transmembrane 793-809 (792-809)
PERIPHERAL   Likelihood = 1.06     714
modified ALOM score: 3.15
*** Reasoning Step: 3
----- Final Results -----
    bacterial membrane --- Certainty = 0.6307 (Affirmative) <succ>
     bacterial outside --- Certainty = 0.0000 (Not Clear) <succ>
    bacterial cytoplasm --- Certainty = 0.0000 (Not Clear) <succ>

The protein has homology with the following sequences in the databases:

```
ORF01112(328-2901 of 3282)
EGAD|108247|BS1566(3-871 of 890) hypothetical protein {Bacillus subtilis} OMNI|NT01BS1841
cation-transporting ATPase PacL GP|2337795|emb|CAA74269.1||Y13937 putative PacL protein
{Bacillus subtilis} GP|2633938|emb|CAB13439.1||Z99112 similar to calcium-transporting
ATPase {Bacillus subtilis} PIR|H69877|H69877 calcium-transporting ATPase homolog yloB -
Bacillus subtilis
% Match = 29.0
% Identity = 43.9  % Similarity = 64.5
Matches = 376 Mismatches = 291 Conservative Sub.s = 176

249       279       309       339       369       396       426       456
GVVLNSETCFHKNRSLFVCGETKGGKVLLKEQKKSLFYTQGQEEVLTSLESS-REGLSTTEAKNRLEMYGRNELEEGKKR
                                  |:  ||  ::| :    :| ::|| :    |   ||  :|  |||:|||
                                  MKFHEMGQTDLLEATNTSMKQGLTEKEVKKRLDKHGPNELQEGKKT
                                  10        20        30        40

486       516       546       576       606       636       666       696
SLIAKFFDQFKDLMIIILLVAAALSVITEGMHGLTDALIILAVVILNAAFGVYQEGQAEAAIEALKDMSSPIARVRRDGH
|:  ||  ||||||:|:::||       |  ::|:   :     || |:|:|  :|  :|| :||  :::|||::|:|        |:|
SALLLFFAQFKDFMVLVLL---AATLISGFLGEYVDAVAIIAIVFVNGILGFFQERRAEQSLQALKELSTPHVMALREGS
        60        70           80        90       100       110       120

726       756       786       816       846       876       906       936
TIEVDSKELVPGDLVMLEAGDVVPADLRLLEAASLKIEEAALTGESVPVEKDISQVVAEDAGIGDRVNMAYQNSNVTYGR
::  |||||||||:|  : ||  :  ||:|| ||:||| |||:|||  || :    :|   ||  ||| :|  ||    |||
WTKIPSKELVPGDIVKFTSGDRIGADVRIVEARSLEIEESALTGESIPVVKHADKLKKPDVSLGDITNMAFMGTIVTRGS
        140       150       160       170       180       190       200

966       996       1026      1056      1086      1116      1146      1176
GYGVVTNTGMYTEVGKIADMLANADESETPLKQSLVQLSKLLTYLIVIIAVITFLVGIFVRKEGWIEGLMTSVALAVAAI
| ||| ||| |:|||||||  :|   |||::  |||:: | ||  :  :::  |:   ||  ::     :: |:|||||
GVGVVVGTGMNTAMGKIADMLESAGTLSTPLQRRLEQLGKILIVVALLLTVLVVAVGV-IQGHDLYSMFLAGVSLAVAAI
        220       230       240       250       260       270       280

1206      1236      1266      1296      1326      1356          1374
PEGLPAIVTIVLSMGTKTLAKRNSIVRKLPAVETLGSTEIIASDKTGTLTMNQMTVEKVYT--------------NGVLQ
||||||||||:  ||:|  : : |: |||||||||||||||  ||  ||||||:| :||| |::                |  :
PEGLPAIVTVALSLGVQRMIKQKSIVRKLPAVETLGCASIICSDKTGTMTQNKMTVTHVWSGGKTWRVAGAGYEPKGSFT
        300       310       320       330       340       350       360

1404         1440      1470      1500      1530      1560      1590
SSSEEISVDNNT--------LRIMNFSNDTKIDPSGKLIGDPTETALVQFGLDKNFDVREVLKNEPRVAELPFDSDRKLM
 :  :|||| : :           :  ||    ||    |     |  ||||| ||:          |     |   : |:|||| ||:|
LNEKEISVNEHKPLQQMLLFGALCNNSNIEKRDGEYVLDGDPTEGALLTAARKGGFSKEFVESNYRVIEEFPFDSARKMM
        380       390       400       410       420       430       440

1620      1650      1680      1710      1740      1770      1794      1824
STIHKESDGRYFIAVKGAPDQLLKRVTKIEDNGLVRDITAEDKEAILNTNKELAKQALRVLMMAYK--YETQIPSLETDI
:  |    :  |    |    |||||  ::|    |   :|                |   :| |||    :   ||::|        || :|
TVIVENQDRKRYIITKGAPDVLMQRSSRIYYDGSAALFSNERKAETEAVLRHLASQALRTIAVAYRPIKAGETPSME--Q
        460       470       480       490       500       510       520

1854      1884      1914      1944      1974      2004      2034      2064
VESDLVFSGLVGMIDPERPEAAEAVRVAKEAGIRPIMITGDHQDTAEAIAKRLGIIDANDTEDHVFTGAELNELSDEEFQ
|  |  ||  || |:|||  |||   :|::   :||||:|  ||||||:|  ||||| ||    | :   |   :   |
AEKDLTMLGLSGIIDPPRPEVRQAIKECREAGIKTVMITGDHVETAKAIAKDL---RLLPKSGKIMDGKMLNELSQEELS
        530       540       550       560       570       580       590

2094      2124      2154      2184      2214      2244      2274      2304
KVFKQYSVYARVSPEHKVRIVKAWQNDGKVVAMTGDGVNDAPSLKTADIGIGMGITGTEVSKGASDMVLADDNFATIIVA
|  :  |:||||||:: ||||  : :|     ||||||||||| |::  :||| ||||||||:|  || :|| ||||||||| :|
HVVEDVYVFARVSPEHKLKIVKAYQENGHIVAMTGDGVNDAPAIKQADIGVSMGITGTDVAKEASSLVLVDDNFATIKSA
        610       620       630       640       650       660       670

2334      2364      2394         2451      2481      2511      2541
VEEGRKVFSNIQKSIQYLLSANMAEVFTIFFATLLGWDV-LAPVHLLWINLVTDTLPAIALGVEPAEPGVMTHKPRGRQS
:::|||  :: ||: |:|||::|: |:   ::  ||  ||    :  |  |:::|||||| |||:||::  ||     |||
IKEGRNIYENIRKFIRYLLASNVGEILVMLFAMLLALPLPLVPIQILWVNLVTDGLPAMALGMDQPEGDVMKRKPRHPKE
        690       700       710       720       730       740       750

2571      2601      2631      2661      2691      2721      2751      2781
NFFDGGVMGAIIYQGILQTILVLGVYGWALMYPEHAGYRMIHADALTMAFATLGLIQLVHAFNVKSVYQSIFTVGAFKNR
|    :  :: :|             |    |          |    | :|||||||   ||::  :|  :|     |:|
GVFARKLGWKVVSRGFLIG--VATILAFIIVY--HRN-PENLAYAQTIAFATLVLAQLIHVFDCRS-ETSVFSRNPFQNL
        770       780       790       800       810       820       830
```

```
2811       2841       2871       2901       2931       2961       2991       3021
TFNWSIPVAFILLMVTIVVPGFNKLFHVTHLSSTQWLTVVIGSLLMVVLTEIVKFIQRKLGQDEKAI*FS**KNSLRISK
 :   ::    : :|::|    |    |  :  :||   ::    |:  |:
YLIGAVLSSILLMLVVIYYPPLQPIFHTVAITPGDWMLVIGMSAIPTFLLAGSLLTRKK
                850        860        870        880        890
```

Based on this analysis, it was predicted that these proteins and their epitopes could be useful antigens for vaccines or diagnostics.

Example 1764

A DNA sequence (GBSx1871) was identified in *S. agalactiae* <SEQ ID 5483> which encodes the amino acid sequence <SEQ ID 5484>. Analysis of this protein sequence reveals the following:

Possible site: 48
>>> Seems to have no N-terminal signal sequence
----- Final Results -----
   bacterial cytoplasm --- Certainty = 0.2905 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:CAB48940 GB:AJ248283 hypothetical protein [Pyrococcus abyssi]
Identities = 60/221 (27%), Positives = 100/221 (45%), Gaps = 37/221(16%)
Query:  33   KIDHLHIA------GDISNHFIKDTLP-FINNLKKH---IKLSYNLGNHDMLDLTE--TE   80
             KID L I       GD+SN+  D+    I+ L      + L    GNHD+  L +
Sbjct:  15   KIDVLKIPDIAIQLGDLSNYGEPDIIENLISELVTQLDPVPLLVIPGNHDIYGLNDIFAA  74

Query:  81   IQRLDFQTYR-----------FDKKMLLAFHGWYDYSFSNN--RDIKDVEKLKKTFWFD   126
             QR +   R              ++  ++ GWYDYS +      KD ++K  F F
Sbjct:  75   FQRFNKLVKRAGAIPLMEGPLILEEIGIVGVPGWYDYSLAPGYLNMTKDEYEIK-AFGFR  133

Query: 127   RR-----LKRPNNDVTIQASILKRLDEILAKVDSS--NIIIAMHFVPHKQFTMT--HPRF  177
             R     +K  +D +    L  L++ ++++  S  ++I+A+HF P K      +P
Sbjct: 134   RLEDADYIKSSLSDEELVRWNLNLLEKFISEIRESVNDVILALHFAPFKDSLKYTGNPEI  193

Query: 178   SPFNAFLGSQAYHDLFQKYHIKDVVFGHAHRSFGDVKIGET                    218
                F+A++GSQ + +    +++I  +V GH HRS +   IG+T
Sbjct: 194   DYFSAYMGSQRFGEFALRHNIGLIVHGHTHRSI-EYYIGKT                    233
```

No corresponding DNA sequence was identified in *S. pyogenes*.

Example 1765

A DNA sequence (GBSx1872) was identified in *S. agalactiae* <SEQ ID 5485> which encodes the amino acid sequence <SEQ ID 5486>. Analysis of this protein sequence reveals the following:

Possible site: 44
>>> Seems to have no N-terminal signal sequence
INTEGRAL   Likelihood = -2.18   Transmembrane 173-189 (173-189)
----- Final Results -----
   bacterial membrane --- Certainty = 0.1871 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database.

```
>GP:CAB16056 GB:Z99124 fructose-1,6-bisphosphatase [Bacillus subtilis]
Identities = 314/642(48%), Positives = 446/642 (68%), Gaps = 7/642 (1%)
Query:   2   SNFYKLLKEKFPRKEDIVTEMINLEAICQLPKGTEYFISDLHGEYDAVDYLLRTGAGSIR   61
             S +  LL +K+  +E +VTE+INL+AI  LPKGTE+F+SDLHGEY A  ++LR G+G ++
Sbjct:  33   SKYLDLLAQKYDCEEKVVTEIINLKAILNLPKGTEHFVSDLHGEYQAFQHVLRNGSGRVK   92

Query:  62   AKLLDCFDWQKIVAVDLDDFCILLYYPKEKLAFDKMNLSASAYKTKLW-EMIPLQIQVLK  120
             K+ D F    I   ++D+   L+YYP++KL    K +  A      + + E I    I+++
Sbjct:  93   EKIRDIFSGV-IYDREIDELAALVYYPEDKLKLIKHDFDAKEALNEWYKETIHRMIKLVS  151

Query: 121   YFSSKYTKSKVRKQLSGKFAYIIEELLAEIDRNPEKKSYFDTIIEKLFELDQVEDLIIVL  180
             Y SSKYT+SK+RK L  +FAYI EELL + ++    K+ Y+  II+++  EL Q + LI  L
Sbjct: 152   YCSSKYTRSKLRKALPAQFAYITEELLYKTEQAGNKEQYYSEIIDQIIELGQADKLITGL  211

Query: 181   SQTIQVLIIDHLHVVGDIYDRGRYPDRILNRLMAFPNLDIQWGNHDVTWMGAASGSYLCM  240
             + ++Q  L++DHLHVVGDIYDRG   PDRI+   L+ +  ++DIQWGNHDV  W+GA SGS +C+
Sbjct: 212   AYSVQRLVVDHLHVVGDIYDRGPQPDRIMEELINYHSVDIQWGNHDVLWIGAYSGSKVCL  271
```

```
                            -continued
Query:  241 VNVIRIAARYNNITLIEDRYGINLRRLVDYSRRYYEPLPSFVPILDGEEMTHPDELDLLN 300
            N+IRI ARY+N+ +IED YGINLR L++ + +YY+ P+F P  D E    DE+ +
Sbjct:  272 ANIIRICARYDNLDIIEDVYGINLRPLLNLAEKYYDDNPAFRPKAD--ENRPEDEIKQIT 329

Query:  301 MIQQATAILQFKLEAQLIDRRPEFQMHNRQLINQVNYKDLSISIKEVVHQLKDFNSRCID 360
            I QA A++QFKLE+ +I RRP F M R L+ +++Y   I++    +QL++     I+
Sbjct:  330 KIHQAIAMIQFKLESPIIKRRPNFNMEERLLLEKIDYDKNEITLNGKTYQLENTCFATIN 389

Query:  361 SKNPSRLTSEEEELLQQLMIAFQTSESLKKHIDFLFEKGSMYLTYNDNLLFHGCIPMHSN 420
            + P +L   EE E++ +L+ + Q SE L +H++F+ +KGS+YL YN NLL HGCIP+ N
Sbjct:  390 PEQPDQLLEEEAEVIDKLLFSVQHSEKLGRHMNFMMKKGSLYLKYNGNLLIHGCIPVDEN 449

Query:  421 GDFKSFKIAGKTYGGRDLLDLFESQIRLAYARPEKHDDLATDIIWYLWCGENSSLFGKNA 480
            G+ ++  I  K Y GR+LLD+FE   +R A+A PE+ DDLATD+ WYLW GE SSLFGK A
Sbjct:  450 GNMETMMIEDKPYAGRELLDVFERFLREAFAHPEETDDLATDMAWYLWTGEYSSLFGKRA 509

Query:  481 MTTFERYYVSDKVTHQERKNPYFKLRDKDDICTALLQEFDL-PKFGHIVNGHTPVKEKNG 539
            MTTFERY++ +K TH+E+KNPY+ LR+ +  C   +L EF L P  GHI+NGHTPVKE  G
Sbjct:  510 MTTFERYFIKEKETHKEKKNPYYYLREDEATCRNILAEFGLNPDHGHTINGHTPVKEIEG 569

Query:  540 EQPIKANGKMLVIDGGFAKGYQKNTGLAGYTLIYNSYGIQLISHLPFTSIEEVLSGTNYI 599
            E PIKANGKM+VIDGGF+K YQ   TG+AGYTL+YNSYG+QL++H  F S  EVLS    +
Sbjct:  570 EDPIKANGKMIVIDGGFSKAYQSTTGIAGYTLLYNSYGMQLVAHKHFNSKAEVLSTGTDV 629

Query:  600 IDTKRLVEEAKDRILVKDTTIGQKLTKEIKDLDHL--YRHFQ                  639
            +   KRLV++  +R  VK+T +G++L +E+  L+ L  YR+ +
Sbjct:  630 LTVKRLVDKELERKKVKETNVGEELLQEVAILESLREYRYMK                  671
```

No corresponding DNA sequence was identified in *S. pyogenes*.

Figure 168:
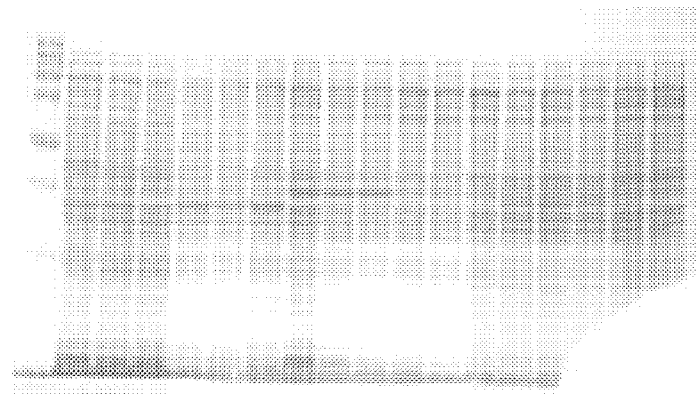

SEQ ID 5486 (GBS197) was expressed in *E. coli* as a His-fusion product. SDS-PAGE analysis of total cell extract is shown in FIG. 168 (lane 17 & 18; MW 89 kDa) and in FIG. 169 (lane 2; MW 89 kDa). It was also expressed in *E. coli* as a GST-fusion product. SDS-PAGE analysis of total cell extract is shown in FIG. 37 (lane 6; MW 99 kDa).

Purified Thio-GBS197-His is shown in FIG. 244, lane 6.

Based on this analysis, it was predicted that this protein and its epitopes, could be useful antigens for vaccines or diagnostics.

Possible site: 24

>>> Seems to have no N-terminal signal sequence

----- Final Results ----- bacterial cytoplasm --- Certainty = 0.2433 (Affirmative) <succ> bacterial membrane --- Certainty = 0.0000 (Not Clear) <succ> bacterial outside --- Certainty = 0.0000 (Not Clear) <succ>

Example 1766

A DNA sequence (GBSx1873) was identified in *S. agalactiae* <SEQ ID 5487> which encodes the amino acid sequence <SEQ ID 5488>. Analysis of this protein sequence reveals the following:

The protein has homology with the following sequences in the GENPEPT database.

```
>GP:CAB12719 GB:Z99108 alternate gene name: ygaP-similar to
hypothetical proteins [Bacillus subtilis]
Identities = 176/367 (47%), Positives = 240/367(64%), Gaps = 6/367 (1%)
Query:    3 IKAEIQKLAKEIGISKIGETTADNFDYLEKSLRASVEEGRNSGFEHKVIEDRIYPERLLE   62
            +K E+ + AK IG+ KIGFTTAD FD L+ L       G  SGFE  IE R+ P+ LL
Sbjct:   55 LKEELIEYAKSIGVDKIGFTTADTFDSLKDRLILQESLGYLSGFEEPDIEKRVTPKLLLP  114

Query:   63 SAKTIISIGVAYPHKLPQQPQKT-SYKRGKITPNSWGLDYHYVVGEKLDRLSKGIEELCR  121
            +AK+I++I +AYP ++    P+ T + +RG   SWG DYH V+ EKLD L    ++
Sbjct:  115 KAKSIVAIALAYPSRMKDAPRSTRTERRGIFCRASWGKDYHDVLREKLDLLEDFLKSKHE  174

Query:  122 DFPLQQKAMVDTGALVDTAVAQRAGIGFIGKNGLVISKEYGSYMFLGELITNLEIEPDKP  181
            D  ++ K+MVDTG L D AVA+RAGIGF  KN ++ + EYGSY++L E+ITN+   EPD P
Sbjct:  175 D--IRTKSMVDTGELSDRAVAERAGIGFSAKNCMITTPEYGSYVVYLAEMITNIPFEPDVP  232

Query:  182 VDYDCGDCRRCLDACPTSCLIGDGSMNAKRCLSFQTQDKGMMDIEFRKKIKTVIYGCDIC  241
            ++   CG C +CLDACPT  L+ G +NA+RC+SF TQ KG + EFR KI   +YGCD C
Sbjct:  233 IEDMCGSCTKCLDACPTGALVNPGQLNAQRCISFLTQTKGFLPDEFRTKIGNRLYGCDTC  292

Query:  242 QICCPYNKGINNPLATEI--DPELAQPELIPFLSLSNGQFKEKFGMIAGSWRGKNILQRN  299
            Q  CP NKG + L+ E+    DPE+A+P L P L++SN +FKEKFG ++GSWRGK +QRN
Sbjct:  293 QTVCPLNKGKDFHLHPEMEPDPEIAKPLLKPLLAISNREFKEKFGHVSGSWRGKKPIQRN  352

Query:  300 AIIALANAHDKTAVVKLIEIIDKNNNPIHTATAIWALGEIVKKPNDEILEFMSNLTLKDE  359
            AI+ALA+   D +A+ +L E++  K+ P+   TA WA+G+I    E LE      KDE
Sbjct:  353 AILALAHFKDASALPELTELMHKDPRPVIRGTAAWAIGKIGDPAYAEELEKALEKE-KDE  411
```

```
Query: 360  DSRKELE                                                  366
            +++ E+E
Sbjct: 412  EAKLEIE                                                  418
```

A related DNA sequence was identified in *S. pyogenes* <SEQ ID 5489> which encodes the amino acid sequence <SEQ ID 5490>. Analysis of this protein sequence reveals the following:

```
Possible site: 21
>>> Seems to have no N-terminal signal sequence
----- Final Results -----
    bacterial cytoplasm --- Certainty = 0.3337 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
Identities = 363/374 (97%), Positives = 367/374 (98%)
Query:   1  MDIKAEIQKLAKEIGISKIGFTTADNFDYLEKSLRASVEEGRNSGFEHKVIEDRIYPERL   60
            M IKAEI+ LAKEIGISKIGFTTADNFDYLEKSLRASVEEGRNSGFEHKVIEDRIY ERL
Sbjct:  18  MTIKAEIKALAKEIGISKIGFTTADNFDYLEKSLRASVEEGRNSGFEHKVIEDRIYTERL   77

Query:  61  LESAKTIISIGVAYPHKLPQQPQKTSYKRGKITPNSWGLDYHYVVGEKLDRLSKGIEELC  120
            LESAKTIISIGVAYPHKLPQQPQKT YKRGKITP+SWGLDYHYVVGEKLDRLSKGIEELC
Sbjct:  78  LESAKTIISIGVAYPHKLPQQPQKTPYKRGKITPSSWGLDYHYVVGEKLDRLSKGIEELC  137

Query: 121  RDFPLQQKAMVDTGALVDTAVAQRAGIGFIGKNGLVISKEYGSYMFLGELITNLEIEPDK  180
            RDFPLQQKAMVDTGALVDTAVAQRAGIGFIGKNGLVISKEYGSYMFLGELITNLEIEPDK
Sbjct: 138  RDFPLQQKAMVDTGALVDTAVAQRAGIGFIGKNGLVISKEYGSYMFLGELITNLEIEPDK  197

Query: 181  PVDYDCGDCRRCLDACPTSCLIGDGSMNAKRCLSFQTQDKGMMDIEFRKKIKTVIYGCDI  240
            PVDYDCGDCRRCLDACPTSCLIGDGSMNAKRCLSFQTQDKGMMDIEFRKKIKTVIYGCDI
Sbjct: 198  PVDYDCGDCRRCLDACPTSCLIGDGSMNAKRCLSFQTQDKGMMDIEFRKKIKTVIYGCDI  257

Query: 241  CQICCPYNKGINNPLATEIDPELAQPELIPFLSLSNGQFKEKFGMIAGSWRGKNILQRNA  300
            CQICCPYNKGINN  ATEIDPELAQPELIPFLSLSNG+FKEKFGMIAGSWRGKNILQRNA
Sbjct: 258  CQICCPYNKGINNSPATEIDPELAQPELIPFLSLSNGKFKEKFGMIAGSWRGKNILQRNA  317

Query: 301  IIALANAHDKTAVVKLIEIIDKNNNPIHTATAIWALGEIVKKPNDEILEFMSNLTLKDED  360
            IIALANAHDKTAVVKLIEIIDKNNNPIHTATAIWALGEIVKKPNDEIL FMS+LTLKDED
Sbjct: 318  IIALANAHDKTAVVKLIEIIDKNNNPIHTATAIWALGEIVKKPNDEILAFMSHLTLKDED  377

Query: 361  SRKELELIRHKWQF                                                374
            SRKELELIRHKWQF
Sbjct: 378  SRKELELIRHKWQF                                                391
```

Example 1767

A DNA sequence (GBSx1874) was identified in *S. agalactiae* <SEQ ID 5491> which encodes the amino acid sequence <SEQ ID 5492>. This protein is predicted to be peptide chain release factor 2, fragment (prfB). Analysis of this protein sequence reveals the following:

```
Possible site: 23
>>> Seems to have no N-terminal signal sequence
----- Final Results -----
    bacterial cytoplasm --- Certainty = 0.4903 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

Based on this analysis, it was predicted that these proteins and their epitopes could be useful antigens for vaccines or diagnostics.

```
>GP:AAC67303 GB:AF017113 putative peptide chain release factor RF-2
[Bacillus subtilis]
Identities = 194/336 (57%), Positives = 251/336 (73%), Gaps = 2/336 (0%)
Query:   2  EEEIALLENQMTEPDFWNDNIAAQKTSQELNELKGKYDTFHNMQELSDETELLLEMLDE-   60
            E  IA L+ QM +P+FWND   AQ    E NLK    +++  + E   +E ++  ++L E
Sbjct:  30  EARIAELDEQMADPEFWNDQQKAQTVINEANGLKDYVNSYKKLNESHEELQMTHDLLKEE   89

Query:  61  -DDSLKEELEENLMQLDKIMGAYEMTLLLSEPYDHNNAILEIHPGSGGTEAQDWGDLLLR  119
             D  L+ ELE+ L  L K    +E+  LLLSEPYD NNAILE+HPG+GGTE+QDWG +LLR
Sbjct:  90  PDTDLQLELEKELKSLTKEFNEFELQLLLSEPYDKNNAILELHPGAGGTESQDWGSMLLR  149

Query: 120  MYTRFGNANGFKVEVLDYQAGDEAGIKSVTLSFEGPNAYGLLKSEMGVHRLVRISPFDSA  179
```

-continued
```
             MYTR+G   GFKVE LDY  GDEAGIKSVTL  +G NAYG LK+E GVHRLVRISPFDS+
Sbjct: 150   MYTRWGERRGFKVETLDYLPGDEAGIKSVTLLIKGHNAYGYLKAEKGVHRLVRISPFDSS  209

Query: 180   KRRHTSFASVEVMPELDDTIEVEVRDDDIKMDTFRSGGAGGQNVNKVSTGVRLTHIPTGI   239
             RRHTSF S EVMPE +D I++++R +DIK+DT+R+ GAGGQ+VN   + VR+TH+PT +
Sbjct: 210   GRRHTSFVSCEVMPEFNDEIDIDIRTEDIKVDTYRASGAGGQHVNTTDSAVRITHLPTNV   269

Query: 240   VVSSTVDRTQYGNRDRAMKMLQAKLYQLEQEKKAQEVDALKGDKKEITWGSQIRSYVFTP   299
             VV+   +R+Q  NR+RAMKML+AKLYQ E++    E+D ++G++KEI WGSQIRSYVF P
Sbjct: 270   VVTCQTERSQIKNRERAMKMLKAKLYQRRIEEQQAELDEIRGEQKEIGWGSQIRSYVFHP   329

Query: 300   YTMVKDHRTNFELAQVDKVMDGEINGFIDAYLKWRI                          335
             Y+MVKDHRTN E+  V  VMDG+I+ FIDAYL+ ++
Sbjct: 330   YSMVKDHRTNTEMGNVQAVMDGDIDTFIDAYLRSKL                          365
```

A related DNA sequence was identified in S. pyogenes <SEQ ID 5493> which encodes the amino acid sequence <SEQ ID 5494>. Analysis of this protein sequence reveals the following:

Possible site: 23
>>> Seems to have no N-terminal signal sequence
----- Final Results -----
   bacterial cytoplasm --- Certainty = 0.4779 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 334/337 (99%), Positives = 336/337 (99%)
Query:   1   MEEEIALLENQMTEPDFWNDNIAAQKTSQELNELKGKYDTFHNMQELSDETELLLEMLDE   60
             +EEEIALLEN MTEPDFWNDNIAAQKTSQELNELKGKYDTFHNMQELSDETELLLEMLDE
Sbjct:   1   LEEEIALLENHMTEPDFWNDNIAAQKTSQELNELKGKYDTPHNMQELSDETELLLEMLDE   60

Query:  61   DDSLKEELEENLMQLDKIMGAYEMTLLLSEPYDHNNAILEIHPGSGGTEAQDWGDLLLRM  120
             DDSLKEELEENLMQLDKIMGAYEMTLLLSEPYDHNNAILEIHPGSGGTEAQDWGDLLLRM
Sbjct:  61   DDSLKEELEENLMQLDKIMGAYEMTLLLSEPYDHNNAILEIHPGSGGTEAQDWGDLLLRM  120

Query: 121   YTRFGNANGFKVEVLDYQAGDEAGIKSVTLSFEGPNAYGLLKSEMGVHRLVRISPFDSAK  180
             YTRFGNANGFK+EVLDYQAGDEAGIKSVTLSFEGPNAYGLLKSEMGVHRLVRISPFDSAK
Sbjct: 121   YTREGNANGFKIEVLDYQAGDEAGIKSVTLSFEGPNAYGLLKSEMGVHRLVRISPFDSAK  180

Query: 181   RRHTSFASVEVMPELDDTIEVEVRDDDIKMDTFRSGGAGGQNVNKVSTGVRLTHIPTGIV  240
             RRHTSFASVEVMPELDDTIEVEVRDDDIKMDTFRSGGAGGQNVNKVSTGVRLTHIPTGIV
Sbjct: 181   RRHTSFASVEVMPELDDTIEVEVRDDDIKMDTFRSGGAGGQNVNKVSTGVRLTHIPTGIV  240

Query: 241   VSSTVDRTQYGNRDRAMKMLQAKLYQLEQEKKAQEVDALKGDKKEITWGSQIRSYVFTPY  300
             VSSTVDRTQYGNRDRAMKMLQAKLYQLEQEKKAQEVDALKGDKKEITWGSQIRSYVFTPY
Sbjct: 241   VSSTVDRTQYGNRDRAMKMLQAKLYQLEQEKKAQEVDALKGDKKEITWGSQIRSYVFTPY  300

Query: 301   TMVKDHRTNFELAQVDKVMDGEINGFIDAYLKWRIED                         337
             TMVKDHRTNFELAQVDKVMDGEINGFIDAYLKWRIED
Sbjct: 301   TMVKDHRTNFELAQVDKVMDGEINGFIDAYLKWRIED                         337
```

Based on this analysis, it was predicted that these proteins and their epitopes could be useful antigens for vaccines or diagnostics.

Example 1768

A DNA sequence (GBSx1875) was identified in S. agalactiae <SEQ ID 5495> which encodes the amino acid sequence <SEQ ID 5496>. This protein is predicted to be cell-division ATP-binding protein (ftsE). Analysis of this protein sequence reveals the following:

Possible site: 42
>>> Seems to have no N-terminal signal sequence
----- Final Results -----
   bacterial cytoplasm --- Certainty = 0.3928 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:AAC67262 GB:AF017113 cell division ATP-binding protein [Bacillus subtilis]
Identities = 138/228 (60%), Positives = 179/228 (77%)
Query:   3   LIEMSGVTKKYRRSTTALRNLNLSIQQGEFVYLVGPSGAGKSSLIRLLYREEKLSSGRLK   62
             +IEM   V K Y    AL  ++++I  GEFVY+VGPSGAGKS+ I+++YREEK + G++
Sbjct:   1   MIEMKEVYKAYPNGVKALNGISVTIHPGEFVYVVGPSGAGKSTFIKMIYREEKPTKGQIL   60
```

-continued
```
Query:   63 VGEFNLNKLKRRQIPILRRSIGVVFQDYKLLPTKTVYENVAFAMQVIGAKRRHIKKRVPE  122
             +   +L  +K ++IP +RR IGVVFQD+KLLP  TV+ENVAFA++VIG +   IKKRV E
Sbjct:   61 INHKDLATIKEKEIPFVRRKIGVVFQDFKLLPKLTVFENVAFALEVIGEQPSVIKKRVLE  120

Query:  123 VLELVGLKHKMRSFPTQLSGGEQQRVAIARAIVNNPKLLIADEPTGNLDPEIAWEIMHLL  182
             VL+LV LKHK R FP QLSGGEQQRV+IAR+IVNNP ++IADEPTGNLDP+ +WE+M  L
Sbjct:  121 VLDLVQLKHKARQFPDQLSGGEQQRVSIARSIVNNPDVVIADEPTGNLDPDTSWEVMKTL  180

Query:  183 ERINLQGTTVLMATHNSQIVNTLRHRVIEIEAGSVIRDEEKGEYGYHD              230
             E IN +GTTV+MATHN +IVNT++ RVI IE G ++RDE +GEYG +D
Sbjct:  181 EEINNRGTTVVMATHNKEIVNTMKKRVIAIEDGIIVRDESRGEYGSYD              228
```

A related DNA sequence was identified in S. pyogenes <SEQ ID 5497> which encodes the amino acid sequence <SEQ ID 5498>. Analysis of this protein sequence reveals the following:

Possible site: 47
>>> Seems to have no N-terminal signal sequence
----- Final Results -----
  bacterial cytoplasm --- Certainty = 0.3728 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

```
Identities =191/230 (8390, Positives =214/230(93%)
Query:    1 MALIEMSGVTKKYRRSTTALRNLNLSIQQGEFVYLVGPSGAGKSSLIRLLYREEKLSSGR    60
            MALIEMSGVTKKYRRSTTALR++N+S+ QGEFVYLVGPSGAGKS+ I+LLYREE+L++G+
Sbjct:    1 MALIEMSGVTKKYRRSTTALRDVNVSVNQGEFVYLVGPSGAGKSTFIKLLYREEQLTTGK    60

Query:   61 LKVGEFNLNKLKRRQIPILRRSIGVVFQDYKLLPTKTVYENVAFAMQVIGAKRRHIKKRV   120
            L VGEFNL KLK R +PILRR IGVVFQDYKLLP KTV+ENVA+AM+VIG KRRHIKKRV
Sbjct:   61 LYVGEFNLTKLKARDVPILRRHIGVVFQDYKLLPRKTVFENVAYAMEVIGEKRRHIKKRV   120

Query:  121 PEVLELVGLKHKMRSFPTQLSGGEQQRVAIARAIVNNPKLLIADEPTGNLDPEIAWEIMH   180
            PEVL+LVGLKHKMRSFP+QLSGGEQQRVAIARAIVNNPKLLIADEPTGNLDPEI+WEIM
Sbjct:  121 PEVLDLVGLKHKMRSFPSQLSGGEQQRVAIARAIVNNPKLLIADEPTGNLDPEISWEIMQ   180

Query:  181 LLERINLQGTTVLMATHNSQIVNTLRHRVIEIEAGSVIRDEEKGEYGYHD              230
            LLERIN+QGTT+LMATHNS IVNT RHRV+ IE G ++RDEEKG+YGY D
Sbjct:  181 LLERINVQGTTILMATHNSHIVNTFRHRVVAIEDGRIVRDEEKGDYGYDD              230
```

<SEQ ID 5500>. This protein is predicted to be ftsE protein (ftsX). Analysis of this protein sequence reveals the following:

Possible site: 45
>>> Seems to have no N-terminal signal sequence
  INTEGRAL    Likelihood = −10.77   Transmembrane 296-312 (291-322)
  INTEGRAL    Likelihood = −9.24    Transmembrane 203-219 (198-228)
  INTEGRAL    Likelihood = −6.16    Transmembrane 49-65 (40-68)
  INTEGRAL    Likelihood = −3.40    Transmembrane 255-271 (252-273)
----- Final Results -----
  bacterial membrane --- Certainty = 0.5310 (Affirmative) <succ>
  bacterial outside --- Certainty = 0.0000 (Not Clear) <succ>
  bacterial cytoplasm --- Certainty = 0.0000 (Not Clear) <succ>

Based on this analysis, it was predicted that these proteins and their epitopes could be useful antigens for vaccines or diagnostics.

Example 1769

A DNA sequence (GBSx1876) was identified in S. agalactiae <SEQ ID 5499> which encodes the amino acid sequence A related GBS nucleic acid sequence <SEQ ID 9629> which encodes amino acid sequence <SEQ ID 9630> was also identified.

The protein has homology with the following sequences in the GENPEPT database.

```
>GP:AAC67264 GB:AF017113 cell division protein [Bacillus subtilis]
Identities = 112/311 (36%), Positives = 182/311 (58%), Gaps = 31/311(9%)
Query:   27 RHFWESLKNLKRNFWMTFASVTSVTITLLLVGLFSSVLLNVEKLTTDVSGNFTISAFLNV   86
            RH   ES K+L RN WMTFAS+++VT+TL+LVG+F  ++LN+  + T+     I   +++
Sbjct:    7 RHLRESFKSLGRNTWMTFASISAVTVTLILVGVFLVIMLNLNNMATNAEKQVEIKVLIDL   66

Query:   87 DSTDAQKQVKDKDGKLKDNPDYHKVYDKIKRISGVEKVTYSSKAEQLKEVQKEYGSDVID  146
             +            D K +D     K+  + IK + G++ VT+SSK ++L ++    +G
Sbjct:   67 TA----------DQKAQD-----KLQNDIKELKGIQSVTFSSKEKELDQLVDSFGDSGKS  111

Query:  147 DTYKDA---LLDVYVVGTSSAKVSKSVSEAIGRIEGV---DYTKEPIDST-KLSNLTDNI  199
            T KD     L D +VV T+     + +V++ I +++  V     Y KE +      K+   ++ NI
Sbjct:  112 LTMKDQENPLNDAFVKTTDPHDTPNVAKKIEKMDHVYKVTYGKEEVSRLFKVVGVSRNI   171
```

```
Query: 200  RIWGFGGVALLIVL---AIFLISNTIRMSIMSRRTDIEIMRLVGAKNSYIRGPFFFEGAW  256
            G+AL+I L    A+FLISNTI+++I +RR +IEIM+LVGA N +IR PFF EG
Sbjct: 172  ------GIALIIGLVFTAMFLISNTIKITIFARRKEIEIMKLVGATNWFIRWPFFLEGLL  225

Query: 257  VGILGAIVPSLIFYFGYQFVFNKFNPKFETSHVSLYPMDIMVPAIIGGMVIIGIIIGSLG  316
            +G+ G+++P +   YQ+V    PK  +S VSL P +  V +    ++ IG +IG G
Sbjct: 226  LGVFGSVIPIALVLSTYQYVIGWVVPKVQGSFVSLLPYNPFVFQVSLVLIAIGAVIGVWG  285

Query: 317  SVLSMRRYLKI                                                  327
            S+ S+R++L++
Sbjct: 286  SLTSIRKFLRV                                                  296
```

A related DNA sequence was identified in *S. pyogenes* <SEQ ID 5501> which encodes the amino acid sequence <SEQ ID 5502>. Analysis of this protein sequence reveals the following:

```
Possible site: 51
>>> Seems to have no N-terminal signal sequence
INTEGRAL    Likelihood = –7.70    Transmembrane 195-211 (189-219)
INTEGRAL    Likelihood = –6.74    Transmembrane 39-55 (30-58)
INTEGRAL    Likelihood = –5.52    Transmembrane 294-310 (288-314)
INTEGRAL    Likelihood = –1.49    Transmembrane 246-262 (245-263)
----- Final Results -----
   bacterial membrane --- Certainty = 0.4079 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP:AAC67264 GB:AF017113 cell division protein [Bacillus subtilis]
Identities = 117/311 (37%), Positives = 184/311 (58%), Gaps = 19/311 (6%)
Query:  11  MIRYFFRHIWESIKNLKRNFWMTFASVSMVAVTLTLVGVFAATLLNIQRVASGVENNVHI   70
            MI+   RH+ ES K+L RN WMTFAS+S V VTL LVGVF  +LN+ +A+ E  V I
Sbjct:   1  MIKILGRHLRESFKSLGRNTWMTFASISAVTVTLILVGVFLVIMLNLNNMATNAEKQVEI   60

Query:  71  NTYLQVDSTDAAKVIQNTAGEPVNNDNYHSVYDKIAQIKGVKKITFSSKDEQLKKLQETL  130
             + + +   A+    + + ND         I ++KG++ +TFSSK+++L +L ++
Sbjct:  61  KVLIDLTADQKAQ-------DKLQND--------IKELKGIQSVTFSSKEKELDQLVDSF  105

Query: 131  GDVWN---MYDQDTNPLQDIYLIETQTPKQVKAITKKIRTIEGVEAADYGGINSDKLFKF  187
            GD    M DQ+ NPL D ++++T  P    + KKI ++ V    YG      +LFK
Sbjct: 106  GDSGKSLTMKDQE-NPLNDAFVVKTTDPHDTPNVAKKIEKMDHVYKVTYGKEEVSRLFKV  164

Query: 188  STLIQTWGLIGTAMLLFVAVFLISNTIRMTIMSRKRDIEIMRLVGAKNSYIRGPFFFEGA  247
             + +  G+    L+F A+FLISNTI++TI +R+++IEIM+LVGA N +IR PFF EG
Sbjct: 165  VGVSRNIGIALIIGLVFTAMFLISNTIKITIFARRKEIEIMKLVGATNWFIRWPFFLEGL  224

Query: 248  WVGLLGAVLPSLLIYYGYDLVYKHFAQELQRNNLSMYPLDPYVYYLIGALFVIGIMIGSL  307
             +G+ G+V+P L+   Y  V    ++Q + +S+ P +P+V+ +      L   IG +IG
Sbjct: 225  LLGVFGSVIPIALVLSTYQYVIGWVVPKVQGSFVSLLPYNPFVFQVSLVLIAIGAVIGVW  284

Query: 308  GSVLSMRRYLK                                                  318
            GS+ S+R++L+
Sbjct: 285  GSLTSIRKFLR                                                  295
```

An alignment of the GAS and GBS proteins is shown below.

```
Identities = 173/318 (54%), Positives = 238/318 (74%), Gaps = 5/318 (1%)
Query:  13  MKRRENMVIMIN-FFRHFWESLKNLKRNFWMTFASVTSVTITLLLVGLFSSVLLNVEKLT   71
            MK++E MV MI  FFRH WES+KNLKRNFWMTFASV+ V +TL LVG+F++ LLN++++
Sbjct:   2  MKKKEIMVTMIRYFFRHIWESIKNLKRNFWMTFASVSMVAVTLTLVGVFAATLLNIQRVA   61

Query:  72  TDVSGNFTISAFLNVDSTDAQKQVKDKDGKLKDNPDYHKVYDKIKRISGVEKVTYSSKAE  131
            + V  N  I+ +L VDSTDA K +++  G+  +N +YH VYDKI +I GV+K+T+SSK E
Sbjct:  62  SGVENNVHINTYLQVDSTDAAKVIQNTAGEPVNNDNYHSVYDKIAQIKGVKKITFSSKDE  121

Query: 132  QLKEVQKEYGSDVID--DTYKDALLDVYVVGTSSAKVSKSVSEAIGRIEGVDYTKEP-ID  188
            QLK++Q+  G DV +  D   + L D+Y++  T +  K  K++++ I   IEGV+    I+
```

```
                                -continued
Sbjct: 122  QLKKLQETLG-DVWNMYDQDTNPLQDIYLIETQTPKQVKAITKKIRTIEGVEAADYGGIN  180

Query: 189  STKLSNLTDNIRIWGFGGVALLIVLAIFLISNTIRMSIMSRRTDIEIMRLVGAKNSYIRG  248
            S KL    + I+ WG  G A+L+ +A+FLISNTIRM+IMSR+ DIEIMRLVGAKNSYIRG
Sbjct: 181  SDKLFKFSTLIQTWGLIGTAMLLFVAVFLISNTIRMTIMSRKRDIEIMRLVGAKNSYIRG  240

Query: 249  PFFFEGAWVGILGAIVPSLIFYFGYQFVFNKFNPKFETSHVSLYPMDIMVPAIIGGMVII  308
            PFFFEGAWVG+LGA++PSL+ Y+GY  V+  F  + + +++S+YP+D  V   +IG + +I
Sbjct: 241  PFFFEGAWVGLLGAVLPSLLIYYGYDLVYKHFAQELQRNNLSMYPLDPYVYYLIGALFVI  300

Query: 309  GIIIGSLGSVLSMRRYLK  326
            GI+IGSLGSVLSMRRYLK
Sbjct: 301  GIMIGSLGSVLSMRRYLK  318
```

Based on this analysis, it was predicted that these proteins and their epitopes could be useful antigens for vaccines or diagnostics.

Example 1770

A DNA sequence (GBSx1877) was identified in *S. agalactiae* <SEQ ID 5503> which encodes the amino acid sequence <SEQ ID 5504>. This protein is predicted to be carboxymethylenebutenolidase-related protein. Analysis of this protein sequence reveals the following:

Possible site: 24
>>> Seems to have a cleavable N-term signal seq.
----- Final Results -----
  bacterial outside --- Certainty = 0.3000 (Affirmative) <succ>
    bacterial membrane --- Certainty = 0.0000 (Not Clear) <succ>
      bacterial cytoplasm --- Certainty = 0.0000 (Not Clear) <succ>

The protein has homology with the following sequences in the GENPEPT database.

```
>GP:AAF10898 GB:AE001979 carboxymethylenebutenolidase-related
protein [Deinococcus radiodurans]
Identities = 65/183 (35%), Positives = 98/183 (53%), Gaps = 3/183 (1%)
Query:  56  SKGKVKANIIFYQGALVEEEAYSQLARDLADKGDNTYILKTPLNLPVLSPHKAKTIINQN  115
            +  +VK  ++FY G  V   +AY  L R LA +G  T I    PL+L +     +A+ +I +
Sbjct: 100  ASAEVKTLLVFYPGGRVRPQAYEWLGRALAVRGVQTVIPAFPLDLAITGTERAEGLIARY  159

Query: 116  HL-TNVYLAGHSLGGVVASQNAKVAP--VRGLILLASYPSRKSDLSHKNLRVLSITASND  172
                  V LAGHSLGG VA+Q A + P    + GL+LLA+YP+    +L     LS+ A  D
Sbjct: 160  GAGKRVVLAGHSLGGTVAAQYAALRPDKIDGLLLLAAYPAPNVNLHDARFPALSLLAEKD  219

Query: 173  HILNWEKYEEAKKRLPNSSTFRTIVGGNHSRFGNYGHQKGDGKATLSHKSSEKQLATFIS  232
             + +         +RLP ++    + G   HS FG YG Q+GDG   T+S   +E+++   +
Sbjct: 220  GVADAGLVRGGLERLPKNTRLTVLPGAVHSFFGRYGPQQGDGVPTVSRARAEREIVQAVE  279

Query: 233  NFI  235
            FI
Sbjct: 280  TFI  282
```

No corresponding DNA sequence was identified in *S. pyogenes*.

SEQ ID 5504 (GBS158) was expressed in *E. coli* as a His-fusion product. SDS-PAGE analysis of total cell extract is shown in FIG. 26 (lane 4; MW 27 kDa). It was also expressed in *E. coli* as a GST-fusion product. SDS-PAGE analysis of total cell extract is shown in FIG. 37 (lane 5; MW 52 kDa).

Figure 113:
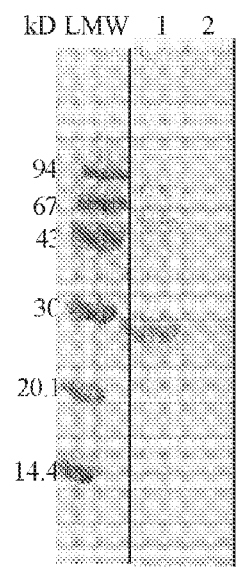

The GBS158-GST fusion product was purified (FIG. 113; see also FIG. 201, lane 4) and used to immunise mice (lane 1+2 product; 14.5 μg/mouse). The resulting antiserum was used for Western blot, FACS, and in the in vivo passive protection assay (Table III). These tests confirm that the protein is immunoaccessible on GBS bacteria and that it is an effective protective immunogen.

Based on this analysis, it was predicted that this protein and its epitopes, could be useful antigens for vaccines or diagnostics.

Example 1771

A DNA sequence (GBSx1878) was identified in *S. agalactiae* <SEQ ID 5505> which encodes the amino acid sequence <SEQ ID 5506>. Analysis of this protein sequence reveals the following:

Possible site: 54
>>> Seems to have no N-terminal signal sequence

-continued

----- Final Results -----
  bacterial cytoplasm --- Certainty = 0.0281 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:BAB06539 GB:AP001516 unknown conserved protein [Bacillus halodurans]
Identities = 83/197 (42%), Positives = 114/197 (57%), Gaps = 4/197 (2%)
Query:  35  NTYYLVNDQAV-ILIDPGSNGQEIIAKIKSFEKPLVAILLTHTHYDHIFSLDLVRDTFDN  93
            N Y   NDQ   I+ DPG  +++I ++   +  +AILLTH H+DHI +++ VR+TF +
Sbjct:  14  NWYIQTNDQGEGIIFDPGGEVEKLITWLRDRQITPLAILLTHAHFDHIGAVEDVRNTF-H  72
```

-continued

```
Query:   94 PPVYVSEKEAAWLSSPDDNLSGLGRHDDIINVIARPAENFFKLKQPYQLNGFEFTVLPTP  153
             PVY+ E E  WL  P  N S L      I   AR AE+    +Q   +  F  +VL TP
Sbjct:   73 IPVYIHENEKEWLIDPQRNGSSLFIPGSSIK--AREAEHLITGEQDLSIGSFSYQVLETP  130

Query:  154 GHSWGGVSFVFHSDELVVTGDALFRETIGRTDLPTSNFEDLITGIRQELFTLPSHYSVHP  213
            GHS  G  +S+       D++V +GDALF  +IGRTDLP  +  + L+   I   +L    LP   +V
Sbjct:  131 GHSPGSLSYYAKEDKIVFSGDALFAGSIGRTDLPGGDHQLLLDSIHDKLLELPEDTTVAS  190

Query:  214 GHGMNTTIGHEKNFNPF                                            230
            GHG   TTIGHE + NPF
Sbjct:  191 GHGPTTTIGHEMDGNPF                                            207
```

A related DNA sequence was identified in *S. pyogenes* <SEQ ID 5507> which encodes the amino acid sequence <SEQ ID 5508>. Analysis of this protein sequence reveals the following:

---

Possible site: 54
>>> Seems to have no N-terminal signal sequence
----- Final Results -----
    bacterial cytoplasm --- Certainty = 0.0407 (Affirmative) <succ>
      bacterial membrane --- Certainty = 0.0000 (Not Clear) <succ>
        bacterial outside --- Certainty = 0.0000 (Not Clear) <succ>

---

An alignment of the GAS and GBS proteins is shown below.

```
Identities = 217/231 (93%), Positives = 224/231 (96%)
Query:   1 MPFIFRHSFFNKVLIFWYTIIMKIYKTINHIAGENTYYLVNDQAVILIDPGSNGQEIIAK   60
           +PFIFR+SFFNKVLIFWYTI+MKIYKTINHIAGENTYYLVNDQAVILIDPGSNGQEIIAK
Sbjct:   1 LPFIFRYSFFNKVLIFWYTILMKIYKTINHIAGENTYYLVNDQAVILIDPGSNGQEIIAK   60

Query:  61 IKSFEKPLVAILLTHTHYDHIFSLDLVRDTFDNPPVYVSEKEAAWLSSPDDNLSGLGRHD  120
           IKSFEKPLVAILLTHTHYDHIFSLDLVRD FD+PPVYVSEKEAAWLSSPDDNLSGLGRHD
Sbjct:  61 IKSFEKPLVAILLTHTHYDHIFSLDLVRDAFDHPPVYVSEKEAAWLSSPDDNLSGLGRHD  120

Query: 121 DIINVIARPAENFFKLKQPYQLNGFEFTVLPTPGHSWGGVSFVFHSDELVVTGDALFRET  180
           DII  VIARPAENFFKLKQPYQLNGFEFTVLPT GHSWGGVSFVFHSDELVVTGDALFRET
Sbjct: 121 DIITVIARPAENFFKLKQPYQLNGFEFTVLPTSGHSWGGVSFVFHSDELVVTGDALFRET  180

Query: 181 IGRTDLPTSNFEDLITGIRQELFTLPSHYSVHPGHGMNTTIGHEKNFNPFF           231
           IGRTDLPTSNFEDLITGIRQELFTLP+HY V+PGHG +TTI HEKN NPFF
Sbjct: 181 IGRTDLPTSNFEDLITGIRQELFTLPNHYRVYPGHGPSTTICHEKNANPFF           231
```

Based on this analysis, it was predicted that these proteins and their epitopes could be useful antigens for vaccines or diagnostics.

Example 1772

A DNA sequence (GBSx1879) was identified in *S. agalactiae* <SEQ ID 5509> which encodes the amino acid sequence <SEQ ID 5510>. This protein is predicted to be acetoin reductase (fabG). Analysis of this protein sequence reveals the following:

---

Possible site: 28
>>> Seems to have no N-terminal signal sequence
----- Final Results -----
    bacterial cytoplasm --- Certainty = 0.1596 (Affirmative) <succ>
      bacterial membrane --- Certainty = 0.0000 (Not Clear) <succ>
        bacterial outside --- Certainty = 0.0000 (Not Clear) <succ>

---

A related GBS nucleic acid sequence <SEQ ID 9631> which encodes amino acid sequence <SEQ ID 9632> was also identified.

The protein has homology with the following sequences in the GENPEPT database.

```
>GP:AAC48769 GB:U71200 acetoin reductase [Bos taurus]
Identities = 162/254 (63%), Positives = 188/254 (73%), Gaps = 2/254 (0%)
Query:  12 KVAIVTGAGQGIGFAIAKRLHADGFKIGVLDYNEETAQAAVDKLSPED--AVAVVADVSK   69
           KVA+VTG QGIG AI   L ADGF + V D NE  ++        A+AV  DVS
Sbjct:   4 KVAMVTGGAQGIGEAIVXXLSADGFAVAVADLNEAKSKXVATDIEKNGGTAIAVKLDVSD   63

Query:  70 RDQVFDAFQKVVDTFGDLNVVVNNAGVAPTTPLDTITEEQFEKAFAINVGGTIWGSQAAQ  129
           R+   F A ++V +   G +V+VNNAG+  PTTP+DTIT E F+K  +INV G IWG QAA
Sbjct:  64 REGFFAAVKEVAEKLGGFDVLVNNAGLGPTTPIDTITPELFDKVYHINVAGDIWGIQAAV  123

Query: 130 KHFRELGHGGKIINATSQAGCEGNPNLTVYGGTKFAVRGITQTLAKDLASEGITVNAYAP  189
           + F++  G+GGKIINATSQAG  GNPNL++Y   TKFAVR +T    A+DLA +  ITVNAYAP
Sbjct: 124 EQFKKNGNGGKIINATSQAGVVGNPNLSLYSSTKFAVRCLTPVAARDLAEQNITVNAYAP  183

Query: 190 GIVKTPMMFDIAHEVGKNAGKDDEWGMEQFAKDITLKRLSEPEDVANAVGFLAGDDSNYI  249
           GIVKTP   FDIAHEVGKNAGKDDEWGM+ FAKDI LKRLSEPEDVA AV FLAG DSNYI
```

```
-continued
Sbjct: 184  GIVKTPXXFDIAHEVGKNAGKDDEWGMQTFAKDIALKRLSEPEDVAAAVAFLAGPDSNYI  243

Query: 250  TGQTIVVDGGMVFH   263
            TGQTI VDGGM FH
Sbjct: 244  TGQTIEVDGGMQFH   257
```

A related DNA sequence was identified in *S. pyogenes* <SEQ ID 5511> which encodes the amino acid sequence <SEQ ID 5512>. Analysis of this protein sequence reveals the following:

```
Possible site: 50
>>> Seems to have no N-terminal signal sequence
----- Final Results -----
   bacterial cytoplasm --- Certainty = 0.1131 (Affirmative) <succ>
      bacterial membrane --- Certainty = 0.0000 (Not Clear) <succ>
         bacterial outside --- Certainty = 0.0000 (Not Clear) <succ>
```

An alignment of the GAS and GBS proteins is shown below.

```
Identities = 209/213 (98%), Positives = 212/213 (99%)
Query:   1  MTKEYEVEDMSKVAIVTGAGQGIGFAIAKRLHADGFKIGVLDYNEETAQAAVDKLSPEDA   60
            +TK+YEVEDMSKVAIVTGAGQGIGFAIAKRLHADGFKIG+LDYNEETAQAAVDKLSPEDA
Sbjct:   1  LTKKYEVEDMSKVAIVTGAGQGIGFAIAKRLHADGFKIGILDYNEETAQAAVDKLSPEDA   60

Query:  61  VAVVADVSKRDQVFDAFQKVVDTFGDLNVVVNNAGVAPTTPLDTITEEQFEKAFAINVGG  120
            VAVVADVSKRDQVFDAFQKVVDTFGDLNVVVNNAGVAPTTPLDTITEEQFEKAFAINVGG
Sbjct:  61  VAVVADVSKRDQVFDAFQKVVDTFGDLNVVVNNAGVAPTTPLDTITEEQFEKAFAINVGG  120

Query: 121  TIWGSQAAQKHFRELGHGGKIINATSQAGCEGNPNLTVYGGTKFAVRGITQTLAKDLASE  180
            TIWGSQAAQKHFRELGHGGKIINATSQAGCEGNPNLTVYGGTKFAVRGITQTLAKDLASE
Sbjct: 121  TIWGSQAAQKHFRELGHGGKIINATSQAGCEGNPNLTVYGGTKFAVRGITQTLAKDLASE  180

Query: 181  GITVNAYAPGIVKTPMMFDIAHEVGKNAGKDDE   213
            GITVNAYAPGIVKTPMMF IAHEVGKNAGKDDE
Sbjct: 181  GITVNAYAPGIVKTPMMFAIAHEVGKNAGKDDE   213
```

Based on this analysis, it was predicted that these proteins and their epitopes could be useful antigens for vaccines or diagnostics.

Example 1773

A DNA sequence (GBSx1880) was identified in *S. agalactiae* <SEQ ID 5513> which encodes the amino acid sequence <SEQ ID 5514>. This protein is predicted to be ATP-dependent DNA helicase. Analysis of this protein sequence reveals the following:

```
Possible site: 37
>>> Seems to have no N-terminal signal sequence
----- Final Results -----
   bacterial cytoplasm --- Certainty = 0.3735 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database.

```
>GP:AAB38451 GB:L47709 22.4% identity with Escherichia coli
DNA-damage inducible protein . . . ; putative [Bacillus subtilis]
Identities = 132/461 (28%), Positives = 231/461 (49%), Gaps = 22/461 (4%)
Query:  21 RKYAVVDLEATGAGPNAS--IIQVGIVIIQGNKIIDSYETDVNPHESLDEHIVHLTGITD    78
           +++ V+D+E TG P      IIQ+ V+I+  +I + +    +NP++S+   I  LTGI++
Sbjct:   4 QRFVVIDVETTGNSPKKGDKIIQIAAVVIENGQITERFSKYINPNKSIPAFIEQLTGISN    63

Query:  79 KQLAKAPDFGQVAHHIYQLIEDCIFVAHNVKFDANLLAEQLFLEGCELRTPRI-DTVELS   137
           + +      F  VA  ++QL++  FVAHN+ FD    +L  G +L    + DTVELS
Sbjct:  64 QMVENEQPFEAVAEEVFQLLDGAYFVAHNIHFDLGFVKYELHKAGFQLPDCEVLDTVELS   123

Query: 138 QVFYPCLEKYSLGALAESLNIELTDAHTAIADARATAQLFIKLKAKISSLPKEVLETILT   197
           ++ +P  E Y L  L+E L  +      H A +DA  T  +F+++  K+  LP   L+ +
Sbjct: 124 RIVFPGFEGYKLTELSEELQLRHDQPHRADSDAEVTGLIFLEILEKLRQLPYPTLKQLRR   183

Query: 198 FADNLLFESYLLIEEAYQEADFVNPKEYYFWQGLVLKKEKAVGKPKKLSSDFQ-------   250
           + + + +  L++     E        Y +      +++  +A+          +F
Sbjct: 184 LSQHFISDLTHLLDMFINENRHTEIPGYTRFSSFSVREPEAIDVRINEDENFSFEIESWE   243

Query: 251 ------VNMALLGMDARPKQVVFADLVKAHFNDQTTTFLEAQPGLGKTYGYLLP--LLDQ   302
                 ++   + G + R  Q++    V   F ++    +EA PG+GKT GYL+P  L  +
Sbjct: 244 AGNEKALSELMPGYEKRDGQMMMMREVADAFANREHALIEAPPGIGKTIGYLIPAALFAK   303

Query: 303 SQKQQIIVSVPTKILQDQIMAKEIKHIQELFHIPCHS--IKGPRNYLKLDAFYKSLQVQD   360
              K+ +I+S  + +LQ QI+ K+  +Q+LF  P  +  +KG  +YL L  F +L +D
Sbjct: 304 KSKKPVIISTYSTLLQQQILTKDLPIVQDLFPFPVTAAILKGQSHYLCLYKFEQVLHEED   363

Query: 361 RNRLINRFKMQLLVWLTETTTGDLDEIKQKQRLESYFDQLKHDGE-VTQSSLFYDLDFWK   419
            N       K QLLVWLTET TGD+ E+       +D+L +D +    +S  + + F++
Sbjct: 364 DNYDAVLTKAQLLVWLTETNTGDVAELNLPSGGKLLWDRLAYDDDSYKRSRSEHVIGFYE   423

Query: 420 RSYDKVAQSQLVIINHAYFL-ERVQDDKDFAKGKVLVFDEA                     459
           R+     +S LVI NH+ L +      K    +    + DEA
Sbjct: 424 RAKQIAMRSDLVITNHSLLLTDEGSHKKRLPESGTFIIDEA                     464

Identities = 63/195 (32%), Positives = 88/195 (44%), Gaps = 16/195 (8%)
Query: 629 KVWIDTSMPNILDLSPEQYAYEIAKRLQDIMTLKQPT-LVLLTSKQTMFMVSDYLDKWEI   687
           +V I   M +I D     + + A+ ++ +      KQP LVL TS  + V        E+
Sbjct: 720 QVMIPKEMKSIQDTGQPEFIQDTARYIELMAKEKQPKILVLFTSHDMLKKVHQ-----EL   774

Query: 688 KH---------LTQD-KNGLAYNVKKRFDRGESNLLLGTGSFWEGVDFVHRDRLIEVITR   737
           KH         L Q  G    + K F    +LLGT  FWEGVDF    +I R
Sbjct: 775 KHNMSASGIQLLAQGITGGSPGKLMKTFKTSNQAILLGTNHFWEGVDFPGDELTTVMIVR   834

Query: 738 LPFDTPKDYFIQKLSQSLTKEGKNFFYDYSLPMTVLKLKQALGRTIRREEQKSAVIILDS   797
           LPF +P        + K+GKN F   SLP  VL +Q +GR  R      K +IILD
Sbjct: 835 LPFRSPDHPLHAAKCELARKKGKNPFQTVSLPEAVLTFRQGIGRLLRSAGDKGTIIILDR   894

Query: 798 RLVIKSYGQTIMHSL                                              812
           R+       YG+   + +L
Sbjct: 895 RIKTAGYGRLFLDAL                                              909
```

A related DNA sequence was identified in *S. pyogenes* <SEQ ID 5515> which encodes the amino acid sequence <SEQ ID 5516>. Analysis of this protein sequence reveals the following:

Possible site: 37
>>> Seems to have no N-terminal signal sequence

----- Final Results -----
bacterial cytoplasm --- Certainty = 0.3735 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 500/835 (59%), Positives = 626/835 (74%), Gaps = 2/835 (0%)
Query:   1 MFCFIDIACYNRLTMTQKKLRKYAVVDLEATGAGPNASIIQVGIVIIQGNKIIDSYETDV    60
           MFCFIDIACYNRLTMTQKKLRKYAVVDLEATGAGPNASIIQVGIVIIQGNKIIDSYETDV
Sbjct:   1 MFCFIDIACYNRLTMTQKKLRKYAVVDLEATGAGPNASIIQVGIVIIQGNKIIDSYETDV    60

Query:  61 NPHESLDEHIVHLTGITDKQLAKAPDFGQVAHHIYQLIEDCIFVAHNVKFDANLLAEQLF   120
           NPHESLDEHIVHLTGITDKQLAKAPDFGQVAHHIYQLIEDCIFVAHNVKFDANLLAE LF
Sbjct:  61 NPHESLDEHIVHLTGITDKQLAKAPDFGQVAHHIYQLIEDCIFVAHNVKFDANLLAEALF   120

Query: 121 LEGCELRTPRIDTVELSQVFYPCLEKYSLGALAESLNIELTDAHTAIADARATAQLFIKL   180
           LEG EL  PR+DTVEL+Q+F+P  EKY+L  L+   LNI+L +AHTAIADARATA LF++L
Sbjct: 121 LEGYELTIPRVDTVELAQLFFPRFEKYNLSHLSRQLNIDLAEAHTAIADARATAILFLRL   180
```

```
Query:  181  KAKISSLPKEVLETILTFADNLLFESYLLIEEAYQEADFVNPKEYYFWQGLVLKKEKAVG  240
             KI SLP E LE++L ++D+LLFE+ ++I+E   +A   +P +Y   + ++L K
Sbjct:  181  LQKIESLPIECLESLLVYSDSLLFETAMVIQEGLAKAKPYDPNKYIKIRQILLPKGSKAL  240

Query:  241  KPKKLSSDFQVNMALLGMDARPKQVVFADLVKAHFNDQTTTFLEAQPGLGKTYGYLLPLL  300
             KP ++S  F +NMALLG++ RPKQ  FA L+   ++      +F+EAQ G+GKTYGYLLPLL
Sbjct:  241  KPYQISKSFPINMALLGLEERPKQTQFAQLIDEDYHQGVASFIEAQTGIGKTYGYLLPLL  300

Query:  301  DQSQKQQIIVSVPTKILQDQIMAKEIKHIQELFHIPCHSIKGPRNYLKLDAFYKSLQVQD  360
             +  + QIIVSVPTK+LQDQ+MA E+   IQE FHI CHS+KGP NYLKLD+F  SL   D
Sbjct:  301  AKEDQNQIIVSVPTKLLQDQLMAGEVAAIQEQFHIACHSLKGPANYLKLDSFADSLDQND  360

Query:  361  RNRLINRFKMQLLVWLTETTTGDLDEIKQKQRLESYFDQLKHDGEVTQSSLFYDLDFWKR  420
             +NRL+NR+KMQLLVWL ET TGDLDEIKQKQR +YF+QLKHDG++ QSS FYD DFW+
Sbjct:  361  QNRLVNRYKMQLLVWLLETKTGDLDEIKQKQRFAAYFEQLKHDGDIKQSSEFYDYDFWRV  420

Query:  421  SYDKVAQSQLVIINHAYFLERVQDDKDFAKGKVLVFDEAQKLVLGLENFSRGQLDISHQL  480
             SY+K    ++L+I NHAYFL RVQDDKDFA+ KVLVFDEAQKL+L L+  SR QL+++  L
Sbjct:  421  SYEKAKTARLLITNHAYFLHRVQDDKDFARNKVLVFDEAQKLMLQLDQLSRHQLNLTVFL  480

Query:  481  QVIQKIIDSSIPLLQKRLLESISYELSHAVELFYRHNSFEFSETWLKRLKNSINALEVVG  540
             Q IQ  + +  +PLL+KRLLES+S+EL       +Y++    +  + W  R+         L
Sbjct:  481  QTIQAKLSNPLPLLEKRLLESLSFELGQVSSDYYQNKEHQLAHDW-SRIAGYAKELTGAD  539

Query:  541  LDELQTFFTATYTNYWFETDKVNEKRLTILRGAREDFLKFSKFLPPTKKTYMISATLQIS  600
                 ELQ FF  +  +YW   ++K   EKR+T L   A  + F+ F  + LP T  KTY +SATL IS
Sbjct:  540  YQELQAFFATSDGDYWLSSEKQEEKRVTYLNSASKAFIHFQQLLPETVKTYFVSATLTIS  599

Query:  601  PKVYLSDLLGGFSSISTEKIAHEKNANQKVWIDTSMPNILDLSPEQYAYEIAKRLQDIMT  660
             +V L+DLL GF        I  +K  +Q V +D   P  ++S  + Y     IAKR++ +
Sbjct:  600  SEVTLADLL-GFEEYLYHVIEKDKKQDQLVLVDQEAPIVTEVSDQIYVEAIAKRIESLKQ  658

Query:  661  LKQPTLVLLTSKQTMFMVSDYLDKWEIKHLTQDKNGLAYNVKKRFDRGESNLLLGIGSFW  720
                P LVL  SK+ +  +VSDYLD+W++ HL Q+KNG AYN+KKRFD+GE   +LLG GSFW
Sbjct:  659  EGYPILVLFNSKKHLLLVSDYLDQWQVPHLAQEKNGTAYNIKKRFDQGEQTILLGLGSFW  718

Query:  721  EGVDFVHRDRLIEVITRLPFDTPKDYFIQKLSQSLTKEGKNFFYDYSLPMTVLKLKQALG  780
             EGVDF+   DR+I +I RLPFD P+D+F++K+S   L  ++GKN F DY LPMT+L+LKQA+G
Sbjct:  719  EGVDFIQADRMITLIARLPFDNPEDFFVKKMSHYLLEKGKNPFRDYFLPMTILRLKQAIG  778

Query:  781  RTTRREEQKSAVIILDSRLVIKSYGQTIMHSLGRDFEISKEKINKVLTEMAKFLI       835
             RT RR++QKS VIILD RL+ KSYGQ I+  LG++F IS++  + L E    FLI
Sbjct:  779  RTMRRQDQKSVVIILDRRLLTKSYGQVILEGLGQEFLISQQNFHDCLVETDCFLI       833
```

Based on this analysis, it was predicted that these proteins and their epitopes could be useful antigens for vaccines or diagnostics.

Example 1774

A DNA sequence (GBSx1881) was identified in *S. agalactiae* <SEQ ID 5517> which encodes the amino acid sequence <SEQ ID 5518>. Analysis of this protein sequence reveals the following:

---

Possible site: 27
>>> Seems to have no N-terminal signal sequence

---

-continued

---
----- Final Results -----
  bacterial cytoplasm --- Certainty = 0.2042 (Affirmative) <succ>
  bacterial membrane  --- Certainty = 0.0000 (Not Clear) <succ>
  bacterial outside   --- Certainty = 0.0000 (Not Clear) <succ>
---

A related GBS nucleic acid sequence <SEQ ID 9633> which encodes amino acid sequence <SEQ ID 9634> was also identified.

The protein has homology with the following sequences in the GENPEPT database.

```
>GP:AAF12702 GB:AF035157 aspartate aminotransferase [Lactococcus
lactis]
Identities = 270/391 (69%), Positives = 314/391 (80%)
Query:    7  MTYLSERVLNMEESVTLAAGAKARELRVQGRDILSLTLGEPDFATPKNIQQAAIEAITDG   66
             M    S+ VL M+ESVTLAA  +A+ L+ QGRDI+ LTLG+PDF TPK I QAAIRAI +G
Sbjct:    1  MKKCSDFVLKMDESVTLAAANRAKALKAQGRDIIDLTLGQPDFPTPKKIGQAAIEAINNG   60

Query:   67  RASFYTPSSGLPELKSAINAYFERFYGYSLKPNQVVVGTGAKFILYTFFMTVLNPGDEVI  126
             +ASFYT + GLPELK A+  Y+  RFY  Y ++  N++++  GAKF LY +FM ++ P DEVI
Sbjct:   61  QASFYTQAGGLPELKKAVQHYWTRFYAYEIQTNEILITAGAKFALYAYFMATVDPLDEVI  120

Query:  127  IPTPYWVSYADQIKMAEGKPVFVTAKEVNHFKVTVEQLEAVRTDKTKVILLNSPSNPTGM  186
             IP PYWVSY DQ+KMA G PV V AK+ N+FKVTVEQLE  RT KTK++LLNSPSNPTGM
Sbjct:  121  IPAPYWVSYVDQVKMAGGNPVIVEAKQENNFKVTVEQLEKARTSKTKILLLNSPSNPTGM  180
```

```
                          -continued
Query: 187  IYKAEELEAIGNWAVEHDILILADDIYGRLVYNGNIFTPISSLSESIRNQTIVINGVSKT  246
            IY  EEL AIG WAV HD+LILADDIY RLVYNG  FT ISSLS+ IRN+T VINGVSKT
Sbjct: 181  IYSKEELTAIGEWAVAHDLLILADDIYHRLVYNGAEFTAISSLSDEIRNRTTVINGVSKT  240

Query: 247  YAMTGWRVGFAVGNHDIIAAMSKVVSQTTSNLTAVSQYATIEALNGSQESFEKMRLAFEE   306
            +AMTGWR+G AVG+ +IIAAM+K+ SQTTSN TAV+QYA IEA    + +SFEKM  AFEE
Sbjct: 241  FAMTGWRIGLAVGDPEIIAAMTKIASQTTSNPTAVAQYAAIEAFEENDKSFEKMHAAFEE  300

Query: 307  RLNIIYPLLCQVPGFEVVKPQGAFYLFPNVTKAMEMKGYTDVTAFTDAILEEVGLALVTG  366
            RLN IY  L +VPGFE+VKP GAFYLFP VTKAM MKGYTDVT  FT AILEE G+ALVTG
Sbjct: 301  RLNKIYLQLSEVPGFELVKPNGAFYLFPKVTKAMAMKGYTDVTDFTTAILEEAGVALVTG  360

Query: 367  AGFGAPENVRLSYATDLETLKEAVRRLHVFM                              397
            AGFG+PENVRLSYAT LETL+ AV RL  +M
Sbjct: 361  AGFGSPENVRLSYATSLETLEAAVTRLKDWM                              391
```

A related DNA sequence was identified in *S. pyogenes* <SEQ ID 1005> which encodes the amino acid sequence <SEQ ID 1006>. Analysis of this protein sequence reveals the following:

---

Possible site: 30
>>> Seems to have no N-terminal signal sequence
INTEGRAL    Likelihood = −0.48    Transmembrane 95-111 (95-113)
----- Final Results -----
    bacterial membrane --- Certainty = 0.1192 (Affirmative) <succ>
      bacterial outside --- Certainty = 0.0000 (Not Clear) <succ>
         bacterial cytoplasm --- Certainty = 0.0000 (Not Clear) <succ>

---

An alignment of the GAS and GBS proteins is shown below.

```
Identities = 301/397 (75%), Positives = 343/397 (85%)
Query:   7  MTYLSERVLNMEESVTLAAGAKARELRVQGRDILSLTLGEPDFATPKNIQQAAIEAITDG   66
            M   LS+RVL M+ESVTLAAGA+A+ L+ QGRD+L+LTLGEPDF TPK+IQ AIE+I  +G
Sbjct:   1  MPKLSKRVLEMKESVTLAAGARAKALKAQGRDVLNLTLGEPDFFTPKHIQDKAIESIQNG   60

Query:  67  RASFYTPSSGLPELKSAINAYFERFYGYSLKPNQVVVGTGAKFILYTFFMTVLNPGDEVI  126
             ASFYT +SGLPELK+AI  Y +   YGY L P+Q+V GTGAKFILY FFM VLNPGD+V+
Sbjct:  61  TASFYTNASGLPELKAAIATYLKNQYGYHLSPDQIVAGTGAKFILYAFFMAVLNPGDQVL  120

Query: 127  IPTPYWVSYADQIKMAEGKPVFVTAKEVNHFKVTVEQLEAVRTDKTKVILLNSPSNPTGM  186
            IPTPYWVSY+DQ+KMAEG+P+FV    E N FKVTV+QLE    RT KTKV+L+NSPSNPTGM
Sbjct: 121  IPTPYWVSYSDQVKMAEGQPIFVQGLEENQFKVTVDQLERARTSKTKVVLINSPSNPTGM  180

Query: 187  IYKAEELEAIGNWAVEHDILILADDIYGRLVYNGNIFTPISSLSESIRNQTIVINGVSKT  246
            IY AEEL AIG WAV +DILILADDIYG LVYNGN F PIS+LSE+IR QTI +NGV+K+
Sbjct: 181  IYGAEELRAIGEWAVHNDILILADDIYGSLVYNGNQFVPISTLSEAIRRQTITVNGVAKS  240

Query: 247  YAMTGWRVGFAVGNHDIIAAMSKVVSQTTSNLTAVSQYATIEALNGSQESFEKMRLAFEE  306
            YAMTGWRVGFA G   +II+AMSK++ QTTSNLT VSQYA IEA  GSQ S E+MRLAFEE
Sbjct: 241  YAMTGWRVGFAAGEPEIISAMSKIIGQTTSNLITVSQYAAIEAFCGSQSSLEEMRLAFEE  300

Query: 307  RLNIIYPLLCQVPGFEVVKPQGAFYLFPNVTKAMEMKGYTDVTAFTDAILEEVGLALVTG  366
            RLNI YPLLCQVPGFEVVKPQGAFY FPNV KAMEM G++DVT+F +AILEEVGLA+V+G
Sbjct: 301  RLNITYPLLCQVPGFEVVKPQGAFYFFPNVKKAMEMTGFSDVTSFANAILEEVGLAVVSG  360

Query: 367  AGFGAPENVRLSYATDLETLKEAVRRLHVFMGSNEIN                        403
            AGFGAPENVRLSYATD+ETLKEAVRRLHVFM SNEIN
Sbjct: 361  AGFGAPENVRLSYATDIETLKEAVRRLHVFMESNEIN                        397
```

Based on this analysis, it was predicted that these proteins and their epitopes could be useful antigens for vaccines or diagnostics.

Example 1775

A DNA sequence (GBSx1882) was identified in *S. agalactiae* <SEQ ID 5519> which encodes the amino acid sequence <SEQ ID 5520>. This protein is predicted to be asparaginyl-tRNA synthetase (asnS). Analysis of this protein sequence reveals the following:

---

Possible site: 46
>>> Seems to have no N-terminal signal sequence
----- Final Results -----
    bacterial cytoplasm --- Certainty = 0.1488 (Affirmative) <succ>
     bacterial membrane --- Certainty = 0.0000 (Not Clear) <succ>
      bacterial outside --- Certainty = 0.0000 (Not Clear) <succ>

---

The protein has homology with the following sequences in the GENPEPT database.

```
>GP:BAB05415 GB:AP001512 asparaginyl-tRNA synthetase [Bacillus halodurans]
Identities = 252/442 (57%), Positives = 316/442 (71%), Gaps = 15/442 (3%)
Query:   7 SIVDVKDYVGQEVTIGAWVANKSGKGKIAFVQLRDGSAFFQGVAFKPNFIEKYGEESGLE      66
             +I +   YV QEVT+GAW+ANK  GKIAF+QLRDG+ F QGV  K         E G E
Sbjct:   4 TIAKIGQYVDQEVTLGAWLANKRSSGKIAFLQLRDGTGFIQGVVVKA--------EVGDE     55

Query:  67 KFDVIKRLNQETSVYVTGIVKEDERSKFGYELDITDLEVIGESHEYPITPKEHGTDFLMD     126
              F   K L QE+S+YVTGIV++DER+  GYEL +T  ++I E+ +YPITPKEHGT+FLMD
Sbjct:  56 WFQKAKNLTQESSLYVTGIVRKDERAPSGYELTVTSFDIIHEATDYPITPKEHGTEFLMD    115

Query: 127 NRHLWLRSRKQMAVMQIRNAIIYSTYEFFDQNGFIKFDSPILSENAAEDSTELFETDYFG     186
             +RHLW+RSRKQ AV++IRN II +TYEFF +NGF+K D PIL+ +A E +TELF T YF
Sbjct: 116 HRHLWIRSRKQHAVLRIRNEIIRATYEFFHENGFVKVDPPILTGSAPEGTTELFHTKYFD    175

Query: 187 KPAFLSQSGQLYLEAGAMALGRVFDFGPVFRAEKSKTRRHLTEFWMMDAEYSFLSHEESL     246
             + AFLSQSGQLY+EA A+A GRVF FGP FRAEKSKTRRHL EFWM++ E +F+  EESL
Sbjct: 176 EDAFLSQSGQLYMEAAALAFGRVFSFGPTFRAEKSKTRRHLIEFWMIEPEMAFVEFEESL    235

Query: 247 DLQEAYVKALIQGVLDRAPQALDILERDVEALKRYIAEPFKRVSYDDAITLLQEHEADED     306
             ++QE YV  ++Q VL      L  L RD  L+ I  PF R+SYDDAI  L E    D+
Sbjct: 236 EIQENYVAYIVQSVLKHCAIELKTLGRDTSVLES-IQAPFPRISYDDAIKFLHEKGFDD-    293

Query: 307 TDYEHLEHGDDFGSPHETWISNYFGVPTFVVNYPASFKAFYMKPVPGNPERVLCADLLAP     366
                  +E GDDFG+PHET I+ +F  P F+ +YP S K FYM+P P    + VLCADL+AP
Sbjct: 294 -----IEWGDDFGAPHETAIAEHFDKPVFITHYPTSLKPFYMEPDPNRDDVVLCADLIAP    348

Query: 367 EGYGEIIGGSMREDDYDALVAKMDELGMDKSEYDFYLDLRKYGSVPHGGFGIGIERMVTF     426
             EGYGEIIGGS R  DYD L  +++E  +    Y +YLDLRKYGSVPH GFG+G+ER V +
Sbjct: 349 EGYGEIIGGSQRISDYDLLKKRLEEHDLSLDAYAWYLDLRKYGSVPHSGFGLGLERTVGW    408

Query: 427 VAGTKHIREAIPFPRMLHRIKP                                         448
             ++G  H+RE IPFPR+L+R+ P
Sbjct: 409 ISGAGHVRETIPFPRLLNRLYP                                         430
```

A related DNA sequence was identified in *S. pyogenes* <SEQ ID 5521> which encodes the amino acid sequence <SEQ ID 5522>. Analysis of this protein sequence reveals the following:

Possible site: 46
>>> Seems to have no N-terminal signal sequence

----- Final Results -----
bacterial cytoplasm --- Certainty = 0.1488 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 443/448 (98%), Positives = 447/448 (98%)
Query:   1 MSKKLISIVDVKDYVGQEVTIGAWVANKSGKGKIAFVQLRDGSAFFQGVAFKPNFIEKYG      60
           MSKKLISIVDVKDYVGQEVTIGAWVANKSGKGKIAFVQLRDGSAFFQGVAFKPNFIEKYG
Sbjct:   1 MSKKLISIVDVKDYVGQEVTIGAWVANKSGKGKIAFVQLRDGSAFFQGVAFKPNFIEKYG      60

Query:  61 EESGLEKFDVIKRLNQETSVYVTGIVKEDERSKFGYELDITDLEVIGESHEYPITPKEHG     120
           EESGLEKFDVIKRLNQETSVYVTGIV+EDERSK GYELDITDLE+IGESHEYPITPKEHG
Sbjct:  61 EESGLEKEDVIKRLNQETSVYVTGIVKEDERSKEGYELDITDLEIIGESHEYPITPKEHG     120

Query: 121 TDFLMDNRHLWLRSRKQMAVMQIRNAIIYSTYEFFDQNGFIKFDSPILSENAAEDSTELF     180
           TDFLMDNRHLWLRSRKQMAVMQIRNAIIY+TYEFFDQNGFIK DSPILSENAAEDSTELF
Sbjct: 121 TDFLMDNRHLWLRSRKQMAVMQIRNAIIYATYEFFDQNGFIKEDSPILSENAAEDSTELF     180

Query: 181 ETDYFGKPAFLSQSGQLYLEAGAMALGRVFDFGPVFRAEKSKTRRHLTEFWMMDAEYSFL     240
           ETDYFGKPAELSQSGQLYLEAGAMALGRVFDFGPVERAEKSKTRRHLTEFWMMDAEYSFL
Sbjct: 181 ETDYFGKPAFLSQSGQLYLEAGAMALGRVFDFGPVFRAEKSKTRRHLTEFWMMDAEYSFL     240

Query: 241 SHEESLDLQEAYVKALIQGVLDRAPQALDILERDVEALKRYIAEPFKRVSYDDAITLLQE     300
           SHEESLDLQEAYVKALIQGVLDRAPQALDILERDVEALKRYI EPFKRVSYDDAITLLQE
Sbjct: 241 SHEESLDLQEAYVKALIQGVLDRAPQALDILERDVEALKRYITEPFKRVSYDDAITLLQE     300

Query: 301 HEADEDTDYEHLEHGDDFGSPHETWISNYFGVPTFVVNYPASFKAFYMKPVPGNPERVLC     360
           HEADEDTDYEHLEHGDDFGSPHETWISNYFGVPIFVVNYPASFKAFYMKPVPGNPERVLC
Sbjct: 301 HEADEDTDYEHLEHGDDFGSPHETWISNYFGVPIFVVNYPASFKAFYMKPVPGNPERVLC     360

Query: 361 ADLLAPEGYGEIIGGSMREDDYDALVAKMDELGMDKSEYDFYLDLRKYGSVPHGGFGIGI     420
           ADLLAPEGYGEIIGGSMRED+YDALVAKMDELGMDKSEYDFYLDLRKYGSVPHGGFGIGI
Sbjct: 361 ADLLAPEGYGEIIGGSMREDNYDALVAKMDELGMDKSEYDFYLDLRKYGSVPHGGFGIGI     420

Query: 421 ERMVTFVAGTKHIREAIPFPRMLHRIKP                                   448
           ERMVTFVAGTKHIREAIPFPRMLHRI+P
Sbjct: 421 ERMVTFVAGTKHIREAIPFPRMLHRIRP                                   448
```

Example 1776

A DNA sequence (GBSx1883) was identified in *S. agalactiae* <SEQ ID 5523> which encodes the amino acid sequence <SEQ ID 5524>. Analysis of this protein sequence reveals the following:

```
Possible site: 17
>>> Seems to have a cleavable N-term signal seq.
INTEGRAL    Likelihood = -6.85    Transmembrane 103-119 (102-127)
INTEGRAL    Likelihood = -5.04    Transmembrane 73-89   (68-93)
INTEGRAL    Likelihood = -4.19    Transmembrane 31-47   (31-49)
INTEGRAL    Likelihood = -1.86    Transmembrane 157-173 (157-173)
----- Final Results -----
    bacterial membrane --- Certainty = 0.3739 (Affirmative) <succ>
      bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:AAD40355 GB:AF036485 hypothetical protein [Plasmid pNZ4000]
Identities = 39/135 (28%), Positives = 72/135 (52%), Gaps = 4/135 (2%)
Query:     3 KSPARLISFISIAIAINLVGANLALFLRLPIYLDTIGTLLIAVILGPWYAASTAFLSALI   62
             K   A   ++I    A+ IN V    LA  L+LP++L ++GT L +++ GP    A + F++ +I
Sbjct:    15 KLSAATMTLIPAAVGINYVAKALAEGLKLPVWLGSLGTFLASMLAGPVAGAISGFINNVI   74

Query:    63 NWMTTDIFSLYYSPVAIVVAIITGILIKRNCKPSS--LLWKSLIISLPGTIIASVITVIL  120
               +T     S  Y+  +I  +I   G+L       S+    +    ++II++   +I++ + VI
Sbjct:    75 YGLTLSPISTVYAITSIGIGIAVGVLHANGWFSSARRVFVSAIIIAIVSAVISTPLNVIF  134

Query:   121 FKGIT--SSGSSIIA                                               133
             + G T   + G S+ A
Sbjct:   135 WGGQTGIAWGDSLFA                                               149
```

No corresponding DNA sequence was identified in *S. pyogenes*.

Based on this analysis, it was predicted that these proteins and their epitopes could be useful antigens for vaccines or diagnostics.

Example 1777

A DNA sequence (GBSx1884) was identified in *S. agalactiae* <SEQ ID 5525> which encodes the amino acid sequence <SEQ ID 5526>. Analysis of this protein sequence reveals the following:

```
Possible site: 25
>>> Seems to have no N-terminal signal sequence
----- Final Results -----
    bacterial cytoplasm --- Certainty = 0.1873 (Affirmative) <succ>
    bacterial membrane --- Certainty = 0.0000 (Not Clear) <succ>
     bacterial outside --- Certainty = 0.0000 (Not Clear) <succ>
```

The protein has homology with the following sequences in the GENPEPT database.

```
>GP:AAC75223 GB:AE000305 orf, hypothetical protein [Escherichia coli K12]
Identities = 97/305 (31%), Positives = 160/305 (51%), Gaps = 10/305 (3%)
Query:     1 MNKEKIIIDCDPGIDDTLALMYAIQHPKLEVVAITITAGNSPVELGLKNTFVTLELLNRH   60
             M K  KII+DCDPG DD +A+M A +HP ++++ ITI AGN  ++  L N     + L
Sbjct:     1 MEKRKIILDCDPGHDDAIAIMMAAKHPAIDLLGITIVAGNQTLDKTLINGLNVCQKL-EI   59

Query:    61 DIPVYVGDNLPLQREFVSAQDTHGMDGLGENNFTLAQPIIFQEESADC---FLANYFEHK  117
             ++PVY G    P+ R+ + A + HG  GL      F  +P+  Q ES         +
Sbjct:    60 NVPVYAGMPQPIMRQQIVADNIHGETGLDGPVF---EPLTRQAESTHAVKYIIDTLMASD  116

Query:   118 NDTSIIALGPLTNIARALQTNPKLGKHCKRFISMGGSFKSHGNCSPVAEYNYWCDPHAAQ  177
             +D +++ +GPL+NIA A++   P +    +   + MGG++ + GN +P AE+N + DP AA+
Sbjct:   117 GDITLVPVGPLSNIAVAMRMQPAILPKIREIVLMGGAYGT-GNFTPSAEFNIFADPEAAR  175

Query:   178 YVFENLDKKIEMVGLDITRHIVLTPNHLSYMERINPDVSSFIQKITKFYFDFHWQYEHII  237
              VF +    + M+GLD+T    V TP+ ++ MER          I F        ++   +
Sbjct:   176 VVFTS-GVPLVMMGLDLTNQTVCTPDVIARMERAGGPAGELFSDIMNFTLKTQFENYGLA  234

Query:   238 GCVINDPLAIAYFVNENIATGFDSYTDVACH-GIAMGQTIVDQYHFYKKDANSKILTSVN  296
             G    ++D   I Y +N +    + Y +V  + G    G+T+ D+        K AN+K+  +++
Sbjct:   235 GGPVHDATCIGYLINPDGIKTQEMYVEVDVNSGPCYGRTVCDELGVLGKPANTKVGITID  294

Query:   297 TNLFW                                                         301
             T+ FW
Sbjct:   295 TDWFW                                                         299
```

No corresponding DNA sequence was identified in *S. pyogenes*.

Based on this analysis, it was predicted that this protein and its epitopes, could be useful antigens for vaccines or diagnostics.

Example 1778

A DNA sequence (GBSx1885) was identified in *S. agalactiae* <SEQ ID 5527> which encodes the amino acid sequence <SEQ ID 5528>. Analysis of this protein sequence reveals the following:

---

Possible site: 53
>>> Seems to have no N-terminal signal sequence
----- Final Results -----
    bacterial cytoplasm --- Certainty = 0.1860 (Affirmative) <succ>
    bacterial membrane --- Certainty = 0.0000 (Not Clear) <succ>
    bacterial outside --- Certainty = 0.0000 (Not Clear) <succ>

---

The protein has homology with the following sequences in the GENPEPT database.

```
>GP:CAB62728 GB:AL133423 hypothetical protein SC4A7.24c
[Streptomyces coelicolor A3(2)]
Identities = 36/134 (26%), Positives = 57/134 (41%), Gaps = 7/134 (5%)
Query:   1 MLYEVTSSNTQGVDGKVYLSNGKIVETNHPLNHL----PGFNPEELIALAWSTCLNATIK    56
           +LY    ++   G DG+V   +G++    +P   +    G NPE+L A  +S C     +
Sbjct:   8 VLYTAVATAENGRDGRVATDDGRLDVVVNPPKEMGGNGAGTNPEQLFAAGYSACFQGALG   67

Query:  57 AILEQKGFKDLKSRVDVTCQLMKEKQVGKGFYFQVNAVASIEKLSLSDSKLIVNKAHSRC   116
           +   Q+G      S V     + K      GF   V    A I  +  + ++ +V KAH  C
Sbjct:  68 VVARQEGADISGSTVTAKVGIGKNDD---GFGIIVEISAEIPTVDAATARSLVEKAHQVC   124

Query: 117 PISKLISNAKTINL                                                130
           P SK      T+ L
Sbjct: 125 PYSKATRGNITVTL                                                138
```

No corresponding DNA sequence was identified in *S. pyogenes*.

Based on this analysis, it was predicted that this protein and its epitopes, could be useful antigens for vaccines or diagnostics.

Example 1779

A DNA sequence (GBSx1886) was identified in *S. agalactiae* <SEQ ID 5529> which encodes the amino acid sequence <SEQ ID 5530>. Analysis of this protein sequence reveals the following:

---

Possible site: 61
>>> Seems to have no N-terminal signal sequence
----- Final Results -----
    bacterial cytoplasm --- Certainty = 0.0531 (Affirmative) <succ>
    bacterial membrane --- Certainty = 0.0000 (Not Clear) <succ>
    bacterial outside --- Certainty = 0.0000 (Not Clear) <succ>

---

A related GBS nucleic acid sequence <SEQ ID 9635> which encodes amino acid sequence <SEQ ID 9636> was also identified.

The protein has homology with the following sequences in the GENPEPT database.

```
>GP:CAB15482 GB:Z99121 similar to hypothetical proteins [Bacillus subtilis]
Identities = 164/285 (57%), Positives = 207/285 (72%), Gaps = 2/285 (0%)
Query:   6 IKLVIVTGMSGAGKTVAIQSFEDLGYFTIDNMPPTLVPKFLELAAQSGDT-SKIANNVDM    64
           I+LVI+TGMSGAGKTVAIQSFEDLGYF +DN+PP+L+PKFLEL  +S    SK+A+V+D+
Sbjct:   9 IQLVIITGMSGAGKTVAIQSFEDLGYFCVDNLPPSLLPKFLELMKESNSKMSKVALVMDL   68

Query:  65 RSRLFFREINSILDSLEINDNINFKILFLDATDTELVSRYKETRRSHPLAADGRVLDGIS   124
           R R FF    +LD + N     +ILFLDA D+ LV+RYKETRRSHPLAA G L+GI+
Sbjct:  69 RGREFFDRLIEALDEMAENPWITPRILFLDAKDSILVTRYKETRRSHPLAATGLPLEGIA   128

Query: 125 LERELLAPLKSMSQNVVDTSELTPRQLRKVISKEFSNQDSQSSFRIEVMSFGFKYGIPLD   184
           LERELL  LK  SQ + DTS++  PR LR+ I K F+      ++  F  +VMSFGFKYGIP+D
Sbjct: 129 LERELLEELKGRSQIIYDTSDMKPRDLREKIVKHFATNQGET-FTVNVMSFGFKYGIPID   187

Query: 185 ADLVFDVRFLPNPYYKPELRDKTGLDTEVYDYVMSFDESDDFYDHLLALIKPILPGYQNE   244
           ADLVFDVRFLPNPYY   +R  TG D EV  YVM ++E+  F  + L+ L+    +LP Y+ E
Sbjct: 188 ADLVFDVRFLPNPYYIESMRPLTGKDKEVSSYVMKWNETQKFNEKLIDLLSFMLPSYKRE   247

Query: 245 GKSVLTVAIGCTGGQHRSTAFAHRLSEDLKADWTVNESHRDKNKR                 289
           GKS + +AIGCTGGQHRS   A  L++  K D+    + +HRD  KR
Sbjct: 248 GKSQVVIAIGCTGGQHRSVTLAENLADYFKKDYYTHVTHRDIEKR                 292
```

A related DNA sequence was identified in *S. pyogenes* <SEQ ID 5531> which encodes the amino acid sequence <SEQ ID 5532>. Analysis of this protein sequence reveals the following:

```
Possible site: 20
 >>> Seems to have an uncleavable N-term signal seq
 ----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the databases:

```
>GP:CAB15482 GB:Z99121 similar to hypothetical proteins [Bacillus subtilis]
Identities = 164/291 (56%), Positives = 213/291 (72%), Gaps = 3/291 (1%)
Query:   1  MSDKH-INLVIVTGMSGAGKTVAIQSFEDLGYFTIDNMPPALVPKFLELIEQTNENR-RV   58
            +S+ H I LVI+TGMSGAGKTVAIQSFEDLGYF +DN+PP+L+PKFLEL++++N    +V
Sbjct:   3  VSESHDIQLVIITGMSGAGKTVAIQSFEDLGYFCVDNLPPSLLPKFLELMKESNSKMSKV  62

Query:  59  ALVVDMRSRLFFKEINSTLDSIESNPSIDFRILFLDATDGELVSRYKETRRSHPLAADGR  118
            ALV+D+R R FF +   LD +  NP I  RILFLDA D  LV+RYKETRRSHPLAA G
Sbjct:  63  ALVMDLRGREFFDRLIEALDEMAENPWITPRILFLDAKDSILVTRYKETRRSHPLAATGL  122

Query: 119  VLDGIRLERELLSPLKSMSQHVVDTTKLTPRQLRKTISDQFSEGSNQASFRIEVMSFGFK  178
            +L+GI LERELL  LK  SQ + DT+ + PR LR+ I    F+    + +F + VMSFGFK
Sbjct: 123  PLEGIALERELLEELKGRSQIIYDTSDMKPRDLREKIVKHFATNQGE-TFTVNVMSFGFK  181

Query: 179  YGLPLDADLVFDVRFLPNPYYQVELREKTGLDEDVFNYVMSHPESEVFYKHLLNLIVPIL  238
            YG+P+DADLVFDVRFLPNPYY  +R  TG D++V +YVM   E++ F + L++L+   +L
Sbjct: 182  YGIPIDADLVFDVRFLPNPYYIESMRPLTGKDKEVSSYVMKWNETQKFNEKLIDLLSFML  241

Query: 239  PAYQKEGKSVLTVAIGCTGGQHRSVAFAHCLAESLATDWSVNESHRDQNRR          289
            P+Y++EGKS + +AIGCTGGQHRSV A   LA+   D+  + +HRD  +R
Sbjct: 242  PSYKREGKSQVVIAIGCTGGQHRSVTLAENLADYFKKDYYTHVTHRDIEKR          292
```

An alignment of the GAS and GBS proteins is shown below.

```
Identities = 234/296 (79%), Positives = 263/296 (88%)
Query:   1  MSDEQIKLVIVTGMSGAGKTVAIQSFEDLGYFTIDNMPPTLVPKFLELAAQSGDTSKIAM   60
            MSD+ I LVIVTGMSGAGKTVAIQSFEDLGYFTIDNMPP LVPKFLEL  Q+ +  ++A+
Sbjct:   1  MSDKHINLVIVTGMSGAGKTVAIQSFEDLGYFTIDNMPPALVPKFLELIEQTNENRRVAL   60

Query:  61  VVDMRSRLFFREINSILDSLEINDNINFKILFLDATDTELVSRYKETRRSHPLAADGRVL  120
            VVDMRSRLFF+EINS LDS+E N  +I+F+ILFLDATD ELVSRYKETRRSHPLAADGRVL
Sbjct:  61  VVDMRSRLFFKEINSTLDSIESNPSIDFRILFLDATDGELVSRYKETRRSHPLAADGRVL  120

Query: 121  DGISLERELLAPLKSMSQNVVDTSELTPRQLRKVISKEFSNQDSQSSFRIEVMSFGFKYG  180
            DGI LERELL+PLKSMSQ+VVDT++LTPRQLRK IS +FS    +Q+SFRIEVMSFGFKYG
Sbjct: 121  DGIRLERELLSPLKSMSQHVVDTTKLTPRQLRKTISDQFSEGSNQASFRIEVMSFGFKYG  180

Query: 181  IPLDADLVFDVRFLPNPYYKPELRDKTGLDTEVYDYVMSFDESDDFYDHLLALIKPILPG  240
            +PLDADLVFDVRFLPNPYY+ ELR+KTGLD +V++YVMS  ES+ FY HLL LI PILP
Sbjct: 181  LPLDADLVFDVRFLPNPYYQVELREKTGLDEDVFNYVMSHPESEVFYKHLLNLIVPILPA  240

Query: 241  YQNEGKSVLTVAIGCTGGQHRSTAFAHRLSEDLKADWTVNESHRDKNKRKETVNRS      296
            YQ EGKSVLTVAIGCTGGQHRS AFAH L+E L  DW+VNESHRD+N+RKETVNRS
Sbjct: 241  YQKEGKSVLTVAIGCTGGQHRSVAFAHCLAESLATDWSVNESHRDQNRRKETVNRS      296
```

Based on this analysis, it was predicted that these proteins and their epitopes could be useful antigens for vaccines or diagnostics.

Example 1780

A DNA sequence (GBSx1887) was identified in *S. agalactiae* <SEQ ID 5533> which encodes the amino acid sequence <SEQ ID 5534>. Analysis of this protein sequence reveals the following:

Possible site: 36
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:CAB96620 GB:AJ400630 hypothetical protein
[Streptococcus pneumoniae bacteriophage MM1]
Identities = 254/321 (79%), Positives = 286/321 (88%), Gaps = 1/321 (0%)
Query:   1 MRKPKITVIGGGTGIPVILKSLRLEDVEITAVVTVADDGGSSGELRSVMQ-LTPPGDLRN   59
           MRKPKITVIGGGTGIPVILKSLR +DVEI A+VTVADDGGSSGELR  MQ LTPPGDLRN
Sbjct:   1 MRKPKITVIGGGTGIPVILKSLREKDVEIAAIVTVADDGGSSGELRKNMQQLTPPGDLRN   60

Query:  60 VLVALSDMPKFYEQIFQYRFAEGDGDFAGHPLGNLIIAGVAEMQGSTYNAMQSLTQFFHT  119
           VLVA+SDMPKFYE++FQYRF+E   G  FAGHPLGNLIIAG++EMQGSTYNAMQ L++FFHT
Sbjct:  61 VLVAMSDMPKFYEKVFQYRFSEDAGAFAGHPLGNLIIAGLSEMQGSTYNAMQLLSKFFHT  120

Query: 120 TGKIYPSSEHPLTLHAVEKDGHEVVGESQIADYKGMIDHVYVTNTYNEETPTASRKVVDA  179
           TGKIYPSS+HPLTLHAVF+DG EV GES I D++G+ID+VYVTN  N++TP ASR+VV
Sbjct: 121 TGKIYPSSDHPLTLHAVFQDGTEVAGESHIVDHRGIIDNVYVTNALNDDTPLASRRVVQT  180

Query: 180 ILESDMIVLGPGSLFTSILPNLVIPEIKQALLETRAEVAYVCNIMTQRGETEHFTDADHV  239
           ILESDMIVLGPGSLFTSILPN+VI  EI  +ALLET+AE+AYVCNIMTQRGETEHFTD+DHV
Sbjct: 181 ILESDMIVLGPGSLFTSILPNIVIKEIGRALLETKAEIAYVCNIMTQRGETEHFTDSDHV  240

Query: 240 EVLKRHLGQDAIDTVLVNIEKVPESYMENNHFDEYLVQVEHDFSGLRKHARRVISSNFLK  299
           EVL RHLG+   IDTVLVNIEKVP+ YM +N FDEYLVQVEHDF GL K    RVISSNFL+
Sbjct: 241 EVLHRHLGRPFIDTVLVNIEKVPQEYMNSNRFDEYLVQVEHDFVGLCKQVSRVISSNFLR  300

Query: 300 LEKGGAFHHGDFVVEELMNLV                                         320
           LE GGAFH GD +V+ELM ++
Sbjct: 301 LENGGAFHDGDLIVDELMRII                                         321
```

A related DNA sequence was identified in *S. pyogenes* <SEQ ID 5535> which encodes the amino acid sequence <SEQ ID 5536>. Analysis of this protein sequence reveals the following:

An alignment of the GAS and GBS proteins is shown below.

```
Identities = 251/320 (78%), Positives = 284/320 (88%)
Query:   1 MRKPKITVIGGGTGIPVILKSLRLEDVEITAVVTVADDGGSSGELRSVMQLTPPGDLRNV   60
           M+ PK+TVIGGGTGI +ILKSLR E V+ITAVVTVADDGGSSGELR+ MQL PPGDLRNV
Sbjct:   1 MKNPKMTVIGGGTGISIILKSLRNEAVDITAVVIVADDGGSSGELRNAMQLAPPGDLRNV   60

Query:  61 LVALSDMPKFYEQIFQYRFAEGDGDFAGHPLGNLIIAGVAEMQGSTYNAMQSLTQFFHTT  120
           L+A+SDMPKFYE++FQYRF E DG  AGHPLGNLIIAG++EMQGSTYNA+Q LT+FFH T
Sbjct:  61 LLAMSDMPKFYERVFQYRFNESDGALAGHPLGNLIIAGISEMQGSTYNAIQILTKFFHIT  120

Query: 121 GKIYPSSEHPLTLHAVFKDGHEVVGESQIADYKGMIDHVYVTNTYNEETPTASRKVVDAI  180
           GKIYPSSE  LTLHAVFKDGHEV GES IA Y GMIDHVYVTNTYN++  P ASRKV+AI
Sbjct: 121 GKIYPSSEQALTLHAVFKDGHEVAGESSIAKYPGMIDHVYVTNTYNDQKPQASRKVVEAI  180

Query: 181 LESDMIVLGPGSLFTSILPNLVIPEIKQALLETRAEVAYVCNIMTQRGETEHFTDADHVE  240
           LESDMIVLGPGSLFTSILPNLVIPEIK+AL  +T+AEV Y+CNIMTQ GETE F+DADHV
Sbjct: 181 LESDMIVLGPGSLFTSILPNLVIPEIKEALRQTKAEVVYICNIMTQYGETEQFSDADHVA  240

Query: 241 VLKRHLGQDAIDTVLVNIEKVPESYMENNHFDEYLVQVEHDFSGLRKHARRVISSNFLKL  300
           VL +HLG+D IDTVLVN+ KVP++YM +N FDEYLVQV+HDF+GL + A+RVISS FL+L
Sbjct: 241 VLNQHLGRDLIDTVLVNVAKVPQAYMNSNKFDEYLVQVDHDFAGLCRAAKRVISSYFLRL  300

Query: 301 EKGGAFHHGDFVVEELMNLV                                          320
           E GGAFH G+ VVEELMNLV
Sbjct: 301 ENGGAFHDGNLVVEELMNLV                                          320
```

Possible site: 36
>>> Seems to have an uncleavable N-term signal seq
----- Final Results -----

SEQ ID 5534 (GBS269) was expressed in *E. coli* as a His-fusion product. SDS-PAGE analysis of total cell extract is shown in FIG. 49 (lane 12; MW 35 kDa). It was also expressed in *E. coli* as a GST-fusion product. SDS-PAGE analysis of total cell extract is shown in FIG. 54 (lane 5; MW 60.5 kDa).

Based on this analysis, it was predicted that these proteins and their epitopes could be useful antigens for vaccines or diagnostics.

Example 1781

A DNA sequence (GBSx1888) was identified in *S. agalactiae* <SEQ ID 5537> which encodes the amino acid sequence <SEQ ID 5538>. Analysis of this protein sequence reveals the following:

Possible site: 34
>>> Seems to have no N-terminal signal sequence
----- Final Results -----
bacterial cytoplasm --- Certainty = 0.2479 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

A related DNA sequence was identified in *S. pyogenes* <SEQ ID 5539> which encodes the amino acid sequence <SEQ ID 5540>. Analysis of this protein sequence reveals the following:

Possible site: 35
>>> Seems to have no N-terminal signal sequence
----- Final Results -----
bacterial cytoplasm --- Certainty = 0.1698 (Affirmative) <succ>
bacterial membrane --- Certainty = 0.0000 (Not Clear) <succ>
bacterial outside --- Certainty = 0.0000 (Not Clear) <succ>

```
>GP:CAB96619 GB:AJ400630 hypothetical protein [Streptococcus pneumoniae
bacteriophage MM1]
Identities = 209/303 (68%), Positives = 260/303 (84%)
Query:   1   MSFTVKVKEELLGHKSENKMELSAIIKMSGSLGLANHGLNLSITTENAKIARHIYSMLEE    60
             MSFTV VKEE+LG    ++ ELSAIIKMSGS+GL+  GL LS+ TENAK+ARH+Y
Sbjct:   1   MSFTVAVKEEILGQHHLSRHELSAIIKMSGSIGLSTSGLTLSVVTENAKLARHLYESFLH    60

Query:  61   HYHLQPEIKYHQKTNLRKNRVYTVFIEEKVDVILADLKLADAFFGIETGIEHSILDNDEN   120
              Y ++ EI++HQ++NLRKNRVYTVF +EKV  +L+DL LAD+FFG+ETGI+  +IL ++E
Sbjct:  61   FYEIKSEIRHHQRSNLRKNRVYTVFTDEKVQDLLSDLHLADSFFGLETGIDEAILSDEEA   120

Query: 121   GRAYLRGAFLSTGTVREPDSGKYQLEIFSVYLDHAQDLANLMKKFMLDAKVIEHKHGAVT   180
             GRAYL GAFL+ G++R+P+SGKYQLEI SVYLDHAQ +A+L+++F+LDAKV+E K GAVT
Sbjct: 121   GRAYLCGAFLANGSIRDPESGKYQLEISSVYLDHAQGIASLLQQFLLDAKVLERKKGAVT   180

Query: 181   YLQKAEDIMDFLIVIDAMEARDAFEEIKMIRETRNDINRANNVETANIARTITASMKTIN   240
             YLQ+AEDIMDFLIVI AM+ARD FE +K++RETRND+NRANN ETANIART++ASMKTIN
Sbjct: 181   YLQRAEDIMDFLIVIGAMQARDDFERVKILRETRNDLNRANNAETANIARTVSASMKTIN   240

Query: 241   NIIKIMDTIGFDALPSDLRQVAQVRVAHPDYSIQQIADSLETPLSKSGVNHRLRKINKIA   300
             NI KI D +G + LP DL++VAQ+R+ HPDYSIQQ+ADSL TPL+KSGVNHRLRKINKIA
Sbjct: 241   NISKIKDIMGLENLPVDLQEVAQLRIQHPDYSIQQLADSLSTPLTKSGVNHRLRKINKIA   300

Query: 301   DEL                                                           303
             DEL
Sbjct: 301   DEL                                                           303
```

An alignment of the GAS and GBS proteins is shown below.

```
Identities = 222/303 (73%), Positives = 269/303 (88%)
Query:   1   MSFTVKVKEELLGHKSENKMELSAIIKMSGSLGLANHGLNLSITTENAKIARHIYSMLEE    60
             MSFT KVKEEL+  + + EL+AIIK+SGSLGLA+  L+LSITTENAKIAR+IYS++E+
Sbjct:   1   MSFITKVKEELIHLSTGDNNELAAIIKLSGSLGLAHQSLHLSITTENAKIARYIYSLIED    60

Query:  61   HYHLQPEIKYHQKTNLRKNRVYTVFIEEKVDVILADLKLADAFFGIETGIEHSILDNDEN   120
              Y + PEI+YHQKTNLRKNRVYTV++E+ V+ ILADLKLAD+FFGLETGIE   +L +D
Sbjct:  61   AYVIVPEIRYHQKTNLRKNRVYTVYVEQGVETILADLKLADSFFGLETGIEPQVLSDDNA   120

Query: 121   GRAYLRGAFLSTGTVREPDSGKYQLEIFSVYLDHAQDLANLMKKFMLDAKVIEHKHGAVT   180
             GR+YL+GAFL+  G++R+P+SGKYQLEI+SVYLDHAQDLA LM+KFMLDAK IEHK GAVT
Sbjct: 121   GRSYLKGAFLAAGSIRDPESGKYQLEIYSVYLDHAQDLAQLMQKFMLDAKTIEHKSGAVT   180

Query: 181   YLQKAEDIMDFLIVIDAMEARDAFEEIKMIRETRNDINRANNVETANIARTITASMKTIN   240
             YLQKAEDIMDFLI+I AM   ++ FE IK++RE RNDINRANN ETANIA+TI+ASMKTIN
Sbjct: 181   YLQKAEDIMDFLIIIGAMSCKEDFEAIKLLREARNDINRANNAETANIAKTISASMKTIN   240

Query: 241   NIIKIMDTIGFDALPSDLRQVAQVRVAHPDYSIQQIADSLETPLSKSGVNHRLRKINKIA   300
```

```
                NIIKIMDTIG ++LP +L+QVAQ+RV HPDYSIQQ+AD+LE P++KSGVNHRLRKINKIA
Sbjct:  241     NIIKIMDTIGLESLPIELQQVAQLRVKHPDYSIQQVADALEFPITKSGVNHRLRKINKIA     300

Query:  301     DEL                                                              303
                D+L
Sbjct:  301     DDL                                                              303
```

Based on this analysis, it was predicted that these proteins and their epitopes could be useful antigens for vaccines or diagnostics.

Example 1782

A DNA sequence (GBSx1889) was identified in *S. agalactiae* <SEQ ID 5541> which encodes the amino acid sequence <SEQ ID 5542>. This protein is predicted to be dipeptidase. Analysis of this protein sequence reveals the following:

Possible site: 23
>>> Seems to have no N-terminal signal sequence
----- Final Results -----
   bacterial cytoplasm --- Certainty = 0.3544 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

A related DNA sequence was identified in *S. pyogenes* <SEQ ID 5543> which encodes the amino acid sequence <SEQ ID 5544>. Analysis of this protein sequence reveals the following:

Possible site: 30
>>> Seems to have no N-terminal signal sequence
----- Final Results -----
   bacterial cytoplasm --- Certainty = 0.0514 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
>GP:CAA86210 GB:Z38063 dipeptidase [Lactobacillus helveticus]
Identities = 218/473 (46%), Positives = 310/473 (65%), Gaps = 14/473 (2%)
Query:  3       CTTILVGKKASYDGSTMIARTEDSVNGDFTPKKLKVMTSKDQPRHYKSVLSNFEVD---L    59
                CTTILVGKKAS DGSTMIAR+ED      P+   KV+  +DQP+HY SV+S  ++D    L
Sbjct:  6       CTTILVGKKASIDGSTMIARSEDG-GRVIIPEGFKVVNPEDQPKHYTSVISKQKIDDEDL   64

Query:  60      PDNPLPYTSVPDALGKDGIWGEAGINSKNVAMSATETITTNSRVLGADPLVSD---GIGE  116
                + PL YTS PD  GK+GIWG AGIN+ NVAM+ATETITTNSR+ G DP++     G+GE
Sbjct:  65      AETPLRYTSAPDVSGKNGIWGAAGINADNVAMTATETITTNSRIQGVDPILDPSEGGLGE  124

Query:  117     EDILTLVLPYIQSAREGVERLGAILEKYGTYESNGIAFSDTEEIWWLETIGGHHWIARRV  176
                ED +TL LPY+ SA +GV+R+G ++EKYGTYE NG+AFSD +  IW+LETIGGHHWIARR+
Sbjct:  125     EDFVTLTLPYLHSAFDGVKRVGYLVEKYGTYEMNGMAFSDKDNIWYLETIGGHHWIARRI  184

Query:  177     PADVYVTNPNQLGIDHFEFNNCDDYMCSSDLKEFIEQYHLDLTYSNEHFNPRYAFGSQRD  236
                P DD YV  PN+L ID F+F++  +++    +SDLK+ I++YHL+      E +N R+ FGS
Sbjct:  185     PDDAYVIAPNRLNIDTFDFDDSENFAAASDLKDLIDEYHLN--PDREGYNMRHIFGSSTI  242

Query:  237     KDRHYNTPRSWAMQRFLNPEIEQDPRSLFIPWCQKPYRKITVEDIKYVLSDHYQDSVYDP  296
                KD HYN PR+W +  + +P+     P  P+  +  R I++EDIK+  S HYQD+ YD
Sbjct:  243     KDAHYNNPRAWYIHNYFDPDFGGTPADQDQPFICRANRLISIEDIKWAESSHYQDTPYDA  302

Query:  297     YGPEGDAVSRRAFRSVGINRTSQTSILQLRPNKSLETTGVQWLSYGSMPFATMVPLFTQV  356
                YG +G   ++ FR +GINR +T ILQ+R +    E    GVQWL++G     F +M+P +T V
Sbjct:  303     YGDQGTPEQKKTFRPIGINRNFETHILQIRNDVPAEIAGVQWLAFGPNTFNSMLPFYTNV  362

Query:  357     ETVPNYFSNTTKDASTDNFYWTNRLIAALADPHFYQHEADIESYIERTMAQGHAHINGVD  416
                 T P   + TK  +  +W N+L A L D ++    +++ ++++AQ H     + D
Sbjct:  363     TTTPEAWQTTPK-FNLNKIFWLNKLTAQLGDTNYRVYGELEDAFEQKSLAQCHKIQHETD  421

Query:  417     REVAENKEIDFQQK----NQEMSDYIQKESQELLNRILFDASNLMTNRFSMGD         465
                +EV      + Q K    NQ+MSD +   + ELL +++ +    LMT ++ + D
Sbjct:  422     KEVKNLSGKELQDKLIAANQKMSDTVYNNTVELLGQMVDEGHGLMTLKYDLLD         474
```

```
Identities = 345/464 (74%), Positives = 407/464 (87%)
Query: 2    ACTTILVGKKASYDGSTMIARTEDSVNGDFTPKKLKVMTSKDQPRHYKSVLSNFEVDLPD    61
            +CTTILVGKKASYDGSTM+ARTEDS NGDFTPKK+ V+  +DQPRHY+SV S+FE+DLPD
Sbjct: 9    SCTTILVGKKASYDGSTMVARTEDSQNGDFTPKKMIVVKPEDQPRHYRSVQSSFEMDLPD    68

Query: 62   NPLPYTSVPDALGKDGIWGEAGINSKNVAMSATETITTNSRVLGADPLVSDGIGEEDILT   121
            NP+ YTSVPDALGKDGIW EAG+N  NVAMSATETITTNSRVLGADPLV+ GIGEED++T
Sbjct: 69   NPMTYTSVPDALGKDGIWAEAGVNEANVAMSATETITTNSRVLGADPLVASGIGEEDMVT   128

Query: 122  LVLPYIQSAREGVERLGAILEKYGTYESNGIAFSDTEEIWWLETIGGHHWIARRVPDDVY   181
            LVLPYI+SAREGV RLGAILE YGTYESNG+AFSD  +IWWLETIGGHHWIARRVPDD Y
Sbjct: 129  LVLPYIRSAREGVLRLGAILEDYGTYESNGVAFSDEHDIWWLETIGGHHWIARRVPDDAY   188

Query: 182  VTNPNQLGIDHFEFNNCDDYMCSSDLKEFIEQYHLDLTYSNEHFNPRYAFGSQRDKDRHY   241
            VTNPNQ GIDHFEFNN +DY+CS+DLK+FI+ YHLDLTYS+EHFNPRYAFGSQRDKDR Y
Sbjct: 189  VTNPNQFGIDHFEFNNPEDYLCSADLKDFIDTYHLDLTYSHEHFNPRYAFGSQRDKDRQY   248

Query: 242  NTPRSWAMQRFLNPEIEQDPRSLFIPWCQKPYRKITVEDIKYVLSDHYQDSVYDPYGPEG   301
            NTPR+W MQ+FLNPEI QDPRS + WCQKPYRKITVED+KYVLS HYQD+ YDPYG EG
Sbjct: 249  NTPRAWIMQKFLNPEIVQDPRSFALAWCQKPYRKITVEDVKYVLSSHYQDTGYDPYGSEG   308

Query: 302  DAVSRRAFRSVGINRTSQTSILQLRPNKSLETTGVQWLSYGSMPFATMVPLFTQVETVPN   361
                VS++ FR +GINRTSQT+IL +RPNK E   +QW++YGSMPF TMVP FTQV+T+P+
Sbjct: 309  TPVSKKVFRPIGINRTSQTAILHIRPNKPQEIAAIQWMAYGSMPFNTMVPFFTQVKTIPD   368

Query: 362  YFSNTTKDASTDNFYWTNRLIAALADPHFYQHEADIESYIERTMAQGHAHINGVDREVAE   421
            YF+NT ++   TDNFYWTNRLIAALADPH+  HE D+++Y+E TMA+GHA ++ V+ ++
Sbjct: 369  YFANTYENVFTDNFYWTNRLIAALADPHYNHHETDLDNYLEETMAKGHAMLHAVEVQLLA   428

Query: 422  NKEIDFQQKNQEMSDYIQKESQELLNRILFDASNLMTNRFSMGD                 465
            + +D +++NQ+MSDY+Q E+Q LLN+ILFDASNLMTNRFS+ D
Sbjct: 429  GETVDLEEENQKMSDYVQGETQTLLNKILFDASNLMTNRFSLSD                 472
```

Based on this analysis, it was predicted that these proteins and their epitopes could be useful antigens for vaccines or diagnostics.

Example 1783

A DNA sequence (GBSx1890) was identified in *S. agalactiae* <SEQ ID 5545> which encodes the amino acid sequence <SEQ ID 5546>. Analysis of this protein sequence reveals the following:

Possible site: 15
>>> Seems to have a cleavable N-term signal seq.
----- Final Results -----
  bacterial outside --- Certainty = 0.3000 (Affirmative) <succ>
  bacterial membrane --- Certainty = 0.0000 (Not Clear) <succ>
  bacterial cytoplasm --- Certainty = 0.0000 (Not Clear) <succ>

The protein has homology with the following sequences in the GENPEPT database.

```
>GP:CAA96185 GB:Z71552 AdcA protein [Streptococcus pneumoniae]
Identities = 257/429 (59%), Positives = 312/429 (71%), Gaps = 7/429 (1%)
Query: 1    MRKKFLLLMSFVAMFAAWQLVQVKQVWADSKLKVVTTFYPVYEFTKNVVGDKADVSMLIK    60
            M+K LLL S A+F     +  Q  AD KL +VTTFYPVYEFTK V GD A+V +LI
Sbjct: 1    MKKISLLLASLCALFL---VACSNQKQADGKLNIVTTFYPVYEFTKQVAGDTANVELLIG    57

Query: 61   AGTEPHDFEPSTKNIAAIQDSNAFVYMDDNMETWAPKVAKSVKSKKVTTIKGTGDMLLTK   120
            AGTEPH++EPS K +A IQD++ FVY ++NMETW PK+  ++  KKV TIK TGDMLL
Sbjct: 58   AGTEPHEYEPSAKAVAKIQDADTFVYENENMETWVPKLLDTLDKKKVKTIKATGDMLLLP   117

Query: 121  GVEEEGEEHEGHGHEGHHHELDPHVWLSPERAISVVENIRNKFVKAYPKDAASFNKNADA   180
            G EEE +H+ HG EGHHHE DPHVWLSP RAI +VE+IR+         YP    +F KNA A
Sbjct: 118  GGEEEEGDHD-HGEEGHHHEFDPHVWLSPVRAIKLVEHIRDTLSADYPDKKETFEKNAAA   176

Query: 181  YIAKLKELDKEYKNGLSNAKQKSFVTQHAAFGYMALDYGLNQVPIAGLTPDAEPSSKRLG   240
            YI KL+ LDK Y  GLS AK+KSFVTQHAAF Y+ALDYGL QV I+GL+PDAEPS+ RL
Sbjct: 177  YIEKLQSLDKAYAEGLSQAKEKSFVTQHAAFNYLALDYGLKQVAISGLSPDAEPSAARLA   236

Query: 241  ELAKYIKKYNINYIYFEENASNKVAKTLADEVGVKTAVLSPLEGLSKKEMAAGEDYFSVM   300
            EL +Y+KK  I  YIYFEENAS +A TL+ E GVKT VL+PLE L++++ AGE+Y SVM
Sbjct: 237  ELTEYVKKNKIAYIYFEENASQALANTLSKEAGVKTDVLNPLESLTEEDTKAGENYISVM   296

Query: 301  RRNLKVLKKTTDVAGKEVAPEE-DKTKTVETGYEKTKDVKDRKLTDYSGNWQSVYPLLQD   359
            +NLK LK+TTD   G + PE+ + TKTV+ GYF+    VKDR L+DY+GNWQSVYP L+D
Sbjct: 297  EKNLKALKQTTDQEGPAIEPEKAEDTKTVQNGYFEDAAVKDRTLSDYAGNWQSVYPFLED   356

Query: 360  GTLDPVWDYKAKSKKDMTAAEYKKYYTAGYKTDVESIKIDGKKHQMTFVRNGKSQTFTYK   419
            GT D V+DYKAK    MT AEYK YYT GY+TDV  I I    + M FV+ G+S+ +TYK
```

```
                            -continued
Sbjct:  357  GTFDQVFDYKAKLTGKMTQAEYKAYYTKGYQTDVTKINI--TDNTMEFVQGGQSKKYTYK  414

Query:  420  YAGYKILTY                                                     428
             Y G KILTY
Sbjct:  415  YVGKKILTY                                                     423
```

A related DNA sequence was identified in *S. pyogenes* <SEQ ID 5547> which encodes the amino acid sequence <SEQ ID 5548>. Analysis of this protein sequence reveals the following:

```
    Possible site: 17
      >>> Seems to have a cleavable N-term signal seq.
      ----- Final Results -----
         bacterial outside --- Certainty = 0.3000 (Affirmative) <succ>
         bacterial membrane --- Certainty = 0.0000 (Not Clear) <succ>
         bacterial cytoplasm --- Certainty = 0.0000 (Not Clear) <succ>
```

The protein has homology with the following sequences in the databases:

```
>GP:CAA96185 GB:Z71552 AdcA protein [Streptococcus pneumoniae]
Identities = 259/438 (59%), Positives = 326/438 (74%), Gaps = 16/438 (3%)
Query:   1   MKKKILLMMSLISVFFAWQLTQAKQVLAEGKVKVVTTFYPVYEFTKGVIGNDGDVFMLMK    60
             MKK  LL+ SL ++F    +  + Q  A+GK+ +VTTFYPVYEFTK V G+   +V +L+
Sbjct:   1   MKKISLLLASLCALFL---VACSNQKQADGKLNIVTTFYPVYEFTKQVAGDTANVELLIG   57

Query:  61   AGTEPHDFEPSTKDIKKIQDADAFVYMDDNMETWVSDVKKSLTSKKVTIVKGTGNMLLVA   120
             AGTEPH++EPS K + KIQDAD FVY ++NMETWV +  +L  KKV +K TG+MLL+
Sbjct:  58   AGTEPHEYEPSAKAVAKIQDADTFVYENENMETWVPKLLDTLDKKKVKTIKATGDMLLLP  117

Query: 121   GAGHDHPHEDADKKHEHNKHSEEGHNHAFDPHVWLSPYRSITVVENIRDSLSKAYPEKAE   180
             G        E+ + H+H   EEGH+H FDPHVWLSP R+I +VE+IRD+LS   YP+K E
Sbjct: 118   GG------EEEEGDHDHG---EEGHHHEFDPHVWLSPVRAIKLVEHIRDTLSADYPDKKE  168

Query: 181   NFKANAATYIEKLKELDKDYTAALSDAKQKSFVTQHAAFGYMALDYGLNQISINGVTPDA   240
              F+ NAA YIEKL+ LDK Y   LS AK+KSFVTQHAAF Y+ALDYGL Q++I+G++PDA
Sbjct: 169   TFEKNAAAYIEKLQSLDKAYAEGLSQAKEKSFVTQHAAFNYLALDYGLKQVAISGLSPDA  228

Query: 241   EPSAKRIATLSKYVKKYGIKYIYFEENASSKVAKTLAKEAGVKAAVLSPLEGLTEKEMKA   300
             EPSA R+A L++YVKK   I YIYFEENAS   +A TL+KEAGVK   VL+PLE LTE++ KA
Sbjct: 229   EPSAARLAELTEYVKKKNKIAYIYFEENASQALANTLSKEAGVKTDVLNPLESLTEEDTKA  288

Query: 301   GQDYFTVMRKNLETLRLTTDVAGKEILPEK-DTTKTVYNGYFKDKEVKDRQLSDWSGSWQ   359
             G++Y +VM KNL+ L+ TTD   G  I PEK + TKTV NGYF+D  VKDR LSD++G+WQ
Sbjct: 289   GENYISVMEKNLKALKQTTDQEGPAIEPEKAEDTKTVQNGYFEDAAVKDRTLSDYAGNWQ  348

Query: 360   SVYPYLQDGTLDQVWDYKAKKSKGKMTAAEYKDYYTTGYKTDVEQIKINGKKKTMTFVRN   419
             SVYP+L+DGT DQV+DYKAK + GKMT AEYK YYT GY+TDV   KIN    TM FV+
Sbjct: 349   SVYPFLEDGTFDQVFDYKAKLT-GKMTQAEYKAYYTKGYQTDV--TKINITDNTMEFVQG  405

Query: 420   GEKKTFTYTYAGKEILTY                                            437
             G+ K +TY Y GK+ILTY
Sbjct: 406   GQSKKYTYKYVGKKILTY                                            423
```

An alignment of the GAS and GBS proteins is shown below.

```
Identities = 353/515 (68%), Positives = 422/515 (81%), Gaps = 9/515 (1%)
Query:   1   MRKKFLLLMSFVAMFAAWQLVQVKQVWADSKLKVVTTFYPVYEFTKNVVGDKADVSMLIK    60
             M+KK LL+MS +++F AWQL Q KQV A+ K+KVVTTFYPVYEFTK V+G+   DV ML+K
Sbjct:   1   MKKKILLMMSLISVFFAWQLTQAKQVLAEGKVEVVTTFYPVYEFTKGVIGNDGDVFMLMK   60

Query:  61   AGTEPHDFEPSTKNIAAIQDSNAFVYMDDNMETWAPKVAKSVKSKKVTTIKGTGDMLLTK   120
             AGTEPHDFEPSTK+I  IQD++AFVYMDDNMETW    V KS+ SKKVT +KGTG+MLL
Sbjct:  61   AGTEPHDFEPSTKDIKKIQDADAFVYMDDNMETWVSDVKKSLTSKKVTIVKGTGNMLLVA  120

Query: 121   GV--------EEEGEEHEGHGHEGHHHELDPHVWLSPERAISVVENIRNKFVKAYPKDAA  172
             G         ++  EH  H  EGH+H  DPHVWLSP R+I+VVENIR+    KAYP+ A
Sbjct: 121   GAGHDHPHEDADKKHEHNKHSEEGHNHAFDPHVWLSPYRSITVVENIRDSLSKAYPEKAE  180
```

```
Query: 173  SFNENADAYIAKLKELDKEYKNGLSNAKQKSFVTQHAAFGYMALDYGLNQVPIAGLTPDA  232
            +F  NA  YI KLKELDK+Y   LS+AKQKSFVTQHAAFGYMALDYGLNQ+ I G+TPDA
Sbjct: 181  NFKANAATYIEKLKELDKDYTAALSDAKQKSFVTQHAAFGYMALDYGLNQISINGVTPDA  240

Query: 233  EPSSKRLGELAKYIKKYNINYIYFEENASNKVAKTLADEVGVKTAVLSPLEGLSKKEMAA  292
            EPS+KR+  L+KY+KKY I YIYFEENAS+KVAKTLA E GVK AVLSPLEGL++KEM A
Sbjct: 241  EPSAKRIATLSKYVKRYGIKYIYFEENASSKVAKTLAKEAGVKAAVLSPLEGLTEKEMKA  300

Query: 293  GEDYFSVMRRNLKVLKKTTDVAGKEVAPEEDKTKTVETGYFKTKDVKDRKLTDYSGNWQS  352
            G+DYF+VMR+NL+ L+ TTDVAGKE+ PE+D TKTV  GYFK K+VKDR+L+D+SG+WQS
Sbjct: 301  GQDYFTVMRKNLETLRLTTDVAGKEILPEKDTTKTVYNGYFKDKEVKDRQLSDWSGSWQS  360

Query: 353  VYPLLQDGTLDPVWDYKA-KSKKDMTAAEYKKYYTAGYKTDVESIKIDGKKHQMTFVRNG  411
            VYP LQDGTLD VWDYKA KSK  MTAAEYK YYT GYKTDVE IKI+GKK  MTFVRNG
Sbjct: 361  VYPYLQDGTLDQVWDYKAKKSKGKMTAAEYKDYYTTGYKTDVEQIKINGKKKTMTFVRNG  420

Query: 412  KSQTFTYKYAGYKILTYKKGNRGVRYLFEAKEKDAGQFKYIQFSDHGIKPNKAEHFHIFW  471
            +  +TFTY YAG +ILTY KGNRGVR++FEAKE DAG+FKY+QFSDH I P KA+HFH++W
Sbjct: 421  EKKTFTYTYAGKEILTYPKGNRGVRFMFEAKEADAGEFKYVQFSDHAIAPEKAKHFHLYW  480

Query: 472  GSESQEKLFEEMENWPTYFPAKMSGREVAQDLMSH                          506
            G +SQEKL +E+E+WPTY+ + +SGRE+AQ++ +H
Sbjct: 481  GGDSQEKLHKELEHWPTYYGSDLSGREIAQEINAH                          515
```

Based on this analysis, it was predicted that these proteins and their epitopes could be useful antigens for vaccines or diagnostics.

A related GBS gene <SEQ ID 8899> and protein <SEQ ID 8900> were also identified. Analysis of this protein sequence reveals the following:

Lipop: Possible site: −1   Crend: 3
SRCFLG: 0
McG: Length of UR: 19
Peak Value of UR: 2.79
Net Charge of CR: 3
McG: Discrim Score: 9.08
GvH: Signal Score (−7.5): 2.59
Possible site: 15
>>> Seems to have a cleavable N-term signal seq.
Amino Acid Composition: calculated from 16

ALOM program count: 0 value: 7.69 threshold: 0.0
PERIPHERAL    Likelihood = 7.69        264
modified ALOM score: −2.04

*** Reasoning Step: 3

Rule gpo1

----- Final Results ----- bacterial outside --- Certainty = 0.3000 (Affirmative) <succ>
bacterial membrane --- Certainty = 0.0000 (Not Clear) <succ>
bacterial cytoplasm --- Certainty = 0.0000 (Not Clear) <succ>

The protein has homology with the following sequences in the databases:

```
3758895|emb|CAA96185.1||Z71552 AdcA protein {Streptococcus pneumoniae}
>PIR|T46756|T46756 Zn-binding lipoprotein
adcA [imported]-Streptococcus pneumoniae (fragment)
Score = 508 bits (1294), Expect = e-143
Identities = 257/429 (59%), Positives = 312/429 (71%), Gaps = 7/429 (1%)
Query:   1  MRKKFLLLMSFVAMFAAWQLVQVKQVWADSKLKVVTTFYPVYEFTKNVVGDKADVSMLIK   60
            M+K  LLL S  A+F    +   Q    AD KL +VTTFYPVYEFTK V GD A+V +LI
Sbjct:   1  MKKISLLLASLCALFL---VACSNQKQADGKLNIVTIFYPVYEFTKQVAGDTANVELLIG   57

Query:  61  AGTEPHDFEPSTKNIAAIQDSNAFVYMDDNMETWAPKVAKSVKSKKVTTIKGTGDMLLTK  120
            AGTEPH++EPS K +A IQD++ FVY ++NMETW PK+  ++  KKV TIK TGDMLL
Sbjct:  58  AGTEPHEYEPSAKAVAKIQDADTFVYENENMETWVPKLLDTLDKKKVKTIKATGDMLLLP  117

Query: 121  GVEEEGEEHEGHGHEGHHHELDPHVWLSPERAISVVENIRNKFVKAYPKDAASFNKNADA  180
            G EEE  +H+ HG EGHHHE DPHVWLSP RAI +VE+IR+     YP    +F KNA A
Sbjct: 118  GGEEEEGDHD-HGEEGHHHEFDPHVWLSPVRAIKLVEHIRDTLSADYPDKKETFEKNAAA  176

Query: 181  YIAKLKELDKEYKNGLSNAKQKSFVTQHAAFGYMALDYGLNQVPIAGLTPDAEPSSKRLG  240
            YI KL+ LDK Y  GLS AK+KSFVTQHAAF Y+ALDYGL QV  I+GL+PDAEPS+ RL
Sbjct: 177  YIEKLQSLDKAYAEGLSQAKEKSFVTQHAAFNYLALDYGLKQVAISGLSPDAEPSAARLA  236

Query: 241  ELAKYIKKYNINYIYFEENASNKVAKTLADEVGVKTAVLSPLEGLSKKEMAAGEDYFSVM  300
            EL +Y+KK  I YIYFEENAS  +A TL+ E GVKT VL+PLE L++++   AGE+Y SVM
Sbjct: 237  ELTEYVKKNKIAYIYFEENASQALANTLSKEAGVKTDVLNPLESLTEEDTKAGENYISVM  296

Query: 301  RRNLEVLKKTTDVAGKEVAPEE-DKTKTVETGYEKTKDVYDRKLTDYSGNWQSVYELLQD  359
            +NLK LK+TTD  G  + PE+ + TKTV  GYF+    VKDR L+DY+GNWQSVYP L+D
Sbjct: 297  EKNLKALKQTTDQEGPAIEPEKAEDTKTVQNGYFEDAAVKDRTLSDYAGNWQSVYPFLED  356

Query: 360  GTLDPVWDYKAKSKKDMTAAEYKKYYTAGYKTDVESIKIDGKXHQMTFVRNGKSQTETYK  419
            GT D V+DYKAK   MT AEYK YYT GY+TDV  I I    + M FV+ G+S+ +TYK
```

```
-continued
Sbjct: 357  GTFDQVFDYKAELTGKMTQAEYKAYYTKGYQTDVTKINI--TDNTMEFVQGGQSKKYTYK  414

Query: 420  YAGYKILTY                                                    428
            Y G KILTY
Sbjct: 415  YVGKKILTY                                                    423
```

SEQ ID 8900 (GBS325) was expressed in *E. coli* as a His-fusion product. SDS-PAGE analysis of total cell extract is shown in FIG. 65 (lane 3; MW 58 kDa).

The GBS325-His fusion product was purified (FIG. 210, lane 7) and used to immunise mice. The resulting antiserum was used for Western blot (FIG. 257A) and FACS (FIG. 257B). These tests confirm that the protein is immunoaccessible on GBS bacteria.

Example 1784

A DNA sequence (GBSx1891) was identified in *S. agalactiae* <SEQ ID 5549> which encodes the amino acid sequence <SEQ ID 5550>. This protein is predicted to be ribosomal protein L31 (rl31). Analysis of this protein sequence reveals the following:

Possible site: 61
>>> Seems to have no N-terminal signal sequence
----- Final Results -----
  bacterial cytoplasm --- Certainty = 0.1948 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 9637> which encodes amino acid sequence <SEQ ID 9638> was also identified.

The protein has homology with the following sequences in the GENPEPT database.

```
>GP:AAF80389 GB:AF160251 ribosomal protein L31 [Listeria innocua]
Identities = 61/81 (75%), Positives = 71/81 (87%), Gaps = 1/81 (1%)
Query:  9  MKKDIHPDYRPVVFLDTTTGYKFLSGSTKSTKETVEFE-GETYPLIRVEISSDSHPFYTG  67
           MK  IHP+YRPVVF+DT+T +KFLSGSTKS+ ET+++E G  YPL+RVEISSDSHPFYTG
Sbjct:  1  MKTGIHPEYRPVVFVDTSTDFKFLSGSTKSSSETIKWEDGNEYPLLRVEISSDSHPFYTG  60

Query: 68  RQKFTQADGRVDRFNKKYGLK                                         88
           +QK   ADGRVDRFNKKYGLK
Sbjct: 61  KQKHATADGRVDRFNKKYGLK                                         81
```

A related DNA sequence was identified in *S. pyogenes* <SEQ ID 5551> which encodes the amino acid sequence <SEQ ID 5552>. Analysis of this protein sequence reveals the following:

Possible site: 53
>>> Seems to have no N-terminal signal sequence
----- Final Results -----
  bacterial cytoplasm --- Certainty = 0.1910 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

```
Identities = 81/86 (94%), Positives = 86/86 (99%)
Query:  9  MKKDIHPDYRPVVFLDTTTGYKFLSGSTKSTKETVEFEGETYPLIRVEISSDSHPFYTGR  68
           M+KDIHPDYRPVVFLDTTTGY+FLSGSTK++KETVEFEGETYPLIRVEISSDSHPFYTGR
Sbjct:  1  MRKDIHPDYRPVVFLDTTTGYQFLSGSTKASKETVEFEGETYPLIRVEISSDSHPFYTGR  60

Query: 69  QKFTQADGRVDRFNKKYGLKDANAAQ                                    94
           QKFTQADGRVDRFNKKYGLKDANAA+
Sbjct: 61  QKFTQADGRVDRFNKKYGLKDANAAK                                    86
```

Based on this analysis, it was predicted that these proteins and their epitopes could be useful antigens for vaccines or diagnostics.

Example 1785

A DNA sequence (GBSx1892) was identified in *S. agalactiae* <SEQ ID 5553> which encodes the amino acid sequence <SEQ ID 5554>. This protein is predicted to be aspartate aminotransferase (aspC). Analysis of this protein sequence reveals the following:

Possible site: 61
>>> Seems to have no N-terminal signal sequence
----- Final Results -----
  bacterial cytoplasm --- Certainty = 0.1740 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 9421> which encodes amino acid sequence <SEQ ID 9422> was also identified.

The protein has homology with the following sequences in the GENPEPT database.

```
>GP:AAC21948 GB:U32714 aminotransferase [Haemophilus influenzae Rd]
Identities = 200/323 (61%), Positives = 264/323 (80%), Gaps = 1/323 (0%)
Query:   1  MQYYQLQNI-HVDMDDIYIVNGVSEGISMSMQALLDNDDEVLVPMPDYPLWTACVSLAGG       59
            +QYYQ + I    ++D+YI NGVSE I+M+MQALL++ DEVLVPMPDYPLWTA V+L+GG
Sbjct:  82  VQYYQSKGILGATVNDVYIGNGVSELITMAMQALLNDGDEVLVPMPDYPLWTAAVTLSGG      141

Query:  60  NAVHYICDEEANWYPDIDDIKSKITSKTKAIVLINPNNPTGAVYPREILQEIVDIARQND      119
             AVEY+CDE+ANW+P IDDIK+K+ +KTKAIV+INPNNPTGAVY +E+LQEIV+IARQN+
Sbjct: 142  KAVHYLCDEDANWFPTIDDIKAKVNAKTKAIVIINPNNPTGAVYSKELLQEIVEIARQNN      201

Query: 120  LIIFSDEVYDRLVMDGMEHIPIASIAEDIFTVTLSGLSKSHRICGFRVGWMVLSGPRQHV      179
            LIIF+DE+YD+++ DG  H  IA++A D+ TVTL+GLSK++R+ GFR GWM+L+GP+ +
Sbjct: 202  LIIFADEIYDKILYDGAVHHHIAALAPDLLTVTLNGLSKAYRVAGFRQGWMILNGPKHNA      261

Query: 180  KGYIEGLNMLANMRLCSNVLAQQVIQTSLGGQQSIDSMLLPGGRIYEQRNYIHKAINEIP      239
            KGYIEGL+MLA+MRLC+NV  Q  IQT+LGG QSI+  +LPGGR+ EQRN  +  I +IP
Sbjct: 262  KGYIEGLDMLASMRLCANVPMQHAIQTALGGYQSINEFILPGGRLLEQRNKAYDLITQIP      321

Query: 240  GLSAVKPNAGLYLFPKIDTDMYRIDNDEEFVLNFLKQEKVLLTHGRGFNMNTADHFRIVY      299
            G++ VKP   +Y+FPKID  + I +DE+ VL+ L+QEKVLL HG+GFN ++ DHFRIV
Sbjct: 322  GITCVKPMGAMYMFPKIDVKKFNIHSDEKMVLDLLRQEKVLLVHGKGFNWHSPDHFRIVT      381

Query: 300  LPRVDELTELQEKMARFLSQYKR                                           322
            LP V++L E   K+ARFLS Y++
Sbjct: 382  LPYVNQLEEAITKLARFLSDYRQ                                           404
```

There is also homology to SEQ ID 3662.

Based on this analysis, it was predicted that this protein and its epitopes, could be useful antigens for vaccines or diagnostics.

Example 1786

A DNA sequence (GBSx1893) was identified in *S. agalactiae* <SEQ ID 5555> which encodes the amino acid sequence <SEQ ID 5556>. Analysis of this protein sequence reveals the following:

Possible site: 52
>>> Seems to have no N-terminal signal sequence

-continued

INTEGRAL     Likelihood = −2.02     Transmembrane 164-180 (163-181)
----- Final Results -----
  bacterial membrane --- Certainty = 0.1808 (Affirmative) <succ>
  bacterial outside --- Certainty = 0.0000 (Not Clear) <succ>
  bacterial cytoplasm --- Certainty = 0.0000 (Not Clear) <succ>

A related GBS nucleic acid sequence <SEQ ID 10099> which encodes amino acid sequence <SEQ ID 10100> was also identified.

The protein has homology with the following sequences in the GENPEPT database.

```
>GP:BAB06181 GB:AP001515 transcriptional pleiotropic repressor
[Bacillus halodurans]
Identities = 129/257 (50%), Positives = 181/257 (70%), Gaps = 3/257 (1%)
Query:  23  NLLEKTRKITSILQRSVDSLDAELPYNTMAAQLADIIDCNACIINGGGNLLGYAMKYKTN       82
            +LL + RKI +LQ+S    + + MA  L D+I N +++ G LLG+A+K +
Sbjct:   2  SLLSRMRKINDMLQKSGVQ---HVNFREMAETLRDVISANIFVVSRRGKLLGFAIKQEIE       58

Query:  83  TDRVEEFFETKQFPDYYVKSASRVYDTEANLSVDNDLSIFPVETKENFQDGITTIAPIYG      142
             +R+++  E +QFP+ Y    +V +T ANL ++++ + FPVE KE F+ G+TTI PI G
Sbjct:  59  NERMKKMLEDRQFPEEYTTGLFKVEETSANLDINSEFTAFPVENKELFKTGLITIVPISG      118

Query: 143  GGMRLGTFIIWRNDKEFSDDDLILVEIASTVVGIQLLNLQTENLEENIRKQTAVTMAINT      202
            GG RLGT I+ R +  F+DDDLIL E  +TVVG+++L+ +T+ +EE  R +  V MAI++
Sbjct: 119  GGQRLGTLILARLNDSFNDDDLILAEYGATVVGMEILHEKTQEIEEEARSKAVVQMAISS      178

Query: 203  LSYSEMKAVAAILGELDGLEGRLTASVIADRIGITRSVIVNALRKLESAGIIESRSLGMK      262
            LSYSE++AV I  ELDG EG L AS IADR+GITRSVIVNALRKLESAG+IESRSLGMK
Sbjct: 179  LSYSELEAVEHIFEELDGKEGLLVASKIADRVGITRSVIVNALRKLESAGVIESRSLGMK      238

Query: 263  GTYLKVINEGIFDKLKE                                                 279
            GTY+KV+N+   +L++
Sbjct: 239  GTYIKVLNDKFLVELEK                                                 255
```

A related DNA sequence was identified in *S. pyogenes* <SEQ ID 5557> which encodes the amino acid sequence <SEQ ID 5558>. Analysis of this protein sequence reveals the following:

```
Possible site: 38
>>> Seems to have no N-terminal signal sequence
INTEGRAL    Likelihood = –0.64   Transmembrane 144-160 (143-161)
----- Final Results -----
    bacterial membrane --- Certainty = 0.1256 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the databases:

```
>GP:CAB13490 GB:Z99112 transcriptional regulator [Bacillus subtilis]
Identities = 131/255 (51%), Positives = 179/255 (69%), Gaps = 3/255 (1%)

Query:   4    LLEKTRKITSILQRSVDSLETELPYNTMASRLADIIDCNACIINGGGTLLGYAMKYKTNT    63
              LL+KTR I S+LQ +      + +  MA  L D+ID N  +++  G LLGY++   +

Sbjct:   3    LLQKTRIINSMLQAAAGK---PVNEKEMAETLRDVIDSNIFVVSRRGKLLGYSINQQIEN   59

Query:  64    DRVEEFFEAKQFPDTYVKAASRVYDTEANLSVENELTIFPVESKDTYPGGLTTIAPIYGG   123
              DR+++  E +QFP+ Y K    V +T +NL + +E T FPVE++D +  GLTTI PI GG Sbjct:  60    DRMKKMLEDRQFPEEYTKNLFNVPETSSNLDINSEYTAFPVENRDLFQAGLTTIVPIIGG   119

Query: 124    GMRLGSLIIWRNDNEFSDDDLILVEISSTVVGIQLLNLQTENLEDTIRKQTAVNMAINTL   183
              G RLG+LI+ R  ++F+DDDLIL E  +TVVG+++L  + E +E+  R +  V MAI++L Sbjct: 120    GERLGTLILSRLQDQFNDDDLILAEYGATVVGMEILREKAEEIEEEARSKAVVQMAISSL   179

Query: 184    SYSEMKAVAAILGELDGNEGRLTASVIADRIGITRSVIVNALRKLESAGIIESRSLGMKG   243
              SYSE++A+   I   ELDGNEG L AS IADR+GITRSVIVNALRKLESAG+IESRSLGMKG Sbjct: 180    SYSELEAIEHIFEELDGNEGLLVASKIADRVGITRSVIVNALRKLESAGVIESRSLGMKG   239

Query: 244    TYLKVINEGIFAKLK                                              258
              TY+KV+N     +L+
Sbjct: 240    TYIKVLNNKFLIELE                                              254
```

An alignment of the GAS and GBS proteins is shown below.

```
Identities = 232/260 (89%), Positives = 247/260 (94%)
Query:  21    MPNLLEKTRKITSILQRSVDSLDAELPYNTMAAQLADIIDCNACIINGGGNLLGYAMKYK    80
              MPNLLEKTRKITSILQRSVDSL+ ELPYNTMA++LADIIDCNACIINGGG LLGYAMKYK
Sbjct:   1    MPNLLEKTRKITSILQRSVDSLETELPYNTMASRLADIIDCNACIINGGGTLLGYAMKYK    60

Query:  81    TNTDRVEEFFETKQFPDYYVKSASRVYDTEANLSVDNDLSIFPVETKENFQDGITTIAPI   140
              TNTDRVEEFFE KQFPD YVK+ASRVYDTEANLSV+N+L+IFPVE+K+ +  G+TTIAPI
Sbjct:  61    TNTDRVEEFFEAKQFPDTYVKAASRVYDTEANLSVENELTIFPVESKDTYPGGLTTIAPI   120

Query: 141    YGGGMRLGTFIIWRNDKEFSDDDLILVEIASTVVGIQLLNLQTENLEENIRKQTAVTMAI   200
              YGGGMRLG+ IIWRND EFSDDDLILVEI+STVVGIQLLNLQTENLE+ IRKQTAV MAI
Sbjct: 121    YGGGMRLGSLIIWRNDNEFSDDDLILVEISSTVVGIQLLNLQTENLEDTIRKQTAVNMAI   180

Query: 201    NTLSYSEMKAVAAILGELDGLEGRLTASVIADRIGITRSVIVNALRKLESAGIIESRSLG   260
              NTLSYSEMKAVAAILGELDG EGRLTASVIADRIGITRSVIVNALRKLESAGIIESRSLG
Sbjct: 181    NTLSYSEMKAVAAILGELDGNEGRLTASVIADRIGITRSVIVNALRKLESAGIIESRSLG   240

Query: 261    MKGTYLKVINEGIFDKLKEY                                          280
              MKGTYLKVINEGIF KLKE+
Sbjct: 241    MKGTYLKVINEGIFAKLKEF                                          260
```

A related GBS gene <SEQ ID 8901> and protein <SEQ ID 8902> were also identified. Analysis of this protein sequence reveals the following:

Lipop: Possible site: −1   Crend: 9
McG: Discrim Score: −6.84
GvH: Signal Score (−7.5): −5.37
Possible site: 13
>>> Seems to have no N-terminal signal sequence
ALOM program count: 1 value: −2.02 threshold: 0.0
INTEGRAL     Likelihood = −2.02   Transmembrane 114-130 (113-131)
PERIPHERAL   Likelihood = 3.61      179
modified ALOM score: 0.90
*** Reasoning Step: 3
----- Final Results -----
   bacterial membrane --- Certainty = 0.1808 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the databases:

```
ORF02556(223-987 of 1293)
EGAD|13275|BS1617(4-255 of 259) cody protein {Bacillus subtilis} OMNI|NT01BS1895 cody
protein (vegetative protein 286b) (veg286b) GP|535351|gb|AAB03372.1||U13634 CodY {Bacillus
subtilis} GP|2633989|emb|CAB13490.1||Z99112 transcriptional regulator {Bacillus subtilis}
PIR|S61496|S61496 transcription pleiotropic repressor codY - Bacillus subtilis
% Match = 29.1
% Identity = 50.6 % Similarity = 71.5
Matches = 128 Mismatches = 71 Conservative Sub.s = 53

177       207       237       267       297       327       357       387
DCKS*NALI*L*RKTYKG*RKCRIYLEKTRKITSILQRSVDSLDAELPYNTMAAQLADIIDCNACIINGGGNLLGYAMKY
       |:|||  |  |:||   :           :   :   ||    | |:||  |    :::    |  ||||::
            MALLQKTRIINSMLQAAAGK---PVNFKEMAETLRDVIDSNIFVVSRRGKLLGYSINQ
            10        20           30        40        50

417       447       477       507       537       567       597       627
KTNTDRVEEFFETKQFPDYYVKSASRVYDTEANLSVDNDLSIFPVETKENFQDGITTIAPIYGGGMRLGTFIIWRNDKEF
:    ||:::  :|  :|||:  | |:      |  :|| ::::  :   ||||  || ||  |||:|:  |     :|
QIENDRMKKMLEDRQFPEEYTKNLFNVPETSSNLDINSEYTAFPVENRDLFQAGLTTIVPIIGGGERLGTLILSRLQDQF
       70        80        90        100       110       120       130

657       687       717       747       777       807       837       867
SDDDLILVEIASTVVGIQLLNLQTENLEENIRKQTAVTMAINTLSYSEMKAVAAILGELDGLEGRLTASVIADRIGITRS
:||||||  |  :|||||:::|  :  |:||     |  :  |||||::||||||::|:  |:  ||||  ||  ||||:|||
NDDDLILAEYGATVVGMEILREKAEEIEEEARSKAVVQMAISSLSYSELEAIEHIFEELDGNEGLLVASKIADRVGITRS
       150       160       170       180       190       200       210

897       927       957       987       1017      1047      1077      1107
VIVNALRKLESAGIIESRSLGMKGTYLKVINEGIFDKLKEYN*S*HGTGSSFQFLFWNQEEIRRKMTXXN*LXXLFS*RL
||||||||||||||:|||||||||||||||||:||:|      :  :|:
VIVNALRKLESAGVIESRSLGMKGTYIKVLNNKFLIELENLKSH
       230       240       250
```

SEQ ID 8902 (GBS431) was expressed in *E. coli* as a GST-fusion product. SDS-PAGE analysis of total cell extract is shown in FIG. 173 (lane 7; MW 54 kDa). It was also expressed in *E. coli* as a His-fusion product. SDS-PAGE analysis of total cell extract is shown in FIG. 77 (lane 6; MW 29 kDa).

GBS431-GST was purified as shown in FIG. 223, lane 8. Based on this analysis, it was predicted that these proteins and their epitopes could be useful antigens for vaccines or diagnostics.

Example 1787

A DNA sequence (GBSx1894) was identified in *S. agalactiae* <SEQ ID 5559> which encodes the amino acid sequence <SEQ ID 5560>. This protein is predicted to be isochorismatase. Analysis of this protein sequence reveals the following:

Possible site: 35
>>> Seems to have no N-terminal signal sequence
INTEGRAL    Likelihood = −2.81   Transmembrane 126-142 (125-142)
----- Final Results -----

-continued bacterial membrane --- Certainty = 0.2126 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the GENPEPT database.

```
>GP:CAB15164 GB:Z99120 similar to pyrazinamidase/nicotinamidase
[Bacillus subtilis]
Identities = 99/181 (54%), Positives = 132/181 (72%)
Query:  1   MTKALISIDYTYDFVADDGKLTAGKPAQSIASAIADVTEKAYRSGDYIFFAIDNHDIGDV   60
            M KALI IDYT DFVA DGKLT G+P + I  AI ++T++   +GDY+  A+D+HD GD
Sbjct:  1   MKKALICIDYTNDFVASDGKLTCGEPGRMIEEAIVNLTKEFITNGDYVVLAVDSHDEGDQ   60

Query: 61   FHPESNLFPEHNIKGTSGRNLYGPLGTLYETIKEDSRVFWIDKRHYSAFSGTDLDIRLRE   120
            +HPE+ LFP HNIKGT G++LYG L  LY+  + +  V++++K  YSAF+GTDL+++LRE
Sbjct: 61   YHPETRLFPPHNIKGTEGKDLYGKLLPLYQKHEHEPNVYYMEKTRYSAFAGTDLELKLRE   120
```

```
Query: 121   RRVDTLILTGVLTDICVLHTAIDAYNLGYKIEVPAAAVASLNDSNHQWALNHFKTVLGATI   181
              R++   L  L GV TDICVLHTA+DAYN G++I V    AVAS N   H WALHF   +GA +
Sbjct: 121   RQIGELHLAGVCTDICVLHTAVDAYNKGFRIVVHKQAVASFNQEGHAWALSHFANSIGAQV   181
```

A related DNA sequence was identified in *S. pyogenes* <SEQ ID 5561> which encodes the amino acid sequence <SEQ ID 5562>. Analysis of this protein sequence reveals the following:

---

Possible site: 31
>>> Seems to have no N-terminal signal sequence
INTEGRAL      Likelihood = -2.60      Transmembrane 126-142 (126-142)
----- Final Results -----
   bacterial membrane --- Certainty = 0.2041 (Affirmative) <succ>
     bacterial outside --- Certainty = 0.0000 (Not Clear) <succ>
       bacterial cytoplasm --- Certainty = 0.0000 (Not Clear) <succ>

---

The protein has homology with the following sequences in the databases:

```
>GP:CAB15164 GB:Z99120 similar to pyrazinamidase/nicotinamidase
[Bacillus subtilis]
Identities = 90/179 (50%), Positives = 127/179 (70%)
Query:  3    RALISIDYTNDEVADDGKLSAGKSAQAIATKIAEVTKTAFDQGDYIFFAIDCHDQNDSWH    62
             +ALI IDYTNDFVA DGKL+ G+  + I  I +TK    GDY+  A+D HD+ D +H
Sbjct:  3    KALICIDYTNDFVASDGKLTCGEPGRMIEEAIVNLTKEFITNGDYVVLAVDSHDEGDQYH    62

Query: 63    PESKLFAAHNIKGTTGRHLYGPLAEVYSYMKQHPRVFWIDKRYYSAFSGTDLDIRLRERG   122
             PE++LF  HNIKGT G+ LYG L  +Y     P V++++K  YSAF+GTDL+++LRER
Sbjct: 63    PETRLFPPHNIKGTEGKDLYGKLLPLYQKHEHEPNVYYMEKTRYSAFAGTDLELKLRERQ   122

Query: 123   ITQLVLTGVLSDICVLHTAIDAYHLGYQLEIVKSAVASLTKESYEWSLAHFEQVLGAKL    181
             I +L L GV +DICVLHIA+DAY+ G+++ + K AVAS  +E + W+L+HF   +GA++
Sbjct: 123   IGELHLAGVCTDICVLHTAVDAYNKGFRIVVHKQAVASFNQEGHAWALSHFANSIGAQV   181
```

An alignment of the GAS and GBS proteins is shown below.

```
Identities = 121/180 (67%), Positives = 150/180 (83%)
Query:  3    KALISIDYTYDFVADDGKLTAGKPAQSIASAIADVTEKAYRSGDYIFFAIDNHDIGDVFH    62
             +ALISIDYT DFVADDGKL+AGK AQ+IA+ IA+VT+ A+  GDYIFFAID HD  D +H
Sbjct:  3    RALISIDYTNDFVADDGKLSAGKSAQAIATKIAEVTKTAFDQGDYIFFAIDCHDQNDSWH    62

Query: 63    PESNLFPEHNIKGTSGRNLYGPLGTLYETIKEDSRVFWIDKRHYSAFSGTDLDIRLRERR   122
             PES LF  HNIKGT+GR+LYGPL  +Y  +K+  RVFWIDKR+YSAFSGTDLDIRLRER
Sbjct: 63    PESKLFAAHNIKGITGRHLYGPLAEVYSYMKQHPRVFWIDKRYYSAFSGTDLDIRLRERG   122

Query: 123   VDTLILTGVLTDICVLHTAIDAYNLGYKIEVPAAAVASLNDSNHQWALNHFKTVLGATIL   182
             +   L+LTGVL+DICVLHTAIDAY+LGY++E+   +AVASL    +++W+L HF+ VLGA ++
Sbjct: 123   ITQLVLTGVLSDICVLHTAIDAYHLGYQLEIVKSAVASLTKESYEWSLAHFEQVLGAKLI   182
```

Based on this analysis, it was predicted that these proteins and their epitopes could be useful antigens for vaccines or diagnostics.

Example 1788

A DNA sequence (GBSx1895) was identified in *S. agalactiae* <SEQ ID 5563> which encodes the amino acid sequence <SEQ ID 5564>. Analysis of this protein sequence reveals the following:

---

Possible site: 16
>>> Seems to have no N-terminal signal sequence
----- Final Results -----
   bacterial cytoplasm --- Certainty = 0.1539 (Affirmative) <succ>
   bacterial membrane --- Certainty = 0.0000 (Not Clear) <succ>
   bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1789

A DNA sequence (GBSx1896) was identified in *S. agalactiae* <SEQ ID 5565> which encodes the amino acid sequence <SEQ ID 5566>. This protein is predicted to be 3-hydroxyacyl-CoA dehydrogenase (hbd-10). Analysis of this protein sequence reveals the following:

---

Possible site: 46
>>> Seems to have an uncleavable N-term signal seq
INTEGRAL      Likelihood = -0.27      Transmembrane 3-19      (1-19)
INTEGRAL      Likelihood = -0.11      Transmembrane 277-293 (277-294)
----- Final Results -----
   bacterial membrane --- Certainty = 0.1107 (Affirmative) <succ>
     bacterial outside --- Certainty = 0.0000 (Not Clear) <succ>
       bacterial cytoplasm --- Certainty = 0.0000 (Not Clear) <succ>

---

The protein has homology with the following sequences in the GENPEPT database.

```
>GP:AAF12219 GB:AE001862 3-hydroxyacyl-CoA dehydrogenase, putative
[Deinococcus radiodurans]
Identities = 151/321 (47%), Positives = 196/321 (61%), Gaps = 36/321 (11%)
Query:  56  NMTIKNLTVAGSGVLGSQIAFQAAYKGMSVTIYDINDEALNKGKERIKKLAKVYQSEIET  115
            +M+IK +TV GSGVLGSQIAFQ A+ G  V +YDIND A+ K +E + KL   YQ +++
Sbjct:  51  SMSIKTVTVCGSGVLGSQIAEQTAFHGFDVHLYDINDAAIAKARETLGKLQARYQQDLKV  110

Query: 116  AKEAYSDKAKSIKYNKNLLPSLDHIFLSKVADSLDLIADLPNQITFSKNLDQAVSDADLV  175
               +   D                                 +I+F ++ +AV   DLV
Sbjct: 111  DAQQTGDAFA------------------------------RISFFTDIAEAVKGVDLV  138

Query: 176  IEAVPETVSIKEDFYKQLAKVAPSKTIFATNSSILVPSQFADITGRPDKFLAMHFANNIW  235
            IEA+PE + IK  FY QL +VA   TIFATNSSTL+PSQF + TGRP+KFLA+HFAN IW
Sbjct: 139  IEAIPENMDIKRKFYNQLGEVADPNTIFATNSSTLLPSQFMEETGRPEKFLALHFANEIW  198

Query: 236  QNNIVEIMGHKGTDDEVIKEALAFSKDIGMVPLHIHKEQPGYILNSILVPFLESALALYY  295
             + N  EIM   TDD V   + F+KDIGMV L ++KEQ GYILN++LVP L +AL  L
Sbjct: 199  KFNTAEIMRTPRTDDAVFDTVVQFAEDIGMVALPMYKEQAGYILNTLLVPLLGAALELVV  258

Query: 296  DKVSDSETIDKTWKLGTGAPMGPLEILDIIGIDTAYNIMKNYSDTNSDPNSLHAHLAKML  355
              ++D +T+DKTW + TGAP GP    LD+IG+ T YNI  N +   ++P S   AK +
Sbjct: 259  KGIADPQTVDKTWMIATGAPRGPFAFLDVIGLTTPYNI--NMASAETNPGS--AAAKYI  314

Query: 356  KEEFIDKGRTGKAAGHGFYDY                                        376
            KE +IDKG+ G A G GFY Y
Sbjct :315  KENYIDKGKLGTATGEGFYKY                                        335
```

No corresponding DNA sequence was identified in *S. pyogenes*.

Based on this analysis, it was predicted that this protein and its epitopes, could be useful antigens for vaccines or diagnostics.

A related GBS gene <SEQ ID 8903> and protein <SEQ ID 8904> were also identified. Analysis of this protein sequence reveals the following:

Lipop: Possible site: −1   Crend: 3
SRCFLG: 0
McG: Length of UR: 20
Peak Value of UR: 1.55
Net Charge of CR: 1
McG: Discrim Score: −0.60

GvH: Signal Score (−7.5): −3.93
Possible site: 21
>>> Seems to have no N-terminal signal sequence
Amino Acid Composition: calculated from 1
ALOM program count: 1 value: −0.11 threshold: 0.0
INTEGRAL      Likelihood = −0.11   Transmembrane 221-237 (221-238)
PERIPHERAL   Likelihood = 4.61      6
modified ALOM score: 0.52
icm1 HYPID: 7 CFP: 0.104
*** Reasoning Step: 3
----- Final Results -----
  bacterial membrane --- Certainty = 0.1044 (Affirmative) <succ>
     bacterial outside --- Certainty = 0.0000 (Not Clear) <succ>
       bacterial cytoplasm --- Certainty = 0.0000 (Not Clear) <succ>

The protein has homology with the following sequences in the databases:

```
37.5/60.5% over 278aa
Archaeoglobus fulgidus
EGAD|103851| 3-hydroxyacyl-CoA dehydrogenase Insert characterized OMNI|AF2273
3-hydroxyacyl-CoA dehydrogenase (hbd-10) Insert characterized
GP|2648250|gb|AAB88983.1||AE000948 3-hydroxyacyl-CoA dehydrogenase (hbd-10)
Insert characterized
PIR|A69534|A69534 3-hydroxyacyl-CoA dehydrogenase (hbd-10) homolog -
Insert characterized
ORF01176(475-1431 of 1731)
EGAD|103851|AF2273(17-295 of 668) 3-hydroxyacyl-CoA dehydrogenase {Archaeoglobus
fulgidus}OMNI|AF2273 3-hydroxyacyl-CoA dehydrogenase (hbd-10)
GP|2648250|gb|AAB88983.1||AE000948 3-hydroxyacyl-CoA dehydrogenase (hbd-10)
{Archaeoglobus fulgidus}PIR|A69534|A69534 3-hydroxyacyl-CoA dehydrogenase
(hbd-10) homolog - Archaeoglobus fulgidus
% Match = 14.8
% Identity = 37.5 % Similarity = 60.4
Matches = 106 Mismatches = 106 Conservative Sub.s = 65

387       417       447       477       507       537       567       597
  KKRYYFKNNHTIYLLLDISFVKLSSKTFSNISIGGCNMTIKNLTVAGSGVLGSQIAFQAAYKGMSVTIYDINDEALNKGK
                                  :    :   || : |:|::|  ||    |  :||:  ||    |:::|
                                  MPRRVKQVINMDVRERIKTVAVLGAGLMGHGIAEVCAMAGYNVTMRDIKQEFVDRGM
                                  10        20        30        40        50

624       651       681       711       741       771       801       831
  ERIKK-LAKVYQS-EIETAKEAYSDKAKSIKYNKNLLPSLDHIFLSKVADSLDLIADLPNQITFSKNLDQAVSDADLVIE
  ||: |||: |  :|::|:|  |                                     :|  : :|::||  ||||||
  NMIKESLAKLEQKGKIKSAEEVLS--------------------------------RIKPTVDLEEAVKDADLVIE
          70        80                                             90       100
```

-continued

```
      861       891       921       951       981      1011      1041      1071
AVPETVSIKEDFYKQLAKVAPSKTIFATNSSTLVPSQFADITGRPDKFLAMHFANNIWQNNIVEIMGHKGTDDEVIKEAL
||||  |  ||:   ::::  |:|     ||  :|:||:   :  :||   ||  ||    :|||  :||::    :   |   |||:    :
AVPEVVEIKKQVWEEVDKLAKPDCIFTSNTSTMRITMLADFTSRPEKFAGLHFFNPPVLMRLVEVIRGEKTSDEVMDLLV
              120       130       140       150       160       170       180

1101      1131      1161      1191      1221      1251      1281      1311
AFSKDIGMVPLHIHKEQPGYILNSILVPFLESALALYYDKVSDSETIDKTWKLGTGAPMGPLEILDIIGIDTAYNIMKNY
  |  ||   |:  :  |:  ||:|:|  :     |         :|:       ::    |  :|    |     |  |||||:|::|    |:|    ||  :|  |
EFVKSIGKTPVRVEKDVPGFIVNRVQAPASVLLMAILEKGIATPEEVDATVR-RLGLPMGPFELVDYTGVDILYNALKYY
              200       210       220       230       240       250       260

1341      1371      1401      1431      1461      1491      1521      1551
SDTNSDPNSLHAHLAKMLKEEFIDKGRTGKAAGHGFYDYD*TIKEVR*KSNLFYNSTKE*LHQEQF*NDLKPIDDYYHLS
:  |  |  |:     :      :      ||  :     :  |:      |:||||:      ::           :    :          |
AQTIS-PD----YEPPKFLEEMVKANKLGRKTGQGFYDWSKGRPQIDSSKATDKINPMDFTFVEINEAVKLVEMGVATPQ
              270       280       290       300       310       320       330
```

SEQ ID 8904 (GBS112) was expressed in *E. coli* as a His-fusion product. SDS-PAGE analysis of total cell extract is shown in FIG. 28 (lane 5; MW 39 kDa). It was also expressed in *E. coli* as a GST-fusion product. SDS-PAGE analysis of total cell extract is shown in FIG. 34 (lane 3; MW 64 kDa).

GBS112-GST was purified as shown in FIG. 198, lane 10.

Example 1790

A DNA sequence (GBSx1897) was identified in *S. agalactiae* <SEQ ID 5567> which encodes the amino acid sequence <SEQ ID 5568>. Analysis of this protein sequence reveals the following:

```
Possible site: 14
>>> Seems to have no N-terminal signal sequence
----- Final Results -----
    bacterial cytoplasm --- Certainty = 0.3332 (Affirmative) <succ>
    bacterial membrane --- Certainty = 0.0000 (Not Clear) <succ>
    bacterial outside --- Certainty = 0.0000 (Not Clear) <succ>
```

A related GBS nucleic acid sequence <SEQ ID 10097> which encodes amino acid sequence <SEQ ID 10098> was also identified.

The protein has homology with the following sequences in the GENPEPT database.

No corresponding DNA sequence was identified in *S. pyogenes*.

Based on this analysis, it was predicted that this protein and its epitopes, could be useful antigens for vaccines or diagnostics.

Example 1791

A DNA sequence (GBSx1898) was identified in *S. agalactiae* <SEQ ID 5569> which encodes the amino acid sequence <SEQ ID 5570>. Analysis of this protein sequence reveals the following:

```
Possible site: 22
>>> Seems to have no N-terminal signal sequence
INTEGRAL      Likelihood = -0.53    Transmembrane 60-76 (60-76)
----- Final Results -----
    bacterial membrane --- Certainty = 0.1213 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:CAB14467 GB:Z99117 similar to hypothetical proteins [Bacillus subtilis]
Identities = 62/169 (36%), Positives = 109/169 (63%), Gaps = 3/169 (1%)
Query:   1    MAVLSMLGIIDAKPKVGYFYLGQYHASIGTSHFEKMTVSEIMGIPLTVHQKDSVYDVIVH    60
              +A+L+M G ++A+P+VGYFY G+     +   +K+ V +   IP+ +H+  SVYD I
Sbjct:  43    LAILTMSGFLEARPRVGYFYTGKIGTQLLADKLKKLQVKDFQSIPVVIHENVSVYDAICT   102

Query:  61    IFMEDAGCAFILDDDDFLCGVVSRKDLLKISIGGGDLSKMPIGMVMTRMPHVTTVLENES   120
              +F+ED G   F++D D   L GV+SRKDLL+ SIG  +L+  +P+ ++MTRMP++T      +
Sbjct: 103    MFLEDVGTLFVVDRDAVLVGVLSRKDLLRASIGQQELTSVPVHIIMIRMPNITVCRREDY   162

Query: 121    LFAAADKLVSRKVDSLPVVRHDKQYPEKFKVIGKLSKTILASLFLEIRD              169
              +   A  L+ +++D+LPV+    K   + F+VIG+++KT +  + + +
Sbjct: 163    VMDIAKHLIEKQIDALPVI---KDTDKGFEVIGRVTKTNMTKILVSLSE              208
```

```
>GP:BAB05092 GB:AP001511 unknown conserved protein [Bacillus halodurans]
Identities = 126/256 (49%), Positives = 183/256 (71%), Gaps = 1/256 (0%)
Query:   7  IFIISDSLGETAKAIAKACLSQFPGRDDWHFQRFSYINSQERLEQVFEEASQKTVFMMFS    66
            ++++SDS+GETA+ + KA  SQF G      +R  Y+  +E +++V + A Q   + F+
Sbjct:  10  VYVVSDSVGETAELVVKAAASQFSGAGI-EVRRIPYVEDKETVDEVIQLAKQADAIIAFT    68

Query:  67  LVDVALASYAQKRCESEHYAYVDLLTNVIQGISRISGIDPLGEPGILRRLDNDYFKRVES   126
            LV    + +Y  ++          VD++   +++ IS ++   +P  EPGI+ RLD DYF++VE+
Sbjct:  69  LVVPGIRTYLLEKATEAKVETVDIIGPMLEKISSLTKEEPRYEPGIVYRLDEDYFRKVEA   128

Query: 127  IEFAVKYDDGRDPRGILQADLVIIGISRTSKTPLSMFLADKNIKVINIPLVPEVPVPKEL   186
            IEFAVKYDDGRDPRGI++ADLV+IG+SRTSKTPLS +LA K +KV N+PLVPEV   P+EL
Sbjct: 129  IEFAVKYDDGRDPRGIVRADLVLIGVSRTSKTPLSQYLAHKRLKVANVPLVPEVEPPEEL   188

Query: 187  RMIDSRRIIGLTNSVDHLNQVRKVRLKSLGLSSTANYASLERILEETRYAEEVMKNLGCP   246
                +  +++IGL   S +  LN +R  RLK+LGL S ANYA+++RI EE   YAE +MK +GCP
Sbjct: 189  FKLSPKKVIGLKISPEQLNGIRAERLKILGLKSQANYANIDRIKEELAYAEGIMKRIGCP   248

Query: 247  IINVSDKAIEETATII                                              262
            +I+VS+KA+EETA +I
Sbjct: 249  VIDVSNKAVEETANLI                                              264
```

No corresponding DNA sequence was identified in *S. pyogenes*.

SEQ ID 5570 (GBS378) was expressed in *E. coli* as a His-fusion product. SDS-PAGE analysis of total cell extract is shown in FIG. 68 (lane 4; MW 34 kDa). It was also expressed in *E. coli* as a GST-fusion product. SDS-PAGE analysis of total cell extract is shown in FIG. 72 (lane 2; MW 59 kDa).

GBS378-GST was purified as shown in FIG. 212, lane 6.

Based on this analysis, it was predicted that this protein and its epitopes, could be useful antigens for vaccines or diagnostics.

Example 1792

A DNA sequence (GBSx1899) was identified in *S. agalactiae* <SEQ ID 5571> which encodes the amino acid sequence <SEQ ID 5572>. Analysis of this protein sequence reveals the following:

Possible site: 47
>>> Seems to have no N-terminal signal sequence
----- Final Results -----
  bacterial cytoplasm --- Certainty = 0.3703 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:AAD35361 GB:AE001709 pyruvate, orthophosphate dikinase
[Thermotoga maritima]
Identities = 494/882 (56%), Positives = 639/882 (72%), Gaps = 9/882 (1%)
Query:   1  METKFVYHFD----EGCKEMKELLGGKGANLAEMTSIGLPVPQGFTITTQACNDYYDNAC    56
            M  K+VY F        EG  +MK++LGGKGANLAEMT++G+PVP GFTI+ + C  YYD+
Sbjct:   1  MAKKYVYFFANGKAEGRADMKDILGGKGANLAEMTNLGIPVPPGFTISAEVCKYYYDHGR    60

Query:  57  HIRESILSQIDQAMAQLEVEQNKQLGSVDDPLLVSVRSGSVFSMPGMMDTVLNLGLNDRS   116
            E  +  Q+++AM +LE    K+ G  ++PLLVSVRSG+  SMPGMMDTVLNLGLND  +
Sbjct:  61  TYPEELKEQVEEAMRRLEEVTGKKEGDPNNPLLVSVRSGAAISMPGMMDTVLNLGLNDET   120

Query: 117  VQGLVKKTEDERFAYDSYRRFIQMFADVVTGIPKYKFDTILDRLKTDKCYQDDTELTGSD   176
            V+GL K T +ERFAYD+YRRF+QMF DVV  IP  KF+  L+ LK +K    DTEL    D
Sbjct: 121  VKGLAKLTNNERFAYDAYRRFLQMFGDVVLKIPHEKFEKALEELKKEKGVKLDTELDAED   180

Query: 177  LKRLVEFYKELYQKEAGEKFPQDPKRQLLLAIEAVFKSWNNPRAKIYRKLNDIPE--TLG   234
            LK+LVE YK++Y KE G++FPQDP +QL LAI+AVF SW N RA   YR+++  I E   LG
Sbjct: 181  LKKLVERYKQIY-KEEGKEFPQDPWKQLWLAIDAVFGSWMNERAIKYRQIHGIKEGDLLG   239

Query: 235  TAVNIQAMVFGNMGNNSGTGVAFTRNPSTGAANLFGEYLINAQGEDVVAGIRTPQSISKL   294
            TAVNI AMVFGNMG +SGTGVAFTR+P+TG    +GE+L NAQGEDVVAGIRTP   +L
Sbjct: 240  TAVNIVAMVFGNMGEDSGTGVAFTRDPNTGEKKPYGEFLPNAQGEDVVAGIRTPLKLEEL   299

Query: 295  AEQMPIIYQEFVSVTQKLEAHYRDMQDMEFTIENGNLYMLQTRSGKRTAKAAIKIAVDQV   354
            +MP +Y + + + KLE HYRDMQD+EFT+E G LY+LQTR+GKRT++AAI+IAVD V
Sbjct: 300  KNRMPEVYNQLLEIMDKLEKHYRDMQDIEFTVERGKLYILQTRNGKRTSQAAIRIAVDMV   359

Query: 355  NEGLISKEEAILRIEPKQLDQLLHPSFDLKSLKKAIILTTGLPASPGAAYGKVYFHAEDV   414
            +EGLI +KEEAILR+  P+  ++Q+LHP FD K    +A ++   GLPASPGAA GKV F+A+
Sbjct: 360  HEGLITKEEAILRVRPEDVEQVLHPVFDPKEKAQAKVIAKGLPASPGAATGKVVFNAKKA   419

Query: 415  VKEMKKGNPVLLVRQETSPEDIEGMVSANGIITARGGMTSHAAVVARGMGKPCVAGCSQL   474
             + K G V+LVR ETSPED+  GM +A  GI+T+RGGMTSHAAVVARGMGKP V G   +
Sbjct: 420  EELGKAGEQVILVRPETSPEDVGGMAAAQGILTSRGGMTSHAAVVARGMGKPAVVGAESI   479
```

```
Query:  475  LVDEVRREISIGHQTIKEGEMLSIDGATGNVYIGQV-PMAETSVDRDFEIFMKWVDENRD  533
             V        +G   +KEGE +SIDG TG V +G+V +       ++      ++W DE R
Sbjct:  480  EVHPEEGYFKVGDVVVKEGEWISIDGTTGEVLLGKVTTIKPQGLEGPVAELLQWADEIRR  539

Query:  534  MMVCSNADNPRDAQKALDFGAEGIGLCRTEHMFFDDERIPVVREMILADEILSRRKALER  593
             + V +NAD PRDA+ A  FGAEGIGLCRTEHMFF+ +RIP VR MILA    R KAL+
Sbjct:  540  LGVRTNADIPRDAEVARKFGAEGIGLCRTEHMFFEKDRIPKVRRMILAKTKEEREKALDE  599

Query:  594  LLSFQRDDFYQIFKVLKGKACTIRLLDPPLHEFLPHDKESIESMARQMGISTLAIEKRIQ  653
             LL  Q++DF +F+V+KG   TIRL+DPPLHEFLP + E I+ +A QMG+S   ++  ++
Sbjct:  600  LLPLQKEDFKGLFRVMKGLPVTIRLIDPPLHEFLPQEDEQIKEVAEQMGVSFEELKNVVE  659

Query:  654  TLEEFNPMLGHRGCRLAITYPEIYQMQVRALVQGAI-LAMKEGYEAKPEIMIPLVTAHEE  712
                L+E NPMLGHRGCRL ITYPEI  MQ +A++  AI L  +EG +  PEIMIPLV    E
Sbjct:  660  NLKELNPMLGHRGCRLTITYPETAVMQTKAIIGAAIELKKEEGIDVIPEIMIPLVGHVNE  719

Query:  713  ISIIRDLIEETIVEESKSKKINLSFPIGTMIETPRACMIADDIAKFADFFSFGTNDLTQM  772
             +  ++ +I+ET     K   + L++ IGTMIE PRA + A  IA+ A+FFSFGTNDLTQM
Sbjct:  720  LRYLKKIIKETADALIKEAGVELTYKIGTMIEVPRAAVTAHQIAEEAEFFSFGTNDLTQM  779

Query:  773  SFGFSRDDAGKFLGEYVDKGLLKKDPFQVLDQKGIGRFIGQAVRLGKEVKPNLKIGICGE  832
             +FGFSRDD GKFL EY++KG+L+ DPF+ LD  G+G  +       G+  +P+LK+G+CGE
Sbjct:  780  TEGFSRDDVGKFLPEYLEKGILEHDPFKTLDYDGVGELVRMGKEKGRSTRPDLKVGVCGE  839

Query:  833  HGGEPSSIEFCYQLGLHYVSCSPFRIPIAKLAAAQAKIKQSR                   874
             HGG+P SI F  ++GL YVSCSP+R+P+A+LAAAQA +K  +
Sbjct:  840  HGGDPRSILFFDKIGLDYVSCSPYRVPVARLAAAQAALKNKK                   881
```

Based on this analysis, it was predicted that these proteins and their epitopes could be useful antigens for vaccines or diagnostics.

Example 1793

A DNA sequence (GBSx1900) was identified in *S. agalactiae* <SEQ ID 5573> which encodes the amino acid sequence <SEQ ID 5574>. This protein is predicted to be glutamyl-tRNA (GM) amidotransferase subunit C (gatC). Analysis of this protein sequence reveals the following:

Possible site: 56
>>> Seems to have no N-terminal signal sequence
----- Final Results -----
  bacterial cytoplasm --- Certainty = 0.3229 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:BAB04384 GB:AP001509 glutamyl-tRNA (Gln) amidotransferase
subunit C [Bacillus halodurans]
Identities = 42/94 (44%), Positives = 63/94 (66%)
Query:  2   KISEEEVRHVANLSKLRFSDQETKEFASSLSKIVDMIELLNEVDTEGVPVTTTMADRKTV  61
            +IS E+V+HVA+L++L  +++E K F   L  I+   E LNE+DTEGV  T+   D K V
Sbjct:  3   RISMEQVKBVAHLARLAITEEEAKLFTEQLGDIIQFAEQLNELDTEGVEPTSHVLDMKNV  62

Query:  62  MREDIAQPGHNRDDLFKNVPQHQDYYIKVPAILE                           95
            +RED   + G   +D+ KN P H+D I+VP++LE
Sbjct:  63  LREDKPEKGLPVEDVLKNAPDHEDGQIRVPSVLE                           96
```

A related DNA sequence was identified in *S. pyogenes* <SEQ ID 5575> which encodes the amino acid sequence <SEQ ID 5576>. Analysis of this protein sequence reveals the following:

Possible site: 60
>>> Seems to have no N-terminal signal sequence
----- Final Results -----
  bacterial cytoplasm --- Certainty = 0.3247 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

```
Identities = 72/100 (72%), Positives = 88/100 (88%)
Query:  1   MKISEEEVRHVANLSKLRFSDQETKEFASSLSKIVDMIELLNEVDTEGVPVTTTMADRKT  60
            MKISEEEVRHVA LSKL FS+ ET  FA++LSKIVDM+ELLNEVDTEGV +TTTMAD+K
```

-continued
```
Sbjct: 5    MKISEEEVRHVAKLSKLSFSESETTTFATTLSKIVDMVELLNEVDTEGVAITTTMADKKN    64

Query: 61   VMREDIAQPGHNRDDLFKNVPQHQDYYIKVPAILEDGGDA                      100
            VMR+D+A+ G +R  LFKNVP+ ++++IKVPAIL+DGGDA
Sbjct: 65   VMRQDVAEEGTDRALLFKNVPEKENHFIKVPAILDDGGDA                      104
```

Based on this analysis, it was predicted that these proteins and their epitopes could be useful antigens for vaccines or diagnostics.

Example 1794

A DNA sequence (GBSx1901) was identified in *S. agalactiae* <SEQ ID 5577> which encodes the amino acid sequence <SEQ ID 5578>. Analysis of this protein sequence reveals the following:

```
Possible site: 30
>>> Seems to have an uncleavable N-term signal seq
INTEGRAL     Likelihood = −7.64     Transmembrane 7-23 (6-24)
----- Final Results -----
    bacterial membrane --- Certainty = 0.4057 (Affirmative) <succ>
      bacterial outside --- Certainty = 0.0000 (Not Clear) <succ>
    bacterial cytoplasm --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1795

A DNA sequence (GBSx1902) was identified in *S. agalactiae* <SEQ ID 5579> which encodes the amino acid sequence <SEQ ID 5580>. This protein is predicted to be glutamyl-tRNA amidotransferase, subunit A (gatA). Analysis of this protein sequence reveals the following:

```
Possible site: 55
>>> Seems to have no N-terminal signal sequence
----- Final Results -----
    bacterial cytoplasm --- Certainty = 0.2855 (Affirmative) <succ>
    bacterial membrane --- Certainty = 0.0000 (Not Clear) <succ>
      bacterial outside --- Certainty = 0.0000 (Not Clear) <succ>
```

The protein has homology with the following sequences in the GENPEPT database.

```
>GP:BAB04385 GB:AP001509 glutamyl-tRNA (Gln) amidotransferase
subunit A [Bacillus halodurans]

Identities = 285/486 (58%), Positives = 367/486 (74%), Gaps = 4/486 (0%)
Query: 1     MSFNNQSIDQLHDFLVKKEISATELTKATLEDIHAREQAVGSFITISDEMAIAQAKEID-    59
             MS  +  + +H  L +KEIS  ++L     + I   + V +F+  +++E A A AKE+D
Sbjct: 1     MSLFDLKLKDVHTKLHEKEISVSDLVDEAYKRIEQVDGQVEAFLALNEEKARAYAKELDA   60

Query: 60    --DKGIDADNVMSGIPLAVKDNISTKGILTTAASKMLYNYEPIFDATAVEKLYAKDMIVI   117
               D+  +A  ++ GIP+ VKDNI TK + TT +S++L N++PI+DAT V KL    + I
Sbjct: 61    ALDRS-EARGLLFGIPIGVKDNIVTKNLRTTCSSRILGNFDPIYDATVVHKLREAQAVTI   119

Query: 118   GKANMDEFAMGGSTETSYFKKTNNAWDHSKVPGGSSGGSAAAVASGQVRLSLGSDTGGSI   177
             GK NMDEFAMG STE S F+KT N W+     VPGGSSGGSAAAVA+G+V +LGSDTGGSI
Sbjct: 120   GKLNMDEFAMGSSTENSAFQKTKNPWNLEYVPGGSSGGSAAAVAAGEVPFTLGSDTGGSI   179

Query: 178   RQPASFNGIVGMKPTYGRVSRFGLFAFGSSLDQIGPMSQTVKENAQLLTVISGHDVRDST   237
             RQPA++  G+VG+KPTYGRVSR+GL AF SSLDQIGP+++ V++NA LL   ISGHD DST
Sbjct: 180   RQPAAYCGVVGLKPTYGRVSRYGLVAFASSLDQIGPITRNVEDNAYLLQAISGHDPMDST   239

Query: 238   SSERTVGDFTAKIGQDIQGMKIALPKEYLGEGIAQGVKETIIKAAKHLEKLGAVIEEVSL   297
             S+    V D+ + +   DI+G+KIA+PKEYLGEG+  + VK++++  A K LE LGA   EEVSL
Sbjct: 240   SANLDVPDYLSALTGDIKGLKIAVPKEYLGEGVKEEVKQSVLDALKVLEGLGATWEEVSL   299

Query: 298   PHSKYGVAVYYIVASSEASSNLQRFDGIRYGYRTENYKNLDDIYVNTRSEGFGDEVKRRI   357
             PHSKY +A YY++ASSEAS+NL RFDG+RYG+R++N  NL D+Y   TR+EGFGDEVKRRI
Sbjct: 300   PHSKYALATYYLLASSEASANLARFDGVRYGFRSDNADNLLDMYKQTRAEGFGDEVKRRI   359

Query: 358   MLGTFSLSSGYYDAYYKKAGQVRSLIIQDFEKVFADYDLILGPTAPTTAFDLDSLNHDPV   417
             MLGTF+LSSGYYDAYYKKA QVR+LI QDFEKVF  YD+I+GPT PT AF +    DP+
Sbjct: 360   MLGTFALSSGYYDAYYKKAQQVRTLIKQDFEKVFEQYDVIIGPTTPTPAFKIGEKTDDPL   419

Query: 418   AMYLADILTIPVNLAGLPGISIPAGFDQGLPVGMQLIGPKFSEETIYQVAAAFEATTDYH   477
              MY  DILTIPVNLAG+P IS+P GFD GLP+G+Q+IG  F E  ++Y+VA AHE    TDYH
Sbjct: 420   TMYANDILTIPVNLAGVPAISVPCGFDNGLPLGLQIIGKHFDEGSVYRVAHAFEQATDYH   479

Query: 478   KQQPKI                                                        483
             ++P +
Sbjct: 480   TKRPTL                                                        485
```

A related DNA sequence was identified in *S. pyogenes* <SEQ ID 5581> which encodes the amino acid sequence <SEQ ID 5582>. Analysis of this protein sequence reveals the following:

<SEQ ID 5584>. This protein is predicted to be glutamyl-tRNAGln amidotransferase subunit B (gatB). Analysis of this protein sequence reveals the following:

Possible site: 57
>>> Seems to have no N-terminal signal sequence
----- Final Results -----
  bacterial cytoplasm --- Certainty = 0.2364 (Affirmative) <succ>
    bacterial membrane --- Certainty = 0.0000 (Not Clear) <succ>
      bacterial outside --- Certainty = 0.0000 (Not Clear) <succ>

Possible site: 27
>>> Seems to have no N-terminal signal sequence
----- Final Results -----
  bacterial cytoplasm --- Certainty = 0.3935 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 392/487 (80%), Positives = 442/487 (90%)
Query: 1    MSFNNQSIDQLHDFLVKKEISATELTKATLEDIHAREQAVGSFITISDEMAIAQAKEIDD   60
            MSFN+++I++LHD LV KEISATELT+ATLEDI +RE+AVGSFIT+S+E+A+ QA  ID
Sbjct: 1    MSFNHKTIEELHDLLVAKEISATELTQATLEDIKSREEAVGSFITVSEEVALKQAAAIDA   60

Query: 61   KGIDADNVMSGIPLAVKDNISTKGILTTAASKMLYNYEPIFDATAVEKLYAKDMIVIGKA   120
            KGIDADN+MSGIPLAVKDNISTK ILTTAASKMLYNYEPIF+AT+V    YAKDMIVIGK
Sbjct: 61   KGIDADNLMSGIPLAVKDNISTKEILTTAASKMLYNYEPIFNATSVANAYAKDMIVIGKT   120

Query: 121  NMDEFAMGGSTETSYFKKTNNAWDHSKVPGGSSGGSAAAVASGQVRLSLGSDTGGSIRQP   180
            NMDEFAMGGSTETSYFKKT NAWDH+KVPGGSSGGSA AVASGQVRLSLGSDTGGSIRQP
Sbjct: 121  NMDEFAMGGSTETSYFKKTKNAWDHTKVPGGSSGGSATAVASGQVRLSLGSDTGGSIRQP   180

Query: 181  ASENGIVGMKPTYGRVSREGLFAFGSSLDQIGPMSQTVKENAQLLTVISGHDVRDSTSSE   240
            A+FN +VG+KPTYG VSR+GL AFGSSLDQIGP + TVKENAQLL VI+  DV+D+TS+
Sbjct: 181  AAFNSVVGLKPTYGTVSRYGLIAFGSSLDQIGPFAPTVKENAQLLNVIASSDVKDATSAP   240

Query: 241  RTVGDFTAKIGQDIQGMKIALPKEYLGEGIAQGVKETIIKAAKHLEKLGAVIEEVSLPHS   300
              + D+T+KIG+DI+GMKIALPKEYLGEGI   +KET++ + K  E LGA +EEVSLPHS
Sbjct: 241  VRIADYTSKIGRDIKGMKIALPKEYLGEGIDPEIKETVLASVKQFEALGATVEEVSLPHS   300

Query: 301  KYGVAVYYIVASSEASSNLQRFDGIRYGYRTENYKNLDDIYVNTRSEGFGDEVKRRIMLG   360
            KYGVAVYYI+ASSEASSNLQRFDGIRYG+R ++ KNLD+IYVNTRS+GFGDEVKRRIMLG
Sbjct: 301  KYGVAVYYIIASSEASSNLQRFDGIRYGFRADDAKNLDEIYVNTRSQGFGDEVKRRIMLG   360

Query: 361  TFSLSSGYYDAYYKKAGQVRSLIIQDFEKVFADYDLILGPTAPTTAFDLDSLNHDPVAMY   420
            TFSLSSGYYDAY+KKAGQVR+LIIQDF+KVFADYDLILGPT PT AF LD+LNHDPVAMY
Sbjct: 361  TFSLSSGYYDAYFKKAGQVRTLIIQDFDKVFADYDLILGPTTPTVAFGLDTLEHDPVAMY   420

Query: 421  LADILTIPVNLAGLPGISIPAGEDQGLPVGMQLIGPKFSEETIYQVAAAFEATTDYHKQQ   480
            LAD+LTIPVNLAGLPGISIPAGF  GLPVG+QLIGPK++EETIYQ AAAFEA TDYHKQQ
Sbjct: 421  LADLLTIPVNLAGLPGISIPAGFVDGLPVGLQLIGPKYAEETIYQAAAAFEAVTDYHKQQ   480

Query: 481  PKIFGGE   487
            P IFGG+
Sbjct: 481  PIIFGGD   487
```

Based on this analysis, it was predicted that these proteins and their epitopes could be useful antigens for vaccines or diagnostics.

A related GBS nucleic acid sequence <SEQ ID 10095> which encodes amino acid sequence <SEQ ID 10096> was also identified.

Example 1796

A DNA sequence (GBSx1903) was identified in *S. agalactiae* <SEQ ID 5583> which encodes the amino acid sequence The protein has homology with the following sequences in the GENPEPT database.

```
>GP:BAB04386 GB:AP001509 glutamyl-tRNA (Gln) amidotransferase
subunit B [Bacillus halodurans]
Identities = 308/476 (64%), Positives = 361/476 (75%), Gaps = 1/476 (0%)
Query: 1    MNFETVIGLEVHVELNTNSKIFSPSSAHFGQEQNANTNVIDWSFPGVLPVMNKGVIDAGI   60
            MNFETVIGLEVHVEL T SKIFS S  HFG E NANT+VID  +PGVLPV+NK  ++  +
Sbjct: 1    MNFETVIGLEVHVELKTESKIFSASPNHFGAEPNANTSVIDLGYPGVLPVLNKAAVEFAM   60

Query: 61   KAALALNMDIHQNMHFDRKNYFYPDNPKAYQISQFDEPIGYNGWIEIELEDGTRKKIRIE   120
            KAA+ALN ++   +  FDRKNYFYPDNPKAYQISQFD+PIG NGWIEIE+ DGT+KKI I
Sbjct: 61   KAAMALNCEVATDTKFDRKNYFYPDNPKAYQISQFDKPIGENGWIEIEV-DGTKKKIGIT   119

Query: 121  RAHLEEDAGKNTHGTDGYSYVDLNRQGVPLIEIVSEADMRSPEEAYAYLTALKEIIQYTG   180
```

-continued
```
                  R HLEEDAGK TH  +GYS VD NRQG PLIEIVSE D+R+P+EAYAYL  LK IIQYTG
Sbjct: 120   RLHLEEDAGKLTHSGNGYSLVDFNRQGTPLIEIVSEPDIRTPQEAYAYLEKLKSIIQYTG  179

Query: 181   ISDVKMEEGSMRVDANISLRPYGQEEFGTKAELKNLNSFNNVRKGLIHEEKRQAQVLRSG   240
             +SD KMEEGS+R DANISLRP GQEEFGTK ELKNLNSFN VRKGL +EEKRQAQVL SG
Sbjct: 180   VSDCKMEEGSLRCDANISLRPVGQEEFGTKTELKNLNSFNFVRKGLEYEEKRQAQVLLSG   239

Query: 241   GQIQQETRRFDETTGETILMRVKEGSSDYRYFPEPDLPLFDISDEWIDQVRLELPEFPQE   300
             G+I QETRR+DE    +T+LMRVKEGS DYRYFPEPDL    I DEW ++R E+PE P
Sbjct: 240   GEILQETRRYDEAANKTVLMRVKEGSDDYRYFPEPDLVALHIDDEWKARIRSEIPELPDA   299

Query: 301   RRAKYVSSFGLSSYDASQLTATKATSDFFEKAVAIGGDAKQVSNWLQGEVAQFLNSESKS   360
             R+ +YV   GL +YDA LT TK  SDFFE+ +A G D K   SNWL GEV+ +LN+E K
Sbjct: 300   RKKRYVEELGLPAYDANVLTLTKEMSDFFEETIAKGADPKLASNWLMGEVSGYLNAEQKE   359

Query: 361   IEEIGLTPENLVEMIGLIADGTISSKIAKKVFVHLAKNGGSAEEFVKKAGLVQISDPEVL   420
             ++E+ LTP+ L +MI LI  GTISSKIAKKVF L + GG  EE VK  GLVQISD    L
Sbjct: 360   LDEVALTPDGLAKMIQLIEKGTISSKIAKKVFKDLIEKGGDPEEIVKAKGLVQISDEGEL   419

Query: 421   IPIIHQVFADNEAAVIDFKSGKRNADKAFTGYLMKATKGQANPQVALKLLAQELAK       476
              + +V +N+ ++ DFK+GK A       G +MKATKG+ANP +  KLL +E+ K
Sbjct: 420   RKYVVEVLDNNQQSIDDFKNGKDRAIGFLVGQIMKATKGKANPPMVNKLLLEEINK       475
```

A related DNA sequence was identified in *S. pyogenes* <SEQ ID 5585> which encodes the amino acid sequence <SEQ ID 5586>. Analysis of this protein sequence reveals the following:

---
Possible site: 27
>>> Seems to have no N-terminal signal sequence
----- Final Results -----
    bacterial cytoplasm --- Certainty = 0.3935 (Affirmative) <succ>
    bacterial membrane --- Certainty = 0.0000 (Not Clear) <succ>
    bacterial outside --- Certainty = 0.0000 (Not Clear) <succ>
---

An alignment of the GAS and GBS proteins is shown below.

Based on this analysis, it was predicted that these proteins and their epitopes could be useful antigens for vaccines or diagnostics.

Example 1797

A DNA sequence (GBSx1904) was identified in *S. agalactiae* <SEQ ID 5587> which encodes the amino acid sequence <SEQ ID 5588>. Analysis of this protein sequence reveals the following:

---
Possible site: 34
>>> Seems to have an uncleavable N-term signal seq
INTEGRAL    Likelihood = −7.27    Transmembrane 108-124 (105-125)
---

```
Identities = 410/479 (85%), Positives = 447/479 (92%)
Query: 1     MNFETVIGLEVHVELNTNSKIFSPSSAHFGQEQNANTNVIDWSFPGVLPVMNKGVIDAGI   60
             MNFET+IGLEVHVELNTNSKIFSPSSAHFG++ NANTNVIDWSFPGVLPVMNKGVIDAGI
Sbjct: 1     MNFETIIGLEVHVELNTNSKIFSPSSAHFGEDPNANTNVIDWSFPGVLPVMNKGVIDAGI   60

Query: 61    KAALALNMDIHQNMHFDRKNYFYPDNPKAYQISQFDEPIGYNGWIEIELEDGTRKKIRIE   120
             KAALALNMDIH+ MHFDRKNYFYPDNPKAYQISQFDEPIGYNGWI+I+LEDG KKIRIE
Sbjct: 61    KAALALNMDIHKEMHFDRKNYFYPDNPKAYQISQFDEPIGYNGWIDIKLEDGSTKKIRIE   120

Query: 121   RAHLEEDAGKNTHGTDGYSYVDLNRQGVPLIEIVSEADMRSPEEAYAYLTALKETIQYTG   180
             RAHLEEDAG NTHGTDGYSYVDLNRQGVPLIEIVSEADMRSPEEAYAYLTALKEIIQYTG
Sbjct: 121   RAHLEEDAGKNTHGTDGYSYVDLNRQGVPLIEIVSEADMRSPEEAYAYLTALKEIIQYTG   180

Query: 181   ISDVKMEEGSMRVDANISLRPYGQEEFGTKAELKNLNSFNNVRKGLIHEEKRQAQVLRSG   240
             ISDVKMEEGSMRVDANISLRPYGQE+FGTK ELKNLNSF+NVRKGL  E +RQA++LRSG
Sbjct: 181   ISDVKMEEGSMRVDANISLRPYGQEFGTKTELKNLNSFSNVRKGLEFEVERQAKLLRSG   240

Query: 241   GQIQQETRRFDETTGETILMRVKEGSSDYRYFPEPDLPLFDISDEWIDQVRLELPEFPQE   300
             G I+QETRR+DE    TILMRVKEG++DYRYFPEPDLPL++I D WID++R +LP+FP +
Sbjct: 241   GVIRQETRRYDEANKGTILMRVKEGAADYRYFPEPDLPLYEIDDAWIDEMRAQLPQFPAQ   300

Query: 301   RRAKYVSSFGLSSYDASQLTATKATSDFFEKAVAIGGDAKQVSNWLQGEVAQFLNSESKS   360
             RRAKY   GLS+YDASQLTATK  SDFFE AV++GGDAKQVSNWLQGEVAQFLN+E K+
Sbjct: 301   RRAKYEEELGLSAYDASQLTATKVLSDFFETAVSLGGDAKQVSNWLQGEVAQFLNAEGKT   360

Query: 361   IEEIGLTPENLVEMIGLIADGTISSKIAKKVFVHLAKNGGSAEEFVKKAGLVQISDPEVL   420
             IEEI LTPENLVEMI +IADGTISSK+AKKVFVHLAKNGGSA +V+KAGLVQISDP VL
Sbjct: 361   IEEIALTPENLVEMIAIIADGTISSKMAKKVFVHLAKNGGSARAYVEKAGLVQISDPAVL   420

Query: 421   IPIIHQVFADNEAAVIDFKSGKRNADKAFTGYLMKATKGQANPQVALKLLAQELAKLKE   479
             +PIIHQVFADNEAAV DFKSGKRNADKAFTG+LMKATKGQANPQVA +LLAQEL KL++
Sbjct: 421   VPIIHQVFADNEAAVADFKSGKRNADKAFTGFLMKATKGQANPQVAQQLLAQELQKLRD   479
```

| | | |
|---|---|---|
| INTEGRAL | Likelihood = −7.27 | Transmembrane 278-294 (268-301) |
| INTEGRAL | Likelihood = −6.05 | Transmembrane 191-207 (188-208) |
| INTEGRAL | Likelihood = −5.63 | Transmembrane 219-235 (215-242) |
| INTEGRAL | Likelihood = −3.93 | Transmembrane 41-57 (39-58) |
| INTEGRAL | Likelihood = −3.88 | Transmembrane 132-148 (131-150) |
| INTEGRAL | Likelihood = −3.03 | Transmembrane 254-270 (253-272) |
| INTEGRAL | Likelihood = −3.03 | Transmembrane 79-95 (79-95) |

----- Final Results -----
    bacterial membrane --- Certainty = 0.3909 (Affirmative) <succ>
        bacterial outside --- Certainty = 0.0000 (Not Clear) <succ>
        bacterial cytoplasm --- Certainty = 0.0000 (Not Clear) <succ>

A related GBS nucleic acid sequence <SEQ ID 10093> which encodes amino acid sequence <SEQ ID 10094> was also identified.

The protein has homology with the following sequences in the GENPEPT database.

```
>GP:CAA04271 GB:AJ000733 hypothetical protein [Bacillus megaterium]
Identities = 102/292 (34%), Positives = 169/292 (56%), Gaps = 3/292 (1%)
Query:   6   TKKEKGTMMTLAAGLAWGISGISGQYLMSH-GVHVNLLTSLRLLITGIFLLSLARSKQKE    64
             +++  G ++ +      WG+SG   QYL  H   +   L  +R+L++G+ LL++A SKQ+
Sbjct:   1   SRRAWGLLLVIIGATMWGVSGTVAQYLFQHKSFNAEWLVVVRMLVSGLLLLAIA-SKQR-   58

Query:  65   HLVAAWKQPKFLKQVLLFSIFGLVLNQYAFLRAIHLTNAGTATVLQYMAPILILSIVCIL  124
             ++  A WK +    +LLF + G++  QY +  AI   NA TATVLQY +PI I+  + +
Sbjct:  59   NIFAIWKTKEERTSLLLFGVIGMLGVQYTYFAAIEAGNAATATVLQYTSPIFIIGYLAVQ  118

Query: 125   NRQRPTSFEIIAIAMAILGTYMIATHGKLGSLAITPKGLMWGLGSAITYSIYILLPVKLI  184
             R+  P     E+I++ +  I  GT+ +AT G    L+IT   L  WG+G+A+T + Y L P +L+
Sbjct: 119   ARKWPVKVEMISVVLVIAGTFFLATSGNFNELSITGWALFWGIGAAVTSAFYTLQPKRLL  178

Query: 185   HEWGSTIVIGSGMFIGGILFSLVTKAWQYPLQINVMSILAYIGIIGIGTIFAYTFFLKGV  244
             +W S  V+G GM IGG   FS +    W    + +++S+ A + +I  GT+ A+  +L+ +
Sbjct: 179   AKWSSIEVVGWGMVIGGASFSFIHPPWHIAGEWSLLSLCAVLFVIIFGTLIAFYCYLESL  238

Query: 245   SIVGAVKGSLLASVEPVSSVFLTVLVLGEIFYPIDLLGMLFIFLAVTLISYK          296
               + A +  +LAS EP+S+  L+VL L   F    + LG +  I    V L+S +
Sbjct: 239   KHISASEAIVLASREPLSAAALSVLWLHVTFGWTEWLGTILIIATVFLLSQR          290
```

No corresponding DNA sequence was identified in *S. pyogenes*.

Possible site: 59
>>> Seems to have no N-terminal signal sequence
----- Final Results -----
    bacterial cytoplasm --- Certainty = 0.2103 (Affirmative) <succ>
        bacterial membrane --- Certainty = 0.0000 (Not Clear) <succ>
        bacterial outside --- Certainty = 0.0000 (Not Clear) <succ>

A related GBS nucleic acid sequence <SEQ ID 10091> which encodes amino acid sequence <SEQ ID 10092> was also identified.

The protein has homology with the following sequences in the GENPEPT database.

```
>GP:CAB14510 GB:Z99117 similar to hypothetical proteins [Bacillus subtilis]
Identities = 52/153 (33%), Positives = 88/153 (56%)
Query:  17   YRPTFVVEAVYDLRAEDLLRHGIRAVLVDLDNTLIAWNNPDGTAEVRAWLDEMITADISV   76
             + P    V+ ++ +   E L     ++ ++ DLDNTL+ W+ P+ T   + W +EM    I V
Sbjct:   6   FLPDEFVKNIFHITPEKLKERNVKGIITDLDNTLVEWDRPNATPRLIEWFEEMKEHGIKV   65

Query:  77   VVVSNNNHARVERAVSRFGVDFVSRAMKPFTRGINMAIERYGFDRDEVIMVGDQLMTDIR  136
             +VSNNN   RV+       G+ F+ +A KP  +  N A+    +++ +++GDQL+TD+
Sbjct:  66   TIVSNNNERRVKLFSEPLGIPFIYKARKPMGKAFNRAVRNMELKKEDCVVIGDQLLTDVL  125

Query: 137   ASHRAGIKSVLVKPIVKSDAWNTKFNRLRERRV                            169
             +R  G  ++LV P+  SD + T+FNR  ERR+
Sbjct: 126   GGNRNGYHTILVVPVASSDGFITRFNRQVERRI                            158
```

Based on this analysis, it was predicted that this protein and its epitopes, could be useful antigens for vaccines or diagnostics.

A related DNA sequence was identified in *S. pyogenes* <SEQ ID 5591> which encodes the amino acid sequence <SEQ ID 5592>. Analysis of this protein sequence reveals the following:

Example 1798

A DNA sequence (GBSx1905) was identified in *S. agalactiae* <SEQ ID 5589> which encodes the amino acid sequence <SEQ ID 5590>. Analysis of this protein sequence reveals the following:

Possible site: 51
>>> Seems to have no N-terminal signal sequence
----- Final Results -----
    bacterial cytoplasm --- Certainty = 0.4252 (Affirmative) <succ>
        bacterial membrane --- Certainty = 0.0000 (Not Clear) <succ>
        bacterial outside --- Certainty = 0.0000 (Not Clear) <succ>

An alignment of the GAS and GBS proteins is shown below.

```
Identities = 147/175 (84%), Positives = 158/175 (90%)
Query:  12   LSIDDYRPTFVVEAVYDLRAEDLLRHGIRAVLVDLDNTLIAWNNPDGTAEVRAWLDEMTT   71
             +SIDDYRPT++VEA+YDLRA DLLRHGI AVLVDLDNTLIAWNNPDGT EVRAWLDEMT
Sbjct:  20   MSIDDYRPTYMVEAIYDLRANDLLRHGITAVLVDLDNTLIAWNNPDGTPEVRAWLDEMTI   79

Query:  72   ADISVVVVSNNNHARVERAVHRFGVDEVSRAMKPFTRGINMAIERYGFDRDEVIMVGDQL  131
             ADISVVVVSNN  H+RVERAVSRFGVDF+SRA+KPF  GI   AI RYGFDR+EVIMVGDQL
Sbjct:  80   ADISVVVVSNNKHSRVERAVSRFGVDFISRALKPFAYGIEKAIARYGFDRNEVIMVGDQL  139

Query: 132   MTDIRASHRAGIKSVLVKPIVKSDAWNTKFNRLRERRVWKKIEENYGKIVYQKGI       186
             MTDIRASHRAGIKSVLVKP+V SDAWNTK NR RERRV  K+EE YGK+ YQKGI
Sbjct: 140   MTDIRASHRAGIKSVLVKPLVASDAWNTKINRWRERRVMAKLEEKYGKLSYQKGI       194
```

Based on this analysis, it was predicted that these proteins and their epitopes could be useful antigens for vaccines or diagnostics.

Example 1799

A DNA sequence (GBSx1906) was identified in S. agalactiae <SEQ ID 5593> which encodes the amino acid sequence <SEQ ID 5594>. Analysis of this protein sequence reveals the following:

Possible site: 15
>>> Seems to have no N-terminal signal sequence
----- Final Results -----
   bacterial cytoplasm --- Certainty = 0.1091 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

A related DNA sequence was identified in S. pyogenes <SEQ ID 5595> which encodes the amino acid sequence <SEQ ID 5596>. Analysis of this protein sequence reveals the following:

Possible site: 15
>>> Seems to have an uncleavable N-term signal seq
----- Final Results -----
   bacterial membrane --- Certainty = 0.0000 (Not Clear) <succ>
   bacterial outside --- Certainty = 0.0000 (Not Clear) <succ>
   bacterial cytoplasm --- Certainty = 0.0000 (Not Clear) <succ>

The protein has homology with the following sequences in the databases:

```
>GP:CAB14509 GB:Z99117 similar to hypothetical proteins [Bacillus subtilis]

Identities = 220/373 (58%), Positives = 280/373 (74%), Gaps = 8/373 (2%)
Query:   1   MEELFCIGCGARIQTENKDAAGYTPRAALEKGLETGELYCQRCFRLRHYNEITDVHITDD    60
             ME++ CIGCG  IQTE+K   GY P A+L K      + CQRCFRL++YNEI DV +TDD
Sbjct:   1   MEKVVCIGCGVTIQTEDKTGLGYAPPASLTKE----NVICQRCFRLKNYNEIQDVSLTDD    56

Query:  61   EFLKLLHEVGDSDALVVNVIDIFDFNGSIIPGLSRFVAGNDVLLVGNKKDILPKSVKDGK   120
             +FL +LH +G++D+LVV ++DIFDFNGS I GL R V GN +LLVGNK DILPKS+K  +
Sbjct:  57   DFLNILHGIGETDSLVVKIVDIFDFNGSWINGLQRLVGGNPILLVGNKADILPKSLKRER   116

Query: 121   VTQWLTERAHEEGLRPVDVILTSAQNHHAIKDLIDTIEKYRHGQDVYVVGVTNVGKSTLI   180
             + QW+   A E GL+PVDV L SA      I+++ID IE YR+G+DVYVVG TNVGKST I
Sbjct: 117   LIQWMKREAKELGLKPVDVFLVSAGRGQGIREVIDAIEHYRNGKDVYVVGCTNVGKSTFI   176

Query: 181   NAIIREITGSRDVITTSRFPGTTLDKIEIPLDDGSYIFDTPGIIHRHQMAHYLTAKNLKY   240
             N II+E++G  D+ITTS+FPGTTLD IEIPLDDGS ++DTPGII+ HQMAHY+   K+LK
Sbjct: 177   NRIIKEVSGEEDIITTSQFPGTTLDAIEIPLDDGSSLYDTPGIINNHQMAHYVNKKDLKI   236

Query: 241   VSPKKEIKPKTYQLNSEQTLFLAGLARFDFISGQKQGFTAYFDNNLNLHRTKLVGADEFY   300
             +SPKKE+KP+T+QLN +QTL+  GLARFD++SG++    F Y   N L +HRTKL  AD  Y
Sbjct: 237   LSPKKELKPRTFQLNDQQTLYFGGLARFDYVSGERSPFICYMPNELMIHRTKLENADALY   296

Query: 301   TKHVGKLLTPPTGKEVSDFPKLVREHFTIKD-KMDIVYSGLGWIRVKSEAENPVVVAAWA   359
              KH G+LLTPP   E+ +FP+LV H FTIKD K DIV+SGLGW+ V       V  A+A
Sbjct: 297   EKHAGELLTPPGKDEMDEPPELVAHTFTIKDKKTDIVFSGLGWVTVHDADKK---VTAYA   353

Query: 360   PEGVAVVLRKALI                                                 372
             P+GV V +R++LI
Sbjct: 354   PKGVHVFVRRSLI                                                 366
```

```
>GP:CAB14509 GB:Z99117 similar to hypothetical proteins [Bacillus subtilis]
Identities = 220/373 (58%), Positives = 286/373 (75%), Gaps = 8/373 (2%)
Query: 1    MEELFCIGCGIQIQTEDKEKAGFTPAAALKKGMETGELYCQRCFRLRHYNEITDVHITDD    60
            ME++ CIGCG+ IQTEDK   G+ P A+L K     + CQRCFRL++YNEI DV +TDD
Sbjct: 1    MEKVVCIGCGVTIQTEDKTGLGYAPPASLTKE----NVICQRCFRLKNYNEIQDVSLTDD    56

Query: 61   EFLRLLHEVGDSDALVVNVIDIFDFNGSIIPGLSRFISGNDVLLVGNKKDILPKSVKDGK   120
            +FL +LH +G++D+LVV ++DIFDENGS I GL R + GN +LLVGNK DILPKS+K  +
Sbjct: 57   DELNILHGIGETDSLVVKIVDIFDFNGSWINGLQRLVGGNPILLVGNKADILPKSLKRER   116

Query: 121  VTQWLTERAHEEGLRPLDVMLTSAQNKYAIKDLIGRINELRNGRDVYVVGVTNVGKSTLI   180
            + QW+   A E GL+P+DV L SA      I+++I I   RNG+DVYVVG TNVGKST I
Sbjct: 117  LIQWMKREAKELGLKPVDVFLVSAGRGQGIREVIDAIEHYRNGKDVYVVGCTNVGKSTFI   176

Query: 181  NAIIQEITGNKDVITTSRFPGTTLDKIEIPLDDGTFIFDTPGIIHRHQMAHYLSPKELKI   240
            N II+E++G +D+ITTS+FPGTTLD IEIPLDDG+ ++DTPGII+ HQMAHY++ K+LKI
Sbjct: 177  NRIIKEVSGEEDIITTSQFPGTTLDAIEIPLDDGSSLYDTPGIINNHQMAHYVNKKDLKI   236

Query: 241  VSPKKEIKPKTYQLNPEQTLFLGGLAREDFINGERQGFTAFFDNQLELHRTKLAGADAFY   300
            +SPKKE+KP+T+QLN +QTL+ GGLARFD+++GER  F  +  N+L +HRTKL  ADA Y
Sbjct: 237  LSPKKELKPRTFQLNDQQTLYEGGLARFDYVSGERSPFICYMPNELMIHRTKLENADALY   296

Query: 301  DKHVGTLLTPPDKKELTAFPKLVRHEFTI-DQKMDIVFSGLGWIRVNGQKDSKAIVAAWA   359
            +KH G LLTPP K E+   FP+LV H FTI D+K DIVFSGLGW+ V+   D+   V A+A
Sbjct: 297  EKHAGELLTPPGKDEMDEFPELVAHTFTIKDKKTDIVFSGLGWVTVH---DADKKVTAYA   353

Query: 360  PEGVAVIVRKAII                                                372
            P+GV V VR+++I
Sbjct: 354  PKGVHVFVRRSLI                                                366
```

An alignment of the GAS and GBS proteins is shown below.

```
Identities = 308/372 (82%), Positives = 343/372 (91%)
Query: 1    MEELFCIGCGARIQTENKDAAGYTPRAALEKGLETGELYCQRCFRLRHYNEITDVHITDD    60
            MEELFCIGCG +IQTE+K+ AG+TP AAL+KG ETGELYCQRCFRLRHYNEITDVHITDD
Sbjct: 1    MEELFCIGCGIQIQTEDKEKAGFTPAAALKKGMETGELYCQRCFRLRHYNEITDVHITDD    60

Query: 61   EFLKLLHEVGDSDALVVNVIDIFDFNGSIIPGLSRFVAGNDVLLVGNKKDILPKSVKDGK   120
            EFL+LLHEVGDSDALVVNVIDIFDFNGSIIPGLSRF++GNDVLLVGNKKDILPKSVKDGK
Sbjct: 61   EFLRLLHEVGDSDALVVNVIDIFDFNGSIIPGLSRFISGNDVLLVGNKKDILPKSVEDGK   120

Query: 121  VTQWLTERAHEEGLRPVDVILTSAQNHHAIKDLIDTIEKYRHGQDVYVVGVTNVGKSTLI   180
            VTQWLTERAHEEGLRP+DV+LTSAQN +AIKDLI  I + R+G+DVYVVGVTNVGKSTLI
Sbjct: 121  VTQWLTERAHEEGLRPLDVMLTSAQNKYAIKDLIGRINELRNGRDVYVVGVTNVGKSTLI   180

Query: 181  NAIIREITGSRDVITTSRFPGTTLDKIEIPLDDGSYIFDTPGIIHRHQMAHYLTAKNLKY   240
            NAII+EITG++DVITTSRFPGTTLDKIEIPLDDG++IFDTPGIIHRHQMAHYL+ K LK
Sbjct: 181  NAIIQEITGNKDVITTSRFPGTTLDKIEIPLDDGTFIFDTPGIIHRHQMAHYLSPKELKI   240

Query: 241  VSPKKEIKPKTYQLNSEQTLFLAGLARFDFISGQKQGFTAYFDNNLNLHRTKLVGADEFY   300
            VSPKKEIKPKTYQLN EQTLFL GLARFDFI+G++QGFTA+FDN L LHRTKL GAD FY
Sbjct: 241  VSPKKEIKPKTYQLNPEQTLFLGGLARFDFINGERQGFTAFFDNQLELHRTKLAGADAFY   300

Query: 301  TKHVGKLLTPPTGKEVSDFPKLVRHEFTIKDKMDIVYSGLGWIRVKSEAENPVVAAWAP   360
             KHVG LLTPP KE++ FPKLVRHEFTI KMDIV+SGLGWIRV + ++ +VAAWAP
Sbjct: 301  DKHVGTLLTPPDKKELTAFPKLVRHEFTIDQKMDIVFSGLGWIRVNGQKDSKAIVAAWAP   360

Query: 361  EGVAVVLRKALI                                                372
            EGVAV++RKA+I
Sbjct: 361  EGVAVIVRKAII                                                372
```

Based on this analysis, it was predicted that these proteins and their epitopes could be useful antigens for vaccines or diagnostics.

Example 1800

A DNA sequence (GBSx1907) was identified in *S. agalactiae* <SEQ ID 5597> which encodes the amino acid sequence <SEQ ID 5598>. Analysis of this protein sequence reveals the following:

Possible site: 18

>>> Seems to have no N-terminal signal sequence

----- Final Results ----- bacterial cytoplasm --- Certainty = 0.2948 (Affirmative) <succ> bacterial membrane --- Certainty = 0.0000 (Not Clear) <succ> bacterial outside --- Certainty = 0.0000 (Not Clear) <succ>

The protein has homology with the following sequences in the GENPEPT database.

```
>GP:CAB14507 GB:Z99117 similar to dihydrodipicolinate reductase
[Bacillus subtilis]
Identities = 49/97 (50%), Positives = 67/97 (68%), Gaps = 2/97 (2%)
Query:  1    MLTSKQRAFLKSEAHSMKPIIQIGKNGLNDQIKTSVRNALDARELIKVTLLQNTDEDIRD    60
             MLT KQ+ FL+S+AH + PI Q+GK G+ND +    +  AL+ARELIKV++LQN +ED +D
Sbjct:  1    MLTGKQKRFLRSKAHHLTPIFQVGKGGVNDNMIKQIAEALEARELIKVSVLQNCEEDKND    60

Query: 61    VAEVLEDEIGCDTVLKIGRILILYKESARKENRKISV                         97
             VAE L         V IG ++LYKES  KEN++I +
Sbjct: 61    VAEALVKGSRSQLVQTIGNTIVLYKES--KENKQIEL                         95
```

A related DNA sequence was identified in *S. pyogenes* <SEQ ID 5599> which encodes the amino acid sequence <SEQ ID 5600>. Analysis of this protein sequence reveals the following:

---

Possible site: 42
>>> Seems to have no N-terminal signal sequence
----- Final Results -----
  bacterial cytoplasm --- Certainty = 0.2839 (Affirmative) <succ>
    bacterial membrane --- Certainty = 0.0000 (Not Clear) <succ>
      bacterial outside --- Certainty = 0.0000 (Not Clear) <succ>

---

An alignment of the GAS and GBS proteins is shown below.

```
Identities = 89/102 (87%), Positives = 98/102 (95%)
Query:  1    MLTSKQRAFLKSEAHSMKPIIQIGKNGLNDQIKTSVRNALDARELIKVTLLQNTDEDIHD    60
             MLTSKQRAFLKSEAHS+KPI+QIGKNGLND IKTS+R ALDARELIKVTLLQNTDEDIH+
Sbjct:  1    MLTSKQRAFLKSEAHSLKPIVQIGKNGINDHIKTSIRQALDARELIKVTLLQNTDEDIHE    60

Query: 61    VAEVLEDEIGCDTVLKIGRILILYKESARKENRKISVKVKAV                   102
             VAE+LE+EIGCDTVLKIGRILILYK SA+KENRK+S KVKA+
Sbjct: 61    VAEILEEEIGCDTVLKIGRILILYKVSAKKENRKLSPKVKAI                   102
```

Based on this analysis, it was predicted that these proteins and their epitopes could be useful antigens for vaccines or diagnostics.

Example 1801

A DNA sequence (GBSx1908) was identified in *S. agalactiae* <SEQ ID 5601> which encodes the amino acid sequence <SEQ ID 5602>. Analysis of this protein sequence reveals the following:

---

Possible site: 16
>>> Seems to have no N-terminal signal sequence
INTEGRAL    Likelihood = −2.66    Transmembrane 3-19 (1-21)
----- Final Results -----
  bacterial membrane --- Certainty = 0.2062 (Affirmative) <succ>
    bacterial outside --- Certainty = 0.0000 (Not Clear) <succ>
      bacterial cytoplasm --- Certainty = 0.0000 (Not Clear) <succ>

---

A related GBS nucleic acid sequence <SEQ ID 10089> which encodes amino acid sequence <SEQ ID 10090> was also identified.

The protein has homology with the following sequences in the GENPEPT database.

```
>GP:CAB14506 GB:Z99117 similar to hypothetical proteins [Bacillus subtilis]
Identities = 85/187 (45%), Positives = 134/187 (71%)

Query:  38   KQIGIMGGNFNPVHNAHLVVADQVRQQLCLDQVLLMPEFQPPHIDKKETIDEQHRLKMLE    97
             K+IGI GG F+P HN HL++A++V  Q  LD++  MP    PPH    ++  D  HR++ML+
Sbjct:   2   KKIGIFGGTFDPPHNGHLLMANEVLYQAGLDEIWFMPNQIPPHKQNEDYTDSFHRVEMLK    61

Query:  98   LAIEGIDGLSIEPIEIERKGISYTYDTMKLLIEKNPDVDYYFIIGADMVEYLPKWHRIDE   157
             LAI+     +E +E+ER+G SYT+DT+ LL ++ P+    +FIIGADM+EYLPKW+++DE
Sbjct:  62   LAIQSNPSFKLELVEMEREGPSYTFDTVSLLKQRYPNDQLFFIIGADMIEYLPKWYKLDE   121

Query: 158   LVEMVQFVGVQRPKYKAGTSYPVIWVDLPLMDISSSMIRQFIKSNRQPNYLLPREVLDYI   217
             L+ ++QF+GV+RP +    T YP+++ D+P ++SS+MIR+  KS   +YL+P +V  Y+
Sbjct: 122   LLNLIQFIGVKRPGFHVETPYPLLFADVPEFEVSSTMIRERFKSKKPTDYLIPDKVKKYV   181

Query: 218   RKEGLYK                                                       224
             + GLY+
Sbjct: 182   EENGLYE                                                       188
```

A related DNA sequence was identified in *S. pyogenes* <SEQ ID 5603> which encodes the amino acid sequence <SEQ ID 5604>. Analysis of this protein sequence reveals the following:

```
Possible site: 44
>>> Seems to have no N-terminal signal sequence
----- Final Results -----
    bacterial cytoplasm --- Certainty = 0.4660 (Affirmative) <succ>
        bacterial membrane --- Certainty = 0.0000 (Not Clear) <succ>
            bacterial outside --- Certainty = 0.0000 (Not Clear) <succ>
```

An alignment of the GAS and GBS proteins is shown below.

```
Identities= 172/210 (81%), Positives = 196/210 (92%)
Query: 15    MALELLTPFTKVELEEKKRDTNRKQIGIMGGNFNPVHNAHLVVADQVRQQLCLDQVLLMP    74
             MALELLTPFTKVELEE+K+++NRKQIGI+GGNFNP+HMAHLVVADQVRQQL LDQVLLMP
Sbjct: 1     MALELLTPFTKVELEEEKKESNRKQIGILGGNFNPIHNAHLVVADQVRQQLGLDQVLLMP    60

Query: 75    EFQPPHIDKKETIDEQHRLKMLELAIEGIDGLSIEPIEIERKGISYTYDTMKLLIEKNPD    134
             E +PPH+D KETIDE+HRL+MLELAIE ++GL+IE  E+ER+GISYTYDTM  L E++PD
Sbjct: 61    ECKPPHVDAKETIDEKHRLRMLELAIEDVEGLAIETCELERQGISYTYDTMLYLTEQHPD    120

Query: 135   VDYYFIIGADMVEYLPKWHRIDELVKMVQFVGVQRPKYKAGTSYPVIWVDLPLMDISSSM    194
             VD+YFIIGADMV+YLPKWHRIDELVK+VQFVGVQRPKYKAGTSYPVIWVDLPL+DISSSM
Sbjct: 121   VDFYFIIGADMVDYLPKWHRIDELVKLVQFVGVQRPKYKAGTSYPVIWVDLPLIDISSSM    180

Query: 195   IRQFIKSNRQPNYLLPREVLDYIRKEGLYK                                224
             IR FIK RQPNYLLP+ VLDYI +EGLY+
Sbjct: 181   IRDFIKKGRQPNYLLPKRVLDYITQEGLYQ                                210
```

SEQ ID 5602 (GBS651) was expressed in *E. coli* as a GST-fusion product. SDS-PAGE analysis of total cell extract is shown in FIG. 132 (lane 8-10; MW 53.3 kDa) and in FIG. 186 (lane 8; MW 53 kDa). It was also expressed in *E. coli* as a His-fusion product. SDS-PAGE analysis of total cell extract is shown in FIG. 132 (lane 12; MW 28.4 kDa) and in FIG. 140 (lane 11; MW 20 kDa).

Purified GBS651-GST is shown in FIG. 243, lane 4; purified GBS651-His is shown in FIG. 229, lane 9.

Based on this analysis, it was predicted that these proteins and their epitopes could be useful antigens for vaccines or diagnostics.

Example 1802

A DNA sequence (GBSx1909) was identified in *S. agalactiae* <SEQ ID 5605> which encodes the amino acid sequence <SEQ ID 5606>. Analysis of this protein sequence reveals the following:

```
Possible site: 32
>>> Seems to have no N-terminal signal sequence
----- Final Results -----
    bacterial cytoplasm --- Certainty = 0.4281 (Affirmative) <succ>
        bacterial membrane --- Certainty = 0.0000 (Not Clear) <succ>
            bacterial outside --- Certainty = 0.0000 (Not Clear) <succ>
```

The protein has homology with the following sequences in the GENPEPT database.

```
>GP:CAB14505 GB:Z99117 similar to hypothetical proteins [Bacillus subtilis]
Identities = 79/180 (43%), Positives = 115/180 (63%)
Query: 9     LDRTELLSKVRHMMSDKRENHVLGVERAAIELAERYGYDKEKAGLAALLHDYAKELSDDE    68
             ++R E L+ V+  +++ R+ H +GV   AIELAER+G D +KA +AA+ HDYAK    +E
Sbjct: 1     MNREEALACVKQQLTEHRYIHTVGVMNTAIELAERFGADSKKAEIAAIFHDYAKFRPKEE    60

Query: 69    FLRLIDKYQPDPDLKKWGNNIWHGLVGIYKIQEDLAIKDQDILAAIAKHTVGSAQMSTLD    128
             ++I + +    L      +WH  VG Y +Q +   ++D+DIL AI   HT G   M+ L+
Sbjct: 61    MKQIIAREKMPAHLLDHNPELWHAPVGAYLVQREAGVQDEDILDAIRYHTSGRPGMTLLE    120

Query: 129   KIVYVADYIEHNRDFPGVEEARELAKVDLNKAVAYETARTVAFLASKAQPIYPKTIETYN    188
             K++YVADYIE NR FPGV+E R+LA+ DLN+A+        T+ FL K QP++P T  TYN
Sbjct: 121   KVIYVADYIEPNRAFPGVDEVRKLAETDLNQALIQSIKNTMVFLMKKNQPVFPDTFLTYN    180
```

A related DNA sequence was identified in *S. pyogenes* <SEQ ID 5607> which encodes the amino acid sequence <SEQ ID 5608>. Analysis of this protein sequence reveals the following:

```
Possible site: 41
>>> Seems to have no N-terminal signal sequence
----- Final Results -----
    bacterial cytoplasm --- Certainty = 0.2615 (Affirmative) <succ>
        bacterial membrane --- Certainty = 0.0000 (Not Clear) <succ>
            bacterial outside --- Certainty = 0.0000 (Not Clear) <succ>
```

An alignment of the GAS and GBS proteins is shown below.

```
Identities = 130/194 (67%), Positives = 159/194 (81%)
Query: 1     MTYKDYTGLDRTELLSKVRHMMSDKRFNHVLGVERAAIELAERYGYDKEKAGLAALLHDY    60
             MTY+DY    RTELL+K+   MS KRF HVLGVE+AA+ LAE YG + +KAGLAALLHDY
Sbjct: 1     MTYEDYLPYSRTELLAKIAEQMSPKRFKHVLGVEKAALSLAECYGCNPDKAGLAALLHDY    60

Query: 61    AKELSDDEFLRLIDKYQPDPDLKKWGNNIWHGLVGIYKIQEDLAIKDQDILAAIAKHTVG   120
             AKE D  FL LIDKYQ  P+L KW NN+WHG+VGIYKIQEDL +KD+DIL AI  HTVG
Sbjct: 61    AKECPDQVFLDLIDKYQLSPELAKWNNNVWHGMVGIYKIQEDLGLKDKDILRAIEIHTVG   120

Query: 121   SAQMSTLDKIVYVADYIEHNRDFPGVEEARELAKVDLNKAVAYETARTVAFLASKAQPIY   180
             +A+M+ LDK++YVADYIE  R FP V++AR++AK+DLN+AVAYET  TVA+LASKAQPI+
Sbjct: 121   AAEMTLLDKVLYVADYIEEGRIFPLVDDARKIAKLDLNQAVAYETVNTVAYLASKAQPIF   180

Query: 181   PKTIETYNAYIPYL                                                194
             P+T++TYNA+  YL
Sbjct: 181   PQTLDTYNAFCSYL                                                194
```

Based on this analysis, it was predicted that these proteins and their epitopes could be useful antigens for vaccines or diagnostics.

Example 1803

A DNA sequence (GBSx1910) was identified in *S. agalactiae* <SEQ ID 5609> which encodes the amino acid sequence <SEQ ID 5610>. Analysis of this protein sequence reveals the following:

Possible site: 56
>>> Seems to have an uncleavable N-term signal seq
INTEGRAL     Likelihood = –2.34     Transmembrane 12-28 (10-28)
----- Final Results -----
   bacterial membrane --- Certainty = 0.1935 (Affirmative) <succ>
   bacterial outside --- Certainty = 0.0000 (Not Clear) <succ>
      bacterial cytoplasm --- Certainty = 0.0000 (Not Clear) <succ>

A related GBS nucleic acid sequence <SEQ ID 10087> which encodes amino acid sequence <SEQ ID 10088> was also identified.

The protein has homology with the following sequences in the GENPEPT database.

```
>GP:AAG19496 GB:AE005041 Vhg1100c [Halobacterium sp. NRC-1]
Identities = 46/175 (26%), Positives = 82/175 (46%), Gaps = 12/175 (6%)
Query: 22    ALLLIDIQQGIMDKK--PKHLTNFAVLLDDLLLSAKGSNCEVIWIRHHDKE----LPQGS    75
             AL+L+D QQG  D       ++  +    ++LL + + +   +RH+ E       L QG
Sbjct: 7     ALVLVDFQQGFADPAWGDRNNPDAEAHAEELLAAWRDAAAPIABVRHNSTEATSPLRQGE    66

Query: 76    PQWEIWEQRHLVTHHKIIDKTYNSCFKDTHLHDYLQSKHISQLIMMGLQTEYCFDTSVKV   135
             P +     +           K+ N  F DT L  +L+ +      L++ GL T++C T+V++
Sbjct: 67    PGFAYTDGLAPAADEPEFVKSVNGAFVDTALEGWLRDRDTGSLVVCGLTTDHCVSTTVRM   126

Query: 136   AFEYGYDIFIPQGGHLTFDTPTLSGDSIKK---HYENIWHHR--FATMVAKDSLL       185
             A    G+D+ +   T D  TL G+ +       H   + H R  FAT+    ++L
Sbjct: 127   ADNRGFDVTLVRDATATHDR-TLDGERLPPSVVHRTALAHLRGEFATLATTATVL      180
```

No corresponding DNA sequence was identified in *S. pyogenes*.

Figure 133:
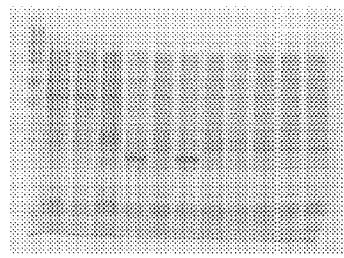

SEQ ID 5610 (GBS652) was expressed in *E. coli* as a GST-fusion product. SDS-PAGE analysis of total cell extract is shown in FIG. 133 (lane 2 & 3; MW 49.7 kDa)+lane 4; MW 27 kDa) and in FIG. 186 (lane 9; MW 50 kDa). It was also expressed in *E. coli* as a His-fusion product. SDS-PAGE analysis of total cell extract is shown in FIG. 133 (lane 5 & 7; MW 24.8 kDa) and in FIG. 178 (lane 10; MW 25 kDa). Purified GBS652-GST is shown in FIG. 243, lane 9; purified GBS652-His is shown in FIG. 229, lane 10.

Based on this analysis, it was predicted that this protein and its epitopes, could be useful antigens for vaccines or diagnostics.

Example 1804

A DNA sequence (GBSx1911) was identified in *S. agalactiae* <SEQ ID 5611> which encodes the amino acid sequence <SEQ ID 5612>. Analysis of this protein sequence reveals the following:

Possible site: 34
>>> Seems to have no N-terminal signal sequence
----- Final Results -----
   bacterial cytoplasm --- Certainty = 0.0945 (Affirmative) <succ>
   bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:CAB14504 GB:Z99117 similar to hypothetical proteins [Bacillus subtilis]
Identities = 55/118 (46%), Positives = 82/118 (68%)
Query: 1     MTEKDLLQLVVKAADEKRAEDIVILDLQPVTSVADYFVIMSASNSRQLEAIADNIREQVK    60
             M +K +L++    A D+KRAEDI+ LD++ ++ VADYF+I    ++ +Q++AIA  I++Q
Sbjct: 1     MNQKSILKIAAAACDDKRAEDILALDMEGISLVADYFLICHGNSDKQVQAIAREIKDQAD    60
```

```
                            -continued
Query: 61    GNGGDASHLEGDSKAGWVLLDLNSVVVHIFSEDERQHYNLEKLWHEAPLLDAEVFMTE     118
             NG    +EG  +A WVL+DL  VVVH+F +DER +YNLEKLW +APL D +  M +
Sbjct: 61    ENGIQVKKMEGFDEARWVLVDLGDVVVHVFHKDERSYYNLEKLWGDAPLADLDFGMNQ     118
```

A related DNA sequence was identified in *S. pyogenes* <SEQ ID 5613> which encodes the amino acid sequence <SEQ ID 5614>. Analysis of this protein sequence reveals the following:

---

Possible site: 50
>>> Seems to have no N-terminal signal sequence
INTEGRAL     Likelihood = −0.69    Transmembrane 91-107 (91-107)
----- Final Results -----
   bacterial membrane --- Certainty = 0.1277 (Affirmative) <succ>
     bacterial outside --- Certainty = 0.0000 (Not Clear) <succ>
       bacterial cytoplasm --- Certainty = 0.0000 (Not Clear) <succ>

---

The protein has homology with the following sequences in the databases:

```
>GP:CAB14504 GB:Z99117 similar to hypothetical proteins [Bacillus subtilis]
Identities = 55/113 (48%), Positives = 80/113 (70%)
Query: 17    MKKEELLKIVVEATEEKRAKDILALDLEGLTSLTDYFVIASATNSRQLEAIADNIREKVK     76
             M ++ +LKI    A ++KRA+DILALD+EG++ + DYF+I    + +Q++AIA  I+++
Sbjct: 1     MNQKSILKIAAAACDDKRAEDILALDMEGISLVADYFLICHGNSDKQVQAIAREIKDQAD     60

Query: 77    EAGGDASHVEGNSQAGWVLLDLTDVVVHLFLEDERYHYNLEKLWHEAPAVALD          129
             E G     +EG  +A WVL+DL DVVVH+F +DER +YNLEKLW +AP    LD
Sbjct: 61    ENGIQVKKMEGFDEARWVLVDLGDVVVHVFHKDERSYYNLEKLWGDAPLADLD          113
```

An alignment of the GAS and GBS proteins is shown below.

```
Identities = 78/116 (67%), Positives = 100/116 (85%)
Query: 1     MTEKDLLQLVVKAADEKRAEDIVILDLQPVTSVADYFVIMSASNSRQLEAIADNIREQVK     60
             M +++LL++VV+A +EKRA+DI+ LDL+ +TS+ DYFVI SA+NSRQLEAIADNIRE+VK
Sbjct: 17    MKKEELLKIVVEATEEKRAKDILALDLEGLTSLTDYFVIASATNSRQLEAIADNIREKVK     76

Query: 61    GNGGDASHLEGDSKAGWVLLDLNSVVVHIFSEDERQHYNLEKLWHEAPLLDAEVFM       116
                GGDASH+EG+S+AGWVLLDL  VVVH+F EDER HYNLEKLWHEAP +  + ++
Sbjct: 77    EAGGDASHVEGNSQAGWVLLDLTDVVVHLFLEDERYHYNLEKLWHEAPAVALDAYL       132
```

Based on this analysis, it was predicted that these proteins and their epitopes could be useful antigens for vaccines or diagnostics.

Example 1805

A DNA sequence (GBSx1912) was identified in *S. agalactiae* <SEQ ID 5615> which encodes the amino acid sequence <SEQ ID 5616>. Analysis of this protein sequence reveals the following:

---

Possible site: 19
>>> Seems to have no N-terminal signal sequence
----- Final Results -----
   bacterial cytoplasm --- Certainty = 0.2415 (Affirmative) <succ>
     bacterial membrane --- Certainty = 0.0000 (Not Clear) <succ>
       bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1806

A DNA sequence (GBSx1913) was identified in *S. agalactiae* <SEQ ID 5617> which encodes the amino acid sequence <SEQ ID 5618>. Analysis of this protein sequence reveals the following:

---

Possible site: 21
>>> Seems to have no N-terminal signal sequence
----- Final Results -----
   bacterial cytoplasm --- Certainty = 0.1570 (Affirmative) <succ>
     bacterial membrane --- Certainty = 0.0000 (Not Clear) <succ>
       bacterial outside --- Certainty = 0.0000 (Not Clear) <succ>

---

The protein has homology with the following sequences in the GENPEPT database.

```
>GP:CAB14503 GB:Z99117 similar to hypothetical proteins [Bacillus subtilis]
Identities = 86/242 (35%), Positives = 154/242 (63%), Gaps = 4/242 (1%)
Query: 4     YETFAAVYDAVMDDTLYAKWTDFSLRHFPKGKKKLLELACGTGIQSVRFAQAGYAVTGLD     63
```

```
                                   -continued
              Y+ FA+VYD +M      Y +WT +     P+ K ++L+LACGTG  S+R A+ G+ VTG+D
Sbjct:  3     YQGFASVYDELMSHAPYDQWTKWIEASLPE-KGRILDLACGTGEISIRLAEKGFEVTGID     61

Query: 64     LSGDMLKLAKKRATSAHQSIQFIEGNMLDLSNV-GKYDLITCYSDSICYMQDEVEVGDVF    122
              LS +ML  A+++ +S+ Q I F++ +M +++    G++D +     DS+ Y++ + +V + F
Sbjct: 62     LSEEMLSFAQQKVSSS-QPILFLQQDMREITGFDGQFDAVVICCDSLNYLKTKNDVIETF    120

Query: 123    IEVYKALEENGVFIFDVHSTYQTDKVFPGYSYHENADDFAMVWDTYEDDAPHSIVHELTF    182
                V++ L+  G+ +FDVHS+++  +VFP   ++ +  +D + +W ++       S++H+++F
Sbjct: 121    KSVFRVLKPEGILLFDVHSSFKIAEVFPDSTFADQDEDISYIWQSFAGSDELSVIHDMSF    180

Query: 183    FVQEEDGRFTRHDEVHEERTYDILTYDILLEQAGFKDVEVYADFEDKKPTATSARWFFVA    242
              FV    +  + R DE HE+RT+ +   Y+ +L+   GF+    +V ADF D +P+A S R FF A
Sbjct: 181    FVWNGEA-YDRFDETHEQRTFPVEEYEEMLKNCGFQLHRVTADFTDTEPSAQSERLFFKA    239

Query: 243    HK                                                             244
                K
Sbjct : 240   QK                                                             241
```

A related DNA sequence was identified in *S. pyogenes* <SEQ ID 5619> which encodes the amino acid sequence <SEQ ID 5620>. Analysis of this protein sequence reveals the following:

---

Possible site: 53
>>> Seems to have no N-terminal signal sequence
----- Final Results -----
  bacterial cytoplasm --- Certainty = 0.2315 (Affirmative) <succ>
    bacterial membrane --- Certainty = 0.0000 (Not Clear) <succ>
      bacterial outside --- Certainty = 0.0000 (Not Clear) <succ>

---

An alignment of the GAS and GBS proteins is shown below.

```
Identities = 191/243 (78%), Positives = 215/243 (87%), Gaps = 2/243 (0%)
Query:   4    YETFAAVYDAVMDDTLYAKWTDFSLRHFPK--GKKKLLELACGTGIQSVRFAQAGYAVTG     61
              YE FA+VYDAVMDD+LY  WTDFSLRH PK  G+ +LLELACGTGIQSVRFAQAG+ VTG
Sbjct:  21    YEKFASVYDAVMDDSLYDLWTDFSLRHLPKSKGRNRLLELACGTGIQSVRFAQAGFDVTG     80

Query:  62    LDLSGDMLKLAKKRATSAHQSIQFIEGNMLDLSNVGKYDLITCYSDSICYMQDEVEVGDV    121
              LDLS DML +AKKRA SA + I FI+GNMLDLS VG++D +TCYSDSICYMQDEV+VGDV
Sbjct:  81    LDLSQDMLAIAKKRAQSAKKKIDFIQGNMLDLSQVGQFDFVTCYSDSICYMQDEVDVGDV    140

Query: 122    FIEVYKALEENGVFIFDVHSTYQTDKVFPGYSYHENADDFAMVWDTYEDDAPHSIVHELT    181
              F EVY  L  +G+FIFDVHSTYQTD+ FPGYSYHENADDFAMVWDTY D+APHS+VHELT
Sbjct: 141    FKEVYDVLANDGIFIFDVHSTYQTDECFPGYSYHENADDFAMVWDTYADEAPHSVVHELT    200

Query: 182    FFVQEEDGRFTRHDEVHEERTYDILTYDILLEQAGFKDVKVYADFEDKKPTATSARWFFV    241
              FF+QE+DGRF+R DEVHEERTY++LTYDILLEQAGFK  KVYADFEDK+PT TS RWFFV
Sbjct: 201    FFIQEDDGRFSRFDEVHEERTYELLTYDILLEQAGFKSFKVYADFEDKEPTKTSKRWFFV    260

Query: 242    AHK                                                             244
              A+K
Sbjct: 261    AYK                                                             263
```

Based on this analysis, it was predicted that these proteins and their epitopes could be useful antigens for vaccines or diagnostics.

Example 1807

A DNA sequence (GBSx1914) was identified in *S. agalactiae* <SEQ ID 5621> which encodes the amino acid sequence <SEQ ID 5622>. Analysis of this protein sequence reveals the following:

---

Possible site: 54
>>> Seems to have no N-terminal signal sequence
----- Final Results -----
  bacterial cytoplasm --- Certainty = 0.3538 (Affirmative) <succ>
    bacterial membrane --- Certainty = 0.0000 (Not Clear) <succ>
      bacterial outside --- Certainty = 0.0000 (Not Clear) <succ>

---

The protein has homology with the following sequences in the GENPEPT database.

```
>GP:BAB06304 GB:AP001516 unknown conserved protein [Bacillus halodurans]
Identities = 129/367 (35%), Positives = 184/367 (49%), Gaps = 45/367 (12%)
Query:   1   MTVTGIVAEFNPFENGHKYLLEQAQ-----GIKVIAMSGNFMQRGEPAIVDKWTRSQMAL     55
             M   G+V E+NPFHNGH + L +A+       + +  MSG F+QRGEPAI+ KW R+ +AL
```

```
                           -continued
Sbjct:   1  MKAVGVVVEYNPFHNGHLHHLTEARKQAKADVVIAVMSGYFLQRGEPAILPKWERTSLAL   60

Query:  56  ENGADLVIELPFLVSVQSADYFASGAVSILARLGVDNLCFGTEE--MLDYARIGDIYVNK  113
            + GADLV+ELP+  S Q A++FA+GAVSILA L  D LCFG+EE +  + R+
Sbjct:  61  QGGADLVVELPYAFSTQKAEWFATGAVSILAALEADALCFGSEEGTIEPFHRLYHFMAKH  120

Query: 114  KEEMEAFLKKQSD-SLSYPQKMQAMWQEFAGIT--FSGQTPNHILGLAYTKAA--SQNGI  168
            +  + +K++ D +SYP      ++   G           PN+ILG  Y KA        I
Sbjct: 121  RLAWDRMIKEELDKGMSYPTATSLAFKRLEGSAEHLDLSRPNNILGFHYVKAIYDLHTSI  180

Query: 169  RLNPIQRQGAGYHSSEKTE-IFASATSLRK--------HQSDRFF------VEKGMPNSD  213
            +  I R  AGYH    E   ASATS+RK              DR         + K
Sbjct: 181  KAMTIPRIKAGYHDDSLNESSIASATSIRKSLKTKEGWQMVDRVVPSYTTEMLKSFEKET  240

Query: 214  LFLNSPQVVWQDYFSLLKYQIMTHS--DLTQIYQVNEEIANRIKSQIRYVETVDELVDKV  271
                FL S    W+  F LLKY+++T +    l  IY+  E +  R    I    +  + +  K+
Sbjct: 241  TFLPS----WERLFPLLKYRLLTATPEQLHAIYEGEEGLEYRALKTIVSATSFHDWMTKM  296

Query: 272  ATKRYTKARIRRLLTYILINAVESPIPNA----------IHVLGFTQKGQQHLKSVKK--  319
              TKRYT  RI+R  T++  N  +  I +                     I +LG T +GQ +L    KK
Sbjct: 297  KTKRYTWTRIQRYATHLFTNTTKEEIHSVLPRGTESLPYIRLLGMTSRGQMYLNGKKKQL  356

Query: 320  SVDIVTR                                                       326
            +   ++TR
Sbjct: 357  TTPVITR                                                       363
```

A related DNA sequence was identified in S. pyogenes <SEQ ID 5623> which encodes the amino acid sequence <SEQ ID 5624>. Analysis of this protein sequence reveals the following:

---

Possible site: 33
>>> Seems to have no N-terminal signal sequence
----- Final Results -----
    bacterial cytoplasm --- Certainty = 0.3165 (Affirmative) <succ>
      bacterial membrane --- Certainty = 0.0000 (Not Clear) <succ>
        bacterial outside --- Certainty = 0.0000 (Not Clear) <succ>

---

An alignment of the GAS and GBS proteins is shown below.

Based on this analysis, it was predicted that these proteins and their epitopes could be useful antigens for vaccines or diagnostics.

Example 1808

A DNA sequence (GBSx1915) was identified in S. agalactiae <SEQ ID 5625> which encodes the amino acid sequence <SEQ ID 5626>. This protein is predicted to be transcriptional activator tipa. Analysis of this protein sequence reveals the following:

---

Possible site: 17
>>> Seems to have no N-terminal signal sequence
----- Final Results -----

```
Identities = 221/359 (61%), Positives = 288/359 (79%)
Query:   1  MTVTGIVAEFNPFHNGHKYLLEQAQGIKVIAMSGNFMQRGEPAIVDKWTRSQMALENGAD   60
            MTVTGI+AEFNPFHNGHKYLLE A+G+K+IAMSGNFMQRGEPA++DKW RS+MAL+NGAD
Sbjct:   1  MTVTGIIAEFNPFHNGHKYLLETAEGLKIIAMSGNFMQRGEPALIDKWIRSEMALKNGAD   60

Query:  61  LVIELPFLVSVQSADYFASGAVSILARLGVDNLCFGTEEMLDYARIGDIYVNKKEEMEAF  120
            +V+ELPF VSVQSADYFA GA+ IL +LG+  L FGTE ++DY ++   +Y  K E+M A+
Sbjct:  61  IVVELPFFVSVQSADYFAQGAIDILCQLGIQQLAFGTENVIDYQKLIKVYEKKSEQMTAY  120

Query: 121  LKKQSDSLSYPQKMQAMWQEFAGITFSGQTPNHILGLAYTKAASQNGIRLNPIQRQGAGY  180
            L   D+ SYPQK Q MW+ FAG+ FSGQTPNHILGL+Y KA++   I+L PI+RQGA Y
Sbjct: 121  LSTLEDTFSYPQKTQKMWEIFAGVKFSGQTPNHILGLSYAKASAGKHIQLCPIKRQGAAY  180

Query: 181  HSSEKTEIFASATSLRKHQSDRFFVEKGMPNSDLFLNSPQVVWQDYFSLLKYQIMTHSDL  240
            HS +K  + ASA+++R+H +D  F+     +PN+ L +N+P + W   YFS LKYQI+ HSDL
Sbjct: 181  HSKDKNHLLASASAIRQHLNDWDFISHSVPNAGLLINNPHMSWDHYFSFLKYQILNHSDL  240

Query: 241  TQIYQVNEEIANRIKSQIRYVETVDELVDKVATKRYTKARIRRLLTYILINAVESPIPNA  300
            T I+QVN+E+A+RIK  I+   + +D LVD VATKRYTKAR+RR+LTYIL+NA E   +P
Sbjct: 241  TSIFQVNDELASRIKKAIKVSQNIDHLVDTVATKRYTKARVRRILTYILVNAKEPTLPKG  300

Query: 301  IHVLGFTQKGQQHLKSVKKSVDIVTRIGSQTWDSLTQRADSVYQMGNANIAEQTWGRIP  359
            IH+LGFT KGQ HLK +KKS   ++TRIG++TWD +TQ+ADS+YQ+G+ +I EQ++GRIP
Sbjct: 301  IHILGFTSKGQAHLKKLKKSRPLITRIGAETWDEMTQKADSIYQLGHQDIPEQSFGRIP  359
```

3215

-continued bacterial cytoplasm --- Certainty = 0.3117 (Affirmative) <succ>
        bacterial membrane --- Certainty = 0.0000 (Not Clear) <succ>
        bacterial outside --- Certainty = 0.0000 (Not Clear) <succ>

The protein has homology with the following sequences in the GENPEPT database.

```
>GP:CAB15677 GB:Z99122 transcriptional regulator [Bacillus subtilis]
Identities = 91/246 (36%), Positives = 144/246 (57%), Gaps = 14/246 (5%)
Query:    4 VKEISHISGISVRTLHYYDEIDLLSPSFVGENGYRYYDDESLIKLQEILLFKELEFPLKK    63
            VK+++ ISG+S+RTLH+YD I+LL+PS + + GYR Y D  L +LQ+IL FKE+ F L +
Sbjct:    5 VKQVAEISGVSIRTLHHYDNIELLNPSALTDAGYRLYSDADLERLQQILFFKEIGFRLDE    64

Query:   64 IKEIMDSPNYDRNQALLDQIRWIELKKQRLEEVIEHAK----SIQRGKNMSD---FTAYN   116
            IKE++D PN+DR  AL Q   L  KKQR++E+I+       S+  G+ M+    F   +
Sbjct:   65 IKEMLDHPNFDRKAALQSQKEILMKKKQRMDEMIQTIDRTLLSVDGGETMNKRDLFAGLS   124

Query:  117 QEELEAFQ----EEARTRWGD--TDSYKEFENSHSKNDFSMISQAMSQIFKDFGQLKELS   170
            +++E Q     +E R  +G    +  ++  +++S +D+ I     I++         +
Sbjct:  125 MKDIEEHQQTYADEVRKLYGKEIAEETEKRTSAYSADDWRTIMAEFDSIYRRIAARMKHG   184

Query:  171 PTDEKVQKQVQILQDYITAQFYNCTNDLLASLGIMYIQDERFQKSIDNWGGQGTALFVSK   230
            P D ++Q  V   +D+I     Y+CT D+    LG +YI DERF  SI+ + G+G A F+ +
Sbjct:  185 PDDAEIQAAVGAFRDHICQYHYDCTLDIFRGLGEVYITDERFTDSINQY-GEGLAAFLRE   243

Query:  231 AIDSYC                                                         236
            AI  YC
Sbjct:  244 AIIIYC                                                         249
```

There is also homology to SEQ ID 1712.

Based on this analysis, it was predicted that this protein and its epitopes, could be useful antigens for vaccines or diagnostics.

Example 1809

A DNA sequence (GBSx1916) was identified in *S. agalactiae* <SEQ ID 5627> which encodes the amino acid sequence <SEQ ID 5628>. Analysis of this protein sequence reveals the following:

Possible site: 39
>>> Seems to have no N-terminal signal sequence
----- Final Results -----
    bacterial cytoplasm --- Certainty = 0.2590 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database.

```
>GP:CAB14597 GB:Z99117 yrkC [Bacillus subtilis]
Identities = 56/129 (43%), Positives = 74/129 (56%), Gaps = 7/129 (5%)
Query:    2 KGFHGNIEKLTLGNTNFRQVLYTAEHCQLVLMTLPVGGEIGSEIHAENDQFFRFEAGHGE    61
            K F NI  + T  N  FR  L+T +H Q+ LM+L +G +IG EIH   DQF R EG G
Sbjct:   59 KPFVVNINRATKQNNTERTALWTGKHFQVTLMSLGIGEDIGLEIHPNVDQFLRIEQGRGI   118

Query:   62 VVIDGN------EYEVADGDAIIVPAGAEHNVINTSETEMLKLYTIYSPAHHKDGIIRAT   115
            V + +        + V D AI+VPAG  HNVINT  T  LKLY+IY+P +H  G +  T
Sbjct:  119 VKMGKSKDHLNFQRNVYDDSAIVVPAGTWHNVINTGNTP-LKLYSIYAPPNHPFGTVHET   177

Query:  116 REEAEENEE                                                      124
            + +A   E+
Sbjct:  178 KADAVAAED                                                      186
```

No corresponding DNA sequence was identified in *S. pyogenes*.

3216

Based on this analysis, it was predicted that this protein and its epitopes, could be useful antigens for vaccines or diagnostics.

Example 1810

A DNA sequence (GBSx1917) was identified in *S. agalactiae* <SEQ ID 5629> which encodes the amino acid sequence <SEQ ID 5630>. This protein is predicted to be glycerol uptake facilitator (glpF). Analysis of this protein sequence reveals the following:

Possible site: 61
>>> Seems to have an uncleavable N-term signal seq
INTEGRAL    Likelihood = −9.08    Transmembrane 156-172 (153-180)
INTEGRAL    Likelihood = −6.21    Transmembrane 135-151 (132-155)
INTEGRAL    Likelihood = −4.09    Transmembrane 86-102 (80-103)
INTEGRAL    Likelihood = −3.93    Transmembrane 213-229 (212-230)
INTEGRAL    Likelihood = −3.72    Transmembrane 8-24 (5-28)
INTEGRAL    Likelihood = −2.76    Transmembrane 38-54 (36-58)
----- Final Results -----
    bacterial membrane --- Certainty = 0.4630 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:BAB04811 GB:AP001510 glycerol uptake facilitator [Bacillus halodurans]
Identities = 135/230 (58%), Positives = 171/230 (73%)
Query:    1  MTQFLGEFLGTFILVLLGDGVVAGNVLSKTKEEGTGWTAIVFGWGIACTVAVYVSGLFSP    60
             M+ FLGE +GT IL++LG GVVAG VL  TK E GW  I   WG+A   AVY  G  S
Sbjct:    1  MSPFLGEVIGTMILIILGGGVVAGVVLKGTKSENGGWIVITAAWGLAVATAVYCVGQISG   60

Query:   61  AHLNPAVTLAMASIGAISWGQVIPFIIAQMLGAMVAATILWLHYYPHWKETKDSGLILAS   120
             AHLNPAVT+ +A +GA  W QV  +I+AQMLGAM+ AT+++LHYYPH+K T+D G  LA
Sbjct:   61  AHLNPAVTIGLALVGAFEWSQVAGYIVAQMLGAMIGATLVFLHYYPHFKATEDQGAKLAV  120

Query:  121  FSTGPAIRHTPSNLLGEIIGTAILVITIMAIGPSKVAAGLGPIIVGIVIFAVGFSLDPTT   180
             FST PAI+H P+N   E++GT +LV+ i+AIG ++   GL P+IVG++I  +G SL TT
Sbjct:  121  FSTDPAIKHLPANFFSEVLGTFVLVLGILAIGANEFTEGLNPLIVGLLIVVIGLSLGGTT  180

Query:  181  GYAINPARDLGPRLMHAILPIENKGNSDWSYAWIPVVGPIIGGVLGAILY            230
             GYAINPARDLGPR+ H +LPI  KG+S+WSYAWIP+VGPIIGG +GA+ Y
Sbjct:  181  GYAINPARDLGPRIAHFLLPIPGKGSSNWSYAWIPIVGPIIGGGIGALTY            230
```

There is also homology to SEQ ID 2854.

Based on this analysis, it was predicted that this protein and its epitopes, could be useful antigens for vaccines or diagnostics.

Example 1811

A DNA sequence (GBSx1918) was identified in *S. agalactiae* <SEQ ID 5631> which encodes the amino acid sequence <SEQ ID 5632>. Analysis of this protein sequence reveals the following:

Possible site: 37
>>> Seems to have no N-terminal signalsequence
----- Final Results -----
  bacterial cytoplasm --- Certainty = 0.1694 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:BAB07114 GB:AP001518 unknown conserved protein in others
[Bacillus halodurans]
Identities = 64/118 (54%), Positives = 85/118 (71%)
Query:    5  GIIVVSHSKNIAQGVVDLISEVAKDVSITYVGGTEDGEIGTSFDQVQQIVEQNDKKTLLA    64
             GI++ SH   +A+G+V L+ E AKDVSITY GGT+D ++G SF+++QQ V  N+    L
Sbjct:    7  GIVISSHVPALAEGIVTLLKEAAKDVSITYAGGTDDDQVGASFEKIQQQAVMDNEADELFV   66

Query:   65  FFDLGSAKMVLELVADFSEKNIIINSVPVVEGAYTAAALLQAGADLDSIQSQLAELTI   122
             F+DLGSAKMN+E+V +  SEK I +   V +VEGAYTAAAL Q GA  ++I  QL  LTI
Sbjct:   67  FYDLGSAKMEVEMVMELSEKTIHLMDVALVEGAYTAAALTQGGASFETIMEQLQPLTI   124
```

No corresponding DNA sequence was identified in *S. pyogenes*.

Example 1812

A DNA sequence (GBSx1919) was identified in *S. agalactiae* <SEQ ID 5633> which encodes the amino acid sequence <SEQ ID 5634>. Analysis of this protein sequence reveals the following:

Possible site: 59
>>> Seems to have no N-terminal signal sequence
----- Final Results -----
  bacterial cytoplasm --- Certainty = 0.4753 (Affirmative) <succ>
    bacterial membrane --- Certainty = 0.0000 (Not Clear) <succ>
      bacterial outside --- Certainty = 0.0000 (Not Clear) <succ>

Based on this analysis, it was predicted that this protein and its epitopes, could be useful antigens for vaccines or diagnostics.

The protein has homology with the following sequences in the GENPEPT database.

```
>GP:BAB07115 GB:AP001518 unknown conserved protein in others
[Bacillus halodurans]
Identities = 98/190 (51%), Positives = 135/190 (70%), Gaps = 2/190 (1%)
Query:    3  VKTAIEWMHTFNQKIQSNKDYLSELDTPIGDGDHGGNMARGMTAVIENLDNNEFSSAADV    62
             V+   +W+H F++K+Q+N+ YLSELD+ IGDGDHG NMARG+  V   L  N F S  +V
Sbjct:    4  VENTTKWLHAFHEKVQANQSYLSELDSAIGDGDHGTNMARGLAEVERKLKENLFESPQEV   63

Query:   63  FKTVSMQLLSKVGGASGPLYGSAFMGITK-AEQSKSTISEALGAGLEMIQKRGKAELNEK   121
             K  +M L+SK GGASGPLYG+A + +K         I +++ AGL  I KRGKA    EK
Sbjct:   64  LKMAAMALISKTGGASGPLYGTALLEMSKQVANDPQNIGKSIEAGLNGILKRGKATTGEK  123

Query:  122  TMVDVWHGVIEAT-EENELTEDRIDSLVDATKGMKATKGRASYVGERSVGHIDPGSFSSG   180
             TMVD+W  V+E++  + +L+++RI    V   TK MKATKGRASY+GERS+GH+DP + SSG
Sbjct:  124  TMVDIWKPVVESLMAEQQLSKERIQQFVSETKEMKATKGRASYLGERSLGHLDPGAVSSG  183
```

```
Query: 181 LLFKALLEVG                                              190
            LF+A+++ G
Sbjct: 184 YLFEAMIDGG                                              193
```

Based on this analysis, it was predicted that this protein and its epitopes, could be useful antigens for vaccines or diagnostics.

Example 1813

A DNA sequence (GBSx1920) was identified in *S. agalactiae* <SEQ ID 5637> which encodes the amino acid sequence <SEQ ID 5638>. This protein is predicted to be dihydroxyacetone kinase (b1200). Analysis of this protein sequence reveals the following:

---
Possible site: 59
>>> Seems to have no N-terminal signal sequence
----- Final Results -----
    bacterial cytoplasm --- Certainty = 0.2080 (Affirmative) <succ>
    bacterial membrane --- Certainty = 0.0000 (Not Clear) <succ>
    bacterial outside --- Certainty = 0.0000 (Not Clear) <succ>
---

The protein has homology with the following sequences in the GENPEPT database.

```
>GP:BAB07116 GB:AP001518 dihydroxyacetone kinase [Bacillus halodurans]
Identities = 204/329 (62%), Positives = 261/329 (79%)
Query:   1 MKKILNQPTDVVTEMLDGLAYVHNDLVHRIEGFDIIARNEEKSGKVALISGGGSGHEPSH    60
           MKKILN P +V+ EMLDG  Y +  LV R+ G  +I R  E  GKVAL+SGGGSGHEPSH
Sbjct:   1 MKKILNDPQNVLDEMLDGFVYANGHLVERVAGTGVIRRTYEDKGKVALVSGGGSGHEPSH    60

Query:  61 AGFVGEGMLSAAVCGAVETSPTPDQVLEAIKEADEGAGVFMVIKNYSGDIMNFEMAQDMA   120
           AGFVG+GMLSAAVCG VFTSPTPDQ+ E IK AD+G GV ++IKNY+GD+MNFEMA +MA
Sbjct:  61 AGFVGQGMLSAAVCGEVFTSPTPDQIFEGIKAADQGGGVLLIIKNYTGDVMNFEMAGEMA   120

Query: 121 EMEGIEVASVVVDDDIAVEDSLYTQGKRGVAGTILVHKILGHAARHGKSLQEIKAIADEL   180
           E EGI V  ++V+DDIAVEDS +T G+RGVAGTI+VHKI+G AA   G SLQ +K + + 
Sbjct: 121 EAEGITVDHIIVNDDIAVEDSSFTAGRRGVAGTIIVHKIVGAAAEAGLSLQSLKVLGETV   180

Query: 181 VPNIHTVGLALSGATVPEVGKPGFVLAEDEIEFGIGIHGEPGYRKEKMQPSKALATELVD   240
           + N  T+G+++  ATVP VGKPGF L +DE+E+G+GIHGEPGYRKEK++ SK +A EL+
Sbjct: 181 IENTKTIGVSILPATVPAVGKPGFELGDDEMEYGVGIHGEPGYRKEKLKSSKEIAEELIL   240

Query: 241 KLIESFDAKSGEKYGVLINGMGATPLMEQYVFANDVAKLLEDKGIEVNYKKLGNYMTSID   300
           KL E+F    G+KYGVL+NG+GATPLMEQYVF NDVA  L ++G+ + +KK+G++MTSID
Sbjct: 241 KLKEAFGWSKGDKYGVLVNGLGATPLMEQYVFMNDVANKLTEEGLNIQFKKVGSFMTSID   300

Query: 301 MAGLSLTLIKLENQEWLEALNSDVTTIAW                                329
           MAG+SLTLIK+  ++WL+  N +V T+ W
Sbjct: 301 MAGVSLTLIKIVEEKWLDYWNHEVKTVDW                                329
```

No corresponding DNA sequence was identified in *S. pyogenes*.

Example 1814

A DNA sequence (GBSx1921) was identified in *S. agalactiae* <SEQ ID 5639> which encodes the amino acid sequence <SEQ ID 5640>. Analysis of this protein sequence reveals the following:

---
Possible site: 23
>>> Seems to have no N-terminal signal sequence
----- Final Results -----
    bacterial cytoplasm --- Certainty = 0.1997 (Affirmative) <succ>
    bacterial membrane --- Certainty = 0.0000 (Not Clear) <succ>
    bacterial outside --- Certainty = 0.0000 (Not Clear) <succ>
---

The protein has homology with the following sequences in the GENPEPT database.

```
>GP:BAB07113 GB:AP001518 unknown [Bacillus halodurans]
Identities = 59/142 (41%), Positives = 82/142 (57%), Gaps = 5/142 (3%)
Query:   1 MTSSLITKKKIAKSFKRLFISQAFDKISVSDIMEDAGIRRQTFYNHFVDKYALLEWIFQT    60
           MT+S+ITKK IAK+FK L  Q F KISVSDIM  A +RRQTFY HF DK+ LL WI++
Sbjct:   1 MTNSIITKKVIAKAFKDLMEVQPFSKISVSDIMNRANMRRQTFYYHFQDKFELLHWIYKQ    60

Query:  61 ELSEQVTDNLDYISGFQLLSELLTFFKIANUFYIKLFQIEDQNDFSSYFESYCEQLVDKL   120
           E   E  D L Y     L+ +F NQ FY +   QN F+ Y   + + L
Sbjct:  61 ETKEHSIDFLAYDDIHTIFRHLMHYFYENQTFYQRAMVVNGQNGFIDYLYBHIQTL---Y   117

Query: 121 LSDYSKSNFNQKERVTFINYHS                                        142
           L++  +   +QK+R    +++S
Sbjct: 118 LNEIDRR--SQKDREFISSFYS                                        137
```

A related DNA sequence was identified in *S. pyogenes* <SEQ ID 5641> which encodes the amino acid sequence <SEQ ID 5642>. Analysis of this protein sequence reveals the following:

```
Possible site: 31
  >>> Seems to have no N-terminal signal sequence
  ----- Final Results -----
    bacterial cytoplasm --- Certainty = 0.2101 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
Identities = 31/115 (26%), Positives = 58/115 (49%), Gaps = 6/115 (5%)
Query:   7  TKKKIAKSFKRLFISQAFDKISVSDIMEDAGIRRQTFYNHFVDKYALLEWIFQTELSEQV    66
            TK  +  +   L    Q+F+ ++VSD+ + AGI R TFY H+ DK+ ++    F+ +  + +
Sbjct:   8  TKAYVKTALTILLTEQSFETLTVSDLIKKAGINRGTFYLHYTDKFDMMNH-FKNDILDDL   66

Query:  67  IDNLD----YISGFQLLSELLTFFKMNQEFYIKLFQIEDQNDFSSYFESYCEQLV       117
               L+    Y   Q+L++ L++   ++EF    L I      F     + +C Q +
Sbjct:  67  YRLLNQAEIYIDTRQVLNQTLSYLIEHREFITALATI-SYLKFPQLIKDFCYQFL       120
```

Based on this analysis, it was predicted that these proteins and their epitopes could be useful antigens for vaccines or diagnostics.

Example 1815

A DNA sequence (GBSx1922) was identified in *S. agalactiae* <SEQ ID 5643> which encodes the amino acid sequence <SEQ ID 5644>. Analysis of this protein sequence reveals the following:

```
Possible site: 45
  >>> Seems to have no N-terminal signal sequence
  ----- Final Results -----
    bacterial cytoplasm --- Certainty = 0.1974 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1816

A DNA sequence (GBSx1923) was identified in *S. agalactiae* <SEQ ID 5645> which encodes the amino acid sequence <SEQ ID 5646>. This protein is predicted to be dihydroxyacetone kinase (b1200). Analysis of this protein sequence reveals the following:

```
Possible site: 55
  >>> Seems to have no N-terminal signal sequence
  ----- Final Results -----
    bacterial cytoplasm --- Certainty = 0.1806 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP:BAB07112 GB:AP001518 dihydroxyacetone kinase [Bacillus halodurans]
Identities = 141/285 (49%), Positives = 197/285 (68%), Gaps = 1/285 (0%)
Query:  45  IPILSGGGSGHEPAHFGYVGEGMLSAAISGPIFVPPCASDILETIRFINRGKGVFVIIKN   104
            +PI+SGGGSGHEP H GYVGEGML+AA+ G +FVPP A  +L  IR +++GKGV +IIKN
Sbjct:  46  VPIISGGGSGHEPGHLGYVGEGMLAAAVHGDVFVPPSAQQVLAAIRQMDQGKGVLLIIKN   105

Query: 105  FEADLEEFSQAIEQARQEGIPIKYIVSHDDISVET-SNFKIRHRGVAGTVLLHKIIGQAA   163
            F ADL  F  A  QAR EG  +  +++ +DD+SVE+ ++F+  R RGVAG VL+HKIIG AA
Sbjct: 106  FVADLATFLSAEVQARAEGRDVAHVIVNDDVSVESDASFEKRRRGVAGAVLVHKIIGAAA   165

Query: 164  LEGASLDELEQLGLSLTTSMATLGVASKSATILGQHQPVFDIEEGYISFGIGIHGEPGYR   223
               EG SL+ L+++G  +   ++ATLGVA    A  +  + +P F +EEG + FG+GIHGE GYR
Sbjct: 166  KEGYSLEALQEIGEQVVKNLATLGVALTHADLPERREPQFLLEEGEVYFGVGIHGEQGYR   225

Query: 224  TMPFVSMEHLANELVNKLKMKLRWQDGEAFILLINNLGGSSKMEELLFTNAVMEFLALDD   283
                 VS E  LA ELVNKLK    RW  +  + +LIN LGG+   +E+  +F N V   LA+++
Sbjct: 226  KEKLVSSELLAVELVNKLKSLYRWDKNDQYAVLINGLGGTPLIEQYVFANDVRRLLAIEN   285

Query: 284  LQLPFIKTGHLITSLDMAGLSVTLCRVKDSRWIDYLKHKTDARAW                328
            L + F+K G  +TSL+M G+S+T+  ++  D +W+  +L       D    W
Sbjct: 286  LHVSFVKVGTQLTSLNMKGISLTMLKICDEQWVKWLYAPVDVAHW                330
```

No corresponding DNA sequence was identified in *S. pyogenes*.

Based on this analysis, it was predicted that this protein and its epitopes, could be useful antigens for vaccines or diagnostics.

Example 1817

A DNA sequence (GBSx1924) was identified in *S. agalactiae* <SEQ ID 5647> which encodes the amino acid sequence <SEQ ID 5648>. Analysis of this protein sequence reveals the following:

```
Possible site: 53
>>> Seems to have no N-terminal signal sequence
----- Final Results -----
    bacterial cytoplasm --- Certainty = 0.3902 (Affirmative) <succ>
    bacterial membrane --- Certainty = 0.0000 (Not Clear) <succ>
    bacterial outside --- Certainty = 0.0000 (Not Clear) <succ>
```

A related GBS nucleic acid sequence <SEQ ID 10085> which encodes amino acid sequence <SEQ ID 10086> was also identified.

The protein has homology with the following sequences in the GENPEPT database.

```
>GP:AAC75047 GB:AE000290 orf, hypothetical protein [Escherichia coli K12]
Identities = 182/237 (76%), Positives = 201/237 (84%)
Query:   20 MGRKWANIVAKKTAKDGANSKVYAKFGVEIYVAAKQGEPDPESNSALKFVLDRAKQAQVP      79
            MGRKWANIVAKKTAKDGA SK+YAKFGVEIY AAKQGEPDPE N++LKFV++RAKQAQVP
Sbjct:    1 MGRKWANIVAKKTAKDGATSKIYAKFGVEIYAAAKQGEPDPELNTSLKFVIERAKQAQVP      60

Query:   80 KHVIDKAIDKAKGNTDETFVEGRYEGFGPNGSMIIVDTLTSNVNRTAANVRTAYGKNGGN     139
            KHVIDKAIDKAKG  DETFV+GRYEGFGPNGSMII +TLTSNVNRT ANVRT + K GGN
Sbjct:   61 KHVIDKAIDKAKGGGDETFVQGRYEGFGPNGSMIIAETLTSNVNRTIANVRTIFNKKGGN     120

Query:  140 MGASGSVSYLFDKKGVIVFAGDDADTVFEQLLEADVDVDDVEAEEGTITVYTAPTDLHKG     199
            +GA+GSVSY+FD  GVIVF G D D +FE LLEA+VDV DV  EEG I +YT PTDLHKG
Sbjct:  121 IGAAGSVSYMFDNTGVIVFKGTDPDHIFEILLEAEVDVRDVTEEEGNIVIYTEPTDLHKG     180

Query:  200 IQALRDNGVEEFQVTELEMIPQSEVVLEGDDLETFEKLIDALESDDDVQKVYHNVAD      256
            I AL+  G+ EF   TELEMI QSEV L  +DLE FE L+DALE DDDVQKVYHNVA+
Sbjct:  181 IAALKAAGITEFSTTELEMIAQSEVELSPEDLEIFEGLVDALEDDDDVQKVYHNVAN      237
```

A related DNA sequence was identified in *S. pyogenes* <SEQ ID 5649> which encodes the amino acid sequence <SEQ ID 5650>. Analysis of this protein sequence reveals the following:

```
Possible site: 34
>>> Seems to have no N-terminal signal sequence
----- Final Results -----
    bacterial cytoplasm --- Certainty = 0.2926 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
Identities = 233/238 (97%), Positives = 236/238 (98%)
Query:   20 MGRKWANIVAKKTAKDGANSKVYAKFGVEIYVAAKQGEPDPESNSALKFVLDRAKQAQVP      79
            MGRKWANIVAKKTAKDGA SKVYAKFGVEIYVAAKQGEPDPE N+ALKFV+DRAKQAQVP
Sbjct:    1 MGRKWANIVAKKTAKDGATSKVYAKFGVEIYVAAKQGEPDPELNTALKFVIDRAKQAQVP      60
```

```
Query:   80  KHVIDKAIDKAKGNTDETFVEGRYEGFGPNGSMIIVDTLTSNVNRTAANVRTAYGKNGGN   139
             KHVIDKAIDKAKGNTDETFVEGRYEGFGPNGSMIIVDTLTSNVNRTAANVRTAYGKNGGN
Sbjct:   61  KHVIDKAIDKAKGNTDETFVEGRYEGFGPNGSMIIVDTLTSNVNRTAANVRTAYGKNGGN   120

Query:  140  MGASGSVSYLFDKKGVIVFAGDDADTVFEQLLEADVDVDDVEAEEGTITVYTAPIDLHKG   199
             MGASGSVSYLFDKKGVIVFAGDDAD+VFEQLLEADVDVDDVEAEEGTITVYTAPIDLHKG
Sbjct:  121  MGASGSVSYLFDKKGVIVFAGDDADSVFEQLLEADVDVDDVEAEEGTITVYTAPTDLHKG   180

Query:  200  IQALRDNGVEEFQVTELEMIPQSEVVLEGDDLETFEKLIDALESDDDVQKVYHNVADF    257
             IQALRDNGVEEFQVTELEMIPQSEVVLEGDDLETFEKLIDALESDDDVQKVYHNVADF
Sbjct:  181  IQALRDNGVEEFQVTELEMIPQSEVVLEGDDLETFEKLIDALESDDDVQKVYHNVADF    238
```

Based on this analysis, it was predicted that these proteins and their epitopes could be useful antigens for vaccines or diagnostics.

Example 1818

A DNA sequence (GBSx1925) was identified in *S. agalactiae* <SEQ ID 5651> which encodes the amino acid sequence <SEQ ID 5652>. Analysis of this protein sequence reveals the following:

Possible site: 17
>>> Seems to have no N-terminal signal sequence
----- Final Results -----
  bacterial cytoplasm --- Certainty = 0.2507 (Affirmative) <succ>
  bacterial membrane --- Certainty = 0.0000 (Not Clear) <succ>
  bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1819

A DNA sequence (GBSx1926) was identified in *S. agalactiae* <SEQ ID 5653> which encodes the amino acid sequence <SEQ ID 5654>. Analysis of this protein sequence reveals the following:

Possible site: 52
>>> Seems to have no N-terminal signal sequence
----- Final Results -----
  bacterial cytoplasm --- Certainty = 0.1523 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:CAA20826 GB:AL031541 hypothetical protein SCI35.37 [Streptomyces
coelicolor A3(2)]
Identities = 73/178 (41%), Positives = 101/178 (56%), Gaps = 2/178 (1%)
   Query:   35  VKNAGGLPVILPISEAESAKAYVEMIDKLIISGGQNVLPSYYGEEKIIESDDYSLARDIF   94
                V+ AGGL  +LP     E A V +D ++I+GG +V P  YG E    +  + ARD +
   Sbjct:   37  VQRAGGLAAMLPPDAPEHAAATVARVDGVVIAGGPDVEPVRYGAEPDPRTGPPARARDTW  96

Query:   95  EFALVEEALKQNKPIFAICRGMQLVNALGGTLNQSIDNHYQEPYIGFAHYLNVEKGSFL  154
                E AL+E AL    P+  ICRGMQL+NVALGGTL Q I+ H +   +    H +    G+
   Sbjct:   97  ELALIEAALAARVPLLGICRGMQLLNVALGGTLVQHIERHAEVVGVFGGHPVRPVPGTLY  156

Query:  155  EGFISGDFKINSLHRQSVKLLAEGLIVSARDPRDGTVEAYESRT-EQCIIGVQWHPEL   211
                 G +    + ++H Q+V  L  GL+ SA      DGTVEA E  +    ++GVQWHPE+
   Sbjct:  157  AGAVPEETFVPTYHHQAVDRLGSGLVASAH-AADGTVEALEMPSGSGWVLGVQWHPEM   213
```

A related DNA sequence was identified in *S. pyogenes* <SEQ ID 5655> which encodes the amino acid sequence <SEQ ID 5656>. Analysis of this protein sequence reveals the following:

Possible site: 52
>>> Seems to have no N-terminal signal sequence
----- Final Results -----
  bacterial cytoplasm --- Certainty = 0.1210 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

```
Identities = 111/230 (48%), Positives = 145/230 (62%), Gaps = 3/230 (1%)
   Query:    2  LTKPIIGITGNEREMSDIPGYYYDSVSRHISEGVKNAGGLPVILPISEAESAKAYVEMID   61
```

```
                  -continued
          +TKPIIGIT N+R      +        +      + V  +GGLP++LPI +   +AK YV M+D
Sbjct:   1  MTKPIIGITANQRLNMALDNLPWSYAPTGFVQAVTQSGGLPLLLPIGDEAAAKTYVSMVD    60

Query:  62  KLIISGGQNVLPSYYGEEKIIESDDYSLARDIFEFALVEEALKQNKPIFAICRGMQLVNV   121
            K+I+ GGQNV P YY EEK    DD+S  RD FE A+++EA+    KPI  ICRG QL+NV
Sbjct:  61  KIILIGGQNVDPKYYQEEKAAFDDDFSPERDTFELAIIKEAITLKKPILGICRGTQLMNV   120

Query: 122  ALGGILNQSIDNHYQE-PYIGFAHYLNVEKGSFLEGFISGDFKINSLHRQSVKLLAEGLI   180
            ALGG LNQ ID+H+QE P     +H +  +E   S L          INS HRQS+K  +A+ L
Sbjct: 121  ALGGNLNQHIDSHWQEAPSDFLSHEMIIEPDSILYPIYGHKILINSFHRQSLKTVAKDLK   180

Query: 181  VSARDPRDGTVEAYESRTEQC-IIGVQWHPELMLH-QIENQTLFGYFVNE             228
            V ARDPRDGT+EA  S  +      +GVQWHPEL+   + E+  LF  FVN+
Sbjct: 181  VIARDPRDGTIEAVISINDAIPFLGVQWHPELLQGVRDEDLQLFRLFVND             230
```

Based on this analysis, it was predicted that these proteins and their epitopes could be useful antigens for vaccines or diagnostics.

Example 1820

A DNA sequence (GBSx1927) was identified in *S. agalactiae* <SEQ ID 5657> which encodes the amino acid sequence <SEQ ID 5658>. Analysis of this protein sequence reveals the following:

Possible site: 31
>>> Seems to have no N-terminal signal sequence
----- Final Results -----
  bacterial cytoplasm --- Certainty = 0.5794 (Affirmative) <succ>
  bacterial membrane --- Certainty = 0.0000 (Not Clear) <succ>
  bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1821

A DNA sequence (GBSx1928) was identified in *S. agalactiae* <SEQ ID 5659> which encodes the amino acid sequence <SEQ ID 5660>. Analysis of this protein sequence reveals the following:

Possible site: 15
>>> Seems to have no N-terminal signal sequence
----- Final Results -----
  bacterial cytoplasm --- Certainty = 0.0524 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 8905> which encodes amino acid sequence <SEQ ID 8906> was also identified. Analysis of this protein sequence reveals the following:

Lipop: Possible site: 22   Crend: 4
McG: Discrim Score: 8.37
GvH: Signal Score (−7.5): −0.64
Possible site: 21
>>> May be a lipoprotein
ALOM program   count: 0 value: 6.74 threshold: 0.0
PERIPHERAL   Likelihood = 6.74   112
modified ALOM score: −1.85
*** Reasoning Step: 3
----- Final Results -----
  bacterial membrane --- Certainty = 0.0000 (Not Clear) <succ>
  bacterial outside --- Certainty = 0.0000 (Not Clear) <succ>
  bacterial cytoplasm --- Certainty = 0.0000 (Not Clear)

A related DNA sequence was identified in *S. pyogenes* <SEQ ID 2919> which encodes the amino acid sequence <SEQ ID 2920>. Analysis of this protein sequence reveals the following:

Possible site: 21
>>> May be a lipoprotein
----- Final Results -----
  bacterial membrane --- Certainty = 0.0000 (Not Clear) <succ>
  bacterial outside --- Certainty = 0.0000 (Not Clear) <succ>
  bacterial cytoplasm --- Certainty = 0.0000 (Not Clear) <succ>

An alignment of the GAS and GBS proteins is shown below.

```
Identities = 120/162 (74%), Positives = 141/162 (86%), Gaps = 5/162 (3%)
Query:   6  LAACSSKSHTTKTGK----KEVNFATVGTTAPFSYVKDGKLTGFDIEVAKAVFKGSDNYK    61
            LAAC S S  T ++G       KEV FATVGTTAPFSY K G+LTG+DIEVAKAVFKGSD+YK
Sbjct:  20  LAACGS-SKTAESGNQGSSKEVLFATVGTTAPFSYEKGGQLTGYDIEVAKAVFKGSDDYK    78

Query:  62  VTFKKTEWSSVFTGIDSGKFQMGGNNISYSSERSQKYLFSYPIGSTPSVLAVPKNSNIKA   121
            V+FKKTEWSS+FTG+DSGK+QMGGNNIS++ ERS KYLFSYPIGSTPSVL VPK+S+IK+
Sbjct:  79  VSFKKTEWSSIFTGLDSGKYQMGGNNISFTKERSAKYLFSYPIGSTPSVLVVPKDSDIKS   138

Query: 122  YNDISGHKTQVVQGTTTAKQLENFNKEHQKNPVTLKYTNENL                     163
```

```
                  ++DI  GH TQVVQGTT+    QLE+FNK+H   NPVTLK+TNEN+
Sbjct:  139   FDDIQGHTTQVVQGTTSVAQLEDFNKKHSDNPVTLKFTNENI              180
```

SEQ ID 8906 (GBS71) was expressed in *E. coli* as a His-fusion product. SDS-PAGE analysis of total cell extract is shown in FIG. 17 (lane 4; MW 31.8 kDa).

GBS71-His was purified as shown in FIG. 196, lane 7.

Based on this analysis, it was predicted that these proteins and their epitopes could be useful antigens for vaccines or diagnostics.

Example 1822

A DNA sequence (GBSx1929) was identified in *S. agalactiae* <SEQ ID 5661> which encodes the amino acid sequence <SEQ ID 5662>. Analysis of this protein sequence reveals the following:

---

Possible site: 18
>>> Seems to have no N-terminal signal sequence
----- Final Results -----
    bacterial cytoplasm --- Certainty = 0.2179 (Affirmative) <succ>
    bacterial membrane --- Certainty = 0.0000 (Not Clear) <succ>
    bacterial outside --- Certainty = 0.0000 (Not Clear) <succ>

---

The protein has no significant homology with any sequences in the GENPEPT database.

There is also homology to SEQ ID 2920:

```
Identities = 64/91 (70%), Positives = 78/91 (85%)
Query:   1    MSDGKADFKLFDGPTVNAIIKNQGLTNLKTIPLTMRDQPYIYFIFGQDQKDLQKYVNNRL   60
              +S+GKADFK+FD PTVNAIIKNQGL NLKTI LT  +QP+IYFIF QDQ+ LQ +VN R+
Sbjct: 187    LSEGKADFKIFDAPTVNAIIKNQGLDNLKTIELTSTEQPFIYFIFSQDQEKLQSFVNKRI   246

Query:  61    KQLRKDGTLSKIAKEYLGGDYVPNEKDLVTP                              91
              K+L  DGTLSK+AKE+LGGDYVP++K+L  P
Sbjct: 247    KELTADGTLSKLAKEHLGGDYVPSDKELKLP                              277
```

Based on this analysis, it was predicted that this protein and its epitopes, could be useful antigens for vaccines or diagnostics.

Example 1823

A DNA sequence (GBSx1930) was identified in *S. agalactiae* <SEQ ID 5663> which encodes the amino acid sequence <SEQ ID 5664>. This protein is predicted to be 28 kDa outer membrane protein (yaeC). Analysis of this protein sequence reveals the following:

---

Possible site: 41
>>> Seems to have no N-terminal signal sequence
INTEGRAL   Likelihood = –1.44   Transmembrane 25-41 (25-42)
----- Final Results -----
    bacterial membrane --- Certainty = 0.1574 (Affirmative) <succ>
    bacterial outside --- Certainty = 0.0000 (Not Clear) <succ>
    bacterial cytoplasm --- Certainty = 0.0000 (Not Clear) <succ>

---

The protein has homology with the following sequences in the GENPEPT database.

```
>GP:CAB59825 GB:AJ012388 hypothetical protein [Lactococcus lactis]
Identities = 110/283 (38%), Positives = 175/283 (60%), Gaps = 13/283 (4%)
Query:  22    KLKHIVLGLALTTLLGV----TFSNQEVSASSTSSKVVKVGVMTFSDTEKARWDKIEKLV    77
              K ++I++ +A+  L+ +    + ++Q    +S    K VKVG+M+    ++  W   +
Sbjct:   4    KNRNIIIAVAVLILVALVAFFSLNHQGGVKASAGEKTVKVGIMSGDKQDQEVWKSVANTA    63

Query:  78    GDK--AKIKFTEFTDYTQPNQATANKDVDINAFQHYNFLENWNKENKKNLIPLEKTYLAP   135
               +K    K+KF  F+DY QPN+A   + D+DINAFQ  YN+++ WNK +K +++ +   TY+ P
Sbjct:  64    KEKYDLKLKFVYFSDYNQPNEALLSGDIDINAFQSYNYVKTWNKAHKSDIVAVGNTYITP   123

Query: 136    IRIYSEKVKSLKKLKKGATIAIPNDATNGSRALYVLQSAGLIKLNVS-GKKVATVANITS   194
              + IYS+++  L   LK+G+T+AIPNDA+N SRAL+VLQSAGL+KL   S    K+  + +IT
Sbjct: 124    MHIYSKEISKLSDLKEGSTVAIPNDASNESRALFVLQSAGLLKLTTSDSSKLVGLPDITE   183

Query: 195    NKKDINIQELDASQTPRALKDVDAAIINNTYIEQANLKPSDAIFVEKSDKNSKQWINIIA   254
              N   + +E+DASQTPRAL  V   +++N Y   A+L  S+++F+E   +K S Q+IN IA
Sbjct: 184    NPHQLKFKEVDASQTPRALDSVALSVVNYNYATAASLPKSESVFMEPLNKTSAQYINFIA   243
```

```
Query: 255 GRKNWKKQKNAKAIQAILDAYHTDEVKKVIKDTSAD---IPQW          294
            K+KN K  + +  AY +   +K IK+   D   +P W
Sbjct: 244 ---TTSKEKNNKVYKEVAKAYASKATEKAIKEQYPDGGELPAW           283
```

There is also homology to SEQ ID 2132.

Based on this analysis, it was predicted that this protein and its epitopes, could be useful antigens for vaccines or diagnostics.

A related GBS gene <SEQ ID 8907> and protein <SEQ ID 8908> were also identified. Analysis of this protein sequence reveals the following:

```
Lipop: Possible site: -1 Crend: 4
McG: Discrim Score: 7.47
GvH: Signal Score (-7.5): -4.79
Possible site: 21
>>> Seems to have an uncleavable N-term signal seq
ALOM program   count: 1 value: -1.44 threshold: 0.0
INTEGRAL       Likelihood = -1.44   Transmembrane 5-21 (5-22)
PERIPHERAL     Likelihood = 5.20    147
modified ALOM score: 0.79
*** Reasoning Step: 3
----- Final Results -----
    bacterial membrane --- Certainty = 0.1574 (Affirmative) <succ>
       bacterial outside --- Certainty = 0.0000 (Not Clear) <succ>
         bacterial cytoplasm --- Certainty = 0.0000 (Not Clear) <succ>
```

The protein has homology with the following sequences in the databases:

SEQ ID 8908 (GBS35) was expressed in *E. coli* as a His-fusion product. SDS-PAGE analysis of total cell extract is shown in FIG. 11 (lane 2; MW 31.6 kDa).

The GBS35-His fusion product was purified (FIG. 96A; see also FIG. 192, lane 6) and used to immunise mice (lane 2 product; 20 µg/mouse). The resulting antiserum was used for Western blot (FIG. 96B), FACS (FIG. 96C), and in the in vivo passive protection assay (Table III). These tests confirm that the protein is immunoaccessible on GBS bacteria and that it is an effective protective immunogen.

Example 1824

A DNA sequence (GBSx1931) was identified in *S. agalactiae* <SEQ ID 5665> which encodes the amino acid sequence <SEQ ID 5666>. Analysis of this protein sequence reveals the following:

```
Possible site: 37
>>> Seems to have no N-terminal signal sequence
----- Final Results -----
    bacterial cytoplasm --- Certainty = 0.3126 (Affirmative) <succ>
```

```
40.6/63.1% over 279aa
Lactococcus lactis
GP|6165402| hypothetical protein Insert characterized
ORF00442(364-1182 of 1482)
GP|6165402|emb|CAB59825.1||AJ012388(4-283 of 287) hypothetical protein
{Lactococcus lactis}
% Match = 21.0
% Identity = 40.6 % Similarity = 63.0
Matches = 112 Mismatches = 96 Conservative Sub.s = 62

162        192        222        252        282        312        342        372
WDTFKNS*RIPWR*LRTK*ERSRYS*GEVVIKTKEMSILSFLLYSLKL*QETVYNNLILITSYGIISLSQKLREFIMKLK
                                                                           | :
                                                                           MNPKNR 402              450       480       510       540       564       594
HIVLGLALTTLLG--VTFS--NQEVSASSTSSKVVKVGVMTFSDTEKARWDKIEKLVGDK--AKIKFTEFTDYTQPNQAT
:|::  :|:  |:    ||  :|    :|   | ||||:|:   :: |  :    :|   |:||   |:|| |||:|
NIIIAVAVLILVALVAFFSLNHQGGVKASAGEKTVKVGIMSGDKQDQEVWKSVANTAKEKYDLKLKFVYFSDYNQPNEAL
         20        30        40        50        60        70        80

624       654       684       714       744       774       804       834
ANKDVDINAFQHYNFLENWNKENKKNLIPLEKTYLAPIRIYSEKVKSLKKLKKGATIAIPNDATNGSRALYVLQSAGLIK
 : |:||||| ||:::  ||| :|  ::: :   ||: |: |||::: |    ||:|:|:||||||:| |||| |||||:|
LSGDIDINAFQSYNYVKTWNKAHKSDIVAVGNTYITPMHIYSKEISKLSDLKEGSTVAIPNDASNESRALFVLQSAGLLK
         100       110       120       130       140       150       160

861       891       921       951       981       1011      1041      1071
LNVS-GKKVATVANITSNKKDINIQELDASQTPRALKDVDAAIINNTYIEQANLKPSDAIFVEKSDKNSKQWINIIAGRK
|  |   | : :|  :|:||||||||  |   :|  |:::|  |:|  |:  |||:|  |    :| | | ||:|| ||
LTTSDSSKLVGLPDITENPHQLKFKEVDASQTPRALDSVALSVVNYNYATAASLPKSESVFMEPLNKTSAQYINFIA---
         180       190       200       210       220       230       240

1101      1131      1161      1182      1212      1242      1272      1302
NWKKQKNAKAIQAILDAYHTDEVKKVIKDTSAD---IPQW*RELTV*V*QGILIGYNLSAI*P*RAWDEYNVPGSWIVFE
 |||    :  ::  ||  :   :| ||:     |   :| |    :|
TTSKEKNNKVYKEVAKAYASKATEKAIKEQYPDGGELPAWDLKL
         260       270       280
```

-continued

```
            bacterial membrane --- Certainty = 0.0000 (Not Clear) <succ>
            bacterial outside  --- Certainty = 0.0000 (Not Clear) <succ>
```

The protein has homology with the following sequences in the GENPEPT database.

```
>GP:AAF11560 GB:AE002038 ArgE/DapE/Acyl family protein [Deinococcus radiodurans]
Identities = 129/419 (30%), Positives = 210/419 (49%), Gaps = 14/419 (3%)
Query:  26  LRDLIAIKSIFAQKVGLNDLSSYLGEVFIKAGAEVIIDDSYSAPFIVANFKSSKVDAKRI    85
            LR L+A+ S+ AQ   L + +  +     G V       AP ++A               +
Sbjct:  16  LRALVALPSVSAQGRMLPETADAVAGLLRAEGFGVQQFPGTVAPVLLAEAGEGPFT---L   72

Query:  86  IFYNHYDTVPADEVEQWTEDPFTLSLRYGKMYGRGVDDDKGHITARLSAVKKYLSRHKGE   145
            + YNHYD  P D +E W   PF L+ R G++YGRG  DDKG + +RL+AV+  +     G
Sbjct:  73  LIYNHYDVQPEDPLELWDTPPFELTERGGRLYGRGASDDKGELASRLAAVRA-VREQLGH   131

Query: 146  LPLDITFIVEGAEESASVGLDYYLEKYQEQLQGADLIVWEDGPKNPKGQLEIAGGNKGIV   205
            LP+ I  +++EG EE S   L+ ++ ++  +LQ AD    WE G  +P+G+  ++ G KG++
Sbjct: 132  LPVKIKWLIEGEEEVGSPTLERFVAEHAAELQ-ADGCWWEFGGISPEGRPILSLGLKGVM   190

Query: 206  TFDLSVSSADVDIHSSFGGVVDSSTWYLIQALNTLRDNKGHILVEGIYDKVIPPTKRELE   265
             +L     AD D+HSS G V+D+   + L +A+ +LRD +G++  + G YD V    +  + +
Sbjct: 191  CLELRCRVADSDLHSSLGAVIDNPLYCLARAVASLRDEQGNVTIPGFYDDVRAASGADRQ   250

Query: 266  LVEKYSRSAKALEGAYQLVLPSLADSHKTFLRKLYFEPSIAIEGITSGYQGEGVKTILP    325
             + +    +A+   + + P    +  +       P + + G    GYQGEG KT+LP
Sbjct: 251  AIAQIP-GDGQAVRDTFGVRRP--LATGPAYNERTNLHPVVNVNGWGGGYQGEGSKTVLP   307

Query: 326  AYAKCKAEVRLVPGLTPKGVLDSIQNHLKENGFKDIELT-YTLGEMSYRSDMSAPSILKV   384
                     K  + RLVP      P  VL ++ HL   G   DIE+       +  R+D    P +
Sbjct: 308  GAGFVKLDFRLVPDQDPARVLSLLREHLTAQGLSDIEVVELEAHQKPARADAGHPFVQAC   367

Query: 385  VDLAEQFYPEGISLLPTSPGTGPMY-----LVHQALRAPIAAIGIGHANSRDHGVDENV    438
            V  A    + +   + P+S  +GPM+           L  P  A+GIG+   R  H   +EN+
Sbjct: 368  VAAARAAHGQDPIVHPSSGASGPMFPFTGGAGGGLGIPCVAVGIGNHAGRVHAPNENI    426
```

There is also homology to SEQ ID 2588.

Based on this analysis, it was predicted that this protein and its epitopes, could be useful antigens for vaccines or diagnostics.

Example 1825

A DNA sequence (GBSx1932) was identified in *S. agalactiae* <SEQ ID 5667> which encodes the amino acid sequence <SEQ ID 5668>. This protein is predicted to be amino acid ABC transporter, ATP-binding protein. Analysis of this protein sequence reveals the following:

Possible site: 47

>>> Seems to have no N-terminal signal sequence

-continued

```
----- Final Results -----
        bacterial cytoplasm --- Certainty = 0.5366 (Affirmative) <succ>
        bacterial membrane  --- Certainty = 0.0000 (Not Clear)   <succ>
        bacterial outside   --- Certainty = 0.0000 (Not Clear)   <succ>
```

The protein has homology with the following sequences in the GENPEPT database.

```
>GP:CAB59828 GB:AJ012388 hypothetical protein [Lactococcus lactis]
Identities = 187/338 (55%), Positives = 256/338 (75%), Gaps = 12/338 (3%)
Query:   6  IIKLDNIDVTFHQKKREINAVKDVTIHINQGDIYGIVGYSGAGKSTLVRVINLLQEPSAG    65
            II+L+N+  V FHQK R + AVK+ T+HI +GDIYG++GYSGAGKSTLVR INLLQ+P+ G
Sbjct:   4  IIELNNLSVQFHQKGRLVTAVKNATLHIEKGDIYGVIGYSGAGKSTLVRTINLLQKPTEG    63

Query:  66  KITIDDQVIYD--NKVTLTSTQLREQRREIGMIFQHFNLMSQLTAEQNVAFALKHSG---   120
            +I I+ + I+D   N V   T   +LRE R++IGMIFQHFNL+S+ T   NVAFAL+HS
Sbjct:  64  QIVINGEKIFDSENPVKFTGAKLREFRQKIGMIFQHFNLLSEKTVFNNVAFALQHSQIED   123

Query: 121  -------LSKEAKAAKVAKLLELVGLSDRAQNYPSQLSGGQKQRVAIARALANDPKILIS   173
                       L+K+ K  KV +LL+LV L+D + YP+QLSGGQKQRVAIARALANDP+ILIS
Sbjct: 124  KNGKKRYLTKKEKNDKVTELLKLVDLADLSDKYPAQLSGGQKQRVAIARALANDPEILIS   183

Query: 174  DESTSALDPKTTKQILALLQDLNKKLGLTIVLITHEMQIVKDIANRVAVMQNGKLIEEGS   233
            DE TSALDPKTT QIL LL+ L++KLG+T+VLITHEMQ+VK+IAN+VAVMQNG++IE+ S
Sbjct: 184  DEGTSALDPKTTNQILDLLKSLHEKLGITVVLITHEMQVVKEIANKVAVMQNGEIIEQNS   243

Query: 234  VLDIFSHPRESLTQDFIKIATGIDEAMLKIEQQEVVKNLPVGSKLVQLKYAGHSTDEPLL   293
            ++DIF+ P+E+LT+  FI+   + + +   + E++  L     +L+ L Y+G    ++P++
Sbjct: 244  LIDIFAQPKEALTKQFIETTSSVNRFIASLSKTELLAQLADDEELIHLDYSGSELEDPVV   303
```

```
-continued
Query: 294   NQIYKEFEVTANILYGNIEILDGIPVGEMVVILSGDEE        331
             + I K+F+VT NI YGN+E+L G P G +V+ L G  E
Sbjct: 304   SDITKKFDVTTNIFYGNVELLQGQPFGSLVLTLKGSSE        341
```

There is also homology to SEQ ID 76.

Based on this analysis, it was predicted that this protein and its epitopes, could be useful antigens for vaccines or diagnostics.

Example 1826

A DNA sequence (GBSx1933) was identified in *S. agalactiae* <SEQ ID 5669> which encodes the amino acid sequence <SEQ ID 5670>. This protein is predicted to be ABC transporter, permease protein. Analysis of this protein sequence reveals the following:

Possible site: 55
>>> Seems to have no N-terminal signal sequence
INTEGRAL    Likelihood = −12.79    Transmembrane 203-219 (197-225)
INTEGRAL    Likelihood = −8.86     Transmembrane 73-89 (69-102)
INTEGRAL    Likelihood = −7.38     Transmembrane 38-54 (35-56)
INTEGRAL    Likelihood = −1.12     Transmembrane 103-119 (103-119)
----- Final Results -----
   bacterial membrane --- Certainty = 0.6116 (Affirmative) <succ>
   bacterial outside --- Certainty = 0.0000 (Not Clear) <succ>
      bacterial cytoplasm --- Certainty = 0.0000 (Not Clear) <succ>

A related GBS nucleic acid sequence <SEQ ID 10083> which encodes amino acid sequence <SEQ ID 10084> was also identified.

The protein has homology with the following sequences in the GENPEPT database.

```
>GP:CAB59829 GB:AJ012388 hypothetical protein [Lactococcus lactis]
Identities = 137/231 (59%), Positives = 171/231 (73%), Gaps = 1/231 (0%)
Query: 1     MIEWIQTHLPNVYQMGWEGAYGWQTAIVQTLYMTFWSFLIGGLMGLLGGLFLVLTSPRGV    60
             M EW     PNV +GW G  GW TAIVQTLYMTF S LIGGL+GL+  G+ +V+T+   G+
Sbjct: 1     MAEWFAHTFPNVVYLGWTGETGWWTAIVQTLYMTFISALIGGLLGLIFGIGVVVTAEDGI    60

Query: 61    IANKLVFGVLDKVVSVFRALPFIILLALIAPVTRVIVGTTLGSPAALVPLSLAVFPFFAR   120
             N+ +F +LDK+VS+ RA PFIILLA IAP+T+++ VGT +G  AALVPL+L V PF+AR
Sbjct: 61    TPNRPLFWILDKIVSIGRAFPFIILLAAIAPLTKILVGTQIGVTAALVPLALGVAPFYAR   120

Query: 121   QVQVVLAELDGGVIEAAQASGGTLWDII-VVYLREGLPDLIRVSTVTLISLVGETAMAGA   179
             QVQ  L  +D G +EAAQ  G       DI+  VYLRE L  LIRVSTVTLISL+G TAMAGA
Sbjct: 121   QVQASLESVDHGKVEAAQTVGADFLDIVFTVYLREELASLIRVSTVTLISLIGLTAMAGA   180

Query: 180   IGAGGLGSVAITKGYNYSRDDITLVATILILLLIFFIQFLGDFLTRRLSHK            230
             IGAGGLG+ AI+ GYN    +D+T  ATILIL+ +   +Q +GDFL RR+SH+
Sbjct: 181   IGAGGLGNTAISYGYNRFANDVTWFATILILIFVLLVQLVGDFLARRVSHR            231
```

The protein has homology with the following sequences in the databases:

A related DNA sequence was identified in *S. pyogenes* <SEQ ID 5671> which encodes the amino acid sequence <SEQ ID 5672>. Analysis of this protein sequence reveals the following:

Possible site: 32
>>> Seems to have an uncleavable N-term signal seq
INTEGRAL    Likelihood = −11.15    Transmembrane 194-210 (187-215)
INTEGRAL    Likelihood = −10.67    Transmembrane 28-44 (20-52)
INTEGRAL    Likelihood = −8.12     Transmembrane 70-86 (62-91)
----- Final Results -----
   bacterial membrane --- Certainty = 0.5458 (Affirmative) <succ>
   bacterial outside --- Certainty = 0.0000 (Not Clear) <succ>
      bacterial cytoplasm --- Certainty = 0.0000 (Not Clear) <succ>

```
>GP:CAB59829 GB:AJ012388 hypothetical protein [Lactococcus lactis]
Identities = 123/213 (57%), Positives = 153/213 (71%), Gaps = 1/213 (0%)
Query: 9     GDAGWGLAIWNTLYMTIVPFIVGGAIGLLLGLLLVLTGPDGVIENKTICWVIDKVTSIFR    68
             G+ GW  AI   TLYMT +  ++GG +GL+ G+ +V+T  DG+  N+ + W++DK+ SI R
Sbjct: 19    GETGWWTAIVQTLYMTFISALIGGLLGLIFGIGVVVTAEDGITPNRPLFWILDKIVSIGR    78

Query: 69    AIPFVILIAILASFTYLLLRTTLGATAALVPLTFATFPPFYARQVQVVFSELDKGVIEAAQ   128
             A PF+IL+A +A   T +L+ T +G TAALVPL      PFYARQVQ     +D G +EAAQ
Sbjct: 79    AFPFIILLAAIAPLTKILVGTQIGVTAALVPLALGVAPFYARQVQASLESVDHGKVEAAQ   138

Query: 129   ASGATFWDIV-KVYLSEGLPDLIRVSTVTLISLVGETAMAGAIGAGGLGNVAISYGYNRF   187
                GA F DIV  VYL E L  LIRVSTVTLISL+G TAMAGAIGAGGLGN AISYGYNRF
```

```
                                   -continued
Sbjct: 139  TVGADFLDIVFTVYLREELASLIRVSTVTLISLIGLTAMAGAIGAGGLGNTAISYGYNRF  198

Query: 188  NNDVTWVATIIILLIIFAIQFIGDSLTRRFSHK                             220
            NDVTW ATI+IL+ +  +Q +GD L RR SH+
Sbjct: 199  ANDVTWFATILILIFVLLVQLVGDFLARRVSHR                             231
```

An alignment of the GAS and GBS proteins is shown below.

```
Identities = 146/212 (68%), Positives = 172/212 (80%)
Query: 19   GAYGWQTAIVQTLYMTFWSFLIGGLMGLLGGLFLVLTSPRGVIANKLVFGVLDKVVSVFR   78
            G  GW  AI  TLYMT  F++GG +GLL GL LVLT P GVI NK +  V+DKV S+FR
Sbjct: 9    GDAGWGLAIWNTLYMTIVPFIVGGAIGLLLGLLLVLTGPDGVIENKTICWVIDKVTSIFR   68

Query: 79   ALPFIILLALIAPVTRVIVGTTLGSPAALVPLSLAVFPFFARQVQVVLAELDGGVIEAAQ   138
            A+PF+IL+A++A   T +++ TTLG+ AALVPL+ A FPF+ARQVQVV +ELD GVIEAAQ
Sbjct: 69   AIPFVILIAILASFTYLLLRTTLGATAALVPLTFATFPFYARQVQVVFSELDKGVIEAAQ   128

Query: 139  ASGGTLWDIIVVYLREGLPDLIRVSTVTLISLVGETAMAGAIGAGGLGSVAITKGYNYSR   198
            ASG T WDI+ VYL EGLPDLIRVSTVTLISLVGETAMAGAIGAGGLG+VAI+ GYN
Sbjct: 129  ASGATFWDIVKVYLSEGLPDLIRVSTVTLISLVGETAMAGAIGAGGLGNVAISYGYNRFN  188

Query: 199  DDITLVATILILLLIFFIQFLGDFLTRRLSHK                              230
            +D+T VATI+ILL+IF IQF+GD LTRR SHK
Sbjct: 189  NDVTWVATIIILLIIFAIQFIGDSLTRRFSHK                              220
```

Based on this analysis, it was predicted that these proteins and their epitopes could be useful antigens for vaccines or diagnostics.

Example 1827

A DNA sequence (GBSx1934) was identified in *S. agalactiae* <SEQ ID 5673> which encodes the amino acid sequence <SEQ ID 5674>. This protein is predicted to be alcohol dehydrogenase, zinc-containing (Zn-dependent). Analysis of this protein sequence reveals the following:

A related GBS nucleic acid sequence <SEQ ID 9419> which encodes amino acid sequence <SEQ ID 9420> was also identified.

The protein has homology with the following sequences in the GENPEPT database.

```
>GP:AAF41759 GB:AE002488 alcohol dehydrogenase, zinc-containing
[Neisseria meningitidis MC58]
Identities = 135/246 (54%), Positives = 186/246 (74%), Gaps = 1/246 (0%)
Query: 3    SHCEDGGWILGHLIEGTQAEYVHIPHADGSLYHAPEGVCDDALVMLSDILPTSYEIGVLP   62
            SHC +GGWILG++I+GTQAEYV  P+AD SL   P+ V ++  ++LSD LPT++EIGV
Sbjct: 102  SHCRNGGWILGYMIDGTQAEYVRTPYADNSLVPLPDNVEEIALLLSDALPTAHEIGVQY   161

Query: 63   SHIKPGDTVCIVGAGPIGLSALLTAQFYSPAKIIMVDLSQKRLEASKKFGATHTILSTST  122
             +KPGDTV I GAGP+G+SALLTAQ YSPA II+ D+ + RL+ +K+ GATHTI + ++
Sbjct: 162  GDVKPGDTVFIAGAGPVGMSALLTAQLYSPAAIIVCDMDENRLKLAKELGATHTI-NPAS  220

Query: 123  QEVKEEIDKITKGRGVDVVLECVGYPATFDICQNVVSIGGHIANVGVHGKPVEFNLQDLW  182
              EV +++  I    GVD  +E VG PAT+++CQ++V  GGHIA VGVHG+ V+F L+ LW
Sbjct: 221  GEVSKQVFAIVGEDGVDCAIEAVGIPATWNMCQDIVKPGGHIAVVGVHGQSVDFKLEKLW  280

Query: 183  IKNITLNTGLVNANTTEMLLEVLETGKIDATQLVTHHFKLSEIEEAYKVFKAAEENNTLK  242
            IK + +  TGLVNANTTEML++ +  +   +D T+++THHFK SE+E+AY VFK A EN   +K
Sbjct: 281  IKKLAITTGLVNANTTEMLMKAISSSSVDYTKMLTHHFKFSELEKAYDVFKHAAENQVMK  340

Query: 243  VIIEND                                                         248
            V++E D
Sbjct: 341  VVLEAD                                                         346
```

A related DNA sequence was identified in *S. pyogenes* <SEQ ID 785> which encodes the amino acid sequence <SEQ ID 786>. Analysis of this protein sequence reveals the following:

Possible site: 21
>>> Seems to have no N-terminal signal sequence
INTEGRAL    Likelihood = −2.92    Transmembrane 71-87 (69-87)
----- Final Results -----
   bacterial membrane --- Certainty = 0.2168 (Affirmative) <succ>
    bacterial outside --- Certainty = 0.0000 (Not Clear) <succ>
      bacterial cytoplasm --- Certainty = 0.0000 (Not Clear) <succ>

Possible site: 23
>>> Seems to have no N-terminal signal sequence
INTEGRAL    Likelihood = −5.41    Transmembrane 184-200 (183-203)
----- Final Results -----
   bacterial membrane --- Certainty = 0.3166 (Affirmative) <succ>

An alignment of the GAS and GBS proteins is shown below.

```
Identities = 199/250 (79%), Positives = 226/250 (89%)
Query: 1     MPSHCEDGGWILGHLIEGTQAEYVHIPHADGSLYHAPEGVCDDALVMLSDILPTSYEIGV   60
             + SHC+DGGWILGHLI GTQAEYVHIPHADGSLYHAP+ + D+ALVMLSDILPTSYEIGV
Sbjct: 114   LSSHCQDGGWILGHLINGTQAEYVHIPHADGSLYHAPDTIDDEALVMLSDILPTSYEIGV   173

Query: 61    LPSHIKPGDTVCIVGAGPIGLSALLTAQFYSPAKIIMVDLSQKRLEASKKFGATHTILST   120
             LPSH+KPGD VCIVGAGP+GL+ALLT QF+SPA IIMVDLSQ RLEA+K FGATHTI S
Sbjct: 174   LPSHVKPGDNVCIVGAGPVGLAALLTVQFFSPANIIMVDLSQNRLEAAKTFGATHTICSG   233

Query: 121   STQEVKEEIDKITKGRGVDVVLECVGYPATFDICQNVVSIGGHIANVGVHGKPVEFNLQD   180
             S++EVK   ID IT GRGVD+ +ECVGYPATFDICQ ++S+GGHIANVGVHGKPV+FNL +
Sbjct: 234   SSEEVKAIIDDITNGRGVDISMECVGYPATFDICQKIISVGGHIANVGVHGKPVDFNLDE   293

Query: 181   LWIKNITLNTGLVNANTTEMLLEVLETGKIDATQLVTHHFKLSEIEEAYKVFKAAEENNT   240
             LWIKNITLNTGLVNANTTEMLL VL+TGKIDAT+L+THHFKLSE+E+AY+ FK A  NN
Sbjct: 294   LWIKNITLNTGLVNANTTEMLLNVLKTGKIDATRLITHHFKLSEVEKAYETFKHAGANNA   353

Query: 241   LKVIIENDIT                                                    250
             LKVII+NDI+
Sbjct: 354   LKVIIDNDIS                                                    363
```

Based on this analysis, it was predicted that these proteins and their epitopes could be useful antigens for vaccines or diagnostics.

Example 1828

A DNA sequence (GBSx1935) was identified in *S. agalactiae* <SEQ ID 5675> which encodes the amino acid sequence <SEQ ID 5676>. This protein is predicted to be a dehydrogenase fragment. Analysis of this protein sequence reveals the following:

---

Possible site: 20
>>> Seems to have no N-terminal signal sequence
INTEGRAL    Likelihood = −10.46    Transmembrane 47-63 (33-66)
----- Final Results -----
  bacterial membrane --- Certainty = 0.5182 (Affirmative) <succ>
    bacterial outside --- Certainty = 0.0000 (Not Clear) <succ>
    bacterial cytoplasm --- Certainty = 0.0000 (Not Clear) <succ>

---

The protein has no significant homology with any sequences in the GENPEPT database.

There is also homology to SEQ ID 786:

```
Identities = 23/38 (60%), Positives = 28/38 (73%)
Query: 7     WRNSNMRAATYLSANELSLTDKAKPQVIKPTDAVVXLV   44
             ++  NM+AATYLS   L L DK KP +IKPTDA+V LV
Sbjct: 10    YKKLNMKAATYLSTGNLQLIDKPKPVIIKPTDAIVQLV   47
```

Based on this analysis, it was predicted that this protein and its epitopes, could be useful antigens for vaccines or diagnostics.

Example 1829

A DNA sequence (GBSx1936) was identified in *S. agalactiae* <SEQ ID 5677> which encodes the amino acid sequence <SEQ ID 5678>. Analysis of this protein sequence reveals the following:

---

Possible site: 39
>>> Seems to have no N-terminal signal sequence
----- Final Results -----
  bacterial cytoplasm --- Certainty = 0.1001 (Affirmative) <succ>
    bacterial membrane --- Certainty = 0.0000 (Not Clear) <succ>
    bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1830

A DNA sequence (GBSx1937) was identified in *S. agalactiae* <SEQ ID 5679> which encodes the amino acid sequence <SEQ ID 5680>. This protein is predicted to be branched chain amino acid transport system II carrier protein (brnQ). Analysis of this protein sequence reveals the following:

---

Possible site: 44
>>> Seems to have an uncleavable N-term signal seq
INTEGRAL    Likelihood = −9.66    Transmembrane 158-174 (154-177)
INTEGRAL    Likelihood = −6.64    Transmembrane 233-249 (231-252)
INTEGRAL    Likelihood = −5.20    Transmembrane 37-53 (30-57)
INTEGRAL    Likelihood = −3.98    Transmembrane 90-106 (87-108)
INTEGRAL    Likelihood = −0.80    Transmembrane 130-146 (130-146)
----- Final Results -----
  bacterial membrane --- Certainty = 0.4864 (Affirmative) <succ>

| | |
|---|---|
| bacterial outside --- Certainty = 0.0000 (Not Clear) <succ> | |
| bacterial cytoplasm --- Certainty = 0.0000 (Not Clear) <succ> | |

A related GBS nucleic acid sequence <SEQ ID 9417> which encodes amino acid sequence <SEQ ID 9418> was also identified.

The protein has homology with the following sequences in the GENPEPT database.

```
>GP:AAC00400 GB:AF008220 branch-chain amino acid transporter
[Bacillus subtilis]
Identities = 89/250 (35%), Positives = 139/250 (55%), Gaps = 18/250 (7%)
Query: 1    MDALASIAFAIIVIQASKQYGAITKKEITSMALKSGAIATFLLAFIYIFVGRIGATSQSL    60
            MDALASI F ++V+ A K  G     K + +  +K+G IA    L FIY+ +  +GATS +
Sbjct: 199  MDALASIVFGVVVVNAVKSKGVTQSKALAAACIKAGVIAALGLTFIYVSLAYLGATSTNA  258

Query: 61   FKFANGSFLLHNTPI-DGGHVLSQSANFYLGIVGQAILGTAIFLACLTTATGLITACAEY  119
                         P+ +G   +LS S+++   G  +G   +LG AI +ACLTT+ GL+T+C  +Y
Sbjct: 259  IG----------PVGEGAKILSASSHYLFGSLGNIVLGAAITVACLTTSIGLVTSCGQY  307

Query: 120  FHKLLPKISHITWATIFTLIAITFYFGGLSEIIRWSLPVLYLLYPLTIVLIFLVFFDQKF  179
             F KL+P +S+      TI  TL ++          GL++II  +S+P+L    +YPL IV+I L  F  D+ F
Sbjct: 308  FSKLIPALSYKIVVTIVTLFSLIIANFGLAQIIAFSVPILSAIYPLAIVIIVLSFIDKIF  367

Query: 180  ESSRIVYQTSIAATAVAALYDALSKLGEMTGLFTIPSALTTFFFTKVVPLGEYSMGWISFA  239
             +  R VY   + T + ++ D +    G       G       +L  F    +PL     +GW+
Sbjct: 368  KERREVYIACLIGTGLFSILDGIKAAGFSLG------SLDVFLNANLPLYSLGIGWVLPG  421

Query: 240  ICGVLVGLIL                                                  249
            I G  ++G +L
Sbjct: 422  IVGAVIGYVL                                                  431
```

A related DNA sequence was identified in *S. pyogenes* <SEQ ID 2233> which encodes the amino acid sequence <SEQ ID 2234>. Analysis of this protein sequence reveals the following:

| | |
|---|---|
| INTEGRAL | Likelihood = −1.81 Transmembrane 390-406 (390-407) |
| INTEGRAL | Likelihood = −1.01 Transmembrane 81-97 (81-97) |
| ----- Final Results ----- | |
| bacterial membrane --- Certainty = 0.5331 (Affirmative) <succ> | |
| bacterial outside --- Certainty = 0.0000 (Not Clear) <succ> | |
| bacterial cytoplasm --- Certainty = 0.0000 (Not Clear) <succ> | |

An alignment of the GAS and GBS proteins is shown below.

```
Identities = 161/253 (63%), Positives = 197/253 (77%)
Query: 1    MDALASIAFAIIVIQASKQYGAITKKEITSMALKSGAIATFLLAFIYIFVGRIGATSQSL  60
            MDALAS+ FAI+V++A+KQ+GA T KE+T + L SGAIA  LLA +YIFVGRIGATSQSL
Sbjct: 202  MDALASLVFAILVIEATKQFGAKTDKEMTKITLISGAIAILLLALVYIFVGRIGATSQSL  261

Query: 61   FKFANGSFLLHNTPIDGGHVLSQSANFYLGIVGQAILGTAIFLACLTTATGLITACAEYF  120
            F F +GSF LH  P++GG +LS ++ FYLG +GQA L    IFLACLTT+TGLIT+ AEYF
Sbjct: 262  FPFIDGSFTLHGNPVNGGQILSHASRFYLGGIGQAFLAVVIFLACLTTSTGLITSSAEYF  321

Query: 121  HKLLPKISHITWATIFTLIAITFYFGGLSEIIRWSLPVLYLLYPLTIVLIFLVFFDQKFE  180
            HKL+P +SHI WATIFTL++   FYFGGLS II WS PVL+LLYPLT+ LIFLV   + F
Sbjct: 322  HKLVPALSHIAWATIFTLLSAFFYFGGLSVIINWSAPVLFLLYPLTVDLIFLVLAQKCFN  381

Query: 181  SSRIVYQTSIAATAVAALYDALSKLGEMTGLFTIPSALTTFFFTKVVPLGEYSMGWISFAI  240
            +  IVY+T+I  T + A++DAL  L +MTGLF +P A+ TFF K VPLG++SMGWI FA
Sbjct: 382  NDPIVYRTTIGLTFIPAIFDALLTLSQMTGLFHLPEAVVTFFQKTVPLGQFSMGWIIFAA  441

Query: 241  CGVLVGLILKKVK                                               253
              G L+GLIL K K
Sbjct: 442  IGFLIGLILSKTK                                               454
```

Possible site: 21
>>> Seems to have a cleavable N-term signal seq.

| | | |
|---|---|---|
| INTEGRAL | Likelihood = −10.83 | Transmembrane 235-251 (228-258) |
| INTEGRAL | Likelihood = −8.49 | Transmembrane 434-450 (429-454) |
| INTEGRAL | Likelihood = −8.12 | Transmembrane 359-375 (356-377) |
| INTEGRAL | Likelihood = −7.86 | Transmembrane 150-166 (144-171) |
| INTEGRAL | Likelihood = −6.00 | Transmembrane 298-314 (288-316) |
| INTEGRAL | Likelihood = −5.95 | Transmembrane 42-58 (38-63) |
| INTEGRAL | Likelihood = −3.35 | Transmembrane 336-352 (335-354) |
| INTEGRAL | Likelihood = −2.81 | Transmembrane 199-215 (198-218) |
| INTEGRAL | Likelihood = −2.18 | Transmembrane 120-136 (120-138) |

Based on this analysis, it was predicted that these proteins and their epitopes could be useful antigens for vaccines or diagnostics.

Example 1831

A DNA sequence (GBSx1938) was identified in *S. agalactiae* <SEQ ID 5681> which encodes the amino acid sequence <SEQ ID 5682>. This protein is predicted to be 30S ribosomal protein S12 (rpsL). Analysis of this protein sequence reveals the following:

Possible site: 52
>>> Seems to have no N-terminal signal sequence
----- Final Results -----
    bacterial cytoplasm --- Certainty = 0.3698 (Affirmative) <succ>
      bacterial membrane --- Certainty = 0.0000 (Not Clear) <succ>
        bacterial outside --- Certainty = 0.0000 (Not Clear) <succ>

A related GBS nucleic acid sequence <SEQ ID 9429> which encodes amino acid sequence <SEQ ID 9430> was also identified.

The protein has homology with the following sequences in the GENPEPT database.

```
>GP:CAA78825 GB:Z15120 ribosomal protein S12 [Streptococcus pneumoniae]
Identities = 64/71 (90%), Positives = 68/71 (95%)
Query:  1   MPTINQLVRKPRKSKVEKSDSPALNIGYNSHRKVHTKLSAPQKRGVATRVGTMTPKKPNS   60
            MPTINQLVRKPRKSKVEKS SPALN+GYNSH+KV T +S+PQKRGVATRVGTMTPKKPNS
Sbjct:  1   MPTINQLVRKPRKSKVEKSKSPALNVGYNSHKKVQTNVSSPQKRGVATRVGTMTPKKPNS   60

Query: 61   ALRKFARVRLS   71
            ALRKFARVRLS
Sbjct: 61   ALRKFARVRLS   71
```

A related DNA sequence was identified in *S. pyogenes* <SEQ ID 5683> which encodes the amino acid sequence <SEQ ID 5684>. Analysis of this protein sequence reveals the following:

Possible site: 29
>>> Seems to have no N-terminal signal sequence
----- Final Results -----
    bacterial cytoplasm --- Certainty = 0.3879 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below.

```
Identities = 44/48 (91%), Positives = 47/48 (97%)
Query: 24   LNIGYNSHRKVHTKLSAPQKRGVATRVGTMTPKKPNSALRKFARVRLS   71
            LNIGYNSH+KV TK++APQKRGVATRVGTMTPKKPNSALRKFARVRLS
Sbjct:  1   LNIGYNSHKKVQTKMAAPQKRGVATRVGTMTPKKPNSALRKFARVRLS   48
```

Based on this analysis, it was predicted that these proteins and their epitopes could be useful antigens for vaccines or diagnostics.

Example 1832

A DNA sequence (GBSx1939) was identified in *S. agalactiae* <SEQ ID 5685> which encodes the amino acid sequence <SEQ ID 5686>. This protein is predicted to be purR. Analysis of this protein sequence reveals the following:

Possible site: 30
>>> Seems to have an uncleavable N-term signal seq
INTEGRAL    Likelihood = −0.37    Transmembrane 142-158 (142-159)
----- Final Results -----
    bacterial membrane --- Certainty = 0.1150 (Affirmative) <succ>
      bacterial outside --- Certainty = 0.0000 (Not Clear) <succ>
        bacterial cytoplasm --- Certainty = 0.0000 (Not Clear) <succ>

The protein has homology with the following sequences in the GENPEPT database.

```
>GP:CAA10902 GB:AJ222642 purR [Lactococcus lactis]
Identities = 143/269 (53%), Positives = 195/269 (72%), Gaps = 1/269 (0%)
Query:   3   LRRSERMVVISNYLINNPYTLTSLNTFASKYGAAKSSISEDIAIIKKAFEQAQIGDIKTV    62
             ++R+ER+V  +N+LIN+P   + +LN  +  Y  AKSSISED+  IK+ FE    +G ++T
Sbjct:   1   MKRNERLVDFTNFLINHPNQMLNLNELSKHYEVAKSSISEDLVFIKRVFENQGVGLVETF    60

Query:  63   TGASGGVIFTPTIAEAEAKEIVEELRQRLSENDRILPGGYIYLSDLLSTPKMLQSIGRII   122
             G+ GGV FTP I +  E+ +E+  +L E +RILPGGYIYLSD+L TP  L+ IG+II
Sbjct:  61   PGSLGGVRFTPYITDERSLEMSQEIAELLREENRILPGGYIYLSDILGTPSNLRKIGQII   120

Query: 123   ANAYRGQKIDAVMTVATKGVPLANAVANVLDVPFVIVRRDLKITEGSTVSVNYASGSSGR   182
             A+  Y    +++D VMT+ATKG+P+A  VA +LDVPFVIVRRD K+TEG+T++++VNY SGSS R
Sbjct: 121   AHEYHEKQVDVVMTIATKGIPIAQSVAEILDVPFVIVRRDPKVTEGATLNVNYMSGSSSR   180
```

-continued
```
Query: 183  IEKMFLSKRSLKPNSRVLIVDDFLKGGGTVSGMISLLSEFDSTLVGVAVFAENA-QEQRE  241
             +E M LSKRSL      VLIVDDF+KG GT++GM SL+ EFD  L GVAVF E   + +R
Sbjct: 181  VENMTLSKRSLSIGQNVLIVDDFMKGAGTINGMRSLVHEFDCLLAGVAVFLEGPFKGERL  240

Query: 242  KMAYKSLLRVSEIDVKNNRVSVEAGNIFD                                270
                 YKS+L+V ID+ N  + V+ GNIF+
Sbjct: 241  IDDYKSILKVDRIDIANRSIDVQLGNIFN                                269
```

A related DNA sequence was identified in *S. pyogenes* <SEQ ID 5687> which encodes the amino acid sequence <SEQ ID 5688>. Analysis of this protein sequence reveals the following:

Possible site: 41
>>> Seems to have an uncleavable N-term signal seq
INTEGRAL    Likelihood = −1.97    Transmembrane 142-158 (142-160)
----- Final Results -----
    bacterial membrane --- Certainty = 0.1786 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:CAA10902 GB:AJ222642 purR [Lactococcus lactis]
Identities = 142/269 (52%), Positives = 196/269 (72%), Gaps = 1/269 (0%)
Query:   3  LRRSERMVVISNYLINNPYKLTSLNTFATKYEAAKSSISEDIAIIKKAFEEANIGDIDTL   62
            ++R+ER+V  +N+LIN+P ++ +LN +   YE AKSSISED+  IK+ FE   +G ++T
Sbjct:   1  MKRNERLVDFTNFLINHPNQMLNLNELSKHYEVAKSSISEDLVFIKRVFENQGVGLVETF   60

Query:  63  TGASGGVIFTPSISETEARTIVEDLCQRLSESDRILPGGYIYLSDLLSTPKILQNIGRII  122
             G+ GGV FTP I++  +  +++ + L E +RILPGGYIYLSD+L TP  L+ IG+II
Sbjct:  61  PGSLGGVRFTPYITDERSLEMSQEIAELLREENRILPGGYIYLSDILGTPSNLRKIGQII  120

Query: 123  ANAFKGEKIDAVMTVATKGVPLANAVANILSVPFVIVRRDLKITEGSTVSVNYASASSDR  182
            A+ +  +++D VMT+ATKG+P+A +VA IL VPFVIVRRD K+TEG+T++VNY S SS R
Sbjct: 121  AHEYHEKQVDVVMTIATKGIPIAQSVAEILDVPFVIVRRDPKVTEGATLNVNYMSGSSSR  180

Query: 183  IEKMFLSKRSLKPNSRVLIVDDFLKGGGTITGMISLLTEFDSTLVGVAVFAENA-QSERE  241
            +E M LSKRSL      VLIVDDF+KG GTI GM SL+ EFD  L GVAVF E   + ER
Sbjct: 181  VENMTLSKRSLSIGQNVLIVDDFMKGAGTINGMRSLVHEFDCLLAGVAVFLEGPFKGERL  240

Query: 242  QMTFKSLLKVSEIDVKNNNVVVEVGNIFD                                270
                +KS+LKV  ID+ N ++ V++GNIF+
Sbjct: 241  IDDYKSILKVDRIDIANRSIDVQLGNIFN                                269
```

Based on this analysis, it was predicted that these proteins and their epitopes could be useful antigens for vaccines or diagnostics.

Example 1833

A DNA sequence (GBSx1940) was identified in *S. agalactiae* <SEQ ID 5689> which encodes the amino acid sequence <SEQ ID 5690>. This protein is predicted to be cmp-binding-factor 1. Analysis of this protein sequence reveals the following:

An alignment of the GAS and GBS proteins is shown below.

```
Identities = 234/270 (86%), Positives = 255/270 (93%)

Query:   1  MKLRRSERMVVISNYLINNPYILTSLNTFASKYGAAKSSISEDIAIIKKAFEQAQIGDIK   60
            MKLRRSERMVVISNYLINNPY LTSLNTFA+KY AAKSSISEDIAIIKKAFE+A IGDI
Sbjct:   1  MKLRRSERMVVISNYLINNPYKLTSLNTFATKYEAAKSSISEDIAIIKKAFEEANIGDID   60

Query:  61  TVTGASGGVIFTPTIAEAEAKEIVEELRQRLSENDRILPGGYIYLSDLLSTPKMLQSIGR  120
            T+TGASGGVIFTP+I+E EA+ IVE+L QRLSE+DRILPGGYIYLSDLLSTPK+LQ+IGR
Sbjct:  61  TLTGASGGVIFTPSISETEARTIVEDLCQRLSESDRILPGGYIYLSDLLSTPKILQNIGR  120

Query: 121  IIANAIRGQKIDAVMTVATKGVPLANAVANVLDVPFVIVRRDLKITEGSTVSVNYASGSS  180
            IIANA++G+KIDAVMTVATKGVPLANAVAN+L VPFVIVRRDLKITEGSTVSVNYAS SS
Sbjct: 121  IIANAFKGEKIDAVMTVATKGVPLANAVANILSVPFVIVRRDLKITEGSTVSVNYASASS  180

Query: 181  GRIEKMFLSKRSLKPNSRVLIVDDFLKGGGTVSGMISLLSEFDSTLVGVAVFAENAQEQR  240
             RIEKMFLSKRSLKPNSRVLIVDDFLKGGGT++GMISLL+EFDSTLVGVAVFAENAQ +R
Sbjct: 181  DRIEKMFLSKRSLKPNSRVLIVDDFLKGGGTITGMISLLTEFDSTLVGVAVFAENAQSER  240

Query: 241  EKMAYKSLLRVSEIDVKNNRVSVEAGNIFD                               270
            E+M +KSLL+VSEIDVKNN V VE GNIFD
Sbjct: 241  EQMTFKSLLKVSEIDVKNNNVVVEVGNIFD                               270
```

Possible site: 53
>>> Seems to have no N-terminal signal sequence
----- Final Results -----
    bacterial cytoplasm --- Certainty = 0.1753 (Affirmative) <succ>
    bacterial membrane --- Certainty = 0.0000 (Not Clear) <succ>
    bacterial outside --- Certainty = 0.0000 (Not Clear) <succ>

Possible site: 38
>>> Seems to have no N-terminal zignal sequence
----- Final Results -----
    bacterial cytoplasm --- Certainty = 0.1822 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database.

An alignment of the GAS and GBS proteins is shown below.

```
>GP:AAC44803 GB:U21636 cmp-binding-factor 1 [Staphylococcus aureus]
Identities = 140/310 (45%), Positives = 195/310 (62%), Gaps = 6/310 (1%)
Query:   3 INQMKKDELFEGFYLIKKAEVRKTRAGKDFIAFTFQDDTGEISGNMWDAQTYNVEEFVAG    62
           I +   +  + F+L+ KA    T  GKD++     QD +GEI    W A   ++
Sbjct:   4 IENLNPGDSVDHFFLVHKATQGVTAQGKDYMTLHLQDKSGEIEAKFWTATKNDMATIKPE    63

Query:  63 KIVHMKGRREVYNGTPQ--VNQITLRNIKDGEPNDPRDFKEKPPINVDNVREYMEQMLFK   120
           +IVH+KG    Y G Q  VNQI L   +D    F + P++    ++E +    L
Sbjct:  64 EIVHVKGDIINYRGNKQMKVNQIRLATTEDQLKTE--QFVDGAPLSPAEIQEEISHYLLD   121

Query: 121 IENATWQRVVRALYRKYNKEFFTYPAAKTNHHAFESGLAYHTATMVRLADSIGDIYPELN   180
           IENA  QR+ R L +KY + F+TYPAA ++HH F SGL+YH  TM+R+A SI DIYP LN
Sbjct: 122 IENANLQRITRHLLKKYQERFYTYPAASSHHHNFASGLSYHVLTMLRIAKSICDIYPLLN   181

Query: 181 KSLMFAGIMLHDLAKVIELSGPDNTEYTIRGNLIGHISLIDEELTKILAELNIDDTKEEV   240
           KSL+++GI+LHD+ KV ELSGP  T YT+ GNL+GHIS+  +E+ +    ELNI+    EE+
Sbjct: 182 KSLLYSGIILHDIGKVRELSGPVATSYTVEGNLLGHISIASDEVVEAARELNIEG--EEI   239

Query: 241 TVLRHVILSHHGQLEYGSPVRPRIMEAEIIHMIDNIDANMMMMTTALNRVNEGEMTNRIF   300
            +LRH+ILSHHG+LEYGSP  P + EAEI+   IDNIDA M M   A  + ++G+ T++IF
Sbjct: 240 MLLRHMILSHHGKLEYGSPKLPYLKEAEILCYIDNIDARMNMFEKAYNKTDKGQFTDKIF   299

Query: 301 AMDNRSFYKP                                                    310
           ++NR FY P
Sbjct: 300 GLENRRFYNP                                                    309
```

A related DNA sequence was identified in *S. pyogenes* <SEQ ID 5691> which encodes the amino acid sequence <SEQ ID 5692>. Analysis of this protein sequence reveals the following:

```
Identities = 275/311 (88%), Positives = 300/311 (96%)

Query:   1 MKINQMKKDELFEGFYLIKKAEVRKTRAGKDFIAFTFQDDTGEISGNMWDAQTYNVEEFV    60
           MKINQMKKD+LFEGFYLIK AEVRKTRAGKDFI+ TFQDDTGEISGN+WDAQ YNVEEF
Sbjct:   1 MKINQMKKDQLFEGFYLIKSAEVRKTRAGKDFISLTFQDDTGEISGNLWDAQPYNVEEFT    60

Query:  61 AGKIVHMKGRREVYNGTPQVNQITLRNIKDGEPNDPRDEKEKPPINVDNVREYMEQMLFK   120
           AGK+V MKGRREVYNGTPQVNQITLRN++ GEPNDP+DFKEK P++V  VR+Y+EQMLFK
Sbjct:  61 AGKVVFMKGRREVYNGTPQVNQITLRNVRPGEPNDPKDEKEKAPVSVTEVRDYLEQMLFK   120

Query: 121 IENATWQRVVRALYRKYNKEFFTYPAAKTNHHAFESGLAYHTATMVRLADSIGDIYPELN   180
           IENATWQR+VRALYRKY+KEF+TYPAAKTNHHAFESGLAYHTATMVRLADSIGDIYP+LN
Sbjct: 121 IENATWQRIVRALYRKYDKEFYTYPAAKTNHHAFESGLAYHTATMVRLADSIGDIYPDLN   180

Query: 181 KSLMFAGIMLHDLAKVIELSGPDNTEYTIRGNLIGHISLIDEELTKILAELNIDDTKEEV   240
           KSL+FAGIMLHDLAKVIEL+GPDNTEYT+RGNLIGHISLI+EE+TK+++EL IDDTKEEV
Sbjct: 181 KSLLFAGIMLHDLAKVIELTGPDNTEYTVRGNLIGHISLINEEITKVISELQIDDTKEEV   240

Query: 241 TVLRHVILSHHGQLEYGSPVRPRIMEAEIIHMIDNIDANMMMMTTALNRVNEGEMTNRIF   300
            VLRHVILSHHGQLEYGSPVRPRIMEAEIIHMIDNIDANMMMMTTAL+RV+EGEMTNRIF
Sbjct: 241 IVLRHVILSHHGQLEYGSPVRPRIMEAEIIHMIDNIDANMMMMTTALSRVSEGEMTNRIF   300

Query: 301 AMDNRSFYKPN                                                   311
           AMDNRSFYKPN
Sbjct: 301 AMDNRSFYKPN                                                   311
```

Based on this analysis, it was predicted that these proteins and their epitopes could be useful antigens for vaccines or diagnostics.

Example 1834

A DNA sequence (GBSx1941) was identified in *S. agalactiae* <SEQ ID 5693> which encodes the amino acid sequence <SEQ ID 5694>. Analysis of this protein sequence reveals the following:

```
Possible site: 21
>>> Seems to have an uncleavable N-term signal seq
INTEGRAL     Likelihood = –14.59     Transmembrane 2-18 (1-22)
----- Final Results -----
   bacterial membrane --- Certainty = 0.6838 (Affirmative) <succ>
      bacterial outside --- Certainty = 0.0000 (Not Clear) <succ>
         bacterial cytoplasm --- Certainty = 0.0000 (Not Clear) <succ>
```

A related DNA sequence was identified in *S. pyogenes* <SEQ ID 5695> which encodes the amino acid sequence <SEQ ID 5696>. Analysis of this protein sequence reveals the following:

```
Possible site: 17
>>> Seems to have an uncleavable N-term signal seq
INTEGRAL     Likelihood = –12.05     Transmembrane 3-19 (1-26)
----- Final Results -----
   bacterial membrane --- Certainty = 0.5819 (Affirmative) <succ>
      bacterial outside --- Certainty = 0.0000 (Not Clear) <succ>
         bacterial cytoplasm --- Certainty = 0.0000 (Not Clear) <succ>
```

An alignment of the GAS and GBS proteins is shown below.

SEQ ID 5694 (GBS88) was expressed in *E. coli* as a His-fusion product. SDS-PAGE analysis of total cell extract is shown in FIG. 18 (lane 2; MW 48 kDa).

Based on this analysis, it was predicted that these proteins and their epitopes could be useful antigens for vaccines or diagnostics.

Example 1835

A DNA sequence (GBSx1942) was identified in *S. agalactiae* <SEQ ID 5697> which encodes the amino acid sequence <SEQ ID 5698>. Analysis of this protein sequence reveals the following:

```
Possible site: 44
>>> Seems to have no N-terminal signal sequence
----- Final Results -----
   bacterial cytoplasm --- Certainty = 0.2722 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database.

```
Identities = 309/424 (72%), Positives = 370/424 (86%), Gaps = 3/424 (0%)

Query:    1  MLVIILIIVLASLTVTIISYQKMTELTKSVEKQLEDNADNLSDQLTYQIEVAQKDQILTL   60
             +++ +L++VL  L   ++   K+  L   + + LE NADNLSDQ+TYQ++ A K Q+L L
Sbjct:    3  LILFLLVLVLLGLGAYLLF--KVNGLQHQLAQTLEGNADNLSDQMTYQLDTANKQQLLEL   60

Query:   61  TNQLNRMQQEIYQLLTDMRTELNQHLTESRDRSDKRLELINSNLSQSVQKMQDSNEKRLD  120
             T  +NR Q  +YQ LTD+R  L++  L++SRDRSDKRLE IN  ++QS++ MQ+SNEKRL+
Sbjct:   61  TQLMNRQQAGLYQQLTDIRDVLHRSLSDSRDRSDKRLEKINQQVNQSLKNMQESNEKRLE  120

Query:  121  QMRQTVEEKLEKTLQTRLQTSFETVSRQLESVNQGLGEMKTVAQDVGTLNKVLSNTKTRG  180
             +MRQ VEEKLE+TL+ RL  SF++VS+QLESVN+GLGEM++VAQDVGTLNKVLSNTKTRG
Sbjct:  121  KMRQIVEEKLEETLKNALHASEDSVSKQLESVNKGLGEMRSVAQDVGTLNKVLSNTKTRG  180

Query:  181  ILGELQLGQIIEDIMTVSQYEREFPTVSGSSERVEYAIKLPGNGQGDYIYLPIDSKFPLE  240
             ILGELQLGQIIEDIMT SQYEREF TVSGSSERVEYAIKLPGNGQG YIYLPIDSKFPLE
Sbjct:  181  ILGELQLGQIIEDIMTSSQYEREFPVTVSGSSERVEYAIKLPGNGQGGYIYLPIDSKFPLE  240

Query:  241  DYYRLEDAYELGDKVQIELYRKSLLASIRKFAKDINNKYLNPPETTNFGIMFLPTEGLYS  300
             DYYRLEDAYE+GDK+ IE  RK+LLA+I++FAKDI+ KYLNPPETTNFG+MFLPTEGLYS
Sbjct:  241  DYYRLEDAYEVGDKLAIEASRKALLAAIKRFAKDIHKKYLNPPETTNFGVMFLPTEGLYS  300

Query:  301  EVVRNATFFDSLRRDENIVVAGPSTLSALLNSLSVGFKTLNIQKNANDISKILGNVKVEF  360
             EVVRNA+FFDSLRR+ENIVVAGPSTLSALLNSLSVGFKTLNIQKNA+DISKILGNVK+EF
Sbjct:  301  EVVRNASFFDSLRREENIVVAGPSTLSALLNSLSVGFKTLNIQKNADDISKILGNVKLEF  360

Query:  361  GKFGGMLSKAQKQLNTASKSIDSLLTTRTNAIIRVLNTVEEHQDQATTSLLNLPITEEEE  420
              KFGG+L+KAQKQ+NTA+  ++D L++TRTNAI+R LNTVE +QDQAT SLLN+P+ EEE
Sbjct:  361  DKFGGLLAKAQKQMNTANNTLDQLISTRTNAIVRALNTVETYQDQATKSLLNMPLLEEEN  420

Query:  421  INEN                                                          424
               NEN
Sbjct:  421  -NEN                                                          423
```

```
>GP:CAB13453 GB:Z99112 yloS [Bacillus subtilis]
Identities = 75/217 (34%), Positives = 109/217 (49%), Gaps = 12/217 (5%)
Query:   1  MTKIALFAGG------DLTYFEYDFDYFVGIDRGSLFLLKNGLSLDMAVGDFDSITEDEL   54
            M  I  +AGG      DLT +  +    ++G+D+G++ LL   G+      A GDFDSITE E
Sbjct:   1  MKTINIVAGGPKNLIPDLTGYTDEHTLWIGVDKGTVTLLDAGIIPVEAFGDFDSITEQER   60

Query:  55  LYIKHYCSNIVSASAEKNDTDTELALKTIFKEFPEAQVTVFGAFGGRIDHMMSNIFLPSD  114
            +I+    +   AEK+    TD +LAL       ++ P+  +  +FG   GGR DH + NI L
Sbjct:  61  RRIEKAAPALHVYQAEKDQTDLDLALDWALEKQPDI-IQIFGITGGRADHFLGNIQLLYK  119

Query: 115  RDLEPFMSQIRLKDEQNIVTYLPSGKNQVSRIEGMSYVSFMPESES--TLQISGAKYELN  172
                +IRL D+QN +    P G+  + +  E   Y+SF+P SE     L ++G KY LN
Sbjct: 120  GVKTNI--KIRLIDKQNHIQMFPPGEYDIEKDENKRYISFIPFSEDIHELTLTGFKYPLN  177

Query: 173  KSNY-FKKKMYSSNEFMTSPIEVELKDGYLIIIYSKD                        208
            +        +   SNE +S         G LI+I S D
Sbjct: 178  NCHITLGSTLCISNELIHSRGTFSFAKGILIMIRSTD                        214
```

A related DNA sequence was identified in *S. pyogenes* <SEQ ID 5699> which encodes the amino acid sequence <SEQ ID 5700>. Analysis of this protein sequence reveals the following:

Possible site: 55
>>> Seems to have no N-terminal signal sequence
----- Final Results -----
  bacterial cytoplasm --- Certainty = 0.2467 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

```
Identities = 130/208 (62%), Positives = 166/208 (79%)
Query:   1  MTKIALFAGGDLTYFEYDFDYFVGIDRGSLFLLKNGLSLDMAVGDFDSITEDELLYIKHY   60
            M+K+ALFAGGDL+Y    DFDYFVGIDRGSLFLL+NGL L+MAVGDFDS+++     IK
Sbjct:   1  MSKVALFAGGDLSYISRDFDYFVGIDRGSLFLLENGLPLNMAVGDFDSVSQKAFTDIKEK   60

Query:  61  CSNIVSASAEKNDTDTELALKTIFKEFPEAQVTVFGAFGGRIDHMMSNIFLPSDRDLEPF  120
                ++A   EKNDTDTELALK +F   FPEA+VT+FGAFGGR+DH++SNIFLPSD  + PF
Sbjct:  61  AELFITAHPEKNDTDTELALKEVFARFPEAEVTIFGAFGGRMDHLLSNIFLPSDPGIAPF  120

Query: 121  MSQIRLKDEQNIVTYLPSGKNQVSRIEGMSYVSFMPESESTLQISGAKYELNKSNYFKKK  180
            M+QI L+D+QN++TY P+G++ + +  EGM+YV+FM E E+ L I+GAK+EL + N+FKKK
Sbjct: 121  MAQIALRDQQNMITYRPAGQHLIHQEEGMTYVAFMAEGEADLTITGAKFELTQDNFFKKK  180

Query: 181  MYSSNEFMTSPIEVELKDGYLIIIYSKD                                208
            +YSSN F+  PI V L  GYLIII SKD
Sbjct: 181  IYSSNAFIHQPITVSLPSGYLIIIQSKD                                208
```

Based on this analysis, it was predicted that these proteins and their epitopes could be useful antigens for vaccines or diagnostics.

Example 1836

A DNA sequence (GBSx1943) was identified in *S. agalactiae* <SEQ ID 5701> which encodes the amino acid sequence <SEQ ID 5702>. This protein is predicted to be ribulose-phosphate 3-epimerase (rpe). Analysis of this protein sequence reveals the following:

Possible site: 18
>>> Seems to have no N-terminal signal sequence
INTEGRAL     Likelihood = –1.59     Transmembrane 124-140 (124-141)
----- Final Results -----
  bacterial membrane --- Certainty = 0.1638 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

```
>GP:BAB06221 GB:AP001515 unknown conserved protein [Bacillus halodurans]
Identities = 113/211 (53%), Positives = 153/211 (71%)
Query:   5  KIAPSILAADYANFANELKRIEETTAEYVHIDIMDGQFVPNISFGADVVSSMRKHSKLVF   64
            KIAPSIL+AD+AN  NE++  +E     A+Y+H+D+MDG FVPNI+ G   +V ++R  + L
Sbjct:   3  KIAPSILSADFANLGNEIQDVERGGADYIHVDVMDGHFVPNITIGPLIVDAIRPVTTLPL   62

Query:  65  DCHLMVVDPERYIEAFAQAGADIMTIHVEATKHIHGALQKIKEAGMKAGVVINPGTPVES  124
            D HLM+  P+  YI AFA+AGADI+T+HVEA  H+H   L  IKE+G+KAGVV+NP TPV S
Sbjct:  63  DVHLMIEQPDGYIPAFAKAGADIITVHVEACPHLHRTLHLIKESGVKAGVVLNPATPVSS  122

Query: 125  LIPILDLVDQILIMTVNPGFGGQAFIPEMMSKVKTVAAWRKEYGHHYDIEVDGGIDNTTI  184
```

```
                +  +L   VD +L MTVNPGFGGQ FIP ++ K+K +A+ +KE G   ++IEVDGG++   T
Sbjct: 123  IQHVLSDVDMVLFMTVNPGFGGQRFIPSVLPKLKELASLKKEQGLTFEIEVDGGVNEETA  182

Query: 185  KAAAEAGANVFVAGSYLFKASDLPAQVETLR                              215
            K    EAGANV VAGS +F   D A ++ +R
Sbjct: 183  KQCVEAGANVLVAGSAVFNEEDRAAAIKGIR                              213
```

A related DNA sequence was identified in *S. pyogenes* <SEQ ID 5703> which encodes the amino acid sequence <SEQ ID 5704>. Analysis of this protein sequence reveals the following:

Possible site: 49
>>> Seems to have no N-terminal signal sequence
----- Final Results -----
  bacterial cytoplasm --- Certainty = 0.0072 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 183/219 (83%), Positives = 198/219 (89%)
Query:   1  MSTNKIAPSILAADYANFANELKRIEETTAEYVHIDIMDGQFVPNISFGADVVSSMRKHS   60
            MST KIAPSILAADYANFA+EL RIEET AEYVHIDIMDGQFVPNISFGADVV+SMRKHS
Sbjct:   1  MSTLKIAPSILAADYANFASELARIEETDAEYVHIDIMDGQFVPNISFGADVVASMRKHS   60

Query:  61  KLVEDCHLMVVDPERYIEAFAQAGADIMTIHVEATKHIHGALQKIKEAGMKAGVVINPGT  120
            KLV DCHLMVVDPERY+EAFAQAGADIMTIH E+T+HIHGALQKIK AGMKAGVVINPGT
Sbjct:  61  KLVFDCHLMVVDPERYVEAFAQAGADIMTIHTESTRHIHGALQKIKAAGMKAGVVINPGT  120

Query: 121  PVESLIPILDLVDQILIMTVNPGFGGQAFIPEMMSKVKTVAAWRKEYGHHYDIEVDGGID  180
            P   +L P+LDLVDQ+LIMTVNPGFGGQAFIPE + KV TVA WR E G  +DIEVDGG+D
Sbjct: 121  PATALEPLLDLVDQVLIMTVNPGFGGQAFIPECLEKVATVAKWRDEKGLSFDIEVDGGVD  180

Query: 181  NTTIKAAAEAGANVFVAGSYLFKASDLPAQVETLRVALD                      219
            N TI+A   EAGANVFVAGSYLFKASDL +QV+TLR AL+
Sbjct: 181  NKTIRACYEAGANVFVAGSYLFKASDLVSQVQTLRTALN                      219
```

Based on this analysis, it was predicted that these proteins and their epitopes could be useful antigens for vaccines or diagnostics.

Example 1837

A DNA sequence (GBSx1944) was identified in *S. agalactiae* <SEQ ID 5705> which encodes the amino acid sequence <SEQ ID 5706>. Analysis of this protein sequence reveals the following:

Possible site: 17
>>> Seems to have no N-terminal signal sequence
----- Final Results -----
  bacterial cytoplasm --- Certainty = 0.2098 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:CAB13451 GB:Z99112 similar to hypothetical proteins [Bacillus subtilis]
Identities = 148/296 (50%), Positives = 202/296 (68%), Gaps = 14/296 (4%)
Query:   2  QGRIVKSLAGFYYV----ESDGVVYQTRARGNFRKKGQIPYVGDWVEFSSQDQSEGYILS   57
            +G+I+K+L+GFYYV     E    V Q R  RG FRK     P VGD+V + +++ EGY++
Sbjct:   3  EGKIIKALSGFYYVLDESESDSDKVIQCRGRGIFRKNKITPLVGDYVVYQAENDKEGYLME   62

Query:  58  IEERKNSLVAPPIVNIDQAVVIMSAKEPDFNANLLDRFLVLLEYKMIQPIIYISKLDLLD  117
            I+ER N L+RPPI N+DQAV++ SA +P F+  LLDRFLVL+E   IQPII I+K+DL++
```

```
-continued
Sbjct:   63  IKERTNELIRPPICNVDQAVLVFSAVQPSFSTALLDRFLVLVEANDIQPIICITKMDLIE  122

Query:  118  DLVVIDDIR---EHYQNIGY-VFCYSQEE------LLPLLANKVTVFMGQTGVGKSTLLN  167
             D    D I+    E Y+NIGY V+  S ++      ++P   +K TVF GQ+GVGKS+LLN
Sbjct:  123  DQDTEDTIQAYAEDYRNIGYDVYLTSSKDQDSLADIIPHFQDKTTVFAGQSGVGKSSLLN  182

Query:  168  KIAPELKLETGEISGSLGRGRHTTRAVSFYNVHKGKIADTPGFSSLDYEVDNAEDLNESF  227
              I+PEL L T EIS  LGRG+HTTR V   +    G +ADTPGFSSL++      E+L  +F
Sbjct:  183  AISPELGLRTNEISEHLGRGKHTTRHVELIHTSGGLVADTPGFSSLEFTDIEEEELGYTF  242

Query:  228  PELRRLSHFCKFRSCTHTHEPKCAVKEALTQGQLWQVRYDNYLQFLSEIESRRETY      283
             P++R   S  CKFR C H  EPKCAVK+A+      G+L Q  RYD+Y++F++EI+ R+ Y
Sbjct:  243  PDIREKSSSCKFRGCLHLKEPKCAVKQAVEDGELKQYRYDHYVEFMTEIKDRKPRY      298
```

A related DNA sequence was identified in *S. pyogenes* <SEQ ID 5707> which encodes the amino acid sequence <SEQ ID 5708>. Analysis of this protein sequence reveals the following:

Possible site: 17
>>> Seems to have no N-terminal signal sequence
----- Final Results -----
   bacterial cytoplasm --- Certainty = 0.2290 (Affirmative) <succ>
   bacterial membrane --- Certainty = 0.0000 (Not Clear) <succ>
   bacterial outside --- Certainty = 0.0000 (Not Clear) <succ>

<SEQ ID 5710>. This protein is predicted to be rRNA. Analysis of this protein sequence reveals the following:

Possible site: 17
>>> Seems to have no N-terminal signal sequence
INTEGRAL    Likelihood = −0.43   Transmembrane 259- 275 (259-275)
----- Final Results -----
   bacterial membrane --- Certainty = 0.1171 (Affirmative) <succ>
   bacterial outside --- Certainty = 0.0000 (Not Clear) <succ>
   bacterial cytoplasm --- Certainty = 0.0000 (Not Clear) <succ>

An alignment of the GAS and GBS proteins is shown below.

The protein has homology with the following sequences in the GENPEPT database.

```
Identities = 230/290 (79%), Positives = 257/290 (88%)
Query:    1  MQGRIVKSLAGFYYVESDGVVYQTRARGNFRKKGQIPYVGDWVEFSSQDQSEGYILSIEE   60
             +QG+I+KSLAGFYYVES+G VYQTRARGNFRK+G+ PYVGD V+FS++D SEGYIL+I
Sbjct:    1  LQGKIIKSLAGFYYVESEGQVYQTRARGNFRKRGETPYVGDIVDFSAEDNSEGYILAIHP   60

Query:   61  RKNSLVRPPIVNIDQAVVIMSAKEPDFNANLLDRFLVLLEYKMIQPIIYISKLDLLDDLV  120
             RKNSLVRPPIVNIDQAVVIMSAKEP+FN+NLLDRFL+LLE+K I P++YISK+DLLD
Sbjct:   61  RKNSLVRPPIVNIDQAVVIMSAKEPEFNSNLLDRFLILLEHKAIHPVVYISKMDLLDSPE  120

Query:  121  VIDDIREHYQNIGYVFCYSQEELLPLLANKVTVFMGQTGVGKSTLLNKIAPELKLETGEI  180
                I  I   YQ IGY F  S  EELLPLLA+K+TVFMGQTGVGKSTLLN+IAPEL LE GEI
Sbjct:  121  EIKAIGRQYQAIGYDFVTSLEELLPLLADKITVFMGQTGVGKSTLLNRIAPELALEIGEI  180

Query:  181  SGSLGRGRHTTRAVSFYNVHKGKIADTPGFSSLDYEVDNAEDLNESFPELRRLSHFCKFR  240
             S  SLGRGRHTTRAVSFYN H GKIADTPGFSSLDY++ NAEDLNE+FPELRRLSH CKFR
Sbjct:  181  SDSLGRGRHTTRAVSFYNTHGGKIADTPGFSSLDYDIANAEDLNEAFPELRRLSHECKFR  240

Query:  241  SCTHTHEPKCAVKEALTQGQLWQVRYDNYLQFLSEIESRRETYKKVIKRK            290
             SCTHTHEPKCAVK AL  G+LW VRY++YLQFLSEIE+RRETYKKVIKRK
Sbjct:  241  SCTHTHEPKCAVKAALETGELWPVRYEHYLQFLSEIENRRETYKKVIKRK            290
```

Based on this analysis, it was predicted that these proteins and their epitopes could be useful antigens for vaccines or diagnostics.

Example 1838

A DNA sequence (GBSx1945) was identified in *S. agalactiae* <SEQ ID 5709> which encodes the amino acid sequence

```
>GP:CAB15937 GB:Z99124 similar to hypothetical proteins [Bacillus subtilis]
Identities = 95/278 (34%), Positives = 147/278 (52%), Gaps = 16/278 (5%)
Query:   14  SYFACPKCQNPLIKESN-SLKCSDN-HCFDLSKFGYVNLLGGKKVDEHYDKKSFENR-QL   70
             S F CP C + +   S  SL C++   H FDLS+ GYVN L   K V    Y   + FE R +L
Sbjct:    8  SMFRCPLCDSSMDAASGKSLICTERGHTFDLSRHGYVNFLT-KPVVKTSYGAELFEARSRL   66

Query:   71  VLENGYYNHILEAISKVLENNSQFH---SVLDIGCGEGFYSRQLVNKHEKTFLAF----D  123
             +E   G+++ +   +AI++++ +       H    ++LD GCGEG +     L           A     D
Sbjct:   67  IGECGFFDPLHDAIAELISHPKSGHEAFTILDSGCGEGSHLNALCGFDYAGKAAIGTGID  126

Query:  124  ISKDSIQLAAKSDQSRLVKWFVSDLANLPIQDSSIDIILDIFSPANYKEFRRVLSDDGIL  183
```

```
                +SKD I  A+K+ +      +W V+D+A  P  D    D++L IFSP+NY EF R+L +DG+L
Sbjct:  127     LSKDGILKASKAFKDLM--WAVADVARAPFHDRQFDVVLSIFSPSNYAEFHRLLKNDGML   184

Query:  184     VKVVPVAEHVQELREKASQYLKQKDYSNQKILDHFRENFEIISEQKVVQSYNCSQQERQA   243
                +KVVP ++++ ELR+        ++ YSN  ++ F N        ++     QQ
Sbjct:  185     IKVVPRSDYLIELRQFLYTDSPRRTYSNTAAVERFTANAAHSRPVRLRYVKTLDQQAIHW   244

Query:  244     FIDMTPLLFSVDKTTIDW---ASISEITVGALIVIGKK                         278
                + MTPL +S  K  +        ++ITV    I+IG K
Sbjct:  245     LLKMTPLAWSAPKDRVSLLKEMKSADITVDVDILIGMK                         282
```

No corresponding DNA sequence was identified in *S. pyogenes*.

Based on this analysis, it was predicted that this protein and its epitopes, could be useful antigens for vaccines or diagnostics.

Example 1839

A DNA sequence (GBSx1946) was identified in *S. agalactiae* <SEQ ID 5711> which encodes the amino acid sequence <SEQ ID 5712>. This protein is predicted to be dimethyladenosine transferase (ksgA). Analysis of this protein sequence reveals the following:

---
Possible site: 61
>>> Seems to have no N-terminal signal sequence
----- Final Results -----
  bacterial cytoplasm --- Certainty = 0.3257 (Affirmative) <succ>
    bacterial membrane --- Certainty = 0.0000 (Not Clear) <succ>
      bacterial outside --- Certainty = 0.0000 (Not Clear) <succ>
---

A related DNA sequence was identified in *S. pyogenes* <SEQ ID 5713> which encodes the amino acid sequence <SEQ ID 5714>. Analysis of this protein sequence reveals the following:

---
Possible site: 19
>>> Seems to have no N-terminal signal sequence
----- Final Results -----
  bacterial cytoplasm --- Certainty = 0.2420 (Affirmative) <succ>
    bacterial membrane --- Certainty = 0.0000 (Not Clear) <succ>
      bacterial outside --- Certainty = 0.0000 (Not Clear) <succ>
---

The protein has homology with the following sequences in the GENPEPT database.

```
>GP:CAB11818 GB:Z99104 dimethyladenosine transferase [Bacillus subtilis]
Identities = 157/284 (55%), Positives = 215/284 (75%), Gaps = 2/284 (0%)
Query:    3     IADKTVTRAILERHGFTFKKSFGQNFLTDTNILQKIVDTAEIDKGVNVIEIGPGIGALTE    62
                IA     T+  IL+++GF+FKKS GQNFL DTNIL +IVD AE+ +    VIEIGPGIGALTE
Sbjct:    5     IATPIRTKEILKKYGFSFKKSLGQNFLIDINILNRIVDHAEVTEKTGVIEIGPGIGALTE    64

Query:   63     FLAENAAEVMAFEIDDRLIPILADTLARFDNVQVVNQDILKADLQTQIQA-FENPDLPIK   121
                 LA+ A +V+AFEID RL+PIL DTL+ ++NV V++QD+LKAD+++ I+  F++ D   I
Sbjct:   65     QLAKRAKKVVAFEIDQRLLPILKDTLSPYENVTVIHQDVLKADVKSVIEEQFQDCD-EIM   123

Query:  122     VVANLPYYITTPILMHLIESKIPFAEFVVMIQKEVADRISAMPNTKAYGSLSIAVQYYMT   181
                VVANLPYY+TTPI+M L+E  +P     VVM+QKEVA+R++A P++K YGSLSIAVQ+Y
Sbjct:  124     VVANLPYYVTTPIIMKLLEEHLPLKGIVVMLQKEVAERMAADPSSKEYGSLSIAVQFYTE   183

Query:  182     AKVSFIVPRTVFVPAPNVDSAILKMVRRDQPVVSVQDEDFFFRVSKVAFVHRRKTLWNNL   241
                AK    IVP+TVFVP PNVDSA+++++ RD P V V++E FFF++ K +F  RRKTL NNL
Sbjct:  184     AKTVMIVPKTVFVPQPNVDSAVIRLILRDGPAVDVENESFFFQLIKASFAQRRKTLLNNL   243

Query:  242     TSHFGKSEDTKAKLEKALEIAKIKPSIRGEALSIPDFASLADAL                 285
                ++  +  +  K+ +E+ LE   I     RGE+LSI +FA+L++  L
Sbjct:  244     VNNLPEGKAQKSTIEQVLEETNIDGKRRGESLSIEEFAALSNGL                 287
```

An alignment of the GAS and GBS proteins is shown below.

```
                Identities = 257/290 (88%), Positives = 275/290 (94%)
                Query:    1     MRIADKTVTRAILERHGFIFKKSFGQNFLTDTNILQKIVDTAEIDKGVNVIEIGPGIGAL    60
                                MRIAD +VT+A+L+RHGFTFKKSFGQNFLTDTNILQKIVDTAEID+ VNVIEIGPGIGAL
                Sbjct:    9     MRIADYSVTKAVLDRHGFTFKKSFGQNFLTDTNILQKIVDTAEIDQNVNVIEIGPGIGAL    68

Query:   61     TEFLAENAAEVMAFEIDDRLIPILADTLARFDNVQVVNQDILKADLQTQIQAFKNPDLPI   120
                                TEFLAENAAEVMAFEIDDRL+PILADTL   FDNVQVVNQDILKADLQTQI+ FKNPDLPI
```

-continued

```
Sbjct:  69  TEFLAENAAEVMAFEIDDRLVPILADTLRDFDNVQVVNQDILKADLQTQIKQFKNPDLPI  128

Query: 121  KVVANLPYYITTPILMHLIESKIPFAEFVVMIQKEVADRISAMPNTKAYGSLSIAVQYYM  180
            KVVANLPYYITTPILMHLIESKIPF EFVVM+Q+EVADRISA PNTKAYGSLSIAVQYYM
Sbjct: 129  KVVANLPYYITTPILMHLIESKIPFQEFVVMMQREVADRISAEPNTKAYGSLSIAVQYYM  188

Query: 181  TAKVSFIVPRTVFVPAPNVDSAILKMVRRDQPVVSVQDEDFFFRVSKVAFVHRRKTLWNN  240
            TAKV+FIVPRTVFVPAPNVDSAILKMVRRDQP++ V+DEDFFFRVS+++FVHRRKTLWNN
Sbjct: 189  TAKVAFIVPRTVFVPAPNVDSAILKMVRRDQPLIEVKDEDFFFRVSRLSFVHRRKTLWNN  248

Query: 241  LTSHFGKSEDTKAKLEKALEIAKIKPSIRGEALSIPDFASLADALKEVGI            290
            LTSHFGKSED KAKLEK L +A IKPSIRGEALSI DF  LADALKEVG+
Sbjct: 249  LTSHFGKSEDIKAKLEKGLALADIKPSIRGEALSIQDFGKLADALKEVGL            298
```

Based on this analysis, it was predicted that these proteins and their epitopes could be useful antigens for vaccines or diagnostics.

Example 1840

A DNA sequence (GBSx1947) was identified in *S. agalactiae* <SEQ ID 5715> which encodes the amino acid sequence <SEQ ID 5716>. Analysis of this protein sequence reveals the following:

Possible site: 20
>>> Seems to have no N-terminal signal sequence
----- Final Results -----
  bacterial cytoplasm --- Certainty = 0.0736 (Affirmative) <succ>
  bacterial membrane --- Certainty =0.0000 (Not Clear) <succ>
  bacterial outside --- Certainty = 0.0000 (Not Clear) <succ>

The protein has no significant homology with any sequences in the GENPEPT database.

Possible site: 59
>>> Seems to have no N-terminal signal sequence
----- Final Results -----
  bacterial cytoplasm --- Certainty = 0.3031 (Affirmative) <succ>
  bacterial membrane --- Certainty =0.0000 (Not Clear) <succ>
  bacterial outside --- Certainty = 0.0000 (Not Clear) <succ>

The protein has homology with the following sequences in the GENPEPT database.

```
>GP:CAB11817 GB:Z99104 similar to hypothetical proteins [Bacillus subtilis]
Identities = 81/179 (45%), Positives = 117/179 (65%), Gaps = 4/179 (2%)
    Query:   7  IQEVIVVEGKDDTANLRRFYNVDTYETRGSAIDEDDLERIERLHNLRGVIVFTDPDYNGE    66
                I+E+IVVEG+DDTA ++   + DT ET GSAID+  +++I      RGVI+ TDPD+ GE
    Sbjct:   3  IKEIIVVEGRDDTARIKLAVDADTIETNGSAIDDHVIDQIRLAQKTRGVIILTDPDFPGE    62

Query:  67  RIRKIIMNAIPTVRHAFLNRDEAKPGSKTKGRSLGVEHASFEDLQKALSKVTQHFDDEDH   126
                +IRK I  A+P  +HAFL +  AKP +K   R +GVEHAS E ++   L   V +  + +
    Sbjct:  63  KIRKTISEAVPGCKHAFLPKHLAKPKNK---RGIGVEHASVESIRACLENVHEEMEAQPS   119

Query: 127  FDITQADLIRWGFITASDSRKRREYLGNQLRIGYSNGKQLLKRLRLFGVTKAEVEECME   185
                 DI+  DLI  G I    ++ RRE LG+ L+IGY+NGKQL KRL++F + K++       ++
    Sbjct: 120  -DISAEDLIHAGLIGGPAAKCRRERLGDLLKIGYTNGKQLQKRLQMFQIKKSDFMSALD   177
```

No corresponding DNA sequence was identified in *S. pyogenes*.

Based on this analysis, it was predicted that this protein and its epitopes, could be useful antigens for vaccines or diagnostics.

Example 1841

A DNA sequence (GBSx1948) was identified in *S. agalactiae* <SEQ ID 5717> which encodes the amino acid sequence <SEQ ID 5718>. Analysis of this protein sequence reveals the following:

A related DNA sequence was identified in *S. pyogenes* <SEQ ID 5719> which encodes the amino acid sequence <SEQ ID 5720>. Analysis of this protein sequence reveals the following:

Possible site: 16
>>> Seems to have no N-terminal signal sequence
----- Final Results -----
  bacterial cytoplasm --- Certainty = 0.1474 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

```
Identities = 146/187 (78%), Positives = 165/187 (88%)
    Query:   1  MMKKIDIQEVIVVEGKDDTANLRRFYNVDTYETRGSAIDEDDLERIERLHNLRGVIVFTD    60
```

```
                            -continued
          + +KI+IQEV+VVEGKDDTANLRRFY VDTYETRGSAI E+DLERI RL++LRGVIV TD
Sbjct: 15 LTEKINIQEVLVVEGKDDTANLRRFYEVDTYETRGSAITEEDLERINRLNDLRGVIVLTD    74

Query: 61  PDYNGERIRKIIMNAIPTVRHAFLNRDEAKPGSKTKGRSLGVEHASFEDLQKALSKVTQH   120
           PDYNGERIRK+IM A+PT RHAFLNR+EA P SK+KGRSLGVEHA+FEDLQKAL+ VTQ
Sbjct: 75  PDYNGERIRKLIMAAVPTARHAFLNRNEAVPSSKSKGRSLGVEHANFEDLQKALAHVTQQ   134

Query: 121 FDDEDHFDITQADLIRWGFITASDSRKRREYLGNQLRIGYSNGKQLLKRLRLFGVTKAEV   180
           +DDE +FDI Q DLIR G + ASDSRKRREYLG +LRIGY+NGKQLLKRL LFG+T AEV
Sbjct: 135 YDDESYFDIRQTDLIRLGLLMASDSRKRREYLGEKLRIGYANGKQLLKRLELFGITLAEV   194

Query: 181 EECMEGY                                                       187
           EE ME Y
Sbjct: 195 EEVMETY                                                       201
```

Based on this analysis, it was predicted that these proteins and their epitopes could be useful antigens for vaccines or diagnostics.

Example 1842

A DNA sequence (GBSx1949) was identified in *S. agalactiae* <SEQ ID 5721> which encodes the amino acid sequence <SEQ ID 5722>. Analysis of this protein sequence reveals the following:

Possible site: 15
>>> Seems to have no N-terminal signal sequence
----- Final Results -----
  bacterial cytoplasm --- Certainty = 0.4955 (Affirmative) <succ>
    bacterial membrane --- Certainty = 0.0000 (Not Clear) <succ>
      bacterial outside --- Certainty = 0.0000 (Not Clear) <succ>

A related GBS nucleic acid sequence <SEQ ID 10139> which encodes amino acid sequence <SEQ ID 10140> was also identified.

The protein has homology with the following sequences in the GENPEPT database.

A related DNA sequence was identified in *S. pyogenes* <SEQ ID 5723> which encodes the amino acid sequence <SEQ ID 5724>. Analysis of this protein sequence reveals the following:

Possible site: 52
>>> Seems to have no N-terminal signal sequence
----- Final Results -----
  bacterial cytoplasm --- Certainty = 0.2817 (Affirmative) <succ>
    bacterial membrane --- Certainty = 0.0000 (Not Clear) <succ>
      bacterial outside --- Certainty = 0.0000 (Not Clear) <succ>

```
>GP:CAB11815 GB:Z99104 similar to hypothetical proteins [Bacillus subtilis]
Identities = 115/254 (45%), Positives = 172/254 (67%)
Query: 28  IFDTHTHLNVENFEGKIDEEINLASELGVTKMNVVGFDQDTISKSLELSSQYAQVYSTIG    87
           +FDTH HLN E ++  ++E I  A     V ++ VVGFD+ TI++++E+  +Y  +Y+ IG
Sbjct: 2   LFDTHAHLNAEQYDTDLEEVIERAKAEKVERIVVVGFDRPTITRAMEMIEEYDFIYAAIG    61

Query: 88  WHPTEAGSYDDNIESMIISHLENPKVIALGEIGLDYYWMEDPKDIQIEVFKRQIELSKEY   147
           WHP +A    +  + I    + KV+A+GE+GLDY+W + PKDIQ EVF+ QI L+KE
Sbjct: 62  WHPVDAIDMTEEDLAWIKELSAHEKVVAIGEMGLDYHWDKSPKDIQKEVFRNQIALAKEV   121

Query: 148 NLPFVVHTRDALEDTYEVIKESGVGPFGGIMHSFSGSLEMAQKFIDLGMMISFSGVVTFK   207
           NLP ++H RDA ED    ++KE G     GGIMH F+GS E+A++ + +    +SF G VTFK
Sbjct: 122 NLPIIIHNRDATEDVVTILKEEGAEAVGGIMHCFTGSAEVARECMKMNFYLSFGGPVTFK   181

Query: 208 KALDVQEAARELPLDKILVETDAPYLAPVPKRGRENKTAYTRYVVEKIAELRGITVEEVA   267
           A    +E  +E+P D++L+ETD P+L P P RG+ N+  +Y +YV E+IAEL+ +T EE+A
Sbjct: 182 NAKKPKEVVKEIPNDRLLIETDCPFLTPHPFRGKRNEPSYVKYVAEQIAELKEMTFEEIA   241

Query: 268 EATYQNAVRIFRLD                                                281
           T +NA R+FR++
Sbjct: 242 SITTENAKRLFRIN                                                255
```

An alignment of the GAS and GBS proteins is shown below.

```
Identities = 190/258 (73%), Positives = 227/258 (87%)
Query: 24  DMIKIFDTHTHLNVENFEGKIDEEINLASELGVTKMNVVGFDQDTISKSLELSSQYAQVY    83
           + + IFDTHTHLNV  F+G   EE+ LA E+GV   NVVGFDQ TIS +L L+++YA +Y
```

```
                         -continued
Sbjct:  38   EKLTIFDTHTHLNVAEFQGHETEELTLAQEMGVAYHNVVGFDQATISGALTLANKYANIY       97

Query:  84   STIGWHPTEAGSYDDNIESMIISHLENPKVIALGEIGLDYYWMEDPKDIQIEVFKRQIEL      143
             +TIGWHPTEAGSY + +E  I+S L + KVIALGEIGLDYYWMEDPK++QIEVFKRQ++L
Sbjct:  98   ATIGWHPTEAGSYSEAVEEAIVSQLSHSKVIALGEIGLDYYWMEDPKEVQIEVFKRQMQL      157

Query: 144   SKEYNLPFVVHTRDALEDTYEVIKESGVGPFGGIMHSFSGSLEMAQKFIDLGMMISFSGV      203
             +K+++LPFVVHTRDALEDTYEVIK +GVGP GGIMHS+SGSLEMA++FI+LGMMISFSGV
Sbjct: 158   AKDHDLPFVVHTRDALEDTYEVIKAAGVGPRGGIMHSYSGSLEMAERFIELGMMISFSGV      217

Query: 204   VTFKKALDVQEAARELPLDKILVETDAPYLAPVPKRGRENKTAYTRYVVEKIAELRGITV      263
             VTFKKALD+QEAA+ LPLDKILVETDAPYL PVPKRG++N TAYTRYVV+KIAELRG+TV
Sbjct: 218   VTFKKALDIQEAAQHLPLDKILVETDAPYLTPVPKRGKQNHTAYTRYVVDKIAELRGMTV      277

Query: 264   EEVAEATYQNAVRIFRLD                                               281
             EEVA+AT  NA R+F+LD
Sbjct: 278   EEVAKATTANAKRVFKLD                                               295
```

Based on this analysis, it was predicted that these proteins and their epitopes could be useful antigens for vaccines or diagnostics.

Example 1843

A DNA sequence (GBSx1950) was identified in *S. agalactiae* <SEQ ID 5725> which encodes the amino acid sequence <SEQ ID 5726>. This protein is predicted to be endosome-associated protein. Analysis of this protein sequence reveals the following:

Possible site: 31
>>> Seems to have no N-terminal signal sequence
----- Final Results -----
    bacterial cytoplasm --- Certainty = 0.5142 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1844

A DNA sequence (GBSx1951) was identified in *S. agalactiae* <SEQ ID 5727> which encodes the amino acid sequence <SEQ ID 5728>. This protein is predicted to be CG17785 gene product. Analysis of this protein sequence reveals the following:

Possible site: 14
>>> Seems to have no N-terminal signal sequence
----- Final Results -----
    bacterial cytoplasm --- Certainty = 0.4730 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1845

A DNA sequence (GBSx1952) was identified in *S. agalactiae* <SEQ ID 5729> which encodes the amino acid sequence <SEQ ID 5730>. Analysis of this protein sequence reveals the following:

Possible site: 45
>>> Seems to have no N-terminal signal sequence
----- Final Results -----
    bacterial cytoplasm --- Certainty = 0.4032 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database.

```
>GP:BAB01041 GB:AB022220 gene_id:MLN21.14~unknown protein
[Arabidopsis thaliana]
Identities = 49/185 (26%), Positives = 85/185 (45%), Gaps = 46/185 (24%)
Query:   5   LTDLDRVNIAKQEYELGSQLDTLVKIMSQDKVLPIGKVAHVQ------DGGKETGEQIYT       58
             L  +D V+ + + ELGS+    + +M+         K+  V+        D  K+    Q++
Sbjct: 154   LEGIDSVDSGRVKIELGSRGLMDLCVMASKLAYENAKMNLVEFLDCWNDYQKQMSTQVFV      213

Query:  59   ITPNGTLDKPEDVKEVTVLFKGSTAPFGGDDWKTD----WFKNDIPIASKL---LLKKFG      111
             T    DK +D  + + F+G T PF   DDW TD     W+   ++P  KL   L+    G
Sbjct: 214   FT-----DKQKDANLIVISFRG-TEPFDADDWGTDFDYSWY--EVPNVGKLHMGFLEAMG      265

Query: 112   ---------------SQSVSHKQGTKQ-----LEQSAH-----LLKEVMNKYPNAKISVY      146
                            Q+ S ++ +K+       +E+SA+     +LK +++++ NA+   V
Sbjct: 266   LGNRDDTTTFHYNLFEQTSSEEENSKKNLLDMVERSAYYAVRVILKRLLSEHENARFVVT      325
```

```
Query:  147  GHSLG                              151
             GHSLG
Sbjct:  326  GHSLG                              330
```

No corresponding DNA sequence was identified in *S. pyogenes*.

Based on this analysis, it was predicted that this protein and its epitopes, could be useful antigens for vaccines or diagnostics.

Example 1846

A DNA sequence (GBSx1953) was identified in *S. agalactiae* <SEQ ID 5731> which encodes the amino acid sequence <SEQ ID 5732>. Analysis of this protein sequence reveals the following:

Possible site: 52
>>> Seems to have an uncleavable N-term signal seq
INTEGRAL     Likelihood = −8.97     Transmembrane 12-28 (5-33)
----- Final Results -----
   bacterial membrane --- Certainty = 0.4588 (Affirmative) <succ>
     bacterial outside --- Certainty = 0.0000 (Not Clear) <succ>
       bacterial cytoplasm --- Certainty = 0.0000 (Not Clear) <succ>

A related GBS nucleic acid sequence <SEQ ID 10141> which encodes amino acid sequence <SEQ ID 10142> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

A related GBS gene <SEQ ID 8909> and protein <SEQ ID 8910> were also identified. Analysis of this protein sequence reveals the following:

Lipop: Possible site: −1 Crend: 4
McG: Discrim Score: 14.01
GvH: Signal Score (−7.5): −5.55
Possible site: 46

>>> Seems to have an uncleavable N-term signal seq
ALOM program   count: 1 value: −8.97 threshold: 0.0
INTEGRAL       Likelihood = −8.97     Transmembrane 6-22 (1-27)
PERIPHERAL     Likelihood = 9.49      84
modified ALOM score: 2.29
*** Reasoning Step: 3
----- Final Results -----
   bacterial membrane --- Certainty = 0.4588 (Affirmative) <succ>
     bacterial outside --- Certainty = 0.0000 (Not Clear) <succ>
       bacterial cytoplasm --- Certainty = 0.0000 (Not Clear) <succ>

SEQ ID 8910 (GBS32) was expressed in *E. coli* as a His-fusion product. SDS-PAGE analysis of total cell extract is shown in FIG. 10 (lane 2; MW 15.6 kDa).

GBS32-His was purified as shown in FIG. 191, lane 8.

Example 1847

A DNA sequence (GBSx1954) was identified in *S. agalactiae* <SEQ ID 5733> which encodes the amino acid sequence <SEQ ID 5734>. This protein is predicted to be extramembranal protein (dltD). Analysis of this protein sequence reveals the following:

Possible site: 31
>>> Seems to have an uncleavable N-term signal seq
INTEGRAL     Likelihood = −10.24    Transmembrane 12-28 (4-31)
----- Final Results -----
   bacterial membrane --- Certainty = 0.5097 (Affirmative) <succ>
     bacterial outside --- Certainty = 0.0000 (Not Clear) <succ>
       bacterial cytoplasm --- Certainty = 0.0000 (Not Clear) <succ>

The protein has homology with the following sequences in the GENPEPT database.

```
>GP:AAC29041 GB:AF050517 unknown [Streptococcus mutans]
Identities = 242/421 (57%), Positives = 309/421 (72%), Gaps = 1/421 (0%)
Query:   1   MLKRLGKVFGPLVCALLLLVGLYFVFPVSQ-PHHLGKEKNSAVALTKAGFKSRVQKVRAF    59
             MLKRL + GP+ CAL+L+  L  +P    H+   +EKN AVAL+ + FKS  +K+RA
Sbjct:   1   MLKRLWLILGPVFCALVLVFSLIMFYPARHLSHNYNEEKNDAVALSPSSFKSTNKKMRAL   60

Query:  60   SDPKANFVPFFGSSEWLRFDAMHPSVLAEAYNRSYIPYLLGQKGAASLTQYYGIQQIKGQ   119
             SD +  FVPFFGSSEW R D MHPSVLAE YNRSY PYLLGQKG+ SL+ Y+G+QQI  Q
Sbjct:  61   SDKRHLFVPFFGSSEWQRIDNMHPSVLAERYNRSYRPYLLGQKGSTSLSHYFGMQQIGNQ   120

Query: 120   IKNKKAIYVISPQWFVRKGANKGAFQNYFSNDQTIRFLQNQTGTTYDRYAARRLLKLYPE   179
             IKNKKA+YVISPQWFV KG +   AFQ YFS++Q   FL NQTG+T DRYAA+RLL + P
Sbjct: 121   IKNKKAVYVISPQWFVPKGTSPIAFQQYFSSEQLADFLLNQTGSTADRYAAKRLLDIKPS   180

Query: 180   ASMSDLIEKVADGQKLSNKDKQRLKFNDWVFEKTDAIFSYLPLGKTYNQAIMPHVGKLPK   239
             +++  +I+K+A G+ L++ D+  L+      +K DA+F  L       Y + ++PHV KLPK
Sbjct: 181   SNLQGMIKKIAAGKTLNSFDRASLRLIKSFLKKEDALFGSLTFSDNYERRVLPHVKKLPK   240

Query: 240   AFSYNHLSRIASQDAKVATRSNQFGIDDRFYQTRIKKHLKKLKGSQRHFNYTKSPEFNDL   299
                FSY   LS+IAS+D +    T++NQF I+D FY  RIK  LK+LKG Q+  +Y +SPE+NDL
Sbjct: 241   HFSYGTLSQIASKDGQRLTKTNQFEINDHFYNKRIKGQLKRLKGFQKQLSYLQSPEYNDL   300
```

-continued

```
Query:  300  QLVLNEFSKQNTDVLFVIPPVNKKWTDYTGLDQKMYQKSVEKIKHQLQSQGFNHIADLSR  359
             QL L + +K  T V+FVIPPVN KW +YTGL Q MYQK+VEKIK+QLQSQGF++IADLS+
Sbjct:  301  QLALTQLAKSKTKVIFVIPPVNAKWVEYTGLSQDMYQKTVEKIKYQLSQSQGFDNIADLSK  360

Query:  360  DGGKPYFMQDTIHLGWNGWLELDKHINPFLTEENSKPNYHINNKFLKKSWAKYTGRPSDYK  420
             +G +PYFMQDTIHLGWNGWL DK +NPFL+++  +P Y INN FL K WA YTG P +K
Sbjct:  361  NGDQPYFMQDTIHLGWNGWLAFDKEVNPFLSKKQLQPAYKINNHFLSKKWATYTGNPFQFK  421
```

A related DNA sequence was identified in *S. pyogenes* <SEQ ID 5735> which encodes the amino acid sequence <SEQ ID 5736>. Analysis of this protein sequence reveals the following:

---

Possible site: 41
>>> Seems to have an uncleavable N-term signal seq
INTEGRAL      Likelihood = −13.06      Transmembrane 7-23 (1-31)
----- Final Results -----
   bacterial membrane --- Certainty = 0.6222 (Affirmative) <succ>
      bacterial outside --- Certainty = 0.0000 (Not Clear) <succ>
         bacterial cytoplasm --- Certainty = 0.0000 (Not Clear) <succ>

---

An alignment of the GAS and GBS proteins is shown below.

```
Identities = 209/410 (50%), Positives = 278/410 (66%)

Query:    1  MLKRLGKVFGPLVCALLLLVGLYFVFPVSQPHHLGKEKNSAVALTKAGFKSRVQKVRAFS    60
             MLKRL  + GPL+ A +L+V   F FP   H + +EK +AVA+T +  FK+ + K +A S
Sbjct:    1  MLKRLWLILGPLLIAFVLVVITIFSFPTQLDHSIAQEKANAVAITDSSFKNGLIKRQALS    60

Query:   61  DPKANFVPFFGSSEWLRFDAMHPSVLAEAYNRSYIPYLLGQKGAASLTQYYGIQQIKGQI   120
             D    FVPFFGSSEW R D+MHPSVLAE Y RSY P+L+G++G+ASL+ YYGIQQI  ++
Sbjct:   61  DETCRFVPFFGSSEWSRMDSMHPSVLAERYKRSYRPFLIGKRGSASLSHYYGIQQITNEM   120

Query:  121  KNKKAIYVISPQWFVRKGANKGAFQNYFSNDQTIRFLQNQTGTTYDRYAARRLLKLYPEA   180
             + KKAI+V+SPQWF  +G N  A Q Y SN Q I FL           ++AA+RLL+L P
Sbjct:  121  QKKKAIFVVSPQWFTAQGINPSAVQMYLSNTQVIEFLLKARTDKESQFAAKRLLELNPGV   180

Query:  181  SMSDLIEKVADGQKLSNKDKQRLKFNDWVFEKTDAIFSYLPLGKTYNQAIMPHVGKLPKA   240
             S S+L++KV+ G+ LS  D+ LK      V +  +++FS+L    Y + I+P V  LPK
Sbjct:  181  SKSNLLKKVSKGKSLSRLDRAILKCQHQVALREESLFSFLGKSTNYEKRILPRVKGLPKV   240

Query:  241  FSYNHLSRIASQDAKVATRSNQFGIDDRFYQTRIKKHLKKLKGSQRHFNYTKSPEFNDLQ   300
             FSY  L+ +A++   ++AT +N+FGI + FY+ RI       K  Q +++Y  SPE+ND Q
Sbjct:  241  FSYKQLNALATKRGQLATTNNRFGIENTFYRKRIAPKYNLYKNFQVNYSYLASPEYNDFQ   300

Query:  301  LVLNEFSKQNTDVLFVIPPVNKKWTDYTGLDQKMYQKSVEKIKHQLQSQGFNHIADLSRD   360
             L+L+ EF+K+ TDVLFVI PVNK W DYTGL+Q  YQ +V KIK QL+SQGF+ IAD S+D
Sbjct:  301  LLLSEFAERKTDVLFVITPVNKAWADYTGLNQDKYQAAVRKIKFQLKSQGFHRIADFSKD   360

Query:  361  GGKPYFMQDTIHLGWNGWLELDKHINPFLTEENSKPNYHINNKFLKKSWA            410
             GG+ YFMQDTIHLGWNGWL  DK + PFL +    PNY +N  F K WA
Sbjct:  361  GGESYFMQDTIHLGWNGWLAFDKKVQPFLETKQPVPNYKMNPYFYSKIWA            410
```

A related GBS gene <SEQ ID 8911> and protein <SEQ ID 8912> were also identified. Analysis of this protein sequence reveals the following:

---

Lipop: Possible site: −1 Crend: 6
McG: Discrim Score: 15.50
GvH: Signal Score (−7.5): −4.52
Possible site: 31
>>> Seems to have an uncleavable N-term signal seq
ALOM program    count: 1 value: −10.24 threshold: 0.0
INTEGRAL       Likelihood = −10.24  Transmembrane 12-28 (4-31)
PERIPHERAL     Likelihood = 8.33       301
modified ALOM score: 2.55
*** Reasoning Step: 3
----- Final Results -----
   bacterial membrane --- Certainty = 0.5097 (Affirmative) <succ>
      bacterial outside --- Certainty = 0.0000 (Not Clear) <succ>
         bacterial cytoplasm --- Certainty = 0.0000 (Not Clear) <succ>

---

The protein has homology with the following sequences in the databases:

```
57.5/76.3% over 420aa
Streptococcus mutans
GP|3403204| unknown Insert characterized
ORF00336(301-1560 of 1860)
GP|3403204|gb|AAC29041.1||AF050517(1-421 of 421) unknown {Streptococcus mutans}
% Match = 41.0
% Identity = 57.5 % Similarity = 76.2
Matches = 242 Mismatches = 99 Conservative Sub.s = 79

33        63        93       123       153       183       213       243
FSGFLDLLWFPQPHNK**GVL*WILNQKY*QLLMTYLWRMFLL*WMKTYLTQEF*TAWVLLN*LLSWKATLILIFRLRNL 273       303       333       363                 420       450       480
VVMTGTQLIKLLLE*RSSAMLKRLGKVFGPLVCALLLLVGLYFVFPVSQ-PHHLGKEKNSAVALTKAGFKSRVQKVRAFS
                             ::||: |||:|:   |    :|   :  |:   :||| ||||: : ||| :|:||:|
                 MLKRLWLILGPVFCALVLVFSLIMFYPAKHLSHNYNEEKNDAVALSPSSFKSTNKKMRALS
                         10        20        30        40        50        60

510       540       570       600  603      660       690       720
DPKANFVPFFGSSEWLRFDAMHPSVLAEAYNRSYIPYLLGQKGAASLTQYYGIQQIKGQIKNKKAIYVISPQWFVRKGAN
|  : ||||||||||  | ||||||| ||||:| |||||||::  ||::|:|:|| ||||||| |||||||||||| :
DKRHLFVPFFGSSEWQRIDNMHPSVLAERYNRSYRPYLLGQKGSTSLSHYFGMQQIGNQIKNKKAVYVISPQWFVPKGTS
         80        90       100       110       120       130       140

750       780       810       840       870       900       930       960
KGAFQNYFSNDQTIRFLQNQTGTTYDRYAARRLLKLYPEASMSDLIEKVADGQKLSNKDQRLKFNDWVFEKTDAIFSYL
|||   |||::|   ||   ||||:| |||||:|||   :   | :|:| |:   |:   |   |::       ::| ||:|    |
PIAFQQYFSSEQLADFLLNQTGSTADRYAAKRLLDIKPSSNLQGMIKKIAAGKTLNSFDRASLRLIKSFLKKEDALFGSL
        160       170       180       190       200       210       220

990      1020      1050      1080      1110      1140      1170      1200
PLGKTYNQAIMPHVGKLPKAFSYNHLSRIASQDAKVATRSNQFGIDDRFYQTRIKKHLKKLKGSQRHFNYTKSPEFNDLQ
:   |  : ::|||  ||||  |||   ||:||||:|  :    |::|||  |:|  ||     |||  :||:|||  :|||:|||
TFSDNYERRVLPHVKKLPKHFSYGTLSQIASKDGQRLTKTNQFEINDHFYNKRIKGQLKRLKGFQKQLSYLQSPEYNDLQ
        240       250       260       270       280       290       300

1230      1260      1290      1320      1350      1380      1410      1440
LVLNEFSKQNTDVLFVIPPVNKKWTDYTGLDQKMYQKSVEKIKHQLQSQGFNHIADLSRDGGKPYFMQDTIHLGWNGWLE
| |  :::|    |  |:||||||||  |  ||||  |||:|||||||||||||:||:: |  |||||||||||||||
LALTQLAKSKTKVIFVIPPVNAKWVEYTGLSQDMYQKTVEKIKYQLQSQGFDNIADLSKNGDQPYFMQDTIHLGWNGWLA
        320       330       340       350       360       370       380

1470      1500      1530      1560      1590      1620      1650      1680
LDKHINPFLTEENSKPNYHINNKFLKKSWAKYTGRPSDYK*IVESDDL*H*SY*SSFLISLYLVILR*LIHVL*FFIYNE
:||  :||||::::    :|  |||  ||   ||  |||   |   :|
FDKEVNPFLSKKQLQPAYKINNHFLSKKWATYTGNPFQFK
        400       410       420
```

Based on this analysis, it was predicted that these proteins and their epitopes could be useful antigens for vaccines or diagnostics.

Example 1848

A DNA sequence (GBSx1955) was identified in S. agalactiae <SEQ ID 5737> which encodes the amino acid sequence <SEQ ID 5738>. This protein is predicted to be d-alanyl carrier protein (dltC). Analysis of this protein sequence reveals the following:

Possible site: 21
>>> Seems to have no N-terminal signal sequence
----- Final Results -----
  bacterial cytoplasm --- Certainty = 0.1061 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:AAC05776 GB:AF051356 D-alanyl carrier protein [Streptococcus mutans]
Identities = 65/79 (82%), Positives = 74/79 (93%)
Query: 1    MDIKSEVLAIIDDLFMEDVSSMMDEDLFDAGVLDSMGTVELIVELESHFNIDIPIAEFGR    60
            MDIKSEVL II D+LFMEDVS MMDEDLFDAGVLDSMGTVELIVELE+HF+I +P++EFGR
Sbjct: 1    MDIKSEVLKIIDELFMEDVSDMMDEDLFDAGVLDSMGTVELIVELENHFDITVPVSEFGR    60

Query: 61   NDWNTANKIVAGVTELCNA                                          79
            +DWNTANKI+ G+TEL NA
Sbjct: 61   DDWNTANKIIEGITELRNA                                          79
```

A related DNA sequence was identified in *S. pyogenes* <SEQ ID 5739> which encodes the amino acid sequence <SEQ ID 5740>. Analysis of this protein sequence reveals the following:

```
Possible site: 38
>>> Seems to have no N-terminal signal sequence
----- Final Results -----
    bacterial cytoplasm --- Certainty = 0.3976 (Affirmative) <succ>
       bacterial membrane --- Certainty = 0.0000 (Not Clear) <succ>
         bacterial outside --- Certainty = 0.0000 (Not Clear) <succ>
```

An alignment of the GAS and GBS proteins is shown below.

```
Identities = 57/79 (72%), Positives = 65/79 (82%)
Query:  1   MDIKSEVLAIIDDLFMEDVSSMNDEDLFDAGVLDSMGTVELIVELESHFNIDIPIAEFGR   60
            M I+  V+ + D LFMEDVS MMDEDLFDAGVLDS+GTVELIVELES FNI +PI+EFGR
Sbjct:  1   MSIEETVIELFDRLFMEDVSEMMDEDLFDAGVLDSLGTVELIVELESTFNIKVPISEFGR   60

Query: 61   NDWNTANKIVAGVTELCNA                                            79
            +DWNT  KIV GV EL +A
Sbjct: 61   DDWNTVTKIVQGVEELQHA                                            79
```

Based on this analysis, it was predicted that these proteins and their epitopes could be useful antigens for vaccines or diagnostics.

Example 1849

A DNA sequence (GBSx1956) was identified in *S. agalactiae* <SEQ ID 5741> which encodes the amino acid sequence <SEQ ID 5742>. Analysis of this protein sequence reveals the following:

```
Possible site: 16
>>> Seems to have an uncleavable N-term signal seq
INTEGRAL    Likelihood = -8.55   Transmembrane 93-109 (91-117)
INTEGRAL    Likelihood = -7.64   Transmembrane 21-37 (19-39)
INTEGRAL    Likelihood = -6.79   Transmembrane 390-406 (387-410)
INTEGRAL    Likelihood = -5.20   Transmembrane 41-57 (40-59)
INTEGRAL    Likelihood = -2.07   Transmembrane 203-219 (200-221)
INTEGRAL    Likelihood = -1.65   Transmembrane 65-81 (65-81)
INTEGRAL    Likelihood = -0.75   Transmembrane 125-141 (125-141)
----- Final Results -----
    bacterial membrane --- Certainty = 0.4418 (Affirmative) <succ>
       bacterial outside --- Certainty = 0.0000 (Not Clear) <succ>
         bacterial cytoplasm --- Certainty = 0.0000 (Not Clear) <succ>
```

A related DNA sequence was identified in *S. pyogenes* <SEQ ID 5743> which encodes the amino acid sequence <SEQ ID 5744>. Analysis of this protein sequence reveals the following:

```
Possible site: 57
>>> Seems to have an uncleavable N-term signal seq
INTEGRAL    Likelihood = -10.14   Transmembrane 387-403 (382-409)
INTEGRAL    Likelihood = -9.66    Transmembrane 18-34 (15-37)
INTEGRAL    Likelihood = -5.95    Transmembrane 64-80 (63-81)
INTEGRAL    Likelihood = -5.63    Transmembrane 92-108 (89-114)
INTEGRAL    Likelihood = -1.97    Transmembrane 40-56 (40-56)
----- Final Results -----
    bacterial membrane --- Certainty = 0.5055 (Affirmative) <succ>
       bacterial outside --- Certainty = 0.0000 (Not Clear) <succ>
         bacterial cytoplasm --- Certainty = 0.0000 (Not Clear) <succ>
```

The protein has homology with the following sequences in the databases:

```
>GP:AAC05775 GB:AF051356 integral membrane protein [Streptococcus mutans]
Identities = 246/413 (59%), Positives = 319/413 (76%)
Query:   1   MMMFFSHIPYMEPYGNPIYFVYLILAFLPVIIGIFKQKRLSTYETLVSLVFILFMFGGDH    60
             M+ FF ++P++E YGNP YF Y+ILA LP+ IG+F +KR   YE  VSL+FI+ M  G+
Sbjct:   1   MIDFFKNLPHLEAYGNPQYFFYIILAVLPIFIGLFFKKRFPLYEAFVSLIFIVLMLTGEK    60

Query:  61   YQQLVAFLFYLLWQIISVFAYQKYRENANSAGVFYLAIAMALFPLIWVKVAPLTGPSSQT   120
                Q+ A  FY++WQI  V++Y+ YR++ ++  +FYL + M++ PL   VK+ P   + Q+
Sbjct:  61   SHQIFALFFYIIWQIFCVYSYKFYRKSRDNKWIFYLHVFMSILPLSLVKITPAIWTNQQS   120

Query: 121   LFSFLGISYLTFKSIGMIIEMRDGTLQEVRLPDFIRFMIFFPTFSSGPIDRFRHFQEDYH   180
             LF FLGISYLTF+S+GMI+EMRDG L      +FIRFM+F PTFSSGPIDRFR F +DY
Sbjct: 121   LFGFLGISYLTFRSVGMIMEMRDGVLTSFTFWEFIRFMLFMPTFSSGPIDRFRRFNDDYE   180

Query: 181   KLPERDDYFAMLNKAVMYLMLGFLYKHIISYCLGGILLPLLENKALMVGGYFRKETILVM   240
             K+P++D+    ML  ++V Y+MLGF YK +++   LG ++LP L+   AL  GG+FN  T+ VM
Sbjct: 181   KIPDKDELLDMLEQSVHYIMLGFFYKFVLAQILGTMILPGLKEMALQKGGWFNWPTLGVM   240

Query: 241   YVYGLNLFFDFAGYSMFAIGISYLLGIRTPENFNMPFLSASLKDFWNRWHMSLSFWFRDY   300
```

```
                                -continued
              YVYGL+LFFDFAGYSMFAI IS  +GI++P NFN PF S  LK+FWNRWHMSLSFWFRD+
Sbjct: 241    YVYGLDLFFDFAGYSMFAIAISNFMGIKSPTNFNQPFKSQDLKEFWNRWHMSLSFWFRDF    300

Query: 301    VFMRLVHLLIKHKTFKNRNVTSGVAYLVNMLVMGFWHGLTWYYIAYGLFHGIGLIINDAW    360
              VFMRLV +L+K+K FKNRNVTS VAY+VNML+MGFWHG+TWYYI YGLFHG+GL++NDAW
Sbjct: 301    VFMRLVKVLVKNKVFKNRNVTSSVAYIVNMLIMGFWHGVTWYYITYGLFHGVGLVLNDAW    360

Query: 361    IRKKKEINRHRKKKGLSPLFQSRAFHVLCIVVTFHVVMFSLLLFSGFLNDLWF           413
              +RKKK +N+ RK K LSPL ++     L IV+TF+VVM S L+FSGFLNDLWF
Sbjct: 361    LRKKKRLNKERKAKNLSPLPENGWTRALGIVITFNVVMLSFLIFSGFLNDLWF           413
```

An alignment of the GAS and GBS proteins is shown below.

```
Identities = 240/416 (57%), Positives = 317/416 (75%), Gaps = 5/416 (1%)
Query: 5      FLEKLPHLDVYGNPQYFFYLILAVLPIYIGLFFKKRFALYEIIFSLSFIVMMLTGSTFNQ    64
              F  +P+++ YGNP YF YLILA LP+ IG+F +KR + YE + SL FI+ M  G  + Q
Sbjct: 4      FFSHIPYMEPYGNPIYFVYLILAFLPVIIGIFKQKRLSTYETLVSLVFILFMFGGDHYQQ    63

Query: 65     LKSLLAYVVGQSLLVFIYKAYRKRFNHTLVFYVTVCLSIFPLFLVKLIPAISEDGHQSLF    124
              L + L Y++ Q + VF Y+ YR+  N    VFY+ + +++FPL  VK+ P ++     Q+LF
Sbjct: 64     LVAFLFYLLWQIISVFAYQKYRENANSAGVFYLAIAMALFPLIWVKVAP-LTGPSSQTLF    122

Query: 125    GFLGISYLTFRAVAMIIEMRDGVLKEFTLWEFLRFLLFFPTFSSGPIDRFKRFNEDYINI    184
                FLGISYLTF+++ MIIEMRDG L+E   L +F+RF++FFPTFSSGPIDRF+ F EDY  +
Sbjct: 123    SFLGISYLTFKSIGMIIEMRDGTLQEVRLPDFIRFMIFFPTFSSGPIDRFRHFQEDYHKL    182

Query: 185    PDRNELLDMLGQAIHYLMLGFLYKFILAYIFGSLIMPPLKELALEQGGVFNWPTLGVMYA    244
              P+R++   ML +A+ YLMLGFLYK I++Y  G +++P L+   AL  GG FN   T+ VMY
Sbjct: 183    PERDDYFAMLNKAVMYLMLGFLYKHIISYCLGGILLPLLENKALMVGGYFNKETILVMYV    242

Query: 245    FGFDLFFDFAGYTMFALAISNLMGIKSPINFDKPFKSRDLKEFWNRWHMSLSFWFRDFVF    304
              +G +LFFDFAGY+MFA+ IS L+GI++P NF+ PF S  LK+FWNRWHMSLSFWFRD+VF
Sbjct: 243    YGLNLFFDFAGYSMFAIGISYLLGIRTPENFNMPFLSASLKDFWNRWHMSLSFWFRDYVF    302

Query: 305    MRLVKLLVKNKVFKNRNVTSSVAYIINMLLMGFWHGLTWYYIAYGLFHGIGLVINDAWVR    364
              MRLV LL+K+K FKNRNVTS VAY++NML+MGFWHGLTWYYIAYGLFHGIGL+INDAW+R
Sbjct: 303    MRLVHLLIKHKTFKNRNVTSGVAYLVNMLVMGFWHGLTWYYIAYGLFHGIGLIINDAWIR    362

Query: 365    KKKNINKERRLAKKPLLP--ENKWTYALGVFITFNVVMFSFLIFSGFLDLLWFPQP        418
              KKK IN+ R+  KK L P    +++  + L + + +TF+VVMFS L+FSGFL+ LWF +P
Sbjct: 363    KKKEINRHRK--KKGLSPLFQSRAFHVLCIVVTFHVVMFSLLLFSGFLNDLWFNRP        416
```

A related GBS gene <SEQ ID 8913> and protein <SEQ ID 8914> were also identified. Analysis of this protein sequence reveals the following:

Lipop: Possible site: −1   Crend: 10
McG: Discrim Score: 3.22
GvH: Signal Score (−7.5): −4.56
Possible site: 16
>>> Seems to have an uncleavable N-term signal seq
ALOM program    count: 7    value: −8.55    threshold: 0.0
INTEGRAL    Likelihood = −8.55    Transmembrane 93-109 (91-117)
INTEGRAL    Likelihood = −7.64    Transmembrane 21-37 (19-39)
INTEGRAL    Likelihood = −6.79    Transmembrane 390-406 (387-410)

-continued

INTEGRAL    Likelihood = −5.20    Transmembrane 41-57 (40-59)
INTEGRAL    Likelihood = −2.07    Transmembrane 203-219 (200-221)
INTEGRAL    Likelihood = −1.65    Transmembrane 65-81 (65-81)
INTEGRAL    Likelihood = −0.75    Transmembrane 125-141 (125-141)
PERIPHERAL  Likelihood = 1.01     322
modified ALOM score: 2.21
*** Reasoning Step: 3
----- Final Results -----
    bacterial membrane --- Certainty = 0.4418 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the database:

```
ORF01206(313-1563 of 1863)
GP|2952530|gb|AAC05775.1||AF051356(4-419 of 420) integral membrane protein
{Streptococcus mutans}
% Match = 50.3
% Identity = 71.0 % Similarity = 86.6
Matches = 296 Mismatches = 55 Conservative Sub.s = 65

273       303       333       363       393       423       453       483
          TFDTKWEN*YQRSYERGKQVIQAFLEKLPHLDVYGNPQYFFYLILAVLPIYIGLFFKKRFALYEIIFSLSFIVMMLTGST
                          |::  ||||:  ||||||||||:|||||||:|||||||| |||   ||  ||| ||||
                          MIDFFKNLPHLEAYGNPQYFFYIILAVLPIFIGLFFKKRFPLYEAFVSLIFIVLMLTGEK
                           10        20        30        40        50        60
```

```
513       543       573       603       633       663       693       723
FNQLKSLLAYVVGQSLLVFIYKAYRKRFNHTLVFYVTVCLSIFPLFLVKLIPAISEDGHQSLFGFLGISYLTFRAVAMII
 :|:  :|:  |::   |  :  |:  ||  |||   ::   :||:  |  :||:||  |||:  |||    :  :||||||||||||||:|  ||:
SHQIFALFFYIIWQIFCVYSYKFYRKSRDNKWIFYLHVFMSILPLSLVKITPAIWTN-QQSLFGFLGISYLTFRSVGMIM
         70        80        90       100       110       120       130

753       783       813       843       873       903       933       963
EMRDGVLKEFTLWEFLRFLLFFPTFSSGPIDRFKRFNEDYINIPDRNELLDMLGQAIHYLMLGFLYKFILAYIFGSLIMP
|||||||   ||:|||:||:|   ||||||||||||||    |:|:||    |:|::||   |||||:|||:|| |:|::|:|
EMRDGVLTSFTFWEFIRFMLFMPTFSSGPIDRFRRFNDDYEKIPDKDELLDMLEQSVHYIMLGFFYKFVLAQILGTMILP
         150       160       170       180       190       200       210

993       1023      1053      1083      1113      1143      1173      1203
PLKELALEQGGVFNWPTLGVMYAFGFDLFFDFAGYTMFALAISNLMGIKSPINFDKPFKSRDLKEFWNRWHMSLSFWFRD
 ||:||::||  ||||||||||    :|:|||||||||:|||  |||||:||||||  ||::|||||:||||||||||||||||
GLKEMALQKGGWFNWPTLGVMYVYGLDLFFDFAGYSMFAIAISNFMGIKSPTNFNQPFKSQKLKEFWNRWHMSLSFWFRD
         230       240       250       260       270       280       290

1233      1263      1293      1323      1353      1383      1412      1443
FVFMRLVKLLVKNKVFKNRNVTSSVAYIINMLLMGFWHGLTWYYIAYGLFHGIGLVINDAWVRKKKNINKERRLAKKPLL
||||||||:|||||||||||||||||||  :|||  :|||||||:|||||  ||||||:|||  :||||:||||    :||||:    |
FVFMRLVKVLVKNKVFKNRNVTSSVAYIVNMLIMGFWHGVTWYYITYGLFHGVGLVLNDAWLRKKKRLNKERKAKNLSPL
         310       320       330       340       350       360       370

1473      1503      1533      1563      1593      1623      1653      1683
PENKWTYALGVPITFNVVMFSFLIFSGFLDLLWFPQPHNK**GVL*WILNQKY*QLLMTYLWRMFLL*WMKTYLTQEP*T
|||  ||  |||:  ||||||||:||||||||||:   |||         :|
PENGWTRALGIVITFNVVMLSFLIFSGFLNDLWFADQLSKK
         390       400       410       420
```

Based on this analysis, it was predicted that these proteins and their epitopes could be useful antigens for vaccines or diagnostics.

Example 1850

A DNA sequence (GBSx1957) was identified in *S. agalactiae* <SEQ ID 5745> which encodes the amino acid sequence <SEQ ID 5746>. Analysis of this protein sequence reveals the following:

Possible site: 45
>>> Seems to have no N-terminal signal sequence

----- Final Results -----
 bacterial cytoplasm --- Certainty = 0.2611 (Affirmative) <succ>
 bacterial membrane --- Certainty = 0.0000 (Not Clear) <succ>
 bacterial outside --- Certainty = 0.0000 (Not Clear) <succ>

A related GBS nucleic acid sequence <SEQ ID 10143> which encodes amino acid sequence <SEQ ID 10144> was also identified.

The protein has homology with the following sequences in the GENPEPT database.

```
>GP:AAC05774 GB:AF051356 D-alanine-D-alanyl carrier protein ligase
[Streptococcus mutans]
Identities = 404/510 (79%), Positives = 465/510 (90%)
Query: 5    IHDMIKTIEHFAETQADFPVYDILGEVHTYGQLKVDSDSLAAHIDSLGLVEKSPVLVFGG    64
            I DMI TIE+FA+ QA+FPVY+ILGE+HTYG+LK DSDSLAAH+D L L  KSPV+VFGG
Sbjct: 6    IKDMIATIENFAQEQAEFPVYNILGEIHTYGELKADSDSLAAHLDQLDLTAKSPVVVFGG    65

Query: 65   QEYEMLATFVALTKSGHAYIPVDQHSALDRIQAIMTVAQPSLIISIGEFPLEVDNVPILD    124
            QEY MLA+FVALTKSGHAYIP+D HSAL+RI+AI+ VA+PSL+I++  +FP++    VP++
Sbjct: 66   QEYAMLASFVALTKSGHAYIPIDHHSALERIEAILEVAEPSLVIAVDDFPIDNLQVPVIQ    125

Query: 125  VSQVSAIFEEKTPYEVTHSVKGDDNYYIIFTSGTTGLPKGVQISHDNLLSETNWMISDDE    184
             SQ+    IF++K  Y++ H+VKGDD YYIIFTSGTTG PKGVQISHDNLLSFTNWMI+ +
Sbjct: 126  YSQLEEIFKQKLSYQINHAVKGDDTYYIIFTSGTTGKPKGVQISHDNLLSFTNWMINAEA    185

Query: 185  FSVPERPQMLAQPPYSFDLSVMYWAPTLAMGGTLFALPKTVVNDFKKLFATINELPIQVW    244
            F+ P RPQMLAQPPYSFDLSVMYWAPTLA+GGTLFALPK + DFK+LF TIN+LPI VW
Sbjct: 186  FATPHRPQMLAQPPYSFDLSVNYWAPTLALGGTLFALPKEITADFKQLFTTINQLPIGVW    245

Query: 245  TSTPSFADMALLSNDENSETLPQLTHEYEDGEELTVKTAQKLRQRFPKARIVNAYGPTEA    304
            TSTPSF DMA+LS+DEN++ LP LTHEYEDGEELTVKTA+KLRQRFP+ARIVNAYGPTEA
Sbjct: 246  TSTPSFVDMAMLSDDFNAQQLPHLTHFYFDGEELTVKTAKKLRQRFPQARIVNAYGPTEA    305

Query: 305  TVALSAVAITDEMLETCKRLPIGYTKDDSPTYVIDEEGHKLPNGEQGEIIIAGPAVSKGY    364
            TVALSA+A+TD+MLETCKRLPIGYTK DSPT++IDE GHKL NG+QGEII++GPAVSKGY
Sbjct: 306  TVALSALAVTDKMLETCKRLPIGYTKPDSPTFIIDESGHKLANGQQGETIVSGPAVSKGY    365
```

```
                            -continued
Query: 365  LNNPEKTAEAFFQFEGLPAYHTGDLGSMTDEGLLLYGGRMDFQIKFNGYRIELEDVSQNL   424
            LNNPE+TA AFF+FEGLPAYHTGDLGSMTDEGLLLYGGRMDFQIKFNGYRIELE+VSQNL
Sbjct: 366  LNNPERTAAAFFEFEGLPAYHTGDLGSMTDEGLLLYGGRMDFQIKFNGYRIELEEVSQNL   425

Query: 425  NKSQYVESAVAVPRYNKDHKVQNLLAYIVLKEGVRDDFERDLDLTKAIKEDLKDIMMDYM   484
            NKSQY+ SAVAVPRYNKDHKVQNLLAY+VLK+GV + FER LD+TKAIK DL+D MMDYM
Sbjct: 426  NKSQYIASAVAVPRYNKDHKVQNLLAYVVLKDGVEEQFERALDITKAIKADLQDVMMDYM   485

Query: 485  MPSKFIYREDLPLTPNGKIDIKGLMSEVNK                                514
            MPSKF+YR+DLPLTPNGKIDIKGLMSEVNK
Sbjct: 486  MPSKFLYRKDLPLTPNGKIDIKGLMSEVNK                                515
```

A related DNA sequence was identified in *S. pyogenes* <SEQ ID 5747> which encodes the amino acid sequence <SEQ ID 5748>. Analysis of this protein sequence reveals the following:

Possible site: 60
>>> Seems to have no N-terminal signal sequence
INTEGRAL    Likelihood = –2.28    Transmembrane 92-108 (91-108)

-continued

INTEGRAL    Likelihood = –0.85    Transmembrane 43-59 (41-59)
----- Final Results -----
    bacterial membrane --- Certainty = 0.1914 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:AAC05774 GB:AF051356 D-alanine-D-alanyl carrier protein ligase
[Streptococcus mutans]
Identities = 365/511 (71%), Positives = 438/511 (85%)
    Query: 2    IKDMIDSIEQFAQTQADFPVYDCLGERRTYGQLKRDSDSIAAFIDSLALLAKSPVLVFGA   61
                IKDMI +IE FAQ QA+FPVY+ LGE  TYG+LK DSDS+AA +D L L AKSPV+VFG
    Sbjct: 6    IKDMIATIENFAQEQAEFPVYNILGEIHTYGELKADSDSLAAHLDQLDLTAKSPVVVFGG   65

Query: 62   QTYDMLATFVALTKSGHAYIPVDVHSAPERILAIIEIAKPSLIIAIEEFPLTIEGISLVS   121
                Q Y MLA+FVALTKSGHAYIP+D HSA ERI AI+E+A+PSL+IA+++FP+    + ++
    Sbjct: 66   QEYAMLASFVALTKSGHAYIPIDHHSALERIEAILEVAEPSLVIAVDDFPIDNLQVPVIQ   125

Query: 122  LSEIESAKLAEMPYERTHSVKGDDNYYIIFTSGTTGQPKGVQISHDNLLSFINWMIEDAA   181
                 S++E     ++ Y+  H+VKGDD YYIIFTSGTTG+PKGVQISHDNLLSFTNWMI  A
    Sbjct: 126  YSQLEEIFKQKLSYQINHAVKGDDTYYIIFTSGTTGKPKGVQISHDNLLSFTNWMINAEA   185

Query: 182  FDVPKQPQMLAQPPYSFDLSVMYWAPTLALGGTLFALPKELVADFKQLFTTIAQLPVGIW   241
                F  P +PQMLAQPPYSFDLSVMYWAPTLALGGTLFALPKE+ ADFKQLFTTI QLP+G+W
    Sbjct: 186  FATPHRPQMLAQPPYSFDLSVMYWAPTLALGGTLFALPKEITADFKQLFTTINQLPIGVW   245

Query: 242  TSTPSFADMAMLSDDFCQAKMPALTHFYFDGEELTVSTARKLFERFPSAKIINAYGPTEA   301
                TSTPSF DMAMLSDDF   ++P LTHFYFDGEELTV TA+KL +RFP A+I+NAYGPTEA
    Sbjct: 246  TSTPSFVDMAMLSDDFNAQQLPHLTHFYFDGEELTVKTAKKLRQRFPQARIVNAYGPTEA   305

Query: 302  TVALSAIEITREMVDNYTRLPIGYPKPDSPTYIIDEDGKELSSGEQGEIIVTGPAVSKGY   361
                TVALSA+ +T +M++   RLPIGY KPDSPT+IIDE G +L++G+QGEIIV+GPAVSKGY
    Sbjct: 306  TVALSAIAVTDKMLETCKRLPIGYTKPDSPTFIIDESGHKLANGQQGEIIVSGPAVSKGY   365

Query: 362  LNNPEKTAEAFFTFKGQPAYHTGDIGSLTEDNILLYGGRLDFQIKYAGYRIELEDVSQQL   421
                LNNPE+TA AFF F+G PAYHTGD+GS+T++ +LLYGGR+DFQIK+ GYRIELE+VSQ L
    Sbjct: 366  LNNPERTAAAFFEFEGLPAYHTGDLGSMTDEGLLLYGGRMDFQIKFNGYRIELEEVSQNL   425

Query: 422  NQSPMVASAVAVPRYNKEHKVQNLLAYIVVKDGVKERFDRELELTKAIKASVKDHMMSYM   481
                N+S   +ASAVAVPRYNK+HKVQNLLAY+V+KDGV+E+F+R L++TKAIKA ++D MM YM
    Sbjct: 426  NKSQYIASAVAVPRYNKDHKVQNLLAYVVLKDGVEEQFERALDITKAIKADLQDVMMDYM   485

Query: 482  MPSKFLYRDSLPLTPNGKIDIKTLINEVNNR                               512
                MPSKFLYR  LPLTPNGKIDIK L++EVN +
    Sbjct: 486  MPSKFLYRKDLPLTPNGKIDIKGLMSEVNKK                               516
```

An alignment of the GAS and GBS proteins is shown below.

```
Identities = 374/510 (73%), Positives = 439/510 (85%)
Query:   4  MIHDMIKTIEHFAETQADFPVYDILGEVHTYGQLKVDSDSLAAHIDSLGLVEKSPVLVFG    63
            MI DMI +IE FA+TQADFPVYD LGE  TYGQLK DSDS+AA IDSL L+ KSPVLVFG
Sbjct:   1  MIKDMIDSIEQFAQTQADFPVYDCLGERRTYGQLKRDSDSIAAFIDSLALLAKSPVLVFG    60

Query:  64  GQEYEMLATFVALTKSGHAYIPVDQHSALDRIQAIMTVAQPSLIISIGEFPLEVDNVPIL   123
            Q Y+MLATFVALTKSGHAYIPVD HSA +RI AI+ +A+PSLII+I EFPL ++ + ++
Sbjct:  61  AQTYDMLATFVALTKSGHAYIPVDVHSAPERILAIIEIAKPSLIIAIEEFPLTIEGISLV   120

Query: 124  DVSQVSAIFEEKTPYEVTHSVKGDDNYYIIFTSGTTGLPKGVQISHDNLLSFTNWMISDD   183
            +S++ +     + PYE THSVKGDDNYYIIFTSGTTG PKGVQISHDNLLSFTNWMI D
Sbjct: 121  SLSEIESAKLAEMPYERTHSVKGDDNYYIIFTSGTTGQPKGVQISHDNLLSFTNWMIEDA   180

Query: 184  EFSVPERPQMLAQPPYSFDLSVMYWAPTLAMGGTLFALPKTVVNDFKKLFATINELPIQV   243
            F VP++PQMLAQPPYSFDLSVMYWAPTLA+GGTLFALPK +V DFK+LF TI +LP+ +
Sbjct: 181  AFDVPKQPQMLAQPPYSFDLSVMYWAPTLALGGTLFALPKELVADFKQLFTTIAQLPVGI   240

Query: 244  WTSTPSFADMALLSNDFNSETLPQLTHEYFDGEELTVKTAQKLRQRFPKARIVNAYGPTE   303
            WTSTPSFADMA+LS+DF    +P LTHFYFDGEELTV TA+KL +RFP A+I+NAYGPTE
Sbjct: 241  WTSTPSFADMAMLSDDFCQAKMPALTHEYEDGEELTVSTARKLFERFPSAKIINAYGPTE   300

Query: 304  ATVALSAVAITDEMLETCKRLPIGYTKDDSPTYVIDEEGHKLPNGEQGEIIIAGPAVSKG   363
            ATVALSA+ IT EM++   RLPIGY K DSPTY+IDE+G +L +GEQGEII+ GPAVSKG
Sbjct: 301  ATVALSAIEITREMVDNYTRLPIGYPKPDSPTYIIDEDGKELSSGEQGEIIVTGPAVSKG   360

Query: 364  YLNNPEKTAEAFFQFEGLPAYHTGDLGSMTDEGLLLYGGRMDFQIKENGYRIELEDVSQN   423
            YLNNPEKTAEAFF F+G PAYHTGD+GS+T++ +LLYGGR+DFQIK+ GYRIELEDVSQ
Sbjct: 361  YLNNPEKTAEAFFTFKGQPAYHTGDIGSLTEDNILLYGGRLDFQIKYAGYRIELEDVSQQ   420

Query: 424  LNKSQYVKSAVAVPRYNKDHKVQNLLAYIVLKEGVRDDFERDLDLTKAIKEDLKDIMMDY   483
            LN+S   V SAVAVPRYNK+HKVQNLLAYIV+K+GV++ F+R+L+LTKAIK  +KD MM Y
Sbjct: 421  LNQSPMVASAVAVPRYNKEHKVQNLLAYIVVKDGVKERFDRELELTKAIKASVKDHMMSY   480

Query: 484  MMPSKFIYREDLPLTPNGKIDIKGLMSEVN                                513
            MMPSKF+YR+ LPLTPNGKIDIK L++EVN
Sbjct: 481  MMPSKFLYRDSLPLTPNGKIDIKTLINEVN                                510
```

Based on this analysis, it was predicted that these proteins and their epitopes could be useful antigens for vaccines or diagnostics.

Example 1851

A DNA sequence (GBSx1958) was identified in *S. agalactiae* <SEQ ID 5749> which encodes the amino acid sequence <SEQ ID 5750>. This protein is predicted to be a histidine protein kinase (phoR). Analysis of this protein sequence reveals the following:

Possible site: 26
>>> Seems to have an uncleavable N-term signal seq
INTEGRAL    Likelihood = −13.64   Transmembrane 9-25 (5-32)
INTEGRAL    Likelihood = −11.62   Transmembrane 136-152 (132-164)
----- Final Results -----
  bacterial membrane --- Certainty = 0.6456 (Affirmative) <succ>
  bacterial outside --- Certainty = 0.0000 (Not Clear) <succ>
   bacterial cytoplasm --- Certainty = 0.0000 (Not Clear) <succ>

The protein has homology with the following sequences in the GENPEPT database.

```
>GP:CAB54569 GB:AJ006392 histidine kinase [Streptococcus pneumoniae]
Identities = 105/416 (25%), Positives = 197/416 (47%), Gaps = 56/416 (13%)
Query:   7  KKFVFLTMSILIVVVLFLFAVSNRYNQYWDEYDAYRIVKLVAKNDY---LGIPGDEPIAL    63
            + F+F+ + +  ++V+ L  + NR +     +   ++ L+A DY    L + G   I
Sbjct:  12  RDFIFILILLGFILVVTLLLLENRRDNIQLKQVNQKVKDLIA-GDYSKVLDMQGGSEITN    70

Query:  64  VTIDNQKMVKIQSNNTDLTNDVIEKSSLKL------LEQGKKSRKWKSFIYSIKE-----   112
            +T +  + ++      LT  +E+ S +L        + G   +   +  I  I+
Sbjct:  71  ITNNLNDLSEV----IRLTQENLEQESKRLNSILFYMTDGVLATNRRGQIIMINDTAKKQ   126

Query: 113  ---YKDKTYTIAIMDLASYEVPYARRFLILVFT--------IFGFCLLAAVSLYLSR---   158
                K+     +I++L   E Y  R LI           I G  L    V   L R
Sbjct: 127  LGLVKEDVLNRSILELLKIEENYELRDLITQSPELLLDSQDINGEYLNLRVRFALIRRES   186

Query: 159  -FIVGPVE-----TEMTREKQ----FVSDASHELKTPIAAIRANVQVLEQ----QIPGNR   204
             FI G V      TE  +E++    FVS+ SHEL+TP+ ++++ ++ L++       +
Sbjct: 187  GFISGLVAVLHDTTEQEKEERERRLFVSNVSHELRTPLTSVKSYLEALDEGALCETVAPD   246

Query: 205  YLDHVVSETKRMEFLIEDLLNLSRLDEKRSKVNFKKLNLSVLCQEVLLTYESLAYEEEKC   264
             +     + ET RM  ++ DLL+LSR+D    S  ++ + +N +     +L ++ + +E++
Sbjct: 247  FIKVSLDETNRMMRMVTDLLHLSRIDNATSHLDVELINFTAFITFILNRFDKMKGQEKEK   306

Query: 265  LNDTIED----DVWIVGEESQIKQILIILLDNAIRHSLSKSAIQFSLKQARRKAILTISN   320
```

-continued

```
                + + D    +W+  +  ++ Q++  +L+NAI++S      I    +K     +IL+IS+
Sbjct: 307  KYELVRDYPINSIWMEIDTDKMTQVVDNILNNAIKYSPDGGKITVRMKTTEDQMILSISD   366

Query: 321  PSAIYSKEVMDNLFERFYQAKDDHADSLS---FGLGLSIAKAIVERHKGRIRAYQE       373
                  K+ +  +F+RFY+    D A  S  +    GLGLSIAK I+++HKG  I  A    E
Sbjct: 367  HGLGIPKQDLPRIFDRFYRV--DRARSRAQGGTGLGLSIAKEIIKQHKGFIWAKSE      420
```

A related sequence was also identified in GAS <SEQ ID 9131> which encodes the amino acid sequence <SEQ ID 9132>. Analysis of this protein sequence reveals the following:

```
>>> Seems to have an uncleavable N-term signal seq
INTEGRAL    Likelihood = -11.30   Transmembrane 9-25 (4-33)
INTEGRAL    Likelihood = -10.35   Transmembrane 161-177 (154-190)
PERIPHERAL  Likelihood = 4.35     142
----- Final Results -----
   bacterial membrane --- Certainty = 0.5522 (Affirmative) <succ>
     bacterial outside --- Certainty = 0.0000 (Not Clear) <succ>
   bacterial cytoplasm --- Certainty = 0.0000 (Not Clear) <succ>
```

An alignment of the GAS and GBS proteins is shown below.

A related GBS gene <SEQ ID 8915> and protein <SEQ ID 8916> were also identified. Analysis of this protein sequence reveals the following:

```
Lipop: Possible site: -1 Crend: 7
McG: Discrim Score: 17.50
GvH: Signal Score (-7.5): -2.9
Possible site: 26
>>> Seems to have an uncleavable N-term signal seq
ALOM program    count: 2 value: -13.64 threshold: 0.0
INTEGRAL    Likelihood = -13.64   Transmembrane 9-25 (5-32)
INTEGRAL    Likelihood = -11.62   Transmembrane 136-152 (132-164)
PERIPHERAL  Likelihood = 2.49     345
modified ALOM score: 3.23
*** Reasoning Step: 3
----- Final Results -----
   bacterial membrane --- Certainty = 0.6456 (Affirmative) <succ>
     bacterial outside --- Certainty = 0.0000 (Not Clear) <succ>
   bacterial cytoplasm --- Certainty = 0.0000 (Not Clear) <succ>
```

```
Identities = 94/406 (23%), Positives = 190/406 (46%), Gaps = 31/406 (7%)
Query:   1  MFSDLRKKFVFLTMSILIVVVLFLFAVSNRYNQYWDEYDAYRIVKLVAKNDYLGIPGDEP    60
            MF+ +R +F+ +     + +++ +  + N    Y + +  RI+ L++ N    +PG
Sbjct:  10  MFNRIRIRFIMIASIAIFIILSSIVGIINTARCYQSQQEINRILHLISSNKGK-LPGTTE    68

Query:  61  IAL-----VTIDNQKMVKIQS-----NNTDLTNDVIEKSSLKLLE------------QGK    98
            +        ++ D+    + S        N   L+++    S+L  E           + K
Sbjct:  69  SSKRLGTKLSEDSLSQFRYYSVIFNANGHLLSSNTANISALDREEAQYFARLFAKSGEEK  128

Query:  99  KSRKWKSFIYS--IKEYKDKTYTIAIMDLASYEVPYARRFLILVFTIFG-FCLLAAVSLY   155
            S + +  +YS  I +    ++   +I+D   Y       + V   FG  F         +
Sbjct: 129  GSYRHQDSVYSYLITQLPNEEKLVVILDTTFYFRSVGDLLAVSVMLAFGGFIFFVVLVSL  188

Query: 156  LSRFIVGPVETEMTREKQFVSDASHELKTPIAAIRANVQVLEQQIPGNRYLDHVVSETKR   215
             S    ++ P          ++++F+++A HELKTP+A  I  AN +++E     +  +    + KR
Sbjct: 189  FSGMVIKPFVQNYEKQRRFITNAGHELKTPLAIISANNELVELMTGESEWTKSTSDQVKR  248

Query: 216  MEFLIEDLLNLSRLDEKRSKVNFKKLNLSVLCQEVLLTYESLAYEEEKCLNDTIEDDVWI   275
            +  LI  ++ L+RL+E+     V     ++ S + Q+      ++SL    ++   K    + TI+  ++  I
Sbjct: 249  LTGLINQMITLARLEEQPDVV-LHMVDFSAIAQDAAEDFKSLVLKDGKRFDLTIQPNIMI  307

Query: 276  VGEESQIKQILIILLDNAIRHSLSKSAIQFSLK---QARRKAILTISNPSAIYSKEVMDN   332
                EE  +  +++  IL+DNA ++        K   ++  SL      + R++A  L +SN
Sbjct: 308  KAEEKSLFELVTILVDNANKYCDPKGLVKVSLTTIGRRRKRAKLEVSNTYLEGKSIDYSR  367

Query: 333  LFERFYQAKDDH-ADSLSFGLGLSIAKAIVERHKGRIRAYQEKDQL                377
             FERFY+   + H +        +G+GLS+A+++V+    KG I     + D +
Sbjct: 368  FFERFYREDESHNSKEKGYGIGLSMAESMVKLFKGTITVNYKNDAI                413
```

The protein has homology with the following sequences in the databases:

```
28.3/57.2% over 371aa
Listeria monocytogenes
GP|6117973| LisK Insert characterized
ORF00341(631-1452 of 1785)
GP|6117973|gb|AAF03933.1|AF139908_3|AF139908(105-476 of 483) LisK
{Listeria monocytogenes}
% Match = 8.4
% Identity = 28.2 % Similarity = 57.1
Matches = 79 Mismatches = 113 Conservative Sub.s = 81
```

-continued

```
459       489       519       549       579       609       639       669
VKLVAKNDYLGIPGDEPIALVTIDNQKMVKIQSNNTDLTNDVIEKSSLKLLEQGKKSRKWKSFIYSIKEYKDKTYTIAIM
  :   |     : : | |         :  |       : |:   : |:         :   |     : | |    : :   | :
QGIGQMLLNEEEPEVKELLLATTSTLTNQDLTDNEEIKYLFNNDKTVNRKLQDQVINLYDKDGHFINKYYFSRSQDITSI
           50        60        70        80        90        100       110

699       729                                             756
DLASYEVPYARRFLILVFTIFG-----------------------------------FCLLAAVSLYLSRFI--
|::  |      |  : | :: |       | |                                 | | || : | :: |   :
DFSQYFVSGTDKFIMNKPTIDGQKMMTAQMPIVADDNTTVIGYAQVVNPLTSYNRMMDRLLVTMILLGAVALFISGMLGY
           130       140       150       160       170       180       190

783       813       843       873
---------------------------------------VGPVETEMTREKQFVSDASHELKTPIAAIRA
                                           : :||    :: ||||  ||||||:||:  :
LLAQNFLNPLTRLARTMNDIRKNGFQKRIETKTNSRDEIGELTVVFNDMMTRIETSFEQQKQFVEDASHELRTPVQIMEG
           210       220       230       240       250       260       270

918       948       978       1008      1038      1068      1098
NVQVLEQ---QIPG--NRYLDHVVSETKRMEFLIEDLLNLSRLDEKRSKVNFKKLNLSVLCQEVLLTYESLAYEEEKCLN
: :::| :         |       |  : : :| : | | :  | ::: :|||           : :         : :|    :|  : ||
HLKLLTRWGKDDPAVLDESLNASLTELERMKKLVQEMLDLSRAEQISQTKELQITDVNATVEQVRRNFE-VMYENFTFTL
           290       300       310       320       330       340       350

1128      1158      1188      1218      1248      1278      1308      1335
DTIEDDVWIVGEESQIKQILIILLDNAIRHSLSKSAIQFSLKQARRKAILTISNPSAIYSKEVMDNLFERFYQA-KDDHA
  : |:   :  :  :  ::::|||||::||:::|      : :    :  : :::   : :         |:|  :|  :|  |||:  |
KEDDTDLRALIQHNHLEQILIIIMDNAVKYSGDGTEVDMHVYKEQKQIHIDVRDYGEGISQEEIDKIFNRFYRVDKARSR
           370       380       390       400       410       420       430

1365      1395      1425      1452      1482      1512      1542      1572
DSLSFGLGLSIAKAIVERHKGRIRAYGEKDQ-LRLEVQLPIDGFWTNTMIN*RKNDETIFIFYW*NVIILRYFIVTNLLF
 :     ||||:|||  :||  :  |    |  |    | |:   ::: ||        :
EKGGNGLGLAIAKQLVEGYLGTINAVSEPDKGTTIKITLPYIEPKSK
           450       460       470       480
```

SEQ ID 5750 (GBS34) was expressed in E. coli as a GST-fusion product. SDS-PAGE analysis of total cell extract is shown in FIG. 15 (lane 9; MW 69 kDa).

GBS34-GST was purified as shown in FIG. 193, lane 9.

Based on this analysis, it was predicted that these proteins and their epitopes could be useful antigens for vaccines or diagnostics.

Example 1852

A DNA sequence (GBSx1959) was identified in S. agalactiae <SEQ ID 5753> which encodes the amino acid sequence <SEQ ID 5754>. This protein is predicted to be two-component response regulator (regX3). Analysis of this protein sequence reveals the following:

Possible site: 30

>>> Seems to have no N-terminal signal sequence

----- Final Results ----- bacterial cytoplasm --- Certainty = 0.1986 (Affirmative) <succ> bacterial membrane --- Certainty =0.0000 (Not Clear) <succ> bacterial outside --- Certainty = 0.0000 (Not Clear) <succ>

The protein has homology with the following sequences in the GENPEPT database.

```
>GP:BAB04091 GB:AP001508 two-component response regulator [Bacillus halodurans]
Identities = 98/223 (43%), Positives = 145/223 (64%), Gaps = 5/223 (2%)

Query:   2  RLLVVEDEKSIAEATQALLADKGYSVDLAFDGDDGLEYILTGLYDLVLLDIMLPKRSGLS    61
            R+L++EDEK IA  +Q  L +GY  D AF G DGLE        +DLVLLD+MLP+ SGL
Sbjct:   3  RILIIEDEKKIARVLQLELEHEGYETDAAFSGSDGLETFQAHAWDLVLLDVMLPELSGLE    62

Query:  62  VLKRVREAGLETPIIFLTAKSQTYDKVNGLDLGADDYITKPFEADELLARIR--LRTRQS   119
            VL+R+R      TPII LTA++   DKV+GLDLGA+DYITKPFE +ELLAR+R  LRT Q+
Sbjct:  63  VLRRIRMTDPVTPIILLTARNSIPDKVSGLDLGANDYITKPFEIEELLARVRACLRTVQT   122

Query: 120  SLIRANQLRLGNIRLNTDSHELESKESSVKLSNKEFLLMEVFMRNAKQIIPKNQLISKVW   179
                + L    + +N   +  +++       +++L+ KEF L+    F++N  Q++ + Q+++ VW
Sbjct: 123  RERVEDTLMFQELTINEKTRDVQRGNETIELTPKEFELLVFFIKNKGQVLSREQILTNVW   182

Query: 180  GPSDNSEYNQLEVFISFLRKKLRFLKADIEIITTKGFGYSLEE                  222
            G     + N  ++V++  +LRKKL    +A    + T +G GY L+E
Sbjct: 183  GFDYYGDTNVIDVYVRYLRKKLSLTEA---LQTVRGVGYRLKE                  222
```

Based on this analysis, it was predicted that this protein and its epitopes, could be useful antigens for vaccines or diagnostics.

Example 1853

A DNA sequence (GBSx1960) was identified in *S. agalactiae* <SEQ ID 5755> which encodes the amino acid sequence <SEQ ID 5756>. This protein is predicted to be 50S ribosomal protein L34-related protein. Analysis of this protein sequence reveals the following:

```
Possible site: 32
>> Seems to have no N-terminal signal sequence
----- Final Results -----
   bacterial cytoplasm --- Certainty = 0.5923 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database.

```
>GP:AAC22660 GB:U32781 ribosomal protein L34 (rpL34)
[Haemophilus influenzae Rd]
Identities = 32/44 (72%), Positives = 37/44 (83%)
Query: 1   MKRTYQPSKIRRQRKHGFRHRMSTKNGRRVLASRRRKGRKVLSA    44
           MKRT+QPS ++R R HGFR RM+TKNGR+VLA RR KGRK LSA
Sbjct: 1   MKRTFQPSVLKRSRTHGFRARMATKNGRQVLARRRAKGRKSLSA    44
```

A related DNA sequence was identified in *S. pyogenes* <SEQ ID 5757> which encodes the amino acid sequence <SEQ ID 5758>. Analysis of this protein sequence reveals the following:

```
Possible site: 32
>>> Seems to have no N-terminal signal sequence
----- Final Results -----
   bacterial cytoplasm --- Certainty = 0.5385 (Affirmative) <succ>
      bacterial membrane --- Certainty = 0.0000 (Not Clear) <succ>
         bacterial outside --- Certainty = 0.0000 (Not Clear) <succ>
```

An alignment of the GAS and GBS proteins is shown below.

```
Identities = 42/44 (95%), Positives = 44/44 (99%)
Query: 1   MKRTYQPSKIRRQRKHGFRHRMSTKNGRRVLASRRRKGRKVLSA    44
           +KRTYQPSKIRRQRKHGFRHRMSTKNGRRVLA+RRRKGRKVLSA
Sbjct: 1   VKRTYQPSKIRRQRKHGFRHRMSTKNGRRVLAARRRKGRKVLSA    44
```

Based on this analysis, it was predicted that these proteins and their epitopes could be useful antigens for vaccines or diagnostics.

Example 1854

A DNA sequence (GBSx1961) was identified in *S. agalactiae* <SEQ ID 5759> which encodes the amino acid sequence <SEQ ID 5760>. Analysis of this protein sequence reveals the following:

```
Possible site: 61
>>> Seems to have an uncleavable N-term signal seq
INTEGRAL    Likelihood = −5.79   Transmembrane 122-138 (115-141)
INTEGRAL    Likelihood =0 −4.35  Transmembrane 19-35 (15-40)
----- Final Results -----
   bacterial membrane --- Certainty = 0.3314 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the GENPEPT database.

```
>GP:AAF95990 GB:AE004350 conserved hypothetical protein [Vibrio cholerae]
Identities = 79/145 (54%), Positives = 117/145 (80%)
Query:    1 MKTFVNNASKTVLSLWFGVMPTIMTVGTIALIISVSTPIFKILGTPFLPFLELLGIPEAD    60
            +++ +     +   + + + FGV+P +M +GTIAL+I+   T +F +LG  PF+PFLELLG+PEA
Sbjct:  314 VQSVIGEGIRNAVDMVFGVLPVVMGLGTIALVIAEYTSVFSLLGQPFIPFLELLGVPEAT  373

Query:   61 IASQTMIVGFSDMVVPSIMAAEIHSEMTRFIVATVSIVQLIYMSETGAVILGSKIPINIL  120
               AS+T++VGF+DM +P+I+AA I +EMTRF++A +S+ QLIYMSE GA++LGS+IP+NI+
Sbjct:  374 AASKTIVVGFADMFIPAILAASIDNEMTRFVIAAMSVTQLIYMSEVGALLLGSRIPVNIV  433

Query:  121 ELFIIFIERTIISLPIIVLMAHLFF                                    145
            ELF+IFI RT+I+LP+I  +AHL F
Sbjct:  434 ELFVIFILRTLITLPVIAAVAHLLF                                    458
```

No corresponding DNA sequence was identified in *S. pyogenes*.

Based on this analysis, it was predicted that this protein and its epitopes, could be useful antigens for vaccines or diagnostics.

```
Possible site: 23
>>> Seems to have no N-terminal signal sequence
----- Final Results -----
   bacterial cytoplasm --- Certainty = 0.2443 (Affirmative) <succ>
      bacterial membrane --- Certainty = 0.0000 (Not Clear) <succ>
        bacterial outside --- Certainty = 0.0000 (Not Clear) <succ>
```

A related GBS nucleic acid sequence <SEQ ID 9485> which encodes amino acid sequence <SEQ ID 9486> was also identified. A further related GBS nucleic acid sequence <SEQ ID 10945> which encodes amino acid sequence <SEQ ID 10946> was also identified.

Example 1855

A DNA sequence (GBSx1962) was identified in *S. agalactiae* <SEQ ID 5761> which encodes the amino acid sequence The protein has homology with the following sequences in the GENPEPT database.

```
>GP:CAA67776 GB:X99400 D,D-carboxypeptidase [Streptococcus pneumoniae]
Identities = 193/383 (50%), Positives = 282/383 (73%), Gaps = 6/383 (1%)
Query:    1 MAVDLDSGKILYEKDANKPAAIASLTKIMTVYMVYKEIDNGNLKWNTKVNISDYPYQLTR    60
            +AV+ ++GKILYEKDA +P   IAS+TK++TVY+VY+ ++NG++   +T V+ISDYPYQLT
Sbjct:   33 IAVEANTGKILYEKDATQPVEIASITKLITVYLVYEALENGSITLSTPVDISDYPYQLTT    92

Query:   61 ESDASNVPLEKRRYTVKQLVDAAMISSANSAAIALAEHISGTESKFVDKMTAQLEKWGIH   120
             S+ASN+P+E R  YTV++L++A ++SSANSAAIALAE  I+G+E    FVD M A+L  +WGI
Sbjct:   93 NSEASNIPMEARNYTVEELLEATLVSSANSAAIALAEKIAGSEKDFVDMMRAKLLEWGIQ   152

Query:  121 DSHLVNASGLNNSMLGNHIYPKSSQNDENKMSARDIAIVAYHLVNEYPSILKITSKSVAK   180
            D+  +VN +GLNN   LG++IYP S +++ENK+SA D+AIVA +L+  +YP +L+IT K   +
Sbjct:  153 DATVVNTTGLNNETLGDNIYPGSKKDEENKLSAYDVAIVARNLIKKYPQVLEITKKPSST   212

Query:  181 FDKDIMHSYNYMLPDMPVFRPGITGLKTGTTELAGQSFIATSTESGMRLLTVIMHADKAD   240
            F    + S NYML  MP +R G   GLKTGTT+ AG+SF+ T+ E GMR++TV+++AD   D
Sbjct:  213 FAGMTITSTNYMLEGMPAYRGGFDGLKTGTTDKAGESFVGTTVEKGMRVITVVLNADHQD   272

Query:  241 KDKYARFTATNSLLNYITNTYEPNLVLAKGAAYKGKEASVRDGKEQSVIAVAKNDLKVVQ   300
             + YARFTAT+SL++YI++T+   ++ +G AY+   +A V+DGKE +VIAVA  D+ +++
Sbjct:  273 NNPYARFTATSSLMDYISSTFTLRKIVQQGDAYQDSKAPVQDGKEDTVIAVAPEDIYLIE   332

Query:  301 KKNITKQNQLKINF---KKELTAPITKKENLGKAYYVDLNKVGKGYLIKE-PSVHLVAKD   356
            +  +  Q+   + F         K + AP+         +G   Y D + +G+GY+    E PS  +VA
Sbjct:  333 R--VGNQSSQSVQFTPDSKAIPAPLEAGTVVGHLTYEDKDLIGQGYITTERPSFEMVADK   390

Query:  357 SIERSFFLKVWWNHFVRYVNEKL                                      379
                IE++FFLKVWWN  FVR+VNEKL
Sbjct:  391 KIEKAFFLKVWWNQFVRFVNEKL                                      413
```

<SEQ ID 5762>. This protein is predicted to be D,D-carboxypeptidase (dacA-2). Analysis of this protein sequence reveals the following:

A related DNA sequence was identified in *S. pyogenes* <SEQ ID 5763> which encodes the amino acid sequence <SEQ ID 5764>. Analysis of this protein sequence reveals the following:

Possible site: 21
>>> Seems to have a cleavable N-term signal seq.
----- Final Results -----
    bacterial outside --- Certainty = 0.3000 (Affirmative) <succ>
    bacterial membrane --- Certainty = 0.0000 (Not Clear) <succ>
       bacterial cytoplasm --- Certainty = 0.0000 (Not Clear) <succ>

An alignment of the GAS and GBS proteins is shown below.

```
Identities = 176/380 (46%), Positives = 257/380 (67%), Gaps = 3/380 (0%)
Query:   1 MAVDLDSGKILYEKDANKPAAIASLTKIMTVYMVYKEIDNGNLKWNTKVNISDYPYQLTR   60
            +AVDL+SGK+LYEKDA +   +AS++K++T Y+VYKE+  G L W++ V IS+YPY+LT
Sbjct:  33 IAVDLESGKVLYEKDAKEVVPVASVSKLLTTYLVYKEVSKGKLNWDSPVTISNYPYELTT   92

Query:  61 ESDASNVPLEKRRYTVKQLVDAAMISSANSAAIALAEHISGTESKFVDKMTAQLEKWGIH  120
              SNVPL+KR+YTVK+L+ A ++++ANS AIALAE I GTE KFVDKM  QL +WGI
Sbjct:  93 NYTISNVPLDKRKYTVKELLSALVVNNANSPAIALAEKIGGTEPKFVDKMKKQLRQWGIS  152

Query: 121 DSHLVNASGLNNSMLGNHIYPKSSQNDENKMSARDIAIVAYHLVNEYPSILKITSKSVAK  180
            D+ +VN++GL N  LG + YP +  +DEN   A D+AI+A HL+ E+P +LK++SKS
Sbjct: 153 DAKVVNSTGLTNHFLGANTYPNTEPDDENCFCATDLAIIARHLLLEFPEVLKLSSKSSTI  212

Query: 181 FDKDIMHSYNYMLPDMPVFRPGITGLKTGTTELAGQSFIATSTESGMRLLTVIMHADKAD  240
            F    ++SYNYML  MP +R G+ GL  G ++ AG SF+ATS E+ MR++TV+++AD++
Sbjct: 213 FAGQTIYSYNYMLKGMPCYREGVDGLFVGYSKKAGASFVATSVENQMRVITVVLNADQSH  272

Query: 241 KDKYARFTATNSLLNYITNTYEPNLVLAKGAAYKGKEASVRDGKEQSVIAVAKNDLKVVQ  300
            +D  A F  TN LL Y+   ++       ++      K   V D  E++V  VA+N L  ++
Sbjct: 273 EDDLAIFKTTNQLLQYLLINFQKVQLIENNKPV--KTLYVLDSPEKTVKLVAQNSLFFIK  330

Query: 301 KKNITKQNQLKINFKKE-LTAPITKKENLGKAYYVDLNKVGKGYLIKEPSVHLVAKDSIE  359
              + +N + I K   + AP++K + LG+A    D + +G+GYL    PS++L+ +  +I
Sbjct: 331 PIHTKTKNTVHITKKSSTMIAPLSKGQVLGRATLQDKHLIGQGYLDTPPSINLILQKNIS  390

Query: 360 RSFFLKVWWNHFVRYVNEKL                                          379
            +SFFLKVWWN FVRYVN  L
Sbjct: 391 KSFFLKVWWNRFVRYVNTSL                                          410
```

Based on this analysis, it was predicted that these proteins and their epitopes could be useful antigens for vaccines or diagnostics.

Example 1856

A DNA sequence (GBSx1963) was identified in *S. agalactiae* <SEQ ID 5765> which encodes the amino acid sequence <SEQ ID 5766>. This protein is predicted to be penicillin binding protein 4 (pdp4) (dacA-1). Analysis of this protein sequence reveals the following:

Possible site: 23
>>> Seems to have a cleavable N-term signal seq.
INTEGRAL   Likelihood = −12.58  Transmembrane 368-384 (363-394)
----- Final Results -----
    bacterial membrane --- Certainty = 0.6031 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:CAA60582 GB:X87104 penicillin binding protein 4 [Staphylococcus aureus]
Identities = 117/333 (35%), Positives = 188/333 (56%), Gaps = 8/333 (2%)
Query:   5 IVSFLCILLSLTCVNSVQAEEHKDIMQITREAGY-DVKDINKPKASIVIDNKGHILWEDN   63
            I+  LC+ LS+   + A      +Q   + GY +     +P +++ +   G +L++ N
Sbjct:   7 IIIILCLTLSIMTPYAQAANSDVTPVQAANQYGYAGLSAAYEPTSAVNVSQTGQLLYQYN   66

Query:  64 ADLERDPASMSKMFTLYLLFEDLAKGKTSLNTTVTATETDQAISKIYEISNNNIHAGVAY  123
            D + +PASM+K+ T+YL   E +  KG+ SL+ TVT T    +S + E+SN  ++ G  +
Sbjct:  67 IDTKWNPASMTKLMTMYLTLEAVNKGQLSLDDTVTMTNKEYIMSTLPELSNTKLYPGQVW  126

Query: 124 PIRELITMTAVPSSNVATIMIANHLSQNNPDAFIKRINETAKKLGMTKTHFYNPSGAVAS  183
              I +L+ +T    SSN A +++A  +S+N  D F+   +N  AK +GM  THF NP+GA  S
Sbjct: 127 TIADLLQITVSNSSNAAALILAKKVSKNTSD-FVDLMNNKAKAIGMKNTHFVNPTGAENS  185

Query: 184 AFNGLYSPKEYDNNATNVTTARDLSILTYHFLKKYPDILNYTKYPEVKAMVGTPYEETFT  243
                    ++P +Y +     VTTARD +IL H +K+ P IL++T      K +  T+   T+
Sbjct: 186 RLR-TFAPTKYKDQERTVTTARDYAILDLHVIKETPKILDFT-----KQLAPTTHAVTYY  239

Query: 244 TYNYSTPGAKFGLEGVDGLKTGSSPSAAFNALVTAKRQNTRLITVVLGVGDWSDQDGEYY  303
            T+N+S  GAK   L G DGLKTGSS +A +N  +T KR   R+  V++G GD+ +  GE
```

```
                           -continued
Sbjct: 240  TFNFSLEGAKMSLPGTDGLKTGSSDTANYNHTITTKRGKFRINQVIMGAGDYKNLGGEKQ  299

Query: 304  RHPFVNALVEKGFKDAKNISSKTPVLKAVKPKK                             336
            R+    NAL+E+ F   K +     + +  KK
Sbjct: 300  RNMMGNALMERSFDQYKYVKILSKGEQRINGKK                             332
```

A related DNA sequence was identified in *S. pyogenes* <SEQ ID 5767> which encodes the amino acid sequence <SEQ ID 5768>. Analysis of this protein sequence reveals the following:

```
Possible site: 23
>>> Seems to have a cleavable N-term signal seq.
INTEGRAL     Likelihood = −15.18   Transmembrane 371-387 (364-392)
----- Final Results -----
   bacterial membrane --- Certainty = 0.7071 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP:CAA62899 GB:X91786 penicillin-binding protein 4 [Staphylococcus aureus]
Identities = 119/328 (36%), Positives = 184/328 (55%), Gaps = 19/328 (5%)
Query:   6  ILTIFTFICF--SVMPLVHAEDVMDIT-----RQAGYT-VSEVNRPKSSIVVDANSSDIL   57
            +++I    +C   S+M         D+T      Q GY  +S     P S++ V + +  +L
Sbjct:   4  LISIIIILCLTLSIMTPYAQATNSDVTPVQAANQYGYAGLSAAYEPTSAVNV-SQTGQLL   62

Query:  58  WQDNIDIPRDPASMSKMFTLYILFEELAKGKITMDTTITATPTDQAIANIYEISNNNIVA  117
            +Q NID   +PASM+K+ T+Y+  E + KG++++D T+T T   +  ++ + E+SN    +
Sbjct:  63  YQYNIDTKWNPASMTKLMTMYLTLEAVNKGQLSLDDTVTMTNKEYIMSTLPELSNTKLYP  122

Query: 118  GVAYPIRDLITMTAVPSSNAATVMIANYLSNNDASAFIDRVNATAKQLGMTNTHFSNASG  177
            G  + I DL+ +T   SSNAA +++A  +S N   S F+D +N  AK +GM NTHF N +G
Sbjct: 123  GQVWTIADLLQITVSNSSNAAALILAKKVSKN-TSDFVDLMNNKAKAIGMKNTHFVNPTG  181

Query: 178  AAAQAFQGYYNPTKYDLSASNITTARDLSKLLYAFLKKYPEIISFTNKSVVHTMVGTPYE  237
            A    +  + PTKY      +TTARD + L    +K+ P+I+ FT +      T+    T
Sbjct: 182  AENSRLR-TFAPTKYKDQERTVTTARDYAILDLHVIKETPKILDFTKQLAPTTLAVT---  237

Query: 238  EEFHTYNHSLPDNQFGMKGVDGLKTGSSPSAAFNAMITAKRGKTRLITIVMGVGDWSDQN  297
            ++T+N SL    +   G DGLKTGSS +A +N  IT KRGK R+   ++MG GD+ +
Sbjct: 238  --YYTFNFSLEGAKMSLPGTDGLKTGSSDTANYNHTITTKRGKFRINQVIMGAGDYKNLG  295

Query: 298  GEFYRHPFVNALTEKGF---KDSKTLSK                                  322
            GE  R+    NAL E+ F     K   K LSK
Sbjct: 296  GEKQRNMMGNALMERSFDQYKYVKILSK                                  323
```

An alignment of the GAS and GBS proteins is shown below.

```
Identities = 226/382 (59%), Positives = 289/382 (75%), Gaps = 7/382 (1%)
Query:  12  LLSLTCVNSVQAEEHKDIMQITREAGYDVEDINKPKASIVID-NKGHILWEDNADLERDP   70
            + +  C + +       +D+M ITR+AGY V ++N+PK+SIV+D N   ILW+DN D+ RDP
Sbjct:   9  IFTFICFSVMPLVHAEDVMDITRQAGYTVSEVNRPKSSIVVDANSSDILWQDNIDIPRDP   68

Query:  71  ASMSKMFTLYLLFEDLAKGKTSLNTTVTATETDQAISKIYEISNNNIHAGVAYPIRELIT  130
            ASMSKMFTLY+LFE+LAKGK +++TT+TAT TDQAI+ IYEISNNNI AGVAYPIR+LIT
Sbjct:  69  ASMSKMFTLYILFEELAKGKITMDTTITATPTDQATANIYEISNNNIVAGVAYPIRDLIT  128

Query: 131  MTAVPSSNVATIMIANHLSQNNPDAFIKRINETAKKLGMTKTHFYNPSGAVASAFNGLYS  190
            MTAVPSSN AT+MIAN+LS N+  AFI R+N TAK+LGMT THF N SGA A AF G Y+
Sbjct: 129  MTAVPSSNAATVMIANYLSNNDASAFIDRVNATAKQLGMTNTHFSNASGAAAQAFQGYYN  188

Query: 191  PKEYDNNATNVTTARDLSILTYHFLKKYPDILNYTKYPEVKAMVGTPYEETFTTYNYSTP  250
            P +YD +A+N+TTARDLS L Y FLKKYP+I+++T      V   MVGTPYEE F TYN+S P
Sbjct: 189  PTKYDLSASNITTARDLSKLLYAFLKKYPEIISFTNKSVVHTMVGTPYEEEFHTYNHSLP  248

Query: 251  GAKFGLEGVDGLKTGSSPSAAFNALVTAKRQNTRLITVVLGVGDWSDQDGEYYRHPFVNA  310
            +FG++GVDGLKTGSSPSAAFNA++TAKR   TRLIT+V+GVGDWSDQ+GE+YRHPFVNA
Sbjct: 249  DNQFGMKGVDGLKTGSSPSAAFNAMITAKRGKTRLITIVMGVGDWSDQNGEFYRHPFVNA  308
```

```
Query:  311  LVEKGFKDAKNISSKT-PVLKAVKPKKEVTKTKTKSIQE--QPQTKEQWWTKTDQFIQSH  367
             L EKGFKD+K +S K      L+ + P+    TK +T S Q+  +   K+ +  + + F+  +
Sbjct:  309  LTEKGFKDSKTLSKKARQKLEKLVPQ---TKKETSSKQQHFKATKKQSYLERVEDFMNHN  365

Query:  368  FVSILIVLGTIAILCLLAGIVL                                       389
             +LI L   I  LL  +V+
Sbjct:  366  HTFLLICLAIFIITILLLSLVV                                       387
```

A related GBS gene <SEQ ID 8917> and protein <SEQ ID 8918> were also identified. Analysis of this protein sequence reveals the following:

Lipop: Possible site: −1 Crend: 9
McG: Discrim Score: −14.02
GvH: Signal Score (−7.5): −2.54
Possible site: 60
>>> Seems to have no N-terminal signal sequence
ALOM program   count: 1 value: −12.58 threshold: 0.0
INTEGRAL    Likelihood = −12.58   Transmembrane 339-355 (334-365)

-continued

PERIPHERAL   Likelihood = 1.38   99
modified ALOM score: 3.02
*** Reasoning Step: 3
----- Final Results -----
  bacterial membrane --- Certainty = 0.6031 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
ORF01254(301-1386 of 1698)
EGAD|40430|42591(32-419 of 431) penicillin binding protein 4 (pdp4)
{Staphylococcus aureus} GP|1125682|emb|CAA60585.1||X87105 penicillin binding
protein 4 {Staphylococcus aureus} GP|1125686|emb|CAA60582.1||X87104 penicillin
binding protein 4 {Staphylococcus aureus}
% Match = 17.3

% Identity = 36.3 % Similarity = 59.6
Matches = 123 Mismatches = 130 Conservative Sub.s = 79

264       294       324       351       381       411       441       471
FPLHFIIPDLCKLCAS*RHKDIMQITREAGY-DVKDINKPKASIVIDNKGHILWEDNADLERDPASMSKMFTLYLLFEDL
           :|    :  ||      :|   ::: :    |::|::  |  : :|| |    |:|||:  |:| : |  :|
ILCLTLSIMTPYAQAANSDVTPVQAANQYGYAGLSAAYEPTSAVNVSQTGQLLYQYNIDTKWNPASMTKLMTYLTLEAV
           20        30        40        50        60        70        80

501       531       561       591       621       651       681       711
AKGKTSLNTTVTATETDQAISKIYEISNNNIHAGVAYPIRELITMTAVPSSNVATIMIANHLSQNNPDAFIKRINETAKK
   ||: ||: |||    :    :| :  |:|    ::    |    : |:|: :|   ||| |     |:::|   :|:|   | |:    :| |||
NKGQLSLDDTVTMTNKEYIMSTLPELSNTKLYPGQVWTIADLLQITVSNSSNAAALILAKKVSKNTSD-FVDLMNNKAKA
           100       110       120       130       140       150       160

741       771       801       831       861       891       921       951
LGMTKTHFYNPSGAVASAFNGLYSPKEYDNNATNVTTARDLSILTYHFLKKYPDILNTYKYPEVKAMVGTPYEETFTTYN
 :||    |||  |||  ||:|   |      ::  :|    |      ||||||  :|:  |  |  ||:||     :   :       :  |:|
IGMKNTHFVNPTGAENSR-LRTFAPTKYKDQERTVTTARDYAILDLHVIKETPKILDFTK-----QLAPTTHAVTYYTFN
           180       190       200       210       220       230       240

981      1011      1041      1071      1101      1131      1161
YSTPGAKFGLEGVDGLKTGSSPSAAFNALVTAKRQNTRLITVVLGVGDWSDQDGEYYRHPFVNALVEKGFKDAK------
 :|    |||     |  |  |||||||||||   :|    :|       :|  ||   |::|  ||| :       |||:|: |       |
FSLEGAKMSLPGTDGLKTGSSDTANYNHTITTKRGKFRINQVIMGAGDYKNLGGEKQRNMMGNALMERSFDQYKYVKILS
               260       270       280       290       300       310       320

1179      1209      1239      1266
-----------------------------------------------NISSKTPVLKAVKPKKEVTKTKTKSI-QEQPQ
                                                  |   : |  :: :|    :    |   ||: :|:|
KGEQRINGKKYYVENDLYDVLPSDFSKKDYKLVVEDGKVHADYPREFINKDYRPPTVEVHQPIIQKANTVAKSMWEEHP-
               340       350       360       370       380       390       400

1296      1326      1356      1386      1416      1446      1476      1506
TKEQWWTKTDQFIQSHFVSILIVLGTIAILCLLAGIVLLIKRSR**LC*YKSPLHQ*HRGFLLSLEIFN*PTEPSIS*EI
                               ::    |       ||:||: |::
---------------------LFTIIGGACLVAGLALIVHMIINRLFRKRK
                                   410       420       430
```

SEQ ID 8918 (GBS379) was expressed in *E. coli* as a His-fusion product. SDS-PAGE analysis of total cell extract is shown in FIG. 68 (lane 5; MW 44 kDa). It was also expressed in *E. coli* as a GST-fusion product. SDS-PAGE analysis of total cell extract is shown in FIG. 72 (lane 3; MW 68.9 kDa).

GBS379-GST was purified as shown in FIG. 212, lane 7.

Based on this analysis, it was predicted that these proteins and their epitopes could be useful antigens for vaccines or diagnostics.

Example 1857

A DNA sequence (GBSx1964) was identified in *S. agalactiae* <SEQ ID 5769> which encodes the amino acid sequence <SEQ ID 5770>. Analysis of this protein sequence reveals the following:

---

Possible site: 49
\>>> Seems to have no N-terminal signal sequence
----- Final Results -----
    bacterial cytoplasm --- Certainty = 0.4039 (Affirmative) <succ>
    bacterial membrane --- Certainty = 0.0000 (Not Clear) <succ>
    bacterial outside --- Certainty = 0.0000 (Not Clear) <succ>

---

A related DNA sequence was identified in *S. pyogenes* <SEQ ID 5771> which encodes the amino acid sequence <SEQ ID 5772>. Analysis of this protein sequence reveals the following:

---

Possible site: 47
\>>> Seems to have no N-terminal signal sequence
----- Final Results -----
    bacterial cytoplasm --- Certainty = 0.3780 (Affirmative) <succ>
    bacterial membrane --- Certainty = 0.0000 (Not Clear) <succ>
    bacterial outside --- Certainty = 0.0000 (Not Clear) <succ>

---

The protein has homology with the following sequences in the GENPEPT database.

```
>GP:CAB15256 GB:Z99120 similar to hypothetical proteins [Bacillus subtilis]
Identities = 316/459 (68%), Positives = 386/459 (83%)
Query:   14 DLGEYKFGFHDDVKPIYSTGKGLNEAVIRELSAAKGEPEWMLDFRLKSLETFNKMPMQTW   73
            D+GEYK+GFHD    I+ + +GL + ++ E+S  K EP+WMLDFRLKSLE F  MPM  W
Sbjct:    7 DIGEYKYGFHDKDVSIFRSERGLTKEIVEEISRMKEEPQWMLDFRLKSLEHFYNMPMPQW   66

Query:   74 GADLSDIDFDDIIYYQKASDKPARDWDDVPEKIKETFERIGIPEAERAYLAGASAQYESE  133
            G DL+ ++FD+I YY K S++   R WD+VPE+IK+TF+++GIPEAE+ YLAG SAQYESE
Sbjct:   67 GGDLNSLNFDEITYYVKPSERSERSWDEVPEEIKQTFDKLGIPEAEQKYLAGVSAQYESE  126

Query:  134 VVYHNMKEEYDKLGIVFTDTDSALKEYPELFKKYFAKLVPPTDNKLAALNSAVWSGGTFI  193
            VVYHNMKE+ +  GIVF DTDSALKE  ++F++++AK++PPTDNK AALNSAVWSGG+FI
Sbjct:  127 VVYHNMKEDLEAQGIVFKDTDSALKENEDIFREHWAKVIPPTDNKFAALNSAVWSGGSFI  186

Query:  194 YVPKGVKVDIPLQTYFRINNENTGQFERTLIIVDEGASVHYVEGCTAPTYSSNSLHAAIV  253
            YVPKGVKV+ PLQ YFRIN+EN GQFERTLIIVDE ASVHYVEGCTAP Y++NSLH+A+V
Sbjct:  187 YVPKGVKVETPLQAYFRINSENMGQFERTLIIVDEEASVHYVEGCTAPVYTTNSLHSAVV  246

Query:  254 EIFALDGAYMRYTTIQNWSDNVYNLVTKRATAKKDATVEWIDGNLGAKTTMKYPSVYLDG  313
            EI    G Y RYTTIQNW++NVYNLVTKR   +++AT+EWIDGN+G+K TMKYP+  L G
Sbjct:  247 EIIVKKGGYCRYTTIQNMANNVYNLVTKRTVCEENATMEWIDGNIGSKLTMKYPACILKG  306

Query:  314 EGARGTMLSIAFANKGQHQDTGAKMIHNAPHTSSSIVSKSIAKGGGKVDYRGQVTFNKDS  373
            EGARG  LSIA A KGQHQD GAKMIH AP+TSS+IVSKSI+K GGKV YRG V F + +
Sbjct:  307 EGARGMTLSIALAGKGQHQDAGAKMIHLAPNTSSTIVSKSISKQGGKVTYRGIVHFGRKA  366

Query:  374 KKSVSHIECDTILMDDISKSDTIPFNEIHNSQVALEHEAKVSKISEEQLYYLMSRGLSEA  433
            + + S+IECDT++MD+ S SDTIP+NEI N  ++LEHEAKVSK+SEEQL+YLMSRG+SE
Sbjct:  367 EGARSNIECDTLIMDNKSTSDTIPYNEILNDNISLEHEAKVSKVSEEQLFYLMSRGISEE  426

Query:  434 EATEMIVMGFVEPFTKELPMEYAVELNRLISYEMEGSVG                      472
            EATEMIVMGF+EPFTKELPMEYAVE+NRLI +EMEGS+G
Sbjct:  427 EATEMIVMGFIEPFTKELPMEYAVEMNRLIKFEMEGSIG                      465
```

An alignment of the GAS and GBS proteins is shown below.

```
Identities = 445/472 (94%), Positives = 461/472 (97%)
Query:    1 MSEINEKVEPQPIDLGEYKFGFHDDVKPIYSTGKGLNEAVIRELSAAKGEPEWMLDFRLK   60
            MS+INEKVEP+PIDLG+Y+FGFHDDV+PIYSTGKGL+EAV+RELSAAK EPEWML+FRLK
```

```
                         -continued
Sbjct:   1  MSDINEKVEPKPIDLGDYQFGFHDDVEPIYSTKGKLSEAVVRELSAAKNEPEWMLEFRLK    60

Query:  61  SLETFNKMPMQTWGADLSDIDFDDIIYYQKASDKPARDWDDVPEKIKETFERIGIPEAER   120
            SLETFNKMPMQTWGADLSDI+FDDIIYYQKASDKPAR WDDVPEKIKETF+RIGIPEAER
Sbjct:  61  SLETFNKMPMQTWGADLSDINFDDIIYYQKASDKPARSWDDVPEKIKETFDRIGIPEAER   120

Query: 121  AYLAGASAQYESEVVYHNMKEEYDKLGIVFTDTDSALKEYPELFKKYFAKLVPPTDNKLA   180
            AYLAGASAQYESEVVYHNMK E++KLGI+FTDTDSALKEYP+LFK+YFAKLVPPTDNKLA
Sbjct: 121  AYLAGASAQYESEVVYHNMKGEFEKLGIIFTDTDSALKEYPDLFKQYFAKLVPPTDNKLA   180

Query: 181  ALNSAVWSGGTFIYVPKGVEVDIPLQTYFRINNENTGQFERTLIIVDEGASVHYVEGCTA   240
            ALNSA WSGGTFIYVPKGVKVDIPLQTYFRINNENTGQFERTLIIVDEGASVHYVEGCTA
Sbjct: 181  ALNSAAWSGGTFIYVPKGVKVDIPLQTYFRINNENTGQFERTLIIVDEGASVHYVEGCTA   240

Query: 241  PTYSSNSLHAAIVEIFALDGAYMRYTTIQNWSDNVYNLVTKRATAKKDATVEWIDGNLGA   300
            PTYSSNSLHAAIVEIFALDGAYMRYTTIQNWSDNVYNLVTKRA A  DATVEWIDGNLGA
Sbjct: 241  PTYSSNSLHAAIVEIFALDGAYMRYTTIQNWSDNVYNLVTKRARALTDATVEWIDGNLGA   300

Query: 301  KTTMKYPSVYLDGEGARGTMLSIAFANKGQHQDTGAKMIHNAPHTSSSIVSKSIAKGGGK   360
            KTTMKYPSVYLDG GARGTMLSIAFAN GQHQDTGAKMIHNAPHTSSSIVSKSIAK GGK
Sbjct: 301  KTTMKYPSVYLDGPGARGTMLSIAFANAGQHQDTGAKMIHNAPHTSSSIVSKSIAKSGGK   360

Query: 361  VDYRGQVTFNKDSKKSVSHIECDTILMDDISKSDTIPFNEIHNSQVALEHEAKVSKISEE   420
            VDYRGQVTFNK SKKSVSHIECDTILMDDISKSDTIPFNEIHNSQVALEHEAKVSKISEE
Sbjct: 361  VDYRGQVTFNKQSKKSVSHIECDTILMDDISKSDTIPFNEIHNSQVALEHEAKVSKISEE   420

Query: 421  QLYYLMSRGLSEAEATEMIVMGFVEPFTKELPMEYAVELNRLISYEMEGSVG           472
            QLYYLMSRGLSE+EATEMIVMGFVEPFTKELPMEYAVELNRLISYEMEGSVG
Sbjct: 421  QLYYLMSRGLSESEATEMIVMGFVEPFTKELPMEYAVELNRLISYEMEGSVG           472
```

Based on this analysis, it was predicted that these proteins and their epitopes could be useful antigens for vaccines or diagnostics.

Example 1858

A DNA sequence (GBSx1965) was identified in *S. agalactiae* <SEQ ID 5773> which encodes the amino acid sequence <SEQ ID 5774>. This protein is predicted to be nitrogen fixation protein (nifU). Analysis of this protein sequence reveals the following:

---
Possible site: 61
>>> Seems to have no N-terminal signal sequence
----- Final Results -----
   bacterial cytoplasm --- Certainty = 0.1078 (Affirmative) <succ>
   bacterial membrane --- Certainty = 0.0000 (Not Clear) <succ>
   bacterial outside --- Certainty = 0.0000 (Not Clear) <succ>
---

The protein has homology with the following sequences in the GENPEPT database.

A related DNA sequence was identified in *S. pyogenes* <SEQ ID 5775> which encodes the amino acid sequence <SEQ ID 5776>. Analysis of this protein sequence reveals the following:

---
Possible site: 14
>>> Seems to have no N-terminal signal sequence
----- Final Results -----
   bacterial cytoplasm --- Certainty = 0.1202 (Affirmative) <succ>
   bacterial membrane --- Certainty = 0.0000 (Not Clear) <succ>
   bacterial outside --- Certainty = 0.0000 (Not Clear) <succ>
---

An alignment of the GAS and GBS proteins is shown below.

```
>GP:CAB15257 GB:Z99120 similar to NifU protein homolog [Bacillus subtilis]
Identities = 72/139 (51%), Positives = 92/139 (65%)

Query:   4  SKLDNLYMAVVADHSKHPHHHGFLEGVEQVQLNNPTCGDVISLSVKFDGNIISDIAFAGN    63
            + LD LY V+ DH K+P + G L    V +NNPTCGD I L++K DG+I+ D   F G
Sbjct:   5  ANLDTLYRQVIMDHYKNPRNKGVLNDSIVVDMNNPTCGDRIRLTMKLDGDIVEDAKFEGE    64

Query:  64  GCTISTASSSMMTDAVIGKTKEEALQLADVFSKMVQGDQNPKQEKLGDAEFLAGVSKFPQ   123
            GC+IS AS+SMMT A+ GK  E AL ++ +FS M+QG +      LGD E L GVSKFP
Sbjct:  65  GCSISMASASMMTQAIKGKDIETALSMSKIFSDMMQGKEYDDSIDLGDIEALQGVSKFPA   124

Query: 124  RIKCATLSWNALRKAIERD                                           142
            RIKCATLSW AL K + ++
Sbjct: 125  RIKCATLSWKALEKGVAKE                                           143
```

```
Identities = 114/146 (78%), Positives = 133/146 (91%)
Query:   1  MALSKLDNLYMAVVADHSKHPHHHGFLEGVEQVQLMNPTCGDVISLSVKFDGNIISDIAF   60
            MALSKL++LYMAVVADHSK PHHHG L+GVE VQLNNPTCGDVISL+VKFD + I DIAF
Sbjct:   1  MALSKLNHLYMAVVADHSKRPHHHGQLDGVEAVQLNNPTCGDVISLTVKFDEDKIEDIAF   60

Query:  61  AGNGCTISTASSSMMTDAVIGKTKEEALQLADVFSKMVQGDQNPKQEKLGDAEFLAGVSK  120
            AGNGCTISTASSSMMTDAVIGK+KEEAL LAD+FS+MVQG +NP Q++LG+AE LAGV+K
Sbjct:  61  AGNGCTISTASSSMMTDAVIGKSKEEALALADIFSEMVQGQENPAQKELGEAELLAGVAK  120

Query: 121  FPQRIKCATLSWNALRKAIERDNQAE                                   146
            FPQRIKC+TL+WNAL++AI+R    A+
Sbjct: 121  FPQRIKCSTLAWNALKEAIKRSANAQ                                   146
```

Based on this analysis, it was predicted that these proteins and their epitopes could be useful antigens for vaccines or diagnostics.

Example 1859

A DNA sequence (GBSx1966) was identified in *S. agalactiae* <SEQ ID 5777> which encodes the amino acid sequence <SEQ ID 5778>. This protein is predicted to be nitrogen fixation protein (nifS) (b1680). Analysis of this protein sequence reveals the following:

---
Possible site: 43
>>> Seems to have no N-terminal signal sequence
----- Final Results -----
  bacterial cytoplasm --- Certainty = 0.2453 (Affirmative) <succ>
  bacterial membrane --- Certainty = 0.0000 (Not Clear) <succ>
  bacterial outside --- Certainty = 0.0000 (Not Clear) <succ>
---

The protein has homology with the following sequences in the GENPEPT database.

A related DNA sequence was identified in *S. pyogenes* <SEQ ID 5779> which encodes the amino acid sequence <SEQ ID 5780>. Analysis of this protein sequence reveals the following:

---
Possible site: 41
>>> Seems to have no N-terminal signal sequence
----- Final Results -----
  bacterial cytoplasm --- Certainty = 0.3714 (Affirmative) <succ>
  bacterial membrane --- Certainty = 0.0000 (Not Clear) <succ>
  bacterial outside --- Certainty = 0.0000 (Not Clear) <succ>
---

An alignment of the GAS and GBS proteins is shown below.

```
>GP:CAB15258 GB:Z99120 similar to NifS protein homolog [Bacillus subtilis]
Identities = 240/400 (60%), Positives = 306/400 (76%), Gaps = 5/400 (1%)

Query:   9  LKQDFPILNQLVNDEPLIYLDNAATTQKPNQVLEALRDYYQNDNANVHRGVHTLAERATA    68
            +++ FPIL+Q VN   L+YLD+AAT+QKP  V+E L  YY   N+NVHRGVHTL  RAT
Sbjct:   6  IREQFPILHQQVNGHDLVYLDSAATSQKPRAVIETLDKYYNQYNSNVHRGVHTLGTRATD    65

Query:  69  QYENAREKARQFLNAKLSKEILFTRGTTTGLNWVA-KFAESILERGDEVLISIMEHHSNI   127
             YE  AREK R+F+NAK   EI+FT+GTTT LN VA  +A + L+ GDEV+I+ MEHH+NI
Sbjct:  66  GYEGAREKVRKFINAKSMAETIFTKGTTTSLNMVALSYARANLKPGDEVVITYMEHHANI   125

Query: 128  IPWQQACERTGAKLVYAYLK-DGSLDLEDFYNKLSSKTKFVSLAHISNVLGCVTPVKAIA   186
            IPWQQA + TGA L Y L+ DG++ LED   ++S TK V+++H+SNVLG V P+K +A
Sbjct: 126  IPWQQAVKATGATLKYIPLQEDGTISLEDVRETVTSNTKIVAVSHVSNVLGTVNPIKEMA   185

Query: 187  ERVHQVGAYMVVDGAQSAPHMAIDVQDLDCDFFALSGHKMLGPTGIGVLYGKESILDKMP   246
            +  H  GA +VVDGAQS PHM IDVQDLDCDFFALS HKM GPTG+GVLYGK+++L+ M
Sbjct: 186  KIAHDNGAVIVVDGAQSTPHMKIDVQDLDCDFFALSSHKMCGPTGVGVLYGKKALLENME   245

Query: 247  PVEFGGEMIDFVYEQSATWKELPWKFEAGTPNIAGAIAFGEALDYLTDVGMDEIHQYEQS   306
            P EFGGEMIDFV   +TWKELPWKFEAGTP IAGAI  G A+D+L ++G+DEI ++E
Sbjct: 246  PAEFGGEMIDFVGLYESTWKELPWKFEAGTPIIAGAIGLGAAIDFLEEIGLDEISRHEHK   305

Query: 307  LVSYVLPKLQAIDGLTIYGPSDAESHVGVIAFNLEGLHPHDVATAMDYEGVAVRAGHHCA   366
            L +Y L + + +DG+T+YGP   E    G++ FNL+ +HPHDVAT +D EG+AVRAGHHCA
Sbjct: 306  LAAYALERFRQLDGVTVYGP---EERAGLVTFNLDDVHPHDVATVLDAEGIAVRAGHHCA   362

Query: 367  QPLINHLGIHSAVRASFYFYNTKEDCDKLVDAIQKTKEFF                      406
            QPL+  L + +  RASFY YNT+E+ DKLV+A+QKTKE+F
Sbjct: 363  QPLMKWLDVTATARASFYLYNTEEEIDKLVEALQKTKEYF                      402
```

```
Identities = 293/408 (71%), Positives = 349/408 (84%)
Query:   3 LLDSYKLKQDFPILNQLVNDEPLIYLDNAATTQKPNQVLEALRDYYQNDNANVHRGVHTL   62
           LLD+ +KQDF ILNQ VNDEPL+YLDNAATTQKP  VLEAL+ YYQ DNANVHRGVHTL
Sbjct:   1 LLDAKDIKQDFQILNQQVNDEPLVYLDNAATTQKPALVLEALQSYYQEDNANVHRGVHTL   60

Query:  63 AERATAQYENAREKARQFLNAKLSKEILFTRGTTTGLNKVAKFAESILERGDEVLISIME  122
           AERAT +YE +R++    F++AK SKE+LFTRGTTT LNWVA+FAE +L   DEVLISIME
Sbjct:  61 AERATLKYEASRQQVADFIHAKSSKEVLFTRGTTTSLNWVARFAEQVLTPEDEVLISIME  120

Query: 123 HHSNIIPWQQACERTGAKLVYAYLKAGSLDLEDFYNKLSSKTKFVSLAHISNVLGCVTPV  182
           HH+NIIPWQQAC++TGA+LVY YLKDG LD++D NKL++KT+FVSL H+SNVLGC+ P+
Sbjct: 121 HHANIIPWQQACQKTGARLVYVYLKDGQLDMDDLANKLTTKTRFVSLVHVSNVLGCINPI  180

Query: 183 KAIAERVHQVGAYMVVDGAQSAPHMAIDVQDLDCDFFALSGHKMLGPTGIGVLYGKESIL  242
           K IA+  H GAY+VVDGAQS PH+AIDVQDLDCDFFA S HKMLGPTG+GVLYGKE +L
Sbjct: 181 KEIAKLAHAKGAYLVVDGAQSVPHLAIDVQDLDCDFFAFSAHKMLGPTGLGVLYGKEELL  240

Query: 243 DKMPPVEFGGEMIDFVYEQSATWKELPWKFEAGTPNIAGAIAFGEALDYLTDVGMDEIHQ  302
           +++ P+EFGGEMIDFVYEQ ATWKELPWKFEAGTP+IAGAI    A+  YL  +GM +IH
Sbjct: 241 NQVEPLEFGGEMIDEVYEQEATWKELPWKFEAGTPHIAGAIGLSAAISYLQRLGMADIHA  300

Query: 303 YEQSLVSYVLPKLQAIDGLTIYGPSDAESHVGVIAFNLEGLHPHDVATAMDYEGVAVRAG  362
           +E  L++YVLPKL+AI+GLTIYGPS   +  G+I+FNL+ LHPHD+ATA+DYEGVAVRAG
Sbjct: 301 HEAELIAYVLPKLEAIEGLTIYGPSQPSARSGLISFNLDDLHPHDLATALDYEGVAVRAG  360

Query: 363 HHCAQPLINHLGIHSAVRASFYFYNTKEDCDKLVDAIQKTKEFFNGTL              410
           HHCAQPL+++LG+ + VRASFY YNTK DCD+LV+AI K KEFFNGTL
Sbjct: 361 HHCAQPLLSYLGVPATVRASFYIYNTKADCDRLVEAILKAKEFFNGIL              408
```

Based on this analysis, it was predicted that these proteins and their epitopes could be useful antigens for vaccines or diagnostics.

Example 1860

A DNA sequence (GBSx1967) was identified in *S. agalactiae* <SEQ ID 5781> which encodes the amino acid sequence <SEQ ID 5782>. Analysis of this protein sequence reveals the following:

Possible site: 14
>>> Seems to have no N-terminal signal sequence
----- Final Results -----
  bacterial cytoplasm --- Certainty = 0.1441 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:BAB07189 GB:AP001518 unknown conserved protein [Bacillus halodurans]
Identities = 171/430 (39%), Positives = 267/430 (61%), Gaps = 15/430 (3%)
Query:   1 MSKEAILNFLQAKGEPTWLQELRLKAFEKIEELELPVIERVKFHRWNLG--DGTILENDY   58
           + KE + +F  A+ EP W +++RLK FE +E LELP ++ K   WN    D  + E
Sbjct:   9 IDKEYVQSFSDARNEPQWFKDIRLKGFELVETLELPKPDKTKITSWNFTNFDHKLPEVSP   68

Query:  59 TANVPDFTE---------LGNNPKLVQIGTQTVLEQVPMELIEKGVVFTDFYSALEEIPE  109
           A++ + +                 LVQ    V ++   L  KGV+FTD  +A++E +
Sbjct:  69 VASIDELRDEVKGLIGEASDTQNLLVQRDATVVYSKLDEALKAKGVIFTDLLTAVKEHGD  128

Query: 110 VIERYFGK-ARPFEEDRLAAYHTAYFNSGAVLYIPDNVEITQPIEGLFYQDSQSKVPFNK  168
           ++E+Y+ K A   +E+RL A H A  N G  +Y+P NVEI  P++ +F+ D++        FN
Sbjct: 129 LVEKYYMKDAVKVDENRLTALHAALVNGGTFINVPRNVEIEVPLQSVFWFDTEKAGLFN-  187

Query: 169 HILLIVGKNAKVSYLERFESIGDGTERTSANISVEVIAQAGSQIKFASIDRLGENVTTFI  228
           H++++    N+ ++Y+E + S G  +E    ANI VEV A A +++  F ++D L    VTT++
Sbjct: 188 HVIIVAEDNSSITYVENYASFG--SEEAVANIVVEVFAGANAKVSFGAVDNLAAGVTTYV  245

Query: 229 SRRGRHSSDATIDWALGVMNEGNVVADFDSDLIGDGSHANLKVVAASSGRQVQGIDTRVT  288
           RR      D+ ++WALG MN+GN V++  + L+GD S A+ K V+   G Q Q   T++
Sbjct: 246 VRRAHVGRDSRVEWALGQMNDGNTVSENTTHLLGDNSWADTKTVSVGRGEQKQNFTTQIF  305

Query: 289 NYGCNSVGHILQHGVILERGTLTFNGIGHIIKGAKGADAQQESRVLMLSDKARSDANPIL  348
           ++G +S G+IL+HGV+ E  T  FNGI  I  GA +   +Q  RVLMLS+KAR DANPIL
Sbjct: 306 HHGKHSEGYILKHGVMREAATSIFNGISKIEHGATKSHGEQTERVLMLSEKARGDANPIL  365

Query: 349 LIDENDVTAGHAASIGQVDPEDLYYLMSRGLNQKTAEQLVIRGFLGTVIAEIPVKEVRDE  408
           LIDE+DVTAGHAAS+G++DP ++YLMSRG+++  AE+LVI GFL V+ ++P++ V++
Sbjct: 366 LIDEDDVTAGHAASVGKIDPIQMFYLMSRGISRAEAERLVIHGFLAPVVGQLPIESVKER  425

Query: 409 MIAVIDTKLE                                                    418
           ++  I+ K++
Sbjct: 426 LVEAIERKVK                                                    435
```

A related DNA sequence was identified in *S. pyogenes* <SEQ ID 5783> which encodes the amino acid sequence <SEQ ID 5784>. Analysis of this protein sequence reveals the following:

```
Possible site: 14
>>> Seems to have no N-terminal signal sequence
INTEGRAL    Likelihood = -0.80   Transmembrane 387-403 (387-403)
----- Final Results -----
   bacterial membrane --- Certainty = 0.1319 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP:CAB15259 GB:Z99120 similar to hypothetical proteins [Bacillus subtilis]
Identities = 177/428 (41%), Positives = 267/428 (62%), Gaps = 15/428 (3%)
Query:   3  KEKLVAFSQAHAEPAWLQERRLAALEAIPNLELPTIERVKFHRWNLGDGT--LTENESLA    60
            +E L +FS+ H EPAWL+  RL ALE   +L +P ++ K  WN +      +NE L+
Sbjct:  11  QEYLKSFSEKHQEPAWLKNLRLQALEQAEDLPMPKPDKTKITNWNFTNFAKHTVDNEPLS    70

Query:  61  SVPDF-------IAIGDNPKLVQVGTQTVLEQLPMA--LIDKGVVFSDFYTALEEIPEVI   111
            S+ D        I I +  K + V       L ++   L DKGV+F+D  TA  E  +++
Sbjct:  71  SLEDLTDEVKALIDIENEDKTLYVQRDQTPAHLSLSQELKDKGVIFTDILTAAREHSDLV   130

Query: 112  EAHFGQ-ALAFDEDKLAAYHTAYFNSAAVLYVPDHLEITTPIEAIFLQDSDSDVPFNKHV   170
            E +F + +  DE KL A H A  N  A LYVP ++++ TP++A+++ +S+     FN HV
Sbjct: 131  EKYFMKDGVKVDEHKLTALHAALVNGGAFLYVPKNVQVETPVQAVYVHESNDTALFN-HV   189

Query: 171  LVIAGKESKFTYLERFESIGNATQKISANISVEVIAQAGSQIKFSAIDRLGPSVTTYISR   230
            L++A    S  TY+E + S N    + NI EVI     + + A+D L    VTTY++R
Sbjct: 190  LIVAEDHSSVTYVENYISTVNPKDAVF-NIISEVITGDNASVTYGAVDNLSSGVTTYVNR   248

Query: 231  RGRLE-KDANIDWALAVMNEGNVIADFDSDLIGQGSQADLKVVAASSGRQVQGIDTRVTN   289
            RG    +D+ I+WAL +MN+G+ I++   ++L G G+  D K V    G Q +   T++ +
Sbjct: 249  RGAARGRDSKIEWALGLMNDGDTISENTTNLYGDGTYGDTKTVVVGRGEQTENFTTQIIH   308

Query: 290  YGQRTVGHILQHGVILERGTLTFNGIGHILKDAKGADAQQESRVLMLSDQARADANPILL   349
            +G+ + G+IL+HGV+ +  +  FNGIG I   A  A+A+QESRVLMLS++AR DANPILL
Sbjct: 309  FGKASEGYILKHGVMKDSASSIFNGIGKIEHGASKANAEQESRVLMLSEKARGDANPILL   368

Query: 350  IDENEVTAGHAASIGQVDPEDMYYLMSRGLDQETAERLVIRGFLGAVIAEIPIPSVRQEI   409
            IDE++VTAGHAAS+G+VDP  +YYLMSRG+ +E AERLVI GFL V+ E+PI  V++++
Sbjct: 369  IDEDDVTAGHAASVGRVDPIQLYYLMSRGIPKEEAERLVIYGFLAPVVNELPIEGVKKQL   428

Query: 410  IKVLDEKL                                                       417
            + V++ K+
Sbjct: 429  VSVIERKV                                                       436
```

An alignment of the GAS and GBS proteins is shown below.

```
Identities = 322/420 (76%), Positives = 368/420 (86%)
Query:   1  MSKEAILNFLQAKGEPTWLQELRLKAFEKIEELELPVIERVKFHRWNLGDGTILENDYTA    60
            M+KE ++ F QA  EP WLQE RL A E I  LELP IERVKFHRWNLGDGT+ EN+ A
Sbjct:   1  MTKEKLVAFSQAHAEPAWLQERRLAALEAIPNLELPTIERVKFHRWNLGDGTLTENESLA    60

Query:  61  NVPDFTELGNNPKLVQIGTQTVLEQVPMELIEKGVVFTDFYSALEEIPEVIERYFGKARP   120
            +VPDF  +G+NPKLVQ+GTQTVLEQ+PM LI+KGVVF+DFY+ALEEIPEVIE +FG+A
Sbjct:  61  SVPDFIAIGDNPKLVQVGTQTVLEQLPMALIDKGVVFSDFYTALEEIPEVIEAHFGQALA   120

Query: 121  FEEDRLAAYHTAYFNSGAVLYIPDNVEITQPIEGLFYQDSQSKVPFNKHILLIVGKNAKV   180
            F+ED+LAAYHTAYFNS AVLY+PD++EIT PIE +F QDS S VPFNKH+L+I GK +K
Sbjct: 121  FDEDKLAAYHTAYFNSAAVLYVPDHLEITTPIEAIFLQDSDSDVPFNKHVLVIAGKESKF   180

Query: 181  SYLERFESIGDGTERTSANISVEVIAQAGSQIKFASIDRLGENVTTFISRRGRHSSDATI   240
            +YLERFESIG+ T++ SANISVEVIAQAGSQIKF++IDRLG +VTT+ISRRGR   DA I
Sbjct: 181  TYLERFESIGNATQKISANISVEVIAQAGSQIKFSAIDRLGPSVTTYISRRGRLEKDANI   240

Query: 241  DWALGVMNEGNVVADFDSDLIGDGSHANLKVVAASSGRQVQGIDTRVTNYGCNSVGHILQ   300
            DWAL VMNEGNV+ADFDSDLIG GS A+LKVVAASSGRQVQGIDTRVTNYG  +VGHILQ
Sbjct: 241  DWALAVMNEGNVIADFDSDLIGQGSQADLKVVAASSGRQVQGIDTRVTNYGQRTVGHILQ   300
```

```
Query: 301  HGVILERGTLTFNGIGHIIKGAKGADAQQESRVLMLSDKARSDANPILLIDENDVTAGHA  360
            HGVILERGTLTFNGIGHI+K AKGADAQQESRVLMLSD+AR+DANPILLIDEN+VTAGHA
Sbjct: 301  HGVILERGTLTFNGIGHILKDAKGADAQQESRVLMLSDQARADANPILLIDENEVTAGHA  360

Query: 361  ASIGQVDPEDLYYLMSRGLNQKTAEQLVIRGFLGTVIAEIPVKEVRDEMIAVIDTKLEKR  420
            ASIGQVDPED+YYLMSRGL+Q+TAE+LVIRGFLG VIAEIP+  VR E+I V+D KL  R
Sbjct: 361  ASIGQVDPEDMYYLMSRGLDQETAERLVIRGFLGAVIAEIPIPSVRQEIIKVLDEKLLNR  420
```

Based on this analysis, it was predicted that these proteins and their epitopes could be useful antigens for vaccines or diagnostics.

Example 1861

A DNA sequence (GBSx1968) was identified in *S. agalactiae* <SEQ ID 5785> which encodes the amino acid sequence <SEQ ID 5786>. This protein is predicted to be ABC transporter, ATP-binding protein, Ycf16 family. Analysis of this protein sequence reveals the following:

Possible site: 59
>>> Seems to have no N-terminal signal sequence
----- Final Results -----
  bacterial cytoplasm --- Certainty = 0.2253 (Affirmative) <succ>
  bacterial membrane --- Certainty = 0.0000 (Not Clear) <succ>
  bacterial outside --- Certainty = 0.0000 (Not Clear) <succ>

A related DNA sequence was identified in *S. pyogenes* <SEQ ID 5787> which encodes the amino acid sequence <SEQ ID 5788>. Analysis of this protein sequence reveals the following:

Possible site: 48
>>> Seems to have no N-terminal signal sequence
----- Final Results -----
  bacterial cytoplasm --- Certainty = 0.2417 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:CAB15260 GB:Z99120 similar to ABC transporter (ATP-binding
protein) [Bacillus subtilis]
Identities = 180/250 (72%), Positives = 212/250 (84%)
Query:   2  SVLEIKNLHVSIEDKEILKGLNLTLKTGEIAAIMGPNGTGKSTLSAAIMGNPNYEVTAGE   61
            S L IK+LHV IE KEILKG+NL +K GE   A+MGPNGIGKSTLSAAIMG+P YEVT G
Sbjct:   4  STLTIKDLHVEIEGKEILKGVNLEIKGGEFHAVMGPNGTGKSTLSAAIMGHPKYEVTKGS   63

Query:  62  ILFDGEDILELEVDERARLGLFLAMQYPSEVPGITNAEFIRAAMNAGKADDDKISIRQFI  121
            I  DG+D+LE+EVDERA+ GLFLAMQYPSE+ G+TNA+F+R+A+NA + + D+IS+ +FI
Sbjct:  64  ITLDGKDVLEMEVDERAQAGLFLAMQYPSEISGVTNADFLRSAINARREEGDEISLMKFI  123

Query: 122  TKLDEKMELLGMKEEMAERYLNEGFSGGEKKRNEILQLLMLEPKFALLDEIDSGLDIDAL  181
             K+DE ME L M  EMA+RYLNEGFSGGEKKRNEILQL+M+EPK A+LDEIDSGLDIDAL
Sbjct: 124  RKMDENMEFLEMDPEMAQRYLNEGFSGGEKKRNEILQLMMIEPKIAILDEIDSGLDIDAL  183

Query: 182  KVVSKGVNEMRGEGFGAMIITHYQRLLNYITPDKVHVMMDGKVVLSGGPELAVRLEKEGY  241
            KVVSKG+N+MR E FG ++ITHYQRLLNYITPD VHVMM G+VV SGG ELA RLE EGY
Sbjct: 184  KVVSKGINKMRSENFGCLMITHYQRLLNYITPDVVHVMMQGRVVKSGGAELAQRLEAEGY  243

Query: 242  AQIAEELGLE                                                   251
            I +ELG+E
Sbjct: 244  DWIKQELGIE                                                   253
```

An alignment of the GAS and GBS proteins is shown below.

```
Identities = 225/255 (88%), Positives = 241/255 (94%)
Query:   1  MSVLEIKNLHVSIEDKEILKGLNLTLKTGEIAAIMGPNGTGKSTLSAAIMGNPNYEVTAG   60
            MS+LEI NLHVSIE KEILKG+NLTLKTGE+AAIMGPNGTGKSTLSAAIMGNPNYEVT G
Sbjct:   1  MSILEINNLHVSIEGKEILKGVNLTLKTGEVAAIMGPNGTGKSTLSAAIMGNPNYEVTQG   60

Query:  61  EILFDGEDILELEVDERARLGLFLAMQYPSEVPGITNAEFIRAAMNAGKADDDKISIRQF  120
            +IL DG +IL+LEVDERARLGLFLAMQYPSE+PGITNAEF+RAAMNAGKAD+DKIS+R F
Sbjct:  61  QILLDGVNILDLEVDERARLGLFLAMQYPSEIPGITNAEFMRAAMNAGKADEDKISVRDF  120

Query: 121  ITKLDEKMELLGMKEEMAERYLNEGFSGGEKKRNEILQLLMLEPKFALLDEIDSGLDIDA  180
            ITKLDEKM LLGMKEEMAERYLNEGFSGGEKKRNEILQLLMLEPKFALLDEIDSGLDIDA
```

-continued

```
Sbjct: 121  ITKLDEKMALLGMKEEMAERYLNEGFSGGEKKRNEILQLLMLEPKFALLDEIDSGLDIDA  180

Query: 181  LKVVSKGVNEMRGEGFGAMIITHYQRLLNYITPDKVHVMMDGKVVLSGGPELAVRLEKEG  240
            LKVVSKGVNEMRG+ FGAMIITHYQRLLNYITPD VHVMMDG++VLSG  LA RLEKEG
Sbjct: 181  LKVVSKGVNEMRGKDFGAMIITHYQRLLNYITPDLVHVMMDGRIVLSGDAALATRLEKEG  240

Query: 241  YAQIAEELGLEYKEE                                              255
            YA IA++LG+EYKEE
Sbjct: 241  YAGIAQDLGIEYKEE                                              255
```

Based on this analysis, it was predicted that these proteins and their epitopes could be useful antigens for vaccines or diagnostics.

Example 1862

A DNA sequence (GBSx1969) was identified in *S. agalactiae* <SEQ ID 5789> which encodes the amino acid sequence <SEQ ID 5790>. This protein is predicted to be RgpG (rfe). Analysis of this protein sequence reveals the following:

Possible site: 40
>>> Seems to have an uncleavable N-term signal seq
INTEGRAL   Likelihood = −12.10   Transmembrane 312-328 (308-336)
INTEGRAL   Likelihood = −10.03   Transmembrane 15-31    (6-41)
INTEGRAL   Likelihood = −9.82    Transmembrane 205-221 (197-226)
INTEGRAL   Likelihood = −8.60    Transmembrane 335-351 (329-358)
INTEGRAL   Likelihood = −7.48    Transmembrane 257-273 (255-281)
INTEGRAL   Likelihood = −5.52    Transmembrane 60-76    (56-79)
INTEGRAL   Likelihood = −5.31    Transmembrane 151-167 (148-171)
INTEGRAL   Likelihood = −4.88    Transmembrane 91-107   (90-108)
INTEGRAL   Likelihood = −4.78    Transmembrane 184-200 (177-203)
INTEGRAL   Likelihood = −3.13    Transmembrane 119-135 (119-135)
INTEGRAL   Likelihood = −2.97    Transmembrane 229-245 (229-250)
----- Final Results -----
  bacterial membrane --- Certainty = 0.5840 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 8919> which encodes amino acid sequence <SEQ ID 8920> was also identified. Analysis of this protein sequence reveals the following:

Lipop: Possible site: −1   Crend: 10
McG: Discrim Score: 5.18
GvH: Signal Score (−7.5): −6.19
Possible site: 15
>>> Seems to have an uncleavable N-term signal seq
ALOM program count: 9 value: −12.10 threshold: 0.0
INTEGRAL   Likelihood = −12.10   Transmembrane 239-255 (235-263)
INTEGRAL   Likelihood = −9.82    Transmembrane 132-148 (124-153)
INTEGRAL   Likelihood = −8.60    Transmembrane 262-278 (256-285)
INTEGRAL   Likelihood = −7.48    Transmembrane 184-200 (182-208)
INTEGRAL   Likelihood = −5.31    Transmembrane 78-94    (75-98)
INTEGRAL   Likelihood = −4.88    Transmembrane 18-34    (17-35)
INTEGRAL   Likelihood = −4.78    Transmembrane 111-127 (104-130)
INTEGRAL   Likelihood = −3.13    Transmembrane 46-62    (46-62)
INTEGRAL   Likelihood = −2.97    Transmembrane 156-172 (156-177)
PERIPHERAL Likelihood = 12.63    284
modified ALOM score: 2.92
*** Reasoning Step: 3
----- Final Results -----
  bacterial membrane --- Certainty = 0.5840 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the GENPEPT database.

```
>GP:BAA82114 GB:AB022909 RgpG [Streptococcus mutans]
Identities = 266/382 (69%), Positives = 317/382 (82%)
Query:  10  TIEYIFVLIGAFLLSIILTPIIRVISLKVGAVDKPNARRINKVPMPSSGGLAIFLSFVVT   69
            T++++ VLI   L S++LTP++R  +L+VGAVD PNARRINKVPMPS+GGLAI +SFV+
Sbjct:   7  TLKFVLVLIATLLTSLVLTPLVRFFALRVGAVDNPNARRINKVPMPSAGGLAIIISFVIA   66

Query:  70  TLFFMPMAASRHFIEVSYFHYILPVIIGGLVVITTGFIDDIFELRPRYKMLGIIIAAIII  129
            TL  MPM       SYF YILPV++G LV+  TGFIDD++EL P+ K LGI++ A+II
Sbjct:  67  TLALMPMILKTQIGGKSYFEYILPVVLGALVIALTGFIDDVYELSPKIKFLGILLGAVII  126

Query: 130  WKFTHFRFDSFKIPIGGPLLEFGPILTFFLTVLWIISITNAINLIDGLDGLVSGVSIISL  189
            W FT FRFDSFKIP GGP+L F P L+FFLT+LW+++ITNA+NLIDGLDGLVSGVS+ISL
Sbjct: 127  WIFTDFRFDSFKIPFGGPMLHFNPFLSPFFLTILWVVAITNAVNLIDGLDGLVSGVSMISL  186

Query: 190  ATMAVVSYFFLPKIDFFLTLTIVILIASIVGFFPYNYHPAIIYLGDAGALFIGFMIGVLS  249
             TM +VSYFFL   D FLTLTI +LI +I GFFPYNYHPAIIYLGD GALFIGFMI VLS
Sbjct: 187  TTMGLVSYFFLYDTDIFLTLTIFVLIFAIAGFFPYNYHPAIIYLGDTGALFIGFMISVLS  246

Query: 250  LQGLKNSTAVAVITPVIILGVPILDTAVAIVRRKLSGKKISEADKMHLHHRLLSMGFTHR  309
            LQGLKN+TAVAV+TP+I+LGVPI+DT VAI+RR LSG+K  EAD MHLHHRLL MGFTHR
Sbjct: 247  LQGLKNATAVAVVTPIIVLGVPIVDTTVAIIRRILSGQKFYEADNMHLHHRLLAMGFTHR  306

Query: 310  GAVLVVYGIAIIFSLIALLLNVSSRIGGIFLLLALLLAMEIFIEGLNIWGENRIPLFNLL  369
            GAVLVVYGIA+ FSL++LLLNVSSR+GGI L++ + A+EIFIEGL IWG  RTPLF LL
Sbjct: 307  GAVLVVYGIAMFFSLVSLLLNVSSRLGGILLMIGVAFALEIFIEGLEIWGPKRTPLFRLL  366

Query: 370  KFIGNSDYRQSVIAKYSDKHQK                                       391
            FIGNSDYRQ V+AKY   K +K
Sbjct: 367  AFIGNSDYRQEVVAKYRRKKKK                                       388
```

A related DNA sequence was identified in *S. pyogenes* <SEQ ID 5791> which encodes the amino acid sequence <SEQ ID 5792>. Analysis of this protein sequence reveals the following:

```
Possible site: 32
>>> Seems to have an uncleavable N-term signal seq
INTEGRAL    Likelihood = -8.28   Transmembrane   9-25    (1-33)
INTEGRAL    Likelihood = -8.17   Transmembrane 201-217 (198-221)
INTEGRAL    Likelihood = -7.64   Transmembrane 308-324 (305-329)
INTEGRAL    Likelihood = -7.17   Transmembrane  55-71   (51-74)
INTEGRAL    Likelihood = -7.06   Transmembrane 145-161 (138-170)
INTEGRAL    Likelihood = -6.58   Transmembrane 260-276 (251-278)
INTEGRAL    Likelihood = -6.21   Transmembrane 180-196 (172-198)
INTEGRAL    Likelihood = -5.95   Transmembrane 331-347 (330-353)
INTEGRAL    Likelihood = -5.68   Transmembrane  87-103  (82-104)
INTEGRAL    Likelihood = -3.93   Transmembrane 113-129 (112-133)
INTEGRAL    Likelihood = -2.60   Transmembrane 233-249 (232-250)
----- Final Results -----
    bacterial membrane --- Certainty = 0.4312 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the databases:

```
>GP:BAA82114 GB:AB022909 RgpG [Streptococcus mutans]
Identities = 289/381 (75%), Positives = 334/381 (86%), Gaps = 1/381 (0%)
Query:   5  TIDYVLVLIGALLMSLFLTPLVRFLAFRVGAVDNPNARRVNKVPMPTSGGLAIFMSFLVA   64
            T+ +VLVLI  LL SL LTPLVRF A RVGAVDNPNARR+NKVPMP++GGLAI +SF++A
Sbjct:   7  TLKFVLVLIATLLTSLVLTPLVRFFALRVGAVDNPNARRINKVPMPSAGGLAIIISFVIA   66

Query:  65  SLGLIPIASKGAMFFGQTYFSYILPVVIGATVITLTGFLDDLYELSPKLKMFGILIGAVI  124
            +L L+P+  K    G++YF YILPVV+GA VI LTGF+DD+YELSPK+K  GIL+GAVI
Sbjct:  67  TLALMPMILK-TQIGGKSYFEYILPVVLGALVIALTGFIDDVYELSPKIKFLGILLGAVI  125

Query: 125  VWAFTDFKFDSFKIPFGGPLLVFGPFLTLFLTVLWIVSITNAINLIDGLDGLVSGVSIIS  184
            +W FTDF+FDSFKIPFGGP+L F PFL+ FLT+LW+V+ITNA+NLIDGLDGLVSGVS+IS
Sbjct: 126  IWIFTDFRFDSFKIPFGGPMLHFNPFLSFFLTILWVVAITNAVNLIDGLDGLVSGVSMIS  185

Query: 185  LVTMAIVSYFFLPQKDFFLTLTILVLISAIAGFFPYNYHPAMIYLGDTGALFIGFMIGVL  244
            L TM +VSYFFL    D  FLTLTI VLI AIAGFFPYNYHPA+IYLGDTGALFIGFMI VL
Sbjct: 186  LTTMGLVSYFFLYDTDIFLTLTIFVLIFAIAGFFPYNYHPAIIYLGDTGALFIGFMISVL  245

Query: 245  SLQGLKNSTAVAVVTPVIILGVPIMDTIVAIIRRSLSGQKFYEPDKMHLHHRLLSMGFTH  304
            SLQGLKN+TAVAVVTP+I+LGVPI+DT VAIIRR+LSGQKFYE D MHLHHRLL+MGFTH
Sbjct: 246  SLQGLKNATAVAVVIPIIVLGVPIVDTTVAIIRRTLSGQKFYEADNMHLHHRLLAMGFTH  305

Query: 305  RGAVLVVYGITMLFSLISLLLNVSSRIGGVLLMLGLLFGLEVFIEGLEIWGEKRTPLFNL  364
            RGAVLVVYGI M FSL+SLLLNVSSR+GG+LLM+G+ F LE+FIEGLEIWG KRTPLF L
Sbjct: 306  RGAVLVVYGIAMFFSLVSLLLNVSSRLGGILLMIGVAFALEIFIEGLEIWGPKRTPLFRL  365

Query: 365  LKFIGNSDYRQAMLLKWKEKK                                         385
            L FIGNSDYRQ ++ K++ KK
Sbjct: 366  LAFIGNSDYRQEVVAKYRRKK                                         386
```

An alignment of the GAS and GBS proteins is shown below.

```
Identities = 282/384 (73%), Positives = 334/384 (86%), Gaps = 1/384 (0%)
Query:   6  MIPFTIEYIFVLIGAFLLSIILTPIIRVISLKVGAVDKPNARRINKVPMPSSGGLAIFLS   65
            M  FTI+Y+  VLIGA L+S+ LTP++R ++  +VGAVD PNARR+NKVPMP+SGGLAIF+S
Sbjct:   1  MFSFTIDYVLVLIGALLMSLFLTPLVRFLAFRVGAVDNPNARRVNKVPMPTSGGLAIFMS   60

Query:  66  FVVTTLFFMPMAAS-RHFIEVSYPHYILPVIIGGLVVTTTGFIDDIFELRPRYKMLGIII  124
            F+V +L  +P+A+    F   +YF YILPV+IG  V+T TGF+DD++EL P+ KM GI+I
Sbjct:  61  FLVASLGLIPIASKGAMFFGQTYFSYILPVVIGATVITLTGFLDDLYELSPKLKMFGILI  120

Query: 125  AAIIIWKFTHFRFDSFKIPIGGPLLEFGPILTFFLTVLWIISITNAINLIDGLDGLVSGV  184
            A+I+W FT F+FDSFKIP GGPLL FGP LT FLTV+MI+SITNAINLIDGLDGLVSGV
Sbjct: 121  GAVIVWAFTDFKFDSFKIPFGGPLLVFGPFLTLFLTVLWIVSITNAINLIDGLDGLVSGV  180

Query: 185  SIISLATMAVVSYFFLPKIDFFLTLTIVILIASIVGFFPYNYHPAIIYLGDAGALFIGFM  244
```

```
                            -continued
            SIISL TMA+VSYFFLP+ DFFLTLTI++LI++I GFFPYNYHPA+IYLGD GALFIGFM
Sbjct: 181  SIISLVTMAIVSYFFLPQKDFFLTLTILVLISAIAGFFPYNYHPAMIYLGDTGALFIGFM  240

Query: 245  IGVLSLQGLKNSTAVAVITPVIILGVPILDTAVAIVRRKLSGKKISEADKMHLHHRLLSM  304
            IGVLSLQGLKNSTAVAV+TPVIILGVPI+DT VAI+RR LSG+K  E DKMHLHHRLLSM
Sbjct: 241  IGVLSLQGLKNSTAVAVVTPVIILGVPIMDTIVAIIRRSLSGQKFYEPDKMHLHHRLLSM  300

Query: 305  GFTHRGAVLVVYGIAIIFSLIALLLNVSSRIGGIFLLLALLLAMEIFIEGLNIWGENRTP  364
            GFTHRGAVLVVYGI ++FSLI+LLLNVSSRIGG+ L+L LL  +E+FIEGL IWGE RTP
Sbjct: 301  GFTHRGAVLVVYGITMLFSLISLLLNVSSRIGGVLLMLGLLFGLEVFIEGLEIWGEKRTP  360

Query: 365  LFNLLKFIGNSDYRQSVIAKYSDK                                     388
            LFNLLKFIGNSDYRQ+++ K+ +K
Sbjct: 361  LFNLLKFIGNSDYRQAMLLKWKEK                                     384
```

Based on this analysis, it was predicted that these proteins and their epitopes could be useful antigens for vaccines or diagnostics.

Example 1863

A DNA sequence (GBSx1970) was identified in *S. agalactiae* <SEQ ID 5793> which encodes the amino acid sequence <SEQ ID 5794>. This protein is predicted to be negative regulator of genetic competence. Analysis of this protein sequence reveals the following:

Possible site: 16
>>> Seems to have no N-terminal signal sequence
----- Final Results -----
bacterial cytoplasm --- Certainty = 0.3460 (Affirmative) <succ>
bacterial membrane --- Certainty = 0.0000 (Not Clear) <succ>
bacterial outside --- Certainty = 0.0000 (Not Clear) <succ>

A related GBS nucleic acid sequence <SEQ ID 9483> which encodes amino acid sequence <SEQ ID 9484> was also identified.

The protein has homology with the following sequences in the GENPEPT database.

A related DNA sequence was identified in *S. pyogenes* <SEQ ID 5795> which encodes the amino acid sequence <SEQ ID 5796>. Analysis of this protein sequence reveals the following:

Possible site: 18
>>> Seems to have no N-terminal signal sequence
----- Final Results -----
bacterial cytoplasm --- Certainty = 0.3307 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
>GP:BAA82113 GB:AB022909 negative regulator of genetic competence
[Streptococcus mutans]

Identities = 168/248 (67%), Positives = 205/248 (81%), Gaps = 9/248 (3%)
Query:   1  MEMKQISETTLKITISMEDLEDRGMELKDFLIPQEKTEEFFYSVMDELDLPENFKNSGML   60
            MEMKQISETTLKITISMEDLE+RGMELKDFLIPQEKTEEFFY+VMDELDLPENFK SGML
Sbjct:   1  MEMKQISETTLKITISMEDLEERGMELKDFLIPQEKTEEFFYTVMDELDLPENFKGSGML   60

Query:  61  SFRVTPKKDRIDVFVTKSELSKDLNLEELADLGDISKMSPEDFFKTLEQSMLEKGDTDAH  120
            SFRVTP+ DRIDVFVTKSE++K+LNLE+L+D  DISKMSPEDFF TLE++M EKGD  A
Sbjct:  61  SFRVTPRNDRIDVFVTKSEINKNLNLEDLSDFDDISKMSPEDFFNTLEETMREKGDAAAL  120

Query: 121  AKLAEIENMMDKATQEVVEENVSEEQPEKEVETIGYVHYVFDFDNIEAVVRFSQTIDFPI  180
             KLAEIE   ++ TQ+  E+  ++E+ +        YVH+V DF NI+ V+ F++T+D+ +
Sbjct: 121  DKLAEIEKREEEKTQQ--EKGETKEKRD-------YVHFVLDFPNIQQVISFAKTVDYDV  171

Query: 181  EASELYKNGKGYHMTILLDLENQPSYFANLMNARMLEHANVGTKTRAYLKEHSIQLIHDD  240
            EASEL+K    YHMT+LL+LE++P Y+A+LM+ARMLEHA  GTKTRAYL EH +QLI  D
Sbjct: 172  EASELFKESDAYHMTVLLNLEDKPDYYADLMFARMLEHAGRGTKTRAYLLEHGVQLIKAD  231

Query: 241  AISKLQMI                                                     248
            A+ +LQMI
Sbjct: 232  ALQELQMI                                                     239
```

```
Identities = 171/253 (67%), Positives = 209/253 (82%), Gaps = 2/253 (0%)
Query:   1  MEMKQISETTLKITISMEDLEDRGMELKDFLIPQEKTEEFFYSVMDELDLPENFKNSGML    60
            MEMKQISETTLKITISM+DLE+RGMELKDFLIPQEKTEEFFYSVMDELDLP+NFK+SGML
Sbjct:   3  MEMKQISETTLKITISMDDLEERGMELKDFLIPQEKTEEFFYSVMDELDLPDNFKDSGML    62

Query:  61  SFRVTPKKDRIDVFVTKSELSKDLNLEELADLGDISKMSPEDFFKTLEQSMLEKGDTDAH   120
            SFRVTP+KDR+DVFVTKSE++KD+NLE+LA+ GD+S+M+PEDFFK+LEQSM EKGD  AH
Sbjct:  63  SFRVTPRKDRLDVFVTKSEINKDINLEDLAEFGDMSQMTPEDFFKSLEQSMREKGDVKAH   122

Query: 121  AKLAEIENMMDKATQEVV--EENVSEEQPEKEVETIGYVHYVFDFDNIEAVVRFSQTIDF   178
              KL +IE +M+   +  +   ++    E E + YVHYV DF  I   V F++TIDF
Sbjct: 123  EKLEKIEEIMEDVVEATLANQSEAADPSTNHESEPLDYVHYVLDFSTITEAVAFAKTIDF   182

Query: 179  PIEASELYKNGKGYHMTILLDLENQPSYFANLMYARMLEHANVGTKTRAYLKEHSIQLIH   238
             IEASELYK    YHMTILLD++ QPSYFAN+MYAR++EHAN G+KTRAYL+EH +QL+
Sbjct: 183  SIEASELYKGSNCYHMTILLDVQQQPSYFANVMYARLIEHANPGSKTRAYLQEHGLQLML   242

Query: 239  DDAISKLQMIEMG                                                 251
            D A+ +LQ IE+G
Sbjct: 243  DGAVEQLQKIELG                                                 255
```

Based on this analysis, it was predicted that these proteins and their epitopes could be useful antigens for vaccines or diagnostics.

Example 1864

A DNA sequence (GBSx1971) was identified in *S. agalactiae* <SEQ ID 5797> which encodes the amino acid sequence <SEQ ID 5798>. This protein is predicted to be BacA (bacA). Analysis of this protein sequence reveals the following:

Possible site: 17
>>> Seems to have no N-terminal signal sequence
INTEGRAL    Likelihood = −9.02    Transmembrane 115-131 (111-135)
INTEGRAL    Likelihood = −8.97    Transmembrane 227-243 (219-247)
INTEGRAL    Likelihood = −7.86    Transmembrane  48-64  (44-69)
INTEGRAL    Likelihood = −7.27    Transmembrane 263-279 (260-279)
INTEGRAL    Likelihood = −7.22    Transmembrane  87-103 (85-107)
INTEGRAL    Likelihood = −3.50    Transmembrane   2-18  (1-19)
----- Final Results -----
    bacterial membrane --- Certainty = 0.4609 (Affirmative) <succ>
     bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

A related DNA sequence was identified in *S. pyogenes* <SEQ ID 5799> which encodes the amino acid sequence <SEQ ID 5800>. Analysis of this protein sequence reveals the following:

Possible site: 56
>>> Seems to have no N-terminal signal sequence
INTEGRAL    Likelihood = −11.30   Transmembrane 225-241 (219-247)
INTEGRAL    Likelihood = −9.24    Transmembrane 115-131 (109-135)
INTEGRAL    Likelihood = −7.64    Transmembrane  48-64  (44-69)
INTEGRAL    Likelihood = −7.43    Transmembrane  87-103 (85-108)
INTEGRAL    Likelihood = −5.15    Transmembrane 263-279 (262-279)
INTEGRAL    Likelihood = −3.82    Transmembrane   2-18  (1-19)
----- Final Results -----
    bacterial membrane --- Certainty = 0.5522 (Affirmative) <succ>
     bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:AAD50462 GB:AF169967 BacA [Flavobacterium johnsoniae]
Identities = 101/275 (36%), Positives = 165/275 (59%), Gaps = 22/275 (8%)
Query:   7  LKALFLGVVEGVTEWLPVSSTGHLILVQEFMKLNQSKSFVEMFNIVIQLGAIMAVIVIYF    66
            L+A+ L V+EG+TE+LPVSSTGH+I+    F  +   + F ++F IVIQLGAI++V+V+YF
Sbjct:   4  LQAIVLAVIEGITEFLPVSSTGHMIIASSFFGIAH-EDFTKLFTIVIQLGAILSVVVLYF    62

Query:  67  KRLNPFQPGKSAREIRLTWQLWLKVVIACIPSILIALPFDNWFEAHFNFMIPIAIALIFY   126
            KR   FQ          T   + K+++A IP++++  L  ++  +    + +A++L+
Sbjct:  63  KRF--FQ----------TLDFYFKLLVAFIPAVVLGLLLSDFIDGLLENPVTAVSLLIG   110

Query: 127  GFVFI----WVEKRNAHLKPQVTELASMSYKTAFLIGCFQVLSIVPGTSRSGATILGAII   182
            G + +    W   NA   Q     ++Y  A  IG FQ ++++PG SRSGA+I+G +
Sbjct: 111  GLILLKVDEWFNNPNAAETSQ-----KITYLQALKIGLFQCIAMIPGVSRSGASIVGGMS   165

Query: 183  IGTSRSVAADFTFFLAIPTMFGYSGLKAVKYFLDGNVLSLDQSLILLVASLTAFVVSLYV   242
                SR+  AA+F +FFLA+PTM G +   K    Y+  G  LS DQ   IL++  ++ AF+V+L
Sbjct: 166  QKLSRTTAAEFSFFLAVPTMLGATVKKCYDYYKAGFELSHDQVNILIIGNVVAFIVALLA   225

Query: 243  IRFLTDYVKRHDFTIFGKYRIVLGSLLILYWLVVH                           277
            I+    ++ ++ F +FG YRI+ G +L+L    +H
Sbjct: 226  IKTFISFLTKNGFKVFGYYRIIAGIILLLIHFFIH                           260
```

```
>GP:AAD50462 GB:AF169967 BacA [Flavobacterium johnsoniae]
Identities = 102/269 (37%), Positives = 169/269 (61%), Gaps = 14/269 (5%)
Query:   7 LKAIFFGIIEGITEWLPVSSTGHLILVQEFIRLNQDKAFIEMFNIVIQLGAIIAVMLIYF    66
           L+AI   +IEGITE+LPVSSTGH+I+   F  +   +  F ++F IVIQLGAI++V+++YF
Sbjct:   4 LQAIVLAVIEGITEFLPVSSTGHMIIASSFFGIAHED-FTKLFTIVIQLGAILSVVVLYF    62

Query:  67 ERLNPFQPGKTAREVQLTWQLWLKVVIACIPSILIAVPLDNWFEAHFYFMVPIAIALIVY   126
           +R   FQ            T    + K+++A IP++++ + L ++ +       V +A++L++
Sbjct:  63 KRF--FQ----------TLDFYFKLLVAFIPAVVLGLLLSDFIDGLLENPVTVAVSLLIG   110

Query: 127 GIAFIWIEKRNAQQEPAVTELARMSYKTAFFIGCFQVLSIVPGTSRSGATILGAIILGTS   186
           G+  + +++           A T   +++Y  A  IG FQ ++++PG SRSGA+I+G  +       S
Sbjct: 111 GLILLKVDEWFNNPNAAETS-QKITYLQALKIGLFQCIAMIPGVSRSGASIVGGMSQKLS   169

Query: 187 RTVAADFTFFLAIPTMFGYSGLKAVKFFLDGHHLDFAQVLILLVASLTAFVVSLLAIRFL   246
           RT AA+F+FFLA+PTM G +  K   ++   G  L    QV IL++ ++ AF+V+LLAI+
Sbjct: 170 RTTAAEFSFFLAVPTMLGATVKKCYDYYKAGFELSHDQVNILIIGNVVAFIVALLAIKTF   229

Query: 247 TDYVKKHDFTIFGKYRIVLGSLLLIYSFF                                 275
           ++ K+ F +FG YRI+ G +LL+   FF
Sbjct: 230 ISFLTKNGFKVFGYYRIIAGIILLLIHFF                                 258
```

An alignment of the GAS and GBS proteins is shown below.

```
Identities = 227/272 (83%), Positives = 253/272 (92%)
Query:   1 MLIIELLKALFLGVVEGVTEWLPVSSTGHLILVQEFMKLNQSKSFVEMFNIVIQLGAIMA    60
           MLIIELLKA+F G++EG+TEWLPVSSTGHLILVQEF++LNQ K+F+EMFNIVIQLGAI+A
Sbjct:   1 MLIIELLKAIFFGIIEGITEWLPVSSTGHLILVQEFIRLNQDKAFIEMFNIVIQLGAIIA    60

Query:  61 VIVIYFKRLNPFQPGKSAREIRLTWQLWLKVVIACIPSILIALPFDNWFEAHFNFMIPIA   120
           V++IYF +RLNPFQPGK+ARE++LTWQLWLKVVIACIPSILIA+P DNWFEAHF FM+PIA
Sbjct:  61 VMLIYFERLNPFQPGKTAREVQLTWQLWLKVVIACIPSILIAVPLDNWFEAHFYFMVPIA   120

Query: 121 IALIFYGFVFIWVEKRNAHLKPQVTELASMSYKTAFLIGCFQVLSIVPGTSRSGATILGA   180
           IALI YG  FIW+EKRNA  +P VTELA MSYKTAF IGCFQVLSIVPGTSRSGATILGA
Sbjct: 121 IALIVYGIAFIWIEKRNAQQEPAVTELARMSYKTAFFIGCFQVLSIVPGTSRSGATILGA   180

Query: 181 IIIGTSRSVAADFTFFLAIPTMFGYSGLKAVKYFLDGNVLSLDQSLILLVASLTAFVVSL   240
           II+GTSR+VAADFTFFLAIPTMFGYSGLKAVK+FLDG+ L   Q LILLVASLTAFVVSL
Sbjct: 181 IILGTSRTVAADFTFFLAIPTMFGYSGLKAVKFFLDGHHLDFAQVLILLVASLTAFVVSL   240

Query: 241 YVIRFLTDYVKRHDFTIFGKYRIVLGSLLILY                              272
            IRFLTDYVK+HDFTIFGKYRIVLGSLL++Y
Sbjct: 241 LAIRFLTDYVKKHDFTIFGKYRIVLGSLLLIY                              272
```

Based on this analysis, it was predicted that these proteins and their epitopes could be useful antigens for vaccines or diagnostics.

Example 1865

A DNA sequence (GBSx1972) was identified in *S. agalactiae* <SEQ ID 5801> which encodes the amino acid sequence <SEQ ID 5802>. Analysis of this protein sequence reveals the following:

Possible site: 42
>>> Seems to have no N-terminal signal sequence
INTEGRAL  Likelihood = –8.65  Transmembrane 494-510 (488-519)
INTEGRAL  Likelihood = –8.01  Transmembrane 263-279 (256-288)

-continued

INTEGRAL  Likelihood = –5.95  Transmembrane 25-41 (20-43)
INTEGRAL  Likelihood = –4.94  Transmembrane 475-491 (473-493)
----- Final Results -----
   bacterial membrane --- Certainty = 0.4461 (Affirmative) <succ>
   bacterial outside --- Certainty = 0.0000 (Not Clear) <succ>
   bacterial cytoplasm --- Certainty = 0.0000 (Not Clear) <succ>

A related GBS nucleic acid sequence <SEQ ID 9481> which encodes amino acid sequence <SEQ ID 9482> was also identified.

The protein has homology with the following sequences in the GENPEPT database.

```
>GP:AAB99606 GB:U67598 M. jannaschii predicted coding region MJ1577
[Methanococcus jannaschii]
Identities = 41/172 (23%), Positives = 78/172 (44%), Gaps = 19/172 (11%)
Query: 479 LISFVVIIYTLFLNYFTYFCIYLLLFGVILLLNKIIFMMTRKISNGYIVTEDGASRVYQW   538
           +IS ++ ++  F+ ++       +  ++ ++ II  +T  G            ++ +W
Sbjct: 442 VISILLAVFLYFIPKYSQTFNEVFYLSIVFVVQNIILALTPTSLFGRWKANYYKEKL-EW   500

Query: 539 TSFRNMLRDIKSFDRSELESIVLWNRILVYATLFGYADRVEKALR-VNQIDIPERFANID   597
```

```
                 +F+N L ++     +    E I +W   L+Y T   G  D+V +A++ +N  ++    + I
Sbjct: 501  DAFKNFLSNLAMIKKYSPEDISIWKDWLIYGTALGVGDKVVEAMKSLNLSELVADYVIIH  560

Query: 598  SHQFAISVNQSSNHFSTITEDVSHASNFSVNSGGSSGGFSGGGG--GGGGGA         647
            S+   ++   +  S + ST                 GS GGF  GGG  GGGGGA
Sbjct: 561  SNYDSMKTSVDSVYSSTT---------------GSGGGFGAGGGFGGGGGGA         597
```

A related DNA sequence was identified in *S. pyogenes* <SEQ ID 5803> which encodes the amino acid sequence <SEQ ID 5804>. Analysis of this protein sequence reveals the following:

---

```
Possible site: 21
>>> Seems to have a cleavable N-term signal seq.
INTEGRAL   Likelihood = -7.91   Transmembrane 486-502 (483-508)
INTEGRAL   Likelihood = -5.89   Transmembrane 465-481 (460-483)
INTEGRAL   Likelihood = -2.18   Transmembrane 244-260 (241-260)
----- Final Results -----
    bacterial membrane --- Certainty = 0.4163 (Affirmative) <succ>
       bacterial outside --- Certainty = 0.0000 (Not Clear) <succ>
         bacterial cytoplasm --- Certainty = 0.0000 (Not Clear) <succ>
```

---

The protein has homology with the following sequences in the databases:

```
>GP:AAB99606 GB:U67598 M. jannaschii predicted coding region MJ1577
[Methanococcus jannaschii]
Identities = 59/263 (22%), Positives = 106/263 (39%), Gaps = 14/263 (5%)
Query: 369  FLDMAFGNKVTLPVDQLFSQYHYDADTIKQLKKTYKGKKLEWEVRQSSEQVIKAMKKASA  428
            ++ +   G K+ +     L  +     Y++D +K L  K     + E  +S  Q   K+ K
Sbjct: 346  YIKIMNGGKIEILKTDLENLDVYESDVMKFLMKYSKNNVFDPEYIKSLAQKYKSSKDKLK  405

Query: 429  AITNNVLETIKKLNLPDTYRQMTPA--EKRKSNSVQGLGCLLLILNSGLLIYLAIKESGL  486
             + +    E  K+  P      ++   A  E R      +  L   ++L    L     ++
Sbjct: 406  KLKD---ELDKIMEYPRYSSKVVNAFLETRGKKIIIALLVISILLAVFLYFIPKYSQTFN  462

Query: 487  ALIYLALMVLTMCLGFYISLKLDQYKKLGIETPEGGVRLHQWQSFKNMIRDIDKFEDVAI  546
             + YL+++ +         I L L    G             +W +FKN + ++   +  +
Sbjct: 463  EVFYLSIVFVVQ----NIILALTPTSLFGRWKANYYKEKLEWDAFKNFLSNLAMIKKYSP  518

Query: 547  EGLVVWNRVLVYATLFGYAKKVERYLKVHRIALPEVYQAVRPGELSMVMYATTPTFVSSL  606
            E + +W    L+Y T   G    KV  +K   ++       + V    +   Y +  T V S+
Sbjct: 519  EDISIWKDWLIYGTALGVGDKVVEAMKSLNLS-----ELVADYVIIHSNYDSMKTSVDSV  573

Query: 607  SSATTSSNFSVSSGGGISGGGGG                                       629
            S+TT S        +GGG GGGGG
Sbjct: 574  YSSTTGSGGGFGAGGGFGGGGGG                                       596
                                                                          45
```

An alignment of the GAS and GBS proteins is shown below.

```
Identities = 241/635 (37%), Positives = 372/635 (57%), Gaps = 18/635 (2%)
Query:  22  MKKCFLAICLALSFFMVSVQADEVDYNIPHYEGNLTIHNDNSADFTEKVTYQFDSSYNGQ   81
            MKK + + L  S    + ++A +VDY+I +YEG L +   +N+A F +KVTYQFD+SYNGQ
Sbjct:   1  MKKILMTLVLCFSLLGIRIKAADVDYSITNYEGQLLLSKENTARFEQKVTYQFDTSYNGQ   60

Query:  82  YVTLGTAGKLPDNFDINNKPQVEVSINGKVRKVSYQIEDLEDGYRLKVFNGGEAGDTVKV  141
            Y+++LG  G LP  F I+ KP+VEV  NG+   VS +   DL DGYRLK++N G+AGD V V
Sbjct:  61  YISLGRTGHLPAGFAIDQKPKVEVYQNGQQVPVSQEFSDLGDGYRLKLYNAGQAGDKVDV  120

Query: 142  NVQWKLKNVLFMHKDVGELNWIPISDWDKTLEKVDFWISTDKKVALSRLWGHLGYL-KTP  200
              V W+L ++ L     ++DV ELNW PISDWDKTLEKV   ++T   +   S LW H GY   K P
Sbjct: 121  KVIWQLHHLLTAYQDVAELNWTPISDWDKTLEKVSLTVTTPTDIQDSNLWAHRGYYQKKP  180

Query: 201  PKIRQNNNRYHLTAFNVNKRLEFHGYWDRSYF--NLPTNSKNNYKKKIEYQEKMIERHGF  258
             +++  N+RY + A  NV+  +LE H YWD+          P  +    + K KI  E   I R
Sbjct: 181  QVLKEGNSRYQINAKNVSGQLELHAYWDKKALLGKEPVDVSTSKKNKIVALETKISRRRT  240

Query: 259  ILSFLLRILLPSFFIIVTLFISIRVFLFRKKVNKYGQFPKEHHLYEAPEDLSPLELTQSI  318
            +L  L  ++P +   + +  L+ I+     +K+ N+Y          H YE PEDLSPL LTQ+I
Sbjct: 241  LLQLLFGKVIPLVEVGFLLWQLIQFTRLKKQFNRYHLANHTDHSYEVPEDLSPLVLTQAI  300
```

-continued

```
Query: 319  YSMSFKNFQ---DEEKTHL---ISQEQLIQSILLDLIDRKVL----NYDDNLLSLANLD  368
            Y  SF        E +K +   ++ E L+Q+ LLDLID+KVL         L ++ LD
Sbjct: 301  YGQSFAYLSPTASESQKLLIPKGVTFEALVQATLLDLIDQKVLLLTKEEGKAYLEISQLD  360

Query: 369  RASDAEIDFIEFAFADSTSLKPDQLFSNYQFSYKETLRELKKQHKASDLQTQMRRRGSNA  428
            R +D E  F++ AF +  +L  DQLFS Y +   +T+++LKK +K   L+ ++R+
Sbjct: 361  RVTDEEAAFLDMAFGNKVTLPVDQLFSQYHYD-ADTIKQLKKTYKGKKLEQEVRQSSEQV  419

Query: 429  LSRITRLTRLISKDNINSLRRKGISSPYRKMSSEESKELSRLKRFSYLSPLISFVVIIYT  488
            + + + +  I+ + + ++++ +     YR+M+  E ++ + ++      L   +++ ++IY
Sbjct: 420  IKAMKKASAAITNNVLETIKKLNLPDTYRQMTPAEKRKSNSVQGLGCLLLILNEGLLIY-  478

Query: 489  LFLNYFTYFCIYLLLFGVILLLNKIIFMMTRKISNGYIVTEDGASRVYQWTSFRNMLRDI  548
            L +       IYL L + + L   I +   +     I T +G  R++QW SF+NM+RDI
Sbjct: 479  LAIKESGLALIYLALMVLTMCLGFYISLKLDQYKKLGIETPEGGVRLHQWQSFKNMIRDI  538

Query: 549  KSFDRSELESIVLWNRILVYATLFGYADRVEKALRVNQIDIPERFANIDSHQFAISVNQS  608
             F+    +E +V+WNR+LVYATLFGYA +VE+ L+V++I +PE +  +   + ++ + +
Sbjct: 539  DKFEDVAIEGLVVWNRVLVYATLFGYAKKVERYLKVHRIALPEVYQAVRPGELSMVMYAT  598

Query: 609  SNHFSTITEDVSHASNFSVNSGGSSGGFSGGGGGG                           643
             +  F +      + +SNFSV+SG     GG SGGGGGG
Sbjct: 599  TPTFVSSLSSATTSSNFSVSSG---GGISGGGGGG                           630
```

Based on this analysis, it was predicted that these proteins and their epitopes could be useful antigens for vaccines or diagnostics.

A related GBS gene <SEQ ID 8921> and protein <SEQ ID 8922> were also identified. Analysis of this protein sequence reveals the following:

Lipop: Possible site: −1   Crend: 4
McG: Discrim Score: 10.29
GvH: Signal Score (−7.5): 3.11
Possible site: 23
>>> Seems to have a cleavable N-term signal seq.
ALOM program   count: 3 value: −8.65 threshold: 0.0
INTEGRAL     Likelihood = −8.65   Transmembrane 475-491 (469-500)
INTEGRAL     Likelihood = −8.01   Transmembrane 244-260 (237-269)
INTEGRAL     Likelihood = −4.94   Transmembrane 456-472 (454-474)
PERIPHERAL   Likelihood = 2.28     540
modified ALOM score: 2.23
*** Reasoning Step: 3
----- Final Results -----
   bacterial membrane --- Certainty = 0.4461 (Affirmative) <succ>
       bacterial outside --- Certainty = 0.0000 (Not Clear) <succ>
           bacterial cytoplasm --- Certainty = 0.0000 (Not Clear) <succ>

The protein has no homology with any sequences in the databases.

Example 1866

A DNA sequence (GBSx1973) was identified in £agalactiae <SEQ ID 5805> which encodes the amino acid sequence <SEQ ID 5806>. This protein is predicted to be glutamine-binding periplasmic protein/glutamine transport system perme. Analysis of this protein sequence reveals the following:

Possible site: 24
>>> Seems to have a cleavable N-term signal seq.
INTEGRAL   Likelihood = −8.86   Transmembrane 301-317 (295-324)
INTEGRAL   Likelihood = −6.05   Transmembrane 479-495 (473-496)
INTEGRAL   Likelihood = −0.59   Transmembrane 369-385 (369-385)
----- Final Results -----
   bacterial membrane --- Certainty = 0.4545 (Affirmative) <succ>
       bacterial outside --- Certainty = 0.0000 (Not Clear) <succ>
           bacterial cytoplasm --- Certainty = 0.0000 (Not Clear) <succ>

The protein has homology with the following sequences in the GENPEPT database.

```
>GP:BAA17584 GB:D90907 glutamine-binding periplasmic protein
[Synechocystis sp.]
Identities = 147/534 (27%), Positives = 256/534 (47%), Gaps = 75/534 (14%)
Query:   4  ILLSLFTALLITFGGMTSIQADEYLRVGMEAAYAPFNWTQNDNTNGAVPIEGTDQYANGY   63
            +LL++    LL  F ++      + + V E  + PF  T              E T Q   G+
Sbjct:  24  VLLAIAIPLLPAFSQVSR----QTIIVATEPTFPPFEMTD----------EATGQLT-GF   68

Query:  64  DVQVAKKLAKKLNKKVVVVKTKWEGLVPALTSGKLDMIIAGMSPTEERKKEINFSKPYYI  123
            DV + + + +     V +      ++G++PAL S   +  I+ ++ T ER + ++FS PY+
Sbjct:  69  DVDLIQAIGEAAQVTVDIQGYPFDGIIPALQSNTVGAAISAITITPERAQSVSFSSPYFK  128

Query: 124  SEPTLVVNAEGKYTNAKNISDFKNAKVTAQQGVYLYNLIDQINGVKKEVAMGDFNQLRQA  183
            S    L + +     KN+ D +  ++      G    +   + G K    + +F+ +  A
Sbjct: 129  S--VLAIAVQDGNDTIKNLKDLEGKRLAVAIGTTGAMVATNVPGAK----VTNFDSITSA  182

Query: 184  VE---SGVVDAYVSERPDATSAQTANPKLKMIELHQGFKTSDADTNISVGMRKGDNRINQ  240
             ++    +G  DA +++RP       A   + L+ +++      + D  I++ +        INQ
Sbjct: 183  LQELVNGNADAVINDRPVLLYA-IKDAGLRNVKISADVGSEDY-YGIAMPLAP-PGEINQ  239

Query: 241  VNQVL-----ESISRDKQIALMDKMIKEQ---------PSV------------KKEKNGK  274
                +VL      + I       A+ +K    E+          PS+           + + N
```

-continued

```
Sbjct: 240  TREVLNQGLFQIIENGTYNAIYEKWFGEKNPPFLPLVAPSLVGKVGTAQSLTERSQAMPN  299

Query: 275  PNFFEQMATILKNNGSQFLRGTATTLLISMVGTIVGLFIGLLIGVFRTAPKSDNKLKAAL  334
            NF  + T+ +N     +G+ T+L++     GL G + +   A  SD
Sbjct: 300  DNF---LITLFRN----LFKGSILTVLLTAFSVFFGLIGGTGVAI---ALISD-------  342

Query: 335  QKLLGWLLNIYIEVFRGTPMIVQSMVIYYGTAQAF-----GVSLDRTLAAIFIVSINTGA  389
            K L  +  IY+E FRGTPM+VQ  +IY+G    F      G+++DR AAI  +S+N  A
Sbjct: 343  IKPLQLIFRIYVEFFRGTPMLVQLFIIYFGLPALFKEIGLGITIDRFPAAIIALSLNVAA  402

Query: 390  YMSEIVRGGIFSVDKGQFEAATALGFTHGQTMRKIVLPQVVRNILPATGNEFVINIKDTS  449
            Y++EI+RGGI S+D+GQ+EA  +LG +  QTM++++ PQ  R ILP   GNEF+  IKDTS
Sbjct: 403  YLAEIIRGGIQSIDQGQWEACESLGMSPWQTMKEVIFPQAFRRILPPLGNEFITLIKDTS  462

Query: 450  VLNVISVVELYFSGNTVATQTYQYFQTFTIIAIIYFILTFTVTRILRYIEKRFD        503
            + VI    EL+  G +    TY+ F+ +  +A++Y +LT   + + +++E   D
Sbjct: 463  LTAVIGFQELFREGQLIVATTYRAFEVYIAVALVYLLLTTISSFVFKWLENYMD        516
```

There is also homology to SEQ ID 1194.

A related GBS gene <SEQ ID 8923> and protein <SEQ ID 8924> were also identified. Analysis of this protein sequence reveals the following:

Lipop: Possible site: −1    Crend: 2
McG: Discrim Score: 6.23
GvH: Signal Score (−7.5): 0.11
Possible site: 24
>>> Seems to have a cleavable N-term signal seq.
ALOM program    count: 3 value: −8.86 threshold: 0.0

INTEGRAL    Likelihood = −8.86    Transmembrane 301-317 (295-324)
INTEGRAL    Likelihood = −6.05    Transmembrane 479-495 (473-496)
PERIPHERAL    Likelihood = 1.32    441
modified ALOM score: 2.27
*** Reasoning Step: 3
----- Final Results -----
   bacterial membrane --- Certainty = 0.4545 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
34.3/57.3% over 462aa
Synechocystis PCC6803
EGAD|48193| glutamine-binding periplasmic protein/glutamine transport system permease
protein Insert characterized
GP|1652664|dbj|BAA17584.1||D90907 glutamine-binding periplasmic protein
{Synechocystis sp.} Insert characterized
PIR|S77250|S77250 hypothetical protein - Synechocystis sp. (strain PCC 6803) Insert
characterized
ORF01242(454-1809 of 2148)
EGAD|48193|sll1270(54-516 of 530) glutamine-binding periplasmic protein/glutamine
transport system permease protein {Synechocystis PCC6803}GP|1652664|dbj|BAA17584.1||D90907
glutamine-binding periplasmic protein {Synechocystis sp.}PIR|S77250|S77250 hypothetical
protein - Synechocystis sp. (strain PCC 6803)
% Match = 12.3
% Identity = 34.2 % Similarity = 57.2
Matches = 128 Mismatches = 149 Conservative Sub.s = 86

204       234       264       294       324       354       384       414
        PSFVCIPF*HKNTINRFQ*DNDIEIDLVFR*NRRK*LIGGC*MKKILLSLFTALLITXGGMTSIQADEYLRVGMEAAYAP

MKGMVKLGHWGKTWRYYLLLALGVLLAIAIPLLPAFSQVS
                                                                  10        20        30        40

444       474       495       525       555       585       615       645
        FNWTQNDNTNGAVPIEGTDQ---YANGYDVQVAKKLAKKLNKKVVVVKTKWEGLVPALTSGKLDMIIAGMSPTEERKKEI
            |  |  ||:        |:||  :  :  :    |  :     ::|::|||  |    |:  ::  |  || ::
        RQTIIVATEPTFPPFEMTDEATGQLTGFDVDLIQAIGEAAQVTVDIQGYPFDGIIPALQSNTVGAAISAITITPERAQSV
                50        60        70        80        90       100       110       120

675       705       735       765       795       825       855       885
        NFSKPYYISEPTLVVNAEGKYTNAKNISDFKNAKVTAQQGVYLYNLIDQINGVKKEVAMGDFNQLRQAVESGVVDAYVSE
        :|| ||:  |    ||: |   | |   ||  |  ||::  ::      :  : ||     |  |:: : :|  || :::
        SFSSPYFKSVLAIAVQ-DGNDT-IKNLKDLEGKRLAVAIGTTGAMVATNVPGAKVTNFDSITSALQELV-NGNADAVIND
                130       140       150       160       170       180       190

903       957       987
        RP-----------------------------------DATSAQTANPKLK-MIELHQG-FKTSDADTNISV
        ||                                   |   ||| :| | :   || |
        RPVLLYAIKDAGLRNVKISADV~~~~NPPFLPLVAPSLVGKVGTAQSLTERSQANPNDNFLITLFRNLFKGS--------
                210       270       280       290       300       310
```

```
1017        1047        1077        1107        1137        1167        1197        1227
GMRKGDNRINQVNQVLESISRDKQIALMDKMIKEQPSVKKEKNGKPNFFEQMATILKNNGSQFLRGTATTLLISMVGTIV
                                                                          ::::: |
------------------------------------------------------------------------ILTVLLTAF
                                                                            320

1257        1284        1314        1344        1374        1404        1419        1449
GLFIGLLIGV-FRTAPKSDNKLKAALQKLLGWLLNIYIEVFRGTPMIVQSMVIYYGTAQAF-----GVSLDRTLAAIFIV
:|||: |    |  |   ||       ||  ::  ||:| ||||||:|| :||:|      |:::|| ||| :
SVFFGLIGGTGVAIALISD-------IKPLQLIFRIYVEFFRGTPMLVQLFIIYFGLPALFKEIGLGITIDRFPAAIIAL
            340                350         360         370         380         390

1479        1509        1539        1569        1599        1629        1659        1689
SINTGAYMSEIVRGGIFSVDKGQFEAATALGFTHGQTMRKIVLPQVVRNILPATGNEFVINIKDTSVLNVISVVELYFSG
|:|    ||::||:||||| |:|:||:||  :||  :  |||::::|| | ||| ||||: |||||: ||  ||:  |
SLNVAAYLAEIIRGGIQSIDQGQWEACESLGMSPWQTMKEVIFPQAFRRILPPLGNEFITLIKDTSLTAVIGFQELFREG
            410         420         430         440         450         460         470

1719        1749        1779        1809        1839        1869        1899        1929
NTVATQTYQYFQTFTIIAIIYFILTFTVTRILRYIEKRFDSDNYTTGANQLQV*EVGMTQAILEIKHLKKSYGSNEVLKD
 :   ||: |: :  :|::|::||    : :::::| |              |                :
QLIVATTYRAFEVYIAVALVYLLLTTISSFVKWLENYMDPIGRAKKKAKAATA
            490         500         510         520         530
```

There is also homology to SEQ ID 5804.

Based on this analysis, it was predicted that these proteins and their epitopes could be useful antigens for vaccines or diagnostics.

Example 1867

A DNA sequence (GBSx1974) was identified in *S. agalactiae* <SEQ ID 5807> which encodes the amino acid sequence <SEQ ID 5808>. This protein is predicted to be ATP-binding. Analysis of this protein sequence reveals the following:

```
Possible site: 44
>>> Seems to have no N-terminal signal sequence
----- Final Results -----
   bacterial cytoplasm --- Certainty = 0.3208 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database.

A related DNA sequence was identified in *S. pyogenes* <SEQ ID 2157> which encodes the amino acid sequence <SEQ ID 2158>. Analysis of this protein sequence reveals the following:

```
Possible site: 27
>>> Seems to have no N-terminal signal sequence
----- Final Results -----
   bacterial cytoplasm --- Certainty = 0.1170 (Affirmative) <succ>
      bacterial membrane --- Certainty = 0.0000 (Not Clear) <succ>
         bacterial outside --- Certainty = 0.0000 (Not Clear) <succ>
```

An alignment of the GAS and GBS proteins is shown below.

```
>GP:CAB73160 GB:AL139076 putative glutamine transport ATP-binding
protein [Campylobacter jejuni]
Identities = 132/241 (54%), Positives = 178/241 (73%), Gaps = 1/241 (0%)
Query:    5  ILEIKHLKKSYGSNEVLKDISLSVNKGEVISIIGSSGSGKSTFLRSINLLEEPSGGEILY   64
             ++E+K+L+K YG  EVLK+I+ +++KG+VI+IIG SG GKSTFLR IN LE    GEIL
Sbjct:    1  MIEVKNLQKKYGELEVLKNINTTISKGDVIAIIGPSGGGKSTFLRCINRLELADSGEILI   60

Query:   65  HGHNVLEKGYDLNNYREKLGMVFQSFNLFENLNILENAIVAQTTVLKRERQEAEKIAKEN  124
             +  N+L+K  D+N  R+K+ MVFQ FNLF N N++EN  +         ++EA K AK
Sbjct:   61  NKQNILDKEIDINKIRQKVSMVFQHFNLFANKNVMENLCLTPIKTGILSQEEAIKKAKLL  120

Query:  125  LNAVGMTEQYWKAKPKQLSGGQKQRVAIARALSVNPEAILFDEPTSALDPEMVGEVLKTM  184
             L  VG+ ++     P +LSGGQKQR+AIAR+L +NP+ ILFDEPTSALDPEM+GEVL  M
Sbjct:  121  LAKVGLADKE-NIMPHKLSGGQKQRIAIARSLMMNPDVILFDEPTSALDPEMIGEVLSIM  179

Query:  185  QDLAKSGLTMIIVTHEMEFAKEVSDRVIFMDKGIIAEQGTPKQLFENPTQERTKEFLQRFL 245
             +D+AK GLTM++VTHEM FA+ V++R+ FMDKG IA   +PK++FENP+ ER +EFL + L
Sbjct:  180  KDVAKEGLTMLVVTHEMGFARNVANRIFFMDKGKIAVDASPKEVFENPSNERLREFLNKVL 240
```

```
Identities = 212/246 (86%), Positives = 237/246 (96%)
Query:   1  MTQAILEIKHLKKSYGSNEVLKDISLSVNKGEVISIIGSSGSGKSTFLRSINLLEEPSGG   60
            M+ +I+EIK+LKKSYGSNEVLKDISLSVNKGEVISIIGSSGSGKST LRSINLLEEPS G
Sbjct:  24  MSNSIIEIKNLKKSYGSNEVLKDISLSVNKGEVISIIGSSGSGKSTLLRSINLLEEPSAG   83

Query:  61  EILYHGHNVLEKGYDLNNYREKLGMVFQSFNLFENLNILENAIVAQTTVLKRERQEAEKI  120
            +IL+HG +VL + Y+L +YREKLGMVFQSFNLFENLN+LENAIVAQTTVLKR+R +AE+I
Sbjct:  84  QILFHGEDVLAEHYNLTHYREKLGMVFQSFNLFENLNVLENAIVAQTTVLKRDRAQAEQI  143

Query: 121  AKENLNAVGMTEQYWKAKPKQLSGGQKQRVAIARALSVNPEAILFDEPTSALDPEMVGEV  180
            AKENLNAVGMTEQYW+AKPKQLSGGQKQRVAIARALSVNPEA+LFDEPTSALDPEMVGEV
Sbjct: 144  AKENLNAVGMTEQYWQAKPKQLSGGQKQRVAIARALSVNPEAMLFDEPTSALDPEMVGEV  203

Query: 181  LKTMQDLAKSGLTMIIVTHEMEFAKEVSDRVIFMDKGIIAEQGTPKQLFENPTQERTKEF  240
            LKTMQDLAKSGLTMIIVTHEMEFA++VSDR+IFMDKG+I E+G+P+Q+FENPTQ+RTKEF
Sbjct: 204  LKTMQDLAKSGLTMIIVTHEMEFARDVSDRIIFMDKGLITEEGSPQQIFENPTQDRTKEF  263

Query: 241  LQRFLK                                                        246
            LQRFLK
Sbjct: 264  LQRFLK                                                        269
```

Based on this analysis, it was predicted that these proteins and their epitopes could be useful antigens for vaccines or diagnostics.

Example 1868

A DNA sequence (GBSx1976) was identified in *S. agalactiae* <SEQ ID 5809> which encodes the amino acid sequence <SEQ ID 5810>. This protein is predicted to be hypersensitive-induced response protein. Analysis of this protein sequence reveals the following:

---

Possible site: 31
>>> Seems to have an uncleavable N-term signal seq
INTEGRAL   Likelihood = –17.94   Transmembrane 4-20 (1-28)
----- Final Results -----
   bacterial membrane --- Certainty = 0.8175 (Affirmative) <succ>
   bacterial outside --- Certainty = 0.0000 (Not Clear) <succ>
   bacterial cytoplasm --- Certainty = 0.0000 (Not Clear) <succ>

---

A related GBS nucleic acid sequence <SEQ ID 9479> which encodes amino acid sequence <SEQ ID 9480> was also identified.

The protein has homology with the following sequences in the GENPEPT database.

A related DNA sequence was identified in *S. pyogenes* <SEQ ID 5811> which encodes the amino acid sequence <SEQ ID 5812>. Analysis of this protein sequence reveals the following:

---

Possible site: 32
>>> Seems to have an uncleavable N-term signal seq
INTEGRAL   Likelihood = –13.06   Transmembrane 5-21 (1-29)
----- Final Results -----
   bacterial membrane --- Certainty = 0.6222 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the databases:

```
>GP:AAF68390 GB:AF236374 hypersensitive-induced response protein [Zea mays]
Identities = 127/275 (46%), Positives = 174/275 (63%), Gaps = 1/275 (0%)
Query:  19  ITSLYVVKQQTVAIIERFGKYQKTATSGIHIRVPLGIDKIAARVQLRLLQSEIIVETKTK   78
            I  L   V Q TVAI E FGK+ +      G H        +IA  + LR+ Q ++  ETKTK
Sbjct:   4  ILGLVQVDQSTVAIKENFGKFSEVLEPGCHFLPWCIGQQIAGYLSLRVRQLDVRCETKTK   63

Query:  79  DNVFVTLNIATQYRVNENNVTDAYYKLIKPEAQIKSYIEDALRSSVPKLTLDELFEKKDE  138
            DNVFVT+   QYR   +  +DA+YKL     QI+SY+ D +R++VPKL LD+ FE+K+E
Sbjct:  64  DNVFVTVVASVQYRALADKASDAFYKLSNTREQIQSYVFDVIRATVPKLGLDDAFEQKNE  123

Query: 139  IALEVQHQVAEEMSTYGYIIVKTLITKVEPDAEVKQSMNEINAAQRKRVAAQELANADKI  198
            IA  V+ ++ + MSTYGY IV+TLI  +EPD  VK++MNEINAA R RVAA E A A+KI
Sbjct: 124  IAKAVEEELEKAMSTYGYQIVQTLIVDIEPDDRVKRAMNEINAAARMRVAASEKAEAEKI  183

Query: 199  KIVTAAEAEAEKDRLHGVGIAQQRKAIVDGLADSIQELKDANVTLTEEQIMSILLTNQYL  258
             +   AE EAE    L GVGIA+QR+AIVDGL DS+      +       T + IM ++L  QY
Sbjct: 184  LQIKKAEGEAESKYLAGVGIARQRQAIVDGLRDSVLAFSENVPGTTAKDIMDMVLVTQYF  243

Query: 259  DTLNTF-AINGNQTIFLPNNPEGVEDIRTQVLSAL                            292
            DT+     A + +  ++F+P+ P   V+D+  Q+    L
Sbjct: 244  DTMREIGASSKSSSVFIPHGPGAVKDVSAQIRDGL                            278
```

```
>GP:AAF68390 GB:AF236374 hypersensitive-induced response protein [Zea mays]
Identities = 126/273 (46%), Positives = 174/273 (63%), Gaps = 3/273 (1%)
Query:   23 LYVVRQQSVAIVERFGRYQKTATSGIHIRLPFGI-DKIAARVQLRLLQSEIIVETKTKDN    81
            L  V Q +VAI E FG++ +    G H  LP+ I  +IA  + LR+ Q ++  ETKTKDN
Sbjct:    7 LVQVDQSTVAIKENFGKFSEVLEPGCHF-LPWCIGQQIAGYLSLRVRQLDVRCETKTKDN    65

Query:   82 VFVTLNVATQYRVNEQNVTDAYYKLMKPESQIKSYIEDALRSSVPKLTLDELFEKKDEIA   141
            VFVT+  + QYR     +DA+YKL    QI+SY+ D +R++VPKL LD+ FE+K+EIA
Sbjct:   66 VFVTVVASVQYRALADKASDAFYKLSNTREQIQSYVFDVIRATVPKLGLDDAFEQKNEIA   125

Query:  142 LEVQHQVAEEMSTYGYIIVKTLITKVEPDAEVKQSMNEINAAQRKRVAAQELANADKIKI   201
              V+ ++ + MSTYGY IV+TLI  +EPD  VK++MNEINAA R RVAA E A A+KI
Sbjct:  126 KAVEEELEKAMSTYGYQIVQTLIVDIEPDDRVKRAMNEINAAARMRVAASEKAEAEKILQ   185

Query:  202 VTAAEAEAEKDRLHGVGIAQQRKAIVDGLAESIQELKEANISLNEEQIMSILLTNQYLDT   261
            +  AE EAE    L GVGIA+QR+AIVDGL +S+    E         + IM ++L  QY DT
Sbjct:  186 IKKAEGEAESKYLAGVGIARQRQAIVDGLRDSVLAFSENVPGTTAKDIMDMVLVTQYFDT   245

Query:  262 LNTFAAKG-NQTLFLPNTPSGVEDIRTQVLSAL                             293
            +     A   +  ++F+P+  P   V+D+  Q+    L
Sbjct:  246 MREIGASSKSSSVFIPHGPGAVKDVSAQIRDGL                             278
```

An alignment of the GAS and GBS proteins is shown below.

```
Identities = 254/291 (87%), Positives = 278/291 (95%)
Query:    5 IILTVILVLVIVLLITSLYVVKQQTVAIIERFGKYQKTATSGIHIRVPLGIDKIAARVQL    64
            I +    +++++ ++ ++LYVV+QQ+VAI+ERFG+YQKTATSGIHIR+P GIDKIAARVQL
Sbjct:    6 IFIAFGVIVILAIVASTLYVVRQQSVAIVERFGRYQKTATSGIHIRLPFGIDKIAARVQL    65

Query:   65 RLLQSEIIVETKTKDNVFVTLNIATQYRVNENNVTDAYYKLIKPEAQIKSYIEDALRSSV   124
            RLLQSEIIVETKTKDNVFVTLN+ATQYRVNE NVTDAYYKL+KPE+QIKSYIEDALRSSV
Sbjct:   66 RLLQSEIIVETKTKDNVFVTLNVATQYRVNEQNVTDAYYKLMKPESQIKSYIEDALRSSV   125

Query:  125 PKLTLDELFEKKDEIALEVQHQVAEEMSTYGYIIVKTLITKVEPDAEVKQSMNEINAAQR   184
            PKLTLDELFEKKDEIALEVQHQVAEEMSTYGYIIVKTLITKVEPDAEVKQSMNEINAAQR
Sbjct:  126 PKLTLDELFEKKDEIALEVQHQVAEEMSTYGYIIVKTLITKVEPDAEVKQSMNEINAAQR   185

Query:  185 KRVAAQELANADKIKIVTAAEAEAEKDRLHGVGIAQQRKAIVDGLADSIQELKDANVTLT   244
            KRVAAQELANADKIKIVTAAEAEAEKDRLHGVGIAQQRKAIVDGLA+SIQELK+AN++L
Sbjct:  186 KRVAAQELANADKIKIVTAAEAEAEKDRLHGVGIAQQRKAIVDGLAESIQELKEANISLN   245

Query:  245 EEQIMSILLTNQYLDTLNTFAINGNQTIFLPNNPEGVEDIRTQVLSALKTR            295
            EEQIMSILLTNQYLDTLNTFA  GNQT+FLPN P GVEDIRTQVLSALKT+
Sbjct:  246 EEQIMSILLTNQYLDTLNTFAAKGNQTLFLPNTPSGVEDIRTQVLSALKTK            296
```

SEQ ID 5810 (GBS231) was expressed in *E. coli* as a GST-fusion product. SDS-PAGE analysis of total cell extract is shown in FIG. 55 (lane 7; MW 60.9 kDa).

GBS231d was expressed in *E. coli* as a GST-fusion product. SDS-PAGE analysis of total cell extract is shown in FIG. 155 (lane 5-7; MW 59 kDa) and in FIG. 239 (lane 11; MW 59 kDa). It was also expressed in *E. coli* as a His-fusion product. SDS-PAGE analysis of total cell extract is shown in FIG. 155 (lane 9; MW 34 kDa) and in FIG. 183 (lane 6; MW 34 kDa). Purified GBS231d-GST is shown in FIG. 246, lane 8.

Based on this analysis, it was predicted that these proteins and their epitopes could be useful antigens for vaccines or diagnostics.

Possible site: 34

>>> Seems to have no N-terminal signal sequence

----- Final Results ----- bacterial cytoplasm --- Certainty = 0.2305 (Affirmative) <succ> bacterial membrane --- Certainty = 0.0000 (Not Clear) <succ> bacterial outside --- Certainty = 0.0000 (Not Clear) <succ>

Example 1869

A DNA sequence (GBSx1977) was identified in *S. agalactiae* <SEQ ID 5813> which encodes the amino acid sequence <SEQ ID 5814>. Analysis of this protein sequence reveals the following:

A related GBS nucleic acid sequence <SEQ ID 9291> which encodes amino acid sequence <SEQ ID 9292> was also identified.

The protein has homology with the following sequences in the GENPEPT database.

```
>GP:CAB13457 GB:Z99112 similar to hypothetical proteins [Bacillus subtilis]
Identities = 259/514 (50%), Positives = 350/514 (67%), Gaps = 9/514 (1%)
Query:    1 MGMTMENGAKEVSDKPATTVGEVGQILSKGVLMGARGNSGVITSQLFRGFGQSIKDKEEL    60
            M ++M +GA+EV        +G+VG   LSKG+LMGARGNSGVI SQLFRGF ++I+ K+E+
Sbjct:   46 MNLSMTSGAREVEQMDTDDIGKVGSALSKGLLMGARGNSGVILSQLFRGFSKNIETKKEI   105
```

```
Query:  61  TGQDLAHAFQNGVEVAYKAVMKPVEGTILTVSRGAATAALKKAEETDDAVEVMRATLKGA  120
              +  A  A Q GV++AYKAVMKPVEGTILTV++ AA A+    AE+   D   +M A   + A
Sbjct: 106  NALEFAAALQAGVDMAYKAVMKPVEGTILTVAKDAAKKAMILAEKETDITALMTAVTEEA  165

Query: 121  KRALAKTPDMLPVLKEVGVVDSGGQGLVFIYEGFLSALTGEYIASEDFKATPATMTEMVN  180
              +  +L +TP++LPVLKEVGVVDSGG+GL+  +YEGFL++L GE +      KA    ++ +MV+
Sbjct: 166  EASLNRTPELLPVLKEVGVVDSGGKGLLCVYEGFLASLKGETVPQ---KAVLPSLDDMVS  222

Query: 181  AEHHKAVVGHVATEDIKYGYCTEVMVGLKQGPTYVKEFNYEEFQGYLSNLGDSLLVVNDD  240
              AEHHK+      + TEDI++G+CTEVMV  L  Q      +EF+    F+   LS   GDSLLV+ D+
Sbjct: 223  AEHHKSAQSMMNTEDIEFGFCTEVMVRLDQTK---REFDEGTFRQDLSQFGDSLLVIADE  279

Query: 241  EIVKVHVHTEDPGLVMQEGLKYGSLVKVEVENMRNQHDA---QMQKVEVEETVKETKEYG  297
               + KVH+H E+PG V+      YG L+K+K+ENMR QH +     Q   K      ET    + YG
Sbjct: 280  SLAKVHIHAEEPGNVLNYAQHYGELIKIKIENMREQHTSIISQESKPADNETPPAKQPYG  339

Query: 298  IIAVVAGDGLAEIFKSQGVDYIISGGQTMNPSTEDIVKAIEKVNARNVIILPNNKNIFMA  357
              I+ V  G+G+A++FKS G    +I GGQTMNPSTEDIV A++ VNA  V ILPNN NI MA
Sbjct: 340  IVTVAMGEGIADLFKSIGASVVIEGGQTMNPSTEDIVDAVKSVNADTVFILPNNSNIIMA  399

Query: 358  AQSAADVVDIPAAVVETRTVPQGFTSLLAFDPAKSLETNVADMTNSLSDVISGSVTLAVR  417
               A   AA VVD      V+  +TVPQG ++LLAF+P +   E N A+M +++    V SG VT +VR
Sbjct: 400  ANQAASVVDEQVFVIPAKTVPQGMSALLAFNPDQEAEANEANMLSAIQQVKSGQVTFSVR  459

Query: 418  DTTIDGLEIHENDILGMVDGKILVSTPDMEKALKDTFDKMIDEDSEIVTIYVGEDGKQAL  477
              DT IDG +I + D +G+++G I+ ++ +    A K    +MI ED EIVTI   GED   Q
Sbjct: 460  DTHIDGKDIKKGDFMGILNGTIIGTSENQLSAAKMLLSEMIGEDDEIVTILYGEDASQEE  519

Query: 478  AETLSEYLEETYEDVEVEIHQGDQPVYPYLMSVE                            511
              AE L  +L E YE++EVEIH G QP+Y Y++S E
Sbjct: 520  AEQLEAFLSEKYEEIEVEIHNGKQPLYSYIVSAE                            553
```

A related DNA sequence was identified in *S. pyogenes* <SEQ ID 5635> which encodes the amino acid sequence <SEQ ID 5636>. Analysis of this protein sequence reveals the following:

Possible site: 15
>>> Seems to have no N-terminal signal sequence

----- Final Results -----
bacterial cytoplasm --- Certainty = 0.1816 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 434/511 (84%), Positives = 475/511 (92%)
Query:   1  MGMTMENGAKEVSDKPATTVGEVGQILSKGVLMGARGNSGVITSQLFRGFGQSIKDKEEL   60
            M MTM+NGAKEV+DKPA+TVGEVGQ+LSKG+LMGARGNSGVITSQLFRGFGQSIK K+EL
Sbjct:  44  MSMTMDNGAKEVADKPASTVGEVGQMLSKGLLMGARGNSGVITSQLFRGFGQSIKGKDEL  103

Query:  61  TGQDLAHAFQNGVEVAYKAVMKPVEGTILTVSRGAATAALKKAEETDDAVEVMRATLKGA  120
            TG+DLA AFQ GVEVAYKAVMKPVEGTILTVSRGAATAALKKA+ TDDAVEVM+A L GA
Sbjct: 104  TGKDLAQAFQVGVEVAYKAVMKPVEGTILTVSRGAATAALKKADLTDDAVEVMQAALDGA  163

Query: 121  KRALAKTPDMLPVLKEVGVVDSGGQGLVFIYEGFLSALTGEYIASEDFKATPATMTEMVN  180
            K ALAKTPD+LPVLKEVGVVDSGGQGLVFIYEGFLSAL G+Y+ S DFKATPA M+EM+N
Sbjct: 164  KGALAKTPDLLPVLKEVGVVDSGGQGLVFIYEGFLSALNGDYVTSADFKATPANMSEMIN  223

Query: 181  AEHHKAVVGHVATEDIKYGYCTEVMVGLKQGPTYVKEFNYEEFQGYLSNLGDSLLVVNDD  240
            AEHHK+VVGHVATEDI YGYCTE+MV LKQGPTYVKEFNY+EFQGYLS LGDSLLVVNDD
Sbjct: 224  AEHHKSVVGHVATEDITYGYCTEIMVALKQGPTYVKEFNYDEFQGYLSGLGDSLLVVNDD  283

Query: 241  EIVKVHVHTEDPGLVMQEGLKYGSLVKVEVENMRNQHDAQMQKVEVEETVKETKEYGIIA  300
            EIVKVHVHTEDPGLVMQEGLKYGSL+K+KV+NMRNQH+AQ+QK +VE+    E K++G+IA
Sbjct: 284  EIVKVHVHTEDPGLVMQEGLKYGSLIKIKVDNMANQHEAQVQKTDVEKNKAEVKDFGLIA  343

Query: 301  VVAGDGLAEIFKSQGVDYIISGGQTMNPSTEDIVKAIEKVNARNVIILPNNKNIFMAAQS  360
            VVAG+GL+EIFK+QGVDY+ISGGQTMNPSTEDIVKAIE VNA+ VIILPNNKNIFMAAQS
Sbjct: 344  VVAGEGLSEIFKAQGVDYVISGGQTMNPSTEDIVKAIEAVNAKQVIILPNNKNIFMAAQS  403

Query: 361  AADVVDIPAAVVETRTVPQGFTSLLAFDPAKSLETNVADMTNSLSDVISGSVTLAVRDTT  420
            AA+VVDIPAAVV TRTVPQGFTSLLAFDP+KSLE NVADM+ SLSDV+SGSVTLAVRDTT
Sbjct: 404  AAEVVDIPAAVVATRTVPQGFTSLLAFDPSKSLEDNVADMSTSLSDVVSGSVTLAVRDTT  463

Query: 421  IDGLEIHENDILGMVDGKILVSTPDMEKALKDTFDKMIDEDSEIVTIYVGEDGKQALAET  480
            IDGLEIHEND LGMVDGKI+VS PDME  LK  F+KMIDEDSEIVTI+VGE+G Q LAE
Sbjct: 464  IDGLEIHENDFLGMVDGKIIVSNPDMEATLKAAFEKMIDEDSEIVTIFVGEEGDQDLAEE  523
```

```
Query: 481  LSEYLEETYEDVEVEIHQGDQPVYPYLMSVE                                511
            L+ YL ETYEDVEVEIHQGDQPVYPYLMSVE
Sbjct: 524  LAGYLGETYEDVEVEIHQGDQPVYPYLMSVE                                554
```

Based on this analysis, it was predicted that these proteins and their epitopes could be useful antigens for vaccines or diagnostics.

Example 1870

A DNA sequence (GBSx1978) was identified in. S. agalactiae <SEQ ID 5815> which encodes the amino acid sequence <SEQ ID 5816>. Analysis of this protein sequence reveals the following:

Possible site: 46
>>> Seems to have no N-terminal signal sequence
----- Final Results -----
   bacterial cytoplasm --- Certainty = 0.4771 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1871

A DNA sequence (GBSx1979) was identified in S. agalactiae <SEQ ID 5817> which encodes the amino acid sequence <SEQ ID 5818>. This protein is predicted to be proliferating-cell nucleolar antigen P120. Analysis of this protein sequence reveals the following:

Possible site: 55
>>> Seems to have no N-terminal signal sequence
----- Final Results -----
   bacterial cytoplasm --- Certainty = 0.3774 (Affirmative) <succ>
   bacterial membrane --- Certainty = 0.0000 (Not Clear) <succ>
   bacterial outside --- Certainty = 0.0000 (Not Clear) <succ>

A related GBS nucleic acid sequence <SEQ ID 9345> which encodes amino acid sequence <SEQ ID 9346> was also identified.

The protein has homology with the following sequences in the GENPEPT database.

```
>GP:AAC74905 GB:AE000278 putative nucleolar proteins [Escherichia coli K12]

Identities = 87/229 (37%), Positives = 128/229 (54%), Gaps = 8/229 (3%)

Query:  63  GKSIEHTTGLVYSQEPAAQ--IVAQIAEPQEGMKVLDLAAAPGGKTTHLLSYLNNTGLLV   120
            G + EH +GL Y QE ++    + A  A+      +V+D+AAAPG KTT + +  +NN G ++

Sbjct:  89  GSTAEHLSGLFYIQEASSMLPVAALFADGNAPQRVMDVAAAPGSKTTQISARMNNEGAIL   148

Query: 121  SNEISNKRSKILVENVERFGARNVIVTNESSQRLAKCFNSFFDLIVEDGPCSGEGMFRKD   180
            +NE S  R K+L  N+ R G  NV +T+     +           FD I+ D PCSGEG+ RKD Sbjct: 149  ANEFSASRVKVLHANISRCGISNVALTHFDGRVFGAAVPEMFDAILLDAPCSGEGVVRKD   208

Query: 181  PQAIQYWHKDYPTECAQLQRDILKEAIKMLAHGGILVYSTCTWSPEENEEVVNWLLQEY-   239
            P A++ W +   E A  QR+++  A   L  GG LVYSTCT + EENE V  WL + Y Sbjct: 209  PDALKNWSPESNQEIAATQRELIDSAFHALRPGGTLVYSTCTLNQEENEAVCLWLKETYP   268

Query: 240  ---DYLELVDIPKLNGMVEGINVPQVARMYPHHFQGEGQFVAKLRDTRS             285
               ++L  L D+      G  + +        ++P  +   EG FVA+LR T++

Sbjct: 269  DAVEFLPLGDL--FPGANKALTEEGFLHVFPQIYDCEGFFVARLRKTQA             315
```

A related DNA sequence was identified in *S. pyogenes* <SEQ ID 5819> which encodes the amino acid sequence <SEQ ID 5820>. Analysis of this protein sequence reveals the following:

```
Possible site: 34
>>> Seems to have no N-terminal signal sequence
----- Final Results -----
   bacterial cytoplasm --- Certainty = 0.2316 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below.

```
Identities = 213/311 (68%), Positives = 254/311 (81%), Gaps = 3/311 (0%)
Query:    1 MKLPNEFIEKYQTILKDEAEAFFDSFEQKPISAYRTNPLKEKQLDFPNAIPSTPWGHYGK   60
              M LP EFI  YQ IL  E E F  SF Q+P++A+R NPLK +   F + IP+T WG+YGK
Sbjct:    2 MSLPKEFINTYQAILGKELEDFLASFNQEPVNAFRINPLKNQLKTFEHPIPNTLWGYYGK   61

Query:   61 ISGKSIEHTTGLVYSQEPAAQIVAQIAEPQEGMKVLDLAAAPGGKTTHLLSYLNNTGLLV  120
             +SGKS  EH +GLVYSQEPAAQ+VAQ+A PQ+G +VLDLAAAPGGK+THLL+YL+NTGLLV
Sbjct:   62 LSGKSPEHVSGLVYSQEPAAQMVAQVAAPQKGSRVLDLAAAPGGKSTHLLAYLDNTGLLV  121

Query:  121 SNEISNKRSKILVENVERFGARNVIVTNESSQRLAKCFNSFFDLIVFDGPCSGEGMFRKD  180
             SNEIS KRSK+LVEN+ERFGARNV+VTNES+ RLAK F+ +FD IVFDGPCSGEGMFRKD
Sbjct:  122 SNEISKKRSKVLVENIERFGARNVVVTNESADRLAKVESHYFDTIVFDGPCSGEGMFRKD  181

Query:  181 PQAIQYWHKDYPTECAQLQRDILKEAIKMLAEGGILVYSTCTWSPEENEEVVNWLLQEYD  240
             P AIQYWH  YP ECA+LQ+ IL++A+ ML  GG L+YSTCTW+PEENE+VV WLL+ Y
Sbjct:  182 PDAIQYWHHGYPAECAKLQKSILEDALAMLKPGGELIYSTCTWAPEENEDVVQWLLETYT  241

Query:  241 YLELVDIPKLNGMVEGINVPQVARMYPHHFQGEGQFVAKLRDTRSKEAQKIKPKAQKIN-  299
             +LELVD+PKLNGMV GI +P+ ARMYPH +QGEGQFVAKL+D R +E Q  K KA K N
Sbjct:  242 FLELVDVPKLNGMVSGIGLPETARMYPHRYQGEGQFVAKLKDKR-QEGQSTKLKAPKSNL  300

Query:  300 -KMQLQLWQQF                                                  309
              K QL+LW+ F
Sbjct:  301 IKDQLRLWKMF                                                  311
```

Based on this analysis, it was predicted that these proteins and their epitopes could be useful antigens for vaccines or diagnostics.

Example 1872

A DNA sequence (GBSx1980) was identified in *S. agalactiae* <SEQ ID 5821> which encodes the amino acid sequence <SEQ ID 5822>. Analysis of this protein sequence reveals the following:

```
Possible site: 41
>>> Seems to have no N-terminal signal sequence
----- Final Results -----
   bacterial cytoplasm --- Certainty = 0.4111 (Affirmative) <succ>
   bacterial membrane --- Certainty = 0.0000 (Not Clear) <succ>
   bacterial outside --- Certainty = 0.0000 (Not Clear) <succ>
```

The protein has homology with the following sequences in the GENPEPT database.

```
>GP:AAC24940 GB:AF012285 unknown [Bacillus subtilis]
Identities = 86/240 (35%), Positives = 133/240 (54%), Gaps = 10/240 (4%)
Query:    6 DFAKQLVYKAGQFIKSEMQNTFDVEEKSRFDDLVTSLDKKTQKLLIQEIIQHYPDDNILA   65
             + AK+ + +AG  I   M   +E KS  +DLVT++DK+T+K  I  I + +P    IL
Sbjct:    9 EIAKKWIREAGARITQSMHESLTIETKSNPNDLVTNIDKETEKFFIDRIQETFPGHRILG   68

Query:   66 EE---DBVRSPIAQGNVWVLDPIDGTVNFIVQKDNFAVMLAYYEEGVGQFGIIYDVMADI  122
             EE   D + S   +G VW++DPIDGT+NF+ Q+ NFA+ +   +E G G+ G+IYDV+ D
Sbjct:   69 EEGQGDKIHS--LEGVVWIIDPIDGTMNFVHQQRNFAISIGIFENGEGKIGLIYDVVHDE  126

Query:  123 LYSGGGHFDVYANDKKIVPFQECPLERCLLGVNSAMYAEN----DCGIAHLASETLGVRI  178
             LY       Y N+ K+ P +E  +E  +L +N+      EN       +A L    G R
Sbjct:  127 LYHAFSGRGAYMNETKLAPLKETVIEEAILAINATWVTENRRIDQSVLAPLVKRVRGTRS  186

Query:  179 YGGAGISMAKVMQGKLLAYFSY-IQPWDYAAAKIMGETLGFTLLTLDGEEPNYSTRQKVM  237
              YG  A +  +A V G++  AY +   + PWDYAA  ++   +G T  T++GE  +    V+
Sbjct:  187 YGSAALELANVAAGRIDAYITMRLAPWDYAAGCVLLNEVGGTYTTIEGEPFTFLENHSVL  246
```

A related GBS nucleic acid sequence <SEQ ID 10937> which encodes amino acid sequence <SEQ ID 10938> was also identified.

A related DNA sequence was identified in *S. pyogenes* <SEQ ID 5823> which encodes the amino acid sequence <SEQ ID 5824>. Analysis of this protein sequence reveals the following:

```
Possible site: 15
>>> Seems to have no N-terminal signal sequence
----- Final Results -----
    bacterial cytoplasm --- Certainty = 0.1843 (Affirmative) <succ>
      bacterial membrane --- Certainty = 0.0000 (Not Clear) <succ>
        bacterial outside --- Certainty = 0.0000 (Not Clear) <succ>
```

An alignment of the GAS and GBS proteins is shown below.

```
Identities = 155/253 (61%), Positives = 205/253 (80%)
Query:   1  MDAKFDFAKQLVYKAGQFIKSEMQNTFDVEEKSRFDDLVTSLDKKTQKLLIQEIIQHYPD   60
            ++ K+ FA+Q++ +AG FIKS+M    D++ K++FDDLVT++D++TQ+LL+   I Q YP
Sbjct:   8  LETKYAFARQIIKEAGLFIKSKMSEQLDIQVKTQFDDLVTNVDQETQQLLMDRIHQTYPC   67

Query:  61  DNILAEEDBVRSPIAQGNVWVLDPIDGTVNFIVQKDNFAVMLAYYEEGVGQFGIIYDVMA  120
            D ILAEE++VR PI QGNVWV+DPIDGTVNFIVQ   FAVM+AYYE+G+GQFG+IYDVMA
Sbjct:  68  DAILAEENDVRHPINQGNVWVIDPIDGTVNFIVQGSQFAVMIATYEQGIGQFGLIYDVMA  127

Query: 121  DILYSGGGHFDVYANDKKIVPFQECPLERCLLGVNSAMYAENDCGIAHLASETLGVRIYG  180
            D L +GGG F+V  N  K+  +QE PLER L+G N+ M+A ND  +AHL ++TLGVR+YG
Sbjct: 128  DQLLAGGGDFEVTLNGDKLPAYQEKPLERSLIGCNAGMFARNDRNLAHLIAKTLGVRVYG  187

Query: 181  GAGISMAKVMQGKLLAYFSYIQPWDYAAAKIMGETLGFTLLTLDGEEPNYSTRQKVMFLP  240
            GAGI M KVM+ +LLAYFS+IQPWDYAAAK++G+ LG+ LLT+DG EP++ TRQK+MF+P
Sbjct: 188  GAGICMVKVMKQELLAYFSFIQPWDYAAAKVLGDKLGYVLLTIDGYEPDFQTRQKIMFVP  247

Query: 241  KSKLNLIQSYLTK                                                253
            K +L   I S+LTK
Sbjct: 248  KCQLTRIASFLTK                                                260
```

Based on this analysis, it was predicted that these proteins and their epitopes could be useful antigens for vaccines or diagnostics.

Example 1873

A DNA sequence (GBSx1981) was identified in *S. agalactiae* <SEQ ID 5825> which encodes the amino acid sequence <SEQ ID 5826>. Analysis of this protein sequence reveals the following:

```
Possible site: 16
>>> Seems to have no N-terminal signal sequence
----- Final Results -----
    bacterial cytoplasm --- Certainty = 0.4131 (Affirmative) <succ>
      bacterial membrane --- Certainty = 0.0000 (Not Clear) <succ>
        bacterial outside --- Certainty = 0.0000 (Not Clear) <succ>
```

The protein has homology with the following sequences in the GENPEPT database.

```
>GP:AAC24938.GB:AF012285 unknown [Bacillus subtilis]

Identities = 33/78 (42%), Positives = 50/78 (63%)

Query:  13  YSYPLDPSWNTEDITKVLRFLNQVEHAYENSIKVDDLLDSYKEFKKVVKSKAQEKQIDRE   72

Y YP++  W TE+    V+ F  QVE AYE     ++LL +Y+ FK++V  KA+EK++  E

Sbjct:   3  YQYPMNEDWTTEEAVDVIAFFQQVELAYEKGADREELLKAYRRFKEIVPGKAEEKKLCGE   62

Query:  73  FQRTSGYSTYQAVKAAQQ                                           90

F+   S YS Y+ VK A++

Sbjct:  63  FEEQSTYSPYRTVKQARE                                           80
```

A related DNA sequence was identified in *S. pyogenes* <SEQ ID 5827> which encodes the amino acid sequence <SEQ ID 5828>. Analysis of this protein sequence reveals the following:

```
Possible site: 60
>>> Seems to have no N-terminal signal sequence
----- Final Results -----
   bacterial cytoplasm --- Certainty = 0.4442 (Affirmative) <succ>
    bacterial membrane --- Certainty = 0.0000 (Not Clear) <succ>
     bacterial outside --- Certainty = 0.0000 (Not Clear) <succ>
```

An alignment of the GAS and GBS proteins is shown below.

```
Identities = 59/91 (64%), Positives = 70/91 (76%)
Query:   9 ISSNYSYPLDPSWNTEDITKVLRFLNQVEHAYENSIKVDDLLDSYKEFKKVVKSKAQEKQ  68
           +S NY YPLD SW+TE+I+ VL FLN+VE AYE +    LLDSYK +K +VKSKAQEKQ
Sbjct:   5 MSGNYYYPLDLSWSTEEISSVLHFLNKVELAYEKKVDAKQLLDSYKTYKTIVKSKAQEKQ  64

Query:  69 IDREFQRTSGYSTYQAVKAAQQQAKGFISLG  99
           IDR+FQ+ SGYSTYQ VK A+   KGF SLG
Sbjct:  65 IDRDFQKVSGYSTYQVVKKAKAIEKGFFSLG  95
```

Based on this analysis, it was predicted that these proteins and their epitopes could be useful antigens for vaccines or diagnostics.

Example 1874

A DNA sequence (GBSx1982) was identified in *S. agalactiae* <SEQ ID 5829> which encodes the amino acid sequence <SEQ ID 5830>. Analysis of this protein sequence reveals the following:

```
Possible site: 18
>>> Seems to have no N-terminal signal sequence (or aa 1-18)
----- Final Results -----
   bacterial cytoplasm --- Certainty = 0.0952 (Affirmative) <succ>
    bacterial membrane --- Certainty = 0.0000 (Not Clear) <succ>
     bacterial outside --- Certainty = 0.0000 (Not Clear) <succ>
```

The protein has homology with the following sequences in the GENPEPT database.

```
>GP:AAF21893 GB:AF103794 unknown [Listeria monocytogenes]
Identities = 74/126 (58%), Positives = 101/126 (79%)
Query:   1 MITLFLSPSCTSCRKARAWLSKHEVAFEEHNIITSPLNKEELLQILSFTENGTEDIISTR   60
           M+TL+ SPSCTSCRK+RAWL +H++ ++E NI + PL+ +E+ +IL  TE+GT++IISTR
Sbjct:   1 MVTLYTSPSCTSCRKSRAWLEEHDIPYKERNIFSEPLSLDEIKEILRMTEDGTDEIISTR   60

Query:  61 SKVFQKLAIDVDELSTSSLMELISENPSLLRRPIILDKKRMQIGFNEDEIRAFLPRDYRK  120
           SK FQKL +D+D L    L ELI +NP LLRRPII+D+KR+Q+G+NEDEIR FLPR  R
Sbjct:  61 SKTFQKLNVDLDSLPLQQLFELIQKNPGLLRRPIIIDEKRLQVGYNEDEIRRFLPRRVRT  120

Query: 121 QELKQA  126
           +L++A
Sbjct: 121 YQLREA  126
```

A related DNA sequence was identified in *S. pyogenes* <SEQ ID 5831> which encodes the amino acid sequence <SEQ ID 5832>. Analysis of this protein sequence reveals the following:

Possible site: 49
>>> Seems to have no N-terminal signal sequence
----- Final Results -----
   bacterial cytoplasm --- Certainty = 0.0511 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

```
Identities = 112/134 (83%), Positives = 127/134 (94%)
Query:    1 MITLFLSPSCTSCRKARAWLSKHEVAFEEHNIITSPLNKEELLQILSFTENGTEDIISTR   60
            M+TLFLSPSCTSCRKARAWL KHEV F+EHNIITSPL+++EL+ ILSFTENGTEDIISTR
Sbjct:    1 MVTLFLSPSCTSCRKARAWLVKHEVDFQEHNIITSPLSRDELMSILSFTENGTEDIISTR   60

Query:   61 SKVFQKLAIDVDELSTSSLMELISENPSLLRRPIILDKKRMQIGFNEDEIRAFLPRDYRK  120
            SKVFQKL IDV+ELS S L++LI++NPSLLRRPII+D+KRMQIGFNEDEIRAFL RDYRK
Sbjct:   61 SKVFQKLDIDVEELSISDLIDLIAKNPSLLRRPIIMDQKRMQIGFNEDEIRAFLSRDYRK  120

Query:  121 QELKQATIRAEIEG                                                134
            QEL+QATI+AEIEG
Sbjct:  121 QELRQATIKAEIEG                                                134
```

SEQ ID 5830 (GBS232) was expressed in *E. coli* as a His-fusion product. SDS-PAGE analysis of total cell extract is shown in FIG. 51 (lane 10; MW 16.8 kDa). It was also expressed in *E. coli* as a GST-fusion product. SDS-PAGE analysis of total cell extract is shown in FIG. 56 (lane 2; MW 42 kDa).

GBS232-GST was purified as shown in FIG. 207, lane 7.

Based on this analysis, it was predicted that these proteins and their epitopes could be useful antigens for vaccines or diagnostics.

Example 1875

A DNA sequence (GBSx1983) was identified in *S. agalactiae* <SEQ ID 5833> which encodes the amino acid sequence <SEQ ID 5834>. Analysis of this protein sequence reveals the, following:

Possible site: 39
>>> Seems to have an uncleavable N-term signal seq
----- Final Results -----
     bacterial membrane --- Certainty = 0.0000 (Not Clear) <succ>
       bacterial outside --- Certainty = 0.0000 (Not Clear) <succ>
   bacterial cytoplasm --- Certainty = 0.0000 (Not Clear) <succ>

A related DNA sequence was identified in *S. pyogenes* <SEQ ID 5835> which encodes the amino acid sequence <SEQ ID 5836>. Analysis of this protein sequence reveals the following:

Possible site: 39
>>> Seems to have no N-terminal signal sequence
----- Final Results -----
   bacterial cytoplasm --- Certainty = 0.1768 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

```
Identities = 210/308 (68%), Positives = 252/308 (810)
Query:    1 MKIHYINDYKDIQAKEDCVLVLGYFDGLHLGHKALFDKAKKIATEKNLKIVVLTFNETPR   60
            M+I YI DY+DI  ++D VL+LGYFDGLH GHKALFDKA+++A ++ LK+VV TF E+P+
Sbjct:    1 MEIEYIKDYRDINQEDDTVLILGYFDGLHRGHKALFDKAREVANKEGLKVVVFTFTESPK   60

Query:   61 LTFARFQPELLLHLTSPEKRSEKFQEYGVDELYLMNFTSHFSKVSSDLFIKKYIYGLRAK  120
            L F+RF PELLLH+T P+KR EKF +YGV++LYL++FTS FSKVSSD FI  YI  L+AK
Sbjct:   61 LAFSRFSPELLLHITYPKKRYEKFADYGVNKLYLVDFTSKFSKVSSDHFITHYIKNLKAK  120

Query:  121 AAVVGFDYKFGHNRTSGDYLARNFKGPVYIIDEISEGGEKISSTRIRQLITEGNVEKANQ  180
               VVGFDYKFGHNRT  DYL RNF+G VY I+EI E   KIS+T IR+LI EGNV KAN
Sbjct:  121 HIVVGFDYKFGHNRTDSDYLTRNFEGQVYTIEEIKEDHRKISATWIRKLIQEGNVVKANH  180

Query:  181 LLGYEFSTCGMVVHGDARGRTIGFPTANLAPINRTYLPADGVYISNVLINGKYYRAMTSI  240
            LLGY+ ST G VVHGDARGRTIGFPTANLAPI+ TYLPADGVY++NV++   K YR+MTS+
Sbjct:  181 LLGYDLSTRGRVVHGDARGRTIGFPTANLAPIDNTYLPADGVYVTNVIVANKIYRSMTSL  240

Query:  241 GKNITFGGTELRLEANIFDFDGDIYGETIEIFWLKRIREMVKFNGIDDLVKQLKKDKEIA  300
            GKN+TFGG ELRLE NIFDFD +IYGE IEI WL +IR+M KF GI+DL  +L+ DK  A
Sbjct:  241 GKNVTFGGKELRLEVNIFDFDEEIYGEIIEIVWLDKIRDMEKFEGIEDLTDRLEYDKRTA  300

Query:  301 LNWKKDSQ                                                      308
            LNWKKDS+
Sbjct:  301 LNWKKDSK                                                      308
```

Based on this analysis, it was predicted that these proteins and their epitopes could be useful antigens for vaccines or diagnostics.

Example 1876

A DNA sequence (GBSx1984) was identified in *S. agalactiae* <SEQ ID 5837> which encodes the amino acid sequence <SEQ ID 5838>. This protein is predicted to be tRNA pseudouridine 5S synthase (truB). Analysis of this protein sequence reveals the following:

```
Possible site: 56
>>> Seems to have no N-terminal signal sequence
----- Final Results -----
    bacterial cytoplasm --- Certainty = 0.2576 (Affirmative) <succ>
    bacterial membrane --- Certainty = 0.0000 (Not Clear) <succ>
    bacterial outside --- Certainty = 0.0000 (Not Clear) <succ>
```

A related GBS nucleic acid sequence <SEQ ID 9817> which encodes amino acid sequence <SEQ ID 9818> was also identified.

The protein has homology with the following sequences in the GENPEPT database.

```
>GP:BAB06129 GB:AP001515 tRNA pseudouridine 5S synthase [Bacillus halodurans]
Identities = 145/283 (51%), Positives = 191/283 (67%), Gaps = 12/283 (4%)
Query:   2 ITGIINLKKEAGMTSHDAVFKLRKILHTKKIGHGGTLDPDVVGVLPIAVGKATRVIEYMT   61
           +TGI+ L K  GMTSHD V KLR++L TKK+GH GTLDPDV GVLP+ +G AT+V +YM+
Sbjct:   3 MTGILPLAKPRGMTSHDCVAKLRRLLKTKKVGHTGTLDPDVYGVLPVCIGHATKVAQYMS   62

Query:  62 ESGKIYEGEITLGYATSTEDSSGEVISRTPLTQSDLSEDVVDHAMKSFTGPITQVPPMYS  121
           +   K YEGE+T+G++T+TED SG+ +  T    Q     E VVD   +F G I Q+PPMYS
Sbjct:  63 DYPKAYEGEVTVGFSTTTEDRSGDTVE-TKTIQQPFVEAVVDQVLATFVGEIKQIPPMYS  121

Query: 122 AVKVNGKKLYEYARSGEEVERPKRQITISEFRRTSPLYFEKGICRFSFYVSCSKGTYVRT  181
           AVKV GK+LYEYAR+G  VERP+R +TI    R S + +E+G+CRF F VSCSKGTYVRT
Sbjct: 122 AVKVRGKRLYEYARAGITVERPERTVTIFSLERMSDIVYEEGVCRFRFNVSCSKGTYVRT  181

Query: 182 LAVDLGIKLGYASHMSFLKRTSSAGLSITQSLTLEEINEKYKQ-EDFSFLLPIEYGVLDL  240
           LAVD+G  LGY +HMS L RT S   S+ +  T  E+ E+ +Q E  S LLPIE  +LD+
Sbjct: 182 LAVDIGKALGYPAHMSDLVRTKSGPFSLEECFTFTELEERLEQGEGSSLLLPIETAILDI  241

Query: 241 PKVNLTEEDKVEISYGR----------RILLENEADTLAAFYE                 273
           P+V + +E + +I +G              R  + NE   L A Y+
Sbjct: 242 PRVQVNKEIEEKIRHGAVLPQKWFNHPRFTVYNEEGALLAIYK                 284
```

A related DNA sequence was identified in *S. pyogenes* <SEQ ID 5839> which encodes the amino acid sequence <SEQ ID 5840>. Analysis of this protein sequence reveals the following:

```
Possible site: 56
>>> Seems to have no N-terminal signal sequence
----- Final Results -----
    bacterial cytoplasm --- Certainty = 0.2698 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
Identities = 201/295 (68%), Positives = 246/295(83%), Gaps = 2/295 (0%)
Query:   1 MITGIINLKKEAGMTSHDAVFKLRKILHTKKIGHGGTLDPDVVGVLPIAVGKATRVIEYM   60
           MI GIINLKKEAGMTSHDAVFKLRK+L   KKIGHGGTLDPDVVGVLPIAVGKATRVIEYM
Sbjct:   1 MINGIINLKKEAGMTSHDAVFKLRKLLQEKKIGHGGTLDPDVVGVLPIAVGKATRVIEYM   60

Query:  61 TESGKIYEGEITLGYATSTEDSSGEVISRTPLTQSDLSEDVVDHAMKSFTGPITQVPPMY  120
           TE+GK+YEG++TLGY+T+TED+SGEV++R+ L   L+E++VD  M +F G ITQ PPMY
Sbjct:  61 TEAGKVYEGQVTLGYSTTTEDASGEVVARSSL-PAVLTEELVDQTMTTFLGKITQTPPMY  119

Query: 121 SAVKVNGKKLYEYARSGEEVERPKRQITISEFRRTSPLYF-EKGICRFSFYVSCSKGTYV  179
           SAVKVNG+KLYEYAR+GE VERP+R++TIS F RTSPL F E G+CRFSF V+CSKGTYV
Sbjct: 120 SAVKVNGRKLYEYARAGESVERPRREVTISLFERTSPLNFTEDGLCRFSFKVACSKGTYV  179

Query: 180 RTLAVDLGIKLGYASHMSFLKRTSSAGLSITQSLTLEEINEKYKQEDFSFLLPIEYGVLD  239
           RTLAVDLG  LG  SHMSFL+R++SAGL++  + TL EI +    +++ SFLLPIEYGV D
Sbjct: 180 RTLAVDLGRALGVESHMSFLQRSASAGLTLETAYTLGEIADMVSKQEMSFLLPIEYGVAD  239

Query: 240 LPKVNLTEEDKVEISYGRRILLENEADTLAAFYENRVIAILEKRGNEFKPHKVLL       294
```

```
                    LPK+ + + +   EIS+GRR+ L ++     LAAF+  +VIAILEKR  E+KP KVL+
Sbjct:  240  LPKMVIDDTELTEISFGRRLSLPSQEPLLAAFHGEKVIAILEKRDQEYKPKKVLI      294
```

Based on this analysis, it was predicted that these proteins and their epitopes could be useful antigens for vaccines or diagnostics.

Example 1877

A DNA sequence (GBSx1985) was identified in *S. agalactiae* <SEQ ID 5841> which encodes the amino acid sequence <SEQ ID 5842>. Analysis of this protein sequence reveals the following:

---

Possible site: 50
>>> Seems to have no N-terminal signal sequence
----- Final Results -----
    bacterial cytoplasm --- Certainty = 0.2776 (Affirmative) <succ>
        bacterial membrane --- Certainty = 0.0000 (Not Clear) <succ>
            bacterial outside --- Certainty = 0.0000 (Not Clear) <succ>

---

A related GBS nucleic acid sequence <SEQ ID 9819> which encodes amino acid sequence <SEQ ID 9820> was also identified.

The protein has homology with the following sequences in the GENPEPT database.

A related DNA sequence was identified in *S. pyogenes* <SEQ ID 5843> which encodes the amino acid sequence <SEQ ID 5844>. Analysis of this protein sequence reveals the following:

---

Possible site: 49
>>> Seems to have no N-terminal signal sequence
----- Final Results -----
    bacterial cytoplasm --- Certainty = 0.0962 (Affirmative) <succ>
        bacterial membrane --- Certainty = 0.0000 (Not Clear) <succ>
            bacterial outside --- Certainty = 0.0000 (Not Clear) <succ>

---

```
>GP:CAB12871 GB:Z99109 similar to hypothetical proteins [Bacillus subtilis]
Identities = 39/145 (26%), Positives = 68/145 (46%), Gaps = 7/145 (4%)
Query:    3  MKIRTATLDDSEKLVPLYQELG----YAISLSEIQSILKVILTHSDYGFLIAEDNGKLLA    58
             M IR A   D+ + PL+ +       A L   ++ LK  L + +    LIAE+NG+ +
Sbjct:    1  MNIRQAKTSDAAAIAPLFNQYREFYRQASDLQGAEAFLKARLENHESVILIAEENGEFIG   60

Query:   59  FVGYHKLYFFEKSGTYYRILALVVNEKHRRKGIASQLINHVKQLAKTDGSEVLALNSSLK  118
             F  + +        Y + L V    R KG   +L++   K A  +G++ L L +   +
Sbjct:   61  FTQLYPTESSVSMKRIYILNDLFVVPHARTKGAGGRLLSAAKDYAGQNGAKCLTLQT--E  118

Query:  119  EYRQEAYHFYENLGFKKVSTGFSYY                                    143
             + ++A    YE  G+++   TGF +Y
Sbjct:  119  HHNRKARSLYEQNGYEE-DTGFVHY                                    142
```

An alignment of the GAS and GBS proteins is shown below.

```
Identities = 37/126 (29%), Positives = 64/126 (50%), Gaps = 16/126 (12%)

Query:   18  PLYQE-----LGYAISLSEIQSILKVILTHSDYGFLIA--EDNGKLLAFVG---YHKLYF   67
             P+ QE     LGY +SL  ++   + ++   + FL    +D  +LL +V     Y  LY
Sbjct:   11  PMLQEINAKALGYLVSLDLLERQYERLIEDCHHYFLAYADKDTNQLLGYVHAERYETLY-   69

Query:   68  FEKSGTYYRILALVVNEKHRRKGIASQLINHVKQLAKTDGSEVLALNSSLKEYRQEAYHF  127
             +         +L L V   ++R+GI S L+   ++   A+  +G    + LNS+    +R+EA+  F
Sbjct:   70  ---ASDGLNLLGLAVLPAYQRRGIGSALLRALESQARQEGIAFIRLNSA--SHRKEAHAF  124

Query:  128  YENLGF                                                       133
             Y NL +
Sbjct:  125  YRNLDY                                                       130
```

Based on this analysis, it was predicted that these proteins and their epitopes could be useful antigens for vaccines or diagnostics.

Example 1878

A DNA sequence (GBSx1986) was identified in *S. agalactiae* <SEQ ID 5845> which encodes the amino acid sequence <SEQ ID 5846>. Analysis of this protein sequence reveals the following:

Possible site: 14
>>> Seems to have no N-terminal signal sequence
----- Final Results -----
   bacterial cytoplasm --- Certainty = 0.1659 (Affirmative) <succ>
     bacterial membrane --- Certainty = 0.0000 (Not Clear) <succ>
     bacterial outside --- Certainty = 0.0000 (Not Clear) <succ>

RGD motif 28-30
The protein has homology with the following sequences in the GENPEPT database.

```
>GP:AAF30776 GB:AE002133 conserved hypothetical [Ureaplasma urealyticum]
Identities = 106/440 (24%), Positives = 206/440 (46%), Gaps = 65/440 (14%)
Query:    13 FAINESEYHQLLEQIRGDAFDKEVSERLEKERLILGEQAKNQLQEVVVE-KDKEIAKLQY   71
             F  N+ +Y++L++Q     +D       LEK+R  L E+ KN+  +  +    KD +  K
Sbjct:    71 FLANDRDYNELVKQ----RYD------LEKQRDELKEKLKNEGNKAIAHFKDSDEYKNLI  120

Query:    72 KVKQFLIEKDNLLKDNEYQLAEQLNQKDMMLRD--------LENQIDRLRLEHENSLQEA  123
             K ++  +    + ++ NE    +++     ++ L+            L+N I +  ++ +N+ + A
Sbjct:   121 KAQEKINSLNKTIESNEQSYKKEIENIELKLKSQFDEETKSLKNTIAKQEIKLDNAEKMA  180

Query:   124 LTKVERE-------RDAIQNQLHIQ-------------------EKEKDLALASVKSDY  156
             +   +          +D I   + I+                     E +K + +   ++S
Sbjct:   181 IINFKESNEYQKIIKDKIDLDIEIEKLKFAIQAHEDNMKAAKENWESKKIVEIKELESKK  240

Query:   157 EVQLKAANEQVEFYKNFKAQQSTKAVGESLEHYAETEFNKVRHLAFPNAYFEKDNTLSSR  216
              + ++      E  +E    K+  K+    + K VGE LE +    +  +F++      + P+   F K N
Sbjct:   241 DKEIHKLTESIEQLKREKSS-NVKLVGEELEQWLKNKFDETYSFSCPDMTFTKINEAID-  298

Query:   217 GSKGDFIY------REKDENDLEFL-SIMFEMKNESDDTIKKHKNEDFFKELDKDRREKS  269
             G K  DF+           +E   +D + + S      E K E    D     K N    +K+LD+DR +
Sbjct:   299 GKKADFLLEFFDFGKEMSNDDKKLIFSATIEAKTEFFDNQKGTKNSAHYKELDQDRINQK  358

Query:   270 CEYAVLVTMLEADNDYYNTGIVDVSHKYPKMYVIRPQFFIQLIFILRNAALNTLKYKQEL  329
                EYA+LVT LE ++ +     ++      ++Y  M+  +RPQ+FI  L+  ++RN A    TLK  K
Sbjct:   359 SEYAILVTELEPEDHF----VIKKINEYKNMFAVRPQYFIPLVDMIRNFA--TLKAKINS  412

Query:   330 ALMKEQNIDITHFEEDLDIFKNAFAKN-YNSASKNFQKAIDEIDKSIKRMEAV-KAALTT  387
              +++ + D      EE+LD   K       N   +  +K ID+     IK+ E++  ++A
Sbjct:   413 QIIRYE--DRAKIEENLDELKKDIVDNTLKYINDKTKKIIDDSKAIIKKAESIEESAEDI  470

Query:   388 SENQLRLANNKLDDVSVKKL                                         407
             +L         K+++++++K+
Sbjct:   471 INKKLNTLKKKINELTIRKI                                         490
```

A related DNA sequence was identified in *S. pyogenes* <SEQ ID 5847> which encodes the amino acid sequence <SEQ ID 5848>. Analysis of this protein sequence reveals the following:

Possible site: 33
>>> Seems to have no N-terminal signal sequence
----- Final Results -----
   bacterial cytoplasm --- Certainty = 0.3192 (Affirmative) <succ>
     bacterial membrane --- Certainty = 0.0000 (Not Clear) <succ>
     bacterial outside --- Certainty = 0.0000 (Not Clear) <succ>

An alignment of the GAS and GBS proteins is shown below.

```
Identities = 310/445 (69%), Positives = 352/445 (78%), Gaps = 22/445 (4%)
Query:     1 MNEIKCPHCGTAFAINESEYHQLLEQIRGDAFDKEVSERLEKERLILGEQAKNQLQEVVV   60
             MNEIKCPHC T F INESEY QLLEQ+RG AFD+E+ +RL  E   +L E+AK+QL EVV
Sbjct:     1 MNEIKCPHCHTLFTINESEYSQLLEQVRGQAFDEELKKRLINEIALLEEKAKHQLHEVVA   60

Query:    61 EKDKEIAKLQYKVKQF----------LIEKDNLL-----------KDNEYQLAEQLNQK   98
             +K+  I  L   +++Q          L +KD L+                  N  +LA QL +K
Sbjct:    61 KKETAITSLTNQLEQIEKEQAYLRQEELAKKDQLIASLEAKLDKLASQNALELANQLAEK  120

Query:    99 DMMLRDLENQIDRLRLEHENSLQEALTKVERERDAIQNQLHIQEKEKDLALASVKSDYEV  158
             D   +  L NQ+D+L LE + + Q   L  +E+ERD I+NQL +Q KE +L+LASV+SDYE
```

```
Sbjct: 121  DKEVVSLTNQLDKLALEKDATFQSKLATIEKERDGIKNQLALQAKESELSLASVRSDYEA  180

Query: 159  QLKAANEQVEFYKNFKAQQSTKAVGESLEHYAETEFNKVRHLAFPNAYFEKDNTLSSRGS  218
            QLKAANEQVEFYKNFKAQQSTKA+GESLE YAETEFNKVR  AFPNA F KDN LSSRGS
Sbjct: 181  QLKAANEQVEFYKNFKAQQSTKAIGESLELYAETEFNKVRSYAFPNASFVKDNQLSSRGS  240

Query: 219  KGDFIYREKDENDLEFLSIMFEMKNESDDTIKKHKNEDFFKELDKDRREKSCEYAVLVTM  278
            KGD+IYRE D N +E LSIMFEMKNE+D T  KHKN DFFKELDKDRREK CEYAVLV+M
Sbjct: 241  KGDYIYREVDANGVEILSIMFEMKNEADTTKTKHKNSDFFKELDKDRREKDCEYAVLVSM  300

Query: 279  LEADNDYYNTGIVDVSHKYPKMYVIRPQFFIQLIGILRNAALNTLKYKQELALMKEQNID  338
            LEADNDYYNTGIVDVSH+Y KMYV+RPQ FIQLIGILRNAALN+L YKQELAL+KEQNID
Sbjct: 301  LEADNDYYNTGIVDVSHEYQKMYVVRPQLFIQLIGILRNAALNSLHYKQELALVKEQNID  360

Query: 339  ITHFEEDLDIFENAFAKNYNSASKNFQKAIDEIDKSIKRMEAVKAALTTSENQLRLANNK  398
            ITHFEEDLD FKNAFAKNY SAS NF+KAIDEIDKSIKRME VK  LTTSENQLRLANNK
Sbjct: 361  ITHFEEDLDQFKNAFAKNYQSASNNFKKAIDEIDKSIKRMEEVKRFLTTSENQLRLANNK  420

Query: 399  LDDVSVKKLTRKNPTMKAKFDALKD                                    423
            L+DVSVKKLTR+NPTM+ KF+ALKD
Sbjct: 421  LEDVSVKKLTRQNPTMREKFEALKD                                    445
```

SEQ ID 5846 (GBS304) was expressed in *E. coli* as a His-fusion product. The purified protein is shown in FIG. 206, lane 7.

Based on this analysis, it was predicted that these proteins and their epitopes could be useful antigens for vaccines or diagnostics.

Example 1879

A DNA sequence (GBSx1987) was identified in *S. agalactiae* <SEQ ID 5849> which encodes the amino acid sequence <SEQ ID 5850>. This protein is predicted to be unnamed protein product. Analysis of this protein sequence reveals the following:

```
Possible site: 34
>>> Seems to have no N-terminal signal sequence
----- Final Results -----
   bacterial cytoplasm --- Certainty = 0.1845 (Affirmative) <succ>
     bacterial membrane --- Certainty = 0.0000 (Not Clear) <succ>
       bacterial outside --- Certainty = 0.0000 (Not Clear) <succ>
```

The protein has no significant homology with any sequences in the GENPEPT database.

A related DNA sequence was identified in *S. pyogenes* <SEQ ID 5851> which encodes the amino acid sequence <SEQ ID 5852>. Analysis of this protein sequence reveals the following:

```
Possible site: 51
>>> Seems to have no N-terminal signal sequence
----- Final Results -----
   bacterial cytoplasm --- Certainty = 0.2492 (Affirmative) <succ>
     bacterial membrane --- Certainty = 0.0000 (Not Clear) <succ>
       bacterial outside --- Certainty = 0.0000 (Not Clear) <succ>
```

An alignment of the GAS and GBS proteins is shown below.

```
Identities = 113/180 (62%), Positives = 141/180 (77%)
Query:  16  LSELVDCFKGKAVPSKAEAGDIRIINLSDMSPLGIDYHNLRTFQDEQRSLLKYLLQEGDV   75
            L  +VDCFKGKAV SK   GD+ +INLSDM  LGI YH LRTFQ ++R LL+YLL++GDV
Sbjct:  18  LGTVVDCFKGKAVSSKVVPGDVGLINLSDMGTLGIQYHQLRTFQMDRRQLLRYLLEDGDV   77

Query:  76  LIASKGTVKKVAIFEEQDYPVVASANITILRPTQHIRGYYLKLFFDSEEGQQALENANKG  135
            LIASKGT+KKV +F +Q+  VVAS+NIT+LRP + +RGYY+K F DS  GQ  L+ A+ G
Sbjct:  78  LIASKGTLKKVCVFHKQNRDVVASSNITVLRPQKLLRGYYIKFFLDSPIGQALLDVADHG  137

Query: 136  KAVMNISTKELLNIAIPSIPLFRQDYLIQRYKQGLNDYKRKIARAEQEWERIQNDIRQQL  195
            K V+N+STKELL+I IP IPL +QDYLI  Y +GL DY RK+ RAEQEWE IQN+I++ L
Sbjct: 138  KDVINLSTKELLDIPIPVIPLVKQDYLINHYLRGLTDYHRKLNRAEQEWEYIQNEIQKGL  197
```

Based on this analysis, it was predicted that these proteins and their epitopes could be useful antigens for vaccines or diagnostics.

Example 1880

A DNA sequence (GBSx1988) was identified in *S. agalactiae* <SEQ ID 5853> which encodes the amino acid sequence <SEQ ID 5854>. Analysis of this protein sequence reveals the following:

```
Possible site: 15
>>> Seems to have a cleavable N-term signal seq.
  INTEGRAL    Likelihood = -7.43   Transmembrane 62-78 (55-82)
  INTEGRAL    Likelihood = -2.87   Transmembrane 130-146 (130-150)
  INTEGRAL    Likelihood = -1.28   Transmembrane 37-53 (37-53)
----- Final Results -----
     bacterial membrane --- Certainty = 0.3972 (Affirmative) <succ>
       bacterial outside --- Certainty = 0.0000 (Not Clear) <succ>
   bacterial cytoplasm --- Certainty = 0.0000 (Not Clear) <succ>
```

A related GBS nucleic acid sequence <SEQ ID 9347> which encodes amino acid sequence <SEQ ID 9348> was also identified.

The protein has homology with the following sequences in the GENPEPT database.

```
>GP:CAA22372 GB:AL034446 putative transmembrane protein
[Streptomyces coelicolor A3(2)]
Identities = 38/139 (27%), Positives = 64/139 (45%), Gaps = 5/139 (3%)
Query:  15 SASVEILCRGWLLPVSATKYSKIVSVSISSIFFGLLHSANNHVSLISIFNLCL-FGLFLS    73
              +A+ E++ RG L  +       +++ ++ + FGL+H  N   +L    + + G  L+
Sbjct: 143 AATEEVVFRGVLFRIIEEHIGTYLALGLTGLVFGLMHLLNEDATLWGALAIAIEAGFMLA   202

Query:  74 LYVILKGNIWGACGIHGAWNCVQGSVFGIEVSGEPMLSNSLVHVKTYGADWISGGKFGVE   133
                  N+W   G+H  WN   G VF   VSG    S  L+      G    ++GG FG E
Sbjct: 203 AAYAATRNLWLTIGVHFGWNFAAGGVFSTVVSGNGD-SEGLLDATMSGPKLLTGGDFGPE   261

Query: 134 GSMIT---SIVLIVACYWL                                           149
              GS+ +    ++L +     WL
Sbjct: 262 GSVYSVGFGVLLTLVFLWL                                           280
```

No corresponding DNA sequence was identified in *S. pyogenes*.

Based on this analysis, it was predicted that these proteins and their epitopes could be useful antigens for vaccines or diagnostics.

Example 1881

A DNA sequence (GBSx1989) was identified in *S. agalactiae* <SEQ ID 5855> which encodes the amino acid sequence <SEQ ID 5856>, which is a methylase gene homolog. Analysis of this protein sequence reveals the following:

Possible site: 33
>>> Seems to have no N-terminal signal sequence

-continued

----- Final Results -----
bacterial cytoplasm --- Certainty = 0.2192 (Affirmative) <succ>
bacterial membrane --- Certainty = 0.0000 (Not Clear) <succ>
bacterial outside --- Certainty = 0.0000 (Not Clear) <succ>

RGD motif: 264-266

A related GBS nucleic acid sequence <SEQ ID 9929> which encodes amino acid sequence <SEQ ID 9930> was also identified.

The protein has homology with the following sequences in the GENPEPT database.

```
>GP:BAA87672 GB:AB016260 Hypothetical gene, methylase gene homolog
[Agrobacterium tumefaciens]
Identities = 358/1238 (28%), Positives = 595/1238 (47%), Gaps = 99/1238 (7%)
Query: 1072 KEVARIKGMVDIRNAYQEVIAIQRYYDYDKETFNHLLGKLNRTYDSFVKHYGYLNSAV--   1129
               K V  I+ ++ IR+A +EV+  Q        +  L   +L    + SFV+ +G +N
Sbjct:  497 KHVRIIRKLIPIRDAVREVLKAQEL----DRPWKDLQVRLRVAWSSEVRDFGPINHTTVS    552

Query: 1130 ----------------NRNLFDSDDKYSLLASLEDESL--DPSGKSVIYTKSLAFEKAL   1170
                               N  F  D   L+AS+ED   L  D +     I+T    E+ +
Sbjct:  553 ITEDPESGETRESHRRPNLQPFADDPDCWLVASIEDYDLENDTAKPGAIFT-----ERVI    607

Query: 1171 VRPEKEVKKVHTALDALNSSLADGRGVDFAYMMSIYQVESQMTLIEELGDLIMPDPEKYL   1230
                P   V  + +A DAL      L +    VD  ++ +   +      ++ ELG  I  DP
Sbjct:  608 SPPAPPV--ITSAADALAVVLNERGRVDLDHIAELLHRDPD-DVVAELGSAIFRDP----    660

Query: 1231 NGELTYVSRQDFLSGDVVTKLEVVDLFVKQDNQDFNWSHYAGLLEAIKPARITLADIDYR   1290
                + ++        +LSG V  KL+V +      D      ++     L   ++P  + +DI  R
Sbjct:  661 -ADGSWQMADAYLSGPVRDKLKVAEAAAALDPV---YNRNVTALAGVQPVDLRPSDITAR    716

Query: 1291 IGSRWIPLAVYGKFAQETFMGKAYELSDQ-EVATVLEVSPIDGVITYQSKFAYTYSNATD   1349
                +G+ WIP A    F +E  MG    + E+A+      G +       A T    TD
Sbjct:  717 LGAPWIPAADVVAFVKE-MMGTDIRIHHMPELASWTVEARQLGYLA-----AGTSEWGTD    770

Query: 1350 RSLGVPASRYDSGRKIFENLLNSNQPTITKQVVEGDKRRNVTDVEKTTVLRAKETHLQEL   1409
                R              ++  +  LNS  P I      + +GD ++ V +V  T    + K     +++
Sbjct:  771 RR---------HAGELLSDALNSRVPQIFDTIRDGDSERRVLNVVDTEAAREKLHKIKDA    821

Query: 1410 FQGFVAKYPEVQQMIEDTYNRLYNRTVSKSYDGSHLTIDGLAQNISLRPHQKNAIQRIVE   1469
                FQ ++    P+   +     YN  +N    + + G HL + G +      L  HQK  I RI+
Sbjct:  822 FQRWIWSDPDRTDRLARVYNDRFNNIAPRKFSGDHLNLPGASGAFVLYGHQKRGIWRIIS    881

Query: 1470 EKRALLAHEVGSGKTLTMLGAGFKLKELGMVHKPLYVVPSSLTAQFGQEIMKFFPTKKVY   1529
                            LAH VG+GKT+TM  + + +      LG++ K  +  VVP    AQ    +E +   +PT ++
Sbjct:  882 SGSTYLAHAVGAGKTMTMAASIMEQRRLGLIAKAMQVVPGHCLAQAAREFLALYPTARIL    941
```

-continued

```
Query:  1530  VTTKKDFAKAKRKQFVSRIITGDYDAIVIGDSQFEKIPMSREKQVTYINDKLEQLREIKL  1589
              V  + +F+K KR +F+SR  T  +DAI+I  S F I+      +   I+D+LE   + L
Sbjct:   942  VADETNFSKDKRARFLSRAATATWDAIIITHSAFRFIGVPAAFESQMIHDELELYETLLL  1001

Query:  1590  GSDSDYTV--KEAERSIKGLEHQLEELQKLERDTFIEFENLGIDFLFVDEAHHFKNIRPI  1647
              + +   V   K  ER  +GL+ +LE L   +D +     +G+D + VDEA  F+ +
Sbjct:  1002  KVEDEDRVSRKRLERLKEGLQERLEALST-RKDDLLTIAEIGVDQIIVDEAQEFRKLSFA  1060

Query:  1648  TGLGNVAGITNTTSKKNVDMEMKVRQVQAEHGDRNVVFATGTPVSNSISELFTMMDYIQP  1707
              T +  + G+     S++  D+ +K R ++ +   R +V A+GTP++N++ E+F++   +
Sbjct:  1061  TNMSTLKGVDPNGSQRAWDLYVKSRFIETINPGRALVLASGTPITNTLGEMFSVQRLMGH  1120

Query:  1708  DVLERYLVSNFDSWVGAFGNIENSMELAPTGDKYQPKKRFKKFVNLPELMRIYKETADI-  1766
                LE  +  FD+W   FG+   +EL P+G KY+P  RF  FVN+PEL+  +   AD+
Sbjct:  1121  AALEERGLHEFDAWASTFGDTTTELELQPSG-KYKPVSRFASFVNVPELIAMFRSFADVV  1179

Query:  1767  ---QTSDMLDLP-VPEAKIIAVESELTQAQKYYLEELVKRSDAIKSGS--VDPSRDNMLK  1820
                 + + +P +     V S+ TQA K++    L +R AI+         P  D +L
Sbjct:  1180  MPADLREYVKVPAISTGRRQIVTSKPTQAFKHHQMVLAERIKAIEERERPPQPGDDILLS  1239

Query:  1821  ITGEARKLAIDMRLIDPTYSLSDNQKILQVVDNVERIYRDGAGDK-------------AT  1867
                + + R   AID+RL+D            + K+  +V N  RI++  AG         A
Sbjct:  1240  VITDGRHAAIDLRLVDADNDNEPDNKLENLVSNAFRIWKATAGSVYLRHDSKPFEVPGAA  1299

Query:  1868  QMIFSDIGTPK-SKEEGFDVYNELKDLFVDRGIPKEEIAFVHDANTDEKKNSLSRKVNSG  1926
              QMIFSD+GT    K  GF  Y  ++D +   G+P  EIAF+ D      EK  L   V +G
Sbjct:  1300  QMIFSDLGTISVEKTRGFSAYRWIRDELIRLGVPASEIAFMQDFKKSEAKQRLFGDVRAG  1359

Query:  1927  EVRILMASTEKGGTGLNVQSRMKAVHYLDVPWRPSDIVQRNGRLIRQGNMHQEVDIYHYI  1986
               VR L+  S+E   GTG+NVQ R+KA++H+LDVPW  PS I  QR GR++QGN H EVDI+ Y
Sbjct:  1360  RVRFLIGSSETMGTGVNVQLRLKALHHLDVPWLPSQIEQREGRIVRQGNQHDEVDIFAYA  1419

Query:  1987  TKGSFDNYLWQTQENKLKYITQIMTSKDPVRSAEDIDE-QTMTASDFKALATGNPYLKLK  2045
              T+GS D  +WQ  E K ++I  ++    +R  EDI EQ    + KA+A+G+   L   K
Sbjct:  1420  TEGSLDATMWQNNERKARFIAAALSGDTSIRRLEDIGEGQANQFAMAKAIASGDQRLMQK  1479

Query:  2046  MELENELTVLENQKRAFNRSKDEYRHTISYSEKHLPIMEKRLSQYDKDIAQSLATKSQDF  2105
                LE ++   LE    +   A +   R + +E+ + +  +R+++  +DI + + T  +DF
Sbjct:  1480  AGLEADIARLERLRAAHIDDQHAVRRQLRDAERDIEVSTRRIAEIGQDITRLVPTTGEDF  1539

Query:  2106  VMRFDNQAMDNRAEAGDYLRK-LITYNRSETKEVRTLASFRGFDLKM-TTRGASEPLPET  2163
               M  +       R EAG  L K ++T  +      +AS GF+L+  R     T
Sbjct:  1540  TMTVAGKDYSERKEAGRALMKEILTLVQLSPEGEAVIASIGGFELEYHGQRYGKDGYRYT  1599

Query:  2164  ISLMIVGDNQYTVALDLK-SDVGTIQRISNAIDHIIDDQEKTQELVKDLKDKLRVAKVEV  2222
                L   G + Y L +    +G + R+ +A+D    ++E+ ++ +  D + +L    +
Sbjct:  1600  TMLKRTGAD-YEIELPVTVTPLGAVSRLEHALDDETGERERYRQRLGDARRRLASYQSRG  1658

Query:  2223  DKVFPKEEDYQLVKAKYDVLAPLVEKEAEIEEIDAALA                        2260
                +                 +++      L EK  ++ E++ ALA
Sbjct:  1659  E------------GSEFAFAGELAEKHRQLAEVETALA                        1684

Identities = 99/271 (36%), Positives = 153/271 (55%), Gaps = 10/271 (3%)
Query:   607  RDKVETNIVAIRLVKNLEVEHRNASPSEQELLAKYVGWGG--LANEFFD-----DYNPKF   659
              +D+   NI AIRL  +E  R A+ EQE L ++ +G+G  LAN F        ++   +
Sbjct:    80  KDRARDNIAAIRLAAEIEASERPATREEQETLIRFTGFGASDLANGVFRRPGELEFRKGW   139

Query:   660  SKEREELKSLVTDKEYSDMKQSSLTAYYTDPSLIRQMWDKLERDGFTGGKILDPSMGTGN   719
                 +  +L+  V  + +Y+  + +     A++T   ++R +W  L+R G+  GG++L+P +GTG
Sbjct:   140  DEIGSDLEDAVGETDYASLARCTQYAHFTPEFIVRAIWSGLQRLGWRGGRVLEPGIGTGL   199

Query:   720  FFAAMPKHLREKSELYGVELDTITGAIAEHLHPNSHIEIKGFETVAFNDNSFDLVISNVP   779
              F A MP+ LR+  S  GVELD +T  I   + P +I       F         SFDL I N P
Sbjct:   200  FPALMPEALRDLSHVTGVELDPVTACIVRLLQPRARILTGDFARTEL-PASFDLAIGNPP   258

Query:   780  FANIRIADNRYDRP--YMIHDYFVKKSLDLLHDGGQVAIISSTGTMDKRTENILQDIRET   837
              F++ + +R  R     +HDYFV  +S+DLL  G  A ++S+GTMDK      Q I   T
Sbjct:   259  FSDRTVRSDRAYRSLGLRLHDYFVARSIDLLKPGAFAAFVTSSGTMDKADSAARQHIATT   318

Query:   838  TEFLGGVRLPDSAFKAIAGTSVTTDMLFFQK                                868
               +  +  +RLP+  +F+A AGT V  D+LFF+K
Sbjct:   319  ADLIAAIRLPEGSFRADAGTDVVVDILFFRK                                349
```

SEQ ID 5856 (GBS327N) was expressed in *E. coli* as a GST-fusion product. SDS-PAGE analysis of total cell extract is shown in FIG. 148 (lane 8-10; MW 140 kDa). It was also expressed in *E. coli* as a His-fusion product. SDS-PAGE analysis of total cell extract is shown in FIG. 148 (lane 11-13; MW 115 kDa) and in FIG. 182 (lane 8; MW 115 kDa).

Purified GBS327N-GST is shown in FIG. 243, lane 5; Purified GBS327N-His is shown in FIG. 235, lane 5.

GBS327C was expressed in *E. coli* as a GST-fusion product. SDS-PAGE analysis of total cell extract is shown in FIG. 148 (lane 14; MW 73 kDa).

Based on this analysis, it was predicted that this protein and its epitopes, could be useful antigens for vaccines or diagnostics.

Example 1882

A DNA sequence (GBSx1990) was identified in *S. agalactiae* <SEQ ID 5857> which encodes the amino acid sequence <SEQ ID 5858>. Analysis of this protein sequence reveals the following:

```
Possible site: 13
>>> Seems to have no N-terminal signal sequence
----- Final Results -----
    bacterial cytoplasm --- Certainty = 0.3656 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1883

A repeated DNA sequence (GBSx1991) was identified in *S. agalactiae* <SEQ ID 5859> which encodes the amino acid sequence <SEQ ID 5860>. This protein is predicted to be giant membrane protein. Analysis of this protein sequence reveals the following:

```
Possible site: 33
>>> Seems to have no N-terminal signal sequence
----- Final Results -----
    bacterial cytoplasm --- Certainty = 0.3698 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP:AAG19662 GB:AE005054 calcium-binding protein homology; Cbp
[Halobacterium sp. NRC-1]
Identities = 22/43 (5194, Positives = 29/43 (6794, Gaps = 1/43(2%)
Query:    9  KDSDQDGLTDAQELAL-GTDPQSVDTDGDGQADLEELQSGHSP        50
             +D+D DGL+D E+ + GTDP   DTDGDG  D  EL++G  P
Sbjct:  198  RDTDDDGLSDGVEVRVAGTDPTERDTDGDGVDDAAELRAGSLP       240
```

No corresponding DNA sequence was identified in *S. pyogenes*.

Based on this analysis, it was predicted that this protein and its epitopes, could be useful antigens for vaccines or diagnostics.

Example 1884

A DNA sequence (GBSx1992) was identified in *S. agalactiae* <SEQ ID 5861> which encodes the amino acid sequence <SEQ ID 5862>. Analysis of this protein sequence reveals the following:

```
Possible site: 52
>>> Seems to have no N-terminal signal sequence
INTEGRAL    Likelihood = -2.39    Transmembrane 1609-1625
                                  (1609-1625)
INTEGRAL    Likelihood = -1.81    Transmembrane 30-46 (29-46)
----- Final Results -----
    bacterial membrane --- Certainty = 0.1956 (Alfirmative) <succ>
    bacterial outside --- Certainty = 0.0000 (Not Clear) <succ>
    bacterial cytoplasm --- Certainty = 0.0000 (Not Clear) <succ>
LPXTG motif 1600-1604
```

The protein has homology with the following sequences in the GENPEPT database.

```
!GB:X57841 antigen I/II [Streptococcus sobrinus] (v . . .
>GP:CAA40973 GB:X57841 antigen I/II [Streptococcus sobrinus]
Identities = 419/1436 (29%), Positives = 608/1436 (42%), Gaps = 310/1436 (21%)
Query:   23  KSKKYRTLCSVALGTMVTAVVAWGGTVAHADEVTTSV----DTTIQRTE--NPATNLPEA    76
             K K  RTL   LGT + A  G  A A+E +T+     DT + TE   NPATNLP+
Sbjct:   23  KVKSGRTLSGALLGTAILASGA--GQKALAEETSTTSTSGGDTAVVGTETGNPATNLPDK    80

Query:   77  QPNP------------------VSEQTESMASTGQSNGAIAVTVPHDTVT-----QAVE   112
             Q NP                  V  T  +S     VTV  D         + +
Sbjct:   81  QDNPSSQAETSQAQARQKTGAMSVDVSTSELDEAAKSPQEAGVTVSQDATVNKGTVEPSD  140
```

-continued

```
Query:  113 EAKAEGVSTVEDSPMDLGNTRSAVET---------------NQQIS------------K   144
            EA +     +D    + +A E                NQ+I+            K
Sbjct:  141 EANQKEPEIKDDYSKQAADIQKATEDYKASVAANQAETDRINQEIAAKKAQYEQDLAANK   200

Query:  145 AD-------------------ADTQKQVETINEVTK----TYKADKATYESNKARIEQEN   181
            A+                   A  QK + I +       Y AK  Y+    AR++  N
Sbjct:  201 AEVERSLMRMRKPRPIYEAKLAQNQKDLAAIQQANSDSQAAYAAAKEAYDKEWARVQAAN   260

Query:  182 KELSQAYEGANQTGKETNAWVDTKVNDLKARYADADVTVKEQ-------VVSSGNGTSVL   234
              +AYE A       N  + ++  ++ R A AD     K          +GN +
Sbjct:  261 AAAKKAYEEALAANTAKNDQIKAEIEAIQQRSAKADYEAKLAQYEKDLAAAQAGNAANEA   320

Query:  235 DY----TNYGKAVETIQSTNEQAVADY----LTKKTKADDIVAKNQAIQKENEA------   280
            DY    Y + +  +Q+ N A  Y    K    I A+N+AIQ+   +A
Sbjct:  321 DYQAKKAAYEQELARVQAANAAAKQAYEQALAANSAKNAQITAENEAIQQNAQAKADYEA   380

Query:  281 -------GLANAKADNEAIERRNQAGQAAVDAEN---RAGQAAVDQANQEKQQLVSDRAA   330
                   LA A++ N AE    Q    AA + E     +A AA QA +++ Q  + A
Sbjct:  381 KLAQYQKDLAAAQSGNAANEADYQEKLAAYEKELARVQAANAAAKQAYEQQVQQANAKNA   440

Query:  331 EIEAITKRNKEKEAAARKENEAIDAYNTKEMERYQRDLAEIS------------------   372
            EI    +  +E+ A A+ + E    +     +E+ +Y++DLAE
Sbjct:  441 EITEANRAIRERNAKAKTDYELKLSKYQEELAQYKKDLAEYPAKLQAYQDEQAAIKAALA   500

Query:  373 -----KGEEGYISEALAQALNLNNGEPQAQHGAITRN-----------------------   404
                 K E+G +SE AQ+L + + EP AQ    +T
Sbjct:  501 ELEKHKNEDGNLSEPSAQSL-VYDLEPNAQVALVTDGKLLKASALDEAFSHDEKNYNNHL   559

Query:  405 --PDQI----------ISTGDALLGGYSRILDSTGF-----------FVYDMFKTGETLS   441
              PD +           +++   LG +   D G+            F    + KG++ +
Sbjct:  560 LQPDNLNVTYLEQADDVASSVELFGNFG---DKQGWTTTVSNGAEVKFASVLLKRGQSAT   616

Query:  442 FNYQNLQHARFDGKKISRVTYDITNLVSPAG-----TNAVKLVVPNDPTEGFIAYRNDGN   496
              Y NL+++ ++GKKIS+V Y  T  V P          T  VL +  DPT G A   G
Sbjct:  617 ATYTNLKNSYYNGKKISKVVYKYT--VDPDKFQNPTGNVWLGIFTDPTLGVFASAYTGQ   674

Query:  497 GDWRTD---KMEFRVVAKYYLEDGSQVTFSKEKPGVETHSSLNHDIGLEYVKDSSGKFV   553
                 + T    K EF    +Y EDG+ + F     + + +SLN     +E  KD SG FV
Sbjct:  675 NEKDTSIFIKNEF----TFYDEDGNPIDFDN---ALLSVASLNREHNSIEMAKDYSGTFV   727

Query:  554 PINGSTVQVTN--------------EGLARSLGSNRASDLNLPEEWDTTSSRYAYKGAIV   599
             I+GS++    N               EG +   RAS+       WD+ +  ++ GA
Sbjct:  728 KISGSSIGEKNGMIYATDTLNFKKGEGGSLHTMYTRASEPG--SGWDSADAPNSWYGAGA   785

Query:  600 STVTSGNTY--------TVTFGQGDMPQNVGL--------SYWFALN-------------   630
                ++ N Y        T       +MPQ  G        + W++LN
Sbjct:  786 VRMSGPNNYITLGATSATNVLSLAEMPVPGKDNTAGKKPNIWYSLNGKIRAVNVPKVTK   845

Query:  631 --TLPVARTVTPYSPKPHVTVEL-----EPIPEPITVTPDIYTPKTFTPEKPVTFT----   679
              P      P P  V EL        EP EP  TP       P   PEKPV  T
Sbjct:  846 EKPTPPVEPTKPDEPTYEVEKELVDLPVEPKYEP-EPTPPSKNPDQSIPEKPVEPTYEVE   904

Query:  680 ----PKPLDEVVQPSLTLTKVT-------LPVKPIPKELPTPP------------QVPTV   716
                 P P++     +  T +T       PV+P  + LPTPP              VPTV
Sbjct:  905 KELEPAPVEPSYEKEPTPPQSTPDQEEPEKPVEPSYQSLPTPPVEPVYETVPGPVSVPTV   964

Query:  717 HYHAYRLTTTSEIMKEVVNSDQANLHEKTVAKDSTVIYPLTVDALSPNRAQTTSLIFEDY   776
             YH Y+L      + KE+ N D  ++ + VAK STV +L     L    R +TTS + D
Sbjct:  965 RYHYYKLAVQPGVTKEIKNQDDLDIDKTLVAKQSTVKFQLKTADLPAGRPETTSFVLMDP   1024

Query:  777 LPAGYLFDKETTQKENGNYVLSFDETKNFVTLTAKENLLQEVNKDLTQVYQLTAPKLYGS   836
            LP+GY   + E T+    +   +S+D    + VT TA       L +N+DLT+      P + G
Sbjct: 1025 LPSGYQLNLEATKVASPGFEASYDAMTHTVTFTATAETLAALNQDLTKAVATIYPTVVGQ   1084

Query:  837 VQNDGATYSNSYKLLLNKGTTNAYTVTSNVVTVRTPG-----DGETTTLITPDKNNENAD   891
            V NDGATY+N++ L++N    +AY + SN+V V TPG      D +    ITP K N+N +
Sbjct: 1085 VNLNGATYTNNFTLMVN----DAYGIKSNIVRVTTPGKPNDPDNPSNNYITPHKVNKNEN   1140

Query:  892 GVLINDTVVALGTTNHYRLTWDLDQYKGDRSAKETIARGFFFVDDYPEEVLDVVENGTAI   951
            GV+I+    V  GTTN+Y LTWDLDQYKGD SAKE I  +GFF+VDDYPEE LD+  +  +
Sbjct: 1141 GVVIDGKSVLAGTTNYYELTWDLDQYKGDKSAKEIIQKGFFYVDDYPEEALDLRTDLIKL   1200

Query:  952 TTLDGQKVSGITVKNYASLNEAPKDLQDKLARAKITPTGAFQVFMPDDNQAFYDQYVQTG   1011
            T  +G+ V+G++V +YASL  AP  +QD L +A I P GAFQVF  DD QAFYD YV TG
Sbjct: 1201 TDANGKAVTGVSVADYASLEAAPAAVQDMLKKANIIPKGAFQVFTADDPQAFYDAYVVTG   1260

Query: 1012 TSLALLTKMTVKDSLYGQTKTYTNKAYQVDFGNGYETKEVTNTLVSPEPKKQ-NLNKDKV   1070
            T  L ++T MTVK +      +Y N+AYQ+DFGNGYE+  V N +   P+K   L  D
Sbjct: 1261 TDLTIVTPMTVKAEMGKTGGSYENRAYQIDFGNGYESNLVVNNVPKINPEKDVTLTMDPA   1320
```

```
-continued

Query:  1071 D---INGKPMLVGTQNHYTLSWDLDQYRGIKADNSQIAQGFYFVDDYPE-----EALLPD  1122
             D   ++G+ + +    +Y L   +    I AD+++   + F DDY +
Sbjct:  1321 DSTNVDGQTIALNQVFNYRLIGGI-----IPADHAEELFEYSFSDDYDQTGDQYTGQYKA  1375

Query:  1123 EAAIQFVTSDGKTV-SGITVKSY--SQLLEAPKTLQAAFSKQKIQPKGAFQVFMPE      1175
             A +    DG + +G + SY +Q+ EA   + F + ++         F E
Sbjct:  1376 FAKVDLTLKDGTIIKAGTDLTSYTEAQVDEANGQIVVTFKEDFLRSVSVDSAFQAE     1431

Identities = 209/444 (47%), Positives = 280/444 (63%), Gaps = 27/444 (6%)
Query:  1198 TVLETMLNSGKSY-ENVAYQVDFGQAYETNTVTNFVPK------------VTPHKSNTNQ  1244
             TV+ +LN G +Y N    V+    ++N V    P               +TPHK N N+
Sbjct:  1080 TVVGQVLNDGATYTNNFTLMVNDAYGIKSNIVRVTTPGKPNDPDNPSNNYITPHKVNKNE  1139

Query:  1245 EGISIDGKTVLPNTVNYYKIVLDYSQYKDMVVTDDVLAKGFYMVDDYPEEALTLNPDGIQ  1304
              G+  IDGK+VL  T NYY++    D  QYK        +++ KGF+ VDDYPEEAL   D I+
Sbjct:  1140 NGVVIDGKSVLAGTTNYYELTWDLDQYKGDKSAKETIQKGFFYVDDYPEEALDLRTDLIK  1199

Query:  1305 VLDKDGNRVSGISVSTYASLSEAPKVVQDAMAKRQFTPKGAIQVLSSDDPKVFYDTYVKT  1364
             + D +G  V+G+SV+ YASL  AP  VQD + K      PKGA QV ++DDP+ FYD YV T
Sbjct:  1200 LTDANGKAVTGVSVADYASLEAAPAAVQDMLKKANIIPKGAFQVFTADDPQAFYDAYVVT  1259

Query:  1365 GQTLVVTLPMTVKNELTKTGGQYENTAYQIDFGLAYVTETVVNNVPKLDPQKDVVIDLSH  1424
              G  L + + PMTVK E+ KTGG YEN AYQIDFG  Y +   VVNNVPK++P+KDV + +
Sbjct:  1260 GTDLTIVTPMTVKAEMGKTGGSYENRAYQIDFGNGYESNLVVNNVPKINPEKDVTLTMDP  1319

Query:  1425 KDA-SLDGKEVALHQTFNYRLVGAMIPSNRATDLFEYGFEDNYDEKHDEYNGVYRSYLMT  1483
              D+ ++DG+ +AL+Q FNYRL+G +IP++ A +LFEY F D+YD+   D+Y G Y+++
Sbjct:  1320 ADSTNVDGQTIALNQVFNYRLIGGIIPADHAEELFEYSFSDDYDQTGDQYTGQYKAFAKV  1379

Query:  1484 DVILKDGSVLKEGTEVTKYTLQQVDTENGLVSISFDKSFLETVSDDSAFQADVYLQMKRI  1543
             D+ LKDG+++K GT++T  YT  QVD  NG + ++F + FL +VS DSAFQA+VYLQMKRI
Sbjct:  1380 DLTLKDGTIIKAGTDLTSYTEAQVDEANGQIVVTFKEDFLRSVSVDSAFQAEVYLQMKRI  1439

Query:  1544 AAGQVENTYLHTVNGYVISSNTVVTHTPQPEEPSPNQP--------TPPQPPIETIEPPV  1595
             A G    NTY++TVNG    SSNTV T TP+P++PSP  P           P Q    PP
Sbjct:  1440 AVGTFANTYVNTVNGITYSSNTVRTSTPEPKQPSPVDPKTTTTVVFQPRQGKAYQPAPPA  1499

Query:  1596 PASILPNTGEQES----LLGLI                                       1613
              A  LP TG+ +      LLGL+
Sbjct:  1500 GAQ-LPATGDSSNAYLPLLGLV                                       1520

Identities = 100/210 (47%), Positives = 137/210 (64%), Gaps = 4/210 (1%)
Query:  1060 PKKQNLNKDKVDINGKPMLVGTQNHYTLSWDLDQYRGIKADNSQIAQGFYFVDDYPEEAL  1119
              P K N N++ V I+GK +L GT N+Y L+WDLDQY+G K+      I +GF++VDDYPEEAL
Sbjct:  1132 PHKVNKNENGVVIDGKSVLAGTTNYYELTWDLDQYKGDKSAKEIIQKGFFYVDDYPEEAL  1191

Query:  1120 LPDEAAIQFVTSDGKTVSGITVKSYSQLLEAPKTLQAAFSKQKIQPKGAFQVFMPEDPQA  1179
                  I+  ++GK V+G+++V Y+ L AP +Q    K I PKGAFQVF   +DPQA
Sbjct:  1192 DLRTDLIKLTDANGKAVTGVSVADYASLEAAPAAVQDMLKKANIIPKGAFQVFTADDPQA  1251

Query:  1180 FFESYVTKGENITIVTPMTVLETMLNSGKSYENVAYQVDFGQAYETNTVTNFVPKVTPHK  1239
             F+++YV  G ++TIVTPMTV    M  +G SYEN AYQ+DFG  YE+N V N VPK+ P K
Sbjct:  1252 FYDAYVVTGTDLTIVTPMTVKAEMGKTGGSYENRAYQIDFGNGYESNLVVNNVPKINPEK  1311

Query:  1240 SNT----NQEGISIDGKTVLPNTVNYYKIV                               1265
              T      + ++DG+T+   N V  Y+++
Sbjct:  1312 DVTLTMDPADSTNVDGQTIALNQVFNYRLI                               1341
```

There is also homology to SEQ ID 598.

Figure 294:
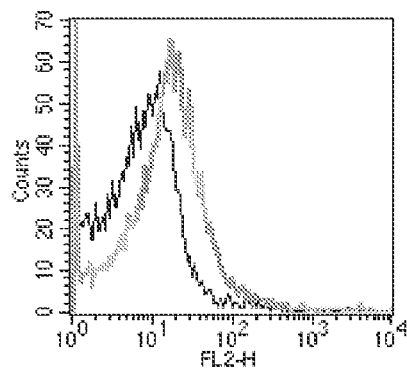

SEQ ID 5862 (GBS76) was expressed in *E. coli* as a His-fusion product. SDS-PAGE analysis of total cell extract is shown in FIG. 17 (lane 2; MW 17.4 kDa). The GBS76-His fusion product was purified (FIG. 196, lane 8) and used to immunise mice. The resulting antiserum was used for FACS (FIG. 294), which confirmed that the protein is immunoaccessible on GBS bacteria.

Based on this analysis, it was predicted that this protein and its epitopes, could be useful antigens for vaccines or diagnostics.

Example 1885

A DNA sequence (GBSx1993) was identified in *S. agalactiae* <SEQ ID 5863> which encodes the amino acid sequence <SEQ ID 5864>. This protein is predicted to be abortive infection bacteriophage resistance protein (abiEi). Analysis of this protein sequence reveals the following:

Possible site: 31
>>> Seems to have no N-terminal signal sequence
----- Final Results -----
  bacterial cytoplasm --- Certainty = 0.2765 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 9931> which encodes amino acid sequence <SEQ ID 9932> was also identified.

The protein has homology with the following sequences in the GENPEPT database.

```
>GP:AAB52382 GB:U36837 AbiEi [Lactococcus lactis]
Identities = 51/206 (24%), Positives = 90/206 (42%), Gaps = 23/206 (11%)

Query:    17  KNNGIVTNKDCKALGIPTIYLTRLEKEGIIFRVEKGIFLTQNGDYDEYYFFQYRFPKAIF    76
              K  G +   K  +  GI    YL +   +  + V+KG+++   +    D  + FQ ++ KA+
Sbjct:    76  KYKGNIIRKIVRDEGISDYYLRKFVLKYNLTEVDKGVYIFPHKKKDSLFIFQQKYSKAVI   135

Query:    77  SYISALYLQQFTDEIPQYFDVTVPRGYRF--------------------NTPPANLNI    114
              S+ ++LYLQ    D IPQ    ++VP  Y                        N    N+ I
Sbjct:   136  SHETSLYLQDVIDYIPQKIQMSVPEKYNISRIQEPHENRLTSYNYVDINSNNIMDKNIPI   195

Query:   115  HFV-SKEYSELGMTTVPTPMGNNVRVYDFERIICDFVIHREKIDSELFVKTLQSYGNYPK   173
              + V +K  S   + TV + +G  +RV       R I D +    K + E+  + ++ Y
Sbjct:   196  NLVRNKSISPTQIETVNSFLGLPLRVTSIARSIVDVLKPSHKAEEEVKEQAIKYYLERFP   255

Query:   174  KNLAKLYEYATKMNTLEKVKQTLEVL                                    199
              N+ +L    A    N L++++  L +L
Sbjct:   256  DNIVRLKRIAKTQNVLKELEYYLILL                                    281
```

No corresponding DNA sequence was identified in *S. pyogenes*.

Based on this analysis, it was predicted that this protein and its epitopes, could be useful antigens for vaccines or diagnostics.

Example 1886

A DNA sequence (GBSx1994) was identified in *S. agalactiae* <SEQ ID 5865> which encodes the amino acid sequence <SEQ ID 5866>. This protein is predicted to be abortive infection bacteriophage resistance protein (abiEii). Analysis of this protein sequence reveals the following:

Possible site: 43
>>> Seems to have no N-terminal signal sequence
INTEGRAL    Likelihood = −1.12    Transmembrane 260-276 (259-277)
----- Final Results -----
  bacterial membrane --- Certainty = 0.1447 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the GENPEPT database.

```
>GP:AAB52383 GB:U36837 AbiEii [Lactococcus lactis]

Identities = 76/276 (27%), Positives = 135/276 (48%), Gaps = 19/276 (6%)

Query:    14  SKNTGLTFNSVMTYYFLEVILKKLSQSSYSNHYIFKGGFLLSNVIGVESRSTVDIDFLFH    73
              ++N  +    Y  E  L +LS S Y   ++ KGGFL+     + R+T D+D
Sbjct:    12  TRNDDIGIENYRIRYATERFLTRLSASQYKEKFVLKGGFLIGVTYNLSQRTTKDLDTALI    71

Query:    74  QITLSEETVKQQLKEIL-ADSEEGISFVIQSITTIKESDDYGGYRATISCQLE--NIKQV   130
                   +++++ + EI    D E+ + F ++ +T+ ++     Y GYRA +      N +
Sbjct:    72  DFKSDAQSIERVITEICNIDLEDQVLFKLKELTSSQDMRIYPGYRAKLKMMFPDGNTRID   131

Query:   131  IHLDIATGDVVTPQPITYDYKAIFDE-----DNFPIIAYTIETILAEKLQTIYSRNFLNS   185
              LDI    GD +TP+      IF+E         ++AY   ETI AEKL+TI +R  +N+
Sbjct:   132  FDLDIGVGDRITPEAKKIKIPLIFNEVKGVEKQIEVLAYPKETIQAEKLETILTRGKVNT   191

Query:   186  RSKDFYDVYIL--SKLKKKDIDFNQLKNACQRTFSYRE-TELDFEKIIE-----LLERFK   237
              R KD+YD ++L  +    I F    A +T+ +R T+    E++  E      L E  +
Sbjct:   192  RMKDYYDFHLLLTDQENSNSISFYY---AFKNTWEFRNPTQFIDEELFEDWLFILDEILE   248

Query:   238  SDPTQNQQWQNYSKKYSYTKGISLANVLDEMISLIT                         273
              S   + + W NY K  +Y K +++ +++ E+    ++
Sbjct:   249  SKELKEKYWPNYIKDRNYAKHLNMDDIISEIKEFVS                         284
```

No corresponding DNA sequence was identified in *S. pyogenes*.

Based on this analysis, it was predicted that this protein and its epitopes, could be useful antigens for vaccines or diagnostics.

Example 1887

A DNA sequence (GBSx1995) was identified in *S. agalactiae* <SEQ ID 5867> which encodes the amino acid sequence <SEQ ID 5868>. Analysis of this protein sequence reveals the following:

Possible site: 23
>>> Seems to have no N-terminal signal sequence
----- Final Results -----
  bacterial cytoplasm --- Certainty = 0.1137 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1888

A DNA sequence (GBSx1996) was identified in *S. agalactiae* <SEQ ID 5869> which encodes the amino acid sequence <SEQ ID 5870>. Analysis of this protein sequence reveals the following:

---

Possible site:44
>>> Seems to have no N-terminal signal sequence
----- Final Results -----
   bacterial cytoplasm --- Certainty = 0.2782 (Affirmative) <succ>
     bacterial membrane --- Certainty = 0.0000 (Not Clear) <succ>
       bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1889

A DNA sequence (GBSx1997) was identified in *S. agalactiae* <SEQ ID 5871> which encodes the amino acid sequence <SEQ ID 5872>. Analysis of this protein sequence reveals the following:

---

Possible site: 21
>>> Seems to have no N-terminal signal sequence
INTEGRAL    Likelihood = −10.14   Transmembrane 310-326 (301-334)
----- Final Results -----
   bacterial membrane --- Certainty = 0.5055 (Affirmative) <succ>
     bacterial outside --- Certainty = 0.0000 (Not Clear) <succ>
       bacterial cytoplasm --- Certainty = 0.0000 (Not Clear) <succ>

---

The protein has homology with the following sequences in the GENPEPT database.

SEQ ID 5872 (GBS74d) was expressed in *E. coli* as a GST-fusion product. SDS-PAGE analysis of total cell extract is shown in FIG. 121 (lane 3 & 4; MW 95.5 kDa). It was also expressed in *E. coli* as a His-fusion product. SDS-PAGE analysis of total cell extract is shown in FIG. 121 (lane 5-7; MW 70.5 kDa) and in FIG. 179 (lane 9; MW 70.5 kDa).

GBS74d-His was purified as shown in FIG. 233, lane 7-8.

Based on this analysis, it was predicted that this protein and its epitopes, could be useful antigens for vaccines or diagnostics.

Example 1890

A DNA sequence (GBSx1998) was identified in *S. agalactiae* <SEQ ID 5873> which encodes the amino acid sequence <SEQ ID 5874>. This protein is predicted to be TrsE-like protein. Analysis of this protein sequence reveals the following:

---

Possible site: 55
>>> Seems to have no N-terminal signal sequence
----- Final Results -----
   bacterial cytoplasm --- Certainty = 0.5526 (Affirmative) <succ>
     bacterial membrane --- Certainty = 0.0000 (Not Clear) <succ>
       bacterial outside --- Certainty = 0.0000 (Not Clear) <succ>

---

The protein has homology with the following sequences in the GENPEPT database.

```
>GP:AAG38044 GB:AF295925 Orf28 [Streptococcus pneumoniae]
Identities = 272/344 (79%), Positives = 307/344 (89%)

Query:   568  VYVNPAFYFPKVIQVQTTILPTIGQFGGDEFERAKAIYDYLKSKGATNQAIAAILGNWSV   627
              +YVNP FYFPKVIQ+QTTILP IGQFGGDEFERAK IY++LKS+GA+ QATAAILGNWSV
Sbjct:     1  MYVNPQFYFPKVIQLQTTILPAIGQFGGDEFERAKHIYEFLKSQGASPQAIAAILGNWSV    60

Query:   628  ESSINPKRAEGDYLSPPVGATDSSWDDEGWLTLNGPTIYNGRYPNILKRGLGLGQWTDTA   687
              ESSINPKRAEGDYL+PPVG      WDDE WL + GP IY+G YPNIL RGLGLGQWTDTA
Sbjct:    61  ESSINPKRAEGDYLTPPVGVPIPPWDDESWLAIGGPAIYSGAYPNILHRGLGLGQWTDTA   120

Query:   688  DGSRRHTLLLEYAKGKHQKWYDLGLQLDFMLYGDSPYYTNWLKDFFKNSGSPASLAQLFL   747
              DGS RHT LL YA+ +++KWYDL LQLDFML+GDSPYY +WLKDFFKN+GS A+LAQLFL
Sbjct:   121  DGSTRHTALLNYARTQNKKWYDLDLQLDFMLHGDSPYYQSWLKDFFKNTGSAANLAQLFL   180

Query:   748  IYWEGNSGDKLLERQTRASEWYYQIEKGFSQPNGGTAQSDPKALEAVREDLFENSIPGGG   807
              +YWEGNSGDKLLERQTRA+EWYYQIEKGFSQ NGG A+SDP++LE  VR DL+++S+PGGG
Sbjct:   181  TYWEGNSGDKLLERQTRATEWYYQIEKGFSQTNGGQAKSDPQSLEGVRGDLYDHSVPGGG   240

Query:   808  DGMGYAYGQCTWGVAARINQLGLKLKGKNGEKIPIISTMGNGQDWVRTAASLGGETGTSP   867
              DGM YAYGQCTWGVAAR+NQLGLKLKG+NGEKI II+TMGNGQDWV T++SLGGETG++P
Sbjct:   241  DGMAYAYGQCTWGVAARMNQLGLKLKGRNGEKISIINTMGNGQDWVATSSSLGGETGSTP   300

Query:   868  QEGAILSFAGGGHGTPTEYGHVAFVEKVYPDGSFLISETNYNGN                 911
              + GAI+SF GG HGTP  YGHVAFVEKVY DGSFL SETNY GN
Sbjct:   301  RAGAIVSFVGGTHGTPASYGHVAFVEKVYDDGSFLVSETNYGGN                 344
```

>GP:AAG38042 GB:AF295925 Orf26 [Streptococcus pneumoniae]
Identities = 618/782 (79%), Positives = 712/782 (91%), Gaps = 1/782 (0%)

```
Query:     1  MKKLKHSMKSK-TSSNDKKQKTKTQKQEISPSTVNTLAYQGLFQNGLMQVSPSYFSQTYL    59
              MK+   +++K + TS+ +KK++ K +K+E+ PST NTL+YQ L+QNGLMQV   YFSQ+YL
Sbjct:     3  MKRKSNTLKKQQTSTTNKKEEVKDKKEEVLPSTANTLSYQALYQNGLMQVKEDYFSQSYL    62

Query:    60  LGDVNYQTVGLDDKGAIVEKYSDLINSLDDKTNFQLTIFNQKVNLEKFRKSILYPLQEDG   119
              LGDVNYQTVGL+DKGAI+EKYSDLI SLDD+TNFQLTIFN+++NLEKFR S+LY +EDG
Sbjct:    63  LGDVNYQTVGLEDKGAIIEKYSDLIKSLDDTNFQLTIFNKRLNLEKFRHSVLYEEKEDG   122

Query:   120  FDTYRDELNRMMDANLEAGENNFSAVKFLSFGKSDQTPKLAFRSLSQIGEYFKSGFSEID   179
              +D+YR ELNRMM+ NL++GENNFSAVK +SFG+ D   PK A+RSLSQIGEYFKSGFSEID
Sbjct:   123  YDSYRKELNRMMNQNLDSGENNFSANKLISFGRKDSNPKQAYRSLSQIGEYFKSGFSEID   182

Query:   180  VSLGLLGGEERVNVLADMLRGENHLPFSYKDLTLSGQSTKHFIAPTYLSFKHKNHIELDD   239
                    L GEERVN+LADMLRGE+HLPFSY+DLT SGQ+T+HFIAP  L FK+KN+++++D
Sbjct:   183  ARFESLAGEERVNLLADMLRGEHHLPFSYRDLTRSGQTTRHFIAPNLLDFKNKNYLQIND   242

Query:   240  RLLQIVYVRDYGMELGDKFIRDLMQSDLEVMISLHAKGSTKSETMTKLRTKKTLMESQKI   299
              RLLQIVYVRDYGMELGD+FIRDLMQ DLE+++SLHA+ STKS+ M KLRTKKTLMESQKI
Sbjct:   243  RLLQIVYVRDYGMELGDQFIRDLMQGDLELIVSLHAQSSTKSDAMKKLRTKKTLMESQKI   302

Query:   300  GEQQKMARTGIYLEKVGHVLENNIDEAEALLQTMTQTGDKLFDTVFLIGVLADTEDQLKQ   359
              GEQQK+ARTGIYLEKVGHVLE+NIDEAE LL+TMT+TGDKLF TVFLIGV   E++LKQ
Sbjct:   303  GEQQKLARTGIYLEKVGHVLESNIDEAEELLKTMTETGDKLFQTVFLIGVFGQDEEELKQ   362

Query:   360  SLDIIKQVAGSNDMIIDNLTYMQEAAFNSLLPFGKNYLEGVSRSLLTSNIAVNAPWTSVD   419
              +LD ++QVAGSND++ID L YMQEAAFNSLLPFG ++LEGVSRSLLTSNIAVN+PWTSVD
Sbjct:   363  ALDTVQQVAGSNDLMIDKLPYMQEAAFNSLLPFGCDFLEGVSRSLLTSNIAVNSPWTSVD   422

Query:   420  IHDKGGKFYGINQISSNIISIDRGKLNTPSGLILGTSGAGKGMATKHEIISTKLKEADSD   479
              + D+ GK+YGINQISSNII+IDR  LNTPSGLILGTSGAGKGMATKHEII+TK+KE+  +
Sbjct:   423  LQDRSGKYYGINQISSNIITIDRSLLNTPSGLILGTSGAGKGMATKHEIITTKIKESGEN   482

Query:   480  TEIIIVDPENEYSIIGQAFGGESIDIAPDSTTFLNVLELSDENMDEDPVKVKSEFLLSWI   539
              TEIIIVDPE EYS+IG+ FGGE IDIAPDS T+LNVL+LS+ENMDEDPVKVKSEFLLS+I
Sbjct:   483  TEIIIVDPEAEYSVIGRTFGGEMIDIAPDSETYLNVLDLSEENMDEDPVKVKSEFLLSFI   542

Query:   540  GKLLDRKMDGREKSLIDRVTRLTYKHFDTPSLVEWVFVLSQQPEQEAKDLALDMELYVEG   599
              GKLLDRKMDGREKS+IDRVTRLTY+ F   PSL EWVFVLSQQPE+EA++LALDMELYVEG
Sbjct:   543  GKLLDRKMDGREKSIIDRVTRLTYQSFKEPSLEEWVFVLSQQPEEEAQNLALDMELYVEG   602

Query:   600  SLDIFSHRTNIKTDSHFLIYNVKKLGDELKQIALMVIFDQIWNRVVKNQKLGKKTWIYFD   659
              SLDIFSH+TNI+T S+FLIYNVKKLGDELKQIALMV+FDQIWNRVV+NQKLGKKTWIYFD
Sbjct:   603  SLDIFSHKTNIQTGSNFLIYNVKKLGDELKQIALMVVFDQIWNRVVRNQKLGKKTWIYFD   662

Query:   660  EMQLLLLDKYASDFFFKLWSRVRKYGAIPTGITQNVETLLLDANGRRIIANSEFMILLKQ   719
              E++LLLLDKY SDFFFKLWSRVRKYGA PTGITQNVETLLLD NGRRIIANSEFMILLKQ
Sbjct:   663  EIELLLLDKYPSDFFFKLWSRVRKYGASPTGITQNVETLLLDPNGRRIIANSEFMILLKQ   722

Query:   720  AKSDREELVHMLGLSKELEKYLVNPEKGAGLIKAGSTVVPFKNKIPQHTKLFDIMSTDPE   779
              AK+DREELV +LGLSKELEKYLVNPEKGAGLIKAGS VVPFKNKIPQ ++LFDIM +DP+
Sbjct:   723  AKNDREELVQLLGLSKELEKYLVNPEKGAGLIKAGSVVVPFKNKIPQGSQLFDIMRSDPD   782

Query:   780  KM   781
              KM
Sbjct:   783  KM   784
```

No corresponding DNA sequence was identified in *S. pyogenes*.

Based on this analysis, it was predicted that this protein and its epitopes, could be useful antigens for vaccines or diagnostics.

A related GBS gene <SEQ ID 8925> and protein <SEQ ID 8926> were also identified. Analysis of this protein sequence reveals the following:

Lipop: Possible site: −1    Crend: 10
McG: Discrim Score: −26.26
GvH: Signal Score (−7.5): −3.87
Possible site: 55

>>> Seems to have no N-terminal signal sequence
ALOM program count: 0    value: 6.26    threshold: 0.0
PERIPHERAL    Likelihood = 6.26    335
modified ALOM score: −1.75
*** Reasoning Step: 3
----- Final Results -----
  bacterial cytoplasm --- Certainty = 0.5526 (Affirmative) <succ>
  bacterial membrane --- Certainty = 0.0000 (Not Clear) <succ>
  bacterial outside --- Certainty = 0.0000 (Not Clear)

The protein has homology with the following sequences in the databases:

```
33.5/57.2% over 789aa
Enterococcus faecalis
GP|8100663| TrsE-like protein Insert characterized
ORF01332(319-2628 of 2949)
GP|8100663|gb|AAF72347.1|AF192329_8|AF192329(2-791 of 799) TrsE-like protein
{Enterococcus faecalis}
% Match = 20.7
% Identity = 33.4 % Similarity = 57.2
Matches = 259 Mismatches = 323 Conservative Sub.s = 184

210       240       270       300       330       360       387
SCYLGSIAPTIYHLKYTSSTVFIMN*RCQTAHLLEEKETNVKKLKHSMKSKTSSNDKKQKTKTQKQEI----------S
                                               |   |  :   |:   |::||
                                          MSKKEIPRETEKTKLTRAQRKEIDAVIRKYKGDGR
                                                   10        20        30

414       444       474       504       534       564       594       624
PSTVN-TLAYQGLFQNGLMQVSPSYFSQTYLLGDVNYQTVGLDDKGAIVEKYSDLINSLDDKTNFQLTIFNQKVNLEKFR
  |   ::  |: ::  :|: :|||  ||:  : |::||    |  : || ||  |  :  :   |:: :|||:  ::
PHTAQQSIPYEVMYPDGVCRVSPGVFSKCIEFADISYQLAQPDTQTAIFEKLCDLYNYVDASIHIQFSFLNRKVDPVQYA
         50        60        70        80        90       100       110

654   684   714   744   774   804   834   864
KSILYPLQEDGPDTYRDELNRMMDANLEAGENNFSAVKFLSFGKSDQTPKLAFRSLSQIGEYFKSGFSEIDVSLGLLGGE
||    |||    |    |          ::|:|    ::   |    |  :||   :     |:      |       |
KSFEIAPQGDDFDDIRAEYTGILQKQLANGNNGMVKTKYLTFTIEAESVKAARARLKRIGFDLLGYFKSMGAVAHVMDGW
         130       140       150       160       170       180       190

894       921       951       981      1011      1041      1071      1011
ERVNVLADMLRGENHL-PFSYKDLTLSGQSTKHFIAPTYLSPFKHKNHIELDDRLLQIVYVRDYGMELGDKFIRDLMQSDL
|||:|  :     :   || ||  || ||| ||||| |||| |||         ||     ||  :|:|: ::|| | |:
ERLNLLHGVYHPDGEIFNFDWKWLAPSGLSTKDFIAPSSLCFGNAKTFGMGGKYGAVSFLQILSPELSDDMLADFLNTES
         210       220       230       240       250       260       270

1131      1161      1191      1221      1251      1281      1311      1341
EVMISLHAKGSTKSETMTKLRTKKTLMESQKIGEQQKMARTGIYLEKVGHVLENNIDEAEALLQTMTQTGDKLFDTVFLI
|:::||  :    :::  ::   ::  |   |::  || |:|  ::    ::|  ::|| ||          ::|| ||:
GVLVNLHVQAIEQTKAIKTIKRKITDLDAMKIAEQKKAVRSGYDMDILPSDLATYGEDAKKLLTKLQTRNERLFQLTFLV
         290       300       310       320       330       340       350

1371      1401      1431      1461      1491      1521      1551
GVLADTEDQLKQSLDIIKQVAGSNDMIIDNLTYMQEAAFNSLLPFGKNYLEGVSRSLLTSNIAVNAPWTSVDIHDKGGK-
 :|||: :|   :       ||   ::  : |  || :  | |||:|    :   |||:|| |:  ::     |
LNVADTKQKLNNDVFQAAGVAQKHNCPLVRLDYQQEQGLASSLPLGVNQI-KIQRSLTTSSVAVFVPFVTQELFQGGAAM
         370       380       390       400       410       420       430

1608      1638      1668      1698      1728      1758      1788      1818
FYGINQISSNIISIDRGKLNTPSGLILGTSGAGKGMATKHEIISTKLKEADSDTEIIIVDPENEYSIIGQAFGGESIDIA
:||||   | |:  :||  :   |:  |||   |::| |  :   |    :|   :|:|| |     :   : |: |::
YYGINAKSRNMIMLDRKQARCPNALKLGTPGSGKSMSCKSEIVSVFLTTPD---DIFISDPEAEYYPLVKRLHGQVIRLS
         450       460       470       480       490       500       510

1848      1875      1905      1935      1959      1989      2019
PDSTTFLNVLELS-DENMDEDPVKVKSEFLLSWIGKLLDRK--MDGREKSLIDRVTRLTYKHFDTPSLVEWVFVLS----
|   |  |::: :  |:::|  :|:|:||  ::    ::        ||:|| ||   ||||      |::|:||
PTSKDFVNPLDINLNYSEDDNPLALKSDFVLSFCELVMGGKNGLEAIEKTVIDRAVRVIYRPYLADPRPENMPILSDLHK
         530       540       550       560       570       580       590

2058      2088      2118      2148      2178      2208      2238      2268
---QQPEQEAKDLALDMELYVEGSLDIFSHRTNIKTDSHFLIYNVKKLGDELKQIALMVIFDQIWNRVVKNQKLGKKTWI
   ||   :|  :|||  :|:|||   |||    ::   :||  |:    ||||  :    :    ::|  | | |||
ALLDQHVPEADRVAQALDLYVSGSLNVFNHRTNVDIGNRLVSFDIKELGKQLKKLGMLIVQDQIWGRVTANRSQGKATWY
         610       620       630       640       650       660       670

2298      2328      2358      2388      2418      2448      2478      2508
YFDEMQLLLLDKYASDFFFKLWSRVRKYGAIPTGITQNVETLLLDANGRRIIANSEFMILLKQAKSDREELVHMLGLSKE
:  ||  :|||    :  ::   |: :| |:||||   :|   ||     |:  ||:|||  ::|   ||      |||
FADEFHLLLLKEEQTAAYSAEIWKRFRKWGGIPTGATQNVKDLLSSPEIENILENSDFITLLNQASGDRKILAERLNLSTE
         690       700       710       720       730       740       750

2538      2568      2598      2628      2658      2688      2718      2748
LEKYLVNPEKGAGLIKAGSTVVPFKNKIPQHTKLFDIMSTDPEKMRT*DERG*KASQTG*AKLSKQLKISSYALSERS*D
 :||: |  ||  |: : |:|| || | ||:|| | ||::|:  |:|
QQKYIDNSEPGEGLLIFENVVLPFTNPIPHNTQLYKIMTTRLNEVAGV
         770       780       790
```

A related GBS gene <SEQ ID 8927> and protein <SEQ ID 8928> were also identified. Analysis of this protein sequence reveals the following:

This protein might be involved in vancomycin resistance. The protein has homology with the following sequences in the databases:

```
>GP|8100663|gb|AAF72347.1|AF192329_8|AF192329 TrsE-like protein
{Enterococcus faecalis}
Score = 427 bits (1086), Expect = e-118
Identities = 257/785 (32%), Positives = 431/785 (54%), Gaps = 28/785 (3%)

Query:     9 DKKQKTKTQKQEIS----------PSTVN-TLAYQGLFQNGLMQVSPSYFSQTYLLGDV     56
             +K + T+ Q++EI            P T   ++ Y+ ++ +G+ +VSP  FS+     D+
Sbjct:    11 EKTKLTRAQRKEIDAVIRKYKGDGRPHTAQQSIPYEVMYPDGVCRVSPGVFSKCIEFADI    70

Query:    57 NYQTVGLDDKGAIVEKYSDLINSLDDKTNFQLTIFNQKVNLEKFRKSILYPLQEDGFDTY   116
             +YQ   D +AI EK  DL N +D   + Q +  N+KV+ ++ KS      Q D FD
Sbjct:    71 SYQLAQPDTQTAIFEKLCDLYNYVDASIHIQFSFLNRKVDPVQYAKSFEIAPQGDDFDDI   130

Query:   117 RDELNRMMDANLEAGENNFSAVKFLSFGKSDQTPKLAFRSLSQIGEYFKSGFSEIDVSLG   176
             R E   ++  L  G N       K+L+F   ++ K A    L +IG       F  +
Sbjct:   131 RAEYTGILQKQLANGNNGMVKTKYLTFTIEAESVKAARARLKRIGFDLLGYFKSMGAVAH   190

Query:   177 LLGGEERVNVLADMLRGENHL-PFSYKDLTLSGQSTKHFIAPTYLSFKHKNHIELDDRLL   235
             ++ G  ER+N+L +   +    F +K L  SG STK FIAP+ L F +      +   +
Sbjct:   191 VMDGWERLNLLHGVYHPDGEIFNFDWKWLAPSGLSTKDFIAPSSLCFGNAKTFGMGGKYG   250

Query:   236 QIVYVRDYGMELGDKFIRDLMQSDLEVMISLHAKGSTKSETMTKLRTKKTLMESQKIGEQ   295
              + +++       EL D  + D  ++  V+++LH +     +++ +   ++ K T +++ KI EQ
Sbjct:   251 AVSFLQILSPELSDDMLADFLNTESGVLVNLHVQAIEQTKAIKTIKRKITDLDAMKIAEQ   310

Query:   296 QKMARTGIYLEKVGHVLENNIDEAEALLQTMTQGDKLFDTVFLIGVLADTEDQLKQSLD   355
             +K R+G ++ +    L    ++A+ LL +     ++LF FL+   +ADT+ +L    +
Sbjct:   311 KKAVRSGYDMDILPSDLATYGEDAKKLLTKLQTRNERLFQLTFLVLNVADTKQKLNNDVF   370

Query:   356 IIKQVAGSNDMIIDNLTYMQEAAFNSLLPFGKNYLEGVSRSLLTSNIAVNAPWTSVDIHD   415
                    VA ++  +   L Y QE   S LP G N   ++ + RSL TS++AV  P+ +  ++
Sbjct:   371 QAAGVAQKHNCPLVRLDYQQEQGLASSLPLGVNQIK-IQRSLTTSSVAVFVPFVTQELFQ   429

Query:   416 KGGK-FYGINQISSNIISIDRGKLNTPSGLILGTSGAGKGMATKHEIISTKLKEADSDTE   474
              G   +YGIN  S N+I +DR +     P+ L LGT G+GK M+ K EI+S  L   D    +
Sbjct:   430 GGAAMYYGINAKSRNMIMLDRKQARCPNALKLGTPGSGKSMSCKSEIVSVFLTTPD---D   486

Query:   475 IIIVDPENEYSIIGQAFGGESIDIAPDSTTFLNVLELS-DENMDEDPVKVKSEFLLSWIG   533
             I I  DPE EY + +    G+ I  ++P S   F+N L+++  + + +  D++P+ +KS F+LS+
Sbjct:   487 IFISDPEAEYYPLVKRLHGQVIRLSPTSKDFVNPLDINLNYSEDDNPLALKSDFVLSFCE   546

Query:   534 KLLDRK--MDGREKSLIDRVTRLTYKHF-------DTPSLVEWVFVLSQQPEQEAKDLAL   584
             ++ K ++  EK++IDR  R+ Y+ +        + P L +   L Q    EA  +A
Sbjct:   547 LVMGGKNGLEAIEKTVIDRAVRVIYRPYLADPRPENMPILSDLHKALLDQHVPEADRVAQ   606

Query:   585 DMELYVEGSLDIFSHRTNIKTDSHFLIYNVKKLGDELKQIALMVIFDQIWNRVVKNQKLG   644
             ++LYV GSL++F+HRTN+  +  + +++K+LG +LK++ ++++ DQIW RV  N+   G
Sbjct:   607 ALDLYVSGSLNVFNHRTNVDIGNRLVSFDIKELGKQLKKLGMLIVQDQIWGRVTANRSQG   666

Query:   645 KKTWIYFDEMQLLLLDKYASDFFFKLWSRVRKYGAIPTGITQNVETLLLDANGRRIIANS   704
             K TW + DE LLL ++ +   ++W R RK+G IPTG TQNV+ LL        I+ NS
Sbjct:   667 KATWYFADEFHLLLLKEEQTAAYSAEIWKRFRKWGGIPTGATQNVKDLLSSPEIENILENS   726

Query:   705 EFMILLKQAKSDREELVHMLGLSKELEKYLVNPEKGAGLIKAGSTVVPFKNKIPQHTKLF   764
             +F+  LL QA  DR+ L   L S E +KY+ N EG GL+    V+PF N IP +T+L+
Sbjct:   727 DFITLLNQASGDRKILAERLNLSTEQQKYIDNSEPGEGLLIFENVVLPFTNPIPHNTQLY   786

Query:   765 DIMST                                                          769
             IM+T
Sbjct:   787 KIMTT                                                          791
```

SEQ ID 8926 (GBS75) was expressed in *E. coli* as a His-fusion product. SDS-PAGE analysis of total cell extract is shown in FIG. 17 (lane 11; MW 89.8 kDa). It was also expressed in *E. coli* as a GST-fusion product. SDS-PAGE analysis of total cell extract is shown in FIG. 20 (lane 6; MW 114.7 kDa).

GBS75-GST was purified as shown in FIG. 197, lane 8.

Figure 174:
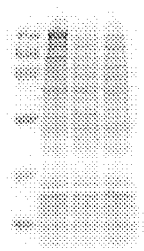

GBS329 was expressed in *E. coli* as a His-fusion product. SDS-PAGE analysis of total cell extract is shown in FIG. 77 (lane 8; MW 89 kDa). It was also expressed in *E. coli* as a GST-fusion product. SDS-PAGE analysis of total cell extract is shown in FIG. 174 (lane 2; MW 114 kDa).

GBS329-GST was purified as shown in FIG. 220, lanes 9 & 10.

Example 1891

A DNA sequence (GBSx1999) was identified in *S. agalactiae* <SEQ ID 5875> which encodes the amino acid sequence <SEQ ID 5876>. Analysis of this protein sequence reveals the following:

Possible site: 33
>>> Seems to have no N-terminal signal sequence
----- Final Results -----
  bacterial cytoplasm --- Certainty = 0.2442 (Affirmative) <succ>
    bacterialmembrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1892

A DNA sequence (GBSx2000) was identified in *S. agalactiae* <SEQ ID 5877> which encodes the amino acid sequence <SEQ ID 5878>. This protein is predicted to be DNA-directed RNA polymerase ii largest subunit. Analysis of this protein sequence reveals the following:

Possible site: 21
>>> Seems to have no N-terminal signal sequence
----- Final Results -----
  bacterial cytoplasm --- Certainty = 0.4393 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1893

A DNA sequence (GBSx2001) was identified in *S. agalactiae* <SEQ ID 5879> which encodes the amino acid sequence <SEQ ID 5880>. Analysis of this protein sequence reveals the following:

Possible site: 13
>>> Seems to have no N-terminal signal sequence
INTEGRAL    Likelihood = −9.92    Transmembrane 256-272 (250-277)
INTEGRAL    Likelihood = −8.28    Transmembrane 216-232 (213-244)
INTEGRAL    Likelihood = −8.12    Transmembrane 151-167 (148-191)
INTEGRAL    Likelihood = −7.27    Transmembrane 57-73 (54-80)
INTEGRAL    Likelihood = −6.74    Transmembrane 93-109 (88-111)
INTEGRAL    Likelihood = −3.50    Transmembrane 172-188 (168-191)
INTEGRAL    Likelihood = −2.76    Transmembrane 113-129 (110-130)
----- Final Results -----
  bacterial membrane --- Certainty = 0.4970 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the GENPEPT database.

```
>GP:AAG38039 GB:AF295925 Orf23 [Streptococcus pneumoniae]
Identities = 71/86 (82%), Positives = 83/86 (95%)

Query:   37   VKSLADFNPTVWSYMTAITKGIMQPLGVAILAVVLVLEFSKMAKKIANSGGAMTFEAIAP   96
              +KSL+ +NPTVW+YM++ITK +MQPLGVAIL+VVL+LEFSKMAKKIANSGGAMTFEA+AP
Sbjct:    1   MKSLSSYNPTVWTYMSSITKSVMQPLGVAILSVVLILEFSKMAKKIANSGGAMTFEALAP   60

Query:   97   MIVSYIMVAVVITNTTVIVEAIIAIA                                   122
              M++SYIMVAVVITNTTVIVEAII IA
Sbjct:   61   MLISYIMVAVVITNTTVIVEAIIGIA                                    86
```

No corresponding DNA sequence was identified in *S. pyogenes*.

Based on this analysis, it was predicted that this protein and its epitopes, could be useful antigens for vaccines or diagnostics.

Example 1894

A DNA sequence (GBSx2002) was identified in *S. agalactiae* <SEQ ID 5881> which encodes the amino acid sequence <SEQ ID 5882>. Analysis of this protein sequence reveals the following:

Possible site: 25
>>> Seems to have no N-terminal signal sequence
INTEGRAL    Likelihood = −7.54    Transmembrane 32-48 (25-52)
INTEGRAL    Likelihood = −4.09    Transmembrane 63-79 (62-80)
----- Final Results -----
  bacterial membrane --- Certainty = 0.4015 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 9933> which encodes amino acid sequence <SEQ ID 9934> was also identified. A related GBS nucleic acid sequence <SEQ ID 10777> which encodes amino acid sequence <SEQ ID 10778> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1895

A DNA sequence (GBSx2003) was identified in *S. agalactiae* <SEQ ID 5883> which encodes the amino acid sequence <SEQ ID 5884>. This protein is predicted to be TrsK-like protein (traK). Analysis of this protein sequence reveals the following:

```
Possible site: 34
>>> Seems to have a cleavable N-term signal seq.
INTEGRAL    Likelihood = -7.38    Transmembrane 66-82 (62-85)
----- Final Results -----
    bacterial membrane --- Certainty = 0.3951 (Affirmative) <succ>
      bacterial outside --- Certainty = 0.0000 (Not Clear) <succ>
         bacterial cytoplasm ---Certainty = 0.0000 (Not Clear) <succ>
```

The protein has homology with the following sequences in the GENPEPT database.

No corresponding DNA sequence was identified in *S. pyogenes*.

Based on this analysis, it was predicted that this protein and its epitopes, could be useful antigens for vaccines or diagnostics.

A related GBS gene <SEQ ID 8929> and protein <SEQ ID 8930> were also identified. Analysis of this protein sequence reveals the following:

```
Lipop: Possible site: -1 Crend: 5
McG: Discrim Score: 5.53
GvH: Signal Score (-7.5): -0.78
Possible site: 34
>>> Seems to have a cleavable N-term signal seq.
ALOM program   count: 1 value: -7.38  threshold: 0.0
INTEGRAL       Likelihood = -7.38   Transmembrane 66-82 (62-85)
PERIPHERAL     Likelihood = 1.75    338
modified ALOM score: 1.98
*** Reasoning Step: 3
----- Final Results -----
    bacterial membrane --- Certainty = 0.3951 (Affirmative) <succ>
      bacterial outside --- Certainty = 0.0000 (Not Clear) <succ>
```

The protein has homology with the following sequences in the databases:

```
>GP:AAG38037 GB:AF295925 Orf21 [Streptococcus pneumoniae]

Identities = 343/457 (75%), Positives = 385/457 (84%), Gaps = 24/457 (5%)

Query:   142  LIVIGGSGAGKTFRFVKPNLIQLNCSNIVVDPKDHLAEKTGKLFLENGYQVKVLDLVNMT    201
              + VIGGSG+GKTFRFVKPNLIQ+N SNIVVDPKDHLAEKTGKLFLE+GYQVKVLDLVNM
Sbjct:     1  MAVIGGSGSGKTFRFVKPNLIQMNSSNIVVDPKDHLAEKTGKLFLEHGYQVKVLDLVNMK     60

Query:   202  NSDGFNPFRYVETENDLNRMLTVYFNNTKGNGSRSDPFWDEASMTLVRAIASYLVDFYNP    261
              NSDGFNPFRY+ETENDLNRML VYFNNTKG+GSRSDPFWDEASMTLVRA+ASYLVDFYNP
Sbjct:    61  NSDGFNPFRYIETENDLNRMLAVYFNNTKGSGSRSDPFWDRASMTLVRALASYLVDFYNP    120

Query:   262  PGS--------------------SKQEQEARRKRGRYPAFSEIGKLIKLLSKGDNQDKS    300
              P +                    K+E E R+KRGR   F E    +    + KS
Sbjct:   121  PKTREQLIEESRLSQKEYQNLLKRQKKEVEERKKRGRLSKFCESQNSLNTYPRVKTR-KS    179

Query:   301  ILEVLFEDYAKKYGHENFTMRNWADFQNYKDKTLDSVIAVTTAKFALFNIQSVIDLTQRD    360
              +LE+LFE+YAKKYG ENFTMRNWADFQNYKDKTLDSVIAVTTAKFALFNIQSV+DLT+RD
Sbjct:   180  VLEILFENYAKKYGTENFTMRNWADFQNYKDKTLDSVIAVTTAKFALFNIQSVMDLTKRD    239

Query:   361  TMDLKTWGTQKTMVYLVIPDNDTTFRFLSAL-FFSTVFSTLTRQADV-DFKGQLPIHVRS    418
              T+D+KTWG +K+MVYLVIPDND+TFRFLSAL FF+   F T  + +    + +LP+HVR
Sbjct:   240  TLDMKTWGQEKSMVYLVIPDNDSTFRFLSALLFFNPYFQTPNKTSQILMLRVRLPLHVRV    299

Query:   419  YLDEFANVGEIPDFAEQTSTVRSRNMSLVPILQNIAQLQGLYKEKEAWKTILGNCDSLLY    478
              YLDEFAN+GEIPDFAEQTSTVRSRNMSLVPILQNIAQLQGLYKEKRAWKTILGNCDSL+Y
Sbjct:   300  YLDEFANIGEIPDFARQTSTVRSRNMSLVPILQNIAQLQGLYKEKEAWKTILGNCDSLVY    359

Query:   479  LGGNDEETFKFMSGLLGKQTVDVRSTSRSFGQTGSSSTSHQKIARDLMTADEVGTMKRDE    538
              LGGNDE+TFKFMSGLLGKQT+DVR TSRSFGQTGS S SHQKIARDLMT DEVG MKR E
Sbjct:   360  LGGNDEDTFKFMSGLLGKQTIDVRNTSRSFGQTGSGSLSHQKIARDLMTPDEVGNMKRHE    419

Query:   539  CLVRIAGVPVFRTKKYFPLKHKHWKLLADKETDDRWW                          575
              CLVRIA +PVF++KKY   KH +WK LA++ETD+R W
Sbjct:   420  CLVRIANMPVFKSKKYNSTKHPNWKYLANQETDERRW                          456
```

```
33.9/50.9% over 419aa
Lactococcus lactis
GP|3582206| trsK protein (traK) Insert characterized
PIR|T43089|T43089 transfer complex protein TrsK - plasmid pMRC01 Insert characterized
ORF00383(715-2004 of 2415)
GP|3582206|gb|AAC56002.1||AE001272(23-442 of 530) trsK protein (traK) {Lactococcus
lactis}PIR|T43089|T43089 transfer complex prote
in TrsK - Lactococcus lactis plasmid pMRC01
% Match = 10.1
% Identity = 33.8 % Similarity = 50.8
Matches = 141 Mismatches = 193 Conservative Sub.s = 71

519       549       579       609       639       669       699       729
SFLAFILGVLMMTLVYLYVSTGQKVYREGEEYGSARFGTSKEKRNFYSKNPFNDTILARDVRLTLLEKKKPQFDRNKNLI
                                                            |   :            |:|::
                                                            MNGTILGVLDNKIIYQDNTTKPNRNVM
                                                               10        20

759       789       816       846       876       906       936       966
VIGGSGAGKTFRFVKPNLIQLNCSNIVV-DPKDHLAEKTGKLFLENGYQVKVLDLVNMTNSDGFNPFRYVETENDLNRML
||||||:||   |   ||    ::|||  |||   |  |||    |  ||:|   |:::   ||  |:|   :      :
VIGGSGSYKTQSVVITNLFNETKNSIVVTDPKGELYEKTAGIKLAQGYEVHVVNFANMAHSDRYNPFDYIERDIQAESVA
         40        50        60        70        80        90       100

996      1026      1056      1086      1116      1146      1176      1194
TVYFNNTKGNGSRSDPFWDEASMTLVRAIASYLVDFYNPPGSSKQEQEARRKRGRYPAFSEIGKLIKLLSKGD----NQD
|   :    |    :   |       |::|:  :::           :  |    |   :  :|    :|  |     |:|
TKIVQSENAEGKK--DVWFSTQRQLLKALILFVM----------------KERSPEQRNLAGVINVLQTFDSEPINKD
          120       130                             140       150       160

1221      1251      1281      1311      1341      1371      1401      1431
K-SILEVLFEDYAKKYGHENFTMRNWADFQNYKDKTLDSVIAVTTAKFALFNIQSVIDLTQRDTMDLKTWGTQKTMVYLV
:  |  |: ||     |    |                |:   |      |:|:     :   |    :   :     |:       |   |   :|  ::|::
ENSDLDNLF--LALKITHPARIAYELG-FKKAKGDMKASIISSLLATISKFTDEEVSNFTSISDFHLQDIGRKKIVLYVI
          180       190       200       210       220       230       240

1461      1491      1521      1551      1581      1611      1641      1671
IPDNDTTFRFLSALFFSTVFSTLTRQADVDFKGQLPIHVRSYLDEFANVGEIPDFAEQTSTVRSRNMSLVPILQNIAQLQ
||    | | :    :    |||  :|    |:   |:           :||     |   | ||||   |: |     :|     :|           |||
IPVMDNTYESFINLFFSQMFDELYKLASSN-GAKLPQEVDFILDEFVNLGKFPKYEEFLATCRGYGIGVTTICQTLTQLQ
          260       270       280       290       300       310       320

1701      1731      1761      1791      1809      1839      1869      1899
GLYKEKEAWKTILGNCDSLLYLGGNDEETFKMSGLLGKQTVDVR----STSRSFGQTGSSSTSHQKIARDLMTADEVGT
||   ||   ::||||      :    | ::|||:|  |||| ||    |       |||   |   :  |  |:     :|   |||  ||:
SLY-GKEKAESILGNHAVKICLNASNEATAKYFSELLGKSTVKVETGSESTSHSKETSTSKSDSYSYTSRQLMTPDEIIR
         340       350       360       370       380       390       400

1929      1956      1974      2004      2034      2064      2094      2124
MKRDECLVRIAGV-PVFRTK----KYFPLKHKHWKLLADKETDDRWWNYHINPLAKEEELDLSDYQIRDLSTETSLH**K
|   :|:         |:   ||      |   ||            ||  ||              |      :    :::::
MPDTQSLLIFTNQKPIKATKAFQFKLFPDADSKVKLEQNKYVGITSKSQLEKYNDLSVKWEEKLQSLKNITVTEEEEKDL
         420       430       440       450       460       470       480
```

SEQ ID 5884 (GBS11d) was expressed in *E. coli* as a His-fusion product. SDS-PAGE analysis of total cell extract is shown in FIG. 151 (lane 6; MW 61 kDa) and in FIG. 182 (lane 10; MW 61 kDa). It was also expressed in *E. coli* as a GST-fusion product. SDS-PAGE analysis of total cell extract is shown in FIG. 12 (lane 5; MW 91.5 kDa).

Example 1896

A DNA sequence (GBSx2004) was identified in *S. agalactiae* <SEQ ID 5885> which encodes the amino acid sequence <SEQ ID 5886>. Analysis of this protein sequence reveals the following:

Possible site: 50
>>> Seems to have no N-terminal signal sequence
----- Final Results -----
  bacterial cytoplasm --- Certainty = 0.4192 (Affirmative) <succ>

-continued bacterial membrane --- Certainty = 0.0000 (Not Clear) <succ>
  bacterial outside --- Certainty = 0.0000 (Not Clear) <succ>

A related GBS nucleic acid sequence <SEQ ID 9935> which encodes amino acid sequence <SEQ ID 9936> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1897

A DNA sequence (GBSx2005) was identified in *S. agalactiae* <SEQ ID 5887> which encodes the amino acid sequence <SEQ ID 5888>. Analysis of this protein sequence reveals the following:

```
Possible site: 16
>>> Seems to have no N-terminal signal sequence
----- Final Results -----
    bacterial cytoplasm --- Certainty = 0.3391 (Affirmative) <succ>
      bacterial membrane --- Certainty = 0.0000 (Not Clear) <succ>
        bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1898

A DNA sequence (GBSx2006) was identified in *S. agalactiae* <SEQ ID 5889> which encodes the amino acid sequence <SEQ ID 5890>. Analysis of this protein sequence reveals the following:

```
Possible site: 45
>>> Seems to have an uncleavable N-term signal seq
INTEGRAL    Likelihood = -10.03   Transmembrane 68-84 (64-90)
INTEGRAL    Likelihood = -7.06    Transmembrane 33-49 (27-50)
INTEGRAL    Likelihood = -5.73    Transmembrane 106-122 (105-123)
INTEGRAL    Likelihood = -4.46    Transmembrane 6-22 (3-24)
INTEGRAL    Likelihood = -2.13    Transmembrane 154-170 (154-170)
INTEGRAL    Likelihood = -0.53    Transmembrane 180-196 (180-196)
----- Final Results -----
    bacterial membrane --- Certainty = 0.5012 (Affirmative) <succ>
      bacterial outside --- Certainty = 0.0000 (Not Clear) <succ>
        bacterial cytoplasm --- Certainty = 0.0000 (Not Clear) <succ>
```

A related GBS nucleic acid sequence <SEQ ID 9937> which encodes amino acid sequence <SEQ ID 9938> was also identified.

The protein has homology with the following sequences in the GENPEPT database.

```
>GP:BAA11325 GB:D78257 ORF8 [Enterococcus faecalis]

Identities = 35/102 (34%), Positives = 57/102 (55%), Gaps = 4/102 (3%)

Query:    90  TRNQAVLVQVGKQVPPIIFLLFL-VNASILEEIVYRQLLWEKLTF--PFEQIGVTSFLFV    146
              T N + L+++    V P++ +L L + A I+EEIV+R   +       I ++SFLF
Sbjct:     7  TANDSTLIKLFSGVSPVLVVLLLGIAAPIMEEIVFRGGIIGYLVENNALLAILISSFLFG     66

Query:   147  LSHGPNQLGSWLIYSCLGLTLAVVRLKT-DCMTAIALHLLWN                     187
              + HGP     S+ +Y  +G+ L+V    KT D    +I++H L N
Sbjct:    67  IIHGPTNFISFGMYFFMGIILSVSYYKTKDLRVSISIHFLNN                    108
```

No corresponding DNA sequence was identified in *S. pyogenes*.

A related GBS gene <SEQ ID 8931> and protein <SEQ ID 8932> were also identified. Analysis of this protein sequence reveals the following:

```
Lipop: Possible site: -1 Crend: 4
McG: Discrim Score: 9.32
GvH: Signal Score (-7.5): -5.41
Possible site: 45
>>> Seems to have an uncleavable N-term signal seq
ALOM program count: 6 value: -10.03  threshold: 0.0
INTEGRAL    Likelihood = -10.03   Transmembrane 68-84 (64-90)
INTEGRAL    Likelihood = -7.06    Transmembrane 33-49 (27-50)
INTEGRAL    Likelihood = -5.73    Transmembrane 106-122 (105-123)
INTEGRAL    Likelihood = -4.46    Transmembrane 6-22 (3-24)
INTEGRAL    Likelihood = -2.13    Transmembrane 154-170 (154-170)
INTEGRAL    Likelihood = -0.53    Transmembrane 180-196 (180-196)
PERIPHERAL  Likelihood = 1.38     131
modified ALOM score: 2.51
Reasoning Step: 3
----- Final Results -----
    bacterial membrane --- Certainty = 0.5012 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the databases:

```
ORF01326(568-861 of 1188)
EGAD|148261|158156(7-108 of 120) hypothetical protein {Enterococcus faecalis}
GP|1402529|dbj|BAA11325.1|D78257 ORF8 {Enterococcus faecalis}
% Match = 5.9
% Identity = 34.7 % Similarity = 60.4
Matches = 35 Mismatches = 37 Conservative Sub.s = 26

303       333       363       393       423       453       483       513
Y*L*RFI*EVTMIRIVLFYLAIQLNGLLVSLFLKEYLTIEGIVLLQLVLLSVTCLEIARHKTVPLKIVGVQNRLSWLLLG 543       573       603       633       660       690       714       744
FVAMVAFAVFISFLFPVQTRNQAVLVQVGKQVPPIIFLLFL-VNASILEEIVYRQLLWEKLT--FPFEQIGVTSFLFVLS
                  | |  :  | : : :      | |  : : :| :  :  |  | :|||| :   |   |
            MQGHTTTANDSTLIKLFSGVSPVLVVLLLGIAAPIMEEIVFRGGIIGYLVENNALLAILISSFLFGII
                     10        20        30        40        50        60

774       804       831       861       891       921       951       981
HGPNQLGSWLIYSCLGLTLAVVRLKT-DCMTAIALHLLWNSLAYVVTFL*YQNQECFRIMEAPYV**GIEKRGGHYVI*T
|||   :  |: : |   :|: |:|    ||  |   :|::|:|  |
HGPTNFISFGMYFFMGIILSVSYYKTKDLRVSISIHFLNNLFPAIAIAYGLI
      80        90       100       110       120
```

Based on this analysis, it was predicted that these proteins and their epitopes could be useful antigens for vaccines or diagnostics.

Example 1899

A DNA sequence (GBSx2007) was identified in S. agalactiae <SEQ ID 5891> which encodes the amino acid sequence <SEQ ID 5892>. Analysis of this protein sequence reveals the following:

Possible site:23
>>> Seems to have no N-terminal signal sequence
----- Final Results -----
    bacterial cytoplasm --- Certainty = 0.2490 (Affirmative) <succ>
      bacterial membrane --- Certainty = 0.0000 (Not Clear) <succ>
        bacterial outside --- Certainty = 0.0000 (Not Clear) <succ>

A related GBS nucleic acid sequence <SEQ ID 9939> which encodes amino acid sequence <SEQ ID 9940> was also identified.

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1900

A DNA sequence (GBSx2008) was identified in S. agalactiae <SEQ ID 5893> which encodes the amino acid sequence <SEQ ID 5894>. Analysis of this protein sequence reveals the following:

Possible site: 46
>>> Seems to have no N-terminal signal sequence
----- Final Results -----
    bacterial cytoplasm --- Certainty = 0.5298 (Affirmative) <succ>
      bacterial membrane --- Certainty = 0.0000 (Not Clear) <succ>
        bacterial outside --- Certainty = 0.0000 (Not Clear) <succ>

The protein has homology with the following sequences in the GENPEPT database.

```
>GP:AAC98423  GB:L29323  unknown [Streptococcus pneumoniae]
Identities = 68/126 (53%), Positives = 88/126 (68%)

Query:    1  MNLLHKKSILDCTELEERIHQAETNQLLQKILSLPNFDCDFEVTFEDDYHKEMNDPLFYE    60
             M  L+K+SILDC ELE  +H AE  QL ++I  +PN+ C+FEVTF DDYHK+ N PLFYE
Sbjct:    1  MKALNKESILDCDELETELHDAEIKQLDEQIFLMPNYPCEFEVTFLDDYHKKHNYPLFYE    60

Query:   61  SNLHQISDFMETRDIKNGVDTLLTKDNHLAFRAFGENYSARGKEGILTTLVTVKCFGEGR   120
             S L  I +F+E++DIKNG D  +    +L F  +G+ Y A GKEGILTT VTVK F E +
Sbjct:   61  SYLQNIMEFLESQDIKNGADAFVDDHQNLVFVLYGQGYRAEGKEGILTTQVTVKAFDEDK   120

Query:  121  MPIDMS                                                       126
             PI+ +
Sbjct:  121  KPINFA                                                       126
```

No corresponding DNA sequence was identified in S. pyogenes.

Based on this analysis, it was predicted that this protein and its epitopes, could be useful antigens for vaccines or diagnostics.

Example 1901

A DNA sequence (GBSx2009) was identified in S. agalactiae <SEQ ID 5895> which encodes the amino acid sequence <SEQ ID 5896>. This protein is predicted to be methyl transferase. Analysis of this protein sequence reveals the following:

Possible site 46
>>> Seems to have no N-terminal signal sequence
----- Final Results -----
   bacterial cytoplasm --- Certainty = 0.1209 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:AAC98421 GB:L29323 methyl transferase [Streptococcus pneumoniae]
Identities = 323/449 (71%), Positives = 389/449 (85%), Gaps = 3/449 (0%)

Query:    1  MKFLDLFAGIGGFRLGMESQGHKCLGFCEIDKFARTSYKAMFNTEGEIEYHDIKEVTDHD     60
             M+F+DLF+GIGGFRLGMES GH+C+GFCEIDKFAR SYK++F TEGEIE+HDI++V+D +
Sbjct:    1  MRFIDLFSGIGGFRLGMESVGHECIGFCEIDKFARESYKSIFQTEGEIEFHDIRDVSDDE    60

Query:   61  FRQFRGQVDIICGGFPCQAFSLAGRRLGFEDTRGTLFFEIARAAKQIQPRFLFLENVKGL   120
             F++ RG+VD+ICGGFPCQAFS+AGRRLGFEDTRGTLFFEIARAAKQIQPRFLFLENVKGL
Sbjct:   61  FKKLRGKVDVICGGFPCQAFSIAGRRLGFEDTRGTLFFEIARAAKQIQPRFLFLENVKGL   120

Query:  121  LNHDEGRTFATILSTLDELGYDVEWQVLNSKDFQVPQNRERVFIIGHSRRYRSRFIFPLR   180
             LNHD+GRTF TIL+TLDELG+DVEWQ+LNSKDF VPQNRERVFIIGHSR+  +R  FP R
Sbjct:  121  LNHDKGRTFTTILTTLDELGFDVEWQMLNSKDFGVPQNRERVFIIGHSRKRGTRLGFPFR   180

Query:  181  RED---SPAHLERLGNINPSKHGLNGEVYLTSGLAPTLTRGKGEGAKIAIPVLTPDRLEK   237
             RE    +P  L+ LGN+NPSK G++G+VY + GLAPTL RGKGEG KIAIP +TPDRL+K
Sbjct:  181  REGQATNPETLKILGNLNPSKSGMSGKVYYSEGLAPTLVRGKGEGFKIAIPCMTPDRLDK   240

Query:  238  RQHGRRFKDNQDPMFTLTSQDKHGVVVAGNLPTSFDQTGRVFDISGLSPTLTTMQGGDKV   297
             RQ+GRRFKDNQ+PMFTL +QD+HG+VV G+LPTSF +TGRV+   GLSPTLTTMQGGDK+
Sbjct:  241  RQNGRRFKDNQEPMFTLNTQDRHGIVVVGDLPTSFKETGRVYGSEGLSPTLTTMQGGDKI   300

Query:  298  PKILLREELPFLKIKEATKTGYAKATLGDSVNLAYPDSTKRRGRVGKGISNTLTTSDNMG   357
             PKIL+ E + FLK++EATK GYA+A +GDS+NL  P S  RRGRVGKGI+NTLTTS  MG
Sbjct:  301  PKILIPEPIQFLKVREATKKGYAQAEIGDSINLERPSSQHRRGRVGKGIANTLTTSGQMG   360

Query:  358  VVVAALEYRQDKWYEVTGIVLEGKLYRLRIRRLTPRECFRLQGFPDWAYERAESVSSKSQ   417
             VVVA+ E    + Y+V G++++G+ YRLRIRR+TP+ECFRLQGFPDWA+E A  VSS SQ
Sbjct:  361  VVVASYEGEDKQVYQVAGVLIDGQFYRLRIRRITPKECFRLQGFPDWAFEAARKVSSNSQ   420

Query:  418  LYKQAGNSVTVTVIEAIAREFRRTEEEEK                                 446
             LYKQAGNSVTV VI AIA++ +  EE+++
Sbjct:  421  LYKQAGNSVTVPVIAAIAKKLKEVEEKDE                                 449
```

A related DNA sequence was identified in *S. pyogenes* <SEQ ID 2435> which encodes the amino acid sequence <SEQ ID 2436>. Analysis of this protein sequence reveals the following:

Possible site: 49
>>> Seems to have no N-terminal signal sequence
----- Final Results -----
   bacterial cytoplasm --- Certainty = 0.1725 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 60/75 (80%), Positives = 69/75 (92%)

Query:    1  MKFLDLFAGIGGFRLGMESQGHKCLGFCEIDKFARTSYKAMFNTEGEIEYHDIKEVTDHD    60
             MKFLDLFAGIGGFRLG+ +Q H+C+GFCEIDKFAR SYKA++ TEGEIE+HDI++VTD D
Sbjct:    4  MKFLDLFAGIGGFRLGLINQCHECIGFCEIDKFARQSYKAIYETEGEIEFHDIRQVTDQD    63

Query:   61  FRQFRGQVDIICGGF                                                75
             FRQ RGQVDIICGGF
Sbjct:   64  FRQLRGQVDIICGGF                                                78
```

Based on this analysis, it was predicted that these proteins and their epitopes could be useful antigens for vaccines or diagnostics.

Example 1902

A DNA sequence (GBSx2010) was identified in *S. agalactiae* <SEQ ID 5897> which encodes the amino acid sequence <SEQ ID 5898>. Analysis of this protein sequence reveals the following:

Possible site: 16
>>> Seems to have an uncleavable N-term signal seq
INTEGRAL     Likelihood = −9.71    Transmembrane 8-24 (3-30)
----- Final Results -----
   bacterial membrane --- Certainty = 0.4885 (Affirmative) <succ>
   bacterial outside --- Certainty = 0.0000 (Not Clear) <succ>
   bacterial cytoplasm --- Certainty = 0.0000 (Not Clear) <succ>

A related GBS nucleic acid sequence <SEQ ID 9941> which encodes amino acid sequence <SEQ ID 9942> was also identified.

The protein has no significant homology with any sequences in the GENPEPT database.

A related DNA sequence was identified in *S. pyogenes* <SEQ ID 5899> which encodes the amino acid sequence <SEQ ID 5900>. Analysis of this protein sequence reveals the following:

---

Possible site: 28
>>> Seems to have no N-terminal signal sequence
INTEGRAL   Likelihood = −1.81   Transmembrane 20-36 (19-36)
----- Final Results -----
   bacterial membrane --- Certainty = 0.1723 (Affirmative) <succ>
      bacterial outside --- Certainty = 0.0000 (Not Clear) <succ>
         bacterial cytoplasm --- Certainty = 0.0000 (Not Clear) <succ>

---

An alignment of the GAS and GBS proteins is shown below.

```
Identities = 16/33 (48%), Positives = 26/33 (78%)

Query:    1  MNKMIWWILGGIYLISIIILIVEIIRAPEMDDH    33
             ++KM WW+L G++ +  I LI+E+I APEM+D+
Sbjct:   12  VSKMFWWLLLGVWGLRTIWLIIEVITAPEMEDY    44
```

A related DNA sequence was identified in *S. pyogenes* <SEQ ID 5903> which encodes the amino acid sequence <SEQ ID 5904>. Analysis of this protein sequence reveals the following:

---

Possible site: 55
>>> Seems to have no N-terminal signal sequence

Based on this analysis, it was predicted that these proteins and their epitopes could be useful antigens for vaccines or diagnostics.

Example 1903

A DNA sequence (GBSx2011) was identified in *S. agalactiae* <SEQ ID 5901> which encodes the amino acid sequence <SEQ ID 5902>. This protein is predicted to be ifn-response binding factor 1 (irebf-1). Analysis of this protein sequence reveals the following:

---

Possible site: 53
>>> Seems to have no N-terminal signal sequence
----- Final Results -----
   bacterial cytoplasm --- Certainty = 0.4771 (Affirmative) <succ>
      bacterial membrane --- Certainty = 0.0000 (Not Clear) <succ>
         bacterial outside --- Certainty = 0.0000 (Not Clear) <succ>

---

The protein has homology with the following sequences in the GENPEPT database.

```
>GP:AAD41248 GB:AF106927 unknown [Streptococcus suis]
Identities = 258/272 (94%), Positives = 266/272 (96%)

Query:    1  MKRITANQYQTSERYYKLPKILFESERYKDMKLEVKVAYAVLKDRLELSLSKGWIDEDGA    60
             MKRITANQYQTSERYYKLPKILFESERYKDMKLEV VAYAVLKDRLELSLSKGWIDEDGA
Sbjct:    1  MKRITANQYQTSERYYKLPKILFESERYKDMKLEVEVAYAVLKDRLELSLSKGWIDEDGA    60

Query:   61  IYLIYSNSNLMALLGCSKSKLLSIKKTLREYGLIDEVQQSSSERGRMANKIYLGELEHEP  120
             IYLIYSNSNLMALLGCSKSKLLSIKKTLREYGLIDEVQQSSSE+GRMANKIYLGELEHE
Sbjct:   61  IYLIYSNSNLMALLGCSKSKLLSIKKTLREYGLIDEVQQSSSEKGRMANKIYLGELEHET  120

Query:  121  TPVLHTDGASVKKTLGESQRKTGPVLYSAPSETEGSETKYSETEGSDLVMKDEEERQLVD  180
             TPVLHTDGASVKKTLG SQRKTGPVL SAPSETEGSETKYSET+GSD +++DEEERQ VD
Sbjct:  121  TPVLHTDGASVKKTLGGSQRKTGPVLNSAPSETEGSETKYSETKGSDFLIEDEEERQQVD  180

Query:  181  EKKEENFTSKVDGVTKYDRDYIWGLVHDQLRQTGLSQSASDYAMIYFSDRYQYALEQMRF  240
             EK+EENFTSKVDGVT+YDRDYIWGLVHDQLRQTGLSQSASDYAMIYFSDRYQYALE MRF
Sbjct:  181  EKQEENFTSKVDGVTRYDRDYIWGLVHDQLRQTGLSQSASDYAMIYFSDRYQYALEHMRF  240

Query:  241  ARSAEVIAEYVFNGVLSEWTKQLRRQEVKGGE                             272
             ARSAEVIAEYVFNGVLSEWTKQLRRQEVKGG+
Sbjct:  241  ARSAEVIAEYVFNGVLSEWTKQLRRQEVKGGD                             272
```

-continued

----- Final Results -----
   bacterial cytoplasm --- Certainty = 0.5248 (Affirmative) <succ>
      bacterial membrane --- Certainty = 0.0000 (Not Clear) <succ>
         bacterial outside --- Certainty = 0.0000 (Not Clear) <succ>

---

An alignment of the GAS and GBS proteins is shown below.

```
Identities = 84/122 (68%), Positives = 99/122 (80%), Gaps = 2/122 (1%)

Query:  145  VLYSAPSETEGSETKYSETEGSDLVMKDEEERQLVD--EKKEENFTSKVDGVTKYDRDYI  202
             VL SAPSETE SET+ SET+ S+LV++DEEER+    +K E +FT +VD VTKYD+DYI
Sbjct:    1  VLNSAPSETEKSETEGSETKESNLVIEDEEERKECTSVKKTEGHFTRQVDQVTKYDKDYI   60

Query:  203  WGLVHDQLRQTGLSQSASDYAMIYFSDRYQYALEQMRFARSAEVIAEYVFNGVLSEWTKQ  262
             W LVH QLR+ GLSQ+ASD M YF +RY YALE +RFAR+AE IAEYVFNGVLSEWTKQ
Sbjct:   61  WSLVHSQLREGGLSQAASDLVMSYFEERYAYALEHIRFARTAEAIAEYVFNGVLSEWTKQ  120

Query:  263  LR                                                           264
             LR
Sbjct:  121  LR                                                           122
```

3383

Based on this analysis, it was predicted that these proteins and their epitopes could be useful antigens for vaccines or diagnostics.

Example 1904

A DNA sequence (GBSx2012) was identified in *S. agalactiae* <SEQ ID 5905> which encodes the amino acid sequence <SEQ ID 5906>. Analysis of this protein sequence reveals the following:

```
Possible site: 17
>>> Seems to have no N-terminal signal sequence
----- Final Results -----
   bacterial cytoplasm --- Certainty = 0.4191 (Affirmative) <succ>
   bacterial membrane --- Certainty = 0.0000 (Not Clear) <succ>
   bacterial outside --- Certainty = 0.0000 (Not Clear) <succ>
```

A related GBS nucleic acid sequence <SEQ ID 9375> which encodes amino acid sequence <SEQ ID 9376> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1905

A DNA sequence (GBSx2013) was identified in *S. agalactiae* <SEQ ID 5907> which encodes the amino acid sequence <SEQ ID 5908>. Analysis of this protein sequence reveals the following:

```
Possible site: 15
>>> Seems to have no N-terminal signal sequence
----- Final Results -----
   bacterial cytoplasm --- Certainty = 0.3723 (Affirmative) <succ>
   bacterial membrane --- Certainty = 0.0000 (Not Clear) <succ>
   bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1906

A DNA sequence (GBSx2014) was identified in *S. agalactiae* <SEQ ID 5909> which encodes the amino acid sequence <SEQ ID 5910>. Analysis of this protein sequence reveals the following:

```
Possible site: 44
>>> Seems to have no N-terminal signal sequence
----- Final Results -----
   bacterial cytoplasm --- Certainty = 0.3053 (Affirmative) <succ>
   bacterial membrane --- Certainty = 0.0000 (Not Clear) <succ>
   bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1907

A DNA sequence (GBSx2015) was identified in *S. agalactiae* <SEQ ID 5911> which encodes the amino acid sequence <SEQ ID 5912>. This protein is predicted to be 50S ribosomal protein L7/112 (rp1L). Analysis of this protein sequence reveals the following:

```
Possible site: 56
>>> Seems to have no N-terminal signal sequence
----- Final Results -----
   bacterial cytoplasm --- Certainty = 0.1034 (Affirmative) <succ>
   bacterial membrane --- Certainty = 0.0000 (Not Clear) <succ>
   bacterial outside --- Certainty = 0.0000 (Not Clear) <succ>
```

A related GBS nucleic acid sequence <SEQ ID 9943> which encodes amino acid sequence <SEQ ID 9944> was also identified.

The protein has homology with the following sequences in the GENPEPT database.

```
>GP:CAB11881 GB:Z99104 ribosomal protein L12 (BL9) [Bacillus subtilis]
Identities = 83/123 (67%), Positives = 95/123 (76%), Gaps = 2/123 (1%)

Query:    6  MALNIENIIAEIKEATILELNDLVKAIEEEFGVTAAAPVAAA--AAGGEAAAAKDSFDVE    63
             MALNIE IIA +KEAT+LELNDLVKAIEEEFGVTAAAPVA A  AA G AA  +  FD+
Sbjct:    1  MALNIEEIIASVKEATVLELNDLVKAIEEEFGVTAAAPVAVAGGAAAGGAAEEQSEFDLI    60

Query:   64  LTAAGDKKVGVIKVVREITGEGLKEAKAIVDNAPSVIKEGASEAEANEIKEKLEAAGASV   123
             L  AG +K+ VIKVVREITG GLKEAK +VDN P  +KEG ++ EA E+K KLE   GASV
Sbjct:   61  LAGAGSQKIKVIKVVREITGLGLKEAKELVDNTPKPLKEGIAKEEAEELKAKLEEVGASV   120

Query:  124  TLK                                                           126
             +K
Sbjct:  121  EVK                                                           123
```

No corresponding DNA sequence was identified in *S. pyogenes*.

Based on this analysis, it was predicted that this protein and its epitopes, could be useful antigens for vaccines or diagnostics.

A related DNA sequence was identified in *S. pyogenes* <SEQ ID 5913> which encodes the amino acid sequence <SEQ ID 5914>. Analysis of this protein sequence reveals the following:

Possible site: 51
>>> Seems to have no N-terminal signal sequence
----- Final Results -----
   bacterial cytoplasm --- Certainty = 0.1164 (Affirmative) <succ>
     bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 104/126 (82%), Positives = 113/126 (89%)

Query:    1  MEEITMALNIENIIAEIKEATILELNDLVKAIEEEFGVTAAAPVAAAAGGEAAAAKDSF    60
             +EEITMALNIENIIAEIKEA+ILELNDLVKAIEEEFGVTAAAPVAAAAGG   AAKDSF
Sbjct:    1  LEEITMALNIENIIAEIKEASILELNDLVKAIEEEFGVTAAAPVAAAAGGAEEAAKDSF    60

Query:   61  DVELTAAGDKKVGVIKVVREITGEGLKEAKAIVDNAPSVIKEGASEAEANEIKEKLEAAG  120
             DVELT+AGDKKVGVIK VREITG GLKEAK +VD AP+ +KEG + AEA EIK KLE AG
Sbjct:   61  DVELTSAGDKKVGVIKAVREITGLGLKEAKGLVDGAPANVKEGVAAAEAEEIKAKLEEAG  120

Query:  121  ASVTLK  126
             A++TLK
Sbjct:  121  ATITLK  126
```

Based on this analysis, it was predicted that these proteins and their epitopes could be useful antigens for vaccines or diagnostics.

Example 1908

A DNA sequence (GBSx2017) was identified in *S. agalactiae* <SEQ ID 5915> which encodes the amino acid sequence <SEQ ID 5916>. This protein is predicted to be ribosomal protein L10 (rp1J). Analysis of this protein sequence reveals the following:

Possible site: 37
>>> Seems to have no N-terminal signal sequence
----- Final Results -----
   bacterial cytoplasm --- Certainty = 0.1251 (Affirmative) <succ>
     bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:CAB11880 GB:Z99104 ribosomal protein L10 (BL5) [Bacillus subtilis]
Identities = 96/164 (58%), Positives = 125/164 (75%), Gaps = 1/164 (0%)

Query:   14  MSEAIIAKKAEQVELIAEKMKAAASIVVVDSRGLTVEQDTNLRRSLRESDVEFKVIKNSI   73
             MS AI  KK   VE IA K+K + S ++VD RGL V + T LR+ LRE++VE KV KN++
Sbjct:    1  MSSAIETKKVV-VEEIASKLKESKSTIIVDYRGLNVSEVTELRKQLREANVESKVYKNTM   59

Query:   74  LTRAAEKAGLEDLKELFVGPSAVAFSNEDVIAPAKVISDFAKDAEALEIKGGSVDGKFTS  133
              RA E+A L  L +   GP+A+AFS EDV+APAKV++DFAK+ EALEIK G ++GK ++
Sbjct:   60  TRRAVEQAELNGLNDFLTGPNAIAFSTEDVVAPARVLNDFAKNHEALEIKAGVIEGKVST  119

Query:  134  VEEINALAKLPNKEGMLSMLLSVLQAPVRNVAYAVKAVAEKDEE  177
             VEE+ ALA+LP +EG+LSMLLSVL+APVRN+A A KAVAE+ EE
Sbjct:  120  VEEVEALAELPPREGLLSMLLSVLKAPVRNLALAAKAVAEQKEE  163
```

A related DNA sequence was identified in *S. pyogenes* <SEQ ID 5917> which encodes the amino acid sequence <SEQ ID 5918>. Analysis of this protein sequence reveals the following:

```
Possible site: 56
>>> Seems to have an uncleavable N-term signal seq
    INTEGRAL   Likelihood = −5.47   Transmembrane 7-23 (5-24)
----- Final Results -----
    bacterial membrane --- Certainty = 0.3187 (Affirmative) <succ>
    bacterial outside --- Certainty = 0.0000 (Not Clear) <succ>
        bacterial cytoplasm --- Certainty = 0.0000 (Not Clear) <succ>
```

An alignment of the GAS and GBS proteins is shown below.

```
Identities = 149/176 (84%), Positives = 162/176 (91%)

Query:     4   SQKIKTEVKLMSEAIIAKKAEQVELIAEKMKAAASIVVVDSRGLTVEQDTNLRRSLRESD    63
               S KIKTEVKLMSEAIIAKKAEQVELIAEKMKAAASIV+VDSRGLTV+QDT LRRSLRES
Sbjct:    23   SPKIKTEVKLMSEAIIAKKAEQVELIAEKMKAAASIVIVDSRGLTVDQDTVLRRSLRESG   82

Query:    64   VEFKVIKNSILTRAAEKAGLEDLKELFVGPSAVAFSNEDVIAPAKVISDFARDAEALEIK   123
               VEFKVIKNSILTRAAEKAGL++LK++FVGPSAVAFSNEDVIAPAKVI+DF K A+ALEIK
Sbjct:    83   VEFKVIKNSILTRAAEKAGLDELKDVFVGPSAVAFSNEDVIAPAKVINDFTKTADALEIK   142

Query:   124   GGSVDGKFTSVEEINALAKLPNKEGMLSMLLSVLQAPVRNVAYAVKAVAEKDEEVA       179
               GG+++G  +S EEI ALA LPN+EGMLSMLLSVLQAPVRNVAYAVKAVAE  E  A
Sbjct:   143   GGAIEGAVSSKEEIQALATLPNREGMLSMLLSVLQAPVRNVAYAVKAVAENKEGAA       198
```

Based on this analysis, it was predicted that these proteins and their epitopes could be useful antigens for vaccines or diagnostics.

Example 1909

A DNA sequence (GBSx2018) was identified in *S. agalactiae* <SEQ ID 5919> which encodes the amino acid sequence <SEQ ID 5920>. Analysis of this protein sequence reveals the following:

```
Possible site: 40
>>> Seems to have no N-terminal signal sequence
    INTEGRAL   Likelihood = −7.22   Transmembrane 125-141 (106-143)
    INTEGRAL   Likelihood = −1.91   Transmembrane 108-124 (106-124)
----- Final Results -----
    bacterial membrane --- Certainty = 0.3888 (Affirmative) <succ>
    bacterial outside --- Certainty = 0.0000 (Not Clear) <succ>
        bacterial cytoplasm --- Certainty = 0.0000 (Not Clear) <succ>
```

A related GBS nucleic acid sequence <SEQ ID 10931> which encodes amino acid sequence <SEQ ID 10932> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1910

A DNA sequence (GBSx2019) was identified in *S. agalactiae* <SEQ ID 5921> which encodes the amino acid sequence <SEQ ID 5922>. This protein is predicted to be Clp-like ATP-dependent protease binding subunit (clpC). Analysis of this protein sequence reveals the following:

```
Possible site: 31
>>> Seems to have no N-terminal signal sequence
----- Final Results -----
    bacterial cytoplasm --- Certainty = 0.3483 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP:AAA68910 GB:L34677 Clp-like ATP-dependent protease binding subunit
[Bos taurus]
Identities = 437/589 (74%), Positives = 514/589 (87%), Gaps = 5/589 (0%)

Query:    10   DPFGN-MDDIFNSLMGNMGGYNSENKRYLINGREVTPEEFSQYRQTGKLPGQELNNQNTP    68
               DPF N MDD+FN LMG M G NSEN+RYLINGREVTPEE++ +RQTGKLPG     Q
Sbjct:     2   DPFNNDMDDLFNQLMGGMNGVNSENRRYLINGREVTPEEYAAFRQTGKLPGVTDPTQ-AK   60

Query:    69   TNQVSADSVLTKLGTNLTDQARQHLLDPVIGRNKEIQETAEILARRTKNNPVLVGDAGVG   128
               T Q   DS+L KLG NLT +A++  LDPVIGRNKEIQETAEIL+RRTKNNPVLVGDAGVG
Sbjct:    61   TKQPQPDSMLAKLGRNLTQEAKEGKLDPVIGRNKEIQETAEILSRRTKNNPVLVGDAGVG   120

Query:   129   KTAVIEGLAQAIINGDVPAAIKNKEIISIDISSLEAGTQYRGSFEENIQNIIKEVKETGN   188
               KTAV+EGLAQAI+ GDVPAAIKNK+IISIDISSLEAGTQYRGSFEEN+Q +I EVK+ GN
Sbjct:   121   KTAVVEGLAQAIVAGDVPAAIKNKQIISIDISSLEAGTQYRGSFEENMQKLIDEVKKDGN   180

Query:   189   IILFFDEIHQILGAGSTGGDSGSKGLADILKPALSRGELTVIGATTQDEYRNTILKNAAL   248
               +ILFFDEIHQI+GAG+  G   SGSKG+ADILKPALSRGE+T+IGATTQDEYRNTILK+AAL
Sbjct:   181   VILFFDEIHQIIGAGNAGDASGSKGMADILKPALSRGEVTLIGATTQDEYRNTILKDAAL   240

Query:   249   ARRFNEVKVNAPSAQDTFNILMGIRNLYEQHHNVVLPDSVLKAAVDLSIQYIPQRSLPDK   308
               +RRFN+V VNAPS +DTF IL G+R LYE+HHNV LPD VLKAA+D S+QYIPQRSLPDK
```

```
                       -continued
Sbjct:  241  SRRFNQVTVNAPSKEDTFKILQGLRKLYEKHHNVSLPDEVLKAAIDYSVQYIPQRSLPDK  300

Query:  309  AIDLIDMTAAHLAAQHPVTDLKSLEKEIAEQRDKQEKAVNTEDFEEALKVKTRIEELQNQ  368
             AIDLID+TAAHLA++HPV D K++E+EI +   KQ++AV  ED++ A + K ++ +LQ+Q
Sbjct:  301  AIDLIDVTAAHLASKHPVKDAKTIEEEIKKTEAKQQEAVEKEDYQAAQEAKDQVAKLQDQ  360

Query:  369  IDNHTEGQKVTATINDIAMSIERLTGVPVSNMGASDIERLKELGNRLKGKVIGQNDAVEA  428
             + +H+E ++V AT +D+A ++ER+TG+PVS MGASDIERLK L  RL+GKVIGQ +AVEA
Sbjct:  361  LKDHSESERVVATPSDVAAAVERMTGIPVSKMGASDIERLKGLATRLEGKVIGQQEAVEA  420

Query:  429  VARAIRRNRAGFDDGNRPIGSFLFVGPTGVGKTELAKQLAFDMFGSKDAIVRLDMSEYND  488
             V+RAIRRNRAGFD+GNRPIGSFLFVGPTGVGKTELAKQLA DMFGS + I+RLDMSEY D
Sbjct:  421  VSRAIRRNRAGFDEGNRPIGSFLFVGPTGVGKTELAKQLALDMFGSTNDIIRLDMSEYTD  480

Query:  489  RTAVSKLIGATAGYVGYDDNSNTLTERIRRNPYSIVLLDEIEKADPQVITLLLQVLDDGR  548
             RTAVSKLIG TAGYVGYDDNSNTLTE++RR+PYSIVLLDEIEKA+PQVITLLLQVLDDGR
Sbjct:  481  RTAVSKLIGTTAGYVGYDDNSNTLTEKVRRHPYSIVLLDEIEKANPQVITLLLQVLDDGR  540

Query:  549  LTDGQGNTINFKNTVIIATSNAGFGNEAFTGDSDKDLKIMERISPYFRP            597
             LTDGQGNT++FKNT+IIATSNAGF ++A  G+    D K+M+++ PYFRP
Sbjct:  541  LTDGQGNTVDFKNTIIIATSNAGFSSDAVAGE---DAKLMDKLQPYFRP            586
```

A related DNA sequence was identified in *S. pyogenes* <SEQ ID 5923> which encodes the amino acid sequence <SEQ ID 5924>. Analysis of this protein sequence reveals the following:

Possible site: 22

>>> Seems to have no N-terminal signal sequence

----- Final Results ----- bacterial cytoplasm --- Certainty = 0.2718 (Affirmative) <succ> bacterial membrane --- Certainty = 0.0000 (Not Clear) <succ> bacterial outside --- Certainty = 0.0000 (Not Clear) <succ>

An alignment of the GAS and GBS proteins is shown below.

```
Identities = 551/697 (79%), Positives = 616/697 (88%), Gaps = 3/697 (0%)

Query:    5  NFYNRDPFGNMDDIFNSLMGNMGGYNSENKRYLINGREVTPEEFSQYRQTGKLPGQELNN   64
             +F  +DPF NMDDIFN LM NMGGY SEN RYL+NGRE+TPEEF YRQTG+LP
Sbjct:    3  HFSGKDPFVNMDDIFNQLMANMGGYRSENPRYLVNGREITPEEFQHYRQTGQLPVATTKA   62

Query:   65  QNTPTNQVSADSVLTKLGTNLTDQARQHLLDPVIGRNKEIQETAEILARRTKNNPVLVGD  124
             N+       ADSVLT+LGTNLT +ARQ  LDPVIGRNKEIQ+TAEILARRTKNNPVLVGD
Sbjct:   63  TNSQMLTPKADSVLTQLGTNLTQEARQGHLDPVIGRNKEIQDTAEILARRTKNNPVLVGD  122

Query:  125  AGVGKTAVIEGLAQAIINGDVPAAIKNKEIISIDISSLEAGTQYRGSFEENIQNIIKEVK  184
             AGVGKTAVIEGLAQAI+NGDVPAAIKNKEI+SIDISSLEAGTQYRGSFEE IQN+I+EVK
Sbjct:  123  AGVGKTAVIEGLAQAIVNGDVPAAIKNKEIVSIDISSLEAGTQYRGSFEETIQNLIQEVK  182

Query:  185  ETGNIILFFDEIHQILGAGSTGGDSGSKGLADILKPALSRGELTVIGATTQDEYRNTILK  244
             E GNIILFFDEIHQI+GAG+T  DSGSKGLADILKPALSRGELT+IGATTQDEYRNTILK
Sbjct:  183  EAGNIILFFDEIHQIVGAGATSSDSGSKGLADILKPALSRGELTLIGATTQDEYRNTILK  242

Query:  245  NAALARRFNEVKVNAPSAQDTFNILMGIRNLYEQHHNVVLPDSVLKAAVDLSIQYIPQRS  304
             NAALARRFNEVKVNAPSA+DTF+ILMGIRNLYEQHH++ LPD+VLKAAVD SIQYIPQRS
Sbjct:  243  NAALARRFNEVKVNAPSAEDTFHILMGIRNLYEQHHHITLPDNVLKAAVDYSIQYIPQRS  302

Query:  305  LPDKAIDLIDMTAAHLAAQHPVTDLKSLEKEIAEQRDKQEKAVNTEDFEEALKVKTRIEE  364
             LPDKAIDL+DMTAAHLAAQHPVTDLK+LE EIA+Q++ QEKAV  EDFE+AL  KTRIE
Sbjct:  303  LPDKAIDLLDMTAAHLAAQHPVTDLKTLETEIAKQKESQEKAVAKEDFEKALAAKTRIET  362

Query:  365  LQNQIDNHTEGQKVTATINDIAMSIERLTGVPVSNMGASDIERLKELGNRLKGKVIGQND  424
             LQ QI+ H + Q VTAT+NDIA S+ERLTG+PVSNMG +D+ERLK + +RLK  VIGQ++
Sbjct:  363  LQKQIEQHNQSQNVTATVNDIAESVERLTGIPVSNMGTNDLERLKGISSRLKSHVIGQDE  422

Query:  425  AVEAVARAIRRNRAGFDDGNRPIGSFLFVGPTGVGKTELAKQLAFDMFGSKDAIVRLDMS  484
             AV AVARAIRRNRAGFDDG RPIGSFLFVGPTGVGKTELAKQLA D+FGSKDAI+RLDMS
Sbjct:  423  AVAAVARAIRRNRAGFDDGKRPIGSFLFVGPTGVGKTELAKQLALDLFGSKDAIIRLDMS  482

Query:  485  EYNDRTAVSKLIGATAGYVGYDDNSNTLTERIRRNPYSIVLLDEIEKADPQVITLLLQVL  544
             EYNDRTAVSKLIG TAGYVGYDDN+NTLTER+RRNPY+IVLLDEIEKADPQ+ITLLLQVL
Sbjct:  483  EYNDRTAVSKLIGTTAGYVGYDDNNNTLTERVRRNPYAIVLLDEIEKADPQIITLLLQVL  542

Query:  545  DDGRLTDGQGNTINEKNTVIIATSNAGFGNEAFTGDSDKDLKIMERISPYFRPEFLNRFN  604
             DDGRLTDGQGNTIN FKNTVIIATSNAGFG +    +   + IM+RI+PYFRPEFLNRFN
```

```
-continued
Sbjct:   543  DDGRLTDGQGNTINFKNTVIIATSNAGFGQQ---DTETSESNIMDRIAPYFRPEFLNRFN   599

Query:   605  GVIEFSHLSKDDLSEIVDLMLDEVNQTIGKKGIDLVVDENVKSHLIELGYDEAMGVRPLR   664
              +I+F+HL K+ L EIVDLML EVNQT  KKGI L + ++ K+HLI+LGY+ AMG RPLR
Sbjct:   600  SIIKFNHLQKESLEEIVDLMLAEVNQTTAKKGISLTITDDAKAHLIDLGYNHAMGARPLR   659

Query:   665  RVIEQEIRDRITDYYLDHTDVKHLKANLQDGQIVISE                         701
              R+IEQEIRDRITDYYLDH +VK L+A L++GQ+VI +
Sbjct:   660  RIIEQEIRDRITDYYLDHPEVKKLQAILKEGQLVIRQ                         696
```

Based on this analysis, it was predicted that these proteins and their epitopes could be useful antigens for vaccines or diagnostics.

Example 1911

A DNA sequence (GBSx2020) was identified in *S. agalactiae* <SEQ ID 5925> which encodes the amino acid sequence <SEQ ID 5926>. Analysis of this protein sequence reveals the following:

---

Possible site: 20
>>> Seems to have an uncleavable N-term signal seq
INTEGRAL   Likelihood = −4.78   Transmembrane 8-24 (7-25)
-----Final Results -----
    bacterial membrane --- Certainty = 0.2911 (Affirmative) <succ>
      bacterial outside --- Certainty = 0.0000 (Not Clear) <succ>
        bacterial cytoplasm --- Certainty = 0.0000 (Not Clear) <succ>

---

A related GBS nucleic acid sequence <SEQ ID 9945> which encodes amino acid sequence <SEQ ID 9946> was also identified.

The protein has homology with the following sequences in the GENPEPT database.

Based on this analysis, it was predicted that this protein and its epitopes, could be useful antigens for vaccines or diagnostics.

A related GBS gene <SEQ ID 8933> and protein <SEQ ID 8934> were also identified. Analysis of this protein sequence reveals the following:

---

Lipop: Possible site: −1   Crend: 5
McG: Discrim Score: 5.48
GvH: Signal Score (−7.5): −2.64
Possible site: 20
>>> Seems to have an uncleavable N-term signal seq
ALOM program   count: 1 value: −4.78 threshold: 0.0
INTEGRAL   Likelihood = −4.78   Transmembrane 8-24 (7-25)
PERIPHERAL   Likelihood = 2.49    259
modified ALOM score: 1.46
*** Reasoning Step: 3
----- Final Results -----
    bacterial membrane --- Certainty = 0.2911 (Affirmative) <succ>
      bacterial outside --- Certainty = 0.0000 (Not Clear) <succ>
        bacterial cytoplasm --- Certainty = 0.0000 (Not Clear) <succ>

---

```
>GP:AAC73364 GB:AE000134 putative enzyme [Escherichia coli K12]
Identities = 142/307 (46%), Positives = 195/307 (63%), Gaps = 6/307 (1%)

Query:    39  KELLESKKTLILHGALGTELESRGCDVSGKLWSAKYLIEDPAAIQTIHEDYIRAGADIVT    98
              + LL+ +   L+L GA+ TELE+RGC+++  LWSAK L+E+P  I+ +H DY RAGA
Sbjct:     8  RALLDKQDILLLDGAMATELEARGCNLADSLWSAKVLVENPELIREVHLDYYRAGAQCAI    67

Query:    99  TSTYQATLQGLAQVGVSESQTEDLIRLTVQLAKAAREQVWKSLTKEEKSERIYPLISGDV   158
              T++YQAT  G A  G+ E+Q++ LI   +V+LA+ ARE      L + ++   + L++G V
Sbjct:    68  TASYQATPAGFAARGLDEAQSKALIGKSVELARKAREAY---LAENPQAGTL--LVAGSV   122

Query:   159  GPYAAFLADGSEYTGLYDIDKQGLKNFHRHRIELLLDEGVDILALETIPNAQEAEALIEL   218
              GPY A+LADGSEY G Y   +   + FHR R+E LLD G D+LA ET+PN  E EAL EL
Sbjct:   123  GPYGAYLADGSEYRGDYHCSVEAFQAFHRPRVEALLDAGADLLACETLPNFSEIEALAEL   182

Query:   219  LAEDFPQVEAYMSFTSQDGKTISDGSAVADLAKAIDVSPQVVALGINCSSPSLVADFLQA   278
              L   +P+  A+ SFT +D + +SDG+ + D+   +    PQVVALGINC +        LQ
Sbjct:   183  LTA-YPRARAWFSFTLRDSEHLSDGTPLRDVVALLAGYPQVVALGINCIALENTTAALQH   241

Query:   279  IAEQTNKPLVTYPNSGEVYDGASQSWQSSPDHSHTLLENTSDWQKLGAQVVGGCCRTRPA   338
              +   T   PLV YPNSGE YD  S++W     +H  L +     WQ  GA+++GGCCRT PA
Sbjct:   242  LHGLTVLPLVVYPNSGEHYDAVSKTWHHHGEHCAQLADYLPQWQAAGARLIGGCCRTTPA   301

Query:   339  DIADLSA                                                       345
              DIA L A
Sbjct:   302  DIAALKA                                                       308
```

No corresponding DNA sequence was identified in *S. pyogenes*.

The protein has homology with the following sequences in the databases:

---

ORF01312(412-1338 of 1644)
OMNI|NT01EC0303(55-357 of 358) conserved hypothetical protein
% Match = 23.8
% Identity = 46.6 % Similarity = 64.3

-continued

```
Matches = 142 Mismatches = 107 Conservative Sub.s = 54

288       318       348       378       408       438       468       498
        LISQSFCS*FRL*GLLGIAHNVLGFTSVFHLLFSAIFITNYVTRNGDLMGRFKELLESKKTLILHGALGTELESRGCDVS
                                                  :: ||: :  |:| ||:  ||||:|||:::
        AWWPVLGWHSIQRRELRCGAGYRLLRCAMVLISLLNPETQNRSQNMSQNNPLRALLDKQDILLLDGAMATELEARGCNLA
                  20        30        40        50        60        70        80

528       558       588       618       648       678       708       738
        GKLWSAKYLIEDPAAIQTIHEDYIRAGADIVTTSTYQATLQGLAQVGVSESQTEDLIRLTVQLAKAAREQVWKSLTKEEK
        ||||| |:|:|   |:  :| || ||||      |::||||   |:|   |: |:|::  ||  :|:||:  |||   |
        DSLWSAKVLVENPELIREVHLDYYRAGAQCAITASYQATPAGFAARGLDEAQSKALIGKSVELARKARE-----AYLAEN
                  100       110       120       130       140       150

768       798       828       858       888       918       948       978
        SERIYPLISGDVGPYAAFLADGSEYTGLYDIDKQGLKNFHRHRIELLLDEGVDILALETIPNAQEAEALIELLAEDFPQV
        :     |::|  ||||  |:||||||| ||     : :: ||| |:|  ||| |||:|  |   ||| ||      :|:
        PQAGTLLVAGSVGPYGAYLADGSEYRGDYHCSVEAFQAFHRPRVEALLDAGADKKACETLPNFSEIEALAELLT-AYPRA
                  170       180       190       200       210       220       230

1008      1038      1068      1098      1128      1158      1188      1218
        EAYMSFTSQDGKTISDGSAVADLAKAIDVSPQVVALGINCSSPSLVADFLQAIAEQTNKPLVTYPNSGEVYDGASQSWQS
        |: |||  :|  : :|||: : |:      :  |||||||||| :     || :    |  ||| |||||| ||  |::|:
        RAWFSFTLRDSEHLSDGTPLRDVVALLAGYPQVVALGINCIALENTTAALQHLGLTVLPLVVYPNSGEHYDAVSKTWHH
                  250       260       270       280       290       300       310

1248      1278      1308      1338      1368      1398      1428      1458
        SPDHSHTLLENTSDWQKLGAQVVGGCCRTRPADIADLSAHLK*VKYLEEG*GKFDFLFQSTRKPAWILPNGFCFYLSEMT
        :|    |  :   ||    ||:::|||||| |||||| | |
        HGEHCAQLADYLPQWQAAGARLIGGCCRTTPADIAALKARS
                  330       340       350
```

SEQ ID 8934 (GBS381) was expressed in *E. coli* as a His-fusion product. SDS-PAGE analysis of total cell extract is shown in FIG. 68 (lane 6; MW 42 kDa). It was also expressed in *E. coli* as a GST-fusion product. SDS-PAGE analysis of total cell extract is shown in FIG. 72 (lane 4; MW 66.9 kDa).

Example 1912

A DNA sequence (GBSx2021) was identified in *S. agalactiae* <SEQ ID 5927> which encodes the amino acid sequence <SEQ ID 5928>. Analysis of this protein sequence reveals the following:

Possible site: 51
>>> Seems to have no N-terminal signal sequence
----- Final Results -----
  bacterial cytoplasm --- Certainty = 0.2996 (Affirmative) <succ>
  bacterial membrane --- Certainty = 0.0000 (Not Clear) <succ>
  bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1913

A DNA sequence (GBSx2022) was identified in *S. agalactiae* <SEQ ID 5929> which encodes the amino acid sequence <SEQ ID 5930>. Analysis of this protein sequence reveals the following:

Possible site: 59
>>> Seems to have no N-terminal signal sequence
INTEGRAL   Likelihood = -11.62   Transmembrane 176-192 (168-198)
INTEGRAL   Likelihood = -11.57   Transmembrane 89-105 (80-111)
INTEGRAL   Likelihood = -10.03   Transmembrane 337-353 (332-359)
INTEGRAL   Likelihood = -9.87    Transmembrane 292-308 (285-316)
INTEGRAL   Likelihood = -4.51    Transmembrane 58-74 (52-78)
INTEGRAL   Likelihood = -3.88    Transmembrane 267-283 (267-286)
INTEGRAL   Likelihood = -3.08    Transmembrane 125-141 (125-142)
INTEGRAL   Likelihood = -2.13    Transmembrane 212-228 (212-228)
----- Final Results -----
  bacterial membrane --- Certainty = 0.5649 (Affirmative) <succ>
  bacterial outside --- Certainty = 0.0000 (Not Clear) <succ>
  bacterial cytoplasm --- Certainty = 0.0000 (Not Clear) <succ>

A related GBS nucleic acid sequence <SEQ ID 9377> which encodes amino acid sequence <SEQ ID 9378> was also identified.

The protein has homology with the following sequences in the GENPEPT database.

```
>GP:CAB12034 GB:Z99105 similar to histidine permease [Bacillus subtilis]
Identities = 221/384 (57%), Positives = 291/384 (75%), Gaps = 2/384 (0%)

Query:    2  PVTGSFHTYATKFISPGTGFTVAWLYWICWTVALGTEFLGAAMLMQRWFPNVPAWAFASF    61
             PVTG+FHTYA K+I PGTGFTVAWLYW+ WTVALG+EF  A +LMQRWFP+   W +++
Sbjct:   76  PVTGAFHTYAAKYIGPGTGFTVAWLYWLTWTVALGSEFTAAGLLMQRWFPHTSVWMWSAV   135
```

```
-continued
Query:    62  FALVIFGLNALSVRFFAEAESFFSSIKVIAIIIFIILGLGAMFGLVSFEGQHKAILFTHL  121
              FAL IF LNA SV+FFAE+E +FSSIKV+AI++FI+LG  AMFG++  +G   A + ++
Sbjct:   136  FALFIFLLNAFSVKFFAESEFWFSSIKVLAIVLFILLGGSAMFGIIPIKGGEAAPMLSNF  195

Query:   122  TANGA-FPNGIVAVVSVMLAVNYAFSGTELIGIAAGETDNPKEAVPRAIKTTIGRLVVFF  180
              TA G  FPNG V ++  ML+VN+AFSGTELIGIAAGE+ +P +  +P+AIKTT+ RL +FF
Sbjct:   196  TAEGGLFPNGFVPILMTMLSVNFAFSGTELIGIAAGESVDPDKTIPKAIKTTVWRLSLFF  255

Query:   181  VLTIVVLASLLPMKEAGVSTAPFVDVFDKMGIPFTADIMNFVILTAILSAGNSGLYASSR  240
              V TI VL+ L+P+++AGV  +PFV VFD++G+P+ ADIMNFVILTAILSA NSGLYASSR
Sbjct:   256  VGTIFVLSGLIPIQDAGVIKSPFVAVFDRVGVPYAADIMNFVILTAILSAANSGLYASSR  315

Query:   241  MLWSLANEGMLSKSVVKINKHGVPMRALLLSMAGAVLSLFSSIYAADTVYLALVSIAGFA  300
              MLWSL+ E  L  + K+    G P  AL+ SM G +LSL SS++A DTVY+ LVSI+GFA
Sbjct:   316  MLWSLSKEKTLHPTFAKLTSKGTPFNALVFSMIGGILSLLSSVFAPDTVYVVLVSISGFA  375

Query:   301  VVVVWLAIPVAQINFRKEFLKE-NQLEDLSYKTPFTPVLPYITIILLLISIVGIAWDSSQ  359
              VVVVW+ I  +Q  FRK +++   N++ DL Y+TP   P +P    +L L S+VGIA+D +Q
Sbjct:   376  VVVVWMGIAASQFMFRKRYIEAGNKVTDLKYRTPLYPFVPIAAFLLCLASVVGIAFDPNQ  435

Query:   360  RAGLYFGVPFIIFCYIYHKLRYKK                                     383
              R  LY GVPF+  CY  + ++ +K
Sbjct:   436  RIALYCGVPFMAICYAIYYVKNRK                                     459
```

There is also homology to SEQ ID 4070.

Based on this analysis, it was predicted that this protein and its epitopes, could be useful antigens for vaccines or diagnostics.

Example 1914

A DNA sequence (GBSx2023) was identified in S. agalactiae <SEQ ID 5931> which encodes the amino acid sequence <SEQ ID 5932>. Analysis of this protein sequence reveals the following:

---
Possible site: 32
>>> Seems to have no N-terminal signal sequence
----- Final Results -----
   bacterial cytoplasm --- Certainty = 0.2378 (Affirmative) <succ>
   bacterial membrane --- Certainty = 0.0000 (Not Clear) <succ>
   bacterial outside --- Certainty = 0.0000 (Not Clear) <succ>
---

There is also homology to SEQ ID 5642.

Based on this analysis, it was predicted that this protein and its epitopes, could be useful antigens for vaccines or diagnostics.

Example 1915

A DNA sequence (GBSx2024) was identified in S. agalactiae <SEQ ID 5933> which encodes the amino acid sequence <SEQ ID 5934>. Analysis of this protein sequence reveals the following:

---
Possible site: 25
>>> Seems to have no N-terminal signal sequence
----- Final Results -----
   bacterial cytoplasm --- Certainty = 0.4935 (Affirmative) <succ>
   bacterial membrane --- Certainty = 0.0000 (Not Clear) <succ>
   bacterial outside --- Certainty = 0.0000 (Not Clear) <succ>
---

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1916

A DNA sequence (GBSx2025) was identified in S. agalactiae <SEQ ID 5935> which encodes the amino acid sequence <SEQ ID 5936>. Analysis of this protein sequence reveals the following:

---
Possible site: 42
>>> Seems to have no N-terminal signal sequence
----- Final Results -----
   bacterial cytoplasm --- Certainty = 0.0530 (Affirmative) <succ>
   bacterial membrane --- Certainty = 0.0000 (Not Clear) <succ>
   bacterial outside --- Certainty = 0.0000 (Not Clear) <succ>
---

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1917

A DNA sequence (GBSx2026) was identified in S. agalactiae <SEQ ID 5937> which encodes the amino acid sequence <SEQ ID 5938>. Analysis of this protein sequence reveals the following:

---
Possible site: 17
>>> Seems to have no N-terminal signal sequence
----- Final Results -----
   bacterial cytoplasm --- Certainty = 0.0175 (Affirmative) <succ>
   bacterial membrane --- Certainty = 0.0000 (Not Clear) <succ>
   bacterial outside --- Certainty = 0.0000 (Not Clear) <succ>
---

The protein has homology with the following sequences in the GENPEPT database.

```
>GP:AAF63739 GB:AF236863 hypothetical GTP-binding protein [Lactococcus lactis]
Identities = 142/193 (73%), Positives = 165/193 (84%)

Query:    6   LNTHNASILLSAANKSHYPQDDLPEVALAGRSNVGKSSFINTLLGRKNLARTSSKPGKTQ    65
              +NT+N +I +SAA+K  YP++D PE+ALAGRSNVGKSSFINTLL RKN ARTS +PGKTQ
Sbjct:    3   INTNNLTITISAASKKQYPENDWPEIALAGRSNVGKSSFINTLLNRKNFARTSGQPGKTQ    62

Query:   66   LLNFYNIDDKLRFVDVPGYGYAKVSKTERAKWGKMIEEYLVTRDNLRVVVSLVDFRHDPS   125
              LLNFYNIDD+L FVDVPGYGYA+VSK ER KWGKMIEEYL TR+NL+ VVSLVD RH+PS
Sbjct:   63   LLNFYNIDDQLHFVDVPGYGYARVSKKEREKWGKMIEEYLTTRENLKAVVSLVDIRHEPS   122

Query:  126   ADDIQMYEFLKYYEIPVIIVATKADKIPRGKWNKHESSIKKKLNFDKKDHFIVFSSVDRT   185
               DD+ MYEFLKYY IPVI+VATKADK+PRGKWNKHES IKK + FD  D FI+FSS D+T
Sbjct:  123   EDDLMMYEFLKYYHIPVILVATKADKVPRGKWNKHESIIKKAMKFDSTDDFIIFSSTDKT   182

Query:  186   GLDESWDTILSEL                                                198
              G++E+W  IL  L
Sbjct:  183   GIEEAWTAILKYL                                                195
```

A related DNA sequence was identified in *S. pyogenes* <SEQ ID 5939> which encodes the amino acid sequence <SEQ ID 5940>. Analysis of this protein sequence reveals the following:

<SEQ ID 5942>. This protein is predicted to be protease ClpX (clpX). Analysis of this protein sequence reveals the following:

---

Possible site: 18
>>> Seems to have no N-terminal signal sequence
----- Final Results -----
  bacterial cytoplasm --- Certainty = 0.0123 (Affirmative) <succ>
    bacterial membrane --- Certainty = 0.0000 (Not Clear) <succ>
      bacterial outside --- Certainty = 0.0000 (Not Clear) <succ>

---

Possible site: 50
>>> Seems to have no N-terminal signal sequence
----- Final Results -----
  bacterial cytoplasm --- Certainty = 0.2389 (Affirmative) <succ>
    bacterial membrane --- Certainty = 0.0000 (Not Clear) <succ>
      bacterial outside --- Certainty = 0.0000 (Not Clear) <succ>

---

An alignment of the GAS and GBS proteins is shown below.

```
Identities = 167/196 (85%), Positives = 183/196 (93%)

Query:    3   EEFLNTHNASILLSAANKSHYPQDDLPEVALAGRSNVGKSSFINTLLGRKNLARTSSKPG    62
              E+ LNTHNASILLSAANKSHYPQDDLPE+ALAGRSNVGKSSFINT+LGRKNLARTSSKPG
Sbjct:    4   EQVLNTHNASILLSAANKSHYPQDDLPEIALAGRSNVGKSSFINTILGRKNLARTSSKPG    63

Query:   63   KTQLLNFYNIDDKLRFVDVPGYGYAKVSKTERAKWGKMIEEYLVTRDNLRVVVSLVDFRH   122
              KTQLLNF+NIDDKLRFVDVPGYGYAKVSK+ERAKWGKMIEEYL +RDNLR VVSLVD RH
Sbjct:   64   KTQLLNFFNIDDKLRFVDVPGYGYAKVSKSERAKWGKMIEEYLTSRDNLRAVVSLVDLRH   123

Query:  123   DPSADDIQMYEFLKYYEIPVIIVATKADKIPRGKWNKHESSIKKKLNFDKKDHFIVFSSV   182
               PS +DIQMY+FLKYY+IPVI+VATKADKIPRGKWNKHES +KK LNFDK D FIVFSSV
Sbjct:  124   APSKEDIQMYDFLKYYDIPVIVVATKADKIPRGKWNKHESVVKKALNFDKSDTFIVFSSV   183

Query:  183   DRTGLDESWDTILSEL                                             198
              +R G+D+SWD IL ++
Sbjct:  184   ERIGIDDSWDAILEQV                                             199
```

Based on this analysis, it was predicted that these proteins and their epitopes could be useful antigens for vaccines or diagnostics.

Example 1918

A DNA sequence (GBSx2027) was identified in *S. agalactiae* <SEQ ID 5941> which encodes the amino acid sequence A related GBS nucleic acid sequence <SEQ ID 9947> which encodes amino acid sequence <SEQ ID 9948> was also identified.

The protein has homology with the following sequences in the GENPEPT database.

```
>GP:AAF63738 GB:AF236863 protease ClpX [Lactococcus lactis]
Identities = 305/395 (77%), Positives = 357/395 (90%), Gaps = 1/395 (0%)

Query:   18   NVYCSFCGKSQDEVKKIIAGNGVFICNECVALSQEIIKEELAEEVLADLAEVPKPKELLE    77
              N+ CSFCGKSQD+VKK+IAG+ V+ICNEC+ LS  I++EEL EE  +++ EV  PKE+ +
Sbjct:    8   NIQCSFCGKSQDDVKKMIAGSDVYICNECIELSTRILEEELKEEQDSEMLEVKTPKEMFD    67

Query:   78   ILNQYVVGQDRAKRALAVAVYNHYKRVSYTESS-DDDVDLQKSNILMIGPTGSGKTFLAQ   136
              LN+YV+GQ++AKRALAVAVYNHYKR+++T S   +D++LQKSNIL+IGPTGSGKTFLAQ
```

```
                           -continued
Sbjct:   68  HLNEYVIGQEKAKRALAVAVYNHYKRINFTASKIAEDIELQKSNILLIGPTGSKTFLAQ   127

Query:  137  TLAKSLNVPFAIADATSLTEAGYVGEDVENILLKLIQAADYNVERAERGIIYVDEIDKIA   196
             TLAKSLNVPFAIADATSLTEAGYVGEDVENILLKL+QA+D+N+ERAERGIIY+DEIDKIA
Sbjct:  128  TLAKSLNVPFAIADATSLTEAGYVGEDVENILLKLLQASDFNIERAERGIIYIDEIDKIA   187

Query:  197  KKGENVSITRDVSGEGVQQALLKIIEGTVASVPPQGGRKHPNQEMIQINTKNILFIVGGA   256
             KK ENVSITRDVSGEGVQQALLKIIEGTVASVPPQGGRKHPNQEMIQI+TKNILFIVGGA
Sbjct:  188  KKSENVSITRDVSGEGVQQALLKIIEGTVASVPPQGGRKHPNQEMIQIDTKNILFIVGGA   247

Query:  257  FDGIEDLVKQRLGEKVIGFGQTSRKIDDNASYMQEIISEDIQKFGLIPEFIGRLPVVAAL   316
             FDGIE++VKQRLGEK+IGFG  ++K+ D   SYMQEII+EDIQKFGLIPEFIGRLP+VAAL
Sbjct:  248  FDGIEEIVKQRLGEKIIGFGANNKKLSDEDSYMQEIIAEDIQKFGLIPEFIGRLPIVAAL   307

Query:  317  ELLTAEDLVRILTEPRNALVKQYQTLLSYDGVELEFDQDALLAIADKAIERKTGARGLRS   376
             E LT EDL++ILTEP+NAL+KQY+ LL +D VELEF   AL+AIA KAIERKTGARGLRS
Sbjct:  308  ERLTEEDLIQILTEPKNALIKQYKQLLLFDNVELEFKDGALMAIAKKAIERKTGARGLRS   367

Query:  377  IIEETMLDIMFEIPSQEDVTKVRITKAAVEGTDKP                           411
             IIEE M+DIMFE+PS E++TKV IT+A V+G  +P
Sbjct:  368  IIEEVMMDIMFEVPSHEEITKVIITEAVVDGKAEP                           402
```

A related DNA sequence was identified in *S. pyogenes* <SEQ ID 5943> which encodes the amino acid sequence <SEQ ID 5944>. Analysis of this protein sequence reveals the following:

Possible site: 42
>>> Seems to have no N-terminal signal sequence
----- Final Results -----
    bacterial, cytoplasm --- Certainty = 0.2711 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below.

Based on this analysis, it was predicted that these proteins and their epitopes could be useful antigens for vaccines or diagnostics.

Example 1919

A DNA sequence (GBSx2028) was identified in *S. agalactiae* <SEQ ID 5945> which encodes the amino acid sequence <SEQ ID 5946>. Analysis of this protein sequence reveals the following:

Possible site: 26
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>

```
Identities = 378/409 (92%), Positives = 393/409 (95%), Gaps = 1/409 (0%)

Query:    9  MAGNRNNDMNVYCSFCGKSQDEVKKIIAGNGVFICNECVALSQEIIKEELAEEVLADLAE    68
             MAG+R ND+ VYCSFCGKSQD+VKKIIAGN VFICNECVALSQEIIKEELAEEVLADL E
Sbjct:    1  MAGSRTNDIKVYCSFCGKSQDDVKKIIAGNNVFICNECVALSQEIIKEELAEEVLADLTE    60

Query:   69  VPKPKELLEILNQYVVGQDRAKRALAVAVYNHYKRVSYTES-SDDDVDLQKSNILMIGPT   127
             VPKPKELL++LNQYVVGQDRAKRAL+VAVYNHYKRVS+TES  DDDVDLQKSNILMIGPT
Sbjct:   61  VPKPKELLDVLNQYVVGQDRAKRALSVAVYNHYKRVSFTESRDDDDVDLQKSNILMIGPT   120

Query:  128  GSGKTFLAQTLAKSLNVPFAIADATSLTEAGYVGEDVENILLKLIQAADYNVERAERGII   187
             GSGKTFLAQTLAKSLNVPFAIADATSLTEAGYVGEDVENILLKLIQAADYNVERAERGII
Sbjct:  121  GSGKTFLAQTLAKSLNVPFAIADATSLTEAGYVGEDVENILLKLIQAADYNVERAERGII   180

Query:  188  YVDEIDKIAKKGENVSITRDVSGEGVQQALLKIIEGTVASVPPQGGRKHPNQEMIQINTK   247
             YVDEIDKIAKKGENVSITRDVSGEGVQQALLKIIEGTVASVPPQGGRKHPNQEMIQI+TK
Sbjct:  181  YVDEIDKIAKKGENVSITRDVSGEGVQQALLKIIEGTVASVPPQGGRKHPNQEMIQIDTK   240

Query:  248  NILFIVGGAFDGIEDLVKQRLGEKVIGFGQTSRKIDDNASYMQEIISEDIQKFGLIPEFI   307
             NILFIVGGAFDGIE++VKQRLGEKVIGFGQ SRKIDDNASYMQEIISEDIQKFGLIPEFI
Sbjct:  241  NILFIVGGAFDGIEEIVKQRLGEKVIGFGQNSRKIDDNASYMQEIISEDIQKFGLIPEFI   300

Query:  308  GRLPVVAALELLTAEDLVRILTEPRNALVKQYQTLLSYDGVELEFDQDALLAIADKAIER   367
             GRLPVVAALE L   DL++ILTEPRNALVKQYQ LLSYDGVEL FD++AL AIA+KAIER
Sbjct:  301  GRLPVVAALEQLNTSDLIQILTEPRNALVKQYQALLSYDGVELAFDKEALEAIANKAIER   360

Query:  368  KTGARGLRSIIEETMLDIMFEIPSQEDVTKVRITKAAVEGTDKPVLETA              416
             KTGARGLRSIIEETMLDIMFEIPSQEDVTKVRITKAAVEG  KPVLETA
Sbjct:  361  KTGARGLRSIIEETMLDIMFEIPSQEDVTKVRITKAAVEGKSKPVLETA              409
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1920

A DNA sequence (GBSx2029) was identified in S. agalactiae <SEQ ID 5947> which encodes the amino acid sequence <SEQ ID 5948>. Analysis of this protein sequence reveals the following:

Possible site: 36
>>> Seems to have no N-terminal signalsequence
----- Final Results -----
   bacterial cytoplasm --- Certainty = 0.4029 (Affirmative) <succ>
     bacterial membrane --- Certainty = 0.0000 (Not Clear) <succ>
       bacterial outside --- Certainty = 0.0000 (Not Clear) <succ>

A related GBS nucleic acid sequence <SEQ ID 9949> which encodes amino acid sequence <SEQ ID 9950> was also identified.

The protein has homology with the following sequences in the GENPEPT database.

```
>GP:AAC33872 GB:AF055727 dihydrofolate reductase [Streptococcus pneumoniae]
Identities = 83/162 (51%), Positives = 118/162 (72%), Gaps = 1/162 (0%)

Query:    25  MTKQIIAIWAEDEDHLIGVNGGLPWRLPKELHHFKETTMGQALLMGRKTFDGMNRRVLPG    84
              MTK+I+AIWA+DE+ LIG     LPW LP EL HFKETT+  A+LMGR TFDGM RR+LP
Sbjct:     1  MTKKIVAIWAQDEEGLIGKENRLPWHLPAELQHFKETTLNHAILMGRVTFDGMGRRLLPK   60

Query:    85  RETIILTKDEQFQADGVTVLNSVEQVIKWFQEHNKTLFIVGGASIYKAFLPYCEAIIKTK  144
              RET+ILT++ + + DGV     V+ V+ W+Q+   K L+I+GG  I++AF PY + +I T
Sbjct:    61  RETLILTRNPEEKIDGVATFQDVQSVLDWYQDQEKNLYIIGGKQIFQAFEPYLDEVIVTH  120

Query:   145  VHGKFKGDTYFP-DVNLSEFKVISRDYFEKDEQNAHAFTVTY                   185
              +H + +GDTYFP +++LS F+ +S  ++ KDE+N + FT+ Y
Sbjct:   121  IHARVEGDTYFPEELDLSLFETVSSKFYAKDEKNPYDFTIQY                   162
```

A related DNA sequence was identified in S. pyogenes <SEQ ID 5949> which encodes the amino acid sequence <SEQ ID 5950>. Analysis of this protein sequence reveals the following:

Possible site: 51
>>> Seems to have no N-terminal signal sequence

-continued

----- Final Results -----
   bacterial cytoplasm --- Certainty = 0.1214 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

```
Identities = 82/160 (51%), Positives = 119/160 (74%)

Query:    25  MTKQIIAIWAEDEDHLIGVNGGLPWRLPKELHHFKETTMGQALLMGRKTFDGMNRRVLPG    84
              MTK+IIAIWAEDE   LIG+ G LPW LPKEL HFK+TT+ QA+LMGR TF+GMN  +LP
Sbjct:     1  MTKEIIAIWAEDEAGLIGIAGKLPWYLPKELEHFKKTTLHQAILMGRVTFEGMNCKRLPQ   60

Query:    85  RETIILTKDEQFQADGVTVLNSVEQVIKWFQEHNKTLFIVGGASIYKAFLPYCEAIIKTK  144
              R+T+++T++  +Q D V  + S+E+V++W+    +KTL+I+GG  +AF  Y + IIKT
Sbjct:    61  RQTLVMTRNRDYQVDEVLTMTSIEKVLEWYHAQDKTLYIIGGNKVLEAFNGYFDRIIKTV  120

Query:   145  VHGKFKGDTYFPDVNLSEFKVISRDYFEKDEQNAHAFTVT                     184
              +H +FKGDTY P+++ S F    S+ ++ +D +N + FTVT
Sbjct:   121  IHHRFKGDTYRPNLDFSHFTQESQTFYARDAKNPYDFTVT                     160
```

Based on this analysis, it was predicted that these proteins and their epitopes could be useful antigens for vaccines or diagnostics.

Example 1921

A DNA sequence (GBSx2030) was identified in *S. agalactiae* <SEQ ID 5951> which encodes the amino acid sequence <SEQ ID 5952>. Analysis of this protein sequence reveals the following:

---

Possible site: 45
>>> Seems to have no N-terminal signal sequence
----- Final Results -----
   bacterial cytoplasm --- Certainty = 0.1577 (Affirmative) <succ>
   bacterial membrane --- Certainty = 0.0000 (Not Clear) <succ>
   bacterial outside --- Certainty = 0.0000 (Not Clear) <succ>

---

The protein has homology with the following sequences in the GENPEPT database.

A related DNA sequence was identified in *S. pyogenes* <SEQ ID 5953> which encodes the amino acid sequence <SEQ ID 5954>. Analysis of this protein sequence reveals the following:

---

Possible site: 53
>>> Seems to have no N-terminal signal sequence
----- Final Results -----
   bacterial cytoplasm --- Certainty = 0.3131 (Affirmative) <succ>
   bacterial membrane --- Certainty = 0.0000 (Not Clear) <succ>
   bacterial outside --- Certainty = 0.0000 (Not Clear) <succ>

---

```
>GP:AAA25221 GB:M33770 thymidylate synthase (EC 2.1.1.45) [Lactococcus lactis]
Identities = 215/280 (76%), Positives = 245/280 (86%), Gaps = 2/280 (0%)

Query:     1 MTKADLLFKDNITKIMSEGVFSEQARPRYKNGEMANSKYITGAFAEYDLSKGEFPITTLR    60
             MT AD +FK NI  I+  GVFSE ARP+YK+G+MANSKY+TG+F  YDL KGEFPITTLR
Sbjct:     1 MTYADQVFKQNIQNILDNGVFSENARPKYKDGQMANSKYVTGSFVTYDLQKGEFPITTLR    60

Query:    61 PIPIKSAIKEIFWIYQDQTNDLAVLNDKYGVTYWNDWEVGHTGTIGQRYGAVVKKHNIIS   120
             PIPIKSAIKE+ WIYQDQT++L+VL +KYGV YW +W +G  GTIGQRYGA VKK+NII
Sbjct:    61 PIPIKSAIKELMWIYQDQTSELSVLEEKYGVKYWGEWGIGD-GTIGQRYGATVKKYNIIG   119

Query:   121 KLLKQLEDNPWNRRNVISLWDYEAFEETEGLLPCAFQTMFDVRRV-NGELYLDATLTQRS   179
             KLL+ L  NPWNRRN+I+LW YE FEETEGLLPCAFQTMFDVRR  +G++YLDATL QRS
Sbjct:   120 KLLEGLAKNPWNRRNIINLWQYEDFEETEGLLPCAFQTMFDVRREKDGQIYLDATLIQRS   179

Query:   180 NDMLVAHHINAMQYVALQMMIAKHFGWRVGKFFYFINNLHIYDNQFEQAQELLKRQPSEC   239
             NDMLVAHHINAMQYVALQMMIAKHF W+VGKFFYF+NNLHIYDNQFEQA EL+KR  SE
Sbjct:   180 NDMLVAHHINAMQYVALQMMIAKHFSWKVGKFFYFVNNLHIYDNQFEQANELMKRTASEK   239

Query:   240 NPKLVLNVPDGTDFFDIKPDDFALVDYDPIKPQLRFDLAI                      279
             P+LVLNVPDGT+FFDIKP+DF LVDY+P+KPQL+FDLAI
Sbjct:   240 EPRLVLNVPDGTNFFDIKPEDFELVDYEPVKPQLKFDLAI                      279
```

An alignment of the GAS and GBS proteins is shown below.

```
Identities = 227/279 (81%), Positives = 251/279 (89%)

Query:     1 MTKADLLFKDNITKIMSEGVFSEQARPRYKNGEMANSKYITGAFAEYDLSKGEFPITTLR    60
             MTKAD +FK NI KI++EG  SEQARP+YK+G  A+SKYITGAFAEYDL+KGEFPITTLR
Sbjct:     9 MTKADQIFKANIQKIINEGSLSEQARPKYKDGRTAHSKYITGAFAEYDLAKGEFPITTLR    68

Query:    61 PIPIKSAIKEIFWIYQDQTNDLAVLNDKYGVTYWNDWEVGHTGTIGQRYGAVVKKHNIIS   120
             PIPIKSAIKE+FWIYQDQ+N L VL  KY V YWN+WEV  T TIGQRYGAVVKKH+IIS
Sbjct:    69 PIPIKSAIKELFWIYQDQSNSLDVLEAKYNVHYWNEWEVDQTRTIGQRYGAVVKKHDIIS   128

Query:   121 KLLKQLEDNPWNRRNVISLWDYEAFEETEGLLPCAFQTMFDVRRVNGELYLDATLTQRSN   180
             K+LKQL +NPWNRRNVISLWDYEAFEET+GLLPCAFQ MFDVRRV  +LYLDA+LTQRSN
Sbjct:   129 KILKQLAENPWNRRNVISLWDYEAFEETKGLLPCAFQIMFDVRRVGEDLYLDASLTQRSN   188

Query:   181 DMLVAHHINAMQYVALQMMIAKHFGWRVGKFFYFINNLHIYDNQFEQAQELLKRQPSECN   240
             D+LVAHHINAMQYVALQMMIAKHFGW++GKFFYF+NNLHIYDNQF+QAQELLKRQP
Sbjct:   189 DILVAHHINAMQYVALQMMIAKHFGWKIGKFFYFVNNLHIYDNQFDQAQELLKRQPVASQ   248

Query:   241 PKLVLNVPDGTDFFDIKPDDFALVDYDPIKPQLRFDLAI                        279
             PKLVLNVPD T+FFDIKPDDF L +YDP+KPQL FDLAI
Sbjct:   249 PKLVLNVPDRTNFFDIKPDDFELQNYDPVKPQLHFDLAI                        287
```

Based on this analysis, it was predicted that these proteins and their epitopes could be useful antigens for vaccines or diagnostics.

Example 1922

A DNA sequence (GBSx2031) was identified in *S. agalactiae* <SEQ ID 5955> which encodes the amino acid sequence <SEQ ID 5956>. This protein is predicted to be HMG-CoA synthase. Analysis of this protein sequence reveals the following:

```
Possible site: 60
>>> Seems to have no N-terminal signal sequence
----- Final Results -----
   bacterial cytoplasm --- Certainty = 0.0816 (Affirmative) <succ>
     bacterial membrane --- Certainty = 0.0000 (Not Clear) <succ>
       bacterial outside --- Certainty = 0.0000 (Not Clear) <succ>
```

A related DNA sequence was identified in *S. pyogenes* <SEQ ID 5957> which encodes the amino acid sequence <SEQ ID 5958>. Analysis of this protein sequence reveals the following:

```
Possible site: 58
>>> Seems to have no N-terminal signal sequence
----- Final Results -----
   bacterial cytoplasm --- Certainty = 0.1670 (Affirmative) <succ>
     bacterial membrane --- Certainty = 0.0000 (Not Clear) <succ>
       bacterial outside --- Certainty = 0.0000 (Not Clear) <succ>
```

An alignment of the GAS and GBS proteins is shown below.

Based on this analysis, it was predicted that these proteins and their epitopes could be useful antigens for vaccines or diagnostics.

Example 1923

A DNA sequence (GBSx2032) was identified in *S. agalactiae* <SEQ ID 5959> which encodes the amino acid sequence <SEQ ID 5960>. This protein is predicted to be HMG-CoA reductase (mvaA). Analysis of this protein sequence reveals the following:

```
Possible site: 50
>>> Seems to have no N-terminal signal sequence
INTEGRAL      Likelihood = −1.49    Transmembrane 348-364 (348-364)
INTEGRAL      Likelihood = −1.33    Transmembrane 53-69 (53-69)
----- Final Results -----
   bacterial membrane --- Certainty = 0.1595 (Affirmative) <succ>
      bacterial outside --- Certainty = 0.0000 (Not Clear) <succ>
       bacterial cytoplasm --- Certainty = 0.0000 (Not Clear) <succ>
```

The protein has homology with the following sequences in the GENPEPT database.

```
Identities = 260/385 (67%), Positives = 325/385 (83%)

Query:    36  MKIGIDKIGFATSQYVLEMTDLAIARQVDPEKFSKGLLLDSLSITPVTEDIVTLAASAAN    95
              M IGIDKIGFATSQYVL++ DLA+ARQVDP KFS+GLL++S S+ P+TEDI+TLAASAA+
Sbjct:    14  MTIGIDKIGFATSQYVLKLEDLALARQVDPAKFSQGLLIESFSVAPITEDIITLAASAAD    73

Query:    96  DILSDEDKETIDMVIVATESSIDQSKAASVYVHQLLEIQPFARSFEMKEACYSATAALDY   155
                IL+DED+  IDMVI+ATESS DQSKA+++YVH L+ IQPFARSFE+K+ACYSATAALDY
Sbjct:    74  QILTDEDRAKIDMVILATESSTDQSKASAIYVHHLVGIQPFARSFEVKQACYSATAALDY   133

Query:   156  AKLHVEKHPDSKVLVIASDIAKYGIKSTGESTQGAGSIAMLISQNPSILELKEDHLAQTR   215
              AKLHV   PDS+VLVIASDIA+YG+ S GESTQG+GSIA+L++ NP IL L ED++AQTR
Sbjct:   134  AKLHVASKPDSRVLVIASDIARYGVGSPGESTQGSGSIALLVTANPRILALNEDNVAQTR   193

Query:   216  DIMDFWRPNYSDVPYVNGMFSTKQYLDMLKTTWKVYQKRFNTSLSDYAAFCFHIPFPKLA   275
              DIMDFWRPNYS  PYV+G++STKQYL+ L+TTW+ YQKR N  LSD AA CFHIPFPKLA
Sbjct:   194  DIMDFWRPNYSFTPYVDGIYSTKQYLNCLETTWQAYQKRENLQLSDLAAVCFHIPFPKLA   253

Query:   276  LKGFNKILDNNLDEQKKAELQENFEHSITYSKKIGNCYTGSLYLGLLSLLENSQNLKAGD   335
              LKG N I+DN +  + + +L E F+ SI+YSK+IGN YTGSLYLGLLSLLENS+ L++GD
Sbjct:   254  LKGLNNIMDNTVPPEHREKLIEAFQASISYSKQIGNIYTGSLYLGLLSLLENSKVLQSGD   313

Query:   336  QIAFFSYGSGAVAEIFTGQLVDGYQNKLQSDRMDQLNKRQKITVTEYEKLFFEKTILDEN   395
              +I FFSYGSGAV+E ++GQLV GY   L ++R    L++R +++V++YE LF+E+  LD+N
Sbjct:   314  KIGFFSYGSGAVSEFYSGQLVAGYDKMLMTNRQALLDQRTRLSVSKYEDLFYEQVQLDDN   373

Query:   396  GNANFNTYRTGTFSLDSICEHQRIY                                     420
              GNANF+ Y TG F+L +I EH+RIY
Sbjct:   374  GNANFDIYLTGKFALTAIKEHRRIY                                     398
```

```
>GP:AAG02454 GB:AF290098 HMG-CoA reductase [Streptococcus pneumoniae]
Identities = 266/421 (63%), Positives = 343/421 (81%), Gaps = 3/421 (0%)

Query:     3 KISWTGFSKKSPEERIHYLEEQDFLADSSLEIVTNQDLLSLSLANQMAENVIGRIALPFS   62
             KISW GFSKKS +ER+  L+ Q  L+      +   +S+++A+Q++ENV+G   +LP+S
Sbjct:     2 KISWNGFSKKSYQERLELLKAQALLSPERQASLEKDEQMSVTVADQLSENVVGTFSLPYS   61

Query:    63 LVPDVLVNGKVYQVPYVTEEPSVVAAASFAAKIIKRSGGFLTTVHNRKMIGQVALYDVQD  122
             LVP+VLVNG+ Y VPYVTEEPSVVAAAS+A+KIIKR+GGF   VH R+MIGQVALY V +
Sbjct:    62 LVPEVLVNGQGYTVPYVTEEPSVVAAASYASKIIKRAGGFTAQVHQRQMIGQVALYQVAN  121

Query:   123 SQHTKESILNQKQQLLEIANAAHPSIVKRGGGACDLTIEI---KEDFLIVYLMVDTKEAM  179
              +  +E I ++K +LLE+AN A+PSIVKRGGGA DL +E    + DFL+VY+ VDT+EAM
Sbjct:   122 PKLAQEKIASKKAELLELANQAYPSIVKRGGGARDLHVEQIKGEPDFLVVYIHVDTQEAM  181

Query:   180 GANMVNTMMEALSSPLEDISKGKSLMSILSNYATESLVTATCRVDLRFLSRQKEEAIKLA  239
             GANM+NTM+EAL   LE++S+G+SLM ILSNYAT+SLVTA+CR+   R+LSRQK++  ++A
Sbjct:   182 GANMLNTMLEALKPVLEELSQGQSLMGILSNYAIDSLVTASCRIAFRYLSRQKDQGREIA  241

Query:   240 QKMTMASQLAQVDPYRASTHNKGIFNGIDAIVLATGNDWRAIEAGAHTYAVKDGQYRGLS  299
             +K+ +ASQ AQ DPYRA+THNKGIFNGIDAI++ATGNDWRAIEAGAH +A +DG+Y+GLS
Sbjct:   242 EKIALASQFAQADPYRAATHNKGIFNGIDAILIATGNDWRAIEAGAHAFASRDGRYQGLS  301

Query:   300 RWSYKVDDNCLEGTLTLPMPVATKGGSIGINPSVHLAHDLLGRPNAKELASIILSIGLAQ  359
              W+  ++    L G +TLPMPVATKGGSIG+NP V L+HDLLG P+A+ELA II+SIGLAQ
Sbjct:   302 CWTLDLEREELVGEMTLPMPVATKGGSIGLNPRVALSHDLLGNPSARELAQIIVSIGLAQ  361

Query:   360 NFAALKALVSTGIQAGHMKLQAKSLALLAGAKEEQISEVVKQLLDSKHMNLETAQKIVNKL  420
             NFAALKALVSTGIQ GHMKLQAKSLALLAGA E +++ +V++L+  K  NLETAQ+ +  L
Sbjct:   362 NFAALKALVSTGIQQGHMKLQAKSLALLAGASESEVAPLVERLISDKTFNLETAQRYLENL  422
```

A related DNA sequence was identified in *S. pyogenes* <SEQ ID 5961> which encodes the amino acid sequence <SEQ ID 5962>. Analysis of this protein sequence reveals the following:

Possible site: 31
>>> Seems to have no N-terminal signal sequence

----- Final Results -----
bacterial cytoplasm --- Certainty = 0.3929 (Affirmative) <succ>
bacterial membrane --- Certainty = 0.0000 (Not Clear) <succ>
bacterial outside --- Certainty=0.0000 (Not Clear) <succ>

An alignment of the GAS and GBS proteins is shown below.

```
Identities = 257/422 (60%), Positives = 330/422 (77%)

Query:     2 TKISWTGFSKKSPEERIHYLEEQDFLADSSLEIVTNQDLLSLSLANQMAENVIGRIALPF   61
             T ++W+GFSKK+ EER+  +E+   L+   LL +   ANQM ENV+GR+ALPF
Sbjct:     4 TNLNWSGFSKKTFEERLQLIEKFKLLNAENLNQLKTDVLLPIQTANQMTENVLGRLALPF   63

Query:    62 SLVPDVLVNGKVYQVPYVTEEPSVVAAASFAAKIIKRSGGFLTTVHNRKMIGQVALYDVQ  121
             S+  PD LVNG  YQ+P+VTEEPSVVAAASFAAK+IKRSGGF       NR+MIGQ+ LYD+
Sbjct:    64 SIAPDFLVNGSTYQMPFVTEEPSVVAAASFAAKLIKRSGGFKAQTLNRQMIGQIVLYDID  123

Query:   122 DSQHTKESILNQKQQLLEIANAAHPSIVKRGGGACDLTIEIKEDFLIVYLMVDTKEAMGA  181
              +   K +IL++ ++L+ +AN A+PSIVKRGGGA   +E K +FLI YL VDT+EAMGA
Sbjct:   124 QIDNAKAAILHKTKKLIALANKAYPSIVKRGGGARTIHLEEKGEFLIFYLTVDTQEAMGA  183

Query:   182 NMVNTMMEALSSPLEDISKGKSLMSILSNYATESLVTATCRVDLRFLSRQKEEAIKLAQK  241
             NMVNTMMEAL   L  +SKG  LM+ILSNYATESLVT +C +   +R L   K ++++LAQK
Sbjct:   184 NMVNTMMEALVPDLTRLSKGHCLMAILSNYATESLVTTSCEIPVRLLDHDKTKSLQLAQK  243

Query:   242 MTMASQLAQVDPYRASTHNKGIFNGIDAIVLATGNDWRAIEAGAHTYAVKDGQYRGLSRW  301
             + +AS+LAQVDPYRA+THNKGIFNGIDA+V+ATGNDWRAIEAGAH YA ++G Y+GLS+W
Sbjct:   244 IELASRLAQVDPYRATTHNKGIFNGIDAVVIATGNDWRAIEAGAHAYASRNGSYQGLSQW  303

Query:   302 SYKVDDNCLEGTLTLPMPVATKGGSIGINPSVHLAHDLLGRPNAKELASIILSIGLAQNF  361
              + D    L G +TLPMP+A+KGGSIG+NP+V +AHDLL +P+AK LA +I S+GLAQNF
Sbjct:   304 HFDQDKQVLLGQMTLPMPIASKGGSIGLNPTVSIAHDLLNQPDAKTLAQLIASVGLAQNF  363

Query:   362 AALKALVSTGIQAGHMKLQAKSLALLAGAKEEQISEVVKQLLDSKHMNLETAQKIVNKLT  421
             AALKAL S+GIQAGHMKL AKSLALLAGA +++I+ +V  LL  K +NLE A    +++L
Sbjct:   364 AALKALTSSGIQAGHMKLHAKSLALLAGATQDEIAPLVNALLADKPINLEKAHFYLSQLR  423

Query:   422 KS                                                           423
             +S
Sbjct:   424 QS                                                           425
```

Based on this analysis, it was predicted that these proteins and their epitopes could be useful antigens for vaccines or diagnostics.

Example 1924

A DNA sequence (GBSx2033) was identified in *S. agalactiae* <SEQ ID 5963> which encodes the amino acid sequence <SEQ ID 5964>. Analysis of this protein sequence reveals the following:

Possible site: 52
>>> Seems to have no N-terminal signal sequence
----- Final Results -----
   bacterial cytoplasm --- Certainty = 0.2355 (Affirmative) <succ>
     bacterial membrane --- Certainty = 0.0000 (Not Clear) <succ>
       bacterial outside --- Certainty = 0.0000 (Not Clear) <succ>

The protein has no significant homology with any sequences in the GENPEPT database.

A related DNA sequence was identified in *S. pyogenes* <SEQ ID 5965> which encodes the amino acid sequence <SEQ ID 5966>. Analysis of this protein sequence reveals the following:

Possible site: 53
>>> Seems to have no N-terminal signal sequence
----- Final Results -----
   bacterial cytoplasm --- Certainty = 0.2687 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

```
Identities = 76/138 (55%), Positives = 100/138 (72%), Gaps = 2/138 (1%)

Query:     7    PKWEELPELDLYLDQVLLYVNQLINPKTITNDKLLTASMINNYVKHNYISKPIKKKYNRR    66
                P W++LP+LDLYLDQVLLYVNQ +   ++++K LTASMINNYVKH Y++KPIKKKY ++
Sbjct:     7    PYWKDLPDLDLYLDQVLLYVNQCTDFSEVSDNKSLTASMINNYVKHGYVTKPIKKKYQKQ    66

Query:    67    QVARLIVITAFKQVFAIQEISQTLELLTADNHSEEAYNGFAACMNKEE--VHDLPPVVIS   124
                Q+ARLI I+ FK VF IQ+IS+ LE L A   SE   YN F  C N++       D+PP+V
Sbjct:    67    QLARLIAISLFKTVFPIQDISRVLEELQAQADSESLYNTFVTCWNQKAPIEEDIPPIVQV   126

Query:   125    ACQTLNLYQETQKLVLEL                                           142
                ACQT+  Y +T L+  E+
Sbjct:   127    ACQTVKDYHKTIYLLQEV                                           144
```

Based on this analysis, it was predicted that these proteins and their epitopes could be useful antigens for vaccines or diagnostics.

Example 1925

A DNA sequence (GBSx2034) was identified in *S. agalactiae* <SEQ ID 5967> which encodes the amino acid sequence <SEQ ID 5968>. This protein is predicted to be hemolysin iii. Analysis of this protein sequence reveals the following:

Possible site: 43
>>> Seems to have no N-terminal signal sequence
INTEGRAL    Likelihood = −9.08    Transmembrane 142-158 (140-165)
INTEGRAL    Likelihood = −6.79    Transmembrane 26-42 (19-44)
INTEGRAL    Likelihood = −5.63    Transmembrane 200-216 (196-217)
INTEGRAL    Likelihood = −5.41    Transmembrane 104-120 (102-121)
INTEGRAL    Likelihood = −3.98    Transmembrane 51-67 (49-69)
INTEGRAL    Likelihood = −1.86    Transmembrane 172-188 (169-188)
----- Final Results -----
   bacterial membrane --- Certainty = 0.4630 (Affirmative) <succ>
     bacterial outside --- Certainty = 0.0000 (Not Clear) <succ>
       bacterial cytoplasm --- Certainty = 0.0000 (Not Clear) <succ>

A related GBS nucleic acid sequence <SEQ ID 9951> which encodes amino acid sequence <SEQ ID 9952> was also identified.

The protein has homology with the following sequences in the GENPEPT database.

```
>GP:CAA58877 GB:X84058 novel hemolytic factor [Bacillus cereus]
Identities = 79/204 (38%), Positives = 132/204 (63%), Gaps = 4/204 (1%)

Query:    17    EELANSITHAVGALLMLILLPITAVYSHNHFGLQAALGTSIFVTSLFLMFLSSSIYHSMT    76
                EE+AN+ITH +GA+L +  L I  +++  H     A + +++    S+FL++L S++ HS+
Sbjct:    14    EEIANAITHGIGAILSIPALIILIIHASKHGTASAVVAFTVYGVSMFLLYLFSTLLHSIH    73

Query:    77    YNSLQKYVLRMIDHSMIYIAIAGSYTPVALSLIGGWLGYLIIFLQWGITLFGILYKIFAP   136
```

```
              +  ++K +    ++DHS IY+ IAG+YTP   L   + G LG+ ++ + W + + GI++KIF
Sbjct:    74  HPKVEK-LFTILDHSAIYLLIAGTYTPFLLITLRGPLGWTLLAIIWTLAIGGIIFKIFFV    132

Query:   137  KINDKFSLVLYLIMGWLVIF-IFPAIITKTGPAFWGLLLAGGICYTIGALFYA-RKRPYD    194
              +   K S + Y+IMGWL+I  I P      TG F  LLLAGGI Y++GA+F+   K P++
Sbjct:   133  RRFIKASTLCYIIMGWLIIVAIKPLYENLTGHGF-SLLLAGGILYSVGAIFFLWEKLPFN    191

Query:   195  HMIWHLFILLASILQYIGIVYFML                                      218
              H IWHLF+L  S + +  +++++L
Sbjct:   192  HAIWHLFVLGGSAMMFFCVLFYVL                                      215
```

A related DNA sequence was identified in *S. pyogenes* <SEQ ID 5969> which encodes the amino acid sequence <SEQ ID 5970>. Analysis of this protein sequence reveals the following:

---

Possible site: 41
>>> Seems to have no N-terminal signal sequence
INTEGRAL     Likelihood = −10.51   Transmembrane 144-160 (138-163)
INTEGRAL     Likelihood = −9.87    Transmembrane 49-65 (45-71)
INTEGRAL     Likelihood = −7.11    Transmembrane 198-214 (193-215)
INTEGRAL     Likelihood = −6.16    Transmembrane 102-118 (100-120)
INTEGRAL     Likelihood = −2.97    Transmembrane 20-36 (20-41)
INTEGRAL     Likelihood = −1.01    Transmembrane 167-183 (167-185)
----- Final Results -----
   bacterial membrane --- Certainty = 0.5203 (Affirmative) <succ>
      bacterial outside --- Certainty = 0.0000 (Not Clear) <succ>
         bacterial cytoplasm --- Certainty = 0.0000 (Not Clear) <succ>

---

The protein has homology with the following sequences in the databases:

```
>GP:CAA58877 GB:X84058 novel hemolytic factor [Bacillus cereus]
Identities = 82/204 (40%), Positives = 128/204 (62%), Gaps = 4/204 (1%)

Query:    15  EEVANSVTHAIGAFAMLILLPISASYAYQTYDLKAAIGISIFVISLFLMFLSSTIYHSMA    74
              EE+AN++TH IGA   + L I  +A +    A +  +++ +S+FL++L ST+ HS+
Sbjct:    14  EEIANAITHGIGAILSIPALIILIIHASKHGTASAVVAFTVYGVSMFLLYLFSTLLHSIH    73

Query:    75  YGSVHKYILRIIDHSMIYIAIAGSYTPVALSLVSGWLGYIIIVLQWGITLFGILYKIFAK   134
              +  V K +   I+DHS IY+  IAG+YTP  L  + G LG+ ++ + W + + GI++KIF
Sbjct:    74  HPKVEK-LFTILDHSAIYLLIAGTYTPFLLITLRGPLGWTLLAIIWTLAIGGIIFKIFFV   132

Query:   135  RINEKFSLMLYIVMGWL-VVFILPVIIQKTSLAFGLLMLFGGLSYTIGAVFYA-KKRPYF   192
              R   K S + YI+MGWL +V I P+      T  F LL L GG+ Y++GA+F+   +K P+
Sbjct:   133  RRFIKASTLCYIIMGWLIIVAIKPLYENLTGHGFSLL-LAGGILYSVGAIFFLWEKLPFN   191

Query:   193  HMIWHLFILLASALQFIAITFFML                                      216
              H IWHLF+L  SA+ F  + F++L
Sbjct:   192  HAIWHLFVLGGSAMMFFCVLFYVL                                      215
```

An alignment of the GAS and GBS proteins is shown below.

Based on this analysis, it was predicted that these proteins and their epitopes could be useful antigens for vaccines or diagnostics.

Example 1926

A DNA sequence (GBSx2035) was identified in *S. agalactiae* <SEQ ID 5971> which encodes the amino acid sequence <SEQ ID 5972>. Analysis of this protein sequence reveals the following:

---

Possible site: 52
>>> Seems to have no N-terminal signal sequence
----- Final Results -----
   bacterial cytoplasm --- Certainty = 0.3641 (Affirmative) <succ>
      bacterial membrane --- Certainty = 0.0000 (Not Clear) <succ>
         bacterial outside --- Certainty = 0.0000 (Not Clear) <succ>

---

The protein has homology with the following sequences in the GENPEPT database.

```
Identities = 153/213 (71%), Positives = 181/213 (84%)

Query:     6  SIKLSPQLSFGEELANSITHAVGALLMLILLPITAVYSHNHFGLQAALGTSIFVTSLFLM    65
              + K S  LSF EE+ANS+THA+GA  MLILLPI+A Y++ + L+AA+G SIFV SLFLM
Sbjct:     4  TFKQSLPLSFSEEVANSVTHAIGAFAMLILLPISASYAYQTYDLKAAIGISIFVISLFLM    63

Query:    66  FLSSSIYHSMTYNSLQKYVLRMIDHSMIYIAIAGSYTPVALSLIGGWLGYLIIFLQWGIT   125
              FLSS+IYHSM Y S+ KY+LR+IDHSMIYIAIAGSYTPVALSL GWLGY+II LQWGIT
Sbjct:    64  FLSSTIYHSMAYGSVHKYILRIIDHSMIYIAIAGSYTPVALSLVSGWLGYIIIVLQWGIT   123

Query:   126  LFGILYKIFAPKINDKFSLVLYLIMGWLVIFIFPAIITKTGPAFWGLLLAGGICYTIGAL   185
              LFGILYKIFA +IN+KFSL+LY++MGWLV+FI P II KT  AF  L+L GG+ YTIGA+
Sbjct:   124  LFGILYKIFAKRINEKFSLMLYIVMGWLVVFILPVIIQKTSLAFGLLMLFGGLSYTIGAV   183

Query:   186  FYARKRPYDHMIWHLFILLASILQYIGIVYFML                             218
              FYA+KRPY HMIWHLFILLAS LQ+I I +FML
Sbjct:   184  FYAKKRPYFHMIWHLFILLASALQFIAITFFML                             216
```

```
>GP:CAB12492 GB:Z99107 similar to hypothetical proteins [Bacillus subtilis]
Identities = 81/302 (26%), Positives = 157/302 (51%), Gaps = 10/302 (3%)

Query:    1  MKSAYIFFNPKSGKDEQALAKEVKSYLIEHDFQDDY-VRIITPSSVEEAVALAKKASEDH   59
             MK A I +NP SG++    + K+  + +++   Q  Y         +   +A   AK+A+
Sbjct:    1  MKRARIIYNPTSGRE---IFKKHLAQVLQKFEQAGYETSTHATTCAGDATHAAKEAALRE   57

Query:   60  IDLVIPLGGDGTINKICGGVYAGGAYPTIGLVPAGTVNNFSKALNIPQERNL-ALENLLN  118
             DL+I  GGDGTIN++  G+        PT+G++P GT N+F++AL IP+E   L A + ++N
Sbjct:   58  FDLIIAAGGDGTINEVVNGLAPLDNRPTLGVIPVGTTNDFARALGIPREDILKAADTVIN  117

Query:  119  GHVKSVDICKVNDDYMISSLTLGLLADIAANVTSEMKRKLGPFAFLGDAYRILKRNRSYS  178
             G  + +DI +VN  Y I+       G L ++   +V S++K   LG   A+          +L     R
Sbjct:  118  GVARPIDIGQVNGQYFINIAGGGRLTELTYDVPSKLKTMLGQLAYYLKGMEMLPSLRPTE  177

Query:  179  ITLAYDNNVRSLRTRLLLITMTNSIAGMPAFSPEATIDDGLFRVYTMEHIHFFKLLLHLR  238
             + +  YD +       L L+T+TNS+ G       +P+++++DG+F +  ++   +  + +
Sbjct:  178  VEIEYDGKLFQGEIMLFLVTLTNSVGGFEKLAPDSSLNDGMFDLMILKKANLAEFIRVAT  237

Query:  239  QFRKGDFSQAKEIKHFHTNNLTISTFKRKKSAIPKVRIDGDPGDQLPVKVEVIPKALKFI  298
                +G+        +  I +      N + ++   ++              ++ +DG+ G   LP +   + + +    +
Sbjct:  238  MALRGEHINDQHIIYTKANRVKVNVSEKM-----QLNLDGEYGGMLPGEFVNLYRHIHVV  292

Query:  299  IP                                                            300
             +P
Sbjct:  293  MP                                                            294
```

A related DNA sequence was identified in *S. pyogenes* <SEQ ID 5119> which encodes the amino acid sequence <SEQ ID 5120>. Analysis of this protein sequence reveals the following:

Possible site: 58
>>> Seems to have no N-terminal signal sequence
----- Final Results -----
  bacterial cytoplasm --- Certainty = 0.4258 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

Based on this analysis, it was predicted that these proteins and their epitopes could be useful antigens for vaccines or diagnostics.

Example 1927

A DNA sequence (GBSx2036) was identified in *S. agalactiae* <SEQ ID 5973> which encodes the amino acid sequence <SEQ ID 5974>. Analysis of this protein sequence reveals the following:

Possible site: 35
>>> Seems to have no N-terminal signal sequence
----- Final Results -----
  bacterial cytoplasm --- Certainty = 0.3628 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
Identities = 172/300 (57%), Positives = 229/300 (76%)

Query:    1  MKSAYIFFNPKSGKDEQALAKEVKSYLIEHDFQDDYVRIITPSSVEEAVALAKKASEDHI   60
             MK+   IF+NP SGK E LA++VK  Y   +H F +D V++ITP    ++A   LAK+A++D I
Sbjct:    1  MKTVRIFYNPNSGKKESQLARQVKDYFCQHGFSEDSVKVITPKDADQAFQLAKQAAKDKI   60

Query:   61  DLVIPLGGDGTINKICGGVYAGGAYPTIGLVPAGTVNNFSKALNIPQERNLALENLLNGH  120
             DLVIPLGGDGT+NKI GG+Y GGA+    IGLVP+GTVNNF+KA++IP +    AL+  +L G
Sbjct:   61  DLVIPLGGDGTLNKIIGGIYEGGAHCLIGLVPSGTVNNFAKAMHIPLQITEALDTILTGQ  120

Query:  121  VKSVDICKVNDDYMISSLTLGLLADIAANVTSEMKRKLGPFAFLGDAYRILKRNRSYSIT  180
             +K VDICK N   YMISSLTLGLLADIAA+VT+E  KR+ GP AFL  D+   RILKRNRSY+I+
Sbjct:  121  IKQVDICKANQQYMISSLTLGLLADIAADVTAEEKRRFGPLAFLKDSIRILKRNRSYAIS  180

Query:  181  LAYDNNVRSLRTRLLLITMTNSIAGMPAFSPEATIDDGLFRVYTMEHIHFFKLLLHLRQF  240
             L    N+       L+T+  LLITMTN+IAG P+FSP A    DDG F+VYTM+  + + FFK L H+     F
Sbjct:  181  LISHNHRIHLKTKFLLITMTNTIAGFPSFSPGAQADDGYFQVYTMKKVSFFKFLWHINDF  240

Query:  241  RKGDFSQAKEIKHFHTNNLTISTFKRKKSAIPKVRIDGDPGDQLPVKVEVIPKALKFIIP  300
             ++GDFS+A+EI HF  N L++       +K++   +P+ RIDGD  D    LP+++++ +IPKA+   I+P
Sbjct:  241  KQGDFSKAEEISHFQANTLSLLPQAKKQAILPRTRIDGDKSDYLPIQLDIIPKAVSIIVP  300
```

```
>GP:BAB10885 GB:AB010693 gene_id:K21C13.21~pir||T04769-strong
similarity to unknown protein [Arabidopsis thaliana]
Identities = 85/291 (29%), Positives = 150/291 (51%), Gaps = 28/291 (9%)

Query:   10  DQEWEVPVESGRYHMIVGEFCPYAQRPQIARQLLGLDKHISISFVDDV------------  57
             D + + P ESGRYH+ +   CP+A R     ++ GLD+ I+ S V +
Sbjct:   29  DPDSQFPAESGRYHLYISYACPWACRCLSYLKIKGLDEAITFSSVHAIWGRTKETDDHRG  88

Query:   58  ----PSDIGLIFSQPEQVTGAKSLRDIYHLTDPTYQGPYTIPILIDKTDNRIVCKESADL  113
                 SD  L   ++P+ +  GAKS+R++Y +   P Y+G YT+P+L DK    +V  ES+++
Sbjct:   89  WVFPDSDTELPGAEPDYLNGAKSVRELYEIASPNYEGKYTVPVLWDKKLKTVVNNESSEI  148

Query:  114  LRLFTTDFSDLHQEDAPVLFSQETASLIDNDIKDINKNFQSLMYKLAFLDKQADYDTYSK  173
             +R+F T+F+ + +   L+       +I+          + +YK   F   KQ  Y+
Sbjct:  149  IRMFNTEFNGIAKTPSLDLYPSHLRDVINETNGWVFNGINNGVYKCGFARKQEPYNEAVN  208

Query:  174  EFFTFLDQKEHLLGQRPFLLGDNLSEVDIHFFTPLVRWDIAGRDLLLLNQKALEDYPNIF  233
             + +  +D+ E +LG++ ++ G+   +E DI   F    L+R+D           N++ L +YPNIF
Sbjct:  209  QLYEAVDRCEEVLGKQRYICGNTFTEADIRLFVTLIRFDEVYAVHFKCNKRLLREYPNIF  268

Query:  234  SWAKTLYNDFNLKTLTNPQSIKNNYY-----LGKFGRAVRHHTIVPTGPNM  279
             ++ K +Y    + + N + IK +YY     + FG          I+P GPN+
Sbjct:  269  NYIKDIYQIHGMSSTVNMEHIKQHYYGSHPTINPFG-------IIPHGPNI  312
```

No corresponding DNA sequence was identified in *S. pyogenes*.

Based on this analysis, it was predicted that this protein and its epitopes, could be useful antigens for vaccines or diagnostics.

Example 1928

A DNA sequence (GBSx2037) was identified in *S. agalactiae* <SEQ ID 5975> which encodes the amino acid sequence <SEQ ID 5976>. Analysis of this protein sequence reveals the following:

Possible site: 59
>>> Seems to have no N-terminal signal sequence
----- Final Results -----
   bacterial cytoplasm --- Certainty = 0.2647 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database.

```
>GP:BAB07793 GB:AB037666 hypothetical protein [Streptomyces sp. CL190]
Identities = 127/331 (38%), Positives = 194/331 (58%), Gaps = 9/331 (2%)

Query:    4  RKDDHIKYALKYQSHY---NSFDDIELIHSSLPKYNVNDIDLSTHFAGQSFEFPFYINAM  60
             RKDDH++ A++ + +    N FDD+ +H +L   + D+ L+T FAG S++ P YINAM
Sbjct:    6  RKDDHVRLAIEQHNAHSGRNQFDDVSFVHHALAGIDRPDVSLATSFAGISWQVPIYINAM  65

Query:   61  TGGSEKGKAVNHKLAQVAQATGIVMVTGSYSAALKNDE--DDSYPTTDLYPDLKLATNIG  118
             TGGSEK    +N  LA  A+ TG+ +  +GS +A +K+      D      D  P+ +  NI
Sbjct:   66  TGGSEKTGLINRDLATAARETGVPIASGSMNAYIKDPSCADTFRVLRDENPNGFVIANIN  125

Query:  119  LDKPVPAAESTVKAMNPIFLQVHVNVMQELLMPEGEREFHMWRSHLKEYVDNIQCPLILK  178
                 V  A+ + +     LQ+H+N  QE   MPEG+R F  W       +++    + P+I+K
Sbjct:  126  ATTTVDNAQRAIDLIEANALQIHINTAQETPMPEGDRSFASWVPQIEKIAAAVDIPVIVK  185

Query:  179  EVGFGMDLQSIKDAYDIGITTVDISGRGGTSFAYIENQRGR--DRSYLNTWGQTTAQSLI  236
             EVG G+  Q+I     D+G+   D+SGRGGT FA IEN R     D ++L+ WGQ+TA  L+
Sbjct:  186  EVGNGLSRQTILLLADLGVQAADVEGRGGTDFARIENGRRELGDYAFLHGWGQSTAACLL  245

Query:  237  NAQSMMDKMDILASGGIRHPLDMVKCLVLGAKAVGLSRTVLELVERYPVDDVIAILNSWK  296
              +AQ +     + +LASGG+RHPLD+V+ L LGA+AVG S    L    VD +I L +W
Sbjct:  246  DAQDI--SLPVLASGGVRHPLDVVRALALGARAVGSSAGFLRTLMDDGVDALITKLTTWL  303

Query:  297  EDLRMIMCALNCKKITDLRQVNYILYGQLKE  327
              + L   +  L   +  DL + + +L+G+L++
Sbjct:  304  DQLAALQTMLGARTPADLTRCDVLLHGELRD  334
```

A related DNA sequence was identified in *S. pyogenes* <SEQ ID 5977> which encodes the amino acid sequence <SEQ ID 5978>. Analysis of this protein sequence reveals the following:

Possible site: 51
>>> Seems to have no N-terminal signal sequence
----- Final Results -----
   bacterial cytoplasm --- Certainty = 0.2823 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

```
Identities = 244/329 (74%), Positives = 284/329 (86%)

Query:     1  MTNRKDDHIKYALKYQSHYNSFDDIELIHSSLPKYNVNDIDLSTHFAGQSFEFPFYINAM    60
              MTNRKDDHIKYALKYQS YN+FDDIELIH SLP Y+++DIDLSTHFAGQ F+FPFYINAM
Sbjct:    31  MTNRKDDHIKYALKYQSPYNAFDDIELIHHSLPSYDLSDIDLSTHFAGQDFDFPFYINAM    90

Query:    61  TGGSEKGKAVNHKLAQVAQATGIVMVTGSYSAALKNDEDDSYPTTDLYPDLKLATNIGLD   120
              TGGS+KGKAVN KLA+VA ATGIVMVTGSYSAALKN  DDSY    ++  +LKLATNIGLD
Sbjct:    91  TGGSQKGKAVNEKLAKVAAATGIVMVTGSYSAALKNPNDDSYRLHEVADNLKLATNIGLD   150

Query:   121  KPVPAAESTVKAMNPIFLQVHVNVMQELLMPEGEREFHMWRSHLKEYVDNIQCPLILKEV   180
              KPV    + TV+ M P+FLQVHVNVMQELLMPEGER FH W+ HL EY    I   P+ILKEV
Sbjct:   151  KPVALGQQTVQEMQPLFLQVHVNVMQELLMPEGERVFHTWKKHLAEYASQIPVPVILKEV   210

Query:   181  GFGMDLQSIKDAYDIGITTVDISGRGGTSFAYIENQRGRDRSYLNTWGQTTAQSLINAQS   240
              GFGMD+ SIK A+D+GI T DISGRGGTSFAYIENQRG DRSYLN WGQTT Q L+NAQ
Sbjct:   211  GFGMDVNSIKLAHDLGIQTFDISGRGGTSFAYIENQRGGDRSYLNDWGQTTVQCLLNAQG   270

Query:   241  MMDKMDILASGGIRHPLDMVKCLVLGAKAVGLSRTVLELVERYPVDDVIAILNSWKEDLR   300
              +MD+++ILASGG+RHPLDM+KC VLGA+AVGLSRTVLELVE+YP + VIAI+N WKE+L+
Sbjct:   271  LMDQVEILASGGVRHPLDMIKCFVLGARAVGLSRTVLELVEKYPTERVIAIVNGWKEELK   330

Query:   301  MIMCALNCKKITDLRQVNYILYGQLKEAN                                329
              +IMCAL+CK I +L+ V+Y+LYG+L++ N
Sbjct:   331  IIMCALDCKTIKELKGVDYLLYGRLQQVN                                359
```

Based on this analysis, it was predicted that these proteins and their epitopes could be useful antigens for vaccines or diagnostics.

Example 1929

A DNA sequence (GBSx2038) was identified in *S. agalactiae* <SEQ ID 5979> which encodes the amino acid sequence <SEQ ID 5980>. This protein is predicted to be phosphomevalonate kinase. Analysis of this protein sequence reveals the following:

Possible site: 41
>>> Seems to have no N-terminal signal sequence
----- Final Results -----
    bacterial cytoplasm --- Certainty = 0.0785 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database.

```
>GP:AAG02457 GB:AF290099 phosphomevalonate kinase [Streptococcus pneumoniae]
Identities = 170/330 (51%), Positives = 233/330 (70%), Gaps = 1/330 (0%)

Query:     1  MVKVQTGGKLYIAGEYAILYPGQVAILKNVPIYMTALATFADNYSLYSDMFNYTASLQPD    60
              M+ V+T GKLY AGEYAIL PGQ+A++K++PIYM A   F+D+Y +YSDMF++    L+P+
Sbjct:     1  MIAVKTCGKLYWAGEYAILEPGQLALIKDIPIYMRAEIAFSDSYRIYSDMFDFAVDLRPN    60

Query:    61  KQYSLIQETILLMEEWLINFGKNIKPIHLEITGKLERYGLKFGIGSSGSVVVLTIKAMAA   120
                YSLIQETI LM ++L  G+N++P  L+I GK+ER G KFG+GSSGSVVVL +KA+ A
Sbjct:    61  PDYSLIQETIALMGDFLAVRGQNLRPFSLKICGKMEREGKKFGLGSSGSVVVLVVKALLA   120

Query:   121  LYEIEMPSDLLFKLSAYVLLKRGDNGSMGDIACIAYEHLISYSAFDRRAVSKMIETKPLE   180
              LY + +  +LLFKL++ VLLKRGDNGSMGD+ACI   E L+ Y +FDR+    +E + L
Sbjct:   121  LYNLSVDQNLLFKLTSAVLLKRGDNGSMGDLACIVAEDLVLYQSFDRQKAAAWLEEENLA   180

Query:   181  QVLEAEWGYRITKIQALLEMDFLVGWTMQPSISKEMINIVKSTITQRFLDDTKYQVVQLL   240
                VLE +WG+ I++++  LE DFLVGWT + ++S  M+   +K I Q FL +K  VV L+
Sbjct:   181  TVLERDWGFFISQVKPTLECDFLVGWTKEVAVSSHMVQQIKQNINQNFLSSSKETVVSLV   240

Query:   241  SAFKEGDKEAIKRCLEEISLLLFNLHPSIYTDKLQKLKEASKGLDIVTKSSGSGGGDCGI   300
                A   ++G  E +    +E  S LL  L    IYT  L++LKEAS+  L  V KSSG+GGGDCGI
Sbjct:   241  EALEQGKAEKVIEQVEVASKLLEGLSTDIYTPLLRQLKEASQDLQAVAKSSGAGGGDCGI   300

Query:   301  AISFN-KNDNQTLIKRWESAGIELLSKETL                               329
              A+SF+ ++   TL  RW  GIELL +E +
Sbjct:   301  ALSFDAQSSRNTLKNRWADLGIELLYQERI                               330
```

A related DNA sequence was identified in *S. pyogenes* <SEQ ID 5981> which encodes the amino acid sequence <SEQ ID 5982>. Analysis of this protein sequence reveals the following:

---

Possible site: 59
>>> Seems to have no N-terminal signal sequence
----- Final Results -----
   bacterial cytoplasm --- Certainty = 0.2669 (Affirmative) <succ>
      bacterial membrane --- Certainty = 0.0000 (Not Clear) <succ>
         bacterial outside --- Certainty = 0.0000 (Not Clear) <succ>

---

An alignment of the GAS and GBS proteins is shown below.

```
Identities = 171/325 (52%), Positives = 227/325 (69%), Gaps = 2/325 (0%)

Query:     4  VQTGGKLYIAGEYAILYPGQVAILKNVPIYMTALATFADNYSLYSDMFNYTASLQPDKQY      63
              VQTGGKLY+ GEYAIL PGQ A++  +P+ MTA   + A +   L SDMF++ A  +PD  Y
Sbjct:    22  VQTGGKLYLTGEYAILTPGQKALIHFIPLMMTAEISPAAHIQLASDMFSHKAGMTPDASY      81

Query:    64  SLIQETILLMEEWLINFGKNIKPIHLEITGKLERYGLKFGIGSSGSVVVLTIKAMAALYE     123
              +LIQ T+      ++L         ++P   L ITGK+ER G KFGIGSSGSV +LT+KA++A Y+
Sbjct:    82  ALIQATVKTFADYLGQSIDQLEPFSLIITGKMERDGKKFGIGSSGSVTLLTLKALSAYYQ     141

Query:   124  IEMPSDLLFKLSAYVLLKRGDNGSMGDIACIAYEHLISYSAFDRRAVSKMIETKPLEQVL     183
              I +  +LLFKL+AY LLK+GDNGSMGDIACIAY+  L++Y++FDR    VS   ++T PL+++L
Sbjct:   142  ITLTPELLFKLAAYTLLKQGDNGSMGDIACIAYQTLVAYTSFDREQVSNWLQTMPLKKLL     201

Query:   184  EAEWGYRITKIQALLEMDFLVGWTMQPSISKEMINIVKSTITQRFLDDTKYQVVQ-LLSA     242
               +WGY I  IQ L  DFLVGWT  P+IS++MI  V ++IT  FL  T YQ+ Q  + A
Sbjct:   202  VKDWGYHIQVIQPALPCDFLVGWTKIPAISRQMIQQVTASITPAFL-RTSYQLTQSAMVA     260

Query:   243  FKEGDKEAIKRCLEEISLLLFNLHPSIYTDKLQKLKEASKGLDIVTKSSGSGGGDCGIAI     302
              +EG KE +K+ L    S LL  LHP+IY  KL   L  A +  D V KSSGSGGGDCGIA+
Sbjct:   261  LQEGHKEELKKSLAGASHLLKELHPAIYHPKLVTLVAACQKQDAVAKSSGSGGGDCGIAL     320

Query:   303  SFNKNDNQTLIKRWESAGIELLSKE                                       327
              +FN++   TLI +W+ A I LL +E
Sbjct:   321  AFNQDARDTLISKWQEADIALLYQE                                       345
```

Based on this analysis, it was predicted that these proteins and their epitopes could be useful antigens for vaccines or diagnostics.

Example 1930

A DNA sequence (GBSx2039) was identified in *S. agalactiae* <SEQ ID 5983> which encodes the amino acid sequence <SEQ ID 5984>. Analysis of this protein sequence reveals the following:

---

Possible site: 32
>>> Seems to have an uncleavable N-term signal seq
INTEGRAL     Likelihood = -1.75    Transmembrane 20-36 (18-36)
----- Final Results -----
   bacterial membrane --- Certainty = 0.1702 (Affirmative) <succ>
      bacterial outside --- Certainty = 0.0000 (Not Clear) <succ>
         bacterial cytoplasm --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1931

A DNA sequence (GBSx2040) was identified in *S. agalactiae* <SEQ ID 5985> which encodes the amino acid sequence <SEQ ID 5986>. This protein is predicted to be mevalonate diphosphate decarboxylase. Analysis of this protein sequence reveals the following:

---

Possible site: 25
>>> Seems to have no N-terminal signal sequence
----- Final Results -----
   bacterial cytoplasm --- Certainty = 0.1557 (Affirmative) <succ>
      bacterial membrane --- Certainty = 0.0000 (Not Clear) <succ>
         bacterial outside --- Certainty = 0.0000 (Not Clear) <succ>

---

The protein has homology with the following sequences in the GENPEPT database.

```
>GP:AAG02456 GB:AF290099 mevalonate diphosphate decarboxylase
[Streptococcus pneumoniae]
Identities = 219/312 (70%), Positives = 264/312 (84%)

Query:     1  MDGKSISVKSYANIAIIKYWGKADAEKMIPATSSISLTLENMYTETRLTALGKDAKKDEF      60
              MD + ++V+SYANIAIIKYWGK   ++M+PATSSISLTLENMYTET L+ L  +   DEF
Sbjct:     1  MDREPVTVRSYANIAIIKYWGKKKEKEMVPATSSISLTLENMYTETTLSPLPANVTADEF      60
```

```
Query:    61  YISGVLQNDHEHDKMSAILDRFRQNRSGFVKIETTNNMPTAAGLSSSSSGLSALVKACND        120
              YI+G LQN+ EH KMS I+DR+R    GFV+I+T NNMPTAAGLSSSSSGLSALVKACN
Sbjct:    61  YINGQLQNEVEHAKMSKIIDRYRPAGEGFVRIDTQNNMPTAAGLSSSSSGLSALVKACNA       120

Query:   121  FFGTNLSQSQLAQEAKFASGSSSRSFFGPVAAWDKDSGDIYKVHTNLDLAMIMLVLNDKR       180
              +F   L +SQLAQEAKFASGSSSRSF+GP+ AWDKDSG+IY V T+L LAMIMLVL DK+
Sbjct:   121  YFKLGLDRSQLAQEAKFASGSSSRSFYGPLGAWDKDSGEIYPVETDLKLAMIMLVLEDKK       180

Query:   181  KPISSREGMKICTETSTTFNEWVRQSEQDYQDMLVYLKNNDFQKVGQLTERNALAMHSTT       240
              KPISSR+GMK+C ETSTTF++WVRQSE+DYQDML+YLK NDF K+G+LTE+NALAMH+TT
Sbjct:   181  KPISSRDGMKLCVETSTTFDDWVRQSEKDYQDMLIYLKENDFAKIGELTEKNALAMHATT       240

Query:   241  KTATPAFSYLTEETYKAMDVVKKLREKGHECYYTMDAGPNVKVLCLRQDLEALAAILEKD      300
              KTA+PAFSYLT+ +Y+AM V++LREKG  CY+TMDAGPNVKV C  +DLE L+ I  +
Sbjct:   241  KTASPAFSYLTDASYEAMAFVRQLREKGEACYFTMDAGPNVKVFCQEKDLEHLSEIFGQR      300

Query:   301  YRIIVSTTKELA                                                      312
              YR+IVS TK+L+
Sbjct:   301  YRLIVSKTKDLS                                                      312
```

A related DNA sequence was identified in *S. pyogenes* <SEQ ID 5987> which encodes the amino acid sequence <SEQ ID 5988>. Analysis of this protein sequence reveals the following:

Possible site: 36
>>> Seems to have no N-terminal signal sequence
----- Final Results -----
   bacterial cytoplasm --- Certainty = 0.1271 (Affirmative) <succ>
     bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 221/313 (70%), Positives = 258/313 (81%)

Query:     1  MDGKSISVKSYANIAIIKYWGKADAEKMIPATSSISLTLENMYTETRLTALGKDAKKDEF       60
              +D   I+V SYANIAIIKYWGK +  KMIP+TSSISLTLENM+T T ++  L    A  D+F
Sbjct:     1  VDPNVITVTSYANIAIIKYWGKENQAKMIPSTSSISLTLENMFTTTSVSFLPDTATSDQF       60

Query:    61  YISGVLQNDHEHDKMSAILDRFRQNRSGFVKIETTNNMPTAAGLSSSSSGLSALVKACND       120
              YI+G+LQND EH K+SAI+D+FRQ     FVK+ET NNMPTAAGLSSSSSGLSALVKAC+
Sbjct:    61  YINGILQNDEEHTKISAIIDQFRQPGQAFVKMETQNNMPTAAGLSSSSSGLSALVKACDQ       120

Query:   121  FFGTNLSQSQLAQEAKFASGSSSRSFFGPVAAWDKDSGDIYKVHTNLDLAMIMLVLNDKR       180
                F T L Q  LAQ+AKFASGSSSRSFFGPVAAWDKDSG IYKV T+L +AMIMLVLN  +
Sbjct:   121  LFDTQLDQKALAQKAKFASGSSSRSFFGPVAAWDKDSGAIYKVETDLKMAMIMLVLNAAK       180

Query:   181  KPISSREGMKICTETSTTFNEWVRQSEQDYQDMLVYLKLINDFQKVGQLTERNALAMHSTT      240
              KPISSREGMK+C +TSTTF++WV QS  DYQ ML YLK N+F+KVGQLTE NALAMH+TT
Sbjct:   181  KPISSREGMKLCRDTSTTFDQWVEQSAIDYQHMLTYLKTNNFEKVGQLTEANALAMHATT      240

Query:   241  KTATPAFSYLTEETYKAMDVVKKLREKGHECYYTMDAGPNVKVLCLRQDLEALAAILEKD      300
              KTA P FSYLT+E+Y+AM+ VK+LR++G  CY+TMDAGPNVKVLCL +DL  LA  L K+
Sbjct:   241  KTANPPFSYLTKESYQAMEAVKELRQEGFACYFTMDAGPNVKVLCLEKDLAQLAERLGKN      300

Query:   301  YRIIVSTTKELAD                                                     313
              YRIIVS TK+L D
Sbjct:   301  YRIIVSKTKDLPD                                                     313
```

Based on this analysis, it was predicted that these proteins and their epitopes could be useful antigens for vaccines or diagnostics.

Example 1932

A DNA sequence (GBSx2041) was identified in *S. agalactiae* <SEQ ID 5989> which encodes the amino acid sequence <SEQ ID 5990>. Analysis of this protein sequence reveals the following:

Possible site: 59
>>> Seems to have no N-terminal signal sequence
----- Final Results -----
   bacterial cytoplasm --- Certainty = 0.1512 (Affirmative) <succ>
     bacterial membrane --- Certainty = 0.0000 (Not Clear) <succ>
      bacterial outside --- Certainty = 0.0000 (Not Clear) <succ>

A related DNA sequence was identified in *S. pyogenes* <SEQ ID 5991> which encodes the amino acid sequence <SEQ ID 5992>. Analysis of this protein sequence reveals the following:

Possible site: 35
>>> Seems to have no N-terminal signal sequence
----- Final Results -----
   bacterial cytoplasm --- Certainty = 0.1117 (Affirmative) <succ>
     bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 182/290 (62%), Positives = 223/290 (76%)

Query:    1  MKEKFGIGKAHSKIILMGEHSVVYGYPAIAIPLKNIEVTCLIEEAPQLIALDMTDPLSTA    60
             M E  G GKAHSKIIL+GEH+VVYGYPAIA+PL +IEV C  I   A + +   D  D LSTA
Sbjct:    6  MNENIGYGKAHSKIILIGEHAVVYGYPAIALPLTDIEVVCHIFPADKPLVFDFYDTLSTA    65

Query:   61  IFAALDYLGKTSSKIAYHIESQVPERRGMGSSAAVAIAAIRAVFDYFDEDLEADLLECLV   120
             I+A+LDYL +      IAY I SQVP++RGMGSSAAV+IAAIRAVF Y  E L  DLLE LV
Sbjct:   66  IYASLDYLQRLQEPIAYEIVSQVPQKRGMGSSAAVSIAAIRAVFSYCQEPLSDDLLEILV   125

Query:  121  NRAEMIAHSNPSGLDAKTCLSENTIKFIRNIGFSTVPMHLNAYLVIADTGIHGHTKEAVD   180
             N+AE+IAH+NPSGLDAKTCLS++  IKFIRNIGF T+ +  LN YL+IADTGIHGHT+EAV+
Sbjct:  126  NKAEIIAHTNPSGLDAKTCLSDHAIKFIRNIGFETIEIALNGYLIIADTGIHGHTREAVN   185

Query:  181  KVKSSGEAVLPFLKELGYLAEASEDAIHKSDSKQLGSLMTKAHQSLKQLGVSSLEADHLV   240
             KV    E   LP+L +LG L +A E AI++ +      +G LMT+AH +LK +GVS  +AD LV
Sbjct:  186  KVAQFEETNLPYLAKLGALTQALERAINQKNKVAIGQLMTQAHSALKAIGVSISKADQLV   245

Query:  241  EVAISCGALGAKMSGGGLGGCIIALVKEKREAERLSQQLEREGAVNTWTE            290
             E A+  GALGAKM+GGGLGGC+IAL    K   AE++S +L+ EGAVNTW +
Sbjct:  246  EAALRAGALGAKMTGGGLGGCMIALADTKDMAEKISHRLKEEGAVNTWIQ           295
```

Based on this analysis, it was predicted that these proteins and their epitopes could be useful antigens for vaccines or diagnostics.

Example 1933

A DNA sequence (GBSx2042) was identified in *S. agalactiae* <SEQ ID 5993> which encodes the amino acid sequence <SEQ ID 5994>. This protein is predicted to be a histidine protein kinase. Analysis of this protein sequence reveals the following:

---

Possible site: 26
>>>Seems to have an uncleavable N-term signal seq
INTEGRAL    Likelihood = –13.43    Transmembrane    12-28 (4- 33)
INTEGRAL    Likelihood = –9.29     Transmembrane 163-179 (157-191)
----- Final Results -----
  bacterial membrane --- Certainty = 0.6371 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the GENPEPT database.

A related DNA sequence was identified in *S. pyogenes* <SEQ ID 5751> which encodes the amino acid sequence <SEQ ID 5752>. Analysis of this protein sequence reveals the following:

---

Possible site: 24
>>> Seems to have an uncleavable N-term signal seq
INTEGRAL    Likelihood = –11.30    Transmembrane    18-34 (13-42)
INTEGRAL    Likelihood = –10.35    Transmembrane 170-186 (163-199)
----- Final Results -----
  bacterial membrane --- Certainty = 0.5522 (Affirmative) <succ>
    bacterial outside --- Certainty = 0.0000 (Not Clear) <succ>
      bacterial cytoplasm --- Certainty= 0.0000 (Not Clear) <succ>

---

An alignment of the GAS and GBS proteins is shown below.

```
>GP:AAF79919 GB:AF039082 putative histidine protein kinase [Lactococcus lactis]
Identities = 78/315 (24%), Positives = 154/315 (48%), Gaps = 33/315 (10%)

Query:  101  SDRQIKNYAKRIVSQNSHSGHITYNFSTYSYLLKKVGKNDYLVVFLDTTNQYLDNQRLLQ   160
             +++QI N  + +  +N + +  Y + T S +           V++    +   Q    +
Sbjct:   84  NEKQI-NTIQTVSVKNPYGDNWHYRYLTTSQFIITNSDGTVTPVYVQIFSNVDQIQDAMS   142

Query:  161  LSIWM---SLVSFIVFMVIVSV-LSGRVILPFVANYEKQRRFITNAGHELKTPLAIISAN   216
             ++W+     ++++F +   VI+S+ L+    + P +A YEKQ+ F+ NA HEL+TPLAI+
Sbjct:  143  RAMWVIVTTMITFWILSVIISLYLANWTLKPILAAYEKQKEFVENASHELRTPLAILQNR   202

Query:  217  NELV-----EMMSGESEWTKSTNDQIQRLTGLINGMVSLAR------FEEQPDISM----   261
                EL+      +  +SE   +  +++  +  L +  +++LAR       E +P  +
Sbjct:  203  LELLFQKPTATIIDQSENISESLSEVRNMRLLTSNLLNLARRDSGIKIEPEPTTATYFEN   262

Query:  262  VDLDFSHITKDAAEDFKGPIIKDGKDFIMSIQPGIHVKAEEKSLFELVTLLVDNANKYCD   321
                +  +T++A + F G +   +G             V  ++  +  +L+T+L DNA KY D
Sbjct:  263  IFNSYEMLTENAGKKFSGNLKLEGT-----------VNLDQALIKQLLTILFDNALKYTD   311

Query:  322  PMGTVTVKLSRSSRLRRAKLEVSNTYKNGKDIDYSKFFERFYREDESHNNKKSGYGIGLS   381
                G ++V + ++          V++   +   D  D  K F+RF+R D++     +K G G+GLS
Sbjct:  312  SEGEISVDVIKNGGF--LTFAVADNGEGISDEDKKKIFDRFFRVDKARTRQKGGLGLGLS   369

Query:  382  IVTSLVHLFKGSIDV                                              396
             +    +V   + G I V
Sbjct:  370  LAKQIVEAYNGKITV                                              384
```

```
Identities = 233/410 (56%), Positives = 303/410 (73%), Gaps = 1/410 (0%)

Query:    1  MFRNLRLRFIGIAALAILVVLFSVVGVLNSANHYQTKNEIYRVLTILADNNGRIPNKLEF    60
             MF  +R+RFI IA++AI ++L S+VG++N+A  YQ++ EI R+L +++ N G++P    E
Sbjct:   10  MFNRIRIRFIMIASIAIFIILSSIVGIINTARCYQSQQEINRILHLISSNKGKLPGTTES   69

Query:   61  SKELGDDLSTDAIFQFRYFSARTDAKGNVTSFDSRNIFEVSDRQIKNYAKRIVSQNSHSG  120
             SK LG  LS D++ QFRY+S   +A G++ S ++ NI  +   + + +A+         G
Sbjct:   70  SKRLGTKLSEDSLSQFRYYSVIFNANGHLLSSNTANISALDREEAQYFARLFAKSGEEKG  129

Query:  121  HITYNFSTYSYLLKKVGKNDYLVVFLDTTNQYLDNQRLLQLSIWMSLVSFIVFMVIVSVL  180
             +   S YSYL+ ++    + LVV LDTT   +     LL +S+ ++    FI F+V+VS+
Sbjct:  130  SYRHQDSVYSYLITQLPNEEKLVVILDTTFYFRSVGDLLAVSVMLAFGGFIFFVVLVSLF  189

Query:  181  SGRVILPFVANYEKQRRFITNAGHELKTPLAIISANNELVEMMSGESEWTKSTNDQIQRL  240
             SG VI PFV NYEKQRRFITNAGHELKTPLAIISANNELVE+M+GESEWTKST+DQ++RL
Sbjct:  190  SGMVIKPFVQNYEKQRRFITNAGHELKTPLAIISANNELVELMTGESEWTKSTSDQVKRL  249

Query:  241  TGLINGMVSLARFEEQPDISMVDLDFSHITKDAAEDFKGPIIKDGKDFIMSIQPGIHVKA  300
             TGLIN M++LAR EEQPD+ +  +DFS I +DAAEDFK  ++KDGK F  ++IQP I +KA
Sbjct:  250  TGLINQMITLARLEEQPDVVLHMVDFSAIAQDAAEDEKSLVLKDGKRFDLTIQPNIMIKA  309

Query:  301  EEKSLFELVTLLVDNANKYCDPMGTVTVKLSRSSRLR-RAKLEVSNTYKNGKDIDYSKFF  359
             EEKSLFELVT+LVDNANKYCDP G V V L+     R R RAKLEVSNTY  GK IDYS+FF
Sbjct:  310  EEKSLFELVTILVDNANKYCDPKGLVKVSLTTIGRRRKRAKLEVSNTYLEGKSIDYSRFF  369

Query:  360  ERFYREDESHNNKKSGYGIGLSIVTSLVHLFKGSIDVNYKHDTITFVIYI            409
             ERFYREDESHN+K+ GYGIGLS+   S+V LFKG+I VNYK+D I F + I
Sbjct:  370  ERFYREDESHNSKEKGYGIGLSMAESMVKLFKGTITVNYKNDAIVFTVVI            419
```

SEQ ID 5994 (GBS273) was expressed in *E. coli* as a His-fusion product. SDS-PAGE analysis of total cell extract is shown in FIG. 51 (lane 14; MW 46 kDa). It was also expressed in *E. coli* as a GST-fusion product. SDS-PAGE analysis of total cell extract is shown in FIG. 56 (lane 5; MW 71 kDa).

GBS273-GST was purified as shown in FIG. 208, lane 4.

Based on this analysis, it was predicted that these proteins and their epitopes could be useful antigens for vaccines or diagnostics.

Example 1934

A DNA sequence (GBSx2043) was identified in *S. agalactiae* <SEQ ID 5995> which encodes the amino acid sequence <SEQ ID 5996>. Analysis of this protein sequence reveals the following:

---
Possible site: 16
>>> Seems to have no N-terminal signal sequence
----- Final Results -----
  bacterial cytoplasm --- Certainty = 0.2181 (Affirmative) <succ>
  bacterial membrane --- Certainty = 0.0000 (Not Clear) <succ>
  bacterial outside --- Certainty = 0.0000 (Not Clear) <succ>
---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1935

A DNA sequence (GBSx2044) was identified in *S. agalactiae* <SEQ ID 5997> which encodes the amino acid sequence <SEQ ID 5998>. This protein is predicted to be two-component response regulator (trcR). Analysis of this protein sequence reveals the following:

---
Possible site: 56
>>> Seems to have no N-terminal signal sequence
----- Final Results -----
  bacterial cytoplasm --- Certainty = 0.2503 (Affirmative) <succ>
  bacterial membrane --- Certainty = 0.0000 (Not Clear) <succ>
  bacterial outside --- Certainty = 0.0000 (Not Clear) <succ>
---

A related GBS nucleic acid sequence <SEQ ID 9379> which encodes amino acid sequence <SEQ ID 9380> was also identified.

The protein has homology with the following sequences in the GENPEPT database.

```
>GP:BAB04091 GB:AP001508 two-component response regulator [Bacillus halodurans]
Identities = 71/183 (38%), Positives = 120/183 (64%), Gaps = 3/183 (1%)

Query:    9  RVLIAEDEEQMSRVLSTAISHQGYVVDVAYDGQTAIDLANQNAYDVMVMDVMMPVKTGIE   68
             R+LI EDE++++RVL     +H+GY  D A+ G   ++     +A+D++++DVM+P  +G+E
Sbjct:    3  RILIIEDEKKIARVLQLELEHEGYETDAAFSGSDGLETFQAHAWDLVLLDVMLPELSGLE   62

Query:   69  AVKEIRQSGNKSHIIMLTAMAEIDDRVTGLDAGADDYLTKPFSLKELLARLRSMSRRLE-  127
             ++ IR +  + II+LTA    I  D+V+GLD GA+DY+TKPF ++ELLAR+R+   R ++
Sbjct:   63  VLRRIRMTDPVTPIILLTARNSIPDKVSGLDLGANDYITKPFEIEELLARVRACLRTVQT  122

Query:  128  -DFTPNVLSLGRVTLSVGEQELQCEN-TIRLAGKEAKMLAFFMLNHDKELSTQQLFEHVW  185
              +    + L  +T++    +++Q  N TI L  KE ++L FF+ N    +LS +Q+   +VW
Sbjct:  123  RERVEDTLMFQELTINEKTRDVQRGNETIELTPKEFELLVFFIKNKGQVLSREQILTNVW  182
```

```
Query:  186  GAD  188
             G D
Sbjct:  183  GFD  185
```

A related DNA sequence was identified in *S. pyogenes* <SEQ ID 5999> which encodes the amino acid sequence <SEQ ID 6000>. Analysis of this protein sequence reveals the following:

Possible site: 21
>>> Seems to have no N-terminal signal sequence

----- Final Results -----
bacterial cytoplasm --- Certainty = 0.2391 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
                                                  Score   E
!868 TRANSLATE of: 868.seq check: 1317 from: 1 to: 666  258  1e-70
>868 TRANSLATE of: 868.seq check: 1317 from: 1 to: 666
Length = 222
Identities = 125/185 (67%), Positives = 151/185 (81%)
Query:    8  MRVLIAEDEEQMSRVLSTAISHQGYVVDVAYDGQTAIDLANQNAYDVMVMDVMMPVKTGI    67
             M++L+AEDE QMS VL+TA++HQGY VDV ++GQ AID A  NAYD+M++D+MMP+K+GI
Sbjct:    1  MKILLAEDEWQMSNVLTTAMTHQGYDVDVVFNGQEAIDKAKDNAYDIMILDIMMPIKSGI    60

Query:   68  EAVKEIRQSGNKSHIIMLTAMAEIDDRVTGLDAGADDYLTKPFSLKELLARLRSMSRRLE   127
             EA+KEIR SGN SHIIMLTAMAEI+DRVTGLDAGADDYLTKPFSLKELLARLRSM RR+E
Sbjct:   61  EALKEIRASGNCSHIIMLTAMAEINDRVTGLDAGADDYLTKPFSLKELLARLRSMERRVE   120

Query:  128  DFTPNVLSLGRVTLSVGEQELQCENTIRLAGKEAKMLAFFMLNHDKELSTQQLFEHVWGA   187
              FTP VL    VTL++ EQEL   N IRLA KE K++AF MLN  K L T+ L++HVW
Sbjct:  121  SFTPQVLQFAGVTLNINEQELSAGNAIRLASKEGKLMAFLMLNQGKYLDTKTLYQHVWSD   180

Query:  188  DKDQE   192
             +D
Sbjct:  181  QEDYD   185
```

Based on this analysis, it was predicted that this protein and its epitopes, could be useful antigens for vaccines or diagnostics.

Example 1936

The following DNA sequence (GBSx2045) was identified in *S. agalactiae* <SEQ ID 6001>:

ATGGAAACAAATATTTATGGAGATTATGGTCGATATCTACCATTAATTTTAGAAGATTTCAGCCAGCGTATCCAATT
AGAAAATGATAAAGCTAAGGTTGAAACAGGCTATAAATTGTACGAACATATCATTGGTCGTATTAAAACGTCAGATA
GTATGATAGAGAAATGTCGTCGCAAACAGTTACCTGTAACGGTAGATTCTGCACTAAAAACGATTAGAGATAGCATT
GGAGTCCGTATTATTTGCGGTTTTGTTAACGACATTTATCAAATTATAGAACGTATTAAGGCATTCGATGATTGTCG
TATTGTGGTTGAAAAAGATTATATCCAGCATGTTAAGCCAAATGGGTATCGTTCTTATCATGTGATTTTAGAAATTG
ATACCCCCTATCCAGACTGTTTGGGTAATTCAGACGGTAAATATTACATTGAAATTCAGTTGCGTACCATTGCGCAA
GATTCTTGGGCTAGTTTAGAACATCAAATGAAATACAAGCATGATATTGAAAATCCCGAACGAATTGTAAGGGAATT
AAAACGTTGTGCTGATGAAATGGCATCCGTTGATTTAACGATGCAAACGATTCGTCAATTGATAGAGAGTGGAACAA
AGAAGGAA

This encodes the amino acid sequence <SEQ ID 6002>:

METNIYGDYGRYLPLILEDFSQRIQLENDKAKVETGYKLYEHIIGRIKTSDSMIEKCRRKQLPVTVDSALKTIRDSI

GVRIICGFVNDIYQIIERIKAFDDCRIVVEKDYIQHVKPNGYRSYHVILEIDTPYPDCLGNSDGKYYIEIQLRTIAQ

DSWASLEHQMKYKHDIENPERIVRELKRCADEMASVDLTMQTIRQLIESGTKKE

Analysis of this protein sequence reveals the following:

```
Possible site: 26
>>> Seems to have no N-terminal signal seq.
----- Final Results -----
              bacterial cytoplasm --- Certainty=0.2627(Affirmative) <
                                 succ>
```

Possible site: 26
>>> Seems to have no N-terminal signal sequence
----- Final Results -----
   bacterial cytoplasm --- Certainty = 0.2627 (Affirmative) <succ>
      bacterial membrane --- Certainty = 0.0000 (Not Clear) <succ>
         bacterial outside --- Certainty = 0.0000 (Not Clear) <succ>

The protein has homology with the following sequences in the GENPEPT database.

```
>GP:BAB05604 GB:AP001513 unknown conserved protein [Bacillus halodurans]
Identities = 67/182 (36%), Positives = 111/182 (60%), Gaps = 4/182 (2%)

Query:    17  LEDFSQRIQLENDKAKVETGYKLYEHIIGRIKTSDSMIEKCRRKQLPVTVDSALKTIRDS   76
              L++ + +I +    + +     Y    EH+  R+K+ +S++ K +R+    T++S  + +RD
Sbjct:    29  LQELNTKIDILKQEFQYIHDYNPIEHVSSRVKSPESIVNKIQRRGNDFTLESIRENVRDI   88

Query:    77  IGVRIICGFVNDIYQIIERIKAFDDCRIVVEKDYIQHVKPNGYRSYHVILEIDTPYPDCL  136
              G+RI C F +DIY + E++     D  +V  KDYI++ KPNGYRS H+IL I    P  +
Sbjct:    89  AGIRITCSFESDIYTLSEQLMQQHDISVVETKDYIKNPKPNGYRSLHLILSI----PIFM  144

Query:   137  GNSDGKYYIEIQLRTIAQDSWASLEHQMKYKHDIENPERIVRELKRCADEMASVDLTMQT  196
                 +      Y+E+Q+RTIA D WASLEH++ YK++    PE +++ELK  A+   A +D  M+
Sbjct:   145  SDRVQDVYVEVQIRTIAMDFWASLEHKIYYKYNKNVPEHLLKELKDAAESAALLDQKMEK  204

Query:   197  IR                                                           198
              I+
Sbjct:   205  IQ                                                           206
```

A related DNA sequence was identified in *S. pyogenes* <SEQ ID 6003> which encodes the amino acid sequence <SEQ ID 6004>. Analysis of this protein sequence reveals the following:

Possible site: 33
>>> Seems to have no N-terminal signal sequence
----- Final Results -----
   bacterial cytoplasm --- Certainty = 0.1057 (Affirmative) <succ>
      bacterial membrane --- Certainty = 0.0000 (Not Clear) <succ>
         bacterial outside --- Certainty = 0.0000 (Not Clear) <succ>

An alignment of the GAS and GBS proteins is shown below.

Based on this analysis, it was predicted that these proteins and their epitopes could be useful antigens for vaccines or diagnostics.

Example 1937

A DNA sequence (GBSx2046) was identified in *S. agalactiae* <SEQ ID 6005> which encodes the amino acid sequence <SEQ ID 6006>. Analysis of this protein sequence reveals the following:

Possible site:40
>>> Seems to have no N-terminal signal sequence
----- Final Results -----
   bacterial cytoplasm --- Certainty = 0.3250 (Affirmative) <succ>
      bacterial membrane --- Certainty = 0.0000 (Not Clear) <succ>
         bacterial outside --- Certainty = 0.0000(Not Clear) <succ>

The protein has homology with the following sequences in the GENPEPT database.

```
Identities = 127/206 (61%), Positives = 162/206 (77%)

Query:     3  TNIYGDYGRYLPLILEDFSQRIQLENDKAKVETGYKLYEHIIGRIKTSDSMIEKCRRKQL   62
              ++IY  +   YLPL+L+  +  I   EN K+K ETG+KLYEH    RIK+   SMIEKC+RKQL
Sbjct:    11  SSIYSGFEVYLPLVLQTITDVIIAENIKSKKETGFKLYEHFTSRIKSEASMIEKCQRKQL   70

Query:    63  PVTVDSALKTIRDSIGVRIICGFVNDIYQIIERIKAFDDCRIVVEKDYIQHVKPNGYRSY  122
              P+T   SALK I+DSIG+RIICGF++DIY++++ +K+        +  EKDYI + KPNGYRSY
Sbjct:    71  PLTSKSALKIIKDSIGIRIICGFIDDIYRMVDLLKSIPGMSVNTEKDYILNAKPNGYRSY  130

Query:   123  HVILEIDTPYPDCLGNSDGKYYIEIQLRTIAQDSWASLEHQMKYKHDIENPERIVRELKR  182
              H+ILE++T +PD LG    G Y+IE+QLRTIAQDSWASLEHQMKYKH + N E I RELKR
Sbjct:   131  HLILELETHFPDILGEKKGCYFIEVQLRTIAQDSWASLEHQMKYKHQVANAEMITRELKR  190

Query:   183  CADEMASVDLTMQTIRQLIESGTKKE                                   208
              CADE+AS D+TMQTIRQLI+  T++E
Sbjct:   191  CADELASCDVTMQTIRQLIQETTEEE                                   216
```

```
>GP:CAA37193 GB:X53013 ORF1 (AA 1-384) [Lactococcus lactis]
Identities = 30/55 (54%), Positives = 37/55 (66%)

Query:      1  MEFYYKTLKRKFINDADTIFIEQSQFEIFIYIETDHNSSSSHVVLDYQSQKEFEK  55
               ME +YKTLKR+ INDA    ++  EIF YIET +N+   H  LDYQS K+FEK
Sbjct:    327  MESFYKTLKRELINDAHFETRAEATQEIFKYIETYYNTKWMHSGLDYQSPKDFEK  381
```

A related DNA sequence was identified in *S. pyogenes* <SEQ ID 6007> which encodes the amino acid sequence <SEQ ID 6008>. Analysis of this protein sequence reveals the following:

Possible site: 36
>>> Seems to have no N-terminal signal sequence
----- Final Results -----
   bacterial cytoplasm --- Certainty = 0.3065 (Affirmative) <succ>
     bacterial membrane --- Certainty = 0.0000 (Not Clear) <succ>
       bacterial outside --- certainty = 0.0000 (Not Clear) <succ>

An alignment of the GAS and GBS proteins is shown below.

```
Identities = 31/59 (52%), Positives = 39/59 (65%)

Query:      1  MEFYYKTLKRKFINDADTIFIEQSQFEIFIYIETDHNSSSSHVVLDYQSQKEFEKIITN  59
               ME +YKTLKR+ +NDA    I+Q+Q EIF Y ET +N   H  L Y S  EFEKI+T+
Sbjct:     13  MEAFYKTLKRELVNDAHFATIKQAQLEIFKYSETYYNPKRLHSALGYLSPVEFEKIVTH  71
```

Based on this analysis, it was predicted that these proteins and their epitopes could be useful antigens for vaccines or diagnostics.

Example 1938

A DNA sequence (GBSx2047) was identified in *S. agalactiae* <SEQ ID 6009> which encodes the amino acid sequence <SEQ ID 6010>. This protein is predicted to be R5 protein. Analysis of this protein sequence reveals the following:

Possible site: 51
>>> Seems to have no N-terminal signal sequence
INTEGRAL    Likelihood = −3.98    Transmembrane    30-46 (29-51)
INTEGRAL    Likelihood = −2.76    Transmembrane    967-983 (966-985)
----- Final Results -----
   bacterial membrane --- Certainty = 0.2593(Affirmative) <succ>
     bacterial outside --- Certainty = 0.0000 (Not Clear) <succ>
       bacterial cytoplasm --- Certainty = 0.0000 (Not Clear) <succ>

A related GBS nucleic acid sequence <SEQ ID 8935> which encodes amino acid sequence <SEQ ID 8936> was also identified. Analysis of this protein sequence reveals the following:

Lipop: Possible site: −1    Crend: 8
SRCFLG: 0
McG: Length of UR: 2
Peak Value of UR: 2.44
Net Charge of CR: 2
McG: Discrim Score: 0.78
GvH: Signal Score (−7.5): −0.0599995
Possible site: 39
>>> Seems to have a cleavable N-term signal seq.
Amino Acid Composition: calculated from 40
ALOM program    count: 0 value: 7.37    threshold: 0.0

-continued

PERIPHERAL    Likelihood = 7.37.    194
modified ALOM score: −1.97
*** Reasoning Step: 3
Rule gpol
----- Final Results -----
   bacterial outside --- Certainty = 0.3000 (Affirmative) <succ>
     bacterial membrane --- Certainty = 0.0000 (Not Clear) <succ>
       bacterial cytoplasm --- Certainty = 0.0000 (Not Clear) <succ>
LPXTG motif: 944-948

No corresponding DNA sequence was identified in *S. pyogenes*.

SEQ ID 8936 (GBS200) was expressed in *E. coli* as a His-fusion product. SDS-PAGE analysis of total cell extract is shown in FIG. 29 (lane 3; MW 107.4 kDa), in FIG. 169 (lane 4; MW 122 kDa) and in FIG. 238 (lane 11; MW 122 kDa). It was also expressed in *E. coli* as a GST-fusion product. SDS-PAGE analysis of total cell extract is shown in FIG. 35 (lane 3; MW 132 kDa).

Purified Thio-GBS200-His is shown in FIG. 244, lane 9.

Based on this analysis, it was predicted that this protein and its epitopes, could be useful antigens for vaccines or diagnostics.

Example 1939

A DNA sequence (GBSx2048) was identified in *S. agalactiae* <SEQ ID 6011> which encodes the amino acid sequence <SEQ ID 6012>. This protein is predicted to be a 16.1 kDa transcriptional regulator. Analysis of this protein sequence reveals the following:

Possible site: 25
>>> Seems to have no N-terminal signal sequence
----- Final Results -----
   bacterial cytoplasm --- Certainty = 0.3919 (Affirmative) <succ>
     bacterial membrane --- Certainty = 0.0000 (Not Clear) <succ>
       bacterial outside --- Certainty= 0.0000 (Not Clear) <succ>

A related GBS nucleic acid sequence <SEQ ID 9953> which encodes amino acid sequence <SEQ ID 9954> was also identified.

The protein has homology with the following sequences in the GENPEPT database.

```
>GP:CAB16108 GB:Z99124 similar to transcriptional regulator (MarR family)
[Bacillus subtilis]
Identities = 30/114 (26%), Positives = 59/114 (51%), Gaps = 3/114 (2%)

Query:   29   DVEHLAGPQGHLVMYLYKHPDKDMSIKAVEEILHISKSVASNLVKRMEKNGFIAIVPSKT      88
              D++     G    +LV +Y++P    + + + E++ + ++ A+   +K++E  GFI   +P +
Sbjct:   25   DLDLTRGQYLYLVR-IYENPG--IIQEKLAEMIKVDRTTAARAIKKLEMQGFIQKLPDEQ     81

Query:   89   DKRVKYLYLTHLGKKKATQFEIFLEKLHSTMLAGITKEEIRTTKKVIRTLAKNM          142
              +K++K  L+   T    GKK             E         L+G T EE    T    ++    + KN+
Sbjct:   82   NKKIKKLFPTEKGKKVYPLLRREGEHSTEVALSGFTSEEKETISALLHRVRKNI         135
```

A related DNA sequence was identified in *S. pyogenes* <SEQ ID 6013> which encodes the amino acid sequence <SEQ ID 6014>. Analysis of this protein sequence reveals the following:

Possible site: 43
>>> Seems to have no N-terminal signal sequence
----- Final Results -----
   bacterial cytoplasm --- Certainty = 0.4175 (Affirmative) <succ>
   bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 27/64 (42%), Positives = 46/64 (71%)

Query:    3   MENPLQKARILVNQLEKYLDHYAKEYDVEHLAGPQGHLVMYLYKHPDKDMSIKAVEEILH     62
              M   +    R L++Q+E+    D    AK+YDVEHLAGPQG+++++L KH ++++  +K +E+  L
Sbjct:    1   MSQVIGDLRELIHQIEQISDEIAKKYDVEHLAGPQGYVLVFLAKHQNQEIFVKDIEKQLR     60

Query:   63   ISKS        66
              I  +S
Sbjct:   61   IFQS        64
```

Based on this analysis, it was predicted that these proteins and their epitopes could be useful antigens for vaccines or diagnostics.

<SEQ ID 6016>. This protein is predicted to be 5'-nucleotidase family protein. Analysis of this protein sequence reveals the following:

Possible site: 27
>>> Seems to have a cleavable N-term signal seq.
INTEGRAL    Likelihood = –2.66    Transmembrane 668-684 (665-684)
----- Final Results -----
   bacterial membrane --- Certainty = 0.2062 (Affirmative) <succ>
      bacterial outside --- Certainty = 0.0000 (Not Clear) <succ>
   bacterial cytoplasm --- Certainty = 0.0000 (Not Clear) <succ>

The protein has homology with the following sequences in the GENPEPT database.

Example 1940

A DNA sequence (GBSx2049) was identified in *S. agalactiae* <SEQ ID 6015> which encodes the amino acid sequence

```
>GP:CAB12747 GB:Z99108 similar to 5'-nucleotidase [Bacillus subtilis]
Identities = 178/535 (33%), Positives = 270/535 (50%), Gaps = 55/535 (10%)

Query:     28   DQVGVQVIGVNDFHGALDNTGTANMPDGKVANAGTAAQLD---AYMDDAQKDFKQTNPNG        84
                + V ++++ +ND HG +D      ++ DG     GT   ++D    AY+ + + + K
Sbjct:    586   EHVPLRILSMNDLHGKIDQQYELDL-DGNGTVDGTFGRMDYAAAYLKEKKAEKKN-----       639

Query:     85   ESIRVQAGDMVGASPANSGLLQDEPTVKNFNAMNVEYGTLGNHEFDEGLAEYNRIVTGKA       144
                 S+  V  AGDM+G S       S    LLQDEPTV+         +    +GT+GNHEFDEG    E   RI+  G
Sbjct:    640   -SLIVEAGDMIGGSSPVSSLLQDEPTVELMEDIGFDVGTVGNHEFDEGTDELLRILNG-G       697

Query:    145   PAPDSNINNITKSYPHEAAKQEIVVANVIDKVNKQIPYNWKPYAIKNIPVNNKSVNVGFI       204
                                P             +++P          +V AN         +P+          +N + V V FI
Sbjct:    698   DHPKGTSGYDGQNFP-------LVCANC------KMKSTGEPFLPAYDIINVEGVPVAFI       744

Query:    205   GIVTKDIPNLVLRKNYEQYEFLDEAETIVKYAKELQAKNVKAIVVLAHVPATSKNDIAEG       264
                G+VT+      +V+ +  +   EF  DEA   + K A+EL+K   VKAI VLAH+  A      +          G
Sbjct:    745   GVVTQSAAGMVMPEGIKNIEFTDEATAVNKAAEELKKKGVKAIAVLAHMSAEQNGNAITG       804

Query:    265   EAAEMMKKVNQLFPENSVDIVFAGHNHQYTNGLVGKTRIVQALSQGKAYADVRGVLDTDT       324
                E+A++    K          ++ +D++FA HNHQ   NG V    IVQA    GKA  V    +D  T
Sbjct:    805   ESADLANKT-----DSEIDVIFAAHNHQVVNGEVNGKLIVQAFEYGKAIGVVDVEIDKTT       859
```

-continued

```
Query:     325 QDFIETPSAKVIAVAPGKKTGSADIQAIVDQANTIVKQVTEAKIGTAEVSVMITRSVDQD    384
               +D ++  SA+++ V   K        AI+ +  TI + +     +G A V +    S D D
Sbjct:     860 KDIVK-KSAEIVYVDQSKIEPDVSASAILKKYETIAEPIISEVVGEAAVDMEGGYSNDGD    918

Query:     385 NVSPVGSLITEAQLAIARKSWPDIDFAMTNNGGIRADLLIKPDGTITWGAAQAVQPFGNI    444
                +P+G+LI +  A  +       DFA+ N GGIR  L      G ITWG   +QPFGN+
Sbjct:     919 --TPLGNLIADGMRAAMK-----TDFALMNGGIREAL---KKGPITWGDLYNIQPFGNV    968

Query:     445 LQVVEITGRDLYKALNEQYDQKQNFFLQIAGLRYTYTDNKEGGEETPFKVVKAYKSNGEE    504
               L  +EI G+DL + +N Q        I+G   +TYT +KE G+      K+      ++G E
Sbjct:     969 LTKLEIKGKDLREIINAQISPVFGPDYSISG--FTYTWDKETGKAVDMKM-----ADGTE   1021

Query:     505 INPDAKYKLVINDFLFGGGDGFASFRNAKLLGAINP-----DTEVFMAYITDLEK        554
                I PDA Y L +N+F+      A ++    LLG  NP      D E + Y+   ++
Sbjct:    1022 IQPDATYTLTVNNFMATATG--AKYQPIGLLGK-NPVTGPEDLEATVEYVKSFDE       1073
``` bacterial outside --- Certainty = 0.0000 (Not Clear) <succ> bacterial cytoplasm --- Certainty = 0.0000 (Not Clear) <succ>

A related DNA sequence was identified in *S. pyogenes* <SEQ ID 1607> which encodes the amino acid sequence <SEQ ID 1608>. Analysis of this protein sequence reveals the following:

Possible site: 40
>>> Seems to have no N-terminal signal sequence
INTEGRAL      Likelihood = −4.67   Transmembrane 662-678 (661-679)
INTEGRAL      Likelihood = −2.02   Transmembrane 19-35 (18-35)
----- Final Results -----
  bacterial membrane --- Certainty = 0.2869 (Affirmative) <succ>

An alignment of the GAS and GBS proteins is shown below.

```
Identities = 415/688 (60%), Positives = 517/688 (74%), Gaps = 21/688 (3%)

Query:       1 MKKKIILKSSVLGLVAGTSIMFSSVFADQVGVQVIGVNDFHGALDNTGTANMPDGKVANA     60
               MKK  ILKSSVL ++    +++ + V ADQV VQ +GVNDFHGALDNTGTA   P GK+ NA
Sbjct:      14 MKKYFILKSSVLSILTSFTLLVTDVQADQVDVQFLGVNDFHGALDNTGTAYTPSGKIPNA    73

Query:      61 GTAAQLDAYMDDAQKDFKQTNPNGESIRVQAGDMVGASPANSGLLQDEPTVKNFNAMNVE    120
               GTAAQL  AYMDDA+ DFKQ N +G SIRVQAGDMVGASPANS LLQDEPTVK FN M  E
Sbjct:      74 GTAAQLGAYMDDAEIDFKQANQDGTSIRVQAGDMVGASPANSALLQDEPTVKVFNKMKFE   133

Query:     121 YGTLGNHEFDEGLAEYNRIVTGKAPAPDSNINNITKSYPHEAAKQEIVVANVIDKVNKQI    180
               YGTLGNHEFDEGL E+NRI+TG+AP P+S IN+ITK Y HEA+ Q IV+ANVIDK  K I
Sbjct:     134 YGTLGNHEFDEGLDEFNRIMTGQAPDPESTINDITKQYEHEASHQTIVIANVIDKKTKDI   193

Query:     181 PYNWKPYAIKNIPVNNKSVNVGFIGIVTKDIPNLVLRKNYEQYEFLDEAETIVKYAKELQ    240
               PY WKPYAIK+I +N+K V +GFIG+VT +IPNLVL++NYE Y+FLD AETI KYAKELQ
Sbjct:     194 PYGWKPYAIKDIAINDKIVKIGFIGVVTTEIPNLVLKQNYEHYQFLDVAETIAKYAKELQ   253

Query:     241 AKNVKAIVVLAHVPATSKNDIAEGEAAEMMKKVNQLFPENSVDIVFAGHNHQYTNGLVGK    300
                ++V AIVVLAHVPATSK+ +  E A +M+KVNQ++PE+S+DI+ FAGHNHQYTNG +GK
Sbjct:     254 EQHVHAIVVLAHVPATSKDGVVDHEMATVMEKVNQIYPEHSIDIIFAGHNHQYTNGTIGK   313

Query:     301 TRIVQALSQGKAYADVRGVLDTDTQDFIETPSAKVIAVAPGKKTGSADIQAIVDQANTIV    360
               TRIVQALSQGKAYADVRG LDTDT DFI+TPSA V+AVAPG KT ++DI+AI++ AN IV
Sbjct:     314 TRIVQALSQGKAYADVRGTLDTDTNDFIKTPSANVVAVAPGIKTENSDIKAIINHANDIV   373

Query:     361 KQVTEAKIGTAEVSVMITRSVDQDNVSPVGSLITEAQLAIARKSWPDIDFAMTNNGGIRA    420
               K VTE KIGTA  S  I+++ + D  SPVG+L T AQL IA+K++P +DFAMTNNGGIR+
Sbjct:     374 KTVTERKIGTATNSSTISKTENIDKESPVGNLATTAQLTIAKKTFPTVDFAMTNNGGIRS   433

Query:     421 DLLIKPDGTITWGAAQAVQPFGNILQVVEITGRDLYKALNEQYDQKQNFFLQIAGLRYTY    480
               DL++K  D  TITWGAAQAVQPFGNILQV+++TG+ +Y  LN+QYD+ Q +FLQ++GL YTY
Sbjct:     434 DLVVKNDRTITWGAAQAVQPFGNILQVIQMTGQHIYDVLNQQYDENQTYFLQMSGLTYTY   493

Query:     481 TDNKEGGEETPFKVVKAYKSNGEEINPDAKYKLVINDFLFGGGDGFASFRNAKLLGAINP    540
               TDN    +TPFK+VK  YK  NGEEIN      Y +V+NDFL+GGGDGF++F+  AKL+GAIN
Sbjct:     494 TDNDPKNSDTPFKIVKVYKDNGEEINLTTTYTVVVNDFLYGGGDGFSAFKKAKLIGAINT   553

Query:     541 DTEVFMAYITDLEKAGKKVSVPNNKPKIYVTMKMVNETITQNDGTHSIIKKLYLDRQGNI    600
               DTE F+ YIT+LE +GK V+          K YVT  + +  T    + G HSII K++  +R GN
Sbjct:     554 DTEAFITYITNLEASGKTVNATIKGVKNYVTSNLESSTKVNSAGKHSIISKVFRNRDGNT   613

Query:     601 VAQEIVSDTLNQTKSKSTKINPVTTIHKKQLHQFTAINPMRNYGKPSNSTTVKSKQLPKT    660
               V+ E++SD L  T++ +  T           +N   T+S    LP T
```

```
-continued
Sbjct:  614  VSSEVISDLLTSTENTNNSLGKEET--------------------TTNKNTISSSTLPIT  653

Query:  661  NSEYGQSFLMSVFG-VGLIGIALNTKKK                                  687
             Y  S +M++   + L G+    KK+
Sbjct:  654  GDNYKMSPIMTILALISLGGLNAFIKKR                                  681
```

Figure 268:
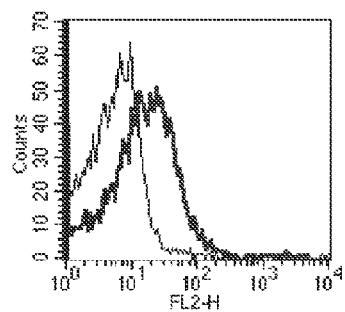

SEQ ID 6016 (GBS328) was expressed in *E. coli* as a His-fusion product. SDS-PAGE analysis of total cell extract is shown in FIG. 69 (lane 4; MW 73 kDa). The GBS328-His fusion product was purified (FIG. 213, lane 9) and used to immunise mice. The resulting antiserum was used for FACS (FIG. 268), which confirmed that the protein is immunoaccessible on GBS bacteria.

Based on this analysis, it was predicted that these proteins and their epitopes could be useful antigens for vaccines or diagnostics.

Example 1941

A DNA sequence (GBSx2050) was identified in *S. agalactiae* <SEQ ID 6017> which encodes the amino acid sequence <SEQ ID 6018>. This protein is predicted to be peptide deformylase (def-2). Analysis of this protein sequence reveals the following:

---

Possible site: 21
>>> Seems to have no N-terminal signal sequence
INTEGRAL    Likelihood = –1.70    Transmembrane 55-71 (55-74)
----- Final Results -----
   bacterial membrane --- Certainty = 0.1680 (Affirmative) <succ>
     bacterial outside --- Certainty = 0.0000 (Not Clear) <succ>
       bacterial cytoplasm --- Certainty = 0.0000 (Not Clear) <succ>

---

A related DNA sequence was identified in *S. pyogenes* <SEQ ID 6019> which encodes the amino acid sequence <SEQ ID 6020>. Analysis of this protein sequence reveals the following:

---

Possible site:45
>>> Seems to have no N-terminal signal sequence
INTEGRAL    Likelihood.= –3.61    Transmembrane 55-71 (55-73)
----- Final Results -----
   bacterial membrane --- Certainty = 0.2444 (Affirmative) <succ>
     bacterial outside --- Certainty = 0.0000 (Not Clear) <succ>
       bacterial cytoplasm --- Certainty = 0.0000 (Not Clear) <succ>

---

The protein has homology with the following sequences in the GENPEPT database.

```
>GP:CAB09662 GB:Z96934 peptide deformylase [Clostridium beijerinckii]
Identities = 71/136 (52%), Positives = 96/136 (70%)

Query:    1  MIKPIVRDTFFLQQKSQMASRADVSLAKDLQETLHANQNYCVGMAANMIGSLKRVIIINV    60
             MIKPIV+D   FL QKS+ A++ D+ +   DL +TL AN  +CVG+AANMIG   KR+++   V
Sbjct:    1  MIKPIVKDILFLGQKSEEATKNDMVVIDDLIDTLRANLEHCVGLAANMIGVKKRILVFTV    60

Query:   61  GITNLVMFNPVVVAKSDPYETEESCLSLVGCRSTQRYCHITISYRDINWKEQQIKLTDFP   120
             G    + M NPV++  K    PYETEESCLSL+G R T+RY  I  ++Y D N+ +++        F
Sbjct:   61  GNLIVPMINPVILKKEKPYETEESCLSLIGFRKTKRYETIEVTYLDRNFNKKKQVFNGFT   120

Query:  121  AQICQHELDHLEGILI                                              136
             AQI QHE+DH EGI+I
Sbjct:  121  AQIIQHEMDHFEGIII                                              136
```

An alignment of the GAS and GBS proteins is shown below.

```
             Identities = 77/136 (56%), Positives = 103/136 (75%)
             Query:  1    MIKPIVRDTFFLQQKSQMASRADVSLAKDLQETLHANQNYCVGMAANMIGSLKRVIIINV    60
                          MI+ I+ D F LQQK+Q+A + D+ + +DLQ+TL    +  C+GMAANMIGE  KR++I+++
             Sbjct:  1    MIREIITDHFLLQQKAQVAKKEDLWIGQDLQDTLAFYRQECLGMAANMIGEQKRIVIVSM    60

Query:  61   GITNLVMFNPVVVAKSDPYETEESCLELVGCRSTQRYCHITISYRDINWKEQQIKLTDFP   120
                          G   +LVMFNPV+V+K       Y+T+ESCLSL G R TQRY    IT+ Y D NW+ +++ LT
             Sbjct:  61   GFIDLVMENPVMVSKKGIYQTKESCLSLEGYRKTQRYDKITVEYLDHNWRPKRLSLTGLT   120

Query: 121   AQICQHELDHLEGILI                                              136
```

```
             AQICQHELDHLEGILI
Sbjct: 121   AQICQHELDHLEGILI                        136
```

Based on this analysis, it was predicted that these proteins and their epitopes could be useful antigens for vaccines or diagnostics.

Example 1942

A DNA sequence (GBSx2051) was identified in *S. agalactiae* <SEQ ID 6021> which encodes the amino acid sequence <SEQ ID 6022>. Analysis of this protein sequence reveals the following:

Possible site: 28
>>> Seems to have no N-terminal signal sequence
----- Final Results -----
   bacterial cytoplasm --- Certainty = 0.2880 (Affirmative) <succ>
      bacterial membrane --- Certainty = 0.0000 (Not Clear) <succ>
         bacterial outside --- Certainty = 0.0000 (Not Clear) <succ>

The protein has homology with the following sequences in the GENPEPT database.

Possible site: 58
>>> Seems to have no N-terminal signal sequence
INTEGRAL    Likelihood = −8.55    Transmembrane 61-77 (55-87)
INTEGRAL    Likelihood = −7.70    Transmembrane 177-193 (175-202)
INTEGRAL    Likelihood = −7.06    Transmembrane 99-115 (95-122)
INTEGRAL    Likelihood = −5.89    Transmembrane 42-58 (40-60)
INTEGRAL    Likelihood = −3.08    Transmembrane 160-176 (159-176)
INTEGRAL    Likelihood = −2.44    Transmembrane 124-140 (122-144)
----- Final Results -----
   bacterial membrane --- Certainty = 0.4418 (Affirmative) <succ>
      bacterial outside --- Certainty = 0.0000 (Not Clear) <succ>
         bacterial cytoplasm --- Certainty = 0.0000 (Not Clear) <succ>

A related GBS nucleic acid sequence <SEQ ID 9955> which encodes amino acid sequence <SEQ ID 9956> was also identified.

The protein has no significant homology with any sequences in the GENPEPT database.

No corresponding DNA sequence was identified in *S. pyogenes*.

```
>GP:BAB05820 GB:AP001514 NADP-specific glutamate dehydrogenase
[Bacillus halodurans]
Identities = 298/444 (67%), Positives = 362/444 (81%), Gaps = 2/444 (0%)
Query:   7   YVASVLEKVKKQNEHEEEFLQAVEEVFESLVPVFDKYPQYIEENLLERLVEPERVISFRV      66
             YV  V E VK++N +E EF QAV+EVF+SL+PV   K+PQY+++ +LER+VEPERVISFRV
Sbjct:  16   YVQHVYETVERRNPNEHEFHQAVKEVFDSLLPVLVKHPQYVKQAILERIVEPERVISFRV      75

Query:  67   PWVDDKGQVQVNRGYRVQFSSAIGPYKGGLRFHPTVTQSIVKFLGFEQIFKNSLTGLPIG     126
             PWVDD+G VQVNRG+RVQF+SA+GPYKGGLRFHP+V   SI+KFLGFEQIFKN+LTG PIG
Sbjct:  76   PWVDDQGNVQVNRGFRVQFNSALGPYKGGLRFHPSVNASIIKFLGFEQIFKNALTGQPIG     135

Query: 127   GGKGGSNFDPKGKSDNEVMRFTQSFMTELQKYIGPDLDVPAGDIGVGGREIGYLYGQYKR     186
             GGKGGS+FDPKGKSD E+MRF+QSFM+EL  YIGPD+DVPAGDIGVG +EIGY++GQYK+
Sbjct: 136   GGKGGSDFDPKGESDGEIMRFSQSFMSELSNYIGPDIDVPAGDIGVGAKEIGYMFGQYKK     195

Query: 187   L-NGYQNGVLTGKGLTYGGSLARTEATGYGAVYFAKEMLAARGQDLTGKVALVSGSGNVA     245
             + G++ GVLTGKG+ YGGSLAR EATGYG VYF +EM+    G    G   +VSGSGNV+
Sbjct: 196   MRGGFEAGVLTGKGIGYGGSLARKEATGYGTVYFVEEMIKDHGFSFAGSTVVVSGSGNVS     255

Query: 246   IYATEKLQELGATVVAVSDSSGYVYDPDGIDLETLKQIKEVERARIVEYTEKHPKANFTP     305
             IYA EK  +LGA VVA SDS GYVYD +GIDL+T+K++KEVER RI  +Y   +HP A++
Sbjct: 256   IYAMEKAMQLGAKVVACSDSGGYVYDKNGIDLQTVKRLKEVERKRISEYVNEHPHAHYVQ     315

Query: 306   ADQGSIWSIKADLAFPCATQNELDEEDAKLLVENGVLAVTEGANMPSTLGAIKVFQKAGV     365
                 G IWS+  D+A PCATQNELDE  A +L+ NGV AV EGANMPSTL A+  FQ+ GV
Sbjct: 316   GCSG-IWSVPCDIALPCATQNELDEAAATMLIANGVKAVGEGANMPSTLQAVHTFQEHGV     374

Query: 366   AFGPAKAANAGGVAVSALEMAQNSSRRAWTFEEVDQELQRIMKTIFVNASEAADEFGDSG     425
              F PAKAANAGGV+VSALEMAQNS+R AWTFEEVD +L  IMK I+  + +AA+  +  SG
Sbjct: 375   LFAPAKAANAGGVSVSALEMAQNSTRLAWTFEEVDAKLYEIMKNIYRESIKAAELYEASG     434

Query: 426   NLVLGANIAGFLKVAQAMSAQGIV                                        449
             NLV+GANIAGF+KVA AM + G+V
Sbjct: 435   NLVVGANIAGFVKVADAMISHGVV                                        458
```

No corresponding DNA sequence was identified in *S. pyogenes*.

Based on this analysis, it was predicted that this protein and its epitopes, could be useful antigens for vaccines or diagnostics.

Example 1943

A DNA sequence (GBSx2052) was identified in *S. agalactiae* <SEQ ID 6023> which encodes the amino acid sequence <SEQ ID 6024>. Analysis of this protein sequence reveals the following:

Based on this analysis, it was predicted that this protein and its epitopes, could be useful antigens for vaccines or diagnostics.

Example 1944

A DNA sequence (GBSx2053) was identified in *S. agalactiae* <SEQ ID 6025> which encodes the amino acid sequence <SEQ ID 6026>. This protein is predicted to be ABC transporter, ATP-binding protein (msbA). Analysis of this protein sequence reveals the following:

Possible site: 37
>>> Seems to have a cleavable N-term signal seq.
INTEGRAL    Likelihood = −10.72    Transmembrane 152-168 (147-192)
INTEGRAL    Likelihood = −5.47     Transmembrane 267-283 (264-288)
INTEGRAL    Likelihood = −4.30     Transmembrane 171-187 (169-192)
INTEGRAL    Likelihood = −2.13     Transmembrane 67-83 (67-83)
INTEGRAL    Likelihood = −0.32     Transmembrane 493-509 (493-509)
----- Final Results -----
    bacterial membrane --- Certainty = 0.5288 (Affirmative) <succ>
      bacterial outside --- Certainty = 0.0000 (Not Clear) <succ>
        bacterial cytoplasm --- Certainty = 0.0000 (Not Clear) <succ>

The protein has homology with the following sequences in the GENPEPT database.

```
>GP:CAB69752 GB:AL137187 putative ABC transporter [Streptomyces coelicolor A3(2)]

Identities = 269/611 (44%), Positives = 392/611 (64%), Gaps = 31/611 (5%)

Query:   9    RLWSYLTRYKATLFLAIFLKVLSSFMSILEPFILGLAITELTANLV--DMAKG-------      59
              RL S    +ATLF  +   V+S ++++ P ILG A   + A +V  DM  G
Sbjct:  27    RLVSQFRPERATLFTLLACVVVSVGLNVVGPKILGRATDLVFAGIVGRDMPSGATKEQVL    86

Query:  60    --------------------VSGAELNVPYIAGILIIYFFRGVFYELGSYGSNYFMTTVV    99
                                  V G  ++   + +L++       L  +  +       V
Sbjct:  87    ATMREHGDGNVADMLRSTDFVPGQGIDFGAVGEVLLLALATFAVAGLLMAVATRLVNRAV   146

Query: 100    QKSIRDIRHDLNRKINKVPVSYFDKHQFGDMLGRFTSDVETVSNALQQSFLQIINAFLSI   159
              +++  +R D+   K++++P+SYFDK Q  G++L R T+D++ +    LQQS  Q+IN+ L+I
Sbjct: 147    NRTMFRLREDVQTKLSRLPLSYFDKRQRGEVLSRATNDIDNIGQTLQQSMGQLINSLLTI   206

Query: 160    ILVVVMVLYLNVPLAMIIIACIPVTYFSAQAILKRSQPYFKEQAKILGELNGFVQEKLTG   219
              I V+ M+ Y++  LA++ +   +P+++    A   +  KRSQP F +Q   G+LN  ++E  TG
Sbjct: 207    IGVLAMMFYVSWILALVALVTVPLSFVVATRVGKRSQPQFVQQWRSTGQLNAHIEEMYTG   266

Query: 220    FNIIKLYGREEASSQEFRDITDNLRHVGFKASFISGIMMPVLNSISDFIYLIIAFVGGLQ   279
              +++K+++GR+E S+++F +   D L    GFKA  F SGIM P++     +S+   Y+++A VGGL+
Sbjct: 267    HALVKVFGRQEESAKQFAEQNDALYEAGFKAQFNSGIMQPLMMCVSNLNYVLVAVVGGLR   326

Query: 280    VIAGTLTIGNMQAFVQYVWQISQPVQTITQLAGVLQSAKSSLERIFEVLD-EEEEANQVT   338
              V +G L+IG++QAF+QY  Q S P+   +  +A ++QS  +S ER+FE+LD EE+ A+ +
Sbjct: 327    VASGQLSIGDVQAFIQYSRQFSMPLTQVASMANLVQSGVASAERVFELLDAEEEQSADPIP   386

Query: .339   EKLSHDLTGQVSFHGVDFHYSPDKPLIRDFNLDVEPGQMIAIVGPTGAGKTTLINLLMRF   398
                     DL  G+V       V F Y P+KPLI D +L VEPG  +AIVGPTGAGKTTL+NLLMRF
Sbjct: 387    GARPEDLRGRVELEHVSFRYDPEKPLIEDLSLKVEPGHTVAIVGPTGAGKTTLVNLLMRF   446

Query: 399    YDVSEGAITVDGHDIRHLSRQDFRQQFGMVLQDAWLYEGTIKENLRFG-NLEASDEDIVA   457
              Y+VS G IT+DG DI  +SR + R   GMVLQD WL+ GTI EN+ +G + E + ++I
Sbjct: 447    YEVSGGRITLDGVDIAKMSRDELRAGIGMVLQDTWLFGGTIAENIAYGASREVTRGEIEE   506

Query: 458    AAKAANVDHFIRTLPGGYNMVMNQESSNISLGQKQLLTIARALLADPKILILDEATSSVD   517
              AA+AA+ D F+RTLP GY+ V++  E + +S G+KQL+TIARA L+DP IL+LDEATSSVD
Sbjct: 507    AARAAHADRFVRTLPDGYDTVIDDEGTGVSAGEKQLITIARAFLSDPVILVLDEATSSVD   566

Query: 518    TRLELLIQKAMKKLMEGRTSFVIAHRLSTIQEADNILVLKDGQIIEQGNHQKLLADKGFY   577
              TR E+LIQKAM KL  GRTSFVIAHRLSTI++AD ILV++DG I+EQG H +LL   G Y
Sbjct: 567    TRTEVLIQKAMAKLAHGRTSFVIAHRLSTIRDADTILVMEDGAIVEQGAHTELLTADGAY   626

Query: 578    YELYNSQFSNS                                                   588
              ++LY +QF+ +
Sbjct: 627    ARLYKAQFAEA                                                   637
```

There is also homology to SEQ IDs 160 and 6546.

Based on this analysis, it was predicted that this protein and its epitopes, could be useful antigens for vaccines or diagnostics.

Example 1945

A DNA sequence (GBSx2054) was identified in *S. agalactiae* <SEQ ID 6027> which encodes the amino acid sequence <SEQ ID 6028>. Analysis of this protein sequence reveals the following:

Possible site: 37
>>> Seems to have a cleavable N-term signal seq.
INTEGRAL    Likelihood = −10.88    Transmembrane 242-258 (235-263)
INTEGRAL    Likelihood = −9.82     Transmembrane 159-175 (129-177)
INTEGRAL    Likelihood = −9.71     Transmembrane 52-68 (49-77)
INTEGRAL    Likelihood = −8.49     Transmembrane 134-150 (129-158)
INTEGRAL    Likelihood = −1.17     Transmembrane 272-288 (272-289)

-continued

----- Final Results -----
    bacterial membrane --- Certainty = 0.5352 (Affirmative) <succ>

The protein has homology with the following sequences in the GENPEPT database.

```
>GP:CAB69751 GB:AL137187 putative ABC transporter [Streptomyces
coelicolor A3(2)]
Identities = 226/565 (40%), Positives = 342/565 (60%), Gaps = 1/565 (0%)
Query:   6   SYLKRYPNWLWLDLLGAMLFVTVILGMPTALAGMIDNGVTKGDRTGVYLWTFIMFIFVVL     65
             +YL+ Y    + L +      L +PT  A +ID GV KGD    +  +M   +
Sbjct:   8   TYLRPYKKPIALLVALQFLQTCASLYLPTLNAHIIDEGVVKGDSGYILSYGALMIGISLA    67

Query:  66   GIIGRITMAYASSRLTTTMIRDMRNDMYAKLQEYSHHEYEQIGVSSLVTRMTSDTFVLMQ    125
             ++ I  + +R    + RD+R  ++ ++Q +S  E    G   SL+TR T+D   +
Sbjct:  68   QVVCNIGAVFYGARTAAALGRDVRGAVFDRVQSFSAREVGHFGAPSLITRTTNDVQQVQM    127

Query: 126   FAEMSLRLGLVTPMVMIFSVVMILITSPSLAWLVAVAMPLLVGVILYWAIKTKPLSERQQ    185
              A M+  L +   P++ +   +VM L      L+ ++    +P+l    +     K +PL   + Q
Sbjct: 128   LALMTFTLMVSAPIMCVGGIVMALGLDVPLSGVLLGVVPVLAICVTLIVRKLRPLFRKMQ    187

Query: 186   TMLDKINQYVRENLTGLRVVRAFARENFQSQKFQVANQRYTDTSTGLFKLTGLTEPLFVQ    245
                LD +N+ +RE +TG RV+RAF R+ ++ Q+F+ AN      T+ + G    L    L  P+ +
Sbjct: 188   VRLDTVNRVLREQITGNRVIRAFVRDEYEQQRFRKANTELTEVALGTGNLLALMFPVVMT    247

Query: 246   IIIAMIVAIVWFALDPLQRGAIKIGDLVAFIEYSFHALFSFLLFANLFTMYPRMVVSSHR    305
             ++     +A+VWF +   G ++IGDL AF+ Y   + S ++      +F M PR   V + R
Sbjct: 248   VVNLSSIAVVWFGAHRIDSGGMQIGDLTAFLAYLMQIVMSVMMATFMFMMVPRAEVCAER    307

Query: 306   IREVMDMPISINPNTEGVTDTKLKGHLEFDNVTFAYPGETESPVLHDISFKAKPGETIAF    365
             I+EV++   S+ P      VT+ +   GHLE       F YPG  E  PVL   I    A+PGET A
Sbjct: 308   IQEVLETESSVVPPVAPVTELRRHGHLEIREAGFRYPG-AEEPVLRHIDLVARPGETTAV    366

Query: 366   IGSTGSGKSSLVNLIPRFYDVTLGKILVDGVDVRDYNLKSLRQKIGFIPQKALLFTGTIG    425
             IGSTGSGKS+L+  L+PR  +D  T  G++LV+GVDVR   + K+L + +    +PQK    LF GT+
Sbjct: 367   IGSTGSGKSTLLGLVPRLFDATDGEVLVNGVDVRTVDPKTLAKVVSLVPQKPYLFAGTVA    426

Query: 426   ENLKYGKADATIDDLRQAVDISQAKEFIESHQEAFETHLAEGGSNLSGGQKQRLSIARAV    485
              NL+YG  DAT ++L  A+ ++QAKEF+  +   +   +A+GG+N+SGGQ+QRL+IAR +
Sbjct: 427   TNLRYGNPDATDEELWHALAVAQAKEFVSELEGGLDAPIAQGGTNVSGGQRQRLAIARTL    486

Query: 486   VKDPDLYIFDDSFSALDYKTDATLRARLKEVTGDSTVLIVAQRVGTIMDADQIIVLDEGE    545
             V+  P++Y+FDDSFSALDY TDA LRA L + T ++TV+IVAQRV TI DAD+I+VLDEG
Sbjct: 487   VQRPEIYLFDDSFSALDYATDAALRAELAQETAEATVVIVAQRVATIRDADRIVVLDEGR    546

Query: 546   IVGRGTHAQLIENNAIYREIAESQL    570
             +VG G H +L+ +N  YREI   SQL
Sbjct: 547   VVGVGRHHELMADNETYREIVLSQL    571
```

A related DNA sequence was identified in *S. pyogenes* <SEQ ID 4985> which encodes the amino acid sequence <SEQ ID 4986>. Analysis of this protein sequence reveals the following:

Possible site: 22
>>> Seems to have an uncleavable N-term signal seq
INTEGRAL     Likelihood = −16.24     Transmembrane 155-171 (145-176)
INTEGRAL     Likelihood = −7.48     Transmembrane 130-146 (122-150)
INTEGRAL     Likelihood = −5.04     Transmembrane 13-29 (12-30)
INTEGRAL     Likelihood = −5.04     Transmembrane 56-72 (52-75)
INTEGRAL     Likelihood = −4.14     Transmembrane 239-255 (238-259)
INTEGRAL     Likelihood = −1.70     Transmembrane 269-285 (269-288)
----- Final Results -----
   bacterial membrane --- Certainty = 0.7496 (Affirmative) <succ> bacterial outside --- Certainty = 0.0000 (Not Clear) <succ>
bacterial cytoplasm---Certainty = 0.0000 (Not Clear) <succ>

An alignment of the GAS and GBS proteins is shown below.

```
Identities = 175/511 (34%), Positives = 296/511 (57%), Gaps = 3/511 (0%)
Query:  59   MFIFVVLGIIGRITMAYASSRLTTTMIRDMRNDMYAKLQEYSHHEYEQIGVSSLVTRMTS    118
             + I  +LG++            ++++   +  DMR   K+Q++S+   E       +LV R+T+
Sbjct:  56   LLIIALLGLMSGAINTVLAAKIAQGVSADMREKTFRKIQDFSYANIEAFNAGNLVVRLTN    115

Query: 119   DTFVLMQFAEMSLRLGLVTPMVMIFSVVMILITSPSLAWLVAVAMPLLVGVILYVAIKTK    178
             D   +    M  ++      P++ I ++M + T P L W++  V + L+  ++     V  +
Sbjct: 116   DINQIQSLVMMMFQILFRLPILFIGAFIMAVQTFPQLWVIVVMVILIALIMGLVMRQMG    175

Query: 179   PLSERQQTMLDKINQYVRENLTGLRVVRAFARENFQSQKFQVANQRYTDTSTGLFKLTGL    238
```

```
                P    + Q ++DKIN+   +ENL G+RVV++F +E   Q   KF+  +       +  +      L
Sbjct: 176      PRFGKFQRLMDKINRIAKENLRGVRVVKSFVQEQQQYTKFKETSNDLLALNLSIGYGFSL      235

Query: 239      TEPLFVQIIIAMIVAIVWFALDPLQRGAIKIGDLVAFIEYSFHALFSFLLFANLFTMYPR      298
                 +P  + +     +       ++    IG++ +F+ Y      +FS ++  ++       R
Sbjct: 236      MQPALMLVSYLAVYVSINVVSTMVETDPTVIGNIASFMTYMMQIMFSIIVVGSMGMQVSR      295

Query: 299      MVVSSHRIREVMDMPISINPNTEGVTDTKLKGHLEFDNVTFAYPGETESPVLHDISFKAK      358
                    VS  RIR+++    ++     E   +  + G + FD+V+F YP + E P L   ISF  +
Sbjct: 296      AFVSMARIRQILSTEPAMTFENE--KEETISGSIVFDDVSFTYPNDDE-PTLKHISFAIE      352

Query: 359      PGETIAFIGSTGSGKSSLVNLIPRFYDVTLGKILVDGVDRDYNLKSLRQKIGFIPQKAL       418
                PG+ +  +G+TGSGKS+L   LIPR +D      G+IL+ G   ++   +  +LRQ  +  + QKA+
Sbjct: 353      PGQMVGIVGATGSGKSTLAQLIPRLFDPQDGQILLGGKPIKTLSQTTLRQSVSIVLQKAI      412

Query: 419      LFTGTIGENLKYGKADATIDDLRQAVDISQAKEFIESHQEAFETHLAEGGSNLSGGQKQR      478
                LF+GTI +NL+ G A A ID +++A   I+QAKEFI+        +E+ + E GSNLSGGQKQR
Sbjct: 413      LFSGTIADNLRQGSAKADIDAMQKAAQIAQAKEFIDRMDSRYESQVEERGSNLSGGQKQR      472

Query: 479      LSIARAVVKDPDLYIFDDSFSALDYKTDATLRARLKEVTGDSTVLIVAQRVGTIMDADQI      538
                LSIAR V+  P + I DDS SALD K++  ++   L        +T +IVAQ++ +++ AD+I
Sbjct: 473      LSIARGVINHPKILILDDSTSALDAKSEKRVQEALSHKLEGTTTVIVAQKISSVVKADKI      532

Query: 539      IVLDEGEIVGRGTHAQLIENNAIYREIAESQ                                      569
                +VLD+G+++G GTHA+L+ NNAIYREI E+Q
Sbjct: 533      LVLDQGQLIGEGTHAELVANNAIYREIYETQ                                      563
```

There is also homology to SEQ IDs 72 and 6552.

Based on this analysis, it was predicted that these proteins and their epitopes could be useful antigens for vaccines or diagnostics.

Example 1946

A DNA sequence (GBSx2055) was identified in *S. agalactiae* <SEQ ID 6029> which encodes the amino acid sequence <SEQ ID 6030>. Analysis of this protein sequence reveals the following:

Possible site: 24
>>> Seems to have no N-terminal signal sequence
----- Final Results -----
    bacterial cytoplasm--- Certainty = 0.2391 (Affirmative) <succ>
      bacterial membrane--- Certainty = 0.0000 (Not Clear) <succ>
        bacterial outside--- Certainty = 0.0000 (Not Clear) <succ>

The protein has homology with the following sequences in the GENPEPT database.

```
>GP:CAA51784 GB:X73368 ORF 18.3 [Salmonella typhimurium]
Identities = 58/162 (35%); Positives = 92/162 (55%), Gaps = 8/162 (4%)
Query:   1      MIIRPIIKNDDQAVAQLIRQSLRAYDL--DKPDTAYSDPHLDHLTSYYEKIEKSGFFVIE       58
                + +R I      D+ A+A++IRQ     Y L  DK  T  +DP+LD L   Y +    + ++V+E
Sbjct:   9      LTVRRITTADNAAIARVIRQVSAEYGLTADKGYTV-ADPNLDELYQVYSQ-PGAAYWVVE       66

Query:  59      ERDEIIGCGGFGPLKNL---IAEMQKVYIAERFRGKGLATDLVKMIEVEARKIGYRQLYL      115
                +    ++G GG   PL       I E+QK+Y        RG+GLA  L M    AR+ G+++ YL
Sbjct:  67      QNGCVVGGGGVAPLSCSEPDICELQKMYFLPVIRGQGLAKELALMALDHAREQGFKRCYL      126

Query: 116      ETASTLSRATAVYKEMGYCALSQPIANDQGHTAMDIWMIKDL                            157
                ET + L   A+Y+ +G+   +S+P+        GH ++  M+KDL
Sbjct: 127      ETTAFLREAIALYERLGFEHISEPL-GCTGHVDCEVRMLKDL                            167
```

No corresponding DNA sequence was identified in *S. pyogenes*.

Based on this analysis, it was predicted that this protein and its epitopes, could be useful antigens for vaccines or diagnostics.

Example 1947

A DNA sequence (GBSx2056) was identified in *S. agalactiae* <SEQ ID 6031> which encodes the amino acid sequence <SEQ ID 6032>. This protein is predicted to be ABC transporter. Analysis of this protein sequence reveals the following:

Possible site: 25
>>> Seems to have no N-terminal signal sequence
----- Final Results -----
    bacterial cytoplasm --- Certainty = 0.1738 (Affirmative) <succ>
      bacterial membrane --- Certainty = 0.0000 (Not Clear) <succ>
        bacterial outside --- Certainty = 0.0000 (Not Clear) <succ>

The protein has homology with the following sequences in the GENPEPT database.

```
>GP:CAB12566 GB:Z99108 similar to ABC transporter (ATP-binding
protein) [Bacillus subtilis]
Identities = 269/625 (43%), Positives = 397/625 (63%), Gaps = 11/625 (1%)
Query: 1    MSDFLVDGLTKSVGDKTVFSNVSFIIHSLDRIGIIGVNGTGKTTLLDVISGELGFDGDRS    60
            MS    + L K+ GDKT+F ++SF I   +RIG+IG NGTGK+TLL VI+G   +
Sbjct: 1    MSILKAENLYKTYGDKTLFDHISFHIEENERIGLIGPNGTGKSTLLKVIAGLESIE--EG    58

Query: 61   PFSSANDYKIAYLKQEPDFDDSQTILDTVLSSDLREMALIKEYELLLNHY-----EESKQ    115
            + +     ++ +L Q+P+    QT+L+ + S +    M  ++EYE  L        E +Q
Sbjct: 59   EITKSGSVQVEFLHQDPELPAGQTVLEHIYSGESAVMKTLREYEKALYELGKDPENEQRQ    118

Query: 116  SRLEKVMAEMDSLDAWSIESEVKTVLSKLGITDLQLSVGELSGGLRRRVQLAQVLLNDAD    175
                L    A+MD+ +AW   +  KTVLSKLG+ D+    V ELSGG ++RV +A+ L+  AD
Sbjct: 119  KHLLAAQAKMDANNAWDANTLAKTVLSKLGVNDVTKPVNELSGGQKKRVAIAKNLIQPAD    178

Query: 176  LLLLLDEPTNHLDIDTIAWLTNFLKNSKKTVLFITHDRYFLDNVATRIFELDKAQITEYQG    235
            LL+ LDEPTNHLD +TI WL  +L        V+ +THDRYFL+ V  RI+EL++ +  Y+G
Sbjct: 179  LLILDEPTNHLDNETIEWLEGYLSQYPGAVMLVTHDRYFLNRVTNRIYELERGSLYTYKG    238

Query: 236  NYQDYVRLRAEQDERDAASLHKKKQLYKQELAWMRTQPQARATKQQARINRFQNLKNDLH    295
            NY+  ++   RAE++  +        K++ L ++ELAW+R    +AR+TKQ+ARI+R +  LK
Sbjct: 239  NYEVFLEKRAEREAQAEQKETERQNLLRRELAWLRRGAKARSTKQKARIDRVETLKEQTG    298

Query: 296  QTSDTSDLEMTFETSRIGKKVINFENVSFSYPDKSILKDFNLLIQNKDRIGIVGDNGVGK    355
                S   S L+   +  R+GK+VI   ENV +Y  +  ++   FN L+     +RIGI+G NG+GK
Sbjct: 299  PQSSGS-LDFAIGSHRLGKQVIEAENVMIAYDGRMLVDRFNELVIPGERIGIIGPNGIGK    357

Query: 356  STLLNLIVQDLQPDSGNVSIGETIRVGYFSQQLHNMDGSKRVINYLQEVADEVKTSVGTT    415
            +TLLN +       PD G+++IG+T+R+GY++Q       M+G   +VI+Y++E A+ VKT+  G
Sbjct: 358  TTLLNALAGRHTPDGGDITIGQTVRIGYYTQDHSEMNGELKVIDYIKETAEVVKTADGDM    417

Query: 416  SVTE-LLEQFLFPRSTHGTQIAKLSGGEKKRLYLLKILIEKPNVLLLDEPTNDLDIATLT    474
                E +LE+FLFPRS   T I  KLSGGEK+RLYLL++L++++PNVL LDEPTNDLD  TL+
Sbjct: 418  ITAEQMLERFLFPRSMQQTYIRKLSGGEKRRLYLLQVLMQEPNVLFLDEPTNDLDTETLS    477

Query: 475  VLENFLQGFGGPVITVSHDRYFLDKVANKIIAFEDND-IREFFGNYTDYLDEKAFNEQNN    533
            VLE+++  F G VITVSHDRYFLD+V +++I  FE N   I   F G+Y+DY++E    +
Sbjct: 478  VLEDYIDQFPGVVITVSHDRYFLDRVVDRLIVFEGNGVISRFQGSYSDYMEESKAKKAAP    537

Query: 534  EVISKKESTKTSREKQSRKRMSYFEKQEWATIEDDIMILENTITRIENDMQTCGSDFTRL    593
            + + ++E T  +  K+ RK++SY ++ EW    IED I   LE       ++E D+    GSDF ++
Sbjct: 538  KP-AAEEKTAEAEPKKKRKKLSYKDQLEWDGIEDKIAQLEEKHEQLEADIAAAGSDFGKI    596

Query: 594  SDLQKELDAKNEALLEKYDRYEYLS                                      618
            +L  E      E L    DR+  LS
Sbjct: 597  QELMAEQAKTAEELEAAMDRWTELS                                      621
```

A related DNA sequence was identified in *S. pyogenes* <SEQ ID 6033> which encodes the amino acid sequence <SEQ ID 6034>. Analysis of this protein sequence reveals the following:

Possible site: 60
>>> Seems to have no N-terminal signal sequence

----- Final Results -----
  bacterial cytoplasm---Certainty = 0.2591 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

```
Identities = 467/624 (74%), Positives = 535/624 (84%), Gaps = 3/624 (0%)
Query: 1    MSDFLVDGLTKSVGDKTVFSNVSFIIHSLDRIGIIGVNGTGKTTLLDVISGELGFDGDRS    60
            MS FLV+ LTK+VGDKTVF ++SFIIH  DRIGIIGVNGTGKTTLLDV+SG LGFDGD S
Sbjct: 1    MSHFLVEKLTKTVGDKTVFQDISFIIHDFDRIGIIGVNGTGKTTLLDVLSGRLGFDGDHS    60

Query: 61   PFSSANDYKIAYLKQEPDFDDSQTILDTVLSSDLREMALIKEYELLLNHYEESKQSRLEK    120
            PFS ANDYKIAYL Q+P+F+D+ ++LDTVLS+D++  + LI++YELL   +Y E KQ  LE
Sbjct: 61   PFSKANDYKIAYLTQDPEFNDAASVLDTVLSADVKAIQLIRQYELLMANYTEDKQESLES    120

Query: 121  VMAEMDSLDAWSIESEVKTVLSKLGITDLQLSVGELSGGLRRRVQLAQVLLNDADLLLLD    180
            +M+EMD LDAWSIES+VKTVLSKLGITDL+  VG+LSGG RRRVQLAQVLL  ADLLLLD
Sbjct: 121  LMSEMDRLDAWSIESDVKTVLSKLGITDLEQKVGDLSGGMRRRVQLAQVLLGAADLLLLD    180

Query: 181  EPTNHLDIDTIAWLTNELKNSKKTVLFITHDRYFLDNVATRIFELDKAQITEYQGNYQDY    240
            EPTNHLDIDTIAWLT +LK +KKTVLFITHDRYFLD+VATRIFELDKA +TEYQGNYQDY
Sbjct: 181  EPTNHLDIDTIAWLTTYLKTAKKTVLFITHDRYFLDHVATRIFELDKAGLTEYQGNYQDY    240

Query: 241  VRLRAEQDERDAASLHKKKQLYKQELAWMRTQPQARATKQQARINREQNLKNDLHQTSDT    300
            VRL+AEQDERDAA+LHKKKQLYKQELAWMRTQPQARATKQQARINRF +LK ++HQ S
```

```
                              -continued
Sbjct: 241  VRLKAEQDERDAANLHKKKQLYKQELAWMRTQPQARATKQQARINRESDLKKEVHQDSSA   300

Query: 301  SDLEMTFETSRIGKKVINFENVSFSYPDKSILKDFNLLIQNKDRIGIVGDNGVGKSTLLN   360
                LEMTFETSRIGKKVI+FE++SF+Y D+ ++KDFNL+IQNKDRIGIVGDNGVGKSTLLN
Sbjct: 301  DKLEMTFETSRIGKKVIHFEDLSFAYGDRQLIKDFNLIIQNKDRIGIVGDNGVGKSTLLN   360

Query: 361  LIVQDLQPDSGNVSIGETIRVGYFSQQLHNMDGSKRVINYLQEVADEVKTSVGTTSVTEL   420
            +I  DL+P SG + IG+TIRVGYFSQQL +MD +KRVINYLQEVADEVKTSVGTTS++EL
Sbjct: 361  IINGDLKPTSGKLDIGDTIRVGYFSQQLKDMDETKRVINYLQEVADEVKTSVGTTSISEL   420

Query: 421  LEQFLFPRSTHGTQIAKLSGGEKKRLYLLKILIEKPNVLLLDEPTNDLDIATLTVLENFL   480
            LEQFLFPRS+HGT IAKLSGGEKKRLYLLK+LIEKPNVLLLDEPTNDLDIATL VLENFL
Sbjct: 421  LEQFLFPRSSHGTLIAKLSGGEKKRLYLLKLLIEKPNVLLLDEPTNDLDIATLKVLENFL   480

Query: 481  QGFGGPVITVSHDRYFLDKVANKIIAFEDNDIREFFGNYTDYLDEKAFNEQNNEVISKRE   540
                F GPVITVSHDRYFLDKVA KI+AFE+ DIR F+GNY+DYLDEK F ++  E    K
Sbjct: 481  ANFAGPVITVSHDRYFLDKVATKILAFEEGDIRVFYGNYSDYLDEKVFEKETVEADLAKT   540

Query: 541  STKTS---REKQSRKRMSYFEKQEWATIEDDIMILENTITRIENDMQTCGSDFTRLSDLQ   597
            +          +K+ RKRMSY EKQEWA IED I +E  I   IEN M T    SD+ +L+ LQ
Sbjct: 541  TVTEEVPLPQKEERKRMSYLEKQEWAQIEDKIATIEANIEEIENQMLTVVSDYGQLAQLQ   600

Query: 598  KELDAKNEALLEKYDRYEYLSELD                                      621
            KELD +N  LL  Y+R+EYLS LD
Sbjct: 601  KELDQRNNDLLLAYERFEYLSGLD                                      624
```

Based on this analysis, it was predicted that these proteins and their epitopes could be useful antigens for vaccines or diagnostics.

Example 1948

A DNA sequence (GBSx2057) was identified in *S. agalactiae* <SEQ ID 6035> which encodes the amino acid sequence <SEQ ID 6036>. This protein is predicted to be poly(a) polymerase (papS). Analysis of this protein sequence reveals the following:

Possible site: 14
>>> Seems to have no N-terminal signal sequence

----- Final Results -----
bacterial cytoplasm--- Certainty = 0.2658 (Affirmative) <succ>
bacterial membrane--- Certainty = 0.0000 (Not Clear) <succ>
bacterial outside--- Certainty = 0.0000 (Not Clear) <succ>

A related GBS nucleic acid sequence <SEQ ID 9957> which encodes amino acid sequence <SEQ ID 9958> was also identified.

The protein has homology with the following sequences in the GENPEPT database.

```
>GP:AAB38446 GB:L47709 poly(A) polymerase [Bacillus subtilis]
Identities = 157/395 (39%), Positives = 235/395 (58%), Gaps = 14/395 (3%)
Query:  11  FQKALPILKKIKKAGYEAYFVGGSVRDVLLDRPIHDVDIATSSYPEETKQIFKRTVDVGI    70
            F KALP+L+ + +AG++AYFVGG+VRD   + R I DVDIAT + P++ +++F+RTVDVG
Sbjct:   5  FIKALPVLRILIEAGHQAYFVGGAVRDSYMKRTIGDVDIATDAAPDQVERLFQRTVDVGK    64

Query:  71  EHGTVLVLEKGGEYEITTERTEEVYVDYRRPSQVNFVRSLEEDLKRRDFTVNAFALNEDG   130
            EHGT++VL +    YE+TTFRTE  YVD+RRPS+V F+ SLEEDLKRRD T+NA A+  DG
Sbjct:  65  EHGTIIVLWEDETYEVTTERTESDYVDERRPSEVQFISSLEEDLKRRDLTINAMAMTADG   124

Query: 131  EVIDLFHGLDDLDNHLLRAVGLASERFNEDALRIMRGLRFSASLNFDIETTTFEAMKKHA   190
            +V+D F G  D+D  ++R VG   +RF EDALR++R +RF + L F +    T EA+ K
Sbjct: 125  KVLDYFGGKKDIDQKVIRTVGKPEDRFQEDALRMLRAVRFMSQLGFTLSPETEEAIAKEK   184

Query: 191  SLLEKISVERSFIEFDKLLLAPYWRKGMLALIDSHAFNYLPCLKNRELQLSAFLSQLDKD   250
            SLL  +SVER  IEF+KLL     R+ + LI + + LP ++   L   +S +
Sbjct: 185  SLLSHVSVERKTIEFEKLLQGRASRQALQTLIQTRLYEELPGFYHKRENL---ISTSEFP   241

Query: 251  FLFETS-EQAWASLILSMEV--EHTKTFLKKWKTSTHFQKDVEHIVDVYRIREQMGLTKE   307
            F    TS E+ WA+L++++ +    FLK WK       K+  HI D +         L
Sbjct: 242  FFSLTSREELWAALLINLGIVLKDAPLFLKAWKLPGKVIKEAIHIADTF----GQSLDAM   297

Query: 308  HLYRYGKTIIKQAEGIRKAR-GLMVDFEKIEQLD---SELAIHDRHEIVVNGGTLIKKLG   363
            +YR GK + A   I +R   +D +K++ +      L I  ++ + G L+
Sbjct: 298  TMYRAGKEALLSAAKISQLRQNEKLDEKKLKDIQYAYQNLPIKSLKDLDITGKDLLALRN   357

Query: 364  IKPGPQMGDIISQIELAIVLGQLINEEEAILHFVK                           398
              G  + + +  IE A+V G+L N+++  I   ++K
Sbjct: 358  RPAGKWVSEELQWIEQAVVTGKLSNQKKHIEEWLK                           392
```

A related DNA sequence was identified in *S. pyogenes* <SEQ ID 6037> which encodes the amino acid sequence <SEQ ID 6038>. Analysis of this protein sequence reveals the following:

```
Possible site: 13
>>> Seems to have no N-terminal signal sequence
----- Final Results -----
  bacterial cytoplasm---Certainty = 0.2023 (Affirmative) <succ>
    bacterial membrane --- Certainty = 0.0000 (Not Clear) <succ>
      bacterial outside --- Certainty = 0.0000 (Not Clear) <succ>
```

An alignment of the GAS and GBS proteins is shown below.

```
Identities = 256/400 (64%), Positives = 312/400 (78%)
Query: 2     MRLNYLPSEFQKALPILKKIKKAGYEAYFVGGSVRDVLLDRPIHDVDIATSSYPEETKQI    61
             M+L  +PSEFQKALPIL KIK+AGYEAYFVGGSVRDVLL+RPIHDVDIATSSYPEETK I
Sbjct: 1     MKLMTMPSEFQKALPILTKIKEAGYEAYFVGGSVRDVLLERPIHDVDIATSSYPEETKAI    60

Query: 62    FKRTVDVGIEHGTVLVLEKGGEYEITTFRTEEVYVDYRRPSQVNFVRSLEEDLKRRDFTV    121
             F RTVDVGIEHGTVLVLE GGEYEITTFRTE++YVDYRRPSQV+FVRSLEEDLKRRDFTV
Sbjct: 61    FNRTVDVGIEHGTVLVLENGGEYEITTFRTEDIYVDYRRPSQVSFVRSLEEDLKRRDFTV    120

Query: 122   NAFALNEDGEVIDLFHGLDDLDNHLLRAVGLASERFNEDALRIMRGLRFSASLNFDIETT    181
             NA AL+E+G+VID F GL DL    LRAVG A ERF EDALRIMRG RF+ASL+FDIE
Sbjct: 121   NALALDENGQVIDKFRGLIDLKQKRLRAVGKAEERFEEDALRIMRGFRFAASLDFDIEAI    180

Query: 182   TFEAMKKHASLLEKISVERSFIEFDKLLLAPYWRKGMLALIDSHAFNYLPCLKNRELQLS    241
             TFEAM+ H+ LLEKISVERSF EFDKLL+AP+WRKG+ A+I   A++YLP LK +E  L+
Sbjct: 181   TFEAMRSHSPLLEKISVERSFIEFDKLLMAPHWRKGISAMIACQAYDYLPGLKQQEAGLN    240

Query: 242   AFLSQLDKDFLFETSEQAWASLILSMEVEHTKTFLKKWKTSTHFQKDVEHIVDVYRIREQ    301
             + L +F F    QAWA +++S+ +E  K+FLK WKTS   FQ+ V  ++  +YRIR++
Sbjct: 241   HLIVSLKDNFTFSDYHQAWAYVMISLAIEDPKSFLKAWKTSNDFQRYVTKLIALYRIRQE    300

Query: 302   MGLTKEHLYRYGKTIIKQAEGIRKARGLMVDFEKIEQLDSELAIHDRHEIVVNGGILIKK    361
                 K  +Y+YGK +    E +RKA+ L VD ++I   LD   L IHD+H+IV+NG   LIK
Sbjct: 301   RSFEKLDIYQYGKKMASLVEDLRKAQSLSVDMDRINTLDQALVIHDKHDIVLNGSHLIKD    360

Query: 362   LGIKPGPQMGDIISQIELAIVLGQLINEEEAILHFVKQYL                      401
             G+K GPQ+G ++ ++ELAIV G+L N+   I   FV++ L
Sbjct: 361   FGMKSGPOLGLMLEKVELAIVEGRLDNDFTTIEAFVREEL                      400
```

Based on this analysis, it was predicted that these proteins and their epitopes could be useful antigens for vaccines or diagnostics.

Example 1949

A DNA sequence (GBSx2058) was identified in *S. agalactiae* <SEQ ID 6039> which encodes the amino acid sequence <SEQ ID 6040>. Analysis of this protein sequence reveals the following:

```
Possible site: 13
>>> Seems to have no N-terminal signal sequence
----- Final Results -----
  bacterial cytoplasm---Certainty = 0.2939 (Affirmative) <succ>
    bacterial membrane---certainty = 0.0000 (Not Clear) <succ>
      bacterial outside --- Certainty = 0.0000 (Not Clear) <succ>
```

The protein has homology with the following sequences in the GENPEPT database.

```
>GP:BAB07346 GB:AP001519 unknown conserved protein [Bacillus halodurans]
Identities = 94/274 (340), Positives = 153/274 (55%), Gaps = 2/274 (0%)
Query: 2     KLALITDTSAYLPEAIENHEDVYVLDIPIIIDGKTYIEGQNLTLDQYYDKLAASKELPKT    61
             K+A++TD++AYL        V V+ + ++    + Y E   L+    +Y+KL   ++LP T
Sbjct: 3     KIAIVTDSTAYLGPKRAKELGVIVVPLSVVFGEEAYQEEVELSSADFYEKLKHEEKLPTT    62
```

```
Query:  62   SQPSLAELDDLLCQLEKEGYTHVLGLFIAAGISGFWQNIQFLIEEHPNLTIAFPDTKITS        121
             SQP++    +   +L KEG+  V+ + +++ ISG +Q+          + +   D+ I+
Sbjct:  63   SQPAVGLFVETFERLAKEGFEVVISIHLSSKISGTYQSALTAGSMVEGIEVIGYDSGISC        122

Query: 122   APQGNLVRNALMCSREGMDFDVIVNKIQSQIEKIEGFIVVNDLNHLVKGGRLSNGSAIIG        181
                PQ N V A    +EG D   I++ +     ++       VV+DL+HL +GGRL+    ++G
Sbjct: 123   EPQANFVAEAAKLVKEGADPQTIIDHLDEVKKRTNALFVVHDLSHLRGGRLNAAQLVVG        182

Query: 182   NLLSIKPVLHFNEEGKIVVYEKVRTEKKALKRLAEI-VKEMTADGEYDIAIIHSRAQDKA        240
             +LL IKP+LHF E+G IV  EKVRTEKKA  R+ E+  +E ++         +IH+  D A
Sbjct: 183   SLLKIKPILHF-EDGSIVPLEKVRTEKKAWARVKELFAEEASSASSVKATVIHANRLDGA        241

Query: 241   EQLYNLLAKAGLKDDLEIVSFGGVIATHLGEGAV                               274
             E+L + +         D+ I  FG VI THLGEG++
Sbjct: 242   EKLADEIRSQFSHVDVSISHFGPVIGTHLGEGSI                               275
```

Based on this analysis, it was predicted that these proteins and their epitopes could be useful antigens for vaccines or diagnostics.

Example 1950

A DNA sequence (GBSx2059) was identified in *S. agalactiae* <SEQ ID 6043> which encodes the amino acid sequence <SEQ ID 6044>. Analysis of this protein sequence reveals the following:

Possible site: 46
>>> Seems to have no N-terminal signal sequence
INTEGRAL     Likelihood = −1.59    Transmembrane 51-67 (50-67)
----- Final Results -----
    bacterial membrane --- Certainty = 0.1638 (Affirmative) <succ>
      bacterial outside --- Certainty = 0.0000 (Not Clear) <succ>
      bacterial cytoplasm --- Certainty = 0.0000 (Not Clear) <succ>

The protein has no significant homology with any sequences in the GENPEPT database.

A related DNA sequence was identified in *S. pyogenes* <SEQ ID 6045> which encodes the amino acid sequence <SEQ ID 6046>. Analysis of this protein sequence reveals the following:

```
Identities = 181/281 (64%), Positives = 233/281 (82%)
Query:   1   MKLALITDTSAYLPEATENHEDVYVLDIPIIIDGKTYIEGQNLTLDQYYDKLAASKELPK         60
             MKLA+ITD++A LP   ++  + ++ LDIP+IID +TY EG+NL++D +Y K+A S+ LPK
Sbjct:   1   MKLAVITDSTATLPTDLKQDKAIFSLDIPVIIDDETYFEGRNLSIDDFYQKMADSQNLPK         60

Query:  61   TSQPSLAELDDLLCQLEKEGYTHVLGLFIAAGISGFWQNIQFLIEEHPNLTIAFPDTKIT        120
             TSQPSL+ELD+LL    L   +GYTHV+GLF+A  GISGFWQNIQFL  EEHP + +AFPD+KIT
Sbjct:  61   TSQPSLSELDNLLGLLSSKGYTHVIGLFLAGGISGFWQNIQFLAEEHPEIEMAFPDSKIT        120

Query: 121   SAPQGNLVRNALMCSREGMDFDVIVNKIQSQIEKIEGFIVVNDLNHLVKGGRLSNGSAII        180
             SAP G++V+N L  SR+GM F  I+NK+Q QI+        FI+V+DLNHLVKGGRLSNGSA++
Sbjct: 121   SAPLGSMVKNVLDWSRQGMTFQAILNKLQEQIDGTTAFIMVDDLNHLVKGGRLSNGSALL        180

Query: 181   GNLLSIKPVLHFNEEGKIVVYEKVRTEKKALKRLAEIVKEMTADGEYDIAIIHSRAQDKA        240
             GNLLSIKP+L F+EEGKIVVYEKVRTEKKA+KRL EI+  ++ ADG+Y++ IIHS+AQDKA
Sbjct: 181   GNLLSIKPILRFDEEGKIVVYEKVRTEKKAMKRLVEILNDLIADGQYNVFIIHSKAQDKA        240

Query: 241   EQLYNLLAKAGLKDDLEIVSFGGVIATHLGEGAVAFGITPK                        281
             +  L  LL   +G + D+E V FG VIATHLGEGA+AFG+TP+
Sbjct: 241   DYLKRLLQDSGYQYDIEEVHFGAVIATHLGEGAIAFGVTPR                        281
```

Possible site: 61
>>> Seems to have no N-terminal signal sequence
INTEGRAL     Likelihood = −3.19    Transmembrane 50-66 (49-67)
----- Final Results -----
    bacterial membrane --- Certainty = 0.2275 (Affirmative) <succ>
      bacterial outside --- Certainty = 0.0000 (Not Clear) <succ>
      bacterial cytoplasm --- Certainty = 0.0000 (Not Clear) <succ>

The protein has no significant homology with any sequences in the GENPEPT database.

An alignment of the GAS and GBS proteins is shown below.

```
Identities = 94/126 (74%), Positives = 115/126 (90%)
Query:   1   MEVIREQEFVNQYHYDARNLEWEEENGTPKTNFEVTFQLANRDEAAKVTSIVAVLQFVIV    60
             M+++RE+EFVNQYHYDARNLEWE+ENGTP+TNFEVTFQL ++DE +K T IV+VLQFVIV
Sbjct:   1   MQLVREKEFVNQYHYDARNLEWERENGTPETNFEVTFQLIDKDEQQKETVIVSVLQFVIV    60

Query:  61   RDEFVISGVISQMAHIQGRLINEPSEFSQDEVENLAAPLLEIVKRLTYEVTEIALDRPGV   120
             ++EFVISGVISQM  I  RL+++PSEF+Q+EVE+LAAPLL++VKALTYEVTEIALDRPG+
Sbjct:  61   KEEFVISGVISQMVRILDRLVDKPSEFTQEEVESLAAPLLDMVKRLTYEVTEIALDRPGI   120

Query: 121   TLEFNS                                                        126
             LEF +
Sbjct: 121   HLEFKN                                                        126
```

SEQ ID 6044 (GBS416) was expressed in *E. coli* as a His-fusion product. SDS-PAGE analysis of total cell extract is shown in FIG. 79 (lane 4; MW 17.5 kDa).

GBS416-His was purified as shown in FIG. 214, lane 7.

Based on this analysis, it was predicted that these proteins and their epitopes could be useful antigens for vaccines or diagnostics.

Example 1951

A DNA sequence (GBSx2060) was identified in *S. agalactiae* <SEQ ID 6047> which encodes the amino acid sequence <SEQ ID 6048>. Analysis of this protein sequence reveals the following:

Possible site: 36
>>> Seems to have no N-terminal signal sequence
----- Final Results -----
  bacterial cytoplasm --- Certainty = 0.3875 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes could be useful antigens for vaccines or diagnostics.

Example 1952

A DNA sequence (GBSx2061) was identified in *S. agalactiae* <SEQ ID 6049> which encodes the amino acid sequence <SEQ ID 6050>. Analysis of this protein sequence reveals the following:

Possible site: 17
>>> Seems to have an uncleavable N-term signal seq

----- Final Results -----
  bacterial membrane --- Certainty = 0.0000 (Not Clear) <succ>
    bacterial outside --- Certainty = 0.0000 (Not Clear) <succ>
      bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1953

A DNA sequence (GBSx2062) was identified in *S. agalactiae* <SEQ ID 6051> which encodes the amino acid sequence <SEQ ID 6052>. This protein is predicted to be PTS system, fructose-specific enzyme II, BC component (fruA-1). Analysis of this protein sequence reveals the following:

Possible site: 23
>>> Seems to have no N-terminal signal sequence
INTEGRAL    Likelihood = -10.56    Transmembrane 630-646 (618-653)
INTEGRAL    Likelihood = -7.43     Transmembrane 307-323 (303-331)
INTEGRAL    Likelihood = -7.01     Transmembrane 415-431 (412-435)
INTEGRAL    Likelihood = -7.01     Transmembrane 448-464 (444-474)
INTEGRAL    Likelihood = -3.72     Transmembrane 595-611 (591-612)
INTEGRAL    Likelihood = -3.61     Transmembrane 530-546 (529-553)
INTEGRAL    Likelihood = -2.39     Transmembrane 350-366 (350-371)
INTEGRAL    Likelihood = -1.70     Transmembrane 486-502 (486-506)
INTEGRAL    Likelihood = -1.49     Transmembrane 376-392 (376-392)
----- Final Results -----
  bacterial membrane --- Certainty = 0.5225 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 9959> which encodes amino acid sequence <SEQ ID 9960> was also identified.

The protein has homology with the following sequences in the GENPEPT database.

```
>GP:BAB04547 GB:AP001510 PTS system, fructose-specific enzyme II, BC
component [Bacillus halodurans]
Identities = 320/659 (48%), Positives = 438/659 (65%), Gaps = 46/659 (6%)
Query:   1   MKIQDLLKKEVMIMDLKATSKEAAIDEMITKLVDTGVVTNFAIFKDGIMKREAQTSTGLG    60
             +KI +LLKK+ M+++L+A SKEA IDE++  L   G + +   FK  I++RE+Q++TG+G
Sbjct:   2   LKISELLKKDTMVLNLRAASKEAVIDELVRTLDKAGRLNDAQAFKRAILERESQSTTGVG    61

Query:  61   DGIAMPHSENAAVKEATVLFAESASGVDYEALDGQPIDLFFMIAAPDGANDTHLAALAEL   120
             +GIA+PH+K AAVK+  + F +S +G+DYE+LDGQP+ LFFMIAA +GAN+ HL   L+ L
Sbjct:  62   EGIAIPHAKTAAVKQPAIAFGRSDAGIDYESLDGQPSHLFFMIAASEGANNEHLETLSRL   121
```

```
Query:  121  SKYLLKEGFADQLRQAKTPDDIIATFDSNSISQETVAPQTVQSTSKGSDYIVAVTACTTG   180
             S +L+ E F    L +A++ D+I+A D    +E        +G + ++AVT C TG
Sbjct:  122  STFLMDETFRSTLMKAQSEDEILAAID----KKEAETAGEAEEKQEGYE-LLAVTGCPTG   176

Query:  181  IAHTYMAEEALKKKAAEMGVGIKVETNGASGVGNKLTSSDIARAKGVIIAADKAVEMDRF   240
             IAHTYMA + LK KA E+GV IKVETNG+ GV N+LT +I+ AK +I+AAD  VEMDRF
Sbjct:  177  IAHTYMAADNLKSKAQELGVSIKVETNGSGGVENRLTDEEISAAKAIIVAADTKVEMDRF   236

Query:  241  DGKPLVSRPVADGIKKSEDLINIILDNKAQTYHAKNQNDKQSGESDGKSGLGS---AFYK   297
                GKP++  PV DGI++ ++LI+  L  KA Y   +   Q+   DG +G G     FYK
Sbjct:  237  HGKPVIQVPVTDGIRRPKELIDQALAGKAPVY----EGGAQASGEDGSAGGGRPKLGFYK   292

Query:  298  HLMGGVSQMLPFVIGGGIMIAIAFLFDNILGVPKDQLSNLGSYHEIAALFKNIGGA-AFA   356
             HLM GVS MLPFV+GGGI+IAI+F+F     P D     SYH  A +   IGG  AF
Sbjct:  293  HLMNGVSNMLPFVVGGGILIAISFMFGIKAFDPSDP-----SYHPFAEMLMTIGGGNAFG   347

Query:  357  FMLPVLAGYIAYSIAEKPGLVAGFVAGSIASSGLAFGKVPFAEGGKATLALAGVPSGFLG   416
                M+PVLA +IA SIA++PG  AG + G IAS+G A                   GFLG
Sbjct:  348  LMIPVLAAFIAMSIADRPGFAAGMIGGLIASTGEA--------------------GFLG   386

Query:  417  ALVGGFLAGGVILLLRKLLSGLPKSLEGIKSILLYPLLGVLITGFLMLLVNIPMAAINTA   476
              L+ GFLAG V L ++K+L+ LP++L+GIK+IL YP+ + ITG +ML++  P+AA NT
Sbjct:  387  GLIAGFLAGYVALGVKKVLANLPQTLDGIKTILFYPVFNIFITGMIMLVIVGPLAAFNTG   446

Query:  477  LNTFLQGLSGSSAVLMGLLVGGMMAVDMGGPVNKAAYVFGTGTLAATVANGGSVVMAAVM   536
             L +L +  ++ V++G+++GGMMAVDMGGP+NKAA+ FG +     A    G      AAVM
Sbjct:  447  LQDWLGSMGTANMVILGVILGGMMAVDMGGPINKAAFTFGIAMIDA----GNFGPHAAVM   502

Query:  537  AGGMVPPLAVFVATLLFKDKFNNEERQSGLTNIVMGLSFITEGAIPFGAADPARAIPSFI   596
             AGGMVPPL +  +AT LFK  KF  +ER++G TN ++G SFITEGAIPF AADP R IPS I
Sbjct:  503  AGGMVPPLGIALATTLFKKKFTKQEREAGKTNYILGASFITEGAIPFAAADPGRVIPSII   562

Query:  597  VGSALTGALVGLAGIKLMAPHGGIFVI---ALTSNPLLYILFILIGAVVSGVLFGLFRK   652
             VGSA  G L  L +  L APHGG FVI    + +NPLLY++ I+ G++V+ +L G ++K
Sbjct:  563  VGSAFAGGLTALFNVTLSAPHGGAFVIFIGNIVNNPLLYLVAIIAGSIVTALLLGFWKK   621
```

A related DNA sequence was identified in *S. pyogenes* <SEQ ID 6053> which encodes the amino acid sequence <SEQ ID 6054>. Analysis of this protein sequence reveals the following:

Possible site: 18
>>> Seems to have no N-terminal signal sequence
INTEGRAL    Likelihood = −10.77    Transmembrane 624-640 (612-646)
INTEGRAL    Likelihood = −7.59     Transmembrane 301-317 (297-321)
INTEGRAL    Likelihood = −6.85     Transmembrane 442-458 (439-468)
INTEGRAL    Likelihood = −5.95     Transmembrane 409-425 (406-426)

-continued

INTEGRAL    Likelihood = −3.61    Transmembrane 524-540 (523-547)
INTEGRAL    Likelihood = −2.50    Transmembrane 337-353 (337-353)
INTEGRAL    Likelihood = −2.44    Transmembrane 589-605 (589-605)
INTEGRAL    Likelihood = −1.70    Transmembrane 480-496 (480-500)
INTEGRAL    Likelihood = −1.44    Transmembrane 370-386 (370-386)
----- Final Results -----
  bacterial membrane --- Certainty = 0.5310 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP:BAB04547 GB:AP001510 PTS system, fructose-specific enzyme II, BC
component [Bacillus halodurans]
Identities = 322/659 (48%), Positives = 431/659 (64%), Gaps = 48/659 (7%)
Query:    1  MKIQDLLRKDIMILDLQAISKEVAIDEMITKLVEKDIVHDFDVFKKSIMTREEQTSTGLG    60
             +KI +LL+KD M+L+L+A SKE  IDE++  L +   ++D   FK++I+ RE Q++TG+G
Sbjct:    2  LKISELLKKDTMVLNLRAASKEAVIDELVRTLDKAGRLNDAQAFKRAILERESQSTTGVG    61

Query:   61  DGIAMPHSKNIVVDKPAVLFAKSNKGVDYKALDGQPTDLFFMIAAPQGANDTHLAALAEL   120
             +GIA+PH+K  V +PA+ F +S+ G+DY++LDGQP+ LFFMIAA +GAN+ HL  L+ L
Sbjct:   62  EGIAIPHAKTAAVKQPAIAFGRSDAGIDYESLDGQPSHLFFMIAASEGANNEHLETLSRL   121

Query:  121  SQYLLKDGFADKLRAAATPEAVIAVFD--EASTAKEEVVAPTSGQDFIVAVTACPTGIAH   178
             S +L+ + F   L A + ++A  D  EA TA E      +  ++AVT CPTGIAH
Sbjct:  122  STFLMDETFRSTLMKAQSEDEILAAIDKKEAETAGEAEEKQEGYE--LLAVTGCPTGIAH   179

Query:  179  TYMAEEALKKQAAEMGVAIKVETNGASGVANRLTAEDIQRAKGVIVAADKAVEMDRFDGK   238
             TYMA + LK +A E+GV+IKVETNG+ GV NRLT E+I  AK +IVAAA  VEMDRF GK
Sbjct:  180  TYMAADNLKSKAQELGVSIKVETNGSGGVKNRLTDEEISAAKAIIVAADTKVEMDRFHGK   239

Query:  239  QFIARPVADGIKKSQELISLILNNEGNTYHAKNGKSETAVSTEKTSLGG-----AFYKHL   293
                I   PV DGI++ +ELI L + + +NTY   +   S   E  SLGG     AFYKHL
Sbjct:  240  PVIQVPVTDGIRRPKELIDQALAGKAPVY-----EGGAQASGEDGSAGGGRPKLGFYKHL   294

Query:  294  MGGVSQMLPFVIGGGIMIALAFLLDNMLGVPNDQLGSLGSYHEIAAIFMNIGGA-AFSFM   352
             M GVS MLPFV+GGGI+IA+ F+ +     P+D     SYH  A +  +IGG  AF  M
```

-continued

```
Sbjct: 295  MNGVSNMLPFVVGGGILIAISFMFGIKAFDPSDP-----SYHPFAEMLMTIGGGNAFGLM  349

Query: 353  LPVLAGYIAYSIAEKPGLVAGFVAGAIASNGLAFGKVPFAAGGEVSLGLTGVPSGFLGAL  412
            +PVLA +IA SIA++PG  AG + G IAS G A                     GFLG L
Sbjct: 350  IPVLAAFIAMSIADRPGFAAGMIGGLIASTGEA--------------------GFLGGL  388

Query: 413  VGGFLAGGVILALRKLLAGLPRSLEGVKSILLYPLLGVLTGFLMLFVNIPMAAINTALN  472
            + GFLAG V L ++K+LA LP++L+G+K+IL YP+ + +TG +ML + P+AA NT L
Sbjct: 389  IAGFLAGYVALGVKKVLANLPQTLDGIKTILFYPVFNIFITGMIMLVIVGPLAAFNTGLQ  448

Query: 473  DFLQGLSGSSAVLMGLLVGGMMAVDMGGPVNKAAYVFGTGTLAATVANGGSVVMAAVMAG  532
            D+L +  ++ V++G+++GGMMAVDMGGP+NKAA+ FG    + A G    AAVMAG
Sbjct: 449  DWLGSMGTANMVILGVILGGMMAVDMGGPINKAAFTFGIAMIDA----GNFGPHAAVMAG  504

Query: 533  GMVPPLAVFVATLLFKDKFTKEERESGLTNIVMGLSFITEGAIPFGAADPARAIPSFIAG  592
            GMVPPL +  +AT LFK KFTK+ERE+G TN ++G SFITEGAIPF AADP R IPS I G
Sbjct: 505  GMVPPLGIALATTLFKKKFTKQEREAGKTNYILGASFITEGAIPFAAADPGRVIPSIIVG  564

Query: 593  SALTGALVGLAGIKLMAPHGGIFVI---ALTSNPILYLVFVVIGALVSGILFGALRKKA  648
            SA  G L  L  + L APHGG FVI    + +NP+LYLV ++ G++V+ +l G +K A
Sbjct: 565  SAFAGGLTALFNVTLSAPHGGAFVIFIGNIVNNPLLYLVAIIAGSIVTALLLGFWKKDA  623
```

An alignment of the GAS and GBS proteins is shown below.[20]

```
Identities = 526/652 (80%), Positives = 581/652 (88%), Gaps = 6/652 (0%)
Query:   1  MKIQDLLKKEVMIMDLKATSKEAAIDEMITKLVDTGVVTNFAIFKDGIMKREAQTSTGLG   60
            MKIQDLL+K++MI+DL+A SKE AIDEMITKLV+  +V +F +FK  IM RE QTSTGLG
Sbjct:   1  MKIQDLLRKDIMILDLQAISKEVAIDEMITKLVEKDIVHDFDVFKKSIMTREEQTSTGLG   60

Query:  61  DGIAMPHSKRAAVKEATVLFAKSASGVDYEALDGQPTDLFFMIAAPDGANDTHLAALAEL  120
            DGIAMPHSKN V + VLFAKS  GVDY+ALDGQPTDLFFMIAAP GANDTHLAALAEL
Sbjct:  61  DGIAMPHSKNIVVDKPAVLFAKSNKGVDYKALDGQPTDLFFMIAAPQGANDTHLAALAEL  120

Query: 121  SKYLLKEGFADQLRQAKTPDDIIATFDSNSISQETVAPQTVQSTSKGSDYIVAVTACTTG  180
            S+YLLK+GFAD+LR A TP+ +IA FD S ++E V  T        G D+IVAVTAC TG
Sbjct: 121  SQYLLKDGFADKLRAAATPEAVIAVFDEASTAKEEVVAPT-----SGQDFIVAVTACPTG  175

Query: 181  IAHTYMAEEALKKKAAEMGVGIKVETNGASGVGNKLTSSDIARAKGVIIAADKAVEMDRF  240
            IAHTYMAEEALKK+AAEMGV IKVETNGASGV N+LT+ DI RAKGVI+AADKAVEMDRF
Sbjct: 176  IAHTYMAEEALKKQAAEMGVAIKVETNGASGVANRLTAEDIQRAKGVIVAADKAVEMDRF  235

Query: 241  DGKPLVSRPVADGIKKSEDLINIILDNKAQTYHAKNQNDKQSGESDGKSGLGSAFYKHLM  300
            DGK  ++RPVADGIKKS++LI++IL+N+  TYHAKN    ++  S  K+ LG AFYKHLM
Sbjct: 236  DGKQFIARPVADGIKKSQELISLILNNEGNTYHAKN-GKSETAVSTEKTSLGGAFYKHLM  294

Query: 301  GGVSQMLPFVIGGGIMIAIAFLFDNILGVPKDQLSNLGSYHEIAALFKNIGGAAFAFMLP  360
            GGVSQMLPFVIGGGIMIA+AFL DN+LGVP DQL +LGSYHEIAA+F NIGGAAF+FMLP
Sbjct: 295  GGVSQMLPFVIGGGIMIALAFLLDNMLGVPNDQLGSLGSYHEIAAIFMNIGGAAFSFMLP  354

Query: 361  VLAGYIAYSIAEKPGLVAGFVAGSIASSGLAFGKVPFAEGGKATLALAGVPSGFLGALVG  420
            VLAGYIAYSIAEKPGLVAGFVAG+IAS+GLAFGKVPFA GG+ +L L GVPSGFLGALVG
Sbjct: 355  VLAGYIAYSIAEKPGLVAGFVAGAIASNGLAFGKVPFAAGGEVSLGLTGVPSGFLGALVG  414

Query: 421  GFLAGGVILLLRKLLSGLPKSLEGIKSILLYPLLGVLITGFLMLLVNIPMAAINTALNTF  480
            GFLAGGVIL LRKLL+GLP+SLEG+KSILLYPLLGVL+TGFLML VNIPMAAINTALN F
Sbjct: 415  GFLAGGVILALRKLLAGLPRSLEGVKSILLYPLLGVLTGFLMLFVNIPMAAINTALNDF  474

Query: 481  LQGLSGSSAVLMGLLVGGMMAVDMGGPVNKAAYVFGTGTLAATVANGGSVVMAAVMAGGM  540
            LQGLSGSSAVLMGLLVGGMMAVDMGGPVNKAAYVFGTGTLAATVANGGSVVMAAVMAGGM
Sbjct: 475  LQGLSGSSAVLMGLLVGGMMAVDMGGPVNKAAYVFGTGTLAATVANGGSVVMAAVMAGGM  534

Query: 541  VPPLAVFVATLLFKDKFNNEERQSGLTNIVMGLSFITEGAIPFGAADPARAIPSFIVGSA  600
            VPPLAVFVATLLFKDKF  EER+SGLTNIVMGLSFITEGAIPFGAADPARAIPSFI GSA
Sbjct: 535  VPPLAVFVATLLFKDKFTKEERESGLTNIVMGLSFITEGAIPFGAADPARAIPSFIAGSA  594

Query: 601  LTGALVGLAGIKLMAPHGGIFVIALTSNPLLYILFILIGAVVSGVLFGLFRK           652
            LTGALVGLAGIKLMAPHGGIFVIALTSNP+LY++F++IGA+VSG+LFG  RK
Sbjct: 595  LTGALVGLAGIKLMAPHGGIFVIALTSNPILYLVFVVIGALVSGILFGALRK           646
```

Based on this analysis, it was predicted that these proteins and their epitopes could be useful antigens for vaccines or diagnostics.

Example 1954

A DNA sequence (GBSx2063) was identified in *S. agalactiae* <SEQ ID 6055> which encodes the amino acid sequence <SEQ ID 6056>. Analysis of this protein sequence reveals the following:

---

Possible site: 29
>>> Seems to have no N-terminal signal sequence
----- Final Results -----
   bacterial cytoplasm --- Certainty = 0.1532 (Affirmative) <succ>
   bacterial membrane --- Certainty = 0.0000 (Not Clear) <succ>
   bacterial outside --- Certainty = 0.0000 (Not Clear) <succ>

---

The protein has homology with the following sequences in the GENPEPT database.

```
>GP:AAC24914 GB:AF012285 fructose-1-phosphate kinase [Bacillus subtilis]
Identities = 146/303 (48%), Positives = 197/303 (64%)
Query:   1 MIYTVTLNPSIDFIVRLDTLLLGSVNRMTSDDKYVGGKGINVSRILKRLKIDNTATGFIG     60
             MIYTVTLNPS+D+IV ++   +G +NR + D KY GGKGINVSR+LKR  + + A GF+G
Sbjct:   1 MIYTVTLNPSVDYIVHVEDFTVGGLNRSSYDTKYPGGKGINVSRLLKRHHVASKALGFVG     60

Query:  61 GFTGHFVEDGLVLEGIKTDFVSVNEDTRINVKVKAKIETEINGGGPRITNEQLHRLEKLL    120
             GFTG +++  L  E ++T F  V  DTRINVK+K    ETEING GP I++E        +
Sbjct:  61 GFTGEYIKTFLREENLETAFSEVKGDTRINVKLKTGDETEINGQGPTISDEDFKAFLEQF    120

Query: 121 SRLTPEDTVVFAGSAPASLGNKVYNTLIPIAKKTGAEVVCDFEGQTLLDALAYQPLLVKP    180
               L   D VV AGS P+SL +  Y +      K+  A VV D  G+ LL A    +P L+KP
Sbjct: 121 QSLQEGDIVVLAGSIPSSLPHDTYEKIAEACKQQNARVVLDISGEALLKATEMKPFLMKP    180

Query: 181 NNHELADIFGVELEGLPDIEKYAHKILDKGAKNVIVSMAGDGALLVTPEASYFAKPIKGE    240
             N+HEL ++FG  +  +   Y  K++++GA++VIVSMAGDGALL  T EA YFA    KG+
Sbjct: 181 NNHELGEMFGTAITSVEEAVPYGKELVEQGAEHVIVSMAGDGALLFTNEAVYFANVPKGK    240

Query: 241 VKNSVGAGDSMVAGFTGEFVKSKNPVEALKWGVACGTATTFSDDLATAEFIQDIYNKVEV    300
             + NSVGAGDS+VAGF      K    EA + GV  G+AT FS++L T EF+Q +   +V+V
Sbjct: 241 LVNSVGAGDSVVAGFLAGISKQLPLEEAFRLGVTSGSATAFSEELGTEEFVQQLLPEVKV    300

Query: 301 EKL                                                            303
             +L
Sbjct: 301 TRL                                                            303
```

A related DNA sequence was identified in *S. pyogenes* <SEQ ID 6057> which encodes the amino acid sequence <SEQ ID 6058>. Analysis of this protein sequence reveals the following:

---

Possible site: 57
>>> Seems to have no N-terminal signal sequence
----- Final Results -----
   bacterial cytoplasm --- Certainty = 0.1738 (Affirmative) <succ>
   bacterial membrane --- Certainty = 0.0000 (Not Clear) <succ>
   bacterial outside --- Certainty = 0.0000 (Not Clear) <succ>

---

An alignment of the GAS and GBS proteins is shown below.

```
Identities = 222/302 (73%), Positives = 261/302 (85%)
Query:   1 MIYTVTLNPSIDFIVRLDTLLLGSVNRMTSDDKYVGGKGINVSRILKRLKIDNTATGFIG     60
             MIYTVTLNPSIDFIVR+D + LGSVNRM SDDK+ GGKGINVSRIL+RL I +TATGF+G
Sbjct:   1 MIYTVTLNPSIDFIVRIDQINLGSVNRMASDDKFAGGKGINVSRILQRLDIASTATGFLG     60

Query:  61 GFTGHFVEDGLVLEGIKTDFVSVNEDTRINVKVKAKIETEINGGGPRITNEQLHRLEKLL    120
             GFTG F+E+  L   EG+KTDFV  ++DTRINVK+K++  ETE+NG GP I+ EQL   L+    L
Sbjct:  61 GFTGRFIEESLSAEGVKTDFVKGDQDTRINVKIKSQEETELNGQGPIISQEQLEDLKTKL    120

Query: 121 SRLTPEDTVVFAGSAPASLGNKVYNTLIPIAKKTGAEVVCDFEGQTLLDALAYQPLLVKP    180
             S+LT EDTVVFAGSAPA+LGN VY  L+P+  +++GA+VVCDFEGQTL+DALAY PLLVKP
Sbjct: 121 SQLTAEDTVVFAGSAPANLGNAVYKELLPLVRQSGAQVVCDFEGQTLIDALAYNPLLVKP    180

Query: 181 NNHELADIFGVELEGLPDIEKYAHKILDKGAKNVIVSMAGDGALLVTPEASYFAKPIKGE    240
             NNHEL   IFG  L   L D+E  YA ++ L+  GA+NVI+SMAGDGALLVT EA+YFAKPIKGE
Sbjct: 181 NNHELEAIFGTILTSLDDVETYARRLLEMGAQNVIISMAGDGALLVTKEATYFAKPIKGE    240

Query: 241 VKNSVGAGDSMVAGFTGEFVKSKNPVEALKWGVACGTATTFSDDLATAEFIQDIYNKVEV    300
             VKNSVGAGDSMVAGFTGEF+KS+NP+EALKWGVACGTAT FSDDLAT   FI++  Y+KVEV
```

-continued
```
Sbjct: 241  VKNSVGAGDSMVAGFTGEFMKSQNPIEALKWGVACGTATAFSDDLATIAFIKETYHKVEV  300

Query: 301  EK   302
            EK
Sbjct: 301  EK   302
```

Based on this analysis, it was predicted that these proteins and their epitopes could be useful antigens for vaccines or diagnostics.

Example 1955

A DNA sequence (GBSx2064) was identified in *S. agalactiae* <SEQ ID 6059> which encodes the amino acid sequence <SEQ ID 6060>. Analysis of this protein sequence reveals the following:

---

Possible site: 26
>>> Seems to have no N-terminal signal sequence
----- Final Results -----
    bacterial cytoplasm --- Certainty = 0.2769 (Affirmative) <succ>
      bacterial membrane --- Certainty = 0.0000 (Not Clear) <succ>
        bacterial outside --- Certainty = 0.0000 (Not Clear) <succ>

---

A related GBS nucleic acid sequence <SEQ ID 9961> which encodes amino acid sequence <SEQ ID 9962> was also identified.

The protein has homology with the following sequences in the GENPEPT database.

A related DNA sequence was identified in *S. pyogenes* <SEQ ID 6061> which encodes the amino acid sequence <SEQ ID 6062>. Analysis of this protein sequence reveals the following:

---

Possible site: 27
>>> Seems to have no N-terminal signal sequence
----- Final Results -----
    bacterial cytoplasm --- Certainty = 0.2604 (Affirmative) <succ>
      bacterial membrane --- Certainty = 0.0000 (Not Clear) <succ>
        bacterial outside --- Certainty = 0.0000 (Not Clear) <succ>

---

```
>GP:AAC24913 GB:AF012285 FruR [Bacillus subtilis]
Identities = 97/247 (39%), Positives = 148/247 (59%), Gaps = 4/247 (1%)
Query:  23  MLKSKRKEIILSRLEQNKSVTLDELTSILETSESTVRRDLDELESAGFLKRVHGGAELPY   82
            ML +R ++I+ ++E++  V + EL ++    SEST+RRDL  LE  GFLKRVHGGA
Sbjct:   1  MLTPERHQLIIDQIEKHDVVKIQELINLTNASESTIRRDLSTLEERGFLKRVHGGAAKLS   60

Query:  83  SLGQELSNQEKAIKNVQKKLDIARQTAKLIAKQDVIFTDAGTTTELLIDFLPH-EQLTVV  141
            +  E    EK+ KN+  KL IA + A L+ + D I++DAGTTT  +IDF+   + + VV
Sbjct:  61  DIRLEPDMLEKSSKNLHDKLKIAEKAASLLEEGDCIYLDAGTTTLHMIDFMDKTKDIVVV  120

Query: 142  TNSIHHAAKLVDRGIKTIIIGGAVKHSTDASIGQVAINQIRQITVDKAFLGMNGID-EVY  200
            TN + H   L++ + I   ++GG VKH T A IG  ++ + Q   DK+FLG NG+  E
Sbjct: 121  TNGVMHIDALIRKEISFYLLGGYVKHRTGAIIGGASLVAMDQYREDKSFLGTNGVHTEAG  180

Query: 201  LTTPDLEEAAIKEAIINNSQQTFILMDSSKIGQVTFAKVKEINDINLVTNKTDSELMTII  260
               TTPD +EA +K+  I  ++  ++L D SK G+++F+    I D  ++T  TD+E +T
Sbjct: 181  FTTPDPDEALLKQKAIKQAKHAYVLADPSKFGEISFSAFAGIGDATIIT--TDAEELTFD  238

Query: 261  KEKMKVI  267
             + K +
Sbjct: 239  NYQEKTV  245
```

An alignment of the GAS and GBS proteins is shown below.

```
Identities = 135/237 (56%), Positives = 184/237 (76%)
Query:  33  LSRLEQNKSVTLDELTSILETSESTVRRDLDELESAGFLKRVHGGAELPYSLGQELSNQE   92
            ++++ +   V+L++L  +L +SEST+RRDL ELE  G L RVHGGAEL +SL +ELSNQE
Sbjct:   1  MAKITEENYVSLEDLMQLLNSSESTIRRDLGELEQEGRLHRVHGGAELFHSLQEELSNQE   60

Query:  93  KAIKNVQKKLDIARQTAKLIAKQDVIFIDAGITTELLIDFLPHEQLTVVTNSIHHAAKLV  152
            K++KN  K  IA++ ++LI  DVIFIDAGTTTE L+ FL + LTVVTNSIHHAA LV
Sbjct:  61  KSVKNSHIKKAIAQRASQLIYDNDVIFIDAGITTEFLLPFLQAKNLTVVTNSIHHAARLV  120

Query: 153  DRGIKTIIIGGAVKHSTDASIGQVAINQIRQITVDKAFLGMNGIDEVYLITETLEEAAIK  212
            +  I+TII+GG VK +TDASIG VA+ QIRQ+  DKAFLGMNG+D+  YLTTPD+EEA IK
Sbjct: 121  ELSIETIIVGGYVKQTTDASIGNVALEQIRQMNFDKAFLGMNGVDDSYLTTPDMEEAVIK  180
```

```
-continued
Query: 213   EAIINNSQQTFILMDSSKIGQVTFAKVKEINDINLVTNKTDSELMTIIKEKMKVIQV    269
              +A+++N++   +IL+D +KIGQV+F KV   IND+ ++T     + ++  IKEK KVI++
Sbjct: 181   KAVLSNARLAYILVDGTKIGQVSFVKVAPINDVTIITLGGSASILKQIKEKAKVIEL    237
```

Based on this analysis, it was predicted that these proteins and their epitopes could be useful antigens for vaccines or diagnostics.

Example 1956

A DNA sequence (GBSx2065) was identified in *S. agalactiae* <SEQ ID 6063> which encodes the amino acid sequence <SEQ ID 6064>. This protein is predicted to be beta-lactam resistance factor. Analysis of this protein sequence reveals the following:

Possible site: 32
>>> Seems to have no N-terminal signal sequence
----- Final Results -----
   bacterial cytoplasm --- Certainty = 0.5777 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:CAB89121 GB:AJ277485 beta-lactam resistance factor

[Streptococcus pneumoniae]

Identities = 215/410 (52%), Positives = 283/410 (68%)
Query:   1   MTLRELTIEEFKEHSGNYDSQSFLQTPEMAKLLEKRGYDVRYLGYQVENKLEIISLSYIM    60
             M L  LT EEF+ +S     S+SF+Q+ +M   LLEKRG   + YL  + E ++++ +L Y +
Sbjct:   1   MALTTLTKEEFQTYSDQVSSRSFMQSVQMGDLLEKRGARIVYLALKQEGEIQVAALVYSL    60

Query:  61   PVTGGFQMKIDSGPVHSNSKYLKQFYKALQGYAKSNGVLELIVEPYDDQLFTSSGVPSN    120
             P+ GG  M+++SGP+++       L  FY  L+ YAK NGVLEL+V+PY+ YQ F S G P +
Sbjct:  61   PMLGGLHMELNSGPIYTQQDALPVFYAELKEYAKQNGVLELLVKPYETYQTFDSQGNPID    120

Query: 121   QGNDNLIEDFTSSGYHHDGLTTGFTGKYLSWHYVKNLEGVTSETLLSSFSKTGRALVKKA    180
                     ++I+D T   GY  DGLTTG+ G     W Y K+L  +T  ++LL SFSK G+ LVKKA
Sbjct: 121   AEKKSIIQDLTDLGYQFDGLTTGYPGGEPDWLYYKDLTELTEKSLLKSFSKKGKPLVKKA    180

Query: 181   MSFGIKVRVLKRDELHLFKEITTSTSNRRDYMDKSLDYYQDFYDSFEGKAEFVIATLNFR    240
              +FGI+++  LKR+EL  +FK  IT    TS  RR+Y DKSL+YY+  FYD+F    +AEF+IA+LNF
Sbjct: 181   ETFGIRLKKLKREELSIFKNITKETSERREYSDKSLEYYEHFYDTFGEQAEFLIASLNFS    240

Query: 241   EYDHNLQIKAEALENKLKLLDERFRENADSPKYHRQRSEIINQLASFETRRQEVQSFIQK    300
              +Y  LQ +    LE  L  L       +N  S  K   Q   E   +Q   +FE R+ E +   I+K
Sbjct: 241   DYMSKLQGEQSKLEENLDKLRLDLSKNPHSEKKQNQLREYSSQFETFEVRKAEARDLIEK    300

Query: 301   YDNQDVVLAGSLFVYSLKETVYFFSGSYTEFNKFYAPAVLQEYVMQEALKRGSTFYNLLG    360
             Y  +D+VLAGSLFVY   +ET Y FSGSYTEFNKFYAPA+LQ+YVM E++KRG     YN LG
Sbjct: 301   YGEEDIVLAGSLFVYMPQETTYLFSGSYTEFNKFYAPALLQKYVMLESIKRGIPKYNFLG    360

Query: 361   IQGTFDGSDSILRFKQNFNGCIIRKMGTFNYYPSPFKYKGIQLLKKVLKR    410
             IQG FDGSD +LRFKQNFNG  I+RK GTF Y+PSP KYK  IQLLKK++ R
Sbjct: 361   IQGIFDGSDGVLRFKQNFNGYIVRKAGTFRYHPSPLKYKAIQLLKKIVGR    410
```

There is also homology to SEQ ID 5460.

Based on this analysis, it was predicted that this protein and its epitopes, could be useful antigens for vaccines or diagnostics.

Example 1957

A DNA sequence (GBSx2066) was identified in *S. agalactiae* <SEQ ID 6065> which encodes the amino acid sequence <SEQ ID 6066>. This protein is predicted to be cell wall protein, 40 kDa (sr 5' region). Analysis of this protein sequence reveals the following:

Possible site: 42
>>> Seems to have no N-terminal signal sequence
INTEGRAL   Likelihood = −3.45   Transmembrane 25-41 (23-42)
----- Final Results -----
   bacterial membrane --- Certainty = 0.2381 (Affirmative) <succ>
   bacterial outside --- Certainty = 0.0000 (Not Clear) <succ>
   bacterial cytoplasm --- Certainty = 0.0000 (Not Clear) <succ>

A related GBS nucleic acid sequence <SEQ ID 9963> which encodes amino acid sequence <SEQ ID 9964> was also identified.

The protein has homology with the following sequences in the GENPEPT database.

!GB:AF278686 choline binding protein D; CbpD[Strept . . .

!GB:AF278686 choline binding protein D; CbpD[Strept . . .

>GP:AAF87768 GB:AF278686 choline binding protein D; CbpD
[Streptococcus pneumoniae]

```
Identities = 63/230 (27%), Positives = 108/230 (46%), Gaps = 34/230 (14%)
Query:  324  WTEQGGQDDIKWYTAVTTGDG------NYKVAVSFADHKNEKGLYNIHLYYQEASGTLVG        377
             W+   G    +W + V  GD        NY     S+    +      +++++ G  VG
Sbjct:  123  WSTAGTYGHVAWVSNVM-GDQIEIEEYNYGYTESYNKRVIKANTMTGFIHFKDLDGGSVG        181

Query:  378  VTGTKVTVAGTNSSQEPIENGLAKTGVYNIIGSTEVKNEAKISSQTQFTLEKGDKINYDQ        437
             + +  +   GT+  +                + +K E  S         G+K++YDQ
Sbjct:  182  NSQSSTSTGGTHYFKT----------------KSAIKTEPLASGTVIDYYYPGEKVHYDQ        225

Query:  438  VLTADGYQWISYKSYSGVRRYIPVKKLTTSSEKAKDEATKPTSYPNLPKTG-TYTFTKTV        496
             +L  DGY+W+SY +Y+G RY+ ++ + +             P    L  TG T+  F
Sbjct:  226  ILEKDGYKWLSYTAYNGSYRYVQLEAVNKN----------PLGNSVLSSTGGTHYFKTKS        275

Query:  497  DVKSQPKVSSPVEFNFQKGEKIHYDQVLVVDGHQWISYKSYSGIRRYIEI              546
              +K++P VS+ V    +  GEK+HYDQ+L  DG++W+SY +Y+G RRYI++
Sbjct:  276  AIKTEPLVSATVIDYYYPGEKVHYDQILEKDGYKWLSYTAYNGSRRYIQL              325

Identities = 49/161 (30%), Positives = 85/161 (52%), Gaps = 14/161 (8%)
Query:  116  GNYVYSKETEVKNTPSKSAPVAFYAKKGDKVFYDQVFNKDNVKWISYKSFCGVRRYAAIE        175
             G  + +  ++ +K P S   V  Y   G+KV YDQ+  KD  KW+SY ++ G  RY  +E
Sbjct:  191  GTHYFKTKSAIKTEPLASGTVIDYYYPGEKVHYDQILEKDGYKWLSYTAYNGSYRYVQLE        250

Query:  176  SLDPSGGSETKAPTPVTNSGSNNQEKIATQGNYTFSHKVEVKNEAKVASPTQFTLDKGDR        235
              +++ +          P+ NS +      +T G + F K   +K E   V++       G++
Sbjct:  251  AVNKN---------PLGNSVLS-----STGGTHYFKTKSAIKTEPLVSATVIDYYYPGEK        296

Query:  236  IFYDQILTIEGNQWLSYKSFNGVRRFVLLGKASSVEKTEDK                      276
             + YDQIL   +G +WLSY ++NG RR++ L   +S + +++
Sbjct:  297  VHYDQILEKDGYKWLSYTAYNGSRRYIQLEGVTSSQNYQNQ                      337
Identities = 52/192 (27%), Positives = 90/192 (46%), Gaps = 13/192 (6%)
Query:  295  ISNETTTGFDILITNIKDDNGIAAVKPVWTEQGGQDDIKWYTAVTTGDGNYKVAVSFAD         354
             I   T TGF      + KD +G +       T  GG    K    +A+ T    + +
Sbjct:  161  IKANTMTGF----IHFKDLDGGSVGNSQSSTSTGGTHYFKTKSAIKTEPLASGTVIDYY-        215

Query:  355  HKNEKGLYNIHLY---YQEASGTLVGVTGTKVTVAGTNSSQEPIENGLAKT--GVYNIIG         409
             +    EK  Y+ L     Y+  S T   +     V +   N+  P+N +     G +
Sbjct:  216  YPGEKVHYDQILEKDGYKWLSYTAYNGSYRYVQLEAVNKN--PLGNSVLSSTGGTHYFKT        273

Query:  410  STEVKNEAKISSQTQFTLEKGDKINYDQVLTADGYQWISYKSYSGVRRYIPVKKLTTSSE         469
              + +K E  +S+       G+K++YDQ+L  DGY+W+SY +Y+G RRYI ++ + TSS+
Sbjct:  274  KSAIKTEPLVSATVIDYYYPGEKVHYDQILEKDGYKWLSYTAYNGSRRYIQLEGV-TSSQ        332

Query:  470  KAKDEATKPTSY        481
             ++++      +SY
Sbjct:  333  NYQNQSGNISSY        344

Identities = 33/113 (29%), Positives = 56/113 (49%), Gaps = 2/113 (1%)
Query:   91  NTATKDITTPLVETKPMVEKTLPEQGNYVYSK-ETEVKNTPSKSAPVAFYAKKGDKVFYD        149
             N + + +     V  P+    L    G     Y K ++ +K P SA V  Y    G+KV YD
Sbjct:  241  NGSYRYVQLEAVNKNPLGNSVLSSTGGTHYFKTKSAIKTEPLVSATVIDYYYPGEKVHYD        300

Query:  150  QVFNKDNVKWISYKSFCGVRRYAAIESLDPSGGSETKAPTPVTNSGSNNQEKI             202
             Q+   KD  KW+SY ++   G RRY  +E  +       +      +  + ++ GS++    +
Sbjct:  301  QILEKDGYKWLSYTAYNGSRRYIQLEGVTSSQNYQNQSGN-ISSYGHSSSTV              352
```

A related GBS gene <SEQ ID 8937> and protein <SEQ ID 8938> were also identified. Analysis of this protein sequence reveals the following:

---

Lipop: Possible site: −1  Crend: 10
McG: Discrim Score: −6.74
GvH: Signal Score (−7.5): 1.26
Possible site: 42
>>> Seems to have no N-terminal signal sequence
ALOM program    count: 1 value: −3.45    threshold: 0.0
INTEGRAL        Likelihood = −3.45       Transmembrane 22-39 (23-42)
PERIPHERAL      Likelihood = 6.26        371

-continued

--- modified ALOM score: 1.19
*** Reasoning Step: 3
----- Final Results -----
   bacterial membrane --- Certainty = 0.2381 (Affirmative) <succ>
      bacterial outside --- Certainty = 0.0000 (Not Clear) <succ>
      bacterial cytoplasm --- Certainty = 0.0000 (Not Clear)

---

The protein has homology with the following sequences in the databases:

```
41.2/57.9% over 283aa
Streptococcus mutans
EGAD|33594| cell wall protein, 40 kDa (sr 5' region) Insert characterized
PIR|A60328|A60328 40K cell wall protein precursor (sr 5' region) - (strain
OMZ175, serotype f) Insert characterized
ORF02145(301-1803 of 2238)
EGAD|33594|34911(30-313 of 335) cell wall protein, 40 kDa (sr 5' region)
{Streptococcus mutans}PIR|A60328|A60328 40K cell wall protein precursor (sr 5' region) -
Streptococcus mutans (strain OMZ175, serotype f)
% Match = 8.0
% Identity = 41.1 % Similarity = 57.9
Matches = 81 Mismatches = 79 Conservative Sub.s = 33

156       186       216       246       276       306       336       366
*YA****FCYTKNNKSWVFFSRSIYSIKYYICITNISKIC*HVTKRIL***CK*IRK*VFMMKKGQVNDTKQSYSLRKYK
                               :          :         :   | :||: :|    | :|:|||
                          MNQKIVVISSFYMLGAHSFSKAVYHNDRSVKLMKRIDINHQAQRFSIRKYA
                               10        20        30        40        50

396       426       456       486       516       546       576       606
FGLASVILGSFIMVTSPVFADQTTSVQVNNQTGTSVDANNSSNETSASSVITSNNDSVQASDKVVNSQNTATKDITTPLV
|| ||||:|  : :   |:      |:        |: :||   |      ||    ||      ||
FGAASVLIGCVFFLGTQNVSAQEQGTQL--------------PASENAVVNVAENSVAISQAVADKAATQTTLTETPQV
                70                80        90        100       110

654       684       714
ETKPMVEK----------------------------------------TLPEQGNYVYSKETEVKNTPSKSAPVAF
|  :    |                                       ::| |||||: : ||| | |:|
EVEEKESKVNAPALNVDDKGAKSKEDVN~~~~AEQNEKAVRENLMCRQAKAVSIPSQGNYVFQETTPVKNAASMSSP---
        130       140       200       210       220       230       240

744       1533      1563      1593      1623      1653      1683
YAKKGDKVFYDQVFNKD~~~~GVYNIIGSTEVKNEAKISSQTQFTLEKGDKINYDQVLTADGYQWISYKSYSGVRRYIPV
                     ||| ::|||: || || ||||| ||||:||| |:
---------------------------------~~~~--------------TQFNFDKGDKVFYDNVLEADGHQWISYVSYSGIRRYAPI
                                                    250       260       270

1713      1743      1773      1803      1833      1863      1893      1923
KKLTTSSEKAKDEATKPTSYPNLPKTGTYTFTKTVDVKSQPKVSSPVEFNFQKGEKIHYDQVLVVDGHQWISYKSYSGIR
     :  ::    |    |||   ||| |||   :| :        |           :
------AVTIEELKQKEIVQQNLPAQGTYHFTKQQSLKMKLNCLVRPNSRFTTEITFFMIRF
            290       300       310       320       330
```

A related DNA sequence was identified in *S. pyogenes* <SEQ ID 6067> which encodes the amino acid sequence <SEQ ID 6068>. Analysis of this protein sequence reveals the following:

Possible site: 23
>>> Seems to have a cleavable N-term signal seq.

-continued

----- Final Results -----
bacterial outside --- Certainty = 0.3000 (Affirmative) <succ>
bacterial membrane --- Certainty = 0.0000 (Not Clear) <succ>
bacterial cytoplasm --- Certainty = 0.0000 (Not Clear) <succ>

The protein has homology with the following sequences in the databases:

```
>GP:AAF87768 GB:AF278686 choline binding protein D; CbpD
[Streptococcus pneumoniae]
Identities = 93/217 (42%), Positives = 136/217 (61%), Gaps = 18/217 (8%)
Query:  42  GDNYPSKWKKGNG-IDSWNMYIRQCTSFAAFRLSSANGFQLPKGYGNACTWGHIAKNQGY      100
            GD+YP+ +K G+  ID W MY RQCTSF AFRLS+ NGF++P  YGNA  WGH A+ +GY
Sbjct:  51  GDDYPAYYKNGSQEIDQWRMYSRQCTSFVAFRLSNVNGFEIPAAYGNANEWGHRARREGY      110

Query: 101  PVNKTPSIGAIAWFDKNAYQSNAAYGHVAWVADIRGDTVTIEEYNYNAGQGPERYHKRQI      160
            V+ TP+IG+I W         + YGHVAWV+++ GD + IEEYNY       E Y+KR I
Sbjct: 111  RVDNTPTIGSITW------STAGTYGHVAWVSNVMGDQIEIEEYNYGY---TESYNKRVI      161

Query: 161  PKSQVSGYIHFKDLSSQTSHSYPRQLKHISQASFDPSGTYHFTTRLPVKGQTSIDSPDLA      220
            + ++G+IHFKDL   +   +         SQ+S    GT++F T+ +K +        +
Sbjct: 162  KANTMTGFIHFKDLDGGSVGN--------SQSSTSTGGTHYFKTKSAIKTEPLASGTVID      213

Query: 221  YYEAGQSVYYDKVVTAGGYTWLSYLSFSGNRRYIPIK                         257
            YY  G+ V+YD+++   GY WLSY +++G+ RY+ ++
Sbjct: 214  YYYPGEKVHYDQILEKDGYKWLSYTAYNGSYRYVQLE                         250
```

An alignment of the GAS and GBS proteins is shown below.

```
Identities = 34/94 (36%), Positives = 52/94 (55%)
Query: 453  SGVRRYIPVKKLTTSSEKAKDEATKPTSYPNLPKTGTYTFTKTVDVKSQPKVSSPVEFNF   512
            S V  YI  K L++ +  +     K  S  +   +GTY FT  + VK Q  + SP    +
Sbjct: 163  SQVSGYIHFKDLSSQTSHSYPRQLKHISQASFDPSGTYHFTTRLPVKGQTSIDSPDLAYY   222

Query: 513  QKGEKIHYDQVLVVDGHQWISYKSYSGIRRYIEI   546
            + G+ ++YD+V+    G+ W+SY S+SG RRYI I
Sbjct: 223  EAGQSVYYDKVVTAGGYTWLSYLSFSGNRRYIPI   256

Identities = 30/78 (38%), Positives = 45/78 (57%), Gaps = 2/78 (2%)
Query: 402  TGVYNIIGSTEVKNEAKISSQTQFTLEKGDKINYDQVLTADGYQWISYKSYSGVRRYIPV   461
            +G Y+       VK +  I S        E G   + YD+V+TA GY W+SY S+SG RRYIP+
Sbjct: 197  SGTYHFTTRLPVKGQTSIDSPDLAYYEAGQSVYYDKVVTAGGYTWLSYLSFSGNRRYIPI   256

Query: 462  KKLTTSSEKAKDEATKPT   479
            K+  +        +++ TKP+
Sbjct: 257  KE--PAQSVVQNDNTKPS   272

Identities = 27/94 (28%), Positives = 47/94 (49%)
Query: 198  NQEKIATQGNYTFSHKVEVKNEAKVASPTQFTLDKGDRIFYDQILTIEGNQWLSYKSFNG   257
            +Q       G Y F+ ++ VK +  + SP    + G  ++YD+++T  G  WLSY SF+G
Sbjct: 190  SQASFDPSGTYHFTTRLPVKGQTSIDSPDLAYYEAGQSVYYDKVVTAGGYTWLSYLSFSG   249

Query: 258  VRRFVLLGKASSVEKTEDKEKVSPQPQARITKTG   291
            RR++ + + +     D  K S +   +T  G
Sbjct: 250  NRRYIPIKEPAQSVVQNDNTKPSIKVGDTVTFPG   283

Identities = 23/73 (31%), Positives = 35/73 (47%)
Query: 103  ETKPMVEKTLPEQGNYVYSKETEVKNTPSKSAPVAFYAKKGDKVFYDQVFNKDNVKWISY   162
            + K + + +      G Y ++    VK    S  +P    Y + G  V+YD+V       W+SY
Sbjct: 185  QLKHISQASFDPSGTYHFTTRLPVKGQTSIDSPDLAYYEAGQSVYYDKVVTAGGYTWLSY   244

Query: 163  KSFCGVRRYAAIE   175
            SF G RRY  I+
Sbjct: 245  LSFSGNRRYIPIK   257
```

SEQ ID 8938 (GBS91) was expressed in *E. coli* as a His-fusion product. SDS-PAGE analysis of total cell extract is shown in FIG. 18 (lane 7; MW 63 kDa).

Figure 283:
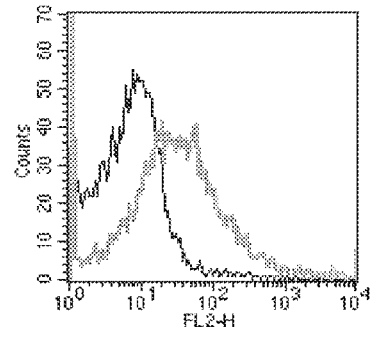

The GBS91-His fusion product was purified (FIG. 195, lane 9) and used to immunise mice. The resulting antiserum was used for FACS (FIG. 283), which confirmed that the protein is immunoaccessible on GBS bacteria.

Based on this analysis, it was predicted that these proteins and their epitopes could be useful antigens for vaccines or diagnostics.

Example 1958

A DNA sequence (GBSx2067) was identified in *S. agalactiae* <SEQ ID 6069> which encodes the amino acid sequence <SEQ ID 6070>. This protein is predicted to be thiamine biosynthesis protein. Analysis of this protein sequence reveals the following:

Possible site: 40
>>> Seems to have no N-terminal signal sequence
----- Final Results -----
   bacterial cytoplasm --- Certainty = 0.0984 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:CAB49673 GB:AJ248285 PROBABLE 2-DEHYDROPANTOATE 2-REDUCTASE (EC
1.1.1.169) [Pyrococcus abyssi]
Identities = 85/301 (28%), Positives = 150/301 (49%), Gaps = 7/301 (2%)
Query:   1  MLVYIAGSGAMGCRFGYQISKTNHDVILLDNWADHIMAIKENGLKVTGDTEDLVKLPIMK    60
            M +YI G+GA+G  FG  ++     DV+L+     H+ AI E GLK+ G   +  VK+
Sbjct:   1  MKIYILGAGAIGSLFGGLLANAGEDVLLIGR-DPHVSAINEKGLKIVGIKDLNVKVEATT    59

Query:  61  PTDATEEADLIILFTKAMQLPNMLQDIKKIIGKKTKVLCLLNGLGHEDVIRQYIPEHNIL   120
                   E+ DLI+L TK+      L+  + I+ K + VL + NG+G+ED I ++        +
Sbjct:  60  RVPE-EKPDLIVLATKSYSTIEALKSARHIV-KGSWVLSIQNGIGNEDKIIEF--GGKAI   115

Query: 121  MGVTVWTAGLKGPGHAHLEGVGSVNLQSIDPENQEAGHRVTELLNEAKLQATYDENVLPN   180
            G+T   A ++ PG     G G     +      ++    +V ++ N A ++        EN++
Sbjct: 116  GGITTNGAMVEAPGVIKWTGKGVTIIGLYPQGKEKFIEKVADVENSADIETHVSENIISW   175

Query: 181  IWRKACVNGTMNSTCALLDCTIGQLFASEDGVNMVHEIIHEFVTGKAEGVELDEEEITK   240
            IW KA  VN    +N     LL+           +   ++   ++M  E++  E     V     G+E D     +
Sbjct: 176  IWAKAIVNSAINPIGTLLEVKNKVIRENDFLLSMAMEVVKEGCRVALQNGIEFDVPPMDL   235
```

```
                                   -continued
Query: 241 YVMDTSVKAAHHYPSMHQDLVQNQRLTEIDELNGAVNKKGENLGIDTPYCRLITQLIHTKE  301
           +   T    +  +Y SM QD+ + ++ TE+D++NG + +   + + ++ P    L+   LI   KE
Sbjct: 236 F-FQTLEQTRENYNSMLQDIWRGKK-TEVDYINGKIVEYAKAVNLEAPMNLLLWGLIKGKE   294
```

A related DNA sequence was identified in *S. pyogenes* <SEQ ID 6071> which encodes the amino acid sequence <SEQ ID 6072>. Analysis of this protein sequence reveals the following:

Possible site: 22
>>> Seems to have no N-terminal signal sequence
----- Final Results -----
  bacterial cytoplasm --- Certainty = 0.1392 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below.

```
Identities = 262/307 (85%), Positives = 288/307 (93%)

Query:   1 MLVYIAGSGAMGCRFGYQISKTNHDVILLDNWADHIMAIKENGLKVTGDTEDLVKLPIMK    60
           MLVYIAGSGAMGCRFGYQISKTN+DVILLDNW DHI AIKENGL VTGD E+ VKLPIMK Sbjct:   1 MLVYIAGSGAMGCRFGYQISKTNNDVILLDNWEDHINAIKENGLVVTGDVEETVKLPIMK    60

Query:  61 PTDATEEADLIILFTKAMQLPNMLQDIKKIIGKKTKVLCLLNGLGHEDVIRQYIPEHNIL   120
           PT+AT+EADLIILFTKAMQLP MLQDIK IIGK+TKVLCLLNGLGHEDVIRQYIPEHNIL
Sbjct:  61 PTEATQEADLIILFTKAMQLPQMLQDIKGIIGKETKVLCLLNGLGHEDVIRQYIPEHNIL   120

Query: 121 MGVTVWTAGLKGPGHAHLEGVGSVNLQSIDPNNQEAGHRVTELLNEAKLQATYDENVLPN   180
           MGVTVWTAGL+GPG AHL+GVG++NLQS+DP+NQEAGH+V +LLNEA L ATYDENV+PN
Sbjct: 121 MGVTVWTAGLEGPGRAHLQGVGALNLQSMDPSNQEAGHQVADLLNEANLNATYDENVVPN   180

Query: 181 IWRKACVNGTMNSTCALLDCTIGQLFASEDGVNMVHEIIHEFVTGKAEGVELDEEEITK   240
           IWRKACVNGTMNSTCALLDCTIG+LFASEDG+ MV EIIHEFV VG+AEGVEL+EEEIT+
Sbjct: 181 IWRKACVNGTMNSTCALLDCTIGELFASEDGLKMVKEIIHEFVIVGQAEGVELNEEEITQ   240

Query: 241 YVMDTSVKAAHHYPSMHQDLVQNQRLTEIDFLNGAVNKKGENLGIDTPYCRLITQLIHTK   300
           YVMDTSVKAAHHYPSMHQDLVQN RLTEIDF+NGAVN KGE LGI+TPYCR+IT+L+H K
Sbjct: 241 YVMDTSVKAAHHYPSMHQDLVQNHRLTEIDFINGAVNTKGEKLGINTPYCRMITELVHAK   300

Query: 301 ENVLSIK                                                        307
           E VL+I+
Sbjct: 301 EAVLNIQ                                                        307
```

Based on this analysis, it was predicted that these proteins and their epitopes could be useful antigens for vaccines or diagnostics.

Example 1959

A DNA sequence (GBSx2068) was identified in *S. agalactiae* <SEQ ID 6073> which encodes the amino acid sequence <SEQ ID 6074>. Analysis of this protein sequence reveals the following:

Possible site: 36
>>> Seems to have no N-terminal signal sequence
INTEGRAL   Likelihood = –3.03   Transmembrane 61-77 (61-78)
INTEGRAL   Likelihood = –1.33   Transmembrane 80-96 (79-96)
----- Final Results -----
  bacterial membrane --- Certainty = 0.2211 (Affirmative) <succ>
    bacterial outside --- Certainty = 0.0000 (Not Clear) <succ>
    bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1960

A DNA sequence (GBSx2069) was identified in *S. agalactiae* <SEQ ID 6075> which encodes the amino acid sequence <SEQ ID 6076>. This protein is predicted to be regulatory protein (pfoS/R). Analysis of this protein sequence reveals the following:

Possible site: 49
>>> Seems to have no N-terminal signal sequence
INTEGRAL   Likelihood = –9.82   Transmembrane 317-333 (304-335)
INTEGRAL   Likelihood = –7.64   Transmembrane 187-203 (183-217)
INTEGRAL   Likelihood = –5.26   Transmembrane 24-40 (18-44)
INTEGRAL   Likelihood = –5.04   Transmembrane 143-159 (139-161)
INTEGRAL   Likelihood = –2.34   Transmembrane 116-132 (115-136)
INTEGRAL   Likelihood = –2.13   Transmembrane 55-71 (55-71)
INTEGRAL   Likelihood = –0.96   Transmembrane 268-284 (268-284)
----- Final Results -----
  bacterial membrane --- Certainty = 0.4927 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:AAC65034 GB:AE001189 regulatory protein (pfoS/R) [Treponema pallidum]
Identities = 138/358 (38%), Positives = 220/358 (60%), Gaps = 18/358 (5%)
Query:   2 TNTVTPKETAGSFINKVLGGTATAIVVALIPNAILATFLKPFLSYG-LAAEFLHIVQVFQ      60
           T +++P++    F+ K+L G++  IV+ L+P AI     +     L A   H+V  Q
Sbjct:   3 TQSLSPRQ----FMMKILNGSSAGIVIGLVPPAIAGELFRALAPLSPLFAALYEVVLPIQ      58

Query:  61 FFTPIMAGFLIGQQFKFTPMQQLAVGGAAYIGSGAWAYTEVIQKGVATGSFQLRGIGDLI     120
           F  P + G L+G QF  +    +  + I SG         + G++ + GIGD+I
Sbjct:  59 FSVPALIGTLVGLQFHCSAPEVATLAFVSVIASG--------NVTLQNGAWLITGIGDVI     110

Query: 121 NMMLTAALAVLAVKWFGNKFGSLTIILLPIIIGTGVGYLGWKLLPYVSYVTTLIGQGINS     180
           N+ML +ALA++ V+   K GSLTII LP+I+      G +G  LPYV   +T  +G+ I +
Sbjct: 111 NVMLISALAIILVRALRGKLGSLTIIALPVIVAVVAGGVGSFSLPYVKMITLFVGRVIAT     170

Query: 181 FTTLQPIAMSILIANAFSMLIVSPISTVAIGLAIGLNGMSASAASMGVASTTAVLVWATM     240
           F  LQP+ MSIL++M+FS++I+SP+S+VA+G+A+GL G+++ AA++GV+S    L+  TM
Sbjct: 171 FIALQPLLMSILLSMSFSLIIISPVSSVAVGIAVGLTGLASGAANIGVSSCAMTLIVGIM     230

Query: 241 KANKSGVPIAIALGAMKMMMPNFLKHPVMAIPMLMTATVSSLTVPLFKLVGTPASSGFGL     300
           + NK GVP+A+  GAMKM+MPN++++P++ IP+L+   V +   LF L GTPAS+GFG
Sbjct: 231 RVNKIGVPLAMFAGAMKMLMPNWIRYPILNIPLLLNGLVCGVLAWLFNLQGTPASAGFGF     290

Query: 301 VGAVGPIASFE--AGASML---IVILSWLVIPFAVGFVSHKICKDILKLYKDDIFVFE         353
           +G VGPI ++   A    M+  I+ L + V+ F  ++   I   D LKLY+ ++F+  E
Sbjct: 291 IGLVGPINAYRLMAYTPMVRAGILFLVYFVLSFLAAYLIDFILVDRLKLYRRELFIPE       348
```

There is also homology to SEQ ID 1280.

A related GBS gene <SEQ ID 8939> and protein <SEQ ID 8940> were also identified. Analysis of this protein sequence reveals the following:

Lipop: Possible site: −1 Crend: 8
McG: Discrim Score: −7.24
GvH: Signal Score (−7.5): −2.94
Possible site: 49
>>> Seems to have no N-terminal signal sequence
ALOM program count: 7 value: −9.82 threshold: 0.0
INTEGRAL   Likelihood = −9.82   Transmembrane 317-333 (304-335)
INTEGRAL   Likelihood = −7.64   Transmembrane 187-203 (183-217)
INTEGRAL   Likelihood = −6.37   Transmembrane 143-159 (136-161)
INTEGRAL   Likelihood = −5.26   Transmembrane 24-40 (18-44)
INTEGRAL   Likelihood = −2.34   Transmembrane 116-132 (115-136)
INTEGRAL   Likelihood = −2.13   Transmembrane 55-71 (55-71)
INTEGRAL   Likelihood = −0.96   Transmembrane 268-284 (268-284)
PERIPHERAL Likelihood = 0.69    205
modified ALOM score: 2.46
*** Reasoning Step: 3
----- Final Results -----
bacterial membrane --- Certainty = 0.4927 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the databases:

```
ORF02147(337-1359 of 1668)
EGAD|138195|TP0038(10-348 of 350) regulatory protein {Treponema pallidum} OMNI|TP0038
regulatory protein (pfoS/R) GP|3322295|gb|AAC65034.1||AE001189 regulatory protein (pfoS/R)
{Treponema pallidum} PIR|E71373|E71373 probable regulatory protein (pfoS/R) - syphilis
spirochete
% Match = 21.6
% Identity = 40.1 % Similarity = 65.6
Matches = 135 Mismatches = 112 Conservative Sub.s = 86

87        117       147       177       207       237       267       297
         LQQDMGKHQSL*TKLSIIFILIEITV*SIQHH**NNYK*N**VYKKGLYILLKK*QSFLFIL*YN*LCRYE*Y*INEARY 327       357       387       417       444       474       504       534
         FMTNTVTPKETAGSFINKVLGGTATAIVVALIPNAILATFLKPFLSYG-LAAEFLHIVQVFQFFTPIMAGFLIGQQFKFT
            |:   |:|   |:   |:|  ||      |  :::   |       |              ||     |    |  :
         MHTQSLSPRQFMMKILNGSSAGIVIGLVPPAIAGELFRALAPLSPLFAALYHVVLPIQFSVPALIGTLVGLQFHCS
            10        20        30        40        50        60        70

564       594       624       654       684       714       744       774
         PMQQLAVGGAAYIGSGAWAYTEVIQKGVATGSFQLRGIGDLINMMLTAALAVLAVKWFGNKFGSLXIILLPIIIGTGVGY
            :    :    :    | |                :    |:::   |||||:||  :|||::  |:    :|||  ||    ||:|:   |
         APEVATLAFVSVIASG--------NVTLQNGAWLITGIGDVINVMLISALAIILVRALRGKLGSLTIIALPVIVAVVAGG
                    90            100       110       120       130       140

804       834       864       894       924       954       984      1014
         LGWKLLPYVSYVTTLIGQGINSFTTLQPIAMSILIAMAFSMLIVSPISTVAIGLAIGLNGMSASAASMGVASTTAVLVWA
            :|    ||||     :|     ::|:     |    |||   |||::|:||::|:|:||:|:|||   ||::||:|   |:
         VGSFSLPYVKMITLFVGRVIATFIALQPLLMSILLSMSFSLIIISPVSSVAVGIAVGLTGLASGAANIGVSSCAMTLIVG
                    160       170       180       190       200       210       220
```

-continued

```
         1044      1074      1104      1134      1164      1194      1224      1248
        TMKANKSGVPIAIALGAMKMMMPNFLKHPVMAIPMLMTATVSSLTVPLFKLVGTPASSGFGLVGAVGPIASFE--AGASM
        ||:  ||  |||:|:  |||||:|||::::|::  ||:|:    |  :  || | |||||:|||::| ||||  ::    |  |
        TMRVNKIGVPLAMFAGAMKMLMPNWIRYPILNIPLLLNGLVCGVLAWLFNLQGTPASAGFGFIGLVGPINAYRLMAYTPM
                  240       250       260       270       280       290       300

1269      1299      1329      1359      1389      1419      1449      1479
        L---IVILSWLVIPFAVGFVSHKICKDILKLYKDDIFVFEGQN*FGGCMLVYIAGSGAMGCRFGYQISKTNHDVILLDNW
        :   |:  |  ::|:  |    ::      |    | ||||: ::|: |
        VRAGILFLVYFVLSFLAAYLIDFILVDRLKLYRRELFIPEQG
                   320       330       340       350
```

There is also homology to SEQ ID 1276

Based on this analysis, it was predicted that these proteins and their epitopes could be useful antigens for vaccines or diagnostics.

Example 1961

A DNA sequence (GBSx2070) was identified in *S. agalactiae* <SEQ ID 6077> which encodes the amino acid sequence <SEQ ID 6078>. Analysis of this protein sequence reveals the following:

Possible site: 20
>>> Seems to have a cleavable N-term signal seq.
----- Final Results -----
  bacterial outside --- Certainty = 0.3000 (Affirmative) <succ>
  bacterial membrane --- Certainty = 0.0000 (Not Clear) <succ>
  bacterial cytoplasm --- Certainty = 0.0000 (Not Clear) <succ>

The protein has homology with the following sequences in the GENPEPT database.

A related DNA sequence was identified in *S. pyogenes* <SEQ ID 6079> which encodes the amino acid sequence <SEQ ID 6080>. Analysis of this protein sequence reveals the following:

Possible site: 20
>>> Seems to have an uncleavable N-term signal seq
INTEGRAL        Likelihood = −0.37        Transmembrane 8-24 (8-24)
----- Final Results -----
  bacterial membrane --- Certainty = 0.1150 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP:BAB07127 GB:AP001518 thioredoxin reductase [Bacillus halodurans]

Identities = 163/325 (50%), Positives = 222/325 (68%), Gaps = 3/325 (0%)

Query:    5  IYDITIVGGGPVGLFAAFYAGLRGVSVKIIESLSELGGQPAILYPEKKIYDIPGYPVITG      64
             +YDITI+GGGP GLFAAFY G+R    VKIIES+ +LGGQ A LYPEK IYD+ G+P +
Sbjct:    7  LYDITIIGGGPTGLFAAFYGGMRQAKVKIIESMPQLGGQLAALYPEKYIYDVAGFPKVKA     66

Query:   65  RELIDKHIEQLERFKDSIEICLKEEVLSFEK-VDDVFTIQTDKDQHLSRAIVFACGNGAF    123
             ++L++    Q E+F  +I   L++ V  +    K  DD FTI+TDK+ H S+AI+   G GAF
Sbjct:   67  QDLVNDLKRQAEQFNPTI--ALEQSVQNVTKETDDTFTIKTDKETHYSKAIIITAGAGAF    124

Query:  124  APRLLGLENEENYADNNLFYNVTKLEQFAGKHVVICGGGDSAVDWANELDKIAASVAIVH    183
               PR L +E  + Y   NL Y V  L  +AGK+V+I GGGDSAVDWA  L+ +A +V ++H
Sbjct:  125  QPRRLEVEGAKQYEGKNLQYFVNDLNAYAGENVLISGGGDSAVDWALMLEPVAKNVTLIH    184

Query:  184  RRDAFRAHEHSVDILKASGVRILTPYVPIGLNGDSQRVSSLVVQKVKGDEVIELPLDNLI    243
             RRD FRAHEHSV++L+ S V ILTP+    L+GD +++   +Q+VKGD V  L +D +I
Sbjct:  185  RRDKFRAHEHSVELLQKSSVNILTPFAISELSGDGEKIHHVTIQEVKGDAVETLDVDEVI    244

Query:  244  VSFGFSTSNKNLRYWNLDYKRSSINVSSLFETTQEGVYAIGDAANYPGKVELIATGYGEA    303
             V+FGF +S   ++ W L+ +++SI V++  ET   G+YA GD   YPGKV+LIATG+GEA
Sbjct:  245  VNFGFVSSLGPIKGWGLEIERNSIVVNTKMETNIPGIYAAGDICTYPGKVKLIATGFGEA    304

Query:  304  PVAINQAINYIYPDRDNRVVHSTSL                                     328
             P A+N A +I P      HSTSL
Sbjct:  305  PTAVNNAKAFIDPTARVFPGHSTSL                                     329
```

```
>GP:CAB15201 GB:Z99120 similar to thioredoxin reductase [Bacillus subtilis]
Identities = 173/328 (52%), Positives = 223/328 (67%), Gaps = 4/328 (1%)
Query:   4 KAYDITIIGGGPIGLFAAFYAGLRGVTVKIIESLSELGGQPAILYPEKMIYDIPAYPSLT    63
             K YDITIIGGGP+GLF AFY G+R  +VKIIESL +LGGQ + LYPEK IYD+  +P +
Sbjct:   6 KVYDITIIGGGPVGLETAFYGGMRQASVKIIESLPQLGGQLSALYPEKYIYDVAGFPKIR   65

Query:  64 GVELTENLIKQLSRFEDRTTICLKEEVLTFDKVKGG-FSIRTNKAEHFSKAIIIACGNGA   122
             EL   NL +Q+++F+    TICL++ V + +K    G F +    K    I  GNGA
Sbjct:  66 AQELINNLKEQMAKEDQ--TICLEQAVESVEKQADGVFKLVQMKKPTTLKRSCITAGNGA   123

Query: 123 FAPRTLGLESEENFADHNLEYNVHQLDQFAGQKVVICGGGDSAVDWALALEDIAESVTVV   182
             F PR L LE+ E +   NL Y V  L +FAG++V I GGGDSAVDWAL  LE IA+ V+++
Sbjct: 124 FKPRKLELENAEQYEGENLHYFVDDLQKFAGRRVAILGGGDSAVDWALMLEPIAKEVSII   183

Query: 183 HRRDAFRAHEHSVELLKASTVNILTPYVPKALKGIGNLAEKLVIQKVKEDEVLELELDSL   242
             HRRD FRAHEHSVE L AS VN+LTP+VP  L G    + E+LV+++VK D    LE+D L
Sbjct: 184 HRRDKFRAHEHSVENLHASKVNVLTPFVPAELIGEDKI-EQLVLEEVKGDRKEILEIDDL   242

Query: 243 IVSFGFSTSNKNLKNWNLDYKRSSITVSPLFQTSQEGIFAIGDAAAYNGKVDLIATGFGE   302
             IV++GF +S    +KNW LD +++SI V    +T+ EG FA GD   Y GKV+LIA+GFGE
Sbjct: 243 IVNYGFVSSLGPIKNWGLDIEKNSIVVKSTMETNIEGFFAAGDICTYEGKVNLIASGFGE   302

Query: 303 APTAVNQAINYIYPDRDNRVVHSTSLID                                330
             APTAVN A  Y+ P    + +HSTSL +
Sbjct: 303 APTAVENARAYMDPKARVQPLHSTSLFE                                330
```

An alignment of the GAS and GBS proteins is shown below.

```
Identities = 242/324 (74%), Positives = 279/324 (85%)
Query:   6 YDITIVGGGPVGLFAAFYAGLRGVSVKIIESLSELGGQPAILYPEKKIYDIPGYPVITGR   65
             YDITI+GGGP+GLFAAFYAGLRGV+VKIIESLSELGGQPAILYPEK IYDIP YP +TG
Sbjct:   6 YDITIIGGGPIGLFAAFYAGLRGVTVKIIESLSELGGQPAILYPEKMIYDIPAYPSLTGV   65

Query:  66 ELIDKHIEQLERFKDSIEICLKEEVLSFEKVDDVFTIQTDKDQHLSRAIVFACGNGAFAP   125
             EL +   I+QL RF+D   ICLKEEVL+F+KV    F+I+T+K +H S+AI+  ACGNGAFAP
Sbjct:  66 ELTENLIKQLSRFEDRTTICLKEEVLTFDKVKGGFSIRTNKAEHFSKAIIIACGNGAFAP   125

Query: 126 RLLGLENEENYADNNLFYNVTKLEQFAGKHVVICGGGDSAVDWANELDKIAASVAIVHRR   185
             R LGLE+EEN+AD+NLFYNV +L+QFAG+ VVICGGGDSAVDWA   L+ IA SV +VHRR
Sbjct: 126 RTLGLESEENFADHNLFYNVHQLDQFAGQKVVICGGGDSAVDWALALEDIAESVTVVHRR   185

Query: 186 DAFRAHEHSVDILKASGVRILTPYVPIGLNGDSQRVSSLVVQKVKGDEVIELPLDNLIVS   245
             DAFRAHEHSV++LKAS V +LTPYVP  L G        LV+QKVK DEV+EL LD+LIVS
Sbjct: 186 DAFRAHEHSVELLKASTVNLLTPYVPKALKGIGNLAEKLVIQKVKEDEVLELELDSLIVS   245

Query: 246 FGFSTSNKNLRYWNLDYKRSSINVSSLFETTQEGVYAIGDAANYPGKVELIATGYGEAPV   305
             FGFSTSNKNL+ WNLDYKRSSI VS LF+T+QEG++AIGDAA Y GKV+LIATG+GEAP
Sbjct: 246 FGFSTSNKNLKNWNLDYKRSSITVSPLFQTSQEGIFAIGDAAAYNGKVDLIATGFGEAPT   305

Query: 306 AINQAINYIYPDRDNRVVHSTSLI                                    329
             A+NQAINYIYPDRDNRVVHSTSLI
Sbjct: 306 AVNQAINYIYPDRDNRVVHSTSLI                                    329
```

SEQ ID 6078 (GBS178) was expressed in E. coli as a His-fusion product. SDS-PAGE analysis of total cell extract is shown in FIG. 38 (lane 5; MW 37.4 kDa). It was also expressed in E. coli as a GST-fusion product. SDS-PAGE analysis of total cell extract is shown in FIG. 41 (lane 8; MW 62.4 kDa).

Based on this analysis, it was predicted that this protein and its epitopes, could be useful antigens for vaccines or diagnostics.

Example 1962

A DNA sequence (GBSx2071) was identified in S. agalactiae <SEQ ID 6081> which encodes the amino acid sequence <SEQ ID 6082>. This protein is predicted to be tRNA methyltransferase (trmD). Analysis of this protein sequence reveals the following:

Possible site: 25
>>> Seems to have no N-terminal signal sequence
----- Final Results -----
    bacterial cytoplasm --- Certainty = 0.1496 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database.

```
>GP:BAB06198 GB:AP001515 tRNA methyltransferase [Bacillus halodurans]
Identities = 144/246 (58%), Positives = 186/246 (75%), Gaps = 6/246 (2%)
```

```
                         -continued
Query:   2  MKIDILTLFPEMFAPLEHS-IVGKAKERGLLEINYHNFRENAE-KSRHVDDEPYGGGQGM   59
            MKID LTLFPEMF  + HS I+ +A+ERG +       NFRE +E K + VDD PYGGG GM
Sbjct:   1  MKIDFLTLFPEMFQGVLHSSILKQAQERGAVSFRVVNFREYSENKHKKVDDYPYGGGAGM   60

Query:  60  LLRAQPIFDTIDKIDAQKA---RVILLDPAGRTFDQDFAEELSKEDELIFICGHYEGYDE  116
            +L  QP+FD ++ +  + +   RVIL+ P G TF Q  AEEL++ +  LI +CGHYEGYDE
Sbjct:  61  VLSPQPLFDAVEDLTKKSSSTPRVILMCPQGETFTQRKAEELAQAEHLILLCGHYEGYDE  120

Query: 117  RIKS-LVTDEVSLGDFVLTGGELAAMTMVDATVRLIPEVIGKETSHQDDSFSSGLLEYPQ  175
            RI+S LVTDE+S+GD+VLTGGEL AM + D+   RL+P V+G ETS Q DSFS+GLLEYPQ
Sbjct: 121  RIRSYLVTDELSIGDYVLTGGELGAMVIADSVTRLLPAVLGNETSAQTDSFSTGLLEYPQ  180

Query: 176  YTRPYDYLGMTVPDVLMSGHHENIRKWRLEQSLRKTLERRPDLLENYAMTDEERLILEKI  235
            YTRP D+ G  VPDVL+SGHH+NI +WR EQSL++TLERRPDLLE    +T+EE+ +L+ I
Sbjct: 181  YTRPADFRGWKVPDVLLSGHHQNIERWRKEQSLKRTLERRPDLLEGRKLTEEEQELLDSI  240

Query: 236  KTEIER                                                       241
            + + E+
Sbjct: 241  RKQQEK                                                       246
```

A related DNA sequence was identified in *S. pyogenes* <SEQ ID 6083> which encodes the amino acid sequence <SEQ ID 6084>. Analysis of this protein sequence reveals the following:

Possible site: 24
>>> Seems to have no N-terminal signal sequence
----- Final Results -----
  bacterial cytoplasm --- Certainty = 0.2705 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

```
Identities = 195/240 (81%), Positives = 224/240 (93%)
Query:   2  MKIDILTLFPEMFAPLEHSIVGKAKERGLLEINYHNFRENAEKSRHVDDEPYGGGQGMLL   61
            MKIDILTLFPEMFAPLEHSIVGKAKE+GLL+I+YHNFR+  AEK+RHVDDEPYGGGQGMLL
Sbjct:   1  MKIDILTLFPEMFAPLEHSIVGKAKEKGLLDIHYHNFRDYAEKARHVDDEPYGGGQGMLL   60

Query:  62  RAQPIFDTIDKIDAQKARVILLDPAGRTFDQDFAEELSKEDELIFICGHYEGYDERIKSL  121
            RAQPIFDTI++I+A+K R+ILLDPAG+ F Q +AEEL+ E+ELIFICGHYEGYDERIK+L
Sbjct:  61  RAQPIFDTIEQIEAKKPRIILLDPAGKPFTQAYAEELALEEELIFICGHYEGYDERIKTL  120

Query: 122  VTDEVSLGDFVLTGGELAAMTMVDATVRLIPEVIGKETSHQDDSFSSGLLEYPQYTRPYD  181
            VTDE+SLGDFVLTGGELAAMTMVDATVRLIP+V+GKE+SHQDDSFSSGLLEYPQYTRPYD
Sbjct: 121  VTDEISLGDFVLTGGELAAMTMVDATVRLIPQVLGKESSHQDDSFSSGLLEYPQYTRPYD  180

Query: 182  YLGMTVPDVLMSGHHENIRKWRLEQSLRKTLERRPDLLENYAMTDEERLILEKIKTEIER  241
            Y GMTVPDVLMSGHHE IR WRLE+SL+KT  RRPDLLE+Y ++EER +L+KIK   +++
Sbjct: 181  YRGMTVPDVLMSGHHERIRLWRLEESLKKTYLRRPDLLEHYNFSEEERKLLDKIKEALDQ  240
```

Based on this analysis, it was predicted that these proteins and their epitopes could be useful antigens for vaccines or diagnostics.

Example 1963

A DNA sequence (GBSx2072) was identified in *S. agalactiae* <SEQ ID 6085> which encodes the amino acid sequence <SEQ ID 6086>. This protein is predicted to be 16S rRNA processing protein. Analysis of this protein sequence reveals the following:

Possible site: 43
>>> Seems to have no N-terminal signal sequence
INTEGRAL    Likelihood = −2.71    Transmembrane 32-48 (32-52)
----- Final Results -----
  bacterial membrane --- Certainty = 0.2084 (Affirmative) <succ>
  bacterial outside --- Certainty = 0.0000 (Not Clear) <succ>
  bacterial cytoplasm --- Certainty = 0.0000 (Not Clear) <succ>

A related GBS nucleic acid sequence <SEQ ID 9381> which encodes amino acid sequence <SEQ ID 9382> was also identified.

The protein has homology with the following sequences in the GENPEPT database.

```
>GP:CAB13475 GB:Z99112 similar to hypothetical proteins [Bacillus subtilis]
Identities = 88/174 (50%), Positives = 128/174 (72%), Gaps = 1/174 (0%)
Query:  54  VTMEYFNVGKIVNTQGLQGEMRVLSVTDFVEERFKKGQVLALFDEKNQFVMDIEIASHRK  113
            +T  +FNVGKIVNT G++GE+RV+S TDF EER+K G  L LF +       +++ + +HR
Sbjct:   1  MTKRWFNVGKIVNTHGIKGEVRVISKTDFAEERYKPGNTLYLFMDGRNEPVEVTVNTHRL   60

Query: 114  QKNFDIIKFKGMYHINDIEKYKGFTLKVAEDQLSDLKDGEFYYHEIIGLDVYEGE-ELIG  172
            +K F +++FK  ++N++E+ K   +KV E++L +GEFY+HEIIG +V+  E ELIG
Sbjct:  61  HKQFHLLQFKERQNLNEVEELKNAIIKVPEEELGELNEGEFYFHEIIGCEVFTEEGELIG  120
```

```
Query: 173  KIKEILQPGANDVWVVERHGKRDLLLPYIPPVVLEVDLSNQRVQVELMEGLDDE  226
            K+KEIL PGANDVWV+ R GK+D L+PYI  VV  +D+  +++++ELMEGL DE
Sbjct: 121  KVKEILTPGANDVWVIGRKGKKDALIPYIESVVKHIDVREKKIEIELMEGLIDE  174
```

A related DNA sequence was identified in *S. pyogenes* <SEQ ID 6087> which encodes the amino acid sequence <SEQ ID 6088>. Analysis of this protein sequence reveals the following:

Possible site: 28
>>> Seems to have no N-terminal signal sequence
----- Final Results -----
   bacterial cytoplasm --- Certainty = 0.2787 (Affirmative) <succ>
    bacterial membrane --- Certainty = 0.0000 (Not Clear) <succ>
     bacterial outside --- Certainty = 0.0000 (Not Clear) <succ>

An alignment of the GAS and GBS proteins is shown below.

```
Identities = 133/172 (77%), Positives = 153/172 (88%)
Query: 56   MEYENVGKIVNTQGLQGEMRVLSVTDFVEERFKKGQVLALFDEKNQFVMDIEIASHRKQK  115
            MEYFNVGKIVNTQGLQGEMRVLSV+DF EERFKKG  LALFD+K++FV ++ I SHRKQK
Sbjct: 1    MEYFNVGKIVNTQGLQGEMRVLSVSDFAEERFKKGSQLALFDDKDRFVQEVTIVSHRKQK   60

Query: 116  NFDIIKFKGMYHINDIEKYKGFTLKVAEDQLSDLKDGEFYYHEIIGLDVYEGEELIGKIK  175
            +FDIIKFK MYHIN IEKYKG+TLKV++D    DL++GEFYYH+IIG+ VYE + LIG +K
Sbjct: 61   HFDIIKFKDMYHINAIEKYKGYTLKVSKDNQGDLQEGEFYYHQIIGMAVYEKDVLIGHVK  120

Query: 176  EILQPGANDVWVVERHGKRDLLLPYIPPVVLEVDLSNQRVQVELMEGLDDED  227
            EILQPGANDVW+V+R GKRDLLLPYIPPVVL VD+ N+RV VELMEGLDDED
Sbjct: 121  EILQPGANDVWIVKRQGKRDLLLPYIPPVVLNVDVPNKRVDVELMEGLDDED  172
```

Based on this analysis, it was predicted that these proteins and their epitopes could be useful antigens for vaccines or diagnostics.

Example 1964

A DNA sequence (GBSx2073) was identified in *S. agalactiae* <SEQ ID 6089> which encodes the amino acid sequence <SEQ ID 6090>. This protein is predicted to be similar to *E. coli* ykfC (11). Analysis of this protein sequence reveals the following:

Possible site: 55
>>> Seems to have no N-terminal signal sequence
----- Final Results -----
   bacterial cytoplasm --- Certainty = 0.3488 (Affirmative) <succ>
    bacterial membrane --- Certainty = 0.0000 (Not Clear) <succ>
     bacterial outside --- Certainty = 0.0000 (Not Clear) <succ>

A related GBS nucleic acid sequence <SEQ ID 9909> which encodes amino acid sequence <SEQ ID 9910> was also identified.

The protein has homology with the following sequences in the GENPEPT database.

```
>GP:AAC38715 GB:AF030367 maturase-related protein [Streptococcus pneumoniae]
Identities = 366/425 (86%), Positives = 396/425 (93%)
Query:  12  MSELLDKILSRNNMLEAYKQVKSNKGSAGINGVTIEQMDDYLHQNWRETKQLIKERSYKP   71
            MS+LLDKILSR NMLEAY QVKSNKGSAGI+G+TIE+MD+YL QNWR TK+LIK+R YKP
Sbjct:   1  MSKLLDKILSRENMLEAYNQVKSNKGSAGIDGMTIEEMDNYLRQNWRLTKELIKQRKYKP   60

Query:  72  QPVLRVEIPKPNGGVRNLGIPTAMDRMIQQAIVQVLSPLCEKHFSEYSYGFRPNRSCETA  131
            QPVL+VEIPKP+GG+R LGIPT MDRMIQQAIVQV+SP+CE HFS+ SYGFRPNRSCE A
Sbjct:  61  QPVLKVEIPKPDGGIRQLGIPTVMDRMIQQAIVQVMSPICEPHFSDTSYGFRPNRSCEKA  120

Query: 132  IVQLLEYLNDGYEWIVDIDLEKFFDTVPQDRLMSLVHNIIQDGDTESLIRKYLHSGVVIN  191
            I++LLEYLNDGYEWIVDIDLEKFFDTVPQDRLMSLVHNII+DGDTESLIRKYLHSGV+IN
Sbjct: 121  IMKLLEYLNDGYEWIVDIDLEKFFDTVPQDRLMSLVHNIIEDGDTESLIRKYLHSGVIIN  180

Query: 192  GQRHKTLVGTPQGGNLSPLLSNIMLNELDKGLEKRGLRFVRYADDCVITVGSEAAAERVM  251
            GQR+KTLVGTPQGGNLSPLLSNIMLNELDK LEKRGLRFVRYADDCVITVGSEAAA+RVM
Sbjct: 181  GQRYKTLVGTPQGGNLSPLLSNIMLNELDKELEKRGLRFVRYADDCVITVGSEAAAERVM  240

Query: 252  HSVSSYIEKRLGLKVNMTKTKIVRPNKLKYLGFGFWKSPKGWKCRPHQDSVQSFKRKLKQ  311
            +SVS +IEKRLGLKVNMTKTKI RP +LKYLGFGFWKS  GWK RPHQDSV+ FK KLK+
Sbjct: 241  YSVSRFIEKRLGLKVNMTKTKITRPRELKYLGFGFWKSSDGWKSRPHQDSVRRFKLKLKK  300

Query: 312  LTMRKWSIDLITRIERLNWVIRGWINYFSLGNMKSIMTQIDERLRTRIRVIIWKQWKKKA  371
            LT RKWSIDL  RIE+LN  IRGWINYFSLGNMKSI+  IDERLRTR+R+IIWKQWKKK+
Sbjct: 301  LTQRKWSIDLTRRIEQLNLSIRGWINYFSLGNMKSIVASIDERLRTRLRMIIWKQWKKKS  360

Query: 372  KRLWGLLKLGVARWIADKVSGWGDHYQLVAQKSVLKRAISKPALAKRGLVSCLDYYLERH  431
            +RLWGLLKLGV +WIADKVSGWGDHYQLVAQKSVLKRAISKP L KRGLVSCLDYYLERH
Sbjct: 361  RRLWGLLKLGVPKWIADKVSGWGDHYQLVAQKSVLKRAISKPVLEKRGLVSCLDYYLERH  420

Query: 432  ALKVS                                                         436
            ALKVS
Sbjct: 421  ALKVS                                                         425
```

No corresponding DNA sequence was identified in *S. pyogenes*.

Based on this analysis, it was predicted that this protein and its epitopes, could be useful antigens for vaccines or diagnostics.

Example 1965

A DNA sequence (GBSx2074) was identified in *S. agalactiae* <SEQ ID 6091> which encodes the amino acid sequence <SEQ ID 6092>. Analysis of this protein sequence reveals the following:

Possible site: 25
>>> Seems to have an uncleavable N-term signal seq
INTEGRAL    Likelihood = −0.37    Transmembrane 7-23 (7-23)
----- Final Results -----
  bacterial membrane --- Certainty = 0.1150 (Affirmative) <succ>
    bacterial outside --- Certainty = 0.0000 (Not Clear) <succ>
    bacterial cytoplasm --- Certainty = 0.0000 (Not Clear) <succ>

A related DNA sequence was identified in *S. pyogenes* <SEQ ID 821> which encodes the amino acid sequence <SEQ ID 822>. Analysis of this protein sequence reveals the following:

Possible site: 25
>>> Seems to have an uncleavable N-term signal seq
INTEGRAL    Likelihood = −2.87    Transmembrane 1157-1173 (1157-1174)
----- Final Results -----
  bacterial membrane --- Certainty = 0.2147 (Affirmative) <succ>
    bacterial outside --- Certainty = 0.0000 (Not Clear) <succ>
    bacterial cytoplasm --- Certainty = 0.0000 (Not Clear) <succ>

An alignment of the GAS and GBS proteins is shown below.

```
Identities = 1031/1064 (96%), Positives = 1042/1064 (97%)
Query:   1  MRKKQKLPFDKLAIALISTSILLNAQSDIKANTVTEDTPATEQAVEPPQPIAVSEESPSS   60
            +RKKQKLPFDKLALAL+STSILLNAQSDIKANTVTEDTPATEQAVE PQP AVSEE+PSS
Sbjct:   1  LRKKQKLPFDKLAIALMSTSILLNAQSDIKANTVTEDTPATEQAVETPQPTAVSEEAPSS   60

Query:  61  KETKTSQTPSDVGETVADDANDLAPQAPAKTADTPATSKATIRDLNDPSHVKTLQEKAGK  120
            KETKT QTP D  ET+ADDANDLAPQAPAKTADTPATSKATIRDLNDPS VKTLQEKAGK
Sbjct:  61  KETKTPQTPDDAEETIADDANDLAPQAPAKTADTPATSKATIRDLNDPSQVKTLQEKAGK  120

Query: 121  GVGTVVAVIDAGFDKNHEAWRLTDKTKARYQSKENLEKAKKEHGITYGEWVNDKVAYYHD  180
            G GTVVAVIDAGFDKNHEAWRLTDKTKARYQSKE+LEKAKKEHGITYGEWVNDKVAYYHD
Sbjct: 121  GAGTVVAVIDAGFDKNHEAWRLTDKTKARYQSKEDLEKAKKEHGITYGEWVNDKVAYYHD  180

Query: 181  YSKDGKNAVDQEHGTHVSGILSGNAPSEMKEPYRLEGAMPEAQLLLMRVEIVNGLADYAR  240
            YSKDGK AVDQEHGTHVSGILSGNAPSE KEPYRLEGAMPEAQLLLMRVEIVNGLADYAR
Sbjct: 181  YSKDGKTAVDQEHGTHVSGILSGNAPSETKEPYRLEGAMPEAQLLLMRVEIVNGLADYAR  240

Query: 241  NYAQAIRDAVNLGAKVINMSFGNAALAYANLPDETKKAFDYAKSKGVSIVTSAGNDSSFG  300
            NYAQAI DAVNLGAKVINMSFGNAALAYANLPDETKKAFDYAKSKGVSIVTSAGNDSSFG
```

```
                              -continued
Sbjct: 241    NYAQAIIDAVNLGAKVINMSFGNAALAYANLPDETKKAFDYAKSKGVSIVTSAGNDSSFG    300

Query: 301    GKPRLPLADHPDYGVVGTPAAADSTLTVASYSPDKQLTETATVKTDDHQDKEMPVLSTNR    360
              GK RLPLADHPDYGVVGTPAAADSTLTVASYSPDKQLTETATVKT D QDKEMPVLSTNR
Sbjct: 301    GKTRLPLADHPDYGVVGTPAAADSTLTVASYSPDKQLTETATVKTADQQDKEMPVLSTNR    360

Query: 361    FEPNKAYDYAYANRGTKEDDFKDVEGKIALIERGDIDFKDKIANAKKAGAVGVLIYDNQD    420
              FEPNKAYDYAYANRG KEDDFKDV+GKIALIERGDIDFKDKIANAKKAGAVGVLIYDNQD
Sbjct: 361    FEPNKAYDYAYANRGMKEDDFKDVKGKIALIERGDIDFKDKIANAKKAGAVGVLIYDNQD    420

Query: 421    KGFPIELPNVDQMPAAFISRRDGLLLKDNPQKTITFNATPKVLPTASGTKLSRFSSWGLT    480
              KGFPIELPNVDQMPAAFISR+DGLLLK+NPQKTITFNATPKVLPTASGTKLSRFSSWGLT
Sbjct: 421    KGFPIELPNVDQMPAAFISRKDGLLLKENPQKTITFNATPKVLPTASGTKLSRFSSWGLT    480

Query: 481    ADGNIKPDIAAPGQDILSSVANNKYAKLSGTSMSAPLVAGIMGLLQKQYETQYPDMTPSE    540
              ADGNIKPDIAAPGQDILSSVANNKYAKLSGTSMSAPLVAGIMGLLQKQYETQYPDMTPSE
Sbjct: 481    ADGNIKPDIAAPGQDILSSVANNKYAKLSGTSMSAPLVAGIMGLLQKQYETQYPDMTPSE    540

Query: 541    RLDLAKKVLMSSATALYDEDEKAYFSPRQQGAGAVDAKKASAATMYVTDKDNTSSKVHLN    600
              RLDLAKKVLMSSATALYDEDEKAYFSPRQQGAGAVDAKKASAATMYVTDKDNTSSKVHLN
Sbjct: 541    RLDLAKKVLMSSATALYDEDEKAYFSPRQQGAGAVDAKKASAATMYVTDKDNTSSKVHLN    600

Query: 601    NVSDKFEVTVTVHNKSDKPQELYYQVTVQTDKVDGKHFALAPKALYETSWQKITIPANSS    660
              NVSDKFEVTVTVHNKSDKPQELYYQ TVQTDKVDGK FALAPKALYETSWQKITIPANSS
Sbjct: 601    NVSDKFEVTVTVHNKSDKPQELYYQATVQTDKVDGKLFALAPKALYETSWQKITIPANSS    660

Query: 661    KQVTVPIDASRFSKDLLAQMKNGYFLEGFVRFKQDPTKEELMSIPYIGFRGDFGNLSALE    720
              KQVT+PID S+FSKDLLA MKNGYFLEGFVRFKQDPTKEELMSIPYIGFRGDFGNLSALE
Sbjct: 661    KQVTIPIDVSQFSKDLLAPMKNGYFLEGFVRFKQDPTKEELMSIPYIGFRGDFGNLSALE    720

Query: 721    KPIYDSKDGSSYYHEANSDAKDQLDGDGLQFYALKNNFTALTTESNPWTIIKAVKEGVEN    780
              KPIYDSKDGSSYYHEANSDAKDQLDGDGLQFYALKNNFTALTTESNPWTIIKAVKEGVEN
Sbjct: 721    KPIYDSKDGSSYYHEANSDAKDQLDGDGLQFYALKNNFTALTTESNPWTIIKAVKEGVEN    780

Query: 781    IEDIESSEITETIFAGTFAKQDDDSHYYIHRHANGKPYAAISPNGDGNRDYVQFQGTFLR    840
              IEDIESSEITETIFAGTFAKQDDDSHYYIHRHANGKPYAAISPNGDGNRDYVQFQGTFLR
Sbjct: 781    IEDIESSEITETIFAGTFAKQDDDSHYYIHRHANGKPYAAISPNGDGNRDYVQFQGTFLR    840

Query: 841    NAKNLVAEVLDKEGNVVWTSEVTEQVVKNYNNDLASTLGSTRFEKTRWDGKNKDGKVVAN    900
              NA+NLVAEVLDKEGNVVWTSEVTEQVVKNYNNDLASTLGSTRFEKTRWDGK+KDGKVVAN
Sbjct: 841    NARNLVAEVLDKEGNVVWTSEVTEQVVKNYNNDLASTLGSTRFEKTRWDGKDKDGKVVAN    900

Query: 901    GTYTYRVRYTPISSGAKEQHTDFDVIVDNTTPEVATSATFSTEDSRLTLASKPKTSQPVY    960
              GTYTYRVRYTPISSGAKEQHTDFDVIVDNTTPEVATSATFSTED RLTLASKPKTSQPVY
Sbjct: 901    GTYTYRVRYTPISSGAKEQHTDFDVIVDNTTPEVATSATFSTEDRRLTLASKPKTSQPVY    960

Query: 961    RERIAYTYMDEDLPTTEYISPNEDGTFTLPEEAETMEGATVPLKMSDFTYVVEDMAGNIT    1020
              RERIAYTYMDEDLPTTEYISPNEDGTFTLPEEAETMEGATVPLKMSDFTYVVEDMAGNIT
Sbjct: 961    RERIAYTYMDEDLPTTEYISPNEDGTFTLPEEAETMEGATVPLKMSDFTYVVEDMAGNIT    1020

Query: 1021   YTPVTKLLEGHSNKPEQDGSDQAPDKKPEAKPEQDGSGQTPDKK                  1064
              YTPVTKLLEGHSNKPEQDGSDQAPDKKPE KPEQDGSGQ PDKK
Sbjct: 1021   YTPVTKLLEGHSNKPEQDGSDQAPDKKPETKPEQDGSGQAPDKK                  1064
```

A related GBS gene <SEQ ID 8941> and protein <SEQ ID 8942> were also identified. Analysis of this protein sequence reveals the following:

Lipop Possible site: −1 Crend: 10
McG: Discrim Score: 5.69
GvH: Signal Score (−7.5): −3.33
Possible site: 25
>>> Seems to have an uncleavable N-term signal seq
ALOM program count: 1 value: −0.37 threshold: 0.0
INTEGRAL      Likelihood = −0.37    Transmembrane 7-23 (7-23)
PERIPHERAL    Likelihood = 2.81     508
modified ALOM score: 0.57
*** Reasoning Step: 3
----- Final Results -----
   bacterial membrane --- Certainty = 0.1150 (Affirmative) <succ>
   bacterial outside --- Certainty = 0.0000 (Not Clear) <succ>
      bacterial cytoplasm --- Certainty = 0.0000 (Not Clear) <succ>

SEQ ID 8942 (GBS276) was expressed in *E. coli* as a His-fusion product. SDS-PAGE analysis of total cell extract is shown in FIG. 46 (lane 2; MW 123 kDa). It was also expressed in *E. coli* as a GST-fusion product. SDS-PAGE analysis of total cell extract is shown in FIG. 60 (lane 5; MW 46.5 kDa).

Figure 296:
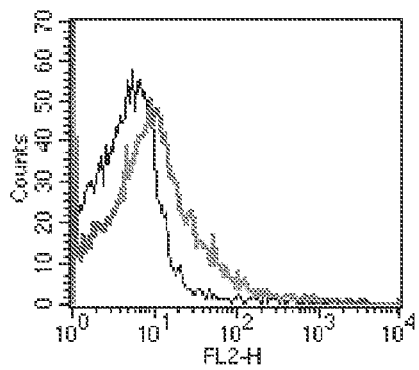

The GBS276-His fusion product was purified (FIG. 206, lane 9) and used to immunise mice. The resulting antiserum was used for FACS (FIG. 296), which confirmed that the protein is immunoaccessible on GBS bacteria.

Based on this analysis, it was predicted that these proteins and their epitopes could be useful antigens for vaccines or diagnostics.

Example 1966

A DNA sequence (GBSx2075) was identified in *S. agalactiae* <SEQ ID 6093> which encodes the amino acid sequence <SEQ ID 6094>. Analysis of this protein sequence reveals the following:

```
Possible site: 58
>>> Seems to have no N-terminal signal sequence
----- Final Results -----
    bacterial cytoplasm --- Certainty = 0.4286 (Affirmative) <succ>
      bacterial membrane --- Certainty = 0.0000 (Not Clear) <succ>
        bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1967

A DNA sequence (GBSx2076) was identified in *S. agalactiae* <SEQ ID 6095> which encodes the amino acid sequence <SEQ ID 6096>. Analysis of this protein sequence reveals the following:

```
>GP:AAF27324 GB:AF178424 unknown [Lactococcus lactis]
Identities = 26/75 (34%), Positives = 45/75 (59%), Gaps = 4/75 (5%)
Query: 11    MAFEPKNSELTKVLKES-LDEEKKEIFSSEMNIRDFERTKQYQFTLQPSVRKKIDRLSKE    69
             MAF+   + ++  VL   S L + K E+       I    E   K Y FTL+PSV++ +++L+++
Sbjct: 1     MAFDVDDKKVKTVLSNSSLAKSKVEL---PKKIESEENKKSYSFTLEPSVKEGLEKLAEK    57

Query: 70    KGYRSASSFINDFFK                                              84
             + Y++ S F+ND  K
Sbjct: 58    QNYKNTSQFLNDLIK                                              72
```

```
Possible site: 30
>>> Seems to have an uncleavable N-term signal seq
INTEGRAL      Likelihood = -11.15 Transmembrane 19-35 (11-39)
----- Final Results -----
    bacterial membrane --- Certainty = 0.5458 (Affirmative) <succ>
      bacterial outside --- Certainty = 0.0000 (Not Clear) <succ>
        bacterial cytoplasm --- Certainty = 0.0000 (Not Clear) <succ>
```

A related GBS nucleic acid sequence <SEQ ID 9911> which encodes amino acid sequence <SEQ ID 9912> was also identified.

The protein has no significant homology with any sequences in the GENPEPT database.

No corresponding DNA sequence was identified in *S. pyogenes*.

SEQ ID 6096 (GBS654) was expressed in *E. coli* as a GST-fusion product. SDS-PAGE analysis of total cell extract is shown in FIG. 142 (lane 8 & 10; MW 51.2 kDa+lane 9; MW 27 kDa). Purified GBS654-GST is shown in FIG. 245, lane 11.

Based on this analysis, it was predicted that this protein and its epitopes, could be useful antigens for vaccines or diagnostics.

Example 1968

A DNA sequence (GBSx2077) was identified in *S. agalactiae* <SEQ ID 6097> which encodes the amino acid sequence <SEQ ID 6098>. Analysis of this protein sequence reveals the following:

```
Possible site: 14
>>> Seems to have no N-terminal signal sequence
----- Final Results -----
    bacterial cytoplasm --- Certainty = 0.4174 (Affirmative) <succ>
      bacterial membrane --- Certainty = 0.0000 (Not Clear) <succ>
        bacterial outside --- Certainty = 0.0000 (Not Clear) <succ>
```

A related GBS nucleic acid sequence <SEQ ID 9913> which encodes amino acid sequence <SEQ ID 9914> was also identified.

The protein has homology with the following sequences in the GENPEPT database.

No corresponding DNA sequence was identified in *S. pyogenes*.

Based on this analysis, it was predicted that this protein and its epitopes, could be useful antigens for vaccines or diagnostics.

Example 1969

A DNA sequence (GBSx2078) was identified in *S. agalactiae* <SEQ ID 6099> which encodes the amino acid sequence <SEQ ID 6100>. This protein is predicted to be ParA. Analysis of this protein sequence reveals the following:

```
Possible site: 45
>>> Seems to have an uncleavable N-term signal seq
----- Final Results -----
    bacterial membrane --- Certainty = 0.0000 (Not Clear) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the GENPEPT database.

```
>GP:AAF27325 GB:AF178424 ParA [Lactococcus lactis]
Identities = 49/104 (47%), Positives = 72/104 (69%)
Query: 22    LSERLEEFKTEAFDFKTRASYVTAKLFFLGNMIKHNTNSSKELIRSLKNDKSVLAMIPHK    81
             L ERL+ FK E   D +TR +Y+TA  +F+GN I+HNT SS+E    +  DK   +AMIP K
Sbjct: 157   LIERLQNFKDEVIDARTRETYITAIPYFVGNRIRHNTKSSREFSEKISQDKGTIAMIPEK    216
```

```
-continued
Query: 82   ELFNRSTLDKKSLSYMMSDKELYSRDSKFFKEIDFTFRKITDKL          125
             ELFNRSTLD    L  M  DK++++ +   F+++++F F +IT+K+
Sbjct: 217  ELFNRSTLDGVPLVEMEKDKDVFNSNKVFYEKLNFAFNEITNKI          260
```

No corresponding DNA sequence was identified in S. pyogenes.

Based on this analysis, it was predicted that this protein and its epitopes, could be useful, antigens for vaccines or diagnostics.

Example 1970

A DNA sequence (GBSx2079) was identified in S. agalactiae <SEQ ID 6101> which encodes the amino acid sequence <SEQ ID 6102>. This protein is predicted to be transposase (orfA). Analysis of this protein sequence reveals the following:

Possible site: 42
>>> Seems to have no N-terminal signal sequence
----- Final Results -----
   bacterial cytoplasm --- Certainty = 0.2830 (Affirmative) <succ>
   bacterial membrane --- Certainty = 0.0000 (Not Clear) <succ>
   bacterial outside --- Certainty = 0.0000 (Not Clear) <succ>

Based on this analysis, it was predicted that this protein and its epitopes, could be useful antigens for vaccines or diagnostics.

Example 1971

A DNA sequence (GBSx2080) was identified in S. agalactiae <SEQ ID 6103> which encodes the amino acid sequence <SEQ ID 6104>. This protein is predicted to be transposase (orfB). Analysis of this protein sequence reveals the following:

Possible site:16
>>> Seems to have no N-terminal signal sequence
----- Final Results -----
   bacterial cytoplasm --- Certainty = 0.2618 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:CAB90834 GB:A3250837 putative transposase [Streptococcus dysgalactiae]
Identities = 242/259 (93%), Positives = 249/259 (95%)

Query:   1   MCRWLNMPHSSYYYQAVESVSETEFEETIKRIFLDSESRYGSRKIKICLNNEGITLSRRR    60
             MCRWLN+P SSYYY+AVE VSE E  EE+IK IFL+S++RYGSRKIKICLNNEGITLSRRR
Sbjct:   1   MCRWLNIPRSSYYYKAVEPVSEAELEESIKAIFLESKARYGSRKIKICLNNEGITLSRRR    60

Query:  61   IRRIMKRLNLVSVYQKATFKPHSRGENEAPIPNHLDRQFKQERPLQALVTDLTYVRVGNR   120
             IRRIMKRLNLVSVYQKATFKPHSRGKNEAPIPNHLDRQFK ERPLQALVTDLTYVRVGNR
Sbjct:  61   IRRIMKRLNLVSVYQKATFKPHSRGKNEAPIPNHLDRQFKPERPLQALVTDLTYVRVGNR   120

Query: 121   WAYVCLIIDLYNREIIGLSLGWHKTAELVKQAIQSIPYALTKVKMFHSDRXKEFDNQLID   180
             WAYVCLIIDLYNREIIGLSLGWHKTAELVKQAIQSIPY LTKVKMFHSDR KEF+NQLID
Sbjct: 121   WAYVCLIIDLYNREIIGLSLGWHKTAELVKQAIQSIPYPLTKVKMFHSDRGKEFNNQLID   180

Query: 181   EILEAFGITRSLSQAGCPYDNAVAESTYRAFKIEFVYQETFQLLEELALKTKDYVHWWNY   240
             EILEAFGITRSLSQAGCPYDNAVAESTYRAFKIEFVYQETFQ LEELALKTK YVHWWNY
Sbjct: 181   EILEAFGITRSLSQAGCPYDNAVAESTYRAFKIEFVYQETFQSLEELALKTKAYVHWWNY   240

Query: 241   HRIHGSLNYQTPMTKRLIA                                          259
             HRIHGSLNYQTPMTKRLIA
Sbjct: 241   HRIHGSLNYQTPMTKRLIA                                          259
```

There is also homology to SEQ ID 32.

Based on this analysis, it was predicted that this protein and its epitopes, could be useful antigens for vaccines or diagnostics.

Example 1972

A DNA sequence (GBSx2081) was identified in S. agalactiae <SEQ ID 6105> which encodes the amino acid sequence <SEQ ID 6106>. Analysis of this protein sequence reveals the following:

Possible site: 16
>>> Seems to have no N-terminal signal sequence
----- Final Results -----
   bacterial cytoplasm --- Certainty = 0.3325 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 1973

A DNA sequence (GBSx2082) was identified in *S. agalactiae* <SEQ ID 6107> which encodes the amino acid sequence <SEQ ID 6108>. Analysis of this protein sequence reveals the following:

```
Possible site: 59
>>> Seems to have no N-terminal signal sequence
----- Final Results -----
    bacterial cytoplasm --- Certainty = 0.4442 (Affirmative) <succ>
      bacterial membrane --- Certainty = 0.0000 (Not Clear) <succ>
        bacterial outside --- Certainty = 0.0000 (Not Clear) <succ>
```

A related GBS nucleic acid sequence <SEQ ID 9917> which encodes amino acid sequence <SEQ ID 9918> was also identified.

The protein has homology with the following sequences in the GENPEPT database.

```
>GP:AAD44095 GB:AF115103 orf359 gp [Streptococcus thermophilus
bacteriophage Sfi21]
Identities = 92/357 (25%), Positives = 162/357 (44%), Gaps = 33/357 (9%)
Query:  45  RKNQYGKTFETMKEAYDELVRIKYEFANKVSLENYNMTFENYMNKIYLRAYKQK-VQSVT  103
            RK +    F T  EA      ++ +  + V+++  ++T  +Y  K +   YK+  V  +T
Sbjct:  24  RKPKTKGGFRTKSEAIKAAAEMELKLQDNVNVDE-DITLYDYF-KQWCEVYKKPTVSKIT   81

Query: 104  YKTALPHHKLFIQYFGLKPLKAITPRDCEAFRLHIIENYSENYAKNLWSRF----KACMG  159
            YK +    +   +FG K LK+IT + +        ++ +Y++ +A++    RF    KAC+
Sbjct:  82  YKAYINSQRKIELFFGDKKLKSITATEYQ----RVLNSYAKTHAQDTVERFNVHVKACIE  137

Query: 160  YAERLGYISNMPCKALD---NPRGKHPETPFWTYAEFQTFIKSFDLHDYEELQRFTAIWL  216
              A    GYI    CK         +G+  ET F      E++   I   ++    + E    + A+++
Sbjct: 138  MAVHEGYIKRNFCKFAKINAKNKGRDIETKFLEVEEYERLI--YETSKHPEYASYAALYI  195

Query: 217  YYMTGVRVSEGLSLCWEDIDFDKKFLKVHTTLEKDENGNWYRKDQTKTPAGERLIELDDI  276
                  TG+R +E L  L   +DI  D     L V+ T +  N   +      TKT +   R I LDD
Sbjct: 196  IAKTGIRFAECLGLTVDDIKRDTGMLSVNKTWDYKNNTGFM---PTKTKSSIREIPLDDE  252

Query: 277  TIEVLQVWRKNQFANQDTDFIISRFGDPFCKSTICRIIKRKAQQVGVPVITGKGLRHSHA  336
              I  +    +Q       D   I+   +       T+ +I+ R+      +     LRH++A
Sbjct: 253  FINFI-----DQLPPTDDGRILPSLSNNAVNKTLRKIVGRE--------VRVHSLRHTYA  299

Query: 337  SYLINVLKKDILYVARRMGHADKSTTLNTYSHWFNALDKTVSEEITQNIKSAGLDSI    393
            SYLI     D++ V++ +GH + +  TL   Y+H         E+I Q     G  +++
Sbjct: 300  SYLI-AHDIDLISVSQVLGHENLNITLEVYAHQLQEQKSRNDEKIKQMWTECGRNAL    355
```

A related DNA sequence was identified in *S. pyogenes* <SEQ ID 6109> which encodes the amino acid sequence <SEQ ID 6110>. Analysis of this protein sequence reveals the following:

```
Possible site: 61
>>> Seems to have no N-terminal signal sequence
----- Final Results -----
   bacterial cytoplasm --- Certainty = 0.5549 (Affirmative) <succ>
     bacterial membrane --- Certainty = 0.0000 (Not Clear) <succ>
       bacterial outside --- Certainty = 0.0000 (Not Clear) <succ>
```

An alignment of the GAS and GBS proteins is shown below.

```
Identities = 111/127 (87%), Positives = 119/127 (93%)
Query: 242  LKVHTTLEKDENGNWYRKDQTKTPAGERLIELDDITIEVLQVWRKNQFANQDTDFIISRF  301
            LKVHTTLEKDENGNWYRKDQTKTPAGERLIELDD+TI VL+ WR+NQ  N DTDFIISRF
Sbjct:   1  LKVHTTLEKDENGNWYRKDQTKTPAGERLIELDDVTIVVLENWRRNQVVNTDTDFIISRF   60

Query: 302  GDPFCKSTICRIIKRKAQQVGVPVITGKGLRHSHASYLINVLKKDILYVARRMGHADKST  361
            G+PFCKSTICR+IK KAQ +GVPVITGKGLRHS+ASYLINVLKKDILYVA+ MGHADKST
Sbjct:  61  GEPFCKSTICRVIKHKAQSIGVPVITGKGLRHSYASYLINVLKKDILYVAKCMGHADKST  120

Query: 362  TLNTYSH                                                      368
            TLNTYSH
Sbjct: 121  TLNTYSH                                                      127
```

Based on this analysis, it was predicted that these proteins and their epitopes could be useful antigens for vaccines or diagnostics.

Example 1974

A DNA sequence (GBSx2083) was identified in *S. agalactiae* <SEQ ID 6111> which encodes the amino acid sequence <SEQ ID 6112>. Analysis of this protein sequence reveals the following:

```
>GP:AAC98432 GB:L29324 repressor protein [Streptococcus pneumoniae]
Identities = 38/65 (58%), Positives = 52/65 (79%), Gaps = 1/65 (1%)
Query:  2   MYRRLRDLREDNDFTQKYVAEK-LSFTHSAYSKIERGERILSADVIIKLSNLYNVSTDYL   60
            M +R+RDLRED+D TQ+YVA+  L+ T SAYSK+E G R++S D +IKL++ YNVS DYL
Sbjct:  1   MLKRIRDLREDDDLTQEYVAKTILNCTRSAYSKMESGTRLISIDDLIKLADFYNVSLDYL   60

Query: 61   LGQTD                                                         65
            +G+ D
Sbjct: 61   VGRVD                                                         65
```

Possible site: 20
>>> Seems to have no N-terminal signal sequence
----- Final Results -----
  bacterial cytoplasm --- Certainty = 0.3299 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes could be useful antigens for vaccines or diagnostics.

Example 1975

A DNA sequence (GBSx2084) was identified in *S. agalactiae* <SEQ ID 6113> which encodes the amino acid sequence <SEQ ID 6114>. This protein is predicted to be repressor protein-related protein. Analysis of this protein sequence reveals the following:

Possible site: 32
>>> Seems to have no N-terminal signal sequence
----- Final Results -----
  bacterial cytoplasm --- Certainty = 0.2721(Affirmative) <succ>
    bacterial membrane --- Certainty = 0.0000 (Not Clear) <succ>
      bacterial outside --- Certainty = 0.0000 (Not Clear) <succ>

A related GBS nucleic acid sequence <SEQ ID 9919> which encodes amino acid sequence <SEQ ID 9920> was also identified.

The protein has homology with the following sequences in the GENPEPT database.

There is also homology to SEQ ID 582.

Based on this analysis, it was predicted that this protein and its epitopes, could be useful antigens for vaccines or diagnostics.

Example 1976

A DNA sequence (GBSx2085) was identified in *S. agalactiae* <SEQ ID 6115> which encodes the amino acid sequence <SEQ ID 6116>. This protein is predicted to be relaxase. Analysis of this protein sequence reveals the following:

Possible site: 40
>>> Seems to have no N-terminal signal sequence
----- Final Results -----
  bacterial cytoplasm --- Certainty = 0.3160 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:AAC98434 GB:L29324 relaxase [Streptococcus pneumoniae]
Identities = 223/417 (53%), Positives = 310/417 (73%), Gaps = 5/417 (1%)
Query: 1     MVITKHYAVHGKKYRRQLIKYILDPKKTRNLSLISDFGMSNYLDFPDYVELVKMYQNNFL    60
             MVITKH+A+HGK YR +LIKYIL+P KT+NL+L+SDFGM NYLDFP Y ELVKMY +NFL
Sbjct: 1     MVITKHFAIHGKNYRSKLIKYILNPSKTKNLTLVSDFGMRNYLDFPSYKELVKMYNDNFL    60

Query: 61    SNDQLYDSRFDRQEKKQQKIHAHHIIQSFSPEDKLSPEEINRIGYETIKELIGGQYKFIV   120
             SND LY+ R DRQE  Q+KIH+HHIIQSFSP+D L+PE+INRIGYE  KEL GG+++FIV
Sbjct: 61    SNDTLYEFRHDRQEVNQRKIHSHHIIQSFSPDDHLTPEQINRIGYEAAKELTGGRERFIV   120

Query: 121   ATHVDQDHCHNHIIINSINSQSQKKLKWDYALERNLQMISDRISKVAGAKIIPPKRYSHR   180
             ATHVD+ H HNHII+NSI+  S KK   WDY  E NL+M+SDR+SK+AGAKII   RYSHR
Sbjct: 121   ATHVDKGHIHNHIILNSIDQNSDKKFLWDYKAEHNLRMVSDRLSKIAGAKII-ENRYSHR   179

Query: 181   DYEVYRRSNHKYELKQRLFFLMEHSIDFNDFMQKAEQLNVKIDFSRKHSRFFMTDRNMKQ   240
               YEVYR++N+KYE+KQR++FL+E+S +F D   +KA+ L++KIDF  KH   +FMTD NMKQ
Sbjct: 180   QYEVYRKTNYKYEIKQRVYFLIENSKNFEDLKKKAKALHLKIDFRHKHVTYFMTDSNMKQ   239

Query: 241   VIQGDKLNKREPYSKEYFQRYFAKKKIELILEFLLLRSNSFDDLVEKARLLGLELKSKKK   300
             V++  KL++++PY++ YF++ F +++I  ILEFLL +  + ++L+++A + GL++  K+K
Sbjct: 240   VVRDSKLSRKQPYNETYFEKKEVQREIINILEFLLPKMKNMNELIQRAEVEGLKIIPKEK   299

Query: 301   TIDFVLSDGKSCISIPNKSLRKKNLYDTTYFDSYFKEHDVFEVLHNNEVKIEFEKFETQQ   360
             + F   DG   I +  + L K NLY +YF  YF  +    VL N  +   +++ +  +
Sbjct: 300   HVLFEF-DG---IKLAEQELVKSNLYSVSYFQDYFNNKNETFVLDNKNLVELYNEEKIIK   355

Query: 361   LSEILTVEEITEAYETYKTKRDAVHEFEVEITEEQIEKIVLDGLFVKVWMGIGQEGL     417
                E+ + E + ++Y+ +K  RDAVHEFEVE+    QIE++V  G+++KV  GI ++ L
Sbjct: 356   EKELPSEEMVWKSYQDFKRNRDAVHEFEVELNLNQIEEVVEHGIYIKVQFGIDKKDL     412
```

A related DNA sequence was identified in *S. pyogenes* <SEQ ID 6117> which encodes the amino acid sequence <SEQ ID 6118>. Analysis of this protein sequence reveals the following:

---

Possible site: 20
>>> Seems to have no N-terminal signal sequence
----- Final Results -----
   bacterial cytoplasm --- Certainty = 0.3114 (Affirmative) <succ>
   bacterial membrane --- Certainty = 0.0000 (Not Clear) <succ>
   bacterial outside --- Certainty = 0.0000 (Not Clear) <succ>

---

An alignment of the GAS and GBS proteins is shown below.

```
Identities = 103/218 (47%), Positives = 170/218 (77%)
Query: 393   EEQIEKIVLDGLFVKVWMGIGQEGLIFIPNHQLNILEQENKKQYQVFIRETSSYFIYHKE   452
             E QIE+++ + +++KV  + Q GLIFIPN+QL+I ++EN K+Y+V+IRET+ +FIY+KE
Sbjct: 2     EHQIERLIAEDIYIKVSFSVKQSGLIFIPNYQLDIRKEENHKKYKVYIRETAQFFIYNKE   61

Query: 453   DSEMNRFMKGRDLIRQLTFDNKSLPYKRRISLVSLQQKIEEINLLMTLNIQNKSFLELKD   512
             SE+NR+M+G +LI QLT D+KS+P +RR ++ +L++KIEEI+LL+ L+ +NK + ++KD
Sbjct: 62    ASELNRYMRGHELICQLTNDSKSIPKRRRQTIDTLKKKIEEISLLIELDTENKPYQDIKD   121

Query: 513   ELVGDIAQLDIELTNLQDKNTTLNKMAEVVVNLQSDNQDTKQLAKYECSKMNLSQNVTIG   572
             ++V D+AQLD+ +T LQD     LNK+AEV++NL +++ + ++LA+Y+ +KMNL+ + I
Sbjct: 122   DIVKDMAQLDLTITELQDHIAHLNKVAEVLLNLNNNDIENRRLARYDYAKMNLTAAIKIE   181

Query: 573   QIESEIEMIQNQLDNKIEEYENAVRKLDEYVRVLNMDK                        610
             ++E EIE  QN+L+  I+EYE  VR+L+++   +L+  K
Sbjct: 182   EVEKEIETSQNELNISIDEYEYLVRRLEKFGEILSDSK                        219
```

Based on this analysis, it was predicted that these proteins and their epitopes could be useful antigens for vaccines or diagnostics.

Example 1977

A DNA sequence (GBSx2086) was identified in *S. agalactiae* <SEQ ID 6119> which encodes the amino acid sequence <SEQ ID 6120>. Analysis of this protein sequence reveals the following:

---

Possible site: 40
>>> Seems to have no N-terminal signal sequence
----- Final Results -----
   bacterial cytoplasm --- Certainty = 0.4006 (Affirmative) <succ>
   bacterial membrane --- Certainty = 0.0000 (Not Clear) <succ>
   bacterial outside --- Certainty = 0.0000 (Not Clear) <succ>

---

The protein has homology with the following sequences in the GENPEPT database.

```
>GP:AAC98436 GB:L29324 unknown [Streptococcus pneumoniae]
Identities = 53/115 (46%), Positives = 77/115 (66%), Gaps = 2/115 (1%)
Query:  5    VREIRKEVNFSIEEYQQIQNFMEQEGYEQFSPFARGKLLKIDHQPSQQLEEWIKYLQHQK    64
             +R IRK+   + E +QI + M ++G + FS F R  LL  D Q  +Q+E+W    + QK
Sbjct:  5    IRSIRKQFRLTETEEKQILDLMREKGDDNFSDFLRKSLLLSDGQ--KQMEKWFNLWKKQK    62

Query: 65    VEQIYRDVHEILVLAKLSQSVTMEHLEIILTCIKDLMKEIEVTIPLSYSFKDKYM       119
             +EQI RDVHE+ ++AK +  VT EH+ I+LTCI++L+KE+E T PLS  F +KYM
Sbjct: 63    LEQISRDVHEVFIIAKTNHQVTHEHVSILLTCIQELIKEVEKTGPLSEDFCNKYM       117
```

No corresponding DNA sequence was identified in *S. pyogenes*.

Based on this analysis, it was predicted that this protein and its epitopes, could be useful antigens for vaccines or diagnostics.

Example 1978

A DNA sequence (GBSx2087) was identified in *S. agalactiae* <SEQ ID 6121> which encodes the amino acid sequence <SEQ ID 6122>. This protein is predicted to be TnpA. Analysis of this protein sequence reveals the following:

Possible site: 34
>>> Seems to have no N-terminal signal sequence
----- Final Results -----
    bacterial cytoplasm --- Certainty = 0.2935 (Affirmative) <succ>
        bacterial membrane --- Certainty = 0.0000 (Not Clear) <succ>
            bacterial outside --- Certainty = 0.0000 (Not Clear) <succ>

The protein has homology with the following sequences in the GENPEPT database.

```
>GP:AAC82523 GB:AF027768 TnpA [Serratia marcescens]

Identities = 176/413 (42%), Positives = 243/413 (58%), Gaps = 18/413 (4%)
Query:  26   MMFKVEAVGPPERCPECGFD-KLYKHSSRNQLIMDLPIRLKRVGLHLNRRRYKCRECGST    84
             M F+V+ V P  C ECG   + +    R+     DLPI  KRV L + RRRY CR C +T
Sbjct:   1   MHFQVD-VPDPIACEECGVQGEFVRFGKRDVPYRDLPIHGKRVTLWVVRRRYTCRACKTT    59

Query:  85   IS------VDEKRSMTKRLLKSIQEQSMSKTFVEVAESVGVDEKTIRNVFKDYVALKERE   138
                        VD  R MT RL + ++++S +  +  VA   G+DEKT+R++F       R
Sbjct:  60   FRPQLPEMVDGFR-MTLRLHEYVEKESFNHPYTFVAAQTGLDEKTVRDIFNARAEFLGRW   118

Query: 139   YQFETPKWLGIDEIHIIRRPRLVLTNIERRTIYDIKPNRNKETVIQRLSEISDRTYIEYV   198
             ++FETP+ LGIDE+++ +R R +LTNIE RT+ D+   R ++ V   L ++ DR   +E V
Sbjct: 119   HRFETPRILGIDELYLNKRYRCILTNIEERTLLDLLATRRQDVVTNYLMKLKDRQKVEIV   178

Query: 199   TMDMWKPYKDAVNTILPQAKVVVDKFHVVRMANQALDNVRKSLKAHMSQKERRTLMRERF   258
             +MDMW PY+ AV  +LPQA++VVDKFHVVRMAN AL+ VRK L+  +   + RTL   +R
Sbjct: 179   SMDMWNPYRAAVKAVLPQARIVVDKFHVVRMANDALERVRKGLRKELKPSQSRTLKGDRK   238

Query: 259   ILLKRKHDLNERESFLLDTWLGNLPALKEAYELKEEFYWIWDTPDPDEGHLRYSQWRHRC   318
             ILLKR H++++RE   +++TW G  P L  AYE KE FY IWD    +    +W
Sbjct: 239   ILLKRAHEVSDRERLIMETWTGAFPQLLAAYEHKERFYGIWDATTRLQAEAALDEW-IAT   297

Query: 319   MSSNSKDAYKDLVRAVDNWHVEIFNYF--DKRLTNAYTESINSIIRQVERMGRGYSFDAL   376
             +     K+ + DLVRAV NW  E   YF D  +TNAYTESIN + +   R GRGYSF+ +
Sbjct: 298   IPKGQKEVWSDLVRAVGNWREETMTYFETDMPVTNAYTESINRLAKDKNREGRGYSFEVM   357

Query: 377   RAKILFNEKLHKKRKPRFNSSAFNKAMLYDTFNWYEVNDHDITDNLGVDFSTL         429
             RA++L+  K HKK+ P    S F K  +      Y + D    N GVD ST+
Sbjct: 358   RARMLYTTK-HKKKAPTAKVSPFYKKTI-----GYGLPDFAEELNYGVDLSTI         404
```

No corresponding DNA sequence was identified in *S. pyogenes*.

Based on this analysis, it was predicted that this protein and its epitopes, could be useful antigens for vaccines or diagnostics.

Example 1979

A DNA sequence (GBSx2088) was identified in *S. agalactiae* <SEQ ID 6123> which encodes the amino acid sequence <SEQ ID 6124>. This protein is predicted to be mercuric reductase. Analysis of this protein sequence reveals the following:

Possible site: 53
>>> Seems to have no N-terminal signal sequence
----- Final Results -----
    bacterial cytoplasm --- Certainty = 0.2115 (Affirmative) <succ>
        bacterial membrane --- Certainty = 0.0000 (Not Clear) <succ>
            bacterial outside --- Certainty = 0.0000 (Not Clear) <succ>

The protein has homology with the following sequences in the GENPEPT database.

```
>GP:CAA70224 GB:Y09024 mercuric reductase [Bacillus cereus]
Identities = 412/546 (75%), Positives = 484/546 (88%)
Query:   1    MNKFKVNISGMTCTGCEKHVESALEKIGAKNIESSYRRGEAVFELPDDIEVESAIKAIDE    60
              M K++V++ GMTCTGCE+HV  ALE +GA  IE  +RRGEAVFELP+ + VE+A KAI +
Sbjct:   1    MKKYRVDVQGMTCTGCEEHVAVALENMGATGIEVDFRRGEAVFELPNALGVETAKKAISD    60

Query:  61    ANYQAGEIEEVSSLENVALINEDNYDLLIIGSGAAAFSSAIKAIEYGAKVGMIERGTVGG   120
              A YQ G+ EEV S E V L NE +YD +IIGSG AAFSSAI+A++YGAKV MIERGT+GG
Sbjct:  61    AKYQPGKAEEVQSQEMVQLGNEGDYDYIIIGSGGAAFSSAIEAVKYGAKVAMIERGTIGG   120

Query: 121    TCVNIGCVPSKTLLRAGEINHLSKDNPFIGLQTSAGEVDLASLITQKDKLVSELRNQKYM   180
              TCVNIGCVPSKTLLRAGEINHL+K+NPF+GL TSAGEVDLA LI QK++LV+ELRN KY+
Sbjct: 121    TCVNIGCVPSKTLLRAGEINHLAKNNPFVGLHTSAGEVDLAPLIKQKNELVTELRNSKYV   180

Query: 181    DLIDEYNFDLIKGEAKFVDASTVEVNGTKLSAKRFLIATGASPSLPQISGLEKMDYLTST   240
              DLID+Y F+LI+GEAKFVD  TVEVNG  +SAKRFLIATGASP+ P I GL ++DYLTST
Sbjct: 181    DLIDDYGFELIEGEAKFVDEKTVEVNGAPISAKRFLIATGASPAKPNIPGLNEVDYLTST   240

Query: 241    TLLELKKIPKRLTVIGSGYIGMELGQLFHHLGSEITLMQRSERLLKEYDPEISESVEKAL   300
              +LLELKK+PKRL VIGSGYIGMELGQLFH+LGSE+TL+QRSERLLKEYDPEISESVEK+L
Sbjct: 241    SLLELKKVPKRLVVIGSGYIGMELGQLFHNLGSEVTLIQRSERLLKEYDPEISESVEKSL   300

Query: 301    IEQGINLVKGATFERVEQSGEIKRVYVTVNGSREVIESDQLLVATGRKPNTDSLNLSAAG   360
              +EQGINLVKGAT+ER+EQ+G+IK+V+V VNG + +IE+DQLLVATGR PNT +LNL AAG
Sbjct: 301    VEQGINLVKGATYERIEQNGDIKKVHVEVNGKKRIIEADQLLVATGRTPNTATLNLRAAG   360

Query: 361    VETGKNNEILINDFGQTSNEKIYAAGDVTLGPQFVYVAAYEGGIITDNAIGGLNKKIDLS   420
              VE G    EI+I+D+ +T+N +IYAAGDVTLGPQFVYVAAY+GG+     NAIGGLNKK++L
Sbjct: 361    VEIGSRGEIIIDDYSRTTNTRIYAAGDVTLGPQFVYVAAYQGGVAAPNAIGGLNKKLNLE   420

Query: 421    VVPAVTFTNPTVATVGLTEEQAKEKGYDVKTSVLPLDAVPRAIVNRETTGVFKLVADAET   480
              VVP VTFT P +ATVGLTE+QAKE GY+VKTSVLPLDAVPRA+VNRETTGVFKLVAD++T
Sbjct: 421    VVPGVTFTAPAIATVGLTEQQAKENGYEVKTSVLPLDAVPRALVNRETTGVFKLVADSKT   480

Query: 481    LKVLGVHIVSENAGDVIYAASLAVKFGLTIEDLTETLAPYLTMAEGLKLVALTFDKDISK   540
              +KVLG H+V+ENAGDVIYAA+LAVKFGLT++D+  ETLAPYLTMAEGLKL ALTFDKDISK
Sbjct: 481    MKVLGAHVVAENAGDVIYAATLAVKFGLTVDDIRETLAPYLTMAEGLKLAALTFDKDISK   540

Query: 541    LSCCAG   546
              LSCCAG
Sbjct: 541    LSCCAG   546
```

There is also homology to SEQ ID 1820.

Based on this analysis, it was predicted that this protein and its epitopes, could be useful antigens for vaccines or diagnostics.

Possible site: 36
>>> Seems to have no N-terminal signal sequence
----- Final Results -----
  bacterial cytoplasm --- Certainty = 0.4529 (Affirmative) <succ>
  bacterial membrane --- Certainty = 0.0000 (Not Clear) <succ>
  bacterial outside --- Certainty = 0.0000 (Not Clear) <succ>

Example 1980

A DNA sequence (GBSx2089) was identified in *S. agalactiae* <SEQ ID 6125> which encodes the amino acid sequence <SEQ ID 6126>. This protein is predicted to be regulatory protein. Analysis of this protein sequence reveals the following:

The protein has homology with the following sequences in the GENPEPT database.

```
>GP:AAA83973 GB:AF138877 mercury resistance operon negative
regulator MerR1 [Bacillus sp. RC607]
Identities = 83/129 (64%), Positives = 104/129 (80%)
Query:   1    MIYRISEFADKCGVNKETIRYYERKNLLQEPHRTEAGYRIYSYDDVKRVGFIKRIQEFGF    60
              M +RI E ADKCGVNKETIRYYER L+ EP RTE GYR+YS   V R+ FIKR+QE GF
Sbjct:   1    MKFRIGELADKCGVNKETIRYYERLGLIPEPERTEKGYRMYSQQTVDRLHFIKRQMELGF    60

Query:  61    SLSEIYKLLGVVDKDEVRCQDMFEFVSKKQKEVQKQIEDLKRIETMLDDLKQRCPDEKKL   120
              +L+EI KLLGVVD+DE +C+DM++F    K  +++Q++IEDLKRIE ML DLK+RCP+ K +
Sbjct:  61    TLNEIDKLLGVVDRDEAKCRDMYDFTILKIEDIQRKIEDLKRIERMLMDLKERCPENKDI   120

Query: 121    HSCPIIETL   129
              + CPIIETL
Sbjct: 121    YECPIIETL   129
```

There is also homology to SEQ ID 1712.

Based on this analysis, it was predicted that this protein and its epitopes, could be useful antigens for vaccines or diagnostics.

Example 1981

A DNA sequence (GBSx2090) was identified in *S. agalactiae* <SEQ ID 6127> which encodes the amino acid sequence <SEQ ID 6128>. Analysis of this protein sequence reveals the following:

```
ORF02021(439-666 of 1080)
GP|451734|gb|AAA18975.1||U05143(9-46 of 46) envelope glycoprotein {Simian
immunodeficiency virus} GP|451744|gb|AAA18980.1||U05148 envelope glycoprotein
{Simian immunodeficiency virus}
% Match = 3.2
% Identity = 38.5 % Similarity = 64.1
Matches = 15 Mismatches = 13 Conservative Sub.s = 10

336       366       396       426       456       486       516       546
RIPVQFKGCDDYYNENVGYPLSRINLEHYLTEGGVLYFVVYSKDVSPTVTYASLTPKVIKNVLPASDKKKRIKKKEDIFL
                                    :||  |  :  ||:|::||:   |:
                                    WGLTGNAGTTPTATTTTTTPRVVENVINESN------------
                                         10        20        30

576       606       636       666       696       726       756       786
LFWMAIIAKLLILPYPALQTSYKSRPCLRRSSLRKLTQIPFSIVTKVGNTNMKSITAFLQVKAYILPCLAKGPARIMV*W
                                    ||::  :|    |  |  |
------------------------PCIKDNSCAGLEQEP
                               40
```

Possible site: 44
>>> Seems to have no N-terminal signal sequence
INTEGRAL    Likelihood = −7.86    Transmembrane 80-96 (78-100)
----- Final Results -----
  bacterial membrane --- Certainty = 0.4142 (Affirmative) <succ>
    bacterial outside --- Certainty = 0.0000 (Not Clear) <succ>
      bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

A related GBS gene <SEQ ID 8943> and protein <SEQ ID 8944> were also identified. Analysis of this protein sequence reveals the following:

Lipop: Possible site: −1 Crend: 8
McG: Discrim Score: −13.52
GvH: Signal Score (−7.5): −6.14
Possible site: 44
>>> Seems to have no N-terminal signal sequence
ALOM program    count: 1 value: −7.86 threshold: 0.0
INTEGRAL    Likelihood = −7.86    Transmembrane 80-96 (78-100)
PERIPHERAL    Likelihood = 1.80    136
modified ALOM score: 2.07
*** Reasoning Step: 3

-continued

----- Final Results -----
  bacterial membrane --- Certainty = 0.4142 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the databases:

SEQ ID 8944 (GBS415) was expressed in *E. coli* as a His-fusion product. SDS-PAGE analysis of total cell extract is shown in FIG. 79 (lane 3; MW 21.2 kDa).

Example 1982

A DNA sequence (GBSx2092) was identified in *S. agalactiae* <SEQ ID 6129> which encodes the amino acid sequence <SEQ ID 6130>. Analysis of this protein sequence reveals the following:

Possible site: 14
>>> Seems to have no N-terminal signal sequence
----- Final Results -----
  bacterial cytoplasm --- Certainty = 0.3402 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1983

A DNA sequence (GBSx2093) was identified in *S. agalactiae* <SEQ ID 6131> which encodes the amino acid sequence <SEQ ID 6132>. This protein is predicted to be ATPase. Analysis of this protein sequence reveals the following:

Possible site: 27
>>> Seems to have no N-terminal signal sequence
INTEGRAL   Likelihood = −10.08   Transmembrane 324-340 (317-343)
INTEGRAL   Likelihood = −5.73    Transmembrane 662-678 (660-690)
INTEGRAL   Likelihood = −5.41    Transmembrane 350-366 (346-378)
INTEGRAL   Likelihood = −3.40    Transmembrane 94-110 (93-110)
INTEGRAL   Likelihood = −2.87    Transmembrane 681-697 (680-699)
INTEGRAL   Likelihood = −1.38    Transmembrane 148-164 (148-164)

```
>GP:AAA22858 GB:M90750 cadmium-efflux ATPase [Bacillus firmus]
Identities = 486/725 (67%), Positives = 584/725 (80%), Gaps = 18/725 (2%)
Query:   1  MSRGKAKQSEKEMKAYRVQGFTCTNCAAIFENNVKELPGVQDAKVNFGASKVYVKGTTTI   60
            MS  KA  SE+EMKAYRVQGFTC NCA  FE NVK+L GV+DAKVNFGASK+ V G  TI
Sbjct:   1  MSDQKAITSEQEMKAYRVQGFTCANCAGKFEKNVKQLSGVEDAKVNFGASKIAVYGNATI   60

Query:  61  EELEKAGAFENLKIRDEKEQRVGGE-----------PFWKQKENIKVYISALLLVVSWFL  109
            EELEKAGAFENLK+   EK  R   +           PF+K K +  +Y S LL+   +
Sbjct:  61  EELEKAGAFENLKVTPEKSARQASQEVKEDTKEDKVPFYK-KHSTLLYAS-LLITFGYLS  118

Query: 110  GEQYGEEHVLPTIGYAASILIGGYSLFIKGLKNLRRLNFDMNTLMTIAIIGAAIIGEWGE  169
               GEE+++ T+ + AS+ IGG SLF  GL+NL R  FDM TLMT+A+IG AIIGEW E
Sbjct: 119  SYVNGEENIVTTLLFLASMFIGGLSLFKVGLQNLLRFEFDMKTLMTVAVIGGAIIGEWAE  178

Query: 170  GATVVILFAISEALERYSMDKARQSIESLMDIAPKEALIRRGNEEMMIHVDEIQVGDIMI  229
              A VVILFAISEALER+SMD+ARQSI SLMDIAPKEAL++R  +E+MIHVD+I VGDIMI
Sbjct: 179  VAIVVILFAISEALERFSMDRARQSIRSLMDIAPKEALVKENGQEIMIHVDDIAVGDIMI  238

Query: 230  VKPGQKLAMDGIVVKGTSTLNQAAITGESVPVTKITNDEVFAGTLNEEGLLEVKVTKRVE  289
            VKPGQK+AMDG+VV G S +NQ AITGESVPV K  ++EVFAGTLNEEGLLEV++TK VE
Sbjct: 239  VKPGQKIAMDGVVVSGYSAVNQTAITGESVPVEKTVDNEVFAGTLNEEGLLEVEITKLVE  298

Query: 290  DTTLSKIIHLVEEAQAERAPSQAFVDKFAKYYTPAIVILALLIAVVPPL-FGGDWSQWIY  348
            DTT+SKIIHLVEEAQ ERAPSQAFVDKFAKYYTP I+I+A L+A+VPPL F G W  WIY
Sbjct: 299  DTTISKIIHLVEEAQGERAPSQAFVDKFAKYYTPIIMIIATLVAIVPPLFFDGSWETWIY  358

Query: 349  QGLAVLVVGCPCALVVSTPVAVVTAIGNAAKNGVLIKGGIHLEAAGHLKAIAFDKTGTLT  408
            QGLAVLVVGCPCALV+STP+++V+ AIGNAAK GVL+KGG++LE   G LKAIAFDKTGTLT
Sbjct: 359  QGLAVLVVGCPCALVISTPISIVSAIGNAAKKGVLVKGGVYLEEMGALKAIAFDKTGTLT  418

Query: 409  KGIPAVTD--IVTYGRNENELITITSAIEKGSQHPLASAIMRKAEENGLKFNEVTVEDFQ  466
            KG+PAVTD  ++      NE EL++I +A+E  SQHPLASAIM+KAEE  + +++V EDF
Sbjct: 419  KGVPAVTDYNVLNKQINEKELLSIITALEYRSQHPLASAIMKKAEEENITYSDVQVEDFS  478

Query: 467  SITGKGVKAKINNEMYYVGSQNLFEE-LHGSISSDKKEKIADMQTQGKTVMVLGTEKEIL  525
            SITGKG+K +N   YY+GS LF+E L     D ++ +  +Q QGKT M++GTEKEIL
Sbjct: 479  SITGKGIKGIVNGTTYYIGSPKLFKELLTNDFDKDLEQNVTTLQNQGKTAMIIGTEKEIL  538

Query: 526  SFIAVADEMRESSKEVIGKLNNMGI-ETVMLTGDNQRTATAIGKQVGVSDIKADLLPEDK  584
            + IAVADE+RESSKE++  KL+ +GI +T+MLTGDN+ TA AIG QVGVSDI+A+L+P+DK
Sbjct: 539  AVIAVADEVRESSKEILQKLHQLGIKKTIMLTGDNKGTANAIGGQVGVSDIEAELMPQDK  598

Query: 585  LNFIKELREKHQSVGMVGDGVNDAPALAASTVGVAMGGAGTDTALETADIALMSDDLSKL  644
            L+FIK+LR  +  +V MVGDGVNDAPALAASTVG+AMGGAGTDTALETAD+ALM DDL KL
Sbjct: 599  LDFIKQLRSEYGNVAMVGDGVNDAPALAASTVGIAMGGAGTDTALETADVALMGDDLRKL  658

Query: 645  PYTIKLSRKALAIIKQNITFSLAIKLVALLLVMPGWLTLWIAIFADMGATLLVTLNSLRL  704
            P T+KLSRK L IIK NITF++AIK +A LLV+PGWLTLWIAI +DMGATLLV LN LRL
Sbjct: 659  PSTVKLSRKTLNIIKANITFAIAIKFIASLLVIPGWLTLWIAILSDMGATLLVALNGLRL  718

Query: 705  LKIKE                                                        709
            +++KE
Sbjct: 719  MRVKE                                                        723
```

There is also homology to SEQ ID 3506.

Based on this analysis, it was predicted that this protein and its epitopes, could be useful antigens for vaccines or diagnostics.

Example 1984

A DNA sequence (GBSx2094) was identified in *S. agalactiae* <SEQ ID 6133> which encodes the amino acid sequence <SEQ ID 6134>. Analysis of this protein sequence reveals the following:

----- Final Results -----
  bacterial membrane --- Certainty = 0.5034 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

Possible site: 19
>>> Seems to have no N-terminal signal sequence
----- Final Results -----
  bacterial cytoplasm --- Certainty = 0.0779 (Affirmative) <succ>
  bacterial membrane --- Certainty = 0.0000 (Not Clear) <succ>
  bacterial outside --- Certainty = 0.0000 (Not Clear) <succ>

The protein has no significant homology with any sequences in the GENPEPT database.
No corresponding DNA sequence was identified in *S. pyogenes*.

Based on this analysis, it was predicted that this protein and its epitopes, could be useful antigens for vaccines or diagnostics.

Example 1985

A DNA sequence (GBSx2095) was identified in *S. agalactiae* <SEQ ID 6135> which encodes the amino acid sequence <SEQ ID 6136>. Analysis of this protein sequence reveals the following:

```
Possible site: 58
>>> Seems to have no N-terminal signal sequence
INTEGRAL    Likelihood = -8.92    Transmembrane 123-139 (115-145)
INTEGRAL    Likelihood = -6.74    Transmembrane 172-188 (167-190)
INTEGRAL    Likelihood = -1.81    Transmembrane 80-96 (80-96)
----- Final Results -----
    bacterial membrane --- Certainty = 0.4567 (Affirmative) <succ>
        bacterial outside --- Certainty = 0.0000 (Not Clear) <succ>
            bacterial cytoplasm --- Certainty = 0.0000 (Not Clear) <succ>
```

A related GBS nucleic acid sequence <SEQ ID 9923> which encodes amino acid sequence <SEQ ID 9924> was also identified.

The protein has no significant homology with any sequences in the GENPEPT database, but there is homology to SEQ ID 4216.

A related GBS gene <SEQ ID 8945> and protein <SEQ ID 8946> were also identified. Analysis of this protein sequence reveals the following:

```
Lipop: Possible site: -1 Crend: 10
McG: Discrim Score: -6.41
GvH: Signal Score (-7.5): -2.23
Possible site: 58
>>> Seems to have no N-terminal signal sequence
ALOM program count: 3 value: -8.92 threshold: 0.0
INTEGRAL      Likelihood = -8.92    Transmembrane 123-139 (115-145)
INTEGRAL      Likelihood = -6.74    Transmembrane 172-188 (167-190)
INTEGRAL      Likelihood = -1.81    Transmembrane 80-96 (80-96)
PERIPHERAL    Likelihood = 2.92     46
modified ALOM score: 2.28
*** Reasoning Step: 3
----- Final Results -----
    bacterial membrane --- Certainty = 0.4567 (Affirmative) <succ>
        bacterial outside --- Certainty = 0.0000 (Not Clear) <succ>
            bacterial cytoplasm --- Certainty = 0.0000 (Not Clear) <succ>
```

Based on this analysis, it was predicted that these proteins and their epitopes could be useful antigens for vaccines or diagnostics.

Example 1986

A DNA sequence (GBSx2096) was identified in *S. agalactiae* <SEQ ID 6137> which encodes the amino acid sequence <SEQ ID 6138>. This protein is predicted to be histidine rich P type ATPase (HRA-1) (copB). Analysis of this protein sequence reveals the following:

```
Possible site: 54
>>> Seems to have no N-terminal signal sequence
INTEGRAL    Likelihood = -13.37   Transmembrane 318-334 (307-345)
INTEGRAL    Likelihood = -5.84    Transmembrane 347-363 (335-364)
INTEGRAL    Likelihood = -5.15    Transmembrane 88-104 (86-112)
INTEGRAL    Likelihood = -5.04    Transmembrane 651-667 (649-669)
INTEGRAL    Likelihood = -4.30    Transmembrane 156-172 (155-173)
INTEGRAL    Likelihood = -4.30    Transmembrane 669-685 (668-690)
INTEGRAL    Likelihood = -3.03    Transmembrane 62-78 (60-80)
----- Final Results -----
    bacterial membrane --- Certainty = 0.6349 (Affirmative) <succ>
        bacterial outside --- Certainty = 0.0000 (Not Clear) <succ>
            bacterial cytoplasm --- Certainty = 0.0000 (Not Clear) <succ>
```

The protein has homology with the following sequences in the GENPEPT database.

```
>GP:AAA62113 GB:U16658 histidine rich P type ATPase [Escherichia coli]
Identities = 598/731 (81%), Positives = 651/731 (88%), Gaps = 36/731 (4%)
Query:   1  MRNNKKHSSHSHHNHGDIDHSKHDHNEMEHSQMDHS----------------------  36
            MRNNK+HSSHSHHNHGD++HSKHDHNEMEHSQMDHS
Sbjct:   1  MRNNKQHSSHSHHNHGDMEHSKHDHNEMEHSQMDHSAMGHCAMGGHAHHHHGDMDHSKHD  60

Query:  37  ------------NMDHSEMDHGAMGGHAHHHHGSFKEIFLKSLPLGIAILLITPMMDIQL  84
                        MD+SEMDHGAMGGHAHHHHGSFK+IFLKSLPLGIAILLITP+M IQL
Sbjct:  61  HNEMKHSQMDHSKMDYSEMDHGAMGGHAHHHHGSFKDIFLKSLPLGIAILLITPLMGIQL  120

Query:  85  PFQIIFPYADVVAAVLATILYIFGGKPFYMGAKDEFNSKAPGMMSLITLGITVSYAYSVY  144
            PFQIIFPYADVVAAVLATILYIFGGKPF MGAKDEFNSK PGMMSLITLGITVSYAYSVY
Sbjct: 121  PFQIIFPYADVVAAVLATILYIFGGKPFLMGAKDEFNSKVPGMMSLITLGITVSYAYSVY  180

Query: 145  AVAARYVTGEHVMDFFFEFTTLILIMLLGHWIEMKALGEAGDAQKALAELVPKDAHVVLE  204
            AVAARYVTGE VMDFFFEFTTLILIMLLGHWIEMKALGEAG+AQKALAELVPKDAHVVLE
Sbjct: 181  ANAARYVTGEPVMDFFFEFTTLILIMLLGHWIEMKALGEAGNAQKALAELVPKDAHVVLE  240

Query: 205  DDSIETRPVSELQIGDVIRVQAGENVPADGIIIRGESRVNEALVTGESKPIEKKTGDEVI  264
            DDSIETRPV++LQ+GD+IRVQAGENVPADG I RGESRVNEALVTGESKPIEK GDEVI
Sbjct: 241  DDSIETRPVADLQVGDLIRVQAGENVPADGTIQRGESRVNEALVTGESKPIEKNPGDEVI  300

Query: 265  GGSTNGGGVLYVEIKQTGDQSFISQVQTLISQAQSQPSRAENVAQKVASWLFYIAVVVAL  324
            GGSTNG GVLYVEIKQTGD+SFISQVQTLISQAQSQPSRAEN+AQKVA WLFYIAV+ AL
Sbjct: 301  GGSTNGDGVLYVEIKQTGDKSFISQVQTLISQAQSQPSRAENLAQKVAGWLFYIAVIAAL  360

Query: 325  IALLIWTIIADLPTAVIFTVTALVIACPHALGLAIPLVVSRSTSLGASRGLLVKNREALE  384
            IAL+IW +IAD+PTAVIFTVT LVIACPHALGLAIPLV +RSTSLGASRGLLVK+R+ALE
Sbjct: 361  IALVIWMVIADVPTAVIFTVTTLVIACPHALGLAIPLVTARSTSLGASRGLLVKDRDALE  420

Query: 385  LTTKADVMVLDKTGTLTTGEFKVLDVTVLSDKYSEEEITGLLAGIEAGSSHPIAQSIVNH  444
```

```
                LTT ADVMVLDKTGTLTTGEFKVLDV + +DKY+++EI   LL+GIE GSSHPIAQSI+++
Sbjct: 421      LITNADVMVLDKTGTLTTGEFKVLDVELFNDKYTKDEIVALLSGIEGGSSHPIAQSIISY  480

Query: 445      AEAKGIKSVSFDSIEIVSGAGIEGEANGHHYQLISQKAYGKALRMDIPKGATLSILVENN  504
                AE +GI+ VSFDSI+++SGAG+EG+ANGH YQLISQKAYG+ L MDIPKGAT+S+LVEN+
Sbjct: 481      AEQQGIRPVSFDSIDVMSGAGVEGQANGHRYQLISQKAYGRNLDMDIPKGATISVLVEND  540

Query: 505      EAIGAVALGDELKETSRNLIEVLKKYGIEPLMATGDNEEAAQGVAEVLGIQYQANQSPED  564
                EAIGAVALGDELK TS++LI+ LKK   I+P+MATGDNE+AAQG AE+LGI Y ANQSP+D
Sbjct: 541      EAIGAVALGDELKPTSKDLIQALKKNKIQPIMATGDNEKAAQGAAEILGIDYLANQSPQD  600

Query: 565      KYKLVESMKNQNKTVIMVGDGVNDAPSLALADVGIAIGAGTQVALDSADIILTQSDPGDI  624
                KY+LVE +K + K VIMVGDGVNDAPSLALADVGIAIGAGTQVALDSADIILTQ  PGDI
Sbjct: 601      KYELVEKLKAEGKKVIMVGDGVNDAPSLALADVGIAIGAGTQVALDSADIILTQYSPGDI  660

Query: 625      ESFIELANKTTRKMKQNLVWGAGYNFIAIPIAAGLLAPIGITLGPAFGAVLMSLSTVIVA  684
                 SFIELA KTTRKMK+NLVWGAGYNFIAIPIAAG+LAPIGITL PA  AVLMSLSTVIVA
Sbjct: 661      ASFIELAQKTTRKMKENLVWGAGYNFIAIPIAAGILAPIGITLSPAVAAVLMSLSTVIVA  720

Query: 685      INAMTLKLEPK                                                  695
                INAMTLKLEPK
Sbjct: 721      INAMTLKLEPK                                                  731
```

There is also homology to SEQ ID 3506.

A related GBS gene <SEQ ID 8947> and protein <SEQ ID 8948> were also identified. Analysis of this protein sequence reveals the, following:

Lipop: Possible site: −1 Crend: 7
McG: Discrim Score: −19.12
GvH: Signal Score (−7.5): −3.71
Possible site: 27
>>> Seems to have no N-terminal signal sequence
ALOM program count: 7 value: −13.37  threshold: 0.0
INTEGRAL    Likelihood = −13.37    Transmembrane 291-307 (280-318)
INTEGRAL    Likelihood = −5.84     Transmembrane 320-336 (308-337)
INTEGRAL    Likelihood = −5.15     Transmembrane 61-77 (59-85)
INTEGRAL    Likelihood = −5.04     Transmembrane 624-640 (622-642)
INTEGRAL    Likelihood = −4.30     Transmembrane 129-145 (128-146)
INTEGRAL    Likelihood = −4.30     Transmembrane 642-658 (641-663)
INTEGRAL    Likelihood = −3.03     Transmembrane 35-51 (33-53)
PERIPHERAL  Likelihood = 0.74      103
modified ALOM score: 3.17
*** Reasoning Step: 3
----- Final Results -----
    bacterial membrane --- Certainty = 0.6349 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
ORF02015(220-2304 of 2604)
EGAD|37454|38974(1-731 of 731) histidine rich P type ATPase (HRA-1) {Escherichia coli}
GP|643613|gb|AAA62113.1||U16658 histidine rich P type ATPase {Escherichia coli}
PIR|JC2464|JC2464 probable copper-transporting ATPase (EC 3.6.1.−) HRA-1 -
Enterobacteriaceae spp.
% Match = 67.4
% Identity = 85.9 % Similarity = 93.7
Matches = 598 Mismatches = 43 Conservative Sub.s = 54

162       192       222       252
           PFRENYM*C*MRKF*NFKISL*YNKEELKMRNNKKHSSHSHHNHGDI---------------------------------
                        |||||:|||||||||||:
                                         MRNNKQHSSHSHHNHGDMEHSKHDHNEMEHSQMDHSAMGHCAMGGHAHHHH
                                                  10        20        30        40        50

294       324       354       384       414       444       474       504
           ---DHSKHDHNEMEHSQMDHSNMDHSEMDHGAMGGHAHHHGSFKEIFLKSLPLGIAILLITPMMDIQLPFQIIFPYADV
              ||||||||||||:||||||    ||  |||||||||||||:||||||||||||||||||:|||||||||||||||
           GDMDHSKHDHNEMEHSQMDHSKMDYSEMDHGAMGGHAHHHHGSFKDIFLKSLPLGIAILLITPLMGIQLPFQIIFPYADV
                    70        80        90       100       110       120       130

534       564       594       624       654       684       714       744
           VAAVLATILYIFGGKPFYMGAKDEFNSKAPGMMSLITLGITVSYAYSVYAVAARYVTGEHVMDFFFEFTTLILIMLLGHW
           ||||||||||||||||| |||||||||| |||||||||||||||||||||||||||||| |||||||||||||||||||
           VAAVLATILYIFGGKPFLMGAKDEFNSKVPGMMSLITLGITVSYAYSVYAVAARYVTGEPVMDFFFEFTTLILIMLLGHW
                         150       160       170       180       190       200       210

774       804       834       864       894       924       954       984
           IEMKALGEAGDAQKALAELVPKDAHVVLEDDSIETRPVSELQIGDVIRVQAGENVPADGIIIRGESRVNEALVTGESKPI
           |||||||||| |:|||||||||||||||||||||||| ::||:|:|||||||||||||| | ||||||||||||||||
           IEMKALGEAGNAQKALAELVPKDAHVVLEDDSIETRPVADLQVGDLIRVQAGENVPADGTIQRGESRVNEALVTGESKPI
                    230       240       250       260       270       280       290
```

-continued

```
      1014        1044        1074        1104        1134        1164        1194        1224
EKKTGDEVIGGSTNGGGVLYVEIKQTGDQSFISQVQTLISQAQSQPSRAENVAQKVASWLFYIAVVVALIALLIWTIIAD
|| ||||||||| |||||||||||| :|||| |||||||: |||| |||||:|| :|||
EKNPGDEVIGGSTNGDGVLYVEIKOTGDKSFISOVOTLISQAQSQPSRAENLAQKVAGWLFYIAVIAALIALVIWMVIAD
             310         320         330         340         350         360         370

1254        1284        1314        1344        1374        1404        1434        1464
LPTAVIFTVTALVIACPHALGLAIPLVVSRSTSLGASRGLLVKNREALELTTKADVMVLDKTGTLTTGEFKVLDVTVLSD
:||||||||| |||||||||||||| :|||||||||||:|:|||||| |||||||||||||||| :::|
VPTAVIFTVTTLVIACPHALGLAIPLVTARSTSLGASRGLLVKDRDALELTTNADVMVLDKTGTLTTGEFKVLDVELFND
             390         400         410         420         430         440         450

1494        1524        1554        1584        1614        1644        1674        1704
KYSEEEITGLLAGIEAGSSHPIAQSIVNHAEAKGIKSVSFDSIEIVSGAGIEGEANGHHYQLISQKAYGKALRMDIPKGA
||::|| ||:||| |||||||||||:::|| :||: |||||||:::||||:||:|||| |||||||||: | ||||||
KYTKDEIVALLSGIEGGSSHPIAQSIISYAEQQGIRPVSFDSIDVMSGAGVEGQANGHRYQLISQKAYGRNLDMDIPKGA
             470         480         490         500         510         520         530

1734        1764        1794        1824        1854        1884        1914        1944
TLSILVENNEAIGAVALGDELKETSRNLIEVLKKYGUEPLMATGDNEEAAQGVAEVLGIQYQANQSPEDKYKLVESMKNQ
|:|:|||| :|||||||||||| ||::||| ||| |:||||||||||:||| ||:|||| |:||| :| :
TISVLVENDEAIGAVALGDELKPTSKDLIQALKKNKIQPIMATGDNEKAAQGAAEILGIDYLANQSPQDKYELVEKLKAE
             550         560         570         580         590         600         610

1974        2004        2034        2064        2094        2124        2154        2184
NKTVIMVGDGVNDAPSLALADVGIAIGAGTQVALDSADIILTQSDPGDIESFIELANKTTRKMKQNLVWGAGYNFIAIPI
| ||||||||||||||||||||||||||||||||||||||| |||| ||||||| ||||||:|||||||||||||
GKKVIMVGDGVNDAPSLALADVGIAIGAGTQVALDSADIILTQYSPGDIASFIELAQKTTRKMKENLVWGAGYNFIAIPI
             630         640         650         660         670         680         690

2214        2244        2274        2304        2334        2364        2394        2424
AAGLLAPIGITLGPAFGAVLMSLSTVIVAINAMTLKLEPK*NEAGTKKHWLV*PPSRIGSDQLVCCIRKIIDR*IFDKNR
|||:||||||||| || ||||||||||||||||||||||
AAGILAPIGITLSPAVAAVLMSLSTVIVAINAMTLKLEPK
             710         720         730
```

Based on this analysis, it was predicted that these proteins and their epitopes could be useful antigens for vaccines or diagnostics.

Example 1987

A DNA sequence (GBSx2097) was identified in *S. agalactiae* <SEQ ID 6139> which encodes the amino acid sequence <SEQ ID 6140>. This protein is predicted to be CopA. Analysis of this protein sequence reveals the following:

Possible site: 59
>>> Seems to have no N-terminal signal sequence
----- Final Results -----
   bacterial cytoplasm --- Certainty = 0.2197 (Affirmative) <succ>
      bacterial membrane --- Certainty = 0.0000 (Not Clear) <succ>
         bacterial outside --- Certainty = 0.0000 (Not Clear) <succ>

The protein has homology with the following sequences in the GENPEPT database.

```
>GP:CAA40599 GB:X57326 ORF-1 [Thiobacillus ferrooxidans]
Identities = 26/65 (40%), Positives = 40/65 (61%), Gaps = 2/65 (3%)
Query:  1    MKQEILL--DGVKCAGCANTVQERFSAIEGVESVEVDLATKKAVLESQTEIDTETLNAAL   58
             M Q+I L   G+ CA CA++V++    I G++S +V LAT +A +  Q+ I TE L AA+
Sbjct:  1    MSQKIFLRITGMTCAHCAHSVEKALLGIHGIDSAQVSLATNQAEVFLQSSIPTEALLAAV   60

Query: 59    AETNY                                                         63
             + Y
Sbjct: 61    TQAGY                                                         65
```

There is also homology to SEQ ID 3510.

Based on this analysis, it was predicted that this protein and its epitopes, could be useful antigens for vaccines or diagnostics.

Example 1988

A DNA sequence (GBSx2098) was identified in *S. agalactiae* <SEQ ID 6141> which encodes the amino acid sequence <SEQ ID 6142>. Analysis of this protein sequence reveals the following:

Possible site: 28
>>> Seems to have no N-terminal signal sequence
----- Final Results -----
   bacterial cytoplasm --- Certainty = 0.3220 (Affirmative) <succ>
      bacterial membrane --- Certainty = 0.0000 (Not Clear) <succ>
         bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1989

A DNA sequence (GBSx2099) was identified in *S. agalactiae* <SEQ ID 6143> which encodes the amino acid sequence <SEQ ID 6144>. This protein is predicted to be heavy-metal transporting P-type ATPase (b0484). Analysis of this protein sequence reveals the following:

Possible site: 27
>>> Seems to have no N-terminal signal sequence
INTEGRAL    Likelihood = −4.09    Transmembrane 131-147 (130-150)
----- Final Results -----
    bacterial membrane --- Certainty = 0.2635 (Affirmative) <succ>
        bacterial outside --- Certainty = 0.0000 (Not Clear) <succ>
            bacterial cytoplasm --- Certainty = 0.0000 (Not Clear) <succ>

The protein has homology with the following sequences in the GENPEPT database.

A related DNA sequence was identified in *S. pyogenes* <SEQ ID 3505> which encodes the amino acid sequence <SEQ ID 3506>. Analysis of this protein sequence reveals the following:

Possible site: 36
>>> Seems to have no N-terminal signal sequence
INTEGRAL    Likelihood = −10.83    Transmembrane 328-344 (314-348)
INTEGRAL    Likelihood = −7.01    Transmembrane 354-370 (347-377)
INTEGRAL    Likelihood = −3.24    Transmembrane 101-117 (100-117)
INTEGRAL    Likelihood = −2.97    Transmembrane 165-181 (165-185)
INTEGRAL    Likelihood = −2.34    Transmembrane 665-681 (662-684)
INTEGRAL    Likelihood = −2.18    Transmembrane 67-83 (66-83)
INTEGRAL    Likelihood = −0.64    Transmembrane 491-507 (490-508)
INTEGRAL    Likelihood = −0.59    Transmembrane 691-707 (691-707)
INTEGRAL    Likelihood = −0.43    Transmembrane 140-156 (139-156)
----- Final Results -----
    bacterial membrane --- Certainty = 0.5331 (Affirmative) <succ>
        bacterial outside --- Certainty = 0.0000 (Not Clear) <succ>
            bacterial cytoplasm --- Certainty= 0.0000 (Not Clear) <succ>

```
>GP:AAB01764 GB:U42410 heavy-metal transporting P-type ATPase
[Proteus mirabilis]
Identities = 98/153 (64%), Positives = 123/153 (80%)
Query: 2     KAVKALRRRGVEVIMITGDNKRTAKAIAKQVGIDSVLSEVLPEDKAEEVKKLQEAGKKVA    61
             +A+KAL   G++V MITGDNK TAKAIAKQ+GID +++EVLP+ K   +K+L + G KVA
Sbjct: 649   EAIKALHALGLKVAMITGDNKATAKAIAKQLGIDEIVAEVLPDGKVAALKQLSQKGDKVA    708

Query: 62    MVGDGINDAPALAQANVGIAVGSGTDVAIESADIVLMRNDLTAVLTTIDLSHATLRNIKQ    121
              VGDGINDAPALAQA+VG+A+G+GTDVAIE+AD+VLM   DL  V+   I  LS AT+RNIKQ
Sbjct: 709   FVGDGINDAPALAQADVGLAIGTGTDVAIEAADVVLMSGDLRGVVDAIALSQATIRNIKQ    768

Query: 122   NLFWAFAYNLVGIPVAMGLLYIFGGLLMSPMLA                             154
             NLFW FAYN + IPVA G+LY   G+L+SP+ A
Sbjct: 769   NLFWTFAYNALLIPVAAGMLYPINGMLLSPIFA                             801
```

An alignment of the GAS and GBS proteins is shown below.

```
Identities = 92/152 (60%), Positives = 123/152 (80%)

Query: 4     VKALRRRGVEVIMITGDNKRTAKAIAKQVGIDSVLSEVLPEDKAEEVKKLQEAGKKVAMV    63
             V+AL  + G+  IM+TGD+  TAKAIA QVGI  V+S+VLP+ KA   +   L+  G+KVAMV
Sbjct: 544   VEALHQLGIHTIMLTGDHDATAKAIASQVGITDVISQVLPDQKAGVIADLRSQGRKVAMV    603

Query: 64    GDGINDAPALAQANVGIAVGSGTDVAIESADIVLMRNDLTAVLTTIDLSHATLRNIKQNL    123
             GDGINDAPALA A++GIA+GSGTD+AIESAD++LM+ D+   ++   + LS   T+R +K+NL
Sbjct: 604   GDGINDAPALAVADIGIAMGSGTDIAIESADVILMKPDMLDLVEAMSLSRVTMRIVKENL    663

Query: 124   FWAFAYNLVGIPVAMGLLYIEGGLLMSPMLAG                              155
             FWAF YN++ IPVAMGLL++FGG L++PMLAG
Sbjct: 664   FWAFIYNVLMIPVAMGLLHLFGGPLLNPMLAG                              695
```

Based on this analysis, it was predicted that these proteins and their epitopes could be useful antigens for vaccines or diagnostics.

Example 1990

A DNA sequence (GBSx2100) was identified in *S. agalactiae* <SEQ ID 6145> which encodes the amino acid sequence <SEQ ID 6146>. This protein is predicted to be CopY. Analysis of this protein sequence reveals the following:

Possible site: 23
>>> Seems to have no N-terminal signal sequence
----- Final Results -----
  bacterial cytoplasm --- Certainty = 0.2067 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:AAG10085 GB:AF296446 CopY [Streptococcus mutans]
Identities = 63/139 (45%), Positives = 96/139 (68%.)
Query:   8  TSITDAEWEVMRVVWANDLVTSKTVISVLKEKMDWTESTIKTILGRLVEKGVLNTEQEGR   67
            TSI++AEWEVMRVVWA  + +S  +I++L    W+ STIKT++ RL EKG L ++++GR
Sbjct:   2  TSISNAEWEVMRVVWAKQMTSSSEIIAILSRTYCWSASTIKTLITRLSEKGYLTSQRQGR   61

Query:  68  KFIYTANIVEKEAVRDFAEDIENRICKKKVGNVIGSIIEDHVLSFDDIDRLEKILEIKKS  127
            K+IY++ I E+EA+     ++F+RIC  K   +I  ++E+  ++ DI++LE +L  KK+
Sbjct:  62  KYIYSSLISEEEALEQQVSEVFSRICVTKHQALIRHLVEETPMTLSDIEKLEALLLSKKA  121

Query: 128  FAVEEVDCQCTEGQCDCHE                                           146
            AV EV C C  GQC C+E
Sbjct: 122  NAVPEVKCNCIVGQCSCYE                                           140
```

There is also homology to SEQ ID 3502.

Based on this analysis, it was predicted that this protein and its epitopes, could be useful antigens for vaccines or diagnostics.

Example 1991

A DNA sequence (GBSx2101) was identified in *S. agalactiae* <SEQ ID 6147> which encodes the amino acid sequence <SEQ ID 6148>. Analysis of this protein sequence reveals the following:

Possible site: 29
>>> Seems to have no N-terminal signal sequence
----- Final Results -----
  bacterial cytoplasm --- Certainty = 0.2829 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 1992

A DNA sequence (GBSx2102) was identified in *S. agalactiae* <SEQ ID 6149> which encodes the amino acid sequence <SEQ ID 6150>. This protein is predicted to be DS RF protein. Analysis of this protein sequence reveals the following:

Possible site: 57
>>> Seems to have a cleavable N-term signal seq.

-continued

| INTEGRAL | Likelihood = −13.21 | Transmembrane 142-158 (136-169) |
| INTEGRAL | Likelihood = −3.45 | Transmembrane 70-86 (66-88) |
| INTEGRAL | Likelihood = −3.13 | Transmembrane 178-194 (176-195) |

----- Final Results -----
  bacterial membrane --- Certainty = 0.6286 (Affirmative) <succ>
    bacterial outside --- Certainty = 0.0000 (Not Clear) < succ>
      bacterial cytoplasm --- Certainty = 0.0000 (Not Clear) < succ>

The protein has homology with the following sequences in the GENPEPT database.

```
>GP:AAA26611 GB:L10909 putative [Staphylococcus aureus]
Identities = 98/204 (48%), Positives = 148/204 (72%), Gaps = 3/204 (1%)
Query:   4  TIISAIGVYISTSIDYLIVLIILFAQLSQNKQKWHIYAGQYLGTGLLVGASLVAAY-VVN   62
            TI++A  VY++T IDYL++LI+LF+Q+ + + K HI+ GQY+GT +++GASL+ A  VVN
Sbjct:  18  TILTATAVYVATGIDYLVLILLLFSQVKKGQVK-HIWIGQYIGTAIVIGASLLVAQGVVN   76

Query:  63  FVPEAWMVGLLGLIPIYLGIRFAIVGEGEEEEEEIIERLEQSKANQLFWTVTLLTIASG  122
            +P+ W++GLLGL+P+YLG++   I GE E+E+E  I+       K NQLF T+  + +AS
Sbjct:  77  LIPQQWVIGLLGLLPLYLGVKIWIKGE-EDEDESSILSLFSSGKFNQLFLTMIFIVLASS  135

Query: 123  GDNLGIYIPYFASLDWSQTLVVLLVFAIGIIIFCELSWVLSSIPLISETIEKYQRIIVPL  182
            D+  IYIPYF +L   S+   +V +VF I  +  C +S+ L+S   ISETIEKY+R IVP+
```

```
                                                          -continued
Sbjct: 136  ADDFSIYIPYFTTLSMSEIFIVTIVFLIMVGVLCYVSYRLASFDFISETIEKYERWIVPI  195

Query: 183  VFIPLGLYIMYESGTIETFLNFIL                                      206
            VFI LG+YI++E+GT   ++F+L
Sbjct: 196  VFIGLGIYILFENGTSNALISFLL                                      219
```

A related DNA sequence was identified in *S. pyogenes* <SEQ ID 6151> which encodes the amino acid sequence <SEQ ID 6152>. Analysis of this protein sequence reveals the following:

---

Possible site: 34
>>> Seems to have an uncleavable N-term signal seq
INTEGRAL    Likelihood = −13.16    Transmembrane 143-159 (135-165)
INTEGRAL    Likelihood = −9.13     Transmembrane 49-65 (43-71)
INTEGRAL    Likelihood = −7.17     Transmembrane 73-89 (72-94)
INTEGRAL    Likelihood = −6.00     Transmembrane 13-29 (9-33)
INTEGRAL    Likelihood = −2.71     Transmembrane 180-196 (179-197)
INTEGRAL    Likelihood = −0.59     Transmembrane 112-128 (109-128)
----- Final Results -----
  bacterial membrane --- Certainty = 0.6265 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the databases:

```
>GP:AAF42284 GB:AE002544 cadmium resistance protein [Neisseria
meningitidis MC58]

Identities = 201/208 (96%), Positives = 205/208 (97%)
Query:   1  MRCFMIQNVVTSIILYSGTAVDLLIILMLFFAKRKSRKDIINIYIGQFLGSVSLILLSLL   60
            MRCFMIQNVVTSIILYSGTAVDLLIILMLFFAKRKSRKDIINIYLGQFLGSVSLILLSLL
Sbjct:   1  MRCYMIQNVVTSIILYSGTAVDLLIILMLFFAKRKSRKDIINIYLGQFLGSVSLILLSLL   60

Query:  61  FAFVLDYIPSKEILGLLGLIPIFLGLKVLLLGDSDGEAIAKEGLSKDNKNLIFLVAMITF  120
            FAFVLDYIPSKEILGLLGLIPI LG+KVLLLGDSDGEAIAKEGL KDNKNLIFLVAMITF
Sbjct:  61  FAFVLDYIPSKEILGLLGLIPILLGIKVLLLGDSDGEATAKEGLRKDNKNLIFLVAMITF  120

Query: 121  ASCGADNIGVFVFYFTTLNLANLIVALLTFLVMIYLLVFSAQKLAQVPSVGETLEKYSRW  180
            ASCGADNIGVFVPYFTTLNLANLIVALLTFLVMIYLLVFSAQKLAQVPSVGETLEKYSRW
Sbjct: 121  ASCGADNIGVFVPYFTTLNLANLIVALLTFLVMIYLLVFSAQKLAQVPSVGETLEKYSRW  180

Query: 181  FIAVVYLGLGMYILIENNSFDMLWAVLG                                  208
            F+AVVYLGLG+YIL+ENNSFDMLW VLG
Sbjct: 181  FVAVVYLGLGIYILVENNSFDMLWTVLG                                  208
```

SEQ ID 6150 (GBS174) was expressed in and purified from *E. coli*. The purified protein is shown in lane 7 of FIG. 223.

Based on this analysis, it was predicted that this protein and its epitopes, could be useful antigens for vaccines or diagnostics.

Example 1993

A DNA sequence (GBSx2103) was identified in *S. agalactiae* <SEQ ID 6153> which encodes the amino acid sequence <SEQ ID 6154>. This protein is predicted to be Pgm. Analysis of this protein sequence reveals the following:

---

Possible site: 53
>>> Seems to have no N-terminal signal sequence
----- Final Results -----
  bacterial cytoplasm --- Certainty = 0.4324 (Affirmative) <succ>
    bacterial membrane --- Certainty = 0.0000 (Not Clear) <succ>
      bacterial outside --- Certainty = 0.0000 (Not Clear) <succ>

---

An alignment of the GAS and GBS proteins is shown below.

The protein has homology with the following sequences in the GENPEPT database.

```
Identities = 71/200 (35%), Positives = 130/200 (64%), Gaps = 4/200 (2%)

Query:   1  MGQTIISAIGVYISTSIDYLIVLIILFAQLSQNKQKWHIYAGQYLGTGLLVGASLVAAYV   60
            M Q ++++I +Y  T++D LI+L++ FA+    K   +IY GQ+LG+  L+  SL+ A+V
Sbjct:   5  MIQNVVTSIILYSGTAVDLLIILMLFFAKRKSRKDIINIYLGQFLGSVSLILLSLLFAFV   64

Query:  61  VNFVPEAMVGLLGLIPIYLGIRFAIVGEGEEEEEEEIIERLEQSKANQLFWTVTLLTIA  120
            ++++P  ++GLLGLIPI+LG++  ++G+ + E    +  E L +   N +F  V ++T A
Sbjct:  65  LDYIPSKEILGLLGLIPIFLGLKVLLLGDSDGEAIAK--EGLSKDNKNLIF-LVAMITFA  121

Query: 121  S-GGDNLGIYIPYFASLDWSQTLVVLLVFAIGIIIFCELSWVLSSIPLISETIEKYQRII  179
            S G  DN+G+++PYF +L+   +V LL F + I      +  L +P + ET+EKY R
Sbjct: 122  SCGADNIGVFVPYFTTLNLANLIVALLTFLVMIYLLVFSAQKLAQVPSVGETLEKYSRWF  181

Query: 180  VPLVFIPLGLYIMYESGTIE                                          199
            +  +V++ LG+YI+ E+ + +
Sbjct: 182  IAVVYLGLGMYILIENNSFD                                          201
```

```
>GP:CAB96418 GB:AJ243290 phosphoglucomutase [Streptococcus thermophilus]
Identities = 65/76 (85%), Positives = 71/76 (92%)
Query:  1   MTYTENLQKWLDFEQLPDYLRQELLSMDEKTKEDAFYTNLEFGTAGMRGYIGAGTNRINI  60
            M+YTEN QKWLDF +LP YLR EL+SMDEKTKEDAFYTNLEFGTAGMRG IGAGTNRINI
Sbjct:  1   MSYTENYQKWLDFAELPAYLRDELVSMDEKTKEDAFYTNLEFGTAGMRGLIGAGTNRINI  60

Query: 61   YVVRQATEGLAKLIET                                              76
            YVVRQATEGLA+LI++
Sbjct: 61   YVVRQATEGLAQLIDS                                              76
```

A related DNA sequence was identified in *S. pyogenes* <SEQ ID 6155> which encodes the amino acid sequence <SEQ ID 6156>. Analysis of this protein sequence reveals the following:

Possible site: 53
>>> Seems to have no N-terminal signal sequence
----- Final Results -----
bacterial cytoplasm --- Certainty = 0.4324 (Affirmative) <succ>
bacterial membrane --- Certainty = 0.0000 (Not Clear) <succ>
bacterial outside --- Certainty = 0.0000 (Not Clear) <succ>

Possible site: 53
>>> Seems to have a cleavable N-term signal seq.
INTEGRAL    Likelihood = −6.21    Transmembrane 94-110 (93-115)
INTEGRAL    Likelihood = −4.14    Transmembrane 172-188 (166-188)
INTEGRAL    Likelihood = −1.97    Transmembrane 130-146 (129-149)
INTEGRAL    Likelihood = −0.16    Transmembrane 62-78 (62-79)
----- Final Results -----
bacterial membrane --- Certainty = 0.3484 (Affirmative) <succ>
bacterial outside --- Certainty = 0.0000 (Not Clear) <succ>
bacterial cytoplasm --- Certainty = 0.0000 (Not Clear) <succ>

An alignment of the GAS and GBS proteins is shown below.

The protein has homology with the following sequences in the GENPEPT database.

```
Identities = 75/76 (98%), Positives = 75/76 (98%)
Query:  1   MTYTENLQKWLITEQLPDYLRQELLSMDEKTKEDAFYTNLEFGTAGMRGYIGAGTNRINI  60
            MTYTEN QKWLDFEQLPDYLRQELLSMDEKTKEDAFYTNLEFGTAGMRGYIGAGTNRINI
Sbjct:  1   MTYTENFQKWLDFEQLPDYLRQELLSMDEKTKEDAFYTNLEFGTAGMRGYIGAGTNRINI  60

Query: 61   YVVRQATEGLAKLIET                                              76
            YVVRQATEGLAKLIET
Sbjct: 61   YVVRQATEGLAKLIET                                              76
```

Based on this analysis, it was predicted that these proteins and their epitopes could be useful antigens for vaccines or diagnostics.

Example 1994

A DNA sequence (GBSx2104) was identified in *S. agalactiae* <SEQ ID 6157> which encodes the amino acid sequence <SEQ ID 6158>. This protein is predicted to be a membrane protein. Analysis of this protein sequence reveals the following:

```
>GP:CAA80247 GB:Z22520 membrane protein [Bacillus acidopullulyticus]

Identities = 47/185 (25%), Positives = 80/185 (42%), Gaps = 23/185 (12%)
Query:   1   MKKKNKSSNIAIIAIFFAIMLVIHFLSSFIFSFWLVPIKPTLMHIPVIIASIAYGPRIGA   60
             MKK     +I I  +   A+  +++                T+MHIP II   I  GP +G
Sbjct:   1   MKKSLTVRDIVIAGVLGAVAILLGVTRLGYIPVPTAAGNATIMHIPAIIGGIMQGPVVGL   60

Query:  61   TLGALMGGISVANSSIVLLPTSYLFSPFVENGNFYSLIIALVPRILIGIIPYFVYKLLHN  120
             +GA+ G  S  N+++ L              F     +++++PR+ IG++  + VY  +
Sbjct:  61   IVGAIFGISSFLNATVPL---------------FKDPLVSILPRLFIGVVAWLVYIGIRR  105

Query: 121   R---FGLAISGAIGSLTNTVFVLSGIFIFFSSTYNGNIKLMLAGIISSNSLAEMVIAAII  177
             +     + +S  IG+LTNT VL+     F        +A    +N L E V+   I+
Sbjct: 106   KSEYVAVGLSAFIGTLTNTALVLA--MAVFRHYLTAGVAWTVA---ITNGLPEAVVGTIV  160

Query: 178   VYLTV                                                        182
                 V
Sbjct: 161   TLAVV                                                        165
```

A related DNA sequence was identified in *S. pyogenes* <SEQ ID 6159> which encodes the amino acid sequence <SEQ ID 6160>. Analysis of this protein sequence reveals the following:

```
Possible site: 31
>>> Seems to have an uncleavable N-term signal seq
INTEGRAL    Likelihood = -8.97    Transmembrane 18-34 (10-41)
INTEGRAL    Likelihood = -7.43    Transmembrane 170-186 (160-191)
INTEGRAL    Likelihood = -5.63    Transmembrane 96-112 (94-117)
INTEGRAL    Likelihood = -4.67    Transmembrane 140-156 (131-158)
INTEGRAL    Likelihood = -3.66    Transmembrane 64-80 (63-84)
INTEGRAL    Likelihood = -0.22    Transmembrane 39-55 (39-55)
----- Final Results -----
    bacterial membrane --- Certainty = 0.4588 (Affirmative) <succ>
       bacterial outside --- Certainty = 0.0000 (Not Clear) <succ>
          bacterial cytoplasm --- Certainty = 0.0000 (Not Clear) < succ>
```

The protein has homology with the following sequences in the databases:

```
>GP:CAA80247 GB:Z22520 membrane protein [Bacillus acidopullulyticus]
Identities = 47/193 (24%), Positives = 86/193 (44%), Gaps = 28/193 (14%)
Query:   8   RKSADISRIAIFFAIMLVIHFVSSLVFNIWPIPI---KPTLVHIPVIIASVLYGPRIGAI      64
             +KS  + I I   + V  +         P+P       T++HIP II  ++ GP +G I
Sbjct:   2   KKSLTVRDIVIAGVLGAVAILLGVTRLGYIPVPTAAGNATIMHIPAIIGGIMQGPVVGLI    61

Query:  65   LGGLMGIISVITNTIILLPTNYLFSPFVDHGTFASLIIAIIPRILIGITPYYCYKLIPNQ   124
             +G + GI S +  T+ L                F   +++I+PR+ IG+   Y  I  +
Sbjct:  62   VGAIFGISSFLNATVPL---------------FKDPLVSILPRLFIGVVAWLVYIGIRRK   106

Query: 125   FGLIVSGI---IGSLTNTIFVLS-GIFIFFATVFDGNIKALLTAIISSNAIVEMIISAII   180
                + G+     IG+LTNT  VL+  +F  + T         +   +N + E ++  I+
Sbjct: 107   SEYVAVGLSAFIGTLTNTALVLAMAVFRHYLTA------GVAWTVAITNGLPEAVVGTIV   160

Query: 181   TFVLIPTLSRLKR                                                193
             T  ++    ++ R
Sbjct: 161   TLAVVLAWKQIGR                                                173
```

An alignment of the GAS and GBS proteins is shown below.

```
Identities = 121/184 (65%), Positives = 157/184 (84%)
Query:   6   KSSNIAIIAIFFAIMLVIHFLSSFIFSFWLVPIKPTLMHIPVIIASIAYGPRIGATLGAL    65
             KS++I+ IAIFFAIMLVIHF+SS +F+ W +PIKPTL+HIPVIIAS+ YGPRIGA LG L
Sbjct:   9   KSADISRIAIFFAIMLVIHFVSSLVFNIWPIPIKPTLVHIPVIIASVLYGPRIGAILGGL    68

Query:  66   MGGISVANSSIVLLPTSYLFSPFVENGNFYSLIIALVPRILIGIIPYFVYKLLHNRFGLA   125
             MG ISV  ++I+LLPT+YLFSPFV++G F SLIIA++PRILIGI PY+ YKL+ N+FGL
Sbjct:  69   MGIISVITNTIILLPTNYLFSPFVDHGTFASLIIAIIPRILIGITPYYCYKLIPNQFGLI   128

Query: 126   ISGAIGSLTNTVFVLSGIFIFFSSTYNGNIKLMLAGIISSNSLAEMVIAAIIVYLTVPRI   185
             +SG IGSLTNT+FVLSGIFIFF++  ++GNIK +L   IISSN++ EM+I+AII ++ +P +
Sbjct: 129   VSGIIGSLTNTIFVLSGIFIFFATVFDGNIKALLTAIISSNAIVEMIISAIITFVLIPTL   188

Query: 186   LNIK                                                         189
              +K
Sbjct: 189   SRLK                                                         192
```

A related GBS gene <SEQ ID 8949> and protein <SEQ ID 8950> were also identified. Analysis of this protein sequence reveals the following:

```
Lipop: Possible site: -1   Crend: 5
McG: Discrim Score:  13.42
GvH: Signal Score (-7.5): -1.93
Possible site: 53
>>> Seems to have a cleavable N-term signal seq.
ALOM program   count: 2 value: -6.21 threshold: 0.0
INTEGRAL    Likelihood = -6.21    Transmembrane 94-110 (93-115)
```

-continued

```
INTEGRAL      Likelihood = −0.16   Transmembrane 62-78 (62-79)
PERIPHERAL    Likelihood = 1.70    123
modified ALOM score: 1.74
*** Reasoning Step: 3
----- Final Results -----
   bacterial membrane --- Certainty = 0.3484 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the databases:

```
ORF01561(301-723 of 1017)
EGAD|38021|39600(1-129 of 183) hypothetical membrane protein {Bacillus acidopullulyticus}
GP|806536|emb|CAA80247.1||Z22520 membrane protein {Bacillus acidopullulyticus}
% Match = 7.6
% Identity = 29.7 % Similarity - 53.9
Matches = 38 Mismatches = 57 Conservative Sub.s = 31

162       192       222       252       282       312       342       372
KKIGYQEIEPRISLLACGDTGQGALADISTILKCIQEVAN*AVNLYTISSLI*GVIMKKKNKSSNIAIIAIFFAIMLVIH
                                                    |||      :|  |  :: |: :::
                                                    MKKSLTVRDIVIAGVLGAVAILLG
                                                         10        20

402       432       462       492       522       552       582       612
FLSSFIFSFWLVPIKPTLMHIPVIIASIAYGPRIGATLGALMGGISVANSSIVLLPTSYLFSPFVENGNFYSLIIALVPR
      |:||||  ||   |   ||  :|   :||: |    |   |:::  |             |      ::::||
VTRLGYIPVPTAAGNATIMHIPAIIGGIMQGPVVGLIVGAIFGISSFLNATVPL---------------FKDPLVSILPR
           40        50        60        70                                 80

642       663       693       723       753       783       813       843
ILIGIIPYFVY---KLLHNRFGLAISGAIGSLTNTVFVXSGIFIFFSSTYNGNIKLMLAGIISXNSLAEMVIAAIIVYLT
::||::  ::||      :        :  :|    ||:||||  :|  :
LFIGVVAWLVYIGIRRKSEYVAVGLSAFIGTLTNTALVLAMAVFRHYLTAGVAWTVAITNGLPEAVVGTIVTLAVVLAWK
             100       110       120       130       140       150       160
```

Based on this analysis, it was predicted that these proteins and their epitopes could be useful antigens for vaccines or diagnostics.

Example 1995

A DNA sequence (GBSx2105) was identified in *S. agalactiae* <SEQ ID 6161> which encodes the amino acid sequence <SEQ ID 6162>. Analysis of this protein sequence reveals the following:

```
Possible site: 18
>>> Seems to have no N-terminal signal sequence (or aa 1-18)
----- Final Results -----
   bacterial cytoplasm --- Certainty = 0.0165 (Affirmative) <succ>
    bacterial membrane --- Certainty = 0.0000 (Not Clear) <succ>
      bacterial outside --- Certainty = 0.0000 (Not Clear) <succ>
```

The protein has homology with the following sequences in the GENPEPT database.

```
>GP:AAC44502 GB:U48885 DNA/pantothenate metabolism flavoprotein
[Streptococcus mutans]

Identities = 101/145 (69%), Positives = 122/145 (83%)
Query:   1  MIKRITLAVTGSISAYKAADLTSQLTKIGYDVHIIMTQAATEFITPLTLQVLSKNPIHLD    60
            M K+I LAV+GSI+AYKAADL+ QLTK+GY V++ MT AA +FI PLTLQVLSKNP++ +
Sbjct:   1  MTKKILLAVSGSIAAYKAADLSHQLTKLGYHVNVFMTNAAKQFIPPLTLQVLSKNPVYSN    60

Query:  61  VMDEHNPKIINHIELAKRTDLFIVAPASANTIAHLAYGFADNIVTSVALAMPDETPKLIA   120
            VM E +P++INHI LAK+ DLF++ PASANT+AHLA+GFADNIVTSVALA+P E PK  A
Sbjct:  61  VMKEDDPQVINHIALAKQADLELLPPASANTLAHLAHGFADNIVTSVALALPLEVPKFFA   120

Query: 121  PAMNTKMYHNTITQRNIDILKKIGY                                    145
            PANNTKMY N ITQ NI +LKK GY
Sbjct: 121  PANNTKMYENPITQSNITLLKKFGY                                    145
```

A related DNA sequence was identified in *S. pyogenes* <SEQ ID 6163> which encodes the amino acid sequence <SEQ ID 6164>. Analysis of this protein sequence reveals the following:

Possible site: 18
>>> Seems to have no N-terminal signal sequence
----- Final Results -----
  bacterial cytoplasm --- Certainty = 0.0076 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 146/178 (82%), Positives = 155/178 (87%)
Query: 1    MIKRITLAVTGSISAYKAADLTSQLTKIGYDVHIIMTQAATEFITPLTLQVLSKNPIHLD    60
            M K ITLAV+GSISAYKAADLTSQLTKIGYDVHIIMTQAAT+FITPLTLQVLSKN IHLD
Sbjct: 1    MTKHITLAVSGSISAYKAADLTSQLTKIGYDVHIIMTQAATQFITPLTLQVLSKNAIHLD    60

Query: 61   VMDEHNPKIINHIELAKRTDLFIVAPASANTIAHLAYGFADNIVTSVALAMPDETPKLIA   120
            VMDEH+PK+INHIELAKRTDLFIVAPASANTIAHLAYGFADN+VTSVALA+P  TPKLIA
Sbjct: 61   VMDEHDPKVINHIELAKRTDLFIVAPASANTIAHLAYGFADNLVTSVALALPATTPKLIA   120

Query: 121  PAMNTKMYHNTITQRNIDILKKIGYQEIEPRISLLACGDTGQGALADISTILKCIQEV     178
            PAMNTKMY N ITQ NI L  IG+ EI P+ SLLACGD G GALADI  IL  I +
Sbjct: 121  PAMNTKMYQNPITQENIKRLSTIGFTEIPPKSSLLACGDKGPGALADIDVILATIDTI    178
```

SEQ ID 6162 (GBS236) was expressed in *E. coli* as a His-fusion product. SDS-PAGE analysis of total cell extract is shown in FIG. 52 (lane 5; MW 21.6 kDa).

Purified GBS236-GST is shown in FIG. 208 (lane 6) and in FIG. 225 (lanes 4-5).

Based on this analysis, it was predicted that these proteins and their epitopes could be useful antigens for vaccines or diagnostics.

Example 1996

A DNA sequence (GBSx2106) was identified in *S. agalactiae* <SEQ ID 6165> which encodes the amino acid sequence <SEQ ID 6166>. This protein is predicted to be pantothenate metabolism flavoprotein homolog (dfp). Analysis of this protein sequence reveals the following:

Possible site: 13
>>> Seems to have no N-terminal signal sequence

----- Final Results -----
  bacterial cytoplasm --- Certainty = 0.2325 (Affirmative) <succ>
    bacterial membrane --- Certainty = 0.0000 (Not Clear) <succ>
      bacterial outside --- Certainty = 0.0000 (Not Clear) <succ>

A related GBS nucleic acid sequence <SEQ ID 9835> which encodes amino acid sequence <SEQ ID 9836> was also identified.

The protein has homology with the following sequences in the GENPEPT database.

```
>GP:AAG39941 GB:AF301375 MTW1216 [Methanothermobacter wolfeii prophage psiM100]
Identities = 71/229 (31%), Positives = 117/229 (51%), Gaps = 27/229 (11%)
Query: 6    MKILITSGGTTEKIDTVRSITNHATGTLGKIIAEKYLREGHQVTLVTTKNAVKPESATNL    65
            +++L++ GGT E ID VR ITN ++G +G  +A +   +G  VTLV    V +   + L
Sbjct: 172  LRVLVSLGGTLEPIDPVRVITNRSSGRMGLAVAREAYIQGADVTLVA--GTVSVDIPSQL   229

Query: 66   STFEIEDVDSLIKTLKPLVKEHDILIHSMAVSDYTPVYMADFEKVKSSDHLDTFLRKDNH   125
            T  E    + + +  L+ EHD+ +  + AVSD+ PVY
Sbjct: 230  RTVRAETAHEMAEAVAELIGEHDVFVSAAAVSDFRPVYS--------------------   268

Query: 126  EGKISSESEYQVLFLKKTPKVISLVKKWNPQITLVGFKLLVNVTKENLFKVARHSLIKNK   185
            E KISS+SE   L LK  PK+I + ++ NP+  +VGFK    V++E L    AR +  +
Sbjct: 269  EEKISSDSEI-TLRLKPNPKIIRMARETNPEAFIVGFKAEHGVSEEELIAAARKQIEDSV   327

Query: 186  ATFILANDL-IDITSKHHIAYLLDHDNVYKATT--KEDIAQLIYEKVKK             231
            A  ++AND+ ++     +    ++   + V +  T  KE++A LI  ++ K
Sbjct: 328  ADMVVANDVSVEGFGSENNRAIIVSEGVTELPTMKKEELAGLIIGEIMK             376
```

A related DNA sequence was identified in *S. pyogenes* <SEQ ID 6167> which encodes the amino acid sequence <SEQ ID 6168>. Analysis of this protein sequence reveals the following:

Possible site: 54
>>> Seems to have no N-terminal signal sequence
----- Final Results -----
  bacterial cytoplasm --- Certainty = 0.1737 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 142/230 (61%), Positives = 170/230 (73%)
Query: 4    MANKILITSGGTTEKIDTVRSITNHATGTLGKIIAEKYLREGHQVTLVTTKNAVKPESAT   63
            M MK++ITSGGTTE ID VR ITNH+TG LGK+I E++L+   H VTLVTTK A KP
Sbjct: 1    MTMKLIITSGGTTEPIDAVRGITNHSTGQLGKLITERFLQYHHDVTLVTTKTATKPLPNK  60

Query: 64   NLSTFEIEDVDSLIKTLKPLVKEHDILIHSMAVSDYTPVYMADFEKVKSSDHLDTFLRKD  123
              L   E+E V+ L+   LK  V  HDILIHSMAVSDYTPVYM D E+V  +D+L+ FL +
Sbjct: 61   RLRIIEVETVNDLMAALKDQVPHHDILIHSMAVSDYTPVYMTDLEQVSQADNLNCFLCEH  120

Query: 124  NHEGKISSESEYQVLFLKKTPKVISLVKKWNPQITLVGFKLLVNVTKENLFKVARHSLIK  183
            N E KISS S+YQVLFLKKTPKVIS VK+WNP I LVGFKLLVNV +E L KVAR SL K
Sbjct: 121  NSEPKISSASDYQVLFLKKTPKVISYVKQWNPNIKLVGFKLLVNVPQEELIKVARASLAK  180

Query: 184  NKATFILANDLIDITSKHHIAYLLDHDNVYKATTKEDIAQLIYEKVKKYD            233
            N A +ILANDL+DI +   H A L+ ++  V  A TKE IA L+YE++ K+D
Sbjct: 181  NHADYILANDLVDIQTGMHKALLISNNEVASADTKEAIADLLYERMTKHD            230
```

Based on this analysis, it was predicted that these proteins and their epitopes could be useful antigens for vaccines or diagnostics.

Example 1997

A DNA sequence (GBSx2107) was identified in *S. agalactiae* <SEQ ID 6169> which encodes the amino acid sequence <SEQ ID 6170>. Analysis of this protein sequence reveals the following:

Possible site: 49
>>> Seems to have no N-terminal signal sequence
INTEGRAL    Likelihood = −0.22    Transmembrane 117-133 (117-133)
----- Final Results -----
  bacterial membrane --- Certainty = 0.1086 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 9833> which encodes amino acid sequence <SEQ ID 9834> was also identified.

The protein has homology with the following sequences in the GENPEPT database.

A related DNA sequence was identified in *S. pyogenes* <SEQ ID 6171> which encodes the amino acid sequence <SEQ ID 6172>. Analysis of this protein sequence reveals the following:

Possible site: 61
>>> Seems to have an uncleavable N-term signal seq
INTEGRAL    Likelihood = −0.22    Transmembrane 95-111 (95-111)
----- Final Results -----
  bacterial membrane --- Certainty = 0.1086 (Affirmative) <succ>
    bacterial outside --- Certainty = 0.0000 (Not Clear) <succ>
      bacterial cytoplasm --- Certainty = 0.0000 (Not Clear) <succ>

```
>GP:BAB07541 GB:AP001520 unknown conserved protein in B. subtilis
[Bacillus halodurans]
Identities = 94/221 (42%), Positives = 133/221 (59%), Gaps = 2/221 (0%)
Query: 52   AEKPFIWTEVFLREINRSNQEIILHIWPMTKTVILGMLDRELPHLELAKKEIISRGYEPV   111
            A + F + +    I +S   L W   TV+LG+ D LP ++   + +    ++ +
Sbjct: 27   ALQSFAYDDTLCTSIGKSQSPPTLRAWVHHNTVVLGIQDSRLPQIKAGIEALKGFQHDVI   86

Query: 112  VRNFGGLAVVADEGILNFSLVIPDVFERKLSISDGYLIMVDFIRSIFSDFYQPIEHFEVE   171
            VRN GGLAVV D GILN SLV+ +   E+  SI DGY +M + I S+F D   + IE   E+
Sbjct: 87   VRNSGGLAVVLDSGILNLSLVLKE--EKGFSIDDGYELMYELICSMFQDHREQIEAREIV  144

Query: 172  TSYCPGKFDLSINGKKFAGLAQRRIKNGIAVSIYLSVCGDQKGRSQMISDFYKIGLGDTG   231
             SYCPG +DLSI+GKKFAG++QRRI+ G+AV IYL V G    R++MI  FY    +
Sbjct: 145  GSYCPGSYDLSIDGKKFAGISQRRIRGGVAVQIYLCVSGSGAERAKMIRTFYDKAVAGQP  204

Query: 232  SPIAYPNVDPEIMANLSDLLDCPMTVEDVIDRMLISLKQVG                     272
            +   YP + PE MA+LS+LL    P V DV+ + L++L+Q G
Sbjct: 205  TKFVYPRIKPETMASLSELLGQPHNVSDVLLKALMTLQQHG                     245
```

The protein has homology with the following sequences in the databases:

```
>GP:BAB07541 GB:AP001520 unknown conserved protein in B. subtilis
[Bacillus halodurans]
Identities = 97/228 (42%), Positives = 138/228 (59%), Gaps = 2/228 (0%)
```

```
-continued
Query:  30  ALSPFVWTEVFLKTINQEPNQLILHIWPMTRTVILGMLDRQLPYFELAKTEIGNNGYVPV   89
            AL  F + +    +I + +   L  W     TV+LG+ D +LP +      +     + +
Sbjct:  27  ALQSFAYDDILCTSIGKSQSPPTLRAWVHHNTVVLGIQDSRLPQIKAGIEALKGFQHDVI   86

Query:  90  TRNIGGLAVVADDGILNFSLVIPDHFSESISISNAYLIMVDVIRESFSDYYQRIEYHEIK  149
              RN GGLAVV D GILN SLV+ +    + SI + Y +M ++I   F D+ ++IE  EI
Sbjct:  87  VRNSGGLAVVLDSGILNLSLVLKEE--KGFSIDDGYELMYELICSMFQDHREQIEAREIV  144

Query: 150  NSYCPGNFDLSIAGRKFAGIAQRRIKKGIVVSIYLSVCGDQAARGQLIKDFYEAGTQGEV  209
              SYCPG++DLSI G+KFAGI+QRRI+ G+ V IYL V G  A R ++I+ FY+     G+
Sbjct: 145  GSYCPGSYDLSIDGKKFAGISQRRIRGGVAVQIYLCVSGSGAERAKMIRTFYDKAVAGQP  204

Query: 210  TKVNYPQIDPECMATLSELLETPFTVAEVLERLRLTLRQLGFSLTEKS              257
            TK  YP+I PE MA+LSELL   P  V++VL +   +TL+Q G SL   +S
Sbjct: 205  TKFVYPRIKPETMASLSELLGQPHNVSDVLLKALMTLQQHGASLLTES              252
```

An alignment of the GAS and GBS proteins is shown below.

```
Identities = 155/275 (56%), Positives = 199/275 (72%), Gaps = 8/275 (2%)
Query:  32  QDLAQLPVSIFKDYVTDAQDAEKPFIWTEVFLREINRSNQEIILHIWPMTKTVILGMLDR   91
            +DLA LP+ ++ D       A  PF+WTEVFL+ IN+    ++ILHIWPMT+TVILGMLDR
Sbjct:  10  RDLASLPIFVYGDGNKKVPGALSPFVWTEVFLKTINQEPNQLILHIWPMTRTVILGMLDR   69

Query:  92  ELPHLELAKKEIISRGYEPVVRNFGGLAVVADEGILNFSLVIPDVFERKLSISDGYLIMV  151
            +LP+ ELAK EI + GY PV RN GGLAVVAD+GILNFSLVIPD F    +SIS+ YLIMV
Sbjct:  70  QLPYFELAKTEIGNNGYVPVTRNIGGLAVVADDGILNFSLVIPDHFSESISISNAYLIMV  129

Query: 152  DFIRSIFSDFYQPIEHFEVETSYCPGKFDLSINGKKFAGLAQRRIKNGIAVSIYLSVCGD  211
            D IR  FSD+YQ IE+ E++ SYCPG FDLSI G+KFAG+AQRRIK GI VSIYLSVCGD
Sbjct: 130  DVIRESFSDYYQRIEYHEIKNSYCPGNFDLSIAGRKFAGIAQRRIKKGIVVSIYLSVCGD  189

Query: 212  QKGRSQMISDFYKIGLGDTGSPIAYPNVDPEIMANLSDLLDCPMTVEDVIDRMLISLKQV  271
            Q  R Q+I DFY+ G     + + YP +DPE MA LS+LL+ P TV +V++R+ ++L+Q+
Sbjct: 190  QAARGQLIKDFYEAGTQGEVTKVNYPQIDPECMATLSELLETPFTVAEVLERLRLTLRQL  249

Query: 272  GFN------DRLLMIRPDLVAEFNRFQAKSMANKG                          300
            GF+      D+ L+    D V  + R Q + +  +G
Sbjct: 250  GFSLTEKSPDQALLTNFDAV--YERMQLEVVRKEG                          282
```

A related GBS gene <SEQ ID 8951> and protein <SEQ ID 8952> were also identified. Analysis of this protein sequence reveals the following:

---

Lipop: Possible site: −1  Crend: 10
McG: Discrim Score: −16.85
GvH: Signal Score (−7.5): −5.07
Possible site: 49
>>> Seems to have no N-terminal signal sequence
ALOM program   count: 1 value: −0.22 threshold: 0.0
INTEGRAL     Likelihood = −0.22   Transmembrane 117-133 (117-133)
PERIPHERAL   Likelihood = 0.47    73

-continued modified ALOM score: 0.54
*** Reasoning Step: 3
----- Final Results -----
   bacterial membrane --- Certainty = 0.1086 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the databases:

---

```
ORF01564(451-1116 of 1518)
EGAD|13388|BS3758(27-249 of 281) hypothetical 31.4 kd protein in pta 3'region {Bacillus
subtilis} OMNI|NT01BS4391 hypothetical protein SP|P39648|YWFL_BACSU HYPOTHETICAL 31.4 KDA
PROTEIN IN PTA 3'REGION. GP|414014|emb|CAA51646.1||X73124 ipa-90d {Bacillus subtilis}
GP|2636300|emb|CAB15791.1||Z99123 alternate gene name: ipa-90d {Bacillus subtilis}
PIR|S39745|S39745 ywfL protein - Bacillus subtilis
% Match = 15.8
% Identity = 40.8 % Similarity = 61.0
Matches = 91 Mismatches = 82 Conservative Sub.s = 45

321       351       381       411       441       471       501       531
         *WNLRETYWKISSDCDKINLAEFSRERMSDLLEWQDLAQLPVSIFKDYVTDAQDAEKPFIWTEVFLREINRSNQEIILHI
                                                         ||::|    :  :   :   :
                                               MANQPIDLLMQPKWRVIDQSSLGPLFDAKQSFAMDDTLCMSVGKGVSPATARS
                                                        10        20        30        40        50
```

-continued

```
561       591       621       651       681       711       738       768
WPMTKTVILGMLDRELPHLELAKKEIISRGYEPVVRNFGGLAVVADEGILNFSLVIPDVFERK-LSISDGYLIMVDFIRS
|    |::||: |  || |:     : | ||  :||| |||||| |:|:|| ||:  |  |:| : |  ||  ||:::|
WVHHDTIVLGIQDTRLPFLQDGISLLESEGYRVIVRNSGGLAVVLDDGVLNISLIFED--EKKGIDIDKGYEAMVELMRR
               70        80        90       100       110         120       130

798       828       858       888       918                 972       996
IFSDFYQPIEHFEVETSYCPGKFDLSINGKKFAGLAQRRIKNGIAVSIYLSVCGDQKG--RSQMISDFYKIGLGD--TGS
::  :   || :|:| ||||| :|||||||||||::|||:: |:|| |||  | |: |  |: :|  ||:  | |
MLRPYNAKIEAYEIEGSYCPGSYDLSINGKKFAGISQRRVRGGVAVQIYL--CADKSGSERADLIRRFYQAALKDKQNDK
                150       160       170       180         190       200

1026      1056      1086      1116      1146      1176      1206      1236
PIAYPNVDPEIMANLSDLLDCPMTVEDVIDRMLISLKQVGFNDRLLMIRPDLVAEFNRFQAKSMANKGMVSRDE*CPR*F
   || : || ||:||:||   ::|:|::  :|  || :
KGVYPEIRPETMASLSELLQKDISVQDLMFALLTELKALSTHLYSAGLSIDEEMEFEKNLVRMAERNAKVFG
        220       230       240       250       260       270       280
```

SEQ ID 8952 (GBS390) was expressed in *E. coli* as a His-fusion product. SDS-PAGE analysis of total cell extract is shown in FIG. 73 (lane 7; MW 37 kDa). It was also expressed in *E. coli* as a GST-fusion product. SDS-PAGE analysis of total cell extract is shown in FIG. 82 (lane 3; MW 62 kDa).

GBS390-GST was purified as shown in FIG. 216, lane 12.

Based on this analysis, it was predicted that these proteins and their epitopes could be useful antigens for vaccines or diagnostics.

Example 1998

A DNA sequence (GBSx2108) was identified in *S. agalactiae* <SEQ ID 6173> which encodes the amino acid sequence <SEQ ID 6174>. This protein is predicted to be probable trimethylamine dehydrogenase (nemA). Analysis of this protein sequence reveals the following:

```
Possible site: 36
>>> Seems to have no N-terminal signal sequence
----- Final Results -----
  bacterial cytoplasm --- Certainty = 0.2218 (Affirmative) <succ>
    bacterial membrane --- Certainty = 0.0000 (Not Clear) <succ>
      bacterial outside --- Certainty = 0.0000 (Not Clear) <succ>
```

The protein has homology with the following sequences in the GENPEPT database.

```
>GP:CAA83700 GB:Z33015 similar to trimethylamine DH [Mycoplasma capricolum]
Identities = 162/311 (52%), Positives = 219/311 (70%), Gaps = 1/311 (0%)

Query: 3    NVQGNLFRPLTLPNGLSLENRFVLSPMVTNSSTSEGFVTDDDIAYAVRRAKSAPLQITGA   62
            N    LF P  L NG  LENRFVLSPM  + +T +G +TD +  Y  RR+ SAPLQITG Sbjct: 2    NKYEKLFEPFYL-NGFKLENRFVLSPMTLSLATLDGKITDKEADYVKRRSHSAPLQITGG  60

Query: 63   AYITEYGQLFEYGFSVSKDEDIPGLTKLAKAMKSKGAKAVLQLTHAGRFSSHTLARHGYV  122
             Y  E+GQLFEYG S   D+DIP LT+L + MK+     +LQL HAG+FS  +L ++GY+

Sbjct: 61   VYFDEFGQLFEYGISAKSDDDIPSLTRLYQEMKTDSNCVILQLAHAGKFSKTSLKKYGYL  120

Query: 123  YGPSPMQLQSPYPHQVKELTHKDILRIIDEYVQATRRAIQAGFDGVEISSAQRLLIQIFF  182
            YGPS  +  +P  H+V EL  + I +II +Y  AT R I+AGF+G+EIS AQRLLIQTFF Sbjct: 121  YGPSYEKNHTPIEHEVLELPKEKIKQIIQDYKDATLRVIKAGFNGIEISMAQRLLIQIFF  180

Query: 183  STFSNQRKDEYGPQTLTNRCRLGLEVFKAVQKVIREEAESDFILGFRATPEETRGSQIGY  242
            S   N+R DEY      NR R  LEV KA+++VI + A  +FI GFRATPEET G  +GY
Sbjct: 181  SQIINKRTDEYSATNFENRSRFCLEVVKAIREVIDKYAPKNFIFGFRATPEETYGDILGY  240

Query: 243  SIEEFMEFLEKILAIAQVDYLAIASWGHDVFRNTIRSEGVYKGQLVNQVIFEHFGDRVPI  302
            +IE+F++ ++KI+ I ++ YLAIASWGHD++ N +RS   YKGQLVN+VI++ + +++PI
Sbjct: 241  TIEDFIQLVDKIIEIGKISYLAIASWGHDIYLNKVRSNTKYKGQLVNKVIYDIYKNKLPI  300

Query: 303  MATGGINSASK                                                   313
            +++GGIN+ +K
Sbjct: 301  ISSGGINTPTK                                                   311
```

A related DNA sequence was identified in *S. pyogenes* <SEQ ID 6175> which encodes the amino acid sequence <SEQ ID 6176>. Analysis of this protein sequence reveals the following:

```
Possible site: 35
>>> Seems to have no N-terminal signal sequence
----- Final Results -----
   bacterial cytoplasm --- Certainty = 0.3055 (Affirmative) <succ>
     bacterial membrane --- Certainty = 0.0000 (Not Clear) <succ>
        bacterial outside --- Certainty = 0.0000 (Not Clear) <succ>
```

An alignment of the GAS and GBS proteins is shown below.

```
Identities = 265/390 (67%), Positives = 321/390 (81%)
Query:   8  LFRPLTLPNGLSLENRFVLSPMVTNSSTSEGFVTDDDIAYAVRRAKSAPLQITGAAYITE   67
            LF PLTLPNG  L+NRFVLSPMVTNSST +G+VT DD++YA+RRA SAPLQITGAAY+
Sbjct:   8  LFEPLTLPNGSQLDNRFVLSPMVTNSSTKDGYVTQDDVSYALRRAASAPLQITGAAYVDP   67

Query:  68  YGQLFEYGFSVSKDEDIPGLTKLAKAMKSKGAKAVLQLTHAGRFSSHTLARHGYVYGPSP  127
            YGQLFEYGFSV+KD DI GL +LA+AMK+KGAKAVLQLTHAGRF+SH L ++G+VYGPS
Sbjct:  68  YGQLFEYGFSVTKDADISGLKELAQAMKAKGAKAVLQLTHAGRFASHALTKYGFVYGPSY  127

Query: 128  MQLQSPYPHQVKELTHKDILRIIDEYVQATRRAIQAGFDGVEISSAQRLLIQTFFSTFSN  187
            MQL+SP PH+VK LT + I  +I  Y QATRRAIQAGFDGVE+SSAQRLLIQTFFSTFSN
Sbjct: 128  MQLRSPQPHEVKPLTGQQIEELIAAYAQATRRAIQAGFDGVEVSSAQRLLIQTFFSTFSN  187

Query: 188  QRKDEYGPQTLTNRCRLGLEVFKAVQKVIREEAESDFILGFRATPEETRGSQIGYSIEEF  247
            +R D YG QTL NR +L L V +AVQ+VI++EA   FI GFRATPEETRG+ IGYSI+EF
Sbjct: 188  KRTDSYGCQTLFNRSKLTLAVLQAVQQVIKQEAPDGFIFGFRATPEETRGNDIGYSIDEF  247

Query: 248  MEFLEKILAIAQVDYLAIASWGHDVFRNTIRSEGVYKGQLVNQVIFEHFGDRVPIMATGG  307
            ++ ++ +L +A++DYLAIASWG  VFRNT+RS G Y G+ VNQV+ ++  +++P+MATGG
Sbjct: 248  LQLMDWVLNVAKLDYLAIASWGRHVFRNTVRSPGPYYGRRVNQVVRDYLRNKLPVMATGG  307

Query: 308  INSASKVFEALQHAHMIGASTPLVVDPEFLQKIKAKCSDQINLRIKVSDLEGLAIPKASF  367
            +N+  K  EAL HA  IG STP VVDPEF  KIK  C + I+LRI+ +DL+ LAIP+ASF
Sbjct: 308  MNTPDKAIEALAHADFIGVSTPFVVDPEFAHKIKEGCEESIHLRIRPADLKSLAIPQASF  367

Query: 368  KDIVPLMDYGESLPKEAREVFRELRSNYRE                              397
            KDIVPLMDYGESLPKE+R +FR L  NY+E
Sbjct: 368  KDIVPLMDYGESLPKESRTLFRSLTHNYKE                              397
```

Based on this analysis, it was predicted that these proteins and their epitopes could be useful antigens for vaccines or diagnostics.

Example 1999

A DNA sequence (GBSx2109) was identified in *S. agalactiae* <SEQ ID 6177> which encodes the amino acid sequence <SEQ ID 6178>. Analysis of this protein sequence reveals the following:

```
Possible site: 53
>>> Seems to have no N-terminal signal sequence
----- Final Results -----
   bacterial cytoplasm --- Certainty = 0.3748 (Affirmative) <succ>
     bacterial membrane --- Certainty = 0.0000 (Not Clear) <succ>
        bacterial outside --- Certainty = 0.0000 (Not Clear) <succ>
```

The protein has homology with the following sequences in the GENPEPT database.

```
>GP:BAB04594 GB:AP001510 unknown conserved protein [Bacillus halodurans]
Identities = 121/333 (36%), Positives = 192/333 (57%), Gaps = 12/333 (3%)
Query:   1  MKLSVLDYGLIDYGKTASDAIQETILLSQEAERLGYHQFWVAEHHGVKAFSISNPELMIM   60
            MKLSVLD   I YG  A +A+++T  L++   E LGYH+FWV+EHH    + S+PE++I
Sbjct:   1  MKLSVLDQSPIAYGSNAKEALRQTTELAKVTEALGYHRFWVSEHHDASTLAGSSPEVLIA   60

Query:  61  HLANQTKSIKIGSGGIMPLHYSSFKLAETLKTLETCHPNRVSIGLGNSLGTVKVSNALRS  120
            HLA  TK I++GSGG+M  HYS++K+AE  K LE  HP R+  +GLG + G + ++
Sbjct:  61  HLAAHTKKIRLGSGGVMLPHYSAYKVAENFKLLEALHPGRIDVGLGRAPGGMPIAKMALQ  120

Query: 121  LHK---AHDYEEVLEELKSWLIDESSSKEPL----VQPTLSSFPDLYVLGSGQKSAYLAA  173
              K     H Y    ++++ +L D+ +         P + + PD+++LGS   SA +AA
Sbjct: 121  EGKEQNIHKYPLQVKDVIGYLQDDLPTDHRFHGLKATPLIDTVPDVWLLGSGGGSANVAA  180

Query: 174  KLGLGFTFGVFPFMDKDPLTEAKKLSSLYYHQFEEYYPNKSPNLMVAAFVVIADTSEEAE  233
            + G GF F    F++ +  +A +       Y  F+       P   VA FV+ ADT E+A+
```

```
                        -continued
Sbjct: 181  ENGTGFAFA--HFINGEGGVQAVE---SYRETFQPSALFDRPQTSVAIFVICADTDEQAD  235

Query: 234  NIAKTLDIWMLGNKDFNEFATFPTIEEANHYQLTPEQKAKIKSNRDRMIVGDPKQVKESL  293
            IA +LD+ ++  ++         P+IE  A   Y   +P ++A+I+ NR RMIVG PK V++ L
Sbjct: 236  QIASSLDLSLIMLENGQLSKGTPSIESALSYPYSPFERARIRENRKRMIVGSPKAVRQQL  295

Query: 294  DALVNASQAEELLLIPLVPGLDQRIKSLKLLSQ                            326
            L   A +  EE++++  +       + RI+S +LL  +
Sbjct: 296  VELARAYETEEVIVVTITHRFEDRIRSYELLGE                            328
```

A related DNA sequence was identified in *S. pyogenes* <SEQ ID 6179> which encodes the amino acid sequence <SEQ ID 6180>. Analysis of this protein sequence reveals the following:

---

Possible site: 51
>>> Seems to have no N-terminal signal sequence
INTEGRAL    Likelihood = –2.60    Transmembrane 212-228 (210-229)
----- Final Results -----
   bacterial membrane --- Certainty = 0.2041 (Affirmative) <succ>
      bacterial outside --- Certainty = 0.0000 (Not Clear) <succ>
         bacterial cytoplasm --- Certainty = 0.0000 (Not Clear) <succ>

---

An alignment of the GAS and GBS proteins is shown below.

```
Identities = 173/329 (52%), Positives = 241/329 (72%), Gaps = 1/329 (0%)
Query: 1    MKLSVLDYGLIDYGKTASDAIQETILLSQEAERLGYHQFWVAEHHGVKAFSISNPELMIM   60
            MK+S+LDYG+ID  KT   +A+ ET   L+Q A++LG+H+FWVAEHH + AF+IS+PEL++M
Sbjct: 1    MKVSILDYGVIDKEKTPQEALLETRCLAQVADKLGFHRFWVAEHHNIYAFAISSPELLMM   60

Query: 61   HLANQTKSIKIGSGGIMPLHYSSFKLAETLKTLETCHPNRVSIGLGNSLGTVKVSNALRS   120
            HLA+  TK  I+IGSGGIMPLHYSSFK+AE +  TLE  HPNR+ +G+GNSLGT   V   AL S
Sbjct: 61   HLADHTKQIRIGSGGIMPLHYSSFKIAEWIMTLEALHPNRIDLGIGNSLGTTLVQRALSS   120

Query: 121  LHKAHDYEEVLEELKSWLIDESSSKEPL-VQPTLSSFPDLYVLGSGQKSAYLAAKLGLGF  179
            +H      Y +V+  EL  +L   +   S   P+ V P   +++P ++  L  +    ++A  LA +LGLG+
Sbjct: 121  IHCKDSYSQVVTELYQYLNPDHLSPLPIFVNPRGNTYPQIWTLSNSLETAELAGQLGLGY  180

Query: 180  TFGVFPFMDKDPLTEAKKLSSLYYHQFEEYYPNKSPNLMVAAFVVIADTSEEAENIAKTL  239
            TFG+FP++  KDP+TEAK++S+  Y    F         K  P L++A  F+V++DT  E+AE   +AK L
Sbjct: 181  TFGIFPYIPKDPITEAKRVSAHYRKAFRPSKLLKIPKLILAVFIVLSDTDEKAEALAKPL  240

Query: 240  DIWMLGNKDFNEFATFPTIEEANHYQLTPEQKAKIKSNRDRMIVGDPKQVKESLDALVNA  299
            DIWMLG +DFNEF  T+P  +EEA +Y LT +Q+   I +NR RM++G P   VK+ LD L+ A
Sbjct: 241  DIWMLGQQDFNEFKTYPDVEEARNYHLTEKQREAIAANRSRMVIGSPHTVKKQLDRLIEA  300

Query: 300  SQAEELLLIPLVPGLDQRIKSLKLLSQLY                                328
            QA+ELL IPLVP       R ++L+LL+ LY
Sbjct: 301  CQADELLAIPLVPEFANRQRTLELLADLY                                329
```

Based on this analysis, it was predicted that these proteins and their epitopes could be useful antigens for vaccines or diagnostics.

Example 2000

A DNA sequence (GBSx2110) was identified in *S. agalactiae* <SEQ ID 6181> which encodes the amino acid sequence <SEQ ID 6182>. Analysis of this protein sequence reveals the following:

---

Possible site: 60
>>> Seems to have no N-terminal signal sequence
----- Final Results -----
   bacterial cytoplasm --- Certainty = 0.2384 (Affirmative) <succ>
      bacterial membrane --- Certainty = 0.0000 (Not Clear) <succ>
         bacterial outside --- Certainty = 0.0000 (Not Clear) <succ>

---

The protein has homology with the following sequences in the GENPEPT database.

```
>GP:AAF81345 GB:AC007767 Identical to a glycine cleavage system
H-protein precursor from Arabidopsis thaliana gbIP25855.
It contains a glycine cleavage H-protein domain
PF|01597. ESTs gb|R90208, gb|AI
Identities = 30/91 (32%), Positives = 53/91 (57%), Gaps = 1/91 (1%)
Query: 18   TISLTPELQDDLGTVGYVEFTD-DANLEVDDVILNIEASKTVMAILSPLTGKVVKVNTAA   76
            TI +T   QD LG V +VE  +    + ++++       +E+  K    ILSP++G+V++VNT
Sbjct: 59   TIGITDHAQDHLGEVVFVELPEANSSVSKEKSFGAVESVKATSEILSPISGEVIEVNTKL   118
```

```
Query:  77  SQEPTLLNSEKADENWLVVLTEVDYAAFEAL                           107
            ++ P L+NS   ++ W++ +    A  EAL
Sbjct: 119  TESPGLINSSPYEDGWMIKVKPSSPAELEAL                           149
```

A related DNA sequence was identified in *S. pyogenes* <SEQ ID 6183> which encodes the amino acid sequence <SEQ ID 6184>. Analysis of this protein sequence reveals the following:

```
Possible site: 60
>>> Seems to have no N-terminal signal sequence
----- Final Results -----
   bacterial cytoplasm --- Certainty = 0.3544 (Affirmative) <succ>
     bacterial membrane --- Certainty = 0.0000 (Not Clear) <succ>
      bacterial outside --- Certainty = 0.0000 (Not Clear) <succ>
```

An alignment of the GAS and GBS proteins is shown below.

```
Identities = 80/110 (72%), Positives = 98/110 (88%)
Query:  1   MKKIANYLLIEKNEELYTISLTPELQDDLGTVGYVEFTDDANLEVDDVILNIEASKTVMA   60
            MKKIANYLLIEK ++ YTIS+TPELQDD+GT+GY EFTD+ +L VDD+ILN+EASKTVM+
Sbjct:  1   MKKIANYLLIEKTDDRYTISMTPELQDDIGTIGYAEFTDNDHLAVDDIILNLEASKTVMS   60

Query: 61   ILSPLTGKVVKVNTAASQEPTLLNSEKADENWLVVLTEVDYAAFEALENA           110
            +LSPL G VV+ N AA+  PTLLNSEKA+ENW+VVLT+VD AAF+ALE+A
Sbjct: 61   VLSPLAGAVVERNEAATLTPTLLNSEKAEENWIVVLTDVDQAAFDALEDA           110
```

Based on this analysis, it was predicted that these proteins and their epitopes could be useful antigens for vaccines or diagnostics.

Example 2001

A DNA sequence (GBSx2111) was identified in *S. agalactiae* <SEQ ID 6185> which encodes the amino acid sequence <SEQ ID 6186>. This protein is predicted to be LRP16 (b1045). Analysis of this protein sequence reveals the following:

```
Possible site: 17
>>> Seems to have no N-terminal signal sequence
----- Final Results -----
   bacterial cytoplasm --- Certainty = 0.0608 (Affirmative) <succ>
     bacterial membrane --- Certainty = 0.0000 (Not Clear) <succ>
      bacterial outside --- Certainty = 0.0000 (Not Clear) <succ>
```

The protein has homology with the following sequences in the GENPEPT database.

```
>GP:AAF15294 GB:AF202922 LRP16 [Homo sapiens]
Identities = 73/171 (42%), Positives = 98/171 (56%), Gaps = 13/171 (7%)

Query:   88  DICLLQVDAIVNAANSKLLGCFIPNHHCIDNQIHTFAGSRLRLACHQLMTQQGRMEAVGQ   147
             DI  L+VDAIVNAANS LLG      +D  IH AG L  C L ++      G+
Sbjct:   78  DITKLEVDAIVNAANSSLLG-----GGGVDGCIHRAAGPLLTDECRTLQSCK-----TGK   127

Query:  148  AKLTESYHLPCKYVIHTVGPYVKVDQKPSRIREDLLKSSYKSCLQLAVRANLKTIVFPCI   207
             AK+T  Y LP KYVIHTVGP    +  S+  E L+S Y S L L +  L+++ FPCI
Sbjct:  128  AKITGGYRLPAKYVIHTVGPIAYGEPSASQAAE--LRSCYLSSLDLLLEHRLRSVAFPCI   185

Query:  208  STGEFGFPNQRAAELAVQAILEWQRENQHKL-YIIFNTFTPKDQDIYQKLL           257
             STG FG+P + AAE+ +  + EW +++ K+   +I   F KD+DIY+  L
Sbjct:  186  STGVFGYPCEAAAEIVLATLREWLEQHKDKVDRLIICVFLEKDEDIYRSRL           236
```

A related DNA sequence was identified in *S. pyogenes* <SEQ ID 6187> which encodes the amino acid sequence <SEQ ID 6188>. Analysis of this protein sequence reveals the following:

```
Possible site: 25
>>>Seems to have no N-terminal signal sequence
----- Final Results -----
  bacterial cytoplasm --- Certainty = 0.1992 (Affirmative) <succ>
    bacterial membrane --- Certainty = 0.0000 (Not Clear) <succ>
      bacterial outside --- Certainty = 0.0000 (Not Clear) <succ>
```

An alignment of the GAS and GBS proteins is shown below.

```
Identities = 139/266 (52%), Positives = 178/266 (66%), Gaps = 6/266 (2%)

Query:     1  MPNQKQLLLAMIEYLQSEKLTDVDDL----RTTDLQTVWRGLVNQQDPQNISQEYLSLED    56
              MP+   LL  MI  LQ+E+LT        T  Q +WR L+NQ+     +S++YL+LED
Sbjct:     1  MPSSFDLLGEMIGLLQTEQLTSSWACPLPNALTKRQDLWRALINQRPALPLSKDYLNLED    60

Query:    57  RYLSHWWNTQKVKTIDVCHQTVYSNVFTYHGDICLLQVDAIVNAANSKLLGCFIPNHHCI   116
              YL  W  +    ++  C +T Y+++F YHGDI  L VDAIVNAANS+LLGCF PNH CI
Sbjct:    61  AYLDDWRASFVPVSVKDCQKTNYTSLFLYHGDIRYLAVDAIVNAANSELLGCFSPNHGCI   120

Query:   117  DNQIHTFAGSRLRLACHQLMTQQGRMEAVGQAKLTESYHLPCKYVIHTVGPYVKVDQKPS   176
              DN IHTFAGSRLRLAC +MT+QGR EA+GQAKLT +YHLP  Y+IHTVGP +        S
Sbjct:   121  DNAIHTFAGSRLRLACQAIMTEQGRKEAIGQAKLTSAYHLPASYIIHTVGPRITKGHHVS   180

Query:   177  RIREDLLKSSYKSCLQLAVRANLKTIVFPCISTGEFGFPNQRAAELAVQAILEWQRENQH   236
              IR DLL    Y+S L LAV+A L ++ F   ISTGEFGFP + AA++A++ +L+WQ E+
Sbjct:   181  PIRADLLARCYRSSLDLAVKAGLTSLAFCSISTGEFGFPKKEAAQIAIKTVLKWQAEHPE   240

Query:   237  K--LYIIFNTFTPKDQDIYQKLLLKE                                   260
                  L  IFNTFT +D+ +Y  L KE
Sbjct:   241  SKTLTTIFNTFTSEDKALYDTYLQKE                                   266
```

Based on this analysis, it was predicted that these proteins and their epitopes could be useful antigens for vaccines or diagnostics.

Example 2002

A DNA sequence (GBSx2112) was identified in *S. agalactiae* <SEQ ID 6189> which encodes the amino acid sequence <SEQ ID 6190>. Analysis of this protein sequence reveals the following:

```
Possible site: 41
>>> Seems to have no N-terminal signal sequence
----- Final Results -----
  bacterial cytoplasm --- Certainty = 0.2171 (Affirmative) <succ>
    bacterial membrane --- Certainty = 0.0000 (Not Clear) < succ>
      bacterial outside --- Certainty = 0.0000 (Not Clear) < succ>
```

The protein has no significant homology with any sequences in the GENPEPT database.

A related DNA sequence was identified in *S. pyogenes* <SEQ ID 6191> which encodes the amino acid sequence <SEQ ID 6192>. Analysis of this protein sequence reveals the following:

```
Possible site: 41
>>> Seems to have no N-terminal signal sequence
----- Final Results -----
  bacterial cytoplasm --- Certainty = 0.2477 (Affirmative) <succ>
    bacterial membrane --- Certainty = 0.0000 (Not Clear) <succ>
      bacterial outside --- Certainty = 0.0000 (Not Clear) <succ>
```

An alignment of the GAS and GBS proteins is shown below.

```
Identities = 218/284 (76%), Positives = 250/284 (87%)

Query:     4  WKTLEKTNHSQSEILSQLIEESDAIVVGIGAGMSAADGFTYIGPRFEEAFPDFIAKYQLL    63
              W T  + N +Q+E L+QLI+E+DA+VVGIGAGMSAADGFTYIG RFE AFPDFIAKYQ L
Sbjct:     4  WTTYPQKNLTQAEQLAQLIKEADALVVGIGAGMSAADGFTYIGSRFETAFPDFIAKYQFL    63

Query:    64  DMLQASLYDFEDWEEYWAFQSRFVALNYLDQPVGQAYLDLKDILAKKEYHIITTNADNAF   123
              DMLQASL+DFEDW+EYWAFQSRFVALNYLDQPVGQ+YLDLK+IL  K+YHIITTNADNAF
Sbjct:    64  DMLQASLFDFEDWQEYWAFQSRFVALNYLDQPVGQSYLDLKEILGTKDYHIITTNADNAF   123

Query:   124  AVADYNLEKVFHIQGEYGLWQCSQHCHQQTYRNDQAIRQMIAQQKDMKIPSNLIPKCPKC   183
                 VA Y+   +FHIQGEYGLWQCSQHCHQQTY++D  IRQMIA+QK+MK+P  LIP CP+C
Sbjct:   124  WVAGYDPHNIFHIQGEYGLWQCSQHCHQQTYKDDTVIRQMIAEQKNMKVPGQLIPHCPEC   183

Query:   184  DQPFEINKRNEEKGMVEDADFHAQRQRYENFLSQHQNDKVLYLEIGVGHTTPQFIKHPFW   243
              + PFEINKRNEEKGMVEDADFHAQ+ RYE FLS+H+  KVLYLEIGVGHTTPQFIKHPFW
Sbjct:   184  EAPFEINKRNEEKGMVEDADFHAQKARYEAFLSEHKEGKVLYLEIGVGHTTPQFIKHPFW   243

Query:   244  RFVSLNENSLFVTLNHKHYRIPQKIRSRSVQLTQHIAELIAEAK                287
              + VS N N+LFVTLNHKHYRIP  IR +S++LT+HIA+LI+  K
Sbjct:   244  KRVSENPNALFVTLNHKHYRIPLSIRRQSLELTEHIAQLISATK                287
```

Based on this analysis, it was predicted that these proteins and their epitopes could be useful antigens for vaccines or diagnostics.

Example 2003

A DNA sequence (GBSx2113) was identified in *S. agalactiae* <SEQ ID 6193> which encodes the amino acid sequence <SEQ ID 6194>. Analysis of this protein sequence reveals the following:

---

Possible site: 21
>>> Seems to have no N-terminal signal sequence
----- Final Results -----
   bacterial cytoplasm --- Certainty = 0.1086 (Affirmative) <succ>
   bacterial membrane --- Certainty = 0.0000 (Not Clear) <succ>
   bacterial outside --- Certainty = 0.0000 (Not Clear) <succ>

---

The protein has homology with the following sequences in the GENPEPT database.

A related DNA sequence was identified in *S. pyogenes* <SEQ ID 6195> which encodes the amino acid sequence <SEQ ID 6196>. Analysis of this protein sequence reveals the following:

---

Possible site: 21
>>> Seems to have no N-terminal signal sequence
----- Final Results -----
   bacterial cytoplasm --- Certainty = 0.0939 (Affirmative) <succ>
   bacterial membrane --- Certainty = 0.0000 (Not Clear) <succ>
   bacterial outside --- Certainty = 0.0000 (Not Clear) <succ>

---

An alignment of the GAS and GBS proteins is shown below.

```
>GP:CAB12865 GB:Z99109 similar to lipoate-protein ligase [Bacillus subtilis]

Identities = 130/331 (39%), Positives = 206/331 (61%), Gaps = 5/331 (1%)

Query:     9  NGKRITDGAIALAMQVYILQNVFLDDDILFPYYCDPKVEIGKFQNAVIETNQEYLKEHDI    68
              + +  I D  I LA++ Y ++++  +    L  Y   P + IGK QN + E N +Y++E+  I
Sbjct:     5  DNQNINDPRINLAIEEYCVKHLDPEQQYLLFYVNQPSIIIGKNQNTIEEINTKYVEENGI    64

Query:    69  PVVRRDTGGGAVYVDSGAVNICYLMKDHGQ-FGDFKRAYEPAIKALKTLGASSVEMRERN   127
               VVRR +GGGAVY D G +N  ++ KD G  F +FK+  EP I+AL  LG  + E+ RN
Sbjct:    65  IVVRRLSGGGAVYHDLGNLNFSFITKDDGDSFHNFKKFTEPVIQALHQLGVEA-ELSGRN   123

Query:   128  DLVIDGKKVSGAAMTIVNGRIYGGYSLLLDVDFDAMEKVLNPNRKKIESKGIKSVRSRVG   187
              D+V+DG+K+SG A    GRI+  +L+ D  D +   L   + KIESKGIKS+RSRV
Sbjct:   124  DIVVDGRKISGNAQFATKGRIFSHGTLMFDSAIDHVVSALKVKKDKIESKGIKSIRSRVA   183

Query:   188  DIRSHLSEDYRHITTDQFKDLMVCQLLHIDHIDQAKRYHLTEKDWAAIDALADEKYKNWD   247
              +I   L +   +TT++F+ ++  + + + +       Y LTEKDW  I  ++ E+Y+NWD
Sbjct:   184  NISEFLDDK---MTTEEFRSHLLRHIFNTNDVGNVPEYKLTEKDWETIHQISKERYQNWD   240

Query:   248  WNYGNSPQYSYHRDARFPSGTYDFHLEIEKGIITNCRIYGDFFSSKDISDIENLLIGCPM   307
              WNYG SP+++ +  R+P G+ D HLE++KG I +C+I+GDFF   D+S+IENLL+G
Sbjct:   241  WNYGRSPKFNLNHSKRYPVGSIDLHLEVKKGKIEDCKIFGDFFGVGDVSEIENLLVGKQY   300

Query:   308  KEELVLEKLSTLSLEDYFGQTSPEEIKAVLF                             338
              +  ++ + L  ++L+ YFG   E+    +++
Sbjct:   301  ERSVIADVLEGVNLKHYFGNITKEDFLDLIY                             331
```

```
Identities = 248/339 (73%), Positives = 283/339 (83%)

Query:    1  MYLIEPIRNGKRITDGAIALAMQVYILQNVFLDDDILFPYYCDPKVEIGKFQNAVIETNQ    60
             MYLIEPIRNGKRITDGA+ALAMQVY+ +N+FLDDDILFPYYCDPKVEIGKFQNAV+ETNQ
Sbjct:    1  MYLIEPIRNGKRITDGAVALAMQVYVQENLFLDDDILFPYYCDPKVEIGKFQNAVVETNQ    60

Query:   61  EYLKEHDIPVVRRDTGGGAVYVDSGAVNICYLMKDHGQFGDFKRAYEPAIKALKTLGASS   120
             EYLKEH IPVVRRDTGGGAVYVDSGAVNICYL+ D+G FGDFKR Y+PAI+AL  LGA+
Sbjct:   61  EYLKEHHIPVVRRDTGGGAVYVDSGAVNICYLINDNGIFGDFKRTYQPAIEALHHLGATE   120

Query:  121  VEMRERNDLVIDGKKVSGAAMTIVNGRIYGGYSLLLDVDFDAMEKVLNPNRKKIESKGIK   180
             VEM  RNDLVIDGKKVSGAAMTI NGR+YGGYSLLLDVDF+AMEK L PNRKKIESKGI+
Sbjct:  121  VEMSGRNDLVIDGKKVSGAAMTIANGRVYGGYSLLLDVDFEAMEKALKPNRKKIESKGIR   180

Query:  181  SVRSRVGDIRSHLSEDYRHITTDQFKDLMVCQLLHIDHIDQAKRYHLTEKDWAAIDALAD   240
             SVRSRVG+IR HL+  Y+ IT ++FKDLMVCQLL I+ I QAKRY LTEKDW  IDAL +
Sbjct:  181  SVRSRVGNIREHLAPQYQGITIEEFKDLMVCQLLQIETISQAKRYDLTEKDWQQIDALTE   240

Query:  241  EKYKNWDWNYGNSPQYSYHRDARFPSGTYDFHLEIEKGIITNCRIYGDFFSSKDISDIEN   300
              KY NW+WNYGN+PQY YHRD RF  GT D HL+I+KG I   CRIYGDFF  DI+++E
Sbjct:  241  RKYHNWEWNYGNAPQYRYHRDGRFTGGTVDIHLDIKKGYIAACRIYGDFFGKADIAELEG   300

Query:  301  LLIGCPMKEELVLEKLSTLSLEDYFGQTSPEEIKAVLFS                       339
             LIG  M++E VL   L+ + L  Y G  + EE+   ++FS
Sbjct:  301  HLIGTRMEKEDVLATLNAIDLAPYLGAITAEELGDLIFS                       339
```

Based on this analysis, it was predicted that these proteins and their epitopes could be useful antigens for vaccines or diagnostics.

Example 2004

A DNA sequence (GBSx2114) was identified in *S. agalactiae* <SEQ ID 6197> which encodes the amino acid sequence <SEQ ID 6198>. Analysis of this protein sequence reveals the following:

Possible site: 17
>>> Seems to have no N-terminal signal sequence
INTEGRAL    Likelihood = −1.49    Transmembrane 196-212 (196-212)
----- Final Results -----
  bacterial membrane --- Certainty = 0.1595 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

```
>GP:AAB49329 GB:U39612 formyl-tetrahydrofolate synthetase [Streptococcus mutans]
Identities = 432/556 (77%), Positives = 493/556 (87%)

Query:     1  MKTDIEIAQSVALKPIAEIVEQVGIGFDDIELYGKYKAKLSFDKIEAVKSQKVGKLILVT     60
              MKTDIEIAQSV L+PI  +V+++GI FDD ELYGKYKAKL+FDKI+AV+   GKL+LVT
Sbjct:     1  MKTDIEIAQSVDLRPITNVVKKLGIDFDDLELYGKYKAKLTFDKIKAVEENAPGKLVLVT     60

Query:    61  AINPTPAGEGKSTMSIGLADALNKIGKKTMIALREPSLGPVMGIKGGAAGGGYAQVLPME    120
              AINPTPAGEGKST++IGLADALNKIGKKTMIA+REPSLGPVMGIKGGAAGGGYAQVLPME
Sbjct:    61  AINPTPAGEGKSTITIGLADALNKIGKKTMIAIREPSLGPVMGIKGGAAGGGYAQVLPME    120

Query:   121  DINLHFTGDMHAITTANNALSALLDNHIHQGNELDIDQRRVIWKRVVDLNDRALRQVIVG    180
              DINLHFTGDMHAITTANNALSAL+DNH+HQGNEL IDQRR+IWKRVVDLNDRALR V VG
Sbjct:   121  DINLHFTGDMHAITTANNALSALIDNHLHQGNELGIDQRRIIWKRVVDLNDRALRHVTVG    180

Query:   181  LGSPVNGIPREDGFDITVASEIMAILCLATDLSDLKKRLSNIVVAYSRNRKPIYVKDLKI    240
              LGSP+NGIPREDGFDITVASEIMAILCLAT++ DLK+RL+NIV+ Y  +R P+YV+DL++
Sbjct:   181  LGSPINGIPREDGFDITVASEIMAILCLATNVEDLKERLANIVIGYRFDRSPVYVRDLEV    240

Query:   241  EGALTLILKDTIKPNLVQTIYGTPALVHGGPFANIAHGCNSVLATSTALRLADYVVTEAG    300
              +GAL LILK+ IKPNLVQTIYGTPA VHGGPFANIAHGCNSVLATSTALRLADY +TEAG
Sbjct:   241  QGALALILKEAIKPNLVQTIYGTPAFVHGGPFANIAHGCNSVLATSTALRLADYTITEAG    300

Query:   301  FGADLGAEKFLDIKTPNLPTSPDAIVIVATLRALKMHGGVSKEDLSQENVEAVKRGFTNL    360
              FGADLGAEKFLDIK PNLPTSPDA+VIVAT+RALKM+GGV+K+  L+QENVEAVK GF NL
Sbjct:   301  FGADLGAEKFLDIKAPNLPTSPDAVVIVATIRALKMNGGVAKDALNQENVEAVKAGFANL    360

Query:   361  ERHVNNMRQYGVPVVVAINQFTADTESEIATLKTLCSNIDVAVELASVWEDGADGGLELA    420
               RHV NMR+YGVPVVVAIN+F  DT  EIA L+  LC+ IDV VELASVW +GADGG++LA
Sbjct:   361  ARHVENMRKYGVPVVVAINEFITDTNDEIAVLRNLCAAIDVPVELASVWANGADGGVDLA    420

Query:   421  QTVANVIETQSSNYKRLYNDEDTIEEKIKKIVTKIYGGNKVHFGPKAQIQLKEFSDNGWD    480
                T+ N IE    S+YKRLY++  ++EEK+ +I  +IY   +KV F    KA+ Q+ +      NGWD
Sbjct:   421  NTLINTIENNPSHYKRLYDNNLSVEEKVTEIAKEIYRADKVIFEKKAKTQIAQIVKNGWD    480

Query:   481  KMPICMAKTQYSFSDNPNLLGAPTDFDITVREFVPKTGAGFIVALTGDVLTMPGLPKKPA    540
              K PICMAKTQYSFSD+P LLGAPT FDIT+RE VPK GAGFIVALTGDV+TMPGLPKKPA
Sbjct:   481  NLPICMAKTQYSFSDDPKLLGAPTGFDITIRELVPKLGAGFIVALTGDVMTMPGLPKKPA    540
```

-continued

```
Query:  541 ALNMDVLEDGTAIGLF                                          556
            ALNMDV  DGTA+GLF
Sbjct:  541 ALNMDVAADGTALGLF                                          556
```

A related DNA sequence was identified in *S. pyogenes* <SEQ ID 6199> which encodes the amino acid sequence <SEQ ID 6200>. Analysis of this protein sequence reveals the following:

---

Possible site: 50
>>> Seems to have no N-terminal signal sequence
INTEGRAL     Likelihood = −1.49    Transmembrane 196-212 (196-212)
----- Final Results -----
  bacterial membrane --- Certainty = 0.1595 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the databases:

```
>GP:AAB49329 GB:U39612 formyl-tetrahydrofolate synthetase [Streptococcus mutans]
Identities = 432/556 (77%), Positives = 490/556 (87%)

Query:    1 MKSDIEIAQSVALQPITDIVKKVGIDGDDIELYGKYKAKLSFEKMKAVEANEPGKLILVT    60
            MK+DIEIAQSV L+PIT++VKK+GID DD+ELYGKYKAKL+F+K+KAVE N PGKL+LVT
Sbjct:    1 MKTDIEIAQSVDLRPITNVVKKLGIDFDDLELYGKYKAKLTFDKIKAVEENAPGKLVLVT    60

Query:   61 AINPTPAGEGKSTMSIGLADALNQMGKKTMLALREPSLGPVMGIKGGAAGGGYAQVLPME   120
            AINPTPAGEGKST++IGLADALN++GKKTM+A+REPSLGPVMGIKGGAAGGGYAQVLPME
Sbjct:   61 AINPTPAGEGKSTITIGLADALNKIGKKTMIAIREPSLGPVMGIKGGAAGGGYAQVLPME   120

Query:  121 DINLHFTGDMHAITTANNALSALIDNHLQQGNDLGIDPRRIIWKRVLDLNDRALRQVIVG   180
            DINLHFTGDMHAITTANNALSALIDNHL QGN+LGID RRIIWKRV+DLNDRALR V VG
Sbjct:  121 DINLHFTGDMHAITTANNALSALIDNHLHQGNELGIDQRRIIWKRVVDLNDRALRHVTVG   180

Query:  181 LGSPVNGVPREDGFDITVASEIMAILCLATDLKDLKKRLADIVVAYTYDRKPVYVRDLKV   240
            LGSP+NG+PREDGFDITVASEIMAILCLAT+++DLK+RLA+IV+ Y +DR PVYVRDL+V
Sbjct:  181 LGSPINGIPREDGFDITVASEIMAILCLATNVEDLKERLANIVIGYRFDRSPVYVRDLEV   240

Query:  241 EGALTLILKDAIKPNLVQTIYGTPALIHGGPFANIAHGCNSVLATSTALRLADYTVTEAG   300
            +GAL LILK+AIKPNLVQTIYGTPA +HGGPFANIAHGCNSVLATSTALRLADYT+TEAG
Sbjct:  241 QGALALILKEAIKPNLVQTIYGTPAFVHGGPFANIAHGCNSVLATSTALRLADYTITEAG   300

Query:  301 FGADLGAEKFLNIKVPNLPKAPDAIVIVATLRALKMHGGVAKSDLAAENCEAVRLGFANL   360
            FGADLGAEKFL+IK PNLP +PDA+VIVAT+RALKM+GGVAK   L EN EAV+ GFANL
Sbjct:  301 FGADLGAEKFLDIKAPNLPTSPDAVVIVATIRALKMNGGVAKDALNQENVEAVKAGFANL   360

Query:  361 KRHVENMRQFKVPVVVAINEFVADTEAEIATLKALCEEIKVPVELASVWANGAEGGLALA   420
              RHVENMR++ VPVVVAINEF+ DT  EIA L+ LC  I VPVELASVWANGA+GG+ LA
Sbjct:  361 ARHVENMRKYGVPVVVAINEFITDTNDEIAVLRNLCAAIDVPVELASVWANGADGGVDLA   420

Query:  421 KTVVRVIDQEAADYKRLYSDEDTLEEKVINIVTQIYGGKAVQFGPKAKTQLKQFAEFGWD   480
            T++  I+   + YKRLY +  ++EEKV I   +IY    V F  KAKTQ+ Q   + GWD
Sbjct:  421 NTLINTIENNPSHYKRLYDNNLSVEEKVTEIAKEIYRADKVIFEKKAKTQIAQIVKNGWD   480

Query:  481 KLPVCMAKTQYSFSDNPSLLGAPTDFDITIREFVPKTGAGFIVGLTGDVMTMPGLPKVPA   540
             LP+CMAKTQYSFSD+P LLGAPT FDITIRE VPK GAGFIV LTGDVMTMPGLPK PA
Sbjct:  481 NLPICMAKTQYSFSDDPKLLGAPTGFDITIRELVPKLGAGFIVALTGDVMTMPGLPKKPA   540

Query:  541 AMAMDVAENGTALGLF                                          556
            A+ MDVA +GTALGLF
Sbjct:  541 ALNMDVAADGTALGLF                                          556
```

An alignment of the GAS and GBS proteins is shown below.

```
Identities = 452/556 (81%), Positives = 513/556 (91%)

Query:    1 MKTDIEIAQSVALKPIAEIVEQVGIGFDDIELYGKYKAKLSFDKIEAVKSQKVGKLILVT    60
            MK+DIEIAQSVAL+PI +IV++VGI DDIELYGKYKAKLSF+K++AV++  GKLILVT
```

-continued

```
Sbjct:    1  MKSDIEIAQSVALQPITDIVKKVGIDGDDIELYGKYKAKLSFEKMKAVEANEPGKLILVT      60

Query:   61  AINPTPAGEGKSTMSIGLADALNKIGKKTMIALREPSLGPVMGIKGGAAGGGYAQVLPME    120
             AINPTPAGEGKSTMSIGLADALN++GKKTM+ALREPSLGPVMGIKGGAAGGGYAQVLPME
Sbjct:   61  AINPTPAGEGKSTMSIGLADALNQMGKKTMLALREPSLGPVMGIKGGAAGGGYAQVLPME    120

Query:  121  DINLHFTGDMHAITTANNALSALLDNHIHQGNELDIDQRRVIWKRVVDLNDRALRQVIVG    180
             DINLHFTGDMHAITTANNALSAL+DNH+ QGN+L ID RR+IWKRV+DLNDRALRQVIVG
Sbjct:  121  DINLHFTGDMHAITTANNALSALIDNHLQQGNDLGIDPRRIIWKRVLDLNDRALRQVIVG    180

Query:  181  LGSPVNGIPREDGFDITVASEIMAILCLATDLSDLKKRLSNIVVAYSRNRKPIYVKDLKI    240
             LGSPVNG+PREDGFDITVASEIMAILCLATDL DLKKRL++IVVAY+ +RKP+YV+DLK+
Sbjct:  181  LGSPVNGVPREDGFDITVASEIMAILCLATDLKDLKKRLADIVVAYTDRKPVYVRDLKV    240

Query:  241  EGALTLILKDTIKPNLVQTIYGTPALVHGGPFANIAHGCNSVLATSTALRLADYVVTEAG    300
             EGALTLILKD IKPNLVQTIYGTPAL+HGGPFANIAHGCNSVLATSTALRLADY VTEAG
Sbjct:  241  EGALTLILKDAIKPNLVQTIYGTPALIHGGPFANIAHGCNSVLATSTALRLADYTVTEAG    300

Query:  301  FGADLGAEKFLDIKTPNLPTSPDAIVIVATLRALKMHGGVSKEDLSQENVEAVKRGFTNL    360
             FGADLGAEKFL+IK PNLP +PDAIVIVATLRALKMHGGV+K DL+ EN EAV+ GF NL
Sbjct:  301  FGADLGAEKFLNIKVPNLPKAPDAIVIVATLRALKMHGGVAKSDLAAENCEAVRLGFANL    360

Query:  361  ERHVNNMRQYGVPVVVAINQFTADTESEIATLKTLCSNIDVAVELASVWEDGADGGLELA    420
             +RHV NMRQ+ VPVVVAIN+F ADTE+EIATLK LC  I V VELASVW +GA+GGL LA
Sbjct:  361  KRHVENMRQFKVPVVVAINEFVADTEAEIATLKALCEEIKVPVELASVWANGAEGGLALA    420

Query:  421  QTVANVIETQSSNYKRLYNDEDTIEEKIKKIVTKIYGGNKVHFGPKAQIQLKEFSDNGWD    480
             +TV  VI+ ++++YKRLY+DEDT+EEK+  IVT+IYGG V FGPKA+ QLK+F++ GWD
Sbjct:  421  KTVVRVIDQEAADYKRLYSDEDTLEEKVINIVTQIYGGKAVQFGPKAKTQLKQFAEFGWD    480

Query:  481  KMPICMAKTQYSFSDNPNLLGAPTDFDITVREFVPKTGAGFIVALTGDVLTMPGLPKKPA    540
             K+P+CMAKTQYSFSDNP+LLGAPTDFDIT+REFVPKTGAGFIV LTGDV+TMPGLPK PA
Sbjct:  481  KLPVCMAKTQYSFSDNPSLLGAPTDFDITIREFVPKTGAGFIVGLTGDVMTMPGLPKVPA    540

Query:  541  ALNMDVLEDGTAIGLF                                              556
             A+ MDV E+GTA+GLF
Sbjct:  541  AMAMDVAENGTALGLF                                              556
```

A related DNA sequence was identified in *S. pyogenes* <SEQ ID 9057> which encodes amino acid sequence <SEQ ID 9058>. Analysis of this protein sequence reveals the following:

Possible site: 13
>>> Seems to have no N-terminal signal sequence
INTEGRAL      Likelihood = −1.49    Transmembrane 516-532 (516-533)
----- Final Results -----
  bacterial membrane --- Certainty = 0.1595 (Affirmative) <succ>
  bacterial outside--- Certainty = 0.0000 (Not Clear) <succ>
  bacterial cytoplasm --- Certainty = 0.0000 (Not Clear) <succ>

An alignment of the GAS and GBS sequences follows:

```
Score = 604 bits (1540), Expect = e-174
Identities = 304/555 (54%), Positives = 389/555 (69%), Gaps = 2/555 (0%)

Query:    4  SDIEIANSVTMEPISKVADQLGIDKEALCLYGKYKAKIDARQLVALKNKPDGKLILVTAI     63
             +DIEIA SV ++PI+++ +Q+GI + + LYGKYKAK+   ++ A+K++  GKLILVTAI
Sbjct:    3  TDIEIAQSVALKPIAEIVEQVGIGFDDIELYGKYKAKLSFDKIEAVKSQKVGKLILVTAI     62

Query:   64  SPTPAGEGKTTTSVGLVDALSAIGKKAVIALREPSLXXXXXXXXXXXXXXXXXXXXPMEDI   123
             +PTPAGEGK+T S+GL DAL+ IGKK +IALREPSL                    PMEDI
Sbjct:   63  NPTPAGEGKSTMSIGLADALNKIGKKTMIALREPSLGPVMGIKGGAAGGGYAQVLPMEDI   122

Query:  124  NLHFTGDFHAIGVANNLLAALIDNHIHHGNSLGIDSRRITWKRVVDMNDRQLRHIVDGLQ    183
             NLHFTGD HAI  ANN L+AL+DNHIH GN L ID RR+ WKRVVD+NDR LR ++ GL
Sbjct:  123  NLHFTGDMHAITTANNALSALLDNHIHQGNELDIDQRRVIWKRVVDLNDRALRQVIVGLG    182

Query:  184  GKVNGIPREDGYDITVASEIMAILCLSENISDLKARLEKIIIGYNYQGEPVTXXXXXXXX    243
                VNGIPREDG+DITVASEIMAILCL+ ++SDLK RL  I++ Y+    +P+
Sbjct:  183  SPVNGIPREDGFDITVASEIMAILCLATDLSDLKKRLSNIVVAYSRNRKPIYVFDLKIEG    242

Query:  244  XXXXXXXXIHPNLVQTLEHTPALIHGGPFANIAHGCNSVLATKLALKYGDYAVTEAGFG    303
                     I PNLVQT+  TPAL+HGGPFANIAHGCNSVLAT  AL+   DY VTEAGFG
Sbjct:  243  ALTLILKDTIKPNLVQTIYGTPALVHGGPFANIAHGCNSVLATSTALRLADYVVTEAGFG    302

Query:  304  ADLGAEKFIDIKCRMSGLRPAAVVLVATIRALKMHGGVPKADLATENVQAVVDGLPNLDK    363
```

-continued

```
              ADLGAEKF+DIK         P A+V+VAT+RALKMHGGV K DL+ ENV+AV  G   NL++
Sbjct:  303   ADLGAEKFLDIKTPNLPTSPDAIVIVATLRALKMHGGVSKEDLSQENVEAVKRGFTNLER       362

Query:  364   HLANIQDVYGLPVVVAINKFPLDTDAELQAVYDACDKRGVDVVISDVWANGGAGGRELAE       423
              H+ N++   YG+PVVVAIN+F  DT++E+   +     C     V V ++ VW +G  GG ELA+
Sbjct:  363   HVNNMRQ-YGVPVVVAINQFTADTESEIATLKTLCSNIDVAVELASVWEDGADGGLELAQ       421

Query:  424   KVVTLAE-QDNQFRFVYEEDDSIETKLTKIVTKVYGGKGINLSSAAKRELADLERLGFGN       482
              V  + E Q + ++  +Y ++D+IE K+ KIVTK+YGG  ++     A+ +L +     G+
Sbjct:  422   TVANVIETQSSNYKRLYNDEDTIEEKIKKIVTKIYGGNKVHFGPKAQIQLKEFSDNGWDK       481

Query:  483   YPICMAKTQYSFSDDAKKLGAPTDFTVTISNLKVSAGAGFIVALTGAIMTMPGLPKVPAS       542
                 PICMAKTQYSFSD+    LGAPTDF +T+       GAGFIVALTG ++TMPGLPK PA+
Sbjct:  482   MPICMAKTQYSFSDNPNLLGAPTDFDITVREFVPKTGAGFIVALTGDVLTMPGLPKKPAA       541

Query:  543   ETIDIDEEGNITGLF                                                    557
                 +D+  E+G    GLF
Sbjct:  542   LNMDVLEDGTAIGLF                                                    556
```

SEQ ID 6198 (GBS131) was expressed in *E. coli* as a His-fusion product. SDS-PAGE analysis of total cell extract is shown in FIG. 29 (lane 6; MW 64.8 kDa). It was also expressed in *E. coli* as a GST-fusion product. SDS-PAGE analysis of total cell extract is shown in FIG. 35 (lane 4; MW 90 kDa).

GBS131-GST was purified as shown in FIG. 201, lane 5.

Based on this analysis, it was predicted that these proteins and their epitopes could be useful antigens for vaccines or diagnostics.

Example 2005

A DNA sequence (GBSx2115) was identified in *S. agalactiae* <SEQ ID 6201> which encodes the amino acid sequence <SEQ ID 6202>. Analysis of this protein sequence reveals the following:

Possible site: 53
>>> Seems to have no N-terminal signal sequence

| | | |
|---|---|---|
| INTEGRAL | Likelihood = −10.03 | Transmembrane 34-50 (29-56) |
| INTEGRAL | Likelihood = −7.70 | Transmembrane 90-106 (84-110) |
| INTEGRAL | Likelihood = −1.97 | Transmembrane 62-78 (62-78) |
| INTEGRAL | Likelihood = −0.69 | Transmembrane 275-291 (275-291) |

----- Final Results ----- bacterial membrane --- Certainty = 0.5012 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the GENPEPT database.

```
>GP:AAA88609 GB:M37842 unknown protein [Streptococcus mutans]
Identities = 243/373 (65%), Positives = 302/373 (80%), Gaps = 1/373 (0%)

Query:   71   IGAVLYLVNSEMDALSRVTWLILVMIAPLLGAMFLMYTKFDWGYRGLKQRLETLIDESQI       130
              IG+VLYLVNS+MD LS +TWL++++  P+LG +FL +YTK DWGYR LK  ++        +
Sbjct:    2   IGSVLYLVNSQMDTLSIITWLLVILPFPILGTLFLIYTKQDWGYRELKSLIKKSTQAIKP        61

Query:  131   YLEDDPETLNQLKSSTSTTYHLVQYFEKAHGNFPVYRNTDVTFLPTGEAFFEKMKEELLK       190
              Y + D      L +LK S  +  TY+L QY    ++  G FPVY+NT VT+ P G++  FE+MK++LLK
Sbjct:   62   YFQYDQRILYKLKESHARTYNLAQYLHRS-GGFPVYKNTKVTYFPNGQSKFEEMKKQLLK       120

Query:  191   AKEYIFLEFFIIDEGIMWGEILSILEQKVEEGVEVRILYDGMIEITKLSFDYTKRLEKIG       250
              A+K+ IFLE+FII EG+MWGEILSILEQKV EGVEVR++YDGM+E++  LSFDY KRLEKIG
Sbjct:  121   AEKFIFLEYFIIAEGLMWGEILSILEQKVQEGVEVRVMYDGMLELSTLSFDYAKRLEKIG       180

Query:  251   IKAKAFSPISPFISTYYNYRDHRKIVVIDGVVGMTGGVNLADEYINHIELFGHWKDSGIM       310
              IKAK  FSPI+PF+STYYNYRDHRKI+VID    GG+NLADEYIN IE  FG+WKD+ +M
Sbjct:  181   IKAKVFSPITPFVSTYYNYRDHRKILVIDNKVAFNGGINLADEYINQIERFGYWKDTAVM       240

Query:  311   LKGKAVDSFLLLFLQMWSITEEKMLVAPYLGVHDDLVENEGYVIPYGDSPLDTDKVGENV       370
              L+G+  V  SF L+FLQMWS T +      APYL +      + GYVIPY DSPLD +KVGENV
Sbjct:  241   LEGEGVASFTLMFLQMWSTTNKDYEFAPYLTQNFHEIVANGYVIPYSDSPLDHEKVGENV       300

Query:  371   YIDILNHAREYVYIMTPYLILDSELEHAIQFAAERGVDVRIIMPGIPDKPIPYALAKTYY       430
              YIDILN AR+YVYIMTPYLILDSE+EHA+QFAAERGVDV+IIMPGIPDK +P+ALAK Y+
Sbjct:  301   YIDILNQARDYVYIMTPYLILDSEMEHALQFAAERGVDVKIIMPGIPDKKVPFALAKRYF       360

Query:  431   QALTKSGVKIYEY                                                      443
                AL   +GVKIYE+
Sbjct:  361   PALLDAGVKIYEF                                                      373
```

A related DNA sequence was identified in *S. pyogenes* <SEQ ID 6203> which encodes the amino acid sequence <SEQ ID 6204>. Analysis of this protein sequence reveals the following:

Possible site: 47
>>> Seems to have no N-terminal signal sequence
INTEGRAL    Likelihood = −8.86    Transmembrane 84-100 (81-104)
INTEGRAL    Likelihood = −8.33    Transmembrane 28-44 (23-49)
INTEGRAL    Likelihood = −6.74    Transmembrane 56-72 (53-74)
----- Final Results -----
   bacterial membrane --- Certainty = 0.4545 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the databases:

```
>GP:AAA23240 GB:J02911 formyltetrahydrofolate synthetase (FTHFS)
(ttg start codon) (EC 6.3.4.3) [Moorella thermoacetica]
Identities = 350/557 (62%), Positives = 438/557 (77%), Gaps = 2/557 (0%)

Query:     2  VLSDIEIANSVTMEPISKVADQLGIDKEALCLYGKYKAKIDARQLVALKNKPDGKLILVT    61
              V SDIEIA +   M+P+ ++A  LGI ++ + LYGKYKAKI        LK+KPDGKLILVT
Sbjct:     4  VPSDIEIAQAAKMKPVMELARGLGIQEDEVELYGKYKAKISLDVYRRLKDKPDGKLILVT    63

Query:    62  AISPTPAGEGKTTTSVGLVDALSAIGKKAVIALREPSLGPVFGVKGGAAGGGHAQVVPME   121
              AI+PTPAGEGKTTTSVGL DAL+ +GK+ ++ LREPSLGP FG+KGGAAGGG+AQVVPME
Sbjct:    64  AITPTPAGEGKTTTSVGLTDALARLGKRVMVCLREPSLGPSFGIKGGAAGGGYAQVVPME   123

Query:   122  DINLHFTGDFHAIGVANNLLAALIDNHIHHGNSLGIDSRRITWKRVVDMNDRQLRHIVDG   181
              DINLHFTGD HA+  A+NLLAA++DNH+  GN L ID R ITW+RV+D+NDR LR+IV G
Sbjct:   124  DINLHFTGDIHAVTYAHNLLAAMVDNHLQQGNVLNIDPRTITWRRVIDLNDRALRNIVIG   183

Query:   182  LQGKVNGIPREDGYDITVASEIMAILCLSENISDLKARLEKIIIGYNYQGEPVTAKDLKA   241
              L GK NG+PRE G+DI+VASE+MA LCL+ ++ DLK R  +I++GY Y G+PVTA DL+A
Sbjct:   184  LGGKANGVPRETGEDISVASEVMACLCLASDLMDLKERFSRIVVGYTYDGKPVTAGDLEA   243

Query:   242  GGALAALLKDAIHPNLVQTLEHTPALIHGGPFANIAHGCNSVLATKLALKYGDYAVTEAG   301
                G++A L+KDAI PNLVQTLE+TPA IHGGPFANIAHGCNS++ATK ALK  DY VTEAG
Sbjct:   244  QGSMALLMKDAIKPNLVQTLENTPAFIHGGPFANIAHGCNSIIATKTALKLADYVVTEAG   303

Query:   302  FGADLGAEKFIDIKCRMSGLRPAAVVLVATIRALKMHGGVPKADLATENVQAVVDGLPNL   361
              FGADLGAEKF D+KCR +G +P A V+VAT+RALKMHGGVPK+DLATEN++A+ +G  NL
Sbjct:   304  FGADLGAEKFYDVKCRYAGFKPDATVIVATVRALKMHGGVPKSDLATENLEALREGFANL   363

Query:   362  DKHLANIQDVYGLPVVVAINKFPLDTDAELQAVYDACDKRGVDVVISDVWANGGAGGREL   421
              +KH+ NI  +G+P VVAIN FP DT+AEL +Y+ C K G +V +S+VWA GG GG EL
Sbjct:   364  EKHIENI-GKFGVPAVVAINAFPTDTEAELNLLYELCAKAGAEVALSEVWAKGGEGGLEL   422

Query:   422  AEKVV-TLAEQDNQFRFVYEEDDSIETKLTKIVTKVYGGKGINLSSAAKRELADLERLGF   480
              A KV+ TL  + + F  +Y  D SI+ K+ KI T++YG  G+N ++ A  +    E LG+
Sbjct:   423  ARKVLQTLESRPSNFHVLYNLDLSIKDKIAKIATEIYGADGVNYTAEADKAIQRYESLGY   482

Query:   481  GNYPICMAKTQYSFSDDAKKLGAPTDFTVTISNLKVSAGAGFIVALTGAIMTMPGLPKVP   540
              GN P+ MAKTQYSFSDD   KLG P +FT+T+  +++SAG    IV +TGAIMTMPGLPK P
Sbjct:   483  GNLPVVMAKTQYSFSDDMTKLGRPRNFTITVREVRLSAGGRLIVPITGAIMTMPGLPKRP   542

Query:   541  ASETIDIDEEGNITGLF   557
              A+  IDID +G ITGLF
Sbjct:   543  AACNIDIDADGVITGLF   559
!GB:M37842 unknown protein [Streptococcus mutans] (v...   517 e-145

>GP:AAA88609 GB:M37842 unknown protein [Streptococcus mutans]
Identities = 246/370 (66%), Positives = 303/370 (81%), Gaps = 1/370 (0%)

Query:    68  VLYLVNSDMDAISRMTWLILIMIAPLLGSLFLIYTKLDWGYRGLKQRINHLVDLSAPYLS   127
              VLYLVNS MD +S +TWL++I+  P+LG+LFLIYTK DWGYR LK  I         PY
Sbjct:     5  VLYLVNSQMDTLSIITWLLVILPFPILGTLFLIYTKQDWGYRELKSLIKKSTQAIKPYFQ    64

Query:   128  DDDAILEVLKDSTSTTYHLVQYLERSRGNFPIYNNTRVTYFPTGETFEDSLKEQLFLAKK   187
              D   IL LK+S + TY+L QYL RS G FP+Y NT+VTYFP G++ F+ +K+QL  A+K
Sbjct:    65  YDQRILYKLKESHARTYNLAQYLHRS-GGFPVYKNTKVTYFPNGQSKFEEMKKQLLKAEK   123

Query:   188  YIFLEFFIIAEGQMWGEILSILEKKVSEGVEVRVLFDGMNELSTLSSDYAKRLEQIGIKA   247
              +IFLE+FIIAEG MWGEILSILE+KV EGVEVRV++DGM ELSTLS DYAKRLE+IGIKA
Sbjct:   124  FIFLEYFIIAEGLMWGEILSILEQKVQEGVEVRVMYDGMLELSTLSFDYAKRLEKIGIKA   183

Query:   248  KSFLPISPFISTYYNYRDHRKIVVIDGEVSFTGGINLADEYINEVERFGHWKDAGLMLEG   307
              K F  PI+PF+STYYNYRDHRKI VID +V F GGINLADEYIN++ERFG+WKD  +MLEG
Sbjct:   184  KVFSPITPFVSTYYNYRDHRKILVIDNKVAFNGGINLADEYINQIERFGYWKDTAVMLEG   243

Query:   308  EATDSFLILFLQMWSITEKELIIDPYLSDHSLKLPSDGYVIPYGDSPLDTKIGKNVYID   367
              E   SF +++FLQMWS T K+   PYL+ +  ++ ++GYVIPY DSPLD K+G+NVYID
Sbjct:   244  EGVASFTLMFLQMWSTTNKDYEFAPYLTQNFHEIVANGYVIPYSDSPLDHEKVGENVYID   303
```

-continued

```
Query:  368  ILNHAKEYVYIMTPYLILDSEMEHALRFASERGVDIRIIMPGVPDKGVPYALAKTYYKAL  427
             ILN A++YVYIMTPYLILDSEMEHAL+FA+ERGVD++IIMPG+PDK VP+ALAK Y+ AL
Sbjct:  304  ILNQARDYVYIMTPYLILDSEMEHALQFAAERGVDVKIIMPGIPDKKVPFALAKRYFPAL  363

Query:  428  MSSGVKIYEY  437
             + +GVKIYE+
Sbjct:  364  LDAGVKIYEF  373
```

An alignment of the GAS and GBS proteins is shown 10 below.

```
Identities = 362/524 (69%), Positives = 437/524 (83%)

Query:    8  LISNKVKIVRLLNKSKKSLLRGIFSRTTVIAILLILQLLFLLASYSWLEQYRVWLATVEH   67
             +I  K K+  LL+K K   LRGIFSRTT+I +L+ILQL+FL  SY+W+EQYRVW+  +E
Sbjct:    2  IIKKKAKVKYLLHKGKHGFLRGIFSRTTIIVLLIILQLVFLFQSYAWMEQYRVWITILES   61

Query:   68  ILTIGAVLYLVNSEMDALSRVTWLILVMIAPLLGAMFLMYTKFDWGYRGLKQRLETLIDE  127
             +  I  VLYLVNS+MDA+SR+TWLIL+MIAPLLG++FL+YTK DWGYRGLKQR+  L+D
Sbjct:   62  VFAITIVLYLVNSDMDAISRMTWLILIMIAPLLGSLFLIYTKLDWGYRGLKQRINHLVDL  121

Query:  128  SQIYLEDDPETLNQLKSSTSTTYHLVQYFEKAHGNFPVYRNTDVTFLPTGEAFFEKMKEE  187
             S   YL DD    L  LK STSTTYHLVQY E++ GNFP+Y NT VT+ PTGE FF+ +KE+
Sbjct:  122  SAPYLSDDDAILEVLKDSTSTTYHLVQYLERSRGNFPIYNNTRVTYFPTGETFFDSLKEQ  181

Query:  188  LLKAKKYIFLEFFIIDEGIMWGEILSILEQKVEEGVEVRILYDGMIEITKLSFDYTKRLE  247
             L  AKKYIFLEFFII EG MWGEILSILE+KV EGVEVR+L+DGM E++  LS DY KRLE
Sbjct:  182  LFLAKKYIFLEFFIIAEGQMWGEILSILEKKVSEGVEVRVLFDGMNELSTLSSDYAKRLE  241

Query:  248  KIGIKAKAFSPISPFISTYYNYRDHRKIVVIDGVVGMTGGVNLADEYINHIELFGHWKDS  307
             +IGIKAK+F  PISPFISTYYNYRDHRKIVVIDG V    TGG+NLADEYIN +E FGHWKD+
Sbjct:  242  QIGIKAKSFLPISPFISTYYNYRDHRKIVVIDGEVSFTGGINLADEYINEVERFGHWKDA  301

Query:  308  GIMLKGKAVDSFLLLFLQMWSITEEKMLVAPYLGVHDDLVENEGYVIPYGDSPLDTDKVG  367
             G+ML+G+A DSFL+LFLQMWSITE+++++ PYL  H   + ++GYVIPYGDSPLDTDK+G
Sbjct:  302  GLMLEGEATDSFLILFLQMWSITEKELIIDPYLSDHSLKLPSDGYVIPYGDSPLDTDKIG  361

Query:  368  ENVYIDILNHAREYVYIMTPYLILDSELEHAIQFAAERGVDVRIIMPGIPDKPIPYALAK  427
             +NVYIDILNHA+EYVYIMTPYLILDSE+EHA++FA+ERGVD+RIIMPG+PDK +PYALAK
Sbjct:  362  KNVYIDILNHAKEYVYIMTPYLILDSEMEHALRFASERGVDIRIIMPGVPDKGVPYALAK  421

Query:  428  TYYQALTKSGVKIYEYTLGFVHSKIFLSDNTKAVVGTINLDYRSLYHHFECAVYLKVDA  487
             TYY+AL  SGVKIYEY  GFVHSK+F+SDNTKAVVGTINLDYRSLYHHFECA YLY+V
Sbjct:  422  TYYKALMSSGVKIYEYQPGFVHSKVFISDNTKAVVGTINLDYRSLYHHFECATYLYRVSV  481

Query:  488  IQDIYRDYMDTLNKSRLVSLKDINNIPKFQKVIGIVTKTIAPLL  531
             I DI  D+ +  +S L++  +    P +QK+IG++ +  IAPLL
Sbjct:  482  IADIVNDFNEAQKQSLLMTSDHLTQRPWYQKLIGLLVRIIAPLL  525
```

A related GBS gene <SEQ ID 8953> and protein <SEQ ID 8954> were also identified. Analysis of this protein sequence reveals the following:

Lipop Possible site: −1 Crend: 6
McG: Discrim Score: −8.80
GvH: Signal Score (−7.5): −1.94
Possible site: 53
>>> Seems to have no N-terminal signal sequence
ALOM program count: 4 value: −10.03 threshold: 0.0
INTEGRAL     Likelihood = −10.03   Transmembrane 34-50 (29-56)
INTEGRAL     Likelihood = −7.70    Transmembrane 90-106 (84-110)
INTEGRAL     Likelihood = −1.97    Transmembrane 62-78 (62-78)

-continued

PERIPHERAL    Likelihood = 1.22   199
modified ALOM score: 2.51
*** Reasoning Step: 3
----- Final Results -----
   bacterial membrane --- Certainty = 0.5012 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the databases:

```
32.5/57.2% over 498aa
Bacillus firmus
SP|O66043| CARDIOLIPIN SYNTHETASE (EC 2.7.8.—) (CARDIOLIPIN SYNTHASE) (CL SYNTHASE).
Insert characterized
GP|2952028|gb|AAC05444.1||U88888 cardiolipin synthase Insert characterized
```

```
ORF01572(409-1893 of 2193)
SP|O66043|CLS_BACFI(5-503 of 503) CARDIOLIPIN SYNTHETASE (EC 2.7.8.—) (CARDIOLIPIN
SYNTHASE) (CL SYNTHASE). GP|2952028|gb|AAC05444.1||U88888 cardiolipin synthase
{Bacillus firmus}
% Match = 17.9
% Identity = 32.5 % Similarity = 57.1
Matches = 162 Mismatches = 204 Conservative Sub.s = 123

153       183       213       243       273       303       333       363
           NLQLSIWMF*KTVQPLDYFK**RGRACDASLFLLGIRF*LEII*NNRMLFK*QYAIIK*LIWRGEKLISNKVKIVRLLNK 393       423       447       477       507       528       558       588
           SKKSLLRGIFSRTTVIAILLILQLLF--LLASYSWLEQYRVWLATVEHILT---IGAVLYLVNSEMDALSRVTWLILVMI
                      : |   : |||    |    |  :|: :     :|   |:    || ::::  |           :|||:::
                      MKNRLNVLAFFALLFAALYISRGFLQSWMVGTLSVVFTLSVIFIGIIIFFEN--RHPTKTLTWLLVLAA
                       10        20        30        40        50        60

618       648       678       705       735       765       789       819
           APLLGAMFLMYTKFDWGYRGLKQRLETLIDESQIYLE-DDPETLNQLKSSTSTTYHLVQYFEKAH--GNFPVYRNTDVTF
            |::|   |:  |    :|   |:   :    |:: : : :    ||: :       |       |   ||  |   |:   :::
           FPVVG--FFFYLMFGQNHRKSKRFSKKAIEDERAFQKIEGQRQLNE-EQLKKMGGHQQLLFRLAHKLGKNPISFSSETKV
                       80        90       100       110       120       130       140

849       879       909       939       969       999      1029      1059
           LPTGEAFFEKMKEELLKAKKYIFLEFFIIDEGIMWGEILSILEQKVEEGVEVRILYDGMIEITKLSFDYTKRLEKIGIKA
           |   |:    : :  :  |   |:  :|  ||:::|:         |||: :          |     ||     |   |:   :::
           LTDGKETYAHILQALKMAEHHIHLEYYIVRHDDLGNQIKDILISKAKEGVHVRFLYDG-VGSWKLSKSYVEELRDAGVEM
                      160       170       180       190       200       210       220

1086      1116      1146      1176      1206      1236      1266      1293
           KAFSPIS-PFISTYYNYRDHRKIVVIDGVVGMTGGVNLADEYINHIELFGHWKDSGIMLKGKAVDSFLLLFLQMWSI-TE
            :|||:   ||::   |||:|||:|||||||   ||:|:  |||:         ||:|:|:  : ::|:||   ::  :||| |        |
           VSFSPVKLPFLTHTINYRNHRKIIVIDGVVGFVGGLNIGDEYLGKDAYFGYWRDTHLYVRGEAVRTLQLIFLQDWHYQTG
                      240       250       260       270       280       290       300

1323      1353      1383      1413      1443      1473      1503      1533
           EKMLVAPYLGVHDDLVENEGYVIPYGDSPLDTDKVGENVYIDILNHAREYVYIMTPYLILDSELEHAIQFAAERGVDVRI
           | :|   ||       :: :|  |         |     :|  :::    ::      |::  ::|    :||:|   |::     |::  ||   |:||||
           ETILNQTYLSPSLSMTKGDGGVQMIASGPDTRWEVNKKLFFSMITSAKKSIWIASPYFIPDDDILSALKIAALSGIDVRI
                      320       330       340       350       360       370       380

1563      1593      1623      1653      1683      1713      1743      1773
           IMPGIPDKPIPYALAKTYYQALTKSGVKIYEYTLGFVHSKIFLSDNTKAVVGTINLDYRSLYHHFECAVYLYKVDAIQDI
           ::|   |||   |  :   :::|:   |    |  ::|||:|||   ||:|||||  |::|||   |:|:||     :||          |||:  :||     |||::|
           LVPNRPDKRIVFHASRSYFPELLEAGVKVYEYNRGFMHSKIIIVDHEIASIGTSNMDMRSFHLNFEVNAYLYRTSSVTKL
                      400       410       420       430       440       450       460

1803      1833      1863      1893      1923      1953      1983      2013
           YRDYMDTLNKSRLVSLKDINNIPKFQKVIGIVTKTIAPLL*K*FIFNLILKVN*RI*LYLKSKGCILTKLC*TTVMR*VD
            ||:  |    |     :::      |   |  |:::|     ::  ::|||
           VSDYVYDLEHSNQINFSLFKNRPFFHRLIESTSRLLSPLL
                      480       490       500
```

Figure 150:
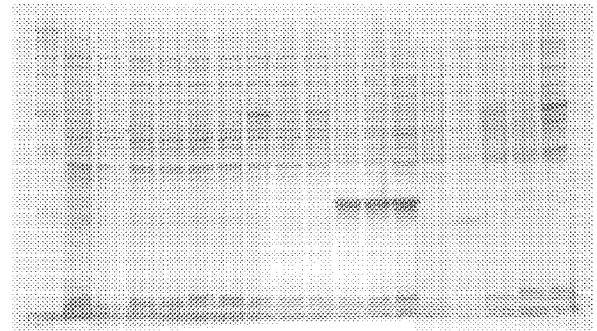

SEQ ID 8954 (GBS277d) was expressed in *E. coli* as a His-fusion product. SDS-PAGE analysis of total cell extract is shown in FIG. 150 (lane 18; MW 51 kDa), in FIG. 151 (lane 17 & 18; MW 51 kDa) and in FIG. 182 (lane 12; MW 51 kDa). It was also expressed in *E. coli* as a GST-fusion product. SDS-PAGE analysis of total cell extract is shown in FIG. 151 (lane 15 & 16; MW 76 kDa) and in FIG. 58 (lane 5; MW 87 kDa).

GBS277d-His was purified as shown in FIG. 235, lane 8.

Based on this analysis, it was predicted that these proteins and their epitopes could be useful antigens for vaccines or diagnostics.

Example 2006

A DNA sequence (GBSx2116) was identified in *S. agalactiae* <SEQ ID 6205> which encodes the amino acid sequence <SEQ ID 6206>. This protein is predicted to be aspartate-semialdehyde dehydrogenase. Analysis of this protein sequence reveals the following:

Possible site: 42
>>> Seems to have an uncleavable N-term signal seq
----- Final Results -----
   bacterial membrane --- Certainty = 0.0000 (Not Clear) <succ>
   bacterial outside --- Certainty = 0.0000 (Not Clear) <succ>
   bacterial cytoplasm --- Certainty = 0.0000 (Not Clear) <succ>

A related GBS nucleic acid sequence <SEQ ID 9831> which encodes amino acid sequence <SEQ ID 9832> was also identified.

The protein has homology with the following sequences in the GENPEPT database.

```
>GP:AAA26850 GB:J02667 aspartate beta-semialdehyde dehydrogenase (EC
1.2.1.11) [Streptococcus mutans]
Identities = 261/357 (73%), Positives = 304/357 (85%), Gaps = 1/357 (0%)

Query:    1  MGYTVAIVGATGAVGTQMIRQLEQSNLPIEQVKLLSSSRSAGKILHFKDEAIRVEETTKE   60
             MGYTVAIVGATGAVGT+MI+QLEQS LP+++V+LLSSSRSAGK+L +KD+ + VE TTK+
Sbjct:    1  MGYTVAIVGATGAVGTRMIQQLEQSTLPVDKVRLLSSSRSAGKVLQYKDQDVTVELTTKD   60

Query:   61  SFYDVDIALFSAGGSISAKFAPYAVKSGAVVVDNTSYFRQNPDVPLVVPEVNAHAMIGHN  120
             SF  VDIALFSAGGS+SAKFAPYAVK+GAVVVDNTS+FRQNPDVPLVVPEVNA+AM  HN
Sbjct:   61  SFEAVDIALFSAGGSVSAKFAPYAVKAGAVVVDNTSHFRQNPDVPLVVPEVNAYAMDAHN  120

Query:  121  GIIACPNCSTIQMMIALEPIRQKWGIERVIVSTYQAVSGSGARAVEETKEQLRQVLNDNL  180
             GIIACPNCSTIQMM+ALEPIRQKWG+ RVIVSTYQAVSG+G  A+ ET  ++++V+ND +
Sbjct:  121  GIIACPNCSTIQMMVALEPIRQKWGLSRVIVSTYQAVSGAGQSAINETVREIKEVVNDGV  180

Query:  181  SPDQLIATVLPCSSDQKHYPIAFNALPQIDIFTDNDYTYEEMKMTLETKKIMEDATIKVS  240
              P  + A + P    D+KHYPIAFNAL QID+FTDNDYTYEEMKMT ETKKIME+  + VS
Sbjct:  181  DPKAVHADIFPSGGDKKHYPIAFNALAQIDVFTDNDYTYEEMKMTNETKKIMEEPELPVS  240

Query:  241  ATCVRIPVLSGHSESIYIETKELASISEIKKAIANFPGAVLQDLPSQQIYPQAINAVGHR  300
             A CVR+P+L  HSE++YIETK++A I E+K AIA FPGAVL+D   QIYPQA NAVG R
Sbjct:  241  AHCVRVPILFSHSEAVYIETKDVAPIEEVKAAIAAFPGAVLEDDIKHQIYPQAANAVGSR  300

Query:  301  ETFVGRIRKDLDQENGVHMWVVSDNLLKGAAWNSVQIAETLHKNGLVKPAKELKFEL     357
              TFVGRIRKDLD ENG+HMWVVSDNLLKGAAWNS+  A  LH+ GLV+    ELKFEL
Sbjct:  301  -TFVGRIRKDLDIENGIHMWVVSDNLLKGAAWNSIITANRLHERGLVRSTSELKFEL     356
```

No corresponding DNA sequence was identified in S. pyogenes.

Based on this analysis, it was predicted that this protein and its epitopes, could be useful antigens for vaccines or diagnostics.

Example 2007

A DNA sequence (GBSx2117) was identified in S. agalactiae <SEQ ID 6207> which encodes the amino acid sequence <SEQ ID 6208>. Analysis of this protein sequence reveals the following:

---

Possible site: 22
>>> Seems to have no N-terminal signal sequence
INTEGRAL    Likelihood = -2.66    Transmembrane 33-49 (33-49)
----- Final Results -----
   bacterial membrane --- Certainty = 0.2062 (Affirmative) <succ>
      bacterial outside --- Certainty = 0.0000 (Not Clear) <succ>
         bacterial cytoplasm --- Certainty = 0.0000 (Not Clear) <succ>

---

The protein has no significant homology with any sequences in the GENPEPT database, but there is homology to SEQ ID 500.

Based on this analysis, it was predicted that this protein and its epitopes, could be useful antigens for vaccines or diagnostics.

Example 2008

A DNA sequence (GBSx2119) was identified in S. agalactiae <SEQ ID 6209> which encodes the amino acid sequence <SEQ ID 6210>. Analysis of this protein sequence reveals the following:

---

Possible site: 24
>>> Seems to have no N-terminal signal sequence
----- Final Results -----
   bacterial cytoplasm --- Certainty = 0.3853 (Affirmative) <succ>

-continued bacterial membrane --- Certainty = 0.0000 (Not Clear) <succ>
      bacterial outside --- Certainty = 0.0000 (Not Clear) <succ>

---

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 2009

A DNA sequence (GBSx2120) was identified in S. agalactiae <SEQ ID 6211> which encodes the amino acid sequence <SEQ ID 6212>. This protein is predicted to be unnamed protein product (clpP). Analysis of this protein sequence reveals the following:

---

Possible site: 45
>>> Seems to have no N-terminal signal sequence
----- Final Results -----
   bacterial cytoplasm --- Certainty = 0.3883 (Affirmative) <succ>
      bacterial membrane --- Certainty = 0.0000 (Not Clear) <succ>
         bacterial outside --- Certainty = 0.0000 (Not Clear) <succ>

---

A related GBS nucleic acid sequence <SEQ ID 10061> which encodes amino acid sequence <SEQ ID 10062> was also identified.

A related DNA sequence was identified in S. pyogenes <SEQ ID 6213> which encodes the amino acid sequence <SEQ ID 6214>. Analysis of this protein sequence reveals the following:

---

Possible site: 41
>>> Seems to have no N-terminal signal sequence
----- Final Results -----
   bacterial cytoplasm --- Certainty = 0.2682 (Affirmative) <succ>

```
       bacterial membrane --- Certainty = 0.0000 (Not Clear) <succ>
       bacterial outside --- Certainty = 0.0000 (Not Clear) <succ>
```

An alignment of the GAS and GBS proteins is shown below.

```
Identities = 175/196 (89%), Positives = 187/196 (95%)

Query:     5  MIPVVIEQTSRGERSYDIYSRLLKDRIIMLTGQVEDNMANSIIAQLLFLDAQDNTKDIYL   64
              MIPVVIEQTSRGERSYDIYSRLLKDRIIMLTG VEDNMANS+IAQLLFLDAQDNTKDIYL
Sbjct:     1  MIPVVIEQTSRGERSYDIYSRLLKDRIIMLTGPVEDNMANSVIAQLLFLDAQDNTKDIYL   60

Query:    65  YVNTPGGSVSAGLAIVDTMNFIKSDVQTIVMGMAASMGTIIASSGAKGKRFMLPNAEYMI  124
              YVNTPGGSVSAGLAIVDTMNFIK+DVQTIVMGMAASMGT+IASSG KGKRFMLPNAEYMI
Sbjct:    61  YVNTPGGSVSAGLAIVDTMNFIKADVQTIVMGMAASMGTVIASSGTKGKREMLPNAEYMI  120

Query:   125  HQPMGGTGGGTQQSDMAIAAEHLLKTRHTLEKILADNSGQSIEKVHDDAERDRWMSAQET  184
              HQPMGGTGGGTQQ+DMAIAAEHLLKTRH LEKILA N+G++I+++H DAERD WMSA+ET
Sbjct:   121  HQPMGGTGGGTQQTDMAIAAEHLLKTRHRLEKILAQNAGKTIKQIHKDAERDYWMSAEET  180

Query:   185  LDYGFIDAIMENNNLQ                                             200
              L YGFID IMENN L+
Sbjct:   181  LAYGFIDEIMENNELK                                             196
```

Based on this analysis, it was predicted that these proteins and their epitopes could be useful antigens for vaccines or diagnostics.

Example 2010

A DNA sequence (GBSx2121) was identified in *S. agalactiae* <SEQ ID 6215> which encodes the amino acid sequence <SEQ ID 6216>. This protein is predicted to be uracil phosphoribosyltransferase (upp). Analysis of this protein sequence reveals the following:

```
Possible site: 26
>>> Seems to have no N-terminal signal sequence
INTEGRAL    Likelihood = -0.43    Transmembrane 127-143 (127-144)
INTEGRAL    Likelihood = -0.06    Transmembrane 72-88 (72-89)
INTEGRAL    Likelihood = -0.06    Transmembrane 154-170 (154-170)
----- Final Results -----
   bacterial membrane --- Certainty = 0.1171 (Affirmative) <succ>
       bacterial outside --- Certainty = 0.0000 (Not Clear) <succ>
          bacterial cytoplasm --- Certainty = 0.0000 (Not Clear) <succ>
```

A related GBS nucleic acid sequence <SEQ ID 10063> which encodes amino acid sequence <SEQ ID 10064> was also identified.

The protein has homology with the following sequences in the GENPEPT database.

```
>GP:AAA26890 GB:L07793 uracil phosphoribosyltransferase [Streptococcus salivarius]
 Identities = 192/209 (91%), Positives = 202/209 (95%)

Query:     1  MGKFQVISHPLIQHKLSILRRTTTSTKDFRELVDEIAMLMGYEVSRDLPLEDVEIQTPVA   60
                   MGKFQVISHPLIQHKLSILRR  TSTKDFRELV+EIAMLMGYEVSRDLPLE+VEIQTP+
     Sbjct:     1  MGKFQVISHPLIQHKLSILRREDTSTKDFRELVNEIAMLMGYEVSRDLPLEEVEIQTPIT   60

Query:    61  TTVQKQLAGKKLAIVPILRAGIGMVDGFLSLVPAAKVGHIGMYRDEETFQPVEYLVKLPE  120
                    TVQKQL+GKKLAIVPILRAGIGMVDGFLSLVPAAKVGHIGMYRDEET +PVEYLVKLPE
     Sbjct:    61  KTVQKQLSGKKLAIVPILRAGIGMVDGFLSLVPAAKVGHIGMYRDEETLEPVEYLVKLPE  120

Query:   121  DIDQRQIFVVDPMLATGGSAILAVDSLKKRGAASIKFVCLVAAPEGVAALQEAHPDVDIY  180
                   DIDQRQIFVVDPMLATGGSAILAVDSLKKRGAA+IKFVCLVAAPEGV  LQ+AHPD+DIY
     Sbjct:   121  DIDQRQIFVVDPMLATGGSAILAVDSLKKRGAANIKFVCLVAAPEGVKKLQDAHPDIDIY  180

Query:   181  TAALDEKLNEHGYIVPGLGDAGDRLFGTK                                209
                   TA+LDEKLNE+GYIVPGLGDAGDRLFGTK
     Sbjct:   181  TASLDEKLNENGYIVPGLGDAGDRLFGTK                                209
```

A related DNA sequence was identified in *S. pyogenes* <SEQ ID 6217> which encodes the amino acid sequence <SEQ ID 6218>. Analysis of this protein sequence reveals the following:

```
Possible site: 26
>>> Seems to have no N-terminal signal sequence
INTEGRAL    Likelihood = -0.59    Transmembrane 72-88 (72-89)
INTEGRAL    Likelihood = -0.22    Transmembrane 127-143 (127-144)
----- Final Results -----
   bacterial membrane --- Certainty = 0.1235 (Affirmative) <succ>
       bacterial outside --- Certainty = 0.0000 (Not Clear) <succ>
          bacterial cytoplasm --- Certainty = 0.0000 (Not Clear) <succ>
```

The protein is similar to uracil phosphoribosyltransferase from *S. salivarius*:

```
>GP:AAA26890 GB:L07793 uracil phosphoribosyltransferase [Streptococcus salivarius]
Identities = 191/209 (91%), Positives = 205/209 (97%)

Query:     1  MGKCQVISHPLIQHKLSILRRQTTSTKDFRELVNEIAMLMGYEVSRDLPLEDVDIQTPVS   60
              MGK QVISHPLIQHKLSILRR+ TSTKDFRELVNEIAMLMGYEVSRDLPLE+V+IQTP++
Sbjct:     1  MGKFQVISHPLIQHKLSILRREDTSTKDFRELVNEIAMLMGYEVSRDLPLEEVEIQTPIT   60

Query:    61  KTVQKQLAGKKLAIVPILRAGIGMVDGLLSLVPAAKVGHIGMYRNEETLEPVEYLVKLPE  120
              KTVQKQL+GKKLAIVPILRAGIGMVDG LSLVPAAKVGHIGMYR+EETLEPVEYLVKLPE
Sbjct:    61  KTVQKQLSGKKLAIVPILRAGIGMVDGFLSLVPAAKVGHIGMYRDEETLEPVEYLVKLPE  120

Query:   121  DINQRQIFLVDPMLATGGSAILAVDSLKKRGAANIKFVCLVAAPEGVKKLQEAHPDIDIF  180
              DI+QRQIF+VDPMLATGGSAILAVDSLKKRGAANIKFVCLVAAPEGVKKLQ+AHPDIDI+
Sbjct:   121  DIDQRQIFVVDPMLATGGSAILAVDSLKKRGAANIKFVCLVAAPEGVKKLQDAHPDIDIY  180

Query:   181  TAALDDHLNEHGYIVPGLGDAGDRLFGTK                                209
              TA+LD+ LNE+GYIVPGLGDAGDRLFGTK
Sbjct:   181  TASLDEKLNENGYIVPGLGDAGDRLFGTK                                209
```

An alignment of the GAS and GBS proteins is shown below.

```
Identities = 190/209 (90%), Positives = 201/209 (95%)

Query:     1  MGKFQVISHPLIQHKLSILRRTTTSTKDFRELVDEIAMLMGYEVSRDLPLEDVEIQTPVA   60
              MGK QVISHPLIQHKLSILRR TTSTKDFRELV+EIAMLMGYEVSRDLPLEDV+IQTPV+
Sbjct:     1  MGKCQVISHPLIQHKLSILRRQTTSTKDFRELVNEIAMLMGYEVSRDLPLEDVDIQTPVS   60

Query:    61  TTVQKQLAGKKLAIVPILRAGIGMVDGFLSLVPAAKVGHIGMYRDEETFQPVEYLVKLPE  120
               TVQKQLAGKKLAIVPILRAGIGMVDG LSLVPAAKVGHIGMYR+EET +PVEYLVKLPE
Sbjct:    61  KTVQKQLAGKKLAIVPILRAGIGMVDGLLSLVPAAKVGHIGMYRNEETLEPVEYLVKLPE  120

Query:   121  DIDQRQIFVVDPMLATGGSAILAVDSLKKRGAASIKFVCLVAAPEGVAALQEAHPDVDIY  180
              DI+QRQIF+VDPMLATGGSAILAVDSLKKRGAA+IKFVCLVAAPEGV  LQEAHPD+DI+
Sbjct:   121  DINQRQIFLVDPMLATGGSAILAVDSLKKRGAANIKFVCLVAAPEGVKKLQEAHPDIDIF  180

Query:   181  TAALDEKLNEHGYIVPGLGDAGDRLFGTK                                209
              TAALD+ LNEHGYIVPGLGDAGDRLFGTK
Sbjct:   181  TAALDDHLNEHGYIVPGLGDAGDRLFGTK                                209
```

Based on this analysis, it was predicted that these proteins and their epitopes could be useful antigens for vaccines or diagnostics.

Example 2011

A DNA sequence (GBSx2122) was identified in *S. agalactiae* <SEQ ID 6219> which encodes the amino acid sequence <SEQ ID 6220>. This protein is predicted to be hemolysin (patB). Analysis of this protein sequence reveals the following:

Possible site: 48
>>> Seems to have no N-terminal signal sequence
INTEGRAL    Likelihood = –3.29    Transmembrane 88-104 (86-106)
----- Final Results -----
   bacterial membrane --- Certainty = 0.2317 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database.

```
>GP:CAB15133 GB:Z99120 aminotransferase [Bacillus subtilis]
Identities = 130/381 (34%), Positives = 221/381 (57%), Gaps = 4/381 (1%)

Query:     5  DFTSLPERFSSNTIKWKAVQK---DQEILPLWIADMDFPIFPEMSEAIEDFSHQMVFGYD   61
              +F    ER  + ++KW     +    LP+W+ADMDF    ++EA+++     +FGY
Sbjct:     2  NFDKREERLGTQSVKWDKTGELFGVTDALPMWVADMDFRAPEAITEALKERLDHGIFGYT   61

Query:    62  SPKDSLYQAISNWEVQEHGYQFDKKSLLLIDGVVPAISVAIQAFTKEGDAVLINTPVYPP  121
              +P   +  A+   W    HG++ + +S+   GVV A+S+A+QAFT+ GD V++  PVY P
Sbjct:    62  TPDQKTKDAVCGWMQNRHGWKVNPESITFSPGVVTALSMAVQAFTEPGDQVVVQPPVYTP  121

Query:   122  FARTIKYNNRHLVSNSLLNNNQYFEIDFKQLEKDIIENNVKLYIFCSPHNPGGRVWTKGE  181
              F     ++ N RH++ N LL +   + IDF+ LE   + +V L+I C+PHNP GR W++ +
Sbjct:   122  FYHMVEKNGRHILHNPLLEKDGAYAIDFEDLETKLSDPSVTLFILCNPHNPSGRSWSRED  181
```

```
-continued
Query:  182  IQKIGDICKRYNVILVSDEIHQDLVLFDNVHHSFNTVDSSFKELSVILSSATKTFNIAGT    241
             + K+G++C    + V +VSDEIH DL+L+ + H   F ++    F ++SV   ++ +KTFNIAG
Sbjct:  182  LLKLGELCLEHGVTVVSDEIHSDLMLYGHKHTPFASLSDDFADISVTCAAPSKTFNIAGL    241

Query:  242  KNSFAIIENEKLRSDFKKRQIANNQQEISSLGLLATEVAFTKEKQWLKALKMELEGSIEY    301
             + S  II +   R+ F      N     +++  + A E A++K    WL  L    +E ++
Sbjct:  242  QASAIIIPDRLKRAKFSASLQRNGLGGLNAFAVTAIEAAYSKGGPWLDELITYIEKNMNE    301

Query:  302  LYEQL-TQKTHIKVMKPEGTYLVWLDFSAYNLTHLEIQEKLRYDAKLILNDGLTFGKEGK    360
                 L T+    +K+MKP+ +YL+WLDFSAY  L+   E+Q+++       K+IL  G  +G   G+
Sbjct:  302  AEAFLSTELPKVKMMKPDASYLIWLDFSAYGLSDAELQQRMLKKGKVILEPGTKYGPGGE    361

Query:  361  KHARINVAAPRSVIEEAVLRL                                         381
                R+N         + +++ + R+
Sbjct:  362  GFMRLNAGCSLATLQDGLRRI                                         382
```

There is also homology to SEQ ID 1006.

SEQ ID 6220 (GBS392) was expressed in *E. coli* as a His-fusion product. SDS-PAGE analysis of total cell extract is shown in FIG. 75 (lane 2; MW 46.4 kDa). It was also expressed in *E. coli* as a GST-fusion product. SDS-PAGE analysis of total cell extract is shown in FIG. 83 (lane 5; MW 71 kDa).

GBS392-GST was purified as shown in FIG. 217, lane 4.

Based on this analysis, it was predicted that this protein and its epitopes, could be useful antigens for vaccines or diagnostics.

Example 2012

A DNA sequence (GBSx2123) was identified in *S. agalactiae* <SEQ ID 6221> which encodes the amino acid sequence <SEQ ID 6222>. This protein is predicted to be rRNA methylase, SpoU family (cspR). Analysis of this protein sequence reveals the following:

Possible site: 39
>>> Seems to have no N-terminal signal sequence
----- Final Results -----
    bacterial cytoplasm --- Certainty = 0.1436 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database.

A related DNA sequence was identified in *S. pyogenes* <SEQ ID 6223> which encodes the amino acid sequence <SEQ ID 6224>. Analysis of this protein sequence reveals the following:

Possible site: 51
>>> Seems to have no N-terminal signal sequence
----- Final Results -----
    bacterial cytoplasm --- Certainty = 0.2236 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below.

```
>GP:AAB02738 GB:U58864 CspR [Bacillus subtilis]
Identities = 84/155 (54%), Positives = 120/155 (77%), Gaps = 3/155 (1%)

Query:   19  HIVLFEPQIPANTGNIARTCAATNAPLHIIRPMGFPIDDKKMKRAGLDYWDKLDVSFYDG    78
             H+VL++P+IPANTGNIARTCAATN  LH+IRP+GF  DDK +KRAGLDYW+ ++V ++D
Sbjct:    4  HVVLYQPEIPANTGNIARTCAATNTTLHLIRPLGFSTDDKMLKRAGLDYWEFVNVVYHDS    63

Query:   79  LEE-FMLSCRGKVHLISKFADKVYSDENYND-DQDHYFMFGREDKGLPETFMREHAEKAL   136
             LEE F    +GK  I+KF + ++   +Y D D+D++F+FGRE  GLP+  ++ + ++ L
Sbjct:   64  LEELFEAYKKGKFFFITKFGQQPHTSFDYTDLDEDYFFVFGRETSGLPKDLIQNNMDRCL   123

Query:  137  RIPMNDEHVRSLNVSNTVCMIVYEALRQQSFPNLE                          171
             R+PM  EHVRSLN+SNT  ++VYEALRQQ++  +L+
Sbjct:  124  RLPMT-EHVRSLNLSNTAAILVYEALRQQNYRDLK                          157

Identities = 135/182 (74%), Positives = 150/182 (82%)

Query:    1  MNIETLTQKNHRSDSGRNHIVLFEPQIPANTGNIARTCAATNAPLHIIRPMGFPIDDKKM    60
                               M  + L  KN +     RNHIVLF+PQIP NTGNIARTCAATNAPLHII+PMGFPIDD+KM
                  Sbjct:   13  MTTKELINKNDKVKKARNHIVLFQPQIPQNTGNIARTCAATNAPLHIIKPMGFPIDDRKM    72
```

```
Query:   61  KRAGLDYWDKLDVSFYDGLEEFMLSCRGKVHLISKFADKVYSDENYNDDQDHYFMFGRED   120
             KRAGLDYWDKL++ FYD LE+F+  C G++HLISKFA   YS   Y D   HYF+FGRED
Sbjct:   73  KRAGLDYWDKLELHFYDHLEQFINQCHGQLHLISKFAVNNYSQATYADGDSHYFLFGRED   132

Query:  121  KGLPETFMREHAEKALRIPMNDEHVRSLNVSNTVCMIVYEALRQQSFPNLELSHTYENDK   180
              GLPE FMREHAEKALRIPMNDEHVRSLNVSNTVCM++YEALRQQ F  LEL HTYE+DK
Sbjct:  133  TGLPEDFMREHAEKALRIPMNDEHVRSLNVSNTVCMVIYEALRQQGFQGLELKHTYEHDK   192

Query:  181  LK                                                            182
             LK
Sbjct:  193  LK                                                            194
```

Based on this analysis, it was predicted that these proteins and their epitopes could be useful antigens for vaccines or diagnostics.

Example 2013

A DNA sequence (GBSx2124) was identified in *S. agalactiae* <SEQ ID 6225> which encodes the amino acid sequence <SEQ ID 6226>. Analysis of this protein sequence reveals the following:

---

Possible site: 60
>>> Seems to have no N-terminal signal sequence
INTEGRAL    Likelihood = −6.79    Transmembrane 82-98 (69-100)
INTEGRAL    Likelihood = −6.48    Transmembrane 27-43 (24-47)
INTEGRAL    Likelihood = −5.52    Transmembrane 132-148 (126-151)
INTEGRAL    Likelihood = −5.10    Transmembrane 162-178 (161-185)
----- Final Results -----
    bacterial membrane --- Certainty = 0.3718 (Affirmative) <succ>
       bacterial outside --- Certainty = 0.0000 (Not Clear) <succ>
      bacterial cytoplasm --- Certainty = 0.0000 (Not Clear) <succ>

---

A related GBS nucleic acid sequence <SEQ ID 9411> which encodes amino acid sequence <SEQ ID 9412> was also identified.

The protein has homology with the following sequences in the GENPEPT database.

```
>GP:CAB13143 GB:Z99110 similar to amino acid permease [Bacillus subtilis]
Identities = 46/143 (32%), Positives = 81/143 (56%), Gaps = 1/143 (0%)

Query:    3  FAYDGWTIFVNIAPEVKNPKKNLPLAFVIGPALILLSYLAFFYGLTQILGASFIMTTGND   62
             FAYDGW +   + E+KNP+K LP A    G ++    Y+   + L  IL A+ I+T G +
Sbjct:  203  FAYDGWILLAALGGEMKNPEKLLPRAMTGGLLIVTAIYIFINFALLHILSANEIVTLGEN  262

Query:   63  AINYAANIIFGPSVGRLLSFIVILSVLGVANGLLLGTMRLPQAFAERGWIK-SERMANIN  121
             A + AA  +FG   G+L+S  +I+S+ G  NG +L   R+  A AER +    +E++++++
Sbjct:  263  ATSTAATMLFGSIGGKLISVGIIVSIFGCLNGKVLSFPRVSFAMAERKQLPFAEKLSHVH  322

Query:  122  LKYQMSLPASLTVTAVAIFWLFV                                      144
             ++    A     A+A+  + +
Sbjct:  323  PSFRTPWIAISFQIALALIMMLI                                      345
```

There is also homology to SEQ ID 3114.

Based on this analysis, it was predicted that this protein and its epitopes, could be useful antigens for vaccines or diagnostics.

Example 2014

A DNA sequence (GBSx2125) was identified in *S. agalactiae* <SEQ ID 6227> which encodes the amino acid sequence <SEQ ID 6228>. Analysis of this protein sequence reveals the following:

---

Possible site: 20
>>> Seems to have no N-terminal signal sequence
----- Final Results -----
    bacterial cytoplasm --- Certainty = 0.1849 (Affirmative) <succ>
       bacterial membrane --- Certainty = 0.0000 (Not Clear) <succ>
       bacterial outside --- Certainty = 0.0000 (Not Clear) <succ>

---

A related GBS nucleic acid sequence <SEQ ID 9439> which encodes amino acid sequence <SEQ ID 9440> was also identified.

The protein has homology with the following sequences in the GENPEPT database.

```
>GP:AAD23454 GB:AF117741 cochaperonin GroES [Streptococcus pneumoniae]
Identities = 31/52 (59%), Positives = 42/52 (80%)

Query:    2  GDGIRTLTGELVAPSVAEGDTVLVENGAGLEVKDGNEKVTVVRESDIVAVVK   53
             G G+RTL G+LVAPSV  GD VLVE   AGL+VKDG+EK  +V E++I+A+++
Sbjct:   42  GQGVRTLNGDLVAPSVKTGDRVLVEAHAGLDVKDGDEKYIIVGEANILAIIE   93
```

A related DNA sequence was identified in *S. pyogenes* <SEQ ID 6229> which encodes the amino acid sequence <SEQ ID 6230>. Analysis of this protein sequence reveals the following:

```
Possible site: 50
>>> Seems to have no N-terminal signal sequence
----- Final Results -----
   bacterial cytoplasm --- Certainty = 0.3290 (Affirmative) <succ>
      bacterial membrane --- Certainty = 0.0000 (Not Clear) <succ>
         bacterial outside --- Certainty = 0.0000 (Not Clear) <succ>
```

An alignment of the GAS and GBS proteins is shown below.

```
Identities = 29/49 (59%), Positives = 39/49 (79%)

Query:    4   GIRTLTGELVAPSVAEGDTVLVENGAGLEVKDGNEKVTVVRESDIVAVV    52
              G+RT+TG+ V PSV+ G  VLVENG  LEV   +EKV+++RESDI+A+V
Sbjct:   60   GVRTITGDSVLPSVSVGQEVLVENGHDLEVTVDDEKVSIIRESDIIAIV   108
```

Based on this analysis, it was predicted that these proteins and their epitopes could be useful antigens for vaccines or diagnostics.

Example 2015

A DNA sequence (GBSx2126) was identified in *S. agalactiae* <SEQ ID 6231> which encodes the amino acid sequence <SEQ ID 6232>. Analysis of this protein sequence reveals the following:

```
Possible site: 13
>>> Seems to have no N-terminal signal sequence
----- Final Results -----
   bacterial cytoplasm --- Certainty = 0.1272 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database.

```
>GP:AAD23455 GB:AF117741 chaperonin GroEL [Streptococcus pneumoniae]
Identities = 472/539 (87%), Positives = 513/539 (94%), Gaps = 1/539 (0%)

Query:     1   MAKDIKFSADARSAMVRGVDILADTVKVTLGPKGRNVVLEKAFGSPLITNDGVTIAKEIE    60
               M+K+IKFS+DARSAMVRGVDILADTVKVTLGPK RNVVLEK+FGSPLITNDGVTIAKEIE
Sbjct:     1   MSKEIKFSSDARSAMVRGVDILADTVKVTLGPKDRNVVLEKSFGSPLITNDGVTIAKEIE    60

Query:    61   LEDHFENMGAKLVSEVASKTNDIAGDGTTTATVLTQAIVREGLKNVTAGANPIGIRRGIE   120
               LEDHFENMGAKLVSE+ASKTNDIAGDGTTTATVLTQAIVREG+KNVTAGANPIGIRRGIE
Sbjct:    61   LEDHFENMGAKLVSEIASKTNDIAGDGTTTATVLTQAIVREGIKNVTAGANPIGIRRGIE   120

Query:   121   TAVSAAVEELKEIAQPVSGKEAIAQVAAVSSRSEKVGEYISEAMERVGNDGVITIEESRG   180
               TAV+AAVE LK  A PV+ KRAI+QVAAVSSRSEKVGEYISEAME+VG DGVITIEESRG
Sbjct:   121   TAVAAAVEALKNNAIPVANKEAISQVAAVSSRSEKVGEYISEAMEKVGKDGVITIEESRG   180

Query:   181   METELEVVEGMQFDRGYLSQYMVTDNEKMVSELENPYILITDKKISNIQEILPLLEEVLK   240
               METELEVVEGMQFDRGYLSQYMVTD+EKMV++LENPYILITDKKISNIQEILPLLE +L+
Sbjct:   181   METELEVVEGMQFDRGYLSQYMVTDSEKMVADLENPYILITDKKISNIQEILPLLESILQ   240

Query:   241   TNRPLLIIADDVDGEALPTLVLNKIRGTFNVVAVKAPGFGDRRKAMLEDIAILTGGTVVT   300
               +NRPLLI IADDVDGEALPTLVLNKIRGTFNVVAVKAPGFGDRRKAMLEDIAILTGGT+T
Sbjct:   241   SNRPLLIIADDVDGEALPTLVLNKIRGTFNVVAVKAPGFGDRRKAMLEDIAILTGGTVIT   300

Query:   301   EDLGLDLKDATMQVLGQSAKVTVDKDSTVIVEGAGDSSAIANRVAIIKSQMEATTSDFDR   360
               EDLGL+LKDAT++ LGQ+A+VTVDKDSTVIVEGAG+   AI++RVA+IKSQ+E TTS+FDR
Sbjct:   301   EDLGLELKDATIEALGQAARVTVDKDSTVIVEGAGNPEAISHRVAVIKSQIETTTSEFDR   360
```

```
                                    -continued
Query:  361  EKLQERLAKLAGGVAVIKVGAATETELKEMKLRIEDALNATRAAVEEGIVSGGGTALVNV  420
             EKLQERLAKL+GGVAVIKVGAATETELKEMKLRIEDALNATRAAVEEGIV+GGGTAL NV
Sbjct:  361  EKLQERLAKLSGGVAVIKVGAATETELKEMKLRIEDALNATRAAVEEGIVAGGGTALANV  420

Query:  421  IEKVAALKLNGDEETGRNIVLRALEEPVRQIAYNAGYEGSVIIERLKQSEIGTGFNAANG  480
             I   A L+L GDE TGRNIVLRALEEPVRQIA+NAG+EGS++I+RLK +E+G GFNAA G
Sbjct:  421  IPAEATLELTGDEATGRNIVLRALEEPVRQIAHNAGFEGSIVIDRLKNAELGIGFNAATG  480

Query:  481  EWVDMVTTGIIDPVKVTRSALQNAASVASLILTTEAVVANKPEPEAPTAPAMDPSMMGG   539
             EWV+M+  GIIDPVKV+RSALQNAASVASLILTTEAVVANKPEP AP APAMDPSMMGG
Sbjct:  481  EWVNMIDQGIIDPVKVSRSALQNAASVASLILTTEAVVANKPEPVAP-APAMDPSMMGG   538
```

A related DNA sequence was identified in *S. pyogenes* <SEQ ID 6233> which encodes the amino acid sequence <SEQ ID 6234>. Analysis of this protein sequence reveals the following:

Possible site: 15
>>> Seems to have no N-terminal signal sequence
----- Final Results -----
   bacterial cytoplasm --- Certainty = 0.1070 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

Based on this analysis, it was predicted that these proteins and their epitopes could be useful antigens for vaccines or diagnostics.

Example 2016

A DNA sequence (GBSx2127) was identified in *S. agalactiae* <SEQ ID 6235> which encodes the amino acid sequence <SEQ ID 6236>. Analysis of this protein sequence reveals the following:

Possible site: 40
>>> Seems to have no N-terminal signal sequence
----- Final Results -----
   bacterial cytoplasm --- Certainty = 0.3216 (Affirmative) <succ>

```
Identities = 491/543 (90%), Positives = 515/543 (94%), Gaps = 3/543 (0%)

Query:    1  MAKDIKFSADARSAMVRGVDILADTVKVTLGPKGRNVVLEKAFGSPLITNDGVTIAKEIE   60
             MAKDIKFSADAR+AMVRGVD+LADTVKVTLGPKGRNVVLEKAFGSPLITNDGVTIAKEIE
Sbjct:    3  MAKDIKFSADARAAMVRGVDMLADTVKVTLGPKGRNVVLEKAFGSPLITNDGVTIAKEIE   62

Query:   61  LEDHFENMGAKLVSEVASKTNDIAGDGTTTATVLTQAIVREGLKNVTAGANPIGIRRGIE  120
             LEDHFENMGAKLVSEVASKTNDIAGDGTTTATVLTQAIV EGLKNVTAGANPIGIRRGIE
Sbjct:   63  LEDHFENMGAKLVSEVASKTNDIAGDGTTTATVLTQAIVHEGLKNVTAGANPIGIRRGIE  122

Query:  121  TAVSAAVEELKEIAQPVSGKEAIAQVAAVSSRSEKVGEYISEAMERVGNDGVITIEESRG  180
             TA + AVE LK IAQPVSGKEAIAQVAAVSSRSEKVGEYISEAMERVGNDGVITIEESRG
Sbjct:  123  TATATAVEALKAIAQPVSGKEAIAQVAAVSSRSEKVGEYISEAMERVGNDGVITIEESRG  182

Query:  181  METELEVVEGMQFDRGYLSQYMVTDNEKMVSELENPYILITDKKISNIQEILPLLEEVLK  240
             METELEVVEGMQFDRGYLSQYMVTDNEKMV++LENP+ILITDKK+SNIQ+ILPLLEEVLK
Sbjct:  183  METELEVVEGMQFDRGYLSQYMVTDNEKMVADLENPFILITDKKVSNIQDILPLLEEVLK  242

Query:  241  TNRPLLIIADDVDGEALPTLVLNKIRGTFNVVAVKAPGFGDRRKAMLEDIAILTGGTVVT  300
             TNRPLLIIADDVDGEALPTLVLNKIRGTFNVVAVKAPGFGDRRKAMLEDIAILTGGTV+T
Sbjct:  243  TNRPLLIIADDVDGEALPTLVLNKIRGTFNVVAVKAPGFGDRRKAMLEDIAILTGGTVIT  302

Query:  301  EDLGLDLKDATMQVLGQSAKVTVDKDSTVIVEGAGDSSAIANRVAIIKSQMEATTSDFDR  360
             EDLGL+LKDATM  LGQ+AK+TVDKDSTVIVEG+G S AIANR+A+IKSQ+E TTSDFDR
Sbjct:  303  EDLGLELKDATMTALGQAAKITVDKDSTVIVEGSGSSEAIANRIALIKSQLETTTSDFDR  362

Query:  361  EKLQERLAKLAGGVAVIKVGAATETELKEMKLRIEDALNATRAAVEEGIVSGGGTALVNV  420
             EKLQERLAKLAGGVAVIKVGA TET LKEMKLRIEDALNATRAAVEEGIV+GGGTAL+ V
Sbjct:  363  EKLQERLAKLAGGVAVIKVGAPTETALKEMKLRIEDALNATRAAVEEGIVAGGGTALITV  422

Query:  421  IEKVAALKLNGDEETGRNIVLRALEEPVRQIAYNAGYEGSVIIERLKQSEIGTGFNAANG  480
             IEKVAAL+L GD+ TGRNIVLRALEEPVRQIA NAGYEGSV+I++LK S  GTGFNAA G
Sbjct:  423  IEKVAALELEGDDATGRNIVLRALEEPVRQIALNAGYEGSVVIDKLKNSPAGTGFNAATG  482

Query:  481  EWVDMVTTGIIDPVKVTRSALQNAASVASLILTTEAVVANKPEP--EAPTAPA-MDPSMM  537
             EWVDM+  TGIIDPVKVTRSALQNAASVASLILTTEAVVANKPEP    AP  PA MDP MM
Sbjct:  483  EWVDMIKTGIIDPVKVTRSALQNAASVASLILTTEAVVANKPEPATPAPAMPAGMDPGMM  542

Query:  538  GGF                                                           540
             GGF
Sbjct:  543  GGF                                                           545
``` bacterial membrane --- Certainty = 0.0000 (Not Clear) <succ>
bacterial outside --- Certainty = 0.0000 (Not Clear) <succ>

A related GBS nucleic acid sequence <SEQ ID 10247> which encodes amino acid sequence <SEQ ID 10248> was also identified.

The protein has homology with the following sequences in the GENPEPT database.

```
>GP:BAB06113 GB:AP001515 transcriptional regulator (GntR family)
[Bacillus halodurans]
Identities = 50/171 (29%), Positives = 86/171 (50%), Gaps = 17/171 (9%)

Query:     21  HVQVYNKIFNMIQDGTYSPGMQLPSEPELAGQLNVSRATLRKSLALLQEDHLVKNIRGKG     80
               ++QV +K+ + ++ G Y  G +LPSE EL+ QL VSRATLR++L LL+E+ +V    G G
Sbjct:     10  YLQVIDKLKHDMEAGVYEEGEKLPSEFELSKQLGVSRATLREALRLLEEEGVVVRRHGVG     69

Query:     81  NFIRENSSNLSENGYENRQHPIKTCLTSKITEVELE--------FRVEVPAEAITASLKQ    132
                F+ ++  L   G E        +T  I   ++E         +++E   +
Sbjct:     70  TFV--HTKPLFSAGIEELY-----SVTDMIRHADMEPGTIFLSSYQIEATDDDKRRFQTD    122

Query:    133  ETPVVVIADRWYHTDDGPLAYTLSFIPIELISDAEISLHDTKQLLNFIEEG            183
                 +++ +R    D  P+ Y L  +P ELI    + S+H+    +L+ +E G
Sbjct:    123  NLDQLMMIERVRTADGVPIVYCLDKLPAELI--GQHSVHEINSILDHLESG            171
```

A related DNA sequence was identified in S. pyogenes <SEQ ID 6237> which encodes the amino acid sequence <SEQ ID 6238>. Analysis of this protein sequence reveals the following:

Possible site: 34
>>> Seems to have no N-terminal signal sequence
----- Final Results -----
  bacterial cytoplasm --- Certainty = 0.2297 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

```
Identities = 154/244 (63%), Positives = 189/244 (77%)

Query:      7  MPKNELNNKLNKLKHVQVYNKIFNMIQDGTYSPGMQLPSEPELAGQLNVSRATLRKSLAL     66
               M  N+L  KL KLKHVQVYN IF +IQDGTYSPGMQLPSEPELA QLNVSE TLRKSLAL
Sbjct:      1  MSTNDLTKKLKKLKHVQVYNTIFQLIQDGTYSPGMQLPSEPELARQLNVSRMTLRKSLAL     60

Query:     67  LQEDHLVKNIRGKGNFIRENSSNLSENGYENRQHPIKTCLTSKITEVELEFRVEVPAEAI    126
               LQEDHL+KNIRGKGNFI +          G+E  QHPI   L+S IT+VELE+R+EVP  AI
Sbjct:     61  LQEDHLIKNIRGKGNFILKTPETKYHQGFEYLQHPIYASLSSDITKVELEYRIEVPTVAI    120

Query:    127  TASLKQETPVVVIADRWYHTDDGPLAYTLSFIPIELISDAEISLHDTKQLLNFIEEGIYQ    186
               TASLKQETPVV+I DRWYH+ +  +AY+LSFIPIE+IS   I+L+   LL F+EE IY+
Sbjct:    121  TASLKQETPVVIIVDRWYHSQNKAIAYSLSFIPIEVISKYAINLNQEEPLLTFLEEKIYE    180

Query:    187  EGISSHSQSHLGYATSGNFSATKYTLSDHGQFILIQETIFKQEKILMCNKHYVPIEHFEL    246
                G +SHS + +GY   +GN++ATKYTLS++   FILIQET++     +IL+  KHYVP + F+L
Sbjct:    181  SGKASHSCNQIGYTKTGNYTATKYTLSENSAFILIQETLYNGKDILVSTKHYVPADLFDL    240

Query:    247  SITS                                                          250
                + S
Sbjct:    241  KVQS                                                          244
```

Based on this analysis, it was predicted that these proteins and their epitopes could be useful antigens for vaccines or diagnostics.

Example 2017

A DNA sequence (GBSx2128) was identified in S. agalactiae <SEQ ID 6239> which encodes the amino acid sequence <SEQ ID 6240>. This protein is predicted to be purine nucleoside phosphorylase (udp-1). Analysis of this protein sequence reveals the following:

Possible site: 47
>>> Seems to have no N-terminal signal sequence
----- Final Results -----
  bacterial cytoplasm --- Certainty = 0.3910 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:AAC65977 GB:AE001270 uridine phosphorylase (udp) [Treponema pallidum]
Identities = 145/246 (58%), Positives = 171/246 (68%)

Query:    11 QYHLQIRPGDVGRYVIMPGDPKRCAKIAEHFDNAVLVADSREYVTYTGTLNGEKVSVTST     70
             +YH+ ++  D+G YVI+PGDP R  KIA+HF +    V  +REYVTYTGTL     VSV ST
Sbjct:    10 EYHIGLKASDIGHYVILPGDPARSEKIAQHFSHPHKVGHNREYVTYTGTLCETPVSVMST     69

Query:    71 GIGGPSASIAMEELKLCGADTFIRVGTCGGIDLDVKGGDIVIATGAIRMEGTSKEYAPIE    130
             GIGGPS +I +EEL    GA TFIRVGT GG+  D+  G +VIATGAIR EGTSKEYAP+E
Sbjct:    70 GIGGPSTAIGVEELIHLGAHTFIRVGTSGGMQPDILAGTVVIATGAIRFEGTSKEYAPVE    129

Query:   131 FPAVADLEVTNALVNAAKKLGYTSHAGVVQCKDAFYGQHEPERMPVSYELLNKWEAWKRL    190
             FPAV D  VT AL +AA+ +        GVVQCKD FYGQH P   MPV  EL  KW AW
Sbjct:   130 FPAVPDFTVTAALKHAAEDVQVRHALGVVQCKDNFYGQHSPHTMPVHAELTQKWHAWIAC    189

Query:   191 GTKASEMESAALFVAASHLGVRCGSDFLVVGNQERNALGMDNPMAHDTEAAIQVAVEALR    250
                T ASEMESAALFV  S    VR G+  LV+GNQ R A G+++    HDTE AI+VAVEA++
Sbjct:   190 NTLASEMESAALFVLGSVRRVRTGAVLLVIGNQTRRAQGLEDIQVHDTENAIRVAVEAVK    249

Query:   251 TLIEND    256
             LI D
Sbjct:   250 LLITQD    255
```

A related DNA sequence was identified in *S. pyogenes* <SEQ ID 6241> which encodes the amino acid sequence <SEQ ID 6242>. Analysis of this protein sequence reveals the following:

---
Possible site: 47
>>> Seems to have no N-terminal signal sequence
----- Final Results -----
   bacterial cytoplasm --- Certainty = 0.3910 (Affirmative) <succ>
    bacterial membrane --- Certainty = 0.0000 (Not Clear) <succ>
     bacterial outside --- Certainty = 0.0000 (Not Clear) <succ>

---

An alignment of the GAS and GBS proteins is shown below.

```
Identities = 259/259 (100%), Positives = 259/259 (100%)

Query:     1 MQNYSGEVGLQYHLQIRPGDVGRYVIMPGDPKRCAKIAEHFDNAVLVADSREYVTYTGTL     60
             MQNYSGEVGLQYHLQIRPGDVGRYVIMPGDPKRCAKIAEHFDNAVLVADSREYVTYTGTL
Sbjct:     1 MQNYSGEVGLQYHLQIRPGDVGRYVIMPGDPKRCAKIAEHFDNAVLVADSREYVTYTGTL     60

Query:    61 NGEKVSVTSTGIGGPSASIAMEELKLCGADTFIRVGTCGGIDLDVKGGDIVIATGAIRME    120
             NGEKVSVTSTGIGGPSASIAMEELKLCGADTFIRVGTCGGIDLDVKGGDIVIATGAIRME
Sbjct:    61 NGEKVSVTSTGIGGPSASIAMEELKLCGADTFIRVGTCGGIDLDVKGGDIVIATGAIRME    120

Query:   121 GTSKEYAPIEFPAVADLEVTNALVNAAKKLGYTSHAGVVQCKDAFYGQHEPERMPVSYEL    180
             GTSKEYAPIEFPAVADLEVTNALVNAAKKLGYTSHAGVVQCKDAFYGQHEPERMPVSYEL
Sbjct:   121 GTSKEYAPIEFPAVADLEVTNALVNAAKKLGYTSHAGVVQCKDAFYGQHEPERMPVSYEL    180

Query:   181 LNKWEAWKRLGTKASEMESAALFVAASHLGVRCGSDFLVVGNQERNALGMDNPMAHDTEA    240
             LNKWEAWKRLGTKASEMESAALFVAASHLGVRCGSDFLVVGNQERNALGMDNPMAHDTEA
Sbjct:   181 LNKWEAWKRLGTKASEMESAALFVAASHLGVRCGSDFLVVGNQERNALGMDNPMAHDTEA    240

Query:   241 AIQVAVEALRTLIENDKSQ    259
             AIQVAVEALRTLIENDKSQ
Sbjct:   241 AIQVAVEALRTLIENDKSQ    259
```

Based on this analysis, it was predicted that these proteins and their epitopes could be useful antigens for vaccines or diagnostics.

Example 2018

A DNA sequence (GBSx2129) was identified in *S. agalactiae* <SEQ ID 6243> which encodes the amino acid sequence <SEQ ID 6244>. This protein is predicted to be nucleoside transporter. Analysis of this protein sequence reveals the following:

Possible site: 25
>>> Seems to have an uncleavable N-terminal signal sequence

| | | |
|---|---|---|
| INTEGRAL | Likelihood = −9.45 | Transmembrane 35-51 (30-57) |
| INTEGRAL | Likelihood = −9.29 | Transmembrane 8-24 (1-28) |
| INTEGRAL | Likelihood = −8.07 | Transmembrane 388-404 (379-404) |
| INTEGRAL | Likelihood = −7.27 | Transmembrane 104-120 (100-127) |
| INTEGRAL | Likelihood = −6.58 | Transmembrane 259-275 (255-284) |
| INTEGRAL | Likelihood = −4.35 | Transmembrane 172-188 (171-190) |
| INTEGRAL | Likelihood = −3.50 | Transmembrane 200-216 (199-221) |
| INTEGRAL | Likelihood = −2.18 | Transmembrane 352-368 (352-371) |

----- Final Results -----
  bacterial membrane --- Certainty = 0.4779 (Affirmative) <succ>
  bacterial outside --- Certainty = 0.0000 (Not Clear) <succ>
  bacterial cytoplasm --- Certainty = 0.0000 (Not Clear) <succ>

A related GBS nucleic acid sequence <SEQ ID 10245> which encodes amino acid sequence <SEQ ID 10246> was also identified.

The protein has homology with the following sequences in the GENPEPT database.

```
>GP:BAB05165 GB:AP001512 nucleoside transporter [Bacillus halodurans]
Identities = 160/405 (39%), Positives = 256/405 (62%), Gaps = 8/405 (1%)

Query:    5 MQFIYSIIGILLVLGIVYAISFNRKSVSLSLIGKALIVQFIIALILVRIPLGQQVVSVVS   64
            M  ++ ++GI++V  I +A S NR+++    I    L +Q + A+I+++IP GQ ++  ++
Sbjct:    1 MNILWGLLGIVVVFLIAFAFSTNRRAIKPRTILGGLAIQLLFAIIVLKIPAGQALLESLT   60

Query:   65 TGVTKVINCGQAGLNFVFGSLADSGAKTGFIFAIQTLGNIVFLSALVSLLYYVGILGFVV  124
               V  +I+    G++FVFG   + G+  GF+FAI  L  ++F SAL+S+LYY+GI+ FV+
Sbjct:   61 NVVLNIISYANEGIDFVFGGFFEEGSGVGFVFAINVLSVVIFFSALISILYYLGIMQFVI  120

Query:  125 KWIGKGVGKIMKSSEVESFVAVANMFLGQTDSPILVSKYLGRMTDSEIMVVLVSGMGSMS  184
            K IG  +  ++ +S+ ES   A AN+F+GQT++P++V  YL +MT SE+  V+  G+ S++
Sbjct:  121 KIIGGALSWLLGTSKAESMSAAANIFVGQTEAPLVVKPYLPKMTQSELFAVMTGGLASVA  180

Query:  185 VSILGGYIALGIPMEYLLIASTMVPIGSILIAKILLPQTEPVQKI-DDIKMDNKGNNANV  243
             S+L GY  LG+P++YLL AS M    +++AK+++P+TE      DD K+    + N+
Sbjct:  181 GSVLIGYSLLGVPLQYLLAASFMAAPAGLIMAKMIMPETEKTTDAEDDFKLAKDEESTNL  240

Query:  244 IDAIAEGASTGAQMAFSIGASLIAFVGLVSLINMMLSGLG-------IRLEQIFSYVFAP  296
            IDA A GASTG +  +I A L+AFV L++LIN +L  +G          + LE I   YVFAP
Sbjct:  241 IDAAANGASTGLMLVLNIAAMLLAFVALIALINGILGWIGGLFGASQLSLELILGYVFAP  300

Query:  297 FGFLMGFDHKNILLEGNLLGSKLILNEFVSFQQLGDLIKSLDYRTALVATISLCGFANLS  356
             F++G      L   G+ +G KL++NEFV++     I++L  +  +V + +LCGFAN S
Sbjct:  301 LAFVIGIPWAEALQAGSYIGQKLVVNEFVAYLSFAPEIENLSDKAVMVISFALCGFANFS  360

Query:  357 SLGICVSGIAVLCPEKRGTLARLVFRAMIGGIAVSMLSAFIVSIV                401
            SLGI + G+ L P +R +ARL  RA++ G   S+LSA I G++
Sbjct:  361 SLGILLGGLGKLAPSRRPDIARLGLRAILAGTLASLLSASIAGML                405
```

A related DNA sequence was identified in *S. pyogenes* <SEQ ID 6245> which encodes the amino acid sequence <SEQ ID 6246>. Analysis of this protein sequence reveals the following:

Possible site: 25
>>> Seems to have an uncleavable N-terminal signal sequence
INTEGRAL    Likelihood = −9.45    Transmembrane 35-51 (30-57)
INTEGRAL    Likelihood = −9.29    Transmembrane 8-24 (1-28)
INTEGRAL    Likelihood = −8.07    Transmembrane 388-404 (379-404)
INTEGRAL    Likelihood = −7.27    Transmembrane 104-120 (100-127)

-continued

INTEGRAL    Likelihood = −6.58    Transmembrane 259-275 (255-284)
INTEGRAL    Likelihood = −4.35    Transmembrane 172-188 (171-190)
INTEGRAL    Likelihood = −3.50    Transmembrane 200-216 (199-221)
INTEGRAL    Likelihood = −2.18    Transmembrane 352-368 (352-371)
----- Final Results -----
    bacterial membrane --- Certainty = 0.4779 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:BAB05165 GB:AP001512 nucleoside transporter [Bacillus halodurans]
Identities = 160/405 (39%), Positives = 257/405 (62%), Gaps = 8/405 (1%)
Query:    5 MQFIYSIIGILLVLGIVYAISFNRKSVSLSLIGKALIVQFIIALILVRIPLGQQIVSVVS   64
            M  ++ ++GI++V  I +A S NR+++    I    L +Q  +A+I+++IP GQ ++  ++
Sbjct:    1 MNILWGLLGIVVVFLIAFAFSTNRRAIKPRTILGGLAIQLLFAIIVLKIPAGQALLESLT   60

Query:   65 TGVTSVINCGQAGLNFVFGSLADSGAKTGFIFAIQTLGNIVFLSALVSLLYYVGILGFVV  124
               V  ++I+    G++FVFG   + G+  GF+FAI  L   ++F SAL+S+LYY+GI+ FV+
Sbjct:   61 NVVLNIISYANEGIDFVFGGFFEEGSGVGFVFAINVLSVVIFFSALISILYYLGIMQFVI  120

Query:  125 KWIGKGVGKIMKSSEVESFVAVANMFLGQTDSPILVSKYLGRMTDSEIMVVLVSGMGSMS  184
            K IG  +  ++ +S+ ES   A AN+F+GQT++P++V  YL +MT SE+  V+  G+ S++
Sbjct:  121 KIIGGALSWLLGTSKAESMSAAANIFVGQTEAPLVVKPYLPKMTQSELFAVMTGGLASVA  180

Query:  185 VSILGGYIALGIPMEYLLIASTMVPIGSILIAKILLPQTEPVQKI-DDIKMDNKGNNANV  243
             S+L GY  LG+P++YLL AS M    +++AK+++P+TE      DD K+    + N+
Sbjct:  181 GSVLIGYSLLGVPLQYLLAASFMAAPAGLIMAKMIMPETEKTTDAEDDFKLAKDEESTNL  240

Query:  244 IDAIAEGASTGAQMAFSIGASLIAFVGLVSLINMMLSGLG-------IRLEQIFSYVFAP  296
            IDA A GASTG +  +I A L+AFV L++LIN +L  +G          + LE I   YVFAP
Sbjct:  241 IDAAANGASTGLMLVLNIAAMLLAFVALIALINGILGWIGGLFGASQLSLELILGYVFAP  300

Query:  297 FGFLMGFDHKNILLEGNLLGSKLILNEFVSFQQLGHLIKSLDYRTALVATISLCGFANLS  356
             F++G      L   G+ +G KL++NEFV++     I++L  +  +V + +LCGFAN S
Sbjct:  301 LAFVIGIPWAEALQAGSYIGQKLVVNEFVAYLSFAPEIENLSDKAVMVISFALCGFANFS  360

Query:  357 SLGICVSGIAVLCPEKRSTLARLVFRAMIGGIAVSMLSAFIVGIV                401
            SLGI + G+ L P +R +ARL  RA++ G   S+LSA I G++
Sbjct:  361 SLGILLGGLGKLAPSRRPDIARLGLRAILAGTLASLLSASIAGML                405
```

An alignment of the GAS and GBS proteins is shown below.

```
Identities = 399/404 (98%), Positives = 401/404 (98%)
Query:   1   MEVIMQFIYSIIGILLVLGIVYAISFNRKSVSLSLIGKALIVQFIIALILVRIPLGQQVV    60
             +EVIMQFIYSIIGILLVLGIVYAISFNRKSVSLSLIGKALIVQFIIALILVRIPLGQQ+V
Sbjct:   1   LEVIMQFIYSIIGILLVLGIVYAISFNRKSVSLSLIGKALIVQFIIALILVRIPLGQQIV    60

Query:  61   SVVSTGVTKVINCGQAGINFVFGSLADSGAKTGFIFAIQTLGNIVFLSALVSLLYYVGIL   120
             SVVSTGVT VINCGQAGLNFVFGSLADSGAKTGFIFAIQTLGNIVFLSALVSLLYYVGIL
Sbjct:  61   SVVSTGVTSVINCGQAGLNFVFGSLADSGAKTGFIFAIQTLGNIVFLSALVSLLYYVGIL   120

Query: 121   GFVVKWIGKGVGKIMKSSEVESFVAVANMFLGQTDSPILVSKYLGRMTDSEIMVVLVSGM   180
             GFVVKWIGKGVGKIMKSSEVESFVAVANMFLGQTDSPILVSKYLGRMTDSEIMVVLVSGM
Sbjct: 121   GFVVKWIGKGVGKIMKSSEVESFVAVANMFLGQTDSPILVSKYLGRMTDSEIMVVLVSGM   180

Query: 181   GSMSVSILGGYIALGIPMEYLLIASTMVPIGSILIAKILLPQTEPVQKIDDIKMDNKGNN   240
             GSMSVSILGGYIALGIPMEYLLIASTMVPIGSILIAKILLPQTEPVQKIDDIKMDNKGNN
Sbjct: 181   GSMSVSILGGYIALGIPMEYLLIASTMVPIGSILIAKILLPQTEPVQKIDDIKMDNKGNN   240

Query: 241   ANVIDAIAEGASTGAQMAFSIGASLIAFVGLVSLINMMLSGLGIRLEQIFSYVFAPFGFL   300
             ANVIDAIAEGASTGAQMAFSIGASLIAFVGLVSLINMMLSGLGIRLEQIFSYVFAPFGFL
Sbjct: 241   ANVIDAIAEGASTGAQMAFSIGASLIAFVGLVSLINMMLSGLGIRLEQIFSYVFAPFGFL   300

Query: 301   MGFDHKNILLEGNLLGSKLILNEFVSFQQLGDLIKSLDYRTALVATISLCGFANLSSLGI   360
             MGFDHKNILLEGNLLGSKLILNEFVSFQQLG LIKSLDYRTALVATISLCGFANLSSLGI
Sbjct: 301   MGFDHKNILLEGNLLGSKLILNEFVSFQQLGHLIKSLDYRTALVATISLCGFANLSSLGI   360

Query: 361   CVSGIAVLCPEKRGTLARLVFRAMIGGIAVSMLSAFIVGIVTLF                  404
             CVSGIAVLCPEKR TLARLVFRAMIGGIAVSMLSAFIVGIVTLF
Sbjct: 361   CVSGIAVLCPEKRSTLARLVFRAMIGGIAVSMLSAFIVGIVTLF                  404
```

A related GBS gene <SEQ ID 8955> and protein <SEQ ID 8956> were also identified. Analysis of this protein sequence reveals the following:

Lipop: Possible site: −1 Crend: 1
McG: Discrim Score: 13.83
GvH: Signal Score (−7.5) : −2.63
Possible site: 25
>>> Seems to have an uncleavable N-terminal signal sequence
ALOM program count: 8 value: −9.45 threshold: 0.0
INTEGRAL   Likelihood = −9.45   Transmembrane 35-51 (30-57)
INTEGRAL   Likelihood = −9.29   Transmembrane 8-24 (1-28)
INTEGRAL   Likelihood = −8.07   Transmembrane 388-404 (379-404)
INTEGRAL   Likelihood = −7.27   Transmembrane 104-120 (100-127)
INTEGRAL   Likelihood = −6.58   Transmembrane 259-275 (255-284)
INTEGRAL   Likelihood = −4.35   Transmembrane 172-188 (171-190)
INTEGRAL   Likelihood = −3.50   Transmembrane 200-216 (199-221)
INTEGRAL   Likelihood = −2.18   Transmembrane 352-368 (352-371)
PERIPHERAL Likelihood = 3.82    286
modified ALOM score: 2.39

*** Reasoning Step: 3
----- Final Results -----
   bacterial membrane --- Certainty = 0.4779 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the databases:

```
ORF01622(313-1512 of 1812)
GP|9656920|gb|AAF95495.1||AE004305(1-418 of 418) NupC family protein {Vibrio cholerae}
% Match = 24.0
% Identity = 39.5 % Similarity = 65.7
Matches = 160 Mismatches = 134 Conservative Sub.s = 106

276       306       336       366       396       426       456       486
         C*STPHTY*K**ITISEVLEVIMQFIYSIIGILLVLGIVYAISFNRKSVSLSLIGKALIVQFIIALILVRIPLGQQVVSV
                               | : |:||: ::|||   :| |||::|  :| |: :||  :   ::   :| ||:::
                               MSLFMSLIGMAVLLGIAVLLSSNRKAINLRTVGGAFAIQFSLGAFILYVPWGQELLRG
                                      10        20        30        40        50

516       546                 591       621       651       681       711
         VSTGVTKVINCGQAGLNFVFGSLADSG-----AKTGFIFAIQTLGNIVFLSALVSLLYYVGILGFVVKWIGKGVGKIMKS
          |: |||  |  |: ||  | :|:||       ||||:|||:|||::| |:|:: :||  | |: : : :
         FSDAVSNVINYGNDGTSFLFGGLVSGKMFEVFGGGGFIFAFRVLPTLIFFSALISVLYYLGVMQWVIRILGGGLQKALGT
                   70        80        90       100       110       120       130

741       771       801       831       861       891       921       951
         SEVESFVAVANMFLGQTDSPILVSKYLGRMTDSEIMVVLVSGMGSMSVSILGGYIALGIPMEYLLIASTMVPIGSILIAK
         |  ||  |  | ||:|:|||::|: ::  :|  :| ||:  |:  | ||  :|:|||  | |:||    |:||
         SRAESMSAAANIFVGQTEAPLVVRPFVPKMTQSELFAVMCGGLASIAGGVLAGYASMGVKIEYLVAASFMAAPGGLLFAK
                  150       160       170       180       190       200       210
```

```
 981     1011      1038      1068      1098      1128              1167
ILLPQTEPVQKIDDIKMDNKGNN-ANVIDAIAEGASTGAQMAFSIGASLIAFVGLVSLINMMLSGLG-------IRLEQI
:::|:||    |  :|       :   ||||||  |  |||  |  |:|::::|  ||||:||::|||  || |:|         ::|| :
LMMPETEKPQDNEDITLDGGDDKPANVIDAAAGGASAGLQLALNVGAMLIAFIGLIALINGMLGGIGGWFGMPELKLEML
         230       240       250       260       270       280       290

1197      1227      1257      1287      1305      1332      1362      1392
FSYVFAPFGFLMGFDHKNILLEGNLLGSKLILNEFVSFQQ----LGDLIKS-LDYRTALVATISLCGFANLSSLGICVSG
: ::|||: ||:|      :  | ::|| |: ||||:: |      |      |  :|  :  :   |||||||||: | : |
LGWLFAPLAFLIGVPWNEATVAGEFIGLKTVANEFVAYSQFAPYLTEAAPVVLSEKTKAIISFALCGFANLSSIAILLGG
         310       320       330       340       350       360       370

1422      1452      1482      1512      1542      1572      1602      1632
IAVLCPEKRGTLARLVFRAMIGGIAVSMLSAFIVGIVTLF*KLTKERRIVTWK*KIF*KR*TILC*QQQQHGQKSKQF*M
:   |  ||::||  :||:    :|:|  |      ::::| |||    |
LGSLAPKRRGDIARMGVKAVIAGTLSNLMAATIAGFFLSF
         390       400       410
```

Based on this analysis, it was predicted that these proteins and their epitopes could be useful antigens for vaccines or diagnostics.

Example 2019

A DNA sequence (GBSx2130) was identified in *S. agalactiae* <SEQ ID 6247> which encodes the amino acid sequence <SEQ ID 6248>. This protein is predicted to be deoxyribose-phosphate aldolase (deoC). Analysis of this protein sequence reveals the following:

Possible site 49
>>> Seems to have no N-terminal signal sequence
----- Final Results -----
    bacterial cytoplasm --- Certainty = 0.2196 (Affirmative) <succ>
      bacterial membrane --- Certainty = 0.0000 (Not Clear) <succ>
        bacterial outside --- Certainty = 0.0000 (Not Clear) <succ>

A related DNA sequence was identified in *S. pyogenes* <SEQ ID 6249> which encodes the amino acid sequence <SEQ ID 6250>. Analysis of this protein sequence reveals the following:

Possible site: 49
>>> Seems to have no N-terminal signal sequence
----- Final Results -----
    bacterial cytoplasm --- Certainty = 0.2196 (Affirmative) <succ>
      bacterial membrane --- Certainty = 0.0000 (Not Clear) <succ>
        bacterial outside --- Certainty = 0.0000 (Not Clear) <succ>

The protein has homology with the following sequences in the GENPEPT database.

```
>GP:CAA81646 GB:Z27121 deoxyribose aldolase [Mycoplasma hominis]
Identities = 99/199 (49%), Positives = 140/199 (69%), Gaps = 1/199 (0%)
Query:   5   DILKTVDHTLLATTATWPEIQTILDDAMAYETASACIPASYVKKAAEYVSGK-LAICTVI   63
             ++ K +DHT L+ +AT  +I  ++ +A+ Y+  S CI  SYVK A E +    + +CTVI
Sbjct:   3   ELNKYIDHTNLSPSATSKDIDKLIQEAIKYDFKSVCIAPSYVKYAKEALKNSDVLVCTVI   62

Query:  64   GFPNGYSTTAAKVFECQDAIKNGADEIDMVINLTDVKNGDFDTVEEEIRQIKAACQDHIL  123
             GFP  GY+  T+  KV+E  +  A+++GADEIDMVIN+    K+G ++  V    EI+  IK AC       L
Sbjct:  63   GFPLGYNATSVKVYETKIAVEHGADEIDMVINVGRFKDGQYEYVLNEIKAIKEACNGKTL  122

Query: 124   KVIVETCQLTKEELIELCGVVTRSGADFIKTSTGFSTAGATFEDVEVMAKYVGEGVKIKA  183
             KVIVET  LTK ELI++   +V +SGADFIKTSTGFS    GA+FED++ M +  G+ +  IKA
Sbjct: 123   KVIVETALLTKAELIKITELVMQSGADFIKTSTGFSYRGASFEDIQTMKETCGDKLLIKA  182

Query: 184   AGGISSLEDAEKFIALGAS                                           202
             +GGI +L DA++  I  LGA+
Sbjct: 183   SGGIKNLADAQEMIRLGAN                                           201
```

An alignment of the GAS and GBS proteins is shown below.

```
             Identities = 211/223 (94%), Positives = 217/223 (96%)
             Query:   1   MEVKDILKTVDHTLLATTATWPEIQTILDDAMAYETASACIPASYVKKAAEYVSGKLAIC   60
                          +EVEDILKTVDHTLLATTATWPEIQTILDDAMAYETASACIPASYVKKAAEYVSGKLAIC
             Sbjct:   1   VEVEDILKTVDHTLLATTATWPEIQTILDDAMAYETASACIPASYVKKAAEYVSGKLAIC   60
```

-continued

```
Query:  61  TVIGFPNGYSTTAAKVFECQDAIKNGADEIDMVINLTDVKNGDFDTVEEEIRQIKAACQD  120
            TVIGFPNGYSTTAAKVFECQDAI+NGADEIDMVINLTDVKNGDFDTVEEEIRQIKA CQD
Sbjct:  61  TVIGFPNGYSTTAAKVFECQDAIQNGADEIDMVINLTDVKNGDFDTVEEEIRQIKAKCQD  120

Query: 121  HILKVIVETCQLTKEELIELCGVVTRSGADFIKTSTGESTAGATFEDVEVMAEYVGEGVK  180
            HILKVIVETCQLT EELIELCGVVTRSGADFIKTSTGESTAGATFEDVEVMA YVGEGVK
Sbjct: 121  HILKVIVETCQLTEEELIELCGVVTRSGADFIKTSTGESTAGATFEDVEVMAKYVGEGVK  180

Query: 181  IKAAGGISSLEDAEKFIALGASRLGTSRIIKIVKNQEVEEGTY                  223
            IKAAGGISSLEDA+ FIALGASRLGTSRIIKIVKN+  +  +Y
Sbjct: 181  IKAAGGISSLEDAKTFIALGASRLGTSRIIKIVKNEATKTDSY                  223
```

Based on this analysis, it was predicted that these proteins and their epitopes could be useful antigens for vaccines or diagnostics.

Example 2020

A DNA sequence (GBSx2131) was identified in *S. agalactiae* <SEQ ID 6251> which encodes the amino acid sequence <SEQ ID 6252>. This protein is predicted to be phosphopentomutase (deoB). Analysis of this protein sequence reveals the following:

---

Possible site: 22
>>> Seems to have no N-terminal signal sequence
----- Final Results -----
  bacterial cytoplasm --- Certainty = 0.0546 (Affirmative) <succ>
    bacterial membrane --- Certainty = 0.0000 (Not Clear) <succ>
      bacterial outside --- Certainty = 0.0000 (Not Clear) <succ>

---

The protein has homology with the following sequences in the GENPEPT database.

```
>GP:AAC45496 GB:U80410 phosphopentomutase [Lactococcus lactis subsp. cremoris]
Identities = 275/408 (67%), Positives = 325/408 (79%), Gaps = 7/408 (1%)
Query:   3  QFDRIHLVVLDSVGIGAAPDANDFVNAGVP------DGASDTLGHISKTVGLAVPNMAKI   56
            +F RIHLVV+DSVGIGAAPDA+ F N  V       D  SDT+GHIS  GL VPN+ K+
Sbjct:   4  KFGRIHLVVMDSVGIGAAPDADKFFNHDVETHEAINDVKSDTIGHISEIRGLDVPNLQKL   63

Query:  57  GLGNIPRPQALKTVPAEENPSGYATKLQEVSLGKDTMTGHWEIMGLNITEPFDTFWNGFP  116
            G GNIPR   LKT+PA + P+ Y TKL+E+S GKDTMTGHWEIMGLNI  PF T+  G+P
Sbjct:  64  GWGNIPRESPLKTIPAAQKPAAYVTKLEEISKGKDTMTGHWEIMGLNIQTPFPTYPEGYP  123

Query: 117  EDIITKIEDFSGRKVIREANKPYSGTAVIDDFGPRQMETGELIIYTSADPVLQIAAHEDI  176
            ED++  KIE+FSGRK+IREANKPYSGTAVI+DFGPRQ+ETGELI YTSADPVLQIAAHED+
Sbjct: 124  EDLLEKIEEFSGRKIIREANKPYSGTAVIEDFGPRQLETGELIIYTSADPVLQIAAHEDV  183

Query: 177  IPLEELYRICEYARSITMERPALL-GRIIARPYVGEPGNFTRTANRHDYAVSPFEDTVLN  235
            I  EELY+ICEY RSIT+E    ++ GRIIARPYVGE GNF RT  R DYA+SPF +TVL
Sbjct: 184  ISREELYKICEYVRSITLEGSGIMIGRIIARPYVGEAGNFERTDGRRDYALSPFAETVLE  243

Query: 236  KLDQAGIDTYAVGKINDIFNGSGINHDMGHNKSNSHGIDTLIKTMGLSEFEKGFSFTNLV  295
            KL +AGIDTY+VGKI+DIFN  G+ +DMGHN ++  G+D L+K M  +EF +GFSFTNLV
Sbjct: 244  KLYKAGIDTYSVGKISDIENTVGVKYDMGHNHNDMDGVDRLLKAMTKTEFTEGFSFTNLV  303

Query: 296  DFDALYGHRRDPHGYRDCLHEFDERLPEIISAMRDKDLLLITADHGNDPTYAGTDHTREY  355
            DFDA YGHRRD  GY   + +FD RLPEII AM++ DLL+ITADHGNDP+Y GTDHTREY
Sbjct: 304  DFDAKYGHRRDVEGYGKAIEDFDGRLPEIIDAMKEDDLLMITADHGNDPSYVGTDHTREY  363

Query: 356  IPLLAYSPSFTGNGLIPVGHFADISATVADNFGVDTAMIGESFLQDLV              403
            IPL+ +S SF    ++PVGHFADISAT+A+NF V  A  GESFL  LV
Sbjct: 364  IPLVIFSKSFKEPKVLPVGHFADISATIAENFSVKKAQTGESFLDALV              411
```

There is also homology to SEQ ID 2740:

```
Identities= 348/402 (86%), Positives = 374/402 (92%)
Query:1   MSQFDRIHLVVLDSVGIGAAPDANDFVNAGVPDGASDTLGHISKTVGLAVPNMAKIGLGN   60
          MS+F+RIHLVVLDSVGIGAAPDA+ F NAGV D  SDTLGHIS+  GL+VPNMAKIGLGN
```

```
Sbjct:   1  MSKFNRIHLVVLDSVGIGAAPDADKFFNAGVADTDSDTLGHISEAAGLSVPNMAKIGLGN    60

Query:  61  IPRPQALKTVPAEENPSGYATKLQEVSLGKDTMTGHWEIMGLNITEPFDTFWNGFPEDII   120
            I RP  LKTVP E+NP+GY TKL+EVSLGKDTMTGHWEIMGLNITEPFDTFWNGFPE+I+
Sbjct:  61  ISRPIPLKTVPTEDNPTGYVTKLEEVSLGKDTMTGHWEIMGLNITEPFDTFWNGFPEEIL   120

Query: 121  TKIEDFSGRKVIREANKPYSGTAVIDDFGPRQMETGELIIYTSADPVLQIAAHEDIIPLE   180
            TKIE+FSGRK+IREANKPYSGTAVIDDFGPRQMETGELI+YTSADPVLQIAAREDIIP+E
Sbjct: 121  TKIEEFSGRKIIREANKPYSGTAVIDDFGPRQMETGELIVYTSADPVLQIAAHEDIIPVE   180

Query: 181  ELYRICEYARSITMERPALLGRIIARPYVGEPGNFTRTANRHDYAVSPFEDTVLNKLDQA   240
            ELY+ICEYARSIT+ERPALLGRIIARPYVG+PGNFTRTANRHDYAVSPF+DTVLNKL  A
Sbjct: 181  ELYKICEYARSITLERPALLGRIIARPYVGDPGNFTRTANRHDYAVSPFQDTVLNKLADA   240

Query: 241  GIDTYAVGKINDIFNGSGINHDMGHNKSNSHGIDTLIKTMGLSEFEKGFSFTNLVDFDAL   300
            G+ TYAVGKINDIFNGSGI +DMGHNKSNSHGIDTLIKT+ L EF KGFSFTNLVDFDA
Sbjct: 241  GVPTYAVGKINDIFNGSGITNDMGHNKSNSHGIDTLIKTLQLPEFTKGFSFTNLVDFDAN   300

Query: 301  YGHRRDPHGYRDCLHEFDERLPEIISAMRDKDLLLITADHGNDPTYAGTDHTREYIPLLA   360
            +GHRRDP GYRDCLHEFD RLPEII+ M++ DLLLITADHGNDPTYAGTDHTREYIPLLA
Sbjct: 301  FGHRRDPEGYRDCLHEFDNRLPEIIANMKEDDLLLITADHGNDPTYAGTDHTREYIPLLA   360

Query: 361  YSPSFTGNGLIPVGHFADISATVADNFGVDTAMIGESFLQDL                    402
            YS SFTGNGLIP GHFADISATVA+NFGVDTAMIGESFL  L
Sbjct: 361  YSVSFTGNGLIPQGHFADISATVAENFGVDTAMIGESFLSHL                    402
```

Based on this analysis, it was predicted that this protein and its epitopes, could be useful antigens for vaccines or diagnostics.

Example 2021

A DNA sequence (GBSx2132) was identified in *S. agalactiae* <SEQ ID 6253> which encodes the amino acid sequence <SEQ ID 6254>. Analysis of this protein sequence reveals the following:

Possible site: 35
>>> Seems to have an uncleavable N-terminal signal seq
INTEGRAL   Likelihood = –12.05   Transmembrane 9-25 (4-35)
----- Final Results -----
  bacterial membrane --- Certainty = 0.5819 (Affirmative) <succ>
  bacterial outside --- Certainty = 0.0000 (Not Clear) <succ>
  bacterial cytoplasm --- Certainty = 0.0000 (Not Clear) <succ>

The protein has no significant homology with any sequences in the GENPEPT database.

A related DNA sequence was identified in *S. pyogenes* <SEQ ID 6255> which encodes the amino acid sequence <SEQ ID 6256>. Analysis of this protein sequence reveals the following:

Possible site: 56
>>> Seems to have no N-terminal signal sequence
INTEGRAL   Likelihood = –5.57   Transmembrane 41-57 (38-60)
----- Final Results -----
  bacterial membrane --- Certainty = 0.3230 (Affirmative) <succ>
  bacterial outside --- Certainty = 0.0000 (Not Clear) <succ>
  bacterial cytoplasm --- Certainty = 0.0000 (Not Clear) <succ>

A related sequence was also identified in GAS <SEQ ID 9143> which encodes the amino acid sequence <SEQ ID 9144>. Analysis of this protein sequence reveals the following:

Possible cleavage site: 49
>>> Seems to have an uncleavable N-term signal seq
INTEGRAL   Likelihood = –5.57   Transmembrane 13-29 (10-32)
----- Final Results -----
  bacterial membrane --- Certainty = 0.323 (Affirmative) <succ>
  bacterial outside --- Certainty = 0.000 (Not Clear) <succ>
  bacterial cytoplasm --- Certainty = 0.000 (Not Clear) <succ>

An alignment of the GAS and GBS proteins is shown below.

```
Identities = 276/544 (50%), Positives = 368/544 (66%), Gaps = 5/544 (0%)
Query:   5  FKKKVVKVCLVIFGIVLVSLLSLGFFYFSKGQVLSRFVAARSRTSGQAFDNIKEYMVWSD    64
            F  K +K  +I    L   L G FY+SK   ++ ++ ARS   SG   F+NIK Y+VW D
Sbjct:  33  FHHKKLKQITIIAATSLFLFLIGGAFYYSKNHCINAYLKARSAQSGPVFENIKAYLVWDD    92

Query:  65  TGESITNDEANYANFEPLSKSEARKLGQEIKEGNKNDSMYLKRVGSRLGIFPDYRIANKP   124
            T E ITNDEA Y  F     S+ E R+  Q++K  +++ ++  +K VG R  IFPDYRIA KP
Sbjct:  93  TNEQITNDEAMYTKFRRYSQKELRQKKQDLKAASQDSAVQVKSVGRRFWIFPDYRIAIKP   152

Query: 125  MSLTLKTNVPKLDVLLNQKKVATSNSDHFSVTVERLPRTHYTASLEGTSDGKEIKLKKDY   184
            M LT+KTNVP+ DVLLNQKKVA S+S+ FSV ++RLP    YTAS+ G  +G+ IK+ K Y
Sbjct: 153  MDLTIKTNVPQADVLLNQKKVAVSDSEQFSVKLDRLPTAEYTASIRGKHNGRNIKVNKSY   212

Query: 185  DGKNQTIDLSVAFKSFTVTSNLMDGNLYFGDNRIAKLKDGSHSVENYPVTDGSKAYIKKV   244
            DG N  +DLSV F++F VTSN   G+LYF DN I  LKDG   VE+YPVT+ ++AY+K
```

-continued

```
Sbjct: 213  DGDNPVLDLSVSFRTFLVTSNAKQGDLYFDDNHIGTLKDGQLQVEDYPVTENAQAYMKTT  272

Query: 245  FNDGEITSHKQKLISIADNQTIKLDVDGLLNEKEAGQKLITAFNQLILYVSTGQDPQTLG  304
            F DGE+ S K  L  + +  T+++ V LL  E +AG+ L++AF+QL+ Y+STGQD    L
Sbjct: 273  FPDGELRSQKYALADVEEGATLEILVTDLLEEDKAGELLVSAFDQLMHYLSTGQDSSNLR  332

Query: 305  TVFEKGAENDFYKGLKESIKAKFVTDNRKASHFTIPNIVLNKMTQVGKESYQVNFAADYD  364
            +VFE G+ N FY+GLKESIKAKF TD RKAS   IP+I+L  MTQVGK +Y ++F A Y+
Sbjct: 333  SVFEAGSSNAFYRGLKESIKAKFQTDTRKASRLNIPSILLTTMTQVGKTTYVLDFTATYE  392

Query: 365  FNYDKSTDPDKKTYGHIIQNLTGNFIMKKSGNSYLISNDGKKDITVAKETNKVKADPVSI  424
            F YDKSTDP++ T GHI Q+LTG  +KK G  YLIS  G K+ITV KE N++KA    S+
Sbjct: 393  FLYDKSTDPEQHTSGHINQDLTGKVTVKKVGQHYLISQSGSKNITVVKEDNQLKAP--SV  450

Query: 425  FPENLVGSWKGEVEDGTVTMTFDKDGKVTQK-KVYKDSKSKESNHSAKVTKLEDKGNGLY  483
            FPE+++G+W G+     ++ M+   DG +T K +   K ++SKE+   +AK++K+EDKGNG Y
Sbjct: 451  FPESILGTWTGQANGLSIHMSLASDGTITTKVEDQKGNRSKET-RTAKISKVEDKGNGFY  509

Query: 484  LYQYESGTDTTTFV-TGGIGGLKVKYAYGIKIEGNKIIPVIWQTSSDGEFDYHKPLLSKP  542
            LY  + G+D +   V  GG+GG  VKYAYG KI G    PV+WQ +   EFDY KPL
Sbjct: 510  LYTPDPGSDISAIMPEGGLGGANVKYAYGFKISGKTASPVVWQAALTHEFDYTKPLSGVT  569

Query: 543  LTKQ                                                         546
            L KQ
Sbjct: 570  LQKQ                                                         573
```

A related DNA sequence was identified in *S. pyogenes* <SEQ ID 9065> which encodes amino acid sequence <SEQ ID 9066>. An alignment of the GAS and GBS sequences follows:

```
Score = 47.3 bits (11%), Expect = 4e-07
Identities = 65/303 (21%), Positives = 119/303 (38%), Gaps = 18/303 (5%)
Query: 153  FYILGIGTSISIVVALTRFVKEISLNFKEIKKLANKMGIEVLSENENYSQII---EFDDI  209
            +YIL + T I+ +V   +  +S  F  +KKL KM       +  +QI     EF D+
Sbjct:  37  YYILSV-TIIACIVGGIVNLFLLSSVFTSLKKLKQKMKDISQRCFDTKAQICSPQEFKDL   95

Query: 210  LRTLHIKGDNLKSLIEREILEKQDLSFQIAALSHDIKTPXXXXXXXXXXXXXXXXXXXQE  269
              +     L+S +    +++  +  IA LSHDIKTP                      +
Sbjct:  96  ETAFNQMSSELESTFKSLNESEREKTMMIAQLSHDIKTPITSIQSTVEGILDGIISEEEV  155

Query: 270  GYIVSMNNSISVFEGYFNSLISYTRML--------SEDRSVKLILVEELLSELHFEVDDL  321
            Y +  N+IS   N L+  +       +E  + I +++LL ++  E  +
Sbjct: 156  NYYL---NTISRQTNRLNHLVEELSFITLETMSDTAEPHKEETIYLDKLLIDILSEFQLV  212

Query: 322  LNINNIEFSICNRLIITSFYGDEENLIRALSNLLVNAIRFMPVLDKKIEVILSESGEQIH  381
             N + I    ++         + L R L NL+ NA ++        + +     + + I
Sbjct: 213  FEKENRQVMIDVAPDVSKLSSQYDKLSRILLNLISNAKKYSDP-GSPLTIKAYSNRQDIV  271

Query: 382  FEIWNNGERFSDSTLKKGDKLFYTEDYSRGNK--HYGIGLAFVKGVAIKHGGNLQLNNPA  439
            +I + G    D  L      Y  + SR  K   +G+GL    + +A +  G++ + +
Sbjct: 272  IDIIDQGYGIKDEDLASIFNRLYRVESSRNMKTGGHGLGLYIARQLAHQLNGDILVESQY  331

Query: 440  RGG                                                         442
            + G
Sbjct: 332  QKG                                                         334
```

A related sequence was also identified in GAS <SEQ ID 9135> which encodes the amino acid sequence <SEQ ID 9136>. Analysis of this protein sequence reveals the following:

---

Possible site: 37
>>> Seems to have a cleavable N-term signal seq.
INTEGRAL    Likelihood = −3.56    Transmembrane 145-161 (145-164)
----- Final Results -----
  bacterial membrane --- Certainty = 0.2423 (Affirmative) <succ>
    bacterial outside --- Certainty = 0.0000 (Not Clear) <succ>
      bacterial cytoplasm --- Certainty = 0.0000 (Not Clear) <succ>

---

SEQ ID 6254 (GBS280) was expressed in *E. coli* as a His-fusion product. SDS-PAGE analysis of total cell extract is shown in FIG. 52 (lane 8; MW 63.7 kDa). It was also expressed in *E. coli* as a GST-fusion product. SDS-PAGE analysis of total cell extract is shown in FIG. 58 (lane 7; MW 88.7 kDa).

Based on this analysis, it was predicted that these proteins and their epitopes could be useful antigens for vaccines or diagnostics.

Example 2022

A DNA sequence (GBSx2133) was identified in *S. agalactiae* <SEQ ID 6257> which encodes the amino acid sequence <SEQ ID 6258>. This protein is predicted to be ribosomal large subunit pseudouridine synthase D (rluC). Analysis of this protein sequence reveals the following:

---

Possible site: 22
>>> Seems to have an uncleavable N-term signal seq
INTEGRAL    Likelihood = −4.62    Transmembrane 2-18 (1-19)

----- Final Results -----
   bacterial membrane --- Certainty = 0.2848 (Affirmative) <succ>
     bacterial outside --- Certainty = 0.0000 (Not Clear) <succ>
       bacterial cytoplasm --- Certainty = 0.0000 (Not Clear) <succ>

The protein has homology with the following sequences in the GENPEPT database.

```
>GP:CAB12749 GB:Z99108 similar to hypothetical proteins [Bacillus subtilis]
Identities = 97/251 (38%), Positives = 147/251 (57%), Gaps = 15/251 (5%)
Query:  86   KHVLINNEFINWQTVVQENDTITLIFDDEDYPTKKIPLGRAELIDCLYEDEHLIIVNKPE  145
             + + +N+E +    +V++ D + +   + + +    G     +D L+ED H++I+NKP
Sbjct:  43   QQIKVNHESVLNNMIVKKGDRVFIDLQESEASSVIPEYGE---LDILFEDNHMLIINKPA   99

Query: 146   GMKTHGNQPNEIALLNHVSAY----SGQTCYV--VHRLDMETSGAVLFAKNPFILPLINQ  199
             G+ TH N+  +   L ++ AY     +G+TC V VHRLD   +TSGA++FAK+      +++Q
Sbjct: 100   GIATHPNEDGQTGTLANLIAYHYQINGETCKVRHVHRLDQDTSGAIVFAKHRLAHAILDQ  159

Query: 200   RLERKEIWREYWALVEGKFSPKHQVLRDKIGRNR-HDRRKRIIDSKNGQHAMTIIDVL--  256
             +LE+K + R Y A+ EGK   K   +    IGR+R H  R+R+  S   GQ A+T    V+
Sbjct: 160   QLEKKTLKRTYTAIAEGKLRTKKGTINPPIGRDRSHPTRRRV--SPGGQTAVTHFKVMAS  217

Query: 257   KYIQNSSLIKCRLETGRTHQIRVHLSHHGHPLIGDPLYNPSSN-NERLMLHAHRLTLSHP  315
              +   SL++  LETGRTHQIRVHL+  GHPL GD LY  S      R  LHA+++    HP
Sbjct: 218   NAKERLSLVELELETGRTHQIRNULASLGHPLTGDSLYGGGSKLLNRQALHANKVQAVHP  277

Query: 316   LTCETISVEAP                                                  326
             +T E I   EAP
Sbjct: 278   ITDELIVAEAP                                                  288
```

A related DNA sequence was identified in *S. pyogenes* <SEQ ID 6259> which encodes the amino acid sequence <SEQ ID 6260>. Analysis of this protein sequence reveals the following:

Possible site: 38
>>> Seems to have no N-terminal signal sequence
----- Final Results -----
   bacterial cytoplasm --- Certainty = 0.4198 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

Based on this analysis, it was predicted that these proteins and their epitopes could be useful antigens for vaccines or diagnostics.

Example 2023

A DNA sequence (GBSx2134) was identified in *S. agalactiae* <SEQ ID 6261> which encodes the amino acid sequence <SEQ ID 6262>. Analysis of this protein sequence reveals the following:

Possible site: 52
>>> Seems to have no N-terminal signal sequence
INTEGRAL    Likelihood = −9.02    Transmembrane 98-114 (93-119)
----- Final Results -----
   bacterial membrane --- Certainty = 0.4609 (Affirmative) <succ>
     bacterial outside --- Certainty = 0.0000 (Not Clear) <succ>
       bacterial cytoplasm --- Certainty = 0.0000 (Not Clear) <succ>

```
Identities = 172/278 (61%), Positives = 212/278 (75%), Gaps = 2/278 (0%)

Query:  63   TVKELLEDYFLIPRKIRHFLRVKKHVLINNEFINWQTVVQENDTITLIFDDEDYPTKKIP  122
             TVK LLE+  LIPRKIRHFLR KKHVLIN   +NWQ+ V+  D + L FD EDYP K I
Sbjct:   2   TVKALLEEQLLIPRKIRHFLRTKKHVLINGHSVNWQSCVKYGDQVKLFFDHEDYPEKIIV   61

Query: 123   LGRAELIDCLYEDEHLIIVNKPEGMKTHGNQPNEIALLNHVSAYSGQTCYVVHRLDMETS  182
             +G+AE + CLYEDEH+IIVNKPEGMKTHGN P E+ALLNHVSAY+GQTCYVVHRLD ETS
Sbjct:  62   MGQAEKVTCLYEDEHIIIVNKPEGMKTHGNDPTELALLNHVSAYTGQTCYVVHRLDKETS  121

Query: 183   GAVLFAKNPFILPLINQRLERKEIWREYWALVEGKFSPKHQVLRDKIGRNRHDRRKRIID  242
             GA+LFAK PFILP++N+ LE+++I REY ALV G              IGR+RHDRRKR++D
Sbjct: 122   GAILFAKTPFILPILNRLLEKRDIHREYLALVHGSLDSPRVTYHHPIGRHRHDRRKRVVD  181

Query: 243   SKNGQHAMTIIDVLK-YIQNSSLIKCRLETGRTHQIRVHLSHHGHPLIGDPLY-NPSSNN  300
              NG+ A+T + ++K + + +SL+ C+L+TGRTHQIRVHL+H GH L GDPLY N   +
Sbjct: 182   PINGKKAITEVTLVKNFHKTASLLTCQLQTGRTHQIRVHLAHQGHVLFGDPLYSNGKKDC  241

Query: 301   ERLMLHAHRLTLSHPLTCETISVEAPSSTFEKILNNYK                       338
             +RLMLHA++L L HPLT E I V+A S+TF+ +LN  K
Sbjct: 242   ARLMLHAYQLRLKHPLTQEDICVQAKSATFDAVLNAQK                       279
```

The protein has homology with the following sequences in the GENPEPT database.

```
>GP:AAF04735 GB:AF101780 penicillin-binding protein 2a
[Streptococcus pneumoniae]
Identities = 424/773 (54%), Positives = 555/773 (70%), Gaps = 47/773 (6%)
Query:   2    KLFDKFIDLFRVDEDNDEMTRKNEQETREETSNLDGEEVYDIDDITRPSKSQYQRGIRHQ    61
              KLF+KF+ LF+                +ETS L+  +      I R S+S
Sbjct:   5    KLFEKFLSLFK-----------------KETSELEDSD----STILRRSRS---------    34

Query:  62    KENAKSRPEWLQKVDRYLPSPKNPIRRFWRRYRIGKLLFIALMAFILIFGSYLFYLSKTA   121
                            DR   +   PIR+FWRRY + K++ I  ++  L+ G YLF ++K+
Sbjct:  35    --------------DRKKLAQVGPIRKFWRRYHLTKIILILGLSAGLLVGIYLFAVAKST    80

Query: 122    TVSDLQSALKTTTTIYDKNKEYAGKLSGQKGTYVELNAISDHLKNAVIATEDRTFYENNG   181
                 V+DLQ+ALKT T I+D+ ++ AG LSGQKGTYVEL  IS +L+NAVIATEDR+FY+N+G
Sbjct:  81    NVNDLQNALKTRTLIFDREEKEAGALSGQKGTYVELTDISKNLQNAVIATEDRSFYKNDG   140

Query: 182    VNFKRFFLAVATLGKFGGGSTITQQLAKNAYLSQDQTIKRKAREFFLALELTKKYSKAEI   241
              +N+ RFFLA+ T G+ GGGSTITQQLAKNAYLSQDQT++RKA+EFFLALEL+KKYSK +I
Sbjct: 141    INYGRFFLAIVTAGRSGGGSTITQQLAKNAYLSQDQTVERKAKEFFLALELSKKYSKEQI   200

Query: 242    LTMYLNNSYFGNGVWGVEDASRKYFGTSAANLTVDEAATLAGMLKGPEVYNPYYSVENAT   301
              LTMYLNN+YFGNGVWGVEDAS+KYFG SA+ +++D+AATLAGMLKGPE+YNP  SVE++T
Sbjct: 201    LTMYLNNAYFGNGVWGVEDASKKYFGVSASEVSLDQAATLAGMLKGPELYNPLNSVEDST   260

Query: 302    NRRDTVLAAMVDAGKLTKSQAKEAASIGMKNRLADTYAGKINDYRYPSYFDAVVNEAIDT   361
              NRRDTVL  MV AG + K+Q  EAA + M ++L D Y GKI+DYRYPSYFDAVVNEA+
Sbjct: 261    NRRDTVLQNMVAAGYIDKNQETEAAEVDMTSQLHDKYEGKISDYRYPSYFDAVVNEAVSK   320

Query: 362    YGISEKDIVNNGYKIYTALDQNYQSGMQKTFDDTSLFPVSDYDGQSAQGASVALDPKTGG   421
              Y ++E++IVNNGY+IYT LDQNYQ+ MQ   +++TSLFP ++ DG  AQ   SVAL+PKTGG
Sbjct: 321    YNLTEEEIVNNGYRIYTELDQNYQANMQIVYENTSLFPRAE-DGTFAQSGSVALEPKTGG   379

Query: 422    VRGLVGRVQSTKDAQFRSFNYATQSKRSPASTIKPLVVYSPAIASGWSIDKELPNKVQDF   481
              VRG+VG+V           FR+FNYATQSKRSP STIKPLVVY+PA+ +GW+++K+L N    +
Sbjct: 380    VRGVVGQVADNDKTGFRNFNYATQSKRSPGSTIKPLVVYTPAVEAGWALNKQLDNHTMQY   439

Query: 482    HGYKPSNYGGIET-ESIPMYQALANSYNIPAVYTDKLGINKAFTYGRKFGLNMSSANKE   540
                   YK  NY GI+T   +PMYQ +LA S N+PAV T++ LG++KAF  G KFGLNM   ++
Sbjct: 440    DSYKVDNYAGIKTSREVPMYQSLAESLNLPAVATVNDLGVDKAFEAGEKFGLNMEKVDRV   499

Query: 541    LGVALGGSVTTNPLEMAQAYSTFANDGIMHRAHLITRIETANGKLVKQFTDKPKRVISRS   600
              LGVALG  V TNPL+MAQAY+ FAN+G+M  AH I+RIE A+G+++      + KRVI +S
Sbjct: 500    LGVALGSGVETNPLQMAQAYAAFANEGLMPEAHFISRIENASGQVIASHKNSQKRVIDKS   559

Query: 601    VASKMTSMMLGTFSNGTAINANVYGYTMAGKTGTTETDFNPNLSGDQWVVGYTPDVVISQ   660
              VA KMTSMMLGTF+NGT I+++ Y MAGKTGTTE    FNP   +DQWV +GYTPDVVIS
Sbjct: 560    VADKMTSMMLGTFTNGTGISSSPADYVMAGKTGTTEAVFNPEYTSDQWVIGYTPDVVISH   619

Query: 661    WVGFKNTDKHHYLTDSSAGTASNIFSTQASYILPYTKGSSFTHIENAYFQNGIGSVYNAQ   720
              W+GF  TD++HYL   S++  A+++F    A+  ILPYT GS+FT  +ENAY QNGI        +
Sbjct: 620    WLGFPTTDENHYLAGSTSNGAAHVFRNIANTILPYTPGSTFT-VENAYKQNGIAPANTKR   678

Query: 721    DASNTTNQESRSIINDLKDSASKAAQDISRAVEDSNFQEKVKDAWNSLKDYFR          773
                    N  ++  ++D++  A    + SRA+ D+  +EK +   W+S+ +  FR
Sbjct: 679    QVQTNDNSQTDDNLSDIRGRAQSLVDEASRAISDAKIKEKAQTIWDSIVNLFR         731
```

A related DNA sequence was identified in *S. pyogenes* <SEQ ID 6263> which encodes the amino acid sequence <SEQ ID 6264>. Analysis of this protein sequence reveals the following:

Possible site: 52
>>> Seems to have no N-terminal signal sequence

---

INTEGRAL     Likelihood = −7.96     Transmembrane 104-120 (99-124)
----- Final Results -----
   bacterial membrane --- Certainty = 0.4185 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the databases:

```
>GP:AAF04735 GB:AF101780 penicillin-binding protein 2a [Streptococcus pneumoniae]
Identities = 414/730 (56%), Positives = 539/730 (73%), Gaps = 17/730 (2%)
Query:  50    TKNSEQDPATALQRSRAYEGSPKSRPAWLQKLEAVLPSPQRPIRRFWRRYHIGKLLMILI   109
              T   E   +T L+RSR+           +KL  V      PIR+FWRRYH+ K+++IL
Sbjct:  18    TSELEDSDSTILRRSRSDR----------KKLAQV-----GPIRKFWRRYHLTKIILILG    62

Query: 110    GTLVLLLGSYLFYLSKTAKVSDLQDALKATTVIYDHKGEYAGSLSGQKGSYVELNAISDD   169
                 +  LL+G YLF ++K+   V+DLQ+ALK   T+I+D +  + AG+LSGQKG+YVEL  IS +
```

-continued

```
Sbjct:  63  LSAGLLVGIYLFAVAKSTNVNDLQNALKTRTLIFDREEKEAGALSGQKGTYVELTDISKN  122

Query: 170  LENAVIATEDRTFYSNSGINLKRFLLAVVTAGRFGGGSTITQQLAXNAYLSQDQTIKRKA  229
            L+NAVIATEDR+FY N GIN  RF LA+VTAGR GGGSTITQQLAKNAYLSQDQT++RKA
Sbjct: 123  LQNAVIATEDRSFYKNDGINYGRFFLAIVTAGRSGGGSTITQQLAKNAYLSQDQTVERKA  182

Query: 230  REFFLALELTKKYSKKDILTMYLNNSYFGNGVWGVEDASQKYFGTTAANLTLDEAATLAG  289
            +EFFLALEL+KKYSK+ ILTMYLNN+YFGNGVWGVEDAS+KYFG +A+ ++LD+AATLAG
Sbjct: 183  KEFFLALELSKKYSKEQILTMYLNNAYFGNGVWGVEDASKKYFGVSASEVSLDQAATLAG  242

Query: 290  MLKGPEIYNPYHSLKNATHRRDTVLGAMVDAKKITQTKAQQARAVGLKNRLADTYVGKTD  349
            MLKGPE+YNP +S++++T+RRDTVL  MV A  I + +  +A V + ++L D Y GK
Sbjct: 243  MLKGPELYNPLNSVEDSTNRRDTVLQNMVAAGYIDKNQETEAAEVDMTSQLHDKYEGKIS  302

Query: 350  DYKYPSYFDAVISEAIATYGLSEKDIVNNGYKVYTELDQNYQTGMQTTFNNDELFPVSAY  409
            DY+YPSYFDAV++EA++ Y L+E++IVNNGY++YTELDQNYQ  MQ + N LFP A
Sbjct: 303  DYRYPSYFDAVVNEAVSKYNLTEEEIVNNGYRIYTELDQNYQANMQIVYENTSLFP-RAE  361

Query: 410  DGSSAQAASVALDPKTGGVRGLIGRVNSSENPTFRSENYATQAKRSPASTIKPLVVYAPA  469
            DG+ AQ+ SVAL+PKTGGVRG++G+V ++    FR+FNYATQ+KRSP STIKPLVVY PA
Sbjct: 362  DGTFAQSGSVALEPKTGGVRGVVGQVADNDKTGFRNFNYATQSKRSPGSTIKPLVVYTPA  421

Query: 470  VASGWSIEKELPNTVQDFDGYQPHNY-GNYESEDVPMYQALANSYNIPAVSTLNDIGIDK  528
            V +GW++ K+L N    +D Y+  NY G   S +VPMYQ+LA S N+PAV+T+ND+G+DK
Sbjct: 422  VEAGWALNKQLDNHTMQYDSYKVDNYAGIKTSREVPMYQSLAESLNLPAVATVNDLGVDK  481

Query: 529  AFTYGKTFGLDMSSAKKELGVALGGSVTTNPLEMAQAYAAFANNGVIHPAHLINRIENAR  588
            AF  G+  FGL+M   + LGVALG  V TNPL+MAQAYAAFAN G++  AH I+RIENA
Sbjct: 482  AFEAGEKFGLNMEKVDRVLGVALGSGVETNPLQMAQAYAAFANEGLMPEAHFISRIENAS  541

Query: 589  GEVLKTFTDKAKRVVSQSVADKMTAMMLGTFSNGTAVNANVYGYTLAGKTGTTETNFNPD  648
            G+V+ + +   KRV+ +SVADKMT+MMLGTF+NGT ++++    Y +AGKTGTTE  FNP+
Sbjct: 542  GQVIASHKNSQKRVIDKSVADKMTSMMLGTFTNGTGISSSPADYVMAGKTGTTEAVFNPE  601

Query: 649  LAGDQWVIGYTPDVVISQWVGFNQTDENHYLTDSSAGTASAIFSTQASYILPYTKGSQFH  708
                DQWVIGYTPDVVIS W+GF  TDENHYL  S++  A+  +F    A+ ILPYT GS F
Sbjct: 602  YTSDQWVIGYTPDVVISHWLGFPTTDENHYLAGSTSNGAAHVFRNIANTILPYTPGSTFT  661

Query: 709  VDNAYAQNGISAVYGVNETGNQSGVDTQSIIDGLRKSAQEASQSLSKAVDQSGLRDKAQS  768
            V+NAY QNGI+        +     T +    +R  AQ      S+A+  +  +++KAQ+
Sbjct: 662  VENAYKQNGIAPANTKRQVQTNDNSQTDDNLSDIRGRAQSLVDEASRAISDAKIKEKAQT  721

Query: 769  IWKEIVDYFR                                                   778
            IW  IV+ FR
Sbjct: 722  IWDSIVNLFR                                                   731
```

An alignment of the GAS and GBS proteins is shown below.

```
Identities = 530/715 (74%), Positives = 623/715 (87%), Gaps = 1/715 (0%)
Query:  59  RHQKENAKSRPEWLQKVDRYLPSPKNPIRRFWRRYRIGKLLFIALMAFILIFGSYLFYLS  118
            R + + KSRP WLQK++ LPSP+ PIRRFWRRY IGKLL I +  +L+ GSYLFYLS
Sbjct:  65  RAYEGSPKSRPAWLQKLEAVLPSPQRPIRRFWRRYHIGKLLMILIGTLVLLLGSYLFYLS  124

Query: 119  KTATVSDLQSALKTTTTIYDKNKEYAGKLSGQKGTYVELNAISDHLKNAVIATEDRTFYE  178
            KTA VSDLQ ALK TT IYD   EYAG LSGQKG+YVELNAISD L+NAVIATEDRTFY
Sbjct: 125  KTAKVSDLQDALKATTVIYDHKGEYAGSLSGQKGSYVELNAISDDLENAVIATEDRTFYS  184

Query: 179  NNGVNFKRFFLAVATLGKFGGGSTITQQLAKNAYLSQDQTIKRKAREFFLALELTKKYSK  238
            N+G+N KRF LAV T G+FGGGSTITQQLAKNAYLSQDQTIKRKAREFFLALELTKKYSK
Sbjct: 185  NSGINLKRFLLAVVTAGRFGGGSTITQQLAKNAYLSQDQTIKRKAREFFLALELTKKYSK  244

Query: 239  AEILTMYLNNSYFGNGVWGVEDASRKYFGTSAANLTVDEAATLAGMLKGPEVYNPYYSVE  298
             +ILTMYLNNSYFGNGVWGVEDAS+KYFGT+AANLT+DEAATLAGMLKGPE+YNP++S++
Sbjct: 245  KDILTMYLNNSYFGNGVWGVEDASQKYFGTTAANLTLDEAATLAGMLKGPEIYNPYHSLK  304

Query: 299  NATNRRDTVLAAMVDAGKLTKSQAKEAASIGMKNRLADTYAGKINDYRYPSYFDAVVNEA  358
            NAT+RRDTVL AMVDA K+T+++A++ +G+KNRLADTY GK +DY+YPSYFDAV++EA
Sbjct: 305  NATHRRDTVLGAMVDAKKITQTKAQQARAVGLKNRLADTYVGKTDDYKYPSYFDAVISEA  364

Query: 359  IDTYGISEKDIVNNGYKIYTALDQNYQSGMQKTFDDTSLFPVSYDGQSAQGASVALDPK  418
            I TYG+SEKDIVNNGYK+YT LDQNYQ+GMQ TF++ LFPVS YDG SAQ ASVALDPK
Sbjct: 365  IATYGLSEKDIVNNGYKVYTELDQNYQTGMQTTFNNDELFPVSAYDGSSAQAASVALDPK  424

Query: 419  TGGVRGLVGRVQSTKDAQFRSFNYATQSKRSPASTIKPLVVYSPAIASGWSIDKELPNKV  478
            TGGVRGL+GRV S+++   FRSFNYATQ+KRSPASTIKPLVVY+PA+ASGWSI+KELPN V
Sbjct: 425  TGGVRGLIGRVNSSENPTFRSFNYATQAKRSPASTIKPLVVYAPAVASGWSIEKELPNTV  484
```

```
                              -continued
Query:  479  QDFHGYKPSNYGGIETESIPMYQALANSYNIPAVYTLDKLGINKAFTYGRKFGLNMSSAN  538
             QDF GY+P NYG  E+E +PMYQALANSYNIPAV TL+ +GI+KAFTYG+ FGL+MSSA
Sbjct:  485  QDFDGYQPHNYGNYESEDVPMYQALANSYNIPAVSTLNDIGIDKAFTYGKTFGLDMSSAK  544

Query:  539  KELGVALGGSVTTNPLEMAQAYSTFANDGIMHRAHLITRIETANGKLVKQFTDKPKRVIS  598
             KELGVALGGSVTTNPLEMAQAY+ FAN+G++H AHLI RIE A G+++K FTDK KRV+S
Sbjct:  545  KELGVALGGSVTTNPLEMAQAYAAFANNGVIHPAHLINRIENARGEVLKTFTDKAKRVVS  604

Query:  599  RSVASKMTSMMLGTFSNGTAINANVYGYTMAGKTGTTETDFNPNLSGDQWVVGYTPDVVI  658
             +SVA KMT+MMLGTFSNGTA+NANVYGYT+AGKTGTTET+FNP+L+GDQWV+GYTPDVVI
Sbjct:  605  QSVADKMTAMMLGTFSNGTAVNANVYGYTLAGKTGTTETNFNPDLAGDQWVIGYTPDVVI  664

Query:  659  SQWVGFKNTDKHHYLTDSSAGTASNIFSTQASYILPYTKGSSFTHIENAYFQNGIGSVYN  718
             SQWVGF  TD++HYLTDSSAGTAS IFSTQASYILPYTKGS F H++NAY QNGI +VY
Sbjct:  665  SQWVGFNQTDENHYLTDSSAGTASAIFSTQASYILPYTKGSQF-HVDNAYAQNGISAVYG  723

Query:  719  AQDASNTTNQESRSIINDLKDSASKAAQDISRAVEDSNFQEKVKDAWNSLKDYFR       773
             +   N +  +++SII+ L+ SA +A+Q +S+AV+ S  ++K +   W   + DYFR
Sbjct:  724  VNETGNQSGVDTQSIIDGLRKSAQEASQSLSKAVDQSGLRDKAQSIWKEIVDYFR       778
```

SEQ ID 6262 (GBS397d) was expressed in *E. coli* as a His-fusion product. SDS-PAGE analysis of total cell extract is shown in FIG. 153 (lane 13; MW 76 kDa) and in FIG. 184 (lane 9; MW 76 kDa).

Based on this analysis, it was predicted that these proteins and their epitopes could be useful antigens for vaccines or diagnostics.

Example 2024

A DNA sequence (GBSx2135) was identified in *S. agalactiae* <SEQ ID 6265> which encodes the amino acid sequence <SEQ ID 6266>. This protein is predicted to be M-like protein. Analysis of this protein sequence reveals the following:

---

Possible site: 27
>>> Seems to have no N-terminal signal sequence
INTEGRAL    Likelihood = −10.56  Transmembrane 609-625 (599-628)
INTEGRAL    Likelihood = −0.00   Transmembrane 19-35 (19-35)
----- Final Results -----
   bacterial membrane --- Certainty = 0.5225 (Affirmative) <succ>
     bacterial outside --- Certainty = 0.0000 (Not Clear) <succ>
       bacterial cytoplasm --- Certainty = 0.0000 (Not Clear) <succ>

---

The protein has homology with the following sequences in the GENPEPT database.

There is also homology to SEQ ID 822.

A related GBS gene <SEQ ID 8957> and protein <SEQ ID 8958> were also identified. Analysis of this protein sequence reveals the following:

---

Lipop: Possible site: −1    Crend: 8
McG: Discrim Score: −5.20
GvH: Signal Score (−7.5): 3.07
Possible site: 27
>>> Seems to have no N-terminal signal sequence
ALOM program count: 2 value: −10.56 threshold: 0.0
INTEGRAL    Likelihood = −10.56  Transmembrane 609-625 (599-628)
INTEGRAL    Likelihood = −0.00   Transmembrane 19-35 (19 -35)
PERIPHERAL  Likelihood = 8.54    139
modified ALOM score: 2.61
*** Reasoning Step: 3
----- Final Results -----
   bacterial membrane --- Certainty = 0.5225 (Affirmative) <succ>
     bacterial outside --- Certainty = 0.0000 (Not Clear) <succ>
       bacterial cytoplasm --- Certainty = 0.0000 (Not Clear) <succ>
LPXTG motif: 596-600

---

The protein has homology with the following sequences in the databases:

```
>GP:CAB91647 GB:AJ130830 cell wall protein, putative [Zea mays]

Identities = 106/182 (58%), Positives = 123/182 (67%), Gaps = 8/182 (4%)
Query:  396  KEDKKPDVKPEAKPEAK--PDVKPEAKPDVKPEAKPDVKPEAKPDVKPEAKPDV--KPEA  451
             K + KP+ KPE KPE K  P   KPE KP+ KPE KP+ KPE KP   KPE KP+    KPE
Sbjct:  116  KPEPKPEPKPEPKPEPKIKPKPKPEPKPEPKPEHKPEPKPEPKPKPKPEPKPEPQPKPEP  175

Query:  452  KPDVKPKAKPDVKPEA--KPDVKPDVKPDVKPEA--KPEDKPDVKPDVKPEAKPDVKPEA  507
             KP+ KP+ KP+ KPE    KP+ KP+ KP+ KPE    KPE KP+ KP+ KPE KP+ KPE
Sbjct:  176  KPEPKPEPKPEPKPEPQPKPEPKPEPKPEPKPEPQPKPEPKPEPKPEPKPEPKPEPKPEP  235

Query:  508  KPEAKPEAKPEAKPEAKPEAKPDVKPEAKPDVKPEAKPEAKPEAKSEAKPEAKLEAKPEA  567
             KPE KPE +PE KPE KPE KP    P+ +P  KPE KPE KPE K E KPE K E KPE
Sbjct:  236  KPEPKPEPRPEPKPEPKPEPKPKPDPKPEPQPKPEPKPEPKPEPKPEPKPEPKPEPKPEP  295

Query:  568  KP                                                           569
             KP
Sbjct:  296  KP                                                           297
```

```
ORF00748(313-2190 of 2490)
GP|2462785|gb|AAB71985.1||U73163(3-374 of 374) M-like protein {Streptococcus equi}
% Match = 9.2
% Identity = 36.0 % Similarity = 55.4
Matches = 126 Mismatches = 147 Conservative Sub.s = 68

282       312       342       372       402       432       462       666
      LS**IRIFN*LYKGANMNNNEKKVKYFLRKTAYGLASMSAAFAVCSGIVHADTSSGISASIPHKKQVNLGAVT~~~~THA
         :|::|::||||:|:||||:|||:    |  :    |   |  ||:
                    MAKKEMKFYLRKSAFGLASVSAALLVGAARVSADS------------------------
                    10        20        30

696       726       756       786       813       843       870       900
      KVSDQELGKQSRRSQDIIKSLGFLSSDQKDILVKSISSSK-DSQLILKFVTQATQLNNAESTKAK-QMAQNDVALIKNIS
                    ::|  |  ::     |   |    :::|  :: |:        |         :  ||:    || |:|   :
      ----------------VESAGPVAVAVTDSLDSEAAATKAEADLVAAKADLAAAEVAITAAKAEFDTAQADLATAEATI
                      40        50        60        70        80        90

921       951       981      1011      1041      1071      1101      1131
      PEV---LEEYKEKIQRASTKSQVDEFVAEAKKVVNSNKETLVNQANGKKQEIAKLENLSNDEMLRYNTAIDNVVKQYNEG
         |:    : |  ::|||    |      |:|  :  ::: |          |       ::          :  |  :
      AELEQKIPELEKKIQEAQEKLNYENRPS-PKRVGSDDEDDTVARKLMSEKEALKAE------LQKTKEALDTAKRAYAGI
            110       120       130       140       150             160       170

1161      1191      1221      1251      1281      1311      1638      1668
      KLNITAAMNALNSIKQAAQEVAQKNLQKQYAKKIERISSKGLALSKKAKEIYEKHSILPTP~~~~AKPDVKPEAKPDVK
      :       |   |::   :|     |  :|:    |          :   ||
      EERKQVAATKLDAANKAFAGVEEKHAQAMAAFGAAFAAYKGA---------------------------------------
                190       200       210

1698                                  1740      1770      1800      1830
      PKAKPDVKPEAKPDVKPD------------------------VKPDVKPEAKPEDKPDVKPDVKPEAKPDVKPEAKPE
         ||  |    |                              ||:|:||||| |  :  ||  ||  ||: |||  |||
      ------VKAELKAAGASDFYTKKIDSADTVDGVKTLREMILDSIAKPEVEPEAKPEPKLEPKPEPKPEPKPEPKPEPKPE
            220       230       240       250       260       270       280

1860      1890      1920      1950      1980      2010      2040      2070
      AKPEAKPEAKPEAKPEAKPDVKPEAKPDVKPEAKPEAKPEAKSEAKPEAKLEAKPEAKPATKKSVNTSGNLAAKKAIENK
      ||| ||| ||| ||| ||: ||: :|     |  ||||| ||  |                                 |
      PKPEPKPEPKPEPKPEPKPKPQPKPAPAPKPEAKKEEKKAAP-------------------------------------K
            300       310       320       330

2100      2130      2160      2190      2220      2250      2280      2310
      KYSKKLPSTGEAASPLLAIVSLIVMLSAGLITIVLKHKKN*IYF*T*TERSILSKS*GKPHQNFAFFI*ILE*FSRYFN*
      : : ||||||||   :|::    :|  ||  ||:    :  |:|
      QDTNKLPSTGEATNPFFTAAALAVMAGAGVAAVSTRRKEN
            350       360       370
```

Figure 261:
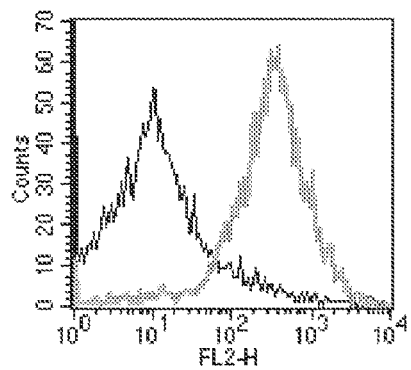

SEQ ID 6266 (GBS3) was expressed in E. coli as a His-fusion product. SDS-PAGE analysis of total cell extract is shown in FIG. 3 (lane 5; MW 65 kDa). The GBS3-His fusion product was purified (FIG. 189, lane 8) and used to immunise mice. The resulting antiserum was used for FACS (FIG. 261), which confirmed that the protein is immunoaccessible on GBS bacteria.

Based on this analysis, it was predicted that these proteins and their epitopes could be useful antigens for vaccines or diagnostics.

Example 2025

A DNA sequence (GBSx2136) was identified in S. agalactiae <SEQ ID 6267> which encodes the amino acid sequence <SEQ ID 6268>. This protein is predicted to be transcription antitermination protein nusg (nusG). Analysis of this protein sequence reveals the following:

Possible site: 48

\>\>\> Seems to have no N-terminal signal sequence

----- Final Results ----- bacterial cytoplasm --- Certainty = 0.3203 (Affirmative) <succ> bacterial membrane --- Certainty = 0.0000 (Not Clear) <succ> bacterial outside --- Certainty = 0.0000 (Not Clear) <succ>

The protein has homology with the following sequences in the GENPEPT database.

```
>GP:CAA53738 GB:X76134 nusG [Staphylococcus carnosus]
Identities = 90/175 (51%), Positives = 118/175 (67%), Gaps = 2/175 (1%)
Query: 7   KGWFVLQTYSGYENKVKENLLQRAQTYNMLDNILRVEIPTQTVNVEKNGKTKEIEENRFP    66
           K W+ + TYSGYENKVK+NL +R ++ NM + I RV IP +      K+GK K++ +  FP
Sbjct: 8   KRWYAVHTYSGYENKVKKNLEKRVESMNMTEQIFRVVIPEEEETQVKDGKAKKLTKKTFP    67
```

```
Query:  67   GYVLVEMVMTDEAWFVVRNTPNVTGFVGSHGNRSKPTPLLEEEIRSILISMGQTVDVFDT    126
             GYVLVE+VMTDE+W+VVRNTP VTGFVGS G SKP  PLL +E+R IL  MG        D
Sbjct:  68   GYVLVELVMTDESWYVVRNTPGVTGFVGSAGAGSKPNPLLPDEVRFILKQMGMKEKTIDV    127

Query: 127   NIKEGDVVQIIDGAFIGQEGRVVEIENNKVKL--MINMFGSETQAELELYQVAEL         179
              ++ G+ V+I  G F  Q G V EIE +K KL   +++MFG ET   E+E  Q+ +L
Sbjct: 128   EVEVGEQVRIKSGPFANQVGEVQEIEADKFKLTVLVDMFGRETPVEVEFDQIEKL         182
```

A related DNA sequence was identified in *S. pyogenes* <SEQ ID 6269> which encodes the amino acid sequence <SEQ ID 6270>. Analysis of this protein sequence reveals the following:

Possible site: 53
>>> Seems to have no N-terminal signal sequence
----- Final Results -----
    bacterial cytoplasm --- Certainty = 0.3874 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below.

```
Identities = 170/179 (94%), Positives = 178/179 (98%)
Query:   1   MLDSFDKGWFVLQTYSGYENKVKENLLQRAQTYNMLDNILRVEIPTQTVNVEKNGKTKEI    60
             MLDSFDKGWFVLQTYSGYENKVKENLLQRAQTYNMLDNILRVEIPTQTVNVEKNG+TKEI
Sbjct:   6   MLDSFDKGWFVLQTYSGYENKVKENLLQRAQTYNMLDNILRVEIPTQTVNVEKNGQTKEI    65

Query:  61   EENRFPGYVLVEMVMTDEAWFVVRNTPNVTGFVGSHGNRSKPTPLLEEEIRSILISMGQT    120
             EENRFPGYVLVEMVMTDEAWFVVRNTPNVTGFVGSHGNRSKPTPLLEEEIR+IL+SMGQT
Sbjct:  66   EENRFPGYVLVEMVMTDEAWFVVRNTPNVTGFVGSHGNRSKPTPLLEEEIRAILLSMGQT    125

Query: 121   VDVFDTNIKEGDVVQIIDGAFIGQEGRVVEIENNKVKLMINMFGSETQAELELYQVAEL     179
             +DVFDTNIKEGDVVQIIDGAF+GQEGRVVEIENNKVKLM+NMFGSET AE+ELYQ+AEL
Sbjct: 126   IDVFDTNIKEGDVVQIIDGAFMGQEGRVVEIENNKVKLMLNMFGSETVAEVELYQIAEL     184
```

Based on this analysis, it was predicted that these proteins and their epitopes could be useful antigens for vaccines or diagnostics.

Example 2026

A DNA sequence (GBSx2137) was identified in *S. agalactiae* <SEQ ID 6271> which encodes the amino acid sequence <SEQ ID 6272>. This protein is predicted to be a glycosyl transferase. Analysis of this protein sequence reveals the following:

Possible site: 16
>>> Seems to have no N-terminal signal sequence
----- Final Results -----
    bacterial cytoplasm --- Certainty = 0.1558 (Affirmative) <succ>
      bacterial membrane --- Certainty = 0.0000 (Not Clear) <succ>
        bacterial outside --- Certainty = 0.0000 (Not Clear) <succ>

The protein has homology with the following sequences in the GENPEPT database.

```
>GP:AAF28363 GB:AF224467 putative glycosyl transferase [Haemophilus ducreyi]
Identities = 98/259 (37%), Positives = 155/259 (59%), Gaps = 10/259 (3%)
Query:   5   VALAVDSNYLDKALVTIKSICVYNRNITFYLFNQDTPVEWVRNINRKLEPLGSKLINVKI    64
             + LA + +Y +  L TIKSI ++N++I FYL N+D P EW   +N KL  L S++I++K+
Sbjct:  10   IVLAANQSYSEYILTTIKSIYLHNKHIRFYLLNRDYPTEWFDILNNKLRKLNSEIIDIKV    69

Query:  65   YNYDIAHLTTFLTVS---TWFRLFLADYIPSSRVLYLDSDIIVNTNLDYLFELDFKGYYL    121
             N I + T+  +S    T+FR F++D+I    +V+YLD+DI+VN +L  L++ D   Y+L
Sbjct:  70   TNDTIKNFKTYSHISSDTTFFRYFISDFIEQDKVIYLDADIVVNGSLTELYQTDISNYFL    129

Query: 122   AAVKDPHKNE----EGGENAGMLLANLELWREDGLTKTLLKTAEELHRVVKTGDQSILNI    177
             AAVKD    +        FNAGMLL N + WRE  +T+ L  +E+    +  DQSILN+
Sbjct: 130   AAVKDIISEKIYVNNHIFNAGMLLINNKKWREHNITQFCLSLSEKYINSLPDADQSILNL    189

Query: 178   VCHNRWLSLNKTWNF--QTYDVVSRYNHRSYLYLNIENRTPNIIHFLTSDKPWNENSVAR    235
             +  ++WL LN+ +N+    T + +Y    YL  ++    P IIH+ T  KPW        R
Sbjct: 190   IFKDKWLKLNRGYNYLIGTDYLFFKYGKTRYLE-DLGETIPLIIHYNTEAKPWLNIENTR    248

Query: 236   FRELWWYYFQLDFCQLTGK                                           254
             FR ++W+Y++L++   + K
Sbjct: 249   FRNIYWFYYELNWQDIYAK                                           267
```

No corresponding DNA sequence was identified in *S. pyogenes*.

Based on this analysis, it was predicted that this protein and its epitopes, could be useful antigens for vaccines or diagnostics.

Example 2027

A DNA sequence (GBSx2138) was identified in *S. agalactiae* <SEQ ID 6273> which encodes the amino acid sequence <SEQ ID 6274>. Analysis of this protein sequence reveals the following:

---

Possible site: 20
>>> Seems to have no N-terminal signal sequence
----- Final Results -----
   bacterial cytoplasm --- Certainty = 0.0417 (Affirmative) <succ>
    bacterial membrane --- Certainty = 0.0000 (Not Clear) <succ>
     bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2028

A DNA sequence (GBSx2139) was identified in *S. agalactiae* <SEQ ID 6275> which encodes the amino acid sequence <SEQ ID 6276>. Analysis of this protein sequence reveals the following:

---

Possible site: 57
>>> Seems to have no N-terminal signal sequence
INTEGRAL    Likelihood = –2.60    Transmembrane 306-322 (306-322)
----- Final Results -----
  bacterial membrane --- Certainty = 0.2041 (Affirmative) <succ>
    bacterial outside --- Certainty = 0.0000 (Not Clear) <succ>
    bacterial cytoplasm --- Certainty = 0.0000 (Not Clear) <succ>

---

The protein has homology with the following sequences in the GENPEPT database.

No corresponding DNA sequence was identified in *S. pyogenes*.

SEQ ID 6276 (GBS395) was expressed in *E. coli* as a His-fusion product. SDS-PAGE analysis of total cell extract is shown in FIG. 75 (lane 5; MW 47.4 kDa). It was also expressed in *E. coli* as a GST-fusion product. SDS-PAGE analysis of total cell extract is shown in FIG. 83 (lane 8; MW 72 kDa) and in FIG. 177 (lane 5; MW 72 kDa).

GBS395-GST was purified as shown in FIG. 217, lane 7.

Based on this analysis, it was predicted that this protein and its epitopes, could be useful antigens for vaccines or diagnostics.

Example 2029

A DNA sequence (GBSx2140) was identified in *S. agalactiae* <SEQ ID 6277> which encodes the amino acid sequence <SEQ ID 6278>. Analysis of this protein sequence reveals the following:

---

Possible site: 48
>>> Seems to have no N-terminal signal sequence
----- Final Results -----
   bacterial cytoplasm --- Certainty = 0.1633 (Affirmative) <succ>
    bacterial membrane --- Certainty = 0.0000 (Not Clear) <succ>
     bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2030

A DNA sequence (GBSx2141) was identified in *S. agalactiae* <SEQ ID 6279> which encodes the amino acid sequence <SEQ ID 6280>. Analysis of this protein sequence reveals the following:

```
>GP:AAF28363  GB:AF224467 putative glycosyl transferase [Haemophilus ducreyi]
Identities = 88/259 (33%), Positives = 156/259 (59%), Gaps = 11/259 (4%)
Query:    7  VVLAGDYSYIRQIETTLKSLCVYHENLSIFIFNQDIPQEWFLAMKDRVGQTGNQIQDVKL      66
             +VLA + SY   I TT+KS+ ++++++  ++ N+D P EWF  + +++ +   ++I D+K+
Sbjct:   10  IVLAANQSYSEYILITIKSIYLHNKHIRFYLLNRDYPTEWFDILNNKLRKLNSEIIDIKV     69

Query:   67  FHDHLSPKWENKKLNHINY-MTYARYFIPQYISADTVLYLDSDLVVTTNLDNLFQISLDN     125
             +D +         K +HI+    T+ RYFI  +I   D V+YLD+D+VV   +L   L+Q    + N
Sbjct:   70  TNDTIK---NFKTYSHISSDTIFFRYFISDFIEQDKVIYLDADIVVNGSLTELYQTDISN     126

Query:  126  AYLAAVP-----ALFGLGYGFNAGVMVINNQRWRQENMTIKLIEKNQKEIENANEGDQTI     180
             +LAAV      ++   + FNAG+++INN++WR+ N+T    +  ++K I +   + DQ+I
Sbjct:  127  YFLAAVKDIISEKIYVNNHIFNAGMLLINNKKWREHNITQFCLSLSEKYINSLPDADQSI     186

Query:  181  LNRMFENQVIYLDDTYNFQIGFD-MGAAIDGHKFIFDIPITPLPKIIHYISGIKPWQTLS     239
             LN +F+++ + L+  YN+ IG D +        +++ D+    T +P IIHY  + KPW   +
Sbjct:  187  LNLIFKDKWLKLNRGYNYLIGTDYLFFKYGKTRYLEDLGET-IPLIIHYNTEAKPWLNIF     245

Query:  240  NMRLREVWWHYNLLEWSSI                                              258
             N R R ++W Y  L W  I
Sbjct:  246  NTRFRNIYWFYYELNWQDI                                              264
```

Possible site: 44
>>> Seems to have no N-terminal signal sequence
INTEGRAL    Likelihood = −0.16    Transmembrane 36-52 (36-52)
----- Final Results -----
    bacterial membrane --- Certainty = 0.1065 (Affirmative) <succ>
        bacterial outside --- Certainty = 0.0000 (Not Clear) <succ>
            bacterial cytoplasm --- Certainty = 0.0000 (Not Clear) <succ>

A related GBS nucleic acid sequence <SEQ ID 10243> which encodes amino acid sequence <SEQ ID 10244> was also identified.

The protein has homology with the following sequences in the GENPEPT database.

```
>GP:AAC77330 GB:AE000508 orf, hypothetical protein [Escherichia coli K12]
Identities = 75/260 (28%), Positives = 123/260 (46%), Gaps = 22/260 (8%)
Query:   6  VGLVLEGGGMRGLYTAGVLDAFLDAGIK-IDGIVSVSAGALFGVNFVSRQRERALRYNKK    64
            + LV EGGG RG++TAGVLD F+ A    D  + SAGA   F+ Q   A +   +
Sbjct:  25  IALVCEGGGQRGIFTAGVLDEFMRAQFNPFDLYLGTSAGAQNLSAFICNQPGYARKVIMR   84

Query:  65  YLSHPKYMSLRSWFRTGNFVNKDF----TYYEVPMKLD----VFDDEAFKKSSIDFYVVA   116
            Y +  ++    + R GN ++ D+      T  ++P+++D    +FD     S   FY+ A
Sbjct:  85  YTTKREFFDPLRFVRGGNLIDLDWLVEATASQMPLQMDTAARLFD------SGKSFYMCA   138

Query: 117  TEMTSGKPEYFKIDSVFEQMEILRASSALPVVSKM-VDWQGKKYLDGGLSDSIPVDFARG   175
                 P YF + +    ++++RASSA+P  +  V  +G  YLDGG+SD+IPV  A
Sbjct: 139  CRQDDYAPNYF-LPTKQNWLDVIRASSAIPGFYRSGVSLEGINYLDGGISDAIPVKEAAR   197

Query: 176  LGFDKLIVVMTRPLNYQKKPSSGR-----LYKTLYRKYPNFVKTASNRYQQYNNSLEKVM   230
             G   L+V+ T P      P    +     L  +  + N V+   Y+       +EK
Sbjct: 198  QGAKTLVVIRTVPSQMYYTPQWFKRMERWLGDSSLQPLVNLVQHHETSYRDIQQFIEKPP   257

Query: 231  SLEKTGDLFAIRPSKSLVIG                                          250
             +  +++  +P  S+ +G
Sbjct: 258  GKLRIFEIYPPKPLHSIALG                                          277
```

No corresponding DNA sequence was identified in *S. pyogenes*.

Based on this analysis, it was predicted that this protein and its epitopes, could be useful antigens for vaccines or diagnostics.

A related GBS gene <SEQ ID 8959> and protein <SEQ ID 8960> were also identified. Analysis of this protein sequence reveals the following:

Lipop: Possible site: −1    Crend: 10
McG: Discrim Score: −5.16
GvH: Signal Score (−7.5): −2.17
Possible site: 44
>>> Seems to have no N-terminal signal sequence
ALOM program    count: 1 value: −0.16    threshold: 0.0
INTEGRAL    Likelihood = −0.16    Transmembrane 36-52 (36-52)
PERIPHERAL    Likelihood = 4.14    18
modified ALOM score: 0.53
*** Reasoning Step: 3
----- Final Results -----
    bacterial membrane --- Certainty = 0.1065 (Affirmative) <succ>

-continued bacterial outside --- Certainty = 0.0000 (Not Clear) <succ>
            bacterial cytoplasm --- Certainty = 0.0000 (Not Clear) <succ>

The protein has homology with the following sequences in the databases:

```
ORF01611(316-1050 of 1449)
ONNI|NT01EC5264(37-289 of 369) hypothetical protein
% Match = 9.2
% Identity = 29.7 % Similarity = 49.8
Matches = 74 Mismatches = 118 Conservative Sub.s = 50

273       303       333       363       393       420       450       480
QKKQLYFAIL*SNINIRK*LPMLSVGLVLEGGGMRGLYTAGVLDAFLDAGIK-IDGIVSVSAGALFGVNFVSRQRERALR
                       : || |||| ||::|||||| |:  |    |   : |||    |:  |   | :
VGQRIPVTLGNIAPLSLRPFQPGRIALVCEGGGQRGIFTAGVLDEFMRAQFNPFDLYLGTSAGAQNLSAFICNQPGYARK
                        30        40        50        60        70        80        90

510       540                 588       618       648       678       708
YNKKYLSHPKYMSLRSWFRTGNFVNKDF----TYYEVPMKLDVFDDEAFKKSSIDFYVVATEMTSGKPEYFKIDSVFEQM
:|  :  ::     :  | ||:::   |:        |  :::|:::|      :    ||:  |      | ||  ::    :
VIMRYTTKREFFDPLRFVRGGNLIDLDWLVEATASQMPLQMDT--AARLFDSGKSFYMCACRQDDYAPNYF-LPTKQNWL
                       110       120       130       140       150       160

738       765       795       825       855       885       912       930
EILRASSALPVVSKM-VDWQGKKYLDGGLSDSIPVDFARGLGFDKLIVVMTRPLNYQKKPSS-GRKYKTL----YRKYPN
:::||||:|   :    |    :|  |||||:|:|||    |    |:|:  | |       |   :  :       |
DVIRASSAIPGFYRSGVSLEGINYLDGGISDAIPVKEAARQGAKTLVVIRTVPSQMYYTPQWFKRMERWLGDSSLQPLVN
        180       190       200       210       220       230       240
```

-continued

```
      960       990      1020      1050      1080      1110      1140      1170
FVKTASNRYQQYNNSLEKVMSLEKTGDKFAIRPSKSLVIGRLEKNPDKLDSIYQLGMKDAKSVMPELNSYLMK*RKQYFS
 :|:       |:       :||        :    :::    :|    |:  :|
LVQHHETSYRDIQQFIEKPPGKLRIFEIYPPKPLHSIALGSRIPALREDYKLGRLCGRYFLATVGKLLTEKAPLTRHLVP
          260       270       280       290       300       310       320
```

SEQ ID 8960 (GBS394) was expressed in *E. coli* as a His-fusion product. SDS-PAGE analysis of total cell extract is shown in FIG. 75 (lane 4; MW 34.7 kDa). It was also expressed in *E. coli* as a GST-fusion product. SDS-PAGE analysis of total cell extract is shown in FIG. 83 (lane 7; MW 60 kDa).

GBS394-GST was purified as shown in FIG. 217, lane 6.

Example 2031

A DNA sequence (GBSx2142) was identified in *S. agalactiae* <SEQ ID 6281> which encodes the amino acid sequence <SEQ ID 6282>. Analysis of this protein sequence reveals the following:

Possible site: 21
>>> Seems to have no N-terminal signal sequence
----- Final Results -----
  bacterial cytoplasm --- Certainty = 0.3004 (Affirmative) <succ>
  bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2032

A DNA sequence (GBSx2143) was identified in *S. agalactiae* <SEQ ID 6283> which encodes the amino acid sequence <SEQ ID 6284>. This protein is predicted to be transporter protein. Analysis of this protein sequence reveals the following:

Possible site: 49
>>> Seems to have a cleavable N-term signal seq.
INTEGRAL   Likelihood = −6.85   Transmembrane 373-389 (370-395)
INTEGRAL   Likelihood = −6.74   Transmembrane 168-184 (162-187)
INTEGRAL   Likelihood = −6.32   Transmembrane 259-275 (257-280)
INTEGRAL   Likelihood = −4.78   Transmembrane 286-302 (285-306)
INTEGRAL   Likelihood = −3.19   Transmembrane 55-71 (54-71)
INTEGRAL   Likelihood = −2.97   Transmembrane 84-100 (79-101)
INTEGRAL   Likelihood = −2.87   Transmembrane 311-327 (310-328)
INTEGRAL   Likelihood = −1.44   Transmembrane 355-371 (355-371)
INTEGRAL   Likelihood = −0.64   Transmembrane 108-124 (108-125)
----- Final Results -----
  bacterial membrane --- Certainty = 0.3739 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:AAC22759 GB:U32790 transporter protein [Haemophilus influenzae Rd]
Identities = 139/391 (35%), Positives = 221/391 (55%), Gaps = 4/391 (1%)

Query:    6   INKNNWRALIAAIVASGTDDLNIMFLAFSMSTIITDLHLSAAQAGWIGTITNLGMLVGGL      65
                   +N    W+ALI + V   G D   +++ L F +S I   DL+L+ AQ G + T T +G + GG+
      Sbjct:    5   VNSYGWKALIGSAVGYGMDGFDLLILGFMLSAISADLNLTPAQGGSLVTWTLIGAVFGGI      64

Query:   66   IFGLLADRYNKFKVFKWTILIFSIATGLVFFTTNLSYLYIMRFIAGIGVGGEYGIAIAIM     125
                   +FG L+D+Y + +V   WTIL+F++ TGL         L I R IAGIG+GGE+GI +A+
      Sbjct:   65   LFGALSDKYGRVRVLTWTILLFAVFTGLCAIAQGYWDLLIYRTIAGIGLGGEFGIGMALA     124

Query:  126   AGIVPTNKMGRISSLNGIAGQVGSISSALLAGWLAPALGWRGLFLFGLLPIVLVLWMQFA     185
                   A      P     + +S   +  QVG + +ALL   L P +GWRG+FL G+ P  +  +++
      Sbjct:  125   AEAWPARHRAKAASYVALGWQVGVLGAALLTPLLLPHIGWRGMFLVGIFPAFVAWFLRSH     184

Query:  186   VDDKDILDQYNTDADDEPLDI----SIKALFDTPVLATQSLALMVMTTVQIAGYFGMMNW     241
                   + + +I  Q T    +    S + L     +  SL ++V+T+VQ   GY+G+M W
      Sbjct:  185   LHEPEIFTQKQTALSTQSSFTDKLRSFQLLIKDKATSKISLGIVVLTSVQNFGYYGIMIW     244

Query:  242   LPTIIQTNLNVSVKNSSLWMIATILGMCLGMLVFGQLLDKFGPRLVYGCFLLSSAICVYL     301
                   LP +    L  S+   S LW   T+ GM  G+ +FGQL D+ G  +     F L + +
      Sbjct:  245   LPNFLSKQLGFSLTKSGLWTAVTVCGMMAGIWIFGQLADRIGRKPSFLLFQLGAVISIVV     304

Query:  302   FQFATTMPSMIIGGAVVGFFVNGMFAGYGAMITRLYPHHIRSTANNLILNVGRAIGGFSS     361
                   +   T    M++ GA +G FVNGM   GYGA++     YP    R+TA N++ N+GRA+GGF
      Sbjct:  305   YSQLTDPDIMLLAGAFLGMFVNGMLGGYGALMAEAYPTEARATAQNVLFNIGRAVGGFGP     364

Query:  362   VIIGMILDVSNVSMVMLFLASLYIVSFLSML                                  392
                   V++G ++     +    LA +Y++  L+ +
      Sbjct:  365   VVVGSVVLAYSFQTAIALLAIIYVIDMLATI                                  395
```

A related DNA sequence was identified in *S. pyogenes* <SEQ ID 2377> which encodes the amino acid sequence <SEQ ID 2378>. Analysis of this protein sequence reveals the following:

```
Possible site: 39
>>> Seems to have a cleavable N-term signal seq.
INTEGRAL    Likelihood = -8.92   Transmembrane 168-184 (162-188)
INTEGRAL    Likelihood = -5.41   Transmembrane 286-302 (285-306)
INTEGRAL    Likelihood = -5.15   Transmembrane 372-388 (362-394)
INTEGRAL    Likelihood = -3.45   Transmembrane 259-275 (257-276)
INTEGRAL    Likelihood = -2.87   Transmembrane 311-327 (306-328)
INTEGRAL    Likelihood = -2.81   Transmembrane 55-71 (51-71)
INTEGRAL    Likelihood = -0.48   Transmembrane 108-124 (108-125)
INTEGRAL    Likelihood = -0.37   Transmembrane 84-100 (84-100)
----- Final Results -----
   bacterial membrane --- Certainty = 0.4567 (Affirmative) <succ>
      bacterial outside --- Certainty = 0.0000 (Not Clear) <succ>
         bacterial cytoplasm --- Certainty = 0.0000 (Not Clear) <succ>
```

An alignment of the GAS and GBS proteins is shown below.

```
Identities = 306/402 (76%), Positives = 354/402 (87%)
Query:    1   MSPLNINKNNWRALIAAIVASGTDDLNIMFLAFSMSTIITDLHLSAAQAGWIGTITNLGN    60
              MS L+++  N RAL+AAI ASGTDDLN+MFLAFSMS+I+TDL LS  Q GWI TITNLGM
Sbjct:    1   MSTLSLDTTNKRALVAAIAASGTDDLNVMFLAFSMSSIMTDLGLSGTQGGWIATITNLGM    60

Query:   61   LVGGLIFGLLADRYNKFKVFKWTILIFSIATGLVFFTTNLSYLYIMRFIAGIGVGGSYGI   120
              LVGGL+FGLLADR++KFKVFKWTIL+FS+ATGL++FT  +L YLY+MRFIAGIGVGGEYG+
Sbjct:   61   LVGGLLFGLLADRHHKFKVFKWTILLFSVATGLIYFTQSLPYLYLMRFIAGIGVGGEYGV   120

Query:  121   AIAIMAGIVPTNKMGRISSLNGIAGQVGSISSALLAGWLAPALGWRGLFLFGLLPIVLVL   180
              AIAIMAGIVP  KMGR+SSLNGIAGQ+GSISSALLAGWLAP+LGWRGLFLFGLLPI+LV+
Sbjct:  121   AIAIMAGIVPPEKMGRMSSLNGIAGQLGSISSALLAGWLAPSLGWRGLFLFGLLPILLVI   180

Query:  181   WMQFAVDDKDILDQYNTDADDEPLDISIKALFDTPVLATQSLALMVMTTVQIAGYFGMMN   240
              WM  A+DD+ I D Y + ++    I I  LF T  L  Q+LALMVMTTVQIAGYFGMMN
Sbjct:  181   WMTLAIDDQKIWDHYGQEEEECSQPIKINELFKTKSLTAQTLALMVMTTVQIAGYFGMMN   240

Query:  241   WLPTIIQTNLNVSVKNSSLWMIATILGMCLGMLVFGQLLDKFGPRLVYGCFLLSSAICVY   300
              WLPTIIQT+LN+SVK+SSLWM+ATI+GMCLGML FGQLLD FGPRL+Y  FLL+S+ICVY
Sbjct:  241   WLPTIIQTSLNLSVKSSSLWMVATIVGMCLGMLYFGQLLDCFGPRLIYSLFLLASSICVY   300

Query:  301   LFQFATTMPSMIIGGAVVGFFVNGMFAGYGAMITRLYPHHIRSTANNLILNVGRAIGGFS   360
              LFQFA +M SM+IGGA+VGFFVNGMFAGYGAMITRLYPHHIRSTANN+ILNVGRA+GGFS
Sbjct:  301   LFQFANSMASMVIGGAIVGFFVNGMFAGYGAMITRLYPHHIRSTANNVILNVGRALGGFS   360

Query:  361   SVIIGMILDVSNVSMVMLFLASLYIVSFLSMLSIKQLKRQKY   402
              SV IG ILD S +SMVM+FLASLY++SF +M SI QLK ++Y
Sbjct:  361   SVAIGSILDASGISMVMIFLASLYVISFGAMWSIGQLKAERY   402
```

Based on this analysis, it was predicted that these proteins and their epitopes could be useful antigens for vaccines or diagnostics.

Example 2033

A DNA sequence (GBSx2144) was identified in *S. agalactiae* <SEQ ID 6285> which encodes the amino acid sequence <SEQ ID 6286>. This protein is predicted to be leucyl-tRNA synthetase (leuS). Analysis of this protein sequence reveals the following:

```
Possible site: 52
>>> Seems to have no N-terminal signal sequence
----- Final Results -----
   bacterial cytoplasm --- Certainty = 0.3481 (Affirmative) <succ>
      bacterial membrane --- Certainty = 0.0000 (Not Clear) <succ>
         bacterial outside --- Certainty = 0.0000 (Not Clear) <succ>
```

A related GBS nucleic acid sequence <SEQ ID 10241> which encodes amino acid sequence <SEQ ID 10242> was also identified.

The protein has homology with the following sequences in the GENPEPT database.

```
>GP:AAC00259 GB:AF008220 leucine tRNA synthetase [Bacillus subtilis]
Identities = 569/835 (68%), Positives = 666/835 (79%), Gaps = 42/835 (5%)
Query:   10  YNHKEIEPKWQAFWADNHTFKTGTDASKPKFYALDMFPYPSGAGLHVGHPEGYTATDILS    69
             + HKEIE KWQ +W +N TF T  +  K KFYALDMFPYPSGAGLHVGHPEGYTATDILS
Sbjct:    3  FQHKEIEKKWQTYWLENKTFATLDNNEKQKFYALDMFPYPSGAGLHVGHPEGYTATDILS    62

Query:   70  RFKRAQGHNVLHPMGWDAFGLPAEQYAMDTGNDPAEFTAENIANFKRQINALGFSYDWDR   129
             R KR QG++VLHPMGWDAFGLPAEQYA+DTGNDPA FT +NI NF+RQI ALGFSYDWDR
Sbjct:   63  RMKRMQGYDVLHPMGWDAFGLPAEQYALDTGNDPAVFTKQNIDNFRRQIQALGFSYDWDR   122

Query:  130  EVNTTDPNYYKWTQWIFTKLYEKGLAYEAEVPVNWVEELGTAIANEEVLPDGTSERGGYP   189
             E+NTTDP YYKWTQWIF KLYEKGLAY  EVPVNW   LGT +ANEEV+ DG SERGG+P
Sbjct:  123  EINTTDPEYYKWTQWIFLKLYEKGLAYVDEVPVNWCPALGTVLANEEVI-DGKSERGGHP   181

Query:  190  VVRKPMRQWMLKITAYAERLLEDLEEVDWPESIKDMQRNWIGKSTGANVTFKVKDTDKDF   249
             V R+PM+QWMLKITAYA+RLLEDLEE+DWPESIKDMQRNWIG+S GA+V F +   D  F
Sbjct:  182  VERRPMKQWMLKITAYADRLLEDLEELDWPESIKDMQRNWIGRSEGAHVHFAIDGHDDSF   241

Query:  250  TVFTTRPDTLFGATYAVLAPEHALVDAITTADQAEAVAEYKRQASLKSDLARTDLAKEKT   309
             TVFTTRPDTLFGATY VLAPEHALV+ ITTA+Q EAV  Y ++  KSDL RTDLAK KT
Sbjct:  242  TVFTTRPDTLFGATYTVLAPEHALVENITTAEQKEAVEAYIKEIQSKSDLERTDLAKTKT   301

Query:  310  GVWTGAYAINPVNGKEIPVWIADYVLASYGTGAIMAVPAHDERDWEFAKQFNLDIIPVLE   369
             GV+TGAYAINPVNG+++P+WIADYVLASYGTGA+MAVP HDERD+EFAK F L +  V++
Sbjct:  302  GVFTGAYAINPVNGEKLPIWIADYVLASYGTGAVMAVPGHDERDFEFAKTFGLPVKEVVK   361

Query:  370  GGNVEEAAFTEDGLHINSDFLDGLDKAAAIAENVEWLEAEGVGNEKVTYRLRDWLFSRQR   429
             GGNVEEAA+T DG H+NSDPL+GL K  AI K++ WLE    G +KVTYRLRDWLRSRQR
Sbjct:  362  GGNVEEAAYTGDGEHVMSDFLNGLHKQEAIEKVIAWLEETKNGEKKVTYRLRDWLFSRQR   421

Query:  430  YWGEPIPIIHWEDGTSTAVPESELPLVLPVTKDIRPSGTGESPLANLTDWLEVT-REDGV   488
             YWGEPIP+IHWEDGTSTAVPE ELPL+LP T +I+PSGTGESPLAN+ +W+EVT  E G
Sbjct:  422  YWGEPIPVIHWEDGTSTAVPEEELPLILPKTDEIKPSGTGESPLANIKEWVEVTDPETGK   481

Query:  489  KGRRETNTMPQWAGSSWYYLRYIDPHNTEKLADEELLKQWLPVDIYVGGAEHAVLHLLYA   548
             KGRRETNTMPQWAGS WY+LRYIDPHN ++LA E L++WLPVD+Y+GGAEHAVLHLLYA
Sbjct:  482  KGRRETNTMPQWAGSCWYFLRYIDPHNPDQLASPEKLEKWLPVDMYIGGAEHAVLHLLYA   541

Query:  549  RFWHKVLYDLGVVPTKEPFQKLFNQGMILGTSYRDSRGALVATDKVEKRDGSFFHVETGE   608
             RFWHK LYD+GVVPTKEPFQKL NQGMILG                         E  E
Sbjct:  542  RFWHKFLYDIGVVPTKEPFQKLYNQGMILG------------------------ENNE    575

Query:  609  ELEQAPAKMSKSLKNVVNPDDVVEQYGADTLRVYEMFMGPLDASIAWSEEGLEGSRKFLD   668
                     KMSKS  NVVNPD++V +GADTLR YEMFMGPLDASIAWSE GL+G+R+FLD
Sbjct:  576  -------KMSKSKGNVVNPDEIVASHGADTLRLYEMFMGPLDASIAWSESGLDGARRFLD   628

Query:  669  RVYRLI------TTKEITEENSGALDKVYNETVKAVTEQVDQMKFNTAIAQLMVFVNAAN   722
             RV+RL       +I E    L++VY+ETV  VT+ +  ++FNT I+QLMVF+N A
Sbjct:  629  RVWRLFIEDSGELNGKIVEGAGETLERVYHETVMKVTDHYEGLRFNTGISQLMVFINEAY   688

Query:  723  KEDKLFSDYAKGFVQLIAPFAPHLGEELWQVLTASGQSISYVPWPSYDESKLVENEIEIV   782
             K  +L  +Y +GFV+L++P APHL EELW+ L  SG +I+Y WP YDE+KLV++E+EIV
Sbjct:  689  KATELPKEYMEGFVKLLSPVAPHLAEELWEKLGHSG-TIAYEAWPVYDETKLVDDEVEIV   747

Query:  783  VQIKGKVKAKLVVAKDLSREELQDLALANEKVQAEIAGKDIIKVIAVPNKLVNIV         837
             VQ+ GKVKAKL V  D ++E+L+  LA A+EKV ++  GK I K+IAVP KLVNIV
Sbjct:  748  VQLNGKVKAKLQVPADATKEQLEQLAQADEKVKEQLEGKTIRKIIAVPGKLVNIV         802
```

A related DNA sequence was identified in *S. pyogenes* <SEQ ID 6287> which encodes the amino acid sequence <SEQ ID 6288>. Analysis of this protein sequence reveals the following:

Possible site: 46
>>> Seems to have no N-terminal signal sequence

----- Final Results -----
bacterial cytoplasm --- Certainty = 0.4358 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 815/833 (97%), Positives = 827/833 (98%)
Query:    7  MTFYNHKEIEPKWQAFWADNHTFKTGTDASKPKFYALDMFPYPSGAGLHVGHPEGYTATD    66
             MTFY+H  IEPKWQAFWADNHTFKTGTDASKPKFYALDMFPYPSGAGLHVGHPEGYTATD
Sbjct:    1  MTFYDHTAIEPKWQAFWADNHTFKTGTDASKPKFYALDMFPYPSGAGLHVGHPEGYTATD    60

Query:   67  ILSRFKRAQGHNVLHPMGWDAFGLPAEQYAMDTGNDPAEFTAENIANFKRQINALGFSYD   126
             ILSRFKRAQGHN+LHPMGWDAFGLPAEQYAMDTGNDPAEFTAENIANFKRQINALGESYD
Sbjct:   61  ILSRFKRAQGHNILHPMGWDAFGLPAEQYAMDTGNDPAEFTAENIANFKRQINALGESYD   120
```

```
Query:  127  WDREVNTTDPNYYKWTQWIFTKLYEKGLAYEAEVPVNWVEELGTAIANEEVLPDGTSERG     186
             WDREVNTTDPNYYKWTQWIFTKLYEKGLAYEAEVPVNWVEELGTAIANEEVLPDGTSERG
Sbjct:  121  WDREVNTTDPNYYKWTQWIFTKLYEKGLAYEAEVPVNWVEELGTAIANEEVLPDGTSERG     180

Query:  187  GYPVVRKPMRQWMLKITAYAERLLEDLEEVDWPESIKDMQRNWIGKSTGANVTFKVKDTD     246
             GYPVVRKPMRQWMLKITAYAERLLEDLEEVDWPESIKDMQRNWIGKSTGANVTFKVKDTD
Sbjct:  181  GYPVVRKPMRQWMLKITAYAERLLEDLEEVDWPESIKDMQRNWIGKSTGANVTFKVKDTD     240

Query:  247  KDFTVETTRPDTLFGATYAVLAPEHALVDAITTADQAEAVAEYKRQASLKSDLARTDLAK     306
             KDFTV TTRPDTLFGATYAVLAPEHALVDAITTADQAEAVA+YKRQASLKSDLARTDLAK
Sbjct:  241  KDFTVFTTRPDTLFGATYAVLAPEHALVDAITTADQAEAVAKYKRQASLKSDLARTDLAK     300

Query:  307  EKTGVWTGAYAINPVNGKEIPVWIADYVLASYGTGAIMAVPAHDERDWEFAKQFNLDIIP     366
             EKTGVWTGAYAINPVNG E+PVWIADYVLASYGTGAIMAVPAHDERDWEFAKQF LDIIP
Sbjct:  301  EKTGVWTGAYAINPVNGNEMPVWIADYVLASYGTGAIMAVPAHDERDWEFAKQFKLDIIP     360

Query:  367  VLEGGNVEEAAFTEDGLHINSDFLDGLDKAAAIAKMVEWLEAEGVGNEKVTYRLRDWLFS     426
             VLEGGNVEEAAFTEDGLHINS FLDGLDKA+AIAKMVEWLEAEGVGNEKVTYRLRDWLFS
Sbjct:  361  VLEGGNVEEAAFTEDGLHINSGFLDGLDKASAIAKMVEWLEAEGVGNEKVTYRLRDWLFS     420

Query:  427  RQRYWGEPIPIIHWEDGTSTAVPESELPLVLPVTKDIRPSGTGESPLANLTDWLEVTRED     486
             RQRYWGEPIPIIHWEDGTSTAVPESELPLVLPVTKDIRPSGTGESPLAN+TDWLEVTRED
Sbjct:  421  RQRYWGEPIPIIHWEDGTSTAVPESELPLVLPVTKDIRPSGTGESPLANVTDWLEVTRED     480

Query:  487  GVKGRRETNTMPQWAGSSWYYLRYIDPHNTEKLADEELLKQWLPVDIYVGGAEHAVLHLL     546
             GVKGRRETNTMPQWAGSSWYYLRYIDPHNTEKLADEELLKQWLPVDIYVGGAEHAVLHLL
Sbjct:  481  GVKGRRETNTMPQWAGSSWYYLRYIDPHNTEKLADEELLKQWLPVDIYVGGAEHAVLHLL     540

Query:  547  YAREWHKVLYDLGVVPTKEPFQKLENQGMILGTSYRDSRGALVATDKVEKRDGSFEHVET     606
             YAR WHKVLYDLGVVPTKEPFQKL NQGMILGTSYRDSRGALVATDKVEKRDGS FHVET
Sbjct:  541  YARFWHKVLYDLGVVPTKEPFQKLFNQGMILGTSYRDSRGALVATDKVEKRDGSFFHVET     600

Query:  607  GEELEQAPAKMSKSLKNVVNPDDVVEQYGADTLRVYEMFMGPLDASIAWSEEGLEGSRKF     666
             GEELEQAPAKMSKSLKNVVNPDDVVEQYGADTLRVYEMFMGPLDASIAWSEEGLEGSRKF
Sbjct:  601  GEELEQAPAKMSKSLKNVVNPDDVVEQYGADTLRVYEMFMGPLDASIAWSEEGLEGSRKF     660

Query:  667  LDRVYRLITTKEITEENSGALDKVYNETVKAVTEQVDQMKENTAIAQLMVEVNAANKEDK     726
             LDRVYRLITTKEITEENSGALDKVYNETVKAVTEQVDQMK NTAIAQLMVEVNAANKEDK
Sbjct:  661  LDRVYRLITTKEITEENSGALDKVYNETVKAVTEQVDQMKFNTAIAQLMVEVNAANKEDK     720

Query:  727  LFSDYAKGFVQLIAPFAPHLGEELWQVLTASGQSISYVPWPSYDESKLVENEIEIVVQIK     786
             LFSDYAKGFVQLIAPFAPHLGEELWQ LTASG+SISYVPWPSYDESKLVEN++EIVVQIK
Sbjct:  721  LFSDYAKGFVQLIAPFAPHLGEELWQALTASGESISYVPWPSYDESKLVENDVEIVVQIK     780

Query:  787  GKVKAKLVVAKDLSREELQDLALANEKVQAEIAGKDIIKVIAVPNKLVNIVVK          839
             GKVKAKLVVAKDLSREELQ++ALANEKVQAEIAGKDIIKVIAVPNKLVNIV+K
Sbjct:  781  GKVKAKLVVAKDLSREELQEVALANEKVQAEIAGKDIIKVIAVPNKLVNIVIK          833
```

Based on this analysis, it was predicted that these proteins and their epitopes could be useful antigens for vaccines or diagnostics.

Example 2034

A DNA sequence (GBSx2145) was identified in *S. agalactiae* <SEQ ID 6289> which encodes the amino acid sequence <SEQ ID 6290>. This protein is predicted to be KIAA1074 protein. Analysis of this protein sequence reveals the following:

Possible site: 35
>>> Seems to have an uncleavable N-term signal seq
----- Final Results -----
   bacterial membrane --- Certainty = 0.0000 (Not Clear) <succ>
     bacterial outside --- Certainty = 0.0000 (Not Clear) <succ>
        bacterial cytoplasm --- Certainty = 0.0000 (Not Clear) <succ>

A related GBS nucleic acid sequence <SEQ ID 8961> which encodes amino acid sequence <SEQ ID 8962> was also identified. Analysis of this protein sequence reveals the following:

Lipop: Possible site: –1    Crend: 7
SRCFLG: 0
McG: Length of UR: 19
Peak Value of UR: 2.86
Net Charge of CR: 4
McG: Discrim Score: 10.27
GvH: Signal Score (–7.5): –3.61
Possible site: 31
>>> Seems to have an uncleavable N-term signal seq
Amino Acid Composition: calculated from 1
ALOM program   count: 0 value: 2.12   threshold: 0.0
PERIPHERAL   Likelihood = 2.12   7
modified ALOM score: –0.92
*** Reasoning Step: 3
----- Final Results -----
   bacterial membrane --- Certainty = 0.0000 (Not Clear) <succ>
     bacterial outside --- Certainty = 0.0000 (Not Clear) <succ>
        bacterial cytoplasm --- Certainty = 0.0000 (Not Clear) <succ>

The protein has no significant homology with any sequences in the GENPEPT database.

No corresponding DNA sequence was identified in *S. pyogenes*.

SEQ ID 8962 (GBS117) was expressed in *E. coli* as a His-fusion product. SDS-PAGE analysis of total cell extract is shown in FIG. 29 (lane 8; MW 22.5 kDa).

GBS117-His was purified as shown in FIG. 200, lane 7.

Based on this analysis, it was predicted that this protein and its epitopes, could be useful antigens for vaccines or diagnostics.

Example 2035

A DNA sequence (GBSx2146) was identified in *S. agalactiae* <SEQ ID 6291> which encodes the amino acid sequence <SEQ ID 6292>. This protein is predicted to be YirC (resE). Analysis of this protein sequence reveals the following:

```
Possible site: 28
>>> Seems to have an uncleavable N-term signal seq
INTEGRAL    Likelihood = -10.88   Transmembrane 177-193 (173-196)
INTEGRAL    Likelihood = -4.09    Transmembrane 10-26 (5-29)
----- Final Results -----
    bacterial membrane --- Certainty = 0.5352 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

There is also homology to SEQ ID 1178.

SEQ ID 6292 (GBS279) was expressed in *E. coli* as a His-fusion product. SDS-PAGE analysis of total cell extract is shown in FIG. 52 (lane 7; MW 54.5 kDa). It was also expressed in *E. coli* as a GST-fusion product. SDS-PAGE analysis of total cell extract is shown in FIG. 58 (lane 6; MW 79.4 kDa).

Based on this analysis, it was predicted that this protein and its epitopes, could be useful antigens for vaccines or diagnostics.

Example 2036

A DNA sequence (GBSx2147) was identified in *S. agalactiae* <SEQ ID 6293> which encodes the amino acid sequence <SEQ ID 6294>. This protein is predicted to be two-component response regulator (mtrA). Analysis of this protein sequence reveals the following:

```
Possible site: 37
>>> Seems to have no N-terminal signal sequence
----- Final Results -----
    bacterial cytoplasm --- Certainty = 0.1706 (Affirmative) <succ>
    bacterial membrane --- Certainty = 0.0000 (Not Clear) <succ>
    bacterial outside --- Certainty = 0.0000 (Not Clear) <succ>
```

A related GBS nucleic acid sequence <SEQ ID 10239> which encodes amino acid sequence <SEQ ID 10240> was also identified.

The protein has homology with the following sequences in the GENPEPT database.

```
>GP:CAB15292 GB:Z99120 similar to two-component sensor histidine
kinase [YvqA] [Bacillus subtilis]

Identities = 108/379 (28%), Positives = 193/379 (50%), Gaps = 33/379 (8%)

Query:   92   DNHKKESHDIIRYLTQKRLWQISKEKDGMFVTIKKKTYYVMTKDYSGILVDGSIKKVPKA    151
              +N +  S    + L+     + ++ K  D       KKK Y   + D +G  V   IKK
Sbjct:   86   ENEEASSDKDLSILSSSFIHKVYKLADKQ--EAKKKRY---SADVNGEKVFFVIKKOLSV    140

Query:  152   QSQLFHVINFS------DITYTQHLITKINHFLIVILVLTYIPMLFIMRKTFTGIRESIQ    205
              Q     +++++      D+ YT  L    ++    + V+++L+++IP +++  +    +   +
Sbjct:  141   NGQSAMMLSYALDSYRDDLAYT--LFKQLLFIIAVVILLSWIPAIWLAKY----LSRPLV    194

Query:  206   SVQTYISSLWKNQGNHQSSQKEIVFSDFDPLLLESQEMANRIYQAEESQRNFFQNASHEL    265
              S + ++  + ++ +           K    + L     +EM  ++ Q +E++R    QN SH+L
Sbjct:  195   SFEKHVKRI--SEQDWDDPVKVDRKDEIGKLGHTIEEMRQKLVQKDETERTLLQNISHDL    252

Query:  266   RTPLMSIQGYTEGVQEGII---DAELAHSVILQESKKMKQLVDDIILLSKLD--SNLSDQ    320
              +TP+M I+GYT+ +++GI       D E    VI  E+ K+++ + D++ L+KLD  +      Q
Sbjct:  253   KTPVMVIRGYTQSIKDGIFPKGDLENTVDVIECEALKLEKKIKDLLYLTKLDYLAKQKVQ    312

Query:  321   KDEFSLNELLNSIIAYFKPLANKQKISITYRPDKHEKLLK-GNEELIQRAINNILSNALR    379
               D FS+ E+    +I   K A K+     +++   D E +L  G+ E    + + NIL N +R
Sbjct:  313   HDMESIVEVTEEVIERLK-WARKE---LSWEIDVEEDILMPGDPEQWNKLLENILENQIR    368

Query:  380   YAVSHIEISYT----NQKLTISNDGPAISKEDLPYIFDRFYKGHGGQTGIGLAMTKEIIK    435
              YA + IEIS        N  +TI NDGP  I   E L   +++ F KG   G+ GIGL++ K I+
Sbjct:  369   YAETKIEISMKQDDRNIVITIKNDGPHIEDEMLSSLYEPFNKGKKGEFGIGLSIVKRILT    428

Query:  436   QHHGNIIAESDSTSTTFTI                                           454
              H  +I  E+D T    ++ I
Sbjct:  429   LHKASISIENDKTGVSYRI                                           447
```

```
>GP:BAB05663 GB:AP001513 two-component response regulator [Bacillus halodurans]
Identities = 87/220 (39%), Positives = 124/220 (55%), Gaps = 4/220 (1%)
Query:  11   IYFADDEKNIRDLVVPFLEHDGFTVRAFETGDLLLEAYKNQKPDLVILDIMMPGTNGLDV      70
             I  DDE ++R+LV  +L  +GF V   ETGD  ++  + +  DLV+LD+MM    +G
Sbjct:   7   ILIVDDELDLRELVTSYLRKEGFAVITAETGDEAIKRLEQEPMDLVVLDVMMDEMDGFTA     66

Query:  71   MKSIRQYDNIPIIMLTARDSDVDFITAFNLGTDDYFTKPFSPIKLSLHVKALFKRLDEKA    130
              K  IR +  IPIIMLTAR + D +      +G DDY  KPFSP +L   ++    +R
Sbjct:  67   CKEIRAFSQIPIIMLTARGGEDDKVMGLQIGADDYIVKPFSPRELVARIEVALRRTQGIQ    126

Query: 131   IKNDTQYQFLDLTLDTEKRIALLSNEEMPLTKTEFDFLLVLIEKPETAFSRETLLNRIWG    190
                +DT Y+F +L +    R    ++ +E+ LTK E+D L+ L+E      F+RE L +R+WG
Sbjct: 127   QVDDTGYRFNELRIQPSGRKVFVNGQEISLTKKEYDLLVFLLEHRGRVFTREHLHDRLWG    186

Query: 191   FDDIES--RAVDDTIKRLRKKFKQYHSQVSIKTVWGYGFK                       228
              D +    R VD  IK LR K K  +   IKTVWG G+K
Sbjct: 187   MDTQQGTLRTVDTHIKTLRLKLKP--ADRFIKTVWGVGYK                       224
```

There is also homology to SEQ ID 3260.

Based on this analysis, it was predicted that this protein and its epitopes, could be useful antigens for vaccines or diagnostics.

Example 2037

A DNA sequence (GBSx2148) was identified in *S. agalactiae* <SEQ ID 6295> which encodes the amino acid sequence <SEQ ID 6296>. Analysis of this protein sequence reveals the following:

---

Possible site: 55
>>> Seems to have a cleavable N-term signal seq.

-continued

| INTEGRAL | Likelihood = −2.18 | Transmembrane 1568-1584 (1568-1585) |
| INTEGRAL | Likelihood = −0.16 | Transmembrane 338-354 (338-354) |

----- Final Results -----
  bacterial membrane --- Certainty = 0.1871 (Affirmative) <succ>
  bacterial outside --- Certainty = 0.0000 (Not Clear) <succ>
  bacterial cytoplasm --- Certainty = 0.0000 (Not Clear) <succ>

A related GBS nucleic acid sequence <SEQ ID 10237> which encodes amino acid sequence <SEQ ID 10238> was also identified.

The protein has homology with the following sequences in the GENPEPT database.

```
>GP:AAG09771 GB:AF243528 cell envelope proteinase [Streptococcus thermophilus]
Identities = 797/1594 (50%), Positives = 1056/1594 (66%), Gaps = 39/1594 (2%)
Query:  21   MNTKQRFSIRKYKLGAVSVLLGTLFFLGGITNVAADSVINKPSDIAVEQQVKDSPTS-IA      79
             M   K+ FS+RKYK+G VSVLLG +F  G  +VAAD + +   + VE  V D+  S   A
Sbjct:   1   MKKKETFSLRKYKIGTVSVLLGAVFLFAGAPSVAADELTSLV-ETKVEATVPDAIVSESA     59

Query:  80   NETPTNN--TSSALASTAQDNLVTKANNSPTETQPVAESHSQATETESPVANQPVESTQE    137
             +E+P     +++ +T+ D  T      ++  + S +   ET P    P S ++
Sbjct:  60   SESPVVEELVDTSVEATSTDVTTTDNEEETPGSEALENSANTEVETTQPAVETPAISEKK    119

Query: 138   VSKTPLTKQNLAVKSTPAISKET--PQNIDSNKIITVPKVWNTGYKGEGTVVAIIDSGLD    195
             V +    K ++A ++T   ++E    PQNIDSN IITVPKVW +GYKGEGTVVAIIDSGLD
Sbjct: 120   VEEEE--KLSVADETTAITNQEEAKPQNIDSNTIITVPKVWYSGYKGEGTVVAIIDSGLD    177

Query: 196   INHDALQLNDSTKAKYQNEQQMNAAKAKAGINYGKWYNNKVIFGHNYVDVNTELKEVKST    255
              ++HD L  ++D + AKY++E+++  AAK   AGI YG+W+N+KV+FG+NYVDVNT LKE
Sbjct: 178   VDHDVLHISDLSTAKYKSEKEIEAAKEAAGITYGEWFNDKVVFGYNYVDVNTVLKEEDKR    237

Query: 256   SHGMHVTSIATANPSKKDTNELIYGVAPEAQVMFMRVFSDEKRGTGPALYVKAIEDAVKL    315
             SHGMHVTSIAT NP++    +L+YGVAPEAQVMFMRVFSD K   TG ALYVKAIEDAVKL
Sbjct: 238   SHGMHVTSIATGNPTQPVAGQLMYGVAPEAQVMFMRVESDLKATTGAALYVKAIEDAVKL    297

Query: 316   GADSINLSLGGANGSLVNADDRLIKALEMARLAGVSVVIAAGNDTEGSGASKPSALYPD    375
             GADSINLSLGGANGS+VN ++ +   A+E AR AGVSVVIAAGNDTGFSGG  S  PSA YPD
Sbjct: 298   GADSINLSLGGANGSVVNMNENVTAATEAARRAGVSVVIAAGNAGTEGSGHSNPSADYPD    357

Query: 376   YGLVGSPSTAREAISVASYNNTTLVNKVFNIIGLENNRNLNNGLAAYADPKVSDKTFEVG    435
             YGLVG+PSTA +AISVASYNNTT+ +KV NIIGLENN +LN G +++  +P+ S    FE+G
Sbjct: 358   YGLVGAPSTAHDAISVASYNNTTVGSKVINIIGLENNADLNYGKSSEDNPEKSPVPFEIG    417

Query: 436   KQYDYVFVGKGNDNDYKDKTLNGKIALIERGDITFTKKVVNAINHGAVGAIIFNNKAGEA    495
             K+Y+YV+  G G  +D+   L GK+ALI+RG ITF++K+ NA    GAVG +IFN++ GEA
Sbjct: 418   KEYEYVYAGIGQASDEDGLDLTGKLALIKRGTITFSEKIANATAAGAVGVVIFNSRPGEA    477

Query: 496   NLTMSLDPEASAIPAIFTQKEFGDVLAKNNYKIVFNNIKNKQANPNAGVLSDESSWGLTA    555
             N++M LD  A AIP++F    EFG+ LA N+YKI FNN  +   NP AG+LSDFSSWGL+A
Sbjct: 478   NVSMQLDDTAIAIPSVFIPLEFGEALAANSYKIAFNNETDIRPNPEAGLLSDFSSWGLSA    537

Query: 556   DGQLKPDLSAPGGSIYAAINDNEYDMMSGTSMASPHVAGATALVKQYLLKEHPELKKGDI    615
             DG+LKPDL+APGG+IYAAIND++Y M GTSMASPHVAGA LVKQYLL +P +I
```

```
-continued
Sbjct:  538  DGELKPDLAAPGGAIYAAINDNDYANMQGTSMASPHVAGAAVLVKQYLLATYPTKSPQEI  597

Query:  616  ERTVKYLLMSTAKAHLNKDTGAYTSPRQQGAGIIDVAAAVQTGLYLTGGENNYGSVTLGN  675
             E  VK+LLMSTAKAH+NK+T AYTSPRQQGAGIID AAA+ TGLYLT GE+ YGS+TLGN
Sbjct:  598  EALVKHLLMSTAKAHVNKETTAYTSPRQQGAGIIDTAAAISTGLYLT-GEDGYGSITLGN  656

Query:  676  IKDKISFDVTVHNINKVAKDLHYTTYLNTDQVKDGFVTLAPQQLGTFTGKTIRIEPGQTQ  735
             ++D  SF VT+HNI   K L+Y+T L TD +    L   + + ++ ++      +
Sbjct:  657  VEDTFSFTVTLHNITNEDKTLNYSTQLTTDTAQKRIDHLGSTSISRDSWRKVTVKANSST  716

Query:  736  TITIDIDVSKYHDMLKKVMPNGYFLEGYVRFTDPVDGGEVLSIPYVGFKGEFQNLEVLEK  795
             T+TI++D S + + L  +M NGY+LEG+VRFTD  D G+++SIPYVGF+GEFQNL VLE+
Sbjct:  717  TVTINVDASSFAEELTGLMKNGYYLEGFVRFTDVADDGDIVSIPYVGFRGEFQNLAVLEE  776

Query:  796  SIYKLVANKEKGFYFQP--KQTNEVPGSEDYTALMTTSSEPTYSTDGTSPIQLKALGSYK  853
                IY L+A+ + GFYF+P   Q N V S  YT L+T S+E IYSTD  S    +K LG++K
Sbjct:  777  PIYNLIADGKGGFYFEPVTAQPNTVDISHHYTGLVTGSTELIYSTDKRSDSAIKTLGTFK  836

Query:  854  SIDGKWILQLDQKGQPHLAISPNDDQNQDAVAVKGVFLRNENNLRAKVYRADDVNLQKPL  913
             +   G ++L+LD+ G+PHLAISPN D NQD++   KGVFLRN+ +L A VY ADD     PL
Sbjct:  837  NKAGYFVLELDESGKPHLAISPNGDDNQDSLVFKGVFLRNYTDLVASVYAADDTERTNPL  896

Query:  914  WVSAPQAGDKNYYSGNTENPKSTFLYDTEWKGTTTDGIPLEDGKYKYVLTYYSDVPGSKP  973
             W S  PQ+GDKN YSGN +NPKS+ +Y TEW GT +DG  L  DGKY+YVLTY S VPG+
Sbjct:  897  WESQPQSGDKNIYSGNPKNPKSSITYPTEWNGTDSDGNALADGKYQYVLTYSSKVPGAAV  956

Query:  974  QQMVEDITLDRQAPTLTTATYDKDRRIFKARPAVEHGESGIFREQVFYLKKDKDGHYNSV  1033
             Q M+FD+  +DR++P +TTATYD+     F  RPA+E GESG++REQVFYL  D  G  ++
Sbjct:  957  QTMIFDVIIDRESPVITTATYDETNFTFNPRPAIEKGESGLYREQVFYLVADASG-VTTI  1015

Query: 1034  LRQQGEDGILVEDNKVFIKQEKDGSFILPKEVNDFSHVYYTVEDYAGNLVSAKLEDLINI  1093
                 + V DNKVF+ Q  DGSF LP ++ D S  YYTVEDYAGN+    K+E+LI+I
Sbjct: 1016  PSLLKNGDVTVSDNKVFVAQNDDGSFTLPLDLADISKFYYTVEDYAGNISYEKVENLISI  1075

Query: 1094  GNKNGLVNVKVFSPELNSNVDIDFSYSVKDDKGNIIKK-QHHGKDLNLLKLPFGTYTFDL  1152
             GN+ GLV V +    + NS V I  FSYSV D+ G I+ +     + D ++LKLPFGTYTFDL
Sbjct: 1076  GNEKGLVTVNILDKDTNSPVPILFSYSVTDETGKIVAELPRYAGDTSVLKLPFGTYTFDL  1135

Query: 1153  FLYDEERANLISPKSVTVTISEKDSLKDVLFKVNLLKKAALLVEFDKLLPKGATVQLVTK  1212
             FLYD E  ++L     VTI E +S  +V F V L   KA LL++ D LLP G+T+QLVT
Sbjct: 1136  FLYDTEWSSLAGETKAVVTILEDNSTAEVNFYVTLKDKANLLIDIDALLPSGSTIQLVTA  1195

Query: 1213  TNTVVDLPKATYSPTDYGKNIPVGDYRLNVTLPSGYSTLENLDDLLVSVKEDQVNLTKLT  1272
                 + LP A YS TDYGK +PVG Y +  TLP GY  LE LD   V+V +Q N+ KLT
Sbjct: 1196  DGQAIQLPNAKYSKTDYGKFVPVGTYTILPTLPEGYEFLEELD---VAVLANQSNVKKLT  1252

Query: 1273  LINKAPLINALAEQTDIITQPVFYNAGTHLKNNYLANLEKAQTLIKNRVEQTSIDNAIAA  1332
             LINK    L  +AE +      +YNA L+  Y  LE A + N+  Q  +D+A+A+
Sbjct: 1253  LINKVALKELIAELAGLEETARYYNASPELQTAYAKALEDANAVYANKHNQAQVDSALAS  1312

Query: 1333  LRESRQALNGKETDTSLLAKAILAETEIKGNYQFVNASPLSQSTYINQVQLAKNLLQKPN  1392
             L  +R+ LNG+ TD   L     +  T   + N+ + NA    Q  Y   V+ A+ +L + N
Sbjct: 1313  LVAAREQLNGQATDKEKLIAEVSNYTPTQANFIYYNAENTKQIAYDTAVRSAQLVLNQEN  1372

Query: 1393  VTQSEVDKALENLDIAKNQLNGHETDYSGLHHMIIKANVLKQTSSKYQNASQFAKENYNN  1452
             VTQ+ V++AL +L  AK  L+G +TD S L    + ++VLK T +KY NAS+   K+ Y+
Sbjct: 1373  VTQAVVNQALADLLAAKANLDGQKTDISALRSAVSVSSVLKATDAKYLNASENVKQAYDQ  1432

Query: 1453  LIKKAELLLSNRQATQAQVEELLNQIKATEQELDG----RDRVSSAENYSQSLNDNDSLN  1508
              ++ A+ +L + +A+QA V++ L + + + ELDG    +     N+    D  ++
Sbjct: 1433  AVEAAKAILVDESASQASVDQALAVLTSAQAELDGVATSTNDAKEPANTATDKRDEGTVT  1492

Query: 1509  TTPIN--------PP-----NQPQALIFKKGMTKESEVAQKRVLGVTSQTDNQKVKTNKL  1555
                PI+        PP     N    I +K    + + + +     L  + +NQ+ +  +L
Sbjct: 1493  PPPIDSEIVDVQAPPVKDTGNSEHVPIGQK-PNPQPTLPRPVTLQASLSSPNQEKQVTQL  1551

Query: 1556  PKTGESTPKITYTILLFSLSMLGLATIKLKSIKR                           1589
             P TGE+  K         L    ++GL T+ L SI+R
Sbjct: 1552  PNTGENDTK----YYLVPGVIIGLGTL-LVSIRR                           1580
```

A related GBS gene <SEQ ID 8963> and protein <SEQ ID 8964> were also identified. Analysis of this protein sequence reveals the following:

Lipop: Possible site: −1 Crend: 10
SRCFLG: 0
McG: Length of UR: 1

Peak Value of UR: 2.55
Net Charge of CR: 4
McG: Discrim Score: 2.60
GvH: Signal Score (−7.5): −0.78
Possible site: 35
>>> Seems to have a cleavable N-term signal seq.
Amino Acid Composition: calculated from 36

3617
-continued

ALOM program count: 1 value: −0.16  threshold: 0.0
INTEGRAL    Likelihood = −0.16  Transmembrane 318-334 (318-334)
PERIPHERAL  Likelihood = 2.54   1161
modified ALOM score: 0.53
icml HYPID: 7    CFP: 0.106
*** Reasoning Step: 3
----- Final Results -----

3618
-continued bacterial membrane --- Certainty = 0.1065 (Affirmative) <succ>
bacterial outside --- Certainty = 0.0000 (Not Clear) <succ>
bacterial cytoplasm --- Certainty = 0.0000 (Not Clear) <succ>
LPXTG motif:1535-1539

The protein has homology with the following sequences in the databases:

```
50.5/67.5% over 1583aa
Streptococcus thermophilus
GP|9963932| cell envelope proteinase Insert characterized
ORF01603(361-5070 of 5370)
GP|9963932|gb|AAG09771.1|AF243528_1|AF243528(1-1584 of 1585) cell envelope
proteinase {Streptococcus thermophilus}
% Match = 41.2
% Identity = 50.4 % Similarity = 67.4
Matches = 794 Mismatches = 498 Conservative Sub.s = 267

255       285       315       345       375       405       435       465
KNALGTVLMLPQNNL**KFRKL*KILIFYVLIVFVIIMLQEKEIFMNTKQRFSIRKYKLGAVSVLLGTLFFLGGIYNVAA
                              |   |: ||:||||:| |||||| :|:: |  :|||
                              MKKKETFSLRKYKIGTVSVLLGAVFLFAGAPSVAA
                                    10        20        30

495       525       552       576       606       636       666       696
DSVINKPSDIAVEQQVKDSPTS-IANETPT--NNTSSALASTAQDNLVTKANNSPTETQPVAESHSQATETFSPVANQPV
|   :   ||   | |:   |  |:|:|  ::: :|:  |       |     ::   ||     ||    |
DE-LTSLVETKVEATVPDAIVSESASESPVVEELVDTSVEATSTDVTTTDNEEETPGSEALENSANTEVETTQPAVETPA
      50        60        70        80        90       100       110

726       756       780       810       840       870       900       930
ESTQEVSKTPLTKQNLAVKSTPAISKE--TPQNIDSNKIIITVPKVWNTGYKGEGTVVAIIDSGLDINHDALQLNDSTKAK
|  ::|   :     |   ::| ::|   ::|   ||||||| ||||||||:|||||||||||||::||  |:::|  : ||
ISEKKVEEEE--KLSVADETTAITNQEEAKPQNIDSNTIITVPKVWYSGYKGEGTVVAIIDSGLDVDHDVLHISDLSTAK
         130       140       150       160       170       180       190

960       990      1020      1050      1080      1110      1140      1170
YQNEQQMNAAKAKAGINYGKWYNNKVIFGHNYVDVNTELKEVKSTSHGMHVTSIATANPSKKDTNELIYGVAPEAQVMFM
| ::|:::  |||   ||  ||:|:|:||:|| |||||||   ||  ||||||||||| ||::        :|:|||||||||||
YKSEKEIEAAKEAAGITYGEWFNDKVVFGYNYVDVNTVLKEEDKRSHGMHVTSIATGNPTQPVAGQLMYGVAPEAQVMFM
         210       220       230       240       250       260       270

1200      1230      1260      1290      1320      1350      1380      1410
RVFSDEKRGTGPALYVKAIEDAVKLGADSINLSLGGANGSLVNADDRLIKALEMARLAGVSVVIAAGNDGTFGSGASKPS
|||||  |  ||  ||||||||||||||||||||||||| :|  :  |:|  |||||||||||  |||
RVFSDLKATTGAALYVKAIEDAVKLGADSINLSLGGANGSVVNMNENVTAAIEAARRAGVSVVIAAGNDGTFGSGHSNPS
         290       300       310       320       330       340       350

1440      1470      1500      1530      1560      1590      1620      1650
ALYPDYGLVGSPSTAREAISVASYNNTTLVNKVFNIIGLENNRNLNNGLAAYADPKVSDKTFEVGKQYDYVFVGKGNDND
| ||||||||| |||||  ||||||||| :||||| |||||||||  :||   : :||   |   ||:||:||| |  :|
ADYPDYGLVGAPSTAHDAISVASYNNTTVGSKVINIIGLENNADLNYGKSSFDNPEKSPVPFEIGKEYEYVYAGIGQASD
         370       380       390       400       410       420       430

1680      1710      1740      1770      1800      1830      1860      1890
YKDKTLNGKIALIERGDITFTKKVVNAINHGAVGAIIFNNKAGEANLTMSLDPEASAIPAIFTQKEFGDVLAKNNYKIVF
:   | ||:|||:|| ||:::|: ||  |||| :|||::| || ||| ||||:|  |||: |||:|||  |:|||| |
FDGLDLTGKLALIKRGTITFSEKIANATAAGAVGVVIFNSRPGEANVSMQLDDTAIAIPSVFIPLEFGEALAANSYKIAF
         450       460       470       480       490       500       510

1920      1950      1980      2010      2040      2070      2100      2130
NNIKNKQANPNAGVLSDFSSWGLTADGQLKPDLSAPGGSIYAAINDNEYDMMSGTSMASPHVAGATALVKQYLLKEHPEL
||  :  ||  ||::|||||||||||:|||  ||||:|||||||||||||||| | ||||||||||| ||||||  :|
NNETDIRPNPEAGLLSDFSSWGLSADGELKPDLAAPGGAIYAAINDNDYANMQGTSMASPHVAGAAVLVKQYLLATYPTK
         530       540       550       560       570       580       590

2160      2190      2220      2250      2280      2310      2340      2370
KKGDIERTVKYLLMSTAKAHLNKDTGAYTSPRQQGAGIIDVAAAVQTGLYLTGGENNYGSVTLGNIKDKISFDVTVHNIN
 :||    ||:|||||||||||:|||||||||||||||||| |||: ||||||| |:  ||||||::|  ||   ||:||||
SPQEIEALVKHLLMSTAKAHVNKETTAYTSPRQQGAGIIDTAAAISTGLYLTG-EDGYGSITLGNVEDTFSFTVTLHNIT
         610       620       630       640       650       660       670
```

```
       2400      2430      2460      2490      2520      2550      2580      2610
KVAKDLHYTTYLNTDQVKDGFVTLAPQQLGTFTGKTIRIEPGQTQTITIDIDVSKYHDMLKKVMPNGYFLEGYVRFTDPV
 |:|:|  ||   || ||  :       |    : :::  :: |:|||::|  : :  ||| ||:||||||
NEDKTLNYSTQLTTDTAQKRIDHLGSTSISRDSWRKVTVKANSSTTVTINVDASSFAEELTGLMKNGYYLEGFVRFTDVA
           690       700       710       720       730       740       750

2640      2670      2700      2730      2754      2784      2814      2844
DGGEVLSIPYVGFKGEFQNLEVLEKSIYKLVANKEKGFYFQP--KQTNEVPGSEDYTALMTTSSEPIYSTDGTSPIQLKA
| |:::|||||||:||||| ||||: || |:|: : ||||    |  |    |||:|:|  ||||| |  :|
DDGDIVSIPYVGFRGEFQNLAVLEEPIYNLIADKGGFYFEPVTAQPNTVDISHHYTGLVTGSTELIYSTDKRSDSAIKT
           770       780       790       800       810       820       830

2874      2904      2934      2964      2994      3024      3054      3084
LGSYKSIDGKWILQLDQKGQPHLAISPNDDQNQDAVAVKGVFLRNFNNLRAKVYRADDVNLQKPLWVSAPQAGDKNYYSG
|||::|:  |  |:|| |:|||||||| |||::  |||||||:| |||||||    |||   ||| |:|||| |||
LGTFKNKAGYFVLELDESGKPHLAISPNGDDNQDSLVFKGVFLRNYTDLVASVYAADDTERTNPLWESQPQSGDKNIYSG
           850       860       870       880       890       900       910

3114      3144      3174      3204      3234      3264      3294      3324
NTENPKSTFLYDTEWKGTTTDGIPLEDGKYKYVLTYYSDVPGSKPQQMVFDITLDRQAPTLTTATYDKDRRIFKARPAVE
 | :|||| :|   ||| |  :|      ||||:|||| ||||  ::|  ||:||::|  :||||||   |:|  |||:|
NPKNPKSSIIYPTEWNGTDSDGNALADGKYQYVLTYSSKVPGAAVQTMIFDVIIDRESPVITTATYDETNFTFNPRPAIE
           930       940       950       960       970       980       990

3354      3384      3414      3444      3474      3504      3534      3564
HGESGIFREQVFYLKKDKDGHYNSVLRQQGEDGILVEDNKVFIKQEKDGSFILPKEVNDFSHVYYTVEDYAGNLVSAKLE
||||::||||||||| | |       ::     :   | |||||  |||| ||:: :||||||||||  |||:|  |:|
KGESGLYREQVFYLVADASG--VTTIPSLLKNGDVTVSDNKVFVAQNDDGSFTLPLDLADISKFYYTVEDYAGNISYEKVE
          1010      1020      1030      1040      1050      1060      1070

3594      3624      3654      3684      3711      3741      3771      3801
DLINIGNKNGLVNVKVFSPELNSNVDIDFSYSVKDDKGNIIKK-QHHGKDLNLLKLPFGTYTFDLFLYDEERANLISPKS
:||:|||  ||| :: : || |  ||||| |:| ||  :   |  ::||||||||||||||||||| ||  ||:
NLISIGNEKGLVTVNILDKDTNSPVPILFSYSVTDETGKIVAELPRYAGDTSVLKLPFGTYTFDLFLYDTEWSSLAGETK
          1080      1090      1100      1110      1120      1130      1140      1150

3831      3861      3891      3921      3951      3981      4011      4041
VTVTISEKDSLKDVLFKVNLLKKAALLVEFDKLLPKGATVQLVTKTNTVVDLPKATYSPTDYGKNIPVGDYRLNVTLPSG
   ||| :|  :| | | |||| ||  ||::  |   |:|:|||     : ||   || ||||| :|||  ||| |||
AVVTILEDNSTAEVNFYVTLKDKANLLIDIDALLPSGSTIQLVTADGQAIQLPNAKYSKTDYGKFVPVGTYTILPTLPEG
          1160      1170      1180      1190      1200      1210      1220      1230

4071      4101      4131      4161      4191      4221      4251      4281
YSTLENLDDLLVSVKEDQVNLTKLTLINKAPLINALAEQTDIITQPVFYNAGTHLKNNYLANLEKAQTLIKNRVEQTSID
|  |||     |:|  :|  |: ||||||| |   :||  :   : |||   |:  |   |||  : :    |::  :|
YEFLEELD---VAVLANQSNVKKLTLINKVALKELIAELAGLEETARYYNASPELQTAYAKALEDANAVYANKHNQAQVD
          1240      1250      1260      1270      1280      1290      1300

4311      4341      4371      4401      4431      4461      4491      4521
NAIAALRESRQALNGKETDTSLLAKAILAETEIKGNYQFVNASPLSQSTYINQVQLAKNLLQKPNVTQSEVDKALENLDI
 :|:|:|   :|  :|:  |||  ||    |  :  :   |    |    ||:|::  |:  :|: |||  |:::||  :|
SALASLVAAREQLNGQATDKEKLIAEVSNYTPTQANFIYYANENTKQIAYDTAVRSAQLVLNQENVTQAVVNQALADLLA
          1320      1330      1340      1350      1360      1370      1380

4551      4581      4611      4641      4671      47014     4731      4761
AKNQLNGHETDYSGLHHMIIKANVLKQTSSKYQNASQFAKENYNNLIKKAELLLSNRQATQAQVEELLNQIKATEQELDG
||  |:|::||  |       :  ::|||   :||  ||||  |: |:   |:  | :| |:|::  :   : ||  ||||
AKANLDGQKTDISALRSAVSVSSVLKATDAKYLNASENVKQAYDQAVEAAKAILVDESASQQASVDQALAVLTSAQAELDG
          1400      1410      1420      1430      1440      1450      1460

4779      4809      4839      4845      4860      4890      4920      4950
----RDRVSSAENYSQSLNDNDSLNTTPIN--------PP-----NQPQALIFKKGMTKESEVAQKRVLGVTSQTDNQKV
     :|  |:|  |     :   |: :         |:      :  | :: |:      | : :  :  ::   |||
VATSTNDAKEPANTATDKKDEGTVTPPPIDSEIVDVQAPPVKDTGNSEHVPIGQKFNPQPT-LPRPVTLQASLSSPNQEK
          1480      1490      1500      1510      1520      1530      1540

4980      5010      5040      5070      5100      5130      5160      5190
KTNKLPKTGESTPKITYTILLFSLSMLGLATIKLKSIKRE*NTLKNRARHQLLAINS**LVPF*GA*NDVPKDLFSAVSW
  : :|| |||: |      |  | ::       | ::  ||
QVTQLPNTGENDTK--YYLVPGVIIGLGTLLVSIRRHKEEV
          1560      1570      1580
```

A related GBS nucleic acid sequence <SEQ ID 10965> which encodes amino acid sequence <SEQ ID 10966> was also identified.

A related DNA sequence was identified in *S. pyogenes* <SEQ ID 6297> which encodes the amino acid sequence <SEQ ID 6298>. Analysis of this protein sequence reveals the following:

LPXTG motif: 1614-1619
Possible site: 33

>>> Seems to have a cleavable N-term signal seq.
INTEGRAL   Likelihood = −4.46   Transmembrane 1623-1639 (1621-1641)
----- Final Results -----
  bacterial membrane --- Certainty = 0.2784 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP:AAG09771 GB:AF243528 cell envelope proteinase [Streptococcus thermophilus]
Identities = 465/1125 (41%), Positives = 668/1125 (59%), Gaps = 61/1125 (5%)
Query:     1  VEKKQRFSLRKYKSGTFSVLIGSVFLVM-TTTVAADELSTMSEPTITNHAQQQAQHLTNT    59
              ++KK+ FSLRKYK GT SVL+G+VFL   +VAADEL+++ E +           T
Sbjct:     1  MKKKETFSLRKYKIGTVSVLLGAVFLFAGAPSVAADELTSLVETKVEA----------T    49

Query:    60  ELSSAESKSQDTSQITLKTNREKEQSQDLVSEPTTTELADTDAASMANTGSDATQKSASL   119
                + S+S   S +          E+  D  E T+t++  TD        GS+A + SA
Sbjct:    50  VPDAIVSESASESPVV-------EELVDTSVEATSTDVTTTDNEE-ETPGSEALENSA--    99

Query:   120  PPVNTDVHDWVKTKGAWDKGYKGQGKVVAVIDTGIDPAHQSMRISDVSTAKVKSKEDMLA   179
                  NT+V     T+ A +    + KV          + + ++D +TA       +E
Sbjct:   100  ---NTEVET---TQPAVETPAISEKKV---------EEEEKLSVADETTAITNQEE----   140

Query:   180  RQKAAGINYGSWINDKVVFAHNYVENSDNIKE-NQFEDFDEDWENFEFDAEAEPKAIKKH   238
                K   I+ + I    V+  Y    +    +  D D D +     + A+ K+ K+
Sbjct:   141  -AKPQNIDSNTIITVPKVWYSGYKGEGTVVAIIDSGLDVDHDVLHISDLSTAKYKSEKEI   199

Query:   239  KIYRPQSTQAPKETVIKTEETDGSHDIDWTQTDDDTKYESHGMHVTGIVAGNSKEAAATG   298
              +  +  +       E    + G ++D       +    SHGMHVT I  GN + A G
Sbjct:   200  EAAKEAAGITYGEW-ENDKVVFGYNYVDVNTVLKEEDKRSHGMHVTSIATGNPTQPVA-G   257

Query:   299  ERFLGIAPEAQVMFMRVFANDINGSAESLFIKAIEDAVALGADVINLSLGTANGAQLSGS   358
                + G+APEAQVMFMRVF++       +L++KAIEDAV LGAD INLSLG ANG+ ++ +
Sbjct:   258  QLMYGVAPEAQVMFMRVESDLKATTGAALYVKAIEDAVKLGADSINLSLGGANGSVVNMN   317

Query:   359  KPLMEATEKAKKAGVSVVVAAGNERVYGSDHDDPLATNPDYGLVGSPSTGRTPTSVAAIN   418
              + +   AIE A++AGVSVV+AAGN+   +GS H +P A  PDYGLVG+PST    SVA+ N
Sbjct:   318  ENVTAAIEAARRAGVSVVIAAGNDGTEGSGHSNPSADYPDYGLVGAPSTAHDAISVASYN   377

Query:   419  SKWVIQRLMTVKELENRADLNHGKAIYSESVDEKDIKDSLGYDKSHQFAYVKESTDAGYN   478
               + V  +++ +   LEN ADLN+GK+ +  ++ +     +G +  + +A + +++D  ++
Sbjct:   378  NTTVGSKVINIIGLENNADLNYGKSSF-DNPEKSPVPFEIGKEYEYVYAGIGQASD--FD   434

Query:   479  AQDVKGKIALIERDPNKTYDEMIALAKKHGALGVLIENNKPGQSNRSMRLTANGMGIPSA   538
                D+ GK+ALI+R    T+ E IA A   GA+GV+IFN++PG++N SM+L    + IPS
Sbjct:   435  GLDLTGKLALIKRG-TITESEKIANATAAGAVGVVIENSRPGEANVSMQLDDTAIAIPSV   493

Query:   539  FISHEFGKAMSQLNGNGTGSLEFDSVVSKAPSQKGNEMNHFSNWGLTSDGYLKPDITAPG   598
              FI   EFG+A++      +  + F++      P+ +   ++ FS+WGL++DG LKPD+ APG
Sbjct:   494  FIPLEFGEALAA----NSYKIAFNNETDIRPNPEAGLLSDESSWGLSADGELKPDLAAPG   549

Query:   599  GDIYSTYNDNHYGSQTGTSMASPQIAGASLLVKQYLEKTQPNLPKEKIADIVKNLLMSNA   658
              G IY+  NDN Y +  GTSMASP +AGA++LVKQYL   T P    ++I +VK+LLMS A
Sbjct:   550  GAIYAAINDNDYANMQGTSMASPHVAGAAVLVKQYLLATYPTKSPQEIEALVKHLLMSTA   609

Query:   659  QIHVNPETKTTTSPRQQGAGLLNIDGAVTSGLYVTGKDNYGSISLGNITDTMTFDVTVHN   718
                + HVN  ET    TSPRQQGAG+++    A+++GLY +TG+D YGSI+LGN+  DT +F  VT
Sbjct:   610  KAHVNKETTAYTSPRQQGAGIIDTAAAISTGLYLTGEDGYGSITLGNVEDTFSFTVTLHN   669

Query:   719  LSNKDKTLRYDTELLTDHVDPQKGRFTLTSHSLKTYQGGEVTVPANGKVTVRVTMDVSQF   778
              ++N+DKTL  Y T+L TD         TS S  +++  +VTV AN    TV + +D S F
Sbjct:   670  ITNEDKTLNYSTQLTTDTAQKRIDHLGSTSISRDSWR--KVTVKANSSTTVTINVDASSF   727

Query:   779  TKELTKQMPNGYYLEGFVRFRDSQDDQLNRVNIPFVGFKGQFENLAVAEEESIYRLKSQGK   838
              +ELT  M NGYYLEGFVRF  D  DD   + V+IP+VGF+G+F+NLAV EE IY L + GK
Sbjct:   728  AEELTGLMKNGYYLEGFVRFTDVADDG-DIVSIPYVGFRGEFQNLAVLEEPIYNLIADGK   786

Query:   839  TGFYFDE-SGPKDDIYVGKHFTGLVTLGSETNVSTKTISDNGLHTLGTFKNADGKFILEK   897
                GFYF+  +   + +    H+TGLVT  +E      ST   SD+ +  TLGTFKN  G F+LE
Sbjct:   787  GGFYFEPVTAQPNTVDISHHYTGLVTGSTELIYSTDKRSDSAIKTLGTFKNKAGYFVLEL   846

Query:   898  NAQGNPVLAISPNGDNNQDFAAFKGVFLRKYQGLKASVYHASDKEHKNPLWVS-PESFKG   956
               +  G P  LAISPNGD+NQD    FKGVFLR Y  L ASVY A D  E  NPLW S P+S  G
Sbjct:   847  DESGKPHLAISPNGDDNQDSLVFKGVFLRNYTDLVASVYAADDTERTNPLWESQPQS--G   904
```

```
                            -continued
Query:  957  DKN-FNSDIRFAKSTTLLGTAFSGKSLTGAELPDGHYHYVVSYYPDVVGAKRQEMTFDMI  1015
             DKN ++ + +  KS+ +  T  ++G    G  L DG Y YV++Y   V GA  Q M FD+I
Sbjct:  905  DKNIYSGNPKNPKSSITYPTEWNGTDSDGNALADGKYQVLTYSSKVPGAAVQTMIFDVI   964

Query:  1016 LDRQKPVLSQATFDPETNRFKPEPLKDRGLAGVRKDSVFYLERKDNKPYTVTINDSYKYV  1075
             +DR+ PV++ AT+D    F P P  ++G +G+ ++ VFYL     +   T+        V
Sbjct:  965  IDRESPVITTATYDETNFTFNPRPAIEKGESGLYREQVFYLADASGVTTIPSLLKNGDV  1024

Query:  1076 SVEDNKTFVERQADGSFILPLDKAKLGDFYYMVEDFAGNVAIAKL                1120
             +V DNK FV +  DGSF LPLD A +  FYY VED+AGN++  K+
Sbjct:  1025 TVSDNKVFVAQNDDGSFTLPLDLADISKFYYTVEDYAGNISYEKV                1069
```

An alignment of the GAS and GBS proteins is shown below.

```
Identities = 543/1676 (32%), Positives = 821/1676 (48%), Gaps = 158/1676 (9%)
Query:    24 KQRFSIRKYKLGAVSVLLGTLFFLGGITNVAAD--SVINKPSDIAVEQQVKDSPTSI---   78
             KQRFS+RKYK G  SVL+G++F +   T VAAD S  +++P+    QQ       T+
Sbjct:     4 KQRFSLRKYKSGTFSVLIGSVFLVM-TTTVAADELSTMSEPTITNHAQQQAQHLTNTELS   62

Query:    79 ANETPTNNTSSALASTAQD-----NLVTKANNSPTETQPVAESHSQATETFSPVANQPVE  133
             + E+ + +TS    T ++      +LV++   +      A  +  ++     A+ P
Sbjct:    63 SAESKSQDTSQITLKTNREKEQSQDLVSEPTTTELADTDAASMANTGSDATQKSASLPPV  122

Query:   134 STQEVSKTPLTKQ--NLAVKSTPAISKETPQNID-SNKIITVPKVWNTGYKGEGTVVAI-  189
             +T +V    TK   +  K  +        ID +++ + +    V      K +  ++A
Sbjct:   123 NT-DVHDWVKTKGAWDKGYKGQGKVVAVIDTGIDPAHQSMRISDVSTARVKSKEDMLARQ  181

Query:   190 ----IDSGLDIN------HDALQLNDSTKAK--------YQNEQQMNAAKAKAGINYGKW  231
                 I+ G IN        H+  ++ +D+ K          ++N    A+  KA I     K
Sbjct:   182 KAAGINYGSWINDKVVFAHNNVENSDNIKENQFEDFDEDWENFEFDAEAEPKA-IKKHKI  240

Query:   232 YN-------------NKVIFGHNYDVNTELKEVKSTSHGMHVTSIATANPSKKD-TNEL   277
             Y              +    G +D     + K  SHGMHVT I   N +   T E
Sbjct:   241 YRPQSTQAPKETVIKTEETDGSHDIDWTQTDDDTKYESHGMHVTGIVAGNSKEAAATGER  300

Query:   278 IYGVAPEAQVMFMRVFSDEKRGTGPALYVKAIEDAVKLGADSINLSLGGANGSLVNADDR  337
              G+APEAQVMFMRVF+++  G+   +L++KAIEDAV LGAD INLSLG ANG+ ++
Sbjct:   301 FLGIAPEAQVMFMRVFANDIMGSAESLFIKAIEDAVALGADVINLSLGTANGAQLSGSKP  360

Query:   338 LIKALEMARLAGVSVVIAAGNDGTEGSGASKPSALYPDYGLVGSPSTAREAISVASYNNT  397
             L++A+E A+ AGVSVV+AAGN+  +GS   P A  PDYGLVGSPST R    SVA+ N+
Sbjct:   361 LMEAIEKAKKAGVSVVVAAGNERVYGSDHDDPLATNPDYGLVGSPSTGRTPTSVAAINSK  420

Query:   398 TLVNKVFNIIGLENNRNLNNGLAAYA---DPKVSDKTFEVGKQYDYVFVGKGNDNDYKDK  454
             ++ ++ +   LEN  +LN+G A Y+    D K       K + ++ +V + D Y  +
Sbjct:   421 WVIQRLMTVKELENRADLNHGKAIYSESVDEKDIKDSLGYDKSHQFAYVKESTDAGYNAQ  480

Query:   455 TLNGKIALIERG-DITFTKKVVNAINHGAVGAIIENNKAGEANLTMSLDPEASAIPAIFT  513
                + GKIALIER  + T+ + +    A   HGA+G +IFNNK G++N +M L      IP+ F
Sbjct:   481 DVKGKIALIERDPNKTYDEMIALAKKHGALGVLIFNNKPGQSNRSMRLTANGMGIPSAFI  540

Query:   514 QKEFGDVLAKNNYK----IVENNIKNKQANPNAGVLSDESSWGLTADGQLKPDLSAPGGS  569
                 EFG    +++ N      + F+++ +K +    ++ FS+WGLT+DG LKPD++APGG
Sbjct:   541 SHEFGKAMSQLNGNGTGSLEFDSVVSKAPSQKGNEMNHFSNWGLTSDGYLKPDITAPGGD  600

Query:   570 IYAAINDNEYDMMSGTSMASPHVAGATALVKQYLLKEHPELKKGDIERTVKYLLMSTAKA  629
             IY+   NDN Y   +GTSMASP +AGA+ LVKQYL K   P L K  I   VK LLMS A+
Sbjct:   601 IYSTYNDNHYGSQTGTSMASPQIAGASLLVKQYLEKTQPNLPKEKIADIVKNLLMSNAQI  660

Query:   630 HLNKDTGAYTSPRQQGAGIIDVAAAVQTGLYLTGGENNYGSVTLGNIKDKISFDVTVHNI  689
             H+N +T   TSPRQQGAG++++  AV +GLY+TG ++NYGS++LGNI D ++FDVTVHN+
Sbjct:   661 HVNPETKTTTSPRQQGAGLLNIDGAVTSGLYVTG-KDNYGSISLGNITDTMTFDVTVHNL  719

Query:   690 NKVAKDLHYTTYLNTDQV--KDGFVTLAPQQLGTFTGKTIRIEPGQTQTITIDIDVSKYH  747
              +     K L Y T L TD V   +G  TL     L T+ G + +         T+ + +DVS++
Sbjct:   720 SNKDKTLRYDTELLTDHVDPQKGRFTLTSHSLKTYQGGEVTVPANGKVTVRVTMDVSQFT  779

Query:   748 DMLKKVMPNGYFLEGYVRFTDPVDGG-EVLSIPYVGFKGEFQNLEVLEKSIYKLVANKEK  806
               L K MPNGY+LEG+VRF D  D         ++IP+VGFKG+F+NL V E+SIY+L +  +
Sbjct:   780 KELTKQMPNGYYLEGFVRFRDSQDDQLNRVNIPFVGFKGQFENLAVAEEESIYRLKSQGKT  839

Query:   807 GFYFQPK-QTNEVPGSEDYTALMTTSSEPIYSTDGTSPIQLKALGSYKSIDGKWILQLDQ  865
             GFYF      +++  +  + +T L+T     SE    ST    S    L LG++K+ DGK+IL+ +
Sbjct:   840 GFYFDESGPKDDIYVGKHFTGLVTLGSETNVSTKTISDNGLHTLGTFKNADGKFILEKNA  899

Query:   866 KGQPHLAISPNDDQNQDAVAVKGVFLRNFNNLRAKVYRADDVNLQKPLWVSAPQ-AGDKN  924
             +G P LAISPN D NQD A  KGVFLR +  L+A VY A D   + PLWVS      GDKN
```

```
                               -continued
Sbjct:  900  QGNPVLAISPNGDNNQDFAAFKGVFLRKYQGLKASVYHASDKEHKNPLWVSPESFKGDKN     959

Query:  925  YYSGNTENPKSTFLYDTEWKGTTTDGIPLEDGKYKYVLTYYSDVPGSKPQQMVFDITLDR     984
             + S +     KST L   T + G +   G   L DG Y YV++YY  DV G+K Q+M FD+ LDR
Sbjct:  960  ENS-DIRFAKSTTLLGTAFSGKSLTGAELPDGHYHYVVSYYPDVVGAKRQEMTEDMILDR    1018

Query:  985  QAPTLTTATYDKDRRIFKARPAVEHGESGIFREQVFYLKKDKDGHYNSVLRQQGEDGILV    1044
             Q P L+ AT+D +     FK  P  + G +G+ ++ VFYL++ KD     +V       + V
Sbjct: 1019  QKPVLSQATFDPETNRFKPEPLKDRGLAGVRKDSVFYLER-KDNKPYTVTINDSYKYVSV    1077

Query: 1045  EDNKVFIKQEKDGSFILPKEVNDFSHVYYTVEDYAGNLVSAKLEDLINIGNKNGLVNVKV    1104
             EDNK F++++ DGSFILP +         YY VED+AGN+  AKL D +          + +K+
Sbjct: 1078  EDNKTFVERQADGSFILPLDKAKLGDFYYMVEDFAGNVAIAKLGDHLPQTLGKTPIKLKL    1137

Query: 1105  FSPELNSNVDIDFSYSVKDDKGNIIKKQ------HHGKDLNLLKLPFGTYTFDLFLYDEE    1158
                +   +   + +     ++ Q      H  +  +L      D F+     E
Sbjct: 1138  TDGNYQTKETLKDNLEMTQSDTGLVTNQAQLAVVHRNQPQSQLT----KMNQDFFISPNE    1193

Query: 1159  RANLISPKSVTVTISEKDSLKDVLFKVNLLKKAALLVEFDKLLP-----KGATVQLVTKT    1213
                N      K      K+++ + L  VN+  K      +  K P          GA+V   +   T
Sbjct: 1194  DGN----KDEVAFKGLKNNVYNDL-TVNVYAKD----DHQKQTPIWSSQAGASVSAIEST    1244

Query: 1214  NTVVDLPKATYSPTDYGKNIPVGDYRLNVTLPSGYSTLENLDDLLVSVKEDQVNLT--KL    1271
                       A Y  T    G +  GDY+   VT        +  E+        +SV + +  +T  +
Sbjct: 1245  --------AWYGITARGSKVMPGDYQYVVTYRDEHGK-EHQKQYTISVNDKKPMITQGRF    1295

Query: 1272  TLINK----APLINALAEQTDIITQPVEYNAGTHLKNNYLANLEKAQTLIKNRVEQTSID    1327
              IN       P       + + I+ + +  VFY A     KN      ++ + + +   I       T   D
Sbjct: 1296  DTINGVDHETPDKTKALDSSGIVREEVFYLA---KKNGRKEDVTEGKDGI------TVSD    1346

Query: 1328  NAIAALRESRQALNGKETDTSLLAKAILAETEIKGNYQFVNASPL----SQSTYIN----    1379
             N +   +   +    +D  L+    +   GN  F        L            +N
Sbjct: 1347  NKVYIPKNPDGSYTISKRDGVTLSDYYYLVEDRAGNVSFATLRDLKAVGKDKAVVNFGLD    1406

Query: 1380  -QVQLAKYLLQKPNVTQSEVDKALENLDIAKNQLNGHETDYS--GLHHMITKANVLKQTS    1436
               V  K ++   + +     K +ENL+   N  N      Y   + +    N K S
Sbjct: 1407  LPVPEDKQIVNFTYLVRDADGKPIENLEYYNNSGNSLILPYGKYTVELLTYDTNAAKLES    1466

Query: 1437  SKYQNASQFAKENYNNLIKKAELLLSNR----------QATQAQVEELLNQIKATEQEL-    1485
             K + +  A  N+ +  K  +L +++            + ++ ++ +Q+    EQ L
Sbjct: 1467  DKIVSFTLSADNNFQQVTFKITMLATSQITAHFDHLLPEGSRVSLKTAQDQLIPLEQSLY    1526

Query: 1486  ----------DGRDRVSSAENYSQSLNDNDSLNTTPINPPNQPQALIFKKGMTKES----    1531
             ----------+G   V    +  N   +NT P N  ++     + KG    +S
Sbjct: 1527  VPKAYGKTVQEGTYEVVVSLPKGYRIEGNTKVNTLP-NEVHELSLRLVKVGDASDSTGDH    1585

Query: 1532  -----EVAQKRVLGVTSQTDNQKVKTNKLPKTGESTPKITYTILLFSLSMLGLATI       1582
                  +Q     T          LP TGE    K+   + +  L +LGL   +
Sbjct: 1586  KVMSKNNSQALTASATPTKSTTSATAKALPSTGE---KMGLKLRIVGLVLLGLTCV       1638
```

SEQ ID 8964 (GBS92) was expressed in *E. coli* as a His-fusion product. SDS-PAGE analysis of total cell extract is shown in FIG. 31 (lane 2; MW 48 kDa).

GBS92-His was purified as shown in FIG. 199, lane 9.

Based on this analysis, it was predicted that these proteins and their epitopes could be useful antigens for vaccines or diagnostics.

Example 2038

A DNA sequence (GBSx2149) was identified in *S. agalactiae* <SEQ ID 6299> which encodes the amino acid sequence <SEQ ID 6300>. This protein is predicted to be AzlC family protein. Analysis of this protein sequence reveals the following:

Possible site: 33
>>> Seems to have no N-terminal signal sequence

-continued

| | | |
|---|---|---|
| INTEGRAL | Likelihood = −7.80 | Transmembrane 212-228 (196-230) |
| INTEGRAL | Likelihood = −7.27 | Transmembrane 167-183 (159-185) |
| INTEGRAL | Likelihood = −5.68 | Transmembrane 189-205 (188-210) |
| INTEGRAL | Likelihood = −2.28 | Transmembrane 17-33 (13-34) |
| INTEGRAL | Likelihood = −1.06 | Transmembrane 135-151 (135-151) |
| INTEGRAL | Likelihood = −1.01 | Transmembrane 61-77 (60-77) |

----- Final Results -----
bacterial membrane --- Certainty = 0.4121(Affirmative) <succ>
bacterial outside --- Certainty = 0.0000 (Not Clear) <succ>
bacterial cytoplasm --- Certainty = 0.0000 (Not Clear) <succ>

A related GBS nucleic acid sequence <SEQ ID 10235> which encodes amino acid sequence <SEQ ID 10236> was also identified.

The protein has homology with the following sequences in the GENPEPT database.

```
>GP:AAF10212 GB:AE001921 AzlC family protein [Deinococcus radiodurans]
Identities = 72/224 (32%), Positives = 117/224 (52%), Gaps = 8/224 (3%)
Query:    6  FKEGVKDALPTALGYISIGLAFGIVASASDLSAIEVGLMSALVYGGSAQFAMCALLLAKA    65
```

```
                F  +G  +   +P   LG  +     LA+  +  A  A+  LS   +   LMS    + G++QFA    L   A   A
Sbjct:      7   FWQGFRALVPLWLGTVPFALAYAVTARAAGLSVGDTCLMSLTTFAGASQFAAAGLFGAHA    66

Query:     66   DLMTITMTVFLVNLRNMLMSLHATTIFKSAHLMNQLAIGTLITDESYGV-LLGEALHHKV    124
                 ++I  +T FL+N R++L  L       ++   L    ++      +TDE+YGV ++  A
Sbjct:     67   GGLSIVLTTFLLNARHLLYGLSLARELRLT-LPQRVVAAQFLTDEAYGVAVVSGARLPGG    125

Query:    125   VSPSWMHGNNVMSYLTWVISTIIGTLLGSTIPNPEMFGLDFALVAMFIGLFVFQLFGMLS    184
                 ++ +++   G   +  YL+W  +ST++G  L  GS  +P  PE    G+         F+GL  V          ++
Sbjct:    126   LTFAFLLGAELSLYLSWNVSTLLGALAGSVLPPPEQLGVGVVFPLAFLGLLV----PLVV    181

Query:    185   DGKRLVVYVLASVGLSYFLLATFLSGALSVLLATVVGCSVGVVL                 228
                D   RL  +  V    +  GL      +  L+    L  G  L   +LLA   V  G    +  G   L
Sbjct:    182   D--RLSLLVALAAGLGGWALSRVLPGGLVILLAGVGGALLGAAL                 223
```

No corresponding DNA sequence was identified in *S. pyogenes*.

Based on this analysis, it was predicted that this protein and its epitopes, could be useful antigens for vaccines or diagnostics.

Example 2039

A DNA sequence (GBSx2150) was identified in *S. agalactiae* <SEQ ID 6301> which encodes the amino acid sequence <SEQ ID 6302>. Analysis of this protein sequence reveals the following:

---
Possible site: 60
>>> Seems to have no N-terminal signal sequence
----- Final Results -----
  bacterial cytoplasm --- Certainty = 0.3794 (Affirmative) <succ>
   bacterial membrane --- Certainty = 0.0000 (Not Clear) <succ>
    bacterial outside --- Certainty = 0.0000 (Not Clear) <succ>
---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2040

A DNA sequence (GBSx2151) was identified in *S. agalactiae* <SEQ ID 6303> which encodes the amino acid sequence <SEQ ID 6304>. Analysis of this protein sequence reveals the following:

---
Possible site: 13
>>> Seems to have no N-terminal signal sequence
----- Final Results -----
  bacterial cytoplasm --- Certainty = 0.5087 (Affirmative) <succ>
   bacterial membrane --- Certainty = 0.0000 (Not Clear) <succ>
    bacterial outside --- Certainty = 0.0000 (Not Clear) <succ>
---

A related GBS nucleic acid sequence <SEQ ID 10233> which encodes amino acid sequence <SEQ ID 10234> was also identified.

The protein has homology with the following sequences in the GENPEPT database.

```
>GP:BAB04157 GB:AP001508 homosystein methyl transferase [Bacillus halodurans]
Identities = 397/751 (52%), Positives = 519/751 (68%), Gaps = 14/751 (1%)
Query:     10   SNLGYPRLGEQREWKQAIEAFWAGNLEQKDLEKQLKQLRINHLKKQKEAGIDLIPVGDFS    69
                SNLGYPR+GE REWK+A+E+FWA +   ++ L   +K+LR+NHL+ Q+E  +DLIPVGDF+
Sbjct:      4   SNLGYPRIGENREWKKALESFWANDTTEEQLLATMKELRLNHLRVQQEQEVDLIPVGDFT    63

Query:     70   CYDHVLDLSFQFNVIPKRFDEY--ERNLDLYFAIARGDKDNVASSMKKWFNTNYHYIVPE    127
                 YDHVLD++   F +IPKRF +       L    YFA+ARG K+   A  M KW+NTNYHYIVPE
Sbjct:     64   LYDHVLDMAVMFGIIPKRFLQQGDTPTLSTYFAMARGSKNAQACEMTKWYNTNYHTIVPE    123

Query:    128   WEVETKPHLQNNYLLDLYLEAREVVGDKAKPVITGPITYVSLSSGIVD--FEATVQRLLP    185
                 +   P  L  N   L+  YLEA+   +G      KPVI  GP ++V L+  G   +     + T+Q  LLP
Sbjct:    124   LH-DAAPRLTKNAPLEAYLEAKNELGIDGKPVILGPYSFVKLAKGYEEDKLQETIQSLLP    182

Query:    186   LYKQVFQDLIDAGATYIQIDEPIFVTDEGELLVDIAKSVYDFFAREVPQAHFIFQTYFES    245
                LY QV Q+L+DAGA  IQ+DEP  VT     + +     +Y+         +  A     QTYF++
Sbjct:    183   LYIQVIQELVDAGARSIQVDEPSLVTSISAREMALVTRIYEQINEAIADAPLFLQTYFDA    242

Query:    246   AVCLDKLSKLPVTGFGLDFIHGRAENLAAVKQ-GLFREKELFAGIVNGRNIWAVNLEETL    304
                  +++    LPV G GLDF+HG A+NL A++    G    +K  L  AGI++GRNIW   NL  E
Sbjct:    243   VTFYEEVVSLPVKGIGLDFVHGGAKNLEALRTFGFPEDKVLAAGIIDGRNIWISNLRERH    302

Query:    305   ALLEEIGPFVK+  RLTLQPSSSLLHVPVTTKYETHLDPVLKNGLSFADEKLKELELLASA    362
                 L+ ++    V      RL LQPS SLLHVPVTTK  E  LDP L      L+FA+EKL  EL   L
Sbjct:    303   ELVHQLEQHVAKDRLVLQPSCSLLHVPVTTKREEKLDPTLLGVLAFANEKLTELHILKQL    362

Query:    363   FDGNKTKGYHEALSR----FSALQAADFRHVALESL-AEVKLERSPYKLRQALQAEKLQL    417
                   GN+ +      EAL            +AL+  +  +R  A   S      E K          +  R+ LQ EK QL
Sbjct:    363   AAGNEAE-VKEALEANDDALAALEKSGWRSGAATSHNLENKKRPQSFNERRPLQEEKWQL    421

Query:    418   PILPTTTIGSFPQSPEIRKKRLAWKRGNLSDSDYKDFIKTEIRRWIAIQEDLDLDVLVHG    477
```

```
                P+LPTTTIGSFPQ+ ++R+ R  W++G LS  +Y+  +K+ I +WI IQE+L LDVLVHG
Sbjct: 422     PLLPTTTIGSFPQTKDVRRTRSLWRKGELSTVEYERTMKSYIEKWINIQEELGLDVLVHG    481

Query: 478     EFERVDMVEFFGQKLAGFTTTKLGWVQSYGSRAVKPPIIYGDVKHIQPLSLEETVYAQSL    537
                EFER DMVEFFG+KL GF  T  GWVQSYGSR VKPPIIYG+V   +P+++ ETVYAQSL
Sbjct: 482     EFERNDMVEFFGEKLDGFAFTANGWVQSYGSRCVKPPIIYGNVSFTEPMTVAETVYAQSL    541

Query: 538     TKKPVKGMLTGPITITNWSFERDDISRSDLFNQIALAIKDEIQLLEQSGIAIIQVDEAAL    597
                T KPVKGMLTGP+TI NWSF RDD+ + + +QIA A+  E+   LE++GI +IQ+DE A+
Sbjct: 542     TDKPVKGMLIGPVTILNWSFVRDDLPLTVIAHQIAEALTHEVTALEEAGIEMIQIDEPAI    601

Query: 598     REGLPLRQQKQQAYLDDAVAAFKIATSSVKDETQIHTHMCYSKFDEIIDSIRALDADVIS    657
                REGLPL+ + QQ YLD AV+AF+ + + VK   TQIHTHMCYS+F E+I++I  LDADVIS
Sbjct: 602     REGLPLKAEDQQEYLDWAVSAFRASCAHVKATTQIHTHMCYSEFHEMIEAIDDLDADVIS    661

Query: 658     IETSRSHGDIIESFETAVYPLGIGLGVYDIHSPRIPTKEEIIVNIQRSLKCLSKEQFWVN    717
                IETSRSHG++I  +FE    Y  GIGLGVYDIHSPR+P++EE++  I+R+L  L    FWVN
Sbjct: 662     IETSRSHGEMISAFEKTTYEKGIGLGVYDIHSPRVPSEEEMLNVIRRALTVLPASLFWVN    721

Query: 718     PDCGLKTRREAETIAALEVLVSATKEVRQQL                              748
                PDCGLKTR E ET+AAL+ +V+A +  R++L
Sbjct: 722     PDCGLKTRAEKETVAALKNMVAAARAAREEL                              752
```

No corresponding DNA sequence was identified in *S. pyogenes*.

Based on this analysis, it was predicted that this protein and its epitopes, could be useful antigens for vaccines or diagnostics.

Possible site: 20
>>> Seems to have no N-terminal signal sequence
----- Final Results -----
bacterial cytoplasm --- Certainty = 0.0753 (Affirmative) <succ>
bacterial membrane --- Certainty = 0.0000 (Not Clear) <succ>
bacterial outside --- Certainty = 0.0000 (Not Clear) <succ>

Example 2041

A DNA sequence (GBSx2152) was identified in *S. agalactiae* <SEQ ID 6305> which encodes the amino acid sequence <SEQ ID 6306>. This protein is predicted to be metH. Analysis of this protein sequence reveals the following:

The protein has homology with the following sequences in the GENPEPT database.

```
>GP:BAB05348 GB:AP001512 unknown conserved protein [Bacillus halodurans]
Identities = 301/610 (49%), Positives = 437/610 (71%), Gaps = 9/610 (1%)
Query:   1     MSKFLEKLKTDILVADGAMGILLYTYGLDTCHESYNVTHPEKVLAIHQAYIEAGADVIQT     60
                M+  +E LKT+ILV DGAMGTLLY  G+D C E  NVT PEK++A H AY+EAGADVIQT
Sbjct:   1     MTNLVEALKTNILVGDGAMGILLYEQGIDRCFEELNVTDPEKIVAAHVAYVEAGADVIQT     60

Query:  61     NTYGAQRHRLKNYGLEDQVVSINQAAVNIAHQATLGKETFILGTVGGFRSQRQCDLTLDN    120
                NTY A R +L  Y L+DQV+ IN+AAV +A +A    +ETF+LGT+GG RS + ++ +
Sbjct:  61     NTYAANRMKLAKYQLDDQVLEINRAAVRLARKAAK-QETFVLGTIGGIRSVQFEEVEIQE    119

Query: 121     IVEETLEQVEALLAIGQLDGLLFETYYDIEEITTVLKIVREMTDLPIITNISLHEAGVTS    180
                + +  LEQ++AL++ G +DGLL ET+YD+EE    + + R +TDLP+I ++S+ E GV
Sbjct: 120     VQDVFLEQMKALVSEG-VDGLLLETFYDLEEAKLAVSLARSLIDLPVIAHLSIAEIGVLQ    178

Query: 181     NGKPIVEALSQLVMLGADVIGLNCHLGPYHMIQSLKQVPLFAQSYLSVYPNASQLSLDGE    240
                 GK + EA ++L   LGAD++G+NC +GPY M++SL+ V L ++Y S YPNAS    D
Sbjct: 179     GGKLLEEAFAELEGLGADLVGINCRMGPYQMLRSLETVQLLLDRAYYSAYPNASLP--DYR    236

Query: 241     NSQYQFSQNSEYFGKSAELLVAEGVRLIGGCCGTTPDHIRAVKRSIRGLKPIERKVVTPI    300
                 + + + N EYF +  + V +GVRL+GGCCGTTP+H+RA  + ++GLKP+  K V
Sbjct: 237     DGRLYYHSNPEYFYEMGKRFVQQGVRLLGGCCGTTPERVRAFAKVVKGLKPVVSKPVR--    294

Query: 301     IPVKDFVRRIRRT---DTLVDKVKKEVTIIAELDPPKHLDIVQFQKAIRAIDQKGIAAIT    357
                 + +K+ +    +  + L +KVKK+ +II ELDPPK+L I +F +   A+    G+ A+T
Sbjct: 295     LEIKETLSSTGQKTAREPLAEKVKKQPSIIVELDPPKNLAIDRFVEGAAALKNAGVDAVT    354

Query: 358     LADNSLSNTRICNLSIASLLKDEISTPFLLHIACRDHNLIGLQSRLLGMELLGFNHILAI    417
                +ADNSL++ R+ NL++ ++++ ++    L+H+ CRD NLIGLQS L+G+  LG   +LAI
Sbjct: 355     MADNSLASPRVDNLALGAIIQQQVGARPLVHVTCRDRNLIGLQSHLMGLHALGMTDLLAI    414

Query: 418     TGDPTKLGDFPGATSVYDVTSFKLLSLIKQLNQGLSYSGASLRRPTDFTVAAAFNPNVKN    477
                TGDPTK+GDFPGATSVYDVTSF+L+SLIKQLN+G+S+SG    L +   +F+V AAFNPNV++
Sbjct: 415     TGDPIKVGDFPGATSVYDVTSFQLISLIKQLNEGISFSGKELGQKANFSVGAAFNPNVRH    474

Query: 478     LTRTVKLIEKKVASGADYFMTQPIFDHSVLKELADLTKTVEQPFFIGIMPITSYNNAVFL    537
                L R V+ +EKK+ +GADYFMTQPI++    ++++ + TK +E+P +IGIMP+ +  NA FL
Sbjct: 475     LERAVQRMEKKIEAGADYFMTQPIYNRKQIEDIYEATKHIEKPIYIGIMPLINGRNAEFL    534

Query: 538     HNEVPGIKLSESFLSALEKVKDDKEACLTLALNESKSLIDEALNYFNGIYLITPFLRYDL    597
                HNEVPGIKL++      + +  +D++           L +KSL+D A +YFNGIYLITPFLRY +
```

-continued
```
Sbjct: 535  HNEVPGIKLTDQIRERMARAGEDRQKGEREGLAIAKSLLDVATHYFNGIYLITPFLRYGM  594

Query: 598  TLELIDYIQK  607
            T++L  Y+++
Sbjct: 595  TVDLTHYVKE  604
```

No corresponding DNA sequence was identified in *S. pyogenes*.

Based on this analysis, it was predicted that this protein and its epitopes, could be useful antigens for vaccines or diagnostics.

Example 2042

A DNA sequence (GBSx2153) was identified in *S. agalactiae* <SEQ ID 6307> which encodes the amino acid sequence <SEQ ID 6308>. Analysis of this protein sequence reveals the following:

---

Possible site: 53
>>> Seems to have no N-terminal signal sequence
INTEGRAL    Likelihood = −9.55    Transmembrane 127-143 (121-147)
INTEGRAL    Likelihood = −1.44    Transmembrane 157-173 (155-175)
----- Final Results -----
   bacterial membrane --- Certainty = 0.4821 (Affirmative) <succ>
      bacterial outside --- Certainty = 0.0000 (Not Clear) <succ>
         bacterial cytoplasm --- Certainty = 0.0000 (Not Clear) <succ>

---

A related GBS nucleic acid sequence <SEQ ID 10231> which encodes amino acid sequence <SEQ ID 10232> was also identified.

The protein has homology with the following sequences in the GENPEPT database.

```
>GP:CAC01354 GB:AL390975 putative integral membrane protein
[Streptomyces coelicolor A3(2)]
Identities = 38/98 (38%), Positives = 59/98 (59%)
Query: 113  RIADDVARFGGSWTFIIVFVSIMAIWMLVNIMKPFGIQFDPYPFILLNLALSTIAAIQAP  172
            R+++ VARF G+  FI+     ++ +W++ N+  P G++FD YPFI L L LS  A+   AP
Sbjct:  47  RLSERVARFLGTGRFIVWMTVVIILWVVWNVSAPSGLRFDEYPFIFLTLMLSLQASYAAP  106

Query: 173  LIMMSQNRAADYDRLQARNDFNVNKTSELEIRLLHEKI  210
            LI+++QNR  D DR+    D   N+ S  +   L +I
Sbjct: 107  LILLAQNRQDDRDRVNLEQDRKQNERSIADTEYLTREI  144
```

No corresponding DNA sequence was identified in *S. pyogenes*.

Based on this analysis, it was predicted that this protein and its epitopes, could be useful antigens for vaccines or diagnostics.

A related GBS gene <SEQ ID 8965> and protein <SEQ ID 8966> were also identified. Analysis of this protein sequence reveals the following:

---

Lipop: Possible site: −1 Crend: 7
McG: Discrim Score: −3.84
GvH: Signal Score (−7.5): −5.05
Possible site: 53
>>> Seems to have no N-terminal signal sequence
ALOM program    count: 2 value: −9.55 threshold: 0.0
INTEGRAL    Likelihood = −9.55    Transmembrane 127-143 (121-147)
INTEGRAL    Likelihood = −1.44    Transmembrane 157-173 (155-175)
PERIPHERAL  Likelihood = 5.46     27
modified ALOM score: 2.41
*** Reasoning Step: 3
----- Final Results -----
   bacterial membrane --- Certainty = 0.4821 (Affirmative) <succ>
      bacterial outside --- Certainty = 0.0000 (Not Clear) <succ>
         bacterial cytoplasm --- Certainty = 0.0000 (Not Clear) <succ>

---

The protein has homology with the following sequences in the databases:

```
ORF01598(637-930 of 1341)
GP|9714438|emb|CAC01354.1||AL390975(47-144 of 198) putative integral membrane protein
{Streptomyces coelicolor A3(2)}
% Match = 8.2
% Identity = 38.8 % Similarity = 61.2
Matches = 38 Mismatches = 38 Conservative Sub.s = 22

600       630       660       690       720       750       780       810
MKEEEKPFNVEERLNKQATIGQRIADDVARFGGSWTFIIVFVSIMAIWMLVNIMKPFGIQFDPYPFILLNLALSTIAAIQ
 |::: |||| |:    |:    |  ||||| |:    :: :|::  |:    | ::|| ||||:|   ||   |  :
RLDQPRPPRRRLLPEWDPESFGRLSERVARFLGTGRFIVWMTVVIILWVVWNVSAPSGLRFDEYPFIFLTLMLSLQASYA
       40        50        60        70        80        90       100

840       870       900       930       960       990      1020      1050
APLIMMSQNRAADYDRLQARNDFNVNKTSELEIRLLHEKIDHMVQQDQFELLEIQKLQTEMLVSLGNQLAQLKQLQK*SF
|||:::|||  | ||:    |  |:  |    | :|
APLILLAQNRQDDRDRVNLEQDRKQNERSIADTEYLTREIAALRIGLGEVATRDWIRSELQDLVRDLEERQNGHHPDRGV
      120       130       140       150       160       170       180
```

SEQ ID 8966 (GBS393) was expressed in *E. coli* as a His-fusion product. SDS-PAGE analysis of total cell extract is shown in FIG. 75 (lane 3; MW 30.8 kDa). It was also expressed in *E. coli* as a GST-fusion product. SDS-PAGE analysis of total cell extract is shown in FIG. 177 (lane 4; MW 56 kDa) and in FIG. 83 (lane 6; MW 56 kDa).

GBS393-GST was purified as shown in FIG. 217, lane 5.

Example 2043

A DNA sequence (GBSx2154) was identified in *S. agalactiae* <SEQ ID 6309> which encodes the amino acid sequence <SEQ ID 6310>. Analysis of this protein sequence reveals the following:

---

Possible site: 36
>>> Seems to have no N-terminal signal sequence
INTEGRAL    Likelihood = −3.29   Transmembrane 274-290 (271- 291)
----- Final Results -----
  bacterial membrane --- Certainty = 0.2317 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the GENPEPT database.

```
>GP:AAD35508 GB:AE001721 glycerol dehydrogenase [Thermotoga maritima]
Identities = 94/307 (30%), Positives = 157/307 (50%), Gaps = 21/307 (6%)
Query:   63  VYGTDSTQSNIDKLVANPQVQAADAILGFGGGKALDTAKMVAKELGKNSFTIPTICSNCS    122
             ++G + +   I++L    + +  D ++G GGGK LDTAK VA +L K     +PTI S  +
Sbjct:   62  IFGGECSDEEIERLSGLVE-EETDVVVGIGGGKTLDTAEAVAYKLKKPVVIVPTIASTDA    120

Query:  123  AGTAIAVVYNDDHSFLRYGY-PESPLHIFINTRIIAQAPSKYFWAGIGDGISKAPEVERA    181
               +A++V+Y  +   F RY + P +P  + ++T I+A+AP+++  AG+GD ++   E E
Sbjct:  121  PCSALSVIYTPNGEFKRYLFLPRNPDVVLVDTEIVAKAPARFLVAGMGDALATWFEAESC    180

Query:  182  TLEAKTNKLPHT-AVLGQAVALSSKEAFYQFGEQGLKDVEANLASRAVEEI--ALDILIS    238
               +    N     ++  A+A   E   ++G   + VE   + A+E+I  A  +L
Sbjct:  181  KQKYAPNMTGRLGSMTAYALARLCYETLLEYGVLAKRSVEEKSVTPALEKIVEANTLLSG    240

Query:  239  TGYASNLVNQPDFYYNSCHAHAFYYGTTAIQRQGEFLHGVVVAFGVLV-LHAYFNELEEL    297
               G+ S                AHA + G T ++   ++LHG  VA GVL  L    + +
Sbjct:  241  LGFESG---------GLAAAHAIHNGLTVLENTHKYLHGEKVAIGVLASLFLTDKPRKMI    291

Query:  298  EKVARFNKSLGLPTTLADVSL---SEKDIPKIVEIAMTTNE---YKNTPFDPKMFAQAIL    351
             E+V  F + +GLPTTLA++ L   S++D+ K+ E A   NE     + P    K  A+
Sbjct:  292  EEVYSFCEEVGLPTTLAEIGLDGVSDEDLMKVAEKACDKNETIHNEPQPVTSKDVFFALK    351

Query:  352  AADAFGQ                                                        358
             AAD +G+
Sbjct:  352  AADRYGR                                                        358
```

There is also homology to SEQ ID 3078.

SEQ ID 6310 (GBS123) was expressed in *E. coli* as a His-fusion product. SDS-PAGE analysis of total cell extract is shown in FIG. 29 (lane 7; MW 43.3 kDa).

Based on this analysis, it was predicted that this protein and its epitopes, could be useful antigens for vaccines or diagnostics.

Example 2044

A DNA sequence (GBSx2155) was identified in *S. agalactiae* <SEQ ID 6311> which encodes the amino acid sequence <SEQ ID 6312>. Analysis of this protein sequence reveals the following:

---

Possible site: 39
>>> Seems to have no N-terminal signal sequence
----- Final Results -----
  bacterial cytoplasm --- Certainty = 0.0974 (Affirmative) <succ>
    bacterial membrane --- Certainty = 0.0000 (Not Clear) <succ>
      bacterial outside --- Certainty = 0.0000 (Not Clear) <succ>

---

A related DNA sequence was identified in *S. pyogenes* <SEQ ID 6313> which encodes the amino acid sequence <SEQ ID 6314>. Analysis of this protein sequence reveals the following:

---

Possible site: 17
>>> Seems to have no N-terminal signal sequence
----- Final Results -----

-continued bacterial cytoplasm --- Certainty = 0.2368 (Affirmative) <succ>
    bacterial membrane --- Certainty = 0.0000 (Not Clear) <succ>
      bacterial outside --- Certainty = 0.0000 (Not Clear) <succ>

---

An alignment of the GAS and GBS proteins is shown below.

```
Identities = 92/167 (55%), Positives = 121/167 (72%)
Query:    1  MKIAIIGYSGSGKSTLARKLGNYYNCNVLHLDSIHFAPNWEERKYDDMIDDVSNMLEKRT    60
             +KIAIIG+SGSGKSTLAR LG +Y+C V HLD +HF+ NW+ER  DMI D+S  L K+
Sbjct:    1  LKIAIIGHSGSGKSTLARFLGQHYHCEVFHLDQLHFSSNWQERSDHDMIADLSTCLLKQD    60

Query:   61  WIIEGNYKKLLYQERLADADEIIFFDFNRFNCLWRAFKRYCKFRGKTRPDMANGCPEKLD   120
             +IEGNY    LY+ER+++AD II+  +F+RF+C++RAFKRY  +RGKTRPDMA+ C EK D
Sbjct:   61  LIIEGNYANCLYEERMSEADYIIYVNFSRFHCVYRAFKRYLNYRGKTRPDMADNCQEKFD   120
```

```
                            -continued
Query: 121  FEFISWILKDGRSDKQKSNYKQVVEDYPQKIKILKHQRDLDQYLKEL       167
            F+ WIL DGRS Q   Y+ VV+ Y  K  +L +Q+ L Y+    +
Sbjct: 121  VAFVKWILLDGRSRNQLKKYQSVVQKYSHKTIVLTNQKQLSHYMNTI       167
```

Based on this analysis, it was predicted that this protein and its epitopes, could be useful antigens for vaccines or diagnostics.

Example 2045

A DNA sequence (GBSx2156) was identified in *S. agalactiae* <SEQ ID 6315> which encodes the amino acid sequence <SEQ ID 6316>. Analysis of this protein sequence reveals the following:

Possible site: 55
>>> Seems to have no N-terminal signal sequence
----- Final Results -----
    bacterial cytoplasm --- Certainty = 0.3874 (Affirmative) <succ>
      bacterial membrane --- Certainty = 0.0000 (Not Clear) <succ>
        bacterial outside --- Certainty = 0.0000 (Not Clear) <succ>

The protein has homology with the following sequences in the GENPEPT database.

```
>GP:CAA41941 GB:X59250 initiation factor IF-1 [Lactococcus lactis]
Identities = 62/72 (86%), Positives = 70/72 (97%)
Query:  1   MAKEDVIEIEGKVVETMPNAMFTVELENGHQILATVSGKIRKNYIRILVGDRVTVEMSPY   60
            MAK+DVIE++GKVV+TMPNAMFTVELENGHQ+LAT+SGKIRKNYIRIL GD+V VE+SPY
Sbjct:  1   MAKDDVIEVDGKVVDTMPNAMFTVELENGHQVLATISGKIRKNYIRILPGDKVQVELSPY   60

Query: 61   DLTRGRITYRFK                                                  72
            DLTRGRITYRFK
Sbjct: 61   DLTRGRITYRFK                                                  72
```

A related DNA sequence was identified in *S. pyogenes* <SEQ ID 6317> which encodes the amino acid sequence <SEQ ID 6318>. Analysis of this protein sequence reveals the following:

Possible site: 50
>>> Seems to have no N-terminal signal sequence
----- Final Results -----
    bacterial cytoplasm --- Certainty = 0.3253 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below.

Based on this analysis, it was predicted that this protein and its epitopes, could be useful antigens for vaccines or diagnostics.

Example 2046

A DNA sequence (GBSx2157) was identified in *S. agalactiae* <SEQ ID 6319> which encodes the amino acid sequence <SEQ ID 6320>. This protein is predicted to be adenylate kinase (adk). Analysis of this protein sequence reveals the following:

Possible site: 17
>>> Seems to have no N-terminal signal sequence
----- Final Results -----
    bacterial membrane --- Certainty = 0.0000 (Not Clear) <succ>
      bacterial outside --- Certainty = 0.0000 (Not Clear) <succ>
        bacterial cytoplasm --- Certainty = 0.0000 (Not Clear) <succ>

The protein has homology with the following sequences in the GENPEPT database.

```
Identities = 67/67 (100%), Positives = 67/67 (100%)
Query:  6   VIEIEGKVVETMPNAMFTVELENGHQILATVSGKIRKNYIRILVGDRVTVEMSPYDLTRG   65
            VIEIEGKVVETMPNAMFTVELENGHQILATVSGKIRKNYIRILVGDRVTVEMSPYDLTRG
Sbjct:  1   VIEIEGKVVETMPNAMFTVELENGHQILATVSGKIRKNYIRILVGDRVTVEMSPYDLTRG   60

Query: 66   RITYRFK                                                        72
            RITYRFK
Sbjct: 61   RITYRFK                                                        67
```

```
>GP:CAA41940 GB:X59250 adenylate kinase [Lactococcus lactis]
Identities = 146/214 (68%), Positives = 170/214 (79%), Gaps = 6/214 (2%)
Query:   1  MNLLIMGLPGAGKGTQAAKIVEEFGVAHISTGDMFRAAMANQTEMGRLAKSYIDKGELVP    60
            MNLLIMGLPGAGKGTQA  IV+ +GV HISTGDMFRAAM N+TEMG+LAKS+IDKGELVP
Sbjct:   1  MNLLIMGLPGAGKGTQAEFIVKNYGVNHISTGDMFRAAMKNETEMGKLAKSFIDKGELVP    60

Query:  61  DEVTNGIVEERLAEDDIAEKGFLLDGYPRTIEQAHALDATLEELGLRLDGVINIKVDPSC   120
            DEVTNGIVKERLA+DDI   GFLLDGYPRTI+QAHALD  LEELG++LD V+NI V+P+
Sbjct:  61  DEVTNGIVKERLAQDDIKASGFLLDGYPRTIDQAHALDTMLEELGIKLDAVVNIVVNPNI   120

Query: 121  LIERLSGRIINRKTGETFHKVFNPPV------DYKEEDYYQREDDKPETVKRRLDVNIAQ   174
            L++RLSGR I R  G T+HK+FNP         D YQR DD PETVK RLDVNI +
Sbjct: 121  LVDRLSGRYICRNCGATYHKIFNPTKVEGTCDVCGSHDLYQRADDVPETVKNRLDVNIKE   180

Query: 175  GEPILEHYRKLGLVTDIEGNQEITEVFADVEKAL                            208
               PI+EHY +LGLV +IEG QEI++V D++K L
Sbjct: 181  SAPIIEHYTELGLVKNIEGEQEISQVTDDIKKVL                            214
```

A related DNA sequence was identified in *S. pyogenes* <SEQ ID 6321> which encodes the amino acid sequence <SEQ ID 6322>. Analysis of this protein sequence reveals the following:

Possible site: 17
>>> Seems to have no N-terminal signal sequence
----- Final Results -----
   bacterial membrane --- Certainty = 0.0000 (Not Clear) <succ>
    bacterial outside --- Certainty = 0.0000 (Not Clear) <succ>
     bacterial cytoplasm --- Certainty = 0.0000 (Not Clear) <succ>

Lipop: Possible site: −1 Crend: 0
McG: Discrim Score: −1.04
GvH: Signal Score (−7.5): −1.08
Possible site: 17
>>> Seems to have no N-terminal signal sequence
ALOM program   count: 0 value: 6.79 threshold: 0.0
PERIPHERAL          Likelihood = 6.79      106
modified ALOM score: −1.86
*** Reasoning Step: 3
----- Final Results -----
   bacterial membrane --- Certainty = 0.0000 (Not Clear) <succ>
    bacterial outside --- Certainty = 0.0000 (Not Clear) <succ>
     bacterial cytoplasm --- Certainty = 0.0000 (Not Clear) <succ>

An alignment of the GAS and GBS proteins is shown below.

```
Identities = 208/212 (98%), Positives = 212/212 (99%)
Query:   1  MNLLIMGLPGAGEGTQAAKIVEEFGVAHISTGDMFRAAMANQTEMGRLAKSYIDKGELVP    60
            M LLIMGLPGAGKGTQAAKIVEEFG+AHISTGDMFRAAMANQTEMGRLAKSYIDEGELVP
Sbjct:   1  MNLLIMGLPGAGKGTQAAKIVEEFGIAHISTGDMFRAAMANQTEMGRLAKSYIDKGELVP    60

Query:  61  DEVTNGIVEERLAEDDIAEKGFLLDGYPRTIEQAHALDATLEELGLRLDGVINIKVDPSC   120
            DEVTNGIVKERLAEDDIAEKGELLDGYPRTIEQAHALDATLEELGLRLDGVINIKVDPSC
Sbjct:  61  DEVTNGIVKERLAEDDIAEKGFLLDGYPRTIEQAHALDATLEELGLRLDGVINIKVDPSC   120

Query: 121  LIERLSGRIINRKTGETFHKVFNPPVDYKEEDYYQREDDKPETVKRRLDVNIAQGEPILE   180
            L+ERLSGRIINRKTGETFHKVFNPPVDYKEEDYYQREDDKPETVERRLDVN+AQGEPILE
Sbjct: 121  LVERLSGRIINRKTGETFHKVENPPVDYKEEDYYQREDDEPETVERRLDVNMAQGEPILE   180

Query: 181  HYRKLGLVTDIEGNQEITEVFADVEKALLELK                              212
            HYRKLGLVTDIEGNQEIT+VFADVEKALLELK
Sbjct: 181  HYRKLGLVTDIEGNQEITDVFADVEKALLELK                              212
```

Based on this analysis, it was predicted that this protein and its epitopes, could be useful antigens for vaccines or diagnostics.

A related GBS gene <SEQ ID 8967> and protein <SEQ ID 8968> were also identified. Analysis of this protein sequence reveals the following:

The protein has homology with the following sequences in the databases:

```
over 213aa
Lactococcus lactis
EGAD|8612| adenylate kinase Insert characterized
SP|P27143|KAD_LACLA ADENYLATE KINASE (EC 2.7.4.3) (ATP-AMP TRANSPHOSPHORYLASE). Edit
characterized
GP|44074|emb|CAA41940.1||X59250 adenylate kinase Insert characterized
PIR|S17987|S17987 adenylate kinase (EC 2.7.4.3) - subsp. lactis Insert characterized
PIR|B44812|B44812 adenylate kinase (EC 2.7.4.3) - Insert characterized
ORF01658(301-924 of 1236)
EGAD|8612|8416(1-214 of 215) adenylate kinase {Lactococcus lactis}SP|P27143|KAD_LACLA
ADENYLATE KINASE (EC 2.7.4.3) (ATP-AMP TRANSPHOSPHORYLASE).GP|44074|emb|CAA41940.1||X59250
adenylate kinase {Lactococcus lactis}PIR|S17987|S17987 adenylate kinase (EC 2.7.4.3) -
Lactococcus lactis subsp. lactisPIR|B44812|B44812 adenylate kinase (EC 2.7.4.3) -
```

-continued

```
Lactococcus lactis
% Match = 34.8
% Identity = 69.5 % Similarity = 81.0
Matches = 146 Mismatches = 38 Conservative Sub.s = 24

132       162       192       222       252       282       312       342
QAYSF*LQRVLKV*NNSRAIF*RDAMLDS*IQQNRI*VDSVNLLFCFLISPTCCVGFI*KQNKETIMNLLIMGLPGAGKG
                                                          ||||||||||||||||
                                                          MNLLIMGLPGAGKG
                                                                       10

372       402       432       462       492       522       552       582
TQAAKIVEEFGVAHISTGDMFRAAMANQTEMGRLAKSYIDKGELVPDEVTNGIVKERLAEDDIAEKGFLLDGYPRTIEQA
|||   ||: :|| ||||||||||||| |:||||:|||||:||||||||||||||||||:||| ||||||||||||:||
TQAEFIVKNYGVNHISTGDMFRAAMKNETEMGKLAKSFIDKGELVPDEVTNGIVKERLAQDDIKASGFLLDGYPRTIDQA
          30        40        50        60        70        80        90

612       642       672       702       732             774       804
HALDATLEELGLRLDGVINIKVDPSCLIERLSXRIINRKTGETFHKVFNPP-----VDY-KEEDYYQREDDKPETVKRRL
||||   |||||::||  |:||  |:|:  |::|||    |   |:||:|||      |   | ||| || |||||  ||
HALDTMLEELGIKLDAVVNIVVNPNILVDRLSGRYICRNCGATYHKIFNPTKVEGTCDVCGSHDLYQRADDVPETVKNRL
          110       120       130       140       150       160       170

834       864       894       924       954       984       1014      1044
DVNIAQGEPILEHYRKLGLVTDIEGNQEITEVFADVEKALLELK*IMLIYLHK*ISNDILS*SDL*LLPLYRGHQIEI*G
||||  :   ||:|||  :||||  |||  |||::|  |::|  | ||
DVNIKESAPIIEHYTELGLVKNIEGEQEISQVTDDIKKVLG
          190       200       210
```

SEQ ID 8968 (GBS114) was expressed in *E. coli* as a His-fusion product. SDS-PAGE analysis of total cell extract is shown in FIG. 29 (lane 9; MW 26.9 kDa).

The GBS114-His fusion product was purified (FIG. 108A; see also FIG. 200, lane 8) and used to immunise mice (lane 1+2+3 product; 20µg/mouse). The resulting antiserum was used for Western blot (FIG. 108B), FACS (FIG. 108C), and in the in vivo passive protection assay (Table III). These tests confirm that the protein is immunoaccessible on GBS bacteria and that it is an effective protective immunogen.

Example 2047

A DNA sequence (GBSx2158) was identified in *S. agalactiae* <SEQ ID 6323> which encodes the amino acid sequence <SEQ ID 6324>. This protein is predicted to be preprotein translocase secy subunit (secY). Analysis of this protein sequence reveals the following:

Possible site: 35
>>> Seems to have an uncleavable N-term signal seg
INTEGRAL    Likelihood = −14.01    Transmembrane 217-233 (209-240)
INTEGRAL    Likelihood = −8.65     Transmembrane 314-330 (307-334)
INTEGRAL    Likelihood = −6.16     Transmembrane 369-385 (363-392)

INTEGRAL    Likelihood = −5.36    Transmembrane 19-35 (17-40)
INTEGRAL    Likelihood = −3.93    Transmembrane 180-196 (179-199)
INTEGRAL    Likelihood = −3.03    Transmembrane 395-411 (392-412)
INTEGRAL    Likelihood = −2.55    Transmembrane 151-167 (151-168)
INTEGRAL    Likelihood = −2.02    Transmembrane 117-133 (117-133)
INTEGRAL    Likelihood = −0.64    Transmembrane 270-286 (269-286)
----- Final Results -----
   bacterial membrane --- Certainty = 0.6604 (Affirmative) <succ>
   bacterial outside --- Certainty = 0.0000 (Not Clear) <succ>
   bacterial cytoplasm --- Certainty = 0.0000 (Not Clear) <succ>

A related GBS nucleic acid sequence <SEQ ID 9467> which encodes amino acid sequence <SEQ ID 9468> was also identified.

The protein has homology with the following sequences in the GENPEPT database.

```
>GP:CAA41939 GB:X59250 SecY protein [Lactococcus lactis]
Identities = 292/433 (67%), Positives = 361/433 (82%), Gaps = 2/433 (0%)
Query:    1  MFLKLLRDALKVKMVRNKILFTIPILLVFRIGTHITVPGINVKSLEQMGELPFLNMLNLV    60
             MF K L++A KVK VR +ILFTIFIL VFR+G HIT PG+NV++L+Q+ +LPFL+M+NLV
Sbjct:    1  MFFKTLKEAFKVKDVRARILFTIFILFVFRLGAHITAPGVNVQNLQQVADLPFLSMMNLV    60

Query:   61  SGNAMRNFSVFSMGVSPYITASIVVQLLQMDILPKFVEWGKQGEVGRRKLNQATRYISLF   120
             SGNAM+N+S+F+MGVSPYITASI+VQLLQMDILPKFVEW KQGE+GRRKLNQATRYI+L
Sbjct:   61  SGNAMQNYSLFAMGVSPYITASIIVQLLQMDILPKFVEWSKQGEIGRRKLNQATRYITLV   120

Query:  121  LAFVQSIGITAGFNTLSSVALVKIPNVQTYLLIGAILTIGSMVVTWLGEQIIDKGFGNGV   180
             LA  QSIGITAGF +SS+ +V+ PN Q+YL+IG +LTIGSMVVTW+GEQI +KGFG+GV
Sbjct:  121  LAMAQSIGITAGFQAMSSLNIVQNPNWQSYLMIGVLLTTGSMVVTWMGEQINEKGFGSGV   180
```

```
Query: 181  SMIIFAGIISSIPSAITTIYEDFFVNVRSSAITNSYIFVGILIVAVLAIVFFTTFIQQAE  240
            S+IIFAGI+S IPSAI ++Y++ F+NVR S I  S+IFV  LI++ + I++ TTF+QQAE
Sbjct: 181  SVIIFAGIVSGIPSAIKSVYDEKFLNVRPSEIPMSWIFVGLILSAIVIIYVTTFVQQAE  240

Query: 241  YKIPIQYTKLVQGAPTSSYLPLKVNPAGVIPVIFASSITTIPSTIIPFFQ--NGKEIPWL  298
            K+PIQYTKL QGAPTSSYLPL+VNPAGVIPVIFA SITT P+TI+ F Q    G  + WL
Sbjct: 241  RKVPIQYTKLIQGAPTSSYLPLRVNPAGVIPVIFAGSITTAPATILQFLQRSQGSNVGWL  300

Query: 299  TKLQELLNYQTPVGMIIYAILIILFSFFYIFVQVNPEKTAENLQKNSSYIPSIRPGRETE  358
            + LQ  L+Y T  GM+ YA+LI+LF+FFY+FVQVNPEK AENLQK  SYIPS+RPG+ TE
Sbjct: 301  STLQNALSYTTWTGMLFYALLIVLFIFFYSFVQVNPEKMAENLQKQGSYIPSVRPGKGTE  360

Query: 359  EYMSSLLKKLATIGSVFLAFISLLPIIAQQALHLSSSIALGGTSLLILIATGIEGMKQLE  418
            +Y+S LL +LAT+GS+FL  IS++PI AQ    L   +ALGGTSLLILI  I+ +KQLE
Sbjct: 361  KYVSRLLMRLATVGSLFLGLISIIPIAAQNVWGLPKIVALGGISLLILIQVAIQAVKQLE  420

Query: 419  GYLLKRRYVGFMN  431
            GYLLKR+Y GFM+
Sbjct: 421  GYLLKRKYAGFMD  433
```

A related DNA sequence was identified in *S. pyogenes* <SEQ ID 3987> which encodes the amino acid sequence <SEQ ID 3988>. Analysis of this protein sequence reveals the following:

Possible site: 55
>>> Seems to have an uncleavable N-term signal seq

| | | |
|---|---|---|
| INTEGRAL | Likelihood = −14.70 | Transmembrane 233-249 (226-255) |
| INTEGRAL | Likelihood = −8.12 | Transmembrane 330-346 (323-350) |
| INTEGRAL | Likelihood = −6.10 | Transmembrane 384-400 (378-403) |
| INTEGRAL | Likelihood = −5.20 | Transmembrane 35-51 (33-56) |
| INTEGRAL | Likelihood = −4.09 | Transmembrane 199-215 (195-215) |
| INTEGRAL | Likelihood = −3.56 | Transmembrane 167-183 (165-184) |
| INTEGRAL | Likelihood = −1.65 | Transmembrane 411-427 (411-428) |
| INTEGRAL | Likelihood = −1.49 | Transmembrane 133-149 (133-149) |
| INTEGRAL | Likelihood = −0.64 | Transmembrane 286-302 (285-302) |

----- Final Results -----
bacterial membrane --- Certainty = 0.6880 (Affirmative) <succ>
bacterial outside --- Certainty = 0.0000 (Not Clear) <succ>
bacterial cytoplasm --- Certainty = 0.0000 (Not Clear) <succ>

An alignment of the GAS and GBS proteins is shown below.

```
Identities = 377/434 (86%), Positives = 417/434 (95%)

Query:   1  MFLKLLRDALKVKMVRNKILFTIFILLVFRIGTHITVPGINVKSLEQMGELPFLNMLNLV   60
            MFLK+L+DALK+K VRNKI FTIFI+LVFRIGTHITVPG+N KSLEQ+ ELPFLNMLNLV
Sbjct:  17  MFLKILKDALKIKTVRNKIFFTIFIILVFRIGTHITVPGVNAKSLEQLSELPFLNMLNLV   76

Query:  61  SGNAMRNFSVFSMGVSPYITASIVVQLLQMDILPKFVEWGKQGEVGRRKLNQATRYISLF  120
            SGNAMRNFSVFSMGVSPYITASIVVQLLQMDILPKFVEWGKQGEVGRRKLNQATRYISL
Sbjct:  77  SGNAMRNFSVFSMGVSPYITASIVVQLLQMDILPKFVEWGKQGEVGRRKLNQATRYISLV  136

Query: 121  LAFVQSIGITAGFNTLSSVALVKTPNVQTYLLIGAILTTGSMVVTWLGEQITDKGFGNGV  180
            LAF QSIGITAGFNTLS+VALVKTP+++TYLLIGA+LTTGS++VTWLGEQIIDKGFGNGV
Sbjct: 137  LAFAQSIGITAGFNTLSNVALVKTPDIKTYLLIGALLTTGSVIVTWLGEQITDKGFGNGV  196

Query: 181  SMIIFAGIISSIPSAITTIYEDFFVNVRSSAITNSYIFVGILIVAVLAIVFFTTFIQQAE  240
            SMIIFAGIISSIPSAI TI ED+FVNV++S + +SY+ VGILI+AVLAIVFFTT++QQAE
Sbjct: 197  SMIIFAGIISSIPSAIATIREDYFVNVKASDLHSSYLIVGILIIAVLAIVFFTTYVQQAE  256

Query: 241  YKIPIQYTKLVQGAPTSSYLPLKVNPAGVIPVIFASSITTIPSTIIPFFQNGKEIPWLTK  300
            YKIPIQYTKL+QGAPTSSYLPLKVNPAGVIPVIFASSITTIPSTIIPF QNG+++PWL +
Sbjct: 257  YKIPIQYTKLMQGAPTSSYLPLKVNPAGVIPVIFASSITTIPSTIIPFVQNGRDLPWLNR  316

Query: 301  LQELLNYQTPVGMIIYAILIILFSFFYIFVQVNPEKTAENLQKNSSYIPSIRPGRETEEY  360
            LQE+ NYQTPVGMI+YA+LIILFSFFYTFVQVNPEKTAENLQKNSSYIPS+RPGRETE++
Sbjct: 317  LQEIFNYQTPVGMIVYALLIILFSFFYTFVQVNPEKTAENLQKNSSYIPSVRPGRETEQF  376

Query: 361  MSSLLKKLATIGSVFLAFISLLPIIAQQALHLSSSIALGGTSLLILIATGIEGMKQLEGY  420
            MS+LLKKLAT+G++FLAFISL PI AQQAL+LSSSIALGGTSLLILI+TGIEGMKQLEGY
```

-continued
```
Sbjct: 377  MSALLKKLATVGAIFLAFISLAPIAQQALNLSSSIALGGTSLLILISTGIEGMKQLEGY  436

Query: 421  LLKRRYVGFMNTTE                                              434
            LLKR+YVGFMNT E
Sbjct: 437  LLKRKYVGFMNTAE                                              450
```

A related GBS gene <SEQ ID 8969> and protein <SEQ ID 8970> were also identified. Analysis of this protein sequence reveals the following:

```
Lipop: Possible site: -1 Crend: 10
McG: Discrim Score: 6.16
GvH: Signal Score (-7.5): -4.32
Possible site: 35
>>> Seems to have an uncleavable N-term signal seq
ALOM program    count: 9 value: -14.01 threshold: 0.0
INTEGRAL    Likelihood = -14.01   Transmembrane 217-233 (209-240)
INTEGRAL    Likelihood = -9.98    Transmembrane 311-327 (307-334)
INTEGRAL    Likelihood = -6.16    Transmembrane 369-385 (363-392)
INTEGRAL    Likelihood = -5.36    Transmembrane 19-35 (17-40)
INTEGRAL    Likelihood = -3.93    Transmembrane 180-196 (179-199)
```

-continued

```
INTEGRAL    Likelihood = -3.03    Transmembrane 395-411 (392-412)
INTEGRAL    Likelihood = -2.55    Transmembrane 151-167 (151-168)
INTEGRAL    Likelihood = -2.02    Transmembrane 117-133 (117-133)
INTEGRAL    Likelihood = -0.64    Transmembrane 270-286 (269-286)
PERIPHERAL  Likelihood = 0.95     69
modified ALOM score: 3.30
*** Reasoning Step: 3
----- Final Results -----
    bacterial membrane --- Certainty = 0.6604 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the databases:

```
ORF01657(301-1596 of 1902)

EGAD|6545|6344(1-434 of 439) preprotein translocase secy subunit {Lactococcus lactis}
SP|P27148|SECY_LACLA PREPROTEIN TRANSLOCASE SECY SUBUNIT. GP|44073|emb|CAA41939.1||X59250
SecY protein {Lactococcus lactis} PIR|S17985|S17985 preprotein translocase secY -
Lactococcus lactic subsp. lactis
% Match = 46.6
% Identity = 67.0 % Similarity = 84.1
Matches = 290 Mismatches = 68 Conservative Sub.s = 74

72        102       132       162       192       222       252       282
          HQCKRICSCEP*PIKCL*RWY*SNSSCS*RSWNRAC*KIRR*NSW*W*IN*EIVC*SS*IF*IC*SSYHC*RWFNRSHLI 312       342       372       402       432       462       492       522
          NER*LIMFLKLLRDALKVKMVRNKILFTIFILLVFRIGTHITVPGINVKSLEQMGELPFLNMLNLVSGNAMRNFSVFSMG
                ||:|  |::|:|||  ||  :||||||:|||:|  |||  ||:|::|:|:  :||||:|:|||||||:|:|:|:||
                MFFKTLKEAFKVKDVRARILFTIFILFVFRLGAHITAPGVNVQNLQQVADLPFLSMMNLVSGNAMQNYSLFAMG
                  10        20        30        40        50        60        70

552       582       612       642       672       702       732       762
          VSPYITASIVVQLLQMDILPKFVEWGKQGEVGRRKLNQATRYISLFLAFVQSIGITAGFNTLSSVALVKTPNVQTYLLIG
          ||||||||:|||||||||||||||| ||||:||||||||||||  |  ||||||||||||    :||:  :|: || |:||:||
          VSPYITASIIVQLLQMDILPKFVEWSKQGEIGRRKLNQATRYITLVLAMAQSIGITAGFQAMSSLNIVQNPNWQSYLMIG
                  90        100       110       120       130       140       150

792       822       852       882       912       942       972       1002
          AILTTGSMVVTWLGEQITDKGFGNGVSMIIFAGIISSIPSAITTIYEDFFVNVRSSAITNSYIFVGILIVAVLAIVFFTT
          :||||||||||||||  :||||  :|||||||||:|  ||::|:|  ||||   |:|||    ||  |    |::    :  |::
          VLLTTGSMVVTWMGEQINEKGFGSGVSVIIFAGIVSGIPSAIKSVYDEKFLNVRPSEIPMSWIFVIGLILSAIVIIYVTT
                  170       180       190       200       210       220       230

1032      1062      1092      1122      1152      1176      1206      1236
          FIQQAEYKIPIQYTKLVQGAPTSSYLPLKVNPAGVIPVIFASSITTIPSTIIPFFQ--NGKEIPWLTKLQELLNYQTPVG
          |:||| |:||||||| ||||||||||||||:||||||||||:||||  |:||: |:|      :  ||: ||  |:|    |
          FVQQAERKVPIQYTKLTQGAPTSSYLPLRVNPAGVIPVIFAGSITTAPATILQFLQRSQGSNVGWLSTLQNALSYTTWTG
                  250       260       270       280       290       300       310

1266      1296      1326      1356      1386      1416      1446      1476
          MIIYAILIILFSFFXTFXQVNPEKTAENLQKNSSYIPSIRPGRETEEYMSSLLKKLATIGSVFLAFISLLPIIAQQALHL
          |: ||:||:||:||  :|   ||||||  ||||||  ||||:|||  ||:|:|  ||  :|||:||:||  :|||:||:|  :  ||
          MLFYALLIVLFTFFYSFVQVNPEKMAENLQKQGSYIPSVRPGKGTEKYVSRLLMRLATVGSLFLGLISIIPIAAQNVWGL
                  330       340       350       360       370       380       390

1506      1536      1566      1596      1626      1656      1686      1716
          SSSIALGGTSLLILIATGIEGMKQLEGYLLKRRYVGFMNTTE*NIG*LCQPSILFFNKSDMLCWIYLKTK*GDYNESFNY
          :||||||||||||||  |:  :||||||||||:| |||:|
          PKIVALGGTSLLILIQVAIQAVKQLEGYLLKRKYAGFMDNPLETK
                  410       420       430
```

Based on this analysis, it was predicted that these proteins and their epitopes could be useful antigens for vaccines or diagnostics.

Example 2048

A DNA sequence (GBSx2159) was identified in *S. agalactiae* <SEQ ID 6325> which encodes the amino acid sequence <SEQ ID 6326>. This protein is predicted to be 50S ribosomal protein L15 (rplO). Analysis of this protein sequence reveals the following:

Possible site: 59
>>> Seems to have no N-terminal signal sequence
----- Final Results -----
   bacterial cytoplasm --- Certainty = 0.5259 (Affirmative) <succ>
      bacterial membrane --- Certainty = 0.0000 (Not Clear) <succ>
         bacterial outside --- Certainty = 0.0000 (Not Clear) <succ>

The protein has homology with the following sequences in the GENPEPT database.

```
>GP:AAB54021 GB:U96620 ribosomal protein L15 [Staphylococcus aureus]
Identities = 116/146 (79%), Positives = 128/146 (87%)
Query:    1  MKLHELKPAEGSRKVRNRVGRGTSSGNGKTSGRGQKGQKARSGGGVRLGFEGGQTPLFRR    60
             MKLHELKPAEGSRK RNRVGRG ++GNGKTSGRG KGQKARSGGGVR GFEGGQ PLFRR
Sbjct:    1  MKLHELKPAEGSRKERNRVGRGVATGNGKTSGRGHKGQKARSGGGVRPGFEGGQLPLFRR    60

Query:   61  MPKRGFSNINAKEYALVNLDQLNVFEDGTEVTPVVLKEAGIVRAEKSGVKILGNGELTKK   120
             +PKRGF+NIN KEYA+VNLDQLN FEDGTEVTP +L E+G+V+ EKSG+KILGNG L KK
Sbjct:   61  LPKRGFTNINRKEYAIVNLDQLNKFEDGTEVTPALLVESGVVKNEKSGIKILGNGSLDKK   120

Query:  121  LSVKAAKFSKSAEAAITAKGGSIEVI                                   146
             L+VKA KFS SA  AI AKGG+ EVI
Sbjct:  121  LTVKAHKFSASAAEAIDAKGGAHEVI                                   146
```

A related DNA sequence was identified in *S. pyogenes* <SEQ ID 6327> which encodes the amino acid sequence <SEQ ID 6328>. Analysis of this protein sequence reveals the following:

Possible site: 59
>>> Seems to have no N-terminal signal sequence
----- Final Results -----
   bacterial cytoplasm --- Certainty = 0.5329 (Affirmative) <succ>
      bacterial membrane --- Certainty = 0.0000 (Not Clear) <succ>
         bacterial outside --- Certainty = 0.0000 (Not Clear) <succ>

An alignment of the GAS and GBS proteins is shown below.

```
Identities = 135/146 (92%), Positives = 142/146 (96%)
Query:    1  MKLHELKPAEGSRKVRNRVGRGTSSGNGKTSGRGQKGQKARSGGGVRLGFEGGQTPLFRR    60
             MKLHELK AEGSRKVRNRVGRGTSSGNGKTSGRGQKGQKARSGGGVRLGFEGGQTPLFRR
Sbjct:    1  MKLHELKAAEGSRKVRNRVGRGISSGNGKTSGRGQKGQKARSGGGVRLGFEGGQTPLFRR    60

Query:   61  MPKRGFSNINAKEYALVNLDQLNVFEDGTEVTPVVLKEAGIVRAEKSGVKILGNGELTKK   120
             +PKRGF+NIN KEYALVNLDQLNVF+DGTEVTP +LK+AGIVRAEKSGVK+LGNGELTKK
Sbjct:   61  IPKRGFTNINTKEYALVNLDQLNVFDDGTEVTPAILKDAGIVRAEKSGVKVLGNGELTKK   120

Query:  121  LSVKAAKFSKSAEAAITAKGGSIEVI                                   146
             L+VKAAKFSKSAEAAI AKGGSIEVI
Sbjct:  121  LSVKAAKFSKSAEAAITAKGGSIEVI                                   146
```

Based on this analysis, it was predicted that this protein and its epitopes, could be useful antigens for vaccines or diagnostics.

Example 2049

A DNA sequence (GBSx2160) was identified in *S. agalactiae* <SEQ ID 6329> which encodes the amino acid sequence <SEQ ID 6330>. Analysis of this protein sequence reveals the following:

Possible site: 53
>>> Seems to have no N-terminal signal sequence
----- Final Results -----
   bacterial cytoplasm --- Certainty = 0.1162 (Affirmative) <succ>
      bacterial membrane --- Certainty = 0.0000 (Not Clear) <succ>
         bacterial outside --- Certainty = 0.0000 (Not Clear) <succ>

The protein has homology with the following sequences in the GENPEPT database.

```
>GP:AAB54020 GB:U96620 ribosomal protein L30 [Staphylococcus aureus]
Identities = 40/58 (68%), Positives = 46/58 (78%)
Query: 1    MAQIKITLTKSPIGRKPEQRKTVVALGLGKLNSSVVKEDNAAIRGMVNAISHLVTVEE     58
            MA+++ITLT+S IGR  QRKTV ALGL K NSSVV EDN AIRG +N + HLVTVEE
Sbjct: 1    MAKLQITLTRSVIGRPETQRKTVEALGLKKTNSSVVVEDNPAIRGQINKVKHLVTVEE     58
```

A related DNA sequence was identified in *S. pyogenes* <SEQ ID 6331> which encodes the amino acid sequence <SEQ ID 6332>. Analysis of this protein sequence reveals the following:

Possible site: 53
>>> Seems to have no N-terminal signal sequence
----- Final Results -----
   bacterial cytoplasm --- Certainty = 0.1088 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

```
Identities = 56/58 (96%), Positives = 57/58 (97%)
Query: 1    MAQIKITLTKSPIGRKPEQRKTVVALGLGKLNSSVVKEDNAAIRGMVNAISHLVTVEE     58
            MAQIKITLTKSPIGRKPEQRKTVVALGLGKLNSSVVKEDNAAIRGMV AISHLVTVE+
Sbjct: 1    MAQIKITLTKSPIGRKPEQRKTVVALGLGKLNSSVVKEDNAAIRGMVTAISHLVTVED     58
```

Based on this analysis, it was predicted that this protein and its epitopes, could be useful antigens for vaccines or diagnostics.

Example 2050

A DNA sequence (GBSx2161) was identified in *S. agalactiae* <SEQ ID 6333> which encodes the amino acid sequence <SEQ ID 6334>. Analysis of this protein sequence reveals the following:

Possible site: 36
>>> Seems to have no N-terminal signal sequence
----- Final Results -----
   bacterial cytoplasm --- Certainty = 0.3226 (Affirmative) <succ>
     bacterial membrane --- Certainty = 0.0000 (Not Clear) <succ>
       bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2051

A DNA sequence (GBSx2162) was identified in *S. agalactiae* <SEQ ID 6335> which encodes the amino acid sequence <SEQ ID 6336>. This protein is predicted to be 30S ribosomal protein S5 (rpsE). Analysis of this protein sequence reveals the following:

Possible site: 26
>>> Seems to have no N-terminal signal sequence
----- Final Results -----
   bacterial cytoplasm --- Certainty = 0.3179 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database.

```
>GP:AAA22699 GB:M57621 ribosomal protein S5 [Bacillus stearothermophilus]
Identities = 119/158 (75%), Positives = 139/158 (87%)

Query:   6  NAVELEERVVAINRVTKVVKGGRRLRFAALVVVGDRNGRVGEGTGKAQEVPEAIRKAVEA    65
            N +ELEERVVA+NRV KVVKGGRRLRF+ALVVVGD+NG VGFGTGKAQEVPEAIRKA+E Sbjct:   7  NKLELEERVVAVNRVAKVVKGGRRLRFSALVVVGDKNGHVGFGTGKAQEVPEAIRKAIED    66

Query:  66  AKKNMVEVPMVGTTIPHEVRSEFGGARVLLKPAVEGAGVAAGGAVRAVIELAGVADITSK   125
            AKKN++EVP+VGTTIPHEV   FG  +++LKPA EG GV AGG  RAV+ELAG++DI SK
Sbjct:  67  AKKNLIEVPIVGTTIPHEVIGHFGAGEIILKPASEGTGVIAGGPARAVLELAGISDILSK   126

Query: 126  SLGSNTPINIVRATVEGLKQLKRAEEVAALRGISVSDL                        163
            S+GSNTPIN+VRAT +GLKQLKRAE+VA LRG +V +L
Sbjct: 127  SIGSNTPINMVRATEDGLKQLKRAEDVAKLRGKTVEEL                        164
```

A related DNA sequence was identified in *S. pyogenes* <SEQ ID 6337> which encodes the amino acid sequence <SEQ ID 6338>. Analysis of this protein sequence reveals the following:

```
Possible site: 26
>>> Seems to have no N-terminal signal sequence
----- Final Results -----
   bacterial cytoplasm --- Certainty = 0.3179 (Affirmative) <succ>
    bacterial membrane --- Certainty = 0.0000 (Not Clear) <succ>
      bacterial outside --- Certainty = 0.0000 (Not Clear) <succ>
```

An alignment of the GAS and GBS proteins is shown below.

```
Identities = 158/164 (96%), Positives = 161/164 (97%)
Query:   1  MAFFQNAVELEERVVAINRVTKVVKGGRRLRFAALVVVGDRNGRVGFGTGKAQEVPEAIR   60
            MAF:DNAVELEERVVAINRVTKVVKGGRRLRFAALVVVGD NGRVGFGTGKAQEVPEAIR
Sbjct:   1  MAFKDNAVELEERVVAINRVTKVVKGGRRLRFAALVVVGDGNGRVGFGTGKAQEVPEAIR   60

Query:  61  KAVEAAKKNMVEVPMVGTTIPHEVRSEFGGAKVLLKPAVEGAGVAAGGAVRAVIELAGVA  120
            KAVEAAKKNM+EVPMVGTTIPHEV + FGGAKVLLKPAVEG+GVAAGGAVRAVIELAGVA
Sbjct:  61  KAVEAAKKNMIEVPMVGTTIPHEVYTNFGGAKVLLKPAVEGSGVAAGGAVRAVIELAGVA  120

Query: 121  DITSKSLGSNTPINIVRATVEGLKQLKRAEEVAALRGISVSDLA                 164
            DITSKSLGSNTPINIVRATVEGLKQLKRAEEVAALRGISVSDLA
Sbjct: 121  DITSKSLGSNTPINIVRATVEGLKQLKRAEEVAALRGISVSDLA                 164
```

Based on this analysis, it was predicted that this protein and its epitopes, could be useful antigens for vaccines or diagnostics.

Example 2052

A DNA sequence (GBSx2163) was identified in *S. agalactiae* <SEQ ID 6339> which encodes the amino acid sequence <SEQ ID 6340>. This protein is predicted to be 50S ribosomal protein L18 (rp1R). Analysis of this protein sequence reveals the following:

```
Possible site: 61
>>> Seems to have no N-terminal signal sequence
```

```
----- Final Results -----
   bacterial cytoplasm --- Certainty = 0.4488 (Affirmative) <succ>
    bacterial membrane --- Certainty = 0.0000 (Not Clear) <succ>
      bacterial outside --- Certainty = 0.0000 (Not Clear) <succ>
```

A related GBS nucleic acid sequence <SEQ ID 9465> which encodes amino acid sequence <SEQ ID 9466> was also identified.

The protein has homology with the following sequences in the GENPEPT database.

```
>GP:AAB06815 GB:L47971 ribosomal protein L18 [Bacillus subtilis]

Identities = 86/120 (71%), Positives = 97/120 (80%), Gaps = 2/120 (1%)

Query:   4  VISKPDKNKIRQKRHRRVRGKLSGTADRPRLNIFRSNTGIYAQVIDDVAGVTLASASTLD   63

+I+K   KN R KRH RVR KLSGTA+RPRLN+FRSN  IYAQ+IDDV GVTLASASTLD

Sbjct:   1  MITKTSKNAARLKRHARVRAKLSGTAERPRLNVFRSNkHIYAQIIDDVNGVTLASASTLD   60

Query:  64  KE--VSNGTKTEQAVVVGKLVAERAVAKGISEVVFDRGGYLYHGRVKALADSARENGLKF  121

K+  V +   T A  VG+LVA+RA  KGIS+VVFDRGGYLYHGRVKALAD+ARE GLKF

Sbjct:  61  KDLNVESTGDTSAATkVGELVAKRAAEKGISDVVFDRGGYLYHGRVKALADAAREAGLKF  120
```

A related DNA sequence was identified in *S. pyogenes* <SEQ ID 6341> which encodes the amino acid sequence <SEQ ID 6342>. Analysis of this protein sequence reveals the following:

Possible site: 61
>>> Seems to have no N-terminal signal sequence
----- Final Results -----
   bacterial cytoplasm --- Certainty = 0.4488 (Affirmative) <succ>
     bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 116/121 (95%), Positives = 120/121 (98%)
Query:   1   MKIVISKPDKNKIRQKRHRRVRGKLSGTADRPRLNIFRSNTGIYAQVIDDVAGVTLASAS   60
             +KIVISKPDKNKIRQKRHRRVRGKLSGTADRPRLN+FRSNTGIYAQVIDDVAGVTLASAS
Sbjct:   1   VKIVISKPDKNKIRQKRERRVRGKLSGTADRPRLNVFRSNTGIYAQVIDDVAGVTLASAS   60

Query:  61   TLDKEVSNGTKTEQAVVVGKLVAERAVAKGISEVVFDRGGYLYHGRVKALADSARENGLKF  121
             TLDK+VS GTKTEQAVVVGKLVAERAVAKGISEVVFDRGGYLYHGRVKALAD+ARENGLKF
Sbjct:  61   TLDKDVSKGTKTEQAVVVGKLVAERAVAKGISEVVFDRGGYLYHGRVKALADAARENGLKF  121
```

Based on this analysis, it was predicted that this protein and its epitopes, could be useful antigens for vaccines or diagnostics.

Example 2053

A DNA sequence (GBSx2164) was identified in *S. agalactiae* <SEQ ID 6343> which encodes the amino acid sequence <SEQ ID 6344>. Analysis of this protein sequence reveals the following:

Possible site: 53
>>> Seems to have no N-terminal signal sequence
----- Final Results -----
   bacterial cytoplasm --- Certainty = 0.1530 (Affirmative) <succ>
     bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:AAA22700 GB:M57622 ribosomal protein L6 [Bacillus stearothermophilus]
Identities = 108/178 (60%), Positives = 133/178 (74%)
Query:   1   MSRIGNKVITLPAGVEIINKDNVVTVKGPKGQLTREFNKNIGITVEGTEVTVTRPNDSKE   60
             M R+G K I +PAGV +    N VTVKGPKG+LTR F+ ++ ITVEG  +TVTRP+D K Sbjct:   1   MXRVGKKPIEIPAGVTVTVNGNTVTVKGPKGELTRTFHPDMTITVEGNVITVTRPSDEKH   60

Query:  61   MKTIHGTTRANLNNMVVGVSEGFKKALEMRGVGYRAQLQGSKLVLSVGKSHQDEVEAPEG  120
             + +HGTTR+ L NMV GVS+G++KALE+ GVGYRA  QG KLVLSVG SH  E+E  EG Sbjct:  61   HRALHGTTRSLLANMVEGVSKGYEKALELVGVGYRASKQGKKLVLSVGYSHPVEIEPEEG  120

Query: 121   VTFEVPTPTTINVIGINKESVGQTAAYVRSLRSPEPYKGKGIRYVGEFVRRKEGKTGK   178
             +  EVP+ T I V G +K+ VG+ AA +R++R PEPYKGKGIRY GE VR KEGKTGK Sbjct: 121   LEIEVPSQTKIIVKGADKQRVGELAANIRAVRPPEPYKGKGIRYEGELVRLKEGKTGK   178
```

A related DNA sequence was identified in *S. pyogenes* <SEQ ID 6345> which encodes the amino acid sequence <SEQ ID 6346>. Analysis of this protein sequence reveals the following:

Possible site: 17
>>> Seems to have no N-terminal signal sequence
----- Final Results -----
   bacterial cytoplasm --- Certainty = 0.1704 (Affirmative) <succ>
     bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 153/178 (85%), Positives = 166/178 (92%)
Query:   1  MSRIGNKVITLPAGVEIINKDNVVTVKGPKGQLTREFNKNIGITVEGTEVTVTRPNDSKE   60
            MSRIGNKVIT+PAGVE+ N +NV+TVKGPKG+LTREFNKNI I VEGTE+TV RPNDSKE
Sbjct:   1  MSRIGNKVITMPAGVELTNNNNVITVKGPKGELTREFNKNIEIKVEGTEITVVRPNDSKE   60

Query:  61  MKTIHGTTRANLNNMVVGVSEGFKKALEMRGVGYRAQLQGSKLVLSVGKSHQDEVEAPEG  120
            MKTIHGTTRANLNNMVVGVSEGFKK LEM+GVGYRAQLQG+KLVLSVGKSHQDEVEAPEG
Sbjct:  61  MKTIHGTTRANLNNMVVGVSEGFKKDLEMKGVGYRAQLQGTKLVLSVGKSHQDEVEAPEG  120

Query: 121  VTFEVPTPTTINVIGINKESVGQTAAYVRSLRSPEPYKGKIRYVGEFVRRKEGKTGK     178
            +TF V  PT+I+V GINKE VGQTAAY+RSLASPEPYKGKIRYVGE+VR KEGKTGK
Sbjct: 121  ITFTVANPTSISVEGINKEVVGQTAAYIRSLRSPEPYKGKIRYVGEYVRLKEGKTGK     178
```

Based on this analysis, it was predicted that this protein and its epitopes, could be useful antigens for vaccines or diagnostics.

Example 2054

A DNA sequence (GBSx2165) was identified in *S. agalactiae* <SEQ ID 6347> which encodes the amino acid sequence <SEQ ID 6348>. This protein is predicted to be 30S ribosomal protein S8 (rpsH). Analysis of this protein sequence reveals the following:

Possible site: 19
>>> Seems to have no N-terminal signal sequence
----- Final Results -----
    bacterial cytoplasm --- Certainty = 0.4356 (Affirmative) <succ>
      bacterial membrane --- Certainty = 0.0000 (Not Clear) <succ>
        bacterial outside --- Certainty = 0.0000 (Not Clear) <succ>

The protein has homology with the following sequences in the GENPEPT database.

```
>GP:AAB06813 GB:L47971 ribosomal protein S8 [Bacillus subtilis]
Identities = 100/132 (75%), Positives = 116/132 (87%)
Query:   1  MVMTDPIADFLTRIRNANQAKHEVLEVPASNIKKGIADILKREGFVKNVEVIEDDKQGII   60
            MVMTDPIAD LTRIRNAN +HE LE+PAS +K+ IA+ILKREGF+++VE +ED KQGII
Sbjct:   1  MVMTDPIADMLTRIRNANMVRHEKLEIPASKLKREIAEILKREGFIRDVEFVEDSKQGII   60

Query:  61  RVFLKYGQNGERVITNLKRISKPGLRVYTKHEDMPKVLNGLGIAIVSTSEGLLTDKEARQ  120
            RVFLKYGQN ERVIT LKRISKPGLRVY K  ++P+VLNGLGIAI+STS+G+LTDKEAR
Sbjct:  61  RVELKYGQNNERVITGLKRISKPGLRVYAKSNEVPRVLNGLGIAIISTSQGVLTDKEARA  120

Query: 121  KNIGGEVLAYIW                                                 132
            K  GGEVLAY+W
Sbjct: 121  KQAGGEVLAYVW                                                 132
```

A related DNA sequence was identified in *S. pyogenes* <SEQ ID 6349> which encodes the amino acid sequence <SEQ ID 6350>. Analysis of this protein sequence reveals the following:

Possible site: 19
>>> Seems to have no N-terminal signal sequence
----- Final Results -----
    bacterial cytoplasm --- Certainty = 0.4327 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below.

```
Identities = 122/132 (92%), Positives = 129/132 (97%)
Query:   1  MVMTDPIADFLTRIRNANQAKHEVLEVPASNIKKGIADILKREGFVkNVEVIEDDKQGII   60
            MVMTDPIADFLTRIRNANQ KHEVLEVPASNIKKGIA+ILKREGFVKNVEVIEDDKQGII
Sbjct:   1  MVMTDPIADFLTRIRNANQVKHEVLEVPASNIKKGIAEILKREGFVKNVEVIEDDKQGII   60

Query:  61  RVFLKYGQNGERVITNLKRISKPGLRVYTKHEDMPKVLNGLGIAIVSTSEGLLTDKEARQ  120
            RVFLKYG+NGERVITNLKRISKPGLRVY K +DMPKVLNGLGIAI+STSEGLLTDKEARQ
Sbjct:  61  RVFLKYGKNGERVITNLKRISKPGLRVYAKRDDMPKVLNGLGIAIISTSEGLLTDKEARQ  120

Query: 121  KNIGGEVLAYIW                                                 132
            KN+GGEV+AY+W
Sbjct: 121  KNVGGEVIAYVW                                                 132
```

Based on this analysis, it was predicted that this protein and its epitopes, could be useful antigens for vaccines or diagnostics.

Example 2055

A DNA sequence (GBSx2166) was identified in *S. agalactiae* <SEQ ID 6351> which encodes the amino acid sequence <SEQ ID 6352>. This protein is predicted to be ribosomal protein S14 (rpsN). Analysis of this protein sequence reveals the following:

---

Possible site: 59
>>> Seems to have no N-terminal signal sequence
----- Final Results -----
   bacterial cytoplasm --- Certainty = 0.3833 (Affirmative) <succ>
     bacterial membrane --- Certainty = 0.0000 (Not Clear) <succ>
       bacterial outside --- Certainty = 0.0000 (Not Clear) <succ>

---

The protein has homology with the following sequences in the GENPEPT database.

```
>GP:CAB11905 GB:Z99104 ribosomal protein S14 [Bacillus subtilis]
Identities = 47/61 (77%), Positives = 53/61 (86%)
Query:   1    MAKKSMIAKNKRPAKFSTQAYTRCEKCGRPHSVYRKFQLCRVCFRDLAYKGQVPGVTKAS    60
              MAKKSMIAK +R  KF  Q YTRCE+CGRPHSV RKF+LCR+CFR+LAYKGQ+PGV KAS
Sbjct:   1    MAKKSMIAKQQRTPKFKVQEYTRCERCGRPHSVIRKFKLCRICFRELAYKGQIPGVKKAS    60

Query:  61    W                                                              61
              W
Sbjct:  61    W                                                              61
```

A related DNA sequence was identified in *S. pyogenes* <SEQ ID 6353> which encodes the amino acid sequence <SEQ ID 6354>. Analysis of this protein sequence reveals the following:

---

Possible site: 59
>>> Seems to have no N-terminal signal sequence
----- Final Results -----
   bacterial cytoplasm --- Certainty = 0.4747 (Affirmative) <succ>
     bacterial membrane --- Certainty = 0.0000 (Not Clear) <succ>
       bacterial outside --- Certainty = 0.0000 (Not Clear) <succ>

---

An alignment of the GAS and GBS proteins is shown below.

```
Identities = 55/61 (90%), Positives = 59/61 (96%)
Query:   1    MAKKSMIAKNKRPAKFSTQAYTRCEKCGRPHSVYRKFQLCRVCFRDLAYKGQVPGVTKAS    60
              +AKKSMIAKNKRPAK STQAYTRCEKCGRPHSVYRKF+LCRVCFR+LAYKGQ+PGV KAS
Sbjct:   1    LAKKSMIAKNKRPAKHSTQAYTRCEKCGRPHSVYRKFKLCRVCFRELAYKGQIPGVVKAS    60

Query:  61    W                                                              61
              W
Sbjct:  61    W                                                              61
```

Based on this analysis, it was predicted that this protein and its epitopes, could be useful antigens for vaccines or diagnostics.

Example 2056

A DNA sequence (GBSx2167) was identified in *S. agalactiae* <SEQ ID 6355> which encodes the amino acid sequence <SEQ ID 6356>. This protein is predicted to be 50S ribosomal protein L5 (rplE). Analysis of this protein sequence reveals the following:

---

Possible site: 48
>>> Seems to have no N-terminal signal sequence
----- Final Results -----
   bacterial cytoplasm --- Certainty = 0.1845 (Affirmative) <succ>
     bacterial membrane --- Certainty = 0.0000 (Not Clear) <succ>
       bacterial outside --- Certainty = 0.0000 (Not Clear) <succ>

---

The protein has homology with the following sequences in the GENPEPT database.

```
>GP:BAB03865 GB:AP001507 ribosomal protein L5 (BL6) [Bacillus halodurans]
Identities = 143/178 (80%), Positives = 162/178 (90%)
Query:    3  NRLKEKYTNEVVPALTEKFNYSSVMAVPKVEKIVLNMGVGDAVSNAKNLEKAAAELALIS    62
             NRLKEKY E+VP+LTEKFNYSSVMAVPK+EKIV+NMGVGDAV NAK L+KA  EL  I+
Sbjct:    2  NRLKEKYQKEIVPSLTEKENYSSVMAVPKLEKIVVEMGVGDAVQNAKALDKAVEELTEIT    61

Query:   63  GQKPLITKAKKSIAGFRLREGVAIGAKVTLRGERMYEFLDKLVSVSLPRVRDFHGVPTKS   122
             GQKP+ITKAKKSIAGF+LREG+ IGAKVTLRGERMYEFLDKL+SVSLPRVRDF G+  K+
Sbjct:   62  GQKPIITKAKKSIAGFKLREGMPIGAKVTLRGERMYEFLDKLISVSLPRVRDFRGISKKA   121

Query:  123  FDGRGNYTLGVKEQLIFPEINFDDVDKVRGLDIVIVTTANTDEESRELLKGLGMPFAK    180
             FDGRGNYTLGVKEQLIFPEI++D VDKVRG+D+VIVTTA+TDEE+RELL  +GMPF K
Sbjct:  122  FDGRGNYTLGVKEQLIFPEIDYDKVDKVRGMDVVIVTTASTDEEARELLSQMGMPFQK    179
```

A related DNA sequence was identified in *S. pyogenes* <SEQ ID 6357> which encodes the amino acid sequence <SEQ ID 6358>. Analysis of this protein sequence reveals the following:

Possible site: 48
>>> Seems to have no N-terminal signal sequence
----- Final Results -----
   bacterial cytoplasm --- Certainty = 0.1793 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 177/180 (98%), Positives = 180/180 (99%)
Query:    1  MANRLKEKYTNEVVPALTEKFNYSSVMAVPKVEKIVLNMGVGDAVSNAENLEKAAAELAL    60
             MANRLKEKYTNEV+PALTEKENY+SVMAVPKVEKIVLNMGVGDAVSNAKNLEKAAAELAL
Sbjct:    1  MANRLKEKYTNEVIPALTEKENYTSVMAVPKVEKIVLNMGVGDAVSNAKNLEKAAAELAL    60

Query:   61  ISGQKPLITKAKKSIAGERLREGVAIGAKVTLRGERMYEELDKLVSVSLPRVRDFHGVPT   120
             ISGQKPLITKAKKSIAGERLREGVAIGAKVTLRGERMYEELDKLVSVSLPRVRDFHGVPT
Sbjct:   61  ISGQKPLITKAKKSIAGERLREGVAIGAKVTLRGERMYEFLDKLVSVSLPRVRDFHGVPT   120

Query:  121  KSFDGRGNYTLGVKEQLIFPEINFDDVDKVRGLDIVIVTTANTDEESRELLKGLGMPFAK   180
             KSFDGRGNYTLGVKEQLIFPEI+FDDVDKVRGLDIVIVTTANTDEESRELLKGLGMPFAK
Sbjct:  121  KSEDGRGNYTLGVKEQLIFPEISFDDVDKVRGLDIVIVTTANTDEESRELLKGLGMPFAK   180
```

Based on this analysis, it was predicted that this protein and its epitopes, could be useful antigens for vaccines or diagnostics.

Example 2057

A DNA sequence (GBSx2169) was identified in *S. agalactiae* <SEQ ID 6359> which encodes the amino acid sequence <SEQ ID 6360>. This protein is predicted to be 50S ribosomal protein L24 (rplX). Analysis of this protein sequence reveals the following:

Possible site: 26
>>> Seems to have no N-terminal signal sequence
----- Final Results -----
   bacterial cytoplasm --- Certainty = 0.1850 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:AAD33285 GB:AF126061 RpL24 [Streptococcus pneumoniae]

Identities = 89/101 (88%), Positives = 94/101 (92%)

Query:    1  MFVKKGDKVRVIAGKDKGTEAVVLKALPKVNKVVVEGVALIKKHQKPNNENPQGAIVEKE    60
             MFVKKGDKVRVIAGKDKGTEAVVL ALPKVNKV+VEGV ++KKHQ+P NE PQG I+EKE
Sbjct:    1  MFVKKGDKVRVIAGKDKGTEAVVLTALPKVNKVIVEGVNIVKKHQRPTNELPQGGIIEKE    60

Query:   61  APIHVSNVQVLDKNGVAGRVGYKVVDGKKVRYNKKSGEVLD                     101
             A IHVSNVQVLDKNGVAGRVGYK VDGKKVRYNKKSGEVLD
Sbjct:   61  AAIHVSNVQVLDKNGVAGRVGYKFVDGKKVRYNKKSGEVLD                     101
```

A related DNA sequence was identified in *S. pyogenes* <SEQ ID 6361> which encodes the amino acid sequence <SEQ ID 6362>. Analysis of this protein sequence reveals the following:

```
Possible site: 26
>>> Seems to have no N-terminal signal sequence
----- Final Results -----
   bacterial cytoplasm --- Certainty = 0.1850 (Affirmative) <succ>
     bacterial membrane --- Certainty = 0.0000 (Not Clear) <succ>
       bacterial outside --- Certainty = 0.0000 (Not Clear) <succ>
```

An alignment of the GAS and GBS proteins is shown below.

```
Identities = 95/101 (94%), Positives = 99/101 (97%)
Query:   1   MFVKKGDKVRVIAGKDKGTEAVVLKALPKVNKVVVEGVALIKKHQKPNNENPQGAIVEKE   60
             MFVKKGDKVRVIAGKDKGTEAVVLKALPKVNKV+VEGV +IKKHQKPN ENPQGAIVEKE
Sbjct:   1   MFVKKGDKVRVIAGKDKGTEAVVLKALPKVNKVIVEGVGMIKKHQKPNTENPQGAIVEKE   60

Query:  61   APIHVSNVQVLDKNGVAGRVGYKVVDGKKVRYNKKSGEVLD                    101
             APIHVSNVQVLDKNGVAGR+GYKVVDGKKVRY+KKSGEVLD
Sbjct:  61   APIHVSNVQVLDKNGVAGRIGYKVVDGKKVRYSKKSGEVLD                    101
```

Based on this analysis, it was predicted that this protein and its epitopes, could be useful antigens for vaccines or diagnostics.

Example 2058

A DNA sequence (GBSx2170) was identified in *S. agalactiae* <SEQ ID 6363> which encodes the amino acid sequence <SEQ ID 6364>. This protein is predicted to be 50S ribosomal protein L14 (rp1N). Analysis of this protein sequence reveals the following:

```
Possible site: 16
>>> Seems to have no N-terminal signal sequence
----- Final Results -----
   bacterial cytoplasm --- Certainty = 0.1004 (Affirmative) <succ>
     bacterial membrane --- Certainty = 0.0000 (Not Clear) <succ>
       bacterial outside --- Certainty = 0.0000 (Not Clear) <succ>
```

The protein has homology with the following sequences in the GENPEPT database.

```
>GP:AAD33284 GB:AF126061 RpL14 [Streptococcus pneumoniae]
Identities = 116/122 (95%), Positives = 120/122 (98%)
Query:   1   MIQQETRLKVADNSGAREILTIKVLGGSGRKFANIGDVIVASVKQATPGGAVKKGDVVKA   60
             MIQ ETRLKVADNSGAREILTIKVLGGSGRKFANIGDVIVASVKQATPGGAVKKGDVVKA
Sbjct:   1   MIQTETRLKVADNSGAREILTIKVLGGSGRKFANIGDVIVASVKQATPGGAVKKGDVVKA   60

Query:  61   VIVRTKTGARRPDGSYIKFDDNAAVIIRDDKTPRGTRIFGPVARELREGGYMKIVSLAPE  120
             VIVRTK+GARR DGSYIKFD+NAAVIIR+DKTPRGTRIFGPVARELREGG MKIVSLAPE
Sbjct:  61   VIVRTKSGARRADGSYIKFDENAAVIIREDKTPRGTRIFGPVARELREGGFMKIVSLAPE  120

Query: 121   VL                                                           122
             VL
Sbjct: 121   VL                                                           122
```

A related DNA sequence was identified in *S. pyogenes* <SEQ ID 6365> which encodes the amino acid sequence <SEQ ID 6366>. Analysis of this protein sequence reveals the following:

Possible site: 16
>>> Seems to have no N-terminal signal sequence
----- Final Results -----
   bacterial cytoplasm --- Certainty = 0.1004 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

```
Identities = 122/122 (100%), Positives = 122/122 (100%)
Query:   1  MIQQETRLKVADNSGAREILTIKVLGGSGRKFANIGDVIVASVKQATPGGAVKKGDVVKA   60
            MIQQETRLKVADNSGAREILTIKVLGGSGRKFANIGDVIVASVKQATPGGAVKKGDVVKA
Sbjct:   1  MIQQETRLKVADNSGAREILTIKVLGGSGRKFANIGDVIVASVKQATPGGAVKKGDVVKA   60

Query:  61  VIVRTKTGARRPDGSYIKFDDNAAVIIRDDKTPRGTRIFGPVARELREGGYMKIVSLAPE  120
            VIVRTKTGARRPDGSYIKFDDNAAVIIRDDKTPRGTRIFGPVARELREGGYMKIVSLAPE
Sbjct:  61  VIVRTKTGARRPDGSYIKFDDNAAVIIRDDKTPRGTRIFGPVARELREGGYMKIVSLAPE  120

Query: 121  VL                                                           122
            VL
Sbjct: 121  VL                                                           122
```

Based on this analysis, it was predicted that this protein and its epitopes, could be useful antigens for vaccines or diagnostics.

Example 2059

A DNA sequence (GBSx2171) was identified in *S. agalactiae* <SEQ ID 6367> which encodes the amino acid sequence <SEQ ID 6368>. Analysis of this protein sequence reveals the following:

Possible site: 47
>>> Seems to have no N-terminal signal sequence
----- Final Results -----
   bacterial cytoplasm --- Certainty = 0.3415 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database.

```
>GP:AAD33283 GB:AF126061 RpS17 [Streptococcus pneumoniae]
Identities = 82/86 (95%), Positives = 83/86 (96%)
Query:   1  MERNQRKTLYGRVVSDKMDKTITVVVETKPNHPVYGKRINYSKKYKAHDENNVAKEGDIV   60
            MERN RK L GRVVSDKMDKTITVVVETKRNHPVYGKRINYSKKYKAHDENNVAKEGDIV
Sbjct:   1  MERNNRKVLVGRVVSDKMDKTITVVVETKRNHPVYGKRINYSKKYKAHDENNVAKEGDIV   60

Query:  61  RIMETRPLSATKRFRLVEVVEKAVII                                    86
            RIMETRPLSATKRFRLVEVVE+AVII
Sbjct:  61  RIMETRPLSATKRFRLVEVVEEAVII                                    86
```

A related DNA sequence was identified in *S. pyogenes* <SEQ ID 6369> which encodes the amino acid sequence <SEQ ID 6370>. Analysis of this protein sequence reveals the following:

Possible site: 47
>>> Seems to have no N-terminal signal sequence
----- Final Results -----
   bacterial cytoplasm --- Certainty = 0.3415 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

```
Identities = 86/86 (100%), Positives = 86/86 (100%)
Query:  1  MERNQRKTLYGRVVSDKMDKTITVVVETKRNHPVYGKRINYSKKYKAHDENNVAKEGDIV   60
           MERNQRKTLYGRVVSDKMDKTITVVVETKRNHPVYGKRINYSKKYKAHDENNVAKEGDIV
Sbjct:  1  MERNQRKTLYGRVVSDKMDKTITVVVETKRNHPVYGKRINYSKKYKAHDENNVAKEGDIV   60

Query: 61  RIMETRPLSATKRFRLVEVVEKAVII                                    86
           RIMETRPLSATKRFRLVEVVEKAVII
Sbjct: 61  RIMETRPLSATKRFRLVEVVEKAVII                                    86
```

Based on this analysis, it was predicted that this protein and its epitopes, could be useful antigens for vaccines or diagnostics.

Example 2060

A DNA sequence (GBSx2172) was identified in *S. agalactiae* <SEQ ID 6371> which encodes the amino acid sequence <SEQ ID 6372>. Analysis of this protein sequence reveals the following:

---
Possible site: 43
>>> Seems to have no N-terminal signal sequence
----- Final Results -----
  bacterial cytoplasm --- Certainty = 0.4329 (Affirmative) <succ>
    bacterial membrane --- Certainty = 0.0000 (Not Clear) <succ>
      bacterial outside --- Certainty = 0.0000 (Not Clear) <succ>
---

The protein has homology with the following sequences in the GENPEPT database.

```
>GP:AAD33282 GB:AF126061 RpL29 [Streptococcus pneumoniae]
Identities = 58/68 (85%), Positives = 64/68 (93%)
Query:  1  MKLQEIKDFVKELRGLSQEELAKKENELKKELFDLRFQAAAGQLEKTARLDEVKKQIARV   60
           MKL E+K+FVKELRGLSQEELAK+ENELKKELF+LRFQAA GQLE+TARL EVKKQIAR+
Sbjct:  1  MKLNEVKEFVKELRGLSQEELAKRENELKKELFELRFQAATGQLEQTARLKEVKKQIARI   60

Query: 61  KTVQSEMK                                                      68
           KTVQSE K
Sbjct: 61  KTVQSEAK                                                      68
```

Based on this analysis, it was predicted that this protein and its epitopes, could be useful antigens for vaccines or diagnostics.

Example 2061

A DNA sequence (GBSx2174) was identified in *S. agalactiae* <SEQ ID 6373> which encodes the amino acid sequence <SEQ ID 6374>. This protein is predicted to be RpL16 (rplP). Analysis of this protein sequence reveals the following:

---
Possible site: 52
>>> Seems to have no N-terminal signal sequence
----- Final Results -----
  bacterial cytoplasm --- Certainty = 0.4574 (Affirmative) <succ>
    bacterial membrane --- Certainty = 0.0000 (Not Clear) <succ>
      bacterial outside --- Certainty = 0.0000 (Not Clear) <succ>
---

The protein has homology with the following sequences in the GENPEPT database.

```
>GP:AAD33263 GB:AF126059 RpL16 [Streptococcus pneumoniae]
Identities = 135/137 (98%), Positives = 137/137 (99%)
Query:   1  MLVPKRVKHRREFRGKMRGEAKGGKEVSFGEYGLQATTSHWITNRQIEAARIAMTRYMKR    60
            MLVPKRVKHRREFRGKMRGEAKGGKEV+FGEYGLQATTSHWITNRQIEAARIAMTRYMKR
Sbjct:   1  MLVPKRVKHRREFRGKMRGEAKGGKEVAFGEYGLQATTSHWITNRQIEAARIAMTRYMKR    60

Query:  61  GGKVWIKIFPHKSYTAKAIGVRMGSGKGAPEGWVAPVKRGKVMFEIAGVSEEVAREALRL   120
            GGKVWIKIFPHKSYTAKAIGVRMGSGKGAPEGWVAPV+RGKVMFEIAGVSEE+AREALRL
Sbjct:  61  GGKVWIKIFPHKSYTAKAIGVRMGSGKGAPEGWVAPVERGKVMFEIAGVSEEIAREALRL   120

Query: 121  ASHKLPVKCKFVKREAE                                             137
            ASHKLPVKCKFVKREAE
Sbjct: 121  ASHKLPVKCKFVKREAE                                             137
```

A related DNA sequence was identified in *S. pyogenes* <SEQ ID 6375> which encodes the amino acid sequence <SEQ ID 6376>. Analysis of this protein sequence reveals the following:

```
Possible site: 52
>>> Seems to have no N-terminal signal sequence
----- Final Results -----
   bacterial cytoplasm --- Certainty = 0.4574 (Affirmative) <succ>
      bacterial membrane --- Certainty = 0.0000 (Not Clear) <succ>
         bacterial outside --- Certainty = 0.0000 (Not Clear) <succ>
```

An alignment of the GAS and GBS proteins is shown below.

```
Identities = 136/137 (99:96), Positives = 137/137 (99%)
Query:   1  MLVPKRVKHRREFRGKMRGEAKGGKEVSFGEYGLQATTSHWITNRQIEAARIAMTRYMKR      60
            MLVPKRVKHRREFR KMRGEAKGGKEVSFGEYGLQATTSHWITNRQIEAARIAMTRYMKR
Sbjct:   1  MLVPKRVKHRREFRGKMRGEAKGGKEVSFGEYGLQATTSHWITNRQIEAARIAMTRYMKR      60

Query:  61  GGKVWIKIFPHKSYTAKAIGVRMGSGKGAPEGWVAPVKRGKVMFEIAGVSEEVAREALRL    120
            GG  WIKIFPHKSYTAKAIGVRMGSGKGAPEGWVAPVKRGKVMFEIAGVSEE+AREALRL
Sbjct:  61  GGKVWIKIFPHKSYTAKAIGVRMGSGKGAPEGWVAPVKRGKVMFEIAGVSEEIAREALRL    120

Query: 121  ASHKLPVKCKFVKREAE                                              137
            ASHKLPVKCKFVKREAE
Sbjct: 121  ASHKLPVKCKFVKREAE                                              137
```

Based on this analysis, it was predicted that this protein and its epitopes, could be useful antigens for vaccines or diagnostics.

Example 2062

A DNA sequence (GBSx2175) was identified in *S. agalactiae* <SEQ ID 6377> which encodes the amino acid sequence <SEQ ID 6378>. Analysis of this protein sequence reveals the following:

```
Possible site: 53
>>> Seems to have no N-terminal signal sequence
----- Final Results -----
   bacterial cytoplasm --- Certainty = 0.3758 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database.

```
>GP:AAD33280 GB:AF126061 RpS3 [Streptococcus pneumoniae]
Identities = 200/208 (96%), Positives = 203/208 (97%)

Query:  10  MRVGIIRDWDAKWYAEKEYADYLHEDLAIRKFINKELADASVSTIEIERAVNKVIVSLHT     69
            MRVGIIRDWDAKWYAEKEYADYLHEDLAIRKF+ KELADA+VSTIEIERAVNKV VSLHT
Sbjct:   1  MRVGIIRDWDAKWYAEKEYADYLHEDLAIRKFVQKELADAAVSTIEIERAVNKVNVSLHT     60

Query:  70  AKPGMVIGKGGANVDALRGQLNKLTGKQVHINIIEIKQPDLDAHLVGENIARQLEQRVAF    129
            AKPGMVIGKGGANVDALR +LNKLTGKQVHINIIEIKQPDLDAHLVGE IARQLEQRVAF
Sbjct:  61  AKPGMVIGKGGANVDALRAKLNKLTGKQVHINIIEIKQPDLDAHLVGEGIARQLEQRVAF    120

Query: 130  RRAQKQAIQRTMRAGAKGIKTQVSGRLNGADIARAEGYSEGTVPLHTLRADIDYAWEEAD    189
            RRAQKQAIQR MRAGAKGIKTQVSGRLNGADIARAEGYSEGTVPLHTLRADIDYAWEEAD
Sbjct: 121  RRAQKQAIQRAMRAGAKGIKTQVSGRLNGADIARAEGYSEGTVPLHTLRADIDYAWEEAD    180

Query: 190  TTYGKLGVKVWIYRGEVLPARKNTKGGK                                   217
            TTYGKLGVKVWIYRGEVLPARKNTKGGK
Sbjct: 181  TTYGKLGVKVWIYRGEVLPARKNTKGGK                                   208
```

A related DNA sequence was identified in *S. pyogenes* <SEQ ID 6379> which encodes the amino acid sequence <SEQ ID 6380>. Analysis of this protein sequence reveals the following:

```
Possible site: 53
>>> Seems to have no N-terminal signal sequence
----- Final Results -----
   bacterial cytoplasm --- Certainty = 0.3758 (Affirmative) <succ>
      bacterial membrane --- Certainty = 0.0000 (Not Clear) <succ>
         bacterial outside --- Certainty = 0.0000 (Not Clear) <succ>
```

Based on this analysis, it was predicted that this protein and its epitopes, could be useful antigens for vaccines or diagnostics.

Example 2063

A DNA sequence (GBSx2176) was identified in *S. agalactiae* <SEQ ID 6381> which encodes the amino acid sequence <SEQ ID 6382>. This protein is predicted to be 50S ribosomal protein L22 (rp1V). Analysis of this protein sequence reveals the following:

```
Possible site: 36
>>> Seems to have no N-terminal signal sequence
----- Final Results -----
   bacterial cytoplasm --- Certainty = 0.2704 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database.

```
>GP:AAD33279 GB:AF126061 RpL22 [Streptococcus pneumoniae]
Identities = 99/114 (86%), Positives = 106/114 (92%)
Query:   1    MAEITSAKAMARTVRVSPRKTRLVLDLIRGKNVADAIAILKFTPNKAARVIEKTLNSAIA    60
              MAEITSAKAMARTVRVSPRK+RLVLD IRGK+VADAIAIL FTPNKAA +I K LNSA+A
Sbjct:   1    MAEITSAKAMARTVRVSPRKSRLVLDNIRGKSVADAIAILTFTPNKAAEIILKVLNSAVA    60

Query:  61    NAENNFGLEKANLVVSETFANEGPTMKRFRPRAKGSASPINKRTTHVTVVVSEK        114
              NAENNFGL+KANLVVSE FANEGPTMKRFRPRAKGSASPINKRT H+TV V+EK
Sbjct:  61    NAENNFGLDKANLVVSEAFANEGPTMKRFRPRAKGSASPINKRTAHITVAVAEK        114
```

A related DNA sequence was identified in *S. pyogenes* <SEQ ID 6383> which encodes the amino acid sequence <SEQ ID 6384>. Analysis of this protein sequence reveals the following:

---

Possible site: 36
>>> Seems to have no N-terminal signal sequence
----- Final Results -----
    bacterial cytoplasm --- Certainty = 0.2794 (Affirmative) <succ>
      bacterial membrane --- Certainty = 0.0000 (Not Clear) <succ>
        bacterial outside --- Certainty = 0.0000 (Not Clear) <succ>

---

An alignment of the GAS and GBS proteins is shown below.

```
Identities = 113/114 (99%), Positives = 113/114 (99%)
Query:   1    MAEITSAEAMARTVRVSPRKTRLVLDLIRGKNVADAIAILKFTPNKAARVIEKTLNSAIA    60
              MAEITSAKAMARTVRVSPRKTRLVLDLIRGK VADAIAILKFTPNKAARVIEKTLNSAIA
Sbjct:   1    MAEITSAKAMARTVRVSPRKTRLVLDLIRGKKVADAIAILKFTPNKAARVIEKTLNSAIA    60

Query:  61    NAENNFGLEKANLVVSETFANEGPTMKRFRPRAKGSASPINKRTTHVTVVVSEK        114
              NAENNFGLEKANLVVSETFANEGPTMKRFRPRAKGSASPINKRTTHVTVVVSEK
Sbjct:  61    NAENNFGLEKANLVVSETFANEGPTMKRFRPRAKGSASPINKRTTRVTVVVSEK        114
```

Based on this analysis, it was predicted that this protein and its epitopes, could be useful antigens for vaccines or diagnostics.

Example 2064

A DNA sequence (GBSx2177) was identified in *S. agalactiae* <SEQ ID 6385> which encodes the amino acid sequence <SEQ ID 6386>. This protein is predicted to be 30S ribosomal protein S19 (rpsS). Analysis of this protein sequence reveals the following:

```
Identities = 92/92 (100%), Positives = 92/92 (100%)
Query:   1    MGRSLKKGPFVDEHLMKKVEAQANDEKKKVIKTWSRRSTIFPSFIGYTIAVYDGRKHVPV    60
              MGRSLKKGPFVDEHLMKKVEAQANDEKKKVIKTWSRRSTIFPSFIGYTIAVYDGRKHVPV
Sbjct:  19    MGRSLKKGPFVDEHLMKKVEAQANDEKKKVIKTWSRRSTIFPSFIGYTIAVYDGRKHVPV    78

Query:  61    YIQEDMVGHKLGEFAPTRTYKGHAADDKKTRR                              92
              YIQEDMVGHKLGEFAPTRTYKGHAADDKKTRR
Sbjct:  79    YIQEDMVGHKLGEFAPTRTYKGHAADDKKTRR                              110
```

---

Possible site: 23
>>> Seems to have no N-terminal signal sequence
----- Final Results -----
    bacterial cytoplasm --- Certainty = 0.2991 (Affirmative) <succ>
      bacterial membrane --- Certainty = 0.0000 (Not Clear) <succ>
        bacterial outside --- Certainty = 0.0000 (Not Clear) <succ>

---

The protein is similar to ribosomal protein S19 from *S. pneumoniae*.

A related DNA sequence was identified in *S. pyogenes* <SEQ ID 6387> which encodes the amino acid sequence <SEQ ID 6388>. Analysis of this protein sequence reveals the following:

---

Possible site: 41
>>> Seems to have no N-terminal signal sequence
----- Final Results -----
    bacterial cytoplasm --- Certainty = 0.3319 (Affirmative) <succ>
      bacterial membrane --- Certainty = 0.0000 (Not Clear) <succ>
        bacterial outside --- Certainty = 0.0000 (Not Clear) <succ>

---

An alignment of the GAS and GBS proteins is shown below.

Based on this analysis, it was predicted that this protein and its epitopes, could be useful antigens for vaccines or diagnostics.

Example 2065

A DNA sequence (GBSx2178) was identified in *S. agalactiae* <SEQ ID 6389> which encodes the amino acid sequence <SEQ ID 6390>. This protein is predicted to be L2 (rp1B). Analysis of this protein sequence reveals the following:

Possible site: 22
>>> Seems to have no N-terminal signal sequence
----- Final Results -----
   bacterial cytoplasm --- Certainty = 0.3182 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database.

```
>GP:AAC45959 GB:U43929 L2 [Bacillus subtilis]
Identities = 208/277 (75%), Positives = 239/277 (86%)
Query:   1 MGIKVYKPTTNGRRNMTSLDFAEITTNTPEKSLLVSLKNKAGRNNNGRITVRHQGGGHKR    60
           M IK YKP++NGRR MT+ DFAEITT+ PEKSLL  L  K GRNN G++TVRHQGGGHKR
Sbjct:   1 MAIKKYKPSSNGRRGMITSDFAEITTDKPEKSLLAPLHKKGGRNNQGKLTVRHQGGGHKR    60

Query:  61 HYRLIDFKRNKDGVEAVVKTIEYDPNRTANIALVHYTDGVKAYILAPKGLEVGQRIISGP   120
           YR+IDFKR+KDG+    V T+EYDPNR+ANIAL++Y DG K YILAPKG++VG    ++SGP
Sbjct:  61 QYRVIDFKRDKDGIPGRVATVEYDPNRSANIALINYADGEKRYILAPKGIQVGTEVMSGP   120

Query: 121 EADIKVGNALPLANIPVGTVIHNIELQPGKGAELIRAAGASAQVLGQEGKYVLVRLQSGE   180
           EADIKVGNALPL NIPVGTV+HNIEL+GEKG +L+R+AG SAQVLG+EGKYVLVRL SGE
Sbjct: 121 EADIKVGNALPLINIPVGTVVHNIELKPGKGGQLVRSAGTSAQVLGKEGKYVLVRLNSGE   180

Query: 181 VRMILGTCRATIGTVGNEQQSLVNIGKAGRNRWKGVRPTVRGSVMNPNDHPHGGGEGKAP   240
           VRMIL  CRA+IG VGNEQ  L+NIGKAGR+RWKG+RPTVRGSVMNPNDHPHGGGEG+AP
Sbjct: 181 VRMILSACRASIGQVGNEQHELINIGKAGRSRWKGIRPTVRGSVMNPNDHPHGGGEGRAP   240

Query: 241 VGRKAPSTPWGKPALGLKTRNKKAKSDKLIVRRRNQK                         277
           +GRK+P +PWGKP LG KTR KK KSDK IVRRR  K
Sbjct: 241 IGRKSPMSPWGKPTLGEKTRKKKEKSDKFIVRRRKNK                         277
```

A related DNA sequence was identified in *S. pyogenes* <SEQ ID 6391> which encodes the amino acid sequence <SEQ ID 6392>. Analysis of this protein sequence reveals the following:

Possible site: 41
>>> Seems to have no N-terminal signal sequence
----- Final Results -----
   bacterial cytoplasm --- Certainty = 0.2560 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

Based on this analysis, it was predicted that this protein and its epitopes, could be useful antigens for vaccines or diagnostics.

Example 2066

A DNA sequence (GBSx2180) was identified in *S. agalactiae* <SEQ ID 6393> which encodes the amino acid sequence <SEQ ID 6394>. This protein is predicted to be 50S ribosomal protein L23 (rp1W). Analysis of this protein sequence reveals the following:

Possible site: 44
>>> Seems to have no N-terminal signal sequence
Final Results
   bacterial cytoplasm --- Certainty = 0.1669 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database.

```
Identities = 264/277 (95%), Positives = 276/277 (99%)

Query:   1 MGIKVYKPTTNGRRNMTSLDFAEITTNTPEKSLLVSLKNKAGRNNNGRITVRHQGGGHKR    60
           +GIKVYKPTTNGRRNMTSLDFAEITT+TPEKSLLVSLK+KAGRNNNGRITVRHQGGGHKR
Sbjct:   1 VGIKVYKPTTNGRRNMTSLDFAEITTSTPEKSLLVSLKSKAGRNNNGRITVRHQGGGHKR    60

Query:  61 HYRLIDFKRNKDGVEAVVKTIEYDPNRTANIALVHYTDGVKAYILAPKGLEVGQRIISGP   120
           HYRLIDFKRNKDGVEAVVKTIEYDPNRTANIALVHYTDGVKAYI+APKGLEVGQRI+SGP
Sbjct:  61 HYRLIDFKRNKDGVEAVVKTIEYDPNRTANIALVHYTDGVKAYIIAPKGLEVGQRIVSGP   120

Query: 121 EADIKVGNALPLANIPVGTVIHNIELQPGKGAELIRAAGASAQVLGQEGKYVLVRLQSGE   180
           +ADIKVGNALPLANIPVGTV+HNIEL+PGKG EL+RAAGASAQVLGQEGKYVLVRLQSGE
Sbjct: 121 DADIKVGNALPLANIPVGTVVHNIELKPGKGGELVRAAGASAQVLGQEGKYVLVRLQSGE   180

Query: 181 VRMILGTCRATIGTVGNEQQSLVNIGKAGRNRWKGVRPTVRGSVMNPNDHPHGGGEGKAP   240
           VRMILGTCRATIGTVGNEQQSLVNIGKAGR+RWKG+RPTVRGSVMNPNDHPHGGGEGKAP
Sbjct: 181 VRMILGTCRATIGTVGNEQQSLVNIGKAGRSRWKGIRPTVRGSVMNPNDHPHGGGEGKAP   240

Query: 241 VGRKAPSTPWGKPALGLKTRNKKAKSDKLIVRRRNQK                         277
           VGRKAPSTPWGKPALGLKTRNKKAKSDKLIVRRRN+K
Sbjct: 241 VGRKAPSTPWGKPALGLKTRNKKAKSDKLIVRRRNEK                         277
```

```
>GP:BAB03855 GB:AP001507 ribosomal protein L23 [Bacillus halodurans]
Identities = 56/92 (60%), Positives = 67/92 (71%), Gaps = 1/92 (1%)
Query:   2   NLYDVIKKPVITEKSMVALEAGKYTFEVDTRAHKLLIKQAVEAAFDGVKVASVNTVTVKP    61
             N DVIK+PVITE+S  +   KYTFEVD RA+K  IK A+E  FD VKVA VNT+   K
Sbjct:   3   NARDVIKRPVITERSTEVMGDKKYTFEVDVRANKTQIKDAIEEIFD-VKVAKVNTMNYKG   61

Query:  62   KAKRVGRYTGFTSKTKKAIITLTADSKAIELF                               93
             K KR GRYTGFT++ KKAI+TLT DSK ++ F
Sbjct:  62   KPKRFGRYTGFTARRKKAIVTLTPDSKELDFF                               93
```

A related DNA sequence was identified in *S. pyogenes* <SEQ ID 6395> which encodes the amino acid sequence <SEQ ID 6396>. Analysis of this protein sequence reveals the following:

Possible site: 44
>>> Seems to have no N-terminal signal sequence
----- Final Results -----
   bacterial cytoplasm --- Certainty = 0.1617 (Affirmative) <succ>
    bacterial membrane --- Certainty = 0.0000 (Not Clear) <succ>
     bacterial outside --- Certainty = 0.0000 (Not Clear) <succ>

An alignment of the GAS and GBS proteins is shown below.

```
Identities = 96/98 (97%), Positives = 97/98 (98%)
Query:   1   MNLYDVIKKPVITEKSMVALEAGKYTFEVDTRAHKLLIKQAVEAAFDGVKVASVNTVTVK   60
             MNLYDVIKKPVITEKSM+ALEAGKYTFEVDTRAHKLLIKQAVEAAFDGVKVASVNTV VK
Sbjct:   1   MNLYDVIKKPVITEKSMIALEAGKYTFEVDTRAHKLLIKQAVEAAFDGVKVASVNTVNVK   60

Query:  61   PKAKRVGRYTGFTSKTKKAIITLTADSKAIELFAAEAE                         98
             PKAKRVGRYTGFTSKTKKAIITLTADSKAIELFAAEAE
Sbjct:  61   PKAKRVGRYTGFTSKTKKAIITLTADSKAIELFAAEAE                         98
```

Based on this analysis, it was predicted that this protein and its epitopes, could be useful antigens for vaccines or diagnostics.

Example 2067

A DNA sequence (GBSx2181) was identified in *S. agalactiae* <SEQ ID 6397> which encodes the amino acid sequence <SEQ ID 6398>. This protein is predicted to be 50S ribosomal protein L4 (rp1D). Analysis of this protein sequence reveals the following:

Possible site: 60
>>> Seems to have no N-terminal signal sequence
INTEGRAL   Likelihood = –1.54   Transmembrane 140-156 (139-156)
----- Final Results -----
    bacterial membrane --- Certainty = 0.1617 (Affirmative) <succ>
     bacterial outside --- Certainty = 0.0000 (Not Clear) <succ>
   bacterial cytoplasm --- Certainty = 0.0000 (Not Clear) <succ>

The protein has homology with the following sequences in the GENPEPT database.

```
>GP:AAC45957 GB:U43929 L4 [Bacillus subtilis]
Identities = 130/207 (62%), Positives = 160/207 (76%)

Query:    1   MANVKLFDQTGKEVSSVELNEAIFGIEPNESVVFDVVISQRASLRQGTHAVKNRSAVSGG    60
              M V L++Q G    +ELN ++FGIEPNESVVFD ++ QRASLRQGTH VKNRS V GG
Sbjct:    1   MPKVALYNQNGSTAGDIELNASVFGIEPNESVVFDA1LMQRASLRQGTHKVKNRSEVRGG    60

Query:   61   GRKPWRQKGTGRARQGSIRSPQWRGGGVVFGPTPRSYGYKLPQKVRRLALKSVYSAKVAE   120
              GRKPWRQKGTGRARQGSIRSPQWRGGGVVFGPTPRSY YKLP+KVRRLA+KSV S+KV +
Sbjct:   61   GRKPWRQKGTGRARQGSIRSPQWRGGGVVFGPTPRSYSYKLPKKVRRLAIKSVLSSKVID   120

Query:  121   DKFVAVENLSFAAPKTAEFASVLSALSIDSKVLVILEEGNEFAALSARNLPNVTVATATT   180
              +  + +E+L+   KT E A++L  LS++ K L++   + NE  ALSARN+P VTV   A
Sbjct:  121   NNIIVLEDLTLDTAKTKEMAAILKGLSVEKKALIVTADANEAVALSARNIPGVTVVEANG   180

Query:  181   ASVLDIVNADKLLVTKEAISTIEGVLA                                   207
              +VLD+VN +KLL+TK A+   +E VLA
Sbjct:  181   INVLDVVNHEKLLITKAAVEKVEEVLA                                   207
```

A related DNA sequence was identified in *S. pyogenes* <SEQ ID 6399> which encodes the amino acid sequence <SEQ ID 6400>. Analysis of this protein sequence reveals the following:

Possible site: 60
>>> Seems to have no N-terminal signal sequence
----- Final Results -----
 bacterial cytoplasm --- Certainty = 0.2544 (Affirmative) <succ>
  bacterial membrane --- Certainty = 0.0000 (Not Clear) <succ>
   bacterial outside --- Certainty = 0.0000 (Not Clear) <succ> bacterial membrane --- Certainty = 0.0000 (Not Clear) <succ>
 bacterial outside --- Certainty = 0.0000 (Not Clear) <succ>

An alignment of the GAS and GBS proteins is shown below.

```
Identities = 199/207 (96%), Positives = 203/207 (97%)
Query:   1  MANVKLEDQTGKEVSSVELNEAIFGIEPNESVVFDVVISQRASLRQGTHAVKNRSAVSGG    60
            MANVKLEDQTGKEVSSVELN+AIFGIEPNESVVEDVVISQRASLRQGTHAVKNRSAVSGG
Sbjct:   1  MANVKLFDQTGKEVSSVELNDAIFGIEPNESVVFDVVISQRASLRQGTHAVKNRSAVSGG    60

Query:  61  GRKPWRQKGTGRARQGSIRSPQWRGGGVVEGPTPRSYGYKLPQKVRRLALKSVYSAKVAE   120
            GRKPWRQKGTGRARQGSIRSPQWRGGGVVEGPTPRSYGYKLPQKVRRLALKSVYSAKVAE
Sbjct:  61  GRKPWRQKGTGRARQGSIRSPQWRGGGVVEGPTPRSYGYKLPQKVRRLALKSVYSAKVAE   120

Query: 121  DKFVAVENLSFAAPKTAEFASVLSALSIDSKVLVILEEGNEFAALSARNLPNVTVATATT   180
            DKFVAVE LSFAAPKTAEFA VLSALSID+KVLV++EEGNEFAALSARNLPNVTVATA T
Sbjct: 121  DKFVAVEGLSFAAPKTAEFARVLSALSIDTKVLVLVEEGNEFAALSARNLPNVTVATAAT   180

Query: 181  ASVLDIVNADKLLVTKEAISTIEGVLA                                    207
            ASVLDIVNADKLLVTKEAISTIE VLA
Sbjct: 181  ASVLDIVNADKLLVTKEAISTIEEVLA                                    207
```

Based on this analysis, it was predicted that this protein and its epitopes, could be useful antigens for vaccines or diagnostics.

Example 2068

A DNA sequence (GBSx2183) was identified in *S. agalactiae* <SEQ ID 6401> which encodes the amino acid sequence The protein has homology with the following sequences in the GENPEPT database.

```
>GP:AAC45956 GB:U43929 L3 [Bacillus subtilis]
Identities = 157/208 (75%), Positives = 180/208 (86%), Gaps = 2/208 (0%)
Query:   1  MTKGILGKKVGMTQIFTESGEFIPVTVIEATPNVVLQVRTVETDGYEAVQVGFDDKREVL    60
            MTKGILG+K+GMTQ+F E+G+ IPVTVIEA PNVVLQ KT E DGYEA+Q+GFDDKRE L
Sbjct:   1  MTKGILGRKIGMTQVFAENGDLIPVTVIEAAPNVVLQKKTAENDGYEAIQLGFDDKREKL    60

Query:  61  SNKPAKGHVAKANTAPKRFIREFKNIE--GLEVGAELSVEQFEAGDVVDVTGTSKGKGFQ   118
            SNKP KGHVAKA TAPKRF++E + +E     EVG E+ VE F AG++VDVTG SKGKGFQ
Sbjct:  61  SNKPEKGHVAKAETAPKRFVKELRGVEMDAYEVGQEVKVEIFSAGEIVDVTGVSKGKGFQ   120

Query: 119  GVIKRHGQSRGPMAHGSRYHRRPGSMGPVAPNRVFKNKRLAGRMGGNRVTVQNLEIVQVI   178
            G IKRHGQSRGPM+HGSRYHRRPGSMGPV PNRVFK K L GRMGG ++TVQNLEIV+V
Sbjct: 121  GAIKRHGQSRGPMSHGSRYHRRPGSMGPVDPNRVFKGKLLPGRMGGEQITVQNLEIVKVD   180

Query: 179  PEKNVVLIKGNVPGAKKSLITIKSAVKA                                   206
            E+N++LIKGNVPGAKKSLIT+KSAVK+
Sbjct: 181  AERNLLLIKGNVPGAKKSLITVKSAVKS                                   208
```

<SEQ ID 6402>. This protein is predicted to be 50S ribosomal protein L3 (rplC). Analysis of this protein sequence reveals the following:

Possible site: 40
>>> Seems to have no N-terminal signal sequence
----- Final Results -----
 bacterial cytoplasm --- Certainty = 0.2090 (Affirmative) <succ>

A related DNA sequence was identified in *S. pyogenes* <SEQ ID 6403> which encodes the amino acid sequence <SEQ ID 6404>. Analysis of this protein sequence reveals the following:

Possible site: 40
>>> Seems to have no N-terminal signal sequence
----- Final Results -----

-continued bacterial cytoplasm --- Certainty = 0.2090 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 205/208 (98%), Positives = 207/208 (98%)
Query: 1     MTKGILGKKVGMTQIFTESGEFIPVTVIEATPNVVLQVKTVETDGYEAVQVGFDDKREVL   60
             MTKGILGKKVGMTQIFTESGEFIPVTVIEATPNVVLQVKTVETDGYEAVQVGFDDKREVL
Sbjct: 1     MTKGILGKKVGMTQIFTESGEFIPVTVIEATPNVVLQVKTVETDGYEAVQVGFDDKREVL   60

Query: 61    SNKPAKGHVAEANTAPKRFIREFKNIEGLEVGAELSVEQFEAGDVVDVTGTSKGKGFQGV  120
             SNKPAKGHVA ANTAPKRFIREFKNIEGLEVGAELSVEQFEAGDVVDVTG SKGKGFQGV
Sbjct: 61    SNKPAKGHVAKANTAPKRFIREFKNIEGLEVGAELSVEQFEAGDVVDVTGISKGKGFQGV  120

Query: 121   IKRHGQSRGPMAHGSRYHRRPGSMGPVAPNRVFKNKRLAGRMGGNRVTVQNLEIVQVIPE  180
             IKRHGQSRGPMAHGSRYHRRPGSMGPVAPNRVFKNKRLAGRMGGNRVTVQNLEIVQVIPE
Sbjct: 121   IKRHGQSRGPMAHGSRYHRRPGSMGPVAPNRVFKNKRLAGRMGGNRVTVQNLEIVQVIPE  180

Query: 181   KNVVLIKGNVPGAKKSLITIKSAVKAAK                                 208
             KNV+L+KGNVPGAKKSLITIKSAVKAAK
Sbjct: 181   KNVILVKGNVPGAKESLITIKSAVKAAK                                 208
```

Based on this analysis, it was predicted that this protein and its epitopes, could be useful antigens for vaccines or diagnostics.

Example 2069

A DNA sequence (GBSx2184) was identified in *S. agalactiae* <SEQ ID 6405> which encodes the amino acid sequence <SEQ ID 6406>. Analysis of this protein sequence reveals the following:

Possible site: 20
>>> Seems to have an uncleavable N-term signal seq

-continued

INTEGRAL   Likelihood = −0.43   Transmembrane 5-21 (5-21)
----- Final Results -----
bacterial membrane --- Certainty = 0.1171 (Affirmative) <succ>
bacterial outside --- Certainty = 0.0000 (Not Clear) <succ>
bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2070

A DNA sequence (GBSx2185) was identified in *S. agalactiae* <SEQ ID 6407> which encodes the amino acid sequence <SEQ ID 6408>. This protein is predicted to be 30S ribosomal protein S10 (rpsJ). Analysis of this protein sequence reveals the following:

Possible site: 37
>>> Seems to have no N-terminal signal sequence
----- Final Results -----
bacterial cytoplasm --- Certainty = 0.3160 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:AAB46363 GB:L29637 S10 ribosomal protein [Streptococcus mutans]
Identities = 98/102 (96%), Positives = 102/102 (99%)
Query: 1     MANKKIRIRLKAYEHRTLDTAAEKIVETATRTGATVAGPVPLPTERSLYTIIRATHKYKD   60
             MANKKIRIRLKAYEHRTLDTAAEKIVETATRTGA+VAGPVPLPTERSLYT+IRATHKYKD
Sbjct: 1     MANKKIRIRLKAYEHRTLDTAAEKIVETATRTGASVAGPVPLPTERSLYTVIRATHKYKD   60

Query: 61    SREQFEMRTHKRLVDIINPTQKTVDALMKLDLPSGVNVEIKL                   102
             SREQFEMRTHKRL+DI+NPTQKTVDALMKLDLPSGVNVEIKL
Sbjct: 61    SREQFEMRTHKRLIDIVNPTQKTVDALMKLDLPSGVNVEIKL                   102
```

A related DNA sequence was identified in *S. pyogenes* <SEQ ID 6409> which encodes the amino acid sequence <SEQ ID 6410>. Analysis of this protein sequence reveals the following:

Possible site: 37
>>> Seems to have no N-terminal signal sequence
----- Final Results -----
bacterial cytoplasm --- Certainty = 0.3160 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 102/102 (100%), Positives = 102/102 (100%)
Query: 1    MANKKIRIRLKAYEHRTLDTAAEKIVETATRTGATVAGPVPLPTERSLYTIIRATHKYKD    60
            MANKKIRIRLKAYEHRTLDTAAEKIVETATRTGATVAGPVPLPTERSLYTIIRATHKYKD
Sbjct: 1    MANKKIRIRLKAYEHRTLDTAAEKIVETATRTGATVAGPVPLPTERSLYTIIRATHKYKD    60

Query: 61   SREQFEMRTHKRLVDIINPTQKTVDALMKLDLPSGVNVEIKL                    102
            SREQFEMRTHKRLVDIINPTQKTVDALMKLDLPSGVNVEIKL
Sbjct: 61   SREQFEMRTHKRLVDIINPTQKTVDALMKLDLPSGVNVEIKL                    102
```

Based on this analysis, it was predicted that this protein and its epitopes, could be useful antigens for vaccines or diagnostics.

Example 2071

A DNA sequence (GBSx2186) was identified in *S. agalactiae* <SEQ ID 6411> which encodes the amino acid sequence <SEQ ID 6412>. Analysis of this protein sequence reveals the following:

```
Possible site:34
>>> Seems to have no N-terminal signal sequence
----- Final Results -----
   bacterial cytoplasm --- Certainty = 0.2538 (Affirmative) <succ>
      bacterial membrane --- Certainty = 0.0000 (Not Clear) <succ>
         bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2072

A DNA sequence (GBSx2187) was identified in *S. agalactiae* <SEQ ID 6413> which encodes the amino acid sequence <SEQ ID 6414>. Analysis of this protein sequence reveals the following:

```
Possible site: 46
>>> Seems to have no N-terminal signal sequence
   INTEGRAL    Likelihood = -11.41   Transmembrane 88-104 (79-110)
   INTEGRAL    Likelihood = -8.39    Transmembrane 304-320 (300-324)
   INTEGRAL    Likelihood = -6.58    Transmembrane 185-201 (180-206)
   INTEGRAL    Likelihood = -5.63    Transmembrane 338-354 (331-357)
   INTEGRAL    Likelihood = -5.52    Transmembrane 240-256 (237-259)
   INTEGRAL    Likelihood = -4.99    Transmembrane 383-399 (375-407)
   INTEGRAL    Likelihood = -3.82    Transmembrane 49-65 (48-73)
   INTEGRAL    Likelihood = -2.87    Transmembrane 127-143 (121-144)
   INTEGRAL    Likelihood = -2.81    Transmembrane 159-175 (159-177)
   INTEGRAL    Likelihood = -2.18    Transmembrane 30-46 (30-47)
----- Final Results -----
   bacterial membrane --- Certainty = 0.5564 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the GENPEPT database.

```
>GP:BAB06655 GB:AP001517 unknown conserved protein [Bacillus halodurans]
Identities = 132/423 (31%), Positives = 210/423 (49%), Gaps = 16/423 (3%)
Query: 7    IIQLAIPAMIENILQMLMGVVDNYLVAQLGVVAVSGVSVANNIITIYQAIF--IALGASI    64
            +  L  P  IE +L MLMG  D   +++Q    AV+ V V+N I+ +    +F  +A G SI
Sbjct: 11   LFALTWPIFIEILLHMLMGNADTLMLSQYSDDAVAAVGVSNQILAVIIVMFGFVATGTSI    70

Query: 65   ASLLAKSLAGSKKDDAISVCSQAIFLTLLIGAVLGIISIVFGQTFFKLLGTTKSVAQVGG    124
              L+A+ L    ++++A V   +I   L+ G VLG++ I FG    K +    S+ Q
Sbjct: 71   --LVAQHLGAKERENAGKVAVVSIGANLIFGIVLGLLLIAFGPPILKAMQLDDSLLQEAT    128

Query: 125  LYLAIVGGGVVTLGMLTTGSFLRVQGQPRLPMYVSIFVNFLNAVLSGFAIFEWR----Y    180
            LYL IVGG V    ++ T G+ LR    +   MYV+I +N LN + +     IF
Sbjct: 129  LYLQIVGGFSVVQSLIMTAGAILRSHSFTKDVMYVTIGMNILNVIGNYLFIFGPFGIPVL    188

Query: 181  GLVGVAVSTLIARLIGICILAKYL--------PIKKIIKRMTWKISAQIWNLALPSAGER    232
            G+ GVA+ST+++R IG+ ++A  L           P  ++KR       +  +  +PSAGE+
Sbjct: 189  GVTGVALSTVVSRTIGLFVIAILLYKRIRGELPFAYLLKRFPRVELRNLLKIGIPSAGEQ    248

Query: 233  LMMRAGDVVIVAIVVQLGTNVVAGNAIGETLTQFNYMPGLGIATATIILTAKYVGQKNRE    292
            L   A  +VI   +  +GT +       + L  F ++   + T  IL    VG K  +
Sbjct: 249  LSYNASQLVITYFIAMMGTEALTTKVYTQNLMMFVLFAVAIGQGTQILIGHQVGAKQIQ    308

Query: 293  SIEETIQSSYYIGLVLMILISSFMLLAGKPLTQLFTNNPSAIKGSLIVILLSFVGVPATI    352
            +       S +I + + + ++          PL  +FT+NP +    ++LL+ +   P
Sbjct: 309  AAYVRCFRSLWIAMTVSVSMAVVFFAFSTPLLGIFIDNPDILSLGTTLLLLTIILEPGRA    368

Query: 353  GTLVYTAAWQGLGNAKLPFYTTTIGMWLIRVVLGYLLGIVFELGLLGVWMATIADNIFRW    412
                LV  ++  +  G+ K P Y   + MW I V + YLLG+     LGL+GVW+A IAD  FR
Sbjct: 369  CNLVVISSLRAAGDVKFPVYLAIVSMWGIAVPIAYLLGLPLGLGLIGVWIAFIADEWFRG    428

Query: 413  LFL                                                          415
            L +
Sbjct: 429  LLM                                                          431
```

A related DNA sequence was identified in *S. pyogenes* <SEQ ID 6415> which encodes the amino acid sequence <SEQ ID 6416>. Analysis of this protein sequence reveals the following:

Possible site: 48
>>> Seems to have no N-terminal signal sequence
INTEGRAL    Likelihood = −5.26    Transmembrane 89-105 (85-108)
INTEGRAL    Likelihood = −4.35    Transmembrane 305-321 (302-322)
INTEGRAL    Likelihood = −3.82    Transmembrane 161-177 (161-180)
INTEGRAL    Likelihood = −3.82    Transmembrane 192-208 (189-208)
INTEGRAL    Likelihood = −3.77    Transmembrane 129-145 (128-151)
INTEGRAL    Likelihood = −3.24    Transmembrane 242-258 (240-258)
INTEGRAL    Likelihood = −2.81    Transmembrane 378-394 (377-394)
INTEGRAL    Likelihood = −2.66    Transmembrane 339-355 (338-358)
INTEGRAL    Likelihood = −2.60    Transmembrane 58-74 (58-75)
INTEGRAL    Likelihood = −2.50    Transmembrane 32-48 (32-49)
----- Final Results -----
  bacterial membrane --- Certainty = 0.3102 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP:BAB06655 GB:AP001517 unknown conserved protein [Bacillus halodurans]
     Identities = 119/435 (27%), Positives = 214/435 (48%), Gaps = 14/435 (3%)
Query:   9  IFSLALPSMIENILQMLMGMVDNYLVAQIGLVAVSGVSIANNIISIYQSLFIALGAAVSS   68
            +F+L  P  IE +L MLMG  D   +Q      AV+ V ++N I+++   +F  +    S
Sbjct:  11  LFALTWPIFIEILLHMLMGNADTLMLSQYSDDAVAAVGVSNQILAVIIVMFGFVATGTSI   70

Query:  69  LIARSIGENNQNKQLNYMAGVLQVTLLLSVGLGLLSVAGHHQVLEWLGAEASVTLVGGQY  128
            L+A+ +G +              +   L+ + LGLL +A     +L+ +   + S+      Y
Sbjct:  71  LVAQHLGAKERENAGKVAVVSIGANLIFGIVLGLLLIAFGPPILKAMQLDDSLLQEATLY  130

Query: 129  LSIVGGMIVSLGLLTSLGAIVRAQGYPKIPMQVSLLINVLNAIFSALSIY----VWGFGL  184
            L IVGG  V   L+ +  GAI+R+  +  K  M V++  +N+LN  I  + L I+    +     G+
Sbjct: 131  LQIVGGFSVVQSLIMTAGAILRSHSFTKDVMYVTIGMNILNVIGNYLFIFGPFGIPVLGV  190

Query: 185  LGVAWATVLSRLVGVFLLCQF--------IPIKQVAKRLMRPLDKIIFDLSLPAAGERLM  236
              GVA +TV+SR +G+F++         +P   +  KR  R   + +   + +P+AGE+L
Sbjct: 191  TGVALSTVVSRTIGLFVIAILLYKRIRGELPFAYLLKRFPRVELRNLLKIGIPSAGEQLS  250

Query: 237  MRAGDVLIIGIVVRFGTTALAGNAIGETLTQFNYMPGLAMATATIILVARQLGGGKVTEI  296
              A  ++I +    GT AL    + L F ++ +A+     T IL+  Q+G   ++
Sbjct: 251  YNASQLVITYFIAMMGTEALTTKVYTQNLMMFVFLFAVAIGQGTQILIGHQVGAKQIQAA  310

Query: 297  RYIIREAFILSTLMMLVMGALTYLLGPSLLPLFTQNTDAQRSAMIVLLFSLLGAPATAGT  356
                +  ++ +  + M + +          LL  +FT N D          +LL +++   P  A
Sbjct: 311  YVRCFRSLWIAMTVSVSMAVVFFAFSTPLLGIFTDNPDILSLGTTLLLLTIILEPGRACN  370

Query: 357  LVYTAVWQGLGKAKLPFYATTIGMWVIRIGLGYVIGVVWQYGLIGVWMATVLDNTSRWFI  416
            LV +  + G  K P Y   + MW I + + Y++G+       GLIGVW+A + D   R +
Sbjct: 371  LVVISSLRAAGDVKFPVYLAIVSMWGIAVPIAYLLGLPLGLGLIGVWIAFIADEWFRGLL  430

Query: 417  LSKHFK--KYQEITF                                              429
            +   ++  K+QE++F
Sbjct: 431  MIWRWRKGKWQEMSF                                              445
```

An alignment of the GAS and GBS proteins is shown below.

```
Identities 219/418 (52%), Positives = 316/418 (75%)
Query:   5  KEIIQLAIPAMIENILQMLMGVVDNYLVAQLGVVAVSGVSVANNIITIYQAIFIALGASI   64
            ++I   LA+P+MIENILQMLMG+VDNYLVAQ+G+VAVSGVS+ANNII+IYQ++FIALGA++
Sbjct:   7  RKIFSLALPSMIENILQMLMGMVDNYLVAQIGLVAVSGVSIANNIISIYQSLFIALGAAV   66

Query:  65  ASLLAKSLAGSKKDDAISVCSQAIFLTLLIGAVLGIISIVFGQTFFKLLGTTKSVAQVGG  124
            +SL+A+S+   + ++  ++  +  +TLL+  LG++S+       + LG    SV  VGG
Sbjct:  67  SSLIARSIGENNQNKQLNYMAGVLQVTLLLSVGLGLLSVAGHHQVLEWLGAEASVTLVGG  126

Query: 125  LYLAIVGGGVVTLGMLTTLGSFLRVQGQPRLPMYVSIFVNFLNAVLSGFAIFEWRYGLVG  184
             YL+IVGG +V+LG+LT+LG+ +R QG P++PM VS+ +N LNA+ S   +I+ W +GL+G
Sbjct: 127  QYLSIVGGMIVSLGLLTSLGAIVRAQGYPKIPMQVSLLINVLNAIFSALSIYVWGFGLLG  186

Query: 185  VAVSTLIARLIGICILAKYLPIKKIIKRMTWKISAQIWNLALPSAGERLMMRAGDVVIVA  244
            VA +T+++ RL+G+ +L   +PIK++ KR+    +   I++L+LP+AGERLMMRAGDV+I+
Sbjct: 187  VAWATVLSRLVGVFLLCQFIPIKQVAKRLMRPLDKIIFDLSLPAAGERLMMRAGDVLIIG  246

Query: 245  IVVQLGTNVVAGNAIGETLTQFNYMPGLGIATATIILTAKYVGQKNRESIEETIQSSYYI  304
            IVV+  GT  +AGNAIGETLTQFNYMPGL +ATATIIL A+ +G      I   I+ ++ +
Sbjct: 247  IVVRFGTTALAGNAIGETLTQFNYMPGLAMATATIILVARQLGGGKVTEIRYIIREAFIL  306

Query: 305  GLVLMILISSFMLLAGKPLTQLFTNNPSAIKGSLIVILLSFVGVPATIGTLVYTAAWQGL  364
              ++M+++ +  LL GKPL QLFT N  A  + +IV+L S +G PAT GTLVYTA WQGL
Sbjct: 307  STLMMLVMGALTYLLGPSLLPLFTQNTDAQRSAMIVLLFSLLGAPATAGTLVYTAVWQGL  366
```

```
Query:  365  GNAKLPFYTTTIGMWLIRVVLGYLLGIVFELGLLGVWMATIADNIFRWLFLKVHYHRY    422
             G AKLPFY TTIGMW+IR+ LGY++G+V++ GL+GVWMAT+ DN  RW L  H+ +Y
Sbjct:  367  GKAKLPFYATTIGMWVIRIGLGYVIGVVWQYGLIGVWMATVLDNTSRWFILSKHFKKY    424

Identities = 48/211 (22%), Positives = 89/211 (41%), Gaps = 29/211 (13%)
Query:  213  MTWKISAQIWNLALPSAGERLMMRAGDVVIVAIVVQLGTNVVAGNAIGETLTQFNYMPGL  272
             M +   +I++LALPS E ++      +V   +V Q+G   V+G +I   +       +
Sbjct:  1    MIYNNRRKIFSLALPSMIENILQMLMGMVDNYLVAQIGLVAVSGVSIANNIISIYQSLFI  60

Query:  273  GIATATIILTAKYVGQKNRESIEETIQSSYYIGLVLMILISSFML--------------L  318
              + A   L A+ +G+ N+        Q +Y  G++ + L+ S  L              L
Sbjct:  61   ALGAAVSSLIARSIGENNQNK-----QLNYMAGVLQVTLLLSVGLGLLSVAGHHQVLEWL  115

Query:  319  AGKPLTQLFTNNPSAIKGSLIVILLSFVGVPATIGTLVYTAAWQGLGNAKLPFYTTTIGM  378
                +     L    +I G +IV L     G+   ++G +V     + G  K+P + + +
Sbjct:  116  GAEASVTLVGGQYLSIVGGMIVSL----GLLTSLGAIV-----RAQGYPKIPMQVSLL-I  165

Query:  379  WLIRVVLGYLLGIVFELGLLGVWMATIADNI                               409
             ++ +   L    V+ GLLGV   AT+    +
Sbjct:  166  NVLNAIFSALSIYVWGFGLLGVAWATVLSRL                               196
```

A related GBS gene <SEQ ID 8971> and protein <SEQ ID 8972> were also identified. Analysis of this

```
INTEGRAL     Likelihood = -2.18   Transmembrane 30-46 (30-47)
PERIPHERAL   Likelihood = 0.32    11
modified ALOM score: 2.78
*** Reasoning Step: 3
```

```
----- Final Results -----
   bacterial membrane --- Certainty = 0.5564 (Affirmative) <succ>
   bacterial outside --- Certainty = 0.0000 (Not Clear) <succ>
   bacterial cytoplasm --- Certainty = 0.0000 (Not Clear) <succ>
```

The protein has homology with the following sequences in the databases:

```
ORF01629(313-1533 of 1878)
EGAD|165726|TM0815(20-436 of 464) conserved hypothetical protein {Thermotoga maritima}
OMNI|TM0815 conserved hypothetical protein GP|4981345|gb|AAD35897.1|AE001748_13|AE001748
conserved hypothetical protein {Thermotoga maritima} PIR|H72331|H72331 conserved
hypothetical protein - Thermotoga maritima (strain MSB8)
% Match = 13.9
% Identity = 29.4  % Similarity = 53.7
Matches = 120 Mismatches = 183 Conservative Sub.s = 99

48        78       108       138       168       198       228       258
YK*RRDTGFRCYFNLKRFVRCFFT*GGYRSTKGRSNP*NGSTYLKYARNG*RVSRFETIIKIRLF*NI*SEKETF*KFSH

M
     288       318       348       378       408       438       468       498
HSLFNDPG**KGDTVRYSKEIIQLAIPAMIENILQMLMGVVDNYLVAQLGVVAVSGVSVANNIITIYQAIFIALGASIAS
           ||:|||:||| ||:|||| |: |   ::  :    |:||| ::|  :   | ::||
RYSLFKNYLPKEEVPEIRKELIKLALPAMGENVQMLFGMADTAFLGHYSWKAMSGVGLSNQVFWVVQVVLIAASMGATV
          20        30        40        50        60        70        80

528       558       588       609       639       669       699       729
LLAKSLAGSKKDDAISVCSQAIFLTLLIGAVL---GIISIVFGQTFFKLLGTTKSVAQVGGLYLAIVGGGVVTLGMLTTL
:|  ::    |:    ::||   |:  |        ||  |    :||        :||      |  :  :  :
TIANAIGAGNRKAVRSLAWNSVFLAIFTGVILTALTPLSDVLINIFPNLEGEIESSA---KEYLKVILSGSMGFSIMAVF
         100       110       120       130       140       150

759       789       819       837       867       897       909       939
GSFLRVQGQPRLPMYVSIFVNFLNAVLSGFAIF----EWRYGLVGVAVSTLIARLIGICILA------KYLPIKKIIKRM
: ||   |   |||  : :  ||||   |   ||     |: | ||:|:::|  ||         : : :|  :
SAMLRGAGDTRTPMIVTGLTNFLNIFLDYAMIFGKFGFPEMGVRGAAVATILSRFVGAGILTYVIFKREEFQLRKGLVPP
         170       180       190       200       210       220       230

969       999      1029      1059      1089      1119      1149      1179
TWKISAQIWNLALPSAGERLMMRAGDVVIVAIVVQLGTNVVAGNAIGETLTQFNYMPGLGIATATIILTAKYVGQKNRES
|   :|   : :|:|    || | ::  |:  ::::||  ||    : |  |        ::|||  |     |    |:|
KWSSQKEILRVGFPTAIENFVFSTGVLMFANILLIAGAEAYAGHRIGINVESLSFMPAFGISVAITTLVGRYNGMGNKEH
         250       260       270       280       290       300       310

1209      1239      1269      1299      1329      1359      1383      1413
IEETIQSSYYIGLVLMILISSFMLLAGKPLTQLFTNNPSAIKGSLIVILLSFVGVPATIGTLVYT--AAWQGLGNAKLPF
  :|   : : |:: :   :  :|   :|| ::||:|| :|   |: |   :  :| | || |      | | :||  |
VLGVIRQGWILSLLFQVTVGIIIFLFPEPLIRIFTSDPQIIEISKLPV--KIIGLFQFFLAIDSTMNGALRGTGNTLPPM
         330       340       350       360       370       380       390
```

```
1443       1473       1503       1533       1563       1593       1623       1653
YTTTIGMWLIRVVLGYLLGIVFELGLLGVWMATIADNIFRWLFLKVHYHRYIQKM*PEMVAFFSKIIK*CLRVLFFFDII
    |  :|    |:  :  :::       |:|||||  |:     |||  |||
IITFISIWTARLPVAFVMVKYFQLGLLGAWIGMIADIIFRSTLKLLFFLSGKWEKRAVLTRERVKELG
              410        420        430        440        450        460
```

Based on this analysis, it was predicted that these proteins and their epitopes could be useful antigens for vaccines or diagnostics.

Example 2073

A DNA sequence (GBSx2188) was identified in *S. agalactiae* <SEQ ID 6417> which encodes the amino acid sequence <SEQ ID 6418>. Analysis of this protein sequence reveals the following:

Possible site: 20
>>> Seems to have no N-terminal signal sequence
----- Final Results -----
   bacterial cytoplasm --- Certainty = 0.2200 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

No corresponding DNA sequence was identified in *S. pyogenes*.

Based on this analysis, it was predicted that this protein and its epitopes, could be useful antigens for vaccines or diagnostics.

Example 2074

A DNA sequence (GBSx2189) was identified in *S. agalactiae* <SEQ ID 6419> which encodes the amino acid sequence <SEQ ID 6420>. Analysis of this protein sequence reveals the following:

Possible site: 27
>>> Seems to have no N-terminal signal sequence
----- Final Results -----
   bacterial cytoplasm --- Certainty = 0.3153 (Affirmative) <succ>

```
>GP:AAD05671 GB:AE001448 THREONINE SYNTHASE [Helicobacter pylori J99]

Identities = 161/479 (33%), Positives = 259/479 (53%), Gaps = 17/479 (3%)

Query:  14   KVTASQAILKGLADDGGLFTPITFPKVDLDFTKLKDASYQEVAKLVLSAFFDDFTEQELD    73
             K+    +A+L   A  GGL+T  F      L++       SY E+ + V    +   + L
Sbjct:  13   KIDFIEAVLNPNAPKGGLYTLEHFET--LEWQDCLGMSYSELVEHVFELLNLEIPKNLLA    70

Query:  74   YCISQAYDTKFDTTEIAPIVKIGDRYHL-ELFHGPTIAFKDMALSILPYLLTTAAKKQGV   132
             + + Y+  +     API  + +R + EL+HGP++AFKDMAL    L  L +   A    G
Sbjct:  71   SALKR-YENFDNPKNPAPIFALNERLFVQELYHGPSLAFKDMALQPLASLFSNLAV--GK   127

Query: 133   DNKIVILTATSGDTGKAAMAGFADVPGTEIIVFYPKNGVSYIQELQMITQAGQNTHVVAI   192
             + K ++L +TSGDTG A + G A +P    ++   YPK+G S +Q+LQM+TQ   N V +
Sbjct: 128   NEKYLVLVSTSGDTGPATLEGLAGMPNVFVVCLYPKDGTSLVQKLQMVTQNASNLKVFGV   187

Query: 193   EGNFDDAQTSVKEMFNNSLLRLKLSQQHMQLSSANSMNIGRLVPQIVYYIYAYAQLVKSK   252
             G+FDDAQ ++K +  +     L  + ++LS ANS+N GR+    QIVY+I+ + +L K
Sbjct: 188   SGDFDDAQNALKNLLKDDDFNEALKARQLKLSVANSVNFGRIAFQIVYHIWGFLELYKKG   247

Query: 253   EISIGQPINFSVPTGNFGNILAAYYASQIGLPVTKLICASNDNNVLTDFFKTQTYD-KNR   311
              I+  + I   ++P+GNFGN L A+YA ++GL  + K+    +N N+VL +F +T   YD   R
Sbjct: 248   AINSKEKITLAIPSGNFGNALGAFYAKKMGLNIAKIKVVTNSNDVLREFIETGRYDLTKR   307

Query: 312   EFKVTSSPSMDILVSSNLERLIFHLLGDDAETTKKLMEDLVTTGEYALEARQANIL-ESF   370
               K T  SP+MDIL  SSN+ER  +F L G    E T +LM+  L       YAL+  ++    +L E F
Sbjct: 308   SLKQTFSPAMDILKSSNVERALFSLFG--FERTLELMQALEEEKFYALKPKELALLQEHF   365

Query: 371   VAGFATEQFVELDIKHLFDQYQYIEDPHTAVASAVYQAYQTETKDQTPAVIVSTASPYKF   430
                      +++      I+ ++ ++QY+ DPHTA      A     K      ++ +TAS  KF
Sbjct: 366   SCASCSDEDCLKTIQEVYAEHQYLIDPHTAT------ALNASLKTHEKTLVSATASYEKF   419

Query: 431   PCVVTKAIT-NKEEIQDFAAISILNDLSGVSLPKAVTDLQKAEVIHRTVVPTSNMRETV   488
             P     A+    K+    D AA+  L +            + + DL +    + H+ V+   +  ++ ++
Sbjct: 420   PKTTLLALNEQKKNDDDKAALETLKNSYNTPDSQRLDDLFERGIKHQEVLKLNEIKSSI   478
```

-continued bacterial membrane --- Certainty = 0.0000 (Not Clear) <succ>
bacterial outside --- Certainty = 0.0000 (Not Clear) <succ>

A related GBS nucleic acid sequence <SEQ ID 9279> which encodes amino acid sequence <SEQ ID 9280> was also identified.

The protein has homology with the following sequences in the GENPEPT database.

```
>GP:AAF40975 GB:AE002410 alcohol dehydrogenase, propanol-preferring
[Neisseria meningitidis MC58]
Identities = 202/282 (71%), Positives = 228/282 (80%), Gaps = 1/282 (0%)
Query: 1     MGHEGIGIVEEIGEGVTSLRVGDRVSIAWFFEGCGHCEYCTTGRETLCRSVKNAGYSVDG   60
             +GHEGIG+V+E ++GV +L+VGDRVSIAW F+ CG CEYC TGRETLCRSV NAGY+ DG
Sbjct: 60    LGHEGIGLVKEVADGVKNLKVGDRVSIAWLFQSCGSCEYCNTGRETLCRSVLNAGYTADG  119

Query: 61    GMSEYAIVTADYAVKVPEGLDPAQASSITCAGVTTYKAIKEAGAAPGQWIAVYGAGGLGN  120
             GM+ + IV+ADYAVKVPEGLDPAQASSITCAGVTTYKAIK +G  PGQWIA+YGAGGLGN
Sbjct: 120   GMATHCIVSADYAVKVPEGLDPAQASSITCAGVTTYKAIKVSGVRPGQWIAIYGAGGLGN  179

Query: 121   LAVQYAKKVFNAHVVAVDINADKLQIAKEVGADLTVNGKEIKDVAAYIQEKTGGCHGVVV  180
             L VQYAKKVF AHVVA+DIN DKL  AKE GADL VN  + +D A  IQEKTGG H  VV
Sbjct: 180   LGVQYAKKVFGAHVVAIDINDDKLAFAKETGADLVVNAAK-EDAAKVIQEKTGGAHAAVV  238

Query: 181   TAVSKVAFNQAIDSVRAGGTVVAVGLPSEYMELSIVKTVLDGIRVVGSLVGTRKDLEEAF  240
             TAVS  AFN A++ VRAGG VVA+GLP E M+LSI +  VLDGI VVGSLVGTRKDLEEAF
Sbjct: 239   TAVSAAAFNSAVNCVRAGGRVVAIGLPPESMDLSIPRLVLDGIEVVGSLVGTRKDLEEAF  298

Query: 241   AFGAEGLVVPVVEKVPVDTAPQVFDEMERGLIQGRKVLDFTK                   282
             FGAEGLVVP V+   +D AP +F EM  G I GR V+D  K
Sbjct: 299   QFGAEGLVVPKVQLRALDEAPAIFQEMREGKITGRMVIDMKK                   340
```

A related DNA sequence was identified in *S. pyogenes* <SEQ ID 6421> which encodes the amino acid sequence <SEQ ID 6422>. Analysis of this protein sequence reveals the following:

Possible site: 31
>>> Seems to have no N-terminal signal sequence
----- Final Results -----
bacterial cytoplasm --- Certainty = 0.2356 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

Based on this analysis, it was predicted that this protein and its epitopes, could be useful antigens for vaccines or diagnostics.

Example 2075

A DNA sequence (GBSx2190) was identified in *S. agalactiae* <SEQ ID 6423> which encodes the amino acid sequence <SEQ ID 6424>. Analysis of this protein sequence reveals the following:

Possible site: 42
>>> Seems to have a cleavable N-term signal seq.

| | | | |
|---|---|---|---|
| INTEGRAL | Likelihood = −9.82 | Transmembrane 83-99 (76-108) |
| INTEGRAL | Likelihood = −7.27 | Transmembrane 46-62 (43-65) |
| INTEGRAL | Likelihood = −7.22 | Transmembrane 187-203 (182-209) |
| INTEGRAL | Likelihood = −6.00 | Transmembrane 243-259 (229-262) |
| INTEGRAL | Likelihood = −4.25 | Transmembrane 404- 420 (402-422) |
| INTEGRAL | Likelihood = −3.98 | Transmembrane 120-136 (119-136) |
| INTEGRAL | Likelihood = −3.88 | Transmembrane 308-324 (307-324) |
| INTEGRAL | Likelihood = −2.13 | Transmembrane 378-394 (376-394) |
| INTEGRAL | Likelihood = −1.38 | Transmembrane 152-168 (152-168) |
| INTEGRAL | Likelihood = −1.17 | Transmembrane 271-287 (271-287) |

----- Final Results -----
bacterial membrane --- Certainty = 0.4927 (Affirmative) <succ>

```
Identities = 263/280 (93%), Positives = 273/280 (96%)
Query: 1     MGHEGIGIVEEIGEGVTSLRVGDRVSIAWFFEGCGHCEYCTTGRETLCRSVKNAGYSVDG   60
             +GHEGIGIVEEIGEGVTSL+VGDRVSIAWFFEGCGHCEYCTTGRETLCRSVKNAGYSVDG
Sbjct: 76    LGHEGIGIVEEIGEGVTSLKVGDRVSIAWFFEGCGHCEYCTTGRETLCRSVKNAGYSVDG  135

Query: 61    GMSEYAIVTADYAVKVPEGLDPAQASSITCAGVTTYKAIKEAGAAPGQWIAVYGAGGLGN  120
             GMSEYA+VTADYAVKVPEGLDPAQASSITCAGVTTYKAIKEAGAAPGQWI ++GAGGLGN
Sbjct: 136   GMSEYAVVTADYAVKVPEGLDPAQASSITCAGVTTYKAIKEAGAAPGQWIVIFGAGGLGN  195

Query: 121   LAVQYAKKVFNAHVVAVDINADKLQIAKEVGADLTVNGKEIKDVAAYIQEKTGGCHGVVV  180
             LAVQYAKKVFNAHVVAVDIN DKL+LAKEVGAD+ VNGKEI+DV  YIQEKTGG HGVVV
Sbjct: 196   LAVQYAKKVFNAHVVAVDINNDKLELAKEVGADILVNGKEIEDVPGYIQEKTGGAHGVVV  255

Query: 181   TAVSKVAFNQAIDSVRAGGTVVAVGLPSEYMELSIVKTVLDGIRVVGSLVGTRKDLEEAF  240
             TAVSKVAFNQAIDSVRAGGTVVAVGLPSEYMELSIVKTVLDGI+VVGSLVGTRKDLEEAF
Sbjct: 256   TAVSKVAFNQAIDSVRAGGTVVAVGLPSEYMELSIVKTVLDGIKVVGSLVGTRKDLEEAF  315

Query: 241   AFGAEGLVVPVVEKVPVDTAPQVFDEMERGLIQGRKVLDF                     280
             AFGAEGLV PVVEKVPVDTAP+VFDEMERGLIQGRKVLDF
Sbjct: 316   AFGAEGLVAPVVEKVPVDTAPEVFDEMERGLIQGRKVLDF                     355
```

-continued bacterial outside --- Certainty = 0.0000 (Not Clear) <succ>
bacterial cytoplasm --- Certainty = 0.0000 (Not Clear) <succ>

A related GBS nucleic acid sequence <SEQ ID 9371> which encodes amino acid sequence <SEQ ID 9372> was also identified.

The protein has homology with the following sequences in the GENPEPT database.

```
>GP:AAC17857 GB:AF026147 YojI [Bacillus subtilis]
Identities = 183/432 (42%), Positives = 266/432 (61%), Gaps = 1/432 (0%)
Query: 1     MKLFIPVLIYQFANFSATFIDSVMTGQYSQLHLAGVSTASNLWTPFFALLVGMISALVPV    60
             + + IP+ I Q     TF+D+VM+G+ S    LAGV+  S+LWTP +  L G++ A+ P+
Sbjct: 15    LHILIPIFITQAGLSLITFLDTVMSGKVSPADLAGVAIGSSLWTPVYTGLAGILMAVTPI   74

Query: 61    VGQHLGRGNKEQIRTEFHQFLYLGLILSLILFLIMQFIAQPVLGSLGLEDEVLAVGRGYL   120
             V Q LG    K++I     Q +Y+  +LS+ + +I       +LG L L+  V  + + +L
Sbjct: 75    VAQLLGAEKKQKIPFTVLQAVYVAALLSIAVLVIGYAAVDLILGRLNLDIHVHQIAKHFL   134

Query: 121   NYMLIGIMPLVLFSICRSFFDALGLTRLSMYLMLLILPFNSFFNYMLIYGKFGMPRLGGA   180
             ++ +GI PL ++++ RSF D+LG TR++M + L  LP N   NY+ I+GKFGMP LGG
Sbjct: 135   GFLSLGIFPLFVYTVLRSFIDSLGKTRVTMMITLSSLPINFVLNYVFIFGKFGMPALGGV   194

Query: 181   GAGLGTSLTYWAIFIVIIIVMSLHPQIKTYHIW-TLERIKAPLIIEDIRLGLPIGLQIFA   239
             GAGL ++LTYW I I+    ++  +      Y I+ T+ +         +++GLPIG  +F
Sbjct: 195   GAGLASALTYWCICIISFFIIHKNAPFSEYGIFLTMYKFSWKACKNLLKIGLPIGFAVFF   254

Query: 240   EVAIFAVVGLFMAKFSSIIAAHQAAMNFSSLMYAFPLSISTALAITISFEVGAERFQDA   299
             E +IFA V L M+ F ++ IA+HQAAMNF+SL+Y  PLS+S AL I + FE GA RF+DA
Sbjct: 255   ETSIFAAVTLLMSHFHTVTIASHQAAMNFASLLYMLPLSVSMALTIVVGFEAGAARFKDA   314

Query: 300   NTYSRIGRLTAVGITSGTLLFLFLFRENVAANYNSDPHFVAITAQFLTYSLFFQFADAYA   359
             +YS IG + A+G +  T   + LFRE +A MY SDP  + +T  FL Y+LFFQ +DA A
Sbjct: 315   RSYSLIGIMMAIGFSLFTAACILLFREQIAGMYTSDPDVLRLTQHFLIYALFFQLSDAVA   374

Query: 360   APVQGILRGYKDTTKPFMIGAGSYWLCALPLAVILEKNSQLGPFAYWIGLITGIFVCGLF   419
             AP+QG LRGYKD          SYW+ LP+ ++   + LG F YWIGLI G+    +
Sbjct: 375   APIQGALRGYKDVNYTLAAAFVSYWVIGLPVGYMVGTFTSLGAFGYWIGLIAGLAAGAVG   434

Query: 420   LNQRLQKIKKLY                                                 431
             L  RL K++K Y
Sbjct: 435   LFFRLAKLQKRY                                                 446
```

Based on this analysis, it was predicted that this protein and its epitopes, could be useful antigens for vaccines or diagnostics.

Example 2076

A DNA sequence (GBSx2191) was identified in *S. agalactiae* <SEQ ID 6425> which encodes the amino acid sequence <SEQ ID 6426>. Analysis of this protein sequence reveals the following:

Possible site: 20
>>> Seems to have no N-terminal signal sequence
INTEGRAL    Likelihood = −2.60    Transmembrane 23-39 (23-39)
----- Final Results -----
    bacterial membrane --- Certainty = 0.2041(Affirmative) <succ>
        bacterial outside --- Certainty = 0.0000 (Not Clear) <succ>
            bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2077

A DNA sequence (GBSx2192) was identified in *S. agalactiae* <SEQ ID 6427> which encodes the amino acid sequence <SEQ ID 6428>. Analysis of this protein sequence reveals the following:

Possible site: 52
>>> Seems to have no N-terminal signal sequence
----- Final Results -----
    bacterial cytoplasm --- Certainty = 0.3829 (Affirmative) <succ>
        bacterial membrane --- Certainty = 0.0000 (Not Clear) <succ>
            bacterial outside --- Certainty = 0.0000 (Not Clear) <succ>

The protein has homology with the following sequences in the GENPEPT database.

```
>GP:AAC06891 GB:AE000703 hypothetical protein [Aquifex aeolicus]
Identities = 72/213 (33%), Positives = 115/213 (53%), Gaps = 11/213 (5%)
Query: 36   RPKILMHVCCAPCSTYTLEYLSQ---WADVTIYFANSNIHPKDEYYRREYVTQKFVHDFN   92
            + KIL+H+CCAP + Y L+ L +       +++ YF + NIHP +EY  R    T++  +
Sbjct: 3    KSKILVHICCAPDAIYFLKKLREDYPESEIIGYFYDPNIHPYEEYRLRYLETERICKELG   62
```

```
Query:  93  KNTGYSVQFLSAPYEPNEFFKIVHGLEEEPEGGDRCKVCYDFRLDKTAEKAVELGFDYFG  152
             N     + Y+   + + V G E+EPE G RC++C+D+RL+K+AE A ELG D
Sbjct:  63  IN------LIEGEYDLENWLERVKGYEDEPERGKRCQICFDYRLEKSAEVAKELGCDALT  116

Query: 153  SALTISPHKNSQTINTIGIDVQKIYDTQYLPSDLKKNKGYQRSVEMCKDYDIYRQCYCGC  212
            + L +SP K+   +   G + K   ++L  D +K  G Q   ++ K+ +IY+Q YCGC
Sbjct: 117  TTLLMSPKKSIPQLKKAGEEATKRTGIEFLAPDYRKGGGTQEMFKLSKEREIYQQDYCGC  176

Query: 213  IFGAKDQGINLLQIKKDAKAFVSDKDGKEEFPN                             245
            I+G   Q   +I  D  F+   + G +E  N
Sbjct: 177  IYGLFKQKNG--KIFWDLVGFLGRRPGSKEERN                             207
```

A related DNA sequence was identified in *S. pyogenes* <SEQ ID 6429> which encodes the amino acid sequence <SEQ ID 6430>. Analysis of this protein sequence reveals the following:

---

Possible site: 55
>>> Seems to have no N-terminal signal sequence
----- Final Results -----
  bacterial cytoplasm --- Certainty = 0.3498 (Affirmative) <succ>
  bacterial membrane --- Certainty = 0.0000 (Not Clear) <succ>
  bacterial outside --- Certainty = 0.0000 (Not Clear) <succ>

---

RGD motif: 254-256
The protein has homology with the following sequences in the databases:

```
>GP:AAC06891 GB:AE000703 hypothetical protein [Aquifex aeolicus]

Identities = 65/182 (35%), Positives = 106/182 (57%), Gaps = 9/182 (4%)

Query:  39  RPSILMHVCCAPCSTYTLEYLTQF---ADITVYFANSNIHPKDEYHRRAYVTQQFVSEFN   95
            +  IL+H+CCAP + Y L+ L +    ++I  YF + NIHP +EY R   T++    E
Sbjct:   3  KSKILVHICCAPDAIYFLKKLREDYPESEIIGYFYDPNIHPYEEYRLRYLETERICKELG   62

Query:  96  AKTGNTVQFLEADYVPNEYVRQVRGLEEEPEGGDRCRYCFDYRLDKTAQKAVELGFDYFA  155
              +  +E +Y    ++ +V+G E+EPE G RC++CFDYRL+K+A+ A ELG D
Sbjct:  63  ------INLIEGEYDLENWLERVKGYEDEPERGKRCQICFDYRLEKSAEVAKELGCDALT  116

Query: 156  SALTISPHKNSQTINDVGIDVQKVYTTKYLPSDFKKNNGYRRSVEMCEEYDIYRQCYCGC  215
            + L +SP K+   +   G + K   ++L  D++K  G +   ++ +E +IY+Q YCGC
Sbjct: 117  TTLLMSPKKSIPQLKKAGEEATKRTGIEFLAPDYRKGGGTQEMFKLSKEREIYQQDYCGC  176

Query: 216  VY                                                           217
            +Y
Sbjct: 177  IY                                                           178
```

An alignment of the GAS and GBS proteins is shown below.

```
Identities = 184/255 (72%), Positives = 219/255 (85%)
Query:   1  MIDVENILEKMKPNQKINYDWVMQQMVKQWQASDIRPKILMHVCCAPCSTYTLEYLSQWA   60
            MID++ IL  M PNQKINYD VMQQM K W+    +RP ILMHVCCAPCSTYTLEYL+Q+A
Sbjct:   4  MIDLQEILANMNPNQKINYDRVMQQMAKVWEKESVRPSILMHVCCAPCSTYTLEYLTQFA   63

Query:  61  DVTIYFANSNIHPKDEYYRREYVTQKFVHDFNKNTGYSVQFLSAPYEPNEFFKIVHGLEE  120
            D+T+YFANSNIHPKDEY+RR YVTQ+FV +FN   TG +VQFL A Y PNE+ + V GLEE
Sbjct:  64  DITVYFANSNIHPKDEYHRRAYVTQQFVSEFNAKTGNTVQFLEADYVPNEYVRQVRGLEE  123

Query: 121  EPEGGDRCKVCYDFRLDKTAEKAVELGFDYFGSALTISPHKNSQTINTIGIDVQKIYDTQ  180
            EPEGGDRC+VC+D+RLDKTA+KAVELGFDYF SALTISPHKNSQTIN +GIDVQK+Y T+
Sbjct: 124  EPEGGDRCRVCFDYRLDKTAQKAVELGFDYFASALTISPHKNSQTINDVGIDVQKVYTTK  183

Query: 181  YLPSDLKKNKGYQRSVEMCKDYDIYRQCYCGCIFGAKDQGINLLQIKKDAKAFVSDKDGK  240
            YLPSD KKN GY+RSVEMC++YDIYRQCYCGC++ AK QGI+L+Q+KKDAKAF++DKD
Sbjct: 184  YLPSDFKKNNGYRRSVEMCEEYDIYRQCYCGCVYAAKMQGIDLVQVKKDAKAFMADKDLD  243

Query: 241  EEFPNIRFTFNGKSM                                               255
            +F  +IRF++ G  M
Sbjct: 244  NDFTHIRFSYRGDEM                                               258
```

Based on this analysis, it was predicted that this protein and its epitopes, could be useful antigens for vaccines or diagnostics.

Example 2078

A DNA sequence (GBSx2193) was identified in *S. agalactiae* <SEQ ID 6431> which encodes the amino acid sequence <SEQ ID 6432>. Analysis of this protein sequence reveals the following:

---

Possible site: 53
>>> Seems to have no N-terminal signal sequence

----- Final Results -----
　bacterial cytoplasm --- Certainty = 0.4216 (Affirmative) <succ>
　　bacterial membrane --- Certainty = 0.0000 (Not Clear) <succ>
　　　bacterial outside --- Certainty = 0.0000 (Not Clear) <succ>

The protein has homology with the following sequences in the GENPEPT database.

```
>GP:CAB14809 GB:Z99118 excinuclease ABC (subunit C) [Bacillus subtilis]
Identities = 189/333 (56%), Positives = 244/333 (72%)
Query:   1  MNELIKHKLELLPDSPGCYLHKDKNGTIIYVGKAKNLKNRVKSYFHGSHNTKTELLVSEI   60
            MN+ +K KL LLPD PGCYL KD+   T+IYVGKAK LKNRV+SYF GSH+ KT+ LV+EI
Sbjct:   1  MNKQLKEKLALLPDQPGCYLMKDRQQTVIYVGKAKVLKNRVRSYFTGSHDAKTQRLVTEI   60

Query:  61  EDFEYIVTTSNTEALLLEINLIQENMPKYNIRLKDDKSYPYIKITNERYPRLMITRQVKK  120
            EDFEYIVT+SN EAL+LE+NLI+++ PKYN+ LKDDK+YP+IK+T+ER+PRL++TR VKK
Sbjct:  61  EDFEYIVTSSNLEALILEMNLIKKHDPKYNVMLKDDKTYPFIKLTHERHPRLIVTRNVKK  120

Query: 121  SDGTYFGPYPDSGAATEIKRLLDRLFPFKKCTNPANKVCFYYHLGQCNAHTVCQTNKAYW  180
              G YFGPYP+  AA E K+LLDRL+P +KC+     ++VC YYHLGQC A  V     +
Sbjct: 121  DKGRYFGPYPNVQAARETKKLLDRLYPLRKCSKLPDRVCLYYHLGQCLAPCVKDISEETN  180

Query: 181  DSLREDVKQFLNGKDNKIVNGLTEKMKSAAMTMEFERAAEYRDLIEAISLLRTKQRVIHQ  240
              L E + +FL G  N++    L EKM  AA  +EFERA E RD I   I     KQ++
Sbjct: 181  RELVESITRFLRGGYNEVRKELEEKMHEAAENLEFERAKELRDQIAHIESTMEKQKMTMN  240

Query: 241  DMKDRDVFGYFVDKGWMCVQVFFVRNGKLIQRDVNMFPYYNEPEEDFLTYIGQFYQDTKH  300
            D+ DRDVF Y  DKGWMCVQVFF+R GKLI+RDV+MFP Y E +E+FLT+IGQFY    H
Sbjct: 241  DLVDRDVFAYAYDKGWMCVQVFFIRQGKLIERDVSMFPLYQEADEEFLTFIGQFYSKNNH  300

Query: 301  FLPKEVFIPQDIDAKSVETIVGCKIVKPQRGKR                            333
            FLPKE+ +P  ID   +E ++      + +P++G +
Sbjct: 301  FLPKEILVPDSIDQSMIEQLLETNVHQPKKGPK                            333
```

There is also homology to SEQ ID 2568.
Based on this analysis, it was predicted that this protein and its epitopes, could be useful antigens for vaccines or diagnostics.

Example 2079

A DNA sequence (GBSx2194) was identified in *S. agalactiae* <SEQ ID 6433> which encodes the amino acid sequence <SEQ ID 6434>. This protein is predicted to be maltose operon transcriptional repressor (rbsR). Analysis of this protein sequence reveals the following:

Possible site: 52
>>> Seems to have no N-terminal signal sequence
----- Final Results -----
　bacterial cytoplasm --- Certainty = 0.3761 (Affirmative) <succ>
　　bacterial membrane --- Certainty = 0.0000 (Not Clear) <succ>
　　　bacterial outside --- Certainty = 0.0000 (Not Clear) <succ>

A related GBS nucleic acid sequence <SEQ ID 9393> which encodes amino acid sequence <SEQ ID 9394> was also identified.

The protein has homology with the following sequences in the GENPEPT database.

```
>GB:AAD02112 GB:AF039082 putative maltose operon transcriptional
repressor [Lactococcus lactis] Identities = 64/166 (38%),
Positives = 105/166 (62%), Gaps = 13/166 (7%)
Query:   1  MGKSAIDYLYKKGHKSIQFVTDDLNSEVSEERYLGYFKGARKLGLNQKPALLFDRGNPQV   60
            +G+ A+  L +   H+++I FVTD    +EV EERY G+   A +LGL+       LLF      N  +
Sbjct: 169  LGREAVRLLAQLNHQNISFVTDTKETEVFEERYQGFKDEAERLGLSHD--LLFMDSNFSL  226

Query:  61  LEEFINRVKEEETTALIVIGDTVSVRVMQFLSFYKLKVPDDISIMTFNNSLFSHLIHPYL  120
              E              TAL+V+ D  +S++V++ L      L  VP+D+S++T+NNS+F   +IHPYL
Sbjct: 227  RNE---------TALVVMDDVLSLKVVERLRSQGLNVPEDVSLITYNNSIFGAMIHPYL  276

Query: 121  STFDINVNNLGRTSVRRLIDIIKSPDKVFSETIIVPFTLEERESVR               166
            +TFDI++  LG +++++++D+   +  +   +TII PF L  RES +
Sbjct: 277  TTFDIHIEQLGASAIKKILDLRDNKENLPEKTII-PFELIVRESTK               321
```

There is also homology to SEQ ID 5082.
Based on this analysis, it was predicted that this protein and its epitopes, could be useful antigens for vaccines or diagnostics.

Example 2080

A DNA sequence (GBSx2195) was identified in *S. agalactiae* <SEQ ID 6435> which encodes the amino acid sequence <SEQ ID 6436>. This protein is predicted to be 4-alpha-glucanotransferase (malQ). Analysis of this protein sequence reveals the following:

Possible site: 30
>>> Seems to have no N-terminal signal sequence
----- Final Results ----- bacterial cytoplasm --- Certainty = 0.2003 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:AAA26923 GB:J01796 amylomaltase [Streptococcus pneumoniae]
Identities = 250/500 (50%), Positives = 329/500 (65%), Gaps = 4/500 (0%)
Query:   1 MKKRASGVLMHITSLPGDLGIGTFGREAYAFVDFLVETDQKFWQILPLTTTSFGDSPYQS   60
           MKKR SGVLMHI+SLPG  GIG+FG+ AY FVDFLV T Q++WQILPL  TS+GDSPYQS
Sbjct:   1 MKKRQSGVLMHISSLPGAYGIGSFGQSAYDFVDFLVRTKQRYWQILPLGATSYGDSPYQS   60

Query:  61 FSAVAGNTHLIDFDLLTLEGFISKDDYQNISFGQDPEVVDYAGLFEKRRPVLEKAVKNFL  120
           FSA AGNTH ID D+L  +G +   D + + FG D    VDYA ++  RRP+LEKAVK F
Sbjct:  61 FSAFAGNTHFIDLDILVEQGLLEASDLEGVDFGSDASEVDYAKIYYARRPLLEKNVKRFF  120

Query: 121 QEERATRMLSDFLQE-EKWVTDFAEFMAIKEHFGNKALQEWDDKAIIRREEEALAGYRQK  179
                E   +   F Q+ + W+  FAE+MAIKE+F N A  EW D    R+  AL  YR++
Sbjct: 121 -EVGDVKDFEKFAQDNQSWLELFAEYMAIKEYFDNLAWTEWPDADARARKASALESYREQ  179

Query: 180 LSEVIKYHEVTQYFFYKQWFELKEYANDKGIQIIGDMPIYVSADSVEVWTMPELFKLDRD  239
           L++ + YH VTQYFF++QW +LK YAND  I+I+GDMPIYV+ DS ++W  P LFK D +
Sbjct: 180 LADKLVYHRVTQYFFFQQWLKLKAYANDNHIEIVGDMPIYVAEDSSDMWANPHLFKTDVN  239

Query: 240 KQPLAIAGVPADDFSDDGQLWGNPIYNWDYHKESDFDWWIYRIQSGVKMYDYLRIDHFKG  299
            +    IAG P D+FS  GQLWGNPIY+W+     + + WWI R++   K+YD +RIDHF+G
Sbjct: 240 GKATCIAGCPPDEFSVTGQLWGNPIYDWEAMDKDGYKWWIERLRESFKIYDIVRIDHFRG  299

Query: 300 FSDYWEIRGDYQTANDGSWQPAPGPELFATIKEKLGDLPIIAENLGYIDERAERLLAGTG  359
           F  YWEI    TA  G W   PG +LFA +KE+LG+L IIAE+LG++ +    L   TG
Sbjct: 300 FESYWEIPAGSDTAAPGEWVKGPGYKLFAAVKEELGELNIIAEDLGFMTDEVIELRERTG  359

Query: 360 FPGMKIMEFGFYDTTGNSIDIPHNYTENTIAYAGTHDNEVINGWFEN-LTVEQKAYAENY  418
           FPGMKI++F F +   SID PH    N++ Y GTHDN  + GW+ N +    + Y   Y
Sbjct: 360 FPGMKILQFAF-NPEDESIDSPHLAPANSVMYTGTHDNNTVLGWYRNEIDDATREYMARY  418

Query: 419 MRRLPNEPITETVLRTLYATVSQTTITCMQDLLDKPADSRMNMPNTVGGNWQWRMRKEDL  478
             R    E +   +LRT++++VS    I  MQDLL+    +RMN P+T+GGNW WRM ++ L
Sbjct: 419 TNRKEYETVVHAMLRTVFSSVSFMAIATMQDLLELDEAARMNFPSTLGGNWSWRMTEDQL  478

Query: 479 TENRKAFLKEITTIYNRGNK                                          498
           T   + L ++TTIY R N+
Sbjct: 479 TPAVEEGLLDLTTIYRRINE                                          498
```

A related DNA sequence was identified in *S. pyogenes* <SEQ ID 6437> which encodes the amino acid sequence <SEQ ID 6438>. Analysis of this protein sequence reveals the following:

Possible site: 17
>>> Seems to have no N-terminal signal sequence

INTEGRAL    Likelihood = –0.85    Transmembrane 435-451 (435-451)
----- Final Results -----
bacterial membrane --- Certainty = 0.1341 (Affirmative) <succ>
bacterial outside --- Certainty = 0.0000 (Not Clear) <succ>
bacterial cytoplasm --- Certainty = 0.0000 (Not Clear) <succ>

An alignment of the GAS and GBS proteins is shown below.

```
Identities = 313/495 (63%), Positives = 387/495 (77%)
Query:   1 MKKRASGVLMHITSLPGDLGIGTFGREAYAFVDFLVETDQKFWQILPLTTTSFGDSPYQS   60
           M KRASG+LMHI+SLPG  GIGTFG+ A+ FVDFL ET Q +WQILPLTTTSFGDSPYQS
Sbjct:   1 MNKRASGILMHISSLPGKFGIGTEGKSAFEFVDFLAETKQTYWQILPLTTTSFGDSPYQS   60

Query:  61 FSAVAGNTHLIDFDLLTLEGFISKDDYQNISFGQDPEVVDYAGLFEKRRPVLEKAVKNFL  120
           FSA+AGNTH IDF+LL +   +  D +I+FG +PE VDYA LF+ RRP+LEKAV+   F+
Sbjct:  61 FSAIAGNTHFIDFELLVDDELLEAADLCDITFGTNPEAVDYAQLFQVRRPLLEKAVRAFV  120

Query: 121 QEERATRMLSDFLQEEKWVTDFAEFMAIKEHFGNKALQEWDDKAIIRREEEALAGYRQKL  180
             E+     L  F     W+TDFAEFMA+KE+F NKALQ+WDD+ +I+R+E++L  YR+ L
Sbjct: 121 AEQENVCKLEAFETASSWLTDFAEFMALKEYFNNKALQDWDDETVIKRQEDSLNNYRELL  180

Query: 181 SEVIKYHEVTQYFFYKQWFELKEYANDKGIQIIGDMPIYVSADSVEVWTMPELFKLDRDK  240
           ++  I YH+V QYFFY+QW  LK YAN KGI+IIGDMPIYVSADSVEVWTMPELFK+D DK
Sbjct: 181 AKKITYHKVCQYFFYQQWSALKTYANHKGIEIIGDMPIYVSADSVEVWTMPELFKVDSDK  240
```

```
Query:  241 QPLAIAGVPADDFSDDGQLWGNPIYNWDYHKESDFDWWIYRIQSGVKMYDYLRIDHFKGF  300
             +PL IAGVPAD FS+DGQLWGNP YNW  H++S+F WWIYRIQ   K+YD LRIDHFKGF
Sbjct:  241 KPLFIAGVPADGFSEDGQLWGNPTYNWSAHEKSNFAWWIYRIQESFKLYDQLRIDHFKGF  300

Query:  301 SDYWEIRGDYQTANDGSWQPAPGPELFATIKEKLGDLPIIAAENLGYIDERAERLLAGTGF  360
             SD+WEI    +TA +G W  APG  LF+ ++E LG+LPIIAENLGYIDE+AE+LLA TGF
Sbjct:  301 SDFWEIPAGDKTARNGHWASAPGIALFSAVREALGELPIIAENLGYIDEKAEQLLASTGF  360

Query:  361 PGMKIMEFGFYDTTGNSIDIPHNYTENTIAYAGTHDNEVINGWFENLTVEQKAYAENYMR   420
             PGMKI+EFG +D T  SID+PH Y  N  +AY GTHDNEV+NGW++NL+ EQ  +  NY+
Sbjct:  361 PGMKILEFGLFDITSQSIDLPHYYDRNCVAYTGTHDNEVVNGWYDNLSEEQVHFVNNYLH  420

Query:  421 RLPNEPITETVLRTLYATVSQTTITCMQDLLDKPADSRMNMPNTVGGNWQWRMRKEDLTE  480
             +  +E IT+ +LRT++A+V  T I C+QDLLDK   SRMNMPNT+GGNWQWRM   +L +
Sbjct:  421 KHADESITKAMLRTIFASVCDTAILCIQDLLDKDGKSRMNMPNTIGGNWQWRMLDGELNQ  480

Query:  481 NRKAFLKEITTIYNR                                              495
             + K +L  +T +Y R
Sbjct:  481 DHKDYLIYLTDLYGR                                              495
```

Based on this analysis, it was predicted that this protein and its epitopes, could be useful antigens for vaccines or diagnostics.

Example 2081

A DNA sequence (GBSx2196) was identified in *S. agalactiae* <SEQ ID 6439> which encodes the amino acid sequence <SEQ ID 6440>. This protein is predicted to be glycogen phosphorylase (malP). Analysis of this protein sequence reveals the following:

Possible site: 40
>>> Seems to have no N-terminal signal sequence
----- Final Results -----
   bacterial cytoplasm --- Certainty = 0.2678 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:AAC00218 GB:AF008220 glycogen phosphorylase [Bacillus subtilis]
Identities = 297/776 (38%), Positives = 452/776 (57%), Gaps = 41/776 (5%)
Query:   13 GKVLSELTNEEIYVELLNFVKEEAAA-------KSKNSSQRKVYYISAEFLIGKLLSNNL   65
             GK  +    + Y  L N V+E  +A          KS+++S ++ YY+S EFL+G+LL   NL
Sbjct:   21 GKSFKDSAKLDQYKTLGNMVREYISADWIETNEKSRSNSGKQTYYLSIEFLLGQLLEQNL   80

Query:   66 INLGIYKDVKKELELVGKSIAEIEDVEPEPSLGNGGLGRLASCFIDSISSLGINGEGVGL  125
             +NLG+    V+  L+ +G ++  EI   +E +    LGNGGLGRLA+CF+DS++SL + G G+G+
Sbjct:   81 MNLGVRDVVEAGLKEIGINLEEILQIENDAGLGNGGLGRLAACFLDSLASLNLPGHGMGI  140

Query:  126 NYHCGLFKQVFANNQQEAEANYWIEN-NSWLVPT-DISYDVPF--------RDFTLKSRL  175
              Y  GLF+Q  + Q     W++N N W V  D + DVPF             +  L R
Sbjct:  141 RYKHGLFEQKIVDGHQVELPEQWLKNGNVWEVRNADQAVDVPFWGEVHMTEKSGRLHERH  200

Query:  176 DR----------IDVLGYKKDTKNYLNLFDIDGLDYNLIEKGITFDKTEIKKNLTLFLYP  225
             ++           I ++GY+   T N L L++ +   Y      G        + ++ FLYP
Sbjct:  201 EQATIVTAVPYDIPIIGYETGTVNTLRLWNAE--PYAHYHGGNILSYKRETEAVSEFLYP  258

Query:  226 DDSDKNGELLRIYQQYFMVSNAAQLLIDEAIERGSNLHDLAEYAYVQINDTHESMVIPEL  285
             DD+     G++LR+ QQYF+V  +  +L +   + L + + INDTHP++ +PEL
Sbjct:  259 DDTHDEGKILRLKQQYFLVCASLKSIVNNYRKTHKSLSGLHKKVSIHINDTHPALAVPEL  318

Query:  286 IRLLTEKHGFEEDEAVSVVRNMVGYTNHTILAEALEKWPLEYLNEVVPHLVTIIKKLDQM  345
             +R+L ++         ++EA   +  + YTNHT L+EALEKWP+    ++P +  II+++++
Sbjct:  319 MRILLDEENMSWEEAWHITVHTISYTNHTTLSEALEKWPIHLFKPLLPRMYMIIEEINER  378

Query:  346 IRE--------EQTNPEVQIIDEAGRVHMAHMDIHFSTSVNGVAALHTEILKNSELKVFY  397
                              +   E    I    G  V MAH+   I  S  SVNGVA +H++ILK  E++ F+
Sbjct:  379 FCRAVWEKYPGDWKRIENMAITAHGVVKMAHLAIVGSYSVNGVAKIHSDILKEREMRDFH  438

Query:  398 DIYPDKFNNKTNGITFRRWLEFANQDLADYLKELIGDSYLTDATQLEKLLTYADSNEVHD  457
              ++P++FNNKTNGI  RRWL  AN  L+   +  E IGD ++       L +L  YA         +
Sbjct:  439 LLFPNRFNNKTNGIAHRRWLLKANPGLSAIITEAIGDEWVKQPESLIRLEPYATDPAFIE  498

Query:  458 KLAAIKFKNKLALKRYLKENKGIELDEYSIIDTQIKRFHEYKRQQMNALYVIHKYLEIKR  517
              +   K  K K   L  +      G+ ++  SI ID Q+KR H YKRQ +N  L++++ Y  +K
Sbjct:  499 QFQNNKSKKKQELADLIFCTAGVVVNPESIEDVQVKRLHAYKRQLLNVLHIMYLYNRLKE  558

Query:  518 GH-FPSRKLTVIFGGKAAPAYTIAQDIIHLILCLSELINNDPEVNKYLNVHLVENYNVTV  576
              F     T IFG KA+P+Y  A+  II LI   ++E +N DP V + +  V   +ENY V++
Sbjct:  559 DSGESIYPQTFIFGAKASPSYYYAKKIIKLIHSVAEKVNYDPAVKQLIKVVFLENYRVSM  618

Query:  577 AEKLIPATDISEQISLASKEASGTGNMKFMLNGALTLGTMDGANVEIAELAGKENIYTFG  636
```

```
                  AE++ PA+D+SEQIS ASKEASGTGNMKFM+NGALT+GT DGAN+EI E  G + IYTFG
Sbjct:  619  AERIFPASDVSEQISTASKEASGTGNMKFMMNGALTIGTHDGANIEILERVGPDCIYTEG  678

Query:  637  KDSDTIINLYETSGYRSKDYYDKDKVIREAVDFIISDDIVSLGNAERLKRLHDELV-GKD  695
                +D +++  E  GYRS++YY  D+ IR+  D +I+      G A+  + + D L+   D
Sbjct:  679  LKADEVLSYQENGGYRSREYYQHDRRIRQVADQLINGFFE--GEADEFESIFDSLLPHND  736

Query:  696  WFMTLIDLKEYIAVKEQVLADYEDYESWNKKVIHNIAKAGFFSSDRTIEQYNQDIW  751
                +  L D   Y  +E++ ADY +   W++  I NIA +G+FSSDRTI +Y +DIW
Sbjct:  737  EYFVLKDFSSYADAQERIQADYRERREWSEHSIVNIAHSGYFSSDRTIREYAKDIW  792
```

A related DNA sequence was identified in *S. pyogenes* <SEQ ID 6441> which encodes the amino acid sequence <SEQ ID 6442>. Analysis of this protein sequence reveals the following:

Possible site: 19
>>> Seems to have no N-terminal signal sequence

-continued

INTEGRAL    Likelihood = −2.71    Transmembrane 538-554 (538-554)
----- Final Results -----
bacterial membrane --- Certainty = 0.2084 (Affirmative) <succ>
bacterial outside --- Certainty = 0.0000 (Not Clear) <succ>
bacterial cytoplasm --- Certainty = 0.0000 (Not Clear) <succ>

An alignment of the GAS and GBS proteins is shown below.

```
Identities = 629/754 (83%), Positives = 696/754 (91%), Gaps = 2/754 (0%)

Query:    1  MTRNFTTYVGQQ-GKVLSELTNEEIYVELLNFVKEEAAAKSKNESQRKVYYISAEFLIGK   59
             MTR FT YV  + GK L++ +NEEIY+ LLNFVKEEA+ K+KNS++RKVYYISAEFLIGK
Sbjct:    1  MTR-FTEYVETKLGKSLTQASNEEIYLSLLNEVKEEASHKAKNSAKRKVYYISAEFLIGK   59

Query:   60  LLSNNLINLGIYKDVKKELELVGKSIAEIEDVEPEPSLGNGGLGRLASCFIDSISSLGIN  119
             LLSNNLINLGIYKD+K+EL   GKSIAE+EDVE EPSLGNGGLGRLASCFIDSI+SLGIN
Sbjct:   60  LLSNNLINLGIYKDIKEELAAAGKSIAEVEDVELEPSLGNGGLGRLASCFIDSIASLGIN  119

Query:  120  GEGVGLNYHCGLFKQVFRNNQQEAEANYWIENNSWLVPTDISYDVPFRDFTLKSRLDRID  179
             GEGVGLNYHCGLFKQVF++N+QEAE N+WIE++SWLVPTDISYDVPF++FTLKSRLDRID
Sbjct:  120  GEGVGLNYHCGLFKQVFKHNEQEAEPNEWIEDDSWLVPTDISYDVPFKNFTLKSRLDRID  179

Query:  180  VLGYKEDTKNYLNLEDIDGLDYNLIEKGITEDKTEIKKNLTLFLYPDDSDKNGELLRIYQ  239
             VLGYK+DTKNYLNLFDI+G+DY LI+ GI+FDKT+I KNLTLFLYPDDSDKNGELLRIYQ
Sbjct:  180  VLGYKRDTKNYLNLEDIEGVDYGLIKDGISFDKTQIARNLTLFLYPDDSDKNGELLRIYQ  239

Query:  240  QYFMVSNAAQLLIDEAIERGSNLHDLAEYAYVQINDTHPSMVIPELIRLLTEKHGFEFDE  299
             QYFMVSNAAQL+IDEAIERGSNLHDLA+YAYVQINDTHPSMVIPELIRLLTEKHGF+FDE
Sbjct:  240  QYFMVSNAAQLIIDEAIERGSNLHDLADYAYVQINDTHPSMVIPELIRLLTEKHGEDFDE  299

Query:  300  AVSVVRNMVGYTNHTILAEALEKWPLEYLNEVVPHLVTIIKKLDQMIREEQTNPEVQIID  359
             AV+VV+NMVGYTNHTILAEALEKWP  YLNEVVPHLVTII+KLD ++R E ++P VQIID
Sbjct:  300  AVAVVKNMVGYTNHTILAEALEKWPTAYLNEVVPHLVTIIEKLDALVRSEVSDPAVQIID  359

Query:  360  EAGRVHMAHMDIHFSTSVNGVAALHTEILKNSELKVFYDIYPDKFNNKTNGITERRWLEF  419
             E+GRVHMAHMDIHF+TSVNGVAALHTEILKNSELK FYD+YP+KFNNKTNGIT RRWLEF
Sbjct:  360  ESGRVHMAHMDIHFATSVNGVAALHTEILKNSELKAFYDLYPEKFNNKTNGITERRWLEF  419

Query:  420  ANQDLADYLKELIGDSYLTDATQLEKLLTYADSNEVHDKLAAIKEKNKLALKRYLKENKG  479
             ANQDLADY+KELIGD YLTDAT+LEKL+ +AD     VH KLA IKF NKLALKRYLK+NK
Sbjct:  420  ANQDLADYIKELIGDEYLTDATKLEKLMAFADDKAVHAKLAEIKENNKLALKRYLKDNKD  479

Query:  480  IELDEYSIIDTQIKREHEYKRQQMNALYVIHKYLEIKRGHFPSRKLTVIEGGKAAPAYTI  539
             IELDE+SIIDTQIKR HEYKRQQMNALYVIHKYLEIK+G+ P RK+TVI GGKAAPAY I
Sbjct:  480  IELDEHSIIDTQIKREHEYKRQQMNALYVIHKYLEIKKGNLPKRKITVIEGGKAAPAYII  539

Query:  540  AQDIIHLILCLSELINNDPEVNKYLNVHLVENYNVTVAEKLIPATDISEQISLASKEASG  599
             AQDIIHLILCLSELINNDPEV+ YLNVHLVENYNVTVAE LIPATDISEQISLASKEASG
Sbjct:  540  AQDIIHLILCLSELINNDPEVSPYLNVHLVENYNVTVAEHLIPATDISEQISLASKEASG  599

Query:  600  TGNMKFMLNGALTGTMDGANVEIAELAGKENIYTEGKDSDTIINLYETSGYRSKDYYDK  659
             TGNMKFMLNGALTGTMDGANVEIAELAG ENIYTFGKDSDTIINLY T+ Y +KDYYD
Sbjct:  600  TGNMKFMLNGALTGTMDGANVEIAELAGMENIYTEGKDSDTIINLYATASYVARDYYDN  659

Query:  660  DKVIREAVDFIISDDIVSLGNAERLKRLHDELVGKDWFMTLIDLKEYIAVKEQVLADYED  719
               I+ AV+FIIS ++++ GN ERL RL+ EL+  KDWFMTLIDL+EYI VKE++LADYED
Sbjct:  660  HPAIKAAVNFIISPELLAFGNEERLDRLYKELISKDWFMTLIDLEEYIEVKEKMLADYED  719

Query:  720  YESWNKKVIHNIAKAGFFSSDRTIEQYNQDIWHS                           753
               + W  KV+HNIAKAGFFSSDRTIEQYN+DIWHS
Sbjct:  720  QDLWMTKVVHNIAKAGFFSSDRTIEQYNEDIWHS                           753
```

Example 2082

A DNA sequence (GBSx2197) was identified in *S. agalactiae* <SEQ ID 6443> which encodes the amino acid sequence <SEQ ID 6444>. This protein is predicted to be glycerol-3-phosphatase transporter (gipT). Analysis of this protein sequence reveals the following:

```
Possible site: 59
>>> Seems to have no N-terminal signal sequence
INTEGRAL    Likelihood = -10.88   Transmembrane 339-355 (333-359)
INTEGRAL    Likelihood = -8.01    Transmembrane 432-448 (426-450)
INTEGRAL    Likelihood = -6.74    Transmembrane 92-108 (91-127)
INTEGRAL    Likelihood = -6.69    Transmembrane 194-210 (190-214)
INTEGRAL    Likelihood = -3.77    Transmembrane 367-383 (364-385)
INTEGRAL    Likelihood = -2.81    Transmembrane 111-127 (109-127)
INTEGRAL    Likelihood = -2.28    Transmembrane 407-423 (406-424)
INTEGRAL    Likelihood = -2.02    Transmembrane 165-181 (165-182)
INTEGRAL    Likelihood = -0.64    Transmembrane 29-45 (29-45)
----- Final Results -----
   bacterial membrane --- Certainty = 0.5352 (Affirmative) <succ>
   bacterial outside --- Certainty = 0.0000 (Not Clear) <succ>
      bacterial cytoplasm --- Certainty = 0.0000 (Not Clear) <succ>
```

The protein has homology with the following sequences in the GENPEPT database.

```
>GP:AAC44575 GB:U28354 IS629 ORFB fused with sequences similar to E.
coli GlpT and UhpT proteins, Swiss-Prot Accession Number P08194 and P09836;
Method: conceptual translation supplied by author [Shig
Identities = 174/321 (54%), Positives = 241/321 (74%), Gaps = 4/321 (1%)
Query: 109  GVIPSVITSIWLFTIMYLINGWLQGMGYPPGARTLVYWYDNKERIKYATIWNLSHNFGGA  168
            GV P V + + +    YL+NGW+QGMGYPPGA+TLV+WY+++ERI +AT+WNLSHN GGA
Sbjct:  12  GVGP-VCSELHIAPSTYLLNGWIQGMGYPPGAKTLVFWYEHRERISWATLWNLSHNVGGA   70

Query: 169  LAPILTGVGLALAGNDSLNQARAAYWFPGVVACLLAVLVYFLQEDTPESIGLPPIEEYHK  228
            +AP+L G       G+ +L+ ARAA+ FPGV+    ++VL+YF+Q D P S+GLPPIEE+
Sbjct:  71  LAPVLIGFSFGFFGDSALDHARAAFIFPGVLCMAMSVLIYFIQVDRPVSVGLPPIEEWKG  130

Query: 229  EQYTNVVDSSDILEEPEVLGMGEIIKKYILPNTKLMWASLYSIFVYILRYGIVSWTPKFL  288
            ++         E+    L + +II+K+I+ N KL++   +Y  FVYILRYGIVSW PKFL
Sbjct: 131  NVVSHPAKGR---EQGPRLSIPDIIRKHIIRNNKLIYCCIYGSFVYILRYGIVSWAPKFL  187

Query: 289  ATSVQDGGKGITATAGMGGFSLFEIGGIIGMLTAGYLSAKVFKNSKPLTNVAFLVVAILL  348
            + S+  GGK +   A MGG S+FEIGG+ GML AGYLS ++F+NSKPLTN  FL + I+L
Sbjct: 188  SDSLDVGGKDMGKLASMGGGSVFEIGGVAGMLLAGYLSVRLFRNSKPLTNTLFLALTIIL  247

Query: 349  LAAYWFIPAGPQYMALDFIILLGLGASIYGPVMMVGLYAMELVPKAAAGAASGLTGTFSY  408
            L AYW++P+G +Y+ L++ IL+ LG ++YGPVM +GLY+MELVPK AAGAASGL+GTFSY
Sbjct: 248  LIAYWYVPSGNEYLWLNYTILILLGLAVYGPVMFIGLYSMELVPKEAAGAASGLSGTFSY  307

Query: 409  VGGATIATLAIGIIIDHFGWG                                        429
            + G+ +ATL +G+++D+ GWG
Sbjct: 308  IFGSIVATLGMGLVVDYLGWG                                        328
```

Based on this analysis, it was predicted that this protein and its epitopes, could be useful antigens for vaccines or diagnostics.

A related DNA sequence was identified in *S. pyogenes* <SEQ ID 6445> which encodes the amino acid sequence <SEQ ID 6446>. Analysis of this protein sequence reveals the following:

```
Possible site: 36
>>> Seems to have no N-terminal signal sequence
INTEGRAL    Likelihood = 12.37    Transmembrane 185-201 (175-208)
INTEGRAL    Likelihood = -9.13    Transmembrane 114-130 (90-134)
INTEGRAL    Likelihood = -7.75    Transmembrane 322-338 (320-345)
INTEGRAL    Likelihood = -6.79    Transmembrane 421-437 (419-439)
INTEGRAL    Likelihood = -6.37    Transmembrane 91-107 (90-113)
INTEGRAL    Likelihood = -5.36    Transmembrane 163-179 (161-181)
INTEGRAL    Likelihood = -5.20    Transmembrane 350-366 (347-371)
INTEGRAL    Likelihood = -4.41    Transmembrane 23-39 (22-41)
INTEGRAL    Likelihood = -3.77    Transmembrane 257-273 (249-273)
INTEGRAL    Likelihood = -1.33    Transmembrane 61-77 (61-77)
INTEGRAL    Likelihood = -1.28    Transmembrane 383-399 (383-399)
INTEGRAL    Likelihood = -0.90    Transmembrane 299-315 (299-315)
----- Final Results -----
   bacterial membrane --- Certainty = 0.5946 (Affirmative) <succ>
   bacterial outside --- Certainty = 0.0000 (Not Clear) <succ>
      bacterial cytoplasm --- Certainty = 0.0000 (Not Clear) <succ>
```

The protein has homology with the following sequences in the databases:

```
>GP:AAF96050 GB:AE004355 glycerol-3-phosphate transporter [Vibrio cholerae]
Identities = 128/438 (29%), Positives = 215/438 (48%), Gaps = 17/438 (3%)
Query:   1  LFMEEDYNKREP-EKFTQFLRRQKVVFFVAFF-GYVCAYLVRNNFKLMSNTIMVQNGWDK   58
            LF  + +R P +K       R +   F+ F GY   YL R NF L +    +++ G+ +
Sbjct:  21  LFKPAAHTQRLPSDKVDSVYSRLRWQLFIGIFVGYAGYYLGRKNFSL-AMPYLIEQGFSR   79

Query:  59  AQIAILLSCLTVSYGLAKFYMGALGDRVSLRKLFSISLGASALICILIGFF---NSSMVV  115
            + + L  ++++YGL+KF MG + DR + R   S  L  SAL+     GF       S+
```

```
                              -continued
Sbjct:  80  GDLGVALGAVSIAYGLSKFLMGNVSDRSNPRYFLSAGLLLSALVMFCFGFMPWATGSITA  139

Query: 116  LGILLVLCGVVQGALAPASQAMIANYFPNKTRGGAIAGWNISQNMGSALLPLTIALLTSM  175
            + ILL  L G   QG    PA    + +++  K RG ++ WN++ N+G  L    I  + +
Sbjct: 140  MFILLFLNGWFQGMGWPACGRTMVHWWSRKERGEIVSVWNVAHNVGGGL----IGPIFLL  195

Query: 176  GLVVPANGNILLAFLIPGVLVFLFALCCWKLGGDNPESEGLDSLRTMYGDAGESAVASEE  235
            GL +  N +    AF +P L     A+  W +  D P+S GL +        D    S E
Sbjct: 196  GLWM-FNDDWRTAFYVPAFFAVLVAVFTWLVMRDTPQSCGLPPIEEYKNDYPDDYDKSHE  254

Query: 236  EKHNLSYWQLIWKYVFCNPSLLLVAAVNVALYFVRFGIEDWMPIYLSQVANMSEAHIHFA  295
            +   ++ ++ +KYVF N  L  +A  N  +Y +R+G+ DW P+YL  +  +      +A
Sbjct: 255  NE--MTAKEIFFKYVFNNKLLWSIAIANAFVYLIRYGVLDWAPVYLKEAKHFTVDKSSWA  312

Query: 296  ISMLEWVAIPGSLVFAWLAVR-YPNKMAKVGAIGLFVLAAIVFVYERLTATGAPNYFLLL  354
              + EW  IPG+L+  W++ + +   + A  G + + ++   V VY   G P   +
Sbjct: 313  YFLYEWAGIPGTLLCGWISDKVFKGRRAPAGILFMVLVTLAVLVY-WFNPAGNPAVDMAA  371

Query: 355  VIAGILGSLIYGPQLIVNILTINFVPLNVAGTAIGFVGVTAYLIGNMGANWLMPILADGF  414
            ++A  +G LIYGP +++ +   + P      AGTA  G+   YL G + AN ++    D F
Sbjct: 372  LVA--IGFLIYGPVMLIGLYALELAPKKAAGTAAGLTGLFGYLGGAVAANAILGYTVDHF  429

Query: 415  GWFWSYIVVAALSAFSAV                                           432
            GW    ++V+ A   S +
Sbjct: 430  GWDGGFMVLVASCVLSVL                                           447
```

An alignment of the GAS and GBS proteins is shown below.

```
Identities = 117/439 (26%), Positives = 203/439 (45%), Gaps = 27/439 (6%)
Query:  23  KYPRYRVQVLISIFVGYMGYYFVRNTTSILSGILNMS----ATEIGIITCASYIAYGLSK   78
            ++ R +  V    F GY+  Y VRN   ++S + +       +I  I+     ++YGL+K
Sbjct:  17  QFLRRQKVVFFVAFFGYVCAYLVRNNFKLMSNTIMVQNGWDKAQIAILLSCLTVSYGLAK   76

Query:  79  FISGLISDESNSKIFLPVGLFLTGLVNVLIGVIPSVITSIWLFTIMYLINGWLQGMGYPP  138
            F  G +D + +     + L  + L+ +LIG   S+ +  I+ ++ G +QG     P
Sbjct:  77  FYMGALGDRVSLRKLFSISLGASALICILIGFFNS---SMVVLGILLVLCGVVQGALAPA  133

Query: 139  GARTLVYWYDNKERIKYATIWNLSHNFGGAIAPI----LTGVGLALAGNDSLNQARAAYW  194
                 +  ++ NK R       WN+S N G A+ P+     LT +GL +   N ++    A+
Sbjct: 134  SQAMIANYFPNKTRGGAIAGWNISQNMGSALLPLTIALLTSMGLVVPANGNI---LLAFL  190

Query: 195  FPGVVACLLAVLVYFLQEDTPESIGLPPIEEYHKEQYTNVVDSSDILEEPEVLGMGEIIK  254
              PGV+    L A+  + L  D PES GL   +   ++ +     + V S   EE     L   ++I
Sbjct: 191  IPGVLVFLFALCCWKLGGDNPESEGLDSLRTMYGDAGESAVASE---EEKHNLSYWQLIW  247

Query: 255  KYILPNIKLMWASLYSIFVYILRYGIVSWTPKFLATSVQDGGKGITATAGMGGFSLFEIG  314
            KY+  N  L+ +   + +  ++Y  +R+GI  W P +L+        I         S+    E
Sbjct: 248  KYVFCNPSLLLVAAVNVALYFVRFGIEDWMPIYLSQVANMSEAHIHFA------ISMLEWV  302

Query: 315  GIIGMLTAGYLSAKVFKNSKPLTNVAFLVVAILLLAAYWFIPAG-PQYMALDFIILLG-L  372
              I GM L  +L+  +            +  +  V+A ++         G P Y  L  +++  G L
Sbjct: 303  AIPGSLVFAWLAVRYPNKMAKVGAIGLFVLAAIVFVYERLTATGAPNYFLL--LVIAGIL  360

Query: 373  GASIYGPVMMVGLYAMELVPKAAAGAASGLIGTFSYVGGATIATLAIGIIIDHFGWGVAF  432
            G+  IYGP ++V  +  +    VP      AG A G  G  +Y+ G  A     +I+     D FGW ++
Sbjct: 361  GSLIYGPQLIVNILTINFVPLNVAGTAIGFVGVTAYLIGNMGANWLMPILADGFGWFWSY  420

Query: 433  IIF-GISGFAAIVCTLLSR                                          450
            I+    +S F+A+       +L++
Sbjct: 421  IVVAALSAFSAVGYLILAK                                          439
```

Based on this analysis, it was predicted that this protein and its epitopes, could be useful antigens for vaccines or diagnostics.

Example 2083

A DNA sequence (GBSx2198) was identified in *S. agalactiae* <SEQ ID 6447> which encodes the amino acid sequence <SEQ ID 6448>. Analysis of this protein sequence reveals the following:

Possible site: 21

>>> Seems to have no N-terminal signal sequence

----- Final Results ----- bacterial cytoplasm --- Certainty = 0.3202 (Affirmative) <succ> bacterial membrane --- Certainty = 0.0000 (Not Clear) <succ> bacterial outside --- Certainty = 0.0000 (Not Clear) <succ>

The protein has no significant homology with any sequences in the GENPEPT database.

A related DNA sequence was identified in *S. pyogenes* <SEQ ID 6449> which encodes the amino acid sequence <SEQ ID 6450>. Analysis of this protein sequence reveals the following:

```
Possible site: 19
>>> Seems to have no N-terminal signal sequence
----- Final Results -----
   bacterial cytoplasm --- Certainty = 0.4473 (Affirmative) <succ>
     bacterial membrane --- Certainty = 0.0000 (Not Clear) <succ>
       bacterial outside --- Certainty = 0.0000 (Not Clear) <succ>
```

An alignment of the GAS and GBS proteins is shown below.

```
Identities = 54/100 (54%), Positives = 67/100 (67%)
Query:   1   MTYELCLEYGTYPLEPVDANADEINTAPAFITEDKKLLELLEEVNTLFHELFLTIECSFH   60
             MTYELCLEYGTYPL VDA+  E    P FI ED+ L   LE +N LFH+LF+TIE  FH
Sbjct:   1   MTYELCLEYGTYPLSRVDAYWGEDQNPPTFIQEDRLLCHKLETMNHLFHDLFVTIESQFH   60

Query:  61   YIGHDFPEKHAKITQIYHVIIEHLSIHYPEYDIKIESLLM                      100
             Y+G + PEKRA+I +Y  +    L   Y +Y IKIE+ L+
Sbjct:  61   YVGFNMPEKRAQIRILYQEVATILKSKYKDYPIKIETFLL                      100
```

Based on this analysis, it was predicted that this protein and its epitopes, could be useful antigens for vaccines or diagnostics.

Example 2084

A DNA sequence (GBSx2199) was identified in *S. agalactiae* <SEQ ID 6451> which encodes the amino acid sequence <SEQ ID 6452>. Analysis of this protein sequence reveals the following:

```
Possible site: 19
>>> Seems to have no N-terminal signal sequence
----- Final Results -----
   bacterial cytoplasm --- Certainty = 0.2369(Affirmative) <succ>
     bacterial membrane --- Certainty = 0.0000(Not Clear) <succ>
       bacterial outside --- Certainty = 0.0000(Not Clear) <succ>
```

The protein has homology with the following sequences in the GENPEPT database.

```
>GP:AAB81912 GB:U92974 unknown [Lactococcus lactic]
Identities = 213/322 (66%), Positives = 260/322 (80%), Gaps = 5/322 (1%)
Query:   1   MSEKIRVLLYYKYVSIENAEEYAAKHLEFCKSIGLKGRILIADEGINGTVSGDYETTQKY   60
             M++  RVLLYY+YV IE+ E +A KHL  CK +GLKGRIL+ADEGINGTVSG  E T  Y
Sbjct:   1   MTQDYRVLLYYQYVPIEDGETFAQKHLADCKELGLKGRILVADEGINGTVSGTIEQTNAY   60

Query:  61   MDWVHSDERFADLWFKIDEENQQAFRKMFVRYKKEIVHLGLEDNNFDSDINPLETTGEYL  120
             M+ + +D RF+   FKIDE  Q AF+KM VRY+ E+V+L LED     D+NPLE TG YL
Sbjct:  61   MELMKNDPRFSSTIFKIDEAEQNAFKKMHVRYRPELVNLSLED-----DVNPLELTGAYL  115

Query: 121   NPKQFKEALLDEDTVVLDTRNDYEYDLGHFRGAIRPDIRNFRELPQWVRDNKDKFMEKRV  180
             +PK+F+EA LDE+TVV D RNDYE+DLGHFRGAIRP+IR+FRELPQW+RDNK++FMEKRV
Sbjct: 116   DPKEFREAMLDENTVVIDARNDYEFDLGHFRGAIRPEIRSFRELPQWIRDNKEQFMEKRV  175

Query: 181   VVYCTGGVRCEKFSGWMVREGFKDVGQLHGGIATYGKDPEVQGELWDGAMYVFDDRISVP  240
             + YCTGG+RCEKFSGW+VREGFKDVGQL GGIATYGKDPEVQG+LWDG MYVFD RI+VP
Sbjct: 176   LTYCTGGIRCEKFSGWLVREGFKDVGQLLGGIATYGKDPEVQGDLWDGQMYVFDSRIAVP  235

Query: 241   INHVNPTVISKDYFDGTPCERYVNCANPFCNKQIFASEENEAKYVRGCSPECRAHERNRY  300
             IN      ++ +D+FDG+PCERY+NC NP CN+Q+ ASEENEAKY+  CS ECR H  NRY
Sbjct: 236   INQKEHVIVGRDWFDGSPCERYINCGNPECNRQMLASEENEAKYLGACSHECRVHPNNRY  295

Query: 301   VQENGLSRQEWAERLEAIGESL                                        322
             ++ + LS QE  ERL  + L
Sbjct: 296   IKAHQLSNQEVQERLALLEKDL                                        317
```

A related DNA sequence was identified in *S. pyogenes* <SEQ ID 6453> which encodes the amino acid sequence <SEQ ID 6454>. Analysis of this protein sequence reveals the following:

```
Possible site: 51
>>> Seems to have no N-terminal signal sequence
----- Final Results -----
    bacterial cytoplasm --- Certainty = 0.2443 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
Identities = 321/324 (99%), Positives = 323/324 (99%)
Query:   1  MSEKIRVLLYYKYVSIENAEEYAAKHLEFCKSIGLKGRILIADEGINGTVSGDYETTQKY   60
            MSEKIRVLLYYKYVSIENA+EYAAKHLEFCKSIGLKGRILIADEGINGTVSGDYETTQKY
Sbjct:   1  MSEKIRVLLYYKYVSIENAQEYAAKHLEFCKSIGLKGRILIADEGINGTVSGDYETTQKY   60

Query:  61  MDWVHSDERFADLWFKIDEENQQAFRKMFVRYKKEIVHLGLEDNNFDSDINPLETTGEYL  120
            MDWVHSDERFADLWFKIDEENQQAFRKMFVRYKKEIVHLGLEDNNFDSDINPLETTGEYL
Sbjct:  61  MDWVHSDERFADLWFKIDEENQQAFRKMFVRYKKEIVHLGLEDNNFDSDINPLETTGEYL  120

Query: 121  NPKQFKEALLDEDTVVLDTRNDYEYDLGHFRGAIRPDIRNFRELPQWVRDNKDKFMEKRV  180
            NPKQFKEALLDEDTVVLDTRNDYEYDLGHFRGAIRPDIRNFRELPQWVRDNKDKFMEKRV
Sbjct: 121  NPKQFKEALLDEDTVVLDTRNDYEYDLGHFRGAIRPDIRNFRELPQWVRDNKDKFMEKRV  180

Query: 181  VVYCTGGVRCEKFSGWMVREGFKDVGQLHGGIATYGEDPEVQGELWDGAMYVFDDRISVP  240
            VVYC GGVRCEKFSGWMVREGFKDVGQLHGGIATYG DPEVQGELWDGAMYVFDDRISVP
Sbjct: 181  VVYCIGGVRCEKFSGWMVREGFKDVGQLHGGIATYGKDPEVQGELWDGAMYVFDDRISVP  240

Query: 241  INHVNPTVISKDYFDGTPCERYVNCANPFCNKQIFASEENEAKYVRGCSPECRAHERNRY  300
            INHVNPTVISKDY DGTPCERYVNCANPFCNKQIFASEENE KYVRGCSPECRAHERNRY
Sbjct: 241  INHVNPTVISKDYEDGTPCERYVNCANPFCNKQIFASEENETKYVRGCSPECRAHERNRY  300

Query: 301  VQENGLSRQEWAERLEAIGESLPQ                                     324
            VQENGLSRQEWAERLEAIGESLP+
Sbjct: 301  VQENGLSRQEWAERLEAIGESLPE                                     324
```

Based on this analysis, it was predicted that this protein and its epitopes, could be useful antigens for vaccines or diagnostics.

Example 2085

A DNA sequence (GBSx2200) was identified in *S. agalactiae* <SEQ ID 6455> which encodes the amino acid sequence <SEQ ID 6456>. Analysis of this protein sequence reveals the following:

```
Possible site: 57
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:AAC83954 GB:L47648 putative [Bacillus subtilis]
Identities = 54/192 (28%), Positives = 89/192 (46%), Gaps = 14/192 (7%)
Query:   5  QTIIIGAGAAGIGFGSAMQRLGLTNFLIIEKGHIGESFLRWPRTTQFITPSFTTNGFGFP   64
            + IIIG G G+      ++++G+ + L+IEKG++   S  +P    F  +S
Sbjct:   5  KAIIIGGGPCGLSAAIHLKQIGI-DALVIEKGNVVNSIYNYPTHQTFFSSSEKLE-----   58

Query:  65  DLNAVIPDTSPAFSFEKEHLSGVEYARYLQLVAAHYNLPIQNETSVLSIDK-RDSLFVIK  123
                    I D  AF  E        ++  Y + V    N+ +        V   K +++ FVI+
Sbjct:  59  -----IGDV--AFITENRKPVRIQALSYYREVVKRKNIRVNAFEMVRKVTKTQNNTFVIE  111

Query: 124  TSKGDFSADYLIMATGEFQNPNTIDIKGADLGMHYGQVDNFHIKSDNPFIIIGGNESACD  183
            TSK   ++   Y I+ATG + +PN + +  G DL    +       H  D    ++IGG S+ D
Sbjct: 112  TSKETYTTPYCIIATGYYDHPNYMGVPGEDLPKVFHYFKEGHPYFDKDVVVIGGKNSSVD  171

Query: 184  ALTHLVYLGNQV                                                 195
            A    LV   G +V
Sbjct: 172  AALELVKSGARV                                                 183
```

No corresponding DNA sequence was identified in *S. pyogenes*.

Based on this analysis, it was predicted that this protein and its epitopes, could be useful antigens for vaccines or diagnostics.

A related GBS gene <SEQ ID 8973> and protein <SEQ ID 8974> were also identified. Analysis of this protein sequence reveals the following:

---

Lipop Possible site: −1  Crend: 2
McG: Discrim Score: 5.05
GvH: Signal Score (−7.5): −3.14
Possible site: 57
>>> Seems to have an uncleavable N-term signal seq
ALOM program           count: 0 value: 0.26 threshold: 0.0
PERIPHERAL             Likelihood = 0.26                6
modified ALOM score: −0.55
*** Reasoning Step: 3
----- Final Results -----
    bacterial membrane --- Certainty = 0.0000 (Not Clear) <succ>
    bacterial outside --- Certainty = 0.0000 (Not Clear) <succ>
        bacterial cytoplasm --- Certainty = 0.0000 (Not Clear) <succ>

---

The protein has homology with the following sequences in the databases:

SEQ ID 8974 (GBS284) was expressed in *E. coli* as a His-fusion product. SDS-PAGE analysis of total cell extract is shown in FIG. 52 (lane 10; MW 42.7 kDa). It was also expressed in *E. coli* as a GST-fusion product. SDS-PAGE analysis of total cell extract is shown in FIG. 58 (lane 9; MW 67.6 kDa).

GBS284-GST was purified as shown in FIG. 225, lane 7.

Example 2086

A DNA sequence (GBSx2201) was identified in *S. agalactiae* <SEQ ID 6457> which encodes the amino acid sequence <SEQ ID 6458>. This protein is predicted to be NrgA-like protein. Analysis of this protein sequence reveals the following:

---

Possible site: 24
>>> Seems to have an uncleavable N-term signal seq
INTEGRAL    Likelihood = 11.73    Transmembrane 7-23 (1-31)
INTEGRAL    Likelihood = −6.42    Transmembrane 86-102 (82-108)
INTEGRAL    Likelihood = −6.42    Transmembrane 324-340 (318-342)
INTEGRAL    Likelihood = −5.26    Transmembrane 210-226 (207-229)
INTEGRAL    Likelihood = −5.10    Transmembrane 113-129 (112-133)
INTEGRAL    Likelihood = −1.49    Transmembrane 246-262 (246-263)
INTEGRAL    Likelihood = −1.17    Transmembrane 183-199 (183-199)

---

```
33.2/56.1% over 281aa
Bacillus subtilis
EGAD|109228| hypothetical protein Insert characterized
GP|2635109|emb|CAB14605.1||Z99117 alternate gene name: yrdP Insert characterized
GP|1934657|gb|AAB80908.1||U93876 hypothetical protein YrdP Insert characterized
PIR|E69725|E69725 potassium uptake trkA - Insert characterized
ORF01799(310-1128 of 1725)
EGAD|109228| S2656(2-283 of 345) hypothetical protein { acillus subtilis}
GP|2635109|emb|CA 14605.1||Z99117 alternate gene name: yrdP { acillus subtilis}
GP|1934657|gb|AA 80908.1||U93876 hypothetical protein YrdP { acillus subtilis}
PIR|E69725|E69725 potassium uptake trkA - acillus subtilis
% Match = 6.1
% Identity = 33.2 % Similarity = 56.0
Matches = 77 Mismatches = 88 Conservative Sub.s = 53

270       300       330       360       390       417       444       474
YYC*LVKYFILHIYFCQGEDMKHYQTIIIGAGAAGIGFGSAMQRLGLTNFLIIEKGH-IGESFL-RWPRTTQFITPSFTT
    ||:||||  |||   |   :::        |:|::|   :|||:    |:        |  : :::
             MYDTIVIGAGQAGISIGYYLKQ-SDQKFIILDKSHEVGESWKDRYDSLVLFTSRMYSS
                10        20        30        40        50

480       510       540       570       600       630       660       690
--------NGFGFPDLNAVIPDTSPAFSFEKEHLSGVEYARYLQLVAAHYNLPIQNETSVLSIDKRDSLFVIKTSKGDFS
        |||   | ::                 ||:       : :|||   | |:|:   :  |:|||:: ::
LPGMHLEGEKHGFPSKNEIV-------------------AYLKKYVKKFEIPIQLRTEVISVLKIKNYFLIKTNREEYQ
        70                                 80        90       100       110

720       750                 822       852       882       912
ADYLIMATGEFQNPNTIDIKGADLG-----MHYGQVDNF-HIKSDNPFIIIGGNESACDALTHLVYLGNQVELYTDTFGR
 |::|||  |: ||    |     ||              :|      |  | :::  |||   |
TKNLVIATGPFHTPNIPSIS-KDLSDNINQLHSSQYKNSKQLAYGNVLVVGGGNSGA--------------------
        130       140       150       160       170

942       969       996       1026
KESNPDPSISLS-PLTKERLKHIQ-DHKKEYYSISEGKKAI--EIKQIG---------------------------
         ::   |:|||:  ::      :|     |::     ||::|         ::|
---------QIAVELSKERVTYLACSNKLVYFPLMIGKRSIFWWFDKLGVLHASHTSIVGKFIQKKGDPVFGHELKHAIK
         180       190       200       210       220       230       240

1068      1098      1128      1158      1188      1218      1248
-------------KQYQVTFDDGSTAESFHKPILSTGFLNTCHLIDGIALFEYDKNQLPIVTEDDESTIVNNCFLIGPSL
             ||  ::   |    |||  :   |  :|||   |:     ::: ::   :                :
QKEIILKKRVIAAKQNEIIFKDSSTLE-VNNIIWATGFRNPLCWINIKGVLDQEGRIIHHRGVSPVEGLYFIGLPWQHKR
             260       270       280       290       300       310       320
```

| | | |
|---|---|---|
| INTEGRAL | Likelihood = −0.43 | Transmembrane 41-57 (41-57) |
| INTEGRAL | Likelihood = −0.00 | Transmembrane 265-281 (265-282) |

----- Final Results -----
bacterial membrane --- Certainty = 0.5692 (Affirmative) <succ>
bacterial outside --- Certainty = 0.0000 (Not Clear) <succ>
bacterial cytoplasm --- Certainty = 0.0000 (Not Clear) <succ>

A related GBS nucleic acid sequence <SEQ ID 9997> which encodes amino acid sequence <SEQ ID 9998> was also identified.

The protein has homology with the following sequences in the GENPEPT database.

```
>GP:CAB15668 GB:Z99122 ammonium transporter [Bacillus subtilis]
Identities = 105/378 (27%), Positives = 181/378 (47%), Gaps = 41/378 (10%)
Query:   3 VKKGLFVFLLLCILSMWLMIFGVAFYYFGSLH-QSLTSRIIYQFVLTVLLTTTAWFMGAY   61
           ++ G   VF+   C L +WLM  G+A +Y G +   +++ S    ++ F   ++ + +     W +   Y
Sbjct:   1 MQMGDTVFMFFCALLVWLMTPGLALFYGGMVKSKNVLSTAMHSFS-SIAIVSIVWVLFGY   59

Query:  62 FLAFEGHFKTVFQFQEADGKQI--------------VNCLQLCFALYAVVMLIGSIIDR  107
           LAF    +   + A  K +                   +FQ+ FA+     ++ G+  +R
Sbjct:  60 TLAFAPGNSIIGGLEWAGLKGVGFDPGDYSDTIPHSLFMMFQMTFAVLTTAIISGAFAER  119

Query: 108 VQTKRLLLAVVSWLFLVYTPLAYLIWNSEGVFAKMGVLDFSGGMIVHLSAGLSSYILAHV  167
           ++     LL  V W   LVYTP+A+  +W    G    ++G LDF+GG +VH+S+G++    +LA V
Sbjct: 120 MRFGAFLLFSVLWASLVYTPVABWVWGG-GWIGQLGALDFAGGNVVHISSGVAGLVLAIV  178

Query: 168 IGK-----SEHQHNKVKNDSLFLGMILITFGWFGFNMGPVGEWNSQAIMILLNTIFAIIG  222
           +GK       + HN +      FLG LI FGWFGFN+G      +  A+    +NT   A
Sbjct: 179 LOKRKDGTASSPHNLIYT---FLGGALIWFGWFGFNVGSALTLDGVAMYAFINTNTAAAA  235

Query: 223 GGLAWTLAAKWNGEEEKTGSLLNGIIVGLVTSTAGVGYLLTWQLLAVTFFASLFTYFVTD  282
           G    W L       ++        ++G I GLV  T    G++   +   + +     ++
Sbjct: 236 GIAGWILVEWIINKKPTMLGAVSGAIAGLVAITPAAGFVTPFASIIIGIIGGAVCFWGVF  295

Query: 283 YVAKAFAIDDVVSSFGMNGIGGLLGSLGVGLFKLSHMP---------------VQLLAL  326
           + K F  DD + +FG++GIGG  G +  GLF  +  +                Q++A+
Sbjct: 296 SLKKKFGYDDALDAFGLHGIGGTWGGIATGLFATTSVNSAGADGLFYGDASLIWKQIVAI  355

Query: 327 ATTILLSIIMTYIISKAI                                           344
           A T +   I+T++I K +
Sbjct: 356 AATYVFVFIVTFVIIKIV                                           373
```

No corresponding DNA sequence was identified in *S. pyogenes*.

A related GBS gene <SEQ ID 8975> and protein <SEQ ID 8976> were also identified. Analysis of this protein sequence reveals the following:

Lipop: Possible site: −1  Crend: 4
McG: Discrim Score: 17.19
GvH: Signal Score (−7.5): −4.07
Possible site: 24
>>> Seems to have an uncleavable N-term signal seq
ALOM program    count: 9 value: −11.73 threshold: 0.0

| | | |
|---|---|---|
| INTEGRAL | Likelihood = −11.73 | Transmembrane 7-23 (1-31) |
| INTEGRAL | Likelihood = −6.42 | Transmembrane 86-102 (82-108) |
| INTEGRAL | Likelihood = −6.42 | Transmembrane 324-340 (318-342) |
| INTEGRAL | Likelihood = −5.26 | Transmembrane 210-226 (207-229) |
| INTEGRAL | Likelihood = −5.10 | Transmembrane 113-129 (112-133) |
| INTEGRAL | Likelihood = −1.49 | Transmembrane 246-262 (246-263) |
| INTEGRAL | Likelihood = −1.17 | Transmembrane 183-199 (183-199) |
| INTEGRAL | Likelihood = −0.43 | Transmembrane 41-57 (41-57) |
| INTEGRAL | Likelihood = −0.00 | Transmembrane 265-281 (265-282) |
| PERIPHERAL | Likelihood = 0.26 | 152 | modified ALOM score: 2.85
*** Reasoning Step: 3
----- Final Results -----
bacterial membrane --- Certainty = 0.5692 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the databases:

ORF01800(307-1332 of 1641)
EGAD|19589|BS3646(1-373 of 404) probable ammonium transporter {*Bacillus subtilis*}
OMNI|NT01BS4254 ammonium transporter SP|Q07429|NRGA_BACSU PROBABLE AMMONIUM TRANSPORTER (MEMBRANE PROTEIN NRGA). GP|143264|gb|AAA17399.1||L03216 membrane-associated protein {*Bacillus subtilis*} GP|1684645|emb|CAB05374.1||Z82987 unknown {*Bacillus subtilis*}

```
GP|2636176|emb|CAB15668.1||Z99122 ammonium transporter {Bacillus subtilis}
PIR|A36865|A36865 ammonium transporter nrgA - Bacillus subtilis
% Match = 13.5
% Identity = 30.0 % Similarity = 54.8
Matches = 104 Mismatches = 149 Conservative Sub.s = 86

144       174       204       234       264       294       324       354
PFSMIRKFVSPNRCMAEPKPIPAAPAPIIMV**CFMSSP*QK*MCKIKYLTS*Q*YSLTNKRVFVKKGLFVFLLLCILSM
                                                             ::  |   ||:::|  | :
                                                             MQMGDTVFMFFCALLV
                                                                    10

384       411       441       471       501       531
WLMIFGVAFYYFGSLH-QSLTSRIIYQFVLTVLLTTTAWFMGAYFLAFEGHFKTVFQFQEADGKQI---------------
|||  |:|::|  |  :   ::  |   ::  |   :::  :    |:  | |||     :  ::  |  |  :
WLMTPGLALFYGGMVKSKNVLSTAMHSF-SSIAIVSIVWVLFGYTLAFAPGNSIIGGLEWAGLKGVGFDPGDYSDTIPHS
      30        40        50        60        70        80        90

579       609       639       669       699       729       759       789
VNCLFQLCFALYAVVMLIGSIIDRVQTKRLLLAVVSWLFLVYTPLAYLIWNSEGVFAKMGVLDFSGGMIVHLSAGLSSYI
:  :||: ||:        ::   |:   :||  |  ||||||:  |     :::|  |||:||  :||:|:|::   :
LFMMFQMTFAVLTTAIISGAFAERMRFGAFLLFSVLWASLVYTPVAHWVWGG-GWIGQLGALDFAGGNVVHISSGVAGLV
    110       120       130       140       150       160       170

819       849       873       903       933       963       993      1023
LAHVIGKSEHQHNKVKNDSLF--LGMILITFGWFGFNMGPVGEWNSQAIMILLNTIFAIIGGGLAWTLAAKWNGEEEKTG
||  |:||  :        ::  ::   ||  ||  ||||||||:|   :  |: ::||    |   |   :|   :: |
LAIVLGKRKDGTASSPHNLIYTFLGGALIWFGWFGFNVGSALTLDGVAMYAFINTNTAAAAGIAGWIL-VEWIINKKPTM
      190       200       210       220       230       240       250

1050      1080      1110      1140      1170      1200      1230      1260
-SLLNGIIVGLVTSTAGVGYLLTWQLLAVTFFASLFTYFVTDYXAKAFAIDDVVSSFGMNGIGGLLGSLGVGLFKLSHMP
 ::|  |  |||   |   |  |:: :   :  ::          ||  |   ||  :  :||::||||  |  :  |||  : :
LGAVSGAIAGLVAITPAAGFVTPFASIIIGIIGGAVCFWGVFSLKKKFGYDDALDAFGLHGIGGTWGGIATGLFATTSVN
     270       280       290       300       310       320       330

1272      1302      1332      1362      1392      1422      1452
V---------------QLLALATTILLSIIMTYIISKAIFRK**IRLRCTSQPYLLF*QGE*LNRIINHFHY*TLSXX*
                |:::|:|  |  ::  |:|::|   |   :
SAGADGLFYGDASLIWKQIVAIAATYVFVFIVTFVIIKIVSLFLPLRATEEEESLGLDLTMHGEKAYQDSM
         350       360       370       380       390       400
```

Based on this analysis, it was predicted that these proteins and their epitopes could be useful antigens for vaccines or diagnostics.

Example 2087

A DNA sequence (GBSx2202) was identified in *S. agalactiae* <SEQ ID 6459> which encodes the amino acid sequence <SEQ ID 6460>. This protein is predicted to be dUTPase (dut). Analysis of this protein sequence reveals the following:

Possible site: 51
>>> Seems to have no N-terminal signal sequence

----- Final Results -----
bacterial cytoplasm --- Certainty = 0.2731 (Affirmative) <succ>
bacterial membrane --- Certainty = 0.0000 (Not Clear) <succ>
bacterial outside --- Certainty = 0.0000 (Not Clear) <succ>

A related GBS nucleic acid sequence <SEQ ID 9471> which encodes amino acid sequence <SEQ ID 9472> was also identified.

The protein has homology with the following sequences in the GENPEPT database.

```
>GP:CAA72644 GB:Y11901 dUTPase [Lactococcus lactis]
Identities = 67/144 (46%), Positives = 90/144 (61%), Gaps = 8/144 (5%)
Query:  40 RGFELVSQFSNKELLPKRETAHAAGYDLKVAKKTVIEPGEITLVPTGIKAYMQPGEVLYL  99
           RGF+    +P+R T H+AGYD+ ++    I+P EI +V TG+    + EVL L
Sbjct:   3 RGFK---KLDGNATIPERATKHSAGYDISASETVTIQPDEIKMVSTGLAVQLGDDEVLKL  59

Query: 100 YDRSSNPRKKGIVLINSVGVIDGDYYNNQVNEGHIFAQMQNITDQAVILEEGERIVQAVF 159
           YDRSSNP K+GI LINSVG+ID DYY +         NI+ + V + +G+RI+Q VF
Sbjct:  60 YDRSSNPVKRGIALINSVGIIDSDYYPQEFK-----GLFMNISKEPVTISKGQRIMQGVF 114

Query: 160 APFLLADDDQATGMRTGGFGSTGK                                    183
           +L  DDD A G RTGGFGSTG+
Sbjct: 115 VKYLTIDDDNANGKRTGGFGSTGE                                    138
```

A related DNA sequence was identified in *S. pyogenes* <SEQ ID 6461> which encodes the amino acid sequence <SEQ ID 6462>. Analysis of this protein sequence reveals the following:

```
Possible site: 37
>>> Seems to have no N-terminal signal sequence
----- Final Results -----
    bacterial cytoplasm --- Certainty = 0.2519 (Affirmative) <succ>
     bacterial membrane --- Certainty = 0.0000 (Not Clear) <succ>
       bacterial outside --- Certainty = 0.0000 (Not Clear) <succ>
```

An alignment of the GAS and GBS proteins is shown below.

```
Identities = 115/148 (77%), Positives = 125/148 (83%)
Query:   36  MSKVRGFELVSQFSNKELLPKRETAHAAGYDLKVAKKTVIEPGEITLVPTGIKAYMQPGE   95
             M+K+RGFELVS F+N +LLPKRET HAAGYDL VA+   I PGEI LVPTG+KAYMQ GE
Sbjct:    1  MTKIRGFELVSSFTNPDLLPKRETTHAAGYDLSVAEAVTIAPGEIKLVPTGVKAYMQDGE   60

Query:   96  VLYLYDRSSNPRKKGIVLINSVGVIDGDYYNNQVNEGHIFAQMQNITDQAVILEEGERIV  155
             VLYLYDRSSNPRKKGI+LINSVGVID DYY N+ NEGHIFAQMQNITD  V L  GERIV
Sbjct:   61  VLYLYDRSSNPRKKGIILINSVGVIDADYYGNEANEGHIFAQMQNITDHPVTLAVGERIV  120

Query:  156  QAVFAPFLLADDDQATGMRTGGFGSTGK                                 183
             Q VF PFL+AD DQA G RTGGFGSTG+
Sbjct:  121  QGVFMPFLIADGDQARGERTGGFGSTGQ                                 148
```

Based on this analysis, it was predicted that this protein and its epitopes, could be useful antigens for vaccines or diagnostics.

Example 2088

A DNA sequence (GBSx2203) was identified in *S. agalactiae* <SEQ ID 6463> which encodes the amino acid sequence <SEQ ID 6464>. This protein is predicted to be RadA homolog (radA). Analysis of this protein sequence reveals the following:

```
Possible site: 34
>>> Seems to have no N-terminal signal sequence
----- Final Results -----
    bacterial cytoplasm --- Certainty = 0.2628(Affirmative) <succ>
     bacterial membrane --- Certainty = 0.0000(Not Clear) <succ>
       bacterial outside --- Certainty = 0.0000(Not Clear) <succ>
```

The protein has homology with the following sequences in the GENPEPT database.

```
>GP:CAB11863 GB:Z99104 DNA repair protein homolog [Bacillus subtilis]
Identities = 285/453 (62%), Positives = 358/453 (78%), Gaps = 4/453 (0%)
Query:   1  MAKKKSVFTCQECGYQSPKYLGRCPNCSAWSSFVEEVEVQEVKNARVSLNGEKSRPTKLK   60
            MAK KS F CQ CGY+SPK++G+CP C AW++ VEE+  + N R + +          K
Sbjct:   1  MAKTKSKFICQSCGYESPKWMGKCPGCGAWNTMVEEMIKKAPANRRAAFSHSVQTVQKPS   60

Query:  61  DVSSINYS---RTKTDMDEFNRVLGGGVVPGSLVLIGGDPGIGKSTLLLQVSTQLA-NKG  116
            ++SI  S     R KT + EFNRVLGGGVV GSLVLIGGDPGIGKSTLLLQVS QL+ +
Sbjct:  61  PITSIETSEEPRVKTQLGEFNRVLGGGVVKGSLVLIGGDPGIGKSTLLLQVSAQLSGSSN  120

Query: 117  TVLYVSGEESAEQIKLRSERLGDIDNEFYLYAETNMQSIRSEIEKIKPDFLIIDSIQTIM  176
            +VLY+SGEES +Q KLR++RLG  +    ++ET+M+ I S  I+++ P F+++DSIQT+
Sbjct: 121  SVLYISGEESVKQTKLRADRLGINNPSLHVLSETDMEYISSAIQEMNPSFVVVDSIQTVY  180

Query: 177  SPEVSSVQGSVSQVREVTAELMQLAKTNNIATFIVGHVTKEGTLAGPRMLEHMVDTVLYF  236
               +++S   GSVSQVRE TAELM++AKT  I   FIVGHVTKEG++AGPR+LEHMVDTVLYF
Sbjct: 181  QSDITSAPGSVSQVRECTAELMKIAKTKGIPIFIVGHVTKEGSIAGPRLLEHMVDTVLYF  240

Query: 237  EGERHHTFRILRAVKNRFGSTNEIGIFEMQSGGLVEVLNPSQVFLEERLDGATGSAIVVT  296
            EGERHHTFRILRAVKNRFGSTNE+GIFEM+  GL EVLNPS++FLEER  G+ GS+I  +
Sbjct: 241  EGERHHTFRILRAVKNRFGSTNEMGIFEMREEGLTEVLNPSEIFLEERSAGSAGSSITAS  300

Query: 297  MEGTRPILAEVQALVTPTVFGNAKRTTTGLDFNRVSLIMAVLEKRCGLLLQNQDAYLKSA  356
            MEGTRPIL E+QAL++PT FGN +R  TG+D NRVSL+MAVLEKR GLLLQNQDAYLK A
Sbjct: 301  MEGTRPILVEIQALISPTSFGNPRRMATGIDHNRVSLLMAVLEKRVGLLLQNQDAYLKVA  360

Query: 357  GGVKLDEPAIDLAVAVAIASSYKEKPTNPQESFIGEIGLTGEIRRVTRIEQRINEASKLG  416
            GGVKLDEPAIDLA+  ++IASS+++  P NP +  FIGE+GLTGE+RRV+RIEQR+ EA+KLG
Sbjct: 361  GGVKLDEPAIDLAIVISIASSFRDTPPNPADCFIGEVGLTGEVRRVSRIEQRVKEAAKLG  420

Query: 417  FTKIYAPKNSLAGIEIPKGIDVIGVTTVSQVLK                            449
            F ++  P  +L G    PKGI+VIGV  V++ L+
Sbjct: 421  FKRMIIPAANLDGWTKPKGIEVIGVANVAEALR                            453
```

A related DNA sequence was identified in *S. pyogenes* <SEQ ID 6465> which encodes the amino acid sequence <SEQ ID 6466>. Analysis of this protein sequence reveals the following:

```
Possible site: 34
>>> Seems to have no N-terminal signal sequence
----- Final Results -----
    bacterial cytoplasm --- Certainty = 0.2191(Affirmative) <succ>
      bacterial membrane --- Certainty = 0.0000 (Not Clear) <succ>
        bacterial outside --- Certainty = 0.0000 (Not Clear) <succ>
```

An alignment of the GAS and GBS proteins is shown below.

```
Identities = 416/453 (91%), Positives = 441/453 (96%)
Query:   1  MAKKKSVFTCQECGYQSPKYLGRCPNCSAWSSFVEEVEVQEVKNARVSLNGEKSRPTKLK    60
            MAKKK+ F CQECGYQSPKYLGRCPNCSAWSSFVEEVEV+EVKNARVSL GEKSRP KLK
Sbjct:   1  MAKKKATFICQECGYQSPKYLGRCPNCSAWSSFVEEVEVKEVKNARVSLAGEKSRPVKLK    60

Query:  61  DVSSINYSRTKTDMDEFNRVLGGGVVPGSLVLIGGDPGIGKSTLLLQVSTQLANKGTVLY   120
            DV +I+Y RT+TDM EFNRVLGGGVVPGSL+LIGGDPGIGKSTLLLQVSTQLANKGTVLY
Sbjct:  61  DVDNISYHRTQTDMSEFNRVLGGGVVPGSLILIGGDPGIGKSTLLLQVSTQLANKGTVLY   120

Query: 121  VSGEESAEQIKLRSERLGDIDNEFYLYAETNMQSIRSEIEKIKPDFLIIDSIQTIMSPEV   180
            VSGEESAEQIKLRSERLGDIDNEFYLYAETNMQ+IR+EIE IKPDFLIIDSIQTIMSP++
Sbjct: 121  VSGEESAEQIKLRSERLGDIDNEFYLYAETNMQAIRTEIENIKPDFLIIDSIQTIMSPDI   180

Query: 181  SSVQGSVSQVREVTAELMQLAKTNNIATFIVGHVTKEGTLAGPRMLEHMVDTVLYFEGER   240
            + VQGSVSQVREVTAELMQLAKTNNIATFIVGHVTKEGTLAGPRMLEHMVDTVLYFEGER
Sbjct: 181  TGVQGSVSQVREVTAELMQLAKTNNIATFIVGHVTKEGTLAGPRMLEHMVDTVLYFEGER   240

Query: 241  HHTFRILRAVKNRFGSTNEIGIFEMQSGGLVEVLNPSQVFLEERLDGATGSAIVVTMEGT   300
            HHTFRILRAVKNRFGSTNEIGIFEMQSGGLVEVLNPSQVFLEERLDGATGSA+VVTMEG+
Sbjct: 241  HHTFRILRAVKNRFGSTNEIGIFEMQSGGLVEVLNPSQVFLEERLDGATGSAVVVTMEGS   300

Query: 301  RPILAEVQALVTPTVFGNAKRTTTGLDFNRVSLIMAVLEKRCGLLLQNQDAYLKSAGGVK   360
            RPILAEVQ+LVTPTVFGNA+RTTTGLDFNRVSLIMAVLEKRCGLLLQNQDAYLKSAGGVK
Sbjct: 301  RPILAEVQSLVTPTVFGNARRTTTGLDFNRVSLIMAVLEKRCGLLLQNQDAYLKSAGGVK   360

Query: 361  LDEPAIDLAVAVAIASSYKEKPTNPQESFIGEIGLTGEIRRVTRIEQRINEASKLGFTKI   420
            LDEPAIDLAVAVAIASSYKEKPT+PQE+F+GEIGLTGEIRRVTRIEQRINEA+KLGFTK+
Sbjct: 361  LDEPAIDLAVAVAIASSYKEKPTSPQEAFLGEIGLTGEIRRVTRIEQRINEAAKLGFTKV   420

Query: 421  YAPKNSLAGIEIPKGIDVIGVTTVSQVLKAVFS                             453
            YAPKN+L GI+IP+GI+V+GVTTV QVL AVFS
Sbjct: 421  YAPKNALQGIDIPQGIEVVGVTTVGQVLNAVFS                             453
```

Based on this analysis, it was predicted that this protein and its epitopes, could be useful antigens for vaccines or diagnostics.

Example 2089

A DNA sequence (GBSx2204) was identified in *S. agalactiae* <SEQ ID 6467> which encodes the amino acid sequence <SEQ ID 6468>. Analysis of this protein sequence reveals the following:

```
Possible site: 49
>>> Seems to have no N-terminal signal sequence
----- Final Results -----
    bacterial cytoplasm --- Certainty = 0.3488 (Affirmative) <succ>
      bacterial membrane --- Certainty = 0.0000 (Not Clear) <succ>
        bacterial outside --- Certainty = 0.0000 (Not Clear) <succ>
```

The protein has homology with the following sequences in the GENPEPT database.

```
>GP:CAA97750 GB:Z73419 hypothetical protein Rv1284 [Mycobacterium
tuberculosis]
Identities = 69/162 (42%), Positives = 100/162 (61%), Gaps = 2/162 (1%)
Query:   3  TYFDNFLKTNQAYADLHGTAHLPIKPKTKVAIVTCMDSRLHVAQALGLALGDAHILRNAG    62
            T  D++L N  YA       LP+ P   +AIV CMD+RL V + LG+  G+AH++RNAG
Sbjct:   2  TVTDDYLANNVDYASGF-KGPLPMPPSKHIAIVACMDARLDVYRMLGIKEGEAHVIRNAG    60

Query:  63  GRVTDDVLRSLVISQQQLGTREIVVLHHTDCGAQTFTNEAFAAQLQRDLGVDMHGHDFLP   122
                VTDDV+RSL ISQ+ LGTREI++LHHTDCG  TFT++ F   +Q + G+
Sbjct:  61  CVVTDDVIRSLAISQRLLGTREIILLHHTDCGMLTFTDDDFKRAIQDETGIRPTWSP-ES   119

Query: 123  FNDIEESVREDVAKLHASPLIPDDVVISGAIYDVDTGRMVEV                    164
            + D  E VR+ + ++ +P +    + G ++DV TG++ EV
Sbjct: 120  YPDAVEDVRQSLRRIEVNPFVTKHTSLRGFVFDVATGKLNEV                    161
```

There is also homology to SEQ ID 6470:

```
Identities = 126/164 (76%), Positives = 146/164 (88%)
Query:   1   MTTYFDNFLKTNQAYADLHGTAHLPIKPKTKVAIVTCMDSRLHVAQALGLALGDAHILRN   60
             + +YF++F+  NQAY  LHGTAHLP+KPKTKVAIVTCMDSRLHVAQALGLALGDAHILRN
Sbjct:   1   LMSYFEHFMAANQAYVALHGTAHLPLKPKTKVAIVTCMDSRLHVAQALGLALGDAHILRN   60

Query:  61   AGGRVTDDVLRSLVISQQQLGTREIVVLHHTDCGAQTFTNEAFAAQLQRDLGVDMHGHDF  120
             AGGRVT+D++RSLVISQQQ+GTREIVVLHHTDCGAQTFTNE FA  +    LGVD+ G DF
Sbjct:  61   AGGRVTEDMIRSLVISQQQMGTREIVVLHHTDCGAQTFTNEGFAKHIHEHLGVDVSGQDF  120

Query: 121   LPFNDIEESVREDVAKLHASPLIPDDVVISGAIYDVDTGRMVEV                164
             LPF D+E+SVRED+AK+ AS LI DDVVI+GA+YDVDTG+M +V
Sbjct: 121   LPFQDVEDSVREDMAKIRASSLISDDVVINGAVYDVDTGKMTQV                164
```

Based on this analysis, it was predicted that this protein and its epitopes, could be useful antigens for vaccines or diagnostics.

Example 2090

A DNA sequence (GBSx2205) was identified in *S. agalactiae* <SEQ ID 6471> which encodes the amino acid sequence <SEQ ID 6472>. Analysis of this protein sequence reveals the following:

```
Possible site: 19
>>> Seems to have no N-terminal signal sequence
```

-continued

```
----- Final Results -----
  bacterial cytoplasm --- Certainty = 0.0536 (Affirmative) <succ>
  bacterial membrane --- Certainty = 0.0000 (Not Clear) <succ>
  bacterial outside --- Certainty = 0.0000 (Not Clear) <succ>
```

A related GBS nucleic acid sequence <SEQ ID 9473> which encodes amino acid sequence <SEQ ID 9474> was also identified.

The protein has homology with the following sequences in the GENPEPT database.

```
>GP:AAC73407 GB:AE000137 putative oxidoreductase [Escherichia coli K12]
Identities = 199/438 (45%), Positives = 286/438 (64%)
Query:   1   MKKYDVIVLGFGKAGKTLAAKLATQGKSVAMVEEDDKMYGGTCINIGCIPTKTLLVSASK   60
             M KY   +++GFGKAGKTLA  LA  G  VA++E+ + MYGGTCINIGCIPTKTL+  A +
Sbjct:  10   MNKYQAVIIGFGKAGKTLAVTLAKAGWRVALIEQSNAMYGGTCINIGCIPTKTLVHDAQQ   69

Query:  61   NHDFQEAMTTRNEVTSRLRAKNFAMLDNKDTVDVYNAKARFISNKVVELTGGADKQELTA  120
             + DF  A+  +NEV + LR KNF  L +    +DV ++A FI+N  + +         E+
Sbjct:  70   HTDFVRAIQRKNEVVNFLRNKNFHNLADMPNIDVIDGQAEFINNHSLRVHRPEGNLEIHG  129

Query: 121   DVIIINTGAKSVQLPIPGLADSQHVYDSTAIQELAHLPKRLGIIGGGNIGLEFATLYSEL  180
             + I  INTGA++V  PIPG+  +  VYDST +   L  LP  LGI+GGG IG+EFA++++
Sbjct: 130   EKIFINTGAQTVVPPIPGITTTPGVYDSTGLLNLKELPGHLGILGGGYIGVEFASMFANF  189

Query: 181   GSKVTVIDSQSRIFAREEEELSEMAQDYLEEMGISFKLSADIKSVQNEDEDVVISFEDEK  240
             GSKVT++++ S    RE+ ++++      L + G+    L+A ++ + + +  V + E  +
Sbjct: 190   GSKVTILEAASLFLPREDRDIADNIATILRDQGVDIILNAHVERISHHENQVQVHSEHAQ  249

Query: 241   LSFDAVLYATGRKPNTEGLALENTDIKLTERGAIAVDEYCQTSVENIFAVGDVNGGPQFT  300
             L+  DA+L A+GR+P T  L  EN  I + ERGAI VD+    T+ +NI+A+GDV GG QFT
Sbjct: 250   LAVDALLIASGRQPATASLHPENAGIAVNERGAIVVDKRLHTTADNIWAMGDVTGGLQFT  309

Query: 301   YISLDDSRIVLNYLNCDKDYSLKNRGAVPTSTFTNPPLATVGLDEKTAKEKGYQVKSNSL  360
             YISLDD RIV + L    +    S +R  VP S F  PPL+ VG+ E+ A+E G  ++  +L
Sbjct: 310   YISLDDYRIVRDELLGEGKRSTDDRKNVPYSVFMTPPLSRVGMTEEQARESGADIQVVTL  369

Query: 361   LVSAMPRAHVNNDLRGIFKVVVDTETNLILGARLFGAESHELINIITMAMDNKIPYTYFQ  420
              V+A+PRA V ND RG+ K +VD +T  +LGA L   +SHE+INI+ M MD  +PY+  +
Sbjct: 370   PVAAIPRARVMNDTRGVLKAIVDNKTQRMLGASLLCVDSHEMINIVKMVMDAGLPYSILR  429

Query: 421   KQIFTHPTMVENFNDLFN                                          438
             +QIFTHP+M E+ NDLF+
Sbjct: 430   DQIFTHPSMSESLNDLFS                                          447
```

There is also homology to SEQ ID 1820.

Based on this analysis, it was predicted that this protein and its epitopes, could be useful antigens for vaccines or diagnostics.

Example 2091

A DNA sequence (GBSx2206) was identified in *S. agalactiae* <SEQ ID 6473> which encodes the amino acid sequence <SEQ ID 6474>. This protein is predicted to be glutamyl-tRNA synthetase (gltX). Analysis of this protein sequence reveals the following:

Possible site: 43
>>> Seems to have no N-terminal signal sequence

----- Final Results -----
bacterial cytoplasm --- Certainty = 0.2245 (Affirmative) <succ>
bacterial membrane --- Certainty = 0.0000 (Not Clear) <succ>
bacterial outside --- Certainty = 0.0000 (Not Clear) <succ>

A related GBS nucleic acid sequence <SEQ ID 9475> which encodes amino acid sequence <SEQ ID 9476> was also identified. A further related GBS nucleic acid sequence <SEQ ID 10953> which encodes amino acid sequence <SEQ ID 10954> was also identified.

The protein has homology with the following sequences in the GENPEPT database.

```
>GP:AAC31971 GB:U49789 glutamyl-tRNA synthetase [Bacillus subtilis]
Identities = 273/491 (55%), Positives = 353/491 (71%), Gaps = 19/491 (3%)
Query:  20  LANKIRVRYAPSPTGLLHIGNARTALFNYLYARHHGGDFVIRIEDTDRKRHVEDGERSQL   79
            + N++RVRYAPSPTG LHIGNARTALFNYL+AR+ GG F+IR+EDTD+KR++E GE+SQL
Sbjct:   1  MGNEVRVRYAPSPTGHLHIGNARTALFNYLFARNQGGKFIIRVEDTDKKRNIEGGEQSQL   60

Query:  80  ENLRWLGMDWDESPET---HENYRQSERLELYQRYIDQLLAEGKAYKSYVTEEELAAERE  136
            L+WLG+DWDES +    +  YRQSER ++Y+ Y ++LL +G AYK Y TEEEL  ERE
Sbjct:  61  NYLKWLGIDWDESVDVGGEYGPYRQSERNDIYKVYYEELLEKGLAYKCYCTEEELEKERE  120

Query: 137  RQELAGETPRYINEFIGMSETEKEAYIAEREAAGIIPTVRLAVNESGIYKWTDMVKGDIE  196
            Q   GE PRY +   +++ E+E +IAE    G P++R  V E +   + D+VKG+I
Sbjct: 121  EQIARGEMPRYSGKHRDLTQEEQEKFIAE----GRKPSIRFRVPEGKVIAFNDIVKGEIS  176

Query: 197  FEGSNIGGDWVIQKKDGYPTYNFAVVIDDHDMQISHVIRGDDHIANTPKQLMVYEALGWE  256
            FE    IG D+VI KKDG PTYNFAV IDD+ M+++HV+RG+DHI+NTPKQ+M+Y+A GW+
Sbjct: 177  FESDGIG-DFVIVKKDGTPTYNFAVAIDDYLMKMTHVLRGEDHISNTPKQIMIYQAFGWD  235

Query: 257  APQFGHMTLIINSETGKKLSKRDTNTLQFIEDYRKKGYMSEAVFNFIALLGWNPGGEEEI  316
            PQFGHMTLI+N E+ KKLSKRD + +QFIE Y++ GY+ EA+FNFI LLGW+P GEEE+
Sbjct: 236  IPQFGHMTLIVN-ESRKKLSKRDESIIQFIEQYKELGYLPEALFNFIGLLGWSPVGEEEL  294

Query: 317  FSREQLINLFDENRLSKSPAAFDQKKMDWMSNDYLKNADFESVFALCKPFLEEAGRL---  373
            F++EQ I +FD NRLSKSPA FD  K+ W++N Y+K  D + V  L  P L++AG++
Sbjct: 295  FTKEQFIEIFDVNRLSKSPALFDMHKLKWVNNQYVKKLDLDQVVELTLPHLQKAGKVGTE  354

Query: 374  -----TDKAEKLVELYQPQLKSADEIVPLTDLFFADFPELTEAEKEVMAAETVPTVLSAF  428
                 +   KL+ LY  QL     EIV LTDLFF D  E  + K V+  E VP VLS F
Sbjct: 355  LSAEEQEWVRKLISLYHEQLSYGAEIVELTDLFFTDEIEYNQEAKAVLEEEQVPEVLSTF  414

Query: 429  KEKLVSLSDEEFTRDTIFPQIKAVQKETGIKGKNLFMPIRIAVSGEMHGPELPDTIYLLG  488
                KL  L    EEFT D I   IKAVQKETG KGK LFMPIR+AV+G+ HGPELP +I L+G
Sbjct: 415  AAKLEEL--EEFTPDNIKASIKAVQKETGHKGKKLFMPIRVAVTGQTHGPELPQSIELIG  472

Query: 489  KEKSVQHIDNM                                                  499
            KE ++Q + N+
Sbjct: 473  KETAIQRLKNI                                                  483
```

A related DNA sequence was identified in *S. pyogenes* <SEQ ID 6475> which encodes the amino acid sequence <SEQ ID 6476>. Analysis of this protein sequence reveals the following:

```
Possible site: 24
>>> Seems to have no N-terminal signal sequence
----- Final Results -----
    bacterial cytoplasm --- Certainty = 0.1966 (Affirmative) <succ>
      bacterial membrane --- Certainty = 0.0000 (Not Clear) <succ>
        bacterial outside --- Certainty = 0.0000 (Not Clear) <succ>
```

An alignment of the GAS and GBS proteins is shown below.

```
Identities = 434/481 (90%), Positives = 459/481 (95%)
Query:  20  LANKIRVRYAPSPTGLLHIGNARTALFNYLYARHHGGDFVIRIEDTDRKRHVEDGERSQL   79
            ++  IRVRYAPSPTGLLHIGNARTALFNYLYAR HGG F+IRIEDTDRKRHVEDGERSQL
Sbjct:   1  MSKPIRVRYAPSPTGLLHIGNARTALFNYLYARRHGGTFIIRIEDTDRKRHVEDGERSQL   60

Query:  80  ENLRWLGMDWDESPETHENYRQSERLELYQRYIDQLLAEGKAYKSYVTEEELAAERERQE  139
            ENL+WLGMDWDESPETHENYRQSERL LYQ+YIDQLLAEGKAYKSYVTEEELAAERERQE
Sbjct:  61  ENLKWLGMDWDESPETHENYRQSERLALYQQYIDQLLAEGKAYKSYVTEEELAAERERQE  120

Query: 140  LAGETPRYINEFIGMSETEKEAYIAEREAAGIIPTVRLAVNESGIYKWTDMVKGDIEFEG  199
             AGETPRYINEFIGMS  EK  YIAEREAAGI+PTVRLAVNESGIYKWTDMVKGDIEFEG
Sbjct: 121  AAGETPRYINEFIGMSADEKAKYIAEREAAGIVPTVRLAVNESGIYKWTDMVKGDIEFEG  180

Query: 200  SNIGGDWVIQKKDGYPTYNFAVVIDDHDMQISHVIRGDDHIANTPKQLMVYEALGWEAPQ  259
             NIGGDWVIQKKDGYPTYNFAVV+DDHDMQISHVIRGDDHIANTPKQLMVYEALGWEAP+
Sbjct: 181  GNIGGDWVIQKKDGYPTYNFAVVVDDHDMQISHVIRGDDHIANTPKQLMVYEALGWEAPE  240

Query: 260  FGHMTLIINSETGKKLSKRDTNTLQFIEDYRKKGYMSEAVFNFIALLGWNPGGEEEIFSR  319
            FGHMTLIINSETGKKLSKRDTNTLQFIEDYRKKGYM EAVFNFIALLGWNPGGEEEIFSR
Sbjct: 241  FGHMTLIINSETGKKLSKRDTNTLQFIEDYRKKGYMPEAVFNFIALLGWNPGGEEEIFSR  300

Query: 320  EQLINLFDENRLSKSPAAFDQKKMDWMSNDYLKNADFESVFALCKPFLEEAGRLTDKAEK  379
            EQLI LFDENRLSKSPAAFDQKKMDWMSN+YLK+ADFE+V+ALCKPFLEEAGRLT+KAEK
Sbjct: 301  EQLIALFDENRLSKSPAAFDQKKMDWMSNEYLKHADFETVYALCKPFLEEAGRLTEKAEK  360

Query: 380  LVELYQPQLKSADEIVPLTDLFFADFPELTEAEKEVMAAETVPTVLSAFKEKLVSLSDEE  439
            LVELY+PQLKSADEI+PLTDLFF+DFPELTEAEKEVMA ETV TVL AFK KL ++SDE+
Sbjct: 361  LVELYKPQLKSADEIIPLTDLFFSDFPELTEAEKEVMAGETVSTVLQAFKAKLEAMSDED  420

Query: 440  FTRDTIFPQIKAVQKETGIKGKNLFMPIRIAVSGEMHGPELPDTIYLLGKEKSVQHIDNML 500
            F + IFPQIKAVQKETGIKGKNLFMPIRIAVSGEMHGPELP+TIYLLG++KS++HI NML
Sbjct: 421  FKPENIFPQIKAVQKETGIKGKNLFMPIRIAVSGEMHGPELPNTIYLLGRDKSIEHIKNML 481
```

Based on this analysis, it was predicted that this protein and its epitopes, could be useful antigens for vaccines or diagnostics.

Example 2092

A DNA sequence (GBSx2207) was identified in *S. agalactiae* <SEQ ID 6477> which encodes the amino acid sequence <SEQ ID 6478>. This protein is predicted to be d-ribose-binding protein precursor, fragment (rbsB). Analysis of this protein sequence reveals the following:

```
Possible site: 24
>>> May be a lipoprotein
----- Final Results -----
      bacterial membrane --- Certainty = 0.0000 (NotClear) <succ>
        bacterial outside --- Certainty = 0.0000 (NotClear) <succ>
    bacterial cytoplasm --- Certainty = 0.0000 (NotClear) <succ>
```

The protein has homology with the following sequences in the GENPEPT database.

```
>GP:CAB15613 GB:Z99122 ribose ABC transporter (ribose-binding
protein) [Bacillus subtilis]
Identities = 143/301 (47%), Positives = 205/301 (67%), Gaps = 1/301 (0%)
Query:  14  MSIVLILGACGKTGLGNSSGNSTKNVTKKSAKDLKLGVSISTTNNPYFVAMKDGIDKYAS   73
            +S++L L      T      K    + K+   +G+S+ST NNP+FV++K GI+K A
Sbjct:   5  VSVILTLSLFLLTACSLEPPQWAKPSNSGNKKEFTIGLSVSTLNNPFFVSLKKGIEKEAK   64

Query:  74  NKKISIKVADAQDDAARQADDVQNFISQNVDAILINPVDSKAIVTAIKSANNANIPVILM  133
             + + + + DAQ+D+++Q  DV++ I Q  VDA+LINP DS AI TA++SAN   +PV+
Sbjct:  65  KRGMKVIIVDAQNDSSKQTSDVEDLIQQGVDALLINPTDSSAISTAVESANAVGVPVVTI  124
```

```
Query:  134  DRGSEGGKVLTTVASDNVAAGKMAADYAVKKLGKKAKAFELSGVPGASATVDRGKGFHSV  193
             DR +E GKV T VASDNV  G+MAA +   KLGK AK  EL GVPGASAT +RG GFH++
Sbjct:  125  DRSAEQGKVETLVASDNVKGGEMAAAFIADKLGKGAKVAELEGVPGASATRERGSGFHNI  184

Query:  194  AKSKLDILSSQSANFDRAKALNTTQNMIQGHKDVQIIFAQNDEMALGAAQAVKSAGLQNV  253
             A  KL +++ QSA+FDR K L   +N++QGH D+Q +FA NDEMALGA +A+ S+G +++
Sbjct:  185  ADQKLQVVTKQSADFDRTKGLTVMENLLQGHPDIQAVFAHNDEMALGALEAINSSG-KDI  243

Query:  254  LIVGIDGQPDAHDAIKKGDISATIAQQPAKMGEIAIQAAIDYYKGKKVEKETISPIYLVTK  314
             L++G DG  DA  +IK   +SAT+AQQP  +G++A +AA D   GKKV+K   +P+ L T+
Sbjct:  244  LVIGFDGNKDALASIKDRKLSATVAQQPELIGKLATEAADDILHGKKVQKTISAPLKLETQ  304
```

No corresponding DNA sequence was identified in *S. pyogenes*.

SEQ ID 6478 (GBS203) was expressed in *E. coli* as a His-fusion product. SDS-PAGE analysis of total cell extract is shown in FIG. 52 (lane 12; MW 36.8 kDa).

GBS203-His was purified as shown in FIG. 208, lane 8.

Based on this analysis, it was predicted that this protein and its epitopes, could be useful antigens for vaccines or diagnostics.

Example 2093

A DNA sequence (GBSx2208) was identified in *S. agalactiae* <SEQ ID 6479> which encodes the amino acid sequence <SEQ ID 6480>. This protein is predicted to be galactoside ABC transporter, permease. protein (rbsC). Analysis of this protein sequence reveals the following:

Possible site: 14
>>> Seems to have no N-terminal signal sequence
INTEGRAL     Likelihood = −11.15   Transmembrane 63-79 (52-85)
INTEGRAL     Likelihood = −3.66    Transmembrane 111-127 (110-128)
INTEGRAL     Likelihood = −2.71    Transmembrane 168-184 (168-188)
INTEGRAL     Likelihood = −2.44    Transmembrane 189-205 (188-205)
INTEGRAL     Likelihood = −0.80    Transmembrane 17-33 (17-33)
----- Final Results -----
    bacterial membrane --- Certainty = 0.5458 (Affirmative) <succ>
    bacterial outside --- Certainty = 0.0000 (Not Clear) <succ>
    bacterial cytoplasm --- Certainty = 0.0000 (Not Clear) <succ>

A related GBS nucleic acid sequence <SEQ ID 9287> which encodes amino acid sequence <SEQ ID 9288> was also identified.

The protein has homology with the following sequences in the GENPEPT database.

A related GBS gene <SEQ ID 8977> and protein <SEQ ID 8978> were also identified.

Based on this analysis, it was predicted that this protein and its epitopes, could be useful antigens for vaccines or diagnostics.

Example 2094

A DNA sequence (GBSx2209) was identified in *S. agalactiae* <SEQ ID 6481> which encodes the amino acid sequence <SEQ ID 6482>. Analysis of this protein sequence reveals the following:

Possible site: 35
>>> Seems to have no N-terminal signal sequence
INTEGRAL     Likelihood = −1.12    Transmembrane 75-91 (74-91)
INTEGRAL     Likelihood = −0.64    Transmembrane 96-112 (96-112)
----- Final Results -----
    bacterial membrane --- Certainty = 0.1447 (Affirmative) <succ>
    bacterial outside --- Certainty = 0.0000 (Not Clear) <succ>
    bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2095

A DNA sequence (GBSx2210) was identified in *S. agalactiae* <SEQ ID 6483> which encodes the amino acid sequence <SEQ ID 6484>. This protein is predicted to be ribose transport ATP-binding protein rbsa (rbsA). Analysis of this protein sequence reveals the following:

```
>GP:CAB15612 GB:Z99122 ribose ABC transporter (permease) [Bacillus subtilis]

Identities = 144/211 (68%), Positives = 182/211 (86%), Gaps = 1/211 (0%)

Query:  1    MGMLNGLFISYGKLAPFIVTLATMTIFRGATLVYSNGNPITAGLSDSFLFQFLGQGYIVG   60
             +GM+NGL I+ GK+APFI TLATMT+FRG TLVY++GNPIT GL  ++ FQ  G+GY +G
Sbjct:  113  LGMINGLLITKGKMAPFIATLATMTVFRGLTLVYTDGNPIT-GLGTNYGFQMFGRGYFLG  171

Query:  61   IPFPVILMFLTFIILYILLHKTAFGKSVYALGGNEKAAYISGIKLNKVKIIIYTISGIMA  120
             IP P I M L F+IL++LLHKT FG+  YA+GGNEKAA ISGIK+ +VK++IY+++G+++
Sbjct:  172  IPVPAITMVLAFVILWVLLHKTPFGRRTYAIGGNEKAALISGIKVTRVKVMIYSLAGLLS  231

Query:  121  SISGLIITSRLSSAQPTAGASYEMDAIAAVVLGGTSLSGGKGRIIGTLIGALIIGVLNNG  180
             +++G I+TSRL SAQPTAG SYE+DAIAAVVLGGTSLSGG+GRI GTLIG LIIG LNNG
Sbjct:  232  ALAGAILTSRLHSAQPTAGESYELDAIAAVVLGGTSLSGGRGRIVGTLIGVLIIGTLNNG  291

Query:  181  LNIIGVSAFWQQVVKGIVILMAVLLDRFKVA                              211
             LN++GVS+F+Q VVKGIVIL+AVLLDR K A
Sbjct:  292  LNLLGVSSFYQLVVKGIVILIAVLLDRKKSA                              322
```

```
Possible site: 35
>>> Seems to have no N-terminal signal sequence
INTEGRAL      Likelihood = −0.00    Transmembrane 401-417 (401-417)
----- Final Results -----
   bacterial membrane --- Certainty = 0.1001 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the GENPEPT database.

```
>GP:CAB15611 GB:Z99122 ribose ABC transporter (ATP-binding protein)
[Bacillus subtilis]
Identities = 297/493 (60%), Positives = 375/493 (75%), Gaps = 1/493 (0%)
Query:   1   MKIDMRNISKSFGTNKVLEKIDLELQSGQIHALMGENGAGKSTLMNILTGLFPASTGTIY    60
             M+I+M++I K+FG N+VL  +  +L  G++HALMGENGAGKSTLMNILTGL  A  G I
Sbjct:   1   MQIEMKDIHKTFGKNQVLSGVSFQLMPGEVHALMGENGAGKSTLMNILTGLHKADKGQIS   60

Query:  61   IDGEERTFSNPQEAEEFGISFIHQEMNTWPEMTVLENLFLGREIKTTFGLLNQKLMRQKA  120
             I+G E  FSNP+EAE+ GI+FIHQE+N WPEMTVLENLF+G+EI + G+L + M+  A
Sbjct:  61   INGNETYFSNPKEAEQHGIAFIHQELNIWPEMTVLENLFIGKEISSKLGVLQTRKMKALA  120

Query: 121   LETFKRLGVTIPLDIPIGNLSVGQQQMIEIAKSLLNQLSILVMDEPTAALTDRETENLFR  180
              E F +L V++ LD   G   SVGQQQMIEIAK+L+    +++MDEPTAALT+RE   LF
Sbjct: 121   KEQFDKLSVSLSLDQEAGECSVGQQQMIEIAKALMTNAEVIIMDEPTAALTEREISKLFE  180

Query: 181   VIRGLKQEGVGVVYISHRMEEIFKITDFVTVMRDGVIVDTKETSLTNSDELVKKMVGRKL  240
             VI   LK+ GV +VYISHRMEEIF I D +T+MRDG  VDT   S T+ DE+VKKMVGR+L
Sbjct: 181   VITALKKNGVSIVYISHRMEEIFAICDRITIMRDGKTVDTTNISETDFDEVVKKMVGREL  240

Query: 241   EDYYPEKHSEIGPVAFEVSNL-CGDNFEDVSFYVRKGEILGFSGLMGAGRTEVMRTIFGI  299
              + YP++   +G    FEV N   +FEDVSFYVR GEI+G SGLMGAGRTE+MR +FG+
Sbjct: 241   TERYPKRTPSLGDKVFEVKNASVKGSFEDVSFYVRSGEIVGVSGLMGAGRTEMMRALFGV  300

Query: 300   DKKKSGKVKIDDQEITITTPSQAIKQGIGFLTENRKDEGLILDFNIKDNMTLPSTKDFSK  359
             D+  +G++ I   ++ I   P +A+K+G+GF+TENRKDEGL+LD +I++N+ LP+    FS
Sbjct: 301   DRLDTGEIWIAGKKTAIKNPQEAVKKGLGFITENRKDEGLLLDTSIRENIALPNLSSFSP  360

Query: 360   HGFFDEKTSTTFVQQLINRLYIKSGRPDLEVGNLSGGNQQKVVLAKWIGIAPKVLILDEP  419
                  G  D K    FV  LI RL IK+  P+     +LSGGNQQKVV+AKWIGI PKVLILDEP
Sbjct: 361   KGLIDHKREAEFVDLLIKRLTIKTASPETHARHLSGGNQQKVVIAKWIGIGPKVLILDEP  420

Query: 420   TRGVDVGAKREIYQLMNELADRGVPIVMVSSDLPEILGVSDRIMVMHEGRISGELSRKEA  479
             TRGVDVGAKREIY LMNEL +RGV I+MVSS+LPEILG+SDRI+V+HEGRISGE+   +EA
Sbjct: 421   TRGVDVGAKREIYTLMNELTERGVAIIMVSSELPEILGMSDRIIVVHEGRISGEIHAREA  480

Query: 480   DQEKVMQLATGGK                                                 492
             QE++M  LATGG+
Sbjct: 481   TQERIMTLATGGR                                                 493
```

There is also homology to SEQ ID 4678.

SEQ ID 6484 (GBS407d) was expressed in *E. coli* as a GST-fusion product. SDS-PAGE analysis of total cell extract is shown in FIG. 147 (lane 2-4; MW 72 kDa). It was also expressed in *E. coli* as a His-fusion product. SDS-PAGE analysis of total cell extract is shown in FIG. 147 (lane 5 & 6; MW 47 kDa).

GBS407d-His was purified as shown in FIG. 235, lane 9-10.

Based on this analysis, it was predicted that this protein and its epitopes, could be useful antigens for vaccines or diagnostics.

Example 2096

A DNA sequence (GBSx2211) was identified in *S. agalactiae* <SEQ ID 6485> which encodes the amino acid sequence <SEQ ID 6486>. This protein is predicted to be high affinity ribose transport protein rbsd (rbsD). Analysis of this protein sequence reveals the following:

```
Possible site: 14
>>> Seems to have no N-terminal signal sequence
----- Final Results -----
   bacterial cytoplasm --- Certainty = 0.2673 (Affirmative) <succ>
     bacterial membrane --- Certainty = 0.0000 (Not Clear) <succ>
       bacterial outside --- Certainty = 0.0000 (Not Clear) <succ>
```

The protein has homology with the following sequences in the GENPEPT database.

```
>GP:CAB15610 GB:Z99122 ribose ABC transporter (membrane protein)
[Bacillus subtilis]
Identities = 74/131 (56%), Positives = 95/131 (72%), Gaps = 1/131 (0%)
Query:   1   MKKTGILNSHLAKLADDLGHTDRVCIGDLGLPVPNGIPKIDLSLTSGIPSFQEVLDIYLE   60
             MKK GILNSHLAK+   DLGHTD++ I D GLPVP+G+ KIDLSL G+P+FQ+   + E
Sbjct:   1   MKKHGILNSHLAKILADLGHTDKIVIADAGLPVPDGVLKIDLSLKPGLPAFQDTAAVLAE   60

Query:  61   NILVEKVILAEEIKEANPDQLSRLLAKLDNSVSIEYVSHNHLKQMTQDVKAVIRTGENTP  120
              + VEKVI A EIK +N +  ++ L L +   IEY+SH    K +T+D KAVIRTGE TP
Sbjct:  61   EMAVEKVIAAAEIKASNQEN-AKFLENLFSEQEIEYLSHEEFKLLTKDAKAVIRTGEFTP  119
```

```
Query: 121  YSNIILQSGVI           131
            Y+N ILQ+GV+
Sbjct: 120  YANCILQAGVL           130
```

No corresponding DNA sequence was identified in *S. pyogenes*.

Based on this analysis, it was predicted that this protein and its epitopes, could be useful antigens for vaccines or diagnostics.

Example 2097

A DNA sequence (GBSx2212) was identified in *S. agalactiae* <SEQ ID 6487> which encodes the amino acid sequence <SEQ ID 6488>. This protein is predicted to be ribokinase (rbsK). Analysis of this protein sequence reveals the following:

Possible site: 47
>>> Seems to have an uncleavable N-term signal seq
----- Final Results -----
   bacterial membrane --- Certainty = 0.0000 (Not Clear) <succ>
   bacterial outside --- Certainty = 0.0000 (Not Clear) <succ>
      bacterial cytoplasm --- Certainty = 0.0000 (Not Clear) <succ>

The protein has homology with the following sequences in the GENPEPT database.

```
>GP:CAB15609 GB:Z99122 ribokinase [Bacillus subtilis]
Identities = 132/293 (45%), Positives = 177/293 (60%), Gaps = 4/293 (1%)
Query: 1    MSNIVIIGSISMDLVMETNRIAKEGETVFGQRFSMVPGGKGANQAVAIGRLSQERDNITI    60
            M NI +IGS SMDLV+ +++  K GETV G  F  VPGGKGANQAVA  RL +   + +
Sbjct: 1    MRNICVIGSCSMDLVVTSDKRPKAGETVLGTSFQTVPGGKGANQAVAAARLGAQ---VFM   57

Query: 61   LGAIGEDSFGPILLDNLNKNHVTTDFVGTIP-SSSGVAQITLYNNDNRIIYCPGANGKVD   119
            +G +G+D +G  +L+NL  N V TD++  +  + SG A I L   DN I+    GAN  +
Sbjct: 58   VGKVGDDHYGTAILNNLKANGVRTDYMEPVTHTESGTAHIVLAEGDNSIVVVKGANDDIT   117

Query: 120  TKKWSQEWSIIKEADLVVLQNEIPHQANMKIANFCKEHSIKLLYNPAPSRETDIEMLDKV   179
                       I++ D+V++Q EIP +   ++  +C  H I ++ NPAP+R    E +D
Sbjct: 118  PAYALNALEQIEKVDMVLIQQEIPEETVDEVCKYCHSHDIPIILNPAPARPLKQETIDHA   177

Query: 180  DYFTPNEHECQELFPNQKLEDILATYPEKLIVTLGTKGAIYSDGKESHLIPALETKAVDT   239
             Y TPNEHE    LFP  + + LA YP KL +T G +G  YS G +  LIP+   + VDT
Sbjct: 178  TYLTPNEHEASILFPELTISEALALYPAKLFITEGKQGVRYSAGSKEVLIPSFPVEPVDT   237

Query: 240  TGAGDTFNGAFGYAISKKFKIAKALRFATLAAHLSVQKFGAQGGMPTIKEMED         292
            TGAGDTFN AF  A+++   I  ALRFA  AA LSV  FGAQGGMPT  E+E+
Sbjct: 238  TGAGDTFNAAFAVALAEGKDIEAALRFANRAASLSVCSFGAQGGMPTRNEVEE         290
```

No corresponding DNA sequence was identified in *S. pyogenes*.

Based on this analysis, it was predicted that this protein and its epitopes, could be useful antigens for vaccines or diagnostics.

Example 2098

A DNA sequence (GBSx2213) was identified in *S. agalactiae* <SEQ ID 6489> which encodes the amino acid sequence <SEQ ID 6490>. Analysis of this protein sequence reveals the following:

Possible site: 31
>>> Seems to have no N-terminal signal sequence
----- Final Results -----
   bacterial cytoplasm --- Certainty = 0.2272 (Affirmative) <succ>
   bacterial membrane --- Certainty = 0.0000 (Not Clear) <succ>
      bacterial outside --- Certainty = 0.0000 (Not Clear) <succ>

A related GBS nucleic acid sequence <SEQ ID 9477> which encodes amino acid sequence <SEQ ID 9478> was also identified.

The protein has homology with the following sequences in the GENPEPT database.

```
>GP:CAB15608 GB:Z99122 transcriptional regulator (LacI family)
[Bacillus subtilis]
Identities = 141/327 (43%), Positives = 204/327 (62%), Gaps = 4/327 (1%)
Query: 13   MSTIRQVAEKAGVSTSTVSRYISQNGYVSQKASQKIEQAIRELHYVPNFLAQSLKTKKNQ   72
            M+TI+  VA   AGVS +TVSR ++ NGYV ++      ++ A+ +L+Y PN +A+SL  ++++
Sbjct: 1    MATIKDVAGAAGVSVATVSRNLNDNGYVHEETRTRVIAAMAKLNYYPNEVARSLYKRESR   60

Query: 73   LVGLLLPDISNPFFPRLARGVEEFLKEQGYRVMLGNTNNKSHLEEEYLNVLLQSNAAGII   132
            L+GLLLPDI+NPFFP+LARG E+ L  +GYR++ GN+++ +  E EYL    Q++ AGII
Sbjct: 61   LIGLLLPDITNPFFPQLARGAEDELNREGYRLIFGNSDEELKKELEYLQTFKQNHVAGII   120

Query: 133  --TTHDFTKNHPEIDIPVVVVDRVNQETQYGVFSDNKEGGKLAAQAIWTAGATNILLIRG   190
                T  +    ++ ++ PVV +DR    E   V SD    G KLAAQAI   + I L+RG
Sbjct: 121  AATNYPDLEEYSGMNYPVVFLDR-TLEGAPSVSSDGYTGVKLAAQAIIHGKSQRITLLRG   179
```

```
-continued
Query:  191  PLDKADNLNQRFQGSQNYLLNKGACFAIEDSASFDFAEIQIEAKTLLDHHPDIDSIIAPS  250
             P         RF G+     L        F +  ++ASF     + Q    AK L    +P  D +IA +
Sbjct:  180  PA-HLPTAQDRFNGALEILKQAEVDFQVIETASFSIKDAQSMAKELFASYPATDGVIASN  238

Query:  251  DIHAIAYLHEILNRGKRIPEDVQIIGYDDILMSQFIYPSLSTIHQSSYIMGQKAAELIFK  310
             DI A A LHE L RGK +PED+QIIGYDDI   S  ++P LSTI Q +Y MG++AA+L+
Sbjct:  239  DIQAAAVLHEALRRGKNVPEDIQIIGYDDIPQSGLLFPPLSTIKQPAYDMGKEAAKLLLG  298

Query:  311  ITNQLPITNKRIKLPVHYVERETLRRK                                  337
             I   + P+      I++PV Y+ R+T R++
Sbjct:  299  IIKKQPLAETAIQMPVTYIGRKTTRKE                                  325
```

A related DNA sequence was identified in *S. pyogenes* <SEQ ID 6491> which encodes the amino acid sequence <SEQ ID 6492>. Analysis of this protein sequence reveals the following:

---

Possible site: 35
>>> Seems to have no N-terminal signal sequence
----- Final Results -----
  bacterial cytoplasm --- Certainty = 0.1657 (Affirmative) <succ>
    bacterial membrane --- Certainty = 0.0000 (Not Clear) <succ>
      bacterial outside --- Certainty = 0.0000 (Not Clear) <succ>

---

An alignment of the GAS and GBS proteins is shown below.

```
Identities = 232/328 (70%), Positives = 274/328 (82%)
Query:   10  GVSMSTIRQVAEKAGVSTSTVSRYISQNGYVSQKASQKIEQAIRELHYVPNFLAQSLKTK   69
             G +M TI+QVAE+AGVS STVSRYISQ GYVS  A   KI+ AI +LHY PN LAQSLKTK
Sbjct:   14  GKAMVTIKQVAEEEAGVSRSTVSRYISQKGYVSDDARHKIKAAIAKLHYTPNVLAQSLKTK   73

Query:   70  KNQLVGLLLPDISNPFFPRLARGVEEFLKEQGYRVMLGNTNNKSHLEEEYLNVLLQSNAA  129
             KNQLVGLLLPDISNPFFPRLARG EE+LKE+GYRVMLGN ++    LEEEY++VLLQSNAA
Sbjct:   74  KNQLVGLLLPDISNPFFPRLARGAEEYLKEKGYRVMLGNISDSEALEEEYVHVLLQSNAA  133

Query:  130  GIITTHDFTKNHPEIDIPVVVVDRVNQETQYGVFSDNKEGGKLAAQAIWTAGATNILLIR  189
             GIITTHDFTK +P + IPVVVVDRV+QETQYGVFSDN+ GG LAAQ +W AGA   +LLIR
Sbjct:  134  GIITTHDFTKRYPTLAIPVVVVDRVDQETQYGVFSDNRAGGLLAAQTVWQAGAKEVLLIR  193

Query:  190  GPLDKADNLNQRFQGSQNYLLNKGACFAIEDSASFDFAEIQIEAKTLLDHHPDIDSIIAP  249
             GPLD A+N+N+RF+ S +YL  +      + DS +FDF  IQ+EA    L  +P IDSIIAP
Sbjct:  194  GPLDNAENINERFEASFSYLQKQDVTMYVCDSQNFDFESIQLEASYNLKCYPTIDSIIAP  253

Query:  250  SDIHAIAYLHEILNRGKRIPEDVQIIGYDDILMSQFIYPSLSTIHQSSYIMGQKAAELIF  309
             SDIHAIAY+HE+ ++GK+IP+DVQIIGYDDILMSQFIYPSLSTIHQSSY+MG+ AAEL++
Sbjct:  254  SDIHAIAYIHELHSQGKKIPQDVQIIGYDDILMSQFIYPSLSTIHQSSYLMGRYAAELVY  313

Query:  310  KITNQLPITNKRIKLPVHYVERETLRRK                                 337
              I +QL +    RIKLPVHYVERET+R++
Sbjct:  314  TIASQLTVKANRIKLPVHYVERETIRKR                                 341
```

Based on this analysis, it was predicted that this protein and its epitopes, could be useful antigens for vaccines or diagnostics.

Example 2099

A DNA sequence (GBSx2214) was identified in *S. agalactiae* <SEQ ID 6493> which encodes the amino acid sequence <SEQ ID 6494>. Analysis of this protein sequence reveals the following:

---

Possible site: 57
>>> Seems to have no N-terminal signal sequence
INTEGRAL    Likelihood = −13.80   Transmembrane 27-43 (24-51)
INTEGRAL    Likelihood = −10.61   Transmembrane 337-353 (329-362)
INTEGRAL    Likelihood = −9.18    Transmembrane 257-273 (249-276)
INTEGRAL    Likelihood = −8.92    Transmembrane 302-318 (291-326)
----- Final Results -----
  bacterialmembrane --- Certainty = 0.6519 (Affirmative) <succ>
    bacterialoutside --- Certainty = 0.0000 (Not Clear) <succ>
      bacterial cytoplasm ---Certainty = 0.0000 (Not Clear) <succ>

---

A related GBS nucleic acid sequence <SEQ ID 8979> which encodes amino acid sequence <SEQ ID 8980> was also identified. Analysis of this protein sequence reveals the following:

---

Lipop Possible site: −1   Crend: 6
SRCFLG: 0
McG: Length of UR: 4
Peak Value of UR: 3.20
Net Charge of CR: 1
McG: Discrim Score: 6.06
GvH: Signal Score (−7.5): 0.0500002
Possible site: 46
>>> Seems to have a cleavable N-term signal seq.
Amino Acid Composition: calculated from 47
ALOM program count: 3 value: −10.61 threshold: 0.0
  INTEGRAL    Likelihood = −10.61   Transmembrane 326-342 (318-348)
  INTEGRAL    Likelihood = −9.18    Transmembrane 246-262 (238-265)
  INTEGRAL    Likelihood = −8.92    Transmembrane 291-307 (280-315)
  PERIPHERAL  Likelihood = 4.98     152
modified ALOM score: 2.62
icml HYPID: 7CFP: 0.525
*** Reasoning Step: 3

-continued

----- Final Results -----
  bacterial membrane --- Certainty = 0.5246 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the GENPEPT database.

```
>GP:AAF12525 GB:AE001863 hypothetical protein [Deinococcus radiodurans]
Identities = 103/352 (29%), Positives = 191/352 (54%), Gaps = 9/352 (2%)
Query:  15   AWKELTFYKKKYLLIELLIIVMMFMVVFLSGLANGLGRAVSAAIENNPAQTYILNEGAEQ    74
             A +EL    K + LLI  ++ ++ FMV  L+GL  GL R  ++ + + PAQ+++  + A+
Sbjct:   4   ALRELQHQKLRSLLIGGIVALIAFMVFMLTGLTRGLSRDSASLLLDTPAQSFVTTKEADG    63

Query:  75   VITSSVLTTKDQTDLNSLNLKDSTTLNIQRSSLTRQGHEKKIDISYFAIDKDSFMAPTLS   134
             V+   S L+ +    +++L  +         ++ ++    +K++        +D   F+AP +S
Sbjct:  64   VLNRSFLSPEQ---VSALQQDNEDAAAFAQTFVSFSHGDKQLSGVLLGVDPRGFLAPDVS   120

Query: 135   EGKQLTSYKKAIILNDSLKAEGIKLGDKVIDKSSSISLTVVGFVHNSMYGHGPVAFIDKD   194
             EG+  L      A++ ++SL+ +G+K+GD +   K S    L V GF ++    H P ++
Sbjct: 121   EGQTLRVAGGAVV-DESLREDGVKVGDVLTLKPSGDQLRVSGFTRSARLNHQPGMYVSLA   179

Query: 195   IYTEINKKINPQYQFLPQALVMKNDKSISHLP-TQLEAVSKKDVIQHIPGYSAEQSTLNM   253
                + +K+NP+     A+ +  +  +L     L   ++   +Q +PGY  EQ +L M
Sbjct: 180   RW----QKLNPRMHGTVNAVALPAAPAQVNLGGADLSVTNRAQTLQVLPGYKEEQGSLTM   235

Query: 254   ILWVLVVASAGILGVFFYIITLQKRHEFSVMKAIGTKMSEIALFQLSQVIILALFGIIVG   313
             I    L+  +A +L   FFY++TLQK  +F ++KAIG       +A   ++Q++IL L  +  +
Sbjct: 236   IQVFLIAVAAFVLATFFYVMTLQKTAQFGLLKAIGASNRTLAGSVVAQMLILTLLAVAIA   295

Query: 314   DGLAVALSYVLPAQMPFVINWQNIILVSFVFLVIAMISSALSIVKVAKIDPV   365
              + + +   +LPA MPF +    NI    S + LV+A ++S LS+ +VAK+DP+
Sbjct: 296   AAVTLGMVQLLPAGMPFHLTAANIASASGLLLVVAALASLLSVRRVAKVDPL   347
```

A related DNA sequence was identified in *S. pyogenes* <SEQ ID 6495> which encodes the amino acid sequence <SEQ ID 6496>. Analysis of this protein sequence reveals the following:

```
Possible site: 58
>>> Seems to have a cleavable N-term signal seq.
INTEGRAL    Likelihood = -12.31   Transmembrane 246-262 (233-270)
INTEGRAL    Likelihood =  -8.49   Transmembrane 327-343 (321-351)
INTEGRAL    Likelihood =  -1.01   Transmembrane 301-317 (301-317)
----- Final Results -----
  bacterial membrane --- Certainty = 0.5925 (Affirmative) <succ>
    bacterial outside --- Certainty = 0.0000 (Not Clear) <succ>
      bacterial cytoplasm --- Certainty = 0.0000 (Not Clear) <succ>
```

The protein has homology with the following sequences in the databases:

```
>GP:AAF12525 GB:AE001863 hypothetical protein [Deinococcus radiodurans]
Identities = 101/360 (28%), Positives = 175/360 (48%), Gaps = 11/360 (3%)
Query:   1   MFLALNEMKQSKLRYGLIAGLLCLVAYLMFFLSGLAFGLMQENRSAVDLWKADSVLLAKD    60
             M+LAL E++  KLR  LI G++  L+A+++F L+GL   GL  +++ S  +     A S +    K+
Sbjct:   1   MYLALRELQHQKLRSLLIGGIVALIAFMVFMLTGLTRGLSRDSASLLLDTPAQSFVTTKE    60

Query:  61   ADATLTLSQVSRAQENQITADKVAPLAQLNTVAWSVKNPKDADKVKVSLFGIDSNSFIRP   120
             AD   L  S +S Q + +   D     A T      K     V     L G+D    F+  P
Sbjct:  61   ADGVLNRSFLSPEQVSALQQDNEDAAAFAQTFVSFSHGDKQLSGV---LLGVDPRGFLAP   117

Query: 121   NIVKGRLFKTNKEVVLDQSLAKEEAFAIGKDFYTSSSSQALTIVGYTQNARFSVAPVVYM   180
             ++  +G+ +    V+D+SL +E+     +G     S    L + G+T++AR +   P +Y+
Sbjct: 118   DVSEGQTLRVAGGAVVDESL-REDGVKVGDVLTLKPSGDQLRVSGFTRSARLNHQPGMYV   176

Query: 181   NLEAFETLKYGEPLPKDKQVVNAFITKGS--LTDYPKKDFQKLDIKTFITKLPGYSAQLL   238
             +L  ++ L        P+     VNA +         +          D        +    LPGY    +
Sbjct: 177   SLARWQKLN-----PRMHGTVNAVALPAAPAQVNLGGADLSVTNRAQTLQVLPGYKEEQG   231

Query: 239   TFGFMISFLVIISAIIIGIFMYILTIQKAPIFGIMKAQGISNKTITTAVLMQTFFLSFLG   298
             +     +   FL+ ++A ++    F  Y++T+QK    FG++KA G SN+T+    +V+ Q     L+ L
```

-continued

```
Sbjct: 232  SLTMIQVFLIAVAAFVLATFFYVMTLQKTAQFGLLKAIGASNRTLAGSVVAQMLILTLLA  291

Query: 299  SGLGLLGTWLTSLLLPTVVPFQSNWFLYLAIFVSMICFALLGTLFSVFNIIRIDPLKAIG  358
                 +    T    LLP +PF        +   ++  A L +L SV  + ++DPL A+G Sbjct: 292  VAIAAAVTLGMVQLLPAGMPFHLTAANIASASGLLLVVAALASLLSVRRVAKVDPLIALG  351
```

An alignment of the GAS and GBS proteins is shown below.[10]

```
Identities = 96/356 (26%), Positives = 178/356 (49%), Gaps = 4/356 (1%)
Query:  15  AWKELTFYKKKYLLIELLIIVMMFMVVFLSGLANGLGRAVSAAIENNPAQTYILNEGAEQ   74
            A  E+    K +Y LI  L+ ++ +++ FLSGLA GL +    +A++   A + +L + A+
Sbjct:   4  ALNEMKQSKLRYGLIAGLLCLVAYLMFFLSGLAFGLMQENRSAVDLWKADSVLLAKDADA   63

Query:  75  VITSSVLTTKDQTDLNSLNLKDSTTLNIQRSSLTRQGHEKKIDISYFAIDKDSFMAPTLS  134
            +T S ++    +  + +       LN    S+         K+ +S F ID +SF+ P +
Sbjct:  64  TLTLSQVSRAQENQITADKVAPLAQLNTVAWSVKNPKDADKVKVSLFGIDSNSFIRPNIV  123

Query: 135  EGKQLTSYKKAIILNDSLKAEGIKLGDKVIDKSSSISLTVVGFVHNSMYGHGPVAFIDKD  194
            +G+   + K+ ++     K E  +G        SSS +LT+VG+  N+ +    PV +++ +
Sbjct: 124  KGRLFKTNKEVVLDQSLAKEEAFAIGKDFYTSSSSQALTIVGYTQNARFSVAPVVYMNLE  183

Query: 195  IYTEIN-KKINPQYQFLPQALVMKNDKSISHLPTQ-LEAVSKKDVIQHIPGYSAEQSTLN  252
             +  +   +   P+ + +  A + K   S++  P +  + +  K I    +PGYSA+   T
Sbjct: 184  AFETLKYGEPLPKDKQVVNAFITKG--SLTDYPKKDFQKLDIKTFITKLPGYSAQLLTFG  241

Query: 253  MILWVLVVASAGILGVFFYIITLQKRHEFSVMKAIGTKMSEIALFQLSQVIILALFGIIV  312
               ++  LV+ SA I+G+F YI+T+QK    F +MKA G     I L    Q  L+  G  +
Sbjct: 242  FMISFLVIISAIIIGIFMYILTIQKAPIFGIMKAQGISNKTITTAVLMQTFFLSFLGSGL  301

Query: 313  GDGLAVALSYVLPAQMPFVINWQNIILVSFVFLVIAMISSALSIVKVAKIDPVEVI     368
            G        S +LP  +PF  NW  + +     + A++ +  S+  +  +IDP++ I
Sbjct: 302  GLLGTWLTSLLLPTVVPFQSNWFLYLAIFVSMICFALLGTLFSVFNIIRIDPLKAI     357
```

SEQ ID 8980 (GBS239) was expressed in *E. coli* as a GST-fusion product. SDS-PAGE analysis of total cell extract is shown in FIG. 175 (lane 13; MW 64 kDa).

GBS239-GST was purified as shown in FIG. 227, lane 4.

Based on this analysis, it was predicted that this protein and its epitopes, could be useful antigens for vaccines or diagnostics.

Example 2100

A DNA sequence (GBSx2215) was identified in *S. agalactiae* <SEQ ID 6497> which encodes the amino acid sequence <SEQ ID 6498>. This protein is predicted to be heterocyst maturation protein (devA) (b0879). Analysis of this protein sequence reveals the following:

Possible site: 33

>>> Seems to have no N-terminal signal sequence

----- Final Results ----- bacterial cytoplasm --- Certainty = 0.1751 (Affirmative) <succ> bacterial membrane --- Certainty = 0.0000 (Not Clear) <succ> bacterial outside --- Certainty = 0.0000 (Not Clear) <succ>

The protein has homology with the following sequences in the GENPEPT database.

```
>GP:CAA05977 GB:AJ7003195 ATP-binding subunit [Anabaena variabilis]
Identities = 87/225 (38%), Positives = 146/225 (64%), Gaps = 1/225 (0%)
Query:   3  AILELKHISKHYPDGDELLSILDNLDLSVSAGEFVAILGPSGSGKSTLLSIAGLLLGADQ   62
            A++ +K ++ +Y  G     IL +++L +  GE V + GPSGSGK+TLLS+ G L     +
Sbjct:   5  AVIAIKSLNHYYGKGALKRQILFDINLEIYPGEIVIMTGPSGSGKTTLLSLIGGLRSVQE   64

Query:  63  GSLYVNHENVTDLSQRQRTQLRREALGFIFQSHQLLPYLTIQEQLQQEARFAKHYDKKTS  122
            G+L        ++   SQ +    Q+RR ++G+IFQ+H LL  +LT ++  +Q      +H  ++ +
Sbjct:  65  GNLQFLGVELSGASQNKLVQIRR-SIGYIFQAHNLLGFLTARQNVQMAVELNEHISQEEA  123

Query: 123  LEEINKLLSDLGIEQCAHKYPNQLSGGQKQRAAIARAFINHPKVILADEPTASLDEERGR  182
             +  +    +L  +G+E      YP+  LSGGQKQR  AIARA +N+P  ++LADEPTA+LD++ GR
Sbjct: 124  IAKAEAMLKAVGLENRVDYYPDNLSGGQKQRVAIARALVNNPPLVLADEPTAALDKQSGR  183

Query: 183  QVTELIRQEVKSHNTAAIMVTHDERVLDLVDTVYRLKDGKLVKEN               227
             V E++++  K     T+ ++VTHD R+LD+ D  +  ++DG L +++
Sbjct: 184  DVVEIMQRLAKDQGTSILLVTHDNRILDIADRIVEMEDGILARDS               228
```

A related DNA sequence was identified in *S. pyogenes* <SEQ ID 6499> which encodes the amino acid sequence <SEQ ID 6500>. Analysis of this protein sequence reveals the following:

```
Possible site: 13
>>> Seems to have no N-terminal signal sequence
----- Final Results -----
   bacterial cytoplasm --- Certainty = 0.4181 (Affirmative) <succ>
      bacterial membrane --- Certainty = 0.0000 (Not Clear) <succ>
         bacterial outside --- Certainty = 0.0000 (Not Clear) <succ>
```

An alignment of the GAS and GBS proteins is shown below.

```
Identities = 103/224 (45%), Positives = 149/224 (65%), Gaps = 4/224 (1%)
Query:   3 AILELKHISKHYPDGDELLSILDNLDLSVSAGEFVAILGPSGSGKSTLLSIAGLLLGADQ   62
           ++L  K ++K + DG    ++ L   D S+ AGEFVAI+GPSGSGKST L+IAG L
Sbjct:   3 SVLTFKQVTKTFQDGHHEINALKATDFSIEAGEFVAIIGPSGSGKSTFLTIAGGLQTPSS   62

Query:  63 GSLYVNHENVTDLSQRQRTQLRREALGFIFQSHQLLPYLTIQEQLQQEARFAKHYDKKTS  122
            G L ++  + T LS+++R++LR +++GFI Q+  L+P+ T+Q+QL+         H
Sbjct:  63 GQLIIDGTDYTHLSEKERSRLRFKSVGFILQASNLIPFSTVQQQLE----LVDHLTGSKE  118

Query: 123 LEEINKLLSDLGIEQCAHKYPNQLSGGQKQRAAIARAFINHPKVILADEPTASLDEERGR  182
             + N+L  DLGI     H+ P +LSGG++QRAAIARA  +   P +ILADEPTASLD E+
Sbjct: 119 KAKANQLFDDLGITGLKHQLPQELSGGERQRAAIARALYHDPALILADEPTASLDTEKAY  178

Query: 183 QVTELIRQEVKSHNTAAIMVTHDERVLDLVDTVYRLKDGKLVKE                 226
           +V +L+ +E K  N A IMVTHD+R+L   D VYR++DG+L +E
Sbjct: 179 EVVKLLAKESKEKNKAIIMVTHDDRMLKYCDKVYRMQDGELCQE                 222
```

Based on this analysis, it was predicted that this protein and its epitopes, could be useful antigens for vaccines or diagnostics.

Example 2101

A DNA sequence (GBSx2216) was identified in *S. agalactiae* <SEQ ID 6501> which encodes the amino acid sequence <SEQ ID 6502>. Analysis of this protein sequence reveals the following:

```
Possible site: 34
>>> Seems to have no N-terminal signal sequence
----- Final Results -----
   bacterial cytoplasm --- Certainty = 0.2645 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database.

```
>GP:CAB64972 GB:AJ012050 VicR protein [Enterococcus faecalis]
Identities = 86/229 (37%), Positives = 132/229 (57%), Gaps = 10/229 (4%)
Query:   3 KILVVEDNIVQQKIITTKLTQEGYQFITASNGQEALNCLDTEEVQLIITDIMMPMMDGYQ   62
           KILVV+D     +I+   L +EGY+  TA +G+EAL  ++   E   LII D+M+P MDG +
Sbjct:  52 KILVVDDEKPISEIVKYNLVKEGYEVFTAYDGEEALEKVEEVEPDLIILDLMLPKMDGLE  111

Query:  63 LIQELRSAAYNVPIIVMTAKSQMEDMTKGFGLGADDYMVKPVQLQELALRIKALLRR---  119
            + +E+R     +++PII++TAK     D     G  LGADDY+ KP    +EL  R+KA LRR
Sbjct: 112 VAREVRK-THDMPIIMVTAKDSEIDKVLGLELGADDYVTKPFSNRELVARVKANLRRGAT  170

Query: 120 ----ANIVAQHQLIIGNTCLNEDELSLKYFEQEIIFPQKEFRVLFHLLSYPNRIFTRLEL  175
               A +  Q +L IG+  ++ D   +     ++I       +EF +L+++L +  ++ TR L
Sbjct: 171 NAKEAEVTTQSELTIGDLTIHPDAYMVSKRGEKIELTHREFELLYYLAKHIGQVMTREHL  230

Query: 176 LDSIWGMDTDLDERVVDACINKIRRKVEHLPDFK--IETVRGVGYRAKN             222
           L ++WG D   D R VD   + ++R K+E  P     + T RGVGY  +N
Sbjct: 231 LQTVWGYDYFGDVRTVDVTVRRLREKIEDSPSHPTYLVTRRGVGYYLRN             279
```

There is also homology to SEQ ID 1182.

Based on this analysis, it was predicted that this protein and its epitopes, could be useful antigens for vaccines or diagnostics.

Example 2102

A DNA sequence (GBSx2217) was identified in *S. agalactiae* <SEQ ID 6503> which encodes the amino acid sequence <SEQ ID 6504>. This protein is predicted to be sensor protein. Analysis of this protein sequence reveals the following:

```
Possible site: 38
>>> Seems to have a cleavable N-term signal seq.
INTEGRAL    Likelihood = -8.97    Transmembrane    53-69 (47-77)
----- Final Results -----
    bacterial membrane --- Certainty = 0.4588 (Affirmative) <succ>
    bacterial outside --- Certainty = 0.0000 (Not Clear) <succ>
      bacterial cytoplasm --- Certainty = 0.0000 (Not Clear) <succ>
```

The protein has homology with the following sequences in the GENPEPT database.

```
>GP:AAC62214 GB:AF049873 sensor protein [Lactococcus lactis]
Identities = 97/307 (31%), Positives = 169/307 (54%), Gaps = 16/307 (5%)
Query:  57 SALAVVFLSLVIASISMWYGSYHLTKPILDISHIVSNVADGDFEGHIYRNSNRRKSYEYY  116
           + LAV+  +L++ + S++Y +  +T+P+L I     +A GD   + N+
Sbjct: 170 AVLAVI--TLIVTAFSIFYITRTVTRPLLKIKLGTDKIAQGDLSIQLNVNTE--------  219

Query: 117 NELDELSESINQMIVSLSHMDHMRKDFITNVSHELKTPIAAVANIVELLQDPELDEETQS  176
           +EL EL++SI  +   L  M   R +F+++V+HEL+TP+  +    ++       E ++
Sbjct: 220 DELGELAKSIEDLAEKLDFMKRERNEFLSSVAHELRTPLTFIKGYADIANRSTTSLEDKT  279

Query: 177 ELLGLVKTESLRLTRLCDTMLQMSRVDNQETIGELSSVRVDEQIRQAMISLTERWQAKRI  236
           + L +++ ES  LT+L + ++ +++++       E   V + E I + +   ++ + KRI
Sbjct: 280 QYLRIIREESRHLTQLMEDLMNLAQLEENGFKVEKHQVLIQELINEVVSKVSGVFSEKRI  339

Query: 237 NFQLDSKPYTVYSNSDLLM--QVWINLLDNAIKYSEDIVDLSVRMEETNNHYLRVIISDK  294
           NF L S      Y+N D +    QV +NLL NA KYS D   D+ +       ++ +++ISDK
Sbjct: 340 NF-LISGEGNFYANIDFMRIEQVLVNLLMNAYKYSADESDIKLAFIPEKENF-KIVISDK  397

Query: 295 GRGISQYDVQHIFDKFYQADQSHNQQ--GNGLGLAIVKRIIVLCKGRISVSSQLEIGTEF  352
           G GI + D+ +IF++FY+ D+S  +   G GLGLAIV+ I+     G+I V S     GT F
Sbjct: 398 GEGIPEQDLPYIFERFYRVDKSRTRTTGGVGLGLAIVQDIVKKHNGKIIVESIQNQGTTF  457

Query: 353 CVELPLS  359
           +ELP S
Sbjct: 458 IIELPYS  464
```

Based on this analysis, it was predicted that this protein and its epitopes, could be useful antigens for vaccines or diagnostics.

A related GBS gene <SEQ ID 8981> and protein <SEQ ID 8982> were also identified. Analysis of this protein sequence reveals the following:

```
Lipop: Possible site: -1    Crend: 10
McG: Discrim Score: 4.84
GvH: Signal Score (-7.5): 0.179999
Possible site: 35
>>> Seems to have a cleavable N-term signal seq.
ALOM program count: 1 value: -8.97    threshold: 0.0
INTEGRAL        Likelihood = -8.97    Transmembrane 50-66 (47-77)
PERIPHERAL      Likelihood = 1.27     324
modified ALOM score: 2.29
*** Reasoning Step: 3
----- Final Results -----
    bacterial membrane --- Certainty = 0.4588 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the databases:

```
31.9/57.3% over 293aa
Lactococcus lactis
GP|3687664| sensor protein Insert characterized
ORF01881(478-1377 of 1677)
GP|3687664|gb|AAC62214.1||AF049873(171-464 of 464) sensor protein {Lactococcus lactis}
% Match = 12.9
% Identity = 31.9 % Similarity = 57.3
Matches = 94 Mismatches = 121 Conservative Sub.s = 75

339       369       399       429       459       489       519       549
          MTKLRRFRFPLRFYFTLMFVLTMLFSVLASLLLVAAIVFTFFQGVLTTHVLQVSALAVVFLSLVIASISMWYGSYHLTKP
          |  ::    :  : :        |          ::     : ::         :      : ::|:: | :   :|:|
          EKKNKKESLHFHWLGDKYIVSKSRIQSNGKIVGSVYMFLSTRPIQKMVFNFTGIFAVLAVITLIVTAFSIFYITRTVTRP
                    130       140       150       160       170       180       190
```

-continued

```
           579       609       639       669       699       729       759       789
           ILDISHIVSNVADGDFEGHIYRNSNRRKSYEYYNELDELSESINQMIVSLSHMDHMRKDFITNVSHELKTPIAAVANIVE
           :|  |       :| |||:   ::    |:           :|| ||::||    :     |    |   :|:::|:|||:||:   :       :
           LLKIKLGTDKIAQGDLSIQLNVTE--------DELGELAKSIEDLAEKLDFMKRERNEFLSSVAHELRTPLTFIKGYAD
                     210              220       230       240       250       260

819       849       879       909       939       969       999      1029
           LLQDPELDEETQSELLGLVKTESLRLTRLCDTMLQMSRVDNQETIGELSSVRVDEQIRQAMISLTERWQAKRINFQLDSK
           :          |  |:::   ||   ||:|   : ::  :::::            |     |     |        :    |||| | |
           IANRSTTSLEDKTQYLRIIREESRHLTQLMEDLMNLAQLEENGFKVEKHQVLIQELINEVVSKVSGVFSEKRINF-LISG
                     280       290       300       310       320       330       340

1059      1083      1113      1143      1173      1203      1233
           PYTVYSNSDLL--MQVWINLLDNAIKYSEDIVDLSVRMEETNNHYLRVIISDKGRGISQYDVQHIFDKFYQADQSHNQQ-
           |:|  |::     ||  :|||  ||  |||   |   |::          :: :::||||| ||   |:  ::||::||: |:|   :
           EGNFYANIDFMRIEQVLVNLLMNAYKYSADESDIKLAFIPEKENF-KIVISDKGEGIPEQDLPYIFERFYRVDKSRTRTT
                     360       370       380       390       400       410       420

1287      1317      1347      1377      1407      1437      1467      1497
           -GNGLGLAIVKRIIVLCKGRISVSSQLEIGTEFCVELPLS*LFKTITANWQLLFYLFRNKYTKNRQKL*KYLTINIASV*
            |  ||||||||:  |:           |:|  |  |         ||  |   :|||  |
           GGVGLGLAIVQDIVKKHNGKIIVESIQNQGTTFIIELPYS
                     440       450       460
```

Figure 123:
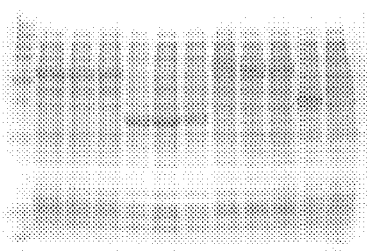
Figure 181:

SEQ ID 8982 (GBS170d) was expressed in *E. coli* as a His-fusion product. SDS-PAGE analysis of total cell extract is shown in FIG. 181 (lane 4; MW 35 kDa) and in FIG. 123 (lane 5-7; MW 35 kDa). It was also expressed in *E. coli* as a GST-fusion product. SDS-PAGE analysis of total cell extract is shown in FIG. 123 (lane 2-4; MW 60 kDa) and in FIG. 184 (lane 3; MW 60 kDa). Purified GBS170d-GST is shown in FIG. 243, lane 7; purified GBS170d-His is shown in FIG. 234, lanes 5-6.

Example 2103

A DNA sequence (GBSx2218) was identified in *S. agalactiae* <SEQ ID 6505> which encodes the amino acid sequence <SEQ ID 6506>. Analysis of this protein sequence reveals the following:

Possible site: 21
>>> Seems to have no N-terminal signal sequence
----- Final Results -----
  bacterial cytoplasm --- Certainty = 0.0502 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:BAB06906 GB:AP001518 argininosuccinate synthase
(citrulline-asparate ligase) [Bacillus halodurans]
Identities = 262/396 (66%), Positives = 321/396 (80%), Gaps = 1/396 (0%)
Query:   1 MGKEKLILAYSGGLDTSVAIAWLK-KDYDVIAVCMDVGEGKDLDFIHDKALTIGAIESYI   59
           M K+K++ LAYSGGLDTSVAI WL  K YDVIAV +DVGEGKDL+F+  +KAL +GAIESY
Sbjct:   1 MSKKKVVLAYSGGLDTSVAIKWLSDKGYDVIAVGLDVGEGKDLEFVKEKALKVGAIESYT   60

Query:  60 LDVKDEFAEHFVLPALQAHAMYEQKYPLVSALSRPIIAQKLVEMAHQTGATTIAHGCTGK  119
           +D K  EFAE FVLPALQAHA+YEQKYPLVSALSRP+I++KLVE+A QTGA +AHGCTGK
Sbjct:  61 IDAKKEFAEEFVLPALQAHALYEQKYPLVSALSRPLISKELVEIAEQTGAQAVAHGCTGK  120

Query: 120 GNDQVRFEVAIAALDPELKVIAPVREWKWHREEEITFAKANGVPIPADLDNPYSIDQNLW  179
           GNDQVRFEV+I AL+P L+V APVREW W R+EEI +AK N +PIP DLDNPYS+DQNLW
Sbjct: 121 GNDQVRFEVSIQALNPNLEVLAPVREWAWSRDEEIEYAKKNNIPIPIDLDNPYSVDQNLW  180

Query: 180 GRANECGVLENPWNQAPEEAFGITKSPEEAPDCAEYIDITFQNGKPIAINNQEMTLADLI  239
           GR+NECG+LE+PW   PE A+ +T + E+APD  E ++I F+ G P+ +N +   + +LI
Sbjct: 181 GRSNECGILEDPWATPPEGAYELTVAIEDAPDQPEIVEIGFEKGIPVTLNGKSYPVHELI  240

Query: 240 LSLNEIAGKHGIGRIDHVENRLVGIKSREIYECPAAMVLLAAHKEIEDLTLVREVSHFKP  299
           L LN+IAGKHG+GRIDHVENRLVGIKSRE+YECP AM L+ AHKE+EDLTL +EV+HFKP
Sbjct: 241 LELNQIAGKHGVGRIDHVENRLVGIKSREVYECPGAMTLIKAHKELEDLTLTKEVAHFKP  300

Query: 300 ILENELSNLIYNALWFSPATKAIIAYVKETQKVVNGTTKVKLYKGSAQVVARHSSNSLYD  359
           ++E +++ +LIY  LWFSP   A+  A++KETQ  V G  +VKL+KG+A V   R S   SLY+
Sbjct: 301 VVEKKIAELIYEGLWFSPLQPALSAFLKETQSTVTGVVRVKLFKGHAIVEGRKSEYSLYN  360

Query: 360 ENLATYTAADSFDQDAAVGFIKLWGLPTQVNAQVNK                         395
           E LATYT  D FD +AAVGFI LWGLPT+V + VNK
Sbjct: 361 EKLATYTPDDEFDHNAAVGFISLWGLPTKVYSMVNK                         396
```

No corresponding DNA sequence was identified in *S. pyogenes*.

Based on this analysis, it was predicted that this protein and its epitopes, could be useful antigens for vaccines or diagnostics.

Example 2104

A DNA sequence (GBSx2219) was identified in *S. agalactiae* <SEQ ID 6507> which encodes the amino acid sequence <SEQ ID 6508>. This protein is predicted to be argininosuccinate lyase (argH). Analysis of this protein sequence reveals the following:

Possible site: 43
>>> Seems to have no N-terminal signal sequence
----- Final Results -----
    bacterial cytoplasm --- Certainty = 0.2131 (Affirmative) <succ>
      bacterial membrane --- Certainty = 0.0000 (Not Clear) <succ>
        bacterial outside --- Certainty = 0.0000 (Not Clear) <succ>

The protein has homology with the following sequences in the GENPEPT database.

```
>GP:BAB06905 GB:AP001518 argininosuccinate lyase [Bacillus halodurans]
Identities = 284/454 (62%), Positives = 350/454 (76%)

Query:   6  KLWGGRFESSLEKWVEEFGASISFDQKLAPYDMKASMAHVTMLGKTDIISQEEAGLIKDG   65
            KLWGGRF  + E WV+EFGASI FDQ+L   D++ S+AHVTML K+ I++ EE    IK G
Sbjct:   3  KLWGGRFTKTAEAWVDEFGASIGFDQQLVEEDIEGSLAHVTMLEKSGILANEEVEQIKKG   62

Query:  66  LKILQDKYRAGQLTFSISNEDIHMNIESLLTAEIGEVAGKLHTARSRNDQVATDMHLYLK  125
            L IL +K + G+L +S++NEDIH+NIE LL  EIG V GKLHT RSRNDQVATDMHLYL+
Sbjct:  63  LHILLEKAKKGELNYSVANEDIHLNIEKLLIDEIGPVGGKLHTGRSRNDQVATDMHLYLR  122

Query: 126  DKLQEMMKELLHLRTTLVNLAENHIYTVMPGYTHLQHAQPISFGHHLMAYYNMFTRDTER  185
             + +E+++ + +++  LV  A+ H+ T++PGYTHLQ AQPISF HHL+AY+ M  RD  R
Sbjct: 123  KQTKEILQLVKNVQAALVEQAKQHVETLIPGYTHLQRAQPISFAHHLLAYFWMLERDYGR  182

Query: 186  LEFNMKHTNLSPLGAAALAGTTFPIDRHMTTRLLDFEKPYSNSLDAVSDRDFIIEFLSNA  245
             E ++K  N+SPLGA ALAGTTFPIDR  T  LL F+  Y NSLDAVSDRDFI+EFLS +
Sbjct: 183  YEDSLKRLNVSPLGAGALAGTTFPIDREYTAELLGFDGIYENSLDAVSDRDFIVEFLSAS  242

Query: 246  SILMMHLSRFCEEIINWCSYEYQFITLSDTFSTGSSIMPQKKNPDMAELIRGKTGRVYGN  305
            S+LM HLSR CEE+I W S E+QF+ + D F+TGSSIMPQKKNPDMAELIRGKTGRVYG+
Sbjct: 243  SLLMTHLSRLCEELILWSSQEFQFVEMDDAFATGSSIMPQKKNPDMAELIRGKTGRVYGS  302

Query: 306  LFSLLTVMKSLPLAYNKDLQEDKEGMFDSVETVSIAIEIMANMLETMTVNEHIMMTSTET  365
            LFSLLTV+K LPLAYNKD+QEDKEGMFD+V+TV  ++ I A M++TM V E  M    +
Sbjct: 303  LFSLLTVLKGLPLAYNKDMQEDKEGMFDAVKTVKGSLAIFAGMIQTMKVKEETMTKAVHQ  362

Query: 366  DFSNATELADYLASKGVPFRKAHEIVGKLVLECSKNGSYLQDIPLKYYQEISELIENDIY  425
            DFSNATELADYLA+KG+P FR+AHE+VGKLVL C + G YL D+PL   Y+  S+L + DIY
Sbjct: 363  DFSNATELADYLATKGMPFREAHEVVGKLVLLCIQKGIYLLDLPLSDYKAASDLEDEDIY  422

Query: 426  EILTAKTAVKRRNSLGGTGFDQVKKQILLARKEL                           459
            ++L  KT V RR S GGTGF +VKK I  A K L
Sbjct: 423  DVLQPKTVVARRTSAGGTGFTEVKKAIAKAEKIL                           456
```

Based on this analysis, it was predicted that this protein and its epitopes, could be useful antigens for vaccines or diagnostics.

Example 2105

A DNA sequence (GBSx2220) was identified in *S. agalactiae* <SEQ ID 6509> which encodes the amino acid sequence <SEQ ID 6510>. This protein is predicted to be class-II aldolase (fba). Analysis of this protein sequence reveals the following:

Possible site: 42
>>> Seems to have no N-terminal signal sequence
----- Final Results -----
    bacterial cytoplasm --- Certainty = 0.2930 (Affirmative) <succ>
      bacterial membrane --- Certainty = 0.0000 (Not Clear) <succ>
        bacterial outside --- Certainty = 0.0000 (Not Clear) <succ>

A related GBS nucleic acid sequence <SEQ ID 9289> which encodes amino acid sequence <SEQ ID 9290> was also identified. Analysis of this sequence reveals:

GvH: Signal Score (-7.5):   -2.92
Possible site: 42
>>> Seems to have no N-terminal signal seq.
ALOM program      count: 0    value: 0.37    threshold: 0.0
PERIPHERAL        Likelihood = 0.37           66
modified ALOM score: -0.57
*** Reasoning Step: 3
----- Final Results -----
    bacterial cytoplasm --- Certainty = 0.2930 (Affirmative) <succ>

-continued bacterial membrane --- Certainty = 0.0000 (Not Clear) <succ>
        bacterial outside --- Certainty = 0.0000 (Not Clear) <succ>

The protein has homology with the following sequences in the GENPEPT database.

```
>GP:BAB16889 GB:AB050113 class-II aldolase [Streptococcus bovis]
Identities = 221/242 (91%), Positives = 234/242 (96%)
Query:   1  MAIVSAEKFVQAARDNGYAVGGFNTNNLEWTQAILRAAEAKKAPVLIQTSMGAAKYMGGY   60
            MAIVSAEKF++AAR+NGYAVGGFNTNNLEWTQAILRAAEAKKAP+LIQTSMGAAKYMGGY
Sbjct:   1  MAIVSAEKFIKAARENGYAVGGFNTNNLEWTQAILRAAEAKKAPILIQTSMGAAKYMGGY   60

Query:  61  KLCKQLIETLVESMGITVPVAIHLDHGHYDDALECIEVGYTSIMFDGSHLPVEENLEKAR  120
            KLCK LIE LVESMGITVPVAIHLDHGH++DALECIEVGYTS+MFDGSHLPVEENLEKA+
Sbjct:  61  KLCKTLIENLVESMGITVPVAIHLDHGHFEDALECIEVGYTSVMFDGSHLPVEENLEKAK  120

Query: 121  EVVAKAHAKGISVEAEVGTIGGEEDGIVGKGELAPIEDAKAMVETGIDFLAAGIGNIHGP  180
            EVVAKAHAKG+SVEAEVGTIGGEEDGIVG GELAPIEDAKAMV TGIDFLAAGIGNIHGP
Sbjct: 121  EVVAKAHAKGVSVEAEVGTIGGEEDGIVGGGELAPIEDAKAMVATGIDFLAAGIGNIHGP  180

Query: 181  YPANWEGLDLDHLKKLTEAVPGFPIVLHGGSGIPDDQIQEAIKLGVAICVNVNTECQLAFC  240
            YPANW+GL LDHLKKLT AVPGFPIVLHGGSGIPDDQI+ AIKLGVAICVNVNTECQ+AF
Sbjct: 181  YPANWQGLHLDHLKKLTAAVPGFPIVLHGGSGIPDDQIKAAIKLGVAICVNVNTECQIAFA  240

Query: 241  QA                                                             242
            +A
Sbjct: 243  KA                                                             242
```

A related DNA sequence was identified in *S. pyogenes* <SEQ ID 6511> which encodes the amino acid sequence <SEQ ID 6512>. Analysis of this protein sequence reveals the following:

---

Possible site: 42
>>> Seems to have no N-terminal signal sequence
----- Final Results -----
   bacterial cytoplasm --- Certainty = 0.2930 (Affirmative) <succ>
    bacterial membrane --- Certainty = 0.0000 (Not Clear) <succ>
     bacterial outside --- Certainty = 0.0000 (Not Clear) <succ>

---

An alignment of the GAS and GBS proteins is shown below.

```
Identities = 217/242 (89%), Positives = 228/242 (93%)
Query:   1  MAIVSAEKFVQAARDNGYAVGGFMTNNLEWTQAILRAAEAKKAPVLIQTSMGAAKYMGGY   60
            MAIVSAEKFVQAAR+NGYAVGGFMTNNLEWTQAILRAAEAK+APVLIQTSMGAAKYMGGY
Sbjct:   1  MAIVSAEKFVQAARENGYAVGGFMTNNLEWTQAILRAAEAKQAPVLIQTSMGAAKYMGGY   60

Query:  61  KLCKQLIETLVESMGITVPVAIHLDHGHYDDALECIEVGYTSIMFDGSHLPVEENLEKAR  120
            K+C+ LI  LVESMGITVPVAIHLDHGHY+DALECIEVGYTSIMFDGSHLPVEENL K
Sbjct:  61  KVCQSLITNLVESMGITVPVAIHLDHGHYEDALECIEVGYTSIMFDGSHLPVEENLAKTA  120

Query: 121  EVVAKAHAKGISVEAEVGTIGGEEDGIVGKGELAPIEDAKAMVETGIDFLAAGIGNIHGP  180
            EVV  AHAKG+SVEAEVGTIGGEEDGI+GKGELAPIEDAKAMVETGIDFLAAGIGNIHGP
Sbjct: 121  EVVKIAHAKGVSVEAEVGTIGGEEDGIIGKGELAPIEDAKAMVETGIDFLAAGIGNIHGP  180

Query: 181  YPANWEGLDLDHLKKLTEAVPGFPIVLHGGSGIPDDQIQEAIKLGVAKVNVNTECQLAFC  240
            YP NWEGL LDHL+KLT AVPGFPIVLHGGSGIPDDQI+EAI+LGVAKVNVNTE Q+AF
Sbjct: 181  YPENWEGLALDHLEKLTAAVPGFPIVLHGGSGIPDDQIKEAIRLGVAKVNVNTESQIAFS  240

Query: 241  QA                                                             242
             A
Sbjct: 241  NA                                                             242
```

SEQ ID 9290 (GBS683) was expressed in *E. coli* as a GST-fusion product. SDS-PAGE analysis of total cell extract is shown in FIG. 150 (lane 8 & 10; MW 55 kDa). It was also expressed in *E. coli* as a His-fusion product. SDS-PAGE analysis of total cell extract is shown in FIG. 150 (lane 11-13; MW 30 kDa) and in FIG. 184 (lane 11; MW 30 kDa).

Based on this analysis, it was predicted that this protein and its epitopes, could be useful antigens for vaccines or diagnostics.

Example 2106

A DNA sequence (GBSx2221) was identified in *S. agalactiae* <SEQ ID 6513> which encodes the amino acid sequence <SEQ ID 6514>. Analysis of this protein sequence reveals the following:

---

Possible site: 22
>>> Seems to have no N-terminal signal sequence
----- Final Results -----

-continued bacterial cytoplasm --- Certainty = 0.2775 (Affirmative) <succ>
    bacterial membrane --- Certainty = 0.0000 (Not Clear) <succ>
     bacterial outside --- Certainty = 0.0000 (Not Clear) <succ>

---

The protein has homology with the following sequences in the GENPEPT database.

```
>GP:AAA88585 GB:M18954 unknown protein [Streptococcus mutans]
Identities = 109/229 (47%), Positives . 156/229 (67%), Gaps = 1/229 (0%)
Query:   1  MFSGKRLKKRRITLGYSQSELADKLHINRSSYFNWENEKTKPNQSNLKQLAILLDVPETY   60
            MFS ++LK+RR  LG SQ++ ADKL I+R SYFNWE  KTKPNQ NL +LA LL V   Y
Sbjct:   1  MFSSQKLKERRKKLGLSQAQTADKLGISRPSYFNWEIGKTKPNQKNLDKLAHLLKVDSAY   60
```

```
Query:  61  FESEYKIVNTYLQLSLQNQEKVEKYAEELLQTQKVHEKIVPLFAVEVLSEIQLSAGPGEG  120
            F S++ IV  Y +L+  N+ K  KY++ LL+ Q        ++          +LSAG G
Sbjct:  61  FLSQHDIVEIYTRLNESNKTKTLKYSQHLLEQQDKKRNLMKNKRYPYRVYEKLSAGTGYS  120

Query: 121  LYDEFETETVYSEDEYTGFDIATWISGNSMEPVYKDGEVALIRSTGFDHDGAVYALNWNG  180
            + +   +TV+ ++E    D A+WI G+SMEP++ +GEVALI+ TGFD+DGA+YA++W+G
Sbjct: 121  YFGDGNFDTVFYDEEID-HDFASWIFGDSMEPIFLNGEVALIKQTGFDYDGAIYAIDWDG  179

Query: 181  SLYIKKLYREEDGFRMVSINPDVAERFIPFEDEIRIVGKIVGHFMPVIG             229
               YIKK+YREE G R+VS+N   A++F P+++  RI+G IVG+F+P+ G
Sbjct: 180  QTYIKKVYREETGLRLVSLNKKYADKFAPYDENPRIIGLIVGNFIPLEG             228
```

A related DNA sequence was identified in *S. pyogenes* <SEQ ID 6515> which encodes the amino acid sequence <SEQ ID 6516>. Analysis of this protein sequence reveals the following:

---

Possible site: 38
>>> Seems to have no N-terminal signal sequence
----- Final Results -----
   bacterial cytoplasm --- Certainty = 0.4340 (Affirmative) <succ>
      bacterial membrane --- Certainty = 0.0000 (Not Clear) <succ>
         bacterial outside --- Certainty = 0.0000 (Not Clear) <succ>

---

An alignment of the GAS and GBS proteins is shown below.

```
Identities = 84/209 (40%), Positives = 130/209 (62%), Gaps = 9/209 (4%)
Query:  25  LHINRSSYFNWENEKTKPNQSNLKQLAILLDVPETYFESEYKIVNTYLQLSLQNQEKVEK   84
            LH+N+ +  NWE  K  PN+ +L   L  L +V   YF+  Y+++   Y QL++ N+EKV
Sbjct:   5  LHVNKMTISNWEKGKNIPNEKHLNALLHLFNVTSDYFDPNYRLLTPYNQLTISNKEKVIG   64

Query:  85  YAEELLQTQ------KVHEKIVPLFAVEVLSEIQLSAGPGEGLYDEFETETVYSEDEYTG  138
            Y+E LL  Q        +K    L+A V      LSAG G  +  +   + V+  DE
Sbjct:  65  YSERLLNHQIDKKSKDLIDKPSQLYAYRVYES--LSAGTGYSYFGDGNFDVVFY-DEQLE  121

Query: 139  FDIATWISGNSMEPVYKDGEVALIRSTGFDHDGAVYALNWNGSLYIKKLYREEDGFRMVS  198
            +D A+W+ G+SMEP Y +GEV LI+    FD+DGA+YA+ W+G  YIKK++RE++G R+VS
Sbjct: 122  YDFASWVFGDSMEPTYLNGEVVLIKQNSFDYDGAIYAVEWDGQTYIKKVFREDEGLRLVS  181

Query: 199  INPDVAERFIPFEDEIRIVGKIVGHFMPV                                227
            +N    +++F P+ +E RI+GKI+ +F P+
Sbjct: 182  LNKKYSDKFAPYSEEPRIIGKIIANFRPL                                210
```

Based on this analysis, it was predicted that this protein and its epitopes, could be useful antigens for vaccines or diagnostics.

Example 2107

A DNA sequence (GBSx2222) was identified in *S. agalactiae* <SEQ ID 6517> which encodes the amino acid sequence <SEQ ID 6518>. Analysis of this protein sequence reveals the following:

---

Possible site: 41
>>> Seems to have no N-terminal signal sequence
----- Final Results -----
   bacterial cytoplasm --- Certainty = 0.2387 (Affirmative) <succ>
      bacterial membrane --- Certainty = 0.0000 (Not Clear) <succ>
         bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2108

A DNA sequence (GBSx2223) was identified in *S. agalactiae* <SEQ ID 6519> which encodes the amino acid sequence <SEQ ID 6520>. This protein is predicted to be UmuC MucB homolog (uvrX). Analysis of this protein sequence reveals the following:

---

Possible site: 47
>>> Seems to have no N-terminal signal sequence
----- Final Results -----
   bacterial cytoplasm --- Certainty = 0.2195 (Affirmative) <succ>
      bacterial membrane --- Certainty = 0.0000 (Not Clear) <succ>
         bacterial outside --- Certainty = 0.0000 (Not Clear) <succ>

---

A related GBS nucleic acid sequence <SEQ ID 9925> which encodes amino acid sequence <SEQ ID 9926> was also identified.

The protein has homology with the following sequences in the GENPEPT database.

```
>GP:AAC98439 GB:L29324 UmuC MucB homolog [Streptococcus pneumoniae]
Identities = 303/436 (69%), Positives = 360/436 (82%)
Query:  39 LHTSLCVMSRADNSAGLILASSPMFKKVEGKGNVGRAYDLPFDVHTRKFNYYRAKISGLP   98
              L   LCVMSRADNSAGLILASSPMFKKVFGK NVGR+YDLPFDV TRKF+YY AK  GLP
Sbjct:   5 LRLRLCVMSRADNSAGLILASSPMFKKVFGKSNVGRSYDLPFDVKTRKFSYYNAKKQGLP   64

Query:  99 TDAKFVSFIENWAKRTFIVPPRMDLYIQKNLEIQKVFQNYADPTDILPYSIDEGFIDLTS  158
              T   +V +IE WAK T IVP      L I  N+EIQK+FQ++A P DI PYSIDEGFIDLTS
Sbjct:  65 TTIDYVRYIEEWAKSTVIVPREWILTIAVNMEIQKIFQDFAAPDDIYPYSIDEGFIDLTS  124

Query: 159 SLNYFVEDKSLSRKDKLDVVSAKIQHDIWEKTGVYSTVGMSNANPLLAKLALDNEAKTTA  218
              SLNYFV DKS+SRKDKLD++SA IQ   IW KTG+YSTVGMSNANPLLAKLALDNEAK T
Sbjct: 125 SLNYFVPDKSISRKDKLDIISAAIQKKIWRKTGIYSTVGMSNANPLLAKLALDNEAKKTP  184

Query: 219 TMRANWSYEDVETKVWNIPKMTDFWGIGSRTEKRLNKLGIYSIKELANCDPTILKKEFGV  278
              TMRANWSYEDVE KVW IPKMTDFWGIG+R EKRL+ LGI+SIKELA  +P ++KKE G+
Sbjct: 185 TMRANWSYEDVEKKVWTIPKMTDFWGIGNRMEKRLHNLGIFSIKELAQANPDLIKKELGI  244

Query: 279 IGVQHWFHANGIDESNVHEPYRPKAVGIGNSQVLHKDYTRQSDIELVLREMAEQVAIRLR  338
              +G++ WFHANGIDESNVH+PY+PK+ GIGNSQVL KDY +Q DIE++LREMAEQVA+RLR
Sbjct: 245 MGLELWFHANGIDESNVHKPYKPKSKGIGNSQVLPKDYIKQRDIEIILREMAEQVAVRLR  304

Query: 339 RRHKKATVVAINVGYSNFENKKSINVQRKINPNNRTLVFQDEVVSLFRSKYDGGAVRSIA  398
              R  KKATVV+I++GYS  E K+SIN Q KI P N+T +  + V+ LF +KY  GA+R++A
Sbjct: 305 RSGKKATVVSIHLGYSKVEQKRSINTQMKIEPTNQTALLTNYVLKLFHTKYTSGAIRNVA  364

Query: 399 VRYDGLVDENFAVISLFDDFEESEKEEKLETTIDSIRDRFGFLAVQKASSLLENSRAISR  458
              V Y GLVDE+F +ISLFDD E+ EKEE+L++ ID+IR  FGF ++ K ++L + SR I+R
Sbjct: 365 VNYSGLVDESEGLISLFDDIEKIEKEERLQSAIDAIRTEFGETSLLKGNALDQASRTIAR  424

Query: 459 SRLVGGHSAGGLEGLK                                              474
              S+L+GGHSAGGL+GLK
Sbjct: 425 SKLIGGHSAGGLDGLK                                              440
```

Based on this analysis, it was predicted that this protein and its epitopes, could be useful antigens for vaccines or diagnostics.

Example 2109

A DNA sequence (GBSx2224) was identified in *S. agalactiae* <SEQ ID 6521> which encodes the amino acid sequence <SEQ ID 6522>. Analysis of this protein sequence reveals the following:

```
Possible site: 45
>>> Seems to have no N-terminal signal sequence
----- Final Results -----
   bacterial cytoplasm --- Certainty = 0.4016 (Affirmative) <succ>
     bacterial membrane --- Certainty = 0.0000 (Not Clear) <succ>
       bacterial outside --- Certainty = 0.0000 (Not Clear) <succ>
```

The protein has no significant homology with any sequences in the GENPEPT database.

No corresponding DNA sequence was identified in *S. pyogenes*.

Example 2110

A DNA sequence (GBSx2225) was identified in *S. agalactiae* <SEQ ID 6523> which encodes the amino acid sequence <SEQ ID 6524>. Analysis of this protein sequence reveals the following:

```
Possible site: 32
>>> Seems to have no N-terminal signal sequence
----- Final Results -----
   bacterial cytoplasm --- Certainty = 0.2088 (Affirmative) <succ>
     bacterial membrane --- Certainty = 0.0000 (Not Clear) <succ>
       bacterial outside --- Certainty = 0.0000 (Not Clear) <succ>
```

The protein has homology with the following sequences in the GENPEPT database.

```
>GP:AAG13001 GB:AF227520 unknown [Streptococcus pneumoniae]

Identities = 68/122 (55%), Positives = 89/122 (72%), Gaps = 6/122 (4%)

Query:   1 MIDRSYLPFKVAREYQDRKMAKWMGFFLSEHTAGLDSELNKVDYTSELSISDKLLLLNQL   60
             MIDRSYLPF+ AREYQD KM KWMGFFLSEHT+ L  + NKV Y S+LS+  KLLLL+Q+
Sbjct:   1 MIDRSYLPFQSAREYQDTKMQKWMGFFLSEHTSALTDDANKVTYMSDLSLEKKLLLLSQV   60

Query:  61 YSNQLNGIIAVPGQ----YYSGKVDNLTFNHVSLKTKTGFVSIPIKDILSIDL--EVEYE  114
             Y+ QLN  I V +       Y+G + +LT + +  +KT TG ++++ KDI+SI+L   EV YE
Sbjct:  61 YAGQLNTRIHVVKKNNQVSYTGTIPSLTKDFILIKTTTGHINLKLKDIVSIELVEEVLYE  120

Query: 115 SA                                                            116
             SA
Sbjct: 121 SA                                                            122
```

Example 2111

A DNA sequence (GBSx2226) was identified in *S. agalactiae* <SEQ ID 6525> which encodes the amino acid sequence <SEQ ID 6526>. Analysis of this protein sequence reveals the following:

---

Possible site: 48
>>> Seems to have no N-terminal signal sequence
----- Final Results -----
   bacterial cytoplasm --- Certainty = 0.4025 (Affirmative) <succ>
     bacterial membrane --- Certainty = 0.0000 (Not Clear) <succ>
       bacterial outside --- Certainty = 0.0000 (Not Clear) <succ>

---

A related GBS nucleic acid sequence <SEQ ID 9927> which encodes amino acid sequence <SEQ ID 9928> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2112

A DNA sequence (GBSx2227) was identified in *S. agalactiae* <SEQ ID 6527> which encodes the amino acid sequence <SEQ ID 6528>. This protein is predicted to be soluble transducer HtrXIII. Analysis of this protein sequence reveals the following:

---

Possible site: 56
>>> Seems to have no N-terminal signal sequence
----- Final Results -----
   bacterial cytoplasm --- Certainty = 0.5246 (Affirmative) <succ>
     bacterial membrane --- Certainty = 0.0000 (Not Clear) <succ>
       bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2113

A DNA sequence (GBSx2228) was identified in *S. agalactiae* <SEQ ID 6529> which encodes the amino acid sequence <SEQ ID 6530>. Analysis of this protein sequence reveals the following:

---

Possible site: 60
>>> Seems to have no N-terminal signal sequence
----- Final Results -----
   bacterial cytoplasm --- Certainty = 0.5131 (Affirmative) <succ>
     bacterial membrane --- Certainty = 0.0000 (Not Clear) <succ>
       bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2114

A DNA sequence (GBSx2229) was identified in *S. agalactiae* <SEQ ID 6531> which encodes the amino acid sequence <SEQ ID 6532>. This protein is predicted to be pXO2-78. Analysis of this protein sequence reveals the following:

---

Possible site: 43
>>> Seems to have no N-terminal signal sequence
----- Final Results -----
   bacterial cytoplasm --- Certainty = 0.2105 (Affirmative) <succ>
     bacterial membrane --- Certainty = 0.0000 (Not Clear) <succ>
       bacterial outside --- Certainty = 0.0000 (Not Clear) <succ>

---

The protein has homology with the following sequences in the GENPEPT database.

```
>GP:AAF13682 GB:AF188935 pXO2-78 [Bacillus anthracis]
Identities = 101/314 (32%), Positives = 147/314 (46%), Gaps = 46/314 (14%)
Query:  27 SGGQIYEHPDHDSFRIFADTNTFKWFSRDIQGDVIDFVQLVAGVSFKKALSYLETG--GFE  84
            S +Y    +HDS  I    N F W SR + G++I FVQ V    SF  A+  L  G    +E
Sbjct:  39 SERYYRLTEHDSLIIDRKKNQFYWNSRGVNGNIIKFVQEVEDASFPGAMQRLLDGEQDYE  98

Query:  85 EAKVIEETYQPFQYYLREEP----FQQARTYLKDIRGLSNQTINSFGRQGLLAQATYQAE 140
            +A  I    +P+ Y   E+      F +AR YL + R +  Q +++    +GL+ Q  Y
Sbjct:  99 KASEITFVSEPYDYEHFEQKEVSRFDRAREYLIEERKIDPQVVDALHNKGLIKQDKYN--  156

Query: 141 SVLVFKSFDHNGTLQAASLQGLVKNEEKYDRGYLKKIMKGSHGHVGISFDIGNPKRLIFC 200
            +VL       G  +    S QG+VK++ KY RG  K I K S  +G  G P+ L F
Sbjct: 157 NVLFLWKDRETGAVMGGSEQGVVKSD-KYKRGAWKSIQKNSTANYGFNVLNGEPRNLKFY 215

Query: 201 ESVIDMMSYYQLHQKQLSDVRLISMEGLKLSVIAYQTLRLAAEEQGKLAFLDTVKPIRLS 260
            ES ID++SY  LH+  L D  LISMEGLK  VI                          +
Sbjct: 216 ESDIDLLSYATLHKHNLKDTHLISMEGLKPQVI----------------------FN   250
```

```
Query: 261  HYLQAIQETTTFFQTHSNVITMAVDNDEAGREFYQKL-------SDKGFPIFQ-DLPPLQ  312
            +Y++A +         + +++ VDND+AG+ F ++L       +D     F+ + P
Sbjct: 251  YYMKACERIGDV----PDSLSLCVDNDKAGKAFVERLIHFRYEKNDGSIVAFKPEYPQAP  306

Query: 313  RLETKSDWNDIVKR                                                326
                 E K DWND  KR
Sbjct: 307  SEEKKWDWNDECKR                                                320
```

No corresponding DNA sequence was identified in S. pyogenes.

Based on this analysis, it was predicted that this protein and its epitopes, could be useful antigens for vaccines or diagnostics.

Example 2115

A DNA sequence (GBSx2230) was identified in S. agalactiae <SEQ ID 6533> which encodes the amino acid sequence <SEQ ID 6534>. Analysis of this protein sequence reveals the following:

Possible site: 20
>>> Seems to have no N-terminal signal sequence
----- Final Results -----
   bacterial cytoplasm --- Certainty = 0.7013 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 2116

A DNA sequence (GBSx2231) was identified in S. agalactiae <SEQ ID 6535> which encodes the amino acid sequence <SEQ ID 6536>. Analysis of this protein sequence reveals the following:

Possible site: 48
>>> Seems to have no N-terminal signal sequence
----- Final Results -----
   bacterial cytoplasm --- Certainty = 0.1310 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 2117

A DNA sequence (GBSx2232) was identified in S. agalactiae <SEQ ID 6537> which encodes the amino acid sequence <SEQ ID 6538>. Analysis of this protein sequence reveals the following:

Possible site: 31
>>> Seems to have no N-terminal signal sequence
----- Final Results -----
   bacterial cytoplasm --- Certainty = 0.6726 (Affirmative) <succ>
   bacterial membrane --- Certainty = 0.0000 (Not Clear) <succ>
   bacterial outside --- Certainty = 0.0000 (Not Clear) <succ>

A related GBS nucleic acid sequence <SEQ ID 9373> which encodes amino acid sequence <SEQ ID 9374> was also identified.

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

Example 2118

A DNA sequence (GBSx2233) was identified in S. agalactiae <SEQ ID 6539> which encodes the amino acid sequence <SEQ ID 6540>. This protein is predicted to be phosphoglucomutase (manB). Analysis of this protein sequence reveals the following:

Possible site: 38
>>> Seems to have no N-terminal signal sequence
----- Final Results -----
   bacterial cytoplasm --- Certainty = 0.2147 (Affirmative) <succ>
   bacterial membrane --- Certainty = 0.0000 (Not Clear) <succ>
   bacterial outside --- Certainty = 0.0000 (Not Clear) <succ>

A related GBS nucleic acid sequence <SEQ ID 9355> which encodes amino acid sequence <SEQ ID 9356> was also identified.

The protein has homology with the following sequences in the GENPEPT database.

```
>GP: CAB96418 GB: AJ243290 phosphoglucomutase [Streptococcus thermophilus]
   Identities = 391/465 (84%), Positives = 424/465 (91%), Gaps = 1/465 (0%)
   Query:   1  MAQHGIKSYVFEALRPTPELSFAVRHLNAYAGIMVTASHNPAPENGYKVYGQDGGQLPPA    60
               +A HGIKSYVFE+LRPTPELSFAVRHL+ +AGIM+TASHNPAPFNGYKVYG+DGGQ+PPA
   Sbjct: 107  LAAHGIKSYVFESLRPTPELSFAVRHLHTFAGIMITASHNPAPFNGYKVYGEDGGQMPPA   166

Query:  61  DADALTDFIRAIENPFAVELADLDESKSSGLIQVIGEDVDIEYLREVKDVNINQDLINNF   120
```

```
                 DADALTD+IRAI+NPF V+LADL++SK+SGLI++IGE+VD EYL+EVKDVNINQDLIN +
Sbjct: 167       DADALTDYIRAIDNPFTVKLADLEDSKASGLIEIIGENVDAEYLKEVKDVNINQDLINEY        226

Query: 121       GKDMKIVYTPLHGTGEMLIRRALAQAGFESVVVVESQAKADPDFSTVKSPNPESQAAFAL        180
                 G+DMKIVYT LHGTGEML RRALAQAGF++V VVE+QA   DF TVKSPNPE+Q AFAL
Sbjct: 227       GRDMKIVYTSLHGTGEMLVRRALAQAGFDAVQVVEAQAVPHADFLTVKSPNPENQDAFAL        286

Query: 181       AEELGREVDADVLVATDPDADRLGVEIRQPDGSYKNLSGNQIGAIIAKYILEAHKTAGIL        240
                 AEELGR VDADVLVATDPDADRLGVEIRQPDGSY NLSGNQIGAIIAKYILEAHKTAGTL
Sbjct: 287       AEELGRNVDADVLVATDPDADRLGVEIRQPDGSYLNLSGNQIGAIIAKYILEAHKTAGIL        346

Query: 241       PENAALAKSIVSTELVTKIAESYGATMFNVLTGFKFIAEKIQEFEEKHNHTYMFGFEESF        300
                 P  NAAL KSIVSTELVTKIAESYGATMFNVLTGFKFI EKI EFE +HN+TYMFGFEESF
Sbjct: 347       PANAALCKSIVSTELVTKIAESYGATMFNVLTGFKFIGEKIHEFETQHNYTYMFGFEESF        406

Query: 301       GYLIKPFVRDKDAIQAVLLVAEIAAYYRSRGLTLADGIDEIYKEYGYFAEKTISVTLSGV        360
                 GYLIKPFVRDKDAIQAVL+VAEIAAYYRSRG+TLADGI+EIYK+YGYF+EKTISVTLSGV
Sbjct: 407       GYLIKPFVRDKDAIQAVLIVAEIAAYYRSRGMTLADGIEEIYKQYGYFSEKTISVTLSGV        466

Query: 361       DGAAEIKKIMDKFRENGPKQFNNTDIVLLEDFQKQTATKNDGTISNLTIPPSNVLKYTLA        420
                 DGAAEIKKIMDKFR N PKQFNNTDI   EDF +QTAT  DG +  LTTPPSNVLKY LA
Sbjct: 467       DGAAEIKKIMDKFRRNAPKQFNNTDIAKTEDFLEQTATTADG-VEKLTTPPSNVLKYILA        525

Query: 421       DDSWIAVRPSGTEPKIKFYIATVGNDLADAETKIANIEKEITTFV                       465
                 DDSW AVRPSGTEPKIKFYIATVG   ADA+ KIANIE EI   FV
Sbjct: 526       DDSWFAVRPSGTEPKIKFYIATVGETEADAKEKIANIEAEINAFV                       570
```

There is also homology to SEQ ID 6156:

```
Query:   1       MAQHGIKSYVFEALRPTPELSFAVRHLNAYAGIMVTASHNPAPFNGYKVYGQDGGQLPPA         60
                 +AQHGIKSYVFEALRPTPELSFAVRELNAYAGIMVTASHNPAPENGYKVYGQDGGQLPPA
Sbjct: 107       LAQHGIKSYVFEALRPTPELSFAVRHLNAYAGIMVTASHNPAPENGYKVYGQDGGQLPPA        166

Query:  61       DADALTDFIRAIENPFAVELADLDESKSSGLIQVIGEDVDIEYLREVKDVNINQDLINNF        120
                 DADALTDFIRAIENPFAVELADLDE+KSSGLIQVIGEDVD+EYLREVKDVNINQDLINNF
Sbjct: 167       DADALTDFIRAIENPFAVELADLDENKSSGLIQVIGEDVDMEYLREVKDVNINQDLINNF        226

Query: 121       GKDMKIVYTPLHGTGEMLTRRALAQAGFESVVVVESQAKADPDFSTVKSPNPESQAAFAL        180
                 GKDMKIVYTPLHGTGEMLTRRALAQAGFESVVVVESQAKADPDFSTVKSPNPESQAAFAL
Sbjct: 227       GKDMKIVYTPLHGTGEMLTRRALAQAGFESVVVVESQAKADPDFSTVKSPNPESQAAFAL        286

Query: 181       AEELGREVDADVLVATDPDADRLGVEIRQPDGSYKNLSGNQIGAIIAKYILEAHKTAGTL        240
                 AEELGREV+ADVLVATDPDADRLGVEIRQPDGSYKNLSGNQIGAIIARYILEAHKTAGTL
Sbjct: 287       AEELGREVEADVLVATDPDADRLGVEIRQPDGSYKNLSGNQIGAIIARYILEAHKTAGTL        346

Query: 241       PENAALAKSIVSTELVTKIAESYGATMFNVLTGFKFIAEKIQEFEEKHNHTYMEGFEESF        300
                 PENAALAKSIVSTELVTKIAESYGATM NVLTGFKFIAEKIQEFEEKHNHTYMEGFEESF
Sbjct: 347       PENAALAKSIVSTELVTKIAESYGATMENVLTGFKFIAEKIQEFEEKHNHTYMEGFEESF        406

Query: 301       GYLIKPFVRDKDAIQAVLLVAEIAAYYRSRGLTLADGIDEIYKEYGYFAEKTISVTLSGV        360
                 GYLIKPFVRDKDAIQAVLLVAEIAAYYRSRGLTLADGIDEIYKEYGYFAEKTISVTLSGV
Sbjct: 407       GYLIKPFVRDKDAIQAVLLVAEIAAYYRSRGLTLADGIDEIYKEYGYFAEKTISVTLSGV        466

Query: 361       DGAAEIKKIMDKFRENGPKQFNNTDIVLLEDFQKQTATKNDGTISNLTTPPSNVLKYTLA        420
                 DGAAEIKKIMDKFRENGPKQFNNTDIVLLEDFQKQTATKNDGTISNLTTPPSNVLKYTLA
Sbjct: 467       DGAAEIKKIMDKFRENGPKQFNNTDIVLLEDFQKQTATKNDGTISNLTTPPSNVLKYTLA        526

Query: 421       DDSWIAVRPSGTEPKIKFYIATVGNDLADAETKIANIEKEITTFV                       465
                 DDSWIAVRPSGTEPKIKFYIAT+G+  L A+ KIANIE EI  TFV
Sbjct: 527       DDSWIAVRPSGTEPKIKFYIATIGDTLDIAQEKIANIETEINTFV                       571
```

Based on this analysis, it was predicted that this protein and its epitopes, could be useful antigens for vaccines or diagnostics.

Example 2119

A DNA sequence (GBSx2235) was identified in *S. agalactiae* <SEQ ID 6541> which encodes the amino acid sequence <SEQ ID 6542>. Analysis of this protein sequence reveals the following:

Possible site: 20
>>> Seems to have no N-terminal signal sequence
----- Final Results ----- bacterial cytoplasm --- Certainty = 0.1564 (Affirmative) <succ>
bacterial membrane --- Certainty = 0.0000 (Not Clear) <succ>
bacterial outside --- Certainty = 0.0000 (Not Clear) <succ>

A related GBS nucleic acid sequence <SEQ ID 9905> which encodes amino acid sequence <SEQ ID 9906> was also identified. There is also homology to SEQ ID 32.

Based on this analysis, it was predicted that this protein and its epitopes, could be useful antigens for vaccines or diagnostics.

Example 2120

A DNA sequence (GBSx2236) was identified in *S. agalactiae* <SEQ ID 6543> which encodes the amino acid sequence <SEQ ID 6544>. This protein is predicted to be ABC transporter, ATP-binding protein (msbA). Analysis of this protein sequence reveals the following:

```
Possible site: 48
>>> Seems to have an uncleavable N-term signal seq
INTEGRAL    Likelihood = -9.92    Transmembrane 162-178 (135-184)
INTEGRAL    Likelihood = -7.11    Transmembrane 58-74 (56-78)
INTEGRAL    Likelihood = -6.42    Transmembrane 136-152 (135-161)
INTEGRAL    Likelihood = -5.20    Transmembrane 23-39 (21-49)
INTEGRAL    Likelihood = -1.75    Transmembrane 485-501 (485-501)
----- Final Results -----
    bacterial membrane --- Certainty = 0.4970 (Affirmative) <succ>
    bacterial outside --- Certainty = 0.0000 (Not Clear) <succ>
       bacterial cytoplasm --- Certainty = 0.0000 (Not Clear) <succ>
```

A related DNA sequence was identified in *S. pyogenes* <SEQ ID 6545> which encodes the amino acid sequence <SEQ ID 6546>. Analysis of this protein sequence reveals the following:

```
Possible site: 56
>>> Seems to have an uncleavable N-term signal seq
INTEGRAL    Likelihood = -8.07    Transmembrane 162-178 (159-182)
INTEGRAL    Likelihood = -7.17    Transmembrane 143-159 (137-161)
INTEGRAL    Likelihood = -5.84    Transmembrane 23-39 (19-45)
INTEGRAL    Likelihood = -5.68    Transmembrane 68-84 (60-86)
INTEGRAL    Likelihood = -2.55    Transmembrane 261-277 (256-278)
----- Final Results -----
    bacterial membrane --- Certainty = 0.4227 (Affirmative) <succ>
    bacterial outside --- Certainty = 0.0000 (Not Clear) <succ>
       bacterial cytoplasm --- Certainty = 0.0000 (Not Clear) <succ>
```

The protein has homology with the following sequences in the GENPEPT database.

The protein has homology with the following sequences in the databases:

```
>GP: AAD35376 GB: AE001710 ABC transporter, ATP-binding protein
[Thermotoga maritima]

Identities = 216/552 (39%), Positives = 336/552 (60%), Gaps = 3/552 (0%)

Query:  26  MALLGTVVQVCLTVYLPVLIGQAVDVVLSPHSMILLLPIMWKMIAVILANTIIQWINPLL      85
                M +   L V P LIG+ +DVV  P    LL   M + +   +++ W+    +
Sbjct:  41  MVFVFVTVSSILGVLSPYLIGKTIDVVFVPRREDLLPRYMLILGTIYALTSLLFWLQGKI     100

Query:  86  YNRLIFHYVASLRKAVMEKLNLLPIAYLDKRGIGDLISRVTTDTEQLSNGLLMVFNQFFV     145
                 L   V  LRK + EKL +P+ + D+   GD+ISRV  D + ++N L    QFF
Sbjct: 101  MLTLSQDVVFRLRKELFEKLQRVPVGFFDRTPHGDIISRVINDVDNINNVLGNSIIQFFS     160

Query: 146  GLLTIIVTIFSMAKIDLLMLFLVLFLTPLSLFLARFIAKKSY-HLYQNQTASRGRQTQFI     204
                G++T+   + M ++++++   + L + PL++ +  ++ ++   + Y+NQ    G+     I
Sbjct: 161  GIVTLAGAVIMMFRVNVILSLVTLSIVPLTVLITQIVSSQTRKYFYENQRVL-GQLNGII     219

Query: 205  EEMVSQESLIQAFSAQEESSDHFRTINQEYANFSQSAIFYSSTVNPSTRFINSLIYGFLA     264
                EE +S   ++I+ F+ +E+   F   +N+          A  +S + P    +N+L+ +  ++
Sbjct: 220  EEDISGLTVIKLFTREEKEMEKFDRVNESLRKVGTKAQIFSGVLPPLMNMVNNLGFALIS     279

Query: 265  GIGALRIMSGAFSVGQLITFLNYVNQYTKPENDISSVLSEMQSALACAERLYSILEESSP     324
                G G    +   +VG + TF+  Y  Q+T+P N++S+  + +Q ALA AER++ IL+
Sbjct: 280  GFGGWLALKDIITVGTIATFIGYSRQFTRPLNELSNQFNMIQMALASAERIFEILDLEEE     339

Query: 325  NITGTEKLDSSTVKGQIDFKNVVFGYNKSKLLLNGINLHIPAGAKVAIVGPTGAGKSTLI     384
                     + ++      V+G+I+FKNV F Y+K K +L   I    HI   G  KVA+VGPTG GK+T++
Sbjct: 340  K-DDPDAVELREVRGEIEFKNVWFSYDKKKPVLKDITFHIKPGQKVALVGPTGSGKTTIV     398

Query: 385  NLIMRFYEVDGGNILLDCKPITDYEPSQLRQEIGMVLQETWLKSATIHDNIANANPKASR     444
                NL+MRFY+VD G  IL+D    I    + S LR   IG+VLQ+T L S  T+ +N+ Y NP A+
Sbjct: 399  NLLMRFYDVDRGQILVDGIDIRKIKRSSLRSSIGIVLQDTILFSTTVKENLKYGNPGATD     458

Query: 445  EEVIEAAKAANADFFIKQLPNGYDTYLEDAGDSLSQGQCQLLTIARIFLKLPRILILDEA     504
                EE+ EAAK   +D FIK LP GY+T L D G+ LSQGQ QLL  I R  FL  P+ILILDEA
Sbjct: 459  EEIKEAAKLTHSDHFIKHLPEGYETVLTDNGEDLSQGQRQLLAITRAFLANPKILILDEA     518

Query: 505  TSSIDTRTEVLVQEAFQMLMKGRTSFIIAHRLSTIQTADIILVMVSGEIVEVGNHSELMA     564
                TS++DT TE +Q A   LM+G+TS IIAHRL+TI+  AD+I+V+   GEIVE+G H EL+
Sbjct: 519  TSNVDTKTEKSIQAAMWKLMEGKTSIIIAHRLNTIKNADLIIVLRDGEIVEMGKHDELIQ     578

Query: 565  QKGIYYQMQNAQ                                                  576
                ++G  YY++   +Q
Sbjct: 579  KRGFYYELFTSQ                                                  590
```

```
>GP: AAD35376 GB: AE001710 ABC transporter, ATP-binding protein
[Thermotoga maritima]
Identities = 206/572 (36%), Positives = 342/572 (59%), Gaps = 5/572 (0%)
Query:   2 IKTDHHLLKRVLQDLLKKPLPVCILVIASFVQVG--LSVYLPVLIGKAVDMSLSVNSWQT   59
           +K      L+R+L  L  +P    ++++ FV V   L V  P LIGK +D+      +
Sbjct:  18 LKNPTATLRRLLGYL--RPHTFTLIMVFVFVTVSSILGVLSPYLIGKTIDVVFVPRRFDL   75

Query:  60 LKWLLGQMLVIIVVNTLIQWVMPLVYSRLLYQYSQQLKDKLLEKIHRLPFAYLDRQTIGD  119
           L  + +  I  + +L+ W+  +  L     +L+ +L EK+ R+P + DR   GD
Sbjct:  76 LPRYMLILGTIYALTSLLFWLQGKIMLTLSQDVVFRLRKELFEKLQRVPVGFFDRTPHGD  135

Query: 120 LVSRVITDTEQLINGLQMVFNQFILGLLTILCTIIAMAQIDWLMLILVLVLTPSSLFLAR  179
           ++SRVI D + N L    QF G++T+   +I M +++ ++ LL + P ++ + +
Sbjct: 136 IISRVINDVDNINNVLGNSIIQFFSGIVTLAGAVIMMFRVNVILSLVTLSIVPLTVLITQ  195

Query: 180 FIAQKSFHYAQAQTKSRGNLAQFTEEILRQEGLVQLFNAQEQSICDYHVLNKTYCEASQK  239
           ++ ++  Y     + G L   EE +  +++LF +E+ + + +N++ + K
Sbjct: 196 IVSSQTRKYFYENQRVLGQLNGIIEEDISGLTVIKLFTREEKEMEKFDRVNESLRKVGTK  255

Query: 240 AIFYASTVNPATRFINSVIYALLAGLGAVRIMAGLFSVGQLTTFLNVVVQYTKPFNDISS  299
           A ++ + P  +N++ +AL++G G  +  + +VG + TF+    Q+T+P N++S+
Sbjct: 256 AQIFSGVLPPLMNMVNNLGFALISGFGGWLALKDIITVGTIATFIGYSRQFTRPLNELSN  315

Query: 300 VLAEIQSSLACAQRLYDLLDIEIKEQEHFLTFKASAVKGQIDFEEVSFSYQKDRPLLKDI  359
                IQ +LA A+R++++LD+E +E++    +   V+G+I+F+  V FSY K +P+LKDI
Sbjct: 316 QFNMIQMALASAERIFEILDLE-EEKDDPDAVELREVRGEIEFKNVWFSYDKKKPVLKDI  374

Query: 360 NFSVPAGSKVAIVGPTGAGKSTLINLLMRFYELDAGSIKLDKVPIKCYAKEELRSITGIV  419
            F +  G KVA+VGPTG+GK+T++NLLMRFY++D G I +D + I+    +  LRS  GIV
Sbjct: 375 TFHIKPGQKVALVGPTGSGKTTIVNLLMRFYDVDRGQILVDGIDIRKIKRSSLRSSIGIV  434

Query: 420 LQETWLKDATVHELIAYGSEEASRDEVVAAAKAAHAHFFIMQLPKTYDTYLSASDDALSQ  479
           LQ+T L    TV E + YG+  A+  +E+    AAK  H+    FI   LP+  Y+T L+  + +  LSQ
Sbjct: 435 LQDTILFSTTVKENLKYGNPGATDEEIKEAAKLTHSDHFIKHLPEGYETVLTDNGEDLSQ  494

Query: 480 GQLQLLAIARMFLKKPKVLVLDEATSSIDIRTEAVIQEALKELMRGRTSFIIAHRLSTIQ  539
           GQ QLLAI R FL  PK+L+LDEATS++D +TE  IQ A+ +LM G+TS IIAHRL+TI+
Sbjct: 495 GQRQLLAITRAFLANPKILILDEATSNVDTKTEKSIQAAMWKLMEGKTSIIIAHRLNTIK  554

Query: 540 SADLILVMDQGRLVEWGTHASLMSKNGCYVRL                              571
           +ADLI+V+  G +VE G H  L+ K G Y  L
Sbjct: 555 NADLIIVLRDGEIVEMGKHDELIQKRGFYYEL                              586
```

An alignment of the GAS and GBS proteins is shown below.

```
Identities = 340/566 (60%), Positives = 433/566 (76%)
Query:  11 KKLVQDLLSKKSLVGMALLGTVVQVCLTVYLPVLIGQAVDVVLSPHSMILLLPIMWKMIA   70
           K+++QDLL K  +V + + + VQV L+VYLPVLIG+AVD + LS +S    L  ++ +M+
Sbjct:  10 KRVLQDLLKKPLPVCILVIASFVQVGLSVYLPVLIGKAVDMSLSVNSWQTLKWLLGQMLV   69

Query:  71 VILANTIIQWINPLLYNRLIFHYVASLRKAVMEKLNLLPIAYLDKRGIGDLISRVTTDTE  130
           +I+  NT+IQW+  PL+Y+RL++ Y    L+     ++EK+ LP  AYLD++  IGDL+SRV TDTE
Sbjct:  70 IIVVNTLIQWVMPLVYSRLLYQYSQQLKDKLLEKIHRLPFAYLDRQTIGDLVSRVITDTE  129

Query: 131 QLSNGLLMVFNQFFVGLLTIIVTIFSMAKIDLLMLFLVLFLTPLSLFLARFIAKKSYHLY  190
           QL NGL MVFNQF +GLLTI+  TI +MA+ID LML LVL  LTP SLFLARFIA+KS+H Y
Sbjct: 130 QLINGLQMVFNQFILGLLTIIAMAQIDWLMLILVLVLTPSSLFLARFIAQKSFHYA       189

Query: 191 QNQTASRGRQTQFIEEMVSQESLIQAFSAQEESSDHFRTINQEYANFSQSAIFYSSTVNP  250
           Q  QT  SRG  QF  EE++ QE L+Q F+AQE+S  +  +N+   Y  SQ AIFY+STVNP
Sbjct: 190 QAQTKSRGNLAQFTEEILRQEGLVQLFNAQEQSICDYHVLNKTYCEASQKAIFYASTVNP  249

Query: 251 STRFINSLIYGFLAGIGALRIMSGAFSVGQLITFLNYVNQYTKPFNDISSVLSEMQSALA  310
           +TRFINS+IY   LAG+GA+RIM+G FSVGQL TFLN V QYTKPFNDISSVL+E+QS+LA
Sbjct: 250 ATRFINSVIYALLAGLGAVRIMAGLFSVGQLTTFLNVVVQYTKPFNDISSVLAEIQSSLA  309

Query: 311 CAERLYSILEESSPNITGTEKLDSSTVKGQIDFKNVVFGYNKSKLLLNGINLHIPAGAKV  370
           CA+RLY +L+                +S VKGQIDF+ V F Y+K +   LL  IN  +PAG KV
Sbjct: 310 CAQRLYDLLDIEIKEQEHFLTFKASAVKGQIDFEEVSFSYQKDRPLLKDINFSVPAGSKV  369

Query: 371 AIVGPTGAGKSTLINLIMRFYEVDGGNILLDCKPITDYEPSQLRQEIGMVLQETWLKSAT  430
           AIVGPTGAGKSTLINL+MRFYE+D G+I LD   PI  Y     +LR   G+VLQETWLK AT
Sbjct: 370 AIVGPTGAGKSTLINLLMRFYELDAGSIKLDKVPIKCYAKEELRSITGIVLQETWLKDAT  429

Query: 431 IHDNIAYANPKASREEVIEAARAANADFFIKQLPNGYDTYLEDAGDSLSQGQCQLLTIAR  490
           +H+ IAY +  +ASR+EV+  AARAA+A FFI QLP  YDTYL  + D+LSQGQ QLL IAR
Sbjct: 430 VHELIAYGSEEASRDEVVAAAKAAHAHFFIMQLPKTYDTYLSASDDALSQGQLQLLAIAR  489
```

```
Query: 491  IFLKLPRILILDEATSSIDTRTEVLVQEAFQMLMKGRTSFIIAHRLSTIQTADIILVMVS  550
            +FLK P++L+LDEATSSID RTE ++QEA + LM+GRTSFIIAHRLSTIQ+AD+ILVM
Sbjct: 490  MFLKKPKVLVLDEATSSIDIRTEAVIQEALKELMRGRTSFIIAHRLSTIQSADLILVMDQ  549

Query: 551  GEIVEVGNHSELMAQKGIYYQMQNAQ                                   576
            G +VE G H+ LM++ G Y ++Q +
Sbjct: 550  GRLVEWGTHASLMSKNGCYVRLQKIE                                   575
```

Based on this analysis, it was predicted that this protein and its epitopes, could be useful antigens for vaccines or diagnostics.

Example 2121

A DNA sequence (GBSx2237) was identified in *S. agalactiae* <SEQ ID 6547> which encodes the amino acid sequence <SEQ ID 6548>. Analysis of this protein sequence reveals the following:

---

Possible site: 26
>>> Seems to have no N-terminal signal sequence
----- Final Results -----
   bacterial cytoplasm --- Certainty = 0.1099 (Affirmative) <succ>
   bacterial membrane --- Certainty = 0.0000 (Not Clear) <succ>
   bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2122

A DNA sequence (GBSx2238) was identified in *S. agalactiae* <SEQ ID 6549> which encodes the amino acid sequence <SEQ ID 6550>. This protein is predicted to be ABC transporter, ATP-binding protein (msbA). Analysis of this protein sequence reveals the following:

---

Possible site: 37
>>> Seems to have no N-terminal signal sequence
INTEGRAL     Likelihood = –13.69    Transmembrane 157-173 (130-182)
INTEGRAL     Likelihood = –10.88    Transmembrane 56-72 (49-77)
INTEGRAL     Likelihood = –7.75     Transmembrane 239-255 (235-258)
INTEGRAL     Likelihood = –6.42     Transmembrane 133-149 (130-156)
INTEGRAL     Likelihood = –4.78     Transmembrane 271-287 (270-289)
INTEGRAL     Likelihood = –1.91     Transmembrane 20-36 (20-37)
----- Final Results -----
   bacterial membrane --- Certainty = 0.6477 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the GENPEPT database.

```
>GP: AAD35375 GB: AE001710 ABC transporter, ATP-binding protein
[Thermotoga maritima]
Identities = 196/570 (34%), Positives = 327/570 (56%), Gaps = 5/570 (0%)
Query:   1  MKRLTYYFKGYIKETIFGPLFKLLEASFELLVPIVIARMIDETIPRGDREGLLLQIGLIF   60
            MK  L   Y K Y     +  PLF ++E    +1   P ++A+++de I RGD S L+L+ G++
Sbjct:   1  MKTLARYLKPYWIFAVLAPLFMVVEVICDLSQPTLLARIVDEGIARGDFS-LVLKTGILM    59

Query:  61  FDAA-VGVVVAITAQYYSSKAAVGYTRQLTEDLYQKVMSLGKKDRDELGTASLITRLTAD  119
            + A +G V I     ++S A+  +   L  DL++KV+S    + +    T+SLITRLT D
Sbjct:  60  LIVALIGAVGGIGCTVFASYASQNFGADLRRDLFRKVLSFSISNVNRFHTSSLITRLTND  119

Query: 120  TFQIQTGLNQFLRLFLRAPIIVFGAIIMAFSISPSLTIWFLVMVVTLFIIVFVMSRLLNP  179
            Q+Q  +    LR+ +RAP++  G I+MA SI+  L+   + ++ + ++   +++    NP
Sbjct: 120  VTQLQNLVMMLLRIVVRAPLLFVGGIVMAVSINVKLSSVLIFLIPPIVLLFVWLTKKGNP  179

Query: 180  IYLKIRTSTDYLVKLTRQQLQGVRVIRAFNQVDRESEAFNDINYHYTNLQLKAGRLSSLV  239
            ++ KI+ STD + ++ R+ L GVRV+RAF + + E+E F   N         + A  L
Sbjct: 180  LFRKIQESTDEVNRVVRENLLGVRVVRAFRREEYENENFRKANESLRRSIISAFSLIVFA  239

Query: 240  TPLTFLVVNITLVVIIWRGNLNIANHLLSQGMLVALINYLLQILVELLKMTMLVTSLNQS  299
            PL   +VN+ ++ ++++W G + + N+ +   G ++A  NYL+QI+  L+ +  ++   +   + ++
Sbjct: 240  LPLFIFIVNMGMIAVLWFGGVLVRNNQMEIGSIMAYTNYLMQIMFSLMMIGNILNFIVRA  299

Query: 300  YISAKRIIAVF-ERPS-EIIDDKLEPKYSNKALEVQEMAFSYPNSSEKALSDITFSMNVG  357
               SAKR++ V  E+P+  E  D+ L         ++  + + F Y  +++   LS + FS+   G
Sbjct: 300  SASAKRVLEVLNEKPAIEEADNALALPNVEGSVSFENVEFRYFENTDPVLSGVNESVKPG  359

Query: 358  ETLGIIGGTGSGKSTLINLLLHIYKVQEGDIDIYHQGKSPDTISNWRTLVRVVPQNAQLF  417
            + ++G TGSGKSTL+NL+   +  + G +++         + + R   + VPQ   LF
Sbjct: 360  SLVAVLGETGSGKSTLMNLIPRLIDPERGRVEVDELDVRTVKLKDLRGHISAVPQETVLF  419

Query: 418  KGTIRSNLSLGLGKVSEEKLWTALEIAQASDFVKEKDGQLDAPVESFGRNFSGGQRQRLT  477
              GTI+  NL  G       ++++   A +IAQ  DF+         D+ VE  GRNFSGGQ+QRL+
Sbjct: 420  SGTIKENLKWGREDATDDEIVEAAKIAQIHDFIISLPEGYDSRVERGGRNFSGGQKQRLS  479

Query: 478  IARALVQDKIPFLILDDATSALDYLTEARLFKAITKHFNQTNLIIVSQRINSIQNADRIL  537
            IARALV+ K    LILDD TS++D +TE R+       + ++            I++Q+I +   AD+IL
```

```
-continued
Sbjct: 480  IARALVK-KPKVLILDDCTSSVDPITEKRILDGLKRYTKGCTTFIITQKIPTALLADKIL    538

Query: 538  LLDKGKQVGFDNHQSLLAHNKVYKSIYHSQ                                 567
            +L +GK  GF  H+ LL H K Y+ IY SQ
Sbjct: 539  VLHEGKVAGFGTHKELLEHCKPYREIYESQ                                 568
```

A related DNA sequence was identified in *S. pyogenes* <SEQ ID 6551> which encodes the amino acid sequence <SEQ ID 6552>. Analysis of this protein sequence reveals the following:

Possible site: 37
>>> Seems to have no N-terminal signal sequence
INTEGRAL    Likelihood = −12.47    Transmembrane 157-173 (149-185)
INTEGRAL    Likelihood = −7.75     Transmembrane 55-71 (51-74)
INTEGRAL    Likelihood = −4.25     Transmembrane 239-255 (237-260)

-continued

INTEGRAL    Likelihood = −3.77     Transmembrane 20-36 (19-37)
INTEGRAL    Likelihood = −3.50     Transmembrane 271-287 (270-288)
INTEGRAL    Likelihood = −2.55     Transmembrane 133-149 (130-151)
----- Final Results -----
  bacterial membrane --- Certainty = 0.5989 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
!GB: AL137187 putative ABC transporter [Streptomyces ... 296 6e-79
>GP: CAB69751 GB: AL137187 putative ABC transporter [Streptomyces
coelicolor A3(2)]
Identities = 185/569 (32%), Positives = 306/569 (53%), Gaps = 8/569 (1%)
Query:   1  MKRLRPYVKGYLKESILGPLFKLLEALFELLVPLLIANMIDISISQHNSQGILRVVLTLF    60
            ++ LR Y++ Y K   L     + L+    L +P L A++ID  + +  S  IL     +
Sbjct:   3  IRLLRTYLRPYKKPIALLVALQFLQTCASLYLPTLNAHIIDEGVVKGDSGYILSYGALMI   62

Query:  61  GLATIGLLLSVTAQYFSSKAAVGFTRQMTDDLFKKIMFLSKEDQDHLGYASLLSRLTSDS  120
            G++    ++ ++ A ++ ++ A     R +    +F ++    S  +  H G  SL++R T+D
Sbjct:  63  GISLAQVVCNIGAVFYGARTAAALGRDVRGAVFDRVQSFSAREVGHFGAPSLITRTTNDV  122

Query: 121  FQIQTGINQFLRLFLRAPIIVCGAMVMAYWISPSLTLWFVMMVIVLLTLVFVMSHLLGPL  180
            Q+Q          L + API+   G +VMA +    L+     ++V VL     V  ++     L PL
Sbjct: 123  QQVQMLALMTFTLMVSAPIMCVGGIVMALGLDVPLSGVLLGVVPVLAICVTLIVRKLRPL  182

Query: 181  YLLIRRETDHLVRLTSQQLQGIRVIKAFNQTQKELQAFKQQNMLLSRHQYQAATLANVLN  240
            +   ++    D + R+  +Q+  G RVI+AF + + E Q F++ N   L+              L   ++
Sbjct: 183  FRKMQVRLDTVNRVLREQITGNRVIRAFVRDEYEQQRFRKANTELTEVALGTGNLLALMF  242

Query: 241  PMTFLVVNLTLLILIWQGSWQVAHRSLSQGMLVALINYLLQILAELLKMTLMGTINQSV   300
            P+     VVNL+ +   ++W G+ ++          + G L A + YL+QI+  ++  T +    + ++
Sbjct: 243  PVVMTVVNLSSIAVVWFGAHRIDSGGMQIGDLTAFLAYLMQIVMSVMMATFMFMMVPRAE  302

Query: 301  TAAKRINQVFVLADEAPLPLLKDGPISTH-LLTIRHLTFTYPGAAEPSLYDIQLSADQGE  359
              A+RI +V          P+    + H  L IR   F YPGA EP  L    I L A   GE
Sbjct: 303  VCAERIQEVLETESSVVPPVAPVTELRRHGHLEIREAGFRYPGAEEPVLRHIDLVARPGE  362

Query: 360  WIGIIGGTGAGKTTLIDLICQTYSQYSGEISLNW---QGEVPKTLTEWRNVIALVPQKAQ   416
             +IG  TG+GK+TL+ + + +    GE+ +N    +    PKTL +      V++LVPQK
Sbjct: 363  TTAVIGSTGSGKSTLLGLVPRLFDATDGEVLVNGVDVRTVDPKTLAK---VVSLVPQKPY  419

Query: 417  LFKGTIRSNLLLGQSMPISDEELWRALELAQAKEEVAALPEQLEAPVEAFGRHFSGGQRQ   476
            LF GT+  +NL  G  +   +DEELW AL +AQAKEFV+ L      L+AP+      G + SGGQRQ
Sbjct: 420  LFAGTVATNLRYG-NPDATDEELWHALAVAQAKEFVSELEGGLDAPIAQGGTNVSGGQRQ  478

Query: 477  RLAIARALLKPKPILILDDASSALDNETRGRLFKALKEELSDVLVILVTQSIKNLQFADK   536
            RLAIAR L++   I + DD+ SALD  T    L  L +E ++     V++V Q +    ++ AD+
Sbjct: 479  RLAIARTLVQRPEIYLFDDSFSALDYATDAALRAELAQETAEATVVIVAQRVATIRDADR  538

Query: 537  ILVLEQGHQLDFASHDQLKVSNALYQEML                                565
            I+VL++G    +    H +L    N  Y+E++
Sbjct: 539  IVVLDEGRVVGVGRHHELMADNETYREIV                                567
```

An alignment of the GAS and GBS proteins is shown below.

```
Identities = 313/568 (55%), Positives = 428/568 (75%), Gaps = 9/568 (1%)
Query:   1  MKRLTYYFKGYIKETIFGPLFKLLEASFELLVPIVIAXMIDETIPRGDRSGLLLQIGLIF   60
            MKRL Y KGY+KE+I GPLFKLLEA FELLVP++IA MID +I + +  G+L   + +F
Sbjct:   1  MKRLRPYVKGYLKESILGPLFKLLEALFELLVPLLIANMIDISISQHNSQGILRVVLTLF   60

Query:  61  FLAAVGVVVAITAQYYSSKAAVGYTRQLTEDLYQKVMSLGKKDRDELGTASLITRLTADT  120
            LA +G+++++++TAQY+SSKAAVG+TRQ+T+DL++K+M L K+D+D LG ASL++RLT+D+
```

```
                          -continued
Sbjct:  61  GLATIGLLLSVTAQYFSSKAAVGFTRQMTDDLFKKIMFLSKEDQDHLGYASLLSRLTSDS  120

Query: 121  FQIQTGLNQFLRLFLRAPIIVFGAIIMAFSISPSLTIWFLVMVVTLFIIVFVMSRLLNPI  180
            FQIQTG+NQFLRLFLRAPIIV GA++MA+ ISPSLT+WF++MV+ L  +VFVMS LL P+
Sbjct: 121  FQIQTGINQFLRLFLRAPIIVCGAMVMAYWISPSLTLWFVMMVIVLLTLVFVMSHLLGPL  180

Query: 181  YLKIRTSTDYLVKLTRQQLQGVRVIRAFNQVDRESEAFNDINYHYTNLQLKAGRLSSLVT  240
            YL IR  TD+LV+LT QQLQG+RVI+AFNQ  +E +AF   N    + Q +A  L++++
Sbjct: 181  YLLIRRETDHLVRLTSQQLQGIRVIKAFNQTQKELQAFKQQNMLLSRHQYQAATLANVLN  240

Query: 241  PLTFLVVNITLVVIIWRGNLNIANHLLSQGMLVALINYLLQILVELLKMTMLVTSLNQSY  300
            P+TFLVVN+TL+++IW+G+   +A+  LSQGMLVALINYLLQIL ELLKMTML+ ++NQS
Sbjct: 241  PMTFLVVNLTLLILIWQGSWQVAHRSLSQGMLVALINYLLQILAELLKMTMLMGTINQSV  300

Query: 301  ISAKRIIAVF----ERPSEIIDDKLEPKYSNKALEVQEMAFSYPNSSEKALSDITFSMNV  356
             +AKRI  VF    E P  ++ D    S   L ++ + F+YP ++E +L DI  S +
Sbjct: 301  TAAKRINQVFVLADEAPLPLLKD---GPISTHLLTIRHLTFTYPGAAEPSLYDIQLSADQ  357

Query: 357  GETLGIIGGTGSGKSTLINLLLHIYKVQEGDIDIYHQGKSPDTISNWRTLVRVVPQNAQL  416
            GE +GIIGGTG+GK+TLI+L+    Y    G+I +   QG+ P T++ WR ++ +VPQ AQL
Sbjct: 358  GEWIGIIGGTGAGKTTLIDLICQTYSQYSGEISLNWQGEVPKTLTEWRNVIALVPQKAQL  417

Query: 417  FKGTIRSNLSLGLG-KVSEEKLWTALEIAQASDFVKEKDGQLDAPVESFGRNFSGGQRQR  475
            FKGTIRSNL LG    +S+E+LW ALE+AQA +FV     QL+APVE+FGR+FSGGQRQR
Sbjct: 418  FKGTIRSNLLLGQSMPISDEELWRALELAQAKEFVAALPEQLEAPVEAFGRHFSGGQRQR  477

Query: 476  LTIARALVQDKIPFLILDDATSALDYLTEARLFKAITKHFNQTNLIIVSQRINSIQNADR  535
            L IARAL++ K P LILDDA+SALD  T   RLFKA+ +    +I+V+Q I ++Q AD+
Sbjct: 478  LAIARALLKPK-PILILDDASSALDNETRGRLFKALKEELSDVLVILVTQSIENLQFADK  536

Query: 536  ILLLDKGKQVGFDNHQSLLAHNKVYKSI                                 563
            IL+L++G Q+ F +H  L   N +Y+ +
Sbjct: 537  ILVLEQGHQLDFASHDQLKVSNALYQEM                                 564
```

Based on this analysis, it was predicted that this protein and its epitopes, could be useful antigens for vaccines or diagnostics.

Example 2123

A DNA sequence (GBSx2239) was identified in *S. agalactiae* <SEQ ID 6553> which encodes the amino acid sequence <SEQ ID 6554>. Analysis of this protein sequence reveals the following:

---

Possible site: 43
>>> Seems to have an uncleavable N-term signal seq
INTEGRAL     Likelihood = −12.26     Transmembrane 8-24 (1-28)
----- Final Results -----
   bacterial membrane --- Certainty = 0.5904 (Affirmative) <succ>
      bacterial outside --- Certainty = 0.0000 (Not Clear) <succ>
         bacterial cytoplasm --- Certainty = 0.0000 (Not Clear) <succ>

---

The protein has homology with the following sequences in the GENPEPT database.

A related DNA sequence was identified in *S. pyogenes* <SEQ ID 4143> which encodes the amino acid sequence <SEQ ID 4144>. Analysis of this protein sequence reveals the following:

---

Possible site: 42
>>> Seems to have an uncleavable N-term signal seq
INTEGRAL     Likelihood = −2.66     Transmembrane 8-24 (7-25)
----- Final Results -----
   bacterial membrane --- Certainty = 0.2062 (Affirmative) <succ>
      bacterial outside --- Certainty = 0.0000 (Not Clear) <succ>
         bacterial cytoplasm --- Certainty = 0.0000 (Not Clear) <succ>

---

An alignment of the GAS and GBS proteins is shown below.

```
>GP: AAB84433 GB: AF027868 RAS-related protein [Bacillus subtilis]

Identities = 53/140 (37%), Positives = 78/140 (54%), Gaps = 2/140 (1%)

Query:  28  VKKVLQYHDLVQNTLAENGSEANVHLVLSMIYTETKGDAIDVMQSSESISGTTNSITDSH   87
            ++++  Y   LV+  L   G     L+L M+Y E+KG  D MQSSES+    N ITD
Sbjct:  49  LERLTDYKPLVEEELESQGLSNYTSLILGMMYQESKGKGNDPMQSSESLGLKRNEITDPQ  108

Query:  88  TSIKHGVTLLSQNISQAKKAKVDVWTAVQAYNFGSSYIDYVADHGGENSIELAKNYSKNV  147
            +S+K G+    +      K+  VD+ T +Q+YN G+  YID+VA+HGG ++ ELAK YS+
Sbjct: 109  LSVKQGIKQFTLMYKTGKEKGVDLDTIIQSYNMGAGYIDFVAEHGGTHTEELAKQYSEQQ  168

Query: 148  VA--PSLGNYNGDTYFYYHP                                          165
            V   P L  G+   + +P
Sbjct: 169  VKKNPDLYTCGGNAKNFRYP                                          188
```

```
Identities = 134/200 (670), Positives = 165/200 (820), Gaps = 1/200 (0%)
Query:    1  MFKFLKRLIALIIIIFIGYRLVIIHENVKKVLQYHDLVQNTLAENGSEANVHLVLSMIYT    60
             MF+ LKR  + +++ F+ Y+  +IH NV++VL Y  +V+ TLAEN ++ANV LVL+MIYT
Sbjct:    1  MFRLLKRACSFLLL-FVIYQSFVIHHNVQRVLAYKPMVEKTLAENDTKANVDLVLAMIYT    59

Query:   61  ETKGDAIDVMQSSESISGTTNSITDSHTSIKHGVTLLSQNISQAKKAKVDVWTAVQAYNF   120
             ETKG  DVMQSSES   SG NSITDS SI+HGV LLS N++ A++A VD WTAVQAYNF
Sbjct:   60  ETKGGEADVMQSSESSSGQKNSITDSQASIEHGVNLLSHNLALAEEAGVDSWTAVQAYNF   119

Query:  121  GSSYIDYVADHGGENSIELAKNYSKNVVAPSLGNYNGDTYFYYHPLALISGGKLYKNGGN   180
             G++YIDY+A+HGG+N+++LA  YSK VVAPSLGN +G TYFYYHPLALISGGKLYKNGGN
Sbjct:  120  GTAYIDYIAEHGGQNTVDLATTYSKTVVAPSLGNISGQTYFYYHPLALISGGKLYKNGGN   179

Query:  181  IYYSREVQFNLYLIKIMELF                                          200
             IYYSREV FNLYLI++M LF
Sbjct:  180  IYYSREVHFNLYLIELMSLF                                          199
```

SEQ ID 6554 (GBS244) was expressed in *E. coli* as a His-fusion product. SDS-PAGE analysis of total cell extract is shown in FIG. 59 (lane 4; MW 23.1 kDa). It was also expressed in *E. coli* as a GST-fusion product. SDS-PAGE analysis of total cell extract is shown in FIG. 67 (lane 2; MW 48 kDa).

Figure 211:
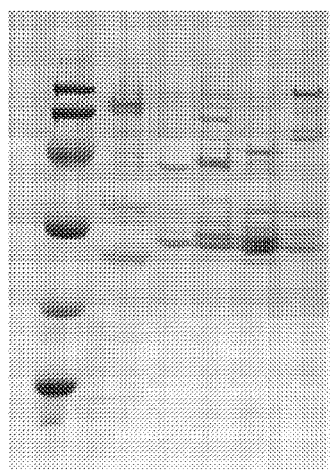

GBS244-GST was purified as shown in FIG. 211, lane 5.

Based on this analysis, it was predicted that this protein and its epitopes, could be useful antigens for vaccines or diagnostics.

Possible site: 38
>>> Seems to have no N-terminal signal sequence
----- Final Results -----
    bacterial cytoplasm --- Certainty = 0.2401 (Affirmative) <succ>
    bacterial membrane --- Certainty = 0.0000 (Not Clear) <succ>
    bacterial outside --- Certainty = 0.0000 (Not Clear) <succ>

Example 2124

A DNA sequence (GBSx2240) was identified in *S. agalactiae* <SEQ ID 6555> which encodes the amino acid sequence <SEQ ID 6556>. Analysis of this protein sequence reveals the following:

A related GBS nucleic acid sequence <SEQ ID 9837> which encodes amino acid sequence <SEQ ID 9838> was also identified.

The protein has homology with the following sequences in the GENPEPT database.

```
>GP: CAB71302 GB: AJ130879 hypothetical protein [Clostridium sticklandii]
Identities = 32/95 (33%), Positives = 53/95 (55%), Gaps = 1/95 (1%)
Query:  235  LSPEKLADQLFDDNLTARLTFVDELKDAIPGPVQVSDIDHSRQIKKLENQKLSLSNGIEL   294
             LS EK + F++    + ++L  A    Q+ ++  +  +K E QK+   +GIE+
Sbjct:    2  LSVEKALETAFEETDEIKATYKEALSKAGIENEQI-EVSETALKRKFEIQKIITESGIEV    60

Query:  295  IVPNNVYQDAESVEFIQNPDGTYSILIKNIQDIQN                           329
             +P N Y D   +EF+ N DGT S++IKNI +IQ+
Sbjct:   61  KIPVNYYGDPSKLEFVANGDGTVSLVIKNIGNIQS                            95
```

A related DNA sequence was identified in *S. pyogenes* <SEQ ID 6557> which encodes the amino acid sequence <SEQ ID 6558>. Analysis of this protein sequence reveals the following:

Possible site: 52
>>> Seems to have no N-terminal signal sequence
----- Final Results -----
    bacterial cytoplasm --- Certainty = 0.3336 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below.

```
Identities = 246/325 (75%), Positives = 286/325 (87%)
Query:    6  MMDFYIKQIIIHQFSPNDTELVLSDTPLTLTPRIDDYFRKKLSKVFSDEAKRGYFGEDNV    65
             M+D YIK+I+IHQFSPNDTEL+LSD +++TPRID+YFRKKL+KVFSDEAKRG F  +N
Sbjct:    1  MLDSYIKRIVIHQFSPNDTELLLSDRLVSITPRIDEYFRKKLAKVFSDEAKRGQFEANNT    60

Query:   66  FMSHLQDDLYVSSCQIAQLWKEEFVISEDQKTNDLVFIQFDKDGMEHFAFLRISLKEQFA   125
             F + + DDL  +S  IAQLWKE FVISEDQKTNDLVF+QFDKDG   FAFLRI+LKEQFA
Sbjct:   61  FETTIGDDLLETSVTIAQLWKEAFVISEDQKTNDLVFVQFDKDGEPFFAFLRIALKEQFA   120
```

-continued
```
Query: 126  HVSENQEQPITITQNNLPSAAQTPDEALVVNKSSKQYYLIEKRIKHNGSFANYFSENLLQ  185
            H+S+N E P T+TQNNLPS  QTPDEALV+N S QYYLIEKR+KHNGSFANYFSE+LL+
Sbjct: 121  HLSDNYEHPFTVTQNNLPSPTQTPDEALVINLKSGQYYLIEKRVKHNGSFANYFSEHLLK  180

Query: 186  VQPEQSVKKSIKMVEQTAQKIAENFNKDDFSFQSKMKSAIYKNLEEEQELSPEKLADQLF  245
            V PEQSVKKSIKM+EQTAQKIAE+FN+DDF+FQSL,LS ++K LE + LSPEKLADQLF
Sbjct: 181  VTPEQSVKKSIKMIEQTAQKIAEHFNQDDFTFQSKMKSTLFKQLEADDVLSPEKLADQLF  240

Query: 246  DDNLTARLTFVDELKDAIPGPVQVSDIDHSRQIKKLENQKLSLSNGIELIVPNNVYQDAE  305
            DDNLTARLTFVD++KD IP P+++SDI+HSRQIKKLENQKLSLSNGIEL VPN +YQDAE
Sbjct: 241  DDNLTARLTFVDQVKDVIPEPIKISDIEHSRQIKKLENQKLSLSNGIELTVPNAIYQDAE  300

Query: 306  SVEFIQNPDGTYSILIKNIQDIQNK                                    330
            +VEF+ N DGTYSILIKNI+DI+ K
Sbjct: 301  AVEFLLNDDGTYSILIKNIEDIKTK                                    325
```

Based on this analysis, it was predicted that this protein and its epitopes, could be useful antigens for vaccines or diagnostics.

Example 2125

A DNA sequence (GBSx2241) was identified in *S. agalactiae* <SEQ ID 6559> which encodes the amino acid sequence <SEQ ID 6560>. This protein is predicted to be Serine hydroxymethyltransferase (glyA-1). Analysis of this protein sequence reveals the following:

---
Possible site: 45
>>> Seems to have no N-terminal signal sequence
----- Final Results -----
   bacterial cytoplasm --- Certainty = 0.3876 (Affirmative) <succ>
   bacterial membrane --- Certainty = 0.0000 (Not Clear) <succ>
   bacterial outside --- Certainty = 0.0000 (Not Clear) <succ>
---

The protein has homology with the following sequences in the GENPEPT database.

A related DNA sequence was identified in *S. pyogenes* <SEQ ID 6561> which encodes the amino acid sequence <SEQ ID 6562>. Analysis of this protein sequence reveals the following:

---
Possible site: 47
>>> Seems to have no N-terminal signal sequence
INTEGRAL    Likelihood = -0.00    Transmembrane 196-212 (196-212)
----- Final Results -----
   bacterial membrane --- Certainty = 0.1001 (Affirmative) <succ>
   bacterial outside --- Certainty = 0.0000 (Not Clear) <succ>
   bacterial cytoplasm --- Certainty = 0.0000 (Not Clear) <succ>
---

The protein has homology with the following sequences in the databases:

```
>GP: AAL35802 GB: AE001743 serine hydroxymethyltransferase [Thermotoga maritima]
Identities = 243/416 (58%), Positives = 307/416 (73%), Gaps = 7/416 (1%)
Query:   9  KEFDQELWQAIHDEEIRQQNNIELIASENVVSKAVMAAQGSVLTNKYAEGYPSHRYYGGT   68
            K+ D E+++ + +E RQ+  +ELIASEN  S AV+   GS+LTNKYAEGYP  RYYGG
Sbjct:   6  KQVDPEIYEVLVNELKRQEYGLELIASENFASLAVIETMGSMLTNKYAEGYPKKRYYGC   65

Query:  69  DCVDVVESLAIERAKTLFNAEFANNQPHSGSQANAAAYMALIEPGDTVLGMDLAAGGHLT  128
            + VD  E  AIERAK LF A+FANVQPHSGSQAN A Y+AL +PGDT++GM L+ GGHLT
Sbjct:  66  EWVDRAEERAIERAKRLFGAKFANVQPHSGSQANMAVYLALAQPGDTIMGMSLSHGGHLT  125

Query: 129  HGASVSFSGKTYHFVSYSVDPKTEMLDYDNILKIAQETQPKLIVAGASAYSRIIDFEKFR  188
            HGA V+FSGK +  V Y V+ +TE +DYD + ++A E +PK+IVAG SAY+RIIDF++FR
Sbjct: 126  HGAPVNFSGKIFKVVPYGVNLETETIDYDEVRRLALEHKPKIIVAGGSAYARIIDFKRFR  185

Query: 189  QIADAVDAYLMVDMAHIAGLVASGHHPSPIPYAHVITTITHKTLRGPRGGLILTNDEAIA  248
            +IAD V AYLMVDMAH AGLVA+G HP+P+ YAHV T+THKTLRGPRGGLILTND  IA
Sbjct: 186  EIADEVGAYLMVDMAHFAGLVAAGIHPNPLEYAHVVISTIHKILRGPRGGLILINDPEIA  245

Query: 249  KKINSAVFPGLQGGPLEHVIAAKAVALKEALDPSFKIYGEDIIKNAQAMAKVFKEDDDFH  308
            K ++  +FPG+QGGPL HVIAAKAV  KEA+   FK Y + ++KNA+ MA+ F++   +
Sbjct: 246  KAVDKTIFPGIQGGPLMHVIAAKAVCFKEAMTEEFKEYQKQVVKNAKKMAEEFQK-RGYR  304

Query: 309  LISDGTDNHLFLVDVTKVIENGKKAQNVLEEVNITLNKNSIPFERLSPFKTSGIRIGTPA  368
            ++S GTD HLFLVD+T   GK A+ LE    IT+NKN+IP E+ SPF  SGIRIGTPA
Sbjct: 305  IVSGGTDTHLFLVDLTPKDITGKAAEKALESCGITVNKNTIPNEKRSPFVASGIRIGTPA  364

Query: 369  ITSRGMGVEESRRIAELMIKALKN--HENQDVLTEVRQE----IKSLTDAFPLYEN     418
            +T+RGM EE    IAE++    L N  EN  V  EVR+E      ++ L + FPLY +
Sbjct: 365  VTTRGMKEEEMEEIAEMIDLVLSNVIDENGTVKPEVREEVSKKVRELCERFPLYRD     420
```

```
>GP: CAB15707 GB: Z99122 serine hydroxymethyltransferase [Bacillus subtilis]
Identities = 250/407 (61%), Positives = 311/407 (75%), Gaps = 2/407 (0%)
Query:  14  DKELWDAIHAEEERQEHHIELIASENMVSKAVMAAQGSVLTNKYAEGYPGNRYYGGTECV      73
            D+++++AI  E ERQ+  IELIASEN VS+AVM AQGSVLTNKYAEGYPG RYYGG E V
Sbjct:   8  DEQVFNAIRNERERQQTKIELIASENFVSEAVMEAQGSVLTNKYAEGYPGKRYYGCENV      67

Query:  74  DIVETLAIERAKKLFGAAFANVQAHSGSQANAAANNALIEAGDTVLGMDLAAGGHLTHGS     133
            D+VE +A +RAK++FGA   NVQ HSG+QAN A Y   ++E GDTVLGM+L+ GGHLTHGS
Sbjct:  68  DVVEDIARDRAKEIFGAEHVNVQPHSGAQANMAVYFTILEQGDTVLGMNLSHGGHLTHGS     127

Query: 134  PVNFSGKTYHFVGYSVDTDTEMLNYEAILEQAKAVQPKLIVAGASAYSRSIDFEKFRAIA     193
            PVNFSG  Y+FV Y VD +T+ ++Y+ +  E+A A +PKLIVAGASAY R+IDF+KFR IA
Sbjct: 128  PVNFSGVQYNFVEYGVDKETQYIDYDDVREKALAHKPKLIVAGASAYPRTIDFKKFREIA     187

Query: 194  DHVGAYLMVDMAHIAGLVAAGVHPSPVPYAHIVTSTTHKTLRGPRGGLILTNDEALAKKI     253
            D VGAY MVDMAHIAGLVAAG+HP+PVPYA   VT+TTHKTLRGPRGG+IL  +E   KKI
Sbjct: 188  DEVGAYFMVDMAHIAGLVAAGLHPNPVPYADFVTTITHKTLRGPRGGMILCREE-FGKKI     246

Query: 254  NSAVFPGLQGGPLEHVIAAKAVAFKEALDPAFKDYAQAIIDNTAAMAAVFAQDDRFRLIS     313
            + ++FPG+QGGPL HVIAAKAV+F E L   FK YAQ +I N   +A    ++   +L+S
Sbjct: 247  DKSIFPGIQGGPLMHVIAARAVSFGEVLQDDFKTYAQNVISNAKRLAEALTKEG-IQLVS     305

Query: 314  GGTDNHVFLVDVTKVIANGKLAQNLLDEVNITLNKNAIPFETLSPFKTSGIRIGCAAITS     373
            GGTDNH+ LVD+  +  GK+A+++LDE+ IT NKNAIP++   PF TSGIR+G AA+TS
Sbjct: 306  GGIDNHLILVDLRSLGLTGKVAEHVLDEIGITSNKNAIPYDPEKPFVTSGIRLGTAAVTS     365

Query: 374  RGMGVNESQTIARLIIKALVNHDQETILEEVRQEVRQLTDAFPLYKK                420
            RG     + +  +I   AL NH+ E  LEE RQ V   LTD FPLYK+
Sbjct: 366  RGFDGDALEEVGAIIALALKNHEDEGKLEEARQRVAALTDKFPLYKE                412
```

An alignment of the GAS and GBS proteins is shown below.

```
Identities = 330/417 (79%), Positives = 368/417 (88%)
Query:   1  MIFDKDNFKEFDQELWQAIHDEEIRQQNNIELIASENVVSKAVMAAQGSVLTNKYAEGYP     60
            MIFDK N ++FD+ELW AIH EE RQ+++IELIASEN+VSKAVMAAQGSVLTNKYAEGYP
Sbjct:   3  MIFDKGNVEDFDKELWDAIHAEEEERQEHHIELIASENMVSKAVMAAQGSVLTNKYAEGYP     62

Query:  61  SHRYYGGIDCVDVVESLAIERAKTLFNAEFANVQPHSGSQANAAAYMALIEPGDTVLGMD    120
            +RYYGGT+CVD+VE+LAIERAK LF A FANVQ HSGSQANAAAYMALIE GDTVLGMD
Sbjct:  63  GNRYYGGTECVDIVETLAIERAKKLYGAAFANVQAHSGSQANAAAYMALIEAGDTVLGMD    122

Query: 121  LAAGGHLTHGASVSFSGKTYHFVSYSVDPKTEMLDYDNILKIAQETQPKLIVAGASAYSR    180
            LAAGGHLTHG+ V+FSGKTYHFV YSVD  TEML+Y+ IL+ A+ QPKLIVAGASAYSR
Sbjct: 123  LAAGGHLTHGSPVNFSGKTYHFVGYSVDTDTEMLNYEAILEQAKAVQPKLIVAGASAYSR    182

Query: 181  IIDFEKFRQIADAVDAYLMVDMAHIAGLVASGHHPSPIPYAHVTTTTHKTLRGPRGGLI     240
             IDFEKFR IAD V AYLMVDMAHIAGLVA+G HPSP+PYAH+ T+TTHKTLRGPRGGLI
Sbjct: 183  SIDFEKFRAIADHVGAYLMVDMAHIAGLVAAGVHPSPVPYAHIVTSTTHKTLRGPRGGLI    242

Query: 241  LTNDEAIAKKINSAVFPGLQGGPLEHVIAAKAVALKEALDPSFKIYGEDIIKNAQAMAKV    300
            LTNDEA+AKKINSAVFPGLQGGPLEHVIAAKAVA KEALDP+FK Y + II N  AMA V
Sbjct: 243  LTNDEALAKKINSAVFPGLQGGPLEHVIAAKAVAFKEALDPAFKDYAQAIIDNIAAMAAV    302

Query: 301  FKEDDDFHLISDGTDNHLFLVDVTKVIENGKKAQNVLEEVNITLNKNSIPFERLSPFKTS    360
            F +DD F LIS GTDNH+FLVDVTKVI NGK AQN+L+EVNITLNKN+IPFE LSPFKTS
Sbjct: 303  FAQDDRFRLISGGTDNHVFLVDVTKVIANGKLAQNLLDEVNITLNKNAIPFETLSPFKTS    362

Query: 361  GIRIGTPAITSRGMGVEESRRIAELMIKALKNHENQDVLTEVRQEIKSLTDAFPLYE      417
            GIRIG   AITSRGMGV+ES+ IA L+IKAL NH+ +  +L EVRQE++ LTDAFPLY+
Sbjct: 363  GIRIGCAAITSRGMGVKESQTIARLIIKALVNHDQETILEEVRQEVRQLTDAFPLYK     419
```

Based on this analysis, it was predicted that these proteins and their epitopes could be useful antigens for vaccines or diagnostics.

Example 2126

A DNA sequence (GBSx2242) was identified in *S. agalactiae* <SEQ ID 6563> which encodes the amino acid sequence <SEQ ID 6564>. Analysis of this protein sequence reveals the following:

Possible site: 30
>>> Seems to have no N-terminal signal sequence
----- Final Results -----
  bacterial cytoplasm --- Certainty = 0.2289 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 9839> which encodes amino acid sequence <SEQ ID 9840> was also identified.

The protein has homology with the following sequences in the GENPEPT database.

```
>GP:AAD35934 GB:AE001752 conserved hypothetical protein [Thermotoga maritime]
Identities = 71/198 (35%), Positives = 114/198 (56%), Gaps = 4/198 (2%)
Query:   1  MNDLGQILEDHGAVIMPTETVYGIFAKALSEEAVNHVYELKKRPRDKAMNLNICDFETIL   60
            + +  ++L +   +I PTETVYGI A A +EEA   +++LK+RP D  + ++I  F+ +
Sbjct:  17  LKEAAELLRNGEVIIFPTETVYGIGADAYNEEACKKIFKLKERPADNPLIVHIHSFKQLE   76

Query:  61  KYSKNQPTYLKQLYDAFLPGPLTIIL-EASQEVPHWINSGLLSVGFRMPKHPVTLDMIAN  119
            + ++    +L  L   F PGPLT+I  + S+++P  + + L +V   RMP HPV L +I
Sbjct:  77  EIAEGYEPHLDFL-KKFWPGPLTVIFRKKSEKIPPVVTADLPTVAVRMPAHPVALKLIEL  135

Query: 120  HG-PLIGPSANISGCDSGRVFSEIQKQFNHQV-LGIEDDKALTGVDSTIIDLSGDRVKIL  177
              G P+  PSANISG  S      + + F  +V L I+       G++STI+DL+ ++  +L
Sbjct: 136  FGHPIAAPSANISGRPSATNVKHVIEDFMGKVKLIIDAGDTPFGLESTIVDLTKEKPVLL  195

Query: 178  RQGAITQEVLTATIPELI                                            195
            R G +  E L    PEL+
Sbjct: 196  RPGPVEVERLKELFPELV                                            213
```

A related DNA sequence was identified in *S. pyogenes* <SEQ ID 6565> which encodes the amino acid sequence <SEQ ID 6566>. Analysis of this protein sequence reveals the following:

---
Possible site: 46
>>> Seems to have no N-terminal signal sequence
----- Final Results -----
   bacterial cytoplasm --- Certainty = 0.0282 (Affirmative) <succ>
   bacterial membrane --- Certainty = 0.0000 (Not Clear) <succ>
   bacterial outside --- Certainty = 0.0000 (Not Clear) <succ>
---

An alignment of the GAS and GBS proteins is shown below.

```
Identities = 127/196 (64%), Positives = 154/196 (77%)
Query:   1  MNDLGQILEDHGAVIMPTETVYGIFAKALSEEAVNHVYELKKRPRDKAMNLNICDFETIL   60
            M  L  I+E   A+++PTETVYG+FAKAL E+AVN VY+LK+RPRDKAMNLN+ DF +IL
Sbjct:  11  MEYLASIIESGDALVLPTETVYGLFAKALDEKAVNAVYDLKQRPRDKAMNLNVADFNSIL   70

Query:  61  KYSKNQPTYLKQLYDAFLPGPLTIILEASQEVPHWINSGLLSVGFRMPKHPVTLDMIANH  120
            +SK QP YLK+LY AFLPGPLTIIL+A+ +VP+WINSGL +VGFR+P HP+T   +I
Sbjct:  71  AFSKEQPRYLKKLYQAFLPGPLTIILKANDQVPYWINSGLSTVGFRLPSHPITAALIQKT  130

Query: 121  GPLIGPSANISGCDSGRVFSEIQKQFNEQVLGIEDDKALTGVDSTIIDLSGDRVKILRQG  180
            GPLIGPSAN+SG  SGRVF  I + F+ QV G  DD   LTG DSTI+DLSG+R  ILRQG
Sbjct: 131  GPLIGPSANLSGKASGRVFDHIMQDFDFQVFGYADDPFLTGKDSTILDLSGERAVILRQG  190

Query: 181  AITQEVLTATIPELIF                                              196
            AIT+E L A +PEL F
Sbjct: 191  AITKEELLANVPELRF                                              206
```

Based on this analysis, it was predicted that these proteins and their epitopes could be useful antigens for vaccines or diagnostics.

Example 2127

A DNA sequence (GBSx2243) was identified in *S. agalactiae* <SEQ ID 6567> which encodes the amino acid sequence <SEQ ID 6568>. This protein is predicted to be protoporphyrinogen oxidase (hemK). Analysis of this protein sequence reveals the following:

---
Possible site: 50
>>> Seems to have no N-terminal signal sequence
----- Final Results -----
   bacterial cytoplasm --- Certainty = 0.3000 (Affirmative) <succ>
   bacterial membrane --- Certainty = 0.0000 (Not Clear) <succ>
   bacterial outside --- Certainty = 0.0000 (Not Clear) <succ>
---

The protein has homology with the following sequences in the GENPEPT database.

```
>GP:BAB07493 GB:AP001519 protoporphyrinogen oxidase [Bacillus halodurans]
Identities = 94/236 (39%), Positives = 132/236 (55%), Gaps = 12/236 (5%)
Query:  49  DTDQQLMENIFQQLKKHRSP---QYITGKAYFRDLIFFVDERVLIPRPETEELVDLILSE  105
            + D +L + + +L  H S    Q++  G   F     F VD+ VLIPRPETEELV  +L E
Sbjct:  46  ELDGELFQRLEEDLAAHASGVPVQHLIGVESFYGRQFQVDQHVLIPRPETEELVLAVLKE  105

Query: 106  -----NKVEDCSVLDIGTGSGAIAISLKKERPSWDVLASDISVSALDLAKENANNCDAEV  160
                 K  E+ ++LDIGTGSGAIA++L  E    +V A DIS  AL +A +NA     A V
Sbjct: 106  IRRQFKKEEEITILDIGTGSGAIAVTLALEEERTNVTAVDISRDALQVAADNARRLGANV  165
```

-continued
```
Query: 161 TFIESDV---FSNISGKFDIIVSNPPYISYNDKDEVGKNVLASEPHSALFADEEGLAIYR217
            I  D+   F    +FD+IVSNPPYI   +KD +   +V    EP   ALF    +GL +YR
Sbjct: 166 QLIHGDLGEPFLKTGERFDVIVSNPPYIPTVEKDTLAVHVRDHEPALALFGGVDGLDVYR225

Query: 218 KIIENSREYL-QPRGKLYFEIGYKQGDDLRSLLKRYFPNNRCRVLKDIFGKDRMVV     272
            +++      +  +G  +   EIG   QG D+   L++   +P      VL D+ GKDR+V+
Sbjct: 226 RLMSQLPALTKEEKGMVALEIGAGQGMDVEKLMQTAYPKAAVDVLYDLNGKDRIVL     281
```

A related DNA sequence was identified in *S. pyogenes* <SEQ ID 6569> which encodes the amino acid sequence <SEQ ID 6570>. Analysis of this protein sequence reveals the following:

---
Possible site: 48
>>> Seems to have no N-terminal signal sequence
----- Final Results -----
  bacterial cytoplasm --- Certainty = 0.4324 (Affirmative) <succ>
  bacterial membrane --- Certainty = 0.0000 (Not Clear) <succ>
  bacterial outside --- Certainty = 0.0000 (Not Clear) <succ>
---

Possible site: 28
>>> Seems to have no N-terminal signal sequence
----- Final Results -----
  bacterial cytoplasm --- Certainty = 0.3446 (Affirmative) <succ>
  bacterial membrane --- Certainty = 0.0000 (Not Clear) <succ>
  bacterial outside --- Certainty = 0.0000 (Not Clear) <succ>
---

An alignment of the GAS and GBS proteins is shown below.

The protein has homology with the following sequences in the GENPEPT database.

```
Identities = 174/274 (63%), Positives = 207/274 (75%)
Query:   1 MNYAQLIKHYGQLLEACGEEVENFIYVLKDLKQWSTTDYLLNQNSSVSDTDQQLMENIFQ 60
           MNYA LI+ Y   LE   E+ EN  YV +++K+WS+ D L++QN +V+   D  L+E+IF
Sbjct:   1 MNYATLIRTYEDKLEQIDEDRENLAYVFREIKEWSSLDMLIHQNQAVTPEDAVLLEHIFC 60

Query:  61 QLKKHRSPQYITGKAYFRDLIFFVDERVLIPRPETEELVDLILSENKVEDCSVLDIGTGS120
             L +H SPQYITG AYFRDL    VD+RVLIPRPETEELVD+IL+EN     +VLDIGTGS
Sbjct:  61 SLSQHLSPQYITGNAYFRDLKLAVDKRVLIPRPETEELVDMILAENLDAPLNVLDIGTGS120

Query: 121 GAIAISLKKERPSWDVLASDISVSALDLAKENANNCDAEVTFIESDVFSNISGKEDIIVS180
           GAIAISLKKERP+W V ASDIS +ALDLAK NA+      ++TFIESDVFS  IS   FDIIVS
Sbjct: 121 GAIAISLKKERPNWQVTASDISRAALDLAKANADAYQLDITFIESDVFSLISETEDIIVS180

Query: 181 NPPYISYNDKDEVGKNVLASEPHSALFADEEGLAIYRKIIENSREYLQPRGKLYFEIGYK240
           NPPYISY DK+EV  NVL SEPH ALFA E G AIYRKIIE +   YL   GKLYFEIGYK
Sbjct: 181 NPPYISYEDKEEVSLNVLQSEPHLALFAKENGYAIYRKIIEQADNYLTKEGKLYFEIGYK240

Query: 241 QGDDLRSLLKRYFPNNRCRVLKDIFGKDRMVVLD                           274
           Q + ++ +L+ YFP    R + DIFGK+RMVV+D
Sbjct: 241 QAEGIKDMLQAYFPQRHIRAVTDIFGKERMVVVD                           274
```

Based on this analysis, it was predicted that these proteins and their epitopes could be useful antigens for vaccines or diagnostics.

Example 2128

A DNA sequence (GBSx2244) was identified in *S. agalactiae* <SEQ ID 6571> which encodes the amino acid sequence <SEQ ID 6572>. This protein is predicted to be peptide chain release factor RF-1 (prfA). Analysis of this protein sequence reveals the following:

```
>GP:CAB15718 GB:Z99122 peptide chain release factor 1 [Bacillus subtilis]
Identities = 211/351 (60%), Positives = 280/351 (79%), Gaps = 1/351 (0%)
Query:   5 DQLQAVEDRYEELGELLSDPDVVSDTKRFMELSREEASTRETVTAYREYKQVIQNISDAE 64
           D+L+++E+RYE+L ELLSDP+VV+D K+  E S+E++    +ETV   YR+Y+    + ++DA+
Sbjct:   3 DRLKSIEERYEKLNELLSDPEVVNDPKKLREYSKEQSDIQETVDVYRQYRDASEQLADAK 62

Query:  65 EMIKDASGDAELEEMAKEELKESKAAKEEYEERLKILLLPKDPNDDKNIILEIRGAAGGD124
              M+++    DAE+  +M KEE+ E  +    E     ERLK+LL+PKDPNDDKN+I +EIRGAAGG+
Sbjct:  63 AMLEEKL-DAEMRDMVKEEISELQKETETLSERLKVLLIPKDPNDDKNVIMEIRGAAGGE121

Query: 125 EAALFAGDLLTMYQKYAETQGWRFEVMESSVNGVGGIKEVVAMSGQSVYSKLKYESGAH184
           EAALFAG+L   MY +YAE QGW+  EVME++V G GG KE++  M++G    YSKLKYE+GAH
Sbjct: 122 EAALFAGNLYRMYSRYAELQGWKTEVMEANVTGTGGYKEIIFMITGSGAYSKLKYENGAH181
```

```
-continued
Query: 185  RVQRVPVTESQGRVHTSTATVLVMPEVEEVEYEIDQKDLRVDIYHASGAGGQNVNKVATA 244
            RVQRVP TES GR+HTSTATV  +PE EEVE +I +KD+RVD + +SG GGQ+VN    +A
Sbjct: 182  RVQRVPETESGGRIHTSTATVACLPEAEEVEVDIHEKDIRVDTFASSGPGGQSVNTTMSA 241

Query: 245  VRMVHIPTGIKVEMQEERTQQKNRDKAMKIIRARVADHFAQIAQDEQDAERKSTVGTGDR 304
            VR+ H+PTG+ V   Q+E++Q KN++KAMK++RAR+ D F Q  AQ E D   RKS VG+GDR
Sbjct: 242  VRLTHLPTGVVVSCQDEKSQIKNKEKA-                                 301
            MKVLRARIYDKFQQEAQAEYDQTRKSAVGSGDR Query: 305  SERIRTYNFPQNRVTDHRIGLTLQKLDTILSGKMDEVIDALVMYDQTQKLE           355
            SERIRTYNFPQNRVTDHRIGLT+QKLD IL GK+DEV++AL++ DQ  KL+
Sbjct: 302  SERIRTYNFPQNRVTDHRIGLTIQKLDQILEGKLDEVVEALIVEDQASKLQ           352
```

A related DNA sequence was identified in *S. pyogenes* <SEQ ID 6573> which encodes the amino acid sequence <SEQ ID 6574>. Analysis of this protein sequence reveals the following:

Possible site: 28
>>> Seems to have no N-terminal signal sequence
----- Final Results -----
   bacterial cytoplasm --- Certainty = 0.3446 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 349/358 (97%), Positives = 354/358 (98%)
Query:   1  MNIYDQLQAVEDRYEELGELLSDPDVVSDTKRFMELSREEASTRETVTAYREYKQVIQNI 60
            MNIYDQLQAVEDRYEELGELLSDPDVVSDTKRFMELSREE +TRETVTAYREYKQVIQ I
Sbjct:   1  MNIYDQLQAVEDRYEELGELLSDPDVVSDTKRFMELSREETNTRETVTAYREYKQVIQTI 60

Query:  61  SDAEEMIKDASGDAELEEMAKEELKESKAAKEEYEERLKILLLPKDPNDDKNIILEIRGA 120
            SDAEEMIKDASGD ELEEMA+EELKESKAAKEEYEE+LKILLLPKDPNDDKNIILEIRGA
Sbjct:  61  SDAEEMIKDASGDPELEEMAKEELKESKAAKEEYEEKLKILLLPKDPNDDKNIILEIRGA 120

Query: 121  AGGDEAALFAGDLLTMYQKYAETQGWRFEVMESSVNGVGGIKEVVAMVSGQSVYSKLKYE 180
            AGGDEAALFAGDLLTMYQKYAETQGWRFEVMESSVNGVGGIKEVVAMVSGQSVYSKLKYE
Sbjct: 121  AGGDEAALFAGDLLTMYQKYAETQGWRFEVMESSVNGVGGIKEVVAMVSGQSVYSKLKYE 180

Query: 181  SGAHRVQRVPVTESQGRVHTSTATVLVMPEVEEVEYEIDQKDLRVDIYHASGAGGQNVNK 240
            SGAHRVQRVPVTESQGRVHTSTATVLVMPEVEEVEY+ID KDLRVDIYHASGAGGQNVNK
Sbjct: 181  SGAHRVQRVPVTESQGRVHTSTATVLVMPEVEEVEYDIDPKDLRVDIYHASGAGGQNVNK 240

Query: 241  VATAVRMVHIPTGIKVEMQEERTQQKNRDKAMKIIRARVADHFAQIAQDEQDAERKSTVG 300
            VATAVRMVHIPTGIKVEMQEERTQQKNRDKAMKIIRARVADHFAQIAQDEQDAERKSTVG
Sbjct: 241  VATAVRMVHIPTGIKVEMQEERTQQKNRDKAMKIIRARVADHFAQIAQDEQDAERKSTVG 300

Query: 301  TGDRSERIRTYNFPQNRVTDHRIGLTLQKLDTILSGKMDEVIDALVMYDQTQKLEALN    358
            TGDRSERIRTYNFPQNRVTDHRIGLTLQKLDTILSGKMDEVIDALVMYDQT+KLE+LN
Sbjct: 301  TGDRSERIRTYNFPQNRVTDHRIGLTLQKLDTILSGKMDEVIDALVMYDQTKKLESLN    358
```

Based on this analysis, it was predicted that these proteins and their epitopes could be useful antigens for vaccines or diagnostics.

Example 2129

A DNA sequence (GBSx2245) was identified in *S. agalactiae* <SEQ ID 6575> which encodes the amino acid sequence <SEQ ID 6576>. This protein is predicted to be thymidine kinase (tdk). Analysis of this protein sequence reveals the following:

Possible site: 39
>>> Seems to have no N-terminal signal sequence
----- Final Results -----
   bacterial cytoplasm --- Certainty = 0.2244 (Affirmative) <succ>
   bacterial membrane --- Certainty = 0.0000 (Not Clear) <succ>
   bacterial outside --- Certainty = 0.0000 (Not Clear) <succ>

A related GBS nucleic acid sequence <SEQ ID 9841> which encodes amino acid sequence <SEQ ID 9842> was also identified.

The protein has homology with the following sequences in the GENPEPT database.

```
>GP:AAB02289 GB:L40415 thymidine kinase [Streptococcus gordonii]
Identities = 158/189 (83%), Positives = 175/189 (91%)
Query:   1  MAQLYYKYGTMNSGKTIEILKVAHNYEEQGKPVVIMTSALDTRDEFGVVSSRIGMRREAV 60
            MAQLYYKYGTMNSGKTIEILKVAHNYEEQGK VVIMTSA+DTRD  G VSSRIGM+R+A+
Sbjct:   1  MAQLYYKYGTMNSGKTIEILKVAHNYEEQGKGVVIMTSAVDTRDGVGYVSSRIGMKRQAM 60

Query:  61  PISDDMDIFSYIQNLPQKPYCVLIDECQFLSKKNVYDLARVVDDLDVPVMAFGLIMDFQN 120
            I DD DI  YI+NLP+KPYC+LIDE QFL + +VYDLARVVD+LDVPVMAFGLKNDF+N
```

```
                              -continued
Sbjct:   61 AIEDDTDILGYIKNLPEKPYCILIDEAQFLKRHHVYDLARVVDELDVPVMAFGLKNDFRN 120

Query:  121 NLFEGSKHLLLLADKIDEIKTICQYCSKKATMVLRTENGKPVYEGDQIQIGGNETYIPVC 180
            LFEGSKHLLLLADKI+EIKTICQYCS+KATMVLRT++GKPVY+G+QIQIGGNETYIPVC
Sbjct:  121 ELFEGSKHLLLLADKIEEIKTICQYCSRKATMVLRTDHGKPVYDGEQIQIGGNETYIPVC 180

Query:  181 RKHYFNPDI                                                   189
            RKHYF PDI
Sbjct:  181 RKHYFKPDI                                                   189
```

A related DNA sequence was identified in *S. pyogenes* <SEQ ID 6577> which encodes the amino acid sequence <SEQ ID 6578>. Analysis of this protein sequence reveals the following:

---

Possible site: 39
>>> Seems to have no N-terminal signal sequence
----- Final Results -----
   bacterial cytoplasm --- Certainty = 0.2244 (Affirmative) <succ>
   bacterial membrane --- Certainty = 0.0000 (Not Clear) <succ>
   bacterial outside --- Certainty = 0.0000 (Not Clear) <succ>

---

An alignment of the GAS and GBS proteins is shown below.

```
Identities = 174/189 (92%), Positives = 184/189 (97%)
Query:    1 MAQLYYKYGTMNSGKTIEILKVAHNYEEQGKPVVIMTSALDTRDEFGVVSSRIGMRREAV  60
            +AQLYYKYGTMNSGKTIEILKVAHNYEEQGKPVVIMTSALDTRD FG+VSSRIGMRREA+
Sbjct:    1 LAQLYYKYGTMNSGKTIEILKVAHNYEEQGKPVVIMTSALDTRDGFGIVSSRIGMRREAI  60

Query:   61 PISDDMDIFSYIQNLPQKPYCVLIDECQFLSKKNVYDLARVVDDLDVPVMAFGLKNDFQN 120
            PIS+DMDIF++I  L +KPYCVLIDE QFLSK+NVYDLARVVD+L+VPVMAFGLKNDFQN
Sbjct:   61 PISNDMDIFTFIAQLEEKPYCVLIDESQFLSKQNVYDLARVVDELNVPVMAFGLKNDFQN 120

Query:  121 NLFEGSKHLLLLADKIDEIKTICQYCSKKATMVLRTENGKPVYEGDQIQIGGNETYIPVC 180
            NLFEGSK LLLLADKIDEIKTICQYCSKKATMVLRTENGKPVYEGDQIQIGGNETYIPVC
Sbjct:  121 NLFEGSKELLLLADKIDEIKTICQYCSKKATMVLRTENGKPVYEGDQIQIGGNETYIPVC 180

Query:  181 RKHYFNPDI                                                   189
            RKHYFNPDI
Sbjct: :181 RKHYFNPDI                                                   189
```

Based on this analysis, it was predicted that these proteins and their epitopes could be useful antigens for vaccines or diagnostics.

Example 2130

A DNA sequence (GBSx2246) was identified in *S. agalactiae* <SEQ ID 6579> which encodes the amino acid sequence <SEQ ID 6580>. Analysis of this protein sequence reveals the following:

---

Possible site: 34
>>> Seems to have no N-terminal signal sequence
----- Final Results -----
   bacterial cytoplasm --- Certainty = 0.3995 (Affirmative) <succ>
   bacterial membrane --- Certainty = 0.0000 (Not Clear) <succ>
   bacterial outside --- Certainty = 0.0000 (Not Clear) <succ>

---

The protein has homology with the following sequences in the GENPEPT database.

```
>GP:AAA26046 GB:M95650 4-oxalocrotonate tautomerase [Plasmid pWW0]
Identities = 27/60 (45%), Positives = 36/60 (60%)
Query: 1    MPFVKIDLFEGRSQEQKNELAREVTEVVSRIAKAPKENIHVFINDMPEGTYYPQGELKKK60
            MP +I + EGRS EQK  L REV+E +SR   AP ++   V I +M +G +   GEL  K
Sbjct: 1    MPIAQIHILEGRSDEQKETLIREVSKAISRSLDAPLTSVRVIITEMAKGHFGIGGELASK60
```

A related DNA sequence was identified in *S. pyogenes* <SEQ ID 6581> which encodes the amino acid sequence <SEQ ID 6582>. Analysis of this protein sequence reveals the following:

```
Possible site: 34
>>> Seems to have no N-terminal signal sequence
----- Final Results -----
    bacterial cytoplasm --- Certainty = 0.4128 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
Identities = 56/60 (93%), Positives = 59/60 (98%)
Query: 1    MPFVKIDLFEGRSQEQKNELAREVTEVVSRIAKAPKENIHVFINDMPEGTYYPQGELKKK60
            MPFV IDLFEGRSQEQKN+LAREVTEVVSRIAKAPKENIHVFINDMPEGTYYPQGE+K+K
Sbjct: 1    MPFVTIDLFEGRSQEQKNQLAREVTEVVSRIAKAPKENIHVFINDMPEGTYYPQGEMKQK60
```

Based on this analysis, it was predicted that these proteins and their epitopes could be useful antigens for vaccines or diagnostics.

Example 2131

A DNA sequence (GBSx2247) was identified in *S. agalactiae* <SEQ ID 6583> which encodes the amino acid sequence <SEQ ID 6584>. Analysis of this protein sequence reveals the following:

```
Possible site: 57
>>> Seems to have no N-terminal signal sequence
----- Final Results -----
    bacterial cytoplasm --- Certainty = 0.2154 (Affirmative) <succ>
    bacterial membrane --- Certainty = 0.0000 (Not Clear) <succ>
    bacterial outside --- Certainty = 0.0000 (Not Clear) <succ>
```

A related GBS nucleic acid sequence <SEQ ID 9843> which encodes amino acid sequence <SEQ ID 9844> was also identified.

The protein has homology with the following sequences in the GENPEPT database.

```
>GP:AAC65759 GB:AE001250 conserved hypothetical protein [Treponema
pallidum]

Identities = 103/317 (32%), Positives = 163/317 (50%), Gaps = 15/317 (4%)
Query:   7  QLSHSLRLMGTTIDIQINSKNAQKQIR----EVIELLELYKNRFSANDFNSELMAINNNA 62
            + S +  ++GT   +++ SK     ++        EV LL+    +   SAN  +S L A+N A
Sbjct:  31  EYSRAELVIGTLCRVRVYSKRPAAEVHAALEEVFTLLQQQEMVLSANRDDSALAALNAQA 90

Query:  63  GIKPIQVHPDLFELITIGKEHSLARPSNLNIAIGPLVQTWRIGFSDAKLPSPSEISEAMI 122
            G   P+ V   L+ L+       +        N A+G  V+ W IGF  A +P P  + EA+
Sbjct:  91  GSAPVVVDRSLYALLERALFFAEKSGGAFNPALGAXVKLWNIGFDRAAVPDPDALKEALT 150

Query: 123  LSDPTHILLDSN-----KQSVFLNQIGMKIDLGALAKGYIADKIMTYLKNEMIDSAIINL 177
             D   + L +        +V L Q GM++DLGA+AKG++ADKI+   L    +DSA+++L
Sbjct: 151  RCDFRQVHLRAGVSVGAPHTVQLAQAGMQLDLGAIAKGFLADKIVQLLTAHALDSALVDL 210

Query: 178  GGNV----LVHGDNPNRSEGY--WVIGIQHPKKKRGKNIGTVKIKNQSVVTSGTYERRLI 231
            GGN+     L +GD + +       W +GI+ P       K    V +++ SVVTSG YER
Sbjct: 211  GGNIFALGLKYGDVRSAAAQRLEWNVGIRDPHGTGQKPALVVSVRDCSVVTSGAYERFFE 270

Query: 232  IDDKEYHHIFDRQTGYPIQTEMASISIVSKQSVDCEIWTTRLFGLSIKEALDILNAVSYI 291
             D    YHHI D  TG+P  T++   S+SI + +S D +    T  F L  +++   +L      +
Sbjct: 271  RDGVRYHHIIDPVTGFPAHTDVDSVSIFAPRSTDADALATACFVLGYEKSCALLREFPGV 330

Query: 292  EGIIITKDDRIYLSDGL                                            308
            +  +  I   D R+   S G+
Sbjct: 331  DALFIFPDKRVRASAGI                                            347
```

A related DNA sequence was identified in *S. pyogenes* <SEQ ID 6585> which encodes the amino acid sequence <SEQ ID 6586>. Analysis of this protein sequence reveals the following:

```
Possible site: 52
>>> Seems to have no N-terminal signal sequence
----- Final Results -----
   bacterial cytoplasm --- Certainty = 0.1020 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below.

```
Identities = 182/310 (58%), Positives = 232/310 (74%)
Query:   8 LSHSLRLMGTTIDIQINSKNAQKQIRE-                                  67
             VIELLELYKNRFSANDFNSELMAINNNAGIKPI
           ++  L+LMGT IDIQI S  A +Q+  VI+LL  YKNRFSAND NSELMAIN  AG+KP+
Sbjct:   3 VTQQLKLMGTVIDIQIESDKACQQLSRVIDLLYTYKNRFSANDSNSELMAINQAAGVKPV  62

Query:  68 QVHPDLFELITIGKEHSLARPSNLNIAIGPLVQTWRIGESDAKLPSPSEISEAMILSDPT 127
              VH DLF LI IGK HSL+ PSNLNIAIGPLVQ WRIGF DA++PS + IS+ + L+DP
Sbjct:  63 SVHSDLFNLIQIGKAHSLSTPSNLNIAIGPLVQAWRIGFEDARVPSHNLISQQLALTDPR 122

Query: 128 HILLDSNKQSVFLNQIGMKIDLGALAKGYIADKIMTYLKNEMIDSAIINLGGNVLVHGDN 187
             +L+D   KQ+VFL Q+GM +DLGALAKGYI DKIM YL  + IDSA+INLGGNV VHG N
Sbjct: 123 QVLIDDKKQTVFLQQVGMALDLGALAKGYITDKIMAYLIEDGIDSALINLGGNVRVHGPN 182

Query: 188 PNRSEGYWVIGIQHPKKKRGKNIGTVKIKNQSVVTSGTYERRLIIDDKEYHHIFDRQTGY 247
           P   +  + IGIQ P  KRG+++G +K+ N SVVTSG YER+    K+YHHI DRQTGY
Sbjct: 183 PKSPDKTFRIGIQKPDAKRGQHLGVIKVNNHSVVTSGIYERQFTSKGKQYHHILDRQTGY 242

Query: 248 PIQTEMASISIVSKQSVDCEIWTTRLFGLSIKEALDILNAVSYIEGIIITKDDRIYLSDG 307
           PI+T+M S++I++  S  C+IWTTRLFGL   + +LN   IEG+++T+   + +S+G
Sbjct: 243 PIETDMLSLTIMAPSSFYCDIWITRLFGLESSMIITLLNTFDNIEGLLVTRKHHVLMSNG 302

Query: 308 LKHHFQLFYH                                                   317
           L+H+FQ +YH
Sbjct: 303 LRHYFQPYYH                                                   312
```

Based on this analysis, it was predicted that these proteins and their epitopes could be useful antigens for vaccines or diagnostics.

Example 2132

A DNA sequence (GBSx2248) was identified in *S. agalactiae* <SEQ ID 6587> which encodes the amino acid sequence <SEQ ID 6588>. Analysis of this protein sequence reveals the following:

```
Possible site: 31
>>> Seems to have no N-terminal signal sequence
----- Final Results -----
   bacterial cytoplasm --- Certainty = 0.0966 (Affirmative) <succ>
   bacterial membrane --- Certainty = 0.0000 (Not Clear) <succ>
   bacterial outside --- Certainty = 0.0000 (Not Clear) <succ>
```

The protein has homology with the following sequences in the GENPEPT database.

```
>GP:AAG18632 GB:AY007504 unknown [Streptococcus mitis]

Identities = 92/160 (57%), Positives = 119/160 (73%), Gaps = 1/160 (0%)
Query:   1 MKLIGIVGTNSNKSTNRQLLQYMQQHFADKAEIELIEVKDLPLFNKPADKNVPQVILDIA  60
           MKL+ IVGTNSN+STNR+LL++MQ+HF+DKA+IE++E+K LP FN+P D+  P  +   +
Sbjct:   1 MKLVAIVGTNSNRSTNRKLLKFMQKHFSDKADIEVLEIKQLPAFNEPEDEQAPAEVQAFS  60

Query:  61 AKIEETDGVIIGTPEYDHSIPSALMSVLAWLSYGIYPLLNKPVMITGASYGTLGSSRAQL 120
            KI   DGVII TPEYDH+IP+L  S L W++Y    L+NKP MI GAS G LG+SRAQ
Sbjct:  61 EKILAADGVIISTPEYDHTIPAPLASALEWIAYTSRALINKPTMIVGASLGLLGTSRAQA 120

Query: 121 QLRQILNAPELKASVLP-DEFLLSHSLQAFDKDGNLHDIE                     159
           LRQIL+APELKA V+P  EF L HS Q  D + +L++ E
Sbjct: 121 HLRQILDAPELKARVMPGTEFFLGHSEQVLDDECHLNNPE                     160
```

A related DNA sequence was identified in *S. pyogenes* <SEQ ID 6589> which encodes the amino acid sequence <SEQ ID 6590>. Analysis of this protein sequence reveals the following:

```
Possible site: 24
 >>> Seems to have an uncleavable N-term signal seq
 ----- Final Results -----
    bacterial membrane --- Certainty = 0.0000 (Not Clear) <succ>
     bacterial outside --- Certainty = 0.0000 (Not Clear) <succ>
    bacterial cytoplasm --- Certainty = 0.0000 (Not Clear) <succ>
```

The protein has homology with the following sequences in the databases:

```
>GP:CAB62679 GB:AL133422 putative secreted protein. [Streptomyces
coelicolor A3(2)]
Identities = 68/192 (35%), Positives = 94/192 (48%), Gaps = 25/192 (13%)
Query:   4 ILFIVGSLREGSFNHQLAAQAQK-ALEHQAVVSYLNWKDVPVLNQDIEANAPLPVVDA-- 60
           IL +VGSLR GS N QLA  A + A E   V  +    ++P  N+DI+    +P   A
Sbjct:   5 ILALVGSLRAGSHNRQLAEAAVRFAPEGAEVQLFEGLAEIPFYNEDIDVEGSVPAAAAKL 64

Query:  61 RQAVQSADAIWIFTPVYNFSIPGSVKNLLDWLSRALDLSDPTGPSAIGGKVVTVSSVANG 120
           R+A Q A A  +F+P YN  +IP +KN +DWLSR       P G  A  GK V V   A G
Sbjct:  65 REAAQGAQAFLLFSPEYNGTIPAVLKNAIDWLSR------PYGAGAFTGKPVAVVGTAFG 118

Query: 121 GHDQVFDQFKA----------LLPFIRTSVAGEFTK-ATVNP--DAWGTGRLEISKETKA 167
             +  V+ Q +A          ++   I+  S+  G  T+  +P  DA    +L     E  A
Sbjct: 119 QYGGVWAQDEARKAVGIAGGKVIEDIKLSIPGSVTRFAETHPADDAEVAAQL---TEVVA 175

Query: 168 NLLSQAEALLAA                                                 179
             L    A+  +AA
Sbjct: 176 RLHGHADEAIAA                                                 187
```

An alignment of the GAS and GBS proteins is shown below.

```
Identities = 28/90 (31%), Positives = 49/90 (54%)
Query:   3 LIGIVGTNSNKSTNRQLLQYMQQHFADKAEIELIEVKDLPLFNKPADKNVPQVILDIAAK 62
           ++ IVG+     S N QL   Q+    +A +  +   KD+P+ N+   + N P   ++D
Sbjct:   4 ILFIVGSLREGSFNHQLAAQAQKALEHQAVVSYLNWKDVPVLNQDIEANAPLPVVDARQA 63

Query:  63 IEETDGVIIGTPEYDHSIPSALMSVLAWLS                              92
           ++   D + I TP Y+ SIP ++ ++L WLS
Sbjct:  64 VQSADAIWIFTPVYNFSIPGSVKNLLDWLS                              93
```

Based on this analysis, it was predicted that these proteins and their epitopes could be useful antigens for vaccines or diagnostics.

Example 2133

A DNA sequence (GBSx2249) was identified in *S. agalactiae* <SEQ ID 6591> which encodes the amino acid sequence <SEQ ID 6592>. Analysis of this protein sequence reveals the following:

```
Possible site: 13
 >>> Seems to have no N-terminal signal sequence
 ----- Final Results -----
    bacterial cytoplasm --- Certainty = 0.1160 (Affirmative) <succ>
    bacterial membrane --- Certainty = 0.0000 (Not Clear) <succ>
     bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2134

A DNA sequence (GBSx2250) was identified in *S. agalactiae* <SEQ ID 6593> which encodes the amino acid sequence <SEQ ID 6594>. Analysis of this protein sequence reveals the following:

```
Possible site: 14
 >>> Seems to have no N-terminal signal sequence
 ----- Final Results -----
    bacterial cytoplasm --- Certainty = 0.2132 (Affirmative) <succ>
    bacterial membrane --- Certainty = 0.0000 (Not Clear) <succ>
     bacterial outside --- Certainty = 0.0000 (Not Clear) <succ>
```

The protein has homology with the following sequences in the GENPEPT database.

```
>GP:AAG18632 GB:AY007504 unknown [Streptococcus mitis]
Identities = 80/162 (49%), Positives = 112/162 (68%)
Query:   1 MKFVGIVGSNAEQSYNRMLLEFIRKNFKTKFELEVLEIDDIPMFNQDQNWEESFQLRLLN 60
```

```
              MK V IVG+N+ +S NR LL+F++K+F  K ++EVLEI  +P FN+ ++ +   +++  +
Sbjct:   1    MKLVAIVGTNSERSTNRKLLKFMQKHFSDKADIEVLEIKQLPAFNEPEDEQAPAEVQAFS   60

Query:  61    NKITRADGVIIATPEHNHTITAALKSVLEWLSFAVHPLENKPVMIVGASYYDQGTSRAQI   120
              KI  ADGVII+TPE++HTI A L S LEW+++    L NKP MIVGAS    GTSRAQ
Sbjct:  61    EKILAADGVIISTPEYDHTIPAPLASALEWIAYTSRALINKPTMIVGASLGLLGTSRAQA   120

Query: 121    HLRKILDAPGVNAYTLPGNEFLLGKAKEAFDDNGNIINPGTV                   162
              HLR+ILDAP + A  +PG EF LG +++  DD   ++ NP  V
Sbjct: 121    HLRQILDAPELKARVMPGTEFFLGHSEQVLDDECHLNNPEKV                   162
```

There is also homology to SEQ ID 6596.

Based on this analysis, it was predicted that this protein and its epitopes, could be useful antigens for vaccines or diagnostics.

Example 2135

A DNA sequence (GBSx2251) was identified in *S. agalactiae* <SEQ ID 6597> which encodes the amino acid sequence <SEQ ID 6598>. Analysis of this protein sequence reveals the following:

---

Possible site: 21
>>> Seems to have no N-terminal signal sequence
INTEGRAL     Likelihood = −7.32    Transmembrane 13-29 (11-29)
----- Final Results -----
   bacterial membrane --- Certainty = 0.3930 (Affirmative) <succ>

Example 2136

A DNA sequence (GBSx2252) was identified in *S. agalactiae* <SEQ ID 6599> which encodes the amino acid sequence <SEQ ID 6600>. This protein is predicted to be potential nitrite transporter. Analysis of this protein sequence reveals the following:

---

Possible site: 42
>>> Seems to have no N-terminal signal sequence
INTEGRAL     Likelihood = −9.92    Transmembrane 61-77 (54-82)
INTEGRAL     Likelihood = −5.57    Transmembrane 106-122 (103-126)
INTEGRAL     Likelihood = −5.15    Transmembrane 160-176 (159-177)
INTEGRAL     Likelihood = −4.09    Transmembrane 180-196 (179-199)
INTEGRAL     Likelihood = −1.01    Transmembrane 233-249 (233-249)
----- Final Results -----
   bacterial membrane --- Certainty = 0.4970 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database.

```
>GP:CAB15832 GB:Z99123 alternate gene name: ipa-48r-similar to nitrite
transporter [Bacillus subtilis]
Identities = 82/253 (32%), Positives = 119/253 (46%), Gaps = 10/253 (3%)
Query:   6    EKIAYNCAKKBALYKESLGRYALRSMLAGAYLTMSTAAGIVAADTIGK-ISPALSGFVF-    63
              +K+     KK+ ++  S  RY LRS+LA  ++     GI AA  G      A SF F
Sbjct:   7    QKVEQYALKKQNIFASSKIRYVLRSILASIFIGF----GITAASKTGSYFFMADSPFAFP    62

Query:  64    --AFIFSFGLIYVLIFNGELATSNMLYLTAGAYNKNISWKKAMTILIYCTFFNLVGACIL   121
                A F  ++ +   G+L T N  Y T A  K ISW+  + + +    NL+GA +
Sbjct:  63    AAAVTFGAAILMIAYGGGDLFTGNTFYFTYTALRKKISWRDTLYLWESSYAGNLIGAILF   122

Query: 122    AWLFNQSYSFQHLTNDSFLGHVVAKKLGKPSSGAFLEGIIANMFVNLAILAYMLLKEESA   181
              A L ++  F+  +  SFL H+    K+  P+S  F  G++   N  V LA    M LK E A
Sbjct: 123    AILISATGLFEEPSVHSFLIHLAEHKMEPPASELFFRGMLCNWLVCLAFFIPMSLKGEGA   182

Query: 182    KMTVILSAIFMFVFLSNEHLIANFASFMLAAFSHIEHIKGFTLLNIIRQWTLVFFGNWIG   241
              K+ ++  +F F    EH IAN +F ++     IEH    TL+  +R    V  GN
Sbjct: 183    KLFTMMLFVFCFFISGFEHSIANMCTFAISLL--IEHPDTVTLMGAVRNLIPVTLGNLTA   240

Query: 242    GGVFIGLAYAWLN                                                254
              G V +G  Y  LN
Sbjct: 241    GIVMMGEMYYTLN                                                253
```

-continued bacterial outside --- Certainty = 0.0000 (Not Clear) <succ>
   bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

A related DNA sequence was identified in *S. pyogenes* <SEQ ID 6601> which encodes the amino acid sequence <SEQ ID 6602>. Analysis of this protein sequence reveals the following:

---

Possible site: 32
>>> Seems to have no N-terminal signal sequence
INTEGRAL     Likelihood = −9.77    Transmembrane 142-158 (139-171)
INTEGRAL     Likelihood = −9.34    Transmembrane 95-111 (89-119)
INTEGRAL     Likelihood = −2.02    Transmembrane 61-77 (61-79)
INTEGRAL     Likelihood = −1.12    Transmembrane 261-277 (261-279)
INTEGRAL     Likelihood = −0.53    Transmembrane 191-207 (191-207)
----- Final Results -----
   bacterial membrane --- Certainty = 0.4906 (Affirmative) <succ>

-continued bacterial outside --- Certainty = 0.0000 (Not Clear) <succ>
bacterial cytoplasm --- Certainty = 0.0000 (Not Clear) <succ>

The protein has homology with the following sequences in the databases:

```
>GP:AAB80864 GB:U93874 formate dehydrogenase [Bacillus subtilis]
Identities = 133/258 (51%), Positives = 181/258 (69%)
Query: 36    KTPEQILEATIHIGEHKVTKTFLAKSILGFIGGAMISLGYLLYVRIAASGLETFGAFSSI    95
             + P++I EA I  G  K+      +  +LGF+GGA I+LGYLL +R+      + +G+ SS+
Sbjct: 4     RKPDEIAEAAIEAGMKKIKLPLPSLLVLGFLGGAFIALGYLLDIRVIGDLPKEWGSLSSL    63

Query: 96    VGACAFPIGLIIILMAGGELITGNMMAVSAALLAKKIKFSELAKNWLIITLFNVIGAVFV    155
             +GA  FP+GLI++++AG ELITGNMM+V+ AL ++KI   ELA NW I+T+ N+IGA+FV
Sbjct: 64    IGAAVFPVGLILVVLAGAELITGNMMSVAMALFSRKISVKELAINWGIVTIMNLIGALFV    123

Query: 156   AFVFGHFLGLTSAGIFKEEVIEVAHAKIAASPLQALVSGIGCNWFVGLALWLCYGANDAA    215
             A+ FGH +GLT  G + E+ I VA  K+  S   + L+S IGCNW V LA+WL +GA DAA
Sbjct: 124   AYFFGHLVGLTETGPYLEKTIAVAQGKLDMSFGKVLISAIGCNWLVCLAVWLSFGAQDAA    183

Query: 216   GKFLGTWFPVMTFVALGFQHSVANAFVIPAAIFEGGATWLDFVTNFIFVYSGNIIGGAIF    275
             GK LG WFP+M FVA+GFQH VAN FVIPAAIF G   TW  F+ N I  + GN+IGGA+F
Sbjct: 184   GKILGIWFPIMAFVAIGFQHVVANMFVIPAAIFAGSFTWGQFIGNIIPAFIGNVIGGAVF    243

Query: 276   VSFLYFKVYYHPQKSKTQ                                             293
             V  +YF  Y+    +S+ +
Sbjct: 244   VGLIYFIAYHKKDRSRKE                                             261
```

An alignment of the GAS and GBS proteins is shown below.

```
Identities = 69/240 (28%), Positives = 101/240 (410), Gaps = 18/240 (7%)
Query: 15    KEALYKESLGRYALRSMLAGAYLTMSTAAGIVAADTIGKISPALSGFVFAFIFSEGLIYV    74
             K  L K  LG       + G  L +  AA       +T G    AS  V A F  GLI +
Sbjct: 55    KTFLAKSILGFIGGAMISLGYLLYVRIAAS--GLETFG----AFSSIVGACAFPIGLIII    108

Query: 75    LIFNGELATSNMLYLTAGAYNKNISWKKAMTILIYCTFFNLVGACILAWLFNQSYSFQHL    134
             L+  GEL T NM+ ++A    K I + +       + T FN++GA  +A++F    F  L
Sbjct: 109   LMAGGELITGNMMANSAALLAKKIKFSELAKNWLIITLFNVIGAVFVAFVFGH---FLGL    165

Query: 135   TNDSFLGHVVAK----KLGKPSSGAFLEGIIANMFVNLAILAYMLLKEESAKMTVILSAI    190
             T+      V +  K+        A + GI  N FV LA+        + + K        +
Sbjct: 166   TSAGIFKEEVIEVAHAKIAASPLQALVSGIGCNWFVGLALWLCYGANDAAGKFLGTWFPV    225

Query: 191   FMFVFLSNEHLIANFASFMLAAFSHIEHIKGFTLLNIIRQWTLVFFGNWIGGGVFIGLAY    250
                FV L  +H +AN     A F       G T L+  +    V+ GN IGG +F+    Y
Sbjct: 226   MTFVALGFQHSVANAFVIPAAIFE-----GGATWLDFVTNFIFVYSGNIIGGAIFVSFLY    280
```

Based on this analysis, it was predicted that these proteins and their epitopes could be useful antigens for vaccines or diagnostics.

Example 2137

A DNA sequence (GBSx2253) was identified in *S. agalactiae* <SEQ ID 6603> which encodes the amino acid sequence <SEQ ID 6604>. Analysis of this protein sequence reveals the following:

Possible site: 56
>>> Seems to have no N-terminal signal sequence
----- Final Results -----
  bacterial cytoplasm --- Certainty = 0.1342 (Affirmative) <succ>
  bacterial membrane --- Certainty = 0.0000 (Not Clear) <succ>
  bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2138

A DNA sequence (GBSx2254) was identified in *S. agalactiae* <SEQ ID 6605> which encodes the amino acid sequence <SEQ ID 6606>. Analysis of this protein sequence reveals the following:

Possible site: 50
>>> Seems to have no N-terminal signal sequence
INTEGRAL   Likelihood = -0.22   Transmembrane 44-60 (44-60)
----- Final Results -----
  bacterial membrane --- Certainty = 0.1086 (Affirmative) <succ>
  bacterial outside --- Certainty = 0.0000 (Not Clear) <succ>
  bacterial cytoplasm --- Certainty = 0.0000 (Not Clear) <succ>

The protein has no significant homology with any sequences in the GENPEPT database.

No corresponding DNA sequence was identified in *S. pyogenes*.

Example 2139

A DNA sequence (GBSx2255) was identified in *S. agalactiae* <SEQ ID 6607> which encodes the amino acid sequence <SEQ ID 6608>. This protein is predicted to be xanthine permease (pbuX). Analysis of this protein sequence reveals the following:

```
Possible site: 23
>>> Seems to have no N-terminal signal sequence
INTEGRAL    Likelihood = -7.91    Transmembrane 160-176 (156-188)
INTEGRAL    Likelihood = -6.48    Transmembrane 184-200 (179-211)
INTEGRAL    Likelihood = -6.21    Transmembrane 101-117 (96-121)
INTEGRAL    Likelihood = -4.04    Transmembrane 309-325 (306-332)
INTEGRAL    Likelihood = -3.98    Transmembrane 334-350 (331-353)
INTEGRAL    Likelihood = -3.88    Transmembrane 400-416 (396-420)
INTEGRAL    Likelihood = -3.45    Transmembrane 19-35 (18-38)
INTEGRAL    Likelihood = -2.81    Transmembrane 127-143 (127-146)
INTEGRAL    Likelihood = -2.71    Transmembrane 228-244 (227-249)
INTEGRAL    Likelihood = -2.02    Transmembrane 47-63 (47-63)
INTEGRAL    Likelihood = -1.97    Transmembrane 75-91 (73-92)
INTEGRAL    Likelihood = -0.85    Transmembrane 368-384 (368-384)
----- Final Results -----
    bacterial membrane --- Certainty = 0.4163 (Affirmative) <succ>
     bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

A related DNA sequence was identified in *S. pyogenes* <SEQ ID 6609> which encodes the amino acid sequence <SEQ ID 6610>. Analysis of this protein sequence reveals the following:

```
Possible site: 29
>>> Seems to have no N-terminal signal sequence
INTEGRAL    Likelihood = -7.32    Transmembrane 160-176 (158-181)
INTEGRAL    Likelihood = -6.37    Transmembrane 103-119 (98-124)
INTEGRAL    Likelihood = -5.84    Transmembrane 130-146 (126-152)
INTEGRAL    Likelihood = -5.68    Transmembrane 187-203 (182-207)
INTEGRAL    Likelihood = -3.98    Transmembrane 337-353 (334-356)
INTEGRAL    Likelihood = -3.82    Transmembrane 232-248 (225-252)
INTEGRAL    Likelihood = -3.35    Transmembrane 403-419 (399-421)
INTEGRAL    Likelihood = -2.50    Transmembrane 22-38 (21-41)
INTEGRAL    Likelihood = -2.07    Transmembrane 312-328 (312-328)
INTEGRAL    Likelihood = -1.97    Transmembrane 78-94 (76-95)
----- Final Results -----
    bacterial membrane --- Certainty = 0.3930 (Affirmative) <succ>
     bacterial outside --- Certainty = 0.0000 (Not Clear) <succ>
    bacterial cytoplasm --- Certainty = 0.0000 (Not Clear) <succ>
```

```
>GP:CAB14123 GB:Z99115 xanthine permease [Bacillus subtilis]
Identities = 213/412 (51%), Positives = 292/412 (70%), Gaps = 5/412 (1%)
Query:  14    LGLQHLLAMYAGSILVPIMIASALGYNAKQLTYLIATDIFMCGIATLLQLRLSKHFGVGL   73
              LG+QH+LAMYAG+I+VP+++  A+G   +QLTYL++ DIFMCG+ATLLQ+   ++ FG+GL
Sbjct:  11    LGIQHVLAMYAGAIVVPLIVGKAMGLTVEQLTYLVSIDIFMCGVATLLQVWSNRFFGIGL   70

Query:  74    PVVLGCAFQSVAPLSIIGAQQGSGYMFGALIASGIYVVLVAGIFSKVANFFPPIVTGSVI  133
              PVVLGC F +V+P+  IG++ G   ++G++IASGI V+L++   F K+ +FFPP+VTGSV+
Sbjct:  71    PVVLGCTFTAVSPMIAIGSEYGVSTVYGSIIASGILVILISFFFGKLVSFFPPVVTGSVV  130

Query: 134    TTIGLTLIPVAMGNMGD---NAKEPSLQSLTLSLVTIGVVLLINIFAKGFLKSISILIGL  190
              T IG+TL+PVAM NM      +A    L +L L+    + +++L+   F KGF+KS+SILIG+
Sbjct: 131    TIIGITLMPVAMNNMAGGEGSADFGDLSNLALAFTVLSIIVLLYRFTKGFIKSVSILIGI  190

Query: 191    ISGTILAAFMGLVDASVVADAPLVHIPKPFYFGAPRFEFTSILMMCIIATVSMVESTGVY  250
              + GT +A FMG V    V+DA +V + +PFYFGAP F    I+ M I+A VS+VESTGVY
Sbjct: 191    LIGTFIAYFMGKVQFDNVSDAAVVQMIQPFYFGAPSFHAAPIITMSIVAIVSLVESTGVY  250

Query: 251    LALSDITNDKLDSKRLRNGYRSEGLAVLLGGLFNTFPYTGFSQNVGLVQISGIRTRKPIY  310
                AL D+TN +L      L    GYR+RGLAVLLGG+FN FPYT FSQNVGLVQ++GI+      I
Sbjct: 251    FALGDLTNRRLTEIDLSKGYRAEGLAVLLGGIFNAFPYTAFSQNVGLVQLTGIKKNAVIV  310

Query: 311    FTALFLVILGLLPKFGAMAQMIPSPVLGGAMLVLFGMVALQGMKMLNQVDFEHNEHNFII  370
              T + L+   GL PK A    +IPS VLGGAM+ +FGMV  G+KML+++DF   E N +I
Sbjct: 311    VTGVILMAFGLFPKIAAFTTIIPSAVLGGAMVAMFGMVIAYGIKMLSRIDFAKQE-NLLI  369

Query: 371    AAVSIAAGVGFNGT-NLFISLPNTLQMFLTNGIVISTLTAVVLNIILNGLPK          421
              A S+  G+G      ++F  LP+ L +  TNGIV  + TAVVLNI+ N    K
Sbjct: 370    VACSVGLGLGVTVVPDIFKQLPSALTLLTTNGIVAGSFTAVVLNIVYNVFSK          421
```

The protein has homology with the following sequences in the databases:

```
>GP:CAB15234 GB:Z99120 similar to purine permease [Bacillus subtilis]
Identities = 216/421 (51%), Positives = 302/421 (71%), Gaps = 5/421 (1%)
Query:  6    KQEHSHSQSAVLGLQHVLSMYAGSILVPIMIAGALGYSARELTYLISTDIFMCGVATFLQ   65
```

```
                 K++H+   Q +LGLQH+L+MYAG+ILVP+++ A+G    +A +LTYLI+ D+FMCG AT LQ
      Sbjct: 2   KEQHNALQLMMLGLQHMLAMYAGAILVPLIVGAAIGLNAGQLTYLIAIDLFMCGAATLLQ   61

Query: 66  LKLTKHTGVGLPVVLGCAFQSVAPLSIIGAQQGSGAMFGALIASGIYVILVAGIFSKIAR  125
                 L    ++ G+GLPVVLGC F +V P+   IG+  G  A++GA+IA+G+ V+L AG F K+ R
      Sbjct: 62  LWRNRYFGIGLPVVLGCTFTAVGPMISIGSTYGVPAIYGAIIAAGLIVVLAAGFFGKLVR  121

Query: 126 FFPPIVTGSVITVIGLSLVGVAMGNM--GDNVKE-PTAQSMMLSLLTIVIILLVQKFTKG  182
                 FFPP+VTGSV+ +IG+SL+  AM N+  G+   KE +  +++L         ILL+  F KG
      Sbjct: 122 FFPPVVTGSVVMIIGISLIPTAMNNLAGGEGSKEFGSLDNVLLGFGVTAFILLLFYFFKG  181

Query: 183 FVKSISILIGLVAGTLVSAMMGLVDTTPVVEASWIHVPIPFYFGMPTFEITSIVMMCIIA  242
                 F++SI+IL+GL+AGT   +  MG VD +  V+EASW+HVP+ FYFG PTFE+ ++V M ++A
      Sbjct: 182 FIRSIAILLGLIAGTAAAYFMGKVDFSEVLEASWLHVPSLFYFGPPTFELPAVVTMLLVA  241

Query: 243 TVSMVESTGVYLALSDLTNDQLDEKRLRNGYRSEGIAVFLGGLFNTFPYTGFSQNVGLVQ  302
                  VS+VESTGVY AL+D+TN +L EK L   GYR+EG+A+ LGGLFN FPYT FSQNVG+VQ
      Sbjct: 242 IVSLVESTGVYFALADITNRRLSEKDLEKGYRAEGLAILLGGLFNAFPYTAFSQNVGIVQ  301

Query: 303 ISGIKTRRPIYYAAGILVVIGLLPKFRAMAQMIPSPVLGGAMLVLFGMVALQGMQMLNRV  362
                 +S +K+    I    ILV IGL+PK  A+  +IP+PVLGGAM+V+FGMV  G++ML+ V
      Sbjct: 302 LSKMKSVNVIAITGIILVAIGLVPKAAALTTVIPTPVLGGAMIVMFGMVISYGIKMLSSV  361

Query: 363 DFQKNEYNFIIAAVSISAGLGFNGT-NLFASLPETAQMFLTNGIVIATLTSVVLNLVLNGK  422
                 D   ++ N +I A S+S GLG     LF+SL  A +  +GIVI +LT++ L+       K
      Sbjct: 362 DLD-SQGNLLIIASSVSLGLGATTVPALFSSLSGAASVLAGSGIVIGSLTAIALHAFFQTK  421
```

An alignment of the GAS and GBS proteins is shown below.

```
      Identities = 328/416 (78%), Positives = 380/416 (90%)
      Query: 7   SNSQAALLGLQHLLAMYAGSILVPIMIASALGYNAKQLTYLIATDIFMCGIATLLQLRLS   66
                 S+SQ+A+LGLQH+L+MYAGSILVPIMIA ALGY+A++LTYLI+TDIFMCG+AT LQL+L+
      Sbjct: 10  SHSQSAVLGLQHVLSMYAGSILVPIMIAGALGYSARELTYLISTDIFMCGVATFLQLKLT   69

Query: 67  KHFGVGLPVVLGCAFQSVAPLSIIGAQQGSGYMFGALIASGIYVVLVAGIFSKVANFFPP  126
                 KH GVGLPVVLGCAFQSVAPLSIIGAQQGSG MFGALIASGIY+LVAGIFSK+A FFPP
      Sbjct: 70  KEIGVGLPVVLGCAFQSVAPLSIIGAQQGSGAMFGALIASGIYVILVAGIFSKIARFFPP  129

Query: 127 IVTGSVITTIGLTLIPVAMGNMGDNAKEPSLQSLTLSLVTIGVVLLINIFAKGFLKSISI  186
                 IVTGSVIT IGL+L+  VAMGNMGDN KEP+ QS+ LSL+TI ++LL+   F KGF+KSISI
      Sbjct: 130 IVTGSVITVIGLSLVGVAMGNMGDNVKEPTAQSMMLSLLTIVIILLVQKFTKGFVKSISI  189

Query: 187 LIGLISGTILAAFMGLVDASVVADAPLVHIPKPFYFGAPRFEFTSILMMCIIATVSMVES  246
                 LIGL++GT+++A MGLVD + V +A   +H+P PFYFG P FE TSI+MMCIIATVSMVES
      Sbjct: 190 LIGLVAGTLVSAMMGLVDTTPVVEASWIHVPTPFYFGMPTFEITSIVMMCIIATVSMVES  249

Query: 247 TGVYLALSDITNDKLDSKRLRNGYRSEGLAVLLGGLFNTFPYTGFSQNVGLVQISGIRTR  306
                 TGVYLALSD+TND+LD KRLRNGYRSEG+AV LGGLFNTFPYTGFSQNVGLVQISGI+TR
      Sbjct: 250 TGVYLALSDLTNDQLDEKRLRNGYRSEGIAVFLGGLFNTFPYTGFSQNVGLVQISGIKTR  309

Query: 307 KPIYFTALFLVILGLLPKFGAMAQMIPSPVLGGAMLVLFGMVALQGMKMLNQVDFEHNEH  366
                 +PIY+ A  LV++GLLPKF AMAQMIPSPVLGGAMLVLFGMVALQGM+MLN+VDF+ NE+
      Sbjct: 310 RPIYYAAGILVVIGLLPKFRAMAQMIPSPVLGGAMLVLFGMVALQGMQMLNRVDFQKNEY  369

Query: 367 NFIIAAVSIAAGVGFNGTNLFISLPNTLQMFLTNGIVISTLTAVVLNIILNGLPKK      422
                 NFIIAAVSI+AG+GFNGTNLF SLP T QMFLTNGIVI+TLT+VVLN++LNG K+
      Sbjct: 370 NFIIAAVSISAGLGFNGTNLFASLPETAQMFLTNGIVIATLTSVVLNLVLNGKDKQ      425
```

Based on this analysis, it was predicted that these proteins and their epitopes could be useful antigens for vaccines or diagnostics.

Example 2140

A DNA sequence (GBSx2256) was identified in *S. agalactiae* <SEQ ID 6611> which encodes the amino acid sequence <SEQ ID 6612>. This protein is predicted to be xanthine phosphoribosyltransferase (xpt). Analysis of this protein sequence reveals the following:

Possible site: 43

>>> Seems to have no N-terminal signal sequence

----- Final Results ----- bacterial cytoplasm --- Certainty = 0.1921 (Affirmative) <succ> bacterial membrane --- Certainty = 0.0000 (Not Clear) <succ> bacterial outside --- Certainty = 0.0000 (Not Clear) <succ>

The protein has homology with the following sequences in the GENPEPT database.

```
>GP:CAA13587 GB:AJ233894 xanthine phosphoribosyltransferase [Streptococcus
pneumoniae]
Identities = 133/162 (82%), Positives = 144/162 (88%)
Query: 16    GENILKVDSFLTHQVDFELMQEIGKVFADKYKEAGITKVVTIEASGIAPAVYAAQALGVP    75
             G+NILKVDSFLTHQVDF LM+EIGKVFA+K+  AGITKVVTIEASGIAPA++ A+AL VP
Sbjct: 1     GDNILKVDSFLTHQVDFSLMREIGKVFAEKFASAGITKVVTIEASGIAPALFTAEALNVP    60

Query: 76    MIFAFEAKNITMTEGILTAEVYSETKQVTSQVSIVSRFLSNDDTVLIIDDFLANGQAAKG   135
             MIFA  AKNITM EGILTAEVYSFTKQVTS VSI   +FLS +D VLIIDDFLANGQAAKG
Sbjct: 61    MIFAKKAKNITMNEGILTAEVYSETKQVTSTVSIAGKELSPEDKVLIIDDFLANGQAAKG   120

Query: 136   LLEIIGQAGAKVAGIGIVIEKSFQDGRDLLEKTGVPVTSLAR                    177
             L++II QAGA V  IGIVIEKSFQDGRDLLEK G PV SLAR
Sbjct: 121   LIQIIEQAGATVEAIGIVIEKSFQDGRDLLEKAGYPVLSLAR                    162
```

A related DNA sequence was identified in *S. pyogenes* <SEQ ID 6613> which encodes the amino acid sequence <SEQ ID 6614>. Analysis of this protein sequence reveals the following:

---
Possible site: 43
>>> Seems to have no N-terminal signal sequence
----- Final Results -----
   bacterial cytoplasm --- Certainty = 0.2576 (Affirmative) <succ>
   bacterial membrane --- Certainty = 0.0000 (Not Clear) <succ>
   bacterial outside --- Certainty = 0.0000 (Not Clear) <succ>
---

An alignment of the GAS and GBS proteins is shown below.

```
Identities = 156/193 (80%), Positives = 172/193 (88%)
Query: 1     MKLLEERILKDGDVLGENILKVDSFLTHQVDFELMQEIGKVFADKYKEAGITKVVTIEAS    60
             M+LLEERIL DG++LGENILKVD+FLTHQVD+ LM+ IGKVFA KY EAGITKVVTIEAS
Sbjct: 1     MQLLEERILTDGNILGENILKVDNFLTHQVDYRLMKAIGKVFAQKYAEAGITKVVTIEAS    60

Query: 61    GIAPAVYAAQALGVPMIFAKKAKNITMTEGILTAEVYSFTKQVTSQVSIVSRFLSNDDTV   120
             GIAPAVYAA+A+ VPMIFAKK KNITMTEGILTAEVYSFTKQVTS VSI   +FLS +D V
Sbjct: 61    GIAPAVYAAEAMDVPMIFAKKHKNITMTEGILTAEVYSFTKQVTSTVSIAGKFLSKEDKV   120

Query: 121   LIIDDFLANGQAAKGLLEIIGQAGAKVAGIGIVIEKSFQDGRDLLEKTGVPVTSLARIKA   180
             LIIDDFLANGQAAKGL+EIIGQAGA+V G+GIVIEKSFQDGR L+E G+  VTSLARIK
Sbjct: 121   LIIDDFLANGQAAKGLIEIIGQAGAQVVGVGIVIEKSFQDGRRLIEDMGIEVTSLARIKN   180

Query: 181   FENGRVVFAEADA                                                 193
             FENG + F EADA
Sbjct: 181   FENGNLNFLEADA                                                 193
```

Based on this analysis, it was predicted that these proteins and their epitopes could be useful antigens for vaccines or diagnostics.

Example 2141

A DNA sequence (GBSx2257) was identified in *S. agalactiae* <SEQ ID 6615> which encodes the amino acid sequence <SEQ ID 6616>. Analysis of this protein sequence reveals the following:

---
Possible site: 28
>>> Seems to have no N-terminal signal sequence
----- Final Results -----
   bacterial cytoplasm --- Certainty = 0.2546 (Affirmative) <succ>
   bacterial membrane --- Certainty = 0.0000 (Not Clear) <succ>
   bacterial outside --- Certainty = 0.0000 (Not Clear) <succ>
---

The protein has homology with the following sequences in the GENPEPT database.

```
>GP:CAB15203 GB:Z99120 similar to GMP reductase [Bacillus subtilis]
Identities = 243/321 (75%), Positives = 286/321 (88%), Gaps = 2/321 (0%)
Query: 7     VPDYEDIQLIPNKCIISSRSQADTSVKLGNYTFKLPVIPANMQTIIDEEVAETLACEGYF    66
             VFDYEDIQLIP KCI++SRS+ DTSV+LG +TFKLPV+PANMQTIIDE++A +LA  GYF
Sbjct: 4     VFDYEDIQLIPAKCIVNSRSECDTSVRLGGHTFKLPVVPANMQTIIDEKLAISLAENGYF    63

Query: 67    YIMHRFNEEERKPFIKRMHDKGLIASISVGVKDYEYDFVTSLKED--APEFITIDIAHGH   124
             Y+MHRF  E R  FIK M+ +GL +SISVGVKD EY+FV  L E+    PE++TIDIAHGH
Sbjct: 64    YVMBRFEPETRIDFIKDMNARGLFSSISVGVKDEEYEFVRQLAEENLTPEYVTIDIAHGH   123

Query: 125   SNSVIEMIQHIKQELPETFVIAGNVGTPEAVRELENAGADATKVGIGPGKVCITKVKTGF   184
             SN+VIEMIQH+K+ LP++FVIAGNVGTPEAVRELENAGADATKVGIGPGKVCITK+KTGF
```

```
                                -continued
Sbjct: 124  SNAVIEMIQHLKKHLPDSFVIAGNVGTPEAVRELENAGADATKVGIGPGKVCITKIKTGF  183

Query: 185  GTGGWQLAALRWCSKAARKPIIADGGIRTHGDIAKSIRFGASMVMIGSLFAGHLESPGKL  244
            GTGGWQLAALRWC+KAA KPIIADGGIRTHGDIAKSIRFGA+MVMIGSLFAGH ESPG+
Sbjct: 184  GTGGWQLAALRWCAKAASKPIIADGGIRTHGDIAKSIRFGATMVMIGSLFAGHEESPGQT  243

Query: 245  VEVEGQQFKEYYGSASEYQKGEHKNVEGKKILLPVKGRLEDTLTEMQQDLQSSISYAGGK  304
            +E +G+ +KEY+GSASE+ KGE KNVEGKK+ +  KG ++DTL EM+QDLQSSISYAGG
Sbjct: 244  IEKDGKLYKEYFGSASEFPKGEKKKNVEGKKMHVAHKGSIKDTLIEMEQDLQSSISYAGGT  303

Query: 305  ELDSLRHVDYVIVKNSIWNGD                                       325
            +L+++R+VDYVIVKNSI+NGD
Sbjct: 304  KLNAIRNVDYVIVKNSIFNGD                                       324
```

A related DNA sequence was identified in *S. pyogenes* <SEQ ID 6617> which encodes the amino acid sequence <SEQ ID 6618>. Analysis of this protein sequence reveals the following:

Possible site: 35
>>> Seems to have no N-terminal signal sequence
----- Final Results -----
    bacterial cytoplasm --- Certainty = 0.2405 (Affirmative) <succ>
    bacterial membrane --- Certainty = 0.0000 (Not Clear) <succ>
    bacterial outside --- Certainty = 0.0000 (Not Clear) <succ>

Possible site: 57
>>> Seems to have an uncleavable N-term signal seq
INTEGRAL    Likelihood = −16.98   Transmembrane 421-437 (413-443)
INTEGRAL    Likelihood = −8.81    Transmembrane 166-182 (159-186)
INTEGRAL    Likelihood = −8.55    Transmembrane 220-236 (208-238)
INTEGRAL    Likelihood = −6.69    Transmembrane 322-338 (319-353)
INTEGRAL    Likelihood = −5.26    Transmembrane 199-215 (196-218)
INTEGRAL    Likelihood = −4.35    Transmembrane 343-359 (342-361)
INTEGRAL    Likelihood = −4.09    Transmembrane 291-307 (287-308)
INTEGRAL    Likelihood = −3.66    Transmembrane 8-24 (8-27)
INTEGRAL    Likelihood = −3.66    Transmembrane 133-149 (133-151)
INTEGRAL    Likelihood = −3.19    Transmembrane 254-270 (253-278)
INTEGRAL    Likelihood = −2.50    Transmembrane 53-69 (53-72)
INTEGRAL    Likelihood = −1.81    Transmembrane 77-93 (76-95)
INTEGRAL    Likelihood = −1.33    Transmembrane 109-125 (109-125)

An alignment of the GAS and GBS proteins is shown below.

```
Identities = 297/327 (90%), Positives = 311/327 (94%)

Query: 1    MFNDIPVFDYEDIQLIPNKCIISSRSQADTSVKLGNYTFKLPVIPANMQTIIDEEVAETL  60
            MFNDIPVFDYEDIQLIPNKCII+SRSQADTSV LG Y FKLPVIPANMQTIIDE +AE L
Sbjct: 8    MFNDIPVFDYEDIQLIPNKCIITSRSQADTSVTLGKYQFKLPVIPANMQTIIDETIAEQL  67

Query: 61   ACEGYFYIMHRFNEEERKPFIKRMHDKGLIASISVGVKDYEYDFVTSLKEDAPEFITIDI  120
            A EGYFYIMHRF+E+ RKPFIKRMH++GLIASISVGVK  EY+FVTSLKEDAPEFITIDI
Sbjct: 68   AKEGYFYIMHRFDEDSRKPFIKRMHEQGLIASISVGVKACEYEFVTSLKEDAPEFITIDI  127

Query: 121  AHGHSNSVIEMIQHIKQELPETFVIAGNVGTPEAVRELENAGADATKVGIGPGKVCITKV  180
            AHGH+NSVI+MI+HIK ELPETFVIAGNVGTPEAVRELENAGADATKVGIGPGKVCITKV
Sbjct: 128  AHGHANSVIDMIKHIKTELPETFVIAGNVGTPEAVRELENAGADATKVGIGPGKVCITKV  187

Query: 181  KTGFGTGGWQLAALRWCSKAARKPIIADGGIRTHGDIAKSIRFGASMVMIGSLFAGHLES  240
            KTGFGTGGWQLAALRWC+KAARKPIIADGGIRTHGDIAKSIRFGASMVMIGSLFAGH ES
Sbjct: 188  KTGFGTGGWQLAALRWCAKAARKPIIADGGIRTHGDIAKSIRFGASMVMIGSLFAGHFES  247

Query: 241  PGKLVEVEGQQFKEYYGSASEYQKGEHKNVEGKKILLPVKGRLEDTLTEMQQDLQSSISY  300
            PGK VEV+G+ FKEYYGSASEYQKGEHKNVEGKKILLP KG L DTLTEMQQDLQSSISY
Sbjct: 248  PGKTVEVDGETFKEYYGSASEYQKGEHKNVEGKKILLPTKGHLSDTLTEMQQDLQSSISY  307

Query: 301  AGGKELDSLRHVDYVIVKNSIWNGDSI                                 327
            AGGK+LDSLRHVDYVIVKNSIWNGDSI
Sbjct: 308  AGGKDLDSLRHVDYVIVKNSIWNGDSI                                 334
```

Based on this analysis, it was predicted that these proteins and their epitopes could be useful antigens for vaccines or diagnostics.

Example 2142

A DNA sequence (GBSx2258) was identified in *S. agalactiae* <SEQ ID 6619> which encodes the amino acid sequence <SEQ ID 6620>. Analysis of this protein sequence reveals the following:

-continued

----- Final Results -----
    bacterial membrane --- Certainty = 0.7793 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:CAB61253 GB:AJ250422 ORFC [Oenococcus oeni]
Identities = 157/447 (35%), Positives = 252/447 (56%),Gaps = 13/447 (2%)
Query:  11   AIITTAILGFSGILIETSMNVTFPLLMKEFGVNPAVIQWVTTGNLLAVAVTVPLSAFMIK   70
             AI+  A L F G+LIETSMNVTFP LM++F ++   +QW+TT  LL VA T+ ++AF+ K
Sbjct:  15   AILGLAGLAFCGVLIETSMNVTFPTLMQQFSISLNKVQWLTTAYLLLVAATISIAAFIEK   74

Query:  71   NLSERQIFTLANVLFLSGVLIDSFAPNLAILLVGRVLQGVGTGLALPLLFHIILTQIPME   130
                ++IF  A +LF+ GV+  + APN  ILL+GR++Q + TGLA+PLL    I+ QIP +
Sbjct:  75   RFIFKKIFFWAGLLFIIGVICSALAPNFLILLIGRLIQALSTGLAIPLLITEIMQQIPQK   134

Query: 131   RRGLMMGVAAMVTLLAPAVGPTYGGVISGMLGWKMIFMLLAPILIISTFIGLASIPKRQV   190
             ++G  M  +   + L P++GPTYGGVI+  L W++IF   +PI +I+  IGL+ I ++
Sbjct: 135   KQGSYMELVEWLLLWQPSLGPTYGGVITQDLSWRLIFWFVLPIGLIAWLIGLSFIEQKSS   194

Query: 191   RINDKLNFPAFISLGIGLATLLLAIEKMSIF---------YLLVAIVSFVIFYYL--NKQ   239
                   +  FISL + L ++ +A+   I+           +LL+A++  ++F  L  N +
Sbjct: 195   PSKIPFAWKQFISLILALLSITVAVNNAGIYGWTSIKFYGFLLIAVILLIVFIKLSTNSR   254

Query: 240   LEFLNLNVFKDKDFSILLYGVLAFQMIPLALSFLLPNLLQLVLHQTSTKAGLFMFPGAIA   299
                +++++FK  +F   L     Q I L+L+FLLPN  QL+L +     +G+   +G++
Sbjct: 255   QALISISIFKKWEFVCPLLIYFLIQFIQLSLTFLLPNYAQLILKKGVMISGIMLLCGSLI   314

Query: 300   VVFLSPFAGYLLDKIGAFKPIMIGISLSLIGLIGTAIFIPAKSVVVLLAFDILTKIGMGI   359
                L P  G +LD        P++IG   +   I  IF    SV ++ A  ++  IG
Sbjct: 315   SAILQPLTGRMLDSFSVKIPLVIGAFFLITSTISFTIFQRYLSVFLIAALYVIYMIGFSF   374

Query: 360   GASNMVTTALTKLKPAQSADGNSILNTLQQFAGAFATAVASQIFTIGQVAIPKNGAIIGS   419
             +N +T AL KL      +DGN++ NTLQQ+AG+ T+VAS +    G    K     GS
Sbjct: 375   VFNNSLTYALQKLPLKLISDGNAVFNTLQQYAGSLGTSVASALLANGIGTDGKQSNYTGS   434

Query: 420   Q--FAVLFVIVVVILAIVGLTYLRKRK                                  444
             +  F + F+   +++   ++     +K K
Sbjct: 435   RHIFILNFISCAIVVILIFSIQRKKNK                                  461
```

There is also homology to SEQ ID 46.

Based on this analysis, it was predicted that this protein and its epitopes, could be useful antigens for vaccines or diagnostics.

Example 2143

A DNA sequence (GBSx2259) was identified in *S. agalactiae* <SEQ ID 6621> which encodes the amino acid sequence <SEQ ID 6622>. Analysis of this protein sequence reveals the following:

---
Possible site: 52
>>> Seems to have no N-terminal signal sequence
----- Final Results -----
    bacterial cytoplasm --- Certainty = 0.2151 (Affirmative) <succ>
      bacterial membrane --- Certainty = 0.0000 (Not Clear) <succ>
        bacterial outside --- Certainty = 0.0000 (Not Clear) <succ>

---

The protein has no significant homology with any sequences in the GENPEPT database.

A related DNA sequence was identified in *S. pyogenes* <SEQ ID 6595> which encodes the amino acid sequence <SEQ ID 6596>. Analysis of this protein sequence reveals the following:

---
Possible site: 32
>>> Seems to have an uncleavable N-term signal seq
----- Final Results -----
    bacterial membrane --- Certainty = 0.0000 (Not Clear) <succ>
      bacterial outside --- Certainty = 0.0000 (Not Clear) <succ>
        bacterial cytoplasm --- Certainty = 0.0000 (Not Clear) <succ>

---

An alignment of the GAS and GBS proteins is shown below.

```
Identities = 74/214 (34%), Positives = 112/214 (51%), Gaps = 5/214 (2%)
Query:  13   NESENNFFITLKTYFNYLFSIQIIT---DISTLNHADFDGSFAFHDIETSIPHLVIDSNY    69
             N+ E  F   L +F++LF +   I+T    +I +   + F G F+FH+ +  +P L  ++
Sbjct:  15   NQLEETFIRELSHHFSHLFEVTILTSKANIQSNQLSTFQGIFSFHEHDIDLPTLYFKTSQ    74

Query:  70   LAISQTNSKIEANDIKTFSELSKTMTEFHYMLNFDLFNHLPYRFRLHNKDGQTIYSNHKP   129
                   ++   +        LS+ +T F+   +      +LP + RL + +G  I   NH
Sbjct:  75   HGQGFLVTESVFDQATAVLSLSQYLTGFYQKFDGHFLQYLPLQARLSDANGNIIVDNHAF   134

Query: 130   EDPFDIYPEEEYPIDKWVQNSLIEKKAKELHLLLPSASQDYILVQSYKRLENDSGQLVGY   189
                 F    P  + I+ W+  L            LLPS S D+I +Q Y+  L+N  GQLVG
Sbjct: 135   NGSF--LPTTDKEIEDWILAELRLSDNPCKTFLLPSGSLDHIYMQHYQALKNPQGQLVGV   192

Query: 190   IEHVHNIKPLLEGYLKESGQAIVGWSDVTSGASI                            223
             ++ V +IKPLL   YL+E+GQAIVGWSDVTSG SI
Sbjct: 193   LDTVQDIKPLLNQYLEETGQAIVGWSDVTSGPSI                            226
```

Based on this analysis, it was predicted that these proteins and their epitopes could be useful antigens for vaccines or diagnostics.

Example 2144

A DNA sequence (GBSx2260) was identified in *S. agalactiae* <SEQ ID 6623> which encodes the amino acid sequence <SEQ ID 6624>. Analysis of this protein sequence reveals the following:

```
Possible site: 18
>>> Seems to have an uncleavable N-term signal seq
INTEGRAL    Likelihood = -12.10   Transmembrane 431-447 (423-452)
INTEGRAL    Likelihood = -8.92    Transmembrane 149-165 (147-174)
INTEGRAL    Likelihood = -8.86    Transmembrane 404-420 (402-428)
INTEGRAL    Likelihood = -7.91    Transmembrane 299-315 (293-318)
INTEGRAL    Likelihood = -6.42    Transmembrane 380-396 (374-398)
INTEGRAL    Likelihood = -5.31    Transmembrane 350-366 (347-367)
INTEGRAL    Likelihood = -4.57    Transmembrane 56-72 (54-74)
INTEGRAL    Likelihood = -3.24    Transmembrane 172-188 (171-198)
INTEGRAL    Likelihood = -1.33    Transmembrane 224-240 (224-240)
INTEGRAL    Likelihood = -0.59    Transmembrane 101-117 (101-117)
----- Final Results -----
   bacterial membrane --- Certainty = 0.5840 (Affirmative) <succ>
   bacterial outside --- Certainty = 0.0000 (Not Clear) <succ>
   bacterial cytoplasm --- Certainty = 0.0000 (Not Clear) <succ>
```

The protein has homology with the following sequences in the GENPEPT database.

A related DNA sequence was identified in *S. pyogenes* <SEQ ID 6625> which encodes the amino acid sequence <SEQ ID 6626>. Analysis of this protein sequence reveals the following:

```
Possible site: 15
>>> Seems to have an uncleavable N-term signal seq
INTEGRAL    Likelihood = -11.78   Transmembrane 428-444 (421-453)
INTEGRAL    Likelihood = -8.70    Transmembrane 146-162 (144-171)
INTEGRAL    Likelihood = -7.64    Transmembrane 404-420 (398-426)
INTEGRAL    Likelihood = -4.88    Transmembrane 296-312 (294-315)
INTEGRAL    Likelihood = -4.57    Transmembrane 53-69 (51-71)
INTEGRAL    Likelihood = -3.93    Transmembrane 347-363 (343-363)
INTEGRAL    Likelihood = -2.50    Transmembrane 372-388 (371-388)
INTEGRAL    Likelihood = -1.33    Transmembrane 169-185 (169-185)
INTEGRAL    Likelihood = -1.33    Transmembrane 221-237 (221-237)
----- Final Results -----
   bacterial membrane --- Certainty = 0.5713 (Affirmative) <succ>
   bacterial outside --- Certainty = 0.0000 (Not Clear) <succ>
   bacterial cytoplasm --- Certainty = 0.0000 (Not Clear) <succ>
```

The protein has homology with the following sequences in the databases:

```
>GP:AAF84709 GB:AE004010 potassium uptake protein [Xylella fastidiosa]
Identities = 201/570 (35%), Positives = 319/570 (55%), Gaps = 34/570 (5%)

Query:   1   MAEMQHVNHSSFDKASKAGFII--ALGIVYGDIGTSPLYTMQSLVENQGGISSVTESFIL    58
             M+  H   +  ++  G II  A+G+V+GDIGTSPLYT++         G++   ++ +L
Sbjct:   1   MSTSSHSGDCTAVPSNSNGTIILSAIGVVFGDIGTSPLYTLKEAFSPNYGLTPNHDT-VL   59

Query:  59   GSISLIINTLTLITTIKYVLVALKADNHHEGGIFSLYTLVRKMTPW-------LIVPAVI  111
             G +SLI W + L+ TIKYV V ++ DN  EGGI +L  L ++ P+        +  +  +
Sbjct:  60   GILSLIFWAMMLVVTIKYVAVIMRVDNDGEGGIMALTALTQRTMPFGSRSIYIVGILGIF  119

Query: 112   GGATLLSDGALTPAVTVTSAVEGLKVVPSLQHIFQNQSNVIFATLFILLLLFAIQRFGTG  171
             G +    DG +TPA++V SAVEGL+V         F      V+  TL +L+LLF  QRFGT
Sbjct: 120   GTSLFFGDGVITPAISVLSAVEGLEVAEPHMKAF-----VVPITLAVLILLFLCQRFGTE  174

Query: 172   VIGKLFGPIMFIWFAFLGISGLLNSFAHPEVFKAINPYYGLKLLFSPENHKGIFILGSIF  231
              +GK FGPI  +WF  +G+ G+ N    PEV  AINP +GL   F       +F+LG++
Sbjct: 175   RVGKTFGPITLLWFIAIGVVGVYNIAQAPEVLHAINPSWGLH-FFLEHGWHSMFVLGAVV  233

Query: 232   LATTGAEALYSDLGHVGRGNIHVSWPFVKVAII-LSYCGQGAWILANKNAGNELNPFFAS  290
             LA  TG  EALY+D+GH G   I   +W +V + ++ L+Y GQGA +L+N  A     NPF+ S
Sbjct: 234   LAVTGGEALYADMGHFGAKAIRHAWMYVVLPMLALNYLGQGALVLSNPTAIG--NPFYQS  291

Query: 291   IPSQFTMHVVILATLAAIIASQALISGSFTLVSEAMRLKIFPQFRSTYPGDN-IGQTYIP  349
             IP      ++  LAT AA+IASQALI+GS++L S+AM+L    P+      +   IGQ Y+P
Sbjct: 292   IPDWGLYPMIALATAAAVIASQALITGSYSLSSQAMQLGYIpRMNVRHTSQSTIGQIYVP  351

Query: 350   VINWFLFAITTSIVLLFKTSAHMEAAYGLAITITMLMTTILLSFFL-IQKGVKRGLVLLM  408
             +NW L +     V+ F  S  M +AYG+A+T TM++TT+L+      V R  +M
Sbjct: 352   TVNWTLLTLVILTVIGFGDSTSMASAYGVAVTGIMMITTVLMIIYARANPRVPRLMLWMM  411

Query: 409   MIFFGILEGIFFLASAVKFMHGGYVVVIIAVAIIFIMTIWYKGSKIVSRYVKL--LDLKD  466
              I F  ++G FF   A+ +KFM G +    +++   V I    M  W +G  K++     ++L +
Sbjct: 412   AIVFIAVDGAFFYANIIKFMDGAWFPLLLGVVIFTFMRTWLRGRKLLHEEMRKDGINLDN  471

Query: 467   YIGQLDKLRHDHRYPIYHTNVVYLTNRMEEDMIDKSIMYSILDKRPKKAQVYWFVNIKVT  526
             ++   L   L      + P         V+LT   +  ++++M+++       +  F+  +K
Sbjct: 472   FLPGL-MLAPPVKVP---GTAVFLT--ADSTVVPHALMHNLKHNKVLHERNV-FLTVKTL  524

Query: 527   DEPYTA---EYKVDMMGTDFIVKVELYLGF                                553
              PY A      K++ +    F  +V + GF
Sbjct: 525   KIPYAANSERLKIEPISNGF-YRVHIRFGF                                553
```

```
>GP:AAF84709 GB:AE004010 potassium uptake protein [Xylella fastidiosa]
Identities = 177/467 (37%), Positives = 270/467 (56%), Gaps = 20/467 (4%)
Query:   7  TAFDKASKAGFII-ALGIVYGDIGTSPLYTIQSLVENQGGVNQVSESFILGSISLIIWTL     65
            TA    S    I+ A+G+V+GDIGTSPLYT++          G+    ++ +LG +SLI W +
Sbjct:  11  TAVPSNSNGTIILSAIGVVFGDIGTSPLYTLKEAFSPNYGLTPNHDT-VLGILSLIFWAM    69

Query:  66  TLITTIKYVLIALKADNHHEGGIFSLFTLVRKMSPW-------LIIPAMIGGATLLSDGA   118
            L+ TIKYV + ++ DN  EGGI +L  L ++  P+       + I + G +     DG
Sbjct:  70  MLVVTIKYVAVIMRVDNDGEGGIMALTALTQRTMPFGSRSIYIVGILGIFGTSLFFGDGV   129

Query: 119  LTPAVTVTSAIEGLKAVPGLSHIYQNQTNVIITTLVILIVLFGIQRFGTGFIGKIFGPVM   178
            +TPA++V SA+EGL+           +    V+  TL +LI+LF QRFGT  +GK FGP+
Sbjct: 130  ITPAISVLSAVEGLEVAEPHMKAF-----VVPITLAVLILLFLCQRFGTERVGKTFGPIT   184

Query: 179  FIWFSFLGVSGFFNTLGHLEIFKAINPYYALHLLFSPENHRGIFILGSIFLATTGAEALY   238
             +WF  +GV G +N     E+  AINP + LH  F       +F+LG++ LA TG EALY
Sbjct: 185  LLWFIAIGVVGVYNIAQAPEVLHAINPSWGLH-FFLEHGWHSMFVLGAVVLAVTGGEALY   243

Query: 239  SDLGHVGRGNIYVSWPFVKM-CIVLSYCGQAAWILANKHSGIELNPFFASVPSQLRVYLV   297
            +D+GH G    I  +W +V +   L+Y GQ A +L+N +      NPF+ S+P      ++
Sbjct: 244  ADMGHFGAKAIRHAWMYVVLPMLALNYLGQGALVLSNPTA--IGNPFYQSIPDWGLYPMI   301

Query: 298  SLATLAAIIASQALISGSFTLVSEAMRLKIFPLFRVTYPG-ANLGQLYIPVINWILFAVT   356
            +LAT AA+IASQALI+GS++L S+AM+L  P   V +   +GQ+Y+P +NW L   +
Sbjct: 302  ALATAAAVIASQALITGSYSLSSQAMQLGYIPRMNVRHTSQSTIGQIYVPTVNWTLLTLV   361

Query: 357  SCTVLAFRTSAHMEAAYGLAITITMLMTTILLKYYLIKKGTRPILAHLVMAF-FALVEFI   415
                TV+ F   S   M  +AYG+A+T TM++TT+L+    Y            P L   +MA  F   V+
Sbjct: 362  ILTVIGFGDSTSMASAYGVAVTGTMMITTVLMIIYARANPRVPRLMLWMMAIVFIAVDGA   421

Query: 416  FFLASAIKFMHGGYAVVILALAIVFVMFIWHAGTRIVFKYVKSLNLN               462
            FF A+ IKFM G +  ++L + I   M W G +++ + ++    +N
Sbjct: 422  FFYANIIKFMEGAWFPLLLGVVIFTFMRTWLRGRKLLHEEMRKDGIN                468

An alignment of the GAS and GBS proteins is shown
below.

Identities = 485/651 (74%), Positives = 575/651 (87%)

Query:    10  SSFDKASKAGFIIALGIVYGDIGTSPLYTMQSLVENQGGISSVTESFILGSISLIIWTLT    69
              ++FDKASKAGFIIALGIVYGDIGTSPLYT+QSLVENQGG++ V+ESFILGSISLIIWTLT
Sbjct:     7  TAFDKASKAGFIIALGIVYGDIGTSPLYTIQSLVENQGGVNQVSESFILGSISLIIWTLT    66

Query:    70  LITTIKYVLVALKADNHHEGGIFSLYTLVRKMTPWLIVPAVIGGATLLSDGALTPAVTVT   129
              LITTIKYVL+ALKADNHHEGGIFSL+TLVRKM+PWLI+PA+IGGATLLSDGALTPAVTVT
Sbjct:    67  LITTIKYVLIALKADNHHEGGIFSLFTLVRKMSPWLIIPAMIGGATLLSDGALTPAVTVT   126

Query:   130  SAVEGLKVVPSLQHIFQNQSNVIFATLFILLLLFAIQRFGTGVIGKLFGPIMFIWFAFLG   189
              SA+EGLK VP L HI+QNQ+NVI   TL IL++LF IQRFGTG IGK FGP+MFIWF+FLG
Sbjct:   127  SAIEGLKAVPGLSHIYQNQTNVIITTLVILIVLFGIQRFGTGFIGKIFGPVMFIWFSFLG   186

Query:   190  ISGLLNSFAHPEVFKAINPYYGLKLLFSPENHKGIFILGSIFLATTGAEALYSDLGHVGR   249
              +SG  N+  H E+FKAINPYY L LLFSPENH+GIFILGSIFLATTGAEALYSDLGHVGR
Sbjct:   187  VSGFFNTLGHLEIFKAINPYYALHLLFSPENHRGIFILGSIFLATTGAEALYSDLGHVGR   246

Query:   250  GNIHVSWPFVKVAIILSYCGQGAWILANKNAGNELNPFFASIPSQFTMHVVILATLAAII   309
              GNI+VSWPFVK+ I+LSYCGQ AWILANK++G ELNPFFAS+PSQ   +V LATLAAII
Sbjct:   247  GNIYVSWPFVKMCIVLSYCGQAAWILANKHSGIELNPFFASVPSQLRVYLVSLATLAAII   306

Query:   310  ASQALISGSFTLVSEAMRLKIFPQFRSTYPGDNIGQTYIPVINWFLFAITTSIVLLFKTS   369
              ASQALISGSFTLVSEAMRLKIFP FR TYPG N+GQ YIPVINW LFA+T+  VL F+TS
Sbjct:   307  ASQALISGSFTLVSEAMRLKIFPLFRVTYPGANLGQLYIPVINWILFAVTSCTVLAFRTS   366

Query:   370  AHMEAAYGLAITITMLMTTILLSFFLIQKGVKRGLVLLMMIFFGILEGIFFLASAVKFMH   429
              AHMEAAYGLAITITMLMTTILL    ++LI+KG +  L  L+M FF ++E IFFLASA+KFMH
Sbjct:   367  AHMEAAYGLAITITMLMTTILLKYYLIKKGTRPILAHLVMAFFALVEFIFFLASAIKFMH   426

Query:   430  GGYVVVIIAVAIIFIMTIWYKGSKIVSRYVKLLDLKDYIGQLDKLRHDHRYPIYHTNVVY   489
              GGY VVI+A+AI+F+M IW+ G++IV +YVK L+L DY  Q+ +LR D    +Y TNVVY
Sbjct:   427  GGYAVVILALAIVFVMFIWHAGTRIVFKYVKSLNLNDYKEQIKQLRDDVCFDLYQTNVVY   486

Query:   490  LTNRMEEDMIDKSIMYSILDKRPKKAQVYWFVNIKVTDEPYTAEYKVDMMGTDFIVKVEL   549
              L+NRM++ MID+SI YSILDKRPK+AQVYWFVN++VTDEPYTA YKVDMMGTD++V+V L
Sbjct:   487  LSNRMQDHMIDRSILYSILDKRPERAQVYWFVNVQVTDEPYTAKYKVDMMGTDYMVRVNL   546

Query:   550  YLGFKMRQTVSRYLRTIVEELLESGRLPKQGKTYSVRPDSNVGDFRFIVLDERFSSSQNL   609
              YLGF+M QTV RYLRTIV++L ESGRLPKQ  Y++ P +VGDFRF++++ER S+++ L
Sbjct:   547  YLGFRMPQTVPRYLRTIVQDLMESGRLPKQEQEYTITPGRDVGDFRFVLIEERVSNARQL   606
```

```
-continued

Query:  610  KPGERFVMLMKSSIKHWTATPIRWFGLQFSEVTTEVVPLIFTANRGLPIKE       660
             ERF+M  K+SIKH TA+P+RWFGLQ+SEVT EVVPLI +    LPIKE
Sbjct:  607  SNFERFIMQTKASIKHVTASPMRWFGLQYSEVTLEVVPLILSDVLKLPIKE       657
```

A related GBS gene <SEQ ID 8983> and protein <SEQ ID 8984> were also identified. Analysis of this protein sequence reveals the following:

```
Lipop: Possible site: -1 Crend: 8
McG: Discrim Score: 5.84
GvH: Signal Score (-7.5): -4.59
Possible site: 18
>>> Seems to have an uncleavable N-terM signal seq
ALOM program count: 10 value: -12.10 threshold: 0.0
INTEGRAL    Likelihood = -12.10   Transmembrane 431-447 (423-452)
INTEGRAL    Likelihood = -8.92    Transmembrane 149-165 (147-174)
INTEGRAL    Likelihood = -8.86    Transmembrane 404-420 (402-428)
INTEGRAL    Likelihood = -7.91    Transmembrane 299-315 (293-318)
INTEGRAL    Likelihood = -6.42    Transmembrane 380-396 (374-398)
```

```
-continued

INTEGRAL    Likelihood = -5.31    Transmembrane 350-366 (347-367)
INTEGRAL    Likelihood = -4.57    Transmembrane 56-72 (54-74)
INTEGRAL    Likelihood = -3.24    Transmembrane 172-188 (171-198)
INTEGRAL    Likelihood = -1.33    Transmembrane 224-240 (224-240)
INTEGRAL    Likelihood = -0.59    Transmembrane 101-117 (101-117)
PERIPHERAL  Likelihood = 0.85     20
modified ALOM score: 2.92
*** Reasoning Step: 3
----- Final Results -----
    bacterial membrane --- Certainty = 0.5840 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the databases:

```
ORF02578(367-1680 of 2607)

GP|9106998|gb|AAF84709.1|AE004010_6|AE004010(25-463 of 634) potassium uptake protein
{Xylella fastidiosa}

% Match = 17.8
% Identity = 40.4  % Similarity = 63.7
Matches = 177 Mismatches = 150 Conservative Sub.s = 102

180       210       240       270       300       330       360       390
TSTCLS*LK**RGPNALIISGLFIDKCCFFNLICYNEFSHFFD*YYLIGGLAEMQHVNHSSFDKASKAGFIIALGIVYGD
                                                          |:|:|:||
                                                          MSTSSHSGDCTAVPSNSNGTIILSAIGVVFGD
                                                                    10        20        30

420       450       480       510       540       570       600       610
IGTSPLYTMQSLVENQGGISSVTESFILGSISLIIWTLTLITTIKYVLVALKADNHHEGGIFSLYTLVRKMTP------W
||||||||::    |::    ::  :|| :|||  | :: |||||  |  ::  ||    ||||  :|  |  ::  |      :
IGTSPLYTLKEAFSPNYGLTPNHDT-VLGILSLIFWAMMLVVTIKYVAVIMRVDNDGEGGIMALTALTQRTMPFGSRSIY
              50        60        70        80        90       100       110

639       669       699       729       759       789       819       849
LI-VPAVIGGATLLSDGALTPAVTVTSAVEGLKVVPSLQHIFQNQSNVIFATLFILLLLFAIQRFGTGVIGKLFGPIMFI
::  :   :  |  :  ::  || :|||::|  ||||||:|           :  ::  |:   ||  :|:|||    |||||      :||  ||||  ::
IVGILGIFGTSLFFGDGVITPAISVLSAVEGLEV-----AEPHMKAFVVPITLAVLILLFLCQRFGTERVGKTFGPITLL
                130       140       150       160       170       180

879       909       939       969       999      1029      1059      1089
WFAFLGISGLLNSFAHPEVFKAINPYYGLKLLFSPENHKGIFILGSIFLATTGAEALYSDLGHVGRGNIHVSWPFVKVAI
||  :|:  |: |         |||:   ||||  :||: ::       ||  ||   ||||||:|:|:|       |  :|    |  ::
WFIAIGVVGVYNIAQAPEVLHAINPSWGLHFFLEHGWHS-MFVLGAVVLAVTGGEALYADMGHFGAKAIRHAWMYVVLPM
     200       210       220       230       240       250       260

1116      1146      1176      1206      1236      1266      1296      1326
I-LSYCGQGAWILANKNAGNELNPFFASIPSQFTMHVVILATLAAIIASQALISGSFTLVSEAMRLKIFPQFRSTYPGDN
: |:|   ||||    :|:|      |  |||:   |||     ::    |||   ||:||||||||:|::|   |:||:|     |:            :         :
LALNYLGQGALVLSNPTA--IGNPFYQSIPDWGLYPMIALATAAAVIASQALITGSYSLSSQAMQLGYIPRMNVRHTSOS 1353      1383      1413      1443      1473      1500      1530      1560
-IGQTYIPVINWFLFAITTSIVLLFKTSAHMEAAYGLAITITMLMTTILLSFFL-IQKGVKRGLVLLMMIFFGILEGIFF
 |||:| :||    |:   :|         |:    |    |    |    :  |||:|:|  ||::||:|:  :          |  |::  :|   |      :|  ||
TIGQIYVPTVNWTLLTLVILTVIGFGDSTSMASAYGVAVTGTMMITTVLMIIYARANPRVPRLMLWMMAIVFIAVDGAFF
              360       370       380       390       400       410       420

1590      1620      1650      1680      1710      1740      1770      1800
LASAVKFMHGGYVVVIIAVAIIFIMTIWYKGSKIVSRYVKLLDLKDYIGQLDKLRHDHRYPIYHTNVVYLTNRMEEDMID
|:  :|||   |    :   :::    |     |    |   |  :| |:
YANIIKFMDGAWFPLLLGVVIFTFMRTWLRGRKLLHEEMRKDGINLDNFLPGLMLAPPVKVPGTAVFLTADSTVVPHALM
              440       450       460       470       480       490       500
```

Based on this analysis, it was predicted that these proteins and their epitopes could be useful antigens for vaccines or diagnostics.

Example 2145

A DNA sequence (GBSx2261) was identified in *S. agalactiae* <SEQ ID 6627> which encodes the amino acid sequence <SEQ ID 6628>. This protein is predicted to be serine dehydrogenase. Analysis of this protein sequence reveals the following:

Possible site: 26
>>> Seems to have no N-terminal signal sequence
----- Final Results -----
    bacterial cytoplasm --- Certainty = 0.3261 (Affirmative) <succ>
      bacterial membrane --- Certainty = 0.0000 (Not Clear) <succ>
        bacterial outside --- Certainty = 0.0000 (Not Clear) <succ>

The protein has homology with the following sequences in the GENPEPT database.

```
>GP:AAD07424 GB:AE000552 short chain alcohol
dehydrogenase [Helicobacter pylori 26695]
Identities = 18/31 (58%), Positives = 25/31 (80%)

Query:     3  WVASQPEHININRIEIMPVSQTYGPQPVYRD    33
              W+  QP H+NINRIEIMP+SQT+ P P +++
Sbjct:   219  WIYEQPLHVNINRIEIMPISQTFAPLPTHKN   249
```

A related DNA sequence was identified in *S. pyogenes* <SEQ ID 6629> which encodes the amino acid sequence <SEQ ID 6630>. Analysis of this protein sequence reveals the following:

Possible site: 21
>>> Seems to have no N-terminal signal sequence
----- Final Results -----
    bacterial cytoplasm --- Certainty = 0.1021 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below.

```
Identities = 24/33 (72%), Positives = 29/33 (87%)

Query:    1  MSWVASQPEHININRIEIMPVSQTYGPQPVYRD   33
             +SWV  QP H+N+NRIE+MPVSQ+YGPQPV RD
Sbjct:   20  VSWVIHQPPHVNVNRIELMPVSQSYGPQPVTRD   52
```

Based on this analysis, it was predicted that these proteins and their epitopes could be useful antigens for vaccines or diagnostics.

Example 2146

A DNA sequence (GBSx2262) was identified in *S. agalactiae* <SEQ ID 6631> which encodes the amino acid sequence <SEQ ID 6632>. Analysis of this protein sequence reveals the following:

Possible site: 21
>>> May be a lipoprotein
----- Final Results -----
    bacterial membrane --- Certainty = 0.0000 (Not Clear) <succ>
      bacterial outside --- Certainty = 0.0000 (Not Clear) <succ>
        bacterial cytoplasm --- Certainty = 0.0000 (Not Clear) <succ>

A related GBS nucleic acid sequence <SEQ ID 9337> which encodes amino acid sequence <SEQ ID 9338> was also identified. A further related GBS nucleic acid sequence <SEQ ID 10781> which encodes amino acid sequence <SEQ ID 10782> was also identified. A further related GBS nucleic acid sequence <SEQ ID 10951> which encodes amino acid sequence <SEQ ID 10952> was also identified.

The protein has homology with the following sequences in the GENPEPT database.

```
>GP:CAA32349 GB:X14130 ORF (AA 1 to 299) [Lactococcus lactis subsp. cremoris]
Identities = 72/215 (33%), Positives = 110/215 (50%), Gaps = 8/215 (3%)

Query:    4  RSKLAAGFLTLMSVATLAACSGKTSNGTN--VVTMKGDTITVSDFYDQVKTSKAAQQSML    61
             + K+    L   +  L   SG  SN T+  V T  G  +T S FY ++K S   +   +
Sbjct:    2  KKKMRLKVLLASTATALLLLSGCQSNQTDQTVATYSGGKVTESSFYKELKQSPTTKTMLA    61

Query:   62  TLILSRVEDTQYGDKVSDKKVSEAYNKTAKGYGNSFSSALSQAGLTPEGYKQQIRTTMLV   121
             +++ R +   YG  VS K V++AY+   + YG +F + LSQ G +    +K+ +RT  L
Sbjct:   62  NMLIYRALNHAYGKSVSTKTVNDAYDSYKQQYGENFDAFLSQNGFSRSSFKESLRTNFLS   121

Query:  122  EYAVKEAAKKELTEANYKEAYKNYTPETSVQVIKLDAEDKAKSVLKDVKADGADFAKIAK   181
             E A+K+   K+++E+  K A+K Y P+ +VQ I     ED AK V+ D+ A G DFA +AK
Sbjct:  122  EVALKKL--KKVSESQLKAAWKTYQPKVTVQHILTSDEDTAKQVISDLAA-GKDFAMLAK   178

Query:  182  E---KTTATDKKVEYKFDSAGTTLPKEVMSAAFKL                           213
                 T    D    + F+     TL        AA+KL
Sbjct:  179  TDSIDTATKDNGGKISFELNNKTLDATFKDAAYKL                           213
```

A related DNA sequence was identified in *S. pyogenes* <SEQ ID 6633> which encodes the amino acid sequence <SEQ ID 6634>. Analysis of this protein sequence reveals the following:

Possible site: 21
>>> May be a lipoprotein
----- Final Results -----
    bacterial membrane --- Certainty = 0.0000 (Not Clear) <succ>
      bacterial outside --- Certainty = 0.0000 (Not Clear) <succ>
        bacterial cytoplasm --- Certainty = 0.0000 (Not Clear) <succ>

The protein has homology with the following sequences in the databases:

```
>GP:AAA25247 GB:M83946 maturation protein [Lactobacillus paracasei]
Identities = 88/294 (29%), Positives = 146/294 (48%), Gaps = 14/294 (4%)

Query:     7 LIASVVTLASVMALAACQSTNDNTKVISMKGDTISVSDFYNETKNTEVSQKAMLNLVISR    66
             L+AS  T  +++ L+ CQS   + KV +  G   ++ S+FY E K +   ++   + N++I R
Sbjct:    10 LLASTAT--ALLLLSGCQSNQADQKVATYSGGKVTESNFYKELKQSPTTKTMLANMLIYR    67

Query:    67 VFEAQYGDKVSKKEVEKAYHKTAEQYGASFSAALAQSSLTPETFKRQIRSSKLVEYAVKE   126
                  YG  VS K V   AY      +QYG +F A L+Q+   +   +FK   +R++ L E A+K+
Sbjct:    68 ALNHAYGKSVSTKTVNDAYDSYKQQYGENFDAFLSQNGFSRSSFKESLRTNFLSEVALKK   127

Query:   127 AAKKELTTQEYKKAYESYTPTMAVEMITLDNEETAKSVLEELKAEGADFTAIARE---KT   183
                  K+++   + K   +++Y P + V+ I    +E+TAK V+ +L A G DF    +AK     T
Sbjct:   128 L--KKVSESQLKAVWKTYQPKVTVQHILTSDEDTAKQVISDL--AAGKDFATLAKTDSIDT   184

Query:   184 TTPEKKVTYKFDSGATNVPTDVVKAASSLNEGGISDVISVLDPTSYQKKFYIVKVTKKAE   243
                  T +      F+S   +         AA   L  G  +          P   +  ++K+
Sbjct:   185 ATKDNGGKISFESNNKTLDATFKDAAYKLENGDYTQT-----PVKVTNGYEVIKMINH-P   238

Query:   244 KKSDWQEYKKRLKAIIIAEKSKDMNFQNKVIANALDKANVKIKDKAFANILAQY         297
                  K +    KK L A + A+ S+D +    +VI+   L    +V IKDK  A+ L  Y
Sbjct:   239 AKGTFTSSKKALTASVYAKWSRDSSIMQRVISQVLKNQHVTIKDKDLADALDSY         292
```

An alignment of the GAS and GBS proteins is shown below.

```
Identities = 125/213 (58%), Positives = 168/213 (78%), Gaps = 1/213 (0%)

Query:     1 MKTRSKLAAGFLTLMSVATLAACSGKTSNGTNVVTMKGDTITVSDFYDQVKTSKAAQQSM    60
             MK  +KL A  +TL SV  LAAC    T++ T V++MKGDTI+VSDFY++ K  ++  +Q++M
Sbjct:     1 MKNSNKLIASVVTLASVMALAACQS-TNDNTKVISMKGDTISVSDFYNETKNTEVSQKAM    59

Query:    61 LTLILSRVFDTQYGDKVSDKKVSEAYNKTAKGYGNSFSSALSQAGLTPEGYKQQIRTTML   120
             L  L++SRVF+  QYGDKVS K+V  +AY+KTA+  YG SFS+AL+Q+  LTPE  +K+QIR++  L
Sbjct:    60 LNLVISRVFEAQYGDKVSKKEVEKAYHKTAEQYGASFSAALAQSSLTPETFKRQIRSSKL   119

Query:   121 VEYAVKEAAKKELTEANYKEAYKNYTPETSVQVIKLDAEDKAKSVLKDVKADGADFAKIA   180
             VEYAVKEAAKKELT    YK+AY++ YTP   +V++I  LD E+ AKSVL+++KA+GADF   IA
Sbjct:   120 VEYAVEEAAKKELTTQEYKKAYESYTPTMAVEMITLDNEETAKSVLEELKAEGADFTAIA   179

Query:   181 KEKTTATDKKVEYKFDSAGTTLPKEVMSAAFKL                             213
             KEKTT  +KKV YKFDS  T +P +V+ AA  L
Sbjct:   180 KEKTTTPEKKVTYKFDSGATNVPTDVVKAASSL                             212
```

Figure 143:
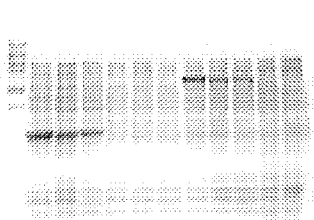
Figure 144:
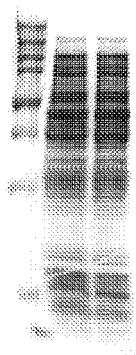

SEQ ID 10782 (GBS657) was expressed in *E. coli* as a GST-fusion product. SDS-PAGE analysis of total cell extract is shown in FIG. 143 (lane 8-10; MW 62.8 kDa) and in FIG. 187 (lane 3; MW 63 kDa). Purified GBS657-GST is shown in FIG. 245, lanes 2 & 3.

Based on this analysis, it was predicted that these proteins and their epitopes could be useful antigens for vaccines or diagnostics.

Example 2147

A DNA sequence (GBSx2263) was identified in *S. agalactiae* <SEQ ID 6635> which encodes the amino acid sequence <SEQ ID 6636>. This protein is predicted to be methyltransferase. Analysis of this protein sequence reveals the following:

Possible site: 44
>>> Seems to have no N-terminal signal sequence
----- Final Results -----
 bacterial cytoplasm --- Certainty = 0.2576 (Affirmative) <succ>
 bacterial membrane --- Certainty = 0.0000 (Not Clear) <succ>
 bacterial outside --- Certainty = 0.0000 (Not Clear) <succ>

The protein has homology with the following sequences in the GENPEPT database.

```
>GP:CAA68045 GB:X99710 methyltransferase [Lactococcus lactis]
Identities = 132/227 (58%), Positives = 169/227 (74%)

Query:     1 MVQSYSKNANHNMRRPVVKEEIVQYMRQHQKQNNGCLAELEAFAKQENIPIIPHETATYF    60
             MV++Y     +N M RPVVK E+V++MR  Q Q  G LAE+   FAK+ NIP+IPHET  YF
Sbjct:     1 MVETYKSTSNPMMNRPVVKAELVEWMRSSQTQVTGELAEVLNFAKENNIPVIPHETVLYF    60

Query:    61 RFLMQTLQPKHILEIGTAIGFSALLMAENAPEAKITTIDRNEEMIALAKENFAKYDNHNQ   120
             + L+  L+PK ILEIGTAIGFSAL+MA+  PEA+I TIDRN EMI LAK+N AKYD+ NQ
Sbjct:    61 QMLLSLLKPKRILEIGTAIGFSALVMAQEVPEAEIVTIDRNPEMIELAKKNLAKYDHRNQ   120

Query:   121 ITLLEGDAVDVLQTLDKSYDFVFMDSAKSKYIVFLPQVLKHLDVGGVVVLDDIFQGGDIA   180
```

-continued

```
                 I L EGDA DVLQ L   +D VFMDSAKSKY+ FLP+ L+ L   G++++DD+FQ G+I
Sbjct:    121    IQLKEGDAADVLQELKGPFDLVFMDSAKSKYVEFLPKSLELLSENGLILMDDVFQAGEIL    180

Query:    181    KPIDEVRRGQRTIYRGLQRLFDSTLQHPDLTATLVPLGDGLLMIRKN               227
                 PI EV+R QR + RGL++LFD    +P    +++PLGDGLLMI+K+
Sbjct:    181    LPIMEVKRNQRALERGLRKLFDEVFDNPKYMTSVLPLGDGLLMIKKH               227
```

A related DNA sequence was identified in *S. pyogenes* <SEQ ID 6637> which encodes the amino acid sequence <SEQ ID 6638>. Analysis of this protein sequence reveals the following:

Possible site: 46
>>> Seems to have no N-terminal signal sequence
INTEGRAL       Likelihood = −1.38    Transmembrane 153-169 (152-170)
----- Final Results -----
   bacterial membrane --- Certainty = 0.1553 (Affirmative) <succ>
     bacterial outside --- Certainty = 0.0000 (Not Clear) <succ>
       bacterial cytoplasm --- Certainty = 0.0000 (Not Clear) <succ>

The protein has homology with the following sequences in the databases:

```
>GP:CAA68045 GB:X99710 methyltransferase [Lactococcus lactis]
Identities = 134/227 (59%), Positives = 169/227 (74%)

Query:     1     MVKSYSKTANHNMRRPVVKEELVHYMRTRQKQTTGFLAELEQFARQENIPIIQPEVVAYF    60
                 MV++Y  T+N  M RPVVK ELV +MR+ Q Q TG LAE+  FA++ NIP+I  E V YF
Sbjct:     1     MVETYKSTSNPMMNRPVVKAELVEWMRSSQTQVTGELAEVLNFAKENNIPVIPHETVLYF    60

Query:    61     RFLLQSLQPKHILEIGTAIGFSALLMAENAPDATIVTIDRNREMIDFAKANFAKYDSRQQ   120
                 + LL   L+PK ILEIGTAIGFSAL+MA+   P+A IVTIDRN EMI+ AK N AKYD R Q
Sbjct:    61     QMLLSLLKPKRILEIGTAIGFSALVMAQEVPEAEIVTIDRNPEMIELAKKNLAKYDHRNQ   120

Query:   121     IRLLEGDAADILSTLEGNFDFVFMDSAKSKYIVFLPEILRLLKVGGVVILDDVFQGGDIT   180
                 I+L EGDAAD+L  L+G FD VFMDSAKSKY+ FLP+ L LL   G++++DDVFQ G+I
Sbjct:   121     IQLKEGDAADVLQELKGPFDLVFMDSAKSKYVEFLPKSLELLSENGLILMDDVFQAGEIL   180

Query:   181     KPIEDIRRGQRTIYRGLQSLFDATLTHPNLTTSLVPLSDGLLMIRKN               227
                 PI +++R QR + RGL+ LFD    +P    TS++PL DGLLMI+K+
Sbjct:   181     LPIMEVKRNQRALERGLRKLFDEVFDNPKYMTSVLPLGDGLLMIKKH               227
```

An alignment of the GAS and GBS proteins is shown below.

```
Identities = 177/235 (75%), Positives = 199/235 (84%)

Query:     1     MVQSYSKNANHNMRRPVVKEEIVQYMRQHQKQNNGCLAELEAFAKQENIPIIPHETATYF    60
                 MV+SYSK ANHNMRRPVVKEE+V YMR  QKQ  G LAELE FA+QENIPII  E    YF
Sbjct:     1     MVKSYSKTANHNMRRPVVKEELVHYMRTRQKQTTGFLAELEQFARQENIPIIQPEVVAYF    60

Query:    61     RFLMQTLQPKHILEIGTAIGFSALLMAENAPEAKITTIDRNEEMIALAKENFAKYDNHNQ   120
                 RFL+Q+LQPKHILEIGTAIGFSALLMAENAP+A I TIDRN EMI  AK NFAKYD+  Q
Sbjct:    61     RFLLQSLQPKHILEIGTAIGFSALLMAENAPDATIVTIDRNREMIDFAKANFAKYDSRQQ   120

Query:   121     ITLLEGDAVDVLQTLDKSYDFVFMDSAKSKYIVFLPQVLKHLDVGGVVVLDDIFQGGDIA   180
                 I LLEGDA D+L TL+ ++DFVFMDSAKSKYIVFLP++L+ L VGGVV+LDD+FQGGDI
Sbjct:   121     IRLLEGDAADILSTLEGNFDFVFMDSAKSKYIVFLPEILRLLKVGGVVILDDVFQGGDIT   180

Query:   181     KPIDEVRRGQRTIYRGLQRLFDSTLQHPDLTATLVPLGDGLLMIRKNADHIVLED       235
                 KPI+++RRGQRTIYRGLQ LFD+TL HP+LT +LVPL DGLLMIRKN   IVL D
Sbjct:   181     KPIEDIRRGQRTIYRGLQSLFDATLTHPNLTTSLVPLSDGLLMIRKNQADIVLPD       235
```

Based on this analysis, it was predicted that these proteins and their epitopes could be useful antigens for vaccines or diagnostics.

Example 2148

A DNA sequence (GBSx2264) was identified in *S. agalactiae* <SEQ ID 6639> which encodes the amino acid sequence <SEQ ID 6640>. This protein is predicted to be phosphoglycolate phosphatase. Analysis of this protein sequence reveals the following:

Possible site: 50
>>> Seems to have no N-terminal signal sequence
----- Final Results -----
   bacterial cytoplasm --- Certainty = 0.2193 (Affirmative) <succ>
     bacterial membrane --- Certainty = 0.0000 (Not Clear) <succ>
       bacterial outside --- Certainty = 0.0000 (Not Clear) <succ>

A related GBS nucleic acid sequence <SEQ ID 8985> which encodes amino acid sequence <SEQ ID 8986> was also identified. This protein appears to be a hydrolase i.e. an exposed protein.

The protein has homology with the following sequences in the GENPEPT database.

```
>GP:CAA91552 GB:Z67740 unidentified [Streptococcus pneumoniae]
Identities = 39/117 (33%), Positives = 67/117 (56%), Gaps = 9/117 (7%)

Query:    98  KEQESRDSKIHLM-PYAKEILEWTKEQDIPNFMYTHKGASTHSVLETLQISHYFDEILTG    156
              KE E+R+ +  ++   ++LE    Q   +F+ +H+     +LE   I+ YF E++T
Sbjct:    25  KENEARELEHPILFEGVSDLLEDILNQGGRHFLVSHRNDQVLEILEKTSIAAYFTEVVTS    84

Query:   157  VSGFERKPHPQGINYLVKRYSLDKSMTYYIGDRPLDLEVAQNAGIKS------INLR    207
              SGF+RKP+P+ + YL ++Y +   +   IGDRP+D+E  Q AG+ +      +NLR
Sbjct:    85  SSGFKRKPNPESMLYLREKYQISSGLV--IGDRPIDIEAGQAAGLDTHLFTSIVNLR    139
```

SEQ ID 8986 (GBS240) was expressed in *E. coli* as a His-fusion product. SDS-PAGE analysis of total cell extract is shown in FIG. 57 (lane 2; MW 26 kDa). It was also expressed in *E. coli* as a GST-fusion product. SDS-PAGE analysis of total cell extract is shown in FIG. 61 (lane 3; MW 51.5 kDa).

GBS240-GST was purified as shown in FIG. 225, lane 12.

Based on this analysis, it was predicted that this protein and its epitopes, could be useful antigens for vaccines or diagnostics.

Example 2149

A DNA sequence (GBSx2265) was identified in *S. agalactiae* <SEQ ID 6641> which encodes the amino acid sequence <SEQ ID 6642>. Analysis of this protein sequence reveals the following:

Possible site: 36
>>> Seems to have no N-terminal signal sequence
----- Final Results ----- bacterial cytoplasm --- Certainty = 0.2620 (Affirmative) <succ>
bacterial membrane --- Certainty = 0.0000 (Not Clear) <succ>
bacterial outside --- Certainty = 0.0000 (Not Clear) <succ>

A related DNA sequence was identified in *S. pyogenes* <SEQ ID 6643> which encodes the amino acid sequence <SEQ ID 6644>. Analysis of this protein sequence reveals the following:

Possible site: 54
>>> Seems to have no N-terminal signal sequence
----- Final Results -----
bacterial cytoplasm --- Certainty = 0.2967 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 463/599 (77%), Positives = 541/599 (90%)

Query:     1  MSDNRSHIEEKYQWDLTTVFATDELWETEVVELTQAIDNAKGFSGHLLDSSQSLLEITEV    60
              M+DNRSH+EEKY WDL+T+FATD+ WE EV +L   ++ +KGF+GHLLDSS +LL++T+
Sbjct:     1  MTDNRSHLEEKYTWDLSTIFATDKDWEAEVSDLATEVEASKGFAGHLLDSSANLLKVTKT    60

Query:    61  ELDLSRRLEKVYVYASMKNDQDTTVAKYQEFQAKATALYAKFSETFSFYEPELLQLSESD    120
              L+L+RR+EKVYVYA MKNDQDTTVAKYQE+QAKA+ LYAKFSE FSFY+PE++ L + D
Sbjct:    61  YLELARRVEKVYVYAHMKNDQDTTVAKYQEYQAKASGLYAKFSEVFSFYDPEVMMLHQED    120

Query:   121  YQSFLLEMPDLQKYDHFFEKIFANKPHVLSQNEEELLAGASEIFGAAGETFEILDNADMV    180
              YQ+FL E P+L+ Y+HFF+K+F  + HVLSQ EEELLAGA EIF   A ETF ILDNAD+V
Sbjct:   121  YQAFLTETPELKVYNHFFDKLFQAREHVLSQAEEELLAGAQEIFNGAEETFSILDNADIV    180

Query:   181  FPVVKNAKGEEVELTHGNFISLMESSDRTVRKEAYQAMYSTYEQFQHTYAKTLQTNVKSQ    240
              FPVVKN KGE+VELTHGNFISLMES DR+VR+  AY+AMYSTYEQFQHTYAKTLQTNVK Q
Sbjct:   181  FPVVKNDKGEDVELTHGNFISLMESKDRSVRQAAYEAMYSTYEQFQHTYAKTLQTNVKVQ    240

Query:   241  NFKARVHHYQSARQSALSANFIPEEVYETLIKTVNHHLPLLHRYMKLRQKVLGLDDLKMY    300
              N+KARVH Y SARQ+A++ANFIPE VY+TL++TVN HLPLLHRY+KLRQ+VLGLDDLKMY
Sbjct:   241  NYKARVHKYDSARQAAMAANFIPEAVYDTLLETVNKHLPLLHRYLKLRQEVLGLDDLKMY    300

Query:   301  DVYTPLSQMDMSFTYDEALKKSEEVLAIFGEAYSERVHRAFTERWIDVHVNKGKRSGAYS    360
              DVYTPLS+ D++  YDEAL+K+E+VLA+FG+ Y++RVHRAFTERWIDVHVNKGKRSGAYS
Sbjct:   301  DVYTPLSETDLAIGYDEALEKAEKVLAVFGKDYADRVHRAFTERWIDVHVNKGKRSGAYS    360

Query:   361  GGSYDTNAFMLLNWQDTLDNLYTLVHETGHSLHSTFTRENQPYVYGDYSIFLAEIASTTN    420
              GGSYDTNAF+LLNWQDTLDNLYTLVHETGHSLHSTFTRE QPYVYGDYSIFLAEIASTTN
Sbjct:   361  GGSYDTNAFILLNWQDTLDNLYTLVHETGHSLHSTFTRETQPYVYGDYSIFLAEIASTTN    420

Query:   421  ENILTETLLKEVKDDKNRFAILNHYLDGFKGTIFRQTQFAEFEHAIHVADQEGQVLTSEY    480
```

```
                                         -continued
               ENI+TE LL  EV+D+K RFAILNHYLDGF+GT+FRQTQFAEFEHAIH ADQ+G+VLTSEY
Sbjct:   421   ENIMTEALLNEVQDEKERFAILNHYLDGFRGTVFRQTQFAEFEHAIHQADQKGEVLTSEY       480

Query:   481   LNNLYAELNEKYYGLTKEDNHFIQYEWARIPHFYYNYYVFQYATGFAAANYLAERIVNGN       540
               LN  LYA+LNEKYYGL+K+DNHFIQYEWARIPHFYYNYYV+QYATGFAAA+YLA++IV+G
Sbjct:   481   LNQLYADLNEKYYGLSKKDNHFIQYEWARIPHFYYNYYVYQYATGFAAASYLADKIVHGT       540

Query:   541   PEDKEAYLNYLKAGNSDYPLNVIAKAGVDMTSADYLDAAFRVFEERLVELENLVAKGVH        599
                +D + YL YLK+GNSDYPL VIAKAGVDM   DYL+AAF+VF+ERL ELE LV+KG+H
Sbjct:   541   QDDIDHYLAYLKSGNSDYPLEVIAKAGVDMEKGDYLEAAFKVFDERLTELEVLVSKGIH       599
```

Based on this analysis, it was predicted that these proteins and their epitopes could be useful antigens for vaccines or diagnostics.

Example 2150

A DNA sequence (GBSx2266) was identified in £agalactiae <SEQ ID 6645> which encodes the amino acid sequence <SEQ ID 6646>. This protein is predicted to be competence protein. Analysis of this protein sequence reveals the following:

Possible site: 22
>>> Seems to have no N-terminal signal sequence
----- Final Results -----
   bacterial cytoplasm --- Certainty = 0.2955 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

A related DNA sequence was identified in S. pyogenes <SEQ ID 6647> which encodes the amino acid sequence <SEQ ID 6648>. Analysis of this protein sequence reveals the following:

Possible site: 61
>>> Seems to have no N-terminal signal sequence
----- Final Results -----
   bacterial cytoplasm --- Certainty = 0.1034 (Affirmative) <succ>
   bacterial membrane --- Certainty = 0.0000 (Not Clear) <succ>
   bacterial outside --- Certainty = 0.0000 (Not Clear) <succ>

```
>GP:AAC23746 GB:AF052209 competence protein [Streptococcus pneumoniae]
Identities = 127/269 (47%), Positives = 176/269 (65%), Gaps = 8/269 (2%)

Query:     1   MLIAKDKQGNLINLLESHPGKGQYFCPTCCSAVRLKAGRIMRRHFAHISLKNCQFYHENE       60
               M +A+D +G L+N+LE    K  Y CP C  + L+ G  +R HFAH SLK+C F+ ENE
Sbjct:     1   MFVARDARGELVNVLEDKLEKQAYTCPACGGQLHLRQGPSVRTHFAHKSLKDCDFFFENE      60

Query:    61   SNEHLQLKAKLYMSLSRENETMLEHHLPEINQIADLFVNETLALE----VQCSRLSEQRL      116
               S EHL   K  LY L +E +  LE+ L E+ QIAD+FVN LALE     V C +   + L
Sbjct:    61   SPEHLANKESLYHWLKKETKVQLEYPLSELKQIADVFVNGNLALESSVVVPCLK---KVL      117

Query:   117   RERTKAYLQADFQVRWLLGEKLWLKHRLTNLHKQFLQFSQSIGFHIWELDLRLEVLRLKY      176
               +ER++  Y    +QV WLLG+KLWLK RLT L   FL  FSQ++GF++WELD   +VLRLKY
Sbjct:   118   KERSEGYRSQGYQVLWLLGQKLWLKERLTRLQAGFLYFSQNMGFYVWELDKGKQVLRLKY      177

Query:   177   LIYEDLRGHVYYLSKTCPL-SGDVLAFLKWPYQSKNLNFYKVKQDRNIRDYVRQQLRYGN      235
               LIY+DLRG  ++Y  K       G +L  L+ PY+ +  ++ + V +D++I  Y+RQQL Y N
Sbjct:   178   LIYQDLRGKLHYQIKEFSYGQGSLLEILRLPYKKQKISHFTVSEDKDICRYIRQQLYYQN      237

Query:   236   QFWLRKQEKAYLSGQNLLTQELMMFFPQI                                264
               FW+++Q +AY  G+N+LT  L  ++PQI
Sbjct:   238   LFWMKEQAEAYQKGENILTYGLKEWYPQI                                266
```

An alignment of the GAS and GBS proteins is shown below.

```
Identities = 154/312 (49%), Positives = 204/312 (65%), Gaps = 1/312 (0%)

Query:     1   MLIAKDKQGNLINLL-ESHPGKGQYFCPTCCSAVRLKAGRIMRRHFAHISLKNCQFYHEN       59
               +L  A D  +  LI+L+ +      K  + CP C  S VRL+ G I R HFAH+ L +CQF   EN
Sbjct:     4   ILTALDDKNQLISLVTQPISTKPPFRCPACKSPVRLRQGTIRRPHFAHVQLAHCQFQAEN       63

Query:    60   ESNEHLQLKAKLYMSLSRENETMLEHHLPEINQIADLFVNETLALEVQCSRLSEQRLRER      119
               ES EHL LKAKLY SL R     +E +LPE+ QIADL+VN  LALE+QCS L   +RL++R
Sbjct:    64   ESEEHLTLKAKLYTSLVRTEAVCIEKYLPELQQIADLWVNDKLALEIQCSPLPVERLKKR      123
```

```
Query:   120  TKAYLQADFQVRWLLGEKLWLKHRLTNLHKQFLQFSQSIGFHIWELDLRLEVLRLKYLIY     179
              TKAY +  + VRWLLG KLWL   LT L KQFL FS S+GFH+WELD    +LRLKYLI+
Sbjct:   124  TKAYQEKGYPVRWLLGRKLWLNTHLTALQKQFLYFSSSLGEHLWELDAAANLLRLKYLIH     183

Query:   180  EDLRGHVYYLSKTCPLSGDVLAFLKWPYQSKNLNFYKVKQDRNIRDYVRQQLRYGNQFWL     239
              EDL G V YL+KT  L +++    +PYQ + L Y+ K    N+    +++ L   + WL
Sbjct:   184  EDLFGKVSYLTKTISLDHNIMEMFRLPYQQEILYSYQKKMTVNLSKRIQRALLARHPKWL     243

Query:   240  RKQEKAYLSGQNLLTQELMMFFPQIQPPRVDTDFCQITNSLTSFYQNFTNYYQKNKNNLD     299
              R+QEKAYLSG NLL       F+PQ +P +  + FCQI   +L +Y++F   YY+K K+
Sbjct:   244  RRQEKAYLSGYNLLMLTTDAFYPQWRPVQSSSGFCQIKGNLRPYYESFKVYYKKEKDKKV     303

Query:   300  QTLYPPVFYDKI                                                  311
              QTL+   P +Y K+
Sbjct:   304  QTLFSPKYYVKM                                                  315
```

Based on this analysis, it was predicted that these proteins and their epitopes could be useful antigens for vaccines or diagnostics.

Example 2151

A DNA sequence (GBSx2267) was identified in *S. agalactiae* <SEQ ID 6649> which encodes the amino acid sequence <SEQ ID 6650>. This protein is predicted to be bicyclomycin resistance protein. Analysis of this protein sequence reveals the following:

```
Possible site: 25
>>> Seems to have a cleavable N-term signal seq.
INTEGRAL    Likelihood = −8.33    Transmembrane 78-94 (75-96)
INTEGRAL    Likelihood = −8.33    Transmembrane 269-285 (267-287)
INTEGRAL    Likelihood = −7.38    Transmembrane 290-306 (287-314)
INTEGRAL    Likelihood = −7.06    Transmembrane 203-219 (199-225)
INTEGRAL    Likelihood = −6.69    Transmembrane 157-173 (143-184)
INTEGRAL    Likelihood = −6.42    Transmembrane 53-69 (44-73)
INTEGRAL    Likelihood = −6.42    Transmembrane 362-378 (357-381)
INTEGRAL    Likelihood = −3.72    Transmembrane 242-258 (240-261)
INTEGRAL    Likelihood = −3.24    Transmembrane 329-345 (328-346)
INTEGRAL    Likelihood = −1.28    Transmembrane 107-123 (106-123)
----- Final Results -----
    bacterial membrane --- Certainty = 0.4333 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:CAA15047 GB:AJ235272 BICYCLOMYCIN RESISTANCE PROTEIN (bcr1)
[Rickettsia prowazekii]
        Identities = 86/336 (25%), Positives = 159/336 (46%), Gaps = 28/336 (8%)

Query:    73  GKKNTVLLGLCLILMSGFISFFTSNFSLAMASRLLLGIGIGLYNSLSISIITDLYEADER     132
              G++   VLLGL + ++S   IS F+ N  + M +R +    G+ + + +  S+  D Y+  E
Sbjct:    70  GRRPIVLLGLFIYIVSSIISIFSFNIEMLMIARFIQAFGVSVGSVIGQSMARDSYQGAEL     129

Query:   133  ASMIGLRTASLNIGKALTTFIVGLVLA-IGVNYIYLVYLLVIPVFF-FFWKNVPEVENQT     190
              + +   + +  L       AL  ++I G ++    + +Y+++ + L     +   +++ +PE
Sbjct:   130  SYVYAILSPWLLFIPALGSYIGGYIIEYLSWHYVFIFFSLAGTILLALYYQILPETNYYI     189

Query:   191  HTLKASTTFDT-----KAALLMLITFLVGI---AYIGATVKIPTLLVTKYHYATSFSSNM     242
              ++S  F+      K  +L L  F++G     Y G  ++ P +L+  +      SF   +
Sbjct:   190  AFSQSSKYFEVFNIIIKDKMLWLYAFIIGAFNGIYYGFFIEAPFILIDQMRVLPSFYGKL     249

Query:   243  LTLLAFSGILVGSVFGKLVK---VFQEKTLLIMILAMGIGNVLFALANNQIIFIVAS--I     297
              LL+F+ I  G + G L+K     V+ +K + I +     G +LFA+ +  + FI+ S
Sbjct:   250  AFLLSFASIFGGFLGGYLIKKRQVYDKKVMSIGFIFSLCGCILFAVDSFILEFILVSNVF     309

Query:   298  LIGASFVGTM-----SSVFFYISKNYAKEHNNFITSLALTAGNI-GVILTPLI--LTKLP     349
              I    F+ M       S+  I+    YA E    +T       TAG+I G I    +I   +T
Sbjct:   310  AIAMIFMPMMIHMIGHSLLIAITLRYALEDYATVTG---TAGSIFGAIYYVVIASVTYCV     366

Query:   350  SQLHLEPFMTPFLITSGLMVINV--FVYLVLMSKNK                          383
              S++H E       L+    L + +V  F Y+ L+ K K
Sbjct:   367  SKIHGETISNFSLLCLVLSISSVISFYYICLLYKKK                          402
```

A related GBS gene <SEQ ID 8987> and protein <SEQ ID 8988> were also identified. Analysis of this protein sequence reveals the following:

```
Lipop: Possible site: −1   Crend: 7
McG: Discrim Score: 6.28
GvH: Signal Score (−7.5): −2.45
Possible site: 25
>>> Seems to have a cleavable N-term signal seq.
ALOM program   count: 10 value: +31 8.33 threshold: 0.0
INTEGRAL    Likelihood = −8.33    Transmembrane 78-94 (75-96)
INTEGRAL    Likelihood = −8.33    Transmembrane 269-285 (267-287)
INTEGRAL    Likelihood = −7.38    Transmembrane 290-306 (287-314)
INTEGRAL    Likelihood = −7.06    Transmembrane 203-219 (199-225)
INTEGRAL    Likelihood = −6.69    Transmembrane 157-173 (143-184)
INTEGRAL    Likelihood = −6.42    Transmembrane 53-69 (44-73)
INTEGRAL    Likelihood = −6.42    Transmembrane 362-378 (357-381)
INTEGRAL    Likelihood = −3.72    Transmembrane 242-258 (240-261)
```

-continued

| | | |
|---|---|---|
| INTEGRAL | Likelihood = −3.24 | Transmembrane 329-345 (328-346) |
| INTEGRAL | Likelihood = −1.28 | Transmembrane 107-123 (106-123) |
| PERIPHERAL | Likelihood = 3.71 | 140 | modified ALOM score: 2.17
\*\*\* Reasoning Step: 3
----- Final Results -----
   bacterial membrane --- Certainty = 0.4333 (Affirmative) <succ>
     bacterial outside --- Certainty = 0.0000 (Not Clear) <succ>
        bacterial cytoplasm --- Certainty = 0.0000 (Not Clear) <succ>

The protein has homology with the following sequences in the databases:

```
ORF01955(517-1449 of 1749)
EGAD|163303|RP603(70-402 of 407) bicyclomycin resistance protein {Rickettsia prowazekii}
OMNI|NT01RP0626 conserved hypothetical protein GP|3861147|emb|CAA15047.1||AJ235272
BICYCLOMYCIN RESISTANCE PROTEIN (bcr1) {Rickettsia prowazekii} PIR|E71665|E71665
bicyclomycin resistance protein (bcr1) RP603 - Rickettsia prowazekii
% Match = 5.9
% Identity = 26.5 % Similarity = 52.0
Matches = 85 Mismatches = 141 Conservative Sub.s = 82

474       504       534       564       594       624       654       684
SLVTIPAMMITIFVILSNFVVTKLGKKNTVLLGLCLILMSGFISFFTSNFSLAMASRLLLGIGIGLYNSLSISIITDLYE
           |::   ||||| : ::|   || |:  |    :  | :|::     |: :  :    |:    ||:
MTSTLYFLGFAVGILSLGRLSDIYGRRPIVLLGLFIYIVSSIISIFSFNIEMLMIARFIQAFGVSVGSVIGQSMARDSYQ
            60        70        80        90       100       110       120

714       744       774       801       831       858       888
ADERASMIGLRTASLNIGKALTTFIVGLVLA-IGVNYIYLVYLLVIPVFF-FFWKNVPEVENQTHTLKAST---TFDT--
|  : :      |  |    || ::|   | ::   :  :|::: :  |    ::: ::::  :||         ::|
GAELSYVYAILSPWLLFIPALGSYIGGYIIEYLSWHYVFIFFSLAGTILLALYYQILPETNYYIAFSQSSKYFEVFNIII
         140       150       160       170       180       190       200

933       954       984       1014      1044      1074      1095      1125
KAALLMLITFLVG---IAYIGATVKIPTLLVTKYHYATSFSSNMLTLLAFSGILVGSVFGKLVK---VFQEKTLLIMILA
|  :|  |  ::|      | |   ::  |: :    ||   :   ||:|:  |:  | | |:      |:  |   |  :
KDKMLWLYAFIIGAFNGIYYGFFIEAPFILIDQMRVLPSFYGKLAFLLSFASIFGGFLGGYLIKKRQVYDKKVMSIGFIF
         220       230       240       250       260       270       280

1155      1182      1209      1224      1254      1284      1311      1335
MGIGNVLFALANNQIIFI-VASIL-IGASFVGTM-----SSVFFYISKNYAKEHNNFITSLALTAGNI-GVILTPLI--L
|  :|||: :  : || |:::: |    |::  |     |:: |:  ||  |    :|    |:|  |    :|  :
SLCGCILFAVDSFILEFILVSNVFAIAMIFMPMMIHMIGHSLLIAITLRYALEDYATVTGTA---GSIFGAIYYVVIASV
         300       310       320       330       340       350       360

1365      1395      1419      1449      1479      1509      1539      1569
TKLPSQLHLEPFMTPFLITSGLMVINV--FVYLVLMSKNK*KVIRKDNFFRIVKVGEKMLIAKDKQGNLINLLESHPGKG
|     |::|  |       |:    :|      ||:   |  |
TYCVSKIHGETISNFSLLCLVLSISSVISFYYICLLYKKKSIIIN
         380       390       400
```

<SEQ ID 6652>. This protein is predicted to be 16S pseudou-ridylate synthase (rsuA). Analysis of this protein sequence reveals the following:

Possible site: 52
>>> Seems to have no N-terminal signal sequence
----- Final Results -----
   bacterial cytoplasm --- Certainty = 0.2645 (Affirmative) <succ>
     bacterial membrane --- Certainty = 0.0000 (Not Clear) <succ>
        bacterial outside --- Certainty = 0.0000 (Not Clear) <succ>

The protein has homology with the following sequences in the GENPEPT database.

There is also homology to SEQ ID 400

Based on this analysis, it was predicted that these proteins and their epitopes could be useful antigens for vaccines or diagnostics.

Example 2152

A DNA sequence (GBSx2268) was identified in *S. agalactiae* <SEQ ID 6651> which encodes the amino acid sequence

```
>GP:BAB06992 GB:AP001518 16S pseudouridylate synthase [Bacillus halodurans]
Identities = 106/234 (45%), Positives = 141/234 (59%), Gaps = 1/234 (0%)

Query:    1 MRLDKLLGQAGFGSRNQVKKLICSRQVSVDGQIVTKDNVIVDSGLQSIFVGKERVCLKES   60
            MR+DK L   GFGSR VKKL+ +   V V GQ +    V+   +SI V  E V   K
Sbjct:    1 MRIDKFLANMGFGSRKDVKKLLKTGAVRVQGQPIKDPSTHVEPESESITVYGEEVEYKPY   60

Query:   61 SYYLLYKPSGVVSAVRDSEHKTVIDLISEKDKVEGLYPIGRLDRDTEGLLIVTNNGPLGY  120
             Y ++ KP GV+ A   D EH+TVIDL+ E+++      P+GRLD+DT GLL++TN+G    +
```

```
Sbjct:    61  VYLMMNKPKGVICATEDLEHETVIDLLGEEERHYEPSPVGRLDKDTVGLLLITNDGKFNH  120

Query:   121  RMLHPKHHVAKTYYVEVNGFLERDAITFFEEGVVFDDGTKCKPAELTIDTANNDKSTARI  180
              ++ PKHHV KTY   V G+ + +  F  GVV DDG   KPA L I  A   +S    +
Sbjct:   121  WLMSPKHHVPKTYRALVEGHVTEEDVGAFSHGVVLDDGYVTKPATLHILEA-GARSHIEL  179

Query:   181  TITEGKFHQVKKMFLAYGVKVIYLRRISFGDLRLDMNLKPGQYRRLRDSEAAIL       234
              +TEGKFHQVK+MF A G +V+ L RI   G+L LD   L  G+YR L    E A+L
Sbjct:   180  ILTEGKFHQVKRMFQAVGKRVLELERIKIGNLLLDPELARGEYRELTKEEIALL       233
```

A related DNA sequence was identified in *S. pyogenes* <SEQ ID 6653> which encodes the amino acid sequence <SEQ ID 6654>. Analysis of this protein sequence reveals the following:

---

Possible site: 56
>>> Seems to have no N-terminal signal sequence
----- Final Results -----
   bacterial cytoplasm --- Certainty = 0.3310 (Affirmative) <succ>
   bacterial membrane --- Certainty = 0.0000 (Not Clear) <succ>
     bacterial outside --- Certainty = 0.0000 (Not Clear) <succ>

---

An alignment of the GAS and GBS proteins is shown below.

```
Identities = 111/194 (57%), Positives = 138/194 (70%)
Query:   1    MRLDKLLGQAGFGSRNQVKKLICSRQVSVDGQIVTKDNVIVDSGLQSIFVGKERVCLKES   60
              MRLDKLL    GSR+QVKKLI ++ V VD          VD GLQ I V +RV      +
Sbjct:   1    MRLDKLLEGTKVGSRSQVKKLIKAQGVWVDHMPARNGRQNVDPGLQLIEVTGQRVTHPKH   60

Query:  61    SYYLLYKPSGVVSAVRDSEHKTVIDLISEKDKVEGLYPIGRLDRDTEGLLIVTNNGPLGY  120
              SY +L KPSGVVSA +D+ +  TVID ++E+DK    LYP+GRLDRDTEGL+++T+NGPLG+
Sbjct:  61    SYIILNKPSGVVSAKKDTNYLTVIDQLAEEDKSPDLYPVGRLDRDTEGLVLLTDNGPLGF  120

Query: 121    RMLHPKHHVAKTYYVEVNGFLERDAITFFEEGVVFDDGTKCKPAELTIDTANNDKSTARI  180
              RMLHP HHV+KTY V VNG L  DA   FF   G+  F  G +C+PA+LTI  A+ D+S A +
Sbjct: 121    RMLHPSHHVSKTYLVTVNGLLAEDASDFFAAGICFPTGEQCQPAQLTILKADTDQSQASL  180

Query: 181    TITEGKFHQVYKMF                                               194
              TI+EGKFHQVKK F
Sbjct: 181    TISEGKFHQVKKCF                                               194
```

Based on this analysis, it was predicted that these proteins and their epitopes could be useful antigens for vaccines or diagnostics.

Example 2153

A DNA sequence (GBSx2269) was identified in *S. agalactiae* <SEQ ID 6655> which encodes the amino acid sequence <SEQ ID 6656>. Analysis of this protein sequence reveals the following:

---

Possible site: 42
>>> Seems to have an uncleavable N-term signal seq
----- Final Results -----
   bacterial membrane --- Certainty = 0.0000 (Not Clear) <succ>
    bacterial outside --- Certainty = 0.0000 (Not Clear) <succ>
   bacterial cytoplasm --- Certainty = 0.0000 (Not Clear) <succ>

---

A related GBS nucleic acid sequence <SEQ ID 9745> which encodes amino acid sequence <SEQ ID 9746> was also identified.

The protein has homology with the following sequences in the GENPEPT database.

```
>GP:BAA18872 GB:D90917 hypothetical protein [Synechocystis sp.]
Identities = 197/318 (61%), Positives = 243/318 (75%)
Query:  22    MGLLVDGKWVDQWYDTASTGGKFVRTVTQFRHWVTKDGSAGPSGDAGFKAESGRYHLYVS   81
              MGLLV+G W DQWYDT STGG+FVR  +QFRHW+T DGS GP+G  GFKAE+GRYHLYVS
Sbjct:   1    MGLLVNGIWQDQWYDTESTGGRFVRHDSQFRHWITPDGSPGPTGHGGFKAEAGRYHLYVS   60

Query:  82    LACPWASRVLIMRKLKNLESHISISIVNPLMLENGWTFQEYKGVIPDMINQSQYLYQIYQ  141
              LACPWA R LI RKLK LE   I +S+V+ LM ENGWTF    GV+PD +   ++YLYQIY
Sbjct:  61    LACPWAHRTLIFRKLKGLEGMIDVSVVHWLMRENGWTFAPGPGVMPDPLFNAEYLYQIYT  120
```

-continued

```
Query: 142  ASQSDYTGRVTVPVLWDKKFHTIVNNESSEIMRMLNTAFNHITGNTDDYYPDSLQGQIDE 201
            + + Y+GRVTVP+LWDK+  TIVNNESSEI+R+ N+AF+ +   + DYYP +L+ QID
Sbjct: 121  RADAQYSGRVTVPILWDKQKQTIVNNESSEIIRIFNSAFDGLGAKSGDYYPKALRTQIDA 180

Query: 202  MNNFIYPKINNGVYKAGFATSQNVYQKEVETLFTALDQLEKHLSDNHYLVGEQFTEADIR 261
            +N+ IY  INNGVYK GFAT+Q  Y+++   LF +LD LE  L  + YL G++ TEAD R
Sbjct: 181  LNDRIYHTINNGVYKCGFATTQTAYEEAIAPLFESLDWLEGILQGHQYLTGDEITEADWR 240

Query: 262  LFTTLVRFDTVYYGHFKCNLKALHDYPHLWHYTKRIYNLPGIAETVNFDHIKKHYYGSHK 321
            LFTTL+RFD VY GHFKCNL+ +  DYP+LW Y + +Y+ PGIAETVNF HIK HYY SH
Sbjct: 241  LFTTLIRFDVVYVGHFKCNLRRIQDYPNLWRYLRDLYHQPGIAETVNFQHIKGHYYESHL 300

Query: 322  TINPTGIIPAGPNLDWTI                                        339
            INPTGI+P GP LD ++
Sbjct: 301  NINPTGIVPMGPALDLSL                                        318
```

No corresponding DNA sequence was identified in *S. pyogenes*.

SEQ ID 6656 (GBS655) was expressed in *E. coli* as a GST-fusion product. SDS-PAGE analysis of total cell extract is shown in FIG. 143 (lane 2-4; MW 27 kDa).

Based on this analysis, it was predicted that this protein and its epitopes, could be useful antigens for vaccines or diagnostics.

Example 2154

A DNA sequence (GBSx2270) was identified in *S. agalactiae* <SEQ ID 6657> which encodes the amino acid sequence <SEQ ID 6658>. Analysis of this protein sequence reveals the following:

---

Possible site: 43
>>> Seems to have no N-terminal signal sequence
----- Final Results -----
  bacterial cytoplasm --- Certainty = 0.1116 (Affirmative) <succ>
  bacterial membrane --- Certainty = 0.0000 (Not Clear) <succ>
  bacterial outside --- Certainty = 0.0000 (Not Clear) <succ>

---

The protein has homology with the following sequences in the GENPEPT database.

A related DNA sequence was identified in *S. pyogenes* <SEQ ID 6659> which encodes the amino acid sequence <SEQ ID 6660>. Analysis of this protein sequence reveals the following:

---

Possible site: 43
>>> Seems to have no N-terminal signal sequence
INTEGRAL    Likelihood = −0.59    Transmembrane 174-190 (174-190)
----- Final Results -----
  bacterial membrane --- Certainty = 0.1235 (Affirmative) <succ>
  bacterial outside --- Certainty = 0.0000 (Not Clear) <succ>
  bacterial cytoplasm --- Certainty = 0.0000 (Not Clear) <succ>

---

The protein has homology with the following sequences in the databases:

```
>GP:CAB12030 GB:Z99105 similar to glucosamine-6-phosphate isomerase
[Bacillus subtilis]

Identities = 112/243 (46%), Positives = 163/243 (66%), Gaps = 10/243 (4%)
Query: 1    MRVITVKNDIEGGKIAFTLLEEKMKAGAQT-LGLATGSSPITFYEEIVKS----NLDFSN 55
            M+++ ++ E K++ +++E+++A      LGLATGS+P+ Y++++       +DFS
Sbjct: 1    MKILIAEHYEELCKLSAAIIKEQIQAKKDAVLGLATGSTPVGLYKQLISDYQAGEIDFSK 60

Query: 56   MVSINLDEYVGIAASNDQSYSYFMHKHLFDAKPFKENNL--PNGLAKDLKEEIKRYDAVI 113
            + + NLDEY G++ S+ QSY++FMH+HLF    + +++  P G   L+   K Y+ +I
Sbjct: 61   VTTFNLDEYAGLSPSHPQSYNHFMHEHLFQHINMQPDHIHIPQGDNPQLEAACKVYEDLI 120

Query: 114  N-ANPIDFQILGIGRNGHIGFNEPGTPFDITTHVVDLAPSTIEANSRFFNSIDD-VPKQA 171
              A  ID QILGIG NGHIGFNEPG+ F+  T VV L+ STI+AN+RFF    VP+ A
Sbjct: 121  RQAGGIDVQILGIGANGHIGFNEPGSDFEDRTRVVKLSESTIQANARFFGGDPVLVPRLA 180

Query: 172  LSMGIGSIMK-SKTIVLVAYGIEKAEAIASMIKGPITEDMPASILQKHDDVVIIVDEAAA 230
            +SMGI +IM+ SK IVL+A G EKA+AI  M +GP+T D+PASILQKH  V +I D  AA
Sbjct: 181  ISMGIKTIMEFSKHIVLLASGEEKADAIQKMAEGPVTTDVPASILQKHNHVTVIADYKAA 240

Query: 231  SKL                                                        233
            KL
Sbjct: 241  QKL                                                        243
```

```
>GP:CAB12030 GB:Z99105 similar to glucosamine-6-phosphate isomerase
[Bacillus subtilis]
Identities = 120/244 (49%), Positives = 162/244 (66%), Gaps = 12/244 (4%)
Query: 1    MKIIRVQDQIEGGKIAFTLLKDSL-AKGAKTLGLATGSSPISFYQEMVKS----PLDFSD    55
            MKI+  +  E  K++  ++K+ + AK     LGLATGS+P+  Y++++       +DFS
Sbjct: 1    MKILIAEHYEELCKLSAAIIKEQIQAKKDAVLGLATGSTPVGLYKQLISDYQAGEIDFSK   60

Query: 56   LTSINLDEYVGLSVESDQSYDYFMRQNLF---NAKPFKKNYLPNGLATDVEAEAKRYNQI   112
            +T+ NLDEY GLS   QSY++FM ++LF    N +P   ++P G   +EA  K Y  +
Sbjct: 61   VTTFNLDEYAGLSPSHPQSYNHFMHEHLFQHINMQP-DHIHIPQGDNPQLEAACKVYEDL   119

Query: 113  IAEHP-IDFQVLGIGRNGHIGFNEPGTSFEEETHVVDLQESTIEANSRFFTSIED-VPKQ   170
            I +   ID Q+LGIG NGHIGFNEPG+ FE+ T VV L ESTI+AN+RFF      VP+
Sbjct: 120  IRQAGGIDVQILGIGANGHIGFNEPGSDFEDRTRVVKLSESTIQANARFFGGDPVLVPRL   179

Query: 171  AISMGIASIMK-SEMIVLLAFGQEKADAIKGMVFGPITEHLPASILQKHDHVIVIVDEAA   229
            AISMGI +IM+ S+ IVLLA G+EKADAI+ M  GP+T   +PASILQKH+HV VI D  A
Sbjct: 180  AISMGIKTIMEFSKHIVLLASGEEKADAIQKMAEGPVTTDVPASILQKHNHVTVIADYKA   239

Query: 230  ASQL                                                          233
            A +L
Sbjct :240  AQKL                                                          243
```

An alignment of the GAS and GBS proteins is shown below.

```
Identities = 163/233 (69%), Positives = 201/233 (85%)
Query: 1    MRVITVKNDIEGGKIAFTLLEEKMKAGAQTLGLATGSSPITFYEEIVKSNLDFSNMVSIN   60
            M++I V++ IEGGKIAFTLL++ +  GA+TLGLATGSSPI+FY+E+VKS LDFS++ SIN
Sbjct: 1    MKIIRVQDQIEGGKIAFTLLKDSLAKGAKTLGLATGSSPISFYQEMVKSPLDFSDLTSIN   60

Query: 61   LDEYVGIAASNDQSYSYFMHKHLFDAKPFKENNLPNGLAKDLKEEIKRYDAVINANPIDF   120
            LDEYVG++   +DQSY YFM ++LF+AKPFK+N LPNGLA D++ E KRY+ +I   +PIDF
Sbjct: 61   LDEYVGLSVESDQSYDYFMRQNLFNAKPFKKNYLPNGLATDVEAEAKRYNQIIAEHPIDF   120

Query: 121  QILGIGRNGHIGFNEPGTPFDITTHVVDLAPSTIEANSRFFNSIDDVPKQALSMGIGSIM   180
            Q+LGIGRNGHIGFNEPGT F+  THVVDL  STIEANSRFF SI+DVPKQA+SMGI SIM
Sbjct: 121  QVLGIGRNGHIGFNEPGTSFEEETHVVDLQESTIEANSRFFTSIEDVPKQAISMGIASIM   180

Query: 181  KSKTIVLVAYGIEKAEAIASMIKGPITEDMPASILQKHDDVVIIVDEAAASKL          233
            KS+ IVL+A+G EKA+AI  M+ GPITE +PASILQKHD V++IVDEAAAS+L
Sbjct: 181  KSEMIVLLAFGQEKADAIKGMVFGPITEHLPASILQKHDHVIVIVDEAAASQL          233
```

Based on this analysis, it was predicted that these proteins and their epitopes could be useful antigens for vaccines or diagnostics.

Example 2155

A DNA sequence (GBSx2271) was identified in S. agalactiae <SEQ ID 6661> which encodes the amino acid sequence <SEQ ID 6662>. Analysis of this protein sequence reveals the following:

Possible site: 61
>>> Seems to have no N-terminal signal sequence

| | | |
|---|---|---|
| INTEGRAL | Likelihood = −8.12 | Transmembrane 169-185 (161-194) |
| INTEGRAL | Likelihood = −6.37 | Transmembrane 151-167 (145-168) |
| INTEGRAL | Likelihood = −5.15 | Transmembrane 42-58 (41-62) |
| INTEGRAL | Likelihood = −1.59 | Transmembrane 207-223 (207-224) |
| INTEGRAL | Likelihood = −1.12 | Transmembrane 24-40 (23-40) |

----- Final Results -----
  bacterial membrane --- Certainty = 0.4248 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

```
>GP:AAF13747 GB:AF117351 unknown [Zymomonas mobilis]
Identities = 88/216 (40%), Positives = 123/216 (56%)
Query: 9    QQLNILRAGVLGANDGIISVAGVVIGVASATHNLWIIPLSAASAILAGAFSMAGGEYVSV   68
            +Q+  LRA VLGANDGI+S +  ++IGVASA  +   I L+  S ++AGA SMA GEYVSV
Sbjct: 17   RQMGWLRASVLGANDGILSTSSLMIGVASAHGSSGNILLAGMSGLIAGALSMAAGEYVSV   76

Query: 69   STQKDTEQAAVAREEKLLENNPELAKKSLVDIYLAKGESHEHAQWLVDKAFSKNAIEHLV   128
            S+Q D EQA VARE   L+ NP   K L +IY+ +G   E A  + ++   +NA+E  +
Sbjct: 77   SSQHDMEQADVAREHAELKANPHAEKHELAEIYVERGLDRELALQVAEQLMAHNALEAHL   136

Query: 129  EEKYGIEFGEYTSPWHAAISSFIAFAIGSIFPTITILLLPFSVRIVGTVIIVSLLSTG    188
            ++ G+          P  AA++S I+F+ G+I P +T L  P +   +I I+ L    G
Sbjct: 137  RDELGLTDSLIARPVQAALASAISFSGGAIVPFLTALFSPPEIINITISLISILCLAVLG   196
```

```
                                    -continued
Query: 189  YVSAKLGQAPTVPAMRRNVMIGCLTMLATYVIGQLF             224
              V ALG     AR     GL M+ T  IG  F
Sbjct: 197  MVGAHLGGANVPKAALRVTFCGALAMIGTAAIGSFF             232
```

No corresponding DNA sequence was identified in *S. pyogenes*.

Based on this analysis, it was predicted that this protein and its epitopes, could be useful antigens for vaccines or diagnostics.

Example 2156

A DNA sequence (GBSx2272) was identified in *S. agalactiae* <SEQ ID 6663> which encodes the amino acid sequence <SEQ ID 6664>. This protein is predicted to be S-adenosylmethionine tRNA ribosyltransferase (queA). Analysis of this protein sequence reveals the following:

Possible site: 41
>>> Seems to have no N-terminal signal sequence
----- Final Results -----
  bacterial cytoplasm --- Certainty = 0.3438 (Affirmative) <succ>
  bacterial membrane --- Certainty = 0.0000 (Not Clear) <succ>
  bacterial outside --- Certainty = 0.0000 (Not Clear) <succ>

A related DNA sequence was identified in *S. pyogenes* <SEQ ID 6665> which encodes the amino acid sequence <SEQ ID 6666>. Analysis of this protein sequence reveals the following:

Possible site: 41
>>> Seems to have no N-terminal signal sequence
----- Final Results -----
  bacterial cytoplasm --- Certainty = 0.3864 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:CAB14732 GB:Z99118 S-adenosylmethionine tRNA ribosyltransferase
[Bacillus subtilis]
Identities = 228/341 (66%), Positives = 279/341 (80%)
Query: 1    MNTNDFDFYLPEELIAQTPLEKRDASKLLVIDHKNKTMTDSHFDHILDELKPGDALVMNN   60
            M + FDF LPE LIAQ PLE+RDAS+L+V+D     +TDS F HI+     GD LV+NN
Sbjct: 1    MKVDLFDFELPERLIAQVPLEQRDASRLMVLDKHTGELTDSSFKHIISFFNEGDCLVLNN   60

Query: 61   TRVLPARLYGEKQDTHGHVELLLLKNTEGDQWEVLAKPAKRLRVGTKVSFGDGRLIATVT   120
            TRVLPARL+G K+DT    VELLLLK    GD+WE LAKPAKR++ GT V+FGDGRL A T
Sbjct: 61   TRVLPARLFGTKEDTGAKVELLLLKQETGDKWETLAKPAKRVKKGTVVTFGDGRLKAICT   120

Query: 121  KELEHGGRIVEFSYDGIFLEVLESLGEMPLPPYIHEKLEDRDRYQTVYAKENGSAAAPTA   180
            +ELEHGGR +EF YDGIF EVLESLGEMPLPPYI E+L+D++RYQTVY+KE GSAAAPTA
Sbjct: 121  EELEHGGRKMEFQYDGIFYEVLESLGEMPLPPYIKEQLDDKERYQTVYSKEIGSAAAPTA   180

Query: 181  GLHFTKELLEKIETKGVKLVYLTLHVGLGTFRPVSVDNLDEHEMHSEFYQLSKEAADTLN   240
            GLHFT+E+L++++ KGV++  ++TLHVGLGTFRPVS D ++EH MH+EFYQ+S+E A  LN
Sbjct: 181  GLHFTEEILQQLKDKGVQIEFITLHVGLGTFRPVSADEVEEHNMHAEFYQMSEETAAALN   240

Query: 241  AVKESGGRIVAVGTTSIRTLETIGSKFNGELKADSGWTNIFIKPGYQFKVVDAFSTNFHL   300
              V+E+GGRI++VGTTS RTLETI  + +G+ KA SGWT+IFI PGY+FK +D     TNFHL
Sbjct: 241  KVRENGGRIISVGTTSTRTLETIAGEHDGQFKASSGWTSIFIYPGYEFKAIDGMITNFHL   300

Query: 301  PKSTLVMLVSAFAGRDFVLEAYNHAVEERYRFFSFGDAMFV                    341
            PKS+L+MLVSA AGR+ +L AYNHAVEE YRFFSFGDAM +
Sbjct: 301  PKSSLIMLVSALAGRENILRAYNHAVEEEYRFFSFGDAMLI                    341
```

An alignment of the GAS and GBS proteins is shown below.

```
Identities= 297/341(87%),Positives= 322/341(94%)
Query: 1    MNTNDFDFYLPEELIAQTPLEKRDASKLLVIDHKNKTMTDSHFDHILDELKPGDALVMNN   60
            MNTN+FDF LPEELIAQTPLEKRD+SKLL+IDH+ KTM DSHFDHI+D+L PGDALVMNN
Sbjct: 1    MNTNNFDFELPEELIAQTPLEKRDSSKLLIIDHRQKTMVDSHFDHIIDQLNPGDALVMNN   60

Query: 61   TRVLPARLYGEKQDTHGHVELLLLKNTEGDQWEVLAKPAKRLRVGTKVSFGDGRLIATVT  120
            TRVLPARLYGEK DTHGHVELLLLKNT+GDQWEVLAKPAKRL+VG++V+FGDGRL AT+
Sbjct: 61   TRVLPARLYGEKPDTHGHVELLLLKNTQGDQWEVLAKPAKRLKVGSQVNFGDGRLKATII  120
```

```
                              -continued
Query: 121  KELEHGGRIVEFSYDGIFLEVLESLGEMPLPPYIHEKLEDRDRYQTVYAKENGSAAAPTA180
            ELEHGGRIVEFSYDGIFLEVLESLGEMPLPPYIHEKLED +RYQTVYAKENGSAAAPTA
Sbjct: 121  DELEHGGRIVEFSYDGIFLEVLESLGEMPLPPYIHEKLEDAERYQTVYAKENGSAAAPTA180

Query: 181  GLHETKELLEKIETKGVKLVYLTLHVGLGTFRPVSVDNLDEHEMHSEFYQLSKEAADTLN240
            GLHFT +LL+KIE KGV LVYLTLHVGLGTFRPVSVDNLDEH+MHSEFY LS+EAA TL
Sbjct: 181  GLHFTTDLLKKIEAKGVHLVYLTLHVGLGTFRPVSVDNLDEHDMHSEFYSLSEEAAQTLR240

Query: 241  AVKESGGRIVAVGTTSIRTLETIGSKFNGELKADSGWTNIFIKPGYQFKVVDAFSTNFHL300
               VK++GGR+VAVGTTSIRTLETIG KF G+++ADSGWTNIFIKPGYQFKVVDAFSTNFHL
Sbjct: 241  DVKQAGGRVVAVGTTSIRTLETIGGKFQGDIQADSGWTNIFIKPGYQFKVVDAFSTNFHL300

Query: 301  PKSTLVMLVSAFAGRDFVLEAYNHAVEERYRFFSFGDAMFV                  341
            PKSTLVMLVSAFAGRDFVLEAY HAV+E+YRFFSFGDAMFV
Sbjct: 301  PKSTLVMLVSAFAGRDFVLEAYRHAVDEKYRFFSFGDAMFV                  341
```

Based on this analysis, it was predicted that these proteins and their epitopes could be useful antigens for vaccines or diagnostics.

Example 2157

A DNA sequence (GBSx2273) was identified in *S. agalactiae* <SEQ ID 6667> which encodes the amino acid sequence <SEQ ID 6668>. Analysis of this protein sequence reveals the following:

```
                 Identities = 126/195 (64%), Positives = 155/195 (78%) Gaps = 1/195 (0%)
        Query: 160  MEERFDITETDYEYIGEHNNYVAAFS-                                 219
                    GAMSIDDMQKYSLVYSENTPAYALAERIGGMDSA
                    M ERFDITETDYEY  EH+ YVA F+GAMSI DMQ+YSLVYSENTPAYALAER+GGM+ A
        Sbjct: 1    MTERFDITETDYEYDQEHHAYVAQFNGAMSIPDMQEYSLVYSENTPAYALAERLGGMNKA 60

Query: 220  YSKFGRYGQSKGDIKNIQKNGNKVTTDYYIQVLDYLWKHRKKYDSLITYLEEAFPTDYYR279
                    Y F  RYG+  G I   I +NGNK+TT YY+QVLDYLW+H+ KY  ++ Y+ E+FP  YY+
        Sbjct: 61   YQLFDRYGKVSGAITTIDRNGNKITTAYYLQVLDYLWQHQDKYKDILYYIGESFPDLYYK120

Query: 280  ALIPSDVVVAQKPGYVREALNVGAIVKEEVPYIVAIYTAGLGGSTQEDSEINGVGLYQLE339
                      +P   V V QKPGYVREALNVGAIV EE PY++A+Y++GLGG+TQ   E+NG+G  QL
        Sbjct: 121  TYLP-HVKVYQKPGYVREALNVGAIVCEESPYLIALYSSGLGGATQASEEVNGLGYVQLV179

Query: 340  QLCFVINQWHRVNMN                                             354
                    QL +VIN+W+R N+N
        Sbjct: 180  QLPYVINEWYRGNLN                                             194
```

Possible site: 36
>>> Seems to have an uncleavable N-term signal seq
INTEGRAL    Likelihood = –14.22  Transmembrane  14-30 (6-34)
----- Final Results -----
   bacterial membrane --- Certainty = 0.6689 (Affirmative) <succ>
      bacterial outside --- Certainty = 0.0000 (Not Clear) <succ>
         bacterial cytoplasm --- Certainty = 0.0000 (Not Clear) <succ>

The protein has no significant homology with any sequences in the GENPEPT database.

A related DNA sequence was identified in *S. pyogenes* <SEQ ID 6669> which encodes the amino acid sequence <SEQ ID 6670>. Analysis of this protein sequence reveals the following:

Possible site: 51
>>> Seems to have no N-terminal signal sequence
----- Final Results -----
   bacterial cytoplasm --- Certainty = 0.2655 (Affirmative) <succ>
      bacterial membrane --- Certainty = 0.0000 (Not Clear) <succ>
         bacterial outside --- Certainty = 0.0000 (Not Clear) <succ>

An alignment of the GAS and GBS proteins is shown below.

SEQ ID 6668 (GBS680) was expressed in *E. coli* as a GST-fusion product. SDS-PAGE analysis of total cell extract is shown in FIG. 164 (lane 10-12; MW 64 kDa) and in FIG. 239 (lane 9; MW 64 kDa). It was also expressed in *E. coli* as a His-fusion product. SDS-PAGE analysis of total cell extract is shown in FIG. 164 (lane 15; MW 40 kDa) and in FIG. 188 (lane 9; MW 40 kDa). Purified GBS680-His is shown in FIG. 242, lane 8. Purified GBS680-GST is shown in FIG. 246, lanes 6 & 7.

Based on this analysis, it was predicted that these proteins and their epitopes could be useful antigens for vaccines or diagnostics.

Example 2158

A DNA sequence (GBSx2274) was identified in *S. agalactiae* <SEQ ID 6671> which encodes the amino acid sequence <SEQ ID 6672>. Analysis of this protein sequence reveals the following:

Possible site: 17
>>> Seems to have no N-terminal signal sequence

3829
-continued

| | | |
|---|---|---|
| INTEGRAL | Likelihood = −4.57 | Transmembrane 8-24 (4-25) |
| INTEGRAL | Likelihood = −2.13 | Transmembrane 66-82 (65-84) |
| INTEGRAL | Likelihood = −1.65 | Transmembrane 107-123 (107-125) |
| INTEGRAL | Likelihood = −0.69 | Transmembrane 36-52 (36-52) |
| INTEGRAL | Likelihood = −0.48 | Transmembrane 89-105 (89-105) |

----- Final Results -----
bacterial membrane --- Certainty = 0.2826 (Affirmative) <succ>

-continued bacterial outside --- Certainty = 0.0000 (Not Clear) <succ>
bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2159

A DNA sequence (GBSx2275) was identified in *S. agalactiae* <SEQ ID 6673> which encodes the amino acid sequence <SEQ ID 6674>. Analysis of this protein sequence reveals the following:

Possible site: 59
>>> Seems to have an uncleavable N-terminal signal sequence

| | | |
|---|---|---|
| INTEGRAL | Likelihood = −9.87 | Transmembrane 108-124 (97-133) |
| INTEGRAL | Likelihood = −9.08 | Transmembrane 181-197 (173-201) |
| INTEGRAL | Likelihood = −7.43 | Transmembrane 220-236 (216-248) |
| INTEGRAL | Likelihood = −6.69 | Transmembrane 6-22 (3-28) |
| INTEGRAL | Likelihood = −3.72 | Transmembrane 401-417 (400-417) |
| INTEGRAL | Likelihood = −3.35 | Transmembrane 279-295 (278-295) |
| INTEGRAL | Likelihood = −2.87 | Transmembrane 31-47 (30-50) |
| INTEGRAL | Likelihood = −2.87 | Transmembrane 244-260 (242-264) |
| INTEGRAL | Likelihood = −0.80 | Transmembrane 62-78 (62-78) |

----- Final Results -----
bacterial membrane --- Certainty = 0.4949 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the GENPEPT database.

```
>GP:AAC21770 GB:U32694 H. influenzae predicted coding region HI0092
[Haemophilus influenzae Rd]
Identities = 232/416 (55%), Positives = 314/416 (74%), Gaps = 3/416 (0%)
Query:    4 TFTTTGALIGLALAILLIIKKVHPAYSLILGALVGGLIGGGDLVTIVNTMVLGAQGMMSS  63
            T +   GAL+ L +AI LI+KKV PAY +++GALVGGLIGG DL   V+ M+ GAQG+ ++
Sbjct:    3 TVSAIGALVALIVAIFLILKKVSPAYGMLVGALVGGLIGGADLSQTVSLMIGGAQGITTA  62

Query:   64 ILRILTSGILAGALIKTGSAEKIAESIIKKLGQQRAITALAIATMIICAVGVFIDIAVIT 123
            ++RIL +G+LAG LI++G+A   I E+I   KLG+ RA+ ALA+ATMI+ AVGVF+D+AVIT
Sbjct:   63 VMRILAAGVLAGVLIESGAANSITETITNKLGETRALLALALATMILTAVGVFVDVAVIT 122

Query:  124 VAPIALAIGKKANLSKSSILLAMIGGGKAGNIISPNPNTIAASEAFKVDLTSLMVQNIIP 183
            V+PIALA+ ++++LSK++ILLAMIGGGKAGNI+SPNPN IAA++ F + LTS+M+  IIP
Sbjct:  123 VSPIALALSRRSDLSKAAILLAMIGGGKAGNIMSPNPNAIAAADTFHLPLTSVMMAGIIP 182

Query:  184 AIAALVVTIILAKIVSKKNNDISYDSEEQV--GSDLPAFLPAISGPLVVICLLALRPLFG 241
            A+  L++T  LAK +  K + ++ D E V   +LP+FL A+  PLV I LLALRPLF
Sbjct:  183 ALFGLILTYFLAKRLINKGSKVT-DKEVIVLETQNLPSFLTALVAPLVAILLLALRPLFD 241

Query:  242 ITIDPLIALPLGGLISILATGYLKETVPFVEYGLSKVVGVSILLIGTGTLSGIIKASNLQ 301
            I +DPLIALPLGGLI      G L+    +    GLSK+  V+I+L+GTG L+GII  S L+
Sbjct:  242 IKVDPLIALPLGGLIGAFCMGKLRNINSYAINGLSKMTPVAIMLLGTGALAGIIANSGLK 301

Query:  302 FDMIHLLEFLNMPTFILAPLSGIFMGAATASTTSGITIASQTFAETLIKSGVPAVSGAAM 361
            +I LE   +P++ILAP+SG+ M  ATASTT+GT +AS  F+  TL++ GV +++GAAM
Sbjct:  302 EVLIQGLEHSGLPSYILAPISGVLMSLATASTTAGTAVASNVFSSTLLELGVSSLAGAAM 361

Query:  362 IHAGATVLDSLPHGSFFHATGGAVNMAIKDRMKLISYEALIGLTSTIVAVVYYCFF     417
            IHAGATV D +PHGSFFHATGG+VNM  IK+R+KLI YE+ +GL  TIV+ + +  F
Sbjct:  362 IHAGATVFDHMPHGSFFHATGGSVNMDIKERLKLIPYESAVGLMMTIVSTLIFGVF     417
```

A related DNA sequence was identified in *S. pyogenes* <SEQ ID 6675> which encodes the amino acid sequence <SEQ ID 6676>. Analysis of this protein sequence reveals the following:

Possible site: 51
>>> Seems to have an uncleavable N-terminal signal sequence

| | | |
|---|---|---|
| INTEGRAL | Likelihood = −11.15 | Transmembrane 240-256 (236-265) |
| INTEGRAL | Likelihood = −10.88 | Transmembrane 3-19 (1-32) |
| INTEGRAL | Likelihood = −10.14 | Transmembrane 269-285 (263-289) |
| INTEGRAL | Likelihood = −7.27 | Transmembrane 107-123 (102-141) |
| INTEGRAL | Likelihood = −7.17 | Transmembrane 307-323 (303-330) |
| INTEGRAL | Likelihood = −6.64 | Transmembrane 24-40 (23-43) |
| INTEGRAL | Likelihood = −5.63 | Transmembrane 422-438 (420-442) |
| INTEGRAL | Likelihood = −3.77 | Transmembrane 124-140 (124-141) |
| INTEGRAL | Likelihood = −3.24 | Transmembrane 189-205 (184-207) |
| INTEGRAL | Likelihood = −2.60 | Transmembrane 65-81 (65-82) |
| INTEGRAL | Likelihood = −2.34 | Transmembrane 393-409 (393-409) |
| INTEGRAL | Likelihood = −0.11 | Transmembrane 149-165 (149-166) |

----- Final Results -----
bacterial membrane --- Certainty = 0.5458 (Affirmative) <succ>
bacterial outside --- Certainty = 0.0000 (Not Clear) <succ>
bacterial cytoplasm --- Certainty = 0.0000 (Not Clear) <succ>

The protein has homology with the following sequences in the databases:

```
>GP:BAB07616 GB:AP001520 unknown conserved protein [Bacillus halodurans]
Identities = 155/435 (35%), Positives = 248/435 (56%), Gaps = 21/435 (4%)
Query:   7   LGVLVGVIVIIYLYVEEVNIIIAAPLATSLVILFNQMDPTTTLLGKEPNQFMGALSTYIL     66
             LG+++G+++++ L  +  +II   AP+A  +V LF  +D    LL    +  +M       +
Sbjct:   2   LGIVLGLVILMVLAYRGWSIIWVAPIAAGVVALFGGLD----LLPAYTDTYMEGFVKFAK    57

Query:  67   NYFAIFLLGSILAKLMETSGATTSIADYILKKVGHDSPYKVLVAIFLISAILTYGGISLF    126
              +F +F+LG+I  KLME +GA  S+A  I K +G       + ++  + L  A+LTYGGISLF
Sbjct:  58   QWFPVFMLGAIFGKLMEDTGAARSVASAITKLIGTK---RAILGVMLGCAVLTYGGISLF   114

Query: 127   VVMFAVLPLARSLFKKMDLAWNLIQVPLWLGIATFTMTILPGTPAIQNVIPIQYLDTSLT    186
             VV+FA+ PLA +LF++  +++   LI    + LG  TFTMT +PGTP IQN+IP  Y T+
Sbjct: 115   VVVFAMYPLALALFREANISRRLIPGTIALGAFTFTMTAVPGTPQIQNLIPTSYYGTNAM   174

Query: 187   AAAIPSIVGSIGCVAFGLFYMKYCLAKSMARGETYATYAFDNEIQVKTKNLPHFLASILP    246
             AA +  ++ ++       G Y+ +   K    GE + T   + E + +   +P+    S LP
Sbjct: 175   AAPMMGVIAALIMGIGGYTYLVWREKKLKEAGE-FFTEPKNGEKEEEGEKVPNPWLSFLP   233

Query: 247   LLLLIIIALTGSLFGNDFFKKNIIFIALLAVILTASWLFRQFIPNKIAVFNLGASSSIAP    306
             L+ +I+    T +L    D         I +AL++  I+      L   +  I   N GA  S+
Sbjct: 234   LVSVIV---TLNLLQWD------IVLALISGIVLIMLLNVGKVKGFIQSMNQGAGGSVLA   284

Query: 307   IFATASAVAFGAVVMIVPGFTFFSDLILNIPGNPLISLAVLTSSMSAITGSSSGALGIVM    366
             I  T++AV FG+VV VPGF    ++L+L I G+PLIS AV  +  ++   TGS+SG +GI +
Sbjct: 285   IINTSAAVGFGSVVRAVPGFERLTELLLGIQGSPLISQAVAINVLAGATGSASGGMGIAL   344

Query: 367   ----PNFAQYYLDQGLNPEMIHRVATIASNIFTIVPQSGVFLTFLALTGLNHKNAFKETF    422
                 + Q  ++ G++PE HRVA+IAS    +P  +G  LT  LA+TGL+HK ++K+ F
Sbjct: 345   EALGDRYMQLAMETGMSPEAFHRVASIASGGLDTLPHNGAVLTLLAITGLSHKESYKDIF   404

Query: 423   ITVSVSTFIAQVIVI                                               437
             +   V  ++    I
Sbjct: 405   VVGCVIPIVSVAFAI                                               419
```

An alignment of the GAS and GBS proteins is shown below.

```
Identities = 88/395 (22%), Positives = 167/395 (42%), Gaps = 40/395 (10%)
Query:   9   GALIGLALAILLIIKKVHPAYSLILGALVGGLIGGGDLVTIV----NTMVLGAQG--MMS     62
             G L+G+ + I L +K+V+    +  L    +    L     D T +       +GA   +++
Sbjct:   8   GVLVGVIVIIYLYVKEVNIIIAAPLATSLVILFNQMDPTTTLLGKEPNQFMGALSTYILN    67

Query:  63   SILRILTSGILAGALIKTGSAEKIAESIIKKLGQQ---RAITALAIATMIICAVGVFIDI    119
                L     ILA   +G+   IA+ I+KK+G      +  + A+ +  + I+    G+ +  +
Sbjct:  68   YFAIFLLGSILAKLMETSGATTSIADYILKKVGHDSPYKVLVAIFLISAILTYGGISLFV   127

Query: 120   AVITVAPIALAIGKKANLSKSSILLAMIGGGKAGNII----SPNPNTIAASEAFKVDLTS    175
             + V P+A ++ KK +L+ + I + +  G        +P +  +     LT+
Sbjct: 128   VMFAVLPLARSLFKKMDLAWNLIQVPLWLGIATFTMTILPGTPAIQNVIPIQYLDTSLTA   187

Query: 176   LMVQNIIPAIAALVVTII-----LAKIVSKKNNDISY--DSEEQVGS-DLPAFLPAISGP    227
             + +I+ +I  +   +       LAK +++     +Y  D+E QV  + +LP FL +I
Sbjct: 188   AAIPSIVGSIGCVAFGLFYMKYCLAKSMARGETYATYAFDNEIQVKTKNLPHFLASILPL   247

Query: 228   LVVICLLALRPLFG-------ITIDPLIALPLGGLISILATGYLKETVPFVEYGLSKVVG    280
             L++I +    LFG        I   L+A+ L    S L   ++  +      G S   +
Sbjct: 248   LLLIIIALTGSLFGNDFFKKNIIFIALLAVIL--TASWLFRQFIPNKIAVFNLGASSSIA   305

Query: 281   ---VSILLIGTGTLSGIIKASNLQFDMIHLLEFLNMPTFILAPLSGIFMGAATASTTSGT    337
                +  + G + I+      D+I L       P   LA L+     M A T S++
Sbjct: 306   PIFATASAVAFGAVVMIVPGFTFFSDLI--LNIPGNPLISLAVLTS-SMSAITGSSSGAL   362

Query: 338   TIASQTFAETLIKSGVPAVSGAAMIHAGATVLDSL                           372
             I    FA+   G+        MIH  AT+  ++
Sbjct: 363   GIVMPNFAQYYLDQGL----NPEMIHRVATIASNI                           393
```

Based on this analysis, it was predicted that these proteins and their epitopes could be useful antigens for vaccines or diagnostics.

Possible site: 21
>>> Seems to have no N-terminal signal sequence
INTEGRAL    Likelihood = −3.24    Transmembrane 85-101 (84-101)
----- Final Results -----
  bacterial membrane --- Certainty = 0.2296 (Affirmative) <succ>
  bacterial outside --- Certainty = 0.0000 (Not Clear) <succ>
  bacterial cytoplasm --- Certainty = 0.0000 (Not Clear) <succ>

Example 2160

A DNA sequence (GBSx2277) was identified in *S. agalactiae* <SEQ ID 6677> which encodes the amino acid sequence <SEQ ID 6678>. Analysis of this protein sequence reveals the following:

The protein has homology with the following sequences in the GENPEPT database.

```
>GP:CAB16041 GB:Z99124 similar to hypothetical proteins [Bacillus subtilis]
Identities = 176/377 (46%), Positives = 234/377 (61%), Gaps = 2/377 (0%)
Query: 1    MKVVVAIDSLKGSLSSLEAGNAIKESINEVISGADVEVHPLADGGEGTVEALTLGMGGTI 60
            MK+++A DS K SLS+LEA  AI+     V  GAD   P+ADGGEGTV++L    G I
Sbjct: 1    MKIIIAPDSFKESLSALEAAEAIERGFKSVFPGADYRKLPVADGGEGTVQSLVDATNGRI 60

Query: 61   ETIPVKGPLGEKVHASYGIIPQRQLAIIEMAAAAGITLIATEERNPLHTTTYGVGEMIKD 120
                V GPLGE V A +G++    + A+IEMAAA+G+ L+   ++RNPL TTT  G GE+I
Sbjct: 61   IEQVVTGPLGEPVRAFFGMMGDGRTAVIEMAAASGLHLVPVDKRNPLITTTRGTGELIGA 120

Query: 121  AISKGCRHFIIGIGGSATNDGGAGMLQALGYALLDKDNQEISLGAQGLADLKSISTDKVI 180
            A+  G      IIGIGGSATNDGGAGM+QALG  LLD        EI   G   L+ L SI    +
Sbjct: 121  ALDAGAERLIIGIGGSATNDGGAGMIQALGGRLLDNSGSEIGPGGGALSQLASIDVSGLD 180

Query: 181  EELKECDFKIACDVTNPLCGAQGCSSIFGPQKGADEDMITKMDTWLSNYATLATSVSEKA 240
             L+       ++AC+V NPL G +G +++FGPQKGA  DM+    +D   +S++A  +A
Sbjct: 181  SRLRNVKLEVACNVDNPLTGPKGATAVFGPQKGATADMLDVLDQNVSHFADMAEKALGST 240

Query: 241  DATIEGTGAAGGLGFAFLAFTNATLEPGIDIILSEINIEKAISEADLVVTGEGRLDGQTV 300
                  EG GAAGGLG++ L +   A L+  GIDI+L   ++  E   +  +ADLV+TGEGR+D  QTV
Sbjct: 241  FRDTEGAGAAGGLGWSLLTYLQADLKRGIDIVLEAVDFESIVQDADLVITGEGRIDSQTV 300

Query: 301  MGKAPIGVAKLAKKYGKKVVAFSGSVTEDAILCNQHGIDAFFPIVRRLISLDEAMSKEVA 360
              GK PIGVAK  AK Y   V+   +GS++ D+    QHGIDA F   IV    + L++A
Sbjct: 301  HGKTPIGVAKAAKSYDVPVIGIAGSISRDSNAVYQHGIDALFSIVPGAVPLEDAFEHAAE 360

Query: 361  YKNMKETATQVFRLINL                                             377
            Y   M+ TA +    I L
Sbjct: 361  Y--MERTARDIAASIKL                                             375
```

A related DNA sequence was identified in *S. pyogenes* <SEQ ID 6679> which encodes the amino acid sequence <SEQ ID 6680>. Analysis of this protein sequence reveals the following:

---

Possible site: 49
>>> Seems to have no N-terminal signal sequence
INTEGRAL    Likelihood = –0.27    Transmembrane 360-376 (360-376)
----- Final Results -----
  bacterial membrane --- Certainty = 0.1107 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the databases:

```
>GP:AAA57927 GB:U18997 ORF_f408 [Escherichia coli]
Identities = 115/345 (33%), Positives = 182/345 (52%), Gaps = 25/345 (7%)
Query: 24   MKILVAIDSFKGSVTSPELNTSVAQALLSVDKQLVIETRAIADGGEGSLVALSQTVAGRW 83
            MKI++A DS+K S+++ E+  ++ +         +   +ADGGEG++ A+            G
Sbjct: 28   MKIVIAPDSYKESLSASEVAQAIEKGFREIFPDAQYVSVPVADGGEGTVEAMIAATQGAE 87

Query: 84   HQVKTIDLLRRPIKVAY--YRHAKQAFIESASIIGIDKITSNSVTYAQATSYGLGLAVKD 141
                L      + ++      K AFIE A+  G++ + +        TS G G    +
Sbjct: 88   RHAWVTGPLGEKVNASWGISGDGKTAFIEMAAASGLELVPAEKRDPLVTTSRGTGELILQ 147

Query: 142  AIQKGATQIEIMLGGTGTSDGGKGFLESLNYDFMT--------GRSYLDTLASPVTLLGL 193
            A++ GAT I I +GG+ T+DGG G +++L                G   L+TL + + + GL
Sbjct: 148  ALESGATNIIIGIGGSATNDGGAGMVQALGAKLCDANGNEIGFGGGSLNTL-NDIDISGL 206

Query: 194  T------------DVTNPYHGPQGFAAVFGPQKGGSLSQIEETDQIASNFAKKVFCQTTI 241
                          DVTNP  G    G +  +FGPQKG S +  I E D    S++A+ +         +
Sbjct: 207  DPRLKDCVIRVACDVTNPLVGDNGASRIFGPQKGASEAMIVELDNNLSHYAEVIKKALHV 266

Query: 242  DLQTIPGSGAAGGLGGAIV-LLGGTLTSGFSRIAELLNLDNSLQSCDLVITGEGCLDTQS 300
            D++  +PG+GAAGG+G A++    LG  L SG    +      LNL+     +  C LVITGEG  +D+QS
Sbjct: 267  DVKDVPGAGAAGGMGAALMAFLGAELKSGIEIVTTALNLEEHIHDCTLVITGEGRIDSQS 326

Query: 301  QSGKVPVAIARMAKKYQVPTIALCGSVKIETGLAAEDFL-AVFSI                 344
              GKVP+ +A +AKKY  P I    GS+   + G+  +        +   AVFS+
Sbjct: 327  IHGKVPIGVANVAKKYHKPVIGIAGSLTDDVGVVHQHGIDAVFSV                 371
```

An alignment of the GAS and GBS proteins is shown below.

```
Identities = 128/379 (33%), Positives . 194/379 (50%), Gaps = 23/379 (6%)
Query:   1  MKVVVAIDSLKGSLSSLEAGNAIKESINEVISGADVEVHPLADGGEGTVEALTLGMGGTI   60
            MK++VAIDS KGS++S E   ++ +++  V       +E    +ADGGEG++ AL+  + G
Sbjct:  24  MKILVAIDSFKGSVTSPELNTSVAQALLSVDKQLVIETRAIADGGEGSLVALSQTVAGRW   83

Query:  61  ETIPVKGPLGEKVHASYGIIPQRQLAIIEMAAAAGITLIATEERNPLHTTTYGVGEMIKD  120
              +        L   +  +Y      + A IE A+  GI  I +       T+YG+G  +KD
Sbjct:  84  HQVKTIDLLRRPIKVAY--YRHAKQAFIESASIIGIDKITSNSVTYAQATSYGLGLAVKD  141

Query: 121  AISKGCRHFIIGIGGSATNDGGAGMLQALGYALLDKDNQEISLGAQGLADLKSISTDKVI  180
            AI KG       I +GG+ T+DGG G L++L Y  +             G + L ++++   +
Sbjct: 142  AIQKGATQIEIMLGGTGTSDGGKGFLESLNYDFMT-----------GRSYLDTLASPVTL  190

Query: 181  EELKECDFKIACDVTNPLCGAQGCSSIFGPQKGADEDMITKMDTWLSNYATLATSVSEKA  240
                 L         DVTNP   G QG +++FGPQKG        I + D   SN+A         +
Sbjct: 191  LGLT--------DVTNPYHGPQGFAAVFGPQKGGSLSQIEETDQIASNFAKKVFCQTTID  242

Query: 241  DATIEGTGAAGGLGFAFLAFTNATLEPGIDIILSEINIEKAISEADLVVTGEGRLDGQTV  300
               TI G+GAAGGLG A +       TL  G    I   +N++ ++     DLV+TGEG LD Q+
Sbjct: 243  LQTIPGSGAAGGLGGA-IVLLGGTLTSGFSRIAELLNLDNSLQSCDLVITGEGCLDTQSQ  301
Query: 301  MGKAPIGVAKLAKKYGKKVVAFSGSVTEDAILCNQHGIDAFFPIVRRLISLDEAMSKEVA  360
              GK P+ +A++AKKY      +A  GSV + L  +  + A F I ++ ISL+ A+ K
Sbjct: 302  SGKVPVAIARMAKKYQVPTIALCGSVKIETGLAAEDFL-AVFSIQQQPISLEAAIDKTTT  360

Query: 361  YKNMKETATQVFRLINLYN                                          379
             N+K  A  +  LI    +N
Sbjct: 361  LSNIKILAANLMLLIAQFN                                          379
```

SEQ ID 6678 (GBS409) was expressed in *E. coli* as a His-fusion product. SDS-PAGE analysis of total cell extract is shown in FIG. 76 (lane 7; MW 45.4 kDa).

GBS409-His was purified as shown in FIG. 214, lane 6.

GBS409d was expressed in *E. coli* as a His-fusion product. SDS-PAGE analysis of total cell extract is shown in FIG. 166 (lane 3 & 4; MW 35 kDa) and in FIG. 188 (lane 12; MW 35 kDa). Purified protein is shown in FIG. 240, lanes 9-10.

Based on this analysis, it was predicted that these proteins and their epitopes could be useful antigens for vaccines or diagnostics.

Possible site: 36

\>>> Seems to have no N-terminal signal sequence

----- Final Results ----- bacterial cytoplasm --- Certainty = 0.1886 (Affirmative) <succ> bacterial membrane --- Certainty = 0.0000 (Not Clear) <succ> bacterial outside --- Certainty = 0.0000 (Not Clear) <succ>

Example 2161

A DNA sequence (GBSx2278) was identified in *S. agalactiae* <SEQ ID 6681> which encodes the amino acid sequence <SEQ ID 6682>. Analysis of this protein sequence reveals the following:

The protein has homology with the following sequences in the GENPEPT database.

```
>GP: AAC21771 GB: U32695 conserved hypothetical protein [Haemophilus influenzae Rd]
    Identities = 97/383 (25%), Positives = 175/383 (45%), Gaps = 52/383 (13%)
    Query:   1  MKLRKQLAQQIVTSIKDVCQQDINFINTKGIIFASTNPKRVGEFHEIGLKVAQTGQMIEV   60
                M+L K  A++IV     +   +N ++  G+I AS N  R+ + H    +    + +++E+
    Sbjct:   1  MQLDKYTAKKIVKRAMKIIHHSVNVMDHDGVIIASGNSTRLNQRHTGAVLALRENRVVEI   60

Query:  61  TD---QESYFGTQAGINIPFYYNCELLATIGISGNPNQVGKYALLAQKMTRLILKEHE-L  116
                 Q+   F  Q GIN+P +Y  +  +  +GISG P QV +YA L +    LI+++    L
    Sbjct:  61  DQALAQKWNFEAQPGINLPIHYLGKNIGVVGISGEPTQVKQYAELVKMTAELIVEQQALL  120

Query: 117  DYLDFGRKNEASIVLHHLVEGRELDYYYLNQFLNQYHLSEKTDYRLLTFEINSQKQKLLL  176
                 +   + R+ +   +L        L+  LN   ++      +  +F++N  +L+
    Sbjct: 121  EQESWHRRYKEEFILQ-----------LLHCNINWKEMEQQA--KFFSFDLNKSRVVVLI  167

Query: 177  S------QSEMSLLNFFDK-----------LDTAIYTFNYPNQYWLLLSDHMFDYYYPNI  219
                     +  +L+N+ ++              LD +     + N    +LS  M
    Sbjct: 168  KLLNPALDNLQNLINYLEQSEFAQDVAILSLDQVVVLKTWQNS--TVLSAQM------KT  219

Query: 220  LSKFECEKGLYKVGIGQKSSLSLLKR---SYETSILALK-ALKGQQK--VNLVDDLDLEL  273
                L   +  K  YK+ +G  +L L ++   S++++   L   LK   + + D+ L +
    Sbjct: 220  LLPADYSKQDYKIAVGACLNLPLFEQLPLSFQSAQSTLSYGLKHHPRKGIYVFDEHRLPV  279

Query: 274  LLTSIDSNIKQYVLNKALVNL-SENDKIL---LNSYFKHNLSLKECSQELFIHKNTVQYR  329
                LL  +  + +  L K L     L SE + IL      L  YF  N L     +++LF+H  NT++YR
```

```
-continued
Sbjct: 280   LLAGLSHSWQGNELIKPLSPLFSEENAILYKTLQQYFLSNCDLYLTAEKLFVHPNTLRYR   339

Query: 330   LNKIYESTQLNPRNFKDATLLYL                                      352
             LNKI + T L     D   LYL
Sbjct: 340   LNKIEQITGLFFNKIDDKLTLYL                                      362
```

No corresponding DNA sequence was identified in *S. pyogenes*.

Based on this analysis, it was predicted that this protein and its epitopes, could be useful antigens for vaccines or diagnostics.

Example 2162

A DNA sequence (GBSx2279) was identified in *S. agalactiae* <SEQ ID 6683> which encodes the amino acid sequence <SEQ ID 6684>. Analysis of this protein sequence reveals the following:

---

Possible site: 15
>>> Seems to have no N-terminal signal sequence
----- Final Results -----
   bacterial cytoplasm --- Certainty = 0.0290 (Affirmative) <succ>
   bacterial membrane --- Certainty = 0.0000 (Not Clear) <succ>
   bacterial outside --- Certainty = 0.0000 (Not Clear) <succ>

---

The protein has homology with the following sequences in the GENPEPT database.

A related DNA sequence was identified in *S. pyogenes* <SEQ ID 5287> which encodes the amino acid sequence <SEQ ID 5288>. Analysis of this protein sequence reveals the following:

---

Possible site: 15
>>> Seems to have no N-terminal signal sequence
----- Final Results -----
   bacterial cytoplasm --- Certainty = 0.0763 (Affirmative) <succ>
   bacterial membrane --- Certainty = 0.0000 (Not Clear) <succ>
   bacterial outside --- Certainty = 0.0000 (Not Clear) <succ>

---

An alignment of the GAS and GBS proteins is shown below.

```
>GP: AAF89979 GB: AF206272 beta-glucosidase [Streptococcus mutans]
Identities = 334/475 (70%), Positives = 392/475 (82%), Gaps = 8/475 (1%)

Query:   4   FPKHFLWGGAVAANQVEGAFRTDGKGLSVQDVLPNGGLGD-------FTAKPTPDNLKLE   56
             FP++FLWGGA AANQ EGA+  DGKGLSVQDV P GG+        T KPT DNLKL
Sbjct:   6   FPENFLWGGATAANQFEGAYNQDGKGLSVQDVTPKGGVAQSGSSSPLITEKPTEDNLKLV   65

Query:  57   AIDFYHNYKNDIKLFAEMGFKVFRTSIAWSRIFPNGDDSAPNEAGLQFYDNLFDELLKYN   116
              IDFY+ YK DI LFAEMGFKVFR SIAW+RIFPNGDD PNEAGL FYD +FDEL KY+
Sbjct:  66   GIDFYNRYKEDIALFAEMGFKVFRLSIAWTRIFPNGDDLEPNEAGLAFYDKVFDELAKYD   125

Query: 117   IEPLVTLSHYETPLHLAKTYNGWADRRLIAFFEKFAQTVMERYKDKVKYWLTFNEVNSIL   176
             IEPLVTLSHYETPLHLA+ YNGWA+R LIAF+E++A+TV  RYKDKVKYWLTFNEVNS+L
Sbjct: 126   IEPLVTLSHYETPLHLARKYNGWANRELIAFYERYARTVFTRYKDKVKYWLTFNEVNSVL   185

Query: 177   HMPFTSGAIMTDKSQLSPQELYQAIHHELVASARVTKLGRSINPNFKIGCMILAMPAYPM   236
             H PF SG I+TD  QLS Q+LYQA+HHELV SA  TK+G  INP+FKIGCM+LAMPAYPM
Sbjct: 186   HAPFMSGGIITDPEQLSKQDLYQAVHHELVVSALATKVGHEINPDFKIGCMVLAMPAYPM   245

Query: 237   TSDPRDVLAARQFEQHNLLFSDIHVRGKYPTYIQSYFKNNGIKIKFEEGDEEVLAQNTVD   296
             T+DP D LA R+FE  N LFSD+H RGKYP YI+ YFK+N I IK  EGD E++ +NTVD
Sbjct: 246   TADPLDQLAVREFENQNYLFSDLHARGKYPNYIKRYFKDNNIDIKMGEGDKELMLENTVD   305

Query: 297   FLSFSYYMSVTQAYDFENYQSGQGNILGGLTNPHLTTSEWGWQIDPIGLRLVLNQYYERY   356
             F+SFSYYMSV A++ E+Y SG+GN+LGGL+NP+L  SEWGWQIDP+GLRLVLN  Y+RY
Sbjct: 306   FISFSYYMSVAAAHNPEDYNSGRGNVLGGLSNPYLQASEWGWQIDPVGLRLVLNDSYDRY   365

Query: 357   QIPLFIVENGLGAKDQLIETLDGDYTVEDDYRIDYMNQHLVQVAKAIEDGVEIMGYTSWG   416
             Q+PLFIVENGLGAKD L++  DG TVEDDYRIDY+ +HL+QV +A++DGV+++GYT+WG
Sbjct: 366   QLPLFIVENGLGAKDVLVQGPDGP-TVEDDYRIDYLQKHLMQVGEALQDGVDLLGYTTWG   424

Query: 417   CIDCVSMSTAQLSKRYGLIYVDRNDDGTGSLQRYKKKSFGWYQKVIKTNGQSLFE        471
              ID VS ST +LSKRYG IYV  NDDG+GSL RYKKKSF WY+KVI+TNG SL+E
Sbjct: 425   PIDLVSESTVELSKRYGFIYVACMDDGSGSLARYKKKSFAWYKKVIETNGASLYE        479
```

```
Identities = 390/469 (83%), Positives = 423/469 (90%)
Query:   1  MTVFPKHFLWGGAVAANQVEGAFRTDGKGLSVQDVLPNGGLGDFTAKPTPDNLKLEAIDF    60
            M +FPK FLWGGAVAANQVEGAF  D KGLSVQDVLPNGGLG++T  PT DNL LEAIDF
Sbjct:   1  MGIFPKDFLWGGAVAANQVEGAFEADAKGLSVQDVLPNGGLGEWTDSPTSDNLTLEAIDF    60

Query:  61  YHNYKNDIKLFAEMGFKVFRTSIAWSRIFPNGDDSAPNEAGLQFYDNLFDELLKYNIEPL   120
            YH YK DI LFAEMGFKVFRTSIAWSRIFPNGDD  PNEAGLQFYD+LFDELL Y IEPL
Sbjct:  61  YHRYKEDIALFAEMGFKVFRTSIAWSRIFPNGDDDQPNEAGLQFYDDLFDELLNYGIEPL   120

Query: 121  VTLSHYETPLHLAKTYNGWADRRLIAFFEKFAQTVMERYKDKVKYWLTFNEVNSILHMPF   180
            VTLSHYETPLHLAK YNGW DRRLI FFE+FAQTVMERYKDKVKYWLTFNEVNSILHMPF
Sbjct: 121  VTLSHYETPLHLAKAYNGWTDRRLIGFFERFAQTVMERYKDKVKYWLTFNEVNSILHMPF   180

Query: 181  TSGAIMTDKSQLSPQELYQAIHHELVASARVTKLGRSINPNEKIGCMILAMPAYPMTSDP   240
            TSG IMT+K +LS Q+LYQAIHHELVASA VTKL   INP+ K+GCMILAMPAYPMTSDP
Sbjct: 181  TSGGIMTEKEKLSLQDLYQAIHHELVASASVTKLAHEINPDVKVGCMILAMPAYPMTSDP   240

Query: 241  RDVLAARQFEQHNLLFSDIHVRGKYPTYIQSYFKNNGIKIKFEEGDEEVLAQNTVDFLSF   300
            RD+LAA  FE  NLLFSDIHVRGKYP+YI+SYFK NGI+I FE+GD+E+LA++TVDFLSF
Sbjct: 241  RDILAAHAFENLNLLFSDIHVRGKYPSYIKSYFKENGIEIVFEDGDKELLAEHTVDFLSF   300

Query: 301  SYYMSVTQAYDFENYQSGQGNILGGLTNPHLTTSEWGWQIDPIGLRLVLNQYYERYQIPL   360
            SYYMSVTQA++ E Y SGQGNILGGL+NP+L +SEWGWQIDPIGLRLVLNQYY+RYQIPL
Sbjct: 301  SYYMSVTQAHNPEAYTSGQGNILGGLSNPYLESSEWGWQIDPIGLRLVLNQYYDRYQIPL   360

Query: 361  FIVENGLGAKDQLIETLDGDYTVEDDYRIDYMNQHLVQVAKAIEDGVEIMGYTSWGCIDC   420
            FIVENGLGAKDQL++T DG  TV DDYRIDYM+QHLVQVAKAIEDGVE+MGYTSWGCIDC
Sbjct: 361  FIVENGLGAKDQLVQTADGSMTVHDDYRIDYMSQHLVQVAKAIEDGVEVMGYTSWGCIDC   420

Query: 421  VSMSTAQLSKRYGLIYVDRNDDGIGSLQRYKKKSFGWYQKVIKTNGQSL             469
            VSMSTAQLSKRYG IYVDRNDDGTG L RYKKKSF WY++VI+TNG+ L
Sbjct: 421  VSMSTAQLSKRYGFINVDRNDDGIGQLTRYKKKSEDWYRQVIQTNGRYL             469
```

Based on this analysis, it was predicted that these proteins and their epitopes could be useful antigens for vaccines or diagnostics.

Example 2163

A DNA sequence (GBSx2280) was identified in *S. agalactiae* <SEQ ID 6685> which encodes the amino acid sequence <SEQ ID 6686>. Analysis of this protein sequence reveals the following:

Possible site: 16
>>> Seems to have no N-terminal signal sequence

-continued

| INTEGRAL | Likelihood = −10.40 | Transmembrane 247-263 (241-273) |
| INTEGRAL | Likelihood = −8.55 | Transmembrane 429-445 (424-450) |
| INTEGRAL | Likelihood = −4.88 | Transmembrane 285-301 (280-303) |
| INTEGRAL | Likelihood = −3.82 | Transmembrane 207-223 (205-225) |
| INTEGRAL | Likelihood = −3.40 | Transmembrane 113-129 (112-139) |
| INTEGRAL | Likelihood = −1.97 | Transmembrane 309-325 (305-328) |
| INTEGRAL | Likelihood = −1.59 | Transmembrane 395-411 (395-411) |
| INTEGRAL | Likelihood = −1.49 | Transmembrane 174-190 (173-193) |

----- Final Results -----
    bacterial membrane --- Certainty = 0.5161 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP: CAA84286 GB: Z34526 beta-glucoside permease [Bacillus subtilis]
Identities = 225/594 (37%), Positives = 351/594 (58%), Gaps = 11/594 (1%)
Query:   4  YQETAKAILAAVGGEENIQHVTHCVTRLRLVLDNDEIVNDQVIKTIPNVIGVMRENDQYQ    63
            Y + +K IL  VGGE+N+Q V HC+TRLR  L ++    +  ++ +P V+G    +Q+Q
Sbjct:   3  YDKLSKDILQLVGGEENVQRVIHCMTRLRFNLHDNAKADRSQLEQLPGVMGTNISGEQFQ    62

Query:  64  IILGNDVNNYYNAFLALGHFENTTREFSSQKKSSILEKLIETIAGVITPLIPALLGGGML   123
            II+GNDV  Y A +  +       SS +K ++L + + I+GV TP++PA+ G GM+
Sbjct:  63  IIIGNDVPKVYQAIVRHSNLSDEKSAGSSSQKKNVLSAVFDVISGVFTPILPAIAGAGMI   122

Query: 124  KVIGILLPMLGIASSSSQTVAFINFFGDAAYYFMPIMIAYSAASRFKVTPVLAATVGGIL   183
            K + L   G +  SQ  +   GD A+YF+P+++A SAA +F   P +AA +   +
Sbjct: 123  KGLVALAVTFGWMAEKSQVHVILTAVGDGAFYFLPLLLAMSAARKFGSNPYVAAAIAAAI   182

Query: 184  LHPAFVTMVAEGKPLSLFGAPVTLASYGSSVIPILIMVFLMQYIERWINKIVPSVMKSFL   243
            LHP    ++  GKP+S  G PVT A+Y S+VIPIL+ +++  Y+E+WI++    +  +K +
Sbjct: 183  LHPDLTALLGAGKPISFIGLPVTAATYSSTVIPILLSIWIASYVEKWIDRFTHASLKLIV   242

Query: 244  QPTLIILISGFLALVVVGPLGVIIGKGLSSAMLSIYHVAPWLALSILGAIMPLVVMIGMH   303
                PT +LI   L  L+  VGPLG I+G+ LSS +   ++ A   +A+ +L       L++MTGMH
Sbjct: 243  VPTFTLLIVVPLTLITVGPLGAILGEYLSSGVNYLFDHAGLVAMILLAGTFSLIIMTGMH   302

Query: 304  WAFAPIFLAASVATPDVLILPAMLASNLAQGAASLAVAVKAKQKQTRQVAFAAGLSALLA   363
            +AF PI +             +LPAM  +N+ Q  AS AV ++++ K+  + +A         ++AL+
Sbjct: 303  YAFVPIMINNIAQNGHDYLLPAMFLANMGQAGASFAVFLRSRNKKFKSLALTTSITALM-   361
```

-continued

```
Query:  364  GITEPALYGVTLKFKKPLYAAMISGGLVGAYIGLVNIASYTFVVPSIIGLPQYINPQGGN  423
             GITEPA+YGV ++ KKP AA+I G    GA+ G+  +ASY  +V    GLP  I    G
Sbjct:  362  GITEPAMYGVNMRLKKPFAAALIGGAAGGAFYGMTGVASY--IVGGNAGLPS-IPVFIGP  418

Query:  424  NFSNAVIAAIATIILTFIITWFLGIDEGENEKSSINAQEHTHIRSGLSKKETLYSPMVGN  483
               F  A+I +        + LG ++   ++ S     Q   H  S     +E ++SP+ G
Sbjct:  419  TFIYAMIGLVIAFAAETAAAYLLGFEDVPSDGSQ---QPAVHEGS----REIIHSPIKGE  471

Query:  484  VLPLSKVPDETFSSKLLGEGLAITPSVGEVYAPFDGEIISLFPTKHAIALKDDKGVEVLI  543
             V  LS+V D  FS+ ++G+G AI P  GEV +P  G + ++F TKHAI +  D+G E+LI
Sbjct:  472  VKALSEVKDGVFSAGVMGKGFAIEPEEGEVVSPVRGSVTTIFKTKHAIGITSDQGAEILI  531

Query:  544  HIGIDTVELNGEGFEQLVKVGDFVKRGQLLLRMDIDFISSKGYSLISPVVVTNS        597
             HIG+DTV+L G+ F    +K GD V  G  L+  D++ I + GY +I+PV+VTN+
Sbjct:  532  HIGLDTVKLEGQWFTAHIKEGDKVAPGDPINSFDLEQIKAAGYDVITPVIVTNT        585
```

A related DNA sequence was identified in *S. pyogenes* <SEQ ID 2883> which encodes the amino acid sequence <SEQ ID 2884>. Analysis of this protein sequence reveals the following:

---

Possible site: 20
>>> Seems to have no N-terminal signal sequence
INTEGRAL    Likelihood = −10.40   Transmembrane 246-262 (240-271)
INTEGRAL    Likelihood = −6.26    Transmembrane 284-300 (279-304)
INTEGRAL    Likelihood = −4.14    Transmembrane 173-189 (172-194)
INTEGRAL    Likelihood = −3.24    Transmembrane 112-128 (111-137)
INTEGRAL    Likelihood = −2.39    Transmembrane 428-444 (425-445)
INTEGRAL    Likelihood = −2.13    Transmembrane 383-399 (380-401)
INTEGRAL    Likelihood = −1.97    Transmembrane 308-324 (304-327)
----- Final Results -----
   bacterial membrane --- Certainty = 0.5161 (Affirmative) <succ>
   bacterial outside --- Certainty = 0.0000 (Not Clear) <succ>
   bacterial cytoplasm --- Certainty = 0.0000 (Not Clear) <succ>

---

An alignment of the GAS and GBS proteins is shown below.

```
Identities = 508/619 (82%), Positives = 561/619 (90%), Gaps = 1/619 (0%)
Query:    4  YQETAKAILAAVGGEKNIQHVTHCVTRLRLVLDNDEIVNDQVIKTIPNVIGVMRKMDQYQ   63
             YQETAKAILAAVGG+ NIQ VTHCVTRLRLVL NDE V DQ +K I NVIGVMRKN QYQ
Sbjct:    3  YQETAKAILAAVGGKTNIQRVTHCVTRLRLVLKNDEKVKDQQVKAISNVIGVMRKNGQYQ   62

Query:   64  IILGNDVNNYYNAFLALGHFENTTREFSSQKKSSILEKLIETIAGVITPLIPALLGGGML  123
             IILGNDVNNYY  AFL+LGHF+N    + SS+ K SILE+LIETIAGVITPLIPALLGGGML
Sbjct:   63  IILGNDVNNYYQAFLSLGHFDNQDEDHSSKAKGSILERLIETIAGVITPLIPALLGGGML  122

Query:  124  KVIGILLPMLGIASSSSQTVAFINFFGDAAYYFMPIMIAYSAASRFKVTPVLAATVGGIL  183
             KV+GILLPMLG+AS+ SQTVAFINFFGDAAYYFMP+MIAYSAA+RFKVTPVLAAT+ GIL
Sbjct:  123  KVVGILLPMLGLASADSQTVAFINFFGDAAYYFMPVMIAYSAAARFKVTPVLAATIAGIL  182

Query:  184  LHPAFVTMVAEGKPLSLFGAPVTLASYGSSVIPILIMVFLMQYIERWINKIVPSVMKSFL  243
             LHPAFV MVAEGKPL+LFGAPVT ASYGSSVIPIL+MV+LMQYIE+W+N++VPSVMKSFL
Sbjct:  183  LHPAFVAMVAEGKPLTLFGAPVTPASYGSSVIPILMMVYLMQYIEKWVNRLVPSVMKSFL  242

Query:  244  QPILIILISGFLALVVVGPLGVIIGKGLSSAMLSIYHVAPWLALSILGAIMPLVVMTGMH  303
             QPILIILISGFLALVVVGPLGVIIG+GLS+  ML+IYHVAPWLAL+ILGAIMPLVVMTGMH
Sbjct:  243  QPTLIILISGFLALVVVGPLGVIIGQGLSNTMLAIYHVAPWLALAILGAIMPLVVMTGMH  302

Query:  304  WAFAPIFLAASVATPDVLILPAMLASNLAQGAASLAVAVKAKQKQTRQVAFAAGLSALLA  363
             WAFAPIFLAASVATPDVLILPAMLASNLAQGAASLAVA K KQKQTRQVA  AAG+SALLA
Sbjct:  303  WAFAPIFLAASVATPDVLILPAMLASNLAQGAASLAVAFKTKQKQTRQVALAAGISALLA  362

Query:  364  GITEPALYGVTLKFKKPLYAAMISGGLVGAYIGLVNIASYTFVVPSIIGLPQYINPQGGN  423
             GITEPALYGVTLKFKKPLYAAMISGGLVGA+IG VNIASYTFVVPSIIGLPQYINP GG
Sbjct:  363  GITEPALYGVTLKFKKPLYAAMISGGLVGAFIGFVNIASYTFVVPSIIGLPQYINPSGGA  422

Query:  424  NFSNAVIAAIATIILTFIITWFLGIDEGENEKSSINAQEHTHIRSGLSKKETLYSPMVGN  483
             NF+NA+IA  ATI+L F +TWF+GIDE E+  K     A + + ++SGLS K+TLY+PM G
Sbjct:  423  NFTNALIAGTATIVLAFSLTWFMGIDE-ESPKQVSVAADMSQVKSGLSTKQTLYAPMTGE  481

Query:  484  VLPLSKVPDETFSSKLLGEGLAITPSVGEVYAPFDGEIISLFPTKHAIALKDDKGVEVLI  543
             +L LS+VPDETFSSKLLGEG AI PS GEVYAPFDGE+I+ FPTKHA+ALK+ +GVEVLI
Sbjct:  482  MLFLSEVPDETFSSKLLGEGFAILPSEGEVYAPFDGEVITFFPTKHAVALKNTRGVEVLI  541

Query:  544  HIGIDTVELNGEGFEQLVKVGDFVKRGQLLLRMDIDFISSKGYSLISPVVVTNSIDQLEI  603
             H+GIDTVEL G+GFEQLV VGD VKRGQ LL+MDIDFI+SKGYSLISPVVVTNS +QLEI
Sbjct:  542  HVGIDTVELKGQGFEQLVSVGDVVKRGQALLKMDIDFITSKGYSLISPVVVTNSAEQLEI  601

Query:  604  IVKDAETMVTNEDDLLVIL                                          622
             I++D + MVT ED LLVIL
Sbjct:  602  IIQDDKKMVTKEDALLVIL                                          620
```

Based on this analysis, it was predicted that these proteins and their epitopes could be useful antigens for vaccines or diagnostics.

Example 2164

A DNA sequence (GBSx2281) was identified in *S. agalactiae* <SEQ ID 6687> which encodes the amino acid sequence <SEQ ID 6688>. Analysis of this protein sequence reveals the following:

Possible site: 18
>>> Seems to have no N-terminal signal sequence
----- Final Results -----
   bacterial cytoplasm --- Certainty = 0.1148 (Affirmative) <succ>
     bacterial membrane --- Certainty = 0.0000 (Not Clear) <succ>
      bacterial outside --- Certainty = 0.0000 (Not Clear) <succ>

The protein has homology with the following sequences in the GENPEPT database.

A related DNA sequence was identified in *S. pyogenes* <SEQ ID 6689> which encodes the amino acid sequence <SEQ ID 6690>. Analysis of this protein sequence reveals the following:

Possible site: 32
>>> Seems to have no N-terminal signal sequence
----- Final Results -----
   bacterial cytoplasm --- Certainty = 0.0680 (Affirmative) <succ>
     bacterial membrane --- Certainty = 0.0000 (Not Clear) <succ>
      bacterial outside --- Certainty = 0.0000 (Not Clear) <succ>

```
>GP: CAB15944 GB: Z99124 transcriptional antiterminator (BglG family)
[Bacillus subtilis]
Identities = 118/275 (42%), Positives = 183/275 (65%)
Query:   1 MIIKRVLNHNAVISVTHQGLDVLLMGKGIAFKKRIGDRINSDAIEKSFVLKNSDNMNRFT      60
             M I +V+N+N +   V   QG ++++MG+G+AF+K+ GD ++    IEK F L N D    +F
Sbjct:   1 MKIAKVINNNVISVVNEQGKELVVMGRGLAFQKKSGDDVDEARIEKVFILDNKDVSEKFK      60

Query:  61 ELFITVPEEVVACSERIINLGKIKLGKNLDEILYINLTDHIHSAIERHEQGMVIQNPLRL     120
              L   +P E +   SE II+   K++LGK L++ +Y++LTDHI+  AI+R+++G+ I+N L
Sbjct:  61 TLLYDIPIECMEVSEEIIHYAKLQLGKKLNDSIYVSLTDHINFAIQRNQKGLDIKNALLW     120

Query: 121 EIQRYYPDEYSIGMKALELIKDELGICLTIDESAFIAMHFVNAGLDNPFNEAHKITEIVS     180
              E +R Y DE++IG +AL ++K++ G+ L  DE+ FIA+H VNA L+         IT+++
Sbjct: 121 ETKRLYKDEFAIGKEALVMVKNKTGVSLPEDEAGFIALHIVNAELNEEMPNIINITKVMQ     180

Query: 181 YIEQKVKIDFRTELDESSIDYYRFMTHTKLFAQRVLSGMKYEDDDADLLLVVKKKYPREY     240
                I   VK  F+ E +E S+ YYRF+TH K FAQR+ +G     E  D  LL   VK+KY R Y
Sbjct: 181 EILSIVKYHFKIEFNEESLHYYRFVTHLKFFAQRLFNGTHMESQDDFLLDTVKEKYHRAY     240

Query: 241 KCVKEIGNNMAIQYQYQLNSSELLYLTVHVYRLVK     275
              +C K+I   +   +Y+++L S ELLYLT+H++R+VK
Sbjct: 241 ECTKKIQTYIEREYEHKLTSDELLYLTIHIERVVK     275
```

An alignment of the GAS and GBS proteins is shown below.

```
Identities = 220/279 (78%), Positives = 246/279 (87%)

Query:    1 MIIKRVLNHNAVISVTHQGLDVLLMGKGIAFKKRIGDRINSDAIEKSFVLKNSDNMNRFT      60
              M+IKRVLNHNA IS  HQGLD+LLMGKGI F K++GD I  +AIE SFVLKNSDNMNRFT
Sbjct:    1 MLIKRVLNHNAAISTNHQGLDILLMGKGITFGKKVGDSIELNAIETSFVLKNSDNMNRFT      60

Query:   61 ELFITVPEEVVACSERIINLGKIKLGKNLDEILYINLIDHIHSAIERHEQGMVIQNPLRL     120
              ELFITVP+EVVACSERIINLGKIKLGK LDEILYINLTDHIHSAIERHEQGM+I NPLR
Sbjct:   61 ELFITVPQEVVACSERIINLGKIKLGKTLDEILYINLTDHIHSAIERHEQGMLIHNPLRW     120

Query:  121 EIQRYYPDEYSIGMKALELIKDELGICLTIDESAFIAMHFVNAGLDNPFNEAHKITEIVS     180
              EIQRYYPDEYS+G+KALELI+  LG+ L IDE+AFIAMHFVNA LD PF E H++TEIVS
Sbjct:  121 EIQRYYPDEYSLGVKALELIERNLGVTLAIDEAAFIAMHFVNASLDTPFKEPHRLTEIVS     180

Query:  181 YIEQKVKIDFRTELDESSIDYYRFMTHTKLFAQRVLSGMKYEDDDADLLLVVKKKYPREY     240
              YIEQK+K  DF+TELD++SIDYYRFMTH  KLFAQRVLS M Y+DDDA+LLLVVK KYP+EY
Sbjct:  181 YIEQKIKTDFKTELDDTSIDYYRFMTHIKLFAQRVLSQMSYDDDDAELLLVVKTKYPKEY     240

Query:  241 KCVKEIGNNMAIQYQYQLNSSELLYLTVHVKRLVKNLKE     279
              +CV +I    +   +Y Y LNSSELLYLTVHVKRLVK+LKE
Sbjct:  241 RCVLDISEEIKKRYNYHLNSSELLYLTVHVKRLVEHLKE     279
```

Example 2165

A DNA sequence (GBSx2282) was identified in *S. agalactiae* <SEQ ID 6691> which encodes the amino acid sequence <SEQ ID 6692>. Analysis of this protein sequence reveals the following:

Possible site: 16
>>> Seems to have no N-terminal signal sequence
----- Final Results -----
   bacterial cytoplasm --- Certainty = 0.1104 (Affirmative) <succ>
     bacterial membrane --- Certainty = 0.0000 (Not Clear) <succ>
       bacterial outside --- Certainty = 0.0000 (Not Clear) <succ>

A related GBS nucleic acid sequence <SEQ ID 9335> which encodes amino acid sequence <SEQ ID 9336> was also identified.

A related DNA sequence was identified in *S. pyogenes* <SEQ ID 6693> which encodes the amino acid sequence <SEQ ID 6694>. Analysis of this protein sequence reveals the following:

Possible site: 23
>>> Seems to have no N-terminal signal sequence
----- Final Results -----
   bacterial cytoplasm --- Certainty = 0.3314 (Affirmative) <succ>
     bacterial membrane --- Certainty = 0.0000 (Not Clear) <succ>
       bacterial outside --- Certainty = 0.0000 (Not Clear) <succ>

An alignment of the GAS and GBS proteins is shown below.

```
Identities = 143/178 (80%), Positives = 161/178 (90%)
Query:   1  MTLHHDKHHATYVANANAALEKHPEIGEDLEALLADVSQIPEDIRQAVINNGGGHLNHAL    60
            MTLHHDKHHATYVAN NAALEKHPEIGE+LE LLADV++IPEDIRQ +INNGGGHLNHAL
Sbjct:  24  MTLHHDKHHATYVANTNAALEKHPEIGENLEELLADVTKIPEDIRQTLINNGGGHLNHAL   83

Query:  61  FWELMSPEETQISQELSEDINATFGSFEDFKAAFTAAATGRFGSGWAWLVVNAEGKLEVL  120
            FWEL+SPE+  ++ ++++ I+  FGSF+ FK  FTAAATGRFGSGWAWLVVN EG+LE+
Sbjct:  84  FWELLSPEKQDVTPDVAQAIDDAFGSFDAFKEQFTAAATGRFGSGWAWLVVNKEGQLEIT  143

Query: 121  STANQDTPIMEGKKPILGLDVWEHAYYLNYRNVRPNYIKAFFEIINWNKVNELYQAAK    178
            STANQDTPI EGKKPIL LDVWEHAYYLNYRNVRPNYIKAFFEI+NW KV+ELYQAAK
Sbjct: 144  STANQDTPISEGKKPILALDVWEHAYYLNYRNVRPNYIKAFFEIVNWKKVSELYQAAK    201
```

Based on this analysis, it was predicted that these proteins and their epitopes could be useful antigens for vaccines or diagnostics.

Example 2166

A DNA sequence (GBSx2283) was identified in *S. agalactiae* <SEQ ID 6695> which encodes the amino acid sequence <SEQ ID 6696>. Analysis of this protein sequence reveals the following:

Possible site: 39
>>> Seems to have no N-terminal signal sequence
----- Final Results -----
   bacterial cytoplasm --- Certainty = 0.3331 (Affirmative) <succ>
     bacterial membrane --- Certainty = 0.0000 (Not Clear) <succ>
       bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2167

A DNA sequence (GBSx2284) was identified in *S. agalactiae* <SEQ ID 6697> which encodes the amino acid sequence <SEQ ID 6698>. This protein is predicted to be DNA polymerase III delta subunit. Analysis of this protein sequence reveals the following:

Possible site: 32
>>> Seems to have no N-terminal signal sequence
----- Final Results -----
   bacterial cytoplasm --- Certainty = 0.0511 (Affirmative) <succ>
     bacterial membrane --- Certainty = 0.0000 (Not Clear) <succ>
       bacterial outside --- Certainty = 0.0000 (Not Clear) <succ>

A related GBS nucleic acid sequence <SEQ ID 9743> which encodes amino acid sequence <SEQ ID 9744> was also identified.

A related DNA sequence was identified in *S. pyogenes* <SEQ ID 6699> which encodes the amino acid sequence <SEQ ID 6700>. Analysis of this protein sequence reveals the following:

Possible site:43
>>> Seems to have no N-terminal signal sequence
INTEGRAL    Likelihood = –1.22    Transmembrane 250-266 (249-266)
----- Final Results -----
   bacterial membrane --- Certainty = 0.1489 (Affirmative) <succ>
     bacterial outside --- Certainty = 0.0000 (Not Clear) <succ>
       bacterial cytoplasm --- Certainty = 0.0000 (Not Clear) <succ>

An alignment of the GAS and GBS proteins is shown below.

```
Identities = 222/340 (65%), Positives = 282/340 (82%)
Query:   1  MIAIEEIGRITPDNLGLVTVLAGEDLGQYAQMKEKLFQVIGFNKDDLAYSYFDLSEEDYQ     60
            MIAIE+I +++ +NLGL+T++ G+D+GQY+Q+K +L + I F+KDDLAYSYFD+SE   YQ
Sbjct:   1  MIAIEKIEKLSKENLGLITLVTGDDIGQYSQLKSRLMEQIAFDKDDLAYSYFDMSEAAYQ     60

Query:  61  NAELDLESLPFLSDYKVVIEDQFQDITTDKKTYLDEQAMKRFEAYLQNPVDTTRLVICAP    120
            +AE+DL SLPF ++ KVVIFD   DITT+KK++L E+ +K FEAYL+NP++TTRL+I AP
Sbjct:  61  DAEMDLVSLPFFAEQKVVIFDHLLDITTNKKSFLKEKDLKAFEAYLENPLETTRLIIFAP    120

Query: 121  GKLDGKRRLVKLLKRDARVLEANTLKESDLKTYFQKYAHQEGLVFEAGVEDELLIKSNYD    180
            GKLD KRRLVKLLKRDA VLEAN LKE++L+TYFQKY+HQ GL FE+G FD+LL+KSN D
Sbjct: 121  GKLDSKRRLVKLLKRDALVLEANPLKEAELRTYFQKYSHQLGLGFESGAFDQLLLKSNDD    180

Query: 181  FSDTLTNIAFLKSYKTDGHISSNDVREAIPKSLQDNIFDLTQDVLLGRIDLARDLVRDLR    240
            FS + N+AFLK+YK  G+IS  D+ +AIPKSLQDNIFDLT+ VL G+ID ARDL+ DLR
Sbjct: 181  FSQIMKNMAFLKAYKKTGNISLTDIEQAIPKSLQDNIFDLTRLVLGGKIDAARDLIHDLR    240

Query: 241  LQGEDEIKLIAIMLGQFRMFLQVKILASKGKSESQIVSELSHYIGRKINPYQVKFAVRDS    300
            L GED+IKLIAIMLGQFR+FLQ+ ILA   K+E Q+V  LS  +GR++NPYQVK+A++DS
Sbjct: 241  LSGEDDIKLIAIMLGQFRLFLQLTILARDVKNEQQLVISLSDILGRRVNPYQVKYALKDS    300

Query: 301  RNLPLAFLKEAIRILIETDYAIKRGTYDKDYLFDLALLKI                       340
            R L LAFL  A++ LIETDY IK G Y+K YL D+ALLKI
Sbjct: 301  RTLSLAFLTGAVKTLIETDYQIKTGLYEKSYLVDIALLKI                       340
```

Based on this analysis, it was predicted that these proteins and their epitopes could be useful antigens for vaccines or diagnostics.

Example 2168

A DNA sequence (GBSx2285) was identified in *S. agalactiae* <SEQ ID 6701> which encodes the amino acid sequence <SEQ ID 6702>. Analysis of this protein sequence reveals the following:

Possible site: 37
>>> Seems to have no N-terminal signal sequence
----- Final Results -----
    bacterial cytoplasm --- Certainty = 0.3071 (Affirmative) <succ>
    bacterial membrane --- Certainty = 0.0000 (Not Clear) <succ>
    bacterial outside --- Certainty = 0.0000 (Not Clear) <succ>

No corresponding DNA sequence was identified in *S. pyogenes*.

Based on this analysis, it was predicted that this protein and its epitopes, could be useful antigens for vaccines or diagnostics.

Example 2169

A DNA sequence (GBSx2286) was identified in *S. agalactiae* <SEQ ID 6703> which encodes the amino acid sequence <SEQ ID 6704>. This protein is predicted to be esterase. Analysis of this protein sequence reveals the following:

Possible site: 26
>>> Seems to, have a cleavable N-term signal seq.
INTEGRAL Likelihood = − 0.32 Transmembrane 175 − 191 (175 − 191)
----- Final Results -----
    bacterial membrane --- Certainty = 0.1128 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP: AAB17013 GB: L38252 esterase [Acinetobacter lwoffii]
Identities = 63/218 (28%), Positives = 107/218 (48%), Gaps = 3/218 (1%)
Query: 105  KVIFYVHGGSYIHQASELQYIFVNKLAKKLDAKVVFPIYPKAPTYNYSDAIPKIKKLYQN    164
            ++IF++HGG++        +    + LA +   +V+    YP AP + Y +AI  I  +YQ
Sbjct:  73  QLIFHIHGGAFFLGSLNTHRALMTDLAARTQMQVIHVDYPLAPEHPYPEAIDAIFDVYQA    132

Query: 165  TLASVTSPKQIILVGESAGGGLALGLADNLVTEHIKQPKEIILISPWLDIATNNPKIEKV    224
            L       PK II+ G+S G  LAL L    L  +      P  +IL+SP+LD+   +  +
Sbjct: 133  LLVQGIKPKDIIISGDSCGANIALALCLRLKQQPELMPSGLILMSPYLDLTLTSESLRFN    192

Query: 225  QKKDPLLKAWQLQQVAPYWANGKKNFKNPQVSPLYSSQFNKMAPISFFIGTHDIFYPDNQ    284
            QK D LL   LQ    ++        +P+VSPL+    + + P    +G+  +I   D++
Sbjct: 193  QKHDALLSIEALQAGIKHYLTDDIQPGDPRVSPLF-DDLDGLPPTLVQVGSKEILLDDSK    251

Query: 285  LLHQKLAKENIKHHYIVGQKMNHVYPVLP--IPEAETA                          320
            +K  + ++K H+ +   M H + +      PEA+ A
Sbjct: 252  RFREKAEQADVKVHFKLYTGMWHNFQMFNAWFPEAKQA                          289
```

There is also homology to SEQ ID 3498.

Based on this analysis, it was predicted that this protein and its epitopes, could be useful antigens for vaccines or diagnostics.

Example 2170

A DNA sequence (GBSx2287) was identified in *S. agalactiae* <SEQ ID 6705> which encodes the amino acid sequence <SEQ ID 6706>. This protein is predicted to be purine nucleotide synthesis repressor. Analysis of this protein sequence reveals the following:

```
Possible site: 51
>>> Seems to have no N-terminal signal sequence
----- Final Results -----
    bacterial cytoplasm --- Certainty = 0.2970 (Affirmative) <succ>
      bacterial membrane --- Certainty = 0.0000 (Not Clear) <succ>
        bacterial outside --- Certainty = 0.0000 (Not Clear) <succ>
```

The protein has homology with the following sequences in the GENPEPT database.

```
>GP: CAB16124 GB: Z99124 similar to transcriptional regulator (LacI
family) [Bacillus subtilis]

Identities = 111/300 (37%), Positives = 175/300 (58%), Gaps = 4/300 (1%)
Query:   1  MTSISDIAEKAGVAKSTVSRVINHHPHVSDETRQKVMALITELDYIPNQLARDLSRGKTQ    60
            M +I +IA+ A V+ STVSRV+NHHP+VS+E R+ V  ++ ELDY PN+ A DL RGKT
Sbjct:   1  MANIKEIARLANVSVSTVSRVLNHHPYVSEEKRKLVHQVMKELDYTPNRTAIDLIRGKTH   60

Query:  61  KIGVVIPHTRHPYFTQLINGLLDAAKTTDYQLVMMPSDYNQELELSYLKQLKMEAIDALI   120
            +GV++P++ HP F +++NG+  AA   +Y   ++P++YN ++E+ YL+ L+ + ID LI
Sbjct:  61  TVGVILPYSDHPCFDKIVNGITKAAFQHEYATTLLPTNYNPDIEIKYLELLRTKKIDGLI   120

Query: 121  FTSRAISLDIIETYAKYGRIVVCEKLQEYNHLSSAYLDRYSSFLEAFSDMKLRGLEHLVL   180
              TSRA   D I  Y +YG ++ CE   + + +  A+ DR +++ E+F  +K RG E++
Sbjct: 121  ITSRANHWDSILAYQEYGPVIACEDTGDID-VPCAFNDRKTAYAESFRYLKSRGHENIAF   179

Query: 181  LFSRNNESSATYQSALLAYQEVYGQLSSPYMVVGNVHDFNDG-LNLSYQLVKEVSIDGIL   239
                  R  + S +       AY+ V G+L   +M+ G  +D NDG L   +   +    I
Sbjct: 180  TCVREADRSPSTADKAAAYKAVCGRLEDRHMLSG-CNDMNDGELAAEHFYMSGRVPTAIY   238

Query: 240  ATSDEVAAGLIKGYEESRKKCPYIIGQECLLVGQLLKLPTIDHKSYYLGKLAFKQALAEK   299
            A SDEVAAG I + +        IIG+   + ++L  P++D    LG  AF   L ++
Sbjct: 239  ANSDEVAAG-IHLFAKKNNWDVEIIGEGNTSISRVLGFPSLDLNLEQLGIAAFSLFLQDE   297
```

Based on this analysis, it was predicted that this protein and its epitopes, could be useful antigens for vaccines or diagnostics.

Example 2171

A DNA sequence (GBSx2288) was identified in *S. agalactiae* <SEQ ID 6707> which encodes the amino acid sequence <SEQ ID 6708>. Analysis of this protein sequence reveals the following:

```
Possible site: 45
>>> Seems to have no N-terminal signal sequence
----- Final Results -----
    bacterial cytoplasm --- Certainty = 0.3451 (Affirmative) <succ>
      bacterial membrane ---Certainty = 0.0000 (Not Clear) <succ>
        bacterial outside --- Certainty = 0.0000 (Not Clear) <succ>
```

The protein has homology with the following sequences in the GENPEPT database.

```
>GP: AAC21682 GB: U32686 conserved hypothetical protein [Haemophilus influenzae Rd]
Identities = 79/264 (29%), Positives = 134/264 (49%), Gaps = 16/264 (6%)
Query:   1   MTIKRIFCDMDGTLLNSEGQVSKSNATLIREAA---IPVTLVSARAPMEMKDAVDALQLG      57
             M  K +F D +GTLL S+  +S      +I+       IP   +SAR+P+ +      L+
Sbjct:   1   MMYKAVFSDFNGTLLTSQHTISPRTVVVIKRLTANGIPFVPISARSPLGILPYWKQLETN     60

Query:  58   GVQVAFNGGLIYRIGDNNQVLPIHTQIIKKSTVKQLLRGIRFHFPQVSLSYYDLNNWYCD    117
               V VAF+G LI     N  + PI++  I+   + ++    + H P + ++YY  N+ +
Sbjct:  61   NVLVAFSGALIL----NQNLEPIYSVQIEPKDILEINTVLAEH-PLLGVNYYTNNDCHAR    115

Query: 118   KID-EGIRYEHSLTQQCPTFIHNEDQFLEGHTNTFKIMMITFDEANMLELEKYLQSLELP    176
             ++ + + YE S+T+      IH D+    T +   + I  +    ++E+E  L+   + P
Sbjct: 116   DVENKWVIYERSVTK---IEIHPFDEVA---TRSPHKIQIIGEAEEIIEIEVLLKE-KFP    168

Query: 177   EITIQRSGKAYLEITHLLAKKSKGIAYILQKEQLAREETAAFGDGHNDLPMLEMVGYPIV    236
             ++I RS    +LE+ H  A K   + ++        +   E   AFGD   NDL MLE VG  +
Sbjct: 169   HLSICRSHANFLEVMHKSATKGSAVRFLEDYFGVQTNEVIAFGDNFNDLDMLEHVGLGVA    228

Query: 237   MDNAFDDIKAIAYQLTKSNDEDGV                                        260
             M NA ++IK  A   +T +N+EDG+
Sbjct: 229   MGNAPNEIKQAANVVTATNNEDGL                                        252
```

Based on this analysis, it was predicted that this protein and its epitopes, could be useful antigens for vaccines or diagnostics.

Example 2172

A DNA sequence (GBSx2289) was identified in *S. agalactiae* <SEQ ID 6709> which encodes the amino acid sequence <SEQ ID 6710>. Analysis of this protein sequence reveals the following:

Possible site: 60
>>> Seems to have no N-terminal signal sequence
----- Final Results -----
  bacterial cytoplasm --- Certainty = 0.2854 (Affirmative) <succ>
  bacterial membrane --- Certainty = 0.0000 (Not Clear) <succ>
  bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2173

A DNA sequence (GBSx2290) was identified in *S. agalactiae* <SEQ ID 6711> which encodes the amino acid sequence <SEQ ID 6712>. Analysis of this protein sequence reveals the following:

Possible site: 40
>>> Seems to have an uncleavable N-term signal seq
INTEGRAL    Likelihood = -10.51   Transmembrane 392-408 (376-417)
INTEGRAL    Likelihood = -9.92    Transmembrane 440-456 (433-461)
INTEGRAL    Likelihood = -6.42    Transmembrane 52-68 (51-70)
INTEGRAL    Likelihood = -6.32    Transmembrane 29-45 (9-48)
INTEGRAL    Likelihood = -6.32    Transmembrane 309-325 (308-328)
INTEGRAL    Likelihood = -4.46    Transmembrane 12-28 (9-29)
INTEGRAL    Likelihood = -3.29    Transmembrane 463-479 (462-479)
INTEGRAL    Likelihood = -2.07    Transmembrane 353-369 (352-369)
INTEGRAL    Likelihood = -1.17    Transmembrane 374-390 (374-390)
INTEGRAL    Likelihood = -0.85    Transmembrane 247-263 (247-263)
INTEGRAL    Likelihood = -0.06    Transmembrane 278-294 (278-294)
----- Final Results -----
  bacterial membrane --- Certainty = 0.5203 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

```
>GP: AAC23742 GB: AF052208 competence protein [Streptococcus pneumoniae]
Identities = 325/705 (46%), Positives = 478/705 (67%), Gaps = 3/705 (0%)
Query:   1   MLQLTKYFPLKPIYLALLVFQIYLLVFSWTMLGCAFLLFSFIFLIYQYDRETIFKTIAIV     60
             MLQ  K F +  IYL+ L+  +Y  +FS + L     +F   + L  Q+  ++  K + I
Sbjct:   1   MLQWIKNFSIPLIYLSFLLLWLYYAIFSASYLALLGFVFLLVCLFIQFPWKSAGKVLIIC     60

Query:  61   IFFLFYFLWQNHNMNVQYQRVPNHISQIKVRIDTISINGDVLSFQADASGNTYQAFYTLK    120
                F +F++QN  +      Q + +  ++++ DT+ +NGD LSF+   A G   +Q +Y L+
Sbjct:  61   GIFGFWFVFQNWQQSQASQNLADSVERVRILPDTVKVNGDSLSFRGKADGRIFQVYYKLQ    120

Query: 121   NKSEKDYFQNLDNNIMIIADIKLEEAEERRHFNGFDYRQYLKRHGIYRIAENTKIKQIRL    180
             ++ EK+ FQ L +     I  + KL E E +R+F GF+Y+ YLK   GIY+    + KI+ ++
Sbjct: 121   SEEEKEAFQALTDLHEIGLEGKLSEPEGQRNFGGFNYQAYLKTQGIYQTLNIKKIQSLQK    180

Query: 181   FQHRSFFALMSKWRRSAIVISQT-FPNPMRHYMSGLLFGYLDKTFDDMSDLYSSLGIIHL    239
                +S  RR A+V   +T FP+PMR+ YM+GLL  G+LD   F++M ++LYSSLGIIHL
Sbjct: 181   IGSWDIGENLSSLRRKAVVWIKTHFPDPMRNYMTGLLLGHLDTDFEEMNELYSSLGIIHL    240

Query: 240   FALSGMQVGFFLGIFRYICLRIGLRLDHVWLLQIPFSLIYAGLTGFSISVVRALIQSLLS    299
             FALSGMQVGFF+   F+  +  LR+GL     +   L   PFSLIYAGLTGFS  SV+R+L+Q  LL+
Sbjct: 241   FALSGMQVGFFMNGFKKLLLRLGLTQEKLKWLTYPFSLIYAGLTGFSASVIRSLLQKLLA    300
```

```
Query: 300  HSGVKKDENFALCLLICLISLPHSLLTTGGVLSFAYAFILTMTSFDHFSSIKKVAIESLT    359
            GVK +N AL +L+  I +P+   T GGVLS AYAFILTM S+    +K VA ESL
Sbjct: 301  QHGVKGLDNCALTVLVLFIVMPNFFFTAGGVLSCAYAFILTMPSKEG-EGLKAVASESLV   359

Query: 360  VSVGILPILTYYFSGFQPISIILTALLSFAFDIIFLPLLTVIFVLSPIVKLSCINSLFEI   419
            +S+GILPIL++YF+ FQP SI+LT + SF FD+ FLPLL+++FVLS +  +  +N +FE
Sbjct: 360  ISLGILPILSFYFAEFQPWSILLTFVFSFLFDLTFLPLLSILFVLSFLYPVIQLNFIFEW   419

Query: 420  LEVLLKWTGQLFPRPLIFGKPSLFLLIVMIIILGLLYDYYHSKCFRYCSLLIIFTLFFIT   479
            LE +++   Q+  RPL+FG+P+ +LLI+++I L L+YD  +       L+I  LF +T
Sbjct: 420  LEGIIRLVSQVTSRPLVFGQPNTWLLILLLISLALVYDLRKNIKKLTVLCLLITGLFLLT   479

Query: 480  KNPITNEVAILDVGQGDSILVRDWLGKTILIDTGGRVR-FEQPEEWKQKVNQSNAKRTLI   538
            K+P+ NE+ +LDVGQG+SI +RD  GKTILID GG+   +++ ++W++K+  SNA+R+LI
Sbjct: 480  KHPLENEITMLDVGQGESIFLRDVTGKTILIDVGGKAESYKKIKKWQEKMTTSNAQRSLI   539

Query: 539  PYLKSRGISKIDDLVITHTDTDHMGDMEVISKHFKVARLITSSGSLTNSQYVKHLSKIGV   598
            PYLKSRG++KID L++T+TD +H+GD+  ++K F V  ++ S    SL    ++V  L
Sbjct: 540  PYLKSRGVAKIDQLILTNTDKEHVGDLSEMTKAFHVGEILVSKDSLKQKEFVAELQATQT   599

Query: 599  AVKSIEAGDKLAVMGSYLQVLYPWHKGDGKNNDSIVLYGHLLGKGFLFTGDLEEEGEKQL   658
               V+S+  G+ L + GS L+VL P   GDG ++D++VLYG  L K FLFTG+LEE+GEK L
Sbjct: 600  KVRSMIVGENLPIFGSQLEVLSPRKMGDGGHDDTLVLYGKFLDKQFLFTGNLEEKGEKDL   659

Query: 659  LEAYPNLSVDILKAGHHGSKGSSSLSFLKKLSPSVVLVSAGKNNR                703
            L+ YP+L V++LKA  HG+K SSS +FL+KL P + L+S GK+NR
Sbjct: 660  LKHYPDLKVNVLKASQHGNKKSSSPAFLEKLKPELTLISVGKSNR                704
```

A related DNA sequence was identified in *S. pyogenes* <SEQ ID 6713> which encodes the amino acid sequence <SEQ ID 6714>. Analysis of this protein sequence reveals the following:

Possible site: 29
>>> Seems to have an uncleavable N-term signal seq
INTEGRAL  Likelihood = −10.19  Transmembrane 394-410 (380-422)
INTEGRAL  Likelihood = −8.28   Transmembrane 54-70 (52-72)
INTEGRAL  Likelihood = −6.32   Transmembrane 356-372 (355-377)
INTEGRAL  Likelihood = −4.73   Transmembrane 8-24 (7-25)

-continued

INTEGRAL  Likelihood = −4.30   Transmembrane 30-46 (29-50)
INTEGRAL  Likelihood = −3.88   Transmembrane 249-265 (249-267)
INTEGRAL  Likelihood = −3.40   Transmembrane 467-483 (465-484)
INTEGRAL  Likelihood = −2.39   Transmembrane 325-341 (325-347)
INTEGRAL  Likelihood = −0.43   Transmembrane 441-457 (441-458)
----- Final Results -----
   bacterial membrane --- Certainty = 0.5076 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the databases:

```
>GP: AAC23742 GB: AF052208 competence protein [Streptococcus pneumoniae]
Identities = 311/706 (44%), Positives = 458/706 (64%), Gaps = 10/706 (1%)
Query:   5  WTKIMPLSKIQFAFLILVFFYQIHSPSWLTFL-LSLSLICLLVKRLSKK--EFLGVFAIL     61
            W K  + I  +FL+L +Y I S S+L L     L+CL ++    K   + L+   I
Sbjct:   4  WIKNFSIPLIYLSFLLLWLYYAIFSASYLALLGFVFLLVCLFIQFPWKSAGKVLIICGIF     63

Query:  62  SFCALFLLYQKQQLVQKLEIQPVQITSVALVPDSIRINGDQLAVLGRHGKHSYQLFYRLK   121
            +F  +F +Q+ Q  Q L    +  V  ++PD++++NGD L+   G+     +Q++Y+L+
Sbjct:  64  GFWFVFQNWQQSQASQNLADS---VERVRILPDTVKVNGDSLSFRGKADGRIFQVYYKLQ   120

Query: 122  SQAEAQLFKKEHRWLVMHAKVTLEKAEEVRNFKGFNYQTFLTYQGIYRIGKVEQIEQLEV   181
            S+ E + F+        + + L + E RNF GFNYQ +L  QGIY+    +++I+ L+
Sbjct: 121  SEEEKEAFQALTDLHEIGLEGKLSEPEGQRNFGGFNYQAYLKTQGIYQTLNIKKIQSLQK   180

Query: 182  ISPESICDYLSSLRRRAIVHCQQHFPRPMSHYLTGLLFGYLDKSFGEMTDYYSQLGIIHL   241
            I     I + LSSLRR+A+V + HFP PM +YGTGLL  G+LD   F EM + YS LGIIHL
Sbjct: 181  IGSWDIGENLSSLRRKAVVWIKTHFPDPMRNYMTGLLLGHLDTDFEEMNELYSSLGIIHL   240

Query: 242  FALSGMQVGFFLTCFRRVLLLLAVPLEWIKWIELPFACFYAALTGYSISVIRSLVQSQLR   301
            FALSGMQVGFF+  F+++ LL L +  E +KW+  PF+  YA LTG+S SVIRSL+Q  L
Sbjct: 241  FALSGMQVGFFMNGFKKLLLRLGLTQEKLKWLTYPFSLIYAGLTGFSASVIRSLLQKLLA   300

Query: 302  HLGIKGLDNLACTFLLVFLWDAHFLMTVGGVLTFSYAFLLTVVTVEELSGAKRQLVQVLT   361
              G+KGLDN A T L++F+   +F  T GGVL+ +YAF+LT+ + +E    G K    + L
Sbjct: 301  QHGVKGLDNCALTVLVLFIVMPNFFFTAGGVLSCAYAFILTMPS-KEGEGLKAVASESLV   359

Query: 362  ISLGILPFLLYFSSFNPMSMVLTGLLSYLFDLFILPLLCLVFCLSPLVTVSICNHLFIL   421
            ISLGILP L  FYF+  FQP S++LT + S+LFDL  LPLL ++F LS L V    N +F
Sbjct: 360  ISLGILPILSFYFAEFQPWSILLTFVFSFLFDLTFLPLLSILFVLSFLYPVIQLNFIFEW   419

Query: 422  LEKVIQFLGNTFNSSLVFGSPTSWHLLILVISFAIFYDYRQ-VRQRVITCGLVIALTLLS   480
            LE +I+ +       + LVFG P +W L++ IS A+ YD R+ +++     C L+ L LL+
Sbjct: 420  LEGIIRLVSQVTSRPLVFGQPNTWLLILLLISLALVYDLRKNIKKLTVLCLLITGLFLLT   479
```

```
-continued
Query:  481  VKYPLTNEVTFIDIGQGDSILVREWTGKNLLIDVGGR-PFFSSKEHWRRGHHVANAQKTL   539
             K+PL NE+T +D+GQG+SI +R+ TGK +LIDVGG+    +    + W+     +NAQ++L
Sbjct:  480  -KHPLENEITMLDVGQGESIFLRDVTGKTILIDVGGKAESYKKIKKWQEKMTTSNAQRSL   538

Query:  540  IPYLKSRGIHTIDQLLVTHADTDHMGDIEVVAKAIRIKEILTSQGSLSHPSFVRRLRRLK   599
             IPYLKSRG+  IDQL++T+ D +H+GD+  + KA   + EIL S+ SL     FV  L+  +
Sbjct:  539  IPYLKSRGVAKIDQLILTNTDKEHVGDLSEMTKAFHVGEILVSKDSLKQKEFVAELQATQ   598

Query:  600  CHVRVLAAGDQLPIMGSVLQVLYPWQLGDGKNNDSLVLYGRLLNRTFLFTGDLEKEGENE   659
              VR +   G+ LPI GS L+VL P ++GDG ++D+LVLYG+ L++  FLFTG+LE++GE +
Sbjct:  599  TKVRSMIVGENLPIFGSQLEVLSPRKMGDGGHDDTLVLYGKFLDKQFLFTGNLEEKGEKD   658

Query:  660  IIKRYPQLRVDYLKAGHHGSNTSSSAAFLDHIQPKVAFISAGKNNR                705
             ++K YP L+V+ LKA HG+   SSS AFL+ ++P++  IS GK+NR
Sbjct:  659  LLKHYPDLKVNVLKASQHGNKKSSSPAFLEKLKPELTLISVGKSNR                704
                                           15
```

An alignment of the GAS and GBS proteins is shown below.

```
Identities = 346/743 (46%), Positives = 491/743 (65%), Gaps = 3/743 (0%)
Query:    5  TKYFPLKPIYLALLVFQIYLLVFSWTMLGCAFLLFSFIFLIYQYDRETIFKTIAIVIFFL    64
             TK  PL   I  A L+  +  +S +L      L     L+ +  ++        AI+ F
Sbjct:    6  TKLVPLSKIQFAFLILVFFYQIHSPSWLIFLLSLSLICLLVKRLSKKEFLGVFAILSFCA    65

Query:   65  FYFLWQNHNMNVQYQRVPNHISQIKVRIDTISINGDVLSFQADASGNTYQAFYTLKNKSE   124
              + L+Q  +  + P I+ + +  D+I INGD L+          ++YQ FY LK+++E
Sbjct:   66  LFLLYQKQQLVQKLEIQPVQITSVALVPDSIRINGDQLAVLGRHGKHSYQLFYRLKSQAE   125

Query:  125  KDYFQNLDNNIMIIADIKLEFAEERRHFNGFDYRQYLKRHGIYRIAKVTKIKQIRLFQHR   184
                F+     +++ A + LE+AEE R+F GF+Y+ +L    GIYRI  KV +I+Q+ +
Sbjct:  126  AQLFKKEHRWLVMHAKVTLEKAEEVRNFKGFNYQTFLTYQGIYRIGKVEQIEQLEVISPE   185

Query:  185  SFFALMSKWRRSAIV-ISQTFPNPMRHYMSGLLFGYLDKTFDDMSDLYSSLGIIHLFALS   243
             S    +S  RR AIV    Q FP PM HY++GLLFGYLDK+F +M+D  YS LGIIHLFALS
Sbjct:  186  SICDYLSSLRRRAIVHCQQHFPRPMSHYLTGLLFGYLDKSFGEMTDYYSQLGIIHLFALS   245

Query:  244  GMQVGFFLGIFRYICLAIGLRLDHVWLLQIPFSLIYAGLIGFSISVVRALIQSLLSHSGV   303
             GMQVGFFL  FR + L  + L+ + +++PF+  YA LTG+SISV+R+L+QS L H G+
Sbjct:  246  GMQVGFFLTCFRRVLLLLAVPLEWIKWIELPFACFYAALTGYSISVIRSLVQSQLRHLGI   305

Query:  304  KKDENFALCLLICLISLPHSLLTTGGVLSFAYAFILTMTSFDHFSSIKKVAIESLTVSVG   363
             K +N A   L+  +    H L+T GGVL+F+YAF+LT+ + + S  K+  ++ LT+S+G
Sbjct:  306  KGLDNLACTFLINFLWDAHFLMTVGGVLTFSYAFLLIVVIVEELSGAKRQLVQVLTISLG   365

Query:  364  ILPILTYYFSGFQPISIILTALLSFAFDIIFLPLLTVIFVLSPIVKLSCINSLFEILEVL   423
             ILP L +YFS F P+S++LT LLS+ FD+  LPLL ++F LSP+V +S  N LF +LE +
Sbjct:  366  ILPFLLFYFSSFNPMSMVLTGLLSYLFDLFILPLLCLVFCLSPLVTVSICNHLFILLEKV   425

Query:  424  LKWTGQLFPRPLIFGKPSLFLLIVMIIILGLLYDYYHSKC-FRYCSLLIIFTLFFITKNP   482
              +++  G  F   L+FG P+ + L+++++I   + YDY     +  C L+I  TL  + K P
Sbjct:  426  IQFLGNTFNSSLVFGSPTSWHLLILVISFAIFYDYRQVRQVITCGLVIALTLLSV-KYP   484

Query:  483  ITNEVAILDVGQGDSILVRDWLGKTILIDTGGRVRFEQPEEWKQKVNQSNAKRTLIPYLK   542
             +TNEV  +D+GQGDSILVR+W GK +LID GGR  F   E W++  + +NA++TLIPYLK
Sbjct:  485  LTNEVIFIDIGQGDSILVREWIGKNLLIDVGGRPFFSSKEHWRRGHHVANAQKILIPYLK   544

Query:  543  SRGISKIDDLVITHTDTDHMGDMEVISKHFKVARLITSSGSLTNSQYVKHLSKIGVAVKS   602
             SRGI   ID L++TH DTDHMGD+EV++K    ++  ++TS GSL+    +V+ L  ++    V+
Sbjct:  545  SRGIHTIDQLLVTHADTDHMGDIEVVAKAIRIKEILTSQGSLSHPSFVRRLRRLKCHVRV   604

Query:  603  IEAGDKLAVMGSYLQVLYPWHKGDGKNNDSIVLYGHLLGKGFLFTGDLEEEGEKQLLEAY   662
              + AGD+L +MGS LQVLYPW  GDGKNNDS+VLYG LL +  FLFTGDLE+EGE ++++  Y
Sbjct:  605  LAAGDQLPIMGSVLQVLYPWQLGDGKNNDSLVLYGRLLNRTFLFTGDLEKEGENEIIKRY   664

Query:  663  PNLSVDILKAGHHGSKGSSSLSFLKKLSPSVVLVSAGKNNRYQHPHQETLQRFQIKSKI   722
             P L VD LKAGHHGS  SSS +FL +  P V  +SAGKNNRYQHPH+ETL R + +
Sbjct:  665  PQLRVDYLKAGHHGSNTSSSAAFLDHIQPKVAFISAGKNNRYQHPHRETLARLEDRQITY   724

Query:  723  FRTDQSGTIRLTGWWKWHIQTVR                                      745
             +RTD  G IRLTG   WH++TVR
Sbjct:  725  YRTDTQGAIRLTGRTSWHLETVR                                      747
```

Based on this analysis, it was predicted that these proteins and their epitopes could be useful antigens for vaccines or diagnostics.

Example 2174

A DNA sequence (GBSx2291) was identified in *S. agalactiae* <SEQ ID 6715> which encodes the amino acid sequence <SEQ ID 6716>. This protein is predicted to be competence protein (comEA). Analysis of this protein sequence reveals the following:

Possible site: 38
>>> Seems to have an uncleavable N-term signal seq
INTEGRAL Likelihood = -3.77 Transmembrane 18-34 (14-36)
----- Final Results -----
  bacterial membrane --- Certainty = 0.2508 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the GENPEPT database.

```
>GP:AAC23741 GB:AF052208 competence protein [Streptococcus pneumoniae]
Identities = 96/217 (44%), Positives = 138/217 (63%), Gaps = 4/217 (1%)
Query: 3    EIVLEKIKSHKWETTGIIVGLLLFGILGLNHFG-THHKEDNLNINLEK-KVSTITEKKVP   60
            E ++EKIK +K       +GLL+ G   L      T  KE NL +      ++EK+V
Sbjct: 2    EAIIEKIKEYKIIVICTGLGLLVGGFFLLKPAPQTPVKETNLQAEVAAVSKDLVSEKEVN   61

Query: 61   MISHVKDKVSNQVTVDVKGAVNHPGVYSLPSQSRVTDAIKRAGGLSNLADSKSVNLAQKL   120
              +    + +TVDVKGAV  PG+Y LP   SR+ DA+++AGGL+   ADSKS +NLAQK+
Sbjct: 62   KEEKEEPLEQDLITVDVKGAVKSPGIYDLPVGSRINDAVQKAGGLTEQADSKSLNLAQKV   121

Query: 121  QDETVIYVAQGEKITVVEEEKANNIATQGNSKGKINLNKADLSSLQTISGVGAKRAQDI   180
              DE ++YV  KGE+   V ++       A+ + + K+NLNKA L  L+ + G+G KRAQDI
Sbjct: 122  SDEALVYVPTKGEE--AVSQQTGLGTASSISKEKKVNLNKASLEELKQVKGLGGKRAQDI   179

Query: 181  LDYRDSQGGFKTIDDLKNVSGIGEKTLEKLRQDVTID                         217
            +D+R++  G FK++D+LK VSGIG KT+EKL+   VT+D
Sbjct: 180  IDHREANGKFKSVDELKKVSGIGGKTIEKLKDYVTVD                         216
```

A related DNA sequence was identified in *S. pyogenes* <SEQ ID 6717> which encodes the amino acid sequence <SEQ ID 6718>. Analysis of this protein sequence reveals the following:

Possible site: 36
>>> Seems to have no N-terminal signal sequence
INTEGRAL Likelihood = -9.61 Transmembrane 22-38 (16-42)
----- Final Results -----
  bacterial membrane --- Certainty = 0.4843 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP:AAC23741 GB:AF052208 competence protein [Streptococcus pneumoniae]

Identities = 82/179 (45%), Positives = 124/179 (68%), Gaps = 4/179 (2%)

Query: 42   NRQSKAAVPALREISPVKQQVSEEKKEIQEDSSILVDLKGAVQKEGVYKLTASSRVRDVI   101
            N Q++ A  + +++    K+    EEK+E  E    I VD+KGAV+  G+Y L   SR+ D +
Sbjct: 42   NLQAEVAAVS-KDLVSEKEVNKEEKEEPLEQDLITVDVKGAVKSPGIYDLPVGSRINDAV   100

Query: 102  ELAGGLTSEADKHAINFAEKLTDEQVYVPKQGEEISVLPRSLVSGKKETASKDQSKVHI   161
            + AGGLT +AD   ++N A+K++DE +VYVP +GEE   + +     G   + SK++ KV++
Sbjct: 101  QKAGGLTEQADSKSLNLAQKVSDEALVYVPTKGEE--AVSQQTGLGTASSISKEK-KVNL   157

Query: 162  NKASLEELQHIPGIGAKRAQDIIDMRDKLGGFKALEDLRQVSGIGEKTLEKLKDDIFLD    220
            NKASLEEL+ + G+G KRAQDIID R+   G FK++++L++VSGIG KT+EKLKD  +D
Sbjct: 158  NKASLEELKQVKGLGGKRAQDIIDHREANGKFKSVDELKKVSGIGGKTIEKLKDYVTVD    216
```

An alignment of the GAS and GBS proteins is shown below.

```
Identities = 81/166 (48%), Positives = 111/166 (66%), Gaps = 10/166 (6%)
Query:  62  ISHVKDKVSNQ---------VTVDVKGAVNHPGVYSLPSQSRVTDAIKRAGGLSNLADSK  112
            IS VK +VS +          + VD+KGAV   GVY L + SRV D I+ AGGL++ AD
Sbjct:  55  ISPVKQQVSEEKKEIQEDSSILVDLKGAVQKEGVYKLTASSRVRDVIELAGGLTSEADKH  114

Query: 113  SVNLAQKLQDETVIYVAQKGEKITVVEEEKANNIA-TQGNSKGKINLNKADLSSLQTISG  171
            ++N A+KL DE V+YV ++GE+I+V+    +     T   + K+++NKA L  LQ I G
Sbjct: 115  AINFAEKLTDEQVVYVPKQGEEISVLPRSLVSGKKETASKDQSKVHINKASLEELQHIPG  174

Query: 172  VGAKRAQDILDYRDSQGGFKTIDDLKNVSGIGEKTLEKLRQDVTID                217
            +GAKRAQDI+D RD  GGFK ++DL+ VSGIGEKTLEKL+ D+ +D
Sbjct: 175  IGAKRAQDIIDMRDKLGGFKALEDLRQVSGIGEKTLEKLKDDIFLD                220
```

A related GBS gene <SEQ ID 8989> and protein <SEQ ID 8990> were also identified. Analysis of this protein sequence reveals the following:

---

Lipop: Possible site: −1 Crend: 9
McG: Discrim Score: 5.70
GvH: Signal Score (−7.5): −2.58
Possible site: 38
>>> Seems to have an uncleavable N-term signal seq
ALOM program   count: 1 value: −3.77 threshold: 0.0
INTEGRAL      Likelihood = −3.77   Transmembrane 18-34 (14-36)
PERIPHERAL    Likelihood = 10.40   73
modified ALOM score: 1.25
*** Reasoning Step: 3
----- Final Results -----
   bacterial membrane --- Certainty = 0.2508 (Affirmative) <succ>
      bacterial outside --- Certainty = 0.0000 (Not Clear) <succ>
         bacterial cytoplasm --- Certainty = 0.0000 (Not Clear) <succ>

---

The protein has homology with the following sequences in the databases:

SEQ ID 8990 (GBS129) was expressed in *E. coli* as a GST-fusion product. SDS-PAGE analysis of total cell extract is shown in FIG. 41 (lane 4; MW 43.8 kDa).

Based on this analysis, it was predicted that these proteins and their epitopes could be useful antigens for vaccines or diagnostics.

Example 2175

A DNA sequence (GBSx2292) was identified in *S. agalactiae* <SEQ ID 6719> which encodes the amino acid sequence <SEQ ID 6720>. Analysis of this protein sequence reveals the following:

---

Possible site: 54
>>> Seems to have a cleavable N-term signal seq.
INTEGRAL   Likelihood = −14.01   Transmembrane 215-231 (208-240)
----- Final Results -----
   bacterial membrane --- Certainty = 0.6604 (Affirmative) <succ>

---

```
44.3/64.1% over 215aa
Streptococcus pneumoniae
GP|3211753| competence protein Insert characterized
ORF01930(304-951 of 1014)
GP|3211753|gb|AAC23741.1||AF052208(1-216 of 216) competence protein
{Streptococcus pneumoniae}
% Match = 25.0
% Identity = 44.2 % Similarity = 64.1
Matches = 96 Mismatches = 75 Conservative Sub.s = 43

90        120       150       180       210       240       270       300
DDGKKLNPLTYIYRLPLAIIAIVLLVLTLIFSYLASFVWDPQKHLK*GLHGNYLLFSK*FFWFLIGKSL*LRISKWRNIF 330       360       390       417       447       474       504       534
MFEIVLEKIKSHKWETTGIIVGLLLFGILGLNHFG-THHKEDNLNINLEK-KVSTITEKKVPMISHVKDKVSNQVTVDVK
   | ::|||| :|        :|||: |  |       | || ||  :         ::||:|    :   : :|||||
MEAIIEKIKEYKIIVICTGLGLLVGGFFLLKPAPQTPVKETNLQAEVAAVSKDLVSEKEVNKEEKEEPLEQDLITVDVK
         10        20        30        40        50        60        70

564       594       624       654       684       714       744       774
GAVNHPGVYSLPSQSRVTDAIKRAGGLSNLADSKSVNLAQKLQDETVIYVAQKGEKITVVXEEKANNIATQGNSKGKINL
|||   ||:   ||   ||||:    ||||:||||:|||:|||||||||: ::|| |||: |||   |:   : |:||
GAVKSPGIYDLPVGSRINDAVQKAGGLTEQADSKSLNLAQKVSDEALVYVPTKGEE--AVSQQTGLGTASSISKEKKVNL
         90        100       110       120       130       140       150

804       934       864       894       924       954       984       1014
NKADLSSLQTISGVGAKRAQDILDYRDSQGGFKTIDDLKNVSGIGEKTLEKLRQDVTID*VFSSKTYLFSIVGLPNLLTS
|||  |:  : :|: ||||||:|:|::   |||:  :|| |||||  ||:||::|| ||                    
NKASLEELKQVKGLGGKRAQDIIDHREANGKFKSVDELKKVSGIGGKTIEKLKDYVTVD
         170       180       190       200       210
``` bacterial outside --- Certainty = 0.0000 (Not Clear) <succ>
bacterial cytoplasm --- Certainty = 0.0000 (Not Clear) < succ>

The protein has homology with the following sequences in the GENPEPT database.

```
>GP:CAB12793 GB:Z99109 similar to 1-acylglycerol-3-phosphate
O-acyltransferase [Bacillus subtilis]
Identities = 66/200 (33%), Positives = 111/200 (55%), Gaps = 10/200 (5%)
Query:   3   YTYLRTLVMFLIWVANGNAHYHNEDKMLKDDENYILVAPHRTFWDPVYMAFAARPKQFIF    62
             Y +     + ++ +   G    Y+ E+  L  D  +++     H   + D + +      P Q   +
Sbjct:   2   YKFCANALKVILSLRGGVKVYNKEN--LPADSGFVIACTHSGWVDVITLGVGILPYQIHY    59

Query:  63   MAKKELFTNRLFGWWIKMCGAFPIDREKPGQDAIRYPVKMLKNSNRSLVMFPSGSRHSKD   122
             MAKKELF N+    G ++K     AFP+DRE PG  +I+ P+K+LK          +  +FPSG+R S+D
Sbjct:  60   MAKKELFQNKWIGSFLKKIHAFPVDRENPGPSSIKTPIKLLK-EGEIVGIFPSGTRTSED   118

Query: 123   V--KGGVAVIAKMAKVRIMPAAYRGPMVFKNLLKGHRVDMNFGNPIDVSDIKRMDA-EGI   179
             V   K G    IA+M K  ++PAAY+GP    K L K   ++ +    G P+   +D      + + E +
Sbjct: 119   VPLKRGAVTIAQMGKAPLVPAAYQGPSSGKELFKKGKMKLIIGEPLHQADFAHLPSKERL   178

Query: 180   A----EVSRRIQEEFDRLDR                                         195
             A       +++RI+E  ++LD+
Sbjct: 179   AAMTEALNQRIKELENKLDQ                                         198
```

A related DNA sequence was identified in *S. pyogenes* <SEQ ID 6721> which encodes the amino acid sequence <SEQ ID 6722>. Analysis of this protein sequence reveals the following:

Possible site: 49
>>>Seems to have no N-terminal signal sequence
INTEGRAL   Likelihood = −11.83   Transmembrane 241-257 (234-266)
INTEGRAL   Likelihood = −4.41    Transmembrane 27-43 (26-44)
----- Final Results -----
   bacterial membrane --- Certainty = 0.5734 (Affirmative) <succ>
     bacterial outside --- Certainty = 0.0000 (Not Clear) <succ>
       bacterial cytoplasm --- Certainty = 0.0000 (Not Clear) <succ>

The protein has homology with the following sequences in the databases:

```
>GP:CAB12793 GB:Z99109 similar to 1-acylglycerol-3-phosphate
O-acyltransferase [Bacillus subtilis]
Identities = 59/198 (29%), Positives = 104/198 (51%), Gaps = 6/198 (3%)
Query:  29   YAYLRGLVVFLLWVNGNAHYHHEEKMLDASENYILVAPHRTFWDPVYMAFAARPKQFIF    88
             Y +     +  +L +   G     Y+ E    LA     +++     H   + D + +      P Q   +
Sbjct:   2   YKFCANALKVILSLRGGVKVYNKEN--LPADSGFVIACTHSGWVDVITLGVGILPYQIHY    59

Query:  89   MAKKELFANRLFAWWIKMCGAFPIDRDKPSPDAIRYPVNMLKKSNRSLLMFPSGSRHSQE   148
             MAKKELF N+       ++K     AFP+DR+  P  P +I+ P+  +LK+         +  +FPSG+R S++
Sbjct:  60   MAKKELFQNKWIGSFLKKIHAFPVDRENPGPSSIKTPIKLLKE-GEIVGIFPSGTRTSED   118

Query: 149   V--KGGVAVIAKLAKVKIMPAAYQGPMSVKGLLAGERVDMTFGNPIDVSDIKRM-NDEGI   205
             V   K G    IA++ K  ++PAAYQGP S  K L      ++ +    G P+   +D      + + E +
Sbjct: 119   VPLKRGAVTIAQMGKAPLVPAAYQGPSSGKELFKKGKMKLIIGEPLHQADFAHLPSKERL   178

Query: 206   AEVANRIQAEFDRIDDEL                                           223
             A +    +         ++++L
Sbjct: 179   AAMTEALNQRIKELENKL                                           196
```

An alignment of the GAS and GBS proteins is shown below.

```
Identities = 186/244 (76%), Positives = 212/244 (86%)
Query:   1   MFYTYLRTLVMFLIWVANGNAHYHNEDKMLKDDENYILVAPHRTFWDPVYMAFAARPKQF    60
             +FY YLR LV+FL+WV NGNAHYH+E+KML   ENYILVAPHRTFWDPVYMAFAARPKQF
Sbjct:  27   VFYAYLRGLVVFLLWVVNGNAHYHHEEKMLDASENYILVAPHRTFWDPVYMAFAARPKQF    86
```

-continued

```
Query:  61  IFMAKKELFTNRLFGWWIKMCGAFPIDREKPGQDAIRYPVKMLKNSNRSLVMFPSGSRHS  120
            IFMAKKELF NRLF WWIKMCGAFPIDR+KP  DAIRYPV MLK SNRSL+MFPSGSRHS
Sbjct:  87  IFMAKKELFANRLFAWWIKMCGAFPIDRDKPSPDAIRYPVNMLKKSNRSLLMFPSGSRHS  146

Query: 121  KDVKGGVAVIAKMAKVRIMPAAYRGPMVFKNLLKGHRVDMNFGNPIDVSDIKRMDAEGIA  180
            ++VKGGVAVIAK+AKV+IMPAAY+GPM  K LL G RVDM FGNPIDVSDIKRM+ EGIA
Sbjct: 147  QEVKGGVAVIAKLAKVKIMPAAYQGPMSVKGLLAGERVDMTFGNPIDVSDIKRMNDEGIA  206

Query: 181  EVSRRIQEEFDRLDRENETYDDGKKLNPLTYIYRLPLAIIAIVLLVLTLIFSYLASFVWD  240
            EV+ RIQ EFDR+D E   +  GK  NPLTY+YRLPL ++ +V+L+LT++FSY+ASFVW+
Sbjct: 207  EVANRIQAEFDRIDDELAPFQPGKARNPLTYLYRLPLGLVLVVVLLLTMLFSYIASFVWN  266

Query: 241  PQKH                                                         244
            P KH
Sbjct: 267  PDKH                                                         270
```

SEQ ID 6720 (GBS171) was expressed in *E. coli* as a His-fusion product. SDS-PAGE analysis of total cell extract is shown in FIG. 36 (lane 2; MW 25 kDa). It was also expressed in *E. coli* as a GST-fusion product. SDS-PAGE analysis of total cell extract is shown in FIG. 41 (lane 3; MW 49.8 kDa).

Based on this analysis, it was predicted that these proteins and their epitopes could be useful antigens for vaccines or diagnostics.

Example 2176

A DNA sequence (GBSx2293) was identified in *S. agalactiae* <SEQ ID 6723> which encodes the amino acid sequence <SEQ ID 6724>. Analysis of this protein sequence reveals the following:

Possible site: 48
>>> Seems to have no N-terminal signal sequence
----- Final Results -----
   bacterial cytoplasm --- Certainty = 0.3268 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

A related DNA sequence was identified in *S. pyogenes* <SEQ ID 6725> which encodes the amino acid sequence <SEQ ID 6726>. Analysis of this protein sequence reveals the following:

Possible site: 48
>>> Seems to have no N-terminal signal sequence
----- Final Results -----
   bacterial cytoplasm --- Certainty = 0.2183 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
>GP:CAB11810 GB:Z99104 similar to hypothetical proteins [Bacillus subtilis]

Identities = 113/244 (46%), Positives = 173/244 (70%), Gaps = 2/244 (0%)
Query:   6  LKENERIDQLFSTDVKIIQNKEVFSYSIDSVLLSRFPKLP-SRGLIVDLCSGNGAVGLFA   64
            L ++ER+D L + D+KIIQ+  VF++S+D+VLLS+F  +P   +G IVDLC+GNG V L
Sbjct:   4  LHDDERLDYLLAEDMKIIQSPTVFAFSLDAVLLSKFAYVPIQKGKIVDLCTGNGIVPLLL   63

Query:  65  STKTNATIIEIELQESLADMAKRSIKLNKLEKQVTMINDDLKNLLDHVQRSNVDLMLCNP  124
            ST++  A I+ +E+QE L DMA RS++ NKL+ Q+ +I+DDLKN+ +   +   D++ CNP
Sbjct:  64  STRSKADILGVEIQERLHDMAVRSVEYNKLDDQIQIIHDDLKNMPEKLGHNRYDVVTCNP  123

Query: 125  PYFKASETSKKNLSPHYLLARHEITTNLREICQIAQHALKTKGRIAMVHRPDRFLEIIDT  184
            PYFK  + +++N++ H  +ARHEI   L ++   ++    LK  G+ A+VHRP R LEI +
Sbjct: 124  PYFKTPKQTEQNMNEHLRIARHEIHCTLEDVISVSSKLLKQGGKAALVHRPGRLLEIFEL  183

Query: 185  MRQFNLAPKRIQFVYPKLGKDANMLLIEAIKDGSTEGMKILPPLVVHQDNGDYTETIFDI  244
            M+ + + PKR+QFVYPK GK+AN +L+E IK G   + +KILPPL V+ +  +YT+ I   I
Sbjct: 184  MKAYQIEPKRVQFVYPKQGKEANTILVEGIKGGRPD-LKILPPLFVYDEQNEYTKEIRTI  242

Query: 245  YFGE                                                         248
            +G+
Sbjct: 243  LYGD                                                         246
```

```
Identities = 200/257 (77%), Positives = 228/257 (87%), Gaps = 3/257 (1%)
Query:   1   MIDTILKENERIDQLFSTDVKIIQNKEVFSYSIDSVLLSRFPKLPSRGLIVDLCSGNGAV    60
             MI  ILKE ERIDQLFS+DV IIQNK+VFSYSIDSVLLSRFPK+PS+GLIVDLCSGNGAV
Sbjct:   1   MIKAILKEGERIDQLFSSDVGIIQNKDVFSYSIDSVLLSRFPKMPSKGLIVDLCSGNGAV    60

Query:  61   GLFASTKTNATIIEIELQESLADMAKRSIKLNKLEKQVTMINDDLKNLLDHVQRSNVDLM   120
             GLFAST+T A I+E+ELQE LADM +RSI+LN+LE QVTMI DDLKNLL+HV RS VDLM
Sbjct:  61   GLFASTRTKAAIVEVELQERLADMGQRSIQLNQLEDQVTMICDDLKNLLNHVPRSGVDLM   120

Query: 121   LCNPPYFKASETSKKNLSPHYLLARHEITTNLREICQIAQHALKTKGRIAMVHRPDRFLE   180
             LCNPPYFK+ E+SKKN+S HYLLARHE+TTNL EICQ+A+HALK+ GR+AMVHRPDRFLE
Sbjct: 121   LCNPPYFKSHESSKKNVSEHYLLARHEVTTNLEEICQVARHALKSNGRLAMVHRPDRFLE   180

Query: 181   IIDTMRQFNLAPKRIQFVYPKLGKDANMLLIEAIKDGSTEGMKILPPLVVHQDNGDYTET   240
             IID++R   LAPKR+QFVYPKLGK ANMLLIEAIKDGS EGM ILPPLVVH++NG+YT+
Sbjct: 181   IIDSLRANGLAPKRVQFVYPKLGKSANMLLIEAIKDGSIEGMTILPPLVVHKENGEYTDH   240

Query: 241   IFDIYFGENGK---SHD                                             254
             IF+IYFG   K   +HD
Sbjct: 241   IFEIYFGAASKGKPNHD                                             257
```

Based on this analysis, it was predicted that these proteins and their epitopes could be useful antigens for vaccines or diagnostics.

Example 2177

A DNA sequence (GBSx2294) was identified in *S. agalactiae* <SEQ ID 6727> which encodes the amino acid sequence <SEQ ID 6728>. Analysis of this protein sequence reveals the following:

Possible site: 55
>>> Seems to have no N-terminal signal sequence
----- Final Results -----
   bacterial cytoplasm --- Certainty = 0.1512 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

A related DNA sequence was identified in *S. pyogenes* <SEQ ID 6729> which encodes the amino acid sequence <SEQ ID 6730>. Analysis of this protein sequence reveals the following:

Possible site: 61
>>> Seems to have no N-terminal signal sequence
----- Final Results -----
   bacterial cytoplasm --- Certainty = 0.1838 (Affirmative) <succ>
   bacterial membrane --- Certainty = 0.0000 (Not Clear) <succ>
   bacterial outside --- Certainty = 0.0000 (Not Clear) <succ>

```
>GP:CAB11811 GB:Z99104 similar to hypothetical proteins [Bacillus subtilis]
Identities = 40/82 (48%), Positives = 63/82 (76%)
Query:   7   YMYVLECSDGTLYTGYTTDVKRRLNTHNTGKGAKYTRARLPVKLLYSEAFNSKQEAMRAE    66
             + YV++C D + Y GYT D+ +R+ THN GKGAKYT+ R PV+L+++E+F++K+EAM+AE
Sbjct:   7   FFYVVKCKDNSWYAGYTNDLHKRVKTHNDGKGAKYTKVRRPVELIFAESFSTKREAMQAE    66

Query:  67   ALFKQKTRQAKLTYIKQHKNEQ                                         88
                FK+ TR+ K  YI++ +N +
Sbjct:  67   YYFKKLTRKKKELYIEEKRNSK                                         88
```

An alignment of the GAS and GBS proteins is shown below.

```
Identities = 60/84 (71%), Positives = 67/84 (79%), Gaps = 1/84 (1%)
Query:   6   AYMYVLECSDGTLYTGYTTDVKRRLNTHNTGKGAKYTRARLPVKLLYSEAFNSKQEAMRA    65
             AYMYVLEC D TLYTGYTTD+K+RL THN GKGAKYTR RLPV LLY E F+SK+ AM A
Sbjct:   6   AYMYVLECVDKTLYTGYTTDLKKRLATHNAGKGAKYTRYRLPVSLLYYEVFDSKEAAMSA    65

Query:  66   EALF-KQKTRQAKLTYIKQHKNEQ                                       88
             EALF K+KTR  KL YI  H+ E+
Sbjct:  66   EALFKKRKTRSQKLAYIATHQKEK                                       89
```

Based on this analysis, it was predicted that these proteins and their epitopes could be useful antigens for vaccines or diagnostics.

Example 2178

A DNA sequence (GBSx2295) was identified in *S. agalactiae* <SEQ ID 6731> which encodes the amino acid sequence <SEQ ID 6732>. This protein is predicted to be autoaggregation-mediating protein (deaD). Analysis of this protein sequence reveals the following:

---
Possible site: 56
>>> Seems to have no N-terminal signal sequence
----- Final Results -----
   bacterial cytoplasm --- Certainty = 0.2287 (Affirmative) <succ>
   bacterial membrane --- Certainty = 0.0000 (Not Clear) <succ>
   bacterial outside --- Certainty = 0.0000 (Not Clear) <succ>
---

The protein has homology with the following sequences in the GENPEPT database.

A related DNA sequence was identified in *S. pyogenes* <SEQ ID 6733> which encodes the amino acid sequence <SEQ ID 6734>. Analysis of this protein sequence reveals the following:

---
Possible site: 56
>>> Seems to have no N-terminal signal sequence
----- Final Results -----
   bacterial cytoplasm --- Certainty = 0.1108 (Affirmative) <succ>
   bacterial membrane --- Certainty = 0.0000 (Not Clear) <succ>
   bacterial outside --- Certainty = 0.0000 (Not Clear) <succ>
---

```
>GP:AAD20136 GB:AF091502 autoaggregation-mediating protein
[Lactobacillus reuteri]
Identities = 289/504 (57%), Positives = 366/504 (72%), Gaps = 18/504 (3%)
Query: 1     MKFTELNLSQDILSAVEKAGFVEPSPIQEMTIPLALEGKDVIGQAQTGTGKTAAFGLPTL   60
             MKF+EL LS  +L A++++G+ E +PIQE TIP+ LEGKDVIGQAQTGTGKTAAFGLP +
Sbjct: 1     MKFSELGLSDSLLKAIKRSGYEEATPIQEQTIPMVLEGKDVIGQAQTGTGKTAAFGLPII   60

Query: 61    NKIHTEDNTIQALIIAPTRELAVQSQEELFRFGRDKGVKVRSVYGGSSIEKQIKALRSGA   120
              + TE+   IQA+II+PTRELA+Q+QEEL+R G+DK V+V+ VYGG+ I +QIK+L+
Sbjct: 61    ENVDTENPNIQAIIISPTRELAIQTQEELYRLGKDKHVRVQVVYGGADIRRQIKSLKQHP   120

Query: 121   HVVVGTPGRLLDLIKRKALKLNHIETLILDEADEMLNMGFLEDIEAIISRVPETRQTLLF   180
              ++VGTPGRL D I R  +KL+HI+TL+LDEADEMLNMGFLEDIE +II    P+ RQTLLF
Sbjct: 121   QILVGTPGRLRDHINRHTVKLDHIKTLVLDEADEMLNMGFLEDIESIIKETPDDRQTLLF   180

Query: 181   SATMPDPIKRIGVKFMKDPEHVKIKATELTNVNVDQYYVRVKENEKFDTMTRLMDVDQPE   240
             SATMP  IKRIGV+FM DPE V+IKA ELT   VDQYYVR ++ EKFD MTRL+DV  P+
Sbjct: 181   SATMPPEIKRIGVQFMSDPETVRIKAKELTTDLVDQYYVRARDYEKFDIMTRLIDVQDPD   240

Query: 241   LSIVFGRTKRRVDELTRGLKLRGFRAEGIHGDLDQNKRLRVIRDFKNDHIDILVATDVAA   300
             L+IVFGRTKRRVDEL++GL  RG+ A GIHGDL Q+KR +++  FKN+ +DILVATDVAA
Sbjct: 241   LTIVFGRTKRRVDELSKGLIARGYNAAGIHGDLTQDKRSKIMWKFKNNELDILVATDVAA   300

Query: 301   RGLDISGVTHVYNYDIPQDPESYVHRIGRTGRAGKSGQSITFVSPNEMGYLTIIENLTKK   360
             RGLDISGVTHVYNYDIP DP+SYVHRIGRTGRAG  G S+TFV+PNEM YL  IE LT+
Sbjct: 301   RGLDISGVTHVYNYDIPSDPDSYVHRIGRTGRAGHHGVSLTFVTPNEMDYLHEIEKLTRV   360

Query: 361   RMTGMKPATASEAFQAKKKVALKRIARDFED-QELVSK--FDKFKADALELATQYTPEEL   417
             RM +KP TA EAF+         ++A  F D  EL+++   D+++  A +L  +   +L
Sbjct: 361   RMLPLKPPTAEEAFKG-------QVASAFNDIDELIAQDSTDRYEEAAEKLLETHNATDL   413

Query: 418   ALYVLSLTVQDPESLPEVEITREKPLPFKPSGGGFKGKGGRGNGRGGD--RRRNDRGDRR   475
              +L+   ++  S   V+IT E+PLP +          G R N  GG+  RR+N R  +
Sbjct: 414   VAALLNNMTKEAASEVPVKITPERPLPRRNKRN--NRNGNRNNSHGGNHYRRKNFRRHQH   471

Query: 476   GNRDRDDRG----SRCDFKRRDDK                                     495
             G+    D+ G    SR  F  R K
Sbjct: 472   GSHRNDNHGKSHSSRHSFNIRHRK                                     495
```

An alignment of the GAS and GBS proteins is shown below.

```
Identities = 430/545 (78%), Positives = 463/545 (84%), Gaps = 24/545 (4%)
Query: 1     MKFTELNLSQDILSAVEKAGFVEPSPIQEMTIPLALEGKDVIGQAQTGTGKTAAFGLPTL   60
             +KFTE NLSQDI SAV  AGF + SPIQEMTIPLALEGKDVIGQAQTGTGKTAAFGLPTL
Sbjct: 1     LKFTEFNLSQDIQSAVVTAGFEKASPIQEMTIPLALEGKDVIGQAQTGTGKTAAFGLPTL   60

Query: 61    NKIHTEDNTIQALIIAPTRELAVQSQEELFRFGRDKGVKVRSVYGGSSIEKQIKALRSGA   120
```

-continued

```
             NKI T +N IQAL+IAPTRELAVQSQEELFRFGR+KGVKVRSVYGGSSIEKQIKAL+SGA
Sbjct:  61   NKIRTNENIIQALVIAPTRELAVQSQEELFRFGREKGVKVRSVYGGSSIEKQIKALKSGA  120

Query: 121   HVVVGTPGRLLDLIKRKALKLNHIETLILDEADEMLNMGFLEDIEAIISRVPETRQTLLF  180
             H+VVGTPGRLLDLIKRKAL L+H+ETLILDEADEMLNMGFLEDIEAIISRVP  RQTLLF
Sbjct: 121   HIVVGTPGRLLDLIKRKALILDHVETLILDEADEMLNMGFLEDIEAIISRVPADRQTLLF  180

Query: 181   SATMPDPIKRIGVKFMKDPEHVKIKATELTNVNVDQYYVRVKENEKFDTMTRLMDVDQPE  240
             SATMP PIK+IGVKFMKDPEHV+IK  ELTNVNVDQYYVRVKE EKFDTMTRLMDV+QPE
Sbjct: 181   SATMPAPIKQIGVKFMKDPEHVQIKNKELTNVNVDQYYVRVKEQEKFDTMTRLMDVNQPE  240

Query: 241   LSIVFGRTKRRVDELTRGLKLRGFRAEGIHGDLDQNKRLRVIRDFKNDHIDILVATDVAA  300
             LSIVFGRTKRRVDE+TRGLKLRGFRAEGIHGDLDQNKRLRVIRDFKND IDILVATDVAA
Sbjct: 241   LSIVFGRTKRRVDEITRGLKLRGFRAEGIHGDLDQNKRLRVIRDFKNDQIDILVATDVAA  300

Query: 301   RGLDISGVTHVYNYDIPQDPESYVHRIGRTGRAGKSGQSITFVSPNEMGYLTIIENLTKK  360
             RGLDISGVTHVYNYDI QDPESYVHRIGRTGRAGKSG+SITFVSPNEMGYL++IENLTKK
Sbjct: 301   RGLDISGVTHVYNYDITQDPESYVHRIGRTGRAGKSGESITFVSPNEMGYLSMIENLTKK  360

Query: 361   RMTGMKPATASEAFQAKKKVALKRIARDFEDQELVSKFDKFKADALELATQYTPEELALY  420
             +M  ++PATA EAFQAKKKVALK+I RDF D+ + S FDKFK DA++LA ++TPEELALY
Sbjct: 361   QMKPLRPATAEEAFQAKKKVALKKIERDFADETIRSNFDKFKGDAVQLAAEFTPEELALY  420

Query: 421   VLSLTVQDPESLPEVEITREKPLPFKPSGGGF---KGKGGRG--NGRGGDRRRNDRGDR-  474
             +LSLTVQDP+SLPEVEI REKPLPFK  GGG    GKGGRG N   GDRR    RGDR
Sbjct: 421   ILSLTVQDPDSLPEVEIAREKPLPFKYVGGGHGNKNGKGGRGRDNRNRGDRRGYRGDRN  480

Query: 475   ------------RGNRDRDDRGSRCDFKRRDDKFKKDNRRQENKKPHKNTSSEKQTGFVI  522
                         R  RD  D    DFKR+ +  KD   +E K    SS K TGFVI
Sbjct: 481   RDERDGDRRRQKRDKRDGHDGSGNRDFKRKSKRNSKDFFNKEKK------SSAKNTGFVI  534

Query: 523   RNKGD  527
             R+KG+
Sbjct: 535   RHKGE  539
```

A related GBS gene <SEQ ID 8991> and protein <SEQ ID 8992> were also identified. Analysis of this protein sequence reveals the following:

RGD motif 471-473

The protein has homology with the following sequences in the databases:

---

```
58.9/74.7% over 494aa
Lactobacillus reuteri
GP|4409804| autoaggregation-mediating protein Insert characterized
ORF01926(301-1785 of 2184)
GP|4409804|gb|AAD20136.1||AF091502(1-495 of 497) autoaggregation-mediating protein
{Lactobacillus reuteri}
% Match = 37.3
% Identity = 58.8 % Similarity = 74.6
Matches = 290 Mismatches = 118 Conservative Sub.s = 78

42         72         102        132        162        192        222        252
IRHYITKEIPSEAAVAF*IDKL*TLLLYRWWVFIAFFLFSEATNRTSNL*KRVIY*IDLILYLFTFNCVTLSRLSEKITN 282        312        342        372        402        432        462        492
KGS*GSFALSFRKEKHLKFTELNLSQDILSAVEKAGFVEPSPIQEMTIPLALEGKDVIGQAQTGTGKTAAFGLPTLNKIH
                 :||:||  ||  :| |::::|:  |  |:||| |||:  |||||||||||||||||||||  :  :
                 MKFSELGLSDSLLKAIKRSGYEEATPIQEQTIPMVLEGKDVIGQAQTGTGKTAAFGLPIIENVD
                    10         20         30         40         50         60

522        552        582        612        642        672        702        732
TEDNTIQALIIAPTRELAVQSQEELFRFGRDKGVKVRSVYGGSSIEKQIKALRSGAHVVVGTPGRLLDLIKRKALKLNHI
||:   |||:||||||||| |||||:|||:||||:|||| ||||  |  |||:|:       :::|||||| | |  :||:||
TENPNIQAIIISPTRELAIQTEELYRLGKDKHVRVQVVYGGADIRRQIKSLKQHPQILVGTPGRLRDHINRHTVKLDHI
             80         90         100        110        120        130        140

762        792        822        852        882        912        942        972
ETLILDEADEMLNMGFLEDIEAIISRVPETRQTLLFSATMPDPIKRIGVKFMKDPEHVKIKATELTNVNVDQYYVRVKEN
:||:|||||||||||||||||:||   |:   |||||||||:||  ||||||:|| |||   |:|||   ||||||  ::
KTLVLDEADEMLNMGFLEDIESIIKETPDDRQTLLFSATMPPEIKRIGVQFMSDPETVRIKAKELTTDLVDQYYVRARDY
            160        170        180        190        200        210        220
```

-continued

```
      1002      1032      1062      1092      1122      1152      1182      1212
EKFDTMTRLMDVDQPELSIVFGRTKRRVDELTRGLKLRGFRAEGIHGDLDQNKRLRVIRDFKNDHIDILVATDVAARGLD
||||  ||||:||   |:|:|||||||||||||::||   ||:  ||||||  |:||  :::    |||:  :||||||||||||||||
EKFDIMTRLIDVQDPDLTIVFGRTKRRVDELSKGLIARGYNAAGIHGDLTQDKRSKIMWKFKNNELDILVATDVAARGLD
           240       250       260       270       280       290       300

1242      1272      1302      1332      1362      1392      1422      1452
ISGVTHVYNYDIPQDPESYVHRIGRTGRAGKSGQSITFVSPNEMGYLTIIENLTKKRMTGMKPATASEAFQAKKKVALKR
||||||||||||||  ||:|||:|||||  |  ||:|||:||||||  ||  ||:   :|| ||| |  | :||    |
ISGVTHVYNYDIPSDPDSYVHRIGRTGRAGHHGVSLTFVTPNEMDYLHEIEKLTRVRMLPLKPPTAWWAF--KGQVA---
           320       330       340       350       360       370

1479      1503      1533      1563      1593      1623      1653      1683
IARDFED-QELVSK--FDKFKADALELATQYTPEELALYVLSLTVQDPESLPEVEITREKPLPFKPSGGGFKGKGGRGNG
  |  |  ||:::    |:::    |:|     :    :|    ::  |     |:||  |:|||  :      |   ||
--SAFNDIDELIAQDSTDRYEEAAEKLLETHNATDLVAALLNNMTKEAASEVPVKITPERPLPRRNKRNNRNGN--RNNS
           390       400       410       420       430       440       450

1707      1737      1755      1785      1815      1845      1875      1905
RGGD--RRRNDRGDRRGNRDRDDRG----SRCDFKRRDDKFKKDNRRQENKKPHKNTSSEKQTGFVIRNKGDK*EDYEKG
  ||:   ||:|  |   :|:    |:|    ||    |    |
HGGNHYRRKNFRRHQHGSHRNDNHGKSHSSRHSFNIRHRKEN
           470       480       490
```

There is also homology to SEQ ID 4454.

SEQ ID 8992 (GBS307) was expressed in *E. coli* as a His-fusion product. SDS-PAGE analysis of total cell extract is shown in FIG. 56 (lane 7; MW 62 kDa). It was also expressed in *E. coli* as a GST-fusion product. SDS-PAGE analysis of total cell extract is shown in FIG. 61 (lane 2; MW 86.7 kDa).

Figure 272:
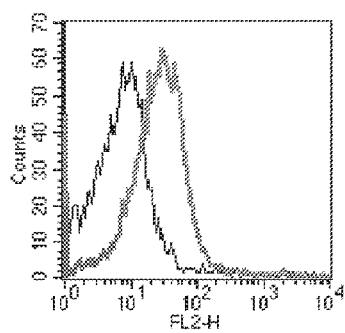

The GBS307-GST fusion product was purified (FIG. 208, lane 9; FIG. 225, lane 10-11) and used to immunise mice. The resulting antiserum was used for FACS (FIG. 272), which confirmed that the protein is immunoaccessible on GBS bacteria.

Possible site: 19
>>> May be a lipoprotein
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:CAB73036 GB:AL139076 putative periplasmic protein [Campylobacter
jejuni]
Identities = 89/237 (37%), Positives = 132/237 (55%), Gaps = 3/237 (1%)
Query:  40  ITVATYSKPTSTFLDLVKDNVKEKGYTLKVVMVSDYIQANIALENKEHDANLLQHEFFMS   99
            IT+      P  + L+L+KD+ K KGY LK+V  SDYI  N ALE KE DANL QH+ F+
Sbjct:  23  ITIGATPNPFGSLLELMKDDFKNKGYELKIVEFSDYILPNRALEEKELDANLYQHKPFLE   82

Query: 100  IFNKENDGHLVSITPIYHSLAGFYGQHLKNIAELKDGAKVAIPSDPANMTRALLLLQEKK  159
            +N +    +L++ TP+   G Y + +KN+  LK+GA+VAIP+D  N +RAL LL++ K
Sbjct:  83  EYNLKKGSNLIATTPVLIAPVGVYSKKIKNLENLKEGARVAIPNDATNESRALELLEKAK  142

Query: 160  LITLKNTSKKTKAIEDIITNPKKLRIEPVALLNLNQAYFEYDLVFNFPGYVTKINLVPKR  219
            LI L   + KT    DI NPKKL+       L +A  + D+         L P +
Sbjct: 143  LIELNKNTLKTPL--DINKNPKKLKFIELKAAQLPRALDDVDIAIINSNFALGAGLNPSK  200

Query: 220  DRLLYEKKPDIRFAGALVAREDNKNSDKIKVLKEVLTSKEIRHYITKEIPSEAAVAF     276
            D +  E K +   +   +V R + KNS+K KV+ E+L S ++   I +         AF
Sbjct: 201  DTIFREDK-NSPYVNYVVVRSEGKNSEKTKVIDEILRSDKFKAIINEHYKDILIPAF     256
```

Based on this analysis, it was predicted that these proteins and their epitopes could be useful antigens for vaccines or diagnostics.

Example 2179

A DNA sequence (GBSx2296) was identified in *S. agalactiae* <SEQ ID 6735> which encodes the amino acid sequence <SEQ ID 6736>. This protein is predicted to be outer membrane protein (yaeC). Analysis of this protein sequence reveals the following:

SEQ ID 6736 (GBS126) was expressed in *E. coli* as a His-fusion product. SDS-PAGE analysis of total cell extract is shown in FIG. 34 (lane 7; MW 32 kDa).

Based on this analysis, it was predicted that this protein and its epitopes, could be useful antigens for vaccines or diagnostics.

Example 2180

A DNA sequence (GBSx2297) was identified in *S. agalactiae* <SEQ ID 6737> which encodes the amino acid sequence <SEQ ID 6738>. This protein is predicted to be probable permease of ABC transporter. Analysis of this protein sequence reveals the following:

```
Possible site: 34
>>> Seems to have no N-terminal signal sequence
INTEGRAL   Likelihood = −11.99   Transmembrane 190-206 (187-215)
INTEGRAL   Likelihood = −8.44    Transmembrane 25-41 (16-45)
INTEGRAL   Likelihood = −6.48    Transmembrane 69-85 (68-90)
INTEGRAL   Likelihood = −3.77    Transmembrane 90-106 (88-109)
INTEGRAL   Likelihood = −1.44    Transmembrane 145-161 (145-161)
----- Final Results -----
   bacterial membrane --- Certainty = 0.5798 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the GENPEPT database.

```
>GP:AAG08889 GB:AE004963 probable permease of ABC transporter
[Pseudomonas aeruginosa]
Identities = 80/206 (38%), Positives = 127/206 (60%), Gaps = 4/206 (1%)
Query:  15   SFWETNLMLGLTLILCFLIAFPTGILLFSLRKSYLIKHSLAYQLLNLFLGTLRSVPFLIF   74
             +FW     MLG +L+   ++  P G+LLF       + +    Y LL+L +  LRS+PF+I
Sbjct:  24   TFW----MLGGSLLFTVVLGLPLGVLLFLTGPRQMFEQKAVYTLLSLVVNILRSLPFIIL   79

Query:  75   IFILIPLNRLIFGTSFGTIAAILPLTLVSVSLYARYVEQALLNIPQVVVDRALSLGANKR  134
             + ++IPL   LI GTS G   AI PL + +   +AR VE AL  + + +++    ++GA+ R
Sbjct:  80   LIVMIPLTVLITGTSLGVAGAIPPLVVGATPFFARLVETALREVDKGIIEATQAMGASTR  139

Query: 135   QIIYYFLIPSIKIDLVLSFTATAISILGYSTIMGVIGAGGLGEYAYRFGYQEYDYPVMYL  194
             QII+  L+P  +  ++ + T TAI+++ Y+ + GV+GAGGLG+ A RFGYQ +    VM +
Sbjct: 140   QIIWNALLPEARPGIIAAITVTAITLVSYTAMAGVVGAGGLGDLAIRFGYQRFQTDVMVV  199

Query: 195   IVVLFIIYVFILQSLGYFIANRYSRK                                   220
             VV+ +I V ILQ++G +   +SRK
Sbjct: 200   TVVMLLILVQILQTVGDKLVVHFSRK                                   225
```

Based on this analysis, it was predicted that this protein and its epitopes, could be useful antigens for vaccines or diagnostics.

Example 2181

A DNA sequence (GBSx2298) was identified in *S. agalactiae* <SEQ ID 6739> which encodes the amino acid sequence <SEQ ID 6740>. This protein is predicted to be ABC transporter, ATP-binding protein (oppF). Analysis of this protein sequence reveals the following:

```
Possible site: 48
>>> Seems to have no N-terminal signal sequence
----- Final Results -----
   bacterial cytoplasm --- Certainty = 0.5454 (Affirmative) <succ>
     bacterial membrane --- Certainty = 0.0000 (Not Clear) <succ>
       bacterial outside --- Certainty = 0.0000 (Not Clear) <succ>
```

A related GBS nucleic acid sequence <SEQ ID 9333> which encodes amino acid sequence <SEQ ID 9334> was also identified.

The protein has homology with the following sequences in the GENPEPT database.

```
>GP:AAC22280 GB:U32744 ABC transporter, ATP-binding protein
[Haemophilus influenzae Rd]
Identities = 62/174 (35%), Positives = 104/174 (59%), Gaps = 2/174 (1%)
Query:   1   MKMINGLIPYDKGNIYYQGKEVKSFSDNKLRQMRKDIAYIFQNHNLLAGESVYYHLALVY   60
             ++ +N L    G++    G E+    SD +L   R+ I  IFQ+ NLL+  +V+ ++AL
Sbjct:  48   IRCVNLLEKPTSGSVIVDGVELTKLSDRELVLARRQIGMIFQHFNLLSSRTVFENVALPL  107

Query:  61   KLNHQKVN--HDAINDILDFLGLMDLKQVKCHSLSGGQQQKVAIAMAVLQKPKLILCDEI  118
             +L +        + I +LD +GL +   +     +LSGGQ+Q+VAIA A+    PK++LCDE
Sbjct: 108   ELESESKAKIQEKITALLDLVGLSEKRDAYPSNLSGGQKQRVAIARALASDPKVLLCDEA  167

Query: 119   SSALDTNSEKEIFNLLSDLREKYGISILMIAHHLSLLKQYCDRVMILDHQTIVD       172
             +SALD  + + I  LL ++      GI+IL+I H + ++KQ CD+V ++D    +V+
Sbjct: 168   TSALDPATTQSILKLLKEINRTLGITILLITHEMEVVKQICDQVAVIDQGRLVE       221
```

There is also homology to SEQ ID 76.

Based on this analysis, it was predicted that this protein and its epitopes, could be useful antigens for vaccines or diagnostics.

Example 2182

A DNA sequence (GBSx2299) was identified in *S. agalactiae* <SEQ ID 6741> which encodes the amino acid sequence <SEQ ID 6742>. Analysis of this protein sequence reveals the following:

```
Possible site: 21
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
       bacterial cytoplasm --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2183

A DNA sequence (GBSx2300) was identified in *S. agalactiae* <SEQ ID 6743> which encodes the amino acid sequence <SEQ ID 6744>. Analysis of this protein sequence reveals the following:

```
Possible site: 18
>>> Seems to have no N-terminal signal sequence
----- Final Results -----
    bacterial cytoplasm --- Certainty = 0.0904 (Affirmative) <succ>
    bacterial membrane --- Certainty = 0.0000 (Not Clear) <succ>
    bacterial outside --- Certainty = 0.0000 (Not Clear) <succ>
```

A related GBS nucleic acid sequence <SEQ ID 9741> which encodes amino acid sequence <SEQ ID 9742> was also identified.

The protein has homology with the following sequences in the GENPEPT database.

```
>GP:AAB87515 GB:AF034138 unknown [Bacillus subtilis]
Identities = 74/125 (59%), Positives = 92/125 (73%)
Query:    5 MGIFSGLMGNASQMDTDKVENQLSDILISDEQVDLAYTLIRDLIVFTNYRLILVDKQGVT  64
            MG   GL+GNAS +  T   V+ +L+  IL+   E+V+ A+ L+RDLIVFT+ RLILVDKQG+T
Sbjct:    1 MGFIDGLLGNASTLSTAAVQEELAHILLEGEKVEAAFKLVRDLIVFTDKRLILVDKQGIT  60

Query:   65 GKKVSYNSIPYASISRFTVETSGHFDLDAELKIWISSAIEPAEVLQFKNDRNIVSIQKAL 124
            GKK + SIPY SISRF+VET+G FDLD+ELKIWIS A  PA   QFK D +I  IQK L
Sbjct:   61 GKKTEFQSIPYKSISRFSVETAGRFDLDSELKIWISGAELPAVSKQFKKDESIYDIQKVL 120

Query:  125 ATAVL                                                        129
            A   +
Sbjct:  121 AAVCM                                                        125
```

No corresponding DNA sequence was identified in *S. pyogenes*.

Based on this analysis, it was predicted that this protein and its epitopes, could be useful antigens for vaccines or diagnostics.

Example 2184

A DNA sequence (GBSx2301) was identified in *S. agalactiae* <SEQ ID 6745> which encodes the amino acid sequence <SEQ ID 6746>. Analysis of this protein sequence reveals the following:

```
Possible site: 59
>>> Seems to have no N-terminal signal sequence
----- Final Results -----
    bacterial cytoplasm --- Certainty = 0.0921 (Affirmative) <succ>
    bacterial membrane --- Certainty = 0.0000 (Not Clear) <succ>
    bacterial outside --- Certainty = 0.0000 (Not Clear) <succ>
```

A related GBS nucleic acid sequence <SEQ ID 9331> which encodes amino acid sequence <SEQ ID 9332> was also identified.

The protein has homology with the following sequences in the GENPEPT database.

```
>GP:CAA74739 GB:Y14370 peptide chain release factor 3
[Staphylococcus aureus]
Identities = 274/462 (59%), Positives = 349/462 (75%), Gaps = 9/462 (1%)
Query:    1 MDIEKQRGISVTSSVMQFDYAGKRVNILDTPGHEDFSEDTYRTLMAVDAAVMVVDSAKGI  60
            M +E++RGISVTSSVMQFDY     +NILDTPGHEDFSEDTYRTLMAVD+AVMV+D AKG+
Sbjct:   57 MKVEQERGISVTSSVMQFDYDDYEINILDTPGHEDFSEDTYRTLMAVDSAVMVIDCAKGV 116
```

-continued

```
Query:  61 EAQTKKLFEVVKHRNIPVETFINKLDRDGREPLDLLEELEEVLGIASYPMNWPIGMGKSF 120
            E  T  KLF+V  K R  IP+FTFINKLDR G+EP +LL+E+EE L I +YPMNWPIGMG+SF
Sbjct: 117 EPPTLKLFKVCKMRGIPIFTFINKLDRVGKEPFELLDEIEETLNIETYPMNWPIGMGQSF 176

Query: 121 EGLYDLHNKRLELYKGDERFASIEDG-----DQLFANNPFYEQVKEDIELLQEAGNDFSE 175
            G+ D  +K +E ++ +E    + D       D    N+  +EQ  E++ L++EAG  F
Sbjct: 177 FGIIDRKSKTIEPFRDEENILHLNDDFELEEDHAITNDSDFEQAIEELMLVEEAGEAFDN 236

Query: 176 QAILDGDLTPVFFGSALTNFGVQTFLDTFLEFAPEPHGHKTTEGNVIDPLAKDFSGFVFK 235
             A+L GDLTPVFFGSAL NFGVQ FL+ +++FAP P+  +T E    + P    FSGF+FK
Sbjct: 237 DALLSGDLTPVFFGSALANFGVQNFLNAYVDFAPMPNARQTKENVEVSPFDDSFSGFIFK 296

Query: 236 IQANMDPRHRDRIAFVRIVSGEFERGMGVNLTRTGKGAKLSNVTQFMAES-RENVTNAVA 294
            IQANMDP+HRDRIAF+R+VSG FER + + L     +K S+V + + ++ ++ V +AVA
Sbjct: 297 IQANMDPKHRDRIAFMRVVSGAFER-VWMLLCNVLIKSKRSHVQRHLWQTIKKLVNHAVA 355

Query: 295 GDIIGVYDTGTYQVGDTLTVGKNKFEFEPLPTFTPELFMKVSAKNVMKQKSFHKGIEQLV 354
            GDIIG+YDTG YQ+GDTL  GK  + F+ LP FTPE+FMKVSAKNVMKQ HFHKGIEQLV
Sbjct: 356 GDIIGLYDTGNYQIGDTLVGGKQTYSFQDLPQFTPEIFMKVSAKNVMKQKHFHKGIEQLV 415

Query: 355 QEGAIQLYKNYQTGEYMLGAVGQLQFEVFKHRMEGEYNAEVVMTPMGKKTVRW--INSDD 412
            QEGAIQ  YK    T + +LGAVGQLQFEVF+HRM+ EYN +VVM P+G+K  RW    N D
Sbjct: 416 QEGAIQYYKTLHTNQIILGAVGQLQFEVFEHRMKNEYNVDVVMEPVGRKIARWDIENEDQ 475

Query: 413 LDERMSSRNILAKDRFDQPVFLFENDFALRWFADKYPDVKL              454
            + ++M++SR+IL KDR+D  VFLFEN+FA RWF +K+P++KL
Sbjct: 476 ITDKMNTSRSILVKDRYDDLVFLFENEFATRWFEEKFPEIKL              517
```

A related DNA sequence was identified in *S. pyogenes* <SEQ ID 6747> which encodes the amino acid sequence <SEQ ID 6748>. Analysis of this protein sequence reveals the following:

Possible site: 52
>>> Seems to have no N-terminal signal sequence

----- Final Results -----
bacterial cytoplasm --- Certainty = 0.2070 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 447/458 (97%), Positives = 455/458 (98%)
Query:   1 MDIEKQRGISVTSSVMQFDYAGKRVNILDTPGHEDFSEDTYRTLMAVDAAVMVVDSAKGI  60
           MDIEKQRGISVTSSVMQFDYAGKRVNILDTPGHEDFSEDTYRTLMAVDAAVMVVDSAKGI
Sbjct:  57 MDIEKQRGISVTSSVMQFDYAGKRVNILDTPGHEDFSEDTYRTLMAVDAAVMVVDSAKGI 116

Query:  61 EAQTKKLFEVVEHRNIPVFTFINKLDRDGREPLDLLEELEEVLGIASYPMNWPIGMGKSF 120
           EAQTKKLFEVVKHRNIPVFTFINKLDRDGREPL+LLEELEEVLGIASYPMNWPIGMG++F
Sbjct: 117 EAQTKKLFEVVYHRNIPVFTFINKLDRDGREPLELLEELEEVLGIASYPMNWPIGMGRAF 176

Query: 121 EGLYDLHNKRLELYKGDERFASIEDGDQLFANNPFYEQVKEDIELLQEAGNDFSEQAILD 180
           EGLYDLHNKRLELYKGDERFASIEDGDQLFANNPFYEQVKEDIELLQEAGNDFSEQAILD
Sbjct: 177 EGLYDLHNKRLELYKGDERFASIEDGDQLFANNPFYEQVKEDIELLQEAGNDFSEQAILD 236

Query: 181 GDLTPVFFGSALTNEGVQTFLDTFLEFAPEPHGHKTTEGNVIDPLAKDFSGFVFKIQANM 240
           GDLTPVF GSALTNEGVQTFLDTFLEFAPEPHGHKTTEGNV+DPLAKDFSGFVFKIQANM
Sbjct: 237 GDLTPVFEGSALTNEGVQTFLDTFLEFAPEPHGHKTTEGNVVDPLAKDFSGFVFKIQANM 296

Query: 241 DPRHRDRIAFVRIVSGEFERGMGVNLTRTGKGAKLSNVTQFMAESRENVINAVAGDIIGV 300
           DP+HRDRIAFVRIVSGEFERGMGVNLTRTGKGAKLSNVTQFMAESRENVTNAVAGDIIGV
Sbjct: 297 DPKHRDRIAFVRIVSGEFERGMGVNLTRTGKGAKLSNVTQFMAESRENVTNAVAGDIIGV 356

Query: 301 YDTGTYQVGDTLTVGKNKFEFEPLPTFTPELFMKVSAKNVMKQKSFHKGIEQLVQEGAIQ 360
           YDTGTYQVGDTLTVGKNKFEFEPLPTFTPE+FMKVS KNVMKQKSFHKGIEQLVQEGAIQ
Sbjct: 357 YDTGTYQVGDTLTVGKNKFEFEPLPTFTPEIFMKVSPKNVMKQKSFHKGIEQLVQEGAIQ 416

Query: 361 LYKNYQTGEYMLGAVGQLQFEVFKHRMEGEYNAEVVMTPMGKKTVRWINSDDLDERMSSS 420
           LYKNYQTGEYMLGAVGQLQFEVFKHRMEGEYNAEVVMTPMGKKTVRWI+ DDLD+RMSSS
Sbjct: 417 LYKNYQTGEYMLGAVGQLQFEVFKHRMEGEYNAEVVMTPMGKKTVRWISEDDLDQRMSSS 476

Query: 421 RNILAKDREDQPVFLFENDFALRWFADICYPDVKLEEKM                     458
           RNILAKDREDQPVFLFENDFALRWFADICYPDV LEEKM
Sbjct: 477 RNILAKDREDQPVFLFENDFALRWFADICYPDVTLEEKM                     514
```

Based on this analysis, it was predicted that these proteins and their epitopes could be useful antigens for vaccines or diagnostics.

Example 2185

A DNA sequence (GBSx2302) was identified in *S. agalactiae* <SEQ ID 6749> which encodes the amino acid sequence <SEQ ID 6750>. Analysis of this protein sequence reveals the following:

Possible site: 17
>>> Seems to have no N-terminal signal sequence
----- Final Results -----
    bacterial cytoplasm --- Certainty = 0.3061 (Affirmative) <succ>
    bacterial membrane --- Certainty = 0.0000 (Not Clear) <succ>
    bacterial outside --- Certainty = 0.0000 (Not Clear) <succ>

INTEGRAL  Likelihood = −15.39  Transmembrane 108-124 (100-131)
INTEGRAL  Likelihood = −8.92   Transmembrane 61-77 (52-82)
INTEGRAL  Likelihood = −5.36   Transmembrane 41-57 (40-60)
----- Final Results -----
    bacterial membrane --- Certainty = 0.7156 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:AAC38046 GB:AF000954 No definition line found [Streptococcus mutans]
Identities = 122/142 (85%), Positives = 138/142 (96%)
Query:    1 MLEFAAQKTGKENKEMAVTFVTNERSHELNLEYRDTDRPTDVISLEYKPEVDISFDEEDL  60
            +LEFAAQKTGKE+KEMAVTEVTNERSHELNL+YRDT+RPTDVISLEYKPE +SFDEEDL
Sbjct:   23 ILEFAAQKTGKEDKEMAVTFVTNERSHELNLKYRDINRPTDVISLEYKPESSLSFDEEDL  82

Query:   61 AENPELAEMLEDFDSYIGELFISIDKAKEQAEEYGHSYEREMGFLAVHGFLHINGYDHYT 120
            A++P+LAE+L +FD+YIGELFIS+DKA+EQA+EYGHS+EREMGFLAVHGFLHINGYDHYT
Sbjct:   83 ADDPDLAEVLTEFDAYIGELFISVDKAREQAQEYGHSFEREMGFLAVHGFLHINGYDHYT 142

Query:  121 PEEEKEMFSLQEEILTAYGLKR                                       142
            P+EEKEMFSLQEEIL AYGLKR
Sbjct:  143 PQEEKEMFSLQEEILDAYGLKR                                       164
```

```
>GP:AAC38047 GB:AF000954 diacyglycerol kinase [Streptococcus mutans]
Identities = 107/133 (80%), Positives = 121/133 (90%), Gaps = 2/133 (1%)
Query:    1 MDLNDN--NHKKWKNRTLTSSMEFAVTGIFTAFKEERNMRKHLVSAILVILAGLTFQVSM  58
            MDL DN  + KKWKNATLTSS+EFA+TGIFTAFKEERNM+KH VSA+L ++AGL F+VS+
Sbjct:    3 MDLRDNKQSQKKWKNRTLTSSLEFALTGIFTAFKEERNMKKHAVSALLAVIAGLVFKVSV  62

Query:   59 VEWLFLLLSIFLVITFEIINSAIENVVDLASNYHFSMLAKNAKDMAAGAVLVVSLFAVLV 118
            +EWLFLLLSIFLVITFEI+NSAIENVVDLAS+YHFSMLAKNAKDMAAGAVLV+S FA L
Sbjct:   63 IEWLFLLLSIFLVITFEIVNSAIENVVDLASDYHFSMLAKNAKDMAAGAVLVISGFAALT 122

Query:  119 GLIIFIPKILALL                                                131
            GLIIF+PKI  LL
Sbjct:  123 GLIIFVPKIWFLL                                                135
```

There is also homology to SEQ ID 120.

Based on this analysis, it was predicted that this protein and its epitopes, could be useful antigens for vaccines or diagnostics.

Example 2186

A DNA sequence (GBSx2303) was identified in *S. agalactiae* <SEQ ID 6751> which encodes the amino acid sequence <SEQ ID 6752>. Analysis of this protein sequence reveals the following:

Possible site: 59
>>> Seems to have no N-terminal signal sequence

A related DNA sequence was identified in *S. pyogenes* <SEQ ID 6753> which encodes the amino acid sequence <SEQ ID 6754>. Analysis of this protein sequence reveals the following:

Possible site: 34
>>> Seems to have no N-terminal signal sequence
INTEGRAL  Likelihood = −10.67  Transmembrane 63-79 (41-84)
INTEGRAL  Likelihood = −7.32   Transmembrane 110-126 (105-129)
INTEGRAL  Likelihood = −5.41   Transmembrane 43-59 (41-62)
----- Final Results -----
    bacterial membrane --- Certainty = 0.5267 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:AAC38047 GB:AF000954 diacyglycerol kinase [Streptococcus mutans]
Identities = 104/135 (77%), Positives = 119/135 (880)
Query:   1  MALHDNNTTKRKWKNRTITSSLEFALTGVFTAFKEERNLRSHLLSACLACVAGLFFSISA  60
            M L DN   +++KWKNRT+TSSLEFALTG+FTAFKEERN++ H +SA LA +AGL F +S
Sbjct:   3  MDLRDNKQSQKKWKNRTLTSSLEFALTGIFTAFKEERNMKKHAVSALLAVIAGLVFKVSV  62

Query:  61  IEWLFLLLAIFLVITLEIVNSAIENVVDLASDYHFSMLAKNAKDMAAGAVLMISGYAVLT  120
            IEWLFLLL+IFLVIT EIVNSAIENVVDLASDYHFSMLAKNAKDMAAGAVL+ISG+A LT
Sbjct:  63  IEWLFLLLSIFLVITFEIVNSAIENVVDLASDYHFSMLAKNAKDMAAGAVLVISGFAALT  122

Query: 121  GLIIFIPKIWNIFVH                                              135
            GLIIF+PKIW +  H
Sbjct: 123  GLIIFVPKIWFLLFH                                              137
```

An alignment of the GAS and GBS proteins is shown below.

```
Identities = 98/129 (75%), Positives = 115/129 (88%), Gaps = 2/129 (1%)
Query:    1MDLNDNN--HKKWKNRTLTSSMEFAVTGIFTAFKEERNMRKHLVSAILVILAGLTFQVSM  58
           M L+DNN   +KWKNRT+TSS+EFA+TG+FTAFKEERN+R HL+SA L  +AGL F +S
Sbjct:    1MALHDNNTTKRKWKNRTITSSLEFALTGVFTAFKEERNLRSHLLSACLACVAGLFFSISA  60

Query:   59VEWLFLLLSIFLVITFEIINSAIENVVDLASNYHFSMLAKNAKDMAAGAVLVVSLFAVLV  118
           +EWLFLLL+IFLVIT EI+NSAIENVVDLAS+YHFSMLAKNAKDMAAGAVL++S +AVL
Sbjct:   61IEWLFLLLAIFLVITLEIVNSAIENVVDLASDYHFSMLAKNAKDMAAGAVLMISGYAVLT  120

Query:  119GLIIFIPKI                                                    127
           GLIIFIPKI
Sbjct:  121GLIIFIPKI                                                    129
```

Based on this analysis, it was predicted that these proteins and their epitopes could be useful antigens for vaccines or diagnostics.

Example 2187

A DNA sequence (GBSx2304) was identified in *S. agalactiae* <SEQ ID 6755> which encodes the amino acid sequence <SEQ ID 6756>. This protein is predicted to be GTPase Era (era). Analysis of this protein sequence reveals the following:

Possible site: 54
>>> Seems to have no N-terminal signal sequence
----- Final Results -----
bacterial cytoplasm --- Certainty = 0.1871 (Affirmative) <succ>
bacterial membrane --- Certainty = 0.0000 (Not Clear) <succ>
bacterial outside --- Certainty = 0.0000 (Not Clear) <succ>

A related GBS nucleic acid sequence <SEQ ID 10017> which encodes amino acid sequence <SEQ ID 10018> was also identified.

The protein has homology with the following sequences in the GENPEPT database.

```
>GP:AAD41632 GB:AF072811 GTPase Era [Streptococcus pneumoniae]
Identities = 273/299 (91%), Positives = 290/299 (96%)
Query:   16  MTFKSGFVAILGRPNVGKSTFLNHVMGQKIAIMSDKAQTTRNKIMGIYTTETEQIVFIDT  75
             MTFKSGFVAILGRPNVGKSTFLNHVMGQKIAIMSDKAQTTRNKIMGIYTT+ EQIVFIDT
Sbjct:    1  MTFKSGFVAILGRPNVGKSTFLNHVMGQKIAIMSDKAQTTRNKIMGIYTTDKEQIVFIDT  60

Query:   76  PGIHKPKTALGDFMVESAYSTLREVETVLFMVPADEKRGKGDDMIIERLKAAKIPVILVI  135
             PGIHKPKTALGDFMVESAYSTLREV+TVLFMVPADE RGKGDDMIIERLKAAK+PVILV+
Sbjct:   61  PGIHKPKTALGDFMVESAYSTLREVDTVLFMVPADEARGKGDDMIIERLKAAKVPVILVV  120

Query:  136  NKIDKVHPDQLLEQIDDFRSQMDFKEVVPISALQGNNVPTLIKLLTDNLEEGFQYFPEDQ  195
             NKIDKVHPDQLL QIDDFR+QMDFKE+VPISALQGNNV  L+ +L++NL+EGFQYFP DQ
Sbjct:  121  NKIDKVHPDQLLSQIDDFRNQMDFKEIVPISALQGNNVSRLVDILSENLDEGFQYFPSDQ  180

Query:  196  ITDHPERFLVSEMVREKVLHLTQQEVPHSVAVVVESMKRDEETDKVHIRATIMVERDSQK  255
             ITDHPERFLVSEMVREKVLHLT++E+PHSVAVVV+SMKRDEETDKVHIRATIMVERDSQK
Sbjct:  181  ITDHPERFLVSEMVREKVLHLTREEIPHSVAVVVDSMKRDEETDKVHIRATIMVERDSQK  240

Query:  256  GIIIGKQGAMLKKIGKMARRDIELMLGDKVYLETWVKVKKNWRDKKLDLADFGYNEKEY  314
             GIIIGK GAMLKKIG MARRDIELMLGDKV+LETWVKVKKNWRDKKLDLADFGYNE+EY
Sbjct:  241  GIIIGKGGAMLKKIGSMARRDIELMLGDKVFLETWVKVKKNWRDKKLDLADFGYNEREY  299
```

A related DNA sequence was identified in *S. pyogenes* <SEQ ID 6757> which encodes the amino acid sequence <SEQ ID 6758>. Analysis of this protein sequence reveals the following:

Possible site: 38
>>> Seems to have no N-terminal signal sequence
----- Final Results ----- bacterial cytoplasm --- Certainty = 0.1088 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 295/297 (99%), Positives = 296/297 (99%)
Query:  18 FKSGFVAILGRPNVGKSTFLNHVMGQKIAIMSDKAQTTRNKIMGIYTTETEQIVFIDTPG 77
           FKSGFVAILGRPNVGKSTFLNHVMGQKIAIMSDKAQTTRNKIMGIYTTETEQIVFIDTPG
Sbjct:   2 FKSGFVAILGRPNVGKSTFLNHVMGQKIAIMSDKAQTTRNKIMGIYTTETEQIVFIDTPG 61

Query:  78 IHKPKTALGDFMVESAYSTLREVETVLFMVPADEKRGKGDDMIIERLKAAKIPVILVINK137
           IHKPKTALGDFMVESAYSTLREVETVLFMVPADEKRGKGDDMIIERLKAAKIPVILVINK
Sbjct:  62 IHKPKTALGDFMVESAYSTLREVETVLFMVPADEKRGKGDDMIIERLKAAKIPVILVINK121

Query: 138 IDKVHPDQLLEQIDDFRSQMDFKEVVPISALQGNNVPTLIKLLTDNLEEGFQYFPEDQIT197
           IDKVHPDQLLEQIDDF SQMDFKEVVPISAL+GNNVPTLIKLLTDNLEEGFQYFPEDQIT
Sbjct: 122 IDKVHPDQLLEQIDDFHSQMDFKEVVPISALEGNNVPTLIKLLTDNLEEGFQYFPEDQIT181

Query: 198 DHPERFLVSEMVREKVLHLTQQEVPHSVAVVVESMKRDEETDKVHIRATIMVERDSQKGI257
           DHPERFLVSEMVREKVLHLTQQEVPHSVAVVVESMKRDEETDKVHIRATIMVERDSQKGI
Sbjct: 182 DHPERFLVSEMVREKVLHLTQQEVPHSVAVVVESMKRDEETDKVHIRATIMVERDSQKGI241

Query: 258 IIGKQGAMLKKIGKMARRDIELMLGDKVYLETWVKVKKNWRDKKLDLADFGYNEKEY     314
           IIGKQGAMLKKIGKMARRDIELMLGDKVYLETWVKVKKNWRDKKLDLADFGYNEKEY
Sbjct: 242 IIGKQGAMLKKIGKMARRDIELMLGDKVYLETWVKVKKNWRDKKLDLADFGYNEKEY     298
```

Based on this analysis, it was predicted that these proteins and their epitopes could be useful antigens for vaccines or diagnostics.

Example 2188

A DNA sequence (GBSx2305) was identified in *S. agalactiae* <SEQ ID 6759> which encodes the amino acid sequence <SEQ ID 6760>. Analysis of this protein sequence reveals the following:

Possible site: 27
>>> Seems to have no N-terminal signal sequence

----- Final Results -----
   bacterial cytoplasm --- Certainty = 0.2679 (Affirmative) <succ>
   bacterial membrane --- Certainty = 0.0000 (Not Clear) <succ>
   bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2189

A DNA sequence (GBSx2306) was identified in *S. agalactiae* <SEQ ID 6761> which encodes the amino acid sequence <SEQ ID 6762>. Analysis of this protein sequence reveals the following:

Possible site: 21
>>> Seems to have a cleavable N-term signal seq.
----- Final Results -----
   bacterial outside --- Certainty = 0.3000 (Affirmative) <succ>
   bacterial membrane --- Certainty = 0.0000 (Not Clear) <succ>
   bacterial cytoplasm --- Certainty = 0.0000 (Not Clear) <succ>

The protein has homology with the following sequences in the GENPEPT database.

```
>GP:BAA16793 GB:D90900 hypothetical protein [Synechocystis sp.]
Identities = 36/119 (30%), Positives = 57/119 (47%), Gaps = 15/119 (12%)
Query: 390 TSDYEKAKVIHDHLVNNYTYATEELATTRETASGISIHAPEALYKDKRGVCQAFAVMFKD  449
           ++D+E+A++ +  +   N  Y    +A TR     I     PE +       +C ++  +++
Sbjct: 153 SNDWEEARLAYSWITQNIAYDVP-MAETRN----IDDLRPETVIARGETICSGYSNLYQA  207

Query: 450 MAATAGLSVWYVTGQAGGG----------NHAWNIVTINGVKYYVDTTWDNNIKSNKYF  498
           +A   GL V + G A GG            NHAWN V I+G  Y +DTTW   I S+  F
Sbjct: 208 LAKELGLDVVIIEGFAKGGDVIVGDDPDVNHAWNGVKIDGQWYLLDTTWGAGIVSDGKF  266
```

A related DNA sequence was identified in *S. pyogenes* <SEQ ID 6763> which encodes the amino acid sequence <SEQ ID 6764>. Analysis of this protein sequence reveals the following:

Possible site: 23
>>> May be a lipoprotein
----- Final Results -----
   bacterial membrane --- Certainty = 0.0000 (Not Clear) <succ>
   bacterial outside --- Certainty = 0.0000 (Not Clear) <succ>
   bacterial cytoplasm --- Certainty = 0.0000 (Not Clear) <succ>

The protein has no significant homology with any sequences in the GENPEPT database.

An alignment of the GAS and GBS proteins is shown below.

```
Identities = 41/181 (22%), Positives = 79/181 (42%), Gaps = 17/181 (9%)
Query: 355  ITITYTLKGDMVGLHKEYKQFVDSFVKENITNKNITSDYEKAKVIHDHLVNNYTYATE--  412
            + +T+ +  D    ++++  Q + + +  N  +K+      YE+ K   ++ ++ +  Y  +
Sbjct: 124  VFVTFPIPEDAKNIYQDL-QAIGNDIVANTPSKD---RYEQVKYFYEVIIRDTDYNKKAF  179

Query: 413  ELATTRETASGISIHAPEALYKDKRGVCQAFAVMFKDMAATAGLSVWYVTGQAGGGN---  469
            E   +  A  S    ++++ D    VC  +A  F+ +    AG+ V Y+  G
Sbjct: 180  EAYQSGSQAQVASNQDIKSVFIDHLSVCNGYAQAFQFLCQKAGIPVAYIRGTGTSQQPQQ  239

Query: 470  ---HAWNIVTINGVKYYVDTTW-----DNNIKSNKYFLVGKTIMDADHLLDSQYNALAKDI 522
               HAWN V IN    Y VD TW       DN++   K   + + +       L +  +  +KDI
Sbjct: 240  SFAHAWNAVQINNTYYGVDVTWGDPVFDNELSHQKQGTINYSFLCLPDYLMALSHQPSKDI 300
```

Based on this analysis, it was predicted that this protein and its epitopes, could be useful antigens for vaccines or diagnostics.

Example 2190

A DNA sequence (GBSx2307) was identified in *S. agalactiae* <SEQ ID 6765> which encodes the amino acid sequence <SEQ ID 6766>. This protein is predicted to be rgg protein. Analysis of this protein sequence reveals the following:

Possible site: 29
\>>> Seems to have no N-terminal signal sequence
INTEGRAL   Likelihood = –0.16   Transmembrane 187-203 (187-203)
----- Final Results -----
  bacterial membrane --- Certainty = 0.1065 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 10015> which encodes amino acid sequence <SEQ ID 10016> was also identified.

The protein has homology with the following sequences in the GENPEPT database.

```
>GP:AAA26968 GB:M89776 rgg [Streptococcus gordonii]
Identities = 71/273 (26%), Positives = 140/273 (51%), Gaps = 16/273 (5%)

Query:    8  KELGKTLRRLRKGKKVSISSLADEHLSKSQISRFERGESEITCSRLLNILDKLNITIDEF    67
             K  GK L+ +R+ K +S+   +A    +S +Q+SR+ERG S +T       + L  +++++ EF
Sbjct:    5  KSSGKILKIIRESKNMSLKEVAAGDISVAQLSRYERGISSLTVDSFYSCLRNMSVSLAEF    64

Query:   68  VSI-HSKAHTHFFILLNRVRKYCAEKNVTKLVALL-----------EDHNHKDYEKIMIK   115
              + H+         +L  ++ +   E N+ KL ++L              E  N+K     I+I+
Sbjct:   65  QYVYHNYREADDVVLSQKLSEAQRENNIVKLESILAGSEAMAQEFPEKKNYK-LNTIVIR   123

Query:  116  ALIFSIDQSIEPNQEELARLTDYLFTVEQWGYYEIILLGNCSRLINYNTLFLLTKEMVNS   175
             A + S +   + ++ ++   LTDYLF+VE+WG  YE+ L   N     L+      TL        EM+N
Sbjct:  124  ATLTSCNPDYQVSKGDIEFLTDYLFSVEEWGRYELWLFTNSVNLLTLETLETFASEMINR   183

Query:  176  FAYSEQNKTNKILVTQLAINCLIISIDHSYFEHSHYLIDKVRSLLQDEVNFYEKTVFLYV   235
              +             N+   +   ++ +N +     I++++ + +    ++ + +       E + Y++ +   Y
Sbjct:  184  TQFYNNLPENRRRIIKMLLNVVSACIENNHLQVAMKFLNYIDNTKIPETDLYDRVLIKYH   243

Query:  236  TGYYHLKLGDTSSGKEDMRKALQIFKYLGEDSF                             268
              Y    K+G+  +  +  D+  +  L    F+YL    DSF
Sbjct:  244  KALYSYKVGNPHA-RHDIEQCLSTFEYL--DSF                             273
```

There is also homology to SEQ ID 628.

Based on this analysis, it was predicted that this protein and its epitopes, could be useful antigens for vaccines or diagnostics.

Example 2191

A DNA sequence (GBSx2308) was identified in *S. agalactiae* <SEQ ID 6767> which encodes the amino acid sequence <SEQ ID 6768>. Analysis of this protein sequence reveals the following:

Possible site: 36
\>>> Seems to have no N-terminal signal sequence
----- Final Results -----
  bacterial cytoplasm --- Certainty = 0.3234 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:BAA05066 GB:D26071 formamidopyrimidine-DNA glycosylase
[Streptococcus mutans]
Identities = 182/271 (67%), Positives = 217/271 (79%)
Query:   1 MPELPEVETVRKGLERLVVNQEIASITIKVPKMVKTDLNDFMISLPGKTIQQVLRRGKYL 60
           MPELPEVETVR+GLE L+V ++I S+ ++VPKMVKT + DF + + G+T + + RRGKYL
Sbjct:   1 MPELPEVETVRRGLEHLIVGKKIVSVEVRVPKMVKTGVEDFQLDILGQTFESIGRRGKYL 60

Query:  61 LFDFGEMVMVSHLRMEGKYLLFPNKVPDNKHFHLYFKLTNGSTLVYQDVRKEGTFELVRK120
           L +       ++SHLRMEGKYLLF ++VPDNKHFHL+F L  GSTLVYQDVRKFGTFEL+ K
Sbjct:  61 LLNLNRQTIISHLRMEGKYLLFEDEVPDNKHFHLFFGLDGGSTLVYQDVRKFGTFELLPK120

Query: 121 SSLKDYFTQKKLGPEPTADTFQFEPFSKGLANSKKPIKPLLLDQRLVAGLGNIYVDEVLW180
           S ++ YF QKK+GPEP A   F+ +PF +GLA S K IK LLLDQ LVAGLGNIYVDEVLW
Sbjct: 121 SQVEAYFVQKKIGPEPNAKDFKLKPFEEGLAKSHKVIKTLLLDQHLVAGLGNIYVDEVLW180

Query: 181 AAKIHPQRLANQLTESETSLLHKEIIRILTLGIEKGGSTIRTYKNALGEDGTMQKYLQVY240
           AAK+ P+RLA+QL  SE   +H E IRIL L IEKGGSTIR+YKN+LGEDG+MQ  LQVY
Sbjct: 181 AAKVDPERLASQLKTSEIKRIHDETIRILQLAIEKGGSTIRSYKNSLGEDGSMQDCLQVY240

Query: 241 GKTGQPCPRCGCLIKKIKVGGRGTHYCPRCQ                            271
           GKT QPC RC   I+KIKVGGRGTH+CP CQ
Sbjct: 241 GKTDQPCARCATPIEKIKVGGRGTHFCPSCQ                            271
```

A related DNA sequence was identified in *S. pyogenes* <SEQ ID 6769> which encodes the amino acid sequence <SEQ ID 6770>. Analysis of this protein sequence reveals the following:

---

Possible site: 54
>>> Seems to have no N-terminal signal sequence
----- Final Results -----
    bacterial cytoplasm --- Certainty = 0.2068 (Affirmative) <succ>
    bacterial membrane --- Certainty = 0.0000 (Not Clear) <succ>
    bacterial outside --- Certainty = 0.0000 (Not Clear) <succ>

---

An alignment of the GAS and GBS proteins is shown below.

```
Identities = 190/271 (70%), Positives = 229/271 (84%)
Query:   1 MPELPEVETVRKGLERLVVNQEIASITIKVPKMVKTDLNDFMISLPGKTIQQVLRRGKYL 60
           MPELPEVETVR+GLE LV+ QEI ++T+KVPKMVKTDL  F ++LPG+ IQ V RRGKYL
Sbjct:   1 MPELPEVETVRRGLETLVLGQEIVAVTLKVPKKVKTDLETFALTLPGQIIQSVGARGKYL 60

Query:  61 LFDFGEMVMVSHLRMEGKYLLFPNKVPDNKHFHLYFKLTNGSTLVYQDVRKFGTFELVRK120
           L D G++V+ VSHLRMEGKYLLFP++VPDNKHFH++F+L NGSTLVYQDVRKFGTF+L+ K
Sbjct:  61 LIDLGQLVLVSHLRMEGKYLLFPDEVPDNKHFHVFFELKNGSTLVYQDVRKFGTFDLIAK120

Query: 121 SSLKDYFTQKKLGPEPTADTFQFEPFSKGLANSKKPIKPLLLDQRLVAGLGNIYVDEVLW180
           S L  +F ++KLGPEP  +TF+ +  F   L +S+KPIKP LLDQ LVAGLGNIYVDEVLW
Sbjct: 121 SQLSAFFAKRKLGPEPKKETFKLKTFEAALLSSQKPIKPHLLDQTLVAGLGNIYVDEVLW180

Query: 181 AAKIHPQRLANQLTESETSLLHKEIIRILTLGIEKGGSTIRTYKNALGEDGTMQKYLQVY240
           AAK+HP+   +++L ++E   LH E IRIL LGIEKGGST+RTY+NALG DGTMQ  YLQVY
Sbjct: 181 AAKVHPETASSRLNKAEIKRLHDETIRILALGIEKGGSTVRTYRNALGADGTMQDYLQVY240

Query: 241 GKTGQPCPRCGCLIKKIKVGGRGTHYCPRCQ                            271
           G+TG+PCPRCG  I K+KVGGRGTH CP+CQ
Sbjct: 241 GQTGKPCPRCGQAIVKLKVGGRGTHICPKCQ                            271
```

Based on this analysis, it was predicted that these proteins and their epitopes could be useful antigens for vaccines or diagnostics.

Example 2192

A DNA sequence (GBSx2309) was identified in *S. agalactiae* <SEQ ID 6771> which encodes the amino acid sequence <SEQ ID 6772>. Analysis of this protein sequence reveals the following:

---

Possible site: 26
>>> Seems to have no N-terminal signal sequence
----- Final Results -----
    bacterial cytoplasm --- Certainty = 0.0797 (Affirmative) <succ>
    bacterial membrane --- Certainty = 0.0000 (Not Clear) <succ>
    bacterial outside --- Certainty = 0.0000 (Not Clear) <succ>

---

A related GBS nucleic acid sequence <SEQ ID 10013> which encodes amino acid sequence <SEQ ID 10014> was also identified.

The protein has homology with the following sequences in the GENPEPT database.

```
>GP:AAC00353 CB:AP008220 YtaG [Bacillus subtilis]
Identities = 80/189 (42%), Positives = 113/189 (59%), Gaps = 1/189 (0%)
Query:   8 MTKIIGLTGGIASGKSTVTKIIRESGFKVIDADQVVHKLQAKGGKLYQALLEWLGPEILD67
           MT +IGLTGGIASGKSTV  ++ E G  VIDAD +  +   KG    Y+ +++  G +IL
Sbjct:   1 MTLVIGLTGGIASGKSTVANMLIEKGITVIDADIIAKQAVEKGMPAYRQIIDEFGEDILL60

Query:  68 ADGELDRPKLSQMIFANPDNMKTSARLQNSIIRQELACQRDQLKQTEEIF-FMDIPLLIE126
           ++G++DR KL  ++F N          + +  +RQE+  +RD+       E F  +DIPLL E
Sbjct:  61 SNGDIDRKKLGALVFTNEQKRLALNAIVHPAVRQEMLNRRDEAVANREAFVVLDIPLLFE120

Query: 127 EKYIKWFDEIWLVFVDKEKQLQRLMARNNYSREEAELRLSHQMPLTDKKSFASLIIDNNG186
              K    D+I +V V KE QL+RLM  RN  +  EEA  R+   QMPL +K + A  +IDN+G
Sbjct: 121 SKLESLVDKIIVVSVTKELQLERLMKRNQLTEEEAVSRIRSQMPLEEKTARADQVIDNSG180

Query: 187 DLITLKEQI                                              195
              L   K Q+
Sbjct: 181 TLEETKRQL                                              189
```

A related sequence was also identified in GAS <SEQ ID 9111> which encodes the amino acid sequence <SEQ ID 9112>. Analysis of this protein sequence reveals the following:

Possible cleavage site: 59
>>> Seems to have no N-terminal signal sequence
----- Final Results -----
    bacterial cytoplasm --- Certainty = 0.101 (Affirmative) <succ>
    bacterial membrane --- Certainty = 0.000 (Not Clear) <succ>
    bacterial outside --- Certainty = 0.000 (Not Clear) <succ>

An alignment of the GAS and GBS proteins is shown below.

```
Identities = 118/191 (61%), Positives = 153/191 (79%)
Query:   9 TKIIGLTGGIASGKSTVTKIIRESGFKVIDADQVVHKLQAKGGKLYQALLEWLGPEILDA    68
           T IIG+TGGIASGKSTV K+IR++G++VIDADQVVH LQ KGG+LY+AL E  G +IL A
Sbjct:   9 TMIIGITGGIASGKSTVVKVIRKAGYQVIDADQVVHDLQEKGGRLYEALREAFGNQILKA    68

Query:  69 DGELDRPKLSQMIFANPDNMKTSARLQNSIIRQELACQRDQLKQTEEIFFMDIPLLIEEK   128
           DGELDR KLS+M+F+NPDNM TS+ +QN II++ELA +RD L Q++ IFFMDIPLL+E
Sbjct:  69 DGELDRTKLSEMLFSNPDNMATSSAIQNQIIKEELAAKRDHLAQSQAIFFMDIPLLMELG   128

Query: 129 YIKWFDEIWLVFVDKEKQLQRLMARNNYSREEAELRLSHQMPLTDKKSFASLIIDNNGDL   188
           Y  WFD IWLV+VD + QLQRLMARN   +A  R++ Q+P+ +KK +ASL+IDN+GD+
Sbjct: 129 YQDWFDAIWLVYVDAQTQLQRLEARNRLDKGKARQRIASQLPIEEKKPYASLVIDNSGDI   188

Query: 189 ITLKEQILDAL                                                   199
              L +Q+  AL
Sbjct: 189 AALIKQVQSAL                                                   199
```

A related GBS gene <SEQ ID 8993> and protein <SEQ ID 8994> were also identified. Analysis of this protein sequence reveals a signal peptide at residues 1-16.

The protein has homology with the following sequences in the databases:

```
42.2/60.6% over 189aa
OMNI|NT01BS3382| Insert characterized
ORF02237(319-885 of 1206)
OMNI|NT01BS3382(3-192 of 200) ( )
% Match = 17.0
% Identity = 42.1 % Similarity = 60.5
Matches = 80 Mismatches = 74 Conservative Sub.s = 35

78        108       138       168       198       228       258       288
KNSPTAFG*SIDRI*NKLITQGNYSHFNFRHRKRWLHD*NI*ECSWRGRYDAKVFTGLW*NWATVSKVWLFN*EDKSRRE
```

```
318        348        378        408        438        468        498        528
RDALLPSVSMLMTKIIGLTGGIASGKSTVTKIIRESGFKVIDADQVVHKLQAKGGKLYQALLEWLGPEILDADGELDRPK
   |:|  :||||||||||||  ::  | |  ||||| :    :   ||   |: :::  :| :|| ::|::|| |
           VDLLTLVIGLTGGIASGKSTVANMLIEKGITVIDADIIAKQAVEKGMPAYRQIIDEFGEDILLSNGDIDRKK
              10         20         30         40         50         60         70

558        588        618        648        675        705        735        765
LSQMIFANPDNMKTSARLQNSIIRQELACQRDQLKQTEEIFF-MDIPLLIEEKYIKWFDEIWLVFVDKEKQLQRLMARNN
|  ::|     |   :|||:   :||:         | |      |||     || |       |:|  |  | ||:||| ||
LGALVFTNEQKRLALNAIVHPAVRQEMLNRRDEAVANREAFVVLDIPLLFESKLESLVDKIIVVSVTKELQLERLMKRNQ
              90         100        110        120        130        140        150

795        825        855        885        915        945        975        1005
YSREEAELRLSHQMPLTDKKSFASLIIDNNGDLITLKEQILDALQEL*NY*MDNVFIHFLSLLH*F*KTCD*TTVIVQ*Y
  :  |||   |:  ||||  :| :   |  :|||:|   |   | |: ::
LTEEEAVSRIRSQMPLEEKTARADQVIDNSGTLEETKRQLDEIMNSWA
              170        180        190        200
```

A related DNA sequence was identified in *S. pyogenes* <SEQ ID 6773> which encodes amino acid sequence <SEQ ID 6774>. An alignment of the GAS and GBS sequences follows:

```
Score = 218 bits (550), Expect = 4e-59
Identities = 104/175 (59%), Positives = 138/175 (78%)
Query:  25  VVKVIRKAGYQVIDADQVVHDLQEKGGRLYEALREAFGNQILKADGELDRTKLSEMLFSN   84
            V K+IR++G++VIDADQVVH LQ KGG+LY+AL E  G +IL ADGELDR KLS+M+F+N
Sbjct:  20  VTKIIRESGFKVIDADQVVHKLQAKGGKLYQALLEWLGPEILDADGELDRPKLSQMIFAN   79

Query:  85  PDNMATSSAIQNQIIKEELAAKRDHLAQSQAIFFMDIPLLMELGYQDWFDAIWLVYVDAQ   144
            PDNM TS+ +QN II++ELA +RD L Q++ IFFMDIPLL+E Y WFD IWLV+VD +
Sbjct:  80  PDNMKTSARLQNSIIRQELACQRDQLKQTEEIFFMDIPLLIEEKYIKWFDEIWLVFVDKE   139

Query: 145  TQLQRLMARNRLDKGKARQRIASQLPIEEKKPYASLVIDNSGDIAALIKQVQSAL       199
             QLQRLMARN   + +A  R++ Q+P+ +KK +ASL+IDN+GD+  L +Q+  AL
Sbjct: 140  KQLQRLMARNNYSREEAELRLSHQMPLTDKKSFASLIIDNNGDLITLKEQILDAL       194
```

SEQ ID 8994 (GBS245) was expressed in *E. coli* as a His-fusion product. SDS-PAGE analysis of total cell extract is shown in FIG. 61 (lane 6; MW 23.7 kDa). It was also expressed in *E. coli* as a GST-fusion product, and purified GBS245-GST is shown in FIG. 211, lane 6.

Figure 278:
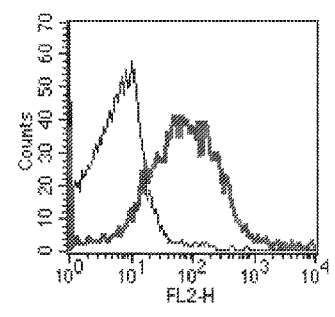

The purified GST fusion product was used to immunise mice ands the resulting antiserum was used for FACS (FIG. 278). This confirmed that the protein is immunoaccessible on GBS bacteria.

Based on this analysis, it was predicted that these proteins and their epitopes could be useful antigens for vaccines or diagnostics.

Possible site: 35
>>> Seems to have no N-terminal signal sequence
----- Final Results -----
  bacterial cytoplasm --- Certainty = 0.4073 (Affirmative) <succ>
  bacterial membrane --- Certainty = 0.0000 (Not Clear) <succ>
  bacterial outside --- Certainty = 0.0000 (Not Clear) <succ>

Example 2193

A DNA sequence (GBSx2310) was identified in *S. agalactiae* <SEQ ID 6775> which encodes the amino acid sequence <SEQ ID 6776>. Analysis of this protein sequence reveals the following:

The protein has homology with the following sequences in the GENPEPT database.

```
>GP:BAA30330 GB:AP000005 253aa long hypothetical ATP-binding
transport protein [Pyrococcus horikoshii]
Identities = 78/240 (32%), Positives = 130/240 (53%), Gaps = 13/240 (5%)
Query:   3  LVIRDIRKRFQETEVLRGASYRFYSGKITGVLGRNGAGKTTLFNILYGDLAADNGTICLL   62
            +++ ++RK+F   EVL+G ++    G+I G+LG NG+GK+T   IL G +    G + +
Sbjct:   2  IIVENLRKKFGSKEVLKGINFTVNDGEIYGLLGPNGSGKSTTMRILSGIITDFEGKVMVA   61

Query:  63  -KDNHEYPLTDKDI-GIVYSENYLPEFLTGYEFVKFYMDLH--PSDDL-MTIDDYLDFME   117
                 D  P+ K+I G V   L  LT EF F  +   P D L    +D
Sbjct:  62  GVDVSRDPMKVKEIVGYVPETPALYESLTPAEFFSFIGGVRRIPQDILEERVKRLVDAFG   121

Query: 118  IGQTERHRIIKGYSDGMKSKLSLICLMISKPKVILLDEPLTAVDVVSSIAIKRLLLELSE   177
```

```
                IG+    +++I    S G K K+SLI    ++   P+V++LDE +    +D  S+    + LL E   E
Sbjct:  122     IGK-YMNQLIGILSFGTKQKISLISALLHDPQVLILDEAMNGLDPKSARIFRELLFEFKE       180

Query:  178     D-HIIILSTHIMALAEDLCDIVAVLDKGKL---QTLDIDR---KHEQFEERLLQVLKGDE       230
                +   I+ STHI+ALAE +CD + ++ +G++      T+D  R   + E+ E+ L++ + E
Sbjct:  181     EGKSIVFSTHILALAEVMCDRIGIIYEGRIVAEGTIDELREIAREEKLEDIFLKLTQAKE       240
```

There is also homology to SEQ ID 2876.

Based on this analysis, it was predicted that this protein and its epitopes, could be useful antigens for vaccines or diagnostics.

Example 2194

A DNA sequence (GBSx2311) was identified in *S. agalactiae* <SEQ ID 6777> which encodes the amino acid sequence <SEQ ID 6778>. Analysis of this protein sequence reveals the following:

---

Possible site: 14
>>> Seems to have no N-terminal signal sequence
----- Final Results -----
   bacterial cytoplasm --- Certainty = 0.6138 (Affirmative) <succ>
   bacterial membrane --- Certainty = 0.0000 (Not Clear) <succ>
   bacterial outside --- Certainty = 0.0000 (Not Clear) <succ>

---

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2195

A DNA sequence (GBSx2312) was identified in *S. agalactiae* <SEQ ID 6779> which encodes the amino acid sequence <SEQ ID 6780>. Analysis of this protein sequence reveals the following:

---

Possible site: 20
>>> Seems to have no N-terminal signal sequence
INTEGRAL   Likelihood = −15.34   Transmembrane 526-542 (511-546)
INTEGRAL   Likelihood = −9.61    Transmembrane 340-356 (335-359)
INTEGRAL   Likelihood = −8.17    Transmembrane 455-471 (451-476)
INTEGRAL   Likelihood = −8.01    Transmembrane 97-113 (95-121)
INTEGRAL   Likelihood = −8.01    Transmembrane 216-232 (207-236)
INTEGRAL   Likelihood = −3.40    Transmembrane 50-66 (46-67)
INTEGRAL   Likelihood = −1.33    Transmembrane 178-194 (178-194)
----- Final Results -----
   bacterial membrane --- Certainty = 0.7135 (Affirmative) <succ>
   bacterial outside --- Certainty = 0.0000 (Not Clear) <succ>
   bacterial cytoplasm --- Certainty = 0.0000 (Not Clear) <succ>

---

A related GBS nucleic acid sequence <SEQ ID 10011> which encodes amino acid sequence <SEQ ID 10012> was also identified.

The protein has no significant homology with any sequences in the GENPEPT database, but there is homology to SEQ ID 376.

No corresponding DNA sequence was identified in *S. pyogenes*.

Based on this analysis, it was predicted that this protein and its epitopes, could be useful antigens for vaccines or diagnostics.

Example 2196

A DNA sequence (GBSx2314) was identified in *S. agalactiae* <SEQ ID 6781> which encodes the amino acid sequence <SEQ ID 6782>. Analysis of this protein sequence reveals the following:

---

Possible site: 32
>>> Seems to have no N-terminal signal sequence
INTEGRAL   Likelihood = −8.17   Transmembrane 140-156 (134-160)
INTEGRAL   Likelihood = −6.64   Transmembrane 255-271 (253-274)
INTEGRAL   Likelihood = −5.79   Transmembrane 345-361 (343-363)
INTEGRAL   Likelihood = −3.29   Transmembrane 184-200 (183-202)
INTEGRAL   Likelihood = −2.34   Transmembrane 66-82 (65-83)
INTEGRAL   Likelihood = −1.65   Transmembrane 221-237 (221-239)
INTEGRAL   Likelihood = −0.00   Transmembrane 121-137 (121-137)
----- Final Results -----
   bacterial membrane --- Certainty = 0.4270 (Affirmative) <succ>
   bacterial outside --- Certainty = 0.0000 (Not Clear) <succ>
   bacterial cytoplasm --- Certainty = 0.0000 (Not Clear) <succ>

---

A related GBS nucleic acid sequence <SEQ ID 9401> which encodes amino acid sequence <SEQ ID 9402> was also identified.

The protein has homology with the following sequences in the GENPEPT database.

```
>GP:CAA07482 GB:AJ007367 multi-drug resistance efflux pump
[Streptococcus pneumoniae]
Identities = 213/372 (57%), Positives = 295/372 (79%)
Query:    1    MPFMVLYVEQLGAPSNKVEWYAGLSVSLSALSSALVAPLWGRLADKYGRKPMMVRAGLMM      60
               +PFM ++VE LG  S +V +YAGL++S+SA+S+AL +P+WG LADKYGRKPMM+RAGL M
Sbjct:   28    VPFMPIFVENLGVGSQQVAFYAGLAISVSAISAALFSPIWGILADKYGRKPMMIRAGLAM      87

Query:   61    TFTMGGLAFIHSVTGLLILRILNGIFAGYVPNSTALIASQAPQEESGYALGTLATGVTGG     120
               T TMGGLAF+ ++  L+ LR+LNG+FAG+VPN+TALIASQ P+E+SG ALGTL+TGV  G
Sbjct:   88    TITMGGLAFVPNIYWLIFLRLLNGVFAGFVPNATALIASQVPKEKSGSALGTLSTGVVAG     147
```

-continued

```
Query:  121  MLIGPLLGGLLAEWFGIREVFLLVGTILLISTLMTIFMVKEDFKPISNEETMPTTEVFKS  180
             L GP +GG +AE FGIR VFLLVG+ L ++ ++TI  +KEDF+P++ E+ +PT E+F S
Sbjct:  148  TLTGPFIGGFIAELFGIRTVFLLVGSFLFLAAILTICFIKEDFQPVAKEKAIPTKELFTS  207

Query:  181  VESLQILIGLFVTSMIIQISAQSIAPILTLYIRHLGQTENLMFVSGLIVSGMGFSSILSS  240
             VK   +L+ LF+TS +IQ SAQSI PIL LY+R LGQTENL+FVSGLIVS MGFSS++S+
Sbjct:  208  VKYPYLLLNLFLTSFVIQFSAQSIGPILALYVRDLGQTENLLFVSGLIVSSMGFSSMMSA  267

Query:  241  PKLGRIGDRIGNHRLLLLALLYSFLMYVLCSLAQTSLQLGVIRFLYGFGTGALMPSINSI  300
                +G++GD++GNHRLL++A   YS ++Y+LC+ A + LQLG+ RFL+G GTGAL+P +N++
Sbjct:  268  GVMGKLGDKVGNHRLLVVAQFYSVIIYLLCANASSPLQLGLYRFLFGLGTGALIPGVNAL  327

Query:  301  LTKIAPRQGLSRIFSYNQMFSNLGQVLGPFVGSAVSIHLGFRWVFFVTSFIVLANFVWCF  360
             L+K+ P+ G+SR+F++NQ+F  LG V+GP   GSAV+      G+   VF+ TS   V  +  ++
Sbjct:  328  LSKMTPKAGISRVFAFNQVFFYLGGVVGPMAGSAVAGQFGYHAVFYATSLCVAFSCLFNL  387

Query:  361  INFRKYIRVKEI                                                372
             I FR   ++VKEI
Sbjct:  388  IQFRTLLKVKEI                                                399
```

A related DNA sequence was identified in *S. pyogenes* <SEQ ID 6783> which encodes the amino acid sequence <SEQ ID 6784>. Analysis of this protein sequence reveals the following:

Possible site: 58
>>> Seems to have a cleavable N-terminal signal sequence
| INTEGRAL | Likelihood = −10.14 | Transmembrane 165-181 (150-185) |
| INTEGRAL | Likelihood = −7.43 | Transmembrane 371-387 (367-391) |
| INTEGRAL | Likelihood = −3.88 | Transmembrane 90-106 (86-109) |
| INTEGRAL | Likelihood = −3.35 | Transmembrane 145-161 (143-162) |
| INTEGRAL | Likelihood = −1.70 | Transmembrane 279-295 (279-297) |
| INTEGRAL | Likelihood = −0.85 | Transmembrane 209-225 (209-226) |
| INTEGRAL | Likelihood = −0.27 | Transmembrane 347-363 (347-363) |

----- Final Results -----
  bacterial membrane --- Certainty = 0.5055 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
>GP:CAA07482 GB:AJ007367 multi-drug resistance efflux pump
[Streptococcus pneumoniae]
Identities = 236/396 (59%), Positives = 309/396 (77%)
Query:    1  VNWRQNLKVAWLGNFFTGASFSLVMPFMALYVENLGTPTELVEYYAGLAVAVTALASALF   60
             +NW +NL++AW GNF TGAS SLV+PFM ++VENLG   ++ V +YAGLA++V+A+++ALF
Sbjct:    4  INWKDNLRIAWFGNFLTGASISLVVPFMPIFVENLGVGSQQVAFYAGLAISVSAISAALF   63

Query:   61  APVWGKLADRYGRKPMMLRASFVMTFTGGLAIIPNVFWLLILRLLTGVSAGYVPNATAL  120
             +P+WG LAD+YGRKPMM+RA    MT TMGGLA +PN++WL+ LRLL GV AG+VPNATAL
Sbjct:   64  SPIWGILADKYGRKPMMIRAGLAMTITMGGLAFVPNIYWLIFLRLLNGVFAGFVPNATAL  123

Query:  121  IASQAPKEESGYALGTLATGVTAGALIGPLLGGILAELLGIRQVFLLVGVILFLCSLMTA  180
             IASQ PKE+SG ALGTL+TGV AG L GP +GG +AEL GIR VFLLVG  LFL +++T
Sbjct:  124  IASQVPKEKSGSALGTLSTGVVAGTLTGPFIGGFIAELFGIRTVFLLVGSFLFLAAILTI  183

Query:  181  VYVKEEFKPVRRFEMIPTKVILKQVKSPQIMLGLFVTSMIIQISAQSVAPILSLYIRHLG  240
             ++KE+F+PV + + IPTK +  VK P ++L LF+TS +IQ SAQS+ PIL+LY+R LG
Sbjct:  184  CFIKEDFQPVAKEKAIPTKELFTSVKYPYLLLNLFLTSFVIQFSAQSIGPILALYVRDLG  243

Query:  241  QTHNLMFTSGLVVSAMGFSSLFSSSYLGKLGDRFGNHRLLLAALCYSFIMYFSSALAQTS  300
             QT NL+F SGL+VS+MGFSS+ S+  +GKLGD+ GNHRLL+ A   YS I+Y  +A A +
Sbjct:  244  QTENLLFVSGLIVSSMGFSSMMSAGVMGKLGDKVGNHRLLVVAQFYSVIIYLLCANASSP  303

Query:  301  FQLGVLRFAYGFGVGALMPSINSLLTKLTPKEGISRVFAYNQMFSNLGQVIGPFIGSNVA  360
              QLG+ RF +G G GAL+P +N+LL+K TPK GISRVFA+NQ+F  LG V+GP  GS VA
Sbjct:  304  LQLGLYRFLFGLGTGALIPGVNALLSKMTPKAGISRVFAFNQVFFYLGGVVGPMAGSAVA  363

Query:  361  VVLGYRSVFYVTSLIVFVNLIWSLIIFRKYIKVKDI                         396
                 GY +VFY TSL V  +  +++LI FR   +KVK+I
Sbjct:  364  GQFGYHAVFYATSLCVAFSCLFNLIQFRTLLKVKEI                         399
```

An alignment of the GAS and GBS proteins is shown below.

```
Identities = 262/373 (70%), Positives = 314/373 (83%)
Query:   1 MPFMVLYVEQLGAPSNKVEWYAGLSVSLSALSSALVAPLWGRLADKYGRKPMMVRAGLMM    60
           MPFM LYVE LG P+  VE+YAGL+V+++AL+SAL AP+WG+LAD+YGRKPMM+RA  +M
Sbjct:  25 MPFMALYVENLGTPTELVEYYAGLAVAVTALASALFAPVWGKLADRYGRKPMMLRASFVM    84

Query:  61 TFTMGGLAFIHSVTGLLILRILNGIFAGYVPNSTALIASQAPQEESGYALGTLATGVTGG   120
           TFTMGGLA I +V  LLILR+L G+ AGYVPN+TALIASQAP+EESGYALGTLATGVT G
Sbjct:  85 TFTMGGLAIIPNVFWLLILRLLTGVSAGYVPNATALIASQAPKEESGYALGTLATGVTAG   144

Query: 121 MLIGPLLGGLLAEWFGIREVFLLVGTILLISTLMTIFMVKEDFKPISNEEIMPTTEVFKS   180
             LIGPLLGG+LAE  GIR+VFLLVG IL + +LMT   VKE+FKP+    E +PT  + K
Sbjct: 145 ALIGPLLGGILAELLGIRQVFLLVGVILFLCSLMTAVYVKEEFKPVRRFEMIPTKVILKQ   204

Query: 181 VKSLQILIGLFVTSMIIQISAQSIAPILTLYIRHLGQTENLMFVSGLIVSGMGFSSILSS   240
           VKS QI++GLFVTSMIIQISAQS+APIL+LYIRHLGQT NLMF SGL+VS MGFSS+ SS
Sbjct: 205 VKSPQIMLGLFVTSMIIQISAQSVAPILSLYIRHLGQTHNLMFTSGLVVSAMGFSSLFSS   264

Query: 241 PKLGRIGDRIGNHRLLLLALLYSFLMYVLCSLAQTSLQLGVIRFLYGFGTGALMPSINSI   300
              LG++GDR GNHRLLL AL YSF+MY   +LAQTS QLGV+RF YGFG GALMPSINS+
Sbjct: 265 SYLGKLGDRFGNHRLLLAALCYSFIMYFSSALAQTSFQLGVLRFAYGFGVGALMPSINSL   324

Query: 301 LTKIAPRQGLSRIFSYNQMFSNLGQVLGPFVGSAVSIHLGFRWVFFVTSFIVLANFVWCF   360
           LTK+ P++G+SR+F+YNQMFSNLGQV+GPF+GS V++ LG+R VF+VTS IV  N +W
Sbjct: 325 LTKLTPKEGISRVFAYNQMFSNLGQVIGPFIGSNVAVVLGYRSVFYVTSLIVFVNLIWSL   384

Query: 361 INFRKYIRVKEIV                                                 373
           I FRKYI+VK+IV
Sbjct: 385 IIFRKYIKVKDIV                                                 397
```

Based on this analysis, it was predicted that these proteins and their epitopes could be useful antigens for vaccines or diagnostics.

Example 2197

A DNA sequence (GBSx2315) was identified in *S. agalactiae* <SEQ ID 6785> which encodes the amino acid sequence <SEQ ID 6786>. Analysis of this protein sequence reveals the following:

---

Possible site: 20
>>> Seems to have no N-terminal signal sequence
----- Final Results -----
bacterial cytoplasm --- Certainty = 0.2343 (Affirmative) <succ>
bacterial membrane --- Certainty = 0.0000 (Not Clear) <succ>
bacterial outside --- Certainty = 0.0000 (Not Clear) <succ>

---

The protein has homology with the following sequences in the GENPEPT database.

```
>GP:AAB69986 GB:U94356 glycerol kinase [Enterococcus faecalis]
Identities = 156/186 (83%), Positives = 167/186 (88%), Gaps = 1/186 (0%)
Query:   3 SEEKYIMAIDQGTTSSRAIIFNKKGEKIASSQKEFPQIFPQAGWVEHNANQIWNSVQSVI    62
           +EEKYIMAIDQGT+SSRAIIF+KKG KI SSQKEF Q FP AGWVEHNAN+IWNSVQSVI
Sbjct:   2 AEEKYIMAIDQGTTSSRAIIFDKKGNKIGSSQKEFTQYFPNAGWVEHNANEIWNSVQSVI    61

Query:  63 AGAFIESSIKPGQIEAIGITNQRETTVVWDKKTGLPIYNAIVWQSRQTAPIADQLKQEGH   122
           AG+ IES +KP   I IGITNQRETTVVWDK TGLPIYNAIVWQSRQT PIADQLK++G+
Sbjct:  62 AGSLIESGVKPTDIAGIGITNQRETTVVWDKATGLPIYNAIVWQSRQTTPIADQLKEDGY   121

Query: 123 TNMIHEKTGLVIDAYFSATKVRWILDHVPGAQERAEKGELLFGTIDTWLVWKLTDGLVHV   182
           + MIHEKTGL+IDAYFSATKVRWILDHV GAQERAE GEL+FGTIDTW+NWKLT G  HV
Sbjct: 122 SEMIHEKTGLIIDAYFSATKVRWILDHVEGAQERAENGELMFGTIDTWLVWKLT-GDTHV   180

Query: 183 TDYSNA                                                        188
           TDYSNA
Sbjct: 181 TDYSNA                                                        186
```

There is also high homology to SEQ ID 2844:

```
Identities = 174/186 (93%), Positives = 182/186 (97%)
Query:     3 SEEKYIMAIDQGTTSSRAIIFNKKGEKIASSQKEFPQIFPQAGWVEHNANQIWNSVQSVI    62
             S+EKYIMAIDQGTTSSRAIIFN+KGEK++SSQKEFPQIFP AGWVEHNANQIWNSVQSVI
Sbjct:     2 SQEKYIMAIDQGTTSSRAIIFNQKGEKVSSSQKEFPQIFPHAGWVEHNANQIWNSVQSVI    61

Query:    63 AGAFIESSIKPGQIEAIGITNQRETTVVWDKKTGLPIYNAIVWQSRQTAPIADQLKQEGH   122
             AGAFIESSIKP QIEAIGITNQRETTVVWDKKTG+PIYNAIVWQSRQTAPIA+QLKQ+GH
Sbjct:    62 AGAFIESSIKPSQIEAIGITNQRETTVVWDKKTGVPIYNAIVWQSRQTAPIAEQLKQDGH   121

Query:   123 TNMIHEKTGLVIDAYFSATKVRWILDHVPGAQERAEKGELLEGTIDTWLVWKLTDGLVHV   182
             T MIHEKTGLVIDAYFSATK+RWILDHVPGAQERAEKGELLEGTIDTWLVWKLTDG VHV
Sbjct:   122 TKMIHEKTGLVIDAYFSATKIRWILDHVPGAQERAEKGELLEGTIDTWLVWKLTDGAVHV   181

Query:   183 TDYSNA   188
             TDYSNA
Sbjct:   182 TDYSNA   187
```

Based on this analysis, it was predicted that these proteins and their epitopes could be useful antigens for vaccines or diagnostics.

Example 2198

A DNA sequence (GBSx2317) was identified in *S. agalactiae* <SEQ ID 6787> which encodes the amino acid sequence <SEQ ID 6788>. This protein is predicted to be glycyl-tRNA synthetase beta chain (glyS). Analysis of this protein sequence reveals the following:

Possible site: 18
>>> Seems to have no N-terminal signal sequence

----- Final Results ----- bacterial cytoplasm --- Certainty = 0.2933 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:CAB14468 GB:Z99117 glycyl-tRNA synthetase (beta subunit)
[Bacillus subtilis]
Identities = 315/687 (45%), Positives = 447/687 (64%), Gaps = 21/687 (3%)
Query:     3 KDLLLELGLEELPAYVVTPSEKQLGQKMVKFLEDHRLSFETVQIFSTPRRLAVRVKGLAD    62
             +DLLLE+GLEE+PA  + S QLG K+ +L++  ++    V++F+TPRRLAV VK +A+
Sbjct:     4 QDLLLEIGLEEMPARFLNESMVQLGDKLTGWLKEKNITHGEVKLFNTPRRLAVFVKDVAE    63

Query:    63 QQTDLTEDFKGPSKKIALDAEGNFSKAAQGFVRGKGLSVDDIEFREVKGEEYVYVTKHET   122
             +Q D+ E+ KGP+KKIALDA+GN++KAA GF +G+G +V+D+  +EVKG EYV+V K +
Sbjct:    64 KQDDIKEEAKGPAKKIALDADGNWTKAAIGFSKGQGANVEDLYIKEVKGIEYVFVQKFQA   123

Query:   123 GKSAIDVLASVTEVLTELTFPVNMHWANNSFEYIRPVHTLVVLLDDQALELDFLDIHSGR   182
             G+      +L  ++  ++T L FP NM W N      YIRP+  +V L      ++ SGR
Sbjct:   124 GQETKSLLPELSGLITSLHFPKNMRWGNEDLRYIRPIKWIVALFGQDVIPFSITNVESGR   183

Query:   183 ISRGHRFLGSDTEISSASSYEDDLRQQFVIADAKERQQMIVNQIHAIEEKKNISVEIDED   242
             ++GHRFLG +  I S S+YE+ L+ Q VIAD    R+QMI +Q+   +   N S+ +DED
Sbjct:   184 TTQGHRFLGHEVSIESPSAYEEQLKGQHVIADPSVRKQMIQSQLETMAAENNWSIPVDED   243

Query:   243 LLNEVLNLVEYPTAFLGSFDEKYLDVPEEVLVTSMKNHQRYFVVRDRDGKLLPNFISVRN   302
             LL+EV +LVEYPTA  GSF+  ++L +PEEVLVT+MK HQRYF V+D++G LLP+FI+VRN
Sbjct:   244 LLDEVNHLVEYPTALYGSFESEFLSIPEEVLVTTMKEHQRYFPVKDKNGDLLPHFITVRN   303

Query:   303 GNAEHIENVIKGNEKVLVARLEDGEFFWQEDQKLNIADLVEKLKQVTFHEKIGSLYEHMD   362
             GN+   IENV +GNEKVL ARL D  FF++EDQKLNI   V+KL+ + FHE++GSL + +
Sbjct:   304 GNSHAIENVARGNEKVLRARLSDASFFYKEDQKLNIDANVKKLENIVFHEELGSLADKVR   363

Query:   363 RVKVISQYLAEKADLSDEEKLAVLRAASIYKFDLLTGMVDEFDELQGIMGEKYALLAGEQ   422
             RV  I++ LA +    ++    V RAA I KFDL+T M+ EF ELQGIMGEKYA + GE
Sbjct:   364 RVTSIAEKLAVRLQADEDTLKHVERAAEISKFDLVTHMIYEFFELQGIMGEKYARMLGED   423

Query:   423 PAVAAAIREHYMPTSADGELPETRVGAILALADKFDTLLSFFSVGLIPSGSNDPYALRRA   482
              AVAAA+ EHYMP SA GE P T  GA++A+ADK DT+  SFFS+G+IP+GS DPY L R
Sbjct:   424 EAVAAAVNEHYMPRSAGGETPSTFTGAVVAMADKLDTIASFFSIGVIPTGSQDPYGLPRQ   483

Query:   483 TQGIVRILEAFGWDIPLDELVTNLYGLSFASLDYANQKEVMAFISARIEKMIGS-KVPKD   541
                GIV IL    W I  +EL+T     F  D  N  E++ F  R++  ++ +   D
Sbjct:   484 ASGIVAILLDRNWGISFEELLT------FVQTDKEN--ELLDFFTQRLKYVLNAEQIRHD   535
```

```
-continued

Query: 542  IREAVLESDIYIVSLILEASQALVQKSKDAQYKVSVESLSRAFNLAEKVTHSVLVDSSLF  601
            + +AVLES       L  +Q L QK      +K + E+L R  ++++K      +   LF
Sbjct: 536  VIDAVLESSELEPYSALHKAQVLEQKLGAPGFKETAEALGRVISISKKGVRGD-IQPDLF  594

Query: 602  ENNQEKALYQAILSLELTEDMHDNLDK---------LFALSPIINDFFDNTMVMTDDEKM  652
            EN  E  L+ A  + +  E++ +N  K           L AL   I+ +FD+DMV+ D+E +
Sbjct: 595  ENEYEAKLFDAYQTAK--ENLQENFSKKDYEAALASLAALKEPIDAYFDHIMVIADNESL  652

Query: 653  KQNRLAILNSLVAKARTVAAFNLLNTK                                  679
            K NRLA + SL  + ++ A  N L  K
Sbjct: 653  KANRLAQMVSLADEIKSFANMNALIVK                                  679
```

A related DNA sequence was identified in *S. pyogenes* <SEQ ID 2835> which encodes the amino acid sequence <SEQ ID 2836>. Analysis of this protein sequence reveals the following:

Possible site: 42
>>> Seems to have no N-terminal signal sequence

```
INTEGRAL  Likelihood = -0.96   Transmembrane  450-466 (450-466)
----- Final Results -----
    bacterial membrane --- Certainty = 0.1383 (Affirmative) <succ>
    bacterial outside  --- Certainty = 0.0000 (Not Clear)   <succ>
    bacterial cytoplasm --- Certainty = 0.0000 (Not Clear)   <succ>
```

An alignment of the GAS and GBS proteins is shown below.

```
Identities = 505/679 (74%), Positives = 578/679 (84%)

Query:   1  MTKDLLLELGLEELPAYVVTPSEKQLGQKMVKFLEDHRLSFETVQIFSTPRRLAVRVKGL   60
            M+K+LL+ELGLEELPAYVVTPSEKQLG+++  FL ++RLSFE +Q FSTPRRLAVRV GL
Sbjct:   1  MSKNLLIELGLEELPAYVVTPSEKQLGERLATFLTENELSFEDIQTFSTPRELAVRVSGL   60

Query:  61  ADQQTDLTEDFKGPSKKIALDAEGNESKAAQGFVRGKGLSVDDIEFREVKGEEYVYVTKH  120
            ADQQTDLTEDFKGP+KKIALDA+GNFSKAAQGFVRGKGL+ D IEFREVKGEEYVYVTKH
Sbjct:  61  ADQQTDLTEDFKGPAKKIALDADGNFSKAAQGFVRGKGLTTDAIEFREVKGEEYVYVTKH  120

Query: 121  ETGKSAIDVLASVTEVLTELTFPVNMHWANNSFEYIRPVHTLVVLLDDQALELDFLDIHS  180
            E GK A +VL   VTEVL+ +TFPV+MHWANNSFEYIRPVHTL VLL+D+ALELDFLDIHS
Sbjct: 121  EAGKPAKEVLLGVTEVLSAMTFPVSMHWANNSFEYIRPVHTLTVLLNDEALELDFLDIHS  180

Query: 181  GRISRGHRFLGSDTEISSASSYEDDLRQQFVIADAKERQQMIVNQIHAIEEKKNISVEID  240
            GR+SRGHRFLG++T I+SA SYE DLR QFVIADAKERQ+MIV QI  +E ++ + V+ID
Sbjct: 181  GRVSEGHRFLGTETTITSADSYEADLRSQFVIADAKERQEMIVEQIKTLEVEQGVQVDID  240

Query: 241  EDLLNEVLNLVEYPTAFLGSFDEKYLDVPEEVLVTSMKNHQRYFVVRDRDGKLLPNFISV  300
            EDLLNEVLNLVE+PTAF+GSF+  KYLDVPEEVLVTSMKNHQRYFVVRD+ G L+PNF SV
Sbjct: 241  EDLLNEVLNLVEFPTAFMGSFEAKYLDVPEEVLVTSMKNHQRYFVVRDQAGHLMPNFVSV  300

Query: 301  RNGNAEHIENVIKGNEKVLVARLEDGEFFWQEDQKLNIADLVEKLKQVTFHEKIGSLYEH  360
            RNGN +  IENVIKGNEKVLVARLEDGEFFW+EDQKL IADLV KL  VTFHEKIGSL EH
Sbjct: 301  RNGNDQAIENVIKGNEKVLVARLEDGEFFWEEDQKLQIADLVAKLTNVTFHEKIGSLAEH  360

Query: 361  MDRVKVISQYLAEKADLSDEEKLAVLRAASIYKFDLLTGMVDEFDELQGIMGEKYALLAG  420
            MDR +VI+  LA++A+LS EE  AV  AA IYKFDLLTGMV EFDELQGIMGEKYALLAG
Sbjct: 361  MDRTRVIAASLAKEANLSAEEEVTAVDRAAQIYKFDLLTGMVGEFDELQGIMGEKYALLAG  420

Query: 421  EQPAVAAAIREHYMPTSADGELPETRVGAILALADKFDTLLSFFSVGLIPSGSNDPYALR  480
            E   AVA AIREHY+P +A G LPET+VGA+LALA K DTLLSFFSVGLIPSGSNDPYALR
Sbjct: 421  EDAAVATAIREHYLPDAAGGALPETKVGAVLALAAKLDTLLSFFSVGLIPSGSNDPYALR  480

Query: 481  RATQGIVRILEAFGWDIPLDELVTNLYGLSFASLDYANQKEVMAFISARIEKMIGSKVPK  540
            RATQGIVRIL+ FGW IP+D+LV +LY LSF SL YAN+ +VM FI AR++KM+G   PK
Sbjct: 481  RATQGIVRILDHFGWRIPMDKLVDSLYDLSFDSLTYANKADVMNFIRARVDKMMGKAAPK  540

Query: 541  DIREAVLESDTYIVSLILEASQALVQKSKDAQYKVSVESLSRAFNLAEKVTHSVLVDSSL  600
            DIREA+L S T++V  +L A++ALV+ S    YK +VESLSRAFNLAEK   SV VD SL
Sbjct: 541  DIREAILASSTFVVPEMLAAAEALVKASHTENYKPAVESLSRAFNLAEKADASVQVDPSL  600

Query: 601  FENNQEKALYQAILSLELTEDMKDNLDKLFALSPIINDFFDNTMVMTDDEKMKQNRLAIL  660
            FEN QE  L+ AI  L L         L+++FALSP+INDFFDNTMVM  D+ +K NRLAIL
Sbjct: 601  FENEQENTLFAAIQGLTLAGSAAQQLEQVFALSPVINDFFDNTMVMAGDQALKNNRLAIL  660

Query: 661  NSLVAKARTVAAFNLLNTK                                          679
             + LV+KA+T+  AFN LNTK
Sbjct: 661  SDLVSKAKTIVAFNQLNTK                                          679
```

Based on this analysis, it was predicted that these proteins and their epitopes could be useful antigens for vaccines or diagnostics.

Example 2199

A DNA sequence (GBSx2318) was identified in *S. agalactiae* <SEQ ID 6789> which encodes the amino acid sequence <SEQ ID 6790>. Analysis of this protein sequence reveals the following:

Possible site: 13
>>> Seems to have no N-terminal signal sequence
----- Final Results -----
   bacterial cytoplasm --- Certainty = 0.2182 (Affirmative) <succ>
     bacterial membrane --- Certainty = 0.0000 (Not Clear) <succ>
       bacterial outside --- Certainty = 0.0000 (Not Clear) <succ>

The protein has homology with the following sequences in the GENPEPT database.

```
>GP: AAD24436 GB: AF112858 NAD(P)H dehydrogenase [Bacillus stearothermophilus]
Identities = 64/174 (36%), Positives = 98/174 (55%), Gaps = 6/174 (3%)

Query:     2 NTLIVNSHPDFSNPYSFTTILQEKFIELYNEHFPNHQLSILNLYDCVLPEITKEVLLSIW      61
             N L + +HP   +  S++ + + FI+ Y +  P+H++   L+LY    +PEI  +V  S W
Sbjct:     3 NVIZITAHPH-DDTQSYSMAVGKAFIDTYKQVHPDHEVIHLDLYKEYIPEIDVDVF-SGW      60

Query:    62 SKQRKGL---ELTADEIVQAKISKDLLEQFKSHHRIVFVSPMHNYNVTARAKTYIDNIFI     118
                K R G     EL+ +E +      +L EQF S  + VFV+PM N++      K YID + +
Sbjct:    61 GKLRSGKSFEELSDEEKAKVGRMNELCEQFISADKYVFVTPMWNFSFPPVLKAYIDAVAV     120

Query:   119 AGETFKYTENGSVGLMTDDYRLLMLESAGSIYSKGQYSPYEPPVHYLKAIFKDF         172
             AG+TFKYTE G VGL+TD  + L +++ G  YS+G  +  E     YL  I + F
Sbjct:   121 AGKTFKYTEQGPVGLLTDK-KALHIQARGGFYSEGPAAEMEMGHRYLSVIMQFF         173
```

No corrresponding DNA sequence was identified in *S. pyogenes*.

Based on this analysis, it was predicted that this protein and its epitopes, could be useful antigens for vaccines or diagnostics.

Example 2200

A DNA sequence (GBSx2319) was identified in *S. agalactiae* <SEQ ID 6791> which encodes the amino acid sequence <SEQ ID 6792>. This protein is predicted to be glycyl-tRNA synthetase (glyQ). Analysis of this protein sequence reveals the following:

Possible site: 56
>>> Seems to have no N-terminal signal sequence
----- Final Results -----
   bacterial cytoplasm --- Certainty = 0.1364 (Affirmative) <succ>
     bacterial membrane --- Certainty = 0.0000 (Not Clear) <succ>
       bacterial outside --- Certainty = 0.0000 (Not Clear) <succ>

A related GBS nucleic acid sequence <SEQ ID 9521> which encodes amino acid sequence <SEQ ID 9522> was also identified.

The protein has homology with the following sequences in the GENPEPT database.

```
>GP:BAB05089 GB:AP001511 glycyl-tRNA synthetase (alpha subunit)
[Bacillus halodurans]
Identities = 222/287 (77%), Positives = 250/287 (86%)
Query:     6 LTFQEIILTLQQFWNDQGCMLMQAYDNEKGAGTMSPYTFLRAIGPEPWNAAYVEPSRRPA      65
             +   Q +ILTLQ++W+ Q C+L+QAYD EKGAGTMSPYT LR IGPEPWN AYVEPSRRPA
Sbjct:     1 MNVQTMILTLQEYWSKQNCILLQAYDTEKGAGTMSPYTMLRTIGPEPWNVAYVEPSRRPA      60

Query:    66 DGRYGENPNRLYQHHQFQVVMKPSPSNIQELYLKSLELLGINPLEHDIRFVEDNWENPST     125
             DGRYGENPNRLYQHHQFQV+MKPSP+NIQELYL  SL   LGINPLEHDIRFVEDNWENPS
Sbjct:    61 DGRYGENPNRLYQHHQFQVIMKPSPTNIQELYLDSLRALGINPLEHDIRFVEDNWENPSL     120

Query:   126 GSAGLGWEVWLDGMEITQFTYFQQVGGLQTGPVTSEVTYGLERLASYIQEVDSVYDIEWA     185
             G AGLGWEVWLDGMEITQFTYFQQVGGL+   PV++E+TYGLERLASYIQ+ ++V+D+EW
Sbjct:   121 GCAGLGWEVWLDGMEITQFTYFQQVGGLEANPVSAEITYGLERLASYIQDKENVEDLEWV     180

Query:   186 PGVKYGEIFTQPEYEHSKYSFEISDQVMLLENFEKFEREAKRALEEGLVHPAYDYVLKCS     245
              G   YG+IFTQPEYEHSKY+FE+SD  ML  E F   +E+EA RALEE LV PAYDYVLKCS
Sbjct:   181 EGFTYGDIFTQPEYEHSKYTFEVSDSAMLFELFSTYEKEADRALEENLVFPAYDYVLKCS     240
```

```
                              -continued
Query: 246  HTFNLLDARGAVSVTERAGYIARIRNLARVVAKTEVAERKKLGFPLL          292
            HTFNLLDARGA+SVTER GYI R+RNLAR  AK +   ER+KLGFP+L
Sbjct: 241  HTFNLLDARGAISVTERTGYIGRVRNLARKCAKKYYEEREKLGFPML          287
```

A related DNA sequence was identified in *S. pyogenes* <SEQ ID 6793> which encodes the amino acid sequence <SEQ ID 6794>. Analysis of this protein sequence reveals the following:

Possible site: 55
>>> Seems to have no N-terminal signal sequence
----- Final Results -----
    bacterial cytoplasm --- Certainty = 0.2081 (Affirmative) <succ>
       bacterial membrane --- Certainty = 0.0000 (Not Clear) <succ>
          bacterial outside --- Certainty = 0.0000 (Not Clear) <succ>

An alignment of the GAS and GBS proteins is shown below.

```
Identities = 290/304 (95%), Positives = 294/304 (96%)
Query:   2  MSKKLTFQEIILTLQQFWNDQGCMLMQAYDNEKGAGTMSPYTFLRAIGPEPWNAAYVEPS   61
            MSKKLTFQEIILTLQQ+WNDQGCMLMQAYDNEKGAGTMSPYTFLRAIGPEPWNAAYVEPS
Sbjct:   1  MSKKLTFQEIILTLQQYWNDQGCMLMQAYDNEKGAGTMSPYTFLRAIGPEPWNAAYVEPS   60

Query:  62  RRPADGRYGENPNRLYQHHQFQVVMKPSPSNIQELYLKSLELLGINPLEHDIRFVEDNWE  121
            RRPADGRYGENPNRLYQHHQFQVVMKPSPSNIQELYL  SLE LGINPLEHDIRFVEDNWE
Sbjct:  61  RRPADGRYGENPNRLYQHHQFQVVMKPSPSNIQELYLASLEKLGINPLEHDIRFVEDNWE  120

Query: 122  NPSTGSAGLGWEVWLDGMEITQFTYFQQVGGLQTGPVTSEVTYGLERLASYIQEVDSVYD  181
            NPSTGSAGLGWEVWLDGMEITQFTYFQQVGGL T PVT+EVTYGLERLASYIQEVDSVYD
Sbjct: 121  NPSTGSAGLGWEVWLDGMEITQFTYFQQVGGLATSPVTAEVTYGLERLASYIQEVDSVYD  180

Query: 182  IEWAPGVKYGEIFTQPEYEHSKYSFEISDQVMLLENFEKFEREAKRALEEGLVHPAYDYV  241
            IEWAPGVKYGEIF QPEYEHSKYSFEISDQ MLLENFEKFE+EA RALEEGLVHPAYDYV
Sbjct: 181  IEWAPGVKYGEIFLQPEYEHSKYSFEISDQDMLLENFEKFEKEASRALEEGLVHPAYDYV  240

Query: 242  LKCSHTFNLLDARGAVSVTERAGYIARIRNLARVVAKTFVAERKKLGFPLLDEETRIKLL  301
            LKCSHTFNLLDARGAVSVTERAGYIARIRNLARVVAKTFVAERKKLGFPLLDE TR  LL
Sbjct: 241  LKCSHTFNLLDARGAVSVTERAGYIARIRNLARVVAKTFVAERKKLGFPLLDEATRAILL  300

Query: 302  AEED                                                         305
            AE+D
Sbjct: 301  AEDD                                                         304
```

Based on this analysis, it was predicted that these proteins and their epitopes could be useful antigens for vaccines or diagnostics.

Example 2201

A DNA sequence (GBSx2320) was identified in *S. agalactiae* <SEQ ID 6795> which encodes the amino acid sequence <SEQ ID 6796>. This protein is predicted to be vacB protein (vacB). Analysis of this protein sequence reveals the following:

Possible site: 60
>>> Seems to have no N-terminal signal sequence
----- Final Results -----
    bacterial cytoplasm --- Certainty = 0.2966 (Affirmative) <succ>
       bacterial membrane --- Certainty = 0.0000 (Not Clear) <succ>
          bacterial outside --- Certainty = 0.0000 (Not Clear) <succ>

A related GBS nucleic acid sequence <SEQ ID 9399> which encodes amino acid sequence <SEQ ID 9400> was also identified.

The protein has homology with the following sequences in the GENPEPT database.

```
>GP:CAB15366 GB:Z99121 similar to hypothetical proteins [Bacillus subtilis]
Identities = 338/780 (43%), Positives = 485/780 (61%), Gaps = 47/780 (6%)
Query:    4 AKAFPKLIKTISNLESHRQL---RFDDNGSLSLQKKEAKKKEITVRGLFRANKAGFGFL-    59
            A+ F +L+K + LE   +  R D G         +K ++G  A+ GF FL
Sbjct:   36 AEEFKELVKALVALEEKGLIVRTRSDRYG--------IPEKMNLIKGKISAHAKGFAFLL    87

Query:   60 SIDQDEDDMFIGKNDIAYAIDGDTVEAVVKKPADRLNGTAAEARVVNIVERSLKTLVGKF   119
               D    D+FI  N++  A++GD V   +    +G+  E  V+ I+ER+++ +VG +
Sbjct:   88 PEDTSLSDVFIPPNELNTAMNGDIVMVRLNSQS---SGSRQEGTVIRILERAIQRVVGTY   144

Query:  120 VLDDERPKYAGYIKSKNQKINQKIYIRKEPV--VLDGTEIIKVDIDKYPIRGHDYFVASV   177
               +   G++   ++KI  I+I K      +G +++ V +  YP G         V
Sbjct:  145 T----ETRNFGKVIPDDKKITSDIFIPKNGKNGAAEGHKVV-VKLTSYP-EGRMNAEGEV   198

Query:  178 RDIVGHQGDVGIDVLEVLESMDIVSEFPEDVIAEANAIPDAPTEKDLIGRVDLRQEVTFT   237
             I+GH+ D GID+L V+     + EFP D + +A++ PD    EKDL  R  DLR +V  T
Sbjct:  199 ETILGHKNDPGIDILSVIHKHGLPGEFPADAMEQASSTPDTIDEKDLKDRRDLRDQVIVT   258

Query:  238 IDGADAKDLDDAVHIKLLDNGHFELGVHIADVSYYVTEGSALNREALSRGTSVYVTDRVV   297
            IDGADAKDLDDAV +   LD+G ++LGVHIADVS+YVTE S +++EAL RGTSVY+ DRV+
Sbjct:  259 IDGADAKDLDDAVIVTKLDDGSYKLGVHIADVSHYVTENSPIDKEALERGTSVYLVDRVI   318

Query:  298 PMLPERLSNGICSLNPNLDRLTQSCIMEIDQNGRVVNHQITQSVINTTYRMTYTAVNDII   357
            PM+P RLSNGICSLNP +DRLT SC M I+   G+V  H+I QSVI TT RMTY+ VN I+
Sbjct:  319 PMIPHRLSNGICSLNPKVDRLTLSCEMTINSQGQVTEHEIFQSVIKTTERMTYSDVNKIL   378

Query:  358 A-GDEEICSEYESIVSSVQHMVTLHHTLEAMKTRRGALNFDTSEAKIMVNDKGMPVDIVI   416
                 DEE+  +YE +V   + M  L     R RGA++FD  EAK++V+D+G   D+VI
Sbjct:  379 VDDDEELKQKYEPLVPMFKDMERLAQILRDKRMDRGAVDFDFKEAKVLVDDEGAVKDVVI   438

Query:  417 RNRGIAERMIESFMLAANETVAEHYARLKLPFIYRIHEEPKAEKLQKFIDYASVFGVQIQ   476
            R R +AE++IE FML ANETVAEH+  + +PFIYRIHEEP AEKLQKF+++ + FG  ++
Sbjct:  439 RERSVAEKLIEEFMLVANETVAEHFHWMNVPFIYRIHEEPNAEKLQKFLEFVTTFGYVVK   498

Query:  477 GTATKITQSALQDFMKKVQGQPGSEVLSMMLLRSMQQARYSEHNHGHYGLAAEYYTHFTS   536
            GTA  I    ALQ  + V+ +P   V+S ++LRSM+QA+Y   + GH+GL+ E+YTHFTS
Sbjct:  499 GTAGNIHPRALQSILDAVRDRPEETVISTVMLRSMKQAKYDPQSLGHFGLSTEFYTHFTS   558

Query:  537 PIRRYPDLLVHRMIRDY-DDKAMDKA--DHFANLIPEIATQTSSLERRAIDAERIVEAMK   593
            PIRRYPDL+VHR+IR Y  + +D+A  + +A  +P+IA  TSS+ERRA+DAER  +K
Sbjct:  559 PIRRYPDLIVHRLIRTYLINGKVDEATQEKWAERLPDIAEHTSSMERRAVDAERETDDLK   618

Query:  594 KAEYMEEYVGEEFEGVVASVVKFGMFVELPNTIEGLIHVTTL-PEYYHFNERTLTLQGEK   652
            KAEYM + +GEEF+G+++SV  FGMFVELPNTIEGL+HV + +YY F+E+   + GE+
Sbjct:  619 KAEYMLDKIGEEEDGMISSVTNFGMFVELPNTIEGLVHVSFMTDDYYRFDEQHFAMIGER   678

Query:  653 SGKVFRVGQQIKVKLIRSDKETGDIDFDYLPSDFDIVEKVSKSSREGRPNRSSKREHQHR   712
            +G VFR+G +I VK++  +K+ +IDF+ +          +G P R + +
Sbjct:  679 TGNVFRIGDEITVKVVDVNKDERNIDFEIV-------------GMKGTPRRPRELD----   721

Query:  713 ISDRDNKNKNTSKKKASRKPKRNSDSKSHHHKDDRTTGSTKKKTKKPFYKGVAKKGQKRK   772
             S R  K   ++K+       S + S   K +  T   KKK K+ F     +K +K+K
Sbjct:  722 -SSRSRKRGKPARKRVQSTNTPVSPAPS-EEKGEWFTKPKKKKKKRGFQNAPKQKRKKKK   779
```

A related DNA sequence was identified in *S. pyogenes* <SEQ ID 6797> which encodes the amino acid sequence <SEQ ID 6798>. Analysis of this protein sequence reveals the following:

Possible site: 30
>>> Seems to have no N-terminal signal sequence

----- Final Results -----
bacterial cytoplasm --- Certainty = 0.0811 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities = 579/773 (74%), Positives = 664/773 (84%), Gaps = 22/773 (2%)
Query:    1 MAGAKAFPKLIKTISNLESHRQLRFDDNGSLSLQKKEAKKKEITVRGLFRANKAGEGFLS    60
            MAGAK FP LIKTIS +ES   LRF D+GSL+L+K+  KKKE TV+G+FRANKAGFGFL
Sbjct:   27 MAGAKHFPSLIKTISKMESQSLLRFSDDGSLALRKEREKKKEPTVQGVERANKAGFGFLH    86

Query:   61 IDQDEDDMFIGKNDIAYAIDGDTVEAVVKKPADRLNGTAAEARVVNIVERSLKTLVGKFV   120
            +D++EDDMFIG+ND+  YAIDGDTVE VVKKPADRL GTAAEA+VV IV+RSLKT VG F+
Sbjct:   87 VDENEDDMFIGRNDVGYAIDGDTVEVVVKKPADRLKGTAAEAKVVAIVDRSLKTAVGTFI   146

Query:  121 LDDERPKYAGYIKSKNQKINQKIYIRKEPVVLDGTEIIKVDIDKYPTRGHDYFVASVRDI   180
            LDD++PKYAGYI+SKNQKI QKIYI+KEPVVL GTEIIKVDIDKYP RGHDYFVASVRDI
Sbjct:  147 LDDDKPKYAGYIRSKNQKIQQKIYIKKEPVVLKGTEIIKVDIDKYPIRGHDYFVASVRDI   206
```

-continued

```
Query:  181  VGHQGDVGIDVLEVLESMDIVSEFPEDVIAEANAIPDAPTEKDLIGRVDLRQEVTFTIDG   240
             VGHQGDVGIDVLEVLESMDIVSEFP +V+AEANAI +APT KDLIGRVDLRQE T TIDG
Sbjct:  207  VGHQGDVGIDVLEVLESMDIVSEFPAEVLAEANAISEAPTAKDLIGRVDLRQETTITIDG   266

Query:  241  ADAKDLDDAVHIKLLDNGHFELGVHIADVSYYVTEGSALNREALSRGTSVYVTDRVVPML   300
             ADAKDLDDA+HIKLLDNG++ELGVHIADVSYYVTEGSAL++EA++RGTSVYVTDRVVPML
Sbjct:  267  ADAKDLDDAIHIKLLDNGNYELGVHIADVSYYVTEGSALDKEAIARGTSVYVTDRVVPML   326

Query:  301  PERLSNGICSLNPNLDRLTQSCIMEIDQNGRVVNHQITQSVINTTYRMTYTAVNDIIAGD   360
             PERLSNGICSLNPN+DRLTQS +MEI+  G VVN+QI QSVI TTYRMTY+ VND+IAGD
Sbjct:  327  PERLSNGICSLNPNIDRLTQSALMEINSQGHVVNYQICQSVIKTTYRMTYSTVNDMIAGD   386

Query:  361  EEICSEYESIVSSVQHMVTLHHTLEAMRTRRGALNFDTSEAKIMVNDKGMPVDIVIRNRG   420
             EE   E+ SI   V  MV LH  LEAMR++RGALNFDT EAKI+VNDKGMPVD+V+R RG
Sbjct:  387  EEALQEFASIADDVTLMVALHRILEAMRSKRGALNFDTQEAKIIVNDKGMPVDVVLRQRG   446

Query:  421  IAERMIESFMLAANETVAEHYARLKLPFIYRIHEEPKAEKLQKFIDYASVFGVQIQGTAT   480
             IAERMIESFMLAANE VAEH+A+ KLPFIYRIHEEPKAEKLQ+FIDYAS FG+ IQGTA
Sbjct:  447  IAERMIESFMLAANECVAEHFAKAKLPFIYRIHEEPKAEKLQQFIDYASTFGIHIQGTAN   506

Query:  481  KITQSALQDFMKKVQGQPGSEVLSMMLLRSMQQARYSEHNHGHYGLAAEYYTHETSPIRR   540
             KI+Q ALQ FM KV+GQPG+EVL+MMLLRSMQQARYSEHNHGHYGLAAEYYTHETSPIRR
Sbjct:  507  KISQEALQAFMAKVEGQPGAEVLNMMLLRSMQQARYSEHNHGHYGLAAEYYTHFTSPIRR   566

Query:  541  YPDLLVHRMIRDYDDKAMDKADHFANLIPEIATQTSSLERRAIDAERIVEAMKKAEYMEE   600
             YPDLLVHRM+R+Y+  + +K DHFA +IPE+AT +S LERRAIDAER+VEAMKKAEYM E
Sbjct:  567  YPDLLVHRMVREYNQPSQEKRDHFAQIIPELATSSSQLERRAIDAERVVEAMKKAEYMAE   626

Query:  601  YVGEEFEGVVASVVKFGMFVELPNTIEGLIHVTTLPEYYHFNERTLTLQGEKSGKVFRVG   660
             YVGEEF+G+V+SVVKFG FVELPNTIEGL+H+T+LPEYYH ENERTL+LQGEKSGKVF+VG
Sbjct:  627  YVGEEFDGIVSSVVKFGFFVELPNTIEGLVHITSLPEYYHENERTLSLQGEKSGKVFKVG   686

Query:  661  QQIKVKLIRSDKETGDIDFDYLPSDFDIVEKVSKSSREGRPNRSSKREHQHRISDRDNKN   720
             Q I+VKL+++DKETGDIDF+YLPSDFD+VEK+  S +  R +R                K+
Sbjct:  687  QPIRVKLVKADKETGDIDFEYLPSDFDVVEKIKMSDKASRRDR--------------RKS   732

Query:  721  KNTSKKKASRKPKRNSDSKSHHHKDDRTTGSTKKKTKKPFYKGVAKKGQKRKS         773
             +SK   ++PK +  +K          T G TKK +KKPFYK  AKK   +++S
Sbjct:  733  SKSSKGTKKKEPKEVAKAK--------TKGKTKKGSKKPFYKEQAKKKSRKRS         777
```

Based on this analysis, it was predicted that these proteins and their epitopes could be useful antigens for vaccines or diagnostics.

Example 2202

A DNA sequence (GBSx2321) was identified in *S. agalactiae* <SEQ ID 6799> which encodes the amino acid sequence <SEQ ID 6800>. This protein is predicted to be VacB homolog (smpB). Analysis of this protein sequence reveals the following:

Possible site: 41
>>> Seems to have no N-terminal signal sequence
----- Final Results -----
bacterial cytoplasm --- Certainty = 0.2988 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:AAC23745 GB:AF052209 VacB homolog [Streptococcus pneumoniae]

Identities = 121/155 (78%), Positives = 139/155 (89%)

Query:    1  MVKGQGNVVAQNKKAHHDYTIVETIEAGIVLTGTEIKSVRAARITLKDGYAQIKNGEAWL   60
             M KG+G VVAQNKKA HDYTIV+T+EAG+VLTGTEIKSVRAARI LKDG+AQ+KNGE WL
Sbjct:    1  MAKGEGKVVAQNKKARHDYTIVDTLEAGMVLTGTEIKSVRAARINLKDGFAQVKNGEVWL   60

Query:   61  INVHITPYDQGNIWNQDPDRTRKLLLKKREIEKISNELKGTGMTLVPLKVYLKDGFAKVL   120
                NVHI PY++GNIWNQ+P+R RKLLL K++I+K+  E KGTGMTLVPLKVY+KDG+AK+L
Sbjct:   61  SNVHIAPYEEGNIWNQEPERRRKLLLHKKQIQKLEQETKGTGMTLVPLKVYIKDOYAKLL   120

Query:  121  LGLAKGKHDYDKRESIKRREQNRDIARQLKNYNSR                         155
             LGLAKGKHDYDKRESIKRREQNRDIAR +K  N R
Sbjct:  121  LGLAKGKHDYDKRESIKRREQNRDIARVMKAVNQR                         155
```

A related DNA sequence was identified in *S. pyogenes* <SEQ ID 6801> which encodes the amino acid sequence <SEQ ID 6802>. Analysis of this protein sequence reveals the following:

```
Possible site: 41
>>> Seems to have no N-terminal signal sequence
----- Final Results -----
   bacterial cytoplasm --- Certainty = 0.2918 (Affirmative) <succ>
      bacterial membrane --- Certainty = 0.0000 (Not Clear) <succ>
         bacterial outside --- Certainty = 0.0000 (Not Clear) <succ>
```

An alignment of the GAS and GBS proteins is shown below.

```
Identities = 124/155 (80%), Positives = 145/155 (93%)
Query:   1  MVKGQGNVVAQNKKAHHDYTIVETIEAGIVLTGTEIKSVRAARITLKDGYAQIKNGEAWL   60
            M KG+G+++AQNKKA HDY IVET+EAGIVLTGTEIKSVRAARI LKDG+AQIKNGEAWL
Sbjct:   1  MAKGEGHILAQNKKARHDYHIVETVEAGIVLTGTEIKSVRAARIQLKDGFAQIKNGEAWL   60

Query:  61  INVHITPYDQGNIWNQDPDRTRKLLLKKREIEKISNELKGTGMTLVPLKVYLKDGFAKVL  120
            +NVHI P++QGNIWN DP+RTRKLLLKKREI ++NELKG+GMTLVPLKVYLKDGFAKVL
Sbjct:  61  VNVHIAPFEQGNIWNADPERTRKLLLKKREITHLANELKGSGMTLVPLKVYLKDGFAKVL  120

Query: 121  LGLAKGKHDYDKRESIKRREQNRDIARQLKNYNSR                          155
            +GLAKGKH+YDKRE+IKRR+Q RDI +Q+K+YN+R
Sbjct: 121  IGLAKGKHEYDKRETIKRRDQERDIKKQMKHYNAR                          155
```

Based on this analysis, it was predicted that these proteins and their epitopes could be useful antigens for vaccines or diagnostics.

Example 2203

A DNA sequence (GBSx2322) was identified in *S. agalactiae* <SEQ ID 6803> which encodes the amino acid sequence <SEQ ID 6804>. Analysis of this protein sequence reveals the following:

```
Possible site: 14
>>> Seems to have no N-terminal signal sequence
----- Final Results -----
   bacterial cytoplasm --- Certainty = 0.6876 (Affirmative) <succ>
      bacterial membrane --- Certainty = 0.0000 (Not Clear) <succ>
         bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2204

A DNA sequence (GBSx2323) was identified in *S. agalactiae* <SEQ ID 6805> which encodes the amino acid sequence <SEQ ID 6806>. This protein is predicted to be d-serine/d-alanine/glycine transporter (cycA). Analysis of this protein sequence reveals the following:

```
Possible site: 55
>>> Seems to have a cleavable N-terminal signal sequence
INTEGRAL    Likelihood = -9.02    Transmembrane  71-87 (62-90)
INTEGRAL    Likelihood = -8.92    Transmembrane  320-336 (316-344)
INTEGRAL    Likelihood = -8.33    Transmembrane  254-270 (251-275)
INTEGRAL    Likelihood = -6.00    Transmembrane  158-174 (154-175)
INTEGRAL    Likelihood = -2.76    Transmembrane  197-213 (196-213)
INTEGRAL    Likelihood = -2.50    Transmembrane  117-133 (116-136)
INTEGRAL    Likelihood = -1.38    Transmembrane  282-298 (279-298)
INTEGRAL    Likelihood = -0.32    Transmembrane  342-358 (342-360)
----- Final Results -----
   bacterial membrane --- Certainty = 0.4609 (Affirmative) <succ>
      bacterial outside --- Certainty = 0.0000 (Not Clear) <succ>
         bacterial cytoplasm --- Certainty = 0.0000 (Not Clear) <succ>
```

A related GBS nucleic acid sequence <SEQ ID 9397> which encodes amino acid sequence <SEQ ID 9398> was also identified.

The protein has homology with the following sequences in the GENPEPT database.

```
>GP:CAB14651 GB:Z99117 amino acid permease [Bacillus subtilis]
Identities = 165/361 (45%), Positives = 227/361 (62%), Gaps = 17/361 (4%)
Query:   1  MGIFLT-LSYWISLIFIGMAEITAVGEYVQFWFPEWPSWIIQIVFLAILSSINLIAVKAF   59
            M  F+T  +YW   I + MA++TAVG Y Q+W P+ P W+++    L IL  +NL  VK F
Sbjct:  95  MAAFITGWTYWFCWISLAMADLTAVGIYTQYWLPDVPQWLPGLLALIILLIMNLATVKLF  154

Query:  60  GETEFWFAMIKVIAILGLIATGIPMVLTNFDTGHGYHASISNITNHFEWFPKGKLNFFMA  119
            GE EFWFA+IKVIAIL LI TGI ++    F   G  AS++N+ +H   FP G   F ++
Sbjct: 155  GELEFWFALIKVIAILALIVTGILLIAKGFSAASG-PASLNNIRSHGGMFPNGWHGFILS  213

Query: 120  FQMVFFAYLAIEFVGVTISETANPRKVLPKAIQEIPMRIILFYAGSLLAIMAIFPWQQLP  179
            FQMV FA++ IE VG+T  ET NP+KV+PKAI +IP+RI+LFY G+L  IM I+PW L
Sbjct: 214  FQMVVFAFVGIELVGLTAGETENPQKVIPKAINQIPVRILLFYVGALFVIMCIYPWNVLN  273

Query: 180  VNESPFVTVFKLAGIKWAAALINFVVLTSAASALNSTLYSTGRHLFQLANE--SPNALTK  237
             NESPFV VF   GI  AA+LINFVVLTSAASA NS L+ST R ++  LA +  +P  L K
```

-continued

```
Sbjct: 274  PNESPFVQVFSANGIVVAASLINFVVLISAASAANSALFSTSRMVYSLARDHHAPGLLKK  333

Query: 238  ALKLDQLSRQSVPSRAIIAS--AVIVGASALISVLPGISDAFSLITASSSGVYISIYVLI  295
            L+  +VPS A+  S   A+++G S L  ++P      F+LIT+ S+  +I I+ +
Sbjct: 334  ------LTSSNVPSNALFFSSIAILIGVS-LNYLMP--EQVFTLITSVSTICFIFIWGIT  384

Query: 296  MIAHWKYRKS--PDFMEDGYKMPAYKILSPITLLFFLFVFVSLFLQDSTYIGAIGATIWII  354
            +I H KYRK+   +   + +KMP Y + + +TL F  F+ V L L + T I      +W +
Sbjct: 385  VICHLKYRKTRQHEAKANKFKMPFYPLSNYLTLAFLAFILVILALANDTRIALFVTPVWFV  445
```

There is also homology to SEQ ID 4070:

```
Identities = 286/364 (78%), Positives = 322/364 (87%), Gaps = 1/364 (0%)
Query:   2  GIFLTLSYWISLIFIGMAEITAVGEYVQFWFPEWPSWIIQIVFLAILSSINLIAVKAFGE   61
            G F  LSYWISLIFIGMAEITAVG YVQFWFP WP+W+IQ+VFL +LSSINLIAV+ FGE
Sbjct: 101  GYFSGLSYWISLIFIGMAEITAVGNYVQFWFPSWPAWLIQLVFLVLLSSINLIAVRVFGE  160

Query:  62  TEFWFAMIKVIAILGLIATGIFMVLTNFDTGHGYHASISNITNHFEWFPKGKLNFFMAFQ  121
            TE+WFAMIK++AIL LIAT IFMVLT F+T H  HAS+SNI +HF  FP GKL FFMAFQ
Sbjct: 161  TEFWFAMIKILAILALIATAIFMVLTGFET-HTGHASLSNIFDHFSMFPNGKLKFFMAFQ  219

Query: 122  MVFFAYLAIEFVGVTTSETANPRKVLPKAIQEIPMRIILFYAGSLLAIMAIFPWQQLPVN  181
            MVFFAY AIEFVG+TTSETANPRKVLPKAIQEIP RI++FY G+L++IMAI PW QLPV+
Sbjct: 220  MVFFAYQAIEFVGITTSETANPRKVLPKAIQEIPTRIVIFYVGALVSIMAIVPWHQLPVD  279

Query: 182  ESPFVTVFKLAGIKWAAALINFVVLTSAASALNSTLYSTGRHLFQLANESPNALTKALKL  241
            ESPFV VFKL GIKWAAALINFVVLTSAASALNSTLYSTGRHL+Q+ANE+PNALT  LK+
Sbjct: 280  ESPFVMVFKLIGIKWAAALINFVVLTSAASALNSTLYSTGRHLYQIANETPNALTNRLKI  339

Query: 242  DQLSRQSVPSRAIIASAVIVGASALISVLPGISDAFSLITASSSGVYISIYVLIMIAHWK  301
            + LSRQ VPSRAIIASAV+VG SALI++LPG++DAFSLITASSSGVYI+IY L MIAHWK
Sbjct: 340  NELSRQGVPSRAIIASAVVVGISALINILPGVADAFSLITASSSGVYIAIYALTMIAHWK  399

Query: 302  YRKSPDFMEDGYKMPAYKILSPITLLFFLFVFVSLFLQDSTYIGAIGATIWIIGFGLYSH  361
            YR+S DFM DGY MP YK+ +P+TL FF FVF+SLFLQ+STYIGAIGATIWII FG+YS+
Sbjct: 400  YRQSKDFMADGYLMPKYKVTTPLTLAFFAFVFISLFLQESTYIGAIGATIWIIIFGIYSN  459

Query: 362  FKHK                                                         365
             K K
Sbjct: 460  VKFK                                                         463
```

Based on this analysis, it was predicted that these proteins and their epitopes could be useful antigens for vaccines or diagnostics.

Example 2205

A DNA sequence (GBSx2324) was identified in *S. agalactiae* <SEQ ID 6807> which encodes the amino acid sequence <SEQ ID 6808>. Analysis of this protein sequence reveals the following:

Possible site: 38
>>> Seems to have an uncleavable N-terminal signal sequence
INTEGRAL    Likelihood = −8.33    Transmembrane 194-210 (191-215)
INTEGRAL    Likelihood = −5.47    Transmembrane 17-33 (14-38)
INTEGRAL    Likelihood = −5.15    Transmembrane 125-141 (119-144)
INTEGRAL    Likelihood = −3.88    Transmembrane 155-171 (153-176)
INTEGRAL    Likelihood = −1.38    Transmembrane 96-112 (94-114)
INTEGRAL    Likelihood = −0.43    Transmembrane 49-65 (49-65)
----- Final Results -----
  bacterial membrane --- Certainty = 0.4333 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the GENPEPT database.

```
>GP:AAC95438 GB:AF068901 unknown [Streptococcus pneumoniae]
Identities = 80/214 (37%), Positives = 122/214 (56%), Gaps = 3/214 (1%)
Query:    4 FFSNIRTEIPQMPLLIHSLILSVLPFLMWLTLVNRDKPLYKTIWSILLGLQLITIYTWFF   63
            FF+    T+ P+  L  +  + ++L          R+K +Y+  +  IL  +QLI +Y W++
Sbjct:    7 FFTTQATKPPKFDLFWYVSLFTLLALTFYTAHRYREKKVYQRFFQILQTVQLILLYGWYW   66

Query:   64 WAKLPLSESLPLYHCRIGMFVVLLARPGI--LKDYFALLGVVGGVLAMIHPDFYPYQFLH  121
              +PLSESLP YHCR+ MFVVLL  PG     K YFALLG  G + A ++P    Y F H
Sbjct:   67 VNHMPLSESLPFYHCRMAMFVVLLL-PGQSKYKQYFALLGTFGTLAAFVYPVPDAYPFPH  125

Query:  122 VTNIFFFIGHFALFVLSLLHLMTQSNLDKLNPKLIIQLTLLINMSLIFINLLTGGNYGFM  181
            +T + F   GH AL     SL++L+ Q N     L+ K I  +T  +N  +   +NL+TGG+YGF+
Sbjct:  126 ITILSFIFGHLALLGNSLVYLLRQYNARLLDVKGIFLMTFALNALIFVVNLVTGGDYGFL  185

Query:  182 MKTPILGITNPFLNLFIVTTLLSFLVLFVKQIFQ                           215
              K  P++G       N  +V+ +L   +    K+I +
Sbjct:  186 TKPPLVGDHGLVANYLLVSIVLVATISLTKKILE                           219
```

A related DNA sequence was identified in *S. pyogenes* <SEQ ID 6809> which encodes the amino acid sequence <SEQ ID 6810>. Analysis of this protein sequence reveals the following:

```
Possible site: 35
>>> Seems to have no N-terminal signal sequence
INTEGRAL      Likelihood = −11.25   Transmembrane 16-32 (11-39)
INTEGRAL      Likelihood = −3.45    Transmembrane 154-170 (153-173)
INTEGRAL      Likelihood = −3.08    Transmembrane 96-112 (94-112)
INTEGRAL      Likelihood = −1.91    Transmembrane 191-207 (191-209)
INTEGRAL      Likelihood = −1.12    Transmembrane 71-87 (71-87)
----- Final Results -----
    bacterial membrane --- Certainty = 0.5501 (Affirmative) <succ>
      bacterial outside --- Certainty = 0.0000 (Not Clear) <succ>
        bacterial cytoplasm --- Certainty = 0.0000 (Not Clear) <succ>
```

The protein has homology with the following sequences in the databases:

```
>GP:AAC95438 GB:AF068901 unknown [Streptococcus pneumoniae]
Identities = 90/231 (38%), Positives = 128/231 (54%), Gaps = 7/231 (3%)
Query:    3 FFAIDPIGLPHTSLIFYLSSLLIALLLVFLTFQAYRLKS-HRYFFLFQLSQVIGLYTWY    61
            FF        P   L +Y+S L    L L F T    YR K  ++ FF   LQ   Q+I LY WY
Sbjct:    7 FFTTQATKPPKFDLFWYVS-LFTLLALTFYTAHRYREKKVYQRFFQILQTVQLILLYGWY    65

Query:   62 VLRGFPLDEALPLYHCRIAMLAIFFLPDRNKFKQLFMVLGIGGTFLALL--SPDLYPFRL  119
            +      PL E+LP YHCR+AM  +   LP ++K+KQ F +LG  GT   A +    PD YPF
Sbjct:   66 WVNHMPLSESLPFYHCRMAMFVVLLLPGQSKYKQYFALLGTFGTLAAFVYPVPDAYPFP-  124

Query:  120 WHVANVSFYFGHYALLVNGLIYLLRFYDASQLRLLSVVRYLATVNFLLLLVSLATKGNYG  179
            H+    +SF FGH ALL N L+YLLR Y+A  L +  +      +N L+ +V+L T G+YG
Sbjct:  125 -HITILSFIFGHLALLGNSLVYLLRQYNARLLDVKGIFLMTFALNALIFVVNLVTGGDYG  183

Query:  180 FVMDIPVIHTRHLLLNFVIVTSGLTFMVKITEYFYLKFGEAQQLALAFSKE           230
            F+    P++    L+ N+++V+  L   + +T+   L+F  AQ+       KE
Sbjct:  184 FLTKPPLVGDHGLVANYLLVSIVLVATISLTKKI-LEFFLAQEAEKMIVKE           233
```

An alignment of the GAS and GBS proteins is shown below.

```
Identities = 70/216 (32%), Positives = 117/216 (53%), Gaps = 1/216 (0%)
Query:    2 IEFFSNIRTEIPQMPLLIHSLILSVLPFLMWLTLVNRDKPLYKTIWSILLGLQLITIYTW   61
            ++FF+       +P   L+ +   L  +  L++LT      ++   +    L   Q+I +YTW
Sbjct:    1 MDFFAIDPIGLPHTSLIFYLSSLLIALLLVFLTFQAYRLKSHRYFFLFQLSQVIGLYTW    60

Query:   62 FFWAKLPLSESLPLYHCRIGMFVVL-LARPGILKDYFALLGVVGGVLAMIHPDFYPYQFL  120
            +          PL E+LPLYHCRI M   +  L    K F   +LG+  G   LA++   PD YP++
Sbjct:   61 YVLRGFPLDEALPLYHCRIAMLAIFFLPDRNKFKQLFMVLGIGGIFLALLSPDLYPFRLW  120

Query:  121 HVTNIFFFIGHFALFVLSLLHLMTQSNLDKLNPKLIIQLTLLINMSLIFINLLTGGNYGF  180
            HV N+ F+ GH+AL V   L+ L+      +L    +++    +N  L+ ++L T GNYGF
Sbjct:  121 HVANVSFYFGHYALLVNGLIYLLRFYDASQLRLLSVVRYLATVNFLLLLVSLATKGNYGF  180
```

-continued

```
Query: 181  MMKTPILGITNPFLNLFIVTTLLSFLVLFVKQIFQK         216
            +M  P++     +  LN  IVT+ L+F+V   +  + K
Sbjct: 181  VMDIPVIHTRHLLLNFVIVTSGLTFMVKITEYFYLK         216
```

Based on this analysis, it was predicted that these proteins and their epitopes could be useful antigens for vaccines or diagnostics.

Example 2206

A DNA sequence (GBSx2325) was identified in *S. agalactiae* <SEQ ID 6811> which encodes the amino acid sequence <SEQ ID 6812>. Analysis of this protein sequence reveals the following:

---

Possible site: 13
>>> Seems to have no N-terminal signal sequence
----- Final Results -----
   bacterial cytoplasm --- Certainty = 0.3297 (Affirmative) <succ>
   bacterial membrane --- Certainty = 0.0000 (Not Clear) <succ>
   bacterial outside --- Certainty = 0.0000 (Not Clear) <succ>

---

The protein has no significant homology with any sequences in the GENPEPT database.

No corresponding DNA sequence was identified in *S. pyogenes*.

---

Possible site: 27
>>> Seems to have a cleavable N-terminal signal sequence
INTEGRAL    Likelihood = −7.80   Transmembrane 380-396 (376-399)
INTEGRAL    Likelihood = −7.43   Transmembrane 291-307 (284-310)
INTEGRAL    Likelihood = −5.63   Transmembrane 169-185 (163-186)
INTEGRAL    Likelihood = −4.99   Transmembrane 226-242 (223-245)
INTEGRAL    Likelihood = −4.19   Transmembrane 46-62 (39-63)
INTEGRAL    Likelihood = −4.09   Transmembrane 311-327 (308-329)
INTEGRAL    Likelihood = −1.49   Transmembrane 261-277 (260-278)
INTEGRAL    Likelihood = −1.06   Transmembrane 133-149 (133-150)
INTEGRAL    Likelihood = −0.85   Transmembrane 98-114 (98-114)
INTEGRAL    Likelihood = −0.06   Transmembrane 77-93 (77-93)
----- Final Results -----
   bacterial membrane --- Certainty = 0.4121 (Affirmative) <succ>
   bacterial outside --- Certainty = 0.0000 (Not Clear) <succ>
   bacterial cytoplasm --- Certainty = 0.0000 (Not Clear) <succ>

---

The protein has homology with the following sequences in the GENPEPT database.

```
>GP:AAF36228 GB:AF168363 oxalate:formate antiporter [Lactococcus lactis]
Identities = 220/398 (55%), Positives = 306/398 (76%), Gaps = 3/398 (0%)
Query:   5  NRYVVAVSGVVLHLMLGSTYAWSVFRNPIISETGWDISSVSFAFSLAIFCLGMSAAFMGH    64
            NRYVVA +GV+ HLM+GS YAWSVF NPI   + GW   SSV+ AFS+AI+ LGMSAAFMG
Sbjct:   4  NRYVVAFAGVMFHLMIGSVYAWSVFTNPIAKQNGWAESSVALAFSIAIYFLGMSAAFMGK   63

Query:  65  LVERFGPRIMGMISAILYGAGNVLTGLAIETQQLWLLYVAYGILGGIGLGSGYITPVSTI  124
            +VE+ GPR+ G I++ LYG G ++TG AI      +WLLY++YG++GG+GLG+GY+TPVSTI
Sbjct:  64  VVEKIGPRLTGTIASFLYGTGTIMTGWAIHQNSIWLLYLSYGVIGGLGLGAGYVTPVSTI  123

Query: 125  IKWFPDRRGLATGFAIMGFGFASLVTSPLAQSLMIRIGVGKTFYILGLVYFFVMMIASQF  184
            IKWFPD+RGLATG AIMGFGFA+++T P+AQ LM  +G+ +TFY+LG  YF +M++A+QF
Sbjct: 124  IKWFPDKRGLATGLAIMGFGFAAMLTGPVAQQLMASVGLEQTFYLLGTFYFVIMLLAAQF  183

Query: 185  IKQPPQEKITILTHDGKKNAMNSQIITG--LKANAAIKSKTFYIIWLTLFINISCGLGLI  242
            I + P      ++  T  +        +++ G  L AN A+K+K+F    +W+   FINI+CG+GL+
Sbjct: 184  IVR-PNLALSSTTENSISQKKGTRLTRGPELTANQALKTKSFTFLWIMFFINITCGIGLV  242

Query: 243  SAASPMAQDLAGYSAESAALLVGVLGIFNGFGRLLWASLSDYIGRPLTFIILFIVNFIMT  302
            SAASPMAQ + G S  ++AA++VG++G+FNGFGRL+WA+LSDYIGRP TF    +FI++ +M
Sbjct: 243  SAASPMAQSMTGMSVQTAAIMVGIIGLFNGFGRLIWATLSDYIGRPATFSAIFILDIVML  302

Query: 303  SSLFLSFNAIVFAIAMSILMTCYGAGFSLLPAYLSDIFGTKELATLHGYSLTAWAIAGLF  362
            S++ +     ++F IA+ +LM+CYGAGFS++PAYL D+FGTKEL   +HGY LTAWA AG+
Sbjct: 303  SAILIFKLPLLFVIALCLLMSCYGAGFSVIPAYLGDVFGTKELGAVHGYVLTAWAAAGVV  362

Query: 363  GPLLLSKTYSWGNSYQLTLMVFGFLFLFGLLLSLYLRK                        400
            GPLLLS T+    ++Y LTL  F  + L   LL+S ++++
Sbjct: 363  GPLLLSLTHQLFHNYTLTLAAFILIDLLALLISFWIQR                        400
```

Based on this analysis, it was predicted that this protein and its epitopes, could be useful antigens for vaccines or diagnostics.

Example 2207

A DNA sequence (GBSx2326) was identified in *S. agalactiae* <SEQ ID 6813> which encodes the amino acid sequence <SEQ ID 6814>. This protein is predicted to be oxalate:formate antiporter (oxlT-2). Analysis of this protein sequence reveals the following:

A related DNA sequence was identified in *S. pyogenes* <SEQ ID 6815> which encodes the amino acid sequence <SEQ ID 6816>. Analysis of this protein sequence reveals the following:

---

Possible site: 27
>>> Seems to have a cleavable N-term signal sequence
INTEGRAL    Likelihood = −12.95   Transmembrane 289-305 (282-321)
INTEGRAL    Likelihood = −11.83   Transmembrane 376-392 (372-397)
INTEGRAL    Likelihood = −8.55    Transmembrane 163-179 (160-189)

| | | | |
|---|---|---|---|
| INTEGRAL | Likelihood = −7.75 | Transmembrane 227-243 (221-247) | |
| INTEGRAL | Likelihood = −5.89 | Transmembrane 44-60 (41-67) | |
| INTEGRAL | Likelihood = −1.38 | Transmembrane 310-326 (309-327) | |
| INTEGRAL | Likelihood = −0.90 | Transmembrane 353-369 (353-369) | |
| INTEGRAL | Likelihood = −0.37 | Transmembrane 138-154 (138-154) | |
| INTEGRAL | Likelihood = −0.06 | Transmembrane 98-114 (98-114) | |
| INTEGRAL | Likelihood = −0.00 | Transmembrane 259-275 (259-275) | |

----- Final Results -----
  bacterial membrane --- Certainty = 0.6180 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the databases:

```
>GP:AAF36228 GB:AF168363 oxalate:formate antiporter [Lactococcus lactis]
Identities = 222/399 (55%), Positives = 305/399 (75%), Gaps = 3/399 (0%)
Query:   3 KTKRYIIATAGILLHLMLGSTYAWSVYRNPILQETGWDQAPVAFAFSLAIFCLGLSAAFM    62
           KT RY++A AG++ HLM+GS YAWSV+ NPI ++ GW ++ VA AFS+AI+ LG+SAAFM
Sbjct:   2 KTNRYVVAFAGVMFHLMIGSVYAWSVFTNPIAKQNGWAESSVALAFSIAIYFLGMSAAFM    61

Query:  63 GNLVEQYGPRLIGTVSAILYASGNMLTGLAIDRKEIWLLYIGYGVIGGLGLGAGYITPIS   122
           G +VE+ GPRLTGT+++ LY +G ++TG AI +  IWLLY+ YGVIGGLGLGAGY+TP+S
Sbjct:  62 GKVVEKIGPRLTGTIASFLYGTGTIMTGWAIHQNSIWLLYLSYGVIGGLGLGAGYVTPVS   121

Query: 123 TIIKWFPDKRGMATGFAIMGFGFASLLTSPIAQWLIETEGLVATFYLLGLIYLIVMLFAS   182
           TIIKWFPDKRG+ATG AIMGFGFA++LT P+AQ L+ + GL  TFYLLG  Y ++ML A+
Sbjct: 122 TIIKWFPDKRGLATGLAIMGFGFAAMLTGPVAQQLMASVGLEQTFYLLGTFYFVIMLLAA   181

Query: 183 QLIIKPTAAEIAILDKKRLQ-NNSYLIEG--MTAKEALKIKSFYCLWVILFINITCGLGL   239
           Q I++P A + +    Q   + L G  +TA +ALKTKSF  LW++ FINITCG+GL
Sbjct: 182 QFIVRPNLALSSTTENSISQKKGIRLTRGPELTANQALKTKSFTFLWIMFFINITCGIGL   241

Query: 240 ISVVAPMAQDLTGMSPEMSAIVVGAMGIFNGFGRLVWASLSDYIGRRVTVILLFLVSIIM   299
           +S +PMAQ +TGMS + +AI+VG +G+FNGFGRL+WA+LSDYIGR   +F++ I+M
Sbjct: 242 VSAASPMAQSMTGMSVQTAAIMVGIIGLFNGFGRLIWATLSDYIGRPATFSAIFILDIVM   301

Query: 300 TISLIFAHSSLIFMISIATLMTCYGAGFSLIPPYLSDLFGAKELATLHGYILTAWAIAAL   359
           +++     L+F+I++ LM+CYGAGFS+IP YL D+FG KEL +HGY+LTAWA A +
Sbjct: 302 LSAILIFKLPLLFVIALCLLMSCYGAGFSVIPAYLGDVFGTKELGAVHGYVLTAWAAAGV   361

Query: 360 TGPMLLSITVEWTHNYLLTLCVFIVLYILGLMVALRLKK                       398
           GP+LLS+T + HNY LTL FI++ +L L+++ +++
Sbjct: 362 VGPLLLSLTHQLFHNYTLTLAAFILIDLLALLISFWIQR                       400
```

An alignment of the GAS and GBS proteins is shown below.

```
Identities = 252/400 (63%), Positives = 329/400 (82%), Gaps = 2/400 (0%)
Query:   1 MKNLNRYVVAVSGVVLHLMLGSTYAWSVFRNPIISETGWDISSVSFAFSLAIFCLGMSAA    60
           M+   RY++A +G++LHLMLGSTYAWSV+RNPI+ ETGWD + V+FAFSLAIFCLG+SAA
Sbjct:   1 MEKTKRYIIATAGILLHLMLGSTYAWSVYRNPILQETGWDQAPVAFAFSLAIFCLGLSAA    60

Query:  61 FMGHLVERFGPRIMGMISAILYGAGNVLTGLAIETQQLWLLYVAYGILGGIGLGSGYITP   120
           FMG+LVE++GPR+ G +SAILY +GN+LTGLAI+ +++WLLY+ YG++GG+GLG+GYITP
Sbjct:  61 FMGNLVEQYGPRLTGTVSAILYASGNMLTGLAIDRKEIWLLYIGYGVIGGLGLGAGYITP   120

Query: 121 VSTIIKWFPDRRGLATGFAIMGFGFASLVTSPLAQSLMIRIGVGKTFYILGLVYFFVMMI   180
           +STIIKWFPD+RG+ATGFAIMGFGFASL+TSP+AQ L+   G+  TFY+LGL+Y  VM+
Sbjct: 121 ISTIIKWFPDKRGMATGFAIMGFGFASLLTSPIAQWLIETEGLVATFYLLGLIYLIVMLF   180

Query: 181 ASQFIKQPPQEKITILTHDGKKNAMNSQIITGLKANAAIKSKTFYIIWLTLFINISCGLG   240
           ASQ I +P  +I IL  D K   NS +I G+ A A+K+K+FY +W+ LFINI+CGLG
Sbjct: 181 ASQLIIKPTAAEIAIL--DKKRLQNNSYLIEGMTAKEALKTKSFYCLWVILFINITCGLG   238

Query: 241 LISAASPMAQDLAGYSAESAALLVGVLGIFNGFGRLLWASLSDYIGRPLTFIILFIVNFI   300
           LIS +PMAQDL G S E +A++VG +GIFNGFGRL+WASLSDYIGR +T I+LF+V+ I
Sbjct: 239 LISVVAPMAQDLTGMSPEMSAIVVGAMGIFNGFGRLVWASLSDYIGRRVTVILLFLVSII   298

Query: 301 MTSSLFLSFNAIVFAIAMSILMTCYGAGFSLLPAYLSDIFGTKELATLHGYSLTAWAIAG   360
           MT SL + ++++F I+++ LMTCYGAGFSL+P YLSD+FG KELATLHGY LTAWAIA
Sbjct: 299 MTISLIFAHSSLIFMISIATLMTCYGAGESLIPPYLSDLFGAKELATLHGYILTAWAIAA   358

Query: 361 LFGPLLLSKTYSWGNSYQLTLMVFGFLFLFGLLLSLYLRK                      400
           L GP+LLS T  W ++Y LTL VF  L++ GL+++L +K
Sbjct: 359 LTGPMLLSITVEWTHNYLLTLCVFIVLYILGLMVALRLKK                      398
```

A related GBS gene <SEQ ID 8995> and protein <SEQ ID 8996> were also identified. Analysis of this protein sequence reveals the following:

Lipop: Possible site: −1 Crend: 5
McG: Discrim Score: 5.06

-continued modified ALOM score: 2.06
*** Reasoning Step: 3
----- Final Results -----
  bacterial membrane --- Certainty = 0.4121 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
ORF02272(313-1500 of 1818)
GP|7107009|gb|AAF36228.1|AF168363_4|AF168363(4-400 of 421) oxalate:formate antiporter
{Lactococcus lactis}
% Match = 38.5
% Identity = 55.4 % Similarity = 79.1
Matches = 220 Mismatches = 81 Conservative Sub.s = 94

216       246       276       306       336       366       396       426
GK*IC*AENW*YIQFFDNLFITNYIFKNKT*VRF*EDCLKNLNRYVVAVSGVVLHLMLGSTYAWSVFRNPIISETGWDIS
                                       ||||||  :||::||| |||||| |||   :  ||   |
                                    MKTNRYVVAFAGVMFHLMIGSVYAWSVFTNPIAKQNGWAES
                                     10        20        30        40

456       486       516       546       576       606       636       666
SVSFAFSLAIFCLGMSAAFMGHLVERFGPRIMGMISAILYGAGNVLTGLAIETQQLWLLYVAYGILGGIGLGSGYITPVS
||::|||:||:|  ||||||| :||: ||| |    | :::|| || |        :|||::||:|||::|||:|||||
SVALAFSIAIYFLGMSAAFMGKVVEKIGPRLTGTIASFLYGTGTIMTGWAIHQNSIWLLYLSYGVIGGLGLGAGYVTPVS
                    60        70        80        90       100       110       120

696       726       756       786       816       846       876       906
TIIKWFPDRRGLATGFAIMGFGFASLVTSPLAQSLMIRIGVGKTFYILGLVYFFVMMIASQFIKQPPQEKITILTHDGKK
||||||||:|||||||:|||||||:::|  |:|| ||  :|: :|||:|| ||:::|:||| :|     :: |   |:
TIIKWFPDKRGLATGLAIMGFGFAAMLTGPVAQQLMASVGLEQTFYLLGTFYFVIMLLAAQFIVRP-NLALSSTTENSIS
                  140       150       160       170       180       190       200

936       960       990      1020      1050      1080      1110      1140
NAMNSQIITG--LKANAAIKSKTFYIIWLTLFINISCGLGLISAASPMAQDLAGYSAESAALLVGVLGIFNGFGRLLWAS
 :::       |   ||  |:|:|   :|:    :|||||||||||||||  :|||:::|::|::|||||||||||| |
QKKGTRLTRGPELTANQALKTKSFTFLWIMFFINITCGIGLVSAASPMAQSMTGMSVQTAAIMVGIIGLFNGFGRLIWAT
               210       220       230       240       250       260       270       280

1170      1200      1230      1260      1290      1320      1350      1380
LSDYIGRPLTFIILFIVNFIMTSSLFLSFNAIVFAIAMSILMTCYGAGFSLLPAYLSDIFGTKELATLHGYSLTAWAIAG
||||||| ||  :||:: :| |:::      ::| ||: :||:|||||||:| ||:|||:|||||| :|| ||||| ||
LSDYIGTPATFSAIFILDIVMLSAILIFKLPLLFVIALCLLMSCYGAGFSVIPAYLGDVFGTKELGAVHGYVLTAWAAAG
               290       300       310       320       330       340       350       360

1410      1440      1470      1500      1530      1560      1590      1620
LFGPLLLSKTYSWGNSYQLTLMVFGFLFLFGLLLSLYLRKLTTKVV*YISNLKFFGFTKEFFL*KIVLSYSK*FDILSI*
: |||||| |:   ::| |||   | :: |:||:::::
VVGPLLLSLTHQLFHNYTLTLAAFILIDLLALLISFWIQRDFIKASKLIKKQIIKNYFKAH
               370       380       390       400       410       420
```

-continued

GvH: Signal Score (−7.5): 4.38
Possible site: 27
>>> Seems to have a cleavable N-term signal sequence
ALOM program count: 10 value: −7.80  threshold: 0.0
INTEGRAL    Likelihood = −7.80    Transmembrane 380-396 (376-399)
INTEGRAL    Likelihood = −7.43    Transmembrane 291-307 (284-310)
INTEGRAL    Likelihood = −5.63    Transmembrane 169-185 (163-186)
INTEGRAL    Likelihood = −4.99    Transmembrane 226-242 (223-245)
INTEGRAL    Likelihood = −4.19    Transmembrane 46-62 (39-63)
INTEGRAL    Likelihood = −4.09    Transmembrane 311-327 (308-329)
INTEGRAL    Likelihood = −1.49    Transmembrane 261-277 (260-278)
INTEGRAL    Likelihood = −1.06    Transmembrane 133-149 (133-150)
INTEGRAL    Likelihood = −0.85    Transmembrane 98-114 (98-114)
INTEGRAL    Likelihood = −0.06    Transmembrane 77-93 (77-93)
PERIPHERAL  Likelihood = 0.42     352

Based on this analysis, it was predicted that these proteins and their epitopes could be useful antigens for vaccines or diagnostics.

Example 2208

A DNA sequence (GBSx2327) was identified in *S. agalactiae* <SEQ ID 6817> which encodes the amino acid sequence <SEQ ID 6818>. This protein is predicted to be D-Ala-D-Ala adding enzyme (murF). Analysis of this protein sequence reveals the following:

Possible site: 45
>>> Seems to have no N-terminal signal sequence
----- Final Results -----
  bacterial cytoplasm --- Certainty = 0.1311 (Affirmative) <succ> bacterial membrane --- Certainty = 0.0000 (Not Clear) <succ>
bacterial outside --- Certainty = 0.0000 (Not Clear) <succ>

Possible site: 14
>>> Seems to have no N-terminal signal sequence
----- Final Results -----
bacterial cytoplasm --- Certainty = 0.3299 (Affirmative) <succ>
bacterial membrane --- Certainty = 0.0000 (Not Clear) <succ>
bacterial outside --- Certainty = 0.0000 (Not Clear) <succ>

A related GBS nucleic acid sequence <SEQ ID 9739> which encodes amino acid sequence <SEQ ID 9740> was also identified.

The protein has homology with the following sequences in the GENPEPT database.

```
>GP:AAC95436 GB:AF068901 D-Ala-D-Ala adding enzyme [Streptococcus pneumoniae]
Identities = 313/453 (690), Positives = 375/453 (82%)
Query:   32 MKLSLHEVAKVVGAKNQVSEFEDVPLGNIEFDSRNISEGDLFLPLKGARDGHEFIEMAFD    91
            MKL++HE+A+VVGAKN +S FED  L   EFDSR I  GDLF+PLKGARDGH+FIE AF+
Sbjct:    1 MKLTIHEIAQVVGAKNDISIFEDTQLEKAEFDSRLIGTGDLFVPLKGARDGHDFIETAFE    60

Query:   92 NGAIATISEKEIEGHPYLLVSDALKAFQVLAQYYIEKMNVDVIAVTGSNGKTTTKDMIAA   151
            NGA T+SEKE+   HPY+LV D L AFQ LA YY+EK  VDV AVTGSNGKTTTKDM+A
Sbjct:   61 NGAAVTLSEKEVSNHPYILVDDVLTAFQSLASYYLEKTTVDVFAVTGSNGKTTTKDMLAH   120

Query:  152 ILSTTYKTYKTQGNYNNEIGLPYTVLHMPEDTEKIILEMGQDHLGDIHVLSEIAKPRIAV   211
            +LST YKTYKTQGNYNNEIGLPYTVLHMPE TEK++LEMGQDHLGDIH+LSE+A+P+ A+
Sbjct:  121 LLSTRYKTYKTQGNYNNEIGLPYTVLHMPEGTEKLVLEMGQDHLGDIHLLSELARPKTAI   180

Query:  212 VTLIGEAHLEFFGSREKIAEGKMQITDGMSSDGILIAPGDPIIDPYLPANQMTIRFGHDQ   271
            VTL+GEAHL FF  R +IA+GKMQI DGM+S  +L+AP DPI++ YLP ++   +RFG
Sbjct:  181 VTLVGEAHLAFFKDRSEIAKGKMQIADGMASGSLLLAPADPIVEDYLPTDKKVVRFGQGA   240

Query:  272 ELQVTELKEEKHSLTFKTNALEHQLRIPVPGKYNATNAMVAAYVGKLLAVAEEDIVDALE   331
            EL++T+L E K SLTFK N LE  L +PV GKYNATNAM+A+YV      V+EE I  A +
Sbjct:  241 ELEITDLVERKDSLTFKANFLEQVLDLPVTGKYNATNAMIASYVALQEGVSEEQIHQAFQ   300

Query:  332 NLQLTRNRTEWKKSANGADILSDVYNANPTAMRLILETFSAIPNNDGGKKIALLADMKEL   391
            +L+LTRNRTEWKK+ANGADILSDVYNANPTAM+LILETFSAIP N+GGKKIA+LADMKEL
Sbjct:  301 DLELTRNRTEWKKAANGADILSDVYNANPTAMKLILETFSAIPANEGGKKIAVLADMKEL   360

Query:  392 GEQSVDLHNQMIMSIRPDSIDTLICYGQDIEGLAQLASQMFPIGKVYFFKKNQEVDQFDQ   451
            G QSV LHNQMI+S+ PD +DT+I YG+DI  LAQLASQMFPIG VY+FKK ++ DQF+
Sbjct:  361 GNQSVQLHNQMILSLSPDVLDTVIFYGEDIAELAQLASQMFPIGHVYYFKKTEDQDQFED   420

Query:  452 LLAKVKDTLKEKDQILLKGSNSMNLSKIVDILE                            484
            L+ +VK++L   DQILLKGSNSMNL+ +V+ LE
Sbjct:  421 LVKQVKESLSANDQILLKGSNSMNLAMLVESLE                            453
```

A related DNA sequence was identified in *S. pyogenes* <SEQ ID 6819> which encodes the amino acid sequence <SEQ ID 6820>. Analysis of this protein sequence reveals the following:

An alignment of the GAS and GBS proteins is shown below.

```
Identities = 323/452 (71%), Positives = 387/452 (85%)
Query:   32 MKLSLHEVAKVVGAKNQVSEFEDVPLGNIEFDSRNISEGDLFLPLKGARDGHEFIEMAFD    91
            MKL+LHEVAK+V A+N VS+ +DVPL +IEFDSR I++GDLFLPLKG RDGHEFI++AF
Sbjct:    1 MKLTLHEVAKIVDAQNNVSDLDDVPLHHIEFDSRKITKGDLFLPLKGQRDGHEFIDLAFQ    60

Query:   92 NGAIATISEKEIEGHPYLLVSDALKAFQVLAQYYIEKMNVDVIAVTGSNGKTTTKDMIAA   151
            NGA+AT SEKE+ G P+LLV D LKAFQ LA YYI+KM VDVIAVTGSNGKT+TKDMI A
Sbjct:   61 NGAVATFSEKELPGKPHLLVEDCLKAFQKLAHYYIDKMRVDVIAVTGSNGKTSTKDMIGA   120

Query:  152 ILSTTYKTYKTQGNYNNEIGLPYTVLHMPEDTEKIILEMGQDHLGDIHVLSEIAKPRIAV   211
            +LSTTYKTYKTQGNYNNEIGLPYTVLHMP+DTEKI+LEMGQDH+GDI +LSEIA+PRIAV
Sbjct:  121 VLSTTYKTYKTQGNYNNEIGLPYTVLHMPDDTEKIVLEMGQDHMGDIRLLSEIARPRIAV   180

Query:  212 VTLIGEAHLEFFGSREKIAEGKMQITDGMSSDGILIAPGDPIIDPYLPANQMTIRFGHDQ   271
            +TL+GEAHLE FGSR +KIA+GKMQI DGM+SDGILIAPGDPIIDPYLP NQM IRFG+ Q
Sbjct:  181 LTLVGEAHLEYFGSRDKIAQGKMQIVDGMNSDGILIAPGDPIIDPYLPENQMVIRFGNQQ   240

Query:  272 ELQVTELKEEKHSLTFKTNALEHQLRIPVPGKYNATNAMVAAYVGKLLAVAEEDIVDALE   331
            E+ VT ++E+K SLTF TN L   + +P+PGKYNATNAMVAAYVGKLLAV +EDI+ AL+
Sbjct:  241 EIDVTGIQEDKDSLTFTTNVLATPVSLPLPGKYNATNAMVAAYVGKLLAVTDEDIIAALQ   300

Query:  332 NLQLTRNRTEWKKSANGADILSDVYNANPTAMRLILETFSAIPNNDGGKKIALLADMKEL   391
            +  LT NRTEWKK+ANGADILSDVYNANPTAMRLILETF+ I  N GGKKIA+LADMKEL
Sbjct:  301 TVTLTGNRTEWKKAANGADILSDVYNANPTAMRLILETFANIAKNPGGKKIAVLADMKEL   360
```

```
-continued
Query: 392  GEQSVDLHNQMIMSIRPDSIDTLICYGQDIEGLAQLASQMFPIGKVYFFKKNQEVDQFDQ  451
            G+ SV LH+Q+I S+   +ID L+ YG  I+ LA+LASQ++P +V++F K ++  DQF+
Sbjct: 361  GKDSVILHSQLIDSLTSGNIDQLVFYGDHIKELARLASQVYPAEQVHYFLKTEQEDQFEA  420

Query: 452  LLAKVKDTLKEKDQILLKGSNSMNLSKIVDIL                             483
            +   V++ L   DQILLKGS+SM+L K+VD L
Sbjct: 421  MAQYVQNILNPFDQILLKGSHSMSLEKLVDRL                             452
```

Based on this analysis, it was predicted that these proteins and their epitopes could be useful antigens for vaccines or diagnostics.

Example 2209

A DNA sequence (GBSx2328) was identified in *S. agalactiae* <SEQ ID 6821> which encodes the amino acid sequence <SEQ ID 6822>. Analysis of this protein sequence reveals the following:

Possible site: 17
>>> Seems to have no N-terminal signal sequence
----- Final Results -----
   bacterial cytoplasm --- Certainty = 0.1381 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

A related DNA sequence was identified in *S. pyogenes* <SEQ ID 4559> which encodes the amino acid sequence <SEQ ID 4560>. Analysis of this protein sequence reveals the following:

Possible site: 23
>>> Seems to have no N-terminal signal sequence
----- Final Results -----
   bacterial cytoplasm --- Certainty = 0.1451 (Affirmative) <succ>
   bacterial membrane --- Certainty = 0.0000 (Not Clear) <succ>
   bacterial outside --- Certainty = 0.0000 (Not Clear) <succ>

```
>GP:AAC95435 GB:AF068901 D-Ala-D-Ala ligase [Streptococcus pneumoniae]
Identities = 243/346 (70%), Positives = 289/346 (83%)
Query:   3  KETLILLYGGRSAEREVSVLSAESVMRAINYDKFFVKTYFITQVGQFIKTQEFDEMPSSD   62
            K+T+ILLYGGRSAEREVSVLSAESVMRA+NYD+F VKT+FI+Q G FIKTQEF   P  +
Sbjct:   2  KQTIILLYGGRSAEREVSVLSAESVMRAVNYDRFTVKTFFISQSGDFIKTQEFSHAPGQE   61

Query:  63  EKLMTNQTVDLDKMVRPSDIYDDNAIVFPVLHGPMGEDGSIQGFLEVLRMPYVGTNILSS  122
            ++LMTN+T+D DK V PS IY++ A+VFPVLHGPMGEDGS+QGFLEVL+MPYVG NILSS
Sbjct:  62  DRLMTNETIDWDKKVAPSAIYEEGAVVFPVLHGPMGEDGSVQGFLEVLKMPYVGCNILSS  121

Query: 123  SVAMDKITTKQVLATVGVPQVAYQTYFEGDDLEHAIKLSLETLSFPIFVKPANMGSSVGI  182
            S+AMDKITTK+VL + G+ QV Y    EGDD+    I    E L++P+F KP+NMGSSVGI
Sbjct: 122  SLAMDKITTKRVLESAGIAQVPYVAIVEGDDVTAKIAEVEEKLAYPVFTKPSNMGSSVGI  181

Query: 183  SKATDESSLRSAIDLALKYDSRILIEQGVTAREIEVGILGNNDVKTTFPGEVVKDVDFYD  242
            SK+ ++   LR A+ LA  +YDSR+L+EQGV AREIEVG+LGN DVK+T PGEVVKDV FYD
Sbjct: 182  SKSENQEELRQALKLAFRYDSRVLVEQGVNAREIEVGLLGNYDVKSTLPGEVVKDVAFYD  241

Query: 243  YDAKYIDNKITMDIPAKVDEATMEAMRQYASKAFKAIGACGLSRCDFFLTEDGQIFLNEL  302
            YDAKYIDNKITMDIPAK+ +  +  MRQ A  AF+AIG  GLSRCDFF T  G+IFLNEL
Sbjct: 242  YDAKYIDNKITMDIPAKISDDVVAVMRQNAETAFRAIGGLGLSRCDFFYTDKGEIFLNEL  301

Query: 303  NTMPGFTQWSMYPLLWENMGLTYSDLIEKLVMLAKEMFEKRESHLI                348
            NTMPGFTQWSMYPLLW+NMG++Y +LIE+LV LAKE F+KRE+HLI
Sbjct: 302  NTMPGFTQWSMYPLLWDNMGISYPELIERLVDLAEESFDKREAHLI                347
```

An alignment of the GAS and GBS proteins is shown below.

```
Identities = 261/348 (75%), Positives = 306/348 (87%)
Query:   1  MSKETLILLYGGRSAEREVSVLSAESVMRAINYDKFFVKTYFITQVGQFIKTQEFDEMPS   60
            MSK+TL+LLYGGRSAEREVSVLSAESVMRA+NYDKF VKTYFITQ+GQFIKTQ+F E PS
Sbjct:   1  MSKQTLVLLYGGRSAEREVSVLSAESVMRAVNYDKFLVKTYFITQMGQFIKTQQFSEKPS   60

Query:  61  SDEKLMTNQTVDLDKMVRPSDIYDDNAIVFPVLHGPMGEDGSIQGFLEVLRMPYVGTNIL  120
            ++ +LMTN+T++L + +  ++PSDIY++ A+VFPVLHGPMGEDGSIQGFLEVLRMPY+GTN++
Sbjct:  61  ESERLMTNETIELTQKIKPSDIYEEGAVVFPVLHGPMGEDGSIQGFLEVLRMPYIGTNVM  120

Query: 121  SSSVAMDKITTKQVLATVGVPQVAYQTYFEGDDLEHAIKLSLETLSFPIFVKPANMGSSV  180
```

```
                SSS+AMDKITTK+VL ++G+PQVAY   Y +G DLE   +  +L   L+FPIFVKPANMGSSV
Sbjct:  121     SSSIAMDKITTKRVLESIGIPQVAYTVYIDGQDLEACLVETLARLTFPIFVKPANMGSSV   180

Query:  181     GISKATDESSLRSAIDLALKYDSRILIEQGVTAREIEVGILGNNDVKITFPGEVVKDVDF   240
                GISKA    + LR AI LAL YDSR+LIEQGV AREIEVG+LGN+ VK+T PGEV+KDVDF
Sbjct:  181     GISKAQTKVELRKAIQLALTYDSRVLIEQGVVAREIEVGLLGNDKVKSTLPGEVIKDVDF   240

Query:  241     YDYDAKYIDNKITMDIPAKVDEATMEAMRQYASKAFKAIGACGLSRCDFFLTKDGQIFLN   300
                YDY AKY+DNKITM IPA VD++ +  MR YA  AFKA+G CGLSRCDFFLT+DGQ++LN
Sbjct:  241     YDYQAKYVDNKITMAIPADVDQSIVTEMRSYAEVAFKALGGCGLSRCDFFLTQDGQVYLN   300

Query:  301     ELNTMPGFTQWSMYPLLWENMGLTYSDLIEKLVMLAKEMFEKRESHLI               348
                ELNTMPGFTQWSMYPLLWENMGL Y DLIE+LV LA+EMF++RESHLI
Sbjct:  301     ELNTMPGFTQWSMYPLLWENMGLAYPDLIEELVTLAQEMFDQRESHLI               348
```

Based on this analysis, it was predicted that these proteins and their epitopes could be useful antigens for vaccines or diagnostics.

Example 2210

A DNA sequence (GBSx2329) was identified in *S. agalactiae* <SEQ ID 6823> which encodes the amino acid sequence <SEQ ID 6824>. This protein is predicted to be recombination protein (recR). Analysis of this protein sequence reveals the following:

Possible site: 36
>>> Seems to have no N-terminal signal sequence
----- Final Results -----
    bacterial cytoplasm --- Certainty = 0.2540 (Affirmative) <succ>
      bacterial membrane --- Certainty = 0.0000 (Not Clear) <succ>
        bacterial outside --- Certainty = 0.0000 (Not Clear) <succ>

The protein has homology with the following sequences in the GENPEPT database.

```
>GP:AAC44615 GB:U58210 RecM [Streptococcus thermophilus]
Identities = 181/198 (91%), Positives = 189/198 (95%)
Query:    1     MLYPTPIAKLIDSFSKLPGIGTKTATRLAFYTIGMSDEDVNEFAKNLLAAKRELTYCSVC    60
                MLYPTPIAKLIDSFSKLPGIG KTATRLAFYTI MSDEDVN+FAKNLLAAKRELTYCSVC
Sbjct:    1     MLYPTPIAKLIDSFSKLPGIGAKTATRLAFYTISMSDEDVNDFAKNLLAAKRELTYCSVC    60

Query:   61     GNLTDDDPCLICTDKTRDQSVILVVEDSKDVSAMEKIQEYNGLYHVLHGLISPMNGISPD   120
                G LTDDDPC+ICTD+TRD++ ILVVEDSKDVSAMEKIQEY GLYHVL GLISPMNG+ PD
Sbjct:   61     GRLTDDDPCIICTDETRDRTKILVVEDSKDVSAMEKIQEYRGLYHVLQGLISPMNGVGPD   120

Query:  121     DINLKSLITRLMDGQVTEVIVATNATADGEATSMYISRVLKPAGIKVTRLARGLAVGSDI   180
                DINLKSLITRLMD +V EVI+ATNATADGEATSMYISRVLKPAGIKVTRLARGLAVGSDI
Sbjct:  121     DINLKSLITRLMDSEVDEVIIATNATADGEATSMYISRVLKPAGIKVTRLARGLAVGSDI   180

Query:  181     EYADEVTLLRAIENRTEL                                            198
                EYADEVTLLRAIENRTEL
Sbjct:  181     EYADEVTLLRAIENRTEL                                            198
```

A related DNA sequence was identified in *S. pyogenes* <SEQ ID 6825> which encodes the amino acid sequence <SEQ ID 6826>. Analysis of this protein sequence reveals the following:

Possible site: 36
>>> Seems to have no N-terminal signal sequence
----- Final Results -----
    bacterial cytoplasm --- Certainty = 0.2652 (Affirmative) <succ>
      bacterial membrane --- Certainty = 0.0000 (Not Clear) <succ>
        bacterial outside --- Certainty = 0.0000 (Not Clear) <succ>

An alignment of the GAS and GBS proteins is shown below.

```
Identities = 180/198 (90%), Positives = 192/198 (96%)
Query:    1     MLYPTPIARLIDSFSKLPGIGIKTATRLAPYTIGMSDEDVNEFAKNLLAAKRELTYCSVC    60
                +LYPTPIAKLIDS+SKLPGIG KTATRLAPYTIGMS+EDVN+FAKNLLAAKRELTYCS+C
Sbjct:    1     VLYPTPIARLIDSYSKLPGIGIKTATRLAFYTIGMSNEDVNDFAKNLLAAKRELTYCSIC    60

Query:   61     GNLTDDDPCLICTDKIRDQSVILVVEDSKDVSAMENIQEYNGLYHVLHGLISPMNGISPD   120
                GNLTDDDPC ICTD +RDQ+ ILVVED+PIVSAMEKIQEY+G YHVLHGLISPMNG+ PD
Sbjct:   61     GNLTDDDPCHICIDTSRDQTTILVVEDAKDVSAMENIQEYHGYYHVLHGLISPMNGVGPD   120

Query:  121     DINLKSLITRLMDGQVTEVIVATNATADGEATSMYISRVLKPAGIKVTRLARGLAVGSDI   180
```

```
                 DINLKSLITRLMDG+V+EVIVATNATADGEATSMYISRVLKPAGIKVTRLARGLAVGSDI
Sbjct:  121      DINLKSLITRLMDGKVSEVIVATNATADGEATSMYISRVLKPAGIKVTRLARGLAVGSDI  180

Query:  181      EYADEVTLLRAIENRTEL                                            198
                 EYADEVTLLRAIENRTEL
Sbjct:  181      EYADEVTLLRAIENRTEL                                            198
```

Based on this analysis, it was predicted that these proteins and their epitopes could be useful antigens for vaccines or diagnostics.

Example 2211

A DNA sequence (GBSx2330) was identified in *S. agalactiae* <SEQ ID 6827> which encodes the amino acid sequence <SEQ ID 6828>. Analysis of this protein sequence reveals the following:

Possible site: 23
>>> Seems to have no N-terminal signal sequence
----- Final Results -----
   bacterial cytoplasm --- Certainty = 0.3144 (Affirmative) <succ>
     bacterial membrane --- Certainty = 0.0000 (Not Clear) <succ>
       bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2212

A DNA sequence (GBSx2331) was identified in *S. agalactiae* <SEQ ID 6829> which encodes the amino acid sequence <SEQ ID 6830>. This protein is predicted to be penicillin-binding protein 2b. Analysis of this protein sequence reveals the following:

Possible site: 52
>>> Seems to have no N-terminal signal sequence
INTEGRAL Likelihood = −13.69 Transmembrane 23-39 (17-46)
----- Final Results -----
   bacterial membrane --- Certainty = 0.6477 (Affirmative) <succ>
     bacterial outside --- Certainty = 0.0000 (Not Clear) <succ>
       bacterial cytoplasm --- Certainty = 0.0000 (Not Clear) <succ>

The protein has homology with the following sequences in the GENPEPT database.

```
>GP:AAC44614 GB:U58210 penicillin-binding protein 2b [Streptococcus thermophilus]
Identities = 341/683 (49%); Positives = 477/683 (68%), Gaps = 12/683 (1%)

Query:    4  RKKRYRLTVKKQNASIPRRLNLLFFIIVLLFTVLILRLEQMQIGQQSFYMKKLTALTSYT   63
             ++K  R     ++    +I RR+ LLF ++ +LF +L  RL   MQ+  +SFY KKL     + YT
Sbjct:   18  KRKEKRANKPRKPVNISRRVYLLFGVVFVLFLLLFARLTYMQVYNKSFYTKKLEDNSKYT   77

Query:   64  VKESKARGQIFDAKGVVLVENDERPTVAFSRGNNISSQSIKELANKLSHYITLTEVASSD  123
             V+ +   RGQIFDAKG+ L  N  +  + F+R N +SS ++K +A +L+    +TLTE      +D
Sbjct:   78  VRIASERGQIFDAKGIALTTNQSKDVITFTRSNLVSSDTMKSVAERLATLVTLTETKVTD  137

Query:  124  RAKRDYYLADKANYKKVVESLPDSKRYDKFGNHLAESTVYANAVAAVPVSAINYSEDELK  183
             R KR++YLAD ANYK+VV   LP+ K+ DKFGN LAE+T+Y NA+ AVP   A++YSEDELK
Sbjct:  138  RQKREFYLADSANYKRVVNDLPNDKKTDKEGNKLAEATIYNNAINAVPDEAVDYSEDELK  197

Query:  184  VVALFNQMNATPTFGSVKLSTGELSDDQIKKLDADKKELLGISVTSNWHRRKKGTSLSDI  243
             +V +++  MNA    F +V L T +L+ DQI   + A +KEL GI V   +W R      +SLS +
Sbjct:  198  IVYIYSHMNAVSNFSTVILKTADLTPDQIAIVAAKQKELNGIRVAKDWERHTSDSSLSPL  257

Query:  244  LGTISTEKAGLPREEVKKYLKKGYSLNDRVGTSYLEKQYEDDLQGIRQIRKVVVNKKGKV  303
             +G  +S+   +AGLP+E+   K  YLKKGY+LNDRVGTSYLEK+YE++ LQG      +R++ V+K+GKV
Sbjct:  258  IGRVSSSEAGLPQEDAKDYLKKGYALNDRVGTSYLEKEYEEELQGKHTVREITVDKEGKV  317

Query:  304  VSDNITQEGKSGRNLKLTIDLNYQNKVESILKQYYGSELSSGRASFSEGMYAVAIEPSTG  363
                SD I Q+G G  NLKLTIDL++Q  VE  IL Q    SE+S   +A++SEGMYAV +    TG
Sbjct:  318  DSDKIIQKGSKGNNLKLTIDLDFQKGVEDILGQQLSSEISGNKATYSEGMYAVVMNADTG  377

Query:  364  KVLAMAGLKNDHG--NLVDDSLGTIAKNFTPGSVVKGATLSSGWENKVLRGNEVLYDQEI  421
                 VLAMAG K++  G  +     D+LGTI     FTPGSVVKGATL++GW +    + G++VL DQ I
Sbjct:  378  AVLAMAGQKHEQGAQDFKADALGTITDVFTPGSVVKGATLTAGWRSGAIYGDQVLTDQPI  437

Query:  422  -----ANIRSWFT-RGLTPISAAQALEYSSNTYMVQVALRLMGQDYNTGDALTDRGYQEA  475
```

```
                I SWFT +G    I+A QALEYSSNTYMVQ+A++ +GQ Y  G +L+     ++A
Sbjct: 438  NIASSPPITSWFTDKGSRAITATQALEYSSNTYMVQIAIKRLGQQYVPGMSLSTDNMEKA  497

Query: 476  MAKLRKTYGEYGLGVSTGLDLP-ESEGYVPGKYSLGTTLMESFGQYDAYTPMQLGQYIST  534
            M  LR TY E+G+GVSTGLDLP ESEGY+P   Y++   L E+FGQYD+YT +QL QY+++
Sbjct: 498  MTTLRDTYAEFGMGVSTGLDLPGESEGYIPKNYNVANVLTEAFGQYDSYTTIQLAQYVAS  557

Query: 535  IANNGNRLAPHVVSDIYEGNDSNKFAQLVRSITPKTLNKIAISDQELAIIQEGFYNVVNS  594
            IAN G R+APH+V  IY+  +    L  ++  + LNK+++  ++L IIQ+GF++VVNS
Sbjct: 558  IANGGKRVAPHIVGGIYDAGKNGSLGTLSSTVDTRVLNKLSLDSKQLGIIQQGFHDVVNS  617

Query: 595  GSGYATGTSMRGNVTTISGKTGTAETFAKNVNGQTVSTYNLNAIAYDTNR---KIAVAVM  651
            GS  ATG +M  ++  ISGKTGTAET+A + +G +V+T NLNA+AY T +   K+AV +M
Sbjct: 618  GSSLATGKAMASSIIPISGKTGTAETYATDGSGNSVTTVNLNAVAYATAKDGTKLAVGIM  677

Query: 652  YPHVTTDTTKSHQLVARDMIDQY                                     674
            YPH       +K+HQ  +  +++ Y
Sbjct: 678  YPHALDWKSKAHQNAVKAIMELY                                     700
```

A related GBS gene <SEQ ID 8997> and protein <SEQ ID 8998> were also identified. Analysis of this protein sequence reveals the following:

Lipop Possible site: −1 Crend: 8
McG: Discrim Score: −12.38
GvH: Signal Score (−7.5): −5.9
Possible site: 35
>>> Seems to have no N-terminal signal sequence
ALOM program   count: 1 value: −12.42   threshold: 0.0
INTEGRAL       Likelihood = −12.42   Transmembrane 23-39 (18-46)
PERIPHERAL     Likelihood = 4.56     355
modified ALOM score: 2.98

*** Reasoning Step: 3
----- Final Results -----
  bacterial membrane --- Certainty = 0.5967 (Affirmative) <succ>
  bacterial outside --- Certainty = 0.0000 (Not Clear) <succ>
  bacterial cytoplasm --- Certainty = 0.0000 (Not Clear) <succ>

The protein has homology with the following sequences in the databases:

```
50.5/71.3% over 683aa
Streptococcus thermophilus
GP|1685112| penicillin-binding protein 2b Insert characterized
ORF02276(307-2322 of 2643)
GP|1685112|gb|AAC44614.1||U58210(17-700 of 704) penicillin-binding protein 2b
{Streptococcus thermophilus}
% Match = 38.5
% Identity = 50.4 % Similarity = 71.2
Matches = 342 Mismatches = 189 Conservative Sub.s = 141

108       138       168       198       228       258       288       318
NHGR*NS*LPTTCFRI**KIKPCFRILLR*II*SLYKKFRPSWLEFFIIYNILSVCKKPFL*YNSSQSFYSKELMLNRKK
                                                                 :    ::    :      ::|
                                                                 MTSFWEKNSQKWKKWRQKRK
                                                                          10        20

348       378       408       438       468       498       528       558
RYRLTVKKQNASIPRRLNLLFFIIXLLFTVLILRLEQMQIGQQSFYMKKLTALTSYTVKESKARGQIFDAKGVVLVENDE
     |    ::    :| ||: ||| :: :|| :|  ||  ||:  :|||  |||    : ||| :: ||||||||:  |    |
EKRANKPRKPVNISRRVYLLFGVVFVFLLLLFARLTYMQVYNKSFYTKKLEDNSKYTVRIASERGQIFDAKGIALTTNQS
         30        40        50        60        70        80        90       100

588       618       648       678       708       738       768       798
RPTVAFSRGNNISSQSIKELANKLSHYITLTEVASSDRAKRDYYLADKANYKKVVESLPDSKRYDKFGNHLAESTVYANA
 :   :  |:|  |  :||  ::|  :|   :|:    :|||   :|| ||::||||  |||||:||:||  ||: :| ||
KDVITFTRSNLVSSDTMKSVAERLATLVTLTETKVTDRQKREFYLADSANYKRVVNDLPNDKKTDKFGNKLAEATIYNNA
        110       120       130       140       150       160       170       180

828       858       888       918       948       978      1008      1038
VAAVPVSAINYSEDELKVVALFNQMNATPTFGSVKLSTGELSDDQIKKLDADKKELLGISVTSNWHRRKKGTSLSDILGT
:  |||   |:    |:  :: :|| :||  |  | | :|:  | ||  : :|||||: :|  | |    :||: ::|
INAVPDEAVDYSEDELKIVYIYSHMNAVSNFSTVILKTADLTPDQIAIVAAKQKELNGIRVAKDWERHTSDSSLSPLIGR
        190       200       210       220       230       240       250       260

1068      1098      1128      1158      1188      1218      1248      1278
ISTEKAGLPREEVKKYLKKGYSLNDRVGTSYLEKQYEDDLQGIRQIRKVVVNKKGKVVSDNITQEGKSGRNLKLTIDLNY
:|: :||||:|     ||||||||||||||||||:||:|  :|: |:|:|||  |   :|:   |   |||||||||::
VSSSEAGLPQEDAKDYLKKGYALNDRVGTSYLEKEYEEELQGKHTVREITVDKEGKVVDSKIIQKGSKGNNLKLTIDLDF
        270       280       290       300       310       320       330       340
```

```
1308      1338      1368      1398      1428    1452      1482      1512
QNKVESILKQYYGSELSSGRASFSEGMYAVAIEPSTGKVLAMAGLKNDHG--NLVDDSLGTIAKNFTPGSVVKGATLSSG
|  || ||  |    ||:  :|::|||||||  :   ||  ||||||  |:::|   ::   |:||||   ||||||||||||::|
QKGVEDILGQQLSSEISGNKATYSEGMYAVVMNADTGAVLAMAGQKHEQGAQDFKADALGTITDVFTPGSVVKGATLTAG
      350       360       370       380       390       400       410       420

1542      1566      1587      1614      1644      1674      1704      1734
WENKVLRGNEVLYDQ--EIAN---IRSWFT-RGLTPISAAQALEYSSNTYMVQVALRLMGQDYNTGDALTDRGYQEAMAK
|  :  :  |::|||  ||  |||| :|   ||:    |:|  ||||||||||:  :|||| | :|:    ::||
WRSGAIYGDQVLTDQPINIASSPPITSWFTDKGSRAITATQALEYSSNTYMVQIAIKRLGQQYVPGMSLSTDNMEKAMTT
      430       440       450       460       470       480       490       500

1764                1821      1851      1881      1911      1941      1971
LRKTYGEYGLGVSTGLDLP-ESEGYVPGKYSLGTTLMESFGQYDAYTPMQLGQYISTIANNGNRLAPHVVSDIYEGNDSN
|| ||  |:|:|||||||||  ||||:|  |::     |  |:||||||:|  :||  ||:::|||    |:|||:|   ||:    :
LRDTYAEFGMGVSTGLDLPGESEGYIPKNYNVANVLTEAFGQYDSYTTIQLAQYVASIANGGKRVAPHIVGGIYDAGKNG
      510       520       530       540       550       560       570       580

2001      2031      2061      2091      2121      2151      2181      2211
KFAQLVRSITPKTLNKIAISDQELAIIQEGFYNVVNSGSGYATGTSMRGNVTTISGKTGTAETFAKNVNGQTVSTYNLNA
:   |   ::  :  |||:::   ::|  |||:||::|||||   |||  :|   ::    ||||||||||:|    ::|  :|:|  ||||
SLGTLSSTVDTRVLNKLSLDSKQLGIIQQGFHDVVNSGSSLATGKAMASSIIPISGKTGTAETYATDGSGNSVTTVNLNA
      590       600       610       620       630       640       650       660

2262      2292      2322      2352      2382      2412      2442
IAYDTNR---KIAVAVMYPHVTTDTTKSHQLVARDMIDQYISQFTGQ*ERTFECFTQHQLLN*LTAFQNYRV*VLKQQHV
:|||  :     |:|| :||||         :|:||   : ::: ||   :   |
VAYATAKDGTKLAVGIMYPHALDWKSKAHQNAVKAIMELYQNTH
      670       680       690       700
```

SEQ ID 8998 (GBS292) was expressed in *E. coli* as a GST-fusion product. SDS-PAGE analysis of total cell extract is shown in FIG. 68 (lane 9; MW 103 kDa).

GBS292-GST was purified as shown in FIG. 211, lane 7.

Based on this analysis, it was predicted that these proteins and their epitopes could be useful antigens for vaccines or diagnostics.

Example 2213

A DNA sequence (GBSx2332) was identified in *S. agalactiae* <SEQ ID 6831> which encodes the amino acid sequence <SEQ ID 6832>. Analysis of this protein sequence reveals the following:

Possible site: 47
>>> Seems to have no N-terminal signal sequence

----- Final Results -----
  bacterial cytoplasm --- Certainty = 0.2644 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:CAB51328 GB:AJ131985 phosphoglyceromutase [Streptococcus pneumoniae]
 Identities = 219/230 (95%), Positives = 226/230 (98%)

Query:    1 MVKLVFARHGESEWNKANLFTGWADVDLSEKGTQQAIDAGKLIQAAGIEFDLAFTSVLKR    60
              MVKLVFARHGESEWNKANLFTGWADVDLSEKGTQQAIDAGKLI+ AGI+FD A+TSVLKR
 Sbjct:    1 MVKLVFARHGESEWNKANLFTGWADVDLSEKGTQQAIDAGKLIKEAGIKFDQAYTSVLKR    60

Query:   61 AIKTTNLALEAADQLWVPVEKSWRLNERHYGGLTGKNKAEAAEQFGDEQVHIWRRSYDVL   120
              AIKTTNLALEA+DQLWVPVEKSWRLNERHYGGLTGKNKAEAAEQFGDEQVHIWRRSYDVL
 Sbjct:   61 AIKTTNLALEASDQLWVPVEKSWRLNERHYGGLTGKNKAEAAEQFGDEQVHIWRRSYDVL   120

Query:  121 PPDMAKDDEHSAHTDRRYASLDDSVIPDAENLKVTLERALPFWEDKIAPALKDGKNVFVG   180
              PP+M +DDEHSAHTDRRYASLDDSVIPDAENLKVTLERALPFWEDKIAPALKDGKNVFVG
 Sbjct:  121 PPNMDRDDEHSAHTDRRYASLDDSVIPDAENLKVTLERALPFWEDKIAPALKDGKNVFVG   180

Query:  181 AHGNSIRALVKHIKQLSDDEIMDVEIPNFPPLVFEFDEKLNLVSEYYLGK            230
              AHGNSIRALVKHIK LSDDEIMDVEIPNFPPLVFEFDEKLN+VSEYYLGK
 Sbjct:  181 AHGNSIRALVKHIKGLSDDEIMDVEIPNFPPLVFEFDEKLNVVSEYYLGK            230
```

A related DNA sequence was identified in *S. pyogenes* <SEQ ID 6833> which encodes the amino acid sequence <SEQ ID 6834>. Analysis of this protein sequence reveals the following:

Possible site: 61
>>> Seems to have no N-terminal signal sequence
----- Final Results -----
   bacterial cytoplasm --- Certainty = 0.2646 (Affirmative) <succ>
      bacterial membrane --- Certainty = 0.0000 (Not Clear) <succ>
         bacterial outside --- Certainty = 0.0000 (Not Clear) <succ>

An alignment of the GAS and GBS proteins is shown below.

```
Identities = 206/229 (89%), Positives = 214/229 (92%)

Query:   1  MVKLVFARHGESEWNKANLFTGWADVDLSEKGTQQAIDAGKLIQAAGIEFDLAFTSVLKR   60
            MVKLVFARHGESEWNKANLFTGWADVDLSEKGTQQAIDAGKLI+ AGIEFDLAFTSVL R
Sbjct:   1  MVKLVFARHGESEWNKANLFTGWADVDLSEKGTQQAIDAGKLIKEAGIEFDLAFTSVLTR   60

Query:  61  AIKTTNLALEAADQLWVPVEKSWRLNERHYGGLTGKNKAEAAEQFGDEQVHIWRRSYDVL  120
            AIKTTNLALE A QLWVP EKSWRLNERHYG LTGKNKAEAAEQF DEQVHIWRRSYDVL
Sbjct:  61  AIKTTNLALENAGQLWVPTEKSWRLNERHYGALTGKNKAEAAEQFCDEQVHIWRRSYDVL  120

Query: 121  PPDMARDDEHSAHTDRRYASLDDSVIPDAENLKVTLERALPFWEDKIAPALKDGKNVFVG  180
            PP MAKDDE+SAH DRRYA LD ++IPDAENLKVTLERA+P+WE+KIAPAL DGKNVFVG
Sbjct: 121  PPAMARDDEYSAHKDRRYADLDPALIPDAENLKVTLERAMPYWEEKIAPALLDGKNVFVG  180

Query: 181  AHGNSIRALVKHIKQLSDDEIMDVEIPNFPPLVFEFDEKLNLVSEYYLG             229
            AHGNSIRALVEHIK LSDDEIMDVEIPNFPPLVFE DEKLN+V EYYLG
Sbjct: 181  AHGNSIRALVEHIKGLSDDEIMDVEIPNFPPLVFELDEKLNIVKEYYLG             229
```

SEQ ID 6832 (GBS110) was expressed in *E. coli* as a His-fusion product. SDS-PAGE analysis of total cell extract is shown in FIG. 38 (lane 8; MW 28.9 kDa). It was also expressed in *E. coli* as a GST-fusion product. SDS-PAGE analysis of total cell extract is shown in FIG. 41 (lane 10; MW 53.9 kDa).

The GBS110-GST fusion product was purified (FIG. 204, lane 5) and used to immunise mice. The resulting antiserum was used for Western blot (FIG. 252A), FACS (FIG. 252B), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 2214

A DNA sequence (GBSx2333) was identified in *S. agalactiae* <SEQ ID 6835> which encodes the amino acid sequence <SEQ ID 6836>. This protein is predicted to be triosephosphate isomerase (tpiA). Analysis of this protein sequence reveals the following:

Possible site: 54
>>> Seems to have no N-terminal signal sequence
INTEGRAL Likelihood = −0.37 Transmembrane 36-52 (36-52)
----- Final Results -----
   bacterial membrane --- Certainty = 0.1150 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the GENPEPT database.

```
>GP:AAC43268 GB:U07640 triosephosphate isomerase [Lactococcus lactis]
Identities = 164/252 (65%), Positives = 202/252 (80%)

Query:   1  MSRKPFIAGNWKMNKNPEEAKAFIEAVASKLPSSELVEAGIAAPALTLSTVLEAAKGSEL   60
            MSRKP IAGNWKMNK   EA+AF+EAV + LPSS+ VE+ I APAL L+ +    +GSEL
Sbjct:   1  MSRKPIIAGNWKMNKTLSEAQAFVEAVKNNLPSSDNVESVIGAPALFLAPMAYLRQGSEL   60

Query:  61  KIAAQNSYFENSGAFTGENSPKVLAEMGIDYVVIGHSERRDYFHETDQDINKKAKAIFAN  120
            K+AA+NSYFEN+GAFTGENSP  + ++G +Y++IGHSERR+YFHETD+DINKKAKAIFA
Sbjct:  61  KLAAENSYFENAGAFTGENSPAAIVDLGIEYIIIGHSERREYFHETDEDINKKAKAIFAA  120

Query: 121  GLTPIICCGESLETYEAGKAVEFVGAQVSAALAGLSEEQVSSLVIAYEPIWAIGTGKSAT  180
            G TPI+CCGE+LET+EAGK  E+V  Q+ A LAGL+ EQVS+LVIAYEPIWAIGTGK+AT
Sbjct: 121  GATPILCCGETLETFEAGKTAEWVSGQIEAGLAGLTAEQVSNLVIAYEPIWAIGTGKTAT  180

Query: 181  QDDAQNMCKAVRDVVAADFGQAVADKVRVQYGGSVKPENVAEYMACPDVDGALVGGASLE  240
              + A   C  VR V   +G+ V++ VR+QYGGSVKPE +  MA ++DGALVGGASLE
Sbjct: 181  NEIADETCGVVRSTVEKLYGKEVSEAVRIQYGGSVKPETIEGLMAKENIDGALVGGASLE  240

Query: 241  AESFLALLDFVK                                                 252
            A+SFLALL+  K
Sbjct: 241  ADSFLALLEMYK                                                 252
```

A related DNA sequence was identified in *S. pyogenes* <SEQ ID 6837> which encodes the amino acid sequence <SEQ ID 6838>. Analysis of this protein sequence reveals the following:

```
Possible site: 42
>>> Seems to have no N-terminal signal sequence
INTEGRAL Likelihood = −1.81 Transmembrane 36-52 (36-52)
----- Final Results -----
    bacterial membrane --- Certainty = 0.1723 (Affirmative) <succ>
        bacterial outside --- Certainty = 0.0000 (Not Clear) <succ>
            bacterial cytoplasm --- Certainty = 0.0000 (Not Clear) <succ>
```

An alignment of the GAS and GBS proteins is shown below.

```
Identities = 220/251 (87%), Positives = 237/251 (93%)

Query:    1  MSRKPFIAGNWKMNKNPEEAKAFIEAVASKLPSSELVEAGIAAPALTLSTVLEAAKGSEL   60
             MSRKP IAGNWKMNKNP+EAKAF+EAVASKLPS++LV+  +AAPA+ L T +EAAK S L
Sbjct:    1  MSRKPIIAGNWKMNKNPQEAKAFVEAVASKLPSTDLVDVAVAAPAVDLVTTIEAAKDSVL   60

Query:   61  KIAAQNSYFENSGAFTGENSPKVLAEMGTDYVVIGHSERRDYFHETDQDINKKAKAIFAN  120
             K+AAQN YFEN+GAFTGE SPKVLAEMG DYVVIGHSERRDYFHETD+DINKKAKAIFAN
Sbjct:   61  KVAAQNCYFENTGAFTGETSPKVLAEMGADYVVIGHSERRDYFHETDEDINKKAKAIFAN  120

Query:  121  GLTPIICCGESLETYEAGKAVEFVGAQVSAALAGLSEEQVSSLVIAYEPIWAIGTGKSAT  180
             GLTPI+CCGESLETYEAGKAVEFVGAQVSAALAGLS EQV+SLV+AYEPIWAIGTGKSAT
Sbjct:  121  GLTPIVCCGESLETYEAGKAVEFVGAQVSAALAGLSAEQVASLVLAYEPIWAIGTGKSAT  180

Query:  181  QDDAQNMCKAVRDVVAADFGQAVADKVRVQYGGSVKPENVAEYMACPDVDGALVGGASLE  240
             QDDAQNMCKAVRDVVAADFGQ VADKVRVQYGGSVKPENV +YMACPDVDGALVGGASLE
Sbjct:  181  QDDAQNMCKAVRDVVAADFGQEVADKVRVQYGGSVKPENVKDYMACPDVDGALVGGASLE  240

Query:  241  AESFLALLDFV                                                  251
             A+SFLALLDF+
Sbjct:  241  ADSFLALLDFL                                                  251
```

Based on this analysis, it was predicted that these proteins and their epitopes could be useful antigens for vaccines or diagnostics.

Example 2215

A DNA sequence (GBSx2334) was identified in *S. agalactiae* <SEQ ID 6839> which encodes the amino acid sequence <SEQ ID 6840>. Analysis of this protein sequence reveals the following:

```
Possible site: 23
>>> Seems to have no N-terminal signal sequence
----- Final Results -----
    bacterial cytoplasm --- Certainty = 0.3050 (Affirmative) <succ>
        bacterial membrane --- Certainty = 0.0000 (Not Clear) <succ>
            bacterial outside --- Certainty = 0.0000 (Not Clear) <succ>
```

The protein has homology with the following sequences in the GENPEPT database.

```
>GP:AAB41198 GB:U75481 elongation factor-Tu [Streptococcus mutans]

Identities = 44/45 (97%), Positives = 45/45 (99%)

Query:    1  MVMPGDNVTIEVELIHPIAVEQGTTFSIREGGRTVGSGIVSEIEA   45
             MVMPGDNVTI+VELIHPIAVEQGTTFSIREGGRTVGSGIVSEIEA
Sbjct:  117  MVMPGDNVTIDVELIHPIAVEQGTTFSIREGGRTVGSGIVSEIEA  161
```

There is also homology to SEQ ID 1022:

```
Identities = 44/45 (97%), Positives = 44/45 (97%)

Query:   1  MVMPGDNVTIEVELIHPIAVEQGTTFSIREGGRTVGSGIVSEIEA   45
            MVMPGDNVTI VELIHPIAVEQGTTFSIREGGRTVGSGIVSEIEA
Sbjct: 371  MVMPGDNVTINVELIHPIAVEQGTTFSIREGGRTVGSGIVSEIEA  415
```

Based on this analysis, it was predicted that these proteins and their epitopes could be useful antigens for vaccines or diagnostics.

Example 2216

A DNA sequence (GBSx2335) was identified in *S. agalactiae* <SEQ ID 6841> which encodes the amino acid sequence <SEQ ID 6842>. Analysis of this protein sequence reveals the following:

```
Possible site: 32
>>> Seems to have no N-terminal signal sequence
INTEGRAL    Likelihood = –2.66    Transmembrane 81-97 (80-97)
INTEGRAL    Likelihood = –2.60    Transmembrane 18-34 (17-34)
----- Final Results -----
   bacterial membrane --- Certainty = 0.2062 (Affirmative) <succ>
      bacterial outside --- Certainty = 0.0000 (Not Clear) <succ>
         bacterial cytoplasm --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2217

A DNA sequence (GBSx2336) was identified in *S. agalactiae* <SEQ ID 6843> which encodes the amino acid sequence <SEQ ID 6844>. Analysis of this protein sequence reveals the following:

```
Possible site: 26
>>> Seems to have no N-terminal signal sequence
----- Final Results -----
   bacterial cytoplasm --- Certainty = 0.0596 (Affirmative) <succ>
      bacterial membrane --- Certainty = 0.0000 (Not Clear) <succ>
         bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2218

A DNA sequence (GBSx2337) was identified in *S. agalactiae* <SEQ ID 6845> which encodes the amino acid sequence <SEQ ID 6846>. Analysis of this protein sequence reveals the following:

```
Possible site: 14
>>> Seems to have no N-terminal signal sequence
----- Final Results -----
   bacterial cytoplasm --- Certainty = 0.3559 (Affirmative) <succ>
      bacterial membrane --- Certainty = 0.0000 (Not Clear) <succ>
         bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2219

A DNA sequence (GBSx2338) was identified in *S. agalactiae* <SEQ ID 6847> which encodes the amino acid sequence <SEQ ID 6848>. Analysis of this protein sequence reveals the following:

```
Possible site 33
>>> Seems to have an uncleavable N-term signal sequence
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the GENPEPT database.

```
>GP:AAF96286 GB:AE004374 hypothetical protein [Vibrio cholerae]
Identities = 56/167 (33%), Positives = 89/167 (52%), Gaps = 12/167 (7%)

Query:  18  LAIIKSLPLNDCWLCAGTLRNFVWNKLS-GINETLTSDIDVVFFDKNI---SYEETVVLE   73
            L  +  L L  C++ AG +RN VW+ L    +  T  +DIDV+FFD  +     YE++  LE
Sbjct:  41  LECVYQLELPQCYIAAGFVRNLVWDSLHHNVKLTPLNDIDVIFFDADCLDSDYEKS--LE   98

Query:  74  QQLKDNYPQYDWELKNEFYMNTHSPNTPKYTSSKDAISKFPEKCTAVGARLDDRNQLELY  133
            +L +  PQ +W++KN+  M+  + + P Y S+ DA+S +PEK TAV  R   +  ++ E
Sbjct:  99  LKLSEQMPQLNWQVKNQAKMHLQNGDNP-YQSTLDAMSYWPEKETAVAVRKVEHDRYECI  157

Query: 134  LPYGEEEILNFIVSPTPYFEEDLLRYNVYLKRVDKKKWNNIWPRLTI              180
```

```
                +G E +      ++  P           Y ++  RV  K W   +WP L I
Sbjct:  158     SAFGFESLFQGFITHNP-----KRAYGIFENRVKSKGWLAMWPNLRI          199
```

No corresponding DNA sequence was identified in *S. pyogenes*.

Based on this analysis, it was predicted that this protein and its epitopes, could be useful antigens for vaccines or diagnostics.

Example 2220

A DNA sequence (GBSx2339) was identified in *S. agalactiae* <SEQ ID 6849> which encodes the amino acid sequence <SEQ ID 6850>. Analysis of this protein sequence reveals the following:

Possible site: 17
>>> Seems to have no N-terminal signal sequence
----- Final Results -----
    bacterial cytoplasm --- Certainty = 0.2779 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database.

```
>GP:CAB13060 GB:Z99110 yjdF [Bacillus subtilis]
Identities = 47/138 (34%), Positives = 93/138 (67%), Gaps = 2/138 (1%)

Query:    1  MKMTVYFDGNFWLGLIEYDDDGDYKVFRYFFGKEPKDDDVFNFINHKLNDLIKKYEFVKT   60
             MK+T+Y+DG FW+G++E  D+G  + FR+ FGKEP+D +V  F++++L +++ + E +
Sbjct:   24  MKLTIYYDGQFWVGVVEVVDNGKLRAFRHLFGKEPRDSEVLEFVHNQLLNMMAQAE--QE   81

Query:   61  DISLKRTNEHKKSPKRMQREINREKRKPVVSTKAQLAMKTIHMSIKNERQLSQKCKKNEL  120
             + L+   + K +PKR+QR++++E +    V++KAQ A+K   + K +++ K  ++  +
Sbjct:   82  GVRLQGRRQKKINPKRLQRQVSKELKNAGVTSKAQEAIKLELEARKQKKKQIMKEQREHV  141

Query:  121  RKHRYQLKQEKRYQKKKG                                            138
             ++ RY LK++K  +K +G
Sbjct:  142  KEQRYMLKKQKAKKKHRG                                            159
```

Example 2221

A DNA sequence (GBSx2340) was identified in *S. agalactiae* <SEQ ID 6851> which encodes the amino acid sequence <SEQ ID 6852>. This protein is predicted to be ComX1. Analysis of this protein sequence reveals the following:

Possible site: 52
>>> Seems to have no N-terminal signal sequence
----- Final Results -----
    bacterial cytoplasm --- Certainty = 0.3143 (Affirmative) <succ>
    bacterial membrane --- Certainty = 0.0000 (Not Clear) <succ>
    bacterial outside --- Certainty = 0.0000 (Not Clear) <succ>

A related GBS nucleic acid sequence <SEQ ID 9469> which encodes amino acid sequence <SEQ ID 9470> was also identified.

The protein has homology with the following sequences in the GENPEPT database.

```
>GP:AAD50429 GB:AF161701 ComX2 [Streptococcus pneumoniae]
Identities = 61/152 (40%), Positives = 95/152 (62%)

Query:    5  EELFDKVKPIVMKLRRNYFVQLWEYDDWIQEGRIVLFRLLEEHPYLLDNESKLFIYFKTK   64
             +EL+++V+  V K R  Y++ LWE  DW QEG + L  L+      L+D+  +L YFKTK
Sbjct:    3  KELYEEVQGTVYKCRNEYYLHLWELSDWDQEGMLCLHELISREEGLVDDIPRLRKYFKTK   62

Query:   65  FSNYLNDVLRHQDCQKRQFNKMPYEEISEVSHYVKSKGLVLDDYIAYRDTLTKVEETLSD  124
             F N + D +R Q+ QKR+++K PYEE+ E+SH +    GL LDDY   +TL        S
Sbjct:   63  FRNRILDYIRKQESQKRRYDKEPYEEVGEISHRISEGGLWLDDYYLFHETLRDYRNKQSK  122

Query:  125  IDKEKFEKLISGERFAGKKQFIRDIQPFFNAF                              156
             +E+ E+++S ERF G+++ +RD++  F  F
Sbjct:  123  EKQEELERVLSNERFRGRQRVLRDLRIVFKEF                              154
```

No corresponding DNA sequence was identified in *S. pyogenes*.

Based on this analysis, it was predicted that this protein and its epitopes, could be useful antigens for vaccines or diagnostics.

A related DNA sequence was identified in *S. pyogenes* <SEQ ID 6853> which encodes the amino acid sequence <SEQ ID 6854>. Analysis of this protein sequence reveals the following:

```
Possible site: 39
>>> Seems to have an uncleavable N-term signal sequence
INTEGRAL     Likelihood = -10.35     Transmembrane 9-25 (7-28)
----- Final Results -----
   bacterial membrane --- Certainty = 0.5140 (Affirmative) <succ>
     bacterial outside --- Certainty = 0.0000 (Not Clear) <succ>
       bacterial cytoplasm --- Certainty = 0.0000 (Not Clear) <succ>
```

A related sequence was also identified in GAS <SEQ ID 9163> which encodes the amino acid sequence <SEQ ID 9164>. Analysis of this protein sequence reveals the following:

```
Possible site: 29
>>> Seems to have an uncleavable N-term signal sequence
INTEGRAL     Likelihood = -10.35     Transmembrane 2-18 (1-18)
----- Final Results -----
   bacterial membrane --- Certainty = 0.160 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP:AAD50429 GB:AF161701 ComX2 [Streptococcus pneumoniae]

Identities = 60/149 (400), Positives = 98/149 (6596)

Query:   41  FEKVKPIILKLKRHYYIQLWDRDDWLQEGHIILLQLLERYPELIEEEERLYRYFKTKFSS 100
             +E+V+  + K +  YY+ LW+  DW QEG + L +L+ R   L+++  RL +YFKTKF +
Sbjct:    6  YEEVQGTVYKCRNEYYLHLWELSDWDQEGMLCLHELISREEGLVDDIPRLRKYFKTKFRN  65

Query:  101  YLKDLLRRQESQKRQFHKLAYEEIGEVAHAIPSRGLWLDDYVAYQEVIASLENQLNSQER 160
             + D +R+QESQKR++ K  YEE+GE++H I   GLWLDDY  + E +   N+ + +++
Sbjct:   66  RILDYIRKQESQKRRYDKEPYEEVGEISHRISEGGLWLDDYYLFHETLRDYRNKQSKEKQ 125

Query:  161  MQFQALIRGERFKGRRALLRKISPYFKEF                                189
             + + ++  ERF+GR+ +LR +   FKEF
Sbjct:  126  EELERVLSNERFRGRQRVLRDLRIVFKEF                                154
```

An alignment of the GAS and GBS proteins is shown below.

```
Identities = 78/149 (52%), Positives = 116/149 (77%)

Query:    8  FDKVKPIVMKLRRNYFVQLWEYDDWIQEGRIVLFRLLEEHPYLLDNESKLFIYFKTKFSN  67
             F+KVKPI++KL+R+Y++QLW+ DDW+QEG I+L +LLE +P L++ E +L+ YFKTKFS+
Sbjct:   41  FEKVKPIILKLKRHYYIQLWDRDDWLQEGHIILLQLLERYPELIEEEERLYRYFICKFSS 100

Query:   68  YLNDVLRHQDCQKRQFNKMPYEEISEVSHYVKSKGLVLDDYIAYRDTLTKVEETLSDIDK 127
             YL D+LR Q+ QKRQF+K+ YEEI EV+H + S+GL LDDY+AY++ + +E  L+  ++
Sbjct:  101  YLKDLLRRQESQKRQFHKLAYEEIGEVAHAIPSRGLWLDDYVAYQEVIASLENQLNSQER 160

Query:  128  EKFEKLISGERFAGKKQFIRDIQPFFNAF                                156
             +F+ LI GERF G++  +R I P+F  F
Sbjct:  161  MQFQALIRGERFKGRRALLRKISPYFKEF                                189
```

Based on this analysis, it was predicted that these proteins and their epitopes could be useful antigens for vaccines or diagnostics.

Example 2222

A DNA sequence (GBSx2341) was identified in *S. agalactiae* <SEQ ID 6855> which encodes the amino acid sequence <SEQ ID 6856>. Analysis of this protein sequence reveals the following:

```
Possible site: 57
>>> Seems to have no N-terminal signal sequence
INTEGRAL     Likelihood = −2.23   Transmembrane 166-182 (166-182)
----- Final Results -----
   bacterial membrane --- Certainty = 0.1893 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the GENPEPT database.

```
>GP:CAA99510 GB:Z75191 ORF YOR283w [Saccharomyces cerevisiae]

Identities = 57/226 (25%), Positives = 97/226 (42%), Gaps = 22/226 (9%)

Query:    4  VRLYIARHGETMFNTIGRAQGWSDTPLTTFGELGIKELGLGLEASNISFKEAFSSDSGRT   63
             +RL+I RHG+T N     QG  DT +    GE    +LG L++   I F + SSD  R
Sbjct:   17  IRLFIIRHGQTEHNVKKILQGHKDTSINPTGEEQATKLGHYLRSRGIHFDKVVSSDLKRC  76

Query:   64  LQTMEIILREVQQENIPYTRDKRIREWCFGSLDGGYDGDLFNGVLPRVSNGDMSHLTHEE  123
             QT  ++L+  +QEN+P  +      +RE   G ++G                 M   E+
Sbjct:   77  RQTTALVLKHSKQENVPTSYTSGLRERYMGVIEG-----------------MQITEAEK  118

Query:  124  IANLICQVDTAGWAEPWAILSNRILSGFTAIAKKIEDIGGGNAIVVSHGMTIATFL-WL-  181
             A+   +     + E      R+         + + G  N  +VSHG  I    L WL
Sbjct:  119  YADKHGEGSFRNFGEKSDDFVARLTGCVEEEVAEASNEGVKNLALVSHGGAIRMILQWLK 178

Query:  182  IDHSTPRSLGLDNGSVSVVDF--EDGTFSIQSIGDMSYREKGREIL              225
             ++        + + N SV++VD+  +    F ++ +G+  +     G  ++
Sbjct:  179  YENHQAHKIIVFNTSVTIVDYVKDSKQFIVRRVGNTQHLGDGEFVV              224
```

A related DNA sequence was identified in *S. pyogenes* <SEQ ID 6857> which encodes the amino acid sequence <SEQ ID 6858>. Analysis of this protein sequence reveals the following:

```
Possible site: 57
>>> Seems to have no N-terminal signal sequence
INTEGRAL     Likelihood = −0.69   Transmembrane 170-186 (170-186)
----- Final Results -----
   bacterial membrane --- Certainty = 0.1277 (Affirmative) <succ>
      bacterial outside --- Certainty = 0.0000 (Not Clear) <succ>
         bacterial cytoplasm --- Certainty = 0.0000 (Not Clear) <succ>
```

The protein has homology with the following sequences in the databases:

```
>GP:CAA99510 GB:Z75191 ORF YOR283w [Saccharomyces cerevisiae]

Identities = 64/231 (27%), Positives = 98/231 (41%), Gaps = 27/231 (11%)

Query:    5  RLYIARHGKTMFNTIGRAQGWSDTPLIKKGEEGIRELGLGLKDATIPFKAAFSSDSGRTM   64
             RL+I RHG+T N     QG  DT +    GEE  +LG L+    I F   SSD  R
Sbjct:   18  RLFIIRHGQTEHNVKKILQGHKDTSINPTGEEQATKLGHYLRSRGIHFDKVVSSDLKRCR  77

Query:   65  QTIEIILRESENEFLPYTKDNRIREWCFGSLEGTYDSELFLGVLPRTKAFENRDNLRDVP  124
             QT  ++L+ S+ E +P  +    +RE   G +EG   +E
Sbjct:   78  QTTALVLKHSKQENVPTSYTSGLRERYMGVIEGMQITEA--------------------  116

Query:  125  YSELAESIVEVDTANWAEPWEVLRKRIWEGFEAIALSIQNAGGGNALVVSHGMTIGTFL-  183
              + A+    E    N+ E  +     R+     E       N  G N  +VSHG  I    L
Sbjct:  117  -EKYADKHGEGSFRNFGEKSDDFVARLTGCVEEEVAEASNEGVKNLALVSHGGAIRMILQ  175

Query:  184  WL--IDPDRDKQYIDNGSVTVVEF--DDGQFTIKTIGDMSYRYRGREIIEE           230
             WL      K  + N SVT+V++  D    QF ++ +G+  +       G  ++ +
Sbjct:  176  WLKYENHQAHKIIVFNTSVTIVDYVKDSKQFIVRRVGNTQHLGDGEFVVSD          226
```

An alignment of the GAS and GBS proteins is shown below.

```
Identities = 150/231 (64%), Positives = 182/231 (77%), Gaps = 5/231 (2%)

Query:   1  MSKVRLYIARHGKIMFNTIGRAQGWSDTPLTTFGELGIKELGLGLKASNISFKEAFSSDS  60
            M+K RLYIARHGK MFNTIGRAQGWSDTPLT  GE GI+ELGLGLK + I FK AFSSDS
Sbjct:   1  MTKTRLYIARHGKIMFNTIGRAQGWSDTPLTKKGEEGIRELGLGLKDATIPFKAAFSSDS  60

Query:  61  GRILQTMEIILREVQQENIPYIRDKRIREWCFGSLDGGYDGDLFNGVLPRV----SNGDM 116
            GRT+QT+EIILRE + E +PYT+D RIREWCFGSL+G YD +LF GVLPR      + ++
Sbjct:  61  GRTMQTIEIILRESENEFLPYTKDNRIREWCFGSLEGTYDSELFLGVLPRTKAFENRDNL 120

Query: 117  SHLTHEEIANLICQVDTAGWAEPWAILSNRILSGFTAIAKKIEDIGGGNAIVVSHGMTIA 176
             + + E+A  I +VDTA WAEPW +L  RI  GF AIA   I++ GGGNA+VVSHGMTI
Sbjct: 121  RDVPYSELAESIVEVDTANWAEPWEVLRKRIWEGFEAIALSIQNAGGGNALVVSHGMTIG 180

Query: 177  TFLWLIDHSTPRSLGLDNGSVSVVDFEDGTFSIQSIGDMSYREKGREILEK          227
            TFLWLID   +    +DNGSV+VV+F+DG F+I++IGDMSYR +GREI+E+
Sbjct: 181  TFLWLIDPDRDKQY-IDNGSVTVVEFDDGQFTIKTIGDMSYRYRGREIIEE          230
```

A related GBS gene <SEQ ID 8999> and protein <SEQ ID 9000> were also identified. Analysis of this protein sequence reveals the following:

```
Cytoplasmic predicted but experimentally found on the surface of Streptococci
32.3/52.0% over 184aa
Thermotoga maritima
EGAD|165681| phosphoglycerate mutase Insert characterized
GP|4981935|gb|AAD36444.1|AE001791_6|AE001791 phosphoglycerate mutase Insert characterized
PIR|G72260|G72260 phosphoglycerate mutase - (strain MSB8) Insert characterized
ORF01265(268-870 of 1248)
EGAD|165681|TM1374(1-185 of 201) phosphoglycerate mutase {Thermotoga maritima}
GP|4981935|gb|AAD36444.1|AE001791_6|AE001791 phosphoglycerate mutase {Thermotoga maritima}
PIR|G72260|G72260 phosphoglycerate mutase - Thermotoga maritima (strain MSB8)
% Match = 6.3
% Identity = 32.2 % Similarity = 52.0
Matches = 57 Mismatches = 78 Conservative Sub.s = 35

105       135       165       195       225       255       285       315
RGRNNSYEIFNPFSMLLKRINRFYFCSR*LQNFFIGKVR*YIPVKAFVFCYNIIKCL*GVSMSKVRLYIARHGKTMFNTI
                                                             ::||: |||:|::|
                                                             MKLYLIRHGETIWNEK
                                                                    10

345       375       405       435       465       495       519       549
GRAQGWSDTPLTTFGELGIKELGLGLKASNISFKEAFSSDSXRTLQTMEIILREVQQENT--PYTRDKRIREWCFGSLDG
|  ||  :|  ||       |    ::|    ||         :||   :|:|   |    ::|    |:   |   |
GLWQGVTDVPLNERGREQARKLANSLK----RVDAIYSSPLKRSLETAEEIARRFEKEIIVEEDLRECEISLW-------
         30        40        50            60        70        80

579       609       639       669              699       729       759
GYDGDLFNGVLPRVSNGDMSHLTHEEIANLICQVDTAGWA----------EPWAILSNRILSGFTAIAKKIEDIGGGNAI
: |||| |         |:    |:  |:                    | ||::   |  :  :  :   |     |:
------------------NGLTVEE-AIREYPVEFKKWSSDPNFGMEGLESMRNVQNRVVKAIMKIVSQEKLNGSENVV
                  90        100       110       120       130       140

789       816       840       870       900       930       960       990
VVSHGMTIATFL-WLIDHST--PRSLGLDNGSVSVVDFEDGTFSIQSIGDMSYREKGREILEKTLQ*KKIKLSDSV*LVF
:|||  :::  |: |::      |:: |||  |:|||: |    :           :|
IVSHSLSLRAFICWILGLPLYLHRNFKLDNASLSVVEIESKPRLVLLNDTCHLKES
         160       170       180       190       200
```

SEQ ID 9000 (GBS44) was expressed in *E. coli* as a His-fusion product. SDS-PAGE analysis of total cell extract is shown in FIG. 4 (lane 6; MW 27 kDa), in FIG. 168 (lane 8-10; MW 42 kDa—thioredoxin fusion) and in FIG. 238 (lane 7; MW 42 kDa). It was also expressed in *E. coli* as a GST-fusion product. SDS-PAGE analysis of total cell extract is shown in FIG. 12 (lane 8; MW 52.4 kDa).

Purified Thio-GBS44-His is shown in FIG. 244, lanes 7 & 8.

Based on this analysis, it was predicted that these proteins and their epitopes could be useful antigens for vaccines or diagnostics.

Example 2223

A DNA sequence (GBSx2342) was identified in *S. agalactiae* <SEQ ID 6859> which encodes the amino acid sequence <SEQ ID 6860>. This protein is predicted to be d-alanyl-d-alanine carboxypeptidase. Analysis of this protein sequence reveals the following:

Possible site: 27
>>> Seems to have a cleavable N-term signal sequence
----- Final Results -----

```
bacterial outside --- Certainty = 0.3000 (Affirmative) <succ>
  bacterial membrane --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:AAD00280 GB:U78599 putative D,D-carboxypeptidase [Streptococcus mutans]
Identities = 108/169 (63%), Positives = 139/169 (81%)
Query: 79    ELSPDVVPVENIYLDKRITKQATQFLEAARAIDSREHLISGYRSVAYQEKLFNSYVTQEM    138
             E++PDV  ++ + +D RI +    +FL AA+ IDS EHLISGYRSVAYQE+L+N+Y+ QE
Sbjct: 4     EMNPDVTDIDGVKVDSRIAENTRKFLAAAQEIDSSEHLISGYRSVAYQEELYNNYIAQEK    63

Query: 139   TSNPNLTRGQAEKLVKTYSQPAGASEHQTGLAMDMSTVDSLNESDPRVVSQLKKIAPQYG    198
               +NP+L++ +A+K V+TYSQP G+SEHQTGLA+DMSTVDSLN+SD   VV+++  IAP+YG
Sbjct: 64    ANNPSLSQEEAQKQVQTYSQPPGSSEHQTGLAIDMSTVDSLNQSDANVVAKVAAIAPKYG    123

Query: 199   FVLRFPDGKTAETGVGYEDWHYRYVGVESAKYMAKHHLTLEEYITLLKE    247
             FVLRFP+GK    TG+ YEDWHYRYVGV+SAKYM KH LTLEEY+  LKE
Sbjct: 124   FVLRFPEGKKDATGIDYEDWHYRYVGVKSAKYMTKHDLTLEEYLKKLKE    172
```

A related DNA sequence was identified in *S. pyogenes* <SEQ ID 6861> which encodes the amino acid sequence <SEQ ID 6862>. Analysis of this protein sequence reveals the following:

```
Possible site: 26
>>> Seems to have an uncleavable N-term signal sequence
INTEGRAL    Likelihood = -9.66    Transmembrane 10-26 (3-29)
----- Final Results -----
  bacterial membrane --- Certainty = 0.4864 (Affirmative) <succ>
    bacterial outside --- Certainty = 0.0000 (Not Clear) <succ>
      bacterial cytoplasm --- Certainty = 0.0000 (Not Clear) <succ>
```

The protein has homology with the following sequences in the databases:

```
>GP:AAD00280 GB:U78599 putative D,D-carboxypeptidase [Streptococcus mutans]
Identities = 118/173 (68%), Positives = 139/173 (80%)
Query: 74    ITKEMSPELADINGISVDKRIEQATSDFLAAAQAIDLQEHLISGYRSVDYQTELYQSYIK    133
             IT EM+P++  DI+G+ VD RI + T  FLAAAQ ID  EHLISGYRSV YQ ELY +YI
Sbjct: 1     ITAEMNPDVTDIDGVKVDSRIAENTRKFLAAAQEIDSSEHLISGYRSVAYQEELYNNYIA    60

Query: 134   KEMANDPTLTQEAAEALVQTYSQPPGASEHHTGLAIDMSTVDTLNASDPSVAKAVQKIAP    193
             +E AN+P+L+QE A+   VQTYSQPPG+SEH TGLAIDMSTVD+LN  SD  V     IAP
Sbjct: 61    QEKANNPSLSQEEAQKQVQTYSQPPGSSEHQTGLAIDMSTVDSLNQSDANVVAKVAAIAP    120

Query: 194   DYGFVLRFPEGKKTSTGVDYEDWHYRYVGKASARYMAQHNLTLEEYIAALKEK    246
              YGFVLRFPEGKK +TG+DYEDWHYRYVG  SA+YM +H+LTLEEY+  LKEK
Sbjct: 121   KYGFVLRFPEGKKDATGIDYEDWHYRYVGVKSAKYMTKHDLTLEEYLKELKEK    173
```

An alignment of the GAS and GBS proteins is shown below.

```
Identities = 131/235 (55%), Positives = 172/235 (72%), Gaps = 3/235 (1%)
Query: 15    LLAILCF--SLFALLKPNSQQSSSQKLRNEDIKKISSQKRNKKLQLPAVSSKDWNLILVN    72
             LL ++ F    L+   +KP      + +Q L   ++I++    +K ++   LP VS +DW L+LVN
Sbjct: 12    LLIVIVFLGGLYLFIKPEESVTPTQ-LNKKEIQQKDIKKTDRLRALPKVSVEDWELVLVN    70

Query: 73    RDHKEELSPDVVPVENIYLDKRITKQATQFLEAARAIDSREHLISGYRSVAYQEKLFNS    132
             RDH  +E+SP++  +   I +DKRI +  + FL AA+AID +EHLISGYRSV YQ +L+  S
Sbjct: 71    RDHITKEMSPELADINGISVDKRIEQATSDFLAAAQAIDLQEHLISGYRSVDYQTELYQS    130

Query: 133   YVTQEMTSNPNLTRGQAEKLVKTYSQPAGASEHQTGLAMDMSTVDSLNESDPRVVSQLKK    192
             Y+ +EM ++P LT+   AE LV+TYSQP  GASEH TGLA+DMSTVD+LN SDP V  ++K
Sbjct: 131   YIKKEMANDPTLTQEAAEALVQTYSQPPGASEHHTGLAIDMSTVDTLNASDPSVAKAVQK    190

Query: 193   IAPQYGFVLRFPDGKTAETGVGYEDWHYRYVGVESAKYMAKHHLTLEEYITLLKE    247
```

```
            IAP YGFVLRFP+GK    TGV YEDWHYRYVG  SA+YMA+H+LTVEEYI  LKE
Sbjct: 191  IAPDYGFVLRFPEGKKTSTGVDYEDWHYRYVGKASARYMAQHNLTLEEYIAALKE          245
```

A related GBS gene <SEQ ID 9001> and protein <SEQ ID 9002> were also identified. Analysis of this protein sequence reveals the following:

```
Lipop: Possible site: -1 Crend: 7
McG: Discrim Score: 14.03
GvH: Signal Score (-7.5) : -1.02
Possible site: 27
>>> Seems to have a cleavable N-term signal sequence
ALOM program       count: 0 value: 10.08       threshold: 0.0
PERIPHERAL         Likelihood = 10.08          56
modified ALOM score: -2.52
*** Reasoning Step: 3
----- Final Results -----
    bacterial outside --- Certainty = 0.3000 (Affirmative) <succ>
       bacterial membrane --- Certainty = 0.0000 (Not Clear) <succ>
          bacterial cytoplasm --- Certainty = 0.0000 (Not Clear) <succ>
```

The protein has homology with the following sequences in the databases:

```
33.7/55.1% over 183aa
Enterococcus faecalis
EGAD|41322| d-alanyl-d-alanine carboxypeptidase Insert characterized
GP|1209528|gb|AAB05624.1||U35369 D,D-carboxypeptidase Insert characterized
ORF01266(484-1038 of 1350)
EGAD|41322|43646(85-268 of 268) d-alanyl-d-alanine carboxypeptidase {Enterococcus
faecalis}SP|Q47746|VANY_ENTFA D-ALANYL-D-ALANINE
CARBOXYPEPTIDASE (EC 3.4.16.4) (DD-PEPTIDASE) (DD-
CARBOXYPEPTIDASE).GP|1209528|gb|AAB05624.1||U35369 D,D-carboxypeptidase
{Enterococcus faecalis}
% Match = 10.1
% Identity = 33.7 % Similarity = 55.1
Matches = 63 Mismatches = 79 Conservative Sub.s = 40

234        264        294        324        354        384        414        444
SR*F*RWNIFYSIYWGYVLSRKRKRNFRKNIAMKKNKIIRFSLVGVLLAILCFSLFALLKPNSQQSSSQKLRNEDIKKIS

MEKSNYHSNVNHHKRHMKQSGEKRAFLWAFIISFTVCTLFLGWRLVSVLEATQLPPIPATHTGSGTGVAEN
                10        20        30        40        50        60        70

474        504        531        561        588        618        648        678
SQKRNKKLQLPAVSSKDWNLILVNRDHK-HEELSPDVVPVEN-IYLDKRITKQATQFLEAARAIDSREHLISGYRSVAYQ
:      ::|:|||||| :     ::  :  |  :| ||:    :::||||     : ||||:   |
PEENTLATAKEQGDEQEWSLILVNRQNPIPAQYDVELEQLSNGERIDIRISPYLQDLFDAARADGVYPIVASGYRTTEKQ
              90        100        110        120        130        140        150

708        738        768        798        828        858        888        918
EKLFNSYVTQEMTSNPNLTRGQAEKLVKTYSQPAGASEHQTGLAMDMSTVDSLNESDPRVVSQLKKIAPQYGFVLRFPDG
::: :  |    |  :    |   ||:   :|:     |  |||| |||:|::   | ::  :     |  ||:  |:|
QEIMDEKV-AEYKAK-GYTSAQAKAEAETWVAVPGTSEHQLGLAVDINA-DGIHSTGNEVYRWLDENSYRFGFIRRYPPD
          160        170        180        190        200        210        220

948        978        1008       1038       1068       1098       1128       1158
KTAETGVGYEDWHYRYVGVESAKYMAKHHLTLEEYITLLKENNQ*GNVFPC*ILLLLLLFSFSLFFFRF*TIREK*MLIL
||   |||  | |||||||||:|:|    :   |  |||||:  |
KTEITGVSNEPWHYRYVGIEAATKIYHOGLCLEEYLNTEK
```

SEQ ID 6860 (GBS18) was expressed in *E. coli* as a His-fusion product. SDS-PAGE analysis of total cell extract is shown in FIG. 4 (lane 3; MW 31 kDa).

The GBS18-His fusion product was purified (FIG. 93A; see also FIG. 189, lane 11) and used to immunise mice (lane 2 product; 20 μg/mouse). The resulting antiserum was used for Western blot (FIG. 93B), FACS (FIG. 93C), and in the in vivo passive protection assay (Table III). These tests confirm that the protein is immunoaccessible on GBS bacteria and that it is an effective protective immunogen.

Example 2224

A DNA sequence (GBSx2343) was identified in *S. agalactiae* <SEQ ID 6863> which encodes the amino acid sequence <SEQ ID 6864>. This protein is predicted to be unnamed protein product. Analysis of this protein sequence reveals the following:

```
Possible site: 34
>>> Seems to have an uncleavable N-term signal sequence
INTEGRAL    Likelihood = -12.58    Transmembrane 10-26 (3-29)
----- Final Results -----
   bacterial membrane --- Certainty = 0.6031 (Affirmative) <succ>
```

-continued

```
   bacterial outside --- Certainty = 0.0000 (Not Clear) <succ>
      bacterial cytoplasm --- Certainty = 0.0000 (Not Clear) <succ>
```

A related DNA sequence was identified in *S. pyogenes* <SEQ ID 6865> which encodes the amino acid sequence <SEQ ID 6866>. Analysis of this protein sequence reveals the following:

Possible site: 33
>>> Seems to have an uncleavable N-terminal signal sequence
INTEGRAL     Likelihood = −11.83    Transmembrane 10-26 (4-33)
----- Final Results -----
  bacterial membrane --- Certainty = 0.5734 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the databases:

```
>GP:AAD00279 GB:U78599 putative N-acetyl-muramidase [Streptococcus mutans]
Identities = 66/150 (44%), Positives = 97/150 (64%), Gaps = 5/150 (3%)
Query:  18    LLLIVCPLLSSQRIASADKEVRVNYSQKQFITKMGKEVKPLAKYYGIRPSILIAQILLET      77
              LL+I+ P+L+S  +A A+K++   YS K+F+ ++    + L+K YG+R SI+I Q  L++
Sbjct:   3    LLVILLPILASGGLADANKKMPSPYSHKEFVKEIAPTAQKLSKIYGVRSSIIIGQAALDS      62

Query:  78    HDGKTLLASKYHNLFSKKATPGQVAITLKSPKQTN---QNV--RYAIYKDDASAIRDYLR     132
              H G TLLASKYHNLFS +A+PGQ A+ LKS +   N   Q V  RY +Y+    ++ DY+
Sbjct:  63    HFGSTLLASKYHNLFSIEASPGQGAVRLKSHEYKNGRWQEVTNRYLVYESWKESLYDYMA     122

Query: 133    MLRQGKEVDKRLYRNLATEKGYKAPAKSLQ                                 162
              +L   K  DK LY + T  GYK  A++LQ
Sbjct: 123    ILHGNKIWDKALYTTMMTSSGYKTVARALQ                                 152
```

An alignment of the GAS and GBS proteins is shown below.

```
Identities = 67/190 (35%), Positives = 102/190 (53%), Gaps = 1/190 (0%)
Query:   1    MRKRFSLLNFIVVTFIFFFFILFPLLNHKGKVDANSRQSVTYTKEEFIQKIVPDAQDLGK      60
              MRKR    F+ +   F    I+ PLL+ +     A+     V Y++++FI K+ + + L  K
Sbjct:   1    MRKRLKFPYFLTLLACFLLLIVCPLLSSQRIASADKEVRVNYSQKQFITKMGKEVKPLAK      60

Query:  61    SYGIRPSFIIAQAALDSDFGEKILANKYHNLFGLLAEPGTPSITLNDSSTGKKQEKQFTH     120
               YGIRPS +IAQ  L++  G+ +LA+KYHNLF   A PG  +ITL  S     Q  ++
Sbjct:  61    YYGIRPSILIAQILLETHDGKTLLASKYHNLFSKKATPGQVAITLK-SPKQTNQNVRYAI     119

Query: 121    YKSWKYSMYDYLAHIKSGATGKKDSYTIMVSVKNPKTLVQKLQDSGFDNDKKYAKKMTEI     180
              YK    ++ DYL ++ G    K Y ++ K  K    + LQ       DK YA+++ ++
Sbjct: 120    YKDDASAIRDYLRMLRQGKEVDKRLYRNLATEKGYKAPAKSLQKYLHYTDKTYARRLIQV     179

Query: 181    IDLYDLTRYD                                                     190
              I+  DLT YD
Sbjct: 180    IESNDLTNYD                                                     189
```

SEQ ID 6864 (GBS246) was expressed in *E. coli* as a His-fusion product. SDS-PAGE analysis of total cell extract is shown in FIG. 61 (lane 7; MW 24.6 kDa).

GBS246d was expressed in *E. coli* as a His-fusion product. SDS-PAGE analysis of total cell extract is shown in FIG. 154 (lanes 14 & 15; MW 21 kDa) and in FIG. 183 (lane 4; MW 21 kDa). It was also expressed in *E. coli* as a GST-fusion product. SDS-PAGE analysis of total cell extract is shown in FIG. 187 (lane 12; MW 46 kDa). Purified GBS246d-GST is shown in FIG. 243, lane 12.

Based on this analysis, it was predicted that these proteins and their epitopes could be useful antigens for vaccines or diagnostics.

Example 2225

A DNA sequence (GBSx2344) was identified in *S. agalactiae* <SEQ ID 6867> which encodes the amino acid sequence <SEQ ID 6868>. Analysis of this protein sequence reveals the following:

Possible site: 44
>>> Seems to have no N-terminal signal sequence
----- Final Results -----
  bacterial cytoplasm --- Certainty = 0.2541 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:AAC45610 GB:U78296 repressor of class I heat shock gene expression HrcA
[Streptococcus mutans]
Identities = 227/345 (65%), Positives = 287/345 (82%), Gaps = 1/345 (0%)
Query:  17   VITQRQNDILNLIVELFTQTHEPVGSKALQRTIDSSSATIRNDMAKLEKLGLLEKAHTSS      76
             +ITQRQ DILNLIVELFT+THEP+GSK LQ +I SS ATIRNDMA LEKLGLLEKA T
Sbjct:   1   MITQRQKDILNLIVELFTKTHEPIGSKTLQNSIASSRATIRNDMAALEKLGLLEKATTPP      60

Query:  77   GRM-PSPAGFKYFVEHSLRLDSIDEQDIYHVIKAFDFEAFKLEDMLQKASHILSEMTGYT     135
               +  P    +YFVEHSL  DS+DEQD+Y VIKAFDFEAF+L D+LQ+AS +L+ +TGYT
Sbjct:  61   AVVCPVKKAIRYFVEHSLNPDSLDEQDVYQVIKAFDFEAFRLGDLLQRASDVLANLTGYT     120

Query: 136   SVILDVEPARQRLTGFDVVQLSNHDALAVMTLDESKPVTVQFAIPRNFLTRDLIAFKAIV     195
```

```
                   ++ILDVEP +QRLT FD+V+LSNHDALAV+TLDE+ PVTVQFAIP+NFL  DL+     I
Sbjct: 121  ALILDVEPKKQRLITFDIVKLSNHDALAVLTLDEASPVTVQFAIPKNFLDSDLMTVAKIA         180

Query: 196  EERLLDGSVMDIHYKLRTEIPQIVQKYFVTTDNVLQLFDYVFSELFLETVFVAGKVNSLT         255
              ER L+ +V+DIHY+LRTE PQI+QKYF  TDNVL LFD++F+ +F E VF++GK+ +L
Sbjct: 181  RERFLNQTVLDIHYRLRTEPPQIIQKYFPRTDNVLDLFDHIFNPIFQEEVFISGKIKTLE         240

Query: 256  YSDLSTYQFLDNEQQVAISLRQSLKEGEMASVQVADSQEAALADVSVLTHKFLIPYRGFG         315
              ++ L TYQFL+N Q VA+ +RQSL E E+   VQVADS+E +LAD++V++ KFLIPYRGFG
Sbjct: 241  FAGLDTYQFLENLQSVALEIRQSLPEDELHRVQVADSKEKSLADLTVISQKFLIPYRGFG         300

Query: 316  LLSLIGPIDMDYRRSVSLVNIIGKVLAAKLGDYYRYLNSNRYEVH                         360
              +L++IGP+D+DY+R++SL+N+I +VLA KLGD+YRYLNSNHYEVH
Sbjct: 301  ILTVIGPVDLDYQRTISLINVISRVLAVKLGDFYRYLNSNHYEVH                         345
```

A related DNA sequence was identified in *S. pyogenes* <SEQ ID 6869> which encodes the amino acid sequence <SEQ ID 6870>. Analysis of this protein sequence reveals the following:

Possible site: 28
>>> Seems to have no N-terminal signal sequence
----- Final Results -----
   bacterial cytoplasm --- Certainty = 0.0695 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 341/344 (99%), Positives = 343/344 (99%)
Query: 17   VITQRQNDILNLIVELFTQTHEPVGSKALQRTIDSSSATIRNDMAKLEKLGLLEKAHTSS         76
            VITQRQNDILNLIVELFTQTHEPVGSKALQRTIDSSSATIRNDMAKLEKLGLLEKAHTSS
Sbjct: 1    VITQRQNDILNLIVELFTQTHEPVGSKALQRTIDSSSATIRNDMAKLEKLGLLEKAHTSS         60

Query: 77   GRMPSPAGFKYFVEHSLRLDSIDEQDIYHVIKAFDFEAFKLEDMLQKASHILSEMTGYTS        136
            GRMPSPAGFKYFVEHSLRLDSIDEQDIYHVIKAFDFEAFKLEDMLQKASHIL+EMTGYTS
Sbjct: 61   GRMPSPAGFKYFVEHSLRLDSIDEQDIYHVIKAFDFEAFKLEDMLQKASHILAEMTGYTS        120

Query: 137  VILDVEPARQRLTGEDVVQLSNHDALAVMTLDESKPVTVQFAIPRNFLTRDLIAFKAIVE        196
            VILDVEPARQRLTGEDVVQLSNHDALAVMTLDESKPVTVQFAIPRNFLTRDLIAFKAIVE
Sbjct: 121  VILDVEPARQRLTGEDVVQLSNHDALAVMTLDESKPVTVQFAIPRNFLTRDLIAFKAIVE        180

Query: 197  ERLLDGSVMDIHYKLRTEIPQIVQKYFVTTDNVLQLFDYVFSELFLETVFVAGKVNSLTY        256
            ERLLD SV+DIHYKLRTEIPQIVQKYFVTTDNVLQLFDYV SELFLETVFVAGKVNSLTY
Sbjct: 181  ERLLDNSVIDIHYKLRTEIPQIVQKYFVTTDNVLQLFDYVESELFLETVFVAGKVNSLTY        240

Query: 257  SDLSTYQFLDNEQQVAISLRQSLKEGEMASVQVADSQEAALADVSVLTHKFLIPYRGFGL        316
            SDLSTYQFLDNEQQVAISLRQSLKEGEMASVQVADSQEAALADVSVLTHKFLIPYRGFGL
Sbjct: 241  SDLSTYQFLDNEQQVAISLRQSLKEGEMASVQVADSQEAALADVSVLTHKFLIPYRGFGL        300

Query: 317  LSLIGPIDMDYRRSVSLVNIIGKVLAAKLGDYYRYLNSNHYEVH                         360
            LSLIGPIDMDYRRSVSLVNIIGKVLAAKLGDYYRYLNSNHYEVH
Sbjct: 301  LSLIGPIDMDYRRSVSLVNIIGKVLAAKLGDYYRYLNSNHYEVH                         344
```

Based on this analysis, it was predicted that these proteins and their epitopes could be useful antigens for vaccines or diagnostics.

Example 2226

A DNA sequence (GBSx2345) was identified in *S. agalactiae* <SEQ ID 6871> which encodes the amino acid sequence <SEQ ID 6872>. This protein is predicted to be grpe protein (grpE). Analysis of this protein sequence reveals the following:

Possible site: 15
>>> Seems to have no N-terminal signal sequence
----- Final Results -----
   bacterial cytoplasm --- Certainty = 0.5138 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:AAC45611 GB:U78296 GrpE [Streptococcus mutans]
Identities = 130/180 (72%), Positives = 151/180 (83%), Gaps = 3/180 (1%)
Query: 14   VSEEIKKDDLQEEVEATE--TEETVEEVIEEIPEKSELELANERADEFENKYLRAHAEM-       70
            +S++ KK++ +EEVEATE  TEE+VEEV EE  E   EL+ A ERA++FENKYLRAHAEM
Sbjct: 1    MSKKDKKEEYKEEVEATEPTTEESVEEVAEETSENKELQEALERAEDFENKYLRAHAEMP      60
```

```
                            -continued
Query:  71  QNIQRRSSEERQQLQRYRSQDLAKAILPSLDNLERALAVEGLTDDVKKGLEMTRDSLIQA   130
             +     +  +   QRYRSQDL KAILPSLDNLERALAVEGLTDDVKKGLEM ++SLIQA
Sbjct:  61  KTFSVALMKSDKVCQRYRSQDLRKAILPSLDNLERALAYEGLTDDVEKGLEMVQESLIQA   120

Query: 131  LKEEGVEEVEVDSFDHNFHMAVQTLPADDEHPADSIAEVFQKGYKLHERLLRPAMVVVYN   190
            LKEEGVEEVE+++FD N HMAVQTL ADD+HPADSIA+V QKGY+LHERLLRPAMVVVYN
Sbjct: 121  LKEEGVEEVELENFDANLHMAVQTLDADDDHPADSIAQVHQKGYQLHERLLRPAMVVVYN   180
```

A related DNA sequence was identified in *S. pyogenes* <SEQ ID 6873> which encodes the amino acid sequence <SEQ ID 6874>. Analysis of this protein sequence reveals the following:

---

Possible site: 15
>>> Seems to have no N-terminal signal sequence
----- Final Results -----
  bacterial cytoplasm --- Certainty = 0.5138 (Affirmative) <succ>
    bacterial membrane --- Certainty = 0.0000 (Not Clear) <succ>
      bacterial outside --- Certainty = 0.0000 (Not Clear) <succ>

---

A related DNA sequence was identified in *S. pyogenes* <SEQ ID 6877> which encodes the amino acid sequence <SEQ ID 6878>. Analysis of this protein sequence reveals the following:

---

Possible site: 17
>>> Seems to have no N-terminal signal sequence
----- Final Results -----
  bacterial cytoplasm --- Certainty = 0.0996 (Affirmative) <succ>
    bacterial membrane --- Certainty = 0.0000 (Not Clear) <succ>
      bacterial outside --- Certainty = 0.0000 (Not Clear) <succ>

---

An alignment of the GAS and GBS proteins is shown below.

An alignment of the GAS and GBS proteins is shown below.

```
Identities = 189/190 (99%), Positives = 189/190 (99%)
Query:   1  MAVFNKLFKRRHSVSEEIKKDDLQEEVEATETEETVEEVIEEIPEKSELELANERADEFE   60
            MAV NKLFKRRHSVSEEIKKDDLQEEVEATETEETVEEVIEE PEKSELELANERADEFE
Sbjct:   1  MAVFNKLFKRRHSVSEEIKKDDLQEEVEATETEETVEEVIEETPEKSELELANERADEFE   60

Query:  61  NKYLRAHAEMQNIQRRSSEERQQLQRYRSQDLAKAILPSLDNLERALAVEGLTDDVKKGL   120
            NKYLRAHAEMQNIQRRSSEERQQLQRYRSQDLAKAILPSLDNLERALAVEGLTDDVKKGL
Sbjct:  61  NKYLRAHAEMQNIQRRSSEERQQLQRYRSQDLAKAILPSLDNLERALAVEGLTDDVKKGL   120

Query: 121  EMTRDSLIQALKEEGVEEVEVDSFDHNEHMAVQTLPADDEHPADSIAEVFQKGYKLHERL   180
            EMTRDSLIQALKEEGVEEVEVDSFDHN HMAVQTLPADDEHPADSIAEVFQKGYKLHERL
Sbjct: 121  EMTRDSLIQALKEEGVEEVEVDSFDHNFHMAVQTLPADDEHPADSIAEVFQKGYKLHERL   180

Query: 181  LRPAMVVVYN                                                    190
            LRPAMVVVYN
Sbjct: 181  LRPAMVVVYN                                                    190
```

Based on this analysis, it was predicted that these proteins and their epitopes could be useful antigens for vaccines or diagnostics.

Example 2227

A DNA sequence (GBSx2346) was identified in *S. agalactiae* <SEQ ID 6875> which encodes the amino acid sequence <SEQ ID 6876>. This protein is predicted to be heat shock protein 70 (dnaK). Analysis of this protein sequence reveals the following:

---

Possible site: 17
>>> Seems to have no N-terminal signal sequence
----- Final Results -----
  bacterial cytoplasm --- Certainty = 0.0996 (Affirmative) <succ>
    bacterial membrane --- Certainty = 0.0000 (Not Clear) <succ>
      bacterial outside --- Certainty = 0.0000 (Not Clear) <succ>

---

```
Identities = 594/609 (97%), Positives = 603/609 (98%); Gaps = 1/609 (0%)
Query:   1  MSKIIGIDLGTTNSAVAVLEGTESKIIANPEGNRTTPSVVSFKNGEIIVGDAAKRQAVTN   60
            MSKIIGIDLGTTNSAVAVLEGTESKIIANPEGNRTTPSVVSFKNGEIIVGDAAKRQAVTN
```

-continued

```
Sbjct:   1  MSKIIGIDLGTTNSAVAVLEGTESKIIANPEGNRTTPSVVSFKNGEIIVGDAAKRQAVTN     60

Query:  61  PDTVISIKSKMGTSEKVSANGKEYTPQEISAMILQYLKGYAEDYLGEKVEKAVITVPAYF    120
            P+TVISIKSKMGTSEKVSANGKEYTPQEISAMILQYLKGYAEDYLGEKVEKAVITVPAYF
Sbjct:  61  PETVISIKSKMGTSEKVSANGKEYTPQEISAMILQYLKGYAEDYLGEKVEKAVITVPAYF    120

Query: 121  NDAQRQATKDAGKIAGLEVERIVNEPTAAALAYGMDKTDKDEKILVFDLGGGTFDVSILE    180
            NDAQRQATKDAGKIAGLEVERIVNEPTAAALAYGMDKTDKDEKILVFDLGGGTFDVSILE
Sbjct: 121  NDAQRQATKDAGKIAGLEVERIVNEPTAAALAYGMDKTDKDEKILVFDLGGGTFDVSILE    180

Query: 181  LGDGVFDVLATAGDNKLGGDDFDQKIIDFLVEEFKKENGIDLSQDKMALQRLKDAAEKAK    240
            LGDGVFDVLATAGDNKLGGDDFDQKIIDFLV EFKKENGIDLSQDKMALQRLKDAAEKAK
Sbjct: 181  LGDGVFDVLATAGDNKLGGDDFDQKIIDFLVAEFKKENGIDLSQDKMALQRLKDAAEKAK    240

Query: 241  KDLSGVTQTQISLPFITAGSAGPLHLEMSLSRAKFDDLTRDLVERTKTPVRQALSDAGLS    300
            KDLSGVTQTQISLPFITAGSAGPLHLEMSLSRAKFDDLTRDLVERTKTPVRQALSDAGLS
Sbjct: 241  KDLSGVTQTQISLPFITAGSAGPLHLEMSLSRAKFDDLTRDLVERTKTPVRQALSDAGLS    300

Query: 301  LSEIDEVILVGGSTRIPAVVEAVKAETGKEPNKSVNPDEVVAMGAAIQGGVITGDVKDVV    360
            LSEIDEVILVGGSTRIPAVVEAVKAETGKEPNKSVNPDEVVAMGAAIQGGVITGDVKDVV
Sbjct: 301  LSEIDEVILVGGSTRIPAVVEAVKAETGKEPNKSVNPDEVVAMGAAIQGGVITGDVKDVV    360

Query: 361  LLDVTPLSLGIETMGGVFTKLIDRNTTIPTSKSQVFSTAADNQPAVDIHVLQGERPMAAD    420
            LLDVTPLSLGIETMGGVFTKLIDRNTTIPTSKSQVFSTAADNQPAVDIHVLQGERPMAAD
Sbjct: 361  LLDVTPLSLGIETMGGVFTKLIDRNTTIPTSKSQVFSTAADNQPAVDIHVLQGERPMAAD    420

Query: 421  NKTLGRFQLTDIPAAPRGIPQIEVTFDIDKNGIVSVKAKDLGTQKEQHIVIQSNSGLTDE    480
            NKTLGRFQLTDIPAAPRGIPQIEVTFDIDKNGIVSVKAKDLGTQKEQHIVI+SN GL++E
Sbjct: 421  NKTLGRFQLTDIPAAPRGIPQIEVTFDIDKNGIVSVKAKDLGTQKEQHIVIKSNDGLSEE    480

Query: 481  EIDKMMKDAEANAEADAKRKEEVDLKNEVDQAIFATEKTIKETEGKGFDTERDAAQSALD    540
            EID+MMKDAEANAEADAKRKEEVDL+NEVDQAIFATEKTIKETEGKGFDTERDAAQSALD
Sbjct: 481  EIDRMMKDAEANAEADAKRKEEVDLKNEVDQAIFATEKTIKETEGKGFDTERDAAQSALD    540

Query: 541  ELKKAQESGNLDDMKAKLEALNEKAQALAVKLYEQAAAAQQAAQGAEGAQSADSSSKGDD    600
            ELK AQESGNLDDMKAKLEALNEKAQALAVK+YEQAAAAQQAAQGAEGAQ+ DS++   DD
Sbjct: 541  ELKAAQESGNLDDMKAKLEALNEKAQALAVKMYEQAAAAQQAAQGAEGAQANDSAN-NDD    599

Query: 601  VVDGEFTEK                                                       609
            VVDGEFTEK
Sbjct: 600  VVDGEFTEK                                                       608
```

Based on this analysis, it was predicted that these proteins and their epitopes could be useful antigens for vaccines or diagnostics.

Example 2228

A DNA sequence (GBSx2347) was identified in *S. agalactiae* <SEQ ID 6879> which encodes the amino acid sequence <SEQ ID 6880>. This protein is predicted to be *Streptococcus pneumoniae* DnaJ protein homologue (dnaJ). Analysis of this protein sequence reveals the following:

Possible site: 18
>>> Seems to have no N-terminal signal sequence
----- Final Results -----
  bacterial cytoplasm --- Certainty = 0.4180 (Affirmative) <succ>
  bacterial membrane --- Certainty = 0.0000 (Not Clear) <succ>
  bacterial outside --- Certainty = 0.0000 (Not Clear) <succ>

A related DNA sequence was identified in *S. pyogenes* <SEQ ID 6881> which encodes the amino acid sequence <SEQ ID 6882>. Analysis of this protein sequence reveals the following:

Possible site: 16
>>> Seems to have no N-terminal signal sequence
----- Final Results -----
  bacterial cytoplasm --- Certainty = 0.1322 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

```
Identities = 330/377 (87%), Positives = 357/377 (94%), Gaps = 1/377 (0%)
Query:   1  MNNTEFYDRLGVSKDASQDEIKKAYRRMSKKYHPDINKETGAEEKYKEVQEAYETLSDTQ     60
            MNNTE+YDRLGVSKDASQD+IKKAYR+MSKKYHPDINKE GAE+KYK+VQEAYETLSD+Q
Sbjct:  19  MNNTEYYDRLGVSKDASQDDIKKAYRKMSKKYHPDINKEAGAEQKYKDVQEAYETLSDSQ     78

Query:  61  KRAAYDQYGAAGANGGFGGFDGGGFGGFDGGGFGGFEDIFSSFFGGGGMRNPNAPRQGDD    120
            KRAAYDQYGAAGA GGFGG   GGFGGFDGGGFGGFEDIFSSFFGGGG RNPNAPRQGDD
Sbjct:  79  KRAAYDQYGAAGAQGGFGG-GAGGFGGFDGGGFGGFEDIFSSFFGGGGSRNPNAPRQGDD    137

Query: 121  LQYRVNLSFEEAIFGAEKEVSYNRESSCHTCSGSGAKPGTSPVTCQKCHGSGVINVDTQT    180
```

```
                          -continued
            LQYRVNLSFEEA+FG EKEVSYNRE++C TC GSGAKPGT+PVTC+KCHGSGV+ +DTQT
Sbjct: 138  LQYRVNLSFEEAVFGVEKEVSYNREATCGTCLGSGAKPGTAPVTCRKCHGSGVMTIDTQT   197

Query: 181  PLGTMRRQVTCDVCQGSGQEIKEKCPTCHGTGHEKKTHKVSVKIPAGVETGQQIRLTGQG   240
            PLG MRRQVTCD+C GSG+EIKE C TCHGTGHEK+ HKVSVKIPAGVETGQQIRL GQG
Sbjct: 198  PLGMMRRQVTCDICHGSGKEIKEPCQTCHGTGHEKQAHKVSVKIPAGVETGQQIRLQGQG   257

Query: 241  EAGFNGGPYGDLFVIINVLPSQQFERNGSTIYYTLNISFVQAALCDTIDIPTVHGAVEMS   300
            EAGFNGGPYGDLFVI+NVLPS+QFERNGSTIYY L+ISF QAALGDT++IPTVHG VEM+
Sbjct: 258  EAGFNGGPYGDLFVILNVLPSKQFERNGSTIYYNLDISFTQAALGDTVEIPTVHGDVEMA   317

Query: 301  IPAGTQTGKTFRLRGKGAPKLRGGGQGDQHVTVNIVTPTKLNDAQKEALHAFAEASGDKM   360
            IPAGTQTGKTFRL+GKGAPKLRGGGQGDQHVTVNIVTPTKLNDAQ+EAL AFAEASG+KM
Sbjct: 318  IPAGTQTGKTFRLKGKGAPKLRGGGQGDQHVTVNIVTPTKLNDAQREALQAFAEASGEKM   377

Query: 361  VHPKKKGFFDKVKDALD                                              377
            +HPKKKGFFDKVKDAL+
Sbjct: 378  LHPKKKGFFDKVKDALE                                              394
```

Based on this analysis, it was predicted that these proteins and their epitopes could be useful antigens for vaccines or diagnostics.

Example 2229

A DNA sequence (GBSx2348) was identified in *S. agalactiae* <SEQ ID 6883> which encodes the amino acid sequence <SEQ ID 6884>. Analysis of this protein sequence reveals the following:

Possible site: 59
>>> Seems to have no N-terminal signal sequence
INTEGRAL     Likelihood = –0.22     Transmembrane 281-297 (281-297)
----- Final Results -----
    bacterial membrane --- Certainty = 0.1086 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

A related DNA sequence was identified in *S. pyogenes* <SEQ ID 6885> which encodes the amino acid sequence <SEQ ID 6886>. Analysis of this protein sequence reveals the following:

Possible site: 59
>>> Seems to have no N-terminal signal sequence
----- Final Results -----
    bacterial cytoplasm --- Certainty = 0.3043 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below.

```
>GP:AAD24445 GB:AF118389 unknown [Streptococcus suis]

Identities = 182/373 (48%), Positives = 257/373 (68%), Gaps = 5/373 (1%)

Query: 4    KVEEIRSYLIASIQNGKLAPGDRLPSIRQLANQFSCNKDTVQRVLMELREDNYIYAKPRS   63
            K + I   ++  I+  +    G++LPSIRQL   Q+  C+KDTVQ+ ++EL++ N IYA  +S
Sbjct: 3    KYQVIIQDILTGIEEHRFKRGEKLPSIRQLREQYHCSKDTVQKAMLELKYQNKIYAVEKS   62

Query: 64   GYYVFDSHQEEVEEGVSLPNSEIANIAYDDERLCLNETLIGREDYLFNYYYRQEGLLDLS   123
            GYY+ + +  + +         +  ++ I  Y+DFR+CL  E+LIGRE+YLFNYY++QEGL +L
Sbjct: 63   GYYILEDRDFQ-DHTCRAQSYRLSRITYEDFRICLKESLIGRENYLFNYYHQQEGLAELI   121

Query: 124  KAVAKLMEETGVYVPLDDIVITAGTQQALFILTQVTFPNRKSRVLIEEPTYPRMIELIKT   183
             +V  L+ +   VY   D  +VITAG+QQAL+ILTQ+        K+  +LIE PTY RMIELI+
Sbjct: 122  SSVQSLLMDYHVYTKKDQLVITAGSQQALYILTQMETLAGKTEILIENPTYSRMIELIRH   181

Query: 184  QNLPYETISRGTHGIDFQRLEEIFQTQSIKFFYVIPRMHNPLGTSYNPVEMKRLIEMAEK   243
            Q +PY+TI R    GID + LE IFQT  IKFFY IPR+HNPLG++Y+        ++++A++
Sbjct: 182  QGIPYQTIERNLDGIDLEELESIFQTGKIKFFYTIPRLHNPLGSTYDIATKTAIVKLAKQ   241

Query: 244  YDVYIVEDDYMSDFASQS--PLHYYDTHGRVIYLKSFSKAIFPALRLAAICLPQALKSTF   301
            YDVYI+EDDY++DF S    PLHY DT  RVIY+KSF+   +FPALR+ AI LP  L+   F
Sbjct: 242  YDVYIIEDDYLADFDSSHSLPLHYLDTDNRVIYIKSFTPTLFPALRIGAISLPNQLRDIF   301

Query: 302  MAYKKLMDYDTNLILQKALALYIENGLYAKNSQYLKYRYQKDLANSKSILADHP-NLPSY   360
            + +K L+DYDTNLI+QKAL+LYI+NG++A+N+Q+L + Y      K  L + N+P Y
Sbjct: 302  IKHKSLIDYDTNLIMQKALSLYIDNGMFARNTQHLHHIYHAQWNKIKDCLEKYALNIP-Y   360

Query: 361  SLHHDSVLFDCSK                                                  373
            +   SV F  SK
Sbjct: 361  RIPKGSVTFQLSK                                                  373
```

```
Identities = 176/382 (46%), Positives = 255/382 (66%), Gaps = 7/382 (1%)
Query: 1    MVTKVEEIRSYLIASIQNGKLAPGDRLPSIRQLANQFSCNKDTVQRVLMELRFDNYIYAK    60
            M TK + I S +   IQ  +L  GD+LPSIR L+  + C+KDTVQR L+EL++ + IYA
Sbjct: 1    MTTKYQTIISNIEQDIQKQRLKKGDKLPSIRVLSKVYYCSKDTVQRALLELKYRHLIYAV    60

Query: 61   PRSGYYVFDSHQEEVEEGVSLPNSEIANIAYDDFRLCLNETLIGREDYLFNYYYRQEGLL    120
            P+SGYYV   +    ++L  +  N+AY+DFRLCLNE L  ++ YLF+YY++ EGL
Sbjct: 61   PKSGYYVL-GNVSMPDNVLNLSLEDYNNMAYEDFRLCLNEALSAKDKYLFHYYHKTEGLE   119

Query: 121  DLSKAVAKLMEETGVYVPLDDIVITAGTQQALFILTQVTFPNRKSRVLIEEPTYPRMIEL    180
            +L +A+   + E  VY   D ++IT+GTQQAL+IL+Q+ FPN     +L+E+PTY RM  +
Sbjct: 120  ELREALLLYLAENSVYSNKDQLLITSGTQQALYILSQMPFPNTGKTILLEKPTYHRMEAI   179

Query: 181  IKTQNLPYETISRGTHGIDFQRLEEIFQTQSIKFFYVIPRMHNPLGTSYNPVEMKRLIEM    240
            +    LPY+TISR  +G+F + LE +FQT  IKFFY I R  +PLG SY+  E +  ++ +
Sbjct: 180  VAQLGLPYQTISRHFNGLDLELLESLFQTGDIKFFYTISRFSHPLGLSYSTKEKEAIVRL   239

Query: 241  AEKYDVYIVEDDYMSDFA--SQSPLHYYDTHGRVIYLKSFSKAIFPALRLAAICLPQALK    298
            A++Y VYI+EDDY+ DF     + P+HYYDTH R+IYLKSFS ++FPALR+ A+ LP  LK
Sbjct: 240  AQRYQVYILEDDYLGDFVKLKEPPIHYYDTHHRIIYLKSFSMSVFPALRIGALVLPSGLK   299

Query: 299  STFMAYKKLMDYDTNLILQKALALYIENGLYAKNSQYLKYRYQKDLANSKSILADHPNLP    358
               F+   K L+D DTNL++QKALALY+ENG++ KN  +++K RY K        ++   N P
Sbjct: 300  PHFLTQKSLIDLDTNLLMQKALALYLENGMFQKNLRFIK-RYLKQRERQLALFLKQ-NCP   357

Query: 359  S--YSLHHDSVLFDCSKLDNFK                                        378
                Y L    ++ D +  D+++
Sbjct: 358  DIHYQLTPTHLVIDYTTSDSYR                                        379
```

SEQ ID 6884 (GBS423) was expressed in *E. coli* as a His-fusion product. SDS-PAGE analysis of total cell extract is shown in FIG. 79 (lane 7; MW 49.3 kDa). It was also expressed in *E. coli* as a GST-fusion product. SDS-PAGE analysis of total cell extract is shown in FIG. 172 (lane 2; MW 74 kDa).

GBS423-GST was purified as shown in FIG. 219, lane 2-3. Based on this analysis, it was predicted that these proteins and their epitopes could be useful antigens for vaccines or diagnostics.

Example 2230

A DNA sequence (GBSx2349) was identified in *S. agalactiae* <SEQ ID 6887> which encodes the amino acid sequence <SEQ ID 6888>. This protein is predicted to be pseudouridylate synthase I (truA). Analysis of this protein sequence reveals the following:

Possible site: 58
>>> Seems to have no N-terminal signal sequence
----- Final Results -----

-continued bacterial cytoplasm --- Certainty = 0.3265 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:BAB03886 GB:AP001507 tRNA pseudouridine synthase A
(pseudouridylate synthase I) [Bacillus halodurans]
Identities = 105/240 (43%), Positives = 147/240 (60%), Gaps = 2/240 (0%)
Query: 1    MTRYKAQISYDGSAFSGFQRQPNCRTVQEEIERTLKRLNSGNDVIIHGAGRTDVGVHAYG    60
            M R   +++YDG+ F+G+Q QPN RTVQ E+E  LK ++ G  + +  +GRTD GVHA G
Sbjct: 1    MKRIGLKVAYDGTDFAGYQIQPNERTVQGELESVLKNIHKGMSIRVTASGRTDTGVHARG   60

Query: 61   QVIHFDLPQARDVEKLRFGLDTQCPDDIDIVKVEQVSDDFHCRYDKHIKTYEFLVDIGRP    120
            Q++HFD  +   V++   L++Q P DI +++    V  DFH RY     K Y + V
Sbjct: 61   QIVHFDTSLSFPVDRWPIALNSQLPADICVLEAADVPADFHARYSAKTKEYRYRVLTSAQ   120

Query: 121  KNPMMRNYATHYPYPVIIELMQEAIKDLVGTHDFTGFTASGTSVENKVRTIFDAKIQFEA    180
            +    RNY H  YP+ +E MQ A    L+GTHDF+ F A+   VE+KVRTI D  +  E
Sbjct: 121  ADVFRRNYTYHVRYPLDVEAMQRAAVQLLGTHDFSSFCAAKAEVEDKVRTIEDVALWREG   180

Query: 181  SKNLLIFTFTGNGFLYKQVRNMVGTLLKIGNGRMPISQIKTILQAKNRDLAGPTAAGNGL    240
             +  LIF+   GNGFLY  VR +VGTLL+IG G+     ++  IL A++R+  AG TA G+GL
Sbjct: 181  DE--LIFSIRGNGFLYNMVRIIVGTLLEIGAGKRSAEEVAKILAARSREAAGKTAPGHGL   238
```

A related DNA sequence was identified in *S. pyogenes* <SEQ ID 6889> which encodes the amino acid sequence <SEQ ID 6890>. Analysis of this protein sequence reveals the following:

Possible site: 58
>>> Seems to have no N-terminal signal sequence
----- Final Results -----
  bacterial cytoplasm --- Certainty = 0.2558 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

```
Identities = 184/249 (73%), Positives = 214/249 (85%)
Query:   1   MTRYKAQISYDGSAFSGFQRQPNCRTVQEEIERTLKRLNSGNDVIIHGAGRTDVGVHAYG    60
             M RYKA ISYDG+ FSGFQRQ + RTVQEEIE+TL +LN+G  +IIHGAGRTD GVHAYG
Sbjct:   1   MVRYKATISYDGTLFSGFQRQRHLRTVQEEIEKTLYKLNNGTKIIIHGAGRTDAGVHAYG    60

Query:  61   QVIHFDLPQARDVEKLRFGLDTQCPDDIDIVKVEQVSDDFHCRYDKHIKTYEFLVDIGRP   120
             QVIHFDLPQ ++VEKLRF LDTQ P+DID+V +E+V+DDFHCRY KH+KTYEFLVD GRP
Sbjct:  61   QVIHFDLPQEQEVEKLRFALDTQTPEDIDVVNIEKVADDFHCRYQKHLKTYEFLVDNGRP   120

Query: 121   KNPMMRNYATHYPYPVIIELMQEAIKDLVGTHDFTGFTASGTSVENKVRTIFDAKIQFEA   180
             KNPMMR+Y THYPY + I+LMQEAI  LVGTHDFTGFTA+GTSV+NKVRTI  A +  +
Sbjct: 121   KNPMMRHYTTHYPYTLNIKLMQEAINGLVGTHDFTGFTAAGTSVQNKVRTITKATVSRDE   180

Query: 181   SKNLLIFTFTGNGFLYKQVRNMVGTLLKIGNGRMPISQIKTILQAKNRDLAGPTAAGNGL   240
               + L+FTF+GNGFLYKQVRNMVGTLLKIGNG+MP+ Q+K IL +KNR LAGPT +GNGL
Sbjct: 181   KTDFLVFTFSGNGFLYKQVRNMVGTLLKIGNGQMPVEQVKVILSSKNRQLAGPTISGNGL   240

Query: 241   YLKEIIYED                                                     249
             YLKEI YE+
Sbjct: 241   YLKEICYEN                                                     249
```

Based on this analysis, it was predicted that these proteins and their epitopes could be useful antigens for vaccines or diagnostics.

Example 2231

A DNA sequence (GBSx2350) was identified in *S. agalactiae* <SEQ ID 6891> which encodes the amino acid sequence <SEQ ID 6892>. This protein is predicted to be phosphomethypyrimidine kinase (thiD). Analysis of this protein sequence reveals the following:

---

Possible site: 45
>>> Seems to have no N-terminal signal sequence
----- Final Results -----
   bacterial cytoplasm --- Certainty = 0.2051 (Affirmative) <succ>
     bacterial membrane --- Certainty = 0.0000 (Not Clear) <succ>
      bacterial outside --- Certainty = 0.0000 (Not Clear) <succ>

---

The protein has homology with the following sequences in the GENPEPT database.

A related DNA sequence was identified in *S. pyogenes* <SEQ ID 4407> which encodes the amino acid sequence <SEQ ID 4408>. Analysis of this protein sequence reveals the following:

---

Possible site: 36
>>> Seems to have no N-terminal signal sequence
----- Final Results -----
   bacterial cytoplasm --- Certainty = 0.2029 (Affirmative) <succ>
     bacterial membrane --- Certainty = 0.0000 (Not Clear) <succ>
      bacterial outside --- Certainty = 0.0000 (Not Clear) <succ>

---

An alignment of the GAS and GBS proteins is shown below.

```
>GP:CAB15828 GB:Z99123 phosphomethylpyrimidine kinase [Bacillus subtilis]

Identities = 95/253 (37%), Positives = 150/253 (58%), Gaps = 13/253 (5%)

Query:   1   MKTRNVLAISGNDIFSGGGLHADLATYVVNKLHGFVAVTCLTAMSDKG---FEVIPIEAS    57
             M     L I+G+D  G G+ ADL T+     ++G  A+T + AM          +V PI+
Sbjct:   1   MSMHKALTIAGSDSSGGAGIQADLKTFQEKNVYGMTALTVIVAMDPNNSWNHQVFPIDTD    60

Query:  58   ILKQQLESLKD-VEFGSIKLGLLPNVETAQVVLEFVKSKQECPVVLDPVLVCKENHDL--   114
             ++ QL ++ D +   ++K G+LP V+  ++ + +K KQ    VV+DPV+VCK  +++
Sbjct:  61   TIRAQLATITDGIGVDAMKTGMLPTVDIIELAAKTIKEKQLKNVVIDPVMVCKGANEVLY   120

Query: 115   --EVSQLREQLIAFFPYADVVITPNLVEAQLLTGLS-IENLDQMKIAAEKLYDMGAKHVVI   171
                 LREQL      P A VITPNL EA  L+G+  ++ +D M  AA+K++   +GA++VVI
Sbjct: 121   PEHAQALREQLA---PLATVITPNLFEASQLSGMDELKTVDDMIEAAKKIHALGAQYVVI   177

Query: 172   KGGNRLNAEEATDLYYDGERFETYVFPVVDANNT-GAGCTFASSIASQLAMGKNVEDAVK   230
              GG +L  E+A D+ YDGE  E        ++D   T  GAGCTF++++ ++LA G  V++A+
Sbjct: 178   TGGGKLKHEKAVDVLYDGETAEVLESEMIDTPYTHGAGCTFSAAVTAELAKGAEVKEAIY   237

Query: 231   MSKGFVYQAIKAS                                                 243
             +K F+  AIK S
Sbjct: 238   AAKEFITAAIKES                                                 250
```

```
Identities = 135/252 (53%), Positives = 174/252 (68%)
Query:   1   MKTRNVLAISGNDIFSGGGLHADLATYVVNKLHGFVAVTCLTAMSDKGFEVIPIEASILK    60
             MKT  ++ ISGNDI SGGGL+ADLATY+    L  FVAVTCLT S++GF + P+   I +
Sbjct:   1   MKTDYIVTISGNDILSGGGLYADLATYIRYDLQAFVAVTCLTTRSEEGFSLFPVAKEIFR    60

Query:  61   QQLESLKDVEFGSIKLGLLPNVETAQVVLEFVKSKQECPVVLDPVLVCKENHDLEVSQLR   120
              QL S +     +IK+GLLPN E  ++VL+F+K    PVVLDPVL CKE  D+++  LR
Sbjct:  61   DQLNSFTNAPISAIKIGLLPNAEMCEIVLDFIKGHLGIPVVLDPVLACKEIDDVKIVPLR   120

Query: 121   EQLIAFFPYADVITPNLVEAQLLTGLSIENLDQMKIAAEKLYDMGAKHVVIKGGNRLNAE   180
             ++++    PY V+TPNLVEAQLL+    I +L  M+ AA+  Y +GAK VVIKGGNR + +
Sbjct: 121   QEILQLLPYVTVVTPNLVEAQLLSQKEIVSLKDMQEAAKYFYQLGAKQVVIKGGNRFSQK   180

Query: 181   EATDLYYDGERFETYVFPVVDANNTGAGCTFASSIASQLAMGKNVEDAVKMSKGFVYQAI   240
             +A DL+YDG+   T    PV++ NN GAGCTFASSIASQL   K   +AVK SK    VYQAI
Sbjct: 181   KAIDLFYDGKEIVTLECPVLEKNNIGAGCTFASSIASQLVKKKTPLEAVKNSKELVYQAI   240

Query: 241   KASDKYGVVQHF                                                 252
             ++SD+YGV Q +
Sbjct: 241   LQSDRYGVKQSY                                                 252
```

Based on this analysis, it was predicted that these proteins and their epitopes could be useful antigens for vaccines or diagnostics.

Example 2232

A DNA sequence (GBSx2351) was identified in *S. agalactiae* <SEQ ID 6893> which encodes the amino acid sequence <SEQ ID 6894>. Analysis of this protein sequence reveals the following:

Possible site: 45
>>> Seems to have a cleavable N-term signal seq.
INTEGRAL    Likelihood = –6.05    Transmembrane 97-113 (96-119)
INTEGRAL    Likelihood = –0.22    Transmembrane 54-70  (54-70)
----- Final Results -----
   bacterial membrane --- Certainty = 0.3421 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the GENPEPT database.

```
>GP:BAA30952 GB:AP000007 202aa long hypothetical protein [Pyrococcus horikoshii]
Identities = 48/148 (32%), Positives = 78/148 (52%), Gaps = 9/148 (6%)
Query:  10   VQLAIVTAISIVLGMFISIPTPTGFLTLLDAGIFFAAFYFGKKEGAVVGALAGFLIDLLK    69
             V  A+VTA+++V+  I IP  G+L  D I  + FG  G  G+       DLL
Sbjct:  49   VMAALVTAMTMVIR--IPIPASQGYLNFGDIMIMLTSVLFGPLVGGFAGGVGSAFADLL-   105

Query:  70   GYPNWMFFSLLIHGTQGYLAGLPGR------RRLLGLISATLVMVLGYAIASGLMYGWGA   123
             GYP+W  F+L+I GT+G + G           + LLG    VMV+GY   +  ++YG
Sbjct: 306   GYPSWALFTLVIKGTEGIIVGYFSKGEANYGKILLGTVLGGSVMVIGYVSVAYVLYGPAG   165

Query: 124   VLPDIPGNIMQNMVGMVVGFALNKSLER                                 151
              + ++  +I+Q + G+V+G  L    L++
Sbjct: 166   AIGELYNDIVQAVSGIVIGGGLGYILKK                                 193
```

A related DNA sequence was identified in *S. pyogenes* <SEQ ID 6895> which encodes the amino acid sequence <SEQ ID 6896>. Analysis of this protein sequence reveals the following:

Possible site: 54
>>> Seems to have a cleavable N-term signal seq.
INTEGRAL    Likelihood = –4.62    Transmembrane 98-114  (97-119)
INTEGRAL    Likelihood = –0.00    Transmembrane 135-151 (135-151)
----- Final Results -----
   bacterial membrane --- Certainty = 0.2848 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the databases:

```
>GP:CAB49310 GB:AJ248284 hypothetical protein [Pyrococcus abyssi]
Identities = 42/145 (28%), Positives = 73/145 (49%), Gaps = 10/145 (6%)
Query:   7   RQMSLTGILTALVVVLGRFVMLPTPT--GFLTLLDAGIYAVSFSFGSAQGAIVGGLSGFL    64
             R ++++ +  ALV  +    + +P P   G+L   D I  V+ FG  G   GG+    +
Sbjct:  39   RTVAISAVAAALVTAMTMVIRIPIPASQGYLNFGDIMIMLVAVLFGPLVGGFAGGVGSAI    98

Query:  65   IDLVAGYPQWMFHSLIAHSVQGYFAGWRGR------KRWLGVVIGSFIMIFWYFLGSLML   118
```

```
                                          -continued
            DL+ GYP W     +LI      +G    G+   +          K +G V+G   FIM+    Y    S +L
Sbjct:  99  ADLI-GYPSWALFTLIIKGSEGLVVGYFSKGEPNYSKILIGTVLGGFIMVLGYVSVSYVL  157

Query: 119  GYGLSGSLAGIWGNVMQNTLGLFVG                                    143
            YG +G+++ ++ + +Q    G+ +G
Sbjct: 158  -YGPAGAISELYNDTVQAVSGIVIG                                    181
```

An alignment of the GAS and GBS proteins is shown below.

```
Identities = 77/155 (49%), Positives = 106/155 (67%), Gaps = 1/155 (0%)
Query:   1  MRKEKTSQLVQLAIVTAISIVLGMFISIPTPTGFLTLLDAGIFFAAFYFGKKEGAVVGAL   60
            M+   K  Q+    I+TA+ +VLG F+ +PTPTGFLTLLDAGI+   +F FG  +GA+VG L
Sbjct:   1  MQNSKIRQMSLTGILTALVVVLGRFVMLPTPTGFLTLLDAGIYAVSFSFGSAQGAIVGGL   60

Query:  61  AGFLIDLLKGYPNWMFFSLLIHGTQGYLAGLPGRRRLLGLISATLVMVLGYAIASGLM-Y  119
            +GFLIDL+ GYP WMF SL+ H  QGY AG   GR+R LG++   + +M+   Y + S ++ Y
Sbjct:  61  SGFLIDLVAGYPQWMFHSLIAHSVQGYFAGWRGRKRWLGVVIGSFIMIFWYFLGSLMGY   120

Query: 120  GWGAVLPDIPGNIMQNMVGMVVGFALNKSLERVKK                          154
            G    L  I GN+MQN +G+ VGF + K++ R KK
Sbjct: 121  GLSGSLAGIWGNVMQNTLGLFVGFIIFKAILRQKK                          155
```

Based on this analysis, it was predicted that these proteins and their epitopes could be useful antigens for vaccines or diagnostics.

Example 2233

A DNA sequence (GBSx2352) was identified in *S. agalactiae* <SEQ ID 6897> which encodes the amino acid sequence <SEQ ID 6898>. Analysis of this protein sequence reveals the following:

Possible site: 43
>>> Seems to have no N-terminal signal sequence
----- Final Results -----
   bacterial cytoplasm --- Certainty = 0.0881 (Affirmative) <succ>
   bacterial membrane --- Certainty = 0.0000 (Not Clear) <succ>
   bacterial outside --- Certainty = 0.0000 (Not Clear) <succ>

A related DNA sequence was identified in *S. pyogenes* <SEQ ID 6899> which encodes the amino acid sequence <SEQ ID 6900>. Analysis of this protein sequence reveals the following:

Possible site: 40
>>> Seems to have no N-terminal signal sequence
----- Final Results -----
   bacterial cytoplasm --- Certainty = 0.2166 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:CAB15708 GB:Z99122 alternate gene name: ipc-33d [Bacillus subtilis]
Identities = 91/176 (51%), Positives = 115/176 (64%)
Query:   6  NKLKQETKAIVVDIIERSALKKGQIFVLGLSSSEVSGGLIGKNSSSEIGEIIVEVILKEL   65
            N+LKQ   K ++ +    +++ LK+ Q+FVLG S+SEV+G   IG + S +I E I   + +
Sbjct:   2  NELKQTWKTMLSEFQDQAELKQDQLFVLGCSTSEVAGSRIGTSGSVDIAESIYSGLAELR   61

Query:  66  HSRGIYLAVQGCEHVNRALVVEAELAERQQLEVVNVVPNLHAGGSGQVAAFKLMTSPVEV  125
                 GI+LA Q  CEH+NRALVVEAE A+   +L V+ VP      AGG+      AFK M SPV V
Sbjct:  62  EKTGIHLAFQCCEHLNRALVVEAETAKLFRLPTVSAVPVPKAGGAMASYAFKQMKSPVLV  121

Query: 126  EEIVAHAGIDIGDTSIGMHIKRVQVPLIPISRELGGAHVTALASRPKLIGGARAGY      181
            E I A  AGIDIGDT IGMH+K V VP+       LG AHVT   +RPKLIGG RA Y
Sbjct: 122  ETIQADAGIDIGDTFIGMHLKPVAVPVRVSQNSLGSAHVTLARTRPKLIGGVRAVY      177
```

An alignment of the GAS and GBS proteins is shown below.

```
Identities = 132/183 (72%), Positives = 161/183 (87%)
Query:   6  NKLKQETKAIVVDIIERSALKKGQIFVLGLSSSEVSGGLIGKNSSSEIGEIIVEVILKEL   65
            N L+++T+  IV+D++ERSA++   G +FVLGLSSSE+  G  IGK SS  E+G+I+VEV+L EL
Sbjct:   3  NNLEKQTREIVIDVVERSAIQPGNLFVLGLSSSEILGSRIGKQSSLEVGQIVVEVVLDEL   62
```

```
-continued

Query:   66  HSRGIYLAVQGCEHVNRALVVEAELAERQQLEVVNVVPNLHAGGSGQVAAFKLMTSPVEV  125
             + RG++LAVQGCEHVNRALVVE  +AE +QLE+VNVVPNLHAGGS Q+AAF+LM+ PVEV
Sbjct:   63  NKRGVHLAVQGCEHVNRALVVERHVAESKQLEIVNVVPNLHAGGSAQMAAFQLMSDPVEV  122

Query:  126  EEIVAHAGIDIGDTSIGMHIKRVQVPLIPISRELGGAINTALASRPKLIGGARAGYTSDP  185
             EE++AHAG+DIGDT+IGMHIKRVQ+PLIP  RELGGAHVTALASRPKLIGGARA Y  D
Sbjct:  123  EEVIAHAGLDIGDTAIGMHIKRVQIPLIPCQRELGGAHVTALASRPKLIGGARADYNMDI  182

Query:  186  IRK                                                          188
             IRK
Sbjct:  183  IRK                                                          185
```

Based on this analysis, it was predicted that these proteins and their epitopes could be useful antigens for vaccines or diagnostics.

Example 2234

A DNA sequence (GBSx2353) was identified in *S. agalactiae* <SEQ ID 6901> which encodes the amino acid sequence <SEQ ID 6902>. Analysis of this protein sequence reveals the following:

---
Possible site: 56
>>> Seems to have no N-terminal signal sequence
INTEGRAL    Likelihood = −11.25   Transmembrane 21-37   (13-46)
INTEGRAL    Likelihood = −4.30    Transmembrane 78-94   (76-113)
INTEGRAL    Likelihood = −2.07    Transmembrane 96-112  (95-113)
----- Final Results -----
   bacterial membrane --- Certainty = 0.5501 (Affirmative) <succ>
   bacterial outside --- Certainty = 0.0000 (Not Clear) <succ>
   bacterial cytoplasm --- Certainty = 0.0000 (Not Clear) <succ>
---

The protein has homology with the following sequences in the GENPEPT database.

A related DNA sequence was identified in *S. pyogenes* <SEQ ID 6903> which encodes the amino acid sequence <SEQ ID 6904>. Analysis of this protein sequence reveals the following:

---
Possible site: 54
>>> Seems to have no N-terminal signal sequence
INTEGRAL    Likelihood = −8.49    Transmembrane 24-40   (15-45)
INTEGRAL    Likelihood = −4.83    Transmembrane 78-94   (73-99)
INTEGRAL    Likelihood = −2.07    Transmembrane 96-112  (95-113)
----- Final Results -----
   bacterial membrane --- Certainty = 0.4397 (Affirmative) <succ>
   bacterial outside --- Certainty = 0.0000 (Not Clear) <succ>
   bacterial cytoplasm --- Certainty = 0.0000 (Not Clear) <succ>
---

The protein has homology with the following sequences in the databases:

```
>GP:BAB06385 GB:AP001516 unknown conserved protein [Bacillus halodurans]

Identities = 105/261 (40%), Positives = 150/261 (57%), Gaps = 2/261 (0%)

Query:   12  NVEEVLFTFFTKLIS--ILLLIIAFVIVRQVINYLFEKTVNRSLAFSRQKVARQKTLAKL   69
             N+      F   T+I+  +L+ +IAF+IVR +    +     R    TL KL
Sbjct:    7  NITSGAFLASTFIIAGKVLVAVIAFLIVRAIGKRIISNSFARMAKNNQLSSGRVVTLEKL   66

Query:   70  SHNVLNYTLYFFLFYWILSILGVPISSLLAGAGIAGVAIGLGAQGFLSDVVNGFFILLEN  129
             S N  +YTL F       +L+I G+  S+L+AGAGI G+AIG GAQG +SD+V GFFILLE
Sbjct:   67  SINAFSYTLMFIFATTLLTIFGLNPSALIAGAGIVGLAIGFGAQGLVSDIVTGFFILLEK  126

Query:  130  QFDVGDIINVGTVSGTVTNVGIRTTQIHDFDGTLHFIPNRNITIVSNKSRSNMRAQIDIP  189
             Q DVGD +  G V G V  VG+RT  I  FDGTLH+IPNRNI  VSN SR NMRA +DI
Sbjct:  127  QIDVGDYVTAGGVDGIVEEVGLRTALIRGFDGTLHYIPNRNIANVSNHSRGNMRALVDIS  186

Query:  190  LFVHTNLDQISDIVTKINEEYVSKHPAIVGEPTVFGPTTNANGQFVYRINIFTQNGAQFD  249
             +   + N+D+   ++ K+ ++      I+  P V G     +   V RI  T+N Q+
Sbjct:  187  ISYNDNIDEAISVMQKVCDQLAEQDERIIEGPDVIGVQNLGDSDVVIRIIAKTENMEQWS  246

Query:  250  IYAEFYKLYQKAILEEGIDLP                                        270
             +     K  ++A+     I++P
Sbjct:  247  VERLLRKQLKEALEAHNIEIP                                        267
```

```
>GP:BAB06385 GB:AP001516 unknown conserved protein [Bacillus halodurans]
Identities = 104/249 (41%), Positives = 151/249 (59%), Gaps = 4/249 (1%)
Query:  22    KKLVSLIILLLFFAILKRVTNYLFEKTINKSFAYSRQSEARKKTLSKLTHNILNYLLYFL   81
              K LV++I  L+  AI KR+ +  F +     +  + S  R  TL KL+ N  +Y L F+
Sbjct:  23    KVLVAVIAFLIVRAIGKRIISNSFARMAENN----QLSSGRVVTLEKLSLNAFSYTLMFI   78

Query:  82    LIYWILSLFGIPVSSLLAGAGIAGVAIGLGAQGFLSDVVNGFFILFENQFEVGDNVTISD   141
                     +L++FG+  S+L+AGAGI G+AIG GAQG +SD+V GFFIL E Q +VGD VT
Sbjct:  79    FATTLLTIFGLNPSALIAGAGIVGLAIGFGAQGLVSDIVTGFFILLEKQIDVGDYVTAGG   138

Query: 142    IEGSVFGVGIRTTQIRGFDGTLHFIPNRSITVVSNKSRGNMRALIEIPLYSTVNLSQVTR   201
              ++G V  VG+RT  IRGFDGTLH+IPNR+I  VSN SRGNMRAL++I +     N+  +
Sbjct: 139    VDGIVEEVGLRTALIRGFDGTLHYIPNRNIANVSNHSRGNMRALVDISISYNDNIDEAIS   198

Query: 202    IIDEVNQKELPNHPQIVGKPNILGPQNNSNGQFTFRIAIFTENGEQFKIYHTFYRLYQEA   261
              ++ +V +      +I+  P+++G QN  +      RI   TEN EQ+ +      +  +EA
Sbjct: 199    VMQKVCDQLAEQDERIIEGPDVIGVQNLGDSDVVIRIIAKTENMEQWSVERLLRKQLKEA   258

Query: 262    LLKEGIQLP                                                      270
              L    I++P
Sbjct: 259    LEAHNIEIP                                                      267
```

An alignment of the GAS and GBS proteins is shown below.

```
Identities = 164/265 (61%), Positives = 215/265 (80%)
Query:   7    FIDHLNVEEVLFTFFTKLISILLLIIAFVIVRQVINYLFEKTVNRSLAFSRQKVARQKTL    66
              +++   ++E +   T F KL+S+++L++  F  I+++V NYLFEKT+N+S A+SRQ  AR+KTL
Sbjct:   7    YLEQSHIENIGLTIFKKLVSLIILLLFFAILKRVTNYLFEKTINKSFAYSRQSEARKKTL    66

Query:  67    AKLSHNVLNYTLYFFLFYWILSILGVPISSLLAGAGIAGVAIGLGAQGFLSDVVNGFFIL   126
              +KL+HN+LNY LYF L  YWILS+  G+P+SSLLAGAGIAGVAIGLGAQGFLSDVVNGFFIL
Sbjct:  67    SKLTHNILNYLLYFLLIYWILSLFGIPVSSLLAGAGIAGVAIGLGAQGFLSDVVNGFFIL   126

Query: 127    LENQFDVGDIINVGTVSGTVTNVGIRTTQIHDFDGTLHFIPNRNITIVSNKSRSNMRAQI   186
               ENQF+VGD + +  + G+V  VGIRTTQI  FDGTLHFIPNR+IT+VSNKSR NMRA I
Sbjct: 127    FENQFEVGDNVTISDIEGSVFGVGIRTTQIRGFDGTLHFIPNRSITVVSNKSRGNMRALI   186

Query: 187    DIPLFVHTNLDQISDIVTKINEEYVSKHPAIVGEPTVFGPTTNANGQFVYRINIFTQNGA   246
              +IPL+    NL Q++ I+  ++N++ +  HP IVG+P + GP   N+NGQF +RI IFT+NG
Sbjct: 187    EIPLYSTVNLSQVTRIIDEVNQKELPNHPQIVGKPNILGPQNNSNGQFTFRIAIFTENGE   246

Query: 247    QFDIYAEFYKLYQKAILEEGIDLPT                                      271
              QF IY   FY+LYQ+A+L+EGI LPT
Sbjct: 247    QFKIYHTFYRLYQEALLKEGIQLPT                                      271
```

Based on this analysis, it was predicted that these proteins and their epitopes could be useful antigens for vaccines or diagnostics.

Example 2235

A DNA sequence (GBSx2354) was identified in *S. agalactiae* <SEQ ID 6905> which encodes the amino acid sequence <SEQ ID 6906>. This protein is predicted to be RopA (tig). Analysis of this protein sequence reveals the following:

Possible site: 20
>>> Seems to have no N-terminal signal sequence
----- Final Results -----
 bacterial cytoplasm --- Certainty = 0.1785 (Affirmative) <succ>
 bacterial membrane --- Certainty = 0.0000 (Not Clear) <succ>
 bacterial outside --- Certainty = 0.0000 (Not Clear) <succ>

A related GBS nucleic acid sequence <SEQ ID 9283> which encodes amino acid sequence <SEQ ID 9284> was also identified.

A related DNA sequence was identified in *S. pyogenes* <SEQ ID 6907> which encodes the amino acid sequence <SEQ ID 6908>. Analysis of this protein sequence reveals the following:

Possible site: 49
>>> Seems to have no N-terminal signal sequence
----- Final Results -----
 bacterial cytoplasm --- Certainty = 0.0776 (Affirmative) <succ>
 bacterial membrane --- Certainty = 0.0000 (Not Clear) <succ>
 bacterial outside --- Certainty = 0.0000 (Not Clear) <succ>

An alignment of the GAS and GBS proteins is shown below.

```
Identities = 303/354 (85%), Positives = 337/354 (94%)
Query:   1    MSTSFENKATNRGIITFTISQDEIKPALDQAFNKVKKDLNVPGFRKGHMPRTVFNQKFGE    60
              MSTSFENKATNRG+ITFTISQD+IKPALD+AFNK+KKDLN PGFRKGHMPR VFNQKFGE
Sbjct:  30    MSTSFENKATNRGVITFTISQDKIKPALDKAFNKIKKDLNAPGFRKGHMPRPVFNQKFGE    89
```

```
                              -continued
Query:  61  EALYENALNLVLPKAYEAAVAELGLDVVAQPKIDVVSMEKGQDWKLTAEVVTKPEVKLGD  120
            E LYE+ALN+VLP+AYEAAV ELGLDVVAQPKIDVVSMEKG++W L+AEVVTKPEVKLGD
Sbjct:  90  EVLYEDALNIVLPEAYEAAVTELGLDVVAQPKIDVVSMEKGKEWTLSAEVVTKPEVKLGD  149

Query: 121  YKDLSVEVDASKEVSDEEVDAKVERERNNLAELTVKDGEAAQGDTVVIDFVGSVDGVEFD  180
            YK+L VEVDASKEVSDE+VDAK+ERER NLAEL +KDGEAAQGDTVVIDFVGSVDGVEFD
Sbjct: 150  YKNLVVEVDASKEVSDEDVDAKIERERQNLAELIIKDGEAAQGDTVVIDFVGSVDGVEFD  209

Query: 181  GGKGDNFSLELGSGQFIPGFEEQLVGSKAGQTVDVNVTFPEDYQAEDLAGKDAKFVTTIH  240
            GGKGDNFSLELGSGQFIPGFE+QLVG+KAG  V+VNVTFPE YQAEDLAGK AKF+TTIH
Sbjct: 210  GGKGDNFSLELGSGQFIPGFEDQLVGAKAGDEVEVNVTFPESYQAEDLAGKAAKFMTTIH  269

Query: 241  EVTKEVPALDDELAKDIDDEVETLDELKAKYRKELESAKEIAFDDAVEGAAIELAVANA  300
            EVTKEVP LDDELAKDID++V+TL++LK KYRKELE+A+E A+DDAVEGAAIELAVANA
Sbjct: 270  EVTKEVPELDDELAKDIDEDVDTLEDLKVKYRKELEAAQETAYDDAVEGAAIELAVANA  329

Query: 301  EIVELPEEMVHDEVHRAMNEFMGNMQRQGISPEMYFQLTGTTEEDLHKQYQADA      354
            EIV+LPEEM+H+EV+R++NEFMGNMQRQGISPEMYFQLTGTT+EDLH QY A+A
Sbjct: 330  EIVDLPEEMIHEEVNRSVNEFMGNMQRQGISPEMYFQLTGTTQEDLHNQYSAEA      383
```

Based on this analysis, it was predicted that these proteins and their epitopes could be useful antigens for vaccines or diagnostics.

Example 2236

A DNA sequence (GBSx2355) was identified in *S. agalactiae* <SEQ ID 6909> which encodes the amino acid sequence <SEQ ID 6910>. This protein is predicted to be galactose-6-phosphate isomerase laca subunit (rpiB). Analysis of this protein sequence reveals the following:

Possible site: 26
>>> Seems to have no N-terminal signal sequence
----- Final Results -----
   bacterial cytoplasm --- Certainty = 0.3491 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

A related DNA sequence was identified in *S. pyogenes* <SEQ ID 6911> which encodes the amino acid sequence <SEQ ID 6912>. Analysis of this protein sequence reveals the following:

Possible site: 45
>>> Seems to have no N-terminal signal sequence
----- Final Results -----
   bacterial cytoplasm --- Certainty = 0.3224 (Affirmative) <succ>
   bacterial membrane --- Certainty = 0.0000 (Not Clear) <succ>
   bacterial outside --- Certainty = 0.0000 (Not Clear) <succ>

```
>GP:AAA25177 GB:M60447 galactose 6-P isomerase [Lactococcus lactis]
Identities = 92/141 (65%), Positives = 115/141 (81%)
Query:   1  MTIIIGADAHGVELKEVIRQHLTSLGKEIIDLTDTSKDFVDNTLAIVAKVNQKEDNLGIM   60
            M I++GAD G  LK+V++  L   G E+ID+T   +DFVD TLA+ ++VN+ E NLGI+
Sbjct:   1  MAIVVGADLKGTRLKDVVKNFLVEEGFEVIDVTKDGQDFVDVTLAVASEVNKDEQNLGIV   60

Query:  61  VDAYGVGPFMVATKVKGMIAAEVSDERSAYMTRAHNNARMITLGSEIVGPGVAKHIVEGF  120
            +DAYG GPFMVATK+KGM+AAEVSDERSAYMTR HNNARMIT+G+EIVG  +AK+I + F
Sbjct:  61  IDAYGAGPFMVATKIKGMVAAEVSDERSAYMTRGHNNARMITVGAEIVGDELAKNIAKAF  120

Query: 121  VDGTYDAGRHQIRVDMLNKMC                                         141
            V+G YD GRHQ+RVDMLNKMC
Sbjct: 121  VNGKYDGGRHQVRVDMLNKMC                                         141
```

An alignment of the GAS and GBS proteins is shown below.

```
            Identities = 101/140 (72%), Positives = 117/140 (83%)
            Query:   1  MTIIIGADAHGVELKEVIRQHLTSLGKEIIDLTDTSKDFVDNTLAIVAKVNQKEDNLGIM   60
                        M II+GADAHG  LKE+I+  L   G +IID+TD + DF+DNTLA+    VN+E    LGIM
            Sbjct:   1  MAIILGADAHGNALKELIKSFLQEEGYDIIDVTDINSDFIDNTLAVAKAVNEAEGRLGIM   60

Query:  61  VDAYGVGPFMVATKVKGMIAAEVSDERSAYMTRAHNNARMITLGSEIVGPGVAKHIVEGF  120
                        VDAYG GPFMVATK+KGM+AAEVSDERSAYMTR HNNARMIT+G+EIVGP +AK+IV+GF
            Sbjct:  61  VDAYGAGPFMVATKLKGMVAAEVSDERSAYMTRGHNNARMITIGAEIVGPELAKNIVKGF  120
```

```
Query: 121  VDGTYDAGRHQIRVDMLNKM                                         140
            V G YD GRHQIRVDMLNKM
Sbjct: 121  VTGPYDGGRHQIRVDMLNKM                                         140
```

Based on this analysis, it was predicted that these proteins and their epitopes could be useful antigens for vaccines or diagnostics.

Example 2237

A DNA sequence (GBSx2356) was identified in *S. agalactiae* <SEQ ID 6913> which encodes the amino acid sequence <SEQ ID 6914>. This protein is predicted to be galactose-6-phosphate isomerase lacb subunit (rpiB). Analysis of this protein sequence reveals the following:

---

Possible site: 35
>>> Seems to have no N-terminal signal sequence
----- Final Results -----
   bacterial cytoplasm --- Certainty = 0.2511 (Affirmative) <succ>
   bacterial membrane --- Certainty = 0.0000 (Not Clear) <succ>
   bacterial outside --- Certainty = 0.0000 (Not Clear) <succ>

---

A related GBS nucleic acid sequence <SEQ ID 10189> which encodes amino acid sequence <SEQ ID 10190> was also identified.

The protein has homology with the following sequences in the GENPEPT database.

A related DNA sequence was identified in *S. pyogenes* <SEQ ID 6915> which encodes the amino acid sequence <SEQ ID 6916>. Analysis of this protein sequence reveals the following:

---

Possible site: 57
>>> Seems to have no N-terminal signal sequence
----- Final Results -----
   bacterial cytoplasm --- Certainty = 0.3048 (Affirmative) <succ>
   bacterial membrane --- Certainty = 0.0000 (Not Clear) <succ>
   bacterial outside --- Certainty = 0.0000 (Not Clear) <succ>

---

```
>GP:AAA25178 GB:M60447 galactose 6-P isomerase [Lactococcus lactis]

Identities = 138/171 (80%), Positives = 157/171 (91%)
Query: 10   MKIAVGCDHIVTYDKIAVVDYLKTKGYEVIDCGTYDNIRTHYPIYGKKVGEAVASGKADL    69

M+IA+GCDHIVT  K+AV ++LK+KGYEV+D GTYD++RTHYPIYGKKVGEAV SG+ADL

Sbjct: 1    MRIAIGCDHIVTDVKMAVSEFLKSKGYEVLDFGTYDHVRTHYPIYGKKVGEAVVSGQADL    60

Query: 70   GVCICGTGVGINNAVNKVPGIRSALVRDLTSAIYAKEELNANVIGFGGKITGGLLMTDII   129
            GVCICGTGVGINNAVNKVPG+RSALVRD+TSA+YAKEELNANVIGFGG ITGGLLM DII
Sbjct: 61   GVCICGTGVGINNAVNKVPGVRSALVRDMTSALYAREELNANVIGFGGMITGGLLMNDII  120

Query: 130  EAFIRAKYKPTKENKVLIEKIAEVETHNAHQEENDFFTEFLDKWNRGEYHD           180
            EAFI A+YKPT+ENK LI KI  VETHNAHQ + +FFTEFL+KW+RGEYHD
Sbjct: 121  EAFIEAEYKPTEENKKLIAKIEHVETHNAHQADEEFFTEFLEKWDRGEYHD           171
```

An alignment of the GAS and GBS proteins is shown below.

```
Identities = 136/171 (79%), Positives = 160/171 (93%)
Query: 10   MKIAVGCDHIVTYDKIAVVDYLKTKGYEVIDCGTYDNIRTHYPIYGKKVGEAVASGKADL    69
            MKIA+GCDHIVT +K+AV D+LK+KGY+VIDCGTYD+ RTHYPI+GKKVGEAV +G+ADL
Sbjct: 2    MKIAIGCDHIVTNEKMAVSDFLKSKGYDVIDCGTYDHTRTHYPIFGKKVGEAVVNGQADL    61

Query: 70   GVCICGTGVGINNAVNKVPGIRSALVRDLTSAIYAKEELNANVIGFGGKITGGLLMTDII   129
            GVCICGTGVGINNAVNKVPGIRSALVRD+T+A+YAKEELNANVIGFGGKITG LLM DII
Sbjct: 62   GVCICGTGVGINNAVNKVPGIRSALVRDMTTALYAKEELNANVIGFGGKITGELLMCDII  121

Query: 130  EAFIRAKYKPTKENKVLIEKIAEVETHNAHQEENDFFTEFLDKWNRGEYHD           180
            +AFI A+YK T+ENK LI KIA +E+H+A+QE+ DFFTEFL+KW+RGEYHD
Sbjct: 122  DAFIKAEYKETEENKKLIAKIAHLESHHANQEDPDFFTEFLEKWDRGEYHD           172
```

Based on this analysis, it was predicted that these proteins and their epitopes could be useful antigens for vaccines or diagnostics.

Example 2238

A DNA sequence (GBSx2357) was identified in *S. agalactiae* <SEQ ID 6917> which encodes the amino acid sequence <SEQ ID 6918>. Analysis of this protein sequence reveals the following:

```
Possible site: 24
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>
```

A related GBS nucleic acid sequence <SEQ ID 10187> which encodes amino acid sequence <SEQ ID 10188> was also identified.

The protein has homology with the following sequences in the GENPEPT database.

A related DNA sequence was identified in *S. pyogenes* <SEQ ID 6919> which encodes the amino acid sequence <SEQ ID 6920>. Analysis of this protein sequence reveals the following:

```
Possible site: 14
>>> Seems to have no N-terminal signal sequence
----- Final Results -----
    bacterial cytoplasm --- Certainty = 0.1178 (Affirmative) <succ>
    bacterial membrane --- Certainty = 0.0000 (Not Clear) <succ>
    bacterial outside --- Certainty = 0.0000 (Not Clear) <succ>
```

```
>GP:AAA25179 GB:M60447 tagatose 6-P kinase [Lactococcus lactis]
Identities = 192/310 (61%), Positives = 236/310 (75%)
Query:  11   MILTVTLNPSIDISYCLENFNMDTVNRVTDVSKTPGGKGLNVTRVLSQLGDNVVATGLLG   70
             MILTVTLNPS+DISY LE   +DTVNRV DVSKT GGKGLNVTRVL + GD V ATG LG
Sbjct:   1   MILTVTLNPSVDISYPLETLKIDTVNRVKDVSKTAGGKGLNVTRVLYESGDKVTATGFLG   60

Query:  71   GDFGDFIRSGLDALEIRHQFLSIGGETRHCIAVLHEGQQTEILEKGPHITKDEADAFLNH  130
             G  G+FI S L+   +   F  I G TR+CIA+LHEG QTEILE+GP I+ +EA+ FL+H
Sbjct:  61   GKIGEFIESELEQSPVSPAFYKISGNTRNCIAILHEGNQTEILEQGPTISHEEAEGFLDH  120

Query: 131   LKLIFDAATIITVSGSLPKGLPSDYYARLISLANHFNKKVVLDCSGEALRSVLKSSAKPT  190
                 +   + ++T+SGSLP GLP+DYY +LI LA+     VVLDCSG  L +VLKSSAKPT
Sbjct: 121   YSNLIKQSEVVTISGSLPSGLPNDYYEKLIQLASDEGVAVVLDCSGAPLETVLKSSAKPT  180

Query: 191   VIKPNLEELTQLIGKPISYSLDELKSTLQQDLFRGIDWVIVSLGARGAFAKHGNHYYQVT  250
                IKPN EEL+QL+GK ++   ++ELK  L++ LF GI+W++VSLG  GAFAKHG+ +Y+V
Sbjct: 181   AIKPNNEELSQLLGKEVTKDIEELKDVLKESLFSGIEWIVVSLGRNGAFAKHGDVFYKVD  240

Query: 251   IPKIEVINPVGSGDATVAGIASALEHQLDDTNLLKRANVLGMLNAQETLTGHINLTYYQE  310
             IP I V+NPVGSGD+TVAGIASAL  + D +LLK A  LGMLNAQET+TGH+N+T Y+
Sbjct: 241   IPDIPVVNPVGSGDSTVAGIASALNSKKSDADLLKHAMTLGMLNAQETMTGHVNMTNYET  300

Query: 311   LISQIQVKEV                                                   320
             L SQI VKEV
Sbjct: 301   LNSQIGVKEV                                                   310
```

An alignment of the GAS and GBS proteins is shown below.

```
Identities = 184/310 (59%), Positives = 232/310 (74%), Gaps = 1/310 (0%)
Query:  11   MILTVTLNPSIDISYCLENFNMDTVNRVTDVSKTPGGKGLNVTRVLSQLGDNVVATGLLG   70
             +ILTVTLNP+ID+SY L+    DTVNRV DV+KTPGGKGLNV+RVL++  G+ V ATG +G
Sbjct:   1   VILTVTLNPAIDVSYPLDELKCDTVNRVVDVTKTPGGKGLNVSRVLNEFGETVKATGCVG   70

Query:  71   GDFGDFIRSGLDALEIRHQFLSIGGETRHCIAVLHEGQQTEILEKGPHITKDEADAFLNH  130
             G+ GDFI + L    I  +F  I G+TR CIA+LHEG QTEILEKGP  ++ DE D F +H
Sbjct:  61   GESGDFIINHLPD-SILSRFYKISGDTRTCIAILHEGNQTEILEKGPMLSVDEIDGFTHH  119

Query: 131   LKLIFDAATIITVSGSLPKGLPSDYYARLISLANHFNKKVVLDCSGEALRSVLKSSAKPT  190
              K + +   ++T+SGSLP G+P DYY +LI +AN   KK VLDCSG AL +VLK  +KPT
Sbjct: 120   FKYLLNDVDVVTLSGSLPAGMPDDYYQKLIKIANLNGKKTVLDCSGNALEAVLKGDSKPT  179

Query: 191   VIKPNLEELTQLIGKPISYSLDELKSTLQQDLFRGIDWVIVSLGARGAFAKHGNHYYQVT  250
             VIKPNLEEL+QL+GK ++     D LK  LQ  +LF GI+W+IVSLGA G FAKH  + Y V
```

```
-continued
Sbjct: 180  VIKPNLEELSQLLGKEMTKDFDALKEVLQDELFDGIEWIIVSLGADGVFAKHKDTFYNVD  239

Query: 251  IPKIEVINPVGSGDATVAGIASALEHQLDDTNLLKRANVLGMLNAQETLTGHINLTYYQE  310
            IPKI++++ VGSGD+TVAGIAS L +  DD  LL +ANVLGMLNAQE  TGH+N+  Y +
Sbjct: 240  IPKIKIVSAVGSGDSTVAGIASGLANDEDDRALLTKANVLGMLNAQEKTTGHVNMANYDK  299

Query: 311  LISQIQVKEV                                                   320
            L   I+VKEV
Sbjct: 300  LYQSIKVREV                                                   309
```

Based on this analysis, it was predicted that these proteins and their epitopes could be useful antigens for vaccines or diagnostics.

Example 2239

A DNA sequence (GBSx2358) was identified in *S. agalactiae* <SEQ ID 6921> which encodes the amino acid sequence <SEQ ID 6922>. This protein is predicted to be tagatose 1,6-diphosphate aldolase. Analysis of this protein sequence reveals the following:

Possible site: 25
>>> Seems to have no N-terminal signal sequence
----- Final Results -----
  bacterial cytoplasm --- Certainty = 0.0369 (Affirmative) <succ>
  bacterial membrane --- Certainty = 0.0000 (Not Clear) <succ>
  bacterial outside --- Certainty = 0.0000 (Not Clear) <succ>

A related DNA sequence was identified in *S. pyogenes* <SEQ ID 6923> which encodes the amino acid sequence <SEQ ID 6924>. Analysis of this protein sequence reveals the following:

Possible site: 26
>>> Seems to have no N-terminal signal sequence
----- Final Results -----
  bacterial cytoplasm --- Certainty = 0.0600 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:AAA25180 GB:M60447 tagatose 1,6-diP aldolase [Lactococcus lactis]
Identities = 253/325 (77%), Positives = 295/325 (89%)
Query:   1  MGLTEQKQKHMEQLSDKNGIISALAFDQRGALKRLMAKYQSEEPTVSQIEALKVLVAEEL    60
            M LTEQK+K +E+LSDKNG ISALAFDQRGALKRLMA+YQ   EPTV+Q+E LKVLVA+EL
Sbjct:   1  MVLTEQKRKSLEKLSDKNGFISALAFDQRGALKRLMAQYQDTEPTVAQMEELKVLVADEL    60

Query:  61  TPYASSMLLDPEYGLPATKVLDDNAGLLLAYEKTGYDTSSTKRLPDCLDIWSAKRIKEEG   120
            T YASSMLLDPEYGLPATK LD   AGLLLA+EKTGYDTSSTKRLPDCLD+WSAKRIKE+G
Sbjct:  61  TKYASSMLLDPEYGLPATKALDKEAGLLLAFEKTGYDTSSTKRLPDCLDVWSAKRIKEQG   120

Query: 121  ADAVKFLLYYDVDSSDEVNEEKEAYIERIGSECVAEDIPFFLEILSYDEKITDSSGIEYA   180
            ADAVKFLLYYDVDSSDE+N++K+AYIER+GSECVAEDIPFFLEIL+YDE+I+D+  +EYA
Sbjct: 121  ADAVKFLLYYDVDSSDELNQQKQAYIERVGSECVAEDIPFFLEILAYDEEISDAGSVEYA   180

Query: 181  KIKPRKVIEAMKVESNPRFNIDVLKVEVPVNMDYVEGFAQGETAYNKATAAAYFREQDQA   240
            K+KPRKVIEAMKVES+PRFNIDVLKVEVPVN+ YVEGFA  GE   YKA AA +F+ Q++A
Sbjct: 181  KVKPRKVIEAMKVESDPRFNIDVLKVEVPVNVKYVEGFADGEVVYSKAEAADFFKAQEEA   240

Query: 241  TLLPYIELSAGVPAQLFQETLVFAKEAGAKFNGVLCGRATWAGSVKEYVEKGEAGARQWL   300
            T LPYI+LSAGV A+LFQETL FA ++GAKFNGVLCGRATWAGSV+ Y+++GE   AR+WL
Sbjct: 241  TNLPYIYLSAGVSAKLFQETLQFAHDSGAKENGVLCGRATWAGSVEPYIKEGEKAAREWL   300

Query: 301  RTIGFQNIDELNKILQKTATSWKER                                     325
            RT GF+NIDELNK+L  KTA+ W ++
Sbjct: 301  RTTGFENIDELNKVLVKTASPWTDK                                     325
```

An alignment of the GAS and GBS proteins is shown below.

```
Identities = 230/323 (71%), Positives = 276/323 (85%), Gaps = 1/323 (0%)
Query:   3  LTEQKQKHMEQLSDKNGIISALAFDQRGALKRLMAKYQSEEPTVSQIEALKVLVAEELTP   62
            LTE K+K ME+LS  +G+ISALAFDQRGALKRMMA++Q+EPTV QIE LK LV+EELTP
Sbjct:   5  LTENKRKSMEKLS-VDGVISALAFDQRGALKRMMAQHQTKEPTVEQIEELKSLVSEELTP   63

Query:  63  YASSMLLDPEYGLPATKVLDDNAGLLLAYEKTGYDTSSTKRLPDCLDIWSARRIKEEGAD   122
            +ASS+LLDPEYGLPA++V +   AGLLLAYEKTGYD ++T RLPDCLD+WSAKRIKE GA+
```

-continued
```
Sbjct:  64  FASSILLDPEYGLPASRVRSEEAGLLLAYEKTGYDATTTSRLPDCLDVWSAKRIKEAGAE  123

Query: 123  AVKFLLYYDVDSSDEVNEEKEAYIERIGSECVAEDIPFFLEILSYDEKITDSSGIEYAKI  182
            AVKFLLYYD+D    +VNE+K+AYIERIGSEC AEDIPF+LEIL+YDEKI D++  E+AK+
Sbjct: 124  AVKFLLYYDIDGDQDVNEQKKAYIERIGSECRAEDIPFYLEILTYDEKIADNASPEFAKV  183

Query: 183  KPRKVIEAMKVFSNPRFNIDVLKVEVPVNMDYVEGFAQGETAYNKATAAAYFREQDQATL  242
            K  KV EAMKVFS  RF +DVLKVEVPVNM +VEGFA GE +   K  AA  FR+Q+ +T
Sbjct: 184  KAHKVNEAMKVFSKERFGVDVLKVEVPVNMKFVEGFADGEVLFTKEEAAQAFRDQEASTD  243

Query: 243  LPYIELSAGVPAQLFQETLVFAKEAGAKFNGVLCGRATWAGSVNEYVEKGEAGARQWLRT  302
            LPYI+LSAGV A+LFQ+TLVFA E+GAKFNGVLCGRATWAGSVK Y+E+G    AR+WLRT
Sbjct: 244  LPYIYLSAGVSAKLFQDTLVFAAESGAKFNGVLCGRATWAGSVKVYIEEGPQAAREWLRT  303

Query: 303  IGFQNIDELNKILQKTATSWKER                                      325
             GF+NIDELNK+L KTA+ W E+
Sbjct: 304  EGFKNIDELNKVLDKTASPWTEK                                      326
```

Based on this analysis, it was predicted that these proteins and their epitopes could be useful antigens for vaccines or diagnostics.

Example 2240

A DNA sequence (GBSx2359) was identified in *S. agalactiae* <SEQ ID 6925> which encodes the amino acid sequence <SEQ ID 6926>. This protein is predicted to be lacx protein, chromosomal. Analysis of this protein sequence reveals the following:

Possible site: 52
>>> Seems to have no N-terminal signal sequence
----- Final Results -----
  bacterial cytoplasm --- Certainty = 0.0643 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 10185> which encodes amino acid sequence <SEQ ID 10186> was also identified.

The protein has homology with the following sequences in the GENPEPT database.

```
>GP:AAA25184 GB:M60447 ORF [Lactococcus lactis]
Identities = 173/298 (58%), Positives = 219/298 (73%)
Query:  24  MAITIQNHELQVTLKALGATMTSITDSQGVEYLWQGDATYWGGQAPILFPICGSVRNDCV   83
            M I ++N  L V  K LG  +TSI D  G+EYLWQ D  YW GQAPILFPICGS+RND
Sbjct:   1  MTIELKNEYLTVQFKTLGGQLTSIKDKDGLEYLWQADPEYWNGQAPILFPICGSLRNDWA   60

Query:  84  IYRPAQAPHFTGIIPRHGETRHKTFDYDYISDSSVRFTIKSSKEMLINYPYRFSLEITYT  143
            IYRP + P FTG+I RHGFVR + F  + ++++SV F+IK +  EML NY Y+F L + YT
Sbjct:  61  IYRPQERPFFTGLIRRHGFVRKEEFTLEEVNENSVTFSIKPNAEMLDNYLYQFELRVVYT  120

Query: 144  LRNKSIAITYIVENLESEKNMPYAIGAHPGFNCPLFEKEVFSDYYLEFEQFETCTIPESF  203
            L  KSI    + V NLE+EK MPY IGAHP FNCPL E E + DY LEF + E+C+IP+SF
Sbjct: 121  LNGKSIRTEFQVTNLETEKTMPYFIGAHPAFNCPLVEGEKYEDYSLEFSEVESCSIPKSF  180

Query: 204  PDTGLLDLQARHPFLENQKQLSLNHALFEKDAITLDQLRSKTVYLKSRNHAKGIQLDFDD  263
            P+TGLLDLQ R PFLENQK L L+++LF  DAITLD+L+S++V L+SR   KG+++DFDD
Sbjct: 181  PETGLLDLQDRTPFLENQKSLDLDYSLFSHDAITLDRLKSRSVTLRSRKSGKGLAVDFDD  240

Query: 264  FENLILWTSNNGGPFLALEPWSSLSTSIEESDILEDKQNIVRLNPKQSKQHSIRITIL    321
            F NLILW++ N  PF+ALEPWS LSTS+EE +ILEDK  + ++ P  + S  ITIL
Sbjct: 241  FPNLILWSTTNKSPFIALEPWSGLSTSLEEGNILEDKPQVTKVLPLDTSKKSYDITIL    298
```

No corresponding DNA sequence was identified in *S. pyogenes*.

Based on this analysis, it was predicted that this protein and its epitopes, could be useful antigens for vaccines or diagnostics.

Example 2241

A DNA sequence (GBSx2361) was identified in *S. agalactiae* <SEQ ID 6927> which encodes the amino acid sequence <SEQ ID 6928>. This protein is predicted to be ABC transporter. Analysis of this protein sequence reveals the following:

Possible site: 49
>>> Seems to have no N-terminal signal sequence
----- Final Results -----
  bacterial cytoplasm --- Certainty = 0.3272 (Affirmative) <succ>
  bacterial membrane --- Certainty = 0.0000 (Not Clear) <succ>
  bacterial outside --- Certainty = 0.0000 (Not Clear) <succ>

A related GBS nucleic acid sequence <SEQ ID 10183> which encodes amino acid sequence <SEQ ID 10184> was also identified.

The protein has homology with the following sequences in the GENPEPT database.

```
>GP:CAA51350 GB:X72832 leucine rich protein [Streptococcus equisimilis]
Identities = 101/278 (36%), Positives = 160/278 (570), Gaps = 1/278 (0%)
Query:  10  MDFKELFPEVITKQEVKQSEDYIIVEQDGHVLHFPKSSLTKRELYLLQMTPSLEDASSVD   69
            M+ K+ FPE+           ++++ V++     +HFPKS L+++E  LL++        +
Sbjct:   1  MELKDYFPEMQVGPHPLGDKEWVSVKEGDQYVHFPKSCLSEKERLLLEVGLGQYEVLQ-P   59

Query:  70  SQNPWYRYLVEGRGRLPQSHSAVQFIFIEHQFTLSEELKDELSPLVINVETIMTINQTQS  129
             +PW RYL++ +G  PQ      QFI++ HQ  L  +L  +L ++    +E I+ I+ TQ+
Sbjct:  60  LGSPWQRYLLDHQGNPPQLFETSQFIYLNHQQVLPADLVELLQQMIAGLEVILPISTTQT  119

Query: 130  VMILNQDNFFNATELLTDILPTIENDFNTRLRCYFGNSWTHLQAVDWKELYEEEYKLFTL  189
             + Q          L +LPT+E+DF    L   + GN+W   + A    +E +EEE +L T
Sbjct: 120  AFLCRQATSIKVLRSLEGLLPTLESDFGLALTMFVGNAWYQVAAGTLRECFEEECQLLTA  179

Query: 190  FLSHKAEQHYCRFPKMALWALANQSPMPSIKAKCLQHILDTSDTSAIIKALWQEQGNLAK  249
             +L K+       F ++ LW++ +   P++     +Q +    SD +  ++ ALW E GNL +
Sbjct: 180  YLKQKSGGKLLTFAEVMLWSILSHQSFPALTRQFHQFLNPQSDMADVVHALWSEHGNLVQ  239

Query: 250  TAKALFIHRNSLQYKLDKFTQSSGLNLKILDDLAYAYL                       287
            TA+ L+IHRNSLQYKLDKF Q SGL+LK LDDLA+AYL
Sbjct: 240  TAQRLYIHRNSLQYKLDKFAQQSGLHLKQLDDLAFAYL                       277
```

A related DNA sequence was identified in *S. pyogenes* <SEQ ID 6929> which encodes the amino acid sequence <SEQ ID 6930>. Analysis of this protein sequence reveals the following:

Possible site: 14
>>> Seems to have no N-terminal signal sequence
----- Final Results -----
   bacterial cytoplasm --- Certainty = 0.4332 (Affirmative) <succ>
   bacterial membrane --- Certainty = 0.0000 (Not Clear) <succ>
   bacterial outside --- Certainty = 0.0000 (Not Clear) <succ>

An alignment of the GAS and GBS proteins is shown below.

```
Identities = 106/287 (36%), Positives = 169/287 (570), Gaps = 4/287 (1%)
Query:   3  KTVVED-AMDFKELFPEVITKQEVKQSEDYIIVEQDGHVLHFPKSSLTKRELYLLQM-TP   60
            KTV++   AM+ K+ FPE+         +D++ ++++ HFPKS     L+++E  LL++
Sbjct:   7  KTVMKGMAMELKDYFPEMQVGPHPLGDKDWMSIKEGDQYVHFPKSCLSEKERLLLEVGLG   66

Query:  61  SLEDASSVDSQNPWYRYLVEGRGRLPQSHSAVQFIFIEHQFTLSEELKDFLSPLVINVET  120
             E   + S   PW RYL++ +G  PQ +      QFI++ HQ  L ++L + L  ++    +E
Sbjct:  67  QCEVLQPLGS--PWQRYLLDHQGNPPQLYETSQFIYLNHQQALPDDLVELLQQMIAGLEV  124

Query: 121  IMTINQTQSVMILNQDNFFNATELLTDILPTIENDFNTRLRCYFGNSWTHLQAVDWKELY  180
            I+ I+ TQ+ + Q          L D+LPT+E+DF    L   + GN+W   + A    +E +
Sbjct: 125  ILPISATQTAFLCRQAISIKVLRWLEDLLPTLESDFGLALTMFVGNAWYQVAAGTLRECF  184

Query: 181  EEEYKLFTLFLSHKAEQHYCRFPKMALWALANQSPMPSIKAKCLQHILDTSDTSAIIKAL  240
            EEE +L T +L  ++ +     F   + LW+L +      ++ +   + Q +   SD +  ++ AL
Sbjct: 185  EEECQLLTAYLRQQSGRKLLTFSGLMLWSLLSHHTFLALTRQFHQFLSPQSDMADVVHAL  244

Query: 241  WQEQGNLAKTAKALFIHRNSLQYKLDKFTQSSGLNLKILDDLAYAYL              287
            W E GNL +TA+ L+IHRNSLQYKLDKF Q SGL+LK LDDLA+A+L
Sbjct: 245  WSEHGNLVQTAQRLYIHRNSLQYKLDKFAQQSGLHLKQLDDLAFAHL              291
```

Based on this analysis, it was predicted that these proteins and their epitopes could be useful antigens for vaccines or diagnostics.

Example 2242

A DNA sequence (GBSx2362) was identified in *S. agalactiae* <SEQ ID 6931> which encodes the amino acid sequence <SEQ ID 6932>. This protein is predicted to be multiple sugar-binding transport ATP-binding protein msmk (malK). Analysis of this protein sequence reveals the following:

Possible site: 17
>>> Seems to have no N-terminal signal sequence
----- Final Results -----
   bacterial cytoplasm --- Certainty = 0.4392 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

>GP:AAA26938 GB:M77351 ATP-binding protein [*Streptococcus mutans*]
Identities = 320/377 (84%), Positives = 359/377 (94%)

```
-continued
Query:    1  MVELNLNHIYKKYPSASHYSVEDFDLDIKDKEFIVFVGPSGCGKSTTLRMIAGLEDISEG    60
             MVELNLNHIYKKYP++SHYSVEDFDLDIK+KEFIVFVGPSGCGKSTTLRM+AGLEDI++G
Sbjct:    1  MVELNLNHIYKKYPNSSHYSVEDFDLDIKNKEFIVFVGPSGCGKSTTLRMVAGLEDITKG    60

Query:   61  ELKIDGEVVNDKSPKDRDIAMVFQNYALYPHMTVYDNMAFGLKLRKFSKQEIDKRVREAA   120
             ELKIDGEVVNDK+PKDRDIAMVFQNYALYPHM+VYDNMAFGLKLR +SK+ IDKRV+EAA
Sbjct:   61  ELKIDGEVVNDKAPKDRDIAMVFQNYALYPHMSVYDNMAFGLKLRHYSKEAIDKRVKEAA   120

Query:  121  ANIGLTEFLERKPADLSGGQRQRVAMGRAIVRDAKVFLMDEPLSNLDAKLRVSMRAEIAK   180
                +GLTEFLERKPADLSGGQRQRVAMGRAIVRDAKVFLMDEPLSNLDAKLRVSMRAEIAK
Sbjct:  121  QILGLTEFLERKPADLSGGQRQRVAMGRAIVRDAKVFLMDEPLSNLDAKLRVSMRAEIAK   180

Query:  181  IHQRIGSTTIYVTHDQTEAMTLADRIVIMSATENPDGDGTIGKIEQVGSPQELYNLPANK   240
             IH+RIG+TTIYVTHDQTEAMTLADRIVIMS+TKNTDG GTIG++EQVG+PQELYN PANK
Sbjct:  181  IHRRIGATTIYVTHDQTEAMTLADRIVIMSSTKNEDGSGTIGRVEQVGTPQELYNRPANK   240

Query:  241  FVAGFIGSPSMNFFKVKVENGMIISEDGLRIAIPEGQEKLLESRGYKGKELIFGIRPEDI   300
             FVAGFIGSP+MNFF V +++G ++S+DGL IA+EGQ  K+LES+G+K K LIFGIRPEDI
Sbjct:  241  FVAGFIGSPAMNFFDVTIKDGHLVSKDGLTIAVTEGQLKMLESKGFKNKNLIFGIRPEDI   300

Query:  301  SSNLLVQDTYPNANVEAEVLVSELLGSETMLYVKLGQTEFASRVEARDFHNPGEKVNLTF   360
             SS+LLVQ+TYP+A V+AEV+VSELLGSETMLY+KLGQTEFA+RV+ARDFH PGEKV+LTF
Sbjct:  301  SSSLLVQETYPDATVDAEVVVSELLGSETMLYLKLGQTEFAARVDARDFHEPGEKVSLTF   360

Query:  361  NVAKGHFFDADTEQAIR                                             377
             NVAKGHFFDA+TE AIR
Sbjct:  361  NVAKGHFFDAETEAAIR                                             377
```

A related DNA sequence was identified in *S. pyogenes* <SEQ ID 6933> which encodes the amino acid sequence <SEQ ID 6934>. Analysis of this protein sequence reveals the following:

```
Possible site: 48
>>> Seems to have no N-terminal signal sequence
----- Final Results -----
    bacterial cytoplasm --- Certainty = 0.4642 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
Identities = 332/377 (88%), Positives = 359/377 (95%)
Query:    1  MVELNLNHIYKKYPSASHYSVEDFDLDIKDKEFIVFVGPSGCGKSTTLRMIAGLEDISEG    60
             MVELNLNHIYKKYP+ +HY+VEDFDLDIKDKEFIVFVGPSGCGKSTTLRMIAGLEDISEG
Sbjct:    1  MVELNLNHIYKKYPNTTHYAVEDFDLDIKDKEFIVFVGPSGCGKSTTLRMIAGLEDISEG    60

Query:   61  ELKIDGEVVNDKSPKDRDIAMVFQNYALYPHMTVYDNMAFGLKLRKFSKQEIDKRVREAA   120
             ELKI GEVVNDKSPKDRDIAMVFQNYALYPHMTVYDNMAFGLKLRK+ K +ID+RV+EAA
Sbjct:   61  ELKIGGEVVNDKSPKDRDIAMVFQNYALYPHMTVYDNMAFGLKLRKYKKDDIDRRVKEAA   120

Query:  121  ANIGLTEFLERKPADLSGGQRQRVAMGRAIVRDAKVFLMDEPLSNLDAKLRVSMRAEIAK   180
                +GLTEFLERKPADLSGGQRQRVAMGRAIVRDAKVFLMDEPLSNLDAKLRVSMRAEIAK
Sbjct:  121  QILGLTEFLERKPADLSGGQRQRVAMGRAIVRDAKVFLMDEPLSNLDAKLRVSMRAEIAK   180

Query:  181  IHQRIGSTTIYVTHDQTEAMTLADRIVIMSATKNPDGDGTIGKIEQVGSPQELYNLPANK   240
             IH+RIGSTTIYVTHDQTEAMTLADRIVIMSATKNP G+GTIGKIEQVGSPQELYNLPANK
Sbjct:  181  IHRRIGSTTIYVTHDQTEAMTLADRIVIMSATKNPQGNGTIGKIEQVGSPQELYNLPANK   240

Query:  241  FVAGFIGSPSMNFFKVKVENGMIISEDGLRIAIPEGQEKLLESRGYKGKELIFGIRPEDI   300
             FVAGFIGSP+MNFF+V+V++G I+SEDGL IAIPEGQ K+LE+ GYKG+++ FGIRPEDI
Sbjct:  241  FVAGFIGSRAMNFFEVEVKDGRIVSEDGLDIAIPEGQAKMLEAAGYKGEKVTFGIRPEDI   300

Query:  301  SSNLLVQDTYPNANVEAEVLVSELLGSETMLYVKLGQTEFASRVEARDFHNPGEKVNLTF   360
             SS  +V DTYP+A V AEVLVSELLGSETMLYVKLGQTEFASRV+ARDFH PGE+V+LTF
Sbjct:  301  SSRQIVHDTYPSATVTAEVLVSELLGSETMLYVKLGQTEFASRVDARDFHSPGEQVSLTF   360

Query:  361  NVAKGHFFDADTEQAIR                                             377
             NVAKGHFFD DTEQAIR
Sbjct:  361  NVAKGHFFDRDTEQAIR                                             377
```

Based on this analysis, it was predicted that these proteins and their epitopes could be useful antigens for vaccines or diagnostics.

Example 2243

A DNA sequence (GBSx2363) was identified in *S. agalactiae* <SEQ ID 6935> which encodes the amino acid sequence <SEQ ID 6936>. This protein is predicted to be glucan 1,6-alpha-glucosidase (dexB) (treC). Analysis of this protein sequence reveals the following:

```
Possible site: 56
>>> Seems to have no N-terminal signal sequence
----- Final Results -----
    bacterial cytoplasm --- Certainty = 0.2525 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
Possible site: 56
>>> Seems to have no N-terminal signal sequence
----- Final Results -----
    bacterial cytoplasm --- Certainty = 0.2793 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
>GP:CAA51348 GB:X72832 glucan 1,6-alpha-glucosidase [Streptococcus
equisimilis]
Identities = 413/535 (77%), Positives = 476/535 (88%), Gaps = 1/535 (0%)
Query: 1    MKKHWWHKATIYQIYPRSFMDSDGDGVGDIKGITSKLDYLEKLGITAIWLSPVYQSPMDD   60
            M+K WWHKATIYQIYPRSF D+ G+G+GD+KGITS+LDYL+KLGITAIWLSPVYQSPMDD
Sbjct: 1    MQKQWWHKATIYQIYPRSFKDTSGNGIGDLKGITSQLDYLQKLGITAIWLSPVYQSPMDD   60

Query: 61   NGYDISDYQAIADIFGDMNDMDQLLQEANQRGIKIIMDLVVNHTSDEHAWFVEARENPNS   120
            NGYDISDY+AIA++FG+M+DMD LL  AN+RGIKIIMDLVVNHTSDEHAWFVEARENPNS
Sbjct: 61   NGYDISDYEAIAEVFGNMDDMDDLLAAANERGIKIIMDLVVNHTSDEHAWFVEARENPNS   120

Query: 121  PERDFYIWRDEPNDLTSIFSGSAWEYDKVSGQYYLHLFSKRQPDLNWENEALRHKIYDMM   180
            PERD+YIWRDEPN+L SIFSGSAWE D+ SGQYYLHLFSK+QPDLNWEN +R KIYDMM
Sbjct: 121  PERDYYIWRDEPNNLMSIFSGSAWELDEASGQYYLHLFSKKQPDLNWENAHVRQKIYDMM   180

Query: 181  NFWIDKGIGGFRMDVIDLIGKIPDKGITGNGPKLHDYLKEMNRASFGKHDLLTVGETWGA   240
            NFWI KGIGGFRMDVIDLIGKIPD  ITGNGP+LHDYLKEMN+A+FG HD++TVGETWGA
Sbjct: 181  NFWIAKGIGGFRMDVIDLIGKIPDSEITGNGPRLHDYLKEMNQATFGNHDVMTVGETWGA   240

Query: 241  TPDIAKQYSNPDNEELSMVFQFEHVGLQHKPDAPKWDYSDGLDVPALKDIFTKWQTQLEL   300
            TP+IA+QYS P+N+ELSMVFQFEHVGLQHKP+APKWDY++ LDVPALK IF+KWQT+L+L
Sbjct: 241  TPEIARQYSRPENKELSMVFQFEHVGLQHKPNAPKWDYAEELDVPALKTIFSKWQTELKL   300

Query: 301  GQGWNSLFWNNHDLPRVLSIWGNDSDNRKQSAKALAILLHLMRGTPYIYQGEEIGMTNYP   360
            G+GWNSLFWNNHDLPRVLSIWGNDS R++SAKALAILLHLMRGTPYIYQGEEIGMTNYP
Sbjct: 301  GEGWNSLFWNNHDLPRVLSIWGNDSIYREKSAKALAILLHLMRGTPYIYQGEEIGMTNYP   360

Query: 361  FECLADVDDIESLNYAKEAMDNGVSEATILDSIRKVGRDNARIPMQWSQEHQAGFTKG-T   419
            F+ L +VDDIESLNYAKEAM+NGV  A ++ SIRKVGRDNARTPMQWS++  AGF++
Sbjct: 361  FKDLTEVDDIESLNYAKEAMENGVPAARVMSSIRKVGRDNARIPMQWSKDTHAGFSEAQE   420

Query: 420  PWLAVNPNYQEINVEAALNDTESIFYTYQKLVALRKEHDWLVDADFKLLETADKVFAYVR   479
              WL VNPNYQEINV  AL + +SIFYTYQ+L+ALRK+ DWLV+AD+ LL TADKVFAY R
Sbjct: 421  TWLPVNPNYQEINVADALANQDSIFYTYQQLIALRKDQDWLVEADYHLLPTADKVFAYQR   480

Query: 480  QTDKERYLIVANLSDQNQSFEFPEAVKETIISNTEVQEVLSSNTLKPWDAFCIEL       534
            Q +E Y+IV N+SDQ Q F    A  E +I+NT+V +VL +  L+PWDAFC++L
Sbjct: 481  QFGEETYVIVVNVSDQEQVFAKDLAGAEVVITNTDVDKVLETKHLQPWDAFCVKL       535
```

A related DNA sequence was identified in *S. pyogenes* <SEQ ID 6937> which encodes the amino acid sequence <SEQ ID 6938>. Analysis of this protein sequence reveals the following:

```
Identities = 418/535 (78%), Positives =474/535 (88%), Gaps =1/535 (0%)
Query: 1    MKKHWWHKATIYQIYPRSFMDSDGDGVGDIKGITSKLDYLEKLGITAIWLSPVYQSPMDD   60
            M  HWWHKATIYQIYPRSF D+ G+G+GD+KGITS+LDYL+KLGITAIWLSPVYQSPMDD
Sbjct: 1    MNNHWWHKATIYQIYPRSFKDTSGNGIGDLKGITSQLDYLQKLGITAIWLSPVYQSPMDD   60

Query: 61   NGYDISDYQAIADIFGDMNDMDQLLQEANQRGIKIIMDLVVNHTSDEHAWFVEARENPNS   120
            NGYDISDY+AIAD+FGDM DMD+LL  AN+RGIKIIMDLVVNHTSDEHAWFVEARENPNS
Sbjct: 61   NGYDISDYEAIADVFGDMADMDELLAAANERGIKIIMDLVVNHTSDEHAWFVEARENPNS   120

Query: 121  PERDFYIWRDEPNDLTSIFSGSAWEYDKVSGQYYLHLFSKRQPDLNWENEALRHKIYDMM   180
            PERD+YIWRDEPN+L SIFSGSAWE D+ SGQYYLHLFSK+QPDLNWEN  LR KIYDMM
Sbjct: 121  PERDYYIWRDEPNNLMSIFSGSAWELDEASGQYYLHLFSKKQPDLNWENAQLRQKIYDMM   180

Query: 181  NFWIDKGIGGFRMDVIDLIGKIPDKGITGNGPKLHDYLKEMNRASFGKHDLLTVGETWGA   240
            NFWI KGIGGFRMDVIDLIGK+PD  ITGNGP+LHDYLKEMN+A+FG HD++TVGETWGA
Sbjct: 181  NFWIAKGIGGFRMDVIDLIGKVPDLEITGNGPRLHDYLKEMNQATFGNHDVMTVGETWGA   240

Query: 241  TPDIAKQYSNPDNEELSMVFQFEHVGLQHKPDAPKWDYSDGLDVPALKDIFTKWQTQLEL   300
            TP+IA+QYS P+N+ELSMVFQFEHVGLQHKPDAPKWDY+  LDVPALK IF+KWQT+L+L
```

```
                                      -continued
Sbjct: 241  TPEIARQYSRPENKELSMVFQFEHVGLQHKPDAPKWDYAKELDVPALKAIFSKWQTELKL  300

Query: 301  GQGWNSLFWNNHDLPRVLSIWGNDSDNRKQSAKALAILLHLMRGTPYIYQGEEIGMTNYP  360
            G+GWNSLFWNNHDLPRVLSIWGNDS  R++SAKALAILLHLMRGTPYIYQGEEIGMTNYP
Sbjct: 301  GEGWNSLFWNNHDLPRVLSIWGNDSTYREKSAKALAILLHLMRGTPYIYQGEEIGMTNYP  360

Query: 361  FECLADVDDIESLNYAKEAMDNGVSEATILDSIRKVGRDNARTPMQWSQEHQAGFIKG-T  419
            F+ L +V+DIESLNYAKEAM NGVS A ++DSIRKVGRDNARTPMQWS++  AGF++
Sbjct: 361  FKDLTEVNDIESLNYAKEAMGNGVSAARVMDSIRKVGRDNARTPMQWSKDTHAGFSEAKE  420

Query: 420  PWLAVNPNYQEINVEAALNDTESIFYTYQKLVALRKEHDWLVDADFKLLETADKVFAYVR  479
              WL VNPNYQ+INV  AL D +SIFYTYQKL+ALRKE DWLV+AD+ LL TADKVFAY R
Sbjct: 421  TWLPVNPNYQDINVADALADPDSIFYTYQKLIALRKEQDWLVEADYHLLPTADKVFAYQR  480

Query: 480  QTDKERYLIVANLSDQNQSFEFPEAVKETIISNTEVQEVLSSNTLKPWDAFCIEL       534
            Q  +E Y+IV N+SD+ Q F    A  +  II+NT+V  VL    +L+PWDAFC++L
Sbjct: 481  QLGEETYVIVVNVSDEEQVFATDLAGAQVIIANTDVDTVLETKHLQPWDAFCLKL       535
```

Based on this analysis, it was predicted that these proteins and their epitopes could be useful antigens for vaccines or diagnostics.

Example 2244

A DNA sequence (GBSx2364) was identified in *S. agalactiae* <SEQ ID 6939> which encodes the amino acid sequence <SEQ ID 6940>. Analysis of this protein sequence reveals the following:

```
Possible site: 44
>>> Seems to have an uncleavable N-term signal seq
----- Final Results -----
   bacterial membrane --- Certainty = 0.0000 (Not Clear) <succ>
   bacterial outside --- Certainty = 0.0000 (Not Clear) <succ>
   bacterial cytoplasm --- Certainty = 0.0000 (Not Clear) <succ>
```

The protein has homology with the following sequences in the GENPEPT database.

Based on this analysis, it was predicted that this protein and its epitopes, could be useful antigens for vaccines or diagnostics.

Example 2245

A DNA sequence (GBSx2366) was identified in *S. agalactiae* <SEQ ID 6941> which encodes the amino acid sequence <SEQ ID 6942>. This protein is predicted to be two-component response regulator. Analysis of this protein sequence reveals the following:

```
Possible site: 40
>>> Seems to have no N-terminal signal sequence
----- Final Results -----
   bacterial cytoplasm --- Certainty = 0.3945 (Affirmative) <succ>
   bacterial membrane --- Certainty = 0.0000 (Not Clear) <succ>
   bacterial outside --- Certainty = 0.0000 (Not Clear) <succ>
```

The protein has homology with the following sequences in the GENPEPT database.

```
>GP:AAB49738 GB:U21942 UDP-galactose 4-epimerase [Streptococcus mutans]
Identities = 267/331 (80%), Positives = 306/331 (91%)

Query: 1    MAVLILGGAGYIGSHMVDQLITQGKEKVIVVDNLVTGHRQAVHSDAIFYEGDLSDKTFMR   60
            MA+L+LGGAGYIGSHMVD+LI +G+E+V+VVD+LVTGHR AVH  A FY+GDL+D+ FM
Sbjct: 1    MAILVLGGAGYIGSHMVDRLIEKGEEEVVVVDSLVTGHRAAVHPAAKFYQGDLADREFMS  60

Query: 61   QVFRENPDVDAVIHFAAFSLVAESMENPLKYFDNNTAGMIKLLEVMNECDIKNIVFSSTA  120
             VFRENPDVDAVIHFAA+SLVAESM+ PLKYFDNNTAGMIKLLEVM+E  +K IVFSSTA
Sbjct: 61   MVFRENPDVDAVIHFAAYSLVAESMKKPLKYFDNNTAGMIKLLEVMSEFGVKYIVFSSTA  120

Query: 121  ATYGIPEQVPILETAPQNPINPYGESKLMMETIMKWADQAYGIKFVALRYFNVAGDKPDG  180
            ATYGIP ++PI ET PQ PINPYGESKLMMETIMKW D+AYGIKFV +RYFNVAG KPDG
Sbjct: 121  ATYGIPNEIPIKETTPQRPINPYGESKLMMETIMKWSDRAYGIKFVPVRYFNVAGAKPDG  180

Query: 181  SIGEDHKPETHLLPIILQVAQGVRDKIMIFGDDYNTPDGTNVRDYVHPFDLADAHILAVD  240
            SIGEDH PETHLLPIILQVAQGVR+KIMIFGDDYNTPDGTNVRDYVHPFDLAD H+LA++
Sbjct: 181  SIGEDHSPETHLLPIILQVAQGVREKIMIFGDDYNTPDGTNVRDYVHPFDLADRHLLALN  240

Query: 241  YLRQGNESNVFNLGSSTGFSNLQMLEAARRITGKEIPAQKAARRPGDPDTLIASSEKARQ  300
            YLRQGN S  FNLGSSTGFSNLQ+LEAAR++TG++IPA+KAARR GDPDTLIASSEKAR+
Sbjct: 241  YLRQGNPSTAFNLGSSTGFSNLQILEAARKVTGQKIPAEKAARRSGDPDTLIASSEKARE  300

Query: 301  ILGWEPKFDNIDKIISSAWAWHSSHPNGYED                             331
            ++GW+P+FD+I+KII+SAWAWHSSHP GY+D
Sbjct: 301  VVGWKPQFDDIEKIIASAWAWHSSHPKGYDD                             331
```

```
>GP:BAB06470 GB:AP001516 two-component response regulator [Bacillus halodurans]
Identities = 71/223 (31%), Positives = 139/223 (61%), Gaps = 7/223 (3%)
Query:   3   VLIIEDDPMVEFIHRNYLEKLNYFQNIYSTASQTQAIAYLNDIKIQLVLLDIHIKEGNGL    62
             VL+IEDDPMV+ ++R ++EKL+ F  + +TA+ + +    +++  L+LLDI + + +GL
Sbjct:   9   VLLIEDDPMVQEVNRMFVEKLSGFTIVGTTATGEEGMVKTRELQPDLILLDIFMPKQDGL    68

Query:  63   ELLKLLRNQHQNTEVIVISAANEAHTVKEAFHLGIVDYLIKPFTFERFESSIEKFLNHYH   122
             +K +R Q+ + ++I ++AAN+  T+K      G++DYL+KPFTFER ++++ ++   +
Sbjct:  69   SFIKQIREQYIDVDIIAVTAANDTKTIKTLLRYGVMDYLVKPFTFERLKAALTQYEEMFR   128

Query: 123   TFEAD-KIYQDNIDHFQKIDSGWLEGEVKLDE--KGLSEITYQHILDAIQELEQPFTIQE   179
             + + ++ QD++D   K     + +  +D+  KGL   T Q +++ ++EL++P + +E
Sbjct: 129   KMQKEAELSQDSLDEMIK----QKQAQANMDDLPKGLHAHTLQQVIERLEELDEPKSAEE   184

Query: 180   LAKCSQFSHVSVRKYIAYMEEKGLLTSQQIYTKVGRPYKVYKL                   222
             + +    + V+VR+Y+ Y+E  G +       Y  +GRP + YKL
Sbjct: 185   IGRDVGLARVTVRRYLNYLESVGQVEMDLTYGSIGRPIQTYKL                   227
```

A related DNA sequence was identified in *S. pyogenes* <SEQ ID 6943> which encodes the amino acid sequence <SEQ ID 6944>. Analysis of this protein sequence reveals the following:

Possible site: 37
>>> Seems to have no N-terminal signal sequence
----- Final Results -----
    bacterial cytoplasm --- Certainty = 0.4053 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below.

```
Identities = 123/220 (55%), Positives = 156/220 (70%)
Query:   1   MDVLIIEDDPMVEFIHRNYLEKLNYFQNIYSTASQTQAIAYLNDIKIQLVLLDIHIKEGN    60
             M+VLIIEDDPMV+FIHRNYLEKLN F   I S+ S   +   L D  I L+LLDIHI +GN
Sbjct:   1   MNVLIIEDDPMVDFIHRNYLEKLNLFDRIISSDSMKAVQSILTDYAIDLILLDIHITDGN    60

Query:  61   GLELLKLLRNQHQNTEVIVISAANEAHTVKEAFHLGIVDYLIKPFTFERFESSIEKFLNH   120
             G++ L+  R QH    EVI+ISAAN+ +  +++ FHLGI +DYLIKPFTFERF+ SI++F+ H
Sbjct:  61   GIQFLEKWRTQHIPCEVIIISAANDGNIIRDGPHLGIIDYLIKPFTFERFQESIQQFVTH   120

Query: 121   YHTFEADKIYQDNIDHFQKIDSGWLEGEVKLDEKGLSEITYQHILDAIQELEQPFTIQEL   180
                  ++ Q   ID + +  S     +L EKGLSE T+Q I++ I++   QPFTIQEL
Sbjct: 121   REHLANQQLEQAQIDQLKCLTSKKDTKNKQLLEKGLSESTFQWIMENIKVFDQPFTIQEL   180

Query: 181   AKCSQFSHVSVRKYIAYMEEKGLLTSQQIYTKVGRPYKVY                      220
             A     SHVSVRKYIAY+EE    L  SQQI+TKVGRPY+VY
Sbjct: 181   ASACHLSHVSVRKYIAYLEENKQLNSQQIFTKVGRPYRVY                      220
```

Based on this analysis, it was predicted that these proteins and their epitopes could be useful antigens for vaccines or diagnostics.

Example 2246

A DNA sequence (GBSx2367) was identified in *S. agalactiae* <SEQ ID 6945> which encodes the amino acid sequence <SEQ ID 6946>. Analysis of this protein sequence reveals the following:

Possible site: 21
>>> Seems to have an uncleavable N-term signal seq
INTEGRAL   Likelihood = −8.76   Transmembrane 12-28   (6-34)
INTEGRAL   Likelihood = −7.43   Transmembrane 178-194 (173-197)
----- Final Results -----
    bacterial membrane --- Certainty = 0.4503 (Affirmative) <succ> bacterial outside --- Certainty = 0.0000 (Not Clear) <succ>
    bacterial cytoplasm --- Certainty = 0.0000 (Not Clear) <succ>

A related GBS nucleic acid sequence <SEQ ID 9003> which encodes amino acid sequence <SEQ ID 9004> was also identified. Analysis of this protein sequence reveals the following:

Lipop: Possible site: −1   Crend: 3
SRCFLG: 0

McG: Length of UR: 27
Peak Value of UR: 2.99
Net Charge of CR: 3
McG: Discrim Score: 12.92
GvH: Signal Score (−7.5): −2.57
Possible site: 19
>>> Seems to have an uncleavable N-term signal seq
Amino Acid Composition: calculated from 1
ALOM program count: 2 value: −8.76 threshold: 0.0
INTEGRAL   Likelihood = −8.76   Transmembrane 10-26   (4-32)
INTEGRAL   Likelihood = −7.43   Transmembrane 176-192 (171-195)
PERIPHERAL Likelihood = 3.18    149
modified ALOM score: 2.25
icm1 HYPID: 7   CFP: 0.450
*** Reasoning Step: 3
----- Final Results -----
    bacterial membrane --- Certainty = 0.4503 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:CAB15141 GB:Z99120 similar to two-component sensor histidine
kinase [YufM] [Bacillus subtilis]
Identities = 132/461 (280), Positives = 245/461 (52%), Gaps = 7/461 (1%)
Query:   3   MKEYLSLWAFLSLILVTMTICIFSIFYYVTIHQSYRMVRVQEEKILKNTGYALSRNPQVI   62
             MKK L L   L++ + + +   I ++    Q+ + +R QE+      T   ++  P
Sbjct:   1   MKKTLKLQTRLTIFVCIVVLIALLITFFTVGAQTTKRIRDQEKATALQTAEMVAEAPMTA   60

Query:  63   QTLKDNHYDQSLQKQMLFLSKKSNLDYIVLINLKGIRFTHPDSTKIGKPFQGGDEQAVFK  122
             L+     +LQ    + K +  +++V++++ GIR THPD +KIGK F+GGDE   V K
Sbjct:  61   AALESGKKQKELQSYTKRVQKITGTEFVVVMDMNGIRKTHPDPSKIGKKFRGGDESEVLK  120

Query: 123   GKAIMSTAEGSLGKSLRYLIPVY-DHQKQVGAIAVGLKLTTLGDLSQSSIKEFSKPLLIS  181
             G   +STA G+LGKS R   +PVY ++ KQVGA+AVG+ +   + ++S++         + +S
Sbjct: 121   GHVHISTASGTLGKSQRAFVPVYAENGKQVGAVAVGITVNEIDEVISHSLRPLYFIICVS  180

Query: 182   ILISLVVTSIISYGLKKQLHNLHPSDIFQHLEERNATLDQIQAAVFVIDQRHIIKRNNPA  241
             I + ++    I++  +K ++ L P +I   LEER+A L+  +  + +D+    IK  N
Sbjct: 181   IFVGVIGAVIVARTVKNIMYGLEPYEIATLLEERSAMLESTKEGILAVDEHGKIKLANAE  240

Query: 242   ASLLFKKEGQRDLFSGKLLESLIP--QLKQDHFSKK--TEQVLHFQGQDYLLSISPITVK  297
             A  LF K G         + ++ ++P  +LK+      +KK    ++ +     G + + +   PI +K
Sbjct: 241   AKRLFVKMGINTNPIDQDVDDILPKSRLKKVIETKKPLQDRDVRINGLELVFNEVPIQLK  300

Query: 298   TQNRGYVVFLRNVTETLFTLDQLAHTTAYASALQAQTHQFMNQLHVIYGLADIEYYDELK  357
                Q   G +     R+ TE       +QL+       YA+AL+AQ+H+FMN+LHVI  GL    ++  YD+L
Sbjct: 301   GQTVGAIATFRDKTEVKHLAEQLSGVKMYANALRAQSHEFMNKLHVILGLVQLKEYDDLG  360

Query: 358   IYLKELLEPQNEFLARLSMLVREPRLASFIIGEREKFAEKHINLSTEILVEIPTKSTVED  417
             Y+K++   Q      + +   V+    LA F++G++     E+  NL  E      IP +
Sbjct: 361   DYIKDIAIQQKSETSEIINDVKSSVLAGFLLGKQSFIREQGANLDIECNGVIPNAADPSV  420

Query: 418   VNNYL-LLHRYINTKILTLLN-STTLVSLRLNYQNNLIETD                    456
             ++  + + ++   IN + + +    +++ + + N++++ +
Sbjct: 421   IHELITIIGNLINNGLDAVADMPKKQITMSMRFHNSILDIE                    461
```

A related DNA sequence was identified in *S. pyogenes* <SEQ ID 6947> which encodes the amino acid sequence <SEQ ID 6948>. Analysis of this protein sequence reveals the following:

Possible site: 57
>>> Seems to have a cleavable N-term signal seq.

INTEGRAL   Likelihood = –10.03   Transmembrane 174-190 (170-195)
----- Final Results -----
  bacterial membrane --- Certainty = 0.5012 (Affirmative) <succ>
  bacterial outside --- Certainty = 0.0000 (Not Clear) <succ>
  bacterial cytoplasm --- Certainty = 0.0000 (Not Clear) <succ>

An alignment of the GAS and GBS proteins is shown below.

```
Identities = 236/488 (48%), Positives = 337/488 (68%), Gaps = 3/488 (0%)
Query:   3   MKKKLSLWAFLSLILVTMTICIFSIFYYVTIHQSYRMVRVQEEKILKNTGYALSRNPQVI   62
             MKK L LWA LSLILV+M +    S+FY + +H +++ ++ QE  +L +TG L+ +  +
Sbjct:   1   MKKPLRLWASLSLILVSMIVVTTSLFYGIMLHDTHQSIKNQETHLLTSTGKMLASHQAIK   60

Query:  63   QTLKDNHYDQSLQKQMLFLSKKSNLDYIVLINLKGIRFTHPDSTKIGKPFQGGDEQAVFK  122
             +  L  +N +          ++     NLDY+V++N+KGIR  THP+   IGKPFQGGDE+AV
Sbjct:  61   ELLLNNQPNAKTTAYTNSIASIYNLDYVVVMNMKGIRLTHPNPKNIGKPFQGGDEEAVLA  120

Query: 123   GKAIMSTAEGSLGKSLRYLIPVYDHQKQVGAIAVGLKLTTLGDLSQSSIKEFSKPLLISI  182
             GK ++STA+G+LGKSLRYL+PV+D  KQ+GAIAVG+KLTTL D++ +S  + ++   LL+ +
Sbjct: 121   GKKVISTAKGTLGKSLRYLVPVFDGDKQIGAIAVGIKLTTLNDVALTSKRNYTLSLLLCL  180

Query: 183   LISLVVTSIISYGLKKQLHNLHPSDIFQHLEERNATLDQIQAAVFVIDQRHIIKRNNPAA  242
             LISL+VTS  IS+  LK+QLH  L PS+I+Q  FEERNA  LDQI+AAVFV+D+   I++   N A
Sbjct: 181   LISLLVTSFISFRLKRQLHQLEPSEIYQLFEERNAMLDQIEAAVFVVDKAGILQLCNQAG  240

Query: 243   SLLFKKEGQRDLFSGKLLESLIPQLKQDHFSKKTEQVLHFQGQDYLLSISPITVKTQNRG  302
                L ++ Q         +G        L P         +         EQ+   +     +DYLL +ISPI  VK   +RG
Sbjct: 241   QKLIARKCQLGKPTGNSFNYLFPDFPKLSLQEGHEQLFRYGEEDYLLAISPICVKNDHRG  300

Query: 303   YVVFLRNVTETLFTLDQLAHTTAYASALQAQTHQFMNQLHVIYGLADIEYYDELKIYLKE  362
             +++F+R     + +   +  TLDQLA+TTAYASALQAQTH+FMNQLHVIYGL DI YYD+LKIYL
Sbjct: 301   HIIFMREAVKAIDTLDQLAYTTAYASALQAQTHKFMNQLHVIYGLVDIAYYDQLKIYLDS  360

Query: 363   LLEPQNEFLARLSMLVREPRLASFIIGEREKFAEKHINLSTEILVEIPTKSTVEDVNNYL  422
             +LEP+NE L   LS+LV+EP LASF+IGE EK+ E  +++L    ++L   ++L EIP +T      +NN L
Sbjct: 361   ILEPENEILTSLSVLVKEPLLASFLIGEQEKYQELNVHLKIDVLSEIPHSATKNQLNNGL  420
```

-continued

```
Query: 423  LLHRYINTKILTLLNSTTLVSLRLNYQNNLIETDYQWENEKWL-LNDYHQYFNDAYFQQL  481
            +++R+I+T +LT L   +LV   + QN+LI  +    + W+ L     F+  YFQQL
Sbjct: 421  MIYRFIHTNLLTTLRPKSLVLSIQHDQNHLI--SHYTLTDNWIDLERVQPIFDLPYFQQL  478

Query: 482  LVDSRATY  489
            L D+ + +
Sbjct: 479  LTDTNSQF  486
```

SEQ ID 9004 (GBS130d) was expressed in *E. coli* as a GST-fusion product. SDS-PAGE analysis of total cell extract is shown in FIG. 123 (lane 8-10; MW 63 kDa) and in FIG. 184 (lane 4; MW 63 kDa). It was also expressed in *E. coli* as a His-fusion product. SDS-PAGE analysis of total cell extract is shown in FIG. 123 (lane 11; MW 38 kDa) and in FIG. 181 (lane 7; MW 38 kDa). GBS130d-GST was purified as shown in FIG. 237, lane 11. GBS130d-His was purified as shown in FIG. 233, lane 9-10.

Based on this analysis, it was predicted that these proteins and their epitopes could be useful antigens for vaccines or diagnostics.

Example 2247

A DNA sequence (GBSx2368) was identified in *S. agalactiae* <SEQ ID 6949> which encodes the amino acid sequence <SEQ ID 6950>. Analysis of this protein sequence reveals the following:

```
Possible site: 51
>>> Seems to have no N-terminal signal sequence
INTEGRAL  Likelihood = -11.52  Transmembrane 364-380 (353-386)
INTEGRAL  Likelihood =  -9.66  Transmembrane  33-49   (26-57)
INTEGRAL  Likelihood =  -7.80  Transmembrane  87-103  (82-105)
INTEGRAL  Likelihood =  -6.85  Transmembrane 153-169 (144-174)
INTEGRAL  Likelihood =  -4.41  Transmembrane 301-317 (300-318)
INTEGRAL  Likelihood =  -2.81  Transmembrane 216-232 (212-235)
INTEGRAL  Likelihood =  -2.39  Transmembrane 120-136 (120-136)
INTEGRAL  Likelihood =  -1.65  Transmembrane  57-73   (56-73)
INTEGRAL  Likelihood =  -1.17  Transmembrane 428-444 (428-444)
INTEGRAL  Likelihood =  -0.32  Transmembrane 276-292 (276-292)
----- Final Results -----
   bacterial membrane --- Certainty = 0.5607 (Affirmative) <succ>
   bacterial outside --- Certainty = 0.0000 (Not Clear) <succ>
   bacterial cytoplasm --- Certainty = 0.0000 (Not Clear) <succ>
```

The protein has homology with the following sequences in the GENPEPT database.

```
>GP:AAB18291 GB:D35658 L-malate permease [Streptococcus bovis]
Identities = 329/428 (76%), Positives = 375/428 (86%)
Query:  18  DLKAKLFHIKIGSVPLPVYVCLALLILLAGFLQKLPVNMLGGFAVILTMGWFLGTIGASI   77
            D + KL   +IGSV LPVY+  A +IL+    L++LPVNMLGGFAVILTMGW LGTIG +I
Sbjct:  14  DWRNKLTKTRIGSVTLPVYLVTASIILVTALLEQLPVNMLGGFAVILTMGWLLGTIGGNI   73

Query:  78  PGFKNFGGPAILSLLVPSILVFFNLINKNVLESTNMLMKQANFLYFYIACLVSGSILGMN  137
            P   K+FGGPAILSLLVPSI+VFFNL+N+NVL+ST++LMKQANFLYFYIACLV GSILGMN
Sbjct:  74  PILKHFGGPAILSLLVPSIMVFFNLLNQNVLDSTDILMKQANFLYFYIACLVCGSILGMN  133

Query: 138  RKMLIQGLLRMIFPMLLGMVCAMMVGTFVGVILGLEWRHTLFYIVTPVLAGGIGEGILPL  197
            RK+L+QGL+RMI PM LGM+ AM VGT VG +LGL W+H+LFYIVTPVLAGGIGEGILPL
Sbjct: 134  RKILVQGLMRMIVPMALGMILAMGVGTLVGTLLGLGWKHSLFYIVTPVLAGGIGEGILPL  193

Query: 198  SLGYSSITGVASEQLVAQLIPATIIGNFFAILCTALLNRLGEKKPHLSGQGQLVRLNKGE  257
            SLGYS+ITG+ SEQLV QLIPATIIGNFFAI+C+ LL+RLGEK+P LSGQGQL+++    +
Sbjct: 194  SLGYSAITGLPSEQLVGQLIPATIIGNFFAIMCSGLLSRLGEKRPELSGQGQLIKITNSD  253

Query: 258  DMSDIIADHSGPIDVKKMGGGVLTACSLFIFGHLLQQLTGFPGPVLMIVAAAILKYINVI  317
            D+SD + +    PIDVK MG GVL AC+LFI G LLQ LTGFPGPVLMIV AA LKY+NV+
Sbjct: 254  DLSDALEEDKAPIDVKLMGAGVLIACTLFITGGLLQHLTGFPGPVLMIVVAAFLKYLNVV  313

Query: 318  PRETQNGAKQLYKFISGNFTFPLMAGLGLLYIPLKDVVATLSIQYFIVVISVVFTVISVG  377
            P+ETQ G+KQLYKFISGNFTFPLM GLG+LYIPLKDVV   LS QYF+VVISVVFTVI+ G
Sbjct: 314  PKETQRGSKQLYKFISGNFTFPLMVGLGMLYIPLKDVVGMLSWQYFVVVISVVFTVIATG  373

Query: 378  FFVSRFLNMNPVEAGIISACQSGMGGTGDVAILSTADRMNLMPFAQVATRLGGAITVITM  437
            FFVSRF+NMNPVEA I+SACQSGMGGTGDVAILSTA+RM LMPFAQVATRLGGAITVITM
Sbjct: 374  FFVSRFMNMNPVEAAIVSACQSGMGGTGDVAILSTANRMTLMPFAQVATRLGGAITVITM  433

Query: 438  TAILRMLF  445
            TAI RMLF
Sbjct: 434  TAIFRMLF  441
```

A related DNA sequence was identified in *S. pyogenes* <SEQ ID 6951> which encodes the amino acid sequence <SEQ ID 6952>. Analysis of this protein sequence reveals the following:

```
Possible site: 48
>>> Seems to have no N-terminal signal sequence
INTEGRAL      Likelihood = -11.89   Transmembrane 361-377 (350-383)
INTEGRAL      Likelihood = -7.43    Transmembrane 84-100 (79-102)
INTEGRAL      Likelihood = -6.16    Transmembrane 150-166 (137-171)
INTEGRAL      Likelihood = -4.88    Transmembrane 30-46 (24-48)
INTEGRAL      Likelihood = -4.35    Transmembrane 299-315 (297-316)
INTEGRAL      Likelihood = -4.14    Transmembrane 117-133 (115-134)
INTEGRAL      Likelihood = -3.19    Transmembrane 54-70 (51-75)
INTEGRAL      Likelihood = -2.92    Transmembrane 425-441 (425-442)
INTEGRAL      Likelihood = -2.81    Transmembrane 213-229 (209-232)
INTEGRAL      Likelihood = -2.44    Transmembrane 273-289 (271-290)
----- Final Results -----
   bacterial membrane --- Certainty = 0.5755 (Affirmative) <succ>
     bacterial outside --- Certainty = 0.0000 (Not Clear) <succ>
       bacterial cytoplasm --- Certainty = 0.0000 (Not Clear) <succ>
```

The protein has homology with the following sequences in the databases:

```
>GP:AAB18291 GB:U35658 L-malate permease [Streptococcus Bovis]
Identities = 344/443 (77%), Positives = 394/443 (88%), Gaps = 6/443 (1%)
Query:     4  ISKKMPQKDLSEHSKAWQNR----RIGSVPLPVYLVLATLILVTGWLQQLPVNMLGGFAV    59
              + KK+P    +E    W+N+      RIGSV LPVYLV A++ILVT  L+QLPVNMLGGFAV
Sbjct:     1  MEKKLPATAANETD--WRNKLTKTRIGSVTLPVYLVTASIILVTALLEQLPVNMLGGFAV    58

Query:    60  ILTLGWLLGTIGATIPGLKHFGGPAILSLLVPSILVFFNLLNPNVLEATNVLMKQANFLY   119
              ILT+GWLLGTIG  IP LKHFGGPAILSLLVPSI+VFFNLLN NVL++T++LMKQANFLY
Sbjct:    59  ILTMGWLLGTIGGNIPILKHFGGPAILSLLVPSIMVFFNLLNQNVLDSTDILMKQANFLY   118

Query:   120  FYIACLVCGSILGMNRKILIQGLFRMIIPMLLGMVCAMGVGTLVGVILGLDWQHTLFYVV   179
              FYIACLVCGSILGMNRKIL+QGL RMI+PM LGM+ AMGVGTLVG +LGL W+H+LFY+V
Sbjct:   119  FYIACLVCGSILGMNRKILVQGLMRMIVPMALGMILAMGVGTLVGTLLGLGWKHSLFYIV   178

Query:   180  TPVLAGGIGEGILPLSLGYSAITGVGSEQLVAQLIPATIIGNFFAILCTALLNRFGEKHP   239
              TPVLAGGIGEGILPLSLGYSAITG+ SEQLV QLIPATIIGNFFAI+C+ LL+R GEK P
Sbjct:   179  TPVLAGGIGEGILPLSLGYSAITGLPSEQLVGQLIPATIIGNFFAIMCSGLLSRLGEKRP   238

Query:   240  SYSGQGQLVKIGHSEDMSDALKDNSGALDVKLMGAGVLTACSLFIAGGLLQHLTDFPGPV   299
                  SGQGQL+KI +S+D+SDAL+++    +DVKLMGAGVL AC+LFI GGLLQHLT FPGPV
Sbjct:   239  ELSGQGQLIKITNSDDLSDALEEDKAPIDVKLMGAGVLIACTLFITGGLLQHLTGFPGPV   298

Query:   300  LMIILAAFLKYLNVIPQETQNGAKQLYKFISSNFTFPLMAGLGLLYIPLKEVVATLSWQY   359
              LMI++AAFLKYLNV+P+ETQ G+KQLYKFIS NFTFPLM GLG+LYIPLK+VV  LSWQY
Sbjct:   299  LMIVVAAFLKYLNWPKETQRGSKQLYKFISGNFTFPLMVGLGMLYIPLKDVVGMLSWQY   358

Query:   360  FIVVISVVLTVVSVGFFVSRFLNMSPVEAAIISACQSGMGGTGDVAILSTADRMNLMPFA   419
              F+VVISVV TV++GFFVSRF+NM+PVEAAI+SACQSGMGGTGDVAILSTA+RM LMPFA
Sbjct:   359  FVVVISVVFTVIATGFFVSRFMNMNPVEAAIVSACQSGMGGTGDVAILSTANRMTLMPFA   418

Query:   420  QVATRLGGAITVITMTAILRIIF                                        442
              QVATRLGGAITVITMTAI R++F
Sbjct:   419  QVATRLGGAITVITMTAIFRMLF                                        441
```

An alignment of the GAS and GBS proteins is shown below.

```
Identities = 356/419 (84%), Positives = 385/419 (90%)
Query:    27  KIGSVPLPVYVCLALLILLAGFLQKLPVNMLGGFAVILTMGWFLGTIGASIPGFKMFGGP    86
              +IGSVPLPVY+ LA LIL+ G+LQ+LPVNMLGGFAVILT+GW LGTIGA+IPG K+FGGP
Sbjct:    24  RIGSVPLPVYLVLATLILVTGWLQQLPVNMLGGFAVILTLGWLLGTIGATIPGLKHFGGP    83

Query:    87  AILSLLVPSILVFFNLINKNVLESTNMLMKQANFLYFYIACLVSGSILGMNRKMLIQGLL   146
              AILSLLVPSILVFFNL+N NVLE+TN+LMKQANFLYFYIAELV GSILGMNRK+LIQGL
Sbjct:    84  AILSLLVPSILVFFNLLNPNVLEATNVLMKQANFLYFYIACLVCGSILGMNRKILIQGLF   143

Query:   147  RMIFPMLLGMVCAMMVGTFVGVILGLEWRHTLFYIVTPVLAGGIGEGILPLSLGYSSITG   206
              RMI PMLLGMVCAM VGT VGVILGL+W+HTLFY+VTPVLAGGIGEGILPLSLGYS+ITG
```

-continued

```
Sbjct: 144  RMIIPMLLGMVCAMGVGTLVGVILGLDWQHTLFYVVTPVLAGGIGEGILPLSLGYSAITG  203

Query: 207  VASEQLVAQLIPATIIGNFFAILCTALLNRLGEKKPHLSGQGQLVRLNKGEDMSDIIADH  266
            V SEQLVAQLIPATIIGNFFAILCTALLNR GEK PSGQGQLV++      EDMSD + D+
Sbjct: 204  VGSEQLVAQLIPATIIGNFFAILCTALLNRFGEKHPSYSGQGQLVKIGHSEDMSDALKDN  263

Query: 267  SGPIDVKKMGGGVLTACSLFIFGHLLQQLTGFPGPVLMIVAAAILKYINVIPRETQNGAK  326
            SG +DVK MG GVLTACSLFI G LLQ LT FPGPVLMI+ AA LKY+NVIP ETQNGAK
Sbjct: 264  SGALDVKLMGAGVLTACSLFIAGGLLQHLTDFPGPVLMIILAAFLKYLNVIPQETQNGAK  323

Query: 327  QLYKFISGNFTFPPLMAGLGLLYIPLKDVVATLSIQYFIVVISVVFTVISVGFFVSRFLNM  386
            QLYKFIS NFTFPPLMAGLGLLYIPLK+VVATLS QYFIVVISVV TV+SVGFFVSRFLNM
Sbjct: 324  QLYKFISSNFTFPPLMAGLGLLYIPLKEVVATLSWQYFIVVISVVLTVVSVGFFVSRFLNM  383

Query: 387  NPVEAGIISACQSGMGGTGDVAILSTADRMNLMPFAQVATRLGGAITVITMTAILRMLF  445
            +PVEA IISACQSGMGGTGDVAILSTADRMNLMPFAQVATRLGGAITVITMTAILR++F
Sbjct: 384  SPVEAAIISACQSGMGGTGDVAILSTADRMNLMPFAQVATRLGGAITVITMTAILRIIF  442
```

Based on this analysis, it was predicted that these proteins and their epitopes could be useful antigens for vaccines or diagnostics.

Example 2248

A DNA sequence (GBSx2369) was identified in *S. agalactiae* <SEQ ID 6953> which encodes the amino acid sequence <SEQ ID 6954>. This protein is predicted to be malic enzyme (mae). Analysis of this protein sequence reveals the following:

---

Possible site: 48
>>> Seems to have no N-terminal signal sequence
INTEGRAL    Likelihood = −2.28    Transmembrane 164-180 (164-181)
----- Final Results -----
  bacterial membrane --- Certainty = 0.1914 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the GENPEPT database.

A related DNA sequence was identified in *S. pyogenes* <SEQ ID 6955> which encodes the amino acid sequence <SEQ ID 6956>. Analysis of this protein sequence reveals the following:

---

Possible site: 48
>>> Seems to have no N-terminal signal sequence
INTEGRAL    Likelihood = −2.44    Transmembrane 164-180 (164-181)
INTEGRAL    Likelihood = −1.75    Transmembrane 94-110 (94-110)
----- Final Results -----
  bacterial membrane --- Certainty = 0.1977 (Affirmative) <succ>
    bacterial outside --- Certainty = 0.0000 (Not Clear) <succ>
      bacterial cytoplasm --- Certainty = 0.0000 (Not Clear) <succ>

---

The protein has homology with the following sequences in the databases:

```
>GP:AAB07709 GB:U35659 malic enzyme [Streptococcus Bovis]

Identities = 285/386 (73%), Positives = 332/386 (85%), Gaps = 1/386 (0%)

Query:   2  SENLGQLAINQARENGGKLEVISKVKVEDKRDLSIAYTPGVASVSSAIAEDVELAYELTT   61
            ++++ +LAI QA++ GGKLEV  KV +E K DL IAYTPGVA+VSSAI E  E AYELTT
Sbjct:   3  TKDVKELAIEQAKKFGGKLEVCPKVPIETKADLGIAYTPGVAAVSSAIYEKKERAYELTT   62

Query:  62  KKNTVAVVSDGSAVIGLGDIGPEAAMPVMEGKAALFKRFANVDAVPIVLKTNDTEEIISI  121
            KKNTVAV+SDGSAVLGLG+IGPEAAMPVMEGKAALFKRFA VD++P+VL T DTEEII
Sbjct:  63  KKNTVAVISDGSAVLGLGNIGPEAAMPVMEGKAALFKRFAGVDSIPLVLDTQDTEEIIQT  122

Query: 122  VKAISPTFGGINLEDISAPRCFEIEQRLIEECDIPVFHDDQHGTAIVVLAALENSLKLVK  181
            VK ++PTFGGINLEDISAPRCFEIEQRLI+E DIPVFHDDQHGTAIVVLAAL+NSLKL+
Sbjct: 123  VKFLAPTFGGINLEDISAPRCFEIEQRLIDELDIPVFHDDQHGTAIVVLAALYNSLKLIN  182

Query: 182  KDIEDIRVVNGGGSAGLSITRKLLSAGAKHVTVVDRFGIINDKDRESLAPHHKAIAELT  241
            K IEDI VV+NGGGSAGLSITRK L+AG KH+ +VDR GI+++ D  +L PHH  IAKLT
Sbjct: 183  KKIEDIHVVINGGGSAGLSITRKFLAAGkCHIIIVDRTGILSETD-TALPPHHAEIAELT  241

Query: 242  NREFQSGSLEDALENADVFIGVSAPEALHAEWISKMADKPIVFAMANPIPEIYPDQALKA  301
            NRE ++G L  ALE ADVF+GVSAP  L  EWI +M ++P++FAMANP+PEI+PD+AL A
Sbjct: 242  NREHRTGDLATALEGADVFVGVSAPGVLKPEWIQQMNEQPVIFAMANPVPEIFPDEALAA  301

Query: 302  GAYIVGTGRSDFPNQINNVLAFPGIFRGALDARAKTITVEMQIAAARGIASLIPEEELST  361
            GAYIVGTGRSDFPNQINNVLAFPGIFRGALDARAK IT+EMQIAAA+GIA LIP+ EL+
Sbjct: 302  GAYIVGTGRSDFPNQINNVLAFPGIFRGALDARAKKITIEMQIAAAKGIAKLIPDNELTP  361

Query: 362  THIIPNAFQNDVADVVAKSVSNAVQK                                   387
            T+IIP+ FQ  VA VVA+SV NAV++
Sbjct: 362  TNIIPDPFQEGVAKVVAESVRNAVKE                                   387
```

```
>GP:AAB07709 GB:1735659 malic enzyme [Streptococcus bovis]
Identities = 289/379 (76%), Positives = 334/379 (87%), Gaps = 1/379 (0%)
Query:   7 QLALEQAKTFGGKLEVQPKVDIKTKHDLSIAYTPGVASVSSAIAKDKTLAYDLTTKKNTV    66
           +LA+EQAK FGGKLEV PKV I+TK DL IAYTPGVA+VSSAI + K  AY+LTTKKNTV
Sbjct:   8 ELAIEQAKKFGGKLEVCPKVPIETKADLGIAYTPGVAAVSSAIYEKKERAYELTIKKNIV    67

Query:  67 AVISDGTAVLGLGDIGPEAAMPVMEGKAALFKAFAGVDAIPIVLDTKDTEEIISIVKALA   126
           AVISDG+AVLGLG+IGPEAAMPVMEGKAALFK FAGVD+IP+VLDT+DTEEII  VK LA
Sbjct:  68 AVISDGSAVLGLGNIGPEAAMPVMEGKAALFKRFAGVDSIPLVLDTQDTEEIIQTVKFLA   127

Query: 127 PTFGGINLEDISAPRCFEIEQRLIKECHIPVFHDDQHGTAIVVLAAIFNSLKLLKKSLDE   186
           PTFGGINLEDISAPRCFEIEQRLI E   IPVFHDDQHGTAIVVLAA++NSLKL+K +++
Sbjct: 128 PTFGGINLEDISAPRCFEIEQRLIDELDIPVFHDDQHGTAIVVLAALYNSLKLINKKIED   187

Query: 187 VSIVVNGGGSAGLSITRKLLAAGATKVTVVDKFGIINEQEAAQLAPHHLDIAKVTNREFK   246
           + +V+NGGGSAGLSITRK LAAG    + +VD+ GI++E + A L PHH +IAK+TNRE +
Sbjct: 188 IHVVINGGGSAGLSITRKFLAAGVKHIIIVDRIGILSETDTA-LPPHHAEIAKLINREHR   246

Query: 247 SGTLEDALEGADIFIGVSAPGVLKAEWISKMAARPVIFAMANPIPEIYPDEALEAGAYIV   306
           +G L  ALEGAD+F+GVSAPGVLK EWI +M  +PVIFAMANP+PEI+PDEAL AGAYIV
Sbjct: 247 TGDLATALEGADVFVGVSAPGVLKPEWIQQMNEQPVIFAMANPVPEIFPDEALAAGAYIV   306

Query: 307 GIGRSDFPNQINNVLAFPGIFRGALDARAKTITVEMQIAAAKGIASLVPDDALSTTNIIP   366
           G GRSDFPNQINNVLAFPGIFRGALDARAK IT+EMQIAAAKGIA L+PD+ L+ TNIIP
Sbjct: 307 GTGRSDFPNQINNVLAFPGIFRGALDARAKKITIEMQIAAAKGIAKLIPDNELTPTNIIP   366

Query: 367 DAFKEGVAEIVAKSVRSW                                            385
           D F+EGVA++VA+SVR+V
Sbjct: 367 DPFQEGVAKVVAESVRNAV                                           385
```

An alignment of the GAS and GBS proteins is shown below.

```
Identities = 306/387 (79%), Positives = 349/387 (90%)
Query:   1 MSENLGQLAINQARENGGKLEVISKVKVEDKRDLSIAYTPGVASVSSAIAEDVELAYELT    60
           M   LGQLA+ QA+  GGKLEV  KV ++ K DLSIAYTPGVASVSSAIA+D  LAY+LT
Sbjct:   1 MKNQLGQLALEQAKTFGGKLEVQPKVDIKTKHDLSIAYTPGVASVSSAIAKDKTLAYDLT    60

Query:  61 TKKNTVAVVSDGSAVLGLGDIGPEAAMPVMEGKAALFKRFANVDAVPIVLKTNDTEEIIS   120
           TKKNTVAV+SDG+AVLGLGDIGPEAAMPVMEGKAALFK  FA VDA+PIVL T DTEEIIS
Sbjct:  61 TKKNTVAVISDGTAVLGLGDIGPEAAMPVMEGKAALFKAFAGVDAIPIVLDTKDTEEIIS   120

Query: 121 IVKAISPTFGGINLEDISAPRCFEIEQRLIEECDIPVFHDDQHGTAIVVLAALFNSLKLV   180
           IVKA++PTFGGINLEDISAPRCFEIEQRLI+EC IPVFHDDQHGTAIVVLAA+FNSLKL+
Sbjct: 121 IVKALAPTFGGINLEDISAPRCFEIEQRLIKECHIPVFHDDQHGTAIVVLAAIFNSLKLL   180

Query: 181 KKDIEDIRVVVNGGGSAGLSITRKLLSAGAKHVTVVDRFGIINDKDRESLAPHHKAIAKL   240
           KK ++++ +VVNGGGSAGLSITRKLL+AGA  VTVVD+FGIIN+++  LAPHH  IAK+
Sbjct: 181 KKSLDEVSIVVNGGGSAGLSITRKLLAAGATKVTVVDKFGIINEQEAAQLAPHHLDIAKV   240

Query: 241 TNREFQSGSLEDALENADVFIGVSAPEALHAEWISKMADKPIVFAMANPIPEIYPDQALK   300
           TNREF+SG+LEDALE AD+FIGVSAP  L AEWISKMA +P++FAMANPIPEIYPD+AL+
Sbjct: 241 TNREFKSGTLEDALEGADIFIGVSAPGVLKAEWISKMAARPVIFAMANPIPEIYPDEALE   300

Query: 301 AGAYIVGTGRSDFPNQINNVLAFPGIFRGALDARAKTITVEMQIAAARGIASLIPEEELS   360
           AGAYIVGTGRSDFPNQINNVLAFPGIFRGALDARAKTITVEMQIAAA+GIASL+P++ LS
Sbjct: 301 AGAYIVGTGRSDFPNQINNVLAFPGIFRGALDARAKTITVEMQIAAAKGIASLVPDDALS   360

Query: 361 TTHIIPNAFQNDVADVVAKSVSNAVQK                                   387
           TT+IIP+AF+   VA++VAKSV + V K
Sbjct: 361 TTNIIPDAFKEGVAEIVAKSVRSVVLK                                   387
```

Based on this analysis, it was predicted that these proteins and their epitopes could be useful antigens for vaccines or diagnostics.

Example 2249

A DNA sequence (GBSx2370) was identified in *S. agalactiae* <SEQ ID 6957> which encodes the amino acid sequence <SEQ ID 6958>. This protein is predicted to be Bta. Analysis of this protein sequence reveals the following:

Possible site: 19
>>> Seems to have no N-terminal signal sequence
INTEGRAL    Likelihood = −2.02    Transmembrane 29-45 (29-45)
----- Final Results -----
   bacterial membrane --- Certainty = 0.1808 (Affirmative) <succ>
   bacterial outside --- Certainty = 0.0000 (Not Clear) <succ>
   bacterial cytoplasm --- Certainty = 0.0000 (Not Clear) <succ>

The protein has homology with the following sequences in the GENPEPT database.

```
>GP:AAD56628 GB:AF165218 Bta [Streptococcus pneumoniae]
Identities = 35/112 (31%), Positives = 63/112 (56%)
Query:   1 MYSFEELLATMTLITAAEIEDKIDSNQDFVLFIGRISCPFCHLFVPKIVEVADEDEFELF  60
           M  F + +   + + T     ++ +D  +    FIGR +CP+C   F  +    V  E +  ++
Sbjct:   1 MEQFLDNIKDLEVTTVVRAQEALDKKETATFFIGRKTCPYCRKFAGTLSGVVAETKAHIY  60

Query:  61 HLDSEDFDHWTANKEFRNKYDIPTVPGLMVVKNGTIKVKCDSKMTKEEIREF         112
           ++SE+        + FR++Y IPTVPG + +  +G I  V+CDS M+  +EI++F
Sbjct:  61 FINSEEASQLNDLQAFRSRYGIPTVPGFVHITDGQINVRCDSSMSAQEIKDF         112
```

A related DNA sequence was identified in *S. pyogenes* <SEQ ID 6959> which encodes the amino acid sequence <SEQ ID 6960>. Analysis of this protein sequence reveals the following:

---

Possible site: 25
>>> Seems to have no N-terminal signal sequence
----- Final Results -----
   bacterial cytoplasm --- Certainty = 0.0900 (Affirmative) <succ>
    bacterial membrane --- Certainty = 0.0000 (Not Clear) <succ>
     bacterial outside --- Certainty = 0.0000 (Not Clear) <succ>

---

An alignment of the GAS and GBS proteins is shown below.

```
Identities = 39/111 (350), Positives = (59%)66/111
Query:   3 SFEELLATMTLITAAEIEDKIDSNQDFVLFIGRISCPFCHLFVPKIVEVADEDEFELFHL  62
           +FEE++A    + AE+   I S +D ++F+GR SCP+C   F  PK+ +VA +++ E++ +
Sbjct:  11 TFEEIVANFIPSSVAEVTSAIASGKDMIVFLGRSSCPYCRRFAPKLAQVATDNQKEVYFV  70

Query:  63 DSEDFDHWTANKEFRNKYDIPTVPGLMVVKNGTIKVKCDSKMTKEEIREFI         113
           DSE+           FR   Y + TVP L+V  +     +  CDS +T  ++I   F+
Sbjct:  71 DSENAADAAELAAFRENYQLVTVPALLVSYDQHQRAVCDSSLTPDDILAFL         121
```

SEQ ID 6958 (GBS427) was expressed in *E. coli* as a His-fusion product. SDS-PAGE analysis of total cell extract is shown in FIG. 80 (lane 5; MW 16.2 kDa).

GBS427-His was purified as shown in FIG. 214, lane 8.

Based on this analysis, it was predicted that this protein and its epitopes, could be useful antigens for vaccines or diagnostics.

Example 2250

A DNA sequence (GBSx2371) was identified in *S. agalactiae* <SEQ ID 6961> which encodes the amino acid sequence <SEQ ID 6962>. Analysis of this protein sequence reveals the following:

---

Possible site: 26
>>> Seems to have an uncleavable N-term signal seq
INTEGRAL    Likelihood = −7.75    Transmembrane 2-18 (1-21)
----- Final Results -----
   bacterial membrane --- Certainty = 0.4100 (Affirmative) <succ>
   bacterial outside --- Certainty = 0.0000 (Not Clear) <succ>
   bacterial cytoplasm --- Certainty = 0.0000 (Not Clear) <succ>

---

A related GBS nucleic acid sequence <SEQ ID 9437> which encodes amino acid sequence <SEQ ID 9438> was also identified.

The protein has homology with the following sequences in the GENPEPT database.

```
>GP:BAA11328 GB:D78257 ORF11 [Enterococcus faecalis]
Identities = 36/80 (45%), Positives = 58/80
Query:   1 MSLPIIMLVVMVGMMFFMQRQQKKQAQERQKQLNAVQKGDEIVTIGGLFGVVDEVNTEAQ  60
           M L +IML+V+V M F++R  QKKQ +ERQ  LN +Q GD +VTIGGL GV+ E++++ +
Sbjct:   1 MKLMLIMLLVIVAMYFYLFRTQKKQQKERQDFLNNLQPGDAVVTIGGLHGVISEISSDKK  60

Query:  61 RMVLDVDGVYLTFELAAIKS                                         80
           ++ LD +G +  F+   +I++
Sbjct:  61 KVTLDCEGAFFDFDQQSIRT                                         80
```

A related DNA sequence was identified in *S. pyogenes* <SEQ ID 6963> which encodes the amino acid sequence <SEQ ID 6964>. Analysis of this protein sequence reveals the following:

---

Possible site: 60
>>> Seems to have an uncleavable N-term signal seq
INTEGRAL    Likelihood = −6.10    Transmembrane 3-19 (1-22)
INTEGRAL    Likelihood = −3.03    Transmembrane 63-79 (63-79)
----- Final Results -----
   bacterial membrane --- Certainty = 0.3442 (Affirmative) <succ>
    bacterial outside --- Certainty = 0.0000 (Not Clear) <succ>
    bacterial cytoplasm --- Certainty = 0.0000 (Not Clear) <succ>

---

The protein has homology with the following sequences in the databases:

```
>GP:BAA11328 GB:D78257 ORF11 [Enterococcus faecalis]
Identities = 29/75 (38%), Positives = 52/75 (68%)
Query:   6 ILMFVVMLGLIWFMQRQQKKQAQERQNQLNAIEKGDEVVTIGGMFAIVDEVDTTAKKIVL    65
           ++M +V++ + +++ R QKKQ +ERQ+ LN ++ GD VVTIGG+ ++ E+ + KK+ L
Sbjct:   5 LIMLLVIVAMYFYLFRTQKKQQKERQDFLNNLQPGDAVVTIGGLHGVISEISSDKKKVTL   64

Query:  66 DVDGVFLTFELLAIK                                                80
           D +G F F+    +I+
Sbjct:  65 DCEGAFFDFDQQSIR                                                79
```

An alignment of the GAS and GBS proteins is shown below.

```
Identities = 63/90 (70%), Positives = 80/90 (88%)
Query:   4 PIIMLVVMVGMMFFMQRQQKKQAQERQKQLNAVQKGDEIVTIGGLFGVVDEVNTEAQRMV   63
           PI+M VVM+G+++FMQRQQKKQAQERQ QLNA++KGDE+VTIGG+F +VDEV+T A+++V
Sbjct:   5 PILMFVVMLGLIWFMQRQQKKQAQERQNQLNAIEKGDEVVTIGGMFAIVDEVDTTAKKIV   64

Query:  64 LDVDGVYLTFELAAIKSVVSKAATPTEPVE                                 93
           LDVDGV+LTFEL AIK +V+KA T T   VE
Sbjct:  65 LDVDGVFLTFELLAIKRIVTKATTETTLVE                                 94
```

Based on this analysis, it was predicted that these proteins and their epitopes could be useful antigens for vaccines or diagnostics.

Example 2251

A DNA sequence (GBSx2372) was identified in *S. agalactiae* <SEQ ID 6965> which encodes the amino acid sequence <SEQ ID 6966>. Analysis of this protein sequence reveals the following:

Possible site: 21
>>> Seems to have an uncleavable N-term signal seq
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2252

A DNA sequence (GBSx2373) was identified in *S. agalactiae* <SEQ ID 6967> which encodes the amino acid sequence <SEQ ID 6968>. Analysis of this protein sequence reveals the following:

Possible site: 16
>>> Seems to have no N-terminal signal sequence
INTEGRAL    Likelihood = −1.38    Transmembrane 164-180 (164-180)
----- Final Results -----
   bacterial membrane --- Certainty = 0.1553 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the GENPEPT database.

```
>GP:CAB61731 GB:AL133220 putative oxidoreductase.[Streptomyces coelicolor A3(2)]
Identities = 72/216 (33%), Positives = 120/216 (55%), Gaps = 1/216 (0%)
Query:  14 AQALEARGQKLYSVANRTYDKGLEFATKYGIQKVYDHIDQVFEDPEVDIIYISTPHNTHI   73
           A ++      ++ +VA+RT       FA ++GI + Y    + +  D +VD++Y++TPH+ H
Sbjct:  25 ADLVDLPDAEVVAVASRTEASAKTFAERFGIPRAYGGWETLARDEDVDVVYVATPHSAHR   84

Query:  74 SFLRKALANGKHVLCEKSITLNSTELKEAIDLAETNHVVLAEAMTIFHMPIYRQLKTLVD  133
           +      L  G++VLCEK  TLN+ E  E + LA   N V L  EAM ++   P+ R+LK LV
Sbjct:  85 TAAGLCLEAGRNVLCEKPFTLNAREAAELVALARENGVFLMEAMWMYCNPLVRRLKELVA  144

Query: 134 SGKLGPLKMIQMNFGSYKEYDMTNRFFSRDLAGGALLDIGVYALSCIRWFMSEAPHNITS  193
           G +G ++ +Q +FG   +   +R         GGALLD+GVY +S +  + E P ++  +
Sbjct: 145 DGAIGEVRSLQADFGLAGPFPAAHRLRDPAQGGGALLDLGVYPVSFAQLLLGE-PTDVAA  203

Query: 194 QVTFAPTGVDEQVGILLTNPANEMATVSLSLHAKQP                           229
           +   + GVD Q G LL+     + +A++  S+    P
Sbjct: 204 RAVLSEEGVDLQTGALLSYGNDALASIHCSITGGTP                           239
```

Based on this analysis, it was predicted that this protein and its epitopes, could be useful antigens for vaccines or diagnostics.

Example 2253

A DNA sequence (GBSx2374) was identified in *S. agalactiae* <SEQ ID 6969> which encodes the amino acid sequence <SEQ ID 6970>. This protein is predicted to be surface protein Rib. Analysis of this protein sequence reveals the following:

Possible site: 45
>>> Seems to have no N-terminal signal sequence
----- Final Results -----
  bacterial cytoplasm --- Certainty = 0.4957 (Affirmative) <succ>
    bacterial membrane --- Certainty = 0.0000 (Not Clear) <succ>
      bacterial outside --- Certainty = 0.0000 (Not Clear) <succ>

No corresponding DNA sequence was identified in *S. pyogenes*.

Based on this analysis, it was predicted that this protein and its epitopes, could be useful antigens for vaccines or diagnostics.

Example 2254

A DNA sequence (GBSx2375) was identified in *S. agalactiae* <SEQ ID 6971> which encodes the amino acid sequence <SEQ ID 6972>. This protein is predicted to be surface protein Rib. Analysis of this protein sequence reveals the following:

Possible site: 24
>>> Seems to have no N-terminal signal sequence
----- Final Results -----
  bacterial cytoplasm --- Certainty = 0.1892 (Affirmative) <succ>
    bacterial membrane --- Certainty = 0.0000 (Not Clear) <succ>
      bacterial outside --- Certainty = 0.0000 (Not Clear) <succ>

No corresponding DNA sequence was identified in *S. pyogenes*.

Based on this analysis, it was predicted that this protein and its epitopes, could be useful antigens for vaccines or diagnostics.

Example 2255

A DNA sequence (GBSx2376) was identified in *S. agalactiae* <SEQ ID 6973> which encodes the amino acid sequence <SEQ ID 6974>. This protein is predicted to be a host cell surface-exposed lipoprotein. Analysis of this protein sequence reveals the following:

Possible site: 38
>>> Seems to have an uncleavable N-term signal seq
INTEGRAL    Likelihood = −7.75    Transmembrane 9-25 (5-28)
----- Final Results -----
  bacterial membrane --- Certainty = 0.4100 (Affirmative) <succ>
    bacterial outside --- Certainty = 0.0000 (Not Clear) <succ>
      bacterial cytoplasm --- Certainty = 0.0000 (Not Clear) <succ>

A related GBS nucleic acid sequence <SEQ ID 9005> which encodes amino acid sequence <SEQ ID 9006> was also identified. Analysis of this protein sequence reveals the following:

Lipop: Possible site: −1 Crend: 3
SRCFLG: 0
McG: Length of UR: 24
Peak Value of UR: 2.84
Net Charge of CR: 2
McG: Discrim Score: 10.29
GvH: Signal Score (−7.5): −4.34
Possible site: 34
>>> Seems to have an uncleavable N-term signal seq
Amino Acid Composition: calculated from 1
ALOM program count: 1 value: −7.75 threshold: 0.0
INTEGRAL    Likelihood = −7.75    Transmembrane 5-21 (1-24)
PERIPHERAL    Likelihood = 13.31    86
modified ALOM score: 2.05
icml HYPID: 7 CFP: 0.410
*** Reasoning Step: 3
----- Final Results -----
  bacterial membrane --- Certainty = 0.4100 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the GENPEPT database.

```
>GP:AAC03455 GB:AF020798 putative host cell surface-exposed
lipoprotein [Streptococcus thermophilus bacteriophage TP-J34]
Identities = 40/102 (390), Positives = 63/102 (61%), Gaps = 10/102 (9%)
Query: 101  KNALISAKIYSKTMNLSKQSIFEQLYSESPDKATHSDKFTKEESQYAIDHLKVDEKENAL  160
            + A+  AK Y+ T+++SK+ +  QL S          DK++++ S YA+++  +D+ + AL
Sbjct:  51  RTAVSKAKQYASTVHMSKEELRSQLVS--------FDKYSQDASDYAVENSGIDYNKQAL  102

Query: 161  ETAKSYQSSSSLSKEEIYKQLTSTLGDKFTNDEAQYAVDHLK                    202
            E AK YQ + S+S + I  QL S   DKFT +EA YAV +LK
Sbjct: 103  EKAKQYQDTLSMSPDAIRDQLVSF--DKFTQEEADYAVANLK                    142

Identities = 40/112 (35%), Positives = 64/112 (56%), Gaps = 9/112 (8%)
Query:  41  KKAKIKFNKTQKKIVKKAREYAKSGHMSKDSIIEKLKKDSKKYRQEDINFVINNLKVDYK  100
            + ++ K   K  + V KA++YA + HMSK+ + +L    K Y Q+ ++ + N  +DY
Sbjct:  40  QSSESKVPKEYRTAVSKAKQYASTVHMSKEELRSQLVSFDK-YSQDASDYAVENSGIDYN   98

Query: 101  KNALISAKIYSKTMNLSKQSIFEQLYSESPDKATHSDKFTKEESQYAIDHLK          152
            K AL  AK Y  T+++S  +I +QL S        DKFT+EE+ YA+ +LK
Sbjct:  99  KQALEKAKQYQDTLSMSPDAIRDQLVS--------FDKFTQEEADYAVANLK          142
```

No corresponding DNA sequence was identified in *S. pyogenes*.

SEQ ID 9006 (GBS122) was expressed in *E. coli* as a His-fusion product. SDS-PAGE analysis of total cell extract is shown in FIG. 38 (lane 6; MW 21.9 kDa).

GBS122-His was purified as shown in FIG. 202, lane 8.

Based on this analysis, it was predicted that this protein and its epitopes, could be useful antigens for vaccines or diagnostics.

Example 2256

A DNA sequence (GBSx2377) was identified in *S. agalactiae* <SEQ ID 6975> which encodes the amino acid sequence <SEQ ID 6976>. This protein is predicted to be transposase (orfA). Analysis of this protein sequence reveals the following:

Possible site: 42
>>> Seems to have no N-terminal signal sequence
----- Final Results -----
    bacterial cytoplasm --- Certainty = 0.2830 (Affirmative) <succ>
       bacterial membrane --- Certainty = 0.0000 (Not Clear) <succ>
         bacterial outside --- Certainty = 0.0000 (Not Clear) <succ>

The protein has homology with the following sequences in the GENPEPT database.

```
>GP:CAB90833 GB:A.1250837 hypothetical protein [Streptococcus dysgalactiae]
Identities = 91/96 (94%), Positives = 93/96 (96%)
Query:   1 MSRKVRRHETDDFKQQIVDLYNVGRKRSSLIKVYELTPSTEDKWVRQAKTTGSFKSIDNL   60
           MSRK+RRHFTDDFKQQIVDLYN GRKRSSLIK YELTPSTFDKWVRQAKTTGSFKS+DNL
Sbjct:   1 MSRKIRRHFTDDFKQQIVDLYNAGRKRSSLIKEYELTPSTFDKWVRQAKTTGSFKSVDNL   60

Query:  61 TDEQRELIELRKHNKELEMQLDILKQAAVIMAQKGK                           96
           TDEQRELIELRK NKELEMQLDILKQAAVIMAQKGK
Sbjct:  61 TDEQRELIELRKRNKELEMQLDILKQAAVIMAQKGK                           96
```

Based on this analysis, it was predicted that this protein and its epitopes, could be useful antigens for vaccines or diagnostics.

Example 2257

A DNA sequence (GBSx2378) was identified in *S. agalactiae* <SEQ ID 6977> which encodes the amino acid sequence <SEQ ID 6978>. This protein is predicted to be transposase (orfB). Analysis of this protein sequence reveals the following:

Possible site: 16
>>> Seems to have no N-terminal signal sequence
----- Final Results -----
    bacterial cytoplasm --- Certainty = 0.2618 (Affirmative) <succ>
       bacterial membrane --- Certainty = 0.0000 (Not Clear) <succ>
         bacterial outside --- Certainty = 0.0000 (Not Clear) <succ>

A related GBS nucleic acid sequence <SEQ ID 9915> which encodes amino acid sequence <SEQ ID 9916> was also identified.

A related GBS nucleic acid sequence <SEQ ID 9903> which encodes amino acid sequence <SEQ ID 9904> was also identified.

The protein has homology with the following sequences in the GENPEPT database.

```
>GP:CAB90834 GB:AJ250837 putative transposase [Streptococcus dysgalactiae]
Identities = 243/259 (93%), Positives = 250/259 (95%)
Query:   1 MCRWLNMPHSSYYYQAVESVSETEFEETIKRIFLDSESRYGSRKIKICLNNEGITLSRRR    60
           MCRWLN+P SSYYY+AVE VSE E EE+IK IPL+S++RYGSRKIKICLNNEGITLSRRR
Sbjct:   1 MCRWLNIPRSSYYYKAVEPVSEAELEESIKAIFLESKARYGSRKIKICLNNEGITLSRRR    60

Query:  61 IRRIMKRLNLVSVYQKATFKPHSRGKNEAPIPNHLDRQFKQERPLQALVTDLTYVRVGNR   120
           IRRIMKRLNLVSVYQKATFKPHSRGKNEAPIPNHLDRQFK ERPLQALVTDLTYVRVGNR
Sbjct:  61 IRRIMKRLNLVSVYQKATFKPHSRGKNEAPIPNHLDRQFKPERPLQALVTDLTYVRVGNR   120

Query: 121 WAYVCLIIDLYNREIIGLSLGWHKTAELVKQAIQSIPYALTKVKMFHSDRGKEFDNQLID   180
           WAYVCLIIDLYNREIIGLSLGWHKTAELVKQAIQSIPY LTKVKMFHSDRGKEF+NQLID
Sbjct: 121 WAYVCLIIDLYNREIIGLSLGWHKTAELVKQAIQSIPYPLTKVKMFHSDRGKEFNNQLID   180

Query: 181 EILEAFGITRSLSQAGCPYDNAVAESTYRAFKIEFVYQETFQLLEELALKTKDYVHWWNY   240
           EILEAFGITRSLSQAGCPYDNAVAESTYRAFKIEFVYQETFQ LEELALKTK YVHWWNY
Sbjct: 181 EILEAFGITRSLSQAGCPYDNAVAESTYRAFKIEFVYQETFQSLEELALKTKAYVHWWNY   240

Query: 241 HRIHGSLNYQTPMTKRLIA                                           259
           HRIHGSLNYQTPMTKRLIA
Sbjct: 241 HRIHGSLNYQTPMTKRLIA                                           259
```

There is also homology to SEQ ID 32.

Based on this analysis, it was predicted that this protein and its epitopes, could be useful antigens for vaccines or diagnostics.

Example 2258

A DNA sequence (GBSx2379) was identified in *S. agalactiae* <SEQ ID 6979> which encodes the amino acid sequence <SEQ ID 6980>. This protein is predicted to be pXO1-128. Analysis of this protein sequence reveals the following:

```
Possible site: 20
>>> Seems to have no N-terminal signal sequence
----- Final Results -----
   bacterial cytoplasm --- Certainty = 0.3684 (Affirmative) <succ>
   bacterial membrane --- Certainty = 0.0000 (Not Clear) <succ>
      bacterial outside --- Certainty = 0.0000 (Not Clear) <succ>
```

The protein has homology with the following sequences in the GENPEPT database.

```
>GP:AAD32432 GB:AF065404 pXO1-128 [Bacillus anthracis]
Identities = 45/69 (65%), Positives = 52/69 (75%)
Query:  17   MKKAGKSNRVIMETLGIKNNSQIYTWMKWYENEELYRFHQGVGKQYTYGKGLEHLSEVEQ    76
             MKK   SNR IME LGIKN SQI TWMKWY  ++ YRF Q VGKQY+YGKG + LSE+EQ
Sbjct:   1   MKKESYSNRTIMEKLGIKNVSQIKTWMKWYRTDQTYRFQQPVGKQYSYGKGPKELSELEQ    60

Query:  77   LQLQVDLLK    85
             L+L+   LK
Sbjct:  61   LRLENKHLK    69
```

No corresponding DNA sequence was identified in *S. pyogenes*.

Based on this analysis, it was predicted that this protein and its epitopes, could be useful antigens for vaccines or diagnostics.

Example 2259

A DNA sequence (GBSx2380) was identified in *S. agalactiae* <SEQ ID 6981> which encodes the amino acid sequence <SEQ ID 6982>. This protein is predicted to be transposase. Analysis of this protein sequence reveals the following:

```
Possible site: 25
>>> Seems to have an uncleavable N-term signal seq
----- Final Results -----
   bacterial membrane --- Certainty = 0.0000 (Not Clear) <succ>
    bacterial outside --- Certainty = 0.0000 (Not Clear) <succ>
   bacterial cytoplasm --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2260

A DNA sequence (GBSx2382) was identified in *S. agalactiae* <SEQ ID 6985> which encodes the amino acid sequence <SEQ ID 6986>. This protein is predicted to be Lmb. Analysis of this protein sequence reveals the following:

```
Possible site: 18
>>> May be a lipoprotein
----- Final Results -----
   bacterial membrane --- Certainty = 0.0000 (Not Clear) <succ>
    bacterial outside --- Certainty = 0.0000 (Not Clear) <succ>
   bacterial cytoplasm --- Certainty = 0.0000 (Not Clear) <succ>
```

A related DNA sequence was identified in *S. pyogenes* <SEQ ID 1595> which encodes the amino acid sequence <SEQ ID 1596>. Analysis of this protein sequence reveals the following:

```
Possible site: 18
>>> May be a lipoprotein
----- Final Results -----
   bacterial membrane --- Certainty = 0.0000 (Not Clear) <succ>
    bacterial outside --- Certainty = 0.0000 (Not Clear) <succ>
   bacterial cytoplasm --- Certainty = 0.0000 (Not Clear) <succ>
```

An alignment of the GAS and GBS proteins is shown below.

```
Identities = 302/306 (98%), Positives = 303/306 (98%)
Query:   1   MKKVFELMAMVVSLVMIAGCDKSANPKQPTQGMSVVTSFYPMYAMTKEVSGDLNDVRMIQ    60
             MKK FELMAMVVSLVMIAGCDKSANPKQPTQGMSVVTSFYPMYAMTKEVSGDLNDVRMIQ
Sbjct:   1   MKKGFELMAMVVSLVMIAGCDESANPKQPTQGMSVVTSFYPMYAMTKEVSGDLNDVRMIQ    60

Query:  61   SGAGIHSFEPSVNDVAAIYDADLFVYHSHTLEAWARDLDPNLKKSKVNVFEASKPLTLDR   120
             SGAGIHSFEPSVNDVAAIYDADLFVYHSHTLEAWARDLDPNLKKSKV+VFEASKPLTLDR
Sbjct:  61   SGAGIHSFEPSVNDVAA1YDADLFVYHSHTLEAWARDLDPNLKKSKVDVFEASKPLTLDR   120

Query: 121   VKGLEDMEVTQGIDPATLYDPHTWTDPVLAGEEAVNIAKELGHLDPKHKDSYTKKAKAFK   180
             VKGLEDMEVTQGIDPATLYDPHTWTDPVLAGEEAVNIAKELG LDPKHKDSYTK AKAFK
Sbjct: 121   VKGLEDMEVTQGIDPATLYDPHTWTDPVLAGEEAVNIAKELGRLDPKHKDSYTKNAKAFK   180

Query: 181   KEAEQLTEEYTQKFKKVRSKTFVTQHTAFSYLAKRFGLKQLGISGISPEQEPSPRQLKEI   240
             KEAEQLTEEYTQKFKKVRSKTFVTQHTAFSYLAKRFGLKQLGISGISPEQEPSPRQLKEI
Sbjct: 181   KEAEQLTEEYTQKFKKVRSKTFVTQHTAFSYLAKRFGLKQLGISGISPEQEPSPRQLKEI   240

Query: 241   QDFVKEYNVKTIFAEDNVNPKIAHAIAKSTGAKVKTLSPLEAAPSGNKTYLENLRANLEV   300
```

```
                 QDFVKEYNVKTIFAEDNVNPKIAHAIAKSTGAKVKTLSPLEAAPSGNKTYLENLRANLEV
Sbjct:  241      QDFVKEYNVKTIFAEDNVNPKIAHAIAKSTGAKVKTLSPLEAAPSGNKTYLENLRANLEV        300

Query:  301      LYQQLK                                                              306
                 LYQQLK
Sbjct:  301      LYQQLK                                                              306
```

There is also homology to SEQ ID 4.

SEQ ID 6986 (GBS189) was expressed in *E. coli* as a His-fusion product. SDS-PAGE analysis of total cell extract is shown in FIG. 38 (lane 2; MW 35.2 kDa).

The GBS189-His fusion product was purified (FIG. 204, lane 7) and used to immunise mice. The resulting antiserum was used for Western blot (FIG. 248A), FACS (FIG. 248B), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

Example 2261

A DNA sequence (GBSx2383) was identified in *S. agalactiae* <SEQ ID 6987> which encodes the amino acid sequence <SEQ ID 6988>. Analysis of this protein sequence reveals the following:

Possible site: 46
>>> Seems to have no N-terminal signal sequence
----- Final Results -----
   bacterial cytoplasm --- Certainty = 0.4656 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

There is also homology to SEQ ID 982.

Based on this analysis, it was predicted that this protein and its epitopes, could be useful antigens for vaccines or diagnostics.

Example 2262

A DNA sequence (GBSx2384) was identified in *S. agalactiae* <SEQ ID 6989> which encodes the amino acid sequence <SEQ ID 6990>. This protein is predicted to be 30S ribosomal protein S11 (rpsK). Analysis of this protein sequence reveals the following:

Possible site: 37
>>> Seems to have no N-terminal signal sequence
----- Final Results -----
   bacterial cytoplasm --- Certainty = 0.0598 (Affirmative) <succ>
   bacterial membrane --- Certainty = 0.0000 (Not Clear) <succ>
   bacterial outside --- Certainty = 0.0000 (Not Clear) <succ>

A related GBS nucleic acid sequence <SEQ ID 9281> which encodes amino acid sequence <SEQ ID 9282> was also identified. A further related GBS nucleic acid sequence <SEQ ID 10919> which encodes amino acid sequence <SEQ ID 10920> was also identified.

The protein has homology with the following sequences in the GENPEPT database.

```
>GP:AAB41455 GB:U34956 phosphoribosylformylglycinamidine synthase
[Mycobacterium tuberculosis]
Identities = 73/237 (30%), Positives = 112/237 (46%), Gaps = 25/237 (10%)
Query:   43    GAGGVCVAIGELAD----GLEIDLDKVPLKYQGLNGTEIAISESQERMSVVVGPSDVDAF        98
               G  G+    ELA     G+ I LD VPL+ + +    E+   SESQERM VV  P +VDAF
Sbjct:  282    GGAGLSCATSELASAGDGGMTIQLDSVPLRAKEMTPAEVLCSESQERMCAVVSPKNVDAF        341

Query:   99    IAACNKENIDAVVVATVTEKPNLVMTWNGETIVDLERCELDTNG------VRVVVDANVV        152
               +A C K   + V+    VT+      L +TW+GET+VD+     +        G      +
Sbjct:  342    LAVCRKWEVLATVIGEVTDGDRLQITWHGETVVDVPPRTVAHEGPVYQRPVARPDTQDAL        401

Query:  153    DKDLTVPEARTTSAETLEADMLKVLSDLNHASQKGLQTIFDSSVGRSTV--NHPIGGRYQ        210
               + D +    +R  + + L A +L +L      + S+    +D V   +TV  H  GG   +
Sbjct:  402    NADRSAELSRPVTGDELRATLLALLGSPHLCSRAFITEQYDRYVRGNTVLAEHADGGMLR        461

Query:  211    ITPTESSVQKLPVQYGVTTTASVMAQGYNPYIAEWSPYHGAAYAVIEATARLVATGA        267
               I   ES+ + + V    +       +++             PY GA  A+ EA   + TGA
Sbjct:  462    I--DESTGRGIAVSTDASGRYTLL----------DPYAGAQLALAEAYRNVAVTGA        505
```

```
>GP:CAB11918 GB:Z99104 ribosomal protein S11 (BS11) [Bacillus subtilis]
Identities = 81/92 (88%), Positives = 87/92 (94%)
Query:    2    HGNALAWSSAGALGFKGSRKSTPFAAQMAAEAAAKSAQEHGLKTVEVTVKGPGSGRESAI        61
               HGNA++WSSAGALGF+GSRKSTPFAAQMAAE AAK + EHGLKT+EVTVKGPGSGRE+AI
Sbjct:   40    HGNAISWSSAGALGFRGSRKSTPFAAQMAAETAAKGSIEHGLKTLEVTVKGPGSGREAAI        99

Query:   62    RALAAAGLEVTAIRDVTPVPHNGARPPKRRRV        93
               RAL  AGLEVTAIRDVTPVPHNG RPPKRRRV
Sbjct:  100    RALQAAGLEVTAIRDVTPVPHNGCRPPKRRRV        131
```

A related DNA sequence was identified in *S. pyogenes* <SEQ ID 6991> which encodes the amino acid sequence <SEQ ID 6992>. Analysis of this protein sequence reveals the following:

```
Possible site: 47
>>> Seems to have no N-terminal signal sequence
----- Final Results -----
    bacterial cytoplasm --- Certainty = 0.0945 (Affirmative) <succ>
    bacterial membrane --- Certainty = 0.0000 (Not Clear) <succ>
    bacterial outside --- Certainty = 0.0000 (Not Clear) <succ>
```

An alignment of the GAS and GBS proteins is shown below.

```
Identities = 92/93 (98%), Positives = 93/93 (99%)
Query:  1   MHGNALAWSSAGALGFKGSRKSTPFAAQMAAEAAAKSAQEHGLKTVEVTVKGPGSGRESA   60
            +HGNALAWSSAGALGFKGSRKSTPFAAQMAAEAAAKSAQEHGLKTVEVTVKGPGSGRESA
Sbjct: 35   VHGNALAWSSAGALGFKGSRKSTPFAAQMAARAAAKSAQEHGLKTVEVTVKGPGSGRESA   94

Query: 61   IRALAAAGLEVTAIRDVTPVPHNGARPPKRRRV   93
            IRALAAAGLEVTAIRDVTPVPHNGARPPKRRRV
Sbjct: 95   IRALAAAGLEVTAIRDVTPVPHNGARPPKRRRV   127
```

Based on this analysis, it was predicted that these proteins and their epitopes could be useful antigens for vaccines or diagnostics.

Example 2263

A DNA sequence (GBSx2385) was identified in *S. agalactiae* <SEQ ID 6993> which encodes the amino acid sequence <SEQ ID 6994>. Analysis of this protein sequence reveals the following:

```
Possible site: 53
>>> Seems to have no N-terminal signal sequence
----- Final Results -----
    bacterial cytoplasm --- Certainty = 0.2551 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP:BAB03881 GB:AP001507 DNA-directed RNA polymerase alpha subunit
[Bacillus halodurans]

Identities = 190/314 (60%), Positives = 249/314 (78%), Gaps = 2/314 (0%)

Query:   1  MIEFEKPIITKIDENKD--YGRFVIEPLERGYGTTLGNSLRRVLLSSLPGAAVTSIKIDG    58
            MIE EKP+I   I+ ++D   YG+FV+EPLERGYGTTLGNSLRR+LLSSLPGAAVTS++IDG Sbjct:   1  MIEIEKPVIETIEISEDAKYGKFVVEPLERGYGTTLGNSLRRILLSSLPGAAVTSVQIDG    60

Query:  59  VLHEFDTIPGVREDVMQIILNVKGLAVKSYVEDEKIIELDVEGPAEITAGDILTDSDIEI   118
            VLHEF  TI GV EDV   I+LN+K LA+K Y +++K +E+D +G    +TAGD+  DSD+++

Sbjct:  61  VLHEFSTIEGVVEDVTTIVLNLKQLALKIYSDEDKTLEIDTQGEGVVTAGDLTHDSDVDV   120

Query: 119  VNPDHYLFTIAEGHSLKATMTVAKNRGYVPAEGNKKDDAPVGTLAVDSIYTPVKKVNYQV   178
            +NPD ++ T+   G   l=   +T    + RGYVPAEGNK D+    +G +   +DSIYTPV +VNYQV Sbjct: 121  LNPDLHIATLTTGAHLRMRITAKRGYVPAEGNKSDELAIGVIPIDSIYTPVSRVNYQV    180

Query: 179  EPARVGSNDGFDKLTIEIMTNGTIIPEDALGLSARVLIEHLNLFTDLTEVAKATEVMKET   238
            E  RVG     +DKLT+++  T+G+I PE+A+  L  A++L  EHLN+F    LT+  A+   E+M E Sbjct: 181  ENTRVGQVTNYDKLTLDVWTDGSIRPEEAVSLGAKILTEHLNIFVGLTDQAQNEAIMVEK   240

Query: 239  EKVNDEKVLDRTIEELDLSVRSYNCLKRAGINTVFDLTEKTEPEMMKVRNLGRKSLEEVK   298
            E+   EKVL+  TIEELDLSVRSYNCLKRAGINTV +LT+KTE +MMKVRNLGRKSLEEV+

Sbjct: 241  EEDQKEKVLEMTIEELDLSVRSYNCLKRAGINTVQELTQKTEEDMMKVRNLGRKSLEEVQ   300

Query: 299  IKLADLGLGLKNDK                                                312
            KL +LGLGL+ ++
Sbjct: 301  EKLGELGLGLRKEE                                                314
```

A related DNA sequence was identified in *S. pyogenes* <SEQ ID 6995> which encodes the amino acid sequence <SEQ ID 6996>. Analysis of this protein sequence reveals the following:

```
Possible site: 53
>>> Seems to have no N-terminal signal sequence
----- Final Results -----
   bacterial cytoplasm --- Certainty = 0.2551 (Affirmative) <succ>
   bacterial membrane --- Certainty = 0.0000 (Not Clear) <succ>
   bacterial outside --- Certainty = 0.0000 (Not Clear) <succ>
```

An alignment of the GAS and GBS proteins is shown below.

```
Identities = 305/312 (97%), Positives = 311/312 (98%)
Query: 1    MIEFEKPIITKIDENKDYGRFVIEPLERGYGTTLGNSLRRVLLSSLPGAAVTSIKIDGVL    60
            MIEFEKPIITKIDENKDYGRFVIEPLERGYGTTLGNSLRRVLLSSLPGAAVTSIKIDGVL
Sbjct: 1    MIEFEKPITTKIDENEDYGREVIEPLERGYGTTLGNSLRRVLLSSLPGAAVTSIKIDGVL    60

Query: 61   HEFDTIPGVREDVMQIILNVKGLAVKSYVEDEKIIELDVEGPAEITAGDILTDSDIEIVN   120
            HEFDTIPGVREDVMQIILNVKGLAVKSYVEDEKIIEL+VEGPAE+TAGDILTDSDIE+VN
Sbjct: 61   HEFDTIPGVREDVMQIILNVKGLAVKSYVEDEKIIELEVEGPAEVTAGDILTDSDIELVN   120

Query: 121  PDHYLFTIAEGHSLKATMTVAKNRGYVPAEGNKKDDAPVGTLAVDSIYTPVYKVNYQVEP   180
            PDHYLFTIAEGHSL+ATMTVAK RGYVPAEGNKKDDAPVGTLAVDSIYTPVKKVNYQVEP
Sbjct: 121  PDHYLFTIAEGHSLRATMTVAKKRGYVPAEGNKKDDAPVGTLAVDSIYTPVKKVNYQVEP   180

Query: 181  ARVGSNDGFDKLTIEIMTNGTIIPEDALGLSARVLIEHLNLFTDLTEVAKATEVMKETEK   240
            ARVGSNDGFDKLTIEIMTNGTIIPEDALGLSARVLIEHLNLFTDLTEVAKATEVMKETEK
Sbjct: 181  ARVGSNDGFDKLTIEIMTNGTIIPEDALGLSARVLIEHLNLFTDLTEVAKATEVMKETEK   240

Query: 241  VNDEKVLDRTIEELDLSVRSYNCLKRAGINTVFDLTEKTEPEMMKVRNLGRKSLEEVKIK   300
            VNDEKVLDRTIEELDLSVRSYNCLKRAGINTVFDLTEK+EPEMMKVRNLGRKSLEEVK+K
Sbjct: 241  VNDEKVLDRTIEELDLSVRSYNCLKRAGINTVFDLTEKSEPEMMKVRNLGRKSLEEVKVK   300

Query: 301  LADLGLGLKNDK   312
            LADLGLGLKNDK
Sbjct: 301  LADLGLGLKNDK   312
```

Based on this analysis, it was predicted that these proteins and their epitopes could be useful antigens for vaccines or diagnostics.

Example 2264

A DNA sequence (GBSx2386) was identified in *S. agalactiae* <SEQ ID 6997> which encodes the amino acid sequence <SEQ ID 6998>. This protein is predicted to be 50S ribosomal protein L17 (rplQ). Analysis of this protein sequence reveals the following:

```
Possible site: 37
>>> Seems to have no N-terminal signal sequence
----- Final Results -----
   bacterial cytoplasm --- Certainty = 0.1609 (Affirmative) <succ>
   bacterial membrane --- Certainty = 0.0000 (Not Clear) <succ>
   bacterial outside --- Certainty = 0.0000 (Not Clear) <succ>
```

The protein has homology with the following sequences in the GENPEPT database.

```
>GP:CAB11920 GB:Z99104 ribosomal protein L17 (BL15) [Bacillus subtilis]
Identities = 95/128 (74%), Positives = 105/128 (81%), Gaps = 8/128 (6%)

Query: 1    MAYRKLGRTSSQRKAMLRDLTTDLLINESIVTTEARAKEIRKTVEKMITLGKRGDLHARR    60
            M+YRKLGRTS+QRKAMLRDL+TDL+INE I TTE RAKE+R  VEKMITLGKRGDLHARR
Sbjct: 1    MSYRKLGRTSAQRKAMLRDLTTDLIINERIETTETRAKELRSVVEKMITLGKRGDLHARR    60

Query: 61   QAAAYVRNEIASENYDEASDKYTSTTALQKLFDDIAPRYAERNGGYTRILKTEPRRGDAA   120
            QAAAY+RNE+A+E  ++         ALQKLF DIA RY ER GGYTRI+K  PRRGD A
Sbjct: 61   QAAAYIRNEVANEENNQ--------DALQKLFSDIATRYEERQGGYTRIMKLGPRRGDGA   112

Query: 121  PMAIIELV   128
            PMAIIELV
Sbjct: 113  PMAIIELV   120
```

A related DNA sequence was identified in *S. pyogenes* <SEQ ID 6999> which encodes the amino acid sequence <SEQ ID 7000>. Analysis of this protein sequence reveals the following:

Possible site: 37
>>> Seems to have no N-terminal signal sequence
----- Final Results -----
bacterial cytoplasm --- Certainty = 0.1609 (Affirmative) <succ>
bacterial membrane --- Certainty = 0.0000 (Not Clear) <succ>
bacterial outside --- Certainty = 0.0000 (Not Clear) <succ>

An alignment of the GAS and GBS proteins is shown below.

```
Identities =125/128 (97%),Positives = 127/128 (98%)
Query: 1     MAYRKLGRTSSQRKAMLRDLTTELLINESIVTTEARAKEIRKTVEKMITLGKRGDLHARR    60
             MAYRKLGRTSSQRKAMLRDLTTELLINESIVTTEARAKEIRKTVEKMITLGKRGDLHARR
Sbjct: 1     MAYRKLGRTSSQRKAMLRDLTTELLINESIVTTEARAKEIRKTVEKMITLGKRGDLHARR    60

Query: 61    QAAAYVRNEIASENYDEASDKYTSTTALQKLFDDIAPRYAERNGGYTRILKTEPRRGDAA   120
             QAAAYVRNEIASENYDEA+DKYTSTTALQKLF +IAPRYAERNGGYTRILKTEPRRGDAA
Sbjct: 61    QAAAYVRNEIASENYDEATEKYTSTTALQKLFSEIAPRYAERNGGYTRILKTEPERGDAA   120

Query: 121   PMAIIELV                                                     128
             PMAIIELV
Sbjct: 121   PMAIIELV                                                     128
```

Based on this analysis, it was predicted that these proteins and their epitopes could be useful antigens for vaccines or diagnostics.

Example 2265

A DNA sequence (GBSx2396) was identified in *S. agalactiae* <SEQ ID 7001> which encodes the amino acid sequence <SEQ ID 7002>. This protein is predicted to be mercuric reductase. Analysis of this protein sequence reveals the following:

Possible site: 35
>>> Seems to have no N-terminal signal sequence
----- Final Results -----
bacterial cytoplasm --- Certainty = 0.2384 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:AAA83977 GB:AF138877 mercuric reductase MerA
[Bacillus sp. RC607]
Identities = 29/33 (87%), Positives = 32/33 (96%)
Query: 4       VGLTEEQAKEKGYDVKTSVLPLXAVPRAIVNRE    36
               VGLTE+QAKEKGY+VKTSVLPL AVPRA+VNRE
Sbjct: 520     VGLTEQQAKEKGYEVKTSVLPLDAVPRALVNRE    552
```

No corresponding DNA sequence was identified in *S. pyogenes*.

Based on this analysis, it was predicted that this protein and its epitopes, could be useful antigens for vaccines or diagnostics.

Example 2266

A DNA sequence (GBSx2397) was identified in *S. agalactiae* <SEQ ID 7003> which encodes the amino acid sequence <SEQ ID 7004>. This protein is predicted to be mercuric reductase. Analysis of this protein sequence reveals the following:

Possible site: 49
>>> Seems to have no N-terminal signal sequence
----- Final Results -----
bacterial cytoplasm --- Certainty = 0.3016 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:CAA70224 GB:Y09024 mercuric reductase [Bacillus cereus]
Identities = 146/194 (75%), Positives = 175/194 (890)
Query: 2       PQISGLEKMDYLTSTILLELKKIPKRLTVIGSGYIGMELGQLFHHLGSEITLMQRSERLL     61
               P I GL ++DYLTST+LLELKK+PKRL VIGSGYIGMELGQLFH+LGSE+TL+QRSERLL
Sbjct: 226     PNIPGLNEVDYLTSTSLLELKKVPKRLVVIGSGYIGMELGQLFHNLGSEVTLIQRSERLL    285

Query: 62      KEYDPEISESVEKALIEQGINLVKGATFERVEQSGEIKRVYVTVNGSREVIESDQLLVAT    121
               KEYDPEISESVEK+L+EQGINLVKGAT+ER+EQ+G+IK+V+V VNG + +IE+DQLLVAT
Sbjct: 286     KEYDPEISESVEKSLVEQGINLVKGATYERIEQNGDIKKVHVEVNGKKRIIEADQLLVAT    345

Query: 122     GRKPNTDSLNLSAAGVETGKNNEILINDFGQTSNEKIYAAGDVTLGPQFVYVAAYEGGII    181
               GR PNT +LNL AAGVE G   EI+I+D+ +T+N  +IYAAGDVTLGPQFVYVAAY+GG+
Sbjct: 346     GRTPNTATLNLRAAGVEIGSRGEIIIDDYSRTTNTRIYAAGDVTLGPQFVYVAAYQGGVA    405

Query: 182     TDNAIGGLNKKIDL                                                195
                 NAIGGLNKK++L
Sbjct: 406     APNAIGGLNKKLNL                                                419
```

There is also homology to SEQ ID 1820.

Based on this analysis, it was predicted that this protein and its epitopes, could be useful antigens for vaccines or diagnostics.

Example 2267

A DNA sequence (GBSx2398) was identified in *S. agalactiae* <SEQ ID 7005> which encodes the amino acid sequence <SEQ ID 7006>. This protein is predicted to be triacylglycerol acylhydrolase. Analysis of this protein sequence reveals the following:

```
Possible site: 46
>>> Seems to have no N-terminal signal sequence
----- Final Results -----
    bacterial cytoplasm --- Certainty = 0.3180 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2268

A DNA sequence (GBSx2399) was identified in *S. agalactiae* <SEQ ID 7007> which encodes the amino acid sequence <SEQ ID 7008>. Analysis of this protein sequence reveals the following:

```
Possible site: 42
>>> Seems to have no N-terminal signal sequence
----- Final Results -----
    bacterial cytoplasm --- Certainty = 0.0544 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP:AAC74453 GB:AE000234 orf, hypothetical protein
[Escherichia coli K12]
Identities = 45/58 (77%), Positives = 51/58 (87%)
Query:  1   MPWQNLLHAGQENLFSGLTALTAEFTVGEGKLMTHDEPCSMAPDDKHDLISGTCSHLP  58
            +PWQNLLHAG+ENLFSGLTAL+AEFT+GEG+LM HD P   APD+  DLISGTCSHLP
Sbjct: 34   LPWQNLLHAGEENLFSGLTALSAEFTIGEGELMAHDVPLGCAPDEYDDLISGTCSHLP  91
```

No corresponding DNA sequence was identified in *S. pyogenes*.

Based on this analysis, it was predicted that this protein and its epitopes, could be useful antigens for vaccines or diagnostics.

Example 2269

A DNA sequence (GBSx2400) was identified in *S. agalactiae* <SEQ ID 7009> which encodes the amino acid sequence <SEQ ID 7010>. This protein is predicted to be transposase for insertion sequence element is 5. Analysis of this protein sequence reveals the following:

```
Possible site: 48
>>> Seems to have no N-terminal signal sequence
----- Final Results -----
    bacterial cytoplasm --- Certainty = 0.2058 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP:BAB15497 GB:AK026530 unnamed protein product [Homo sapiens]
Identities = 297/299 (99%), Positives = 297/299 (99%)
Query:   1   MEQILPWQNMVEVIEPFYPKAGNGRRPYPLETMLRIHCMQHWYNLSDGAMEDALYEIASM    60
             MEQILPWQNMVEVIEPFYPKAGNGRRPYPLETMLRIHCMQHWYNLSDGAMEDALYEIASM
Sbjct:  40   MEQILPWQNMVEVIEPFYPKAGNGRRPYPLETMLRIHCMQHWYNLSDGAMEDALYEIASM    99

Query:  61   RLFARLSLDSALPDRTTIMNFRHLLEQHQLARQLFKTINRWLAEAGVMMTQGTLVDATII   120
             RLFARLSLDSALPDRTTIMNFRHLLEQHQLARQLFKTINRWLAEAGVMMTQGTLVDATII
Sbjct: 100   RLFARLSLDSALPDRTTIMNFRHLLEQHQLARQLFKTINRWLAEAGVMMTQGTLVDATII   159

Query: 121   EAPSSTKNKEQQRDPEMHQTKKGNQWHFGMKAHIGVDAKSGLTHSLVTTAANEHDLNQLX   180
             EAPSSTKNKEQQRDPEMHQTKKGNQWHFGMKAHIGVDAKSGLTHSLVTTAANEHDLNQL
```

```
                                 -continued
Sbjct:  160   EAPSSTKNKEQQRDPEMHQTKKGNQWHFGMKAHIGVDAKSGLTHSLVTTAANEHDLNQLG     219

Query:  181   NLLHGEEQFVSADAXYQGAPQREELAEVDVDWLIAERPGKVRTLKQHPRKNKTAINIEYM     240
              NLLHGEEQFVSADA YQGAPQREELAEVDVDWLIAERPGKVRTLKQHPRKNKTAINIEYM
Sbjct:  220   NLLHGEEQFVSADAGYQGAPQREELAEVDVDWLIAERPGKVRTLKQHPRKNKTAINIEYM     279

Query:  241   KASIRARVEHPFRIIKRQFGFVKARYKGLLKNDNQLAMLFTLANLFRADQMIRQWERSH      299
              KASIRARVEHPFRIIKRQFGFVKARYKGLLKNDNQLAMLFTLANLFRADQMIRQWERSH
Sbjct:  280   KASIRARVEHPFRIIKRQFGFVKARYKGLLKNDNQLAMLFTLANLFRADQMIRQWERSH      338
```

No corresponding DNA sequence was identified in *S. pyogenes*.

Based on this analysis, it was predicted that this protein and its epitopes, could be useful antigens for vaccines or diagnostics.

Example 2270

A DNA sequence (GBSx2401) was identified in *S. agalactiae* <SEQ ID 7011> which encodes the amino acid sequence <SEQ ID 7012>. Analysis of this protein sequence reveals the following:

---
Possible site: 16
>>> Seems to have a cleavable N-term signal seq.
----- Final Results -----
    bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>
---

The protein has homology with the following sequences in the GENPEPT database.

There is also homology to SEQ ID 3026.

Based on this analysis, it was predicted that this protein and its epitopes, could be useful antigens for vaccines or diagnostics.

Example 2271

A DNA sequence (GBSx2402) was identified in *S. agalactiae* <SEQ ID 7013> which encodes the amino acid sequence <SEQ ID 7014>. Analysis of this protein sequence reveals the following:

---
Possible site: 38
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>
---

A related GBS nucleic acid sequence <SEQ ID 9311> which encodes amino acid sequence <SEQ ID 9312> was also identified.

The protein has homology with the following sequences in the GENPEPT database.

```
>GP:CAB51958 GB:AL109661 putative eukaryotic-type serine/threonine
protein kinase [Streptomyces coelicolor A3(2)]
Identities = 49/169 (28%), Positives = 90/169 (52%), Gaps = 6/169 (3%)
Query:   23   PTTIRVPDVSNKTVAQAKMTLENSGLKVGAIRNIESDSVSEGLVVKTDPAAGRSRREGAK     82
              P T+++PDV+   + +A+  LE+ GL+ G +      SD V+ G V+ T P +G + R G+
Sbjct:  469   PDTVKLPDVTGYKLDKARTLLEDEGLEPGMVTRAFSDEVARGFVISTKPGSGTTVRAGSA    528

Query:   83   VNLYIATPNKSFTLGNYKEHNYKDILKDLQGKGVKKSLIKVRKINNDYTTGTILAQSLP     142
              V L + +       + +   + +  +L+G G+K +     ++N++Y +G + A+   P
Sbjct:  529   VAL-VVSKGSPVDVPDVTGDDLDEARAELEGAGLK--VKTADERVNSEYDSGRV-ARQTP   584

Query:  143   EGTSFNPDGNKKLTLTVAVNDPMI-MPDVTGMTVGEVIETLTDLGLDAD              190
              E    +G+  +TLTV+    MI +PDV G +V +    + L D G + D
Sbjct:  585   EPGGRAAEGD-TVTLTVSKGPRMIEVPDVVGDSVDDAKQKLEDAGFEVD              632

Identities = 45/161 (27%), Positives = 80/161 (48%), Gaps = 4/161 (2%)
Query:   27   RVPDVSNKTVAQAKMTLENSGLKVGAIRNIESDSVSEGLVVKTDPAAGRSRREGAKVNLY     86
              +VP +  +KT AQA+  L+++GL VG +R+   SD+V   G V+ TDP  G    R+     V+L
Sbjct:  405   KVPPLLSKTEAQARDRLDDAGLDVGKVRHAYSDTVERGKVISTDPGVGDRIRKNDSVSLT    464

Query:   87   IATPNKSFTLGNYKEHNYKDILKDLQGKGVKKSLIKVRKINNDYTTGTILAQSLPEGTS     146
              ++        + L +        L+ +G++   + V R    +++   G +++       GT+
Sbjct:  465   VSDGPDTVKLPDVTGYKLDKARTLLEDEGLEPGM--VTRAFSDEVARGFVISTKPGSTT     522
Query:  147   FNPDGNKKLTLTVAVNDPMIMPDVTGMTVGEVIETLTDLGL                    187
                  + L V+    P+ +PDVTG  + E     L    GL
Sbjct:  523   VR--AGSAVALVVSKGSPVDVPDVTGDDLDEARAELEGAGL                    561
```

```
>GP:AAB90561 GB:AE001058 glutamine ABC transporter, ATP-binding
protein (glnQ) [Archaeoglobus fulgidus]
Identities = 142/219 (64%), Positives = 178/219 (80%)
Query:    1   MDIHQGEVVVIIGPSGSGKSTFLRTMNLLEVPTKGTVTFEGIDITDKKNDIFKMREKMGM    60
              M + +GEVVVIIGPSGSGKST LR +N LE PT G +   +G+DIT+ K DI K+R+++G+
Sbjct:   24   MKVEKGEVVVIIGPSGSGKSTLLRCINRLEEPTSGKILLDGVDITNSKIDINKVRQRIGI    83

Query:   61   VFQQFNLFPNMTVLENITLSPIKTKGLSNLDAQTKAYELLEKVGLKEKANTYPASLSGGQ   120
```

```
                VFQQFNLFP++T L+N+TL+PIK K +S   +A+       LLEKVGL++KA+ YPA LSGGQ
Sbjct:  84      VFQQFNLFPHLTALQNVTLAPIKIKKMSKREAEELGMRLLEKVGLEDKADYYPAQLSGGQ143

Query: 121      QQRIAIARGLAMNPDVLLFDEPTSALDPEMVGEVLTVMQDLAKSGMTMVIVTHEMGFARE180
                QQR+AIAR LAMNP+V+LFDE TSALDPE+V EVL VM+ LA+ GMTMV+VTHEMGFARE
Sbjct: 144      QQRVAIARALAMNPEVMLFDEVTSALDPELVKEVLDVMKQLARDGMTMVVVTHEMGFARE203

Query: 181      VADRVIFMDAGIIVEQGAPKEVFEQTKEIRTRDFLSKVL                      219
                V DRVIFMD G+IVE+G P+++F   K  RTR FLS +L
Sbjct: 204      VGDRVIFMDGGVIVEEGKPEQIFSNPKHERTRKFLSMIL                      242
```

There is also homology to SEQ ID 1186.

Based on this analysis, it was predicted that this protein and its epitopes, could be useful antigens for vaccines or diagnostics.

Example 2272

A DNA sequence (GBSx2403) was identified in *S. agalactiae* <SEQ ID 7015> which encodes the amino acid sequence <SEQ ID 7016>. This protein is predicted to be 4-hydroxy-2-oxoglutarate aldolase (kdgA). Analysis of this protein sequence reveals the following:

---
Possible site: 43
>>> Seems to have no N-terminal signal sequence
----- Final Results -----
    bacterial cytoplasm --- Certainty = 0.1479 (Affirmative) <succ>
    bacterial membrane --- Certainty = 0.0000 (Not Clear) <succ>
    bacterial outside --- Certainty = 0.0000 (Not Clear) <succ>
---

The protein has homology with the following sequences in the GENPEPT database.

```
>GP:CAB14127 GB:Z99115 deoxyphosphogluconate aldolase [Bacillus subtilis]
Identities = 21/62 (33%), Positives = 38/62 (60%), Gaps = 4/62 (6%)
Query:   3      QLMQGKIVAVIRGNSQEEAFQAAQACIKGGISAIEIAYTNSKASQVIEQLVTQYTNQEQV62
                +L + K++AVIR  ++EA Q  ++  GI A+E+ YT   AS +IE    + N+E  +
Sbjct:   9      RLKEAKLIAVIRSKDKQEACQQIESLLDKGIRAVEVTYTTPGASDIIE----SFRNREDI64

Query:  63      VV                                                           64
                ++
Sbjct:  65      LI                                                           66
```

Based on this analysis, it was predicted that this protein and its epitopes, could be useful antigens for vaccines or diagnostics.

Example 2273

A DNA sequence (GBSx2405) was identified in *S. agalactiae* <SEQ ID 7017> which encodes the amino acid sequence <SEQ ID 7018>. This protein is predicted to be H repeat-associated protein (rfbQRS) (b1458). Analysis of this protein sequence reveals the following:

---
Possible site: 27
>>> Seems to have no N-terminal signal sequence
----- Final Results -----
    bacterial cytoplasm --- Certainty = 0.0207 (Affirmative) <succ>
    bacterial membrane --- Certainty = 0.0000 (Not Clear) <succ>
    bacterial outside --- Certainty = 0.0000 (Not Clear) <succ>
---

There is homology to SEQ ID 504.

Based on this analysis, it was predicted that this protein and its epitopes, could be useful antigens for vaccines or diagnostics.

Example 2274

A DNA sequence (GBSx2406) was identified in *S. agalactiae* <SEQ ID 7019> which encodes the amino acid sequence <SEQ ID 7020>. Analysis of this protein sequence reveals the following:

---
Possible site: 14
>>> Seems to have an uncleavable N-term signal seq
INTEGRAL     Likelihood = −6.74     Transmembrane 2-18 (1-21)
INTEGRAL     Likelihood = −3.03     Transmembrane 73-89 (73-92)
----- Final Results -----
    bacterial membrane --- Certainty = 0.3697 (Affirmative) <succ>
    bacterial outside --- Certainty = 0.0000 (Not Clear) <succ>
    bacterial cytoplasm --- Certainty = 0.0000 (Not Clear) <succ>
---

The protein has no significant homology with any sequences in the GENPEPT database.

There is also homology to SEQ ID 3376.

Based on this analysis, it was predicted that this protein and its epitopes, could be useful antigens for vaccines or diagnostics.

Example 2275

A DNA sequence (GBSx2407) was identified in *S. agalactiae* <SEQ ID 7021> which encodes the amino acid sequence <SEQ ID 7022>. This protein is predicted to be insertion element IS1 protein InsB (insB_5). Analysis of this protein sequence reveals the following:

---
Possible site: 52
>>> Seems to have no N-terminal signal sequence
----- Final Results -----
    bacterial cytoplasm --- Certainty = 0.4280 (Affirmative) <succ>
    bacterial membrane --- Certainty = 0.0000 (Not Clear) <succ>
    bacterial outside --- Certainty = 0.0000 (Not Clear) <succ>
---

No corresponding DNA sequence was identified in *S. pyogenes*.

Example 2276

A DNA sequence (GBSx2409) was identified in *S. agalactiae* <SEQ ID 7023> which encodes the amino acid sequence <SEQ ID 7024>. Analysis of this protein sequence reveals the following:

```
Possible site: 13
>>> Seems to have no N-terminal signal sequence
----- Final Results -----
    bacterial cytoplasm --- Certainty = 0.3937(Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2277

A DNA sequence (GBSx2410) was identified in *S. agalactiae* <SEQ ID 7025> which encodes the amino acid sequence <SEQ ID 7026>. This protein is predicted to be triosephosphate isomerase (tpi). Analysis of this protein sequence reveals the following:

```
Possible site: 53
>>> Seems to have no N-terminal signal sequence
INTEGRAL    Likelihood = -0.37    Transmembrane 35-51 (35-51)
----- Final Results -----
    bacterial membrane --- Certainty = 0.1150 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:AAC43268 GB:U07640 triosephosphate isomerase [Lactococcus lactis]
Identities = 50/75 (66%), Positives = 61/75 (80%)
Query:  6  IAGNWKMNKNPEEAKAFIEAVASKLPSSELVEAGIAAPALTLSTVLEAAKGSELKIAAQN65
           IAGNWKMNK   EA+AF+EAV + LPSS+ VE+ I APAL L+ +     +GSELK+AA+N
Sbjct:  7  IAGNWKMNKTLSEAQAFVEAVKNNLPSSDNVESVIGAPALFLAPMAYLRQGSELKLAAEN66

Query: 66  SYFENSGAFTGENSP                                              80
           SYFEN+GAFTGENSP
Sbjct: 67  SYFENAGAFTGENSP                                              81
```

There is also homology to SEQ ID 6838:

```
Identities = 58/77 (75%), Positives = 68/77 (87%)
Query:  6  IAGNWKMNKNPEEAKAFIEAVASKLPSSELVEAGIAAPALTLSTVLEAAKGSELKIAAQN65
           IAGNWKMNKNP+EAKAF+EAVASKLPS++LV+   +AAPA+ L T +EAAK S LK+AAQN
Sbjct:  7  IAGNWKMNKNPQEAKAFVEAVASKLPSTELVDVAVAAPANDLVTTIEAAKDSVLKVAAQN66

Query: 66  SYFENSGAFTGENSPKV                                            82
            YFEN+GAFTGE SPKV
Sbjct: 67  CYFENTGAFTGETSPKV                                            83
```

Based on this analysis, it was predicted that this protein and its epitopes, could be useful antigens for vaccines or diagnostics.

Example 2278

A DNA sequence (GBSx2412) was identified in *S. agalactiae* <SEQ ID 7027> which encodes the amino acid sequence <SEQ ID 7028>. Analysis of this protein sequence reveals the following:

```
Possible site: 20
>> Seems to have no N-terminal signal sequence
INTEGRAL    Likelihood = -2.39    Transmembrane 96-112 (96-112)
----- Final Results -----
    bacterial membrane --- Certainty = 0.1956 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:BAA14368 GB:D90354 surface protein antigen precursor
[Streptococcus sobrinus]
```

```
Identities = 60/129 (46%), Positives = 76/129 (58%), Gaps = 18/129 (13%)
Query:    3  ISFDNSFLETVSDDSAFQADVYLQMKRIAAGQVENTYLHTVNGYVISSNTVVTHTPQPEE    62
                ++F   FL +VS DSAFQA+VYLQMKRIA G   NTY++TVNG  SSNTV T TP+P++
Sbjct: 1442  VTFKEDFLRSVSVDSAFQAEVYLQMKRIAVGTFANTYVNTVNGITYSSNTVRTSTPEPKQ  1501

Query:   63  PSPNQP--------TPPQPPIETIEPPVPASILPNTGEQES----LLGLIG--AGILLGT   108
             PSP  P        P Q     PP  A LP TG+   +     LLGL+    AG L
Sbjct: 1502  PSPVDPKTTTTVVFQPRQGKAYQPAPPAGAQ-LPATGDSSNAYLPLLGLVSLTAGFSL--  1558

Query:  109  AYGLKKKEE                                                      117
                GL++K++
Sbjct: 1559  -LGLRRKQD                                                     1566
```

No corresponding DNA sequence was identified in *S. pyogenes*.

Based on this analysis, it was predicted that this protein and its epitopes, could be useful antigens for vaccines or diagnostics.

Example 2279

A DNA sequence (GBSx2413) was identified in *S. agalactiae* <SEQ ID 7029> which encodes the amino acid sequence <SEQ ID 7030>. Analysis of this protein sequence reveals the following:

---

Possible site: 23
>>> Seems to have no N-terminal signal sequence
----- Final Results -----
    bacterial cytoplasm --- Certainty = 0.3691 (Affirmative) <succ>
    bacterial membrane --- Certainty = 0.0000 (Not Clear) <succ>
    bacterial outside --- Certainty = 0.0000 (Not Clear) <succ>

---

A related GBS nucleic acid sequence <SEQ ID 9359> which encodes amino acid sequence <SEQ ID 9360> was also identified.

The protein has homology with the following sequences in the GENPEPT database.

A related DNA sequence was identified in *S. pyogenes* <SEQ ID 7031> which encodes the amino acid sequence <SEQ ID 7032>. Analysis of this protein sequence reveals the following:

---

Possible site: 34
>>> Seems to have no N-terminal signal sequence
----- Final Results -----
    bacterial cytoplasm --- Certainty = 0.3182 (Affirmative) <succ>
    bacterial membrane --- Certainty = 0.0000 (Not Clear) <succ>
    bacterial outside --- Certainty = 0.0000 (Not Clear) <succ>

---

An alignment of the GAS and GBS proteins is shown below.

```
>GP:CAB15793 GB:Z99123 phosphotransacetylase [Bacillus subtilis]
Identities = 131/221 (59%), Positives = 169/221 (76%), Gaps = 2/221 (0%)
Query:   6  LVDPVILGKADEVHDSLARLGFVDQDYSIIDPEQYEKFEEMKEAFVEIRKGKATMEDADR   65
            +++P+++G  +E+     L       I DP  YE  E++ +AFVE RKGKAT E A +
Sbjct:  41  VLNPIVIGNENEIQAKAKELNLTLGGVKIYDPHTYEGMEDLVQAFVERRKGKATEEQARK  100

Query:  66  LLKDVNYFGVMLVKLGLADGMVSGAIHSTADTVRPALQIIKTKPGISRTSGVFLMNRENT  125
             L D NYFG MLV  GLADG+VSGA HSTADTVRPALQ IKTK  G+  +TSGVF+M R
Sbjct: 101  ALLDENYFGTMLVYKGLADGLVSGAAHSTADTVRPALQIIKTKEGVKKTSGVFIMARG--  158

Query: 126  QERYIFADCAINIDPNAQELAEIAVNTADTAKIFDIDPKIAMLSFSTKGSAKAPQAEKVQ  185
            +E+Y+FADCAINI P++Q+LAEIA+  +A+TAK+FDI+P++AMLSFSTKGSAK+  + EKV
Sbjct: 159  EEQYVFADCAINIAPDSQDLAEIAIESANTAKMFDIEPRVAMLSFSTKGSAKSDETEKVA  218

Query: 186  EAAKIAKDLSPELAVDGELQFDAAFVPETAEIKAPNSDVAG                      226
            +A KIAK+ +PEL +DGE QFDAAFVP  AE KAP+S++ G
Sbjct: 219  DAVKIAKEKAPELTLDGEFQFDAAFVPSVAEKKAPDSEIKG                     259
```

55

```
Identities = 181/227 (79%), Positives = 211/227 (92%)
Query:   1  MKFEGLVDPVILGKADEVHDSLARLGFVDQDYSIIDPEQYEKFEEMKEAFVEIRKGKATM   60
            +KFEGL++P+ILG+++EV + L +LGF DQDY+II+P +Y  F++MKEAFVE+RKGKAT+
Sbjct:  38  LKFEGLLEPIILGQSEEVRNLLTKLGFADQDYTIINPNEYADFDKMKEAFVEVRKGKATL   97

Query:  61  EDADRLLKDVNYFGVMLVKLGLADGMVSGAIHSTADTVRPALQIIKTKPGISRTSGVFLM  120
            EDAD++L+DVNYFGVMLVK+GLADGMVSGAIHSTADTVRPALQIIKTKPGISRTSGVFLM
```

```
Sbjct: 98    EDADKMLRDVNYFGVMLVKMGLADGMVSGAIHSTADTVRPALQIIKTKPGISRTSGVFLM157

Query: 121   NRENTQERYIFADCAINIDPNAQELAEIAVNTADTAKIFDIDPKIAMLSFSTKGSAKAPQ180
             NRENT ERY+FADCAINIDP AQELAEIAVNTA+TAKIFDIDPKIAMLSFSTKGS KAPQ
Sbjct: 158   NRENTSERYVFADCAINIDPTAQELAEIAVNTAETAKIFDIDPKIAMLSFSTKGSGKAPQ217

Query: 181   AEKVQEAAKIAKDLSPELAVDGELQFDAAFVPETAEIKAPNSDVAGK              227
             +KV+EA +IA  L+P+LA+DGELQFDAAFVFETA IKAP+S VAG+
Sbjct: 218   VDKVREATEIATGLNPDLALDGELQFDAAFVPETAAIKAPDSAVAGQ              264
```

Based on this analysis, it was predicted that these proteins and their epitopes could be useful antigens for vaccines or diagnostics.

Example 2280

A DNA sequence (GBSx2414) was identified in *S. agalactiae* <SEQ ID 7033> which encodes the amino acid sequence <SEQ ID 7034>. This protein is predicted to be lipopolysaccharide biosynthesis protein-related protein. Analysis of this protein sequence reveals the following:

Possible site: 61
>>> Seems to have no N-terminal signal sequence
----- Final Results -----

-continued bacterial cytoplasm --- Certainty = 0.4076 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:AAG19110 GB:AE005009 Vng0600c [Halobacterium sp. NRC-1]
Identities = 57/176 (32%), Positives = 86/176 (48%), Gaps = 20/176 (11%)
Query: 1     MKVLLYLEAEEYLKKSGIGRAIKHQEKALQIAGIDYTTNPT------------------ 41
             M+ L YLEA E L+  G+ A  Q  AL+    ++       P
Sbjct: 2     MRALNYLEAAEALR-GGMVTATNQQRAALETTDVEVVETPWRAGDPVRSIGSLAAGGSCF 60

Query: 42    DDFDLVHMNTYGIRSWLLMSKAKKTGKKVIMHGHSTEEDFRNSFIGSNLVSPLFKWYLCR101
              FD+ H N  G  S  +    A++T    +++H H T EDF  SF GS+ ++P  + YL
Sbjct: 61    TAFDVAHCNLVGPGSVAVARHARRTDTPLVLHAHLTREDFAQSFRGSSTIAPALEPYLRW120

Query: 102   FYQKADAIITPTDYSKQLIKAYGIKKPIFVLSNGIDLSRYQXSEKKESAFRHYFHL      157
             FY +AD ++ P++Y+K +++AY +  PI  LSNG+DL    Q  E   +  R   F L
Sbjct: 121   FYSQADLVLCPSEYTKDVLRAYPVDAPIRQLSNGVDLESMQGYESFRADTRARFDL      176
```

There is also homology to SEQ ID 1220.

Based on this analysis, it was predicted that this protein and its epitopes, could be useful antigens for vaccines or diagnostics.

Example 2281

A DNA sequence (GBSx2415) was identified in *S. agalactiae* <SEQ ID 7035> which encodes the amino acid sequence <SEQ ID 7036>. Analysis of this protein sequence reveals the following:

Possible site: 41
>> Seems to have no N-terminal signal sequence
----- Final Results -----
   bacterial cytoplasm --- Certainty = 0.2625 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:AAC35010 GB:AF055987 intracellular a-amylase [Streptococcus mutans]
Identities = 27/46 (58%), Positives = 33/46 (71%)
Query: 1     MEVGEIYAGKTFVDYLGNCEQEVVIGDDGWGDFLVESASISAWVPK   46
             M +GE   K FVDYL NC +EV++ D GWGDF V+ AS+SAWV K
Sbjct: 438   MNMGEFNRNKVFVDYLNNCTEEVILDDQGWGDFPVQEASLSAWVNK   483
```

No corresponding DNA sequence was identified in *S. pyogenes*.

Based on this analysis, it was predicted that this protein and its epitopes, could be useful antigens for vaccines or diagnostics.

Example 2282

A DNA sequence (GBSx2416) was identified in *S. agalactiae* <SEQ ID 7037> which encodes the amino acid sequence <SEQ ID 7038>. This protein is predicted to be RopA. Analysis of this protein sequence reveals the following:

Possible site: 24
>>> Seems to have no N-terminal signal sequence
----- Final Results -----

-continued

```
bacterial cytoplasm --- Certainty = 0.2082 (Affirmative) <succ>
bacterial membrane --- Certainty = 0.0000 (Not Clear) <succ>
 bacterial outside --- Certainty = 0.0000 (Not Clear) <succ>
```

There is also homology to SEQ ID 6908:

```
Identities = 30/35 (85%), Positives = 33/35 (93%)
Query:   1  MEADQVRGLLSADMLKHDIAMKKAVDVITSSA    35
            TVK
            M ADQVR LLSADMLKHDIAMKKAV+VITS+A
            +VK
Sbjct: 422  MPADQVRSLLSADMLKHDIAMKKAVEVITSTA   456
            SVK
```

Based on this analysis, it was predicted that these proteins and their epitopes could be useful antigens for vaccines or diagnostics.

Example 2283

A DNA sequence (GBSx2417) was identified in *S. agalactiae* <SEQ ID 7039> which encodes the amino acid sequence <SEQ ID 7040>. This protein is predicted to be DNA-directed RNA polymerase, subunit delta. Analysis of this protein sequence reveals the following:

```
Possible site: 54
>>> Seems to have no N-terminal signal sequence
----- Final Results -----
   bacterial cytoplasm --- Certainty = 0.2407 (Affirmative) <succ>
   bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP:CAB15744 GB:Z99123 RNA polymerase (delta subunit) [Bacillus subtilis]
Identities = 62/186 (33%), Positives = 102/186 (54%), Gaps = 15/186 (8%)
Query:   1  MELEVFAGQEKSELSMIEVARAILEQRGRDNEMYFSDLVNDIQTYLGKSDSAIRESLPFF  60
            M ++ ++ +E  E++++E+A  + E+  +   + F +L+N+I + LG    + + + F
Sbjct:   1  MGIKQYSQEELKEMALVEIAHELFEEHKKP--VPFQELLNEIASLLGVKKEELGDRIAQF  58

Query:  61  YSDLNTDGSFIPLGENKWGLRSWYAIDEIDEEIITLEEDEDGAPKRKKKRVNAFMDGDED120
            Y+DLN DG F+ L +   WGLRSWY  D++DEE         K  KKK+    ++ D D
Sbjct:  59  YTDLNIDGRFLALSDQTWGLRSWYPYDQLDEE-------TQPTVKAKKKKAKKAVEEDLD111

Query: 121  AIDYNDDDPEDEDFTEETPSLEYDEENPDDEKSEVESYDSEINEIIPDEDLDEDVEINEE180
            ++ + D +D D  E    L+ + ++ D+E  + +  D EI  E  I DED DED
Sbjct: 112  LDEFEEIDEDDLDLDEVEEELDLEADDFDEEDLDEDDDDLEIEEDIIDED-DEDY-----165

Query: 181  DDEEEE                                                       186
            DDEEEE
Sbjct: 166  DDEEEE                                                       171
```

A related DNA sequence was identified in *S. pyogenes* <SEQ ID 7041> which encodes the amino acid sequence <SEQ ID 7042>. Analysis of this protein sequence reveals the following:

```
Possible site: 33
>>> Seems to have no N-terminal signal sequence
----- Final Results -----
   bacterial cytoplasm --- Certainty = 0.2263 (Affirmative) <succ>
    bacterial membrane --- Certainty = 0.0000 (Not Clear) <succ>
     bacterial outside --- Certainty = 0.0000 (Not Clear) <succ>
```

An alignment of the GAS and GBS proteins is shown below.

```
Identities = 162/191 (84%), Positives = 181/191 (93%), Gaps = 1/191 (0%)
Query:   1  MELEVFAGQEKSELSMIEVARAILEQRGRDNEMYFSDLVNDIQTYLGKSDSAIRESLPFF  60
            ++L+VFAGQEKSELSMIEVARAILE+RGRDNEMYFSDLVN+IQ YLGKSD+ IR +LPFF
Sbjct:  12  LKLDVFAGQEKSELSMIEVARAILEERGRDNEMYESDLVNEIWYLGKSDAGIRHALPFF   71

Query:  61  YSDLNTDGSFIPLGENKWGLRSWYAIDEIDEEIITLEEDEDGAPKRKKKRVNAFMDGDED120
            Y+DLNTDGSFIPLGENKWGLRSWYAIDEIDEEIITLEEDEDGA KRKKKRVNAFMDGDED
Sbjct:  72  YTDLNTDGSFIPLGENKWGLRSWYAIDEIDEEIITLEEDEDGAQKRKKKRVNAFMDGDED131

Query: 121  AIDYNDDDPEDEDFTEETPSLEYDEENPDDEKSEVESYDSEINEIIPDEDLDEDVEINEE180
            AIDY DDDPEDEDFTEE+   +EYDE+PDDEKSEVESYDSE+NEIIP++D E+V+INEE
Sbjct: 132  AIDYRDDDPEDEDFTEESAEVEYDEEDPDDEKSEVESYDSELNEIIPEDDF-EEVDINEE190

Query: 181  DDEEEEEEEV                                                   191
            D+E+EE+EE V
Sbjct: 191  DEEDEEDEEPV                                                  201
```

Based on this analysis, it was predicted that these proteins and their epitopes could be useful antigens for vaccines or diagnostics.

Example 2284

A DNA sequence (GBSx2418) was identified in *S. agalactiae* <SEQ ID 7043> which encodes the amino acid sequence <SEQ ID 7044>. This protein is predicted to be CTP synthetase (pyrG). Analysis of this protein sequence reveals the following:

Possible site: 23
>>> Seems to have an uncleavable N-terminal signal sequence
INTEGRAL Likelihood = −0.11 Transmembrane 5-21 (5-21)
----- Final Results -----
    bacterial membrane --- Certainty = 0.1044 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the GENPEPT database.

```
>GP:CAA09021 GB:AJ010153 CTP synthetase [Lactococcus lactis subsp.
cremoris] (ver 2)
Identities = 421/533 (78%), Positives = 481/533 (890),
Query: 2    TKYIFVTGGVVSSIGKGIVAASLGRLLKNRGLKVTIQKFDPYINIDPGTMSPYQHGEVYV 61
            TKYIFVTGG  SS+GKGIVAASLGRLLKNRGLKVT+QKFDPY+NIDPGTMSPYQHGEV+V
Sbjct: 3    TKYIFVTGGGTSSMGKGIVAASLGRLLKNRGLKVTVQKFDPYLNIDPGTMSPYQHGEVFV 62

Query: 62   TDDGAETDLDLGHYERFIDINLNKYSNVTTGKIYSEVLKKERRGEYLGATVQVIPHVTDA 121
            TDDGAETDLDLGHYERFIDINLNKYSNVT+GK+YSE+L+KER+GEYLGATVQ++PHVT+
Sbjct: 63   TDDGAETDLDLGHYERFIDINLNKYSNVTSGKVYSEILRKERKGEYLGATVQMVPHVTNM 122

Query: 122  LKEKIKRAATTTDSDVIITEVGGTVGDIESLPFLEALRQMKADVGSDNVMYIHTTLLPYL 181
            LKEKIKRAATTTD+D+IITEVGGTVGD+ESLPF+EALRQMKA+VG+DNVMYIHT   + +L
Sbjct: 123  LKEKIKRAATTTDADIIITEVGGTVGDMESLPFIEALRQMKAEVGADNVMYIHTVPILHL 182

Query: 182  KAAGEMKTKPTQHSVKELRGLGIQPNMLVIRTEQPAGQSIKNKLAQFCDVAPEAVIESLD 241
            +AAGE+KTK  Q++ K LR  GIQ NMLV+R+E P    +++K+A FCDVAPEAVI+SLD
Sbjct: 183  RAAGELKTKIAQNATKTLREYGIQANMLVLRSEVPITTEMRDKIAMFCDVAPEAVIQSLD 242

Query: 242  VDHIYQIPLNMQAQNMDQIVCDHLKLETPAADMTEWSAMVDKVMNLEKKVKIALVGKYVE 301
            V+H+YQIPLN+QAQNMDQIVCDHLKL+ P ADM EWSAMVD VMNL+KKVKIALVGKYVE
Sbjct: 243  VEHLYQIPLNLQAQNMDQIVCDHLKLDAPKADMAEWSAMVDHVMNLKKKVKIALVGKYVE 302

Query: 302  LPDAYLSVVEALKHSGYVNDVAIDLKWVNAAEVTEDNIKELVGDADGIIVPGGFGQRGSE 361
            LPDAY+SV EALKH+GY +D  +D+ WVNA +VT++N+ ELVGDA GIIVPGGFGQRG+E
Sbjct: 303  LPDAYISVTEALKHAGYASDAEVDINWVNANDVTDENVAELVGDAAGIIVPGGFGQRGTE 362

Query: 362  GKIEAIRYARENDVPMLGVCLGMQLTCVEFARNVLNLHGANSAELDPKTPFPIIDIMRDQ 421
            GKI AI+YARENDVPMLG+CLGMQLT VEFARNVL L GA+S ELDP+T +P+IDIMRDQ
Sbjct: 363  GKIAAIKYARENDVPMLGICLGMQLTAVEFARNVLGLEGAHSFELDPETKYPVIDIMRDQ 422

Query: 422  IDIEDMGGTLRLGLYPCKLKSGSRAAAAYNNQEVVQRRHRHRYEFNTKFREQFEAAGFVF 481
            +D+EDMGGTLRLGLYP KLK+GSRA AAYN+ EVVQRRHRHRYEFN K+RE FE AGFVF
Sbjct: 423  VDVEDMGGTLRLGLYPAKLKNGSRAKAAYNDAEVVQRRHAHRYEFNNKYREDFEKAGFVF 482

Query: 482  SGVSPDNRLMEVVELPEKKFFVAAQYHPELQSRPNHAEELYTAFVTAAVENME        534
            SGVSPDNRL+E+VEL  KKFFVA QYHPELQSRPN  EELYT F+  AVEN K
Sbjct: 483  SGVSPDNRLVEIVELSGKKFFVACQYHPELQSRPNRPEELYTEFIRVAVENSK        535
```

A related DNA sequence was identified in *S. pyogenes* <SEQ ID 7045> which encodes the amino acid sequence <SEQ ID 7046>. Analysis of this protein sequence reveals the following:

Possible site: 23
>>> Seems to have an uncleavable N-terminal signal sequence
INTEGRAL Likelihood = −0.11 Transmembrane 5-21 (5-21)
----- Final Results -----
    bacterial membrane --- Certainty = 0.1044 (Affirmative) <succ>
    bacterial outside --- Certainty = 0.0000 (Not Clear) <succ>
    bacterial cytoplasm --- Certainty = 0.0000 (Not Clear) <succ>

The protein has homology with the following sequences in the databases:

```
>GP:CAA09021 GB:AJ010153 CTP synthetase [Lactococcus lactis subsp.
cremoris](ver 2)
Identities = 423/532 (79%), Positives = 483/532 (90%)
Query: 2    TKYIFVTGGVVSSIGKGIVAASLGRLLKNRGLKVTIQKFDPYINIDPGTMSPYQHGEVYV 61
            TKYIFVTGG  SS+GKGIVAASLGRLLKNRGLKVT+QKFDPY+NIDPGTMSPYQHGEV+V
```

```
Sbjct: 3    TKYIFVTGGGTSSMGKGIVAASLGRLLKNRGLKVTVQKFDPYLNIDPGTMSPYQHGEVFV 62

Query: 62   TDDGAETDLDLGHYERFIDINLNKYSNVTTGKIYSEVLRKERKGEYLGATVQVIPHITDA121
            TDDGAETDLDLGHYERFIDINLNKYSNVT+GK+YSE+LRKERKGEYLGATVQ++PH+T+
Sbjct: 63   TDDGAETDLDLGHYERFIDINLNKYSNVTSGKVYSEILRKERKGEYLGATVQMVPHVTNM122

Query: 122  LKEKIKRAASTTDSDVIITEVGGTVGDIESLPFLEALRQMKADVGSENVMYIHTTLLPYL181
            LKEKIKRAA+TTD+D+IITEVGGTVGD+ESLPF+EALRQMKA+VG++NVMYIHT   + +L
Sbjct: 123  LKEKIKRAATTTDADIIITEVGGTVGDMESLPFIEALRQMKAEVGADNVMYIHTVPILHL182

Query: 182  KAAGEMKTKPTQHSVKELRGLGIQPNMLVIRTEEPVEQGIKNKLAQFCDVNSEAVIESRD241
            +AAGE+KTK  Q++ K LR  GIQ NMLV+R+E P+    +++K+A FCDV  EAVI+S D
Sbjct: 183  RAAGELKTKIAQNATKTLREYGIQANMLVLRSEVPITTEMRDKIAMFCDVAPEAVIQSLD242

Query: 242  VEHLYQIPLNLQAQSMDQIVCDHLKLNAPQADMTEWSAMVDKVMNLRKTTKIALVGKYVE301
            VEHLYQIPLNLQAQ+MDQIVCDHLKL+AP+ADM EWSAMVD VMNL+K  KIALVGKYVE
Sbjct: 243  VEHLYQIPLNLQAQNMDQIVCDHLKLDAPKADMAEWSAMVDHVMNLKKKVKIALVGKYVE302

Query: 302  LPDAYLSVVEALKHSGYANDTAIDLKWVNANDVTVDNAADLLGDADGIIVPGGFGQRGTE361
            LPDAY+SV EALKH+GYA+D   +D+ WVNANDVT  +N A+L+GDA GIIVPGGFGQRGTE
Sbjct: 303  LPDAYISVTEALKHAGYASDAEVDINWVNANDVTDENVAELVGDAAGIIVPGGFGQRGTE362

Query: 362  GKIQAIRYARENDVPMLGICLGMQLTCVEFARHVLNMEGANSFELEPSTKYPIIDIMRDQ421
            GKI AI+YARENDVPMLGICLGMQLT VEFAR+VL +EGA+SFEL+P TKYP+IDIMRDQ
Sbjct: 363  GKIAAIKYARENDVPMLGICLGMQLTAVEFARNVLGLEGAHSFELDPETKYPVIDIMRDQ422

Query: 422  IDIEDMGGTLRLGLYPCKLKPGSKAAMAYNNQEVVQRRHRHRYEFNNKFRPEFEAAGFVF481
            +D+EDMGGTLRLGLYP KLK GS+A  AYN+ EVVQRRHRHRYEFNNK+R +FE AGFVF
Sbjct: 423  VDVEDMGGTLRLGLYPAKLKNGSRAKAAYNDAEVVQRRHRHRYEFNNKYREDFEKAGFVF482

Query: 482  SGVSPDNRLVEIVELKEKKFFVAAQYHPELQSRPNRPEELYTAFVTAAIKNS        533
            SGVSPDNRLVEIVEL  KKFFVA QYHPELQSRPNRPEELYT F+  A++NS
Sbjct: 483  SGVSPDNRLVEIVELSGKKFFVACQYHPELQSRPNRPEELYTEFIRVAVENS        534
```

An alignment of the GAS and GBS proteins is shown below.

```
Identities = 477/532 (89%), Positives = 503/532 (93%)

Query: 1    MTKYIEVTGGVVSSIGKGIVAASLGRLLKNRGLKVTIQKFDPYINIDPGTMSPYQHGEVY 60
            MTKYI+VTGGVVSSIGKGIVAASLGRLLKNRGLKVTIQKFDPYINIDPGTMSPYQHGEVY
Sbjct: 1    MTKYIFVTGGVVSSIGKGIVAASLGRLLKNRGLKVTIQKFDPYINIDPGTMSPYQHGEVY 60

Query: 61   VTDDGAETDLDLGHYERFIDINLNKYSNVTTGKIYSEVLKKERRGEYLGATVQVIPHVTD120
            VTDDGAETDLDLGHYERFIDINLNKYSNVTTGKIYSEVL+KER+GEYLGATVQVIPH+TD
Sbjct: 61   VTDDGAETDLDLGHYERFIDINLNKYSNVTTGKIYSEVLRKERKGEYLGATVQVIPHITD120

Query: 121  ALKEKIKRAATTTDSDVIITEVGGTVGDIESLPFLEALRQMKADVGSDNVMYIHTILLPY180
            ALKEKIKRA+TTTDSDVIITEVGGTVGDIESLPFLEALRQMKADVGS+NVMYIHT+LLPY
Sbjct: 121  ALKEKIKRAASTTDSDVIITEVGGTVGDIESLPFLEALRQMKADVGSENVMYIHTTLLPY180

Query: 181  LKAAGEMKTKPTQHSVRELRGLGIQPNMLVIRTEQPAGQSIKNKLAQFCDVAPEAVIESL240
            LKAAGEMKTKPTQHSV+ELRGLGIQPNMLVIRTE+P  Q IKNKLAQFCDV  EAVIES
Sbjct: 181  LKAAGEMKTKPTQHSVKELRGLGIQPNMLVIRTEEPVEQGIKNKLAQFCDVNSEAVIESR240

Query: 241  DVDHIYQIPLNMQAQNMDQIVCDHLKLETPAADMTEWSAMVDKVMNLEKKVKIALVGKYV300
            DV+H+YQIPLN+QAQ+MDQIVCDHLKL  P ADMTEWSAMVDKVMNL K  KIALVGKYV
Sbjct: 241  DVEHLYQIPLNLQAQSMDQIVCDHLKLNAPQADMTEWSAMVDKVMNLRKTTKIALVGKYV300

Query: 301  ELPDAYLSVVEALKHSGYVNDVAIDLKWVNAAEVTEDNIKELVGDADGIIVPGGFGQRGS360
            ELPDAYLSVVEALKHSGY ND AIDLKWVNA +VT DN  +L+GDADGIIVPGGFGQRG+
Sbjct: 301  ELPDAYLSVVEALKHSGYANDTAIDLKWVNANDVTVDNAADLLGDADGIIVPGGFGQRGT360

Query: 361  EGKIEAIRYARENDVPMLGVCLGMQLTCVEFARNVLNLHGANSAELDPKTPFPIIDIMRD420
            EGKI+AIRYARENDVPMLG+CLGMQLTCVEFAR+VLN+ GANS EL+P T +PIIDIMRD
Sbjct: 361  EGKIQAIRYARENDVPMLGICLGMQLTCVEFARHVLNMEGANSFELEPSTKYPIIDIMRD420

Query: 421  QIDIEDMGGTLRLGLYPCKLKSGSRAAAAYNNQEVVQRRHRHRYEFNTKFREQFEAAGFV480
            QIDIEDMGGTLRLGLYPCKLK GS+AA AYNNQEVVQRRHRHRYEFN KFR +FEAAGFV
Sbjct: 421  QIDIEDMGGTLRLGLYPCKLKPGSKAAMAYNNQEVVQRRHRHRYEFNNKFRPEFEAAGFV480

Query: 481  FSGVSPDNRLMEVVELPEKKFFVAAQYHPELQSRPNHAEELYTAFVTAAVEN       532
            FSGVSPDNRL+E+VEL EKKFFVAAQYHPELQSRPN  EELYTAFVTAA++N
Sbjct: 481  FSGVSPDNRLVEIVELKEKKFFVAAQYHPELQSRPNRPEELYTAFVTAAIKN       532
```

Based on this analysis, it was predicted that these proteins and their epitopes could be useful antigens for vaccines or diagnostics.

Example 2285

A DNA sequence (GBSx2419) was identified in *S. agalactiae* <SEQ ID 7047> which encodes the amino acid sequence <SEQ ID 7048>. Analysis of this protein sequence reveals the following:

```
Possible site: 34
>>> Seems to have an uncleavable N-terminal signal sequence
INTEGRAL Likelihood = -9.92 Transmembrane 13-29 (3-34)
----- Final Results -----
    bacterial membrane --- Certainty = 0.4970 (Affirmative) <succ>
     bacterial outside --- Certainty = 0.0000 (Not Clear) <succ>
    bacterial cytoplasm --- Certainty = 0.0000 (Not Clear) <succ>
```

A related GBS nucleic acid sequence <SEQ ID 9285> which encodes amino acid sequence <SEQ ID 9286> was also identified.

The protein has homology with the following sequences in the GENPEPT database.

```
>GP:CAB14296 GB:Z99116 yqkD [Bacillus subtilis]
Identities = 79/289 (27%), Positives = 139/289 (47%), Gaps = 8/289 (2%)
Query:   1 MKKIRLSKFIKMIVVILFLISVAASFYFFHVAQVRDDKSFISNGQRKPGNSLYAYDKSFD     60
             MKKI L+  I  +V + I + S     + + D+   I  +   G+ ++    +SF+
Sbjct:   1 MKKILLA--IGALVTAVIAIGIVFSHMILFIKKKTDED--IIKRETDNGHDVF---ESFE     53

Query:  61 KLLKQKIEMTNQNIKQVAWYVPAVKKTHKTAVVVHGFANSKENMKAYGWLFHKLGYNVLM    120
             ++ K   ++     +   Y A   T  T ++ HG   + N   Y LF  LG+NVL+
Sbjct:  54 QMEKTAFVIPSAYGYDIKGYHVAPHDTPNTIIICHGVTMNVLNSLKYMHLFLDLGWNVLI    113

Query: 121 PDNIAHGESHGOLIGYGWNDRENIIKWTEMIVDK-NPSSQITLFGVSMGGATVMMASGEK    179
              D+  HG+S G+    YG+ +++++ K   ++ +K N    I + G SMG  T ++ +G
Sbjct: 114 YDHRRHGQSGGKTTSYGFYEKDDLNKVVSLLKNKTNHRGLIGIHGESMGAVTALLYAGAH    173

Query: 180 LPSQVVNIIEDCGYSSVWDELKFQAKEMYGLPAPPLLYEVSTISKIRAGFSYGQASSVEQ    239
                       I DC ++    ++L ++ +  Y LP++PLL        K+R G+   + S +
Sbjct: 174 CSDGADFYIADCPFACFDEQLAYRLRAEYRLPSWPLLPIADFFLKLAGGYRAREVSPLAV    233

Query: 240 LKKNNLPALFIHGDKDNFVPTSMVYDNYKATAGKKELYIVKGAKHAKSF              288
             + K    P LFIH   D+++P S    Y+    G K LYI +   +HA S+
Sbjct: 234 IDKIEKPVLFIHSKDDDYIPVSSTERLYEKKRGPKALYIAENGEHAMSY              282
```

A related DNA sequence was identified in *S. pyogenes* <SEQ ID 7049> which encodes the amino acid sequence <SEQ ID 7050>. Analysis of this protein sequence reveals the following:

```
Possible site: 24
>>> Seems to have an uncleavable N-terminal signal sequence
INTEGRAL Likelihood = -7.48 Transmembrane 10-26 (3-32)
----- Final Results -----
    bacterial membrane --- Certainty = 0.3994 (Affirmative) <succ>
     bacterial outside --- Certainty = 0.0000 (Not Clear) <succ>
    bacterial cytoplasm --- Certainty = 0.0000 (Not Clear) <succ>
```

The protein has homology with the following sequences in the databases:

```
>GP:CAB14296 GB:Z99116 yqkD [Bacillus subtilis]
Identities = 88/295 (29%), Positives = 145/295 (48%), Gaps = 4/295 (1%)
Query:  10 LGILFLLITLISVGASFYFFHVAQIREEKSFINNKKRSTNNPLYPAEQSFDALPYEKRQL     69
             L I  L+  +I++G     F  H+       ++K+  + KR T+N +    +SF+ +         +
Sbjct:   6 LAIGALVTAVIAIG--IVFSHMILFIKKKTDEDIIKRETDNG-HDVFESFEQMEKTAFVI     62

Query:  70 TNRGLKQVGWYLPAAQKTKKTAIVVHGFTNDKEDMKPYAMLFHDLGYNVLMPDNEAHGES    129
              +       +   Y A   T  T I+ HG T +  +    Y LF  DLG+NVL+ D+   HG+S
Sbjct:  63 PSAYGYDIKGYHVAPHDTPNTIIICHGVTMNVINSLKYMHLFLDLGWNVLIYDHRRHGQS    122

Query: 130 EGNLIGYGWNDRLNVMAWTDQLI-KENPESQITLFGLSMGAATVMMASGERLPAQVTSLI    188
             G     YG+ ++ ++      L   K N     I + G SMGA T ++ +G               I
Sbjct: 123 GGKTTSYGFYEKDDLNKVVSLLKNKTNHRGLIGIHGESMGAVTALLYAGAHCSDGADFYI    182

Query: 189 EDCGYASVWDELKFQAKAMYNLPAFPLLYEVSALSKIRAGFSYGEASSVKQLAKNKRPTL    248
              DC +A    ++L ++ +A Y LP++PLL         K+R G+     E S +     + K ++P L
Sbjct: 183 ADCPFACFDEQLAYRLRAEYRLPSWPLLPIADFFLKLRGGYRAREVSPLAVIDKIEKPVL    242

Query: 249 FIHGDKDDFVPTKMVYDNYKATKGPKEILIVKGAKHAKSFETNPEQYQKKIAAFL         303
             FIH   DD++P   +   Y+   +GPK + +   +HA S+  N     Y+K     FL
Sbjct: 243 FIHSKDDDYIPVSSTERLYEKKRGPKALYIAENGEHAMSYTKNRHTYRKTVQEFL         297
```

An alignment of the GAS and GBS proteins is shown below.

```
Identities = 203/294 (69%), Positives = 246/294 (83%)
Query:   1 MKKIRLSKFIKMIVVILFLISVAASFYFPHVAQVRDDKSFISNGQRKPGNSLYAYDKSFD   60
           MK IR++K++ ++ +++ LISV ASFYFFHVAQ+R++KSFI+N +R    N LY  ++SFD
Sbjct:   1 MKTIRIAKYLGILFLLITLISVGASFYFFHVAQIREEKSFINNKKRSTNNPLYPAEQSFD   60

Query:  61 KLLKQKIEMTNQNIKQVAWYVPAVKKTHKTAVVVHGFANSKENMKAYGWLFHKLGYNVLM  120
           L   +K ++TN+  +KQV WY+PA +KT KTA+VVHGF N KE+MK Y  LFH LGYNVLM
Sbjct:  61 ALPYEKRQLTNRGLKQVGWYLPAAQKTKKTAIVVHGFINDKEDMKPYAMLFHDLGYNVLM  120

Query: 121 PDNIAHGESHGQLIGYGWNDRENIIKWTEMIVDKNPSSQIILFGVSMGGATVMMASGEKL  180
           PDN AHGES G LIGYGWNDR N++ WT+ ++ +NP SQITLFG+SMG ATVMMASGE+L
Sbjct: 121 PDNEAHGESEGNLIGYGWNDRLNVMAWIDQLIKENPESQIILFGLSMGAATVMMASGERL  180

Query: 181 PSQVVNIIEDCGYSSVWDELKFQAKEMYGLPAPPLLYEVSTISKIRAGFSYGQASSVEQL  240
           P+QV ++IEDCGY+SVWDELKFQAK MY LPAFPLLYEVS +SKIRAGFSYG+ASSV+QL
Sbjct: 181 PAQVISLIEDCGYASVWDELKFQAKAMYNLPAFPLLYEVSALSKIRAGFSYGEASSVKQL  240

Query: 241 KKNNLPALFIHGDKDNFVPTSMVYDNYKATAGKKELYIVKGAKHAKSFETEPEK        294
           KN  P LFIHGDKD+FVPT MVYDNYKAT G KE+ IVKGAKHAKSFET PE+
Sbjct: 241 AKNKRPTLFIHGDKDDFVPTKMVYDNYKATKGPKEILIVKGAKHAKSFETNPEQ        294
```

SEQ ID 9286 (GBS662) was expressed in *E. coli* as a GST-fusion product. SDS-PAGE analysis of total cell extract is shown in FIG. 136 (lane 8-10; MW 63 kDa) and in FIG. 187 (lane 4; MW 63 kDa).

GBS662-GST was purified as shown in FIG. 237, lane 7.

Based on this analysis, it was predicted that these proteins and their epitopes could be useful antigens for vaccines or diagnostics.

Example 2286

A DNA sequence (GBSx2420) was identified in *S. agalactiae* <SEQ ID 7051> which encodes the amino acid sequence <SEQ ID 7052>. This protein is predicted to be aspartate-ammonia ligase (asnA). Analysis of this protein sequence reveals the following:

Possible site: 60
>>> Seems to have no N-terminal signal sequence
----- Final Results -----
  bacterial cytoplasm --- Certainty = 0.2898 (Affirmative) <succ>
    bacterial membrane --- Certainty = 0.0000 (Not Clear) <succ>
      bacterial outside --- Certainty = 0.0000 (Not Clear) <succ>

A related GBS nucleic acid sequence <SEQ ID 9309> which encodes amino acid sequence <SEQ ID 9310> was also identified.

The protein has homology with the following sequences in the GENPEPT database.

```
>GP:AAC22222 GB:U32738 aspartate--ammonia ligase (asnA)
[Haemophilus influenzae Rd]
Identities = 246/300 (82%), Positives = 268/300 (89%)
         Query:   1 MIDKLEIVEVQGPILSQVGDGMQDNLSGIEHPVSVKVLNIPEAEFEVVHSLAKWKRHTLA   60
                    +I++L I+EVQGPILSQVG+GMQDNLSGIE  V V V  IP A  FEVVHSLAKWKRHTLA
         Sbjct:  23 LIEQLGIIEVQGPILSQVGNGMQDNLSGIEKAVQVNVKCIPNAVFEVVHSLAKWKRHTLA   82

Query:  61 REGFNEGEGLEVHMKALRPDEDSLDPTHSVYVDQWDWEKVIPDGRRNLDYLKETVEKIYK  120
                    RF F E EGLEVHMKALRPDEDSLDPTHSVYVDQWDWEKVIP+GRRN  YLKETV  IY+
         Sbjct:  83 RFNFKEDEGLFVHMKALRPDEDSLDPTHSVYVDQWDWEKVIPEGRRNFAYLKETVNSIYR  142

Query: 121 AIRLTELAVEARFDIESILPKRITFIHTEELVEKYPDLSPKERENAIAKEYGAVFLIGIG  180
                    AIRLTELAVEARFDI SILPK+ITF+H+E+LV++YPD;S KERENAI KEYGAVFLIGIG
         Sbjct: 143 AIRLTELAVEAREDIPSILPKQITFVHSEDLVKRYPDLSSKERENAICKEYGAVFLIGIG  202

Query: 181 GELADGKPHDGRAPDYDDWTTPSENGFKGLNGDILVWNEQLGTAFELSSMGIRVDEDALK  240
                    G+L+DGKPHDGRAPDYDDWTT SENG+KGLNGDILVWN+QLG AFELSSMGIRVDE AL+
         Sbjct: 203 GKLSDGKPHDGRAPDYDDWTTESENGYKGLNGDILVWNDQLGKAFELSSMGIRVDESALR  262

Query: 241 RQVVLTGDEDRLEFEWHKTLLRGFFPLTIGGGIGQSRLAMFLLRKXHIGEVQSSVWPKEV  300
                       QV LTGDED L+ +WH+ LL G  PLTIGGGIGQSRLAM LLRK HIGEVQSSVWPKE+
         Sbjct: 263 LQVGLTGDEDHLKMDWHQDLLNGKLPLTIGGGIGQSRLAMLLLRKKHIGEVQSSVWPKEM  322
```

A related DNA sequence was identified in *S. pyogenes* <SEQ ID 7053> which encodes the amino acid sequence <SEQ ID 7054>. Analysis of this protein sequence reveals the following:

Possible site: 34
>>> Seems to have no N-terminal signal sequence
INTEGRAL Likelihood = −0.16 Transmembrane 189-205 (189-205)
----- Final Results -----
  bacterial membrane --- Certainty = 0.1065 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the databases:

```
>GP:AAC22222 GB:U32738 aspartate--ammonia ligase (asnA)
[Haemophilus influenzae Rd]
Identities = 255/330 (77%), Positives = 289/330 (87%)
Query:   1  MKKSFIHQQEEISFVKNTFTQYLIAKLDVVEVQGPILSRVGDGMQDNLSGTENPVSVNVL   60
            MKK+FI QQ+EISFVKNTFTQ LI +L ++EVQGPILS+VG+GMQDNLSG E  V VNV
Sbjct:   1  MKKTFILQQQEISFVKNTFTQNLIEQLGIIEVQGPILSQVGNGMQDNLSGIEKAVQVNVK   60

Query:  61  KIPNATFEVVHSLAKWKRHTLARFGFNEGEGLVVNMKALRPDEDSLDQTHSVYVDQWDWE  120
             IPNA FEVVHSLAKWKRHTLARF F E EGL V+MKALRPDEDSLD THSVYVDQWDWE
Sbjct:  61  CIPNAVFEVVHSLAKWKRHTLARFNFKEDEGLFVHMKALRPDEDSLDPTHSVYVDQWDWE  120

Query: 121  KVIPDGKRNLAYLKETVETIYKVIRLTELAVEARYDIEAVLPKKITFIHTEELVAKYPDL  180
            KVIP+G+RN AYLKETV +IY+ IRLTELAVEAR+DI ++LPK+ITF+H+E+LV +YPDL
Sbjct: 121  KVIPEGRRNFAYLKETVNSIYRAIRLTELAVEARFDIPSILPKQITFVHSEDLVKRYPDL  180

Query: 181  TPKERENAITKEFGAVFLIGIGGVLPDGKPHDGRAPDYDDWTTETENGYHGLNGDILVWN  240
            + KERENAI KE+GAVFLIGIGG L DGKPHDGRAPDYDDWTTE+ENGY GLNGDILVWN
Sbjct: 181  SSKERENAICKEYGAVFLIGIGGKLSDGKPHDGRAPDYDDWTTESENGYKGLNGDILVWN  240

Query: 241  DQLGSAFELSSMGIRVDEEALKRQVEMTGDQDRLGFDWHKSLLNGLFPLTIGGGIGQSRM  300
            DQLG AFELSSMGIRVDE AL+ QV +TGD+D L  DWH+ LLNG  PLTIGGGIGQSR+
Sbjct: 241  DQLGKAFELSSMGIRVDESALRLQVGLTGDEDHLKMDWHQDLLNGKLPLTIGGGIGQSRL  300

Query: 301  VMFLLRKQHIGEVQTSVWPQEVRDSYDNIL                               330
            M LLRK+HIGEVQ+SVWP+E+ + + NIL
Sbjct: 301  AMLLLRKKHIGEVQSSVWPKEMLEEFSNIL                               330
```

An alignment of the GAS and GBS proteins is shown below.

```
Identities = 254/303 (83%), Positives = 280/303 (91%)
Query:   1  MIDKLEIVEVQGPILSQVGDGMQDNLSGIEHPVSVKVLNIPEAEFEVVHSLAKWKRHTLA   60
            +I KL++VEVQGPILS+VGDGMQDNLSG E+PVSV VL IP A FEVVHSLAKWKRHTLA
Sbjct:  23  LIAKLDVVEVQGPILSRVGDGMQDNLSGTENPVSVNVLKIPNATFEVVHSLAKWKRHTLA   82

Query:  61  RFGFNEGEGLFVHMKALRPDEDSLDPTHSVYVDQWDWEKVIPDGRRNLDYLKETVEKIYK  120
            RFGFNEGEGL V+MKALRPDEDSLD THSVYVDQWDWEKVIPDG+RNL YLKETVE IYK
Sbjct:  83  RFGFNEGEGLVVNMKALRPDEDSLDQTHSVYVDQWDWEKVIPDGKRNLAYLKETVETIYK  142

Query: 121  AIRLTELAVEARFDIESILPKRITFIHTEELVEKYPDLSPKERENAIAKEYGAVFLIGIG  180
             IRLTELAVEAR+DIE++LPK+ITFIHTEELV KYPDL+PKERENAI KE+GAVFLIGIG
Sbjct: 143  VIRLTELAVEARYDIEAVLPKKITFIHTEELVAKYPDLTPKERENAITKEFGAVFLIGIG  202

Query: 181  GELADGKPHDGRAPDYDDWTTPSENGFKGLNGDILVWNEQLGTAFELSSMGIRVDEDALK  240
            G L DGKPHDGRAPDYDDWTT +ENG+ GLNGDILVWN+QLG+AFELSSMGIRVDE+ALK
Sbjct: 203  GVLPDGKPHDGRAPDYDDWTTETENGYHGLNGDILMWNDQLGSAFELSSMGIRVDEEALK  262

Query: 241  RQVVLTGDEDRLEFEWHKTLLRGFFPLTIGGGIGQSRLAMFLLRKXHIGEVQSSVWPKEV  300
            RQV +TGD+DRL F+WHK+LL G FPLTIGGGIGQSR+ MFLLRK HIGEVQ+SVWP+EV
Sbjct: 263  RQVEMTGDQDRLGFDWHKSLLNGLFPLTIGGGIGQSRMVMFLLRKQHIGEVQTSVWPQEV  322

Query: 301  RDT                                                           303
            RD+
Sbjct: 323  RDS                                                           325
```

Based on this analysis, it was predicted that these proteins and their epitopes could be useful antigens for vaccines or diagnostics.

Example 2287

A DNA sequence (GBSx2421) was identified in *S. agalactiae* <SEQ ID 7055> which encodes the amino acid sequence <SEQ ID 7056>. Analysis of this protein sequence reveals the following:

Possible site: 27
>>> Seems to have no N-terminal signal sequence
----- Final Results -----
  bacterial cytoplasm --- Certainty = 0.3163 (Affirmative) <succ>
   bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2288

A DNA sequence (GBSx2422) was identified in *S. agalactiae* <SEQ ID 7057> which encodes the amino acid sequence <SEQ ID 7058>. Analysis of this protein sequence reveals the following:

Possible site: 25
>>> Seems to have a cleavable N-terminal signal sequence
----- Final Results -----
    bacterial outside --- Certainty = 0.3000 (Affirmative) <succ>

A related GBS nucleic acid sequence <SEQ ID 9007> which encodes amino acid sequence <SEQ ID 9008> was also identified.

The protein has homology with the following sequences in the GENPEPT database.

```
>GP:AAD56628 GB:AF165218 Bta [Streptococcus pneumoniae]
Identities = 30/97 (30%), Positives = 50/97 (50%), Gaps = 3/97 (3%)
Query:  50  KALVSKSQQSEATIFIGRPTCQYCRAFLPKLLKSQATLHSKIYYLDSQKYKG-KRLKSFF  108
            +A  +  ++  AT FIGR TC YCR F    L    A   + IY+++S++      L++F
Sbjct:  18  RAQEALDKKETATFFIGRKTCPYCRKFAGTLSGVVAETKAHIYFINSEEASQLNDLQAFR  77

Query: 109  KKHHITTVPNLAHYQQGKMTKYLVQGSQATPQQIQTF  145
            ++ I TVP   H    G++   +   S  + Q+I+ F
Sbjct:  78  SRYGIPTVPGFVHITDGQIN--VRCDSSMSAQEIKDF  112
```

SEQ ID 9008 (GBS134) was expressed in *E. coli* as a His-fusion product. SDS-PAGE analysis of total cell extract is shown in FIG. 40 (lane 2; MW 17 kDa). It was also expressed in *E. coli* as a GST-fusion product. SDS-PAGE analysis of total cell extract is shown in FIG. 46 (lane 4; MW 42 kDa).

GBS134-GST was purified as shown in FIG. 204, lane 10.

Based on this analysis, it was predicted that this protein and its epitopes, could be useful antigens for vaccines or diagnostics.

Example 2289

A DNA sequence (GBSx2423) was identified in *S. agalactiae* <SEQ ID 7059> which encodes the amino acid sequence <SEQ ID 7060>. Analysis of this protein sequence reveals the following:

Possible site: 58
>>> Seems to have no N-terminal signal sequence
----- Final Results -----
   bacterial cytoplasm --- Certainty = 0.0735 (Affirmative) <succ>
   bacterial membrane --- Certainty = 0.0000 (Not Clear) <succ>
   bacterial outside --- Certainty = 0.0000 (Not Clear) <succ>

A related GBS nucleic acid sequence <SEQ ID 9603> which encodes amino acid sequence <SEQ ID 9604> was also identified.

The protein has homology with the following sequences in the GENPEPT database.

There is also homology to SEQ ID 132.

Based on this analysis, it was predicted that this protein and its epitopes, could be useful antigens for vaccines or diagnostics.

Example 2290

A DNA sequence (GBSx2424) was identified in *S. agalactiae* <SEQ ID 7061> which encodes the amino acid sequence <SEQ ID 7062>. Analysis of this protein sequence reveals the following:

Possible site: 14
>>> Seems to have no N-terminal signal sequence
----- Final Results -----
   bacterial cytoplasm --- Certainty = 0.4984 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
GP:BAB06309 GB:AP001516 unknown conserved protein [Bacillus halodurans]

Identities = 78/178 (43%), Positives = 115/178 (63%), Gaps = 3/178 (1%)

Query:   3  MRVVAGTEGGRPLKTLDGKTTRPTTDKVKGAIFNMIGPFFEGGRVLDLFSGSGSLAIEAI  62
            MRV+AG    G  LK + G  TRPTTDKVK AIFNMIGPFF+GG  LDL+ GSG L IEA+
Sbjct:   1  MRVIAGEQKGLTLKAVPGHKTRPTTDKVKEAIFNMIGPFFDGGIGLDLYGGSGGLGIEAL  60

Query:  63  SRGMDQAVLVEKDRRAQVVIQENIAMTKSPEQFQLLKMEANRALEQLTGQ---FDLVLLD  119
            SRG+++ + V++ +RA    I++N++       + ++ + +A RAL+ LT +    F  V LD
Sbjct:  61  SRGVERMIFVDQQKRAIETIKQNLSHCGLEGRAEVYRNDAKRALQVLTKRGIVFAYVFLD  120

Query: 120  PPYAKEEIVKQIQIMDSKGLLGDDIMIACETDKSVDLPEEIASEGIWKQKIYGISKVT  177
            PPYAK+  I   + I+ +  GLL    ++ CE D+     LP++I       K++ YG + +T
Sbjct: 121  PPYAKQTIKNDLAILANHGLLEEGGVVVCEHDRDTMLPDQIEYAVKHKEETYGDIMIT  178
```

```
>GP:CAB96619 GB:AJ400630 hypothetical protein
[Streptococcus pneumoniae bacteriophage MM1]
Identities = 175/254 (68%), Positives = 219/254 (85%)
Query:   2 LRRHIYSMLEEHXHLQPEIKYHQKTNLRKNRVYTVFIEEKVDVILADLKLADAFFGIETG    61
           L RH+Y      ++ EI++HQ++NLRKNRVYTVF +EKV  +L+DL LAD+FFG+ETG
Sbjct:  50 LARHLYESFLHFYEIKSEIRHHQRSNLRKNRVYTVFTDEKVQDLLSDLELADSFFGLETG   109

Query:  62 IEHSILDNDENGRAYLRGAFLSTGTVREPDSGKYQLEIFSVYLDHAQDLANLMKKFMLDA   121
           I+ +IL ++E GRAYL GAFL+ G++R+P+SGKYQLEI SVYLDHAQ +A+L+++F+LDA
Sbjct: 110 IDEAILSDEEAGRAYLCGAFLANGSIRDPESGKYQLEISSVYLDHAQGIASLLQQFLLDA   169

Query: 122 KVIEHKHGAVTYLQKAEDIMDFLIVIDAMEARDAFEEIKMIRETRNDINRANNVETANIA   181
           KV+E K GAVTYLQ+AEDIMDFLIVI AM+ARD FE +K++RETRND+NRANN ETANIA
Sbjct: 170 KVLERKKGAVTYLQRAEDIMDFLIVIGAMQARDDFERVKILRETRNDLNRANNAETANIA   229

Query: 182 RTITASMKTINNIIKIMDTIGFDALPSDLRQVAQVRVAHPDYSIQQIADSLETPLSKSGV   241
           RT++ASMKTINNI KI D +G + LP DL++VAQ+R+ HPDYSIQQ+ADSL TPL+KSGV
Sbjct: 230 RTVSASMKTINNISKIKDIMGLENLPVDLQEVAQLRIQHPDYSIQQLADSLSTPLTKSGV   289

Query: 242 NHRLRKINKIADEL                                                255
           NHRLRKINKIADEL
Sbjct: 290 NHRLRKINKIADEL                                                303
```

There is also homology to SEQ ID 5540:

```
Identities = 186/254 (73%), Positives = 227/254 (89%)
Query:   2 LRRHIYSMLEEHXHLQPEIKYHQKTNLRKNRVYTVFIEEKVDVILADLKLADAFFGIETG    61
           + R+IYS++E+   + PEI+YHQKTNLRKNRVYTV++E+ V+ ILADLKLAD+FFG+ETG
Sbjct:  50 IARYIYSLIEDAYVIVPEIRYHQKTNLRKNRVYTVYVEQGVETILADLKLADSFFGLETG   109

Query:  62 IEHSILDNDENGRAYLRGAFLSTGTVREPDSGKYQLEIFSVYLDHAQDLANLMKKFMLDA   121
           IE  +L +D  GR+YL+GAFL+ G++R+P+SGKYQLEI+SVYLDHAQDLA LM+KFMLDA
Sbjct: 110 IEPQVLSDDNAGRSYLKGAFLAAGSIRDPESGKYQLEIYSVYLDHAQDLAQLMQKFMLDA   169

Query: 122 KVIEHKHGAVTYLQKAEDIMDFLIVIDAMEARDAFEEIKMIRETRNDINRANNVETANIA   181
           K IEHK GAVTYLQKAEDIMDFLI+I AM  ++ FE IK++RE RNDINRANN ETANIA
Sbjct: 170 KTIEHKSGAVTYLQKAEDIMDFLIIIGAMSCKEDFEAIKLLREARNDINRANNAETANIA   229

Query: 182 RTITASMKTINNIIKIMDTIGFDALPSDLRQVAQVRVAHPDYSIQQIADSLETPLSKSGV   241
           +TI+ASMKTINNIIKIMDTIG ++LP +L+QVAQ+RV HPDYSIQQ+AD+LE P++KSGV
Sbjct: 230 KTISASMKTINNIIKIMDTIGLESLPIELQQVAQLRVKHPDYSIQQVADALEFPITKSGV   289

Query: 242 NHRLRKINKIADEL                                                255
           NHRLRKINKIAD+L
Sbjct: 290 NHRLRKINKIADDL                                                303
```

Based on this analysis, it was predicted that these proteins and their epitopes could be useful antigens for vaccines or diagnostics.

Example 2291

A DNA sequence (GBSx2425) was identified in *S. agalactiae* <SEQ ID 7063> which encodes the amino acid sequence <SEQ ID 7064>. Analysis of this protein sequence reveals the following:

Possible site: 14
>>> Seems to have no N-terminal signal sequence
----- Final Results -----
  bacterial cytoplasm --- Certainty = 0.0297 (Affirmative) <succ>
    bacterial membrane --- Certainty = 0.0000 (Not Clear) <succ>
    bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2292

A DNA sequence (GBSx2428) was identified in *S. agalactiae* <SEQ ID 7065> which encodes the amino acid sequence <SEQ ID 7066>. Analysis of this protein sequence reveals the following:

Possible site: 31
>>> Seems to have no N-terminal signal sequence
----- Final Results -----
  bacterial cytoplasm --- Certainty = 0.2706 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database.

```
>GP:CAB54571 GB:AJ006393 response regulator [Streptococcus pneumoniae]
Identities = 139/190 (73%), Positives = 166/190 (87%)
Query:   8 IKIVLVDDHEMVRLGLKSFLNLQADVEVIGEASNGLEGIKKALELRPDVVVMDLVMPEMD    67
           +KI+LVDDHEMVRLGLKS+ +LQ DVEV+GEASNG +GI   ALELRPDV+MD+VMPEM+
Sbjct:   1 MKILLVDDHEMVRLGLKSYFDLQDDVEVVGEASNGSQGIDLALELRPDVIVMDIVMPEMN   60
```

```
-continued
Query:   68  GVEATLALLKDWPEAAILVLTSYLDNEKIYPVIEAGAKGYMLKTSSAAEILNAIRKVSRG  127
             G++ATLA+LK+WPEA IL++TSYLDNEKI PV++AGAKGYMLKTSSA E+L+A+ KV+ G
Sbjct:   61  GIDATLAILKEWPEAKILIVTSYLDNEKIMPVLDAGAKGYMLKTSSADELLHAVSKVAAG  120

Query:  128  EQAIENEVDKKIKAHDKCPALHEGLTARERDILNLLAKGYDNQRIADELFISLKTVKTHV  187
             E AIE EV KK++ H      LHE LTARERD+L L+AKGY+NQRIAD+LFISLKTVKTHV
Sbjct:  121  ELAIEQEVSKKVEYHRNHMELHEELTARERDVLQLIAKGYENQRIADDLFISLKTVKTHV  180

Query:  188  SNILGKLNGS                                                  197
             SNIL KL  S
Sbjct:  181  SNILAKLEVS                                                  190
```

There is also high homology to SEQ ID 2996:

```
Identities = 158/198 (79%), Positives = 176/198 (88%), Gaps = 1/198 (0%)
Query:    5  MDKIKIVLVDDHEMVRLGLKSFLNLQADVEVIGEASNGLEGIKKALELRPDVVVMDLVMP   64
             M KIK++LVDDHEMVR+GLKSFLNLQAD++V GEASNG EG+  AL L+PDV+VMDLVMP
Sbjct:    3  MSKIKVILVDDHEMVRMGLKSFLNLQADIDVVGEASNGREGVDLALALKPDVLVMDLVMP   62

Query:   65  EMDGVEATLALLKDWPEAAILVLTSYLDNEKIYPVIEAGAKGYMLKISSAAEILNAIRKV  124
             E+ GVEATL +LK W EA +LVLISYLDNEKIYPVI+AGAKGYMLKTSSAAEILNAIRKV
Sbjct:   63  ELGGVEATLEVLKKWKEAKVLVLTSYLDNEKIYPVIDAGAKGYMLKTSSAAEILNAIRKV  122

Query:  125  SRGEQAIENEVDKKIKAHDKCPALHEGLTARERDILNLLAKGYDNQRIADELFISLKTVK  184
             S+GE AIE EVDKKIKAHD+ P LHE LTARE DIL+LLAKGYDNQ IADELFISLKTVK
Sbjct:  123  SKGELAIETEVDKKIKAHDQHPDLHEELTAREYDILHLLAKGYDNQTIADELFISLKTVK  182

Query:  185  THVSNILGKLN-GSRSNS                                          201
             THVSNIL KLG    R+ +
Sbjct:  183  THVSNILAKLEVGDRTQA                                          200
```

Based on this analysis, it was predicted that these proteins and their epitopes could be useful antigens for vaccines or diagnostics.

Example 2293

A DNA sequence (GBSx2429) was identified in *S. agalactiae* <SEQ ID 7067> which encodes the amino acid sequence <SEQ ID 7068>. This protein is predicted to be histidine kinase (narQ). Analysis of this protein sequence reveals the following:

Possible site: 56
>>> Seems to have no N-terminal signal sequence
----- Final Results -----
    bacterial cytoplasm --- Certainty = 0.3944 (Affirmative) <succ>
      bacterial membrane --- Certainty = 0.0000 (Not Clear) <succ>
       bacterial outside --- Certainty = 0.0000 (Not Clear) <succ>

The protein has homology with the following sequences in the GENPEPT database.

```
>GP:CAB54570 GB:AJ006393 histidine kinase [Streptococcus pneumoniae]
Identities = 32/55 (58%), Positives = 49/55 (88%)
Query:    1  MIDNGIGFDMDSVYDLSYGLKNIEDRVEDLAGNLQLLSQPGKGVAMDIRLPLVNQ   55
             ++DNGIGF + S+ DLSYGL+NI++RVED+AG +QLL+ P +G+A+DIR+PL+++
Sbjct:  276  VVDNGIGFQLGSLDDLSYGLRNIKERVEDMAGTVQLLTAPKQGLAVDIRIPLLDK  330
```

There is also homology to SEQ ID 2992:

```
Identities = 44/59 (74%), Positives = 51/59 (85%)
Query:    1  MIDNGIGFDMDSVYDLSYGLKNIEDRVEDLAGNLQLLSQPGKGVAMDIRLPLVNQSEDK   59
             MID+G+GFDMD V DLSYGLKNIEDRV DLAGNL L+SQ GKGV+MDIRLP+V   +D+
Sbjct:  276  MIDDGVGFDMDQVRDLSYGLKNIEDRVNDLAGNLHLISQKGKGVSMDIRLPIVKGDDDE  334
```

Based on this analysis, it was predicted that these proteins and their epitopes could be useful antigens for vaccines or diagnostics.

Example 2294

A DNA sequence (GBSx2430) was identified in *S. agalactiae* <SEQ ID 7069> which encodes the amino acid sequence <SEQ ID 7070>. This protein is predicted to be RfbQRSO155-1. Analysis of this protein sequence reveals the following:

Possible site 41
>>> Seems to have no N-terminal signal sequence
----- Final Results -----
    bacterial cytoplasm --- Certainty = 0.1120 (Affirmative) <succ>
      bacterial membrane --- Certainty = 0.0000 (Not Clear) <succ>
       bacterial outside --- Certainty = 0.0000 (Not Clear) <succ>

There is also homology to SEQ ID 7072:

```
Identities = 171/172 (99%), Positives = 172/172 (99%)
Query:   1  MGQVAVEEKSNEIVAIPQLLRTIDIRKSIVTIDAMGTQTAIVDTIIKGKADYCLAVKGNQ    60
            +GQVAVEEKSNEIVAIPQLLRTIDIRKSIVTIDAMGTQTAIVDTIIKGKADYCLAVKGNQ
Sbjct: 143  LGQVAVEEKSNEIVAIPQLLRTIDIRKSIVTIDAMGTQTAIVDTIIKGKADYCLAVKGNQ   202

Query:  61  ETLYDDIALYFSDVNLLEELQENAQYYQTVEKSRGQIEVREYWVSSDIKWLCQNHPKWHK   120
            ETLYDDIALYFSDVNLLEELQENAQYYQTVEKSRGQIEVREYWVSSDIKWLCQNHPKWHK
Sbjct: 203  ETLYDDIALYFSDVNLLEELQENAQYYQTVEKSRGQIEVREYWVSSDIKWLCQNHPKWHK   262

Query: 121  LRGIGMTRNTIDKDGQLSQENRYFIFSFKPDVLTFANCVRGHWQIESMHWLL          172
            LRGIGMTRNTIDKDGQLSQENRYFIFSFKPDVLTFANCVRGHWQIESMHWLL
Sbjct: 263  LRGIGMTRNTIDKDGQLSQENRYFIFSFKPDVLTFANCVRGHWQIESMHWLL          314
```

Based on this analysis, it was predicted that these proteins and their epitopes could be useful antigens for vaccines or diagnostics.

Example 2295

A DNA sequence (GBSx2431) was identified in *S. agalactiae* <SEQ ID 7073> which encodes the amino acid sequence <SEQ ID 7074>. This protein is predicted to be translation initiation factor if-3 homolog dsg (infC). Analysis of this protein sequence reveals the following:

Possible site: 42
>>> Seems to have no N-terminal signal sequence
----- Final Results -----
  bacterial cytoplasm --- Certainty = 0.1787 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:CAA.68920 GB:Y07640 translation initiation factor, IF3
[Listeria monocytogenes]
Identities = 112/169 (66%), Positives = 134/169 (79%)
Query:   7  KDLFINDEIRVREVRLVGLEGEQLGIKPLSEAQAIADDANVDLVLIQPQATPPVAKIMDY    66
            KD+ +ND IR REVRL+  +GEQLG+K   +A   IA+ AN+DLVL+ P A PPVA+IMDY
Sbjct:   3  KDMLVNDGIRAREVRLIDQDGEQLGVKSKIDALQIAEKANLDLVLVAPTAKPPVARIMDY    62

Query:  67  GKFKFEYQKKQKEQRKKQSVVTVKEVRLSPVIDKGDFETKLRNGRKFLEKGNKVKVSIRF   126
            GKF+FE QKK KE RK Q V+ +KEVRLSP ID+ DF+TKLRN RKFLEKG+KVK SIRF
Sbjct:  63  GKFRFEQQKKDKEARKNQKVIVMKEVRLSPTIDEHDFDTKLRNARKFLEKGDKVKCSIRF   122

Query: 127  KGRMITHKEIGAKNLAEFAEATQDIAIIEQRAKMDGRQMFMQLAPIPDK             175
            KGR ITHKEIG KVL  FA+A +D+  IEQR KMDGR MF+ LAP+ +K
Sbjct: 123  KGRAITHKEIGQKVLDRFAKACEDLCTIEQRPKMDGRSMELVLAPLHEK             171
```

A related DNA sequence was identified in *S. pyogenes* <SEQ ID 7075> which encodes the amino acid sequence <SEQ ID 7076>. Analysis of this protein sequence reveals the following:

Possible site: 42
>>> Seems to have no N-terminal signal sequence
----- Final Results -----
  bacterial cytoplasm --- Certainty = 0.2247 (Affirmative) <succ>
  bacterial membrane --- Certainty = 0.0000 (Not Clear) <succ>
  bacterial outside --- Certainty = 0.0000 (Not Clear) <succ>

An alignment of the GAS and GBS proteins is shown below.

```
Identities = 167/176 (94%), Positives = 173/176 (97%)
Query:   1  MKIIAKKDLFINDEIRVREVRLV-                                      60
            GLEGEQLGIKPLSEAQAIADDANVDLVLIQPQATPPV
            +KIIAKKDLFINDEIRVREVRLVGLEGEQLGIKPLSEAQ++AD +NVDLVLIQPQA PPV
Sbjct:   1  VKIIAKKDLFINDEIRVREVRLVGLEGEQLGIKPLSEAQSLADASNVDLVLIQPQAVPPV    60

Query:  61  AKIMDYGKFKFEYQKKQKEQRKKQSVVTVKEVRLSPVIDKGDFETKLRNGRKFLEKGNKV   120
            AK+MDYGKFKFEYQKKQKEQRKKQSVVTVKEVRLSPVIDKGDFETKLRNGRKFLEKGNKV
Sbjct:  61  AKLMDYGKFKFEYQKKQKEQRKKQSVVTVKEVRLSPVIDKGDFETKLRNGRKFLEKGNKV   120

Query: 121  KVSIRFKGRMITHKEIGAKVLAEFAEATQDIAIIEQRAKMDGRQMFMQLAPIPDKK       176
            KVSIRFKGRMITHKEIGAKVLA+FAEATQDIAZIEQRAKMDGRQMFMQLAPI DKK
Sbjct: 121  KVSIRFKGRMITHKEIGAKVLADFAEATQDIAIIEQRAKMDGRQMFMQLAPISDKK       176
```

Example 2296

A DNA sequence (GBSx2432) was identified in *S. agalactiae* <SEQ ID 7077> which encodes the amino acid sequence <SEQ ID 7078>. Analysis of this protein sequence reveals the following:

Possible site: 57
>>> Seems to have no N-terminal signal sequence
----- Final Results -----
   bacterial cytoplasm --- Certainty = 0.1807 (Affirmative) <succ>
    bacterial membrane --- Certainty = 0.0000 (Not Clear) <succ>
     bacterial outside --- Certainty = 0.0000 (Not Clear) <succ>

The protein has homology with the following sequences in the GENPEPT database.

```
>GP:AAC45308 GB:U81957 RNA polymerase beta' subunit [Streptococcus gordonii]
Identities = 262/286 (91%), Positives = 276/286 (95%)
Query:   1   MAAKVVKAGVEEVXIRSVFTCNTRHGVCRHCYGINLATGDAVEVGEAVGTIAAQSIGEPG    60
             MA +VV AGV EV IRSV TCNTRHGVCRHCYGINLATGDAVEVGEAVGTIAAQSIGEPG
Sbjct: 122   MARQVVNAGVTEVTIRSVLTCNTRHGVCRHCYGINLATGDAVEVGEAVGTIAAQSIGEPG   181

Query:  61   TQLTMRTFHTGGVASNTDITQGLPRIQEIFEARNPKGEAVITEVKGEVVAIEEDSSTRTK   120
             TQLTMRTFHTGGVAS++DITQGLPR+QEIFEARNPKGEAVITEVKGEV AIEED+STRTK
Sbjct: 182   TQLTMRTFHTGGVASSSDITQGLPRVQEIFEARNPKGEAVITEVKGEVTAIEEDASTRTK   241

Query: 121   KVFVKGQTGEGEYVVPFTARMKVEVGDEVARGAALTEGSIQPKRLLEVRDTLSVETYLLA   180
             KVFVKGQTGEGEYVVPFTARMKVEVGD+V+RGAALTEGSIQPK LL VRD LSVETYLLA
Sbjct: 242   KVFVKGQTGEGEYVVPFTARMKVEVGDQVSRGAALTEGSIQPKHLLAVRDVLSVETYLLA   301

Query: 181   EVQKVYRSQGVEIGDKHVEVMVRQMLRKVRVMDPGDTDLLPGTLMDISDFTDANKDIVIS   240
             EVQKVYRSQGVEIGDKH+EVMVRQM+RKVRVMDPGDTDLL GTLMDI+DFTDAN+D+VIS
Sbjct: 302   EVQKVYRSQGVEIGDKHIEVMVRQMIRKVRVMDPGDTDLLMGTLMDITDFTDANRDVVIS   361

Query: 241   GGIPATSRPVLMGITKASLETNSFLSAASFQETTRVLTDAAIRGKK               286
             GG+PAT+RPVLMGITKASLETNSFLSAASFQETTRVLTDAAIRGKK
Sbjct: 362   GGVPATARPVLMGITKASLETNSFLSAASFQETTRVLTDAAIRGKK               407
```

There is also homology to SEQ ID 384.

Based on this analysis, it was predicted that this protein and its epitopes, could be useful antigens for vaccines or diagnostics.

Example 2297

A DNA sequence (GBSx2434) was identified in *S. agalactiae* <SEQ ID 7079> which encodes the amino acid sequence <SEQ ID 7080>. Analysis of this protein sequence reveals the following:

Possible site: 24
>>> Seems to have no N-terminal signal sequence
----- Final Results -----
   bacterial cytoplasm --- Certainty = 0.0352 (Affirmative) <succ>
    bacterial membrane --- Certainty = 0.0000 (Not Clear) <succ>
     bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2298

A DNA sequence (GBSx2435) was identified in *S. agalactiae* <SEQ ID 7081> which encodes the amino acid sequence <SEQ ID 7082>. This protein is predicted to be acetoin dehydrogenase (TPP-dependent) beta chain (pdhB). Analysis of this protein sequence reveals the following:

Possible site: 47
>>> Seems to have no N-terminal signal sequence
----- Final Results -----
   bacterial cytoplasm --- Certainty = 0.0266 (Affirmative) <succ>
    bacterial membrane --- Certainty = 0.0000 (Not Clear) <succ>
     bacterial outside --- Certainty = 0.0000 (Not Clear) <succ>

The protein has homology with the following sequences in the GENPEPT database.

```
>GP:BAB04496 GB:AP001509 acetoin dehydrogenase (TPP-dependent) beta
chain [Bacillus halodurans]
Identities = 37/57 (64%), Positives = 50/57 (86%)
Query:   1   MLEEFGAKRVRDTPISEAAIAGSAIGAAQTGLRPIVDLTFMDFVTIAMDAIVDDCIR      57
             M+EEFG++RVR+TPISEAAI+G+AIGAA TG+RPI++L F DF+TIAMD +V+   +
Sbjct:  44   MIEEFGSERVRNTPISEAAISGTAIGAALTGMRPILELQFSDPITIAMDNMVNQAAK     100
```

There is also homology to SEQ ID 4272.

Based on this analysis, it was predicted that this protein and its epitopes, could be useful antigens for vaccines or diagnostics.

Example 2299

A DNA sequence (GBSx2436) was identified in *S. agalactiae* <SEQ ID 7083> which encodes the amino acid sequence <SEQ ID 7084>. This protein is predicted to be Structural protein. Analysis of this protein sequence reveals the following:

---
Possible site: 30
>>> Seems to have no N-terminal signal sequence
----- Final Results -----
    bacterial cytoplasm --- Certainty = 0.3015 (Affirmative) <succ>
      bacterial membrane --- Certainty = 0.0000 (Not Clear) <succ>
        bacterial outside --- Certainty = 0.0000 (Not Clear) <succ>

---

The protein has homology with the following sequences in the GENPEPT database.

```
>GP:AAB18706 GB:U38906 Structural protein [Bacteriophage rlt]
Identities = 57/127 (44%), Positives = 83/127 (64%)
Query:   5   IKAGTLFKPELVTEIMSKVKGHSTLAKLSGQTPIPFNGVEQFVFNLDGNAQIVGEGEQKL   64
             +  GTLF P LVT+++SKV G S++A+LS Q PIPFNG + F F +D   +V E  +K
Sbjct:   3   LNKGTLFDPTLVTDLISKVAGKSSIARLSAQKPIPFNGEKVFTFTMDSEIDVVAESGKKT   62

Query:  65   GNTAKVTSKIIKPLKFVYQARMTDEFKYASEEKRLNFLKHYADGFAKKMAEAFDIAAIHG   124
             + + + P+K  Y AR++DEF YAS+E+++N L+ + DGFAKK+A    D+ A HG
Sbjct:  63   HGGVTLAPQTMVPIKVEYGARISDEFMYASDEEKINILQEFNDGFAKKVARGIDLMAFHG   122

Query: 125   LEPRTMT                                                       131
             + PR  T
Sbjct: 123   VNPRLGT                                                       129
```

Based on this analysis, it was predicted that this protein and its epitopes, could be useful antigens for vaccines or diagnostics.

Example 2300

A DNA sequence (GBSx2439) was identified in *S. agalactiae* <SEQ ID 7085> which encodes the amino acid sequence <SEQ ID 7086>. This protein is predicted to be surface protein Rib. Analysis of this protein sequence reveals the following:

---
Possible site: 24
>>> Seems to have no N-terminal signal sequence
----- Final Results -----
    bacterial cytoplasm --- Certainty = 0.1892 (Affirmative) <succ>
      bacterial membrane --- Certainty = 0.0000 (Not Clear) <succ>
        bacterial outside --- Certainty = 0.0000 (Not Clear) <succ>

---

No corresponding DNA sequence was identified in *S. pyogenes*.

Based on this analysis, it was predicted that this protein and its epitopes, could be useful antigens for vaccines or diagnostics.

Example 2301

A DNA sequence (GBSx2440) was identified in *S. agalactiae* <SEQ ID 7087> which encodes the amino acid sequence <SEQ ID 7088>. Analysis of this protein sequence reveals the following:

---
Possible site: 39
>>> Seems to have no N-terminal signal sequence
----- Final Results -----
    bacterial cytoplasm --- Certainty = 0.2227 (Affirmative) <succ>
      bacterial membrane --- Certainty = 0.0000 (Not Clear) <succ>
        bacterial outside --- Certainty = 0.0000 (Not Clear) <succ>

---

Based on this analysis, it was predicted that this protein and its epitopes, could be useful antigens for vaccines or diagnostics.

Example 2302

A DNA sequence (GBSx2441) was identified in *S. agalactiae* <SEQ ID 7089> which encodes the amino acid sequence <SEQ ID 7090>. This protein is predicted to be integrase. Analysis of this protein sequence reveals the following:

---
Possible site: 37
>>> Seems to have no N-terminal signal sequence
----- Final Results -----
    bacterial cytoplasm --- Certainty = 0.2948 (Affirmative) <succ>
      bacterial membrane --- Certainty = 0.0000 (Not Clear) <succ>
        bacterial outside --- Certainty = 0.0000 (Not Clear) <succ>

---

A related GBS nucleic acid sequence <SEQ ID 9319> which encodes amino acid sequence <SEQ ID 9320> was also identified.

The protein has homology with the following sequences in the GENPEPT database.

```
>GP:CAB96616 GB:AJ400629 integrase [Streptococcus pneumoniae
bacteriophage MM1]
Identities = 84/238 (35%), Positives = 137/238 (57%), Gaps = 8/238 (3%)
Query:   1   MTLDKNSSQAQKKAGLILQEKIEDRLAIRNHSEMTYGELKKEYLKQWIPTVKDSTKRGYL   60
             +T++K + QA+ +A ++LQEKI   +L+ +    +T+ E+    + K W   TVK+STK
Sbjct:  30   VTMEKKTPQARNQAAILLQEKINKKLSTKQVESITFEEIYNLFYKSWAQTVKESTKHNCK   89

Query:  61   VSDSHIATVLPDDTIINKLTKRDIRLIIDKLLKHNSYHVTHKCRKRLHAIFSYAIQMDYM   120
             D +  V+P DTI+  L +R ++  I+K+++ N Y    K R RL  IF+YA+Q  Y+
Sbjct:  90   SVDKKMKEVIPSDTILANLDRRFLQEAIEKIIESNGYITAKKVRHRLRGIFNYAVQYSYI   149
```

```
Query: 121  TSNPTENVLVP-KPK--DDYKPEKVLYLTSNEV---YDLCNRMIDNDEQTLADIVLFMFL  174
            +N  +   +P KPK  ++ + ++  +LT E+    D+ NR     Q  AD+VL  +L
Sbjct: 150  ENNEVDYTTIPQKPKTLEELEKKRNNFLTMQEIKALVDVLNRR--EYHQKYADMVLVLTL  207

Query: 175  TGVRYGELSCLTYDKIDFENKEILINATYDFNTRXITTTKTKKSTRKISVSDNILDIV    232
            TG+RYGEL+L       IDFEN +I I   +D   +  T  KT  S R I VS+++++ +
Sbjct: 208  TGMRYGELTALQLKNIDFENNKIEITGNFDSVNKIKTLPKTTNSIRTIKVSESVIEAI    265
```

There is also homology to SEQ ID 578.

Based on this analysis, it was predicted that this protein and its epitopes, could be useful antigens for vaccines or diagnostics.

Example 2303

A DNA sequence (GBSx2444) was identified in *S. agalactiae* <SEQ ID 7091> which encodes the amino acid sequence <SEQ ID 7092>. Analysis of this protein sequence reveals the following:

Possible site:50
>>> Seems to have no N-terminal signal sequence
----- Final Results -----
  bacterial cytoplasm --- Certainty = 0.2518 (Affirmative) <succ>
    bacterial membrane --- Certainty = 0.0000 (Not Clear) <succ>
      bacterial outside --- Certainty = 0.0000 (Not Clear) <succ>

The protein has no significant homology with any sequences in the GENPEPT database.

There is also homology to SEQ ID 4212:

```
Identities = 92/144 (63%), Positives = 118/144 (81%), Gaps = 1/144 (0%)
Query:    1  MPKYSLFELENGRRRLLASAGELQKGNELALPTQFMKFLYLASRYNESKGKPEEIEKKQE    60
             +PKYSLFELENGR+R+LASAGELQKGNELALP++++ FLYLAS Y + KG PE+ E+KQ
Sbjct: 1198  LPKYSLFELENGRKRMLASAGELQKGNELALPSKYVNFLYLASHYEKLKGSPEDNEQKQL  1257

Query:   61  FVNQHVSYFDDILQLINDFSKRVILADANLEKINKLYQDNKENISVDELANNIINLFTFT   120
             FV QH  Y D+I++ I++FSKRVILADANL+K+    Y   +++   + E A NII+LFT T
Sbjct: 1258  FVEQHKHYLDEIIEQISEFSKRVILADANLDKVLSAYNKHRDK-PIREQAENIIHLFTLT  1316

Query:  121  SLGAPAAFKFFDKIVDRKRYTSTQ                                       144
             +LGAPAAFK+FD  +DRKRYTST+
Sbjct: 1317  NLGAPAAFKYFDTTIDRKRYTSTK                                      1340
```

Based on this analysis, it was predicted that this protein and its epitopes, could be useful antigens for vaccines or diagnostics.

Example 2304

A DNA sequence (GBSx2445) was identified in *S. agalactiae* <SEQ ID 7093> which encodes the amino acid sequence <SEQ ID 7094>. This protein is predicted to be ( ). Analysis of this protein sequence reveals the following:

Possible site: 48
>>> Seems to have no N-terminal signal sequence
INTEGRAL    Likelihood = −4.57    Transmembrane 239-255 ( 236-256)
----- Final Results -----
  bacterial membrane --- Certainty = 0.2826 (Affirmative) <succ>
    bacterial outside --- Certainty = 0.0000 (Not Clear) <succ>
      bacterial cytoplasm --- Certainty = 0.0000 (Not Clear) <succ>

The protein has homology with the following sequences in the GENPEPT database.

```
>GP:CAB15253 GB:Z99120 similar to opine catabolism [Bacillus subtilis]
Identities = 88/257 (34%), Positives = 129/257 (49%), Gaps =11/257 (4%)
Query:   1  MARLGADFYSKLVTDLQKDGFETKFYQQTGVFLLKKDESQLESLFALADKRRLESPLIGD    60
            +A+ GA +Y  L+   L+KDG       Y++ G   +  D S+L+ +    A  KRR ++P IGD
Sbjct:  61  LAKGGARYYKDLIHQLEKDGESDTGYKRVGAISIHTDASKLDKMEERAYKRREDAPEIGD   120

Query:  61  LQILNKSEANTHFPEL-DGYEQLLYASGGARVEGADLTRILLEAS---GVNVIKDEVHF-   115
            +  L+ SE    FP L DGYE  ++ SG ARV G   L R LL A+    G   VIK
Sbjct: 121  ITRLSASETKKLFPILADGYES-VHISGAARVNGRALCRSLLSAAEKRGATVIKGNASLL   179

Query: 116  ----TITDNGFRVQGIDFDKLVLASGAWLAKILDEHNYQVDVRPQKGQLRDYYFSNINTG   171
                T+T       +     D +++  +GAW  +IL         V  QK Q+  +   ++ +TG
Sbjct: 180  FENGTVTGVQTDTKQFAADAVIVTAGAWANEILKPLGIHFQVSFQKAQIMHFEMTDADTG   239
```

```
Query: 172  KYPVVMPEGELDIIPFDNGKVSVGASHENDMAF-DLNIDFKVLDKFEEQAIGYFPQLKKQ  230
            +PVVMP  +  I+ FDNG++  GA+HEND    DL +     +  +A+   P L
Sbjct: 240  SWPVVMPPSDQYILSFDNGRIVAGATHENDAGLDDLRVTAGGQHEVLSKALAVAPGLADA  299

Query: 231  IRLLKRVEFVPIQVIFL                                            247
             +  RV F P    FL
Sbjct: 300  AAVETRVGFRPFTPGFL                                            316
```

There is also homology to SEQ ID 2656.

Based on this analysis, it was predicted that this protein and its epitopes, could be useful antigens for vaccines or diagnostics.

Example 2305

A DNA sequence (GBSx2446) was identified in *S. agalactiae* <SEQ ID 7095> which encodes the amino acid sequence <SEQ ID 7096>. Analysis of this protein sequence reveals the following:

---

Possible site: 60
>>> Seems to have no N-terminal signal sequence
----- Final Results -----
    bacterial cytoplasm --- Certainty = 0.2572 (Affirmative) <succ>
    bacterial membrane --- Certainty = 0.0000 (Not Clear) <succ>
    bacterial outside --- Certainty = 0.0000 (Not Clear) <succ>

---

A related GBS nucleic acid sequence <SEQ ID 9315> which encodes amino acid sequence <SEQ ID 9316> was also identified.

The protein has homology with the following sequences in the GENPEPT database.

```
>GP:AAC00337 GB:AF008220 YtqI [Bacillus subtilis]
Identities = 119/256 (46%), Positives = 174/256 (67%), Gaps = 3/256 (1%)
Query:   6  QILDKIKEYDTIIIHRHMRPDPDALGSQIGLRDIIRHNFPKKKVLATGFDEPTLAWIAKM   65
            +++  I  YDTII+HRH+RPDPDA GSQ GL +I+R  +P+K + A G   EP+L+++  +
Sbjct:   4  ELIRTISLYDTIILHRHVRPDPDAYGSQCGLTEILRETYPEKNIFAVGTPEPSLSFLYSL   63

Query:  66  DQVTDQDYQGALVVVTDTANTPRIDDERYKKGDFLIKIDHHPNDEVYGDLSYVDTNASSA  125
            D+V ++ Y+GALV+V DTAN  RIDD+RY  G  L+KIDHHPN++ YGDL +VDT+ASS
Sbjct:  64  DEVDNETYEGALVIVCDTANQERIDDQRYPSGAKLMKIDHHPNEDPYGDLLWVDTSASSV  123

Query: 126  SEIVTDFAL---SCDLLLSTSAARVLYNGIVGDTGRFLYPATTSKTLKIASKLREFDFDF  182
            SE++ +  L      L+T AA ++Y GIVGDTGRFL+P TT KTLK A +L ++  F
Sbjct: 124  SEMIYELYLEGKEHGWKLNTKAAELIYAGIVGDTGRFLFPNTTEKTLKYAGELIQYPFSS  183

Query: 183  SAMARQMDSFPFKIAKLQGFIFEQLKIDKNGAACVTLTQEDLKRFDVTDAETAAIVGVPG  242
            S +  Q+       + KL GFIF+ + +  +NGAA V + ++ L++F  T +E +  +VG  G
Sbjct: 184  SELFNQLYETKLNVVKLNGFIFQNVSLSENGAASVFIKKDTLEKFGTTASEASQLVGTLG  243

Query: 243  KIDIVESWAIFVKQSD                                             258
             I  + +W  FV++ D
Sbjct: 244  NISGIRAWVFFVEEDD                                             259
```

A related DNA sequence was identified in *S. pyogenes* <SEQ ID 7097> which encodes the amino acid sequence <SEQ ID 7098>. Analysis of this protein sequence reveals the following:

---

Possible site: 61
>>> Seems to have no N-terminal signal sequence
----- Final Results -----
    bacterial cytoplasm --- Certainty = 0.2584 (Affirmative) <succ>
    bacterial membrane --- Certainty = 0.0000 (Not Clear) <succ>
    bacterial outside --- Certainty = 0.0000 (Not Clear) <succ>

---

An alignment of the GAS and GBS proteins is shown below.

```
Identities = 180/256 (70%), Positives = 215/256 (83%)
Query:   4  FQQILDKIKEYDTIIIHRHMRPDPDALGSQIGLRDIIRHNFPKKKVLATGFDEPTLAWIA   63
            F+ ILDKIK + TIIIHRH PDPDALGSQ GL++II NFP KKVL TGFDEP+LAWI+
Sbjct:   5  FETILDKIKAHQTIIIHRHQNPDPDALGSQAGLKEIIAQNFPDKKVLMTGFDEPSLAWIS   64

Query:  64  KMDQVTDQDYQGALVVVTDTANTPRIDDERYKKGDFLIKIDHHPNDEVYGDLSYVDTNAS  123
            +MDQVTD+DY+ ALV++TDTAN PRIDDERY  G  LIKIDHHPND+VYGD  YVDT+AS
Sbjct:  65  QMDQVTDKDYKEALVIITDTANRPRIDDERYTLGKCLIKIDHHPNDDVYGDFYYVDTSAS  124
```

-continued

```
Query: 124  SASEIVTDFALSCDLLLSTSAARVLYNGIVGDTGRFLYPATTSKTLKIASKLREFDFDFS  183
            SASEI+ DFA S +L LS   AA++LY GIVGDTGRFLY +TTSKTL IAS+LR F+FDF+
Sbjct: 125  SASEIIADFAFSQNLTLSDKAAKLLYTGIVGDTGRFLYASTTSKTLSIASQLRHFEFDFA  184

Query: 184  AMARQMDSFPFKIAKLQGFIFEQLKIDKNGAACVTLTQEDLKRFDVTDAETAAIVGVPGK  243
            A++RQMDSFP KIAKLQ ++FE L ID++GAA V ++QE LK FDVT AE++AIV  PGK
Sbjct: 185  AISRQMDSFPLKIAKLQSYVFEHLTIDESGAAYVLVSQETLKHFDVTLAESSAIVCAPGK  244

Query: 244  IDIVESWAIFVKQSDG                                             259
            ID V++WAIFV+ +DG
Sbjct: 245  IDNVQAWAIFVELTDG                                             260
```

Based on this analysis, it was predicted that these proteins and their epitopes could be useful antigens for vaccines or diagnostics.

Example 2306

A DNA sequence (GBSx2447) was identified in £agalactiae <SEQ ID 7099> which encodes the amino acid sequence <SEQ ID 7100>. Analysis of this protein sequence reveals the following:

---
Possible site: 26
>>> Seems to have no N-terminal signal sequence
----- Final Results -----
    bacterial cytoplasm --- Certainty = 0.1846 (Affirmative) <succ>
    bacterial membrane --- Certainty = 0.0000 (Not Clear) <succ>
    bacterial outside --- Certainty = 0.0000 (Not Clear) <succ>
---

The protein has homology with the following sequences in the GENPEPT database.

```
>GP:CAB42949 GB:AL049863 putative adenosine deaminase [Streptomyces
coelicolor A3(2)]

Identities = 123/343 (35%), Positives = 175/343 (50%), Gaps = 26/343 (7%)

Query:   6  LKELAKAELHCHLDGSLSLPAIRKLANMADIILPSSDK-ELRKYVIAPAQTESLVDYLKT   64
            L+ L KA LH HLDG L    + +LA         LP++D  EL  +   A +  LV Y+ T
Sbjct:  11  LRRLPKAVLHDHLDGGLRPATVVELARSVGHTLPTTDPDELAAWYYEAANSGDLVRYIAT   70

Query:  65  FEFIRPLLQTKEALRFAAYDVARQAALENVIYIEIRFAPELSMDKGLTASDTVLAVLEGL  124
            FE   ++Q +E L  AA +     A + V+Y E+R+APEL+   GL+  + V  V EGL
Sbjct:  71  FEHTLAVMQNREGLLRAAEEYVLDLAADGVVYGEVRYAPELNTRGGLSMREVVETVQEGL  130

Query: 125  ADAQKEFNIVAR-----ALVCGMRQSSHKTTKDIIKHIVDLA----PKGLVGFDFAGDEF  175
            A   +            L+CGMR        D ++   DLA       G+VGFD AG E
Sbjct: 131  ATGMAKAAAAGTPVRVGTLLCGMRMF------DRVREAADLAVAFRDAGVVGFDIAGAED  184

Query: 176  SYPTDSLVDLIQEVKRSGYPMTLHAGECGCAKHIADSLNL-GIKRMGHVTALT-------  227
             +P   +D  ++R   P T+HAGE   +  I  +L   G  +R+GH   +T
Sbjct: 185  GFPPADHLDAFEHLRRENVPFTIHAGEAHGLPSIHQALQVCGAQRIGHGVRITDDIPDLA  244

Query: 228  -GQRDLIKRFVEEDAVA-EMCLTSNLQTKAASSIQSFPYQELYDAGGKITINTDNRTVSD  285
             G+    +  +V + +A EMC TSNLQT AA+SI     P   L D G  ++T+NTDNR VS
Sbjct: 245  AGKLGRLAAWVRDRRIALEMCPTSNLQTGAATSIAEHPITALKDLGFRVTLNTDNRLVSG  304

Query: 286  TNLTKEYSLFVTYFGTKIEDFLVFNQNAVKASFTSDSEKDTLL                  328
            T +T+E SL V   G   +ED       NA+K++F    E+  L+
Sbjct: 305  TTMTREMSLLVEQAGWSVEDLRTVTVNALKSAFVPFDERTALI                  347
```

No corresponding DNA sequence was identified in *S. pyogenes*.

Based on this analysis, it was predicted that this protein and its epitopes, could be useful antigens for vaccines or diagnostics.

Example 2307

A DNA sequence (GBSx2448) was identified in *S. agalactiae* <SEQ ID 7101> which encodes the amino acid sequence <SEQ ID 7102>. Analysis of this protein sequence reveals the following:

---
Possible site: 18
>>> Seems to have no N-terminal signal sequence
----- Final Results -----
    bacterial cytoplasm --- Certainty = 0.2042 (Affirmative) <succ>
    bacterial membrane --- Certainty = 0.0000 (Not Clear) <succ>
    bacterial outside --- Certainty = 0.0000 (Not Clear) <succ>
---

A related GBS nucleic acid sequence <SEQ ID 9639> which encodes amino acid sequence <SEQ ID 9640> was also identified.

The protein has homology with the following sequences in the GENPEPT database.

```
>GP:CAB13290 GB:Z99111 similar to sulfite reductase [Bacillus subtilis]
Identities = 63/146 (43%), Positives = 87/146 (59%), Gaps = 1/146 (0%)
Query:   5    MALAKIVYASMTGNTEEIADIVADKLRDLGLDVEVEECTMVDAAD-FEDADIAIVATYTY   63
              MA   +VYA+M+GNTE +AD++    L++    +V+   E   +D A  F D D  I+ TYT+
Sbjct:   1    MAKILLVYATMSGNTEAMADLIEKGLQEALAEVDRFEAMDIDDAQLFTDYDHVIMGTYTW   60

Query:  64    GDGDLPDEIVDFYEDLAEVDLSGKVYGVVGSGDTFYDYFCKSVDEFEAQFALTGAQKGAD   123
              GDGDLPDE +D   ED+ E+D SGK    V GSGDT Y++FC +VD  EA+      G
Sbjct:  61    GDGDLPDEFLDLVEDMEEIDFSGKTCAVFGSGDTAYEFFCGAVDTLEAKIKERGGDIVLP   120

Query: 124    CVKVDLAAEDEDIENLEAFAEEIASK                                     149
                VK++     E E+ E L   F  +A K
Sbjct: 121    SVKIENNPEGEEEEELINFGRQFAKK                                     146
```

A related DNA sequence was identified in *S. pyogenes* <SEQ ID 7103> which encodes the amino acid sequence <SEQ ID 7104>. Analysis of this protein sequence reveals the following:

Possible site: 14
>>> Seems to have no N-terminal signal sequence
----- Final Results -----
    bacterial cytoplasm --- Certainty = 0.1641 (Affirmative) <succ>
    bacterial membrane --- Certainty = 0.0000 (Not Clear) <succ>
    bacterial outside --- Certainty = 0.0000 (Not Clear) <succ>

An alignment of the GAS and GBS proteins is shown below.

```
Identities = 116/147 (78%), Positives = 136/147 (91%)
Query:   5    MALAKIVYASMTGNTEEIADIVADKLRDLGLDVEVEECTMVDAADFEDADIAIVATYTYG    64
              MALAKIVYASMTGNTEEIADIVA+KL++LG DV+++ECT VDA++FE+ADIA+VATYTYG
Sbjct:   1    MALAKIVYASMTGNTEEIADIVANKLQELGEDVDIDECTTVDASEFENADIAVVATYTYG    60

Query:  65    DGDLPDEIVDFYEDLAEVDLSGKVYGVVGSGDTFYDYFCKSVDEFEAQFALTGAQKGADC   124
              DGDLPDEIVDFYEDL ++DL GK+YGVVGSGDTFYDYFCKSVD+F  QFALTGA KGA+
Sbjct:  61    DGDLPDEIVDFYEDLQDLDLEGKIYGVVGSGDTFYDYFCKSVDDFSEQFALTGAIKGAEP   120

Query: 125    VKVDLAAEDEDIENLEAFAEEIASKLN                                    151
              VKVDLAAEDEDI+ LEAFAE+++  +N
Sbjct: 121    VKVDLAAEDEDIDELEAFAEQLSQAVN                                    147
```

Based on this analysis, it was predicted that. these proteins and their epitopes could be useful antigens for vaccines or diagnostics.

Example 2308

A DNA sequence (GBSx2449) was identified in *S. agalactiae* <SEQ ID 7105> which encodes the amino acid sequence <SEQ ID 7106>. Analysis of this protein sequence reveals the following:

Possible site: 33
>>> Seems to have no N-terminal signal sequence
----- Final Results -----
    bacterial cytoplasm --- Certainty = 0.3568 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the GENPEPT database.

```
>GP:AAB98234 GB:U67480 chorismate mutase/prephenate dehydratase
(pheA) [Methanococcus jannaschii]

Identities = 26/85 (30%), Positives = 46/85 (53%), Gaps = 1/85 (1%)
Query:   2    ELEEIRQEIDEIDQQLVSLLETRMGLILEVIAFKKKHRLPVLDNNRENEVLNNVLKKVQN    61
              +L EIR++IDEID +++ L+  R L  +V    K +  +P+ D  RE  + +   K +
Sbjct:   4    KLAEIRKKIDEIDNKILKLIAERNSLAKDVAEIKNQLGIPINDPEREKYIYDRIRKLCKE    63

Query:  62    HQFDDVIRATFKDIMTE-SRVYQKE                                       85
              H  D+ I        I+ E ++  QK+
Sbjct:  64    HNVDENIGIKIFQILIEHNKALQKQ                                       88
```

Example 2309

A DNA sequence (GBSx2450) was identified in *S. agalactiae* <SEQ ID 7107> which encodes the amino acid sequence <SEQ ID 7108>. This protein is predicted to be a minor structural protein. Analysis of this protein sequence reveals the following:

```
Possible site: 23
>>> Seems to have no N-terminal signal sequence
----- Final Results -----
    bacterial cytoplasm --- Certainty = 0.1828 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP:AAC34413 GB:AF158600 putative minor structural protein
[Streptococcus thermophilus bacteriophage Sfill]
Identities = 39/65 (60%), Positives = 54/65 (83%)
Query: 1     MEVETDSQEVLMSTGLKDLKAHAYPAITYEVDGYVDLELGDVVRIQDDGYEPPLILTARV   60
             ME++TDS++VL+ST L++L+   YPAITYEVDG++DL++GD V+IQD G+ P L+L ARV
Sbjct: 707   MEIDTDSEDVLISTALRNLRKFCYPAITYEVDGFLDLDIGDTVKIQDTGFSPMLMLEARV   766

Query: 61    VEQDI   65
             EQ I
Sbjct: 767   SEQQI   771
```

No corresponding DNA sequence was identified in *S. pyogenes*.

Based on this analysis, it was predicted that this protein and its epitopes, could be useful antigens for vaccines or diagnostics.

Example 2310

A DNA sequence (GBSx2451) was identified in *S. agalactiae* <SEQ ID 7109> which encodes the amino acid sequence <SEQ ID 7110>. This protein is predicted to be phosphomethylpyrimidine kinase (thiD). Analysis of this protein sequence reveals the following:

```
Possible site: 45
>>> Seems to have no N-terminal signal sequence
----- Final Results -----
    bacterial cytoplasm --- Certainty = 0.2051 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP:AAC22074 GB:U32725 phosphomethylpyrimidine kinase (thiD)
[Haemophilus influenzae Rd]
 Identities = 29/78 (37%), Positives = 48/78 (61%), Gaps = 2/78 (2%)
Query:   4  RNVLAISGNDIFSGGGLHADLATYVVNKLHGFVAVTCLTAMSDKG-FEVIPIEASILKQQ   62
            + VL I+G+D    G G+ ADL T++    + G  A+T +TA +  G F++PI    ++ Q
Sbjct:   5  KQVLTIAGSDSGGGAGIQADLKTFQMRGVFGTSAITAVTAQNTLGVFDIHPIPLKTIQAQ   64

Query:  63  LESLK-DVEFGSIKLGLL   79
            LE++K D +  S K+G+L
Sbjct:  65  LEAVKNDFQIASCKIGML   82
```

There is also homology to SEQ ID 4408.

Based on this analysis, it was predicted that this protein and its epitopes, could be useful antigens for vaccines or diagnostics.

Example 2311

A DNA sequence (GBSx2452) was identified in *S. agalactiae* <SEQ ID 7111> which encodes the amino acid sequence <SEQ ID 7112>. Analysis of this protein sequence reveals the following:

```
Possible site: 57
>>> Seems to have no N-terminal signal sequence
INTEGRAL    Likelihood = -7.43    Transmembrane 109-125 (102-129)
INTEGRAL    Likelihood = -1.28    Transmembrane 84-100 (84-100)
----- Final Results -----
    bacterial membrane --- Certainty = 0.3972 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:CAA22372 GB:AL034446 putative transmembrane protein
[Streptomyces coelicolor A3(2)]
 Identities = 25/93 (26%), Positives = 43/93 (45%), Gaps = 1/93 (1%)
Query:  62 SASVEILCRGWLLPVSATKYSKIVSVSISSIFFGLLHSANNHVSLISIFNLCL-FGLFLS 120
            +A+ E++ RG L +         +++ ++ + FGL+H  N   +L    + + G  L+
Sbjct: 143 AATEEVVFRGVLFRIIEEHIGTYLALGLTGLVFGLMHLLNEDATLWGALAIAIEAGFMLA 202

Query: 121 LYVILKGNIWGACGIHGAWNCVQGSVFGIEVSG                            153
              N+W   G+H  WN   G VF   VSG
Sbjct: 203 AAYAATRNLWLTIGVHFGWNFAAGGVFSTVVSG                            235
```

No corresponding DNA sequence was identified in S. pyogenes.

Based on this analysis, it was predicted that this protein and its epitopes, could be useful antigens for vaccines or diagnostics.

Example 2312

A DNA sequence (GBSx2453) was identified in S. agalactiae <SEQ ID 7113> which encodes the amino acid sequence <SEQ ID 7114>. This protein is predicted to be pppL protein. Analysis of this protein sequence reveals the following:

---

Possible site: 45
>>> Seems to have no N-terminal signal sequence
----- Final Results -----
    bacterial cytoplasm --- Certainty = 0.5796 (Affirmative) <succ>
    bacterial membrane --- Certainty = 0.0000 (Not Clear) <succ>
    bacterial outside --- Certainty = 0.0000 (Not Clear) <succ>

---

The protein has homology with the following sequences in the GENPEPT database.

```
>GP:CAA10712 GB:AJ132604 pppL protein [Lactococcus lactis]
Identities = 38/64 (59%), Positives = 51/64 (79%)
Query:   1 MEISLLTDIGQRRSNNQDFINQFENKAGVPLIILADGMGGHRAGNIASEMTVTDLGSDWA 60
           ME S+L+DIG +RS NQD++    + N+AG  L +LADGMGGH+AGN+AS++TV DLG   W+
Sbjct:   1 MEYSILSDIGSKRSTNQDYVGTYVNRAGYQLELLADGMGGHKAGNVASKLTVEDLGKLWS 60

Query:  61 ETDF                                                         64
           ET F
Sbjct:  61 ETFF                                                         64
```

There is also homology to SEQ ID 3022:

```
Identities = 58/74 (78%), Positives = 69/74 (92%)
Query:   1 MEISLLTDIGQRRSNNQDFINQFENKAGVPLIILADGMGGHRAGNIASEMTVTDLGSDWA 60
           M+ISL TDIGQ+RSNNQDFIN+F+NK G+ L+ILADGMGGHRAGNIASEMTVTDLG +W
Sbjct:   1 MKISLKTDIGQKRSNNQDFINKFDNKKGITLVILADGMGGHRAGNIASEMTVTDLGREWV 60

Query:  61 ETDFSELSEIRDWM 74
           +TDF+ELS+IRDW+
Sbjct:  61 KTDFTELSQIRDWL 74
```

Based on this analysis, it was predicted that this protein and its epitopes, could be useful antigens for vaccines or diagnostics.

Example 2313

A DNA sequence (GBSx2454) was identified in S. agalactiae <SEQ ID 7115> which encodes the amino acid sequence <SEQ ID 7116>. This protein is predicted to be sunL protein. Analysis of this protein sequence reveals the following:

---

Possible site: 25
>>> Seems to have no N-terminal signal sequence
----- Final Results -----
    bacterial cytoplasm --- Certainty = 0.1631 (Affirmative) <succ>
    bacterial membrane --- Certainty = 0.0000 (Not Clear) <succ>
    bacterial outside --- Certainty = 0.0000 (Not Clear) <succ>

---

The protein has homology with the following sequences in the GENPEPT database.

```
>GP:CAA10711 GB:AJ132604 sunL protein [Lactococcus lactis]
Identities = 48/81 (59%), Positives = 67/81 (82%)
Query:   1 MSILSSVCQTLRKGGIITYSTCTIFEEENFQVIEKFLENHPNFEQVELSHTQEDIVKAGC  60
             + IL+S  ++L+K GI+ YSTCTIF+EENF V+ +FLENHPNFEQVE+S+ + +++K GC
Sbjct: 342 LEILNSASKSLKKSGIMVYSTCTIFDEENFDVVHEFLENHPNFEQVEISNEKPEVIKEGC 401

Query:  61 ISISPEQYHTDGFFIGQVKRI                                         81
             + I+PE YHTDGFFI + K+I
Sbjct: 402 LFITPEMYHTDGFFIAKFKKI                                        422
```

There is also homology to SEQ ID 3018:

```
Identities = 64/82 (78%), Positives = 74/82 (90%)
Query:   1 MSILSSVCQTLRKGGIITYSTCTIFEEENFQVIEKFLENHPNFEQVELSHTQEDIVKRGC  60
             + ILSSVCQTLRKGGIITYSTCTIF+EEN QVIE FL++HPNFEQV+L+HTQ DIVK G
Sbjct: 359 LEILSSVCQTLRKGGIITYSTCTIFDEENRQVIEAFLQSHPNFEQVKLNHTQADIVKDGY 418

Query:  61 ISISPEQYHTDGFFIGQVKRIL                                        82
             + I+PEQY IDGFFIGQV+R+L
Sbjct: 419 LIITPEQYQTDGFFIGQVRRVL                                       440
```

Based on this analysis, it was predicted that this protein and its epitopes, could be useful antigens for vaccines or diagnostics.

Example 2314

A DNA sequence (GBSx2455) was identified in *S. agalactiae* <SEQ ID 7117> which encodes the amino acid sequence <SEQ ID 7118>. This protein is predicted to be PTS permease for mannose subunit IIPMan. Analysis of this protein sequence reveals the following:

```
Possible site: 53
>>> Seems to have no N-terminal signal sequence
INTEGRAL    Likelihood = -9.18    Transmembrane 32-48 (30-58)
INTEGRAL    Likelihood = -8.07    Transmembrane 127-143 (122-146)
INTEGRAL    Likelihood = -2.07    Transmembrane 56-72 (56-72)
INTEGRAL    Likelihood = -1.44    Transmembrane 87-103 (86-103)
INTEGRAL    Likelihood = -0.53    Transmembrane 105-121 (105-121)
----- Final Results -----
   bacterial membrane --- Certainty = 0.4673 (Affirmative) <succ>
     bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:AAF81084 GB:AF228498 AgaW [Escherichia coli]
Identities = 38/122 (31%), Positives = 68/122 (55%), Gaps = 7/122 (5%)
Query:  25 KVPETKSIIRLTALAFLVCSILVVELVSMRELISSISFIGILVGSGPVNSFVHHIPQNLM  84
             ++P T  + L A +L         L+++        +F+ I G+    + +  +PQ L+
Sbjct: 126 RMPRTPILAALNACNYLA-------LLALGNFYFLCAFLPIYFGAEHAKTIIDVLPQRLI 178

Query:  85 NGLSAAGGLLPAVGFAMLMKLLWTNKLAVFYLLGFVLTAYLKLPAVAVAALGAVICVISS 144
             +GL AGG++PA+GFA+L+K++N +++LGFV A+LKLP +A+A ++I
Sbjct: 179 DGLGVAGGIMPAIGFAVLLKIMMKNVYIPYFILGFVAAAWLKLPVLAIACPALAMALIDL 238

Query: 145 QR                                                           146
            R
Sbjct: 239 LR                                                           240
```

There is also homology to SEQ ID 1636:

```
Identities = 104/109 (95%), Positives = 108/109 (98%)
Query:  56 LISSISFIGILVGSGPVNSFVHHIPQNLMNGLSAAGGLLPAVGFAMLMKLLWTNKLAVFY 115
            +I+SISFIGILVGSGPVN+FV HIPQNLMNGLSAAGGLLPAVGFAMLMKLLWTNKLAVFY
Sbjct: 149 IIASISFIGILVGSGPVNAFVEHIPQNLMNGLSAAGGLLPAVGFAMLMKLLWTNKLAVFY 208
```

```
Query: 116 LLGFVLTAYLKLPAVAVAALGAVICVISSQRDIELDAITRGAISKQTTF        164
            LLGFVLTAYLKLPAVAVAALGAVICVISSQRD+ELDAITRGAISKQTTF
Sbjct: 209 LLGFVLTAYLKLPAVAVAALGAVICVISSQRDLELDAITRGAISKQTTF        257
```

Based on this analysis, it was predicted that this protein and its epitopes, could be useful antigens for vaccines or diagnostics.

Example 2315

A DNA sequence (GBSx2456) was identified in *S. agalactiae* <SEQ ID 7119> which encodes the amino acid sequence <SEQ ID 7120>. Analysis of this protein sequence reveals the following:

```
Possible site: 50
>>> Seems to have a cleavable N-term signal seq.
INTEGRAL      Likelihood = -8.12    Transmembrane 121-137 (118-144)
INTEGRAL      Likelihood = -5.52    Transmembrane 91-107 (89-111)
INTEGRAL      Likelihood = -5.20    Transmembrane 166-182 (162-192)
----- Final Results -----
    bacterial membrane --- Certainty = 0.4248 (Affirmative) <succ>
     bacterial outside --- Certainty = 0.0000 (Not Clear) <succ>
    bacterial cytoplasm --- Certainty = 0.0000 (Not Clear) <succ>
```

The protein has homology with the following sequences in the GENPEPT database.

```
>GP:CAB15963 GB:Z99124 phosphotransferase system (PTS)
beta-glucoside-specific enzyme IIABC component [Bacillus subtilis]
 Identities = 76/201 (37%), Positives = 122/201 (59%), Gaps = 3/201 (1%)
Query:   1 MIKALLALLLVFKILTPSSQTYILLNLFADGVFYFLPILIAITAAQKLKANPILALGTVV   60
           MIK L+AL + F  +   SQ +++L    DG FYFLP+L+A++AA+K  +NP +A
Sbjct: 121 MIKGLVALAVTFGWMAEKSQVHVILTAVGDGAFYFLPLLLAMSAARKFGSNPYVAAAIAA 180

Query:  61 MLLHPNWANLVASGKPVSLFHTIPFTLTNYASSVIPIILIICVQAYIEKYLKQIIPKSLR 120
            +LHP+    L+ +GKP+S F  +P T    Y+S+VIPI+L I + +Y+EK++ +     SL+
Sbjct: 181 AILHPDLTALLGAGKPIS-FIGLPVTAATYSSTVIPILLSIWIASYVEKWIDRFTHASLK 239

Query: 121 LVLVPMLIFLSMGILSFSILGPMGTIAGQYLAVIFTFLSKYASW-APAFLVGAFAPILIM 179
           L++VP    L + L+    +GP+G I G+YL+     +L  +A     FL G F+ ++IM
Sbjct: 240 LIVVPTFTLLIVVPLTLITVGPLGAILGEYLSSGVNYLFDHAGLVAMIFLAGTFS-LIIM 298

Query: 180 FGVHSGIAALGITQLAKLGVD                                        200
           G+H      + I   +A  +G D
Sbjct: 299 TGMHYAFVPIMINNIAQNGHD                                        319
```

There is also homology to SEQ ID 2884.

Based on this analysis, it was predicted that this protein and its epitopes, could be useful antigens for vaccines or diagnostics.

Example 2316

A DNA sequence (GBSx2457) was identified in *S. agalactiae* <SEQ ID 7121> which encodes the amino acid sequence <SEQ ID 7122>. This protein is predicted to be glucose kinase. Analysis of this protein sequence reveals the following:

```
Possible site: 54
>>> Seems to have no N-terminal signal sequence
----- Final Results -----
    bacterial cytoplasm --- Certainty = 0.1180 (Affirmative) <succ>
     bacterial membrane --- Certainty = 0.0000 (Not Clear) <succ>
      bacterial outside --- Certainty = 0.0000 (Not Clear) <succ>
```

The protein has homology with the following sequences in the GENPEPT database.

```
>GP:CAB14416 GB:Z99116 glucose kinase [Bacillus subtilis]
 Identities = 32/57 (56%), Positives = 41/57 (71%)
Query:   1 MVIGGGVSAAGEFLRSRVEKYFVTFAFPQVKKSTKIKIAELGNDAGIIGAASLANQQ  57
           +V+GGGVS AGE LRS+VEK F    AFP+  ++I IA LGNDAG+IG A +A +
Sbjct: 258 IVLGGGVSRAGELLRSKVEKTFRKCAFPRAAQAADISIAALGNDAGVIGGAWIAKNE 314
```

There is also homology to SEQ ID 198. An alignment of the GAS and GBS proteins is shown below:

```
Identities = 50/56 (89%), Positives = 53/56 (94%)
Query:   1 MVIGGGVSAAGEFLRSRVEKYFVTFAFPQVKKSTKIKIAELGNDAGIIGAASLANQ   56
```

```
            +VIGGGVSAAGEFLRSR+EKYFVTF FPQV+ STKIKIAELGNDAGIIGAASLA Q
Sbjct: 264  VVIGGGVSAAGEFLRSRIEKYFVTFTFPQVRYSTKIKIAELGNDAGIIGAASLARQ 319
```

Based on this analysis, it was predicted that these proteins and their epitopes could be useful antigens for vaccines or diagnostics.

Example 2317

A DNA sequence (GBSx2458) was identified in £agalactiae <SEQ ID 7123> which encodes the amino acid sequence <SEQ ID 7124>. Analysis of this protein sequence reveals the following:

Possible site: 19
>>> Seems to have a cleavable N-term signal seq.
----- Final Results -----
  bacterial outside --- Certainty = 0.3000 (Affirmative) <succ>
  bacterial membrane --- Certainty = 0.0000 (Not Clear) <succ>
  bacterial cytoplasm --- Certainty = 0.0000 (Not Clear) <succ>

The protein has homology with the following sequences in the GENPEPT database.

```
>GP:CAB14385 GB:Z99116 similar to hypothetical proteins [Bacillus subtilis]
Identities = 37/86 (43%), Positives = 51/86 (59%)
Query:   3 MSVILIIVILLAFVAWASWNYWRVRRAAKFLDNESFQKEMSRGQLIDIREAGAFHRKHIL 62
           MS +++++I  AF+ +   +Y  +R  K L  E F+    + QLID+RE   F   HIL
Sbjct:   1 MSNMIVLIIFPAFIIYMIASYVYQQRIMKTLTEEEFRAGYRKAQLIDVREPNEFEGGHIL 60

Query:  63 GARNIPASQFKVALSALRKDKPVLLY                                  88
           GARNIP SQ K +   +R DKPV LY
Sbjct:  61 GARNIPLSQLKQRKNEIRTDKPVYLY                                  86
```

There is also homology to SEQ ID 202. An alignment of the GAS and GBS proteins is shown below:

```
Identities = 51/108 (47%), Positives = 70/108 (64%)
Query:   1 MDMSVILIIVILLAFVAWASWNYWRVRRAAKFLDNESFQKEMSRGQLIDIREAGAFHRKH 60
           M   +++  ++L+  V ++WNY+ R+   AK +DNE+F+  M +GQLID+RE  AF  KH
Sbjct:   1 MSPITLILWLLLVGIVGYYTWNYFSFRKMAKQVDNETFKDVMRQGQLIDLREPAAFRTKH 60

Query:  61 ILGARNIPASQFKVALSALRKDKPVLLYDASRGQSIPRIVLLLRKERF             108
           ILGARN PA QF A+  LRKDKPVL+Y+  R Q      V  L+K  F
Sbjct:  61 ILGARNFPAQQFDAAIKGLRKDKPVLIYENMRPQYRVPAVKKLKKAGF             108
```

Based on this analysis, it was predicted that these proteins and their epitopes could be useful antigens for vaccines or diagnostics.

Example 2318

A DNA sequence (GBSx2459) was identified in *S. agalactiae* <SEQ ID 7125> which encodes the amino acid sequence <SEQ ID 7126>. This protein is predicted to be surface protein Rib. Analysis of this protein sequence reveals the following:

Possible site: 24
>>> Seems to have no N-terminal signal sequence
----- Final Results -----
  bacterial cytoplasm --- Certainty = 0.1892 (Affirmative) <succ>
  bacterial membrane --- Certainty = 0.0000 (Not Clear) <succ>
  bacterial outside --- Certainty = 0.0000 (Not Clear) <succ>

No corresponding DNA sequence was identified in *S. pyogenes*.

Based on this analysis, it was predicted that this protein and its epitopes, could be useful antigens for vaccines or diagnostics.

Example 2319

A DNA sequence (GBSx2460) was identified in *S. agalactiae* <SEQ ID 7127> which encodes the amino acid sequence <SEQ ID 7128>. Analysis of this protein sequence reveals the following:

Possible site: 18
>>> Seems to have no N-terminal signal sequence
----- Final Results -----
  bacterial cytoplasm --- Certainty = 0.3522 (Affirmative) <succ>
  bacterial membrane --- Certainty = 0.0000 (Not Clear) <succ>
  bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2320

A DNA sequence (GBSx2461) was identified in *S. agalactiae* <SEQ ID 7129> which encodes the amino acid sequence <SEQ ID 7130>. Analysis of this protein sequence reveals the following:

```
Possible site: 25
  >>> Seems to have no N-terminal signal sequence
  ----- Final Results -----
     bacterial cytoplasm --- Certainty = 0.2770 (Affirmative) <succ>
     bacterial membrane --- Certainty = 0.0000 (Not Clear) <succ>
     bacterial outside  --- Certainty = 0.0000 (Not Clear) <succ>
```

The protein has homology with the following sequences in the GENPEPT database.

```
>GP:AAB18708 GB:U38906 ORF33 [Bacteriophage rlt]
Identities = 56/85 (65%), Positives = 66/85 (76%), Gaps = 1/85 (1%)
Query:   1 MTNFATTDDVILLWRQLSVDEIKRAEALLETVSDTLRLEASKVGKNLDEMILETP-YFAT  59
           M  FAT DD++LWR  L  DE +RAE LLE VSD+LR EA KVG++L  MI E P YFA+
Sbjct:   1 MNPFATVDDLTMLWRPLKGDEKERAEKLLEIVSDSLREEADKVGRDLYAMIAEKPSYFAS  60

Query:  60 VLKSVTVDIVARTLMTATQGEPMSQ                                    84
           V+KSVTVDIVARTLMT+T  EPM+Q
Sbjct:  61 VVKSVTVDIVARTLMTSTDQEPMTQ                                    85
```

There is also homology to SEQ ID 1432.

Based on this analysis, it was predicted that this protein and its epitopes, could be useful antigens for vaccines or diagnostics.

Example 2321

A DNA sequence (GBSx2462) was identified in *S. agalactiae* <SEQ ID 7131> which encodes the amino acid sequence <SEQ ID 7132>. This protein is predicted to be regulatory protein TypA (typA). Analysis of this protein sequence reveals the following:

```
Possible site: 41
>>> Seems to have no N-terminal signal sequence
----- Final Results -----
   bacterial cytoplasm --- Certainty = 0.2238 (Affirmative) <succ>
   bacterial membrane --- Certainty = 0.0000 (Not Clear) <succ>
   bacterial outside  --- Certainty = 0.0000 (Not Clear) <succ>
```

The protein has homology with the following sequences in the GENPEPT database.

```
>GP:BAB06351 GB:AP001516 GTP-binding protein TypA/BipA (tyrosine
phosphorylated protein A) [Bacillus halodurans]
 Identities = 175/237 (73%), Positives = 204/237 (85%), Gaps = 1/237 (0%)
Query:   1 MEDIFVGETVTPTDAIEPLPVLRIDEPTLQMTFLVNNSPFAGREGKWITSRKVEERLLAE   60
           ME+I VGETV P D  +PLP+LRIDEPTLQMTFLVNNSPFAGREGK +TSRK+EERL AE
Sbjct: 281 MEEINVGETVCPVDHQDPLPILRIDEPTLQMTFLVNNSPFAGREGKHVTSRKLEERLRAE  340

Query:  61 LQTDVSLRVDPTDSPDKWTVSGRGELHLSILIETMRREGYELQVSRPEVIIKEIDGVQCE  120
           L+TDVSLRV+ TDSPD W VSGRGELHLSILIE MRREGYELQVS+PEVII+EIDGVQCE
Sbjct: 341 LETDVSLRVENTDSPDMWVVSGRGELHLSILIENMRREGYELQVSKPEVIIREIDGVQCE  400

Query: 121 PFERVQIDTPEEYQGAIIQSLSERKGDMLDMQMVGNGQTRLIFLIPARGLIGYSTEFLSM  180
           P ERVQID PEEY GA+++SL ERKG+ML+M   G+GQ RL F++PARGLIGY+TEFLS
Sbjct: 401 PVERVQIDVPEEYTGAVMESLGERKGEMLNMTNTGSGQVRLEFMVPARGLIGYTTEFLSQ  460

Query: 181 TRGYGIMNHTFDQYLPVVQGEIGGRHRGALVSIENGKATTYSIMRIEERGNLSFVNP    237
           TRGYGI+NH+FD Y PV  G++GGR +G LVS+E GKAT Y I+++E+RG + FV P
Sbjct: 461 TRGYGIINHSFDSYQPVTPGQVGGRRQGVLVSMETGKATQYGIIQVEDRGTI-FVEP    516
```

There is also homology to SEQ ID 206. An alignment of the GAS and GBS proteins is shown below:

```
Identities = 228/237 (96%), Positives = 233/237 (98%), Gaps = 1/237 (0%)

Query:     1  MEDIFVGETVTPTDAIEPLPVLRIDEPTLQMTFLVNNSPFAGREGKWITSRKVEERLLAE    60
              MEDIFVGET+TPTD +E LP+LRIDEPTLQMTFLVNNSPFAGREGKWITSRKVEERLLAE
Sbjct:   284  MEDIFVGETITPTDCVEALPILRIDEPTLQMTFLVNNSPFAGREGKWITSRKVEERLLAE   343

Query:    61  LQTDVSLRVDPTDSPDKWTVSGRGELHLSILIETMRREGYELQVSRPEVIIKEIDGVQCE   120
              LQTDVSLRVDPTDSPDKWTVSGRGELHLSILIETMRREGYELQVSRPEVIIKEIDGV+CE
Sbjct:   344  LQTDVSLRVDPTDSPDKWTVSGRGELHLSILIETMRREGYELQVSRPEVIIKEIDGVKCE   403

Query:   121  PFERVQIDTPEEYQGAIIQSLSERKGDMLDMQMVGNGQTRLIFLIPARGLIGYSTEFLSM   180
              PFERVQIDTPEEYQGAIIQSLSERKGDMLDMQMVGNGQTRLIFLIPARGLIGYSTEFLSM
Sbjct:   404  PFERVQIDTPEEYQGAIIQSLSERKGDMLDMQMVGNGQTRLIFLIPARGLIGYSTEFLSM   463

Query:   181  TRGYGIMNHTFDQYLPVVQGEIGGRHRGALVSIENGKATTYSIMRIEERGNLSFVNP     237
              TRGYGIMNHTFDQYLPVVQGEIGGRHRGALVSIENGKATTYSIMRIEERG + FVNP
Sbjct:   464  TRGYGIMNHTFDQYLPVVQGEIGGRHRGALVSIENGKATTYSIMRIEERGTI-FVNP     519
```

Based on this analysis, it was predicted that these proteins and their epitopes could be useful antigens for vaccines or diagnostics.

Example 2322

A DNA sequence (GBSx2464) was identified in *S. agalactiae* <SEQ ID 7133> which encodes the amino acid sequence <SEQ ID 7134>. This protein is predicted to be pseudouridine synthase family 1 protein (rluB). Analysis of this protein sequence reveals the following:

Possible site: 34
>>> Seems to have no N-terminal signal sequence
----- Final Results -----
    bacterial cytoplasm --- Certainty = 0.1950 (Affirmative) <succ>
      bacterial membrane --- Certainty = 0.0000 (Not Clear) <succ>
       bacterial outside --- Certainty = 0.0000 (Not Clear) <succ>

The protein has homology with the following sequences in the GENPEPT database.

```
>GP:CAB14248 GB:Z99116 similar to hypothetical proteins [Bacillus subtilis]
Identities = 59/105 (56%), Positives = 85/105 (80%)

Query:     5  VKERIYPVGRLDWDTTGLLILTNDGDFTDKMIHPRNEIDKVYLARVKGIATKENLRPLTR    64
              + +RIYP+GRLD+DT+GLL+LTNDG+F +K++HP+ EIDK Y+A+VKGI  KE LR L R
Sbjct:    91  IPQRIYPIGRLDYDTSGLLLLTNDGEFANKLMHPKYEIDKTYVAKVKGIPPKELLRKLER   150

Query:    65  GVVIDGKKTKPARYTIIKVDHEKNRSVVELTIHEGRNHQVKKMFE                109
              G+ ++   KT PA+    ++ +D +K   S+++LTIHEGRN QV++MFE
Sbjct:   151  GIRLEEGKTAPAKAKLLSLDKKKQTSIIQLTIHEGRNRQVRRMFE                195
```

There is also homology to SEQ ID 4728:

```
Identities = 96/109 (88%), Positives = 106/109 (97%)

Query:     1  MLPQVKERIYPVGRLDWDTTGLLILTNDGDFTDKMIHPRNEIDKVYLARVKGIATKENLR    60
              +LPQVKERIYPVGRLDWDT+G+LILTNDGDFTD MIHPRNEIDKVYLARVKGIATKENLR
Sbjct:    94  LLPQVKERIYPVGRLDWDTSGVLILTNDGDFTDTMIHPRNEIDKVYLARVKGIATKENLR   153

Query:    61  PLTRGVVIDGKKTKPARYTIIKVDHEKNRSVVELTIHEGRNHQVKKMFE             109
              PLTRG+VIDGKKTKPARY I++V+ +K+RS+VELTIHEGRNHQVKKMFE
Sbjct:   154  PLTRGIVIDGKKTKPARYNIVRVEADKSRSIVELTIHEGRNHQVKKMFE             202
```

Based on this analysis, it was predicted that these proteins and their epitopes could be useful antigens for vaccines or diagnostics.

Example 2323

A DNA sequence (GBSx2466) was identified in *S. agalactiae* <SEQ ID 7135> which encodes the amino acid sequence <SEQ ID 7136>. This protein is predicted to be L-ribulose 5-phosphate 4-epimerase. Analysis of this protein sequence reveals the following:

Possible site: 19
>>> Seems to have no N-terminal signal sequence
----- Final Results -----
    bacterial cytoplasm --- Certainty = 0.2827 (Affirmative) <succ>
      bacterial membrane --- Certainty = 0.0000 (Not Clear) <succ>
       bacterial outside --- Certainty = 0.0000 (Not Clear) <succ>

The protein has homology with the following sequences in the GENPEPT database.

```
>GP:AAD45716 GB:AF160811 L-ribulose 5-phosphate 4-epimerase
[Bacillus stearothermophilus]
Identities = 68/103 (66%), Positives = 82/103 (79%)

Query:     2  QEMRERVCEANKSLPVHSLVKFTWGNVSEVDREAGLIVIKPSGVDYDQLTPENMVVTDLE    61
              +E+++ V EAN  LP + LV FTWGNVS +DRE GL+VIKPSGV YD+LT ++MVV DL
Sbjct:     3  EELKQAVLEANLQLPQYRLVTFTWGNVSGIDRERGLVVIKPSGVAYDKLTIDDMVVVDLT    62

Query:    62  GNIVEGDLNPSSDLPTHVQLYKAWPEVGGIVHTHSTEAVGWAQ                   104
              GN+VEGDL PSSD PTH+ LYK +P +GGIVHTHST A  WAQ
Sbjct:    63  GNVVEGDLKPSSDTPTHLWLYKQFPGIGGIVHTHSTWATVWAQ                   105
```

There is also homology to SEQ ID 4600:

```
Identities = 93/103 (90%), Positives = 96/103 (92%)

Query:     2  QEMRERVCEANKSLPVHSLVKFTWGNVSEVDREAGLIVIKPSGVDYDQLTPENMVVTDLE    61
              QEMRERVC ANKSLP H LVKFTWGNVSEV RE G IVIKPSGVDYD LTPENMVVTDL+
Sbjct:     6  QEMRERVCAANKSLPQHGLVKFTWGNVSEVCRELGRIVIKPSGVDYDLLTPENMVVTDLD    65

Query:    62  GNIVEGDLNPSSDLPTHVQLYKAWPEVGGIVHTHSTEAVGWAQ                   104
              GN+VEGDLNPSSDLPTHV+LYKAWPEVGGIVHTHSTEAVGWAQ
Sbjct:    66  GNVVEGDLNPSSDLPTHVELYKAWPEVGGIVHTHSTEAVGWAQ                   108
```

Based on this analysis, it was predicted that these proteins and their epitopes could be useful antigens for vaccines or diagnostics.

Example 2324

A DNA sequence (GBSx2467) was identified in *S. agalactiae* <SEQ ID 7137> which encodes the amino acid sequence <SEQ ID 7138>. Analysis of this protein sequence reveals the following:

Possible site: 20
>>> Seems to have no N-terminal signal sequence
----- Final Results -----
  bacterial cytoplasm --- Certainty = 0.3452 (Affirmative) <succ>
  bacterial membrane --- Certainty = 0.0000 (Not Clear) <succ>
  bacterial outside --- Certainty = 0.0000 (Not Clear) <succ>

The protein has homology with the following sequences in the GENPEPT database.

```
>GP:AAG05712 GB:AE004658 hypothetical protein [Pseudomonas aeruginosa]
Identities = 141/200 (70%), Positives = 162/200 (80%), Gaps = 1/200 (0%)

Query:    10  LSLGTDYETLANRFRPIFREISAGNVEREKARALPYEPIEWLKKAGFGAVRVPSEYGGAG    69
              LS G DYE LA RFRPIF  I+ G VERE+ R LP+E I WLK+AGFGAVRVP E+GGAG
Sbjct:    14  LSEGADYELLAQRFRPIFARIAEGAVERERQRELPHEAIAWLKQAGFGAVRVPREHGGAG    73

Query:    70  ASIGQLFQLLIELAEADSNIPQALRAHFAFVEDRLNAPPGVDRDTWFARFVAGDLVGNGW   129
              AS+ QL QLLIELAEADSNI QALR HFAFVEDRLNA PG  RD W  RFV GDLVG  W
Sbjct:    74  ASLPQLVQLLIELAEADSNITQALRGHFAFVEDRLNAEPGPGRDRWLRRFVEGDLVGCAW   133

Query:   130  TEVGTVKIGDVITKVSAQGDG-FVLNGTKFYSTGSIFADWIDVYAQRADNGADVIAVVNA   188
              TEVG+V++G+V+T+VS + DG +V+NG+K+YSTGS+F+DWID+YAQR D GADVIA +
Sbjct:   134  TEVGSVRLGEVLTRVSRKDDGRWVVNGSKYYSTGSLFSDWIDLYAQRDDTGADVIAAIRT   193

Query:   189  RHAGVRHSDDWDGFGQRTTG                                          208
                 GVR SDDWDGFGQRTTG
Sbjct:   194  DQPGVRQSDDWDGFGQRTTG                                          213
```

No corresponding DNA sequence was identified in *S. pyogenes*.

Based on this analysis, it was predicted that this protein and its epitopes, could be useful antigens for vaccines or diagnostics.

Example 2325

A DNA sequence (GBSx2468) was identified in *S. agalactiae* <SEQ ID 7139> which encodes the amino acid sequence <SEQ ID 7140>. Analysis of this protein sequence reveals the following:

Possible site: 15
>>> Seems to have no N-terminal signal sequence
----- Final Results -----
  bacterial cytoplasm --- Certainty = 0.1919 (Affirmative) <succ>
  bacterial membrane --- Certainty = 0.0000 (Not Clear) <succ>
  bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2326

A DNA sequence (GBSx2474) was identified in *S. agalactiae* <SEQ ID 7141> which encodes the amino acid sequence <SEQ ID 7142>. Analysis of this protein sequence reveals the following:

```
Possible site: 39
>>> Seems to have no N-terminal signal sequence
----- Final Results -----
    bacterial cytoplasm --- Certainty = 0.2978 (Affirmative) <succ>
      bacterial membrane --- Certainty = 0.0000 (Not Clear) <succ>
       bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2327

A DNA sequence (GBSx2476) was identified in *S. agalactiae* <SEQ ID 7143> which encodes the amino acid sequence <SEQ ID 7144>. Analysis of this protein sequence reveals the following:

```
Possible site: 61
>>> Seems to have no N-terminal signal sequence
----- Final Results -----
    bacterial cytoplasm --- Certainty = 0.5402 (Affirmative) <succ>
      bacterial membrane --- Certainty = 0.0000 (Not Clear) <succ>
       bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2328

A DNA sequence (GBSx2477) was identified in *S. agalactiae* <SEQ ID 7145> which encodes the amino acid sequence <SEQ ID 7146>. This protein is predicted to be mercuric reductase. Analysis of this protein sequence reveals the following:

```
Possible site: 49
>>> Seems to have no N-terminal signal sequence
----- Final Results -----
    bacterial cytoplasm --- Certainty = 0.2755 (Affirmative) <succ>
      bacterial membrane --- Certainty = 0.0000 (Not Clear) <succ>
       bacterial outside --- Certainty = 0.0000 (Not Clear) <succ>
```

The protein has homology with the following sequences in the GENPEPT database.

```
>GP:CAA70224 GB:Y09024 mercuric reductase [Bacillus cereus]
Identities = 190/247 (76%), Positives = 225/247 (90%)

Query:     1  MELGQLFHHLGSEITLMQRSERLLKEYDPEISESVEKALIEQGINLVKGATFERVEQSGE    60
              MELGQLFH+LGSE+TL+QRSERLLKEYDPEISESVEK+L+EQGINLVKGAT+ER+EQ+G+
Sbjct:   262  MELGQLFHNLGSEVTLIQRSERLLKEYDPEISESVEKSLVEQGINLVKGATYERIEQNGD   321

Query:    61  IKRVYVTVNGSREVIESDQLLVATGRKPNTDSLNLSAAGVETGKNNEILINDFGQTSNEK   120
              IK+V+V VNG + +IE+DQLLVATGR PNT +LNL AAGVE G    EI+I+D+ +T+N +
Sbjct:   322  IKKVHVEVNGKKRIIEADQLLVATGRTPNTATLNLRAAGVEIGSRGEIIIDDYSRTTNTR   381

Query:   121  IYAAGDVTLGPQFVYVAAYEGGIITDNAIGGLNKKIDLSVVPAVTFTNPTVATVGLTEEQ   180
              IYAAGDVTLGPQFVYVAAY+GG+   NAIGGLNKK++L VVP VTFT P +ATVGLTE+Q
Sbjct:   382  IYAAGDVTLGPQFVYVAAYQGGVAAPNAIGGLNKKLNLEVVPGVTFTAPAIATVGLTEQQ   441

Query:   181  AKEKGYDVKTSVLPLGAVPRAIVNRETTGVFKLVADAETLKVLGVHIVSENAGDVIYAAS   240
              AKE GY+VKTSVLPL AVPRA+VNRETTGVFKLVAD++T+KVLG H+V+ENAGDVIYAA+
Sbjct:   442  AKENGYEVKTSVLPLDAVPRALVNRETTGVFKLVADSKTMKVLGAHVVAENAGDVIYAAT   501

Query:   241  LAVKFGL                                                       247
              LAVKFGL
Sbjct:   502  LAVKFGL                                                       508
```

There is also homology to SEQ ID 1820.

Based on this analysis, it was predicted that this protein and its epitopes, could be useful antigens for vaccines or diagnostics.

Example 2329

A DNA sequence (GBSx2478) was identified in *S. agalactiae* <SEQ ID 7147> which encodes the amino acid sequence <SEQ ID 7148>. Analysis of this protein sequence reveals the following:

```
Possible site: 30
>>> Seems to have no N-terminal signal sequence
----- Final Results -----
    bacterial cytoplasm --- Certainty = 0.3642 (Affirmative) <succ>
      bacterial membrane --- Certainty = 0.0000 (Not Clear) <succ>
       bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2330

A DNA sequence (GBSx2479) was identified in *S. agalactiae* <SEQ ID 7149> which encodes the amino acid sequence <SEQ ID 7150>. This protein is predicted to be surface protein Rib. Analysis of this protein sequence reveals the following:

```
Identities = 42/157 (26%), Positives = 78/157 (48%), Gaps = 2/157 (1%)

Query:   71  LLGREFIDSQHFKDINAYFLRHFICYCYYFIPDFYFLNTSRLSY--SKDLYHLLDKGLAD  128
             LLG  ++S  FK I   F R FI      +PD +  +  R    +K  Y+ L    + +
Sbjct:    8  LLGNNILNSLPFKRILVSFSRLFISNLQVLLPDIHLFHYLRRQQKRNKSFYNTLKTIVEE   67

Query:  129  IFNLKGGNLTFSKHETVLLTMQLSNLIETFLAPLSVYVISSSNIRLQTYQVMLNQYFTSK  188
             +  +G        +  +L T+QL  L++T+L P+ VY+++++    L     L+ YF
Sbjct:   68  WMSAEGIVGKLPSYHLLLFTIQLEELLKTYLPPIPVYLLTNNTAALDLMTNALSIYFPPA  127

Query:  189  IAEFFFVNYQTTQIDEKLLKKADIIIAERRYISSLKN  225
             IA    VN +    + + +K  +IIA+R+Y++ +++
Sbjct:  128  IATVMPVNVEIIPFKDIVKEKQSVIIADRQYLNLIQH  164
```

Possible site: 61
>>> Seems to have no N-terminal signal sequence
----- Final Results -----
    bacterial cytoplasm --- Certainty = 0.1936 (Affirmative) <succ>
      bacterial membrane --- Certainty = 0.0000 (Not Clear) <succ>
        bacterial outside --- Certainty = 0.0000 (Not Clear) <succ>

No corresponding DNA sequence was identified in *S. pyogenes*.

Based on this analysis, it was predicted that this protein and its epitopes, could be useful antigens for vaccines or diagnostics.

Example 2331

A DNA sequence (GBSx2480) was identified in *S. agalactiae* <SEQ ID 7151> which encodes the amino acid sequence <SEQ ID 7152>. This protein is predicted to be Nra. Analysis of this protein sequence reveals the following:

Possible site: 36
>>> Seems to have no N-terminal signal sequence
----- Final Results -----
    bacterial cytoplasm --- Certainty = 0.1510 (Affirmative) <succ>
      bacterial membrane --- Certainty = 0.0000 (Not Clear) <succ>
        bacterial outside --- Certainty = 0.0000 (Not Clear) <succ>

A related GBS nucleic acid sequence <SEQ ID 9383> which encodes amino acid sequence <SEQ ID 9384> was also identified.

The protein has no significant homology with any sequences in the GENPEPT database.

A related DNA sequence was identified in *S. pyogenes* <SEQ ID 7153> which encodes the amino acid sequence <SEQ ID 7154>. Analysis of this protein sequence reveals the following:

Possible site: 16
>>> Seems to have no N-terminal signal sequence
INTEGRAL    Likelihood = −0.64    Transmembrane    22-38 (22-38)
----- Final Results -----
    bacterial membrane --- Certainty = 0.1256 (Affirmative) <succ>
      bacterial outside --- Certainty = 0.0000 (Not Clear) <succ>
        bacterial cytoplasm --- Certainty = 0.0000 (Not Clear) <succ>

An alignment of the GAS and GBS proteins is shown below.

Based on this analysis, it was predicted that these proteins and their epitopes could be useful antigens for vaccines or diagnostics.

Example 2332

A DNA sequence (GBSx2481) was identified in *S. agalactiae* <SEQ ID 7155> which encodes the amino acid sequence <SEQ ID 7156>. Analysis of this protein sequence reveals the following:

Possible site: 20
>>> Seems to have no N-terminal signal sequence
----- Final Results -----
    bacterial cytoplasm --- Certainty = 0.1383 (Affirmative) <succ>
      bacterial membrane --- Certainty = 0.0000 (Not Clear) <succ>
        bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2333

A DNA sequence (GBSx2482) was identified in *S. agalactiae* <SEQ ID 7157> which encodes the amino acid sequence <SEQ ID 7158>. Analysis of this protein sequence reveals the following:

Possible site: 60
>>> Seems to have no N-terminal signal sequence
----- Final Results -----
    bacterial cytoplasm --- Certainty = 0.4145 (Affirmative) <succ>

Example 2334

A DNA sequence (GBSx2484) was identified in *S. agalactiae* <SEQ ID 7159> which encodes the amino acid sequence <SEQ ID 7160>. Analysis of this protein sequence reveals the following:

Possible site: 57
>>> Seems to have no N-terminal signal sequence
INTEGRAL   Likelihood = –2.02   Transmembrane   34-50 (34-50)
----- Final Results -----
  bacterial membrane --- Certainty= 0.1808 (Affirmative) <succ>
    bacterial outside --- Certainty = 0.0000 (Not Clear) <succ>
      bacterial cytoplasm --- Certainty = 0.0000 (Not Clear) <succ>
        bacterial membrane --- Certainty = 0.0000 (Not Clear) <succ>
          bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2335

A DNA sequence (GBSx2485) was identified in *S. agalactiae* <SEQ ID 7161> which encodes the amino acid sequence <SEQ ID 7162>. Analysis of this protein sequence reveals the following:

Possible site: 49
>>> Seems to have no N-terminal signal sequence
----- Final Results -----
  bacterial cytoplasm --- Certainty = 0.3488 (Affirmative) <succ>
    bacterial membrane --- Certainty = 0.0000 (Not Clear) <succ>
      bacterial outside --- Certainty = 0.0000 (Not Clear) <succ>

The protein has homology with the following sequences in the GENPEPT database.

```
>GP:CAB52002 GB:AL109663 hypothetical protein [Streptomyces coelicolor A3(2)]
Identities = 61/141 (43%), Positives = 86/141 (60%), Gaps = 2/141 (1%)

Query:    3  TYFDNFLKTNQAYADLHGTAHLPIKPKTKVAIVTCMDSRLHVAQALGLALGDAHILRNAG   62
             T  D  ++ N+ YA       +  +P  +VA+V CMD+RL  +   ALGL LGD H +RNAG
Sbjct:    5  TVTDRLVEANERYAAAFADPGMDARPVQRVAVVACMDARLDLHAALGLKLGDCHTIRNAG   64

Query:   63  GRVTDDVLRSLVISQQQLGTREIVVLHHTDCGAQTFTNEAFAAQLQRDLGVDMHGHDFLP  122
             G  VTDDV+RSL ISQ+ LGTR + ++HHT CG +T T E F     L+ ++G
Sbjct:   65  GVVTDDVIRSLTISQRALGTRSVALIHHTGCGMETITEE-FRHDLELEVG-QRPAWAVEA  122

Query:  123  FNDIEESVREDVAKLHASPFL                                         143
             F D ++ VR+ + ++  SPFL
Sbjct:  123  FRDADQDVRQSIERVRTSPFL                                         143
```

A related DNA sequence was identified in *S. pyogenes* <SEQ ID 6469> which encodes the amino acid sequence <SEQ ID 6470>. Analysis of this protein sequence reveals the following:

Possible site: 20
>>> Seems to have no N-terminal signal sequence
----- Final Results -----
  bacterial cytoplasm --- Certainty = 0.2295 (Affirmative) <succ>
    bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 109/146 (74%), Positives = 128/146 (87%)

Query:    1  MTTYFDNFLKTNQAYADLHGTAHLPIKPKTKVAIVTCMDSRLHVAQALGLALGDAHILRN   60
             +  +YF++F+   NQAY  LHGTAHLP+KPKTKVAIVTCMDSRLHVAQALGLALGDAHILRN
Sbjct:    1  LMSYFEHFMAANQAYVALHGTAHLPLKPKTKVAIVTCMDSRLHVAQALGLALGDAHILRN   60

Query:   61  AGGRVTDDVLRSLVISQQQLGTREIVVLHHTDCGAQTFTNEAFAAQLQRDLGVDMHGHDF  120
             AGGRVT+D++RSLVISQQQ+GTREIVVLHHTDCGAQTFTNE FA  +    LGVD+ G DF
Sbjct:   61  AGGRVTEDMIRSLVISQQQMGTREIVVLHHTDCGAQTFTNEGFAKHIHEHLGVDVSGQDF  120

Query:  121  LPFNDIEESVREDVAKLHASPFLREE                                    146
             LPF D+E+SVRED+AK+ AS   + ++
Sbjct:  121  LPFQDVEDSVREDMAKIRASSLISDD                                    146
```

Based on this analysis, it was predicted that these proteins and their epitopes could be useful antigens for vaccines or diagnostics.

Example 2336

A DNA sequence (GBSx2486) was identified in *S. agalactiae* <SEQ ID 7163> which encodes the amino acid sequence <SEQ ID 7164>. Analysis of this protein sequence reveals the following:

```
Possible site: 26
>>> Seems to have no N-terminal signal sequence
----- Final Results -----
   bacterial cytoplasm --- Certainty = 0.0932 (Affirmative) <succ>
      bacterial membrane --- Certainty = 0.0000 (Not Clear) <succ>
         bacterial outside --- Certainty = 0.0000 (Not Clear) <succ>
```

The protein has homology with the following sequences in the GENPEPT database.

```
>GP:AAG08811 GB:AE004955 phosphoribosyl-
aminoimidazole carboxylase, catalytic subunit
[Pseudomonas aeruginosa]
Identities = 20/27 (74%), Positives = 26/27 (96%)

Query:    1  MFKHAEEARGRGIKIIAGAGGAAHLP                27
             +F++AEEA GRG+++IIAGAGGAAHLP
Sbjct:   46  LFQYAEEAEGRGLEVIIAGAGGAAHLP                72
```

There is also homology to SEQ ID 910:

```
Identities = 27/27 (100%), Positives = 27/27 (100%)

Query:    1  MFKHAEEARGRGIKIIAGAGGAAHLP                27
             MFKHAEEARGRGIKIIAGAGGAAHLP
Sbjct:   87  MFKHAEEARGRGIKIIAGAGGAAHLP               113
```

Based on this analysis, it was predicted that these proteins and their epitopes could be useful antigens for vaccines or diagnostics.

Example 2337

A DNA sequence (GBSx2488) was identified in *S. agalactiae* <SEQ ID 7165> which encodes the amino acid sequence <SEQ ID 7166>. Analysis of this protein sequence reveals the following:

```
Possible site: 43
>>> Seems to have an uncleavable N-term signal seq
INTEGRAL   Likelihood = -6.85    Transmembrane 58-74 (53-80)
INTEGRAL   Likelihood = -5.79    Transmembrane 103-119 (101-122)
----- Final Results -----
```

```
   bacterial membrane --- Certainty = 0.3739 (Affirmative) <succ>
      bacterial outside--- Certainty = 0.0000 (Not Clear) <succ>
         bacterial cytoplasm --- Certainty = 0.0000 (Not Clear) <succ>
```

There is also homology to SEQ IDs 880 and 9278.

Based on this analysis, it was predicted that this protein and its epitopes, could be useful antigens for vaccines or diagnostics.

Example 2338

A DNA sequence (GBSx2489) was identified in *S. agalactiae* <SEQ ID 7167> which encodes the amino acid sequence <SEQ ID 7168>. This protein is predicted to be short chain alcohol dehydrogenase. Analysis of this protein sequence reveals the following:

```
Possible site: 16
>>> Seems to have no N-terminal signal sequence
----- Final Results -----
   bacterial cytoplasm --- Certainty = 0.1742 (Affirmative) <succ>
      bacterial membrane --- Certainty = 0.0000 (Not Clear) <succ>
         bacterial outside --- Certainty = 0.0000 (Not Clear) <succ>
```

A related GBS nucleic acid sequence <SEQ ID 9357> which encodes amino acid sequence <SEQ ID 9358> was also identified.

The protein has homology with the following sequences in the GENPEPT database.

```
>GP:AAD06605 GB:AE001530 putative oxidoreductase [Helicobacter pylori J99]
Identities = 68/94 (72%), Positives = 79/94 (83%)

Query:    4  IDLLVNNAGLALGLDKSYEADFGDWMTMINTNVVGLIYLTRCILPKMVEVNRGLIINLGS    63
             ID L+NNAGLALGL+K+YE +  DW  MI+TN+ GL++LTR ILP M+E ++G IINLGS
Sbjct:   76  IDALINNAGLALGLNKAYECELDDWEVMIDTNIKGLLHLTRLILPSMIEHDQGTIINLGS   135

Query:   64  XAGTIPYPGANVYGASKAFVKQFSLNLRADLAGT                              97
             AGT  YPG NVYGASKAFVKQFSLNLRADLAGT
Sbjct:  136  IAGTYAYPGGNVYGASKAFVKQFSLNLRADLAGT                             169
```

A related DNA sequence was identified in *S. pyogenes* <SEQ ID 7169> which encodes the amino acid sequence <SEQ ID 7170>. Analysis of this protein sequence reveals the following:

```
Possible site: 18
>>> Seems to have an uncleavable N-term signal seq
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>
```

A related sequence was also identified in GAS <SEQ ID 9121> which encodes the amino acid sequence <SEQ ID 9122>. Analysis of this protein sequence reveals the following:

```
Possible site: 12
>>> Seems to have an uncleavable N-term signal seq
----- Final Results -----
```

-continued

```
    bacterial membrane --- Certainty = 0.0000 (Not Clear) <succ>
    bacterial outside --- Certainty = 0.0000 (Not Clear) <succ>
      bacterial cytoplasm --- Certainty = 0.0000 (Not Clear) <succ>
```

An alignment of the GAS and GBS proteins is shown below.

```
Identities = 78/96 (81%), Positives = 87/96 (90%)

Query:    2  QSIDLLVNNAGLALGLDKSYEADFGDWMTMINTNVVGLIYLTRCILPKMVEVNRGLIINL    61
             Q I +LVNNAGLALGLDK+YEADF +WMTMINTN+VGLIYLTR +LP MV  + G+IINL
Sbjct:   82  QDITILVNNAGLALGLDKAYEADFENWMTMINTNIVGLIYLTRQLLPHMVSKDDGIIINL   141

Query:   62  GSXAGTIPYPGANVYGASKAFVKQFSLNLRADLAGT                            97
             GS AGTIPYPGAN+YGASKAFVKQFSLNLRADLAG+
Sbjct:  142  GSTAGTIPYPGANIYGASKAFVKQFSLNLRADLAGS                           177
```

Based on this analysis, it was predicted that these proteins and their epitopes could be useful antigens for vaccines or diagnostics.

Example 2339

A DNA sequence (GBSx2492) was identified in *S. agalactiae* <SEQ ID 7171> which encodes the amino acid sequence <SEQ ID 7172>. This protein is predicted to be mercuric reductase. Analysis of this protein sequence reveals the following:

```
Possible site: 53
>>> Seems to have no N-terminal signal sequence
----- Final Results -----
    bacterial cytoplasm --- Certainty = 0.2115 (Affirmative) <succ>
    bacterial membrane --- Certainty = 0.0000 (Not Clear) <succ>
    bacterial outside --- Certainty = 0.0000 (Not Clear) <succ>
```

The protein has homology with the following sequences in the GENPEPT database.

```
>GP:CAC14663 GB:Y10855 mercuric reductase [Bacillus licheniformis]
Identities = 68/104 (65%), Positives = 82/104 (78%)

Query:    1  MNKFKVNISGMTCTGCEKHVESALEKIGAKNIESSYRRGEAVFELPDDIEVESAIKAIDE    60
             M K++VN+ GMTCTGCE+HV  ALE +GAK IE  YRRGEAVFELP+ +EVE+A KAI E
Sbjct:    1  MKKYRVNVQGMTCTGCEEHVAVALENMGAKRIEVDYRRGEAVFELPNGLEVETAKKAIAE    60

Query:   61  ANYQAGEIEEVSSLENVALINEDNYDLLIIGSGAAAFSSAIKAI                   104
             A YQ GE EEV S E + L +E +YD +IIGSG AAFSSAI+A+
Sbjct:   61  AKYQPGEAEEVQSQELIQLGDEGDYDYIIIGSGGAAFSSAIEAV                   104
```

No corresponding DNA sequence was identified in *S. pyogenes*.

Based on this analysis, it was predicted that this protein and its epitopes, could be useful antigens for vaccines or diagnostics.

Example 2340

A DNA sequence (GBSx2494) was identified in *S. agalactiae* <SEQ ID 7173> which encodes the amino acid sequence <SEQ ID 7174>. Analysis of this protein sequence reveals the following:

```
Possible site: 58
>>> Seems to have no N-terminal signal sequence
----- Final Results -----
    bacterial cytoplasm --- Certainty = 0.3341 (Affirmative) <succ>
```

-continued

```
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2341

A DNA sequence (GBSx2495) was identified in *S. agalactiae* <SEQ ID 7175> which encodes the amino acid sequence <SEQ ID 7176>. Analysis of this protein sequence reveals the following:

```
Possible site: 31
>>> Seems to have no N-terminal signal sequence
----- Final Results -----
    bacterial cytoplasm --- Certainty = 0.4989 (Affirmative) <succ>
    bacterial membrane --- Certainty = 0.0000 (Not Clear) <succ>
    bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2342

A DNA sequence (GBSx2496) was identified in *S. agalactiae* <SEQ ID 7177> which encodes the amino acid sequence <SEQ ID 7178>. Analysis of this protein sequence reveals the following:

```
Possible site: 30
>>> Seems to have no N-terminal signal sequence
----- Final Results -----
   bacterial cytoplasm --- Certainty = 0.2569 (Affirmative) <succ>
      bacterial membrane --- Certainty = 0.0000 (Not Clear) <succ>
       bacterial outside --- Certainty = 0.0000 (Not Clear) <succ>
```

Based on this analysis, it was predicted that this protein and its epitopes, could be useful antigens for vaccines or diagnostics.

Example 2343

A DNA sequence (GBSx2497) was identified in *S. agalactiae* <SEQ ID 7179> which encodes the amino acid sequence <SEQ ID 7180>. This protein is predicted to be DNA polymerase III alpha subunit (dnaE). Analysis of this protein sequence reveals the following:

```
Possible site: 60
>>> Seems to have no N-terminal signal sequence
----- Final Results -----
   bacterial cytoplasm --- Certainty = 0.3124 (Affirmative) <succ>
      bacterial membrane --- Certainty = 0.0000 (Not Clear) <succ>
       bacterial outside --- Certainty = 0.0000 (Not Clear) <succ>
```

A related DNA sequence was identified in *S. pyogenes* <SEQ ID 4095> which encodes the amino acid sequence <SEQ ID 4096>. Analysis of this protein sequence reveals the following:

```
Possible site: 36
>>> Seems to have no N-terminal signal sequence
----- Final Results -----
   bacterial cytoplasm --- Certainty = 0.2600 (Affirmative) <succ>
      bacterial membrane --- Certainty = 0.0000 (Not Clear) <succ>
       bacterial outside --- Certainty = 0.0000 (Not Clear) <succ>
```

An alignment of the GAS and GBS proteins is shown below.

```
Identities = 186/237 (780), Positives = 214/237 (89%)

Query:  10  DPVKHNLIFERFLNEERYSMPDIDIDLPDIYRGEFLRYVRNRYGSMHSAQIVTFSTFGAK   69
            DPV+H+L+FERFLN+ERYSMPDIDIDLPDIYR EFLRYVRNRYGS HSAQIVTFSTFG K
Sbjct: 321  DPVQHDLLFERFLNKERYSMPDIDIDLPDIYRSEFLRYVRNRYGSDHSAQIVTFSTFGPK   380

Query:  70  QAIRDVYKRFGASEYELTNITKKIHFRDNLTSVYNRNLAFRQIIDSKIEYQKAYDIAKRI  129
            QAIRDV+KRFG  EYELTN+TKKI F+D+L +VY ++++FRQ+I+S+ E+QKA+ IAKRI
Sbjct: 381  QAIRDVFKRFGVPEYELTNLTKKIGFKDSLATVYEKSISFRQVINSRTEFQKAFAIAKRI  440

Query: 130  EGNPRQTSIHAAGVVMSDDLLTDHIPLKNGEDMMITQYDASSVEDNGLLKMDFLGLRNLT  189
            EGNPRQTSIHAAG+VMSDD LT+HIPLK+G+DMMITQYDA +VE NGLLKMDFLGLRNLT
Sbjct: 441  EGNPRQTSIHAAGIVMSDDALTNHIPLKSGDDMMITQYDAHAVEANGLLKMDFLGLRNLT  500

Query: 190  FVQKMKEKVDKDYGISIQLETIDLEDKETLKLFAAGQTKGIFQFEQSGAINLLRRIR     246
            FVQKM+EKV KDYG  I +   IDLED +TL LFA G TKGIFQFEQ+GAINLL+RI+
Sbjct: 501  FVQKMQEKVAKDYGCQIDITAIDLEDPQTLALFAKGDTKGIFQFEQNGAINLLKRIK     557
```

Based on this analysis, it was predicted that these proteins and their epitopes could be useful antigens for vaccines or diagnostics.

Example 2344

A DNA sequence (GBSx2498) was identified in *S. agalactiae* <SEQ ID 7181> which encodes the amino acid sequence <SEQ ID 7182>. This protein is predicted to be a methylase. Analysis of this protein sequence reveals the following:

```
Possible site: 60
>>> Seems to have no N-terminal signal sequence
----- Final Results -----
    bacterial cytoplasm --- Certainty = 0.2121 (Affirmative) <succ>
      bacterial membrane --- Certainty = 0.0000 (Not Clear) <succ>
        bacterial outside --- Certainty = 0.0000 (Not Clear) <succ>
```

The protein has homology with the following sequences in the GENPEPT database.

```
>GP:AAG21729 GB:AF116907 putative methylase [Corynebacterium hoagii]
Identities = 48/160 (300), Positives = 85/160 (53%), Gaps = 6/160 (3%)

Query:   97  EPDDSENGHNDTDLEETDNQIPEEEVVETIPEIPVTDFYFPEDLTDFYPKTARDKVETNI    156
             EP+           +  E +  + ++E         +P TDF    D+     P  A+ +V  NI
Sbjct: 1236  EPEAPTQPEAASAAETAEPAVEQQEPRAGPQSVPATDFALGTDV--HVPSGAKARVRANI   1293

Query:  157  VAIRLVENLEVEHRNASPSEQELLAKYVGWGGLANEFFDD---YNPKFSKEREELKSLVT    213
               A RLV  L+ + R A+   EQ +LA++ GWG +   E FD+    +  +++ ER  L   L+
Sbjct: 1294  AAARLVLELDEQQRPATAEEQAVLAQWSGWGAVP-EVFDNRSKFLSEWADERAALLDLLG   1352

Query:  214  DKEYSDMKQSSLTAYYTDPSLIRQMWGIVERDGFTGWQIL                       253
             +K +S    ++++L A+YTDP+++ ++W  V+R G      +L
Sbjct: 1353  EKGFSQARETTLNAHYTDPAIVGELWRAVQRAGLPDGALL                      1392
```

No corresponding DNA sequence was identified in *S. pyogenes*.

Based on this analysis, it was predicted that this protein and its epitopes, could be useful antigens for vaccines or diagnostics.

Example 2345

A DNA sequence (GBSx2499) was identified in *S. agalactiae* <SEQ ID 7183> which encodes the amino acid sequence <SEQ ID 7184>. Analysis of this protein sequence reveals the following:

```
Possible site: 34
>>> Seems to have no N-terminal signal sequence
----- Final Results -----
    bacterial cytoplasm --- Certainty = 0.1111 (Affirmative) <succ>
      bacterial membrane --- Certainty = 0.0000 (Not Clear) <succ>
        bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2346

A DNA sequence (GBSx2501) was identified in *S. agalactiae* <SEQ ID 7185> which encodes the amino acid sequence <SEQ ID 7186>. Analysis of this protein sequence reveals the following:

```
Possible site: 39
>>> Seems to have no N-terminal signal sequence
----- Final Results -----
    bacterial cytoplasm --- Certainty = 0.4752 (Affirmative) <succ>
      bacterial membrane --- Certainty = 0.0000 (Not Clear) <succ>
        bacterial outside --- Certainty = 0.0000 (Not Clear) <succ>
```

The protein has homology with the following sequences in the GENPEPT database.

```
>GP:CAA61516 GB:X89232 DNA-directed RNA polymerase [Pediococcus
acidilactici]
Identities = 48/53 (90%), Positives = 52/53 (97%)

Query:   5  KKPETINYRTLKPEREGLFDEVIFGPTKDWECACGKYKRIRYKGIICDRCGVE 57
            KKPETINYRTLYPE++GLFDE IFGPTKD+ECACGKYKRIRYKGI+CDRCGVE
Sbjct:  29  KKPETINYRTLKPEKDGLFDERIFGPTKDYECACGKYKRIRYKGIVCDRCGVE 81
```

There is also homology to SEQ ID 384.

Based on this analysis, it was predicted that these proteins and their epitopes could be useful antigens for vaccines or diagnostics.

Example 2347

A DNA sequence (GBSx2502) was identified in *S. agalactiae* <SEQ ID 7187> which encodes the amino acid sequence <SEQ ID 7188>. Analysis of this protein sequence reveals the following:

Possible site: 22
>>> Seems to have no N-terminal signal sequence
----- Final Results -----
   bacterial cytoplasm --- Certainty = 0.3080 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:AAC00282 GB:AF008220 Yt1R [Bacillus subtilis]
Identities = 61/216 (28%), Positives = 98/216 (45%), Gaps = 28/216 (12%)

Query:   8    IPCTYYPVGSGNDFARALKIPNL---------KETLTAIQTERLKEINCFIYDKGLIL--   56
              I  ++ P G+ NDF+R   I +         K  LT +T  L  +N F+ DK  IL
Sbjct:  86    IELSFVPAGAYNDFSRGFSIKKIDLIQEIKKVKRPLT--RTFHLGSVN-FLQDKSQILYF  142

Query:  57    -NSLDLGFAAYVVWKASNSKIKNILNRYRLGKITYIVIAIKSLLHSSK------VQVLVE  109
               N + +GF AYV   KA     ++ +    RL   + Y +     S LH+S        +     E
Sbjct: 143    MNHIGIGFDAYVNKKAMEFPLRRVFLFLRLRFLVYPL----SHLHASATFKPFTLACTTE  198

Query: 110    GETGQQIKLNDLYFFALANNTYFGGGITIWPKASALTAELDMVYAKGHTFLKRLSILLSL  169
              ET +    +D++F  ++N+ ++GGG+      P A+       D+V  +   FLK+  +L  +
Sbjct: 199    DETRE---FHDVWFAVVSNHPFYGGGMKAAPLANPREKTFDIVIVENQPFLKKYWLLCLM  255

Query: 170    VFKRHTTSKSIKHQTFKAMTVYFPKNSLIEIDGEIV                         205
              F  +HT    +     K +T Y          DGEI+
Sbjct: 256    AFGKHTKMDGVTMFKAKDITFYTKDKIPFHADGEIM                         291
```

No corresponding DNA sequence was identified in *S. pyogenes*.

Based on this analysis, it was predicted that this protein and its epitopes, could be useful antigens for vaccines or diagnostics.

Example 2348

A DNA sequence (GBSx2503) was identified in *S. agalactiae* <SEQ ID 7189> which encodes the amino acid sequence <SEQ ID 7190>. This protein is predicted to be protease subunit HflC (hflC) Analysis of this protein sequence reveals the following:

Possible site: 18
>>> Seems to have no N-terminal signal sequence
----- Final Results -----
   bacterial cytoplasm --- Certainty = 0.1809 (Affirmative) <succ>
   bacterial membrane --- Certainty = 0.0000 (Not Clear) <succ>
   bacterial outside --- Certainty = 0.0000 (Not Clear) <succ>

The protein has homology with the following sequences in the GENPEPT database.

```
>GP:AAG08326 GB:AE004907 protease subunit Hf1C [Pseudomonas aeruginosa]
Identities = 182/202 (90%), Positives = 194/202 (95%)

Query:   1    MSQTERAVLLQFGKVVQTDVKPGLHVKVPYVNQVRKFDGRLLTLDAPTQRFLTLEKKANM   60
              + QTERAV+L+FG+VV++DVKPGLH K+PYVNQVRKFD RLLTLDAPTQRFLTLEKKAVM
Sbjct:  26    VQQTERAVMLRFGRVVESDVKPGLHFKIPYVNQVRKFDARLLTLDAPTQRFLTLEKKAVM   85

Query:  61    VDAYAKWRVKDAERFYTATSGLKQIADERLSRRLESGLRDQFGKRTLHEVVSGERDALMA  120
              VDAYAKWRV DAERFYTATSGLKQIADERLSRRLE+GLRDQFGKRTLHEVVSGERDALM
Sbjct:  86    VDAYAKWRVADAERFYTATSGLKQIADERLSRRLEAGLRDQFGKRTLHEVVSGERDALMG  145

Query: 121    DITGSLNRMAEKELGIEVLDVRVKAIDLPKEVNRSVFERMSTEREREAREHRAKGNELGE  180
              DIT SLNRMA+KELGIEV+DVRVKAIDLPKEVNRSVFERMSTEREREAREHRAKG EL E
Sbjct: 146    DITASLNRMAQKELGIEVIDVRVKAIDLPKEVNRSVFERMSTEREREAREHRAKGRELAE  205

Query: 181    GIRADADRQRRVLLAEAYRESE                                       202
              GIRADADRQRRV++AEAYRESE
Sbjct: 206    GIRADADRQRRVIVAEAYRESE                                       227
```

No corresponding DNA sequence was identified in *S. pyogenes*.

Based on this analysis, it was predicted that this protein and its epitopes, could be useful antigens for vaccines or diagnostics.

Example 2349

A DNA sequence (GBSx2504) was identified in *S. agalactiae* <SEQ ID 7191> which encodes the amino acid sequence <SEQ ID 7192>. Analysis of this protein sequence reveals the following:

Possible site: 24
>>> Seems to have an uncleavable N-term signal seq
----- Final Results ----- bacterial membrane --- Certainty = 0.0000 (Not Clear) <succ>
bacterial outside --- Certainty = 0.0000 (Not Clear) <succ>
bacterial cytoplasm --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2350

A DNA sequence (GBSx2505) was identified in *S. agalactiae* <SEQ ID 7193> which encodes the amino acid sequence <SEQ ID 7194>. This protein is predicted to be ABC transporter (ATP-binding; daunorubicin resistance). Analysis of this protein sequence reveals the following:

Possible site: 56
>>> Seems to have no N-terminal signal sequence
----- Final Results -----
bacterial cytoplasm --- Certainty = 0.1846 (Affirmative) <succ>
bacterial membrane --- Certainty = 0.0000 (Not Clear) <succ>
bacterial outside --- Certainty = 0.0000 (Not Clear) <succ>

The protein has homology with the following sequences in the GENPEPT database.

```
>GP:CAB15892 GB:Z99123 similar to ABC transporter (ATP-binding protein) [Bacillus
subtilis]
Identities = 88/231 (38%), Positives = 132/231 (57%), Gaps = 13/231 (5%)

Query:  10   QVIGYLPDVPKFYDYMTAQEYLQLC---AGLAQNKTSLPIADLLEQVGLADN-QQRISTY    65
             ++IGYLP  P FY +MTA E+L      +GL++ K     I ++LE VGL +   +RI  Y
Sbjct:  69   RLIGYLPQYPAFYSWMTANEFLTFAGRLSGLSKRKCQEKIGEMLEFVGLHEAAHKRIGGY   128

Query:  66   SRGMKQRLGLAQALIHXXKILICDEPTSALDPQGRQEILSIISQLRGQKTVIFSTHILSD   125
             S GMKQRLGLAQAL+H  K LI DEP SALDP GR E+L ++ +L+      V+FSTH+L D
Sbjct: 129   SGGMKQRLGLAQALLHKPKFLILDEPVSALDPTGRFEVLDMMRELKKHMAVLFSTHVLHD   188

Query: 126   VEKVCDQVLILIKSGIH---NLEDLRDKASASVNQLNLLIKVSDNEAQKLALRFPLNQKD   182
             E+VCDQV+I+    I     L++L+ +   +V L++  K+     +K  +   + +
Sbjct: 189   AEQVCDQVVIMKNGEISWKGELQELKQQQQTNVFILSVNEKLEGWLEEKPYVSAIVYKNP   248

Query: 183   QYYKVHLELSEANNREQALASFYRYLVEQEITPYFIELLEDSLEDFYLEVI           233
                +   EL + +    L+      + + +T    E   +SLED YL+V+
Sbjct: 249   S--QAVFELPDIHAGRSLLSD----CIRKGLTVTRFEQKTESLEDVYLKVV           293
```

There is also homology to SEQ ID 686.

Based on this analysis, it was predicted that this protein and its epitopes, could be useful antigens for vaccines or diagnostics.

Example 2351

A DNA sequence (GBSx2506) was identified in *S. agalactiae* <SEQ ID 7195> which encodes the amino acid sequence <SEQ ID 7196>. Analysis of this protein sequence reveals the following:

Possible site: 52
>>> Seems to have no N-terminal signal sequence
----- Final Results ----- bacterial cytoplasm --- Certainty = 0.0679 (Affirmative) <succ>
bacterial membrane --- Certainty = 0.0000 (Not Clear) <succ>
bacterial outside --- Certainty = 0.0000 (Not Clear) <succ>

The protein has homology with glycine-rich cell wall proteins (e.g. GB:AL161589—the glycine-rich cell wall protein from *Arabidopsis thaliania*) and to SEQ ID 6882.

Based on this analysis, it was predicted that this protein and its epitopes, could be useful antigens for vaccines or diagnostics.

Example 2352

A DNA sequence (GBSx2507) was identified in *S. agalactiae* <SEQ ID 7197> which encodes the amino acid sequence <SEQ ID 7198>. Analysis of this protein sequence reveals the following:

Possible site: 35
>>> Seems to have no N-terminal signal sequence
----- Final Results -----
bacterial cytoplasm --- Certainty = 0.2890 (Affirmative) <succ>
bacterial membrane --- Certainty = 0.0000 (Not Clear) <succ>
bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2353

A DNA sequence (GBSx2508) was identified in *S. agalactiae* <SEQ ID 7199> which encodes the amino acid sequence <SEQ ID 7200>. Analysis of this protein sequence reveals the following:

Possible site: 60
>>> Seems to have no N-terminal signal sequence
----- Final Results -----
bacterial cytoplasm --- Certainty = 0.2410 (Affirmative) <succ>

-continued

```
bacterial membrane --- Certainty = 0.0000 (Not Clear) <succ>
bacterial outside --- Certainty = 0.0000 (Not Clear) <succ>
```

A related GBS nucleic acid sequence <SEQ ID 9329> which encodes amino acid sequence <SEQ ID 9330> was also identified.

The protein has no significant homology with any sequences in the GENPEPT database.

No corresponding DNA sequence was identified in *S. pyogenes*.

Figure 163:
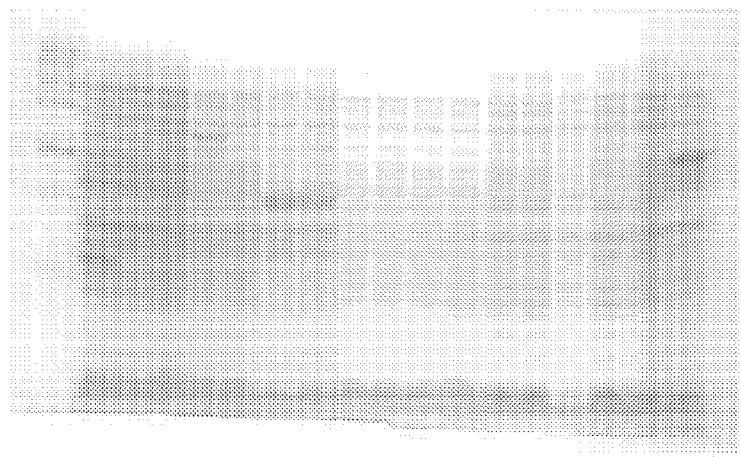

SEQ ID 9330 (GBS678) was expressed in *E. coli* as a His-fusion product. SDS-PAGE analysis of total cell extract is shown in FIG. 163 (lane 18; MW 53 kDa), FIG. 164 (lane 2 & 3; MW 53 kDa) and FIG. 188 (lane 7; MW 53 kDa). Purified protein is shown in FIG. 242, lanes 6 & 7.

Based on this analysis, it was predicted that this protein and its epitopes, could be useful antigens for vaccines or diagnostics.

Example 2354

A DNA sequence (GBSx2509) was identified in *S. agalactiae* <SEQ ID 7201> which encodes the amino acid sequence <SEQ ID 7202>. This protein is predicted to be surface protein Rib. Analysis of this protein sequence reveals the following:

```
Possible site: 24
>>> Seems to have no N-terminal signal sequence
----- Final Results -----
    bacterial cytoplasm --- Certainty = 0.2025 (Affirmative) <succ>
        bacterial membrane --- Certainty = 0.0000 (Not Clear) <succ>
            bacterial outside --- Certainty = 0.0000 (Not Clear) <succ>
```

No corresponding DNA sequence was identified in *S. pyogenes*.

Based on this analysis, it was predicted that this protein and its epitopes, could be useful antigens for vaccines or diagnostics.

Example 2355

A DNA sequence (GBSx2510) was identified in *S. agalactiae* <SEQ ID 7203> which encodes the amino acid sequence <SEQ ID 7204>. This protein is predicted to be surface protein Rib. Analysis of this protein sequence reveals the following:

```
Possible site: 24
>>> Seems to have no N-terminal signal sequence
----- Final Results -----
    bacterial cytoplasm --- Certainty = 0.1892 (Affirmative) <succ>
        bacterial membrane --- Certainty = 0.0000 (Not Clear) <succ>
            bacterial outside --- Certainty = 0.0000 (Not Clear) <succ>
```

No corresponding DNA sequence was identified in *S. pyogenes*.

Based on this analysis, it was predicted that this protein and its epitopes, could be useful antigens for vaccines or diagnostics.

Example 2356

A DNA sequence (GBSx2511) was identified in *S. agalactiae* <SEQ ID 7205> which encodes the amino acid sequence <SEQ ID 7206>. This protein is predicted to be surface protein Rib. Analysis of this protein sequence reveals the following:

```
Possible site: 24
>>> Seems to have no N-terminal signal sequence
----- Final Results -----
    bacterial cytoplasm --- Certainty = 0.1892 (Affirmative) <succ>
        bacterial membrane --- Certainty = 0.0000 (Not Clear) <succ>
            bacterial outside --- Certainty = 0.0000 (Not Clear) <succ>
```

No corresponding DNA sequence was identified in *S. pyogenes*.

Based on this analysis, it was predicted that this protein and its epitopes, could be useful antigens for vaccines or diagnostics.

Example 2357

A DNA sequence (GBSx2512) was identified in *S. agalactiae* <SEQ ID 7207> which encodes the amino acid sequence <SEQ ID 7208>. Analysis of this protein sequence reveals the following:

```
Possible site: 28
>>> Seems to have no N-terminal signal sequence
----- Final Results -----
    bacterial cytoplasm --- Certainty = 0.0999 (Affirmative) <succ>
        bacterial membrane --- Certainty = 0.0000 (Not Clear) <succ>
            bacterial outside --- Certainty = 0.0000 (Not Clear) <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2358

A DNA sequence (GBSx2514) was identified in *S. agalactiae* <SEQ ID 7209> which encodes the amino acid sequence <SEQ ID 7210>. This protein is predicted to be surface protein Rib. Analysis of this protein sequence reveals the following:

```
Possible site: 24
>>> Seems to have no N-terminal signal sequence
----- Final Results -----
    bacterial cytoplasm --- Certainty = 0.1892 (Affirmative) <succ>
        bacterial membrane --- Certainty = 0.0000 (Not Clear) <succ>
            bacterial outside --- Certainty = 0.0000 (Not Clear) <succ>
```

No corresponding DNA sequence was identified in *S. pyogenes*.

Based on this analysis, it was predicted that this protein and its epitopes, could be useful antigens for vaccines or diagnostics.

Example 2359

A DNA sequence (GBSx2515) was identified in *S. agalactiae* <SEQ ID 7211> which encodes the amino acid sequence <SEQ ID 7212>. Analysis of this protein sequence reveals the following:

Possible site: 19
>>> Seems to have no N-terminal signal sequence
----- Final Results -----
   bacterial cytoplasm --- Certainty = 0.2041 (Affirmative) <succ>
     bacterial membrane --- Certainty = 0.0000 (Not Clear) <succ>
      bacterial outside --- Certainty = 0.0000 (Not Clear) <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Example 2360

A DNA sequence (GBSx2516) was identified in *S. agalactiae* <SEQ ID 7213> which encodes the amino acid sequence <SEQ ID 7214>. This protein is predicted to be 30S ribosomal protein S6 (rpsF). Analysis of this protein sequence reveals the following:

Possible site: 51
>>> Seems to have no N-terminal signal sequence
----- Final Results -----
   bacterial cytoplasm --- Certainty = 0.3607 (Affirmative) <succ>
     bacterial membrane --- Certainty = 0.0000 (Not Clear) <succ>
      bacterial outside --- Certainty = 0.0000 (Not Clear) <succ>

A related GBS nucleic acid sequence <SEQ ID 9423> which encodes amino acid sequence <SEQ ID 9424> was also identified.

The protein has homology with the following sequences in the GENPEPT database.

>GP:CAB16128 GB:Z99124 ribosomal protein S6 (BS9) [*Bacillus subtilis*]

Identities = 41/72 (56%), Positives .= 58/72 (79%), Gaps = 1/72 (1%)

```
Query:  1   MVARFDSILSDNGATVVESKDWEKRRLAYEIQDFTEGLYHIVNVEAEDAVALNEFDRLSK 60
            ++ RF+++L+ NGA +  +KDW KRRLAYEI DF +G Y IVNV++ DA A+ EFDRL+K
Sbjct: 22   VIERFNNVLTSNGAEITGTKDWGKRRLAYEINDFRDGFYQIVNVQS-DAAAVQEFDRLAK 80

Query: 61   INGDILRHMIVK                                                 72
            I+ DI+RH++VK
Sbjct: 81   ISDDIIRHIVVK                                                 92
```

A related DNA sequence was identified in *S. pyogenes* <SEQ ID 7215> which encodes the amino acid sequence <SEQ ID 7216>. Analysis of this protein sequence reveals the following:

Possible site: 40
>>> Seems to have no N-terminal signal sequence
----- Final Results -----
   bacterial cytoplasm --- Certainty = 0.2720 (Affirmative) <succ>
     bacterial membrane --- Certainty = 0.0000 (Not Clear) <succ>
      bacterial outside --- Certainty = 0.0000 (Not Clear) <succ>

An alignment of the GAS and GBS proteins is shown below.

```
Identities = 66/74 (89%), Positives = 70/74 (94%)

Query:  1   MVARFDSILSDNGATVVESKDWEKRRLAYEIQDFTEGLYHIVNVEAEDAVALNEFDRLSK 60
            +VARFDSIL+DNGATVVESKDWEKRRLAYEI DF EGLYHIVN+EA DA ALNEFDRLSK
Sbjct: 22   LVARFDSILTDNGATVVESKDWEKRRLAYEINDFREGLYHIVNLEATDAAALNEFDRLSK 81

Query: 61   INGDILRHMIVKVD                                               74
            INGDILRHMIVK+D
Sbjct: 82   INGDILRHMIVKLD                                               95
```

Based on this analysis, it was predicted that these proteins and their epitopes could be useful antigens for vaccines or diagnostics.

Example 2361

A DNA sequence (GBSx2518) was identified in *S. agalactiae* <SEQ ID 7219> which encodes the amino acid sequence <SEQ ID 7220>. This protein is predicted to be surface protein Rib. Analysis of this protein sequence reveals the following:

Possible site: 49
>>> Seems to have no N-terminal signal sequence
----- Final Results -----
   bacterial cytoplasm --- Certainty = 0.5289 (Affirmative) <succ>
     bacterial membrane --- Certainty = 0.0000 (Not Clear) <succ>
      bacterial outside --- Certainty = 0.0000 (Not Clear) <succ>

No corresponding DNA sequence was identified in *S. pyogenes*.

Based on this analysis, it was predicted that this protein and its epitopes, could be useful antigens for vaccines or diagnostics.

Example 2362

A DNA sequence (GASx1R) was identified in *S. pyogenes* <SEQ ID 7221> which encodes the amino acid sequence <SEQ ID 7222>. Analysis of this protein sequence reveals the following:

```
Possible site: 33
>>> Seems to have an uncleavable N-term signal seq
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2363

A DNA sequence (GASx5R) was identified in *S. pyogenes* <SEQ ID 7223> which encodes the amino acid sequence <SEQ ID 7224>. Analysis of this protein sequence reveals the following:

```
Possible site: 20
>>> Seems to have an uncleavable N-term signal seq
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2364

A DNA sequence (GASx11) was identified in *S. pyogenes* <SEQ ID 7225> which encodes the amino acid sequence <SEQ ID 7226>. Analysis of this protein sequence reveals the following:

```
Possible site: 22
>>> Seems to have no N-terminal signal sequence
----- Final Results -----
   bacterial cytoplasm --- Certainty = 0.2614 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2365

A DNA sequence (GASx17) was identified in *S. pyogenes* <SEQ ID 7227> which encodes the amino acid sequence <SEQ ID 7228>. Analysis of this protein sequence reveals the following:

```
Possible site: 30
>>> Seems to have no N-terminal signal sequence
----- Final Results -----
   bacterial cytoplasm --- Certainty = 0.2849 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2366

A DNA sequence (GASx18) was identified in *S. pyogenes* <SEQ ID 7229> which encodes the amino acid sequence <SEQ ID 7230>. Analysis of this protein sequence reveals the following:

```
Possible site: 30
>>> Seems to have no N-terminal signal sequence
----- Final Results -----
   bacterial cytoplasm --- Certainty = 0.2099 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2367

A DNA sequence (GASx34) was identified in *S. pyogenes* <SEQ ID 7231> which encodes the amino acid sequence <SEQ ID 7232>. Analysis of this protein sequence reveals the following:

```
Possible site: 54
>>> Seems to have no N-terminal signal sequence
----- Final Results -----
   bacterial cytoplasm --- Certainty = 0.0801 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2368

A DNA sequence (GASx38) was identified in *S. pyogenes* <SEQ ID 7233> which encodes the amino acid sequence <SEQ ID 7234>. Analysis of this protein sequence reveals the following:

Possible site: 18
>>> Seems to have an uncleavable N-term signal seq
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>

No corresponding DNA sequence was identified in *S. agalactiae*.

The protein has homology with the following sequences in the GENPEPT database:

```
>GP:CAB12617 GB:Z99108 similar to protein-tyrosine phosphatase [Bacillus
subtilis]
Identities = 57/155 (36%), Positives = 88/155 (56%), Gaps = 12/155 (7%)

Query:   1   MKKVCFVCLGNICRSPMAEFVMKSIVS----SDVMMIESRATSDWEHGNPIHSGTQSILK      56
             M  V FVCLGNICRSPMAE + + + +     +  +S     W  GNP H GTQ IL+
Sbjct:   1   MISVLFVCLGNICRSPMAEAIFRDLAAKKGLEGKIKADSAGIGGWHIGNPPHEGTQEILR      60

Query:  57   TYQINYDITKCSKQITITDFNIFDYIIGMDSDNVKNLKEMSQHQWDSKIYLFRE------     110
                I++D     ++Q++   D + FDYII MD++N+ +L+ M+   +  S I +
Sbjct:  61   REGISFD-GMLARQVSEQDLDDFDYIIAMDAENIGSLRSMAGEKNTSHIKRLLDYVEDSD     119

Query: 111   -GGVPDPWYTNDFEETYQLVRKGCQDWLSRLMSKE                             144
              VPDP+YT +FEE   QL++ GC+   L+ +  ++
Sbjct: 120   LADVPDPYYTGNFEEVCQLIKTGCEQLLASIQKEK                             154
```

Based on this analysis, it was predicted that this GAS-specific protein and its epitopes, could be useful antigens for vaccines or diagnostics.

Example 2369

A DNA sequence (GASx42R) was identified in *S. pyogenes* <SEQ ID 7235> which encodes the amino acid sequence <SEQ ID 7236>. Analysis of this protein sequence reveals the following:

Possible site: 14
>>> Seems to have no N-terminal signal sequence
----- Final Results -----
   bacterial cytoplasm --- Certainty = 0.4753 (Affirmative) <succ>
      bacterial membrane --- Certainty = 0.0000 (Not Clear) <succ>
         bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2370

A DNA sequence (GASx47R) was identified in *S. pyogenes* <SEQ ID 7237> which encodes the amino acid sequence <SEQ ID 7238>. Analysis of this protein sequence reveals the following:

Possible site: 58
>>> Seems to have no N-terminal signal sequence
----- Final Results -----
   bacterial cytoplasm --- Certainty = 0.2014 (Affirmative) <succ>
      bacterial membrane --- Certainty = 0.0000 (Not Clear) <succ>
         bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2371

A DNA sequence (GASx53R) was identified in *S. pyogenes* <SEQ ID 7239> which encodes the amino acid sequence <SEQ ID 7240>. Analysis of this protein sequence reveals the following:

Possible site: 45
>>> Seems to have no N-terminal signal sequence
INTEGRAL    Likelihood = −0.11    Transmembrane 56-72 (56-72)
----- Final Results -----
   bacterial membrane --- Certainty = 0.1044 (Affirmative) <succ>
      bacterial outside --- Certainty = 0.0000 (Not Clear) <succ>
         bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2372

A DNA sequence (GASx67R) was identified in *S. pyogenes* <SEQ ID 7241> which encodes the amino acid sequence <SEQ ID 7242>. Analysis of this protein sequence reveals the following:

---

Possible site: 39
>>> Seems to have no N-terminal signal sequence
----- Final Results -----
   bacterial cytoplasm --- Certainty = 0.1610 (Affirmative) <succ>
      bacterial membrane --- Certainty = 0.0000 (Not Clear) <succ>
         bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2373

A DNA sequence (GASx75) was identified in *S. pyogenes* <SEQ ID 7243> which encodes the amino acid sequence <SEQ ID 7244>. Analysis of this protein sequence reveals the following:

---

Possible site: 31
>>> Seems to have no N-terminal signal sequence
----- Final Results -----
   bacterial cytoplasm --- Certainty = 0.2803 (Affirmative) <succ>
      bacterial membrane --- Certainty = 0.0000 (Not Clear) <succ>
         bacterial outside --- Certainty = 0.0000 (Not Clear) <succ>

---

No corresponding DNA sequence was identified in *S. agalactiae*.

The protein has homology with the following sequences in the GENPEPT database:

```
>GP:CAA41942 GB:X59250 ribosomal protein B [Lactococcus lactis]
Identities = 37/38 (97%), Positives = 37/38 (97%)

Query: 1   MKVRPSVKPICEYCKVIRRNGRVMVICPTNPKHKQRQG     38
           MKVRPSVKPICEYCKVIRRNGRVMVICP NPKHKQRQG
Sbjct: 1   MKVRPSVKPICEYCKVIRRNGRVMVICPANPKHKQRQG     38
```

Based on this analysis, it was predicted that this GAS-specific protein and its epitopes, could be useful antigens for vaccines or diagnostics.

Example 2374

A DNA sequence (GASx76) was identified in *S. pyogenes* <SEQ ID 7245> which encodes the amino acid sequence <SEQ ID 7246>. Analysis of this protein sequence reveals the following:

---

Possible site: 35
>>> Seems to have no N-terminal signal sequence
----- Final Results -----
   bacterial cytoplasm --- Certainty = 0.0824 (Affirmative) <succ>
      bacterial membrane --- Certainty = 0.0000 (Not Clear) <succ>
         bacterial outside --- Certainty = 0.0000 (Not Clear) <succ>

---

No corresponding DNA sequence was identified in *S. agalactiae*.

The protein has homology with the following sequences in the GENPEPT database:

```
>GP:AAB06824 GB:L47971 ribosomal protein S13 [Bacillus subtilis]
Identities = 86/121 (71%), Positives = 103/121 (85%)

Query: 1   MARIAGVDIPNDKRVVISLTYVYGIGLATSKKILAAAGISEDIRVKDLTSDQEDAIRREV    60
           MARIAGVDIP DKRVVISLTY++GIG  T++++L   AG+SED RV+DLT ++   IR +
Sbjct: 1   MARIAGVDIPRDKRVVISLTYIFGIGRTTAQQVLKEAGVSEDTRVRDLTEEELGKIRDII   60

Query: 61  DAIKVEGDLRREVEMNIKRLMEIGSYRGIRNRRGLPVRGQNTKNNARTRKGKAVAIAGKKK 121
           D +KVEGDLRREV++NIKRL+EIGSYRGIRHRRGLPVRGQN+KNNARTRKG    +A KKK
Sbjct: 61  DKLKVEGDLRREVSLNIKRLIEIGSYRGIRHRRGLPVRGQNSKNNARTRKGPRRTVANKKK 121
```

Based on this analysis, it was predicted that this GAS-specific protein and its epitopes, could be useful antigens for vaccines or diagnostics.

Example 2375

A DNA sequence (GASx81R) was identified in *S. pyogenes* <SEQ ID 7247> which encodes the amino acid sequence <SEQ ID 7248>. Analysis of this protein sequence reveals the following:

---

Possible site: 21
>>> Seems to have no N-terminal signal sequence
----- Final Results -----
   bacterial cytoplasm --- Certainty = 0.1842 (Affirmative) <succ>
      bacterial membrane --- Certainty = 0.0000 (Not Clear) <succ>
         bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2376

A DNA sequence (GASx82) was identified in *S. pyogenes* <SEQ ID 7249> which encodes the amino acid sequence <SEQ ID 7250>. Analysis of this protein sequence reveals the following:

Possible site: 59
>>> Seems to have no N-terminal signal sequence
----- Final Results -----
  bacterial cytoplasm --- Certainty = 0.3613 (Affirmative) <succ>
    bacterial membrane --- Certainty = 0.0000 (Not Clear) <succ>
      bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2377

A DNA sequence (GASx83) was identified in *S. pyogenes* <SEQ ID 7251> which encodes the amino acid sequence <SEQ ID 7252>. Analysis of this protein sequence reveals the following:

Possible site: 51
>>> Seems to have no N-terminal signal sequence
----- Final Results -----
  bacterial cytoplasm --- Certainty = 0.1141 (Affirmative) <succ>
    bacterial membrane --- Certainty = 0.0000 (Not Clear) <succ>
      bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2378

A DNA sequence (GASx85) was identified in *S. pyogenes* <SEQ ID 7253> which encodes the amino acid sequence <SEQ ID 7254>. Analysis of this protein sequence reveals the following:

Possible site: 16
>>> Seems to have no N-terminal signal sequence
----- Final Results -----
  bacterial cytoplasm --- Certainty = 0.2280 (Affirmative) <succ>
    bacterial membrane --- Certainty = 0.0000 (Not Clear) <succ>
      bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2379

A DNA sequence (GASx89R) was identified in *S. pyogenes* <SEQ ID 7255> which encodes the amino acid sequence <SEQ ID 7256>. Analysis of this protein sequence reveals the following:

Possible site: 44
>>> Seems to have no N-terminal signal sequence
----- Final Results -----
  bacterial cytoplasm --- Certainty = 0.3040 (Affirmative) <succ>
    bacterial membrane --- Certainty = 0.0000 (Not Clear) <succ>
      bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2380

A DNA sequence (GASx102) was identified in *S. pyogenes* <SEQ ID 7257> which encodes the amino acid sequence <SEQ ID 7258>. Analysis of this protein sequence reveals the following:

Possible site: 33
>>> Seems to have an uncleavable N-term signal seq
INTEGRAL    Likelihood = −13.75    Transmembrane 21-37 (12-41)
----- Final Results -----
  bacterial membrane --- Certainty = 0.6498 (Affirmative) <succ>
    bacterial outside --- Certainty = 0.0000 (Not Clear) <succ>
      bacterial cytoplasm --- Certainty = 0.0000 (Not Clear) <succ>

No corresponding DNA sequence was identified in *S. agalactiae*.

The protein has homology with the following sequences in the GENPEPT database:

```
>GP:AAC45312 GB:U81957 ComYC [Streptococcus gordonii]
Identities = 59/104 (5696), Positives = 85/104 (81%), Gaps = 1/104 (0%)

Query:  6   NNLRHKKLKGFTLLEMLLVILVISVLMLLFVPNLSKQKDRVTETGNAAVVKLVENQAELY    65
            N L+   ++K FTL+EML+V+L+ISVLMLLFVPNL+KQK+  V++TGNAAVVK+VE+QAELY
Sbjct:  2   NKLKKLRVKAFTLVEMLVVLLIISVLMLLFVPNLTKQKEAVSDTGNAAVVKVVESQAELY    61

Query: 66   EL-SQGSKPSLSQLKADGSITEKQEKAYQDYYDKHKNEKARLSN                   108
            EL + G + +LS+L A G+I++KQ  +Y+ YY K+ +E    ++N
Sbjct: 62   ELKNTGDQATLSKLVAAGNISQKQADSYKAYYGKNNSETQAVAN                   105
```

Based on this analysis, it was predicted that this GAS-specific protein and its epitopes, could be useful antigens for vaccines or diagnostics.

Example 2381

A DNA sequence (GASx103) was identified in *S. pyogenes* <SEQ ID 7259> which encodes the amino acid sequence <SEQ ID 7260>. Analysis of this protein sequence reveals the following:

Possible site: 24
>>> Seems to have a cleavable N-term signal seq.
----- Final Results -----
   bacterial outside --- Certainty = 0.3000 (Affirmative) <succ>
     bacterial membrane --- Certainty = 0.0000 (Not Clear) <succ>
       bacterial cytoplasm --- Certainty = 0.0000 (Not Clear) <succ>

No corresponding DNA sequence was identified in *S. agalactiae*.

The protein has homology with the following sequences in the GENPEPT database:

```
>GP:AAC23740 GB:AF052207 competence protein [Streptococcus pneumoniae]
Identities = 52/131 (39%), Positives = 76/131 (57%)

Query:  8    IKAFTLLETLLSLSVMSFIILGLSVPVTKSYQKVEEHLFFSHFEHLYRHQQKLAILQQKQ    67
             IKAFT+LE+LL L ++S + LGLS  V  ++  VEE +FF  FE LYR  QK ++  Q++
sbjct:  2    IKAFTMLESLLVLGLVSILALGLSGSVQSTFSAVEEQIFFMEFEELYRETQKRSVASQQK    61

Query: 68    RVLDISSTKIVTEGNSLTVPKSITVNHPYRLVIDQMGGNESLAKIIFDMTDRRFKYQFYL   127
             L++   I       LTVPK I    +  D+ GGN SLAK+ F  +     +YQ YL
Sbjct: 62    TSLNLDGQMISNGSQKLTVPKGIQAPSGQSITFDRAGGNSSLAKVEFQTSKGAIRYQLYL   121

Query: 128   GSGNYQKTSQS                                                   138
             G+G ++ ++
Sbjct: 122   GNGKIKRIKET                                                   132
```

Based on this analysis, it was predicted that this GAS-specific protein and its epitopes, could be useful antigens for vaccines or diagnostics.

Example 2382

A DNA sequence (GASx104) was identified in *S. pyogenes* <SEQ ID 7261> which encodes the amino acid sequence <SEQ ID 7262>. Analysis of this protein sequence reveals the following:

Possible site: 23
>>> Seems to have a cleavable N-term signal seq.
----- Final Results -----
   bacterial outside --- Certainty = 0.3000 (Affirmative) <succ>
     bacterial membrane --- Certainty = 0.0000 (Not Clear) <succ>
       bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2383

A DNA sequence (GASx109) was identified in *S. pyogenes* <SEQ ID 7265> which encodes the amino acid sequence <SEQ ID 7266>. Analysis of this protein sequence reveals the following:

Possible site: 45
>>> Seems to have no N-terminal signal sequence
INTEGRAL    Likelihood = −10.51    Transmembrane 37-53 (28-58)
INTEGRAL    Likelihood = −3.56     Transmembrane 61-77 (60-77)
----- Final Results -----
   bacterial membrane --- Certainty = 0.5203 (Affirmative) <succ>
     bacterial outside --- Certainty = 0.0000 (Not Clear) <succ>
       bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2384

A DNA sequence (GASx115R) was identified in *S. pyogenes* <SEQ ID 7267> which encodes the amino acid sequence <SEQ ID 7268>. Analysis of this protein sequence reveals the following:

```
Possible site:18
>>> Seems to have an uncleavable N-term signal seq
INTEGRAL      Likelihood = -11.09      Transmembrane 20-36 (13-40)
----- Final Results -----
    bacterial membrane --- Certainty = 0.5437 (Affirmative) <succ>
      bacterial outside --- Certainty = 0.0000 (Not Clear) <succ>
       bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2385

A DNA sequence (GASx124) was identified in *S. pyogenes* <SEQ ID 7269> which encodes the amino acid sequence <SEQ ID 7270>. Analysis of this protein sequence reveals the following:

```
Possible site: 52
>>> Seems to have no N-terminal signal sequence
INTEGRAL     Likelihood = -8.17      Transmembrane 31-47 (29-59)
INTEGRAL     Likelihood = -5.63      Transmembrane 737-753 (734-756)
----- Final Results -----
    bacterial membrane --- Certainty = 0.4270 (Affirmative) <succ>
      bacterial outside --- Certainty = 0.0000 (Not Clear) <succ>
       bacterial cytoplasm --- Certainty = 0.0000 (Not Clear) <succ>
```

No corresponding DNA sequence was identified in *S. agalactiae*.

The protein has homology with the following sequences in the GENPEPT database:

```
>GP:AAC97148 GB:D49397 Cpa [Streptococcus pyogenes]
Identities = 401/737 (54%), Positives = 517/737 (69%), Gaps = 25/737 (3%)

Query:  25  SKNSKR--FTVTLVGVFLMIFALVTSMVGAKTVFGLVESSTPNAINPDSSSEYRWYGYES   82
            S N+KR   T+ L+ VFL    AL+ + +   FG  E S PN      S  +Y WYGY+S
Sbjct:  11  SANNKRRQTTIGLLKVFLTFVALIGIVGFSIRAFGAEEQSVPN--RQSSIQDYPWYGYDS   68

Query:  83  YVRGHPYYKQFRVAHDLRVNLEGSRSYQVYCFNLKKAFPLGSDSSVKKWYKKHDGISTKF  142
            Y +G+P Y   + H+L+VNLEGS+ YQ YCFNL K FP   SDS    +WYKK +G    +F
Sbjct:  69  YPKGYPDYSPLKTYHNLKVNLEGSKDYQAYCFNLTKHFPSKSDSVRSQWYKKLEGTNENF  128

Query: 143  EDYAMSPRITGDELNQKLRAVMYNGHPQNANGIMEGLEPLNAIRVTQEAVWYYSDNAPIS  202
                 A   PRI   +L Q +  ++YNG+P N NGIM+G++PLNAI VTQ A+W Y+D+A I
Sbjct: 129  IKLADKPRIEDGQLQQNILRILYNGYPNNRNGIMKGIDPLNAILVTQNAIW-YTDSAQI-  186

Query: 203  NPDESFKRESESNLVSTSQLSLMRQALKQLIDPNLATKMPKQVPDDFQLSIFESEDKGDK  262
            NPDESFK E+ SN ++   QL LMR+ALK+LIDPNL +K   + P    ++L++FES D
Sbjct: 187  NPDESFKTEARSNGINDQQLGLMRKALKELIDPNLGSKYSNKTPSGYRLNVFESHD----  242

Query: 263  YNKGYQNLLSGGLVPTKPPTPGDPPMPPNQPQTTSVLIRKYAIGDYSKLLEGATLQLTGD  322
               K +QNLLS    VP  PP  PG+    PP + +  TSV+IRKYA GD SKLLEGATL+L+
Sbjct: 243  --KPFQNLLSAEYVPDTPPKPGEE--PPAKTEKTSVIIRKYAEGD-SKLLEGATLKLSQI  297

Query: 323  NVNSFQARVFSSNDIGERIELSDGTYTLTELNSPAGYSIAEPITFKVEAGKVYTI-IDGK  381
             + FQ + F SN +GE +EL +GTYTLTE +SP GY IAEPI F+VE   KV+ +   DG
Sbjct: 298  EGSGFQEKDFQSNSLGETVELPNGTYTLTETSSPDGYKIAEPIKFRVENKKVPIVQKDGS  357

Query: 382  QIENPNKEIVEPYSVEAYNDFEEFSVLT-TQNYAKFYYAKNKNGSSQVVYCFNADLKSPP  440
            Q+ENPNKE+ EPYSVEAYNDF + VL+   Y KFYYA NK+ SSQVVYCFNADL SPP
Sbjct: 358  QVENPNKEVAEPYSVEAYNDFMDEEVLSGFTPYGKFYYATNKDKSSQVVYCFNADLHSPP  417

Query: 441  DSEDGGKTMTPDFTT-GEVKYTHIAGRDLFKYTVKPRDTDPDTFLKHIKKVIEKGYREKG  499
            DS D  G+T+ PD +T   EVKYTH AG DLFKY ++PRDT+P+ FLKHIKKVIEKGY++KG
Sbjct: 418  DSYDSGETINPDTSTMKEVKYTHTAGSDLFKYALRPRDTNPEDFLKHIKKVIEKGYKKKG  477

Query: 500  QAIEYSGLTETQLRAATQLAIYYFTDSAELDKDKL----KDYHGFGDMNDSTLAVAKILV  555
              +  Y+GLTETQ  RAATQLAIYYFTDSA+L    K       K YHGF  M++  TLAV K  L+
Sbjct: 478  DS--YNGLTETQFRAATQLAIYYFTDSADLKTLKTYNNGKGYHGFESMDEKTLAVTKELI  535

Query: 556  EYAQDSNPPQLTDLDFFIPNNNKYQSLIGTQWHPEDLVDIIRMEDKK-EVIPVTHNLTLR  614
             YAQ+ + PQLT+LDFF+PNN+K QSLIGT+  HP+DLVD+IRMEDKK EVIPVTH+LT++
Sbjct: 536  TYAQNGSAPQLTNLDFFVPNNSKDQSLIGTECHPDDLVDVIRMEDKKQEVIPVTHSLTVK  595

Query: 615  KTVTGLAGDRTKDFHFEIELENNKQELLSQTVKTDKTNLEFKDGKATINLKHGESLTLQG  674
            KTV G  GD+TK F  FE+ELK+   +  +   T+KT+  +L   KDGK + NLKHG+++ ++G
Sbjct: 596  KTVVGELGDKTKGFQFELELKDKTGQPIVNTLKTNNQDLVAKDGKYSFNLKHGDTIRIEG  655

Query: 675  LPEGYSYLVKETDSEGYKVKVNSQEVANATVSKTGITSDETLAFENNKEPVVPTGVDQKI  734
            LP GYSY +KE +++  Y V V+++     A        IT D+ +  FEN K+ V  PTG+
Sbjct: 656  LPTGYSYTLKEAEAKDYIVTVDNKVSQEAQSVGKDITEDKKVTFENRKDLVPPTGLTTDG  715
```

```
                            -continued
Query:  735  NGYLALIVIAGISLGIW                                   751
             YL L+++    +L +W
Sbjct:  716  AIYLWLLLLVPLGLLVW                                   732
```

Based on this analysis, it was predicted that this GAS-specific protein and its epitopes, could be useful antigens for vaccines or diagnostics.

Example 2386

A DNA sequence (GASx125R) was identified in *S. pyogenes* <SEQ ID 7271> which encodes the amino acid sequence <SEQ ID 7272>. Analysis of this protein sequence reveals the following:

Possible site: 40
>>> Seems to have no N-terminal signal sequence
----- Final Results -----
    bacterial cytoplasm --- Certainty = 0.2604 (Affirmative) <succ>
      bacterial membrane --- Certainty = 0.0000 (Not Clear) <succ>
        bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2387

A DNA sequence (GASx126) was identified in *S. pyogenes* <SEQ ID 7273> which encodes the amino acid sequence <SEQ ID 7274>. Analysis of this protein sequence reveals the following:

Possible site: 14
>>> Seems to have no N-terminal signal sequence
----- Final Results -----
    bacterial cytoplasm --- Certainty = 0.1537 (Affirmative) <succ>
      bacterial membrane --- Certainty = 0.0000 (Not Clear) <succ>
        bacterial outside --- Certainty = 0.0000 (Not Clear) <succ>

No corresponding DNA sequence was identified in *S. agalactiae*.

The protein has homology with the following sequences in the GENPEPT database:

```
>GP:AAC97149 GB:U49397 LepA [Streptococcus pyogenes]
Identities = 59/132 (44%), Positives = 84/132 (62%), Gaps = 5/132 (3%)

Query:  1    MIIKRNDMAPSVKAGDAILFYRLSQTYKVEEAVVYEDSKTSITKVGRIIAQAGDEVDLTE   60
             MII NDM+P++ AGD +L+YRL+   + + VVYE    T   KVGRI AQAGDEV+ T+
Sbjct:  42   MIINTNDMSPALSAGDGVLYYRLADRSHINDVVVYEVDNT--LKVGRIAAQAGDEVNFTQ   99

Query:  61   QGELKINGHIQNEG---LTFIKSREANYPYRIADNSYLILNDYYSQESENYLQDAIAKDA  117
             +G L INGH  +    LT+ S    N+PY++    +Y ILNDY  +  ++    A+   +
Sbjct:  100  EGGLLINGHPPEKEVPYLTYPHSSGPNFPYKVPIGTYFILNDYREERLDSRYYGALPINQ  159

Query:  118  IKGTINTLIRLR                                                129
             IKG I+TL+R+R
Sbjct:  160  IKGKISTLLRVR                                                171
```

Example 2388

A DNA sequence (GASx127) was identified in *S. pyogenes* <SEQ ID 7275> which encodes the amino acid sequence <SEQ ID 7276>. Analysis of this protein sequence reveals the following:

Possible site: 17
>>> Seems to have a cleavable N-term signal seq.
INTEGRAL    Likelihood = −3.93    Transmembrane 312-328 (311-337)
---- Final Results ----
    bacterial membrane --- Certainty = 0.2572 (Affirmative) <succ>
      bacterial outside --- Certainty = 0.0000 (Not Clear) <succ>
        bacterial cytoplasm --- Certainty = 0.0000 (Not Clear) <succ>

No corresponding DNA sequence was identified in *S. agalactiae*.

The protein has homology with the following sequences in the GENPEPT database:

```
>GP:AAC97152 GB:U49397 unknown [Streptococcus pyogenes]
Identities = 125/355 (35%), Positives = 191/355 (53%), Gaps = 26/355 (7%)
Query:    1 MKLRHLLLTGAALTSFA-----ATTVHGET--VVNGAKLTVTKNL-DLVNSNALIPNTDF   52
            MK    LLL A L +         + +  ET  V++G+ L V K        + N L+P    D+
Sbjct:    1 MKKNKLLLATAILATALGMASMSQNIKAETAGVIDGSTLVVKKTFPSYTDDNVLMPKADY   60

Query:   53 TFKIEPDTTVN---EDGNKFK-GVALNTPMTK-VTYTNSDKGGSNTKTAEFDFSEVTFEK  107
            +FK+E D         +DG   K GV       TK + Y+NSDK   +    K+   F+F+ V F
Sbjct:   61 SFKVEADDNAKGKTKDGLDIKPGVIDGLENTKTIRYSNSDKITAKEKSVNFEFANVKFPG  120

Query:  108 PGVYYYKVTEEKIDKVPGVSYDTTSYTVQVHVLWNEEQQKPVATYIVGYKEGS--KVPIQ  165
              GVY Y V E      +K   G++YD+   +TV  V+V+ N+E           YIV    + G       K P+
Sbjct:  121 VGVYRYTVAEVNGNKA-GITYDSQQWTVDVYVV-NKEGGGFEVKYIVSTEVGQSEKKPVL  178

Query:  166 FKNSLDSTTLTVKKKVSGTGGDRSKDFNFGLTLKANQYYKASEKVMIEKTTKGGQAPVQT  225
            FKNS D+T+L  ++K+V+G G+       + F+F L L   N+ +       EK +       +GG+
Sbjct:  179 FKNSFDTTSLKIEKQVTGNTGEHQRLFSFTLLLTPNECF---EKGQVVNILQGGETK---  232

Query:  226 EASIDQLYHFTLKDGESIKVTNLPVGVDYVVTEDDYKSEKYTTNVEVSPQDGAVKNIAGN  285
             +  I + Y FTLKD     S+ ++ LPVG++Y +TE+D       + Y T+  +    + +        G
Sbjct:  233 KVVIGEEYSFTLKDKGSVTLSQLPVGIEYKLTEEDVTKDGYKTSATLKDGEQSSTYELGK  292

Query:  286 STEQETSTDKDMTITFTNKKDFEVPTGVAMTVAPYIALGIVAVGGALYFVKKKNA       340
              + + S D+    I   TNK+D +VPTGV    T+AP+   L IVA+GG +Y   K+K A
Sbjct:  293 DHKTDKSADE---IVVTNKRDTQVPTGVVGTLAPFAVLSTVAIGGVIYITKRKKA       344
```

Based on this analysis, it was predicted that this GAS-specific protein and its epitopes, could be useful antigens for vaccines or diagnostics.

Example 2389

A DNA sequence (GASx128) was identified in *S. pyogenes* <SEQ ID 7277> which encodes the amino acid sequence <SEQ ID 7278>. Analysis of this protein sequence reveals the following:

---

Possible site: 44
>>> Seems to have a cleavable N-term signal seq.
----- Final Results -----
    bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>

---

No corresponding DNA sequence was identified in *S. agalactiae*.

The protein has homology with the following sequences in the GENPEPT database:

Based on this analysis, it was predicted that this GAS-specific protein and its epitopes, could be useful antigens for vaccines or diagnostics.

Example 2390

A DNA sequence (GASx129) was identified in *S. pyogenes* <SEQ ID 7279> which encodes the amino acid sequence <SEQ ID 7280>. Analysis of this protein sequence reveals the following:

---

Possible site: 26
>>> Seems to have an uncleavable N-terminal signal sequence
INTEGRAL     Likelihood = −6.05    Transmembrane 5-21 (4-22)
INTEGRAL     Likelihood = −5.04    Transmembrane 191-207 (186-209)
----- Final Results -----
    bacterial membrane --- Certainty = 0.3421 (Affirmative) <succ>
    bacterial outside --- Certainty = 0.0000 (Not Clear) <succ>
    bacterial cytoplasm --- Certainty = 0.0000 (Not Clear) <succ>
LPXTG motif: 181-186

---

No corresponding DNA sequence was identified in *S. agalactiae*.

The protein has homology with the following sequences in the GENPEPT database:

```
>GP:AAC97152 GB:U49397 unknown [Streptococcus pyogenes]

Identities = 115/240 (47%), Positives = 178/240 (73%), Gaps = 3/240 (1%)

Query:    1 MIVRLIKLLDKLINVIVLCFFFLCLLIAALGIYDALTVYQGANATNYQQYKKKGVQ--FD   58
            M++ ++++++K I+ ++L F  + L +A  G++D+  +YQ A+A+N++++K      Q   F+
Sbjct:  351 MMMTIVQVINKAIDTLILIFCLVVLFLAGFGLWDSYHLYQQADASNFKKFKTAQQQPKFE  410

Query:   59 DLLAINSDVMAWLTVKGTHIDYPIVQGENNLEYINKSVEGEYSLSGSVFLDYRNKVTFED  118
            DLLA+N DV+ WL + GTHIDYP+VQG+ NLEYINK+V+G  ++SGS+FLD RN    F D
Sbjct:  411 DLLALNEDVIGWLNIPGTHIDYPLVQGKTNLEYINKAVDGSVAMSGSLFLDTRNHNDFTD  470

Query:  119 KYSLIYAHHMAGNVMFGELPNFRKKSFFNKHKEFSIETKTKQKLKINIFACIQTDAFDSL  178
             YSLIY HHMAGN MFGE+P F KK+FFNKH +   IETK ++KL + IFAC++TDAFD L
Sbjct:  471 DYSLIYGHHMAGNAMFGEIPKFLKKNFFNKHNKAIIETKERKKLIVTIFACLKTDAFDQL  530

Query:  179 LFNPIDV-DISSKNEFLNHIKQKSVQYREILTTNESRFVALSTCEDMITDGRIIVIGQIE  237
            +FNP + +     + + +++I ++S Q++ +       + ++FVA  STCE+ +TD R+IV+G I+
Sbjct:  531 VFNPNAITNQDQQRQLVDYISKRSKQFKPVKLKHHTKFVAFSTCENFSTDNRVIVVGTIQ  590
```

```
>GP:AAC97151 GB:U49397 unknown [Streptococcus pyogenes]
Identities = 64/213 (30%), Positives = 106/213 (49%), Gaps = 20/213 (9%)
Query:    1  MKKSILRILAIGYLLMSFCLLDSVEAENLTASINIEVINQVDVATNKQSSDIDETFMFVI    60
             M+K    + ++  +L      +V A++ T   +I V N ++ A  +         F   +
Sbjct:    1  MRKYWKMLFSVVMMLTMLAFNQTVLAKDSTVQTSISVENVLERAGDSTP------FSIAL   54

Query:   61  EALDKESPLPNSVTTSVKGNGKTSFEQLTFSEVGQYHYKIHQLLGKNSQYHYDETVYEVV  120
             E++D    +         ++ G+GK SF   L F+ VGQY Y+++Q    +N   Y  D TV++V+
Sbjct:   55  ESIDAMKTIEE---ITIAGSGKASFSPLNFTTVGQYTYRVYQKPSQNKDYQADTTVFDVL  111

Query:  121  IYVLYNEQSGALETNLVSNKLGETEKSELIFKQEYSEKTPEPHQPDTTEKEKPQKKRNGI  180
             +YV Y+E  G L     ++S + G+ EKS + FK +      K    P QPD  +
Sbjct:  112  VYVTYDE-DGTLVAKVISRRAGDEEKSAITFKPKRLVKPIPPRQPDIPKTP---------  161

Query:  181  LPSTGEMVSYVSALGIVLVATITLYSIYKKLKT                            213
             LP  GE+ S +  L IVL+  + L  + KKLK+
Sbjct:  162  LPLAGEVKSLLGILSIVLLGLLVLLYV-KKLKS                            193
```

Based on this analysis, it was predicted that this GAS-specific protein and its epitopes, could be useful antigens for vaccines or diagnostics.

Example 2391

A DNA sequence (GASx130R) was identified in *S. pyogenes* <SEQ ID 7281> which encodes the amino acid sequence <SEQ ID 7282>. Analysis of this protein sequence reveals the following:

Possible site: 57
>>> Seems to have no N-terminal signal sequence
----- Final Results -----
   bacterial cytoplasm --- Certainty = 0.1614 (Affirmative) <succ>
   bacterial membrane --- Certainty = 0.0000 (Not Clear) <succ>
   bacterial outside --- Certainty = 0.0000 (Not Clear) <succ>

No corresponding DNA sequence was identified in *S. agalactiae*.

The protein has homology with the following sequences in the GENPEPT database:

Based on this analysis, it was predicted that this GAS-specific protein and its epitopes, could be useful antigens for vaccines or diagnostics.

Example 2392

A DNA sequence (GASx131R) was identified in *S. pyogenes* <SEQ ID 7283> which encodes the amino acid sequence <SEQ ID 7284>. Analysis of this protein sequence reveals the following:

Possible site: 37
>>> Seems to have no N-terminal signal sequence
----- Final Results -----
   bacterial cytoplasm --- Certainty = 0.4465 (Affirmative) <succ>
   bacterial membrane --- Certainty = 0.0000 (Not Clear) <succ>
   bacterial outside --- Certainty = 0.0000 (Not Clear) <succ>

No corresponding DNA sequence was identified in *S. agalactiae*.

The protein has no significant homology with any sequences in the GENPEPT database.

```
>GP:CAB54046 GB:AJ245436 hypothetical protein, 57.8 kD [Pseudomonas putida]

Identities = 128/388 (32%), Positives = 204/388 (51%), Gaps = 21/388 (5%)

Query:    4  IGSVVQRQELVFIPAQLKRINHVQHAYKCQTCSDNSLSDKIIKAPVPKAPLAHSLGSASI   63
             IG  V  Q L  +P Q++ I HV+  Y C+ C       ++      A P    + S+ S S+
Sbjct:  126  IGEEVSEQ-LEIVPMQIRVIKHVRKVYGCRDCESAPVT-----ADKPAQMIEKSMASPSV  179

Query:   64  IAHTVHQKFTLKVPNYRQEEDWNKLGLSISRKEIANWHIKSSQYYFEPLYDLLRDILLSQ  123
             +A  +  K+   +P +R E+   + G+ I R+  +A W I+  S++ F+PL +L+R+  LL+
Sbjct:  180  LAMLLTTKYVDGLPLHRFEKVLGRHGIDIPRQTLARWVIQCSEH-FQPLLNLMRESLLNS  238

Query:  124  EVIHADETSYRVLESD----TQLTYYWTFLSGKHEKKGITLYHHDKRRSGLVTQEVLGDY  179
             +IH DET   +VL+       +  ++ W    G  ++   + L+ +    R+  V   +L  Y
Sbjct:  239  RIIHCDETRVQVLKEPGREPSSQSWMWVQTGGPPDRP-VILFDYATSRAQEVPVRLLDGY  297

Query:  180  SGYVHCDMHGAYRQL---EHAKLVGCWAHVRRKFFEATPKQAD-KTSLGRKGLVYCDKLF  235
                GYV  D +  Y L   +   + +GCWAH RRKF EA    Q   KT      L    +KL+
Sbjct:  298  RGYVMTDDYAGYNALAAQDGLERLGCWAHARRKFVEAQKVQPKGKTGRADIALNLINKLY  357

Query:  236  ALEAEWCELPPQERLVERKEILTPLMTTFFDWCR--EQVVLSGSKLGLAIAYSLKHERTF  293
             +E + +   ++R V R E    PL+T   +W    +   V   ++ LG AI Y  +
Sbjct:  358  GVERDLKDSDDEDRKVARMERSLPLLTQLKNWVEKTQPQVTTQNALGKAIGYLASNWSKL  417

Query:  294  RTVLEDGHIVLSNNMAERAIKSLVMGRKNWLFSQSFEGAKAAAIIMSLLETAKRHGLNSE  353
              +E  G++  +  + NN  AERAI+   V+GRKNWLFS  + +GA A+A  +  SL+ETAK  +G
Sbjct:  418  ERYVEHGYLPMDNNAAERAIRPFVIGRKNWLFSDTPKGATASAQLYSLVETAKANGQEPY  477

Query:  354  KYISYLLDRLPNEETLAKREVLEAYLPW                                 381
             ++ +  +  L+RLP    ++   E  EA LPW
Sbjct:  478  AWLRHALERLPQACSV---EDYEALLPW                                 502
```

Example 2393

A DNA sequence (GASx132R) was identified in *S. pyogenes* <SEQ ID 7285> which encodes the amino acid sequence <SEQ ID 7286>. Analysis of this protein sequence reveals the following:

---

Possible site: 46
>> Seems to have no N-terminal signal sequence
----- Final Results -----
    bacterial cytoplasm --- Certainty = 0.1529 (Affirmative) <succ>
        bacterial membrane --- Certainty = 0.0000 (Not Clear) <succ>
        bacterial outside --- Certainty = 0.0000 (Not Clear) <succ>

---

No corresponding DNA sequence was identified in *S. agalactiae*.

The protein has homology with the following sequences in the GENPEPT database:

```
>GP:BAA84885 GB:AB024946 orf50 [Escherichia coli]
Identities = 37/91 (40%), Positives = 53/91 (57%)
Query:  10   QNYLVCGKTDMRQGIDSLAYLVKSQHELDLFSGAVYLFCGGRRDRFKALYWDGQGFWLLY    69
             +++LV G TDMR G + LA  V++   + D FSG +++F G R D+ K L+ D   G  L
Sbjct:   9   RIWLVAGITDMRNGFNGLASKVQNVLKDDPFSGHLFIFRGRRGDQIKVLWADSDGLCLFT    68

Query:  70   KRFENGKLAWPRNRDEVKCLTAVQVDWLMKG                              100
             KR  E G+  WP  RD      LT  Q+  L++G
Sbjct:  69   KRLERGRFVWPVTRDGKVHLTPAQLSMLLEG                               99
```

Based on this analysis, it was predicted that this GAS-specific protein and its epitopes, could be useful antigens for vaccines or diagnostics.

Example 2394

A DNA sequence (GASx133R) was identified in *S. pyogenes* <SEQ ID 7287> which encodes the amino acid sequence <SEQ ID 7288>. Analysis of this protein sequence reveals the following:

---

Possible site: 18
>> Seems to have no N-terminal signal sequence
----- Final Results -----
    bacterial cytoplasm --- Certainty = 0.1979 (Affirmative) <succ>
        bacterial membrane --- Certainty = 0.0000 (Not Clear) <succ>
        bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2395

A DNA sequence (GASx135R) was identified in *S. pyogenes* <SEQ ID 7289> which encodes the amino acid sequence <SEQ ID 7290>. Analysis of this protein sequence reveals the following:

---

Possible site: 20
>>> Seems to have a cleavable N-terminal signal sequence
----- Final Results -----
    bacterial outside --- Certainty = 0.3000 (Affirmative) <succ>
        bacterial membrane --- Certainty = 0.0000 (Not Clear) <succ>
        bacterial cytoplasm --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2396

A DNA sequence (GASx136) was identified in *S. pyogenes* <SEQ ID 7291> which encodes the amino acid sequence <SEQ ID 7292>. Analysis of this protein sequence reveals the following:

---

Possible site 54
>>> Seems to have no N-terminal signal sequence
INTEGRAL    Likelihood = −11.73    Transmembrane 222-238 (212-242)
INTEGRAL    Likelihood = −10.88    Transmembrane 37-53 (32-57)
INTEGRAL    Likelihood = −9.87    Transmembrane 462-478 (456-478)
INTEGRAL    Likelihood = −4.25    Transmembrane 119-135 (117-137)
INTEGRAL    Likelihood = −2.60    Transmembrane 308-324 (306-324)
INTEGRAL    Likelihood = −1.28    Transmembrane 164-180 (164-180)
INTEGRAL    Likelihood = −0.06    Transmembrane 137-153 (137-153)
INTEGRAL    Likelihood = −0.06    Transmembrane 343-359 (343-359)
----- Final Results -----
    bacterial membrane --- Certainty = 0.5692 (Affirmative) <succ>
        bacterial outside --- Certainty = 0.0000 (Not Clear) <succ>
        bacterial cytoplasm --- Certainty = 0.0000 (Not Clear) <succ>

---

No corresponding DNA sequence was identified in *S. agalactiae*.

The protein has homology with the following sequences in the GENPEPT database:

```
>GP:BAB04077 GB:AP001508 short-chain fatty acids transporter
[Bacillus halodurans]
Identities = 158/465 (33%), Positives = 248/465 (52%), Gaps = 41/465 (8%)
Query:  15   IKTKKRFMDRYIDGFMKWMPESLFICFILTFLVVTMSVLMTDSPFIGTEKTGGITYGWVN    74
               I    R M RY+       P+     +LTFLV  +S++ T+S   T   T  I+  W
```

```
                               -continued
Sbjct:   5 ISLSNRLMQRYL-------PDPFLFVVLLTFLVFALSLIFTES----TPLT--IVQYWGE       51

Query:  75 GFWGLLSFAMQMTILLATGNAVASSPPAHKMFKSLAKLPQTRTQIFIFSIVVGSIFGFLH      134
           GFWGLLSF+MQM ++L TG+ +ASSP   K   +LA LP +  Q  +   VV  + F++
Sbjct:  52 GFWGLLSFSMQMVLVLVTGHVLASSPLFKKGLGALAGLPASPGQAILLVTVVSLVASFIN      111

Query: 135 WGLGMMVAIVFGKELLVQARQKGIKVHTPLFVATLFFTFLPATSGLSGAAVLYSATPDYL      194
           WG G+++  +F KEL      +K   V   L +A+ +  F+      GLSG+  L ATPD+
Sbjct: 112 WGFGLVIGALFAKELA----KKVDNVDYRLLIASAYSGFMIWHGGLSGSVPLTIATPDHF      167

Query: 195 RNSVADAYKQVVPESVPLTESVL---NLPFISLLVVCMLVPLCFALLAHPKDETKIME--      249
             +              +P +E++    NL  +  L +    +PL    L+    K +T  ++
Sbjct: 168 AQDMIGV--------IPTSETIFAPYNLAIVFALFIA--IPLANRLMMPGKSDTVTVDRS      217

Query: 250 -LDDEIYHHSLDTASHVVIARNTPAEKMNASRLVMYLVGGAIVSYSLYHFSVVGLSGLDL      308
            LDD      L  AS + +     TP++++  SR++   LVG     + +  Y+F+  G    L+L
Sbjct: 218 LLDDG---RDLQAAS-LELEAMTPSDRLENSRMISLLVGVLGLVFLGYYFATNGFE-LNL      272

Query: 309 NCFNFLFLGLGLLLCGQQGPEYYGSLFKDGVMSSWGLVLQFPFYAGIFGIIQSTGLGLEI      368
            +  N LFL LG+L  G    P+  +        V   + G+++QFPFYAG+ GI+ S+GL      +
Sbjct: 273 DIVNSLFLFLGILFHGT--PKLFLKAVTSAVKGASGIIIQFPFYAGLMGIMVSSGLATVM      330

Query: 369 SHFFVAISNGTTWPVFAYLYSALLNIAVPSGGSKFVIEAPYIVPATIEVGNDLGKILQAY      428
           S   FV+ SN   T+P+F +L +  ++N+ VPSGG ++ ++AP ++ A    +G     K   A
Sbjct: 331 SEAFVSFSNEVTFPLFVFLSAGIVNVFVPSGGGQWAVQAPVVLEAAQSLGVPAAKAAMAV      390

Query: 429 QLGDATTNLIVPFWALSYLSNFKLKFNQIVAYTIPCVLVVTGIAI                  473
             GDA TN+I PFWAL  L+    LK    I+ + +   +LVV+G+ I
Sbjct: 391 AWGDAWTNMIQPFWALPALAIAGLKAKDIMGFCV-MILVVSGVVI                  434
```

Based on this analysis, it was predicted that this GAS-specific protein and its epitopes, could be useful antigens for vaccines or diagnostics.

Example 2397

A DNA sequence (GASx137R) was identified in *S. pyogenes* <SEQ ID 7293> which encodes the amino acid sequence <SEQ ID 7294>. Analysis of this protein sequence reveals the following:

```
Possible site: 58
>>> Seems to have no N-terminal signal sequence
----- Final Results -----
   bacterial cytoplasm --- Certainty = 0.2591 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae.*

The protein has homology with the following sequences in the GENPEPT database:

Based on this analysis, it was predicted that this GAS-specific protein and its epitopes, could be useful antigens for vaccines or diagnostics.

Example 2398

A DNA sequence (GASx140) was identified in *S. pyogenes* <SEQ ID 7295> which encodes the amino acid sequence <SEQ ID 7296>. Analysis of this protein sequence reveals the following:

```
Possible site: 50
>>> Seems to have no N-terminal signal sequence
----- Final Results -----
   bacterial cytoplasm --- Certainty = 0.3351 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae.*

The protein has homology with the following sequences in the GENPEPT database:

```
>GP:AAC22434 GB:U32761 transcriptional regulator [Haemophilus influenzae Rd]

Identities = 37/107 (34%), Positives = 56/107 (51%), Gaps = 1/107 (0%)

Query:  21  LHRQNLVTFDKTFMINHQLTTLFEEANSLPVVKCYSASWDFLLNCTRYS-SYLTILPRPI    79

LH+Q +  FD+TFMI+H L    FE  N  P +    S+ WDFLL+  + +    LTILP P+

Sbjct: 205  LHQQKMAIFDQTFMIHHHLKEAFERNNCYPDIVLDSSCWDFLLSAVKTNKELLTILPLPM    264

Query:  80  THFAHMDGLVEVQLTEHPKWEVVLASLKHNKTSHLKHYIKHTILDYF                 126
                H    +  ++      W+V L    +     +HL+ YI     +L+ F Sbjct: 265  AELYHSKEFLCRKIESPVPWKVTLCRQRKTVYTHLEEYIFDKLLEAF                 311
```

```
!GB:U32761 acetate CoA-transferase, alpha subunit [H... 215  4e-55
Identities = 105/213 (49%), Positives = 146/213 (68%)
Query:  22 ENKRIAIAEAISHIKDGDTIMVGGFMANGTPEALIDALVDKGTKDLTLICNDAGFVDRGV    81
            + K + + +A    +DG TIMVGGFM  GTP  L++AL++ G +DLTLI  ND   FVD G+
Sbjct:   2 KTKLMTLQDATGFFRDGMTIMVGGFMGIGTPSRLVEALLESGVRDLTLIANDTAFVDTGI    61

Query:  82 GKMVANHQFKTIYATHIGLNKEAGRQMTAGETTIELIPQGTFAEKIRIGAYGIGGFYTPT   141
            G ++ N + + + A+HIG N E GR+M +GE  + L+PQGT  E+IR G  G+GGF TPT
Sbjct:  62 GPLIVNGRVRKVIASHIGTNPETGRRMISGEMDVVLVPQGTLIEQIRCGGAGLGGFLTPT   121

Query: 142 GVGTLVAEGKETKTIKGKTYLLEYPFEADVALIFANQADEMGNLQYSGSENNFNQLMAAC   201
            GVGT+V EGK+T T+ GKT+LLE P   AD+ALI A++ D +GNL Y  S   NFN L+A
Sbjct: 122 GVGTVVEEGKQTLTLDGKTWLLERPLRADLALIRAHRCDTLGNLTYQLSARNFNPLIALA   181

Query: 202 AKTTIVQAREIVPVGTIQPECVHTPHIFVDYIV                              234
            A   T+V+  E+V  G +QP+ + TP     +D+I+
Sbjct: 182 ADITLVEPDELVETGELQPDHIVTPGAVIDHII                              214
            subunit (EC 2.8.3.-). [Escherichia coli]
```

Based on this analysis, it was predicted that this GAS-specific protein and its epitopes, could be useful antigens for vaccines or diagnostics.

Example 2399

A DNA sequence (GASx141) was identified in *S. pyogenes* <SEQ ID 7297> which encodes the amino acid sequence <SEQ ID 7298>. Analysis of this protein sequence reveals the following:

possible site: 41
>>> Seems to have no N-terminal signal sequence
----- Final Results -----
  bacterial cytoplasm --- Certainty = 0.4941 (Affirmative) <succ>
  bacterial membrane --- Certainty = 0.0000 (Not Clear) <succ>
  bacterial outside --- Certainty = 0.0000 (Not Clear) <succ>

No corresponding DNA sequence was identified in *S. agalactiae*.

The protein has homology with the following sequences in the GENPEPT database:

Based on this analysis, it was predicted that this GAS-specific protein and its epitopes, could be useful antigens for vaccines or diagnostics.

Example 2400

A DNA sequence (GASx144) was identified in *S. pyogenes* <SEQ ID 7299> which encodes the amino acid sequence <SEQ ID 7300>. Analysis of this protein sequence reveals the following:

Possible site: 39
>>> Seems to have no N-terminal signal sequence
----- Final Results -----
  bacterial cytoplasm --- Certainty = 0.3227 (Affirmative) <succ>
  bacterial membrane --- Certainty = 0.0000 (Not Clear) <succ>
  bacterial outside --- Certainty = 0.0000 (Not Clear) <succ>

No corresponding DNA sequence was identified in *S. agalactiae*.

The protein has homology with the following sequences in the GENPEPT database:

```
>GP:AAF12248 GB:AE001862 CoA transferase, subunit B [Deinococcus radiodurans]

Identities = 114/203 (56%), Positives = 158/203 (770), Gaps = 3/203 (1%)

Query:  11 QNRIAERVAKELEDGTLVNLGIGLPTKVANFVPEEMTVYFQSENGFIGLGP--KSDDPNS    68
            ++ +A R A+EL+DG  VNLGIGLPT VAN +P  M+V+ QSENG +G+GP      D+ +
Sbjct:   5 RDEMAARAAQELQDGYYVNLGIGLPTLVANHIPAGMSVWLQSENGLLGIGPFPTEDEVDP    64

Query:  69 TIVNAGGQPVTVYPGAAFFNSADSFGIIRGGHVDLTVLGALEIAENGDIANYLIPGKMVP   128
            ++NAG Q VT   PGA+FF+SADSF +IRGGHV+L  +LGA++++E  GD+AN++IPGKMV
Sbjct:  65 DLINAGKQTVTALPGASFFSSADSFAMIRGGHVNLAILGAMQVSETGDLANWMIPGKMVK   124

Query: 129 GMGGAMDLLVGAKKVIVAMEHTNKG-KHKLLKECTLPLTAKGVVDLIITEMGVFKVTPDG   187
            GMGGAMDL+ G ++V+V MEH  KG  HK+L+ECTLPLT +GVVD IIT++GV   VTP G
Sbjct: 125 GMGGAMDLVAGVQRVVVLMEHVAKGDAHKILRECTLPLTGQGVVDRIITDLGVLDVTPQG   184

Query: 188 IQVIEISEGFTFDEVQAATGVPL                                        210
            ++++E++  G T DE++   TG  +
Sbjct: 185 LKLVELAPGVTLDELRQKTGADI                                        207
```

```
>GP:BAA29948 GB:AP000003 137aa long hypothetical protein [Pyrococcus
horikoshii]
Identities = 49/113 (43%), Positives = 71/113 (62%), Gaps = 1/113 (0%)
Query:   5   PEPMGPYSTYTIEGHFLYTAGQLPLNPVTGQLSDG-FEAQCRQVFVNLQSILAEQKLDLN    63
             P+P+GPYS        G+FL+ AGQ+P++P TG++   G  + Q RQV  N+++IL       LN
Sbjct:  22   PKPIGPYSQAIKAGNFLFIAGQIPIDPKTGEIVKGDIKDQTRQVLENIKAILEAAGYSLN    81

Query:  64   HIYKLNVYLTDVTNVEILNEVMTDLFEEPYPVRTAVQVSALPLQALIEVEAVA          116
             +  K+ VYL D+ +    +N V  + F E   P R AV+VS LP    LIE+EA+A
Sbjct:  82   DVIKVTVYLKDMNDFAKMNEVYAEYFGESKPARVAVEVSRLPKDVLIEIEAIA          134
```

Based on this analysis, it was predicted that this GAS-specific protein and its epitopes, could be useful antigens for vaccines or diagnostics.

Example 2401

A DNA sequence (GASx146) was identified in *S. pyogenes* <SEQ ID 7301> which encodes the amino acid sequence <SEQ ID 7302>. Analysis of this protein sequence reveals the following:

---

Possible site: 16
>>> Seems to have no N-terminal signal sequence
----- Final Results -----
  bacterial cytoplasm --- Certainty = 0.1238 (Affirmative) <succ>
    bacterial membrane --- Certainty = 0.0000 (Not Clear) <succ>
      bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2402

A DNA sequence (GASx147) was identified in *S. pyogenes* <SEQ ID 7303> which encodes the amino acid sequence <SEQ ID 7304>. Analysis of this protein sequence reveals the following:

---

Possible site: 30
>>> Seems to have no N-terminal signal sequence
INTEGRAL    Likelihood = −11.46   Transmembrane 456-472 (452-481)
INTEGRAL    Likelihood = −8.17    Transmembrane 603-619 (595-623)
INTEGRAL    Likelihood = −6.85    Transmembrane 495-511 (491-518)
INTEGRAL    Likelihood = −5.31    Transmembrane 420-436 (418-443)
INTEGRAL    Likelihood = −4.99    Transmembrane 396-412 (392-413)
INTEGRAL    Likelihood = −1.59    Transmembrane 522-538 (522-538)
INTEGRAL    Likelihood = −0.64    Transmembrane 577-593 (577-593)
INTEGRAL    Likelihood = −0.43    Transmembrane 377-393 (377-393)
----- Final Results -----
  bacterial membrane --- Certainty = 0.5585 (Affirmative) <succ>
    bacterial outside --- Certainty = 0.0000 (Not Clear) <succ>
      bacterial cytoplasm --- Certainty = 0.0000 (Not Clear) <succ>

---

No corresponding DNA sequence was identified in *S. agalactiae*.

The protein has homology with the following sequences in the GENPEPT database:

```
>GP:BAA04270 GB:D17462 Na+ -ATPase subunit I [Enterococcus hirae]
Identities = 232/681 (34%), Positives = 370/681 (54%), Gaps = 40/681 (5%)
Query:   1   MAISQMKKLAMVFEKDYLDLVLKTLQQSQLVEVRDMKQLKH---WQDAFNKGNVKLPQIV    57
             MA+++M+K+ ++ +K    +++L+ +Q     VE+RD+ Q      W + F       P+++
Sbjct:   1   MAVTKMEKVTLISDKKNREILLQAVQGLHAVEIRDLFQESENNQWVETF----FPEPEMI    56

Query:  58   QYDLTHQKPLLDDEALQYLLQSQQELENGLASLSAFLPPIGKLTALRQ--KTPSLSFKQF   115
              D   K      L Y L     + +  F+   G+ +   +Q  K    LS
Sbjct:  57   DKDKELAK------LSYKLTD-------IRTAIQFIEHHGEKSQKKQHLKRRELSLDTL   102

Query: 116   EERHRQQAAQTALKMMSQKIERLEQLQSKIDQLTEYCQELEKWRSLTVLPQDLAQFHFLS   175
             E+ + ++A      L+ +    E+ EQL   QL +      L  W++L  + P+
Sbjct: 103   EKNYSEEAFSKKLEEVLLLKEQWEQLVDERQQLEDQENWLLNWQNLDLAPKAFDS-QMTK   161

Query: 176   ARVGTIPSTANNHFYHQLKQHKGLFIEEVYH----TEFEYGLVLFWQAQDTIHLQKYQFK   231
              +GT+ +     F   ++ +    ++EE+        T F Y ++    +++       +Y F
Sbjct: 162   LVIGTVNAKNAESFKAEVAEINEAYLEEINSSPTTTYFAYIVLRADESRMEEIASRYGFV   221

Query: 232   PLLYKEQLLPSEQLRINKELLTNWLAEKDSLLKELRQSQKILAQLQVEIDYVLSQYQRQQ   291
                Y + P +QL   K+ L    ++  L   +      +   +   + L++ +R+
Sbjct: 222   KEDYLYEGTPQQQLVAAKQSLQEIKDQQKKLSSAIGACSGYIKDFEWTEEIFLARSEREA   281

Query: 292   TKKQLLGTRHLIALEGWIEADSVNQLKGLMTKTLGDMFYLDSYDVTPDDW--EDVPIKLR   349
              K +++ T +LI ++GW++ +    +L ++        L      ++D   D+    E+VP KL+
Sbjct: 282   IKDRIIHTPYLILIQGWVDHEEKQELIHMLQNILASEEVYLTFDEPTDNEIAEEVPTKLK   341

Query: 350   NHRYIAPFELVTEMYALPKYQEKDPTPFLAPLYLTFFGMMVADLGYGLLLYAVTLAALVF   409
             NH   +APFE++TEMY+LPKY+E  DPTP++  P  YL  FFGMMVAD+GYGLL++
Sbjct: 342   NHPIVAPFEMLTEMYSLPKYEEVDPTPWMMPFYLVFFGMMVADIGYGLLMFLGAFLLQKL   401

Query: 410   FNLQKTSKRLVTFFNILAISVAIWGLIYGSFFG---------FDLPVALLSTKTDVITIL   460
               L +   +R   FF ILAI    IWG IY SFFG              LP  +LST  DV TIL
Sbjct: 402   VVLPRGMQRFAKFFEILAIPSIIWGFIYSSFFGAALPKEIFGIHLPFPILSTTDDVNTIL   461
```

-continued
```
Query:  461  VVSLLFGFVTLIFGLLLGAWQQVRMKAYATAYTSSLAWTFILLGLLLFILGKNVSGLAYL  520
             ++S++FG + ++ GL + A + ++ KAY  A       AW +ILLG++L +LG
Sbjct:  462  ILSVIFGLIQILVGLFIAAKEHIKRKAYVDAVNDGFAWQWILLGIILILLGTMTLKNNAF  521

Query:  521  SVIGKWLALGNAFGILVVSLLKSKSLL-GLGSGLYNLYGISSYLSDLVSFTRLMALGLSG  579
               +G  LA+ +A  IL++ + +S S   G+  G YNLYG++ Y+ DLVS+TRLMALG+SG
Sbjct:  522  VYLGGALAVLSAVCILIIPVFQSSSKAKGIAKGAYNLYGLTGYIGDLVSYTRLMALGISG  581

Query:  580  ASIGAAFNMIVGIFPPVTRFTVGIFIFILLHAINIFLSMLSGYVHGARLIFVEFFGKFYE  639
               SI  AAFNM+V    PP  RF+VGI +  I+L A+N+FL++LS YVHGARL +VEFFGKFY
Sbjct:  582  GSIAAAFNMLVAFMPPAARFSVGILLIIVLQALNMFLTLLSAYVHGARLQYVEFFGKFYT  641

Query:  640  GGGKAFNPLKLADNYVNVNEE                                        660
             GGG++F PLK   + YVN+N +
Sbjct:  642  GGGRSFKPLKTVEKYVNINHK                                        662
```

Based on this analysis, it was predicted that this GAS-specific protein and its epitopes, could be useful antigens for vaccines or diagnostics.

Example 2403

A DNA sequence (GASx148) was identified in *S. pyogenes* <SEQ ID 7305> which encodes the amino acid sequence <SEQ ID 7306>. Analysis of this protein sequence reveals the following:

```
Possible site: 40
>>> Seems to have no N-terminal signal sequence
INTEGRAL    Likelihood = -7.80    Transmembrane 28-44 (21-51)
INTEGRAL    Likelihood = -6.85    Transmembrane 148-164 (146-170)
INTEGRAL    Likelihood = -2.81    Transmembrane 105-121 (105-123)
----- Final Results -----
   bacterial membrane --- Certainty = 0.4121 (Affirmative) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae.*

The protein has homology with the following sequences in the GENPEPT database:

Based on this analysis, it was predicted that this GAS-specific protein and its epitopes, could be useful antigens for vaccines or diagnostics.

Example 2404

A DNA sequence (GASx149) was identified in *S. pyogenes* <SEQ ID 7307> which encodes the amino acid sequence <SEQ ID 7308>. Analysis of this protein sequence reveals the following:

```
Possible site: 55
>>> Seems to have no N-terminal signal sequence
----- Final Results -----
   bacterial cytoplasm --- Certainty = 0.4510 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae.*

The protein has homology with the following sequences in the GENPEPT database:

>GP:BAA03841 GB:D16334 Na+-ATPase K subunit [*Enterococcus hirae*]

Identities = 85/150 (56%), Positives = 107/150 (70%)

```
Query:  20  HYFTAHGGVFFAALGIVLAVALSGMGSAYGVGKGGQAAAALLKEEPEKFTSALILQLLPG   79
            +  T +GG+ FA L +  A   SG+GSA GVG  G+AAAAL    +PEKF  ALILQLLPG Sbjct:   4  YLITQNGGMVFAVLAMATATIFSGIGSAKGVGMTGEAAAALTTSQPEKFGQALILQLLPG   63

Query:  80  SQGIYGFAIGILIWMKLTPELSVN-                                   139
            QGLAYFLVSLPIAIVGYFSAKHQGNVSVAGMQILAK

+QG+YGF I  LI++ L  ++SV QGL +   SLPIA  G FS   QG V+ AG+QILAK

Sbjct:  64  TQGLYGFVIAFLIFINLGSDMSVVQGLNFLGASLPIAFTGLFSGIAQGKVAAAGIQILAK 123

Query: 140  RPKDFMKGVILAAMVETYAILAFVVSFILL                               169
            +P+   KG+I AAMVETYAIL FV+SF+L+

Sbjct: 124  KPEHATKGIIFAAMVETYAILGFVISFLLV                               153
```

```
>GP:BAA04272 GB:D17462 Na+ -ATPase subunit E [Enterococcus hirae]
Identities = 43/193 (22%), Positives = 95/193 (48%), Gaps = 2/193 (1%)
Query:   1 VNDITQLRQNVLEKAHQEGQQCLKIATDSLDTDFKERQQQGLHDLKAKRQKELKALEQQF   60
             V+ I ++   + E A  E        ++   +D  F+ ++ Q    D + ++  +L+ +E+ +
Sbjct:   3 VDAIDKIITQINETAQLERASFEEMKRKEIDQKFEVKKWQIEADFQKEKASKLEEIERSY   62

Query:  61 QVAQQQLKNQERQALLALKQDSIKELFEASLEKMTNFSKEEELAFLKQVLSKYP-EQPLQ  119
             +  + + K Q +Q +L   KQ+ ++ LF  +  ++ N   KEE+LA +KQ++    P       +
Sbjct:  63 RQLRNKQKMQVKQEILNAKQEVLQRLFTEATLQLENEPKEEQLALMKQMIQTLPINGTAR  122

Query: 120 VTFGEKTGQKFSSYDCAELRLAFPQLSYNQELIPQ-EAGFLVSLDQVDDNYLYRYLLESV  178
             +  GEK+   +    AE    P      ++   + +AG ++       +  N+L+ +L++ +
Sbjct: 123 LIPGEKSADILTPAVIAEWNEELPFELIREDFTEKAQAGLIIDDAGIQYNFLFSHLIKEI  182

Query: 179 LKEESSRIIDMLF                                                191
             +  S+ I   LF
Sbjct: 183 QETMSAEIAKELF                                                195
```

Based on this analysis, it was predicted that this GAS-specific protein and its epitopes, could be useful antigens for vaccines or diagnostics.

Example 2405

A DNA sequence (GASx150) was identified in *S. pyogenes* <SEQ ID 7309> which encodes the amino acid sequence <SEQ ID 7310>. Analysis of this protein sequence reveals the following:

Possible site: 30
>>> Seems to have no N-terminal signal sequence
----- Final Results -----
  bacterial cytoplasm --- Certainty = 0.3095 (Affirmative) <succ>
bacterial membrane --- Certainty = 0.0000 (Not Clear) <succ>
bacterial outside --- Certainty = 0.0000 (Not Clear) <succ>

---

No corresponding DNA sequence was identified in *S. agalactiae.*

The protein has homology with the following sequences in the GENPEPT database:

Based on this analysis, it was predicted that this GAS-specific protein and its epitopes, could be useful antigens for vaccines or diagnostics.

Example 2406

A DNA sequence (GASx151) was identified in *S. pyogenes* <SEQ ID 7311> which encodes the amino acid sequence <SEQ ID 7312>. Analysis of this protein sequence reveals the following:

---

Possible site: 29
>>> Seems to have no N-terminal signal sequence
----- Final Results -----
bacterial cytoplasm --- Certainty = 0.0484 (Affirmative) <succ>
bacterial membrane --- Certainty = 0.0000 (Not Clear) <succ>
bacterial outside --- Certainty = 0.0000 (Not Clear) <succ>

---

No corresponding DNA sequence was identified in *S. agalactiae.*

The protein has homology with the following sequences in the GENPEPT database:

```
>GP:BAA04273 GB:D17462 Na+ -ATPase subunit C [Enterococcus hirae]

Identities = 94/326 (28%), Positives = 167/326 (50%), Gaps = 5/326 (1%)
Query:   6  ELNTTISVKEKELLTKEQFDKLLQAPNTTTLARLLHQSVYHLTVDDLNDLDRLESILMAE   65
            ELN  I  +E EL++K+ F++++Q  +  +L  +L  ++Y   + D  D D  E+ L  E
Sbjct:   5  ELNPLIRGRELELISKDTFEQMIQTDSIDSLGEILQSTIYQPYIYDGFDKD-           63
            FEANLSQE Query:  66  LTKTYRWAFAETPQPDIVQLFTLRYTYHNVKVLLKAKASQADLSHLLLPIGDKPLVALEH  125
             +K ++W      P+P+IV ++T+RYT+HN+KVL KA+ +  +L HL +  G   L  L+
Sbjct:  64  RSKLFQWLKESAPEPEIVWIYTMRYTFHNLKVLTKAEITGQNLDHLYIHDGFYSLEVLKD  123

Query: 126  LIRTMTSDEFPKEVVTEIQSIWAEYQDYQDIRVLEIGTDLAYFKALKQIAQRLEDPVFQQ  185
             I T  S E P  ++  I+ +     ++    ++ +++  D  +     +++ ++L  P   +
Sbjct: 124  AIHTQVSVELPDSLMDYIREVHEYCEESTILQGIDVIYDRCFLTEQRRLGEQLGYPELLE  183

Query: 186  AVLIVIDLYNLITVRRAKSQNKPISFMMQLLSDEASRPSKTFITLEDDKDLMTWFENVTP  245
             ++  IDL N+ T  R   Q++   FM  ++S   S P  T ++     ++ ++ + +
Sbjct: 184  EIIAFIDLTNITTTARGILQHRSAGFMTTVISSSGSIPKDTLLSFVRG-EMASFTQFLLT  242

Query: 246  DSYMTALKPYSEKLRQGTLQTTELEYLVDECLYHLFAKAKYQVDGPYVLARFLLAKSFEV  305
             Y   LK   + + +  +     LE L D+ L    +  A+ Q  GP  L  FL AK  E
Sbjct: 243  TDYSELLK---QVIHEEQIDLVSLEQLKDDYLSSFYQVAQTQAFGPLPLLAFLNAKEVES  299

Query: 306  KNLRLLAAALANDLPKERVIERMRPI                                   331
            KNLRLL     N    E++ ERMR +
Sbjct: 300  KNLRLLIIGKRNHFSLEQLKERMRQV                                   325
```

```
>GP:BAA04274 GB:D17462 Na+ -ATPase subunit G [Enterococcus hirae]
Identities = 45/101 (44%), Positives = 65/101 (63%)
Query:   6 YKVGVIGNRDVILPFQMIGFQTFPVIKPQDAINQLRQLAMEDFGIIYITEDIAAAIPEAL    65
           YK+GV+G++D + PF++ GF     +   + ++A ++G+IYITE  A  +PE +
Sbjct:   3 YKIGVVGDKDSVSPFRLFGFDVQHGTTKTEIRKTIDEMAKNEYGVIYITEQCANLVPETI    62

Query:  66 THYDNQVLPAVIPLPTHQGAQGIGLSRIQAMVEKAVGQNIL                      106
            Y  Q+ PA+I +P+HQG  GIGL  IQ  VEKAVGQNIL
Sbjct:  63 ERYKGQLTPAIILIPSHQGTLGIGLEEIQNSVEKAVGQNIL                      103
```

Based on this analysis, it was predicted that this GAS-specific protein and its epitopes, could be useful antigens for vaccines or diagnostics.

Example 2407

A DNA sequence (GASx152R) was identified in *S. pyogenes* <SEQ ID 7313> which encodes the amino acid sequence <SEQ ID 7314>. Analysis of this protein sequence reveals the following:

Possible site: 21
>>> Seems to have no N-terminal signal sequence
----- Final Results -----
  bacterial cytoplasm --- Certainty = 0.1048 (Affirmative) <succ>
    bacterial membrane --- Certainty = 0.0000 (Not Clear) <succ>
     bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2408

A DNA sequence (GASx156) was identified in *S. pyogenes* <SEQ ID 7315> which encodes the amino acid sequence <SEQ ID 7316>:
EYSIIPQLKETIHYIELKLEMERASLVRIMKITS
Analysis of this protein sequence reveals the following:

Possible site: 16
>>> Seems to have no N-terminal signal sequence
----- Final Results -----
  bacterial cytoplasm --- Certainty = 0.5026 (Affirmative) <succ>
    bacterial membrane --- Certainty = 0.0000 (Not Clear) <succ>
     bacterial outside --- Certainty = 0.0000 (Not Clear) <succ>

No corresponding DNA sequence was identified in *S. agalactiae*.

The protein has homology with the following sequences in the GENPEPT database:

```
>GP:BAA04277 GB:D17462 Na+ -ATPase subunit D [Enterococcus hirae]
Identities = 119/201 (59%), Positives = 151/201 (74%), Gaps = 2/201 (0%)
Query:  10 RLNVKPTRMELSNLKNRLKTATRGHKLLKDKRDELMRRFVDLIRENNELRQTIEKELAAN    69
           RLNV PTRMEL+ LK +L TATRGHKLLKDK+DELMR+F+ LIR+NNELRQ IEKE
Sbjct:   2 RLNVNPTRMELTRLKKQLTTATRGHKLLKDKQDELMRQFILLIRKNNELRQAIEKETQTA    61

Query:  70 MKEFVLAKASENSLMVEELYAVPVHEVTLWIDIENIMSVNVPKFHVQSNTAREQEQGEFA   129
           MK+FVLAK++      ++EL A+P  V++ +  +NIMSV VP   + Q +    +    E
Sbjct:  62 MKDFVLAKSTVEEAFIDELLALPAENVSISVVEKNIMSVKVPLMNFQYDETLNETPLE--   119

Query: 130 YSYLSSNSEMDNTIQKTKELLEKLLRLAEVEKTCQLMADDIEKTRRRVNGLEYSIIPQLK   189
           Y YL SN+E+D +I      +LL KLL+LAEVEKTCQLMA++IEKTRRRVN LEY  IPQL+
Sbjct: 120 YGYLHSNAELDRSIDGFTQLLPKLLKLAEVEKTCQLMAEEIEKTRRRVNALEYMTIPQLE   179

Query: 190 ETIHYIELKLEEAERASLVRI                                         210
           ETI+YI++KLEE ERA + R+
Sbjct: 180 ETIYYIKMKLEENERAEVTRL                                         200
```

Based on this analysis, it was predicted that this GAS-specific protein and its epitopes, could be useful antigens for vaccines or diagnostics.

Example 2409

A DNA sequence (GASx161R) was identified in *S. pyogenes* <SEQ ID 7317> which encodes the amino acid sequence <SEQ ID 7318>. Analysis of this protein sequence reveals the following:

Possible site: 27
>>> Seems to have an uncleavable N-terminal signal sequence
----- Final Results -----
    bacterial membrane --- Certainty = 0.0000 (Not Clear) <succ>
     bacterial outside --- Certainty = 0.0000 (Not Clear) <succ>
  bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2410

A DNA sequence (GASx164) was identified in *S. pyogenes* <SEQ ID 7319> which encodes the amino acid sequence <SEQ ID 7320>. Analysis of this protein sequence reveals the following:

---

Possible site: 36
>>> Seems to have no N-terminal signal sequence
INTEGRAL   Likelihood = −1.06   Transmembrane 9-25 (9-25)
----- Final Results -----
  bacterial membrane --- Certainty = 0.1426 (Affirmative) <succ>
    bacterial outside --- Certainty = 0.0000 (Not Clear) <succ>
      bacterial cytoplasm --- Certainty = 0.0000 (Not Clear) <succ>

---

A related sequence was also identified <SEQ ID 9091> which encodes the amino acid sequence <SEQ ID 9092>. Analysis of this protein sequence reveals the following:

---

Possible cleavage site: 33
>>> Seems to have a cleavable N-terminal signal sequence
----- Final Results -----
  bacterial outside --- Certainty = 0.300 (Affirmative) <succ>
    bacterial membrane --- Certainty = 0.000 (Not Clear) <succ>
      bacterial cytoplasm --- Certainty = 0.000 (Not Clear) <succ>

---

No corresponding DNA sequence was identified in *S. agalactiae*.

Based on this analysis, it was predicted that this GAS-specific protein and its epitopes, could be useful antigens for vaccines or diagnostics.

Example 2411

A DNA sequence (GASx165) was identified in *S. pyogenes* <SEQ ID 7321> which encodes the amino acid sequence <SEQ ID 7322>. Analysis of this protein sequence reveals the following:

---

Possible site: 59
>>> Seems to have no N-terminal signal sequence
----- Final Results -----
  bacterial cytoplasm --- Certainty = 0.2251 (Affirmative) <succ>
    bacterial membrane --- Certainty = 0.0000 (Not Clear) <succ>
      bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2412

A DNA sequence (GASx166) was identified in *S. pyogenes* <SEQ ID 7323> which encodes the amino acid sequence <SEQ ID 7324>. Analysis of this protein sequence reveals the following:

---

Possible site: 34
>>> Seems to have a cleavable N-terminal signal sequence
----- Final Results -----
  bacterial outside --- Certainty = 0.3000 (Affirmative) <succ>
    bacterial membrane --- Certainty = 0.0000 (Not Clear) <succ>
      bacterial cytoplasm --- Certainty = 0.0000 (Not Clear) <succ>

---

No corresponding DNA sequence was identified in *S. agalactiae*.

Based on this analysis, it was predicted that this GAS-specific protein and its epitopes, could be useful antigens for vaccines or diagnostics.

Example 2413

A DNA sequence (GASx167) was identified in *S. pyogenes* <SEQ ID 7325> which encodes the amino acid sequence <SEQ ID 7326>. Analysis of this protein sequence reveals the following:

---

Possible site: 31
>>> Seems to have a cleavable N-terminal signal sequence
----- Final Results -----
  bacterial outside --- Certainty = 0.3000 (Affirmative) <succ>
    bacterial membrane --- Certainty = 0.0000 (Not Clear) <succ>
      bacterial cytoplasm --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2414

A DNA sequence (GASx168R) was identified in *S. pyogenes* <SEQ ID 7327> which encodes the amino acid sequence <SEQ ID 7328>. Analysis of this protein sequence reveals the following:

---

Possible site: 22
>>> Seems to have a cleavable N-terminal signal sequence
----- Final Results -----
  bacterial outside --- Certainty = 0.3000 (Affirmative) <succ>
    bacterial membrane --- Certainty = 0.0000 (Not Clear) <succ>
      bacterial cytoplasm --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2415

A DNA sequence (GASx169R) was identified in *S. pyogenes* <SEQ ID 7329> which encodes the amino acid sequence <SEQ ID 7330>. Analysis of this protein sequence reveals the following:

```
Possible site: 31
>>> Seems to have a cleavable N-terminal signal sequence
----- Final Results -----
    bacterial outside --- Certainty = 0.3000 (Affirmative) <succ>
      bacterial membrane --- Certainty = 0.0000 (Not Clear) <succ>
        bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2416

A DNA sequence (GASx170) was identified in *S. pyogenes* <SEQ ID 7331> which encodes the amino acid sequence <SEQ ID 7332>. Analysis of this protein sequence reveals the following:

```
Possible site: 61
>>> Seems to have no N-terminal signal sequence
INTEGRAL    Likelihood = -2.34    Transmembrane 154-170 (153-170)
INTEGRAL    Likelihood = -1.12    Transmembrane 20-36 (19-36)
INTEGRAL    Likelihood = -0.69    Transmembrane 52-68 (52-68)
INTEGRAL    Likelihood = -0.53    Transmembrane 399-415 (399-415)
----- Final Results -----
    bacterial membrane --- Certainty = 0.1935 (Affirmative) <succ>
      bacterial outside --- Certainty = 0.0000 (Not Clear) <succ>
        bacterial cytoplasm --- Certainty = 0.0000 (Not Clear) <succ>
```

No corresponding DNA sequence was identified in *S. agalactiae*.

The protein has homology with the following sequences in the GENPEPT database:

Based on this analysis, it was predicted that this GAS-specific protein and its epitopes, could be useful antigens for vaccines or diagnostics.

Example 2417

A DNA sequence (GASx178) was identified in *S. pyogenes* <SEQ ID 7333> which encodes the amino acid sequence <SEQ ID 7334>. Analysis of this protein sequence reveals the following:

```
Possible site: 21
>>> Seems to have no N-terminal signal sequence
----- Final Results -----
    bacterial cytoplasm --- Certainty = 0.1492 (Affirmative) <succ>
      bacterial membrane --- Certainty = 0.0000 (Not Clear) <succ>
        bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2418

A DNA sequence (GASx182) was identified in *S. pyogenes* <SEQ ID 7335> which encodes the amino acid sequence <SEQ ID 7336>. Analysis of this protein sequence reveals the following:

```
Possible site: 22
>>> Seems to have no N-terminal signal sequence
```

```
>GP:BAB05347 GB:AP001512 cystathionine beta-lyase [Bacillus halodurans]

Identities = 200/384 (52%), Positives = 262/384 (68%), Gaps = 3/384 (0%)
Query:   79  IAEVYEMRENTTLLHGYTVIDEFTGAASVPIYQTSTFHNSELYCPSQKHLYTRFSNPTTE   138
             ++E Y ++   T LLH    +D+ TGA SVPI     STFH + +    + Y+R  NPT +
Sbjct:    1  MSEQYSLQ--TKLLHNEHKVDQATGAVSVPIQHASTFHQPFD-FDTFGTYDYSRSGNPTRD    57

Query:  139  ALEDGLACLEKATYAVAYASGMAAISTVLMLLKAGDHVIFPLEVYGGTCQFATAILPNYQ   198
             ALE  +A LE   +  A+ASGMAAIST  MLL  GDHV+    +VYGGT   T  +L
Sbjct:   58  ALEAAIAELEGGNHGFAFASGMAAISTAFMLLSKGDHVVLTKDVYGGTFRLVTEVLTRLG   117

Query:  199  IETSFVDMADLATVKASIRPNTRMIYLETPSNPLLKICDISELVQLAKAYGVLTVADNTF   258
             IE +FVDM  +LA V A+IRPNTR++Y ETPSNP L I DI  +V LAK +   LT  DNTF
Sbjct:  118  IEHTFVDMTNLAEVAAAIRPNTRVLYMETPSNPTLNITDIRGVVSLAKEHECLTFLDNTF   177

Query:  259  MTSLYQEPLAMGVDIVVESVTKFINGHSDVVAGLAATNNEAIYNQLKLFQKNFGAIVGVE   318
             +T    Q PL +GVD+V+ S TKFI GHSDVVAGLA T NE +  +L  Q +FGAI+GV+
Sbjct:  178  LTPALQRPLELGVDVVLHSATKFIGGHSDVVAGLAVTKNEELGKKLAFLQNSFGAILGVQ   237

Query:  319  DAWLILRGMKTMGIRMEQAVKNAQQLANYLAKHPKVLKVHYPGLDSHPNHDTHLQQAKNG   378
             D WL+LRG+KT+ +RME   K AQQ+A +L    P+V +V+YPGL  HP  H+   +QA+
Sbjct:  238  DVWLVLRGLKTLHVRMEHGEKGAQQIAEWLQGVPEVKRVYYPGLKDHPGHELQKRQAEGF   297

Query:  379  GAVLSFELASKEELMTFTHRIQLPILAVSLGGVESILSHPATMSHACLSPQARLEQGVVD   438
             GAVLSFEL ++E +  F    ++LP+ AVSLG VESILS+PA MSHA   +  +R   +G+ D
Sbjct:  298  GAVLSFELENEEAVRRFVEHVKLPVFAVSLGAVESILSYPAKMSHAAMPKEEREARGIRD   357

Query:  439  GLLRLSCGVENIEDLLADFEQALA                                      462
             GLLRLS G+E  E+L+ADF+ A A
Sbjct:  358  GLLRLSVGLEKPEELMADFKAAFA                                      381
```

-----Final Results-----
    bacterial cytoplasm --- Certainty = 0.2584 (Affirmative) <succ>
      bacterial membrane --- Certainty = 0.0000 (Not Clear) <succ>
        bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2419

A DNA sequence (GASx187) was identified in *S. pyogenes* <SEQ ID 7337> which encodes the amino acid sequence <SEQ ID 7338>. Analysis of this protein sequence reveals the following:

```
>GP:AAG05515 GB:AE004640 conserved hypothetical protein [Pseudomonas
aeruginosa]
Identities = 140/442 (31%), Positives = 208/442 (46%), Gaps = 73/442 (16%)
Query:   2  KKYLNQNVYDALIERLHFLENDFPIVYISFSGGKDSGLLLNILLDFRDKYYPDREIG---   58
            K Y + +V+ A + RL  +F +F  V ++FSGGKDS + L + LD         RE+G
Sbjct:   4  KHYQDADVHAATLSRLRLVERNFERVCVAFSGGKDSSVTLQLALDVA------RELGRSP  57

Query:  59  --VFHQDFEAQYSLTTKYVQETFTSLEGRKKVSLYWVCLPMATRTALSSYEMFWYPWDDK  116
              V   D EQY  T +V E       GR V +WVCLP+  R A S  E +W  W+
Sbjct:  58  VDVLFIDLEGQYQATIDHVSEML----GRPDVRPWWVCLPLNLRNASSLEEPYWCCWEPG  113

Query: 117  TEDIWVRPMPSQDYVINLENNSITTYRYKMNQEDLAKQFGRWYKQIHGNQKTVCILGNRA  176
            E  WVRP+P Q   VI+ +       YRY+M  E+     F  W +    + T  ++G R+
Sbjct: 114  AEADWVRPLPKQRGVIS-DPAFFPFYRYRMEFEEFVAGFNAWLAR---EEPTAFLVGIRS  169

Query: 177  SESLHRYSGFINKKYGYQKEC-----------WITKQFKDVWTAS--PLYDWSVEDIWH  222
            ESL+RY    K+    K+C              W +    +  S  P+YDW  ED+W
Sbjct: 170  DESLNRYLAV--KRRSRAKQCAWTPPGGSAPLAWSARDRANPQAVSFFPIYDWRFEDLWR  227

Query: 223  AYYKFSYSYNELYDLFYKAGLKPSQMRVASPFQDYAVDSLNLYRIIDQETWVKLLGRVQG  282
             Y+YN LYD  Y+AG+   SQMR+ P+ D    L+L+ I+  TW K++ RV G
Sbjct: 228  CVADHGYAYNRLYDQMYRAGVPFSQMRICQPYGDDQRKGLDLFHRIEPRTWFKVVRRVAG  287

Query: 283  VNFSNIYGRTKAMGYK-SIALPKGH-SWKSYTQFLLSTLPVRLRNNYVRKFNKSIDFWHK  340
            N+     Y R + +GY+  + LP    +W+ Y+QFLL  ++P   LR   Y R+  + I  +W +
Sbjct: 288  ANYGARYCRQRFLGYRGGLGLPPSFGTWREYSQFLLRSMPPPLRGIYQRRIERFILWWKQ  347

Query: 341  TGGGLAEETINELIEKGYRIARNGISNYTSFKHSRVIFLDQ-IPDDTDDIVTTKDIPSWK  399
                LA             I+ D   IP       +    PSW+
Sbjct: 348  HDYPLA------------------------------IWPDAGIP----ALENRRKQPSWR  373

Query: 400  RMCFCILKNDHICRTMGFGLTR                                       421
            R+    +LK D + R++ FG ++
Sbjct: 374  RIALSLLKQD-MARSLSFGFSQ                                       394
```

Possible site: 61
>>> Seems to have no N-terminal signal sequence
-----Final Results-----
    bacterial cytoplasm --- Certainty = 0.2084 (Affirmative) <succ>
      bacterial membrane --- Certainty = 0.0000 (Not Clear) <succ>
        bacterial outside --- Certainty = 0.0000 (Not Clear) <succ>

No corresponding DNA sequence was identified in *S. agalactiae*.

Based on this analysis, it was predicted that this GAS-specific protein and its epitopes, could be useful antigens for vaccines or diagnostics.

Example 2420

A DNA sequence (GASx188) was identified in *S. pyogenes* <SEQ ID 7339> which encodes the amino acid sequence <SEQ ID 7340>. Analysis of this protein sequence reveals the following:

Possible site: 34
>>> Seems to have no N-terminal signal sequence
-----Final Results-----
    bacterial cytoplasm --- Certainty = 0.2060 (Affirmative) <succ>
      bacterial membrane --- Certainty = 0.0000 (Not Clear) <succ>
        bacterial outside --- Certainty = 0.0000 (Not Clear) <succ>

No corresponding DNA sequence was identified in *S. agalactiae*.

The protein has homology with the following sequences in the GENPEPT database:

Based on this analysis, it was predicted that this GAS-specific protein and its epitopes, could be useful antigens for vaccines or diagnostics.

Example 2421

A DNA sequence (GASx189) was identified in *S. pyogenes* <SEQ ID 7341> which encodes the amino acid sequence <SEQ ID 7342>. Analysis of this protein sequence reveals the following:

```
Possible site: 45
>>> Seems to have no N-terminal signal sequence
----- Final Results -----
    bacterial cytoplasm --- Certainty = 0.4121 (Affirmative) <succ>
      bacterial membrane --- Certainty = 0.0000 (Not Clear) <succ>
        bacterial outside --- Certainty = 0.0000 (Not Clear) <succ>
```

No corresponding DNA sequence was identified in *S. agalactiae*.

The protein has homology with the following sequences in the GENPEPT database:

```
>GP:AAC73702 GB:AE000165 orf, hypothetical protein [Escherichia coli]
Identities = 79/162 (48%), Positives = 110/162 (67%), Gaps = 1/162 (0%)
Query:   7  PVYEIKSIPIEKISPNDYNPNSVAPPEMKLLYDSIKSDGYTMPIVCYYDKEEDRYSIVDG      66
            PV  +  +   ++ PNDYNPN+VAPPE   KLL SI+ DG+T PIV  +   +++    IVDG
Sbjct:  46  PVDCVLWVKNSQLMPNDYNPNNVAPPEKKLLQKSIEIDGFTQPIVVTHT-DKNAMEIVDG    104

Query:  67  FHRYRIMLDYSDIYERESGRLPVSVIDKSLDYRMASTIRHNRARGSHDVDLMSQIVKDLH     126
            FHR+ I    S +  R  G LPV+ ++ + +  R+A+TIRHNRARG H +   MS+IV++L
Sbjct: 105  FHRHEIGKGSSSLKLRLKGYLPVTCLEGTRNQRIAATIRHNRARGRHQITAMSEIVRELS    164

Query: 127  ECGRSDNWIAKHLGMDKDEILRLKQITGLASLFKDHEFNQSW                       168
            + G  DN I K LGMD DE+LRLKQI  GL   LF D  +++++W
Sbjct: 165  QLGWDDNKIGKELGMDSDEVLRLKQINGLQELFADRQYSRAW                       206
```

Based on this analysis, it was predicted that this GAS-specific protein and its epitopes, could be useful antigens for vaccines or diagnostics.

Example 2422

A repeated DNA sequence (GASx192R) was identified in *S. pyogenes* <SEQ ID 7343> which encodes the amino acid sequence <SEQ ID 7344>. Analysis of this protein sequence reveals the following:

```
Possible site: 13
>>> Seems to have no N-terminal signal sequence
----- Final Results -----
    bacterial cytoplasm --- Certainty = 0.4301 (Affirmative) <succ>
      bacterial membrane --- Certainty = 0.0000 (Not Clear) <succ>
        bacterial outside --- Certainty = 0.0000 (Not Clear) <succ>
```

No corresponding DNA sequence was identified in *S. agalactiae*.

The protein has homology with the following sequences in the GENPEPT database:

```
>GP:CAA63509 GB:X92946 transposase [Lactococcus lactis]
Identities = 23/36 (63%), Positives = 28/36 (76%)
Query:   1     MQDKLVTEAFNQAYNREKPKEGVIVHTDQGSQYTGA            36
               MQDKLV + F QA  +E P+ G+IVHTDQGSQYT +
Sbjct: 134     MQDKLVRDCFLQACGKEHPQPGLIVHTDQGSQYTSS           169
```

Based on this analysis, it was predicted that this GAS-specific protein and its epitopes, could be useful antigens for vaccines or diagnostics.

Example 2423

A DNA sequence (GASx194R) was identified in *S. pyogenes* <SEQ ID 7345> which encodes the amino acid sequence <SEQ ID 7346>. Analysis of this protein sequence reveals the following:

```
Possible site: 26
>>> Seems to have an uncleavable N-term signal seq
----- Final Results -----
    bacterial membrane --- Certainty = 0.0000 (NotClear) <succ>
    bacterial outside --- Certainty = 0.0000 (NotClear) <succ>
        bacterial cytoplasm --- Certainty = 0.0000 (NotClear) <succ>
```

No corresponding DNA sequence was identified in *S. agalactiae*.

The protein has homology with the following sequences in the GENPEPT database:

```
>GP:CAA63508 GB:X92946 hypothetical protein [Lactococcus lactis]
Identities = 64/96 (66%), Positives = 78/96 (80%)
Query:   1  MPRKTFDKAFKLSAVYLILEEEQSVKMVSSTLEIHPNSLYQWIQEYEKYGESAFPGHGSA   60
            M R+ FDK FK SAVKLILEE  SVK VS  LE+H NSLY+W+QE E+YGESAFPG+G+A
Sbjct:   1  MARRKFDKQFKNSAVKLILEEGYSVKEVSQELEVHANSLYRWVQEVEEYGESAFPGNGTA   60

Query:  61  LRHAQFETKKLEKEHKLLQEELALLKKFQVFLKPNR                          96
            L +AQ + K LEKE++ LQEEL LLKKF+VFLK ++
Sbjct:  61  LANAQHKIKLLEKENRYLQEELELLKKFRVFLKRSK                          96
```

Based on this analysis, it was predicted that this GAS-specific protein and its epitopes, could be useful antigens for vaccines or diagnostics.

Example 2424

A DNA sequence (GASx195R) was identified in *S. pyogenes* <SEQ ID 7347> which encodes the amino acid sequence <SEQ ID 7348>. Analysis of this protein sequence reveals the following:

```
Possible site: 13
>>> Seems to have a cleavable N-term signal seq.
INTEGRAL    Likelihood = -11.30    Transmembrane 179-195 (173-201)
INTEGRAL    Likelihood =  -8.86    Transmembrane 229-245 (224-254)
INTEGRAL    Likelihood =  -8.39    Transmembrane 289-305 (280-307)
INTEGRAL    Likelihood =  -8.23    Transmembrane 417-433 (410-435)
INTEGRAL    Likelihood =  -5.89    Transmembrane 324-340 (323-349)
INTEGRAL    Likelihood =  -4.73    Transmembrane 260-276 (256-278)
INTEGRAL    Likelihood =  -4.51    Transmembrane 96-112 (91-113)
INTEGRAL    Likelihood =  -4.25    Transmembrane 24-40 (20-43)
INTEGRAL    Likelihood =  -2.44    Transmembrane 344-360 (342-360)
```

-continued

```
----- Final Results -----
    bacterial membrane --- Certainty= 0.5522 (Affirmative) <succ>
    bacterial outside --- Certainty= 0.0000 (Not Clear) <succ>
        bacterial cytoplasm --- Certainty= 0.0000 (Not Clear) <succ>
```

No corresponding DNA sequence was identified in *S. agalactiae*.

The protein has homology with the following sequences in the GENPEPT database:

```
>GP:CAB75191 GB:AL139075 putative integral membrane protein [Campylobacter
jejuni]
Identities = 177/430 (41%), Positives = 274/430 (63%), Gaps = 8/430 (1%)
Query:    5  IIISAIALAIGIGYRTKINIGLLAIAFSYLIATTLMGLSPKELLHFWPTSLFFTIFSVSL    64
             +IIS+I +AI +GY T+ N+G+ A+ F+Y+I    M L+PK+++ FWP S+FF IF+VSL
Sbjct:    6  LIISSIIVAIILGYITRHNVGIFAMIFAYIIGAFFMDLAPKKIIAFWPISIFFVIFAVSL    65

Query:   65  FYNVATTNGTLDVLAQHILYRTRTHPNALYMILYLIATLLSALGAGFFTTMAVCCPLAIT   124
             FYN AT NGTL+ LA H++YR    HP L  ++++++ +++ALGAGF+T +A    PL
Sbjct:   66  FYNFATVNGTLEKLAGHLMYRFANHPYLLPFVIFVVSAIIAALGAGFYTVLAFMAPLTFL   125

Query:  125  LCQKADKHPLIGAQAVNWGASGGANLITSGSGIVFQGLFKQMGWE-EQAFSLGNHIFIVS   183
             LC K    + GA A+N+GA GGAN ITS SGI+F+GL +  G E  +AF+  + IF  +
Sbjct:  126  LCDKIGLSKIAGAMAINYGALGGANFITSQSGIIFRGLMENSGIEANEAFANSSIIFAFT   185

Query:  184  IIYPLIVLLLLSCYIRYSKGRTNSSLT-IDQPPVLSKVQRQTTLLMISSMVLVWLFPLLL   242
             II P++VL        +  ++  + N  ++ I +P      Q+ T +LM    +V+V +FP+L
Sbjct:  186  IILPIVVL----SFFVFNAFKNNIKISVISKPDPFDYKQKTTLILMFMMIVVVLIFPVLN   241

Query:  243  LIFPNIAWIATYRQTFDIGFVSILMVCLALRLKLGKQEAILAKVPWAIIIMLCGMSLLMS   302
             +IFP+  I+ + +  DI  ++++ V +AL LKL  ++ ++A +PW   +IM+CG+ +L+S
Sbjct:  242  IIFPHNETISYFNKKIDIAMIAMIFVAIALFLKLADEKQVVALIPWGTLIMICGVGMLIS   301

Query:  303  LAVKSGLVTLIGHLITTTIPHFWLPLFFCVIAGVMSLFSSTLSVVAPTLFPIIATISAQS   362
             +AV++G + L+    I    ++PL C IA MSLFSSTL VV P LFPI+ +I+A S
Sbjct:  302  IAVEAGAIKLFSDLVENEINVIFIPLIMCAIAAFMSLFSSTLGVVTPALFPIVPSIAASS   361

Query:  363  PHIDIRLLTTATIIGALSTNISPFSSAGSLIQLSLPHIEERSLAFKKQILLGVPISLSLA   422
              +    LL +  ++GA ++  ISPFSS GSLI  S P  +  L FK ++  VPI    A
Sbjct:  362  -GLSEALLFSCIVVGAQASAISPFSSGGSLILGSCPDKYKEKL-FKDLLIKAVPIGFIAA   419

Query:  423  LLTIWILMLL                                                    432
             +L   I+  +
Sbjct:  420  ILATIIMSFI                                                    429
```

Based on this analysis, it was predicted that this GAS-specific protein and its epitopes, could be useful antigens for vaccines or diagnostics.

Example 2425

A DNA sequence (GASx196) was identified in *S. pyogenes* <SEQ ID 7349> which encodes the amino acid sequence <SEQ ID 7350>. Analysis of this protein sequence reveals the following:

```
Possible site: 57
>>> Seems to have no N-terminal signal sequence
----- Final Results -----
    bacterial cytoplasm --- Certainty = 0.0563 (Affirmative) <succ>
        bacterial membrane --- Certainty = 0.0000 (Not Clear) <succ>
          bacterial outside --- Certainty = 0.0000 (Not Clear) <succ>
```

No corresponding DNA sequence was identified in *S. agalactiae*.

The protein has homology with the following sequences in the GENPEPT database:

```
>GP:AAC45128 GB:U65510 nicotinate-nucleotide pyrophosphorylase [Rhodospirillum
rubrum]
Identities = 116/277 (41%), Positives = 170/277 (60%), Gaps = 4/277 (1%)
Query:  17  LTPFQIDDTLKAALREDV-HSEDYSTNAIFDHHGQAKVSLFAKEAGVLAGLTVFQRVFTL    75
            L+PF ID+ ++ AL ED+  + D ++ A       +A      A++ G+LAGL    +  F L
Sbjct:  10  LSPFAIDEAVRRALAEDLGRAGDITSTATIPAATRAHARFVARQPGILAGLGCARSAFAL    69

Query:  76  FDTEVTFQNPHQFKDGDRLTSGDLVLEIIGSVRSLLTCERVALNFLQHLSGIASMTAAYV   135
              D  VTF  P   +DG  + +G  V E+ G+ R++L  ER ALNFL HLSGIA+ T   +
Sbjct:  70  LDDTVTFTTP--LEDGAEIAAGQTVAEVAGAARTILAAERTALNFLGHLSGIATRTRRFG   127

Query: 136  EALGDDRIKVFDTRKTTPNLRLFEKYAVRVGGGYNHRFNLSDAIMLKDNHIAAVGSVQKA   195
             +A+    R ++    TRKTTP LR  EKYAVR GGG NHRF L DA+++KDNHIA  G V  A
Sbjct: 128  DAIAHTRARLTCTRKTTPGLRGLEKYAVRCGGGSNHRFGLDDAVLIKDNHIAVAGGVSAA   187

Query: 196  IAQARAYAPFVKMVEVEVESL-AAAEEAAAAGVDIIMLDNMSLEQIEQAITLIAGRSRIE   254
            +++ARA    +   +E+EV++L   AE  A  G ++++LDNM     + +A+ ++AGR    E
Sbjct: 188  LSRARAGVGHMVRIEIEVDTLEQLAEVLAVGGAEVVLLDNMDAPTLTRAVDMVAGRLVTE   247

Query: 255  CSGNIDMTTISRFRGLAIDYVSSGSLTHSAKSLDFSM                         291
              SG + +  TI+       +DY+S G+LTHS  +LD +
Sbjct: 248  ASGGVSLDTIAALAESGVDYISVGALTHSVTTLDIGL                         284
```

Based on this analysis, it was predicted that this GAS-specific protein and its epitopes, could be useful antigens for vaccines or diagnostics.

Example 2426

A DNA sequence (GASx199) was identified in *S. pyogenes* <SEQ ID 7351> which encodes the amino acid sequence <SEQ ID 7352>. Analysis of this protein sequence reveals the following:

```
Possible site: 25
>>> Seems to have no N-terminal signal sequence
----- Final Results -----
    bacterial cytoplasm --- Certainty = 0.1649 (Affirmative) <succ>
        bacterial membrane --- Certainty = 0.0000 (Not Clear) <succ>
          bacterial outside --- Certainty = 0.0000 (Not Clear) <succ>
```

No corresponding DNA sequence was identified in *S. agalactiae*.

The protein has no significant homology with any sequences in the GENPEPT database.

Example 2427

A DNA sequence (GASx201) was identified in *S. pyogenes* <SEQ ID 7353> which encodes the amino acid sequence <SEQ ID 7354>. Analysis of this protein sequence reveals the following:

```
Possible site: 19
>>> Seems to have an uncleavable N-term signal seq
----- Final Results -----
    bacterial membrane --- Certainty = 0.0000 (Not Clear) <succ>
      bacterial outside --- Certainty = 0.0000 (Not Clear) <succ>
    bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2428

A DNA sequence (GASx203) was identified in *S. pyogenes* <SEQ ID 7355> which encodes the amino acid sequence <SEQ ID 7356>. Analysis of this protein sequence reveals the following:

```
Possible site: 37
>>> Seems to have a cleavable N-term signal seq.
----- Final Results -----
    bacterial outside --- Certainty = 0.3000 (Affirmative) <succ>
      bacterial membrane --- Certainty = 0.0000 (Not Clear) <succ>
     bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2429

A DNA sequence (GASx210) was identified in *S. pyogenes* <SEQ ID 7357> which encodes the amino acid sequence <SEQ ID 7358>. Analysis of this protein sequence reveals the following:

```
Possible site: 29
>>> Seems to have an uncleavable N-term signal seq
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2430

A DNA sequence (GASx211) was identified in *S. pyogenes* <SEQ ID 7359> which encodes the amino acid sequence <SEQ ID 7360>. Analysis of this protein sequence reveals the following:

```
Possible site: 24
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>
```

No corresponding DNA sequence was identified in *S. agalactiae*.

Based on this analysis, it was predicted that this GAS-specific protein and its epitopes, could be useful antigens for vaccines or diagnostics.

Example 2431

A DNA sequence (GASx213) was identified in *S. pyogenes* <SEQ ID 7361> which encodes the amino acid sequence <SEQ ID 7362>. Analysis of this protein sequence reveals the following:

```
Possible site: 14
>>> Seems to have no N-terminal signal sequence
----- Final Results -----
   bacterial cytoplasm --- Certainty = 0.4430 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2432

A DNA sequence (GASx219) was identified in *S. pyogenes* <SEQ ID 7363> which encodes the amino acid sequence <SEQ ID 7364>. Analysis of this protein sequence reveals the following:

```
Possible site: 15
>>> Seems to have an uncleavable N-term signal seq
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2433

A DNA sequence (GASx220) was identified in *S. pyogenes* <SEQ ID 7365> which encodes the amino acid sequence <SEQ ID 7366>. Analysis of this protein sequence reveals the following:

```
Possible site: 24
>>> Seems to have no N-terminal signal sequence
----- Final Results -----
   bacterial cytoplasm --- Certainty = 0.0530 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2434

A DNA sequence (GASx231R) was identified in *S. pyogenes* <SEQ ID 7367> which encodes the amino acid sequence <SEQ ID 7368>. Analysis of this protein sequence reveals the following:

```
Possible site: 30
>>> Seems to have an uncleavable N-term signal seq
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

Example 2435

A DNA sequence (GASx237) was identified in *S. pyogenes* <SEQ ID 7369> which encodes the amino acid sequence <SEQ ID 7370>. Analysis of this protein sequence reveals the following:

```
Possible site: 52
>>> Seems to have no N-terminal signal sequence
----- Final Results -----
    bacterial cytoplasm --- Certainty = 0.4961 (Affirmative) <succ>
    bacterial membrane --- Certainty = 0.0000 (Not Clear) <succ>
    bacterial outside --- Certainty = 0.0000 (Not Clear) < succ>
```

No corresponding DNA sequence was identified in *S. agalactiae*.

The protein has homology with the following sequences in the GENPEPT database:

```
>GP:CAB49143 GB:AJ248283 hypothetical protein [Pyrococcus abyssi]
Identities = 79/229 (34%), Positives = 131/229 (56%), Gaps = 11/229 (4%)
Query:  18  MRFTIDQNMQFPLVEIDLEHGGSVYLQQGSMVYHTENVTLNTKLNGKGSGLGKLVGAIGR      77
            M + I+     F L+E++L   G +V   + G+MVY       V++ TK   G         L+GA+ R
Sbjct:   1  MEYRIEHRPSFSLLEVNLREGEAVQAEAGAMVYMDPTVSIETKARGG------LLGALKR      54

Query:  78  SMVSGESMFITQAMSNGDGKLALAPNTPGQIVALELGEKQYRLNDGAFLALDGSAQYKME     137
            S++ GES F+   +   G G++   AP   PG I++LEL    Y     GAFL          ++
Sbjct:  55  SVLGGESFFMN--VFRGPGRVGFAPGYPGDIISLELNGTLYA-QSGAFLVASEGIDIDVK     111

Query: 138  RQNIGKALFGGQGGLFVMTTEGLGTLLANSFGSIKKITLDGGTMTIDNAHVVAWSRELDY     197
                 GK +FG +G +F++      +G  G +   +S+G+I+KITL  G ++   +D    H+VA++    +D+
Sbjct: 112  FGG-GKTIFGREG-VFLLELKGKGIVFLSSYGAIEKITLRGESVIVDTGHMVAFTEGIDF     169

Query: 198  DIHLENGFMQSIGTGEGVVNTFRGHGEIYIQSLNLEQFAGTLKRYLPTS              246
             I      G    ++ +GEG+V   F   GHG++YIQ+  +L+ F       + +LP S
Sbjct: 170  RIRKIGGLKATLFSGEGLVFEFSGHGDVYIQTRSLDGFLSWILPHLPKS             218
```

Based on this analysis, it was predicted that this GAS-specific protein and its epitopes, could be useful antigens for vaccines or diagnostics.

Example 2436

A DNA sequence (GASx240R) was identified in *S. pyogenes* <SEQ ID 7371> which encodes the amino acid sequence <SEQ ID 7372>. Analysis of this protein sequence reveals the following:

```
Possible site: 35
>>> Seems to have no N-terminal signal sequence
----- Final Results -----
    bacterial cytoplasm --- Certainty = 0.2745 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2437

A DNA sequence (GASx241) was identified in *S. pyogenes* <SEQ ID 7373> which encodes the amino acid sequence <SEQ ID 7374>. Analysis of this protein sequence reveals the following:

```
Possible site: 21
>>> Seems to have an uncleavable N-term signal seq
INTEGRAL    Likelihood = -10.14   Transmembrane 196-212 (187-215)
INTEGRAL    Likelihood = -8.01    Transmembrane 160-176 (156-179)
INTEGRAL    Likelihood = -5.89    Transmembrane 116-132 (110-134)
INTEGRAL    Likelihood = -4.57    Transmembrane 74-90 (73-97)
INTEGRAL    Likelihood = -2.66    Transmembrane 51-67 (50-68)
INTEGRAL    Likelihood = -2.60    Transmembrane 8-24 (7-27)
INTEGRAL    Likelihood = -1.28    Transmembrane 344-360 (344-360)
INTEGRAL    Likelihood = -0.22    Transmembrane 30-46 (30-46)
----- Final Results -----
    bacterial membrane --- Certainty = 0.5055 (Affirmative) <succ>
    bacterial outside --- Certainty = 0.0000 (Not Clear) <succ>
    bacterial cytoplasm --- Certainty = 0.0000 (Not Clear) <succ>
```

No corresponding DNA sequence was identified in *S. agalactiae*.

The protein has homology with the following sequences in the GENPEPT database:

```
>GP:CAC10175 GB:AJ278302 histidine kinase [Streptococcus pneumoniae]
Identities = 136/449 (30%), Positives = 234/449 (51%), Gaps = 26/449 (5%)
Query:   8  FLLLSIIVYYMTKIYIFSFLSDITLP---VWKQLTI-LALALFFNQFPYLS-----PLLI    58
```

```
                 ++LL  +V +   KI IF  +   I+L      ++K       + LA+ F     Y+              +
Sbjct:    5   WILLYTLVTHGLKIVIFFKVDGISLTFERIFKAFLFKILLAVVFGMLGYMVGNVYLSYFM        64

Query:   59   DPL----LFLVVLRQETKQLFSLKALFLAVAPSVLVDLLSRFMGTIVIPYLFLSSGIYLG       114
                +PL      L    ++LR+    K+L       LF  + P +LV+L  R +    V+P  FL  G
Sbjct:   65   EPLYGIGLSFLLLRELPKKLL----LFYGLFPMILVNLFYRGVSYFVLP--FLGQGQVYD       118

Query:  115   HIIFDLLAYLLIFPSFAIINYMIGKDYKMIC-QSGYSKRSHNFYQTLLMFVLVYYVDIFV       173
                     F   L   ++IF    F   + ++     DY      + G    +       T + +++   Y   +
Sbjct:  119   DYSFIWLC-IIIFNFFISLAFLKWLDYDFTSLRKGILDKDFQKSLTQINWIMGAYYLVIQ       177

Query:  174   ILGFTDPFLHFHHSLFVPTPYKLLFLMFILLLVYLLSYFNHSSKEYLKNELRREQQAYMT       233
                 L + +       +      +      T     L+ + ++L    + ++       +    K+ L     L +EQ
Sbjct:  178   NLSYFE----YEQGIQSTTVRHLILVFYLLFFMGIIKKLDTYLKDKLHERLNQEQDLRYR       233

Query:  234   NLEIYGKHLEKLYRDVRAFQSDYLSRIERLGQAIKSESITQIQDIYAQTVHEANDYWDDK       293
                +E  Y  +H+E+LY++VR+F+  DY  + +      L        I+  E  +  QI++IY         + ++++       D
Sbjct:  234   EMERYSRHIEELYKEVRSFRHDYTNLLTSLRLGIEEEDMEQIKEIYDSVLKDSSEKLQDN       293

Query:  294   HYNISKLRKINISSIKSLLSAKIISAEKSGIDLNVEVPDNIKETYIPELDLLLLMSIFCD       353
                   Y++   +L  +          ++KSLL+   K I  A             I           NVEVP+ I+       +    LD  L  ++SI  CD
Sbjct:  294   KYDLGRLVNVRDRALKSLLAGKFIKARDKNIVFNVEVPEEIQVEGVSLLDFLTVVSILCD       353

Query:  354   NAIEAALEAQQPHMSIAYFLLGDYQMFVVTNTTKKK-VDINKIFEEGYSSKGSERGIGLS       412
                NAIEA++EA  QPH+SIA+F    G   +  F++  N+  K++  +DI++IF     G  SSKG   ERG+GL
Sbjct:  354   NAIEASVEACQPHVSIAFFKNGAQETFIIENSIKEEGIDISEIFSFGASSKGEERGVGLY       413

Query:  413   NAQRILKKYPYLSLRTKSFDKEFSQTLTM                                     441
                  +I++   +P    SL T      D    F Q  LT+
Sbjct:  414   TVMKIVESHPNTSLNTTCQDHVFRQVLTV                                     442
```

Based on this analysis, it was predicted that this GAS-specific protein and its epitopes, could be useful antigens for vaccines or diagnostics.

Example 2438

A DNA sequence (GASx242R) was identified in *S. pyogenes* <SEQ ID 7375> which encodes the amino acid sequence <SEQ ID 7376>. Analysis of this protein sequence reveals the following:

---

Possible site: 26
>>> Seems to have no N-terminal signal sequence
----- Final Results -----
   bacterial cytoplasm --- Certainty = 0.4165 (Affirmative) <succ>
     bacterial membrane --- Certainty = 0.0000 (Not Clear) <succ>
       bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2439

A DNA sequence (GASx243) was identified in *S. pyogenes* <SEQ ID 7377> which encodes the amino acid sequence <SEQ ID 7378>. Analysis of this protein sequence reveals the following:

---

Possible site: 26
>>> Seems to have an uncleavable N-term signal seq
INTEGRAL    Likelihood = −11.09   Transmembrane 188-204 (182-208)
INTEGRAL    Likelihood = −7.17    Transmembrane 52-68 (47-69)
INTEGRAL    Likelihood = −4.73    Transmembrane 119-135 (114-142)
INTEGRAL    Likelihood = −4.62    Transmembrane 83-99 (77-107)
INTEGRAL    Likelihood = −1.86    Transmembrane 328-344 (328-345)
INTEGRAL    Likelihood = −1.65    Transmembrane 7-23 (6-23)
INTEGRAL    Likelihood = −0.22    Transmembrane 35-51 (35-51)
----- Final Results -----
   bacterial membrane --- Certainty = 0.5437 (Affirmative) <succ>
     bacterial outside --- Certainty = 0.0000 (Not Clear) <succ>
       bacterial cytoplasm --- Certainty = 0.0000 (Not Clear) <succ>

---

No corresponding DNA sequence was identified in *S. agalactiae*.

The protein has homology with the following sequences in the GENPEPT database:

```
>GP:CAC10175 GB:AJ278302 histidine kinase [Streptococcus pneumoniae]
Identities = 123/438 (28%), Positives = 229/438 (52%), Gaps = 49/438 (11%)
Query:   20   VIFAKVSAIKLSWKRVS-------IIGISFVIANMIFDKVIL---IDQLFFIIVSLL---        66
                VIF KV  I L+++R+            ++ + F +    +    V L    ++ L+ I +S  L
Sbjct:   19   VIFFKVDGISLTFERIFKAFLFKILLAVVFGMLGYMVGNVYLSYFMEPLYGIGLSFLLLR        78

Query:   67   SAPKKKLFEHMFNGFFTILIVELLFRVIGSFFLPAVLGFSIGQINNNLKLLELCYLFVLP       126
                 PKK  L      +F G F  +++V L  +R    F  LP  +       GQ+ ++    +  LC + +
Sbjct:   79   ELPKKLL---LFYGLFPMILVNLFYRGVSYFVLPFL---GQGQVYDDYSFIWLC-IIIFN       131

Query:  127   IFYLFSYIFSIDL---SLIRFISEDKMKKWVFWMNTAMFSYYFFAHFLVTVQSGFLALYF       183
                      F    +++    +D    SL +  I +      +K + +N  M +YY     L                    YF
```

```
                                    -continued
Sbjct: 132  FFISLAFLKWLDYDFTSLRKGILDKDFQKSLTQINWIMGAYYLVIQNLS---------YF   182

Query: 184  QY---------RSILVFIYLAIFIWVIVKLDRFAKDQLSQKLTQAQNERIAYLENYNQSI   234
            +Y         R +++  YL  F+ +I KLD + KD+L ++L Q Q+ R   +E Y++ I
Sbjct: 183  EYEQGIQSTTVRHLILVFYLLFFMGIIKKLDTYLKDKLHERLNQEQDLRYREMERYSRHI   242

Query: 235  EQLYREIRTVKHDSENILISLKDSIDSGDIDLITRVYDTVIQQSATSMMRTNYEISSLDN   294
            E+LY+E+R+ +HD  N+L SL+  I+  D++ I  +YD+V++ S+  +     Y++ L N
Sbjct: 243  EELYKEVRSFRHDYTNLLTSLRLGIEEEDMEQIKEIYDSVLKDSSEKLQDNKYDLGRLVN   302

Query: 295  IKEAVIRSIMNSKLLEAQYLGIELYIEIPDVIDHLPIKLIDLIVLFTGLVDNAIETAKGS   354
            +++  ++S++  K ++A+    I   +E+P+ I     + L+D + + + L DNAIE +  +
Sbjct: 303  VRDRALKSLLAGKFIKARDKNIVFNVEVPEEIQVEGVSLLDFLTVVSILCDNAIEASVEA   362

Query: 355  RRPFLSIAYFKQDNKQLFIIENSTKTNRVDIAKRFDAQQQNSAH--------FLTVLDSY   406
             +P +SIA+FK    ++ FIIENS K    +DI++ F     +              + +++S+
Sbjct: 363  CQPHVSIAFFKNGAQETFIIENSIKEEGIDISEIFSFGASSKGEERGVGLYTVMKIVESH   422

Query: 407  PQITLSTKSDHYRLRQLL                                            424
            P  +L+T    +  RQ+L
Sbjct: 423  PNTSLNTTCQDHVFRQVL                                            440
```

Based on this analysis, it was predicted that this GAS-specific protein and its epitopes, could be useful antigens for vaccines or diagnostics.

Example 2440

A DNA sequence (GASx248) was identified in *S. pyogenes* <SEQ ID 7379> which encodes the amino acid sequence <SEQ ID 7380>. Analysis of this protein sequence reveals the following:

Possible site: 32
>>> Seems to have no N-terminal signal sequence
----- Final Results -----
    bacterial cytoplasm --- Certainty = 0.5665 (Affirmative) <succ>
        bacterial membrane --- Certainty = 0.0000 (Not Clear) <succ>
        bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2441

A DNA sequence (GASx255) was identified in *S. pyogenes* <SEQ ID 7381> which encodes the amino acid sequence <SEQ ID 7382>. Analysis of this protein sequence reveals the following:

Possible site: 19
>>> Seems to have no N-terminal signal sequence
----- Final Results -----
    bacterial cytoplasm --- Certainty = 0.1437 (Affirmative) <succ>
        bacterial membrane --- Certainty = 0.0000 (Not Clear) <succ>
        bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2442

A DNA sequence (GASx270R) was identified in *S. pyogenes* <SEQ ID 7383> which encodes the amino acid sequence <SEQ ID 7384>. Analysis of this protein sequence reveals the following:

Possible site: 21
>>> Seems to have no N-terminal signal sequence
INTEGRAL Likelihood = −5.89 Transmembrane 20-36 (17-36)
----- Final Results -----
    bacterial membrane --- Certainty = 0.3357 (Affirmative) <succ>
        bacterial outside --- Certainty = 0.0000 (Not Clear) <succ>
        bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2443

A DNA sequence (GASx272) was identified in *S. pyogenes* <SEQ ID 7385> which encodes the amino acid sequence <SEQ ID 7386>. Analysis of this protein sequence reveals the following:

Possible site: 58
>>>Seems to have no N-terminal signal sequence
----- Final Results -----
    bacterial cytoplasm --- Certainty = 0.2488 (Affirmative) <succ>
        bacterial membrane --- Certainty = 0.0000 (Not Clear) <succ>
        bacterial outside --- Certainty = 0.0000 (Not Clear) <succ>

No corresponding DNA sequence was identified in *S. agalactiae*.

The protein has homology with the following sequences in the GENPEPT database:

```
>GP:CAB11887 GB:Z99104 ribosomal protein S7 (BS7) [Bacillus subtilis]
Identities = 117/156 (75%), Positives = 139/156 (89%)
Query:   1  MSRKNQAPKREVLPDPLYNSKIVTRLINRVMLDGKRGTAATIVYDAFNAIKEATGNDALE    60
            M RK    KR+VLPDP+YNSK+V+RLIN++M+DGK+G   TI+Y  +F+ IKE TGNDA+E
Sbjct:   1  MPRKGPVAKRDVLPDPIYNSKLVSRLINKMMIDGKKGKPQTILYKSFDIIKERTGNDAME    60

Query:  61  VFETAMDNIMPVLEVRARRVGGSNYQVPVEVRPERRTTLGLRWLVNASRARGEHTMKDRL   120
            VFE A+ NIMPVLEV+ARRVGG+NYQVPVEVRPERRTTLGLRWLVN +R RGE TM++RL
Sbjct:  61  VFEQALKNIMPVLEVKARRVGGANYQVPVEVRPERRTTLGLRWLVNYARLRGEKTMEERL   120

Query: 121  AKEIMDAANNTGASVKKREDTHKMAEANRAFAHFRW                           156
            A EI+DAANNTGA+VKKREDTHKMAEAN+AFAH+RW
Sbjct: 121  ANEILDAANNTGAAVKKREDTHKMAEANKAFAHYRW                           156
```

Based on this analysis, it was predicted that this GAS-specific protein and its epitopes, could be useful antigens for vaccines or diagnostics.

Example 2444

A DNA sequence (GASx274) was identified in *S. pyogenes* <SEQ ID 7387> which encodes the amino acid sequence <SEQ ID 7388>. Analysis of this protein sequence reveals the following:

```
Possible site: 61
>>> Seems to have an uncleavable N-term signal seq
----- Final Results -----
   bacterial membrane --- Certainty = 0.0000 (NotClear) <succ>
      bacterial outside --- Certainty = 0.0000 (NotClear) <succ>
         bacterial cytoplasm --- Certainty = 0.0000 (NotClear) <succ>
```

A related sequence was also identified in GAS <SEQ ID 9095> which encodes the amino acid sequence <SEQ ID 9096>. Analysis of this protein sequence reveals the following:

```
Possible cleavage site: 52
>>> Seems to have no N-terminal signal sequence
----- Final Results -----
   bacterial cytoplasm --- Certainty = 0.291 (Affirmative) <succ>
      bacterialmembrane --- Certainty = 0.000 (Not Clear) <succ>
         bacterialoutside --- Certainty = 0.000 (Not Clear) <succ>
```

No corresponding DNA sequence was identified in *S. agalactiae.*

Based on this analysis, it was predicted that this GAS-specific protein and its epitopes, could be useful antigens for vaccines or diagnostics.

Example 2445

A DNA sequence (GASx275R) was identified in *S. pyogenes* <SEQ ID 7389> which encodes the amino acid sequence <SEQ ID 7390>. Analysis of this protein sequence reveals the following:

```
Possible site: 16
>>> Seems to have no N-terminal signal sequence
----- Final Results -----
   bacterial cytoplasm --- Certainty = 0.5664 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

Example 2446

A DNA sequence (GASx283) was identified in *S. pyogenes* <SEQ ID 7391> which encodes the amino acid sequence <SEQ ID 7392>. Analysis of this protein sequence reveals the following:

```
Possible site: 18
>>> Seems to have no N-terminal signal sequence
----- Final Results -----
   bacterial cytoplasm --- Certainty = 0.0724 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

Example 2447

A DNA sequence (GASx298) was identified in *S. pyogenes* <SEQ ID 7393> which encodes the amino acid sequence <SEQ ID 7394>. Analysis of this protein sequence reveals the following:

```
Possible site: 25
>>> Seems to have no N-terminal signal sequence
----- Final Results -----
   bacterial cytoplasm --- Certainty = 0.2840 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

Example 2448

A DNA sequence (GASx300) was identified in *S. pyogenes* <SEQ ID 7395> which encodes the amino acid sequence <SEQ ID 7396>. Analysis of this protein sequence reveals the following:

```
Possible site: 18
>>> Seems to have an uncleavable N-term signal seq
INTEGRAL    Likelihood = −1.91    Transmembrane 4-20 (4-20)
----- Final Results -----
   bacterial membrane --- Certainty = 0.1765 (Affirmative) <succ>
     bacterial outside --- Certainty = 0.0000 (Not Clear) <succ>
       bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2449

A DNA sequence (GASx301) was identified in *S. pyogenes* <SEQ ID 7397> which encodes the amino acid sequence <SEQ ID 7398>. Analysis of this protein sequence reveals the following:

```
Possible site: 33
>>> Seems to have no N-terminal signal sequence
----- Final Results -----
   bacterial cytoplasm --- Certainty = 0.4884 (Affirmative) <succ>
     bacterial membrane --- Certainty = 0.0000 (Not Clear) <succ>
       bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2450

A repeated DNA sequence (GASx302) was identified in *S. pyogenes* <SEQ ID 7399> which encodes the amino acid sequence <SEQ ID 7400>. Analysis of this protein sequence reveals the following:

```
Possible site: 22
>>> Seems to have no N-terminal signal sequence
----- Final Results -----
   bacterial cytoplasm --- Certainty = 0.2581 (Affirmative) <succ>
     bacterial membrane --- Certainty = 0.0000 (Not Clear) <succ>
       bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2451

A DNA sequence (GASx316) was identified in *S. pyogenes* <SEQ ID 7401> which encodes the amino acid sequence <SEQ ID 7402>. Analysis of this protein sequence reveals the following:

```
Possible site: 18
>>> Seems to have no N-terminal signal sequence
INTEGRAL    Likelihood = −0.80    Transmembrane 23-39 (22-39)
----- Final Results -----
   bacterial membrane --- Certainty = 0.1319 (Affirmative) <succ>
     bacterial outside --- Certainty = 0.0000 (Not Clear) <succ>
       bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2452

A DNA sequence (GASx323R) was identified in *S. pyogenes* <SEQ ID 7403> which encodes the amino acid sequence <SEQ ID 7404>. Analysis of this protein sequence reveals the following:

```
Possible site: 28
>>> Seems to have no N-terminal signal sequence
----- Final Results -----
   bacterial cytoplasm --- Certainty = 0.0005 (Affirmative) <succ>
     bacterial membrane --- Certainty = 0.0000 (Not Clear) <succ>
       bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2453

A DNA sequence (GASx334) was identified in *S. pyogenes* <SEQ ID 7405> which encodes the amino acid sequence <SEQ ID 7406>. Analysis of this protein sequence reveals the following:

```
Possible site:17
>>> Seems to have a cleavable N-term signal seq.
----- Final Results -----
   bacterial outside --- Certainty = 0.3000 (Affirmative) <succ>
     bacterial membrane --- Certainty = 0.0000 (Not Clear) <succ>
       bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2454

A DNA sequence (GASx336) was identified in *S. pyogenes* <SEQ ID 7407> which encodes the amino acid sequence <SEQ ID 7408>. Analysis of this protein sequence reveals the following:

```
Possible site: 31
>>> Seems to have no N-terminal signal sequence
----- Final Results -----
    bacterial cytoplasm --- Certainty = 0.3379 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2455

A DNA sequence (GASx361R) was identified in *S. pyogenes* <SEQ ID 7409> which encodes the amino acid sequence <SEQ ID 7410>. Analysis of this protein sequence reveals the following:

```
Possible site: 22
>>> Seems to have no N-terminal signal sequence
----- Final Results -----
    bacterial cytoplasm --- Certainty = 0.2807 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2456

A DNA sequence (GASx387) was identified in *S. pyogenes* <SEQ ID 7411> which encodes the amino acid sequence <SEQ ID 7412>. Analysis of this protein sequence reveals the following:

```
Possible site: 16
>>> Seems to have no N-terminal signal sequence
----- Final Results -----
    bacterial cytoplasm --- Certainty = 0.2740 (Affirmative) <succ>
```
-continued
```
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2457

A DNA sequence (GASx389) was identified in *S. pyogenes* <SEQ ID 7413> which encodes the amino acid sequence <SEQ ID 7414>. Analysis of this protein sequence reveals the following:

```
Possible site: 21
>>> Seems to have no N-terminal signal sequence
----- Final Results -----
    bacterial cytoplasm --- Certainty = 0.0744 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2458

A DNA sequence (GASx392) was identified in *S. pyogenes* <SEQ ID 7415> which encodes the amino acid sequence <SEQ ID 7416>. Analysis of this protein sequence reveals the following:

```
Possible site: 29
>>> Seems to have no N-terminal signal sequence
----- Final Results -----
    bacterial cytoplasm --- Certainty = 0.2162 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2459

A DNA sequence (GASx393R) was identified in *S. pyogenes* <SEQ ID 7417> which encodes the amino acid sequence <SEQ ID 7418>. Analysis of this protein sequence reveals the following:

```
Possible site: 18
>>> Seems to have no N-terminal signal sequence
----- Final Results -----
    bacterial cytoplasm --- Certainty = 0.2520 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2460

A DNA sequence (GASx395) was identified in *S. pyogenes* <SEQ ID 7419> which encodes the amino acid sequence <SEQ ID 7420>. Analysis of this protein sequence reveals the following:

```
Possible site: 16
>>> Seems to have no N-terminal signal sequence
----- Final Results -----
    bacterial cytoplasm --- Certainty = 0.2590 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2461

A DNA sequence (GASx396) was identified in *S. pyogenes* <SEQ ID 7421> which encodes the amino acid sequence <SEQ ID 7422>. Analysis of this protein sequence reveals the following:

```
Possible site: 41
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>
```

No corresponding DNA sequence was identified in *S. agalactiae*.

The protein has homology with the following sequences in the GENPEPT database:

```
>GP:CAB13373 GB:Z99111 similar to hypothetical proteins [Bacillus subtilis]
Identities = 23/88 (26%), Positives = 52/88 (58%)
Query:   4  KQERIGLVVYLYYNRDARKLSKFGDLYYHSKRSRYLIIYINKNDLDTKLEEMRRLKCVKD   63
            + R G+VVYL+  + ++ L KFG+++Y SKR +Y+++Y + + ++  ++++      VK
Sbjct:   2  ENRRQGMVVYLHSLKQSKMLRKFGNVHYVSKRLKYVVLYCDMDQIEKTMDKIASYSFVKK   61

Query:  64  IRPSAFDDIDRQFVGNLHRDETNNHQKG                                  91
            + PS    + +F   L + +  +++ G
Sbjct:  62  VEPSYKPFLKLEFESKLDKAKEYDYKIG                                  89
```

Based on this analysis, it was predicted that this GAS-specific protein and its epitopes, could be useful antigens for vaccines or diagnostics.

Example 2462

A DNA sequence (GASx400) was identified in *S. pyogenes* <SEQ ID 7423> which encodes the amino acid sequence <SEQ ID 7424>. Analysis of this protein sequence reveals the following:

```
Possible site: 13
>>> Seems to have no N-terminal signal sequence
----- Final Results -----
    bacterial cytoplasm --- Certainty = 0.2010 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2463

A DNA sequence (GASx401) was identified in *S. pyogenes* <SEQ ID 7425> which encodes the amino acid sequence <SEQ ID 7426>. Analysis of this protein sequence reveals the following:

```
Possible site: 17
>>> Seems to have no N-terminal signal sequence
----- Final Results -----
   bacterial cytoplasm --- Certainty = 0.1176 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2464

A DNA sequence (GASx402) was identified in *S. pyogenes* <SEQ ID 7427> which encodes the amino acid sequence <SEQ ID 7428>. Analysis of this protein sequence reveals the following:

```
Possible site: 16
>>> Seems to have no N-terminal signal sequence
----- Final Results -----
   bacterial cytoplasm --- Certainty = 0.2938 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2465

A DNA sequence (GASx403R) was identified in *S. pyogenes* <SEQ ID 7429> which encodes the amino acid sequence <SEQ ID 7430>. Analysis of this protein sequence reveals the following:

```
Possible site: 21
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2466

A DNA sequence (GASx406) was identified in *S. pyogenes* <SEQ ID 7431> which encodes the amino acid sequence <SEQ ID 7432>. Analysis of this protein sequence reveals the following:

```
Possible site: 31
>>> Seems to have an uncleavable N-term signal seq
INTEGRAL    Likelihood = −12.26   Transmembrane 15-31 (4-36)
INTEGRAL    Likelihood = −6.64    Transmembrane 96-112 (94-115)
----- Final Results -----
   bacterial membrane --- Certainty = 0.5904 (Affirmative) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2467

A DNA sequence (GASx408R) was identified in *S. pyogenes* <SEQ ID 7433> which encodes the amino acid sequence <SEQ ID 7434>. Analysis of this protein sequence reveals the following:

```
Possible site: 19
>>> Seems to have no N-terminal signal sequence
INTEGRAL    Likelihood = −2.23    Transmembrane 17-33 (15-34)
INTEGRAL    Likelihood = −0.85    Transmembrane 38-54 (38-54)
----- Final Results -----
   bacterial membrane --- Certainty = 0.1893 (Affirmative) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2468

A DNA sequence (GASx412) was identified in *S. pyogenes* <SEQ ID 7435> which encodes the amino acid sequence <SEQ ID 7436>. Analysis of this protein sequence reveals the following:

```
Possible site: 13
>>> Seems to have an uncleavable N-term signal seq
INTEGRAL    Likelihood = −6.53    Transmembrane 5-21 (4-23)
----- Final Results -----
   bacterial membrane --- Certainty = 0.3612 (Affirmative) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2469

A DNA sequence (GASx413) was identified in *S. pyogenes* <SEQ ID 7437> which encodes the amino acid sequence <SEQ ID 7438>. Analysis of this protein sequence reveals the following:

Possible site: 56
>>> Seems to have no N-terminal signal sequence
----- Final Results -----
   bacterial cytoplasm --- Certainty = 0.3422 (Affirmative) <succ>
   bacterial membrane --- Certainty = 0.0000 (Not Clear) <succ>
   bacterial outside --- Certainty = 0.0000 (Not Clear) <succ>

No corresponding DNA sequence was identified in *S. agalactiae*.

The protein has homology with the following sequences in the GENPEPT database:

```
>GP:CAA68903 GB:Y07622 lactate oxidase [Streptococcus iniae]
Identities = 328/392 (83%), Positives = 359/392 (90%), Gaps = 4/392 (1%)
Query:   3 MAQKTVITEETTDFVMDFKTSSAEGNVDFINVFDLEKMAQQVIPKGAFGYIASGAGDTFT  62
           M K+ +    TT   ++FKTSSAEG+VDF+NVFDLEKMAQ+VIPKGAFGYIASGAGDTFT
Sbjct:   1 MENKSEMINATT---IEFKTSSAEGSVDEVNVFDLEKMAQKVIPKGAFGYIASGAGDTFT  57

Query:  63 LHENIRSENHKLIVPHSLKGVENPSTEITEDGDYLTSPLILAPVAAHKLANEQGEVASAK 122
           LHENIRSFNHKLI PH LKGVENPSTEITF GD L SP+ILAPVAAHKLANEQGE+ASAK
Sbjct:  58 LHENIRSFNHKLI-PHGLKGVENPSTEITFIGDKLASPIILAPVAAHKLANEQGEIASAK 116

Query: 123 GLKEFGSIYTTSSYSTTDLPEISAALGGTPHWFQFYYSKDDGINRNIMDRVKAQGCKAIV 182
           G+KEFG+IYTTSSYSTTDLPEIS  LG +PHWFQFYYSKDDGINR+IMDR+KA+G K+IV
Sbjct: 117 GVKEFGTIYTTSSYSTTDLPEISQTLGDSPHWFQFYYSKDDGINRHIMDRLKAEGVKSIV 176

Query: 183 LTADATVGGNREVDRRNGFVFPVGMPIVQEYLPDGAGKTMDYVYKSAKQALTSKDIEYIA 242
           LT DATVGGNREVD+RNGFVFPVGMPIVQEYLP+GAGKTMDYVYK+ KQAL+ KD+EYIA
Sbjct: 177 LTVDATVGGNREVDKRNGFVFPVGMPIVQEYLPNGAGKTMDYVYKATKQALSPKDVEYIA 236

Query: 243 TYSGLPVYVKGPQCAEDTLRALDAGASGIWVTNHGGRQLDGGPAAFDSLQEVAEAVDQKV 302
            YSGLPVYVKGPQCAED   RAL+AGASGIWVTNHGGRQLDGGPAAFDSLQEVAE+VD++V
Sbjct: 237 QYSGLPVYVKGPQCAEDAFRALEAGASGIWVTNHGGRQLDGGPAAFDSLQEVAESVDRRV 296

Query: 303 PIVFDSGIRRGQHIFKALASGADLVALGRPAIYGLAMGGSIGTRQVFEKLNDELKMVMQL 362
           PIVFDSG+RRGQH+FKALASGADLVALGRP IYGLAMGGS+GTRQVFEK+NDELKMVMQL
Sbjct: 297 PIVFDSGVRRGQHVFKALASGADLVALGRPVIYGLAMGGSVGTRQVFEKINDELKMVMQL 356

Query: 363 AGTQTIQDVKAFNLRHNPYDSSIPFDQNALRL                             394
           AGTQTI DVK F LRHNPYDSSIPF      ++
Sbjct: 357 AGTQTIDDVKHFKLRHNPYDSSIPFSPKCFKI                             388
```

Based on this analysis, it was predicted that this GAS-specific protein and its epitopes, could be useful antigens for vaccines or diagnostics.

Example 2470

A DNA sequence (GASx414) was identified in *S. pyogenes* <SEQ ID 7439> which encodes the amino acid sequence <SEQ ID 7440>. Analysis of this protein sequence reveals the following:

Possible site: 32
>>> Seems to have no N-terminal signal sequence
----- Final Results -----
   bacterial cytoplasm --- Certainty = 0.0682 (Affirmative) <succ>
   bacterial membrane --- Certainty = 0.0000 (Not Clear) <succ>
   bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2471

A DNA sequence (GASx417R) was identified in *S. pyogenes* <SEQ ID 7441> which encodes the amino acid sequence <SEQ ID 7442>. Analysis of this protein sequence reveals the following:

Possible site: 34
>>> Seems to have no N-terminal signal sequence
----- Final Results -----
   bacterial cytoplasm --- Certainty = 0.1765 (Affirmative) <succ>
   bacterial membrane --- Certainty = 0.0000 (Not Clear) <succ>
   bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2472

A DNA sequence (GASx418) was identified in *S. pyogenes* <SEQ ID 7443> which encodes the amino acid sequence <SEQ ID 7444>. Analysis of this protein sequence reveals the following:

Possible site: 32
>>> Seems to have no N-terminal signal sequence
----- Final Results -----
    bacterial cytoplasm --- Certainty = 0.2532 (Affirmative) <succ>
      bacterial membrane --- Certainty = 0.0000 (Not Clear) <succ>
        bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2473

A DNA sequence (GASx419) was identified in *S. pyogenes* <SEQ ID 7445> which encodes the amino acid sequence <SEQ ID 7446>. Analysis of this protein sequence reveals the following:

Possible site: 28
>>> Seems to have no N-terminal signal sequence
----- Final Results -----
    bacterial cytoplasm --- Certainty = 0.3082 (Affirmative) <succ>
      bacterial membrane --- Certainty = 0.0000 (Not Clear) <succ>
        bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2474

A DNA sequence (GASx423) was identified in *S. pyogenes* <SEQ ID 7447> which encodes the amino acid sequence <SEQ ID 7448>. Analysis of this protein sequence reveals the following:

Possible site: 52
>>> Seems to have an uncleavable N-term signal seq
INTEGRAL    Likelihood = −2.18    Transmembrane 14-30 (13-31)
----- Final Results -----
    bacterial membrane --- Certainty = 0.1871 (Affirmative) <succ>
      bacterial outside --- Certainty = 0.0000 (Not Clear) <succ>
        bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2475

A DNA sequence (GASx427R) was identified in *S. pyogenes* <SEQ ID 7449> which encodes the amino acid sequence <SEQ ID 7450>. Analysis of this protein sequence reveals the following:

Possible site: 25
>>> Seems to have an uncleavable N-term signal seq
INTEGRAL    Likelihood = −1.17    Transmembrane 13-29 (10-29)
----- Final Results -----
    bacterial membrane --- Certainty = 0.1468 (Affirmative) <succ>
      bacterial outside --- Certainty = 0.0000 (Not Clear) <succ>
        bacterial cytoplasm --- Certainty = 0.0000 (Not Clear) <succ>

A related sequence was also identified in GAS <SEQ ID 9105> which encodes the amino acid sequence <SEQ ID 9106>. Analysis of this protein sequence reveals the following:

Possible site: 20
>>> Seems to have an uncleavable N-term signal seq
INTEGRAL    Likelihood = −1.17        Transmembrane 8-24
----- Final Results -----
    bacterial membrane --- Certainty = 0.1470 (Affirmative) <succ>
      bacterial outside --- Certainty = 0.0000 (Not Clear) <succ>
        bacterial cytoplasm --- Certainty = 0.0000 (Not Clear) <succ>

No corresponding DNA sequence was identified in *S. agalactiae*.

The protein has homology with the following sequences in the GENPEPT database:

```
>GP:AAA26616 GB:M63917 epidermal cell differentiation inhibitor
[Staphylococcus aureus]
Identities = 58/195 (29%), Positives = 106/195 (53%), Gaps = 13/195 (6%)
Query:  67  RWGKGLI----YPRAEQEAMAAYTCQQAGPINTSLDKAKGELSQLTPELRDQVAQLDAAT  122
            +WG LI     Y   ++ A+  YT + +  IN  L  A G++++L     +D+V +LD++
Sbjct:  49  KWGNKLIKQAKYSSDDKIALYEYT-KDSSKINGPLRLAGGDINKLDSTTQDKVRRLDSSI  107

Query: 123  HRLVIPWNIVVYRYVYETFLRDI-GVSHADLTSYYR--NHQFDPHILCKIK--LGTR-YT  176
            +      P ++ VYR +   +L   I G ++ DL    + N Q+D +++ K+    +R Y
Sbjct: 108  SKSTTPESVYVYRLLNLDYLTSIVGFTNEDLYKLQQTNNGQYDENLVRKLNNVMNSRIYR  167

Query: 177  KHSFMSTTALKNGAMTHRPVEVRICVKKGAKAAFV--EPYSAVPSEVELLFPRGCQLEVV  234
            +   + ST +    A+  RP+E+R+  + KG KAA++      +A    + E+L PRG + V
Sbjct: 168  EDGYSSTQLVSGAAVGGRPIELRLELPKGTKAAYLNSKDLTAYYGQQEVLLPRGTEYAVG  227

Query: 235  GAYVSQDQKKLHIEA                                              249
            +S D+KK+ I A
Sbjct: 228  SVELSNDKKKIIITA                                              242
```

Example 2476

A DNA sequence (GASx428) was identified in *S. pyogenes* <SEQ ID 7451> which encodes the amino acid sequence <SEQ ID 7452>. Analysis of this protein sequence reveals the following:

```
Possible site: 14
>>> Seems to have no N-terminal signal sequence
----- Final Results -----
   bacterial cytoplasm --- Certainty = 0.3817 (Affirmative) <succ>
     bacterial membrane --- Certainty = 0.0000 (Not Clear) <succ>
      bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2477

A DNA sequence (GASx429) was identified in *S. pyogenes* <SEQ ID 7453> which encodes the amino acid sequence <SEQ ID 7454>. Analysis of this protein sequence reveals the following:

```
Possible site: 32
>>> Seems to have a cleavable N-term signal seq.
----- Final Results -----
      bacterial outside --- Certainty = 0.3000 (Affirmative) <succ>
     bacterial membrane --- Certainty = 0.0000 (Not Clear) <succ>
   bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2478

A DNA sequence (GASx431) was identified in *S. pyogenes* <SEQ ID 7455> which encodes the amino acid sequence <SEQ ID 7456>. Analysis of this protein sequence reveals the following:

```
Possible site: 43
>>> Seems to have an uncleavable N-term signal seq
   INTEGRAL   Likelihood = -8.60   Transmembrane 68-84 (66-90)
   INTEGRAL   Likelihood = -6.85   Transmembrane 22-38 (16-42)
   INTEGRAL   Likelihood = -3.29   Transmembrane 44-60 (43-61)
----- Final Results -----
     bacterial membrane --- Certainty = 0.4439 (Affirmative) <succ>
      bacterial outside --- Certainty = 0.0000 (Not Clear) <succ>
   bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2479

A DNA sequence (GASx432R) was identified in *S. pyogenes* <SEQ ID 7457> which encodes the amino acid sequence <SEQ ID 7458>. Analysis of this protein sequence reveals the following:

```
Possible site: 22
>>> Seems to have a cleavable N-term signal seq.
----- Final Results -----
      bacterial outside --- Certainty = 0.3000 (Affirmative) <succ>
     bacterial membrane --- Certainty = 0.0000 (Not Clear) <succ>
   bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2480

A DNA sequence (GASx434) was identified in *S. pyogenes* <SEQ ID 7459> which encodes the amino acid sequence <SEQ ID 7460>. Analysis of this protein sequence reveals the following:

```
Possible site: 24
>>> Seems to have a cleavable N-term signal seq.
----- Final Results -----
      bacterial outside --- Certainty = 0.3000 (Affirmative) <succ>
     bacterial membrane --- Certainty = 0.0000 (Not Clear) <succ>
   bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2481

A DNA sequence (GASx435R) was identified in *S. pyogenes* <SEQ ID 7461> which encodes the amino acid sequence <SEQ ID 7462>. Analysis of this protein sequence reveals the following:

```
Possible site: 25
>>> Seems to have an uncleavable N-term signal seq
   INTEGRAL   Likelihood = −2.50   Transmembrane 4-20 (3-21)
   ----- Final Results -----
      bacterial membrane --- Certainty = 0.1999 (Affirmative) <succ>
      bacterial outside --- Certainty = 0.0000 (Not Clear) <succ>
      bacterial cytoplasm --- Certainty = 0.0000 (Not Clear) <succ>
```

No corresponding DNA sequence was identified in *S. agalactiae*.

The protein has homology with the following sequences in the GENPEPT database:

```
>GP:AAB59092 GB:M97157 pyrogenic exotoxin C [Streptococcus pyogenes]
Identities = 110/229 (48%), Positives = 150/229 (65%), Gaps = 4/229 (1%)
Query:   4   IIKTIILVIIIFHGYGS--VKSDSE-NIKDVKLQLNYAYEIIPVDYTNCNIDYLTTHDFY   60
             IIK + ++ +I       S   +KSDS+ +I +VK  L YAY I P DY +C +++ TTH
Sbjct:   6   IIKIVFIITVILISTISPIIKSDSKKDISNVKSDLLYAYTITPYDYKDCRVNFSTTHTLN   65

Query:  61   IDISSYKKKNFSVDSEVESYITTKFTKNQKVNIFGLPYIFTRYDVYYIYGGVTPSVNSNS  120
             ID   Y+ K++ + SE+    + KF ++ V++FGL YI +   YIYGG+TP+ N N
Sbjct:  66   IDTQKYRGKDYYISSEMSYEASQKFKRDDHVDVFGLFYILNSHTGEYIYGGITPAQN-NK  124

Query: 121   ENSKIVGNLLIDGVQQKTLINPIKIDKPIFTIQEFDFKIRQYLMQTYKIYDPNSPYIKGQ  180
              N K++GNL I G Q+  L N I ++K I T QE DFKIR+YLM  YKIYD  SPY+ G+
Sbjct: 125   VNHKLLGNLFISGESQQNLNNKIILEKDIVTFQEIDFKIRKYLMDNYKIYDATSPYVSGR  184

Query: 181   LEIAINGNKHESFNLYDATSSSTRSDIFKKYKDNKTINMKDFSHFDIYL             229
             +EI     KHE +L+D+ +  TRSDIF KYKDN+ INMK+FSHFDIYL
Sbjct: 185   IEIGTKDGKHEQIDLFDSPNEGTRSDIFAKYKDNRIINMKNFSHFDIYL             233
```

Based on this analysis, it was predicted that this GAS-specific protein and its epitopes, could be useful antigens for vaccines or diagnostics.

Example 2482

A DNA sequence (GASx436R) was identified in *S. pyogenes* <SEQ ID 7463> which encodes the amino acid sequence <SEQ ID 7464>. Analysis of this protein sequence reveals the following:

```
Possible site: 22
>>> Seems to have a cleavable N-term signal seq.
   ----- Final Results -----
      bacterial outside --- Certainty = 0.3000 (Affirmative) <succ>
      bacterial membrane --- Certainty = 0.0000 (Not Clear) <succ>
      bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2483

A DNA sequence (GASx446) was identified in *S. pyogenes* <SEQ ID 7465> which encodes the amino acid sequence <SEQ ID 7466>. Analysis of this protein sequence reveals the following:

```
Possible site: 20
>>> Seems to have a cleavable N-term signal seq.
```

```
   ----- Final Results -----
      bacterial outside --- Certainty = 0.3000 (Affirmative) <succ>
      bacterial membrane --- Certainty = 0.0000 (Not Clear) <succ>
      bacterial cytoplasm --- Certainty = 0.0000 (Not Clear) <succ>
```

No corresponding DNA sequence was identified in *S. agalactiae*.

The protein has no significant homology with any sequences in the GENPEPT database.

Example 2484

A DNA sequence (GASx449) was identified in *S. pyogenes* <SEQ ID 7467> which encodes the amino acid sequence <SEQ ID 7468>. Analysis of this protein sequence reveals the following:

```
Possible site: 15
>>> Seems to have an uncleavable N-term signal seq
   INTEGRAL   Likelihood = −3.82   Transmembrane 3-19 (1-20)
   ----- Final Results -----
      bacterial membrane --- Certainty = 0.2529 (Affirmative) <succ>
      bacterial outside --- Certainty = 0.0000 (Not Clear) <succ>
      bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2485

A DNA sequence (GASx450R) was identified in *S. pyogenes* <SEQ ID 7469> which encodes the amino acid sequence <SEQ ID 7470>. Analysis of this protein sequence reveals the following:

```
Possible site: 30
>>> Seems to have an uncleavable N-term signal seq
INTEGRAL   Likelihood = -1.44   Transmembrane 21-37 (19-37)
----- Final Results -----
   bacterial membrane --- Certainty = 0.1574 (Affirmative) <succ>
   bacterial outside --- Certainty = 0.0000 (Not Clear) <succ>
     bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2486

A DNA sequence (GASx457R) was identified in *S. pyogenes* <SEQ ID 7471> which encodes the amino acid sequence <SEQ ID 7472>. Analysis of this protein sequence reveals the following:

```
Possible site: 19
>>> Seems to have a cleavable N-term signal seq.
INTEGRAL   Likelihood = -15.34   Transmembrane 64-80 (57-86)
INTEGRAL   Likelihood = -13.43   Transmembrane 97-113 (91-116)
INTEGRAL   Likelihood = -5.57    Transmembrane 38-54 (32-56)
----- Final Results -----
   bacterial membrane --- Certainty = 0.7135 (Affirmative) <succ>
   bacterial outside --- Certainty = 0.0000 (Not Clear) <succ>
     bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2487

A DNA sequence (GASx476R) was identified in *S. pyogenes* <SEQ ID 7473> which encodes the amino acid sequence <SEQ ID 7474>. Analysis of this protein sequence reveals the following:

```
Possible site: 31
>>> Seems to have no N-terminal signal sequence
----- Final Results -----
   bacterial cytoplasm --- Certainty = 0.3013 (Affirmative) <succ>
   bacterial membrane --- Certainty = 0.0000 (Not Clear) <succ>
   bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2488

A DNA sequence (GASx477) was identified in *S. pyogenes* <SEQ ID 7475> which encodes the amino acid sequence <SEQ ID 7476>. Analysis of this protein sequence reveals the following:

```
Possible site: 57
>>> Seems to have no N-terminal signal sequence
----- Final Results -----
   bacterial cytoplasm --- Certainty = 0.1022 (Affirmative) <succ>
   bacterial membrane --- Certainty = 0.0000 (Not Clear) <succ>
   bacterial outside --- Certainty = 0.0000 (Not Clear) <succ>
```

No corresponding DNA sequence was identified in *S. agalactiae*.

The protein has homology with the following sequences in the GENPEPT database:

```
>GP:CAC03521 GB:AJ276410 BlpJ protein [Streptococcus pneumoniae]
Identities = 47/77 (61%), Positives = 59/77 (76%)
Query: 1    MIKFAEEIQKEELFHIIGGYSATDCKNHLIGGITSGAIAGGVGAGMATLGVGGVAGAFAG 60
            M+  E+   E L  + GGYS+TDC+N LI G+T+G I GG GAG+ATLGV G+AGAF G
Sbjct: 5    MLSQLEVMDTEMLAKVEGGYSSTDCQNALITGVTTGIITGGTGAGLATLGVAGLAGAFVG 64

Query: 61   AHVGAIAGGLTCVGGML                                         77
            AH+GAI GGLTC+GGM+
Sbjct: 65   AHIGAIGGGLTCLGGMV                                         81
```

Based on this analysis, it was predicted that this GAS-specific protein and its epitopes, could be useful antigens for vaccines or diagnostics.

Example 2489

A DNA sequence (GASx478) was identified in *S. pyogenes* <SEQ ID 7477> which encodes the amino acid sequence <SEQ ID 7478>. Analysis of this protein sequence reveals the following:

Possible site: 45
>>> Seems to have no N-terminal signal sequence
INTEGRAL   Likelihood = −2.07   Transmembrane 42-58 (41-58)
INTEGRAL   Likelihood = −1.59   Transmembrane 22-38 (22-38)
----- Final Results -----
   bacterial membrane --- Certainty = 0.1829 (Affirmative) <succ>
   bacterial outside --- Certainty = 0.0000 (Not Clear) <succ>
   bacterial cytoplasm --- Certainty = 0.0000 (Not Clear) <succ>

No corresponding DNA sequence was identified in *S. agalactiae*.

The protein has homology with the following sequences in the GENPEPT database:

```
>GP:CAC03520 GB:AJ276410 BlpI protein [Streptococcus pneumoniae]
Identities = 35/56 (62%), Positives = 44/56 (78%)
Query: 1   MDNFLELQFEELVNISGGKGNIGSAIGGCLGGMLIAAAGGPITGGAAAFVCVASGI 56
           M+  F   +   EEL  +SGG+GN+GSAIGGC+G  +L+AAA GPITGGAA   +CV SGI
Sbjct: 6   MEQFSVMDNEELEIVSGGRGNLGSAIGGCIGAVLLAAATGPITGGAATLICVGSGI 61
```

Based on this analysis, it was predicted that this GAS-specific protein and its epitopes, could be useful antigens for vaccines or diagnostics.

Example 2490

A DNA sequence (GASx482) was identified in *S. pyogenes* <SEQ ID 7479> which encodes the amino acid sequence <SEQ ID 7480>. Analysis of this protein sequence reveals the following:

Possible site: 14
>>> Seems to have an uncleavable N-term signal seq
INTEGRAL   Likelihood = −0.43   Transmembrane 61-77 (61-79)
----- Final Results -----
   bacterial membrane --- Certainty = 0.1171 (Affirmative) <succ>
   bacterial outside --- Certainty = 0.0000 (Not Clear) <succ>
   bacterial cytoplasm --- Certainty = 0.0000 (Not Clear) <succ>

No corresponding DNA sequence was identified in *S. agalactiae*.

The protein has homology with the following sequences in the GENPEPT database:

```
>GP:CAC03524 GB:AJ7276410 BlpM protein [Streptococcus pneumoniae]
Identities = 22/52 (42%), Positives = 30/52 (57%)
Query: 29  MEIKKLETFHQMTIEKLAKVEGGKNNWQANVSGVIAAGSAGAAIGFPVCGVA       80
           M+ K  +E FH+M I   L+  +EGGKNNWQ NV      A    G +G  +C  +
Sbjct: 1   MDTKIMEQFHEMDITMLSSIEGGKNNWQTNVLEGGGAAFGGWGLGTAICAAS       52
```

Based on this analysis, it was predicted that this GAS-specific protein and its epitopes, could be useful antigens for vaccines or diagnostics.

Example 2491

A DNA sequence (GASx483) was identified in *S. pyogenes* <SEQ ID 7481> which encodes the amino acid sequence <SEQ ID 7482>. Analysis of this protein sequence reveals the following:

Possible site: 58
>>> Seems to have no N-terminal signal sequence

----- Final Results -----
   bacterial cytoplasm --- Certainty = 0.1832 (Affirmative) <succ>
   bacterial membrane --- Certainty = 0.0000 (Not Clear) <succ>
   bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2492

A DNA sequence (GASx484) was identified in *S. pyogenes* <SEQ ID 7483> which encodes the amino acid sequence <SEQ ID 7484>. Analysis of this protein sequence reveals the following:

Possible site: 21
>>> Seems to have a cleavable N-term signal seq.
----- Final Results -----
   bacterial outside --- Certainty = 0.3000 (Affirmative) <succ>
   bacterial membrane --- Certainty = 0.0000 (Not Clear) <succ>
   bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2493

A DNA sequence (GASx485) was identified in *S. pyogenes* <SEQ ID 7485> which encodes the amino acid sequence <SEQ ID 7486>. Analysis of this protein sequence reveals the following:

Possible site: 32
>>> Seems to have no N-terminal signal sequence
----- Final Results -----
   bacterial cytoplasm --- Certainty = 0.1037 (Affirmative) <succ>
   bacterial membrane --- Certainty = 0.0000 (Not Clear) <succ>
   bacterial outside --- Certainty = 0.0000 (Not Clear) <succ>

Example 2494

A DNA sequence (GASx487) was identified in *S. pyogenes* <SEQ ID 7487> which encodes the amino acid sequence <SEQ ID 7488>. Analysis of this protein sequence reveals the following:

```
Possible site: 50
>>> Seems to have no N-terminal signal sequence
----- Final Results -----
    bacterial cytoplasm --- Certainty = 0.1086 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2495

A DNA sequence (GASx488) was identified in *S. pyogenes* <SEQ ID 7489> which encodes the amino acid sequence <SEQ ID 7490>. Analysis of this protein sequence reveals the following:

```
Possible site: 22
>>> Seems to have no N-terminal signal sequence
----- Final Results -----
    bacterial cytoplasm --- Certainty = 0.2176 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2496

A DNA sequence (GASx489R) was identified in *S. pyogenes* <SEQ ID 7491> which encodes the amino acid sequence <SEQ ID 7492>. Analysis of this protein sequence reveals the following:

```
Possible site: 22
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2497

A DNA sequence (GASx490) was identified in *S. pyogenes* <SEQ ID 7493> which encodes the amino acid sequence <SEQ ID 7494>. Analysis of this protein sequence reveals the following:

```
Possible site: 24
>>> Seems to have no N-terminal signal sequence
----- Final Results -----
    bacterial cytoplasm --- Certainty = 0.2547 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2498

A DNA sequence (GASx491R) was identified in *S. pyogenes* <SEQ ID 7495> which encodes the amino acid sequence <SEQ ID 7496>. Analysis of this protein sequence reveals the following:

```
Possible site: 22
>>> Seems to have an uncleavable N-term signal seq
  INTEGRAL   Likelihood = -10.24   Transmembrane 6-22 (3-28)
----- Final Results -----
    bacterial membrane --- Certainty = 0.5097 (Affirmative) <succ>
    bacterial outside --- Certainty = 0.0000 (Not Clear) <succ>
    bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2499

A DNA sequence (GASx492) was identified in *S. pyogenes* <SEQ ID 7497> which encodes the amino acid sequence <SEQ ID 7498>. Analysis of this protein sequence reveals the following:

```
Possible site: 27
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
      bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2500

A DNA sequence (GASx493) was identified in *S. pyogenes* <SEQ ID 7499> which encodes the amino acid sequence <SEQ ID 7500>. Analysis of this protein sequence reveals the following:

```
Possible site: 19
>>> Seems to have no N-terminal signal sequence
  INTEGRAL  Likelihood = -0.69   Transmembrane 21-37 (21-37)
----- Final Results -----
    bacterial membrane --- Certainty = 0.1277 (Affirmative) <succ>
    bacterial outside --- Certainty = 0.0000 (Not Clear) <succ>
      bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2501

A DNA sequence (GASx495R) was identified in *S. pyogenes* <SEQ ID 7501> which encodes the amino acid sequence <SEQ ID 7502>. Analysis of this protein sequence reveals the following:

```
Possible site: 28
>>> Seems to have no N-terminal signal sequence
----- Final Results -----
    bacterial cytoplasm --- Certainty = 0.2891 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2502

A DNA sequence (GASx499R) was identified in *S. pyogenes* <SEQ ID 7503> which encodes the amino acid sequence <SEQ ID 7504>. Analysis of this protein sequence reveals the following:

```
Possible site: 15
>>> Seems to have an uncleavable N-term signal seq
  INTEGRAL  Likelihood = -2.50   Transmembrane 3-19 (1-20)
----- Final Results -----
    bacterial membrane --- Certainty = 0.1999 (Affirmative) <succ>
    bacterial outside --- Certainty = 0.0000 (Not Clear) <succ>
      bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2503

A DNA sequence (GASx500) was identified in *S. pyogenes* <SEQ ID 7505> which encodes the amino acid sequence <SEQ ID 7506>. Analysis of this protein sequence reveals the following:

```
Possible site: 54
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
      bacterial cytoplasm --- Certainty = 0.0000 (Not Clear) <succ>
```

No corresponding DNA sequence was identified in *S. agalactiae*.

The protein has homology with the following sequences in the GENPEPT database:

```
>GP:AAC77220 GB:AE000497 orf, hypothetical protein [Escherichia coli]
Identities = 262/480 (54%), Positives = 338/480 (69%), Gaps = 5/480 (1%)
Query:  18  GMLNRHGLIAGATGTGKTVTLKVLAEQLSLAGVPVFLADIKGDLSNLTKAGEVTDKLAAR    77
            GM NRHGLI GATGTGKTVTL+ LAE LS GVPVF+AD+KGDL+  + +AG V++KL AR
Sbjct:  20  GMANRHGLITGATGTGKTVTLQKLAESLSEIGVPVFMADVKGDLTGVAQAGTVSEKLLAR    79

Query:  78  LATIGVSDYQPQAFPVRMWDVFGQNGQPLRTTISELGPMMLSRLLNLNDTQTGVLNIVFK   137
            L  IGV+D+QP A PV +WD+FG+ G P+R T+S+LGP++L+RLLNLND Q+GVLNI+F+
Sbjct:  80  LKNIGVNDWQPHANPVVVWDIFGEKGHPVRATVSDLGPLLLARLLNLNDVQSGVLNIIFR   139

Query: 138  IADEKGWLLIDLKDLQAILKEVGDHASDYSSHYGNIAKQSIGAIQRSLLTLEQEGAHQFF   197
```

-continued

```
                  IAD++G  LL+D KDL+AI + +GD+A  + +  YGNI+  S+GAIQR LL+LEQ+GA  FF
Sbjct: 140  IADDQGLLLLDFKDLRAITQYIGDNAKSFQNQYGNISSASVGAIQRGLLSLEQQGAAHFF  199

Query: 198  GEPALDVADLMQLDVASGYGAINILSATKLFQSPTLYTTFLLWLLSELYKLLPEVGDLDK  257
            GEP LD+ D M+ D A+G G INILSA KL+Q P LY   LLW+LSELY+ LPE GDL+K
Sbjct: 200  GEPMLDIKDWMRTD-ANGKGVINILSAEKLYQMPKLYAASLLWMLSELYEQLPEAGDLEK  258

Query: 258  PKMVFFFDEAHLLFKDAPKVFLEKVEQIVRLIRSKGVGIFFVTQNPLDLPETVLAQLGNR  317
            PK+VFFFDEAHLLF DAP+V L+K+EQ++RLIRSKGVG++FV+QNP D+P+ VL QLGNR
Sbjct: 259  PKLVFFFDEAHLLFNDAPQVLLDKIEQVIRLIRSKGVGVWFVSQNPSDIPDNVLGQLGNR  318

Query: 318  IQHAFRAYTPKEQKAVRVAADTFRQNPDLDVARVITELEVGEALISVLNDKGQPSIVERA  377
            +QHA RA+TPK+QKAV+ AA T R NP D  + I EL  GEALIS L+ KG PS+VERA
Sbjct: 319  VQHALRAFTPKDQKAVKAAAQTMRANPAFDTEKAIQELGTGEALISFLDAKGSPSVVERA  378

Query: 378  YIMPPKSSFAVLSEIESQQLVQSSPFASKYSQSIDRESAYEKLAAKVLEDNRLAQEAIAT  437
            ++  P S    ++E E   L+  SP    KY    +DRESAYE L   K  + +      Q
Sbjct: 379  MVIAPCSRMGPVTEDERNGLINHSPVYGKYEDEVDRESAYEML-QKGFQASTEQQNNPPA  437

Query: 438  AQREKEAKEAIKAQAATKKANRRSVGRSHKTVVEKATDAFISTTVRTIGRELVRGLLGSL  497
            +E      + I            K   +       + R +  ++VRG+LGSL
Sbjct: 438  KGKEVAVDDGILGGLKDILFGTTGPRGGKK---DGVVQTMAKSAARQVTNQIVRGMLGSL  494
```

Based on this analysis, it was predicted that this GAS-specific protein and its epitopes, could be useful antigens for vaccines or diagnostics.

Example 2504

A DNA sequence (GASx502) was identified in *S. pyogenes* <SEQ ID 7507> which encodes the amino acid sequence <SEQ ID 7508>. Analysis of this protein sequence reveals the following:

Possible site: 49
>>> Seems to have an uncleavable N-term signal seq
INTEGRAL   Likelihood = −13.59   Transmembrane 59-75 (52-77)
INTEGRAL   Likelihood = −9.34    Transmembrane 4-20 (1-24)
----- Final Results -----
   bacterial membrane --- Certainty = 0.6434 (Affirmative) <succ>
      bacterial outside --- Certainty = 0.0000 (Not Clear) <succ>
         bacterial cytoplasm --- Certainty = 0.0000 (Not Clear) <succ>

No corresponding DNA sequence was identified in *S. agalactiae*.

The protein has homology with the following sequences in the GENPEPT database:

```
>GP:CAB15368 GB:Z99121 yvaL [Bacillus subtilis]
Identities = 28/72 (38%), Positives = 44/72 (60%), Gaps = 2/72 (2%)
Query: 1   MYNLLLTILLVLSGLLEIAIFMQPQKNPSSNVFDSSGSEALFERTKARGFEAFMQRFTAV  60
           M+ +L+T+L+++S   L I + +Q  K+    +    S G+E LF + KARG +  + R T V
Sbjct: 1   MHAVLITLLVIVSIALIIVVLLQSSKSAGLSGAISGGAEQLFGKQKARGLDLILHRITVV  60

Query: 61  L--VFFWLAIAL                                                70
           L  +FF L IAL
Sbjct: 61  LAVLFFVLTIAL                                                72
```

Based on this analysis, it was predicted that this GAS-specific protein and its epitopes, could be useful antigens for vaccines or diagnostics.

Example 2505

A DNA sequence (GASx505) was identified in *S. pyogenes* <SEQ ID 7509> which encodes the amino acid sequence <SEQ ID 7510>. Analysis of this protein sequence reveals the following:

Possible site: 45
>>> Seems to have no N-terminal signal sequence
INTEGRAL   Likelihood = −1.44   Transmembrane 140-156 (138-156)
----- Final Results -----
   bacterial membrane --- Certainty = 0.1574 (Affirmative) <succ>
      bacterial outside --- Certainty = 0.0000 (Not Clear) <succ>
         bacterial cytoplasm --- Certainty = 0.0000 (Not Clear) <succ>

No corresponding DNA sequence was identified in *S. agalactiae*.

The protein has homology with the following sequences in the GENPEPT database:

```
>GP:AAF09704 GB:AE001874 glutamine cyclotransferase [Deinococcus radiodurans]
Identities = 81/229 (35%), Positives = 128/229 (55%), Gaps = 10/229 (4%)
Query: 16   YSYDSNLYTQGLEQLNNNHILLSAGRYGFSKVGVYDL--TQEIFSEKIAFP-DTVFAEGL   72
            Y +D  +TQGL+ L   H L S G+ G S + V +L    + ++S  +A      F EG
Sbjct: 54   YPHDRAAFTQGLQYLGGGHYLESTGQVGESDLRVSELRGAKVLWSTPLAQALPQAFGEGS   113

Query: 73   TVVEDYFWLLTYKEGVAYKFDKATCNCLGAYPFEGDGWGLAYDKENQCLWMTSGNAFLQK   132
            T +     + LT+++GVA  +D  T      G + ++G+GWGL   D ++   L M++G + L
Sbjct: 114  TQLGSTVYQLTWQDGVALTYDARTFKETGRHRYQGEGWGLTSDGKS--LIMSNGTSTLVW   171

Query: 133  RDPKDFALLDTVLVAIESVPISMLNELEYVDGYLYANIWQTNTIVKLQPDSGKVVATYDI   192
            RDPK FA   +V V  +   P+  LNELEYV G +YAN+W T+ I ++ P +GKV+    D+
Sbjct: 172  RDPKTFAAQRSVQVTDQGQPVRNLNELEYVQGSVYANVWLTDRIARIHPQTGKVLTWIDV   231

Query: 193  SPLLKALNLDKSHYPDL----NVLNGIAHLDQQ-RFLITGKLYPLMLEV             236
            S L + ++   +             +V NGIA + ++   L+TGK +P + EV
Sbjct: 232  SDLTREVSAAATKQGQALTFDDVPNGIAFIPERGTLLLTGKRWPTLFEV             280
```

Based on this analysis, it was predicted that this GAS-specific protein and its epitopes, could be useful antigens for vaccines or diagnostics.

Example 2506

A DNA sequence (GASx506R) was identified in *S. pyogenes* <SEQ ID 7511> which encodes the amino acid sequence <SEQ ID 7512>. Analysis of this protein sequence reveals the following:

---
Possible site: 33
>>> Seems to have no N-terminal signal sequence
----- Final Results -----
  bacterial cytoplasm --- Certainty = 0.2800 (Affirmative) <succ>
  bacterial membrane --- Certainty = 0.0000 (Not Clear) <succ>
  bacterial outside --- Certainty = 0.0000 (Not Clear) <succ>
---

No corresponding DNA sequence was identified in *S. agalactiae*.

Based on this analysis, it was predicted that this GAS-specific protein and its epitopes, could be useful antigens for vaccines or diagnostics.

Example 2507

A DNA sequence (GASx507R) was identified in *S. pyogenes* <SEQ ID 7513> which encodes the amino acid sequence <SEQ ID 7514>. Analysis of this protein sequence reveals the following:

---
Possible site: 53
>>> Seems to have a cleavable N-term signal seq.
INTEGRAL    Likelihood = −10.51    Transmembrane 103-119 (97-124)
INTEGRAL    Likelihood = −9.13     Transmembrane 126-142 (122-145)
INTEGRAL    Likelihood = −8.65     Transmembrane 290-306 (286-307)
INTEGRAL    Likelihood = −7.17     Transmembrane 200-216 (198-228)
INTEGRAL    Likelihood = −7.06     Transmembrane 58-74 (54-82)
INTEGRAL    Likelihood = −3.19     Transmembrane 223-239 (220-242)
INTEGRAL    Likelihood = −2.81     Transmembrane 244-260 (244-261)
INTEGRAL    Likelihood = −2.71     Transmembrane 174-190 (169-191)
----- Final Results -----
  bacterial membrane --- Certainty = 0.5203 (Affirmative) <succ>
  bacterial outside --- Certainty = 0.0000 (Not Clear) <succ>
  bacterial cytoplasm --- Certainty = 0.0000 (Not Clear) <succ>
---

No corresponding DNA sequence was identified in *S. agalactiae*.

The protein has homology with the following sequences in the GENPEPT database:

```
>GP:CAB56669 GB:AL121596 putative membrane protein [Streptomyces coelicolor A3(2)]
Identities = 119/322 (36%), Positives = 182/322 (55%), Gaps = 24/322 (7%)
Query: 9    LETIYILIGLQLFHTAYCTFKDKTNPVYFGTALFWGLLGVTFV------------GGAFL   56
            +E +Y LIGL    A    D++NP  + +A FWGLLG+TF              GG  L
Sbjct: 4    VEWLYWLIGLVFVVMAVQMAMDRSNPKRWTSAAFWGLLGLTFPYGTGVANATAGNGGWTL   63

Query: 57   PNKVIGFIVIVLALLTLFKQVRIGTLPAFNEQKAEESAHRIGNWIFLPVMLMAMISLLLA   116
            P + +G  V+ L +L F + G       ++ E +A R+GN IF+P + + +++++ A
Sbjct: 64   PAEPLGVAVLALIVLAGFNFLGKGVPVTTTGEQREAAAARLGNKIFVPALTIPLVAIVCA   123

Query: 117  LILPDFSKSAIGIAGILA---------TIAILIITKQKPSALLAENNRMNQQVSTSGILP   167
            +L +        G A +L          + +L+   ++K S   +      M + + ++  +LP
Sbjct: 124  SVLDESGLFETGKATLLGLGLGCVAALVVGMLVTGEKKLSVPIHSGRSMLEAMGSALLLP   183

Query: 168  QLLGALGAIFAAAGVGDVIASLIREIVPADSRFFGVLAYVLGMVIFTMIMGNAFAAFTVI   227
            QLL   LG+IFAAAGVGD +    ++ +++P DS++F  VLAY +GM +FT+IMGNAFAAF V+
Sbjct: 184  QLLAVLGSIFAAAGVGDQVGDIMNKVLPDDSKYFAVLAYCVGMFLFTVIMGNAFAAFPVM   243

Query: 228  TTGIGVPFVFAL--GADPIIAGALAMTAGFCGTLLTPMAANFNALPVALMEIKDRNAVIK   285
            T  IG P +      G +P +   A+ M AGF GTL TPMAANFN +P  L+E+KD+   IK
Sbjct: 244  TAAIGWPVLIQQMHGNEPAVL-AIGMLAGFAGTLCTPMAANFNIVPATLLELKDQYGPIK   302

Query: 286  KQAPIALVLIISHIALMYLLAY                                       307
            +Q P  + L+       +M L A+
Sbjct: 303  AQLPTGIALLGCCTVIMALFAF                                       324
```

Based on this analysis, it was predicted that this GAS-specific protein and its epitopes, could be useful antigens for vaccines or diagnostics.

Example 2508

A DNA sequence (GASx508R) was identified in *S. pyogenes* <SEQ ID 7515> which encodes the amino acid sequence <SEQ ID 7516>. Analysis of this protein sequence reveals the following:

```
Possible site: 61
>>> Seems to have an uncleavable N-term signal seq
INTEGRAL    Likelihood = −12.15   Transmembrane 212-228 (208-235)
INTEGRAL    Likelihood = −8.81    Transmembrane 23-39 (17-64)
INTEGRAL    Likelihood = −7.43    Transmembrane 45-61 (40-64)
INTEGRAL    Likelihood = −1.49    Transmembrane 114-130 (114-130)
INTEGRAL    Likelihood = −1.49    Transmembrane 3-19 (3-20)
INTEGRAL    Likelihood = −1.49    Transmembrane 76-92 (76-92)
----- Final Results -----
    bacterial membrane --- Certainty = 0.5861 (Affirmative) <succ>
        bacterial outside --- Certainty = 0.0000 (Not Clear) <succ>
            bacterial cytoplasm --- Certainty = 0.0000 (Not Clear) <succ>
```

No corresponding DNA sequence was identified in *S. agalactiae*.

The protein has homology with the following sequences in the GENPEPT database:

```
>GP:CAB56670 GB:AL121596 possible integral membrane protein
[Streptomyces coelicolor A3(2)]
Identities = 77/220 (35%), Positives = 138/220 (62%), Gaps = 2/220 (0%)
Query:  23   IKLIGIVIIVLGFILKCDAIATVVVAGLVTALVSGISFIDFLDILGKEFTNQRLLTIFFI  82
             I L+G+V+++LGF+ + + +  V VAG+VT L+  ++ ++ L    G+ F   +R +T++ I
Sbjct:   2   IVLLGVVVVILGFVTRRNPVLVVGVAGIVTGLLGKMNPLEVLAAFGRSFADSRSVTVYAI  61

Query:  83   TLPLIGLSETYGLKHRATQLIQRVQALTVGRLLTLYLIIRELAGLFSIR-LGGHPQFVRP 141
                LP+IGL E YGL+ +A   LI R+   L+ GR LT+YL++R++     F +   +GG  Q VRP
Sbjct:  62   VLPVIGLLERYGLREQARHLIGRLGKLSAGRFLTVYLLVRQVTAAFGLNSIGGPAQTVRP 121

Query: 142   LIQPMGEAAAKANIGEELTDAEKDDIKAMAAANENFGNFFAQNTFVGAGGVLLIAGTLEQ 201
             L+ PM EAAA+ + G +L D   ++ +++ +A+ +    G FF ++ F+  G +LLI G +
Sbjct: 122   LVAPMAEAAAERSTGAKLPDKLREKVRSYSASADTVGVFFGEDCFIAIGSILLITGFVNS 181

Query: 202   LGY-DGNQAKIAFSSILIAIISIIVAIYNYLFEKKMERQ                      240
             + D    ++A   +I  +A+ + +I        L +K++ER+
Sbjct: 182   TYHQDIEPTQLALWAIPLAVCAFLIHGARLLLMDKQLERE                     221
```

Based on this analysis, it was predicted that this GAS-specific protein and its epitopes, could be useful antigens for vaccines or diagnostics.

Example 2509

A DNA sequence (GASx520) was identified in *S. pyogenes* <SEQ ID 7517> which encodes the amino acid sequence <SEQ ID 7518>. Analysis of this protein sequence reveals the following:

```
Possible site: 13
>>> Seems to have no N-terminal signal sequence
----- Final Results -----
    bacterial cytoplasm --- Certainty = 0.2652 (Affirmative) <succ>
        bacterial membrane --- Certainty = 0.0000 (Not Clear) <succ>
            bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2510

A DNA sequence (GASx522R) was identified in *S. pyogenes* <SEQ ID 7519> which encodes the amino acid sequence <SEQ ID 7520>. Analysis of this protein sequence reveals the following:

```
Possible site: 21
>>> Seems to have an uncleavable N-term signal seq
----- Final Results -----
    bacterial membrane --- Certainty = 0.0000 (Not Clear) <succ>
        bacterial outside --- Certainty = 0.0000 (Not Clear) <succ>
            bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2511

A DNA sequence (GASx523) was identified in *S. pyogenes* <SEQ ID 7521> which encodes the amino acid sequence <SEQ ID 7522>. Analysis of this protein sequence reveals the following:

```
Possible site: 22
>>> Seems to have no N-terminal signal sequence
----- Final Results -----
    bacterial cytoplasm --- Certainty = 0.2133 (Affirmative) <succ>
        bacterial membrane --- Certainty = 0.0000 (Not Clear) <succ>
            bacterial outside --- Certainty = 0.0000 (Not Clear) <succ>
```

No corresponding DNA sequence was identified in *S. agalactiae*.

The protein has no significant homology with any sequences in the GENPEPT database.

Example 2512

A DNA sequence (GASx525) was identified in *S. pyogenes* <SEQ ID 7523> which encodes the amino acid sequence <SEQ ID 7524>. Analysis of this protein sequence reveals the following:

---
Possible site: 14
\>>> Seems to have no N-terminal signal sequence
----- Final Results -----
   bacterial cytoplasm --- Certainty = 0.2364 (Affirmative) <succ>
     bacterial membrane --- Certainty = 0.0000 (Not Clear) <succ>
       bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2513

A DNA sequence (GASx535) was identified in *S. pyogenes* <SEQ ID 7525> which encodes the amino acid sequence <SEQ ID 7526>. Analysis of this protein sequence reveals the following:

---
Possible site: 47
\>>> Seems to have no N-terminal signal sequence
----- Final Results -----
   bacterial cytoplasm --- Certainty = 0.4223 (Affirmative) <succ>
     bacterial membrane --- Certainty = 0.0000 (Not Clear) <succ>
       bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2514

A DNA sequence (GASx536) was identified in *S. pyogenes* <SEQ ID 7527> which encodes the amino acid sequence <SEQ ID 7528>. Analysis of this protein sequence reveals the following:

---
Possible site: 59
\>>> Seems to have no N-terminal signal sequence
----- Final Results -----
   bacterial cytoplasm --- Certainty = 0.1102 (Affirmative) <succ>
     bacterial membrane --- Certainty = 0.0000 (Not Clear) <succ>
       bacterial outside --- Certainty = 0.0000 (Not Clear) <succ>

---

No corresponding DNA sequence was identified in *S. agalactiae*.

The protein has homology with the following sequences in the GENPEPT database:

```
>GP:AAB85515 GB:AE000874 conserved protein [Methanobacterium
thermoautotrophicum]
Identities = 82/236 (34%), Positives = 132/236 (55%), Gaps = 11/236(4%)
Query:   9   MNLSIFGLKNIPYLKEGDSIEKLIEESIKTSEFFIEDNDVLCIASKVVSIAEGQVMSLNE  68
             M +S+ G++ +P +  GD I  LI  ++      + D D++ IA  +VS AEG ++SL E
Sbjct:   1   MGISLIGVEGMPLVGAGDDIAYLIISALNEGGEDLLDGDIIVIAETIVSKAEGNIISLEE  60

Query:  69   IQVSDVAKEIHRNIPRKDPRIIEIMLNLVNRDLSRLDIKKNYIGCRLENGLKLTSGGIDR 128
             I+ S  A +I     KDP ++E +L       + +  ++I     +G    + GID
Sbjct:  61   IKPSPEALDIAERTG-KDPSLVEAILG---ESSEIIRVGHDFIVSETRHGFVCANAGIDE 116

Query: 129   KSVDEVFL--LPNNPDASAKRISEYLKKSLGKNVAVVITDSDGREDKRGATQVAIGIYGI 186
              +VD+      LP +PD SA++I   L+++ G+ +AV+I+D+ GR   + GA  VA+G+ G+
Sbjct: 117   SNVDDGLATPLPRDPDGSAEKILRTLQEATGRELAVIISDTQGRPFREGAVGVAVGVAGL 176

Query: 187   HPL--RKTEVIDSQGETIKFQEETLCDMIAACAGLVMGQRGTGIPAVLIRGLDYKW     240
             P+  RK E   D   G +++        + D +AA A  LVMGQ    G+PAV+IRG  Y W
Sbjct: 177   SPIWDRKGE-RDLYGRSLETTRVAVADELAAAASLVMGQADEGVPAVIIRG--YPW     229
```

Based on this analysis, it was predicted that this GAS-specific protein and its epitopes, could be useful antigens for vaccines or diagnostics.

Example 2515

A DNA sequence (GASx537) was identified in *S. pyogenes* <SEQ ID 7529> which encodes the amino acid sequence <SEQ ID 7530>. Analysis of this protein sequence reveals the following:

---
Possible site: 50
\>>> Seems to have no N-terminal signal sequence
INTEGRAL   Likelihood = -1.12   Transmembrane 174-190 (174-190)
----- Final Results -----
   bacterial membrane --- Certainty = 0.1447 (Affirmative) <succ>
     bacterial outside --- Certainty = 0.0000 (Not Clear) <succ>
       bacterial cytoplasm --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2516

A DNA sequence (GASx538) was identified in *S. pyogenes* <SEQ ID 7531> which encodes the amino acid sequence <SEQ ID 7532>. Analysis of this protein sequence reveals the following:

Possible site: 32
>>> Seems to have no N-terminal signal sequence
----- Final Results -----
  bacterial cytoplasm --- Certainty = 0.3852 (Affirmative) <succ>
    bacterial membrane --- Certainty = 0.0000 (Not Clear) <succ>
      bacterial outside --- Certainty = 0.0000 (Not Clear) <succ>

No corresponding DNA sequence was identified in *S. agalactiae*.

The protein has homology with the following sequences in the GENPEPT database:

```
>GP:AAB99212 GB:U67562 conserved hypothetical protein [Methanococcus
jannaschii]
Identities = 129/387 (33%), Positives = 208/387 (53%), Gaps = 44/387 (11%)
Query:  18    EVVERKGLGHPDTLADGIAEQIEIDYSLYCLDKFGVIPHHNFDKIIIRGGHSVQDFGGSD    77
              E+VERKGLGHPD++ DGIAE +        ++KFG I HHN D++ + GGH+   FGG
Sbjct:  20    EIVERKGLGHPDSICDGIAESVSRALCKMYMEKFGTILHHNTDQVELVGGHAYPKFGGGV    79

Query:  78    FIEPIKIIFLGRASKKCFNS------SIPLFKIQKKAATKYLNRILPNLDVENYVEFETL   131
              + PI I+  GRA+ + +         +P+    KAA +YL ++L N+DV+  V   +
Sbjct:  80    MVSPIYILLSGRATMEILDKEKNEVIKLPVGTTAVKAAKEYLKKVLRNVDVDKDVIID--   137

Query: 132    TSDFTTKTNWFSPEAIEDLP-EYLDVPKANDTATMISYWPLTISEELALMIEGYFYKLD-   189
                         +   S + ++     +  +VP ANDT+   + Y PL+ +E L  L  E +      +
Sbjct: 138    -----CRIGQGSMDLVDVFERQKNEVPLANDTSFGVGYAPLSTTERLVLETERFLNSDEL   192

Query: 190    KNELPTPRFTKMGGDIKVMVVRNDLEYSIRINFPLISKFFNNDIESQLYVDKHVEKIKKY   249
              KNE+P        +G DIKVM +R  + ++ I   ++ ++  N IE     V    +EK++K
Sbjct: 193    KNEIPA-----VGEDIKVMGLREGKKITLTIAMAVVDRYVKN-IEEYKEV---IEKVRKK   243

Query: 250    IEQKYKNIS--FSIDYH-----------YYLTTTGSCIDFGEEGAVGRGNKTHGIISSFR   296
              +E   K I+  + ++ H                YLT TG+  + G++G+VGRGN+ +G+I+ FR
Sbjct: 244    VEDLAKKIADGYEVEIHINTADDYERESVYLTVTGTSAEMGDDGSVGRGNRVNGLITPFR   303

Query: 297    PNTMEAPAGKNCTYFVGKVWGFLSDTIAKEIYEAFNT-PCQIIMQLNIGSKLYRPTHLFI   355
              P +MEA +GKN      VGK++  L++ IA +I  +         C + +    IG  +  P L I
Sbjct: 304    PMSMEAASGKNPVNHVGKIYNILANLIANDIAKLEGVKECYVRILSQIGKPINEPKALDI   363

Query: 356    Q--TEESVD----QERVLEIVNRHLNN                                   376
              +   TE+S D    + + EI N+ L+N
Sbjct: 364    EIITEDSYDIKDIEPKAKEIANKWLDN                                   390
```

Based on this analysis, it was predicted that this GAS-specific protein and its epitopes, could be useful antigens for vaccines or diagnostics.

Example 2517

A DNA sequence (GASx539) was identified in *S. pyogenes* <SEQ ID 7533> which encodes the amino acid sequence <SEQ ID 7534>. Analysis of this protein sequence reveals the following:

Possible site: 17
>>> Seems to have no N-terminal signal sequence
----- Final Results -----
  bacterial cytoplasm --- Certainty = 0.1436 (Affirmative) <succ>
    bacterial membrane --- Certainty = 0.0000 (Not Clear) <succ>
      bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2518

A DNA sequence (GASx540) was identified in *S. pyogenes* <SEQ ID 7535> which encodes the amino acid sequence <SEQ ID 7536>. Analysis of this protein sequence reveals the following:

Possible site: 45
>>> Seems to have no N-terminal signal sequence
----- Final Results -----
  bacterial cytoplasm --- Certainty = 0.3956 (Affirmative) <succ>
    bacterial membrane --- Certainty = 0.0000 (Not Clear) <succ>
      bacterial outside --- Certainty = 0.0000 (Not Clear) <succ>

No corresponding DNA sequence was identified in *S. agalactiae*.

The protein has homology with the following sequences in the GENPEPT database:

```
>GP:AAD36304 GB:AE001779 conserved hypothetical protein [Thermotoga maritima]
Identities = 105/353 (29%), Positives = 173/353 (48%), Gaps = 46/353 (13%)
Query:   3  VIGIPTLNEADNISRLVKQIDEYAVNL-GKEIIINSDSKSTDGTPQIFLETKTYNT-KV   60
            V+GIP+ N A+ IS + +   + V+    + +I+NSD  S DGT + F+ET T+   K
Sbjct: 106  VVGIPSYNNAETISHVARTAAQGIVDFFDGDGMIVNSDGGSADGTRERFMETDTFGLPKE 165

Query:  61  SIVSEA-KGKGYNVRNIFEYAINHVPNFSGLILIDGDVVSMKKMWLEKMFIAIESGN-DL  118
            S V E   GKG +R I E+A+    +  ++ +D D+ S+K  W+E++    +  G  D
Sbjct: 166  SFVYEGLPGKGSAMRAIMEFALKQ--DAEAVVFLDADLRSVKPWWVERLAGPVLKGEADY 223

Query: 119  IIPNYARKSFEGNATNHFIYPMLVKIFKRDMPYQCISGDFGFSRGLIKDLTLKCN--WHK  176
            + P Y R  F+G  TN+  +PM   ++ + +  Q I GDFG  R L++     K   W+
Sbjct: 224  VTPFYLRHRFDGTITNNVCFPMTAVLYGKKVR-QPIGGDFGVGRKLLEIYLGKPKEIWNT 282

Query: 177  YTLGYGIDIFLTLTAILKSYIKEIDLQSKIH--KKSFEKIEKIFLEVSQSFFETINDNS  234
                +GIDI++T TAI +S ++ +    L +K+H K    + ++FL+V   + FE  +
Sbjct: 283  DVARFGIDIWMTTTAINESGRVVQAALGTKVHDVKDPGKHLKGMFLQVVGTLFELV---- 338

Query: 235  LNQDKLRLNINFESHSRQFIKSSDI------------LSSNDIENLKLRALFLLQEEKQY  282
                I  +E+  ++    K D+                S DI NLK   A    L+E +
Sbjct: 339  ---------ITYENVWKEIWKIEDVPIYGETPQEEVPSMSIDIGNLKKLARETLEEVEYI 389

Query: 283  LHG-LSEVEWDGI--LSNTINNIYRYSSEEHSL-------YLLPLYLLRVYNY        325
              G LSEV+  G   LS+ ++ +YR + +           LLP Y  R    +
Sbjct: 390  DRGILSEVKESGTLSLSSWVDTLYRSAVQYRKTRDKKVVENLLPFYFARTARF        442
```

Based on this analysis, it was predicted that this GAS-specific protein and its epitopes, could be useful antigens for vaccines or diagnostics.

Example 2519

A DNA sequence (GASx542) was identified in *S. pyogenes* <SEQ ID 7537> which encodes the amino acid sequence <SEQ ID 7538>. Analysis of this protein sequence reveals the following:

Possible site: 20
>>> Seems to have an uncleavable N-term signal seg

-continued

INTEGRAL Likelihood = −5.31 Transmembrane 3-19 (1-21)
----- Final Results -----
bacterial membrane --- Certainty = 0.3123 (Affirmative) <succ>
bacterial outside --- Certainty = 0.0000 (Not Clear) <succ>
bacterial cytoplasm --- Certainty = 0.0000 (Not Clear) <succ>

No corresponding DNA sequence was identified in *S. agalactiae.*

The protein has homology with the following sequences in the GENPEPT database:

```
>GP:BAB07427 GB:AP001519 nucleotide sugar dehydrogenase [Bacillus halodurans]

Identities = 184/388 (47%), Positives = 274/388 (70%), Gaps = 3/388 (0%)

Query: 1    MKITVVGIGYVGLSIGLLLAKEHDVTFFDIDNKKIDLINKRQSPLKEAAINKLLC-KAKN   59
            M IT+ G GYVGLS  +LLA+ +DV  +DI  +K+D+IN R+SP+ +  I + L  K  N
Sbjct: 1    MNITIAGTGYVGLSNAVLLAQHNDVIAYDIVQEKVDMINNRKSPIVDREIEEFLATKELN   60

Query: 60   INATSSEELAYKDATFIILSLPTNL--KFNKLDTSIIEISVSNILKINKKATIVIKSTVP  117
            + AT+ +E A+KDA F+++S PTN   + N  DTS +E  +S++L IN  A +VIKST+P
Sbjct: 61   LTATTDKEKAFKDAQFVVISTPTNYDPEKNYFDTSSVEAVISDVLSINPNAVMVIKSTIP  120

Query: 118  IGFTEYLRNRFHYNDIIFSPEFLREGSTIHDQLYPSRTIVGNESRNSQLFLDILTDISVE  177
            +G+T   +  RF+  +IIFSPEFLREGS ++D L+PSR +VG  ++ +++F  +L   +++
Sbjct: 121  VGYTREVNERFNTKNIIFSPEFLREGSALYDNLHPSRIVVGERTQRAKIFAALLVQGAIK  180

Query: 178  KDSPSLLVGSSEAEAIKLFSNAYLAQKIAFFNELDTFAEMQNLDSKKIIEAMGYDQRIGN  237
            ++   L   S+EAEAIKLF+N YLA ++AFFNELD++AE++ LD+K+II+ +G D RIG
Sbjct: 181  ENIDVLFTDSTEAEAIKLFANTYLAMRVAFFNELDSYAELKGLDAKQIIDGVGLDPRIGT  240

Query: 238  SHNNPSFGFGGYCLPKDIKQLEYHFKEIPAPIITSISESNLLRKIHIAKMILNSSAKTIG  297
             +NNPSFG+GGYCLPKD KQL  +F+++P  II +I ++N  RK H+A MIL    K +G
Sbjct: 241  HYNNPSFGYGGYCLPKDTKQLLANFEDVPNNIIGAIVDANDTRKDHVANMILKREPKVVG  300

Query: 298  IYRINSKKDSDNCRESSTIDVAKLLKSSGKDVIIFEPLINQKKFLGCPLSNDFNEFIKYS  357
            IYR+   K  SDN R+S+ +DV   L ++G +V+++EP ++   +F G  +  DF EF K S
Sbjct: 301  IYRLTMKTGSDNFRQSAILDVMTRLNNAGAEVVVYEPALDATEFDGSKVIEDFAEFKKMS  360

Query: 358  DIIVANRIDDALRKCNSKVFTRDIFQYD                                 385
            D+IVANR+ D L++   KV+TRD++  D
Sbjct: 361  DVIVANRLSDDLKEVAEKVYTRDLYTRD                                 388
```

Example 2520

A DNA sequence (GASx544R) was identified in *S. pyogenes* <SEQ ID 7539> which encodes the amino acid sequence <SEQ ID 7540>. Analysis of this protein sequence reveals the following:

Possible site: 34
>>> Seems to have no N-terminal signal sequence
INTEGRAL    Likelihood = –0.06    Transmembrane 46-62 (46-62)
----- Final Results -----
    bacterial membrane --- Certainty = 0.1022 (Affirmative) <succ>
        bacterial outside --- Certainty = 0.0000 (Not Clear) <succ>
            bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2521

A DNA sequence (GASx545R) was identified in *S. pyogenes* <SEQ ID 7541> which encodes the amino acid sequence <SEQ ID 7542>. Analysis of this protein sequence reveals the following:

Possible site: 58
>>> Seems to have no N-terminal signal sequence
INTEGRAL    Likelihood = –1.49    Transmembrane 186-202 (186-203)
----- Final Results -----
    bacterial membrane --- Certainty = 0.1595 (Affirmative) <succ>
        bacterial outside --- Certainty = 0.0000 (Not Clear) <succ>
            bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2522

A DNA sequence (GASx546R) was identified in *S. pyogenes* <SEQ ID 7543> which encodes the amino acid sequence <SEQ ID 7544>. Analysis of this protein sequence reveals the following:

Possible site: 47
>>> Seems to have no N-terminal signal sequence
----- Final Results -----
    bacterial cytoplasm --- Certainty = 0.2422 (Affirmative) <succ>
        bacterial membrane --- Certainty = 0.0000 (Not Clear) <succ>
            bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2523

A DNA sequence (GASx547R) was identified in *S. pyogenes* <SEQ ID 7545> which encodes the amino acid sequence <SEQ ID 7546>. Analysis of this protein sequence reveals the following:

Possible site: 60
>>> Seems to have no N-terminal signal sequence
----- Final Results -----
    bacterial cytoplasm --- Certainty = 0.1612 (Affirmative) <succ>
        bacterial membrane --- Certainty = 0.0000 (Not Clear) <succ>
            bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2524

A DNA sequence (GASx548) was identified in *S. pyogenes* <SEQ ID 7547> which encodes the amino acid sequence <SEQ ID 7548>. Analysis of this protein sequence reveals the following:

Possible site: 44
>>> Seems to have no N-terminal signal sequence
----- Final Results -----
    bacterial cytoplasm --- Certainty = 0.5156 (Affirmative) <succ>
        bacterial membrane --- Certainty = 0.0000 (Not Clear) <succ>
            bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2525

A DNA sequence (GASx549R) was identified in *S. pyogenes* <SEQ ID 7549> which encodes the amino acid sequence <SEQ ID 7550>. Analysis of this protein sequence reveals the following:

Possible site: 21
>>> Seems to have a cleavable N-term signal seq.
----- Final Results -----
    bacterial outside --- Certainty = 0.3000 (Affirmative) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2526

A DNA sequence (GASx552) was identified in *S. pyogenes* <SEQ ID 7551> which encodes the amino acid sequence <SEQ ID 7552>. Analysis of this protein sequence reveals the following:

Possible site: 15
>>> Seems to have no N-terminal signal sequence
INTEGRAL    Likelihood = −0.59    Transmembrane 83-99 (83-99)
----- Final Results -----
  bacterial membrane --- Certainty = 0.1235 (Affirmative) <succ>
    bacterial outside --- Certainty = 0.0000 (Not Clear) <succ>
      bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2527

A DNA sequence (GASx553) was identified in *S. pyogenes* <SEQ ID 7553> which encodes the amino acid sequence <SEQ ID 7554>. Analysis of this protein sequence reveals the following:

Possible site: 49
>>> Seems to have no N-terminal signal sequence
----- Final Results -----
  bacterial cytoplasm --- Certainty = 0.2781 (Affirmative) <succ>
    bacterial membrane --- Certainty = 0.0000 (Not Clear) <succ>
      bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2528

A DNA sequence (GASx554) was identified in *S. pyogenes* <SEQ ID 7555> which encodes the amino acid sequence <SEQ ID 7556>. Analysis of this protein sequence reveals the following:

Possible site: 18
>>> Seems to have no N-terminal signal sequence
----- Final Results -----
  bacterial cytoplasm --- Certainty = 0.2792 (Affirmative) <succ>
    bacterial membrane --- Certainty = 0.0000 (Not Clear) <succ>
      bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2529

A DNA sequence (GASx555) was identified in *S. pyogenes* <SEQ ID 7557> which encodes the amino acid sequence <SEQ ID 7558>. Analysis of this protein sequence reveals the following:

Possible site: 35
>>> Seems to have no N-terminal signal sequence
INTEGRAL Likelihood = −0.00 Transmembrane 49-65 (49-65)
----- Final Results -----
  bacterial membrane --- Certainty = 0.1001 (Affirmative) <succ>
    bacterial outside --- Certainty = 0.0000 (Not Clear) <succ>
      bacterial cytoplasm --- Certainty = 0.0000 (Not Clear) <succ>

No corresponding DNA sequence was identified in *S. agalactiae*.

The protein has homology with the following sequences in the GENPEPT database:

```
>GP:BAA36631 GB:AB016282 ORF25 [bacteriophage phi-105]
Identities = 43/118 (36%), Positives = 69/118(58%), Gaps = 2/118 (1%)
Query:  3  LLDLIGRKRARDKPQNSYEGQDFSYLFG--RTTSGENVDEFKTMQTTAVYACVRVLAEAV  60
           LL+ +  KR+             +FG  +T SGE V E  ++    ++ACV VL++ +
Sbjct:  2  LLERMFEKRSGSSDHEDGFNNILLNMFGGRKTASGERVSESNSLVQPDIFACVNVLSDDI  61

Query: 61  ASLPIHIYERTENGKEKKLDHPLYFLLHDEPNPEMSSFIFRETIMSHLLIWGNAYVQI   118
           A LPIH Y+RT+ G E+K +H     ++   PNP M++F +++ +M+H+L WGNAY  I
Sbjct: 62  AKLPIHTYKRTDGGIERKPEHKSAHAVYARPNPYMTAFTWKKLMMTHVLTWGNAYSYI   119
```

Based on this analysis, it was predicted that this GAS-specific protein and its epitopes, could be useful antigens for vaccines or diagnostics.

Example 2530

A DNA sequence (GASx556) was identified in *S. pyogenes* <SEQ ID 7559> which encodes the amino acid sequence <SEQ ID 7560>. Analysis of this protein sequence reveals the following:

```
Possible site: 43
>>> Seems to have no N-terminal signal sequence
----- Final Results -----
   bacterial cytoplasm --- Certainty = 0.2055 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2531

A DNA sequence (GASx557) was identified in *S. pyogenes* <SEQ ID 7561> which encodes the amino acid sequence <SEQ ID 7562>. Analysis of this protein sequence reveals the following:

```
Possible site: 50
>>> Seems to have no N-terminal signal sequence
----- Final Results -----
   bacterial cytoplasm --- Certainty = 0.1696 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2532

A DNA sequence (GASx559) was identified in *S. pyogenes* <SEQ ID 7563> which encodes the amino acid sequence <SEQ ID 7564>. Analysis of this protein sequence reveals the following:

```
Possible site: 51
>>> Seems to have no N-terminal signal sequence
----- Final Results -----
   bacterial cytoplasm --- Certainty = 0.1556 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has homology with the following sequences in the GENPEPT database:

```
>GP:CAB15798 GB:Z99123 alternate gene name: ipa-83d [Bacillus subtilis]
Identities = 70/263 (26%), Positives = 121/263 (45%), Gaps = 25/263 (9%)
Query:  68  KTIEQIKELK--YSIDAVACWDEALTHIADDISKELGLNPISSLDSQSFRFKDRMRMVCE125
            + +EQI ++   +   DA+   +E           + LGL       +++ R  K++MR
Sbjct:  87  EVVEQIVKVAEMFGADAITTNNELFIAPMAKACERLGLRGAGVQAAENARDKNKMRDAFN146

Query: 126  AGGLKMPKYKIINQFSDTNKIINW-KYPLIVKPTSFLASIGVKKVYNFSELQQAVSQMLN184
              G+K  K K +   D    +    PLI+KPT   +SIGV + +    +   +++ +
Sbjct: 147  KAGVKSIKNKRVTTLEDFRAALEEIGTPLILKPTYLASSIGVTLITDTETAEDEFNRVND206

Query: 185  VKFPVYIASGVYELGELYNLEPRVLVEEFIDGE-----------EY-SLESVVRNGIYTP232
             + +     V          E    + EEF+ GE                +Y S+E ++ +G Y P
Sbjct: 207  YLKSINVPKAV-------TFEAPFIAEEFLQGEYGDWYQTEGYSDYISIEGIMADGEYFP259

Query: 233  LGITKKIVDEKLFMDEIGHIFPSNLNKEEKSRVYSWAEKLHQILQLNHITTHTEFRIGRN292
             + I   K     ++     E    HI PS L++E  K ++     A+K ++ L L +    THTE ++ +N
Sbjct: 260  IAIHDKT--PQIGFTETSHITPSILDEEAKKKIVEAAKKANEGLGLQNCATHTEIKLMKN317

Query: 293  GDIILIEIGARIGG-DCIPNLMK                                      314
             +  LIE   AR   G + IPN+ K
Sbjct: 318  REPGLIESAARFAGWNMIPNIKK                                      340
```

Based on this analysis, it was predicted that this GAS-specific protein and its epitopes, could be useful antigens for vaccines or diagnostics.

Example 2533

A DNA sequence (GASx561) was identified in *S. pyogenes* <SEQ ID 7565> which encodes the amino acid sequence <SEQ ID 7566>. Analysis of this protein sequence reveals the following:

```
Possible site: 55
>>> Seems to have no N-terminal signal sequence
----- Final Results -----
   bacterial cytoplasm --- Certainty = 0.2602 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2534

A DNA sequence (GASx562) was identified in *S. pyogenes* <SEQ ID 7567> which encodes the amino acid sequence <SEQ ID 7568>. Analysis of this protein sequence reveals the following:

---

Possible site: 34
>>> Seems to have no N-terminal signal sequence
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>

---

No corresponding DNA sequence was identified in *S. agalactiae*.

The protein has homology with the following sequences in the GENPEPT database:

```
>GP:AAD06696 GB:AE001539 HISTIDYL-TRNA SYNTHETASE
[Helicobacter pylori J99]
Identities = 75/309 (24%), Positives = 129/309 (41%), Gaps = 35/309 (11%)
Query:  11 KGYRRQFNQILLGAWGIESAYVDAEIIVATWRGLQRFKGIKVE--FIQLSNKNIFDVLEK     68
           KG  R+F Q     G ES   DAEII      L    K + +E   + ++++ I + + +
Sbjct: 115 KGRYREFTQCDFDFIGSESLVCDAEIIQVIIASL---KALDLEDFCVSINHRKILNGICE    171

Query:  69 DLSKKLRFEDISIEAILGKYLCNNDIEIIKCLYEKDKINMELLISLISKISNKLVKQEFI    128
                E + I   L K   N   E +K   + D   ++ L+ ++    N L    EF
Sbjct: 172 YFGIAQVNEVLRIVDKLEKIGLNGVEEELKKECDLSNTIKDLLEMVQIKQNDLSHAEFF    231

Query: 129 -KVLVLYEYVKNFLP----VDCIYFSLS------NLY--------GTGHYSSMNYKIFIR    169
            K+  L +Y +N         ++ +Y  L       NLY          G G+Y+ +  Y+  +
Sbjct: 232 EKIAYLKDYNENLKKGIQDLERLYQLLGDLQISQNLYKIDFSIARGLGYYTGIVYETTLN    291

Query: 170 TKSGDIFDIADGGRIDDMVSKFNKVNVLGVCMGIGTTVLSQEI-------EYEIEDRIMI    222
           +   + GGR D +   F+K N+ GV   IG   L   +         E   + +++I
Sbjct: 292 DMKS-LGSVCSGGRYDHLTKNFSKENLQGVGASIGIDRLIVALSEMQLLDERSTQAKVLI    350

Query: 223 LVEKIDVKIYKNCLELANKLSGYHCSVFEFPYKKIKKFFKHELYSRHHYIIVRLDGSMEY    282
                + Y N L + + SG    V+    +KIKK F +  + H ++ V    G  E+
Sbjct: 351 ACMHEEYFSYANRLAESLRQSGIFSEVYP-EAQKIKKPFSYANHKGHEFVAV--IGEEEF    407

Query: 283 RFSSVALKN                                                     291
           +  +++LKN
Sbjct: 408 KSETLSLKN                                                     416
```

Based on this analysis, it was predicted that this GAS-specific protein and its epitopes, could be useful antigens for vaccines or diagnostics.

Example 2535

A DNA sequence (GASx564) was identified in *S. pyogenes* <SEQ ID 7569> which encodes the amino acid sequence <SEQ ID 7570>. Analysis of this protein sequence reveals the following:

---

Possible site: 56
>>> Seems to have no N-terminal signal sequence
----- Final Results -----
    bacterial cytoplasm --- Certainty = 0.1264 (Affirmative) <succ>
    bacterial membrane --- Certainty = 0.0000 (Not Clear) <succ>
    bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2536

A DNA sequence (GASx576) was identified in *S. pyogenes* <SEQ ID 7571> which encodes the amino acid sequence <SEQ ID 7572>. Analysis of this protein sequence reveals the following:

---

Possible site: 60
>>> Seems to have a cleavable N-term signal seq.
----- Final Results -----
    bacterial outside --- Certainty = 0.3000 (Affirmative) <succ>

-continued bacterial membrane --- Certainty = 0.0000 (Not Clear) <succ>
    bacterial cytoplasm --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2537

A DNA sequence (GASx577R) was identified in *S. pyogenes* <SEQ ID 7573> which encodes the amino acid sequence <SEQ ID 7574>. Analysis of this protein sequence reveals the following:

Possible site: 17
>>> Seems to have no N-terminal signal sequence
INTEGRAL    Likelihood = −2.60    Transmembrane    2-18 (1-18)
----- Final Results -----
   bacterial membrane --- Certainty = 0.2041 (Affirmative) <succ>
      bacterial outside --- Certainty = 0.0000 (Not Clear) <succ>
         bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2538

A DNA sequence (GASx579) was identified in *S. pyogenes* <SEQ ID 7575> which encodes the amino acid sequence <SEQ ID 7576>. Analysis of this protein sequence reveals the following:

Possible site: 13
>>> Seems to have no N-terminal signal sequence
----- Final Results -----
   bacterial cytoplasm --- Certainty = 0.3161 (Affirmative) <succ>
      bacterial membrane --- Certainty = 0.0000 (Not Clear) <succ>
         bacterial outside --- Certainty = 0.0000 (Not Clear) <succ>

No corresponding DNA sequence was identified in *S. agalactiae*.

The protein has homology with the following sequences in the GENPEPT database:

```
>GP:CAB12286 GB:Z99106 similar to hypothetical proteins [Bacillus subtilis]
Identities = 62/140 (44%), Positives = 88/140 (62%), Gaps = 3/140 (2%)
Query:     3  LTNYVQEVSLADEGKPLHHKAYWNKRLKTTGGRFFPKDGHLDFNPRMLEEHGELIFRKIV      62
              L    +++S    F  KP  H+A +N RLKTTGGR+       +++ N + L EHG        I+
Sbjct:     6  LQKLTEDISETYFKKPFRHQALFNDRLKTTGGRYLLTSHNIELNRKYLIEHGREELIGII     65

Query:    63  RHELCHYHLYFEGRGYHHKDRDFKDLLAQVNGLRY---VPTSSKSKTNHHYSCQTCGQVY    119
              +HELCHYHL+ EG+GY H+DRDF+ LL QVN  R+    +    +++K  + Y C TCGQ Y
Sbjct:    66  KHELCHYHLHLEGKGYKHRDRDERMLLQQVNAPRFCTPLKEEAENKKTYMYICTTCGQQY    125

Query:   120  QRKRRINLAKYVCGNCHGKL                                          139
              +KR +N  +Y CG C GK+
Sbjct:   126  IKERAMNPDRYRCGKCRGKI                                          145
```

Based on this analysis, it was predicted that this GAS-specific protein and its epitopes, could be useful antigens for vaccines or diagnostics.

Example 2539

A DNA sequence (GASx587R) was identified in *S. pyogenes* <SEQ ID 7577> which encodes the amino acid sequence <SEQ ID 7578>. Analysis of this protein sequence reveals the following:

Possible site: 53
>>> Seems to have no N-terminal signal sequence
INTEGRAL    Likelihood = −10.40    Transmembrane    46-62 (39-89)
INTEGRAL    Likelihood = −5.36     Transmembrane    65-81 (63-89)
----- Final Results -----
   bacterial membrane --- Certainty = 0.5161 (Affirmative) <succ>
      bacterial outside --- Certainty = 0.0000 (Not Clear) <succ>
         bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2540

A DNA sequence (GASx590R) was identified in *S. pyogenes* <SEQ ID 7579> which encodes the amino acid sequence <SEQ ID 7580>. Analysis of this protein sequence reveals the following:

Possible site: 35
>>>> Seems to have no N-terminal signal sequence
----- Final Results -----
   bacterial cytoplasm --- Certainty = 0.2036 (Affirmative) <succ>
      bacterial membrane --- Certainty = 0.0000 (Not Clear) <succ>
         bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2541

A DNA sequence (GASx592R) was identified in *S. pyogenes* <SEQ ID 7581> which encodes the amino acid sequence <SEQ ID 7582>. Analysis of this protein sequence reveals the following:

Possible site: 23
>>> Seems to have a cleavable N-terminal signal sequence
INTEGRAL    Likelihood = −4.62    Transmembrane    25-41 (24-43)
----- Final Results -----
   bacterial membrane --- Certainty = 0.2848 (Affirmative) <succ>
      bacterial outside --- Certainty = 0.0000 (Not Clear) <succ>
         bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2542

A DNA sequence (GASx600) was identified in *S. pyogenes* <SEQ ID 7583> which encodes the amino acid sequence <SEQ ID 7584>. Analysis of this protein sequence reveals the following:

Possible site: 24
>>> Seems to have an uncleavable N-terminal signal sequence
INTEGRAL    Likelihood = −2.18    Transmembrane    3-19 (2-19)
----- Final Results -----
    bacterial membrane --- Certainty = 0.1871 (Affirmative) <succ>
    bacterial outside --- Certainty = 0.0000 (Not Clear) <succ>
    bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2543

A DNA sequence (GASx603R) was identified in *S. pyogenes* <SEQ ID 7585> which encodes the amino acid sequence <SEQ ID 7586>. Analysis of this protein sequence reveals the following:

Possible site: 48
>>> Seems to have no N-terminal signal sequence
----- Final Results -----
    bacterial cytoplasm --- Certainty = 0.3027 (Affirmative) <succ>
    bacterial membrane --- Certainty = 0.0000 (Not Clear) <succ>
    bacterial outside --- Certainty = 0.0000 (Not Clear) <succ>

No corresponding DNA sequence was identified in *S. agalactiae*.

The protein has homology with the following sequences in the GENPEPT database:

```
>GP:CAA03927 GB:AJ000109 gluthatione peroxidase [Lactococcus lactis]

Identities = 79/133 (59%), Positives = 103/133 (77%)
Query:    1  VVLVVNTATKCGLTPQYQALQALYDTYHDKGFEVLDFPCNQFLNQAPGDAEEINHFCSLT    60
             VV+VVNTA+KCG TPQ++ L+ LY+TY D+G E+L FPCNQF NQ  G+  EIN FC L
Sbjct:   25  VVIVVNTASKCGFTPQFEGLEKLYETYKDQGLEILGFPCNQFANQDAGENTEINEFCQLN    84

Query:   61  YHTTFPRFAKIKVNGKDADPLFTWLKEEKSGPLGKRIEWNFTKFLIDQNGQVIKRYSSKT   120
             Y  TF  F KIKVNGK+A PL+ +LK+E  G L   I+WNFTKVLID++GQVI+R++ KT
Sbjct:   85  YGVTFTMFQKIKVNGKEAHPLYQFLKKEAKGALSGTIKWNFTKFLIDRDGQVIERFAPKT   144

Query:  121  DPKLIEEDLKALL                                                133
             +P+ +EE++K LL
Sbjct:  145  EPEEMEEEIKKLL                                                157
```

Based on this analysis, it was predicted that this GAS-specific protein and its epitopes, could be useful antigens for vaccines or diagnostics.

Example 2544

A DNA sequence (GASx605) was identified in *S. pyogenes* <SEQ ID 7587> which encodes the amino acid sequence <SEQ ID 7588>. Analysis of this protein sequence reveals the following:

Possible site: 26
>>> Seems to have no N-terminal signal sequence
----- Final Results -----
    bacterial cytoplasm --- Certainty = 0.3687 (Affirmative) <succ>
    bacterial membrane --- Certainty = 0.0000 (Not Clear) <succ>
    bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2545

A DNA sequence (GASx608R) was identified in *S. pyogenes* <SEQ ID 7589> which encodes the amino acid sequence <SEQ ID 7590>. Analysis of this protein sequence reveals the following:

Possible site: 17
>>>> Seems to have no N-terminal signal sequence
----- Final Results -----
    bacterial cytoplasm --- Certainty = 0.1327 (Affirmative) <succ>
    bacterial membrane --- Certainty = 0.0000 (Not Clear) <succ>
    bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2546

A DNA sequence (GASx616) was identified in *S. pyogenes* <SEQ ID 7591> which encodes the amino acid sequence <SEQ ID 7592>. Analysis of this protein sequence reveals the following:

```
Possible site: 21
>>> Seems to have no N-terminal signal sequence
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2547

A DNA sequence (GASx617R) was identified in *S. pyogenes* <SEQ ID 7593> which encodes the amino acid sequence <SEQ ID 7594>. Analysis of this protein sequence reveals the following:

```
Possible site: 36
>>>> Seems to have no N-terminal signal sequence
----- Final Results -----
   bacterial cytoplasm --- Certainty = 0.0677 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2548

A DNA sequence (GASx622R) was identified in *S. pyogenes* <SEQ ID 7595> which encodes the amino acid sequence <SEQ ID 7596>. Analysis of this protein sequence reveals the following:

```
Possible site: 16
>>> Seems to have an uncleavable N-terminal signal sequence
INTEGRAL      Likelihood = -7.32   Transmembrane  4-20 (1-26)
----- Final Results -----
   bacterial membrane --- Certainty = 0.3930 (Affirmative) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2549

A DNA sequence (GASx632) was identified in *S. pyogenes* <SEQ ID 7597> which encodes the amino acid sequence <SEQ ID 7598>. Analysis of this protein sequence reveals the following:

```
Possible site: 31
>>> Seems to have no N-terminal signal sequence
INTEGRAL      Likelihood = -3.40   Transmembrane  83-99 (82-102)
INTEGRAL      Likelihood = -1.28   Transmembrane  108-124 (108-124)
----- Final Results -----
   bacterial membrane --- Certainty = 0.2359 (Affirmative) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2550

A DNA sequence (GASx638) was identified in *S. pyogenes* <SEQ ID 7599> which encodes the amino acid sequence <SEQ ID 7600>. Analysis of this protein sequence reveals the following:

```
Possible site: 25
>>> Seems to have an uncleavable N-terminal signal sequence
INTEGRAL      Likelihood = -0.64   Transmembrane  12-28 (12-28)
----- Final Results -----
   bacterial membrane --- Certainty = 0.1256 (Affirmative) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2551

A DNA sequence (GASx652R) was identified in *S. pyogenes* <SEQ ID 7601> which encodes the amino acid sequence <SEQ ID 7602>. Analysis of this protein sequence reveals the following:

```
Possible site: 16
>>> Seems to have no N-terminal signal sequence
----- Final Results -----
   bacterial cytoplasm --- Certainty = 0.2622 (Affirmative) <succ>
``` bacterial membrane --- Certainty = 0.0000 (Not Clear) <succ>
bacterial outside --- Certainty = 0.0000 (Not Clear) <succ>

No corresponding DNA sequence was identified in *S. agalactiae*.

The protein has homology with the following sequences in the GENPEPT database:

```
>GP:CAA74610 GB:Y14232 hypothetical protein [Bacteriophage TP901-1]
Identities = 225/485 (46C, Positives = 308/485 (63%), Gaps = 20/485 (4%)
Query:   2  RKVAIYSRVSTINQAEEGYSIQGQIEALTKYCEAMEWKIYKNYSDAGFSGGKLERPAITE      61
            +KVAIY+RVST NQAEEG+SI  QI+ LTKY EAM W++    Y+DAGFSG KLERPA+
Sbjct:   3  KKVAIYTRVSTTNQAEEGFSIDEQIDRLTKYAEAMGWQVSDTYTDAGFSGAKLERPAMQR     62

Query:  62  LIEDGKNNKFDTILVYKLDRLSRNVKDTLYLVKDVFTANNIHFVSLKENIDTSSAMGNLF    121
            LI D +N  FDT+LVYKLDRLSR+V+DTLYLVKDVFT N I F+SL E+IDTSSAMG+LF
Sbjct:  63  LINDIENKAFDTVLVYKLDRLSRSVRDTLYLVKDVFTKNKIDFISLNESIDTSSAMGSLF    122

Query: 122  LTLLSAIAEFEREQIKERMQFGVMNRAKSGKTTAWKTPPYGYRYNKDEKTLSVNELEAAN    181
            LT+LSAI EFERE IKERM  G + RAKSGK+  W    +GY +N+    L + L+A
Sbjct: 123  LTILSAINEFERENIKERMTMGKLGRAKSGKSMMWTKTAFGYYHNRKTGILEIVPLQATI    182

Query: 182  VRQMFDMIISGCSIMSITNYARDN-FVGN--TWTHVKVKRILENETYKGLVKYREQTFSG    238
            V Q+F   +SG S+  + +   ++  +G    W++   +++ L+N  Y G +K+++  F G
Sbjct: 183  VEQIFTDYLSGISLTKLRDKLNESGHIGKDIPWSYRTLRQTLDNPVYCGYIKFKDSLFEG    242

Query: 239  DHQAIIDEKTYNKAQIALAHRT----DTKTNTRPFQGKYMLSHIAKCGYCGAPLKVCIGR    294
             H+ II  +TY K Q  L  R       + N RPFQ KYMLS +A+CGYCGAPLK+  G
Sbjct: 243  MHKPIIPYETYLKVQKELEERQQQTYERNNNPRPFQAKYMLSGMARCGYCGAPLKIVLGH    302

Query: 295  AKNDGTRRQTYVCVNKTESLARRSVNNYNNQKICNTGRYEKKHIEKYVIDVLYKLQHDKE    354
             +  DG+R    Y C N+       + + YN+ K C++G Y+   ++E  VID L   Q + +
Sbjct: 303  KRKDGSRTMKYHCANRFPR-KTKGITVYNDNKKCDSGTYDLSNLENTVIDNLIGFQENND    361

Query: 355  YLKKIKKDDN--IIDITPLKKEIEIIDKKINRLNDLYINDLIDLPKLKKDIEELNHLKDD    412
              L KI  +N  I+D +   KK+I   IDKKI + +DLY+ND I +  +LK    + L    K
Sbjct: 362  SLLKIINGNNQPILDTSSFKKQISQIDKKIQKNSDLYLNDFITMDELKDRTDSLQAEK--    419

Query: 413  YNKAIKLNYLDKKNEDSLGML------MDNLDIRKSSYDVQSRIVKQLIDRVEVTMDNID    466
              K +K    + K  DS  +         + ++ I + SYD + +IV  L+ +V+VT DN+D
Sbjct: 420  --KLLKAKISENKFNDSTDVFELVKTQLGSIPINELSYDNKKKIVNNLVSKVDVTADNVD    477

Query: 467  IIFKF                                                         471
            IIFKF
Sbjct: 478  IIFKF                                                         482
```

Based on this analysis, it was predicted that this GAS-specific protein and its epitopes, could be useful antigens for vaccines or diagnostics.

Example 2552

A DNA sequence (GASx653R) was identified in *S. pyogenes* <SEQ ID 7603> which encodes the amino acid sequence <SEQ ID 7604>. Analysis of this protein sequence reveals the following:

Possible site: 48

>>> Seems to have no N-terminal signal sequence
INTEGRAL Likelihood = −1.22 Transmembrane 86-102 (86-102)
----- Final Results -----
   bacterial membrane --- Certainty = 0.1489 (Affirmative) <succ>
   bacterial outside --- Certainty = 0.0000 (Not Clear) <succ>
   bacterial cytoplasm --- Certainty = 0.0000 (Not Clear) <succ>

No corresponding DNA sequence was identified in *S. agalactiae*.

The protein has homology with the following sequences in the GENPEPT database:

```
>GP:AAF12707 GB:AF066865 unknown [bacteriophage TPW22]

Identities = 45/67 (67%), Positives = 53/67 (78%), Gaps = 2/67 (2%)

Query:  57  EKEAVRCPKCKSTNVGFMQQGKKTFSVKKAVAGTLLIG--GTVMGFLGEKGKKQWHCNEC    114
            +K A++CPKCKST+V FMQQGKK FSV KAV G +L G   GT+ GF G+KGKKQWHCN C
Sbjct: 138  DKHAIKCPKCKSTDVVFMQQGKKGFSVGKAVGGAVLTGGIGTLAGFAGKKGKKQWHCNNC    197

Query: 115  SCIFETK                                                      121
            +FETK
Sbjct: 198  GRVFETK                                                      204
```

Example 2553

A DNA sequence (GASx655) was identified in *S. pyogenes* <SEQ ID 7605> which encodes the amino acid sequence <SEQ ID 7606>. Analysis of this protein sequence reveals the following:

```
Possible site: 50
>>> Seems to have no N-terminal signal sequence
----- Final Results -----
   bacterial cytoplasm --- Certainty = 0.3956 (Affirmative) <succ>
      bacterial membrane --- Certainty = 0.0000 (Not Clear) <succ>
      bacterial outside --- Certainty = 0.0000 (Not Clear) <succ>
```

No corresponding DNA sequence was identified in *S. agalactiae*.

The protein has homology with the following sequences in the GENPEPT database:

```
>GP:CAB63661 GB:AJ251789 Cro protein [Lactobacillus casei
bacteriophage A2]
Identities = 43/76 (56%), Positives = 55/76 (71%)
Query:  26   MTINLKRLKAERIASGMTQCEVAQSMGWKTRTPYAKRENGIVSIGADELAKITLIFGLPI    85
             MT+NLKRL+AERIA GM Q E+A++MGW TR+ YAKRENGI +I A EL K+  I G
Sbjct:   1   MTLNLKRLRAERIAKGMNQDEMAKAMGWHTRSSYAKRENGITTISATELVKMASILGYGT    60

Query:  86   EKIAIFFDKDVPVMER    101
             ++ +FF +VP  ER
Sbjct:  61   NQLDLFFTNNVPDRER    76
```

Based on this analysis, it was predicted that this GAS-specific protein and its epitopes, could be useful antigens for vaccines or diagnostics.

Example 2554

A DNA sequence (GASx656) was identified in *S. pyogenes* <SEQ ID 7607> which encodes the amino acid sequence <SEQ ID 7608>. Analysis of this protein sequence reveals the following:

```
Possible site: 34
>>> Seems to have no N-terminal signal sequence
----- Final Results -----
   bacterial cytoplasm --- Certainty = 0.4505 (Affirmative) <succ>
      bacterial membrane --- Certainty = 0.0000 (Not Clear) <succ>
      bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2555

A DNA sequence (GASx657) was identified in *S. pyogenes* <SEQ ID 7609> which encodes the amino acid sequence <SEQ ID 7610>. Analysis of this protein sequence reveals the following:

```
Possible site: 35
>>> Seems to have no N-terminal signal sequence
----- Final Results -----
   bacterial cytoplasm --- Certainty = 0.6593 (Affirmative) <succ>
      bacterial membrane --- Certainty = 0.0000 (Not Clear) <succ>
      bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2556

A DNA sequence (GASx658) was identified in *S. pyogenes* <SEQ ID 7611> which encodes the amino acid sequence <SEQ ID 7612>. Analysis of this protein sequence reveals the following:

```
Possible site: 32
>>> Seems to have no N-terminal signal sequence
----- Final Results -----
   bacterial cytoplasm --- Certainty = 0.5244 (Affirmative) <succ>
      bacterial membrane --- Certainty = 0.0000 (Not Clear) <succ>
      bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2557

A DNA sequence (GASx660) was identified in *S. pyogenes* <SEQ ID 7613> which encodes the amino acid sequence <SEQ ID 7614>. Analysis of this protein sequence reveals the following:

```
Possible site: 58
>>> Seems to have no N-terminal signal sequence
----- Final Results -----
   bacterial cytoplasm --- Certainty = 0.1133 (Affirmative) <succ>
      bacterial membrane --- Certainty = 0.0000 (Not Clear) <succ>
      bacterial outside --- Certainty = 0.0000 (Not Clear) <succ>
```

No corresponding DNA sequence was identified in *S. agalactiae*.

The protein has homology with the following sequences in the GENPEPT database:

```
>GP:AAB99331 GB:U67572 purine NTPase [Methanococcus jannaschii]
Identities = 71/346 (20%), Positives = 154/346 (43%), Gaps = 52/346 (15%)
Query:    8 MSITINKLEIENVK-----RIKAVKIEPSATGLTIIGGNNNQGKTSVLDAIAWAL--GGN      60
              MS+ + ++ + N K      RIK K          G+  I G N  GK+S+ +A+ +AL  G+
Sbjct:    1 MSMILKEIRMNNPFKSHVNSRIKFEK------GIVAIIGENGSGKSSIFEAVFFALFGAGS      54

Query:   61 KYKPSQAMREGSQ---VPPTLKITMSNGLIVERKGKNASLKVIDPNGQ----------KG     107
              +        + +G +      V    ++ +N   I+              +   NG+          K
Sbjct:   55 NFNYDTIITKGKKSVYVELDFEVNGNNYKIIREYDSGRGGAKLYKNGKPYATTISAVNKA     114

Query:  108 GQQLL----DSFVEELAI---NLPKFMDSTPKEKADVLLEIIGVGDQLAELELKEKEIYN     160
              ++L     + F+  + I       + KF+    P EK + + +++G+ D+    +    K   EI
Sbjct:  115 VNEILGVDRNMFLNSIYIKQGEIAKFLSLKPSEKLETVAKLLGI-DEFEKCYQKMGEIVK     173

Query:  161 QRHAIGVIADQKEKFAKEMTYYPDAPKQLVS-ISELIQQHQAILAKNGE-NAQKR--QNV     216
              +             + E+     E+ Y  +    K+L + +S+L ++++ ++    N + N    K+  +++
Sbjct:  174 E------YEKRLERIEGELNYKENYEKELKNKMSQLEEKNKKLMEINDKLNKIKKEFEDI     227

Query:  217 ERIRYDYNQSILEVDRLRKLLADAEAKTNKLSEDLKIANTD------AMDLHDESTAEIE     270
              E++  ++      L  ++        L + +         +++LKI    D         A+    +      E E
Sbjct:  228 EKLFNEWENKKLLYEKFINKLEERKRALELKNQELKILEYDLNTVVEARETLNRHKDEYE     287

Query:  271 ANIADIDEVNRKVRANFDKDKAE-EDAKQQREQYNILTNDIESIRQ                  315
              + +DE+ RK+ +    + K+  ED   +  +Q  I+   DIE +++
Sbjct:  288 KYKSLVDEI-RKIESRLRELKSHYEDYLKLTKQLEIIKGDIEKLKE                  332
```

Based on this analysis, it was predicted that this GAS-specific protein and its epitopes, could be useful antigens for vaccines or diagnostics.

Example 2558

A DNA sequence (GASx661) was identified in *S. pyogenes* <SEQ ID 7615> which encodes the amino acid sequence <SEQ ID 7616>. Analysis of this protein sequence reveals the following:

Possible site: 28
>>> Seems to have no N-terminal signal sequence
----- Final Results -----
  bacterial cytoplasm --- Certainty = 0.1559 (Affirmative) <succ>
    bacterial membrane --- Certainty = 0.0000 (Not Clear) <succ>
      bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2559

A DNA sequence (GASx662) was identified in *S. pyogenes* <SEQ ID 7617> which encodes the amino acid sequence <SEQ ID 7618>. Analysis of this protein sequence reveals the following:

Possible site: 52
>>> Seems to have no N-terminal signal sequence
----- Final Results -----
  bacterial cytoplasm --- Certainty = 0.3292 (Affirmative) <succ>
    bacterial membrane --- Certainty = 0.0000 (Not Clear) <succ>
      bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2560

A DNA sequence (GASx663) was identified in *S. pyogenes* <SEQ ID 7619> which encodes the amino acid sequence <SEQ ID 7620>. Analysis of this protein sequence reveals the following:

Possible site: 15
>>> Seems to have no N-terminal signal sequence
----- Final Results -----
  bacterial cytoplasm --- Certainty = 0.4867 (Affirmative) <succ>
    bacterial membrane --- Certainty = 0.0000 (Not Clear) <succ>
      bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2561

A DNA sequence (GASx664) was identified in *S. pyogenes* <SEQ ID 7621> which encodes the amino acid sequence <SEQ ID 7622>. Analysis of this protein sequence reveals the following:

```
Possible site: 46
>>> Seems to have no N-terminal signal sequence
----- Final Results -----
   bacterial cytoplasm --- Certainty = 0.2141 (Affirmative) <succ>
     bacterial membrane --- Certainty = 0.0000 (Not Clear) <succ>
      bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2562

A DNA sequence (GASx667) was identified in *S. pyogenes* <SEQ ID 7623> which encodes the amino acid sequence <SEQ ID 7624>. Analysis of this protein sequence reveals the following:

```
Possible site: 59
>>> Seems to have no N-terminal signal sequence
----- Final Results -----
   bacterial cytoplasm --- Certainty = 0.2614 (Affirmative) <succ>
     bacterial membrane --- Certainty = 0.0000 (Not Clear) <succ>
      bacterial outside --- Certainty = 0.0000 (Not Clear) <succ>
```

No corresponding DNA sequence was identified in *S. agalactiae*.

The protein has homology with the following sequences in the GENPEPT database:

```
>GP:AAF80834 GB:AF165214 Orf78 [Pseudomonas phage D3]
Identities = 68/200 (34%), Positives = 109/200 (54%), Gaps . 10/200 (5%)
Query:  12 GLRFGSLTVINRNRNNSKGGNARWNCLCDCGNKTVVI-GSKLRSGYTKSCGCARKNDNAK    70
           GLR G + V      ++   G  + W C CDCGN+ ++    G+ +R+   T SCGC+R +
Sbjct:   8 GLRVGKVVV--EAFSHCAGKASHWVCRCDCGNRVIMRRGNLMRNRTTTSCGCSRFSH---    62

Query:  71 GYSSTRLYRIWKGMMNRCYNHKNDNYKYYGGKGISICDEWLTFINFRTWSLSNGYKESLT   130
           G + T  Y  W  M++RC N   N  Y  Y G+GI++C+ W+TF NF        G +    T
Sbjct:  63 GMTGTPTYSSWSNMIDRCTNPSNKRYVDYQGRGITVCERWMTFANFLA---DMGERPDAT   119

Query: 131 -IDRINPKGNYTPLNCRWVSMKMQQNNKTNNRYLSYLGQEYTIAEFSEKLNVTYWTVINQ   189
            +DRI+    Y     NCRW +    Q NN    N ++ YLG+  T+++++ +L  +   T+ ++
Sbjct: 120 SLDRIDNDAGYFKENCRWATALEQMNNTRRNTFVEYLGRRQTVSQWAGQLGIPECTLRSR   179

Query: 190 LKLGWSVERIVEEARMKNDR                                         209
           L  GWS+E  +++    K  R
Sbjct: 180 LNRGWSIEDAMQKPISKQRR                                         199
```

Based on this analysis, it was predicted that this GAS-specific protein and its epitopes, could be useful antigens for vaccines or diagnostics.

Example 2563

A DNA sequence (GASx668) was identified in *S. pyogenes* <SEQ ID 7625> which encodes the amino acid sequence <SEQ ID 7626>. Analysis of this protein sequence reveals the following:

```
Possible site: 41
>>> Seems to have no N-terminal signal sequence
----- Final Results -----
   bacterial cytoplasm --- Certainty = 0.1476 (Affirmative) <succ>
     bacterial membrane --- Certainty = 0.0000 (Not Clear) <succ>
      bacterial outside --- Certainty = 0.0000 (Not Clear) <succ>
```

No corresponding DNA sequence was identified in *S. agalactiae*.

The protein has homology with the following sequences in the GENPEPT database:

```
>GP:CAB75598 GB:AJ271879 putative DNA helicase [uncultured
eubacterium]
Identities = 42/168 (25%), Positives = 75/168 (44%), Gaps = 7/168 (4%)
Query: 374 IAGPSKAGKSFALIELSIAIAEGQKWLG-WQCEQGKVLYVNLELDRPSALHREKDVYDAM   432
           +  P  AGKS  ++L+   +A G    LG  +    G V+Y+   E D P+A+H         A
Sbjct:  35 LVSPGGAGKSMLALQLAAQIAGGPDLLGVGELPTGPVIYLPAE-DPPTAIHHELHALGAH    93
```

```
                                 -continued
Query: 433  GLPPANVANIDIWNLRGKTVPMDKLAPKLIRRSLKKNYQA---VIIDPIYKVLTGDENSA   489
                  A  D    ++     +  +        +LK+   +     +I+D + +     +EN++
Sbjct:  94  LSAEERQAVADGLLIQPLIGSLPNIMASNWFEALKRAAEGRRLMILDTLRREHIEEENAS   153

Query: 490  DQMAHFTNQFDKVATELGCSVIYCHHHSKGS--QGGKKSMDRASGSGV              535
                  MA     +  +  +A  +  GCS+++ HH SKG+    G         + GS V
Sbjct: 154  GPMAQVIGRMEAIAADTGCSIVFLHHASKGATMMGAGDQQQASRGSSV              201
```

Based on this analysis, it was predicted that this GAS-specific protein and its epitopes, could be useful antigens for vaccines or diagnostics.

Example 2564

A DNA sequence (GASx669) was identified in S. pyogenes <SEQ ID 7627> which encodes the amino acid sequence <SEQ ID 7628>. Analysis of this protein sequence reveals the following:

Possible site: 56
>>> Seems to have no N-terminal signal sequence
----- Final Results -----
    bacterial cytoplasm --- Certainty = 0.2555 (Affirmative) <succ>
        bacterial membrane --- Certainty = 0.0000 (Not Clear) <succ>
        bacterial outside --- Certainty = 0.0000 (Not Clear) <succ>

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2565

A DNA sequence (GASx670) was identified in S. pyogenes <SEQ ID 7629> which encodes the amino acid sequence <SEQ ID 7630>. Analysis of this protein sequence reveals the following:

Possible site: 54
>>> Seems to have no N-terminal signal sequence
----- Final Results -----
    bacterial cytoplasm --- Certainty = 0.2921 (Affirmative) <succ>
        bacterial membrane --- Certainty = 0.0000 (Not Clear) < succ>
        bacterial outside --- Certainty = 0.0000 (Not Clear) < succ>

No corresponding DNA sequence was identified in S. agalactiae.

The protein has homology with the following sequences in the GENPEPT database:

Based on this analysis, it was predicted that this GAS-specific protein and its epitopes, could be useful antigens for vaccines or diagnostics.

Example 2566

A DNA sequence (GASx671) was identified in S. pyogenes <SEQ ID 7631> which encodes the amino acid sequence <SEQ ID 7632>. Analysis of this protein sequence reveals the following:

Possible site: 33
>>> Seems to have no N-terminal signal sequence
----- Final Results -----
    bacterial cytoplasm --- Certainty = 0.4294 (Affirmative) <succ>
        bacterial membrane --- Certainty = 0.0000 (Not Clear) <succ>
        bacterial outside --- Certainty = 0.0000 (Not Clear) <succ>

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2567

A DNA sequence (GASx672R) was identified in S. pyogenes <SEQ ID 7633> which encodes the amino acid sequence <SEQ ID 7634>. Analysis of this protein sequence reveals the following:

Possible site: 15
>>> Seems to have a cleavable N-term signal seq.
INTEGRAL     Likelihood = -6.37    Transmembrane 106-122 (104-125)
----- Final Results -----
    bacterial membrane --- Certainty = 0.3548 (Affirmative) <succ>
        bacterial outside --- Certainty = 0.0000 (Not Clear) <succ>
        bacterial cytoplasm --- Certainty = 0.0000 (Not Clear) <succ>

No corresponding DNA sequence was identified in S. agalactiae.

The protein has no significant homology with any sequences in the GENPEPT database.

```
>GP:AAF74082 GB:AF212845 ORF129 [Lactococcus lactis bacteriophage
ul36]

Identities = 36/108 (33%), Positives = 63/108 (58%), Gaps = 1/108 (0%)

Query:   8   IEFFLPMDKIPTTTHQQKKVTVINGKPHFYEPESLKNARDKFTSLLAQHVPPSKLDGPIR    67
             ++F    +DK+PTT   QQK  +  GK  FY+     KN    K   +      + + P++
Sbjct:   1   MKFEFELDKMPTT-QQQKGIKKVKGKLQFYDRRGTKNYSLKAQLMKNKPKECFEKNVPLK    59

Query:  68   LTVKWLFPKIKGSTNGQYKTTKPDTDNLQKLLKDCMTELGFWNDDAQV              115
             L+V  +  + +  Q+KT++PD DNL K  LMT+++DD+Q+
Sbjct:  60   LSVTFFYAIKQKKRWWQWKTSRPDLDNLMKNLQDYMTKLRYYSDDSQI              107
```

Based on this analysis, it was predicted that this GAS-specific protein and its epitopes, could be useful antigens for vaccines or diagnostics.

Example 2568

A DNA sequence (GASx673) was identified in *S. pyogenes* <SEQ ID 7635> which encodes the amino acid sequence <SEQ ID 7636>. Analysis of this protein sequence reveals the following:

---
Possible site: 56
>>> Seems to have no N-terminal signal sequence
----- Final Results -----
    bacterial cytoplasm --- Certainty = 0.4781 (Affirmative) <succ>
    bacterial membrane --- Certainty = 0.0000 (Not Clear) <succ>
    bacterial outside --- Certainty = 0.0000 (Not Clear) <succ>

---

No corresponding DNA sequence was identified in *S. agalactiae*.

The protein has homology with the following sequences in the GENPEPT database:

```
>GP:AAB18697 GB:U38906 ORF22 [Bacteriophage rlt]
Identities = 78/207 (37%), Positives = 123/207 (58%), Gaps = 2/207 (0%)
Query:   28 EIHRILGIDEVYKAPKRLIDILFDKDSREDIFRQFLKYETDVSYDWFMQYFEEEQADRKN      87
             + + +L +DE       R+ +++FDK  RE+ + + L    D+  D+F  YF     A
Sbjct:    7 QFYDMLNVDEHMNFTNRIQELVFDKKGREEFYSKILNIHHDMGVDFFRDYFMAHSAVSA-     65

Query:   88 KKQDFTPKSVSTLLSKIISGNQYYEVA-VGTGGILIQAWQEQRLNDSPFTYRPSKYWYHV    146
             K Q +TP  +  L + ++ G+    ++    GTG ++IQ WQ+ R+N    F Y PS YWY
Sbjct:   66 KGQHYTPDELGKLTALLVGGSGGADLTGAGTGTLIIQKWQDDRMNTDFFNYLPSNYWYQA    125

Query:  147 EELSDKAVPFLLFNMSIRGINGVVVHGDSLTRQVKNIYFLQNTKDDMLSFSDINVMPRIQ    206
              ELSD+A+ FL+    +IRG+NGVV+HGD+L    VK +YF+QN+ ++ + FS+INV+P ++
Sbjct:  126 LELSDEAISFLIHAFAIRGMNGVVIHGDALEMAVKQVYFIQNSANNPIGFSEINVIPHSK    185

Query:  207 DIEREFNVKEWIGDGIEHIENPLIEWI    233
             D      + EW    IEHIE+   +WI
Sbjct:  186 DAMEFLGIHEWTEQAIEHIESKFPDWI    212
```

Based on this analysis, it was predicted that this GAS-specific protein and its epitopes, could be useful antigens for vaccines or diagnostics.

Example 2569

A DNA sequence (GASx674) was identified in *S. pyogenes* <SEQ ID 7637> which encodes the amino acid sequence <SEQ ID 7638>. Analysis of this protein sequence reveals the following:

---
Possible site: 51
>>> Seems to have no N-terminal signal sequence
INTEGRAL     Likelihood = −0.00    Transmembrane 122-138 (122-138)
----- Final Results -----
    bacterial membrane --- Certainty = 0.1001 (Affirmative) <succ>
    bacterial outside --- Certainty = 0.0000 (Not Clear) <succ>
    bacterial cytoplasm --- Certainty = 0.0000 (Not Clear) <succ>

---

No corresponding DNA sequence was identified in *S. agalactiae*.

The protein has homology with the following sequences in the GENPEPT database:

```
>GP:AAF63071 GB:AF158600 gp137 [Streptococcus thermophilus
bacteriophage Sfi11]
Identities = 66/135 (48%), Positives = 89/135 (65%), Gaps = 2/135 (1%)
Query:    5 PEIDIQKTKSNAKRKLREYPRWRRIANDVDTQKVTATYSFEPRQSHGVPSKPVERLALNR     64
             PEID + T    KRKLREYPRWR IA+D   QK+T  +FF PR   G  +KPVE +A+ R
Sbjct:    4 PEIDEKATLKRCKRKLREYPRWREIAHDSAEQKITQEFTFMPRG--GGVNKPVENIAVRR     61

Query:   65 VSAEQELDAIEQAVSMILEPERRRILYDKYLAPYKKADKVIYTELCMSESFYYDTLDIAL    124
             V A  EL+AIEQAV+ +  P+ RRIL +KYLA    K + I    +   + + + L+ ++
Sbjct:   62 VDALNELEAIEQAVNGLYRPDYRRILIEKYLAYPPKPNWQIAQSIGFERTAFQELLNNSI    121

Query:  125 LAFAELYREGVLLVE    139
             LAFAELYR+G L+VE
Sbjct:  122 LAFAELYRDGRLIVE    136
```

Based on this analysis, it was predicted that this GAS-specific protein and its epitopes, could be useful antigens for vaccines or diagnostics.

Example 2570

A DNA sequence (GASx675) was identified in *S. pyogenes* <SEQ ID 7639> which encodes the amino acid sequence <SEQ ID 7640>. Analysis of this protein sequence reveals the following:

```
>GP:BAB07254 GB:AP001519 unknown [Bacillus halodurans]
Identities = 194/451 (43%), Positives = 262/451 (58%), Gaps = 69/451 (15%)
Query:   1 MEFVDKKLSEITPYKNNPRNNDEAVGPVAE----SIKEFGFKVPIVV-DKNGEIVNGHTR    55
           +  V+KK+ ++ P + NPR + +    P  E    SI+EFG   PIV  ++ G +V GH R
Sbjct:   3 IRIVNKKIDDLVPAEYNPRLDLQPGDPEYEKLKRSIEEFGLVEPIVFNERTGRVVGGHQR    62

Query:  56 YKAAQKLGLETVPVIVADDLSEEQIKAFRLADNKV-GEIAVWDLDLLNEELNDILDLDMS   114
           K   ++LG E VPV V D L +    KA  +A NK+ G+    + L   L EEL+   L +D++
Sbjct:  63 LKILRELGWEEVPVSVVD-LDDHHEKALNVALNKIEGDWDNFKLKELLEELDSGL-IDVT   120

Query: 115 AFGFDVLDNLDDL-----IEDEKDL--DDF----TGTVPDEPKSKLGDIYQLGSHKLMCG   163
              GFD  + ++DL       +EDE ++ DDF         +EP  +K GD++ LG H L+ G
Sbjct: 121 LTGFDE-EEIEDLMTQFFVEDENEIKEDDFDPDEVAEEIEEPITKPGDLWHLGRHFLLVG   179

Query: 164 DSTNGADVKKLMNGELADLLLTDPPYNVAYEGKTKDSLTIKNDSMDNDSFRQFLVNAFSS   223
           DST    DVK+LM  E AD++   TDPPYNV  YEG T   +  IEND+M++   F  QFL +AF +
Sbjct: 180 DSTKIEDVKRLMGNEKADMIFTDPPYNVDYEGAT--GMKIENDNMEDSEFYQFLFDAFVA   237

Query: 224 ANEVMKPGAVFYIWHADSEGYNFRGACFDIGWTVRQCLIWNKNSMVLGRQDYHWKHEPCL   283
            +V K G   Y+ HADSEG   FR A   D G+ ++QCLIW KNS+VLGRQDYHW+HEP L
Sbjct: 238 MYQVTKEGGPIYVCHADSEGLTFRKAFQDSGFLLKQCLIWVKNSLVLGRQDYENRHEPIL   297

Query: 284 YGWKDGAGHLWASDRKQTSVID--------------------------------------   305
           YGWK GA H W    RKQ++VI+
Sbjct: 298 YGWKPGAAHKWYGGRKQSTVIEDPVDLAITPKVDHVLLTFNNGISSTVVKVPSYEIIHDG   357

Query: 306 ---------YEKPQRNGVHPTMKPVGLFDYQIKNNTKGSDIVLDLFGGSGTTLIACESNG   356
                    E+P+RN  HPTMKP+ L   I+N++K   + VLD FGGSG+TLIACE  G
Sbjct: 358 SDEGMTTWRIERPKRNADHPTMKPIALCARAIQNSSKPGERVLDPFGGSGSTLIACEQTG   417

Query: 357 RHARLMEYDPKYVDVIIKRWEELTGESVIQL                              387
           R   +MEYDP Y +VII+RWEE TG++ ++L
Sbjct: 418 RICHMMEYDPVYAEVIIRRWEEWTGQNAVKL                              448
```

Possible site: 41
>>> Seems to have no N-terminal signal sequence
----- Final Results -----
bacterial cytoplasm --- Certainty = 0.1865 (Affirmative) <succ>
bacterial membrane --- Certainty = 0.0000 (Not Clear) <succ>
bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2571

A DNA sequence (GASx676) was identified in *S. pyogenes* <SEQ ID 7641> which encodes the amino acid sequence <SEQ ID 7642>. Analysis of this protein sequence reveals the following:

Possible site: 31
>>> Seems to have no N-terminal signal sequence
----- Final Results -----
bacterial cytoplasm --- Certainty = 0.4870 (Affirmative) <succ>
bacterial membrane --- Certainty = 0.0000 (Not Clear) <succ>
bacterial outside --- Certainty = 0.0000 (Not Clear) <succ>

No corresponding DNA sequence was identified in *S. agalactiae*.

The protein has homology with the following sequences in the GENPEPT database:

Based on this analysis, it was predicted that this GAS-specific protein and its epitopes, could be useful antigens for vaccines or diagnostics.

Example 2572

A DNA sequence (GASx677) was identified in *S. pyogenes* <SEQ ID 7643> which encodes the amino acid sequence <SEQ ID 7644>. Analysis of this protein sequence reveals the following:

Possible site: 54
>>> Seems to have no N-terminal signal sequence
----- Final Results -----
bacterial cytoplasm --- Certainty = 0.4744 (Affirmative) <succ>
bacterial membrane --- Certainty = 0.0000 (Not Clear) <succ>
bacterial outside --- Certainty = 0.0000 (Not Clear) <succ>

No corresponding DNA sequence was identified in *S. agalactiae*.

The protein has no significant homology with any sequences in the GENPEPT database.

Example 2573

A DNA sequence (GASx678) was identified in *S. pyogenes* <SEQ ID 7645> which encodes the amino acid sequence <SEQ ID 7646>. Analysis of this protein sequence reveals the following:

```
Possible site: 31
>>> Seems to have no N-terminal signal sequence
INTEGRAL     Likelihood = -0.27    Transmembrane 90-106 (90-106)
----- Final Results -----
   bacterial membrane --- Certainty = 0.1107 (Affirmative) <succ>
   bacterial outside --- Certainty = 0.0000 (Not Clear) <succ>
      bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2574

A DNA sequence (GASx679) was identified in *S. pyogenes* <SEQ ID 7647> which encodes the amino acid sequence <SEQ ID 7648>. Analysis of this protein sequence reveals the following:

```
Possible site: 19
>>> Seems to have no N-terminal signal sequence
----- Final Results -----
   bacterial cytoplasm --- Certainty = 0.3408 (Affirmative) <succ>
   bacterial membrane --- Certainty = 0.0000 (Not Clear) <succ>
      bacterial outside --- Certainty = 0.0000 (Not Clear) <succ>
```

No corresponding DNA sequence was identified in *S. agalactiae*.

The protein has homology with the following sequences in the GENPEPT database:

```
>GP:CAA66734 GB:X98106 minor capsid protein [Bacteriophage phigle]
Identities = 213/494 (43%), Positives = 323/494 (65%), Gaps = 19/494 (3%)
Query:    1 MGVIQKIKNLVTRSKYVM-TTQSLTNITDHPKIAISKLEYDRITTNLKYYKSDWDSVLYL    59
            MG+IQ+IK+L +       T SL+ ITD P+I+I   EY RI T+L YY      + Y
Sbjct:    1 MGLIQRIKDLFWKGAAATGVTGSLSKITDDPRISIDPDEYVRIQTDLDYYSDKLQYIHYQ   60

Query:   60 NTDGETKKRDLNHLPIARTAAKKIASLVFNEQAEIKV-DDDAANEFISETLKNDRFNKNF  118
            +DG   KKR  N + +A+TAA++IAS+VFNE+AEI V D++ A++F+++ L+++ F    F
Sbjct:   61 ASDGIKKKRLKNTINMAKTAARRIASVVFNEKAEIHVKDNNEADKFLNDVLEDNDFKNKF  120

Query:  119 ERYLESCLALGGLAMRPYVDGDKVRVAFVQAPVFLPLQSNTQDVSSAAVVIKSVKTINGK  178
            E  LE +ALGG AMRPY+DG+ +++A+V+A  F PLQSNT D+S AA+  ++ +T + +
Sbjct:  121 EEALEKGVALGGFAMRPYIDGNHIKIAWVRADQFYPLQSNTNDISEAAIASRTQRTESNQ  180

Query:  179 EVYYTLIEFHEWQSSDDYVISNELYRSDDKAKVGSRVPLS--EVYKDLKDEAKVTDVIRP  236
               YYTL+EFH+WQ +  Y I+NELY+SD     VG++VPLS   VYK+L +   ++ + RP
Sbjct:  181 TKYYTLLEFHQWQDNGSYQITNELYKSDSPDIVGNQVPLSTLPVYKELAPQVTISGLQRP  240

Query:  237 IFTYLKTPGMNNKDINSPLGLSIFDNAKTTIDFINTTYDEFMWEVKMGQRRVAVPESLTA  296
            +F Y KTPG NN +I SPLGL + DNAK  +D IN T+D+F+WE+++GQ+ +AV     +
Sbjct:  241 LFAYFKTPGANNINIESPLGLGVVDNAKHVLDDINDTHDQFIWEIRLGQKHIAVQPGMLR  300

Query:  297 LTVRTADGDVVPRPRFESDQNVYIRMGGRDLDSSAIQDLTTPIRADDYIKAINEGLSLFE  356
                   D   +P F+++QNVY+ +    D +   ++D+TTPIR    Y AI+  + FE
Sbjct:  301 F-------DDEHKPTFDTEQNVYVGVLSDDNNGLGVKDMTTPIRTVQYKDAIDHFIKEFE  353

Query:  357 MQIGVSAGLFSFDGKSMKTATEIVSENSDTYQMRNSIVTLVEQSLKELVISIFEIAKAYD  416
            +QIG+S G FS+    +KTATE+VS NS TYQ R+S +T+VE+++ EL   SIFE+A A
Sbjct:  354 VQIGLSTGTFSYSNDGVKTATEVVSNNSMTYQTRSSYLTMVEKAIDELCQSIFELANAGA  413

Query:  417 LYQSEVP--SMDNISISL------DDGVFTDRDAELDYWIKVVNAGFGTREMAIQKVLNV  468
            L+    P  ++D+ S L       DDGVF ++D +L+   KV+  G    +++ +Q+   +
Sbjct:  414 LFDDGKPLFTLDSASQPLDIECHFDDGVFVNKDKQLEEDAKVLAIGALSKQTFLQRNYGM  473

Query:  469 TEEKAQEIAAEINT                                                482
            T+E+A  E AA+I +
Sbjct:  474 TDEQAAEELAKIQS                                                487
```

Based on this analysis, it was predicted that this GAS-specific protein and its epitopes, could be useful antigens for vaccines or diagnostics.

Example 2575

A DNA sequence (GASx680) was identified in *S. pyogenes* <SEQ ID 7649> which encodes the amino acid sequence <SEQ ID 7650>. Analysis of this protein sequence reveals the following:

Possible site: 48
>>> Seems to have no N-terminal signal sequence
----- Final Results -----
  bacterial cytoplasm --- Certainty = 0.1840 (Affirmative) <succ>
  bacterial membrane --- Certainty = 0.0000 (Not Clear) <succ>
  bacterial outside --- Certainty = 0.0000 (Not Clear) <succ>

No corresponding DNA sequence was identified in *S. agalactiae*.

The protein has homology with the following sequences in the GENPEPT database:

```
>GP:CAB53790 GB:AJ242593 gp4 [Bacteriophage A118]
Identities = 114/385 (29%), Positives = 187/385 (47%), Gaps = 23/385 (5%)
Query:   8 LNDEQLLLEASQLSDMYHQLTLDLFDQVIERIKARGSASLADNPYLWQANKLHDVGLLNA    67
             L   QL L   + D+Y  L  +LF  ++ R+K + + S ADN    WQ  KL+ V  L+
Sbjct:   3 LTPRQLDLFVQPIVDVYTGLENELFTLIVRRLKTKKNIS-ADNVLAWQIEKLNQVHALDQ    61

Query:  68 DNIKLIAKYSGIAEAQLRYIIKNEGFKIYKNTSEQLEEALGRESGV-------NSTIQDD   120
              I+ I+K SG++  +L  ++K+ G+    K      +   E+G         TI D
Sbjct:  62 QMIERISKASGVSAKKLFSVVKDAGYSDLKQVDNYFSKLA--EAGAVLPLVSDGQTIVDK   119

Query: 121 LSNYARQAIDDVHNLTNTTLPFSVIGAYQGIIQDAVAGVVTGLKTPDQAINQTVIKWFKK   180
             +   +  +  N T+       Y  II +    V+ GLKT  QA+ +TV K+ +
Sbjct: 120 VMRSYFKLAESNYKRINQTMLSQARQIYSDIIHETTQSVLAGLKTHRQALAETVTKFAEN   179

Query: 181 GFYGFTDKAGRKWRADSYARTVINTTTWRVFNEAKBAPAREFGIDTFYYSKKATAREMCA   240
             G     DKA ++W   ++Y RTV  TT    V+N  ++    E+G+D    S+    AR  C+
Sbjct: 180 GVPALVDKANKRWTPEAYVRTVTRTTVNSVYNSVEDERMNEYGVDLVRISQHVGARPTCS   239

Query: 241 PLQHQIV---TTGEAREEGGIKILALSD----YGHGEPDGCLGINCKHTKTPFVVGVNSK   293
             +Q +++     + E R + G K +++       YG+G  DG  G NC+H +   F+ G+N
Sbjct: 240 IVQGKVICLLSVEETRSKYGNKYMSIYSPELRYGYG--DGIFGCNCRHHRFAFIEGINIA   297

Query: 294 PELPEHLKNITPAQAKANANAQAKQRAIERSIRKSKELLHVAKQLGDKELIRQYQSDVRS   353
             P+  E    I  + K        +QR +ER IR +K  L   A++LGD+  +++ +  VR+
Sbjct: 298 PDESE---LIDEEENKRVYALSQQQRLMERDIRAAKRKLSAAEELGDELAVKKAKQAVRT   354

Query: 354 KQDALNYLINNNAFLHRNQAREKRY                                    378
             KQ  L  +  + L R +REK Y
Sbjct: 355 KQSKLRAFVKTHN-LTRQYSREKVY                                    378
```

Based on this analysis, it was predicted that this GAS-specific protein and its epitopes, could be useful antigens for vaccines or diagnostics.

Example 2576

A DNA sequence (GASx681) was identified in *S. pyogenes* <SEQ ID 7651> which encodes the amino acid sequence <SEQ ID 7652>. Analysis of this protein sequence reveals the following:

Possible site: 31
>>> Seems to have no N-terminal signal sequence
----- Final Results -----
  bacterial cytoplasm --- Certainty = 0.2756 (Affirmative) <succ>
  bacterial membrane --- Certainty = 0.0000 (Not Clear) <succ>
  bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2577

A DNA sequence (GASx682) was identified in *S. pyogenes* <SEQ ID 7653> which encodes the amino acid sequence <SEQ ID 7654>:

TLDNQSVIKAIGDTVDYIKKNYKRKWGK

Analysis of this protein sequence reveals the following:

Possible site: 25
>>> Seems to have a cleavable N-term signal seq.
----- Final Results -----
  bacterial outside --- Certainty = 0.3000 (Affirmative) <succ>
  bacterial membrane --- Certainty = 0.0000 (Not Clear) <succ>
  bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2578

A DNA sequence (GASx683) was identified in *S. pyogenes* <SEQ ID 7655> which encodes the amino acid sequence <SEQ ID 7656>. Analysis of this protein sequence reveals the following:

```
Possible site: 60
>>> Seems to have no N-terminal signal sequence
----- Final Results -----
    bacterial cytoplasm --- Certainty = 0.5288 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2579

A DNA sequence (GASx685) was identified in *S. pyogenes* <SEQ ID 7657> which encodes the amino acid sequence <SEQ ID 7658>:

GATEVGANRVVSGVYGEVLGV-
QIVRSRKCPKGTAYMVRKGALRIMLKRN-
TMVETDRDITKAINQIVANKHYGVYLY-
KAEKAVKITLKDAAK K

Analysis of this protein sequence reveals the following:

```
Possible site: 18
>>> Seems to have no N-terminal signal sequence
----- Final Results -----
    bacterial cytoplasm --- Certainty = 0.1750 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has homology with the following sequences in the GENPEPT database:

```
>GP:CAA59185 GB:X84706 major head protein [Bacteriophage B1]

Identities = 138/270 (51%), Positives = 186/270 (68%), Gaps = 6/270 (2%)
Query:   1   MAVGTTKMAQMLDPEVLADMIDAEVGKAIRFAPLAEVDTTLEGQPGTTLTVPK-WDYIGD      59
             M+    T +A +++PEVLA ++   E+ KA+RFAPLA+VDTTL+GQPG TL  P  + YIGD
Sbjct:   1   MSKQKTTLADLVNPEVLATIVSYELNKALRFAPLAQVDTTLQGQPGNTLKFPDPFTYIGD      60

Query:  60   AEDVAEGEAIPMTQLGFKKTTMTIKKAGKGVEITDEAILSGYGDPVGQAAKQIVEAIDHK    119
             A DVAEG  I + ++G      ++TIKKA KG EITDEA LSGYGDP+G++ KQ+  ++ +K
Sbjct:  61   AADVAEGGEISLDKIGTTTKSVTIKKAAKGTEITDEAALSGYGDPIGESNKQLGLSLANK    120

Query: 120   VDADVLDALSKSTQTVEATATVDGVSKALDIFNDEDDAETVIVMNPADASTLRLDAAKEW    179
             VD D+L A    ++QTV  A  VDGV    ALDIFNDED    V+++NP DA+ +R DA  +
Sbjct: 121   VDDDLLSAAKTTSQTOSTKANVDGVQAALDIFNEDAQAYVLIVNPKDAAKIRKDANAKN    180

Query: 180   LGATEVGANRVVSGVYGEVLGVQIVRSRKCPKGTAYMVR----KGALRIMLKRNTMVETD    235
             +G +EVGAN +++G Y +VLG QIVRS+K  +G+A M +        AL+++LKR    VETD
Sbjct: 181   IG-SEVGANALINGTYADVLGAQIVRSKKLAEGSALMFKIVSNSPALKLVLKRGVQVETD    239

Query: 236   RDITKAINQIVANKHYGVYLYKAEKAVKIT                                 265
             RDI     I A++HY  YLY   K V IT
Sbjct: 240   RDIVTKTTVITADEHYAAYLYDLTKVVNIT                                 269
```

Based on this analysis, it was predicted that this GAS-specific protein and its epitopes, could be useful antigens for vaccines or diagnostics.

Example 2580

A DNA sequence (GASx686) was identified in *S. pyogenes* <SEQ ID 7659> which encodes the amino acid sequence <SEQ ID 7660>. Analysis of this protein sequence reveals the following:

```
Possible site: 35
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2581

A DNA sequence (GASx687) was identified in *S. pyogenes* <SEQ ID 7661> which encodes the amino acid sequence <SEQ ID 7662>. Analysis of this protein sequence reveals the following:

```
Possible site: 54
>>> Seems to have no N-terminal signal sequence
----- Final Results -----
    bacterial cytoplasm --- Certainty = 0.2942 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2582

A DNA sequence (GASx688) was identified in *S. pyogenes* <SEQ ID 7663> which encodes the amino acid sequence <SEQ ID 7664>. Analysis of this protein sequence reveals the following:

```
Possible site: 21
>>> Seems to have no N-terminal signal sequence
----- Final Results -----
    bacterial cytoplasm --- Certainty = 0.2844 (Affirmative) <succ>
       bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has homology with the following sequences in the GENPEPT database:

```
>GP:AAC00538 GB:L02496 unknown protein [Bacteriophage LL-H]
Identities = 35/86 (40%), Positives = 48/86 (55%), Gaps = 6/86 (6%)
Query:  24    KLIMNNQVMMSMNPYVPYRDGALRGSSRANSVGVTWSGPHARAQFYGGAYNKYKSFKFKK      83
              +L + NQ+   M  YVP R G LR  S  N  G+ ++  +ARAQFYG         + +
Sbjct:  20    RLQVLNQMHQDMEQYVPKRAGFLRSQSFVNDTGIHYTAKYARAQFYGFV----NGHRVRN    75

Query:  84    YTTPGTGKRWDKRALANATIVKDWEK                                    109
              Y+TPGTG+RWD +  A A     DW+K
Sbjct:  76    YSTPGTGRRWDLK--AKAVYKADWQK                                    99
```

Based on this analysis, it was predicted that this GAS-specific protein and its epitopes, could be useful antigens for vaccines or diagnostics.

Example 2583

A DNA sequence (GASx689) was identified in *S. pyogenes* <SEQ ID 7665> which encodes the amino acid sequence <SEQ ID 7666>. Analysis of this protein sequence reveals the following:

```
Possible site: 45
>>> Seems to have no N-terminal signal sequence
----- Final Results -----
    bacterial cytoplasm --- Certainty = 0.2892 (Affirmative) <succ>
       bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has homology with the following sequences in the GENPEPT database:

Based on this analysis, it was predicted that this GAS-specific protein and its epitopes, could be useful antigens for vaccines or diagnostics.

Example 2584

A DNA sequence (GASx690) was identified in *S. pyogenes* <SEQ ID 7667> which encodes the amino acid sequence <SEQ ID 7668>. Analysis of this protein sequence reveals the following:

```
Possible site: 18
>>> Seems to have no N-terminal signal sequence
----- Final Results -----
    bacterial cytoplasm --- Certainty = 0.1626 (Affirmative) <succ>
       bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has homology with the following sequences in the GENPEPT database:

```
>GP:CAA66741 GB:X98106 minor capsid protein [Bacteriophage phigle]
Identities = 36/109 (33%), Positives = 64/109 (58%), Gaps = 2/109 (1%)
Query:  17    DLGIKPRLDYLTRQEDLATYPMPGGKVNNEYMDGTREISLPFEIAIKTKNQELASTVMWT    76
              +L +K   L YLT  +  L++YP+PG +V +E    G ++   + +E+ ++TKNQ+ A+T +W
Sbjct:  16    NLPMKCTLGYLTAADSLSLYPLPGSRVLDEDYAGNQQWQMNYEVGMRTKNQQQANTTLWL    75

Query:  77    INSALSNFDL-KLPSLNHSYTFISLDVE-KPFLNDLSDQGFYIYVLDIT             123
              ++ AL     L S N S+ F SL +  +P +++   QG+  Y L  +
Sbjct:  76    VSQALDVLTADDLVSSNGSFEFESLTINGQPSISEQDTQGYSTYQLSFS             124
```

```
>GP:CAB53798 GB:AJ242593 major tail shaft protein [Bacteriophage A118]
Identities = 54/133 (40%), Positives = 77/133 (57%), Gaps = 9/133 (6%)
Query: 1    MRQKNALRGHFIAPYVKGEEKTEVTKEKLLELARWIKDISDDTDEKTEDEAYYDGDGTEE    60
            MR KNA   + +A  V G  + +  +     L++WI ++SDD  + TE++  YDGDG E+
Sbjct: 1    MRIKNAKTKYSVAEIVAGAGEPDWKR-----LSKWITNVSDDGSDNTEEQGDYDGDGNEK    55

Query: 61   TTVVGVKGAYTFEGTYDPEDKAQAHIASLKYKLGDERKVWHLIVSADGKTQWLGVATVTE   120
            T V+G   AYTFEGT+D ED+AQ  I + K +  + R +   I   D +T  +G ATV+E
Sbjct: 56   TVVLGYSEAYTFEGTHDREDEAQNLIVA-KRRTPENRSIMFKIEIPDTETA-IGKATVSE   113

Query: 121  I--IAGSGAAARF                                                131
            I   AG G A  F
Sbjct: 114  IKGSAGGGDATEF                                                126
```

Based on this analysis, it was predicted that this GAS-specific protein and its epitopes, could be useful antigens for vaccines or diagnostics.

```
Possible site: 61
>>> Seems to have no N-terminal signal sequence
----- Final Results -----
  bacterial cytoplasm --- Certainty = 0.3438 (Affirmative) <succ>
    bacterial membrane --- Certainty = 0.0000 (Not Clear) <succ>
      bacterial outside --- Certainty = 0.0000 (Not Clear) <succ>
```

No corresponding DNA sequence was identified in *S. agalactiae.*

The protein has homology with the following sequences in the GENPEPT database:

```
>GP:CAB53801 GB:AJ242593 gp15 [Bacteriophage A118]
Identities = 67/191 (35%), Positives = 110/191 (57%), Gaps = 17/191 (8%)
Query: 11   FEFRGEIYPIDLSFNKVLDVFDVIDDDFLNEAEKCFLCLDILLDRTDLPFTYAVD-----    65
            +E+ G+ Y +DL+F+ VL V D+ +D+ L++  +  L +D+L    D+P+  + +
Sbjct: 12   YEYEGKEYKLDLAFDNVLRVIDLTEDNSLSDVFRANLAIDVLF-ADDMPWPRSNEEDEYA    70

Query: 66   -------LWVYIKTNFIDAERPEKPQLDIKGNPMPVVKEKEDNKKVI---DLSLDAEFIY   115
                   + + I TN+I  E  +     DI GN MP      D+ + I    L+ DA++IY
Sbjct: 71   NIEEKSLVLIDIFTNYIVKENDDGLLYDIDGNKMPSATNNNDDAEEIASYSLTQDADYIY   130

Query: 116  ASFRQAYQINLLKEQNRLSWIEFKALLNALPDDTVMQR11AIRQWE-DDGEGSKKYRDNM   174
            ASF Q Y I+LL  + ++ W +F+ALL +L DDT ++ II IRQ E   G+G++K R+ +
Sbjct: 131  ASFLQDYNIDLLDSRGKMHWYKFRALLESLRDDTTIKTIIGIRQAELPSGKGTEKERNEL   190

Query: 175  RKLKAKYSLDE                                                  185
             KLK +Y L +
Sbjct: 191  IKLKNRYKLKD                                                  201
```

```
Possible site: 17
>>> Seems to have no N-terminal signal sequence
----- Final Results -----
  bacterial cytoplasm --- Certainty = 0.3521 (Affirmative) <succ>
    bacterial membrane --- Certainty = 0.0000 (Not Clear) <succ>
      bacterial outside --- Certainty = 0.0000 (Not Clear) <succ>
```

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

Example 2585

A DNA sequence (GASx691) was identified in *S. pyogenes* <SEQ ID 7669> which encodes the amino acid sequence <SEQ ID 7670>. Analysis of this protein sequence reveals the following:

Based on this analysis, it was predicted that this GAS-specific protein and its epitopes, could be useful antigens for vaccines or diagnostics.

Example 2586

A DNA sequence (GASx692) was identified in *S. pyogenes* <SEQ ID 7671> which encodes the amino acid sequence <SEQ ID 7672>. Analysis of this protein sequence reveals the following:

Example 2587

A DNA sequence (GASx694) was identified in *S. pyogenes* <SEQ ID 7673> which encodes the amino acid sequence <SEQ ID 7674>. Analysis of this protein sequence reveals the following:

```
Possible site: 29
>>> Seems to have no N-terminal signal sequence
----- Final Results -----
  bacterial cytoplasm --- Certainty = 0.4143 (Affirmative) <succ>
    bacterial membrane --- Certainty = 0.0000 (Not Clear) <succ>
      bacterial outside --- Certainty = 0.0000 (Not Clear) <succ>
```

No corresponding DNA sequence was identified in *S. agalactiae.*

The protein has homology with the following sequences in the GENPEPT database:

```
>GP:AAG18639 GB:AY007505 unknown [Streptococcus mitis]
Identities = 48/157 (30%), Positives = 85/157 (53%), Gaps = 10/157 (6%)
Query:  86   DLELSWEPDYIYKATHITPFSIKEVLRNFGRLKINFLIHPIKYLKTGKQEVPLVNG-GTL    144
             +LE S+ P+ ++ A H    S K    +   +LKI    + P +Y KT    E    NG GT+
Sbjct:  81   ELEFSYHPESVFYA-HFLTASYKPFGNHAWQLKIKLNMQPFRYQKTVNPES--YNGPGTI    137

Query: 145   QNPONVQAKPILKIKGTGNGILTINDFETGLENVQSELVIDMERHLVYKDVLSAWDNIVR    204
                 NPG + ++PI++++G G+   +TI    ET    NV+++  ID  +    +++ +A    +
Sbjct: 138   NNPGTIYSEPIIEVQGDGDVSITIGR-ETMYLNVKTKATIDCRQG--RQNIYNATGAVQN    194

Query: 205   TERHRMPLFDV--GQNKISWTGS-FTITAVPNWGVKV                         238
             T  R  R    F++   G++ I++TG+    +    PNW     K+
Sbjct: 195   TLRKRGGFFEIPTGRSGITFTGNVLRLIIRPNWRYKI                         231
```

Based on this analysis, it was predicted that this GAS-specific protein and its epitopes, could be useful antigens for vaccines or diagnostics.

Example 2588

A DNA sequence (GASx695R) was identified in *S. pyogenes* <SEQ ID 7675> which encodes the amino acid sequence <SEQ ID 7676>. Analysis of this protein sequence reveals the following:

---

Possible site: 15
>>> Seems to have no N-terminal signal sequence
INTEGRAL    Likelihood = −2.60    Transmembrane 15-31 (15-31)
----- Final Results -----
  bacterial membrane --- Certainty = 0.2041 (Affirmative) <succ>
  bacterial outside --- Certainty = 0.0000 (Not Clear) <succ>
  bacterial cytoplasm --- Certainty = 0.0000 (Not Clear) <succ>

---

Example 2589

A DNA sequence (GASx697) was identified in *S. pyogenes* <SEQ ID 7677> which encodes the amino acid sequence <SEQ ID 7678>. Analysis of this protein sequence reveals the following:

---

Possible site: 22
>>> Seems to have no N-terminal signal sequence
----- Final Results -----
  bacterial cytoplasm --- Certainty = 0.3348 (Affirmative) <succ>
  bacterial membrane --- Certainty = 0.0000 (Not Clear) <succ>
  bacterial outside --- Certainty = 0.0000 (Not Clear) <succ>

---

No corresponding DNA sequence was identified in *S. agalactiae*.

The protein has homology with the following sequences in the GENPEPT database:

```
>GP:AAA86895 GB:U28144 hyaluronidase [Streptococcus pyogenes]
Identities = 326/337 (96%), Positives = 329/337 (96%)
Query:   1   MSENIPLRVQFKRMKAAEWARSDVILLESEIGFETDTGFARAGDGHNRFSDLGYISPLDY    60
             MSENIPLRVQFKRMKAAEWARSDVILLESEIGFETDTGFARAGDGHNRFSDLGYISPLDY
Sbjct:   1   MSENIPLRVQFKRMKAAEWARSDVILLESEIGFETDTGFARAGDGHNRFSDLGYISPLDY    60

Query:  61   NLLTNKPNIDGLATKVETAQKLQQKADKETVYTKAESKQELDKKLNLKGGVMTGQLKFKP    120
             NLLTNKPNIDGLATKVETAQKLQQKADKETVYTKAESKQELDKKLNLKGGVMTGQLKFKP
Sbjct:  61   NLLTNKPNIDGLATKVETAQKLQQKADKETVYTKAESKQELDKKLNLKGGVMTGQLKFKP    120

Query: 121   AATVAYSSSTGGAVNIDLSSTRGAGVVVYSDNDTSDGPLMSLRTGKETFNQSALFVDYKG    180
             AATVAYSSSTGGAVNIDLSSTRGAGVVVYSDNDTSDGPLMSLRTGKETFNQSALFVDYKG
Sbjct: 121   AATVAYSSSTGGAVNIDLSSTRGAGVVVYSDNDTSDGPLMSLRTGKETFNQSALFVDYKG    180

Query: 181   TTNAVNIAMRQPTTPNFSSALNITSGNENGSAMQLRGSEKALGTLKITHENPSIGADYDK    240
             TTNAVNIAMR  TTPNFSSALNITSGNENGSAMQLRGSEKALGTLKITHENPSIGADYDK
Sbjct: 181   TTNAVNIAMRHATTPNFSSALNITSGNENGSAMQLRGSEKALGTLKITHENPSIGADYDK    240

Query: 241   NAAALSIDIVKKTNGAGTAAQGIYINSTSGTTGKLLRIRNLSDDKFYVKSDGGFYAKETS    300
             NAA   + + K+ NGAGTAAQGIYINSTSGTTGKLLRIRNLSDDKFYVKSDGGFYAKETS
Sbjct: 241   NAARYPLILSKRQNGAGTAAQGIYINSTSGTTGKLLRIRNLSDDKFYVKSDGGFYAKETS    300

Query: 301   QIDGNLKLKDPTANDHAATKAYVDKAISELKKLILKK                         337
             QIDGNLKLKDPTANDHAATKAYVDKAISELKKLILKK
Sbjct: 301   QIDGNLKLKDPTANDHAATKAYVDKAISELKKLILKK                         337
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Based on this analysis, it was predicted that this GAS-specific protein and its epitopes, could be useful antigens for vaccines or diagnostics.

Example 2590

A DNA sequence (GASx698) was identified in *S. pyogenes* <SEQ ID 7679> which encodes the amino acid sequence <SEQ ID 7680>. Analysis of this protein sequence reveals the following:

Possible site: 17
>>> Seems to have no N-terminal signal sequence
----- Final Results -----
    bacterial cytoplasm --- Certainty = 0.4208 (Affirmative) <succ>
    bacterial membrane --- Certainty = 0.0000 (Not Clear) <succ>
        bacterial outside --- Certainty = 0.0000 (Not Clear) <succ>
RGD motif 54-56

No corresponding DNA sequence was identified in *S. agalactiae*.

The protein has homology with the following sequences in the GENPEPT database:

```
>GP:AAA98102 GB:M19348 ORF [Streptococcus pyogenes phage H4489A]

Identities = 250/648 (38%), Positives = 351/648 (53%), Gaps = 75/648 (11%)
Query: 1     MSRDPTLILDESNLVIGKDGRVHYTFTTEDDNPKVRLASKCLGTAHFNQLMIERGDQATS    60
             MSRDPT  ++E +L    DGR + TF + +  VRL S CLG     +L +E  +
Sbjct: 1     MSRDPTYTINEHDLSFA-DGRFYVTFKADKSSETVRLNSSCLGNTIIKKLQVEDDNTMBD  59

Query: 61    YVAPVVVEGTGNPTGLFKDLKEISLELTDTANSQLWSKIKLTNRGMLQEYYDGKIKTEIV   120
             +V P V   T     GL + +KE+ L+L D   S LW KIK  N+ ML EY + ++ + I
Sbjct: 60    FVKPKVT--TQQAFGLAQQVKELDLQLKDP-KSDLWGKIKFNNKAMLVEYANKEMSSAIA   116

Query: 121   NSARGVATRISEDTDKKLALINDTIDGIRREYRDADRKLSASYQAGIEGLKATMANDKIG   180
                SA +  ++    D++ +     T++GI++   +
Sbjct: 117   QSAEQILLQVKSIDDERYSKFEQTLNGIKQTVKSES------------------------   152

Query: 181   LQAEIKASAQGLSQKYDDELRKLSAKITTTSSGTTEAYESKLAGLRAEFTRSNQGTRTEL   240
                    ++++    L+  +D  + L  K +  S  T ++  S+L            G   + L
Sbjct: 153   ----VESARTQLASMFDSRISGLDGKYSRLSQ-TIDSLSSRLDDGVGNYSTL          199

Query: 241   ESQISGLRAVQQSTASQISQEIRDREGAVSRVQQSLESYQRRMQDAEENYSSLTHTVRGL   300
                ++SG           I  + +     VSR+ Q+ +   Q ++ +A +NYSSL+ TV+GL
Sbjct: 200   SQKVSG-----------IDLRVSNAANDVSRLSQTAQGLQSQITNANQNYSSLSQTVQGL   248

Query: 301   QSDVGSPTGKIQSRLTQLAGQIEQRVTRDGVMSIISGAGDSIKLAIQKAGGINAKMSGNE   360
             Q+ V        SR+ QL+  I   +VT+  V + I+ + D  I  AI+      + KM+G+E
Sbjct: 249   QTTVRDNQSNATSRINQLSDLISTKVTKGDVETTIAQSYDKIAFAIRDKLPAS-KMTGSE   307

Query: 361   IISAINLNSYGVTIAGKHIALDGNTTVNGTFTTKIAEAIKIRADQIIAGTIDAARIRVIN   420
             IISAINL+  GV I GK+I LDGN+ ++       K A    + A +I  G ++A+RI
Sbjct: 308   IISAINLDRSGVKITGKNITLDGNSYISNA-VIKDAHIANMDAGKINTGYLNASRIAAEA   366

Query: 421   LNASSIVGLDANFIK--AKIGY---------------AIT---DLLEGKVIKARNGAMLI   460
             +    I   A F K   A  GY                A+T     + G V+ A NGA
Sbjct: 367   ITGDKIKMDYAFFNKLTANEGYFRTLFAKNIFTTSVQAVITSASKITGGVLSATNGASRW   426

Query: 461   DLNTAKMDFNSDATINFNSKNNALVRKDGTHTAFVHFSNATPKGYTGSALYASIGITSSG   520
             DLN+A +DFN DATINFNSKNNALVRK GT+TAFVHFSNATPKGY GSALYASIGITSSG
Sbjct: 427   DLNSANIDFNRDATINFNSKNNALVRKSGTNTAFVHFSNATPKGYRGSALYASIGITSSG   486

Query: 521   DGVNSASSGRFAGLRSFRYATGYNHTAAVDQTEIYGDNVLVVDDFNITRGFKFRPDKMQK   580
             DG++SASSGRF G+R FRYA G  HTA VDQ EIYGD+++  DDFNI RGFK RP   M K
Sbjct: 487   DGIDSASSGRFCGVRFFRYAEGLQHTAKVDQAEIYGDDIVFSDDFNIDRGFKMRPSLMPK   546

Query: 581   MLDMNDLYAAVVALGRCWGHLANVGWNTAHSNFTSAVNRELNNYITKI              628
             M+D+N +Y A++ALGRCW H  N W+ + + SA+  E N +I  I
Sbjct: 547   MVDLNKMYQAILALGRCWLHANNTAWSW-NFDTRSAIIAEYNAHINNL              593
```

Based on this analysis, it was predicted that this GAS-specific protein and its epitopes, could be useful antigens for vaccines or diagnostics.

Example 2591

A DNA sequence (GASx699) was identified in *S. pyogenes* <SEQ ID 7681> which encodes the amino acid sequence <SEQ ID 7682>. Analysis of this protein sequence reveals the following:

Possible site: 36
>>> Seems to have no N-terminal signal sequence
----- Final Results -----
    bacterial cytoplasm --- Certainty = 0.3323 (Affirmative) <succ>
    bacterial membrane --- Certainty = 0.0000 (Not Clear) <succ>
        bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2592

A DNA sequence (GASx701) was identified in *S. pyogenes* <SEQ ID 7683> which encodes the amino acid sequence <SEQ ID 7684>. Analysis of this protein sequence reveals the following:

Possible site: 20
>>> Seems to have no N-terminal signal sequence
----- Final Results -----
   bacterial cytoplasm --- Certainty = 0.1017 (Affirmative) <succ>
     bacterial membrane --- Certainty = 0.0000 (Not Clear) <succ>
     bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2593

A DNA sequence (GASx702) was identified in *S. pyogenes* <SEQ ID 7685> which encodes the amino acid sequence <SEQ ID 7686>. Analysis of this protein sequence reveals the following:

Possible site: 27
>>> Seems to have an uncleavable N-term signal seq
INTEGRAL   Likelihood = −3.03   Transmembrane 2-18 (1-23)
----- Final Results -----
   bacterial membrane ---Certainty = 0.2211 (Affirmative) <succ>
     bacterial outside ---Certainty = 0.0000 (Not Clear) <succ>
     bacterial cytoplasm ---Certainty = 0.0000 (Not Clear) <succ>

No corresponding DNA sequence was identified in *S. agalactiae*.

The protein, has no significant homology with any sequences in the GENPEPT database.

Based on this analysis, it was predicted that this GAS-specific protein and its epitopes, could be useful antigens for vaccines or diagnostics.

Example 2594

A DNA sequence (GASx703) was identified in *S. pyogenes* <SEQ ID 7687> which encodes the amino acid sequence <SEQ ID 7688>. Analysis of this protein sequence reveals the following:

Possible site: 25
>>> Seems to have a cleavable N-term signal seq.
INTEGRAL   Likelihood = −3.45   Transmembrane 36-52 (36-55)
----- Final Results -----
   bacterial membrane --- Certainty = 0.2381 (Affirmative) <succ>
     bacterial outside --- Certainty = 0.0000 (Not Clear) <succ>
     bacterial cytoplasm --- Certainty = 0.0000 (Not Clear) <succ>

No corresponding DNA sequence was identified in *S. agalactiae*.

The protein has homology with the following sequences in the GENPEPT database:

```
>GP:AAC39287 GB:AF115103 orf87 gp [Streptococcus thermophilus
bacteriophage Sfi21]
Identities = 43/73 (58%), Positives = 61/73 (82%)
Query:  1    MINLKLRLQNKVTLMAILGAIFLLAQQLGIKLPSNIADIANTAVTLLVLLGVVTDPTTKG    60
             MIN KLRLQNK TL+A++ A+FL+ QQ G+ +P+NI +  NT V +LV+LG++TDPTTKG
Sbjct:  8    MINFKLRLQNKATLVALISAVFLMLQQFGLHVPNNIQEGINTLVGILVILGIITDPTTKG    67

Query: 61    LSDSEQALTYHEP                                                 73
             ++DSE+AL+Y +P
Sbjct: 68    IADSERALSYIQP                                                 80
```

Based on this analysis, it was predicted that this GAS-specific protein and its epitopes, could be useful antigens for vaccines or diagnostics.

Example 2595

A DNA sequence (GASx707R) was identified in *S. pyogenes* <SEQ ID 7689> which encodes the amino acid sequence <SEQ ID 7690>. Analysis of this protein sequence reveals the following:

Possible site: 22
>>> Seems to have an uncleavable N-term signal seq
INTEGRAL   Likelihood = −10.35   Transmembrane 9-25 (1-27)
----- Final Results -----
   bacterial membrane ---Certainty = 0.5140 (Affirmative) <succ>
     bacterial outside ---Certainty = 0.0000 (Not Clear) <succ>
     bacterial cytoplasm ---Certainty = 0.0000 (Not Clear) <succ>

No corresponding DNA sequence was identified in *S. agalactiae*.

Based on this analysis, it was predicted that this GAS-specific protein and its epitopes, could be useful antigens for vaccines or diagnostics.

Example 2596

A DNA sequence (GASx714R) was identified in *S. pyogenes* <SEQ ID 7691> which encodes the amino acid sequence <SEQ ID 7692>. Analysis of this protein sequence reveals the following:

Possible site: 26
>>> Seems to have no N-terminal signal sequence
----- Final Results -----
   bacterial cytoplasm --- Certainty = 0.1401 (Affirmative) <succ>
     bacterial membrane --- Certainty = 0.0000 (Not Clear) <succ>
     bacterial outside --- Certainty = 0.0000 (Not Clear) <succ>

No corresponding DNA sequence was identified in *S. agalactiae*.

The protein has no significant homology with any sequences in the GENPEPT database.

Example 2597

A DNA sequence (GASx715) was identified in *S. pyogenes* <SEQ ID 7693> which encodes the amino acid sequence <SEQ ID 7694>. Analysis of this protein sequence reveals the following:

---

Possible site: 20
>>> Seems to have no N-terminal signal sequence
----- Final Results -----
   bacterial cytoplasm --- Certainty = 0.0417 (Affirmative) <succ>
     bacterial membrane --- Certainty = 0.0000 (Not Clear) <succ>
       bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2598

A DNA sequence (GASx726) was identified in *S. pyogenes* <SEQ ID 7695> which encodes the amino acid sequence <SEQ ID 7696>. Analysis of this protein sequence reveals the following:

---

Possible site: 33
>>> Seems to have no N-terminal signal sequence
INTEGRAL    Likelihood = −1.17    Transmembrane 18-34 (18-35)
----- Final Results -----
   bacterial membrane --- Certainty = 0.1468 (Affirmative) <succ>
     bacterial outside --- Certainty = 0.0000 (Not Clear) <succ>
       bacterial cytoplasm --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2599

A DNA sequence (GASx728R) was identified in *S. pyogenes* <SEQ ID 7697> which encodes the amino acid sequence <SEQ ID 7698>. Analysis of this protein sequence reveals the following:

---

Possible site: 29
>>> Seems to have no N-terminal signal sequence
----- Final Results -----
   bacterial cytoplasm --- Certainty = 0.1795 (Affirmative) <succ>
     bacterial membrane --- Certainty = 0.0000 (Not Clear) <succ>
       bacterial outside --- Certainty = 0.0000 (Not Clear) <succ>

---

No corresponding DNA sequence was identified in *S. agalactiae*.

The protein has homology with the following sequences in the GENPEPT database:

```
>GP:AAF61314 GB:U96166 unknown [Streptococcus cristatus]
Identities = 149/194 (76%), Positives = 162/194 (82%)
     Query:   1 LSAIIRQSTSKRISDKRGIYLVEKLVSLAKQSYFTVTKTSPMIEEVRYYAKELLRLSERR   60
                 L  IIRQSTSKRIS+KR  YL +KL+ LAKQS+  V KTSPM+EEVRYYA+ELLRLSERR
     Sbjct:  56 LYEIIRQSTSKRISEKRIAYLTDKLIKLAKQSFCAVKKTSPMLEEVRYYAQELLRLSERR  115

Query:  61 QAIFDKMVASAQPLPEDKILRSIPSIVETTATSIIGELGAIRRFQSANQINAFIGIDFRH  120
                 Q + + MVA AQPLPE  ILRSIP I ETTATSIIGELG I RFQS NQ NAFIGID RH
     Sbjct: 116 QVVLNDMVALAQPLPEYDILRSIPGIAETTATSIIGELGDIHRFQSTNQFNAFIGIDLRH  175

Query: 121 YESGNYLAQEHITKRGNPYAPKILFKCIHDIAFASHTNPCHIADFYEKRKRQSQTASTKP  180
                 YES N+LA+EHITKRGNPYA KILFKCIH+IA ASHTNPCHIADFYEKRKRQS  ASTKP
     Sbjct: 176 YESRNFLAKEHITKRGNPYARKILFKCIHNIASASHTNPCHIADFYEKRKRQSTIASTKP  235

Query: 181 HTIASRHCLVRQCF                                                194
                 TIAS H L+R +
     Sbjct: 236 LTIASIHRLIRTMY                                                249
```

Based on this analysis, it was predicted that this GAS-specific protein and its epitopes, could be useful antigens for vaccines or diagnostics.

Example 2600

A DNA sequence (GASx729R) was identified in *S. pyogenes* <SEQ ID 7699> which encodes the amino acid sequence <SEQ ID 7700>. Analysis of this protein sequence reveals the following:

---

Possible site: 28
>>> Seems to have no N-terminal signal sequence
----- Final Results -----
   bacterial cytoplasm --- Certainty = 0.2363 (Affirmative) <succ>
     bacterial membrane --- Certainty = 0.0000 (Not Clear) <succ>
       bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2601

A DNA sequence (GASx730R) was identified in *S. pyogenes* <SEQ ID 7701> which encodes the amino acid sequence <SEQ ID 7702>. Analysis of this protein sequence reveals the following:

```
Possible site: 25
>>> Seems to have an uncleavable N-term signal seq
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2602

A DNA sequence (GASx734) was identified in *S. pyogenes* <SEQ ID 7703> which encodes the amino acid sequence <SEQ ID 7704>. Analysis of this protein sequence reveals the following:

```
Possible site: 52
>>> Seems to have no N-terminal signal sequence
----- Final Results -----
   bacterial cytoplasm --- Certainty = 0.4001 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

Based on this analysis, it was predicted that this GAS-specific protein and its epitopes, could be useful antigens for vaccines or diagnostics.

Example 2603

A DNA sequence (GASx735) was identified in *S. pyogenes* <SEQ ID 7705> which encodes the amino acid sequence <SEQ ID 7706>. Analysis of this protein sequence reveals the following:

```
Possible site: 55
>>> Seems to have no N-terminal signal sequence
INTEGRAL    Likelihood = -3.66    Transmembrane 276-292 (274-292)
----- Final Results -----
   bacterial membrane --- Certainty = 0.2466 (Affirmative) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

Based on this analysis, it was predicted that this GAS-specific protein and its epitopes, could be useful antigens for vaccines or diagnostics.

Example 2604

A DNA sequence (GASx736) was identified in *S. pyogenes* <SEQ ID 7707> which encodes the amino acid sequence <SEQ ID 7708>. Analysis of this protein sequence reveals the following:

```
Possible site: 33
>>> Seems to have no N-terminal signal sequence
----- Final Results -----
   bacterial cytoplasm --- Certainty = 0.3998 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2605

A DNA sequence (GASx737) was identified in *S. pyogenes* <SEQ ID 7709> which encodes the amino acid sequence <SEQ ID 7710>. Analysis of this protein sequence reveals the following:

```
Possible site: 60
>>> Seems to have a cleavable N-term signal seq.
INTEGRAL    Likelihood = -12.74    Transmembrane 77-93 (69- 99)
INTEGRAL    Likelihood = -4.14     Transmembrane 152-168 (151-170)
INTEGRAL    Likelihood = -1.17     Transmembrane 196-212 (194-212)
----- Final Results -----
   bacterial membrane --- Certainty = 0.6095 (Affirmative) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2606

A DNA sequence (GASx738) was identified in *S. pyogenes* <SEQ ID 7711> which encodes the amino acid sequence <SEQ ID 7712>. Analysis of this protein sequence reveals the following:

```
Possible site: 37
>>> Seems to have a cleavable N-term signal seq.
INTEGRAL    Likelihood = -13.16    Transmembrane 44-60 (39-71)
INTEGRAL    Likelihood = -10.24    Transmembrane 94-110 (81-114)
INTEGRAL    Likelihood = -7.64     Transmembrane 185-201 (179-207)
INTEGRAL    Likelihood = -7.48     Transmembrane 132-148 (130-158)
INTEGRAL    Likelihood = -2.76     Transmembrane 208-224 (204-225)
INTEGRAL    Likelihood = -0.06     Transmembrane 153-169 (152-169)
```

----- Final Results -----
   bacterial membrane --- Certainty = 0.6265 (Affirmative) <succ>
   bacterial outside --- Certainty = 0.0000 (Not Clear) <succ>
   bacterial cytoplasm --- Certainty = 0.0000 (Not Clear) < succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2607

A DNA sequence (GASx742) was identified in *S. pyogenes* <SEQ ID 7713> which encodes the amino acid sequence <SEQ ID 7714>. Analysis of this protein sequence reveals the following:

Possible site: 22
>>> Seems to have an uncleavable N-term signal seq
INTEGRAL    Likelihood = −7.80    Transmembrane 887-903 (882-906)
INTEGRAL    Likelihood = −4.88    Transmembrane 6-22 (5-23)
----- Final Results -----
   bacterial membrane --- Certainty = 0.4121 (Affirmative) <succ>
   bacterial outside --- Certainty = 0.0000 (Not Clear) <succ>
   bacterial cytoplasm --- Certainty = 0.0000 (Not Clear) <succ>

LPXTG motif: 877-881

No corresponding DNA sequence was identified in *S. agalactiae*.

The protein has homology with the following sequences in the GENPEPT database:

```
>GP:CAB46409 GB:AL096743 putative large secreted protein
[Streptomyces coelicolor A3(2)]
Identities = 231/599 (380), Positives = 329/599 (54%), Gaps = 43/599 (7%)
Query: 278  TSSNSDASSRNIVKIGEIQGASHTSPLLKKAVTVEQVVVTYL---DDSTHFYVQDLNGDG   334
            T +++ +++    V+I ++QG++  SP   + VT    +VT +     S  F++QD   D
Sbjct: 28   TPABAASAAAGPVRIHDVQGSTRLSPYAGEQVTDVAGIVTGVRGYGSSKGFWMQDPLPDA    87

Query: 335  DLATSDGIRVFAKNA-KVQVGDVLTISGEVEEFFGRGYEERKQTDLTITQIVAKAVTK-T   392
            D ATS+G+ VF    A +V VGD +T+SG V E+      G       Q+     +T+I      VT +
Sbjct: 88   DPATSEGVFVFTSRAPEVAVGDAVTVSGTVSEYVPGGTSSGNQS---LTEITRPTVTVVS   144

Query: 393  GTAQVPSPLVLGKDRIAPANIIDNDGLR-------VFDPEEDAIDYWESMEGMLVAVDDA   445
            G    +P+  +    +  A   + DG            P    A+DY+ES+EGM V V DA
Sbjct: 145  GGNAIPAATTVSARSVPRAYAPEGDGAANGSVNALPLRPGTYALDYYESLEGMNVRVADA   204

Query: 446  KILGPMKN-KEIYVLPGSSTRPLNNSGGVLLPANSYNTDVIPVLFKKGKQI----IKAGD   500
            +++G       E++V         P     G V    + NT + +      GK        GD
Sbjct: 205  RVVGASDPYTELWVTVKPWENPNRRGGTVYGSYDDQNTGRLQIQ-SLGKPADFPAADVGD   263

Query: 501  SYKGRLAGPVSYS-YGNYKVFVDDSKNMPSLMDGHLKPEKTNLQKDLSKLSIASYNIENF   559
            +   G  AGP+ Y+ YG Y  +      +  + +L  G    + E T    Q     +L++A+YN+EN
Sbjct: 264  TLAGTTAGPLDYNQYGGYTLVASE---IGALESGGTERESTRRQS-ARELAVATYNVENL   319

Query: 560  SANPSSTKDEKVKRIAESFIHDLNAPDIIGLIEVQDNNGPTDDGTTDATQSAQRLIDAIK   619
                +PS    D+        AE+ +H L +PDI+ 1 E+QDNNG TDDGT   A   +   RLIDAI
Sbjct: 320  --DPS---DDTFTAHAETIVHRLKSPDIVSLEEIQDNNGATDDGTVAADATVGRLIDAIV   374

Query: 620  KLGGPTYRYVDIAPENNVDGGQPGGNIRTGFLYQPERVSLSDKPKGGARDA--LTWVNGE   677
              GGP Y +   I P +  DGGQPGGNIR   FL+  PERVS +D+   G  A   A + V G+
Sbjct: 375  AAGGPRYDWRGIDPVDKADGGQPGGNIRQAFLFNPERVSFTDRAGGDATTATGVRKVRGK   434

Query: 678  --LNLSVGRIDPTNAAWKDVRKSLAAEFIFQGRKVVVVANHLNSKRGDNALYGCVQPVTF   735
                L   S GR+DP N  AW+D  RK  LA  EF+F+GR V  VVANH NSK GD   L          QP +
Sbjct: 435  AALTHSPGRVDPANEAWEDSRKPLAGEFVFRGRTVFVVANHFNSKGGDQGLTAQYQPPSR   494

Query: 736  KSEQRRHVLANMLAQFAKE--GAKHQANIVMLGDFNDFEFTKTIQLIE-EGDMVNLVSRH   792
                  SE +RH   A ++  F KE       A+   A++V LGD NDFEF++T +++E +G + + V
Sbjct: 495  GSETQRHAQAKVVNTFVKEILAAQKNADVVALGDINDFEFSRTARILEGDGALWSAVKSL   554

Query: 793  DISDRYSYFHQGNNQTLDNILVSRHLL--DHYEFDMVEVNSPFMEAHGRASDHDPLLLQ   849
            +  S+RYSY +QGN+Q LD ILVS  +          H  +D VHVN+ F    H + SDHDP +L+
Sbjct: 555  PRSERYSYVYQGNSQVLDQILVSPSVRRGGHLSYDSVEVNAEF---HDQISDHDPQVLR   610
```

Based on this analysis, it was predicted that this GAS-specific protein and its epitopes, could be useful antigens for vaccines or diagnostics.

Example 2608

A DNA sequence (GASx743) was identified in *S. pyogenes* <SEQ ID 7715> which encodes the amino acid sequence <SEQ ID 7716>. Analysis of this protein sequence reveals the following:

Possible site: 22
>>> Seems to have no N-terminal signal sequence
----- Final Results -----
   bacterial cytoplasm --- Certainty = 0.2437 (Affirmative) <succ>
   bacterial membrane --- Certainty = 0.0000 (Not Clear) <succ>
   bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2609

A DNA sequence (GASx756) was identified in *S. pyogenes* <SEQ ID 7717> which encodes the amino acid sequence <SEQ ID 7718>. Analysis of this protein sequence reveals the following:

---

Possible site: 18
>>> Seems to have no N-terminal signal sequence
INTEGRAL    Likelihood = −4.30    Transmembrane 10-26 (8-27)
INTEGRAL    Likelihood = −3.08    Transmembrane 51-67 (50-67)
----- Final Results -----
   bacterial membrane --- Certainty = 0.2720 (Affirmative) <succ>
      bacterial outside --- Certainty = 0.0000 (Not Clear) < succ>
         bacterial cytoplasm --- Certainty = 0.0000 (Not Clear) < succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2610

A repeated DNA sequence (GASx758) was identified in *S. pyogenes* <SEQ ID 7719> which encodes the amino acid sequence <SEQ ID 7720>. Analysis of this protein sequence reveals the following:

---

Possible site: 22
>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

---

No corresponding DNA sequence was identified in *S. agalactiae*.

The protein has homology with the following sequences in the GENPEPT database:

Based on this analysis, it was predicted that this GAS-specific protein and its epitopes, could be useful antigens for vaccines or diagnostics.

Example 2611

A DNA sequence (GASx764) was identified in *S. pyogenes* <SEQ ID 7721> which encodes the amino acid sequence. <SEQ ID 7722>. Analysis of this protein sequence reveals the following:

---

Possible site:58
>>> Seems to have no N-terminal signal sequence
INTEGRAL    Likelihood = −3.98    Transmembrane 47-63 (46-67)
----- Final Results -----
   bacterial membrane --- Certainty = 0.2593 (Affirmative) <succ>
      bacterial outside --- Certainty = 0.0000 (Not Clear) <succ>
         bacterial cytoplasm --- Certainty = 0.0000 (Not Clear) <succ>

---

A related sequence was also identified in GAS <SEQ ID 9149> which encodes the amino acid sequence <SEQ ID 9150>. Analysis of this protein sequence reveals the following:

---

Possible site: 53
>>> Seems to have no N-terminal signal sequence
INTEGRAL    Likelihood = −3.98    Transmembrane 35-51 (34-55)
----- Final Results -----
   bacterial membrane --- Certainty = 0.2593 (Affirmative) <succ>
      bacterial outside --- Certainty = 0.0000 (Not Clear) <succ>
         bacterial cytoplasm --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2612

A DNA sequence (GASx783) was identified in *S. pyogenes* <SEQ ID 7723> which encodes the amino acid sequence <SEQ ID 7724>. Analysis of this protein sequence reveals the following:

---

Possible site: 43
>>> Seems to have no N-terminal signal sequence
INTEGRAL    Likelihood = −13.16   Transmembrane 142-158 (132-167)

---

```
>GP:CAA38133 GB:X54225 7 kDa protein [Streptococcus pneumoniae]
Identities = 31/61 (50%), Positives = 41/61 (660)
Query:  1    MTNGLKYVLEQMLLLFIIAALACLFLAIGLMIGYSFMGDGQSPWHILSMDKWAELVNKFT       60
             M      YV++++LL+ I+   L   L L IGLM+GY  +G GQ PW ILS  KW EL++KFT
Sbjct:  3    MNKKSSYVVKRLLLVIIVLILGTLALGIGLMVGYGILGKGQDPWAILSPAKWQELIHKFT       62

Query: 61    G                                                                61
             G
Sbjct: 63    G                                                                63
```

-continued

| INTEGRAL | Likelihood = −12.26 | Transmembrane 113-129 (101-140) |
| INTEGRAL | Likelihood = −10.24 | Transmembrane 238-254 (233-260) |
| INTEGRAL | Likelihood = −2.76 | Transmembrane 34-50 (34-51) |

----- Final Results -----
   bacterial membrane --- Certainty.0.6265 (Affirmative) <succ>
    bacterial outside --- Certainty = 0.0000 (Not Clear) <succ>
     bacterial cytoplasm --- Certainty = 0.0000 (Not Clear) <succ>

No corresponding DNA sequence was identified in *S. agalactiae*.

The protein has homology with the following sequences in the GENPEPT database:

```
>GP:BAA32091 GB:AB010970 ABC-transporter [Streptococcus mutans]
Identities = 173/269 (64%), Positives = 214/269 (79%), Gaps = 2/269 (0%)
Query: 1   MNFLTKKNRILLREMVKTDFKLRYQGSAIGYLWSILKPLMMFTIMYLVFIRFLRLGGNVP    60
           M+F ++KNRILL+E++KTDFKLRYQGSAIGYLWSILKPLM+F IMY+VF+RFL LGG+VP
Sbjct: 1   MDFFSRKNRILLKELIKTDFKLRYQGSAIGYLWSILKPLMLFAIMYIVFVRFLPLGGDVP    60

Query: 61  HFPVALLLANVIWSFFSEATSMGMVSIVSRGDLLRKLNFSKHIIVFSAVLGALINFLINL    120
           H+PVALLL NVIW+FF E T MGMVS+V+RGDLLRKLNFSK  IVFSAV GA INF IN+
Sbjct: 61  HWPVALLLGNVIWTFFQETTMMGMVSVVTRGDLLRKLNFSKQTIVFSAVSGAAINFGINV    120

Query: 121 VVVLIFALINGVTIS--GYAYLSLFLFIELVVLVLGIALLLSNVFVYYRDLAQVWEVLLQ    178
           +VVLIFAL+NGVT +      +L + LF+EL++   GIA +LS ++V YRD+  VWEV+LQ
Sbjct: 121 IVVLIFALLNGVTFTFRWNLFLLIPLFLELLLFSTGIAFILSTLYVRYRDIGPVWEVILQ    180

Query: 179 AGMYATPIIYPITFVLDSHPLAAKLLMLNPVAQMIQDFRYLLIDRANVTIWQMSTNWFYI    238
              G Y TPIIY +T++      + AKLL+L+P+AQ+IQD R++LID ANVTIWQM +
Sbjct: 181 GGFYGTPIIYSLTYIATRSVVGAKLLLLSPIAQIIQDMRHILIDPANVTIWQMINHKSIA    240

Query: 239 VIPYLVPFVILFIGIFVFKENADRFAEII    267
           VIPYLVP + IG VF  NA +FAEII
Sbjct: 241 VIPYLVPIFVFIIGFLVFNYNAKKFAEII    269
```

Based on this analysis, it was predicted that this GAS-specific protein and its epitopes, could be useful antigens for vaccines or diagnostics.

Example 2613

A DNA sequence (GASx786) was identified in *S. pyogenes* <SEQ ID 7725> which encodes the amino acid sequence <SEQ ID 7726>. Analysis of this protein sequence reveals the following:

Possible site: 32
>>> Seems to have no N-terminal signal sequence

-continued

----- Final Results -----
   bacterial cytoplasm --- Certainty = 0.3828 (Affirmative) <succ>
    bacterial membrane --- Certainty = 0.0000 (Not Clear) <succ>
     bacterial outside --- Certainty = 0.0000 (Not Clear) <succ>

No corresponding DNA sequence was identified in *S. agalactiae*.

The protein has homology with the following sequences in the GENPEPT database:

```
>GP:BAA32094 GB:AB010970 rgpFc [Streptococcus mutans]
Identities = 381/582 (65%), Positives = 475/582 (81%), Gaps = 1/582 (0%)
Query: 1   MNRILLYVHFNKYNKISAHVYYQLEQMRSLFSKIVFISNSKVSHEDLKRLKNHCLIDEFL    60
           M R+LLYVHFNKYN++S+HV YQL QMRSLFSK++FISNS+V+  D+K L+    LID+F+
Sbjct: 1   MKRLLLYVHFNKYNRVSSHVVYQLTQMRSLFSKVIFISNSQVADADVKMLREKHLIDDFI    60

Query: 61  QRKNKGFDFSAWHDGLIIMGFDKLEEFDSLTIMNDTCFGPIWEMAPYFENFEEKETVDFW   120
           QR+N GFDF+AW DG++ +GFD+L  +DS+T MNDTCFGP+WEM    ++ FE K TVDFW
Sbjct: 61  QRQNSGFDFAAWRDGMVFVGFDELVTYDSVTTMNDTCFGPLWEMYSIYQEFETKTTVDFW   120

Query: 121 GITNNRGTKAFKEHVQSYFMTFMNQVIQNKVFQQFWQSIIEYENVQEVIQHYETQLTSIL   180
           G+TNNR TK+F+EH+QSYF++FK  V+++  F+ FW++I EY++VQ+VI  YET++T+ L
Sbjct: 121 GLTNNRATKSFREHIQSYFISFKASVLRSTAFRDFWENIKEYQDVQKVIDQYETKVTTTL   180

Query: 181 LNEGFSYQTVFDTRKAESSFMPHPDFSYYNPTAILKHHVPFIKVKAIDANQHIAPYLLNL   240
           L+ GF Y  VFDT K ++S M H DFSYYNPTAIL H VPFIKVKAID NQHI PYLLN
Sbjct: 181 LDAGFQYDVVFDTTKEDASHMLHADFSYYNPTAILNHRVPFIKVKAIDNNQHITPYLLND   240

Query: 241 IRETTNYPIDLIVSHMSQISLPDTKYLLSQKYLNCQRLAKQTCQKVAVHLHVFYVDLLDE   300
           I++ + YPIDLIVSHMS+I+ PD  YLL  KY+ +           QKVAVHLHVFYVDLL+E
Sbjct: 241 IQKNSTYPIDLIVSHMSEINYPDFSYLLGHKYVKKRERVDLKNQKVAVHLHVFYVDLLEE   300
```

```
                              -continued
Query: 301  FLTAFENWNFHYDLFITTDSDIKRKEIKEILQRKGKTADIRVTGNRGRDIYPMLLLKDKL  360
            FLTAF+ ++F YDLFITTDSD K+ EI+EIL   G+ A + VTGN GRD+ PML LK+ L
Sbjct: 301  FLTAFKQFHFSYDLFITTDSDDKRAEIEEILSANGQEAQVFVTGNIGRDVLPMLKLKNYL  360

Query: 361  SQYDYIGHFHTKKSKEADFWAGESWRKELIDMLVKPADSILSAFETD-DIGIIIADIPSF  419
            S YD++GHFHTKKSKEADFWAG+SWR+ELIDMLVKPAD+IL+  + +  IG++IAD+P+F
Sbjct: 361  SAYDFVGHFHTKKSKEADFWAGQSWREELIDMLVKPADNILAQLQQNPKIGLVIADMPTF  420

Query: 420  FRFNKIVNAWNEHLIAQEMMSLWRKMDVKKQIDFQAMDTFVMSYGTFVWFKYDALKSLFD  479
            FR+NKIV+AWNEHLIA EM +LW+KM + K+IDF A  TFVMSYGTFVWFKYDALK LFD
Sbjct: 421  FRYNKIVDAWNEHLIAPEMNTLWQKMGMTKKIDFNAFHTFVMSYGTFVWFKYDALKPLFD  480

Query: 480  LELTQNDIPSEPLPQNSILHAIERLLVYIAWGDSYDFRIVKNPYELTPFIDNKLLNLRED  539
            L LT +D+P EPLPQNSILHAIERLL+YIAW + YDFRI KNP +LTPFIDNKLLN R +
Sbjct: 481  LNLTDDDVPEEPLPQNSILHAIERLLIYIAWNEHYDFRISKNPVDLTPFIDNKLLNERGN  540

Query: 540  EGAHTYVNENQMGGIKGALKYIIVGPAKAMKYIFLRLMEKLK                   581
             +T+V+FN MGGIKGA KYI +GPA+A+KYI   R ++K+K
Sbjct: 541  SAPNTFVDFNYMGGIKGAFKYIFIGPARAVKYILKRSLQKIK                   582
```

Based on this analysis, it was predicted that this GAS-specific protein and its epitopes, could be useful antigens for vaccines or diagnostics.

Example 2614

A DNA sequence (GASx787) was identified in *S. pyogenes* <SEQ ID 7727> which encodes the amino acid sequence <SEQ ID 7728>. Analysis of this protein sequence reveals the following:

```
Possible site: 33
>>> Seems to have a cleavable N-term signal seq.
INTEGRAL    Likelihood = -15.66   Transmembrane 202-218 (191-224)
INTEGRAL    Likelihood = -10.03   Transmembrane 340-356 (335-365)
```

-continued

```
INTEGRAL    Likelihood = -9.08    Transmembrane 270-286 (263-289)
INTEGRAL    Likelihood = -8.60    Transmembrane 124-140 (118-145)
INTEGRAL    Likelihood = -4.94    Transmembrane 377-393 (375-395)
INTEGRAL    Likelihood = -3.29    Transmembrane 291-307 (290-311)
INTEGRAL    Likelihood = -2.87    Transmembrane 160-176 (159-180)
INTEGRAL    Likelihood = -2.66    Transmembrane 50-66 (48-66)
INTEGRAL    Likelihood = -1.28    Transmembrane 77-93 (76-93)
INTEGRAL    Likelihood = -0.69    Transmembrane 229-245 (229-245)
----- Final Results -----
   bacterial membrane --- Certainty = 0.7262 (Affirmative) <succ>
     bacterial outside --- Certainty = 0.0000 (Not Clear) <succ>
       bacterial cytoplasm --- Certainty = 0.0000 (Not Clear) <succ>
```

No corresponding DNA sequence was identified in *S. agalactiae.*

The protein has homology with the following sequences in the GENPEPT database:

```
>GP:BAA32095 GB:AB010970 ORF7 [Streptococcus mutans]
Identities = 374/775 (48%), Positives = 525/775 (67%), Gaps = 7/775 (0%)
Query: 53   VSFVGYIISLIGLSYYLSRQVSRQLFLKTSFIVISYLIVSYWVQITQHLNDKRFDIWSLT    112
            V  V Y++S++GLS+YLS+ + +  F++       Y+++SY++ +T+ LN++ F IW L
Sbjct: 30   VCLVIYVLSILGLSFYLSKNLKKTFFIELLLGYGLYIVISYFLAVTRELNNESFKIWDLA     89

Query: 113  KNQFYQFQALPSLLIILV----MATLIKILAAYFAIEKDRFGLL-GYQGNTFSVALILAV    167
            KN F+Q    LP+L++I+      +  LI++       + +     LL  +     F +  ++
Sbjct: 90   KNHFFQPYFLPTLVLIIACTFALNYLIRVKMKRSHLSRKMTLLLENFSETEFLLTGLIVS    149

Query: 168  VPINDIHLLKLISSRFSELVTAGNSQIALLKISGLLIVLLVIFATITYVVLNALKHLKSN    227
             ++D    +KL+                 +  +LL +  LL    L++F+ I+    NA + +K N
Sbjct: 150  FILSDTLYVKLLQESLRAYYHKPLAYESLLFLYTLLT--LILFSVIVEACFNAYRSIKLN    207

Query: 228  KPSFSVAATTSLFLALVFNYTFQYGVKGDEALLGYYVFPGATLFQIVAITLVALLAYVIT    287
            +P+ S+A +SL A +FNY FQYG+K D LLG Y+ PGAT +QI+
Sbjct: 208  RPNLSLAFVSSLLFATIFNYAFQYGLKNDADLLGKYIVPGATAYQILVLTAAGFFLYLII    267

Query: 288  NRYWPTTFFLLILGTIISVVNDLKESMRSEPLLVTDFVWLQELGLVTSFVKKSVIVEMVV    347
            NRY   TF ++ILG+II+VVN LK  MR+EPLLVTDF W+  + L+   V  ++I   ++
Sbjct: 268  NRYLLVTFLIVILGSIITVVNVLKVGMRNEPLLVTDFAWVTNIRLLARSVNANIIFSTLL    327

Query: 348  GLAICIVVAWYLHGRVLAGKLFMSPVKRASAVLGLFIVECSMLIPFSYEKEGKILSGLPI    407
             LA  I++  +L  R+L GK+  +   +  + ++  S+ I F  EK  KI+++G+P+
Sbjct: 328  ILAALILLYLFLRKRLLQGKITENYRLKVGLISSICLLGFSIFIIFRNEKGSKIVNGIPV    387

Query: 408  ISALNNDNDINWLGFSTNARYKSLAYVWTRQVTKKIMEKPTNYSQETIASIAQKYQKLAE    467
            IS +NN  DI + GF +NA YKSL YVWT+QVTK IM+KP++YS+E I  +A+KY +A
Sbjct: 388  ISQVNNWVDIGYQGFYSNASYKSLMYVWTKQVTKSIMDKPSDYSKERILKLAKKYNNVAN    447

Query: 468  DINKDRKNNIADQTVIYLLSESLSDPDRVSNVTVSHDVLPNIKAIKNSTTAGLMQSDSYG    527
             INK R  NI++QTVIY+LSES SDPDRV  V +S DV+PNIK IK  TT+GLM SD YG
Sbjct: 448  KINKVRTENISNQTVIYILSESFSDPDRVQGVNLSRDVIPNIKQIKEKTTSGLMHSDGYG    507

Query: 528  GGTANMEFQTLTSLPFYNFSSSVSVLYSEVFPKMAKPHTISEFYQGKNRIAMHPASANNF    587
            GGTANMEFQ+LT LP+YNF+SSVS LY+EV P M+   +IS  ++ KNR+ +HP+SA+N+
Sbjct: 508  GGTANMEFQSLTGLPYYNFNSSVSTLYTEVVPDMSVFPSISNQFKSKNRVVIHPSSASNY    567
```

-continued

```
Query:  588  NRKTVYSNLGFSKFLALSGSKDKFKNIENVGLLTSDKTVYNNILSLINPSESQFFSVITM    647
             +RK VY  L F  F+A SG+ DK   + E VGL  SDKT Y NIL  INPS+SQFFSV+TM
Sbjct:  568  SRKYVYDKLKFPTFVASSGTSDKITHSEKVGLNVSDKTTYQNILDKINPSQSQFFSVMTM    627

Query:  648  QNHIPWSSDYPEEIVAEGKNFTEEENHNLTSYARLLSFTDKETRAFLEKLTQINKPITVV    707
             QNH+PW+SD P ++VA GK +T++EN +L+SYARLL++TDKET+ FL +L+Q+    +TVV
Sbjct:  628  QNHVPWASDEPSDVVATGKGYTKDENGSLSSYARLLTYTDKETKDFLAQLSQLKHKVTVV    687

Query:  708  FYGDHLPGLYPDSAFNKHIENKYLTDYFIWSNGTNEKKNHPLINSSDFTAALFEHTDSKV    767
             FYGDHLPGLYP+SAF K   +++Y TDYFIWSN    +   NH  +NSSDFTA L EHT+SKV
Sbjct:  688  FYGDHLPGLYPESAFKKDPDSQYQTDYFIWSNYNTKTLNHSYVNSSDFTAELLEHTNSKV    747

Query:  768  SPYYALLTEVLNKASVDKSPDSPEVKAIQNDLKNIQYDVTIGKGYLLKHKTFFKI    822
             SPYYALLTEVL+  +V     + E K I NDLK IQYD+T+GKGY+  +K FF I
Sbjct:  748  SPYYALLTEVLDNTTVGHGKLTKEQKEIANDLKLIQYDITVGKGYIRNYKGFFDI    802
```

Based on this analysis, it was predicted that this GAS-specific protein and its epitopes, could be useful antigens for vaccines or diagnostics.

Example 2615

A DNA sequence (GASx789R) was identified in *S. pyogenes* <SEQ ID 7729> which encodes the amino acid sequence <SEQ ID 7730>. Analysis of this protein sequence reveals the following:

---

Possible site: 13
>>> Seems to have no N-terminal signal sequence
INTEGRAL    Likelihood = −1.06    Transmembrane 42-58 (42-58)
----- Final Results -----
  bacterial membrane --- Certainty = 0.1426 (Affirmative) <succ>
  bacterial outside --- Certainty = 0.0000 (Not Clear) <succ>
  bacterial cytoplasm --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2616

A DNA sequence (GASx790) was identified in *S. pyogenes* <SEQ ID 7731> which encodes the amino acid sequence <SEQ ID 7732>. Analysis of this protein sequence reveals the following:

---

Possible site: 24
>>> Seems to have a cleavable N-term signal seq.
----- Final Results -----
  bacterial membrane --- Certainty = 0.3000 (Affirmative) <succ>
  bacterial outside --- Certainty = 0.0000 (Not Clear) <succ>
  bacterial cytoplasm --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2617

A DNA sequence (GASx791) was identified in *S. pyogenes* <SEQ ID 7733> which encodes the amino acid sequence <SEQ ID 7734>. Analysis of this protein sequence reveals the following:

---

Possible site: 48
>>> Seems to have a cleavable N-term signal seq.
INTEGRAL    Likelihood = −12.42    Transmembrane 166-182 (157-188)
INTEGRAL    Likelihood = −7.32     Transmembrane 85-101 (79-104)
INTEGRAL    Likelihood = −6.90     Transmembrane 397-413 (386-417)
INTEGRAL    Likelihood = −6.05     Transmembrane 253-269 (252-273)
INTEGRAL    Likelihood = −5.26     Transmembrane 301-317 (293-325)
INTEGRAL    Likelihood = −3.35     Transmembrane 363-379 (362-379)
INTEGRAL    Likelihood = −3.24     Transmembrane 335-351 (335-351)
----- Final Results -----
  bacterial membrane --- Certainty = 0.5967 (Affirmative) <succ>
  bacterial outside --- Certainty = 0.0000 (Not Clear) <succ>
  bacterial cytoplasm --- Certainty = 0.0000 (Not Clear) <succ>

---

No corresponding DNA sequence was identified in *S. agalactiae*.

The protein has homology with the following sequences in the GENPEPT database:

```
>GP:AAA64645 GB:U10927 CapF [Staphylococcus aureus]
Identities = 97/419 (23%), Positives = 186/419 (44%), Gaps = 40/419 (9%)
Query:   12  FLWNMLGSLSTAVISVILLMVVTRLLTSADSDIYAFAYSFANMMVVVGLFQVANYQATDI    71
             F +   + ++ +A+    ++L+V+  RL T D     Y +A    +   +    ++R+    T
Sbjct:    5  FNYMFVANILSALCKFLILLVIVRLGTPEDVGRYNYALVITAPIFLFISLKIRSVIVT--    62

Query:   72  NEKYSFSQYLVARLMTCLLMLAITVIYLTLTKTDSYKSTIVFLVCFYRSTDAFSDLYQGM    131
             N+KYS  ++Y+  A L    ++  L     I++  +       T   +V   +   ++   G+
Sbjct:   63  NDKYSPNEYISAILSLNIITLIFVAIFVYVLGNGDL--TTILIVSLIKLFENIKEVPYGI    120
```

-continued

```
Query: 132  FQQHERLDIAGKSLAYRNTLIFMVYTAIILYSKNLTLALVAVCIVSLVFIMYYDIGHSKK  191
            +Q++E L + G S+     N L  +++  I  +S NL +AL+ + I  +     D +  K
Sbjct: 121  YQKNESLKLLGISMGIYNILSLILFYIIYSFSHNLNMALLFLVISCIFSFAIIDRWYLSK  180

Query: 192  FQKLMFSELLSNISFQNSLKLLKESF----PLFLNGFLIIYIYTQPKYAIELMTTLGEVA  247
            + +          + + N++   KE F    PL   + L      P+  +E  +  G+
Sbjct: 181  YYNI-------KLHYNNNIAKFKEIFILTIPLAFSSALGSLNTGIPRIVLENL--FGKYT  231

Query: 248  LGS-QTIFNILFMPAFVMNLLILFFRPHITQMAIALIRGQIK-EFNKIQVQLFAYLGVF-  304
            LG   TI  +L +     N +   F  P + +      L + + KEF K+  ++  ++G+F
Sbjct: 232  LGIFSTIAYVLVIGGLFANSISQVFLPKLRK----LYKDEKKIEFEKLTRKM-VFIGIFI  286

Query: 305  SLIALVGSGLFGIPFLSILYG-----TNLTDYWVDF-MLIMLGGSIGSFATVIDNILTAM  358
            +  +++  S    G    LS+L+G       N+    + F +L +L G           +
Sbjct: 287  GMCSVILSLFLGEALLSLLFGKEYGENNIILIILSFGLLFILSGIFLGTTIIATGKYNVN  346

Query: 359  RKQQLLLIPYTGGFLISLLITNLFVMKYHILGAALSFLITMLVWLGLSIMIYLFIMNRF  417
            K  L+L+        F I L+ + L + KY +LGAAL+   I+   V L     I YF       F
Sbjct: 347  YKISLILL-----FCI-LIFSFLLIPKYSLLGAALTITISQFVAL---ISYYYFYKRIF  396
```

Based on this analysis, it was predicted that this GAS-specific protein and its epitopes, could be useful antigens for vaccines or diagnostics.

Example 2618

A DNA sequence (GASx792) was identified in *S. pyogenes* <SEQ ID 7735> which encodes the amino acid sequence <SEQ ID 7736>. Analysis of this protein sequence reveals the following:

Possible site: 36
>>> Seems to have no N-terminal signal sequence

| | | |
|---|---|---|
| INTEGRAL | Likelihood = −10.03 | Transmembrane 64-80 (60-84) |
| INTEGRAL | Likelihood = −9.66 | Transmembrane 43-59 (37-63) |
| INTEGRAL | Likelihood = −8.70 | Transmembrane 232-248 (229-251) |
| INTEGRAL | Likelihood = −8.28 | Transmembrane 410-426 (402-432) |

-continued

| | | |
|---|---|---|
| INTEGRAL | Likelihood = −6.21 | Transmembrane 298-314 (296-322) |
| INTEGRAL | Likelihood = −6.21 | Transmembrane 478-494 (471-496) |
| INTEGRAL | Likelihood = −5.04 | Transmembrane 265-281 (256-288) |
| INTEGRAL | Likelihood = −3.29 | Transmembrane 380-396 (378-397) |
| INTEGRAL | Likelihood = −2.92 | Transmembrane 210-226 (209-227) |
| INTEGRAL | Likelihood = −2.60 | Transmembrane 187-203 (187-204) |
| INTEGRAL | Likelihood = −2.50 | Transmembrane 442-458 (439-458) |
| INTEGRAL | Likelihood = −1.65 | Transmembrane 18-34 (18-35) |
| INTEGRAL | Likelihood = −1.38 | Transmembrane 165-181 (165-181) |

----- Final Results -----
bacterial membrane --- Certainty = 0.5012 (Affirmative) <succ>
bacterial outside --- Certainty = 0.0000 (Not Clear) <succ>
bacterial cytoplasm --- Certainty = 0.0000 (Not Clear) <succ>

No corresponding DNA sequence was identified in *S. agalactiae.*

The protein has homology with the following sequences in the GENPEPT database:

```
>GP:BAA19642 GB:AB002668 unnamed protein product [Actinobacillus
actinomycetemcomitans]
Identities = 116/459 (25%), Positives = 207/459 (44%), Gaps = 60/459 (13%)
Query: 69   FILVFGTISAIISPINDIPDEYVHYSRTVYISEGDINLTNNNKKLRISKDVDKLI-----  123
            FIL F  I  II+P    PDE+ H+ R   IS G I  ++   K    + K + K++
Sbjct: 16   FILTF-IIGVIITPPYQSPDEFYHFQRGYAISNGQIIPSSTEK---LDKAMMKMLSIYEG   71

Query: 124  ----KQSGKTFITSNLKATKHSTREYSYPYIKGTNAYYSFSYIPQALGILVGNALDLPIL  179
                ++  T    N         +EY        TN Y+   Y+PQALG  +G+ LDL +
Sbjct: 72   IPYRSENKVTHFLENEAQNVAWEKEYILDESANTNVYFPLIYLPQALGSFLGSTLDLSLY  131

Query: 180  LTYYFGRLCN-LISYAMLAFIAIKLSGSFKQVIAVVTLLPMNIYLAASFNQDGFAIGLVL  238
              YY  ++   L+S A+L F +++   S    + ++  LPM ++   S N D       ++
Sbjct: 132  NMYYLAKIFTLLVSIAILYFASVQYRLSIP--VLLILSLPMTMFQMGSTNPDS-----II  184

Query: 239  VTIGLFI-NLLSSKDKSNYNTKFFLYLVLCGLL------VLSKFTYFLLVCLPLFIPNEK  291
             ++ +FI +LL+    SNYN   F +   C LL      V  KF   +L+ LP FI   +
Sbjct: 185  FSLSVFIGSLLARGLDSNYN---FTHKDFCKLLFSIFLCVTVKFNMLVLLLLPFFISKRR  241

Query: 292  FGKNTKLVILKKLGGLLLIFLFAAMWFRLYGQVKTPYVADFLKEV----NVSQQVKNMLE  347
              ++  +  +  +   +L  + A              K   + +F   +    ++ +  KN L
Sbjct: 242  EIRHGSMYSIFIIILSILWIVLAMKLTEAQSHFKEGALHNFSYYIFHMDDLFEIFKNTLN  301

Query: 348  SPIVYSSIIIRHMVINLINMNNIFQFGA-LSYGITNLFPLYVCFFFFVYISNASKITINI  406
              + Y   ++R  +  L  ++  F     L +G T+L        + F++I N  K+   I
Sbjct: 302  --LTYLKSLLRMFLGVLGWVDTKFTINEYLFFGSTSLLA-----YIFLFIHNLYKLKYVI  354

Query: 407  VEKM--GIIFVISAIIGATVLAMYLTWTPVGSSTVLGVQSRYLIGIIPLVLLLFSS----  460
            V  +  G++F+ +  I      + +T+  +G++ ++GVQ RY    IP++L++FSS
Sbjct: 355  VSVLLVGVVFLFTHFI------LLITYNEIGTTQIVGVQGRY---FIPIMLIIFSSFILK  405

Query: 461  QQQKFKQIEDILSDKLAIHVSLLFILAMLM--STIFRYY                       497
            + +K    + I    + +    LFI + +    + + RYY
Sbjct: 406  KSEKTSNNKTISKYFIIVPFLFLFISSFITINTLVSRYY                       444
```

Based on this analysis, it was predicted that this GAS-specific protein and its epitopes, could be useful antigens for vaccines or diagnostics.

Example 2619

A DNA sequence (GASx797) was identified in *S. pyogenes* <SEQ ID 7737> which encodes the amino acid sequence <SEQ ID 7738>. Analysis of this protein sequence reveals the following:

```
Possible site: 49
  >>> Seems to have no N-terminal signal sequence
  ----- Final Results -----
    bacterial cytoplasm --- Certainty = 0.1491 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has homology with the following sequences in the GENPEPT database:

```
>GP:AAC83961 GB:L47648 cytidine monophosphate kinase [Bacillus subtilis]
Identities = 116/220 (52%), Positives = 156/220 (70%), Gaps = 1/220 (0%)
Query: 2    KAIKIAIDGPASSGKSTVAKIIAKNLGYTYLDTGAMYRSATYIALTHGYTGKEVALILEE    61
            K + IAIDGPA++GKSTVAKI+A+   Y Y+DTGAMYR+ TY AL         +  + E
Sbjct: 3    KKLSIAIDGPAAAGKSTVAKIVAEKKSYIYIDTGAMYRAITYAALQENVDLTDEEKLAEL    62

Query: 62   LEKNPIFFKKAKDGSQLVFLGDEDVTLAIRQNDVTNNVSWISALPEIREELVHQQRRIAQ    121
            L++  I      KDG Q VF+   DVT AIR ++++N VS  +     +REE+V +Q+++ +
Sbjct: 63   LKRTDIELITTKDG-QKVFVNGTDVTEAIRTDEISNQVSIAAKHRSVREEMVKRQQQLGE    121

Query: 122  AGGIIMDGRDIGTVVLPDAELKIFLVASVEERAERRYKENLEKGIESDFETLKEEIAARD    181
              GG++MDGRDIGT VLP+AE+KIFL+ASVEERA+RRY EN++KG +  ++ETL EEIA RD
Sbjct: 122  KGGVVMDGRDIGTHVLPNAEVKIFLLASVEERAKRRYEENVKKGFDVNYETLIEEIARRD    181

Query: 182  YKDSHRKVSPLKAAEDALIFDTTGVSIDGVVQFIQEKAEK    221
             DS R+VSPL+ AEDAL  DTT +SI V    I E  E+
Sbjct: 182  KLDSEREVSPLRKAEDALEIDTTSLSIQEVADKILEAVEQ    221
```

Based on this analysis, it was predicted that this GAS-specific protein and its epitopes, could be useful antigens for vaccines or diagnostics.

Example 2620

A DNA sequence (GASx799) was identified in *S. pyogenes* <SEQ ID 7739> which encodes the amino acid sequence <SEQ ID 7740>. Analysis of this protein sequence reveals the following:

```
Possible site: 29
  >>> Seems to have no N-terminal signal sequence
  ----- Final Results -----
    bacterial cytoplasm --- Certainty = 0.4324 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has homology with the following sequences in the GENPEPT database:

```
>GP:CAA34313 GB:X16188 ribosomal protein L35 (AA 1-66) [Bacillus
stearothermophilus]

Identities = 46/65 (70%), Positives = 51/65 (77%)
Query: 1    MPKQKTHRASAKRFKRTGSGGLKRFRAFTSHRFHGKTKKQRRHLRKAGLVSSGDFKRIKA    60
            MPK KTHR SAKRFK+T SG LKR  A+TSH F  KTKKQ+RHLRKA LVS GDFKRI+
Sbjct: 1    MPKMKTHRGSAKRFKKTASGKLKRGHAYTSHLFANKTKKQKRHLRKATLVSPGDFKRIRQ    60
```

```
Query:  61  MVTGL                                              65
            M+ L
Sbjct:  61  MLDNL                                              65
```

Based on this analysis, it was predicted that this GAS-specific protein and its epitopes, could be useful antigens for vaccines or diagnostics.

Example 2621

A DNA sequence (GASx806R) was identified in *S. pyogenes* <SEQ ID 7741> which encodes the amino acid sequence <SEQ ID 7742>. Analysis of this protein sequence reveals the following:

```
Possible site: 16
>>> Seems to have no N-terminal signal sequence
----- Final Results -----
    bacterial cytoplasm --- Certainty = 0.5361 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2622

A DNA sequence (GASx809R) was identified in *S. pyogenes* <SEQ ID 7743> which encodes the amino acid sequence <SEQ ID 7744>. Analysis of this protein sequence reveals the following:

```
Possible site: 52
>>> Seems to have no N-terminal signal sequence
INTEGRAL      Likelihood = -8.81    Transmembrane 33-49 (28-53)
----- Final Results -----
    bacterial membrane --- Certainty = 0.4524 (Affirmative) <succ>
    bacterial outside --- Certainty = 0.0000 (Not Clear) <succ>
    bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2623

A DNA sequence (GASx814R) was identified in *S. pyogenes* <SEQ ID 7745> which encodes the amino acid sequence <SEQ ID 7746>. Analysis of this protein sequence reveals the following:

```
Possible site: 33
>>> Seems to have no N-terminal signal sequence
----- Final Results -----
    bacterial cytoplasm --- Certainty = 0.0206 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2624

A DNA sequence (GASx817) was identified in *S. pyogenes* <SEQ ID 7747> which encodes the amino acid sequence <SEQ ID 7748>. Analysis of this protein sequence reveals the following:

```
Possible site: 13
>>> Seems to have an uncleavable N-term signal seq
INTEGRAL      Likelihood = -1.49    Transmembrane 16-32 (15-32)
----- Final Results -----
    bacterial membrane --- Certainty = 0.1595 (Affirmative) <succ>
    bacterial outside --- Certainty = 0.0000 (Not Clear) <succ>
    bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2625

A DNA sequence (GASx820) was identified in *S. pyogenes* <SEQ ID 7749> which encodes the amino acid sequence <SEQ ID 7750>. Analysis of this protein sequence reveals the following:

```
Possible site: 31
>>> Seems to have an uncleavable N-term signal seq
INTEGRAL      Likelihood = -7.11    Transmembrane 62-78 (59-81)
INTEGRAL      Likelihood = -6.00    Transmembrane 128-144 (123-147)
INTEGRAL      Likelihood = -2.50    Transmembrane 5-21 (3-26)
----- Final Results -----
    bacterial membrane --- Certainty = 0.3845 (Affirmative) <succ>
    bacterial outside --- Certainty = 0.0000 (Not Clear) <succ>
    bacterial cytoplasm --- Certainty = 0.0000 (Not Clear) <succ>
```

No corresponding DNA sequence was identified in *S. agalactiae*.

The protein has homology with the following sequences in the GENPEPT database:

```
>GP:AAA26653 GB:M83994 prolipoprotein signal peptidase
[Staphylococcus aureus]
Identities = 57/153 (37%), Positives = 96/153 (62%), Gaps = 6/153 (3%)
Query: 1    MKKRLFVLSLILL----VALDQLSKFWIVSHIALGEVKPFIPGIVSLTYLQNNGAAFSIL   56
            M K+ F+ + IL+     V  DQ++K+ I + + +G+     IP  +++T  +NNGAA+ IL
Sbjct: 1    MHKKYFIGTSILIAVFVVIFDQVTKYIIATTMKIGDSFEVIPHFLNITSHRNNGAAWGIL   60

Query: 57   QDQQWFFVVITVLVIGYAIYYLATHPHLNIWKQLALLLIISGGIGNFIDRLRLAYVIDMI   116
            +   FF +IT++++      +Y+         N++ Q+A+ L+ +G +GNFIDR+     V+D I
Sbjct: 61   SGKMTFFFIITIIILIALVYFFIKDAQYNLFMQVAISLLFAGALGNFIDRILTGEVVDFI   120

Query: 117  HLDF--VDFAIFNVADSYLTVGVILLLICLWKE                             147
              +   DF IFN+ADS LT+GVIL++I L K+
Sbjct: 121  DTNIFGYDFPIFNIADSSLTIGVILIIIALLKD                             153
```

Based on this analysis, it was predicted that this GAS-specific protein and its epitopes, could be useful antigens for vaccines or diagnostics.

Example 2626

A DNA sequence (GASx822R) was identified in *S. pyogenes* <SEQ ID 7751> which encodes the amino acid sequence <SEQ ID 7752>. Analysis of this protein sequence reveals the following:

Possible site: 33
>>> Seems to have no N-terminal signal sequence
----- Final Results -----
 bacterial cytoplasm --- Certainty = 0.2638 (Affirmative) <succ>
  bacterial membrane --- Certainty = 0.0000 (Not Clear) <succ>
   bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2627

A DNA sequence (GASx823R) was identified in *S. pyogenes* <SEQ ID 7753> which encodes the amino acid sequence <SEQ ID 7754>. Analysis of this protein sequence reveals the following:

Possible site: 45
>>> Seems to have no N-terminal signal sequence
----- Final Results -----
 bacterial cytoplasm --- Certainty = 0.3452 (Affirmative) <succ>
  bacterial membrane --- Certainty = 0.0000 (Not Clear) <succ>
   bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2628

A DNA sequence (GASx828) was identified in *S. pyogenes* <SEQ ID 7755> which encodes the amino acid sequence <SEQ ID 7756>. Analysis of this protein sequence reveals the following:

Possible site: 21
>>> Seems to have an uncleavable N-term signal seq
----- Final Results -----
 bacterial membrane --- Certainty = 0.0000 (Not Clear) <succ>
  bacterial outside --- Certainty = 0.0000 (Not Clear) <succ>
   bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2629

A DNA sequence (GASx836) was identified in *S. pyogenes* <SEQ ID 7757> which encodes the amino acid sequence <SEQ ID 7758>. Analysis of this protein sequence reveals the following:

Possible site: 18
>>> Seems to have no N-terminal signal sequence
----- Final Results -----
 bacterial cytoplasm --- Certainty = 0.4333 (Affirmative) <succ>
  bacterial membrane --- Certainty = 0.0000 (Not Clear) <succ>
   bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2630

A DNA sequence (GASx853R) was identified in *S. pyogenes* <SEQ ID 7759> which encodes the amino acid sequence <SEQ ID 7760>. Analysis of this protein sequence reveals the following:

Possible site: 14
>>> Seems to have no N-terminal signal sequence
----- Final Results -----
 bacterial cytoplasm --- Certainty = 0.4906 (Affirmative) <succ>

```
bacterial membrane --- Certainty = 0.0000 (Not Clear) <succ>
   bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2631

A DNA sequence (GASx854R) was identified in *S. pyogenes* <SEQ ID 7761> which encodes the amino acid sequence <SEQ ID 7762>. Analysis of this protein sequence reveals the following:

```
Possible site: 43
>>> Seems to have no N-terminal signal sequence
----- Final Results -----
   bacterial cytoplasm --- Certainty = 0.3989 (Affirmative) <succ>
      bacterial membrane --- Certainty = 0.0000 (Not Clear) <succ>
         bacterial outside --- Certainty = 0.0000 (Not Clear) <succ>
```

A related sequence was also identified in GAS <SEQ ID 9147> which encodes the amino acid sequence <SEQ ID 9148>. Analysis of this protein sequence reveals the following:

```
Possible site: 42
>>> Seems to have no N-terminal signal sequence
----- Final Results -----
   bacterial cytoplasm --- Certainty = 0.399 (Affirmative) <succ>
      bacterial membrane --- Certainty = 0.000 (Not Clear) <succ>
         bacterial outside --- Certainty = 0.000 (Not Clear) <succ>
```

No corresponding DNA sequence was identified in *S. agalactiae*.

The protein has homology with the following sequences in the GENPEPT database:

```
>GP:AAB59092 GB:M97157 pyrogenic exotoxin C [Streptococcus pyogenes]
Identities = 39/67 (58%), Positives = 53/67 (78%)
Query:   1   LMESKEIYLTKSPYIRGSLEIHSKNRKHEKINLYDAKPNSTRSDVFKKYKDNKTINMKDF   60
             LM++ +IY   SPY+ G +EI +K+ KHE+I+L+D+    TRSD+F KYKDN+ INMK+F
Sbjct: 167   LMDNYKIYDATSPYVSGRIEIGTKDGKHEQIDLFDSPNEGTRSDIFAKYKDNRIINMKNF  226

Query:  61   SHFDIYL                                                       67
             SHFDIYL
Sbjct: 227   SHFDIYL                                                      233
```

Based on this analysis, it was predicted that this GAS-specific protein and its epitopes, could be useful antigens for vaccines or diagnostics.

Example 2632

A DNA sequence (GASx855R) was identified in *S. pyogenes* <SEQ ID 7763> which encodes the amino acid sequence <SEQ ID 7764>. Analysis of this protein sequence reveals the following:

```
Possible site: 33
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2633

A DNA sequence (GASx856) was identified in *S. pyogenes* <SEQ ID 7765> which encodes the amino acid sequence <SEQ ID 7766>. Analysis of this protein sequence reveals the following:

```
Possible site: 26
>>> Seems to have no N-terminal signal sequence
----- Final Results -----
   bacterial cytoplasm --- Certainty = 0.4145 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2634

A DNA sequence (GASx862) was identified in *S. pyogenes* <SEQ ID 7767> which encodes the amino acid sequence <SEQ ID 7768>. Analysis of this protein sequence reveals the following:

```
Possible site: 19
>>> Seems to have no N-terminal signal sequence
----- Final Results -----
   bacterial cytoplasm --- Certainty = 0.6285 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2635

A DNA sequence (GASx863) was identified in *S. pyogenes* <SEQ ID 7769> which encodes the amino acid sequence <SEQ ID 7770>. Analysis of this protein sequence reveals the following:

```
Possible site: 51
>>> Seems to have no N-terminal signal sequence
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2636

A DNA sequence (GASx878) was identified in *S. pyogenes* <SEQ ID 7771> which encodes the amino acid sequence <SEQ ID 7772>. Analysis of this protein sequence reveals the following:

```
Possible site: 21
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2637

A DNA sequence (GASx887R) was identified in *S. pyogenes* <SEQ ID 7773> which encodes the amino acid sequence <SEQ ID 7774>. Analysis of this protein sequence reveals the following:

```
Possible site: 20
>>> Seems to have no N-terminal signal sequence
----- Final Results -----
   bacterial cytoplasm --- Certainty = 0.1911 (Affirmative) <succ>
      bacterial membrane --- Certainty = 0.0000 (Not Clear) <succ>
      bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2638

A DNA sequence (GASx910) was identified in *S. pyogenes* <SEQ ID 7775> which encodes the amino acid sequence <SEQ ID 7776>. Analysis of this protein sequence reveals the following:

```
Possible site: 20
>>> Seems to have no N-terminal signal sequence
----- Final Results -----
   bacterial cytoplasm --- Certainty = 0.4511 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2639

A DNA sequence (GASx911) was identified in *S. pyogenes* <SEQ ID 7777> which encodes the amino acid sequence <SEQ ID 7778>. Analysis of this protein sequence reveals the following:

```
Possible site: 52
>>> Seems to have no N-terminal signal sequence
----- Final Results -----
   bacterial cytoplasm --- Certainty = 0.2993 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has homology with the following sequences in the GENPEPT database:

```
>GP:AAC74707 GB:AE000259 glutathionine S-transferase [Escherichia coli]
Identities = 29/137 (21%), Positives = 61/137 (44%), Gaps = 9/137 (6%)
```

```
Query:   1   LPFIAKQTLKSQLIPQDNLLAESRFNEIMDFLTGDFPLVFRPMINPHRYTISQDNQALEK    60
             + ++A       QL+    N ++  +  E ++++  +     F P+  P          E+
Sbjct:  70   MQYLADSVPDRQLLAPVNSISRYKTIEWLNYIATELHKGFTPLFRP---------DTPEE   120

Query:  61   VKQASYKRMDIAMTHLDSLIGESGHVYRDQQTIADAYAYAMALWSQKTPKSYENYPHLAA   120
             K         +++  + +++  + +   +  + TIADAY + +   W+     + E    H+AA
Sbjct: 121   YKPTVRAQLEKKLQYVNEALKDEHWICGQRFTIADAYLFTVLRWAYAVKLNLEGLEHIAA   180

Query: 121   FMAKMVEDSAVQQVLNA                                             137
             FM +M E    VQ  L+A
Sbjct: 181   FMQRMAERPEVQDALSA                                             197
```

Based on this analysis, it was predicted that this GAS-specific protein and its epitopes, could be useful antigens for vaccines or diagnostics.

Example 2640

A DNA sequence (GASx932R) was identified in *S. pyogenes* <SEQ ID 7779> which encodes the amino acid sequence <SEQ ID 7780>. Analysis of this protein sequence reveals the following:

---

Possible site: 14
>>> Seems to have no N-terminal signal sequence
----- Final Results -----
   bacterial cytoplasm --- Certainty = 0.4081 (Affirmative) <succ>
     bacterial membrane --- Certainty = 0.0000 (Not Clear) <succ>
       bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2641

A DNA sequence (GASx935) was identified in *S. pyogenes* <SEQ ID 7781> which encodes the amino acid sequence <SEQ ID 7782>. Analysis of this protein sequence reveals the following:

---

Possible site: 45
>>> Seems to have no N-terminal signal sequence
----- Final Results -----
   bacterial cytoplasm --- Certainty = 0.6304 (Affirmative) <succ>
     bacterial membrane --- Certainty = 0.0000 (Not Clear) <succ>
       bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2642

A DNA sequence (GASx937) was identified in *S. pyogenes* <SEQ ID 7783> which encodes the amino acid sequence <SEQ ID 7784>. Analysis of this protein sequence reveals the following:

---

Possible site: 34
>>> Seems to have no N-terminal signal sequence
----- Final Results -----
   bacterial cytoplasm --- Certainty = 0.3503 (Affirmative) <succ>
     bacterial membrane --- Certainty = 0.0000 (Not Clear) <succ>
       bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2643

A DNA sequence (GASx938R) was identified in *S. pyogenes* <SEQ ID 7785> which encodes the amino acid sequence <SEQ ID 7786>. Analysis of this protein sequence reveals the following:

---

Possible site: 27
>>> Seems to have no N-terminal signal sequence
----- Final Results -----
   bacterial cytoplasm --- Certainty = 0.2884 (Affirmative) <succ>
     bacterial membrane --- Certainty = 0.0000 (Not Clear) <succ>
       bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2644

A DNA sequence (GASx939) was identified in *S. pyogenes* <SEQ ID 7787> which encodes the amino acid sequence <SEQ ID 7788>. Analysis of this protein sequence reveals the following:

---

Possible site: 50
>>> Seems to have no N-terminal signal sequence
----- Final Results -----
   bacterial cytoplasm --- Certainty = 0.2771 (Affirmative) <succ>
     bacterial membrane --- Certainty = 0.0000 (Not Clear) <succ>
       bacterial outside --- Certainty = 0.0000 (Not Clear) <succ>

Example 2645

A DNA sequence (GASx941) was identified in *S. pyogenes* <SEQ ID 7789> which encodes the amino acid sequence <SEQ ID 7790>. Analysis of this protein sequence reveals the following:

Possible site: 29
>>> Seems to have no N-terminal signal sequence
----- Final Results -----
  bacterial cytoplasm --- Certainty = 0.2257 (Affirmative) <succ>
    bacterial membrane --- Certainty = 0.0000 (Not Clear) <succ>
    bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2646

A DNA sequence (GASx942R) was identified in *S. pyogenes* <SEQ ID 7791> which encodes the amino acid sequence <SEQ ID 7792>. Analysis of this protein sequence reveals the following:

Possible site: 23
>>> Seems to have no N-terminal signal sequence
----- Final Results -----
  bacterial cytoplasm --- Certainty = 0.3255 (Affirmative) <succ>
    bacterial membrane --- Certainty = 0.0000 (Not Clear) <succ>
    bacterial outside --- Certainty = 0.0000 (Not Clear) <succ>

No corresponding DNA sequence was identified in *S. agalactiae*.

The protein has homology with the following sequences in the GENPEPT database:

Example 2647

A DNA sequence (GASx943R) was identified in *S. pyogenes* <SEQ ID 7793> which encodes the amino acid sequence <SEQ ID 7794>. Analysis of this protein sequence reveals the following:

Possible site: 30
>>> Seems to have no N-terminal signal sequence
----- Final Results -----
  bacterial cytoplasm --- Certainty = 0.1526 (Affirmative) <succ>
    bacterial membrane --- Certainty = 0.0000 (Not Clear) <succ>
    bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2648

A DNA sequence (GASx944) was identified in *S. pyogenes* <SEQ ID 7795> which encodes the amino acid sequence <SEQ ID 7796>. Analysis of this protein sequence reveals the following:

Possible site: 19
>>> Seems to have no N-terminal signal sequence
----- Final Results -----
  bacterial cytoplasm --- Certainty = 0.1427 (Affirmative) <succ>
    bacterial membrane --- Certainty = 0.0000 (Not Clear) <succ>
    bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

```
>GP:AAB91582 GB:AF242881 ymh [Agrobacterium tumefaciens] (ver 2)
Identities = 75/223 (33%), Positives = 116/223 (51%), Gaps = 2/223 (0%)
Query:  38   DQNSGFNKHKRVHNLVSDILNRTQNTDNIKLVIEYVCNPLRYINEVSIFEQLRTAINIPL   97
             D +    K R++N +  N +   +I  I   P R+  +  FE +R  +N  L
Sbjct:  39   DTDPQMTKRHRLYNAFASDQNSRKQRTHIIAFIRKAMKPERFARDSERFEPMRLNLNRAL   98

Query:  98   SLKGLIVSDSGQIVTTTTSKTLSEAKKRFETLDSRLKELKVHPHVLKFCTQELLQENYFH   157
             +  GL V  SG++        ++TLS+A +R   L + L     VHP VL+FC +ELL +NYFH
Sbjct:  99   AFAGLAVKASGELAAVDAAETLSQATRRALELRADLTSRGVHPDVLRFCREELLVDNYFH   158

Query: 158   AVFEASKGVFHRIRLLTGSAMDSASLIDQCFKPGEPIVIINGNKLQTLDEQSEYKGLKNL   217
             AV EA K V  +IR   TG    D A L+D+  F     P++  I  N+LQ+    E+ E  +G  NL
Sbjct: 159   AVLEAVKSVADKIRQRTGLTDDGAVLVDRAFSGDAPMLAI--NELQSESEKGEQRGFSNL   216

Query: 218   LLAIAHLYRNSKAHKLKYYNPDNLNDALTALTLMSLAHNLLDS                  260
             +      ++RN+ AH + +     + DA    ++ SL H  +D+
Sbjct: 217   VKGTFSMFRNTTAHAPRIHWQMSKEDAEDLFSMFSLMHRRIDA                  259
```

Example 2649

A DNA sequence (GASx945) was identified in *S. pyogenes* <SEQ ID 7797> which encodes the amino acid sequence <SEQ ID 7798>. Analysis of this protein sequence reveals the following:

```
Possible site: 13
>>> Seems to have no N-terminal signal sequence
----- Final Results -----
   bacterial cytoplasm --- Certainty = 0.2578 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has homology with the following sequences in the GENPEPT database:

```
>GP:AAC98430 GB:L29324 excisionase [Streptococcus pneumoniae]
Identities = 23/54 (42%), Positives = 40/54 (73%)
Query:  1   LIQQWEGLTVATAKQWATEMRDHPDFKQFVLNPTHRIVFIDYEGFKLFVQWKSR       54
            ++++W+GL    T   +W   EMR++    F   +V+NPTH++VFI+  EGF+  F++WK +
Sbjct:  21  ILKRWDGLNKYTLNRWIKEMRENRTFSMYVINPTHKLVFINLEGFESFLRWKQK       74
```

Based on this analysis, it was predicted that this GAS-specific protein and its epitopes, could be useful antigens for vaccines or diagnostics.

Example 2650

A DNA sequence (GASx946) was identified in *S. pyogenes* <SEQ ID 7799> which encodes the amino acid sequence <SEQ ID 7800>. Analysis of this protein sequence reveals the following:

```
Possible site: 16
>>Seems to have an uncleavable N-term signal seq
INTEGRAL    Likelihood = -4.99    Transmembrane 3-19 (1-23)
----- Final Results -----
   bacterial membrane --- Certainty = 0.2996 (Affirmative) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2651

A DNA sequence (GASx950) was identified in *S. pyogenes* <SEQ ID 7801> which encodes the amino acid sequence <SEQ ID 7802>. Analysis of this protein sequence reveals the following:

```
Possible site: 51
>>> Seems to have no N-terminal signal sequence
----- Final Results -----
   bacterial cytoplasm --- Certainty = 0.2211 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2652

A DNA sequence (GASx951) was identified in *S. pyogenes* <SEQ ID 7803> which encodes the amino acid sequence <SEQ ID 7804>. Analysis of this protein sequence reveals the following:

```
Possible site: 30
>>> Seems to have no N-terminal signal sequence
----- Final Results -----
   bacterial cytoplasm --- Certainty = 0.4258 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2653

A DNA sequence (GASx952) was identified in *S. pyogenes* <SEQ ID 7805> which encodes the amino acid sequence <SEQ ID 7806>. Analysis of this protein sequence reveals the following:

```
Possible site: 46
>>> Seems to have no N-terminal signal sequence
----- Final Results -----
   bacterial cytoplasm --- Certainty = 0.2476 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has homology with the following sequences in the GENPEPT database:

```
>GP:AAF74110 GB:AF212847 ORF245 [Lactococcus lactis bacteriophage ul36.2]
Identities = 82/265 (30%), Positives = 128/265 (47%), Gaps = 27/265 (10%)
Query:   1   MANQLSTQQVKRDITTDPTLLTGADIKKYFDPQNLLSEKQVGQALALCKGRNLNPFANEV    60
             MAN+L     V          L      IK+Y D      S+ ++   + LCK N+NPF  EV
Sbjct:   1   MANELGIFSVDN--------LNMTTIKQYLDGGGKASDAELVLLINLCKQNNMNPFMKEV    52

Query:  61   YIVAYKNNSGTDFSLIVSKEAFMKRAERCEGYDGFEAGITVM-RNGEMVEIEGSLKLPDD   119
             Y + Y N        ++VS++ + KRA +    + G E G+ V+ ++G +    EG+ K  +
Sbjct:  53   YFIKYGNQPA---QIVVSRDFYRKRAFQNPNFVGIEVGVIVLNKDGVLEHNEGTFKTHEQ   109

Query: 120   VLIGGWAIVYRKDRSHRYKVTVDFNEYVKLDKYGNPRSTWKSMPGTMIRKTALVQTLREA   179
                L+G  WA V+ K+         V V ++EYV++ K G+P     W + P TM+ K A  Q LR A
Sbjct: 110   ELVGAWARVHLKNTEIPVYVAVSYDEYVQM-KDGHPNKMWTNKPCTMLGKVAESQALRMA   168

Query: 180   FPDELGNMYTDIDGGDTFDAIKDVTPQETQEEVRARK---MAQIEQYKQEQ--TQKQTQK   234
               FP E     Y + +  +           P++   EV   K      AQIE + +E       +K  +
Sbjct: 169   FPAEFSGTYGEEEYPE---------PEKEPREVNGVKEPDRAQIESFDKEDYAAKKIEEL   219

Query: 235   ADTSYPVDEVSEHTDDPVQGELLDG                                     259
             + + P   EV E  T + +   E L+G
Sbjct: 220   KEKAQPQKEVVEETGEVIDEEPLEG                                     244
```

Based on this analysis, it was predicted that this GAS-specific protein and its epitopes, could be useful antigens for vaccines or diagnostics.

Example 2654

A DNA sequence (GASx953) was identified in *S. pyogenes* <SEQ ID 7807> which encodes the amino acid sequence <SEQ ID 7808>. Analysis of this protein sequence reveals the following:

---

Possible site: 13
>>> Seems to have no N-terminal signal sequence
----- Final Results -----
    bacterial cytoplasm --- Certainty = 0.3413 (Affirmative) <succ>
      bacterial membrane --- Certainty = 0.0000 (Not Clear) <succ>
        bacterial outside --- Certainty = 0.0000 (Not Clear) <succ>

---

No corresponding DNA sequence was identified in *S. agalactiae*.

The protein has homology with the following sequences in the GENPEPT database:

```
>GP:AAF74111 GB:AF212847 ORF364 [Lactococcus lactis bacteriophage ul36.2]

Identities = 67/222 (30%), Positives = 120/222 (53%), Gaps = 3/222 (1%)

Query:   1   MQELQLKVTQAQVEITDREKFEQNINEVVAKYQNYAVTAGTIKDDKQVLADLRKLKKQLS    60
             ++++++     A + I++ EKF+ +IN+VVA+Y +  +    + D++     A L KL   ++
Sbjct:  19   VEDIEIDFKPAIINILEEEKFKASINQVVAEYTGHVPSVENLTVDRKTRASLNKLITKIE    78

Query:  61   DERIKVKKELSKPADDIDGYIKQASKPLDDTIDKIATDVKEFEDHQKALRLDTVKSYLSN   120
                R ++KK ++  P  + +G+ K+A    P++ I+ I    +K+  E   QK  R      V       L
Sbjct:  79   TRRKEIKKSINVPYAEFEGWYKKAIAPMEKVIETIDAGIKKIEAEQKESRKKVVHELLVE   138

Query: 121   KASEYMLDPRIFDEKAMEYTKAGNFMADGVTLKKVTMKSLEDLVTFEYQKEQEVEKAKAT   180
              ++ +D RIF+   ++ K+ NF  + + KK  + S+ ++ E QK  E + AK +
Sbjct: 139   LTTDTEVDSRIFENFVDDWAKSSNF--NDIKPKKQLIDSITYVIDGEKQKIAEYKSAKQS   196

Query: 181   ISGQCAEYGMTDQPYIRMLKE-MTLVEVLGQIKADYLAEKQK                    221
             IS  C   +T PYIRML    T+ E++  I  D L EKQ+
Sbjct: 197   ISDFCFGNNITSTPYIRMLDSGKTVSEIMAVITEDVLFEKQR                    238
```

Based on this analysis, it was predicted that this GAS-specific protein and its epitopes, could be useful antigens for vaccines or diagnostics.

Example 2655

A DNA sequence (GASx954) was identified in *S. pyogenes* <SEQ ID 7809> which encodes the amino acid sequence <SEQ ID 7810>. Analysis of this protein sequence reveals the following:

---

Possible site: 56
>>> Seems to have no N-terminal signal sequence
----- Final Results -----
    bacterial cytoplasm --- Certainty = 0.3884 (Affirmative) <succ>
      bacterial membrane --- Certainty = 0.0000 (Not Clear) <succ>
        bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2656

A DNA sequence (GASx955) was identified in *S. pyogenes* <SEQ ID 7811> which encodes the amino acid sequence <SEQ ID 7812>. Analysis of this protein sequence reveals the following:

```
Possible site: 34
>>> Seems to have no N-terminal signal sequence
----- Final Results -----
    bacterial cytoplasm --- Certainty = 0.1777 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2657

A DNA sequence (GASx956) was identified in *S. pyogenes* <SEQ ID 7813> which encodes the amino acid sequence <SEQ ID 7814>. Analysis of this protein sequence reveals the following:

```
Possible site: 16
>>> Seems to have no N-terminal signal sequence
INTEGRAL   Likelihood = -2.44   Transmembrane 82-98 (81-98)
----- Final Results -----
    bacterial membrane --- Certainty = 0.1977 (Affirmative) <succ>
    bacterial outside --- Certainty = 0.0000 (Not Clear) <succ>
    bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2658

A DNA sequence (GASx958) was identified in *S. pyogenes* <SEQ ID 7815> which encodes the amino acid sequence <SEQ ID 7816>. Analysis of this protein sequence reveals the following:

```
Possible site: 34
>>> Seems to have no N-terminal signal sequence
----- Final Results -----
    bacterial cytoplasm --- Certainty = 0.3673 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2659

A DNA sequence (GASx960) was identified in *S. pyogenes* <SEQ ID 7817> which encodes the amino acid sequence <SEQ ID 7818>. Analysis of this protein sequence reveals the following:

```
Possible site: 36
>>> Seems to have no N-terminal signal sequence
----- Final Results -----
    bacterial cytoplasm --- Certainty = 0.1852 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2660

A DNA sequence (GASx961) was identified in *S. pyogenes* <SEQ ID 7819> which encodes the amino acid sequence <SEQ ID 7820>. Analysis of this protein sequence reveals the following:

```
Possible site: 45
>>> Seems to have no N-terminal signal sequence
----- Final Results -----
    bacterial cytoplasm --- Certainty = 0.7380 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has homology with the following sequences in the GENPEPT database:

```
>GP:AAF63071 GB:AF158600 gp137 [Streptococcus thermophilus
bacteriophage Sfi11]
Identities = 67/136 (49%), Positives = 97/136 (71%), Gaps = 2/136 (1%)
```

```
Query:   5   PEIDIQKTKSNAKRKLREYPRWRRIANDVDTQKVTATYSFEPRQPHGTPSKPVERLALNR    64
             PEID + T    KRKLREYPRWR IA+D   QK+T  ++F PR    G  +KPVE +A+ R
Sbjct:   4   PEIDEKATLKRCKRKLREYPRWREIAHDSAEQKITQEFTFMPRG--GGVNKPVENIAVRR    61

Query:  65   VSAEQELDTIERAVNGIFDPEYRLILIDKYLLTYPKTDCDIYTKLGYEKSQYYNMLDNAL   124
             V A  EL+ IE+AVNG++ P+YR ILI+KYL   PK +  I   +G+E++ +  +L+N++
Sbjct:  62   VDALNELEAIEQAVNGLYRPDYRRILIEKYLAYPPKPNWQIAQSIGFERTAFQELLNNSI   121

Query: 125   LSFSELYKEGMLLVEK                                              140
             L+F+ELY++G L+VE+
Sbjct: 122   LAFAELYRDGRLIVER                                              137
```

Based on this analysis, it was predicted that this GAS-specific protein and its epitopes, could be useful antigens for vaccines or diagnostics.

Example 2661

A DNA sequence (GASx962) was identified in *S. pyogenes* <SEQ ID 7821> which encodes the amino acid sequence <SEQ ID 7822>. Analysis of this protein sequence reveals the following:

---

Possible site: 16
>>> Seems to have no N-terminal signal sequence
----- Final Results -----
    bacterial cytoplasm --- Certainty = 0.3375 (Affirmative) <succ>
    bacterial membrane --- Certainty = 0.0000 (Not Clear) <succ>
    bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2662

A DNA sequence (GASx963R) was identified in *S. pyogenes* <SEQ ID 7823> which encodes the amino acid sequence <SEQ ID 7824>. Analysis of this protein sequence reveals the following:

---

Possible site: 48
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2663

A DNA sequence (GASx964) was identified in *S. pyogenes* <SEQ ID 7825> which encodes the amino acid sequence <SEQ ID 7826>. Analysis of this protein sequence reveals the following:

---

Possible site: 51
>>> Seems to have a cleavable N-term signal seq.
INTEGRAL    Likelihood = −6.16    Transmembrane  90-106  (89-111)
INTEGRAL    Likelihood = −5.52    Transmembrane  131-147 (129-150)
INTEGRAL    Likelihood = −0.43    Transmembrane  53-69   (52-69)
----- Final Results -----
    bacterial membrane--- Certainty = 0.3463 (Affirmative) <succ>
    bacterial outside --- Certainty = 0.0000 (Not Clear) <succ>
    bacterial cytoplasm --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2664

A DNA sequence (GASx965) was identified in *S. pyogenes* <SEQ ID 7827> which encodes the amino acid sequence <SEQ ID 7828>. Analysis of this protein sequence reveals the following:

---

Possible site: 15
>>> Seems to have no N-terminal signal sequence
----- Final Results -----
    bacterial cytoplasm --- Certainty = 0.3944 (Affirmative) <succ>
    bacterial membrane --- Certainty = 0.0000 (Not Clear) <succ>
    bacterial outside --- Certainty = 0.0000 (Not Clear) <succ>

---

No corresponding DNA sequence was identified in *S. agalactiae*.

The protein has homology with the following sequences in the GENPEPT database:

```
>GP:CAA66779 GB:X98106 Rorf172 [Bacteriophage phigle]
Identities = 36/82 (43%), Positives = 52/82 (62%), Gaps = 3/82 (3%)
Query:  18   ELTEKQQRFVDKYITTFNATESAKQAGYSEKSAYSQGQRLLKNVEIQKAMKERFLEAKDT    77
             +LT KQQ+F D+YI + NA  ++A++AGYS++SA S GQ  L    +I++ + ER    +
Sbjct:   4   KLTPKQQKFADEYIKSGNAADAARKAGYSKRSARSVGQENLTKPDIKQYIDERM---DEI    60
```

```
                             -continued
Query:  78  KGDRIQDVAETLEQDTSIARGE                                    99
                RI D   E +E  T IARGE
Sbjct:  61  ASKRIMDATEAVELLTRIARGE                                    82
```

Based on this analysis, it was predicted that this GAS-specific protein and its epitopes, could be useful antigens for vaccines or diagnostics.

Example 2665

A DNA sequence (GASx966) was identified in *S. pyogenes* <SEQ ID 7829> which encodes the amino acid sequence <SEQ ID 7830>. Analysis of this protein sequence reveals the following:

---

Possible site: 36
>>> Seems to have no N-terminal signal sequence
----- Final Results -----
  bacterial cytoplasm --- Certainty = 0.2389 (Affirmative) <succ>
  bacterial membrane --- Certainty = 0.0000 (Not Clear) <succ>
  bacterial outside --- Certainty = 0.0000 (Not Clear) <succ>

---

No corresponding DNA sequence was identified in *S. agalactiae*.

The protein has homology with the following sequences in the GENPEPT database:

Based on this analysis, it was predicted that this GAS-specific protein and its epitopes, could be useful antigens for vaccines or diagnostics.

Example 2666

A DNA sequence (GASx967) was identified in *S. pyogenes* <SEQ ID 7831> which encodes the amino acid sequence <SEQ ID 7832>. Analysis of this protein sequence reveals the following:

---

Possible site: 32
>>> Seems to have no N-terminal signal sequence
----- Final Results -----
  bacterial cytoplasm --- Certainty = 0.4899 (Affirmative) <succ>
  bacterial membrane --- Certainty = 0.0000 (Not Clear) <succ>
  bacterial outside --- Certainty = 0.0000 (Not Clear) <succ>

---

No corresponding DNA sequence was identified in *S. agalactiae*.

The protein has homology with the following sequences in the GENPEPT database:

```
>GP:CAB13115 GB:Z99110 PBSX defective prophage terminase (large subunit)
[Bacillus subtilis]

Identities = 117/417 (28%), Positives = 195/417 (46%), Gaps = 33/417 (7%)

Query:  31  YRVVKGSRGSKKSKTTALNFIVRLLKYPWANLLVIRRYSNTNKQSTYTDFKWACNQLKVT   90
            Y+ + G  GS KS  TAL  +++LLK      LVIR   +T++ ST+  F+    +L +T Sbjct:  21  YQFLVGGYGSSKSYHTALKIVLKLLKEK-RTALVIREVFDTHRDSTFALFQEVIEELGLT   79

Query:  91  HLFKFNESLPEITVKATGQKILFRGLDDELKITSITVDVGALCWAWFEEAYQIETEDKFS   150
                     S  ++      G +I+F+G+D+  K+ S     V  +    W EE +++ E Sbjct:  80  KAVASLSSPLQLRFH-NGSRIMFKGMDNPAKLKS----VHNISLIWIEECSEVKYEG---   131

Query: 151  TVVESIRGSLDAPDFFKQITVTFNPWSERHWLKRVFFDEETKR----------------   193
            + + G L  P+    + T NP   +W  R FF +E K+

Sbjct: 132  --FKELIGRLRHPELKLHMICTTNPVGTSNWTYRHFFRDERKKRFVLDDSELYEKRTIVK   189

Query: 194  ADTFSGTTTFRVNEWLDDVKRRYEDLYKTNPRRARIVCDGEWGVAEGLVFDNFEVVDFD   253
            DT+    +T    N +L +    ++ + L + +P   RI    G +GV    V    FEV+  D Sbjct: 190  GDTYYHHSTANDNLFLPESYVKQLDGLKEYDPDLYRIARKGRFGVNGIRVLPQFEVLPHD   249

Query: 254  -VEKTIQRVKET--SAGMDFGFTQDPTTLICVAVDLANKELWLYNEHYQKAMLTDHIVKM   310
             V+K I  + +       GMDFGF +      ++ +AVD    K L++Y E+YQ  M  D     +

Sbjct: 250  QVKKCIAAISKPIFRTGMDFGFEESYNAVVRLAVDPEKKYLYIYWEYYQNKMTDDRTAEE   309

Query: 311  IRDKNLHRSYIAGDSAEKRLIAEIKSKGVSGIVPSIKGKGSIMQGIQFMQGF-KIYIHPS   369
            +R+    +  I  DSAE + I    +G   +V + K  GS +Q     + ++ F  KI+

Sbjct: 310  LREFIETQELIKADSAEPKSIQYFRQQGFR-MVGARKFPGSRLQYTKKVKRFKKIFCSDR   368

Query: 370  CEHTIEEFNTYTFKQDKEGNWLNEPIDKNNHVIDAIRYALEKYHIRSNESNQFEVLR     426
            CE+ I E   T T+ +DK  G   + +     + H + AI YAL+ Y +      + +R Sbjct: 369  CENVIYELETLTYAKDKNGALIEDEFTIDPHTLSAIWYALDDYEVADMKETAHKRMR     425
```

```
>GP:AAC34397 GB:AF158600 gp502 [Streptococcus thermophilus
bacteriophage Sfill]
Identities = 67/114 (58%), Positives = 83/114 (72%)
Query:   6    FRDSTGKTKTLEFRFHREARMRYQAESLESLLTEKYKLLREMIEHHDKVQKPRIQELLDY    65
              F DSTG+    L RFHRE+R+RY+A++LE L+   ++LL+  I HH   Q PRIQELLDY
Sbjct:   7    FTDSTGQDLVLNLRFHRESRIRYRADNLEELMVNNWELLKNFINHHKLRQAPRIQELLDY    66

Query:  66    AEGNNHTISEIGRRKDDDMADVRAVHNYGKYISTLKQGYLVGNPIRVEYIDGTE         119
              A G NH + + GRRKD++MAD RAVHNYG+ IS  K GYL GNPIRVEY D  +
Sbjct:  67    ARGENHDVLKSGRRKDNEMADKRAVHNYGRMISKFKTGYLAGNPIRVEYDDNED         120
```

Based on this analysis, it was predicted that this GAS-specific protein and its epitopes, could be useful antigens for vaccines or diagnostics.

Example 2667

A DNA sequence (GASx968) was identified in *S. pyogenes* <SEQ ID 7833> which encodes the amino acid sequence <SEQ ID 7834>. Analysis of this protein sequence reveals the following:

---
Possible site: 34
>>> Seems to have no N-terminal signal sequence
----- Final Results -----
   bacterial cytoplasm --- Certainty = 0.4007 (Affirmative) <succ>
   bacterial membrane --- Certainty = 0.0000 (Not Clear) <succ>
   bacterial outside --- Certainty = 0.0000 (Not Clear) <succ>
---

No corresponding DNA sequence was identified in *S. agalactiae*.

The protein has homology with the following sequences in the GENPEPT database:

Based on this analysis, it was predicted that this GAS-specific protein and its epitopes, could be useful antigens for vaccines or diagnostics.

Example 2668

A DNA sequence (GASx969) was identified in *S. pyogenes* <SEQ ID 7835> which encodes the amino acid sequence <SEQ ID 7836>. Analysis of this protein sequence reveals the following:

---
Possible site: 21
>>> Seems to have no N-terminal signal sequence
----- Final Results -----
   bacterial cytoplasm --- Certainty = 0.5307 (Affirmative) <succ>
   bacterial membrane --- Certainty = 0.0000 (Not Clear) <succ>
   bacterial outside --- Certainty = 0.0000 (Not Clear) <succ>
---

No corresponding DNA sequence was identified in *S. agalactiae*.

The protein has homology with the following sequences in the GENPEPT database:

```
>GP:AAC34397 GB:AF158600 gp502 [Streptococcus thermophilus bacteriophage
Sfill]
Identities = 172/319 (53%), Positives = 227/319 (70%), Gaps = 9/319 (2%)

Query:   1    LIYRSMDDKTEVVRLDPREVFVIYQNNLEQSSLAGVRYYNKNQLDGTTKIVELYTDNKIL    60
              +IYRS  D+T + RL P E FVIY N+LE +S+A VRYYN+  L      +VE+YT+  I
Sbjct: 157    VIYRSEYDETRIKRLSPLETFVIYDNSLEDNSIAAVRYYNRGTLQNAKDVVEIYTNQHIY   216

Query:  61    KFEYDGDLTPIGETSSHAFGSVPITEYLNTDDGMGDYETELSLIDLYDAAQSDTANYMQD   120
              +           I  T  HAFG+VPITE+LN  DG+GDYETEL LIDLYD+A+SDTAN+M D
Sbjct: 217    TLDASDSFNEISVTP-HAFGTVPITEFLNNADGIGDYETELYLIDLYDSAESDTANHMSD   275

Query: 121    LSDAILAIIGRVSFPGYVDTAEKAIEYLRKMRKARLLNLEPPVDQDGREGSVDAKYLYKQ   180
              ++DAILAI G ++ P  +    ++        M++ RL+ L+PP   DG+EG+V A+YL K
Sbjct: 276    MADAILAIYGDLALPQGMQASD--------MKRTRLMQLKPPKSADGKEGTVKAEYLTKS   327

Query: 181    YDVQGTEAYKNRIVSDIHKFTNTPDMTDSKFAGQQSGEALKWKVFGLDQERVDMQALFEQ   240
              YDV G  EAYK R+  DIH FTNTPDM+D+  F+G  SGEALK+K+FGLDQ+RVD Q+ F Q
Sbjct: 328    YDVSGAEAYKTRLNKDIHVFTNTPDMSDNHFSGNASGEALKYKLFGLDQDRVDTQSQFTQ   387

Query: 241    SLKRRYKLIARVSQLLKEIDDFDISKLKITFTPNLPKSLQEKIEAFKALGGELSQETAMA   300
                LKRRY+L AR+   L+ E  DFD S+LKITFTPNLPKSL E++      LGG++SQETA++
Sbjct: 388    GLKRRYRLAARIGSLVNEFKDFDESRLKITFTPNLPKSLYEQVSILNDLGGQVSQETALS   447

Query: 301    ITDIVEDAKKEISLINSES                                           319
              ++  +VE+  +E+   IN ES
Sbjct: 448    LSGLVENPTEELDKINEES                                           466
```

```
>GP:AAC79543 GB:U88974 ORF28 [Streptococcus thermophilus temperate
bacteriophage 01205]
Identities = 118/309 (38%), Positives = 183/309 (59%), Gaps = 18/309 (5%)
Query: 8    YWRDRIKKEMDAK-EADDISLEQSMKQLHDYHFRNIEKEIESFYQRYADKEKIDLSEARK  66
             YW  R  +E +A  +  +   ++ ++ L++     + KE++++ Q+YA+K  + +S+A++
Sbjct: 3    YWSKRTLREREASIKKGEAEFKKELEALYNLQLSQLRKELDAYIQKYANKNGLSVSDAKR  62

Query: 67   RASELDISAYQKKAKELVAKAEKLRREGKIVTRDDFTHQENADMSIYNLAMKTNALELLR 126
             +A   D+ A++ KAK  VA                DF+ + N ++  YN +M     ELL
Sbjct: 63   KADSFDVKAFETKAKRYVADK-------------DFSPKANRELQDYNFSMSVGRQELLI 109

Query: 127  LNIDLEMQELANGEHKLTKKFLDEGYRKETEFQAGLLGLSVASQASVKSLADAVINANFK 186
              ++LE+  L+  E +LT  +L  GY+ E   +  LL  +V S  +++    A +NANF+
Sbjct: 110  QELELELLALSESERQLTNDYLTNGYKSEV-VRESLLDQTVPSGKTLEKYMKAAVNANFE 168

Query: 187  GAKWSDNIWDRQDKLRSIISQSVQSAILKGKNGLTIARDIRREFDVSASYAKRLAITEHA 246
             GA+WS+  IW RQ++LR I+   V  A+++G+NGLTIAR IR+  D S + A+RLAITEHA
Sbjct: 169  GAEWSERIWKRQEQLRKIVKTEVTRALIRGENGLTIARRIRKHMDASRTEAERLAITEHA 228

Query: 247  RVQMEVGRLSMAENGFAMFDILPEPKACDVCKDIAKH---GPYHLDKWRIGENSPPFHPY 303
             RVQ       M ENGF  F ++PE +ACD+CKDI K      P  +     IG N+PP HPY
Sbjct: 229  RVQTLAQESIMKENGFEHFKLMPESRACDICKDIGKETEKNPVKIADMEIGTNAPPIHPY 288

Query: 304  CRCAIVGVD                                                    312
             CRCA+V V+
Sbjct: 289  CRCAVVEVE                                                    297
```

Based on this analysis, it was predicted that this GAS-specific protein and its epitopes, could be useful antigens for vaccines or diagnostics.

Example 2669

A DNA sequence (GASx970) was identified in *S. pyogenes* <SEQ ID 7837> which encodes the amino acid sequence <SEQ ID 7838>. Analysis of this protein sequence reveals the following:

```
Possible site: 15
>>> Seems to have no N-terminal signal sequence
----- Final Results -----
   bacterial cytoplasm --- Certainty = 0.2091 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

Example 2670

A DNA sequence (GASx971) was identified in *S. pyogenes* <SEQ ID 7839> which encodes the amino acid sequence <SEQ ID 7840>. Analysis of this protein sequence reveals the following:

```
Possible site: 28
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>
```

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

Example 2671

A DNA sequence (GASx972) was identified in *S. pyogenes* <SEQ ID 7841> which encodes the amino acid sequence <SEQ ID 7842>. Analysis of this protein sequence reveals the following:

```
Possible site: 46
>>> Seems to have no N-terminal signal sequence
----- Final Results -----
   bacterial cytoplasm --- Certainty = 0.3226 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

Example 2672

A DNA sequence (GASx973) was identified in *S. pyogenes* <SEQ ID 7843> which encodes the amino acid sequence <SEQ ID 7844>. Analysis of this protein sequence reveals the following:

```
Possible site: 29
>>> Seems to have no N-terminal signal sequence
----- Final Results -----
   bacterial cytoplasm --- Certainty = 0.1830 (Affirmative) <succ>
```

-continued

```
        bacterial membrane --- Certainty = 0.0000 (Not Clear) <succ>
        bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2673

A DNA sequence (GASx975) was identified in *S. pyogenes* <SEQ ID 7845> which encodes the amino acid sequence <SEQ ID 7846>. Analysis of this protein sequence reveals the following:

```
Possible site: 45
>>> Seems to have no N-terminal signal sequence
----- Final Results -----
    bacterial cytoplasm --- Certainty = 0.4757 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has homology with the following sequences in the GENPEPT database:

```
>GP:BAB07248 GB:AP001519 unknown [Bacillus halodurans]

Identities = 46/134 (34%), Positives = 73/134 (54%)

Query:  23   KQPQDEKKYTDADVDAIIDKKFAKWKSEQEAEKSEAKKMAKMNEKEKADYEKQKLLDELQ     82
             K  + E+ +T  +V+ I+  + A+    ++E     EA+K+AKMN ++K +YE +KL  E +
Sbjct:  66   KPNKTERLFTQEEVNRIVKDRLARALKDKEEAIKEAEKLAKMNAEQKREYELEKLRRENE    125

Query:  83   ELKNDKTRNELTAVARQMFAESEINVNDDVLGLVVTLDAEQTKANVTTLANAFAKVIADD    142
             +LK  + R EL   A +M  E+ I  +DDVL  VV   DAEQT+  V T  +    K+
Sbjct: 126   QLKKAQMRYELGREATKMLGEAGIMADDDVLSFVVRDDAEQTQEAVKTFISLVDKLADMR   185

Query: 143   RKALVRQTTPSTGG                                                156
                K  ++    P    G
Sbjct: 186   MKEKLKGRPPKKDG                                                199
```

Based on this analysis, it was predicted that this GAS-specific protein and its epitopes, could be useful antigens for vaccines or diagnostics.

Example 2674

A DNA sequence (GASx976) was identified in *S. pyogenes* <SEQ ID 7847> which encodes the amino acid sequence <SEQ ID 7848>. Analysis of this protein sequence reveals the following:

```
Possible site: 24
>>> Seems to have no N-terminal signal sequence
----- Final Results -----
    bacterial cytoplasm --- Certainty = 0.2478 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has homology with the following sequences in the GENPEPT database:

```
>GP:AAC79545 GB:U88974 ORF30 [Streptococcus thermophilus temperate
bacteriophage 01205]
Identities = 43/119 (36%), Positives = 66/119 (55%), Gaps = 16/119 (13%)
Query:   9   SKEILHNLDYEAISVTLDSNKIG-----KKVVPAGTILAGKDKSIFEDRKQKVETVTNEE     63
             +  I+ +L Y+A+S T+DS+  G     KK + AGT++AG    SIF+DR + V
Sbjct:   9   TSNIVRSLPYKAVSATVDSSYPGVLVDGKKYIKAGTLVAGNGGSIFDDRTKSV-------    61
```

```
Query:  64  VSTKEYVDGILLTDVDLTNGDAVGSCVYRGTINADKLADSSVAENYDDLEEVLPHIVFI  122
            V K   +GI+L DVDLT  + V S +Y G +  DK+     +    D +++ LP + FI
Sbjct:  62  VENKTEPEGIVLYDVDLTIDNTV-SVLYAGEVYKDKVNGGDIT---DTVKKALPLVKFI  116
```

Based on this analysis, it was predicted that this GAS-specific protein and its epitopes, could be useful antigens for vaccines or diagnostics.

Example 2675

A DNA sequence (GASx978) was identified in *S. pyogenes* <SEQ ID 7849> which encodes the amino acid sequence <SEQ ID 7850>. Analysis of this protein sequence reveals the following:

---
Possible site: 60
>>> Seems to have no N-terminal signal sequence
----- Final Results -----
   bacterial cytoplasm --- Certainty = 0.4238 (Affirmative) <succ>
   bacterial membrane --- Certainty = 0.0000 (Not Clear) <succ>
   bacterial outside --- Certainty = 0.0000 (Not Clear) <succ>
---

No corresponding DNA sequence was identified in *S. agalactiae*.

The protein has homology with the following sequences in the GENPEPT database:

```
>GP:AAC79546 GB:U88974 ORF31 [Streptococcus thermophilus temperate
bacteriophage O1205]
Identities = 195/343 (56%), Positives = 256/343 (73%), Gaps = 1/343 (0%)
Query:   1  MALIHEIITSENIKGFYNAKNENVENTLGEKAPPPKQQLGLKLSFIKGAAGKPVTLKAAA   60
            M  LI++  +T+ NI G++NA  ENV +TLGE  FP ++QLG KLS+IKGA+G+ V LKAAA
Sbjct:   1  MGLIYDKVTASNIAGYFNALQENVSSTLGESIFPARKQLGTKLSYIKGASGQSVALKAAA   60

Query:  61  FDTKVPLRDRMAVELIDEEMPFFKEAMLVKEADRQQLNMLAQTKNNELIDTILASIYNDQ  120
            FDT V +RDR++ E+ DE+MPFFKEAMLVKE DRQQLN++  + N  L++TI+A I+ND
Sbjct:  61  FDTNVTIRDRVSAEMHDEQMPFFKEAMLVKENDRQQLNLVKDSGNAVLVNTIVAGIFNDN  120

Query: 121  ATLIAGAKARLEAMRMEVLSKGKIHIQSNGVMKDIDYGLAEDQTTKPDAKWDSAGTATPL  180
              TL+  GA+ARLEAMRM+VL+ GKI    S+GV KDIDYG+   D     W   G ATPL
Sbjct: 121  LTLVNGARARLEAMRMQVLATGKIAFTSDGVNKDIDYGVKPDHKKQVSKSWAEPG-ATPL  179

Query: 181  KDIEKAIEKMAERGFVPEAIIMNSKTFSLIKNAESTLDVVKPMAPNGAAVTKRDLNTYLE  240
             D+E AIE    E G  PE  +MN+KTF LI+ A ST+ V+KP+A +G+AVTK +L  Y+
Sbjct: 180  ADLEDAIETARELGLNPERAVMNAKTFGLIRKAASTVKVIKPLAGDGSAVTKAELENYIA  239

Query: 241  DELQIKVILKDGMFVGDDGESRKYFPDGFATLVPNGNLGYTVFGTTPEQSDLLGGEATDA  300
            D   + ++L++G +  D GE   K++PDG   TL+PNG LG TVFGTTPE+SDL     +A
Sbjct: 240  DNFGVSIVLENGTYRNDKGEVSKFYPDGHLTLIPNGPLGNTVFGTTPEESDLFADNTVNA  299

Query: 301  NVSIVETGIAITTTKTTDPVNVQTKVSMIALPSFERLEEVHII                  343
              V IV+ GIA+TTTKTTDPVNVQTKVSM+ALPSFERL++V+++
Sbjct: 300  EVEIVDNGIAVTTTKTTDPVNVQTKVSMVALPSFERLDDVYML                  342
```

Based on this analysis, it was predicted that this GAS-specific protein and its epitopes, could be useful antigens for vaccines or diagnostics.

Example 2676

A DNA sequence (GASx979) was identified in *S. pyogenes* <SEQ ID 7851> which encodes the amino acid sequence <SEQ ID 7852>. Analysis of this protein sequence reveals the following:

---
Possible site: 46
>>> Seems to have no N-terminal signal sequence
----- Final Results -----
   bacterial cytoplasm --- Certainty = 0.3319 (Affirmative) <succ>
   bacterial membrane --- Certainty = 0.0000 (Not Clear) <succ>
   bacterial outside --- Certainty = 0.0000 (Not Clear) <succ>
---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2677

A DNA sequence (GASx980) was identified in *S. pyogenes* <SEQ ID 7853> which encodes the amino acid sequence <SEQ ID 7854>. Analysis of this protein sequence reveals the following:

---
Possible site: 55
>>> Seems to have no N-terminal signal sequence
----- Final Results -----
   bacterial cytoplasm --- Certainty = 0.2385 (Affirmative) <succ>
   bacterial membrane --- Certainty = 0.0000 (Not Clear) <succ>
   bacterial outside --- Certainty = 0.0000 (Not Clear) <succ>
---

No corresponding DNA sequence was identified in *S. agalactiae*.

The protein has homology with the following sequences in the GENPEPT database:

```
>GP:AAC34404 GB:AF158600 gp113 [Streptococcus thermophilus bacteriophage
Sfi11]
Identities = 53/109 (48%), Positives = 79/109 (71%), Gaps = 4/109 (3%)
Query:  11   IVKNVKLDLGIEDDNQDQLLEMLLNRITDHFKANYGVLEIDNAFSVLEDCLIARFNRRG   70
             +++NV +DL I DDN   LL +LL RI +HFKA YGV E+D+  +F+ EDCL+ RFNRRG
Sbjct:   9   VIQNVSVDLNINDDN---LLGILLERIVNHFKAEYGVDEVDDNLAFIFEDCLVKRFNRRG   65

Query:  71   SERAKTEEVEGHKTTYYDHLNEFEPYDAMIMAKLNLIKDKSRKGGLYFL            119
             +E A++E ++GH  +YYD+ NEF+PYD M+   +L     ++++G + FL
Sbjct:  66   AEGARSESIDGHSMSYYDNENEFDPYDNMLQ-RLYGTSGQAKEGEVLFL            113
```

Based on this analysis, it was predicted that this GAS-specific protein and its epitopes, could be useful antigens for vaccines or diagnostics.

Example 2678

A DNA sequence (GASx981) was identified in *S. pyogenes* <SEQ ID 7855> which encodes the amino acid sequence <SEQ ID 7856>. Analysis of this protein sequence reveals the following:

```
Possible site: 49
 >>> Seems to have no N-terminal signal sequence
 ----- Final Results -----
      bacterial cytoplasm --- Certainty = 0.5714 (Affirmative) <succ>
      bacterial membrane --- Certainty = 0.0000 (Not Clear) <succ>
      bacterial outside --- Certainty = 0.0000 (Not Clear) <succ>
```

No corresponding DNA sequence was identified in *S. agalactiae*.

The protein has homology with the following sequences in the GENPEPT database:

```
>GP:CAA59188 GB:X84706 b3 [Bacteriophage B1]
Identities = 28/82 (34%), Positives = 49/82 (59%), Gaps = 2/82 (2%)
Query:   1   MRYADRVTFVKTT-DEQYNPDLGEYTHTEVISITKPCFVMDMGMEKSVQIFGDYQKDRKV   59
             +RY D VTF+K + D  Y+PDLGE+   E       + D+G ++SV++FGD +K  KV
Sbjct:   1   LRYLDEVTFIKESPDSHYDPDLGEWVEKEPTRTVFSANITDIGTDRSVEVFGDIKKGAKV   60

Query:  60   IYLKQPYT-KAFDYCEYEGRRY                                       80
             + +   +    +DY E++ +++
Sbjct:  61   MRMMPLFNMPKYDYIEFDNKKW                                       82
```

Example 2679

A DNA sequence (GASx982) was identified in *S. pyogenes* <SEQ ID 7857> which encodes the amino acid sequence <SEQ ID 7858>. Analysis of this protein sequence reveals the following:

```
Possible site: 14
 >>> Seems to have no N-terminal signal sequence
 ----- Final Results -----
      bacterial cytoplasm --- Certainty = 0.2509 (Affirmative) <succ>
      bacterial membrane --- Certainty = 0.0000 (Not Clear) <succ>
      bacterial outside --- Certainty = 0.0000 (Not Clear) <succ>
```

No corresponding DNA sequence was identified in *S. agalactiae*.

The protein has homology with the following sequences in the GENPEPT database:

```
>GP:AAC34406 GB:AF158600 gp114 [Streptococcus thermophilus bacteriophage
Sfi11]
Identities = 44/103 (42%), Positives = 65/103 (62%), Gaps = 5/103 (4%)
Query:  17   GLKKKLELIIKKDAVKK---IVRDNGTQLQRKMINKAVFTKGYSTGATRRSITMQIGDGG   73
             GL +  + ++K  +K    ++R  G++L+   +N+A F KGYSTGATRRSIT+Q+
Sbjct:   8   GLDEMAQSLLKNASPEKRSKVLRKYGSKLKEAAVNRAQFNKGYSTGATRRSITLQVESDK   67

Query:  74   LSVKVKPGTHYAGYLERGTRLMSKQPFVLPALKEQKVKFRKDL                  116
             +V+    T Y+GYLE GTR M  QPF+ PAL E    K ++L
Sbjct:  68   ATVEAL--TSYSGYLEVGTRKMEAQPFMKPALDEVAPKMVEEL                  108
```

Based on this analysis, it was predicted that this GAS-specific protein and its epitopes, could be useful antigens for vaccines or diagnostics.

Example 2680

A DNA sequence (GASx983) was identified in *S. pyogenes* <SEQ ID 7859> which encodes the amino acid sequence <SEQ ID 7860>. Analysis of this protein sequence reveals the following:

```
Possible site: 45
  >>> Seems to have no N-terminal signal sequence
  ----- Final Results -----
    bacterial cytoplasm --- Certainty = 0.3098 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has homology with the following sequences in the GENPEPT database:

```
>GP:AAA32612 GB:L31366 putative [Bacteriophage Tuc2009]
Identities = 88/129 (68%), Positives = 108/129 (83%)
Query: 1    MIKTRDQSIFDEMFKRIQSLGFKVYDYKPMTEVPYPFVEMESTDAEYIPNKDDIKGSVEL   60
            MIKTRDQSIFDE+FKRIQ+LG+ VYDYKPM EV YPFVE+E+T   +  NK DIKG+V L
Sbjct: 1    MIKTRDQSIFDELFKRIQALGYTVYDYKPMNEVGYPFVELENTQTIHEANKTDIKGTVSL   60

Query: 61   MLSVWGVQKKRKQVSDMASAIFSQALTVESSDVFRWSLNTRQSSIQMLDDTTTVTPLKRA   120
             LSVWG+QKKRK+VSDMAS IF+QAL + ++D + W+LN++ S+IQMLDDTTT TPLKRA
Sbjct: 61   SLSVWGLQKKRKEVSDMASNIFNQALNISATDGYSWALNSQASTIQMLDDTTTHTPLKRA   120

Query: 121  IVTLRFNLR   129
            ++ L F LR
Sbjct: 121  LINLEFRLR   129
```

Based on this analysis, it was predicted that this GAS-specific protein and its epitopes, could be useful antigens for vaccines or diagnostics.

Example 2681

A DNA sequence (GASx984R) was identified in *S. pyogenes* <SEQ ID 7861> which encodes the amino acid sequence <SEQ ID 7862>. Analysis of this protein sequence reveals the following:

```
Possible site: 36
  >>> Seems to have no N-terminal signal sequence
  ----- Final Results -----
    bacterial cytoplasm --- Certainty = 0.1736 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2682

A DNA sequence (GASx985) was identified in *S. pyogenes* <SEQ ID 7863> which encodes the amino acid sequence <SEQ ID 7864>. Analysis of this protein sequence reveals the following:

```
Possible site: 27
  >>> Seems to have no N-terminal signal sequence
  ----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>
```

No corresponding DNA sequence was identified in *S. agalactiae*.

The protein has homology with the following sequences in the GENPEPT database:

```
>GP:AAA32613 GB:L31366 structural protein [Bacteriophage Tuc2009]
Identities = 81/185 (43%), Positives = 111/185 (59%), Gaps = 22/185 (11%)
Query: 4    QLEAKQGIHSILLFRLLKEASSEAATKLAFQTEHEVGKSRDVDGQKTKDGIIQSVGALEY   63
            +L AKQG   ILL+RLL +A+ EAA KLAFQTEH    K+RD +   TKDG I S+ A+EY
Sbjct: 3    ELTAKQGKDIILLYRLLSKATKEAAWKLAFQTEHSNEKTRDYNTTATKDGTIGSLAAIEY   62

Query: 64   DFKATSILAKGDVLAAKLEKAMENGELVEIWDIDLEETSKNGDSDNKLANVWGIDKNGTN   123
                ATSI A GD     +++KA ++GE++++W+ID   E
Sbjct: 63   SLSATSIAANGDPHLDEMDKAFDDGEIIDVWEIDKAEKG--------------------   101
```

```
Query: 124  RGNGKYLATYYQGYISSFSAKKNAEENIEIEMEFAINGVGQKGFATLTDAQKAAVQYAFK  183
            +GKY A Y + Y++SFS + N+E+ +E+ +EF + G  OKG ATLT+ Q   VQY FK
Sbjct: 102  -SDGKYKAKYLRAYLTSFSYEPNSEDALELSLEFGVFGKPQKGQATLTEEQANVVQYVFK  160

Query: 184  DTTKG                                                        188
            DT  G
Sbjct: 161  DTVAG                                                        165
```

Based on this analysis, it was predicted that this GAS-specific protein and its epitopes, could be useful antigens for vaccines or diagnostics.

Example 2683

A DNA sequence (GASx986) was identified in *S. pyogenes* <SEQ ID 7865> which encodes the amino acid sequence <SEQ ID 7866>. Analysis of this protein sequence reveals the following:

Possible site: 55
>>> Seems to have no N-terminal signal sequence
----- Final Results -----
   bacterial cytoplasm --- Certainty = 0.2273 (Affirmative) <succ>
   bacterial membrane --- Certainty = 0.0000 (Not Clear) <succ>
   bacterial outside --- Certainty = 0.0000 (Not Clear) <succ>

No corresponding DNA sequence was identified in *S. agalactiae*.

The protein has homology with the following sequences in the GENPEPT database:

```
>GP:CAA59192 GB:X84706 a2 [Bacteriophage B1]
Identities = 54/111 (48%), Positives = 72/111 (64%), Gaps = 1/111 (0%)
Query: 1    MQLEIKGKTHNVKFGTRFVAEMDKNHIAERQGFKFGAGLQSSV-PFLIDHSVVTLAEVIY   59
            M+L IKGK +KFG +FV E+DKN  + E+ G  FG L   + P L   ++ TL+ V++
Sbjct: 1    MELTIKGKQVHFKFGVKFVRELDKNLVIEQNGVSFGLALAVKIIPELEMANIATLSNVLF   60

Query: 60   TGTITEPPRPSLNDIYDYIDEVEDIEKLFDDVLDELRQSNASKLFMAQVEK           110
             G  TE P+ S  DI D+IDE EDIEKLFDDVL E+ +SN  KL  A++ K
Sbjct: 61   LGNRTETPKLSQGDIDDFIDECEDIEKLFDDVLKEITESNTGKLIKAKMTK           111
```

Based on this analysis, it was predicted that this GAS-specific protein and its epitopes, could be useful antigens for vaccines or diagnostics.

Example 2684

A DNA sequence (GASx987) was identified in *S. pyogenes* <SEQ ID 7867> which encodes the amino acid sequence <SEQ ID 7868>. Analysis of this protein sequence reveals the following:

Possible site: 36
>>> Seems to have no N-terminal signal sequence
----- Final Results -----
   bacterial cytoplasm --- Certainty = 0.2735 (Affirmative) <succ>
   bacterial membrane --- Certainty = 0.0000 (Not Clear) <succ>
   bacterial outside --- Certainty = 0.0000 (Not Clear) <succ>

No corresponding DNA sequence was identified in *S. agalactiae*.

The protein has homology with the following sequences in the GENPEPT database:

```
>GP:CAA59193 GB:X84706 c2 [Bacteriophage B1]

Identities = 40/111 (36%), Positives = 57/111 (51%), Gaps = 10/111 (9%)
Query: 2    IVLNCIRYLGMTDINEIGRLTLYEYDLLMTGKALAAVDESHKAHKQAWINHQVTATKLVG   61
            +++  +R  G+ D++    R+T+ EY +      L +DE    ++QAW N QV ATK  G
Sbjct: 15   MMIRFLRCFGIQDLSVFERMTIREYSIRSIAFQLRTLDEEEFIYEQAWANWQVQATKQQG   74

Query: 62   GKKNKKEVPVYKKFKDFFD---YEEEIRKI-TQEIDEGYDKKGMDLLLKAN           108
             K    P+Y  FK FFD    E EI  I + E    D K +DL+ KAN
Sbjct: 75   KK------PLYPTFKKFFDKKKLENEILGIESPENKFKKDNKLIDLMKKAN           119
```

Based on this analysis, it was predicted that this GAS-specific protein and its epitopes, could be useful antigens for vaccines or diagnostics.

Example 2685

A DNA sequence (GASx989) was identified in *S. pyogenes* <SEQ ID 7869> which encodes the amino acid sequence <SEQ ID 7870>. Analysis of this protein sequence reveals the following:

---

Possible site: 60
>>> Seems to have no N-terminal signal sequence
----- Final Results -----
   bacterial cytoplasm --- Certainty = 0.2869 (Affirmative) <succ>
     bacterial membrane --- Certainty = 0.0000 (Not Clear) <succ>
       bacterial outside --- Certainty = 0.0000 (Not Clear) <succ>

---

No corresponding DNA sequence was identified in *S. agalactiae*.

The protein has homology with the following sequences in the GENPEPT database:

```
>GP:CAA66560 GB:X97918 gene 19.1 [Bacteriophage SPP1]
Identities = 66/232 (28%), Positives = 106/232 (45%), Gaps = 12/232 (5%)
Query:  38   FRTLTVSGRDVVDLEHQTTSVLGRNGEYFHNATVEVRKLEIKAKISGKDNKS-MRLQYEK    96
             F    V GR V  +E    ++ G +G      ++  R+LE+ A + G    ++ +R + E
Sbjct:  24   FLVQEVRGRSVYSIEMGKRTIAGVDGGVITTESLPARELEVDAIVFGDGTETDLRRRIEY    83

Query:  97   LNKLIVSHNQVFLSFSDEPDRNYLGIFKSKDVPEEVSNEQIIGLTFICYNPFK-----MS   151
             LN L+      V ++FSDEP  R Y G ++      +E      + L F C +P K       +
Sbjct:  84   LNFLLHRDTDVPITFSDEPSRTYYGRYEFATEGDEKGGFHKVTLNFYCQDPLKYGPEVTT   143

Query: 152   DVKTKKGTSIQNGGLFQTKPIITLNLSSPTKEIKLLHVESQKYIRLT----GTYTTDEIK   207
             DV T    T ++N GL  T P I     S+   E ++  ++     ++       G  T D +
Sbjct: 144   DV-TTASTPVKNTGLAVTNPTIRCVFSTSATEYEMQLLDGSTVVKFLKVKYGFNTGDTLV   202

Query: 208   IDMATGKITQNGRNILGDLDMINSRYFELLPGNNTLQCANAAITAEFREVYL           259
             ID      +T NG++I+   L +I S + +L P  NT    A      T   F E +L
Sbjct: 203   IDCHERSVTLNGQDIMPAL-LIQSDWIQLKPQVNTYLKATQPSTIVFTEKFL          253
```

Based on this analysis, it was predicted that this GAS-specific protein and its epitopes, could be useful antigens for vaccines or diagnostics.

---

Possible site: 22
>>> Seems to have no N-terminal signal sequence
----- Final Results -----
   bacterial cytoplasm --- Certainty = 0.2861 (Affirmative) <succ>
     bacterial membrane --- Certainty = 0.0000 (Not Clear) <succ>
       bacterial outside --- Certainty = 0.0000 (Not Clear) <succ>

---

Example 2686

A DNA sequence (GASx990) was identified in *S. pyogenes* <SEQ ID 7871> which encodes the amino acid sequence <SEQ ID 7872>. Analysis of this protein sequence reveals the following:

No corresponding DNA sequence was identified in *S. agalactiae*.

The protein has homology with the following sequences in the GENPEPT database:

```
>GP:BAB04681 GB:AP001510 unknown conserved protein in others
[Bacillus halodurans]
Identities = 116/449 (25%), Positives = 198/449 (43%), Gaps = 79/449 (17%)
Query:   2   IYLFDKLERLVATVG-TDDLLSWHFKVKNNDWDQASFEVPVDYDVEPFVYFGFFNYDPHQ    60
             +++FD+ ++L+ T+   +    L+   F+ + N       F   ++    E   +    + HQ
Sbjct:   4   LFIFDREDQLLTTLTESTGLVRALFREELNRVPNQPFAFTIEASSEEAKHV----IEEHQ    59

Query:  61   -----KEDVFKLFKVIDYNLEDSKFYKG------LDKAESDLDTIAIIKDKRFRQSSADA   109
                  KE   +LF + +   LED    G         + A   +L    I++      Q  +A
Sbjct:  60   VVFRDKEGDLRLFVIKE--LEDVDGLDGPQTTAICEPAFMELAEHMIVEQSVVNQPAHEA   117
```

-continued

```
Query: 110  CIDGALEGTGYQVGKVEGITNVRTLSYYYISPRAALIKIVEAFNCEFNVRYTF-INNKIT  168
             ++ AL+GT +  G VE      T  + Y+S   A+  I+  +  +F    TF   N+IT
Sbjct: 118  -LNVALQGTRW-TGSVEVNLGNATEHFSYVSAIEAVWNILVTWGGDFKDVVTFNAENRIT  175

Query: 169  SRYIDLKKRFGKPTGKQFEHGNNLLKVVYEESTDDIVTCLIGRGKGEEIQHEEAEPKDVE  228
            S  I + +R G    GK+FE +N+  + +         VT L GRG    +Q  E E    +
Sbjct: 176  SHQIKIVQRRGVDRGKRFEIDHNI-EQIERTILSYPVTALYGRGAS--LQGENGE----D  228

Query: 229  GHLPOEERRQGYGRRIEFTDVVWSVEKGDPIDKRAGQNFVALDSAREEYGLSQNGELKHR  288
            G L              +F +V W    G P+DKP GQ +V    A ++YG   NG+L HR
Sbjct: 229  GSL------------DFGEVEWRKSAGAPVDKPKGQLWVGDPEALQKYGRKHNGQLLHR  275

Query: 289  WGVFVNEEIEDKTELLKATWEELQRLSIPIRIYKAEILDIGPETWKGDSVAIIYDEVKIA  348
             G+F N  IED  ELL+ TWE+LQ+ S P   Y+  +                +++ +
Sbjct: 276  EGIFQNTNIEDPEELLEKTWEQLQKSSKPEVHYRLSVR-------------LFEHIS--  319

Query: 349  FETRVDEIDIDKLNFNRSVVTLGDYSVVQNR------ESRSRKEAVQ-NMIDESLETITD  401
                          +     +LGD ++  +R       E +SR  A++ +++D     + +
Sbjct: 320  -------------GYEHEQASLGDTAIAIDRQFSRPIEIQSRIIAIEYDLVDIDGTGMVE  366

Query: 402  LGMTFQEFLQGIEKRIETGKKEMEDNWRK                                430
            +G      L G+++R+E   +E+E N  K
Sbjct: 367  MGQFLS--LNGMDERLERIIEEIEKNQGK                                393
```

Based on this analysis, it was predicted that this GAS-specific protein and its epitopes, could be useful antigens for vaccines or diagnostics.

Example 2687

A DNA sequence (GASx991) was identified in *S. pyogenes* <SEQ ID 7873> which encodes the amino acid sequence <SEQ ID 7874>. Analysis of this protein sequence reveals the following:

```
Possible site: 50
>>> Seems to have no N-terminal signal sequence
----- Final Results -----
  bacterial cytoplasm --- Certainty = 0.2584(Affirmative) <succ>
    bacterial membrane --- Certainty = 0.0000(Not Clear) <succ>
      bacterial outside --- Certainty = 0.0000(Not Clear) <succ>
```

No corresponding DNA sequence was identified in *S. agalactiae.*

The protein has homology with the following sequences in the GENPEPT database:

```
>GP:AAA98101 GB:M19348 hyaluronidase [Streptococcus pyogenes phage H4489A]

Identities = 314/371 (84%), Positives = 338/371 (90%), Gaps = 1/371 (0%)

Query: 1    MAENIPLRVQFKRMKAAEWASSDVVLLEGEIGFETDTGFAKFGDGQNTFSKLKYLTGPKG   60
            M ENIPLRVQFKRM A EWA SDV+LLEGEIGFETDTGFAKFGDGQNTFSKLKYLTGPKG
Sbjct: 1    MTENIPLRVQFKRMSADEWARSDVILLEGEIGFETDTGFAKFGDGQNTFSKLKYLTGPKG   60

Query: 61   PKGDTGLQGKTGGTGSRGPAGKPGTTDYDQLQNKPDLGAFAQKEETNSKITKLESSKADK  120
            PKGDTGLQGKTGGTG RGPAGKPGTTDYDQLQNKPDLGAFAQKEETNSKITKLESSKADK
Sbjct: 61   PKGDTGLQGKTGGTGPRGPAGKPGTTDYDQLQNKPDLGAFAQKEETNSKITKLESSKADK  120

Query: 121  NAVYLKAESNAKLDEKLNLKGGVMTGQLQFKPN-SGIKPSSSVGGAINIDMSKSEGAAMV  179
            +AVY KAES  +LD+KL+L GG++TGQLQFKPN SGIKPSSSVGGAINIDMSKSEGAAMV
Sbjct: 121  SAVYSKAESKIELDKKLSLTGGIVTGQLQFKPNKSGIKPSSSVGGAINIDMSKSEGAAMV  180

Query: 180  MYTNKDTTDGPLMILRSNKDTFDQSVQFVDYKGTTNAVNIVMRQPTTPNFSSALNITSAN  239
            MYTNKDTTDGPLMILRS+KDTFDQS QFVDY G TNAVNIVMRQP+ PNFSSALNITSAN
Sbjct: 181  MYTNKDTTDGPLMILRSDKDTFDQSAQFVDYSGKTNAVNIVMRQPSAPNFSSALNITSAN  240

Query: 240  EGGSAMQIRGVEKALGTLKITHENPSVDKEYDKNAAALSIDIVKKQKGGKGTAAQGIYIN  299
            EGGSAMQIRGVEKALGTLKITHENP+V+  +YD+NAAALSIDIVKKQKGGKGTAAQGIYIN
Sbjct: 241  EGGSAMQIRGVEKALGTLKITHENPNVEAKYDENAAALSIDIVKKQKGGKGTAAQGIYIN  300

Query: 300  STSGTTGKLLRIRNLNDDKFYVKPDGGFYAKETSQIDGNLKLKDPIANDHAATKAYVDGE  359
            STSGT GK+LRIRN N+DKFYV PDGGF++   S + GNL +KDP +  HAATK YVD +
Sbjct: 301  STSGTAGKMLRIRNKNEDKFYVGPDGGFHSGANSTVAGNLTVKDPTSGKHAATKDYVDEK  360

Query: 360  VEKLKALLAAK                                                  370
            + +LK L+  K
Sbjct: 361  IAELKKLILKK                                                  371
```

Example 2688

A DNA sequence (GASx993) was identified in *S. pyogenes* <SEQ ID 7875> which encodes the amino acid sequence <SEQ ID 7876>. Analysis of this protein sequence reveals the following:

---

Possible site: 29
>>> Seems to have no N-terminal signal sequence
----- Final Results -----
    bacterial cytoplasm --- Certainty = 0.1358 (Affirmative) <succ>
      bacterial membrane --- Certainty = 0.0000 (Not Clear) <succ>
      bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2689

A DNA sequence (GASx995) was identified in *S. pyogenes* <SEQ ID 7877> which encodes the amino acid sequence <SEQ ID 7878>. Analysis of this protein sequence reveals the following:

---

Possible site: 22
>>> Seems to have no N-terminal signal sequence
----- Final Results -----
    bacterial cytoplasm --- Certainty = 0.0855 (Affirmative) <succ>
      bacterial membrane --- Certainty = 0.0000 (Not Clear) <succ>
      bacterial outside --- Certainty = 0.0000 (Not Clear) <succ>

---

No corresponding DNA sequence was identified in *S. agalactiae*.

The protein has homology with the following sequences in the GENPEPT database:

```
>GP:AAC34418 GB:AF158600 gp149 [Streptococcus thermophilus
bacteriophage Sfi11]
Identities = 27/95 (28%), Positives = 50/95 (52%), Gaps = 2/95 (2%)
Query:  9  KYPQLDGTGAVASTHIIAAEDGAVIPQLIKQDLTSTNDTEIIKAALEEFKKSEYVEIAM  68
           K  + D +GA  +T +I+    DGA +P  +  +    ++TE++K ALE    +  + A
Sbjct: 26  KSKEYDASGAAYATKVILKNRDGAYVPVFLPVEKIDLSNTELLKEALEVIYQENFPQRAE  85

Query: 69  GEAVQKVDDLEKISQETAKTAKTAQTAAGLAKVSA                          103
           E   ++D  EKI +   A + K  +T A + S+
Sbjct: 86  NEKFNELD--EKIKEYEALSKKATETIAKMEEASS                          118
```

Based on this analysis, it was predicted that this GAS-specific protein and its epitopes, could be useful antigens for vaccines or diagnostics.

Example 2690

A DNA sequence (GASx996) was identified in *S. pyogenes* <SEQ ID 7879> which encodes the amino acid sequence <SEQ ID 7880>. Analysis of this protein sequence reveals the following:

---

Possible site: 22
>>> Seems to have an uncleavable N-terminal signal sequence
INTEGRAL Likelihood = −4.62 Transmembrane 9-25 (7-26)
----- Final Results -----
    bacterial membrane --- Certainty = 0.2848 (Affirmative) <succ>
      bacterial outside --- Certainty = 0.0000 (Not Clear) <succ>
      bacterial cytoplasm --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2691

A DNA sequence (GASx997) was identified in *S. pyogenes* <SEQ ID 7881> which encodes the amino acid sequence <SEQ ID 7882>. Analysis of this protein sequence reveals the following:

---

Possible site: 41
>>> Seems to have no N-terminal signal sequence
INTEGRAL Likelihood = −3.66 Transmembrane 38-54 (35-55)
----- Final Results -----
    bacterial membrane --- Certainty = 0.2466 (Affirmative) <succ>
      bacterial outside --- Certainty = 0.0000 (Not Clear) <succ>
      bacterial cytoplasm --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2692

A DNA sequence (GASx998R) was identified in *S. pyogenes* <SEQ ID 7883> which encodes the amino acid sequence <SEQ ID 7884>. Analysis of this protein sequence reveals the following:

---

Possible site: 27
>>> Seems to have no N-terminal signal sequence
INTEGRAL Likelihood = −9.87 Transmembrane 47-63 (41-72)
----- Final Results -----
    bacterial membrane --- Certainty = 0.4949 (Affirmative) <succ>
      bacterial outside --- Certainty = 0.0000 (Not Clear) <succ>
      bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2693

A DNA sequence (GASx999) was identified in *S. pyogenes* <SEQ ID 7885> which encodes the amino acid sequence <SEQ ID 7886>. Analysis of this protein sequence reveals the following:

---

Possible site: 24
>>> Seems to have a cleavable N-terminal signal sequence
----- Final Results -----
 bacterial outside --- Certainty = 0.3000 (Affirmative) <succ>
  bacterial membrane --- Certainty = 0.0000 (Not Clear) <succ>
   bacterial cytoplasm --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2694

A DNA sequence (GASx1001) was identified in *S. pyogenes* <SEQ ID 7887> which encodes the amino acid sequence <SEQ ID 7888>. Analysis of this protein sequence reveals the following:

---

Possible site: 22
>>> Seems to have an uncleavable N-terminal signal sequence
INTEGRAL Likelihood = −10.51 Transmembrane 18-34 (16-34)
----- Final Results -----
 bacterial membrane --- Certainty = 0.5203(Affirmative) <succ>
  bacterial outside --- Certainty = 0.0000 (Not Clear) <succ>
   bacterial cytoplasm --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2695

A DNA sequence (GASx1002) was identified in *S. pyogenes* <SEQ ID 7889> which encodes the amino acid sequence <SEQ ID 7890>. Analysis of this protein sequence reveals the following:

---

Possible site: 32
>>> Seems to have an uncleavable N-terminal signal sequence
INTEGRAL Likelihood = −3.61 Transmembrane 12-28 (11-33)
----- Final Results -----
 bacterial membrane --- Certainty = 0.2444 (Affirmative) <succ>
  bacterial outside --- Certainty = 0.0000 (Not Clear) <succ>
   bacterial cytoplasm --- Certainty = 0.0000 (Not Clear) <succ>

---

No corresponding DNA sequence was identified in *S. agalactiae*.

The protein is similar to AF 186180 from *S. equi*.

Based on this analysis, it was predicted that this GAS-specific protein and its epitopes, could be useful antigens for vaccines or diagnostics.

Example 2696

A DNA sequence (GASx1003) was identified in *S. pyogenes* <SEQ ID 7891> which encodes the amino acid sequence <SEQ ID 7892>. Analysis of this protein sequence reveals the following:

---

Possible site: 32
>>> Seems to have a cleavable N-terminal signal sequence
----- Final Results -----
 bacterial outside --- Certainty = 0.3000 (Affirmative) <succ>
  bacterial membrane --- Certainty = 0.0000 (Not Clear) <succ>
   bacterial cytoplasm --- Certainty = 0.0000 (Not Clear) <succ>

---

No corresponding DNA sequence was identified in *S. agalactiae*.

The protein is similar to SeeH from *S. equi*:

```
>GP:AAF72809 GB:AF186180 SeeH [Streptococcus equi] Length = 236
Identities = 233/236 (98%), Positives = 234/236 (98%)
Query:   1  MRYNCRYSHIDKKIYSMIICLSFLLYSNVVQANSYNTTNRHNLESLYKHDSNLIEADSIK   60
            MRYNCRYSHIDKKIYSMIICLSFLLYSNVVQANSYNTTNRHNLESLYKHDSNLIEADSIK
Sbjct:   1  MRYNCRYSHIDKKIYSMIICLSFLLYSNVVQANSYNTTNRHNLESLYKHDSNLIEADSIK   60

Query:  61  NSPDIVTSHMLKYSVKDKNLSVFFEKDWISQEFKDKEVDIYALSAQEVCECPGKRYEAFG  120
            NSPDIVTSHMLKYSVKDKNLSVFFEKDWISQEFKDKEVDIYALSAQE CECPGKRYEAFG
Sbjct:  61  NSPDIVTSHMLKYSVKDKNLSVFFEKDWISQEFKDKEVDIYALSAQEACECPGKRYEAFG  120

Query: 121  GITLTNSEKKEIKVPVNVWDKSKQQPPMFITVNKPKVTAQEVDIKVRKLLIKKYDIYNNR  180
            GITLTNSEKKEIKVP+NVWDKSKQ PPMFITVNKPKVTAQEVDIKVRKLLIKKYDIYNNR
Sbjct: 121  GITLTNSEKKEIKVPINVWDKSKQHPPMFITVNKPKVTAQEVDIKVRKLLIKKYDIYNNR  180

Query: 181  EQKYSKGTVTLDLNSGKDIVFDLYYFGNGDFNSMLKIYSNNERIDSTQFHVDVSIS      236
            EQKYSKGTVTLDLNSGKDIVFDLYYFGNGDFNSMLKIYSNNERIDSTQFHVDVSIS
Sbjct: 181  EQKYSKGTVTLDLNSGKDIVFDLYYFGNGDFNSMLKIYSNNERIDSTQFHVDVSIS      236
```

There is also homology to a *S. aureus* enterotoxin:

```
>GP:AAA19777 GB:U11702 enterotoxin H [Staphylococcus aureus]
Identities = 70/215 (32%), Positives = 108/215 (49%), Gaps = 19/215 (8%)
Query: 27   SNVVQANSYNTTNRHNLESLYKHDSNLIEADSI-KNSPDIVTSHMLKYSVKDKNLSVFFE    85
            +++  AN+Y  N    ++    K D     E D I +N  D       +K++  D
Sbjct: 34   TDLALANAYGQYNHPFIKENIKSDEISGEKDLIFRNQGDSGNDLRVKFATAD--------    85

Query: 86   KDWISQEFKDKEVDIYALSAQEVCECPGKRYEA--FGGITLTNSEK--KEIKVPVNVWDK   141
               ++Q+FK+K VDIY  S   CE   +      +GG TL NSEK  +E  +  NVW
Sbjct: 86   ---LAQKFKNKNVDIYGASFYYKCEKISENISECLYGGTTL-NSEKLAQERVIGANVWVD   141

Query: 142  SKQQPPMFITVNKPKVTAQEVDIKVRKLLIKKYDIYNNREQKYSKGTVTLDLNSGKDIVF   201
                Q+    I  NK  VT QE+DIK+RK+L   KY IY  ++ + SKG   D+ +  +D   F
Sbjct: 142  GIQKETELIRTNKKNVTLQELDIKIRKILSDKYKIY-YKDSEISKGLIEFDMKTPRDYSF   200

Query: 202  DLYYFGNGDFNSMLKIYSNNERIDSTQF-HVDVSI                           235
            D+Y       +     + KIY +N+ + S      H+DV++
Sbjct: 201  DIYDLKGENDYEIDKIYEDNKTLKSDDISHIDVNL                          235

>GP:AAC26661 GB:AF064774 extracellular enterotoxin type I precursor
[Staphylococcus aureus]
Identities = 68/214 (31%), Positives = 109/214 (50%), Gaps = 27/214 (12%)
Query: 42   NLESLY-KHDSNLIEADSIKNSPDIVTSHMLKYSVKDKNLSVFFEKDWIS-QEFKDKEVD    99
            NL + Y KHD    ++  + KN P    ++  L++S    +L +      +W    +FK  K++D
Sbjct: 32   NLRNFYTKHDYIDLKGVTDKNLP---IANQLEFSTGTNDL-ISESNNWDEISKFKGKKLD    87

Query: 100  IYALSAQEVCECPGKRYEAFGGITLTNSEKKEI-KVPVNVWDKSKQQPPMF--ITVNKPK   156
            I+ +     C    K      +GG TL+            K+P+N+W   K +      I  NK
Sbjct: 88   IFGIDYNGPC----KSKYMYGGATLSGQYLNSARKIPINLWVNGKHKTISTDKIATNKKL   143

Query: 157  VTAQEVDIKVRKLLIKKYDIYNNRE--------------QKYSKGTVTLDLNSGKDIVFD   202
            VTAQE+D+K+R +L ++Y+IY +                ++ G V LN+    K    +D
Sbjct: 144  VTAQEIDVKLRRYLQEEYNIYGHNNTGKGKEYGYKSKFYSGFNNGKVLFHLNNEKSFSYD   203

Query: 203  LYYFGNGDFNSMLKIYSNNERIDSTQFHVDVSIS                           236
            L+Y G+G   S LKIY +N+ I+S +FH+DV IS
Sbjct: 204  LFYTGDGLPVSFLKIYEDNKIIESEKFHLDVEIS                           237

>GP:AAC28968 GB:U93688 enterotoxin [Staphylococcus aureus]
Identities = 70/244 (28%), Positives = 127/244 (51%), Gaps = 27/244 (11%)
Query: 12   KKIYSMIICLSFLLYSNVVQANSYNTTNRHNLESLYKHDSNLIEADSIKNSPDIVTSHML    71
            KK+ S+++  ++ ++        A++        NL + Y  + ++    +K++ D   ++ L
Sbjct: 2    KKLISILL-INIIILGVSNNASAQGDIGIDNLRNFYTK-KDFVDLKDVKDN-DTPIANQL    58

Query: 72   KYSVKDKNLSVFFEKDWIS-QEFKDKEVDIYALSAQEVCECPGKRYEAFGGITLTNSE-K   129
            ++S +  +L +     KD+     FK K++D++ +S     C          +Y  +GG+T  TN
Sbjct: 59   QFSNESYDL-ISESKDFNKFSNFKGKKLDVFGISYNGQCNT---KY-IYGGVTATNEYLD   113

Query: 130  KEIKVPVNVW--DKSKQQPPMFITVNKPKVTAQEVDIKVRKLLIKKYDIYNNREQK----   183
            K    +P+N+W      K      ++ NK  VTAQE+D+K+RK L  ++Y+IY +       K
Sbjct: 114  KSRNIPINIWINGNHKTISTNKVSTNKKLVTAQEIDVKLRKYLQEEYNIYGHNGTKKGEE   173

Query: 184  ----------YSKGTVTLDLNSGKDIVFDLYYFG-NGDFNSMLKIYSNNERIDSTQFHVD   232
                      ++ G VT LN+        +DL+Y G +G    S LKIY +N+  ++S +FH+D
Sbjct: 174  YGHKSKFYSGFNIGKVTFHLNNNDTFSYDLFYTGDDGLPKSFLKIYEDNKTVESEKFHLD   233

Query: 233  VSIS                                                          236
            V IS
Sbjct: 234  VDIS                                                          237
```

Based on this analysis, it was predicted that this GAS-specific protein and its epitopes, could be useful antigens for vaccines or diagnostics.

Example 2697

A DNA sequence (GASx1004R) was identified in *S. pyogenes* <SEQ ID 7893> which encodes the amino acid sequence <SEQ ID 7894>. Analysis of this protein sequence reveals the following:

Possible site: 29
>>> Seems to have an uncleavable N-terminal signal sequence
INTEGRAL Likelihood = −2.18 Transmembrane 12-28 (12-28)

-continued

----- Final Results -----
bacterial membrane --- Certainty = 0.1871 (Affirmative) <succ>
bacterial outside --- Certainty = 0.0000 (Not Clear) <succ>
bacterial cytoplasm --- Certainty = 0.0000 (Not Clear) <succ>

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

Example 2698

A DNA sequence (GASx1009) was identified in *S. pyogenes* <SEQ ID 7895> which encodes the amino acid sequence <SEQ ID 7896>. Analysis of this protein sequence reveals the following:

```
Possible site: 34
>>> Seems to have no N-terminal signal sequence
----- Final Results -----
   bacterial cytoplasm --- Certainty = 0.6391(Affirmative) <succ>
      bacterial membrane --- Certainty = 0.0000(Not Clear) <succ>
         bacterial outside --- Certainty = 0.0000(Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2699

A DNA sequence (GASx1011) was identified in *S. pyogenes* <SEQ ID 7897> which encodes the amino acid sequence <SEQ ID 7898>. Analysis of this protein sequence reveals the following:

```
Possible site: 50
>>> Seems to have no N-terminal signal sequence
----- Final Results -----
   bacterial cytoplasm --- Certainty = 0.4528 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2700

A DNA sequence (GASx1024) was identified in *S. pyogenes* <SEQ ID 7899> which encodes the amino acid sequence <SEQ ID 7900>. Analysis of this protein sequence reveals the following:

```
Possible site: 22
>>> Seems to have an uncleavable N-terminal signal sequence
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2701

A DNA sequence (GASx1033) was identified in *S. pyogenes* <SEQ ID 7901> which encodes the amino acid sequence <SEQ ID 7902>. Analysis of this protein sequence reveals the following:

```
Possible site: 20
>>> Seems to have no N-terminal signal sequence
----- Final Results -----
   bacterial cytoplasm --- Certainty = 0.1652 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2702

A DNA sequence (GASx1039) was identified in *S. pyogenes* <SEQ ID 7903> which encodes the amino acid sequence <SEQ ID 7904>. Analysis of this protein sequence reveals the following:

```
Possible site: 22
>> Seems to have no N-terminal signal sequence
INTEGRAL Likelihood = -1.06 Transmembrane 15-31 (15-31)
----- Final Results -----
   bacterial membrane --- Certainty = 0.1426 (Affirmative) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2703

A DNA sequence (GASx1058) was identified in *S. pyogenes* <SEQ ID 7905> which encodes the amino acid sequence <SEQ ID 7906>. Analysis of this protein sequence reveals the following:

```
Possible site: 60
>>> Seems to have no N-terminal signal sequence
----- Final Results -----
   bacterial cytoplasm --- Certainty = 0.5484 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2704

A DNA sequence (GASx1077) was identified in *S. pyogenes* <SEQ ID 7907> which encodes the amino acid sequence <SEQ ID 7908>. Analysis of this protein sequence reveals the following:

```
Possible site: 31
>>> Seems to have no N-terminal signal sequence
----- Final Results -----
  bacterial cytoplasm --- Certainty = 0.4848 (Affirmative) <succ>
    bacterial membrane --- Certainty = 0.0000 (Not Clear) <succ>
      bacterial outside --- Certainty = 0.0000 (Not Clear) <succ>
```

No corresponding DNA sequence was identified in *S. agalactiae*.

Based on this analysis, it was predicted that this GAS-specific protein and its epitopes, could be useful antigens for vaccines or diagnostics.

Example 2705

A DNA sequence (GASx1080) was identified in *S. pyogenes* <SEQ ID 7909> which encodes the amino acid sequence <SEQ ID 7910>. Analysis of this protein sequence reveals the following:

```
Possible site: 40
>5> Seems to have an uncleavable N-terminal signal sequence
INTEGRAL    Likelihood = -12.42   Transmembrane 107-123 (93-133)
INTEGRAL    Likelihood = -11.2    Transmembrane 20-36 (14-44)
INTEGRAL    Likelihood = -8.39    Transmembrane 226-242 (218-246)
INTEGRAL    Likelihood = -5.52    Transmembrane 129-145 (126-148)
INTEGRAL    Likelihood = -4.46    Transmembrane 160-176 (159-183)
INTEGRAL    Likelihood = -1.44    Transmembrane 55-71 (55-72)
----- Final Results -----
  bacterial membrane --- Certainty = 0.5967 (Affirmative) <succ>
    bacterial outside --- Certainty = 0.0000 (Not Clear) < succ>
      bacterial cytoplasm --- Certainty = 0.0000 (Not Clear) < succ>
```

No corresponding DNA sequence was identified in *S. agalactiae*.

Based on this analysis, it was predicted that this GAS-specific protein and its epitopes, could be useful antigens for vaccines or diagnostics.

Example 2706

A DNA sequence (GASx1081) was identified in *S. pyogenes* <SEQ ID 7911> which encodes the amino acid sequence <SEQ ID 7912>. Analysis of this protein sequence reveals the following:

```
Possible site: 34
>>> Seems to have a cleavable N-terminal signal sequence
INTEGRAL    Likelihood = -13.00   Transmembrane 103-119 (91-129)
INTEGRAL    Likelihood = -11.46   Transmembrane 208-224 (203-230)
INTEGRAL    Likelihood = -8.28    Transmembrane 54-70 (46-71)
INTEGRAL    Likelihood = -5.79    Transmembrane 160-176 (155-181)
INTEGRAL    Likelihood = -4.25    Transmembrane 127-143 (125-149)
----- Final Results -----
  bacterial membrane --- Certainty = 0.6201 (Affirmative) <succ>
    bacterial outside --- Certainty = 0.0000 (Not Clear) <succ>
      bacterial cytoplasm --- Certainty = 0.0000 (Not Clear) <succ>
```

No corresponding DNA sequence was identified in *S. agalactiae*.

Based on this analysis, it was predicted that this GAS-specific protein and its epitopes, could be useful antigens for vaccines or diagnostics.

Example 2707

A DNA sequence (GASx1089) was identified in *S. pyogenes* <SEQ ID 7913> which encodes the amino acid sequence <SEQ ID 7914>. Analysis of this protein sequence reveals the following:

```
Possible site: 37
>>> Seems to have no N-terminal signal sequence
----- Final Results -----
  bacterial cytoplasm --- Certainty = 0.2999 (Affirmative) <succ>
    bacterial membrane --- Certainty = 0.0000 (Not Clear) <succ>
      bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2708

A DNA sequence (GASx1109) was identified in *S. pyogenes* <SEQ ID 7915> which encodes the amino acid sequence <SEQ ID 7916>. Analysis of this protein sequence reveals the following:

```
Possible site: 27
>>> Seems to have no N-terminal signal sequence
----- Final Results -----
  bacterial cytoplasm --- Certainty = 0.1270 (Affirmative) <succ>
    bacterial membrane --- Certainty = 0.0000 (Not Clear) <succ>
      bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2709

A DNA sequence (GASx1114R) was identified in *S. pyogenes* <SEQ ID 7917> which encodes the amino acid sequence <SEQ ID 7918>. Analysis of this protein sequence reveals the following:

Possible site: 19
>>> Seems to have no N-terminal signal sequence
----- Final Results -----
    bacterial cytoplasm --- Certainty = 0.4021 (Affirmative) <succ>
        bacterial membrane --- Certainty = 0.0000 (Not Clear) <succ>
            bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2710

A DNA sequence (GASx1149) was identified in *S. pyogenes* <SEQ ID 7919> which encodes the amino acid sequence <SEQ ID 7920>. Analysis of this protein sequence reveals the following:

Possible site: 28
>>> Seems to have an uncleavable N-terminal signal sequence
INTEGRAL Likelihood = −1.70 Transmembrane 12-28 (12-29)
----- Final Results -----
    bacterial membrane --- Certainty = 0.1680 (Affirmative) <succ>
        bacterial outside --- Certainty = 0.0000 (Not Clear) <succ>
            bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2711

A DNA sequence (GASx1150) was identified in *S. pyogenes* <SEQ ID 7921> which encodes the amino acid sequence <SEQ ID 7922>. Analysis of this protein sequence reveals the following:

Possible site: 22
>>> Seems to have a cleavable N-terminal signal sequence
----- Final Results -----
    bacterial outside --- Certainty = 0.3000 (Affirmative) <succ>
        bacterial membrane --- Certainty = 0.0000 (Not Clear) <succ>
            bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2712

A DNA sequence (GASx1160) was identified in *S. pyogenes* <SEQ ID 7923> which encodes the amino acid sequence <SEQ ID 7924>. Analysis of this protein sequence reveals the following:

Possible site: 17
>>> Seems to have no N-terminal signal sequence
INTEGRAL Likelihood = −3.19 Transmembrane 15-31 (15-31)
----- Final Results -----
    bacterial membrane --- Certainty = 0.2275 (Affirmative) <succ>
        bacterial outside --- Certainty = 0.0000 (Not Clear) <succ>
            bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2713

A DNA sequence (GASx1167) was identified in *S. pyogenes* <SEQ ID 7925> which encodes the amino acid sequence <SEQ ID 7926>. Analysis of this protein sequence reveals the following:

Possible site: 16
>>> Seems to have no N-terminal signal sequence
----- Final Results -----
    bacterial cytoplasm --- Certainty = 0.1404 (Affirmative) <succ>
        bacterial membrane --- Certainty = 0.0000 (Not Clear) <succ>
            bacterial outside --- Certainty = 0.0000 (Not Clear) <succ>

No corresponding DNA sequence was identified in *S. agalactiae*.

The protein has homology with the following sequences in the GENPEPT database:

```
>GP:AAB99233 GB:U67563 oxaloacetate decarboxylase alpha chain (oadA)
[Methanococcus jannaschii]
Identities = 250/453 (55%), Positives = 325/453 (71%), Gaps = 7/453 (1%)
Query:  13    VAITETVLRDGHQSLMATRLSIEDMLPVLTILDKIGYYSLECWGGATFDACIRFLNEDPW    72
              V I +T RD QSL+ATR+ EDMLP+   +D++G+YS+E WGGATFDACIR+LNEDPW
Sbjct:  2     VKIVDTTFRDAQQSLIATRMRTEDMLPIAEKMDEVGFYSMEVWGGATFDACIRYLNEDPW    61

Query:  73    ERLRTLKKGLPNTRLQMLLRGQNLLGYRHYADDIVDKFISLSAQNGIDVFRIFDALNDPR   132
              ERLR LKK + NT LQMLLRGQNL+GYRHY DDIV+KF+  + +NGID+FRIFDALND R
Sbjct:  62    ERLRALKKRIQNTPLQMLLRGQNLVGYRHYPDDIVEKFVIKAHENGIDIFRIFDALNDVR   121
```

```
-continued
Query: 133  NIQQALRAVKKTGKEAQLCIAYTTSPVHTLNYYLSLVKELVEMGADSICIKDMAGILTPK  192
            N++ A++  KK G E Q  I YT SPVHT++ Y+ L K+L EMG DSICIKDMAG+LTP
Sbjct: 122  NMETAIKTAKKVGAEVQGAICYTISPVHTIDQYVELAKKLEEMGCDSICIKDMAGLLTPY  181

Query: 193  AARELVSGIKAMTNLPLIVHTHATSGISQMTYLAAVEAGADRIDTALSPFSEGTSQPATE  252
               ELV  +K   +LP+ VH+H TSG++ MTYL  +EAGAD +D A+SPF+ GTSQP TE
Sbjct: 182  EGYELVKRLKEEISLPIDVHSHCTSGLAPMTYLKVIEAGADMVDCAISPFAMGTSQPPTE  241

Query: 253  SMYLALKEASYDITLDETLLEQAANBLRQARQKYLADGILDPSLLFPDPRTLQYQVPGGM  312
            S+ +ALK   YD LD LL +  ++  + R+KY         +P     D R L YQVPGGM
Sbjct: 242  SIVVALKGTKYDTGLDLKLIBEIRDYFMKVREKYKM--LFSPISQIVDARVLVYQVPGGM  299

Query: 313  LSNMLSQLKQANAESKLEEVLAEVPRVRKDLGYPPLVTPLSQMVGTQAAMNVILGKPYQM  372
            LSN++SQLK+  A  K EEVL E+PRVRKDLGYPPLVTP SQ+VGTQA +NV+  + Y++
Sbjct: 300  LSNLVSQLKEQGALDKFEEVLQEIPRVRKDLGYPPLVTPTSQIVGTQAVLNVLTEERYKI  359

Query: 373  VSKEIKQYLAGDYGKTPAPVNEDLKRSQI--GSAPVTTNRPADQLSPEFEVLK--AEVAD  428
            ++ E+  Y+ G YGK PAP+N +L +  +  G  P+T RPAD L PE+E +K  AE
Sbjct: 360  ITNEVVNYVKGFYGKPPAPINPELLKRVLDEGEKPITC-RPADLLPPEWEKVKKEAEEKG  418

Query: 429  LAQTDEDVLTYALFPSVAKPFLTTKYQTDDVIK                            461
            + + +ED+LTYAL+P +A  FL  + + + K
Sbjct: 419  IVKKEEDILTYALYPQIAVKFLRGELKAEPIPK                            451
```

Based on this analysis, it was predicted that this GAS-specific protein and its epitopes, could be useful antigens for vaccines or diagnostics.

Example 2714

A DNA sequence (GASx1168) was identified in *S. pyogenes* <SEQ ID 7927> which encodes the amino acid sequence <SEQ ID 7928>. Analysis of this protein sequence reveals the following:

---

Possible site: 38

>>> Seems to have an uncleavable N-term signal sequence

INTEGRAL Likelihood = −7.11 Transmembrane 16-32 (2-34)

----- Final Results ----- bacterial membrane --- Certainty = 0.3845 (Affirmative) <succ> bacterial outside --- Certainty = 0.0000 (Not Clear) <succ> bacterial cytoplasm --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2715

A DNA sequence (GASx1170) was identified in *S. pyogenes* <SEQ ID 7929> which encodes the amino acid sequence <SEQ ID 7930>. Analysis of this protein sequence reveals the following:

---

Possible site: 51

>>> Seems to have no N-terminal signal sequence

| INTEGRAL | Likelihood = −7.06 | Transmembrane 211-227 (208-238) |
| INTEGRAL | Likelihood = −5.84 | Transmembrane 117-133 (110-136) |
| INTEGRAL | Likelihood = −5.36 | Transmembrane 256-272 (253-274) |
| INTEGRAL | Likelihood = −4.67 | Transmembrane 44-60 (41-64) |
| INTEGRAL | Likelihood = −4.19 | Transmembrane 287-303 (287-306) |
| INTEGRAL | Likelihood = −3.77 | Transmembrane 358-374 (357-375) |
| INTEGRAL | Likelihood = −2.18 | Transmembrane 20-36 (16-38) |
| INTEGRAL | Likelihood = −0.85 | Transmembrane 90-106 (90-106) |
| INTEGRAL | Likelihood = −0.53 | Transmembrane 165-181 (164-181) |

----- Final Results ----- bacterial membrane --- Certainty = 0.3824 (Affirmative) <succ> bacterial outside --- Certainty = 0.0000 (Not Clear) <succ> bacterial cytoplasm --- Certainty = 0.0000 (Not Clear) <succ>

---

No corresponding DNA sequence was identified in *S. agalactiae*.

The protein has homology with the following sequences in the GENPEPT database:

```
>GP:CAA05140 GB:A.7002015 methylmalonyl-CoA decarboxylase,
beta-subunit [Propionigenium modestum]
Identities = 231/395 (58%), Positives = 293/395 (73%), Gaps = 19/395 (4%)
Query: 1    MLDVLNQMVQSSGLAHLTVNNLIMICLASFFLYLGIKKEYEPYLMVPIAFGILLVNLPMA  60
            ML +    S+G  L + ++IM+ +A FLYL  I KE+EP L+VPI+FGILL NLP A
Sbjct: 1    MLQAILDFYHSTGFYGLNMGSIIMMLVACVFLYLAIAKEFEPLLLVPISFGILLTNLPFA  60

Query: 61   GLMDHP---------ANG---------NPGGLLYYLYKGTSLGIYPPLIFLCLGASTDFG  102
            G+M  P         A+G         PGGLLYYL++G LGI+PPLIFL  +GA TDFG
Sbjct: 61   GMMAEPLLEVHEKLSASGAHLYTAHTAEPGGLLYYLFQGDHLGIFPPLIFLGVGAMTDFG  120
```

-continued

```
Query: 103  PLIANPKTILLGGAAQVGIFLAFFLAIMLGM-TPQRAASVGIIGGADGPTAIYVTTKLAP  161
            PLI+NPK++LLG AAQ GIF+FF AI G+   T QEAAS+GIIGGADGPTAI++++KLAP
Sbjct: 121  PLISNPKSLLLGAAAQFGIFVTFFGAIASGLFTAQEAASIGIIGGADGPTAIFLSSKLAP  180

Query: 162  DLLSTIALAAYSYMALVPIIQPPIIKLLTTKAERQVKMTQARTVSQKEKIIFPIMVTIFV  221
            L+  IA+AAYSYMALVPIIQPPI+  LT++ ER++KM+Q R VS++EKIIFPI+VTI V
Sbjct: 181  HLMGPIAMAAYSYMALVPIIQPPIMTALTSETERKIKMSQLRLVSKREKIIFPIVVTILV  240

Query: 222  SLLVPSATTLVGCLMLGNLVREIKIVPKIVENLQQVVMFCITIILGLTVGAKANGDLFLS  281
            SL+VP A TLVG LMLGNL RE +V +30+++++ITI LG+TVGA A +FL
Sbjct: 241  SLIVPPAATLVGMLMLGNLFRECGVVGRLEDTAKNALINIITIFLGVTVGATATAEAFLK  300

Query: 282  ATTLKIIALGLIAFAAGTAGGVLMGKVMYYLSGNKVNPMIGAAGVSAVPMAARVVQKIGQ  341
             TL  I+ LG++AF  GT  GVL+ K M  LS    +NP++G+AGVSAVPMAARV Q +GQ
Sbjct: 301  VETLAILGLGIVAFGIGTGSGVLLAKFMNKLSKEPINPLLGSAGVSAVPMAARVSQVVGQ  360

Query: 342  EEDPSNFLLMHAMGPNVAGVIGSAIASGALLAFFG                          376
            + DP+NFLLMHAMGPNVAGVIGSA+++G LL+ FG
Sbjct: 361  KADPTNFLLMHAMGPNVAGVIGSAVSAGVLLSLFG                          395
```

Based on this analysis, it was predicted that this GAS-specific protein and its epitopes, could be useful antigens for vaccines or diagnostics.

Example 2716

A DNA sequence (GASx1171R) was identified in *S. pyogenes* <SEQ ID 7931> which encodes the amino acid sequence <SEQ ID 7932>. Analysis of this protein sequence reveals the following:

---
Possible site: 16
>>> Seems to have no N-terminal signal sequence
----- Final Results -----
   bacterial cytoplasm --- Certainty = 0.0851 (Affirmative) <succ>
   bacterial membrane --- Certainty = 0.0000 (Not Clear) <succ>
   bacterial outside --- Certainty = 0.0000 (Not Clear) <succ>
---

No corresponding DNA sequence was identified in *S. agalactiae*.

The protein has homology with the following sequences in the GENPEPT database:

Based on this analysis, it was predicted that this GAS-specific protein and its epitopes, could be useful antigens for vaccines or diagnostics.

Example 2717

A DNA sequence (GASx1172R) was identified in *S. pyogenes* <SEQ ID 7933> which encodes the amino acid sequence <SEQ ID 7934>. Analysis of this protein sequence reveals the following:

---
Possible site: 23
>>> Seems to have no N-terminal signal sequence
----- Final Results -----
   bacterial cytoplasm --- Certainty = 0.2501 (Affirmative) <succ>
   bacterial membrane --- Certainty = 0.0000 (Not Clear) <succ>
   bacterial outside --- Certainty = 0.0000 (Not Clear) <succ>
---

No corresponding DNA sequence was identified in *S. agalactiae*.

The protein has homology with the following sequences in the GENPEPT database:

```
>GP:AAF93965 GB:AE004165 citG protein [Vibrio cholerae]

Identities = 100/287 (34%), Positives = 154/287 (52%), Gaps = 12/287 (4%)

Query: 9    ISQLALKALLYEVSLSPKPGLVDREDNGAHDDMSFITFIDSMIALSPFFQAYIETGFAYA  68
            +  LA  A++ EV L+PKPGLVD +NGAH DM   TFI S  A++P+  +++  G+   A
Sbjct: 32   VGHLAYHAMMLEVHLTPKPGLVDTANNGAHRDMDLNTFIASAEAIAPYLHSFVSAGWESA  91

Query: 69   KEEPLLLFNRLRQLGQKAEETMFCATQGINTHKGLNFSMALLLGATGAYLARTPHLMTDL  128
            L + LR +G +AE+ MF ATQG+NTHKG+ F + L+ G+ G    A
Sbjct: 92   GNPAAQLLSALRPIGIEAEQAMFAATQGVNTHKGMIFILGLICGSVGWLKANQ-------  144

Query: 129  GRFSKEDTLAICRLVKPMTAHLIQTDLGHLNTKKEFTYGEQLFVTYGIKGPRGEASEGFT  188
                K D  I   ++     L+  +L       +   T GE+++   YG+ G RGEA+ G
Sbjct: 145  ---LKIDAQHIGETIRQACQFLVIDELKAKRDCEPETAGERIYRQYGLTGARGEAASGLA  201

Query: 189  TLTDHALPYFRQMISQN-DPETSQLRLLVYLMSIVEDGNLIHRGGIEAWKGVKAD-MRLL  246
            +  HALP ++ +++     E + L+    LM+  D NL+ RGG+     V+    +LL
Sbjct: 202  MVMQHALPAYQACLTKGASTEQALWHTLLVLMANNNDSNLVSRGGLAGLHFVQEQAQQLL  261

Query: 247  LQQDLSTTDLRLALSSYNQCLINQHLSPGGAADLLALTFYFAFLEKL              293
            +      ++ AL++ + LI +HLSPGG+ADLLA T+    L +L
Sbjct: 262  AKGGFLYQEIEQALTALDSVLIEKHLSPGGSADLLAATWLIYELVQL              308
```

```
>GP:CAB12389 GB:Z99107 similar to transcriptional regulator (GntR
family) [Bacillus subtilis]
Identities = 60/205 (29%), Positives = 99/205 (48%), Gaps = 3/205 (1%)
Query:  19   PLKIAFYNALKKTIILRQIPVGSRINEKEFSIALNISRTPIRYALGLLSEEHLVEHIPKK   78
             P + FYN LKK I       G RINE + + +  +SR+PIR A+ LL ++ L++    +
Sbjct:  11   PYYLQFYNQLKKMIFNGTFKPGERINETQLAKSFGVSRSPIREAMRLLEKDGLLKADDRN   70

Query:  79   GIIVKGVSIKDACEIFEIRKALETLATVQAMHLMTEEDFKVMHNLLEDCETFI--AEDDT  136
             G  +  ++ KD  EI++IR  LE LA    +    EE+ ++   LE+ E  I    +DT
Sbjct:  71   GFSITSLTAKDVDEIYKIRIPLEQLAVELVIDEADEEELTILEKQLEETEKAIHNGTEDT  130

Query: 137   NRILDNFNAFNNLIYSYSQMVRLKEIVTELQAYLVYFRKISISSVERRKRALSEHWMIYR  196
                I  N   F+ L+  +S     LK ++  +   + + R ++ +    R + L EH  I+
Sbjct: 131   EIIRLN-QKFHELLVDFSHNRHLKNLLEHVNDLIHFCRILNYTGDHRAETILREHRRIFE  189

Query: 197   GMKNKDHEQITLITHEHLNSSLEFI                                    221
             +K K+ E         H N   E +
Sbjct: 190   EVKKKNKEAAKQHVLAHENHDCEHL                                    214
```

Based on this analysis, it was predicted that this GAS-specific protein and its epitopes, could be useful antigens for vaccines or diagnostics.

Example 2718

A DNA sequence (GASx1173R) was identified in *S. pyogenes* <SEQ ID 7935> which encodes the amino acid sequence <SEQ ID 7936>. Analysis of this protein sequence reveals the following:

```
Possible site: 16
>>> Seems to have a cleavable N-term signal seq.
INTEGRAL   Likelihood = -10.99   Transmembrane 450-466 (445-473)
INTEGRAL   Likelihood = -9.61    Transmembrane 33-49 (30-55)
INTEGRAL   Likelihood = -8.55    Transmembrane 326-342 (321-346)
INTEGRAL   Likelihood = -7.01    Transmembrane 288-304 (286-311)
INTEGRAL   Likelihood = -6.79    Transmembrane 95-111 (88-114)
INTEGRAL   Likelihood = -4.99    Transmembrane 265-281 (264-285)
INTEGRAL   Likelihood = -4.62    Transmembrane 208-224 (204-228)
INTEGRAL   Likelihood = -3.13    Transmembrane 126-142 (126-145)
INTEGRAL   Likelihood = -2.81    Transmembrane 366-382 (365-383)
INTEGRAL   Likelihood = -2.34    Transmembrane 419-435 (417-438)
----- Final Results -----
  bacterial membrane --- Certainty = 0.5394 (Affirmative) <succ>
    bacterial outside --- Certainty = 0.0000 (Not Clear) <succ>
      bacterial cytoplasm --- Certainty = 0.0000 (Not Clear) <succ>
```

A related sequence was also identified in GAS <SEQ ID 9169> which encodes the amino acid sequence <SEQ ID 9170>. Analysis of this protein sequence reveals the following:

```
Possible cleavage site: 39
>>> Seems to have a cleavable N-term signal seq.
INTEGRAL   Likelihood = -10.99   Transmembrane 443-459 (438-466)
INTEGRAL   Likelihood = -8.55    Transmembrane 319-335 (314-339)
INTEGRAL   Likelihood = -7.01    Transmembrane 281-297 (279-304)
INTEGRAL   Likelihood = -6.79    Transmembrane 88-104 (81-107)
INTEGRAL   Likelihood = -4.99    Transmembrane 258-274 (257-278)
INTEGRAL   Likelihood = -4.62    Transmembrane 201-217 (197-221)
INTEGRAL   Likelihood = -3.13    Transmembrane 119-135 (119-138)
INTEGRAL   Likelihood = -2.81    Transmembrane 359-375 (358-376)
INTEGRAL   Likelihood = -2.34    Transmembrane 412-428 (410-431)
----- Final Results -----
  bacterial membrane --- Certainty = 0.539 (Affirmative) <succ>
    bacterial outside --- Certainty = 0.0000 (Not Clear) <succ>
      bacterial cytoplasm --- Certainty = 0.0000 (Not Clear) <succ>
```

No corresponding DNA sequence was identified in *S. agalactiae.*

The protein has homology with the following sequences in the GENPEPT database:

```
>GP:AAG08853 GB:AE004959 probable citrate transporter [Pseudomonas aeruginosa]
Identities = 199/468 (42%), Positives = 296/468 (62%), Gaps = 41/468 (8%)
Query: 9    LLTMLAYAMIIVFMYVVMKKKMTPFTALVMIPLIMTIAVILTGSADFNADAKFVAFVGDG    68
            +LT+LA+AM+  FM+++M K+++   AL+++P                    +AF   G
Sbjct: 1    MLTLLAFAMVATFMFLIMTKRLSALIALILVP--------------------IAFALIG    39

Query: 69   GIAKDLTAIGPMVMYGINNTAKTGIMLLFAILFFSVMLDAGLFDPITEKMIRFAKGDPMK   128
            G A  L   GPM++ GI   A TG+ML+FAIL+F++M+D+GLFDP   K++R  KGDP+K
Sbjct: 40   GFAAGL---GPMMLDGIRTLAPTGVMLMFAILYFAIMIDSGLFDPAVRKILRLVKGDPLK    96

Query: 129  VLIATAVVAAAVSLNGDGTITTLICCSAFLPIYKKLDMKIMNLGVLIILQNTIMNLLPWG   188
            V + TA +A  VSL+GDG+TT +IC +A LP+Y +L M  +  + LI+L + ++N+ PWG
Sbjct: 97   VSLGTAALAMIVSLDGDGSTTYMICVAAVLPLYSRLGMSPLVMACLIMLSSGVLNMTPWG   156

Query: 189  GPTARAMSVLGVGP-EILGYLAPGMILSLL--YVICWVAPSMGRKERARLGVIDL--SEE   243
            GPTARA S L V P +I +   P MI  LL  + I W+    G++ERARLG + L    E
Sbjct: 157  GPTARAASALHVDPADIFVPMIPAMIAGLLAIFAIAWI---YGKRERARLGELHLPTDHE   213

Query: 244  DMRQLTDITDPDTLFIRRPKNFVFNAILTIGLITWLVAGSFNKSIAMAPLLLFAVGTCIA   303
            D+ +++    P+    RRPK   FNAILT+ L+  L+AG      + M  L + A G  IA
Sbjct: 214  DLAEISVSQYPEA---RRPKLLWFNAILTVVLMATLIAGL----LPMPVLFMIAFG--IA   264

Query: 304  LMVNYPVLKDQSKRIGDNAGDAVQVVILVFAAGIFMGLFQGSGMASALAQSFATIIPKQL   363
            ++VNYP +++Q KRIG +A + + VV L+FAAG+F G+  G+GM  A++S   +IP  L
Sbjct: 265  MIVNYPCIQEQKKRIGAHAENILAVVSLIFAAGVFTGILSGTGMVDAMSKSLLAVIPPAL   324
```

```
-continued
Query:  364  AGFWGLVIALVSAPGTFFISNDGFYYGILPVLAEAGAEYGFSNMAMALASLMGQAFHLLS   423
               +  +ALVS  P TFF+SND FYYG+LP+L +A AEYG + + MA AS++GQ  HLLS
Sbjct:  325  GPYLATITALVSMPFTFFMSNDAFYYGVLPILTQAAAEYGITPVEMARASIVGQPVHLLS   384

Query:  424  PLVAFIYLLLRLTGLDMGEWQKEAAKYALIIFVIFVVTIIAMGQMPLY   471
             PLV    YLL+ L  +D G +Q+    K+A+++ +  +     + +G  PL+
Sbjct:  385  PLVPSTYLLVGLAKIDFGDHQRFILKWAVLVCLAILAMALLLGLFPLF   432
```

Based on this analysis, it was predicted that this GAS-specific protein and its epitopes, could be useful antigens for vaccines or diagnostics.

Example 2719

A DNA sequence (GASx1174) was identified in *S. pyogenes* <SEQ ID 7937> which encodes the amino acid sequence <SEQ ID 7938>. Analysis of this protein sequence reveals the following:

Possible site: 57
>>> Seems to have no N-terminal signal sequence
----- Final Results -----
  bacterial cytoplasm --- Certainty = 0.3948 (Affirmative) <succ>
  bacterial membrane --- Certainty = 0.0000 (Not Clear) <succ>
  bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2720

A DNA sequence (GASx1175) was identified in *S. pyogenes* <SEQ ID 7939> which encodes the amino acid sequence <SEQ ID 7940>. Analysis of this protein sequence reveals the following:

Possible site: 39
>>> Seems to have no N-terminal signal sequence
----- Final Results -----
  bacterial cytoplasm --- Certainty = 0.3519 (Affirmative) <succ>
  bacterial membrane --- Certainty = 0.0000 (Not Clear) <succ>
  bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2721

A DNA sequence (GASx1177) was identified in *S. pyogenes* <SEQ ID 7941> which encodes the amino acid sequence <SEQ ID 7942>. Analysis of this protein sequence reveals the following:

Possible site: 60
>>> Seems to have an uncleavable N-term signal seq
INTEGRAL    Likelihood = -9.24    Transmembrane 115-131 (105-137)
INTEGRAL    Likelihood = -8.92    Transmembrane 208-224 (204-238)
INTEGRAL    Likelihood = -7.80    Transmembrane 282-298 (273-303)
INTEGRAL    Likelihood = -4.94    Transmembrane 85-101 (75-102)
INTEGRAL    Likelihood = -4.04    Transmembrane 10-26 (3-32)
INTEGRAL    Likelihood = -3.61    Transmembrane 255-271 (253-271)
----- Final Results -----
  bacterial membrane --- Certainty = 0.4694 (Affirmative) <succ>
  bacterial outside --- Certainty = 0.0000 (Not Clear) <succ>
  bacterial cytoplasm --- Certainty = 0.0000 (Not Clear) <succ>

No corresponding DNA sequence was identified in *S. agalactiae*.

The protein has homology with the following sequences in the GENPEPT database:

```
>GP:AAB89172 GB:AE000960 oxaloacetate decarboxylase, sodium ion pump
subunit (oadB) [Archaeoglobus fulgidus]
Identities = 190/354 (53%), Positives = 255/354 (71%), Gaps = 8/354 (2%)
Query:  16   IVMMVIGALLMYLGIKKEYEPTLLVPMGLGTILVNFPGSGVLTQVVNGVEQEGVFEALFN   75
             +VM+  +G  LL+YLGI K+ EP LLVP+G+G  ILVN  PG G+          E+   +F+
Sbjct:   5   LVMIGVGLLLVYLGIVKKMEPLLLVPIGIGAILVNIPGGGL-------AEEGSIFDLFLK   57

Query:  76   FGIGTELFPLLIFIGIGAMIDFGPLLQNPFMLLFGDAAQFGIFFVVVVAVLAGFDIKEAA   135
             + I TE+ PLLIF+G+GA+ DF PLL NP   L G AAQ GIF ++ A+  GF  +EAA
Sbjct:  58   YLIHTEIVPLLIFLGLGALTDFSPLLANPKTFLLGAAAQIGIFAALIAALFLGFTPQEAA   117

Query:  136  SIGIIGAADGPTSIFVANQLAKDLLGPITVAAYSYMALVPIIQPFAIKLVTTKKERRIRM   195
             SIGIIG ADGPT+I+     LA  LL      VAAYSYM+LVPIIQP  IK  +T+  +ER+I+M
```

-continued

```
Sbjct: 118  SIGIIGGADGPTTIYTTTILAPHLLAATAVAAYSYMSLVPIIQPPIIKALTSSRERKIKM  177

Query: 196  TYKAENVSQMTKILFPIIITLVAGFIAPISLPLVGFLMFGNLLRECGVLDRLSQTAQNEL  255
              +   VS+  KILFPI   +++GF+AP +LPLVG LM GNL RE GV DRL++ A  EL
Sbjct: 178  R-QLRIVSKKEKILFPIATIIISGFLAPKALPLVGMLMTGNLFRESGVTDRLAKGASEEL  236

Query: 256  VNIISILLGLTISIKMQADLFLNVQTLLIIVFGLLAFIMDSIGGVMFAKFLNLFRKEKIN  315
            +NI++I+LGL++   M+A+ FL  +TLL++  G++AF   + GGV+ AK +NLF KEKIN Sbjct: 237  MNIMTIILGLSVGSTMRAESFLTQKTLLVLALGVVAFAAATAGGVLLAKVMNLFLKEKIN  296

Query: 316  PMIGAAGISAFPMSSRVIQKMATDEDPQNFILMYAVGANVSGQIASVIAGGLLL       369
            PMIGAAG+SA PMS+RV+Q++A +EDP N ILM+A+G NV+G I S +A G+L+
Sbjct: 297  PMIGAAGVSAVPMSARVVQRLAIEEDPHNHILMHAMGPNVAGVIGSAVAAGVLI       350
```

Based on this analysis, it was predicted that this GAS-specific protein and its epitopes, could be useful antigens for vaccines or diagnostics.

Example 2722

A DNA sequence (GASx1178) was identified in *S. pyogenes* <SEQ ID 7943> which encodes the amino acid sequence <SEQ ID 7944>. Analysis of this protein sequence reveals the following:

```
Possible site: 16
>>> Seems to have no N-terminal signal sequence
INTEGRAL    Likelihood = −9.50    Transmembrane 21-37 (8-43)
----- Final Results -----
   bacterial membrane --- Certainty = 0.4800 (Affirmative) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

Example 2723

A DNA sequence (GASx1179) was identified in *S. pyogenes* <SEQ ID 7945> which encodes the amino acid sequence <SEQ ID 7946>. Analysis of this protein sequence reveals the following:

```
Possible site: 60
>>> Seems to have no N-terminal signal sequence
----- Final Results -----
   bacterial cytoplasm --- Certainty = 0.1906 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae.*

The protein has homology with the following sequences in the GENPEPT database:

```
>GP:AAF93961 GB:AE004165 citrate lyase, gamma subunit [Vibrio cholerae]

Identities = 46/97 (47%), Positives = 64/97 (65%)

Query: 1  MDIKQTAVAGSLESSDLMITVSPNDEQTITITLDSSVEKQFGNHIRQLIHQTLVNLKVTA  60

M I   A AG+LESSDL + + PN++  I + LDS+VE+QFG+ IRQ++  TL  ++V

Sbjct: 1  MKIAHPAFAGTLESSDLQVRIEPNNDGGIELVLDSTVEQQFGHAIRQVVLHILDAMQVRD  60

Query: 61 ARVEAVDKGALDCTIQARTIAAVHRAAGIDQYDWKEI                         97
           A V   DKGALDC I+AR  AAV RA  +   +W ++

Sbjct: 61 ALVTIEDKGALDCVIRARVQAAVMRACDVQNIEWSQL                         97
```

Example 2724

A DNA sequence (GASx1181) was identified in *S. pyogenes* <SEQ ID 7947> which encodes the amino acid sequence <SEQ ID 7948>. Analysis of this protein sequence reveals the following:

```
Possible site: 16
>>> Seems to have no N-terminal signal sequence
INTEGRAL    Likelihood = -1.65    Transmembrane 74-90 (74-90)
----- Final Results -----
    bacterial membrane --- Certainty = 0.1659 (Affirmative) <succ>
    bacterial outside  --- Certainty = 0.0000 (Not Clear)   <succ>
    bacterial cytoplasm --- Certainty = 0.0000 (Not Clear)  <succ>
```

No corresponding DNA sequence was identified in *S. agalactiae*.

The protein has homology with the following sequences in the GENPEPT database:

```
>GP:CAA71632 GB:Y10621 CILB, citryl-CoA lyase beta subunit
[Leuconostoc mesenteroides]
Identities = 187/293 (63%), Positives = 237/293 (80%), Gaps = 1/293 (0%)
Query: 2     ERLRRTMMFVPGANAAMIRDAPLFGADSIMFDLEDSVSLKEKDTSRALVHFALKTFDYSS    61
             ERLRRTMMFVPG N AM++DA +FGADSIMFDLED+VSL EKD++R LV+ AL+T DY S
Sbjct: 4     ERLRRTMMFVPGNNPAMVKDAGIFGADSIMFDLEDAVSLAEKDSARYLVYEALQTVDYGS    63

Query: 62    VETVVRVNGLDS-CGALDIEAVVLAGVNVIRLPKTETAQDIIDVEAVIERVERENSIEVG   120
             E VVR+NGLD+     DI+A+V AG++VIRLPK ETA + ++E++I   E+E      VG
Sbjct: 64    SELVVRINGLDTPFYKNDIKAMVKAGIDVIRLPKVETAAMMHELESLITDAEKEFGRPVG   123

Query: 121   RTRMMAAIESAEGVLNAREIAKASKRLIGIALGAEDYVTNMKTRRYPDGQELFFARSMIL   180
               T MMAAIESA GV+NA EIA AS R+IGIAL AEDY T+MKT RYPDGQEL +AR++IL
Sbjct: 124   TTHMMAAIESALGVVNAVEIANASDRMIGIALSAEDYTTDMKTHRYPDGQELLYARNVIL   183

Query: 181   HAARAAGIAAIDTVYSDVNNTEGFQNEVRMIKQLGFDGKSVINPRQIPLVNEIYTPTKKE   240
             HAARAAGIAA DTV++++N+ EGF  E ++I QLGFDGKS+INPRQI +VN++Y PT+KE
Sbjct: 184   HAARAAGIAAFDTVETNLNDEEGFYRETQLIHQLGEDGKSLINPRQIEMVNKVYAPTEKE   243

Query: 241   IDHAKQVIWAIREAESKGSGVISLNGKMVDKPIVERAERVIALATAAGVLSEE           293
             I++A+ VI AI EA+ KGSGVIS+NG+MVD+P+V RA+RV+ LA A   ++   E
Sbjct: 244   INNAQNVIAAIEEAKQKGSGVISMNGQMVDRPVVLRAQRVMKLANANHLVDSE           296
```

Example 2725

A DNA sequence (GASx1182) was identified in *S. pyogenes* <SEQ ID 7949> which encodes the amino acid sequence <SEQ ID 7950>. Analysis of this protein sequence reveals the following:

```
Possible site: 55
>>> Seems to have no N-terminal signal sequence
----- Final Results -----
    bacterial cytoplasm --- Certainty = 0.3554 (Affirmative) <succ>
    bacterial membrane  --- Certainty = 0.0000 (Not Clear)   <succ>
    bacterial outside   --- Certainty = 0.0000 (Not Clear)   <succ>
```

No corresponding DNA sequence was identified in *S. agalactiae*.

The protein has homology with the following sequences in the GENPEPT database:

```
>GP:CAA71633 GB:Y10621 CILA, citrate CoA-transferase alpha subunit
[Leuconostoc mesenteroides]
Identities = 294/511 (57%), Positives = 378/511 (73%), Gaps = 7/511 (1%)
Query: 4     NKLGRDIPQPYADQY--GVFEGELANIKQYDESSRRIKPVKPGDSKLLGSVREAIEKTGL    61
             NK+ D+P   +Q   VFE   +    +++   G+SK+ S+ + +   T L
Sbjct: 3     NKVNIDVPDAILEQLDDSVFESTNYGNPEIQRVGPKVRATT-GESKVQSSIDDVLSNT-L    60

Query: 62    TDGMTISFHHHFREGDFIMNMVLEEIAKMGIKNLSIAPSSIANV-HEPLIDHIKNGVVTN   120
             DGMTISFHHHFREGDF+ N V+ +I  MG +NL++APSS+ NV ++  +I+  IK GVVTN
Sbjct: 61    KDGMTISFHHHFREGDFVFNKVMRKIIDMGYQNLTLAPSSLTNVMNDIVIEAIKKGVVTN   120

Query: 121   ITSSGLRDKVGAAISEGLMENPVVIRSHGGRARAIASGDIHIDVAFLGAPSSDAYGNVNG   180
```

-continued

```
                ITSSG+R   +G A+S G+++NPV+ RSHG RARAI SG+I IDVAFLG P+SD  GN NG
Sbjct: 121      ITSSGMRGTLGDAVSHGILKNPVIFRSHGARARAIESGEIKIDVAFLGVPNSDEMGNANG  180

Query: 181      TKGKATCGSLGYAMIDAKYADQVVILTDNLVPYPNTPISIPQTDVDYVVTVDAIGDPQGI  240
                 G A  GSLGYA+IDA+YAD++V++TD ++PYPNTP SI QT VDYVV VD +GDP  I
Sbjct: 181      MNGDAAFGSLGYALIDAQYADKLVLITDTIMPYPNTPASIKQTQVDYVVKVDKVGDPDKI  240

Query: 241      AKGATRFTKNPKELLIAEYAAKVITNSPYFKEGFSFQTGTGGASLAVTRFMREAMIKENI  300
                   GATRFTK+PKEL IA+    VI NS YFK FSFQTG+GGA+LAVTRF+REAM+ +NI
Sbjct: 241      GSGATRFTKDPKELKIAKTVNDVIVNSKYFKNDFSFQTGSGGRALAVTRFLREAMMAQNI  300

Query: 301      KASFALGGITNAMVELLEEELVEKILDVQDFDHPSAVSLGKHAEHYEIDANMYASPLSKG  360
                 ASFALGGIT   V+LL E LV +++DVQDFD  +A S+         EIDA+ YA P +KG
Sbjct: 301      MASFALGGITKPTVDLLNEGLVNRVMDVQDFDKGAASSMKLSPNQQEIDASWYADPANKG  360

Query: 361      AVINQLDTCILSALEVDTNFNVNVMTGSDGVIRGASGGHCDTAFAAKMSLVISPLIRGRI  420
                A+30+++LD ILSALEVDTNFNVNVM+30GSDGVIRGA GGH D A AK++++PL+RGRI
Sbjct: 361      AMVDKLDVAILSALEVDTNFNVNVMSGSDGVIRGAIGGHQDAA-TAKLTIISVPLVRGRI  419

Query: 421      PTFVDEVNTVITPGTSVDVIVTEVGIAINPNRQDLVDHFKSL-NVPQFSIEELKEKAYAI  479
                 T  V +VNTVITPG S+DV+VTEVGIAINP R DLV+  K +  +P +SIEEL++KA  I
Sbjct: 420      ATIVPKVNTVITPGDSIDVVVTEVGIAINPKRTDLVEQLKQVPGLPIYSIEELQQKAEKI  479

Query: 480      VGTPERIQYGDKVVALIEYRDGSLMDVVYNV                              510
                VG P +++  D+VVA+ EYRDGS++D++   V
Sbjct: 480      VGQPAPLKFTDRVVAVAEYRDGSVIDIIKEV                              510
```

Based on this analysis, it was predicted that this GAS-specific protein and its epitopes, could be useful antigens for vaccines or diagnostics.

Example 2726

A DNA sequence (GASx1183) was identified in *S. pyogenes* <SEQ ID 7951> which encodes the amino acid sequence <SEQ ID 7952>. Analysis of this protein sequence reveals the following:

---

Possible site: 13
>>> Seems to have a cleavable N-term signal seq.
----- Final Results -----
   bacterial outside --- Certainty = 0.3000 (Affirmative) <succ>
     bacterial membrane --- Certainty = 0.0000 (Not Clear) <succ>
        bacterial cytoplasm --- Certainty = 0.0000 (Not Clear) <succ>

---

No corresponding DNA sequence was identified in *S. agalactiae*.

The protein has homology with the following sequences in the GENPEPT database:

```
>GP:CAA71634 GB:Y10621 CILG, hypothetical protein [Leuconostoc
mesenteroides]

Identities = 65/176 (36%), Positives = 97/176 (54%), Gaps = 3/176 (1%)

Query: 21   DTYFSGEAIQLSDMLRAREERALRQLHLLKEYPEGSLLSVTMNIPGPIKTSPKLLEAFDI   80
            D +  GE + L  +L  RE R   Q  L+  +P   + SV +N+PGPIKTSPKL   F I
Sbjct: 2    DYFEGGERLNLMQVLDNREWREKYQKQLMASFPTAVITSVKLNLPGPIKTSPKLQSVFQI   61

Query: 81   VIKAIQTALADDKICYQLRLL-PTTGYEYYLITSLPSRDLKLKMIALETELPIGRLMDLD  139
            +I +       D +I +   +    TG + + +TS   + +K  MI  E     +GRL+DLD
Sbjct: 62   IINDLNPVEKDLQIIKEASFVDQITGPDIFFVTSGCLKLVKQIMITFEESHLLGRLLDLD  121

Query: 140  VLVLQNDLPHSISRTVLGGSPRQCFICSKEAKVCGRLRKHSVEEMQTAISKLLHSF      195
            V+    D     +SR  LG +PR+C +C +AK C +HS+      E  + I+K+LH+F
Sbjct: 122  VMCQNAD--KQLSREELGFAPRKCLLCGKDAKTCIKEGNHSLAEGYSQINKMLHNF      175
```

Based on this analysis, it was predicted that this GAS-specific protein and its epitopes, could be useful antigens for vaccines or diagnostics.

Example 2727

A DNA sequence (GASx1184) was identified in *S. pyogenes* <SEQ ID 7953> which encodes the amino acid sequence <SEQ ID 7954>. Analysis of this protein sequence reveals the following:

---

Possible site: 58
>>> Seems to have no N-terminal signal sequence
----- Final Results -----
   bacterial cytoplasm --- Certainty = 0.3730 (Affirmative) <succ>
     bacterial membrane --- Certainty = 0.0000 (Not Clear) <succ>
        bacterial outside --- Certainty = 0.0000 (Not Clear) <succ>

---

No corresponding DNA sequence was identified in *S. agalactiae*.

The protein has homology with the following sequences in the GENPEPT database:

```
>GP:AAB99233 GB:1767563 oxaloacetate decarboxylase alpha chain (oadA)
[Methanococcus jannaschii]
Identities = 245/441 (55%), Positives = 336/441 (75%), Gaps = 5/441 (1%)
Query: 10    IRITETVLRDGQQSQIATRMITKEMIPILETLDNAGYHALEMWGGATFDSCLRFLNEDPW   69
             ++I +T  RD QQS IATRM T++M+PI E +D  G++++E+WGGATFD+C+R+LNEDPW
Sbjct: 2     VKIVDTTFRDAQQSLIATRMRTEDMLPIAEKMDEVGFYSMEVWGGATFDACIRYLNEDPW   61

Query: 70    ERLRAIRKAVKKTKLQMLLRGQNLLGYRNYADDVVRSFIQKSIENGIDIVRIFDALNDPR  129
             ERLRA++K ++ T LQMLLRGQNL+GYR+Y DD+V F+  K+ ENGIDI RIFDALND R
Sbjct: 62    ERLRALKKRIQNTPLQMLLRGQNLVGYRHYPDDIVEKFVIKAHENGIDIFRIFDALNDVR  121

Query: 130   NLQTAVSATKKEGGHAQVAISYTTSPVHTIDYFVELAKAYQAIGADSICIKDMAGVLTPE  189
             N++TA+   KK G   Q AI YT SPVHTID +VELAK  + +G DSICIKDMAG+LTP
Sbjct: 122   NMETAIKTAKKVGAEVQGAICYTISPVHTIDQYVELAKKLEEMGCDSICIKDMAGLLTPY  181

Query: 190   IGYQLVKCIKENTTIPLEVHTHATSGISEMTYLKVAEAGADIIDTAISSFSGGTSQPATE  249
               GY+LVK +KE  ++P++VH+H TSG++MTYLKV  EAGAD++D AIS F+ GTSQP TE
Sbjct: 182   EGYELVKRLKEEISLPIDVHSHCTSGLAPMTYLKVIEAGADMVDCAISPFAMGTSQPPTE  241

Query: 250   SMAIALTDLGFDTGLDMQEVAKVAEYFNTIRDHYREIGILNPKVKDTEPKTLIYQVPGGM  309
             S+ +AL    +DTGLD++  ++  +YF  +R+  Y+    +P  + + + L+YQVPGGM
Sbjct: 242   SIVVALKGTKYDTGLDLKLLNEIRDYFMKVREKYKM--LFSPISQIVDARVLVYQVPGGM  299

Query: 310   LSNLLSQLTEQGLTDKYEEVLAEVPKVRADLGYPPLVTPLSQMVGTQALMNIISGERYKV  369
             LSNL+SQL EQG  DK+ EEVL E+P+VR DLGYPPLVTP SQ+VGTQA++N+++ ERYK+
Sbjct: 300   LSNLVSQLKEQGALDKFEEVLQEIPRVRKDLGYPPLVTPTSQIVGTQAVLNVLTEERYKI  359

Query: 370   VPNEIKDYVRGLYGQSPAPLAEGIKEKIIGD-EAVITCRPADLIEPQMIYLRDEIAP--Y  426
             + NE+ +YV+G YG+ PAP+     + ++++ + E  ITCRPADL+ P+   ++ E
Sbjct: 360   ITNEVVNYVKGFYGKPPAPINPELLKRVLDEGEKPITCRPADLLPPEWEKVKKEAEEKGI  419

Query: 427   AHSEEDVLSYASFPQQARDFL                                        447
                 EED+L+YA +PQ A   FL
Sbjct: 420   VKKEEDILTYALYPQIAVKFL                                        440
```

Based on this analysis, it was predicted that this GAS-specific protein and its epitopes, could be useful antigens for vaccines or diagnostics.

Example 2728

A DNA sequence (GASx1185R) was identified in *S. pyogenes* <SEQ ID 7955> which encodes the amino acid sequence <SEQ ID 7956>. Analysis of this protein sequence reveals the following:

---

Possible site: 40
>>> Seems to have no N-terminal signal sequence

---

----- Final Results ----- bacterial cytoplasm --- Certainty = 0.2497 (Affirmative) <succ> bacterial membrane --- Certainty = 0.0000 (Not Clear) <succ> bacterial outside --- Certainty = 0.0000 (Not Clear) <succ>

---

No corresponding DNA sequence was identified in *S. agalactiae*.

The protein has homology with the following sequences in the GENPEPT database:

```
>GP:AAF93960 GB:AE004165 citrate (pro-3S)-lyase ligase [Vibrio cholerae]
Identities = 118/336 (35%), Positives = 183/336 (54%), Gaps = 5/336 (1%)
Query: 4     YTISKVFPSDKTTMASVKNLLHQEGIRLDAHLDYTCAIMNAQNDVIATGSYFGNSLRCLC   63
             YT S+V   ++T +  +K  L Q + +D +++         N +IA G   G+ L+ +
Sbjct: 10    YTFSRVSTKNRTKLLQIKEFLCQHQLTVDDDVEHF-VVAYGTNQIIACGGIAGHVLKSIA   68

Query: 64    VSSAYQGEGLLNRIVSHLIDEEYALGNYHLFVYTKTSSAAFFKDLGFTEIVHIDNHISFL  123
             VS A QG G   ++++ L +  Y +G + LF++TK ++   F+   GF +   ++ HI+ L
Sbjct: 69    VSPALQGTGFALKLMTELTNFAYEMGRFSLFLFTKPANIDLFRQCGFFLVDKVEPHIALL  128

Query: 124   ENKKTGFQDYLMTLNKPEQTPGKVAAIVINANPFTLGHQFLVEKAARENDWVHLFMVSED  183
             EN     Y L  + +  K+ +IV+NANPFTLGHQ+L+E+A  + DWVHLF+V  +
Sbjct: 129   ENSPNRLSVYCKQLQLLKMSGRKIGSIVMNANPFTLGHQYLIEQACEQCDWVHLFVVKAE  188

Query: 184   RSLIPFSVRKRLIQEGLAHLDNVIYHETGPYLISQATFPAYFQKEDNDVIKSQALLDTAI  243
                    ++ R  +I+ G  HL N+  H    Y+IS+ATFP+YF K+   V +S   LD +I
Sbjct: 189   NKDFSYADRMAMIKAGSKHLLNLTIHSGSDYIISRATFPSYFIKDQQVVNQSHTALDLSI  248

Query: 244   FL-KIAQTLQITKRYVGEEPTSRVTAIYNEIM---AEQLQQAGILLDILPRKAINQQQDP  299
             F   IA L IT R+VG EP   VT  YN+ M    E+  A  + +   +    Q   P
Sbjct: 249   FRHSIAPALGITHRFVGSEPICTVTRHYNQAMRRWLEEAHDASAPIQVVEIERSQQASQP  308

Query: 300   ISASTARQALKDNDWDLLAKLLPKTSLDYFCSLKAQ                         335
             ISAS  R  LK   +A L+PKT+ Y C   A+
Sbjct: 309   ISASRVRYLLKQFGFAAIADLVPKTTYSYLCQHYAE                         344
```

Based on this analysis, it was predicted that this GAS-specific protein and its epitopes, could be useful antigens for vaccines or diagnostics.

Example 2729

A DNA sequence (GASx1187) was identified in *S. pyogenes* <SEQ ID 7957> which encodes the amino acid sequence <SEQ ID 7958>. Analysis of this protein sequence reveals the following:

---

Possible site: 30
>>> Seems to have no N-terminal signal sequence
----- Final Results -----
   bacterial cytoplasm --- Certainty = 0.4790 (Affirmative) <succ>
     bacterial membrane --- Certainty = 0.0000 (Not Clear) <succ>
       bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2730

A DNA sequence (GASx1188R) was identified in *S. pyogenes* <SEQ ID 7959> which encodes the amino acid sequence <SEQ ID 7960>. Analysis of this protein sequence reveals the following:

---

Possible site: 21
>>> Seems to have no N-terminal signal sequence
----- Final Results -----
   bacterial cytoplasm --- Certainty = 0.3956 (Affirmative) <succ>
     bacterial membrane --- Certainty = 0.0000 (Not Clear) <succ>
       bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2731

A DNA sequence (GASx1190) was identified in *S. pyogenes* <SEQ ID 7961> which encodes the amino acid sequence <SEQ ID 7962>. Analysis of this protein sequence reveals the following:

---

Possible site: 14
>>> Seems to have no N-terminal signal sequence
----- Final Results -----
   bacterial cytoplasm --- Certainty = 0.1274 (Affirmative) <succ>
     bacterial membrane --- Certainty = 0.0000 (Not Clear) <succ>
       bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2732

A DNA sequence (GASx1196R) was identified in *S. pyogenes* <SEQ ID 7963> which encodes the amino acid sequence <SEQ ID 7964>. Analysis of this protein sequence reveals the following:

---

Possible site: 33
>>> Seems to have a cleavable N-term signal seq.
----- Final Results -----
   bacterial outside --- Certainty = 0.3000 (Affirmative) <succ>
     bacterial membrane --- Certainty = 0.0000 (Not Clear) <succ>
       bacterial cytoplasm --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2733

A DNA sequence (GASx1211) was identified in *S. pyogenes* <SEQ ID 7965> which encodes the amino acid sequence <SEQ ID 7966>. Analysis of this protein sequence reveals the following:

---

Possible site: 15
>>> Seems to have no N-terminal signal sequence
----- Final Results -----
   bacterial cytoplasm --- Certainty = 0.1850 (Affirmative) <succ>
     bacterial membrane --- Certainty = 0.0000 (Not Clear) <succ>
       bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2734

A DNA sequence (GASx1219R) was identified in *S. pyogenes* <SEQ ID 7967> which encodes the amino acid sequence <SEQ ID 7968>. Analysis of this protein sequence reveals the following:

---

Possible site: 15
>>> Seems to have no N-terminal signal sequence
----- Final Results -----
   bacterial cytoplasm --- Certainty = 0.2284 (Affirmative) <succ> bacterial membrane --- Certainty = 0.0000 (Not Clear) <succ>
bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2735

A DNA sequence (GASx1225) was identified in *S. pyogenes* <SEQ ID 7969> which encodes the amino acid sequence <SEQ ID 7970>. Analysis of this protein sequence reveals the following:

```
Possible site: 27
>>> Seems to have no N-terminal signal sequence
----- Final Results -----
   bacterial cytoplasm --- Certainty = 0.2062 (Affirmative) <succ>
     bacterial membrane --- Certainty = 0.0000 (Not Clear) < succ>
       bacterial outside --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2736

A DNA sequence (GASx1229) was identified in *S. pyogenes* <SEQ ID 7971> which encodes the amino acid sequence <SEQ ID 7972>. Analysis of this protein sequence reveals the following:

```
Possible site: 15
>>> Seems to have no N-terminal signal sequence
----- Final Results -----
   bacterial cytoplasm --- Certainty = 0.2755 (Affirmative) <succ>
     bacterial membrane --- Certainty = 0.0000 (Not Clear) <succ>
       bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2737

A DNA sequence (GASx1247R) was identified in *S. pyogenes* <SEQ ID 7973> which encodes the amino acid sequence <SEQ ID 7974>. Analysis of this protein sequence reveals the following:

```
Possible site: 31
>>> Seems to have a cleavable N-term signal seq.
INTEGRAL      Likelihood = -6.32    Transmembrane 55-71 (53-81)
INTEGRAL      Likelihood = -6.00    Transmembrane 74-90 (72-95)
INTEGRAL      Likelihood = -2.18    Transmembrane 95-111 (95-111)
INTEGRAL      Likelihood = -1.54    Transmembrane 124-140 (123-141)
----- Final Results -----
   bacterial membrane --- Certainty = 0.3527 (Affirmative) <succ>
     bacterial outside --- Certainty = 0.0000 (Not Clear) <succ>
       bacterial cytoplasm --- Certainty = 0.0000 (Not Clear) <succ>
```

No corresponding DNA sequence was identified in *S. agalactiae*.

The protein has homology with the following sequences in the GENPEPT database:

```
>GP:CAB14326 GB:Z99116 yqjA [Bacillus subtilis]
Identities = 97/306 (31%), Positives = 154/306 (49%)
Query:   6    RTLKMTLATIVAILIAYQLHLDYAMSAGIIALLSVLDTRKSSLVVARNRLLSFFLAFGIA    65
              RT+K  L T +AI I+  LHL    SAGII +L +  T+K SL   +  R  +  LA   +
Sbjct:   7    RTIKTALGTALAIYISQLLHLQNFASAGIITILCIQITQKRSLQASWARFWACCLAIAFS    66

Query:  66    MMCFSLFGFTTVGFMCYLLIIIPLLYHFQIEAGLVPITVLVTHLIAKKSIALPILSNEFM   125
              +  F L G+        LLI IP+    +I  G+V  +V++ HL     I    + NE
Sbjct:  67    YLFFELIGYHPFVIGALLLIFIPITVLLKINEGIVTSSVIILHLYMSGGITPTFIWNEVQ   126

Query: 126    LFFVGTSVALLFNAYMGPQDQQIRYYHQKVESDLKGILYRFESFLLEGKGQNEGLLIKNL   185
              L  VG  VALL N YM    D+++  Y +K+E +    I    E +LL G+      G  I
Sbjct: 127    LITVGIGVALLMNLYMPSLDRKLIAYRKKIEDNFAVIFAEIERYLLTGEQDWSGKEIPET   186

Query: 186    DKILDEALKLVYRERHNQLFQQTNYQVHYFEMRRQQNRLLGQMAINVNTLMRQSKESILL   245
              +++ EA  L YR+  N + +  N    HYF+MR +Q  ++ ++     V ++       +  ++
Sbjct: 187    HQLITEAKNLAYRDVQNHILRYENLHYHYFKMREKQFEIIERLLPKVTSISITVDQGKMI   246

Query: 246    SHLFHETACQLSEQNPALTLIDDIEQLLETFRHGDLPQTREEFERRAVLFQLLQDLERFI   305
              +   H+     +   N A   +    + + +F      LP  TREEFE  RA  LF  LL  ++E+++
Sbjct: 247    AEFIHDLREAIHPGNTAYKFLKRLADMRKEFEEMPLPATREEFEARAALFHLLGEMEQYL   306

Query: 306    LLKVEF                                                        311
              ++K  F
Sbjct: 307    VIKSYF                                                        312
```

Based on this analysis, it was predicted that this GAS-specific protein and its epitopes, could be useful antigens for vaccines or diagnostics.

Example 2738

A DNA sequence (GASx1261) was identified in *S. pyogenes* <SEQ ID 7975> which encodes the amino acid sequence <SEQ ID 7976>. Analysis of this protein sequence reveals the following:

Possible site: 15
>>> Seems to have no N-terminal signal sequence
----- Final Results -----
    bacterial cytoplasm --- Certainty = 0.6082 (Affirmative) <succ>
    bacterial membrane --- Certainty = 0.0000 (Not Clear) <succ>
        bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2739

A DNA sequence (GASx1262R) was identified in *S. pyogenes* <SEQ ID 7977> which encodes the amino acid sequence <SEQ ID 7978>. Analysis of this protein sequence reveals the following:

Possible site: 51
>>> Seems to have no N-terminal signal sequence
INTEGRAL    Likelihood = −7.06    Transmembrane 38-54 (37-55)
----- Final Results -----
    bacterial membrane --- Certainty = 0.3824 (Affirmative) <succ>
    bacterial outside --- Certainty = 0.0000 (Not Clear) <succ>
        bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2740

A DNA sequence (GASx1265R) was identified in *S. pyogenes* <SEQ ID 7979> which encodes the amino acid sequence <SEQ ID 7980>. Analysis of this protein sequence reveals the following:

Possible site: 25
>>> Seems to have a cleavable N-term signal seq.
----- Final Results -----
    bacterial outside --- Certainty = 0.3000 (Affirmative) <succ>
    bacterial membrane --- Certainty = 0.0000 (Not Clear) <succ>
        bacterial cytoplasm --- Certainty = 0.0000 (Not Clear) <succ>

No corresponding DNA sequence was identified in *S. agalactiae*.

Based on this analysis, it was predicted that this GAS-specific protein and its epitopes, could be useful antigens for vaccines or diagnostics.

Example 2741

A DNA sequence (GASx1270) was identified in *S. pyogenes* <SEQ ID 7981> which encodes the amino acid sequence <SEQ ID 7982>. Analysis of this protein sequence reveals the following:

Possible site: 36
>>> Seems to have no N-terminal signal sequence
----- Final Results -----
    bacterial cytoplasm --- Certainty = 0.4063 (Affirmative) <succ>
    bacterial membrane --- Certainty = 0.0000 (Not Clear) <succ>
        bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2742

A DNA sequence (GASx1290R) was identified in *S. pyogenes* <SEQ ID 7983> which encodes the amino acid sequence <SEQ ID 7984>. Analysis of this protein sequence reveals the following:

Possible site: 26
>>> Seems to have no N-terminal signal sequence
INTEGRAL    Likelihood = −12.37    Transmembrane 180-196 (172-207)
INTEGRAL    Likelihood = −10.19    Transmembrane 34-50 (30-53)
INTEGRAL    Likelihood = −4.09     Transmembrane 233-249 (232-250)
----- Final Results -----
    bacterial membrane --- Certainty = 0.5946 (Affirmative) <succ>
    bacterial outside --- Certainty = 0.0000 (Not Clear) <succ>
        bacterial cytoplasm --- Certainty = 0.0000 (Not Clear) <succ>

No corresponding DNA sequence was identified in *S. agalactiae*.

The protein has homology with the following sequences in the GENPEPT database:

```
>GP:AAB88010 GB:L21856 MalA [Streptococcus pneumoniae]
Identities = 66/237 (27%), Positives = 105/237 (43%), Gaps = 28/237 (11%)
Query: 45   MIPVTLHYANMITYPLERIVTKSLSPITDKTYQALTQGKIEKD---TFQGQSLIRRD---  98
            M+P  +  ++ TYPLE  +    P+TDK  Q L++     D       T+ G +
Sbjct: 1    MVPIAIQNSSQETYPLETFIDNVYEPLTDKVVQDLSEHATIVDGTLTYTGTASQAPSVVI  60
```

```
                            -continued
Query: 99   GELVLAVLPTKVDLEQLASESTRQIIVTKKEWRFVTPDGKEL-RAHVRGQQQSLADLTTV  157
            G   + LP  + L       T +++++K         + KEL R    R Q        T
Sbjct: 61   GPSQIKELPKDLQLHF----DTNELVISK--------ESKELTRISYRAIQ------TEG  102

Query: 158  KAVKDFVNQQWY---DSNKASVLGFLLLTFVLMVCVGTLIVIGLGAFFLTLTKRSRLFMI   214
               KD + Q +      +N+   +  FL+L   +   +   IV       L +TK+SRLF
Sbjct: 103  FKSKDSLTQAFIRLVPTNRVYISLFLVLGASFLFGLNFFIVSLGACLLLYITKKSRLFSF   162

Query: 215  RNFSEGLGLMVNCLAWPSLLAIALSFFIQDPVLIMNCQVFGTLLMLTWVFYKTQFRD      271
            R F E     ++NCL  P+L+ + L  F Q+    ++    Q    +L L  +FYKT FRD
Sbjct: 163  RTFKECYHFILNCLGLPTLITLILGLFGQNMTTLITVQNILFVLYLVTIFYKTHFRD      219
```

Based on this analysis, it was predicted that this GAS-specific protein and its epitopes, could be useful antigens for vaccines or diagnostics.

Example 2743

A DNA sequence (GASx1294) was identified in *S. pyogenes* <SEQ ID 7985> which encodes the amino acid sequence <SEQ ID 7986>. Analysis of this protein sequence reveals the following:

Possible site: 18
>>> Seems to have no N-terminal signal sequence
----- Final Results -----
  bacterial cytoplasm --- Certainty = 0.2104 (Affirmative) <succ>
    bacterial membrane --- Certainty = 0.0000 (Not Clear) <succ>
    bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2744

A DNA sequence (GASx1303R) was identified in *S. pyogenes* <SEQ ID 7987> which encodes the amino acid sequence <SEQ ID 7988>. Analysis of this protein sequence reveals the following:

Possible site: 38
>>> Seems to have an uncleavable N-terminal signal sequence
INTEGRAL    Likelihood = –8.07    Transmembrane    13-29 (8-38)
----- Final Results -----
  bacterial membrane --- Certainty = 0.4227 (Affirmative) <succ>
    bacterial outside --- Certainty = 0.0000 (Not Clear) <succ>
    bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2745

A DNA sequence (GASx1307R) was identified in *S. pyogenes* <SEQ ID 7989> which encodes the amino acid sequence <SEQ ID 7990>. Analysis of this protein sequence reveals the following:

Possible site: 19
>>> Seems to have a cleavable N-terminal signal sequence
----- Final Results -----
  bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2746

A DNA sequence (GASx1312R) was identified in *S. pyogenes* <SEQ ID 7991> which encodes the amino acid sequence <SEQ ID 7992>. Analysis of this protein sequence reveals the following:

Possible site: 21
>>> Seems to have no N-terminal signal sequence
----- Final Results -----
  bacterial cytoplasm --- Certainty = 0.1996 (Affirmative) <succ>
    bacterial membrane --- Certainty = 0.0000 (Not Clear) <succ>
    bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2747

A DNA sequence (GASx1316R) was identified in *S. pyogenes* <SEQ ID 7993> which encodes the amino acid sequence <SEQ ID 7994>. Analysis of this protein sequence reveals the following:

Possible site: 58
>>> Seems to have no N-terminal signal sequence
----- Final Results -----
  bacterial cytoplasm --- Certainty = 0.3504 (Affirmative) <succ>
    bacterial membrane --- Certainty = 0.0000 (Not Clear) <succ>
    bacterial outside --- Certainty = 0.0000 (Not Clear) <succ>

RGD motif: 271-273

No corresponding DNA sequence was identified in *S. agalactiae*.

The protein has homology with the following sequences in the GENPEPT database:

```
>GP:AAC66321 GB:AE000792 outer surface protein, putative [Borrelia
burgdorferi]
Identities = 127/365 (34%), Positives = 195/365 (52%), Gaps = 14/365 (3%)
Query: 1    MVDLGFSLYPERYDVTKSKAYIDLCHSYGAKRLFMSLLQLAPADHQMFMCYAELIAYANQ    60
            M ++G S+YP      K   Y++   +G ++F  SLL +   +   F  + EL++ AN+
Sbjct: 1    MKEIGISIYPNVSPKNKIIKYLEKSAHFGFTQVFTSLLYI---NGNEFDIFKELLSIANK    57

Query: 61   LGIRVIADVSPSFISQAGWSDQLIERA------HAFGLAGLRLDEALPLAEIVTLTRNPF   114
            G++ I DVSP   + G    +           G   +RLD      E +T    N
Sbjct: 58   NGMKPIIDVSPEIFKELGIDLSNLRNCPKLDYFKKLGAWAIRLDNTFTGIEESLMTFNDS   117

Query: 115  GLKIELNMSTDKQLLMSLLATDAERSNIIGCHNFYPHEFTGLSWQHFKDMSRFYHEHDIE   174
            LKI+LN+S    + + +++       N++GCHNFYPH++TGLS   FK+ ++ +   + I
Sbjct: 118  DLKIQLNISNINKHIDTIMYFKPNIKNLLGCHNFYPHKYTGLSRNFFKETTKIFKHYSIP   177

Query: 175  TAAFITAQSASE-GPWLLAEGLPTVEDHRHLPIGLQVELMKAIGTIDNILISNQFISEEE   233
            TAAFI++ +A E    EG+PT+E HR   I  Q + +   G ID +LISN F SE E
Sbjct: 178  TAAFISSNNAEECARGKEKEGVPTLESHRSKDIETQAKDLEKEG-IDTVLISNCFPSETE   236

Query: 234  LAACTQALARPVTTIKVRPIIDLTEVEEQII-GYPHCYRGDVSDYVIRSTMPRLVYAQES   292
            L   ++ + R +  +K      D    VE++II     H  RGD++ Y IRSTMPR+ Y  +
Sbjct: 237  LKKVSK-VNRNILELKADLNPDANSVEKEIILENLHFNRGDINSYRIRSTMPRVYYNNKK   295

Query: 293  IAPRDQSKEVKRGSIIIDNDRYHRYKGELQIALKNFTVSSKANVVAEVREDYLSLLDDLR   352
              P      E+K+G I+ID+  Y  Y GELQIALK+     +   NVV ++  D + LL+ +
Sbjct: 296  F-PVHSPNEIKKGDILIDSSEYLGYTGELQIALKDTPNNGLVNVVGKIINDEIYLLEKIE   354

Query: 353  PWQEF                                                         357
            PW++F
Sbjct: 355  PWEKF                                                         359
```

Based on this analysis, it was predicted that this GAS-specific protein and its epitopes, could be useful antigens for vaccines or diagnostics.

Example 2748

A DNA sequence (GASx1319) was identified in *S. pyogenes* <SEQ ID 7995> which encodes the amino acid sequence <SEQ ID 7996>. Analysis of this protein sequence reveals the following:

---

Possible site: 34
>>> Seems to have no N-terminal signal sequence
INTEGRAL     Likelihood = −9.50    Transmembrane 127-143 (125-151)
INTEGRAL     Likelihood = −7.43    Transmembrane 17-33 (15-36)
INTEGRAL     Likelihood = −5.68    Transmembrane 39-55 (36-57)
INTEGRAL     Likelihood = −1.86    Transmembrane 60-76 (59-77)
INTEGRAL     Likelihood = −0.59    Transmembrane 85-101 (85-101)
----- Final Results -----
   bacterial membrane --- Certainty = 0.4800 (Affirmative) <succ>
      bacterial outside --- Certainty = 0.0000 (Not Clear) <succ>
         bacterial cytoplasm --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2749

A DNA sequence (GASx1320) was identified in *S. pyogenes* <SEQ ID 7997> which encodes the amino acid sequence <SEQ ID 7998>. Analysis of this protein sequence reveals the following:

---

Possible site: 45
>>>Seems to have no N-terminal signal sequence

INTEGRAL     Likelihood = −1.81    Transmembrane 35-51 (35-51)
----- Final Results -----
   bacterial membrane --- Certainty = 0.1723 (Affirmative) <succ>
      bacterial outside --- Certainty = 0.0000 (Not Clear) <succ>
         bacterial cytoplasm --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2750

A DNA sequence (GASx1321) was identified in *S. pyogenes* <SEQ ID 7999> which encodes the amino acid sequence <SEQ ID 8000>. Analysis of this protein sequence reveals the following:

---

Possible site: 29
>>> Seems to have an uncleavable N-terminal signal sequence
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>

---

No corresponding DNA sequence was identified in *S. agalactiae*.

The protein has no significant homology with any sequences in the GENPEPT database.

Example 2751

A DNA sequence (GASx1329) was identified in *S. pyogenes* <SEQ ID 8001> which encodes the amino acid sequence <SEQ ID 8002>. Analysis of this protein sequence reveals the following:

```
Possible site: 44
>>> Seems to have no N-terminal signal sequence
INTEGRAL    Likelihood = -1.28    Transmembrane 64-80 (64-80)
----- Final Results -----
    bacterial membrane --- Certainty = 0.1510 (Affirmative) <succ>
        bacterial outside --- Certainty = 0.0000 (Not Clear) <succ>
            bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2752

A DNA sequence (GASx1332R) was identified in *S. pyogenes* <SEQ ID 8003> which encodes the amino acid sequence <SEQ ID 8004>. Analysis of this protein sequence reveals the following:

```
Possible site: 37
>>> Seems to have an uncleavable N-terminal signal sequence
----- Final Results -----
    bacterial membrane --- Certainty = 0.0000 (Not Clear) <succ>
        bacterial outside --- Certainty = 0.0000 (Not Clear) <succ>
            bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2753

A DNA sequence (GASx1333) was identified in *S. pyogenes* <SEQ ID 8005> which encodes the amino acid sequence <SEQ ID 8006>. Analysis of this protein sequence reveals the following:

```
Possible site: 29
>>> Seems to have an uncleavable N-terminal signal sequence
----- Final Results -----
    bacterial membrane --- Certainty = 0.0000 (NotClear) <succ>
        bacterial outside --- Certainty = 0.0000 (NotClear) <succ>
            bacterial cytoplasm --- Certainty = 0.0000 (NotClear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2754

A DNA sequence (GASx1335R) was identified in *S. pyogenes* <SEQ ID 8007> which encodes the amino acid sequence <SEQ ID 8008>. Analysis of this protein sequence reveals the following:

```
Possible site: 37
>>> Seems to have an uncleavable N-terminal signal sequence
----- Final Results -----
    bacterial membrane --- Certainty = 0.0000 (Not Clear) <succ>
        bacterial outside --- Certainty = 0.0000 (Not Clear) <succ>
            bacterial cytoplasm --- Certainty = 0.0000 (Not Clear) <succ>
```

No corresponding DNA sequence was identified in *S. agalactiae*.

The protein has homology with the following sequences in the GENPEPT database:

```
>GP:AAF96047 GB:AE004354 uridine phosphorylase [Vibrio cholerae]
Identities = 46/167 (27%), Positives = 72/167 (42%), Gaps = 12/167 (7%)
Query:   8   GVKEMISTGICGVLVP-IAENRELVPVKALRDEGTSYHYVAPSRYIDIDPKMLRLIEKTL   66
             G K ++  G+ G +      I     ++    A+RDEG S  Y+          +++ +++ L
Sbjct:  79   GAKAIVRVGSAGAMQSEIGLGELILVEGAVRDEGGSKAYIGAAYPAYSSFELVVEMQRFL  138

Query:  67   LAQGLAYQEVITWSTDGFYR-ETKEKVAHRQEEGCSVVEMECSALAAVAQLRG-----IL  120
                Q +    I S D FY  E E   +   +G     +ME SAL   V +LRG         +L
Sbjct: 139   AEQSVPIHRGIVRSHDSFYTDEEAELCRYWHRKGILAADMETSALLTVGRLRGLQVASVL  198

Query: 121   WGQLLFTADTLADVEVY---DQRNWGADSFSFALHLCLEVLNTLEKD              164
                +L+  D  A V Y    DQR    +   + A    L  LN L+ D
Sbjct: 199   NNVVLYEQDVQAGVNQYVNADQRMMQGE--TLAARAALHALNALKFD              243
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2755

A DNA sequence (GASx1353) was identified in *S. pyogenes* <SEQ ID 8009> which encodes the amino acid sequence <SEQ ID 8010>. Analysis of this protein sequence reveals the following:

```
Possible site: 42
>>> Seems to have a cleavable N-terminal signal sequence
INTEGRAL    Likelihood = −5.79    Transmembrane 241-257 (234-260)
INTEGRAL    Likelihood = −5.15    Transmembrane 44-60 (43-65)
INTEGRAL    Likelihood = −4.78    Transmembrane 74-90 (72-92)
----- Final Results-----
    bacterial membrane --- Certainty = 0.3314 (Affirmative) <succ>
      bacterial outside --- Certainty = 0.0000 (Not Clear) <succ>
        bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2756

A DNA sequence (GASx1354R) was identified in *S. pyogenes* <SEQ ID 8011> which encodes the amino acid sequence <SEQ ID 8012>. Analysis of this protein sequence reveals the following:

```
Possible site: 55
>>> Seems to have a cleavable N-terminal signal sequence
INTEGRAL    Likelihood = −3.45    Transmembrane 68-84 (65-86)
----- Final Results -----
    bacterial membrane --- Certainty = 0.2381 (Affirmative) <succ>
      bacterial outside --- Certainty = 0.0000 (Not Clear) <succ>
        bacterial cytoplasm --- Certainty = 0.0000 (Not Clear) <succ>
```

No corresponding DNA sequence was identified in *S. agalactiae*.

The protein has homology with the following sequences in the GENPEPT database:

```
>GP:CAB83831 GB:AL162753 putative integral membrane protein [Neisseria
meningitidis]
Identities = 31/72 (430), Positives = 46/72 (63%), Gaps = 6/72 (8%)
Query:  17  FVIYAFDKRKAIKKKRRISERKLLVITVLFGGF-GALLAAKKYHHKTRKWYFVI----TC   71
            F +Y  DKR+A++ KRRI E +LL +   LFGG+ GA L ++ + HKT K  FV+     T
Sbjct:  38  FALYGIDKRRAVRGKRRIPEHRLL-LPALFGGWAGAYLGSRIFRHKTAKKRFVVLFRLTV   96

Query:  72  YTSILLTLLVTY                                                 83
            ++L TL++ Y
Sbjct:  97  SGNVLATLILIY                                                108
```

Based on this analysis, it was predicted that this GAS-specific protein and its epitopes, could be useful antigens for vaccines or diagnostics.

Example 2757

A DNA sequence (GASx1363R) was identified in *S. pyogenes* <SEQ ID 8013> which encodes the amino acid sequence <SEQ ID 8014>. Analysis of this protein sequence reveals the following:

```
Possible site: 21
>>> Seems to have an uncleavable N-terminal signal sequence
----- Final Results -----
    bacterial membrane --- Certainty = 0.0000 (Not Clear) <succ>
      bacterial outside --- Certainty = 0.0000 (Not Clear) <succ>
        bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2758

A DNA sequence (GASx1367) was identified in *S. pyogenes* <SEQ ID 8015> which encodes the amino acid sequence <SEQ ID 8016>. Analysis of this protein sequence reveals the following:

```
Possible site: 31
>>> Seems to have an uncleavable N-terminal signal sequence
----- Final Results -----
    bacterial membrane --- Certainty = 0.0000 (Not Clear) <succ>
      bacterial outside --- Certainty = 0.0000 (Not Clear) <succ>
        bacterial cytoplasm --- Certainty = 0.0000 (Not Clear) <succ>
```

No corresponding DNA sequence was identified in *S. agalactiae*.

The protein has homology with the following sequences in the GENPEPT database:

```
>GP:CAA63508 GB:X92946 hypothetical protein [Lactococcus lactis]
Identities = 64/96 (66%), Positives = 77/96 (79%)
Query:   1  MPRKTFDKAFKLSAVKLILEEEQPVKMVSSTLEIHPNSLYQWIQEYEKYGESAFPGHGSA   60
            M R+ FDK FK SAVKLILEE   VK VS  LE+H NSLY+W+QE E+YGESAFPG+G+A
Sbjct:   1  MARRKFDKQFKNSAVKLILEEGYSVKEVSQELEVHANSLYRWVQEVEEYGESAFPGNGTA   60
```

```
-continued
Query:  61 LRHAQFKTKKLEKEHKLLQEELALLKKFQVFLKPNR        96
           L +AQ  K K LEKE++ LQEEL LLKKF+VFLK ++
Sbjct:  61 LANAQHKIKLLEKENRYLQEELELLKKFRVFLKRSK        96
```

Based on this analysis, it was predicted that this GAS-specific protein and its epitopes, could be useful antigens for vaccines or diagnostics.

Example 2759

A DNA sequence (GASx1374R) was identified in *S. pyogenes* <SEQ ID 8017> which encodes the amino acid sequence <SEQ ID 8018>. Analysis of this protein sequence reveals the following:

```
Possible site: 39
>>> Seems to have no N-terminal signal sequence
----- Final Results -----
    bacterial cytoplasm --- Certainty = 0.2585 (Affirmative) <succ>
      bacterial membrane --- Certainty = 0.0000 (Not Clear) <succ>
        bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2760

A DNA sequence (GASx1382R) was identified in *S. pyogenes* <SEQ ID 8019> which encodes the amino acid sequence <SEQ ID 8020>. Analysis of this protein sequence reveals the following:

```
Possible site: 14
>>> Seems to have an uncleavable N-term signal seq
INTEGRAL      Likelihood = –2.39       Transmembrane 3-19 (3-19)
----- Final Results -----
    bacterial membrane --- Certainty = 0.1956 (Affirmative) <succ>
        bacterial outside --- Certainty = 0.0000 (Not Clear) <succ>
      bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2761

A DNA sequence (GASx1391R) was identified in *S. pyogenes* <SEQ ID 8021> which encodes the amino acid sequence <SEQ ID 8022>. Analysis of this protein sequence reveals the following:

```
Possible site: 22
>>> May be a lipoprotein
```

```
----- Final Results -----
    bacterial membrane --- Certainty = 0.0000 (Not Clear) <succ>
        bacterial outside --- Certainty = 0.0000 (Not Clear) <succ>
      bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2762

A DNA sequence (GASx1404) was identified in *S. pyogenes* <SEQ ID 8023> which encodes the amino acid sequence <SEQ ID 8024>. Analysis of this protein sequence reveals the following:

```
Possible site: 32
>>> Seems to have no N-terminal signal sequence
----- Final Results -----
    bacterial cytoplasm --- Certainty = 0.3046 (Affirmative) <succ>
      bacterial membrane --- Certainty = 0.0000 (Not Clear) <succ>
        bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2763

A DNA sequence (GASx1412R) was identified in *S. pyogenes* <SEQ ID 8025> which encodes the amino acid sequence <SEQ ID 8026>. Analysis of this protein sequence reveals the following:

```
Possible site: 20
>>> Seems to have no N-terminal signal sequence
----- Final Results -----
    bacterial cytoplasm --- Certainty = 0.1590 (Affirmative) <succ>
      bacterial membrane --- Certainty = 0.0000 (Not Clear) <succ>
        bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2764

A DNA sequence (GASx1414R) was identified in *S. pyogenes* <SEQ ID 8027> which encodes the amino acid sequence <SEQ ID 8028>. Analysis of this protein sequence reveals the following:

```
Possible site: 24
>>> Seems to have no N-terminal signal sequence
----- Final Results -----
   bacterial cytoplasm --- Certainty = 0.2816 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2765

A DNA sequence (GASx1416) was identified in *S. pyogenes* <SEQ ID 8029> which encodes the amino acid sequence <SEQ ID 8030>. Analysis of this protein sequence reveals the following:

```
Possible site: 34
>>> Seems to have no N-terminal signal sequence
----- Final Results -----
   bacterial cytoplasm --- Certainty = 0.1744 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2766

A DNA sequence (GASx1417) was identified in *S. pyogenes* <SEQ ID 8031> which encodes the amino acid sequence <SEQ ID 8032>. Analysis of this protein sequence reveals the following:

```
Possible site: 13
>>> Seems to have no N-terminal signal sequence
----- Final Results -----
   bacterial cytoplasm --- Certainty = 0.3771 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2767

A DNA sequence (GASx1419R) was identified in *S. pyogenes* <SEQ ID 8033> which encodes the amino acid sequence <SEQ ID 8034>. Analysis of this protein sequence reveals the following:

```
Possible site: 13
>>> Seems to have an uncleavable N-term signal seq
INTEGRAL    Likelihood = -10.93    Transmembrane 4-20 (1-25)
----- Final Results -----
   bacterial membrane --- Certainty = 0.5373 (Affirmative) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2768

A DNA sequence (GASx1423) was identified in *S. pyogenes* <SEQ ID 8035> which encodes the amino acid sequence <SEQ ID 8036>. Analysis of this protein sequence reveals the following:

```
Possible site: 39
>>> Seems to have no N-terminal signal sequence
INTEGRAL    Likelihood = -8.97    Transmembrane 30-46 (25-49)
INTEGRAL    Likelihood = -7.80    Transmembrane 52-68 (50-72)
INTEGRAL    Likelihood = -6.95    Transmembrane 129-145 (125-146)
----- Final Results -----
   bacterial membrane --- Certainty = 0.4588 (Affirmative) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2769

A DNA sequence (GASx1426R) was identified in *S. pyogenes* <SEQ ID 8037> which encodes the amino acid sequence <SEQ ID 8038>. Analysis of this protein sequence reveals the following:

```
Possible site: 25
>>> Seems to have a cleavable N-term signal seq.
INTEGRAL    Likelihood = -3.45    Transmembrane 36-52 (36-55)
----- Final Results -----
   bacterial membrane --- Certainty = 0.2381 (Affirmative) <succ>
```

-continued

```
    bacterial outside --- Certainty = 0.0000 (Not Clear) <succ>
    bacterial cytoplasm --- Certainty = 0.0000 (Not Clear) <succ>
```

No corresponding DNA sequence was identified in *S. agalactiae*.

The protein has homology with the following sequences in the GENPEPT database:

```
>GP:AAC39287 GB:AF115103 orf87 gp [Streptococcus thermophilus
bacteriophage Sfi21]
Identities = 43/73 (58%), Positives = 61/73 (82%)
Query:  1    MINLKLRLQNKVTLMAILGAIFLLAQQLGIKLPSNIADIANTAVTLLVLLGVVTDPTTKG   60
             MIN KLRLQNK TL+A++ A+FL+ QQ G+ +P+NI +  NT V +LV+LG++TDPTTKG
Sbjct:  8    MINFKLRLQNKATLVALISAVFLMLQQFGLHVPNNIQEGINTLVGILVILGIITDPTTKG   67

Query: 61    LSDSEQALTYHEP                                                73
             ++DSE+AL+Y +P
Sbjct: 68    IADSERALSYIQP                                                80
```

Based on this analysis, it was predicted that this GAS-specific protein and its epitopes, could be useful antigens for vaccines or diagnostics.

Example 2770

A DNA sequence (GASx1427R) was identified in *S. pyogenes* <SEQ ID 8039> which encodes the amino acid sequence <SEQ ID 8040>. Analysis of this protein sequence reveals the following:

Possible site: 27
>>> Seems to have an uncleavable N-term signal seq
INTEGRAL    Likelihood = –3.03    Transmembrane 2-18 (1-23)
----- Final Results -----
    bacterial membrane --- Certainty = 0.2211 (Affirmative) <succ>
    bacterial outside --- Certainty = 0.0000 (Not Clear) <succ>
    bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2771

A DNA sequence (GASx1428R) was identified in *S. pyogenes* <SEQ ID 8041> which encodes the amino acid sequence <SEQ ID 8042>. Analysis of this protein sequence reveals the following:

Possible site: 20
>>> Seems to have no N-terminal signal sequence
----- Final Results -----
    bacterial cytoplasm --- Certainty = 0.1017 (Affirmative) <succ>
    bacterial membrane --- Certainty = 0.0000 (Not Clear) <succ>
    bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2772

A DNA sequence (GASx1429R) was identified in *S. pyogenes* <SEQ ID 8043> which encodes the amino acid sequence <SEQ ID 8044>. Analysis of this protein sequence reveals the following:

Possible site: 46
>>> Seems to have no N-terminal signal sequence
----- Final Results -----
    bacterial cytoplasm --- Certainty = 0.3097 (Affirmative) <succ>
    bacterial membrane --- Certainty = 0.0000 (Not Clear) <succ>
    bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2773

A DNA sequence (GASx1431R) was identified in *S. pyogenes* <SEQ ID 8045> which encodes the amino acid sequence <SEQ ID 8046>. Analysis of this protein sequence reveals the following:

Possible site: 50
>>> Seems to have no N-terminal signal sequence
----- Final Results -----
    bacterial cytoplasm --- Certainty = 0.2584 (Affirmative) <succ>
    bacterial membrane --- Certainty = 0.0000 (Not Clear) <succ>
    bacterial outside --- Certainty = 0.0000 (Not Clear) <succ>

No corresponding DNA sequence was identified in *S. agalactiae*.

The protein has homology with the following sequences in the GENPEPT database:

```
>GP:AAA98101 GB:M19348 hyaluronidase [Streptococcus pyogenes phage H4489A]
Identities = 337/371 (90%), Positives = 351/371 (93%), Gaps = 1/371 (0%)
Query:   1   MAENIPLRVQFKRMKAAEWASSDVVLLEGEIGFETDTGFAKFGDGQNTFSKLKYLTGPKG    60
             M ENIPLRVQFKRM A EWA SDV+LLEGEIGFETDTGFAKFGDGQNTFSKLKYLTGPKG
Sbjct:   1   MTENIPLRVQFKRMSADEWARSDVILLEGEIGFETDTGFAKFGDGQNTFSKLKYLTGPKG    60

Query:  61   PKGDTGLQGKTGGTGSRGPAGKPGTTDYDQLQNKPDLGAFAQKEETNSKITKLESSKADK   120
             PKGDTGLQGKTGGTG RGPAGKPGTTDYDQLQNKPDLGAFAQKEETNSKITKLESSKADK
Sbjct:  61   PKGDTGLQGKTGGTGPRGPAGKPGTTDYDQLQNKPDLGAFAQKEETNSKITKLESSKADK   120

Query: 121   NAVYLKAESNAKLDEKLNLKGGVMTGQLQFKPN-SGIKPSSSVGGAINIDMSKSEGAAMV   179
             +AVY KAES   +LD+KL+L GG++TGQLQFKPN SGIKPSSSVGGAINIDMSKSEGAAMV
Sbjct: 121   SAVYSKAESKIELDKKLSLTGGIVTGQLQFKPNKSGIKPSSSVGGAINIDMSKSEGAAMV   180

Query: 180   MYTNKDTTDGPLMILRSNKDTEDQSVQFVDYKGTTNAVNIVMRQPTTPNESSALNITSAN   239
             MYTNKDTTDGPLMILRS+KDTFDQS QFVDY G TNAVNIVMRQP+ PNFSSALNITSAN
Sbjct: 181   MYTNKDTTDGPLMILRSDKDTEDQSAQFVDYSGKTNAVNIVMRQPSAPNESSALNITSAN   240

Query: 240   EGGSAMQIRGVEKALGTLKITHENPSVDKEYDENAAALSIDIVKKQKGGKGTAAQGIYIN   299
             EGGSAMQIRGVEKALGTLKITHENP+V+ +YDENAAALSIDIVKKQKGGKGTAAQGIYIN
Sbjct: 241   EGGSAMQIRGVEKALGTLKITHENPNVEAKYDENAAALSIDIVKKQKGGKGTAAQGIYIN   300

Query: 300   STSGTAGKMLRIRNKNKDKFYVGPDGDFWSCASSIVDGNLTVKDPTSGKHAATKDYVDEK   359
             STSGTAGKMLRIRNKN+DKFYVGPDG F S A+S V GNLTVKDPTSGKHAATKDYVDEK
Sbjct: 301   STSGTAGKMLRIRNKNEDKEYVGPDGGEHSGANSTVAGNLTVKDPTSGKHAATKDYVDEK   360

Query: 360   IAELKKLILKK                                                   370
             IAELKKLILKK
Sbjct: 361   IAELKKLILKK                                                   371
```

Based on this analysis, it was predicted that this GAS-specific protein and its epitopes, could be useful antigens for vaccines or diagnostics.

Example 2774

A DNA sequence (GASx1438R) was identified in *S. pyogenes* <SEQ ID 8047> which encodes the amino acid sequence <SEQ ID 8048>. Analysis of this protein sequence reveals the following:

Possible site: 55
>>> Seems to have no N-terminal signal sequence
----- Final Results -----
   bacterial cytoplasm --- Certainty = 0.1892 (Affirmative) <succ>
   bacterial membrane --- Certainty = 0.0000 (Not Clear) <succ>
   bacterial outside --- Certainty = 0.0000 (Not Clear) <succ>

A related DNA sequence <SEQ ID 10439> was identified in GBS which encodes amino acid sequence <SEQ ID 10440>.

No corresponding DNA sequence was identified in *S. agalactiae*.

The protein has homology with the following sequences in the GENPEPT database:

```
>GP:AAB18711 GB:U38906 ORF36 [Bacteriophage rlt]
Identities = 70/111 (63%), Positives = 88/111 (79%)
Query:   1   LIEVIIKKYLDEHLDVPSFFEHQKDEPARFIILEKTSGAKQNHLLSSTFAFQSYAESLYE    60
             +IE+IIK +LD HL V SF E + + P  +I+ EKT  +K NHLLSSTFAFQSYA S+YE
Sbjct:   1   MIEIIIKNFLDTHLSVSSFLEKKGEMPLSYILFEKTGSSKSNHLLSSTFAFQSYAPSMYE    60

Query:  61   AALLNDKVKQVIEQLDVLPQVSGVHLNADYNFTDTATKRYRYQAVFDINHY            111
             AA LN+++K+V+E+L   L  ++S V LN+DYNFTDT TK YRYQAVFDINHY
Sbjct:  61   AAKLNEQLKEVVERLIELNEISNVSLNSDYNFTDTETKEYRYQAVFDINHY            111
```

Based on this analysis, it was predicted that this GAS-specific protein and its epitopes, could be useful antigens for vaccines or diagnostics.

Example 2775

A DNA sequence (GASx1442R) was identified in *S. pyogenes* <SEQ ID 8049> which encodes the amino acid sequence <SEQ ID 8050>. Analysis of this protein sequence reveals the following:

Possible site: 55
>>> Seems to have no N-terminal signal sequence
----- Final Results -----
   bacterial cytoplasm --- Certainty = 0.1241 (Affirmative) <succ>
   bacterial membrane --- Certainty = 0.0000 (Not Clear) <succ>
   bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2776

A DNA sequence (GASx1444R) was identified in *S. pyogenes* <SEQ ID 8051> which encodes the amino acid sequence <SEQ ID 8052>. Analysis of this protein sequence reveals the following:

Possible site: 42
>>> Seems to have no N-terminal signal sequence
----- Final Results -----
   bacterial cytoplasm --- Certainty = 0.4547 (Affirmative) <succ>
      bacterial membrane --- Certainty = 0.0000 (Not Clear) <succ>
         bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2777

A DNA sequence (GASx1447R) was identified in *S. pyogenes* <SEQ ID 8053> which encodes the amino acid sequence <SEQ ID 8054>. Analysis of this protein sequence reveals the following:

Possible site: 25
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2778

A DNA sequence (GASx1448R) was identified in *S. pyogenes* <SEQ ID 8055> which encodes the amino acid sequence <SEQ ID 8056>. Analysis of this protein sequence reveals the following:

Possible site: 20
>>> Seems to have no N-terminal signal sequence
----- Final Results -----
   bacterial cytoplasm --- Certainty = 0.3221 (Affirmative) <succ>
      bacterial membrane --- Certainty = 0.0000 (Not Clear) <succ>
         bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2779

A DNA sequence (GASx1449R) was identified in *S. pyogenes* <SEQ ID 8057> which encodes the amino acid sequence <SEQ ID 8058>. Analysis of this protein sequence reveals the following:

Possible site: 19
>>> Seems to have no N-terminal signal sequence
----- Final Results -----
   bacterial cytoplasm --- Certainty = 0.6356 (Affirmative) <succ>
      bacterial membrane --- Certainty = 0.0000 (Not Clear) <succ>
         bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2780

A DNA sequence (GASx1453R) was identified in *S. pyogenes* <SEQ ID 8059> which encodes the amino acid sequence <SEQ ID 8060>. Analysis of this protein sequence reveals the following:

Possible site: 13
>>> Seems to have no N-terminal signal sequence
----- Final Results -----
   bacterial cytoplasm --- Certainty = 0.2869 (Affirmative) <succ>
      bacterial membrane --- Certainty = 0.0000 (Not Clear) <succ>
         bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2781

A DNA sequence (GASx1455R) was identified in *S. pyogenes* <SEQ ID 8061> which encodes the amino acid sequence <SEQ ID 8062>. Analysis of this protein sequence reveals the following:

Possible site: 40
>>> Seems to have no N-terminal signal sequence
----- Final Results -----
   bacterial cytoplasm --- Certainty = 0.1787 (Affirmative) <succ>
      bacterial membrane --- Certainty = 0.0000 (Not Clear) <succ>
         bacterial outside --- Certainty = 0.0000 (Not Clear) <succ>

No corresponding DNA sequence was identified in *S. agalactiae*.

The protein has homology with the following sequences in the GENPEPT database:

```
>GP:AAF43512 GB:AF145054 ORF19 [Streptococcus thermophilus bacteriophage
7201]
Identities = 47/126 (37%), Positives = 86/126 (67%), Gaps = 2/126 (1%)
Query:   8   LKDLRNLDLYIASLIRRRDKIEASLL--SSPKWSSDKVNGGIKRKQDDVYVELIATAKDI    65
             ++ ++ LD YI S I +  ++E+  L  +S    +D V GG ++ +DD+YVELI   +++
Sbjct:   7   IQQIKALDRYIESQIEQIKRLESQALKVTSGSMHTDMVQGGKRKGKDDIYVELITAREEV    66

Query:  66   EKKTAEAIRKQRELQNLIDSLENTDSQTILSMVYIDKMTRWQVIDELNCSESTYFRLLRV   125
             E+ TAEAI+++ E +  I ++E+ D++++L MVYID+++ WQ+ D++  S++TY+  LR
Sbjct:  67   ERFTAEAIKQKLEFRRQIANIEDIDARSLLQMVYIDQLSIWQICDKMGISKATYYVKLRQ   126

Query: 126   ATKELN                                                         131
             A K L+
Sbjct: 127   AEKYLD                                                         132
```

Based on this analysis, it was predicted that this GAS-specific protein and its epitopes, could be useful antigens for vaccines or diagnostics.

Example 2782

A DNA sequence (GASx1456R) was identified in *S. pyogenes* <SEQ ID 8063> which encodes the amino acid sequence <SEQ ID 8064>. Analysis of this protein sequence reveals the following:

---
Possible site: 34
>>> Seems to have no N-terminal signal sequence
----- Final Results -----
  bacterial cytoplasm --- Certainty = 0.2883 (Affirmative) <succ>
    bacterial membrane --- Certainty = 0.0000 (Not Clear) <succ>
      bacterial outside --- Certainty = 0.0000 (Not Clear) <succ>
---

No corresponding DNA sequence was identified in *S. agalactiae*.

The protein has homology with the following sequences in the GENPEPT database:

```
>GP:AAB18697 GB:U38906 ORF22 [Bacteriophage rlt]
Identities = 78/207 (37%), Positives = 123/207 (58%), Gaps = 2/207 (0%)
Query:   6   EIHRILGIDEVYKAPKRLTDILFDKDSREDIFRQFLKYETDVSYDWFMQYFEEEQADRKN    65
             + + +L +DE       R+ +++FDK  RE+ + +L     D+ D+F  YF     A
Sbjct:   7   QFYDMLNVDEHMNFTNRIQELVFDKKGREEFYSKILNIHHDMGVDFFRDYFMAHSAVSA-    65

Query:  66   KKQDFTPKSVSTLLSKIISGNQYYEVA-VGTGGILIQAWQEQRLNDSPFTYRPSKYWYHV   124
             K Q +TP +  L + ++ G+   ++  GTG ++IQ WQ+ R+N   F Y PS YWY
Sbjct:  66   KGQHYTPDELGKLTALLVGGSGGADLTGAGTGTLIIQKWQDDRMNTDFFNYLPSNYWYQA   125

Query: 125   EELSDKAVPFLLFNMSIRGINGVVVHGDSLTRQVKNIYFLQNTKDDMLSFSDINVMPRTQ   184
             ELSD+A+ FL+    +IRG+NGVV+HGD+L    VK +YF+QN+ ++ + FS+INV+P ++
Sbjct: 126   LELSDEAISFLIHAFAIRGMNGVVIHGDALEMAVKQVYFIQNSANNPIGFSEINVIPHSK   185

Query: 185   DIEREFNVKEWIGDGIEHIENPLIEWI                                    211
             D      +EW IEHIE+      +WI
Sbjct: 186   DAMEFLGIHEWTEQAIEHIESKFPDWI                                    212
```

Based on this analysis, it was predicted that this GAS-specific protein and its epitopes, could be useful antigens for vaccines or diagnostics.

Example 2783

A DNA sequence (GASx1459R) was identified in *S. pyogenes* <SEQ ID 8065> which encodes the amino acid sequence <SEQ ID 8066>. Analysis of this protein sequence reveals the following:

---
Possible site: 16
>>> Seems to have no N-terminal signal sequence
INTEGRAL     Likelihood = −2.44    Transmembrane 82-98 (81-98)
----- Final Results -----
  bacterial membrane --- Certainty = 0.1977 (Affirmative) <succ>
    bacterial outside --- Certainty = 0.0000 (Not Clear) <succ>
      bacterial cytoplasm --- Certainty = 0.0000 (Not Clear) <succ>
---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2784

A DNA sequence (GASx1460R) was identified in *S. pyogenes* <SEQ ID 8067> which encodes the amino acid sequence <SEQ ID 8068>. Analysis of this protein sequence reveals the following:

---
Possible site: 55
>>> Seems to have no N-terminal signal sequence
----- Final Results -----
  bacterial cytoplasm --- Certainty = 0.3368 (Affirmative) <succ>
    bacterial membrane --- Certainty = 0.0000 (Not Clear) <succ>
      bacterial outside --- Certainty = 0.0000 (Not Clear) <succ>
---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2785

A DNA sequence (GASx1461R) was identified in *S. pyogenes* <SEQ ID 8069> which encodes the amino acid sequence <SEQ ID 8070>. Analysis of this protein sequence reveals the following:

---

Possible site: 61
>>> Seems to have no N-terminal signal sequence
----- Final Results -----
 bacterial cytoplasm --- Certainty = 0.2834 (Affirmative) <succ>
  bacterial membrane --- Certainty = 0.0000 (Not Clear) <succ>
   bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2786

A DNA sequence (GASx1462R) was identified in *S. pyogenes* <SEQ ID 8071> which encodes the amino acid sequence <SEQ ID 8072>. Analysis of this protein sequence reveals the following:

---

Possible site: 27
>>> Seems to have no N-terminal signal sequence
----- Final Results -----
 bacterial cytoplasm --- Certainty = 0.3531 (Affirmative) <succ>
  bacterial membrane --- Certainty = 0.0000 (Not Clear) <succ>
   bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2787

A DNA sequence (GASx1463R) was identified in *S. pyogenes* <SEQ ID 8073> which encodes the amino acid sequence <SEQ ID 8074>. Analysis of this protein sequence reveals the following:

---

Possible site: 58
>>> Seems to have no N-terminal signal sequence
----- Final Results -----
 bacterial cytoplasm --- Certainty = 0.2483 (Affirmative) <succ>
  bacterial membrane --- Certainty = 0.0000 (Not Clear) <succ>
   bacterial outside --- Certainty = 0.0000 (Not Clear) <succ>

---

No corresponding DNA sequence was identified in *S. agalactiae*.

The protein has homology with the following sequences in the GENPEPT database:

```
>GP:CAB14569 GB:Z99117 similar to phage-related protein [Bacillus subtilis]
Identities = 98/252 (38%), Positives = 152/252 (59%), Gaps = 29/252 (11%)
Query:  16  SPAVKNRIEQVVGARAEQFTTSLLSIISNNNLLAKATSESIMGAAMKAAVLNLPIEPSLG   75
            SP+V  R E+V+G RA QFT S+LS+ ++  +L K    S++ +AM AA L+LPI ++LG
Sbjct:  33  SPSVIKRFEEVLGKRATQFTASILSLYNSEQMLQKTDPMSVISSAMVAATLDLPIDKNLG   92

Query:  76  FAYVVYYNRNYKDGNRWITVNEAQFQIGYRGLIQLAQRSGQVRNIEHGIIYEEEFLGYDK  135
            +A++VPY            +AQFQ+GY+G IQLA R+GQ ++I    I+E E   ++
Sbjct:  93  YAWIVPYG-----------GKAQFQLGYKGYIQLALRTGQYKSINCIPIHEGELQKWNP  140

Query: 136  IRGQLKLTGDYVDSGVVKGYFASLELISGFYKMIFWPKEKVYEHAKKYSKTFDKKTGDFK  195
            +  ++++  +  +S  V GY A ELI+GF K  ++W K +V +H KK+SK+      DF
Sbjct: 141  LTEEIEIDFEKRESDAVIGYAAYFELINGFRKTVYWTKAQVEKHKKKFSKS------DF-  193

Query: 196  PGTPWATEFDPMAIKTLLKELLSKYAPLSVEMQDA-LEADNADSTIVIPKDVTPQEINSL  254
               W  ++D MA+KT+LK +LSK+ LSVEMQ A +E D    I   D+T +  +S
Sbjct: 194  ---GWKNDWDAMALKTVLKAVLSKWGILSVEMQKAVIEEDETRERI----DITNEADSS-  245

Query: 255  DDLIGTQNEKKD                                                 266
            ++I ++    KD
Sbjct: 246  -EIIDSEPSNKD                                                 256
```

Based on this analysis, it was predicted that this GAS-specific protein and its epitopes, could be useful antigens for vaccines or diagnostics.

Example 2788

A DNA sequence (GASx1464R) was identified in *S. pyogenes* <SEQ ID 8075> which encodes the amino acid sequence <SEQ ID 8076>. Analysis of this protein sequence reveals the following:

---

Possible site: 30
>>> Seems to have no N-terminal signal sequence
----- Final Results -----
 bacterial cytoplasm --- Certainty = 0.4258 (Affirmative) <succ>
  bacterial membrane --- Certainty = 0.0000 (Not Clear) <succ>
   bacterial outside --- Certainty = 0.0000 (Not Clear) <succ>

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2789

A DNA sequence (GASx1465R) was identified in S. pyogenes <SEQ ID 8077> which encodes the amino acid sequence <SEQ ID 8078>. Analysis of this protein sequence reveals the following:

Possible site: 51
>>> Seems to have no N-terminal signal sequence
----- Final Results -----
    bacterial cytoplasm --- Certainty = 0.2045 (Affirmative) <succ>
      bacterial membrane --- Certainty = 0.0000 (Not Clear) <succ>
      bacterial outside --- Certainty = 0.0000 (Not Clear) <succ>

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2790

A DNA sequence (GASx1469R) was identified in S. pyogenes <SEQ ID 8079> which encodes the amino acid sequence <SEQ ID 8080>. Analysis of this protein sequence reveals the following:

Possible site: 19
>>> Seems to have a cleavable N-term signal sequence
----- Final Results -----
    bacterial outside --- Certainty = 0.3000 (Affirmative) <succ>
      bacterial membrane --- Certainty = 0.0000 (Not Clear) <succ>
        bacterial cytoplasm --- Certainty = 0.0000 (Not Clear) <succ>

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2791

A DNA sequence (GASx1470R) was identified in S. pyogenes <SEQ ID 8081> which encodes the amino acid sequence <SEQ ID 8082>. Analysis of this protein sequence reveals the following:

Possible site: 37
>>> Seems to have no N-terminal signal sequence
----- Final Results -----
    bacterial cytoplasm --- Certainty = 0.3577 (Affirmative) <succ>
      bacterial membrane --- Certainty = 0.0000 (Not Clear) <succ>
        bacterial outside --- Certainty = 0.0000 (Not Clear) <succ>

No corresponding DNA sequence was identified in S. agalactiae.

The protein has homology with the following sequences in the GENPEPT database:

```
>GP:AAC98430 GB:L29324 excisionase [Streptococcus pneumoniae]
Identities = 23/56 (41%), Positives = 41/56 (73%)
Query:  23 KHLIQQWEGLTVATAKQWATEMRDHPDFKQFVLNPTHRIVFIDYKGFKLFVQWKSR 78
            K  ++++W+GL    T  +W  EMR++   F  +V+NPTH++VFI+  +GF+ F++WK +
Sbjct:  19 KGILKRWDGLNKYTLNRWIKEMRENRTFSMYVINPTHKLVFINLEGFESFLRWKQK 74
```

Based on this analysis, it was predicted that this GAS-specific protein and its epitopes, could be useful antigens for vaccines or diagnostics.

Example 2792

A DNA sequence (GASx1473) was identified in S. pyogenes <SEQ ID 8083> which encodes the amino acid sequence <SEQ ID 8084>. Analysis of this protein sequence reveals the following:

Possible site: 27
>>> Seems to have no N-terminal signal sequence
----- Final Results -----
    bacterial cytoplasm --- Certainty = 0.2725 (Affirmative) <succ>
      bacterial membrane --- Certainty = 0.0000 (Not Clear) <succ>
        bacterial outside --- Certainty = 0.0000 (Not Clear) <succ>

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2793

A DNA sequence (GASx1476) was identified in S. pyogenes <SEQ ID 8085> which encodes the amino acid sequence <SEQ ID 8086>. Analysis of this protein sequence reveals the following:

Possible site: 23
>>> Seems to have no N-terminal signal sequence
----- Final Results -----
    bacterial cytoplasm --- Certainty = 0.1422 (Affirmative) <succ>
        bacterial membrane --- Certainty = 0.0000 (Not Clear) <succ>
            bacterial outside --- Certainty = 0.0000 (Not Clear) <succ>

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2794

A DNA sequence (GASx1480R) was identified in S. pyogenes <SEQ ID 8087> which encodes the amino acid sequence <SEQ ID 8088>. Analysis of this protein sequence reveals the following:

Possible site: 25
>>> Seems to have a cleavable N-term signal sequence
INTEGRAL    Likelihood = –4.04    Transmembrane 291-307 (290-309)
----- Final Results -----
    bacterial membrane --- Certainty = 0.2614 (Affirmative) <succ>
        bacterial outside --- Certainty = 0.0000 (Not Clear) <succ>
            bacterial cytoplasm --- Certainty = 0.0000 (Not Clear) <succ>

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2795

A DNA sequence (GASx1489R) was identified in S. pyogenes <SEQ ID 8089> which encodes the amino acid sequence <SEQ ID 8090>. Analysis of this protein sequence reveals the following:

Possible site: 23
>>> Seems to have no N-terminal signal sequence
----- Final Results -----
    bacterial cytoplasm --- Certainty = 0.2278 (Affirmative) <succ>
        bacterial membrane --- Certainty = 0.0000 (Not Clear) <succ>
            bacterial outside --- Certainty = 0.0000 (Not Clear) <succ>

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2796

A DNA sequence (GASx1490R) was identified in S. pyogenes <SEQ ID 8091> which encodes the amino acid sequence <SEQ ID 8092>:

SFITSVLAFRICLLKCEGIDLYLMYGDLMTCFEQLLTQLICDWTDVYFNY

DESGYGRLRDQICAAQFFKKKGIAVHTYQDHYLHGSQEIINQSGQPYKVF

TPYYRIWQNYPKETPIKVELSQGRWLNLETPDDVLRTVESFKDEKYQDVA

TFDEASKQLNRFIQDQLAAYHANRDFPAQLGTSRLSPFLRIGAIGIRTVY

HAVRQAPNSLGQATFLKELAWRDFYNMVYVAYPDQKTQPIQKAFSQIEWV

NNPDWFQLWICEGKTGYPIVDAAMLQLQKTGWMHNRLRMIVASFLTKDLL

CDWRLGEQYFQQQLIDYDAASNIGGWQWAASTGTDAVPYFRIFNPVTQGK

RFDPKGEFIKAYLPQLEHVPEKYLHEPWKMPICINTLQESVSCIIGTDYP

QPIVDHAICQREQAIAICYEWAKEKAKIE

Analysis of this protein sequence reveals the following:

Possible site: 33
>>> Seems to have an uncleavable N-term signal sequence
----- Final Results -----
    bacterial membrane --- Certainty = 0.0000 (NotClear) <succ>
        bacterial outside --- Certainty = 0.0000 (NotClear) <succ>
            bacterial cytoplasm --- Certainty = 0.0000 (NotClear) <succ>

No corresponding DNA sequence was identified in S. agalactiae.

The protein has homology with the following sequences in the GENPEPT database:

```
>GP:AAA22361 GB:M94110 DNA photolyase [Bacillus firmus]
Identities = 175/338 (51%), Positives = 228/338 (66%), Gaps = 6/338 (1%)
Query: 145  EIINQSGQPYKVFTPYYRIWQNYPKETP--IKVELSQGRWLNLETPDDVLRTVES--FKD  200
            +++ + G PYKVFTPYY+ W    K TP  IK ++ G         PD    T+ +   K
Sbjct: 2    QVLKKDGTPYKVFTPYYKAWAKERKRTPAVIKRDVLLGSVHKGTAPDREAETLFNNLIKK  61

Query: 201  EKYQDVATFDE-ASKQLNRFIQDQLAAYHANRDFPAQLGTSRLSPFLRIGAIGIRTVY-H  258
                  Y     A   +E A  K+L  F + +L+  Y ANRDFP+    GTSRLSP+++ GA+    R++Y H
Sbjct: 62   CSYDWSAIGEEHAIKRWMFTKKRLSGYKANRDFPSITGTSRLSPYIKTGAVSSRSIYYH  121

Query: 259  AVRQAPNSLGQATFLKELAWRDFYNMVYVAYPDQKTQPIQKAFSQIEWVNNPDWFQLWKE  318
              +  +S      TFLKELAWRDFY MV+     PD K + I + + ++ W ++ D     WK
Sbjct: 122  ILNAEADSYSAETFLKELAWRDFYRMVHFYEPDCKDRELMEGYRELNWSHDQDDLTSWKR  181
```

```
-continued
Query: 319   GKTGYPIVDAAMLQLQKTGWMHNRLRMIVASFLTKDLLCDWRLGEQYFQQQLIDYDAASN   378
             G+TG+PIVDA M QL    GWMHNRLRMI ASFLTKDLL DWRLGE+YF++ LIDYD +SN
Sbjct: 182   GETGFPIVDAGMRQLLNEGWMHNRLRMITASFLTKDLLIDWRLGERYFERMLIDYDPSSN   241

Query: 379   IGGWQWAASTGTDAVPYFRIFNPVTQGKRFDPKGEFIKAYLPQLEHVPEKYLHEPWKMPK   438
             IGGWQWAAS GTDAVPYFRIFNPVTQ KRFD  G +I+ Y+P+L HVP+ Y+HEPWKM +
Sbjct: 242   IGGWQWAASVGTDAVPYFRIFNPVTQSKRFDENGTYIRTYIPELNHVPDHYIHEPWKMSE   301

Query: 439   NLQESVSCIIGTDYPQPIVDHAKQREQAIAKYEWAKEK                        476
                Q   C +  DYP PIVDH+KQR++A++ ++   E+
Sbjct: 302   EEQVKYKCRLDEDYPLPIVDHSKQRKKALSFFKGDDEE                        339
```

Based on this analysis, it was predicted that this GAS-specific protein and its epitopes, could be useful antigens for vaccines or diagnostics.

Example 2797

A DNA sequence (GASx1493R) was identified in *S. pyogenes* <SEQ ID 8093> which encodes the amino acid sequence <SEQ ID 8094>. Analysis of this protein sequence reveals the following:

```
>GP:AAC95443 GB:AF068901 YlmG [Streptococcus pneumoniae]
 Identities = 35/81 (43%), Positives = 58/81 (71%)
 Query: 1    MILILSILLRLIKVYTYLLIAYALMSWFPGAYDSKIGRLISGIVEPILKPFRAFNLQFAG   60
             MI ++ ++   + +Y+ +L+A+A+MSWFPGAY+S  +GR I  +V+P+L P +   LQ AG
 Sbjct: 1    MIFLIRMIYNAVDIYSLILVAFAVMSWFPGAYESSLGRWIVALVKPVLAPLQRLPLQIAG   60

Query: 61   LDFTIFVVIISLNFLAQVLVR                                         81
             LD +++V I+  +FL + LVR
 Sbjct: 61   LDLSVWVAIVLVRFLGENLVR                                         81
```

Possible site: 39
>>> Seems to have no N-terminal signal sequence
----- Final Results -----
  bacterial cytoplasm --- Certainty = 0.2748 (Affirmative) <succ>
     bacterial membrane --- Certainty = 0.0000 (Not Clear) <succ>
        bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2798

A DNA sequence (GASx1501R) was identified in *S. pyogenes* <SEQ ID 8095> which encodes the amino acid sequence <SEQ ID 8096>. Analysis of this protein sequence reveals the following:

Possible site: 31
>>> Seems to have a cleavable N-term signal sequence
INTEGRAL    Likelihood = –7.27    Transmembrane 64-80 (53-83)
----- Final Results -----
   bacterial membrane --- Certainty = 0.3909 (Affirmative) <succ>
      bacterial outside --- Certainty = 0.0000 (Not Clear) <succ>
         bacterial cytoplasm --- Certainty = 0.0000 (Not Clear) <succ>

No corresponding DNA sequence was identified in *S. agalactiae*.

The protein has homology with the following sequences in the GENPEPT database:

Based on this analysis, it was predicted that this GAS-specific protein and its epitopes, could be useful antigens for vaccines or diagnostics.

Example 2799

A DNA sequence (GASx1502) was identified in *S. pyogenes* <SEQ ID 8097> which encodes the amino acid sequence <SEQ ID 8098>. Analysis of this protein sequence reveals the following:

Possible site: 25
>>> Seems to have no N-terminal signal sequence
INTEGRAL    Likelihood = –2.39    Transmembrane 17-33 (17-33)
----- Final Results -----
   bacterial membrane --- Certainty = 0.1956 (Affirmative) <succ>
      bacterial outside --- Certainty = 0.0000 (Not Clear) <succ>
         bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2800

A DNA sequence (GASx1507) was identified in *S. pyogenes* <SEQ ID 8099> which encodes the amino acid sequence <SEQ ID 8100>. Analysis of this protein sequence reveals the following:

```
Possible site: 23
>>> Seems to have no N-terminal signal sequence
----- Final Results -----
   bacterial cytoplasm --- Certainty = 0.0865 (Affirmative) <succ>
     bacterial membrane --- Certainty = 0.0000 (Not Clear) <succ>
       bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2801

A DNA sequence (GASx1511R) was identified in *S. pyogenes* <SEQ ID 8101> which encodes the amino acid sequence <SEQ ID 8102>. Analysis of this protein sequence reveals the following:

```
Possible site: 47
>>> Seems to have an uncleavable N-term signal sequence
INTEGRAL    Likelihood = -11.83    Transmembrane 31-47 (22-53)
INTEGRAL    Likelihood = -0.96     Transmembrane 2-18 (1-18)
----- Final Results -----
   bacterial membrane --- Certainty = 0.5734 (Affirmative) <succ>
     bacterial outside --- Certainty = 0.0000 (Not Clear) <succ>
       bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2802

A DNA sequence (GASx1516R) was identified in *S. pyogenes* <SEQ ID 8103> which encodes the amino acid sequence <SEQ ID 8104>. Analysis of this protein sequence reveals the following:

```
Possible site: 42
>>> Seems to have no N-terminal signal sequence
----- Final Results -----
   bacterial cytoplasm --- Certainty = 0.2729 (Affirmative) <succ>
     bacterial membrane --- Certainty = 0.0000 (Not Clear) <succ>
       bacterial outside --- Certainty = 0.0000 (Not Clear) <succ>
```

No corresponding DNA sequence was identified in *S. agalactiae*.

The protein has homology with the following sequences in the GENPEPT database:

```
>GP:BAA96472 GB:AB036428 Dpr [Streptococcus mutans]
Identities = 132/175 (75%), Positives = 153/175 (87%)

Query:   1   MTNTLVENIYASVTHNISKKEASKNEKTKAVLNQAVADLSVAASIVHQVHWYMRGPGFLY  60
             MTNT+ ENIYAS+ H + KKE S NEKTKAVLNQAVADLS AASIVHQVHWYMRG GFLY
Sbjct:   1   MTNTITENIYASIIHQVEKEENSGNEKTKAVLNQAVADLSKAASIVHQVHWYMRGSGFLY  60

Query:  61   LHPKMDELLDSLNANLDEMSERLITIGGAPYSTLAEFSKHSKLDEAKGTYDKTVAQHLAR 120
             LHPKMDEL+D+LN +LDE+SERLITIGGAP+STL EF ++S+L+E  GT+DK++  HL R
Sbjct:  61   LHPKMDELMDALNGHLDEISERLITIGGAPFSTLKEFDENSRLEETVGTWDKSITDHLKR 120

Query: 121   LVEVYLYLSSLYQVGLDITDEEGDAGTNDLFTAAKTEAEKTIWMLQAERGQGPAL       175
             LV+VY YLSSLYQVGLD+TDEE DA +ND+FTAA+TEA+KTIWMLQAE GQ P L
Sbjct: 121   LVQVYDYLSSLYQVGLDVTDEEDDAVSNDIFTAAQTEAQKTIWMLQAELGQAPGL       175
```

Based on this analysis, it was predicted that this GAS-specific protein and its epitopes, could be useful antigens for vaccines or diagnostics.

Example 2803

A DNA sequence (GASx1517) was identified in *S. pyogenes* <SEQ ID 8105> which encodes the amino acid sequence <SEQ ID 8106>. Analysis of this protein sequence reveals the following:

```
Possible site: 46
>>> Seems to have an uncleavable N-term signal sequence
INTEGRAL    Likelihood = -6.32    Transmembrane 109-125 (106-126)
INTEGRAL    Likelihood = -5.26    Transmembrane 63-79 (61-81)
INTEGRAL    Likelihood = -5.20    Transmembrane 154-170 (151-176)
INTEGRAL    Likelihood = -4.14    Transmembrane 189-205 (189-205)
INTEGRAL    Likelihood = -3.50    Transmembrane 130-146 (127-147)
INTEGRAL    Likelihood = -2.92    Transmembrane 6-22(1-24)
INTEGRAL    Likelihood = -2.23    Transmembrane 83-99(83-101)
----- Final Results -----
   bacterial membrane --- Certainty = 0.3527 (Affirmative) <succ>
     bacterial outside --- Certainty = 0.0000 (Not Clear) <succ>
       bacterial cytoplasm --- Certainty = 0.0000 (Not Clear) <succ>
```

No corresponding DNA sequence was identified in *S. agalactiae*.

The protein has homology with the following sequences in the GENPEPT database:

```
>GP:BAA96471 GB:AB036428 type IV prepilin peptidase homologue [Streptococcus
mutans]
Identities = 55/127 (43%), Positives = 78/127 (61%), Gaps = 3/127 (2%)

Query:  83  VSASYCYLLLFSLLFSLFDWRSQEYPPILWLFSFVSLLLFYSINYLSLILLLLGLLAHLR142
            ++ S   LL   +L SL+D  +Q YP  LW+     L+  Y +N +SLIL L G+ A L+
Sbjct:  91  LITSQVCLLFMGVLLSLYDLQDQSYPLTLWIGFTFLLMFIYPLNLISLILFLFGIFAALK150

Query: 143  PFSIGAGDFFYLASLALVLDLTSLIWLIQLASLAGITACLLLGIKRIP--FIPYLSFGLF200
              +IG+GDFFYLA+LAL L+L  +IW+IQ+ASL GI    LL    + P  F+P+L  G
Sbjct: 151  NINIGSGDFFYLATLALSLNLQQIIWIIQIASLLGILYSLLFQKHKEPFAFVPFLFLG-H209

Query: 201  WIVLLEH                                                     207
            I++  H
Sbjct: 210  LIIIFSH                                                     216
```

Based on this analysis, it was predicted that this GAS-specific protein and its epitopes, could be useful antigens for vaccines or diagnostics.

Example 2804

A DNA sequence (GASx1538R) was identified in S. pyogenes <SEQ ID 8107> which encodes the amino acid sequence <SEQ ID 8108>. Analysis of this protein sequence reveals the following:

Possible site: 15
>>> Seems to have no N-terminal signal sequence
----- Final Results -----
  bacterial cytoplasm --- Certainty = 0.1186 (Affirmative) <succ>
    bacterial membrane --- Certainty = 0.0000 (Not Clear) <succ>
      bacterial outside --- Certainty = 0.0000 (Not Clear) <succ>

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2805

A DNA sequence (GASx1539R) was identified in S. pyogenes <SEQ ID 8109> which encodes the amino acid sequence <SEQ ID 8110>. Analysis of this protein sequence reveals the following:

Possible site: 34
>>> Seems to have an uncleavable N-term signal seq
INTEGRAL Likelihood = −11.73 Transmembrane 6-22 (3-32)
----- Final Results -----
  bacterial membrane --- Certainty = 0.5692 (Affirmative) <succ>
    bacterial outside --- Certainty = 0.0000 (Not Clear) <succ>
      bacterial cytoplasm --- Certainty = 0.0000 (Not Clear) <succ>

No corresponding DNA sequence was identified in S. agalactiae.

The protein has homology with the following sequences in the GENPEPT database:

```
>GP:AAF31453 GB:AF221126 putative histidine kinase [Streptococcus pneumoniae]
Identities = 141/301 (46%), Positives = 210/301 (68%), Gaps = 7/301 (2%)

Query:   1  MKRYPLLVQLISYVFVIVIALITTLGLLYYQTSSRNIRQLIERDTRQSIRQSSQFIDAYI  60
            MKR  LLV+++  +F++ + L+  +G  YYQ+SS  I    IE +++ +I Q+S FI +YI
Sbjct:   1  MKRSSLLVRMVISIFLVFLILLALVGTFYYQSSSSAIEATIEGNSQTTISQTSHFIQSYI  60

Query:  61  KPLKETTSVLAKNTEIQAFASQIHQENDKQVLQLMKMVLATNSDLQAAVLVTKDGRTVST 120
            K L+ T++ L + T++ A+A   Q+ + + L   +L ++ DL+  VLVTK G+ +ST
Sbjct:  61  KKLETTSTGLTQQTDVLAYAENPSQDKVEGIRDLFLTILKSDKDLKTVVLVTKSGQVIST 120

Query: 121  NSQLTMKTSSDMMAEPWYKAAIDRQAMPILTPARQLSLSSKKEWVVSVTQEVVDRAGHNL 180
            +  + MKTSSDMMAE WY+ AI + AMP+LTPAR+     S   +WV+SVTQE+VD  G NL
Sbjct: 121  DDSVQMKTSSDMMAEDWYQKAIHQGAMPVLTPARK----SDSQWVISVTQELVDAKGANL 176

Query: 181  GVLRLDIAYPTIKASLDQLQLGRQGFAFIVNDKHEFVYHPKKSVYSSSKEMAAMKPYLAI 240
            GVLRLDI+Y  T++A L+QLQLG+QGFAFI+N+  HEFVYHP+  +VYSSS  +M AMKPY+
Sbjct: 177  GVLRLDISYETLEAYLNQLQLGQQGFAFIINENHEFVYHPQHTVYSSSSKMEAMKPYIDT 236

Query: 241  QNGYTKDKTSFVYQKLIPNSQWTLVGVASLDQLHRVQRQIFWSFSWNRASTLSDLWLCNCL 301
                 GYT     S+V Q+ I  + WT++GV+SL++L +V+ Q+ W+        ++++ L +C CL
Sbjct: 237  GQGYTPGHKSYVSQEKIAGTDWTVLGVSSLEKLDQVRSQLLWTL---LGASVTSLLVCLCL 294
```

Based on this analysis, it was predicted that this GAS-specific protein and its epitopes, could be useful antigens for vaccines or diagnostics.

Example 2806

A DNA sequence (GASx1542R) was identified in S. pyogenes <SEQ ID 8111> which encodes the amino acid sequence <SEQ ID 8112>. Analysis of this protein sequence reveals the following:

Possible site: 39
>>> May be a lipoprotein
----- Final Results -----
    bacterial membrane --- Certainty = 0.0000 (Not Clear) <succ>
    bacterial outside --- Certainty = 0.0000 (Not Clear) <succ>
       bacterial cytoplasm --- Certainty = 0.0000 (Not Clear) <succ>

No corresponding DNA sequence was identified in *S. agalactiae*.

The protein has homology with the following sequences in the GENPEPT database:

```
>GP:AAC23101 GB:U32823 conserved hypothetical protein [Haemophilus influen-
zae Rd]
Identities = 56/128 (43%), Positives = 87/128 (67%)

Query:  73  DFELKGIDGKTYRLSEFKGKKVYLKFWASWCSICLSTLADTEDLAKMSDKDYVVLTVVSP  132
            D +LK ++ +   LS++KGK VY+K WASWC ICL+ LA+ +DL+   D+++ V+T+VSP
Sbjct:  24  DVQLKDLNNQPVTLSQYKGKPVYVKMWASWCPICLAGLAEIDDLSAEKDRNFEVITIVSP   83

Query: 133  GHQGEKSEADFKKWFQGTDYKDLPVLLDPDGKLLEAYGVRSYPTEVFIGSDGVLAKKHIG  192
               H+GEK  ADF +W++G +YK++ VLLD  G++++   VR YP  +F+ SD  L K   G
Sbjct:  84  DHKGEKDTADFIEWYKGLEYKNITVLLDEKGEIIDKARVRGYPFNLFLDSDLNLKKTVPG  143

Query: 193  YAKKSDIK                                                     200
            +     I+
Sbjct: 144  HLGAEQIR                                                     151
```

Based on this analysis, it was predicted that this GAS-specific protein and its epitopes, could be useful antigens for vaccines or diagnostics.

Example 2807

A DNA sequence (GASx1543R) was identified in *S. pyogenes* <SEQ ID 8113> which encodes the amino acid sequence <SEQ ID 8114>. Analysis of this protein sequence reveals the following:

```
>GP:AAC23102 GB:U32823 cytochrome C-type biogenesis protein [Haemophilus
influenzae Rd]
Identities = 106/224 (47%), Positives = 138/224 (61%), Gaps = 16/224 (7%)

Query:   6  VLMVSVFGAGLLSFFSPCIFPVLPVYLGILLDADDSKTITIFGKKLYWYGIVKTLAFIFG   65
            +L+ +VF AGL SF SPCIFP++P+Y GIL         GKK      ++ T  FI G
Sbjct:   6  LLIGTVFLAGLASFLSPCIFPIIPIYFGILSKG---------GKK-----VLNTFLFILG   51

Query:  66  LSTIFVILGYGAGFLGNILYAVWFRYLLGALVIILGIHQMGLITIKSLQFQKSLTFHNNK  125
            LS  FV LG+  GFLGNIL++    R + G +VIILGIHQ+G+  I  L+  K   +
Sbjct:  52  LSLTFVSLGFSFGFLGNILFSNTTRIIAGVIVIILGIHQLGIFKIGLLERTKLVEIKTSG  111

Query: 126  NRNGLFNAFILGLTFSFGWTPCVGPVLSSVLALVASGGNGAWQGGVLMIIYTLGLGIPFL  185
                L  AF+LGLTFS GWTPC+GP+L+SVLAL    G+ A  G   +M +Y LGL  PF+
Sbjct: 112  KSTAL-EAFVLGLTFSLGWTPCIGPILASVLALSGDEGS-ALYGASMMFVYVLGLATPFV  169

Query: 186  LISFASGIVLKQFNKLKPHILLLKKVGGVLIIVMGILLMTGTLN                 229
            L SF S  +LK+    L H+    K   GG+LIIVMGILL+T  +
Sbjct: 170  LFSFFSDSLLKRAKGLNKHLDKFKIGGGILIIVMGILLITNNFS                 213
```

Possible site: 13
>>> Seems to have a cleavable N-term signal sequence
INTEGRAL Likelihood = −7.75 Transmembrane --- 171-187 (169 -191)
INTEGRAL Likelihood = −6.26 Transmembrane --- 205-221 (203 -232)
INTEGRAL Likelihood = −5.73 Transmembrane --- 56-72 (54-81)
INTEGRAL Likelihood = −5.36 Transmembrane --- 92-108 (91-113)
INTEGRAL Likelihood = −3.45 Transmembrane --- 20-36 (14-39)
INTEGRAL Likelihood = −1.17 Transmembrane --- 147-163 (144-163)
----- Final Results -----
    bacterial membrane --- Certainty = 0.4100 (Affirmative) <succ>
    bacterial outside --- Certainty = 0.0000 (Not Clear) <succ>
    bacterial cytoplasm --- Certainty = 0.0000 (Not Clear) <succ>

No corresponding DNA sequence was identified in *S. agalactiae*.

The protein has homology with the following sequences in the GENPEPT database:

Based on this analysis, it was predicted that this GAS-specific protein and its epitopes, could be useful antigens for vaccines or diagnostics.

Example 2808

A DNA sequence (GASx1544) was identified in *S. pyogenes* <SEQ ID 8115> which encodes the amino acid sequence <SEQ ID 8116>. Analysis of this protein sequence reveals the following:

```
Possible site: 25
>>> Seems to have no N-terminal signal sequence
----- Final Results -----
    bacterial cytoplasm --- Certainty = 0.1493 (Affirmative) <succ>
      bacterial membrane --- Certainty = 0.0000 (Not Clear) <succ>
        bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2809

A DNA sequence (GASx1546R) was identified in *S. pyogenes* <SEQ ID 8117> which encodes the amino acid sequence <SEQ ID 8118>. Analysis of this protein sequence reveals the following:

```
Possible site: 46
>>> Seems to have no N-terminal signal sequence
----- Final Results -----
    bacterial cytoplasm --- Certainty = 0.4658 (Affirmative) <succ>
      bacterial membrane --- Certainty = 0.0000 (Not Clear) <succ>
        bacterial outside --- Certainty = 0.0000 (Not Clear) <succ>
```

No corresponding DNA sequence was identified in *S. agalactiae*.

The protein has homology with the following sequences in the GENPEPT database:

```
>GP:BAB04061 GB:AP001508 unknown conserved protein in others
[Bacillus halodurans]
Identities = 48/89 (53%), Positives = 61/89 (67%)

Query:   1  MMVLVTYDVNTETPAGRKRLRHVAKLCVDYGQRVQNSVFECSVTPAEFVDIKHRLTQIID 60
            M+VL+TYDV T +  G KRLR VAK C +YGQRVQNSVFEC V    +K  LT +ID
Sbjct:   1  MLVLITYDVQTSSMGGTKRLRKVAKACQNYGQRVQNSVFECIVDSTQLTSLKLELTSLID 60

Query:  61  EKTDSIRFYLLGKNWQRRVETLGRSDSYD                                89
            E+ DS+R Y LG N++ +VE +G   S D
Sbjct:  61  EEKDSLRIYRLGNNYKTKVEHIGAKPSID                                89
```

Based on this analysis, it was predicted that this GAS-specific protein and its epitopes, could be useful antigens for vaccines or diagnostics.

Example 2810

A DNA sequence (GASx1547R) was identified in *S. pyogenes* <SEQ ID 8119> which encodes the amino acid sequence <SEQ ID 8120>. Analysis of this protein sequence reveals the following:

```
Possible site: 57
>>> Seems to have no N-terminal signal sequence
INTEGRAL Likelihood = -1.70 Transmembrane 44-60 (43-60)
----- Final Results -----
    bacterial membrane --- Certainty = 0.1680 (Affirmative) <succ>
      bacterial outside --- Certainty = 0.0000 (Not Clear) <succ>
        bacterial cytoplasm --- Certainty = 0.0000 (Not Clear) <succ>
```

RGD motif: 330-332

No corresponding DNA sequence was identified in *S. agalactiae*.

The protein has homology with the following sequences in the GENPEPT database:

```
>GP:BAB04060 GB:AP001508 unknown conserved protein in others [Bacillus halodurans]
Identities = 162/341 (47%), Positives = 231/341 (67%), Gaps = 1/341 (0%)

Query:   1  MKKLLNTLYLTQEDFYVTKEGDNIVIKQEGKVLKRFPFRIIDGIVCFSYLGVSSALVKLC        60
            MKKLLNTLY+TQ D Y++ +GDN+V+ +E + L R P    ++ IV F Y G S AL+  C
Sbjct:   1  MKKLLNTLYVTQPDTYLSLDGDNVVLLKEQEKLGRLPLHNLEAIVGFGYT>FEATURESALMGYC 60

Query:  61  TENQINLSFHTPQGRFCGRYIGSTNGNVLLRREHYRLSDRE-ESLEYAKRFILAKISNSR      119
            E  I+++F T  GRF   R +G + GNV+LR+   YR+S+ +  ES + A+ FI   K+ NS+
```

```
                           -continued
Sbjct:  61  AERNISITFLTKNGRFLARVVGESRGNVVLRKTQYRISENDQESTKIARNFITGKVYNSK   120

Query: 120  KYLLRFKRDHRQQIDTKLFEAVNDELIWALEMVQAADNKDSLRGIEGQAANQYFRIFNDL   179
            L R R+H +++ + F+A + L   ++ ++  D+ +SLRG EGQAA  Y ++F+ +
Sbjct: 121  WMLERMTREHPLRVNVEQFKATSQLLSVMMQEIRNCDSLESLRGWEGQAAINYNKVFDQM   180

Query: 180  VLTDKKTFYFQGRSKRPPLDCVNALLSFGYSLLTFECQSALEAVGLDSYVGFFHTDRPGR   239
            +L K+ F F GRS+RPP D VNA+LSF Y+LL  +  +ALE VGLD+YVGF H DRPGR
Sbjct: 181  ILQQKEEFAFHGRSRRPPKDNVNAMLSFANTLLANDVAAALETVGLDAYVGFMHQDRPGR   240

Query: 240  ASLALDLVEEFRSYIVDRFVFSLINKGQLQKKHFEVKENGSILLTENGRAIFIDLWQKRK   299
            ASLALDL+EE R   DRFV SLIN+ ++    F  KENG++L+T+  R  F+  WQ +K
Sbjct: 241  ASLALDLMEELRGLYADRFVLSLINRKEMTADGFYKKENGAVLMTDEARKTFLKAWQTKK   300

Query: 300  HTEVEHPFTKEKVKLMLLPYVQAQLLAKAIRGDLESYPPFM                     340
            ++ HP+  EK+    L+PYVQA LLA+ +RGDL+ YPPF+
Sbjct: 301  QEKITHPYLGEKMSWGLVPYVQALLLARFLRGDLDEYPPFL                     341
```

Based on this analysis, it was predicted that this GAS-specific protein and its epitopes, could be useful antigens for vaccines or diagnostics.

Example 2811

A DNA sequence (GASx1548R) was identified in *S. pyogenes* <SEQ ID 8121> which encodes the amino acid sequence <SEQ ID 8122>. Analysis of this protein sequence reveals the following:

---

Possible site: 49
>>> Seems to have no N-terminal signal sequence
----- Final Results -----
   bacterial cytoplasm --- Certainty = 0.2247 (Affirmative) <succ>
   bacterial membrane --- Certainty = 0.0000 (Not Clear) <succ>
   bacterial outside --- Certainty = 0.0000 (Not Clear) <succ>

---

No corresponding DNA sequence was identified in *S. agalactiae*.

The protein has homology with the following sequences in the GENPEPT database:

```
>GP:BAB04059 GB:AP001508 unknown [Bacillus halodurans]

Identities = 90/169 (53%), Positives = 111/169 (65%), Gaps = 1/169 (0%)

Query:  45  LHTKADNPYIKEKRKELLVSRAMPISSAELGLSGIMDVVEFYKDDQGVSLRGKRGKWLPK  104
            +H KAD P++KEKR   L  RAMPI S  L +SGI DVVEF +D +G+  L G  G +
Sbjct:   1  MHKKADQPFMKEKRGSKLTVRAMPIQSKNLQISGICDVVEFVQDSEGIELSGVSGSYKAF   60

Query: 105  VVEYKRGKPKKDTRDIVQLVAQTMCLEETLDCDINEGCLYYHSVNQRVIVPMTSALRQEV  164
             VEYKRGKPKK   DIVQLVAQ MCLEE L C I++G L+Y+ +   RV VP+T ALR +V
Sbjct:  61  PVEYKRGKPKKGDEDIVQLVAQAMCLEEMLVCRIDKGYLFYNEIKHRVEVPITDALRDKV  120

Query: 165  KELAAEMHEVYQSQMLPKAAYFKNCQLCSLVDICKPRLSKKTRSVSRYI             213
            ++A EMH  Y+++  PK      C  CSL  IC P+L K RSV RYI
Sbjct: 121  VQMAKEMHHYYENRHTPKVKTGPFCNNCSLQSICLPKLMNK-RSVKRYI             168
```

Example 2812

A DNA sequence (GASx1549R) was identified in *S. pyogenes* <SEQ ID 8123> which encodes the amino acid sequence <SEQ ID 8124>. Analysis of this protein sequence reveals the following:

---

Possible site: 26
>>> Seems to have no N-terminal signal sequence
----- Final Results -----
   bacterial cytoplasm --- Certainty = 0.1399 (Affirmative) <succ>
   bacterial membrane --- Certainty = 0.0000 (Not Clear) <succ>
   bacterial outside --- Certainty = 0.0000 (Not Clear) <succ>

---

No corresponding DNA sequence was identified in *S. agalactiae*.

The protein has homology with the following sequences in the GENPEPT database:

```
>GP:BAB04058 GB:AP001508 unknown conserved protein in others [Bacillus halodurans]
Identities = 148/290 (51%), Positives = 190/290 (65%), Gaps = 19/290 (6%)

Query: 6    MLEHKIDFMVTLEVKEANANGDPLNGNMPRTDAKGYGVMSDVSIKRKIRNRLQDMGKSIF    65
            +L+HKIDF V L V +AN NGDPLNGN PR +  G+G +SDV+IKRKIRNRL DM + IF
Sbjct: 3    ILDHKIDFAVILSVTKANPNGDPLNGNRPRQNYDGHGEISDVAIKRKIRNRLLDMEEPIF    62

Query: 66   VQANERIEDDFRSLEKRFSQH----FTAKTPDKEIEEKANAL---WFDVRAFGQVFTYLK   118
            VQ+++R  D F+SL  R    +       K  +  ++E A      W DVR+FGQVF +
Sbjct: 63   VQSDDRKADSFKSLRDRADSNPELAKMLKAKNASVDEFAKIACQEWMDVRSFGQVFAFKG   122

Query: 119  K--SIGVRGPVSISMAKSLEPIVISSLQITRSTNGMEAKNNSGRSSDTMGTKHFVDYGVY   176
               S+GVRGPVSI  A S++PI I S QIT+S N +        RSSDTMG KH VD+GVY
Sbjct: 123  SNLSVGVRGPVSIHTATSIDPIDIVSTQITKSVNSVTGDK---RSSDTMGMKHRVDFGVY   179

Query: 177  VLKGSINAYFAEKTGFSQEDAEAIKEVLVSLFENDASSARPEGSMRVCEVFWFTHSSKLG   236
            V KGSIN   AEKTGF+ EDAE IK  L++LFEND+SSARP+GSM V +V+W+ HSSKLG
Sbjct: 180  VFKGSINTQLAEKTGFTNEDAEKIKRALITLFENDSSSARPDGSMEVHKVYWWEHSSKLG   239

Query: 237  NVSSARVFDLLEYHQSIEEKSTYDAYQIHLNQEKLAKYEAKGLTLEILEG           286
             SSA+V   L+     +   ++D Y + L        YE  GL +E+++G
Sbjct: 240  QYSSAKVHRSLKIESKTDTPKSFDDYAVEL-------YELDGLGVEVIDG           282
```

Based on this analysis, it was predicted that this GAS-specific protein and its epitopes, could be useful antigens for vaccines or diagnostics.

Example 2813

A DNA sequence (GASx1550R) was identified in *S. pyogenes* <SEQ ID 8125> which encodes the amino acid sequence <SEQ ID 8126>. Analysis of this protein sequence reveals the following:

```
Possible site: 43
>>> Seems to have no N-terminal signal sequence
```

-continued

```
----- Final Results -----
bacterial cytoplasm --- Certainty = 0.2882 (Affirmative) <succ>
bacterial membrane --- Certainty = 0.0000 (Not Clear) <succ>
bacterial outside --- Certainty = 0.0000 (Not Clear) <succ>
```

No corresponding DNA sequence was identified in *S. agalactiae.*

The protein has homology with the following sequences in the GENPEPT database:

```
>GP:BAB04057 GB:AP001508 unknown [Bacillus halodurans]
Identities = 176/671 (26%), Positives = 311/671 (46%), Gaps = 87/671 (12%)

Query: 1    MDFFTSLLKTYEKAELADLVDHQKR--NNEPVLLPIYHTSLKSNGKNIISVKLDKDGQFH  58
            M +    L +TYE A L  +     K+  + E  LLPI HT+  ++     I V LD+DG F
Sbjct: 1    MSWLLHLYETYE-ANLDQVGKTVKKGEDREYTLLPISHTTQNAH----IEVTLDEDGDFL  55

Query: 59   KAEFMADKQMIIFPVTADSVARSGSHPAPHPLVDKFAYYSAEM----GQIQ------YDS 108
            +A+ +   K+   + P T ++ +RSGS  AP+PL DK +Y + +      G+I+       +D+
Sbjct: 56   RAKALT-KESTLIPCTEEAASRSGSKVAPYPLHDKLSYVAGDFVKYGGKIKNQDDAPFDT 114

Query: 109  FHKQLNNWID--YCEEGDVKKFLTFVQQFILKPEFLTLILDSLIGPDYQHNQLKVTFCDA 166
            + K L  W +  Y  E  VK   T++++  L  + +   + L         NQ  +   +
Sbjct: 115  YIKNLGEWANSPYATE-KVKCIYTYLKKGRLIEDLVDAGVLKL-----DENQQLIEKWEK 168

Query: 167  TGKEKLIDLSACFLEFSIDQ------FQGFKNESVSTF---KALHQSYISFVEANRENLG 217
              +E L +  A F   + DQ         F  F  ES+       K +  S+ISF
Sbjct: 169  RYEELLGEKPAIFSSGATDQASAFVRFNVFHPESIDDVWKDKEMFDSFISFYNDKLGEED 228

Query: 218  ICNISGREEQLTDKH----RGLMGNAKIISVS-NKREAYKGRFREREDVESVGYETSEKI 272
            IC ++G       T++H     R      AK+IS + N     ++GRF+     +   + YE S+K
Sbjct: 229  ICFVTGNRLPSTERHANKIRHAADKAKLISANDNSGFTFRGRFKTSREAVGISYEVSQKA 288

Query: 273  HLMLKYLLENKNTSTWLGSSQYLINWFSDD-LTNDSRLDIVSPIFDDGLEEDDDDDTPPV 331
            H  LK+L+  ++ S       +  + W +D+ L  +   D V  +      E + D DT  +
Sbjct: 289  HNALKWLIHRQSKSI---DDRVFLVWSNDNSLVPNPDEDAVDIMKHANRELERDPDTGQI 345

Query: 332  ITLATEDNKRIGKSFIKGQKLFANDATY----YVAILNKTSNGRIALKYFRQLQASQLLT 387
              A E  K IG          + +D  Y     ++ +L+  + GR+A+ Y+R L      L
Sbjct: 346  F--AGEVKKAIGG--------YRSDLNYQPEVHILVLDSATTGRMAVLYYRSLNKELYLN 395

Query: 388  NLNKWQETYSWESRSKFGKSRLRT----PTFHDILNVSYGVDRDRFLELDNDNFKSDQIQ 443
             L  W ++ +WE R +   +      P    DI    +YG          ++    D ++
Sbjct: 396  RLEAWHDSCAWEHRYRRDEKEFISFYGAPATKDIAFAAYGPRA-------SEKVIKDLME 448

Query: 444  KLVASLIDGKPMPQSIVKKL---GNNVKERHRYRKHWYQVEQVCLAILHK---QNGEEFS 497
            +++  ++DG+ +P+ IV+      +N       R+    W +    +  A++ K    +    EE+
```

-continued

```
Sbjct: 449  RMLPCIVDGRRVPKDIVRSAFQRASNPVSMERWE--WEKTLSITCALIRKMHIEQKEEWG 506

Query: 498  PMLDHTNQNRSYLFGRLLAIFELIETLRYGLDGNNNDRITNAERYWTAYTGQPTKLMMLL 557
              LD ++ +RSYLFGRLLA+ +++E    G  G +  R TNA RY  +Y+  P +    +
Sbjct: 507  VPLDKSSTDRSYLFGRLLAVADVLER---GALGKDETRATNAIRYMNSYSKNPGRTWKTI 563

Query: 558  ENKIKPYEEPLKLNRRGSWMKLEKEKEEILELLNPLLETETMEKPLDYRFIFGYYAEKNY 617
            +  ++PY+    KL   + ++  L K  +EI +   P    +   PL  +++ G+Y+++
Sbjct: 564  QESLQPYQ--AKLGTKATY--LSKLVDEIGDQFEP---GDFNNNPLTEQYLLGFYSQRRE 616

Query: 618  YYTKQNTEVTE                                                  628
              Y K+  E  +
Sbjct: 617  LYKKKEEETNQ                                                  627
```

Based on this analysis, it was predicted that this GAS-specific protein and its epitopes, could be useful antigens for vaccines or diagnostics.

Example 2814

A DNA sequence (GASx1551R) was identified in *S. pyogenes* <SEQ ID 8127> which encodes the amino acid sequence <SEQ ID 8128>. Analysis of this protein sequence reveals the following:

```
Possible site: 33
>>> Seems to have no N-terminal signal sequence
----- Final Results -----
   bacterial cytoplasm --- Certainty = 0.3035 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae.*

The protein has homology with the following sequences in the GENPEPT database:

Based on this analysis, it was predicted that this GAS-specific protein and its epitopes, could be useful antigens for vaccines or diagnostics.

Example 2815

A DNA sequence (GASx1552R) was identified in *S. pyogenes* <SEQ ID 8129> which encodes the amino acid sequence <SEQ ID 8130>. Analysis of this protein sequence reveals the following:

```
Possible site: 53
>>> Seems to have no N-terminal signal sequence
----- Final Results -----
   bacterial cytoplasm --- Certainty = 0.2770 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae.*

The protein has homology with the following sequences in the GENPEPT database:

>GP:BAB04056 GB:AP001508 unknown [*Bacillus halodurans*]

```
Identities = 90/218 (41%), Positives = 127/218 (57%), Gaps = 7/218 (3%)

Query: 13   GQRALFTNPATKGGSERSSYSVPTRQALNGIVDAIYYKPTFTNIVTEVKVINQIQTELQG   72
            G  ALFT+P TK G E+ SYSVPT QAL GI ++IY+KPT   ++ E++V+  IQ E +G Sbjct: 11   GDYALFTDPLTKIGGEKLSYSVPTYQALKGIAESIYWKPTIVFVIDELRVMKPIQMESKG   70

Query: 73   VRALLHDYSADLSYVSYLSDVVYLIKFHFVWNEDRKDLNSDRLPAKHEAIMERSIRKGGR 132
            VR + +     L++ +YL DV Y +K HF +N  R DL  DR   KH +I++RS++ GGR Sbjct: 71   VRPIEYGGGNTLAHYTYLKDVHYQVKAHFEFNLHRPDLAFDRNEGKHYSILQRSLKAGGR 130

Query: 133  RDVFLGTRECLGLVDDISQEEYETTVSYYNGV-NIDLGIMPHSFAYPKDK-KTPLKSYFT 190
            RD+FLG REC G V    +  E+ +    +Y+G      LG M H F YP +  +  L Sbjct: 131  RDIFLGARECQGYV---APCEFGSGDGFYDGQGKYHLGTMVHGFNYPDETGQHQLDVRLW 187

Query: 191  KTVMKNGVITFKAQSECDIVNTLSSYAFKA--PEEIKS                       226
              VM+NG I F    +C IV  +     K   P+ ++S Sbjct: 188  SAVMENGYIQFPRPEDCPIVRPVKEMEPKIFNPDNVQS                       225
```

```
>GP:BAB04055 GB:AP001508 unknown conserved protein in others
[Bacillus halodurans]
Identities = 252/836 (30%), Positives = 404/836 (48%), Gaps = 90/836 (10%)

Query: 3    MILAHYDCKKDKKQSLDEHLWHVACSSRQEASIIGQGDVLFLIGLYHDLGKADRTFQD--   60
            M +AH        Q+L EHL  V C +    + +    V  L GL HDLGK    F+D
Sbjct: 1    MYIAHIREVDKVIQTLKEHLCGVQCLAETFGAKLRLQHVAGLAGLLHDLGKYTNEFKDYI   60

Query: 61   -------KLLNNPNRHVDHSYAGAKYLCSIIGPHLKNRGVDKNERMTFNEMVGYVISAHH  113
                   +L       VDHS AG + L  +    L +R    +E++    E+VG  I +HH
Sbjct: 61   YKAVFEPELAEKKRGQVDHSTAGGRLLYQM----LHDRENSFHEKL-LAEVVGNAIISHH  115

Query: 114  GMYDLCYYFDDAEYYGFNKFKNRINRDLDGYHYHEDIKGYALKLEKKLCDYGYK-DLREL  172
                      +Y       N + R L+     +++  Y   +E+   +   + +L
Sbjct: 116  SNLQ--------DYISPTIESNFLTRVLE-----KELPEYESAVERFFQEVMTEAELARY  162

Query: 173  IDKAFDNYQQAMSSLNWQDKSEWDYYQSCMVRLYLSLLKNADILDTVNAYGLKISPMDKT  232
            + KA D  +Q   +   Q      Y  SC++        +AD  +T   +   +    + T
Sbjct: 163  VAKAVDEIKQFTDNSPTQSFFLTKYIFSCLI--------DADRTNT-RMFDEQAREEEPT  213

Query: 233  ERSFLKHSYLAAIEQKYASFGQPNNQ---LNTIRTEIAERVKERGKRDSKGIYRLDLPTG  289
            +   L   Y   +    AS  + ++     +N +R+ ++E+ +     R S GIY L +PTG
Sbjct: 214  QPQQLFEHYHQQLLNHLASLKESDSAQKPINVLRSAMSEQCESFAMRPS-GIYTLSIPTG  272

Query: 290  AGKTNLSMRYAFHQLVHHDKSRFFYITPFLSVLEQNASEIRKVTGD-LGVLEHHSNVVKQ  348
             GKT  S+RYA      ++K R  YI PF +++EQNA E+R + GD   +LEHHSNVV+
Sbjct: 273  GGKTLASLRYALKHAQEYNKQRIIYIVPFTTIIEQNAQEVRNILGDDENILEHHSNVVED  332

Query: 349  ANEDDDDKDSLLSA-----YLSDSWDSQVVLTSMVQFFQTLFKTKSANLRRFSSLINSVV  403
            +    D+ +D +++             D+WD  ++ T++VQF      +    + N RR  +L +SV+
Sbjct: 333  SENGDEQEDGVITKKERLRLARDNWDRPIIFTTLVQFLNVFYAKGNRNTRRLHNLSHSVL  392

Query: 404  ILDEVQSLPIEVTTLFNLTMNFLNKVMDTTIVLCTATQPAYDSSEIDHRICYGGNLGELA  463
            I DEVQ +P +  +LFN  +NFL +    +I+LCTATQP  ++  + H +    +
Sbjct: 393  IFDEVQKVPTKCVSLFNEALNFLKEFAHCSILLCTATQPTLEN--VKHSLLKDRD----G  446

Query: 464  EIVELTIEEKQIFSRTELRKFDDSDQKVHLTDVINLILGEE---NSVLAIFNTKKTVHNC  520
            EIV+    E  + F R E+   D +DQ +    +    +  E     S L I NTKK V +
Sbjct: 447  EIVQNLTEVSEAFKRVEI--LDKTDQPMTNERLAEWVRDEAPSWGSTLIILNTKKVVKDL  504

Query: 521  YTMLKDMTDRPVYQLSTNMCAQHRLDLIAKIKTELQNNIPIICISTQLIEAGVDVDFHRV  580
            Y L+       PV+ LST+MCA HR D + +I+  L+    P IC++TQLIEAGVDV F  V
Sbjct: 505  YEKLEG-GPLPVFHLSTSMCAAHRKDQLDEIRALLKEGTPFICVTTQLIEAGVDVSFKCV  563

Query: 581  IRSYSGIDSIVQAAGRCNREGKRDKGQVTLVNLTNEEENISRLTEIKTKKEATESILHKI  640
            IRS +G+DSI QAAGRCNR G+     V +++  + EE +S+L EI+  +E    ++L +
Sbjct: 564  IRSLAGLDSIAQAAGRCNRHGEEQLQYVYVID--HAEETLSKLKEIEVGQEIAGNVLARF  621

Query: 641  GSPIDISTLN-------RDFFEYYYYANNQGLMDYPLED-----NLSIYDYLSLNIYQTAN  688
                 +      N       R++F YYY+     ++Y +++         +  +    N Y T
Sbjct: 622  KKKAEKYEGNLLSQAAMREYFRYYYYSKMDANLNYFVKEVDKDMTKLLMSHAVENSYVTYY  681

Query: 689  KKFKGK-----LKQAFKTAGAKMNLINNDMIGILVPYGEAEKKLAYLEELGVSHFLSAKD  743
            +K  G       L  ++KTA      +I+ +     +VPYGE +  +A L         S +
Sbjct: 682  QKNTGTHFPLLLNGSYKTAADHFRVIDQNTTSAIVPYGEGQDIIAQLN--------SGEW  733

Query: 744  YQTIKSLLKELQPFTVNV--RENDPLFE--TTKSYLNGQILVLTSEYYDTERGVKY     795
              +  +LK+ Q +TVN+  +E D L +      +L+G +   L   +Y  + GV +
Sbjct: 734  VDDLSKVLKKAQQYTVNLYSQEIDQLKKEGAIVMHLDGMVYELKESWYSHQYGVDF     789
```

Based on this analysis, it was predicted that this GAS-specific protein and its epitopes, could be useful antigens for vaccines or diagnostics.

Example 2816

A DNA sequence (GASx1558) was identified in *S. pyogenes* <SEQ ID 8131> which encodes the amino acid sequence <SEQ ID 8132>. Analysis of this protein sequence reveals the following:

| |
|---|
| Possible site: 16 |
| >>> Seems to have no N-terminal signal sequence |
| ----- Final Results ----- |
| bacterial cytoplasm --- Certainty = 0.1050 (Affirmative) <succ> |

-continued

| |
|---|
| bacterial membrane --- Certainty = 0.0000 (Not Clear) <succ> |
| bacterial outside --- Certainty = 0.0000 (Not Clear) <succ> |

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

Example 2817

A DNA sequence (GASx1563) was identified in *S. pyogenes* <SEQ ID 8133> which encodes the amino acid sequence <SEQ ID 8134>. Analysis of this protein sequence reveals the following:

```
Possible site: 27
>>> Seems to have no N-terminal signal sequence
----- Final Results -----
   bacterial cytoplasm --- Certainty = 0.1872 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2818

A DNA sequence (GASx1564R) was identified in *S. pyogenes* <SEQ ID 8135> which encodes the amino acid sequence <SEQ ID 8136>. Analysis of this protein sequence reveals the following:

```
Possible site: 32
>>> Seems to have no N-terminal signal sequence
----- Final Results -----
   bacterial cytoplasm --- Certainty = 0.2173 (Affirmative)<succ>
      bacterial membrane --- Certainty = 0.0000 (Not Clear)<succ>
         bacterial outside --- Certainty = 0.0000 (Not Clear)<succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2819

A DNA sequence (GASx1566R) was identified in *S. pyogenes* <SEQ ID 8137> which encodes the amino acid sequence <SEQ ID 8138>. Analysis of this protein sequence reveals the following:

```
Possible site: 43
>>> Seems to have no N-terminal signal sequence
----- Final Results -----
   bacterial cytoplasm --- Certainty = 0.3486 (Affirmative) <succ>
      bacterial membrane --- Certainty = 0.0000 (Not Clear) <succ>
         bacterial outside --- Certainty = 0.0000 (Not Clear) <succ>
```

Based on this analysis, it was predicted that this GAS-specific protein and its epitopes, could be useful antigens for vaccines or diagnostics.

Example 2820

A DNA sequence (GASx1568) was identified in *S. pyogenes* <SEQ ID 8139> which encodes the amino acid sequence <SEQ ID 8140>. Analysis of this protein sequence reveals the following:

```
Possible site: 26
>>> Seems to have no N-terminal signal sequence
----- Final Results -----
   bacterial cytoplasm --- Certainty = 0.2711 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2821

A DNA sequence (GASx1569) was identified in *S. pyogenes* <SEQ ID 8141> which encodes the amino acid sequence <SEQ ID 8142>. Analysis of this protein sequence reveals the following:

```
Possible site: 27
>>> Seems to have an uncleavable N-term signal seq
----- Final Results -----
   bacterial membrane --- Certainty = 0.0000 (NotClear) <succ>
      bacterial outside --- Certainty = 0.0000 (NotClear) <succ>
         bacterial cytoplasm --- Certainty = 0.0000 (NotClear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2822

A DNA sequence (GASx1576R) was identified in *S. pyogenes* <SEQ ID 8143> which encodes the amino acid sequence <SEQ ID 8144>. Analysis of this protein sequence reveals the following:

```
Possible site: 28
>>> Seems to have no N-terminal signal sequence
----- Final Results -----
   bacterial cytoplasm --- Certainty = 0.4042 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2823

A DNA sequence (GASx1577R) was identified in *S. pyogenes* <SEQ ID 8145> which encodes the amino acid sequence <SEQ ID 8146>. Analysis of this protein sequence reveals the following:

```
Possible site: 21
>>> Seems to have no N-terminal signal sequence
----- Final Results -----
 bacterial cytoplasm --- Certainty = 0.3342 (Affirmative) <succ>
  bacterial membrane --- Certainty = 0.0000 (Not Clear) <succ>
   bacterial outside --- Certainty = 0.0000 (Not Clear) <succ>
```

No corresponding DNA sequence was identified in *S. agalactiae.*

The protein has homology with the following sequences in the GENPEPT database:

```
>GP:BAB04515 GB:AP001509 unknown [Bacillus halodurans]
Identities = 36/104 (34%), Positives = 55/104 (52%)

Query: 2   HMGAWNTGNNKILYTQESVTDDMIAKRDQSIKDAKESPILGFTVDTKVIKTELSNISNVM 61
           +M ++  GN  IL   E    D      +    + A   SP LGF   D+   ++TE++ ISNV
Sbjct: 392NMPSFAIGNQLILKLYEDDPQDKWEAFEAFNESAIPSPALGFYFDSNPVRTEIAAISNVT451

Query: 62  NRYKASINTGTVDPDEALPKLLADLKGAGWDKVQKEVQKQLDDF                105
           + +  ++  G VDP+E LP      L  AG  KV  E+Q+Q D++
Sbjct: 452SEFSPALLKGAVDPEEYLPLFNDKLNEAGLQKVIDEMQRQFDEW                495
```

Based on this analysis, it was predicted that this GAS-specific protein and its epitopes, could be useful antigens for vaccines or diagnostics.

Example 2824

A DNA sequence (GASx1578R) was identified in *S. pyogenes* <SEQ ID 8147> which encodes the amino acid sequence <SEQ ID 8148>. Analysis of this protein sequence reveals the following:

```
Possible site: 27
>>> May be a lipoprotein
----- Final Results -----
 bacterial membrane --- Certainty = 0.0000 (Not Clear) <succ>
  bacterial outside --- Certainty = 0.0000 (Not Clear) <succ>
   bacterial cytoplasm --- Certainty = 0.0000 (Not Clear) <succ>
```

No corresponding DNA sequence was identified in *S. agalactiae.*

The protein has homology with the following sequences in the GENPEPT database:

```
>GP:BAB04515 GB:AP001509 unknown [Bacillus halodurans]
Identities = 134/346 (38%), Positives = 206/346 (58%), Gaps = 10/346 (2%)

Query: 21   AACESKSASKDSDVKLLMYQVGDKPDNFDELMTIANKRIKEKTGATVDLQYIGWGDWDDK   80
             +A E+++    D  V L  Y +G     + + +M    N    +EK  ATVDL+ + WG++D++
Sbjct: 42   SANETEATDLDH-VTLTWYMIGTPQPDLELVMEEVNAYTEEKINATVDLRMLDWGEYDER  100

Query: 81   MSTIIASGENYDIAF----ANNYVVNAQKGAFADLTTLMPKYAKKTYKNLDPAYIKGNTI  136
```

```
                   M I   SGE YDIAF     ANNY +NA++GAF +L  L+ ++ ++   + +DPA+++G  +
Sbjct: 101  MQVITTSGEAYDIAFTSSWANNYALNARRGAFLELNDLLDEHGQEMKELIDPAFLEGAQV  160

Query: 137  DGKLYAFPVDANVYAQQMLSFNKELVDKYGLDISNIKSYADAENVLKQFHEKEPNTAAFA  196
            DGKLYA P +  V  Q +LSFN ELV+K+ LD+S++ S AD E +L     E+E + A
Sbjct: 161  DGKLYAVPTNKEVGQQAVLSFNNELVEKHNLDLSSVHSLADLEPLLAVIKEEESDVTPIA  220

Query: 197  IGQVFSMSGDYDYPLTKTQPFAVKIDEGKPTIINQYEDESFKNNLRLMHKWYKEGLIPTD  256
                 F   +D  L +  PFA +++       +IN+YE++     L+ MH +YK+G I  D
Sbjct: 221  ---TFDAYLPFDSILQEEMPFAFRLEGNTNEVINKYEEDITMETLKTMHDYYKKGYIRPD  277

Query: 257  AATNTEGYPLEGNTWFMREETQGPMDYGDTILTNAAGKDIVSRPLTKPLKTTSQAQMANF  316
            AAT+T+ +PLE   WF+R+E   P  Y + I T   AG +I +RPL +P    +     +
Sbjct: 278  AATSTDSWPLETPNWFVRKELYQP--YAELIWTRTAGYEIATRPLHEPYIFNNSVTGSMQ  335

Query: 317  VVSSVSKNKEKAVEVLSLLNSDPELLNGLVYGVEGKAWEKIGDKKI                362
            +S+ SKN E+A+ L+LLNSDP L N L  G+EG +E++  D  I
Sbjct: 336  AISATSKNPERAMMFLNLLNSDPYLRNLLDKGIEGVHYEELEDGTI               381
```

Based on this analysis, it was predicted that this GAS-specific protein and its epitopes, could be useful antigens for vaccines or diagnostics.

Example 2825

A DNA sequence (GASx1582) was identified in *S. pyogenes* <SEQ ID 8149> which encodes the amino acid sequence <SEQ ID 8150>. Analysis of this protein sequence reveals the following:

---

Possible site: 34
>>> Seems to have no N-terminal signal sequence
----- Final Results -----
  bacterial cytoplasm --- Certainty = 0.0454 (Affirmative) <succ>
   bacterial membrane --- Certainty = 0.0000 (Not Clear) <succ>
    bacterial outside --- Certainty = 0.0000 (Not Clear) <succ>

---

No corresponding DNA sequence was identified in *S. agalactiae*.

The protein has no significant homology with any sequences in the GENPEPT database.

Example 2826

A DNA sequence (GASx1584R) was identified in *S. pyogenes* <SEQ ID 8151> which encodes the amino acid sequence <SEQ ID 8152>. Analysis of this protein sequence reveals the following:

---

Possible site: 41
>>> Seems to have no N-terminal signal sequence
----- Final Results -----
  bacterial cytoplasm --- Certainty = 0.3105 (Affirmative) <succ>
   bacterial membrane --- Certainty = 0.0000 (Not Clear) <succ>
    bacterial outside --- Certainty = 0.0000 (Not Clear) <succ>

---

RGD motif: 3-5

No corresponding DNA sequence was identified in *S. agalactiae*.

The protein has homology with the following sequences in the GENPEPT database:

```
>GP:AAG21428 GB:AF307332 meningioma-expressed antigen 5s splice
variant [Homo sapiens]

Identities = 94/271 (34%), Positives = 148/271 (53%), Gaps = 14/271 (5%)

Query:  120  GIIEGFYGTPWTREERLDCLRFIGNKRMNTYMYAPKDDDYQRKLWRDLYPEDWVTYFKEL  179
             G++EGFYG PW  E+R + R +       +NTY+YAPKDD     R  WR++Y  +         L
Sbjct:   63  GVVEGFYGRPWVMEQRKELFRRLQKWELNTYLYAPKDDYKHRMFWREMYSVEEAEQLMTL  122

Query:  180  LAVAKEEGLDFWYMISPGLDFDYTKEADYQLLYQKLQQLLALGVCHFGLLLDDIDYQIVD  239
             ++ A+E ++F Y ISPGLD  ++   +   L +KL Q+     G   F LL DDID+  +
Sbjct:  123  ISAAREYEIEFIYAISPGLDITFSNPKEVSTLKRKLDQVSQFGCRSFALLFDDIDHNMCA  182

Query:  240  AVERRFKKTAYAQAHLATEVHHFLNQQHAAPELVICPTE------YDNHHDSIYLQELSE  293
             A +  F   A+AQ  +  E++ +L +            + CPTE       Y N    S  YL+ + E
Sbjct:  183  ADKEVFSSFAHAQVSITNEIYQYLGEPET---FLFCPTEYCGTFCYPNVSQSPYLRTVGE  239

Query:  294  RIPKEVAFFWTGPSTLASQISQADIETMAAVYQRPIIIWDNIPVNDYQKDPERLFLTPFA  353
             ++  +     WTGP  ++ +I       IE ++ + +R  +IWDNI   NDY  D +RLFL P+
Sbjct:  240  KLLPGIEVLWTGPKVVSKEIPVESIEEVSKIIKRAPVIWDNIHANDY--DQKRLFLGPYK  297

Query:  354  NRSPFLCQPDYQVKGIVSNPMISWELSKLTL                              384
             RS  L         ++KG+++NP +E  +  +
Sbjct:  298  GRSTELIP---RLKGVLTNPNCEFEANYVAI                              325
```

Based on this analysis, it was predicted that this GAS-specific protein and its epitopes, could be useful antigens for vaccines or diagnostics.

Example 2827

A DNA sequence (GASx1585R) was identified in *S. pyogenes* <SEQ ID 8153> which encodes the amino acid sequence <SEQ ID 8154>. Analysis of this protein sequence reveals the following:

Possible site: 24
>>> Seems to have no N-terminal signal sequence

Possible site: 47
>>> Seems to have no N-terminal signal sequence
----- Final Results -----
  bacterial cytoplasm --- Certainty = 0.3082 (Affirmative) <succ>
  bacterial membrane --- Certainty = 0.0000 (Not Clear) <succ>
  bacterial outside --- Certainty = 0.0000 (Not Clear) <succ>

No corresponding DNA sequence was identified in *S. agalactiae*.

The protein has homology with the following sequences in the GENPEPT database:

```
>GP:BAB04509 GB:AP001509 unknown conserved protein in others
[Bacillus halodurans]
Identities = 221/425 (52%), Positives = 296/425 (69%), Gaps = 4/425 (0%)

Query:    12  RPIPTSVSQFMAKVESLCGDQHPDWALNFKTSFTNTLETTLKTYEDGTSFLLTGDIPAMW   71
              + IP S+   +A+V++   D      L F+  F NT  TT++  E GT F++TGDIPAMW
Sbjct:     4  KKIPRSLQAIIAQVKAHYADDQELQTL-FEQCFLNTYLTTIQEDEQGT-FVVTGDIPAMW   61

Query:    72  LRDSTAQMKPYLFLAKEDEEIRKIIAGLVKRQFRYICIDPYANAFNEEANEKGHQTDHTQ  131
              LRDS+AQ++PYL + KED ++ ++I G+++RQ+RYI  DPYANAFN+ AN++GHQ D T+
Sbjct:    62  LRDSSAQVRPYLTVVKEDADMARMIKGVIERQWRYILHDPYANAFNQTANKQGHQQDRTE  121

Query:   132  MNPWIWERKYEIDCLCYPIQLAYLLYRETGSTDQFNDDFHRGVELILDLWTVEQDH-AQS  190
              M+P +WERKYE+D LCYPIQLAYL ++ TG            + +E I  +W +EQDH A+S
Sbjct:   122  MSPLVWERKYELDSLCYPIQLAYLYWKATGDDSVLQPTLKQVLETIYRIWKIEQDHEAKS  181

Query:   191  PYLFERDTWRKEDTLTHAGKGSPVAPTGMTWSGFRPSDDACQYGYLIPSNMFAVVVLSYL  250
               Y FERD  R  DTL   GKG    PTGMTWSGFRPSDDAC YGYLIP+NMFAVVV +Y
Sbjct:   182  SYSFERDDCRVSDTLLRKGKGGYSVPTGMTWSGFRPSDDACLYGYLIPANMFAVVVSNYA  241

Query:   251  EDLYNNLFHNEPVATRAKQLKEAIQSGIADHALVQNSKGETIYAYEVDGLGQFSIMDDAN  310
              +L  +      +A    ++L+  I+  GI   +  + +    IY YE DG G+ ++MDDAN
Sbjct:   242  VELLTAM-EEIKLAEEFRELEADIRQGIGQYGKMDHPVYGEIYVYETDGNGRVNLMDDAN  300

Query:   311  IPSLLAAPYLGFCTKDDPIYLATRRTILSQENPYYYQGNAAAGIGSSHTPENYIWHIALA  370
              +PSLLA PYLG+ T DDP+Y   TRR ILS++NPYYY+G+ A  G+GS HTP++Y+WHI+LA
Sbjct:   301  VPSLLAIPYLGYTTADDPVYQNTRRFILSRDNPYYYEGSYAKGVGSPHTPDHYVWHISLA  360

Query:   371  LQGLTALDQDSKKEMLDLLVATDAGTHLMHEGFDVNDPYQYTREWFSWANMMFCELLLDY  430
              +QG+TA+D   KK+++ +    T A T+ MHEGFDV+  P QYTR WF+WAN MF E LL
Sbjct:   361  IQGMTAIDSKEKKQIVAMFKQTHADTYFMHEGFDVDRPEQYTRSWFAWANSMFSEFLLSE  420

Query:   431  LGFSI                                                         435
                G +
Sbjct:   421  AGIYV                                                         425
```

-continued

----- Final Results -----
  bacterial cytoplasm --- Certainty = 0.4469 (Affirmative) <succ>
  bacterial membrane --- Certainty = 0.0000 (Not Clear) <succ>
  bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2828

A DNA sequence (GASx1587) was identified in *S. pyogenes* <SEQ ID 8155> which encodes the amino acid sequence <SEQ ID 8156>. Analysis of this protein sequence reveals the following:

Based on this analysis, it was predicted that this GAS-specific protein and its epitopes, could be useful antigens for vaccines or diagnostics.

Example 2829

A DNA sequence (GASx1588) was identified in *S. pyogenes* <SEQ ID 8157> which encodes the amino acid sequence <SEQ ID 8158>. Analysis of this protein sequence reveals the following:

Possible site: 21
>>> Seems to have no N-terminal signal sequence
----- Final Results -----
  bacterial cytoplasm --- Certainty = 0.5250 (Affirmative) <succ>
  bacterial membrane --- Certainty = 0.0000 (Not Clear) <succ>
  bacterial outside --- Certainty = 0.0000 (Not Clear) <succ>

No corresponding DNA sequence was identified in *S. agalactiae*.

The protein has homology with the following sequences in the GENPEPT database:

\>GP:BAB04508 GB:AP001509 unknown conserved protein in others
(divided) [*Bacillus halodurans*]
Identities = 312/737 (42%), Positives = 426/737 (57%), Gaps = 21/737 (2%)

```
Query:   123  FPDTFGNMGQTPQLMLKAGLQAAAFGRGIRPTGFNNQVDTSEKYSSQFSEISWQGPDNSR    182
              FPDTFG  GQ PQL+ +AG++AA FGRG+ PTGFNNQV   + YSS FSE+ W+ PD S+
Sbjct:     4  FPDTFGIYGQAPQLLAQAGIRAAVFGRGVTPTGFNNQVQHDD-YSSPFSELIWEAPDGSQ     62

Query:   183  ILGLLFANWYSNGNEIPTTEAEARLFWDKKLADAERFASTKHLLMMNGCDHQPVQLDVTK    242
              ++G+L ANWYSNGNEIPT E EA+ FW KKL DAERFAST  LL MNGCDHQPVQ DVT+
Sbjct:    63  VIGILLANWYSNGNEIPTDEDEAQTFWVKKLRDAERFASTSQLLFMNGCDHQPVQKDVTQ    122

Query:   243  AIALANQLYPDYEFVHSCFEDYLADLADDLPENLSTVQGEITSQETDGWYTLANTASARI    302
              AI +A  L+PD  F HS F DYL  + ++LP+ L  + GE+ +Q+TDGW TL NTASARI
Sbjct:   123  AIKVAETLFPDVAFKHSNFHDYLTQIKEELPKELQKITGELRNQKTDGWSTLVNTASARI    182

Query:   303  YLKQANTRVSRQLENITEPLAAMAYEVTSTYPHDQLRYAWKTLMQNHPHDSICGCSVDSV    362
              YLKQAN R   L N+ EP+  +    +   D   Y WK LM+NHPHDSICGCS+D+V
Sbjct:   183  YLKQANDRCQTLLTNVLEPMCLLV--ENKSLHRDFSEYYWKLLMENHPHDSICGCSIDAV    240

Query:   363  HREMMTRFEKAYEVGHYLAKEAAKQIADAIDTRDFPMDSQPFVLFNTSGHSKTSVAELSL    422
              HREM  TRFEK    E   K+IA  I+T      ++  P V+  T+G S    V     +
Sbjct:   241  HREMKTRFEKVEAGATTFIAEQGKEIAAQINTLHDSEEAIPLVVLKTNGTSGKRVVRHKV    300

Query:   423  TWKKYHFGQRFPKEVYQEAQEYLARLSQSFQIIDTSGQVRPEAEILGTSIAFDYDLPKRS    482
                 KK +F +    ++    + L +         ++    E+    + F YDLP+
Sbjct:   301  AMKKIYFDEM----DFRHIPDRLKEIVMPTYRLEFPNKGSVPIEVQDAGVRFGYDLPRDG    356

Query:   483  FREPYFAIKVRLRLPITLPAMSWKTLALKLG------NETTPSETVSLYDDSNQCLENGF    536
              FR PY+A      L +T    S   L + G        + T +     + D S     LEN
Sbjct:   357  FRRPYYA----RELEVTFSYDSDLYLGYECGFLVPVEEKQTEARKELIGDPSMNTLENEA    412

Query:   537  LKVMIQTDGRLTITDKQSGLIYQDLLRFEDCGDIGNEYISRQPNHDQPFYADQGTIKLNI    596
              +KVMI  +G  +I DK +G  Y+  L  +ED GDIGNEY+  +   +  +     + I
Sbjct:   413  MKVMIHRNGSYSILDKTTGFEYRHLGIYEDVGDIGNEYMFKASSDGVRYTTEACEASIRI    472

Query:   597  ISNTAQVAELEIQQTFAIPISADKLLQAEMEAVIDITERQARRSQEKAELTLTTLIRMEK    656
              I N +  A +EI QT ++P +AD+ L+ E E ++    +R+A RS+E+ ++TL T + +E+
Sbjct:   473  IENNSLCATVEICQTLSVPAAADERLKEEQERLVWHPDRKAGRSKERTDITLRTELTLEQ    532

Query:   657  NNPRLQFTTRFDNQMTNHRLRVLFPTHLKTDHHLADSIFETVKRPNHPDATFWKNPSNPQ    716
                   L+     DN   +HR+R LFP       +H ADSI+E V+RPN PD   W+NP+
Sbjct:   533  GAKGLKVNVNIDNTAKDHRMRALFPVERARGNHYADSIYEIVERPNTPDPK-WQNPAFDH    591

Query:   717  HQECFVSLFDGENGVTIGNYGLNEYEILPDTNTIAITLLRSVGEMGDWGYFPTPEAQCLG    776
              H +  VSL +GE G+TI   GL+EYEI+ D  +IA+TLLRSVGE+GDWG F TPEAQC G
Sbjct:   592  HMQRLVSLDNGEYGLTIATKGLHEYEIVSD--SIAVTLLRSVGELGDWGLFETPEAQCFG    649

Query:   777  KHSLSYSFESITKQTQFAS-YWRAQEGQVPVITTQTNQHEGTLAAEYSYLTGTNDQVALT    835
              ++   +          A+ Y  A +   V    QT Q  G L    +   + + + LT
Sbjct:   650  QNEAQFVLLPHKGDVLSANVYVAAYDDPVEPTVIQTEQSMGPLPHATNLFQWSGEGLVLT    709

Query:   836  AFKRRLADNALITRSYN                                             852
              A K +   +I R +N
Sbjct:   710  ACKPTMDGRGMILRWFN                                             726
```

Based on this analysis, it was predicted that this GAS-specific protein and its epitopes, could be useful antigens for vaccines or diagnostics.

Example 2830

A DNA sequence (GASx1589R) was identified in *S. pyogenes* <SEQ ID 8159> which encodes the amino acid sequence <SEQ ID 8160>. Analysis of this protein sequence reveals the following:

```
Possible site: 31
>>> Seems to have a cleavable N-term signal seq.
INTEGRAL    Likelihood = -11.30   Transmembrane  203-219  (195-221)
INTEGRAL    Likelihood = -8.17    Transmembrane   61-77   (59-82)
INTEGRAL    Likelihood = -3.98    Transmembrane  107-123  (107-124)
```

-continued

```
INTEGRAL    Likelihood = -3.40    Transmembrane   39-55   (38-58)
INTEGRAL    Likelihood = -2.34    Transmembrane  129-145  (126-145)
INTEGRAL    Likelihood = -2.07    Transmembrane   89-105  (87-105)
----- Final Results -----
 bacterial membrane --- Certainty = 0.5522 (Affirmative) <succ>
  bacterial outside --- Certainty = 0.0000 (Not Clear) <succ>
   bacterial cytoplasm --- Certainty = 0.0000 (Not Clear) <succ>
```

No corresponding DNA sequence was identified in *S. agalactiae.*

The protein has homology with the following sequences in the GENPEPT database:

```
>GP:CAC10175 GB:AJ278302 histidine kinase [Streptococcus pneumoniae]
Identities = 114/432 (26%), Positives = 219/432 (50%), Gaps = 10/432 (2%)

Query:   21  LTLKLFSFVSAIPLRLKNIFYLSLSMVLFQVVFWAFFPDHFILDVVMLAQF---LFFALI    77
             L + +F  V  I L  + IF   L  +L  VVF        +++  V L+ F    L+  +
Sbjct:   16  LKIVIFFKVDGISLTFERIFKAFLFKILLAVVFGML---GYMVGNVYLSYFMEPLYGIGL    72

Query:   78  ALYYGKSIKAKFLMFYAFFPLVSISLVKRFIVFFVMPLFGMPYSVVKHNTLLIYSITCFS   137
             +     + +  K L+FY  FP++ ++L  R + +FV+P   G    V   + +   I  F+
Sbjct:   73  SFLLLRELPKKLLLFYGLFPMILVNLFYRGVSYFVLPFLGQG-QVYDDYSFIWLCIIIFN   131

Query:  138  IFLIYRCIQVFHFDFSTWRQYFQSHRASKLLVFTNSSMALYYLCVQGIDVMSPSLSGLAT   197
                F+     ++   +DF++ R+        K L   N  M  YYL +Q +         G+ +
Sbjct:  132  FFISLAFLKWLDYDFTSLRKGILDKDFQKSLTQINWIMGAYYLVIQNLSYFEYE-QGIQS   190

Query:  198  TTARSIIVLFYFILFLTLLIHLERYVKQNSIEAIVQQKE--YRELINYSQHLGLLYQDIQ   255
             TT R +I++FY + F+ ++    L+ Y+K     E + Q+++   YRE+  YS+H+   LY++++
Sbjct:  191  TTVRHLILVFYLLFFMGIIKKLDTYLKDKLHERLNQEQDLRYREMERYSRHIEELYKEVR   250

Query:  256  ELRRLLTTVSSRLKIGIEQNDISIVRLTYEGILNAEKNNAKDDRLDLTCLDKLQVEAIRH   315
                R    T + +  L++GIE+ D+  ++   Y+ +L       +D++ DL   L   ++  A++
Sbjct:  251  SFRHDYTNLLTSLRLGIEEEDMEQIKEIYDSVLKDSSEKLQDNKYDLGRLVNVRDRALKS   310

Query:  316  IVLAKLIEAKNKKLKVEVSIPNCIATFFLEVVDFTKLLSFLLDNAIEMSLETKQPCLSIA   375
              ++    K I+A++K +    V +P  I     + ++DF  ++S L DNAIE S+E  QP +SIA
Sbjct:  311  LLAGKFIKARDKNIVFNVEVPEEIQVEGVSLLDFLTVVSILCDNAIEASVEACQPHVSIA   370

Query:  376  FLDQNHKLVIVIQSSTKQGQDDSQSVFAIPALKKRDDWQFDLRNVTTILNRYDYLTISSQ   435
             F    +  +I++S K+   D   +F+  A K ++    L  V  I+  +    ++++
Sbjct:  371  FFKNGAQETFIIENSIKEEGIDISEIFSFGASSKGEERGVGLYTVMKIVESHPNTSLNTT   430

Query:  436  IHDGILTQLIEI                                                 447
               D +   Q++ +
Sbjct:  431  CQDHVFRQVLTV                                                 442
```

Based on this analysis, it was predicted that this GAS-specific protein and its epitopes, could be useful antigens for vaccines or diagnostics.

Example 2831

A DNA sequence (GASx1593R) was identified in *S. pyogenes* <SEQ ID 8161> which encodes the amino acid sequence <SEQ ID 8162>. Analysis of this protein sequence reveals the following:

Possible site: 25
>>> Seems to have an uncleavable N-term signal seq
INTEGRAL    Likelihood = −1.28    Transmembrane    2-18    (1-18)
----- Final Results -----
  bacterial membrane --- Certainty = 0.1510 (Affirmative) <succ>
  bacterial outside --- Certainty = 0.0000 (Not Clear) <succ>
  bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2832

A DNA sequence (GASx1594) was identified in *S. pyogenes* <SEQ ID 8163> which encodes the amino acid sequence <SEQ ID 8164>. Analysis of this protein sequence reveals the following:

Possible site: 61
>>> Seems to have no N-terminal signal sequence
INTEGRAL    Likelihood = −3.93    Transmembrane    76-92    (76-92)
----- Final Results -----
  bacterial membrane --- Certainty = 0.2572 (Affirmative) <succ>
  bacterial outside --- Certainty = 0.0000 (Not Clear) <succ>
  bacterial cytoplasm --- Certainty = 0.0000 (Not Clear) <succ>

No corresponding DNA sequence was identified in *S. agalactiae*.

The protein has homology with the following sequences in the GENPEPT database:

```
>GP:AAF61313 GB:U96166 unknown [Streptococcus cristatus]

Identities = 31/66 (46%), Positives = 40/66 (59%), Gaps = 2/66 (3%)

Query:   14  LLGRILSKYVGRLTSCIENETTKIRNHSRQNDTIGLNHLLGNLKTVHNPEIILKTINVYS    73
             + G  +SK     +  +   E  K+  ++ ND IG N  LLG+LKTVHNPEII  +    VYS
Sbjct:   30  VFGMDVSKTSSEVAILVNGE--KVHGYTILNDAIGFNRLLGDLKTVHNPEIIFEATGVYS    87

Query:   74  RRLQVF                                                       79
             RRLQ F
Sbjct:   88  RRLQAF                                                       93
```

Example 2833

A DNA sequence (GASx1598) was identified in *S. pyogenes* <SEQ ID 8165> which encodes the amino acid sequence <SEQ ID 8166>. Analysis of this protein sequence reveals the following:

```
Possible site: 14
>>> Seems to have no N-terminal signal sequence
----- Final Results -----
  bacterial cytoplasm --- Certainty = 0.2117 (Affirmative) <succ>
  bacterial membrane --- Certainty = 0.0000 (Not Clear) <succ>
  bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2834

A DNA sequence (GASx1608) was identified in *S. pyogenes* <SEQ ID 8167> which encodes the amino acid sequence <SEQ ID 8168>. Analysis of this protein sequence reveals the following:

```
Possible site: 16
>>> Seems to have an uncleavable N-term signal seq
----- Final Results -----
  bacterial membrane --- Certainty = 0.0000 (Not Clear) <succ >
  bacterial outside --- Certainty = 0.0000 (Not Clear) <succ >
  bacterial cytoplasm --- Certainty = 0.0000 (Not Clear) <succ >
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2835

A DNA sequence (GASx1619) was identified in *S. pyogenes* <SEQ ID 8169> which encodes the amino acid sequence <SEQ ID 8170>. Analysis of this protein sequence reveals the following:

```
Possible site: 36
>>> Seems to have no N-terminal signal sequence
----- Final Results -----
  bacterial cytoplasm --- Certainty = 0.2916 (Affirmative) <succ>
  bacterial membrane --- Certainty = 0.0000 (Not Clear) <succ>
  bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2836

A DNA sequence (GASx1621) was identified in *S. pyogenes* <SEQ ID 8171> which encodes the amino acid sequence <SEQ ID 8172>. Analysis of this protein sequence reveals the following:

```
Possible site: 33
>>> Seems to have no N-terminal signal sequence
----- Final Results -----
  bacterial cytoplasm --- Certainty = 0.1899 (Affirmative) <succ>
  bacterial membrane --- Certainty = 0.0000 (Not Clear) <succ>
  bacterial outside --- Certainty = 0.0000 (Not Clear) <succ>
```

No corresponding DNA sequence was identified in *S. agalactiae*.

The protein has homology with the following sequences in the GENPEPT database:

```
alpha subunit [Escherichia coli]

Identities = 110/211 (52%), Positives = 153/211 (72%)

Query:     7  KEITIKEAVAHVKDGDTIMVGGFMTNGTPEKLIDALVEKGVKDLTLICNDAGFPDKGVGK   66
              K +T+++A   +DG TIMVGGFM  GTP +L++AL+E GV+DLTLI ND  F D G+G
Sbjct:     4  KLMTLQDATGFFRDGMTIMVGGFMGIGTPSRLVEALLESGVRDLTLIANDTAFVDTGIGP   63

Query:    67  MVANKQFSTIIASHIGLNREAGRQMTEGETVIDLVPQGTLAERIRSGGFGLGGFLTPTGI  126
              ++ N +   +IASHIG N E GR+M  GE   + LVPQGTL E+IR GG GLGGFLTPTG+
Sbjct:    64  LIVNGRVRKVIASHIGTNPETGRRMISGEMDVVLVPQGTLIEQIRCGGAGLGGFLTPTGV  123

Query:   127  GTEVAKGKEVITIDGKDYLLEKPLKADVALIFANKADKNGNLQYAGSENNFNHVMAANAK  186
              GT V +GK+ +T+DGK +LLE+PL+AD+ALI A++ D  GNL Y  S  NFN ++A  A
Sbjct:   124  GTVVEEGKQTLTLDGKTWLLERPLRADLALIRAHRCDTLGNLTYQLSARNFNPLIALAAD  183

Query:   187  TTIVEAREIVDVGQMDPNFVHTPGIFVNYLV                              217
              T+VE   E+V+ G++ P+ + TPG +++++
Sbjct:   184  ITLVEPDELVETGELQPDHIVTPGAVIDHII                              214
```

Based on this analysis, it was predicted that this GAS-specific protein and its epitopes, could be useful antigens for vaccines or diagnostics.

Example 2837

A DNA sequence (GASx1622) was identified in *S. pyogenes* <SEQ ID 8173> which encodes the amino acid sequence <SEQ ID 8174>. Analysis of this protein sequence reveals the following:

```
Possible site: 44
>>> Seems to have no N-terminal signal sequence
----- Final Results -----
   bacterial cytoplasm --- Certainty = 0.4668 (Affirmative) <succ>
   bacterial membrane --- Certainty = 0.0000 (Not Clear) <succ>
   bacterial outside --- Certainty = 0.0000 (Not Clear) <succ>
```

No corresponding DNA sequence was identified in *S. agalactiae*.

The protein has homology with the following sequences in the GENPEPT database:

```
>GP:AAD54948 GB:AF157306 acetoacetate:butyrate/acetate coenzyme A
transferase [Clostridium beijerinckii]
Identities = 121/214 (56%), Positives = 161/214 (74%), Gaps = 5/214 (2%)

Query:    7  VLSKEEIQTRIAKRVAQELEHNTLVNLGIGLPTKVANYIPEGVTITLQSENGFVGLTGLT   66
             VL+KE I   AKRVA+EL+    LVNLGIGLPT VANY+P+ + IT +SENG VG+  +
Sbjct:    6  VLAKEII----AKRVAKELKKGQLVNLGIGLPTLVANYVPKEMNITFESENGMVGMAQMA   61

Query:   67  DD-HYDPTIVNAGGQPVSIAPGGAFFDSSTSFGIIRGGHVAATVLGALQVDKEASIANYL  125
             DP I+NAGG+ V++ P GAFFDSSTSF +IRGGHV   VLGAL+VD+E ++AN++
Sbjct:   62  SSGENDPDIINAGGEYVTLLPQGAFFDSSTSFALIRGGHVDVAVLGALEVDEEGNLANWI  121

Query:  126  IPGKMVPGMGGAMDLLVGAKKVIVAMEHTNKGKAKILDKCTLPLTAQNVVNLIITEMGVF  185
             +P K+VPGMGGAMDL +GAKK+IVAM+HT KGK KI+ KCTLPLTA+  V+LI+TE+ V
Sbjct:  122  VPNKIVPGMGGAMDLAIGAKKIIVAMQHTGKGKPKIVKKCTLPLTAKAQVDLIVTELCVI  181

Query:  186  EYQDEGLCALEINPDYTFEDVQNVTEVTLIDKTN                          219
             +  ++GL    EI+ D T ++++ +T+  LI    N
Sbjct:  182  DVTNDGLLFREIHKDTTIDEIKFLTDADLIIPDN                          215
```

Based on this analysis, it was predicted that this GAS-specific protein and its epitopes, could be useful antigens for vaccines or diagnostics.

Example 2838

A DNA sequence (GASx1628R) was identified in *S. pyogenes* <SEQ ID 8175> which encodes the amino acid sequence <SEQ ID 8176>. Analysis of this protein sequence reveals the following:

```
Possible site: 17
>>> Seems to have no N-terminal signal sequence
----- Final Results -----
   bacterial cytoplasm --- Certainty = 0.1243 (Affirmative) <succ>
   bacterial membrane --- Certainty = 0.0000 (Not Clear) <succ>
   bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2839

A DNA sequence (GASx1639R) was identified in *S. pyogenes* <SEQ ID 8177> which encodes the amino acid sequence <SEQ ID 8178>. Analysis of this protein sequence reveals the following:

```
Possible site: 34
>>> Seems to have an uncleavable N-term signal seq
INTEGRAL   Likelihood = -8.65  Transmembrane 55-71 (44-73)
INTEGRAL   Likelihood = -7.64  Transmembrane 13-29 (5-31)
-----Final Results -----
   bacterial membrane --- Certainty = 0.4461 (Affirmative) <succ>
   bacterial outside --- Certainty = 0.0000 (Not Clear) <succ>
   bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2840

A DNA sequence (GASx1643) was identified in *S. pyogenes* <SEQ ID 8179> which encodes the amino acid sequence <SEQ ID 8180>. Analysis of this protein sequence reveals the following:

```
Possible site: 35
>>> Seems to have no N-terminal signal sequence
----- Final Results -----
   bacterial cytoplasm --- Certainty = 0.0766 (Affirmative) <succ>
   bacterial membrane --- Certainty = 0.0000 (Not Clear) <succ>
   bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2841

A DNA sequence (GASx1645R) was identified in *S. pyogenes* <SEQ ID 8181> which encodes the amino acid sequence <SEQ ID 8182>. Analysis of this protein sequence reveals the following:

Possible site: 18
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2842

A DNA sequence (GASx1649R) was identified in *S. pyogenes* <SEQ ID 8183> which encodes the amino acid sequence <SEQ ID 8184>. Analysis of this protein sequence reveals the following:

Possible site: 24
>>> Seems to have no N-terminal signal sequence
----- Final Results -----
   bacterial cytoplasm --- Certainty = 0.0931 (Affirmative) <succ>
      bacterial membrane --- Certainty = 0.0000 (Not Clear) <succ>
         bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2843

A DNA sequence (GASx1650) was identified in *S. pyogenes* <SEQ ID 8185> which encodes the amino acid sequence <SEQ ID 8186>. Analysis of this protein sequence reveals the following:

Possible site: 14
>>> Seems to have no N-terminal signal sequence
----- Final Results -----
   bacterial cytoplasm --- Certainty = 0.5678 (Affirmative) <succ>
      bacterial membrane --- Certainty = 0.0000 (Not Clear) <succ>
         bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2844

A DNA sequence (GASx1651R) was identified in *S. pyogenes* <SEQ ID 8187> which encodes the amino acid sequence <SEQ ID 8188>. Analysis of this protein sequence reveals the following:

Possible site: 40
>>> Seems to have no N-terminal signal sequence
----- Final Results -----
   bacterial cytoplasm --- Certainty = 0.2761 (Affirmative) <succ>
      bacterial membrane --- Certainty = 0.0000 (Not Clear) <succ>
         bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2845

A DNA sequence (GASx1667R) was identified in *S. pyogenes* <SEQ ID 8189> which encodes the amino acid sequence <SEQ ID 8190>. Analysis of this protein sequence reveals the following:

Possible site: 33
>>> Seems to have no N-terminal signal sequence
----- Final Results -----
   bacterial cytoplasm --- Certainty = 0.2967 (Affirmative) <succ>
      bacterial membrane --- Certainty = 0.0000 (Not Clear) <succ>
         bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2846

A DNA sequence (GASx1672) was identified in *S. pyogenes* <SEQ ID 8191> which encodes the amino acid sequence <SEQ ID 8192>. Analysis of this protein sequence reveals the following:

Possible site: 24
>>> Seems to have an uncleavable N-term signal seq
INTEGRAL    Likelihood = −3.82    Transmembrane 3-19 (1- 20)
-----Final Results -----
   bacterial membrane --- Certainty = 0.2529 (Affirmative) <succ>
      bacterial outside --- Certainty = 0.0000 (Not Clear) <succ>
         bacterial cytoplasm --- Certainty= 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2847

A DNA sequence (GASx1673R) was identified in *S. pyogenes* <SEQ ID 8193> which encodes the amino acid sequence <SEQ ID 8194>. Analysis of this protein sequence reveals the following:

---

Possible site: 38
>>> Seems to have no N-terminal signal sequence
INTEGRAL    Likelihood = −8.86    Transmembrane 51- 67 ( 47-75)
INTEGRAL    Likelihood = −5.20    Transmembrane 27-43 ( 24-45)
INTEGRAL    Likelihood = −3.66    Transmembrane112-128 (112-131)
----- Final Results -----
   bacterial membrane --- Certainty = 0.4545 (Affirmative) <succ>
      bacterial outside --- Certainty= 0.0000 (Not Clear) <succ>
         bacterial cytoplasm --- Certainty= 0.0000 (Not Clear) <succ>

---

No corresponding DNA sequence was identified in *S. agalactiae*.

The protein has homology with the following sequences in the GENPEPT database:

A related GBS gene <SEQ ID 9009> and protein <SEQ ID 9010> were also identified. Analysis of this protein sequence reveals the following:

---

Lipop: Possible site:−1   Crend: 0
McG: Discrim Score: 5.86
GvH: Signal Score (−7.5): 0.14
Possible site: 60
>>> Seems to have a cleavable N-term signal seq.
ALOM program    count: 2 value: −8.23 threshold: 0.0
INTEGRAL    Likelihood = −8.23    Transmembrane 69-85 (64-89)
INTEGRAL    Likelihood = −3.29    Transmembrane 142-158 (140-159)
PERIPHERAL  Likelihood = 1.70     123
modified ALOM score: 2.15
*** Reasoning Step: 3
----- Final Results -----
   bacterial membrane --- Certainty = 0.4291 (Affirmative) <succ >
      bacterial outside --- Certainty = 0.0000 (Not Clear) <succ >
         bacterial cytoplasm --- Certainty = 0.0000 (Not Clear) <succ >

---

```
>GP:AAF41294 GB:AE002440 conserved hypothetical protein [Neisseria
meningitidis MC58]
Identities = 61/148 (41%), Positives = 96/148 (64%)

Query:    1  LKKSITNEKAILAQGGQEFGAQNTKFLTLLHIMIYVFAVIEALLKQIKFDGISFLGLLLM    60
             L  SI +EKA++A+G +++G  N+   L  +H + Y+     L     F+GIS +G L +
Sbjct:   19  LAVSIKHEKALIAKGAKQYGKTNSTLAAVHTLYYLACFVWVWLSDTAFNGISLIGTLTV    78

Query:   61  LLSVAVLYEVTRILGDIWTVKLMLAKDHKYVDHWLFKTIKHPNYFLNIAPELVGIALLCH   120
             + S  +L  + + LG+IWTVK+ +  +H+    WLFKT +HPNYFLNI  PEL+GIALLC
Sbjct:   79  MASFVILSLIIKQLGEIWTVKIYILPNHQINRSWLFKTFRHPNYFLNIIPELIGIALLCQ   138

Query:  121  AKITAMLLFPCYIVVIYLRIREENKLLA                                  148
             A    ++   P Y++V++ RIR+E + +A
Sbjct:  139  AWYVLLIGLPIYLLVLFKRIRQEEQAMA                                  166
```

The protein has homology with the following sequences in the databases:

---

```
42.1/64.0% over 168aa
imported
EGAD|177248| conserved hypothetical protein {Neisseria meningitidis}Insert characterized
GP|7379797|emb|CAB84365.1||AL162755 putative integral membrane protein {Neisseria
meningitidis} Insert characterized
GP|7226121|gb|AAF41294.1||AE002440 conserved hypothetical protein {Neisseria meningitidis
MC58} Insert characterized
PIR|F81147|F81147 probable integral membrane protein NMA1102 - Neisseria meningitidis
group B strain MD58, group A strain Z2491) Insert
characterized
ORF00432(301-807 of 1140)
EGAD|177248|NMB0883(1-169 of 169) conserved hypothetical protein {Neisseria
meningitidis}GP|7379797|emb|CAB84365.1||AL162755 putative integral membrane protein
{Neisseria meningitidis}GP|7226121|gb|AAF41294.1||AE002440 conserved hypothetical protein
{Neisseria meningitidis MC58}PIR|F81147|F81147 probable integral membrane protein NMA1102
[imported] - Neisseria meningitidis (group B strain MD58, group A strain Z2491)
% Match = 19.0
% Identity = 42.0 % Similarity = 63.9
Matches = 71 Mismatches = 61 Conservative Sub.s = 37
```

```
237         267         297         327         357         387         417         447
SSGEYHLLTSDHSLV*IGKAXX*LIXXXEFTMSIIIGLMAAMFIIRLAYLKLSIANEKALRKNGAKEYGVGVSKAITVLH
                                    |::|:  :::  |||||  :|  :||  :||||    |||:||    |  :  :|
                                    MTMILSILSLFFIIRLLFLAVSIKHEKALIAKGAKQYGKTNSTLLAAVH
                                         10          20          30          40

477         507         537         567         597         627         657         687
IIIYFSSVTEAILTKASFNFVSVIGLSLMIFSVFMLHTVTRLLGRIWTVKLMVDKNHQFVDHWLFRVVKHPNYFLNIAPE
 :  |::     |:  :||  :|:||    ::    |  :  :||||||:  :   |||       |||:    :||||||||  ||
TLYYLACFVWVWLSDTAFNGISLIGTLTVMASFVILSLIIKQLGEIWTVKIYILPNHQINRSWLFKTFRHPNYFLNIIPE
       60          70          80          90         100         110         120

717         747         777         807         837         867         897         927
LLGVTLLCHAKYTALFVLPIYAFVIYLRIREENLLLKTIIIPNGIKKSRVY*E*DK**T*KSFFVILSQ*EEVFISCFFS
|::|:  |||:|  |    |  ||||  :|::  |||:|      :  |:
LIGIALLCQAWYVLLIGLPIYLLVLFKRIRQEEQAMATLF
        140         150         160
```

Based on this analysis, it was predicted that these proteins and their epitopes could be useful antigens for vaccines or diagnostics.

Example 2848

A DNA sequence (GASx1674R) was identified in *S. pyogenes* <SEQ ID 8195> which encodes the amino acid sequence <SEQ ID 8196>. Analysis of this protein sequence reveals the following:

Possible site: 23
>>> Seems to have no N-terminal signal sequence
----- Final Results -----
  bacterial cytoplasm --- Certainty = 0.3098 (Affirmative) <succ>
  bacterial membrane --- Certainty = 0.0000 (Not Clear) <succ>
  bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2849

A DNA sequence (GASx1677R) was identified in *S. pyogenes* <SEQ ID 8197> which encodes the amino acid sequence <SEQ ID 8198>. Analysis of this protein sequence reveals the following:

Possible site: 33
>>> Seems to have no N-terminal signal sequence
INTEGRAL   Likelihood = -8.86   Transmembrane 254-270 (248-280)
INTEGRAL   Likelihood = -7.01   Transmembrane 303-319 (296-322)
INTEGRAL   Likelihood = -2.39   Transmembrane 74-90 (74-91)
INTEGRAL   Likelihood = -1.91   Transmembrane 201-217 (199-217)
INTEGRAL   Likelihood = -1.91   Transmembrane 223-239 (220-240)
INTEGRAL   Likelihood = -1.65   Transmembrane 118-134 (115-135)
INTEGRAL   Likelihood = -1.49   Transmembrane 56-72 (55-72)
INTEGRAL   Likelihood = -0.32   Transmembrane 13-29 (13-30)
----- Final Results -----
  bacterial membrane --- Certainty = 0.4545 (Affirmative) <succ>
  bacterial outside --- Certainty = 0.0000 (Not Clear) <succ>
  bacterial cytoplasm --- Certainty = 0.0000 (Not Clear) <succ>

No corresponding DNA sequence was identified in *S. agalactiae*.

The protein has homology with the following sequences in the GENPEPT database:

```
>GP:BAB05126 GB:AP001511 unknown conserved protein [Bacillus halodurans]
Identities = 249/534 (46%), Positives = 380/534 (70%)

Query:    12  QDIAFHFFGGLGLFLFSIKYMGDGLQQAAGDKLRYYIDKYTSNPFFGILVGIAMSALIQS    71
              Q + F FFGGLG+FLF IKYMGDGLQ+ AG++LR  +DK+T+NP  G+L GI ++ L+Q+
Sbjct:     6  QTLLFMFFGGLGIFLFGIKYMGDGLQKVAGERLRDLLDKFTTNPLMGVLAGIVVTVLLQT    65

Query:    72  SSGVTVITVGLVSAGLLNLRQAIGIVMGANIGTTITSFLIGFKLGDYALPMIFIGAACLF   131
              S+G TV+T+GLV+AG + L+QAIG++MGANIGTT+T+F+IG K+ +YALP+I +GAA +F
Sbjct:    66  STGTTVLTIGLVNAGFMTLKQAIGVIMGANIGTTVTAFIIGIKISEYALPIIAVGAALIF   125

Query:   132  FTSNKKLNNFGRIIFGVGGIFFSLNLMGDAMDPLKSVSAFQNYLATLGDKPFQGVFIGTA   191
              F  NKK+NN G++IFG G +F+ LN MG+ ++PL+ + AF +    ++ + P  GV IGT
Sbjct:   126  FIKNKKVNNIGQVIFGFGTLFYGLNTMGEGLNPLRELQAFADLTVSMSENPLLGVLIGTI   185

Query:   192  LTMLIQSSAAIIGILQGLFSGGLLTLQGAIPILLGSNIGTCITAVLAAIGSNIAAKRVAA   251
                T +QSS+A IG+LQ L+  G + L  A+P+L G NIGT ITAVLAAIG+++AAKR A
Sbjct:   186  FTAAVQSSSASIGLLQQLYDQGAMDLFAALPVLFGDNIGTTITAVLAAIGASVAAKRAAL   245

Query:   252  AHVLFNLIGTIIFMIILVPFTSLMLWLQSKLSLTPEMTIAFSHGSFNITNTILLIPFISL   311
                HV+FNLIGTII  +II++PFT  + L     +L   MTIAF+HG FN++NTI+ PFI +
Sbjct:   246  THVIFNLIGTIIVLIIIPFTHFIAYLAEVFALNRPMTIAFAHGIFNVSNTIIQFPPFIGI   305

Query:   312  LAMIVTRLIPGEDEVVKYEALYLDRLLITQAPSIALGNAHKELVHLASYAIQAFEASYSY   371
```

-continued

```
                   LA+IVT+L+PG+D   ++Y+A  +LD    +   +P+IALG A +E++ +A ++ +       Y
Sbjct:  306  LAIIVTKLVPGDDFYIEYKAKHLDPRFVGSSPAIALGQAKQEVLRMAEFSEKGLLEVSKY  365

Query:  372  IMTADGKFGEKVKRYERAVDTIDEELTTYLVDISNEALSPSENEVLAGILDSSRDLERIG  431
                +    K  E   ++E A++ +D ++T YL+ IS+ +LS  ++++      ++D+ RD+ERIG
Sbjct:  366  MENGQKKHAEMAVQFEDAINNLDRKITEYLISISSRSLSAQDSKMHGMLMDTVRDIERIG  425

Query:  432  DHSESLGILIEGIISKQIGFSISARQELTEMYQLTHCLTLDAIRAIVDSDTDLAQTIVTR  491
               DH E++   L +   + ++   S    A   +L EM+ LTH      +AI ++    D + A++++ +
Sbjct:  426  DHIENIVELKDYQKANKVKISEKALHDLQEMFDLTHSTLTEAIMSLETGDLEAARSVIEK  485

Query:  492  HKEIEEKERRLRKTHIKRLNCGECTAQAGINFIDIISHYTRITDHALNLAEKVL       545
                + I++ ER+LRK HI R+N G CT    AGI F+DI+S+   RI  DH++N+AE V+
Sbjct:  486  EEHIDQMERKLRKQHIIRVNEGNCTGAAGIVFVDIVSNLERIGDHSVNIAEAVI       539
```

Based on this analysis, it was predicted that this GAS-specific protein and its epitopes, could be useful antigens for vaccines or diagnostics.

Example 2850

A DNA sequence (GASx1678R) was identified in *S. pyogenes* <SEQ ID 8199> which encodes the amino acid sequence <SEQ ID 8200>. Analysis of this protein sequence reveals the following:

---
Possible site: 48
>>> Seems to have no N-terminal signal sequence
----- Final Results -----
    bacterial cytoplasm --- Certainty = 0.2940 (Affirmative) <succ>
    bacterial membrane --- Certainty = 0.0000 (Not Clear) <succ>
    bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2851

A DNA sequence (GASx1685R) was identified in *S. pyogenes* <SEQ ID 8201> which encodes the amino acid sequence <SEQ ID 8202>. Analysis of this protein sequence reveals the following:

---
Possible site: 22
>>> Seems to have an uncleavable N-term signal seq
INTEGRAL   Likelihood = −7.11   Transmembrane 13-29 (9-31)
----- Final Results -----
    bacterial membrane --- Certainty = 0.3845 (Affirmative) <succ>
    bacterial outside --- Certainty = 0.0000 (Not Clear) <succ>
    bacterial cytoplasm --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2852

A DNA sequence (GASx1695R) was identified in *S. pyogenes* <SEQ ID 8203> which encodes the amino acid sequence <SEQ ID 8204>. Analysis of this protein sequence reveals the following:

---
Possible site: 15
>>> Seems to have no N-terminal signal sequence
----- Final Results -----
    bacterial cytoplasm --- Certainty = 0.1357 (Affirmative) <succ>
    bacterial membrane --- Certainty = 0.0000 (Not Clear) <succ>
    bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2853

A DNA sequence (GASx1698) was identified in *S. pyogenes* <SEQ ID 8205> which encodes the amino acid sequence <SEQ ID 8206>. Analysis of this protein sequence reveals the following:

---
Possible site: 33
>>> Seems to have no N-terminal signal sequence
----- Final Results -----
    bacterial cytoplasm --- Certainty = 0.1970 (Affirmative) <succ>
    bacterial membrane --- Certainty = 0.0000 (Not Clear) <succ>
    bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2854

A DNA sequence (GASx1713) was identified in *S. pyogenes* <SEQ ID 8207> which encodes the amino acid sequence <SEQ ID 8208>. Analysis of this protein sequence reveals the following:

```
Possible site: 44
>>> Seems to have no N-terminal signal sequence
----- Final Results -----
    bacterial cytoplasm --- Certainty = 0.3092 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2855

A DNA sequence (GASx1737) was identified in S. pyogenes <SEQ ID 8209> which encodes the amino acid sequence <SEQ ID 8210>. Analysis of this protein sequence reveals the following:

```
Possible site: 13
>>> Seems to have no N-terminal signal sequence
----- Final Results -----
    bacterial cytoplasm --- Certainty = 0.1878 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2856

A DNA sequence (GASx1748R) was identified in S. pyogenes <SEQ ID 8211> which encodes the amino acid sequence <SEQ ID 8212>. Analysis of this protein sequence reveals the following:

```
Possible site: 23
>>> Seems to have no N-terminal signal sequence
----- Final Results -----
    bacterial cytoplasm --- Certainty = 0.2841 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2857

A DNA sequence (GASx1750R) was identified in S. pyogenes <SEQ ID 8213> which encodes the amino acid sequence <SEQ ID 8214>. Analysis of this protein sequence reveals the following:

```
Possible site: 59
>>> Seems to have no N-terminal signal sequence
INTEGRAL   Likelihood = -1.22   Transmembrane 18-34 (18-34)
----- Final Results -----
    bacterial membrane --- Certainty = 0.1489 (Affirmative) <succ>
    bacterial outside --- Certainty = 0.0000 (Not Clear) <succ>
    bacterial cytoplasm --- Certainty = 0.0000 (Not Clear) <succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2858

A DNA sequence (GASx1754) was identified in S. pyogenes <SEQ ID 8215> which encodes the amino acid sequence <SEQ ID 8216>. Analysis of this protein sequence reveals the following:

```
Possible site: 44
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2859

A DNA sequence (GASx1759) was identified in S. pyogenes <SEQ ID 8217> which encodes the amino acid sequence <SEQ ID 8218>. Analysis of this protein sequence reveals the following:

```
Possible site: 36
>>> Seems to have no N-terminal signal sequence
----- Final Results -----
    bacterial cytoplasm --- Certainty = 0.1534 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2860

A DNA sequence (GASx1764R) was identified in S. pyogenes <SEQ ID 8219> which encodes the amino acid sequence <SEQ ID 8220>. Analysis of this protein sequence reveals the following:

```
Possible site: 29
>>> Seems to have a cleavable N-term signal seq.
INTEGRAL    Likelihood = -6.74   Transmembrane 90-106 (87-121)
INTEGRAL    Likelihood = -4.57   Transmembrane 210-226 (205-229)
INTEGRAL    Likelihood = -4.19   Transmembrane 43-59 (42-62)
INTEGRAL    Likelihood = -3.77   Transmembrane 137-153 (137-155)
----- Final Results -----
   bacterial membrane --- Certainty = 0.3697 (Affirmative) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2861

A DNA sequence (GASx1768R) was identified in *S. pyogenes* <SEQ ID 8221> which encodes the amino acid sequence <SEQ ID 8222>. Analysis of this protein sequence reveals the following:

```
Possible site: 17
>>> Seems to have an uncleavable N-term signal seq
INTEGRAL    Likelihood = -12.37  Transmembrane 26-42 (17-47)
INTEGRAL    Likelihood = -7.54   Transmembrane 53-69 (46-73)
INTEGRAL    Likelihood = -3.29   Transmembrane 209-225 (209-225)
INTEGRAL    Likelihood = -2.13   Transmembrane 82-98 (82-98)
INTEGRAL    Likelihood = -1.65   Transmembrane 9-25 (9-25)
INTEGRAL    Likelihood = -0.85   Transmembrane 117-133 (117-134)
----- Final Results -----
   bacterial membrane --- Certainty = 0.5946 (Affirmative) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has homology with the following sequences in the GENPEPT database:

Based on this analysis, it was predicted that this GAS-specific protein and its epitopes, could be useful antigens for vaccines or diagnostics.

Example 2862

A DNA sequence (GASx1769R) was identified in *S. pyogenes* <SEQ ID 8223> which encodes the amino acid sequence <SEQ ID 8224>. Analysis of this protein sequence reveals the following:

```
Possible site: 16
>>> Seems to have a cleavable N-term signal seq.
INTEGRAL    Likelihood = -7.32   Transmembrane 164-180 (158-186)
INTEGRAL    Likelihood = -4.67   Transmembrane 85-101 (84-105)
INTEGRAL    Likelihood = -3.03   Transmembrane 42-58 (42-61)
INTEGRAL    Likelihood = -2.76   Transmembrane 118-134 (117-134)
INTEGRAL    Likelihood = -2.07   Transmembrane 64-80 (64-82)
INTEGRAL    Likelihood = -1.22   Transmembrane 18-34 (17-34)
----- Final Results -----
   bacterial membrane --- Certainty = 0.3930 (Affirmative) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2863

A DNA sequence (GASx1776R) was identified in *S. pyogenes* <SEQ ID 8225> which encodes the amino acid sequence <SEQ ID 8226>. Analysis of this protein sequence reveals the following:

```
Possible site: 21
>>> Seems to have an uncleavable N-term signal seq
INTEGRAL    Likelihood = -6.37   Transmembrane 4-20 (1-22)
INTEGRAL    Likelihood = -0.43   Transmembrane 261-277 (261-278)
----- Final Results -----
   bacterial membrane --- Certainty = 0.3548 (Affirmative) <succ>
      bacterial outside --- Certainty = 0.0000 (Not Clear) <succ>
         bacterial cytoplasm --- Certainty = 0.0000 (Not Clear) <succ>
```

```
>GP:AAB84959 GB:AE000829 conserved protein [Methanobacterium
thermoautotrophicum]
Identities = 54/192 (28%), Positives = 90/192 (46%), Gaps = 6/192 (3%)

Query:     7   TKLLLLVLANACFFFRVDGFLEFIIVIFLLLLLSALNKKKLA--FKLAVVYLLMIGLSVI      64
               +KL ++V A     F  D L I+ +    L++     + A  F    ++    ++ L++I
Sbjct:    32   SKLTVVVSATLLSTFISDLTLLIIMGVIFTALIAHSGSLRFAAPFLSFIILFWLVSLAII      91

Query:    65   PLSIFPSYLDHLLSFVSIAGRLVFPSLLAGLITIKTTTIYELVHGLRKWRFPEVWLLTLA     124
               +     S   H + F+S+       F     AGL    TT   +L   LR  R P   + TL
Sbjct:    92   MVL---SGNPHTMGFLSLFFARFFIISAAGLSFAFTTEPQKLAESLRSVRIPGEIVFTLT     148

Query:   125   VMCRFIPMIRQECCVIHRSLKIRGIILTKWSILIRPKQYLEYLMVPLLLSLIRSSQELTI     184
                V  R+IP +   E   I   SLK+R     L+   SI+ RP       L++P+++ ++  S E+  I
Sbjct:   149   VALRYIPALAVEASSIWDSLKLR-TSLSGSSIIRRPSLLYRGLIIPMIIRTVKISDEVAI     207

Query:   185   ASLTKGLAVNKG                                                 196
               A+  T+G    +G
Sbjct:   208   AAETRGFNPREG                                                 219
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2864

A DNA sequence (GASx1777R) was identified in *S. pyogenes* <SEQ ID 8227> which encodes the amino acid sequence <SEQ ID 8228>. Analysis of this protein sequence reveals the following:

```
Possible site: 24
>>> Seems to have no N-terminal signal sequence
INTEGRAL      Likelihood = –8.17    Transmembrane 1217-1233 (1215-
                                                      1235)
----- Final Results -----
   bacterial membrane --- Certainty = 0.4270 (Affirmative) <succ>
     bacterial outside --- Certainty = 0.0000 (Not Clear) <succ>
       bacterial cytoplasm --- Certainty = 0.0000 (Not Clear) <succ>
```

No corresponding DNA sequence was identified in *S. agalactiae*.

The protein has homology with the following sequences in the GENPEPT database:

```
>GP:AAF53254 GB:AE003639 CG16974 gene product [Drosophila melanogaster]
Identities = 84/238 (35%), Positives = 133/238 (55%), Gaps = 10/238 (4%)

Query:    516   LRLDHYELTDISLL--KHAKNITELHLDGNQITEIPKELFSQMKQLRFLNLRSNHLTYLD     573
                L +     L++ SLL  ++ K + ELHLD +++T +P+    ++ +LR LNL   N LT L
Sbjct:    232   LEMSGNRLSNCSLLNLQYMKQLQELHLDRSELTYLPQRFLGELSELRMLNLSQNLLTELP     291

Query:    574   KDTFKSNAQLRELYLSSNFIHSLEGGLFQSLHHLEQLDLSKNRIGRLCDNPFEGLSRLTS     633
                +D F    +L  LYLS N + L    LFQ+    L+ LDLS NR+    DN F    +L
Sbjct:    292   RDIFVGALKLERLYLSGNRLSVLPFMLFQTAADLQVLDLSDNRLLSFPDNFFARNGQLRQ     351

Query:    634   LGFAENSLEEIPEKALEPLTSLNFIDLSQNNLALLP-KTIEKLRALSTIVASRNHITRID     692
                L   N L+ I + +L  L  L   +DLSQN+L+++    K   E L  L  +  S N++T +
Sbjct:    352   LHLQRNQLKSIGKHSLYSLRELRQLDLSQNSLSVIDRKAFESLDHLLALNVSGNNLTLLS     411

Query:    693   NISFKNLPKLSVLDLSTNEISNLPNGIFKQNNQL-------TKLDFFNNLLTQVEESV     743
                +I F++L   L   LDLS N+     LP+G+F++    L         T ++ F+N +++ +ES+
Sbjct:    412   SIIFQSLHALRQLDLSRNQFKQLPSGLFQRQRSLVLLRIDETPIEQFSNWISRYDESL     469
```

Based on this analysis, it was predicted that this GAS-specific protein and its epitopes, could be useful antigens for vaccines or diagnostics.

Example 2865

A DNA sequence (GASx1778R) was identified in *£pyogenes* <SEQ ID 8229> which encodes the amino acid sequence <SEQ ID 8230>. Analysis of this protein sequence reveals the following:

```
Possible site: 39
>>> Seems to have no N-terminal signal sequence
----- Final Results -----
   bacterial cytoplasm --- Certainty = 0.1067 (Affirmative) <succ>
    bacterial membrane --- Certainty = 0.0000 (Not Clear) <succ>
     bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2866

A DNA sequence (GASx1779) was identified in *S. pyogenes* <SEQ ID 8231> which encodes the amino acid sequence <SEQ ID 8232>. Analysis of this protein sequence reveals the following:

```
Possible site: 17
>>> Seems to have no N-terminal signal sequence
----- Final Results -----
   bacterial cytoplasm --- Certainty = 0.1885 (Affirmative) <succ>
    bacterial membrane --- Certainty = 0.0000 (Not Clear) <succ>
     bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2867

A DNA sequence (GASx1786R) was identified in *S. pyogenes* <SEQ ID 8233> which encodes the amino acid sequence <SEQ ID 8234>. Analysis of this protein sequence reveals the following:

```
Possible site: 19
>>> Seems to have no N-terminal signal sequence
----- Final Results -----
   bacterial cytoplasm --- Certainty = 0.0612 (Affirmative) <succ>
    bacterial membrane --- Certainty = 0.0000 (Not Clear) <succ>
     bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2868

A DNA sequence (GASx1790) was identified in *S. pyogenes* <SEQ ID 8235> which encodes the amino acid sequence <SEQ ID 8236>. Analysis of this protein sequence reveals the following:

Possible site: 13
>>> Seems to have a cleavable N-term signal seq.
----- Final Results -----
  bacterial outside --- Certainty = 0.3000 (Affirmative) <succ>
  bacterial membrane --- Certainty = 0.0000 (Not Clear) <succ>
  bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2869

A DNA sequence (GASx1791R) was identified in *S. pyogenes* <SEQ ID 8237> which encodes the amino acid sequence <SEQ ID 8238>. Analysis of this protein sequence reveals the following:

Possible site: 43
>>> Seems to have no N-terminal signal sequence
INTEGRAL   Likelihood = –0.90   Transmembrane 28-44 (28-44)
----- Final Results -----
  bacterial membrane --- Certainty = 0.1362 (Affirmative) <succ>
  bacterial outside --- Certainty = 0.0000 (Not Clear) <succ>
  bacterial cytoplasm --- Certainty = 0.0000 (Not Clear) <succ>

A related sequence was also identified in GAS <SEQ ID 9155> which encodes the amino acid sequence <SEQ ID 9156>. Analysis of this protein sequence reveals the following:

Possible site: 25
>>> Seems to have a cleavable N-term signal seq.
----- Final Results -----
  bacterial outside --- Certainty = 0.300 (Affirmative) <succ>
  bacterial membrane --- Certainty = 0.000 (Not Clear) <succ>
  bacterial cytoplasm --- Certainty = 0.000 (Not Clear) <succ>

No corresponding DNA sequence was identified in *S. agalactiae*.

The protein has homology with the following sequences in the GENPEPT database:

```
>GP:AAA24923 GB:L06331 endoglycosidase [Chryseobacterium meningosepticum]
Identities = 105/322 (32%), Positives = 153/322 (46%), Gaps = 53/322 (16%)

Query:  106  ADKQAQELAKMKIPEKIPMKPLHGSLYGGYFRTWHDKTSDPTEKDKVNSMGELPKEVDLA  165
                 A K   ++ + +   I K     +  GY+RTW D      T    + SM  LP  +D+
    Sbjct:   37  AQKSGVTVSAVNLSNLIAYKNSDHQISAGYYRTWRDSA---TASGNLPSMRWLPDSLDMV   93

Query:  166  FIFHDWTKDYSLFWKELATKHVPKLNKQGTRVIRTIPWRFLAGGDNSGIAEDTSKYPNTP  225
                  +F D+T    + +W  L T +VP L+K+GT+VI T+      G  NS      T+
    Sbjct:   94  MVFPDYTPPENAYWNTLKTNYVPYLHKRGTKVIITL------GDLNSA----TTTGGQDS  143

Query:  226  EGNKALAKAIVDEYVYKYNLDGLDVDVEHDSIPKVDKKEDTAGVERSIQVFEEIGKLIGP  285
                 G   + AK I  D++V  +YNLDG+D+D+E              A + + +    + K  GP
    Sbjct:  144  IGYSSWAKGIYDKWVGEYNLDGIDIDIE--------SSPSGATLTKFVAATKALSKYFGP  195

Query:  286  KGVDKSRLFIMDSTYMADKNP--LIERGAPYINLLLVQVYGSQGEKGGWEPVSNRPEKTM  343
                 K    + F+ D+    ++NP    + AP  N + +Q YG              R     +
    Sbjct:  196  KS-GTGKTFVYDT----NQNPTNFFIQTAPRYNYVFLQAYG-------------RSTTNL  237

Query:  344  EERWQGYSKYIRPEQYMIGFSFYEENAQEGNLWYDINSRKDEDKANGINTDITGTRAERY  403
                      Y+ YI  +Q++ GFSFYEEN   GN W D+    +      NG      TG RA   Y
    Sbjct:  238  TTVSGLYAPYISMKQFLPGFSFYEENGYPGNYWNDVRYPQ-----NG-----TG-RAYDY  286

Query:  404  ARWQPKTGGVKGGIFSYAIDRD                                       425
                 ARWQP T G KGG+FSYAI+RD
    Sbjct:  287  ARWQPAT-GKKGGVFSYAIERD                                       307
```

Based on this analysis, it was predicted that this GAS-specific protein and its epitopes, could be useful antigens for vaccines or diagnostics.

Example 2870

A DNA sequence (GASx1803) was identified in *S. pyogenes* <SEQ ID 8239> which encodes the amino acid sequence <SEQ ID 8240>. Analysis of this protein sequence reveals the following:

Possible site: 20
>>> Seems to have no N-terminal signal sequence
----- Final Results -----
  bacterial cytoplasm --- Certainty = 0.2099 (Affirmative) <succ> bacterial membrane --- Certainty = 0.0000 (Not Clear) <succ>
bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2871

A DNA sequence (GASx1806R) was identified in *S. pyogenes* <SEQ ID 8241> which encodes the amino acid sequence <SEQ ID 8242>. Analysis of this protein sequence reveals the following:

Possible site: 54
>>>Seems to have no N-terminal signal sequence
----- Final Results -----
bacterial cytoplasm --- Certainty = 0.2706 (Affirmative) <succ>
bacterial membrane --- Certainty = 0.0000 (Not Clear) <succ>
bacterial outside --- Certainty = 0.0000 (Not Clear) <succ>

No corresponding DNA sequence was identified in *S. agalactiae*.

The protein has homology with the following sequences in the GENPEPT database:

```
>GP:CAB16126 GB:Z99124 ribosomal protein S18 [Bacillus subtilis]
Identities = 51/77 (66%), Positives = 63/77 (81%)

Query:    1   MAQQRRGGFKRRKKVDFIAANKIEYVDYKDTELLSRFVSERGKILPRRVTGTSAKNQRKV    60
              MA  RRGG +R+KV +  +N I ++DYKD +LL +FVSERGKILPRRVTGT+AK QRK+
Sbjct:    3   MAGGRRGGRAKRRKVCYFTSNGITHIDYKDVDLLKKFVSERGKILPRRVTGTNAKYQRKL   62

Query:   61   TTAIKRARVMALMPYVN                                            77
              T AIKRAR MAL+PYV+
Sbjct:   63   TAAIKRARQMALLPYVS                                            79
```

Based on this analysis, it was predicted that this GAS-specific protein and its epitopes, could be useful antigens for vaccines or diagnostics.

Example 2872

A DNA sequence (GASx1809R) was identified in *S. pyogenes* <SEQ ID 8243> which encodes the amino acid sequence <SEQ ID 8244>. Analysis of this protein sequence reveals the following:

Possible site: 60
>>> Seems to have an uncleavable N-term signal seq

INTEGRAL    Likelihood = −7.59    Transmembrane 70-86 (66-92)
INTEGRAL    Likelihood = −6.42    Transmembrane 13-29 (8-33)
INTEGRAL    Likelihood = −5.68    Transmembrane 48-64 (43-69)
----- Final Results -----
bacterial membrane --- Certainty = 0.4036 (Affirmative) <succ>
bacterial outside --- Certainty = 0.0000 (Not Clear) <succ>
bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2873

A DNA sequence (GASx1813R) was identified in *S. pyogenes* <SEQ ID 8245> which encodes the amino acid sequence <SEQ ID 8246>. Analysis of this protein sequence reveals the following:

Possible site: 56
>>> Seems to have a cleavable N-term signal seq.
INTEGRAL    Likelihood = −10.51    Transmembrane 127-143 (113-147)
INTEGRAL    Likelihood = −10.46    Transmembrane 151-167 (149-167)
INTEGRAL    Likelihood = −4.41     Transmembrane 59-75 (57-77)
----- Final Results -----

-continued bacterial membrane --- Certainty = 0.5203 (Affirmative) <succ>
bacterial outside --- Certainty = 0.0000 (Not Clear) <succ>
bacterial cytoplasm --- Certainty = 0.0000 (Not Clear) <succ>

No corresponding DNA sequence was identified in *S. agalactiae*.

The protein has homology with the following sequences in the GENPEPT database:

```
>GP:AAB98363 GB:U67490 lipoprotein B (lppB) [Methanococcus jannaschii]
Identities = 43/143 (30%), Positives = 68/143 (47%), Gaps = 7/143 (4%)

Query:   25   LLNVLLKIITGVMY--ILYPSFLIFTLWQGMTFQLWLRLLIIPAVGFIALSYIRKRFDFP    82
              + + ++ II+    Y  I  S +IF  +   +L  L +  + F +L Y+       P
Sbjct:  181   IFDAIMPIISKTAYPLIAITSLIIFIKNRKFGMKLIFALFLAFMIAF-SLKYLVNE---P   236
```

```
Query:    83  RPYEKWNIKPLIDKDTKGRSMPSRHVFSATMISMCLLRYYVYFGIVCLILSALLAICRVI   142
              RPY  +  L+  +   S PS H   A  ++ LL Y    GI+ L  + ++A  RV
Sbjct:   237  RPYLVLDNVHLLCNEGNEPSFPSGHTTLAFTLATSLLFYSKKLGILFLSWAIIVAYSRVY   296

Query:   143  AGIHYPKDVIVGYLIGLMLGLCL   165
              G+HYP DV+ G +IG+  G CL
Sbjct:   297  VGVHYPLDVLAGMIIGIFCG-CL   318
```

A related GBS gene <SEQ ID 9011> and protein <SEQ ID 9012> were also identified. Analysis of this protein sequence reveals the following:

Lipop: Possible site: −1   Crend: 9
McG: Discrim Score: 3.19
GvH: Signal Score (−7.5): −2.18
Possible site: 55
>>> Seems to have a cleavable N-term signal seq.
ALOM program   count: 3 value: −11.78 threshold: 0.0
INTEGRAL    Likelihood = −11.78   Transmembrane 126-142 (112-147)
INTEGRAL    Likelihood = −11.30   Transmembrane 150-166 (147-166)
INTEGRAL    Likelihood = −4.41    Transmembrane 58-74 (56-76)
PERIPHERAL  Likelihood = 3.29     107
modified ALOM score: 2.86
*** Reasoning Step: 3
----- Final Results -----
   bacterial membrane --- Certainty = 0.5713 (Affirmative) <succ>
      bacterial outside --- Certainty = 0.0000 (Not Clear) <succ>
      bacterial cytoplasm --- Certainty = 0.0000 (Not Clear) <succ>

The protein has homology with the following sequences in the databases:

```
ORF01020(472-792 of 1098)
EGAD|44548|MJ0374(213-318 of 330) conserved hypothetical protein {Methanococcus
jannaschii} OMNI|MJ0374 conserved hypothetical protein SP|Q57819|Y374_METJA HYPOTHETICAL
PROTEIN MJ0374. GP|1591081|gb|AAB98363.1||U67490 lipoprotein B (lppB) {Methanococcus
jannaschii} PIR|F64346|F64346 hypothetical protein MJ0374 - Methanococcus jannaschii
% Match = 6.8
% Identity = 30.8 % Similarity = 53.3
Matches = 33 Mismatches = 49 Conservative Sub.s = 24
   222       252       282       312       342       372       402       432
EGVTKYLRRNKHVKHFAYAPQNAGGSGATIVTLG*IMESYEQFYAKLSQPFRKSPQLIILLNFLLKIVTGMMYILYPSFL VIAWLSGIFEMHKLLFTVGTIIGRLPRFLAVAYFGDVLGNINRLSDINIYLFYLINSHYNYIFDAIMPIISKTAYPLIAI
       130       140       150       160       170       180       190

462       492       522       552       582       612       642       672
IFTLWQGMTFQLWLRLLIIPAVGFIALSYIRKRLDFPRPYEKWNIKPLIYKDTEGRSMPSRHVFSATMISMCLLRYYVYF
          ::|:     : |:       ::   ::  ||||      :      |:      |  |||   |   ::  ||  |    :
TSLIIFIKNRKFGMKLIFALFLAFMIAFSLKYLVNEPRPYLVLDNVHLLCNEGNEPSFPSGHTTLAFTLATSLLFYSKKL
       210       220       230       240       250       260       270

702       732       762       792       822       852       882       912
GIVCLILSVLLAICRVIAGIHYPKDVIVGYLIGLILGLCLFI*RVRSK*FQKQLDSCTIGLSLR*NGEKRWH*K*QMLHL
|| :  |   : : : :|   ||     |:||| ||:   :||:     |  ||
GILFLSWAIIVAYSRVYVGVHYPLDVLAGMIIGIFCG-CLTRIDIYKLIDNI
       290       300       310       320       330
```

Based on this analysis, it was predicted that these proteins and their epitopes could be useful antigens for vaccines or diagnostics.

Example 2874

A DNA sequence (GASx1815R) was identified in *S. pyogenes* <SEQ ID 8247> which encodes the amino acid sequence <SEQ ID 8248>. Analysis of this protein sequence reveals the following:

Possible site: 15
>>> Seems to have no N-terminal signal sequence
----- Final Results -----
   bacterial cytoplasm --- Certainty = 0.0888 (Affirmative) <succ>
      bacterial membrane --- Certainty = 0.0000 (Not Clear) <succ>
      bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2875

A DNA sequence (GASx1825R) was identified in *S. pyogenes* <SEQ ID 8249> which encodes the amino acid sequence <SEQ ID 8250>. Analysis of this protein sequence reveals the following:

Possible site: 30
>>> Seems to have no N-terminal signal sequence
INTEGRAL    Likelihood = −0.16    Transmembrane 7-23 (7-23)
----- Final Results -----
   bacterial membrane --- Certainty = 0.1065 (Affirmative) <succ>
      bacterial outside --- Certainty = 0.0000 (Not Clear) <succ>
      bacterial cytoplasm --- Certainty = 0.0000 (Not Clear) <succ>

No corresponding DNA sequence was identified in *S. agalactiae*.

Example 2876

A DNA sequence (GASx1832) was identified in *S. pyogenes* <SEQ ID 8251> which encodes the amino acid sequence <SEQ ID 8252>. Analysis of this protein sequence reveals the following:

Possible site: 26
>>> Seems to have no N-terminal signal sequence
----- Final Results -----
   bacterial cytoplasm --- Certainty = 0.0918 (Affirmative) <succ>
     bacterial membrane --- Certainty = 0.0000 (Not Clear) <succ>
        bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2877

A DNA sequence (GASx1836R) was identified in *S. pyogenes* <SEQ ID 8253> which encodes the amino acid sequence <SEQ ID 8254>. Analysis of this protein sequence reveals the following:

Possible site: 22
>>> Seems to have no N-terminal signal sequence
----- Final Results -----
   bacterial cytoplasm --- Certainty = 0.4084 (Affirmative) <succ>
     bacterial membrane --- Certainty = 0.0000 (Not Clear) <succ>
        bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2878

A DNA sequence (GASx1864R) was identified in *S. pyogenes* <SEQ ID 8255> which encodes the amino acid sequence <SEQ ID 8256>. Analysis of this protein sequence reveals the following:

Possible site: 21
>>> Seems to have no N-terminal signal sequence
----- Final Results -----
   bacterial cytoplasm --- Certainty = 0.5280 (Affirmative) <succ>
     bacterial membrane --- Certainty = 0.0000 (Not Clear) <succ>
        bacterial outside --- Certainty = 0.0000 (Not Clear) <succ>

No corresponding DNA sequence was identified in *S. agalactiae*.

The protein has homology with the following sequences in the GENPEPT database:

```
>GP:AAC36810 GB:L12244 ribosomal protein L28 [Bacillus subtilis]
Identities = 45/62 (72%), Positives = 52/62 (83%)

Query:    1    MAKVCYFTGRKTVSGNNRSHAMNQTKRTVKPNLQKVTILVDGKPKKVWASARALKSGKVE    60
               MA+ C  TG+KT +GNNRSHAMN +KRT   NLQKV ILV+GKPKKV+ SARALKSGKVE
Sbjct:    1    MARKCVITGKKTTAGNNRSHAMNASKRTWGANLQKVRILVNGKPKKVYVSARALKSGKVE    60

Query:   61    RI                                                            62
               R+
Sbjct:   61    RV                                                            62
```

Based on this analysis, it was predicted that this GAS-specific protein and its epitopes, could be useful antigens for vaccines or diagnostics.

Example 2879

A DNA sequence (GASx1869) was identified in *S. pyogenes* <SEQ ID 8257> which encodes the amino acid sequence <SEQ ID 8258>. Analysis of this protein sequence reveals the following:

Possible site: 19
>>> Seems to have no N-terminal signal sequence
----- Final Results -----
   bacterial cytoplasm --- Certainty = 0.1858 (Affirmative) <succ>
     bacterial membrane --- Certainty = 0.0000 (Not Clear) <succ>
        bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2880

A DNA sequence (GASx1881) was identified in *S. pyogenes* <SEQ ID 8259> which encodes the amino acid sequence <SEQ ID 8260>. Analysis of this protein sequence reveals the following:

```
Possible site: 29
>>> Seems to have no N-terminal signal sequence
----- Final Results -----
    bacterial cytoplasm --- Certainty = 0.2752 (Affirmative) <succ>
    bacterial membrane --- Certainty = 0.0000 (Not Clear) <succ>
        bacterial outside --- Certainty = 0.0000 (Not Clear) <succ>
```

RGD motif 136-138

No corresponding DNA sequence was identified in *S. agalactiae*.

The protein has homology with the following sequences in the GENPEPT database:

```
>GP:AAF04356 GB:AF177167 type IC restriction subunit
[Streptococcus thermophilus] Identities =
358/1047 (34%), Positives = 571/1047 (54%), Gaps = 91/1047 (8%)
Query:   7  TELELEKELIHLLETGESQWTYRKELKTEDALWDNFFKILAQNNTQYLNEEPLTASEKEQ    66
            +E +E  +I +L    E+QWTYR +LK+E+ALW NF   L + N   L E+PLT  E +Q
Sbjct:   4  SEQMIENQFIQILSEKENQWTYRPDLKSEEALWQNFRSHLNRINLAVLGEQPLTDKEFKQ    63

Query:  67  IKNQLNEVNY--YEAAKWLAGENGIAKVQVQREDAKLGTIRLEVVKADNVAGGTSVYEIA   124
            +K + + +     A++WL GENG+A++ ++RED K   + LE +  +++GGTS YE+
Sbjct:  64  VKVEFSRLTGTPFLASQWLRGENGVAQILLEREDGK--RVTLEAFRNKDISGGTSSYEVV   121

Query: 125  NQVAFSGSRDRRGDVTLLINGLPMIQIELKSQNHQ--CIEAFNQVKKYDKEGQFRGIFST   182
            +QV    SR  RGDV+LLINGLP+I IELK ++ +    ++A+ Q+++Y ++G F+GI++T
Sbjct: 122  HQVVPDSSRVDRGDVSLLINGLPIIHIELKKESAKDGFMQAYYQIQRYAEDGFFKGIYAT   181

Query: 183  LQMFVVSNKTDTRYIAAAKENKLNP-----NFLTQWVDQNNKPQKDLFAFAKEVLSIPRA   237
              Q+ V+SNK DTRY A    E+         FL  W ++N+  DLF F + VL IP A
Sbjct: 182  TQIMVISNKVDTRYFARPSEDTAEAYARMKKFLENWRTEDNQTVSDLEDFTRTVLRIPDA   241

Query: 238  HQMVMTYSVIDDDKKA---LILLRPYQIHAIEAVAEASRHRKSGYIWHTTGSGKTLTSYK   294
            H+++ Y+++ DD+K     L+ LRPYQIHAI  + +    + G+IWH TGSGKT+TS+
Sbjct: 242  HELISQYTILVDDQKNQKFLMALRPYQIHAIRKIRQKAAQHEGGFIWHATGSGKTITSFV   301

Query: 295  VARNILQIP-AVEKSIFVIDRKDLDNQTASAFQSYA---------QNDIFD--VDETEDT   342
             +  +  Q  V+++ + V+DR DLD QT   F +A         +N +  +     ++
Sbjct: 302  ATKLLAQNAIGVDRTVMVVDRTDLDAQTQDEFTKFASEYHTGQTTENSVANTLIVGIKNQ   361

Query: 343  RQLIKNLESS--DRRVVVTTIQKLNAMISQMESYDTPKFKKLKERLAHLNVVFVVDECHR   400
            +QL +NL SS    ++VVTTIQKL+A +     +     K   E+L   ++VF+VDE HR
Sbjct: 362  KQLAQNLLSSKNNNTILVTTIQKLSAAMRSAQQESEEKGSNQFEKLRQEHIVFIVDEAHR   421

Query: 401  AVTPERQRYLTNTFRNSRWYGFTGTPIFVENKRAQLGDLAQTTEQQYGKCLHQYTVKEAI   460
            AV+ E + +     NS W+G TGTPIF  ENK+  +G  A+TT QQYG  LH  YT+K A+
Sbjct: 422  AVSDEEMKRIKKILPNSTWFGLTGTPIFEENKKQENGTFARTTSQQYGPLLHSYTIKNAM   481

Query: 461  HDKAVLGFQVEYKTTIPD--------------MPEDS------IPEEAYDHEEHMLAVLD   500
             D  AVLGFQVEY  +I +              +P+D+     +P E Y+ +EH+   +L
Sbjct: 482  DDGAVLGFQVEYHSLISEEDQEVIVTQLNKGKLPDDALQQEKLLPTELYETDEHIRTMLQ   541

Query: 501  SIINQSR--KKLGENNGIGQTFEGLLTVKSIARAQAYYDLMKKVKAGETDLVISKKVKEK   558
              I N+    KK  NG   T +LT   SIA+A+  Y  ++K++K    T L+   ++ E+
Sbjct: 542  KIENRRSVVKKEKVKNGF-PTMSAILTTHSIAQAKHIYRILKEMKDNGT-LLNGRQFDER   599

Query: 559  L----PDFPKVAITYSITENDNASISRQDKMTKNLEDYNHLFGTNETIDNLQGYNRDLND   614
                 DFP+VAIT+S   +     +  D++ +++Y      F   +    D + YN+++N
Sbjct: 600  HQLIDKDFPRVAITFSTNPDQLEKNEQDDELVEIMKEYEKQFDASPYQDE-KLYNQNINK   658

Query: 615  RLARKKDKFKDRHEQLDLVIVVDRLLTGFDAPCLSTIFIDRQPMKPQHIIQAFSRTNRIF   674
            RLARK+ +++     + LD VIVVDRLLTGFD+P +  T++IDR+ M  Q ++QAFSRTNRI+
Sbjct: 659  RLARKEKQYQSDGQWLDFVIVVDRLLTGFDSPTIQTLYIDRE-MNYQKLLQAFSRTNRIY   717

Query: 675  ESRKHYGQVVTFQTPLRFKEAVDKALSLYSNGGEN-DVLAP-SWEEEKARFFEKVTVLKN   732
            +  K   G +V+F+ P     +E V       L+SN +N D L P  +EE K  F E T+ K
Sbjct: 718  -TGKDSGLIVSFRKPFTMRENVRNTFRLFSNEKQNFDQLIPKEYEEVKKEFIECSTLYKQ   776

Query: 733  IVPDPDAFPTIESAQTAFLKQYAKAFQAFDKLFASVQVYSDFNETLLSEVGLSDEVIDTY   792
                D    P        A + YK +++ L + Q   DF E   SEV     E + Y
Sbjct: 777  SEADLSDNPNDLKTMIAQVSAYQKLEKSYKALRSYDQYEEDFEE--FSEV---VEQLPQY   831

Query: 793  KGTYQNVIAEIRKRRED--------DEAIPEINIDYELESVQMDDINYHYILTLIQAFVD   844
            +G  +N+  +I++  ED          ++  + EI      +L+   D ++ YI  L++A
Sbjct: 832  QGKTENIKTKIKEMIEDEGHPEEDFEKLLQEIAFSSQLNATHKDVVDSFYINQLLKAIQL   891

Query: 845  QEQEALQERLNDNPMDQYIQDLAKSNPAMADSLAELWQDIQKEPKAYEGKSIVYELDNLI   904
             E  A+++   +    + +Q   +      +D L   ++I       +      +  +I
Sbjct: 892  NEAGAVEK--FEKEIQQKDPQIUMYHTLKDQLVNTTEEI----------DVAQLKETSI   939

Query: 905  GDKIQRAIKHFADQWKADPDKLAFVATNYHSANSTKQVGMSTLKE-SLDYQAYKEKQGDS   963
            ++IQR ++ A+++    D L    YS T        L +L + ++K G+
```

```
                         -continued
Sbjct: 940  QNEIQRQLQKEAEEFGLSFDFLQSAMNEYQSDKKTIPYLTHLLDSMILSKEEFEAKTGE-   998

Query: 964  AMNKLKYKSQFERELVQFIRDQIQPLK                                     990
            K + +++    E +Q    +Q+Q  K
Sbjct: 999  ---KYRRRTKVLEERLQQNFEQLQKWK                                    1022
```

Based on this analysis, it was predicted that this GAS-specific protein and its epitopes, could be useful antigens for vaccines or diagnostics.

Example 2881

A DNA sequence (GASx1882) was identified in *S. pyogenes* <SEQ ID 8261> which encodes the amino acid sequence <SEQ ID 8262>. Analysis of this protein sequence reveals the following:

---
Possible site 39
>>> Seems to have no N-terminal signal sequence
----- Final Results -----
  bacterial cytoplasm --- Certainty = 0.3653 (Affirmative) <succ>
   bacterial membrane --- Certainty = 0.0000 (Not Clear) <succ>
    bacterial outside --- Certainty = 0.0000 (Not Clear) <succ>
---

No corresponding DNA sequence was identified in *S. agalactiae*.

The protein has homology with the following sequences in the GENPEPT database:

```
>GP:AAB53491 GB:U35629 unknown [Lactococcus lactis subsp. lactic]
Identities = 141/241 (58%), Positives = 178/241 (73%)
Query:   3  KSKQPQYRFDGFEGEWEEKELGDIVQITMGQSPSSQNYTTNPSDYILVQGNADIKNGYVF    62
            K K P+ RF GF  EWE ++LGD V+I MGQSP+S+NYT +P+DYILVQGNAD+KNG V
Sbjct:  13  KKKVPELRFKGFTDEWELRKLGDEVRIVMGQSPNSENYTDDPNDYILVQGNADMKNGRVL   72

Query:  63  PRVWTTQITKQADKGDIILSVRAPVGDVGKTNYHVIIGRGVAAIKGNEFIFQILKYLKEI   122
            PRVWTTQ+TKQA+K D+ILSVRAPVGD+GKT Y V+IGRGVAAIKGNEFIFQ L  +K
Sbjct:  73  PRVWITQVTKQAEKDDLILSVRAPVGDIGKTAYDVVIGRGVAAIKGNEFIFQNLGKMKSD  132

Query: 123  GYWKRISTGSTFDSISSSDIKYAKIQIPSLPEQEAIGELFQMVDQLIQLQDQKLATLKEQ   182
            GYW R STGSTF+SI+S+DIK A I +P++ EQ+ IG  F+ +D  I L  +KL  LKEQ
Sbjct: 133  GYWTRYSTGSTFESINSTDIKEAIISVPAIEEQDKIGSFFKQLDNTIALHQRKLDLLKEQ  192

Query: 183  KQTFLRKMFPAQGQKVPEIRLQGFKGEWEEKKLREVSTHRSGTAIEKYFDSEGEFKVISIG  243
            K+ FL+KMFP  G KVPE+R  GF  +WEE+KL +++    +G         G++   + G
Sbjct: 193  KKGFLQKMFPKNGAKVPELRFAGFADDWEERKLGDITKISIGKLDANAMVENGKYDBYTSG  253
```

Based on this analysis, it was predicted that this GAS-specific protein and its epitopes, could be useful antigens for vaccines or diagnostics.

Example 2882

A DNA sequence (GASx1883) was identified in *S. pyogenes* <SEQ ID 8263> which encodes the amino acid sequence <SEQ ID 8264>. Analysis of this protein sequence reveals the following:

---
Possible site: 61
>>> Seems to have no N-terminal signal sequence
----- Final Results -----
  bacterial cytoplasm --- Certainty = 0.4318 (Affirmative) <succ>
   bacterial membrane --- Certainty = 0.0000 (Not Clear) <succ>
    bacterial outside --- Certainty = 0.0000 (Not Clear) <succ>
---

No corresponding DNA sequence was identified in *S. agalactiae*.

The protein has homology with the following sequences in the GENPEPT database:

```
>GP:AAF04357 GB:AF177167 type IC modification subunit [Streptococcus thermophilus]
Identities = 293/523 (56%), Positives = 377/523 (72%), Gaps = 6/523 (1%)
Query:   6  TSLRQALWHSADQLRGQMDANDYKNYLLGLIFYKHLSDKLLLAVCDNLEKHFNTFTEAQK    65
            TSL Q LW SAD LRG+MDA++YKNYLLGLIFYK+LSDK L  V +     +TF E
Sbjct:   3  TSLNQQLWASADILRGKMDASEYKNYLLGLIFYKYLSDKQLREVYEQENGKTDTFPERST   62

Query:  66  I---FEDAYQDEGLKDDLISVVTGDLGYFIEPTLTFEKLIQDVYHNTFQLESLAQGFRDI   122
              +   F + Y+++  KDDLI +       GYFI+P  F          + F L  L GF ++
Sbjct:  63  LYAGFMEWYEED--KDDLIENIQPRQGYFIQPDRLFYHRIKADNYEFNLTDLQAGFNEL   120
```

-continued

```
Query:  123  EQSGEDFENLFEDIDLYSKKLGSTPQKQNQTISNVMKTLNEIDFEAVDGDTLGDAYEYLI   182
             E+ GE+F  LF DIDL S KLGS  Q++N TI+ V++ L+EID    +GD +GDAYEYLI
Sbjct:  121  ERQGEEFSGLFSDIDLNSTKLGSNAQQRNVTITEVLRALDEIDLFEHNGDVIGDAYEYLI   180

Query:  183  GEFASESGKKAGEFYTPQAVSHLMTQIVFLGREDQKGMTLYDPAMGSGSLLLNAKKYSNQ   242
             G FA++GKKAGEFYTPQAVS +M++3OI +G+E ++YDPAMGSGSL+LN ++Y
Sbjct:  181  GMFAAGAGKKAGEFYTPQAVBRIMSEITSIGQESRVPFHIYDPAMGSGSLMLNIRRYLIH   240

Query:  243  SDTVSYYGQEINTSTYNLARMEMMLHGVAIENQHLSNADTLDADWPTDEPINFDGVLMNP   302
             + V Y+GQE+NT+T+NLARMN++LHGV  E  +L+N DTLDADWP++EP  FD V+MNP
Sbjct:  241  PNQVHYHGQELNTTTFNLARMNLILHGVDKERMNLNNGDTLDADWPSEEPYQFDSVVMNP   300

Query:  303  PYSLKWSATAGFLTDPRFSSYGVLAPKSKADFAFLLHGFYHLKNTGTMAIVLPHGVLFRG   362
             PYS KWSA    FL+DPRF  +G LAPKSKADFAFLLHGFYHLK +GTM IVLPHGVLFRG
Sbjct:  301  PYSAKWSAADKFLSDPRFERFGKLAPKSKADFAFLLHGFYHLKESGTMGIVLPHGVLFRG   360

Query:  363  AAEGKIRQKLLEQGAIDTIIGLPSNIFYNTSIPTTIIILKKNRTNKDVFFIDASKEFDKG   422
             AEG IRQ LLE GAID +IGLP+NIF+ TSIPTT+IILKKNR+ +DV FIDAS++F+K
Sbjct:  361  GAEGTIRQALLEMGAIDAVIGLPANIFFGTSIPTTVIILKKNRSRRDVLFIDASQDFEKQ   420

Query:  423  KNQNTMTDNHIKKILDAYKSRDNSDKFSYLASFDEIIENDYNLNIPRYVDTFEEVPVKPL   482
             KNQN + D HI KI+   YK R++ ++++++ASFDEI END+NLNIPRYVDTFEE     L
Sbjct:  421  KNQNVLLDEHIDKIVSTYKKREDIERYAHVASFDEIQENDFNLNIPRYVDTFEEEEPVDL   480

Query:  483  PELAKQLSDIDQEIAKTNAKLDQLMKQLVGTTKEAQDELDTFR                   525
             E+    L  I++E+ +    L  L+        ++E Q  +++ R
Sbjct:  481  VEVNTNLLKINEELVQQEQTLLSLINDF-SESEENQAMIESMR                   522
```

Based on this analysis, it was predicted that this GAS-specific protein and its epitopes, could be useful antigens for vaccines or diagnostics.

Based on this analysis, it was predicted that this GAS-specific protein and its epitopes, could be useful antigens for vaccines or diagnostics.

Example 2883

A DNA sequence (GASx1886R) was identified in *S. pyogenes* <SEQ ID 8265> which encodes the amino acid sequence <SEQ ID 8266>. Analysis of this protein sequence reveals the following:

Example 2884

A DNA sequence (GASx1890R) was identified in *S. pyogenes* <SEQ ID 8267> which encodes the amino acid sequence <SEQ ID 8268>. Analysis of this protein sequence reveals the following:

Possible site: 59
>>> Seems to have an uncleavable N-term signal seq
INTEGRAL    Likelihood = −8.17    Transmembrane 155-171 (147-173)
INTEGRAL    Likelihood = −7.22    Transmembrane 14-30 (11-33)
INTEGRAL    Likelihood = −7.17    Transmembrane 182-198 (179-205)
INTEGRAL    Likelihood = −5.68    Transmembrane 132-148 (128-152)
INTEGRAL    Likelihood = −4.14    Transmembrane 46-62 (43-62)
INTEGRAL    Likelihood = −3.50    Transmembrane 73-89 (73-90)
INTEGRAL    Likelihood = −0.96    Transmembrane 95-111 (95-111)
----- Final Results -----
  bacterial membrane --- Certainty = 0.4270 (Affirmative) <succ>
  bacterial outside --- Certainty = 0.0000 (Not Clear) <succ>
  bacterial cytoplasm --- Certainty = 0.0000 (Not Clear) <succ>

Possible site: 58
>>> Seems to have no N-terminal signal sequence
----- Final Results -----
  bacterial cytoplasm --- Certainty = 0.4757 (Affirmative) <succ>
  bacterial membrane --- Certainty = 0.0000 (Not Clear) <succ>
  bacterial outside --- Certainty = 0.0000 (Not Clear) <succ>

RGD motif 339-341

No corresponding DNA sequence was identified in *S. agalactiae*.

The protein has no significant homology with any sequences in the GENPEPT database.

No corresponding DNA sequence was identified in *S. agalactiae*.

The protein has homology with the following sequences in the GENPEPT database:

```
>GP:AAA62650 GB:L37110 clyM [Plasmid pAD1] PositivesIdentities = 127/492
  (25%), = 230/492 (45%), Gaps = 30/492 (6%)
Query:   46  KLFYSEFENQLFETIMFLSMKTLVLDINHFSKEIENK----SEAYEQYIQQ-IREENGIN   100
             K F       L + ++ L+ KTLVLD++ F K     K     S+ +  Y+++    + I
Sbjct:  135  KEFIINLLENLTQELIHLTSKTLVLDLHTFKKNEPLKGNDSSKRFIYYLKKRFNSKKDII   194

Query:  101  HFFDRYPYLLKQINKEVGLIEESYSLLFDRFLEDLSEIKSCFNI-SEPLSNVAFSLGDSH   159
             F+    YP L++       +     ++    R   EDL I++CFNI S   L++++ S GDSH
Sbjct:  195  AFYTCYPELMRITVVRMRYFLDNTKQMLIRVTEDLPSIQNCFNIQSSELNSISESQGDSH   254

Query:  160  SKKQTVVKIAFKE-KSVYYKPKSYHSHSILLELTSLLKSSNIPSFSLPKSLVKADYCWQL   218
             S+ +TV   + F + K  YKPK  +S + L  +       L          + K + +   Y ++
Sbjct:  255  SRGKTVSTLTFSDGKKIVYKPK-INSENKLRDFFEFLNKELEADIYIVKKVTRNTYFYEE   313
```

-continued

```
Query: 219  GVAYTSSNK-DEVAKIYFKYGVLAAFSEIFSITDLHMENVIVSGGDLYLIDVETFFQRKL   277
              +    N  +EV K Y +YG L   + +F++TDLH EN+I  G    +ID ETFFQ+ +
Sbjct: 314  YIDNIEINNIEEVKKYYERYGKLIGIAFLFNVTDLNYENIIABGEYPVIIDNETFFOONI   373

Query: 278  NVQNQNFEGITVDTYQRIYETSLSNGLFP---VQFEKNSAPNVSGISRKGGKRQKGKYEL   334
              ++  N     TVD    +  ++ +   GL P    ++ + +S       +S    K Q    +++
Sbjct: 374  PIEFGN--SATVDAKYKYLDSIMVTGLVPYLAMKDKSDSKDEGVNLSALNFKEQSVPFKI   431

Query: 335  I---NKNRGDLKLVKVDYFQEDRFNIPTLNGKVVEPLDYANEIISGFRECYIFLLSQRSK   391
             +    N     +++      +  +   N P +N + +   + Y    I++G       +     + K
Sbjct: 432  LKIKNTFTDEMRFEYQTHIMDTAKNTPIMNNEKISFISYEKYIVTGMKSILMKAKDSKKK   491

Query: 392  IKEIV-EGFPELKSRVPFRNTSDYGKFLQASTNPKYLFS----EKKRKNLFSILYETKHI   446
             I    +         L  R    R T   Y    L+ S +P     +     EK    N+++    Y+  K +
Sbjct: 492  ILAYINNNLQNLIVRNVIRPTQRYADMLEFSYHPNCFSNAIEREKVLHNMWAYPYKNKKV   551

Query: 447  EHFIVDNEIKDLMNGDIP-YFSMDTRGNVYNSVGTLIGNLGDTTSL---FDSITILNDER   502
              H+     E  DL++GDIP +++  ++ ++   S G L+ +      ++L      + I   L DE
Sbjct: 552  VHY----EFSDLIDGDIPIFYNNISKTSLIASDGCLVEDFYQESALNRCLNKINDLCDED   607

Query: 503  LKFTCELLEIVL                                                  514
             +       LEI L
Sbjct: 608  ISIQTVWLEIAL                                                  619
```

Based on this analysis, it was predicted that this GAS-specific protein and its epitopes, could be useful antigens for vaccines or diagnostics.

Example 2885

A DNA sequence (GASx1891R) was identified in *S. pyogenes* <SEQ ID 8269> which encodes the amino acid sequence <SEQ ID 8270>. Analysis of this protein sequence reveals the following:

```
Possible site: 40
>>> Seems to have no N-terminal signal sequence
----- Final Results -----
   bacterial cytoplasm --- Certainty = 0.3487 (Affirmative) <succ>
     bacterial membrane --- Certainty = 0.0000 (Not Clear) <succ>
       bacterial outside --- Certainty = 0.0000 (Not Clear) <succ>
```

No corresponding DNA sequence was identified in *S. agalactiae*.

The protein has homology with the following sequences in the GENPEPT database:

```
>GP:AAA02867 GB:L07740 salivaricin A [Streptococcus salivarius]
Identities = 46/51 (90%), Positives = 48/51 (93%)
Query: 1  MSFMKNSKDILTNAIEEVSEKELMEVAGGKKGSGWFATITDDCPNSVFVCC   51
           M+ MKNSKDIL NAIEEVSEKELMEVAGGK+GSGW ATITDDCPNSVFVCC
Sbjct: 1  MNAMKNSKDILNNAIEEVSEKELMEVAGGKRGSGWIATITDDCPNSVFVCC   51
```

Based on this analysis, it was predicted that this GAS-specific protein and its epitopes, could be useful antigens for vaccines or diagnostics.

Example 2886

A DNA sequence (GASx1901R) was identified in *S. pyogenes* <SEQ ID 8271> which encodes the amino acid sequence <SEQ ID 8272>. Analysis of this protein sequence reveals the following:

```
Possible site: 13
>>> Seems to have no N-terminal signal sequence
INTEGRAL      Likelihood = -1.59      Transmembrane 3-19 (1-20)
----- Final Results -----
   bacterial membrane --- Certainty = 0.1638 (Affirmative) <succ>
     bacterial outside --- Certainty = 0.0000 (Not Clear) <succ>
       bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2887

A DNA sequence (GASx1905R) was identified in *S. pyogenes* <SEQ ID 8273> which encodes the amino acid sequence <SEQ ID 8274>. Analysis of this protein sequence reveals the following:

```
Possible site: 25
>>> Seems to have an uncleavable N-term signal seq
INTEGRAL      Likelihood = -0.48      Transmembrane 38-54 (37-54)
----- Final Results -----
   bacterial membrane --- Certainty = 0.1192 (Affirmative) <succ>
     bacterial outside --- Certainty = 0.0000 (Not Clear) <succ>
       bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2888

A DNA sequence (GASx1911R) was identified in *S. pyogenes* <SEQ ID 8275> which encodes the amino acid sequence <SEQ ID 8276>. Analysis of this protein sequence reveals the following:

```
Possible site: 30
>>> Seems to have no N-terminal signal sequence
INTEGRAL    Likelihood = -10.40   Transmembrane 27-43 (22-48)
INTEGRAL    Likelihood = -9.82    Transmembrane 52-68 (50-74)
INTEGRAL    Likelihood = -7.27    Transmembrane 113-129 (111-134)
INTEGRAL    Likelihood = -1.97    Transmembrane 137-153 (135-153)
----- Final Results -----
  bacterial membrane --- Certainty = 0.5161 (Affirmative) <succ>
     bacterial outside --- Certainty = 0.0000 (Not Clear) <succ>
        bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2889

A DNA sequence (GASx1915R) was identified in *S. pyogenes* <SEQ ID 8277> which encodes the amino acid sequence <SEQ ID 8278>. Analysis of this protein sequence reveals the following:

```
Possible site: 31
>>> Seems to have a cleavable N-term signal seq.
INTEGRAL     Likelihood = -10.77   Transmembrane 242-258 (238-262)
----- Final Results -----
  bacterial membrane --- Certainty = 0.5310 (Affirmative) <succ>
     bacterial outside --- Certainty = 0.0000 (Not Clear) <succ>
        bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2890

A DNA sequence (GASx1918R) was identified in *S. pyogenes* <SEQ ID 8279> which encodes the amino acid sequence <SEQ ID 8280>. Analysis of this protein sequence reveals the following:

```
Possible site: 38
>>> Seems to have a cleavable N-term signal seq.
INTEGRAL     Likelihood = -7.32    Transmembrane 40-56 (39-60)
----- Final Results -----
  bacterial membrane --- Certainty = 0.3930 (Affirmative) <succ>
     bacterial outside --- Certainty = 0.0000 (Not Clear) <succ>
        bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2891

A DNA sequence (GASx1923R) was identified in *S. pyogenes* <SEQ ID 8281> which encodes the amino acid sequence <SEQ ID 8282>. Analysis of this protein sequence reveals the following:

```
Possible site: 42
>>> Seems to have an uncleavable N-term signal seq
INTEGRAL     Likelihood = -12.26   Transmembrane 20-36 (13-42)
----- Final Results -----
  bacterial membrane --- Certainty = 0.5904 (Affirmative) <succ>
     bacterial outside --- Certainty = 0.0000 (Not Clear) <succ>
        bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2892

A DNA sequence (GASx1926) was identified in *S. pyogenes* <SEQ ID 8283> which encodes the amino acid sequence <SEQ ID 8284>. Analysis of this protein sequence reveals the following:

```
Possible site: 24
>>> Seems to have no N-terminal signal sequence
----- Final Results -----
  bacterial cytoplasm --- Certainty = 0.2322 (Affirmative) <succ>
     bacterial membrane --- Certainty = 0.0000 (Not Clear) <succ>
        bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2893

A DNA sequence (GASx1928R) was identified in *S. pyogenes* <SEQ ID 8285> which encodes the amino acid sequence <SEQ ID 8286>. Analysis of this protein sequence reveals the following:

```
Possible site: 13
>>> Seems to have no N-terminal signal sequence
----- Final Results -----
    bacterial cytoplasm --- Certainty = 0.3395 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2894

A DNA sequence (GASx1929R) was identified in S. pyogenes <SEQ ID 8287> which encodes the amino acid sequence <SEQ ID 8288>. Analysis of this protein sequence reveals the following:

```
Possible site: 16
>>> Seems to have an uncleavable N-term signal seq
INTEGRAL    Likelihood = −1.86    Transmembrane 17-33 (15-33)
----- Final Results -----
    bacterial membrane --- Certainty = 0.1744 (Affirmative) <succ>
    bacterial outside --- Certainty = 0.0000 (Not Clear) <succ>
    bacterial cytoplasm --- Certainty = 0.0000 (Not Clear) <succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2895

A DNA sequence (GASx1931R) was identified in S. pyogenes <SEQ ID 8289> which encodes the amino acid sequence <SEQ ID 8290>. Analysis of this protein sequence reveals the following:

```
Possible site: 31
>>> Seems to have no N-terminal signal sequence
----- Final Results -----
    bacterial cytoplasm --- Certainty = 0.0551 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2896

A DNA sequence (GASx1941R) was identified in S. pyogenes <SEQ ID 8291> which encodes the amino acid sequence <SEQ ID 8292>. Analysis of this protein sequence reveals the following:

```
Possible site: 16
>>> Seems to have no N-terminal signal sequence
----- Final Results -----
    bacterial cytoplasm --- Certainty = 0.2377 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2897

A DNA sequence (GASx1949) was identified in S. pyogenes <SEQ ID 8293> which encodes the amino acid sequence <SEQ ID 8294>. Analysis of this protein sequence reveals the following:

```
Possible site: 29
>>> Seems to have no N-terminal signal sequence
----- Final Results -----
    bacterial cytoplasm --- Certainty = 0.0262 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2898

A DNA sequence (GASx1951R) was identified in S. pyogenes <SEQ ID 8295> which encodes the amino acid sequence <SEQ ID 8296>. Analysis of this protein sequence reveals the following:

```
Possible site: 45
>>> Seems to have no N-terminal signal sequence
----- Final Results -----
    bacterial cytoplasm --- Certainty = 0.1330 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2899

A DNA sequence (GASx1953) was identified in S. pyogenes <SEQ ID 8297> which encodes the amino acid sequence <SEQ ID 8298>. Analysis of this protein sequence reveals the following:

```
Possible site: 15
>>> Seems to have a cleavable N-term signal seq.
----- Final Results -----
    bacterial outside --- Certainty = 0.3000 (Affirmative) <succ>
      bacterial membrane --- Certainty = 0.0000 (Not Clear) <succ>
        bacterial cytoplasm --- Certainty = 0.0000 (Not Clear) <succ>
```

No corresponding DNA sequence was identified in *S. agalactiae*.

Based on this analysis, it was predicted that this GAS-specific protein and its epitopes, could be useful antigens for vaccines or diagnostics.

Example 2900

A DNA sequence (GASx1957) was identified in *S. pyogenes* <SEQ ID 8299> which encodes the amino acid sequence <SEQ ID 8300>. Analysis of this protein sequence reveals the following:

```
Possible site: 26
>>> Seems to have no N-terminal signal sequence
----- Final Results -----
    bacterial cytoplasm --- Certainty = 0.2409 (Affirmative) <succ>
      bacterial membrane --- Certainty = 0.0000 (Not Clear) <succ>
        bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2901

A DNA sequence (GASx1969) was identified in *S. pyogenes* <SEQ ID 8301> which encodes the amino acid sequence <SEQ ID 8302>. Analysis of this protein sequence reveals the following:

```
Possible site: 14
>>> Seems to have an uncleavable N-term signal seq
INTEGRAL    Likelihood = -2.28    Transmembrane 7-23 (7-23)
----- Final Results -----
    bacterial membrane --- Certainty = 0.1914 (Affirmative) <succ>
      bacterial outside --- Certainty = 0.0000 (Not Clear) <succ>
        bacterial cytoplasm --- Certainty = 0.0000 (Not Clear) <succ>
```

No corresponding DNA sequence was identified in *S. agalactiae*.

Based on this analysis, it was predicted that this GAS-specific protein and its epitopes, could be useful antigens for vaccines or diagnostics.

Example 2902

A DNA sequence (GASx1971R) was identified in *S. pyogenes* <SEQ ID 8303> which encodes the amino acid sequence <SEQ ID 8304>. Analysis of this protein sequence reveals the following:

```
Possible site: 21
>>> Seems to have no N-terminal signal sequence
----- Final Results -----
    bacterial cytoplasm --- Certainty = 0.1545 (Affirmative) <succ>
      bacterial membrane --- Certainty = 0.0000 (Not Clear) <succ>
        bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2903

A DNA sequence (GASx1973) was identified in *S. pyogenes* <SEQ ID 8305> which encodes the amino acid sequence <SEQ ID 8306>. Analysis of this protein sequence reveals the following:

```
Possible site: 49
>>> Seems to have no N-terminal signal sequence
INTEGRAL    Likelihood = -2.44    Transmembrane 31-47 (31-48)
----- Final Results -----
    bacterial membrane --- Certainty = 0.1977 (Affirmative) <succ>
      bacterial outside --- Certainty = 0.0000 (Not Clear) <succ>
        bacterial cytoplasm --- Certainty = 0.0000 (Not Clear) <succ>
```

No corresponding DNA sequence was identified in *S. agalactiae*.

The protein has homology with the following sequences in the GENPEPT database:

```
>GP:CAB51744 GB:AJ245405 speX [Streptococcus pyogenes]
Identities = 236/256 (92%), Positives = 243/256 (94%)
Query:     3 MIISFESVILKHNKIITPEKRLFMKKTKLIFSFTSIFIAIISRPVFGLEVDNNSLLRNIY    62
             MIISFESVILKHNKIITPEKRLFMKKTKLIFSFTSIFIAIISRPVFGLEVDNNSLLRNIY
Sbjct:     1 MIISFESVILKHNKIITPEKRLFMKKTKLIFSFTSIFIAIISRPVFGLEVDNNSLLRNIY    60

Query:    63 STIVYEYSDTVIDFKTSHNLVTKKLDVRDARDFFINSEMDEYAANDFKDGDKIAMFSVPF   122
             STIVYEYSD VIDFKTSHNLVTKKLDVRDARDFFINSEMDEYAANDFK GDKIA+FSVPF
Sbjct:    61 STIVYEYSDIVIDFKTSHNLVTKKLDVRDARDFFINSEMDEYAANDFKTGDKIAVFSVPF   120

Query:   123 DWNYLSEGKVIAYTYGGMTPYQEEPMSKNIPVNLWINRKQIPVPYNQISTNKTTVTAQEI   182
             DWNYLS+GKV AYTYGG+TPYQ+   K   VNLWIN KQI VPYN+ISTNKTTVTAQEI
Sbjct:   121 DWNYLSKGKVTAYTYGGITPYQKLQYLKISLVNLWINGKQISVPYNEISTNKTTVTAQEI   180
```

-continued

```
Query: 183 DLKVRKFLISQHQLYSSGSSYKSGKLVFHTNDNSDKYSLDLFYVGYRDKESIFKVYKDNK  242
           DLKVRKFLI+QHQLYSSGSSYKSG+LVFHTNDNSDKYS DLFYVGYRDKESIFKVYKDNK
Sbjct: 181 DLKVRKFLIAQHQLYSSGSSYKSGRLVFHTNDNSDKYSFDLFYVGYRDKESIFKVYKDNK  240

Query: 243 SFNIDKIGHLDIEIDS                                              258
           SFNIDKIGHLDIEIDS
Sbjct: 241 SFNIDKIGHLDIEIDS                                              256
```

Based on this analysis, it was predicted that this GAS-specific protein and its epitopes, could be useful antigens for vaccines or diagnostics.

Example 2904

A DNA sequence (GASx1974R) was identified in *S. pyogenes* <SEQ ID 8307> which encodes the amino acid sequence <SEQ ID 8308>. Analysis of this protein sequence reveals the following:

---

Possible site: 53
>>> Seems to have no N-terminal signal sequence
----- Final Results -----
   bacterial cytoplasm --- Certainty = 0.2022 (Affirmative) <succ>
     bacterial membrane --- Certainty = 0.0000 (Not Clear) <succ>
     bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2905

A DNA sequence (GASx1983) was identified in *S. pyogenes* <SEQ ID 8309> which encodes the amino acid sequence <SEQ ID 8310>. Analysis of this protein sequence reveals the following:

---

Possible site: 14
>>> Seems to have no N-terminal signal sequence
----- Final Results -----
   bacterial cytoplasm --- Certainty = 0.0989 (Affirmative) <succ>
     bacterial membrane --- Certainty = 0.0000 (Not Clear) <succ>
     bacterial outside --- Certainty = 0.0000 (Not Clear) <succ>

---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2906

A DNA sequence (GASx1987) was identified in *S. pyogenes* <SEQ ID 8311> which encodes the amino acid sequence <SEQ ID 8312>. Analysis of this protein sequence reveals the following:

---

Possible site: 34
>>> Seems to have no N-terminal signal sequence
----- Final Results -----
   bacterial cytoplasm --- Certainty = 0.2389 (Affirmative) <succ>
     bacterial membrane --- Certainty = 0.0000 (Not Clear) <succ>
     bacterial outside --- Certainty = 0.0000 (Not Clear) <succ>

---

No corresponding DNA sequence was identified in *S. agalactiae*.

Based on this analysis, it was predicted that this GAS-specific protein and its epitopes, could be useful antigens for vaccines or diagnostics.

Example 2907

A DNA sequence (GASx1988) was identified in *S. pyogenes* <SEQ ID 8313> which encodes the amino acid sequence <SEQ ID 8314>. Analysis of this protein sequence reveals the following:

---

Possible site: 48
>>> Seems to have no N-terminal signal sequence
----- Final Results -----
   bacterial cytoplasm --- Certainty = 0.5904 (Affirmative) <succ>
     bacterial membrane --- Certainty = 0.0000 (Not Clear) <succ>
     bacterial outside --- Certainty = 0.0000 (Not Clear) <succ>

---

No corresponding DNA sequence was identified in *S. agalactiae*.

The protein has homology with the following sequences in the GENPEPT database:

```
>GP:BAB16031 GB:AB030747 transposase [Streptococcus pyogenes]

Identities = 22/24 (91%), Positives = 23/24 (95%)
Query:   1 LERLFGTAKEYHNLCYTREKGKSK                                    24
           +ERLFGTAKEYHNL YTREKGKSK
Sbjct: 399 IERLFGTAKEYHNLRYTREKGKSK                                   422
```

Example 2908

A DNA sequence (GASx1990R) was identified in *S. pyogenes* <SEQ ID 8315> which encodes the amino acid sequence <SEQ ID 8316>. Analysis of this protein sequence reveals the following:

Possible site: 32
>>> Seems to have a cleavable N-term signal seq.
----- Final Results -----
bacterial outside --- Certainty = 0.3000 (Affirmative) <succ>
bacterial membrane --- Certainty = 0.0000 (Not Clear) <succ>
bacterial cytoplasm --- Certainty = 0.0000 (Not Clear) <succ>

No corresponding DNA sequence was identified in *S. agalactiae*.

Based on this analysis, it was predicted that this GAS-specific protein and its epitopes, could be useful antigens for vaccines or diagnostics.

Example 2909

A DNA sequence (GASx1991) was identified in *S. pyogenes* <SEQ ID 8317> which encodes the amino acid sequence <SEQ ID 8318>. Analysis of this protein sequence reveals the following:

Possible site: 53
>>> Seems to have an uncleavable N-term signal seq
INTEGRAL    Likelihood = –0.16    Transmembrane 2-18 (1-18)
----- Final Results -----
bacterial membrane --- Certainty = 0.1065 (Affirmative) <succ>
bacterial outside --- Certainty = 0.0000 (Not Clear) <succ>
bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2910

A DNA sequence (GASx1994) was identified in *S. pyogenes* <SEQ ID 8319> which encodes the amino acid sequence <SEQ ID 8320>. Analysis of this protein sequence reveals the following:

Possible site: 40
>>> Seems to have no N-terminal signal sequence
INTEGRAL    Likelihood = –1.44    Transmembrane 28-44 (28-44)
----- Final Results -----
bacterial membrane --- Certainty = 0.1574 (Affirmative) <succ>
bacterial outside --- Certainty = 0.0000 (Not Clear) <succ>
bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2911

A DNA sequence (GASx1996) was identified in *S. pyogenes* <SEQ ID 8321> which encodes the amino acid sequence <SEQ ID 8322>. Analysis of this protein sequence reveals the following:

Possible site: 13
>>> Seems to have no N-terminal signal sequence
----- Final Results -----
bacterial cytoplasm --- Certainty = 0.1076 (Affirmative) <succ>
bacterial membrane --- Certainty = 0.0000 (Not Clear) <succ>
bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2912

A DNA sequence (GASx1997R) was identified in *S. pyogenes* <SEQ ID 8323> which encodes the amino acid sequence <SEQ ID 8324>. Analysis of this protein sequence reveals the following:

Possible site: 61
>>> Seems to have no N-terminal signal sequence
INTEGRAL    Likelihood = –7.96    Transmembrane 53-69 (49-75)
INTEGRAL    Likelihood = –2.34    Transmembrane 24-40 (24-43)
----- Final Results -----
bacterial membrane --- Certainty = 0.4185 (Affirmative) <succ>
bacterial outside --- Certainty = 0.0000 (Not Clear) <succ>
bacterial cytoplasm --- Certainty = 0.0000 (Not Clear) <succ>

No corresponding DNA sequence was identified in *S. agalactiae*.

Based on this analysis, it was predicted that this GAS-specific protein and its epitopes, could be useful antigens for vaccines or diagnostics.

Example 2913

A DNA sequence (GASx2007R) was identified in *S. pyogenes* <SEQ ID 8325> which encodes the amino acid sequence <SEQ ID 8326>. Analysis of this protein sequence reveals the following:

Possible site: 55
>>> Seems to have no N-terminal signal sequence
INTEGRAL    Likelihood = –6.64    Transmembrane 46-62 (43-65)
----- Final Results -----
bacterial membrane --- Certainty = 0.3654 (Affirmative) <succ> bacterial outside --- Certainty = 0.0000 (Not Clear) <succ>
bacterial cytoplasm --- Certainty = 0.0000 (Not Clear) <succ>

No corresponding DNA sequence was identified in *S. agalactiae*.

The protein has homology with the following sequences in the GENPEPT database:

```
>GP:AAB97959 GB:U96166 ATP-binding cassette lipoprotein [Streptococcus
cristatus] Identities = 37/60 (61%), Positives = 42/60 (69%), Gaps = 1/60 (1%)
Query: 59    FLTACGTKKDSKKEEVKEIKMSDIKDDAVSKKTKVVDGEEVTEYTTKDGNVIQIPAGNEE   118
             FL ACG+K    KE + + K   D K DAV +KTK VDG+EVTEYT  DGNVIQIPA  EE
Sbjct: 12    FLAACGSKNADNKE-ISDGKKVDFKKDAVDQKTKTVDGKEVTEYTMPDGNVIQIPADGEE   70
```

Based on this analysis, it was predicted that this GAS-specific protein and its epitopes, could be useful antigens for vaccines or diagnostics.

Example 2914

A DNA sequence (GASx2009) was identified in *S. pyogenes* <SEQ ID 8327> which encodes the amino acid sequence <SEQ ID 8328>. Analysis of this protein sequence reveals the following:

Possible site: 41
>>> Seems to have no N-terminal signal sequence
----- Final Results -----
bacterial cytoplasm --- Certainty = 0.1246 (Affirmative) <succ>
bacterial membrane --- Certainty = 0.0000 (Not Clear) <succ>
bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2915

A DNA sequence (GASx2010) was identified in *S. pyogenes* <SEQ ID 8329> which encodes the amino acid sequence <SEQ ID 8330>. Analysis of this protein sequence reveals the following:

Possible site: 17
>>> Seems to have no N-terminal signal sequence

----- Final Results -----
bacterial cytoplasm --- Certainty = 0.2549 (Affirmative) <succ>
bacterial membrane --- Certainty = 0.0000 (Not Clear) <succ>
bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2916

A DNA sequence (GASx2012R) was identified in *S. pyogenes* <SEQ ID 8331> which encodes the amino acid sequence <SEQ ID 8332>. Analysis of this protein sequence reveals the following:

Possible site:28
>>> Seems to have no N-terminal signal sequence
----- Final Results -----
bacterial cytoplasm --- Certainty = 0.3307 (Affirmative) <succ>
bacterial membrane --- Certainty = 0.0000 (Not Clear) <succ>
bacterial outside --- Certainty = 0.0000 (Not Clear) <succ>

No corresponding DNA sequence was identified in *S. agalactiae*.

The protein has homology with the following sequences in the GENPEPT database:

```
>GP:AAA27007 GB:L26141 pyrogenic exotoxin B [Streptococcus pyogenes]
Identities = 40/102 (39%), Positives = 57/102 (55%), Gaps = 7/102 (6%)
Query:  2    EMHFVRTEPEARRIAETFCAENTQTKTPMRVQQLSYPSDTDHSGGEL-----YIYALSPA   56
             + +F R E EA+   A TF ++    K   R +      D  + GGEL     YIY +S
Sbjct: 28    DQNFARNEKEAKDSAITFIQKSAAIKAGARSAE-DIKLDKVNLGGELSGSNMYIYNISTG   86

Query: 57    GFIIVSGDTRAHTILGYSFDNNLDLN-HDNVRSMIEAYQKQI                    97
             GF+IVSGD R+   ILGYS   + D+N   +N+ S +E+Y +QI
Sbjct: 87    GFVIVSGDKRSPEILGYSTSGSFDVNGKENIASFMESYVEQI                    128
```

Based on this analysis, it was predicted that this GAS-specific protein and its epitopes, could be useful antigens for vaccines or diagnostics.

Example 2917

A DNA sequence (GASx2013R) was identified in *S. pyogenes* <SEQ ID 8333> which encodes the amino acid sequence <SEQ ID 8334>. Analysis of this protein sequence reveals the following:

Possible site: 22
>>> Seems to have a cleavable N-term signal seq.

-continued

```
----- Final Results -----
    bacterial outside --- Certainty = 0.3000 (Affirmative) <succ>
      bacterial membrane --- Certainty = 0.0000 (Not Clear) <succ>
        bacterial cytoplasm --- Certainty = 0.0000 (Not Clear) <succ>
```

No corresponding DNA sequence was identified in *S. agalactiae*.

Based on this analysis, it was predicted that this GAS-specific protein and its epitopes, could be useful antigens for vaccines or diagnostics.

Example 2918

A DNA sequence (GASx2014R) was identified in *S. pyogenes* <SEQ ID 8335> which encodes the amino acid sequence <SEQ ID 8336>. Analysis of this protein sequence reveals the following:

```
Possible site: 44
>>> Seems to have no N-terminal signal sequence
----- Final Results -----
    bacterial cytoplasm --- Certainty = 0.1392 (Affirmative) <succ>
      bacterial membrane --- Certainty = 0.0000 (Not Clear) <succ>
        bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2919

A DNA sequence (GASx2015) was identified in *S. pyogenes* <SEQ ID 8337> which encodes the amino acid sequence <SEQ ID 8338>. Analysis of this protein sequence reveals the following:

```
Possible site: 35
>>> Seems to have an uncleavable N-term signal seq
INTEGRAL    Likelihood = −1.75    Transmembrane 18-34 (17-37)
----- Final Results -----
    bacterial membrane --- Certainty = 0.1702 (Affirmative) <succ>
      bacterial outside --- Certainty = 0.0000 (Not Clear) <succ>
        bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2920

A DNA sequence (GASx2018) was identified in *S. pyogenes* <SEQ ID 8339> which encodes the amino acid sequence <SEQ ID 8340>. Analysis of this protein sequence reveals the following:

```
Possible site: 29
>>> Seems to have no N-terminal signal sequence
INTEGRAL    Likelihood = −5.84    Transmembrane 23-39 (22-40)
----- Final Results -----
    bacterial membrane --- Certainty = 0.3336 (Affirmative) <succ>
      bacterial outside --- Certainty = 0.0000 (Not Clear) <succ>
        bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2921

A DNA sequence (GASx2019) was identified in *S. pyogenes* <SEQ ID 8341> which encodes the amino acid sequence <SEQ ID 8342>. Analysis of this protein sequence reveals the following:

```
Possible site: 26
>>> Seems to have no N-terminal signal sequence
----- Final Results -----
    bacterial cytoplasm --- Certainty = 0.0669 (Affirmative) <succ>
      bacterial membrane --- Certainty = 0.0000 (Not Clear) <succ>
        bacterial outside --- Certainty = 0.0000 (Not Clear) <succ>
```

No corresponding DNA sequence was identified in *S. agalactiae*.

The protein has homology with the following sequences in the GENPEPT database:

```
>GP:AAC98898 GB:AF023179 low temperature requirement C protein
[Listeria monocytogenes]Identities = 95/144 (65%), Positives = 117/144 (80%)
    Query:   15  LAERGVSLEAIAELVLFLQNDYIPNLTMAECLESVEAVLAKREVQNAIITGVELDKLAEA   74
                 L ERGV ++ IAELVLFLQ  Y P L +  C ++VE VL KREVQNA++TG++LD +AE
    Sbjct:   16  LIERGVEIDDIAELVLFLQQKYHPGLELDICRQNVEHVLRKREVQNAVLTGIQLDVMAEK   75

Query:   75  NQLSEPLLSILKTDQGLYGIDEILALSIVNLYGSIGFTNYGYLDKTKPGIVDKLNHKDGY   134
                 +L +PL +I+   D+GLYG+DEILALSIVN+YGSIGFTNYGY+DK KPGI+ KLN  DG
    Sbjct:   76  GELVQPLQNIISADEGLYGVDEILALSIVNVYGSIGFTNYGYIDKVKPGILAKLNEHDGI  135

Query:  135  SCHTFLDDIVSAIAAAAASRIAHN                                      158
                 + HTFLDDIV AIAAAAASR+AH+
    Sbjct:  136  ANHTFLDDIVGAIAAAAASRLAHS                                      159
```

Based on this analysis, it was predicted that this GAS-specific protein and its epitopes, could be useful antigens for vaccines or diagnostics.

Example 2922

A DNA sequence (GASx2030) was identified in *S. pyogenes* <SEQ ID 8343> which encodes the amino acid sequence <SEQ ID 8344>. Analysis of this protein sequence reveals the following:

Possible site: 18
>>> Seems to have no N-terminal signal sequence
----- Final Results -----
   bacterial cytoplasm --- Certainty = 0.0320 (Affirmative) <succ>
      bacterial membrane --- Certainty = 0.0000 (Not Clear) <succ>
         bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2923

A DNA sequence (GASx2031) was identified in *S. pyogenes* <SEQ ID 8345> which encodes the amino acid sequence <SEQ ID 8346>. Analysis of this protein sequence reveals the following:

Possible site: 24
>>> Seems to have no N-terminal signal sequence
----- Final Results -----
   bacterial cytoplasm --- Certainty = 0.0583 (Affirmative) <succ>
      bacterial membrane --- Certainty = 0.0000 (Not Clear) <succ>
         bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2924

A DNA sequence (GASx2032R) was identified in *S. pyogenes* <SEQ ID 8347> which encodes the amino acid sequence <SEQ ID 8348>. Analysis of this protein sequence reveals the following:

Possible site: 53
>>> Seems to have no N-terminal signal sequence
INTEGRAL   Likelihood = −2.76   Transmembrane 27-43 (26-43)
----- Final Results -----
   bacterial membrane --- Certainty = 0.2105 (Affirmative) <succ>
      bacterial outside --- Certainty = 0.0000 (Not Clear) <succ>
         bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

A related GBS gene <SEQ ID 8467> and protein <SEQ ID 8468> were also identified. Analysis of this protein sequence reveals the following:

Lipop: Possible site: −1  Crend: 10
McG: Discrim Score: −11.19
GvH: Signal Score (−7.5): −4.94
Possible site: 49
>>> Seems to have no N-terminal signal sequence
ALOM program     count: 1 value: −4.19 threshold: 0.0
INTEGRAL         Likelihood = −4.19   Transmembrane 25-41 (25-42)
PERIPHERAL       Likelihood = 13.26   41
modified ALOM score: 1.34
*** Reasoning Step: 3
----- Final Results -----
   bacterial membrane --- Certainty = 0.2678 (Affirmative) <succ>
      bacterial outside --- Certainty = 0.0000 (Not Clear) <succ>
         bacterial cytoplasm --- Certainty = 0.0000 (Not Clear) <succ>

The protein has homology with the following sequences in the databases:

```
ORF01616(304-429 of 771)
SP|O06442|SECE_STAAU(7-48 of 60) PREPROTEIN TRANSLOCASE SECE SUBUNIT.
GP|2078376|gb|AAB54017.1||U96619 SecE {Staphylococcus aureus}
% Match = 5.4
% Identity = 26.2 % Similarity = 57.1
Matches = 11 Mismatches = 18 Conservative Sub.s = 13

99        129       159       189       219       249       279       309
RIIQIMLK*HLWRRYGTKESKPSVYRMRKPKLLNRSK*HPQANTTRSK*IL*IL*EVYNTQRNALI*RNKLQKGELIMFV
                                                                               |
                                                                        MAKKESFF 339       369       399       429       459       489       519       549
KGIFQVLRDTTWPNRKQRWKDFISILEYTVFFTIVIYIFDKLLAAGVMDLINRF***IILDRNNPNP*ILLRVFCVENNI
||:    :   |:||  :::  :|   : ::     :||     |   |:|
KGVKSEMEKTSWPTKEELFKYTVIVVSTVIFFLVFFYALDLGITALKNLLFG
          20        30        40        50        60
```

SEQ ID 8468 (GBS396) was expressed in *E. coli* as a GST-fusion product. SDS-PAGE analysis of total cell extract is shown in FIG. 83 (lane 9; MW 35 kDa).

GBS396-GST was purified as shown in FIG. 217, lane 8.

Example 2925

A DNA sequence (GASx2034R) was identified in *S. pyogenes* <SEQ ID 8349> which encodes the amino acid sequence <SEQ ID 8350>. Analysis of the protein sequence reveals the following:

```
Possible site: 21
>>> Seems to have no N-terminal signal sequence
INTEGRAL    Likelihood = -0.59    Transmembrane 53-69 (53-70)
----- Final Results -----
   bacterial membrane --- Certainty = 0.1235 (Affirmative) <succ>
     bacterial outside --- Certainty = 0.0000 (Not Clear) <succ>
       bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2926

A DNA sequence (GASx2035) was identified in *S. pyogenes* <SEQ ID 8351> which encodes the amino acid sequence <SEQ ID 8352>. Analysis of this protein sequence reveals the following:

```
Possible site: 39
>>> Seems to have no N-terminal signal sequence
----- Final Results -----
   bacterial cytoplasm --- Certainty = 0.2928 (Affirmative) <succ>
     bacterial membrane --- Certainty = 0.0000 (Not Clear) <succ>
       bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2927

A DNA sequence (GASx2042R) was identified in *S. pyogenes* <SEQ ID 8353> which encodes the amino acid sequence <SEQ ID 8354>. Analysis of this protein sequence reveals the following:

```
Possible site: 44
>>> Seems to have no N-terminal signal sequence
----- Final Results -----
   bacterial cytoplasm --- Certainty = 0.2547 (Affirmative) <succ>
     bacterial membrane --- Certainty = 0.0000 (Not Clear) <succ>
       bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2928

A DNA sequence (GASx2043) was identified in *S. pyogenes* <SEQ ID 8355> which encodes the amino acid sequence <SEQ ID 8356>. Analysis of this protein sequence reveals the following:

```
Possible site: 26
>>> Seems to have no N-terminal signal sequence
----- Final Results -----
   bacterial cytoplasm --- Certainty = 0.3289 (Affirmative) <succ>
     bacterial membrane --- Certainty = 0.0000 (Not Clear) <succ>
       bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2929

A DNA sequence (GASx2049) was identified in *S. pyogenes* <SEQ ID 8357> which encodes the amino acid sequence <SEQ ID 8358>. Analysis of this protein sequence reveals the following:

```
Possible site: 13
>>> Seems to have no N-terminal signal sequence
----- Final Results -----
   bacterial cytoplasm --- Certainty = 0.4014 (Affirmative) <succ>
     bacterial membrane --- Certainty = 0.0000 (Not Clear) <succ>
       bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2930

A DNA sequence (GASx2052) was identified in *S. pyogenes* <SEQ ID 8359> which encodes the amino acid sequence <SEQ ID 8360>. Analysis of this protein sequence reveals the following:

```
Possible site: 40
>>> Seems to have a cleavable N-term signal seq.
----- Final Results -----
   bacterial outside --- Certainty = 0.3000 (Affirmative) <succ>
``` bacterial membrane --- Certainty = 0.0000 (Not Clear) <succ>
bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2931

A DNA sequence (GASx2055R) was identified in *S. pyogenes* <SEQ ID 8361> which encodes the amino acid sequence <SEQ ID 8362>. Analysis of this protein sequence reveals the following:

Possible site: 32
>>> Seems to have no N-terminal signal sequence
----- Final Results -----
   bacterial cytoplasm --- Certainty = 0.3048 (Affirmative) <succ>
   bacterial membrane --- Certainty = 0.0000 (Not Clear) <succ>
   bacterial outside --- Certainty = 0.0000 (Not Clear) <succ>

No corresponding DNA sequence was identified in *S. agalactiae*.

The protein has homology with the following sequences in the GENPEPT database:

Based on this analysis, it was predicted that this GAS-specific protein and its epitopes, could be useful antigens for vaccines or diagnostics.

Example 2932

A DNA sequence (GASx2056) was identified in *S. pyogenes* <SEQ ID 8363> which encodes the amino acid sequence <SEQ ID 8364>. Analysis of this protein sequence reveals the following:

Possible site: 14
>>> Seems to have no N-terminal signal sequence
----- Final Results -----
   bacterial cytoplasm --- Certainty = 0.1847 (Affirmative) <succ>
   bacterial membrane --- Certainty = 0.0000 (Not Clear) <succ>
   bacterial outside --- Certainty = 0.0000 (Not Clear) <succ>

No corresponding DNA sequence was identified in *S. agalactiae*.

The protein has homology with the following sequences in the GENPEPT database:

```
>GP:BAB05703 GB:AP001513 imidazolonepropionase (imidazolone-5-propionate hydrolase) [Bacillus halodurans]

Identities = 203/416 (48%), Positives = 278/416 (66%), Gaps = 4/416 (0%)

Query:  11  DVLLTHENQLFCLNDPGHPLTGQEMKKATIVEDGYIAIKDGLIVALGSGEPDAELVGTQT   70
            D LL +  QL +   G P  G+EM +  ++E   + I+DG +  +G+            Q Sbjct:   6  DTLLVNIGQLLPMESKG-PKRGKEMSELQLLEHAALGIRDGKVAFIGTMVEADTFTANQM   64

Query:  71  IMRSYKGKIATPGIIDCHTHLVYGGSREHEFAKKLAGVSYLDILAQGGGILSTVRATRSA  130
            I    +GK+ TPG++D HTHL++GGSREHE A K  GV YL+IL  GGGIL+TV ATR+A Sbjct:  65  I--DCQGKLVTPGLVDPHTHLIFGGSREHEMALKQQGVPYLEILKNGGGILATVEATRAA  122

Query: 131  SFDNLYQKSKRLLDYMLLHGVTTVEAKSGYGLDWETEKRQLDVVAALEKDHPIDLVSTFM  190
            S + L  K+   L+ ML +GVTT+EAKSGYGLD ETE +QL    A+ +  HPID+VSTF+

Sbjct: 123  SEEELITKAICHLNRMLSYGVTTIEAKSGYGLDRETEWKQLRAAKAVGEQHPIDIVSTFL  182

Query: 191  AAHAIPEEYKGNPKAYLDVIIKDMLPVVKEENLAEFCDIFCEKNVFTADESRYLLSKAKE  250
              AHAIP  ++ +P  +LD +  DML   +KE+NLAEF DIF E   VFT ++SR  L KAKE Sbjct: 183  GAHAIPTSHRNDPDRFLDEMA-DMLGEIKEQNLAEFVDIFTETGVFTVEQSRTFLQKAKE  241

Query: 251  MGFKLRIHADEIASIGGVDVAAELSAVSAEHLMMITDDGIAKLIGAGVIGNLLPATTFSL  310
              GF L++HADEI  +GG ++A EL A+SA+HL+    +D GI K+   AG I    LLP TTF L Sbjct: 242  RGFGLKLHADEIDPLGGAELAGELGAISADHLVGASDQGIQKMAAAGTIACLLPGTTFYL  301

Query: 311  MEDTYAPARKMIDAGMAITLSTDSNPGSCPTANMQFVMQLGCFMLRLTPIEVLNAVTINA  370
            +DTYA AR MID G+A+T+STD NPGS PT N+Q +M +     L++TP E+  +AVT+N Sbjct: 302  GKDTYARARDMIDQGLAVTISTDFNPGSSPTENLQLIMSIAALRLKMTPEEIWHAVTVNG  361

Query: 371  AYSVNRQERVGSLTVGKEADIAIFDAPNIDYPFYFFATNLIHQVYKKGQLTVDRGR      426
            A+++ R +   G L VG+ AD+ ++DA N  Y Y  + + N +H V+KKG++   +R R Sbjct: 362  AHAIGRGDTAGQLAVGRAADVVVWDAKNYYVPYHYGVNHVHSVWKKGEVVYERRR      417
```

```
>GP:CAB61139 GB:AL132952 predicted using Genefinder~cDNA EST yk155e6.3 comes
from this gene-cDNA EST yk155e6.5 comes from this gene-cDNA EST yk156d6.5
comes from this gene~cDNA EST yk259b10.3 comes fr
Identities = 302/649 (46%), Positives = 419/649 (64%), Gaps = 17/649 (2%)
Query:  29  EGIRRAPDRGERLTQAQTEIALKNALRYVPTKEHEEVIPEFLEELKTRGRIYGYRFRPKD   88
            + +  AP R    LTQ +   +A++NALRY+P + H   +   EF EEL T G IYGYRF P
Sbjct:  85  KNVAHAPKRPCNLTQTEKMLAVRNALRYIPKEHHVLLATEFAEELNTYGHIYGYRFMPNE  144

Query:  89  RIYGKPIDEYKGNCTAAKAMQVMIDNNLSFEIALYPYELVTYGETGSVCANWMQYCLIKK  148
             ++  P+ E   +C  A A+ +MI NNL   +A +P ELVTYG  G V +NW+Q+ L+ +
Sbjct: 145  DLEAPPVSEIGAHCEQASAIILMILNNLDKRVAQFPQELVTYGGNGQVFSNWIQFRLVLR  204

Query: 149  YLEVMTDEQTLVVESGHPVGLFKSKPEAPRVIITNGLLVGEYDNMKDWEIAEEMGVTNYG  208
            YL  MTD QTLV+ SGHP+GLF S P++PR+ +TNG+++  Y   + ++    +GVT YG
Sbjct: 205  YLYTMTDHQTLVLYSGHPLGLEPSTPDSPRMTVTNGMMIPSYSTKELYDKYFALGVTQYG  264

Query: 209  QMTAGGWMYIGPQGIVHGTFNTLLNAGRLKLGVADDGDLTGKLFISSGLGGMSGAQGKAA  268
            QMTAG + YIGPQGIVHGT  T+LNAGR ++G+      L GK+F+++GLGGMSGAQ KAA
Sbjct: 265  QMTAGSFCYIGPQGIVHGTTITVLNAGR-RMGL---DSLAGKVEVTAGLGGMSGAQPKAA  320

Query: 269  EIAKAVAIIAEVDQSRIKTRHSQGWISQIAESPEEALQLAQKAIDAKESTSIAYHGNIVD  328
            +IA  + +IAE+  + +  RH QGW+   ++  EE +   ++  + KE+ SI Y GN+VD
Sbjct: 321  KIAGCIGVIAEISDTALLKRHQQGWLDVYSKDLEEIVNWIKEYREKKBAISIGYLGNVVD  380

Query: 329  LLE-YVNDKQIHVDLLSDQTSCHNVYDGGYCPVGISFDERTRLLAEDKDTFHQMVDDTLA  387
            L E     + +  V+L SDQTS HN +GG+  P G++F++   +++  D   F ++V ++L
Sbjct: 381  LWERLAEEPECLVELGSDQTSLHNPFLGGFYPAGLTFEQSNQMMTSDPVKFKKLVQNSLI  440

Query: 388  RHFEAIKTLTENGTYFFDYGNAFMKSVYDSGITEISKNGRNDKDGFIWPSYVEDIMGPML  447
            R   AI  +   G YF+DYGNAF+     +G   + ++ ++DK  F +PSY++DIMG  +
Sbjct: 441  RQIAAIDKIAAKGMYFWDYGNAFLLECQRAGANLLREDAQDDK-SFRYPSYMQDIMGD-I  498

Query: 448  FDYGYGPFRWVCLSGNHDDLVATDKAAMEAIDPDR--------RYQDRDNYNWIRDAEKN  499
            F  G+GPFRWVC SG  +DL  TD+ A + ID  +         + Q  DN  WI +AEKN
Sbjct: 499  FSMGFGPFRWVCTSGKPEDLRLTDQTACKIIDELKDTDVPEYVKQQYLDNKKWIEEAEKN  558

Query: 500  QLVVGTQARILYQDCIGRVTIALKFNELVRKGKI-GPVMIGRDHHDVSGTDSPFRETSNI  558
            +LVVG+QARILY D  GRV +A  FNELV+ GK+   ++I RDHHDVSGTDSPFRETSN+
Sbjct: 559  KLVVGSQARILYSDRAGRVALASAFNELVKSGKVSAAIVISRDHHDVSGTDSPFRETSNV  618

Query: 559  KDGSNVTCDMAVQCYAGNAARGMSLVALHNGGGTGIGKAINGGEGLVLDGSERIDEIIKS  618
             DGS  T DMAVQ   G++ RG + VALHNGGG G G  INGGFG+VLDGS       +
Sbjct: 619  YDGSAFTADMAVQNCIGDSFRGATWVALHNGGGVGWGDVINGGEGIVLDGSSDAARRAEG  678

Query: 619  AIAWDTMGGVARRNWARNEHAIETAIEYNRLHAGTDHITIPYLADDDLV            667
             + WD   GV RR+W+ N  A E AI+          +T+P  AD++L+
Sbjct: 679  MLN WDVPNGVTRRSWSGNAKAQE-AIQRAEKQVDGLRVTLPVEADEELL            726
```

Based on this analysis, it was predicted that this GAS-specific protein and its epitopes, could be useful antigens for vaccines or diagnostics.

Example 2933

A DNA sequence (GASx2057) was identified in *S. pyogenes* <SEQ ID 8365> which encodes the amino acid sequence <SEQ ID 8366>. Analysis of this protein sequence reveals the following:

```
Possible site: 44
>>> Seems to have no N-terminal signal sequence
```

-continued

```
----- Final Results -----
bacterial cytoplasm --- Certainty = 0.1887 (Affirmative) <succ>
bacterial membrane --- Certainty = 0.0000 (Not Clear) <succ>
bacterial outside --- Certainty = 0.0000 (Not Clear) <succ>
```

No corresponding DNA sequence was identified in *S. agalactiae.*

The protein has homology with the following sequences in the GENPEPT database:

```
>GP:AAD35925 GB:AE001751 formiminotransferase-cyclodeaminase/
formiminotetrahydrofolate cyclodeaminase, putative [Thermotoga maritima]
Identities = 160/296 (54%), Positives = 214/296 (72%), Gaps = 2/296 (0%)
Query:   3  KIVECIPNESEGQNQAVIDGLVATAKSIPGVTLLDYSSDASHNRSVFTLVGDDQSIQEAA   62
            K++E +PNFSEG+ +V++  +VA AK    V +LD+S DA HNRSV TLVG+ +++  A
Sbjct:   2  KLIESVPNFSEGRRKEVVEKIVAEAKKYDRVWVLDWSMDADHNRSVITLVGEPENLINAL   61

Query:  63  FQLVKYASENIDMTKHHGEHPRMGATDVCPFVPIKDITTQECVEISKQVAERINRELGIP  122
            F + K A+E ID+  H G+HPRMGA DV P VP+ + T +ECVE SK +  RI  ELGIP
Sbjct:  62  FDMIKKAAELIDLRNHTGQHPRMGAADVIPLVPLYNTTMEECVEYSKILGRRIGEELGIP  121
```

-continued

```
Query: 123  IFLYEDSATRPERQNLAKVRKGQFEGMPEKLLEEDWAPDYGDRKIHPTAGVTAVGARMPL  182
            ++LYE SATRPERQNLA +RKG+FEG  EK+ +  W PD+G  ++HPTAGVTAVGAR  L
Sbjct: 122  VYLYEKSATRPERQNLADIRKGEFEGFFEKIKDPLWKPDFGPDRVHPTAGVTAVGAREFL  181

Query: 183  VAFNVNLDTDNIDIAHKIAKIIRGSGGGYKYCKAIGVMLEDRHIAQVSMNMVNFEKCSLY  242
            +AFNVNL T ++ IA KIA+ IR S GG +Y KAIGV L+ R + QVS+N+ N +K  LY
Sbjct: 182  IAFNVNLGTRDVKIAEKIARAIRFGSGGLRYVKAIGVDLKGRGVVQVSINITNHKKTPLY  241

Query: 243  RTFETIKFEARRYGVNVIGSEVIGLAPAKALIDVAEYYLQVEDFDYHKQILENHLL      298
            R FE IK EA RYGV V+GSE++GL P ++L+    YYL+ +     K+++E++LL
Sbjct: 242  RVFELIKMEAERYGVPVLGSEIVGLFPLESLLKTVSYYLRTD--LNAKKVIESNLL      295
```

Based on this analysis, it was predicted that this GAS-specific protein and its epitopes, could be useful antigens for vaccines or diagnostics.

Example 2934

A DNA sequence (GASx2058) was identified in *S. pyogenes* <SEQ ID 8367> which encodes the amino acid sequence <SEQ ID 8368>. Analysis of this protein sequence reveals the following:

```
Possible site: 31
>>> Seems to have no N-terminal signal sequence
----- Final Results -----
   bacterial cytoplasm --- Certainty = 0.2776 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae.*

The protein has homology with the following sequences in the GENPEPT database:

```
>GP:AAA62653 GB:L33465 methenyl tetrahydrofolate cyclohydrolase [Methylobacterium
extorquens] Identities = 79/198 (39%), Positives = 112/198 (55%)
Query:   7  SLTDFAKVLGSDAPAPGGGSAAALSGANGISLTKMVCELTLGKKKYADYQDIITEIHAKS   66
            ++  F   L S AP PGGG AAA+SGA G +L  MVC LT+GKKKY + +  + ++  KS
Sbjct:   6  TIETFLDGLASSAPTPGGGGAAAISGAMGAALVSMVCNLTIGKKKYVEVEADLMQVLEKS   65

Query:  67  TALQASLLAAIDKDTEAFNLVSAVFDMPKETDEDKAARRTAMQKALKTAAQSPFEMMTLM  126
             L+ +L    I  D EAF+ V   + +PK TDE+KAAR   +Q+ALKTA    P     +
Sbjct:  66  EGLRRTLTGMIADDVEAFDAVMGAYGLPKNTDEEKAARAAKIQEALKTATDVPLACCRVC  125

Query: 127  VEALEITATAVGKSNTNAASDLGVAALNLKAGLQGAWLNVLINLSGIKDEDFVTDYRQKG  186
             E +++       K N N  SD GVA L+  AGL+ A LNV +N G+  D  F  +  ++
Sbjct: 126  REVIDLAEIVAEKGNLNVISDAGVAVLSAYAGLRSAALNVYVNAKGLDDRAFAEERLKEL  185

Query: 187  QALLDKGCHLADDIYTKI                                            204
            + LL +   L + IY  +
Sbjct: 186  EGLLAEAGALNERIYETV                                            203
```

Based on this analysis, it was predicted that this GAS-specific protein and its epitopes, could be useful antigens for vaccines or diagnostics.

Example 2935

A DNA sequence (GASx2061) was identified in *S. pyogenes* <SEQ ID 8369> which encodes the amino acid sequence <SEQ ID 8370>. Analysis of this protein sequence reveals the following:

```
Possible site: 22
>>> Seems to have no N-terminal signal sequence
----- Final Results -----
   bacterial cytoplasm --- Certainty = 0.3924 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

Example 2936

A DNA sequence (GASx2063) was identified in *S. pyogenes* <SEQ ID 8371> which encodes the amino acid sequence <SEQ ID 8372>. Analysis of this protein sequence reveals the following:

```
Possible site: 57
>>> Seems to have an uncleavable N-term signal seq
INTEGRAL    Likelihood = -1.06    Transmembrane  231-247 ( 231-247)
INTEGRAL    Likelihood = -0.53    Transmembrane  2-18 (1-18)
----- Final Results -----
   bacterial membrane --- Certainty = 0.1426 (Affirmative) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae.*

The protein has homology with the following sequences in the GENPEPT database:

```
>GP:CAB15971 GB:Z99124 histidase [Bacillus subtilis]
Identities = 236/477 (49%), Positives = 321/477 (66%), Gaps = 2/477 (0%)
Query:  42  VINLDGESLTIEDVIAIARQGVACHIDDSAIEAVNASRKIVDDIVSEKRVVYGVTTGFGS  101
            ++ LDG SLT  DV  +          + ++E V  SR  V+ IV +++ +YG+ TGFG
Sbjct:   1  MVTLDGSSLTTADVARVLFDFEEAAASEESMERVKKSRAAVERIVRDEKTIYGINTGFGK   60

Query: 102  LCNVSISPEDTVQLQENLIRTHASGFGDPLPEDAVRAIMLIRINSLVKGYSGIRLSTIEK  161
             +V I  ED+  LQ NLI +HA G GDP PE   RA++L+R N+L+KG+SG+R   IE+
Sbjct:  61  FSDVLIQKEDSAALQLNLILSHACGVGDPFPECVSRAMLLLRANALLKGFSGVRAELIEQ  120

Query: 162  LLELLNKGVHPYIPEKGSLGASGDLAPLAHMVLPMLGLGKAYYKGELLSGQEALDKAGID  221
            LL  LNK VHP IP++GSLGASGDLAPL+H+ L ++G G+ +++GE +     L KAGI
Sbjct: 121  LLAFLNKRVHPVIPQQGSLGASGDLAPLSHLALALIGQGEVFFEGERMPAMTGLKKAGIQ  180

Query: 222  KISLAAKEGLALINGTTVLTAVGALATYDAIQLLKLSDLAGALSLEVHNGITSPFEENLH  281
             ++L +KEGLALINGT  +TA+G +A  +A +L   ++   +L++E   GI   F+E++H
Sbjct: 181  PVTLTSKEGLALINGTQAMTAMGVVAYIEAEKLAYQTERIASLTIEGLQGIIDAFDEDIH  240

Query: 282  TIRPQSGQLATARNIRNLLEGSQNTTVATQSRVQDPYTLRCMPQIHGASKDSIAYVKSKV  341
              R Q+   A    IR  L  S  TT   + RVQD Y+LRC+PQ+HGA+  ++ YVK K+
Sbjct: 241  LARGYQEQIDVAERIRFYLSDSGLTTSQGELRVQDAYSLRCIPQVHGATWQTLGYVKEKL  300

Query: 342  DIEINSVTDNPIICKDG-HVISGGNFHGEPMAQPFDFLGIAISEIGNVSERRVERLVNSQ  400
            +IE+N+ TDNP+I  DG  VISGGNFHG+P+A   DFL IAISE+ N++ERR+ERLVN Q
Sbjct: 301  EIEMNAATDNPLIFNDGDKVISGGNFHGQPIAFAMDFLKIAISELANIAERRIERLVNPQ  360

Query: 401  LSKLPSFLVKYPGLNSGFMITQYACASLASENKVLAHPASVDSIPSCENQEDFVSMGTTA  460
            L+ LP FL  +PGL SG MI QYA ASL SENK LAHPASVDSIPS  NQED VSMGT A
Sbjct: 361  LNDLPPFLSPHPGLQSGAMIMQYAAASLVSENKTLAHPASVDSIPSSANQEDHVSMGTIA  420

Query: 461  ARKAFEILKNSRRIVATEIMAACQALDLKPENHELGKGTKVAYDLFRKEVNFIEHDK     517
            AR A++++ N+RR++A E + A QA++ +   H     TK  +   RK V  I+ D+
Sbjct: 421  ARHAYQVIANTRRVIAIEAICALQAVEYRGIEH-AASYTKQLFQEMRKVVPSIQQDR     476
```

Based on this analysis, it was predicted that this GAS-specific protein and its epitopes, could be useful antigens for vaccines or diagnostics.

Example 2937

A DNA sequence (GASx2064) was identified in *S. pyogenes* <SEQ ID 8373> which encodes the amino acid sequence <SEQ ID 8374>. Analysis of this protein sequence reveals the following:

```
Possible site: 44
>>> Seems to have no N-terminal signal sequence
```

-continued

```
----- Final Results -----
  bacterial cytoplasm --- Certainty = 0.4483 (Affirmative) <succ>
    bacterial membrane --- Certainty = 0.0000 (Not Clear) <succ>
      bacterial outside --- Certainty = 0.0000 (Not Clear) <succ>
```

No corresponding DNA sequence was identified in *S. agalactiae.*

The protein has homology with the following sequences in the GENPEPT database:

```
>GP:AAG06563 GB:AE004741 probable arginase family protein
[Pseudomonas aeruginosa]
Identities = 99/275 (36%), Positives = 147/275 (53%), Gaps = 9/275 (3%)

Query:   53  LIGFKSDKGVYINNGRVGAVESPAAIRTQLAKFPWHLGNQVMVYDVGNIDGPNRSLEQLQ   112
             L+GF SD+GV  N GR GA   P A+R  LA   WH G Q  +YD G+I   +  LE  Q
Sbjct:   42  LLGFASDEGVRRNQGRQGARHGPPALRRALANLAWH-GEQA-IYDAGDIVAGD-DLEAAQ    98

Query:  113  NSLSKAIKRMCDLNLKPIVLGGGHETAYGHYLGLRQSLSPSDDL---AVINMDAHFDLRP   169
                ++ +  +      + + LGGGHE AY  + GL + LS  + L    ++N DAHFDLR
Sbjct:   99  ECYAQRVADLLACGHRVVGLGGGHEIAYASFAGLARHLSRHERLPRIGILNFDAHFDLRH   158

Query:  170  YDQTGPNSGTGFRQMFDDAVADKRLFKYFVLGIQEHNNNLFLFDFVAKSKGIQFLTGQDI   229
              ++    +SGT FRQ+ +    A     F Y  LGI    +N    LFD  A+  G+++L  + +
Sbjct:  159  AERA--SSGTPFRQIAELCQASDWPFAYCCLGISRLSNTAALFD-QAQRLGVRYLLDRQL   215

Query:  230  YQMGHQKVCRAIDRFLEGQERVYLTIDMDCFSVGAAPGVSAIQSLGVDPNLAVLVLQHIA   289
                  ++     +D FL+  + +YLT+ +D       APGVSA  + GV+  +    +++
Sbjct:  216  QPWNLERSEAFLDGFLQSVDHLYLTVCLDVLPAAQAPGVSAPSAHGVEMPVVEHLVRRAK   275

Query:  290  ASGKLVGFDVVEVSPPHDIDNHTANLAATFIFYLV                         324
             ASGKL   D+ E++P  D D  TA +AA  +  LV
Sbjct:  276  ASGKLRLADIAELNPQLDSDQRTARIAARLVDSLV                         310
```

Based on this analysis, it was predicted that this GAS-specific protein and its epitopes, could be useful antigens for vaccines or diagnostics.

Example 2938

A DNA sequence (GASx2065R) was identified in *S. pyogenes* <SEQ ID 8375> which encodes the amino acid sequence <SEQ ID 8376>. Analysis of this protein sequence reveals the following:

```
Possible site: 27
>>> Seems to have no N-terminal signal sequence
INTEGRAL    Likelihood = -0.37    Transmembrane 375-391 (375-392)
----- Final Results -----
   bacterial membrane --- Certainty = 0.1150 (Affirmative) <succ>
     bacterial outside --- Certainty = 0.0000 (Not Clear) <succ>
       bacterial cytoplasm --- Certainty = 0.0000 (Not Clear) <succ>
```

No corresponding DNA sequence was identified in *S. agalactiae*.

The protein has homology with the following sequences in the GENPEPT database:

```
>GP:CAB37582 GB:AL035569 putative regulatory protein [Streptomyces
coelicolor A3(2)]
Identities = 95/437 (21%), Positives = 177/437 (39%), Gaps = 28/437 (6%)

Query:   271  EVGALLLIGDTGIGKRTLARQVLANQTQTFQIVTAKCFREEAMDSL--LPWRNILDGLGD   328
              E  ALLL G+ G+GK   L   + A   +  +V        E  D L   P+   L  L
Sbjct:    95  EPQALLLGGEAGVGKTRLVEEFAAAADRRGAVVALGGCVEIGADGLPFAPFSTALRALRR   154

Query:   329  LVIQNRLLTTKAWKAALKRCFP-VATIFQEDNNQPFIKDHTSLLVSFIVDILQHLAEIKA   387
              + +            + L R P +A          ++ + L      +L+ +A
Sbjct:   155  HLPEELAAAAAGQEEELARLLPELAEGTPVTGGGRHDEESMARLFELTARLLERVAARHT   214

Query:   388  LVILIEDCHWMDEDSLTLLQRVMNQLVHYPIAFVLT-------KHLGTTPELGLCLNALM   440
              +V+++ED HW D   + L+ ++ L     + T        +    P L    L+ L
Sbjct:   215  VVLVLEDLHWADASTRHLIAYLLRTLRTGRLVVLATYRSDDIHRRHPLRPLLAE-LDRLR   273

Query:   441  SQGRLESICLEPFNRQESLVYINSQLGSQPVTAEEMEHLYQASQGNPFFLSEYTQALLRH   500
              +  RLE    L    F R E      I    L  +P          +++ +++ S GN FF+  E    A    R
Sbjct:   274  TVRRLE---LGRFTRDEVGRQIAGILAHEP-DQLQVDEIFERSDGNAFFVEELAVA-ARV   328

Query:   501  EKFVPLTPAIKAKLGLKLANLSSRDDALLNYLSCCRRPIPLNTLAQLMLLPLEEVIEMVD   560
                     LT +++  L +++    L         +      ++    +   LA +   L   +++IE +
Sbjct:   329  GSCTGLTDSLRDLLLVRVEALPESAQRVARIVAEGGSTVEYRLLAAVARLAEDDLIEALR   388

Query:   561  NLGHYYILVEESVGEEVLISFRQRIIQLYSYDRLSLSKRRLLHGQIAKRLEDLLPILTPS   620
              +   +    IL+      G+      FR  +++      D L   +R   L+ + A+ L D  P L P+
Sbjct:   389  SAVNANILLPAPDGDG--YRFRHSLVREAVGDDLLPGERSRLNRRYAEAL-DADPTLVPA   445

Query:   621  PHLLDDIAYHYQESRQVIKALEYNLNYLDATLPFQHELFPIYSKSIGSLEKSDRDHQRLM   680
                   +A ++   +      KAL         LDA++   +           YS+ +   LE++          L
Sbjct:   446  AERVMRLASYWYHAHAPAKALP---AVLDASVEARRR--HAYSEQLRLLERA----MELW   496

Query:   681  EEQFDKIRQSIADLELT                                            697
              +       D +R ++   ++   T
Sbjct:   497  DSAPDDVRATLRPVDCT                                            513
```

Based on this analysis, it was predicted that this GAS-specific protein and its epitopes, could be useful antigens for vaccines or diagnostics.

Example 2939

A DNA sequence (GASx2072) was identified in *S. pyogenes* <SEQ ID 8377> which encodes the amino acid sequence <SEQ ID 8378>. Analysis of this protein sequence reveals the following:

```
Possible site: 14
>>> Seems to have no N-terminal signal sequence
----- Final Results -----
   bacterial cytoplasm --- Certainty = 0.3702 (Affirmative) <succ>
     bacterial membrane --- Certainty = 0.0000 (Not Clear) <succ>
       bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2940

A DNA sequence (GASx2074R) was identified in *S. pyogenes* <SEQ ID 8379> which encodes the amino acid sequence <SEQ ID 8380>. Analysis of this protein sequence reveals the following:

```
Possible site: 37
>>> Seems to have no N-terminal signal sequence
INTEGRAL    Likelihood = -0.90    Transmembrane 21-37 (21-38)
----- Final Results -----
   bacterial membrane --- Certainty = 0.1362 (Affirmative) <succ>
     bacterial outside --- Certainty = 0.0000 (Not Clear) <succ>
       bacterial cytoplasm --- Certainty = 0.0000 (Not Clear) <succ>
```

No corresponding DNA sequence was identified in *S. agalactiae*.

Example 2941

A DNA sequence (GASx2075R) was identified in *S. pyogenes* <SEQ ID 8381> which encodes the amino acid sequence <SEQ ID 8382>. Analysis of this protein sequence reveals the following:

---
Possible site: 25
>>> Seems to have no N-terminal signal sequence
----- Final Results -----
    bacterial cytoplasm --- Certainty = 0.3545 (Affirmative) <succ>
        bacterial membrane --- Certainty = 0.0000 (Not Clear) <succ>
            bacterial outside --- Certainty = 0.0000 (Not Clear) <succ>
---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2942

A DNA sequence (GASx2076R) was identified in *S. pyogenes* <SEQ ID 8383> which encodes the amino acid sequence <SEQ ID 8384>. Analysis of this protein sequence reveals the following:

---
Possible site: 34
>>> Seems to have no N-terminal signal sequence
----- Final Results -----
    bacterial cytoplasm --- Certainty = 0.2340 (Affirmative) <succ>
        bacterial membrane --- Certainty = 0.0000 (Not Clear) <succ>
            bacterial outside --- Certainty = 0.0000 (Not Clear) <succ>
---

No corresponding DNA sequence was identified in *S. agalactiae*.

The protein has homology with the following sequences in the GENPEPT database:

```
>GP:AAC44494 GB:U44893 orf108; unknown function [Butyrivibrio fibrisolvens]

Identities = 42/75 (56%), Positives = 55/75 (73%)

Query:    1    LLKGTLRFGQLKSSIGSVSQKVLTAQLRAMEADGLVHREVYAEVPPRVEYSLTETGLSLA    60
               LL    RF +LK+++  +SQKVLT  LR+ME DG++ R VY EVPPRVEYSL+E G S+
Sbjct:   31    LLVRPWRFNELKNNLEGISQKVLTDSLRSMEEDGIITRTVYPEVPPRVEYSLSELGESMR    90

Query:   61    PVIEAMSDWGQTYQE                                                75
               P+I+AM  WG  Y+E
Sbjct:   91    PIIKAMEQWGTEYKE                                               105
```

Based on this analysis, it was predicted that this GAS-specific protein and its epitopes, could be useful antigens for vaccines or diagnostics.

Example 2943

A DNA sequence (GASx2097) was identified in *S. pyogenes* <SEQ ID 8385> which encodes the amino acid sequence <SEQ ID 8386>. Analysis of this protein sequence reveals the following:

---
Possible site: 40
>>> Seems to have no N-terminal signal sequence
INTEGRAL    Likelihood = −3.40    Transmembrane 26-42 (23-44)
----- Final Results -----
    bacterial membrane --- Certainty = 0.2359 (Affirmative) <succ>
        bacterial outside --- Certainty = 0.0000 (Not Clear) <succ>
            bacterial cytoplasm --- Certainty = 0.0000 (Not Clear) <succ>
---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2944

A DNA sequence (GASx2098) was identified in *S. pyogenes* <SEQ ID 8387> which encodes the amino acid sequence <SEQ ID 8388>. Analysis of this protein sequence reveals the following:

---
Possible site: 20
>>> Seems to have no N-terminal signal sequence
----- Final Results -----
    bacterial cytoplasm --- Certainty = 0.1385 (Affirmative) <succ>
        bacterial membrane --- Certainty = 0.0000 (Not Clear) <succ>
            bacterial outside --- Certainty = 0.0000 (Not Clear) <succ>
---

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2945

A DNA sequence (GASx2100) was identified in *S. pyogenes* <SEQ ID 8389> which encodes the amino acid sequence <SEQ ID 8390>. Analysis of this protein sequence reveals the following:

Possible site: 23
>>> Seems to have no N-terminal signal sequence
----- Final Results -----
   bacterial cytoplasm --- Certainty = 0.2138 (Affirmative) <succ>
     bacterial membrane --- Certainty = 0.0000 (Not Clear) <succ>
      bacterial outside --- Certainty = 0.0000 (Not Clear) <succ>

No corresponding DNA sequence was identified in *S. agalactiae*.

The protein has homology with the following sequences in the GENPEPT database:

```
>GP:AAA98589 GB:L44593 ORF79; putative [Lactococcus lactis phage BK5-T]
Identities = 34/62 (54%), Positives = 44/62 (70%)

Query:    3   QITLKAARINAGYTLKQVAGAVGKNPQTISKYEKDSSDISLGLLQKLSSLYGVTIDNLFL    62
              +I LKAAR NA ++ K+VA VGKN QTI  YEKDS++I + L  KL+ +Y   ID +FL
Sbjct:    8   KIKLKAARTNADFSAKEVAEIVGKNYQTILSYEKDSTEIPMSLAIKLAEIYDYPIDFIFL    67

Query:   63   GK    64
              GK
Sbjct:   68   GK    69
```

Based on this analysis, it was predicted that this GAS-specific protein and its epitopes, could be useful antigens for vaccines or diagnostics.

Example 2946

A DNA sequence (GASx2103) was identified in *S. pyogenes* <SEQ ID 8391> which encodes the amino acid sequence <SEQ ID 8392>. Analysis of this protein sequence reveals the following:

Possible site: 39
>>> Seems to have no N-terminal signal sequence
----- Final Results -----
   bacterial cytoplasm --- Certainty = 0.3316 (Affirmative) <succ>
     bacterial membrane --- Certainty = 0.0000 (Not Clear) <succ>
      bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2947

A DNA sequence (GASx2104) was identified in *S. pyogenes* <SEQ ID 8393> which encodes the amino acid sequence <SEQ ID 8394>. Analysis of this protein sequence reveals the following:

Possible site: 55
>>> Seems to have no N-terminal signal sequence
----- Final Results -----
   bacterial cytoplasm --- Certainty = 0.4371 (Affirmative) <succ>
     bacterial membrane --- Certainty = 0.0000 (Not Clear) <succ>
      bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2948

A DNA sequence (GASx2105) was identified in *S. pyogenes* <SEQ ID 8395> which encodes the amino acid sequence <SEQ ID 8396>. Analysis of this protein sequence reveals the following:

Possible site: 40
>>> Seems to have no N-terminal signal sequence
----- Final Results -----
   bacterial cytoplasm --- Certainty = 0.2263 (Affirmative) <succ>
     bacterial membrane --- Certainty = 0.0000 (Not Clear) <succ>
      bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2949

A DNA sequence (GASx2106) was identified in *S. pyogenes* <SEQ ID 8397> which encodes the amino acid sequence <SEQ ID 8398>. Analysis of this protein sequence reveals the following:

Possible site: 32
>>> Seems to have an uncleavable N-term signal seq
INTEGRAL     Likelihood = −6.42     Transmembrane 9-25 (6-29)
----- Final Results -----
   bacterial membrane --- Certainty = 0.3569 (Affirmative) <succ> bacterial outside --- Certainty = 0.0000 (Not Clear) <succ>
bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2950

A DNA sequence (GASx2107) was identified in *S. pyogenes* <SEQ ID 8399> which encodes the amino acid sequence <SEQ ID 8400>. Analysis of this protein sequence reveals the following:

Possible site: 25
>>> Seems to have no N-terminal signal sequence
---- Final Results ----
bacterial cytoplasm --- Certainty = 0.1355 (Affirmative) <succ>
bacterial membrane --- Certainty = 0.0000 (Not Clear) <succ>
bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2951

A DNA sequence (GASx2108) was identified in *S. pyogenes* <SEQ ID 8401> which encodes the amino acid sequence <SEQ ID 8402>. Analysis of this protein sequence reveals the following:

Possible site: 26
>>> Seems to have no N-terminal signal sequence

----- Final Results -----
bacterial cytoplasm --- Certainty = 0.3050 (Affirmative) <succ>
bacterial membrane --- Certainty = 0.0000 (Not Clear) <succ>
bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2952

A DNA sequence (GASx2109) was identified in *S. pyogenes* <SEQ ID 8403> which encodes the amino acid sequence <SEQ ID 8404>. Analysis of this protein sequence reveals the following:

Possible site: 13
>>> Seems to have no N-terminal signal sequence
----- Final Results -----
bacterial cytoplasm --- Certainty = 0.3628 (Affirmative) <succ>
bacterial membrane --- Certainty = 0.0000 (Not Clear) <succ>
bacterial outside --- Certainty = 0.0000 (Not Clear) <succ>

No corresponding DNA sequence was identified in *S. agalactiae*.

The protein has homology with the following sequences in the GENPEPT database:

```
>GP:CAB46557 GB:AJ242479 putative replication protein [Streptococcus thermophilus]
Identities = 143/242 (59%), Positives = 180/242 (74%), Gaps = 2/242 (0%)

Query:     1  MAIYEARGFSSYLY--PYKGPLEPFDYIAQFRPLKPPEDIDIEEYKRTQAPYCLSGKVTA   58
              MAIYE+RGF + L+       +PF ++A FRP+K P+   DI ++KR  APYC+SG+V
Sbjct:     1  MAIYESRGFGNILHLNNSNASKDPFKFVATFRPMKVPQGEDIADFKRYHAPYCISGEVKQ   60

Query:    59  EKNGSYKRNNASLVYRDLIFLDYDEIETGVNLPKIVSQTLWEYSYIIYPTIKHTPEKPRY  118
              ++G+YKRNNASL+YRDLIFLDYD++E   + P+ VS  L  YSY+IYPTIKHT EKPRY
Sbjct:    61  DEDGNYKRNNASLLYRDLIFLDYDKLEASTDFPRAVSNALNGYSYVIYPTIKHTAEKPRY  120

Query:   119  RLVMKPSDVMTEATYKQVVKEIADKIGLPFDLASLTWSQLQGLPVTTGDPEDYQRYVNHG  178
              RLV+KP+D M E TYK   +EIADKIGLPFD +SLTWSQLQGLPVTTGDPE Y+R VN G
Sbjct:   121  RLVVKPTDKMDEQTYKATAQEIADKIGLPFDDSSLTWSQLQGLPVTTGDPEKYERIVNRG  180

Query:   179  LDYPVPKNGSTPNRQVVTTYTPRPRSQRSITMRVIDTLFNGFGNEGGRNVALTKFVGLLF  238
               YPV +         +TPR    +S+TMRV+DTL NGFG+EGGRN+ +T++FVGLL
Sbjct:   181  RCYPVANPNTVKANHSPNYHTPRQSGDKSLTMRVVDTLLNGFGDEGGRNIEVTRFVGLLL  240

Query:   239  NK                                                           240
              +K
Sbjct:   241  SK                                                           242
```

Based on this analysis, it was predicted that this GAS-specific protein and its epitopes, could be useful antigens for vaccines or diagnostics.

Example 2953

A DNA sequence (GASx2110) was identified in *S. pyogenes* <SEQ ID 8405> which encodes the amino acid sequence <SEQ ID 8406>. Analysis of this protein sequence reveals the following:

Possible site: 28
>>> Seems to have no N-terminal signal sequence
----- Final Results -----
   bacterial cytoplasm --- Certainty = 0.5215 (Affirmative) <succ>
     bacterial membrane --- Certainty = 0.0000 (Not Clear) <succ>
       bacterial outside --- Certainty = 0.0000 (Not Clear) <succ>

No corresponding DNA sequence was identified in *S. agalactiae*.

The protein has homology with the following sequences in the GENPEPT database:

```
>GP:CAB46558 GB:AJ242479 putative DNA primase [Streptococcus thermophilus]
Identities = 274/548 (50%), Positives = 363/548 (66%), Gaps = 17/548 (3%)

Query:    17  DLKNLENEITEARE------NEDKYFSTFKGVRGQLIKECQEMKDEAFKIAYDGVMADSK    70
              DL  LE E E+++      +ED Y  TFK +R Q I   ++ K+ A++  YD  M + K
Sbjct:     8  DLTKLEEEYNESKKEASTLFDEDGYLKTFKDIRKQFINILEQKKEIAYQKGYDLYMNNPK    67

Query:    71  HLENVKAGRLTEVQHE-------ELAKEKGQEASEKALPKTPLGVAIMLKHYLRFIRVKP   123
              L  +    E   E         E AK++G++A + A PKTPL  A  LK Y+RFIR++P
Sbjct:    68  VLLKLAKAEKDEENGELIRKTVIEDAKKEGEKAKKNATPKTPLECAEFLKKYIRFIRIRP   127

Query:   124  EAQGQKAPLYFFHPDHGVWLEDNEFLQDLISVIFPNATEKQAFDTLYKIARQSQLKEIQR   183
              + +G++    F    G++LED+EFL DL+  I PN TE+   D LYKIA    LK+ Q
Sbjct:   128  KGKGRERLYTETKILGIYLEDDEFLHDLMVTIHPNNTERLGNDALYKIAHSVPLKDKQE   187

Query:   184  EYTVIGNQLYNYKTGQFEELTPDITVTRKIKTGYNKKAKEPTIKGWKPTAWLLELFDGDA   243
              Y V+G +LYN +TG+F +  P I VTRK++ GYN  A EP I GWKPT WL  LF+GD
Sbjct:   188  NYVVVGGELYNNETGEFTQFDPRIIVTRKVRMGYNPDATEPIIDGWKPTVWLKGLFNGDR   247

Query:   244  ELYNLAIQIIKASITGQSLQKIFWLFGEGGTGKGTFQQLLINLVGMDNVASLKITELAKS   303
              + Y+LAIQII+A+ITG++L+  IFWL+GEGGTGKGTFQ LL NLVG +NVAS KI + A
Sbjct:   248  DSYDLAIQIIRATITGKTLENIEWLYGEGGTGKGTFQTLLENLVGSENVASFKI-DGASG   306

Query:   304  RFTTSILLGKSIVIGDDIQKDAVIKDTSDIFSLATGDIMTIEDKGKRPYSIRLNMTVVQS   363
              +F TSIL+GK++VIGDDIQKD VIKDTS +FSLATGD + IEDKGKRPY+ R  MTVVQS
Sbjct:   307  KFDTSILIGKTVVIGDDIQKDVVIKDTSVVFSLATGDPIRIEDKGKRPYTTRKRMTVVQS   366

Query:   364  SNGLPRMNGDKSAIDRRFRILPFTKVFKGKPNKAIRNDYINRKEVLEYLLKLAIETPITD   423
              SNG PRMN D+ AI+RRFR+L F+++ KGK +K I+NDY+ RKEVLEY +KLAIETP  D
Sbjct:   367  SNGFPRMNADQKAINRRERVLTFSEL-KGKADKRIKNDYVGRKEVLEYFVKLAIETPFRD   425

Query:   424  INPKASIEILEEHHKEMNPVIDFVSKFFTDE-LTSEFIPNSFVYHVWKGFLEYYDIKQ-I   481
              +NP+ SIE L+E +KEMNPV DFV +FF DE +    ++PN +V+ +K + E   +
Sbjct:   426  VNPQKSIEFLDEAYKEMNPVADFVDRFFNDEVIKCNYVPNGYVFECFKAYCEKNQNRNYF   485

Query:   482  KSERGLHKEIKSNLPEGFEAGQKVIPVGRQLHTGFYPKEDLPLFASASYANGRASPEKRK   541
              + R LHK+IK  LP+ F  + I  G++ +  F P     +  +Y NGR    E ++
Sbjct:   486  LNSRTLHKQIKKILPKTFRPKEVTIKKGQKFYEEFNPHLVSNPWHFDAYDNGRNKKEDQQ   545

Query:   542  KPKNERGY                                                      549
                K ERGY
Sbjct:   546  DAKKERGY                                                      553
```

Based on this analysis, it was predicted that this GAS-specific protein and its epitopes, could be useful antigens for vaccines or diagnostics.

Example 2954

A DNA sequence (GASx2111) was identified in *S. pyogenes* <SEQ ID 8407> which encodes the amino acid sequence <SEQ ID 8408>. Analysis of this protein sequence reveals the following:

Possible site: 41
>>> Seems to have no N-terminal signal sequence
----- Final Results -----
   bacterial cytoplasm --- Certainty = 0.0994 (Affirmative) <succ>
     bacterial membrane --- Certainty = 0.0000 (Not Clear) <succ>
       bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2955

A DNA sequence (GASx2112) was identified in *S. pyogenes* <SEQ ID 8409> which encodes the amino acid sequence <SEQ ID 8410>. Analysis of this protein sequence reveals the following:

Possible site: 54
>>> Seems to have no N-terminal signal sequence
----- Final Results -----
   bacterial cytoplasm --- Certainty = 0.3058 (Affirmative) <succ>
     bacterial membrane --- Certainty = 0.0000 (Not Clear) <succ>
       bacterial outside --- Certainty = 0.0000 (Not Clear) <succ>

No corresponding DNA sequence was identified in *S. agalactiae*.

Example 2956

A DNA sequence (GASx2114) was identified in *S. pyogenes* <SEQ ID 8411> which encodes the amino acid sequence <SEQ ID 8412>. Analysis of this protein sequence reveals the following:

```
Possible site: 37
>>> Seems to have no N-terminal signal sequence
----- Final Results -----
   bacterial cytoplasm --- Certainty = 0.2815 (Affirmative) <succ>
     bacterial membrane --- Certainty = 0.0000 (Not Clear) <succ>
       bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2957

A DNA sequence (GASx2115R) was identified in *S. pyogenes* <SEQ ID 8413> which encodes the amino acid sequence <SEQ ID 8414>. Analysis of this protein sequence reveals the following:

```
Possible site: 27
>>> Seems to have an uncleavable N-term signal seq
----- Final Results -----
   bacterial membrane --- Certainty = 0.0000 (Not Clear) <succ>
     bacterial outside --- Certainty = 0.0000 (Not Clear) <succ>
       bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2958

A DNA sequence (GASx2116) was identified in *S. pyogenes* <SEQ ID 8415> which encodes the amino acid sequence <SEQ ID 8416>. Analysis of this protein sequence reveals the following:

```
Possible site: 56
>>> Seems to have no N-terminal signal sequence
----- Final Results -----
   bacterial cytoplasm --- Certainty = 0.4213 (Affirmative) <succ>
     bacterial membrane --- Certainty = 0.0000 (Not Clear) <succ>
       bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2959

A DNA sequence (GASx2117) was identified in *S. pyogenes* <SEQ ID 8417> which encodes the amino acid sequence <SEQ ID 8418>. Analysis of this protein sequence reveals the following:

```
Possible site: 20
>>> Seems to have no N-terminal signal sequence
----- Final Results -----
   bacterial cytoplasm --- Certainty = 0.3091 (Affirmative) <succ>
     bacterial membrane --- Certainty = 0.0000 (Not Clear) <succ>
       bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2960

A DNA sequence (GASx2118) was identified in *S. pyogenes* <SEQ ID 8419> which encodes the amino acid sequence <SEQ ID 8420>. Analysis of this protein sequence reveals the following:

```
Possible site: 41
>>> Seems to have an uncleavable N-term signal seq
----- Final Results -----
   bacterial membrane --- Certainty = 0.0000 (Not Clear) <succ>
     bacterial outside --- Certainty = 0.0000 (Not Clear) <succ>
       bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2961

A DNA sequence (GASx2119) was identified in *S. pyogenes* <SEQ ID 8421> which encodes the amino acid sequence <SEQ ID 8422>. Analysis of this protein sequence reveals the following:

Possible site: 22
>>> Seems to have no N-terminal signal sequence
----- Final Results -----
   bacterial cytoplasm --- Certainty = 0.2531 (Affirmative) <succ>
      bacterial membrane --- Certainty = 0.0000 (Not Clear) <succ>
         bacterial outside --- Certainty = 0.0000 (Not Clear) <succ>

No corresponding DNA sequence was identified in *S. agalactiae*.

The protein has homology with the following sequences in the GENPEPT database:

```
>GP:AAF63071 GB:AF158600 gp137 [Streptococcus thermophilus
bacteriophage Sfi11]
Identities = 41/121 (33%), Positives = 65/121 (52%), Gaps = 3/121 (2%)

Query:    4    KNAIRKLKEFHRWQRIAN-SLDLTYTELYQFDIEYHPTRR--KHLEISRECALEELDAIR    60
               K  RKL+E+ RW+ IA+ S +   T+ + F       + +++ + R  AL EL+AI
Sbjct:   13    KRCKRKLREYPRWREIAHDSAEQKITQEFTFMPRGGGVNKPVENIAVRRVDALNELEAIE   72

Query:   61    YAINQLSKVEYRQILIECYLISEEKTQQDIMEELNGSQSWYYESKKRALLEFVEFYRDGAL   121
               A+N L + +YR+ILIE YL      K     I + +    ++ + E     ++L F E YRDG L
Sbjct:   73    QAVNGLYRPDYRRILIEKYLAYPPKPNWQIAQSIGFERTAFQELLNNSILAFAELYRDGRL   133
```

Based on this analysis, it was predicted that this GAS-specific protein and its epitopes, could be useful antigens for vaccines or diagnostics.

Example 2962

A DNA sequence (GASx2120) was identified in *S. pyogenes* <SEQ ID 8423> which encodes the amino acid sequence <SEQ ID 8424>. Analysis of this protein sequence reveals the following:

Possible site: 24
>>> Seems to have no N-terminal signal sequence
----- Final Results -----
   bacterial cytoplasm --- Certainty = 0.2666 (Affirmative) <succ>
      bacterial membrane --- Certainty = 0.0000 (Not Clear) <succ>
         bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2963

A DNA sequence (GASx2121) was identified in *S. pyogenes* <SEQ ID 8425> which encodes the amino acid sequence <SEQ ID 8426>. Analysis of this protein sequence reveals the following:

Possible site: 30
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) <succ>
         bacterial cytoplasm --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2964

A DNA sequence (GASx2123R) was identified in *S. pyogenes* <SEQ ID 8427> which encodes the amino acid sequence <SEQ ID 8428>. Analysis of this protein sequence reveals the following:

Possible site: 21
>>> Seems to have no N-terminal signal sequence
----- Final Results -----
   bacterial cytoplasm --- Certainty = 0.3441 (Affirmative) <succ>
      bacterial membrane --- Certainty = 0.0000 (Not Clear) <succ>
         bacterial outside --- Certainty = 0.0000 (Not Clear) <succ>

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2965

A DNA sequence (GASx2132) was identified in *S. pyogenes* <SEQ ID 8429> which encodes the amino acid sequence <SEQ ID 8430>. Analysis of this protein sequence reveals the following:

Possible site: 31
>>> Seems to have an uncleavable N-term signal seq
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>

No corresponding DNA sequence was identified in *S. agalactiae*.

The protein has no significant homology with any sequences in the GENPEPT database.

Example 2966

A DNA sequence (GASx2136) was identified in *S. pyogenes* <SEQ ID 8431> which encodes the amino acid sequence <SEQ ID 8432>. Analysis of this protein sequence reveals the following:

```
Possible site: 30
>>> Seems to have no N-terminal signal sequence
INTEGRAL    Likelihood = -3.19    Transmembrane 57-73 (54-78)
----- Final Results -----
    bacterial membrane --- Certainty = 0.2275 (Affirmative) <succ>
       bacterial outside --- Certainty = 0.0000 (Not Clear) <succ>
          bacterial cytoplasm --- Certainty = 0.0000 (Not Clear) <succ>
```

No corresponding DNA sequence was identified in *S. agalactiae*.

The protein has homology with the following sequences in the GENPEPT database:

```
>GP:AAB18271 GB:U74623 CadX [Staphylococcus lugdunensis]
Identities = 50/110 (45%), Positives = 76/110 (68%)

Query:   11   MKKDSICQVGVINQQNVTTATNYLEKEKVQKSLRILSKFTDNKQINIIFYLLAVEELCVC   70
              M  ++ C V  +++   V   A ++LE +K +K  L  IL  K   D K++ II   L+   +ELCVC
Sbjct:    1   MSYENACDVICVHEDKVNNALSFLEDDKSKKLLNILEKICDEKKLKIILSLIKEDELCVC   60

Query:   71   DIACLLNLSMASASHHLRKLANQNILDTRREGKIIYYFIKDEEIRDFFNQ            120
              DI+ +L +S+AS SHHLR L   ++LD  ++GK+ YYFIKD+EIR+FF++
Sbjct:   61   DISLILKMSVASTSHHLRLLYKNDVLDFYKKGKMAYYFIKDDEIREFFSK            110
```

Based on this analysis, it was predicted that this GAS-specific protein and its epitopes, could be useful antigens for vaccines or diagnostics.

Example 2967

A DNA sequence (GASx2137) was identified in *S. pyogenes* <SEQ ID 8433> which encodes the amino acid sequence <SEQ ID 8434>. Analysis of this protein sequence reveals the following:

```
Possible site: 49
>>> Seems to have no N-terminal signal sequence
----- Final Results -----
    bacterial cytoplasm --- Certainty = 0.4582 (Affirmative) <succ>
       bacterial membrane --- Certainty = 0.0000 (Not Clear) <succ>
          bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2968

A DNA sequence (GASx2139) was identified in *S. pyogenes* <SEQ ID 8435> which encodes the amino acid sequence <SEQ ID 8436>. Analysis of this protein sequence reveals the following:

```
Possible site: 28
>>> Seems to have a cleavable N-term signal seq.
INTEGRAL    Likelihood = -5.89    Transmembrane 63-79 (54-80)
----- Final Results -----
    bacterial membrane --- Certainty = 0.3357 (Affirmative) <succ>
       bacterial outside --- Certainty = 0.0000 (Not Clear) <succ>
          bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2969

A DNA sequence (GASx2141R) was identified in *S. pyogenes* <SEQ ID 8437> which encodes the amino acid sequence <SEQ ID 8438>. Analysis of this protein sequence reveals the following:

```
Possible site: 19
>>> Seems to have no N-terminal signal sequence
----- Final Results -----
    bacterial cytoplasm --- Certainty = 0.4663 (Affirmative) <succ>
       bacterial membrane --- Certainty = 0.0000 (Not Clear) <succ>
          bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2970

A DNA sequence (GASx2142) was identified in *S. pyogenes* <SEQ ID 8439> which encodes the amino acid sequence <SEQ ID 8440>. Analysis of this protein sequence reveals the following:

```
Possible site: 29
>>> Seems to have a cleavable N-term signal seq.
INTEGRAL    Likelihood = -10.08    Transmembrane 143-159 (135-165)
INTEGRAL    Likelihood = -7.64     Transmembrane 53-69 (49-79)
INTEGRAL    Likelihood = -7.17     Transmembrane 252-268 (248-275)
INTEGRAL    Likelihood = -6.74     Transmembrane 186-202 (183-208)
INTEGRAL    Likelihood = -5.63     Transmembrane 220-236 (218-240)
INTEGRAL    Likelihood = -5.26     Transmembrane 116-132 (115-136)
```

```
INTEGRAL   Likelihood = -2.02   Transmembrane 85-101 (85-101)
INTEGRAL   Likelihood = -0.64   Transmembrane 165-181 (165-181)
----- Final Results -----
    bacterial membrane --- Certainty = 0.5034 (Affirmative) <succ>
    bacterial outside --- Certainty = 0.0000 (Not Clear) <succ>
    bacterial cytoplasm --- Certainty = 0.0000 (Not Clear) <succ>
```

No corresponding DNA sequence was identified in S. agalactiae.

The protein has homology with the following sequences in the GENPEPT database:

```
>GP:AAD35257 GB:AE001701 conserved hypothetical protein [Thermotoga maritima]
Identities = 81/275 (29%), Positives = 137/275 (49%), Gaps = 29/275 (10%)

Query:    9  FKGMIIALGFILPGVSGGVLAAILGIYERMISFLAHMRDNFIENVLFFLPVGIG---GIL    65
             F G+++ +  ++PGVSGG +A ++G+YE++I +           ++  +PVG G    G+
Sbjct:    7  FSGVLMGIANVVPGVSGGTIAVLMGVYEKLIESVNSFFHGNSRSLKVLIPVGAGVLVGVF    66

Query:   66  GIALFSFPVEFLLKHYQVSVLWGFAGAIVGTIPSLIKESTKQSQRDKADWLWLVLTFVIS   125
             GIA F  +E  L  Y V   + F G I    I S +K  TK+     K     + + FV+
Sbjct:   67  GIARF---LEIFLSKYPVPTHFFFLGLI---IVSFVK--TKEYFSIKP----VNIFFVLL   114

Query:  126  GLGLYFLNDLIG--TLPANFLTFILAGALIALGVLVPGLSPSNLLLILGLYGPMLIGFKS   183
             G+ L F+    G T   +    +L G + A  ++VPG+S S +LLI G+Y  +L
Sbjct:  115  GMFLIFMLHFSGETTAKESMFLLVLGGFVAATAMVVPGISGSLILLIFGVYDHVLYLVSH   174

Query:  184  LDLLGTFLPIAIGGVLAILAFSKSMDYALQHHHSKVYHFIIGIVLSSTLLILIPNSSSPE   243
             L ++G  L  +IG V  IL    K M++ L+    + Y FI G++L+S L  ++P   +
Sbjct:  175  L-IIGELLIFSIGVVAGILVSVKIMNFLLKRFREETYSFIGGMILAS-LYEVLPKKMNTN   232

Query:  244  SISYSHAGILTWLMAFVLFALGIWLGLWMSQLEEK                           278
             +          L + +   L + LG ++  +E+K
Sbjct:  233  VV----------LPSVLSLVLSLTGFFLLYIEKK                            257
```

Based on this analysis, it was predicted that this GAS-specific protein and its epitopes, could be useful antigens for vaccines or diagnostics.

Example 2971

A DNA sequence (GASx2143R) was identified in S. pyogenes <SEQ ID 8441> which encodes the amino acid sequence <SEQ ID 8442>. Analysis of this protein sequence reveals the following:

```
Possible site: 20
>>> Seems to have no N-terminal signal sequence
----- Final Results -----
    bacterial cytoplasm --- Certainty = 0.3964 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in S. agalactiae.

The protein has homology with the following sequences in the GENPEPT database:

Based on this analysis, it was predicted that this GAS-specific protein and its epitopes, could be useful antigens for vaccines or diagnostics.

Example 2972

A DNA sequence (GASx2144R) was identified in S. pyogenes <SEQ ID 8443> which encodes the amino acid sequence <SEQ ID 8444>. Analysis of this protein sequence reveals the following:

```
Possible site: 17
>>> Seems to have no N-terminal signal sequence
----- Final Results -----
    bacterial cytoplasm --- Certainty = 0.4761 (Affirmative) <succ>
    bacterial membrane --- Certainty = 0.0000 (Not Clear) <succ>
    bacterial outside --- Certainty = 0.0000 (Not Clear) <succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

Example 2973

A DNA sequence (GASx2145) was identified in S. pyogenes <SEQ ID 8445> which encodes the amino acid sequence <SEQ ID 8446>. Analysis of this protein sequence reveals the following:

```
>GP:BAB05000 GB:AP001511 unknown conserved protein in others [Bacillus halodurans]
Identities = 28/78 (35%), Positives = 37/78 (46%)

Query:   44  EVDKVFIVPLRQLLFTDPVYYRLEVTPIETTDFPFDRIRNGKYYQFSQEYRSIPFYENLE   103
             EVD VF VP+   +   P  YR+ V        FP +RI N   YQ S   +  FY
Sbjct:  127  EVDHVFTVPIDHFISHPPEQYRINVHFEPGAGFPIERIANQSAYQKSTRQITESFYYYQS   186

Query:  104  ETIWGMTAQFTKCLTDIL                                            121
              IWG+TA+ + + IL
Sbjct:  187  YVIWGLTAKILRHVITIL                                            204
```

```
Possible site: 25
>>> Seems to have an uncleavable N-term signal seq
INTEGRAL     Likelihood = -4.09      Transmembrane 2-18 (1-19)
----- Final Results -----
  bacterial membrane --- Certainty = 0.2635 (Affirmative) <succ>
    bacterial outside --- Certainty = 0.0000 (Not Clear) <succ>
      bacterial cytoplasm --- Certainty = 0.0000 (Not Clear) <succ>
```

No corresponding DNA sequence was identified in *S. agalactiae*.

The protein has homology with the following sequences in the GENPEPT database:

```
>GP:CAA49519 GB:X69895 X [Bacillus sphaericus]
Identities = 40/97 (41%), Positives = 57/97 (58%), Gaps = 5/97 (5%)

Query:   10   IEFLILAIVEKNDSYGYDISQTIKLVAN----IKESTLYPILKKLEKAGFLTTYSQE-HQ   64
              ++ +IL ++ + D YGY+ISQ I    N    IKE+TLY + ++LEK   + Y +
Sbjct:   11   LDSIILRLILEKDRYGYEISQEISNRTNNSFQIKEATLYAVFQRLEKKEVIEAYYGDVSD  70

Query:   65   GRKRKYYAVTSSGRAQLIFLKKEWQSYKFALDGIIEG                         101
              G KRKYY +TS G+A L   L KEW   K  +D  +EG
Sbjct:   71   GGKRKYYRITSLGKAYLSELVKEWAEVKEIIDLFMEG                         107
```

Based on this analysis, it was predicted that this GAS-specific protein and its epitopes, could be useful antigens for vaccines or diagnostics.

Example 2974

A DNA sequence (GASx2146) was identified in *S. pyogenes* <SEQ ID 8447> which encodes the amino acid sequence <SEQ ID 8448>. Analysis of this protein sequence reveals the following:

```
Possible site: 56
>>> Seems to have no N-terminal signal sequence
INTEGRAL     Likelihood = -14.75   Transmembrane 97-113 (77-143)
INTEGRAL     Likelihood = -6.85    Transmembrane 116-132 (114-143)
INTEGRAL     Likelihood = -5.68    Transmembrane 156-172 (149-175)
INTEGRAL     Likelihood = -5.47    Transmembrane 79-95 (77-96)
----- Final Results -----
  bacterial membrane --- Certainty = 0.6901 (Affirmative) <succ>
    bacterial outside --- Certainty = 0.0000 (Not Clear) <succ>
      bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2975

A DNA sequence (GASx2147) was identified in *S. pyogenes* <SEQ ID 8449> which encodes the amino acid sequence <SEQ ID 8450>. Analysis of this protein sequence reveals the following:

```
Possible site: 31
>>> Seems to have an uncleavable N-term signal seq
INTEGRAL     Likelihood = -7.11      Transmembrane 8-24 (6-30)
----- Final Results -----
  bacterial membrane --- Certainty = 0.3845 (Affirmative) <succ>
    bacterial outside --- Certainty = 0.0000 (Not Clear) <succ>
      bacterial cytoplasm --- Certainty = 0.0000 (Not Clear) <succ>
```

No corresponding DNA sequence was identified in *S. agalactiae*.

The protein has homology with the following sequences in the GENPEPT database:

```
>GP:AAF04457 GB:AF078161 lacunin [Manduca sexta]
Identities = 68/310 (21%), Positives = 117/310 (36%), Gaps = 12/310 (3%)

Query:    55   DIDSSASTITVETGPVQRPTVTYYTHPKLIDPIVTTVTGKTLSLSQTPKDVVITGGIEIL   114
               DI+ + ++ + E+       T++ T  +    TT T  T +S T +  I      +
Sbjct:  1004   DIEGTTASGSTESTFTDETTMSKVTEESSVAEEETTKTTITEEVSGTSESASINSDKTTM  1063

Query:   115   GFTLNNSRQEKNYRSIT--ITVPEKTSLNEVKASNVPHTTLSNLT--VQDMQFDGNLTLL   170
               ++ +         IT   +TV E+TS        TT+S ++  +           T
Sbjct:  1064   TTLSEDTGKTSVSEEITTEMTVTEETSETSPTEGTSDKTTMSTVSEETESSSVTEETTTE  1123

Query:   171   HTKVKKATITGMLEATKSQLTNLELKADYSFSNLTDSSVE-NGTISLGNGQLTTKDTTLK   229
                T V+ AT     E  T S   T +    ++ S      +++ E   T +    T+ K
Sbjct:  1124   TTVVENATDISSTEVTASDKTTMTTMSEESEKTTEEATTEITVTKEVTESSSTETATSDK  1183

Query:   230   AVNIQSLHPGGIE-AERTTLENVTFTVSKSKEEEENDYYDNDAIFTAHALTLKGTNTITG   288
               ++   S    G    AE +T E VT T   +   EE           T+    +T+K T T
Sbjct:  1184   TISTLSEETGKTSVAEESTTEKVTETTVTTMPEETGK------TITSEEITIKTTVTEEP  1237

Query:   289   GDIDVDITLTKAKAIAYRARTENGKVSLGSQLTPAKIGKESTSDVISYVAENKAATGNLT   348
                D+      +T  K    A  E GK S+  + T      E++++    S   A    T     T
Sbjct:  1238   TDVGSSEAITSDKTTVSTASEETGKYSVSEEETVKTTVAEASTEPSSTEAITSDKTKMST  1297
```

```
Query:    349 VNLNKGDITI       358
              ++  G  ++
Sbjct:   1298 ISEETGKTSV      1307
```

Based on this analysis, it was predicted that this GAS-specific protein and its epitopes, could be useful antigens for vaccines or diagnostics.

Example 2976

A DNA sequence (GASx2148R) was identified in *S. pyogenes* <SEQ ID 8451> which encodes the amino acid sequence <SEQ ID 8452>. Analysis of this protein sequence reveals the following:

```
Possible site: 28
>>> Seems to have an uncleavable N-term signal seq
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2977

A DNA sequence (GASx2160) was identified in *S. pyogenes* <SEQ ID 8453> which encodes the amino acid sequence <SEQ ID 8454>. Analysis of this protein sequence reveals the following:

```
Possible site: 29
>>> Seems to have no N-terminal signal sequence
----- Final Results -----
   bacterial cytoplasm --- Certainty = 0.1630 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2978

A DNA sequence (GASx2170R) was identified in *S. pyogenes* <SEQ ID 8455> which encodes the amino acid sequence <SEQ ID 8456>. Analysis of this protein sequence reveals the following:

```
Possible site: 37
>>> Seems to have no N-terminal signal sequence
INTEGRAL     Likelihood = –3.32    Transmembrane 181-197 (175-203)
----- Final Results -----
   bacterial membrane --- Certainty = 0.6328 (Affirmative) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

Based on this analysis, it was predicted that this GAS-specific protein and its epitopes, could be useful antigens for vaccines or diagnostics.

Example 2979

A DNA sequence (GASx2174) was identified in *S. pyogenes* <SEQ ID 8457> which encodes the amino acid sequence <SEQ ID 8458>. Analysis of this protein sequence reveals the following:

```
Possible site: 28
>>> Seems to have an uncleavable N-term signal seq
INTEGRAL     Likelihood = –2.39       Transmembrane 3-19 (3-19)
----- Final Results -----
   bacterial membrane --- Certainty = 0.1956 (Affirmative) <succ>
      bacterial outside --- Certainty = 0.0000 (Not Clear) <succ>
         bacterial cytoplasm --- Certainty = 0.0000 (Not Clear) <succ>
```

No corresponding DNA sequence was identified in *S. agalactiae*.

Based on this analysis, it was predicted that this GAS-specific protein and its epitopes, could be useful antigens for vaccines or diagnostics.

Example 2980

A DNA sequence (GASx2181R) was identified in *S. pyogenes* <SEQ ID 8459> which encodes the amino acid sequence <SEQ ID 8460>. Analysis of this protein sequence reveals the following:

```
Possible site: 24
>>> Seems to have no N-terminal signal sequence
----- Final Results -----
   bacterial cytoplasm --- Certainty = 0.3751 (Affirmative) <succ>
      bacterial membrane --- Certainty = 0.0000 (Not Clear) <succ>
         bacterial outside --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2981

A DNA sequence (GASx2185R) was identified in *S. pyogenes* <SEQ ID 8461> which encodes the amino acid sequence <SEQ ID 8462>. Analysis of this protein sequence reveals the following:

```
Possible site: 26
>>> Seems to have no N-terminal signal sequence
INTEGRAL      Likelihood = -0.90    Transmembrane 18-34 (18-34)
----- Final Results -----
    bacterial membrane --- Certainty = 0.1362 (Affirmative) <succ>
        bacterial outside --- Certainty = 0.0000 (Not Clear) <succ>
            bacterial cytoplasm --- Certainty = 0.0000 (Not Clear) <succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

Example 2982

A DNA sequence (GASx2186R) was identified in *S. pyogenes* <SEQ ID 8463> which encodes the amino acid sequence <SEQ ID 8464>. Analysis of this protein sequence reveals the following:

```
>GP:CAA78948 GB:Z17279 transposase [Streptococcus salivarius]
Identities = 48/87 (55%), Positives = 57/87 (65%)

Query:    1   MNMSNINSTRKSSYSHLSATERGEIAAYLKMGKKPVEIARLLGSHRSTICREIKRGSVDQ    60
              MNMS    ST    SY HLS  ERGEI AYL +G KP EIAR LG +RSTI REI RGS+ Q
Sbjct:    1   MNMSTNYSTTNQSYKHLSEAERGEIEAYLSVGLKPAEIARRLGRNRSTITREINRGSITQ    60

Query:   61   VKDKNGKQTFFNAYFADSRQRVYETNR                                   87
              VK  NG++ ++  Y+AD+    Y  R
Sbjct:   61   VKKVNGQKVYYQHYYADAAHNRYRHAR                                   87
```

```
Possible site: 61
>>> Seems to have no N-terminal signal sequence
----- Final Results -----
    bacterial cytoplasm --- Certainty = 0.4803 (Affirmative) <succ>
        bacterial membrane --- Certainty = 0.0000 (Not Clear) <succ>
            bacterial outside --- Certainty = 0.0000 (Not Clear) <succ>
```

No corresponding DNA sequence was identified in *S. agalactiae*.

The protein has homology with the following sequences in the GENPEPT database:

Based on this analysis, it was predicted that this GAS-specific protein and its epitopes, could be useful antigens for vaccines or diagnostics.

Example 2983

A DNA sequence (GASx2187R) was identified in *S. pyogenes* <SEQ ID 8465> which encodes the amino acid sequence <SEQ ID 8466>. Analysis of this protein sequence reveals the following:

```
Possible site: 50
>>> Seems to have no N-terminal signal sequence
----- Final Results -----
    bacterial cytoplasm --- Certainty = 0.3287 (Affirmative) <succ>
        bacterial membrane --- Certainty = 0.0000 (Not Clear) <succ>
            bacterial outside --- Certainty = 0.0000 (Not Clear) <succ>
```

No corresponding DNA sequence was identified in *S. agalactiae*.

The protein has homology with the following sequences in the GENPEPT database:

Based on this analysis, it was predicted that this GAS-specific protein and its epitopes, could be useful antigens for vaccines or diagnostics.

Example 2984

A DNA sequence <SEQ ID 9013> was identified in *S. agalactiae* which encodes amino acid sequence <SEQ ID 9014>. Analysis of the amino acid sequence reveals the following:

```
>GP:CAA78948 GB:Z17279 transposase [Streptococcus salivarius]

Identities = 48/77 (62%), Positives = 55/77 (71%), Gaps = 1/77 (1%)

Query:    1   VSMKPIDLSKMVSIRKRSKKVMKTNKKTLGKSIEERPEYINDRSEFGHWEIDLALGKKTK    60
              + +K IDL + V IRK+  K    T KK LGKSIEERPE IN+RS FG WEID  LG KT
Sbjct:  150   LEIKVIDLPRAVRIRKKFTKRPST-KKHLGKSIEERPEEINNRSRFGDWEIDSVLGGKTI   208

Query:   61   SEAVMLTLVERQTRYAL                                             77
              E  +LTLVERQTRYA+
Sbjct:  209   GEPSILTLVERQTRYAV                                            225
```

Lipop: Possible site: −1    Crend: 3
McG: Discrim Score: 10.50
GvH: Signal Score (−7.5): −5.2
Possible site: 40
>>> Seems to have an uncleavable N-term signal seq
ALOM program     count: 4     value: −12.26     threshold: 0.0
INTEGRAL      Likelihood = −12.26   Transmembrane 98-114 (94-116)
INTEGRAL      Likelihood = −8.17    Transmembrane 5-21 (1-27)
INTEGRAL      Likelihood = −6.95    Transmembrane 62-78 (57-80)
INTEGRAL      Likelihood = −5.84    Transmembrane 37-53 (30-55)
PERIPHERAL    Likelihood = 17.35    81
modified ALOM score: 2.95
*** Reasoning Step: 3
----- Final Results -----
   bacterial membrane --- Certainty = 0.5904 (Affirmative) <succ>
     bacterial outside --- Certainty = 0.0000 (Not Clear) <succ>
       bacterial cytoplasm --- Certainty = 0.0000 (Not Clear) <succ>

The protein has homology with the following sequences in the databases:

```
ORF01345(292-636 of 951)

PIR|G64646|G64646(56-168 of 205) hypothetical protein HP1015 - Helicobacter pylori (strain 26695)
% Match = 4.4
% Identity = 30.6 % Similarity = 54.1
Matches = 34 Mismatches = 46 Conservative Sub.s = 26

87         117        147        177        207        237        267        297
LSGMGATFVPQTLIHRYLDKECNVYHFHKNKLFSEYIMIYKKDVELSGIALLLYKAFLTK*FR*FY*KSVYFLPKSV*NR
                                                                              |
                  RYFLQNIIHIHQNKELQFIKKCLLGYFFAPLCGAILLVLFIVSSGAKSFQISNLFNN
                   10         20         30         40         50

327        357        381        411        441        471        501
PMIYKIIASLFLVLIPIFSQVL--VKIFKLKKFNIMFPDVAFPIFVFLIPLISSSLLKQNLLPYYLILISLLAIGITI--
 : |  :: ||||   :    :     ::  |: :      | : ||  :  ::   |||:     |   :||:  |::|
QLAYIVLLSLFLCALGFIAGAIGFYRLSKITRHLSFFENFAFSFLAVILCAILSYLV-----PNASNALSLIGNGVSIFY
           70         80         90         100        110        120        130

549        579        606        636        666        696        726        756
--KLLRTKTLFSYKRFLKLFWRSGF-ILTFLFYLGLLVIIFIKVQ*KELDKLNCTPKVRQKI*RLGCFSDEIKL*R*TRN
  || |   :|:: :||    : ||| :|  | | |  || |:
LHKLYRELSLYTQERF----FLSGFRLLLLFSFMLALLGILVQALVIIFLTTAVVLMCVALGFLARAFLNFSQVFLKA
              150        160        170        180        190        200
```

Based on this analysis, it is predicted that this protein from *S. agalactiae*, and its epitopes, could be useful antigens for vaccines and/or diagnostics.

Example 2985

A DNA sequence <SEQ ID 9015> was identified in *S. agalactiae* which encodes amino acid sequence <SEQ ID 9016>. Analysis of the amino acid sequence reveals the following:

Lipop: Possible site:−1    Crend: 10
McG: Discrim Score: 13.20
GvH: Signal Score (−7.5): −2.08
Possible site: 34

-continued

>>> Seems to have a cleavable N-term signal seq.
ALOM program     count: 0     value: 10.45     threshold: 0.0
PERIPHERAL      Likelihood = 10.45    36
modified ALOM score: −2.59
*** Reasoning Step: 3
Final Results
   bacterial outside --- Certainty = 0.3000 (Affirmative) <succ>
     bacterial membrane --- Certainty = 0.0000 (Not Clear) <succ>
       bacterial cytoplasm --- Certainty = 0.0000 (Not Clear) <succ>

The protein has homology with the following sequences in the databases:

```
43.9/72.0% over 56aa
Streptococcus pneumoniae
EGAD|7626| epua protein Insert characterized
SP|Q03159|EPUA_STRPN EPUA PROTEIN. Insert characterized
GP|47373|emb|CAA38133.1||X54225 7 kDa protein Insert characterized
PIR|S10640|S10640 epuA protein - Insert characterized
ORF01809(331-501 of 801)
EGAD|7626|7426(8-64 of 64) epua protein {Streptococcus pneumoniae}SP|Q03159|EPUA_STRPN
EPUA PROTEIN.GP|47373|emb|CAA38133.1||X54225 7 kDa protein {Streptococcus
pneumoniae}PIR|S10640|S10640 epuA protein - Streptococcus pneumoniae
% Match = 10.0
% Identity = 43.9 % Similarity = 71.9
Matches = 25 Mismatches = 16 Conservative Sub.s = 16

171       201       231       261       291       321       351       381
     RSCLLTYELVQL*SWQEWLRKGKQ*LAN*PI*TVVIINSMKN*RLLVLILNV*VRRNMASSGWKYVLKQIGLIVLVILLA
                                                       :    ||:|::  |:::|::|
                                                       MKMNKKSSYVVKRLLLVIIVLILG
                                                                  10        20

411       441       471       501       531       561       591       621
     LLFLAVGLMLGYSVFGDGEHAYSILSLDKWQNIIGKLFGK*KEPL*VI*CL*WFPLRVNFSSRIIQ*QKNKNK*QLRL*L
     |  |  :|||:||  ::| |:  ::|||   |||  :| ||| |
     TLALGIGLMVGYGILGKGQDPWAILSPAKWQELIHKFTGN
                  40        50        60
```

A related DNA sequence <SEQ ID 10507> was identified in GBS which encodes amino acid sequence <SEQ ID 10508>.

SEQ ID 9016 (GBS168) was expressed in *E. coli* as a His-fusion product. SDS-PAGE analysis of total cell extract is shown in FIG. 33 (lane 9; MW 7.6 kDa) and in FIG. 34 (lane 5; MW 7.6 kDa). It was also expressed in *E. coli* as a GST-fusion product. SDS-PAGE analysis of total cell extract is shown in FIG. 42 (lane 2; MW 32.6 kDa).

Based on this analysis, it is predicted that this protein from *S. agalactiae*, and its epitopes, could be useful antigens for vacc Example 2986

A DNA sequence <SEQ ID 9017> was identified in *S. agalactiae* which encodes amino acid sequence <SEQ ID 9018>. Analysis of the amino acid sequence reveals the following:

Lipop: Possible site: −1    Crend: 8
McG: Discrim Score: −2.85
GvH: Signal Score (−7.5): −5.7
Possible site: 21
>>> Seems to have no N-terminal signal sequence
ALOM program    count: 0    value: 5.25    threshold: 0.0
PERIPHERAL    Likelihood = 5.25    103
modified ALOM score: −1.55
*** Reasoning Step: 3
----- Final Results -----
    bacterial cytoplasm --- Certainty = 0.1210 (Affirmative) <succ>
    bacterial membrane --- Certainty = 0.0000 (Not Clear) <succ>
    bacterial outside --- Certainty = 0.0000 (Not Clear) <succ>

The protein has homology with the following sequences in the databases:

```
56.1/72.0% over 131aa
Escherichia coli
EGAD|40237| arsenate reductase Insert characterized
SP|P52147|ARC2_ECOLI ARSENATE REDUCTASE (ARSENICAL PUMP MODIFIER). Edit characterized
GP|1061418|gb|AAB09628.1||U38947 ArsC {Plasmid R46} Insert characterized
ORF00095(304-699 of 1008)
EGAD|40237|42398(1-132 of 141) arsenate reductase {Escherichia coil} SP|P52147|ARC2_ECOLI
ARSENATE REDUCTASE (ARSENICAL PUMP MODIFIER). GP|1061418|gb|AAB09628.1||U38947 ArsC
{Plasmid R46}
% Match = 22.0
% Identity = 56.1 % Similarity = 72.0
Matches = 74 Mismatches = 37 Conservative Sub.s = 21

129       159       189       219       249       279       309       339
     RIHSSLSL*PIFHRKRPYPSRAFRRYFSNSCG*LWC*YCDDWRELLAGLGINFYFLKTLVALKIERKMMEKIRIYHNPNC
                                                                   |   |  |||||:|
                                                                   MSNITIYHNPHC
                                                                             10

369       399       429       459       489       519       549       579
     GTSRNVLAIIRHCGIEPEIIYYLKTPPSRMELVELLLEMKLSARELLRTDVPAYEKFNLESSSVTDEEMIDAMIQDPILI
     ||||  :|:  ||||   :|  ||:||||  ||::|:  :|  : |  |||   :|  ||:: |       ||:::||  |:|  ||||
     GTSRNTLEMIRNSGIEPTVILYLETPPSRDELLKLIADMGISVRALLRKNVEPYEELGLAEDKFTDDQLIDFMLQHPILI
                  30        40        50        60        70        80        90
```

```
609       639       669       699       729       759       789       819
NRPIVVTSKGAKLCRPCEAILTILPVKMEKDFVKEDGQIIQSL*HIV**IMV*EVSK*HY*KKLMRLETFCKQKASQHQN
|||||||   |  |||||  |  :|  |||     :    |  ||||:   :
NRPIVVTPLGTKLCRPSEVVLDILPDAQKAAFTKEDGEKVVDDSGKRLK
               110      120       130      140
```

SEQ ID 9018 (GBS45) was expressed in *E. coli* as a His-fusion product. SDS-PAGE analysis of total cell extract is shown in FIG. 8 (lane 4; MW 18.6 kDa).

The GBS45-His fusion product was purified (FIG. 97A; see also FIG. 191, lane 5) and used to immunise mice (lane 1 product; 20 μg/mouse). The resulting antiserum was used for Western blot (FIG. 97B), FACS (FIG. 97C), and in the in vivo passive protection assay (Table III). These tests confirm that the protein is immunoaccessible on GBS bacteria and that it is an effective protective immunogen.

Based on this analysis, it is predicted that this protein from *S. agalactiae*, and its epitopes, could be useful antigens for vaccines and/or diagnostics.

Example 2987

A DNA sequence <SEQ ID 9019> was identified in *S. agalactiae* which encodes amino acid sequence <SEQ ID 9020>. Analysis of the amino acid sequence reveals the following:

---

Lipop: Possible site: −1          Crend: 3
McG: Discrim Score: 6.84
GvH: Signal Score (−7.5): 2.98
Possible site: 25
>>> Seems to have a cleavable N-term signal seq.
ALOM program      count: 0      value: 13.69      threshold: 0.0
PERIPHERAL        Likelihood = 13.69              77
modified ALOM score: −3.24
*** Reasoning Step: 3

----- Final Results -----
    bacterial outside --- Certainty = 0.3000 (Affirmative) <succ>
        bacterial membrane --- Certainty = 0.0000 (Not Clear) <succ>
        bacterial cytoplasm --- Certainty = 0.0000 (Not Clear)

---

A DNA sequence <SEQ ID 10337> was identified in GBS which encodes amino acid sequence <SEQ ID 10338>. This protein and its epitopes could be useful antigens for vaccines and/or diagnostics.

SEQ ID 9020 (GBS55) was expressed in *E. coli* as a His-fusion product. SDS-PAGE analysis of total cell extract is shown in FIG. 17 (lane 7; MW 11.3 kDa). It was also expressed in *E. coli* as a GST-fusion product. SDS-PAGE analysis of total cell extract is shown in FIG. 33 (lane 5; MW 36.3 kDa).

GBS55-GST was purified as shown in FIG. 197, lane 5.

Figure 161:
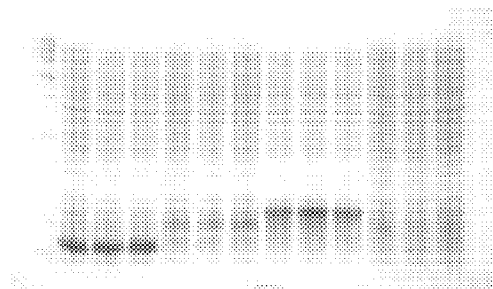

GBS671 was expressed in *E. coli* as a His-fusion product. SDS-PAGE analysis of total cell extract is shown in FIG. 161 (lane 2-4; MW 12 kDa) and in FIG. 188 (lane 2; MW 12 kDa). Purified protein is shown in FIG. 242, lane 3.

Based on this analysis, it is predicted that this protein from *S. agalactiae*, and its epitopes, could be useful antigens for vaccines and/or diagnostics.

Example 2988

A DNA sequence <SEQ ID 9021> was identified in *S. agalactiae* which encodes amino acid sequence <SEQ ID 9022>. Analysis of the amino acid sequence reveals the following:

---

Lipop Possible site: −1          Crend: 3

McG: Discrim Score: −14.35

GvH: Signal Score (−7.5): −2.12

Possible site: 44

>>> Seems to have no N-terminal signal sequence

ALOM program    count: 4     value: −13.90     threshold: 0.0
INTEGRAL        Likelihood = −13.90             Transmembrane 101-117 (92-126)
INTEGRAL        Likelihood = −7.64              Transmembrane 130-146 (125-148)
INTEGRAL        Likelihood = −6.64              Transmembrane 24-40 (20-45)
INTEGRAL        Likelihood = −2.44              Transmembrane 55-71 (55-75)
PERIPHERAL      Likelihood = 17.40              2 modified ALOM score: 3.28

*** Reasoning Step: 3

----- Final Results -----
    bacterial membrane --- Certainty = 0.6562 (Affirmative) <succ>
        bacterial outside --- Certainty = 0.0000 (Not Clear) <succ>
        bacterial cytoplasm --- Certainty = 0.0000 (Not Clear) <succ>

SEQ ID 9022 (GBS215) was expressed in *E. coli* as a GST-fusion product. SDS-PAGE analysis of total cell extract is shown in FIG. 175 (lane 10; MW 45 kDa).

Based on this analysis, it is predicted that this protein from *S. agalactiae*, and its epitopes, could be useful antigens for vaccines and/or diagnostics.

Example 2989

A DNA sequence <SEQ ID 9023> was identified in *S. agalactiae* which encodes amino acid sequence <SEQ ID 9024>. Analysis of the amino acid sequence reveals the following:

```
Lipop Possible site: -1         Crend: 0

McG: Discrim Score: 11.66
GvH: Signal Score (-7.5): -5.3
Possible site: 61
>>> Seems to have an uncleavable N-term signal seq
ALOM program     count: 2       value: -14.12      threshold: 0.0
INTEGRAL         Likelihood = -14.12               Transmembrane 13-29 (5-35)
INTEGRAL         Likelihood = -8.17                Transmembrane 44-60 (39-65)
PERIPHERAL       Likelihood = 39.00                29
modified ALOM score: 3.32
*** Reasoning Step: 3
----- Final Results -----
   bacterial membrane --- Certainty = 0.6647 (Affirmative) <succ>
      bacterial outside --- Certainty = 0.0000 (Not Clear) <succ>
         bacterial cytoplasm --- Certainty = 0.0000 (Not Clear) <succ>
```

Figure 156:
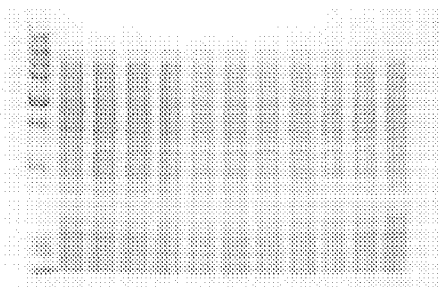

SEQ ID 9024 (GBS217) was expressed in *E. coli* as a GST-fusion product. SDS-PAGE analysis of total cell extract is shown in FIG. 85 (lane 2; MW 36.1 kDa) and in FIG. 156 (lane 1 & 3; MW 36 kDa).

GBS217-GST was purified as shown in FIG. 224, lane 5-6.

Based on this analysis, it is predicted that this protein from *S. agalactiae*, and its epitopes, could be useful antigens for vaccines and/or diagnostics.

Example 2990

A DNA sequence <SEQ ID 9025> was identified in *S. agalactiae* which encodes amino acid sequence <SEQ ID 9026>. Analysis of the amino acid sequence reveals the following:

```
Lipop Possible site: -1         Crend: 10
McG: Discrim Score: 8.20
GvH: Signal Score (-7.5): -3.7
Possible site: 33
>>> Seems to have an uncleavable N-term signal seq
ALOM program     count: 4       value: -9.98       threshold: 0.0
INTEGRAL         Likelihood = -9.98                Transmembrane 22-38 (12-43)
INTEGRAL         Likelihood = -7.80                Transmembrane 61-77 (56-85)
INTEGRAL         Likelihood = -5.20                Transmembrane 121-137 (117-148)
INTEGRAL         Likelihood = -2.97                Transmembrane 99-115 (98-119)
PERIPHERAL       Likelihood = 10.77                5
modified ALOM score: 2.50
*** Reasoning Step: 3
----- Final Results -----
   bacterial membrane --- Certainty = 0.4991 (Affirmative) <succ>
      bacterial outside --- Certainty = 0.0000 (Not Clear) <succ>
         bacterial cytoplasm --- Certainty = 0.0000 (Not Clear) <succ>
```

A related DNA sequence <SEQ ID 10701> was identified in GBS which encodes amino acid sequence <SEQ ID 10702>.

Based on this analysis, it is predicted that this protein from *S. agalactiae*, and its epitopes, could be useful antigens for vaccines and/or diagnostics.

Example 2991

A DNA sequence <SEQ ID 9027> was identified in *S. agalactiae* which encodes amino acid sequence <SEQ ID 9028>. Analysis of the amino acid sequence reveals the following:

```
Lipop Possible site: -1           Crend: 7
McG: Discrim Score: 10.61
GvH: Signal Score (-7.5): -4.21
Possible site: 51
>>> Seems to have an uncleavable N-term signal seq
ALOM program      count: 3        value: -10.99     threshold: 0.0
INTEGRAL          Likelihood = -10.99               Transmembrane 38-54 (33-61)
INTEGRAL          Likelihood = -8.01                Transmembrane 5-21 (1-26)
INTEGRAL          Likelihood = -7.01                Transmembrane 65-81 (60-87)
PERIPHERAL        Likelihood = 13.85                99
modified ALOM score: 2.70
*** Reasoning Step: 3
----- Final Results -----
   bacterial membrane --- Certainty = 0.5394 (Affirmative) <succ>
      bacterial outside --- Certainty = 0.0000 (Not Clear) <succ>
         bacterial cytoplasm --- Certainty = 0.0000 (Not Clear) <succ>
```

Based on this analysis, it is predicted that this protein from *S. agalactiae*, and its epitopes, could be useful antigens for vaccines and/or diagnostics.

Example 2992

A DNA sequence <SEQ ID 9029> was identified in *S. agalactiae* which encodes amino acid sequence <SEQ ID 9030>. Analysis of the amino acid sequence reveals the following:

```
Lipop Possible site: -1           Crend: 10
McG: Discrim Score: -21.39
GvH: Signal Score (-7.5): -1.85
Possible site: 57
>>> Seems to have no N-terminal signal sequence
ALOM program      count: 1        value: -8.44      threshold: 0.0
INTEGRAL          Likelihood = -8.44                Transmembrane 38-54 (36-59)
PERIPHERAL        Likelihood = 19.10                18
modified ALOM score: 2.19
*** Reasoning Step: 3
----- Final Results -----
   bacterial membrane --- Certainty = 0.4376 (Affirmative) <succ>
      bacterial outside --- Certainty = 0.0000 (Not Clear) <succ>
         bacterial cytoplasm --- Certainty = 0.0000 (Not Clear) <succ>
```

Based on this analysis, it is predicted that this protein from *S. agalactiae*, and its epitopes, could be useful antigens for vaccines and/or diagnostics.

Example 2993

A DNA sequence <SEQ ID 9031> was identified in *S. agalactiae* which encodes amino acid sequence <SEQ ID 9032>. Analysis of the amino acid sequence reveals the following:

```
Lipop Possible site: -1          Crend: 5
McG: Discrim Score: 12.87
GvH: Signal Score (-7.5): -3.57
Possible site: 41
>>> Seems to have an uncleavable N-term signal seq
ALOM program      count: 4      value: -10.30   threshold: 0.0
INTEGRAL          Likelihood = -10.30           Transmembrane 69-85 (63-98)
INTEGRAL          Likelihood = -8.65            Transmembrane 4-20 (1-29)
INTEGRAL          Likelihood = -2.07            Transmembrane 96-112 (95-118)
PERIPHERAL        Likelihood = 9.71             113
modified ALOM score: 2.56
*** Reasoning Step: 3
----- Final Results -----
    bacterial membrane --- Certainty = 0.5118 (Affirmative) <succ>
       bacterial outside --- Certainty = 0.0000 (Not Clear) <succ>
          bacterial cytoplasm --- Certainty = 0.0000 (Not Clear) <succ>
```

The protein has homology with the following sequences in the databases:

```
20.1/50.5% over 114aa
Streptococcus pneumoniae
GP|9798572| BlpX protein Insert characterized
ORF02100(316-660 of 999)
GP|9798572|emb|CAC03527.1||AJ276410(9-123 of 132) BlpX protein {Streptococcus pneumoniae}
% Match = 5.0
% Identity = 20.0 % Similarity = 50.4
Matches = 23 Mismatches = 57 Conservative Sub.s = 35
     90         120        150        180        210        240        270        300
LMSLF*DPQVSGEELDKFTVRLDSHRKSNSRG*NQLVIILRLYSQIN*REPNMLVGPFLNKGEHMTQDYICYL*SRGGED

MEV 330        360        390        420        450        480        510        540
MHNILRFLGIVIISAVILFSIGSGYDLTLMKNILLICWSFLFDLLVFVFKQRQTTEVLTWYQVVKQFWLFIKCTILIPIL
   :   |:: :: :|:|:    :|:|  ::::     |: :| ||:  ||::   :     :  :|  :   |:   ||
FNMKYRLFFVIFLSSVLDILLGTFLQISIVSIGWLVLYSGLFEAGVFLLANKGVAVKIKEVDIRNRPKFIFGKTLWFQIL
              20         30         40         50         60         70         80

570        600        630        660        690        720        750        780
VAFIIMKGCLTSISDILIYFYLHLVVVYYTIGMILSLGRIISPEHSMFNKLRK*NELYLKFVFNRADLTICCLPCLS*FF
 :   ::       :     || || |: :|:   :  :||    ::       :: ::  :  :
LLIFLIIKLYLGLDARLILFYGHIFIVFNALMYLLSSSQVSLKKNKLSS
              100        110        120        130
```

Based on this analysis, it is predicted that this protein from *S. agalactiae*, and its epitopes, could be useful antigens for vaccines and/or diagnostics.

Example 2994

A DNA sequence <SEQ ID 9033> was identified in *S. agalactiae* which encodes amino acid sequence <SEQ ID 9034>. Analysis of the amino acid sequence reveals the following:

Lipop Possible site: −1 Crend: 9
McG: Discrim Score: 3.25
GvH: Signal Score (−7.5): −3.39
Possible site: 59
>>> Seems to have an uncleavable N-term signal seq

| | | | |
|---|---|---|---|
| ALOM program | count: 4 | value: −6.64 | threshold: 0.0 |
| INTEGRAL | Likelihood = −6.64 | | Transmembrane 46-62 (43-64) |
| INTEGRAL | Likelihood = −5.15 | | Transmembrane 17-33 (15-34) |
| PERIPHERAL | Likelihood = 11.03 | | 100 | modified ALOM score: 1.83
*** Reasoning Step: 3
----- Final Results -----
bacterial membrane --- Certainty = 0.3654 (Affirmative) <succ>

-continued

```
    bacterial outside --- Certainty = 0.0000 (Not Clear) <succ>
      bacterial cytoplasm --- Certainty = 0.0000 (Not Clear) <succ>
```

The protein has homology with the following sequences in the databases:

```
35.5/63.8% over 127aa
OMNI|NT01BS4455| wall teichoic acid glycosylation protein GtcA
Insert characterized
ORF01715(343-750 of 1053)
OMNI|NT01BS4455(58-185 of 187) wall teichoic acid glycosylation protein GtcA
% Match = 8.0
% Identity = 35.5 % Similarity = 63.7
Matches = 44 Mismatches = 39 Conservative Sub.s = 35

210       240       270       300       330       360       390       411
GN*ASRVV*NNLLSISQTKSKAKLMGDFLITLKHP*YNKNMVKLKSLLKKSIQNEVSLYLLFGLLTSLLYLV---IRQGI
 : :       :      : :|  |         : :    |: :|:: |::|::: :      |   |
PRRNHQTIICIGPASHLPQLFRRTLGIFYFRQRAREAKNFEKFFRKRGTSVKYREIIMYIIMGVFTTIVNIASFYILVEI
           20        30        40        50        60        70        80

441       471       501       531       549       579       609       639
FNFSQDAPFSAIVANIIAILFAFFTNDRFVFKQTKIEQLQRL----QTFVIARLGTLGLDLILAVIFVDQFPSIIGQFVQ
 |    |   : : | |:::||| :  ||  :||:|  |  ||  |    |: :||:|| : :|:| ||
MNVDYKA--ATVAAWILSVLFAYITNKLYVFQQ-KTHDLQSLLKELTAFFSVRVLSLGIDLGMMIILVGQF---------
           100       110       120       130       140       150

669       690       720       750       780       810       840       870
HNLNKINTIESL---VSQILIILLNYILSKFVIFKDKKRQL*QELSFLIFLLWIFG*ET*YLHALIQFFLSQFLERWHSV
     ||  |:|     :    :|:::||: ||:::||   |  :
------NTNETLAKILDNAVIVVVNYVASKWLVFKKTKEEGV
           160       170       180
```

Figure 63:
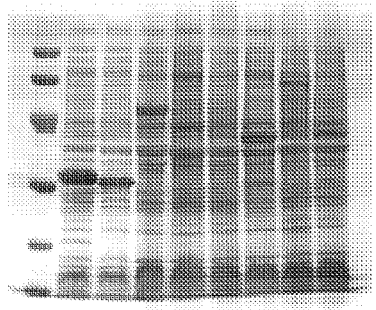

SEQ ID 9034 (GBS283) was expressed in *E. coli* as a GST-fusion product. SDS-PAGE analysis of total cell extract is shown in FIG. 63 (lane 8; MW 67.6 kDa).

Based on this analysis, it is predicted that this protein from *S. agalactiae*, and its epitopes, could be useful antigens for vaccines and/or diagnostics.

Example 2995

A DNA sequence <SEQ ID 9035> was identified in *S. agalactiae* which encodes amino acid sequence <SEQ ID 9036>. Analysis of the amino acid sequence reveals the following:

```
Lipop Possible site: -1   Crend: 2
SRCFLG: 0
McG: Length of UR: 22
Peak Value of UR: 3.86
Net Charge of CR: 2
McG: Discrim Score: 16.84
GvH: Signal Score (-7.5): -4.38
Possible site: 21
>>> Seems to have an uncleavable N-term signal seq
Amino Acid Composition: calculated from 1
ALOM program    count: 1 value: -12.37 threshold: 0.0
INTEGRAL     Likelihood = -12.37   Transmembrane 7-23 (1-26)
PERIPHERAL   Likelihood = 12.84    64
modified ALOM score: 2.97
icm1 HYPID: 7 CFP: 0.595
*** Reasoning Step: 3
----- Final Results -----
    bacterial membrane --- Certainty = 0.5946 (Affirmative) <succ>
      bacterial outside --- Certainty = 0.0000 (Not Clear) <succ>
        bacterial cytoplasm --- Certainty = 0.0000 (Not Clear) <succ>
```

SEQ ID 9036 (GBS286) was expressed in *E. coli* as a His-fusion product. SDS-PAGE analysis of total cell extract is shown in FIG. 52 (lane 11; MW 16.4 kDa). It was also expressed in *E. coli* as a GST-fusion product. SDS-PAGE analysis of total cell extract is shown in FIG. 59 (lane 2; MW 41.3 kDa) and in FIG. 63 (lane 9; MW 41.4 kDa).

Figure 274:
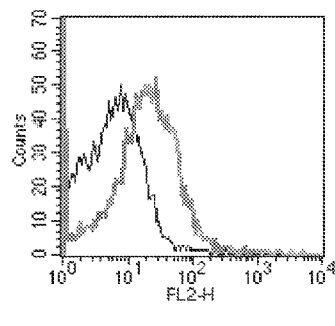

The GBS286-GST fusion product was purified (FIG. 210, lane 9; FIG. 225, lane 9) and used to immunise mice. The resulting antiserum was used for FACS (FIG. 274), which confirmed that the protein is immunoaccessible on GBS bacteria.

Figure 139:
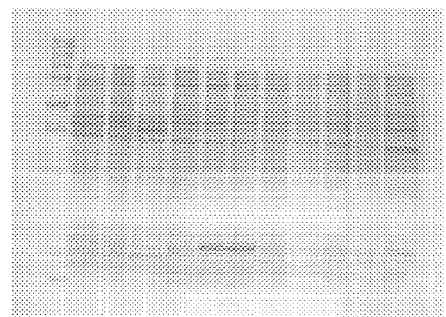

GBS668 was expressed in *E. coli* as a GST-fusion product. SDS-PAGE analysis of total cell extract is shown in FIG. 139 (lane 2-4; MW 43.5 kDa) and in FIG. 187 (lane 6; MW 43 kDa). It was also expressed in *E. coli* as a His-fusion product. SDS-PAGE analysis of total cell extract is shown in FIG. 139 (lane 6 & 7; MW 18.6 kDa) and in FIG. 179 (lane 12; MW 19 kDa).

GBS668-GST was purified as shown in FIG. 237 (lane 10). GBS668-His was purified as shown in FIG. 231 (lanes 5 & 6).

Figure 162:
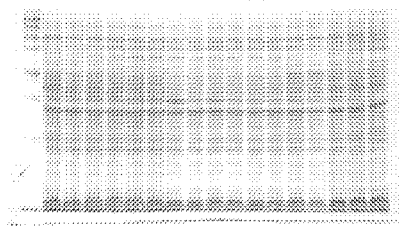

GBS673 was expressed in *E. coli* as a His-fusion product. SDS-PAGE analysis of total cell extract is shown in FIG. 161 (lane 8-10; MW 17 kDa) and in FIG. 188 (lane 4; MW 17 kDa). It was also expressed in *E. coli* as a GST-fusion product. SDS-PAGE analysis of total cell extract is shown in FIG. 162 (lane 8; MW 41.5 kDa) and in FIG. 239 (lane 7; MW 41 kDa). Purified GBS673-His is shown in FIG. 242, lane 5. Purified GBS673-GST is shown in FIG. 246, lane 2.

Based on this analysis, it is predicted that this protein from *S. agalactiae*, and its epitopes, could be useful antigens for vaccines and/or diagnostics.

Example 2996

A DNA sequence <SEQ ID 9037> was identified in *S. agalactiae* which encodes amino acid sequence <SEQ ID 9038>. Analysis of the amino acid sequence reveals the following:

Lipop: Possible site: −1   Crend: 6
McG: Discrim Score: −18.42
GvH: Signal Score (−7.5): −6.16
Possible site: 57
>>> Seems to have no N-terminal signal sequence
ALOM program   count: 2 value: −8.49 threshold: 0.0
INTEGRAL      Likelihood = −8.49   Transmembrane  51-67 (44-95)
INTEGRAL      Likelihood = −3.08   Transmembrane  70-86 (68-95)
PERIPHERAL    Likelihood = 12.89   32
modified ALOM score: 2.20
*** Reasoning Step: 3
----- Final Results -----
   bacterial membrane --- Certainty = 0.4397 (Affirmative) <succ>

Lipop: Possible site: −1   Crend: 8
McG: Discrim Score: −15.47
GvH: Signal Score (−7.5): −6.21
Possible site: 14
>>> Seems to have no N-terminal signal sequence
ALOM program   count: 2 value: −3.61 threshold: 0.0
INTEGRAL      Likelihood = −3.61   Transmembrane  94-110 (94-111)
INTEGRAL      Likelihood = −1.70   Transmembrane  75-91 (75-91)
PERIPHERAL    Likelihood = 5.94    139
modified ALOM score: 1.22
*** Reasoning Step: 3
----- Final Results -----
   bacterial membrane --- Certainty = 0.2444 (Affirmative) <succ>
       bacterial outside --- Certainty = 0.0000 (Not Clear) <succ>
           bacterial cytoplasm --- Certainty = 0.0000 (Not Clear) <succ>

The protein has homology with the following sequences in the databases:

```
ORF01481(394-720 of 1065)
GP|9657521|gb|AAF96047.1||AE004354(16-121 of 243) uridine phosphorylase {Vibrio cholerae}
% Match = 5.3
% Identity = 28.0 % Similarity = 48.6
Matches = 30 Mismatches = 54 Conservative Sub.s = 22
       150       180       210       240       270       300       330       360
V*KHMV*AI*YGNLP*KW*IVPLSIFIFANLTLPFKFH*VKIEKIFLTR**NIVN*GLKEMLMIINSFDNSRKAIINPED

MSIQ 390       420       450       480       510       540       570       600
INSPIKGFPKTVITCFARETFNRILEELPHREIARTSVANLEIPIYELEFKGQKIGFFNAYVGASACVAILEDIIVFGME
           |:  |      |||    |  :  |      |    ::  ||:  |  |    :    :||  :  :   :|::        |   :
PHIHVAQVAPRVVVCGEPNRANRIASLLNNAE---LVAENREYRLFSGEFEEQPITVCSTGIGAPSMIIAVEELARSGAK
            20         30           40          50         60        70        80

630       660       690       720       750       780       810       840
SLIVFGTCGVLDSSIEETSIIIPRSAIRDEGTSFHYSEASSEIAVNTNSIFLLCG*FRCRSMGSKIFRK*RGFRKER*NC
:::   |:  |  :  |  |        :|:     |:||||  |    |      |
AIVRVGSAGAMQSEIGLGELILVEGAVRDEGGSKAYIGAAYPAYSSFELVVEMQRFLAEQSVPIHRGIVRSHDSFYTDEE
             100         110          120         130        140       150        160
```

-continued bacterial outside --- Certainty = 0.0000 (Not Clear) <succ>
       bacterial cytoplasm --- Certainty = 0.0000 (Not Clear) <succ>

SEQ ID 9038 (GBS386) was expressed in *E. coli* as a His-fusion product. SDS-PAGE analysis of total cell extract is shown in FIG. 70 (lane 2; MW 14 kDa). It was also expressed in *E. coli* as a GST-fusion product. SDS-PAGE analysis of total cell extract is shown in FIG. 72 (lane 8; MW 39.5 kDa).

GBS386-GST was purified as shown in FIG. 213, lane 8.

Based on this analysis, it is predicted that this protein from *S. agalactiae*, and its epitopes, could be useful antigens for vaccines and/or diagnostics.

Example 2997

A DNA sequence <SEQ ID 9039> was identified in *S. agalactiae* which encodes amino acid sequence <SEQ ID 9040>. Analysis of the amino acid sequence reveals the following:

SEQ ID 9040 (GBS388) was expressed in *E. coli* as a His-fusion product. SDS-PAGE analysis of total cell extract is shown in FIG. 70 (lane 3; MW 21 kDa). It was also expressed in *E. coli* as a GST-fusion product. SDS-PAGE analysis of total cell extract is shown in FIG. 72 (lane 9; MW 45.6 kDa).

Figure 311:
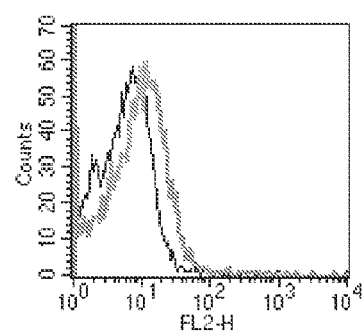

The GBS388-GST fusion product was purified (FIG. 213, lane 10) and used to immunise mice. The resulting antiserum was used for FACS (FIG. 311), which confirmed that the protein is immunoaccessible on GBS bacteria.

Based on this analysis, it is predicted that this protein from *S. agalactiae*, and its epitopes, could be useful antigens for vaccines and/or diagnostics.

Example 2998

A DNA sequence <SEQ ID 9041> was identified in *S. agalactiae* which encodes amino acid sequence <SEQ ID 9042>. Analysis of the amino acid sequence reveals the following:

Lipop: Possible site: −1  Crend: 9
McG: Discrim Score: −11.81
GvH: Signal Score (−7.5): −7.49
Possible site: 25
>>> Seems to have no N-terminal signal sequence
ALOM program  count: 1 value: −5.68 threshold: 0.0
INTEGRAL     Likelihood = −5.68   Transmembrane 78-94 (77-95)
PERIPHERAL   Likelihood = 4.61    134
modified ALOM score: 1.64
*** Reasoning Step: 3
----- Final Results -----
   bacterial membrane --- Certainty = 0.3272 (Affirmative) <succ>
     bacterial outside --- Certainty = 0.0000 (Not Clear) <succ>
       bacterial cytoplasm --- Certainty = 0.0000 (Not Clear) <succ>

The protein has homology with the following sequences in the databases:

```
ORF01912(307-720 of 1056)
GP|3845252|gb|AAC71927.1||AE001412(81-242 of 244) hypothetical protein {Plasmodium
falciparum} PIR|D71608|D71608 hypothetical protein PFB0690w - malaria parasite
(Plasmodium falciparum)
% Match = 4.0
% Identity = 31.2 % Similarity = 53.5
Matches = 45 Mismatches = 58 Conservative Sub.s = 32

231       261       291            348       378       405
KKGRFLIDLYCNVMNFKNSKIA*NQCFDV**RVVNHLLN-LSKENIAKIDFDFLNEALNA-NIRLKELVDELKISK----
            ||  |  |  ::  :  |:  |     |     :    :|| |  |  || |
KYNELQSLLSKEEEKYDFVKNELGDLQKQKDLLKWHLCNNIKKLSMKRSDYKFKTETKSLESKLKSLKDMNKIHKFEHD
            60        70        80        90       100       110       120

450       480       501       531       558       588       618
----------ELDSKGWSKKDSRTIKILYDGLINK---HIVSLDRADYNII-QVIPFANVHVLLFLIPERENSKNYRIY
          ||::|  :  | |    |: ::: |||  ::  :  :: :       |     |:||  ::||:||| |
TLEELVHKMEQELETKMYIKND---IENIFNECINKKDEYLKDITQERISVFKERKKRQNQLQKLLLIMKQENNKNYNIN
       140       150       160       170       180       190       200

648       672       693       720       750       780       810       840
NYSDYEMELINE--DRQQFSKYET---VDL-DQLILVDIFNIDDYISSYLTI*DIENLDLGLLKLINYADNKSDRHILQT
||   |:||        :  :   :||      :||   |  |::
YLKKYESNLMNEINSYKNYKDFETKIAMDLIDDHSLNDLYVT
         220       230       240
```

A related DNA sequence <SEQ ID 10589> was identified in GBS which encodes amino acid sequence <SEQ ID 10590>.

SEQ ID 9042 (GBS408) was expressed in *E. coli* as a His-fusion product. SDS-PAGE analysis of total cell extract is shown in FIG. 76 (lane 6; MW 20.4 kDa). It was also expressed in *E. coli* as a GST-fusion product. SDS-PAGE analysis of total cell extract is shown in FIG. 171 (lane 5; MW 45.3 kDa).

GBS408-GST was purified as shown in FIG. 218, lane 9.

Based on this analysis, it is predicted that this protein from *S. agalactiae*, and its epitopes, could be useful antigens for vaccines and/or diagnostics.

Example 2999

A DNA sequence <SEQ ID 9043> was identified in *S. agalactiae* which encodes amino acid sequence <SEQ ID 9044>. Analysis of the amino acid sequence reveals the following:

Lipop: Possible site: −1  Crend: 9
McG: Discrim Score: −9.62
GvH: Signal Score (−7.5): −4.84
Possible site: 61
>>> Seems to have no N-terminal signal sequence
ALOM program  count: 2 value: −11.09 threshold: 0.0
INTEGRAL     Likelihood = −11.09  Transmembrane 45-61 (37-72)
INTEGRAL     Likelihood = −8.60   Transmembrane 76-92 (70-97)

-continued

PERIPHERAL   Likelihood = 11.62   95
modified ALOM score: 2.72
*** Reasoning Step: 3
----- Final Results -----
   bacterial membrane --- Certainty = 0.5437 (Affirmative) <succ>
     bacterial outside --- Certainty = 0.0000 (Not Clear) <succ>
       bacterial cytoplasm --- Certainty = 0.0000 (Not Clear) <succ>

The protein has homology with the following sequences in the databases:

```
ORF01977(442-627 of 948)
EGAD|88220|96064(204-583 of 751) hypothetical 848 kDa protein f23f125 in chromosome iii
{Caenorhabditis elegans} SP|P46501|YLX5_CAEEL HYPOTHETICAL 84.8 KDA PROTEIN F23F12.5 IN
CHROMOSOME III. GP|529214|gb|AAA20607.1||U12965 F23F12.5 gene product {Caenorhabditis
elegans}
Match = 4.6
% Identity = 35.9 % Similarity = 59.4
Matches = 23 Mismatches = 24 Conservative Sub.s = 15
192       222       252       282       312       342       372       402
DFVSSFFIS*SQTNYNRISFLLKLAKHQLECLNNVAQGLSV**YSSMKDYINRILHFIKEHMTYHVNFIDDFLDIKWEKV
```

-continued

```
VTLSAYFPFTITVERYYAMNKSEKYEKMPIILGPLFVLFIVKLELKIKDKVTLFQVIVNFGVIFQIYKNETFSHGDVAFS
        120       130       140       150       160       170       180       190

432       462       492       522       552
SNIHLRFWTTIIAYLVIFILSISTVILNLVLLFQGFLTQNPIIYLLFFITLVCAFY----------------------~~~~
        |:|:|::::   |::|||||    ||   |   :|  ||:       |:
LYPPGTAEKVFTFYVVLFLINLLDVMFNLVLLQMSFLNTNRFHWLCFFLWQFALFFCCQQIFSIFYNFSPGLSCDD~~~~
        200       210       220       230       240       250       260

600       627       657       687       717       747
------------------FAYKFITYTPTIVKNAL-QYIKKLKNV*NNKVICTLTLYQLCFRVFFHTKITKKDSYLTI
                  |::  ||  |:   :    |   ||
AGNFYLSQFVSGAVTAFAKIFVFLLDTYVPSFDRRRLHQYPQIAMILCYCVIMVLMILPESDCGSQGSRDLAIIIINIIG
                  560       570       580       590       600       610       620
```

SEQ ID 9044 (GBS411) was expressed in E. coli as a His-fusion product. SDS-PAGE analysis of total cell extract is shown in FIG. 78 (lane 2; MW 16 kDa).

Based on this analysis, it is predicted that this protein from S. agalactiae, and its epitopes, could be useful antigens for vaccines and/or diagnostics.

Example 3000

A DNA sequence <SEQ ID 9045> was identified in S. agalactiae which encodes amino acid sequence <SEQ ID 9046>. Analysis of the amino acid sequence reveals the following:

Lipop: Possible site: −1   Crend: 6
McG: Discrim Score: −17.94
GvH: Signal Score (−7.5): −4.63
Possible site: 45
>>> Seems to have no N-terminal signal sequence
ALOM program   count: 1 value: −6.10 threshold: 0.0
INTEGRAL       Likelihood = −6.10   Transmembrane 31-47 (26-49)
PERIPHERAL     Likelihood = 15.33   3
modified ALOM score: 1.72
*** Reasoning Step: 3
----- Final Results -----
    bacterial membrane --- Certainty = 0.3442 (Affirmative) <succ>
        bacterial outside --- Certainty = 0.0000 (Not Clear) <succ>
            bacterial cytoplasm --- Certainty = 0.0000 (Not Clear) <succ>

The protein has homology with the following sequences in the databases:

SEQ ID 9046 (GBS412) was expressed in E. coli as a GST-fusion product. SDS-PAGE analysis of total cell extract is shown in FIG. 171 (lane 6; MW 36 kDa). Purified GBS412-GST is shown in FIG. 218, lane 10-11.

Based on this analysis, it is predicted that this protein from S. agalactiae, and its epitopes, could be useful antigens for vaccines and/or diagnostics.

Example 3001

A DNA sequence <SEQ ID 9047> was identified in S. agalactiae which encodes amino acid sequence <SEQ ID 9048>. Analysis of the amino acid sequence reveals the following:

Lipop: Possible site: −1   Crend: 0
McG: Discrim Score: 3.67
GVH: Signal Score (−7.5): −3.62
Possible site: 41
>>> Seems to have an uncleavable N-term signal seq
ALOM program   count: 5 value: −7.27 threshold: 0.0
INTEGRAL       Likelihood = −7.27   Transmembrane 48-64 (32-68)
INTEGRAL       Likelihood = −6.26   Transmembrane 87-103 (85-105)
INTEGRAL       Likelihood = −6.21   Transmembrane 29-45 (26-46)
INTEGRAL       Likelihood = −3.29   Transmembrane 110-126 (109-130)
INTEGRAL       Likelihood = −2.87   Transmembrane 2-18 (1-18)
PERIPHERAL     Likelihood = 4.24    66
modified ALOM score: 1.95
*** Reasoning Step: 3
----- Final Results -----
    bacterial membrane --- Certainty = 0.3909 (Affirmative) <succ>
        bacterial outside --- Certainty = 0.0000 (Not Clear) <succ>
            bacterial cytoplasm --- Certainty = 0.0000 (Not Clear) <succ>

```
ORF01982(313-501 of 801)
GP|2444082|gb|AAC79518.1||U88974(93-156 of 156) ORF2 {Streptococcus thermophilus
temperate bacteriophage O1205} PIR|T13290|T13290 hypothetical protein 2 -
Streptococcus phage phi-O1205
% Match = 11.5
% Identity = 48.4 % Similarity = 59.4
Matches = 31 Mismatches = 25 Conservative Sub.s = 7

174       204       234       264       294       324       254       384
DVDQNIESHKLFKRHFV*RAILPQSKRK*EN**LCVISEPR*KLKSKLGELKMGFFAQRCPYCQSTKVQFMNQDRKGFNG
                                          |  :|||||:||  |:||   ||   ||  |:
LLMFVGVALLFARLFWEIKHPMTKEQKEQLKIERAKAKEEFRKSRNEFKKAMAEARAVKCPYCKSTDVEFMVQQRKSFSI
        50        60        70        80        90       100       110

414       441       471       501       531       561       591       621
CVGCIGFLIAWPF-LLLGLVGKKGKNNWHCTNCGRTFKTK*KSPTLKFCPRRA*GKF*YSKNLLFGRGFYHTYFNRK*GI
      | ::         | |: |||||   ||| |||   | ||
GKAAAGTIMTGGVGALAGFAGKKGKKEWHCKNCGAVFTTK
        130       140       150
```

The protein has homology with the following sequences in the databases:

```
ORF01286(304-672 of 993)
GP|8272442|dbj|BAA96471.1||AB036428(90-212 of 218) type IV prepilin peptidase
homologue {Streptococcus mutans}
% Match = 16.8
% Identity = 46.3 % Similarity = 72.4
Matches = 57 Mismatches = 34 Conservative Sub.s = 32

102       132       162       192       222       252       282       312
*RRLPI*T*IPNFFKRFCTSNKTFIYEF*QKTIQFSRKSATAC*LSL*R*TDYL**KS*SLFYHFSNININYKKDFMIMS
                                                                            : : :
LGSFFGLVVDRYPQKSIIFPRSHCNKCYNCLTMRDLIPIFSRIINKNSCRFCGYPIPLRYSLVELLCGLISTGFALDLLT
              30        40        50        60        70        80        90

342       372       402       432       462       492       522       552
TIYFISLCMSFILSYYDIKYQEYPIFLWILFTISTIILTPITKVSIVLCLFGILAEVVDINIGSGDFLYLATIGLSLPLH
|     |  |  :|| ||::  |  ||:  ||| ||    :  :  |:   :|::|  ||||:|  : :||||||||:||||:  ||| |:
TSQVCLLFMGVLLSLYDLQDQSYPLTLWIGFTFLLMFIYPLNLISLILFLGFIGAALKNINIGSGDFFYLATLALSLNLQ
              110       120       130       140       150       160       170

582       612       642       672       702       732       762       792
QMLFIIQIGAWLGIIYCLVMRKMKKTIAFLPFLSIAYIIVTSYSLLF*SL*IIRKVIKLWVLVAFWIFRMTNCTTKINHG
|:::||||  :  |||:|  |:  :| |:   ||:|||  :  ::|:
QIIWIIQIASLLGILYSLLFQKHKEPFAFVPFLFLGHLIIIFSHLI
              190       200       210
```

Based on this analysis, it is predicted that this protein from *S. agalactiae*, and its epitopes, could be useful antigens for vaccines and/or diagnostics.

Example 3002

A DNA sequence <SEQ ID 9049> was identified in *S. agalactiae* which encodes amino acid sequence <SEQ ID 9050>. Analysis of the amino acid sequence reveals the following:

```
Lipop: Possible site: -1   Crend: 2
McG: Discrim Score: 10.43
GvH: Signal Score (-7.5): -4.39
Possible site: 54
>>> Seems to have an uncleavable N-term signal seq
```

```
ALOM program    count: 4 value: -10.30 threshold: 0.0
INTEGRAL    Likelihood = -10.30    Transmembrane 62-78 (59-84)
INTEGRAL    Likelihood = -6.10     Transmembrane 4-20 (1-22)
INTEGRAL    Likelihood = -4.25     Transmembrane 128-144 (123-145)
INTEGRAL    Likelihood = -3.13     Transmembrane 88-104 (87-104)
PERIPHERAL  Likelihood = 2.01      109
modified ALOM score: 2.56
*** Reasoning Step: 3
----- Final Results -----
    bacterial membrane --- Certainty = 0.5118 (Affirmative) <succ>
    bacterial outside --- Certainty = 0.0000 (Not Clear) <succ>
    bacterial cytoplasm --- Certainty = 0.0000 (Not Clear) <succ>
```

The protein has homology with the following sequences in the databases:

```
SP|Q48729|LSPA_LACLC(1-149 of 150) LIPOPROTEIN SIGNAL PEPTIDASE (EC 3.4.23.36)
(PROLIPOPROTEIN SIGNAL PEPTIDASE) (SIGNAL PEPTIDASE II) (SPASE II).
% Match = 16.3
% Identity = 40.7 % Similarity = 66.0
Matches = 61 Mismatches = 50 Conservative Sub.s = 38

180       210       240       270       300       330       360       390
EWYHCYSIRRSSR*PNDLYQTKRS*FISDGFKICCCYGRVF*GI*FIGEVMRKIIIPIITILLIALDQLSKLWIVKHIEL
                                               |:|:: :|  ::  |  ||:  |  |:|  :|:|
                                               MKKLLSLVIIVVGIIADQVFKNWVVANIQL
                                                        10        20        30

420       450       480       510       540       570       600       630
NQIKEFIPNIVSLTYLRNYGAAFSILQNQQWLFTLITIFVVGVAIIYLMKHINGSYWLLISLTLIISGGLGNFIDRLRLG
|:   |:::||||::|  |||:|  :    ||:| ::: |:  ||: :|    |    |:   ||||:|  |||::  |:|  |
GDTKKIWPDVLSLTYIKNDGAAWSSFSGQQWFFLVLTPIVLIVALWFLWKK-MGQNWYFAGLTLIIAGALGNLLTRVRQG
              40        50        60        70        80        90        100

660       690       720       750       780       810       840       870
YVVDMVHLDFINFAIFNVADSYLTIGIICLMIALWKEESNGNHN*NSRS*AR*SFSG*F*TVA*SS**RN*KRDCVSKWT
:||||         :|  |||:||   |::|  :   |  ||:   ::
FVVDMFXNRIYDFPIFNIADILLSVGFVVLFIAILTDKETK
              120       130       140       150
```

There is also homology to SEQ ID 7750.

Based on this analysis, it is predicted that this protein from *S. agalactiae*, and its epitopes, could be useful antigens for vacc

Example 3003

A DNA sequence <SEQ ID 9051> was identified in *S. agalactiae* which encodes amino acid sequence <SEQ ID 9052>. Analysis of the amino acid sequence reveals the following:

```
Lipop: Possible site: -1    Crend: 7
McG: Discrim Score: 13.24
GvH: Signal Score (-7.5): -2.18
Possible site: 19
>>> Seems to have a cleavable N-term signal seq.
ALOM program    count: 0 value: 2.01 threshold: 0.0
PERIPHERAL      Likelihood = 2.01    21
modified ALOM score: -0.90
*** Reasoning Step: 3
----- Final Results -----
    bacterial outside --- Certainty = 0.3000 (Affirmative) <succ>
        bacterial membrane --- Certainty = 0.0000 (Not Clear) <succ>
            bacterial cytoplasm --- Certainty = 0.0000 (Not Clear) <succ>
```

The protein has no homology with any sequences in the databases.

SEQ ID 9052 (GBS138) was expressed in *E. coli* as a His-fusion product. SDS-PAGE analysis of total cell extract is shown in FIG. 19 (lane 2; MW 15 kDa)

GBS672 was expressed in *E. coli* as a His-fusion product. SDS-PAGE analysis of total cell extract is shown in FIG. 161 (lane 5-7; MW 15 kDa) and in FIG. 188 (lane 3; MW 15 kDa). Purified protein is shown in FIG. 242, lane 4.

Based on this analysis, it is predicted that this protein from *S. agalactiae*, and its epitopes, could be useful antigens for vaccines and/or diagnostics.

Example 3004

A DNA sequence <SEQ ID 9053> was identified in *S. agalactiae* which encodes amino acid sequence <SEQ ID 9054>. Analysis of the amino acid sequence reveals the following:

```
Lipop: Possible site: -1    Crend: 8
McG: Discrim Score: 18.01
GvH: Signal Score (-7.5): -2.35
Possible site: 26
>>> Seems to have a cleavable N-term signal seq.
ALOM program    count: 0 value: 14.80 threshold: 0.0
PERIPHERAL      Likelihood = 14.80    51
modified ALOM score: -3.46
*** Reasoning Step: 3
----- Final Results -----
    bacterial outside --- Certainty = 0.3000 (Affirmative) <succ>
        bacterial membrane --- Certainty = 0.0000 (Not Clear) <succ>
            bacterial cytoplasm --- Certainty = 0.0000 (Not Clear) <succ>
```

SEQ ID 9054 (GBS143) was expressed in *E. coli* as a GST-fusion product. SDS-PAGE analysis of total cell extract is shown in FIG. 23 (lane 2; MW 33.5 kDa).

Based on this analysis, it is predicted that this protein from *S. agalactiae*, and its epitopes, could be useful antigens for vaccines and/or diagnostics.

Example 3005

A DNA sequence <SEQ ID 9055> was identified in *S. agalactiae* which encodes amino acid sequence <SEQ ID 9056>. Analysis of the amino acid sequence reveals the following:

```
Lipop Possible site: -1    Crend: 0
McG: Discrim Score: 7.43
GvH: Signal Score (-7.5): -6.25
Possible site: 41
>>> Seems to have an uncleavable N-term signal seq
ALOM program    count: 1 value: -10.77 threshold: 0.0
INTEGRAL        Likelihood = -10.77  Transmembrane 2-18 (1-20)
PERIPHERAL      Likelihood = 5.14    29
modified ALOM score: 2.65
*** Reasoning Step: 3
----- Final Results -----
    bacterial membrane --- Certainty = 0.5310 (Affirmative) <succ>
        bacterial outside --- Certainty = 0.0000 (Not Clear) <succ>
            bacterial cytoplasm --- Certainty = 0.0000 (Not Clear) <succ>
```

SEQ ID 9056 (GBS229) was expressed in *E. coli* as a GST-fusion product. SDS-PAGE analysis of total cell extract is shown in FIG. 55 (lane 3; MW 35.9 kDa).

GBS229-GST was purified as shown in FIG. 206, lane 5.

Based on this analysis, it is predicted that this protein from *S. agalactiae*, and its epitopes, could be useful antigens for vaccines and/or diagnostics.

Example 3006

A DNA sequence <SEQ ID 9183> was identified in GAS which encodes amino acid sequence <SEQ ID 9184>. Analysis of the amino acid sequence reveals the following:

```
Possible site: 29
>>> Seems to have a cleavable N-term signal seq.
----- Final Results -----
    bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3007

A DNA sequence <SEQ ID 9185> was identified in GAS which encodes amino acid sequence <SEQ ID 9186>. Analysis of the amino acid sequence reveals the following:

```
Possible site: 28
>>> Seems to have a cleavable N-term signal seq.
----- Final Results -----
    bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3008

A DNA sequence <SEQ ID 9187> was identified in GAS which encodes amino acid sequence <SEQ ID 9188>. Analysis of the amino acid sequence reveals the following:

```
Possible site: 36
>>> Seems to have no N-terminal signal sequence
INTEGRAL    Likelihood = –1.70    Transmembrane 850-866 (850-866)
INTEGRAL    Likelihood = –1.22    Transmembrane 15-31 (15-31)
----- Final Results -----
   bacterial membrane --- Certainty = 0.1680 (Affirmative) <succ>
      bacterial outside --- Certainty = 0.0000 (Not Clear) <succ>
         bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3009

A DNA sequence <SEQ ID 9189> was identified in GAS which encodes amino acid sequence <SEQ ID 9190>. Analysis of the amino acid sequence reveals the following:

```
LPXTG motif: 259-263
Possible site: 13
>>> Seems to have no N-terminal signal sequence
INTEGRAL    Likelihood = –3.93    Transmembrane 270-286 (268-288)
----- Final Results -----
   bacterial membrane --- Certainty = 0.2572 (Affirmative) <succ>
      bacterial outside --- Certainty = 0.0000 (Not Clear) < succ>
         bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3010

A DNA sequence <SEQ ID 9191> was identified in GAS which encodes amino acid sequence <SEQ ID 9192>. Analysis of the amino acid sequence reveals the following:

```
Possible site: 21
>>> May be a lipoprotein
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3011

A DNA sequence <SEQ ID 9193> was identified in GAS which encodes amino acid sequence <SEQ ID 9194>. Analysis of the amino acid sequence reveals the following:

```
Possible site: 29
>>> May be a lipoprotein
----- Final Results -----
   bacterial membrane --- Certainty = 0.0000 (Not Clear) <succ>
      bacterial outside --- Certainty = 0.0000 (Not Clear) <succ>
         bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3012

A DNA sequence <SEQ ID 9195> was identified in GAS which encodes amino acid sequence <SEQ ID 9196>. Analysis of the amino acid sequence reveals the following:

```
Possible site: 34
>>> Seems to have a cleavable N-term signal seq.
----- Final Results -----
   bacterial outside --- Certainty = 0.3000 (Affirmative) <succ>
      bacterial membrane --- Certainty = 0.0000 (Not Clear) < succ>
         bacterial cytoplasm --- Certainty = 0.0000 (Not Clear) < succ>
```

Based on this analysis, it is predicted that this GAS protein, and its epitopes, could be useful antigens for vaccines and/or diagnostics.

Example 3013

A DNA sequence <SEQ ID 9197> was identified in GAS which encodes amino acid sequence <SEQ ID 9198>. Analysis of the amino acid sequence reveals the following:

```
Possible site: 13
>>> Seems to have no N-terminal signal sequence
INTEGRAL    Likelihood = –3.50    Transmembrane 346-362 (343-366)
INTEGRAL    Likelihood = –2.97    Transmembrane 177-193 (176-195)
----- Final Results -----
   bacterial membrane --- Certainty = 0.2402 (Affirmative) <succ>
      bacterial outside --- Certainty = 0.0000 (Not Clear) <succ>
         bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3014

A DNA sequence <SEQ ID 9199> was identified in GAS which encodes amino acid sequence <SEQ ID 9200>. Analysis of the amino acid sequence reveals the following:

```
Possible site: 19
>>> Seems to have no N-terminal signal sequence
INTEGRAL    Likelihood = –1.33    Transmembrane 24-40 (24-40)
----- Final Results -----
   bacterial membrane --- Certainty = 0.1532 (Affirmative) <succ>
      bacterial outside --- Certainty = 0.0000 (Not Clear) <succ>
         bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3015

A DNA sequence <SEQ ID 9201> was identified in GAS which encodes amino acid sequence <SEQ ID 9202>. Analysis of the amino acid sequence reveals the following:

Possible site: 33
>>> Seems to have a cleavable N-term signal seq.
INTEGRAL    Likelihood = −6.00    Transmembrane 194-210 (192-214)
----- Final Results -----
  bacterial membrane --- Certainty = 0.3399 (Affirmative) <succ>
    bacterial outside --- Certainty = 0.0000 (Not Clear) <succ>
      bacterial cytoplasm --- Certainty = 0.0000 (Not Clear) <succ>
LPXTG motif: 183-187

Based on this analysis, it is predicted that this GAS protein, and its epitopes, could be useful antigens for vaccines and/or diagnostics.

Example 3016

A DNA sequence <SEQ ID 9203> was identified in GAS which encodes amino acid sequence <SEQ ID 9204>. Analysis of the amino acid sequence reveals the following:

Possible site: 32
>>> Seems to have an uncleavable N-term signal seq
INTEGRAL    Likelihood = −11.25    Transmembrane 9-25 (4-28)
----- Final Results -----
  bacterial membrane --- Certainty = 0.5501 (Affirmative) <succ>
    bacterial outside --- Certainty = 0.0000 (Not Clear) <succ>
      bacterial cytoplasm --- Certainty = 0.0000 (Not Clear) <succ>

Based on this analysis, it is predicted that this GAS protein, and its epitopes, could be useful antigens for vaccines and/or diagnostics.

Example 3017

A DNA sequence <SEQ ID 9205> was identified in GAS which encodes amino acid sequence <SEQ ID 9206>. Analysis of the amino acid sequence reveals the following:

Possible site: 37
>>> Seems to have no N-terminal signal sequence
INTEGRAL    Likelihood = −3.03    Transmembrane 462-478 (460-479)
INTEGRAL    Likelihood = −0.90    Transmembrane 18-34 (18-34)
----- Final Results -----
  bacterial membrane --- Certainty = 0.2211 (Affirmative) <succ>
    bacterial outside --- Certainty = 0.0000 (Not Clear) <succ>
      bacterial cytoplasm --- Certainty = 0.0000 (Not Clear) <succ>
LPXTG motif: 450-454

Based on this analysis, it is predicted that this GAS protein, and its epitopes, could be useful antigens for vaccines and/or diagnostics.

Example 3018

A DNA sequence <SEQ ID 9207> was identified in GAS which encodes amino acid sequence <SEQ ID 9208>. Analysis of the amino acid sequence reveals the following:

Possible site: 26
>>> Seems to have an uncleavable N-term signal seq
INTEGRAL    Likelihood = −2.60    Transmembrane 15-31 (12-32)
----- Final Results -----
  bacterial membrane --- Certainty = 0.2041 (Affirmative) <succ>
    bacterial outside --- Certainty = 0.0000 (Not Clear) <succ>
      bacterial cytoplasm --- Certainty = 0.0000 (Not Clear) <succ>

Based on this analysis, it is predicted that this GAS protein, and its epitopes, could be useful antigens for vaccines and/or diagnostics.

Example 3019

A DNA sequence <SEQ ID 9209> was identified in GAS which encodes amino acid sequence <SEQ ID 9210>. Analysis of the amino acid sequence reveals the following:

Possible site: 28
>>> Seems to have no N-terminal signal sequence
INTEGRAL    Likelihood = −1.38    Transmembrane 16-32 (16-32)
----- Final Results -----
  bacterial membrane --- Certainty = 0.1553 (Affirmative) <succ>
    bacterial outside --- Certainty = 0.0000 (Not Clear) <succ>
      bacterial cytoplasm --- Certainty = 0.0000 (Not Clear) <succ>

Based on this analysis, it is predicted that this GAS protein, and its epitopes, could be useful antigens for vaccines and/or diagnostics.

Example 3020

A DNA sequence <SEQ ID 9211> was identified in GAS which encodes amino acid sequence <SEQ ID 9212>. Analysis of the amino acid sequence reveals the following:

Possible cleavage site: 24
>>> Seems to have a cleavable N-term signal seq.
----- Final Results -----
  bacterial outside --- Certainty = 0.300 (Affirmative) <succ>
    bacterial membrane --- Certainty = 0.000 (Not Clear) <succ>
      bacterial cytoplasm --- Certainty = 0.000 (Not Clear) <succ>

Based on this analysis, it is predicted that this GAS protein, and its epitopes, could be useful antigens for vaccines and/or diagnostics.

Example 3021

A DNA sequence <SEQ ID 9213> was identified in GAS which encodes amino acid sequence <SEQ ID 9214>. Analysis of the amino acid sequence reveals the following:

Possible cleavage site: 23
>>> May be a lipoprotein
----- Final Results -----
  bacterial membrane --- Certainty = 0.000 (Not Clear) <succ>
    bacterial outside --- Certainty = 0.000 (Not Clear) <succ>
      bacterial cytoplasm ---Certainty = 0.000 (Not Clear) <succ>

Based on this analysis, it is predicted that this GAS protein, and its epitopes, could be useful antigens for vaccines and/or diagnostics.

Example 3022

A DNA sequence <SEQ ID 9215> was identified in GAS which encodes amino acid sequence <SEQ ID 9216>. Analysis of the amino acid sequence reveals the following:

Possible site: 19
>>> Seems to have an uncleavable N-term signal seq
INTEGRAL  Likelihood = −2.76  Transmembrane 3-19 (2-20)
----- Final Results -----
  bacterial membrane --- Certainty = 0.2105 (Affirmative) <succ>
    bacterial outside --- Certainty = 0.0000 (Not Clear) <succ>
      bacterial cytoplasm --- Certainty = 0.0000 (Not Clear) <succ>
RGD motif: 396-398

Based on this analysis, it is predicted that this GAS protein, and its epitopes, could be useful antigens for vaccines and/or diagnostics.

Example 3023

A DNA sequence <SEQ ID 9217> was identified in GAS which encodes amino acid sequence <SEQ ID 9218>. Analysis of the amino acid sequence reveals the following:

Possible site: 18
>>> Seems to have no N-terminal signal sequence
INTEGRAL  Likelihood = −0.80  Transmembrane 251-267 (251-267)
INTEGRAL  Likelihood = −0.75  Transmembrane 179-195 (179-195)
----- Final Results -----
  bacterial membrane --- Certainty = 0.1319 (Affirmative) <succ>
    bacterial outside --- Certainty = 0.0000 (Not Clear) <succ>
      bacterial cytoplasm --- Certainty = 0.0000 (Not Clear) <succ>

Based on this analysis, it is predicted that this GAS protein, and its epitopes, could be useful antigens for vaccines and/or diagnostics.

Example 3024

A DNA sequence <SEQ ID 9219> was identified in GAS which encodes amino acid sequence <SEQ ID 9220>. Analysis of the amino acid sequence reveals the following:

Possible site: 39
>>> Seems to have no N-terminal signal sequence
INTEGRAL  Likelihood = −1.22  Transmembrane 52-68 (51-68)
----- Final Results -----
  bacterial membrane --- Certainty = 0.1489 (Affirmative) <succ>
    bacterial outside --- Certainty = 0.0000 (Not Clear) <succ>
      bacterial cytoplasm --- Certainty = 0.0000 (Not Clear) <succ>

Based on this analysis, it is predicted that this GAS protein, and its epitopes, could be useful antigens for vaccines and/or diagnostics.

Example 3025

A DNA sequence <SEQ ID 9221> was identified in GAS which encodes amino acid sequence <SEQ ID 9222>. Analysis of the amino acid sequence reveals the following:

Possible site: 52
>>> Seems to have an uncleavable N-term signal seq
INTEGRAL  Likelihood = −12.58 Transmembrane  39-55 (32-86)
INTEGRAL  Likelihood = −9.55 Transmembrane  60-76 (56-86)
----- Final Results -----
  bacterial membrane --- Certainty = 0.6031 (Affirmative) <succ>
    bacterial outside --- Certainty = 0.0000 (Not Clear) <succ>
      bacterial cytoplasm --- Certainty = 0.0000 (Not Clear) <succ>

Based on this analysis, it is predicted that this GAS protein, and its epitopes, could be useful antigens for vaccines and/or diagnostics.

Example 3026

A DNA sequence <SEQ ID 9223> was identified in GAS which encodes amino acid sequence <SEQ ID 9224>. Analysis of the amino acid sequence reveals the following:

Possible site: 18
>>> Seems to have an uncleavable N-term signal seq
----- Final Results -----
  bacterial membrane --- Certainty = 0.0000 (Not Clear) <succ>
    bacterial outside --- Certainty = 0.0000 (Not Clear) <succ>
      bacterial cytoplasm ---Certainty = 0.0000 (Not Clear) <succ>

Based on this analysis, it is predicted that this GAS protein, and its epitopes, could be useful antigens for vaccines and/or diagnostics.

Example 3027

A DNA sequence <SEQ ID 9225> was identified in GAS which encodes amino acid sequence <SEQ ID 9226>. Analysis of the amino acid sequence reveals the following:

Possible site: 26
>>> Seems to have an uncleavable N-term signal seq
----- Final Results -----
  bacterial membrane --- Certainty = 0.0000 (Not Clear) <succ>
    bacterial outside --- Certainty = 0.0000 (Not Clear) <succ>
      bacterial cytoplasm --- Certainty = 0.0000 (Not Clear) <succ>

Based on this analysis, it is predicted that this GAS protein, and its epitopes, could be useful antigens for vaccines and/or diagnostics.

Example 3028

A DNA sequence <SEQ ID 9227> was identified in GAS which encodes amino acid sequence <SEQ ID 9228>. Analysis of the amino acid sequence reveals the following:

Possible site: 33
>>> Seems to have an uncleavable N-term signal seq
INTEGRAL  Likelihood = −8.44 Transmembrane  18-34 (13-40)
INTEGRAL  Likelihood = −7.86 Transmembrane  59-75 (54-79)
----- Final Results -----
  bacterial membrane --- Certainty = 0.4376 (Affirmative) <succ>
    bacterial outside --- Certainty = 0.0000 (Not Clear) <succ>
      bacterial cytoplasm --- Certainty = 0.0000 (Not Clear) <succ>

Example 3029

A DNA sequence <SEQ ID 9229> was identified in GAS which encodes amino acid sequence <SEQ ID 9230>. Analysis of the amino acid sequence reveals the following:

```
Possible site: 27
>>> Seems to have a cleavable N-term signal seq.
----- Final Results -----
    bacterial outside --- Certainty = 0.3000 (Affirmative) <succ>
    bacterial membrane --- Certainty = 0.0000 (Not Clear) <succ>
    bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3030

A DNA sequence <SEQ ID 9231> was identified in GAS which encodes amino acid sequence <SEQ ID 9232>. Analysis of the amino acid sequence reveals the following:

```
Possible site: 24
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3031

A DNA sequence <SEQ ID 9233> was identified in GAS which encodes amino acid sequence <SEQ ID 9234>. Analysis of the amino acid sequence reveals the following:

```
Possible site: 49
>>> Seems to have a cleavable N-term signal seq.
INTEGRAL   Likelihood = -9.87 Transmembrane   58-74 (53-81)
----- Final Results -----
    bacterial membrane --- Certainty = 0.4949 (Affirmative) <succ>
    bacterial outside --- Certainty = 0.0000 (Not Clear) <succ>
    bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3032

A DNA sequence <SEQ ID 9235> was identified in GAS which encodes amino acid sequence <SEQ ID 9236>. Analysis of the amino acid sequence reveals the following:

```
Possible site: 16
>>> Seems to have no N-terminal signal sequence
INTEGRAL   Likelihood = -0.06 Transmembrane   92-108 (92-108)
----- Final Results -----
    bacterial membrane --- Certainty = 0.1022 (Affirmative) <succ>
    bacterial outside --- Certainty = 0.0000 (Not Clear) <succ>
    bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3033

A DNA sequence <SEQ ID 9237> was identified in GAS which encodes amino acid sequence <SEQ ID 9238>. Analysis of the amino acid sequence reveals the following:

```
Possible site: 40
>>> Seems to have no N-terminal signal sequence
INTEGRAL   Likelihood = -1.38 Transmembrane   18-34 (18-34)
----- Final Results -----
    bacterial membrane --- Certainty = 0.1553 (Affirmative) <succ>
    bacterial outside --- Certainty = 0.0000 (Not Clear) <succ>
    bacterial cytoplasm --- Certainty = 0.0000 (Not Clear) < succ>
```

Based on this analysis, it is predicted that this GAS protein, and its epitopes, could be useful antigens for vaccines and/or diagnostics.

Example 3034

A DNA sequence <SEQ ID 9239> was identified in GAS which encodes amino acid sequence <SEQ ID 9240>. Analysis of the amino acid sequence reveals the following:

```
Possible site: 19
>>> Seems to have an uncleavable N-term signal seq
----- Final Results -----
    bacterial membrane --- Certainty = 0.0000 (Not Clear) <succ>
    bacterial outside --- Certainty = 0.0000 (Not Clear) <succ>
    bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3035

A DNA sequence <SEQ ID 9241> was identified in GAS which encodes amino acid sequence <SEQ ID 9242>. Analysis of the amino acid sequence reveals the following:

```
Possible site: 57
>>> Seems to have no N-terminal signal sequence
INTEGRAL   Likelihood = -1.01 Transmembrane   155-171 (154-171)
----- Final Results -----
    bacterial membrane --- Certainty = 0.1404 (Affirmative) <succ>
    bacterial outside --- Certainty = 0.0000 (Not Clear) <succ>
    bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3036

A DNA sequence <SEQ ID 9243> was identified in GAS which encodes amino acid sequence <SEQ ID 9244>. Analysis of the amino acid sequence reveals the following:

```
Possible site: 28
>>> Seems to have a cleavable N-term signal seq.
INTEGRAL   Likelihood = −4.25 Transmembrane   113-129 (111-131)
----- Final Results -----
   bacterial membrane --- Certainty = 0.2699 (Affirmative) <succ>
      bacterial outside --- Certainty = 0.0000 (Not Clear) <succ>
         bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3037

A DNA sequence <SEQ ID 9245> was identified in GAS which encodes amino acid sequence <SEQ ID 9246>. Analysis of the amino acid sequence reveals the following:

```
Possible site: 56
>>> Seems to have no N-terminal signal sequence
INTEGRAL   Likelihood = −0.69 Transmembrane 110-126 (110-126)
----- Final Results -----
   bacterial membrane --- Certainty = 0.1277 (Affirmative) <succ>
      bacterial outside --- Certainty = 0.0000 (Not Clear) <succ>
         bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3038

A DNA sequence <SEQ ID 9247> was identified in GAS which encodes amino acid sequence <SEQ ID 9248>. Analysis of the amino acid sequence reveals the following:

```
Possible site: 58
>>> Seems to have no N-terminal signal sequence
INTEGRAL   Likelihood = −1.28 Transmembrane   130-146 (128-146)
----- Final Results -----
   bacterial membrane --- Certainty = 0.1510 (Affirmative) <succ>
      bacterial outside --- Certainty = 0.0000 (Not Clear) <succ>
         bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3039

A DNA sequence <SEQ ID 9249> was identified in GAS which encodes amino acid sequence <SEQ ID 9250>. Analysis of the amino acid sequence reveals the following:

```
Possible site: 39
>>> Seems to have no N-terminal signal sequence
INTEGRAL   Likelihood = −4.57 Transmembrane   74-90 (72-92)
INTEGRAL   Likelihood = −3.13 Transmembrane   169-185 (166-185)
INTEGRAL   Likelihood = −3.13 Transmembrane   28-44 (27-44)
----- Final Results -----
   bacterial membrane --- Certainty = 0.2826 (Affirmative) <succ>
      bacterial outside --- Certainty = 0.0000 (Not Clear) <succ>
         bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3040

A DNA sequence <SEQ ID 9251> was identified in GAS which encodes amino acid sequence <SEQ ID 9252>. Analysis of the amino acid sequence reveals the following:

```
Possible cleavage site: 56
>>> Seems to have a cleavable N-term signal seq.
INTEGRAL      Likelihood = −12.21   Transmembrane 93-109 (87-114)
INTEGRAL      Likelihood = −8.65    Transmembrane 227-243 (226-243)
----- Final Results -----
   bacterial membrane --- Certainty = 0.588 (Affirmative) <succ>
      bacterial outside --- Certainty = 0.0000 (Not Clear) <succ>
         bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3041

A DNA sequence <SEQ ID 9253> was identified in GAS which encodes amino acid sequence <SEQ ID 9254>. Analysis of the amino acid sequence reveals the following:

```
Possible site: 45
>>> Seems to have an uncleavable N-term signal seq
INTEGRAL      Likelihood = −6.53    Transmembrane 73-89 (70-94)
INTEGRAL      Likelihood = −4.41    Transmembrane 32-48 (30-51)
INTEGRAL      Likelihood = −2.55    Transmembrane 10-26 (10-26)
INTEGRAL      Likelihood = −2.39    Transmembrane 106-122 (104-123)
INTEGRAL      Likelihood = −1.75    Transmembrane 153-169 (152-169)
----- Final Results -----
   bacterial membrane --- Certainty = 0.3612 (Affirmative) <succ>
      bacterial outside --- Certainty = 0.0000 (Not Clear) <succ>
         bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3042

A DNA sequence <SEQ ID 9255> was identified in GAS which encodes amino acid sequence <SEQ ID 9256>. Analysis of the amino acid sequence reveals the following:

```
Possible site: 44
>>> Seems to have no N-terminal signal sequence
INTEGRAL      Likelihood = −11.68   Transmembrane 25-41 (15-46)
```

| | | |
|---|---|---|
| INTEGRAL | Likelihood = −9.24 | Transmembrane 255-271 (248-276) |
| INTEGRAL | Likelihood = −7.59 | Transmembrane 82-98 (79-100) |
| INTEGRAL | Likelihood = −4.30 | Transmembrane 115-131 (113-135) |
| INTEGRAL | Likelihood = −0.11 | Transmembrane 148-164 (148-164) |

----- Final Results -----
   bacterial membrane --- Certainty = 0.5670 (Affirmative) <succ>
     bacterial outside --- Certainty = 0.0000 (Not Clear) <succ>
        bacterial cytoplasm --- Certainty = 0.0000 (Not Clear) <succ>

Based on this analysis, it is predicted that this GAS protein, and its epitopes, could be useful antigens for vaccines and/or diagnostics.

Example 3043

A DNA sequence <SEQ ID 9257> was identified in GAS which encodes amino acid sequence <SEQ ID 9258>. Analysis of the amino acid sequence reveals the following:

Possible site: 51
>>> Seems to have no N-terminal signal sequence

| | | |
|---|---|---|
| INTEGRAL | Likelihood = −11.04 | Transmembrane 137-153 (126-160) |
| INTEGRAL | Likelihood = −10.56 | Transmembrane 36-52 (29-58) |
| INTEGRAL | Likelihood = −10.08 | Transmembrane 407-423 (399-426) |
| INTEGRAL | Likelihood = −4.94 | Transmembrane 230-246 (228-250) |
| INTEGRAL | Likelihood = −4.83 | Transmembrane 79-95 (77-98) |
| INTEGRAL | Likelihood = −4.35 | Transmembrane 202-218 (201-220) |
| INTEGRAL | Likelihood = −1.12 | Transmembrane 293-309 (293-309) |

----- Final Results -----
   bacterial membrane --- Certainty = 0.5416 (Affirmative) <succ>
     bacterial outside --- Certainty = 0.0000 (Not Clear) <succ>
        bacterial cytoplasm --- Certainty = 0.0000 (Not Clear) <succ>

Based on this analysis, it is predicted that this GAS protein, and its epitopes, could be useful antigens for vaccines and/or diagnostics.

Example 3044

A DNA sequence <SEQ ID 9259> was identified in GAS which encodes amino acid sequence <SEQ ID 9260>. Analysis of the amino acid sequence reveals the following:

Possible site: 31
>>> Seems to have no N-terminal signal sequence

| | | |
|---|---|---|
| INTEGRAL | Likelihood = −2.76 | Transmembrane 137-153 (137-154) |

----- Final Results -----
   bacterial membrane --- Certainty = 0.2105 (Affirmative) <succ>
     bacterial outside --- Certainty = 0.0000 (Not Clear) <succ>
        bacterial cytoplasm --- Certainty = 0.0000 (Not Clear) <succ>

Based on this analysis, it is predicted that this GAS protein, and its epitopes, could be useful antigens for vaccines and/or diagnostics.

Example 3045

A DNA sequence <SEQ ID 9261> was identified in GAS which encodes amino acid sequence <SEQ ID 9262>. Analysis of the amino acid sequence reveals the following:

Possible site: 36
>>> Seems to have no N-terminal signal sequence
INTEGRAL    Likelihood = −7.91    Transmembrane 238-254 (236-264)

| | | |
|---|---|---|
| INTEGRAL | Likelihood = −6.16 | Transmembrane 69-85 (65-89) |
| INTEGRAL | Likelihood = −6.00 | Transmembrane 136-152 (134-155) |
| INTEGRAL | Likelihood = −4.73 | Transmembrane 29-45 (21-48) |
| INTEGRAL | Likelihood = −2.97 | Transmembrane 194-210 (193-220) |

----- Final Results -----
   bacterial membrane --- Certainty = 0.4163 (Affirmative) <succ>
     bacterial outside --- Certainty = 0.0000 (Not Clear) <succ>
        bacterial cytoplasm --- Certainty = 0.0000 (Not Clear) <succ>

Based on this analysis, it is predicted that this GAS protein, and its epitopes, could be useful antigens for vaccines and/or diagnostics.

Example 3046

A DNA sequence <SEQ ID 9263> was identified in GAS which encodes amino acid sequence <SEQ ID 9264>. Analysis of the amino acid sequence reveals the following:

Possible site: 39
>>> Seems to have a cleavable N-term signal seq.

| | | |
|---|---|---|
| INTEGRAL | Likelihood = −9.87 | Transmembrane 574-590 (568-601) |
| INTEGRAL | Likelihood = −9.18 | Transmembrane 243-259 (238-262) |
| INTEGRAL | Likelihood = −7.11 | Transmembrane 66-82 (65-87) |
| INTEGRAL | Likelihood = −1.28 | Transmembrane 270-286 (270-287) |

----- Final Results -----
   bacterial membrane --- Certainty = 0.4949 (Affirmative) <succ>
     bacterial outside --- Certainty = 0.0000 (Not Clear) <succ>
        bacterial cytoplasm --- Certainty = 0.0000 (Not Clear) <succ>

Based on this analysis, it is predicted that this GAS protein, and its epitopes, could be useful antigens for vaccines and/or diagnostics.

Example 3047

A DNA sequence <SEQ ID 9265> was identified in GAS which encodes amino acid sequence <SEQ ID 9266>. Analysis of the amino acid sequence reveals the following:

Possible site: 33
>>> Seems to have no N-terminal signal sequence

| | | |
|---|---|---|
| INTEGRAL | Likelihood = −7.91 | Transmembrane 98-114 (92-124) |
| INTEGRAL | Likelihood = −6.21 | Transmembrane 19-35 (14-37) |
| INTEGRAL | Likelihood = −5.36 | Transmembrane 170-186 (169-189) |
| INTEGRAL | Likelihood = −5.15 | Transmembrane 147-163 (136-167) |
| INTEGRAL | Likelihood = −1.12 | Transmembrane 77-93 (77-93) |

----- Final Results -----
   bacterial membrane ---Certainty = 0.4163 (Affirmative) <succ>
     bacterial outside --- Certainty = 0.0000 (Not Clear) <succ>
        bacterial cytoplasm --- Certainty = 0.0000 (Not Clear) <succ>

Based on this analysis, it is predicted that this GAS protein, and its epitopes, could be useful antigens for vaccines and/or diagnostics.

Example 3048

A DNA sequence <SEQ ID 9267> was identified in GAS which encodes amino acid sequence <SEQ ID 9268>. Analysis of the amino acid sequence reveals the following:

Possible site: 47
>>> Seems to have no N-terminal signal sequence

```
INTEGRAL    Likelihood = -11.94   Transmembrane 27-43 (19-51)
INTEGRAL    Likelihood = -4.83    Transmembrane 152-168 (151-171)
INTEGRAL    Likelihood = -4.09    Transmembrane 277-293 (276-294)
INTEGRAL    Likelihood = -3.82    Transmembrane 195-211 (193-217)
INTEGRAL    Likelihood = -2.50    Transmembrane 120-136 (120-137)
INTEGRAL    Likelihood = -0.64    Transmembrane 81-97 (81-98)
----- Final Results -----
    bacterial membrane --- Certainty = 0.5776 (Affirmative) <succ>
       bacterial outside --- Certainty = 0.0000 (Not Clear) <succ>
         bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3049

A DNA sequence <SEQ ID 9269> was identified in GAS which encodes amino acid sequence <SEQ ID 9270>. Analysis of the amino acid sequence reveals the following:

```
Possible site: 36
>>> Seems to have no N-terminal signal sequence
INTEGRAL    Likelihood = -8.49    Transmembrane 27-43 (14-50)
INTEGRAL    Likelihood = -8.17    Transmembrane 58-74 (52-79)
INTEGRAL    Likelihood = -7.38    Transmembrane 165-181 (161-193)
INTEGRAL    Likelihood = -3.66    Transmembrane 247-263 (246-270)
INTEGRAL    Likelihood = -1.54    Transmembrane 134-150 (134-150)
----- Final Results -----
    bacterial membrane --- Certainty = 0.440 (Affirmative) <succ>
       bacterial outside --- Certainty = 0.0000 (Not Clear) <succ>
         bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3050

A DNA sequence <SEQ ID 9271> was identified in GAS which encodes amino acid sequence <SEQ ID 9272>. Analysis of the amino acid sequence reveals the following:

```
Possible site: 55
>>> Seems to have no N-terminal signal sequence
INTEGRAL    Likelihood = -14.75   Transmembrane 389-405 (377-413)
INTEGRAL    Likelihood = -8.44    Transmembrane 31-47 (29-54)
INTEGRAL    Likelihood = -7.17    Transmembrane 181-197 (179-205)
INTEGRAL    Likelihood = -7.01    Transmembrane 339-355 (326-360)
INTEGRAL    Likelihood = -6.58    Transmembrane 105-121 (102-124)
INTEGRAL    Likelihood = -5.36    Transmembrane 225-241 (222-244)
INTEGRAL    Likelihood = -0.43    Transmembrane 139-155 (139-155)
INTEGRAL    Likelihood = -0.16    Transmembrane 283-299 (282-300)
----- Final Results -----
    bacterial membrane --- Certainty = 0.6901 (Affirmative) <succ>
       bacterial outside --- Certainty = 0.0000 (Not Clear) <succ>
         bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3051

A DNA sequence <SEQ ID 9273> was identified in GAS which encodes amino acid sequence <SEQ ID 9274>. Analysis of the amino acid sequence reveals the following:

```
Possible cleavage site: 25
>>> Seems to have a cleavable N-term signal seq.
INTEGRAL    Likelihood = -5.31    Transmembrane 155-171 (154-174)
INTEGRAL    Likelihood = -3.50    Transmembrane 111-127 (110-128)
INTEGRAL    Likelihood = -2.07    Transmembrane 80-96 (78-96)
INTEGRAL    Likelihood = -0.90    Transmembrane 57-73 (57-74)
----- Final Results -----
    bacterial membrane --- Certainty = 0.312 (Affirmative) <succ>
       bacterial outside --- Certainty = 0.0000 (Not Clear) <succ>
         bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3052

A DNA sequence <SEQ ID 9275> was identified in GAS which encodes amino acid sequence <SEQ ID 9276>. Analysis of the amino acid sequence reveals the following:

```
Possible site: 27
>>> Seems to have an uncleavable N-term signal seq
INTEGRAL    Likelihood = -3.93    Transmembrane 463-479 (461-480)
----- Final Results -----
    bacterial membrane --- Certainty = 0.2572 (Affirmative) <succ>
       bacterial outside --- Certainty = 0.0000 (Not Clear) <succ>
         bacterial cytoplasm --- Certainty = 0.0000 (Not Clear) <succ>
```

Based on this analysis, it is predicted that this GAS protein, and its epitopes, could be useful antigens for vaccines and/or diagnostics.

Example 3053

A DNA sequence <SEQ ID 8741> was identified in GBS which encodes amino acid sequence <SEQ ID 8742>. This protein and its epitopes could be useful antigens for vaccines and/or diagnostics.

Example 3054

A DNA sequence <SEQ ID 8685> was identified in GBS which encodes amino acid sequence <SEQ ID 8686>. This protein and its epitopes could be useful antigens for vaccines and/or diagnostics.

Example 3055

A DNA sequence <SEQ ID 10303> was identified in GBS which encodes amino acid sequence <SEQ ID 10304>. This protein and its epitopes could be useful antigens for vaccines and/or diagnostics.

Example 3056

A DNA sequence <SEQ ID 10305> was identified in GBS which encodes amino acid sequence <SEQ ID 10306>. This protein and its epitopes could be useful antigens for vaccines and/or diagnostics.

Example 3057

A DNA sequence <SEQ ID 10307> was identified in GBS which encodes amino acid sequence <SEQ ID 10308>. This protein and its epitopes could be useful antigens for vaccines and/or diagnostics.

Example 3058

A DNA sequence <SEQ ID 10309> was identified in GBS which encodes amino acid sequence <SEQ ID 10310>. This protein and its epitopes could be useful antigens for vaccines and/or diagnostics.

Example 3059

A DNA sequence <SEQ ID 10311> was identified in GBS which encodes amino acid sequence <SEQ ID 10312>. This protein and its epitopes could be useful antigens for vaccines and/or diagnostics.

Example 3060

A DNA sequence <SEQ ID 10313> was identified in GBS which encodes amino acid sequence <SEQ ID 10314>. This protein and its epitopes could be useful antigens for vaccines and/or diagnostics.

Example 3061

A DNA sequence <SEQ ID 10315> was identified in GBS which encodes amino acid sequence <SEQ ID 10316>. This protein and its epitopes could be useful antigens for vaccines and/or diagnostics.

Example 3062

A DNA sequence <SEQ ID 10317> was identified in GBS which encodes amino acid sequence <SEQ ID 10318>. This protein and its epitopes could be useful antigens for vaccines and/or diagnostics.

Example 3063

A repeated DNA sequence <SEQ ID 10319> was identified in GBS which encodes amino acid sequence <SEQ ID 10320>. This protein and its epitopes could be useful antigens for vaccines and/or diagnostics.

Example 3064

A DNA sequence <SEQ ID 10321> was identified in GBS which encodes amino acid sequence <SEQ ID 10322>. This protein and its epitopes could be useful antigens for vaccines and/or diagnostics.

Example 3065

A DNA sequence <SEQ ID 10323> was identified in GBS which encodes amino acid sequence <SEQ ID 10324>. This protein and its epitopes could be useful antigens for vaccines and/or diagnostics.

Example 3066

A DNA sequence <SEQ ID 10325> was identified in GBS which encodes amino acid sequence <SEQ ID 10326>. This protein and its epitopes could be useful antigens for vaccines and/or diagnostics.

Example 3067

A DNA sequence <SEQ ID 10327> was identified in GBS which encodes amino acid sequence <SEQ ID 10328>. This protein and its epitopes could be useful antigens for vaccines and/or diagnostics.

Example 3068

A DNA sequence <SEQ ID 10329> was identified in GBS which encodes amino acid sequence <SEQ ID 10330>. This protein and its epitopes could be useful antigens for vaccines and/or diagnostics.

Example 3069

A DNA sequence <SEQ ID 10331> was identified in GBS which encodes amino acid sequence <SEQ ID 10332>. This protein and its epitopes could be useful antigens for vaccines and/or diagnostics.

Example 3070

A DNA sequence <SEQ ID 10333> was identified in GBS which encodes amino acid sequence <SEQ ID 10334>. This protein and its epitopes could be useful antigens for vaccines and/or diagnostics.

Example 3071

A DNA sequence <SEQ ID 10335> was identified in GBS which encodes amino acid sequence <SEQ ID 10336>. This protein and its epitopes could be useful antigens for vaccines and/or diagnostics.

Example 3072

A DNA sequence <SEQ ID 10339> was identified in GBS which encodes amino acid sequence <SEQ ID 10340>. This protein and its epitopes could be useful antigens for vaccines and/or diagnostics.

Example 3073

A DNA sequence <SEQ ID 10341> was identified in GBS which encodes amino acid sequence <SEQ ID 10342>. This protein and its epitopes could be useful antigens for vaccines and/or diagnostics.

Example 3074

A DNA sequence <SEQ ID 10343> was identified in GBS which encodes amino acid sequence <SEQ ID 10344>. This protein and its epitopes could be useful antigens for vaccines and/or diagnostics.

Example 3075

A DNA sequence <SEQ ID 10345> was identified in GBS which encodes amino acid sequence <SEQ ID 10346>. This protein and its epitopes could be useful antigens for vaccines and/or diagnostics.

Example 3076

A DNA sequence <SEQ ID 10347> was identified in GBS which encodes amino acid sequence <SEQ ID 10348>. This protein and its epitopes could be useful antigens for vaccines and/or diagnostics.

Example 3077

A DNA sequence <SEQ ID 10349> was identified in GBS which encodes amino acid sequence <SEQ ID 10350>. This protein and its epitopes could be useful antigens for vaccines and/or diagnostics.

Example 3078

A DNA sequence <SEQ ID 10351> was identified in GBS which encodes amino acid sequence <SEQ ID 10352>. This protein and its epitopes could be useful antigens for vaccines and/or diagnostics.

Example 3079

A DNA sequence <SEQ ID 10353> was identified in GBS which encodes amino acid sequence <SEQ ID 10354>. This protein and its epitopes could be useful antigens for vaccines and/or diagnostics.

Example 3080

A DNA sequence <SEQ ID 10355> was identified in GBS which encodes amino acid sequence <SEQ ID 10356>. This protein and its epitopes could be useful antigens for vaccines and/or diagnostics.

Example 3081

A DNA sequence <SEQ ID 10357> was identified in GBS which encodes amino acid sequence <SEQ ID 10358>. This protein and its epitopes could be useful antigens for vaccines and/or diagnostics.

Example 3082

A DNA sequence <SEQ ID 10359> was identified in GBS which encodes amino acid sequence <SEQ ID 10360>. This protein and its epitopes could be useful antigens for vaccines and/or diagnostics.

Example 3083

A DNA sequence <SEQ ID 10361> was identified in GBS which encodes amino acid sequence <SEQ ID 10362>. This protein and its epitopes could be useful antigens for vaccines and/or diagnostics.

Example 3084

A DNA sequence <SEQ ID 10363> was identified in GBS which encodes amino acid sequence <SEQ ID 10364>. This protein and its epitopes could be useful antigens for vaccines and/or diagnostics.

Example 3085

A DNA sequence <SEQ ID 10365> was identified in GBS which encodes amino acid sequence <SEQ ID 10366>. This protein and its epitopes could be useful antigens for vaccines and/or diagnostics.

Example 3086

A DNA sequence <SEQ ID 10367> was identified in GBS which encodes amino acid sequence <SEQ ID 10368>. This protein and its epitopes could be useful antigens for vaccines and/or diagnostics.

Example 3087

A DNA sequence <SEQ ID 10369> was identified in GBS which encodes amino acid sequence <SEQ ID 10370>. This protein and its epitopes could be useful antigens for vaccines and/or diagnostics.

Example 3088

A DNA sequence <SEQ ID 10371> was identified in GBS which encodes amino acid sequence <SEQ ID 10372>. This protein and its epitopes could be useful antigens for vaccines and/or diagnostics.

Example 3089

A DNA sequence <SEQ ID 10373> was identified in GBS which encodes amino acid sequence <SEQ ID 10374>. This protein and its epitopes could be useful antigens for vaccines and/or diagnostics.

Example 3090

A DNA sequence <SEQ ID 10375> was identified in GBS which encodes amino acid sequence <SEQ ID 10376>. This protein and its epitopes could be useful antigens for vaccines and/or diagnostics.

Example 3091

A DNA sequence <SEQ ID 10377> was identified in GBS which encodes amino acid sequence <SEQ ID 10378>. This protein and its epitopes could be useful antigens for vaccines and/or diagnostics.

Example 3092

A DNA sequence <SEQ ID 10379> was identified in GBS which encodes amino acid sequence <SEQ ID 10380>. This protein and its epitopes could be useful antigens for vaccines and/or diagnostics.

Example 3093

A DNA sequence <SEQ ID 10381> was identified in GBS which encodes amino acid sequence <SEQ ID 10382>. This protein and its epitopes could be useful antigens for vaccines and/or diagnostics.

Example 3094

A DNA sequence <SEQ ID 10383> was identified in GBS which encodes amino acid sequence <SEQ ID 10384>. This protein and its epitopes could be useful antigens for vaccines and/or diagnostics.

Example 3095

A DNA sequence <SEQ ID 10385> was identified in GBS which encodes amino acid sequence <SEQ ID 10386>. This protein and its epitopes could be useful antigens for vaccines and/or diagnostics.

Example 3096

A DNA sequence <SEQ ID 10387> was identified in GBS which encodes amino acid sequence <SEQ ID 10388>. This protein and its epitopes could be useful antigens for vaccines and/or diagnostics.

Example 3097

A DNA sequence <SEQ ID 10389> was identified in GBS which encodes amino acid sequence <SEQ ID 10390>. This protein and its epitopes could be useful antigens for vaccines and/or diagnostics.

Example 3098

A DNA sequence <SEQ ID 10391> was identified in GBS which encodes amino acid sequence <SEQ ID 10392>. This protein and its epitopes could be useful antigens for vaccines and/or diagnostics.

Example 3099

A DNA sequence <SEQ ID 10393> was identified in GBS which encodes amino acid sequence <SEQ ID 10394>. This protein and its epitopes could be useful antigens for vaccines and/or diagnostics.

Example 3100

A DNA sequence <SEQ ID 10395> was identified in GBS which encodes amino acid sequence <SEQ ID 10396>. This protein and its epitopes could be useful antigens for vaccines and/or diagnostics.

Example 3101

A DNA sequence <SEQ ID 10397> was identified in GBS which encodes amino acid sequence <SEQ ID 10398>. This protein and its epitopes could be useful antigens for vaccines and/or diagnostics.

Example 3102

A DNA sequence <SEQ ID 10399> was identified in GBS which encodes amino acid sequence <SEQ ID 10400>. This protein and its epitopes could be useful antigens for vaccines and/or diagnostics.

Example 3103

A DNA sequence <SEQ ID 10401> was identified in GBS which encodes amino acid sequence <SEQ ID 10402>. This protein and its epitopes could be useful antigens for vaccines and/or diagnostics.

Example 3104

A DNA sequence <SEQ ID 10403> was identified in GBS which encodes amino acid sequence <SEQ ID 10404>. This protein and its epitopes could be useful antigens for vaccines and/or diagnostics.

Example 3105

A DNA sequence <SEQ ID 10405> was identified in GBS which encodes amino acid sequence <SEQ ID 10406>. This protein and its epitopes could be useful antigens for vaccines and/or diagnostics.

Example 3106

A DNA sequence <SEQ ID 10407> was identified in GBS which encodes amino acid sequence <SEQ ID 10408>. This protein and its epitopes could be useful antigens for vaccines and/or diagnostics.

Example 3107

A DNA sequence <SEQ ID 10409> was identified in GBS which encodes amino acid sequence <SEQ ID 10410>. This protein and its epitopes could be useful antigens for vaccines and/or diagnostics.

Example 3108

A DNA sequence <SEQ ID 10411> was identified in GBS which encodes amino acid sequence <SEQ ID 10412>. This protein and its epitopes could be useful antigens for vaccines and/or diagnostics.

Example 3109

A DNA sequence <SEQ ID 10413> was identified in GBS which encodes amino acid sequence <SEQ ID 10414>. This protein and its epitopes could be useful antigens for vaccines and/or diagnostics.

Example 3110

A DNA sequence <SEQ ID 10415> was identified in GBS which encodes amino acid sequence <SEQ ID 10416>. This protein and its epitopes could be useful antigens for vaccines and/or diagnostics.

Example 3111

A DNA sequence <SEQ ID 10417> was identified in GBS which encodes amino acid sequence <SEQ ID 10418>. This protein and its epitopes could be useful antigens for vaccines and/or diagnostics.

Example 3112

A DNA sequence <SEQ ID 10419> was identified in GBS which encodes amino acid sequence <SEQ ID 10420>. This protein and its epitopes could be useful antigens for vaccines and/or diagnostics.

Example 3113

A DNA sequence <SEQ ID 10421> was identified in GBS which encodes amino acid sequence <SEQ ID 10422>. This protein and its epitopes could be useful antigens for vaccines and/or diagnostics.

Example 3114

A DNA sequence <SEQ ID 10423> was identified in GBS which encodes amino acid sequence <SEQ ID 10424>. This protein and its epitopes could be useful antigens for vaccines and/or diagnostics.

Example 3115

A DNA sequence <SEQ ID 10425> was identified in GBS which encodes amino acid sequence <SEQ ID 10426>. This protein and its epitopes could be useful antigens for vaccines and/or diagnostics.

Example 3116

A DNA sequence <SEQ ID 10427> was identified in GBS which encodes amino acid sequence <SEQ ID 10428>. This protein and its epitopes could be useful antigens for vaccines and/or diagnostics.

Example 3117

A DNA sequence <SEQ ID 10429> was identified in GBS which encodes amino acid sequence <SEQ ID 10430>. This protein and its epitopes could be useful antigens for vaccines and/or diagnostics.

Example 3118

A DNA sequence <SEQ ID 10431> was identified in GBS which encodes amino acid sequence <SEQ ID 10432>. This protein and its epitopes could be useful antigens for vaccines and/or diagnostics.

Example 3119

A DNA sequence <SEQ ID 10433> was identified in GBS which encodes amino acid sequence <SEQ ID 10434>. This protein and its epitopes could be useful antigens for vaccines and/or diagnostics.

Example 3120

A DNA sequence <SEQ ID 10435> was identified in GBS which encodes amino acid sequence <SEQ ID 10436>. This protein and its epitopes could be useful antigens for vaccines and/or diagnostics.

Example 3121

A DNA sequence <SEQ ID 10437> was identified in GBS which encodes amino acid sequence <SEQ ID 10438>. This protein and its epitopes could be useful antigens for vaccines and/or diagnostics.

Example 3122

A DNA sequence <SEQ ID 10441> was identified in GBS which encodes amino acid sequence <SEQ ID 10442>. This protein and its epitopes could be useful antigens for vaccines and/or diagnostics.

Example 3123

A DNA sequence <SEQ ID 10443> was identified in GBS which encodes amino acid sequence <SEQ ID 10444>. This protein and its epitopes could be useful antigens for vaccines and/or diagnostics.

Example 3124

A DNA sequence <SEQ ID 10445> was identified in GBS which encodes amino acid sequence <SEQ ID 10446>. This protein and its epitopes could be useful antigens for vaccines and/or diagnostics.

Example 3125

A DNA sequence <SEQ ID 10447> was identified in GBS which encodes amino acid sequence <SEQ ID 10448>. This protein and its epitopes could be useful antigens for vaccines and/or diagnostics.

Example 3126

A DNA sequence <SEQ ID 10449> was identified in GBS which encodes amino acid sequence <SEQ ID 10450>. This protein and its epitopes could be useful antigens for vaccines and/or diagnostics.

Example 3127

A DNA sequence <SEQ ID 10451> was identified in GBS which encodes amino acid sequence <SEQ ID 10452>. This protein and its epitopes could be useful antigens for vaccines and/or diagnostics.

Example 3128

A DNA sequence <SEQ ID 10453> was identified in GBS which encodes amino acid sequence <SEQ ID 10454>. This protein and its epitopes could be useful antigens for vaccines and/or diagnostics.

Example 3129

A DNA sequence <SEQ ID 10455> was identified in GBS which encodes amino acid sequence <SEQ ID 10456>. This protein and its epitopes could be useful antigens for vaccines and/or diagnostics.

Example 3130

A DNA sequence <SEQ ID 10457> was identified in GBS which encodes amino acid sequence <SEQ ID 10458>. This

Example 3131

A DNA sequence <SEQ ID 10459> was identified in GBS which encodes amino acid sequence <SEQ ID 10460>. This protein and its epitopes could be useful antigens for vaccines and/or diagnostics.

Example 3132

A DNA sequence <SEQ ID 10461> was identified in GBS which encodes amino acid sequence <SEQ ID 10462>. This protein and its epitopes could be useful antigens for vaccines and/or diagnostics.

Example 3133

A DNA sequence <SEQ ID 10463> was identified in GBS which encodes amino acid sequence <SEQ ID 10464>. This protein and its epitopes could be useful antigens for vaccines and/or diagnostics.

Example 3134

A DNA sequence <SEQ ID 10465> was identified in GBS which encodes amino acid sequence <SEQ ID 10466>. This protein and its epitopes could be useful antigens for vaccines and/or diagnostics.

Example 3135

A DNA sequence <SEQ ID 10467> was identified in GBS which encodes amino acid sequence <SEQ ID 10468>. This protein and its epitopes could be useful antigens for vaccines and/or diagnostics.

Example 3136

A DNA sequence <SEQ ID 10469> was identified in GBS which encodes amino acid sequence <SEQ ID 10470>. This protein and its epitopes could be useful antigens for vaccines and/or diagnostics.

Example 3137

A DNA sequence <SEQ ID 10471> was identified in GBS which encodes amino acid sequence <SEQ ID 10472>. This protein and its epitopes could be useful antigens for vaccines and/or diagnostics.

Example 3138

A DNA sequence <SEQ ID 10473> was identified in GBS which encodes amino acid sequence <SEQ ID 10474>. This protein and its epitopes could be useful antigens for vaccines and/or diagnostics.

Example 3139

A DNA sequence <SEQ ID 10475> was identified in GBS which encodes amino acid sequence <SEQ ID 10476>. This protein and its epitopes could be useful antigens for vaccines and/or diagnostics.

protein and its epitopes could be useful antigens for vaccines and/or diagnostics. A related GBS nucleic acid sequence <SEQ ID 10907> which encodes amino acid sequence <SEQ ID 10908> was also identified.

Example 3140

A DNA sequence <SEQ ID 10477> was identified in GBS which encodes amino acid sequence <SEQ ID 10478>. This protein and its epitopes could be useful antigens for vaccines and/or diagnostics.

Example 3141

A DNA sequence <SEQ ID 10479> was identified in GBS which encodes amino acid sequence <SEQ ID 10480>. This protein and its epitopes could be useful antigens for Vaccines and/or diagnostics.

Example 3142

A DNA sequence <SEQ ID 10481> was identified in GBS which encodes amino acid sequence <SEQ ID 10482>. This protein and its epitopes could be useful antigens for vaccines and/or diagnostics.

Example 3143

A DNA sequence <SEQ ID 10483> was identified in GBS which encodes amino acid sequence <SEQ ID 10484>. This protein and its epitopes could be useful antigens for vaccines and/or diagnostics.

Example 3144

A DNA sequence <SEQ ID 10485> was identified in GBS which encodes amino acid sequence <SEQ ID 10486>. This protein and its epitopes could be useful antigens for vaccines and/or diagnostics.

Example 3145

A DNA sequence <SEQ ID 10487> was identified in GBS which encodes amino acid sequence <SEQ ID 10488>. This protein and its epitopes could be useful antigens for vaccines and/or diagnostics.

Example 3146

A DNA sequence <SEQ ID 10489> was identified in GBS which encodes amino acid sequence <SEQ ID 10490>. This protein and its epitopes could be useful antigens for vaccines and/or diagnostics.

Example 3147

A DNA sequence <SEQ ID 10491> was identified in GBS which encodes amino acid sequence <SEQ ID 10492>. This protein and its epitopes could be useful antigens for vaccines and/or diagnostics.

Example 3148

A DNA sequence <SEQ ID 10493> was identified in GBS which encodes amino acid sequence <SEQ ID 10494>. This protein and its epitopes could be useful antigens for vaccines and/or diagnostics.

Example 3149

A DNA sequence <SEQ ID 10495> was identified in GBS which encodes amino acid sequence <SEQ ID 10496>. This protein and its epitopes could be useful antigens for vaccines and/or diagnostics.

Example 3150

A DNA sequence <SEQ ID 10497> was identified in GBS which encodes amino acid sequence <SEQ ID 10498>. This protein and its epitopes could be useful antigens for vaccines and/or diagnostics.

Example 3151

A DNA sequence <SEQ ID 10499> was identified in GBS which encodes amino acid sequence <SEQ ID 10500>. This protein and its epitopes could be useful antigens for vaccines and/or diagnostics.

Example 3152

A DNA sequence <SEQ ID 10501> was identified in GBS which encodes amino acid sequence <SEQ ID 10502>. This protein and its epitopes could be useful antigens for vaccines and/or diagnostics.

Example 3153

A DNA sequence <SEQ ID 10503> was identified in GBS which encodes amino acid sequence <SEQ ID 10504>. This protein and its epitopes could be useful antigens for vaccines and/or diagnostics.

Example 3154

A DNA sequence <SEQ ID 10505> was identified in GBS which encodes amino acid sequence <SEQ ID 10506>. This protein and its epitopes could be useful antigens for vaccines and/or diagnostics.

Example 3155

A DNA sequence <SEQ ID 10509> was identified in GBS which encodes amino acid sequence <SEQ ID 10510>. This protein and its epitopes could be useful antigens for vaccines and/or diagnostics.

Example 3156

A DNA sequence <SEQ ID 10511> was identified in GBS which encodes amino acid sequence <SEQ ID 10512>. This protein and its epitopes could be useful antigens for vaccines and/or diagnostics.

Example 3157

A DNA sequence <SEQ ID 10513> was identified in GBS which encodes amino acid sequence <SEQ ID 10514>. This protein and its epitopes could be useful antigens for vaccines and/or diagnostics.

Example 3158

A DNA sequence <SEQ ID 10515> was identified in GBS which encodes amino acid sequence <SEQ ID 10516>. This protein and its epitopes could be useful antigens for vaccines and/or diagnostics.

Example 3159

A DNA sequence <SEQ ID 10517> was identified in GBS which encodes amino acid sequence <SEQ ID 10518>. This protein and its epitopes could be useful antigens for vaccines and/or diagnostics.

Example 3160

A DNA sequence <SEQ ID 10519> was identified in GBS which encodes amino acid sequence <SEQ ID 10520>. This protein and its epitopes could be useful antigens for vaccines and/or diagnostics.

Example 3161

A DNA sequence <SEQ ID 10521> was identified in GBS which encodes amino acid sequence <SEQ ID 10522>. This protein and its epitopes could be useful antigens for vaccines and/or diagnostics.

Example 3162

A DNA sequence <SEQ ID 10523> was identified in GBS which encodes amino acid sequence <SEQ ID 10524>. This protein and its epitopes could be useful antigens for vaccines and/or diagnostics.

Example 3163

A DNA sequence <SEQ ID 10525> was identified in GBS which encodes amino acid sequence <SEQ ID 10526>. This protein and its epitopes could be useful antigens for vaccines and/or diagnostics.

Example 3164

A DNA sequence <SEQ ID 10527> was identified in GBS which encodes amino acid sequence <SEQ ID 10528>. This protein and its epitopes could be useful antigens for vaccines and/or diagnostics.

Example 3165

A DNA sequence <SEQ ID 10529> was identified in GBS which encodes amino acid sequence <SEQ ID 10530>. This protein and its epitopes could be useful antigens for vaccines and/or diagnostics.

Example 3166

A DNA sequence <SEQ ID 10531> was identified in GBS which encodes amino acid sequence <SEQ ID 10532>. This protein and its epitopes could be useful antigens for vaccines and/or diagnostics.

Example 3167

A DNA sequence <SEQ ID 10533> was identified in GBS which encodes amino acid sequence <SEQ ID 10534>. This protein and its epitopes could be useful antigens for vaccines and/or diagnostics.

Example 3168

A DNA sequence <SEQ ID 10535> was identified in GBS which encodes amino acid sequence <SEQ ID 10536>. This protein and its epitopes could be useful antigens for vaccines and/or diagnostics.

Example 3169

A DNA sequence <SEQ ID 10537> was identified in GBS which encodes amino acid sequence <SEQ ID 10538>. This protein and its epitopes could be useful antigens for vaccines and/or diagnostics.

Example 3170

A DNA sequence <SEQ ID 10539> was identified in GBS which encodes amino acid sequence <SEQ ID 10540>. This protein and its epitopes could be useful antigens for vaccines and/or diagnostics.

Example 3171

A DNA sequence <SEQ ID 10541> was identified in GBS which encodes amino acid sequence <SEQ ID 10542>. This protein and its epitopes could be useful antigens for vaccines and/or diagnostics.

Example 3172

A DNA sequence <SEQ ID 10543> was identified in GBS which encodes amino acid sequence <SEQ ID 10544>. This protein and its epitopes could be useful antigens for vaccines and/or diagnostics.

Example 3173

Figure 230:
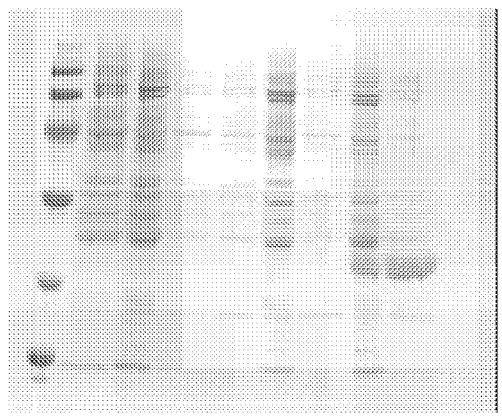

A DNA sequence <SEQ ID 10545> was identified in GBS which encodes amino acid sequence <SEQ ID 10546>. This protein and its epitopes could be useful antigens for vaccines and/or diagnostics.
SEQ ID 10546 (GBS665) was expressed in *E. coli* as a GST-fusion product. SDS-PAGE analysis of total cell extract is shown in FIG. 137 (lane 8-10; MW 41 kDa) and in FIG. 187 (lane 5; MW 41 kDa). It was also was expressed in *E. coli* as a His-fusion product. SDS-PAGE analysis of total cell extract is shown in FIG. 137 (lane 11 & 12; MW 16.1 kDa), in FIG. 141 (lane 4; MW 16 kDa) and in FIG. 179 (lane 6; MW 16 kDa). Purified GBS665-GST is shown in FIG. 243, lane 4, GBS665-His was purified as shown in FIG. 230, lane 7-8.

Example 3174

A DNA sequence <SEQ ID 10547> was identified in GBS which encodes amino acid sequence <SEQ ID 10548>. This protein and its epitopes could be useful antigens for vaccines and/or diagnostics. A related GBS nucleic acid sequence <SEQ ID 10909> which encodes amino acid sequence <SEQ ID 10910> was also identified.

Example 3175

A DNA sequence <SEQ ID 10549> was identified in GBS which encodes amino acid sequence <SEQ ID 10550>. This protein and its epitopes could be useful antigens for vaccines and/or diagnostics.

Example 3176

A DNA sequence <SEQ ID 10551> was identified in GBS which encodes amino acid sequence <SEQ ID 10552>. This protein and its epitopes could be useful antigens for vaccines and/or diagnostics.

Example 3177

A DNA sequence <SEQ ID 10553> was identified in GBS which encodes amino acid sequence <SEQ ID 10554>. This protein and its epitopes could be useful antigens for vaccines and/or diagnostics.

Example 3178

A DNA sequence <SEQ ID 10555> was identified in GBS which encodes amino acid sequence <SEQ ID 10556>. This protein and its epitopes could be useful antigens for vaccines and/or diagnostics.

Example 3179

A DNA sequence <SEQ ID 10557> was identified in GBS which encodes amino acid sequence <SEQ ID 10558>. This protein and its epitopes could be useful antigens for vaccines and/or diagnostics.

Example 3180

A DNA sequence <SEQ ID 10559> was identified in GBS which encodes amino acid sequence <SEQ ID 10560>. This protein and its epitopes could be useful antigens for vaccines and/or diagnostics.

Example 3181

A DNA sequence <SEQ ID 10561> was identified in GBS which encodes amino acid sequence <SEQ ID 10562>. This protein and its epitopes could be useful antigens for vaccines and/or diagnostics.

Example 3182

A DNA sequence <SEQ ID 10563> was identified in GBS which encodes amino acid sequence <SEQ ID 10564>. This protein and its epitopes could be useful antigens for vaccines and/or diagnostics.

Example 3183

A DNA sequence <SEQ ID 10565> was identified in GBS which encodes amino acid sequence <SEQ ID 10566>. This protein and its epitopes could be useful antigens for vaccines and/or diagnostics.

Example 3184

A DNA sequence <SEQ ID 10567> was identified in GBS which encodes amino acid sequence <SEQ ID 10568>. This protein and its epitopes could be useful antigens for vaccines and/or diagnostics.

Example 3185

A DNA sequence <SEQ ID 10569> was identified in GBS which encodes amino acid sequence <SEQ ID 10570>. This protein and its epitopes could be useful antigens for vaccines and/or diagnostics.

Example 3186

A DNA sequence <SEQ ID 10571> was identified in GBS which encodes amino acid sequence <SEQ ID 10572>. This protein and its epitopes could be useful antigens for vaccines and/or diagnostics.

Example 3187

A DNA sequence <SEQ ID 10573> was identified in GBS which encodes amino acid sequence <SEQ ID 10574>. This protein and its epitopes could be useful antigens for vaccines and/or diagnostics.

Example 3188

A DNA sequence <SEQ ID 10575> was identified in GBS which encodes amino acid sequence <SEQ ID 10576>. This protein and its epitopes could be useful antigens for vaccines and/or diagnostics.

Example 3189

A DNA sequence <SEQ ID 10577> was identified in GBS which encodes amino acid sequence <SEQ ID 10578>. This protein and its epitopes could be useful antigens for vaccines and/or diagnostics.

Example 3190

A DNA sequence <SEQ ID 10579> was identified in GBS which encodes amino acid sequence <SEQ ID 10580>. This protein and its epitopes could be useful antigens for vaccines and/or diagnostics.

Example 3191

A DNA sequence <SEQ ID 10581> was identified in GBS which encodes amino acid sequence <SEQ ID 10582>. This protein and its epitopes could be useful antigens for vaccines and/or diagnostics.

Example 3192

A DNA sequence <SEQ ID 10583> was identified in GBS which encodes amino acid sequence <SEQ ID 10584>. This protein and its epitopes could be useful antigens for vaccines and/or diagnostics.

Example 3193

A DNA sequence <SEQ ID 10585> was identified in GBS which encodes amino acid sequence <SEQ ID 10586>. This protein and its epitopes could be useful antigens for vaccines and/or diagnostics.

Example 3194

A DNA sequence <SEQ ID 10587> was identified in GBS which encodes amino acid sequence <SEQ ID 10588>. This protein and its epitopes could be useful antigens for vaccines and/or diagnostics.

Example 3195

A DNA sequence <SEQ ID 10591> was identified in GBS which encodes amino acid sequence <SEQ ID 10592>. This protein and its epitopes could be useful antigens for vaccines and/or diagnostics.

Example 3196

A DNA sequence <SEQ ID 10593> was identified in GBS which encodes amino acid sequence <SEQ ID 10594>. This protein and its epitopes could be useful antigens for vaccines and/or diagnostics.

Example 3197

A DNA sequence <SEQ ID 10595> was identified in GBS which encodes amino acid sequence <SEQ ID 10596>. This protein and its epitopes could be useful antigens for vaccines and/or diagnostics.

Example 3198

A DNA sequence <SEQ ID 10597> was identified in GBS which encodes amino acid sequence <SEQ ID 10598>. This protein and its epitopes could be useful antigens for vaccines and/or diagnostics. A related GBS nucleic acid sequence <SEQ ID 10797> which encodes amino acid sequence <SEQ ID 10798> was also identified.

Example 3199

A DNA sequence <SEQ ID 10599> was identified in GBS which encodes amino acid sequence <SEQ ID 10600>. This protein and its epitopes could be useful antigens for vaccines and/or diagnostics.

Example 3200

A DNA sequence <SEQ ID 10601> was identified in GBS which encodes amino acid sequence <SEQ ID 10602>. This protein and its epitopes could be useful antigens for vaccines and/or diagnostics.

Example 3201

A DNA sequence <SEQ ID 10603> was identified in GBS which encodes amino acid sequence <SEQ ID 10604>. This protein and its epitopes could be useful antigens for vaccines and/or diagnostics.

Example 3202

A DNA sequence <SEQ ID 10605> was identified in GBS which encodes amino acid sequence <SEQ ID 10606>. This protein and its epitopes could be useful antigens for vaccines and/or diagnostics.

Example 3203

A DNA sequence <SEQ ID 10607> was identified in GBS which encodes amino acid sequence <SEQ ID 10608>. This protein and its epitopes could be useful antigens for vaccines and/or diagnostics.

Example 3204

A DNA sequence <SEQ ID 10609> was identified in GBS which encodes amino acid sequence <SEQ ID 10610>. This protein and its epitopes could be useful antigens for vaccines and/or diagnostics.

Example 3205

A DNA sequence <SEQ ID 10611> was identified in GBS which encodes amino acid sequence <SEQ ID 10612>. This protein and its epitopes could be useful antigens for vaccines and/or diagnostics.

Example 3206

A DNA sequence <SEQ ID 10613> was identified in GBS which encodes amino acid sequence <SEQ ID 10614>. This protein and its epitopes could be useful antigens for vaccines and/or diagnostics.

Example 3207

A DNA sequence <SEQ ID 10615> was identified in GBS which encodes amino acid sequence <SEQ ID 10616>. This protein and its epitopes could be useful antigens for vaccines and/or diagnostics.

Example 3208

A DNA sequence <SEQ ID 10617> was identified in GBS which encodes amino acid sequence <SEQ ID 10618>. This protein and its epitopes could be useful antigens for vaccines and/or diagnostics.

Example 3209

A DNA sequence <SEQ ID 10619> was identified in GBS which encodes amino acid sequence <SEQ ID 10620>. This protein and its epitopes could be useful antigens for vaccines and/or diagnostics.

Example 3210

A DNA sequence <SEQ ID 10621> was identified in GBS which encodes amino acid sequence <SEQ ID 10622>. This protein and its epitopes could be useful antigens for vaccines and/or diagnostics.

Example 3211

A DNA sequence <SEQ ID 10623> was identified in GBS which encodes amino acid sequence <SEQ ID 10624>. This protein and its epitopes could be useful antigens for vaccines and/or diagnostics.

Example 3212

A DNA sequence <SEQ ID 10625> was identified in GBS which encodes amino acid sequence <SEQ ID 10626>. This protein and its epitopes could be useful antigens for vaccines and/or diagnostics.

Example 3213

A DNA sequence <SEQ ID 10627> was identified in GBS which encodes amino acid sequence <SEQ ID 10628>. This protein and its epitopes could be useful antigens for vaccines and/or diagnostics.

Example 3214

A DNA sequence <SEQ ID 10629> was identified in GBS which encodes amino acid sequence <SEQ ID 10630>. This protein and its epitopes could be useful antigens for vaccines and/or diagnostics.

Example 3215

A DNA sequence <SEQ ID 10631> was identified in GBS which encodes amino acid sequence <SEQ ID 10632>. This protein and its epitopes could be useful antigens for vaccines and/or diagnostics.

Example 3216

A DNA sequence <SEQ ID 10633> was identified in GBS which encodes amino acid sequence <SEQ ID 10634>. This protein and its epitopes could be useful antigens for vaccines and/or diagnostics. A related GBS nucleic acid sequence <SEQ ID 10939> which encodes amino acid sequence <SEQ ID 10940> was also identified.

SEQ ID 10634 (GBS675) was expressed in *E. coli* as a GST-fusion product. SDS-PAGE analysis of total cell extract is shown in FIG. 162 (lane 14 & 15; MW 56 kDa). It was also expressed in *E. coli* as a His-fusion product. SDS-PAGE analysis of total cell extract is shown in FIG. 163 (lane 2; MW 31 kDa) and in FIG. 188 (lane 5; MW 31 kDa).

Purified GBS675-His is shown in FIG. 240, lane 7-8.

Example 3217

A DNA sequence <SEQ ID 10635> was identified in GBS which encodes amino acid sequence <SEQ ID 10636>. This protein and its epitopes could be useful antigens for vaccines and/or diagnostics.

Example 3218

A DNA sequence <SEQ ID 10637> was identified in GBS which encodes amino acid sequence <SEQ ID 10638>. This protein and its epitopes could be useful antigens for vaccines and/or diagnostics.

Example 3219

A DNA sequence <SEQ ID 10639> was identified in GBS which encodes amino acid sequence <SEQ ID 10640>. This protein and its epitopes could be useful antigens for vaccines and/or diagnostics.

Example 3220

A DNA sequence <SEQ ID 10641> was identified in GBS which encodes amino acid sequence <SEQ ID 10642>. This protein and its epitopes could be useful antigens for vaccines and/or diagnostics.

Example 3221

A DNA sequence <SEQ ID 10643> was identified in GBS which encodes amino acid sequence <SEQ ID 10644>. This protein and its epitopes could be useful antigens for vaccines and/or diagnostics.

Example 3222

A DNA sequence <SEQ ID 10645> was identified in GBS which encodes amino acid sequence <SEQ ID 10646>. This protein and its epitopes could be useful antigens for vaccines and/or diagnostics.

Example 3223

A DNA sequence <SEQ ID 10647> was identified in GBS which encodes amino acid sequence <SEQ ID 10648>. This protein and its epitopes could be useful antigens for vaccines and/or diagnostics.

Example 3224

A DNA sequence <SEQ ID 10649> was identified in GBS which encodes amino acid sequence <SEQ ID 10650>. This protein and its epitopes could be useful antigens for vaccines and/or diagnostics.

Example 3225

A DNA sequence <SEQ ID 10651> was identified in GBS which encodes amino acid sequence <SEQ ID 10652>. This protein and its epitopes could be useful antigens for vaccines and/or diagnostics.

Example 3226

A DNA sequence <SEQ ID 10653> was identified in GBS which encodes amino acid sequence <SEQ ID 10654>. This protein and its epitopes could be useful antigens for vaccines and/or diagnostics.

Example 3227

A DNA sequence <SEQ ID 10655> was identified in GBS which encodes amino acid sequence <SEQ ID 10656>. This protein and its epitopes could be useful antigens for vaccines and/or diagnostics.

Example 3228

A DNA sequence <SEQ ID 10657> was identified in GBS which encodes amino acid sequence <SEQ ID 10658>. This protein and its epitopes could be useful antigens for vaccines and/or diagnostics.

Example 3229

A DNA sequence <SEQ ID 10659> was identified in GBS which encodes amino acid sequence <SEQ ID 10660>. This protein and its epitopes could be useful antigens for vaccines and/or diagnostics.

Example 3230

A DNA sequence <SEQ ID 10661> was identified in GBS which encodes amino acid sequence <SEQ ID 10662>. This protein and its epitopes could be useful antigens for vaccines and/or diagnostics.

Example 3231

A DNA sequence <SEQ ID 10663> was identified in GBS which encodes amino acid sequence <SEQ ID 10664>. This protein and its epitopes could be useful antigens for vaccines and/or diagnostics.

Example 3232

A DNA sequence <SEQ ID 10665> was identified in GBS which encodes amino acid sequence <SEQ ID 10666>. This protein and its epitopes could be useful antigens for vaccines and/or diagnostics. A related GBS nucleic acid sequence <SEQ ID 10917> which encodes amino acid sequence <SEQ ID 10918> was also identified.

A DNA sequence <SEQ ID 10667> was identified in GBS which encodes amino acid sequence <SEQ ID 10668>. This protein and its epitopes could be useful antigens for vaccines and/or diagnostics.

Example 3233

A DNA sequence <SEQ ID 10669> was identified in GBS which encodes amino acid sequence <SEQ ID 10670>. This protein and its epitopes could be useful antigens for vaccines and/or diagnostics.

Example 3234

A DNA sequence <SEQ ID 10671> was identified in GBS which encodes amino acid sequence <SEQ ID 10672>. This protein and its epitopes could be useful antigens for vaccines and/or diagnostics.

Example 3235

A DNA sequence <SEQ ID 10673> was identified in GBS which encodes amino acid sequence <SEQ ID 10674>. This protein and its epitopes could be useful antigens for vaccines and/or diagnostics.

Example 3236

A DNA sequence <SEQ ID 10675> was identified in GBS which encodes amino acid sequence <SEQ ID 10676>. This protein and its epitopes could be useful antigens for vaccines and/or diagnostics.

Example 3237

A DNA sequence <SEQ ID 10677> was identified in GBS which encodes amino acid sequence <SEQ ID 10678>. This protein and its epitopes could be useful antigens for vaccines and/or diagnostics.

Example 3238

A DNA sequence <SEQ ID 10679> was identified in GBS which encodes amino acid sequence <SEQ ID 10680>. This protein and its epitopes could be useful antigens for vaccines and/or diagnostics.

Example 3239

A DNA sequence <SEQ ID 10681> was identified in GBS which encodes amino acid sequence <SEQ ID 10682>. This protein and its epitopes could be useful antigens for vaccines and/or diagnostics.

Example 3240

A DNA sequence <SEQ ID 10683> was identified in GBS which encodes amino acid sequence <SEQ ID 10684>. This protein and its epitopes could be useful antigens for vaccines and/or diagnostics.

Example 3241

A DNA sequence <SEQ ID 10685> was identified in GBS which encodes amino acid sequence <SEQ ID 10686>. This protein and its epitopes could be useful antigens for vaccines and/or diagnostics.

Example 3242

A DNA sequence <SEQ ID 10687> was identified in GBS which encodes amino acid sequence <SEQ ID 10688>. This protein and its epitopes could be useful antigens for vaccines and/or diagnostics.

Example 3243

A DNA sequence <SEQ ID 10689> was identified in GBS which encodes amino acid sequence <SEQ ID 10690>. This protein and its epitopes could be useful antigens for vaccines and/or diagnostics.

Example 3244

A DNA sequence <SEQ ID 10691> was identified in GBS which encodes amino acid sequence <SEQ ID 10692>. This protein and its epitopes could be useful antigens for vaccines and/or diagnostics.

SEQ ID 10692 (GBS676) was expressed in *E. coli* as a GST-fusion product. SDS-PAGE analysis of total cell extract is shown in FIG. 163 (lane 3-5; MW 66 kDa) and in FIG. 239 (lane 8; MW 66 kDa). It was also expressed in *E. coli* as a His-fusion product. SDS-PAGE analysis of total cell extract is shown in FIG. 163 (lane 7 & 8; MW 41 kDa) and in FIG. 188 (lane 6; MW 41 kDa). Purified GBS676-His is shown in FIG. 240, lane 4-5. Purified GBS676-GST is shown in FIG. 246, lanes 10 & 11.

Example 3245

A DNA sequence <SEQ ID 10693> was identified in GBS which encodes amino acid sequence <SEQ ID 10694>. This protein and its epitopes could be useful antigens for vaccines and/or diagnostics.

Example 3246

A DNA sequence <SEQ ID 10695> was identified in GBS which encodes amino acid sequence <SEQ ID 10696>. This protein and its epitopes could be useful antigens for vaccines and/or diagnostics.

Example 3247

A DNA sequence <SEQ ID 10697> was identified in GBS which encodes amino acid sequence <SEQ ID 10698>. This protein and its epitopes could be useful antigens for vaccines and/or diagnostics.

Example 3248

A DNA sequence <SEQ ID 10699> was identified in GBS which encodes amino acid sequence <SEQ ID 10700>. This protein and its epitopes could be useful antigens for vaccines and/or diagnostics.

Example 3249

A DNA sequence <SEQ ID 10703> was identified in GBS which encodes amino acid sequence <SEQ ID 10704>. This protein and its epitopes could be useful antigens for vaccines and/or diagnostics.

Example 3250

A DNA sequence <SEQ ID 10705> was identified in GBS which encodes amino acid sequence <SEQ ID 10706>. This protein and its epitopes could be useful antigens for vaccines and/or diagnostics.

Example 3251

A DNA sequence <SEQ ID 10707> was identified in GBS which encodes amino acid sequence <SEQ ID 10708>. This protein and its epitopes could be useful antigens for vaccines and/or diagnostics.

Example 3252

A DNA sequence <SEQ ID 10709> was identified in GBS which encodes amino acid sequence <SEQ ID 10710>. This protein and its epitopes could be useful antigens for vaccines and/or diagnostics. A related GBS nucleic acid sequence <SEQ ID 10803> which encodes amino acid sequence <SEQ ID 10804> was also identified.

Example 3253

A DNA sequence <SEQ ID 10711> was identified in GBS which encodes amino acid sequence <SEQ ID 10712>. This protein and its epitopes could be useful antigens for vaccines and/or diagnostics. A related GBS nucleic acid sequence <SEQ ID 10913> which encodes amino acid sequence <SEQ ID 10914> was also identified.

Example 3254

A DNA sequence <SEQ ID 10713> was identified in GBS which encodes amino acid sequence <SEQ ID 10714>. This protein and its epitopes could be useful antigens for vaccines and/or diagnostics.

Example 3255

A DNA sequence <SEQ ID 10715> was identified in GBS which encodes amino acid sequence <SEQ ID 10716>. This protein and its epitopes could be useful antigens for vaccines and/or diagnostics.

Example 3256

A DNA sequence <SEQ ID 10717> was identified in GBS which encodes amino acid sequence <SEQ ID 10718>. This protein and its epitopes could be useful antigens for vaccines and/or diagnostics.

Example 3257

A DNA sequence <SEQ ID 10719> was identified in GBS which encodes amino acid sequence <SEQ ID 10720>. This protein and its epitopes could be useful antigens for vaccines and/or diagnostics.

Example 3258

A DNA sequence <SEQ ID 10721> was identified in GBS which encodes amino acid sequence <SEQ ID 10722>. This protein and its epitopes could be useful antigens for vaccines and/or diagnostics.

Example 3259

A DNA sequence <SEQ ID 10723> was identified in GBS which encodes amino acid sequence <SEQ ID 10724>. This protein and its epitopes could be useful antigens for vaccines and/or diagnostics.

Example 3260

A DNA sequence <SEQ ID 10725> was identified in GBS which encodes amino acid sequence <SEQ ID 10726>. This protein and its epitopes could be useful antigens for vaccines and/or diagnostics.

Example 3261

A DNA sequence <SEQ ID 10727> was identified in GBS which encodes amino acid sequence <SEQ ID 10728>. This protein and its epitopes could be useful antigens for vaccines and/or diagnostics.

Example 3262

A DNA sequence <SEQ ID 10729> was identified in GBS which encodes amino acid sequence <SEQ ID 10730>. This protein and its epitopes could be useful antigens for vaccines and/or diagnostics.

Figure 140:
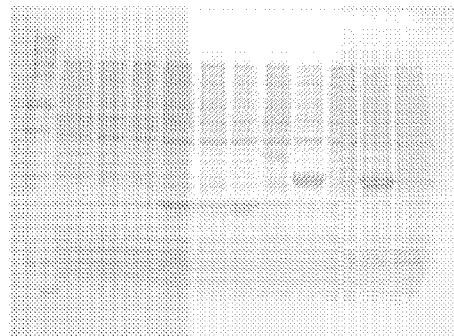

SEQ ID 10730 (GBS670) was expressed in *E. coli* as a GST-fusion product. SDS-PAGE analysis of total cell extract is shown in FIG. 140 (lane 2-4; MW 45.3 kDa). It was also expressed in *E. coli* as a His-fusion product. SDS-PAGE analysis of total cell extract is shown in FIG. 140 (lane 5-7; MW 20.4 kDa) and in FIG. 179 (lane 10; MW 20 kDa).

GBS670-His was purified as shown in FIG. 230, lane 9-10.

Example 3263

A DNA sequence <SEQ ID 10731> was identified in GBS which encodes amino acid sequence <SEQ ID 10732>. This protein and its epitopes could be useful antigens for vaccines and/or diagnostics.

Example 3264

A DNA sequence <SEQ ID 10733> was identified in GBS which encodes amino acid sequence <SEQ ID 10734>. This protein and its epitopes could be useful antigens for vaccines and/or diagnostics.

Example 3265

A DNA sequence <SEQ ID 10735> was identified in GBS which encodes amino acid sequence <SEQ ID 10736>. This protein and its epitopes could be useful antigens for vaccines and/or diagnostics.

Example 3266

A DNA sequence <SEQ ID 10737> was identified in GBS which encodes amino acid sequence <SEQ ID 10738>. This protein and its epitopes could be useful antigens for vaccines and/or diagnostics.

Example 3267

A DNA sequence <SEQ ID 10739> was identified in GBS which encodes amino acid sequence <SEQ ID 10740>. This protein and its epitopes could be useful antigens for vaccines and/or diagnostics.

Example 3268

A DNA sequence <SEQ ID 10741> was identified in GBS which encodes amino acid sequence <SEQ ID 10742>. This protein and its epitopes could be useful antigens for vaccines and/or diagnostics.

Example 3269

A DNA sequence <SEQ ID 10743> was identified in GBS which encodes amino acid sequence <SEQ ID 10744>. This protein and its epitopes could be useful antigens for vaccines and/or diagnostics.

Example 3270

A DNA sequence <SEQ ID 10745> was identified in GBS which encodes amino acid sequence <SEQ ID 10746>. This protein and its epitopes could be useful antigens for vaccines and/or diagnostics.

Example 3271

A DNA sequence <SEQ ID 10747> was identified in GBS which encodes amino acid sequence <SEQ ID 10748>. This protein and its epitopes could be useful antigens for vaccines and/or diagnostics.

Example 3272

A DNA sequence <SEQ ID 10749> was identified in GBS which encodes amino acid sequence <SEQ ID 10750>. This protein and its epitopes could be useful antigens for vaccines and/or diagnostics.

Example 3273

A DNA sequence <SEQ ID 10751> was identified in GBS which encodes amino acid sequence <SEQ ID 10752>. This protein and its epitopes could be useful antigens for vaccines and/or diagnostics.

Example 3274

A DNA sequence <SEQ ID 10753> was identified in GBS which encodes amino acid sequence <SEQ ID 10754>. This protein and its epitopes could be useful antigens for vaccines and/or diagnostics.

Example 3275

A DNA sequence <SEQ ID 10755> was identified in GBS which encodes amino acid sequence <SEQ ID 10756>. This protein and its epitopes could be useful antigens for vaccines and/or diagnostics.

Example 3276

A DNA sequence <SEQ ID 10757> was identified in GBS which encodes amino acid sequence <SEQ ID 10758>. This protein and its epitopes could be useful antigens for vaccines and/or diagnostics.

Example 3277

A DNA sequence <SEQ ID 10759> was identified in GBS which encodes amino acid sequence <SEQ ID 10760>. This protein and its epitopes could be useful antigens for vaccines and/or diagnostics.

Example 3278

A DNA sequence <SEQ ID 10761> was identified in GBS which encodes amino acid sequence <SEQ ID 10762>. This protein and its epitopes could be useful antigens for vaccines and/or diagnostics.

Example 3279

A DNA sequence <SEQ ID 10763> was identified in GBS which encodes amino acid sequence <SEQ ID 10764>. This protein and its epitopes could be useful antigens for vaccines and/or diagnostics.

Example 3280

A DNA sequence <SEQ ID 10765> was identified in GBS which encodes amino acid sequence <SEQ ID 10766>. This protein and its epitopes could be useful antigens for vaccines and/or diagnostics.

Example 3281

A DNA sequence <SEQ ID 10767> was identified in GBS which encodes amino acid sequence <SEQ ID 10768>. This protein and its epitopes could be useful antigens for vaccines and/or diagnostics.

Example 3282

A DNA sequence <SEQ ID 10769> was identified in GBS which encodes amino acid sequence <SEQ ID 10770>. This protein and its epitopes could be useful antigens for vaccines and/or diagnostics.

Example 3283

A DNA sequence <SEQ ID 10771> was identified in GBS which encodes amino acid sequence <SEQ ID 10772>. This protein and its epitopes could be useful antigens for vaccines and/or diagnostics.

Example 3284

A repeated DNA sequence <SEQ ID 10791> was identified in GBS which encodes amino acid sequence <SEQ ID 10792>. This protein and its epitopes could be useful antigens for vaccines and/or diagnostics.

Example 3285

A DNA sequence <SEQ ID 10805> was identified in GBS which encodes amino acid sequence <SEQ ID 10806>. This protein and its epitopes could be useful antigens for vaccines and/or diagnostics.

Example 3286

A DNA sequence <SEQ ID 10807> was identified in GBS which encodes amino acid sequence <SEQ ID 10808>. This protein and its epitopes could be useful antigens for vaccines and/or diagnostics.

Example 3287

A DNA sequence <SEQ ID 10809> was identified in GBS which encodes amino acid sequence <SEQ ID 10810>. This protein and its epitopes could be useful antigens for vaccines and/or diagnostics.

Example 3288

A DNA sequence <SEQ ID 10811> was identified in GBS which encodes amino acid sequence <SEQ ID 10812>. This protein and its epitopes could be useful antigens for vaccines and/or diagnostics.

Example 3289

A DNA sequence <SEQ ID 10813> was identified in GBS which encodes amino acid sequence <SEQ ID 10814>. This protein and its epitopes could be useful antigens for vaccines and/or diagnostics.

Example 3290

A DNA sequence <SEQ ID 10815> was identified in GBS which encodes amino acid sequence <SEQ ID 10816>. This protein and its epitopes could be useful antigens for vaccines and/or diagnostics.

Example 3291

A DNA sequence <SEQ ID 10817> was identified in GBS which encodes amino acid sequence <SEQ ID 10818>. This protein and its epitopes could be useful antigens for vaccines and/or diagnostics.

Example 3292

A DNA sequence <SEQ ID 10819> was identified in GBS which encodes amino acid sequence <SEQ ID 10820>. This protein and its epitopes could be useful antigens for vaccines and/or diagnostics.

Example 3293

A DNA sequence <SEQ ID 10821> was identified in GBS which encodes amino acid sequence <SEQ ID 10822>. This protein and its epitopes could be useful antigens for vaccines and/or diagnostics.

Example 3294

A DNA sequence <SEQ ID 10823> was identified in GBS which encodes amino acid sequence <SEQ ID 10824>. This protein and its epitopes could be useful antigens for vaccines and/or diagnostics.

Example 3295

A DNA sequence <SEQ ID 10825> was identified in GBS which encodes amino acid sequence <SEQ ID 10826>. This protein and its epitopes could be useful antigens for vaccines and/or diagnostics.

Example 3296

A DNA sequence <SEQ ID 10827> was identified in GBS which encodes amino acid sequence <SEQ ID 10828>. This protein and its epitopes could be useful antigens for vaccines and/or diagnostics.

Example 3297

A DNA sequence <SEQ ID 10829> was identified in GBS which encodes amino acid sequence <SEQ ID 10830>. This protein and its epitopes could be useful antigens for vaccines and/or diagnostics.

Example 3298

A DNA sequence <SEQ ID 10831> was identified in GBS which encodes amino acid sequence <SEQ ID 10832>. This protein and its epitopes could be useful antigens for vaccines and/or diagnostics.

Example 3299

A DNA sequence <SEQ ID 10833> was identified in GBS which encodes amino acid sequence <SEQ ID 10834>. This protein and its epitopes could be useful antigens for vaccines and/or diagnostics.

Example 3300

A DNA sequence <SEQ ID 10835> was identified in GBS which encodes amino acid sequence <SEQ ID 10836>. This protein and its epitopes could be useful antigens for vaccines and/or diagnostics.

Example 3301

A DNA sequence <SEQ ID 10837> was identified in GBS which encodes amino acid sequence <SEQ ID 10838>. This protein and its epitopes could be useful antigens for vaccines and/or diagnostics.

Example 3302

A DNA sequence <SEQ ID 10839> was identified in GBS which encodes amino acid sequence <SEQ ID 10840>. This protein and its epitopes could be useful antigens for vaccines and/or diagnostics.

Example 3303

A DNA sequence <SEQ ID 10841> was identified in GBS which encodes amino acid sequence <SEQ ID 10842>. This protein and its epitopes could be useful antigens for vaccines and/or diagnostics.

Example 3304

A DNA sequence <SEQ ID 10843> was identified in GBS which encodes amino acid sequence <SEQ ID 10844>. This protein and its epitopes could be useful antigens for vaccines and/or diagnostics.

Example 3305

A DNA sequence <SEQ ID 10845> was identified in GBS which encodes amino acid sequence <SEQ ID 10846>. This protein and its epitopes could be useful antigens for vaccines and/or diagnostics.

Example 3306

A DNA sequence <SEQ ID 10847> was identified in GBS which encodes amino acid sequence <SEQ ID 10848>. This protein and its epitopes could be useful antigens for vaccines and/or diagnostics.

Example 3307

A DNA sequence <SEQ ID 10849> was identified in GBS which encodes amino acid sequence <SEQ ID 10850>. This protein and its epitopes could be useful antigens for vaccines and/or diagnostics.

Example 3308

A DNA sequence <SEQ ID 10851> was identified in GBS which encodes amino acid sequence <SEQ ID 10852>. This protein and its epitopes could be useful antigens for vaccines and/or diagnostics.

Example 3309

A DNA sequence <SEQ ID 10853> was identified in GBS which encodes amino acid sequence <SEQ ID 10854>. Related sequences are <SEQ ID 10855>, <SEQ ID 10856>, <SEQ ID 10857>, <SEQ ID 10858>, <SEQ ID 10859>, <SEQ ID 10860>, <SEQ ID 10861>, <SEQ ID 10862>, <SEQ ID 10863>, <SEQ ID 10864>, <SEQ ID 10865> and <SEQ ID 10866>. These proteins and their epitopes could be useful antigens for vaccines and/or diagnostics.

Example 3310

A DNA sequence <SEQ ID 10867> was identified in GBS which encodes amino acid sequence <SEQ ID 10868>. This protein and its epitopes could be useful antigens for vaccines and/or diagnostics.

Example 3311

A DNA sequence <SEQ ID 10869> was identified in GBS which encodes amino acid sequence <SEQ ID 10870>. This protein and its epitopes could be useful antigens for vaccines and/or diagnostics.

Example 3312

A DNA sequence <SEQ ID 10871> was identified in GBS which encodes amino acid sequence <SEQ ID 10872>. This protein and its epitopes could be useful antigens for vaccines and/or diagnostics.

Example 3313

A DNA sequence <SEQ ID 10873> was identified in GBS which encodes amino acid sequence <SEQ ID 10874>. This protein and its epitopes could be useful antigens for vaccines and/or diagnostics.

Example 3314

A DNA sequence <SEQ ID 10875> was identified in GBS which encodes amino acid sequence <SEQ ID 10876>. This protein and its epitopes could be useful antigens for vaccines and/or diagnostics.

Example 3315

A DNA sequence <SEQ ID 10877> was identified in GBS which encodes amino acid sequence <SEQ ID 10878>. This protein and its epitopes could be useful antigens for vaccines and/or diagnostics.

Example 3316

A DNA sequence <SEQ ID 10879> was identified in GBS which encodes amino acid sequence <SEQ ID 10880>. This protein and its epitopes could be useful antigens for vaccines and/or diagnostics.

Example 3317

A DNA sequence <SEQ ID 10881> was identified in GBS which encodes amino acid sequence <SEQ ID 10882>. This protein and its epitopes could be useful antigens for vaccines and/or diagnostics.

Example 3318

A DNA sequence <SEQ ID 10883> was identified in GBS which encodes amino acid sequence <SEQ ID 10884>. This protein and its epitopes could be useful antigens for vaccines and/or diagnostics.

Example 3319

A DNA sequence <SEQ ID 10885> was identified in GBS which encodes amino acid sequence <SEQ ID 10886>. This protein and its epitopes could be useful antigens for vaccines and/or diagnostics.

Example 3320

A DNA sequence <SEQ ID 10887> was identified in GBS which encodes amino acid sequence <SEQ ID 10888>. This protein and its epitopes could be useful antigens for vaccines and/or diagnostics.

Example 3321

A DNA sequence <SEQ ID 10889> was identified in GBS which encodes amino acid sequence <SEQ ID 10890>. This protein and its epitopes could be useful antigens for vaccines and/or diagnostics.

Example 3322

A DNA sequence <SEQ ID 10891> was identified in GBS which encodes amino acid sequence <SEQ ID 10892>. This protein and its epitopes could be useful antigens for vaccines and/or diagnostics.

Example 3323

A DNA sequence <SEQ ID 10893> was identified in GBS which encodes amino acid sequence <SEQ ID 10894>. This protein and its epitopes could be useful antigens for vaccines and/or diagnostics.

Example 3324

A DNA sequence <SEQ ID 10895> was identified in GBS which encodes amino acid sequence <SEQ ID 10896>. This protein and its epitopes could be useful antigens for vaccines and/or diagnostics.

Example 3325

A DNA sequence <SEQ ID 10897> was identified in GBS which encodes amino acid sequence <SEQ ID 10898>. This protein and its epitopes could be useful antigens for vaccines and/or diagnostics.

Example 3326

A DNA sequence <SEQ ID 10899> was identified in GBS which encodes amino acid sequence <SEQ ID 10900>. This protein and its epitopes could be useful antigens for vaccines and/or diagnostics.

Example 3327

A DNA sequence <SEQ ID 10901> was identified in GBS which encodes amino acid sequence <SEQ ID 10902>. This protein and its epitopes could be useful antigens for vaccines and/or diagnostics.

Example 3328

A DNA sequence <SEQ ID 10903> was identified in GBS which encodes amino acid sequence <SEQ ID 10904>. This protein and its epitopes could be useful antigens for vaccines and/or diagnostics.

Example 3329

Seven rRNA genes were identified in *S. agalactiae*. These are SEQ IDs 12018 to 12024. These rRNA genes are particularly useful for diagnostic purposes and for phlyogenetic studies. An alignment of the rRNA sequences is shown below:

```
12023     ------------------------------TTTCGAGTCAAAGTCATCAGCGTT
12024     -----------------------------------------------------
12019     -----TCCAATCATACTTAATTTCACTAATATCTGGATTTTGACATATTCAGTTAATTCT
12021     ...ATCGAATTGAACGGACTCAATTTGGTTGTTATGTAATTTT--ACATAATCTATGATTTCT
12020     -----------------------------------------------------
12018     -----------------------------------------------------
12022     --------------------------CTTCTTTGTTTTCTTTAGAGATATTAACTGTA

12023     TACTGTTACGGCAGCAGTTCCAAGAGTTACTCCACTCACAAGGACTGCTGATAATATTCT
12024     ------------------------------------------------------------
12019     TTTTCATGCTTTTTGAGATAAGCTACTTGTTCTTTTTTTATTACTTTTTTACCTTTCTTT
12021     TGCTCATGCTCTTTGAGATAGGCTAATTGTTCTTTTTTTGTCATTTTTTTATCTTTCTTC
12020     ------------------------------------------------------------
12018     ------------------------------------------------------------
12022     CCCACTTTGGGCGTTAAAATACCTAAAGTAGCCTTTATTAAAGTTGATTTAGCAGCCCCA

12023     TTTTTTCATTTTTATTAAACTACTCCTTTAC--GATAAGACATTAAATATTTTACCAAAA
12024     ------------------------------------------------------------
12019     ACTGCTGACTGTTTGCTATTTTTTACTTCGTTTGACTGACTTTTAGATTCACTATTCATT
12021     ACTTCTGATTGCTTGCTATTTTTTACTTCGTTTGACTGAATTTTATGTTCACTATTCATT
12020     ------------------------------------------------------------
12018     --------------------------CTTT-GATACAATATTATCAAAATTATATTAA
12022     TTTTCACCTGTTAAGGTAACAAACTCCCCACT-GTCTAAATGGTAATTAACCCCTTCCAG

12023     AATTCACGAAATTATATTACGTCATTGTTACATTTATATTTGAAATCAACTATTTCTAAA
12024     ------------------------------------------------------------
12019     TGACAGCCTGCTAGTAACATCCCAATAATAGATATGGGAATTAACCATTTTACATATTTT
12021     TGACAGCCTCCAAGTATCATCCCAAAAATTGATATGGGAATTAACCATTTTATATATTTT
12020     ------------------------------------------------------------
12018     CGGTAAAGATATTGTTAAAGACCAAACTTGGATTATCAATCGT----TATCAAGAAATTA
12022     CA-CAGGATCGCTATCGTACTGAAAAGTAAGACCACTAACTGTAATATATCGCATGATTA

12023     TGAACCATAATCAAATCTAGAAAACGATAACCTTCTTCTATTCACTCT---ATCAATATA
12024     ------------------------------------------------------------
12019     TTCAACATGCTCTCTTTTCTTAGAAAATAAACTTCCCATGTCAAGTATCTAATAAAAATA
12021     CTCATCATGTTCTCTTTTCTTAGAATATAAATTTTATATATCAAGTATATAATGAAATTA
12020     ------------------------------------------------------------
12018     TTAGTG---ATTTGTCTTTAGGAAGCACTA--------TTGCAGAAGA---AATTACTCG
12022     CCCTTCT--AATTCTCTAGAGAAAAGATCAAGAAAACGTTCTAAAACG---ACCTTTTCG

12023     ATTACTCCATAGTGAAACTAAAAGAGAAATAAAAAAAGAGTATAATTACTCTTAAAATTA
12024     ------------------------------------------------------------
12019     ATTATTATTTACCAGTATGTTAAAACTAATATTAGTATAACAAA-TTTTCACGAGTTTAA
12021     ACTATTATTCACCAACATTATAAAATTAATTTTAGTATAACAAAATTTTCACGTATTTTT
12020     ----------ATCAAAAAAACATGACCAGTATGAATTAAAGCAACGTATAATCAATGCCT
12018     CTCTAT--AGAGCAGCTAGCTTCACTTCCCATAGAAAATAATCAGTTTTTAT-ATGAT--
12022     TCCTTTGAAAAATGATTTACTAATCTTCCGTAAACCCCTAACGTATTGTCATGATGATGT

12023     TAATATTTACGGAGAATAAGGGATTCGAACCCTTGCGCCAGTTACCCGACCTAACGATTT
12024     ------------------------------------------------------------
12019     TT--TTTTAGTCGTAACATATACACTGAAAAATCTTATTATTTTATACTACCTATCTATC
12021     ATAGTTTTAGTCTTAACATGTAAACAGAAA------A---------------------TC
12020     TAATGCGTAAAGGATACCAGTACGAAGATA---------------------------TC
12018     ---TGTTTTTTAGCAGCCGGTGAAGATA------------------ACAACGCAAAGTT
12022     GTGTGTTCATCTGCAATGGGTTAGCAAGT----TCA---------GATAACTCAAAATA

12023     AGCAAACCGTCCTCTTCAGCCTCTTGAG--TAATTCTCCAAATTAATATTAATGGGCACG
12024     ------------------------------------------------------------
12019     ATTCACAAACACTTTTATTACTTCAGAACCTATGACATTTAGGAGTCCTCTTTGAATTTC
12021     ATTTGTATA-----T--------------------TTTAAATGCCCTAATTAAATT--
12020     AAAAGTGC------T--------------------TTAAGAGAATATTTATAAGAT--
12018     AGTTGCA-ACGTTTTTTAATCAAAATGA--CATTCCTGCAAGATATGTTCATCCAAACGA
12022     AGTAATACGAGCATCTTTAGAATCTTTA--TTCGCTTTCAACATATCCTGAGA-AATTAA
```

```
12023  AGTGGACTCGAACCACCGACCTCACGCTTATCAGGCGTGCGCTCTAACCACCTGAGCTAC
12024  ------------------------------------------------------------
12019  ATTTAAATGTTGAGTCTCCACTAACTCTTGAAAAATTTCCTTATTATTTCTGCTTGTTTT
12021  ------------------------------AATAATT-----AATATTTATTATTATATA
12020  ------------------------------AATAACTCTCAGACGATGTATT--TTACAGA
12018  AGCAGGAATTATTGTAACTAAAGAACCATG--TAATGCACGAATTATT--CCAG----GA
12022  ACTTTTTACTGCTTTAGTTACAGCTGCCTGACTAATATTTAACTTCTTAGCTAAATCAGA

12023  GCGCCCAAGCAAATGCTTGGTTTTACTTTTATGTAAAGTAAGCGGGTGACGAGAATCGA-
12024  ------------------------------------------------------------
12019  AAACCTTCTATAACGATTGCAATAATGAAAAACAAATATAAGTAATTTTCAGTAACTTTT
12021  AATTCTTCTACAATGA----------AAAAAATAAATATAT--A-TTACAAGTAACATT-
12020  AAAT----TATGATAA-----A----CTATAACAGACGTAT--AAATTGTAGAAAGTTG-
12018  AGTTATGATAAGATTGA------GAACTTATGTCTATACAATGAGGTTCTTGTTATCCCT
12022  ATTTGTCAACTGCTCTT------GTGATAAAAGCATCAGAATGTGTTCTTGCGTATTAGT

12023  -ACTCGCGACAACAGCTTGGAAGGCTGTAGTTTTACCACTAAACTACACCCGCTAAAAAC
12024  ------------------------------------------------------------
12019  TCTCAAAATTACCAGCACAATACAAAAAAGACAAGGCTTCTAAACCTTGTCTTTATAAAT
12021  --TCACAATAAATTATCTAGTAGAAAAAAGACAAGGTTTAGAAACCTTGTCTTTATAAGT
12020  ----GTAGGCTATGAGATTACCTAAAGAAGGCGACTTTATTACAATTCAAAGTTACAAAC
12018  GGATTT---------TTTGG--AGTCACAGAAGATAAC-CAAATTTGTACCTTTTCAAGA
12022  CAATTTAA-CATCACTTTGACAAGTACCAAACAATAATTCATGTTGATTTTCTGCTTTAA

12023  TTATATAATAAATGGCGCGAGACGGAATCGAACCGCCGACACATGGAGCTTCAATCCATT
12024  ------------------------------------------------------------
12019  ATACCGGCGGCCGGGGTCGAACCGGCACGTCCGTGAGGACACTGGATTTTGAGTCCAGCG
12021  ATACCGGCGGCCGGGGTCGAACCGGCACGTCCGTGAGGACACTGGATTTTGAGTCCAGCG
12020  ATGATGGTAGTTTACACCGAACTTG-----GCGTGACACCA-TGGTATTAAAAACAACCG
12018  GGGGGATCTGACATTACTGGATC--------CCTAATTGC--------AGCAGGCATAAA
12022  GCAAGATTTGAC-TCACTAAATGG-------TCTAATTTTTGTTCTAAAACTGTCATATA

12023  GCTCTACCAACTGAGCTACCGAGCCTATTGCGGGAGCAGGATTTGAACCTACGACCTTCG
12024  ------------------------------------------------------------
12019  CGTCTGCCAATTCCGCCACGCCGGCTATCTTAAAACTGGGGTAGCTGGATTCGA--ACCA
12021  CGTCTGCCAATTCCGCCACGCCGGCTATCTTAAAACTGGGGTAGCTGGATTCGA--ACCA
12020  AAAATGCC--CTCATTGGTGTTAATGATCAT---ACTTTAGTAACAGAAAATGATGGTCG
12018  AGCAGACCT-TTATGAGAACTTCACAGATGT----TGATGGTATATTTGCAGCACATCCA
12022  TACCT-CTT-TTTTGTTAACCAGTAAATTATATCACGAAGATATAGAAGAATCAATCATA

12023  GGTTA-TGAGCCCGACGAGCTACCTAGCTGCTCCA-------TCCCGCGATATCTTTAAA
12024  ------------------------------------------------------------
12019  ACGCA-TGAGGGAGTCAAAGTCCCTTGCCTTACCG-------CTTGGCTATACCCCATGA
12021  ACGCA-TGAGGGAGTCAAAGTCCCTTGCCTTACCG-------CTTGGCTATACCCCATGA
12020  ACGC--TGGGTGACACGAGAGCC--TGCAATA---------------GTATACTTTCATA
12018  GGT-------GTAGTTAAGAACCCTCACGCTA----------TCCCTGAGCTTACTTATA
12022  GATAGGTGAAGAAGATAAAACCTTTTATCTCAACAACCTAACTTTATAAACTTCTTTGCA

12023  GGA---------GGATGTGGGATTCGAACCCACGCACGCTTTTACAC--GCCTGACGGTT
12024  ------------------------------------------------------------
12019  AAAGGCG-----AGTGATGGGAATCGAACCCACGAATGTCAGAGCCACAATCTGATGTGT
12021  AAAGGCG-----AGTGATGGGAATCGAACCCACGAATGTCAGAGCCACAATCTGATGTGT
12020  AAA---------AATACTGG---T------TT--AACATTATCGCTA-----TGATACGT
12018  AAGA--------AATGCGTGAATTAGCCTATGCGGGTTTTTCGGTTT-TACATGATGAA-
12022  AAAACCTTTCATACTATTAAAAACACGATCAGCTTTTTTCTCTGTAG-AACACATTGAAA

12023  TTCAAGACCGTTCCCTTCAGCCGGACTTGGGTAATCCTCCATATAACAAAAAATATGGAC
12024  ------------------------------------------------------------
12019  TAACCACTTCACCACACCCGCCATATTAGAAAAAACACGGGCAGTAGGAATCGAACCCAC
12021  TAACCACTTCACCACACCCGCCATATTAGAAAAAACACGGGCAGTAGGAATCGAACCCAC
12020  GAAACTGGTGTCTCCTACTATTGTAATCTAGCAAGT-----CCGTATATCTTGGACCC--
12018  --------GCTTTACTTCCTGCCTATCGTGGCAGAATCCCTCTTGTTATTAAAAATAC--
12022  AAACAGTTGGTCCACTTCCTGTC-ATTAATGCAACATCGGCTCCAGAATTTAACATAC--

12023  CTTGTAGGACTCGAACCTACGACCGCTCGGTTATGAGCCGAGTGCTCTAACCAGTTGAGC
12024  ------------------------------------------------------------
12019  ACTGAAGGTTTTGGAGACCTTAGTTCTACCTTTAAACTATGCCCGTTTACTATGGAGAGA
12021  ACTGAAGGTTTTGGAGACCTTAGTTCTACCTTTAAACTATGCCCGTTTACTATGGAGAGA
12020  --TGAAGCACTCAAGTATATTGACTATGACCTTGATGTCAAAGTATTTGCAGATGGTGAA
12018  ----AAA----TAATCCCCAACAGCCTGGTACAAAAATAGTTTTAAAGCATACTCGTAG-
12022  ----GTTCTTTTATTGTACTTATAACTGGATTTTTAGTAATTGTAATATCCTCGAGTGAA

12023  TAAAGGTCCAAAGTCTCAATAAAATAAATAGCGGCGGAGGGGATCGAACCCCCGACCTCC
12024  ------------------------------------------------------------
12019  GAGGGATTCGAACCCCCGAACCCGAAGGAGCGGATTTACAGTCCGCCGCGTTTAGCCTCT
12021  GAGGGATTCGAACCCCCGAACCCGAAGGAGCGGATTTACAGTCCGCCGCGTTTAGCCTCT
12020  AAAAGACTACTAGATGTGGACGAATATGAACAGCATAAAGYTCAGATGAACT--ATCCTA
12018  --TAACATAGCAGTAACTGG-GATCGCT--TCTGATAGCCGTTTTGCTAGCATAAACGTA
12022  TTTCCCATAGATTTGACCATTAACTGATAATCTGATGACAAAATAGCAGACTTTAATAAA

12023  CGGGTATG-AACCGGACGCTCTAGCCAGCT--GAGCTACACCGCCATAAAAATATATCCA
```

-continued

```
12024       ------------------------------------------------------------
12019       TCGCTATC-TCTCCTAAGGTATAAATGGCGCGAGACGGAATCGAACCGCCGACACATGGA
12021       TCGCTATC-TCTCCTAAGGTATAAATGGCGCGAGACGGAATCGAACCGCCGACACATGGA
12020       CCGATATT-GATTATATATTAAAGGAAAATGTAAAAATATTGGTAGAATGGATAAATGAG
12018       TCTAAAT--ACTTAATGAATAGA---GAAGTAGGTTTCGGCCGAAAAG----TACTACAA
12022       TCAATATCAACTCTACTTATAGACTTACAATCAATATCTCTAAAAATGGATTTAGTTGAA

12023       TCGGGAAGACAGGATTCGAACCTGCGACACCTTGGTCCCAAACCAAGTACTCTACCAAGC
12024       ------------------------------------------------------------
12019       GCTTCAATCCATTGCTCTACCAACTGAGCTACCGAGCCTATTGCGGGAGCAGGATTTGAA
12021       GCTTCAATCCATTGCTCTACCAACTGAGCTACCGAGCCTATTGCGGGAGCAGGATTTGAA
12020       AATAAAGGCCCCTTTTC-ATCATC--ATATATCAA-TATCTGGTATAAACGGTA------
12018       ATTTTAGAG---GATTTAAATATT---AGTTTTGAACATATGCCAACTGGCATAGATGAT
12022       ATACCAAAATCCGGCTTAACCAGA---ACTATCCAACATGGTCTCAATGTCGGTAAGGGT

12023       TGAGCTACTTCCCGAAAAATATGCAC--CCTAGAGGAGTCGAACCTCTAACCGCCTGATT
12024       ------------------------------------------------------------
12019       CCTACGACCTTCGGGTTATGAGCCCG--ACGAGCTACCTAGCTGCTCCATCCCGCGATAT
12021       CCTACGACCTTCGGGTTATGAGCCCG--ACGAGCTACCTAGCTGCTCCATCCCGCGATAT
12020       --------CCTTGAATTGAAA-------AAGCGCTAACTAAC-ACACTAAATAGTG-TGT
12018       CTATCCATTGT---CTTACGTGAAA---AAGAATTGACACCAATCAAAGAACAAGAAATC
12022       TTAACAATTTCACCTTTACCTAATACTAACGAACATCCCCCACCAAGACAATAAGGAACA

12023       CGTAGTCAG---GTACTCTATCCAGTTGAGCTAAGGGTGCTAAATATTATA-----TGCC
12024       ------------------------------------------------------------
12019       CTTTAAAGGAGGATGTGGGATTCGAACCCACGCACGCTTTTACACGCCTGACG--GTTTT
12021       CTTTAAAGGAGGATGTGGGATTCGAACCCACGCACGCTTTTACACGCCTGACG--GTTTT
12020       TTTTATTA----ATATCAAATTTAATTACA---ATACTATTGCAAAAATAT----ATACT
12018       TTAAATTACCTAACTCGTAAACTAGAAGTAG--ATTACGTTGACATCCAA----------
12022       TC--ACTACC-AATTTTAAAACCAATAGCAACCATTTCGTCATAGTCCATTTGAAGATTC

12023       GAGGACCGGAATC----GAACCGGTACGATGTTTACCATCGCAGGATTTTAAGTCCTGTG
12024       ------------------------------------------------------------
12019       CAAGACCGTTCCCTTCAGCCGGACTTGGGTAATCCTCCATATAACAAAAAATAGTCCGTA
12021       CAAGACCGTTCCCTTCAGCCGGACTTGGGTAATCCTCCATATAACAAAAAATAGTCCGTA
12020       TAAAATAAA-------AAAAGTAGAAAGATCACTTTCTACTTTTTTAAGAATAGTCCGTA
12018       CACAATCTATC-------TACAATCGTAATTGTAGGTGAAA-ATATGAAAAGTCAGATTG
12022       CATAATCGATT-------AAGAGCTCTTATTGTAGCAGCAGCATCAGTAGAACCACCCCC

12023       CGTCTGCCAGTTCCGCCACCCCGGCCTCTAACAAGCGAACGACGGGGTTCGAACCCGCGA
12024       ------------------------------------------------------------
12019       CGGGATTCGAACCCGTGTTACCGCCGTGAAAAGGCGGTGTCTTAACCCCTTGACCAACGG
12021       CGGGATTCGAACCCGTGTTACCGCCGTGAAAAGGCGGTGTCTTAACCCCTTGACCAACGG
12020       CGGGATTCGAACCCGTGTTACCGCCGTGAAAAGGCGGTGTCTTAACCCCTTGACCAACGG
12018       GAGTCACTGCAACAGCGACACAAGCCTTATC------AAGAGAAAAA-----ATCAATAT
12022       CAGTC-CTGCACAGACAGGAATGGATTTTTCTAATCTAATATGAACACCTTTATTAATAC

12023       -CCCTCACCTT-----GGCAAGGTGATGTTCTACCACTGAACTACGTTCGCACTAAAGAC
12024       ------------------------------------------------------------
12019       -ACCATATTCTTGATGGGCACGAGTGGACTCGAACCACCGACCTCACGCTTATCAGGCGT
12021       -ACCATATTCTTGATGGGCACGAGTGGACTCGAACCACCGACCTCACGCTTATCAGGCGT
12020       -ACCATATTCTTGATGGGCACGAGTGGACTCGAACCACCGACCTCACGCTTATCAGGCGT
12018       CACCATGAT-----ATCACA-----AGGTTCAAGCGAA--GTCTCCATTATGT-------
12022       CATATTGATTTTTGATTATATCTGCAGCTTTAAACACATCATTATCATTATTTAAAGGCA

12023       ACTATTTATCCTATAAAATTGTAATGCCGGC-----------------------------
12024       ------TATCCTATAAAATTGTAATGCCGGC-----------------------------
12019       GCGCTCTAACCACCTGAGCTACGCGCCCAAAATAACTTCTAAAATTATAAAGTTAATGCC
12021       GCGCTCTAACCACCTGAGCTACGCGCCCAAG-------CTA-------------------
12020       GCGCTCTAACCACCTGAGCTACGCGCCCAAG-------CTA-------------------
12018       --TCGTTATAAACAGTAAGGATGAAAAAGAG------------------------CTAT
12022       TTTTGCTACTATCAGAATCGATAACAATACAAT-----CTT---------------CCTT
                        **        *

12023       ---TACATGACTTGAACACGCGACCCTCTGATTACAAATCAGATGCTCTACCAACTGAGC
12024       ---TACATGACTTGAACACGCGACCCTCTGATTACAAATCAGATGCTCTACCAACTGAGC
12019       GGCTACATGACTTGAACACGCGACCCTCTGATTACAAATCAGATGCTCTACCAACTGAGC
12021       --TTGCTTGGTTT-----T---TACTTTCTTATA-------A------------------
12020       --TTGCTTGGTTT-----T---TACTTTCTTATA------------------A-------
12018       TAAAGCACTATATGAA-ACAT--TCTTCCAAA--AATAGTACCTATTACACTACTTACAC
12022       TAGCTCAGAAATGGTA-ACGTAGTCATTAAGATCAATACTAACCATAATCATAGCTAATT
                  *                 *

12023       TAAGCCGGCAATCTACTAATGCGGGTGAAGGGACTTGAACCCCACGCCGTTAAGCGCCA
12024       TAAGCCGGCAATCTACTAATGCGGGTGAAGGGACTTGAACCCCACGCCGTTAAGCGCCA
12019       TAAGCCGGCAATCTACTAATGCGGGTGAAGGGACTTGAACCCCACGCCGTTAAGCGCCA
12021       ---------AG-----TAAAGCGGGTGACGAGAATCGAACTC------------------
12020       ---------AG-----TAAAGCGGGTGACGAGAATCGAACTC------------------
12018       TATTAGATAGATAA--CAAATCGTCCT-----AAGTAAGCTTA-------CTTAGGACGA
12022       CATGATAACCATCGT-CACATCGTCCTTTAATATCTAATCCTAAATTAAGTTTGGCAGGA
                  *  **          *   * *
```

-continued

```
12023  GATCCTAAATCTGGTGCGTCTGCCAATTCCGCCACACCCGCATTTCTAAATGACCCGTAC
12024  GATCCTAAATCTGGTGCGTCTGCCAATTCCGCCACACCCGCATTTCTAAATGACCCGTAC
12019  GATCCTAAATCTGGTGCGTCTGCCAATTCCGCCACACCCGCATTTCTAAATGACCCGTAC
12021  -------------------------------GCGACAACAGC-------------------
12020  -------------------------------GCGACAACAGC-------------------
12018  TTTT----ATTTAGAACATAGGATAGTTTTTCCACTTTTAATCGTAA-------CCACTT
12022  GCTT----TCTCAAAAATTTTCATAAAACCTCCCTAATAAAATATAGAA-T-ATCCATAT
                                       *

12023  TGGGCTCGAACCAGTGACCCATTGATTAAAAGTCAATTGCTCTACCAACTGAGCTAACGA
12024  TGGGCTCGAACCAGTGACCCATTGATTAAAAGTCAATTGCTCTACCAACTGAGCTAACGA
12019  TGGGCTCGAACCAGTGACCCATTGATTAAAAGTCAATTGCTCTACCAACTGAGCTAACGA
12021  ---------------T-----------TGGAAGGCTGTAGTTTTACCA-CTAAACTA----
12020  -------------------------TTGGAAGGCTGTAGTTTTACCA-CTAAACTA----
12018  GGTATCA------GTGACA----AATTCGGA--CAATTAAGATGTTAGCCAATCTTAAGG
12022  TATAACATAACAAATGACA----AATTCGGA--CAATTAAGATGCTAGCCAATCTTAAGG
                         *   *    *  *      *    *   *   **

12023  GTCTACGGTCCCGACGGGAATCGAACCCGCGATCTTCGCCGTGACAGGGCGACGTGATAA
12024  GTCTACGGTCCCGACGGGAATCGAACCCGCGATCTTCGCCGTGACAGGGCGACGTGATAA
12019  GTCTACGGTCCCGACGGGAATCGAACCCGCGATCTTCGCCGTGACAGGGCGACGTGATAA
12021  --------------------------------------------CACC------------
12020  --------------------------------------------CACC------------
12018  ATA-ATAATTCCAATAAAAA--------------------AAGGCTAACCAAAGTTAGTC
12022  ATA-ATAATTCCAATAAAAA--------------------AAGGCTAACCAAAGTTAGTC
                                                        *

12023  CCGCTACACTACGGGACCTATGGGAGTTAACGGGATCGAACCGCTGACCCTCTGCTTGTA
12024  CCGCTACACTACGGGACCTATGGGAGTTAACGGGATCGAACCGCTGACCCTCTGCTTGTA
12019  CCGCTACACTACGGGACCTATGGGAGTTAACGGGATCGAACCGCTGACCCTCTGCTTGTA
12021  -CGCT-----------TCTATGGGAGTTAACGGGATCGAACCGCTGACCCTCTGCTTGTA
22020  -CGCT-----------TCTATGGAGTTAACGGGATCGAACCGCTGACCCTCTGCTTGTA
12018  TCCCTTTA--------TCTACTCCGCCAGTAGGACTCGAACCTACGACATCATGATTAAC
12022  TCCCTTTA--------TCTACTCCGCCAGTAGGACTCGAACCTACGACATCATGATTAAC
        * **           ***             ** *******  ***    ** **

12023  AGGCAGATGCT-CTCCCAGCTGAGCTAAACTCCCTTT--GCTAAGCGACTACCTTATCTC
12024  AGGCAGATGCT-CTCCCAGCTGAGCTAAACTCCCTTT--GCTAAGCGACTACCTTATCTC
12019  AGGCAGATGCT-CTCCCAGCTGAGCTAAACTCCCTTT--GCTAAGCGACTACCTTATCTC
12021  AGGCAGATGCT-CTCCCAGCTGAGCTAAACTCCCTTT--GCTAAGCGACTACCTTATCTC
12020  AGGCAGATGCT-CTCCCAGCTGAGCTAAACTCCCTTT--GCTAAGCGACTACCTTATCTC
12018  AGTCATGCGCTACTACCAACTGAGCTATGGCGGATTATAGCTAAGCGACTACCTTATCTC
12022  AGTCATGCGCTACTACCAACTGAGCTATGGCGGATTATAGCTAAGCGACTACCTTATCTC
        ** **   *** ** *** *******          **  ********************

12023  ACAGGGGGCAACCCCCAACTACTTCCGGCGTTCTAGGGCTTAACTTCTGTGTTCGGCATG
12024  ACAGGGGGCAACCCCCAACTACTTCCGGCGTTCTAGGGCTTAACTTCTGTGTTCGGCATG
12019  ACAGGGGGCAACCCCCAACTACTTCCGGCGTTCTAGGGCTTAACTTCTGTGTTCGGCATG
12021  ACAGGGGGCAACCCCCAACTACTTCCGGCGTTCTAGGGCTTAACTTCTGTGTTCGGCATG
12020  ACAGGGGGCAACCCCCAACTACTTCCGGCGTTCTAGGGCTTAACTTCTGTGTTCGGCATG
12018  ACAGGGGGCAACCCCCAACTACTTCCGGCGTTCTAGGGCTTAACTTCTGTGTTCGGCATG
12022  ACAGGGGGCAACCCCCAACTACTTCCGGCGTTCTAGGGCTTAACTTCTGTGTTCGGCATG
        ************************************************************

12023  AGAACAGGTGTATCTCCTAGGCAATTATCACTTAACTATTGAGCCTTATTCACTCAAAAT
12024  AGAACAGGTGTATCTCCTAGGCAATTATCACTTAACTATTGAGCCTTATTCACTCAAAAT
12019  AGAACAGGTGTATCTCCTAGGCAATTATCACTTAACTATTGAGCCTTATTCACTCAAAAT
12021  AGAACAGGTGTATCTCCTAGGCAATTATCACTTAACTATTGAGCCTTATTCACTCAAAAT
12020  AGAACAGGTGTATCTCCTAGGCAATTATCACTTAACTATTGAGCCTTATTCACTCAAAAT
12018  AGAACAGGTGTATCTCCTAGGCAATTATCACTTAACTATTGAGCCTTATTCACTCAAAAT
12022  AGAACAGGTGTATCTCCTAGGCAATTATCACTTAACTATTGAGCCTTATTCACTCAAAAT
        ************************************************************

12023  TGAATATCTATAGTCTAACAAGAAACCGTAACGTTGTCAATATCTCTTTTTGGATAAGTC
12024  TGAATATCTATAGTCTAACAAGAAACCGTAACGTTGTCAATATCTCTTTTTGGATAAGTC
12019  TGAATATCTATAGTCTAACAAGAAACCGTAACGTTGTCAATATCTCTTTTTGGATAAGTC
12021  TGAATATCTATAGTCTAACAAGAAACCGTAACGTTGTCAATATCTCTTTTTGGATAAGTC
12020  TGAATATCTATAGTCTAACAAGAAACCGTAACGTTGTCAATATCTCTTTTTGGATAAGTC
12018  TGAATATCTATAGTCTAACAAGAAACCGTAACGTTGTCAATATCTCTTTTTGGATAAGTC
12022  TGAATATCTATAGTCTAACAAGAAACCGTAACGTTGTCAATATCTCTTTTTGGATAAGTC
        ************************************************************

12023  CTCGAGCTATTAGTATTAGTCCGCTAAATGTGTCACCACAATTACACTCCTAACCTATCT
12024  CTCGAGCTATTAGTATTAGTCCGCTAAATGTGTCACCACAATTACACTCCTAACCTATCT
12019  CTCGAGCTATTAGTATTAGTCCGCTAAATGTGTCACCACAATTACACTCCTAACCTATCT
12021  CTCGAGCTATTAGTATTAGTCCGCTAAATGTGTCACCACAATTACACTCCTAACCTATCT
12020  CTCGAGCTATTAGTATTAGTCCGCTAAATGTGTCACCACAATTACACTCCTAACCTATCT
12018  CTCGAGCTATTAGTATTAGTCCGCTAAATGTGTCACCACAATTACACTCCTAACCTATCT
12022  CTCGAGCTATTAGTATTAGTCCGCTAAATGTGTCACCACAATTACACTCCTAACCTATCT
        ************************************************************
```

-continued

```
12023  ACCTGATCATCTCTCAGGGCTCTTACTGATATAAAATCATGGGAAATCTCATCTTGAGGT
12024  ACCTGATCATCTCTCAGGGCTCTTACTGATATAAAATCATGGGAAATCTCATCTTGAGGT
12019  ACCTGATCATCTCTCAGGGCTCTTACTGATATAAAATCATGGGAAATCTCATCTTGAGGT
12021  ACCTGATCATCTCTCAGGGCTCTTACTGATATAAAATCATGGGAAATCTCATCTTGAGGT
12020  ACCTGATCATCTCTCAGGGCTCTTACTGATATAAAATCATGGGAAATCTCATCTTGAGGT
12018  ACCTGATCATCTCTCAGGGCTCTTACTGATATAAAATCATGGGAAATCTCATCTTGAGGT
12022  ACCTGATCATCTCTCAGGGCTCTTACTGATATAAAATCATGGGAAATCTCATCTTGAGGT
       ************************************************************

12023  GGGCTTCGCACTTAGATGCTTTCAGCGCTTATCCCTTCCCTACATAGCTACCCAGCGATG
12024  GGGCTTCGCACTTAGATGCTTTCAGCGCTTATCCCTTCCCTACATAGCTACCCAGCGATG
12019  GGGCTTCGCACTTAGATGCTTTCAGCGCTTATCCCTTCCCTACATAGCTACCCAGCGATG
12021  GGGCTTCGCACTTAGATGCTTTCAGCGCTTATCCCTTCCCTACATAGCTACCCAGCGATG
12020  GGGCTTCGCACTTAGATGCTTTCAGCGCTTATCCCTTCCCTACATAGCTACCCAGCGATG
12018  GGGCTTCGCACTTAGATGCTTTCAGCGCTTATCCCTTCCCTACATAGCTACCCAGCGATG
12022  GGGCTTCGCACTTAGATGCTTTCAGCGCTTATCCCTTCCCTACATAGCTACCCAGCGATG
       ************************************************************

12023  CCTTTGGCAAGACAACTGGTACACCAGCGGTAAGTCCACTCTGGTCCTCTCGTACTAGGA
12024  CCTTTGGCAAGACAACTGGTACACCAGCGGTAAGTCCACTCTGGTCCTCTCGTACTAGGA
12019  CCTTTGGCAAGACAACTGGTACACCAGCGGTAAGTCCACTCTGGTCCTCTCGTACTAGGA
12021  CCTTTGGCAAGACAACTGGTACACCAGCGGTAAGTCCACTCTGGTCCTCTCGTACTAGGA
12020  CCTTTGGCAAGACAACTGGTACACCAGCGGTAAGTCCACTCTGGTCCTCTCGTACTAGGA
12018  CCTTTGGCAAGACAACTGGTACACCAGCGGTAAGTCCACTCTGGTCCTCTCGTACTAGGA
12022  CCTTTGGCAAGACAACTGGTACACCAGCGGTAAGTCCACTCTGGTCCTCTCGTACTAGGA
       ************************************************************

12023  GCAGATCCTCTCAAATTTCCTACGCCCGCGACGGATAGGGACCGAACTGTCTCACGACGT
12024  GCAGATCCTCTCAAATTTCCTACGCCCGCGACGGATAGGGACCGAACTGTCTCACGACGT
12019  GCAGATCCTCTCAAATTTCCTACGCCCGCGACGGATAGGGACCGAACTGTCTCACGACGT
12021  GCAGATCCTCTCAAATTTCCTACGCCCGCGACGGATAGGGACCGAACTGTCTCACGACGT
12020  GCAGATCCTCTCAAATTTCCTACGCCCGCGACGGATAGGGACCGAACTGTCTCACGACGT
12018  GCAGATCCTCTCAAATTTCCTACGCCCGCGACGGATAGGGACCGAACTGTCTCACGACGT
12022  GCAGATCCTCTCAAATTTCCTACGCCCGCGACGGATAGGGACCGAACTGTCTCACGACGT
       ************************************************************

12023  TCTGAACCCAGCTCGCGTGCCGCTTTAATGGGCGAACAGCCCAACCCTTGGGACCGACTA
12024  TCTGAACCCAGCTCGCGTGCCGCTTTAATGGGCGAACAGCCCAACCCTTGGGACCGACTA
12019  TCTGAACCCAGCTCGCGTGCCGCTTTAATGGGCGAACAGCCCAACCCTTGGGACCGACTA
12021  TCTGAACCCAGCTCGCGTGCCGCTTTAATGGGCGAACAGCCCAACCCTTGGGACCGACTA
12020  TCTGAACCCAGCTCGCGTGCCGCTTTAATGGGCGAACAGCCCAACCCTTGGGACCGACTA
12018  TCTGAACCCAGCTCGCGTGCCGCTTTAATGGGCGAACAGCCCAACCCTTGGGACCGACTA
12022  TCTGAACCCAGCTCGCGTGCCGCTTTAATGGGCGAACAGCCCAACCCTTGGGACCGACTA
       ************************************************************

12023  CAGCCCCAGGATGCGACGAGCCGACATCGAGGTGCCAAACCTCCCCGTCGATGTGAACTC
12024  CAGCCCCAGGATGCGACGAGCCGACATCGAGGTGCCAAACCTCCCCGTCGATGTGAACTC
12019  CAGCCCCAGGATGCGACGAGCCGACATCGAGGTGCCAAACCTCCCCGTCGATGTGAACTC
12021  CAGCCCCAGGATGCGACGAGCCGACATCGAGGTGCCAAACCTCCCCGTCGATGTGAACTC
12020  CAGCCCCAGGATGCGACGAGCCGACATCGAGGTGCCAAACCTCCCCGTCGATGTGAACTC
12018  CAGCCCCAGGATGCGACGAGCCGACATCGAGGTGCCAAACCTCCCCGTCGATGTGAACTC
12022  CAGCCCCAGGATGCGACGAGCCGACATCGAGGTGCCAAACCTCCCCGTCGATGTGAACTC
       ************************************************************

12023  TTGGGGGAGATAAGCCTGTTATCCCCAGGGTAGCTTTTATCCGTTGAGCGATGGCCCTTC
12024  TTGGGGGAGATAAGCCTGTTATCCCCAGGGTAGCTTTTATCCGTTGAGCGATGGCCCTTC
12019  TTGGGGGAGATAAGCCTGTTATCCCCAGGGTAGCTTTTATCCGTTGAGCGATGGCCCTTC
12021  TTGGGGGAGATAAGCCTGTTATCCCCAGGGTAGCTTTTATCCGTTGAGCGATGGCCCTTC
12020  TTGGGGGAGATAAGCCTGTTATCCCCAGGGTAGCTTTTATCCGTTGAGCGATGGCCCTTC
12018  TTGGGGGAGATAAGCCTGTTATCCCCAGGGTAGCTTTTATCCGTTGAGCGATGGCCCTTC
12022  TTGGGGGAGATAAGCCTGTTATCCCCAGGGTAGCTTTTATCCGTTGAGCGATGGCCCTTC
       ************************************************************

12023  CATACGGAACCACCGGATCACTAAGCCCGACTTTCGTCCCTGCTCGAGTTGTAGCTCTCG
12024  CATACGGAACCACCGGATCACTAAGCCCGACTTTCGTCCCTGCTCGAGTTGTAGCTCTCG
12019  CATACGGAACCACCGGATCACTAAGCCCGACTTTCGTCCCTGCTCGAGTTGTAGCTCTCG
12021  CATACGGAACCACCGGATCACTAAGCCCGACTTTCGTCCCTGCTCGAGTTGTAGCTCTCG
12020  CATACGGAACCACCGGATCACTAAGCCCGACTTTCGTCCCTGCTCGAGTTGTAGCTCTCG
12018  CATACGGAACCACCGGATCACTAAGCCCGACTTTCGTCCCTGCTCGAGTTGTAGCTCTCG
12022  CATACGGAACCACCGGATCACTAAGCCCGACTTTCGTCCCTGCTCGAGTTGTAGCTCTCG
       ************************************************************

12023  CAGTCAAGCTCCCTTATACCTTTACACTCTACGACTGATTTCCAACCAGTCTGAGGGAAC
12024  CAGTCAAGCTCCCTTATACCTTTACACTCTACGACTGATTTCCAACCAGTCTGAGGGAAC
12019  CAGTCAAGCTCCCTTATACCTTTACACTCTACGACTGATTTCCAACCAGTCTGAGGGAAC
12021  CAGTCAAGCTCCCTTATACCTTTACACTCTACGACTGATTTCCAACCAGTCTGAGGGAAC
12020  CAGTCAAGCTCCCTTATACCTTTACACTCTACGACTGATTTCCAACCAGTCTGAGGGAAC
12018  CAGTCAAGCTCCCTTATACCTTTACACTCTACGACTGATTTCCAACCAGTCTGAGGGAAC
12022  CAGTCAAGCTCCCTTATACCTTTACACTCTACGACTGATTTCCAACCAGTCTGAGGGAAC
       ************************************************************
```

```
-continued

12023   CTTTGGGCGCCTCCGTTACCTTTTAGGAGGCGACCGCCCCAGTCAAACTGCCCGTCAGAC
12024   CTTTGGGCGCCTCCGTTACCTTTTAGGAGGCGACCGCCCCAGTCAAACTGCCCGTCAGAC
12019   CTTTGGGCGCCTCCGTTACCTTTTAGGAGGCGACCGCCCCAGTCAAACTGCCCGTCAGAC
12021   CTTTGGGCGCCTCCGTTACCTTTTAGGAGGCGACCGCCCCAGTCAAACTGCCCGTCAGAC
12020   CTTTGGGCGCCTCCGTTACCTTTTAGGAGGCGACCGCCCCAGTCAAACTGCCCGTCAGAC
12018   CTTTGGGCGCCTCCGTTACCTTTTAGGAGGCGACCGCCCCAGTCAAACTGCCCGTCAGAC
12022   CTTTGGGCGCCTCCGTTACCTTTTAGGAGGCGACCGCCCCAGTCAAACTGCCCGTCAGAC
        ************************************************************

12023   ACTGTCTCCGATAGGGATTGCCTATCTGGGTTAGAGTAGCCATAACACAAGGGTAGTATC
12024   ACTGTCTCCGATAGGGATTGCCTATCTGGGTTAGAGTAGCCATAACACAAGGGTAGTATC
12019   ACTGTCTCCGATAGGGATTGCCTATCTGGGTTAGAGTAGCCATAACACAAGGGTAGTATC
12021   ACTGTCTCCGATAGGGATTGCCTATCTGGGTTAGAGTAGCCATAACACAAGGGTAGTATC
12020   ACTGTCTCCGATAGGGATTGCCTATCTGGGTTAGAGTAGCCATAACACAAGGGTAGTATC
12018   ACTGTCTCCGATAGGGATTGCCTATCTGGGTTAGAGTAGCCATAACACAAGGGTAGTATC
12022   ACTGTCTCCGATAGGGATTGCCTATCTGGGTTAGAGTAGCCATAACACAAGGGTAGTATC
        ************************************************************

12023   CCAACAACGCCTCAAACGAAACTGGCGTCCCGTTATCATAGGCTCCTACCTATCCTGTAC
12024   CCAACAACGCCTCAAACGAAACTGGCGTCCCGTTATCATAGGCTCCTACCTATCCTGTAC
12019   CCAACAACGCCTCAAACGAAACTGGCGTCCCGTTATCATAGGCTCCTACCTATCCTGTAC
12021   CCAACAACGCCTCAAACGAAACTGGCGTCCCGTTATCATAGGCTCCTACCTATCCTGTAC
12020   CCAACAACGCCTCAAACGAAACTGGCGTCCCGTTATCATAGGCTCCTACCTATCCTGTAC
12018   CCAACAACGCCTCAAACGAAACTGGCGTCCCGTTATCATAGGCTCCTACCTATCCTGTAC
12022   CCAACAACGCCTCAAACGAAACTGGCGTCCCGTTATCATAGGCTCCTACCTATCCTGTAC
        ************************************************************

12023   ATGTGGTACAGATACTCAATATCAAACTGCAGTAAAGCTCCATGGGGTCTTTCCGTCCTG
12024   ATGTGGTACAGATACTCAATATCAAACTGCAGTAAAGCTCCATGGGGTCTTTCCGTCCTG
12019   ATGTGGTACAGATACTCAATATCAAACTGCAGTAAAGCTCCATGGGGTCTTTCCGTCCTG
12021   ATGTGGTACAGATACTCAATATCAAACTGCAGTAAAGCTCCATGGGGTCTTTCCGTCCTG
12020   ATGTGGTACAGATACTCAATATCAAACTGCAGTAAAGCTCCATGGGGTCTTTCCGTCCTG
12018   ATGTGGTACAGATACTCAATATCAAACTGCAGTAAAGCTCCATGGGGTCTTTCCGTCCTG
12022   ATGTGGTACAGATACTCAATATCAAACTGCAGTAAAGCTCCATGGGGTCTTTCCGTCCTG
        ************************************************************

12023   TCGCGGGTAACCTGCATCTTCACAGGTACTAAAATTTCACCGAGTCTCTCGTTGAGACAG
12024   TCGCGGGTAACCTGCATCTTCACAGGTACTAAAATTTCACCGAGTCTCTCGTTGAGACAG
12019   TCGCGGGTAACCTGCATCTTCACAGGTACTAAAATTTCACCGAGTCTCTCGTTGAGACAG
12021   TCGCGGGTAACCTGCATCTTCACAGGTACTAAAATTTCACCGAGTCTCTCGTTGAGACAG
12020   TCGCGGGTAACCTGCATCTTCACAGGTACTAAAATTTCACCGAGTCTCTCGTTGAGACAG
12018   TCGCGGGTAACCTGCATCTTCACAGGTACTAAAATTTCACCGAGTCTCTCGTTGAGACAG
12022   TCGCGGGTAACCTGCATCTTCACAGGTACTAAAATTTCACCGAGTCTCTCGTTGAGACAG
        ************************************************************

12023   TGCCCAAATCATTACGCCTTTCGTGCGGGTCGGAACTTACCCGACAAGGAATTTCGCTAC
12024   TGCCCAAATCATTACGCCTTTCGTGCGGGTCGGAACTTACCCGACAAGGAATTTCGCTAC
12019   TGCCCAAATCATTACGCCTTTCGTGCGGGTCGGAACTTACCCGACAAGGAATTTCGCTAC
12021   TGCCCAAATCATTACGCCTTTCGTGCGGGTCGGAACTTACCCGACAAGGAATTTCGCTAC
12020   TGCCCAAATCATTACGCCTTTCGTGCGGGTCGGAACTTACCCGACAAGGAATTTCGCTAC
12018   TGCCCAAATCATTACGCCTTTCGTGCGGGTCGGAACTTACCCGACAAGGAATTTCGCTAC
12022   TGCCCAAATCATTACGCCTTTCGTGCGGGTCGGAACTTACCCGACAAGGAATTTCGCTAC
        ************************************************************

12023   CTTAGGACCGTTATAGTTACGGCCGCCGTTTACTGGGGCTTCAATTCATACCTTCGCTTA
12024   CTTAGGACCGTTATAGTTACGGCCGCCGTTTACTGGGGCTTCAATTCATACCTTCGCTTA
12019   CTTAGGACCGTTATAGTTACGGCCGCCGTTTACTGGGGCTTCAATTCATACCTTCGCTTA
12021   CTTAGGACCGTTATAGTTACGGCCGCCGTTTACTGGGGCTTCAATTCATACCTTCGCTTA
12020   CTTAGGACCGTTATAGTTACGGCCGCCGTTTACTGGGGCTTCAATTCATACCTTCGCTTA
12018   CTTAGGACCGTTATAGTTACGGCCGCCGTTTACTGGGGCTTCAATTCATACCTTCGCTTA
12022   CTTAGGACCGTTATAGTTACGGCCGCCGTTTACTGGGGCTTCAATTCATACCTTCGCTTA
        ************************************************************

12023   CGCTAAGCACTCCTCTTAACCTTCCAGCACCGGGCAGGCGTCACCCCCTATACATCATCT
12024   CGCTAAGCACTCCTCTTAACCTTCCAGCACCGGGCAGGCGTCACCCCCTATACATCATCT
12019   CGCTAAGCACTCCTCTTAACCTTCCAGCACCGGGCAGGCGTCACCCCCTATACATCATCT
12021   CGCTAAGCACTCCTCTTAACCTTCCAGCACCGGGCAGGCGTCACCCCCTATACATCATCT
12020   CGCTAAGCACTCCTCTTAACCTTCCAGCACCGGGCAGGCGTCACCCCCTATACATCATCT
12018   CGCTAAGCACTCCTCTTAACCTTCCAGCACCGGGCAGGCGTCACCCCCTATACATCATCT
12022   CGCTAAGCACTCCTCTTAACCTTCCAGCACCGGGCAGGCGTCACCCCCTATACATCATCT
        ************************************************************

12023   TACGATTTAGCAGAGAGCTGTGTTTTTGATAAACAGTTGCTTGGGCCTATTCACTGCGGC
12024   TACGATTTAGCAGAGAGCTGTGTTTTTGATAAACAGTTGCTTGGGCCTATTCACTGCGGC
12019   TACGATTTAGCAGAGAGCTGTGTTTTTGATAAACAGTTGCTTGGGCCTATTCACTGCGGC
12021   TACGATTTAGCAGAGAGCTGTGTTTTTGATAAACAGTTGCTTGGGCCTATTCACTGCGGC
12020   TACGATTTAGCAGAGAGCTGTGTTTTTGATAAACAGTTGCTTGGGCCTATTCACTGCGGC
12018   TACGATTTAGCAGAGAGCTGTGTTTTTGATAAACAGTTGCTTGGGCCTATTCACTGCGGC
12022   TACGATTTAGCAGAGAGCTGTGTTTTTGATAAACAGTTGCTTGGGCCTATTCACTGCGGC
        ************************************************************
```

```
12023  TGATCTAAAATCAGCGCCCCTTCTCCCGAAGTTACGGGGCCATTTTGCCGAGTTCCTTAA
12024  TGATCTAAAATCAGCGCCCCTTCTCCCGAAGTTACGGGGCCATTTTGCCGAGTTCCTTAA
12019  TGATCTAAAATCAGCGCCCCTTCTCCCGAAGTTACGGGGCCATTTTGCCGAGTTCCTTAA
12021  TGATCTAAAATCAGCGCCCCTTCTCCCGAAGTTACGGGGCCATTTTGCCGAGTTCCTTAA
12020  TGATCTAAAATCAGCGCCCCTTCTCCCGAAGTTACGGGGCCATTTTGCCGAGTTCCTTAA
12018  TGATCTAAAATCAGCGCCCCTTCTCCCGAAGTTACGGGGCCATTTTGCCGAGTTCCTTAA
12022  TGATCTAAAATCAGCGCCCCTTCTCCCGAAGTTACGGGGCCATTTTGCCGAGTTCCTTAA
       ************************************************************

12023  CGAGAGTTCTCTCGCTCACCTGAGGCTACTCGCCTCGACTACCTGTGTCGGTTTGCGGTA
12024  CGAGAGTTCTCTCGCTCACCTGAGGCTACTCGCCTCGACTACCTGTGTCGGTTTGCGGTA
12019  CGAGAGTTCTCTCGCTCACCTGAGGCTACTCGCCTCGACTACCTGTGTCGGTTTGCGGTA
12021  CGAGAGTTCTCTCGCTCACCTGAGGCTACTCGCCTCGACTACCTGTGTCGGTTTGCGGTA
12020  CGAGAGTTCTCTCGCTCACMTGAGGCTACTCGCCTCGACTACCTGTGTCGGTTTGCGGTA
12018  CGAGAGTTCTCTCGCTCACCTGAGGCTACTCGCCTCGACTACCTGTGTCGGTTTGCGGTA
12022  CGAGAGTTCTCTCGCTCACCTGAGGCTACTCGCCTCGACTACCTGTGTCGGTTTGCGGTA
       ******************* ****************************************

12023  CGGGTAGAGTATATGTATCGCTAGAAGCTTTTCTTGGCAGTGTGACATCACTAACTTCGC
12024  CGGGTAGAGTATATGTATCGCTAGAAGCTTTTCTTGGCAGTGTGACATCACTAACTTCGC
12019  CGGGTAGAGTATATGTATCGCTAGAAGCTTTTCTTGGCAGTGTGACATCACTAACTTCGC
12021  CGGGTAGAGTATATGTATCGCTAGAAGCTTTTCTTGGCAGTGTGACATCACTAACTTCGC
12020  CGGGTAGAGTATATGTATCGCTAGAAGCTTTTCTTGGCAGTGTGACATCACTAACTTCGC
12018  CGGGTAGAGTATATGTATCGCTAGAAGCTTTTCTTGGCAGTGTGACATCACTAACTTCGC
12022  CGGGTAGAGTATATGTATCGCTAGAAGCTTTTCTTGGCAGTGTGACATCACTAACTTCGC
       ************************************************************

12023  TACTAAACTTCGCTCCTCGTCACAGCTCAATGTTAAAGATATAAGCATTTGACTCATATC
12024  TACTAAACTTCGCTCCTCGTCACAGCTCAATGTTAAAGATATAAGCATTTGACTCATATC
12019  TACTAAACTTCGCTCCTCGTCACAGCTCAATGTTAAAGATATAAGCATTTGACTCATATC
12021  TACTAAACTTCGCTCCTCGTCACAGCTCAATGTTAAAGATATAAGCATTTGACTCATATC
12020  TACTAAACTTCGCTCCTCGTCACAGCTCAATGTTAAAGATATAAGCATTTGACTCATATC
12018  TACTAAACTTCGCTCCTCGTCACAGCTCAATGTTAAAGATATAAGCATTTGACTCATATC
12022  TACTAAACTTCGCTCCTCGTCACAGCTCAATGTTAAAGATATAAGCATTTGACTCATATC
       ************************************************************

12023  ACACCTCACTGTTTGACCAGACACTTCCAATCGTCTGGTTTAGTTAGCCTACTGCGTCCC
12024  ACACCTCACTGTTTGACCAGACACTTCCAATCGTCTGGTTTAGTTAGCCTACTGCGTCCC
12019  ACACCTCACTGTTTGACCAGACACTTCCAATCGTCTGGTTTAGTTAGCCTACTGCGTCCC
12021  ACACCTCACTGTTTGACCAGACACTTCCAATCGTCTGGTTTAGTTAGCCTACTGCGTCCC
12020  ACACCTCACTGTTTGACCAGACACTTCCAATCGTCTGGTTTAGTTAGCCTACTGCGTCCC
12018  ACACCTCACTGTTTGACCAGACACTTCCAATCGTCTGGTTTAGTTAGCCTACTGCGTCCC
12022  ACACCTCACTGTTTGACCAGACACTTCCAATCGTCTGGTTTAGTTAGCCTACTGCGTCCC
       ************************************************************

12023  TCCATCACTATATACTCTAGTACAGGAATATCAACCTGTTGTCCATCGGATACACCTTTC
12024  TCCATCACTATATACTCTAGTACAGGAATATCAACCTGTTGTCCATCGGATACACCTTTC
12019  TCCATCACTATATACTCTAGTACAGGAATATCAACCTGTTGTCCATCGGATACACCTTTC
12021  TCCATCACTATATACTCTAGTACAGGAATATCAACCTGTTGTCCATCGGATACACCTTTC
12020  TCCATCACTATATACTCTAGTACAGGAATATCAACCTGTTGTCCATCGGATACACCTTTC
12018  TCCATCACTATATACTCTAGTACAGGAATATCAACCTGTTGTCCATCGGATACACCTTTC
12022  TCCATCACTATATACTCTAGTACAGGAATATCAACCTGTTGTCCATCGGATACACCTTTC
       ************************************************************

12023  GGTCTCTCCTTAGGTCCCGACTAACCCAGGGCGGACGAGCCTTCCCCTGGAAACCTTAGT
12024  GGTCTCTCCTTAGGTCCCGACTAACCCAGGGCGGACGAGCCTTCCCCTGGAAACCTTAGT
12019  GGTCTCTCCTTAGGTCCCGACTAACCCAGGGCGGACGAGCCTTCCCCTGGAAACCTTAGT
12021  GGTCTCTCCTTAGGTCCCGACTAACCCAGGGCGGACGAGCCTTCCCCTGGAAACCTTAGT
12020  GGTCTCTCCTTAGGTCCCGACTAACCCAGGGCGGACGAGCCTTCCCCTGGAAACCTTAGT
12018  GGTCTCTCCTTAGGTCCCGACTAACCCAGGGCGGACGAGCCTTCCCCTGGAAACCTTAGT
12022  GGTCTCTCCTTAGGTCCCGACTAACCCAGGGCGGACGAGCCTTCCCCTGGAAACCTTAGT
       ************************************************************

12023  CTTACGGTGGACAGGATTCTCACCTGTCTTGCGCTACTCATACCGGCATTCTCACTTCTA
12024  CTTACGGTGGACAGGATTCTCACCTGTCTTGCGCTACTCATACCGGCATTCTCACTTCTA
12019  CTTACGGTGGACAGGATTCTCACCTGTCTTGCGCTACTCATACCGGCATTCTCACTTCTA
12021  CTTACGGTGGACAGGATTCTCACCTGTCTTGCGCTACTCATACCGGCATTCTCACTTCTA
12020  CTTACGGTGGACAGGATTCTCACCTGTCTTGCGCTACTCATACCGGCATTCTCACTTCTA
12018  CTTACGGTGGACAGGATTCTCACCTGTCTTGCGCTACTCATACCGGCATTCTCACTTCTA
12022  CTTACGGTGGACAGGATTCTCACCTGTCTTGCGCTACTCATACCGGCATTCTCACTTCTA
       ************************************************************

12023  TGCGTTCCAGCGCTCCTCACGGTACACCTTCTTCACACATAGAACGCTCTCCTACCATGA
12024  TGCGTTCCAGCGCTCCTCACGGTACACCTTCTTCACACATAGAACGCTCTCCTACCATGA
12019  TGCGTTCCAGCGCTCCTCACGGTACACCTTCTTCACACATAGAACGCTCTCCTACCATGA
12021  TGCGTTCCAGCGCTCCTCACGGTACACCTTCTTCACACATAGAACGCTCTCCTACCATGA
12020  TGCGTTCCAGCGCTCCTCACGGTACACCTTCTTCACACATAGAACGCTCTCCTACCATGA
12018  TGCGTTCCAGCGCTCCTCACGGTACACCTTCTTCACACATAGAACGCTCTCCTACCATGA
12022  TGCGTTCCAGCGCTCCTCACGGTACACCTTCTTCACACATAGAACGCTCTCCTACCATGA
       ************************************************************
```

```
                    -continued
12023   CACTTTTGTGTCATCCACAGCTTCGGTAATATGTTTTAGCCCCGGTACATTTTCGGCGCA
12024   CACTTTTGTGTCATCCACAGCTTCGGTAATATGTTTTAGCCCCGGTACATTTTCGGCGCA
12019   CACTTTTGTGTCATCCACAGCTTCGGTAATATGTTTTAGCCCCGGTACATTTTCGGCGCA
12021   CACTTTTGTGTCATCCACAGCTTCGGTAATATGTTTTAGCCCCGGTACATTTTCGGCGCA
12020   CACTTTTGTGTCATCCACAGCTTCGGTAATATGTTTTAGCCCCGGTACATTTTCGGCGCA
12018   CACTTTTGTGTCATCCACAGCTTCGGTAATATGTTTTAGCCCCGGTACATTTTCGGCGCA
12022   CACTTTTGTGTCATCCACAGCTTCGGTAATATGTTTTAGCCCCGGTACATTTTCGGCGCA
        ************************************************************

12023   GGGTCACTCGACTAGTGAGCTATTACGCACTCTTTGAATGAATAGCTGCTTCTAAGCTAA
12024   GGGTCACTCGACTAGTGAGCTATTACGCACTCTTTGAATGAATAGCTGCTTCTAAGCTAA
12019   GGGTCACTCGACTAGTGAGCTATTACGCACTCTTTGAATGAATAGCTGCTTCTAAGCTAA
12021   GGGTCACTCGACTAGTGAGCTATTACGCACTCTTTGAATGAATAGCTGCTTCTAAGCTAA
12020   GGGTCACTCGACTAGTGAGCTATTACGCACTCTTTGAATGAATAGCTGCTTCTAAGCTAA
12018   GGGTCACTCGACTAGTGAGCTATTACGCACTCTTTGAATGAATAGCTGCTTCTAAGCTAA
12022   GGGTCACTCGACTAGTGAGCTATTACGCACTCTTTGAATGAATAGCTGCTTCTAAGCTAA
        ************************************************************

12023   CATCCTAGTTGTCTGTGCAACCCCACATCCTTTTCCACTTAACATATATTTTGGGACCTT
12024   CATCCTAGTTGTCTGTGCAACCCCACATCCTTTTCCACTTAACATATATTTTGGGACCTT
12019   CATCCTAGTTGTCTGTGCAACCCCACATCCTTTTCCACTTAACATATATTTTGGGACCTT
12021   CATCCTAGTTGTCTGTGCAACCCCACATCCTTTTCCACTTAACATATATTTTGGGACCTT
12020   CATCCTAGTTGTCTGTGCAACCCCACATCCTTTTCCACTTAACATATATTTTGGGACCTT
12018   CATCCTAGTTGTCTGTGCAACCCCACATCCTTTTCCACTTAACATATATTTTGGGACCTT
12022   CATCCTAGTTGTCTGTGCAACCCCACATCCTTTTCCACTTAACATATATTTTGGGACCTT
        ************************************************************

12023   AGCTGGTGGTCTGGGCTGTTTCCCTTTCGACTACGGATCTTAGCACTCGCAGTCTGACTG
12024   AGCTGGTGGTCTGGGCTGTTTCCCTTTCGACTACGGATCTTAGCACTCGCAGTCTGACTG
12019   AGCTGGTGGTCTGGGCTGTTTCCCTTTCGACTACGGATCTTAGCACTCGCAGTCTGACTG
12021   AGCTGGTGGTCTGGGCTGTTTCCCTTTCGACTACGGATCTTAGCACTCGCAGTCTGACTG
12020   AGCTGGTGGTCTGGGCTGTTTCCCTTTCGACTACGGATCTTAGCACTCGCAGTCTGACTG
12018   AGCTGGTGGTCTGGGCTGTTTCCCTTTCGACTACGGATCTTAGCACTCGCAGTCTGACTG
12022   AGCTGGTGGTCTGGGCTGTTTCCCTTTCGACTACGGATCTTAGCACTCGCAGTCTGACTG
        ************************************************************

12023   CCGATTATATCTCGTTGGCATTCGGAGTTTATCTGAGATTGGTAATCCGGGATGGACCCC
12024   CCGATTATATCTCGTTGGCATTCGGAGTTTATCTGAGATTGGTAATCCGGGATGGACCCC
12019   CCGATTATATCTCGTTGGCATTCGGAGTTTATCTGAGATTGGTAATCCGGGATGGACCCC
12021   CCGATTATATCTCGTTGGCATTCGGAGTTTATCTGAGATTGGTAATCCGGGATGGACCCC
12020   CCGATTATATCTCGTTGGCATTCGGAGTTTATCTGAGATTGGTAATCCGGGATGGACCCC
12018   CCGATTATATCTCGTTGGCATTCGGAGTTTATCTGAGATTGGTAATCCGGGATGGACCCC
12022   CCGATTATATCTCGTTGGCATTCGGAGTTTATCTGAGATTGGTAATCCGGGATGGACCCC
        ************************************************************

12023   TCACCCAAACAGTGCTCTACCTCCAAGAGACTTAACATCGACGCTAGCCCTAAAGCTATT
12024   TCACCCAAACAGTGCTCTACCTCCAAGAGACTTAACATCGACGCTAGCCCTAAAGCTATT
12019   TCACCCAAACAGTGCTCTACCTCCAAGAGACTTAACATCGACGCTAGCCCTAAAGCTATT
12021   TCACCCAAACAGTGCTCTACCTCCAAGAGACTTAACATCGACGCTAGCCCTAAAGCTATT
12020   TCACCCAAACAGTGCTCTACCTCCAAGAGACTTAACATCGACGCTAGCCCTAAAGCTATT
12018   TCACCCAAACAGTGCTCTACCTCCAAGAGACTTAACATCGACGCTAGCCCTAAAGCTATT
12022   TCACCCAAACAGTGCTCTACCTCCAAGAGACTTAACATCGACGCTAGCCCTAAAGCTATT
        ************************************************************

12023   TCGGAGAGAACCAGCTATCTCCAAGTTCGTTTGGAATTTCTCCGCTACCCACAAGTCATC
12024   TCGGAGAGAACCAGCTATCTCCAAGTTCGTTTGGAATTTCTCCGCTACCCACAAGTCATC
12019   TCGGAGAGAACCAGCTATCTCCAAGTTCGTTTGGAATTTCTCCGCTACCCACAAGTCATC
12021   TCGGAGAGAACCAGCTATCTCCAAGTTCGTTTGGAATTTCTCCGCTACCCACAAGTCATC
12020   TCGGAGAGAACCAGCTATCTCCAAGTTCGTTTGGAATTTCTCCGCTACCCACAAGTCATC
12018   TCGGAGAGAACCAGCTATCTCCAAGTTCGTTTGGAATTTCTCCGCTACCCACAAGTCATC
12022   TCGGAGAGAACCAGCTATCTCCAAGTTCGTTTGGAATTTCTCCGCTACCCACAAGTCATC
        ************************************************************

12023   CAAGCACTTTTCAACGTGCCCTGGTTCGGTCCTCCAGTGAGTTTTACCTCACCTTCAACC
12024   CAAGCACTTTTCAACGTGCCCTGGTTCGGTCCTCCAGTGAGTTTTACCTCACCTTCAACC
12019   CAAGCACTTTTCAACGTGCCCTGGTTCGGTCCTCCAGTGAGTTTTACCTCACCTTCAACC
12021   CAAGCACTTTTCAACGTGCCCTGGTTCGGTCCTCCAGTGAGTTTTACCTCACCTTCAACC
12020   CAAGCACTTTTCAACGTGCCCTGGTTCGGTCCTCCAGTGAGTTTTACCTCACCTTCAACC
12018   CAAGCACTTTTCAACGTGCCCTGGTTCGGTCCTCCAGTGAGTTTTACCTCACCTTCAACC
12022   CAAGCACTTTTCAACGTGCCCTGGTTCGGTCCTCCAGTGAGTTTTACCTCACCTTCAACC
        ************************************************************

12023   TGCTCATGGGTAGGTCACATGGTTTCGGGTCTACAACATGATACTATGACGCCCTATTAA
12024   TGCTCATGGGTAGGTCACATGGTTTCGGGTCTACAACATGATACTATGACGCCCTATTAA
12019   TGCTCATGGGTAGGTCACATGGTTTCGGGTCTACAACATGATACTATGACGCCCTATTAA
12021   TGCTCATGGGTAGGTCACATGGTTTCGGGTCTACAACATGATACTATGACGCCCTATTAA
12020   TGCTCATGGGTAGGTCACATGGTTTCGGGTCTACAACATGATACTATGACGCCCTATTAA
12018   TGCTCATGGGTAGGTCACATGGTTTCGGGTCTACAACATGATACTATGACGCCCTATTAA
12022   TGCTCATGGGTAGGTCACATGGTTTCGGGTCTACAACATGATACTATGACGCCCTATTAA
        ************************************************************
```

```
-continued
12023   GACTCGGTTTCCCTACGGCTCCGTCTCTTCAACTTAACCTCGCATCATATCGTAACTCGC
12024   GACTCGGTTTCCCTACGGCTCCGTCTCTTCAACTTAACCTCGCATCATATCGTAACTCGC
12019   GACTCGGTTTCCCTACGGCTCCGTCTCTTCAACTTAACCTCGCATCATATCGTAACTCGC
12021   GACTCGGTTTCCCTACGGCTCCGTCTCTTCAACTTAACCTCGCATCATATCGTAACTCGC
12020   GACTCGGTTTCCCTACGGCTCCGTCTCTTCAACTTAACCTCGCATCATATCGTAACTCGC
12018   GACTCGGTTTCCCTACGGCTCCGTCTCTTCAACTTAACCTCGCATCATATCGTAACTCGC
12022   GACTCGGTTTCCCTACGGCTCCGTCTCTTCAACTTAACCTCGCATCATATCGTAACTCGC
        ************************************************************

12023   CGGTTCATTCTACAAAAGGCACGCTCTCACCCATTAACGGGCTCGAACTTGTTGTAGGCA
12024   CGGTTCATTCTACAAAAGGCACGCTCTCACCCATTAACGGGCTCGAACTTGTTGTAGGCA
12019   CGGTTCATTCTACAAAAGGCACGCTCTCACCCATTAACGGGCTCGAACTTGTTGTAGGCA
12021   CGGTTCATTCTACAAAAGGCACGCTCTCACCCATTAACGGGCTCGAACTTGTTGTAGGCA
12020   CGGTTCATTCTACAAAAGGCACGCTCTCACCCATTAACGGGCTCGAACTTGTTGTAGGCA
12018   CGGTTCATTCTACAAAAGGCACGCTCTCACCCATTAACGGGCTCGAACTTGTTGTAGGCA
12022   CGGTTCATTCTACAAAAGGCACGCTCTCACCCATTAACGGGCTCGAACTTGTTGTAGGCA
        ************************************************************

12023   CACGGTTTCAGGTTCTATTTCACTCCCCTCCCGGGGTGCTTTTCACCTTTCCCTCACGGT
12024   CACGGTTTCAGGTTCTATTTCACTCCCCTCCCGGGGTGCTTTTCACCTTTCCCTCACGGT
12019   CACGGTTTCAGGTTCTATTTCACTCCCCTCCCGGGGTGCTTTTCACCTTTCCCTCACGGT
12021   CACGGTTTCAGGTTCTATTTCACTCCCCTCCCGGGGTGCTTTTCACCTTTCCCTCACGGT
12020   CACGGTTTCAGGTTCTATTTCACTCCCCTCCCGGGGTGCTTTTCACCTTTCCCTCACGGT
12018   CACGGTTTCAGGTTCTATTTCACTCCCCTCCCGGGGTGCTTTTCACCTTTCCCTCACGGT
12022   CACGGTTTCAGGTTCTATTTCACTCCCCTCCCGGGGTGCTTTTCACCTTTCCCTCACGGT
        ************************************************************

12023   ACTGGTTCACTATCGGTCACTAGAGAGTATTTAGGGTTGGGAGATGGTCCTCCCAGATTC
12024   ACTGGTTCACTATCGGTCACTAGAGAGTATTTAGGGTTGGGAGATGGTCCTCCCAGATTC
12019   ACTGGTTCACTATCGGTCACTAGAGAGTATTTAGGGTTGGGAGATGGTCCTCCCAGATTC
12021   ACTGGTTCACTATCGGTCACTAGAGAGTATTTAGGGTTGGGAGATGGTCCTCCCAGATTC
12020   ACTGGTTCACTATCGGTCACTAGAGAGTATTTAGGGTTGGGAGATGGTCCTCCCAGATTC
12018   ACTGGTTCACTATCGGTCACTAGAGAGTATTTAGGGTTGGGAGATGGTCCTCCCAGATTC
12022   ACTGGTTCACTATCGGTCACTAGAGAGTATTTAGGGTTGGGAGATGGTCCTCCCAGATTC
        ************************************************************

12023   CGACGAGATTTCGCGTGTCTCGCCGTACTCAGGATACTGCTAAGGTTAATCTATCATTTT
12024   CGACGAGATTTCGCGTGTCTCGCCGTACTCAGGATACTGCTAAGGTTAATCTATCATTTT
12019   CGACGAGATTTCGCGTGTCTCGCCGTACTCAGGATACTGCTAAGGTTAATCTATCATTTT
12021   CGACGAGATTTCGCGTGTCTCGCCGTACTCAGGATACTGCTAAGGTTAATCTATCATTTT
12020   CGACGAGATTTCGCGTGTCTCGCCGTACTCAGGATACTGCTAAGGTTAATCTATCATTTT
12018   CGACGAGATTTCGCGTGTCTCGCCGTACTCAGGATACTGCTAAGGTTAATCTATCATTTT
12022   CGACGAGATTTCGCGTGTCTCGCCGTACTCAGGATACTGCTAAGGTTAATCTATCATTTT
        ************************************************************

12023   AAATACGAGGCTGTTACTCTCTTTGGCTTACCTTCCCAGGTAATTCTTCTATAATGATTA
12024   AAATACGAGGCTGTTACTCTCTTTGGCTTACCTTCCCAGGTAATTCTTCTATAATGATTA
12019   AAATACGAGGCTGTTACTCTCTTTGGCTTACCTTCCCAGGTAATTCTTCTATAATGATTA
12021   AAATACGAGGCTGTTACTCTCTTTGGCTTACCTTCCCAGGTAATTCTTCTATAATGATTA
12020   AAATACGAGGCTGTTACTCTCTTTGGCTTACCTTCCCAGGTAATTCTTCTATAATGATTA
12018   AAATACGAGGCTGTTACTCTCTTTGGCTTACCTTCCCAGGTAATTCTTCTATAATGATTA
12022   AAATACGAGGCTGTTACTCTCTTTGGCTTACCTTCCCAGGTAATTCTTCTATAATGATTA
        ************************************************************

12023   ATCCTATATCGCAGTCCTACAACCCCGAAGTGTAAACACTTCGGTTTGCCCTCCTGCCGT
12024   ATCCTATATCGCAGTCCTACAACCCCGAAGTGTAAACACTTCGGTTTGCCCTCCTGCCGT
12019   ATCCTATATCGCAGTCCTACAACCCCGAAGTGTAAACACTTCGGTTTGCCCTCCTGCCGT
12021   ATCCTATATCGCAGTCCTACAACCCCGAAGTGTAAACACTTCGGTTTGCCCTCCTGCCGT
12020   ATCCTATATCGCAGTCCTACAACCCCGAAGTGTAAACACTTCGGTTTGCCCTCCTGCCGT
12018   ATCCTATATCGCAGTCCTACAACCCCGAAGTGTAAACACTTCGGTTTGCCCTCCTGCCGT
12022   ATCCTATATCGCAGTCCTACAACCCCGAAGTGTAAACACTTCGGTTTGCCCTCCTGCCGT
        ************************************************************

12023   TTCGCTCGCCGCTACTAAGGCAATCGCTTTTGCTTTCTCTTCCTGCAGCTACTTAGATGT
12024   TTCGCTCGCCGCTACTAAGGCAATCGCTTTTGCTTTCTCTTCCTGCAGCTACTTAGATGT
12019   TTCGCTCGCCGCTACTAAGGCAATCGCTTTTGCTTTCTCTTCCTGCAGCTACTTAGATGT
12021   TTCGCTCGCCGCTACTAAGGCAATCGCTTTTGCTTTCTCTTCCTGCAGCTACTTAGATGT
12020   TTCGCTCGCCGCTACTAAGGCAATCGCTTTTGCTTTCTCTTCCTGCAGCTACTTAGATGT
12018   TTCGCTCGCCGCTACTAAGGCAATCGCTTTTGCTTTCTCTTCCTGCAGCTACTTAGATGT
12022   TTCGCTCGCCGCTACTAAGGCAATCGCTTTTGCTTTCTCTTCCTGCAGCTACTTAGATGT
        ************************************************************

12023   TTCAGTTCACTGCGTCTTCCTTCTCATATCCTTAACAGATATGGATACTAGTCATTAACT
12024   TTCAGTTCACTGCGTCTTCCTTCTCATATCCTTAACAGATATGGATACTAGTCATTAACT
12019   TTCAGTTCACTGCGTCTTCCTTCTCATATCCTTAACAGATATGGATACTAGTCATTAACT
12021   TTCAGTTCACTGCGTCTTCCTTCTCATATCCTTAACAGATATGGATACTAGTCATTAACT
12020   TTCAGTTCACTGCGTCTTCCTTCTCATATCCTTAACAGATATGGATACTAGTCATTAACT
12018   TTCAGTTCACTGCGTCTTCCTTCTCATATCCTTAACAGATATGGATACTAGTCATTAACT
12022   TTCAGTTCACTGCGTCTTCCTTCTCATATCCTTAACAGATATGGATACTAGTCATTAACT
        ************************************************************
```

-continued

```
12023    AGTGGGTTCCCCCATTCGGACATCTCTGGATCAGCGCTTACTTACAGCTCCCCAAAGCAT
12024    AGTGGGTTCCCCCATTCGGACATCTCTGGATCAGCGCTTACTTACAGCTCCCCAAAGCAT
12019    AGTGGGTTCCCCCATTCGGACATCTCTGGATCAGCGCTTACTTACAGCTCCCCAAAGCAT
12021    AGTGGGTTCCCCCATTCGGACATCTCTGGATCAGCGCTTACTTACAGCTCCCCAAAGCAT
12020    AGTGGGTTCCCCCATTCGGACATCTCTGGATCAGCGCTTACTTACAGCTCCCCAAAGCAT
12018    AGTGGGTTCCCCCATTCGGACATCTCTGGATCAGCGCTTACTTACAGCTCCCCAAAGCAT
12022    AGTGGGTTCCCCCATTCGGACATCTCTGGATCAGCGCTTACTTACAGCTCCCCAAAGCAT
         ************************************************************

12023    TTCGTCGTTAGTCACGTCCTTCTTCGGCTTCTAGTGCCAAGGCATCCACCGTGCGCCCTT
12024    TTCGTCGTTAGTCACGTCCTTCTTCGGCTTCTAGTGCCAAGGCATCCACCGTGCGCCCTT
12019    TTCGTCGTTAGTCACGTCCTTCTTCGGCTTCTAGTGCCAAGGCATCCACCGTGCGCCCTT
12021    TTCGTCGTTAGTCACGTCCTTCTTCGGCTTCTAGTGCCAAGGCATCCACCGTGCGCCCTT
12020    TTCGTCGTTAGTCACGTCCTTCTTCGGCTTCTAGTGCCAAGGCATCCACCGTGCGCCCTT
12018    TTCGTCGTTAGTCACGTCCTTCTTCGGCTTCTAGTGCCAAGGCATCCACCGTGCGCCCTT
12022    TTCGTCGTTAGTCACGTCCTTCTTCGGCTTCTAGTGCCAAGGCATCCACCGTGCGCCCTT
         ************************************************************

12023    ATTAACTTAACCTTATTAACCTAGTTTCTTTAAAACTAGAAAACTCATTAAATATTCACA
12024    ATTAACTTAACCTTATTAACCTAGTTTCTTTAAAACTAGAAAACTCATTAAATATTCACA
12019    ATTAACTTAACCTTATTAACCTAGTTTCTTTAAAACTAGAAAACTCATTAAATATTCACA
12021    ATTAACTTAACCTTATTAACCTAGTTTCTTTAAAACTAGAAAACTCATTAAATATTCACA
12020    ATTAACTTAACCTTATTAACCTAGTTTCTTTAAAACTAGAAAACTCATTAAATATTCACA
12018    ATTAACTTAACCTTATTAACCTAGTTTCTTTAAAACTAGAAAACTCATTAAATATTCACA
12022    ATTAACTTAACCTTATTAACCTAGTTTCTTTAAAACTAGAAAACTCATTAAATATTCACA
         ************************************************************

12023    GCGTTTTCGGTTTATTTTCTTGTTACTTTCTACAATCTATTTCTAGATCGTGGAATTTGA
12024    GCGTTTTCGGTTTATTTTCTTGTTACTTTCTACAATCTATTTCTAGATCGTGGAATTTGA
12019    GCGTTTTCGGTTTATTTTCTTGTTACTTTCTACAATCTATTTCTAGATCGTGGAATTTGA
12021    GCGTTTTCGGTTTATTTTCTTGTTACTTTCTACAATCTATTTCTAGATCGTGGAATTTGA
12020    GCGTTTTCGGTTTATTTTCTTGTTACTTTCTACAATCTATTTCTAGATCGTGGAATTTGA
12018    GCGTTTTCGGTTTATTTTCTTGTTACTTTCTACAATCTATTTCTAGATCGTGGAATTTGA
12022    GCGTTTTCGGTTTATTTTCTTGTTACTTTCTACAATCTATTTCTAGATCGTGGAATTTGA
         ************************************************************

12023    TATAGATATTCAATTTTCAATGAACAATTTGAACCTTTCGATTCAATGGAGCCTAGCGGG
12024    TATAGATATTCAATTTTCAATGAACAATTTGAACCTTTCGATTCAATGGAGCCTAGCGGG
12019    TATAGATATTCAATTTTCAATGAACAATTTGAACCTTTCGATTCAATGGAGCCTAGCGGG
12021    TATAGATATTCAATTTTCAATGAACAATTTGAACCTTTCGATTCAATGGAGCCTAGCGGG
12020    TATAGATATTCAATTTTCAATGAACAATTTGAACCTTTCGATTCAATGGAGCCTAGCGGG
12018    TATAGATATTCAATTTTCAATGAACAATTTGAACCTTTCGATTCAATGGAGCCTAGCGGG
12022    TATAGATATTCAATTTTCAATGAACAATTTGAACCTTTCGATTCAATGGAGCCTAGCGGG
         ************************************************************

12023    ATCGAACCGCTGACCTCCTGCGTGCAAAGCAGGCGCTCTCCCAGCTGAGCTAAGGCCCCA
12024    ATCGAACCGCTGACCTCCTGCGTGCAAAGCAGGCGCTCTCCCAGCTGAGCTAAGGCCCCA
12019    ATCGAACCGCTGACCTCCTGCGTGCAAAGCAGGCGCTCTCCCAGCTGAGCTAAGGCCCCA
12021    ATCGAACCGCTGACCTCCTGCGTGCAAAGCAGGCGCTCTCCCAGCTGAGCTAAGGCCCCA
12020    ATCGAACCGCTGACCTCCTGCGTGCAAAGCAGGCGCTCTCCCAGCTGAGCTAAGGCCCCA
12018    ATCGAACCGCTGACCTCCTGCGTGCAAAGCAGGCGCTCTCCCAGCTGAGCTAAGGCCCCA
12022    ATCGAACCGCTGACCTCCTGCGTGCAAAGCAGGCGCTCTCCCAGCTGAGCTAAGGCCCCA
         ************************************************************

12023    CAAGACCTCTCAAAACTAAACAAGACGCAAATGGCAGGTTTCCTTATCCTTAGAAAGGAG
12024    CAAGACCTCTCAAAACTAAACAAGACGCAAATGGCAGGTTTCCTTATCCTTAGAAAGGAG
12019    CAAGACCTCTCAAAACTAAACAAGACGCAAATGGCAGGTTTCCTTATCCTTAGAAAGGAG
12021    CAAGACCTCTCAAAACTAAACAAGACGCAAATGGCAGGTTTCCTTATCCTTAGAAAGGAG
12020    CAAGACCTCTCAAAACTAAACAAGACGCAAATGGCAGGTTTCCTTATCCTTAGAAAGGAG
12018    CAAGACCTCTCAAAACTAAACAAGACGCAAATGGCAGGTTTCCTTATCCTTAGAAAGGAG
12022    CAAGACCTCTCAAAACTAAACAAGACGCAAATGGCAGGTTTCCTTATCCTTAGAAAGGAG
         ************************************************************

12023    GTGATCCAGCCGCACCTTCCGATACGGCTACCTTGTTACGACTTCACCCCAATCATCTAT
12024    GTGATCCAGCCGCACCTTCCGATACGGCTACCTTGTTACGACTTCACCCCAATCATCTAT
12019    GTGATCCAGCCGCACCTTCCGATACGGCTACCTTGTTACGACTTCACCCCAATCATCTAT
12021    GTGATCCAGCCGCACCTTCCGATACGGCTACCTTGTTACGACTTCACCCCAATCATCTAT
12020    GTGATCCAGCCGCACCTTCCGATACGGCTACCTTGTTACGACTTCACCCCAATCATCTAT
12018    GTGATCCAGCCGCACCTTCCGATACGGCTACCTTGTTACGACTTCACCCCAATCATCTAT
12022    GTGATCCAGCCGCACCTTCCGATACGGCTACCTTGTTACGACTTCACCCCAATCATCTAT
         ************************************************************

12023    CCCACCTTAGGCGGCTGGCTCCTAAAAGGTTACCTCACCGACTTCGGGTGTTACAAACTC
12024    CCCACCTTAGGCGGCTGGCTCCTAAAAGGTTACCTCACCGACTTCGGGTGTTACAAACTC
12019    CCCACCTTAGGCGGCTGGCTCCTAAAAGGTTACCTCACCGACTTCGGGTGTTACAAACTC
12021    CCCACCTTAGGCGGCTGGCTCCTAAAAGGTTACCTCACCGACTTCGGGTGTTACAAACTC
12020    CCCACCTTAGGCGGCTGGCTCCTAAAAGGTTACCTCACCGACTTCGGGTGTTACAAACTC
12018    CCCACCTTAGGCGGCTGGCTCCTAAAAGGTTACCTCACCGACTTCGGGTGTTACAAACTC
12022    CCCACCTTAGGCGGCTGGCTCCTAAAAGGTTACCTCACCGACTTCGGGTGTTACAAACTC
         ************************************************************
```

```
12023    TCGTGGTGTGACGGGCGGTGTGTACAAGGCCCGGGAACGTATTCACCGCGGCGTGCTGAT
12024    TCGTGGTGTGACGGGCGGTGTGTACAAGGCCCGGGAACGTATTCACCGCGGCGTGCTGAT
12019    TCGTGGTGTGACGGGCGGTGTGTACAAGGCCCGGGAACGTATTCACCGCGGCGTGCTGAT
12021    TCGTGGTGTGACGGGCGGTGTGTACAAGGCCCGGGAACGTATTCACCGCGGCGTGCTGAT
12020    TCGTGGTGTGACGGGCGGTGTGTACAAGGCCCGGGAACGTATTCACCGCGGCGTGCTGAT
12018    TCGTGGTGTGACGGGCGGTGTGTACAAGGCCCGGGAACGTATTCACCGCGGCGTGCTGAT
12022    TCGTGGTGTGACGGGCGGTGTGTACAAGGCCCGGGAACGTATTCACCGCGGCGTGCTGAT
         ************************************************************

12023    CCGCGATTACTAGCGATTCCGACTTCATGTAGGCGAGTTGCAGCCTACAATCCGAACTGA
12024    CCGCGATTACTAGCGATTCCGACTTCATGTAGGCGAGTTGCAGCCTACAATCCGAACTGA
12019    CCGCGATTACTAGCGATTCCGACTTCATGTAGGCGAGTTGCAGCCTACAATCCGAACTGA
12021    CCGCGATTACTAGCGATTCCGACTTCATGTAGGCGAGTTGCAGCCTACAATCCGAACTGA
12020    CCGCGATTACTAGCGATTCCGACTTCATGTAGGCGAGTTGCAGCCTACAATCCGAACTGA
12018    CCGCGATTACTAGCGATTCCGACTTCATGTAGGCGAGTTGCAGCCTACAATCCGAACTGA
12022    CCGCGATTACTAGCGATTCCGACTTCATGTAGGCGAGTTGCAGCCTACAATCCGAACTGA
         ************************************************************

12023    GATTGGCTTTAAGAGATTAGCTTGCCGTCACCGGCTTGCGACTCGTTGTACCAACCATTG
12024    GATTGGCTTTAAGAGATTAGCTTGCCGTCACCGGCTTGCGACTCGTTGTACCAACCATTG
12019    GATTGGCTTTAAGAGATTAGCTTGCCGTCACCGGCTTGCGACTCGTTGTACCAACCATTG
12021    GATTGGCTTTAAGAGATTAGCTTGCCGTCACCGGCTTGCGACTCGTTGTACCAACCATTG
12020    GATTGGCTTTAAGAGATTAGCTTGCCGTCACCGGCTTGCGACTCGTTGTACCAACCATTG
12018    GATTGGCTTTAAGAGATTAGCTTGCCGTCACCGGCTTGCGACTCGTTGTACCAACCATTG
12022    GATTGGCTTTAAGAGATTAGCTTGCCGTCACCGGCTTGCGACTCGTTGTACCAACCATTG
         ************************************************************

12023    TAGCACGTGTGTAGCCCAGGTCATAAGGGGCATGATGATTTGACGTCATCCCCACCTTCC
12024    TAGCACGTGTGTAGCCCAGGTCATAAGGGGCATGATGATTTGACGTCATCCCCACCTTCC
12019    TAGCACGTGTGTAGCCCAGGTCATAAGGGGCATGATGATTTGACGTCATCCCCACCTTCC
12021    TAGCACGTGTGTAGCCCAGGTCATAAGGGGCATGATGATTTGACGTCATCCCCACCTTCC
12020    TAGCACGTGTGTAGCCCAGGTCATAAGGGGCATGATGATTTGACGTCATCCCCACCTTCC
12018    TAGCACGTGTGTAGCCCAGGTCATAAGGGGCATGATGATTTGACGTCATCCCCACCTTCC
12022    TAGCACGTGTGTAGCCCAGGTCATAAGGGGCATGATGATTTGACGTCATCCCCACCTTCC
         ************************************************************

12023    TCCGGTTTATTACCGGCAGTCTCGCTAGAGTGCCCAACTTAATGATGGCAACTAACAATA
12024    TCCGGTTTATTACCGGCAGTCTCGCTAGAGTGCCCAACTTAATGATGGCAACTAACAATA
12019    TCCGGTTTATTACCGGCAGTCTCGCTAGAGTGCCCAACTTAATGATGGCAACTAACAATA
12021    TCCGGTTTATTACCGGCAGTCTCGCTAGAGTGCCCAACTTAATGATGGCAACTAACAATA
12020    TCCGGTTTATTACCGGCAGTCTCGCTAGAGTGCCCAACTTAATGATGGCAACTAACAATA
12018    TCCGGTTTATTACCGGCAGTCTCGCTAGAGTGCCCAACTTAATGATGGCAACTAACAATA
12022    TCCGGTTTATTACCGGCAGTCTCGCTAGAGTGCCCAACTTAATGATGGCAACTAACAATA
         ************************************************************

12023    GGGGTTGCGCTCGTTGCGGGACTTAACCCAACATCTCACGACACGAGCTGACGACAACCA
12024    GGGGTTGCGCTCGTTGCGGGACTTAACCCAACATCTCACGACACGAGCTGACGACAACCA
12019    GGGGTTGCGCTCGTTGCGGGACTTAACCCAACATCTCACGACACGAGCTGACGACAACCA
12021    GGGGTTGCGCTCGTTGCGGGACTTAACCCAACATCTCACGACACGAGCTGACGACAACCA
12020    GGGGTTGCGCTCGTTGCGGGACTTAACCCAACATCTCACGACACGAGCTGACGACAACCA
12018    GGGGTTGCGCTCGTTGCGGGACTTAACCCAACATCTCACGACACGAGCTGACGACAACCA
12022    GGGGTTGCGCTCGTTGCGGGACTTAACCCAACATCTCACGACACGAGCTGACGACAACCA
         ************************************************************

12023    TGCACCACCTGTCACTTCTGCTCCGAAGAGAAAGCCTATCTCTAGGCCGGTCAGAAGGAT
12024    TGCACCACCTGTCACTTCTGCTCCGAAGAGAAAGCCTATCTCTAGGCCGGTCAGAAGGAT
12019    TGCACCACCTGTCACTTCTGCTCCGAAGAGAAAGCCTATCTCTAGGCCGGTCAGAAGGAT
12021    TGCACCACCTGTCACTTCTGCTCCGAAGAGAAAGCCTATCTCTAGGCCGGTCAGAAGGAT
12020    TGCACCACCTGTCACTTCTGCTCCGAAGAGAAAGCCTATCTCTAGGCCGGTCAGAAGGAT
12018    TGCACCACCTGTCACTTCTGCTCCGAAGAGAAAGCCTATCTCTAGGCCGGTCAGAAGGAT
12022    TGCACCACCTGTCACTTCTGCTCCGAAGAGAAAGCCTATCTCTAGGCCGGTCAGAAGGAT
         ************************************************************

12023    GTCAAGACCTGGTAAGGTTCTTCGCGTTGCTTCGAATTAAACCACATGCTCCACCGCTTG
12024    GTCAAGACCTGGTAAGGTTCTTCGCGTTGCTTCGAATTAAACCACATGCTCCACCGCTTG
12019    GTCAAGACCTGGTAAGGTTCTTCGCGTTGCTTCGAATTAAACCACATGCTCCACCGCTTG
12021    GTCAAGACCTGGTAAGGTTCTTCGCGTTGCTTCGAATTAAACCACATGCTCCACCGCTTG
12020    GTCAAGACCTGGTAAGGTTCTTCGCGTTGCTTCGAATTAAACCACATGCTCCACCGCTTG
12018    GTCAAGACCTGGTAAGGTTCTTCGCGTTGCTTCGAATTAAACCACATGCTCCACCGCTTG
12022    GTCAAGACCTGGTAAGGTTCTTCGCGTTGCTTCGAATTAAACCACATGCTCCACCGCTTG
         ************************************************************

12023    TGCGGGCCCCGTCAATTCCTTTGAGTTTCAACCTTGCGGTCGTACTCCCCAGGCGGAGT
12024    TGCGGGCCCCGTCAATTCCTTTGAGTTTCAACCTTGCGGTCGTACTCCCCAGGCGGAGT
12019    TGCGGGCCCCGTCAATTCCTTTGAGTTTCAACCTTGCGGTCGTACTCCCCAGGCGGAGT
12021    TGCGGGCCCCGTCAATTCCTTTGAGTTTCAACCTTGCGGTCGTACTCCCCAGGCGGAGT
12020    TGCGGGCCCCGTCAATTCCTTTGAGTTTCAACCTTGCGGTCGTACTCCCCAGGCGGAGT
12018    TGCGGGCCCCGTCAATTCCTTTGAGTTTCAACCTTGCGGTCGTACTCCCCAGGCGGAGT
12022    TGCGGGCCCCGTCAATTCCTTTGAGTTTCAACCTTGCGGTCGTACTCCCCAGGCGGAGT
         ************************************************************
```

-continued

| | |
|---|---|
| 12023 | GCTTAATGCGTTAGCTGCGGCACTAAGCCCCGGAAAGGGCCTAACACCTAGCACTCATCG |
| 12024 | GCTTAATGCGTTAGCTGCGGCACTAAGCCCCGGAAAGGGCCTAACACCTAGCACTCATCG |
| 12019 | GCTTAATGCGTTAGCTGCGGCACTAAGCCCCGGAAAGGGCCTAACACCTAGCACTCATCG |
| 12021 | GCTTAATGCGTTAGCTGCGGCACTAAGCCCCGGAAAGGGCCTAACACCTAGCACTCATCG |
| 12020 | GCTTAATGCGTTAGCTGCGGCACTAAGCCCCGGAAAGGGCCTAACACCTAGCACTCATCG |
| 12018 | GCTTAATGCGTTAGCTGCGGCACTAAGCCCCGGAAAGGGCCTAACACCTAGCACTCATCG |
| 12022 | GCTTAATGCGTTAGCTGCGGCACTAAGCCCCGGAAAGGGCCTAACACCTAGCACTCATCG |
| | ************************************************************ |
| 12023 | TTTACGGCGTGGACTACCAGGGTATCTAATCCTGTTTGCTCCCCACGCTTTCGAGCCTCA |
| 12024 | TTTACGGCGTGGACTACCAGGGTATCTAATCCTGTTTGCTCCCCACGCTTTCGAGCCTCA |
| 12019 | TTTACGGCGTGGACTACCAGGGTATCTAATCCTGTTTGCTCCCCACGCTTTCGAGCCTCA |
| 12021 | TTTACGGCGTGGACTACCAGGGTATCTAATCCTGTTTGCTCCCCACGCTTTCGAGCCTCA |
| 12020 | TTTACGGCGTGGACTACCAGGGTATCTAATCCTGTTTGCTCCCCACGCTTTCGAGCCTCA |
| 12018 | TTTACGGCGTGGACTACCAGGGTATCTAATCCTGTTTGCTCCCCACGCTTTCGAGCCTCA |
| 12022 | TTTACGGCGTGGACTACCAGGGTATCTAATCCTGTTTGCTCCCCACGCTTTCGAGCCTCA |
| | ************************************************************ |
| 12023 | GCGTCAGTTACAGACCAGAGAGCCGCTTTCGCCACCGGTGTTCCTCCATATATCTACGCA |
| 12024 | GCGTCAGTTACAGACCAGAGAGCCGCTTTCGCCACCGGTGTTCCTCCATATATCTACGCA |
| 12019 | GCGTCAGTTACAGACCAGAGAGCCGCTTTCGCCACCGGTGTTCCTCCATATATCTACGCA |
| 12021 | GCGTCAGTTACAGACCAGAGAGCCGCTTTCGCCACCGGTGTTCCTCCATATATCTACGCA |
| 12020 | GCGTCAGTTACAGACCAGAGAGCCGCTTTCGCCACCGGTGTTCCTCCATATATCTACGCA |
| 12018 | GCGTCAGTTACAGACCAGAGAGCCGCTTTCGCCACCGGTGTTCCTCCATATATCTACGCA |
| 12022 | GCGTCAGTTACAGACCAGAGAGCCGCTTTCGCCACCGGTGTTCCTCCATATATCTACGCA |
| | ************************************************************ |
| 12023 | TTTCACCGCTACACATGGAATTCCACTCTCCCCTTCTGCACTCAAGTCCTCCAGTTTCCA |
| 12024 | TTTCACCGCTACACATGGAATTCCACTCTCCCCTTCTGCACTCAAGTCCTCCAGTTTCCA |
| 12019 | TTTCACCGCTACACATGGAATTCCACTCTCCCCTTCTGCACTCAAGTCCTCCAGTTTCCA |
| 12021 | TTTCACCGCTACACATGGAATTCCACTCTCCCCTTCTGCACTCAAGTCCTCCAGTTTCCA |
| 12020 | TTTCACCGCTACACATGGAATTCCACTCTCCCCTTCTGCACTCAAGTCCTCCAGTTTCCA |
| 12018 | TTTCACCGCTACACATGGAATTCCACTCTCCCCTTCTGCACTCAAGTCCTCCAGTTTCCA |
| 12022 | TTTCACCGCTACACATGGAATTCCACTCTCCCCTTCTGCACTCAAGTCCTCCAGTTTCCA |
| | ************************************************************ |
| 12023 | AAGCGTACAATGGTTAAGCCACTGCCTTTAACTTCAGACTTAAAGAACCGCCTGCGCTCG |
| 12024 | AAGCGTACAATGGTTAAGCCACTGCCTTTAACTTCAGACTTAAAGAACCGCCTGCGCTCG |
| 12019 | AAGCGTACAATGGTTAAGCCACTGCCTTTAACTTCAGACTTAAAGAACCGCCTGCGCTCG |
| 12021 | AAGCGTACAATGGTTAAGCCACTGCCTTTAACTTCAGACTTAAAGAACCGCCTGCGCTCG |
| 12020 | AAGCGTACAATGGTTAAGCCACTGCCTTTAACTTCAGACTTAAAGAACCGCCTGCGCTCG |
| 12018 | AAGCGTACAATGGTTAAGCCACTGCCTTTAACTTCAGACTTAAAGAACCGCCTGCGCTCG |
| 12022 | AAGCGTACAATGGTTAAGCCACTGCCTTTAACTTCAGACTTAAAGAACCGCCTGCGCTCG |
| | ************************************************************ |
| 12023 | CTTTACGCCCAATAAATCCGGACAACGCTCGGGACCTACGTATTACCGCGGCTGCTGGCA |
| 12024 | CTTTACGCCCAATAAATCCGGACAACGCTCGGGACCTACGTATTACCGCGGCTGCTGGCA |
| 12019 | CTTTACGCCCAATAAATCCGGACAACGCTCGGGACCTACGTATTACCGCGGCTGCTGGCA |
| 12021 | CTTTACGCCCAATAAATCCGGACAACGCTCGGGACCTACGTATTACCGCGGCTGCTGGCA |
| 12020 | CTTTACGCCCAATAAATCCGGACAACGCTCGGGACCTACGTATTACCGCGGCTGCTGGCA |
| 12018 | CTTTACGCCCAATAAATCCGGACAACGCTCGGGACCTACGTATTACCGCGGCTGCTGGCA |
| 12022 | CTTTACGCCCAATAAATCCGGACAACGCTCGGGACCTACGTATTACCGCGGCTGCTGGCA |
| | ************************************************************ |
| 12023 | CGTAGTTAGCCGTCCCTTTCTGGTTAGTTACCGTCACTTGGTAGATTTTCCACTCCTACC |
| 12024 | CGTAGTTAGCCGTCCCTTTCTGGTTAGTTACCGTCACTTGGTAGATTTTCCACTCCTACC |
| 12019 | CGTAGTTAGCCGTCCCTTTCTGGTTAGTTACCGTCACTTGGTAGATTTTCCACTCCTACC |
| 12021 | CGTAGTTAGCCGTCCCTTTCTGGTTAGTTACCGTCACTTGGTAGATTTTCCACTCCTACC |
| 12020 | CGTAGTTAGCCGTCCCTTTCTGGTTAGTTACCGTCACTTGGTAGATTTTCCACTCCTACC |
| 12018 | CGTAGTTAGCCGTCCCTTTCTGGTTAGTTACCGTCACTTGGTAGATTTTCCACTCCTACC |
| 12022 | CGTAGTTAGCCGTCCCTTTCTGGTTAGTTACCGTCACTTGGTAGATTTTCCACTCCTACC |
| | ************************************************************ |
| 12023 | AACGTTCTTCTCTAACAACAGAGCTTTACGATCCGAAAACCTTCTTCACTCACGCGGCGT |
| 12024 | AACGTTCTTCTCTAACAACAGAGCTTTACGATCCGAAAACCTTCTTCACTCACGCGGCGT |
| 12019 | AACGTTCTTCTCTAACAACAGAGCTTTACGATCCGAAAACCTTCTTCACTCACGCGGCGT |
| 12021 | AACGTTCTTCTCTAACAACAGAGCTTTACGATCCGAAAACCTTCTTCACTCACGCGGCGT |
| 12020 | AACGTTCTTCTCTAACAACAGAGCTTTACGATCCGAAAACCTTCTTCACTCACGCGGCGT |
| 12018 | AACGTTCTTCTCTAACAACAGAGCTTTACGATCCGAAAACCTTCTTCACTCACGCGGCGT |
| 12022 | AACGTTCTTCTCTAACAACAGAGCTTTACGATCCGAAAACCTTCTTCACTCACGCGGCGT |
| | ************************************************************ |
| 12023 | TGCTCGGTCAGACTTCCGTCCATTGCCGAAGATTCCCTACTGCTGCCTCCCGTAGGAGTC |
| 12024 | TGCTCGGTCAGACTTCCGTCCATTGCCGAAGATTCCCTACTGCTGCCTCCCGTAGGAGTC |
| 12019 | TGCTCGGTCAGACTTCCGTCCATTGCCGAAGATTCCCTACTGCTGCCTCCCGTAGGAGTC |
| 12021 | TGCTCGGTCAGACTTCCGTCCATTGCCGAAGATTCCCTACTGCTGCCTCCCGTAGGAGTC |
| 12020 | TGCTCGGTCAGACTTCCGTCCATTGCCGAAGATTCCCTACTGCTGCCTCCCGTAGGAGTC |
| 12018 | TGCTCGGTCAGACTTCCGTCCATTGCCGAAGATTCCCTACTGCTGCCTCCCGTAGGAGTC |
| 12022 | TGCTCGGTCAGACTTCCGTCCATTGCCGAAGATTCCCTACTGCTGCCTCCCGTAGGAGTC |
| | ************************************************************ |

-continued

```
12023   TGGGCCGTGTCTCAGTCCCAGTGTGGCCGATCACCCTCTCAGGTCGGCTATGTATCGTCG
12024   TGGGCCGTGTCTCAGTCCCAGTGTGGCCGATCACCCTCTCAGGTCGGCTATGTATCGTCG
12019   TGGGCCGTGTCTCAGTCCCAGTGTGGCCGATCACCCTCTCAGGTCGGCTATGTATCGTCG
12021   TGGGCCGTGTCTCAGTCCCAGTGTGGCCGATCACCCTCTCAGGTCGGCTATGTATCGTCG
12020   TGGGCCGTGTCTCAGTCCCAGTGTGGCCGATCACCCTCTCAGGTCGGCTATGTATCGTCG
12018   TGGGCCGTGTCTCAGTCCCAGTGTGGCCGATCACCCTCTCAGGTCGGCTATGTATCGTCG
12022   TGGGCCGTGTCTCAGTCCCAGTGTGGCCGATCACCCTCTCAGGTCGGCTATGTATCGTCG
        ************************************************************

12023   CCTTGGTGAGCCTTTACCTCACCAACTAGCTAATACAACGCAGGTCCATCTCACAGTGAA
12024   CCTTGGTGAGCCTTTACCTCACCAACTAGCTAATACAACGCAGGTCCATCTCACAGTGAA
12019   CCTTGGTGAGCCTTTACCTCACCAACTAGCTAATACAACGCAGGTCCATCTCACAGTGAA
12021   CCTTGGTGAGCCTTTACCTCACCAACTAGCTAATACAACGCAGGTCCATCTCACAGTGAA
12020   CCTTGGTGAGCCTTTACCTCACCAACTAGCTAATACAACGCAGGTCCATCTCACAGTGAA
12018   CCTTGGTGAGCCTTTACCTCACCAACTAGCTAATACAACGCAGGTCCATCTCACAGTGAA
12022   CCTTGGTGAGCCTTTACCTCACCAACTAGCTAATACAACGCAGGTCCATCTCACAGTGAA
        ************************************************************

12023   GCAATTGCTCCTTTTAAATAACTAACATGTGTTAATTACTCTTATGCGGTATTAGCTATC
12024   GCAATTGCTCCTTTTAAATAACTAACATGTGTTAATTACTCTTATGCGGTATTAGCTATC
12019   GCAATTGCTCCTTTTAAATAACTAACATGTGTTAATTACTCTTATGCGGTATTAGCTATC
12021   GCAATTGCTCCTTTTAAATAACTAACATGTGTTAATTACTCTTATGCGGTATTAGCTATC
12020   GCAATTGCTCCTTTTAAATAACTAACATGTGTTAATTACTCTTATGCGGTATTAGCTATC
12018   GCAATTGCTCCTTTTAAATAACTAACATGTGTTAATTACTCTTATGCGGTATTAGCTATC
12022   GCAATTGCTCCTTTTAAATAACTAACATGTGTTAATTACTCTTATGCGGTATTAGCTATC
        ************************************************************

12023   GTTTCCAATAGTTATCCCCCGCTATGAGGCAGGTTACCTACGCGTTACTCACCCGTTCGC
12024   GTTTCCAATAGTTATCCCCCGCTATGAGGCAGGTTACCTACGCGTTACTCACCCGTTCGC
12019   GTTTCCAATAGTTATCCCCCGCTATGAGGCAGGTTACCTACGCGTTACTCACCCGTTCGC
12021   GTTTCCAATAGTTATCCCCCGCTATGAGGCAGGTTACCTACGCGTTACTCACCCGTTCGC
12020   GTTTCCAATAGTTATCCCCCGCTATGAGGCAGGTTACCTACGCGTTACTCACCCGTTCGC
12018   GTTTCCAATAGTTATCCCCCGCTATGAGGCAGGTTACCTACGCGTTACTCACCCGTTCGC
12022   GTTTCCAATAGTTATCCCCCGCTATGAGGCAGGTTACCTACGCGTTACTCACCCGTTCGC
        ************************************************************

12023   AACTCATCAGTCTAGTGTAAACACCAAACCTCAGCGTTCTACTTGCATGTATTAGGCACG
12024   AACTCATCAGTCTAGTGTAAACACCAAACCTCAGCGTTCTACTTGCATGTATTAGGCACG
12019   AACTCATCAGTCTAGTGTAAACACCAAACCTCAGCGTTCTACTTGCATGTATTAGGCACG
12021   AACTCATCAGTCTAGTGTAAACACCAAACCTCAGCGTTCTACTTGCATGTATTAGGCACG
12020   AACTCATCAGTCTAGTGTAAACACCAAACCTCAGCGTTCTACTTGCATGTATTAGGCACG
12018   AACTCATCAGTCTAGTGTAAACACCAAACCTCAGCGTTCTACTTGCATGTATTAGGCACG
12022   AACTCATCAGTCTAGTGTAAACACCAAACCTCAGCGTTCTACTTGCATGTATTAGGCACG
        ************************************************************

12023   CCGCCAGCGTTCGTCCTGAGCCAGGATCAAACTCTCATTAAAAGTTTGAGCTTTGCTCTT
12024   CCGCCAGCGTTCGTCCTGAGCCAGGATCAAACTCTCATTAAAAGTTTGAGCTTTGCTCTT
12019   CCGCCAGCGTTCGTCCTGAGCCAGGATCAAACTCTCATTAAAAGTTTGAGCTTTGCTCTT
12021   CCGCCAGCGTTCGTCCTGAGCCAGGATCAAACTCTCATTAAAAGTTTGAGCTTTGCTCTT
12020   CCGCCAGCGTTCGTCCTGAGCCAGGATCAAACTCTCATTAAAAGTTTGAGCTTTGCTCTT
12018   CCGCCAGCGTTCGTCCTGAGCCAGGATCAAACTCTCATTAAAAGTTTGAGCTTTGCTCTT
12022   CCGCCAGCGTTCGTCCTGAGCCAGGATCAAACTCTCATTAAAAGTTTGAGCTTTGCTCTT
        ************************************************************

12023   TTCTGTCTCGCTGACAGATTTATTGTTTTTT-GTCATTGACGGATTTACAATGTAAATCC
12024   TTCTGTCTCGCTGACAGATTTATTGTTTTTTTGTCATTGACGGATTTACAATGTAAATCC
12019   TTCTGTCTCGCTGACAGATTTATTGTTTTTT-GTCATTGACGGATTTACAATGTAAATCC
12021   TTCTGTCTCGCTGACAGATTTATTGTTTTTTTGTCATTGACGGATTTACAATGTAAATCC
12020   TTCTGTCTCGCTGACAGATTTATTGTTTTTTTGTCATTGACGGATTTACAATGTAAATCC
12018   TTCTGTCTCGCTGACAGATTTATTGTTTTTT-GTCATTGACGGATTTACAATGTAAATCC
12022   TTCTGTCTCGCTGACAGATTTATTGTTTTTT-GTCATTGACGGATTTACAATGTAAATCC
        ******************************* ****************************

12023   ACCCTGCACATTCGTTCGTCTTGTTCAGTTTTCAAAGGTCTAATGATATATCATAAAAAT
12024   ACCCTGCACATTCGTTCGTCTTGTTCAGTTTTCAAAGGTCTTTGCCTCTCTTGAGACAAC
12019   ACCCTGCACATTCGTTCGTCTTGTTCAGTTTTCAAAGGTCTTTGCCTCTCTTGAGACAAC
12021   ACCCTGCACATTCGTTCGTCTTGTTCAGTTTTCAAAGGTCTTTGCCTCTCTTGAGACAAC
12020   ACCCTGCACATTCGTTCGTCTTGTTCAGTTTTCAAAGGTCTTTGCCTCTCTTGAGACAAC
12018   ACCCTGCACATTCGTTCATCTTGTTCAGTTTTCAAAGGTCTTTGCCTCTCTTGAGACAAC
12022   ACCCTGCACATTCGTTCGTCTTGTTCAGTTTTCAAAGGTCTTTGCCTCTCTTGAGACAAC
        *****************  *********************  *    * *    * **

12023   ATATCCATCGGGAAGACAGGATTCGAACCTG-CGACACCTTGGTCCCAAACCAAGTACTC
12024   TTCTATATTCTAGCAAACTTATTCTGCTTTGTCAACTACTTTTTTTTAAGTTGTTAACTA
12019   TTCTATATTCTAGCAAACTTATTCTGCTTTGTCAACTACTTTT-TTTTAAGTTGTTAACTA
12021   TTCTATATTCTAGCAAACTTATTCTGCTTTGTCAACTACTTT-TTTTAAGTTGTTAACTA
12020   TTCTATATTCTAGCAAACTTATTCTGCTTTGTCAACTACTTT-TTTTAAGTTGTTAACTA
12018   TTCTATATTCTAGCAAACTTATTCTGCTTTGTCAACTACTTT-TTTTAAGTTGTTTATAA
12022   TTCTATATTCTAGCAAACTTATTCTGCTTTGTCAACTACTTT-TTTTAAGTTGTTAACTA
         *  *  **      *     ****  ** *  ** ***  *   **         *
```

-continued

```
12023    TACCAAGCTG--A-GCTACT-TCCCGAAAAA---TATGCACC---CTAGAGGAGTCGAAC
12024    CGCGTTACTAGAA-GCTGCTCTCTCGAGACAACTTATTCATTATACTAAATATTTCTACT
12019    CGCGCTAATAGAA-ACTGCTCTCTCGAGACAACTTATTCATTATACTAAATATTTCTACT
12021    CGCGCTAATAGAA-ACTGCTCTCTCGAGACAACTTATTAGTTTACTACATCATCTCTTA
12020    CGCGCTAATAGAA-ACTGCTCTCTCGAGACAACTTATTAGTTTACTACATCATCTCTTA
12018    AATGATAATACAATATTAGGTTCGCTTAAGAACTCATTTAGTATACATAATTTTTTATT
12022    CGCGCTAATAGAA-ACTGCTCTCTCGAGACAACTTATTAGTTTACTACATCATCTCTTA
                      *   *   *    **  *  * *    **  *    *** *

12023    CTCTAACCGCCTGATTCGTA-GTCAGGTACTCTATCC------AGTTGA----GCTAAG
12024    TCCTGTCAATACTATTTTTGCATTTTTTCTTTTATTTTTAAA-AAGTTAATATTATTTAT
12019    TCCTGTCAATACTATTTTTGTA---TTTTATAAATTTAGTAT-AGACATAACTATTCCTC
12021    CTTTGTCAACTCTTTTTTCATACT-TTTTCTACATTTTCTGA-AAATGTAGATCAGGCTC
12020    CTTTGTCAACTCTTTTTTCATACT-TTTTCTACATTTTCTGA-AAATGTAGATAGAGCGC
12018    TGTTGTCAATAGGTTTTAAAAA----------AATCTCAGAGAAAACCCTGAGATTTTT
12022    CTTTGTCAACTCTTTTTTCATACT-TTTTCTACATTTTCTGAAAAAAGTTTCCTGTTGGC
             *  *        **            *

12023    GGTGCTAAAT--------ATTATATGCCGA-------GGACCGGAATC-------G---A
12024    AGTAACTAAC--------CTTCTATACTTGTTGA-ATGGATAGCATTT-------T---T
12019    TATATTCAATTAAGAGAAATTATATAACCACTATTGAGAAATGTAGTC-------T---A
12021    AA-GCTTAAC---GATTCTTTTTAAAATCATTA-----AATTTTAAAA-------C---A
12020    AAGAAAAAAAGAGGTCTCACCTCTTTTTATTTCTTAGTAACTACTACA-------A---A
12018    TAAATT--ATGTTACAAAGTT--AATTTCCTT-----TAGCTTCAATT---------AAA
12022    TAACACCAATAACATAGAGTTTAAAATTCCATAC--CTAAATTTATTTTATTAGTAAAAA
                 *

12023    ACCGGTACGATGTTTACC-A--TCGCAGGATTTTAAGTCCTGTGCGTCTGC--CAGTTCC
12024    ACCGTTGTCATGTTCAT--A--TTTCATCTTCTTAATTCACAAATTTAAACTTCATCTTC
12019    GCGATTAAATTCTTTGCTCA--TCGAA-AATATCCAATAAATATAATAATGCATAAAACG
12021    AATTTCAGACATGTTGC------CAAA-GTTTTGATATTATTACTATAAT--ATAGTTTG
12020    TCTATTAGGATCGTTACCTT--CAGAATAACTTTCAACACCCTCTATAGT-TGCAATTGT
12018    CCTAGTTCGCCATCTTCACG-CTTGTAAAGGACATTTGTCGTATTATCTTCTGCATCT--
12022    AATAAAAGATGGGCTAGCCATCTTTTATAATATTTGTTTTTTATATTCTTCAGCTTCTTG
                                 *                  *

12023    G-CCA--------CCCCGGCCTCTAACAAGCGAACGACGGGGTTCGAA-CCCGCGACCCT
12024    A-TAAAAAATACCCTTCAAATTTTATCTAAATTTGAAGGGTATTTGAAATTTATAAAGTT
12019    C-CTGCTTACGAAATATAAACAAA-ATTGTTTGCAT--TTCGTAAACAAGCGTTACCTAT
12021    T-AGAGGAGAATAATATGGGCCAA-GAACCTATCAT--CGAATATCAAAATAT----CAA
12020    T-TTATGAACAGTTTTTCGCTCACTGTTACTCATAGGATCCATATGGTAAGGTTCATTAG
12018    --GTATAGATAAAGAAATCATGACCTAAAAGTTCCATTTGCAACAATGCTTCCTCAACAT
12022    GGGTGTAGATAAAACAAA-ATGACCAGGGGTAATCTCGTGCATTTGACGTTCTTGTCCGT

12023    CAC--CTTGGCAAGGTGATGTTCTACCACTGAACTACGT-TCGCACTAAAGACACTATT-
12024    CTT--TAAAAATATATGATGACTTATTTTTTATCTTCTTCTTGCATTTTTCTCATCTTTT
12019    TTA--ACAATATATGATGAGTGTTCCCGCTGAGAATAATTCTCAGCGGTAGACCAGAGCT
12021    TAA--AGTGTATGGGGAAAATGTTGCGGTTGAAGCA----TTAACCTTAAAATTTACCCC
12020    TCT--CTAAAACACGCCTAGCTATTTTTTTAGAAAAA----TCAATTAAAGTTTCTGTAC
12018    CCA--TTGGTTTTAGATTAACATTCTTAGTACGTACAAT--T-CTTTGGCTTACTGCTTC
12022    CTTGCTCAATAGCTGGATTATACGGCTGGTGAACACGTT--GACGTTCACTCTCCGGATC
                                                *

12023    ------------------------------------------------------------
12024    CATCGTATGATAACGCTCTTGCTTTATCTTCA---TCATTTTCTGTCTCAGGCATTTTAC
12019    AGACTAAGAATCGATTGATTCCATCATCATAACACTCAACAAAATTGATAAAAATTATAC
12021    TGGT---GATTTGTTTGTTTCATCGGTA-------CGAGTGGATCAGGTAAAACAACAT
12020    GATGCTCAACGTAGTCATGGACATTAATGGA----TACTGAAAAACTCTTAGAAAAGCGG
12018    TTCATCTGGCTCAGCC-----TCAAATTCTGTTGTGAAAAC---TTGACTTGCTGGAATC
12022    TGGTTCTGGAATAGCTGATAATAGACTCTTCGTATAAGGGTGGATTGGATTGTTATAAAC

12023    ------------------------------------------------------------
12024    CTGTCTCAAAAATCGATTTAATCTGAGCAGCATCAA-----GAGTCTCATATTTTAAGAG
12019    TAATTCA-ATAATTGCCATTGGGGCAGCATCGCCAC--GGCGTGGTTCTGT-TTTAAGAA
12021    TAATGCGTATGGTTAACCATATGTTAAACCAACAA--ATGGTACTCTATTATTTAAGGG
12020    TCATGAAGATAATT----TTGTGCTAACAACTGCAACGATTTTAATACTTT-TCCATGAT
12018    TTTTCACGATATT--------TTTTCGCAATTTTA--------GTTTTATT-TTTACGA-
12022    ATCATCAGATGTTC---CAACTTCTAACAGTTTCCCCCAATGCATAACACC-GATACGAT

12023    ------------------------------------------------------------
12024    GGCTTCTGCAATTAATTTATGAGTATCACGGTTTTCGTTGATAATATCAGCTGCC--TTA
12019    TACGAGTGTATCCTCCG--TTACGTTCAGCATAACGAGGTGCGATGTCGTC-AAA--AAG
12021    AAAAGATATTTCTACTA--TTAACCCCATTGAATTAAGACGCAGAATTG---GAT--ATG
12020    AACCAATGATGCGCCCAGCTTCTGGCGTTTCTATTTGGAGATTTATTTGTC-GCT--TAC
12018    ---------ATTTGAC------GCTCAATTTT-----ATCAACAACTAAGTCAAT-----
12022    CTGAAATGTATTTTACC--ATAGACAAATCATGTGCGATAAACAAATAAGTCAATCCTTG

12023    ------------------------------------------------------------
12024    TTACGTGCTTCATTAAGAAGGTGACGAACTTCATCATCAATAAGTTGTGCAGTTTGAGCA
12019    TTTTTGAAGAGCTGTTGTTGATGTAT-ATTT-ATCAGAAGCTTCATCATAGTTTTCTGAT
```

```
                     -continued
12021    TTATCCAAAACATTGGTTTAATGCCTCATATGACCATTTACGAAAATATAGTTCT-TGTA
12020    TTGTCGTAG--TTTCTATTGTTGCAT-CTAAATCCATCTCATAGATGATATTTTC----A
12018    TGACCCATACATATCTTGTGAAACATCTTCTGCTCGTAAAGTAATAGAATCTATTAAG--
12022    TTCTCTTTGCAATTTTTGCATTAAATTAACAACTTGTGCTTGGATTGAAACATCTAAGGC 12023    ------------------------------------------------------------
12024    GAATATGATTTTTCAGGTGACATTTGACCA--GCCATCATTGCGTGGTTGCCTTCGTATT
12019    GCAATTTCATTACGTACATAAGCAGCAGCT---TGACGACGAGCATGTAAATCACCACGTT
12021    CCAAAATTATTGAAATGGTCAGAAGAAGCT--AAAAGA-GCTAAAGCAAGGGAACTTATT
12020    ACGTATTTAGTCACCTGAGCAGCTGCTACT---TCAATATTAGGAAGTAGGTCAATTTTTT
12018    ----ATTGTTACTTCAACTTTTGCGGTCTT---CTCTCTGTATACTTTGAGGTTGACTCT
12022    AGATATTGGTTCATCAGCAATGATAAATTTAGGCTCTACTGCTAAAGCACGTGCAATCCC 12023    ------------------------------------------------------------
12024    GAACTGGTCCAAGTTTCTCGCTCATACCATATTCAGTTACCATAGCGCGGGCCATAGCAG
12019    TACCTAGAGTAATCATTTTTTCAACTGTTTTACGGATTTCTTTAGCACGTGCTTCAGTAG
12021    AAATTAGTTGAATTACCCGAAGAA-TATTTGGATCGCTACCCTAGTGAGTTGTCTGGCGG
12020    CAATAGCTTCACTTGTAGTTACAACGTTTTTATCATCAATTTTTGGAAGT--TCTGGTTG
12018    AGTATCTAATTCTTGTGCTTC-----ATTAAAGTATTTTTCAACTTTAGAGAGTTTGGTC
12022    GATACGTTGTCGTTGTCCACCTGAAAATTCATGCGGATAACGTGTTAAATGATCTTTATT 12023    ------------------------------------------------------------
12024    TGGCTTGTTCGAAGTCATTTGAGGCACCTGTTGTCTGAGCGTTGAAAATAATTTCTTCCG
12019    TTACAATTGATTCGTTGATAAGAAGATCGGTTGTCAAATCA--CGAAGCATTGCCTTACG
12021    TCAGCAACAACGTATCGGTGTCATTCGCGCTCTTGCAGCAGACCAAGATATTATTTTAAT
12020    T----GATACGTCTTCTTTTTCAAGCGT-TTCATCAACCTCCTCTATATATTCTTCCACC
12018    TCAACATACTCA--CGAATAGCTTCTG----TTACTTCGATGTTTTCACCACGAAT-ACT
12022    TAACCCTACAAGATCTAATAGGGCCTGAACTTTACTATCACGATCTGATTTTGATTTAGC 12023    ------------------------------------------------------------
12024    CTACACGTCCTCCCATAAGACCTGCTAATTGCTCTTTCATATCATCTTTTGAAAGAAGCA
12019    TTGTGAGCTAGT-------GCGTCCTAGTTTACGGTAAGCCATTATGTCCTCCTATTTTA
12021    GGATGAGCCTTTT-----GGAGCTCTGGATCCTATTACTAGAGAAGGTATTCAAGACTTA
12020    ACATCTACGCTA-------GACGGTACATTCTTAATATTTTTTAACG--CTACCGATTCA
12018    GTATTTAATCAT----ATGAGTACCTCTTTCTTGCGTTGTTAACGCTTTCTATACTCTTA
12022    TAATTTATGTAT----ATCTAAACCT-TCTGCTACGATATCACGAATCTTCATACGGCCG 12023    ------------------------------------------------------------
12024    TTTGATCTTCTTTAGGT----AAAGCAATCATATATCCACCTGCACGACCACGTGGTACG
12019    TTTATCGTTTTTTAATC----CAAGACCTAGATCGGCAAGTTTGATTTTAACTTCTTCAA
12021    GTCAAGTCTCTTCAGG------AAGAAATGGG--GAAAACTATCATCTTAGTTACT-CAT
12020    TTAATATCAGTTACTT----------CGTCGGT-GATACCTTCTATTTCAACTTTTGCTG
12018    TTATAACC-GCTT-----TCATGAAAA---------------------------------
12022    TTTAAGCTAGCCTGAGGATCCTGAAAAATCATCTGAGCGTCTTTACGAAAACTATGTAAT 12023    ------------------------------------------------------------
12024    ATAGTAACTTTATGAACAACTCGCGCATTTGAAAGAATCAAACCGACAATTGTGTGCCCA
12019    GACTCTTACGTCCTAAGTTTCGGACTTTCATCATTTCAGGCTCAGTTTTTTCTG-TTAAA
12021    GA---T-ATGGATGAAGCCCTCAAGTT--AGCAACAAAAATT--ATTGTTATGG-ACAAT
12020    GC---TTTTTACCAAAGCCCAAAAAACCTTTTTTCTCACGTGATACAACTTTTATATGTG
12018    ------------------------------------------------------------
12022    GCTTTACCTTTCAGATGTGAGATCACTTCTCCATTAAAGGTAATTTCTCCATCAGAAATA 12023    ------------------------------------------------------------
12024    GCTTCATGGTAAGCAACCATAGCTCTTTCTCTTTCAGAAATAGTACGATCTTTTTTAGAA
12019    TCAAATACTGTATTAATTCCAGCACGTTTTAAACAGTTATATGAGCGCACTGACAAATCA
12021    GGTAAAATGGTCCAAGAAGGGACACCCAATGATCTCTTACATCATCCTGCTA--------
12020    CCCTCAATCGTGAAATGTTTAACTCTTGTAGTCCTTTTTCAATAGCTTCTTCTACAGTCG
12018    ------------------------------------------------------------
12022    TCATAAAGTTTTAAAATTGAACGTCCAACGGTTGTCTTTCCTGATCCAGATTCCCCAACT 12023    ------------------------------------------------------------
12024    GGACCAGCAATTACACGGTCTTCTGCTTCATCAATATCTGAAGCATCAATAACTTTTTTA
12019    AGTTCCTCAATTGTCCGGTCAAGCACTTTCTCATCGTTCACTTTCTCTGTTTCCTTCATT
12021    ------------------------------------------------------------
12020    CTCCTGTAAATAATACC-------------------------------------------
12018    ------------------------------------------------------------
12022    AATCCAAACACTTCACCTTCATAAATGTCAAAACTAACATTATCAATTGCTCTCACTTCA 12023    ------------------------------------------------------------
12024    TTTCGTCGCGCAGCAACTAAAGCAGCTTCATTGAGAACATTCTCCAAATCAGCACCAACA
12019    ACTTCAGTTGCTTTAGCAACCTCTGTTAAATCAGTAAACAAGTTTAAGTGTTCAATTAAG
12021    ------------------------------------------------------------
12020    ------------------------------------------------------------
12018    ------------------------------------------------------------
12022    TTAGCTTTTCCTTTATTGAAGGTCAAAGAAACATTTTTGACTTCAACTAATTTTTTCGA 12023    ------------------------------------------------------------
12024    AATCCTGGGGTTTGTTGAGCTACTACTTTTAAGTCAACATTATCTGCTAATGGTTTATTT...
12019    ACGCGAGCTGAAAGACCAAGAGCATCCTCAGGAATGA-----------------------
12021    ------------------------------------------------------------
```

```
                        -continued
12020       ------------------------------------------------------------
12018       ------------------------------------------------------------
12022       TTTTCAGTCATTAGGCT-------------------------------------------
```

It will be understood that the invention has been described by way of example only and modifications may be made whilst remaining within the scope and spirit of the invention.

TABLE I

THEROETICAL MOLECULAR WEIGHTS FOR GBS PROTEINS

| GBS # | expected mol. weight (dalton) | | |
|---|---|---|---|
| | GST-fusion | His-fusion | Native |
| 1 | 78425 | 53460 | 49720 |
| 2 | 40035 | 15070 | 11330 |
| 3 | 90305 | 65340 | 61600 |
| 4 | 43115 | 18150 | 14410 |
| 5 | 158835 | 133870 | 130130 |
| 6 | 39265 | 14300 | 10560 |
| 7 | 44985 | 20020 | 16280 |
| 8 | 56315 | 31350 | 27610 |
| 9 | 50265 | 25300 | 21560 |
| 10 | 96465 | 71500 | 67760 |
| 11 | 91515 | 66550 | 62810 |
| 11d | 85905 | 60940 | 57200 |
| 12 | 64455 | 39490 | 35750 |
| 13 | 40475 | 15510 | 11770 |
| 14 | 33325 | 8360 | 4620 |
| 15 | 44765 | 19800 | 16060 |
| 16 | 73475 | 48510 | 44770 |
| 17 | 46745 | 21780 | 18040 |
| 18 | 54335 | 29370 | 25630 |
| 19 | 46085 | 21120 | 17380 |
| 20 | 47625 | 22660 | 18920 |
| 21 | 56535 | 31570 | 27830 |
| 21 long | 66435 | 41470 | 37730 |
| 22 | 60055 | 35090 | 31350 |
| 23 | 60165 | 35200 | 31460 |
| 24 | 58405 | 33440 | 29700 |
| 25 | 50265 | 25300 | 21560 |
| 26 | 118245 | 93280 | 89540 |
| 28 | 63795 | 38830 | 35090 |
| 29 | 50595 | 25630 | 21890 |
| 30 | 44215 | 19250 | 15510 |
| 31 | 63795 | 38830 | 35090 |
| 31d | 58735 | 33770 | 30030 |
| 32 | 40585 | 15620 | 11880 |
| 33 | 71495 | 46530 | 42790 |
| 34 | 69295 | 44330 | 40590 |
| 35 | 56535 | 31570 | 27830 |
| 36 | 59065 | 34100 | 30360 |
| 37 | 46965 | 22000 | 18260 |
| 38 | 61815 | 36850 | 33110 |
| 39 | 65225 | 40260 | 36520 |
| 41 | 75235 | 50270 | 46530 |
| 42 | 46745 | 21780 | 18040 |
| 43 | 58955 | 33990 | 30250 |
| 44 | 52355 | 27390 | 23650 |
| 45 | 43555 | 18590 | 14850 |
| 46 | 59835 | 34870 | 31130 |
| 47 | 84255 | 59290 | 55550 |
| 48 | 86455 | 61490 | 57750 |
| 48d | 106695 | 81730 | 77990 |
| 49 | 59615 | 34650 | 30910 |
| 50 | 94155 | 69190 | 65450 |
| 51 | 47075 | 22110 | 18370 |
| 52 | 55435 | 30470 | 26730 |
| 53 | 110215 | 85250 | 81510 |
| 54 | 73365 | 48400 | 44660 |
| 55 | 36295 | 11330 | 7590 |
| 56 | 34865 | 9900 | 6160 |
| 57 | 51145 | 26180 | 22440 |
| 58 | 128805 | 103840 | 100100 |
| 59 | 99215 | 74250 | 70510 |
| 60 | 63575 | 38610 | 34870 |

TABLE I-continued

THEROETICAL MOLECULAR WEIGHTS FOR GBS PROTEINS

| GBS # | expected mol. weight (dalton) | | |
|---|---|---|---|
| | GST-fusion | His-fusion | Native |
| 61 | 68085 | 43120 | 39380 |
| 62 | 105485 | 80520 | 76780 |
| 63 | 64125 | 39160 | 35420 |
| 64 | 112745 | 87780 | 84040 |
| 65 | 72485 | 47520 | 43780 |
| 66 | 49715 | 24750 | 21010 |
| 67 | 120335 | 95370 | 91630 |
| 68 | 131225 | 106260 | 102520 |
| 68d | 103065 | 78100 | 74360 |
| 69 | 53895 | 28930 | 25190 |
| 70 | 74465 | 49500 | 45760 |
| 70d | 59725 | 34760 | 31020 |
| 71 | 56755 | 31790 | 28050 |
| 72 | 75565 | 50600 | 46860 |
| 73 | 72815 | 47850 | 44110 |
| 74 | 131225 | 106260 | 102520 |
| 74d | 95475 | 70510 | 66770 |
| 75 | 114725 | 89760 | 86020 |
| 76 | 198875 | 173910 | 170170 |
| 77 | 78535 | 53570 | 49830 |
| 78 | 48835 | 23870 | 20130 |
| 79 | 58185 | 33220 | 29480 |
| 79d | 50815 | 25850 | 22110 |
| 80 | 81835 | 56870 | 53130 |
| 81 | 89205 | 64240 | 60500 |
| 82 | 40475 | 15510 | 11770 |
| 83 | 62585 | 37620 | 33880 |
| 84 | 122645 | 97680 | 93940 |
| 85 | 70175 | 45210 | 41470 |
| 86 | 84035 | 59070 | 55330 |
| 87 | 44435 | 19470 | 15730 |
| 88 | 73365 | 48400 | 44660 |
| 89 | 143325 | 118360 | 114620 |
| 90 | 93495 | 68530 | 64790 |
| 91 | 88325 | 63360 | 59620 |
| 92 | 193595 | 168630 | 164890 |
| 93 | 95585 | 70620 | 66880 |
| 94 | 77435 | 52470 | 48730 |
| 95 | 60605 | 35640 | 31900 |
| 96 | 57195 | 32230 | 28490 |
| 97 | 138375 | 113410 | 109670 |
| 98 | 82055 | 57090 | 53350 |
| 99 | 60715 | 35750 | 32010 |
| 100 | 53015 | 28050 | 24310 |
| 101 | 59395 | 34430 | 30690 |
| 102 | 40695 | 15730 | 11990 |
| 103 | 56975 | 32010 | 28270 |
| 104 | 120005 | 95040 | 91300 |
| 105 | 179735 | 154770 | 151030 |
| 105dNterm | 127265 | 102300 | 98560 |
| 105dCterm | 81285 | 56320 | 52580 |
| 106 | 85795 | 60830 | 57090 |
| 107 | 89535 | 64570 | 60830 |
| 108 | 64565 | 39600 | 35860 |
| 109 | 75125 | 50160 | 46420 |
| 109d | 70725 | 45760 | 42020 |
| 110 | 53895 | 28930 | 25190 |
| 111/190 | 60165 | 35200 | 31460 |
| 112 | 63905 | 38940 | 35200 |
| 113 | 59175 | 34210 | 30470 |
| 114 | 51915 | 26950 | 23210 |
| 115 | 98225 | 73260 | 69520 |
| 116 | 73475 | 48510 | 44770 |
| 117 | 47515 | 22550 | 18810 |
| 118 | 42235 | 17270 | 13530 |
| 119 | 109225 | 84260 | 80520 |

TABLE I-continued

THEORETICAL MOLECULAR WEIGHTS FOR GBS PROTEINS

| GBS # | expected mol. weight (dalton) | | |
|---|---|---|---|
| | GST-fusion | His-fusion | Native |
| 120 | 71385 | 46420 | 42680 |
| 121 | 65115 | 40150 | 36410 |
| 122 | 46855 | 21890 | 18150 |
| 123 | 68305 | 43340 | 39600 |
| 124 | 54115 | 29150 | 25410 |
| 125 | 57305 | 32340 | 28600 |
| 126 | 56865 | 31900 | 28160 |
| 127 | 80845 | 55880 | 52140 |
| 128 | 39925 | 14960 | 11220 |
| 129 | 43775 | 18810 | 15070 |
| 130 | 82275 | 57310 | 53570 |
| 130d | 63245 | 38280 | 34540 |
| 131 | 89755 | 64790 | 61050 |
| 132 | 49055 | 24090 | 20350 |
| 133 | 54445 | 29480 | 25740 |
| 134 | 42015 | 17050 | 13310 |
| 135 | 65225 | 40260 | 36520 |
| 136 | 54885 | 29920 | 26180 |
| 137 | 63465 | 38500 | 34760 |
| 138 | 40145 | 15180 | 11440 |
| 139 | 38165 | 13200 | 9460 |
| 140 | 43445 | 18480 | 14740 |
| 141 | 49935 | 24970 | 21230 |
| 142 | 79745 | 54780 | 51040 |
| 143 | 33545 | 8580 | 4840 |
| 144 | 49165 | 24200 | 20460 |
| 145 | 63025 | 38060 | 34320 |
| 146 | 107025 | 82060 | 78320 |
| 147 | 156965 | 132000 | 128260 |
| 148 | 41905 | 16940 | 13200 |
| 149 | 62365 | 37400 | 33660 |
| 150 | 54665 | 29700 | 25960 |
| 151 | 50412 | 25447 | 21707 |
| 151L | 50045 | 25080 | 21340 |
| 152 | 45535 | 20570 | 16830 |
| 153 | 46965 | 22000 | 18260 |
| 154 | 101525 | 76560 | 72820 |
| 155 | 62585 | 37620 | 33880 |
| 156 | 61265 | 36300 | 32560 |
| 157 | 74025 | 49060 | 45320 |
| 158 | 52025 | 27060 | 23320 |
| 159 | 41025 | 16060 | 12320 |
| 160 | 82825 | 57860 | 54120 |
| 161 | 95365 | 70400 | 66660 |
| 162 | 42015 | 17050 | 13310 |
| 163 | 69405 | 44440 | 40700 |
| 164 | 42345 | 17380 | 13640 |
| 165 | 43555 | 18590 | 14850 |
| 166 | 38055 | 13090 | 9350 |
| 167 | 50375 | 25410 | 21670 |
| 168 | 32555 | 7590 | 3850 |
| 169 | 43445 | 18480 | 14740 |
| 170 | 64015 | 39050 | 35310 |
| 170d | 59945 | 34980 | 31240 |
| 171 | 49825 | 24860 | 21120 |
| 172 | 62365 | 37400 | 33660 |
| 173 | 96795 | 71830 | 68090 |
| 174 | 45095 | 20130 | 16390 |
| 175 | 59175 | 34210 | 30470 |
| 176 | 55435 | 30470 | 26730 |
| 177 | 66215 | 41250 | 37510 |
| 178 | 62365 | 37400 | 33660 |
| 179 | 58515 | 33550 | 29810 |
| 180 | 37615 | 12650 | 8910 |
| 181 | 63685 | 38720 | 34980 |
| 182 | 90085 | 65120 | 61380 |
| 182d | 87225 | 62260 | 58520 |
| 183 | 57855 | 32890 | 29150 |
| 184 | 46415 | 21450 | 17710 |
| 185 | 40695 | 15730 | 11990 |
| 186 | 85685 | 60720 | 56980 |
| 187 | 56205 | 31240 | 27500 |
| 188 | 61595 | 36630 | 32890 |
| 189 | 60165 | 35200 | 31460 |
| 191 | 116705 | 91740 | 88000 |
| 192 | 69625 | 44660 | 40920 |
| 193 | 98005 | 73040 | 69300 |
| 194 | 49385 | 24420 | 20680 |
| 195 | 81065 | 56100 | 52360 |
| 195L | 147615 | 122650 | 118910 |
| 195L N-term | 91405 | 66440 | 62700 |
| 196 | 69515 | 44550 | 40810 |
| 197 | 99325 | 74360 | 70620 |
| 198 | 73805 | 48840 | 45100 |
| 199 | 158285 | 133320 | 129580 |
| 200 | 132325 | 107360 | 103620 |
| 201 | 74538 | 49573 | 45833 |
| 202 | 157295 | 132330 | 128590 |
| 203 | 61705 | 36740 | 33000 |
| 204 | 39705 | 14740 | 11000 |
| 205 | 55985 | 31020 | 27280 |
| 206 | 56645 | 31680 | 27940 |
| 207 | 44765 | 19800 | 16060 |
| 208 | 59725 | 34760 | 31020 |
| 209 | 62145 | 37180 | 33440 |
| 209d | 56425 | 31460 | 27720 |
| 210 | 60935 | 35970 | 32230 |
| 210d | 53675 | 28710 | 24970 |
| 211 | 64895 | 39930 | 36190 |
| 212 | 60825 | 35860 | 32120 |
| 213 | 45205 | 20240 | 16500 |
| 214 | 38935 | 13970 | 10230 |
| 215 | 45205 | 20240 | 16500 |
| 216 | 91515 | 66550 | 62810 |
| 217 | 36075 | 11110 | 7370 |
| 218 | 81065 | 56100 | 52360 |
| 219 | 56535 | 31570 | 27830 |
| 220 | 54555 | 29590 | 25850 |
| 220 | 50155 | 25190 | 21450 |
| 221 | 41465 | 16500 | 12760 |
| 222 | 47405 | 22440 | 18700 |
| 223 | 42895 | 17930 | 14190 |
| 224 | 45865 | 20900 | 17160 |
| 225 | 56645 | 31680 | 27940 |
| 226 | 44875 | 19910 | 16170 |
| 227 | 46195 | 21230 | 17490 |
| 228 | 46525 | 21560 | 17820 |
| 229 | 35855 | 10890 | 7150 |
| 230 | 51915 | 26950 | 23210 |
| 231 | 60935 | 35970 | 32230 |
| 231d | 58735 | 33770 | 30030 |
| 232 | 41795 | 16830 | 13090 |
| 233 | 35635 | 10670 | 6930 |
| 234 | 43115 | 18150 | 14410 |
| 235 | 58295 | 33330 | 29590 |
| 235d | 48395 | 23430 | 19690 |
| 236 | 46525 | 21560 | 17820 |
| 237 | 44215 | 19250 | 15510 |
| 238 | 59725 | 34760 | 31020 |
| 239 | 63905 | 38940 | 35200 |
| 240 | 51475 | 26510 | 22770 |
| 241 | 45095 | 20130 | 16390 |
| 242 | 43225 | 18260 | 14520 |
| 243 | 119455 | 94490 | 90750 |
| 244 | 48065 | 23100 | 19360 |
| 245 | 48615 | 23650 | 19910 |
| 246 | 49605 | 24640 | 20900 |
| 246d | 45975 | 21010 | 17270 |
| 247 | 58955 | 33990 | 30250 |
| 248 | 92505 | 67540 | 63800 |
| 248d | 70835 | 45870 | 42130 |
| 249 | 103835 | 78870 | 75130 |
| 250 | 136505 | 111540 | 107800 |
| 251 | 52135 | 27170 | 23430 |
| 252 | 51695 | 26730 | 22990 |
| 253 | 74245 | 49280 | 45540 |

TABLE I-continued

THEORETICAL MOLECULAR WEIGHTS FOR GBS PROTEINS

| GBS # | GST-fusion | His-fusion | Native |
|---|---|---|---|
| 254 | 59615 | 34650 | 30910 |
| 255 | 69075 | 44110 | 40370 |
| 256 | 47845 | 22880 | 19140 |
| 257 | 60495 | 35530 | 31790 |
| 258 | 67975 | 43010 | 39270 |
| 259 | 79415 | 54450 | 50710 |
| 260 | 48175 | 23210 | 19470 |
| 261 | 55765 | 30800 | 27060 |
| 262 | 75345 | 50380 | 46640 |
| 263 | 63465 | 38500 | 34760 |
| 264 | 47185 | 22220 | 18480 |
| 265 | 56315 | 31350 | 27610 |
| 266 | 51365 | 26400 | 22660 |
| 267 | 88655 | 63690 | 59950 |
| 268 | 50265 | 25300 | 21560 |
| 269 | 60495 | 35530 | 31790 |
| 270 | 59285 | 34320 | 30580 |
| 271 | 56315 | 31350 | 27610 |
| 272 | 118355 | 93390 | 89650 |
| 272d | 98885 | 73920 | 70180 |
| 273 | 70945 | 45980 | 42240 |
| 274 | 56205 | 31240 | 27500 |
| 275 | 47515 | 22550 | 18810 |
| 276 | 147945 | 122980 | 119240 |
| 277 | 87005 | 62040 | 58300 |
| 277d | 75675 | 50710 | 46970 |
| 278 | 52245 | 27280 | 23540 |
| 279 | 79415 | 54450 | 50710 |
| 280 | 88655 | 63690 | 59950 |
| 281 | 74465 | 49500 | 45760 |
| 281d | 71495 | 46530 | 42790 |
| 282 | 44765 | 19800 | 16060 |
| 283 |  | 20240 | 16500 |
| 284 | 67645 | 42680 | 38940 |
| 285 | 57525 | 32560 | 28820 |
| 286 | 41355 | 16390 | 12650 |
| 287 | 61045 | 36080 | 32340 |
| 287d | 57085 | 32120 | 28380 |
| 288 | 53675 | 28710 | 24970 |
| 288d | 51035 | 26070 | 22330 |
| 289 | 65005 | 40040 | 36300 |
| 289 long | 71825 | 46860 | 43120 |
| 290 | 47405 | 22440 | 18700 |
| 291 | 63795 | 38830 | 35090 |
| 292 | 103505 | 78540 | 74800 |
| 293 | 115935 | 90970 | 87230 |
| 293d N-term | 73805 | 48840 | 45100 |
| 293d C-term | 70835 | 45870 | 42130 |
| 294 | 75785 | 50820 | 47080 |
| 295 | 89425 | 64460 | 60720 |
| 296 | 60385 | 35420 | 31680 |
| 297 | 100205 | 75240 | 71500 |
| 298 | 54335 | 29370 | 25630 |
| 299 | 62255 | 37290 | 33550 |
| 300 | 130895 | 105930 | 102190 |
| 301 | 54885 | 29920 | 26180 |
| 302 | 80075 | 55110 | 51370 |
| 303 | 53235 | 28270 | 24530 |
| 304 | 75125 | 50160 | 46420 |
| 305 | 78645 | 53680 | 49940 |
| 306 | 67975 | 43010 | 39270 |
| 307 | 86675 | 61710 | 57970 |
| 308 | 59285 | 34320 | 30580 |
| 309 | 62695 | 37730 | 33990 |
| 310 | 58845 | 33880 | 30140 |
| 311 | 76445 | 51480 | 47740 |
| 312 | 64785 | 39820 | 36080 |
| 313 | 65995 | 41030 | 37290 |
| 314 | 52135 | 27170 | 23430 |
| 315 | 51695 | 26730 | 22990 |
| 316 | 41795 | 16830 | 13090 |
| 317 | 179295 | 154330 | 150590 |
| 317d N-term | 115935 | 90970 | 87230 |
| 317d C-term | 92160 | 67402 | 63360 |
| 318 | 70065 | 45100 | 41360 |
| 319 | 61925 | 36960 | 33220 |
| 320 | 57965 | 33000 | 29260 |
| 321 | 83705 | 58740 | 55000 |
| 322 | 76628 | 51663 | 47923 |
| 323 | 86345 | 61380 | 57640 |
| 324 | 86345 | 61380 | 57640 |
| 325 | 82605 | 57640 | 53900 |
| 326 | 91515 | 66550 | 62810 |
| 326L | 172695 | 147730 | 143990 |
| 326L N-term | 113955 | 88990 | 85250 |
| 327 | 279175 | 254210 | 250470 |
| 327d N-term | 139915 | 114950 | 111210 |
| 327d C-term | 167965 | 143000 | 139260 |
| 328 | 97602 | 72637 | 68897 |
| 329 | 113955 | 88990 | 85250 |
| 330 | 83595 | 58630 | 54890 |
| 331 | 60825 | 35860 | 32120 |
| 332 | 75675 | 50710 | 46970 |
| 333 | 63465 | 38500 | 34760 |
| 333d | 57965 | 33000 | 29260 |
| 334 | 38275 | 13310 | 9570 |
| 335 | 43555 | 18590 | 14850 |
| 336 | 67645 | 42680 | 38940 |
| 337 | 75235 | 50270 | 46530 |
| 338 | 54995 | 30030 | 26290 |
| 339 | 76665 | 51700 | 47960 |
| 339d | 72925 | 47960 | 44220 |
| 340 | 86565 | 61600 | 57860 |
| 341 | 38385 | 13420 | 9680 |
| 342 | 61595 | 36630 | 32890 |
| 343 | 60385 | 35420 | 31680 |
| 344 | 55875 | 30910 | 27170 |
| 345 | 40585 | 15620 | 11880 |
| 346 | 53895 | 28930 | 25190 |
| 347 | 55325 | 30360 | 26620 |
| 348 | 58405 | 33440 | 29700 |
| 349 | 98335 | 73370 | 69630 |
| 350 | 53895 | 28930 | 25190 |
| 351 | 82165 | 57200 | 53460 |
| 352 | 111315 | 86350 | 82610 |
| 352d | 105485 | 80520 | 76780 |
| 353 | 55325 | 30360 | 26620 |
| 354 | 42345 | 17380 | 13640 |
| 355 | 52135 | 27170 | 23430 |
| 356 | 59065 | 34100 | 30360 |
| 357 | 40255 | 15290 | 11550 |
| 358 | 60495 | 35530 | 31790 |
| 359 | 78865 | 53900 | 50160 |
| 360 | 73695 | 48730 | 44990 |
| 361 | 109005 | 84040 | 80300 |
| 362 | 125945 | 100980 | 97240 |
| 362d N-term | 63355 | 38390 | 34650 |
| 362d C-term | 91295 | 66330 | 62590 |
| 363 | 53125 | 28160 | 24420 |
| 364 | 75015 | 50050 | 46310 |
| 365 | 102075 | 77110 | 73370 |
| 366 | 68415 | 43450 | 39710 |
| 367 | 76885 | 51920 | 48180 |
| 368 | 44765 | 19800 | 16060 |
| 369 | 142115 | 117150 | 113410 |
| 370 | 94595 | 69630 | 65890 |
| 371 | 65555 | 40590 | 36850 |
| 372 | 55105 | 30140 | 26400 |
| 373 | 50265 | 25300 | 21560 |
| 374 | 57525 | 32560 | 28820 |
| 375 | 66875 | 41910 | 38170 |
| 376 | 48065 | 23100 | 19360 |
| 377 | 73805 | 48840 | 45100 |
| 378 | 58955 | 33990 | 30250 |
| 379 | 68855 | 43890 | 40150 |
| 380 | 47405 | 22440 | 18700 |

TABLE I-continued

THEROETICAL MOLECULAR WEIGHTS FOR GBS PROTEINS

| GBS # | GST-fusion | His-fusion | Native |
|---|---|---|---|
| 381 | 66875 | 41910 | 38170 |
| 382 | 50815 | 25850 | 22110 |
| 383 | 57085 | 32120 | 28380 |
| 384 | 77985 | 53020 | 49280 |
| 385 | 75675 | 50710 | 46970 |
| 386 | 39485 | 14520 | 10780 |
| 387 | 54555 | 29590 | 25850 |
| 388 | 45645 | 20680 | 16940 |
| 389 | 43005 | 18040 | 14300 |
| 390 | 62255 | 37290 | 33550 |
| 391 | 54775 | 29810 | 26070 |
| 392 | 71385 | 46420 | 42680 |
| 393 | 55765 | 30800 | 27060 |
| 394 | 59725 | 34760 | 31020 |
| 395 | 72375 | 47410 | 43670 |
| 396 | 34865 | 9900 | 6160 |
| 397 | 113625 | 88660 | 84920 |
| 397d | 100865 | 3740 | 72160 |
| 398 | 56755 | 31790 | 28050 |
| 399 | 55435 | 30470 | 26730 |
| 400 | 74135 | 49170 | 45430 |
| 401 | 59395 | 34430 | 30690 |
| 402 | 78095 | 53130 | 49390 |
| 403 | 64455 | 39490 | 35750 |
| 404 | 61595 | 36630 | 32890 |
| 405 | 45975 | 21010 | 17270 |
| 406 | 36955 | 11990 | 8250 |
| 407 | 82715 | 57750 | 54010 |
| 407d | 71715 | 46750 | 43010 |
| 408 | 45315 | 20350 | 16610 |
| 409 | 70395 | 45430 | 41690 |
| 409d | 59600 | 34842 | 30800 |
| 410 | 62475 | 37510 | 33770 |
| 411 | 41355 | 16390 | 12650 |
| 412 | 35965 | 11000 | 7260 |
| 413 | 59175 | 34210 | 30470 |
| 414 | 50375 | 25410 | 21670 |
| 415 | 46195 | 21230 | 17490 |
| 416 | 42455 | 17490 | 13750 |
| 417 | 77985 | 53020 | 49280 |
| 418 | 42125 | 17160 | 13420 |
| 419 | 47515 | 22550 | 18810 |
| 420 | 67755 | 42790 | 39050 |
| 421 | 62915 | 37950 | 34210 |
| 422 | 60165 | 35200 | 31460 |
| 423 | 74245 | 49280 | 45540 |
| 424 | 89975 | 65010 | 61270 |
| 424 | 77325 | 52360 | 48620 |
| 425 | 116045 | 91080 | 87340 |
| 426 | 83815 | 58850 | 55110 |
| 427 | 41135 | 16170 | 12430 |
| 428 | 55325 | 30360 | 26620 |
| 429 | 59175 | 34210 | 30470 |
| 430 | 53785 | 28820 | 25080 |
| 431 | 54005 | 29040 | 25300 |
| 432 | 65665 | 40700 | 36960 |
| 433 | 40915 | 15950 | 12210 |
| 434 | 44545 | 19580 | 15840 |
| 642 | 91845 | 66880 | 63140 |
| 643 | 78975 | 54010 | 50270 |
| 644 | 49605 | 24640 | 20900 |
| 645 | 59725 | 34760 | 31020 |
| 646 | 61595 | 36630 | 32890 |
| 647 | 55875 | 30910 | 27170 |
| 648 | 59835 | 34870 | 31130 |
| 649 | 76115 | 51150 | 47410 |
| 650 | 51475 | 26510 | 22770 |
| 651 | 53345 | 28380 | 24640 |
| 652 | 49715 | 24750 | 21010 |
| 653 | 44655 | 19690 | 15950 |
| 654 | 51255 | 26290 | 22550 |
| 655 | 65995 | 41030 | 37290 |
| 656 | 57525 | 32560 | 28820 |
| 657 | 62805 | 37840 | 34100 |
| 658 | 60165 | 35200 | 31460 |
| 659 | 60275 | 35310 | 31570 |
| 660 | 71495 | 46530 | 42790 |
| 661 | 60605 | 35640 | 31900 |
| 662 | 62695 | 37730 | 33990 |
| 663 | 89535 | 64570 | 60830 |
| 664 | 45315 | 20350 | 16610 |
| 665 | 41135 | 16170 | 12430 |
| 666 | 47075 | 22110 | 18370 |
| 667 | 53162 | 28197 | 24457 |
| 668 | 43555 | 18590 | 14850 |
| 669 | 48505 | 23540 | 19800 |
| 670 | 45315 | 20350 | 16610 |
| 671 | 36940 | 12182 | 8140 |
| 672 | 40130 | 15372 | 11330 |
| 673 | 41450 | 16692 | 12650 |
| 674 | 45300 | 20542 | 16500 |
| 675 | 55970 | 31212 | 27170 |
| 676 | 65650 | 40892 | 36850 |
| 677 | 54320 | 29562 | 25520 |
| 678 | 77750 | 52992 | 48950 |
| 679 | 60480 | 35722 | 31680 |
| 680 | 64440 | 39682 | 35640 |
| 681 | 93040 | 68282 | 64240 |
| 682 | 84790 | 60032 | 55990 |
| 683 | 15950 | 44655 | 19690 |
| 684 | 11880 | 40585 | 15620 |
| 685 | 16280 | 44985 | 20020 |
| 686 | 21340 | 50045 | 25080 |
| 687 | 9350 | 38055 | 13090 |
| 689 | 55105 | 3740 | 26400 |

TABLE II

PRIMERS USED TO AMPLIFY GBSnnn PROTEINS
Forward primers begin 5'-GGGGACAAGTTTGTACAAAAAAGCAGGC-3' and continue
with the sequences indicated in the table below; reverse primers begin
5'-GGGGACCACTTTGTACAAGAAAGCTGGGTT-3' and
continue with the sequences indicated in the table. The primers for GBS1 are thus:
Fwd: GGGGACAAGTTTGTACAAAAAAGCAGGCTCTCAATCTCATATTGTTTCAG
Rev: GGGGACCACTTTGTACAAGAAAGCTGGGTTATTTTTAGACATCATAGACA
The full forward primer sequences are given in the sequence listing as SEQ IDs 10968-11492. The
reverse primer sequences are SEQ IDs 11493-12017.

| GBS | Forward | Reverse |
|---|---|---|
| 1 | TCTCAATCTCATATTGTTTCAG | ATTTTTAGACATCATAGACA |
| 2 | TCTAATTACATTATTCATTTTTG | GGGAATGCCTACAAA |
| 3 | TCTGATACTAGTTCAGGAATATC | TTTTTTACTATACTTTTTGT |

TABLE II-continued

PRIMERS USED TO AMPLIFY GBSnnn PROTEINS
Forward primers begin 5'-GGGGACAAGTTTGTACAAAAAAGCAGGC-3' and continue
with the sequences indicated in the table below; reverse primers begin
5'-GGGGACCACTTTGTACAAGAAAGCTGGGTT-3' and
continue with the sequences indicated in the table. The primers for GBS1 are thus:
Fwd: GGGGACAAGTTTGTACAAAAAAGCAGGCTCTCAATCTCATATTGTTTCAG
Rev: GGGGACCACTTTGTACAAGAAAGCTGGGTTATTTTTAGACATCATAGACA
The full forward primer sequences are given in the sequence listing as SEQ IDs 10968-11492. The
reverse primer sequences are SEQ IDs 11493-12017.

| GBS | Forward | Reverse |
|---|---|---|
| 4 | TCTGATACAAGTGATAAGAATACT | TTCCTTTTTAGGCTTACT |
| 5 | TCTATTTTTCTTCATAGTCCAC | ATTAGCTTCATTTGTCAG |
| 6 | TCTGAATGGGTGTTATTAACTC | AGTTTCTTCTTTAAAATCAT |
| 7 | TCTACAAATTCTTATTTTAGCAA | CTCTGAAGCTGTAAAACC |
| 8 | TCTGTATCAGTTCAGGCGT | TTTATCAATGTTTGAAACG |
| 9 | TCTGCTGCTCTAGGACAAC | TAGTAAATCAAGTTTTTGCA |
| 10 | TCTTTTGTTGTTGCCTTATT | ATCCCTTCTATTTTCGA |
| 11 | TCTCCACCTATGGAACGT | ATGTAGTGACGTTTCTGTG |
| 11d | TCTCAGAAAGTCTATCGGG | ATGTAGTGACGTTTCTGTG |
| 12 | TCTAGTGAGAAGAAAGCAAAT | ATTGGGTGTAAGCATT |
| 13 | TCTTCTTGGAATTATTGGAG | CTTAACTCTACCCGTCC |
| 14 | TCTGCAATGATTGTAACCAT | TTTTCTCTTATTAAAGAATT |
| 15 | TCTGCATCTTATACCGTGAA | ATACCAGCCGTTACTATT |
| 16 | TCTGCCGAGAAGGATAAA | TTTAGCTGCTTTTTTAATG |
| 17 | TCTGTTTATAAAGTTATTCAAAA | AAATACTACATTTACAGGTG |
| 18 | TCTAAGCCTAACAGTCAACA | TTGGTTATTCTCCTTTAAT |
| 19 | TCTGATGATAACTTTGAAATGC | ATTATATTTTTGGATATTTC |
| 20 | TCTGCAGTGATTGCAAGTC | GGGCTTTTTCTTAAAAA |
| 21 | TGTGCTGCATCAAAC | GTTGGCATCCCTTTT |
| 21 Long + A527 | TGTGCTGCATCAAAC | CTTTTGATGGGATTGG |
| 22 | TGTACTAAACAAAGCCAG | TTGATTTAACGATTTGA |
| 23 | TGTCAATTAACCGATAC | TTTATCTCCTCTAAAATAATG |
| 24 | TGCTCAAATGATTCAT | CTTTGATAAGTCAGACCA |
| 25 | TCTAAAAGTTCACAAGTTACTACT | GTAACCCCAAGCTGAT |
| 26 | TCTAGTCATTATTCCATAAAATT | TGATTTTGCAATATCAA |
| 28 | TCTAATCATATGCTGATTGAG | TTTTTGTAATTTAAGTACTAA |
| 29 | TCAGTTTGGATGTTAAC | TTCTTTTATATTAAGAGCTT |
| 30 | TCAACAAATGCAGATG | ATTCGGATAAATGTAGC |
| 31 | TGTTTTGTCATTATTGATAG | TCCATTTTTATCCTCAC |
| 31d | TCTCTAACTTGGTTTTTATTAGA | TCCATTTTTATCCTCAC |
| 32 | TCTGGTTTAAAAGTGACTGAA | ATGACCTCTACTTTCCA |
| 33 | TCTCATCATTTAGGTAAGGAA | CTTGTAATCACTTGGAC |
| 34 | TCTGTTAGTAATCGCTACAATC | ATTAATCATGGTATTGGT |
| 35 | TCTAATCAAGAAGTTTCAGC | CCATTGTGGAATATCA |
| 36 | TCTCGAGTTTTAGCGGATA | TTTGTAAAGCAGTTCTT |
| 37 | TCTGTATTATTTTACCAATCACA | ATCATTCATATGATCTCTAGA |
| 38 | TTAGGAGTGGTAGTTCAT | ATTTTGATTGATTCTACTC |
| 39 | TTTTTATTGTTAGTATTAGC | TTTTGTTTTTTTCAAATA |
| 41 | TCTGTTTATCTAGCGGTTAGA | ATCTTCAACGTCCTCC |
| 42 | TATAACAGTTTAGTTAGAAGTC | AAAGTCAAAGGAAACTT |
| 43 | TTTAAAGGGTTTACATATT | TTCTTTATCTAAATTATAATAG |
| 44 | TTTAATACAATTGGTCG | TTGCAATGTTTTTTCT |
| 45 | TCTATGGAAAAAATTAGGATT | TAAACTTTGGATAATCTGT |
| 46 | TCTAGAGATGAGCAAGAAATA | GTTGAAATTTTGATATGA |
| 47 | TCTCAACAGATAGGTCTTTATAA | CTCCTTTACTATATAGCTAACT |
| 48 | TTTCTCTATAATTACTTCAAT | TTGTTTGTGAAGTAAAAC |
| 49 | TCTAATAAGGCATTATTAGAGG | TGATAATATCTCCATATTTT |
| 50 | TCTACACATTTAGTTGACTTAAC | GCATTGGCGCCATA |
| 51 | TCTAGTAAACAACACATTTATCTA | TTCTACACGACTTTTATTC |
| 52 | TCTCAAGAAACTCATCAGTTG | AAGACCTCCTCGAGAT |
| 53 | TCTGCAGAAGACATTGTTACA | TGTTTTTTCTTTCTGTTG |
| 54 | TATAATTTTTCGACTAATGA | TGGATTAGTTTGACCTG |
| 55 | TCTGACACAGTGTCTTATCCT | TTTATCGTAAGCACTTAGG |
| 56 | TCTGTGGAGCAAGTGGCCA | CTCCTTCCAGGCATCG |
| 57 | TCTCAAGAACTAAGTAACTTTGA | GTAAAAGTATCTTAAATAGTCA |
| 58 | TCTACTGAAACGTTTGAAGG | TGCCATTCCTCCTCT |
| 59 | TCTGATGAAGCAACAACTAA | TGTTACCTTTTTATTTTCT |
| 60 | TCTAATAAAGATAATCAAAAAACT | TTTTTCATGCGATTGA |
| 61 | TGTTTCTTTTTTATTCCA | GAGACGTTTCTTATACCTT |
| 62 | TATTACTTTGATGGTAGTTT | TGTACCATATGTTCTCTCT |
| 63 | TCTGTTCAATCATTAGCAAA | AAAAGTTGGACTACTTTC |
| 64 | TTTAAAGGTAATAAGAAGTTG | TCGTTTTCCACCC |
| 64d | TCTAGTCAAGTTGACTCTGTTA | TCGTTTTCCACCC |
| 65 | TCTCAAAACCAGGTGACTG | ATTTGGGTAAATATAGTAAA |
| 66 | TTAAGATTTTATAACAACGA | TTTACGACTAACCTCAAC |
| 67 | TCTAATGTTTTAGGGGAAA | AATTCCTTTTGGTGG |
| 68 | TCCCAAAAGACTTTTG | GGCAGAATACACCTTC |
| 68d | TCCCCAAAAGACTTTTG | GGCTGACGTCGACGCA |

TABLE II-continued

PRIMERS USED TO AMPLIFY GBSnnn PROTEINS
Forward primers begin 5'-GGGGACAAGTTTGTACAAAAAAGCAGGC-3' and continue
with the sequences indicated in the table below; reverse primers begin
5'-GGGGACCACTTTGTACAAGAAAGCTGGGTT-3' and
continue with the sequences indicated in the table. The primers for GBS1 are thus:
Fwd: GGGGACAAGTTTGTACAAAAAAGCAGGCTCTCAATCTCATATTGTTTCAG
Rev: GGGGACCACTTTGTACAAGAAAGCTGGGTTATTTTTAGACATCATAGACA
The full forward primer sequences are given in the sequence listing as SEQ IDs 10968-11492. The
reverse primer sequences are SEQ IDs 11493-12017.

| GBS | Forward | Reverse |
|---|---|---|
| 69 | TCTAAAGTTTTAGCCTTTGA | AACTCTCTTAATATATTCTTCT |
| 70 | TCTGAAATGGCTTTAG | GTCTTTTTCAATATTCTGT |
| 70d | TCTACTAACTTATTGAGTAGAATCA | GTCTTTTTCAATATTCTGT |
| 71 | TGTAGCTCAAAATCTCAT | CTTCTCCTTAGGAGTAACG |
| 72 | TCTAGTTTATCTATTAAAGATGCC | ATTATTATCAATTAATAACTCTT |
| 73 | TCTATCAAAGAGGCGGTAA | GTCAAACATACTTCCAAA |
| 74 | TCTAAAGAGGATAAAAAGCTAG | TTTCGTCGTATAAGCA |
| 74d | TCTAGTGTTTCAGGTAGTAGTG | TTTCGTCGTATAAGCA |
| 75 | TCTAAAAAATTAAAACACTCAA | TGTCCTCATTTTTTCAG |
| 76 | TCTGATGAAGTTACAACTTCAG | AATACTTGCTGGAACAG |
| 77 | TTATTCCAAAGTAAAATAAA | GTCTTTCTTCAATTTTGG |
| 78 | TCTCATAACCATCACTCAGAACACATGT | GTCGTGATTTTTATGAGT |
| 79 | TCTCCCAAGAATAGGATAAA | CCCAAACTGGCATAAC |
| 79d | TCTAGTCAGTATGAGTCACAGA | CCCAAACTGGCATAAC |
| 80 | TCTGCAGAAGTGTCACAAGA | TGAAGGACGTTTGTTG |
| 81 | TCTTTTGATGGATTTTT | TTTTTTTAGTTTAAGGCTA |
| 82 | TCTACAAATGAAAAACGAAC | GTCCACCTTCCGAT |
| 83 | TCTGAAATTAAACTCAAAAATATT | AACATTGTTTTTCCTTTC |
| 84 | TCTCATACTCAAGAACACAAAA | ATGGTGATGATGACCT |
| 85 | TCTCCTAAGAAGAAATCAGATAC | ATTAACATTTTGAGGGT |
| 86 | TCTGCAGAACTAACTCTTTTAA | TTTTGCAAAATCAACA |
| 87 | TCTGCGGATACATATAATAACTA | GAATAAATAACTGTATTTTT |
| 88 | TCTTACCAAAAAATGACG | ATTTTCATTAATTTCCTCT |
| 89 | TCTGAAGAGCTTACCAAAAC | GATAGCTAATTGGTCTGT |
| 90 | TCTAGATATACAAATGGAAATTT | TAAAAGATGAGCTTCTCG |
| 91 | TCTAAAAAAGGACAAGTAAATG | AATTTCAATATAGCGACG |
| 92 | TCTGATTCTGTCATAAATAAGC | CTTGTTTGTCTTTACCTT |
| 93 | TCTGAATTTTCACGAGAAA | ATTATCCTTCAAAGCTG |
| 94 | TACCAATTAGGTAGCTATAA | TGTGTCATATAATGTAACCA |
| 95 | TCTGTTAATACAAAAACACTTCT | TGATCTTAATTTTCGAG |
| 96 | TCTGGTCAGTCTAAAAATGAAG | CCAAACAGGTTGATCT |
| 97 | TCTAGCCAGGAGGTATATG | ATTTACATCAGACTGTGAC |
| 98 | TCTGAAACTATTAATCCAGAAA | TTTATGGCCAATAACA |
| 99 | TCTACAAGTATGAACCATCAA | TTTTTTAGTAGTTGTCAATT |
| 100 | TCTAAGGGGCCAAAAGTAG | GTAAGCTGAATTTTCGA |
| 101 | TCTATTACTTTAGAAAAATTTATAGA | ACGAGAGTGGTTATTGG |
| 102 | TCTGCCTTTTACTTTGGCA | TTTCTTCACTCTTTCTAGAG |
| 103 | TCTATTTTTTCCTTGATCAT | CGGCCAGTTTTTCTT |
| 104 | TCTGGTGAAACCCAAGATA | AACACCTGGTGGGCGT |
| 105 | TTAACAATTCATGGACC | ACTATTTCTAATTGCTCTG |
| 105d | TTAACAATTCATGGACC | TGGTCCCGGTGCGCCA |
| 105d | TCTCAAGGACCTCCCGGTG | ACTATTTCTAATTGCTCTG |
| 106 | TCTCAAAATCAAAATTCACA | CTTAGCAGATTCATCCC |
| 107 | TCTCTGGAGCCTTTTATTT | TTTACTATTTGAAAATTGG |
| 108 | TCTGGTAATCGTTCAGATAAG | TTTCATAGGAACTTGTATT |
| 109 | TCTATCCAGCAGATCAACT | GTCCACACCTGCGACT |
| 109d | TCTAAACGGGTTCGCTATG | GTCCACACCTGCGACT |
| 110 | TCTGTAAAATTAGTATTCGCAC | TTTACCTAAGTAATATTCTGA |
| 111.19 | TCTGTTAGCGTTGATAAGGC | TCCCCGTCTTTTTTGT |
| 112 | TCTACAATTAAAAATCTCACTG | GTCGTAATCATAAAAGCC |
| 113 | TCTAGTAAAATCAAAATTGTAACG | TTCATAACGAACCATAAC |
| 114 | TCTAATCTTTTAATTATGGGTT | TTTGAGTTCTAGCAACG |
| 115 | TTTCAATACTATTTAAAAGG | TTTTTTATCTTCTTCTTGC |
| 116 | TCTACCGAGGAGCCATTAA | TTTTAAAACCTGGTAAAC |
| 117 | TCTGAACAATCACAAAAAACA | TCAGCTCGTACTCTGTTT |
| 118 | TCTATGGTGACGGTGCTGG | GTCCTCCTCAATTGGT |
| 119 | TCTAGTCAGCCGGTAGGGG | CTCTTTTATACGCGATG |
| 120 | TCTGGTGGAGCATTTGCTA | GTTATTTGCTCGTTGTT |
| 121 | TCTAATAAAGATAATCAAAAAACT | TTTCTCAAATGTTTTCAT |
| 122 | TCTGCTGCCACCAAGAAAG | TTTCAAATGATCTACAGC |
| 123 | TCTACAACAAATGTAATGGC | GGCTAGTGTCTGTCCG |
| 124 | TCAATGAATTTTTCATTT | ACCATCTATTTTTACCCC |
| 125 | TCTACAAAATATCAGCGAATG | AGAACCCGCACTCTCA |
| 126 | TCTACTAAGCAAGCAATGTC | GAACGCAACGGCTGCT |
| 127 | TCTACAAAAGAATATCAAAATTAT | TTTCATATCAAAAACTATCG |
| 128 | TCGACTAATTCGTTAAA | TTCTTTATCTCTTAATGCTT |
| 129 | TTTGAAATAGTATTGGAAA | CACAACAGTTATTTTTCA |
| 130 | TCTATATTTTCTATTTTTATTATGT | AGGCCCTTCTGAGTAG |

TABLE II-continued

PRIMERS USED TO AMPLIFY GBSnnn PROTEINS
Forward primers begin 5'-GGGGACAAGTTTGTACAAAAAAGCAGGC-3' and continue
with the sequences indicated in the table below; reverse primers begin
5'-GGGGACCACTTTGTACAAGAAAGCTGGGTT-3' and
continue with the sequences indicated in the table. The primers for GBS1 are thus:
Fwd: GGGGACAAGTTTGTACAAAAAAGCAGGCTCTCAATCTCATATTGTTTCAG
Rev: GGGGACCACTTTGTACAAGAAAGCTGGGTTATTTTTAGACATCATAGACA
The full forward primer sequences are given in the sequence listing as SEQ IDs 10968-11492. The
reverse primer sequences are SEQ IDs 11493-12017.

| GBS | Forward | Reverse |
|---|---|---|
| 130d | TCTAAAAAACAACTTCACAAC | AGGCCCTTCTGAGTAG |
| 131 | TCTAAAACAGATATTGAAATAGC | AAATAATCCAATGGCTG |
| 132 | TCTATTAAATATTATCATTTGCA | CTTTTCAAGCTTTTTCC |
| 133 | TCTGCTTTACGGAACCTTG | AAAATGATCAGTTTGAGG |
| 134 | TCTACTATTTCTCAACAACAATAC | TTTTTGGCTTAAGAAAG |
| 135 | TCTGAAAAAAAGAGTAGTTCAAC | CTTACGATACATTTTAAATTG |
| 136 | TCTAATCAATTATCAGAAATCA | TTCTTTTTTTACTTTAGCG |
| 137 | TCTCAAGAGTATAAAACAAAAGAG | CCATTGCAATCCAGCA |
| 138 | TCTGCTGTATTTACACTCGTC | ATGTTTATGGCTTGCT |
| 139 | TCTGGCGGCAAGATAAAAT | TTTTTGATAAATCCCC |
| 140 | TCTGATGGGTTAAAGAATAATG | ATATGTGTATTCATCCTTT |
| 141 | TCTGATGTTGTAATTAGTGGAG | TACTTCTATTTTTCCATCTG |
| 142 | TTCGAATTAAGAGAAAGA | GTAATGCAATAAATCAAAA |
| 143 | TCTAGCTTTTTAGTGATTTCA | GGATTTTAGTTTCGCA |
| 144 | TATACGCATAGTGGAAC | CCCATTGATTTCGTCG |
| 145 | TCTGTTATTATCAGGGGCG | TACCTCTTTCAATACCAC |
| 146 | TCTGTTAGTCGTTCTCCGA | ATTACCGTTAGGTACTGTA |
| 147 | TCTGAGGAGCAAGAATTAAA | GGTATGGTTAACAGAATC |
| 148 | TCTATTCTAACAAAAGCAAGT | ATATACCCTAGACTTTTTGA |
| 149 | TCTAGTGGGCGTTCATGGA | AGGAGTTTTATTGATGATAT |
| 150 | TCTGATACCCCTAATCAACTA | AAATGATTGTGGAAAAA |
| 151 | TGCAGGAGCTGTCCGC | ATCAAAGAAGTTGACATTG |
| 151 Long | TCTGTCCGCATTGGTAAAG | ATCAAAGAAGTTGACATTG |
| 152 | TCTAACTGCTTAGAAAATGAA | GTTAGATAAATTAACCAGTG |
| 153 | TCTAACAACTCCAGCA | CCCTTTGCTTCGTTGT |
| 154 | TCTGGAAAGGTCAGTGCAG | TTCCACAAGTCCGATT |
| 155 | TCTATTTTATTTTCAGATGAAC | TTGTTTGATTCGTCCT |
| 156 | TCTGCATCAGATGTTCAGA | ACTACCAAACTGCTGG |
| 157 | TCTAGTGACGTTGACAAATA | TTGTGTATTTTTAGTTAGGT |
| 158 | TCTATGACCATTTACTTCAATA | GTGGATAAAATTCGAAA |
| 159 | TCTCAAACTATTTTGACGC | CAGACTGACTAGGAGCT |
| 160 | TCTGATGAATATCTACGTGTCG | GACTTGTAATTGATTCGC |
| 161 | TCTGATGAGGTGGACTATAACA | GAAGGCACCACCACCT |
| 162 | TCTATTTTCTTGCTCTTAGTTG | GTTGTATAGATGAGTTAATCTG |
| 163 | TCTGAAACTGTCATTCAACTTG | ACGGTTTTTAAAGAATG |
| 164 | TATTTTTTAACAACAAAAAA | TTTTTCTTTATCTTCTGTG |
| 165 | TCTCCAATTTTTATTGGTTT | CGATTTTGTAAGAGCTT |
| 166 | TCTGCATCTTATACCGTGAA | CGACGAAGCTATTTCT |
| 167 | TCTACAATTTATATTGCTTGG | TAAGGCTTGCATTTTG |
| 168 | TCTGTTGGATTGATGTTGG | TTTTCCTAAAAATTTTCC |
| 169 | TGGAAACAAATCACAG | GGCATCTCCTAGCTTT |
| 170 | TCTGCAATAGTTTTTACTTTTTT | TGATAAAGGTAGTTCTACAC |
| 170d | TCTGGTTCTTATCATTTAACAA | TGATAAAGGTAGTTCTACAC |
| 171 | TCTGCTAGACCCAAACAGT | TTTTAGATGTTTTTGTGG |
| 172 | TACACTCATATTGTTGAAAA | ATGATTGATAATTTTAAGC |
| 173 | TCTAATAGTACTGAGACAAGTGC | TGCTTTTTGATATGCC |
| 174 | TCTGCTTATGTCGTCAATTT | TAAAATAAAGTTCAGAAAAG |
| 175 | TCTGAATTACCTTCGTTTATC | TTTCTCCCTTGACTTTC |
| 176 | TCTAAACATCCGATACTTAATG | CTTTTTCTCAGATGCTT |
| 177 | TCTAATTATCCTTTTGCGA | GACATTGAAACGGAAT |
| 178 | TCTGGACTACGCGGAGTAT | TTTTATCAATGATGTTGA |
| 179 | TCTGCTATTGGAGCAGCTG | CATATGACGCAAACGC |
| 180 | TCTGATAAAGAAGGGATAGAGG | AGCCTCTTTTCTTGTT |
| 181 | TCTAAAGAAAAATCACAAACTG | ACGATTATCAACAAAGTT |
| 182 | TCTCAAAATAATAAAAAAGTAAAA | CATTCTTTTAAATACAAATC |
| 182d | TCTCAAAATAATAAAAAAGTAAAA | GGGTTTGAAAGTTTTC |
| 183 | TCAAATGGTCAATCTAGC | TTTAACTTTAATTACTGGAAT |
| 184 | TCTAAGGATTCAAAAATCCC | TTTTTTAATAAGCTTCGA |
| 185 | TCTGGGCAACCATCTACAT | TTTTTTGTAAACTTCCTG |
| 186 | TCTCATTCACAGGATAGCA | CTTAGATACATTGTTTTTTTC |
| 187 | TCTGGACGAGGAGAAGTATC | CTTTCTTTTCTTACTTGC |
| 188 | TCACAATCTTCTCAAAA | TTTATTATTTTTAATACTTGAA |
| 189 | TCTGATAAGTCAGCAAACCC | CTTCAACTGTTGATAGAGC |
| 191 | TCTATCACGACATTACAGACT | TCCTTTAGCAGGAGCT |
| 192 | TCTAGATATTTAACTGCTGGT | GTTATACATGTTGTCTGAAG |
| 193 | TCTATAAAATATCAAGATGATTTT | CCAAATAATAACACGTTT |
| 194 | TTAGAAGTCAGAGAGCAG | GCTATCCCTTTCCAAT |
| 195 | TCTATTATGGAGACGGGTA | TGTATTTTTAATTTGTTTTC |

TABLE II-continued

PRIMERS USED TO AMPLIFY GBSnnn PROTEINS
Forward primers begin 5'-GGGGACAAGTTTGTACAAAAAAGCAGGC-3' and continue
with the sequences indicated in the table below; reverse primers begin
5'-GGGGACCACTTTGTACAAGAAAGCTGGGTT-3' and
continue with the sequences indicated in the table. The primers for GBS1 are thus:
Fwd: GGGGACAAGTTTGTACAAAAAAGCAGGCTCTCAATCTCATATTGTTTCAG
Rev: GGGGACCACTTTGTACAAGAAAGCTGGGTTATTTTTAGACATCATAGACA
The full forward primer sequences are given in the sequence listing as SEQ IDs 10968-11492. The
reverse primer sequences are SEQ IDs 11493-12017.

| GBS | Forward | Reverse |
| --- | --- | --- |
| 195L | TCTTTGAATAATAAAGGTGTCG | TGTATTTTTAATTTGTTTTC |
| 195LN | TCTTTGAATAATAAAGGTGTCG | CAAACTTTTAACATTTAATG |
| 196 | TCTATTTCCTCAAATTTTTACG | ATAGTGTAAGCTACCAGC |
| 197 | TCTAATTTTTATAAGCTCTTG | GTCATCATATTCCTGAAA |
| 198 | TCTGCGCTTAAAGAATTAA | TGTTCGGCGTAAGATT |
| 199 | TTTTTAAAAGAAATTGAAA | ATTGGTCATTTCTTGAG |
| 200 | TTTCGTAAATATAATTTTGA | AACAGATTTATTGGTTGG |
| 201 | TCTAGCGATACCTTTAATTTT | AGACTCATCAACTTTTTCT |
| 202 | TCTATGCTGATTAAGTCGC | GAACCCTGAAGGGTAG |
| 203 | TGTGGTAAAACTGGACT | CCAATTGTATTTTTCAAC |
| 204 | TCTAAGACAGGAGCACCCGT | ATTTATACTACCTGTTGAATC |
| 205 | TGCGAGTCAATTGAGC | TTTAAATTTGTAGTCTTTAATA |
| 206 | TCTACAAATACTTTGAAAAAAGA | CTCTTTTACTTTTCCAAAA |
| 207 | TCTAATTTATTTAAACGTTCCT | CCCTCCCTTAAGAGAA |
| 208 | TCTAAAAAGCGGCTAGTCA | TTGACGATGTTGCATC |
| 209 | TCTGGACAAAAATCAAAAATA | TTTCGAATTATTGTGACT |
| 209d | TCTGGACAAAAATCAAAAATA | GTATTGTTGTTGCCTG |
| 210 | TCTGGAGGAAAATTTCAGAA | TTTTTGATTTCCCTTTC |
| 210d | TCTACCTCATATCCTTTTATTT | TTTATAGTGTGTTTGCAA |
| 211 | TGTGGACATCGTGGTG | TTTGCTAGGAACTTTGA |
| 212 | TCTAAGACTAAAAAAATCATCA | TGATTCAATTCCTTTTC |
| 213 | TCTAAACACACCAGTAAAGAA | TTTTTCCTCTACTTTCTTA |
| 214 | TCTAAAAATAAAAAAATCTTATTT | TTTGCTCACCTCCACA |
| 215 | TTAATAAAAGGATTATTGTCA | CAATAACTTCTGTAAAATAAA |
| 216 | TCTGCTCGTTTAATACCACA | TTCACCCTTAAAATAATT |
| 217 | TCTAACACTAACATCCCTAGC | TGCATTTTTCCCTTCT |
| 218 | TCTAGAGGGAAGGTTATTTAC | CTCCAGTAAAGTATTAGTATTT |
| 219 | TCTATCAATAAAGTAACAGCTCA | GTGAGGTTTTGGTAATT |
| 220 | TCTAGAACACTATTTAGAATGATAT | TGCATATAAGTTTTTTAGC |
| 220d | TACTATGCGAATCACAG | TGCATATAAGTTTTTTAGC |
| 221 | TCTAGTTTAGCATTGCAAAT | CTCATCTAAAGTGCTATCC |
| 222 | TCTACATTTTATAAAAAGACGG | CTCGTATTTAGGCAACT |
| 223 | TCTAAGAAAATACGAAGCTATAC | ATTGGATATGCCATAAA |
| 224 | TCTGGAGGAAATGAAATATTA | GACTTTTTGATGTTTACTTT |
| 225 | TCTGGTATGTCTAATAAGGAAAT | TTCTTTACTATAAACATCTTCA |
| 226 | TCTAACAAACTTATTACAGAAAA | AGCATTTAAAGTTGAATGT |
| 227 | TCTGTTTCATATGAAAAAGTCC | GTTAGTCTCTTCAAGATCA |
| 228 | TCTAGTAGAGGTATTTTTTTACAA | AAGACCTACCGCCCAA |
| 229 | TCTGAACGTCGGGTAAGTC | TACTTCTTTCTCTTTCAATT |
| 230 | TTTTTAATCGATTTTATTT | CTTAGTGTTCCGATATGA |
| 231 | TCATTAATTATTCTTACGGT | TCTTGTTTTAAGAGCAGA |
| 231d | TCTTTATACGTTGTTAAACA | TCTTGTTTTAAGAGCAGA |
| 232 | TGGCTAAGTAAGCATGAG | ATCATGTTTTCCCTCAA |
| 233 | TTCCCAGCTAGCTGTC | ATCTGATATATCCGTTTTAT |
| 234 | TCTATAGAAATTGCTGTATTAATT | TTTTTTGTCTCCTTTTTA |
| 235 | TCTATTCGATTTCTTATTCTTG | AAAGACACGATAAACATAAG |
| 235d | TCTGACTCAACCACAGTCTC | AAAGACACGATAAACATAAG |
| 236 | TCTGCAGACCTTACAAGTCA | ATTTGCAACTTCTTGTATA |
| 237 | TCTATTGTATTTGCTATTGCA | TTTAAAAGTATCCTTAAATAAG |
| 238 | TCTGATATTTTTTCAGCTATTGA | CTTCCTCCTCAATAGTTG |
| 239 | TCTGTTAGTGCTGCTATTGAA | TTCTCCTCCCCCATTA |
| 240 | TCTAAGAAGCTTACTTTTATTTG | ATCCAAACGAGTGAAAT |
| 241 | TCAAAAGGATATTCAAGA | AGGTGTTGTTGTATTTTC |
| 242 | TCTCATAATATATTAAGATTTTTAGG | CTTTCTAAGTTTATTAAACATA |
| 243 | TCTATTCTTGGTCAAGATGT | GGCATCTGTTACCTTG |
| 244 | TCTCATGAAAATGTTAAAAAAG | AAACAACTCCATTATTTTT |
| 245 | TCTAAGTCAACGGTAACAAA | TAAACGTTGAAGAGCAT |
| 246 | AGGAAACGTTTTTCCT | CTTATCATATCTTGTTAAATCA |
| 246d | TCTAACCATAAGGGAAAAGTA | CTTATCATATCTTGTTAAATCA |
| 247 | TCTGGTAAACAATTAATTGGT | TTGCCATGGGTTATAG |
| 248 | TCTTTGATGGTGTTGTTATTC | AGAATTAAAATTTTCATGC |
| 248d | TCTAAAACTTATTTGTCAAATG | AGAATTAAAATTTTCATGC |
| 249 | TGGGCTTACCATACTG | TTTTTTAGATGTTTTATGTG |
| 250 | TCTGGCCTTAATCTTAAGC | CTCTTTTACTTTAGCTTCA |
| 251 | TCTCAATATTTTTGAAACAAG | TTTCAAACTCCAGCCA |
| 252 | TTTATTTCAGGTTATATCAA | GGAGTGCCTTTCTACT |
| 253 | TCTGAAAATTGGAAGTTTGC | TTCATATCGTAAAGCATC |
| 254 | TCTATTGAAAAGGGAGTTG | ATCGTCAACCTTAACG |

TABLE II-continued

PRIMERS USED TO AMPLIFY GBSnnn PROTEINS
Forward primers begin 5'-GGGGACAAGTTTGTACAAAAAAGCAGGC-3' and continue
with the sequences indicated in the table below; reverse primers begin
5'-GGGGACCACTTTGTACAAGAAAGCTGGGTT-3' and
continue with the sequences indicated in the table. The primers for GBS1 are thus:
Fwd: GGGGACAAGTTTGTACAAAAAAGCAGGCTCTCAATCTCATATTGTTTCAG
Rev: GGGGACCACTTTGTACAAGAAAGCTGGGTTATTTTTAGACATCATAGACA
The full forward primer sequences are given in the sequence listing as SEQ IDs 10968-11492. The
reverse primer sequences are SEQ IDs 11493-12017.

| GBS | Forward | Reverse |
| --- | --- | --- |
| 255 | TCTATTGTTGGTAGAGAAATCA | TTTTACTTGACGTCTCAC |
| 256 | TATCATGTAAAAATTGATCA | GTCTTCCATTAATATTCCC |
| 257 | TCTGATTTTTTATACAAAGGAGG | CCAATTATTTTGAAAGTTC |
| 258 | TCTGAACGTTATACAGATAAAATG | ATTTTTTTGAATAATATAATCC |
| 259 | TCTCTTTCTCGTAAAAAAGAG | TTTATTATCAGAAAAGGC |
| 260 | TCTACTCTTGTCTTAGTTGTTTAT | ATTCAAAAAATTTTTCAA |
| 261 | TCTATAAAGAAAGCTGAAAATC | CGAAACGTCAGGTAAA |
| 262 | TCTATAAAAAATGCTATAGCATA | ACTTATTTTTGATAATATTTCTT |
| 263 | TCTCAGCCTTCTAAACTACTTC | ATCAGCATTTCTACGAA |
| 264 | TCTGATTTGTTTAGCATGTTG | ATGTAGACTCCTAATGATTT |
| 265 | TCTCTTGCTTCCCTGATTT | TTTACTGTTCCTTTCGC |
| 266 | TCTCATCAATCAAATCATTATC | GAGATTAATTTGATTATATTTT |
| 267 | TCTATCTTTATTATCGGACAA | AACATCATTTCCTCCC |
| 268 | TCTAAAGAATTTATTAAAGAATGG | GTTGATAGTTCCAAAACG |
| 269 | TCTGCAGATGATGGTGGTT | TAAATGTGTTCCTACTAAATT |
| 270 | TTAAATGATGCAATAACAA | CATCAATAGCCGAGCTG |
| 271 | TTGCTGGATTATCCTC | TTTATTTTCCAAATGACA |
| 272 | TCTGTATTTATGGCAAATAAGA | TTCACTCGGAGTTGGAG |
| 272d | TCTATGAGTTCTCTGGAAGTT | TTCACTCGGAGTTGGAG |
| 273 | TCTGGTGTCCTCAACTCTG | AATGTAAATGACAAAGGTA |
| 274 | TCTGTTCATGATTTTGGTGA | GTTTTTTAATGGTTTGC |
| 275 | TCTGGGGTTTGGTTTTATA | TTTATCATAAGCATCTAGAC |
| 276 | TCTCAATCAGACATTAAAGCA | CTGATCTCTTGTTGATGC |
| 277 | TCTATTTGGAGGGGGGAAA | AAGCAGGGGAGCAATA |
| 277d | TCTACCAAATTTGACTGGG | AAGCAGGGGAGCAATA |
| 278 | TCTGTTACGTTTTTCTTAT | CTGAGCAACACCTGTC |
| 279 | TCTAAAAAGAAAAGTTTAATTAGC | GGCAATTTTGTGGCAA |
| 280 | TTTGATTTTTTAAGAAAA | TTGCTTAGTTAATGGCT |
| 281 | TCTAAGAAATTAATTATAGGTATTT | AGGCGTTGAATATAATTC |
| 281d | TCTGGTTTTCGTTTTTGA | AGGCGTTGAATATAATTC |
| 282 | TCTCTATTCTCAGATGAAACAA | CTTTTCAACTCCAAACA |
| 283 | TCTGTTAAATTAAAATCGTTACTG | GAGTTGTCTTTTTTTGTC |
| 284 | TCTATGCAACGATTAGGAC | GCAATCACAATTGACAT |
| 285 | TTAGGTGAAAGCAAATC | CTTTGTCTGCTTCACTT |
| 286 | TCTGGAGGATTTTATATGAAAG | TTGTATCTTCTCCTGACC |
| 287 | TCTGCACACACACCTACTAGT | TTGGTTAATCGTCTTG |
| 287d | TCTAACAATCGTTCAAAGC | TTGGTTAATCGTCTTG |
| 288 | TCTAAAAAGTTTTAAAAGTTTT | TTTAGTTACTTTCATAAATGG |
| 288d | TGGAATAATCATCAGTCA | TTTAGTTACTTTCATAAATGG |
| 289 | TCTCAATCTAAAGGGCAAA | ATATAATTCCTCTAAAACTAGC |
| 289L | TCTCAATCTAAAGGGCAAA | CCACTTCAAATTAACTAAC |
| 290 | TATTACTTATCAAAAGAAAAGG | ATTCCTTGAACACGAA |
| 291 | TCTCAAGTATTAAATGACAATGG | GTGCCATTCATTCTCT |
| 292 | TTGAATCGTAAAAAAGG | TTGTCCTGTGAACTGTG |
| 293 | TCTATGGGTCTAGCAACAA | AGGGTTTATTTGTTGAAG |
| 293d N-term | TCTATGGGTCTAGCAACAA | TCCTGATTTATCCACTG |
| 293d C-term | TCTGTTACAGCTAAACACGG | AGGGTTTATTTGTTGAAG |
| 294 | TCTGGTCATTTTAGTGAAAAA | CAAAATACCTAAGCTAGC |
| 295 | TCTAGCGACATAAAAATCAT | ACGAACTTCCATAACC |
| 296 | TCTAAAGGTATTATTTTAGCG | GGCTTCTCCAATCAAA |
| 297 | TCTATTCAGATTGGCAAATT | TTGAGTTAATGGATTGTT |
| 298 | TCTACTAAATTTATTGTTGATTCA | TAGCGTTATTTCACTGTG |
| 299 | TTTGAAATACTTAAACCTG | TTTCTCCGCCCAGTCA |
| 300 | TCTGCTTCTACAAATAATGTTTC | CCGTTATTCTTTCTACTG |
| 301 | TCTGTAATTAATATTGAGCAAGC | CATATCTGTTGCATCAAT |
| 302 | TCTGAAATCAACACTGAAATAG | AACTGGCTTTTTAGTCAG |
| 303 | TCTACAAGGCATATAAAAATTTC | TTTATTATTTAATTCTTCAATA |
| 304 | TCTAACGAAATCAAATGCCC | GTCTTTTAGAGCATCGA |
| 305 | TCTGGACGAGTAATGAAAACA | CTCTCCTCTAAGACTTTCG |
| 306 | TCTGGGAAAAAAATTGTTTT | TCCTTTTGTTACTTTTGC |
| 307 | TCTAAATTTACAGAACTTAACTTAT | TTTATCGCCTTTGTTG |
| 308 | ATGACACAGATGAATTTA | ATGTTCAGGTTCTCCG |
| 309 | TTGCAACTTGGAATTG | TTCCATTATCTTCAAGTTA |
| 310 | TCTGCTAAAGAGAGGGTAGAT | CTCTTCTTCATTTTTCTTA |
| 311 | TCAATTATTACTGATGTTTAC | TTTTTTTAAGTTGTAGAATG |
| 312 | TCTACTGCAACTAAACAACAT | GTTTTTTGATGCTTCTTG |
| 313 | TCTAAACGTATTGCTGTTTTA | TTTACTACTTTGGTTGGC |
| 314 | TCTAAATTTTATCTTGTTAGACAC | GTGTGTCATTTTGACCT |

TABLE II-continued

PRIMERS USED TO AMPLIFY GBSnnn PROTEINS
Forward primers begin 5'-GGGGACAAGTTTGTACAAAAAAGCAGGC-3' and continue
with the sequences indicated in the table below; reverse primers begin
5'-GGGGACCACTTTGTACAAGAAAGCTGGGTT-3' and
continue with the sequences indicated in the table. The primers for GBS1 are thus:
Fwd: GGGGACAAGTTTGTACAAAAAAGCAGGCTCTCAATCTCATATTGTTTCAG
Rev: GGGGACCACTTTGTACAAGAAAGCTGGGTTATTTTTAGACATCATAGACA
The full forward primer sequences are given in the sequence listing as SEQ IDs 10968-11492. The
reverse primer sequences are SEQ IDs 11493-12017.

| GBS | Forward | Reverse |
|---|---|---|
| 315 | TCTATAGGGGATTATTCAGTAA | TCCTTCAAGATCATTTAA |
| 316 | TCTACTGAACGAACATTCGA | ACCTCCTTTTCTTTCATT |
| 317 | TCTAATAAGCCATATTCAATAG | ATCTTCTCCTAACTTACCC |
| 317d N-term | TCTAATAAGCCATATTCAATAG | ACTAGCTAGATTCTTAACGC |
| 317d C-term | TCTGACTTGAATGGCAATAT | ATCTTCTCCTAACTTACCC |
| 318 | TCTATTGATTTTATTATTTCTATTG | GCCTCTTTCTCCAAAT |
| 319 | TTAAAACATTTTGGTAGTAA | ATGTCCTGTTATATCTTCTT |
| 320 | TCTACTATTTATGACCAAATTG | GCGTTGAATAATGGTT |
| 321 | TCTAAAAATAAAAAAGATCAGTT | TATTTCTTTAGTTTCTTCAA |
| 322 | TCTCAAGAAACAGATACGACG | TAATAAAAATTATATAAGAACCT |
| 323 | TCTGGTAATGAGTCAAAGAAC | TTCTGTCTTATAAGCATAAG |
| 324 | TCTGGAAGTAAATCAGCTTC | TTTTTTATAAGCATGTGTA |
| 325 | TCTGCTTGGCAACTTGTTC | ATGAGACATAAGGTCTTG |
| 326 | TCTGGCATCTCAGACTTACC | GTTGGAGCTCCTACTG |
| 326L | TCTAAATTCAAATCTGGGG | GTTGGAGCTCCTACTG |
| 326L N-term | TCTAAATTCAAATCTGGGG | CATTTCTTTGGTTAAAGC |
| 327 | TCTGGAGGGAAAATGAATC | TATCTCGAGTGCTATTTG |
| 327d N-term | TCTGGAGGGAAAATGAATC | CTCTTCATCGACATAGTAA |
| 327d C-term | TCTGGCAACTTCAAAGCAT | TATCTCGAGTGCTATTTG |
| 328 | TCTGACCAAGTCGGTGTCC | ATTTTACAGTAGTGGAGTTT |
| 329 | TCTAAATCAAAGACCTCTTCTA | TGTCCTCATTTTTTCA |
| 330 | TCTAATAAACGCGTAAAAATC | TTTAACAGTACGAACACG |
| 331 | TCTACCAGAACAGTAGCAAT | CCCCCTGTTTTTAAAAT |
| 332 | TCTACAAAAAACCTGTTATTAA | ACCCTCATATGATTCC |
| 333 | TCTATTGATATACAAAAAATAAAA | TTTAAAATAATGATACATCTC |
| 333d | TCTGGATCATTGAGGGCAA | TTTAAAATAATGATACATCTC |
| 334 | TCTAATTTAGTAAAAGTGAATAGTG | TAACCCCGTCTCAACA |
| 335 | TCTGAAGAAGAAAAATATTTTGA | TATTTTCGTTTTCTCAAA |
| 336 | TCTCAGGTTGAAGTTGACTTA | TTTCTCCAAATAATCTCTC |
| 337 | TCTGAAACAGATTCGTTTGTA | CCTACTTTTAGTTTTAGAAGA |
| 338 | TCTGCTATAATAGACAAAAAG | GAAATCATAGCTTCCC |
| 339 | TCGAAACCGATTAAGAT | ACCTTTTACTTTTGGTAGT |
| 339d | TCTCAAGTCATGCGCTATG | ACCTTTTACTTTTGGTAGT |
| 340 | TCTGGATTTCTCTATAATTACTTC | TTGTTTGTGAAGTAAAACG |
| 341 | TCTGGAAAACCATTGTTAAC | TAATTTAAAAATTGCATAAA |
| 342 | TCTCAGAAAATTGAAGGTATT | TTTCGTTACCATATCTAGA |
| 343 | TCTGAAATGCAAGTTCAAA | TAAATCATGGAAACTAGC |
| 344 | TCTGCACAACGCAGAATGT | AAAGCCCAACCTTCCG |
| 345 | TCTAAAAACCTGAATTGGG | GTTTCCACGTCCTTTC |
| 346 | TCTAATAAAATAGCTAATACAGAAG | AAGTTTATTCAAATCTGG |
| 347 | TCTATTGATATTCATTCTCATATC | AATGTAATGGTTTTTTAATA |
| 348 | TCTACTGGATCTAAAAAATTAGC | AGCTAAAATACCTAACCAG |
| 349 | TCTAAAGATCGCTTATATAATAAA | ATTTTTTAAACGACTCAT |
| 350 | TCTGCAAAAGATATAATTAAGGTT | AGCGGAACGGTGAATA |
| 351 | TCAGAAGATCAAAAACA | ATAATCTAAACTATCAGCTCT |
| 352 | TCTACTTTTTTTAAAAAGCTAAA | ATCTCCTATTGTAATTTTGA |
| 352d | TCTGGTACAGATAGTAAATTTGG | ATCTCCTATTGTAATTTTGA |
| 353 | TCTACAATGTTAAAAATTGAAA | CACCTCTTTTGTCAGA |
| 354 | TCTATTAAAGAACTAAAAGAATTT | TTTGTTAGCGAGTAAGTC |
| 355 | TCTCGCTCACTACCTT | TTTATCATCCTCCTTAATAA |
| 356 | TCTAAATTCTATATTATTGATG | ATGAAACGTTTTACTCTGTAAAA |
| 357 | TTGGAACATTTTTATATTAT | AAATAAGAATGTTAAAAGAGC |
| 358 | TTTTATACAATTGAAGAGC | TTCCCCAAAAATTTCT |
| 359 | TCAAGAAATAATTACGGT | ACGCAGTCCCATTTTC |
| 360 | TCTATAATGAAGGCGGTCT | CTGGCATGAGGTCTCA |
| 361 | TCTAGCGTATATGTTAGTGGA | CCTTTTTTCAATAATAGC |
| 362 | TCTACTAAACCACAGGGGG | ATCTTTAATCTTACCATCC |
| 362d N-term | TCTACTAAACCACAGGGGG | TGCTGCTACTGCAATG |
| 362 C-term | TCTGGTAATGAAGGAAATATCAC | ATCTTTAATCTTACCATCC |
| 363 | TCTCTCGAATTAAAAAATATTG | TAAATTCCTTTGTTGTAATA |
| 364 | TCTAACTATATGGGTATGGGC | ACCATCAGTTGTCACC |
| 365 | TCTGGAACTGCTACATATAGTAGG | TATTGACCAGTGCACG |
| 366 | TGGCTTGACATTATTTT | TTTTTTTGAATTTGTAAAAG |
| 367 | TCTAAGAAATTAAAAATATTCCC | AGAGATTATTTTTATTTTAAAT |
| 368 | TCTAAAATCATTATTCAACGT | TTTATTTTTAGTATCTAAAACG |
| 369 | TCTAGTAGAATGATTCCAGG | TTTAGAAACTCCAAGTATCTC |
| 370 | TCTACCGAATTTAATGACG | GTTAATTTGACTATTGATATATT |
| 371 | TCTAAAGATAGATATATTTTAGCAG | TAAACTCTCAAAAGCTAAAC |

TABLE II-continued

PRIMERS USED TO AMPLIFY GBSnnn PROTEINS
Forward primers begin 5'-GGGGACAAGTTTGTACAAAAAAGCAGGC-3' and continue
with the sequences indicated in the table below; reverse primers begin
5'-GGGGACCACTTTGTACAAGAAAGCTGGGTT-3' and
continue with the sequences indicated in the table. The primers for GBS1 are thus:
Fwd: GGGGACAAGTTTGTACAAAAAAGCAGGCTCTCAATCTCATATTGTTTCAG
Rev: GGGGACCACTTTGTACAAGAAAGCTGGGTTATTTTTAGACATCATAGACA
The full forward primer sequences are given in the sequence listing as SEQ IDs 10968-11492. The
reverse primer sequences are SEQ IDs 11493-12017.

| GBS | Forward | Reverse |
|---|---|---|
| 372 | TCAGAAAAATATTCCACT | ACGTTCTTCTCTGGCT |
| 373 | TCTGAAATTGGTCAGCAAA | ACTTAAATGGAACAACC |
| 374 | TCTAAGTTCGAAAATATAATATATG | TTTGCCTAAAAAATTAGG |
| 375 | TCTGAAAAAGAAACTATTTTAAGT | GGCTTTCCTCCCTTCA |
| 376 | TCTAAAGAAAAGAAAAATTTGG | TTCATCTTTTTCAATATCA |
| 377 | TCTGGTAATAAACTGATGTATCA | GTGAGAGTGTCTTTGTTT |
| 378 | TCTGAAGATCAACTCACTATATTT | CAGATTTTTAGCTACTTGTC |
| 379 | TCTCAAATTACCCGAGAAG | TCTAGAGCGCTTTATAAG |
| 380 | TCTCTTAAAAGATTACTTACTGAAG | TTTTCTAATAGTTAGAAGCC |
| 381 | TCTCTTGGGATAGCTCACA | TTTTAAATGTGCAGAGA |
| 382 | TCTATAAAGTTTAAATTATTTTTAA | ATTTATAATTTCCTTGGG |
| 383 | TCTATTTTACAGACGAATATACTAT | TCTATAATATCTCTCTAAAGTGA |
| 384 | TCTAGAATAATTGTTGTCGG | CCTCGCTAACATATCAC |
| 385 | TCTAATGTAAAAAAACGC | AGCTCTTACAGTCTTGC |
| 386 | TCTCTAGTATCAAAGGAGAAAGC | TTGTCTGAGTGACCAA |
| 387 | TCTGGTATGTTGTTAGCA | ATAATATGAAATATGTTGTTCA |
| 388 | TCTCTTATGATAATAAATTCATTCG | TCCGCAGAGTAAAAAA |
| 389 | TCTATGAATAGTGAACATAAAATT | TTCATAAATGTGCCAA |
| 390 | TCTAGGGAAACTTACTGGA | TTCATCTCTGCTCACC |
| 391 | TCTAAAAAAGTCATCGATTTAA | TTCTCCTTCAGCTTTTA |
| 392 | TCTATTACATATGATTTCACAAG | GTCATTTTTTCTAAAGTTTG |
| 393 | TCTAATAAATCTTGGTTGAGAA | TTTTTGTAGTTGTTTCAAT |
| 394 | TCTCCTATGTTGTCTGTTGG | TTTCATTAGATAACTATTCAGC |
| 395 | TCTACTTATCAAAAAACAGTTG | TATAGACTGAAGATAATTAATTAA |
| 396 | TTTGTCAAAGGGATTT | AAATCGATTAATCAAGTC |
| 397 | TCTAAATTATTTGATAAGTTTATAGA | TCTAAAGTAGTCCTTTAGACTA |
| 397d | TCTAAAACTGCTACAGTTAG | TCTAAAGTAGTCCTTTAGACTA |
| 398 | TATTTAGAACAATTAAAAGAGG | TTTGTCCATAATCATTTC |
| 399 | TCTAAAGTTTTAGTAGTTGATGAT | GGTAGATATGCCTAACATT |
| 400 | TCTAAAATAGTTGAAGGCG | GTTTCCTTCCAAAAAAA |
| 401 | TCTGGAATTGAATTTAAAAATG | TCCATGCTTAATAGCC |
| 402 | TCTGGAAAATATTTTGGTACAG | ATCTAAACCAATTTCTGTAC |
| 403 | TCTGAGGTTAGAATGGTAACTC | GTCCACAAAAACGTCT |
| 404 | TCTAAAATAGATGACCTAAGAAA | TAGATGTTCTACGGAGAA |
| 405 | TTGAAAATTCAGTATTATCA | AAAGATGGCAAGCCAT |
| 406 | TCTGATAAAAATAATTTAGAAGACT | TCTCTCTCCACACCATA |
| 407 | TCTAAAATTGACATGAGGAA | CTTACCTCCTGTGGCT |
| 407d | TCTAAAATTGACATGAGGAA | CTTTTGTTGGTTACCTC |
| 408 | TCTAACCACTTACTTAACCTCA | TATTGTTAAATATGATGAAATG |
| 409 | TCTAAGGTAGTAGTAGCTATTGAT | ATGATTATACAAATTGATTAAT |
| 409d | TCTACTGAAGAGAGAAATCCT | ATGATTATACAAATTGATTAAT |
| 410 | TCTGCTTTATTATCAGTTATTGTC | TCCCTCTTCCTTGACA |
| 411 | TCTAAAGACTATATTAACAGAATATT | AACGTTTTTGAGCTTT |
| 412 | TCTGGATTTTTTGCACAGC | TTTTGTCTTAAACGTTCT |
| 413 | TCTATTGTTGGTGAACAAGA | TTTAGATAGTCTAGCCATTT |
| 414 | TTAAATCAATATTTTCTGC | ACGGCTTGGGGCAGAG |
| 415 | TCTGAGCGAATTCCTGTTC | TACCATTATCCGTGCT |
| 416 | TCTGAAGTCATTCGTGAACA | ACTATTAAACTCCAATGTTA |
| 417 | TCAAAACAATATGATTATATC | GCGCATTGTAACAAAT |
| 418 | TCTAGCAAGCCTAATGTTG | TTTTGGTAAAAGGTCTG |
| 419 | TCTGATTTAAATAATTACATCGC | TCCTGGAAAGTTCATC |
| 420 | TCTAAACGTGAATTACTACTCG | TAGTTTATCTAAAGCGTTC |
| 421 | TCTATACGCCAGTTTTTAAG | TTTATGTATAGAAACAGCAG |
| 422 | TTTTCGAGCGATTTTG | AATGTACATAACAATAGAGAGC |
| 423 | TCTGTAACCAAAGTTGAAGAG | CAACGATCCCAAGAAC |
| 424 | TCTATGAAAGATTTTATTGAATG | GCCATTCTTACCTCCT |
| 424d | TCTATGAAAGATTTTATTGAATG | ACGTTTTTCTGACCG |
| 425 | TCTATAGCCTTTAATAGTTTATTT | TATAAAATAAATTTGAAGATCT |
| 426 | TCTD440ACAGTTTATAATATAAACCATG | ATCATCTTGTACCAACTC |
| 427 | TATTCTTTTGAAGAACTTTT | GCCAATAAATTCACGG |
| 428 | TCTATAAAAATTTTGATCCC | AGTCTGTTTTTAACAAAAG |
| 429 | TCTAATCATTCCATTGAATC | TGGTTTTAGAACAACTTTA |
| 430 | TTACAAAAAAAATATCGG | AATTAAGCTGAAAATGAC |
| 431 | TCTGCGGCTCAATTAGCTG | ATTATATTCTTTTAATTTGTCA |
| 432 | TCTCGTACCTTCAAACCAG | CTTACGACGTCCTGGA |
| 433 | TCTATTAAAGCAACTTTTACTC | GTGTGTCATGACTACTGTAC |
| 434 | TCAATTTTTCAGACAACA | TGAGTAGAGCACAAGC |
| 642 | TCTAGAAAACGTAATGATACATT | GAAACGAATACGTTCTT |

TABLE II-continued

PRIMERS USED TO AMPLIFY GBSnnn PROTEINS
Forward primers begin 5'-GGGGACAAGTTTGTACAAAAAAGCAGGC-3' and continue
with the sequences indicated in the table below; reverse primers begin
5'-GGGGACCACTTTGTACAAGAAAGCTGGGTT-3' and
continue with the sequences indicated in the table. The primers for GBS1 are thus:
Fwd: GGGGACAAGTTTGTACAAAAAAGCAGGCTCTCAATCTCATATTGTTTCAG
Rev: GGGGACCACTTTGTACAAGAAAGCTGGGTTATTTTTAGACATCATAGACA
The full forward primer sequences are given in the sequence listing as SEQ IDs 10968-11492. The
reverse primer sequences are SEQ IDs 11493-12017.

| GBS | Forward | Reverse |
|---|---|---|
| 643 | TCTGATTGTCAAATTACACCA | ACTACCTACCGTTTTCAC |
| 644 | TCTATTTTTCGTGGTGATAA | TTTGATGGTAACAGTCG |
| 645 | TTTTTTAATATTGAATATCAC | AGAAAGGCGCTCTTCT |
| 646 | TCTAAGGGAGTCCAATATATG | TATCTTTAATAAAGCCCTA |
| 647 | TCTCGTCGCATGAATACCA | CATCCCATAAATTTGTT |
| 648 | TCTATAGAATTTTCAGGGC | CAAGACATTTCTTAAAGC |
| 649 | TCTGCTACTCACTCTAACTCAG | TTTTGTTTTAGCGATG |
| 650 | TGCTCTTCTTCAAATACT | TTTTAAACCATGCTGT |
| 651 | TCTCTAACACCATTTACAAAAG | TTTGTAAAGACCTTCTTT |
| 652 | TCTCAACAAGGTATTATGGATA | TTCCTCGTTTATTAATTT |
| 653 | TCTAAAATTTTAGGTACACCA | AAAGAAAAGATGTGCC |
| 654 | TCTGGAAAAATGGTTAAGAA | CTGTGCAGGCTCAAAT |
| 655 | TCTAAATTCGTCCGAACCGT | AATTGTCCAGTCTAAGTTA |
| 656 | TCTGGTCTTCCAACGCAGC | ATTTAGTGTTATTTCTCCTG |
| 657 | TGCTCAGGTAAAACAT | TTTTTTAAGTGATGATGAA |
| 658 | TCTGAAAGCAAATCTTTGC | CTTTGTCTGCTTCACTT |
| 659 | TGTGCTAATTGGATTG | TTTTGGGGTTACTTTAC |
| 660 | TGTGGAAATGTCGGAG | TTTTGCTGAAATAATGTT |
| 661 | TGTCAGTCAAACCACA | ATCATACGAATGCAAC |
| 662 | TCTGCTAGTTTTTATTTTTTCC | TTTTTCATATTTTTTCAAA |
| 663 | TGTGGAAGTAAATCAGC | ATTATTTTTATAAGCATGTG |
| 664 | TCTGTTAAATTAAAATCGTTACTG | GAGTTGTCTTTTTTTGTC |
| 665 | TCTATTGCTGGTCCTAGTG | GATAAGCACTTTCCTTAA |
| 666 | TTATTTTTTGGAAATTGG | GCCTAAAAACCAATCA |
| 667 | TCTGCTGTATTTACACTCGTC | ATGTTTATGGCTTGCT |
| 668 | TTTTATATGAAAGAACAACA | TTGTATCTTCTCCTGACC |
| 669 | TCAATTATTATTGGGTTAA | ATATACCCTAGACTTTTTGA |
| 670 | TCTCCTAAATTAACCCTAGTCT | GGCTTTAAAGTTCGATA |
| 671 | TCTAGTCTTGCGAAGGCAG | TTTATCGTAAGCACTTAGG |
| 672 | TCTGTATTTACACTCGTCTTACA | ATGTTTATGGCTTGCTT |
| 673 | TCTGGAGGATTTTATATGAAAG | TTGTATCTTCTCCTGACC |
| 674 | TCTGTTAAATTAAAATCGTTACTG | GAGTTGTCTTTTTTTGTCT |
| 675 | TCTGGTTCATCAGACAAACA | TTCAACTTGATTGCCA |
| 676 | TCTGTAGTTAAAGTTGGTATTAACG | TTTTGCAATTTTTGC |
| 677 | TCTGTATTAGAAGTACATGCTGA | TTTTAATGCTGTTTGAA |
| 678 | TCTGAGACACCAGTAATGGC | TTTTTTAGCTAAGGCTG |
| 679 | TCTGCTAACAAGCAGGATC | TTTTGCTAAACCTTCTG |
| 680 | TCTAATAAGTCCAGTAACTCTAAG | ATTCATATTAACACGATGC |
| 681 | TCTGCTTTTGATGTAATTATGC | TTTGCGTTTTGGAGGG |
| 682 | TCTATTAACTATGAGGTTAAAGC | TGCACCTTGATGGCGA |
| 683 | TCTGTAATTGTTGAACTTAGTTTG | CCATAATATTTGATGCTG |
| 684 | TCTCTTAGGAAGTATAAGCAAA | TTCTAATCCTACAGCATG |
| 685 | TCTAAAATTTGTCTGGTTGG | AAAAATTCCTCCTAAATTAA |
| 686 | TCTGACTTTTATGATATCAATCTT | AAAGTTTTGACTATTACTGATAG |
| 687 | TATGCTATTATGCAAAAAG | TGGGGGAGATAGTTATG |
| 688 | TCTGCAATCGTTTCAGCAG | TTGACAGAAAGCTAATTG |

TABLE III

RESULTS FOR in vivo GBS CHALLENGE

| GBS # | % survival Pre-immune | % survival Post-immune |
|---|---|---|
| 1 | 18.7 | 22.2 |
| 4gst | 19.4 | 37.2 |
| 4his | 25.0 | 75.0 |
| 8 | 14.3 | 42.1 |
| 10 | 29.1 | 36.0 |
| 15 | 30.0 | 60.9 |
| 16 | 33.3 | 53.8 |
| 18 | 29.4 | 50.0 |
| 21 | 5.9 | 10.0 |
| 22 | 36.8 | 63.1 |
| 24 | 38.5 | 41.4 |
| 25 | 28.6 | 85.7 |
| 32 | 20.0 | 25.0 |
| 35 | 0.0 | 17.6 |
| 45 | 26.7 | 37.5 |
| 48 | 20.0 | 25.0 |
| 52 | 14.2 | 17.3 |
| 53 | 23.8 | 29.2 |
| 54 | 22.7 | 44.0 |
| 55 | 50.0 | 52.9 |

TABLE III-continued

RESULTS FOR in vivo GBS CHALLENGE

| GBS # | % survival | |
|---|---|---|
| | Pre-immune | Post-immune |
| 57 | 33.3 | 55.6 |
| 58 | 6.7 | 11.8 |
| 62 | 15.8 | 36.4 |
| 63 | 21.4 | 42.9 |
| 65 | 3.7 | 23.3 |
| 67 | 23.5 | 27.8 |
| 71 | 13.3 | 26.7 |
| 73 | 28.6 | 39.1 |
| 80 | 38.8 | 56.5 |
| 84 | 33.3 | 37.5 |
| 85 | 30.8 | 62.5 |
| 90 | 14.3 | 22.7 |
| 94 | 25.0 | 30.0 |
| 95 | 16.7 | 23.1 |
| 98 | 5.9 | 11.1 |
| 100 | 26.9 | 42.9 |
| 103 | 16.7 | 52.9 |
| 106 | 10.0 | 18.2 |
| 110 | 11.1 | 30.0 |
| 113 | 17.6 | 29.4 |
| 114 | 40.0 | 52.2 |
| 117 | 27.8 | 36.8 |
| 119 | 36.4 | 52.2 |
| 139 | 23.1 | 26.7 |
| 150 | 21.6 | 44.4 |
| 153 | 25.0 | 30.0 |
| 155 | 22.6 | 36.8 |
| 157 | 14.3 | 31.8 |
| 158 | 22.6 | 40.0 |
| 163 | 29.6 | 37.9 |
| 164 | 25.0 | 43.8 |
| 173 | 17.9 | 38.7 |
| 176 | 20.0 | 38.9 |
| 177 | 21.7 | 33.3 |
| 181 | 5.0 | 21.7 |
| 186 | 41.2 | 52.6 |
| 188 | 11.8 | 23.5 |
| 189 | 21.4 | 31.6 |
| 195 | 32.1 | 64.7 |
| 206 | 33.3 | 50.0 |
| 211 | 30.8 | 33.3 |
| 232 | 50.0 | 57.1 |
| 233 | 34.8 | 55.2 |
| 236 | 57.1 | 70.6 |
| 243 | 46.7 | 52.9 |
| 263 | 15.4 | 35.7 |
| 273 | 61.5 | 75.0 |
| 276 | 23.8 | 44.4 |
| 296 | 25.0 | 28.6 |
| 297 | 13.3 | 23.5 |
| 298 | 20.0 | 22.2 |
| 302 | 30.0 | 52.2 |
| 304 | 33.3 | 40.9 |
| 305 | 42.1 | 70.0 |
| 316 | 38.5 | 42.9 |
| 318 | 7.1 | 15.8 |

TABLE IV

COMPARISON OF GBSnnn NUMBERING AND SEQ ID NUMBER

| GBS numbering | Sequence listing |
|---|---|
| GBS1 | SEQ ID 3532 & 8736 |
| GBS2 | SEQ ID 4530 & 8818 |
| GBS3 | SEQ ID 6266 & 8958 |
| GBS4 | SEQ ID 2 & 8786 |
| GBS5 | SEQ ID 2598 & 8674 |
| GBS6 | SEQ ID 398 & 8496 |
| GBS7 | SEQ ID 8790 & 9798 |
| GBS8 | SEQ ID 8694 |
| GBS9 | SEQ ID 4540 & 8822 |
| GBS10 | SEQ ID 8718 |
| GBS11 | SEQ ID 5884 & 8930 |
| GBS12 | SEQ ID 8764 & 9692 |
| GBS13 | SEQ ID 8484 |
| GBS14 | SEQ ID 5406 & 8892 |
| GBS15 | SEQ ID 4 & 8710 |
| GBS16 | SEQ ID 944 & 8538 |
| GBS17 | SEQ ID 1770 & 8602 |
| GBS18 | SEQ ID 6860 & 9002 |
| GBS19 | SEQ ID 4422 & 8812 |
| GBS20 | SEQ ID 308 & 8488 |
| GBS21 | SEQ ID 8762 |
| GBS22 | SEQ ID 8584 |
| GBS23 | SEQ ID 8512 |
| GBS24 | SEQ ID 1694 & 8598 |
| GBS25 | SEQ ID 3180 & 8714 |
| GBS26 | SEQ ID 8820 |
| GBS27 | SEQ ID 8774 |
| GBS28 | SEQ ID 8738 |
| GBS29 | SEQ ID 8744 |
| GBS30 | SEQ ID 8860 |
| GBS31 | SEQ ID 8702 |
| GBS32 | SEQ ID 8910 & 10142 |
| GBS33 | SEQ ID 5734 & 8912 |
| GBS34 | SEQ ID 5750 & 8916 |
| GBS35 | SEQ ID 8908 |
| GBS36 | SEQ ID 8542 |
| GBS37 | SEQ ID 8564 |
| GBS38 | SEQ ID 2122 & 8642 |
| GBS39 | SEQ ID 8480 |
| GBS40 | SEQ ID 8654 |
| GBS41 | SEQ ID 1176 & 8562 |
| GBS42 | SEQ ID 4856 & 8850 |
| GBS43 | SEQ ID 672 & 8520 |
| GBS44 | SEQ ID 9000 |
| GBS45 | SEQ ID 9018 |
| GBS46 | SEQ ID 1834 & 8608 |
| GBS47 | SEQ ID 8588 |
| GBS48 | SEQ ID 8594 & 8596 |
| GBS49 | SEQ ID 8494 & 9490 |
| GBS50 | SEQ ID 1236 & 8566 |
| GBS51 | SEQ ID 5410 |
| GBS52 | SEQ ID 3920 |
| GBS53 | SEQ ID 8586 |
| GBS54 | SEQ ID 3442 |
| GBS55 | SEQ ID 9020 & 10338 |
| GBS56 | SEQ ID 2510 & 8668 |
| GBS57 | SEQ ID 8854 |
| GBS58 | SEQ ID 8664 |
| GBS59 | SEQ ID 3744 |
| GBS60 | SEQ ID 8760 |
| GBS61 | SEQ ID 8776 |
| GBS62 | SEQ ID 2244 |
| GBS63 | SEQ ID 390 |
| GBS64 | SEQ ID 374 |
| GBS65 | SEQ ID 8544 |
| GBS66 | SEQ ID 3028 |
| GBS67 | SEQ ID 3746 |
| GBS68 | SEQ ID 4012 |
| GBS69 | SEQ ID 4916 |
| GBS70 | SEQ ID 3718 |
| GBS71 | SEQ ID 8906 |
| GBS72 | SEQ ID 1348 |
| GBS73 | SEQ ID 220 |
| GBS74 | SEQ ID 5872 |
| GBS75 | SEQ ID 8926 |
| GBS76 | SEQ ID 5862 |
| GBS77 | SEQ ID 3256 |
| GBS78 | SEQ ID 3262 |
| GBS79 | SEQ ID 3264 |
| GBS80 | SEQ ID 8780 |
| GBS81 | SEQ ID 2706 |
| GBS82 | SEQ ID 2898 |

TABLE IV-continued

COMPARISON OF GBSnnn NUMBERING AND SEQ ID NUMBER

| GBS numbering | Sequence listing |
|---|---|
| GBS83 | SEQ ID 8772 |
| GBS84 | SEQ ID 4182 |
| GBS85 | SEQ ID 216 |
| GBS86 | SEQ ID 2978 |
| GBS87 | SEQ ID 3452 |
| GBS88 | SEQ ID 5694 |
| GBS89 | SEQ ID 2682 |
| GBS90 | SEQ ID 8476 |
| GBS91 | SEQ ID 8938 |
| GBS92 | SEQ ID 8964 & 10238 |
| GBS93 | SEQ ID 2848 |
| GBS94 | SEQ ID 1592 |
| GBS95 | SEQ ID 2224 |
| GBS96 | SEQ ID 2130 |
| GBS97 | SEQ ID 800 |
| GBS98 | SEQ ID 8746 |
| GBS99 | SEQ ID 4240 |
| GBS100 | SEQ ID 8782 |
| GBS101 | SEQ ID 6902 |
| GBS102 | SEQ ID 6894 |
| GBS103 | SEQ ID 6 |
| GBS104 | SEQ ID 8778 |
| GBS105 | SEQ ID 1400 |
| GBS106 | SEQ ID 8502 |
| GBS107 | SEQ ID 6026 |
| GBS108 | SEQ ID 8532 |
| GBS109 | SEQ ID 4116 |
| GBS110 | SEQ ID 6832 |
| GBS111 | SEQ ID 8842 |
| GBS112 | SEQ ID 8904 |
| GBS113 | SEQ ID 300 |
| GBS114 | SEQ ID 8968 |
| GBS115 | SEQ ID 5164 |
| GBS116 | SEQ ID 5152 |
| GBS117 | SEQ ID 8962 |
| GBS118 | SEQ ID 2508 |
| GBS119 | SEQ ID 8814 |
| GBS120 | SEQ ID 8874 |
| GBS121 | SEQ ID 3826 |
| GBS122 | SEQ ID 9006 |
| GBS123 | SEQ ID 6310 |
| GBS124 | SEQ ID 260 |
| GBS125 | SEQ ID 3872 |
| GBS126 | SEQ ID 6736 |
| GBS127 | SEQ ID 8816 |
| GBS128 | SEQ ID 752 |
| GBS129 | SEQ ID 8990 |
| GBS130 | SEQ ID 9004 |
| GBS131 | SEQ ID 6198 |
| GBS132 | SEQ ID 8730 |
| GBS133 | SEQ ID 474 |
| GBS134 | SEQ ID 9008 |
| GBS135 | SEQ ID 8882 |
| GBS136 | SEQ ID 1188 |
| GBS137 | SEQ ID 3960 |
| GBS138 | SEQ ID 9052 |
| GBS139 | SEQ ID 884 |
| GBS140 | SEQ ID 8632 |
| GBS141 | SEQ ID 1768 |
| GBS142 | SEQ ID 8600 |
| GBS143 | SEQ ID 9054 |
| GBS144 | SEQ ID 2238 |
| GBS145 | SEQ ID 8700 |
| GBS146 | SEQ ID 8696 |
| GBS147 | SEQ ID 8526 |
| GBS148 | SEQ ID 9010 |
| GBS149 | SEQ ID 8732 |
| GBS150 | SEQ ID 3736 |
| GBS151 | SEQ ID 3188 |
| GBS152 | SEQ ID 3952 |
| GBS153 | SEQ ID 3904 |
| GBS154 | SEQ ID 4024 |
| GBS155 | SEQ ID 8796 |
| GBS156 | SEQ ID 4646 |
| GBS157 | SEQ ID 4812 |
| GBS158 | SEQ ID 5504 |
| GBS159 | SEQ ID 8628 |
| GBS160 | SEQ ID 8924 |
| GBS161 | SEQ ID 8922 |
| GBS162 | SEQ ID 168 |
| GBS163 | SEQ ID 224 |
| GBS164 | SEQ ID 1102 |
| GBS165 | SEQ ID 3672 |
| GBS166 | SEQ ID 8712 |
| GBS167 | SEQ ID 4214 |
| GBS168 | SEQ ID 9016 |
| GBS169 | SEQ ID 4346 |
| GBS170 | SEQ ID 8982 |
| GBS171 | SEQ ID 6720 |
| GBS172 | SEQ ID 6704 |
| GBS173 | SEQ ID 8788 |
| GBS174 | SEQ ID 6150 |
| GBS175 | SEQ ID 62 |
| GBS176 | SEQ ID 8478 |
| GBS177 | SEQ ID 8876 |
| GBS178 | SEQ ID 6078 |
| GBS179 | SEQ ID 8848 |
| GBS180 | SEQ ID 3062 |
| GBS181 | SEQ ID 1924 |
| GBS182 | SEQ ID 3774 |
| GBS183 | SEQ ID 4796 |
| GBS184 | SEQ ID 1978 |
| GBS185 | SEQ ID 1046 |
| GBS186 | SEQ ID 8470 |
| GBS187 | SEQ ID 844 |
| GBS188 | SEQ ID 3410 |
| GBS189 | SEQ ID 6986 |
| GBS190 | SEQ ID 8842 |
| GBS191 | SEQ ID 1814 |
| GBS192 | SEQ ID 8618 |
| GBS193 | SEQ ID 2382 |
| GBS194 | SEQ ID 3912 |
| GBS195 | SEQ ID 8 |
| GBS196 | SEQ ID 4944 |
| GBS197 | SEQ ID 5486 |
| GBS198 | SEQ ID 8896 |
| GBS199 | SEQ ID 1162 |
| GBS200 | SEQ ID 8936 |
| GBS201 | SEQ ID 4550 |
| GBS202 | SEQ ID 8666 |
| GBS203 | SEQ ID 6478 |
| GBS204 | SEQ ID 1996 |
| GBS205 | SEQ ID 18 |
| GBS206 | SEQ ID 8552 |
| GBS207 | SEQ ID 3822 |
| GBS208 | SEQ ID 3916 |
| GBS209 | SEQ ID 3918 |
| GBS210 | SEQ ID 3738 |
| GBS211 | SEQ ID 4680 |
| GBS212 | SEQ ID 8750 |
| GBS213 | SEQ ID 8500 |
| GBS214 | SEQ ID 8498 |
| GBS215 | SEQ ID 9022 |
| GBS216 | SEQ ID 8606 |
| GBS217 | SEQ ID 9024 |
| GBS218 | SEQ ID 8652 |
| GBS219 | SEQ ID 8646 |
| GBS220 | SEQ ID 2730 |
| GBS221 | SEQ ID 9028 |
| GBS222 | SEQ ID 3842 |
| GBS223 | SEQ ID 8794 |
| GBS224 | SEQ ID 9026 |
| GBS225 | SEQ ID 8834 |
| GBS226 | SEQ ID 4966 |
| GBS227 | SEQ ID 5030 |
| GBS228 | SEQ ID 5050 |
| GBS229 | SEQ ID 9056 |
| GBS230 | SEQ ID 1296 |
| GBS231 | SEQ ID 5810 |
| GBS232 | SEQ ID 5830 |

TABLE IV-continued

COMPARISON OF GBSnnn NUMBERING AND SEQ ID NUMBER

| GBS numbering | Sequence listing |
|---|---|
| GBS233 | SEQ ID 4722 |
| GBS234 | SEQ ID 1106 |
| GBS235 | SEQ ID 8560 |
| GBS236 | SEQ ID 6162 |
| GBS237 | SEQ ID 8706 |
| GBS238 | SEQ ID 4246 |
| GBS239 | SEQ ID 8980 |
| GBS240 | SEQ ID 8986 |
| GBS241 | SEQ ID 9030 |
| GBS242 | SEQ ID 9032 |
| GBS243 | SEQ ID 8678 |
| GBS244 | SEQ ID 6554 |
| GBS245 | SEQ ID 8994 |
| GBS246 | SEQ ID 6864 |
| GBS247 | SEQ ID 8856 |
| GBS248 | SEQ ID 454 |
| GBS249 | SEQ ID 8620 |
| GBS250 | SEQ ID 8634 |
| GBS251 | SEQ ID 2258 |
| GBS252 | SEQ ID 8648 |
| GBS253 | SEQ ID 2526 |
| GBS254 | SEQ ID 2710 |
| GBS255 | SEQ ID 2966 |
| GBS256 | SEQ ID 3424 |
| GBS257 | SEQ ID 3550 |
| GBS258 | SEQ ID 3752 |
| GBS259 | SEQ ID 8756 |
| GBS260 | SEQ ID 4162 |
| GBS261 | SEQ ID 1530 |
| GBS262 | SEQ ID 8572 |
| GBS263 | SEQ ID 1616 |
| GBS264 | SEQ ID 8824 |
| GBS265 | SEQ ID 4554 |
| GBS266 | SEQ ID 4652 |
| GBS267 | SEQ ID 4980 |
| GBS268 | SEQ ID 5038 |
| GBS269 | SEQ ID 5534 |
| GBS270 | SEQ ID 1998 |
| GBS271 | SEQ ID 8570 |
| GBS272 | SEQ ID 22 |
| GBS273 | SEQ ID 5994 |
| GBS274 | SEQ ID 774 |
| GBS275 | SEQ ID 2308 |
| GBS276 | SEQ ID 8942 |
| GBS277 | SEQ ID 8954 |
| GBS278 | SEQ ID 8524 |
| GBS279 | SEQ ID 6292 |
| GBS280 | SEQ ID 6254 |
| GBS281 | SEQ ID 4458 |
| GBS282 | SEQ ID 4444 |
| GBS283 | SEQ ID 9034 |
| GBS284 | SEQ ID 6456 & 8974 |
| GBS285 | SEQ ID 8802 |
| GBS286 | SEQ ID 9036 |
| GBS287 | SEQ ID 5354 |
| GBS288 | SEQ ID 5374 |
| GBS289 | SEQ ID 8616 |
| GBS290 | SEQ ID 8680 |
| GBS291 | SEQ ID 8530 |
| GBS292 | SEQ ID 8998 |
| GBS293 | SEQ ID 8582 |
| GBS294 | SEQ ID 8604 |
| GBS295 | SEQ ID 2722 |
| GBS296 | SEQ ID 2658 |
| GBS297 | SEQ ID 3024 |
| GBS298 | SEQ ID 8704 |
| GBS299 | SEQ ID 3268 |
| GBS300 | SEQ ID 4170 |
| GBS301 | SEQ ID 8576 |
| GBS302 | SEQ ID 8670 |
| GBS303 | SEQ ID 8554 |
| GBS304 | SEQ ID 5846 |
| GBS305 | SEQ ID 208 |
| GBS306 | SEQ ID 212 |
| GBS307 | SEQ ID 8992 |
| GBS308 | SEQ ID 8880 |
| GBS309 | SEQ ID 3386 |
| GBS310 | SEQ ID 286 |
| GBS311 | SEQ ID 3964 |
| GBS312 | SEQ ID 4660 |
| GBS313 | SEQ ID 4090 |
| GBS314 | SEQ ID 8556 |
| GBS315 | SEQ ID 1766 |
| GBS316 | SEQ ID 2000 |
| GBS317 | SEQ ID 4210 |
| GBS318 | SEQ ID 8548 |
| GBS319 | SEQ ID 892 |
| GBS320 | SEQ ID 916 |
| GBS321 | SEQ ID 8846 |
| GBS322 | SEQ ID 8540 |
| GBS323 | SEQ ID 2102 |
| GBS324 | SEQ ID 8490 |
| GBS325 | SEQ ID 8900 |
| GBS326 | SEQ ID 8630 |
| GBS327 | SEQ ID 5856 |
| GBS328 | SEQ ID 6016 |
| GBS329 | SEQ ID 8928 |
| GBS330 | SEQ ID 8792 |
| GBS331 | SEQ ID 922 |
| GBS332 | SEQ ID 1004 |
| GBS333 | SEQ ID 1786 |
| GBS334 | SEQ ID 1784 |
| GBS335 | SEQ ID 1782 |
| GBS336 | SEQ ID 1886 |
| GBS337 | SEQ ID 2010 |
| GBS338 | SEQ ID 8638 |
| GBS339 | SEQ ID 2080 |
| GBS340 | SEQ ID 8594 & 8596 |
| GBS341 | SEQ ID 2280 |
| GBS342 | SEQ ID 2266 |
| GBS343 | SEQ ID 8644 |
| GBS344 | SEQ ID 8662 |
| GBS345 | SEQ ID 2442 |
| GBS346 | SEQ ID 2768 |
| GBS347 | SEQ ID 2766 |
| GBS348 | SEQ ID 8658 |
| GBS349 | SEQ ID 2360 |
| GBS350 | SEQ ID 8698 |
| GBS351 | SEQ ID 2970 |
| GBS352 | SEQ ID 8692 |
| GBS353 | SEQ ID 3454 |
| GBS354 | SEQ ID 8754 |
| GBS355 | SEQ ID 8752 |
| GBS356 | SEQ ID 8724 |
| GBS357 | SEQ ID 8720 |
| GBS358 | SEQ ID 3184 |
| GBS359 | SEQ ID 3948 |
| GBS360 | SEQ ID 3926 |
| GBS361 | SEQ ID 8770 |
| GBS362 | SEQ ID 8768 |
| GBS363 | SEQ ID 3816 |
| GBS364 | SEQ ID 1452 |
| GBS365 | SEQ ID 1398 |
| GBS366 | SEQ ID 8574 |
| GBS367 | SEQ ID 1340 |
| GBS368 | SEQ ID 1598 |
| GBS369 | SEQ ID 4822 |
| GBS370 | SEQ ID 8844 |
| GBS371 | SEQ ID 4926 |
| GBS372 | SEQ ID 4956 |
| GBS373 | SEQ ID 5062 |
| GBS374 | SEQ ID 8878 |
| GBS375 | SEQ ID 326 |
| GBS376 | SEQ ID 5380 |
| GBS377 | SEQ ID 5468 |
| GBS378 | SEQ ID 5570 |
| GBS379 | SEQ ID 8918 |
| GBS380 | SEQ ID 156 |
| GBS381 | SEQ ID 8934 |
| GBS382 | SEQ ID 8610 |

TABLE IV-continued

COMPARISON OF GBSnnn NUMBERING AND SEQ ID NUMBER

| GBS numbering | Sequence listing |
|---|---|
| GBS383 | SEQ ID 4738 |
| GBS384 | SEQ ID 8836 |
| GBS385 | SEQ ID 1094 |
| GBS386 | SEQ ID 9038 |
| GBS387 | SEQ ID 8558 |
| GBS388 | SEQ ID 9040 |
| GBS389 | SEQ ID 8516 |
| GBS390 | SEQ ID 8952 |
| GBS391 | SEQ ID 8522 |
| GBS392 | SEQ ID 6220 |
| GBS393 | SEQ ID 8966 |
| GBS394 | SEQ ID 8960 |
| GBS395 | SEQ ID 6276 |
| GBS396 | SEQ ID 8468 |
| GBS397 | SEQ ID 6262 |
| GBS398 | SEQ ID 8806 |
| GBS399 | SEQ ID 1960 |
| GBS400 | SEQ ID 3154 |
| GBS401 | SEQ ID 3170 |
| GBS402 | SEQ ID 4236 |
| GBS403 | SEQ ID 8798 |
| GBS404 | SEQ ID 8800 |
| GBS405 | SEQ ID 8508 |
| GBS406 | SEQ ID 8506 |
| GBS407 | SEQ ID 6484 |
| GBS408 | SEQ ID 9042 |
| GBS409 | SEQ ID 6678 |
| GBS410 | SEQ ID 4064 |
| GBS411 | SEQ ID 9044 |
| GBS412 | SEQ ID 9046 |
| GBS413 | SEQ ID 272 |
| GBS414 | SEQ ID 8946 |
| GBS415 | SEQ ID 8944 |
| GBS416 | SEQ ID 6044 |
| GBS417 | SEQ ID 1874 |
| GBS418 | SEQ ID 5146 |
| GBS419 | SEQ ID 2638 |
| GBS420 | SEQ ID 2104 |
| GBS421 | SEQ ID 2108 |
| GBS422 | SEQ ID 714 |
| GBS423 | SEQ ID 6884 |
| GBS424 | SEQ ID 4874 |
| GBS425 | SEQ ID 3978 |
| GBS426 | SEQ ID 3976 |
| GBS427 | SEQ ID 6958 |
| GBS428 | SEQ ID 3398 |
| GBS429 | SEQ ID 3402 |
| GBS430 | SEQ ID 8840 |
| GBS431 | SEQ ID 8902 |
| GBS432 | SEQ ID 8534 |
| GBS433 | SEQ ID 2558 |
| GBS434 | SEQ ID 8590 |
| GBS435 | SEQ ID 484 |
| GBS436 | SEQ ID 8472 |
| GBS437 | SEQ ID 466 |
| GBS438 | SEQ ID 362 |
| GBS439 | SEQ ID 900 |
| GBS440 | SEQ ID 8536 |
| GBS441 | SEQ ID 936 |
| GBS442 | SEQ ID 940 |
| GBS443 | SEQ ID 998 |
| GBS444 | SEQ ID 1776 |
| GBS445 | SEQ ID 8634 |
| GBS446 | SEQ ID 2048 |
| GBS447 | SEQ ID 1654 |
| GBS448 | SEQ ID 8592 |
| GBS449 | SEQ ID 1634 |
| GBS450 | SEQ ID 1630 |
| GBS451 | SEQ ID 2098 |
| GBS452 | SEQ ID 2062 |
| GBS453 | SEQ ID 8636 |
| GBS454 | SEQ ID 1734 |
| GBS455 | SEQ ID 1690 |
| GBS456 | SEQ ID 1684 |
| GBS457 | SEQ ID 8656 |
| GBS458 | SEQ ID 8650 |
| GBS459 | SEQ ID 2152 |
| GBS460 | SEQ ID 2148 |
| GBS461 | SEQ ID 2394 |
| GBS462 | SEQ ID 2778 |
| GBS463 | SEQ ID 8688 |
| GBS464 | SEQ ID 8684 |
| GBS465 | SEQ ID 8682 |
| GBS466 | SEQ ID 2694 |
| GBS467 | SEQ ID 2350 |
| GBS468 | SEQ ID 8660 |
| GBS469 | SEQ ID 2998 |
| GBS470 | SEQ ID 2988 |
| GBS471 | SEQ ID 2924 |
| GBS472 | SEQ ID 2910 |
| GBS473 | SEQ ID 2882 |
| GBS474 | SEQ ID 2878 |
| GBS475 | SEQ ID 2856 |
| GBS476 | SEQ ID 8690 |
| GBS477 | SEQ ID 3112 |
| GBS478 | SEQ ID 3432 |
| GBS479 | SEQ ID 3460 |
| GBS480 | SEQ ID 3504 |
| GBS481 | SEQ ID 8734 |
| GBS482 | SEQ ID 8740 |
| GBS483 | SEQ ID 3606 |
| GBS484 | SEQ ID 3562 |
| GBS485 | SEQ ID 3552 |
| GBS486 | SEQ ID 3762 |
| GBS487 | SEQ ID 3756 |
| GBS488 | SEQ ID 3732 |
| GBS489 | SEQ ID 3730 |
| GBS490 | SEQ ID 3704 |
| GBS491 | SEQ ID 3698 |
| GBS492 | SEQ ID 3252 |
| GBS493 | SEQ ID 3244 |
| GBS494 | SEQ ID 3238 |
| GBS495 | SEQ ID 8722 |
| GBS496 | SEQ ID 8716 |
| GBS497 | SEQ ID 3876 |
| GBS498 | SEQ ID 3858 |
| GBS499 | SEQ ID 8758 |
| GBS500 | SEQ ID 4022 |
| GBS501 | SEQ ID 4106 |
| GBS502 | SEQ ID 1406 |
| GBS503 | SEQ ID 8580 |
| GBS504 | SEQ ID 4578 |
| GBS505 | SEQ ID 4566 |
| GBS506 | SEQ ID 8832 |
| GBS507 | SEQ ID 8830 |
| GBS508 | SEQ ID 4644 |
| GBS509 | SEQ ID 8828 |
| GBS510 | SEQ ID 8826 |
| GBS511 | SEQ ID 4892 |
| GBS512 | SEQ ID 4970 |
| GBS513 | SEQ ID 4974 |
| GBS514 | SEQ ID 8862 |
| GBS515 | SEQ ID 8864 |
| GBS516 | SEQ ID 8866 |
| GBS517 | SEQ ID 8868 |
| GBS518 | SEQ ID 9012 |
| GBS519 | SEQ ID 5068 |
| GBS520 | SEQ ID 8870 |
| GBS521 | SEQ ID 5228 |
| GBS522 | SEQ ID 322 |
| GBS523 | SEQ ID 8492 |
| GBS524 | SEQ ID 8894 |
| GBS525 | SEQ ID 5430 |
| GBS526 | SEQ ID 5414 |
| GBS527 | SEQ ID 5524 |
| GBS528 | SEQ ID 8898 |
| GBS529 | SEQ ID 5670 |
| GBS530 | SEQ ID 5630 |
| GBS531 | SEQ ID 5588 |
| GBS532 | SEQ ID 1324 |

TABLE IV-continued

COMPARISON OF GBSnnn NUMBERING AND SEQ ID NUMBER

| GBS numbering | Sequence listing |
|---|---|
| GBS533 | SEQ ID 8914 |
| GBS534 | SEQ ID 8550 |
| GBS535 | SEQ ID 8568 |
| GBS536 | SEQ ID 1288 |
| GBS537 | SEQ ID 5798 |
| GBS538 | SEQ ID 8920 |
| GBS539 | SEQ ID 158 |
| GBS540 | SEQ ID 8482 |
| GBS541 | SEQ ID 184 |
| GBS542 | SEQ ID 9048 |
| GBS543 | SEQ ID 8932 |
| GBS544 | SEQ ID 5880 |
| GBS545 | SEQ ID 44 |
| GBS546 | SEQ ID 9014 |
| GBS547 | SEQ ID 12 |
| GBS548 | SEQ ID 8614 |
| GBS549 | SEQ ID 8612 |
| GBS550 | SEQ ID 4720 |
| GBS551 | SEQ ID 4710 |
| GBS552 | SEQ ID 1086 |
| GBS553 | SEQ ID 1088 |
| GBS554 | SEQ ID 1138 |
| GBS555 | SEQ ID 8748 |
| GBS556 | SEQ ID 5968 |
| GBS557 | SEQ ID 774 |
| GBS558 | SEQ ID 1192 |
| GBS559 | SEQ ID 1196 |
| GBS560 | SEQ ID 1268 |
| GBS561 | SEQ ID 8518 |
| GBS562 | SEQ ID 8676 |
| GBS563 | SEQ ID 2296 |
| GBS564 | SEQ ID 2300 |
| GBS565 | SEQ ID 8950 |
| GBS566 | SEQ ID 694 |
| GBS567 | SEQ ID 680 |
| GBS568 | SEQ ID 6300 |
| GBS569 | SEQ ID 8956 |
| GBS570 | SEQ ID 8972 |
| GBS571 | SEQ ID 8970 |
| GBS572 | SEQ ID 3300 |
| GBS573 | SEQ ID 3304 |
| GBS574 | SEQ ID 8726 |
| GBS575 | SEQ ID 8810 |
| GBS576 | SEQ ID 4418 |
| GBS577 | SEQ ID 8808 |
| GBS578 | SEQ ID 4382 |
| GBS579 | SEQ ID 4378 |
| GBS580 | SEQ ID 1932 |
| GBS581 | SEQ ID 8622 |
| GBS582 | SEQ ID 8624 |
| GBS583 | SEQ ID 1962 |
| GBS584 | SEQ ID 8708 |
| GBS585 | SEQ ID 8672 |
| GBS586 | SEQ ID 6444 |
| GBS587 | SEQ ID 8976 |
| GBS588 | SEQ ID 8804 |
| GBS589 | SEQ ID 8514 |
| GBS590 | SEQ ID 8510 |
| GBS591 | SEQ ID 630 |
| GBS592 | SEQ ID 8504 |
| GBS593 | SEQ ID 514 |
| GBS594 | SEQ ID 8978 |
| GBS595 | SEQ ID 6738 |
| GBS596 | SEQ ID 6712 |
| GBS597 | SEQ ID 6686 |
| GBS598 | SEQ ID 6674 |
| GBS599 | SEQ ID 6662 |
| GBS600 | SEQ ID 8988 |
| GBS601 | SEQ ID 8578 |
| GBS602 | SEQ ID 8948 |
| GBS603 | SEQ ID 6132 |
| GBS604 | SEQ ID 5282 |
| GBS605 | SEQ ID 5302 |
| GBS606 | SEQ ID 8884 |
| GBS607 | SEQ ID 5314 |
| GBS608 | SEQ ID 8886 |
| GBS609 | SEQ ID 8888 |
| GBS610 | SEQ ID 8890 |
| GBS611 | SEQ ID 6028 |
| GBS612 | SEQ ID 8474 |
| GBS613 | SEQ ID 5092 |
| GBS614 | SEQ ID 8872 |
| GBS615 | SEQ ID 6052 |
| GBS616 | SEQ ID 8940 |
| GBS617 | SEQ ID 1824 |
| GBS618 | SEQ ID 6600 |
| GBS619 | SEQ ID 6608 |
| GBS620 | SEQ ID 6620 |
| GBS621 | SEQ ID 864 |
| GBS622 | SEQ ID 8640 |
| GBS623 | SEQ ID 8996 |
| GBS624 | SEQ ID 9050 |
| GBS625 | SEQ ID 2812 |
| GBS626 | SEQ ID 8858 |
| GBS627 | SEQ ID 8852 |
| GBS628 | SEQ ID 8784 |
| GBS629 | SEQ ID 6950 |
| GBS630 | SEQ ID 4502 |
| GBS631 | SEQ ID 4492 |
| GBS632 | SEQ ID 4488 |
| GBS633 | SEQ ID 8728 |
| GBS634 | SEQ ID 3066 |
| GBS635 | SEQ ID 8838 |
| GBS636 | SEQ ID 4772 |
| GBS637 | SEQ ID 8626 |
| GBS638 | SEQ ID 8984 |
| GBS639 | SEQ ID 8546 |
| GBS640 | SEQ ID 6780 |
| GBS641 | SEQ ID 900 |
| GBS642 | 1312 |
| GBS643 | 1772 |
| GBS644 | 1956 |
| GBS645 | 2726 |
| GBS646 | 3348 |
| GBS647 | 3770 |
| GBS648 | 4934 |
| GBS649 | 5076 |
| GBS650 | 5446 |
| GBS651 | 5602 |
| GBS652 | 5610 |
| GBS653 | 5760 |
| GBS654 | 6096 |
| GBS655 | 6656 |
| GBS656 | 9324 |
| GBS657 | 10782 |
| GBS658 | 8802 |
| GBS659 | 9344 |
| GBS660 | 9410 |
| GBS661 | 9428 |
| GBS662 | 9286 |
| GBS663 | 9294 |
| GBS664 | 9034 |
| GBS665 | 10546 |
| GBS666 | 10610 |
| GBS667 | 9052 |
| GBS668 | 9036 |
| GBS669 | 9010 |
| GBS670 | 10730 |
| GBS671 | 9020 |
| GBS672 | 9052 |
| GBS673 | 9036 |
| GBS674 | 9034 |
| GBS675 | 10634 |
| GBS676 | 10692 |
| GBS677 | 10746 |
| GBS678 | 9330 |
| GBS679 | 9404 |
| GBS680 | 6668 |
| GBS681 | 4264 |
| GBS682 | 6762 |

TABLE IV-continued

COMPARISON OF GBSnnn NUMBERING AND SEQ ID NUMBER

| GBS numbering | Sequence listing |
|---|---|
| GBS683 | 9290 |
| GBS684 | 9614 |
| GBS685 | 10454 |
| GBS686 | 2774 |
| GBS687 | 4620 |
| GBS688 | 10224 |

TABLE V

NUCLEOTIDES DELETED IN EXPRESSION OF GBSnnn PROTEINS

| GBS | Deleted nucleotides |
|---|---|
| 11d | 1-153 |
| 31d | 1-129 |
| 64d | 1-165 |
| 68d | 2029-2796 |
| 70d | 1-402 |
| 74d | 1-975 |
| 79d | 1-201 |
| 105dN | 2689-4119 |
| 105dC | 1-2688 |
| 105d | 1-2688 |
| 109d | 1-120 |
| 130d | 1-518 |
| 170d | 1-111 |
| 182d | 1596-1674 |
| 195C | 1-1710 |
| 195N | 1711-3243 |
| 209d | 757-912 |
| 210d | 1-99 & 777-879 |
| 220d | 1-120 |
| 231d | 1-54 |
| 235d | 1-270 |
| 246d | 1-75 |
| 248d | 1-591 |
| 272d | 1-531 |
| 277d | 1-318 |
| 281d | 1-54 |
| 287d | 1-108 |
| 288d | 1-72 |
| 293C | 1-1229 |
| 293N | 1230-2379 |
| 317N | 1729-4107 |
| 317C | 1-2379 |
| 326N | 1707-2652 |
| 326dN | 2326-3927 |
| 327N | 3034-6831 |
| 327C | 1-3033 |
| 333d | 1-150 |
| 339d | 1-111 |
| 352d | 1-158 |
| 362N | 1707-2652 |
| 362C | 1-1706 |
| 397d | 1-348 |
| 399d | 1-111 |
| 407d | 1174-1473 |
| 409d | 1-297 |
| 424d | 1327-1671 |

TABLE VI

PREDICTED FUNCTIONS FOR CERTAIN SEQ IDs

| SEQ ID | Function |
|---|---|
| 6 | manganese ABC transporter, ATP-binding protein (psaB) |
| 12 | iron (chelated) ABC transporter, permease protein (psaC) |
| 18 | peptidyl-prolyl cis-trans isomerase, cyclophilin-type |
| 26 | chorismate binding enzyme (pabB) |
| 30 | probable transposase (insertion sequence IS861) |
| 42 | peptidase, M20/M25/M40 family |
| 44 | drug transporter |
| 50 | ribosomal protein L11 (rplK) |
| 54 | ribosomal protein L1 (rplA) |
| 62 | peptide ABC transporter, permease protein |
| 66 | peptide ABC transporter, permease protein |
| 78 | uridylate kinase (pyrH) |
| 84 | ribosome recycling factor (frr) |
| 104 | PhoH family protein (phoH) |
| 110 | MutT/nudix family protein superfamily |
| 116 | tetracenomycin polyketide synthesis O-methyltransferase TcmP |
| 134 | phosphopantetheine adenylyltransferase (coaD) |
| 140 | PDZ domain protein |
| 144 | 5-nucleotidase family protein |
| 156 | VanZF-related protein |
| 158 | ABC transporter, ATP-binding/permease protein |
| 162 | ABC transporter, ATP-binding/permease protein |
| 168 | BioY family protein |
| 180 | acetyl-CoA acetyltransferase |
| 188 | endonuclease III (nth) |
| 196 | glucokinase (gki) |
| 200 | rhodanese family protein |
| 204 | elongation factor Tu family protein (typA) |
| 212 | UDP-N-acetylglucosamine--N-acetylmuramyl-(pentapeptide) pyrophosphoryl- |
| 216 | cell division protein DivIB |
| 220 | cell division protein FtsA (ftsA) |
| 224 | cell division protein FtsZ (ftsZ) |
| 236 | ylmH protein (ylmH) |
| 240 | cell division protein DivIVA (divIVA) |
| 244 | isoleucyl-tRNA synthetase (ileS) |
| 252 | MutT/nudix family protein |
| 256 | ATP-dependent Clp protease, ATP-binding subunit ClpE (clpE) |
| 268 | methylenetetrahydrofolate dehydrogenase/methenyltetrahydrofolate cycloh |
| 274 | exodeoxyribonuclease VII, large subunit (xseA) |
| 278 | exodeoxyribonuclease VII, small subunit (xseB) |
| 282 | geranyltransferase (ispA) |
| 286 | hemolysin A |
| 290 | transcriptional repressor |
| 296 | DNA repair protein RecN (recN) |
| 300 | degV family protein (degV) |
| 322 | peptide ABC transporter, permease protein (oppC) |
| 326 | peptide ABC transporter, ATP-binding protein (oppD) |
| 328 | peptide ABC transporter, ATP-binding protein (oppF) |
| 348 | 4-diphosphocytidyl-2C-methyl-D-erythritol kinase (ispE) |
| 352 | adc operon repressor AdcR (adcR) |
| 356 | zinc ABC transporter, ATP-binding protein (adcC) |
| 370 | tyrosyl-tRNA synthetase (tyrS) |
| 374 | penicillin-binding protein 1B (pbp1B) |
| 378 | DNA-directed RNA polymerase, beta subunit (rpoB) |
| 382 | dna-directed rna polymerase beta' chain |
| 390 | competence protein CglA (cglA) |
| 406 | acetate kinase (ackA) |
| 410 | transcriptional regulator |
| 418 | pyrroline-5-carboxylate reductase (proC) |
| 422 | glutamyl-aminopeptidase (pepA) |
| 432 | thioredoxin family protein |
| 436 | tRNA binding domain protein (pheT) |
| 440 | methyltransferase |
| 442 | single-strand DNA-binding protein, authentic point mutation (ssbB) |
| 454 | GAF domain protein (lytS) |
| 466 | IrgB protein (IrgB) |

TABLE VI-continued

PREDICTED FUNCTIONS FOR CERTAIN SEQ IDs

| SEQ ID | Function |
|---|---|
| 474 | oligopeptide ABC transporter, permease protein |
| 476 | peptide ABC transporter, ATP-binding protein |
| 480 | peptide ABC transporter, ATP-binding protein (oppF) |
| 484 | PTS system, IIABC components (treB) |
| 488 | alpha amylase family protein (treC) |
| 494 | transcriptional regulator, BgIG family |
| 506 | transcriptional regulator, BgIG family |
| 508 | PTS system, IIB component |
| 514 | PTS system, IIC component |
| 518 | transketolase, N-terminal subunit (tktA) |
| 528 | ribosomal protein S15 (rpsO) |
| 546 | cysteinyl-tRNA synthetase (cysS) |
| 554 | RNA methyltransferase, TrmH family, group 3 |
| 562 | DegV family protein (degV) |
| 572 | ribosomal protein S9 (rpsI) |
| 576 | integrase, phage family |
| 580 | transcriptional regulator |
| 596 | recombination protein |
| 626 | transcriptional regulator MutR |
| 630 | transporter |
| 640 | amino acid ABC transporter, permease protein (opuBB) |
| 642 | glycine betaine/L-proline transport ATP binding subunit (proV) |
| 654 | lectin, alpha subunit precursor |
| 662 | transcriptional regulator |
| 664 | acetyltransferase, GNAT family |
| 666 | acetyltransferase, GNAT family (rimJ) |
| 670 | acetyltransferase, GNAT family |
| 676 | transcriptional regulator, tetR family domain protein |
| 680 | ABC transporter efflux protein, DrrB family |
| 690 | IS1381, transposase OrfA/OrfB, truncation |
| 714 | magnesium transporter, CorA family |
| 718 | oxidoreductase, Gfo/Idh/MocA family |
| 722 | valyl-tRNA synthetase (valS) |
| 730 | acetyltransferase, GNAT family |
| 746 | methyltransferase |
| 750 | bacteriophage L54a, integrase |
| 754 | DNA-damage-inducible protein J |
| 774 | cation efflux system protein |
| 778 | oxidoreductase, aldo/keto reductase family |
| 784 | alcohol dehydrogenase, zinc-containing |
| 790 | 3-oxoadipate enol-lactone hydrolase/4-carboxymuconolactone decarboxylas |
| 804 | ribonucleoside-diphosphate reductase, alpha subunit (nrdE) |
| 808 | nrdI protein (nrdI) |
| 812 | Ribonucleotide reductases |
| 824 | elaA protein (elaA) |
| 828 | RNA methyltransferase, TrmA family |
| 832 | RecX family protein |
| 840 | -identity (jag) |
| 844 | membrane protein, 60 kDa (yidC) |
| 856 | UTP-glucose-1-phosphate uridylyltransferase (galU) |
| 864 | rhomboid family protein |
| 884 | MORN motif family |
| 892 | transcriptional regulator |
| 896 | adenylosuccinate lyase (purB) |
| 908 | phosphoribosylaminoimidazole carboxylase, catalytic subunit (purE) |
| 912 | phosphoribosylamine--glycine ligase (purD) |
| 916 | phosphosugar-binding transcriptional regulator |
| 920 | acetyl xylan esterase |
| 922 | ROK family protein (gki) |
| 926 | N-acetylneuraminate lyase (nanA) |
| 936 | sugar ABC transporter, permease protein |
| 940 | sugar ABC transporter, permease protein (msmF) |
| 952 | LysM domain protein, authentic frameshift |
| 956 | zoocin A endopeptidase |
| 958 | phosphoribosylaminoimidazolecarboxamide formyltransferase/IMP cyclohydr |
| 962 | acetyltransferase, GNAT family family |
| 964 | phosphoribosylglycinamide formyltransferase (purN) |
| 968 | phosphoribosylformylglycinamidine cyclo-ligase (purM) |
| 972 | amidophosphoribosyltransferase (purF) |
| 980 | phosphoribosylformylglycinamidine synthase |
| 984 | phosphoribosylaminoimidazole-succinocarboxamide synthase (purC) |
| 1042 | oligoendopeptidase F (pepF) |
| 1060 | ebsC protein |
| 1068 | hydrolase, haloacid dehalogenase-like family |
| 1076 | riboflavin synthase, beta subunit (ribH) |
| 1082 | riboflavin biosynthesis protein RibD (ribD) |
| 1086 | Mn2+/Fe2+ transporter, NRAMP family |
| 1094 | peptidase, U32 family |
| 1116 | HPr(Ser) kinase/phosphatase (hprK) |
| 1130 | oxidoreductase |
| 1148 | signal recognition particle-docking protein FtsY (ftsY) |
| 1152 | Cof family protein |
| 1156 | Cof family protein |
| 1172 | vicX protein (vicX) |
| 1176 | sensory box sensor histidine kinase (vicK) |
| 1180 | DNA-binding response regulator (vicR) |
| 1184 | amino acid ABC transporter, ATP-binding protein |
| 1188 | amino acid ABC transporter, amino acid-binding protein (fliY) |
| 1192 | amino acid ABC transporter, permease protein |
| 1196 | amino acid ABC transporter, permease protein |
| 1208 | DNA-binding response regulator (vicR) |
| 1210 | threonyl-tRNA synthetase (thrS) |
| 1214 | glycosyl transferase, group 1 |
| 1218 | glycosyl transferase, group 1 (cpoA) |
| 1222 | alpha-amylase (amy) |
| 1230 | proline dipeptidase (pepQ) |
| 1238 | haloacid dehalogenase-like hydrolase superfamily |
| 1244 | mannonate dehydratase (uxuA) |
| 1248 | glucuronate isomerase |
| 1254 | transcriptional regulator, GntR family |
| 1268 | sodiumgalactoside symporter family protein |
| 1270 | D-isomer specific 2-hydroxyacid dehydrogenase family protein |
| 1282 | transcriptional regulator, LysR family |
| 1290 | ABC transporter, ATP-binding protein (potA) |
| 1296 | DedA family protein |
| 1308 | MutT/nudix family protein family |
| 1310 | phosphoserine phosphatase SerB (serB) |
| 1312 | septation ring formation regulator EzrA |
| 1320 | hydrolase, haloacid dehalogenase-like family (gph) |
| 1340 | sensor histidine kinase (vncS) |
| 1348 | transmembrane protein Vexp3 (vex3) |
| 1352 | ABC transporter, ATP-binding protein (vex2) |
| 1358 | transmembrane protein Vexp1 (vex1) |
| 1366 | transposase |
| 1374 | integrase, phage family |
| 1390 | holin 2 |
| 1398 | minor structural protein |
| 1400 | host specificity protein |
| 1404 | minor structural protein |
| 1406 | PblA |
| 1486 | homeobox protein drg11 |
| 1488 | reverse transcriptase |
| 1496 | p22 erf-like protein |
| 1498 | gp157 |
| 1500 | tropomyosin 2 |
| 1512 | gp49 homologous |
| 1526 | transcriptional regulator-related protein |
| 1566 | chorismate mutase |
| 1572 | PTS system component |
| 1576 | PTS system, IIB component |
| 1580 | PTS system IIA component |
| 1584 | lactose phosphotransferase system repressor (lacR) |
| 1594 | adhesion lipoprotein (lmb) |
| 1602 | GTP pyrophosphokinase (relA) |
| 1606 | 2',3'-cyclic-nucleotide 2'-phosphodiesterase (cpdB) |
| 1616 | iron ABC transporter, iron-binding protein |
| 1620 | DNA-binding response regulator |
| 1630 | PTS system component |

TABLE VI-continued

PREDICTED FUNCTIONS FOR CERTAIN SEQ IDs

| SEQ ID | Function |
| --- | --- |
| 1634 | PTS system component (manM) |
| 1638 | PTS system component (manL) |
| 1642 | PTS system component |
| 1658 | response regulator BlpR (blpR) |
| 1676 | phosphate transport system regulatory protein PhoU |
| 1680 | phosphate ABC transporter, ATP-binding protein (pstB) |
| 1684 | phosphate ABC transporter, permease protein (pstA) |
| 1690 | phosphate ABC transporter, permease protein (pstC) |
| 1694 | probable hemolysin precursor |
| 1704 | ribosomal protein L11 methyltransferase (prmA) |
| 1710 | transcriptional regulator, MerR family (skgA) |
| 1714 | acetyltransferase, GNAT family |
| 1716 | MutT/nudix family protein |
| 1722 | spermidine N1-acetyltransferase |
| 1726 | ATPase, AAA family |
| 1736 | ABC transporter domain protein |
| 1738 | Helix-turn-helix domain protein |
| 1748 | integrase, phage family |
| 1756 | Helix-turn-helix domain protein |
| 1762 | bacteriophage L54a, integrase |
| 1768 | LPXTG-motif cell wall anchor domain protein |
| 1776 | membrane protein |
| 1778 | conjugal transfer protein |
| 1780 | IS1381, transposase OrfA/OrfB, truncation |
| 1802 | transcriptional regulator (rstR-1) |
| 1806 | transcriptional regulator |
| 1808 | FtsK/SpoIIIE family protein |
| 1814 | aggregation substance |
| 1818 | mercuric reductase |
| 1822 | transcriptional regulator, MerR family |
| 1824 | Mn2+/Fe2+ transporter, NRAMP family |
| 1830 | ABC transporter, ATP-binding protein (epiF) |
| 1848 | Helix-turn-helix domain protein |
| 1850 | type 2 phosphatidic acid phosphatase(PAP2), family |
| 1858 | Abortive infection protein family |
| 1868 | aminotransferase, class-V |
| 1874 | glutathione reductase (gor) |
| 1882 | chorismate synthase (aroC) |
| 1886 | 3-dehydroquinate synthase (aroB) |
| 1900 | sulfatase family protein |
| 1914 | ABC transporter, ATP-binding protein |
| 1920 | smf protein (Smffamily) |
| 1924 | transferrin receptor |
| 1928 | iron compound ABC transporter, ATP-binding protein |
| 1932 | iron compound ABC transporter, permease protein |
| 1942 | acetyltransferase, CysE/LacA/LpxA/NodL family |
| 1952 | GTP-binding protein |
| 1958 | carbon starvation protein A |
| 1960 | response regulator (lytR) |
| 1962 | GAF domain protein (lytS) |
| 2000 | extracellular protein |
| 2004 | diarrheal toxin (yukA) |
| 2024 | carbamoyl-phosphate synthase, large subunit (carB) |
| 2028 | carbamoyl-phosphate synthase, small subunit (carA) |
| 2032 | aspartate carbamoyltransferase (pyrB) |
| 2036 | dihydroorotase, multifunctional complex type (pyrC) |
| 2040 | orotate phosphoribosyltransferase (pyrE) |
| 2048 | membrane protein |
| 2062 | phosphate ABC transporter, permease protein (pstA-2) |
| 2064 | phosphate ABC transporter, ATP-binding protein (pstB) |
| 2070 | phosphate transport system regulatory protein PhoU |
| 2072 | aminopeptidase N (pepN) |
| 2076 | DNA-binding response regulator (arlR) |
| 2080 | sensor histidine kinase (arlS) |
| 2088 | signal recognition particle protein (ffh) |
| 2102 | peptide ABC transporter, peptide-binding protein |
| 2104 | integrase/recombinase, phage integrase family |
| 2108 | sensor histidine kinase |
| 2112 | DNA-binding response regulator (vicR) |
| 2118 | ABC transporter, ATP-binding protein |
| 2122 | nisin-resistance protein |
| 2130 | lipoprotein |
| 2136 | gid protein (gid) |
| 2140 | transcriptional regulator, GntR family |
| 2142 | GMP synthase (guaA) |
| 2152 | branched-chain amino acid ABC transporter, permease protein (livM) |
| 2154 | branched-chain amino acid ABC transporter, ATP-binding protein (livG) |
| 2156 | branched-chain amino acid ABC transporter, ATP-binding protein (livF) |
| 2160 | acetoin utilization protein AcuB |
| 2174 | DNA polymerase III, delta prime subunit (holB) |
| 2186 | copper homeostasis protein (cutC) |
| 2190 | phosphoserine aminotransferase (serC) |
| 2202 | methylated-DNA--protein-cysteine S-methyltransferase (ogt) |
| 2208 | exodeoxyribonuclease III (xth) |
| 2214 | PTS system, IIC component |
| 2224 | tellurite resistance protein TehB (tehB) |
| 2246 | icaA protein |
| 2250 | acetyltransferase, GNAT family |
| 2258 | oxidoreductase, short chain dehydrogenase/reductase family (fabG) |
| 2266 | oxidoreductase, Gfo/ldh/MocA family family |
| 2268 | glyoxalase family protein |
| 2272 | UDP-N-acetylglucosamine pyrophosphorylase (glmU) |
| 2276 | MutT/nudix family protein |
| 2284 | 5-methylthioadenosine/S-adenosylhomocysteine nucleosidase (mtf) |
| 2296 | phosphatidate cytidylyltransferase (cdsA) |
| 2300 | membrane-associated zinc metalloprotease |
| 2308 | autolysin (flgJ) |
| 2312 | DNA polymerase III, alpha subunit, Gram-positive type |
| 2320 | nitroreductase family protein superfamily |
| 2326 | 4-hydroxy-2-oxoglutarate aldolase/2-deydro-3-deoxyphosphogluconate aldo |
| 2328 | carbohydrate kinase, PfkB family |
| 2336 | oxidoreductase, short chain dehydrogenase/reductase family (fabG) |
| 2338 | PTS system, IIA component (manL) |
| 2342 | glucuronyl hydrolase |
| 2346 | PTS system, IIB component (manL) |
| 2350 | PTS system, IIC component (manM) |
| 2364 | sugar binding transcriptional regulator RegR (regR) |
| 2368 | polypeptide deformylase (def) |
| 2380 | oxidoreductase, Gfo/ldh/MocA family |
| 2382 | endopeptidase O (pepO) |
| 2394 | Na+/H+ antiporter |
| 2404 | transcriptional regulator |
| 2410 | replication initiation protein RepRC |
| 2412 | bacteriophage L54a, antirepressor |
| 2416 | e11 |
| 2422 | replicative DNA helicase (dnaB) |
| 2432 | GTP-binding protein |
| 2440 | arpR protein |
| 2444 | gene 17 protein |
| 2458 | integrase/recombinase, phage integrase family |
| 2468 | bacteriophage L54a, phage D3 terminase |
| 2472 | protease |
| 2500 | PblB |
| 2504 | sensor histidine kinase |

TABLE VI-continued
PREDICTED FUNCTIONS FOR CERTAIN SEQ IDs

| SEQ ID | Function |
|---|---|
| 2514 | N-acetylmuramoyl-L-alanine amidase |
| 2518 | KH domain protein |
| 2522 | ribosomal protein S16 (rpsP) |
| 2526 | permease |
| 2528 | ABC transporter, ATP-binding protein |
| 2538 | carbamoyl-phosphate synthase, large subunit |
| 2540 | carbamoyl-phosphate synthase, small subunit (carA) |
| 2550 | transcriptional regulator, LysR family |
| 2554 | ribosomal protein L27 (rpmA) |
| 2562 | ribosomal protein L21 (rplU) |
| 2572 | glycerophosphoryl diester phosphodiesterase |
| 2582 | nitroreductase family protein |
| 2586 | dipeptidase (pepV) |
| 2614 | GTP-binding protein HflX (hflX) |
| 2618 | galactose-1-phosphate uridylyltransferase (galT) |
| 2626 | oxidoreductase, short chain dehydrogenase/reductase family |
| 2630 | single-stranded-DNA-specific exonuclease RecJ (recJ) |
| 2638 | adenine phosphoribosyltransferase (apt) |
| 2646 | Bcl-2 family protein |
| 2654 | oxidoreductase, DadA family protein |
| 2658 | glucose-1-phosphate thymidylyltransferase (rfbA) |
| 2664 | dTDP-4-dehydrorhamnose 3,5-epimerase (rfbC) |
| 2682 | hyaluronidase |
| 2686 | mutator MutT protein (mutX) |
| 2690 | MutT/nudix family protein |
| 2694 | membrane protein |
| 2702 | acetolactate synthase (ilvK) |
| 2706 | adherence and virulence protein A (pavA) |
| 2714 | ABC transporter, permease protein (rbsC) |
| 2722 | metallo-beta-lactamase superfamily protein |
| 2734 | ribose 5-phosphate isomerase (rpiA) |
| 2738 | phosphopentomutase (deoB) |
| 2742 | purine nucleoside phosphorylase, family 2 (deoD) |
| 2750 | purine nucleoside phosphorylase (deoD) |
| 2762 | capsular polysaccharide biosynthesis protein Cps4A (cps4A) |
| 2768 | cpsb protein |
| 2770 | cpsc protein |
| 2772 | CpsE |
| 2774 | CpsF |
| 2776 | CpsVG |
| 2778 | CpsVH |
| 2780 | CpsVM |
| 2782 | CpsVN |
| 2784 | glycosyl transferase domain protein |
| 2786 | glycosyl transferase, family 2/ glycosyl transferase family 8 |
| 2790 | CpsVK |
| 2794 | CpsL |
| 2796 | neuB protein |
| 2798 | UDP-N-acetylglucosamine 2-epimerase |
| 2800 | hexapeptide transferase family protein |
| 2802 | NeuA |
| 2808 | uracil-DNA glycosylase (ung) |
| 2818 | DNA topoisomerase IV, B subunit (parE) |
| 2822 | DNA topoisomerase IV, A subunit (parC) |
| 2826 | branched-chain amino acid aminotransferase (ilvE) |
| 2842 | glycerol kinase (glpK) |
| 2848 | aerobic glycerol-3-phosphate dehydrogenase (glpD) |
| 2874 | ABC transporter, ATP-binding protein |
| 2882 | PTS system component (bglP) |
| 2886 | glutamate 5-kinase (proB) |
| 2890 | gamma-glutamyl phosphate reductase (proA) |
| 2898 | cell division protein FtsL (ftsL) |
| 2904 | penicillin-binding protein 2X (pbpX) |
| 2910 | phospho-N-acetylmuramoyl-pentapeptide-transferase (mraY) |
| 2914 | ATP-dependent RNA helicase, DEAD/DEAH box family (deaD) |
| 2918 | ABC transporter, substrate-binding protein |
| 2924 | amino acid ABC transporter, permease protein |
| 2928 | amino acid ABC transporter, ATP-binding protein |
| 2932 | thioredoxin reductase (trxB) |
| 2940 | NAD + synthetase (nadE) |
| 2944 | aminopeptidase C (pepC) |
| 2952 | recombination protein U (recU) |
| 2966 | Uncharacterized protein family UPF0020 family |
| 2974 | autoinducer-2 production protein LuxS (luxS) |
| 2978 | KH domain protein |
| 2986 | ABC transporter, ATP-binding protein |
| 2994 | DNA-binding response regulator (vraR) |
| 3000 | guanylate kinase (gmk) |
| 3004 | DNA-directed RNA polymerase, omega subunit |
| 3008 | primosomal protein N (priA) |
| 3012 | methionyl-tRNA formyltransferase (fmt) |
| 3016 | Sun protein (sun) |
| 3020 | protein phosphatase 2C |
| 3032 | sensor histidine kinase |
| 3034 | DNA-binding response regulator (vraR) |
| 3036 | cof family protein/peptidyl-prolyl cis-trans isomerase, cyclophilin typ |
| 3040 | S1 RNA binding domain protein (rpsA) |
| 3044 | pyruvate formate-lyase-activating enzyme |
| 3062 | PTS system, IIB component (celA) |
| 3066 | PTS system, cellobiose-specific IIC component (celB) |
| 3068 | formate acetyltransferase (pfl) |
| 3072 | transaldolase |
| 3080 | cysteine synthase A (cysK) |
| 3088 | comF operon protein 1 (comFA) |
| 3092 | competence protein ComF |
| 3096 | ribosomal subunit interface protein (yfiA) |
| 3104 | tryptophanyl-tRNA synthetase (trpS) |
| 3108 | carbamate kinase (arcC) |
| 3116 | ornithine carbamoyltransferase (argF) |
| 3124 | arginine deiminase (arcA) |
| 3134 | transcriptional regulator, Crp/Fnr family |
| 3138 | inosine-5'-monophosphate dehydrogenase (guaB) |
| 3140 | MutR |
| 3142 | transporter |
| 3146 | recF protein (recF) |
| 3158 | peptidase, M16 family |
| 3166 | ABC transporter, ATP-binding protein |
| 3170 | ABC transporter, ATP-binding protein |
| 3178 | LysM domain protein (lytN) |
| 3180 | immunodominant antigen A (isaA) |
| 3184 | L-serine dehydratase, iron-sulfur-dependent, alpha subunit (sdhA) |
| 3188 | L-serine dehydratase, iron-sulfur-dependent, beta subunit (sdhB) |
| 3202 | DHH subfamily 1 protein |
| 3206 | ribosomal protein L9 (rpll) |
| 3210 | replicative DNA helicase (dnaB) |
| 3216 | ribosomal protein S4 (rpsD) |
| 3224 | transcriptional regulator, TetR family |
| 3236 | membrane protein |
| 3238 | choline transporter (proWX) |
| 3240 | glycine betaine/L-proline transport ATP binding subunit (proV) |
| 3242 | DNA-binding response regulator |
| 3244 | Histidine kinase-, DNA gyrase B-, phytochrome-like ATPase family |
| 3246 | ornithine carbamoyltransferase (argF) |
| 3248 | carbamate kinase (arcC) |
| 3252 | membrane protein |
| 3256 | sensory box histidine kinase VicK |
| 3258 | DNA-binding response regulator |
| 3268 | Helix-turn-helix domain protein |
| 3278 | integrase |
| 3284 | ribosomal protein L33 (rpmG) |
| 3288 | ribosomal protein L32 (rpmF) |
| 3300 | YitT family protein |
| 3304 | YitT family protein |
| 3320 | DNA mismatch repair protein MutS (mutS) |
| 3324 | cold-shock domain family protein-related protein |
| 3336 | drug transporter |
| 3340 | Holliday junction DNA helicase RuvA (ruvA) |
| 3352 | recA protein (recA) |
| 3386 | oxidoreductase, Gfo/ldh/MocA family |

TABLE VI-continued

PREDICTED FUNCTIONS FOR CERTAIN SEQ IDs

| SEQ ID | Function |
|---|---|
| 3390 | acetyltransferase, GNAT family |
| 3394 | anaerobic ribonucleoside-triphosphate reductase activating protein (nrd |
| 3412 | ABC transporter, permease protein (rbsC) |
| 3414 | ABC transporter, ATP-binding protein (nrtC) |
| 3416 | PTS system, mannose-specific IIAB components (manL) |
| 3420 | Cof family protein |
| 3432 | xanthine/uracil permease family protein |
| 3440 | acetyltransferase, GNAT family |
| 3442 | transcriptional regulator (cps4A) |
| 3448 | HIT family protein (hit) |
| 3460 | ABC transporter, permease protein |
| 3472 | Uncharacterized BCR, YhbC family COG0779 superfamily |
| 3484 | ribosomal protein L7A family |
| 3496 | esterase |
| 3500 | transcriptional repressor, CopY (copY) |
| 3504 | cation-transporting ATPase, E1-E2 family |
| 3508 | cation-binding protein-related protein |
| 3520 | DNA polymerase I (polA) |
| 3534 | DNA-binding response regulator (saeR) |
| 3536 | sensor histidine kinase (saeS) |
| 3562 | drug resistance transporter, EmrB/QacA subfamily |
| 3566 | peptidase M24 family protein |
| 3570 | peptidase M24 family protein (pepQ) |
| 3572 | cytidine/deoxycytidylate deaminase family protein |
| 3584 | translation elongation factor P (efp) |
| 3592 | N utilization substance protein B (nusB) |
| 3596 | sugar-binding transcriptional regulator, LacI family (scrR) |
| 3600 | sucrose-6-phosphate dehydrogenase (scrB) |
| 3606 | PTS system IIABC components (scrA) |
| 3610 | fructokinase (scrK) |
| 3614 | mannose-6-phosphate isomerase, class I (manA) |
| 3622 | phospho-2-dehydro-3-deoxyheptonate aldolase (aroH) |
| 3626 | holo-(acyl-carrier-protein) synthase (acpS) |
| 3630 | alanine racemase (alr) |
| 3634 | autolysin (usp45) |
| 3636 | ATP-dependent DNA helicase RecG (recG) |
| 3642 | shikimate 5-dehydrogenase (aroE) |
| 3652 | Cof family protein |
| 3668 | ferredoxin-related protein |
| 3676 | peptidase t (pepT) |
| 3684 | UDP-N-acetylmuramoylalanyl-D-glutamate--2,6-diaminopimelate ligase (mur |
| 3692 | iron compound ABC transporter, substrate-binding protein |
| 3698 | FecCD transport family protein (sirB) |
| 3704 | iron compound ABC transporter, permease protein (sirB) |
| 3710 | inorganic pyrophosphatase, manganese-dependent (ppaC) |
| 3714 | pyruvate formate-lyase-activating enzyme (pflA) |
| 3718 | CBS domain protein |
| 3730 | acid phosphatase |
| 3736 | LPXTG-motif cell wall anchor domain protein |
| 3738 | LPXTG-site transpeptidase family protein |
| 3742 | LPXTG-site transpeptidase family protein |
| 3744 | cell wall surface anchor family protein |
| 3746 | cell wall surface anchor family protein |
| 3752 | glycosyl transferase, group 1 family protein domain protein |
| 3754 | EpsQ protein |
| 3756 | polysaccharide extrusion protein |
| 3768 | dTDP-glucose 4-6-dehydratase |
| 3782 | glycosyl transferase domain protein |
| 3788 | dTDP-4-dehydrorhamnose reductase (rfbD) |
| 3796 | RNA polymerase sigma-70 factor (rpoD) |
| 3802 | DNA primase (dnaG) |
| 3816 | ABC transporter, ATP-binding protein Vexp2 (vex2) |
| 3818 | permease |
| 3820 | transmembrane protein Vexp3 |
| 3822 | transmembrane protein Vexp3 |
| 3832 | endopeptidase O (pepO) |

TABLE VI-continued

PREDICTED FUNCTIONS FOR CERTAIN SEQ IDs

| SEQ ID | Function |
|---|---|
| 3834 | endopeptidase O (pepO) |
| 3840 | serine protease, subtilase family |
| 3842 | exotoxin 2 |
| 3844 | CylK |
| 3854 | glycine cleavage system T protein |
| 3856 | CylE |
| 3858 | ABC transporter homolog CylB |
| 3862 | acyl carrier protein homolog AcpC (acpP) |
| 3864 | 3-oxoacyl-(acyl-carrier-protein) reductase (fabG) |
| 3868 | CylD |
| 3876 | membrane protein |
| 3912 | LPXTG-site transpeptidase family protein |
| 3916 | LPXTG-site transpeptidase family protein |
| 3918 | LPXTG-site transpeptidase family protein |
| 3920 | LPXTG-motif cell wall anchor domain protein |
| 3928 | chaperonin, 33 kDa (hslO) |
| 3932 | Tn5252, Orf 10 protein |
| 3934 | transposase OrfAB, subunit B |
| 3948 | psr protein |
| 3952 | shikimate kinase (aroK) |
| 3964 | enolase (eno) |
| 3972 | MutT/nudix family protein |
| 3976 | glycosyl transferase, group 1 |
| 3978 | preprotein translocase, SecA subunit (secA) |
| 3986 | preprotein translocase SecY family protein |
| 3990 | glycosyl transferase, family 8 |
| 3992 | glycosyl transferase, family 2 |
| 3998 | glycosyl transferase, family 8 |
| 4000 | glycosyl transferase, family 2/ glycosyl transferase family 8 |
| 4002 | glycosyl transferase, family 8 |
| 4012 | LPXTG-motif cell wall anchor domain protein (clfB) |
| 4016 | transcriptional regulator |
| 4018 | excinuclease ABC, B subunit (uvrB) |
| 4022 | Abortive infection protein family |
| 4024 | amino acid ABC transporter, amino acid-binding protein/permease protein |
| 4026 | amino acid ABC transporter, ATP-binding protein |
| 4034 | GTP-binding protein, GTP1/Obg family (obg) |
| 4042 | aminopeptidase PepS (pepS) |
| 4050 | ribosomal small subunit pseudouridine synthase A (rsuA) |
| 4060 | lactoylglutathione lyase (gloA) |
| 4064 | glycosyl transferase family protein |
| 4072 | alkylphosphonate utilization operon protein PhnA (phnA) |
| 4078 | glucosamine--fructose-6-phosphate aminotransferase (isomerizing) (glmS) |
| 4090 | Phosphofructokinase |
| 4094 | DNA polymerase III, alpha subunit (dnaE) |
| 4098 | transcriptional regulator, GntR family |
| 4102 | ABC transporter, ATP-binding protein |
| 4106 | ABC transporter, ATP-binding protein |
| 4116 | FtsK/SpoIIIE family protein |
| 4122 | Helix-turn-helix domain protein |
| 4152 | Helix-turn-helix domain protein |
| 4158 | excisionase |
| 4160 | transposase |
| 4166 | chloramphenicol acetyltransferase (cat) |
| 4174 | PilB-related protein |
| 4178 | acetyltransferase |
| 4182 | Leucine Rich Repeat domain protein |
| 4190 | nucleoside diphosphate kinase (ndk) |
| 4206 | Protein of unknown function superfamily |
| 4218 | hydrolase, haloacid dehalogenase-like family (pho2) |
| 4226 | oxygen-independent coproporphyrinogen III oxidase |
| 4236 | phosphoglucomutase/phosphomannomutase family protein (femD) |
| 4240 | Gram-positive signal peptide, YSIRK family domain protein |
| 4256 | cobyric acid synthase (cobQ) |
| 4260 | lipoate-protein ligase A (lplA) |
| 4264 | branched-chain alpha-keto acid dehydrogenase E3 component, lipoamide de |
| 4266 | pyruvate dehydrogenase complex, E2 component, dihydrolipoamide acetyltr |

TABLE VI-continued

PREDICTED FUNCTIONS FOR CERTAIN SEQ IDs

| SEQ ID | Function |
|---|---|
| 4270 | pyruvate dehydrogenase complex, E1 component, pyruvate dehydrogenase be |
| 4286 | magnesium transporter, CorA family |
| 4294 | exonuclease RexB (rexB) |
| 4302 | phenylalanyl-tRNA synthetase, beta subunit (pheT) |
| 4324 | ATP synthase F1, epsilon subunit (atpC) |
| 4328 | ATP synthase F1, beta subunit (atpD) |
| 4332 | ATP synthase F1, gamma subunit (atpG) |
| 4338 | ATP synthase F1, alpha subunit (atpA) |
| 4342 | ATP synthase F1, delta subunit (atpH) |
| 4346 | ATP synthase F0, B subunit (atpF) |
| 4350 | ATP synthase, F0 subunit A (atpB) |
| 4354 | proton-translocating ATPase, c subunit-related protein |
| 4360 | glycogen synthase (glgA) |
| 4362 | glycogen biosynthesis protein GlgD (glgD) |
| 4366 | 1,4-alpha-glucan branching enzyme (glgB) |
| 4368 | pullulanase |
| 4382 | ribonuclease BN |
| 4396 | acetyltransferase, GNAT family |
| 4398 | UDP-N-acetylglucosamine 1-carboxyvinyltransferase (murA) |
| 4402 | thiamine-phosphate pyrophosphorylase (thiE) |
| 4406 | phosphomethylpyrimidine kinase (thiD) |
| 4410 | transcriptional regulator, Deg family (tenA) |
| 4414 | ABC transporter, ATP-binding protein |
| 4426 | S-adenosylmethionine synthetase (metK) |
| 4440 | DNA polymerase III, gamma and tau subunits (dnaX) |
| 4444 | GAF domain protein |
| 4448 | uridine kinase (udk) |
| 4452 | ATP-dependent RNA helicase, DEAD/DEAH box family |
| 4458 | peptidoglycan GlcNAc deacetylase (pgdA) |
| 4462 | glyceraldehyde-3-phosphate dehydrogenase, NADP-dependent (gapN) |
| 4466 | phosphoenolpyruvate-protein phosphotransferase (ptsI) |
| 4470 | phosphocarrier protein hpr |
| 4474 | NrdH-redoxin-related protein |
| 4478 | ribonucleoside-diphosphate reductase 2, alpha subunit (nrdE) |
| 4498 | glycosyl transferase, family 8 |
| 4504 | alanyl-tRNA synthetase (alaS) |
| 4512 | alkyl hydroperoxide reductase, subunit F (ahpF) |
| 4516 | alkyl hydroperoxide reductase, subunit C (ahpC) |
| 4520 | ribosomal protein S2 (rpsB) |
| 4524 | translation elongation factor Ts (tsf) |
| 4532 | transcriptional regulator CtsR (ctsR) |
| 4536 | ATP-dependent Clp protease, ATP-binding subunit (clpC) |
| 4540 | deoxynucleoside kinase |
| 4544 | NifR3/Smm1 family protein |
| 4548 | chaperonin, 33 kDa (hslO) |
| 4558 | glutamate--cysteine ligase (gshA) |
| 4562 | Helix-turn-helix domain, fis-type protein |
| 4566 | perfringolysin O regulator protein (pfoR) |
| 4570 | adenylosuccinate synthetase (purA) |
| 4578 | SgaT protein (sgaT) |
| 4582 | PTS system, IIb component (sgaT) |
| 4586 | PTS system, IIA component (mtlA) |
| 4590 | hexulose-6-phosphate synthase |
| 4594 | hexulose-6-phosphate isomerase |
| 4598 | L-ribulose-5-phosphate 4-epimerase (araD) |
| 4606 | sugar binding transcriptional regulator RegR |
| 4610 | D-isomer specific 2-hydroxyacid dehydrogenase family protein (serA) |
| 4622 | transcriptional regulator, BglG family |
| 4632 | glycine betaine/L-proline transport ATP binding subunit (proV) |
| 4636 | amino acid ABC transporter, permease protein |
| 4644 | Na+/H+ exchanger family protein (kefB) |
| 4648 | glyoxylase family protein |
| 4652 | LPXTG-site transpeptidase family protein |
| 4656 | DNA gyrase, A subunit (gyrA) |
| 4660 | L-lactate dehydrogenase (ldh) |
| 4664 | NADH oxidase (nox) |
| 4680 | lipoprotein (bmpD) |
| 4690 | pantothenate kinase (coaA) |
| 4694 | ribosomal protein S20 (rpsT) |
| 4698 | amino acid ABC transporter, amino acid-binding protein (aatB) |
| 4702 | amino acid ABC transporter, ATP-binding protein |
| 4726 | ribosomal large subunit pseudouridine synthase B (rluB) |
| 4734 | Uncharacterized ACR, COG1354 |
| 4738 | integrase/recombinase, phage integrase family (xerD) |
| 4742 | CBS domain protein |
| 4746 | phosphoesterase |
| 4750 | HAM1 protein |
| 4768 | transcriptional regulator, biotin repressor family |
| 4792 | amino acid ABC transproter, permease protein |
| 4796 | amino acid ABC transporter, substrate-binding protein |
| 4798 | 6-aminohexanoate-cyclic-dimer hydrolase |
| 4800 | transcription elongation factor GreA (greA) |
| 4804 | Uncharacterized BCR, YceG family COG1559 |
| 4812 | UDP-N-acetylmuramate--alanine ligase (murC) |
| 4822 | Snf2 family protein |
| 4828 | GTP-binding protein (b2511) |
| 4832 | primosomal protein DnaI (dnaI) |
| 4844 | sensor histidine kinase (arlS) |
| 4846 | DNA-binding response regulator (arlR) |
| 4852 | heat shock protein HtpX (htpX) |
| 4870 | potassium uptake protein, Trk family |
| 4874 | ABC transporter, ATP-binding protein |
| 4888 | phosphoglycerate kinase (pgk) |
| 4896 | transcriptional regulator, MerR family |
| 4900 | glutamine synthetase, type I (glnA) |
| 4904 | secreted 45 kd protein (usp45) |
| 4908 | metallo-beta-lactamase superfamily protein |
| 4916 | glycoprotease family protein |
| 4926 | glycoprotease family protein (gcp) |
| 4938 | ribosomal protein S14p/S29e (rpsN) |
| 4952 | exonuclease (dnaQ) |
| 4956 | transcriptional regulator, merR family |
| 4958 | cyclopropane-fatty-acyl-phospholipid synthase (cfa) |
| 4970 | 1,4-dihydroxy-2-naphthoate octaprenyltransferase (menA) |
| 4972 | pyridine nucleotide-disulphide oxidoreductase (ndh) |
| 4974 | cytochrome d oxidase, subunit I (cydA) |
| 4976 | cytochrome d ubiquinol oxidase, subunit II (cydB) |
| 4980 | transport ATP-binding protein CydD |
| 4988 | polyprenyl synthetase (ispB) |
| 4990 | X-pro dipeptidyl-peptidase (pepX) |
| 4998 | drug transporter |
| 5002 | universal stress protein family |
| 5004 | glycerol uptake facilitator protein (glpF) |
| 5012 | cppA protein (cppA) |
| 5034 | exodeoxyribonuclease V, alpha subunit (recD) |
| 5038 | Signal peptidase I |
| 5042 | ribonuclease HIII (rnhC) |
| 5062 | transcriptional regulator |
| 5068 | maltose ABC transporter, permease protein (malD) |
| 5072 | maltose ABC transporter, permease protein (malC) |
| 5088 | ABC transporter, ATP-binding protein |
| 5092 | ABC transporter, permease protein |
| 5106 | spspoJ protein (spo0J) |
| 5114 | DNA polymerase III, beta subunit (dnaN) |
| 5118 | Diacylglycerol kinase catalytic domain (presumed) protein |
| 5138 | transcription-repair coupling factor (mfd) |
| 5142 | S4 domain protein |
| 5156 | MesJ/Ycf62 family protein |
| 5160 | hypoxanthine phosphoribosyltransferase (hpt) |
| 5164 | cell division protein FtsH (ftsH) |
| 5172 | hydrolase, haloacid dehalogenase-like family (b2690) |
| 5178 | transcriptional regulator, MarR family |
| 5182 | 3-oxoacyl-(acyl-carrier-protein) synthase III (fabH) |

TABLE VI-continued

PREDICTED FUNCTIONS FOR CERTAIN SEQ IDs

| SEQ ID | Function |
| --- | --- |
| 5190 | enoyl-(acyl-carrier-protein) reductase (fabK) |
| 5194 | malonyl CoA-acyl carrier protein transacylase (fabD) |
| 5198 | 3-oxoacyl-+acyl-carrier protein+ reductase (fabG) |
| 5200 | 3-oxoacyl-(acyl-carrier-protein) synthase II (fabF) |
| 5202 | acetyl-CoA carboxylase, biotin carboxyl carrier protein (accB) |
| 5206 | (3R)-hydroxymyristoyl-(acyl-carrier-protein) dehydratase (fabZ) |
| 5210 | acetyl-CoA carboxylase, biotin carboxylase (accC) |
| 5214 | acetyl-CoA carboxylase, carboxyl transferase, beta subunit (accD) |
| 5218 | acetyl-CoA carboxylase, carboxyl transferase, alpha subunit (accA) |
| 5224 | seryl-tRNA synthetase (serS) |
| 5234 | PTS system, mannose-specific IID component |
| 5246 | ribosomal large subunit pseudouridine synthase, RluD subfamily (rluD) |
| 5254 | GTP pyrophosphokinase (relA) |
| 5266 | ribose-phosphate pyrophosphokinase (prsA) |
| 5270 | aminotransferase, class-V |
| 5274 | DNA-binding protein |
| 5282 | Domain of unknown function |
| 5290 | platelet activating factor |
| 5296 | transcriptional regulator, AraC family |
| 5302 | voltage-gated chloride channel family protein |
| 5318 | spermidine/putrescine ABC transporter, ATP-binding protein (potA) |
| 5320 | UDP-N-acetylenolpyruvoylglucosamine reductase (murB) |
| 5324 | bifunctional folate synthesis protein (folK) |
| 5328 | dihydroneopterin aldolase (folB) |
| 5332 | dihydropteroate synthase (folP) |
| 5336 | GTP cyclohydrolase I (folE) |
| 5344 | rarD protein (rarD) |
| 5348 | homoserine kinase (thrB) |
| 5354 | Polysaccharide deacetylase family (icaB) |
| 5362 | osmoprotectant transporter, BCCT family (opuD) |
| 5384 | thiol peroxidase (psaD) |
| 5388 | hydrolase |
| 5390 | transcriptional regulator, GntR family |
| 5402 | gls24 protein |
| 5424 | uncharacterized domain 1 |
| 5440 | cation efflux family protein |
| 5454 | dihydroorotate dehydrogenase A (pyrDa) |
| 5458 | beta-lactam resistance factor (fibB) |
| 5462 | beta-lactam resistance factor (fibA) |
| 5474 | HD domain protein |
| 5482 | cation-transporting ATPase, E1-E2 family |
| 5486 | fructose-1,6-bisphosphatase (fbp) |
| 5488 | iron-sulfur cluster-binding protein |
| 5492 | peptide chain release factor 2 (prfB) |
| 5496 | cell division ABC transporter, ATP-binding protein FtsE (ftsE) |
| 5504 | carboxymethylenebutenolidase-related protein |
| 5506 | metallo-beta-lactamase superfamily protein |
| 5514 | DNA polymerase III, epsilon subunit/ATP-dependent helicase DinG |
| 5520 | asparaginyl-tRNA synthetase (asnS) |
| 5526 | inosine-uridine preferring nucleoside hydrolase (iunH) |
| 5528 | general stress protein 170 |
| 5534 | Uncharacterised protein family superfamily |
| 5538 | Uncharacterized BCR, COG1481 |
| 5546 | zinc ABC transporter, zinc-binding adhesion liprotein (adcA) |
| 5560 | isochorismatase family protein (entB) |
| 5566 | 3-hydroxybutyryl-CoA dehydrogenase |
| 5572 | pyruvate phosphate dikinase (ppdK) |
| 5574 | glutamyl-tRNA(Gln) amidotransferase, C subunit (gatC) |
| 5580 | glutamyl-tRNA(Gln) amidotransferase, A subunit (gatA) |
| 5594 | GTP-binding protein |
| 5612 | iojap-related protein |
| 5626 | transcriptional regulator SkgA (skgA) |
| 5630 | glycerol uptake facilitator protein (glpF) |
| 5634 | dihydroxyacetone kinase family protein |
| 5638 | dihydroxyacetone kinase family protein |
| 5640 | transcriptional regulator, tetR family |
| 5646 | dihydroxyacetone kinase family protein |
| 5654 | glutamine amidotransferase, class I |
| 5666 | peptidase, M20/M25/M40 family |
| 5668 | ABC transporter, ATP-binding protein |
| 5686 | pur operon repressor (purR) |
| 5690 | cmp-binding-factor 1 (cbf1) |
| 5694 | competence-induced protein Ccs50 (ccs50) |
| 5702 | ribulose-phosphate 3-epimerase (rpe) |
| 5710 | rRNA (guanine-N1-)-methyltransferase (rrmA) |
| 5712 | dimethyladenosine transferase (ksgA) |
| 5718 | primase-related protein |
| 5726 | endosome-associated protein |
| 5728 | CG17785 gene product |
| 5734 | dltD protein (dltD) |
| 5738 | D-alanyl carrier protein-related protein |
| 5742 | dltB protein (dltB) |
| 5754 | DNA-binding response regulator (arlR) |
| 5756 | ribosomal protein L34 (rpmH) |
| 5766 | penicillin-binding protein 4 (pbp4) |
| 5770 | intein-containing protein |
| 5774 | NifU family protein |
| 5778 | aminotransferase, class-V |
| 5782 | Uncharacterized protein family (UPF0051) family |
| 5786 | ABC transporter, ATP-binding protein |
| 5790 | glycosyl transferase domain protein (llm) |
| 5794 | transcriptional regulator MecA (mecA) |
| 5798 | undecaprenol kinase |
| 5806 | amino acid ABC transporter, amino acid-binding protein/permease protein |
| 5808 | amino acid ABC transporter, ATP-binding protein |
| 5834 | riboflavin biosynthesis protein RibF (ribF) |
| 5850 | type I restriction-modification system, S subunit |
| 5860 | lipoprotein |
| 5862 | aggregation substance |
| 5866 | ID479 |
| 5896 | type II DNA modification methyltransferase Spn5252IP (spn5252IMP) |
| 5916 | ribosomal protein L10 (rplJ) |
| 5922 | ATP-dependent Clp protease, ATP-binding subunit ClpC (clpC) |
| 5926 | homocysteine S-methyltransferase (mmuM) |
| 5932 | transcriptional regulator, TetR family |
| 5938 | GTP-binding protein (cgpA) |
| 5952 | thymidylate synthase (thyA) |
| 5956 | condensing enzyme, FabH-related |
| 5960 | hydroxymethylglutaryl-CoA reductase, degradative |
| 5974 | gene_idK21C13.21~pir||T04769~ strong similarity to unknown protein, put |
| 5976 | FMN-dependent dehydrogenase family protein |
| 5980 | phosphomevalonate kinase |
| 5986 | diphosphomevalonate decarboxylase (mvaD) |
| 5990 | mevalonate kinase (mvk) |
| 5994 | Histidine kinase-, DNA gyrase B-, phytochrome-like ATPase family (PhoR1 |
| 6002 | GTP pyrophosphokinase (relA) |
| 6006 | transposase for insertion sequence element is904 |
| 6016 | 5'-nucleotidase family |
| 6018 | polypeptide deformylase (def) |
| 6022 | NADP-specific glutamate dehydrogenase (gdhA) |
| 6026 | ABC transporter, ATP-binding/permease protein |
| 6028 | ABC transporter, ATP-binding/permease protein |
| 6030 | acetyltransferase, GNAT family family |
| 6032 | ABC transporter, ATP-binding protein |
| 6040 | degV family protein (degV) |
| 6056 | carbohydrate kinase, PfkB family (fruB) |
| 6064 | beta-lactam resistance factor (fibB) |
| 6070 | 2-dehydropantoate 2-reductase |
| 6076 | PTS system component |
| 6078 | pyridine nucleotide-disulphide oxidoreductase family protein (trxB) |
| 6082 | tRNA (guanine-N1-)-methyltransferase (trmD) |
| 6092 | c5a peptidase precursor |
| 6100 | ParA |
| 6102 | transposase family protein (orfA) |

TABLE VI-continued

PREDICTED FUNCTIONS FOR CERTAIN SEQ IDs

| SEQ ID | Function |
|---|---|
| 6116 | Tn5252, relaxase |
| 6120 | Tn5252, Orf 10 protein |
| 6124 | mercuric reductase |
| 6126 | transcriptional regulator, MerR family |
| 6132 | cation transport ATPase, E1-E2 family |
| 6138 | cation-transporting ATPase, E1-E2 family |
| 6140 | cation-transporting ATPase, E1-E2 family |
| 6144 | cation-transporting ATPase, E1-E2 family |
| 6146 | transcriptional repressor, CopY (copY) |
| 6150 | cadmium resistance transporter |
| 6158 | membrane protein |
| 6162 | flavoprotein (dfp) |
| 6170 | lipoate-protein ligase A |
| 6174 | FMN oxidoreductase (nemA) |
| 6178 | Bacterial luciferase superfamily |
| 6182 | glycine cleavage system H protein (gcvH) |
| 6186 | Domain of unknown function |
| 6194 | lipoate-protein ligase A (lplA) |
| 6198 | formate--tetrahydrofolate ligase (fhs) |
| 6202 | cardiolipin synthetase (cls) |
| 6220 | aminotransferase, class II (aspB) |
| 6222 | RNA methyltransferase, TrmH family, group 2 |
| 6232 | 60 kda chaperonin |
| 6242 | purine nucleoside phosphorylase (deoD) |
| 6248 | deoxyribose-phosphate aldolase (deoC) |
| 6254 | Lyme disease proteins of unknown function |
| 6258 | ribosomal large subunit pseudouridine synthase, RluD subfamily (rluD) |
| 6262 | penicillin-binding protein 2A (pbp2A) |
| 6266 | pathenogenicity protein |
| 6268 | transcription antitermination protein NusG (nusG) |
| 6272 | glycosyl transferase, family 8 |
| 6276 | glycosyl transferase, family 8 |
| 6284 | sugar transporter family protein |
| 6292 | sensory box histidine kinase |
| 6306 | homocysteine S-methyltransferase (metH) |
| 6310 | glycerol dehydrogenase |
| 6312 | DNA topology modulation protein FlaR |
| 6316 | translation initiation factor IF-1 (infA) |
| 6320 | adenylate kinase (adk) |
| 6326 | ribosomal protein L15 (rplO) |
| 6330 | ribosomal protein L30 (rpmD) |
| 6336 | ribosomal protein S5 (rpsE) |
| 6344 | ribosomal protein L6 (rplF) |
| 6348 | ribosomal protein S8 (rpsH) |
| 6352 | ribosomal protein S14 (rpsN) |
| 6356 | ribosomal protein L5 (rplE) |
| 6360 | ribosomal protein L24 (rplX) |
| 6366 | ribosomal protein L14 (rplN) |
| 6368 | ribosomal protein S17 (rpsQ) |
| 6372 | ribosomal protein L29 (rpmC) |
| 6374 | ribosomal protein L16 (rplP) |
| 6378 | ribosomal protein S3 (rpsC) |
| 6382 | ribosomal protein L22 (rplV) |
| 6386 | ribosomal protein S19 (rpsS) |
| 6390 | ribosomal protein L2 (rplB) |
| 6394 | ribosomal protein L23 (rplW) |
| 6398 | ribosomal protein L4/L1 family (rplD) |
| 6402 | ribosomal protein L3 (rplC) |
| 6408 | ribosomal protein S10 (rpsJ) |
| 6414 | MATE efflux family protein |
| 6418 | threonine synthase (thrC) |
| 6428 | Uncharacterized BCR, COG1636 superfamily |
| 6436 | 4-alpha-glucanotransferase (malQ) |
| 6440 | glycogen phosphorylase family protein (malP) |
| 6444 | glycerol-3-phosphate transporter (glpT) |
| 6452 | rhodanese family protein |
| 6458 | ammonium transporter |
| 6464 | DNA repair protein RadA (radA) |
| 6472 | oxidoreductase, pyridine nucleotide-disulfide, class I |
| 6478 | ribose ABC transporter, periplasmic D-ribose-binding protein (rbsB) |
| 6484 | ribose ABC transporter, ATP-binding protein (rbsA) |
| 6486 | ribose ABC transporter protein (rbsD) |
| 6488 | ribokinase (rbsK) |
| 6498 | ABC transporter, ATP-binding protein |
| 6502 | DNA-binding response regulator (vicR) |
| 6506 | argininosuccinate synthase (argG) |
| 6508 | argininosuccinate lyase (argH) |
| 6514 | bacteriophage L54a, repressor protein |
| 6528 | soluble transducer HtrXIII |
| 6542 | probable transposase (insertion sequence IS861) |
| 6544 | ABC transporter, ATP-binding/permease protein |
| 6550 | ABC transporter, ATP-binding/permease protein |
| 6560 | Serine hydroxymethyltransferase |
| 6568 | HemK protein (hemK) |
| 6572 | peptide chain release factor 1 (prfA) |
| 6576 | thymidine kinases |
| 6580 | 4-oxalocrotonate tautomerase (dmpI) |
| 6588 | oxidoreductase |
| 6594 | oxidoreductase |
| 6600 | formate/nitrite transporter family protein |
| 6608 | xanthine permease (pbuX) |
| 6612 | xanthine phosphoribosyltransferase (xpt) |
| 6616 | guanosine monophosphate reductase (guaC) |
| 6620 | drug resistance transporter, EmrB/QacA subfamily |
| 6622 | oxidoreductase |
| 6624 | Kup system potassium uptake protein (kup) |
| 6636 | O-methyltransferase |
| 6642 | oligoendopeptidase F (pepF) |
| 6646 | competence protein CoiA (coiA) |
| 6650 | major facilitator superfamily protein superfamily |
| 6652 | ribosomal small subunit pseudouridine synthase A (rsuA) |
| 6658 | glucosamine-6-phosphate isomerase (nagB) |
| 6662 | nodulin-related protein, truncation |
| 6664 | S-adenosylmethioninetRNA ribosyltransferase-isomerase (queA) |
| 6674 | permease, GntP family |
| 6684 | 6-phospho-beta-glucosidase (bglA) |
| 6686 | PTS system, beta-glucosides-specific IIABC components |
| 6688 | transcription antiterminator LicT (licT) |
| 6704 | esterase |
| 6706 | sugar-binding transcriptional repressor, LacI family |
| 6708 | hydrolase, haloacid dehalogenase-like family |
| 6712 | DNA internalization-related competence protein ComEC/Rec2 |
| 6716 | competence protein CelA (celA) |
| 6720 | acyltransferase family protein |
| 6732 | ATP-dependent RNA helicase DeaD (deaD) |
| 6736 | lipoprotein, YaeC family |
| 6738 | ABC transporter, permease protein |
| 6752 | diacylglycerol kinase (dgkA) |
| 6768 | formamidopyrimidine-DNA glycosylase (mutM) |
| 6776 | epidermin immunity protein F |
| 6788 | glycyl-tRNA synthetase, beta subunit (glyS) |
| 6790 | acyl carrier protein phosphodiesterase |
| 6800 | SsrA-binding protein (smpB) |
| 6822 | D-alanine--D-alanine ligase |
| 6824 | recombination protein RecR (recR) |
| 6830 | penicillin-binding protein 2b |
| 6832 | phosphoglycerate mutase (gpmA) |
| 6836 | triosephosphate isomerase (tpiA) |
| 6856 | phosphoglycerate mutase family protein |
| 6860 | D-alanyl-D-alanine carboxypeptidase family |
| 6864 | autolysin |
| 6868 | heat-inducible transcription repressor HrcA (hrcA) |
| 6872 | heat shock protein GrpE (grpE) |
| 6876 | chaperone protein dnaK |
| 6880 | dnaJ protein (dnaJ) |
| 6884 | transcriptional regulator, gntR family domain protein |
| 6888 | tRNA pseudouridine synthase A (truA) |
| 6892 | phosphomethylpyrimidine kinase (thiD) |
| 6910 | galactose-6-phosphate isomerase, LacA subunit (lacA) |
| 6922 | tagatose 1,6-diphosphate aldolase (lacD) |
| 6932 | sugar ABC transporter, ATP-binding protein (msmK) |

TABLE VI-continued

PREDICTED FUNCTIONS FOR CERTAIN SEQ IDs

| SEQ ID | Function |
|---|---|
| 6936 | glucan 1,6-alpha-glucosidase (dexB) |
| 6940 | UDP-glucose 4-epimerase (galE) |
| 6942 | response regulator (citB) |
| 6950 | citrate carrier protein (citS) |
| 6954 | malate oxidoreductase (tme) |
| 6958 | bacterocin transport accessory protein |
| 6976 | transposase family protein (orfA) |
| 6980 | pXO1-128 |
| 6986 | adhesion lipoprotein (lmb) |
| 6994 | DNA-directed RNA polymerase, alpha subunit (rpoA) |
| 6998 | ribosomal protein L17 (rplQ) |
| 7040 | probable dna-directed rna polymerase delta subunit |
| 7044 | CTP synthase (pyrG) |
| 7058 | bacteriocin transport accessory protein |
| 7074 | translation initiation factor IF-3 (infC) |
| 7100 | adenosine deaminase |
| 8468 | preprotein translocase, SecE subunit |
| 8476 | antigen, 67 kDa |
| 8486 | Lipase/Acylhydrolase |
| 8492 | peptide ABC transporter, permease protein (oppB) |
| 8494 | competence protein CglB (cglB) |
| 8502 | peptide ABC transporter, peptide-binding protein |
| 8504 | oxidoreductase |
| 8510 | amino acid ABC transporter, permease protein (opuBB) |
| 8522 | abc transporter atp-binding protein ybhf |
| 8530 | glycerol-3-phosphate dehydrogenase (NAD(P)+) (gpsA) |
| 8538 | sugar ABC transporter, sugar-binding protein |
| 8544 | secreted 45 kd protein (usp45) |
| 8556 | phosphoglycerate mutase family protein |
| 8566 | glycosyl hydrolase, family 3 |
| 8576 | N-acetylmuramoyl-L-alanine amidase |
| 8596 | sensory box histidine kinase (withHAMPandPASd) |
| 8608 | aminoglycoside 6-adenylyltransferase |
| 8622 | iron compound ABC transporter, permease protein (sirB) |
| 8636 | phosphate ABC transporter, permease protein (pstC-2) |
| 8650 | branched-chain amino acid transport system II carrier protein (brnQ) |
| 8658 | PTS system, IID component |
| 8662 | replisome organiser-related protein |
| 8674 | alkaline amylopullulanase |
| 8676 | exfoliative toxin A |
| 8690 | glycerol uptake facilitator protein (glpF) |
| 8698 | ABC transporter, ATP-binding protein |
| 8706 | CDP-diacylglycerol--glycerol-3-phosphate 3-phosphatidyltransferase (pgs |
| 8708 | cobalt transport protein |
| 8730 | integral membrane protein |
| 8734 | yadS protein |
| 8736 | cell wall surface anchor family protein |
| 8748 | polysaccharide biosynthesis protein |
| 8752 | glycosyl transferase domain protein |
| 8764 | endopeptidase O |
| 8770 | beta-ketoacyl-acyl carrier protein synthase II |
| 8772 | ABC transporter, ATP-binding protein |
| 8776 | penicillin-binding protein |
| 8778 | cell wall surface anchor family protein |
| 8780 | cell wall surface anchor family protein |
| 8786 | LPXTG-motif cell wall anchor domain protein |
| 8788 | 6-aminohexanoate-cyclic-dimer hydrolase |
| 8796 | NLP/P60 family protein |
| 8802 | DNA/RNA non-specific endonuclease |
| 8806 | hydroxyethylthiazole kinase (thiM) |
| 8826 | PTS system component |
| 8832 | sugar ABC transporter, permease protein |
| 8836 | potassium uptake protein, Trk family (trkA) |
| 8850 | lemA protein (lemA) |
| 8856 | cobalt transport protein |
| 8882 | spermidine/putrescine ABC transporter, spermidine/putrescine-binding pr |
| 8884 | spermidine/putrescine ABC transporter, |

| SEQ ID | Function |
|---|---|
|  | permease protein (potC) |
| 8906 | ABC transporter, substrate-binding protein |
| 8908 | lipoprotein |
| 8916 | sensor histidine kinase |
| 8930 | TrsK-like protein (traK) |
| 8936 | R5 protein |
| 8962 | chromosome assembly protein homolog |
| 8978 | ribose ABC transporter, permease protein (rbsC) |
| 8980 | permease |
| 8982 | sensor histidine kinase (arlS) |
| 8986 | hydrolase, haloacid dehalogenase-like family (gph) |
| 8994 | dephospho-CoA kinase |
| 8996 | oxalate:formate antiporter |
| 9004 | sensory box protein |
| 9006 | host cell surface-exposed lipoprotein |
| 9012 | PAP2 family protein |
| 9034 | GtrA family protein |
| 9050 | lipoprotein signal peptidase (lspA) |
| 9280 | alcohol dehydrogenase, zinc-containing (adh) |
| 9284 | trigger factor (tig) |
| 9290 | fructose-bisphosphate aldolase (fba) |
| 9292 | DAK2 domain protein |
| 9296 | oligopeptide ABC transporter, permease protein |
| 9298 | N-acetylglucosamine-6-phosphate deacetylase (nagA) |
| 9300 | transcriptional regulator, DeoR family (lacR) |
| 9302 | PTS system, mannose-specific IIC component (manM) |
| 9306 | Phosphoglucose isomerase |
| 9310 | aspartate--ammonia ligase (asnA) |
| 9312 | amino acid ABC transporter, ATP-binding protein |
| 9314 | DNA-binding protein HU (hup) |
| 9316 | DHH subfamily 1 protein |
| 9318 | chloride channel |
| 9320 | integrase (int) |
| 9324 | DNA/RNA non-specific endonuclease |
| 9326 | PTS system component |
| 9328 | cell division protein, FtsW/RodA/SpoVE family (ftsW) |
| 9330 | LPXTG-motif cell wall anchor domain protein |
| 9332 | peptide chain release factor 3 (prfC) |
| 9334 | ABC transporter, ATP-binding protein |
| 9336 | superoxide dismutase +mn-fe+ |
| 9340 | phenylalanyl-tRNA synthetase, alpha subunit (pheS) |
| 9342 | amino acid ABC transporter, permease protein |
| 9344 | phosphate ABC transporter, phosphate-binding protein (pstS) |
| 9346 | NOL1/NOP2/sun family protein (sun) |
| 9348 | Abortive infection protein family |
| 9350 | permease |
| 9352 | N-acetylmuramoyl-L-alanine amidase domain protein (usp45) |
| 9354 | ABC transporter, ATP-binding protein |
| 9356 | phosphoglucomutase (pgm) |
| 9358 | oxidoreductase, short chain dehydrogenase/reductase family |
| 9360 | phosphate acetyltransferase |
| 9362 | gl24 protein |
| 9364 | ribosomal protein S1 (rpsA) |
| 9368 | dTDP-glucose 4,6-dehydratase (rfbB) |
| 9370 | excinuclease ABC, C subunit (uvrC) |
| 9372 | MATE efflux family protein |
| 9378 | amino acid permease (rocE) |
| 9380 | DNA-binding response regulator TrcR (trcR) |
| 9382 | 16S rRNA processing protein RimM (rimM) |
| 9384 | transcriptional regulator |
| 9388 | ribosomal protein L20 (rplT) |
| 9394 | sugar-binding transcriptional repressor, LacI family (malR) |
| 9396 | proton/peptide symporter family protein |
| 9398 | amino acid permease |
| 9400 | exoribonuclease, VacB/Rnb family (vacB) |
| 9402 | multi-drug resistance efflux pump (pmrA) |
| 9404 | adhesion lipoprotein (psaA) |
| 9406 | iron-dependent transcriptional regulator (sirR) |

TABLE VI-continued

PREDICTED FUNCTIONS FOR CERTAIN SEQ IDs

| SEQ ID | Function |
| --- | --- |
| 9410 | branched-chain amino acid ABC transporter, amino acid-binding protein ( |
| 9412 | amino acid permease |
| 9414 | SpoU rRNA Methylase family protein |
| 9416 | sodium/dicarboxylate symporter (gltP-2) |
| 9418 | branched-chain amino acid transport system II carrier protein (brnQ) |
| 9420 | alcohol dehydrogenase, zinc-containing |
| 9422 | aminotransferase, class I (aspB) |
| 9424 | ribosomal protein S6 (rpsF) |
| 9426 | A/G-specific adenine glycosylase (mutY) |
| 9428 | acid phosphatase (olpA) |
| 9430 | ribosomal protein S12 (rpsL) |
| 9434 | microcin immunity protein MccF (mccF-1) |
| 9436 | undecaprenyl diphosphate synthase (uppS) |
| 9438 | preprotein translocase, YajC subunit (yajC) |
| 9440 | chaperonin, 10 kDa (groES) |
| 9444 | YitT family protein |
| 9446 | serine protease (htrA) |
| 9448 | ribose-phosphate pyrophosphokinase (prsA) |
| 9450 | aromatic amino acid aminotransferase (araT) |
| 9452 | Recombination protein O (recO) |
| 9454 | Abortive infection protein family |
| 9456 | fatty acid/phospholipid synthesis protein PlsX (plsX) |
| 9458 | acyl carrier protein (acpP) |
| 9462 | phosphoribosylaminoimidazole carboxylase, ATPase subunit (purK) |
| 9464 | alcohol dehydrogenase, iron-containing |
| 9466 | ribosomal protein L18 (rplR) |
| 9468 | preprotein translocase, SecY subunit |
| 9470 | transcriptional regulator ConnX1 (comX1) |
| 9472 | deoxyuridine 5'-triphosphate nucleotidohydrolase (dut) |
| 9478 | sugar-binding transcriptional regulator, LacI family (rbsR) |
| 9480 | SPFH domain/Band 7 family |
| 9488 | zinc ABC transporter, permease protein (adcB) |
| 9492 | abortive infection protein |
| 9494 | hydrolase, haloacid dehalogenase-like family |
| 9496 | response regulator (lytT) |
| 9500 | transketolase, C-terminal subunit |
| 9502 | polyribonucleotide nucleotidyltransferase (pnp) |
| 9504 | serine O-acetyltransferase (cysE) |
| 9508 | ribosomal protein L13 (rplM) |
| 9510 | replication initiation protein |
| 9518 | amino acid ABC transporter, amino acid-binding protein |
| 9522 | glycyl-tRNA synthetase, alpha subunit (glyQ) |
| 9524 | NADH oxidase |
| 9528 | transketolase (tkt) |
| 9534 | penicillin-binding protein 1A (pbp1A) |
| 9536 | cell division protein DivIVA (divIVA) |
| 9538 | sensor histidine kinase |
| 9540 | serine/threonine protein kinase (pknB) |
| 9542 | transcriptional regulator |
| 9544 | PTS system, IIA component (lacF) |
| 9546 | glycerol dehydrogenase (gldA) |
| 9548 | aspartate kinase (thrA) |
| 9550 | enoyl-CoA hydratase/isomerase family protein |
| 9552 | acyl carrier protein (acpP) |
| 9564 | ABC transporter, ATP-binding protein |
| 9566 | N utilization substance protein A (nusA) |
| 9568 | ribosome-binding factor A (rbfA) |
| 9570 | Cof family protein |
| 9572 | CoA binding domain protein (b0965) |
| 9574 | transcriptional regulator, Fur family |
| 9578 | queuine tRNA-ribosyltransferase (tgt) |
| 9580 | ribonuclease P protein component (rnpA) |
| 9582 | serine protease, subtilase family |
| 9584 | glycosyl transferase domain protein |
| 9586 | transcriptional activator, AraC family |
| 9588 | transcriptional regulator, TetR family |
| 9590 | transcriptional regulator, AraC family |
| 9594 | surface protein Rib |
| 9596 | transposase, mutator family |
| 9600 | acetyltransferase, GNAT family |
| 9602 | Transposase, Mutator family |
| 9606 | UDP-sugar hydrolase |
| 9610 | anthranilate synthase component II (trpG) |
| 9612 | biotin synthetase (bioB) |
| 9616 | UDP-N-acetylmuramoylalanine--D-glutamate ligase (murD) |
| 9618 | ylmF protein (ylmF) |
| 9620 | amino acid ABC transporter, permease protein |
| 9622 | phosphoglucomutase (pgm) |
| 9624 | YjeF-related protein, C-terminus |
| 9626 | FemAB family protein (fibA) |
| 9628 | Cof family protein |
| 9630 | cell division ABC transporter, permease protein FtsX (ftsX) |
| 9632 | oxidoreductase, short-chain dehydrogenase/reductase family (fabG) |
| 9634 | aspartate aminotransferase (aspC) |
| 9638 | ribosomal protein L31 (rpmE) |
| 9640 | nrdI protein (nrdI) |
| 9642 | ribosomal protein L19 (rplS) |
| 9644 | bacteriophage L54a, repressor protein |
| 9646 | bacteriophage L54a, antirepressor |
| 9652 | single-strand binding protein (ssb) |
| 9660 | pneumococcal surface protein A |
| 9666 | DNA-binding response regulator (vncR) |
| 9668 | transposase OrfAB, subunit B |
| 9670 | cell division protein, FtsW/RodA/SpoVE family (rodA) |
| 9672 | DNA gyrase, B subunit (gyrB) |
| 9674 | 3-phosphoshikimate 1-carboxyvinyltransferase (aroA) |
| 9676 | RNA methyltransferase, TrmA family |
| 9680 | transcriptional regulator, AraC family |
| 9682 | ABC transporter, ATP-binding protein |
| 9690 | CylJ |
| 9696 | permease |
| 9698 | regulatory protein |
| 9700 | carbohydrate kinase, pfkB family |
| 9702 | beta-glucuronidase |
| 9704 | 2-deydro-3-deoxyphosphogluconate aldolase/4-hydroxy-2-oxoglutarate aldo |
| 9706 | 3-oxoacyl-(acyl-carrier-protein) reductase |
| 9708 | catabolite control protein A (ccpA) |
| 9712 | ribonuclease III (rnc) |
| 9714 | SMC family, C-terminal domain family |
| 9718 | S1 RNA binding domain protein |
| 9722 | prolipoprotein diacylglyceryl transferase (lgt) |
| 9724 | riboflavin synthase, alpha subunit (ribE) |
| 9726 | 3,4-dihydroxy-2-butanone 4-phosphate synthase/GTP cyclohydrolase II (ri |
| 9728 | lysyl-tRNA synthetase (lysS) |
| 9734 | Transposase subfamily |
| 9738 | translation elongation factor Tu (tuf) |
| 9740 | UDP-N-acetylmuramoylalanyl-D-glutamyl-2,6-diaminopimelate--D-alanyl-D-a |
| 9746 | Glutathione S-transferases domain protein |
| 9754 | Ribonucleotide reductases |
| 9756 | biotin--acetyl-CoA-carboxylase ligase |
| 9760 | Uncharacterized protein family SNZ family |
| 9762 | methionine aminopeptidase, type I (map) |
| 9764 | DNA ligase, NAD-dependent (ligA) |
| 9766 | glucose-1-phosphate adenylyltransferase (glgC) |
| 9768 | UDP-N-acetylglucosamine 1-carboxyvinyltransferase (murA) |
| 9770 | acetyltransferase, GNAT family |
| 9772 | exonuclease RexA (rexA) |
| 9774 | tRNA modification GTPase TrmE (trmE) |
| 9776 | ABC transporter, ATP-binding protein |
| 9778 | pyruvate dehydrogenase complex, E1 component, pyruvate dehydrogenase al |
| 9782 | Mur ligase family protein |
| 9786 | HD domain protein |
| 9788 | translation elongation factor G (fusA) |
| 9796 | pyruvate kinase (pyk) |
| 9798 | Signal peptidase I |
| 9802 | cytidine deaminase (cdd) |

TABLE VI-continued
PREDICTED FUNCTIONS FOR CERTAIN SEQ IDs

| SEQ ID | Function |
| --- | --- |
| 9804 | sugar ABC transporter, ATP-binding protein |
| 9806 | sugar ABC transporter, permease protein |
| 9808 | acetyltransferase, GNAT family |
| 9810 | ABC transporter, permease protein |
| 9812 | SatD |
| 9814 | Helix-turn-helix domain, fis-type protein |
| 9816 | phosphate ABC transporter, ATP-binding protein (pstB-1) |
| 9818 | tRNA pseudouridine synthase B (truB) |
| 9820 | Acetyltransferase (GNAT) family |
| 9822 | DNA topoisomerase I (topA) |
| 9824 | ribonuclease HII (rnhB) |
| 9830 | orotidine 5'-phosphate decarboxylase (pyrF) |
| 9832 | aspartate-semialdehyde dehydrogenase (asd) |
| 9836 | pantothenate metabolism flavoprotein (dfp) |
| 9840 | Sua5/YciO/YrdC/YwlC family protein |
| 9844 | thiamine biosynthesis protein ApbE |
| 9846 | Domain of unknown function |
| 9848 | DNA repair protein RadC (radC) |
| 9850 | glycosyl hydrolase, family 1 (bglA) |
| 9852 | Cof family protein (b0844) |
| 9854 | spermidine/putrescine ABC transporter, permease protein (potH) |
| 9856 | folylpolyglutamate synthase (folC) |
| 9858 | homoserine dehydrogenase (hom) |
| 9860 | succinate-semialdehyde dehydrogenase (gabD-1) |
| 9862 | membrane protein |
| 9864 | ATP-dependent DNA helicase PcrA (pcrA) |
| 9866 | uracil permease (uraA) |
| 9868 | sodiumalanine symporter family protein |
| 9878 | capsular polysaccharide biosynthesis protein Cps4B (cps4B) |
| 9880 | transcriptional regulator, LysR family |
| 9882 | CpslaS |
| 9884 | chloride channel protein |
| 9886 | tributyrin esterase (estA) |
| 9888 | ABC transporter, ATP-binding protein (potA) |
| 9890 | alpha-acetolactate decarboxylase (budA) |
| 9892 | TPR domain protein |
| 9896 | metallo-beta-lactamase superfamily protein |
| 9898 | tRNA delta(2)-isopentenylpyrophosphate transferase (miaA) |
| 9902 | glycerophosphoryl diester phosphodiesterase |
| 9904 | transposase OrfAB, subunit B |
| 9906 | IS3-Spn1, transposase |
| 9908 | transposase OrfAB, subunit B (orfB) |
| 9910 | reverse transcriptase |
| 9916 | transposase OrfAB, subunit B |
| 9918 | integrase, phage family (int) |
| 9920 | transcription regulator |
| 9922 | TnpA |
| 9926 | structural gene for ultraviolet resistance (uvra) |
| 9930 | Helicases conserved C-terminal domain protein |
| 9932 | abortive infection bacteriophage resistance protein (abiEi) |
| 9944 | ribosomal protein L7/L12 (rpIL) |
| 9948 | ATP-dependent Clp protease, ATP-binding subunit ClpX (clpX) |
| 9950 | dihydrofolate reductase (folA) |
| 9952 | hemolysin |
| 9954 | transcriptional regulator, MarR family |
| 9958 | polyA polymerase family protein |
| 9960 | PTS system, fructose specific IIABC components (fruA-1) |
| 9962 | lactose phosphotransferase system repressor (lacR) |
| 9964 | choline binding protein D (cbpD) |
| 9968 | pyrimidine operon regulatory protein (pyrR) |
| 9970 | ribosomal large subunit pseudouridine synthase D (rluD) |
| 9972 | thiamine biosynthesis protein ThiI (thiI) |
| 9974 | 3-dehydroquinate dehydratase, type I (aroD) |
| 9976 | iron compound ABC transporter, ATP-binding protein (fepC) |
| 9980 | transcriptional regulator |
| 9982 | glycosyl transferase domain protein |
| 9984 | Cps9H |
| 9988 | 4-diphosphocytidyl-2C-methyl-D-erythritol synthase (ispD) |
| 9990 | licD1 protein (licD1) |
| 9996 | large conductance mechanosensitive channel protein (mscL) |
| 10000 | maltose ABC transporter, maltose-binding protein |
| 10004 | nucleotide sugar synthetase-like protein |
| 10006 | transcriptional regulator |
| 10008 | oxidoreductase, aldo/keto reductase family |
| 10010 | NAD(P)H-flavin oxidoreductase |
| 10016 | transcriptional regulator MutR |
| 10018 | GTP-binding protein Era (era) |
| 10022 | peptide methionine sulfoxide reductase (msrA) |
| 10026 | peptide ABC transporter, ATP-binding protein |
| 10028 | peptide ABC transporter, ATP-binding protein (amiE) |
| 10030 | peptide ABC transporter, peptide-binding protein |
| 10032 | transposase, IS30 family |
| 10034 | transcriptional regulator, LysR family |
| 10036 | spoE family protein (ftsK) |
| 10044 | methionyl-tRNA synthetase (metG) |
| 10046 | D-isomer specific 2-hydroxyacid dehydrogenase family protein (serA) |
| 10048 | acetyltransferase, GNAT family |
| 10050 | phosphoserine aminotransferase (serC) |
| 10054 | thymidylate kinase (tmk) |
| 10060 | branched-chain amino acid ABC transporter, permease protein (livH) |
| 10062 | ATP-dependent Clp protease, proteolytic subunit ClpP (clpP) |
| 10064 | uracil phosphoribosyltransferase (upp) |
| 10066 | potassium uptake protein, Trk family (trkH) |
| 10068 | glutamate racemase (murI) |
| 10070 | membrane protein |
| 10072 | HD domain protein |
| 10074 | Acylphosphatase |
| 10076 | spoIIIJ family protein |
| 10078 | acetyltransferase, GNAT family |
| 10080 | glucose-inhibited division protein B (gidB) |
| 10082 | potassium uptake protein, Trk family |
| 10084 | ABC transporter, permease protein |
| 10088 | isochorismatase family protein |
| 10092 | haloacid dehalogenase-like hydrolase superfamily |
| 10094 | membrane protein |
| 10096 | glutamyl-tRNA(Gln) amidotransferase, B subunit (gatB) |
| 10098 | CBS domain protein protein |
| 10100 | transcription regulator (codY) |
| 10102 | universal stress protein family |
| 10104 | L-asparaginase (ansA) |
| 10106 | oxidoreductase, aldo/keto reductase 2 family |
| 10108 | preprotein translocase, SecA subunit (secA) |
| 10112 | excinuclease ABC, A subunit (uvrA) |
| 10114 | magnesium transporter, CorA family (corA) |
| 10116 | thioredoxin (trx) |
| 10118 | MutS2 family protein (mutS2) |
| 10122 | DNA-damage inducible protein P (dinP) |
| 10124 | formate acetyltransferase (pfl) |
| 10126 | transcriptional regulator, Crp family |
| 10128 | transport ATP-binding protein CydC |
| 10138 | ribosomal-protein-alanine acetyltransferase (rimI) |
| 10140 | hydrolase |
| 10144 | D-alanine-activating enzyme (dltA) |
| 10148 | carbohydrate kinase, FGGY family |
| 10150 | transaldolase |
| 10160 | Helix-turn-helix domain protein |
| 10164 | single-strand binding protein (ssb) |
| 10166 | type II DNA modification methyltransferase Spn5252IP (spn5252IMP) |
| 10174 | integrase, phage family |
| 10178 | Cyclic nucleotide-binding domain protein |
| 10180 | transcriptional regulator, MarR family |
| 10182 | prolyl-tRNA synthetase (proS) |
| 10184 | leucine-rich protein |

TABLE VI-continued

PREDICTED FUNCTIONS FOR CERTAIN SEQ IDs

| SEQ ID | Function |
| --- | --- |
| 10186 | lacX protein, truncation (lacX) |
| 10188 | tagatose-6-phosphate kinase (lacC) |
| 10190 | galactose-6-phosphate isomerase, LacB subunit (lacB) |
| 10192 | neuraminidase |
| 10198 | Histidine kinase-, DNA gyrase B-, phytochrome-like ATPase domain protei |
| 10200 | ABC transporter, ATP-binding protein |
| 10202 | PTS system, IIABC components (ptsG) |
| 10204 | phosphate regulon response regulator PhoB (phoB) |
| 10212 | Uncharacterized ACR, COG2161 subfamily |
| 10216 | abortive phage resistance protein |
| 10222 | TnpA |
| 10226 | acetyltransferase, GNAT family |
| 10230 | ABC transporter domain protein |
| 10234 | 5-methyltetrahydropteroyltriglutamate--homocysteine methyltransferase ( |
| 10236 | branched-chain amino acid transport protein AzlC (azlC) |
| 10240 | DNA-binding response regulator (srrA) |
| 10242 | leucyl-tRNA synthetase (leuS) |
| 10246 | NupC family protein |
| 10248 | transcriptional regulator, GntR family |
| 10252 | glyoxalase family protein |
| 10254 | anaerobic ribonucleoside-triphosphate reductase (nrdD) |
| 10256 | competence-induced protein Ccs4 |
| 10262 | competence/damage-inducible protein CinA (cinA) |
| 10264 | DNA-3-methyladenine glycosylase I (tag) |
| 10268 | DNA mismatch repair protein HexB (hexB) |
| 10270 | arginine repressor (argR) |
| 10272 | arginyl-tRNA synthetase (argS) |
| 10274 | aspartyl-tRNA synthetase (aspS) |
| 10276 | histidyl-tRNA synthetase (hisS) |
| 10280 | AGR_pAT_51p |
| 10286 | hydrolase, alpha/beta hydrolase fold family |
| 10288 | phage infection protein |
| 10290 | Glucose inhibited division protein A (gidA) |
| 10292 | tRNA (5-methylaminomethyl-2-thiouridylate)-methyltransferase (trmU) |
| 10296 | arginine/ornithine antiporter (arcD) |
| 10298 | chromosomal replication initiator protein DnaA (dnaA) |
| 10302 | peptidyl-tRNA hydrolase (pth) |
| 10310 | phosphotyrosine protein phosphatase |
| 10316 | ribosomal protein L36 (rpmJ) |
| 10318 | ribosomal protein S13/S18 (rpsM) |
| 10328 | L-lactate dehydrogenase (ldh) |
| 10330 | ribosomal protein L28 (rpmB) |
| 10362 | RNA polymerase sigma-70 factor, ECF subfamily |
| 10384 | BioY family protein |
| 10386 | AtsA/ElaC family protein |
| 10388 | cytidine/deoxycytidylate deaminase family protein |
| 10394 | phosphorylase, Pnp/Udp family |
| 10396 | transcriptional regulator, MerR family |
| 10402 | methyltransferase (ubiE) |
| 10412 | type IV prepilin peptidase |
| 10416 | ylmG protein (ylmG) |
| 10444 | transposase OrfAB, subunit B |
| 10446 | IS150-like transposase |
| 10452 | Bacterial regulatory proteins, tetR family domain protein |
| 10454 | cell wall surface anchor family protein, authentic frameshift (clfB) |
| 10456 | transposase OrfAB, subunit A (orfA) |
| 10460 | chaperonin, 33 kDa (hslO) |
| 10472 | 3R -hydroxymyristoyl-(acyl-carrier-protein)dehydratase (fabZ) |
| 10482 | sprT protein |
| 10490 | transcriptional regulator, MarR family |
| 10498 | transcriptional regulator |
| 10504 | glycogen biosynthesis protein GlgD (glgD) |
| 10536 | ribonucleoside-diphosphate reductase, alpha subunit, truncation (nrdD) |
| 10538 | LPXTG-motif cell wall anchor domain |
| 10550 | membrane protein |
| 10554 | arsenate reductase (arsC) |
| 10564 | transposase, authentic frameshift |
| 10570 | transposase OrfAB, subunit A (orfA) |
| 10574 | Tn5252, Orf 9 protein |
| 10580 | IS3-Spn1, transposase |
| 10584 | transcriptional regulator, ArsR family |
| 10628 | ribosomal protein L35 (rpml) |
| 10630 | cytidylate kinase (cmk) |
| 10636 | MutT/nudix family protein |
| 10644 | preprotein translocase, SecG subunit |
| 10680 | ribosomal protein S18 (rpsR) |
| 10682 | single-strand binding protein (ssb) |
| 10692 | glyceraldehyde 3-phosphate dehydrogenase (gap) |
| 10694 | translation elongation factor G (fusA) |
| 10696 | ribosomal protein S7 (rpsG) |
| 10704 | phosphinothricin N-acetyltransferase (pat) |
| 10730 | nrdI protein (nrdI) |
| 10732 | accessory gene regulator protein C (blpH) |
| 10744 | rhodanese family protein (pspE) |
| 10746 | cAMP factor |
| 10758 | competence/damage-inducible protein CinA (cinA) |
| 10770 | transcriptional regulator, ArgR family (argR) |
| 10772 | FliP family family |
| 10794 | peptide ABC transporter, peptide-binding protein |
| 10800 | ribosomal protein S21 (rpsU) |
| 10802 | transposase, IS30 family |
| 10816 | mucin 2 precursor, intestinal |
| 10854 | SV40-transformed marker protein pG1-related protein |
| 10856 | SV40-transformed marker protein pGl-related protein |
| 10858 | SV40-transformed marker protein pG1-related protein |
| 10860 | SV40-transformed marker protein pG1-related protein |
| 10862 | SV40-transformed marker protein pG1-related protein |
| 10864 | SV40-transformed marker protein pG1-related protein |
| 10866 | SV40-transformed marker protein pG1-related protein |
| 10910 | transcriptional regulator |
| 10920 | ribosomal protein S11 (rpsK) |
| 10922 | elaA protein |
| 10926 | 5-formyltetrahydrofolate cyclo-ligase family protein |
| 10938 | inositol monophosphatase family protein |
| 10940 | amino acid ABC transporter, amino acid-binding protein (artI) |
| 10944 | Holliday junction DNA helicase RuvB (ruvB) |
| 10946 | D-alanyl-D-alanine carboxypeptidase (dacA) |
| 10948 | lipoprotein (bmpD) |
| 10950 | peptidase, U32 family family |
| 10952 | protease maturation protein |
| 10954 | glutamyl-tRNA synthetase (gltX) |
| 10956 | GTP-binding protein LepA (lepA) |
| 10960 | translation initiation factor if-2 |
| 10962 | phosphoenolpyruvate carboxylase (ppc) |
| 10964 | calcium E1-E2-type ATPase |
| 10966 | serine protease, subtilase family |

SEQUENCE LISTING (12026 sequences)

SEQ ID NO: 1 - DNA, 576 bp, Streptococcus agalactiae
atgaaagtgaaaaataagattttaacgatggtagcacttactgtcttaacatgtgctacttattcatcaatcggttatgctgatacaagtgataagaatactgacacgagtgtcgtgactacgaccttatctgaggagaaaagatcagatgaactagaccagtctagtactggttcttcttctgaaaatgaatcgagttcatcaagtgaaccagaaacaaatccgtcaactaatccacctacaacagaaccatcgcaaccctcacctagtgaagagaacaagcctgatggtagaacgaagacagaaattggcaataataaggatatttctagtggaacaaaagtattaatttcagaagatagtattaagaattttagtaaagcaagtagtgatcaagaagaagtggatcgcgatgaatcatcatcttcaaaagcaaatgatgggaaaaaaggccacagtaagcctaaaaaggaacttcctaaaacaggagatagccactcagatactgtaatagcatctacgggagggattattctgttatcattaagtttttacaataagaaaatgaaactttat

SEQ ID NO: 2 - protein, 192 aa, Streptococcus agalactiae
MKVKNKILTMVALTVLTCATYSSIGYADTSDKNTDTSVVTTTLSEEKRSDELDQSSTGSSSENESSSSSEPETNPSTNPPTTEPSQPSPSEENKPDGRTKTEIGNNKDISSGTKVLISEDSIKNFSKASSDQEEVDRDESSSSKANDGKKGHSKPKKELPKTGDSHSDTVIASTGGIILLSLSFYNKKMKLY

SEQ ID NO: 3 - DNA, 537 bp, Streptococcus agalactiae
atgtcaataacctcggttaaaaaatcaaaaccatttaaattaggagtggcaggtcttttagtgggtgcttcattagctttaccactttcagtaagcgcagcatcttataccgtgaaatcaggtgataccttatcagctattgctaaaaatcataaaactacggtacaagagttagtgtctctcaatagtatcagtaacgctgatgtcatcagtataggtgatgttttaaaattggataattctacagctagtcaagcagaagcaaaatctcaaccaacaattgaaaattcaatgaattcttcatcaaatttgagttcaagtgattcagccgcaaaagaagaaatagctcgtcgtgaatcaaatggtagttatactgcacagaatggacaatattatggaagatatcaactgtctcaatcttacctaaatggcgacttatctcctgaaaatcaagaaaaagtagcggacaattatgtggtttctcgttacggatcttggtcggcagcgctatcattttggaatagtaacggctggtat

SEQ ID NO: 4 - protein, 179 aa, Streptococcus agalactiae
MSITSVKKSKPFKLGVAGLLVGASLALPLSVSAASYTVKSGDTLSAIAKNHKTTVQELVSLNSISNADVISIGDVLKLDNSTASQAEAKSQPTIENSMNSSSNLSSSDSAAKEEIARRESNGSYTAQNGQYYGRYQLSQSYLNGDLSPENQEKVADNYVVSRYGSWSAALSFWNSNGWY

SEQ ID NO: 5 - DNA, 837 bp, Streptococcus agalactiae
atgaataagaaaaaaatacttaccggactttctttttttctggtaagtcttcttttatcttttgggattttttccttgatcattccaaaatcaaatcctaaattaacaaaaaaagacttcctaacaaagaaagttatcccacttaactatgttgctcttggagattctctgaccgaaggtgtgggcgatacaacctctcaaggtggttttgttccactgctatcagaatcactccataatcgatactcttaccaagtgacttctgttaattatggtgtgtctgggaatactagtcaacaaattttaaaacgtatgacgacagatcctcaaatcgaaaaagatttagagaaagctgatttattgacgctaactgttggtggtaatgatgtcttggctgttattcgtaaagagctcagtcatttatcactaaattcctttgagaaaccagcagaagcatataaggaacgtttgaaagaaatccttgcaaaagcaagacaagataatcctaaattgcctatttatgttttaggcatttataatcctttttacctaaactttccacaattaactaaaatgcaaaccgttattgataattggaataaagctacaaaagaagtagttgatgcttcagaaaatgtttattttgtcccaattaatgaccgcctttataagggaataaatggtaaagagggtattacagagtcatcaaatagtcaggcaagtatcactaatgatgctctctttactggagaccattttcatcccaataatattggctatcaaatcatgtctaacgccgttatggagaaaataaatgaaacaagaaaaaactggccg

SEQ ID NO: 6 - protein, 279 aa, Streptococcus agalactiae
MNKKKILTGLSFFLVSLLLSFGIFSLIIPKSNPKLTKKDFLTKKVIPLNYVALGDSLTEGVGDTTSQGGFVPLLSESLHNRYSYQVTSVNYGVSGNTSQQILKRMTTDPQIEKDLEKADLLTLTVGGNDVLAVIRKELSHLSLNSFEKPAEAYKERLKEILAKARQDNPKLPIYVLGIYNPFYLNFPQLTKMQTVIDNWNKATKEVVDASENVYFVPINDRLYKGINGKEGITESSNSQASITNDALFTGDHFHPNNIGYQIMSNAVMEKINETRKNWP

SEQ ID NO: 7 - DNA, 1536 bp, Streptococcus agalactiae
ttgattatggagacgggtagtgtaagtaagaaagttcaacaacttcctttaagtcctagattatctaaaaataagcatatgagggatatgctacttactatgcaaaaagattcagcgtattacgaaacaagtgacagtctagtccttcgaattaatctcactgcagatactaaacttaattttaatgctgttaaaggagcgagtgctcttactgaaaatatgatgatgagacagtttgcagttgctggaccacaagatgatcctgttagtgaacataaatacccatcagtatttctcttaactcctgccttattggaaactgctagtgaggcaactctaaatggtaaggaaatcacagcatctggtattatcggtcacatcaaggatggtgataaaagcaagcatgttgaagtcaaaatggtgaatgaaaatggagacatgctaggaacccctgttattattcaaggtaaagacttgactaatcgaacaaaaccattaatgagtggacgtagagtactttatgccggtaaacaatatgagttccgggctaaattaccacttagtcgttttaacacttggattagggttgaagtggtaacagaagcaggagagaaagcaagtattgttcgtcgcatgttctttgaccaatcagttccagagcttaacacagcagttgctaaacgtgatttgacttctgatactgctcttatccacatcgttgccaaagatgactctctaaaactaaaattatatcaagatgattcattacttgaatctgttgataaaaccggtctttatagttttagaaatggtgtagaaatcactaaagatatgacagtaccactagaatttggagataatattattaagttatctgctgttgacttatcaaattatcgtcgtaatgagacccttcatatctatagaaaccgttttgatgttaaagcaagccaaatgacagctgacaaaggagctaaagtaactgtggatatgttgatgaagcacttagttgttccagaaatggcaggagcttatacattaacaatcgacgaagctccaaacacaaatgaatcaggaatgttaacaaacgctaaagtatcgattcattatgtaaatggtggtgttgataaagttgatgttccgattaaagtagttgacttagaagctattcgtaaagctgaagaagcacgtaaagctgaagaagcacgtaaagctgaagaagcacgtaaagctgaagagggacataaaacccaagaagcacctatagttgaagaaggctacaaggttaataacgttcatcaaactgatactacagttaaagcgtctgatttaccaaagactaagacagtttccgcagttcatatggctagaacagacaataaacagataacttcacatcagacacatgttgaaaaacaaattaaaaatacattgccatccactggtgacagcaaacgtggttattatatcactggaatggctatcgttatgctgagtgtattatttagtttagctaaaaagtttaaaagcaaatat

SEQ ID NO: 8 - protein, 512 aa, Streptococcus agalactiae
LIMETGSVSKKVQQLPLSPRLSKNKHMRDMLLTMQKDSAYYETSDSLVLRINLTADTKLNFNAVKGASALTENMMMRQFAVAGPQDDPVSEHKYPSVFLLTPALLETASEATLNGKEITASGIIGHIKDGDKSKHVEVKMVNENGDMLGTPVIIQGKDLTNRTKPLMSGRRVLYAGKQYEFRAKLPLSRFNTWIRVEVVTEAGEKASIVRRMFFDQSVPELNTAVAKRDLTSDTALIHIVAKDDSLKLKLYQDDSLLESVDKTGLYSFRNGVEITKDMTVPLEFGDNIIKLSAVDLSNYRRNETLHIYRNRFDVKASQMTADKGAKVTVDMLMKHLVVPEMAGAYTLTIDEAPNTNESGMLTNAKVSIHYVNGGVDKVDVPIKVVDLEAIRKAEEARKAEEARKAEEARKAEEGHKTQEAPIVEEGYKVNNVHQTDTTVKASDLPKTKTVSAVHMARTDNKQITSHQTHVEKQIKNTLPSTGDSKRGYYITGMAIVMLSVLFSLAKKFKSKY

SEQ ID NO: 9 - DNA, 96 bp, Streptococcus agalactiae
atgttaacaaaatcatcaataaataatgataaaaagaaactctcattcccattgattttgctaaaacaggatcaaaagaagtcaataataattctt

SEQ ID NO: 10 - protein, 32 aa, Streptococcus agalactiae
MLTKSSINNDKKKLSFPLILLKQDQKKSIIIL

SEQ ID NO: 11 - DNA, 831 bp, Streptococcus agalactiae
atgtttacgaaattttttgaaggcttattgacttatcattttttgcaaaatgcttttataactgcaattgtgattggtattgtagcgggtgcagtaggctgttttattatcttgcgctcaatgtctttgatgggtgatgctatttctcacgctgttctaccaggtgttgctatatcttttattttagggattaacttttttataggtgctattgtctttggtttgttgtcttcgattatcattacttatattaaagaaaatagtgtcataaaaggagatactgctattggaattactttttcgtcctttttagccttaggtatcattttaattggacttgctaatagtacaactgacctctttcatattctttttgggaatattttggcagtacaagatagtgataaatatatgactattattgtgggattaattgtactgactctgattactatcttctttaaagaattattattgacttcttttgatcctgttttagcaaaatcaatgggaatgagagtttctttttatcattatttattgatgattttgttaacattagttgcagtaacagctatgcagagtgtgggaacaatattgatcgtagcacttttaattacaccagctgcaacagcatatctttatgttaaaagtctcagaacaatgttgtttttatcatctgcattaggagcagtagcatctgttctggggttatatatcggttatacatttaatattgccgcaggatcaagtattgttttaacatctacttttatgtttttacttgctttcctattttctcctaaacaaagtttgtttaaaaagaaacaa

SEQ ID NO: 12 - protein, 277 aa, Streptococcus agalactiae
MFTKFFEGLLTYHFLQNAFITAIVIGIVAGAVGCFIILRSMSLMGDAISHAVLPGVAISFILGINFFIGAIVFGLLSSIIITYIKENSVIKGDTAIGITFSSFLALGIILIGLANSTTDLFHILFGNILAVQDSDKYMTIIVGLIVLTLITIFFKELLLTSFDPVLAKSMGMRVSFYHYLLMILLTLVAVTAMQSVGTILIVALLITPAATAYLYVKSLRTMLFLSSALGAVASVLGLYIGYTFNIAAGSSIVLTSTFMFLLAFLFSPKQSLFKKKQ

SEQ ID NO: 13 - DNA, 852 bp, Streptococcus pyogenes
atgtctatgaaattttttgagggcttgatgtcataccactttttacaaaatgcactgataacggctgtagtcattggtatcgtctcaggtgctgtagggtgttttattatccttaggtcaatgtctcttatgggtgatgccatctcacacgctgttttaccaggggttgctttgtcatttattttaggagtcaatttttttattggagcgattatttttgggttattagcttctgttattattacttatatcaaggaaaactctgtcattaaaggagatacggctattggtatcacctttagctcttttttggcactgggagtcatcttgataggggtagccaatagttcgacggacttatttcatattttgtttgggaatattttagctgtgcaagatagcgataagtggattactattggtgtttcgatttttgttttagtggttattagtctctttttcaaagaactattattaacatcatttgatcctatcttagccaaatcaatgggtgtgaaggtcaatgcgtatcattatttgttgatggtcctattaactttagtggctgttacggcgatgcaaagcgtgggtactatcttgattgttgccttattgattacgccagcagcgacagcttatttatatgctaatagcttaaaagtaatgttagtgatgtcatctttactaggcgctttagcatcggttttagggctttatttgggctatacctttaatgttgccgcagggtcaagtatcgtactgacttctgcgatgatgtttttgatcagtttctttgtttcacccaagcaaggctaccttaaaagatggatgcaaaaaaaagaaaaaacacct

SEQ ID NO: 14 - protein, 284 aa, Streptococcus pyogenes
MSMKFFEGLMSYHFLQNALITAVVIGIVSGAVGCFIILRSMSLMGDAISHAVLPGVALSFILGVNFFIGAIIFGLLASVIITYIKENSVIKGDTAIGITFSSFLALGVILIGVANSSTDLFHILFGNILAVQDSDKWITIGVSIFVLVVISLFFKELLLTSFDPILAKSMGVKVNAYHYLLMVLLTLVAVTAMQSVGTILIVALLITPAATAYLYANSLKVMLVMSSLLGALASVLGLYLGYTFNVAAGSSIVLTSAMMFLISFFVSPKQGYLKRWMQKKEKTP

SEQ ID NO: 15 - DNA, 123 bp, Streptococcus agalactiae
gtgaccctaatggagacgggaccggtggaaaatctatatggaatagcaaagataaaaagaaagattctggaaatggttttgttaatgaaatatccccttacctctacaatatcaggggaagtt

SEQ ID NO: 16 - protein, 41 aa, Streptococcus agalactiae
MTLMETGPVENLYGIAKIKRKILEMVLLMKYPLTSTISGEV

SEQ ID NO: 17 - DNA, 801 bp, Streptococcus agalactiae
atgaaaaaaattatttatcttggtttagcctgtgtcagtatattaactttaagtggttgcgagtcaattgagcgttctctaaaaggagaccgttatgttgaccaaaaactagctgaaaactcttcaaaggaagctactgaacaactaaacaaaaaaactaagcaagccttaaaagctgataaaaaagcttttcctcaattggacaaggctgttgccaaaaacgaggcacaagtgcttataaaaacctctaaaggtgatataaatatcaagttatttccaaaatatgctcctttagctgttgaaaattttctaacacatgcaaaagaaggatactataatgggttaagtttccacagagttatcaaagattttatgatacaatctggtgaccctaatggagacgggaccggtggaaaatctatatggaatagcaaagataaaaagaaagattctggaaatggttttgttaatgaaatatccccttacctctacaatatcaggggaagtttagcaatggcaaatgctggagctgatactaatggcagccaattctttatcaatcaaagccagcaagatcattccaaacaactgtcagataaaaaagttcctaaggtgattattaaagcctattcagagggaggaaatccaagtttagatggtggttataccgtctttggacaagtaatctctggcatggaaactgtggataaaattgcttcggtagaagttacaaaatcagatcaaccaaaagaaaaaattactattacaagtatcaaagttattaaagactacaaatttaaa

SEQ ID NO: 18 - protein, 267 aa, Streptococcus agalactiae
MKKIIYLGLACVSILTLSGCESIERSLKGDRYVDQKLAENSSKEATEQLNKKTKQALKADKKAFPQLDKAVAKNEAQVLIKTSKGDINIKLFPKYAPLAVENFLTHAKEGYYNGLSFHRVIKDFMIQSGDPNGDGTGGKSIWNSKDKKKDSGNGFVNEISPYLYNIRGSLAMANAGADTNGSQFFINQSQQDHSKQLSDKKVPKVIIKAYSEGGNPSLDGGYTVFGQVISGMETVDKIASVEVTKSDQPKEKITITSIKVIKDYKFK

SEQ ID NO: 19 - DNA, 804 bp, Streptococcus pyogenes
atgaaaaaattattatctctcagtttagtagccattagtttacttaatttgagtgcttgtgaatctgttgaccgcgctataaaaggcgataaatacattgatgaaaaaactgccaaagaagaaagcgaagcagcttctaaagcctatgaagaaagcattcaaaaagctctcaaagctgatgctagccaatttccacaactaaccaaagaagtcggcaaagaagaagctaaggtcgtaatgaggacaagtcaaggggacattacccttaagttattcccaaaatatgctcccttagctgttgagaacttcctcacccatgctaaaaaaggctactatgataaccttaccttccatcgtgtgatcaacgactttatgattcaatcaggtgaccccaaaggagatggcacaggtggtgaatcgatttggaaaggcaaggatcctaaaaaagatgctggcaatggctttgtcaacgaaatctctccatttttatatcatattcgcggtgctcttgccatggcaaatgctggtgctaatactaacggtagccaattttatatcaaccaaaacaagaaaaatcaaagcaagggattatcaagtaccaactacccaaaacctatcatctctgcctatgagcatggcggcaatccaagcttagatggcggttatactgtatttggtcaagtcattgatggtatggatgttgtcgataaaattgccgctacttctatcaaccaaaatgataaaccagaacaagacattacgattacctcaattgacattgtcaaagattatcgctttaaaaac

SEQ ID NO: 20 - protein, 268 aa, Streptococcus pyogenes
MKKLLSLSLVAISLLNLSACESVDRAIKGDKYIDEKTAKEESEAASKAYEESIQKALKADASQFPQLTKEVGKEEAKVVMRTSQGDITLKLFPKYAPLAVENFLTHAKKGYYDNLTFHRVINDFMIQSGDPKGDGTGGESIWKGKDPKKDAGNGFVNEISPFLYHIRGALAMANAGANTNGSQFYINQNKKNQSKGLSSTNYPKPIISAYEHGGNPSLDGGYTVFGQVIDGMDVVDKIAATSINQNDKPEQDITITSIDIVKDYRFKN

SEQ ID NO: 21 - DNA, 2448 bp, Streptococcus agalactiae
atggtatttatggcaaataagaaaaaaacaaaaggaaagaaaaccagaagacctactaaggcagaaatagagcgtcaaagagctattcaaaggatgattactgctcttgttttaacaattattctcttctttggtattatcagattaggtatttttggtattacagtctataacgtcatccgttttatggtaggtagcttggcttacttatttattgcggcaactttaatctacctttatttctttaaatggttgcgaaagaaagatagcttagtagcaggttttttgatagcttctttaggattattgattgagtggcatgcttaccttttctcaatgcctattttgaaagataaagaaattttgcgttcaactgctcgattaattgtgtctgatttaatgcaatttaaaatcactgtttttgccggtggaggtatgttgggtgctttgatttacaagccaattgcttttctcttttctaatattggtgcctatatgattggtgttctcttcatcattttgggtctctttttaatgagttctctggaagtttatgacatcgtcgaatttattagagcttttaaaaataaagtggcagagaagcacgagcaaaataaaaaggagcgttttgctaagcgagagatgaaaaaagcaatcgctgaacaagagcgcatagagcgtcaaaaagctgaagaagaagcttatttagcttcggttaatgtagaccctgaaacgggtgagattctagaggatcaagctgaggacaatttggatgatgcgctaccacctgaggtaagtgaaacatcaactccggtatttgagccagagatccttgcttatgagacatcgcctcaaaatgatcctttaccagtagagccgacaatttatttagaagactatgattcgccgattcctaatatgagagaaaatgatgaggaaatggtttatgatttagatgatgatgtagatgatagtgatatagaaaatgtcgactttacacctaaaacgacactggtttataaattaccaacgatagatttatttgcaccagataagcctaaaaatcaatccaaagaaaaggatttagtccgaaagaatatcagagttttagaagaaacatttagaagttttggtatcgatgtaaaagtagaacgtgctgaaattggaccatcagttactaaatatgaaattaaaccagcagttggagttcgtgtgaatcgtatttcaaatctatctgacgacctagctcttgctcttgcagcaaaagatgtgcgtatagaaacaccaattcctggaaaatcattaataggtattgaagttcctaactcagaaattgcaacggtttctttccgcgaactttgggaacaatctgatgccaatcctgaaaaccttttagaagtaccactaggaaaagctgttaacggcaatgctcgcagttttaacttagctagaatgccgcatcttttggtagctggttcaactggttcaggtaaatctgtggcagttaatggaattatttcaagtattttgatgaaggcacgtccagatcaagttaagtttatgatgattgatcccaaaatggttgaattatctgtttataatgatattccacatttattaatccctgttgtaaccaatccgcgtaaagcaagtaaggcactccaaaaagttgttgatgaaatggaaaatcgatacgagttatttagcaaaattggtgtgcgtaatatagcaggttataatacaaaggttgaagagtttaatgcttcctctgagcaaaaacaaatacctttgcctttaatcgttgtcattgtagatgaattggctgacttgatgatggttgctagtaaagaagttgaagatgctattattcgtttggggcaaaaagcacgtgctgcaggtatccatatgattcttgcaactcaacgtccatccgtagatgttatttctggtttgattaaagcaaatgttccgtcgcgtattgcatttgctgtttcaagtggtactgatagccgtacgatccttgatgaaaatggtgctgaaaagctcttgggacggggtgacatgctctttaagcctattgatgagaatcatccagtacgactacaaggttcctttatttcagatgatgatgttgaaaggatcgttggttttatcaaagaccaagccgaggctgactatgatgatgcctttgatcctggagaagtatctgaaacagataacggctctggtggtggcggcggagtacctgaaagtgatcctctttttgaagaagccaagggactcgttttagagacgcaaaaagcaagtgcctcaatgattcaacgccgattgtctgttggtttcaatagagcaacaagactaatggaagaattagaagcagcgggggttattggtccagcagaaggaaccaagccacgaaaagttttaatgactccaactccgagtgaa

SEQ ID NO: 22 - protein, 816 aa, Streptococcus agalactiae
MVFMANKKKTKGKKTRRPTKAEIERQRAIQRMITALVLTIILFFGIIRLGIFGITVYNVIRFMVGSLAYLFIAATLIYLYFFKWLRKKDSLVAGFLIASLGLLIEWHAYLFSMPILKDKEILRSTARLIVSDLMQFKITVFAGGGMLGALIYKPIAFLFSNIGAYMIGVLFIILGLFLMSSLEVYDIVEFIRAFKNKVAEKHEQNKKERFAKREMKKAIAEQERIERQKAEEEAYLASVNVDPETGEILEDQAEDNLDDALPPEVSETSTPVFEPEILAYETSPQNDPLPVEPTIYLEDYDSPIPNMRENDEEMVYDLDDDVDDSDIENVDFTPKTTLVYKLPTIDLFAPDKPKNQSKEKDLVRKNIRVLEETFRSFGIDVKVERAEIGPSVTKYEIKPAVGVRVNRISNLSDDLALALAAKDVRIETPIPGKSLIGIEVPNSEIATVSFRELWEQSDANPENLLEVPLGKAVNGNARSFNLARMPHLLVAGSTGSGKSVAVNGIISSILMKARPDQVKFMMIDPKMVELSVYNDIPHLLIPVVTNPRKASKALQKVVDEMENRYELFSKIGVRNIAGYNTKVEEFNASSEQKQIPLPLIVVIVDELADLMMVASKEVEDAIIRLGQKARAAGIHMILATQRPSVDVISGLIKANVPSRIAFAVSSGTDSRTILDENGAEKLLGRGDMLFKPIDENHPVRLQGSFISDDDVERIVGFIKDQAEADYDDAFDPGEVSETDNGSGGGGGVPESDPLFEEAKGLVLETQKASASMIQRRLSVGFNRATRLMEELEAAGVIGPAEGTKPRKVLMTPTPSE

SEQ ID NO: 23 - DNA, 2403 bp, Streptococcus agalactiae
atggttaaaagaaatcaaagaaaaaaaagtgcgcctaagaagcgtttaacaaaagcagaagtggaaaagcaacgtgccattaagaggatgattttatctgttttaatggctttgttgcttatttttgcgatgcttcgcttgggcgtctttggtgtgacaacttataatatgattcgttttttggtgggtagtttagcctatccgtttatgtttgcctggttaatttacttattttgttttaaatggttacggcaaaaagatggaatgattgcgggagttgttattgcctttttgggattgctagttgagtggcacgccttcttatttgcgatgcctaggatgcttgatcaagatatttttctaggcactgctcggctaattacaagagatttactagccctgcgcgtgactgaatttgttggtggaggaatgcttggtgcattactttataaacccatagcctttttattttcgaatatcggctcttactttattggttttttgtttatcttattaggattatttctaatgacgccttgggatatctatgatgtgagtcactttgtgaaagaggctgttgataaactagcagtggcttatcaggaaaataaagaaaagcggttcatcaaacgagaagagcaccgcttacaagctgaaaaagaggctttagagaaacaagcacaagaggaagaaaaacgtctagcagaattgacggttgatcctgagacgggagagattgttgaggatagtcagtctcaagtcagctatgatttggctgaggatatgacaaaagaaccagagattcttgcttatgatagtcacctcaaagacgatgagacaagcttatttgatcaagaagacttggcttacgctcatgaggaaattggggcttatgactctttatctgctttagcatcttctgaagatgagatggatatggatgaacctgttgaagttgatttcacaccaaaaacccatcttctttataaacttccaacgatagatttatttgcaccagataagcccaaaaaccagtccaaagagaaaaacttagtccgcaaaaatatcaaggtgcttgaagataccttccaaagttttgggattgatgtcaaggtagagcgagcagaaatcgggccttccgtcaccaaatatgaaatcaagccagctgtcggggtccgagttaatcgtatttcaaatcttgctgatgatttggcacttgctctggctgctaaagatgttcgtattgaagcaccaattcctggaaaatccttaataggtattgaagttcctaactcagaaattgcaacggtttctttccgcgaactttgggaacaatctgatgccaatcctgaaaaccttttagaagtaccactaggtaaagctgttaatggcaatgcgcgcagttttaacttagctagaatgccgcatcttttggtagctggttcaactggttcaggtaaatctgtggcagttaatggcattatttcaagtattttgatgaaggcacgtccagatcaagttaagtttatgatgattgaccccaaaatggttgaattatctgtttataatgatattccacatttattaatcccagttgtaaccaatccgcgtaaagccagtaaggcactccaaaaagtggttgatgagatggaaaaccgctacgagttatttagtaaaattggtgtgcgtaatatagcaggttataatacaaaggttgaagagtttaatgcttcttctgagcaaaaacaaataccgttgcctttaatcgttgtcattgtagatgaattggctgacttgatgatggtggctagtaaagaagttgaagatgctattattcgtttgggacaaaaagcacgtgctgcaggtatccatatgattcttgcaactcaacgtccctctgtagatgttatttctggtttgattaaagcaaatgttccgtcgcgtatggcatttgctgtttcaagtggtactgatagccgtacgatccttgatgaaaatggtgctgaaaagctcttgggacggggtgatatgctctttaagccgattgatgaaaatcaccctgttcgcttgcaagggtctttcatctcagatgatgatgtggagcgtattgtcaactttatcaaagaccaaactgaagcggattatgatgacgcctttgatcctggtgaagttagcgacaatgatcctggtttttctggaaatggcggagctgctgaaggtgatcctctttttgaagaagcaaaagccttggtcttagaaacacaaaaagctagtgcctcaatgattcaaaggcgtttgtcggttggatttaatcgtgccacgcgcttgatggatgaattggaagaagcaggtgttatcggtccagcagaaggaaccaagcctcgtaaggtattgcagacaaac

SEQ ID NO: 24 - protein, 801 aa, Streptococcus agalactiae
MVKRNQRKKSAPKKRLTKAEVEKQRAIKRMILSVLMALLLIFAMLRLGVFGVTTYNMIRFLVGSLAYPFMFAWLIYLFCFKWLRQKDGMIAGVVIAFLGLLVEWHAFLFAMPRMLDQDIFLGTARLITRDLLALRVTEFVGGGMLGALLYKPIAFLFSNIGSYFIGFLFILLGLFLMTPWDIYDVSHFVKEAVDKLAVAYQENKEKRFIKREEHRLQAEKEALEKQAQEEEKRLAELTVDPETGEIVEDSQSQVSYDLAEDMTKEPEILAYDSHLKDDETSLFDQEDLAYAHEEIGAYDSLSALASSEDEMDMDEPVEVDFTPKTHLLYKLPTIDLFAPDKPKNQSKEKNLVRKNIKVLEDTFQSFGIDVKVERAEIGPSVTKYEIKPAVGVRVNRISNLADDLALALAAKDVRIEAPIPGKSLIGIEVPNSEIATVSFRELWEQSDANPENLLEVPLGKAVNGNARSFNLARMPHLLVAGSTGSGKSVAVNGIISSILMKARPDQVKFMMIDPKMVELSVYNDIPHLLIPVVTNPRKASKALQKVVDEMENRYELFSKIGVRNIAGYNTKVEEFNASSEQKQIPLPLIVVIVDELADLMMVASKEVEDAIIRLGQKARAAGIHMILATQRPSVDVISGLIKANVPSRMAFAVSSGTDSRTILDENGAEKLLGRGDMLFKPIDENHPVRLQGSFISDDDVERIVNFIKDQTEADYDDAFDPGEVSDNDPGFSGNGGAAEGDPLFEEAKALVLETQKASASMIQRRLSVGFNRATRLMDELEEAGVIGPAEGTKPRKVLQTN

SEQ ID NO: 25 - DNA, 1713 bp, Streptococcus agalactiae
atgcatattgagactgttattgatttcaaagaattaggaaaaagatatcgttttaaaaatcctacaaaagaattaatagctgatactttagaacaagtcttagaagtgataaaagaagttgattattatcaatctcaaaattattatgttgttggttatttatcttatgaagcatctgctgcttttgattcacattttaaagtttctcaacagaagttggctggagaacatctagcttattttacagtacataaagattgtgagaacgaagcttttcctttaagttatgaaaatgttagattagcagataattggactgctaatgtttctgagcaagaatatcaagaggcaattgctaatattaaaggacaaattagacaaggaaatacttatcaagtaaattatacactagagcttagccaacaattatgctcggatccctttagtgtttatgaacgcctaatggtagaacaaggagcaggatataatgcttatattgcctacgacgataaaaggattttatctgtaagcccggaattgttctttaagaagaaggatgaagtcttaacaactagaccaatgaagggaacaagcgctagaaagcctacttatcaagaagatgtggcggagcgagattggttggcaaatgatcctaaaaatcgttctgaaaatatgatgattgttgatttattaagaaacgatatgggccgtatctgtgatgttggaacagttaaggtaaaaaaactatgtcaagtggagcagtatgcaactgtgtggcaaatgacatcaactattgaaggagttttatcgccagaagtgacacttatgtctatttttcaagctctatatccttgtggatctatcactggagctcctaagatatcaacaatggctattattaatgagttggaaaaacggccaagaggtatttattgtgggacgataggactttgcatgccagacggacaagctatttttaacgttcctattcgcacagtacaaatgaaaggtcaacaagcctattacggcgttggtggaggtattacgtgggagagccagacagattctgaatatgaagaaacccgtcaaaaatcagctgttttaacacgtgtcaatccaaaatttcaattaataactacaggaagagtgactgaaaataaacttcttttctctcaacaacatgtcgagagattagttgaatcagcgtcttattttgcttattcttttgataaaagtaaattcgaaagggaactgaaaaaataccttcatcagctagatgagaaggattaccgcttgaaaataatgcttgataaaactggtaaggtaacgtttgaggtaaaacaactagtgaatttatcaaaaaagtttttaacggcagaggtggtcgtacaagactaccctattaaattatccccgtttacttattttaaaacttcttatcgcccacatattattgaaggtcagaatgaaaagatatttgtatctcctgaggggttgctattggaaacaagtattgggaatattgttttagaaaaaaatggaaggtttttaaccccagatttatcagaaggagggttgaatgggatttatcgtcgtcatctccttaaaaaccaaaaagtaattgaagcaccactaactttaaaagatttagaatcagccgatgctatatacgcctgtaatgctgttagagggctttatcctctaaacctaaag

SEQ ID NO: 26 - protein, 571 aa, Streptococcus agalactiae
MHIETVIDFKELGKRYRFKNPTKELIADTLEQVLEVIKEVDYYQSQNYYVVGYLSYEASAAFDSHFKVSQQKLAGEHLAYFTVHKDCENEAFPLSYENVRLADNWTANVSEQEYQEAIANIKGQIRQGNTYQVNYTLELSQQLCSDPFSVYERLMVEQGAGYNAYIAYDDKRILSVSPELFFKKKDEVLTTRPMKGTSARKPTYQEDVAERDWLANDPKNRSENMMIVDLLRNDMGRICDVGTVKVKKLCQVEQYATVWQMTSTIEGVLSPEVTLMSIFQALYPCGSITGAPKISTMAIINELEKRPRGIYCGTIGLCMPDGQAIFNVPIRTVQMKGQQAYYGVGGGITWESQTDSEYEETRQKSAVLTRVNPKFQLITTGRVTENKLLFSQQHVERLVESASYFAYSFDKSKFERELKKYLHQLDEKDYRLKIMLDKTGKVTFEVKQLVNLSKKFLTAEVVVQDYPIKLSPFTYFKTSYRPHIIEGQNEKIFVSPEGLLLETSIGNIVLEKNGRFLTPDLSEGGLNGIYRRHLLKNQKVIEAPLTLKDLESADAIYACNAVRGLYPLNLK

SEQ ID NO: 27 - DNA, 1761 bp, Streptococcus pyogenes
ttgggtatgcatagaaaaactattattgatttcaaagagctcgggcaacgctatctttttgatgagccattagtagaattggtagccaagtccttagatcaggtcggtccagtcattgaaaaagtacaacactaccaacagctgggctattacgtggtgggctatctcagttatgaagcagctgctttttttgacaatgccctacaaacccataatgacagactaggcaacgagtaccttgcctattttacagtgcacaaaacctgtcaaaaaaaagacctacctcttgattatgacagcattactatccctaaccaatgggtcagcgcaactcaaaaagaagcctatcaaaaagccattgaaaccattcaccgtgagatgcaacagggcaatacttatcaggttaactacacccttcaattaactcaggaactcaatgcagctgatagtttagccatttacaataaactcgtcgttgaacaggctgctggctacaatgcctacatcgcccatgatgagtttgccgttatttcagctagtcctgaattgttctttaaacaagagggcaacaggttaactactaggcctatgaaaggcaccaccaaacgaggggttaatagctggctggatcaacaagaacatgactggctccaagctgacgggaaaaaccgttctgaaaacatgatgattgtggatttgctccgcaatgacatggggaaaatttgccaaacaggcagtgttcgtgttgataggctctgtgaggtcgagcgatactctaccgtctggcaaatgacctcaactattgttggtgacctcaaagcggactgtgacctgatagacattctcaaagctctctttccttgtggctctatcacaggggcaccaaaagtctccaccatggcaattatcacatctctggagccaaaaccaagggggatttattgtggaagtattggcatttgcctacctgatggtcgccgtttcttcaatgttcccattagaaccatccagctcagtcataatcaagctacttatggtgtcggaggcggcatcacttggcaaagcaagtgggaagacgaatacgaggaagtccatcaaaaaacagcttttctctatcggcacaaacaaatctttgacctcaaaacaaccgccaaggtggaacacaaaaaaatagccttccttgagcaacacctcaatcgccttaaagaagcagccacttattttgcttacccttataatgaaaaagctttgcagaaacaactgtcaacctatttggaaaataagaataatgctgcctaccgtttgatgattcgtttatccaaagatggaaagattagcctctctgatcaacccttggaacctttgtcagccgattttctgacagctcaactctctttacagaaaaaggacgtgacagcttcgccttttacctactttaagaccagctaccggcctcatattgagcaaaaatcttatgaacagctattctataaccaagcggggcaattattggaaacgtccattggcaatctctttgttcagctgggtcagaccctctacacaccaccagtggctgtggggattttaccaggactttttcgccaagaactgctagctactggtcaagctcaggaaaaagaggtgacactagctgatttaaaagaggctagcgctatttttggaggaaatgctgtccgtggcctttatcctctcaaccttgagcttactcaccttgatgccctcttagctaagagtcaagcc

SEQ ID NO: 28 - protein, 587 aa, Streptococcus pyogenes
LGMHRKTIIDFKELGQRYLFDEPLVELVAKSLDQVGPVIEKVQHYQQLGYYVVGYLSYEAAAFFDNALQTHNDRLGNEYLAYFTVHKTCQKKDLPLDYDSITIPNQWVSATQKEAYQKAIETIHREMQQGNTYQVNYTLQLTQELNAADSLAIYNKLVVEQAAGYNAYIAHDEFAVISASPELFFKQEGNRLTTRPMKGTTKRGVNSWLDQQEHDWLQADGKNRSENMMIVDLLRNDMGKICQTGSVRVDRLCEVERYSTVWQMTSTIVGDLKADCDLIDILKALFPCGSITGAPKVSTMAIITSLEPKPRGIYCGSIGICLPDGRRFFNVPIRTIQLSHNQATYGVGGGITWQSKWEDEYEEVHQKTAFLYRHKQIFDLKTTAKVEHKKIAFLEQHLNRLKEAATYFAYPYNEKALQKQLSTYLENKNNAAYRLMIRLSKDGKISLSDQPLEPLSADFLTAQLSLQKKDVTASPFTYFKTSYRPHIEQKSYEQLFYNQAGQLLETSIGNLFVQLGQTLYTPPVAVGILPGLFRQELLATGQAQEKEVTLADLKEASAIFGGNAVRGLYPLNLELTHLDALLAKSQA

SEQ ID NO: 29 - DNA, 831 bp, Streptococcus agalactiae
atggtcacaggaggattccgactagacctcttacttgagataactaagatagctcgtgcaacttactattatcaactaaagaaactgaataaaccaaataaagacaaagcaatcaaatctgacattcaatccatttatgatgaacatagaggaaactatggctatcgtcggatttatttagaactgcgaaatcgtggctttgtcatcaaccacaaaagggtgcaaggcttgatgaaaagtatgggcttgactgctcgtattcgtcgtaagcgcaagtatgcctcttacaaaggtgaggttggtaagaaggctgataacctgattcaacgccagtttgaggggtcgaagccctatgagaagtgctataccgatgtgacggagtttgctttacctgaagggaaactttatctatcgcctgttcttgatggctataacagtgagataattgattttaccctgtctcggtctcctgacttgaaacaggttcaaaccatgcttgagagggcttttcctgcggcttcatacagcgaaaccattctccacagcgaccaaggctggcagtaccagcacaagtcctaccatcaatttctggaggacaaaggcattcgtccttctatgtcacggaaggggaacagtcctgacaacggtatgatggaatctttctttgggattctaaaatctgagatgttctatggcttggagaagtcttacaaatcacttgatgaccttgagcaagctatcacagattacattttttactacaacaacaagcgaatcaaagcaaaactaaaaggacttagtcctgtgcaatacagaactaaatccttcact

SEQ ID NO: 30 - protein, 277 aa, Streptococcus agalactiae
MVTGGFRLDLLLEITKIARATYYYQLKKLNKPNKDKAIKSDIQSIYDEHRGNYGYRRIYLELRNRGFVINHKRVQGLMKSMGLTARIRRKRKYASYKGEVGKKADNLIQRQFEGSKPYEKCYTDVTEFALPEGKLYLSPVLDGYNSEIIDFTLSRSPDLKQVQTMLERAFPAASYSETILHSDQGWQYQHKSYHQFLEDKGIRPSMSRKGNSPDNGMMESFFGILKSEMFYGLEKSYKSLDDLEQAITDYIFYYNNKRIKAKLKGLSPVQYRTKSFT

SEQ ID NO: 31 - DNA, 804 bp, Streptococcus pyogenes
atgctacttgaaatccttgatttatcacgctccacctattactatcaagtgaagcgactagctcaaggagataaggatatagaactaaagcatgtgattcgagagatttatgatgagcataaaggtaattacggttatcgtcggattcatatggagttgcgtaaccgaggatttgtggtcaatcataagaaagttcaacgtctcatgaaagtcatgggcttagcagcccgcattcgtcggaagcgcaagtattcttcttacaaaggagaggttggtaagaaggctgataatctgattaaacgtcacttcgaaggctctaaaccttacgaaaaatgttacactgatgtgacggagttggccttacctgaaggaaaactctacttatcacctgttcttgatggctataacagtgagattattgatttcactctatctcggtctcctaacttgaaacaggttcaaaccatgcttgagaagacttttccagcagattcatacagcggaactattcttcatagtgaccaggggtggcaataccaacaccagtcctaccatgattttttagagtctaaaggtattctggcatccatgtcccgcaaagggaatagtccggataacggcatgatggaatccttctttggcattctcaaatctgaaatgttttatggactcgagacaacttatcaatcacttgacaagcttgaagaagctattacagattacattttttactacaacaacaaacgaattaaagcaaaactaaaaggatttagtcctgtccaatacagaactaaatcctttcaa

SEQ ID NO: 32 - protein, 268 aa, Streptococcus pyogenes
MLLEILDLSRSTYYYQVKRLAQGDKDIELKHVIREIYDEHKGNYGYRRIHMELRNRGFVVNHKKVQRLMKVMGLAARIRRKRKYSSYKGEVGKKADNLIKRHFEGSKPYEKCYTDVTELALPEGKLYLSPVLDGYNSEIIDFTLSRSPNLKQVQTMLEKTFPADSYSGTILHSDQGWQYQHQSYHDFLESKGILASMSRKGNSPDNGMMESFFGILKSEMFYGLETTYQSLDKLEEAITDYIFYYNNKRIKAKLKGFSPVQYRTKSFQ

SEQ ID NO: 33 - DNA, 534 bp, Streptococcus agalactiae
atgaaattaagttatgaagataaactagaaatatacgagttaagaaagatcgggatgtcctggtctcagattagtcaacgatatgatgttcgtatctcgaatcttaaatacatgataaaactcatggatcggtatggtgtagaaatcgtcgaaaaaggtagaaatgagtattatccacctgaattaaagcaggaaatgatagataaagtcttgattcatggttgttctcaactctctgtttctcttgattatgctctctctaattgttctatactcacaaattggctttcccaatttaagaaaaatggttatactattgttgagaaaacaagagggagaccgagtaaaatgggacgtaagcgtaagaaaacttgggaagaaatgacagagctcgagcgacttcaggaagaaaatgagcgcttgagaacggagaatgcctttctaaaaaagttgagggatttgcgcttgagggacgaagccttacagagcgaacggcagaaacaattagagaaatggtcacaggaggattccgac

SEQ ID NO: 34 - protein, 178 aa, Streptococcus agalactiae
MKLSYEDKLEIYELRKIGMSWSQISQRYDVRISNLKYMIKLMDRYGVEIVEKGRNEYYPPELKQEMIDKVLIHGCSQLSVSLDYALSNCSILTNWLSQFKKNGYTIVEKTRGRPSKMGRKRKKTWEEMTELERLQEENERLRTENAFLKKLRDLRLRDEALQSERQKQLEKWSQEDSD

SEQ ID NO: 35 - DNA, 513 bp, Streptococcus pyogenes
atgaaatttaatcaagaaacgaaagttaagatttatgagttacggcaaatgggagagtccattaaatccatatcaaaaaagtttgatatggcagaatccgatctcaaatatatgattcgcttgattgataggtatggggtaaccattgttcaaaaatgtaagaatcattattattctccagaactgaagcaagagataataaataaagtcctgattgacggccaatctcagaaacaaacatccttagattatgctttaccaacttctagtatgctctcaaggtggatagcgcaatacaagaaaaacggttatactattcttgaaaaaccaagagggagaccgagtaagatggggcgtaaacgtaagaaaaatttggaagagatgacagaggttgaacgtcttcagaaggaattagaataccctagagcggagaatgctgtgctaaaaaagctgagagaataccgcttgagggacgaagcaaaactcaaagagcaacagaaatcattcaagcat

SEQ ID NO: 36 - protein, 171 aa, Streptococcus pyogenes
MKFNQETKVKIYELRQMGESIKSISKKFDMAESDLKYMIRLIDRYGVTIVQKCKNHYYSPELKQEIINKVLIDGQSQKQTSLDYALPTSSMLSRWIAQYKKNGYTILEKPRGRPSKMGRKRKKNLEEMTEVERLQKELEYPRAENAVLKKLREYRLRDEAKLKEQQKSFKH

SEQ ID NO: 37 - DNA, 903 bp, Streptococcus agalactiae
ttgaaaaatcaacaaaaattaatgtatctagagagtatcgagctatactcaaacatcactaaagccgctgcacacctttttatttctcaaccttacctaagcaaagtgatcaagcaattagaaaatgagttagaaataaaactcatccagagccaaggacaccaaacctttttaacttatgctggacagagatatctattctacctaaaagaaattgatatgattgagcgtcaaatggccaaagaactatatctcatccgttctgataaaaaaggagaaatcacacttgggattaactctggcttagcaagttctattctggcaaatgtacttcccaaatttaacttggagcacccagaaatttctgtcaaattactcgaaaacaatcaaaatatttctgaacaattggtagcgagtggtgatattgacctagctgttgggatggctcctatcctttataaagatggaattgcatcaaccactatttaccgcgacgaattgtttttaatgatacctaccaccagccaactctacaacgctgaaaaacgtggacagattattccttttgaatatcctatttcagttctagacaatgaacctcttatcctaacaccattagagtacggaattggcaaaacaattgcacaattctatgagcttcatcacatgtcattaaatcagatgattacaactagtaccgttcctacagcagctagcctatctttgtcagggatgggagcaacatttgttccacaaactctcattcatcgctatttggataaagagtgcaatgtctaccattttcataagaataagttattttcagagtacattatgatttataaaaaagatgttgaattatctggaattgctctcctactttataaagcttttttaaccaag

SEQ ID NO: 38 - protein, 301 aa, Streptococcus agalactiae
MKNQQKLMYLESIELYSNITKAAAHLFISQPYLSKVIKQLENELEIKLIQSQGHQTFLTYAGQRYLFYLKEIDMIERQMAKELYLIRSDKKGEITLGINSGLASSILANVLPKFNLEHPEISVKLLENNQNISEQLVASGDIDLAVGMAPILYKDGIASTTIYRDELFLMIPTTSQLYNAEKRGQIIPFEYPISVLDNEPLILTPLEYGIGKTIAQFYELHHMSLNQMITTSTVPTAASLSLSGMGATFVPQTLIHRYLDKECNVYHFHKNKLFSEYIMIYKKDVELSGIALLLYKAFLTK

SEQ ID NO: 39 - DNA, 918 bp, Streptococcus pyogenes
ttgataagacaaggagaatcctatttggatattaaacaaattcgttattttatcgcaatcgttgaaaatcattttaacttgagccaggcggcggaactgttgtatgtgtcgcagccgacacttagcatgatgatcaatgattttgaaaaaagagaaaatgttaagctcttcaaacgaaaaagaggtcgtattattgggttaacctatcttggtgataattattataaggacgctcaaaaggttctcagtctctatgatgacatgtttttgaaattgcatgatcacagtaaagggttaaagggaagtatcaatattggtattcctcctcttattttatcagttgttttctcagaagtaatgccaaaactgattttagaaaatccggggattcaattcaatgttaaggagattggtgcttaccaactaaaaaatgaactactcgtgggaaatgttgacgtcgcagtcttgttatccccaacaggcatcgctgataatttggttgagacttatgaaatccagagatcagaattatctgtatgcctgtctccacgccatcgtttagcttccaaaaaagttattcagtgggaagatttaacagatgaacaacttgccctatttgatcctagtttcatggttcaccatttagtgcttgaagcttgcgagcgtcaccaagtcagacctaatattattttgacgtcctcttcctgggattttatgcttaattctaccaagattaatcacaacgtcttaactatttgtcccaaacctattacagaattataccaattaaaggacattaagtgtattccaatggaacgtcccatttcttggcgtgttgtcttaacacgcctccggaaaaaaagttattctgaaatagaagcctacatcatggacgacttgctacagtctttttttaag

SEQ ID NO: 40 - protein, 306 aa, Streptococcus pyogenes
LIRQGESYLDIKQIRYFIAIVENHFNLSQAAELLYVSQPTLSMMINDFEKRENVKLFKRKRGRIIGLTYLGDNYYKDAQKVLSLYDDMFLKLHDHSKGLKGSINIGIPPLILSVVFSEVMPKLILENPGIQFNVKEIGAYQLKNELLVGNVDVAVLLSPTGIADNLVETYEIQRSELSVCLSPRHRLASKKVIQWEDLTDEQLALFDPSFMVHHLVLEACERHQVRPNIILTSSSWDFMLNSTKINHNVLTICPKPITELYQLKDIKCIPMERPISWRVVLTRLRKKSYSEIEAYIMDDLLQSFFK

SEQ ID NO: 41 - DNA, 1212 bp, Streptococcus agalactiae
atggccaatgcatctttgcgacatcaattatttgaaaaacttgaccaaaaatgtgatcaaatggttgctattcgtcgctatttacatgaaaatcccgaattatcatttaaagagacaaaaacagcagcttatatttcagatttttataaaggtaaggactgtcatgttcagacacaatttggtggtatgaatggcgtcgtagttgatatctatggtgataaagcgacagataagcccatcaaacacattgctttgagagccgactttgatgctcttccaattcaggaagagacagggctttcttttgcttcaaaaacagcgggcgtcatgcatgcttgtggacatgatgcccatacagcttatttattgattttggctgagagcttgattgaattaaaatcagaattttcaggtcatatccgtatcttacatcaaccggctgaagaggtgccaccaggcggagcaaaagcaatgattgaagcaggatgtttagatggcattgatgctgtccttggtatccatgttatgtcaacgatggaagagggaacggtacaatatcacgcaggtcccattcaaacagggcgtgccacttttaaagttattttgcaaggtaagggtggacatggttccatgccacatcgtgcaaatgatacaattgttgcagcttctagttttgttatggcagcgcaaacgattgtcagtcgtcgagttaatccatttgacacagcagtagttactatcggatcttttgatggtaaaggttctgctaatgtgatcaaagatagtgtaaccttagaaggtgatgtgcgcgtgatgtctgaagagacacgaggtgttgttgaggaggaatttaagcgtattctagatggaatagcacaaacttatggtgttagttatcagttagactatcagaatgattatcctgttttagttaataacagtgaagtgacacagaaagttgcaaatagtttaaaatctgttgctataaaagaaattttagatgtcattgattgcgaccctcaaacgccgtctgaagattttgcctattatgctcaaacaatcccagcttgcttcttctatgttggagcacatgaagaggggcaaccatattacccacatcatcatccaaaattccaaattgcagaatcatcattgatggtatctgctaaatcaatggcaacagcagcgcttgctatgcttgtagaaggagaa

SEQ ID NO: 42 - protein, 404 aa, Streptococcus agalactiae
MANASLRHQLFEKLDQKCDQMVAIRRYLHENPELSFKETKTAAYISDFYKGKDCHVQTQFGGMNGVVVDIYGDKATDKPIKHIALRADFDALPIQEETGLSFASKTAGVMHACGHDAHTAYLLILAESLIELKSEFSGHIRILHQPAEEVPPGGAKAMIEAGCLDGIDAVLGIHVMSTMEEGTVQYHAGPIQTGRATFKVILQGKGGHGSMPHRANDTIVAASSFVMAAQTIVSRRVNPFDTAVVTIGSFDGKGSANVIKDSVTLEGDVRVMSEETRGVVEEEFKRILDGIAQTYGVSYQLDYQNDYPVLVNNSEVTQKVANSLKSVAIKEILDVIDCDPQTPSEDFAYYAQTIPACFFYVGAHEEGQPYYPHHHPKFQIAESSLMVSAKSMATAALAMLVEGE

SEQ ID NO: 43 - DNA, 1380 bp, Streptococcus agalactiae
atgttaacgacaaaggaaaatttcaaaggaaataacaaattattggtgggaattgtactcgctgtactatcattttggttatttgcacagtctattttaaacatgggaccagatgttcagtcatcattaggtatttcatctggtgcaatggatattggtgtctcaagtacggcattgttttcaggtttatttattgttgtaactggtggtttagcagataaacttggtcgagttaaatttacttttattggtctttgcttaaatattattggttctctactaattgttttagctaatggagcagtgctatttattatgggacgtatttttcaaggattggcagcagcttttattatgccatcaacaatggccttggttaaaacgtactatgatggtaaagatagacaacgtgcagttagtttctggtcaatcggatcgtggggtggctcaggtctatgttcttattttggtggagcggtggcaagtactctaggttggcgttatgtctttatcttttcaatcatcgcatcagtagttagttttctattaattttaggaaccccagaaagtaaaaatgttggacaaaaaactcactttgattaccttggtttaattatttttattatttcaatgttatcgttaaatattgggatatctatggctcaggaacatggattgatgaacgttattccattgagtctttttacagtgatgcttattggatttgttctgttttattatgttgaaacacgtaaatctaatagttttattgactttcatctgtttgaaaatcgattttacttaggtgcgacaatatcaaatttcttactgaatgcagttgcaggaactctgattgttattaatacttacatgcaacaaggtcgccagctaacaccaaaggttgcaggtgaaatgtctttaggctatttggtttgtgtactaattgctatccgagttggtgagaaaattttacaacgttttggtgcccgtaagccaatgcttttgggagctatgagtacatttgttgggatatttttaatgactttggtcaatattcaaggacctttgtatcttgtgttagtctttgttggttatgctttatttggaacaggcttggggatctatgcgacaccatcaacagatacagctatttctagtattcctaatgaaaaagtaggttctgcatctggaatttacaaaatggcaagttcactaggtggtgcaattggtgtagcaacttcaattgcgatttatcatgctttttctggtaatgcagattttcacaaagcagctttgtgtggattaattttaaacctagttttttgtagtctatcgatcttatcaattctttttgttatccctaagaaaattgaggataaa

SEQ ID NO: 44 - protein, 460 aa, Streptococcus agalactiae
MLTTKENFKGNNKLLVGIVLAVLSFWLFAQSILNMGPDVQSSLGISSGAMDIGVSSTALFSGLFIVVTGGLADKLGRVKFTFIGLCLNIIGSLLIVLANGAVLFIMGRIFQGLAAAFIMPSTMALVKTYYDGKDRQRAVSFWSIGSWGGSGLCSYFGGAVASTLGWRYVFIFSIIASVVSFLLILGTPESKNVGQKTHFDYLGLIIFIISMLSLNIGISMAQEHGLMNVIPLSLFTVMLIGFVLFYYVETRKSNSFIDFHLFENRFYLGATISNFLLNAVAGTLIVINTYMQQGRQLTPKVAGEMSLGYLVCVLIAIRVGEKILQRFGARKPMLLGAMSTFVGIFLMTLVNIQGPLYLVLVFVGYALFGTGLGIYATPSTDTAISSIPNEKVGSASGIYKMASSLGGAIGVATSIAIYHAFSGNADFHKAALCGLILNLVFCSLSILSILFVIPKKIEDK

SEQ ID NO: 45 - DNA, 1365 bp, Streptococcus pyogenes
atgtcacatcatcaacaaaccgtttcaaaacaaacaattatggcgattatcgccatagcactcattggtttttcaggaattttgtctgaaaccagtatgaatgtcaccttcccgacactgatgtcagtctatcagttacccttaaatagcttgcaatggatgacgaccatttatttactagcagtggcgattatgatgaccacttcggctacactgaaaaaaaatgtgcgggaaagacccctcttttttatggccacaggtctttttacatttggcaccatcttggccgttctgacccagtcctttgcgatcatgttgctagcccgcatttttcaaggcattggtactggtctggtaatgcctcagatgtttaatattattttagagcgtgtcccaatgcataaggtaggtctatttatgggatttgctggtcttattattagcttagcacctgcttttgggcctacttatgggggctttatgattagccattttagttggcaatggatttttatctgtatactccctgtaccactgattgcaggtattctagcttattattacctcgaagattctccagtaagcgaaaaagtaccctttgactggttggcatttattgcactatcgattagcttaacttctgccttattagctattactagtctagaaaacggcagtgttaatttgtattacttagggctttttattctcagctttatcctcttcctctacaagaatctcacagctaagcaaccctttcttgatattcgcattctcaaaattccctctctaacctttggcctgattcccttttttgtcttccagctgattaatttaggcataaattttctaacgccaaactttattgtcatggaaaagattgctaatagttctcaagctggtatggtgttactacctggtaccttactcggagctctactagcacctgcttttggtaaactttatgatcaaaaaggagcaagactttcgctttatttaggaaatgccttatttagtttatcattgattattatgacacttcaaacaagacattttatgcttttaccattcactcttttatatattttattcacgtttgggcgtaacatgggctttaataatagcttagccacggctattcgagaattgcctgccgagaaaaatgccgatgccacggccatttttcagatgatgcagcaatttgctggcgctctaggaactgctatggcatcactgatagcaaatagtcaagcagaattcacaagcggtgtccagtctgtctaccttctctttactatttttgctctacttgattttatctttttctttgctatgttttaccatttagggaaaaaaggattagcc

SEQ ID NO: 46 - protein, 455 aa, Streptococcus pyogenes
MSHHQQTVSKQTIMAIIAIALIGFSGILSETSMNVTFPTLMSVYQLPLNSLQWMTTIYLLAVAIMMTTSATLKKNVRERPLFFMATGLFTFGTILAVLTQSFAIMLLARIFQGIGTGLVMPQMFNIILERVPMHKVGLFMGFAGLIISLAPAFGPTYGGFMISHFSWQWIFICILPVPLIAGILAYYYLEDSPVSEKVPFDWLAFIALSISLTSALLAITSLENGSVNLYYLGLFILSFILFLYKNLTAKQPFLDIRILKIPSLTFGLIPFFVFQLINLGINFLTPNFIVMEKIANSSQAGMVLLPGTLLGALLAPAFGKLYDQKGARLSLYLGNALFSLSLIIMTLQTRHFMLLPFTLLYILFTFGRNMGFNNSLATAIRELPAEKNADATAIFQMMQQFAGALGTAMASLIANSQAEFTSGVQSVYLLFTIFALLDFIFFFAMFYHLGKKGLA

SEQ ID NO: 47 - DNA, 615 bp, Streptococcus agalactiae
  MISC_FEATURE (1)..(615): n = a, c, g, or t
atgagtttatccatcatgacaaaacacaaacacctaactctcttagaccgtaatgacatccaatctggtttggatagaggagaaacctttaaagccatcgggcttaatctactgaaacaccctactactatcgcaaaagaagtcaaacgaaataagcaactaagagaatcaaccaaagactgcctagactgtccgctactaagaaaagctccctatgtttgtaatgggtgtccaaagaggaggatcaactgtggttacaagaagaccttctatcttgctaagcaagctcaaagaaactatgaaaaacttttagttgaatctagagaaggaatccctttgaacaaagagaccttctggaaaatagatagagtgctttctaatggggtcaagaagggccaacgtatctatcatatcctcaaaaccaacgatctagaagtgagttcttcaaccgtttatcgacacatcaagaaaggctacctatccatcacaccaatcgacctacccagagctgtgaagttcaaaaaaaggcgaaagagcacactccctcctattccaaaagcgattaaagaagggcgacggtacgaggattttatagaacacataacnnnnnttaat

SEQ ID NO: 48 - protein, 205 aa, Streptococcus agalactiae
  MISC_FEATURE (1)..(205): Xaa = Any Amino Acid
MSLSIMTKHKHLTLLDRNDIQSGLDRGETFKAIGLNLLKHPTTIAKEVKRNKQLRESTKDCLDCPLLRKAPYVCNGCPKRRINCGYKKTFYLAKQAQRNYEKLLVESREGIPLNKETFWKIDRVLSNGVKKGQRIYHILKTNDLEVSSSTVYRHIKKGYLSITPIDLPRAVKFKKRRKSTLPPIPKAIKEGRRYEDFIEHITXXN

SEQ ID NO: 49 - DNA, 423 bp, Streptococcus agalactiae
atggctaaaaaagttgaaaaacttgtaaaacttcaaattcctgctggtaaagcaactccagctccaccagttggaccagcacttggtcaagcaggaatcaacatcatgggattcactaaagagtttaacgctcgtacagctgatcaagctggtatgattattccagttgttatctcagtatatgaagacaaatcatttgatttcatcactaaaacaccaccagctgctgttcttttgaaaaaagctgcaggtgttgaaaaaggatcaggtgaacctaacaaaactaaagttgcaacaattactcgtgcgcaagtacaagaaattgctgaaactaaaatgccagatttaaacgctgcaaaccttgagtctgcaatgcgtatgatcgaaggtactgctcgttctatgggattcactgttactgac

SEQ ID NO: 50 - protein, 141 aa, Streptococcus agalactiae
MAKKVEKLVKLQIPAGKATPAPPVGPALGQAGINIMGFTKEFNARTADQAGMIIPVVISVYEDKSFDFITKTPPAAVLLKKAAGVEKGSGEPNKTKVATITRAQVQEIAETKMPDLNAANLESAMRMIEGTARSMGFTVTD

SEQ ID NO: 51 - DNA, 495 bp, Streptococcus pyogenes
atgcaatattgcatatctgtgggaggtaaaaatctcaattaccgccaaaaccacaacaggaggatttttaaaatggctaaaaaagtcgaaaaacttgtaaaacttcaaatccctgctggtaaagctacaccagctccaccagttggaccagctcttggtcaagcaggtatcaacatcatgggcttcactaaagaatttaacgctcgtacagctgatcaagctggtatgatcatcccagttgttatctcagtttatgaagacaaatcatttgatttcatcactaaaacaccaccagctgctgttcttttgaaaaaagctgcaggtgttgaaaaaggatcaggtacacctaacactactaaggttgcgacagttactcgtgcacaagtacaagaaattgctgaaactaagatgccagatttgaacgctgcaaacattgaagctgcaatgcgtatgatcgaaggtactgctcgttctatgggattcactgttactgac

SEQ ID NO: 52 - protein, 165 aa, Streptococcus pyogenes
MQYCISVGGKNLNYRQNHNRRIFKMAKKVEKLVKLQIPAGKATPAPPVGPALGQAGINIMGFTKEFNARTADQAGMIIPVVISVYEDKSFDFITKTPPAAVLLKKAAGVEKGSGTPNTTKVATVTRAQVQEIAETKMPDLNAANIEAAMRMIEGTARSMGFTVTD

SEQ ID NO: 53 - DNA, 687 bp, Streptococcus agalactiae
atggctaaaaaaagtaaaaacttacgtgctgctcttgagaaaattgatagcactaaagcatacagcgtagaagaagctgtagctcttgcaaaagaaactaactttgctaaatttgatgcaactgttgaagtttcttataaccttaacattgacgttaaaaaagctgaccaacaaatccgtggtgctatggttttaccagcaggtactggtaaaacttcacgtgttcttgtttttgctcgtggtgctaaagctgaagaagctaaagcagcaggtgcagactttgtcggtgaagatgacttagttgctaaaatccaaggtggatggcttgactttgatgttgttatcgcaacaccagatatgatggcacttgttggacgtcttggacgtgtccttggacctcgtaacttgatgccaaaccctaaaactggtacagtaactatggacgttgctaaagcagttgaagagtctaaaggtggtaaaattacttaccgtgctgataaagcaggtaacgtccaagcccttattggtaaagtttcatttgatgatgctaaattagttgataacttcaaagcatttaatgatgttattgttaaagctaaaccagctactgcaaaaggaacttacatcacaaacctttcaattacaacaacacaaggtgttggtatcaaagttgatcctaactcactt

SEQ ID NO: 54 - protein, 229 aa, Streptococcus agalactiae
MAKKSKNLRAALEKIDSTKAYSVEEAVALAKETNFAKFDATVEVSYNLNIDVKKADQQIRGAMVLPAGTGKTSRVLVFARGAKAEEAKAAGADFVGEDDLVAKIQGGWLDFDVVIATPDMMALVGRLGRVLGPRNLMPNPKTGTVTMDVAKAVEESKGGKITYRADKAGNVQALIGKVSFDDAKLVDNFKAFNDVIVKAKPATAKGTYITNLSITTTQGVGIKVDPNSL

SEQ ID NO: 55 - DNA, 687 bp, Streptococcus pyogenes
atggctaaaaaaagcaaacaaatgcgtgctgcacttgaaaaagtagatagcacaaaagcgtacagtgtagaagaagctgtagcattagtaaaagaaacgaacttcgcaaaatttgatgcgtctgttgaagttgcttacaacttgaacattgacgttcgtaaagcagaccaacaaatccgtggcgcaatggtattgccaaacggaactggtaaaacacaacgtgttcttgtttttgcacgtggtgcaaaagctgaagaagcaaaagcagctggtgcagacttcgtaggtgaagacgaccttgttgcaaaaatcaatggtggatggcttgactttgacgttgttatcgcaacgccagacatgatggctatcgtaggtcgtcttggacgtgtccttggacctcgtaacttgatgccaaaccctaaaactggtacagtaacgatggatgttgctaaagccgttgaagagtctaaaggtggtaaaatcacttaccgtgctgacaaagcaggtaatgttcaagctcttattggtaaagtttcatttgatgctgacaaattggttgaaaacttcaaagccttccacgatgtaatggctaaagctaaacctgcaacagctaaaggaacttacatggcaaacgtctcaatcacatcaacacaaggtgttggtatcaaggttgatcctaactcactt

SEQ ID NO: 56 - protein, 229 aa, Streptococcus pyogenes
MAKKSKQMRAALEKVDSTKAYSVEEAVALVKETNFAKFDASVEVAYNLNIDVRKADQQIRGAMVLPNGTGKTQRVLVFARGAKAEEAKAAGADFVGEDDLVAKINGGWLDFDVVIATPDMMAIVGRLGRVLGPRNLMPNPKTGTVTMDVAKAVEESKGGKITYRADKAGNVQALIGKVSFDADKLVENFKAFHDVMAKAKPATAKGTYMANVSITSTQGVGIKVDPNSL

SEQ ID NO: 57 - DNA, 1623 bp, Streptococcus agalactiae
ttggtaaaaatgagacgtaacatattattgagcattacttgtttattgatggtgactctgactgcatgccattcacaggatagcaaaagtcataaactaaacagtgataaactcacgcttgcttggggagaagactttggtgatgttaatccgcatcgctataaccctgatcagtttgttatccaggatatggtttatgaggggttggtacgatatggtgacaatgggaaaattgaaccagctttagcgaaaagctggagcattagtcaagatggaaaaacctacacttttaaattgagaaatgctaaatattctgatggcagtaactttaatgctgcgaatgtcaaacgtaattttgatagtattttttcgaagtctaatagaggtaatcataattggtttaatttaacgaatcaattggaaaattatcgtgccttgaatcaaagtacttttgaaattaaactgaaacaagcttatagtgctactttatatgatctctctatgattcgaccaattcgctttttatctgatagcgctttccctaaaggtgatgatacaactaagaagaatgtaaaaaaaccaattggaacgggtcaatgggttgtgaaaagtaaaaagcaaaatgaatatattaccttcaaacgtaatgagaattactggggaaagaaaccaaaattaaaagaagtaaccgtaaaagttatacccgatgctcagacgcgtgctttagcattcgaatcaggtgacgttgatttgatctatgggaatggcattattggtttagacacttttgcccaatatacgaaggacaagaaatatgtcacagctatttctcaacctatgtcaacaagacttttgttgctaaatgctaaggaaagtattttccaagataaaaaagttcgtcaggcaatgaatcatgctattgacaaggtttctattgctaagaacacctttagaggaacagaaaagccagcagacactattttttcaaaatcaacatctcactcagatgctaagttaaatccttatagctataatgttgataaagcaaatcagctattggatcaagctggttggaagatgggaaaagataaggttcgtgaaaaagatggtaaaactctaaccttacgtcttccttatatcgccactaaggcaactgataaagacctggtaacttatttccaaggagaatggcgtaaaatcggtattaatgtttctcttattgctatggaagaagatgattattgggctaatgctaaaaagggtaattttgatatgatgttaacctattcttggggagcaccatgggaccctcatgcttggatgtcggcattaactgccaaggcagatcatggacatccagaaaatatagctttagaaaatctagcaactaaaactgaaatggatagacttattaagtcagctctagtagatcctaaggaagaaaatgttgatagagactataagaaggttcttgaattattgcatgatgaggctgtatatatcccattaacttatcaatcggtgatttctgtttataggaaaggtgattttaaaaccatgcgttttgcgccagaagaaaattcattcccattacgctatatagaaaaaaacaatgtatctaag

SEQ ID NO: 58 - protein, 541 aa, Streptococcus agalactiae
MVKMRRNILLSITCLLMVTLTACHSQDSKSHKLNSDKLTLAWGEDFGDVNPHRYNPDQFVIQDMVYEGLVRYGDNGKIEPALAKSWSISQDGKTYTFKLRNAKYSDGSNFNAANVKRNFDSIFSKSNRGNHNWFNLTNQLENYRALNQSTFEIKLKQAYSATLYDLSMIRPIRFLSDSAFPKGDDTTKKNVKKPIGTGQWVVKSKKQNEYITFKRNENYWGKKPKLKEVTVKVIPDAQTRALAFESGDVDLIYGNGIIGLDTFAQYTKDKKYVTAISQPMSTRLLLLNAKESIFQDKKVRQAMNHAIDKVSIAKNTFRGTEKPADTIFSKSTSHSDAKLNPYSYNVDKANQLLDQAGWKMGKDKVREKDGKTLTLRLPYIATKATDKDLVTYFQGEWRKIGINVSLIAMEEDDYWANAKKGNFDMMLTYSWGAPWDPHAWMSALTAKADHGHPENIALENLATKTEMDRLIKSALVDPKEENVDRDYKKVLELLHDEAVYIPLTYQSVISVYRKGDFKTMRFAPEENSFPLRYIEKNNVSK

SEQ ID NO: 59 - DNA, 1632 bp, Streptococcus pyogenes
ttgattgtgtcaaaatacctaaaatacttctctattatcacgttatttttgactgggcttattttagttgcatgtcaacaacaaaagcctcaaacaaaagaacgtcagcgcaaacaacgtccaaaagacgaacttgtcgtttctatgggggcaaagctccctcatgaattcgatccaaaggaccgttatggagtccacaatgaagggaatatcactcatagcactctattgaaacgttctcctgaactagatataaaaggagagcttgctaaaacataccatctctctgaagatgggctgacttggtcgtttgacttgcatgatgattttaaattctcaaatggtgagcctgttactgctgatgatgttaagtttacttatgatatgttgaaagcagatggaaaggcttgggatctaaccttcattaagaacgttgaagtagttgggaaaaatcaggtcaatatccatttgactgaggcgcattcgacatttacagcacagttgactgaaatcccaatcgtccctaaaaaacattacaatgataagtataagagcaatcctatcggttcaggaccttacatggtaaaagaatataaggctggagaacaagctatttttgttcgtaacccttattggcatgggaaaaaaccatactttaaaaaatggacttgggtcttacttgatgaaaacacagcactagcagctttagaatctggtgatgttgatatgatctacgcaacgccagaacttgctgataaaaaagtcaaaggcacccgcctccttgatattccatcaaatgatgtgcgcggcttatcattaccttatgtgaaaaagggcgtcatcactgattctcctgatggttatcctgtaggaaatgatgtcactagtgatccagcaatccgaaaagccttgactattggtttaaataggcaaaaagttctcgatacggttttaaatggttatggtaaaccagcttattcaattattgataaaacaccattttggaatccaaaaacagccattaaagataataaagtagctaaagctaagcaattattgacaaaagcgggatggaaagaacaagcagacggtagccgtaaaaaaggtgaccttgatgcagcgtttgatctgtactaccctactaatgatcaattgcgagcgaacttagccgttgaagtagcagagcaagccaaggccctagggattactattaaactcaaagctagtaactgggatgaaatggcaacgaagtcacatgactcagccttactttatgccggaggacgtcatcacgcgcagcaattttatgaatcgcatcatccaagcctagcagggaaaggttggaccaatattacgttttataacaatcctaccgtgactaagtaccttgacaaagcaatgacatcttctgaccttgataaagctaacgaatattggaagttagcgcagtgggatggcaaaacaggtgcttctactcttggagatttgccaaatgtatggttggtgagccttaaccatacttatattggtgataaacgtatcaatgtaggtaaacaaggcgtccacagtcatggtcatgattggtcattattgactaacattgccgagtggacttgggatgaatcaactaag

SEQ ID NO: 60 - protein, 544 aa, Streptococcus pyogenes
LIVSKYLKYFSIITLFLTGLILVACQQQKPQTKERQRKQRPKDELVVSMGAKLPHEFDPKDRYGVHNEGNITHSTLLKRSPELDIKGELAKTYHLSEDGLTWSFDLHDDFKFSNGEPVTADDVKFTYDMLKADGKAWDLTFIKNVEVVGKNQVNIHLTEAHSTFTAQLTEIPIVPKKHYNDKYKSNPIGSGPYMVKEYKAGEQAIFVRNPYWHGKKPYFKKWTWVLLDENTALAALESGDVDMIYATPELADKKVKGTRLLDIPSNDVRGLSLPYVKKGVITDSPDGYPVGNDVTSDPAIRKALTIGLNRQKVLDTVLNGYGKPAYSIIDKTPFWNPKTAIKDNKVAKAKQLLTKAGWKEQADGSRKKGDLDAAFDLYYPTNDQLRANLAVEVAEQAKALGITIKLKASNWDEMATKSHDSALLYAGGRHHAQQFYESHHPSLAGKGWTNITFYNNPTVTKYLDKAMTSSDLDKANEYWKLAQWDGKTGASTLGDLPNVWLVSLNHTYIGDKRINVGKQGVHSHGHDWSLLTNIAEWTWDESTK

SEQ ID NO: 61 - DNA, 942 bp, Streptococcus agalactiae
atgtatctaagtagttcgatcatcaaaaaaatattgtcagcttttttggcattgtttttcatatcacttctaacatttattcttatcaaactatcaacagttaattcagcagaaaattaccttcgtttatcaaaaataagtgttagtccagaagcgctaaaagaagcagagcactatttaggtttagataagccattatggaagcagtactggctgtggttccaaaaagcattaacaggagattttggatattcttatgtgctcaggttgccagtattagatttggttttacaacggtttttggctactttatttttaggcacgagtgccttcttgctaattgttaccatttctaccccgttaggtgtgtgggctggcttacatgaatctgctcggagtgatcacttgattcgatttttgagtttttctagtgtgtctatgccaaatttttgggttgcttacttgttgatgctgctattttcggcaaaattaaatcttctgcctgtttcaggaggtaacgatttacaaagtttaattttgccaagtattaccttaagtttttctaccgtaggtcaatacatagcccttattcgaaaagctattagtcaagaaaatagaagtttaaatgtggaaaatgcccgattaagaggagtaaaagaacgttatattgtcacacatcacctccttagaaatgccttacctgcgataatgacagcacttagcttgacttgggtttacttattaacaggatcaattattgttgaagaaattttttcatggaatggaataggacgtttatttgtgaccagtctaagaacttcagatcttccagtaatacaagcttgtatgctaatttttggaaccttatttttagctaataattttatgacacagtgttttatgaattgggttgatcctcggttacgaaagtcaagggagaaa

SEQ ID NO: 62 - protein, 314 aa, Streptococcus agalactiae
MYLSSSIIKKILSAFLALFFISLLTFILIKLSTVNSAENYLRLSKISVSPEALKEAEHYLGLDKPLWKQYWLWFQKALTGDFGYSYVLRLPVLDLVLQRFLATLFLGTSAFLLIVTISTPLGVWAGLHESARSDHLIRFLSFSSVSMPNFWVAYLLMLLFSAKLNLLPVSGGNDLQSLILPSITLSFSTVGQYIALIRKAISQENRSLNVENARLRGVKERYIVTHHLLRNALPAIMTALSLTWVYLLTGSIIVEEIFSWNGIGRLFVTSLRTSDLPVIQACMLIFGTLFLANNFMTQCFMNWVDPRLRKSREK

SEQ ID NO: 63 - DNA, 975 bp, Streptococcus pyogenes
gtgaaacgtactaccattattatcatctggaaaatcatcagatgtgtcacgcttatttttggggtatctgttttgaccttcgttttgttaaaacaatctccagtagatccagtcatggcaagtgtcaattatgacacatcactaacccctgctcagtacaaagcgattgctcaccactatggcttggataagccagctctagtccaatattttatttggttgaaaaatgtgatacagggagatttagggacctcgctcgtttatcggcaacctgttagtgatattattagatcacgggcaggtgcttctttcatacttatgggactctcttggatcttatcgggtcttattggatttatcttaggaacgttatccgctttccatcaagggaaattacttgaccgagttgtcaggtggttttcataccttcagatatcagtaccaacgttttggattggactcatttttttattaatcttttctgtccagctggggtggttcccgattggtatttcttccccgataggcactttgagtcaagatattacgttagctgatcgagttaagcaccttatgttacctgttttcacgctaagtattctaggcattgccaatgtcacccttcatacgagaactaaaatgatgtcggtgctttctagtgaatatgtcttatttgccagagcgcgtggggaaacacagtggcaaatttttaaacatcattgccttagaaatgctatcgtaccagctattacactgcatttttcctattttggagaattgtttggaggatctgttcttgctgagcaagttttctcatatcctggcttagggtctaccctcactgaagcaggacttaaaagtgatacaccgctccttctagctattgtgatgatagggacattatttgtttttgcgggcaatcttattgcggatattttaaatagcatcatcaatccacagttaaggagaaaagta

SEQ ID NO: 64 - protein, 325 aa, Streptococcus pyogenes
VKRTTIIIIWKIIRCVTLIFGVSVLTFVLLKQSPVDPVMASVNYDTSLTPAQYKAIAHHYGLDKPALVQYFIWLKNVIQGDLGTSLVYRQPVSDIIRSRAGASFILMGLSWILSGLIGFILGTLSAFHQGKLLDRVVRWFSYLQISVPTFWIGLIFLLIFSVQLGWFPIGISSPIGTLSQDITLADRVKHLMLPVFTLSILGIANVTLHTRTKMMSVLSSEYVLFARARGETQWQIFKHHCLRNAIVPAITLHFSYFGELFGGSVLAEQVFSYPGLGSTLTEAGLKSDTPLLLAIVMIGTLFVFAGNLIADILNSIINPQLRRKV

SEQ ID NO: 65 - DNA, 765 bp, Streptococcus agalactiae
ttgttagtgattagtgccatttttgcccctattctatctagctttgatccacaatacgtagatttatcacaaaaattattggctcccaataatgttcatttgttagggactgaccaattgggtagagatgtattatctcgcttgctttatggtgctagatattcactgtttttagctattattattagcttattggaattaacgattggtatgtttgtgggtcttattgttggttggtatcaaggaaagttagaaaacctctttttatggatagctaatattattttagcttttccgagctttttgctctctcttgcaaccgtgggaatcttaggtcatggtctagggaatttaatttttgcaattgtctttgtggaatgggtttactatgctaaattaatgaccaatttagttaagagtgcaaaaaaagagccttatgtgataaatgcgcaaattatgggactttcagtctggcatattttaagaaaacatatttttccttttgtgtatcagccaatcctcgttatggtccttatgaatataggaaatattattttaatgatttctggcttttctttcttagggattggtgtgcaacctaatgtcacagaatggggaatgatgttgcacgatgctagaggatattttaggacagctacttggatgatgttatctcctggaattgcgatttttttaacagtattttcctttaatactttaggcgatgccatagataaaaaagattggaaacgacaatggaacagt

SEQ ID NO: 66 - protein, 255 aa, Streptococcus agalactiae
MLVISAIFAPILSSFDPQYVDLSQKLLAPNNVHLLGTDQLGRDVLSRLLYGARYSLFLAIIISLLELTIGMFVGLIVGWYQGKLENLFLWIANIILAFPSFLLSLATVGILGHGLGNLIFAIVFVEWVYYAKLMTNLVKSAKKEPYVINAQIMGLSVWHILRKHIFPFVYQPILVMVLMNIGNIILMISGFSFLGIGVQPNVTEWGMMLHDARGYFRTATWMMLSPGIAIFLTVFSFNTLGDAIDKKDWKRQWNS

SEQ ID NO: 67 - DNA, 819 bp, Streptococcus pyogenes
atgatattgaaacgtcgaacgatggttttatggcaactgggtatcgccatttctctcattcttagtattctagccttaaacctttatttctataggacgcctttggaaaccaatgcagctttacgcaacctcgctccttccttaaaccatctttttgggacagatggtttaggtagggatatgtttgtcagaacgattaaagggctttatttctctttacaagtcggcttattaggcgcccttatgggagtctttcttgcgaccgtttttggagtgcttgcaggtctaggaaatagccttattgataaaataatagcctggttggttgatttgtttattggtatgcctcatttgatttttatgattctcatttcttttgttgttgggaaaggggctcaaggggttatcattgcaacagctgttacccattggccctctctagcaaggcttatccgcaatgaagtctatgatctaaagaataaagcctttgtccagctctctaaaagcatgggaaaaacgccttattatattgtgaggcatcatatcctgcctttgattgcttctcaaattttcattgggtttatcctcttatttccgcacgtcatcttgcatgaagcatccatgactttcttaggatttggcctttctgccgaacaaccttcggttggtatcattttgtcagaggcagctaagcatatctctcttggcaattggtggttggtgatttttccaggcctttatcttattttggttgtcaatgcctttgatactatcggagaatctttaaagaaactcttttaccctcaaacggatcatttt

SEQ ID NO: 68 - protein, 273 aa, Streptococcus pyogenes
MILKRRTMVLWQLGIAISLILSILALNLYFYRTPLETNAALRNLAPSLNHLFGTDGLGRDMFVRTIKGLYFSLQVGLLGALMGVFLATVFGVLAGLGNSLIDKIIAWLVDLFIGMPHLIFMILISFVVGKGAQGVIIATAVTHWPSLARLIRNEVYDLKNKAFVQLSKSMGKTPYYIVRHHILPLIASQIFIGFILLFPHVILHEASMTFLGFGLSAEQPSVGIILSEAAKHISLGNWWLVIFPGLYLILVVNAFDTIGESLKKLFYPQTDHF

SEQ ID NO: 69 - DNA, 798 bp, Streptococcus agalactiae
ttggaaacgacaatggaacagttagaaataagaaaattgtcattacagataggagaggtccctgtactaagagattttagttgtaaaatagatatgggagaatcgctaactattattggtgagagtggttcagggaaaaccctcttggcaaaattattggttggtcacattccacaaggtatgacagttagaggaaacatattttttaagggagttgatttaggtaaactaactgtaaagcagtggcagaaattaaggggacgagatattgcctatttagtgcaaaatcccatgtctatgtttaatccttttcaaaaaattgaagcgcatattttggaaacaatccttagtcatgagaaatgttcaaagagagtagccttatctaaagcgttagaatggatgaaacgtttaaatttagatgatgcgatatccctgttaaaaaaatacccttttgagcttagtggaggaatgctacaaagaattatgttagccactatattatctcttgatcctcaggtaatcatattagatgagccgacctcagcggttgattgtcataattgttctactatatcagctattttgcaggaattgcaaaataatggaaaaaccttgattactgtaacgcatgattatcagttagctagagacctggggggacaattattagttataagtgagggagaagttgttgaacagggacaaacccaagctattttaagcaatcctcaacataactatacgaaagcactgacagtgcaaatggagtatgaaggagatattcttaatgttggtttg

SEQ ID NO: 70 - protein, 266 aa, Streptococcus agalactiae
METTMEQLEIRKLSLQIGEVPVLRDFSCKIDMGESLTIIGESGSGKTLLAKLLVGHIPQGMTVRGNIFFKGVDLGKLTVKQWQKLRGRDIAYLVQNPMSMFNPFQKIEAHILETILSHEKCSKRVALSKALEWMKRLNLDDAISLLKKYPFELSGGMLQRIMLATILSLDPQVIILDEPTSAVDCHNCSTISAILQELQNNGKTLITVTHDYQLARDLGGQLLVISEGEVVEQGQTQAILSNPQHNYTKALTVQMEYEGDILNVGL

SEQ ID NO: 71 - DNA, 1068 bp, Streptococcus pyogenes
atgacaaaagaaaataatgtaatcttaactgccaaagatgtggtggtagaatttgatgtgcgtgatcgtgttttaacagctatccgtaacgtctcactggaacttgttgaaggagaagtccttgcttttgtaggggaatcaggctcaggtaaatctgttttaacaaagacctttacagggatgttggagtctaatggacgcattgctaatggttcaattgtctatcgtgggcaagaattgacagatttaaaaacaaataaagagtgggcaaagattcgcggctcaaaaatcgcaacgattttccaagacccaatgaccagtcttagtcccattaaaactatcggtagccaaatcacagaagtgattattaagcaccaaaaagtaagtcatgccaaagctaaagaaatggcccttgattacatgaataaagtgggtatcccaaatgccaaaaaacgctttgaagattacccatttgagtattcaggaggaatgcgtcaacgtattgttatcgctattgctttagcttgtcgcccagatattcttatctgtgatgagccaacaacagcccttgatgtgactattcaagctcaaatcgttgagttattgaagtcgcttcaacgagaatatcatttcaccattatctttattacgcacgatttaggtgttgtggcaagcattgcagataaagtggctgtcatgtatgcaggagaaattgttgaatttggaacagtcgaagagattttctatgatccaagacacccctatacatggagtttgctgtctagcttaccgcagttggcagatgaatctggtgaactttacgctattccaggaacgcctccatcactttattcaccaattatcggagatgcctttgcacttcgctcagaatatgctatggttttagactttgaaaaagcacctccggcgattaacgtatctgagactcattgggccaaaacatggcttttacacccagaggctccaaaagttcaaaaaccagaagtcattcaagatttgcatcaaaaaatcttaagaaaaatgtcacaacaggaggaaggaaatgtc

SEQ ID NO: 72 - protein, 356 aa, Streptococcus pyogenes
MTKENNVILTAKDVVVEFDVRDRVLTAIRNVSLELVEGEVLAFVGESGSGKSVLTKTFTGMLESNGRIANGSIVYRGQELTDLKTNKEWAKIRGSKIATIFQDPMTSLSPIKTIGSQITEVIIKHQKVSHAKAKEMALDYMNKVGIPNAKKRFEDYPFEYSGGMRQRIVIAIALACRPDILICDEPTTALDVTIQAQIVELLKSLQREYHFTIIFITHDLGVVASIADKVAVMYAGEIVEFGTVEEIFYDPRHPYTWSLLSSLPQLADESGELYAIPGTPPSLYSPIIGDAFALRSEYAMVLDFEKAPPAINVSETHWAKTWLLHPEAPKVQKPEVIQDLHQKILRKMSQQEEGNV

SEQ ID NO: 73 - DNA, 696 bp, Streptococcus agalactiae
atgaaggagatattcttaatgttggtttgtaatcatgtcggaaaaacatttggacgacaagaggttttaaaggactgtcattttcatcttaaaagaggagaaataattggtataatgggtaaaagtggcagtggtaaaagtagccttgcccgactcattataggactagatagtcctacttgtggttcgatatattttcaaggaaaaatttacacacctaaagatggtaaggcgcagattatccttgtttttcaagatgcgcttagttcggtcaatccatattttagtattgaggaaattttgaatgaagctttttatggaaaaaaaacaacttttgaattatgtcaaatattagaagcggtgggtttagatggaacttatctaaaatataaagctagacaacttagtggtggtcagctacagagagtttgtatcgctagagctttactcttaaagcctaaaattattatttttgatgaatccttaagtggattagacccagtaactcaaattaaaatgctacgtttattacaaaaaataaaacgccgttatgaattaagttttataatgatttctcatgaccctaaaatttgtcaagctatctgtaaccgggtctttctgataaaaaatggttatttagtagaagataatgaattcttgaagagagcgtgttctactaactgtttgaccaatctc

SEQ ID NO: 74 - protein, 232 aa, Streptococcus agalactiae
MKEIFLMLVCNHVGKTFGRQEVLKDCHFHLKRGEIIGIMGKSGSGKSSLARLIIGLDSPTCGSIYFQGKIYTPKDGKAQIILVFQDALSSVNPYFSIEEILNEAFYGKKTTFELCQILEAVGLDGTYLKYKARQLSGGQLQRVCIARALLLKPKIIIFDESLSGLDPVTQIKMLRLLQKIKRRYELSFIMISHDPKICQAICNRVFLIKNGYLVEDNEFLKRACSTNCLTNL

SEQ ID NO: 75 - DNA, 1062 bp, Streptococcus pyogenes
atgaatgaagcaataattcaattagatcatattgatattaccttccgtcaaaaaaaacgggttatcgaagctgttaaagatgtcacggttcatatcaatcaaggagatatttatggcattgttgggtattcaggtgccgggaaatcaactcttgtgcgtgtgattaacctgctacaggcaccaacaaacgggaaaatcactgttgatggggatgtgacttttgaccaggggaaaattcaattgtcagctgatgcccttcgccaaaaacgacgtgatattggtatgatcttccaacatttcaatttgatggcccaaaaaacagccaaagaaaatgtagcatttgcgctccgtcattcgtcgttaagtaagactgagaaagaacacaaagttatcgaactgctagaacttgtaggtttatcagagcgagcagataactaccctgcccagttatcgggtgggcaaaaacaaagggtggctattgcgcgtgctctagctaacgatccaaaaattttgatttcagatgaggccacatcagcactagatccaaaaaccactaaacaaattttggcgctcttgcaagaattaaaccgcaaacttggccttaccattgttatgattactcatgaaatgcaaattgttaaggatatttgtaatcgtgttgctgttatgcaaaatggtgttttgattgaagaaggttctgtccttgatatcttttcaaatccaaaagaagccttgacacaggaatttatcacaacagctacagggattgatgaggctttagaaaaaattaaccaacaagacattgttaaacatttgcctgcaaatgcccttctagctcagttgaaatatgcaggaacttctacggatgagcctctacttaatagcatttaccgtcagtttgaagtgacagctaatattttgtatggcaatattgagattttagatcatattccagttggtgacatgattgttgtcttggaagggcaagctgaaaatattcttgcggctgagaaagccttgcatgaagctggtgttgatgttagtattttaaagagaggagcc

SEQ ID NO: 76 - protein, 354 aa, Streptococcus pyogenes
MNEAIIQLDHIDITFRQKKRVIEAVKDVTVHINQGDIYGIVGYSGAGKSTLVRVINLLQAPTNGKITVDGDVTFDQGKIQLSADALRQKRRDIGMIFQHFNLMAQKTAKENVAFALRHSSLSKTEKEHKVIELLELVGLSERADNYPAQLSGGQKQRVAIARALANDPKILISDEATSALDPKTTKQILALLQELNRKLGLTIVMITHEMQIVKDICNRVAVMQNGVLIEEGSVLDIFSNPKEALTQEFITTATGIDEALEKINQQDIVKHLPANALLAQLKYAGTSTDEPLLNSIYRQFEVTANILYGNIEILDHIPVGDMIVVLEGQAENILAAEKALHEAGVDVSILKRGA

SEQ ID NO: 77 - DNA, 726 bp, Streptococcus agalactiae
gtggaacctaaatatcaacgtatattaattaagttatctggtgaagcattggcgggagataagggtgtcggtattgacattcctaccgttcaatctattgcaaaagaaattgccgaagtacacaattcaggtgttcaaatagcgcttgtcattggtggaggtaatctttggcgtggagaacctgcagcagaagcagggatggatcgtgttcaagctgattatacagggatgttagggacagtaatgaatgctcttgtaatggctgatagccttcaacaatatggggtagatactagagttcaaacagctattccaatgcaaactgttgctgagccttacgtacgtggtcgtgctttacgtcatctagagaagaatcgtattgttgtctttggagcgggtattggttcgccttatttctcaactgatacaacagcagcgcttcgtgctgctgagattgaggcagaagcaattttaatggctaaaaatggagtagatggtgtttataatgctgatccaaagaaagatgccaatgctgtcaaatttgatgaattaactcacgttgaagtaataaaacgagggttaaaaatcatggatgcaaccgcatcaactatttcaatggataatgatattgaccttgttgttttcaatatgaatgagactggtaatattaagcgtgttgttcttggagaacaaatcggaacaactgtttcaaacaaagcatctgaa

SEQ ID NO: 78 - protein, 242 aa, Streptococcus agalactiae
MEPKYQRILIKLSGEALAGDKGVGIDIPTVQSIAKEIAEVHNSGVQIALVIGGGNLWRGEPAAEAGMDRVQADYTGMLGTVMNALVMADSLQQYGVDTRVQTAIPMQTVAEPYVRGRALRHLEKNRIVVFGAGIGSPYFSTDTTAALRAAEIEAEAILMAKNGVDGVYNADPKKDANAVKFDELTHVEVIKRGLKIMDATASTISMDNDIDLVVFNMNETGNIKRVVLGEQIGTTVSNKASE

SEQ ID NO: 79 - DNA, 726 bp, Streptococcus pyogenes
gtggaacctaaatatcaacgtatattaattaagttatctggtgaagcattagcaggtgaaaaaggagttggcattgacattccaactgttcaggctattgcaaaagaaattgccgaagttcatgtgtcgggagtacagatcgctcttgttattggtggaggcaatctctggcgtggagagcctgcagcagacgctggaatggaccgtgttcaggctgattacactggcatgcttggaacggtgatgaatgccctagtcatggctgatagtcttcaacattatggtgttgatacccgtgtgcaaacagctattcctatgcaaaatgtagcagaaccttatattcgcggacgtgccttgcgccatctagaaaaaaatcggattgttgtttttggagctggtattggctcgccttatttttcaacagacaccaccgcggcactgcgtgctgctgagattgaagcagatgctattttaatggcaaaaaatggtgtggatggggtctataatgctgatcctaaaaaagatgctaatgcggttaaatttgatgaattaacacatggtgaagtgatcaaacgtggtctcaaaatcatggatgcaacggcatcgaccttatcgatggataacgatattgatttggtggttttcaatatgaatgaagctggcaatattcaacgtgttgtctttggagaacatattggaactactgtatcaaataaagtttgtgac

SEQ ID NO: 80 - protein, 242 aa, Streptococcus pyogenes
VEPKYQRILIKLSGEALAGEKGVGIDIPTVQAIAKEIAEVHVSGVQIALVIGGGNLWRGEPAADAGMDRVQADYTGMLGTVMNALVMADSLQHYGVDTRVQTAIPMQNVAEPYIRGRALRHLEKNRIVVFGAGIGSPYFSTDTTAALRAAEIEADAILMAKNGVDGVYNADPKKDANAVKFDELTHGEVIKRGLKIMDATASTLSMDNDIDLVVFNMNEAGNIQRVVFGEHIGTTVSNKVCD

SEQ ID NO: 81 - DNA, 93 bp, Streptococcus agalactiae
ttgattgatgatttatcaaatggtgaaattaaaagaacacgagcttcaggtacagtaatagaagctaattggttaaggggggttggcgctcca

SEQ ID NO: 82 - protein, 31 aa, Streptococcus agalactiae
MIDDLSNGEIKRTRASGTVIEANWLRGVGAP

SEQ ID NO: 83 - DNA, 555 bp, Streptococcus agalactiae
atgactaaggaaatcgttacaaaagctcaagagcgttttgagcaatcacaccaaagtttatcaagagaatttgcagggattcgtgcaggacgtgctaatgctagcttgcttgatcgtattcaagttgagtattatggagcgccaaccccccttaaccaattagcttctattactgtacctgaagctcgtgttcttttaatttcaccatttgataaatcatcaatcaaagatattgagcgtgctattaacgaatcagatttaggtattaatcctgcaaatgatggttcagttattcgtcttgttattccagctttgacagaagaaacacgtcgtgatttagctaaagaagtgaaaaaagtcggagaaaatgctaagattgctatccgtaatattcgccgtgatgctatggatgaagctaagaagcaagaaaagaataaagaaattacagaagatgacttgaaatctcttgaaaaagatattcaaaaggctactgatgatgctgtaaaacatattgatgagatgactgctaataaagaaaaagaattgttggaagtt

SEQ ID NO: 84 - protein, 185 aa, Streptococcus agalactiae
MTKEIVTKAQERFEQSHQSLSREFAGIRAGRANASLLDRIQVEYYGAPTPLNQLASITVPEARVLLISPFDKSSIKDIERAINESDLGINPANDGSVIRLVIPALTEETRRDLAKEVKKVGENAKIAIRNIRRDAMDEAKKQEKNKEITEDDLKSLEKDIQKATDDAVKHIDEMTANKEKELLEV

SEQ ID NO: 85 - DNA, 555 bp, Streptococcus pyogenes
atggcaaatgcaattattgaaactgcaaaagaacgttttgcacaatcccatcagtctttatcacgtgaatatgccagcattcgtgcgggtcgtgccaacgctagtcttttagaccgtatccaagttgattattacggggcaccgacaccattaaatcaattggcttcaatcactgtaccagaagcgcgtgtcttattgatctcgccttttgataaatcttctatcaaagatatcgagcgcgctcttaacgcatcagatttaggcattacacctgctaacgatggctctgtcattcgtttggttattccagctttgaccgaagaaacacgtaaagaattagccaaagaagtgaaaaaagttggtgaaaatgctaaaattgcaatccgtaatatccgccgcgatgctatggatgatgctaaaaagcaagaaaaagcaaaagaaatcactgaagatgagttaaaaacacttgagaaagatatccaaaaagcaaccgatgatgctatcaaagaaattgaccgcatgacggctgaaaaagaaaaagaattgctctcagtg

SEQ ID NO: 86 - protein, 185 aa, Streptococcus pyogenes
MANAIIETAKERFAQSHQSLSREYASIRAGRANASLLDRIQVDYYGAPTPLNQLASITVPEARVLLISPFDKSSIKDIERALNASDLGITPANDGSVIRLVIPALTEETRKELAKEVKKVGENAKIAIRNIRRDAMDDAKKQEKAKEITEDELKTLEKDIQKATDDAIKEIDRMTAEKEKELLSV

SEQ ID NO: 87 - DNA, 942 bp, Streptococcus agalactiae
ttggcaagtaataaaatgattatggaggtaactgatagaatcaaaaccagatggatttggtttgtcggttacctttttaaaaggagaaaaatgaatacattattagcgacagtcataacaggcttagtaactgatgaaaacaaagatttttactttatccaaaaagatggctttacctttgcattatcaaagtcagaaggagagcatcacattggtgaaatggttaaaggattcgcctatacagatatgcaacaaaaagcacgtcttacaactaaagaaacatttgcgactcgagatcattatggttgggggacagttactgaggtacgtaaagacttgggagtatttcttgatactggtcttccagataagcaagtggttgtttctttggatgttcttcctgaattgaaagaactttggcctaaaaaaggtgatcgcctctacgtttgcttagatgttgataaaaaagatcgtctctgggctctccctgcagatcctgaagtgtttcaacgaatggcaacccctgcatataacaatatgcaaaatcaaaattggccagcaatcgtttatcgcttaaaattgtcaggaacttttgtttatctaccagaaaataatatgctcggctttattcaccctagtgaacgttacagtgaacctcgtttagggcaagtgctggatgcacgagttattggcttcagagaagttgatagaaccttaaatttatcattaaagcctcgttcttttgaaatgttagaaaatgacgcacaaatgattttaacgtatttagaaagtaacggaggattcatgactttaaatgataaatcttctccagaggaaattaaagctacttttggaatttccaaaggtcagtttaaaaaagcacttggaggactcatgaaagctaaaaagatcaaacaagatcagctaggtacagaattatta

SEQ ID NO: 88 - protein, 314 aa, Streptococcus agalactiae
MASNKMIMEVTDRIKTRWIWFVGYLFKRRKMNTLLATVITGLVTDENKDFYFIQKDGFTFALSKSEGEHHIGEMVKGFAYTDMQQKARLTTKETFATRDHYGWGTVTEVRKDLGVFLDTGLPDKQVVVSLDVLPELKELWPKKGDRLYVCLDVDKKDRLWALPADPEVFQRMATPAYNNMQNQNWPAIVYRLKLSGTFVYLPENNMLGFIHPSERYSEPRLGQVLDARVIGFREVDRTLNLSLKPRSFEMLENDAQMILTYLESNGGFMTLNDKSSPEEIKATFGISKGQFKKALGGLMKAKKIKQDQLGTELL

SEQ ID NO: 89 - DNA, 855 bp, Streptococcus pyogenes
atgaatgatttactagcaacagtcattactgggcttattaaagaagaaaacgctaatgactattttatccacaaagaagggtttacctttaccttgtctaaagcagaaggagaacgccagattggtgatatggtcacaggctttgcctatacagacatagagcaaaaggcacgtctcacaaccaaagagatccgttcaacacggacaagttatggctggggggaagtgacagaggttcgtcgtgacctaggcgtttttgtcgatacaggaattccaaataaagaaattgtggtttctttggacgtgttgcctgagatgaaagaactatggcctaaaaaaggggataaactttacattcgtttggatgtggataaaaaagaccgtatttggggacttccagcagagcctgaggtctttcaaaagatggctagccctgcttacaataacatgcaaaatcaacattggccagcaattgtttaccgcctaaaattaacaggaacgtttgtttacctgcctgaaaacaacatgttgggctttattcactcaagtgaacgctacgcagaaccgcgcttaggtcaggttttagatgcccgtgtgattgggtttagagaggtcgatcgtaccttgaatttatcgttgaaaccacgttcttttgagatgttggagaatgacgctcagatgattgttacttatctggaagccaatggtggtttcatgactttaaatgacaaatcaagtccagaagagattaaagcaagctttggtatttcaaaaggccagtttaaaaaagccttgggtggattgatgaaagctaaacgtatcaaacaagacgccacaggaactgaattaatagga

SEQ ID NO: 90 - protein, 285 aa, Streptococcus pyogenes
MNDLLATVITGLIKEENANDYFIHKEGFTFTLSKAEGERQIGDMVTGFAYTDIEQKARLTTKEIRSTRTSYGWGEVTEVRRDLGVFVDTGIPNKEIVVSLDVLPEMKELWPKKGDKLYIRLDVDKKDRIWGLPAEPEVFQKMASPAYNNMQNQHWPAIVYRLKLTGTFVYLPENNMLGFIHSSERYAEPRLGQVLDARVIGFREVDRTLNLSLKPRSFEMLENDAQMIVTYLEANGGFMTLNDKSSPEEIKASFGISKGQFKKALGGLMKAKRIKQDATGTELIG

SEQ ID NO: 91 - DNA, 555 bp, Streptococcus agalactiae
ttggctttttttgttataatgtatctattaaaaagaatggagaacgatatggaacgtgcgatttttgctggaggttgtttttggtgtatggtacaaccatttgaagaattagatggtattgaatctgttttatctggatacactggaggacatgttgagaatccaacttataaagaagtttgtagtaaaactactggacatacagaagctgttgaaattatttttaatcctgaaaaaatctcttatgcagatttagttgagttatattgggcacaaacagatccaacagacgcttttggtcagtttgaagatcgtggggataattatcgtcctgtcatcttttatgagaatgaagagcaacgtcagattgctcaaaaatcaaaagataagctacaagcttcgggtagatttgatagaccaattgtaaccagcattgagcctgctgatactttttacccagcagaagactatcatcaagcattctatcggactaaccctgctcgttacgccttgagtagtgccagaagacatgcatttctagaggagaactggcat

SEQ ID NO: 92 - protein, 185 aa, Streptococcus agalactiae
MAFFVIMYLLKRMENDMERAIFAGGCFWCMVQPFEELDGIESVLSGYTGGHVENPTYKEVCSKTTGHTEAVEIIFNPEKISYADLVELYWAQTDPTDAFGQFEDRGDNYRPVIFYENEEQRQIAQKSKDKLQASGRFDRPIVTSIEPADTFYPAEDYHQAFYRTNPARYALSSARRHAFLEENWH

SEQ ID NO: 93 - DNA, 507 bp, Streptococcus pyogenes
atggaaagagccatttttgcaggaggttgtttctggtgtatggtgcaaccttttgaggagcaagcaggtattttgtcagtcagaagtggctacacaggtgggcatctcccaaatcctagctatgaacaagtttgtgccaaaacaacaggacatacagaagctgttgaaattatttttgaccctaagcaaatcgcttataaagatttggtagagctctattggacgcagacggatccaacagacgcctttgggcaatttgaagatcgtggggacaactaccgtcctgtcatttactacacaacggaaagacaaaaagaaattgcagagcaatcaaaagcaaacttgcaagcttcaggacgttttgaccaacccattgtcaccactattgaaccagcagagccattttatctcgcagaggattatcaccaaggattttataaaaagaatcccaagcggtatgcacaaagcagtgctattcgtcatcagtttttagaggagaattggtca

SEQ ID NO: 94 - protein, 169 aa, Streptococcus pyogenes
MERAIFAGGCFWCMVQPFEEQAGILSVRSGYTGGHLPNPSYEQVCAKTTGHTEAVEIIFDPKQIAYKDLVELYWTQTDPTDAFGQFEDRGDNYRPVIYYTTERQKEIAEQSKANLQASGRFDQPIVTTIEPAEPFYLAEDYHQGFYKKNPKRYAQSSAIRHQFLEENWS

SEQ ID NO: 95 - DNA, 213 bp, Streptococcus agalactiae
ttgagaaaatcattttacagttggttgatgacacaaagaaatccaaaatcaaatgaaccagtagcaatcctagcagattacgcttttgatgaaaccacttttccaaaacatagttcggattttgaaacagttagtcgctatttagaagatgaggccagtttttcctttaatttaacagattttgatgatatttgggaagattatctcaatcat

SEQ ID NO: 96 - protein, 71 aa, Streptococcus agalactiae
MRKSFYSWLMTQRNPKSNEPVAILADYAFDETTFPKHSSDFETVSRYLEDEASFSFNLTDFDDIWEDYLNH

SEQ ID NO: 97 - DNA, 219 bp, Streptococcus pyogenes
ttggtcatgagaaaatcattttacagctggctgatgacacaacgtaaccctaaatcaaatgaacctgtggcgattttagcagatttggtgtttgatgacaccacttttccaaagcataccaatgattttgaactcattagtcggtatctagaagatcaagctagtttttcctttaatttaggtcaatttgatgaaatctgggaagattatctagcacat

SEQ ID NO: 98 - protein, 73 aa, Streptococcus pyogenes
LVMRKSFYSWLMTQRNPKSNEPVAILADLVFDDTTFPKHTNDFELISRYLEDQASFSFNLGQFDEIWEDYLAH

SEQ ID NO: 99 - DNA, 1776 bp, Streptococcus agalactiae
ttgtttatgagatatacaaatggaaattttgaagcctttgcaagacctcgaaaacctgaaggtgtggataaaaaatccgcttatattgttggttctggtttagcaggattagctgccgctgtctttttaatacgtgacggtcaaatggatggtcaacgtattcatatttttgaagaactacctctttctggaggatcacttgacggtgtcaaacgacctgatatcggttttgtaacgcgtggtggtcgtgaaatggaaaatcacttcgaatgtatgtgggatatgtaccgttccatcccctctctcgaagttccagatgcttcttatctagatgaattttattggcttgacaaggatgatcccaattcatctaactgtcgcctcattcataaacaggggaatcgcttagaatctgatggtgattttacactcggaacacattccaaagagttagttaagctagtcatggagactgaagagtctttaggtgctaagacgattgaagaagttttttcaaaagaattttttgaaagtaatttttggacttattggggtactatgtttgcctttgagaaatggcattcagcgattgaaatgcgtcgatatgctatgcgctttatccatcatattggtggtctgcctgatttcacttcattaaaatttaataaatataatcaatatgattctatggtgaaaccaatcatcagttatttagagtctcataatgtagatgttcaatttgatagcaaggtaactaatatctccgtagactttaagaacggtcagaagcttgcaaaagctattcatctcacagttggtggtgaagcaaaaacaattgatcttactccaaatgattttgtttttgtaacgaatggttctatcactgaaagtacgaactatggtagtcatgatactgtagctaaacctaataccgatttgggaggttcttggaatctttgggaaaacttagctgctcaatctgatgaatttggacatcctaaagtcttctacaaagatattccaaaagagtcatggtttgtttctgctactgcaacaataaaagatccagctattgaaccttatatagagcgtttaacacatcgtgacctccatgatggtaaagtaaataccggaggcattgttacagttacagattctaattggatgatgagttttgctatccatcgccaaccgcatttcaaagagcaaaaggaaaatgaaacaattgtttggatttatggactctattcaaatgtggaaggtaattatattaaaaaaccaattgaagaatgtactggtcgagaaatcacagaagagtggttatatcacttaggtgttcctgaaatgaagattcatgatttatctgataaacaatatgtaagtacagttcctgtttatatgccttacattactagttatttcatgcctcgagttaaaggtgaccgaccagatgttatcccacaaggatctgttaacctagccttcattggtaattttgcagaatctccatccagagatacagtatttacaacggaatattctattagaactgctatggaagctgtttatactttcttaaatattgaacgtggtgttccagaagtctttaattcagcatttgatattcgtgtcttgttgcaatctttatactatctcaatgataagaaatctgttgaagatatggatttaccaatacctgccttaatgcgtaaagtaggcatgaaaaaaattagaggaacttatttagaagaattacttcgagaagctcatctttta

SEQ ID NO: 100 - protein, 592 aa, Streptococcus agalactiae
MFMRYTNGNFEAFARPRKPEGVDKKSAYIVGSGLAGLAAAVFLIRDGQMDGQRIHIFEELPLSGGSLDGVKRPDIGFVTRGGREMENHFECMWDMYRSIPSLEVPDASYLDEFYWLDKDDPNSSNCRLIHKQGNRLESDGDFTLGTHSKELVKLVMETEESLGAKTIEEVFSKEFFESNFWTYWGTMFAFEKWHSAIEMRRYAMRFIHHIGGLPDFTSLKFNKYNQYDSMVKPIISYLESHNVDVQFDSKVTNISVDFKNGQKLAKAIHLTVGGEAKTIDLTPNDFVFVTNGSITESTNYGSHDTVAKPNTDLGGSWNLWENLAAQSDEFGHPKVFYKDIPKESWFVSATATIKDPAIEPYIERLTHRDLHDGKVNTGGIVTVTDSNWMMSFAIHRQPHFKEQKENETIVWIYGLYSNVEGNYIKKPIEECTGREITEEWLYHLGVPEMKIHDLSDKQYVSTVPVYMPYITSYFMPRVKGDRPDVIPQGSVNLAFIGNFAESPSRDTVFTTEYSIRTAMEAVYTFLNIERGVPEVFNSAFDIRVLLQSLYYLNDKKSVEDMDLPIPALMRKVGMKKIRGTYLEELLREAHLL

SEQ ID NO: 101 - DNA, 1812 bp, Streptococcus pyogenes
gtgatgatatcactttgcttgactattcaaggaggtcttgaaatgtattatactagtggtaattacgaagcttttgcaacacctcgaaaacccgaaggggtagatcagaaatcagcttatattgttggtactggtttagctggtttagcagcagctgttttccttattcgcgatgggcatatggctggggaacgcattcatctgtttgaggaattgcctttagcaggtggttctttagatggtattgaaaagcctcatcttggttttgtgacccgtggtggtcgtgagatggaaaatcattttgagtgtatgtgggacatgtatcggtctattccctcactggaaattcccggtgcgtcttatttagatgaattttattggttggataaggatgatcctaactcatccaactgtcgtttgattcacaagagaggaaatcgtgtggatgatgacggccagtatacgctcggtaaacagtcaaaagaattaatccatttaatcatgaagacagaagaatctctaggagaccaaaccattgaagagttcttctcagaagatttctttaagagtaatttttgggtgtattgggcaaccatgtttgcttttgaaaaatggcattctgctgtagaaatgcgacgctatgcgatgaggtttatccaccatattgatggtttgccagatttcacctccctcaagttcaacaaatataaccaatatgactctatggtcaaaccgattattgcttacctagaatcacacgacgttgacatccaatttgacacaaaagtcactgatattcaggtggagcaaacagctggtaaaaaggtagcaaaaaccatccatatgacggtgtctggggaggctaaggcgattgagctaacacctgatgatttggtttttgtgaccaatggttctattactgaaagcagcacatacggtagtcatcacgaagtggctaagccaaccaaagcgttaggtggttcttggaatttatgggaaaatctagctgctcaatcagatgattttggtcatcctaaagtgttttaccaggacttgcctgctgaaagctggtttgtgtctgctacagcaaccataaaacacccagctatcgagccttatatagaacgtttgacccaccgtgacttgcacgatggcaaagtgaacactggcggcatcatcactattacagattctaactggatgatgagctttgccattcaccgtcaacctcattttaaagaacaaaaagaaaatgagaccactgtctggatttacggtctttattccaatagtgagggcaattacgtccacaagaaaattgaggagtgtacaggtcaagaaatcacagaagaatggttgtaccaccttggggtacctgttgataaaatcaaggacttagcgagtcaggactatatcaatacagttcctgtttacatgccttatattacgagttactttatgccacgcgtcaaaggagaccgtccgaaagttatcccagatggttcagtcaacttggcctttattggtaactttgcggaatctccatctcgagatacggtctttacgactgagtattctattcgtactgccatggaagcagtgtatagcttcttgaatgtggaacgaggcatcccagaagtctttaattcagcctatgatattcgtgaattgctcaaagccttttattaccttaatgataaaaaggcaatcaaggatatggatttgccaattcctgcactgattgagaaaatcggacataaaaaaatcaaggatacctttatcgaagaattgctcaaagatgctaatcttatg

SEQ ID NO: 102 - protein, 604 aa, Streptococcus pyogenes
VMISLCLTIQGGLEMYYTSGNYEAFATPRKPEGVDQKSAYIVGTGLAGLAAAVFLIRDGHMAGERIHLFEELPLAGGSLDGIEKPHLGFVTRGGREMENHFECMWDMYRSIPSLEIPGASYLDEFYWLDKDDPNSSNCRLIHKRGNRVDDDGQYTLGKQSKELIHLIMKTEESLGDQTIEEFFSEDFFKSNFWVYWATMFAFEKWHSAVEMRRYAMRFIHHIDGLPDFTSLKFNKYNQYDSMVKPIIAYLESHDVDIQFDTKVTDIQVEQTAGKKVAKTIHMTVSGEAKAIELTPDDLVFVTNGSITESSTYGSHHEVAKPTKALGGSWNLWENLAAQSDDFGHPKVFYQDLPAESWFVSATATIKHPAIEPYIERLTHRDLHDGKVNTGGIITITDSNWMMSFAIHRQPHFKEQKENETTVWIYGLYSNSEGNYVHKKIEECTGQEITEEWLYHLGVPVDKIKDLASQDYINTVPVYMPYITSYFMPRVKGDRPKVIPDGSVNLAFIGNFAESPSRDTVFTTEYSIRTAMEAVYSFLNVERGIPEVFNSAYDIRELLKAFYYLNDKKAIKDMDLPIPALIEKIGHKKIKDTFIEELLKDANLM

SEQ ID NO: 103 - DNA, 1035 bp, Streptococcus agalactiae
atgaaattttgttataatgtagtcacttactgtacgaaaaggaagaataatttgcaagaatactctatcgaaattactttacaacatccagatgatatgatgtcactctttggcagcaatgagcgccatttaaaattaatcgaagaaaatttagatgttatcattcatgctagaactgaacgtgttcaggtattaggtgactctgaagaagcagtagaaaccgctcggttaaccattgaagcattattagtgcttgttaaccgcgggatgactgtgaatacttcagatgttgtaacagccttatccatggcacaaaatggttcaattgataaattcgttgccctttatgaggaagaaattattaaggatagctatggtaagcctatccgtgttaagactttagggcaaaaaatatacgttgatagcgttaaaaatcatgatgttgtttttggtattgggcctgctggaacgggaaaaacttttttagcagtcactctagcagtaacggcactaaagcgtggtcaagttaaacgaataatcttaacgagaccagcggttgaagctggtgaaagccttggtttcttgcctggagatctcaaagagaaagttgatccttatttgagaccagtttatgatgccctatatcaaattttaggtaaagagcaaacaagtcgcttaatggagcgtgaaatcatcgaaattgctccattggcttacatgcgtggtcgtactttagatgatgcatttgtcatattagatgaagcgcaaaacaccactataatgcaaatgaaaatgttcctaacacgtcttggcttcaattctaaaatgattgtaaatggcgatgttagccaaattgacttaccaaagaatgttaaatctggtttgattgatgctgttgagaaattacgaaatatcaaaaagattgactttattcatttatcagcaaaggatgttgtaagacaccctgtcgttgctgaaataataaatgcttattcagattcagaaagtagtcacaagctacaatctgataaggac

SEQ ID NO: 104 - protein, 345 aa, Streptococcus agalactiae
MKFCYNVVTYCTKRKNNLQEYSIEITLQHPDDMMSLFGSNERHLKLIEENLDVIIHARTERVQVLGDSEEAVETARLTIEALLVLVNRGMTVNTSDVVTALSMAQNGSIDKFVALYEEEIIKDSYGKPIRVKTLGQKIYVDSVKNHDVVFGIGPAGTGKTFLAVTLAVTALKRGQVKRIILTRPAVEAGESLGFLPGDLKEKVDPYLRPVYDALYQILGKEQTSRLMEREIIEIAPLAYMRGRTLDDAFVILDEAQNTTIMQMKMFLTRLGFNSKMIVNGDVSQIDLPKNVKSGLIDAVEKLRNIKKIDFIHLSAKDVVRHPVVAEIINAYSDSESSHKLQSDKD

SEQ ID NO: 105 - DNA, 1050 bp, Streptococcus pyogenes
ttgcaagagtattctattgacattaccttaacccatcctgatgatgttttagctctttttggtagcaacgagcgtcatttgaagctaatagaagctcatttaggagttattgttcacgcaagaaccgagcgagtccaagtgattggtgatgatgaagaagctgtggaattggctcgattgaccatcaaagccctactggttctagtgggtcgtggcatggtggtcaacacatcagatgtggtgacagctttatctatggcagaatctcatcagattgaccaatttatggcgctttatgaagaagaaatcattaaagataactatggtaaggcaatacgagtcaaaacattaggtcaaaaaacctatgttgatagtgtcaaacgtcatgatgtggtttttggtgtaggacctgcagggacaggtaaaaccttcttagctgttacgcttgcagtcactgctctgaaaagaggacaggtaaagcgtattattttgacgcgtcctgcggtagaagctggcgaaagcctaggttttttaccaggcgatttgaaagaaaaggtggatccttacctcagacctgtttacgatgccctttatcacattttaggcaaggaacaaaccacacgcctgatggaacgagatgtgattgagattgctccgttagcttatatgcgaggtcgtactctggatgacgcttttgttatcttagatgaggctcaaaacacgaccatcatgcaaatgaagatgtttttgacccgtcttggttttaattctaaaatgattgtcaatggagatacgagtcagattgacctccctcgaaatgtcaagtctggtttgattgatgctactcagaaattacaaggcattaaacagattgattttgtctatttctctgctaaggatgttgtccgacatcctgttgtggctgatattatcaaggcttatgaaacgtcctcagaggagatgaaggacttactaaaacctaaggctagtgacgttgaagctgattaccagccaggcttgacaaaataccctgtgatcggtcaagagcac

SEQ ID NO: 106 - protein, 350 aa, Streptococcus pyogenes
LQEYSIDITLTHPDDVLALFGSNERHLKLIEAHLGVIVHARTERVQVIGDDEEAVELARLTIKALLVLVGRGMVVNTSDVVTALSMAESHQIDQFMALYEEEIIKDNYGKAIRVKTLGQKTYVDSVKRHDVVFGVGPAGTGKTFLAVTLAVTALKRGQVKRIILTRPAVEAGESLGFLPGDLKEKVDPYLRPVYDALYHILGKEQTTRLMERDVIEIAPLAYMRGRTLDDAFVILDEAQNTTIMQMKMFLTRLGFNSKMIVNGDTSQIDLPRNVKSGLIDATQKLQGIKQIDFVYFSAKDVVRHPVVADIIKAYETSSEEMKDLLKPKASDVEADYQPGLTKYPVIGQEH

SEQ ID NO: 107 - DNA, 801 bp, Streptococcus agalactiae
atggaccatttcacaaaactctggcaagatttctctaaacttccaaatgttgttgctatagcactcggaggctcacgctctggtgacagttttgaccaatcttccgattatgatttgtatgtttattgtgcagcaactcctgatatcactagtcgtaaacgtatccttaacaagcactgtcattacattgaacttaacaatcattactgggagcttgaagataatggtactttaaacgacggaactgatattgatattctctatcgtaacatagataactttttatcagacttagaagatgtcgttgaacaccacaattctcgaattggatacactacttgtttttggcataacctcatcaattgccaaatactctatgatcctgaaaatcaattacaatcactcaaagagagattcgaagtttcttatcccagtcagttacaaaaacaaattatcattcaaaatcgtaacttattaactggcaagcttccctcttacgataaacaaattataaaagcccttaaacgccaagactttgttagtactcaccatagaactactgctttcttagattcctactttgatattatttttgcacttaataagttgacacatcctggcgaaaaaagaatgatttcctatgctaagaagaatgctacattgcttcctaaacatttcgaagaaaatatcattaaactatgtcatcacaactccaacgaacacactgttaaagaaacattaaacgatataataatgcatctcgacgtcatgcttaaagaaaattttcaacactttataggt

SEQ ID NO: 108 - protein, 267 aa, Streptococcus agalactiae
MDHFTKLWQDFSKLPNVVAIALGGSRSGDSFDQSSDYDLYVYCAATPDITSRKRILNKHCHYIELNNHYWELEDNGTLNDGTDIDILYRNIDNFLSDLEDVVEHHNSRIGYTTCFWHNLINCQILYDPENQLQSLKERFEVSYPSQLQKQIIIQNRNLLTGKLPSYDKQIIKALKRQDFVSTHHRTTAFLDSYFDIIFALNKLTHPGEKRMISYAKKNATLLPKHFEENIIKLCHHNSNEHTVKETLNDIIMHLDVMLKENFQHFIG

SEQ ID NO: 109 - DNA, 474 bp, Streptococcus agalactiae
atgaaacaagattatatttcctacattaggtcaaaagttggacatgagactatctttttaacatattctggtggtattttgacagatggtaagggacgtgtcttactccaattaagagctgataagaattcttggggaattattggtggatgtatggagttaggtgagtcatcagtagatacattgaaaagagaatttttcgaagaaactggattgagagtggaaccaatcagactgttaaatgtttatactaactttcaagactcttatcccaatggcgataaagcacaaaccgtcggttttatttatgaagtaagctgtccaaaaccagttaatatagaaggttttcataatgaggaaacattgcaattggactatttttctaaagaagacgtcaaaaatattacgatcgtaaatgaacaacaccaattaattttagatgaatatttttcacaaacattccaaatggggcgt

SEQ ID NO: 110 - protein, 158 aa, Streptococcus agalactiae
MKQDYISYIRSKVGHETIFLTYSGGILTDGKGRVLLQLRADKNSWGIIGGCMELGESSVDTLKREFFEETGLRVEPIRLLNVYTNFQDSYPNGDKAQTVGFIYEVSCPKPVNIEGFHNEETLQLDYFSKEDVKNITIVNEQHQLILDEYFSQTFQMGR

SEQ ID NO: 111 - DNA, 519 bp, Streptococcus pyogenes
ttggctataatgagaaagaatactaacatagtaaagcgagatcatatgccacaagactacatttcttatatccgctccaaagttgggcatgataagattattcttaactttgctggtgggattttgaccaatgatgacggcaaggtgctgatgcagctgcgtggtgataagaaaacctggactattcctggtggcactatggaactgggtgagagctctttagagacttgcaaacgtgagttcttagaggaaaccggaattgaggttgaagctgttcgcttactgaatgtttacactcattttgaggaagtttatcccaacggtgatgctgttcagactattgtctttatctatgaactaacggctgtttctgatatggctattgataactttcataatgaggaaacgctcaagttacaatttttctctcatgaggagatagcagagttagagagtgtctcagccaaacatcgcctgatgttagaggaatattttagtgatagctttgctatggggcat

SEQ ID NO: 112 - protein, 173 aa, Streptococcus pyogenes
LAIMRKNTNIVKRDHMPQDYISYIRSKVGHDKIILNFAGGILTNDDGKVLMQLRGDKKTWTIPGGTMELGESSLETCKREFLEETGIEVEAVRLLNVYTHFEEVYPNGDAVQTIVFIYELTAVSDMAIDNFHNEETLKLQFFSHEEIAELESVSAKHRLMLEEYFSDSFAMGH

SEQ ID NO: 113 - DNA, 117 bp, Streptococcus agalactiae
gtgactgtttttttagaaagcataagaagtacagaaaaagaaaattatggaatatttgatggtggggatatgctttacttacggtattggaatgatatacttaaagaaatccagttt

SEQ ID NO: 114 - protein, 39 aa, Streptococcus agalactiae
MTVFLESIRSTEKENYGIFDGGDMLYLRYWNDILKEIQF

SEQ ID NO: 115 - DNA, 804 bp, Streptococcus agalactiae
atgaagataacattacacggcgttgctgaaacgttattaatcaccttatatattagggctaaagatgcgatggctaaacatccgatacttaatgatcaaaaatccttagcaattgttgaacagatagaatatgattttgataaattcgataattcagaagcttctttttatgcaacattagctagaattcgcgttatggatagagaaatcaaaaaatttattagagaaaatccaaatagtcaaatcctttcaattggttgtggacttgatacaaggtttgaaagagtcgataatggacaaattaggtggtataaccttgatttgccagaggttatggagataagaaaattattttttgaagagcatgaaagagttactaatatagcaaaatcagccctagatgaaacttggacacgggaggtaaatccccaaaatgccccttttctaatcgtgtcagaaggtgttttaatgtttctaaaagaagatgacgtagagacttttcttcatatcctgacaaattcatttagccaatttatggcacaatttgatttgtgtcataaggaaatgattaataaaggaaagcaacatgatacagtaaagtatatggatacagaatttcagtttggtatcacagatggtcatgagattgtggatttagaccctaaattaaagcaaataaatctgattaactttacagatgagatgagcaaatttgagttaggcacacttcgctctttacttccaacaattcgtaaatttaataattgtttaggtgtgtacgaatataaagcatctgagaaaaag

SEQ ID NO: 116 - protein, 268 aa, Streptococcus agalactiae
MKITLHGVAETLLITLYIRAKDAMAKHPILNDQKSLAIVEQIEYDFDKFDNSEASFYATLARIRVMDREIKKFIRENPNSQILSIGCGLDTRFERVDNGQIRWYNLDLPEVMEIRKLFFEEHERVTNIAKSALDETWTREVNPQNAPFLIVSEGVLMFLKEDDVETFLHILTNSFSQFMAQFDLCHKEMINKGKQHDTVKYMDTEFQFGITDGHEIVDLDPKLKQINLINFTDEMSKFELGTLRSLLPTIRKFNNCLGVYEYKASEKK

SEQ ID NO: 117 - DNA, 495 bp, Streptococcus agalactiae
atgtacgttgaaatgattgatgaaactggacaagtttcagaagatatcaaaaagcaaactcttgatttgttagagtttgcagcacaaaaaacaggtaaagagaataaagaaatggctgtaacgtttgtcactaatgaacgtagccatgaattgaatttagagtatcgagataccgatcgtccgactgatgttatcagtttagaatataagcctgaggttgatatttcttttgatgaagaagatctggctgaaaatcctgaacttgctgagatgctagaagattttgattcttatattggtgaactttttatttctattgataaagctaaagaacaagcagaagagtacggtcactcttatgaacgtgaaatgggttttttagctgtacatggttttttgcatattaacggttatgatcattatacacccgaagaagaaaaagagatgttcagcttacaggaagaaattttaactgcttatggacttaaacgacaa

SEQ ID NO: 118 - protein, 165 aa, Streptococcus agalactiae
MYVEMIDETGQVSEDIKKQTLDLLEFAAQKTGKENKEMAVTFVTNERSHELNLEYRDTDRPTDVISLEYKPEVDISFDEEDLAENPELAEMLEDFDSYIGELFISIDKAKEQAEEYGHSYEREMGFLAVHGFLHINGYDHYTPEEEKEMFSLQEEILTAYGLKRQ

SEQ ID NO: 119 - DNA, 546 bp, Streptococcus pyogenes
gtgcccaacataccaaatgaggtgggcagcccttccctaacaattaaccttatgtatatcgagatgattgacgaaacgggacaagtttcgcaagagattatggagcaaacacttgatttgctcaattttgctgctcaaaagacgggcaaagaagaaaaagaaatgtctgtgacctttgtgaccaatgaaagaagtcatgaactcaacttagaataccgagatactgatcgtccaacagatgtgatttctctagaatataagccagaaacgcctattttatttagtcaagaggatttggctgctgatcctagtttggcagagatgatggcagagtttgatgcttatattggcgaattgtttatttctattgacaaggcgcgtgagcagtcccaagaatatgggcactcttttgagcgtgaaatgggatttttggctgttcatggattcttacatattaatgggtatgatcactacacccttgaagaagaaaaagagatgtttaccttacaggaagagattttgactgcttatggccttacacgacaa

SEQ ID NO: 120 - protein, 182 aa, Streptococcus pyogenes
VPNIPNEVGSPSLTINLMYIEMIDETGQVSQEIMEQTLDLLNFAAQKTGKEEKEMSVTFVTNERSHELNLEYRDTDRPTDVISLEYKPETPILFSQEDLAADPSLAEMMAEFDAYIGELFISIDKAREQSQEYGHSFEREMGFLAVHGFLHINGYDHYTLEEEKEMFTLQEEILTAYGLTRQ

SEQ ID NO: 121 - DNA, 708 bp, Streptococcus agalactiae
atgtcagaaaatcctgatgcctatattattcgtagtcaaaatttgcataatcaggatttcccaagtaacctcaaagctattgctagggcgggtgcaggaacaaataatattcctattgaagaggcaagtgcacagggaatagtcgtgtttaataccccaggtgcaaatgctaatgctgtaaaagaagcggtcattgctgccttattactttcagctcgtgattatttaggagctaaccgatgggttaatactctaactggaacagatattcccaaacaaattgaagcaggaaagaaagcttttgctggtaatgaaattgcaggaaaaaaattgggagttatcggccttggtgccattggagctagaattgcgaatgatgctagacgcttaggaatgacagttcttggttatgatccctatgtttcaattgaaacagcttggaatatttcaagccatgttcaaagggttaaagagattaaggatatttttgaaacttgtgactatatcacaattcatgttcccttaacaaatgaaactaagcatacttttgatgcgaaagctttttcaatcatgaaaaaaggaactacgattatcaactttgctcgtgcagaattagtcaataaccaagagctatttgaagcgatagaaactggtgttgtcaagcgctatattactgattttggagacaaagaattattaaaccaaaag

SEQ ID NO: 122 - protein, 236 aa, Streptococcus agalactiae
MSENPDAYIIRSQNLHNQDFPSNLKAIARAGAGTNNIPIEEASAQGIVVFNTPGANANAVKEAVIAALLLSARDYLGANRWVNTLTGTDIPKQIEAGKKAFAGNEIAGKKLGVIGLGAIGARIANDARRLGMTVLGYDPYVSIETAWNISSHVQRVKEIKDIFETCDYITIHVPLTNETKHTFDAKAFSIMKKGTTIINFARAELVNNQELFEAIETGVVKRYITDFGDKELLNQK

SEQ ID NO: 123 - DNA, 993 bp, Streptococcus pyogenes
ttgatgaaattaaaattatataatgttagaggcgaagaagcagtcttagcaaaaaaatgggctgatgacaatgggattgagatttccttgacggagtctcccttaactcctgaaacggttaaagaagctgaaggctttgacgggattgccaatgcccaaattggtcctttagatgatgcgatttatcctctcttaaaggaaatggggattaaacaaatcgctcagcacagtgctagtgtcgatatgtataaccttgatttggccaccgaaaatgacattattatcacaaatgttcctagctattctccagaatccattgcagaatttacggttactattgtccttaatttaattcgtcatgtggagttgattcgtgaaaatgttaaaaaacaaaatttcacttggggactccctatccgcggccgtgttttaggtgatatgacagttgcgattatcggaactggacgtattggtctagctactgctaaaatctttaaaggttttggctgcaaggtcgttggatatgatatttaccaaagcgatgctgccaaagctgtcttggactataaggaatctgtagaagaagcgattaaagatgctgatcttgtttccttacacatgccaccaactgcagagaacacacaccttttcaattctgatttatttaaatcattcaaaaaaggggctattttgatgaatatggcgcgtggtgccgtcattgagacgcaagatttactggatgctttggatgcaggcttactgagcggagctggtattgacacttacgaatttgaaggaccttatatacctaagaattttgaaggtcaagaaattacagattcactatttaaagctttgattaaccatcctaaggttatttatacacctcatgcagcttattatactgatgaagccgttaaaaacctagttgaaggtgcccttaatgctacagtagagattatcaaaactgggacaacgacaactcgtgttaac

SEQ ID NO: 124 - protein, 331 aa, Streptococcus pyogenes
LMKLKLYNVRGEEAVLAKKWADDNGIEISLTESPLTPETVKEAEGFDGIANAQIGPLDDAIYPLLKEMGIKQIAQHSASVDMYNLDLATENDIIITNVPSYSPESIAEFTVTIVLNLIRHVELIRENVKKQNFTWGLPIRGRVLGDMTVAIIGTGRIGLATAKIFKGFGCKVVGYDIYQSDAAKAVLDYKESVEEAIKDADLVSLHMPPTAENTHLFNSDLFKSFKKGAILMNMARGAVIETQDLLDALDAGLLSGAGIDTYEFEGPYIPKNFEGQEITDSLFKALINHPKVIYTPHAAYYTDEAVKNLVEGALNATVEIIKTGTTTTRVN

SEQ ID NO: 125 - DNA, 159 bp, Streptococcus agalactiae
  MISC_FEATURE (1)..(159): n = a, c, g, or t
atgcttttcatgagagataatttagattctttgattcagcctgttattgatgagatggctaaacattatcaatggtctgatcaagacaaaactttctatgaagaagaattacatgagactctaaaagacaatgacttggcagctttgaannnnnttaat

SEQ ID NO: 126 - protein, 53 aa, Streptococcus agalactiae
  MISC_FEATURE (1)..(53): Xaa = Any Amino Acid
MLFMRDNLDSLIQPVIDEMAKHYQWSDQDKTFYEEELHETLKDNDLAALXXXN

SEQ ID NO: 127 - DNA, 1836 bp, Streptococcus pyogenes
atggaattttcaagagaaacaagacgcttagctctccaaaaaatgcaagaaagagatttagacctactgattattgggggaggtattacgggtgctggtgtggcacttcaggcggcagctagtggcctagatacgggtctgattgagatgcaagattttgctcaaggaacctctagccgttcaaccaaattggttcacggggggcttcgttacttgaaacaatttgatgtggaggtggtttcagatacggtgtcagagcgggctgtggtgcaacaaattgcaccccacattccaaaaccagaccctatgttattacctgtttatgacgaacctggcagtacctttagcatgttccgtttgaaggtcgctatggatttgtatgatcttttagcaggcgtgtccaatacgccagcggccaacaaggtgttaaccaaagaagaagtcttaaaacgagaaccagacttaaaacaagaaggcttgcttggtggtggggtttaccttgatttccgcaataatgacgcaaggcttgttattgaaaatatcaaacgagctaatcgtgatggggctcttattgctagtcatgtgaaagcagaagatttcttgctagatgacaatggtaagattattggtgtgaaggcgcgtgatctgctgtcagatcaagaaatcattatcaaggctaaattagtcatcaacaccacaggtccatggagtgatgagattcgtcaattctctcataagggacaaccgattcatcaaatgcgccctacaaaaggggtgcatctggtagtggaccgtcaaaaattaccagtgtctcaacctgtctatgttgacacagggttaaatgatggtcgtatggtctttgtcttgccacgtgaggaaaaaacttattttggaacaacggacacggactacactggagacttggagcacccacaagttactcaagaagatgtggattatttgttaggcgttgtcaataaccgctttccaaatgccaacgtgaccattgatgatattgaaagcagttgggctggtcttcgccccttgttatcaggtaatagtgcttctgactacaatggtggcaacagcggtaaagtcagtgatgatagttttgatcacttggttgatactgtcaaagcctatattaaccacgaagatagccgagaagctgttgaaaaagctattaagcaggttgaaaccagcacatctgaaaaagaattggatccgtctgcagtgtcacgaggttcaagttttgagcgtgatgagaatggactctttaccttggcaggtggtaagattaccgactatcgcaaaatggctgaaggagcattgacagggattattcaaatcctcaaagaagagtttggcaaatccttcaagcttatcaattcaaaaacctatcctgtttcaggaggtgaaatcaatccagccaatgtagattcggaaatagaagcctatgctcaattaggaactcttagtggtctttcgatggatgatgctaggtatttggcaaacctttatggttctaatgcgccaaaagtctttgccttaactcgtcaattaacagcagctgaagggttaagtttagctgaaaccttgtccttacattatgcgatggattatgaaatggctcttaaaccgacagattatttcttgagaagaacaaatcacctcttatttatgcgagatagcctagatgctttgattgacccagtgattaatgaaatggctaaacattttgaatggtctgatcaggaaagagtggcacaagaagacgatcttcgtcgcgtgattgcagacaatgatttgagtgccttaaaaggccatcaggagggt

SEQ ID NO: 128 - protein, 612 aa, Streptococcus pyogenes
MEFSRETRRLALQKMQERDLDLLIIGGGITGAGVALQAAASGLDTGLIEMQDFAQGTSSRSTKLVHGGLRYLKQFDVEVVSDTVSERAVVQQIAPHIPKPDPMLLPVYDEPGSTFSMFRLKVAMDLYDLLAGVSNTPAANKVLTKEEVLKREPDLKQEGLLGGGVYLDFRNNDARLVIENIKRANRDGALIASHVKAEDFLLDDNGKIIGVKARDLLSDQEIIIKAKLVINTTGPWSDEIRQFSHKGQPIHQMRPTKGVHLVVDRQKLPVSQPVYVDTGLNDGRMVFVLPREEKTYFGTTDTDYTGDLEHPQVTQEDVDYLLGVVNNRFPNANVTIDDIESSWAGLRPLLSGNSASDYNGGNSGKVSDDSFDHLVDTVKAYINHEDSREAVEKAIKQVETSTSEKELDPSAVSRGSSFERDENGLFTLAGGKITDYRKMAEGALTGIIQILKEEFGKSFKLINSKTYPVSGGEINPANVDSEIEAYAQLGTLSGLSMDDARYLANLYGSNAPKVFALTRQLTAAEGLSLAETLSLHYAMDYEMALKPTDYFLRRTNHLLFMRDSLDALIDPVINEMAKHFEWSDQERVAQEDDLRRVIADNDLSALKGHQEG

SEQ ID NO: 129 - DNA, 489 bp, Streptococcus agalactiae
atggttcgtacaactcgtccaacaactgataaggttaaaggcgctatttttaatatgattggtcctttttttgaaggtggtcgtgttttagaccttttttctggcagtggtagcttagctattgaggcgatctcaaggggaatggaccaagctgtcctagttgaaaaagataggcgtgcgcaggtcgttattcaagaaaatattgcaatgactaagagtccggagcaatttcaattattaaaaatggaagccaaccgtgctttagaacaattaacgggacaatttgatttggtcttgttggacccgccatatgctaaggaagaaattgtaaagcaaatccaaatcatggatagcaagggtttattaggcgatgatatcatgattgcttgtgaaacggacaaatcagttgatttacctgaagaaattgcttcttttgggatatggaaacagaaaatttatggcatttctaaagtaacggtctacgttcgt

SEQ ID NO: 130 - protein, 163 aa, Streptococcus agalactiae
MVRTTRPTTDKVKGAIFNMIGPFFEGGRVLDLFSGSGSLAIEAISRGMDQAVLVEKDRRAQVVIQENIAMTKSPEQFQLLKMEANRALEQLTGQFDLVLLDPPYAKEEIVKQIQIMDSKGLLGDDIMIACETDKSVDLPEEIASFGIWKQKIYGISKVTVYVR

SEQ ID NO: 131 - DNA, 537 bp, Streptococcus pyogenes
atgagagttgtatcaggtgaatttggtgggcgtcctttaaagacgctcgatggaaagataacacgccctacttcagacaaagttagaggtgcgatttttaatatgataggaccttactttaatggtggtcgtgttttagatttgtttgcaggttcaggtggattagccattgaggctgtttctcgtgggatgtctgctgcagttttggttgagaagaatcgtaaagcgcaagctattattcaagacaatattataatgactaaagctgagaatcggtttaccttgttaaaaatggaagctgagcgagctattgattgcttgactggtcgatttgacttagtctttttagaccctccttatgccaaagaaacaattgtggcaactattgaagctttagcagctaaaaacttattgagtgaacaggttatggttgtctgtgagacagataaaacagtcttgttgccaaaagagattgcaacgttaggtatttggaaagaaaaaatttatggaattagtaaggtaacagtttatgttaac

SEQ ID NO: 132 - protein, 179 aa, Streptococcus pyogenes
MRVVSGEFGGRPLKTLDGKITRPTSDKVRGAIFNMIGPYFNGGRVLDLFAGSGGLAIEAVSRGMSAAVLVEKNRKAQAIIQDNIIMTKAENRFTLLKMEAERAIDCLTGRFDLVFLDPPYAKETIVATIEALAAKNLLSEQVMVVCETDKTVLLPKEIATLGIWKEKIYGISKVTVYVN

SEQ ID NO: 133 - DNA, 483 bp, Streptococcus agalactiae
atgacaaagaaagctttatttacaggttcatttgatcctgttactaatggacatttagatattattgagcgcgccagctatctatttgatcatgtttacattgggttattttataaccttgagaagcaaggttacttttcgattgagtgccgtaaaaaaatgttagaagaagctatccgtcagtttaagaatgtttcagttttagtggcgcaagatagactggctgttgacttagcaagggaagtgggagcaaaatattttgttcgaggtctgcgtaatagccaggattttgattatgaagccaatttggagttttttaataaacagttggcagatgatattgagacagtttatttatcaacgtcgccatctttgagtccgatatcatctagtcgcatccgtgaattgatacattttaaggcttctgtgaagccttttgttccaaagagtgttgttagagaagtggagaaaatgagtgaagaa

SEQ ID NO: 134 - protein, 161 aa, Streptococcus agalactiae
MTKKALFTGSFDPVTNGHLDIIERASYLFDHVYIGLFYNLEKQGYFSIECRKKMLEEAIRQFKNVSVLVAQDRLAVDLAREVGAKYFVRGLRNSQDFDYEANLEFFNKQLADDIETVYLSTSPSLSPISSSRIRELIHFKASVKPFVPKSVVREVEKMSEE

SEQ ID NO: 135 - DNA, 489 bp, Streptococcus pyogenes
atgttaactaaaataggactttatacagggtcatttgatcctgttacaaacggtcatctcgatattgttaaacgggcaagtggcctatttgatcaaatatatgttgggatttttgataatcctaccaaaaaaagctattttaaactagaagttcgtaaagcaatgcttactcaagctctggctgattttacaaatgtaattgtagtaacttcgcacgaacgtttagctattgatgtagctaaagaattacgagtaactcacttgattagaggcttgcgaaatgcaactgactttgagtatgaagaaaatttggaatattttaatcaccttttagctccaaatattgaaaccgtctatttgatatcaagaaataaatggcaggcccttagctctagtcgtgtgagagagctaattcattttcagtcttccttagaaggtttggttcctcagtcggttattgctcaagtggagaaaatgaatgaaaagact

SEQ ID NO: 136 - protein, 163 aa, Streptococcus pyogenes
MLTKIGLYTGSFDPVTNGHLDIVKRASGLFDQIYVGIFDNPTKKSYFKLEVRKAMLTQALADFTNVIVVTSHERLAIDVAKELRVTHLIRGLRNATDFEYEENLEYFNHLLAPNIETVYLISRNKWQALSSSRVRELIHFQSSLEGLVPQSVIAQVEKMNEKT

SEQ ID NO: 137 - DNA, 141 bp, Streptococcus agalactiae
ttggatctctattcttcactcattttctccacttctctaacaacactctttggaacaaaaggcttcacagaagccttaaaatgtatcaattcacggatgcgactagatgatatcggactcaaagatggcgacgttgataaa

SEQ ID NO: 138 - protein, 47 aa, Streptococcus agalactiae
MDLYSSLIFSTSLTTLFGTKGFTEALKCINSRMRLDDIGLKDGDVDK

SEQ ID NO: 139 - DNA, 1071 bp, Streptococcus agalactiae
gtgaagaatagagatccaaaaagaaaacataaaagtttactaggtctgcttaaatggtggattataggttttgcttttttattgttagtattagcaagccttgtagtgagactaccttattatttggaaatgccaggtggagcttatgatatccgttcggtattgaaagtgaataaaaaggctgataaagctaagggttcgtacaattttgtagcggtatctgtcagtcaagcaacgccagctcaggttctttatgcttggttaactccttttacagaattatctagtaaagaggagacaacaggtggctttagtaatgacgattatctcagaattaatcaattctacatggagacttctcaaaatgagtccatctatcaagctttaaagttagctaataagcaagtatctcttacttataaaggagtttatgtgcttaacttagctaaaaattcgacatttaaagatagattacatttagctgatacagtcacaggagttaatggcaaaagtttcaaaaattcttctcaacttatcaaatatgttgcagctcttcatctaggtgataaagtaaaggtacaatacacaagtcaaggtaaaaagaaagaatcagttggtaaagttattaaactatcaaacggtaaaaatggtattggtatcggtttgacagaccatacagaagtattatctgatgttcctgtggactttaatactgaaggtgttggaggaccaagtgcaggtttaatgtttactttagcgatttacgaccaattggttaaagaagatttacgtaaaggacgtaagattgcaggtactggtactattgagcaaaatgggcatgttggcgatattggtggagcaggtttgaaagttgtttcagcggctaaaaaaggaatggatattttctttgttcctaataatccgatcgataaaaatgctaaaaaaggcaaaacaaaggttcagacgaattatcaagaggcaaaagcagcagctaagcgattaggtacgaagatgaaaattgtaccagttcaaaatgttcagcaagctattgattatttgaaaaaaacaaaa

SEQ ID NO: 140 - protein, 357 aa, Streptococcus agalactiae
MKNRDPKRKHKSLLGLLKWWIIGFAFLLLVLASLVVRLPYYLEMPGGAYDIRSVLKVNKKADKAKGSYNFVAVSVSQATPAQVLYAWLTPFTELSSKEETTGGFSNDDYLRINQFYMETSQNESIYQALKLANKQVSLTYKGVYVLNLAKNSTFKDRLHLADTVTGVNGKSFKNSSQLIKYVAALHLGDKVKVQYTSQGKKKESVGKVIKLSNGKNGIGIGLTDHTEVLSDVPVDFNTEGVGGPSAGLMFTLAIYDQLVKEDLRKGRKIAGTGTIEQNGHVGDIGGAGLKVVSAAKKGMDIFFVPNNPIDKNAKKGKTKVQTNYQEAKAAAKRLGTKMKIVPVQNVQQAIDYLKKTK

SEQ ID NO: 141 - DNA, 1035 bp, Streptococcus pyogenes
atgaaaagacttaaaaaaatcaaatggtggttagtgggtctgctagctttaatctctttgttgctagcgttattttttccgctaccttattatattgaaatgcctggaggcgcttacgatattcggactgtcttacaagtcaatggcaaagaagacaaacgaaaaggagcttaccagtttgttgcagtgggcattagtcgtgccagcctcgctcagctattatatgcttggctgacaccgtttactgaaattagtacagcagaagatacaacaggcggatacagcgatgctgatttccttcgaattaatcaattttacatggaaacatcacaaaatgcagctatttatcaagctttatccttagctggaaaaccagttacattagattataaaggcgtatatgttttagacgtaaacaacgaatctacttttaaaggaacgctacacttagcagatactgtaacaggtgtaaatggtaaacagtttactagttcagcagaacttattgactatgtttctcacctaaaactaggggatgaagttacggttcagtttacgagtgataataagcctaaaaaaggagttggccgtattatcaaactgaaaaatgggaaaaatgggattggcattgccttgactgatcatacaagtgtcaattcagaagacacagtgatctttagtactaaaggagtaggaggacctagtgctggtctaatgtttactcttgatatatatgatcaaataactaaagaagatttacgcaagggccgtacaattgcaggtacaggaactattggcaaggatggcgaagtaggagatattggtggtgcaggtcttaaagtagttgcagcagctgaagctggtgcagatatattttttgttccgaataatcctgttgataaggaaattaaaaaagttaatccaaatgctataagtaattacgaagaagccaaacgggcagccaaacgactaaagaccaaaatgaagattgttcctgttacgactgttcaagaggcactggtttatcttcgcaaa

SEQ ID NO: 142 - protein, 345 aa, Streptococcus pyogenes
MKRLKKIKWWLVGLLALISLLLALFFPLPYYIEMPGGAYDIRTVLQVNGKEDKRKGAYQFVAVGISRASLAQLLYAWLTPFTEISTAEDTTGGYSDADFLRINQFYMETSQNAAIYQALSLAGKPVTLDYKGVYVLDVNNESTFKGTLHLADTVTGVNGKQFTSSAELIDYVSHLKLGDEVTVQFTSDNKPKKGVGRIIKLKNGKNGIGIALTDHTSVNSEDTVIFSTKGVGGPSAGLMFTLDIYDQITKEDLRKGRTIAGTGTIGKDGEVGDIGGAGLKVVAAAEAGADIFFVPNNPVDKEIKKVNPNAISNYEEAKRAAKRLKTKMKIVPVTTVQEALVYLRK

SEQ ID NO: 143 - DNA, 822 bp, Streptococcus agalactiae
atgacagagcttataagaatactacatttaaatgatctgcactctcattttgagaattttcctaaggtaaaacgattttttcatgacaatcaagcgcagccaatagagacgatttcacttgacttgggggataatattgataaaagccatcctttgacagaagcaagctcgggaaaggctaatgtccaattgatgaatgaactgggtattgagcttgctactattggtaataatgaaggagttggtttatccaaaaaagacttggaccaagtctacaaagattcagattttacggttattgttggcaatctaaaagataacataatcgaaccgagttgggcaaaaccttacattatttatgagacgcagcaaggaactaagcttgcctttttagcttatacttttccttattataaaacctatgaacctaatgggtggacgatagaagatccaattgactgtcttaaatgccatttacaaataaatgagataaaagaggcaaattgtcgcattttgatgagtcatttaggtattcgttttgatacaaggattgctcaagaattttcagaaattgaccttattataggtgcacatacacaccatttatttgaggaaggggagctaattaacggtacatatcttgcagcagctggtaaatatggtcgctttgttgggagtattgatataacttttgataatcatacactaaaagatattttaatctcaacatgtgatacaaaacaactaactggttatccttcggacagtgactggctaagaagattgagtcagaaggtaaagaacagcttagaaaagaaagtt

SEQ ID NO: 144 - protein, 274 aa, Streptococcus agalactiae
MTELIRILHLNDLHSHFENFPKVKRFFHDNQAQPIETISLDLGDNIDKSHPLTEASSGKANVQLMNELGIELATIGNNEGVGLSKKDLDQVYKDSDFTVIVGNLKDNIIEPSWAKPYIIYETQQGTKLAFLAYTFPYYKTYEPNGWTIEDPIDCLKCHLQINEIKEANCRILMSHLGIRFDTRIAQEFSEIDLIIGAHTHHLFEEGELINGTYLAAAGKYGRFVGSIDITFDNHTLKDILISTCDTKQLTGYPSDSDWLRRLSQKVKNSLEKKV

SEQ ID NO: 145 - DNA, 441 bp, Streptococcus agalactiae
atggatgcgatgctgttttacgcaggtgcagatgttgctattatcaattctggcttaattgttcagccatttgaaaaagacttttcgaggaaaaatctccacgaatcattacctcatcaaatgcgcctcgctaaattgacagtgagtagtcaagaacttttagagatttatgaaactatttatcaacaaggtcaatttttagcgcaacaaaagattcatggtatgggctttcgtggcaagtgctttggagaagttttacattcgggatttgattacaaaaatggaaaaatagtgtataatgagaaagatattgatgccaaagaagaagtgattcttgtaatcgttgatcagtattattttgcatcgtattttgagtgtttaaaaacgaaaaaagtagacttgcttttcctgaattactcagagatgtggcagcagattatt

SEQ ID NO: 146 - protein, 147 aa, Streptococcus agalactiae
MDAMLFYAGADVAIINSGLIVQPFEKDFSRKNLHESLPHQMRLAKLTVSSQELLEIYETIYQQGQFLAQQKIHGMGFRGKCFGEVLHSGFDYKNGKIVYNEKDIDAKEEVILVIVDQYYFASYFECLKTKKVDLLFLNYSEMWQQII

SEQ ID NO: 147 - DNA, 576 bp, Streptococcus agalactiae
atgcgaaaagaagtgacaccagagatgcttaactataataagtatcctggcccacagttcattcactttgaaaatatcgttaaaagtgatgatattgaatttcaacttgttattaatgaaaaatcagcttttgatgtgactgtctttggacaacgtttttctgagattttattaaaatatgattttatcgttggcgattggggtaacgagcagttgaggctaagaggcttttacaaagatgctagtacaattagaaaaaatagccggatttcacgtttagaagattatattaaagagtattgtaactttggttgtgcttattttgtgttggagaatccaaatcctagagatattaaatttgatgatgaaagacctcataagcgtcgtaagtcaagatccaaatcacaatcatcaaagtcacaaactagaaataatcgttcccagtcaaatgccaatgctcattttacaagtaaaaagcgtaaagacacaaaacgccgtcaagaacgtcatattaaagaagagcaagataaggaaatgacctctgcaaagcagcattttgttattcgtaagaaaaaa

SEQ ID NO: 148 - protein, 192 aa, Streptococcus agalactiae
MRKEVTPEMLNYNKYPGPQFIHFENIVKSDDIEFQLVINEKSAFDVTVFGQRFSEILLKYDFIVGDWGNEQLRLRGFYKDASTIRKNSRISRLEDYIKEYCNFGCAYFVLENPNPRDIKFDDERPHKRRKSRSKSQSSKSQTRNNRSQSNANAHFTSKKRKDTKRRQERHIKEEQDKEMTSAKQHFVIRKKK

SEQ ID NO: 149 - DNA, 642 bp, Streptococcus pyogenes
atggatttttcagaaaggtgtcaaatgaaaaaagaaatttcgccagaaatgtacaactataataaatttccaggtcccaaatttattcattttgaagagcaagttaaggctgaaggcattgatttgttactcttagaagatgttaagaacgcttttgatacgactagctttggtcaacgttatacagaagttctcctaaagtatgactatattgttggcgattggggaaatgaacagcttcgtcttaaagggttttataaggatagtgacgatatcaagaaaacgaatcgcatctcacgtttagaagattatattaaagaattttgcaattttggttgtgcttattttgttttagaaaatcttcatccacaagatattaaatttgaagaggagcgccaaccaagacgaaagaaatcacctaaatcaaaatcaaatcgtcgcaagccaaactattcaaatcagcagcccgcaacacctaagagcaaatcgaagcgggcatcaaaagaaaagcaacctgaaaaccaagcgtttaccagtcaaaaacgtcgaagtaatactaagcataaagaaaagtcaaaacgtaatcagactagtcaacttaataccaaaattagtcattttatcatcagaaagaaagataaa

SEQ ID NO: 150 - protein, 214 aa, Streptococcus pyogenes
MDFSERCQMKKEISPEMYNYNKFPGPKFIHFEEQVKAEGIDLLLLEDVKNAFDTTSFGQRYTEVLLKYDYIVGDWGNEQLRLKGFYKDSDDIKKTNRISRLEDYIKEFCNFGCAYFVLENLHPQDIKFEEERQPRRKKSPKSKSNRRKPNYSNQQPATPKSKSKRASKEKQPENQAFTSQKRRSNTKHKEKSKRNQTSQLNTKISHFIIRKKDK

SEQ ID NO: 151 - DNA, 1122 bp, Streptococcus agalactiae
atgaagaaagaaaatattatgcctaaaaaaactgatacacccgcctataaaccctctatttatagcttaactcgcgatgaactaatagcttgggctattgaacatggagaaaagaaattccgtgcttcacaaatctgggactggctctataaaaagcgtgtgcaaagcttcgatgaaatgactaacatttccaaagattttattgcacttttgaacgagaattttgttgttaatcctctaaaacaacgtattgttcaagaatctgctgatggaactgttaaatacctttttgaattacctgatggcatgctgattgagacggttttgatgcgtcaacattatggtttatcagtatgtgtaacgactcaagttggttgtaacattggttgcactttctgtgcaagtggtttaataaagaaacaacgtgatcttaacaatggcgaaatcactgctcaaattatgcttgttcaaaaatattttgatgaacgtggacaaggtgagcgcgttagtcacattgtggtcatgggaataggtgaaccctttgataactataccaatgtattaaaattcttgcgtacagttaatgatgataatggattagctattggtgcacgtcacattacagtgtctacttcaggtttagcacataaaattcgtgaatttgcaaatgaaggtgtacaagttaacttagcagtatctcttcatgctccaaataacgatttacgatcaagtatcatgcgtattaatcgttctttccctcttgaaaagttgtttgcggctattgaatattatattgagacgactaaccgtcgtgtaacatttgagtatattatgttaaatggtgtcaacgataccccagaaaatgctcaagagttagcagatttaacgaaaaagattcgcaaattatcttatgtcaatttaattccttacaatcctgtctcagaacatgaccagtatagtcgtagtcctaaagagcgtgtagaagctttctatgacgttttgaagaaaaatggagttaactgtgttgttcgtcaagaacatggtacggacattgatgcagcttgcgggcaattacgttcaaacacaatgaaacgcgatcgtcaaaaagcgaaggtagggcag

SEQ ID NO: 152 - protein, 374 aa, Streptococcus agalactiae
MKKENIMPKKTDTPAYKPSIYSLTRDELIAWAIEHGEKKFRASQIWDWLYKKRVQSFDEMTNISKDFIALLNENFVVNPLKQRIVQESADGTVKYLFELPDGMLIETVLMRQHYGLSVCVTTQVGCNIGCTFCASGLIKKQRDLNNGEITAQIMLVQKYFDERGQGERVSHIVVMGIGEPFDNYTNVLKFLRTVNDDNGLAIGARHITVSTSGLAHKIREFANEGVQVNLAVSLHAPNNDLRSSIMRINRSFPLEKLFAAIEYYIETTNRRVTFEYIMLNGVNDTPENAQELADLTKKIRKLSYVNLIPYNPVSEHDQYSRSPKERVEAFYDVLKKNGVNCVVRQEHGTDIDAACGQLRSNTMKRDRQKAKVGQ

SEQ ID NO: 153 - DNA, 1077 bp, Streptococcus pyogenes
atgaaaccatcgatttatagcttaacacgcgatgaactgatcgcgtgggcagttgaacgcggccaaaaacagtttagagctactcaaatttgggattggctctataaaaaaagagttcaatcttttgaggagatgacgaatatttctaaagattttgtttctattttaaatgatagtttctgtgtcaatcctttaaaacagcgagttgtacaagagtcagctgatggtacagtaaaatatttatttgaactgcccgatggtatgttaattgaaacagttttaatgcgtcaacattatggtcattctgtttgtgtgacgactcaagttggctgtaacattggctgtactttttgtgctagtggattgatcaaaaagcaacgtgatctaaacagtggggaaattacagctcaaatcatgttagtccaaaaatattttgacgatagaaagcaaggtgagcgggttagccatgttgtcgtaatgggcattggtgaaccttttgataattacaaaaatgtcatgtgctttcttcgcgtcatcaacgatgataatggcttagcaattggtgcccgtcatattacagtctctacctcagggttagctcacaagattcgggattttgcaaacgagggagtacaggttaacttagcagtctcgttgcatgcaccaaataatgatttacgttcaagtattatgcgagtaaatcgctcttttccgcttgaaaagctcttttcagctatagaatactatattgaaaaaacgaatcgtcgtgtcacttttgaatacattatgctaaatgaagttaacgatagcattaagcaagctcaagaattagcagacttaactaaaactattcgtaagttatcttatgttaacttgattccgtataatcctgtttcagaacatgatcagtatagtagaagtcctaaagagcgagttctagcgttttatgatgtgctaaagaaaaatggagttaactgtgtggtgcgtcaagagcacggaacagatattgatgcagcctgtggccagttacgttctaaaacgatgaaaaaagatcgcgaaaaggttacagcgacaaaa

SEQ ID NO: 154 - protein, 359 aa, Streptococcus pyogenes
MKPSIYSLTRDELIAWAVERGQKQFRATQIWDWLYKKRVQSFEEMTNISKDFVSILNDSFCVNPLKQRVVQESADGTVKYLFELPDGMLIETVLMRQHYGHSVCVTTQVGCNIGCTFCASGLIKKQRDLNSGEITAQIMLVQKYFDDRKQGERVSHVVVMGIGEPFDNYKNVMCFLRVINDDNGLAIGARHITVSTSGLAHKIRDFANEGVQVNLAVSLHAPNNDLRSSIMRVNRSFPLEKLFSAIEYYIEKTNRRVTFEYIMLNEVNDSIKQAQELADLTKTIRKLSYVNLIPYNPVSEHDQYSRSPKERVLAFYDVLKKNGVNCVVRQEHGTDIDAACGQLRSKTMKKDREKVTATK

SEQ ID NO: 155 - DNA, 513 bp, Streptococcus agalactiae
atgcttaaaagattacttactgaagatggggaattgacaaagattagtcgtcgtttcgtttggatgttagtgattatctattgtcttattattgtcaggatgtgttttgggcctcaaattatgattgagggggtatcaactccgaatgttcagcgcttcggaagaattgtagctcttttagtaccatttaattcttttcgtagtttagatcagctaactagctttaaagagattttttgggttattggtcaaaatgtagtgaatattttactgctgtttcctctcattatagggttactatccctaaagccaagtttacggaaatataaaagcgttatattacttgctttcttgatgtctattttcatagagtgtactcaagttgttttagatattttaatagatgctaatcgggtttttgaaatcgacgatctatggacaaataccttaggcggtcctttcgccctatggacttatcgaaacataaaaggttggcttctaactattagaaaa

SEQ ID NO: 156 - protein, 171 aa, Streptococcus agalactiae
MLKRLLTEDGELTKISRRFVWMLVIIYCLIIVRMCFGPQIMIEGVSTPNVQRFGRIVALLVPFNSFRSLDQLTSFKEIFWVIGQNVVNILLLFPLIIGLLSLKPSLRKYKSVILLAFLMSIFIECTQVVLDILIDANRVFEIDDLWTNTLGGPFALWTYRNIKGWLLTIRK

SEQ ID NO: 157 - DNA, 1743 bp, Streptococcus agalactiae
atgtctattataaaaaatttgtggtggttttttaaggaagaaaagaagcgctatcttattggaattttgtcattaagtttggttgcggtgttaaatcttatccctcctaaaatcatgggatcagttattgatgctattacaactggaaaattaacaagaccacaattgctctggaatttattaggtttggttttgtcagctttagctatgtatgggctgcgttatatttggcgtatgtatattttagggacttcttacaaattgggtcaagttgtcagataccgtttatttgaacattttacaaaaatgtctccttctttttatcagaaatatcgtacaggtgatttaatggcgcacgcgaccaacgacatcaattctctaacacgtcttgcaggaggaggagttatgtcagcagtggatgcctctatcacagcattagtaacgcttatcaccatgttctttactatttcgtggcaaatgacattaattgcggttatccctttgcccttaatggccttagcaactagtaaattggggcgaaaaacccatgaaaccttcaaagaatctcaggcagccttttcagaattaaataataaagtgcaagaaagtgtctctggcgtcaaagtgactaaatcatttggttatcaagaacaagaaattgcttcttttcaagaggttaatcagatgactttcgtgaagaacatgcggaccatgacttatgatgtcatgtttgatcctttagttcttctttttataggtgcctcctacgtattaacattggctatgggagcttttatgatttcaaaaggtcaagttactgttggtgacttggtaacatttgtgacgtatttagatatgttggtatggcccttgatggcgattggtttcttgttcaatatggtacagcgtggtagtgtttcttataaccgtattaatagcctacttgagcaagaatcggatataactgaccctttaaatcctatcagacctgttgtcaatggaacattaagatatgatattgatttctttagatacgacaatgaagaaaccttagccgatattcatttcaccttagaaaaaggtcaaaccttaggtttggtaggtcaaacgggatcagggaagacaagtcttattaagttattgctacgtgaacatgatgtgactcagggaaaaattactttaaataaacatgatatacgtgattatcgattgtctgagttacgtcaactaatcggttatgttcctcaagatcagtttttatttgctaccagtattttagaaaatgttcgctttggaaatccaactctatctatcaatgctgttaaaaaagcaactaaattggctcatgtttacgatgacattaaacagatgccagcaggatttgagactctaattggagaaaaaggagtctcattatctggtggacaaaaacaaaggattgcgatgagtcgtgccatgattttagatccagatattcttattttggatgattctctatcagcagtggacgctaaaacggaacatgccattattgaaaatcttaaaacgaatcgtcaagggaaatcgactattatttcagcacatcgattatcagctgttgtgcacgcagaccttatcttagttatgcaagacggcagagtcatcgagcgaggtcagcatcaagagttgctaaataaaggtggttggtatgctgaaacgtatgcctcacagcaattagaaatggaggaagcatttgatgaagtc

SEQ ID NO: 158 - protein, 581 aa, Streptococcus agalactiae
MSIIKNLWWFFKEEKKRYLIGILSLSLVAVLNLIPPKIMGSVIDAITTGKLTRPQLLWNLLGLVLSALAMYGLRYIWRMYILGTSYKLGQVVRYRLFEHFTKMSPSFYQKYRTGDLMAHATNDINSLTRLAGGGVMSAVDASITALVTLITMFFTISWQMTLIAVIPLPLMALATSKLGRKTHETFKESQAAFSELNNKVQESVSGVKVTKSFGYQEQEIASFQEVNQMTFVKNMRTMTYDVMFDPLVLLFIGASYVLTLAMGAFMISKGQVTVGDLVTFVTYLDMLVWPLMAIGFLFNMVQRGSVSYNRINSLLEQESDITDPLNPIRPVVNGTLRYDIDFFRYDNEETLADIHFTLEKGQTLGLVGQTGSGKTSLIKLLLREHDVTQGKITLNKHDIRDYRLSELRQLIGYVPQDQFLFATSILENVRFGNPTLSINAVKKATKLAHVYDDIKQMPAGFETLIGEKGVSLSGGQKQRIAMSRAMILDPDILILDDSLSAVDAKTEHAIIENLKTNRQGKSTIISAHRLSAVVHADLILVMQDGRVIERGQHQELLNKGGWYAETYASQQLEMEEAFDEV

SEQ ID NO: 159 - DNA, 1785 bp, Streptococcus pyogenes
gtgatgaaaacagcacgttttttctggttttattttaaacgctatcgtttctcatttactgtcattgctgttgccgttatcttagcaacttatttacaagtaaaagctcctgtcttcttaggagagtccttgactgagttgggaaaaatcggtcaggcttattacgttgctaagatgagtggccagacacattttagccctgatttatcagcttttaatgccgtgatgtttaagcttttgatgacttatttctttactgttttagctaatctaatatatagtttcttacttacacgtgttgtctcacattcgactaaccgcatgcgcaagggcttatttggtaaattagaacgtttaaccgtcgccttttttgaccgccataaagatggggagattctttctcgtttcacgagtgatttggataatattcaaaactcgctgaaccaatccttgattcaagtggtgactaatattgccctttacatcggcctggtctggatgatgtttaggcaagatagccgtttagctttgttaaccatcgcatcaaccccagttgctctcatttttttagtgattaacatccgtttggcaagaaaatacaccaatatccaacagcaagaagtcagtgctttaaatgcttttatggatgaaaccatttcaggacaaaaggctattattgtacaaggtgtccaagaagatacgatgacagcctttttaaagcataatgaaagggttcgacaagccaccttcaaacgccgtctgttctcaggacaattatttccagtcatgaatggaatgagccttattaacacggctatcgtgatttttgtcggttcaacaattgtcctcagtgacaaatctatgccagcagcggcagcgcttggtttagtggttacttttgtacaatattcccagcaatattaccaacccatgatgcaaatcgcgtctagttggggagaattgcagctggcctttaccggtgctcaccgtattcaagaaatgtttgatgaaaccgaagaagttcgtccacaaaatgcaccagcgttcaccagcttaaaagaagcagtggcgattaaccacgtcgattttgggtatcttcctgggcaaaaagttttatcagatgtgtcaatcgttgcacccaagggcaaaatgattgccgtggttggaccgacaggttctggaaagaccactattatgaacttgattaaccgtttctacgatgtggatgcaggttcgattacctttgatggccgtgatattcgtgactacgatttggatagtcttcgtcaaaaggtagggattgtgttgcaagagtcagttcttttttcaggaaccattacggataatattcgttttggtgatcagaccattagtcaagacatggttgaaactgctgcgcgtgcgacccatattcatgactttatcatgtccttaccaaaagggtacaatacctatgtctcagatgatgacaatgtcttttcaacaggtcaaaagcagttgatttctattgctaggacgctactgactgaccctgaagtgttgattttggatgaggccacttcaaatgttgatacggttaccgaaagtaaaattcaacgggccatggaagctatcgtggcaggtcgaactagctttgtcattgctcaccgcctcaaaaccattttaaatgccgatcacattattgtgttgaaagatggcaaggtcattgagcaaggaaatcatcatgagctattgcatcaaaaaggcttttatgccgaattgtatcacaatcaatttgtctttgaa

SEQ ID NO: 160 - protein, 595 aa, Streptococcus pyogenes
VMKTARFFWFYFKRYRFSFTVIAVAVILATYLQVKAPVFLGESLTELGKIGQAYYVAKMSGQTHFSPDLSAFNAVMFKLLMTYFFTVLANLIYSFLLTRVVSHSTNRMRKGLFGKLERLTVAFFDRHKDGEILSRFTSDLDNIQNSLNQSLIQVVTNIALYIGLVWMMFRQDSRLALLTIASTPVALIFLVINIRLARKYTNIQQQEVSALNAFMDETISGQKAIIVQGVQEDTMTAFLKHNERVRQATFKRRLFSGQLFPVMNGMSLINTAIVIFVGSTIVLSDKSMPAAAALGLVVTFVQYSQQYYQPMMQIASSWGELQLAFTGAHRIQEMFDETEEVRPQNAPAFTSLKEAVAINHVDFGYLPGQKVLSDVSIVAPKGKMIAVVGPTGSGKTTIMNLINRFYDVDAGSITFDGRDIRDYDLDSLRQKVGIVLQESVLFSGTITDNIRFGDQTISQDMVETAARATHIHDFIMSLPKGYNTYVSDDDNVFSTGQKQLISIARTLLTDPEVLILDEATSNVDTVTESKIQRAMEAIVAGRTSFVIAHRLKTILNADHIIVLKDGKVIEQGNHHELLHQKGFYAELYHNQFVFE

SEQ ID NO: 161 - DNA, 1740 bp, Streptococcus agalactiae
ttgatgaagtctaatcaatggcaagtctttaagagattaatctcctatttacgcccttataaatggtttacagtattagctctatctctcttattgttgacgactgttgttaaaaatattattcctttaattgcttcacattttattgatcactatctgacaaatgttaatcaaacagcagttcttattttagtgggatattattcaatgtatgtcttgcagaccttaattcaatattttgggaatctcttttttgcgcgtgtttcttatagtattgttagagatattcgtagagatgcttttgctaatatggaaaggcttggcatgtcttattttgataggacaccggcaggatctatagtgtcacgtattactaatgatactgaagcaatatctgatatgttttcgggtattttatcgagttttatctcggcgatatttatttttacagttactctgtacactatgttgatgctagacattaaactaacaggacttgtcgctcttttattacctgttatctttatattagtgaatgtctatcggaaaaaatcagtcactgtcattgctaaaacgagaagtttacttagtgatatcaacagtaaattatcagaaagtattgaaggaattcgcattgtacaggcttttggtcaagaagagcgcttgaagactgaatttgaggaaattaacaaagagcatgttgtgtatgccaatcgttctatggctcttgatagtctcttcttaagaccggcgatgtctcttttaaaactcctagcatatgctgttcttatggcttattttggatttacaggagttaaaggaggtcttacggcaggattgatgtatgcttttattcagtacgttaatcgtctctttgaccctttaattgaagtaacgcaaaatttttcaaccttacaaacatcaatggtatcagcagggcgtgtgtttgatttgattgatgaaacaggttttgaaccaagccaaaaaaatacagaagcttttgtgagagaaggaaatatcgaatttaaaaatgtatcattctcatatgatggaaaaaaacaaatccttgataatgtttcttttagtgttaaaaaaggtgaaacgattgcttttgtaggagcgacaggttctggaaaatcatctattattaatgtctttatgaggttttacgaatttcaatctggacaagttttattagatgggaaggatattagggattactcacaagaacaattgcgaaagaatattggactcgtcttacaagacccctttttatatcatggcactattaaatctaatatcaaaatgtaccaagacatcaccgatcaagaggtacaggacgcagcagagtttgttgatgctgatcaatttattcagaagttgccagataagtacgatgcagctgtttcagaacgtgggtcaagtttttcgactggacaacgccaactattggcgtttgccagaactgtggctagtaaacctaaaattttaatcttagatgaagcgacagcaaatattgattcggaaacagagcagattgtacaagattcgttagcaaaaatgcgtcaaggtcgaacaacaattgccattgctcaccgcttatcaaccattcaagatgctaattgtatctatgttcttgatagaggaaagataattgaaagtgggaatcacgagtctttattagacctaaaagggacttattatcgtatgtaccaattacaagctggcatgatggaggtc

SEQ ID NO: 162 - protein, 580 aa, Streptococcus agalactiae
MMKSNQWQVFKRLISYLRPYKWFTVLALSLLLLTTVVKNIIPLIASHFIDHYLTNVNQTAVLILVGYYSMYVLQTLIQYFGNLFFARVSYSIVRDIRRDAFANMERLGMSYFDRTPAGSIVSRITNDTEAISDMFSGILSSFISAIFIFTVTLYTMLMLDIKLTGLVALLLPVIFILVNVYRKKSVTVIAKTRSLLSDINSKLSESIEGIRIVQAFGQEERLKTEFEEINKEHVVYANRSMALDSLFLRPAMSLLKLLAYAVLMAYFGFTGVKGGLTAGLMYAFIQYVNRLFDPLIEVTQNFSTLQTSMVSAGRVFDLIDETGFEPSQKNTEAFVREGNIEFKNVSFSYDGKKQILDNVSFSVKKGETIAFVGATGSGKSSIINVFMRFYEFQSGQVLLDGKDIRDYSQEQLRKNIGLVLQDPFLYHGTIKSNIKMYQDITDQEVQDAAEFVDADQFIQKLPDKYDAAVSERGSSFSTGQRQLLAFARTVASKPKILILDEATANIDSETEQIVQDSLAKMRQGRTTIAIAHRLSTIQDANCIYVLDRGKIIESGNHESLLDLKGTYYRMYQLQAGMMEV

SEQ ID NO: 163 - DNA, 603 bp, Streptococcus agalactiae
gtgtataatgaggtcaaagtgcaaggaaaggtctataaaatgttactattggtagataattacgattcttttacctataatttaaagcaatatttaagtgtctataaagaggtattcgtcataaaaaatgatgttcctaacctttttttattagctgagagcgcagaagccatcgtcttatcacctggaccaggacacccaaaggatgctgggaaaatggtagaattaatcaatcagtttataggaaagaaacctattctaggtatctgtttggggcatcaagcgcttgccgagtgcttgggtgggcgattaaatttagcaaatcacgttatgcatggtaaacaaagttgggtaacaataaacgaccatactagtttgtttaagggaattgatagtccaacccaagttatgcgttatcattcattggtagtgactgatttaccagagaatattgctgttattgcacgatcaaatgaggataatgaaatcatggcattccattgccccagcttaaaggtatatgcgatgcagtttcatcctgagtcaatcgggagtattgatggaatgaaaatgattgaaaactttttgacgttaattaatgac

SEQ ID NO: 164 - protein, 201 aa, Streptococcus agalactiae
MYNEVKVQGKVYKMLLLVDNYDSFTYNLKQYLSVYKEVFVIKNDVPNLFLLAESAEAIVLSPGPGHPKDAGKMVELINQFIGKKPILGICLGHQALAECLGGRLNLANHVMHGKQSWVTINDHTSLFKGIDSPTQVMRYHSLVVTDLPENIAVIARSNEDNEIMAFHCPSLKVYAMQFHPESIGSIDGMKMIENFLTLIND

SEQ ID NO: 165 - DNA, 564 bp, Streptococcus pyogenes
atgatactcttaattgataattacgattcatttacctacaacctcgcccaatatttaagtgaatttgacgagacgattgtcttgtataaccaagacccaaacttatatgacatggccaaaaaagctaacgctctagtcctctcacctggtcctggttggcccaaggaagccaaccaaatgccaaaactcattcaagacttttaccaaacaaaacctatcttaggagtgtgtctgggacaccaagctatcgctgaaactttagggggaaccttacgcttggccaaacgcgtcatgcatgggagacaaagcaccattgaaacgcaaggccctgctagtctttttcgctccctgccacaagagatcaccgtcatgcgctaccattccatcgttgtggatcagttaccaaaaggttttagcgtaaccgctagagactgtgacgatcaagaaatcatggcatttgaacaccacaccctgccactttttgggctacaatttcacccagaaagcatcggaactcctgatggcatgaccatgattgccaacttcatcgcagccattccccgt

SEQ ID NO: 166 - protein, 188 aa, Streptococcus pyogenes
MILLIDNYDSFTYNLAQYLSEFDETIVLYNQDPNLYDMAKKANALVLSPGPGWPKEANQMPKLIQDFYQTKPILGVCLGHQAIAETLGGTLRLAKRVMHGRQSTIETQGPASLFRSLPQEITVMRYHSIVVDQLPKGFSVTARDCDDQEIMAFEHHTLPLFGLQFHPESIGTPDGMTMIANFIAAIPR

SEQ ID NO: 167 - DNA, 537 bp, Streptococcus agalactiae
atgaaaacaagaacaactacctatattgcactcatggttgcactacttattgttttaggttttatcccagggatcccattaggtttcattccagtcccaattgttttacaaaatcttggtgttatgctggcaggtgctctgcttggtagtaggaagggtttcctagctgtggctattttcttgctcttagttgctattggtgcaccatttttaccaggaggacggtcaggtctcgtaacgctgtttgggccaacagcaggctatctgctgacttatccatttgcagctttttttatcggcctagggcttgagaaagtgaaaacaacaaaactctgggttcaattccttattatttggatatttggcgtactattgattgatatttgtggtagcatcgttctttcctttcaaacttctctacccttaactaaatcactattttctaaccttatttttattcctggggataccttaaaagcatccatttgcttgattatttatcgtaaatttgcaaacagattaactcatctatacaac

SEQ ID NO: 168 - protein, 179 aa, Streptococcus agalactiae
MKTRTTTYIALMVALLIVLGFIPGIPLGFIPVPIVLQNLGVMLAGALLGSRKGFLAVAIFLLLVAIGAPFLPGGRSGLVTLFGPTAGYLLTYPFAAFFIGLGLEKVKTTKLWVQFLIIWIFGVLLIDICGSIVLSFQTSLPLTKSLFSNLIFIPGDTLKASICLIIYRKFANRLTHLYN

SEQ ID NO: 169 - DNA, 537 bp, Streptococcus pyogenes
atgtttacaaccaaagaacttgttaaggtggctatgatgaccactttgattattattttaggctttattcctgctatcccgctaggctttatcccagtccctattgttttacaaaacttaggtgtcatgttggctggattgatgctgggtggtaaaaagggaaccttatctgttttcttatttttagtgattggccttttcttacctgttttctcaggctcaagaacaaccattccagtattgatggggccatctgctggctatgttattgcctaccttcttgtgcctattgtcttttcattactttaccgcaattggttctcaaaaagcacgccattagcattcctagctcttttaatctcaggagttgtactggttgatgttctgggtgctatctggttgtcagcctacactggcatgtctcttgtgacatcgcttttatcaaacttggtctttattccaggagataccatcaaagcaatcattgcgaccattatcgctgttaaatacaaagatagttttttgaatacaaaacag

SEQ ID NO: 170 - protein, 179 aa, Streptococcus pyogenes
MFTTKELVKVAMMTTLIIILGFIPAIPLGFIPVPIVLQNLGVMLAGLMLGGKKGTLSVFLFLVIGLFLPVFSGSRTTIPVLMGPSAGYVIAYLLVPIVFSLLYRNWFSKSTPLAFLALLISGVVLVDVLGAIWLSAYTGMSLVTSLLSNLVFIPGDTIKAIIATIIAVKYKDSFLNTKQ

SEQ ID NO: 171 - DNA, 120 bp, Streptococcus agalactiae
gtgactaatgattcaaaattctcaaaatggacctctcgtccagcgcttaatcttaattccttgaaaggaaaaacaaaacgcaacatggccataatttttaagcatttaatgggagtcaaa

SEQ ID NO: 172 - protein, 40 aa, Streptococcus agalactiae
MTNDSKFSKWTSRPALNLNSLKGKTKRNMAIIFKHLMGVK

SEQ ID NO: 173 - DNA, 1023 bp, Streptococcus agalactiae
atgctattattaatttcgttaaaggaggctatcatgtcatttcaaacaaattatatccatttggctgacgaaatattatctggaaagactagcatttcttatgaacaagcgctggaaattctaaatagcgatgagaactggtgggaaatctacgctgctgccttataccttaaaaatcaagttagccgaaataatattcgccttaacgttttattaagtgctaagcaaggactttgtgcagaaaattgtggttactgttctcaatctaaagaaagcactgctgacattgataaatttggtctgcttcctcaaaatgtcattctaaaacaggctattgtcgctcatcaaaatggtgctagcgtcttttgtattgcgatgagtggaactaagcctagcaagagagaaattgagcagttatgtcaagtcatccctgaaatcaaaaaaagcctccctctagaaatatgccttaccgctggttttttggatagagaacaacttcatcagctaaaacaagcaggaattgaccgtatcaatcataatctcaacacccccgaagaaaactaccccaacattgcaacgacgcatagcttcaaagatcgttgtgatactttagaaagaattcacaatgaagacattgatgtttgttctggattcatttgtggtatgggagagagcgatgaggggctcatcacattagctttcagactaaaagagctggacccctattctatccctgtcaattttttacttgctgttgaaggaacacctcttggaaaatataactatttgactcccattaaatgcttaaaaattatggccatgttgcgttttgtttttcctttcaaggaattaagattaagcgctggacgagaggtccattttgagaattttgaatcattagtcaccttacttgttgactcaacttttttgggaaattacctaacagagggcggtcgcaatcaacataccgatattgaattcttggaaaaattacaactaaatcatactaaaaaggaattaatt

SEQ ID NO: 174 - protein, 341 aa, Streptococcus agalactiae
MLLLISLKEAIMSFQTNYIHLADEILSGKTSISYEQALEILNSDENWWEIYAAALYLKNQVSRNNIRLNVLLSAKQGLCAENCGYCSQSKESTADIDKFGLLPQNVILKQAIVAHQNGASVFCIAMSGTKPSKREIEQLCQVIPEIKKSLPLEICLTAGFLDREQLHQLKQAGIDRINHNLNTPEENYPNIATTHSFKDRCDTLERIHNEDIDVCSGFICGMGESDEGLITLAFRLKELDPYSIPVNFLLAVEGTPLGKYNYLTPIKCLKIMAMLRFVFPFKELRLSAGREVHFENFESLVTLLVDSTFLGNYLTEGGRNQHTDIEFLEKLQLNHTKKELI

SEQ ID NO: 175 - DNA, 528 bp, Streptococcus agalactiae
atgatatactggtcttatattttgacgggagataagatgaaaaaactatttaaaaaagcgatagctatgtgccgagatttgccgcttaattttgtaattgttgaacttagtttgtatcaaagagaggatggctcatctgataatattaaatggatttctaagagaattcttgaggtaacggtaactgatcagcaatggatttaccatttgaggatgcttaatttaccaaaacttaagccaatgtcactagcatccagtgactgtcctgcaagggaagagaaggctagtcttatttcaatagaagaatgtcaaaaattcactagcttagtgcgagataaaaatccttttcaccaaggggaagcagctattgtgcctgcggctctattattggaaaaaataatggaagttagaaaaggaaaaataaaggagattcatttgacttttttatctccagtaagggtgaatcaagaattctcagtgcaagtagtggataacacagtgattatttttcagcatcaaatattatgg

SEQ ID NO: 176 - protein, 176 aa, Streptococcus agalactiae
MIYWSYILTGDKMKKLFKKAIAMCRDLPLNFVIVELSLYQREDGSSDNIKWISKRILEVTVTDQQWIYHLRMLNLPKLKPMSLASSDCPAREEKASLISIEECQKFTSLVRDKNPFHQGEAAIVPAALLLEKIMEVRKGKIKEIHLTFLSPVRVNQEFSVQVVDNTVIIFQHQILW

SEQ ID NO: 177 - DNA, 99 bp, Streptococcus agalactiae
ttgtttaatgcacgatgctgctgcatttctaacgcttcagagtcagaaaacagaattccggattgttcacattgtagaagtagcaggagatcccaagct

SEQ ID NO: 178 - protein, 33 aa, Streptococcus agalactiae
MFNARCCCISNASESENRIPDCSHCRSSRRSQA

SEQ ID NO: 179 - DNA, 1113 bp, Streptococcus agalactiae
atgaagaatagagatgtttatattggttttgggctacgaacacctatcggtataaaagggaagcaatttaaacattaccgtccagaacttttaggagcacaccttttaaatcaaataaaaaaaatagaatcagaatctaacattgatagtattatttgtgggaacacagttggtactgggggcaatattggtcgtttgatgactcttttttctgattatgaatcctatattccagtacaaacgattgatatgcagtgtgcttcatcaagttctgccttgttttttggttatctaaaaatcagtaccggtattaatgaaaaagttcttgttggggggattgaaagtagttctcttcaacctatgagacgttatgctaaagaagataatcgtaacggagaatatacagttgctcagttttctcctgactcttatgctgaaactgtaatgttagaaggggcccagagagtctgtcaaaaatatggttttagaagagaaatgttagataaattggcattcttgagccataaacgcgccttaacagctaaacaaggtggctatttagaagaggtaatcttaccaatggaagggatgcgagatcaaggcgttagaaaactaaaagaaacattttttcaaaaattaccaagattgatggaaaattcacctttgctcactattggaaatgtttgtttaatgcacgatgctgctgcatttctaacgcttcagagtcagaaaacagaattccggattgttcacattgtagaagtagcaggagatcccaagcttagtccagaattggttcacacggctacggaaaaactattaacagaaactcatactaaaatatcggattatgatgcaattgaatggaatgaaccatttgcagcgattgatgctctatttaatcattattatcctgaagagagagaaaaattcaatatttttggagggacattagcttacggacacccttatgcctgctcaggaattattaatatccttcatcttatgcaggcattaaaatataaaaataaacctatgggtctaactgccattgcaggggcaggaggagtcggaatggccatatcaatagagtacttaggagttaagaatgct

SEQ ID NO: 180 - protein, 371 aa, Streptococcus agalactiae
MKNRDVYIGFGLRTPIGIKGKQFKHYRPELLGAHLLNQIKKIESESNIDSIICGNTVGTGGNIGRLMTLFSDYESYIPVQTIDMQCASSSSALFFGYLKISTGINEKVLVGGIESSSLQPMRRYAKEDNRNGEYTVAQFSPDSYAETVMLEGAQRVCQKYGFRREMLDKLAFLSHKRALTAKQGGYLEEVILPMEGMRDQGVRKLKETFFQKLPRLMENSPLLTIGNVCLMHDAAAFLTLQSQKTEFRIVHIVEVAGDPKLSPELVHTATEKLLTETHTKISDYDAIEWNEPFAAIDALFNHYYPEEREKFNIFGGTLAYGHPYACSGIINILHLMQALKYKNKPMGLTAIAGAGGVGMAISIEYLGVKNA

SEQ ID NO: 181 - DNA, 1146 bp, Streptococcus pyogenes
atgacggatgtttatattgctgcaggccttagaacccctatcggtttagtagggaaacaatttgctaaagaacaaccagaaatccttggagcaaagctcatcaacgctttacaaaataagtatccagttcccattgaccaagtgatttgtggcaataccgtcggaacgggtggtaatattgggcgcttgatgaccctgtattctcatttaggagaatctgtctctgctttgacggttgatatgcagtgtgcatcagctggtgcagctctttccgtgggttatgctaaaatcaaggcaggtatggcaagcaaccttttagtgggagggattgaaagcagctccttacaacctgaatcggtatatgcttcagctgattggcgccaaggagcctacaaggtagctcagttttctccagatagtatcagcccttttgcgatgattgaaggggcagaacgagtggcaagagagcatggctttacaaaggagtatttgaatcactggacattgagaagtcatcaaaaggctagttattgccaggagcaagccctgttagctgatcttattctagacctgtcaggagccagtgatcaaggtattcgaccgcgcttgtcaagtaaggtgttgtcaaaggtaccccctatcttaggagaaggtcacgtgattagtgcagccaatgcctgcctaacccatgatgctgctgcctttttacagctaagtagtcagccttcagcttttaaactgattgatgtggtagaagtagcaggagacccacagcgtagccctttaatggtgattaaggctagtcaagtccttttggaaaaacatggtctagggatggcagatatgacagcgattgaatggaacgaagcctttgccgttattgatggtctatttgaaacccattatccagatttattggaccgctataatatatttggtggtgcattagcttatggtcatccctatggtgcctcagcagccattataatattgcacttaatgagggctttagagattaaaaatggacgctatggaatagctgctatagcagcagctggtggccaagggtttgctgttttactaaaatatcataaggagtttagtcatgctgacaaagctagaatattgggcaaagcaatgcccaaa

SEQ ID NO: 182 - protein, 382 aa, Streptococcus pyogenes
MTDVYIAAGLRTPIGLVGKQFAKEQPEILGAKLINALQNKYPVPIDQVICGNTVGTGGNIGRLMTLYSHLGESVSALTVDMQCASAGAALSVGYAKIKAGMASNLLVGGIESSSLQPESVYASADWRQGAYKVAQFSPDSISPFAMIEGAERVAREHGFTKEYLNHWTLRSHQKASYCQEQALLADLILDLSGASDQGIRPRLSSKVLSKVPPILGEGHVISAANACLTHDAAAFLQLSSQPSAFKLIDVVEVAGDPQRSPLMVIKASQVLLEKHGLGMADMTAIEWNEAFAVIDGLFETHYPDLLDRYNIFGGALAYGHPYGASAAIIILHLMRALEIKNGRYGIAAIAAAGGQGFAVLLKYHKEFSHADKARILGKAMPK

SEQ ID NO: 183 - DNA, 1227 bp, Streptococcus agalactiae
atgcttgaatcattgaaaacgatagttaaaaccaatagcgataaaaagttatttgatggtgatttacaggtcagttatggagaattttataacttagtaagacaagatatggcgtcacaagacaataggaaacatgtgattagcacacactctctgcttaaccaattagtaagatttgtttcaaagttatgtcaaaaagctcttcctattatttgtaaacctaaccttactcataatgaaataagtcgattagaaaaagaagtgcagtatgctcctcaactagctgattttggtgttctttcttctgggactacagctgatgctaaactattgtggaggagcttcacttcgtggtctgatttttttagcattcagaatgcttatttttcggtcacttccaatagcaaactgtttattcaaggtgatttttcatttactggtaacttaaatttagcgctatcccttttattactggggggaacacttgttgtcacacagaaaaattctgtaaaatactggcagactttatgggaaaaaactggtgtaacgcatctatatctgctccctagttatctcaagttagtggaacaatatagcaaggagactgcgttagacaataaaactattattacctcttcgcaatatgtctctgactcattactggaaggtttatatagaaagcatcctaaagtgtcagtgaaaatcttctatggtgctagtgagctcaattatgtgtcatggtacgatggtcgtgatatccgagataagccacagtatgttggagaaatcgttccaaatgtagctgttaggattaaagagggaagaatttttgtaaaaacaccgtatagtatctgtggcctttcaagtgaatattgtgctggtgattatggtgaactgatagatggcaaattatatctatttggccgtggtggtgattggtgcaatcaatcgggcattaagctctatttacctagattaatcgaaaaaataaaaacatgcccttatatcaaggatgcagtagcatttacaaaagagagtcaaagtcatggacaagagtcacattgctgtattgttttaattgaaaatcagatgcaacaagagtgtttgaagtggttatcggaacattttgaaaagaagtatgggtttaagcattatcatattgtatctaaaattcctttgatgccatctggaaaaattgattatcaacaactcaaaagacagttagca

SEQ ID NO: 184 - protein, 409 aa, Streptococcus agalactiae
MLESLKTIVKTNSDKKLFDGDLQVSYGEFYNLVRQDMASQDNRKHVISTHSLLNQLVRFVSKLCQKALPIICKPNLTHNEISRLEKEVQYAPQLADFGVLSSGTTADAKLLWRSFTSWSDFFSIQNAYFSVTSNSKLFIQGDFSFTGNLNLALSLLLLGGTLVVTQKNSVKYWQTLWEKTGVTHLYLLPSYLKLVEQYSKETALDNKTIITSSQYVSDSLLEGLYRKHPKVSVKIFYGASELNYVSWYDGRDIRDKPQYVGEIVPNVAVRIKEGRIFVKTPYSICGLSSEYCAGDYGELIDGKLYLFGRGGDWCNQSGIKLYLPRLIEKIKTCPYIKDAVAFTKESQSHGQESHCCIVLIENQMQQECLKWLSEHFEKKYGFKHYHIVSKIPLMPSGKIDYQQLKRQLA

SEQ ID NO: 185 - DNA, 1245 bp, Streptococcus pyogenes
atgctgacaaagctagaatattgggcaaagcaatgcccaaataaaaaagctatcgtagccgatcagataagcttgacttatcaagagctatggcaagcggttttaataaaggatcagacaataaaagacagtgtaccatatatcatcagtcatagtcgctatcttaatcagttactctcttttttacgaggattaaaagaaggcagttgtcctatcattttacaccctaatatctcaggtacatttcagcagcaaataaaacacgtcgatggtgagcttcttaaaaaagctgattttgctgttttgagttcgggaacaactggcaaagcaaaattattttggcgtcgtctatcaacttggacgagactttttgattatcaaaataaggtgtttggtatgactggtaatagttgtctattcttacatggtagttttagttttactggcaatcttaacttagcattagctcaactatgggccgggggatgtctggttttaagccaaaagctgtctttgaaaacgtggttaagcttatggcaagcaaaaaaggtgagtcacctttaccttttaccgacctacctaaatcgcttgctaccttatttgactaagaacaacatgactgcgactcacttattgacctcttcgcaaatgatatcacaagaattactaagacattattacaaaaaatttcctcagcttgaaattgtcattttctacggggctagtgaattatcttttataacgtggtgtaatggcagagctgctgtcaaaattaatggtttggtaggacagccctttcctgatgtgtctatcagtttcaaagataaggaaatttttgtagagactccttatagtgtagaaggaatgtcacaaccatacagtgtttcagacttaggaaaaatgagcccagcgggtttaattttagaagggcgacaagatgactgggttaatcaacgaggagtgaaatgccacctgcctagcctagttgaactcgctcaccaagcgccaaacgtcaaagaagcgcacgctttaaagataggaaaaggagaaaacgaaaccctaatattagtattagttttgactaagaaggattgcctagcacctattaaagactttttagctctttatttaaactctggacaacttcccaagtactatcttgtgattgattgtttgcctttaaaagataatggtaaaattaatcgagaagttcttttaaataaaatacccaaacagtggcttagt

SEQ ID NO: 186 - protein, 415 aa, Streptococcus pyogenes
MLTKLEYWAKQCPNKKAIVADQISLTYQELWQAVLIKDQTIKDSVPYIISHSRYLNQLLSFLRGLKEGSCPIILHPNISGTFQQQIKHVDGELLKKADFAVLSSGTTGKAKLFWRRLSTWTRLFDYQNKVFGMTGNSCLFLHGSFSFTGNLNLALAQLWAGGCLVLSQKLSLKTWLSLWQAKKVSHLYLLPTYLNRLLPYLTKNNMTATHLLTSSQMISQELLRHYYKKFPQLEIVIFYGASELSFITWCNGRAAVKINGLVGQPFPDVSISFKDKEIFVETPYSVEGMSQPYSVSDLGKMSPAGLILEGRQDDWVNQRGVKCHLPSLVELAHQAPNVKEAHALKIGKGENETLILVLVLTKKDCLAPIKDFLALYLNSGQLPKYYLVIDCLPLKDNGKINREVLLNKIPKQWLS

SEQ ID NO: 187 - DNA, 630 bp, Streptococcus agalactiae
atgttatcaaaagcaaaatcacgatatattatccgtgagattattaagttatttccagatgctaaacctagcttagactttactaatgtctttgagcttttggtagctgtaatgctatcagctcaaacaactgatgcagctgttaataaagttacacccgccctttttgaacgctttccaaatcctttagttttggcacaagctgatcccaaagagattgaaccctatatttctaaaattgggctttaccgtaataaagctcgattcttaaatcaatgcgctaaacaattgatagagcattttgatggaaaagtcccccgaactcgtcaagagctagaaagtttggctggcgttggaaggaaaacggctaacgtggtcatgagtgttggatttggtattccggcttttgccgtagatactcatgtcactcggatttgtaaacaccaccagatttgcaaacagtcggcttctccactggaaattgagaaacgagtcatggaggttttaccaccagaagagtggctagctgcacatcaatccatgatttattttggtcgtgcaatttgtcatcctaaaaatccaaaatgcgaccagtacccacaactttatcactttcctgataatttaaag

SEQ ID NO: 188 - protein, 210 aa, Streptococcus agalactiae
MLSKAKSRYIIREIIKLFPDAKPSLDFTNVFELLVAVMLSAQTTDAAVNKVTPALFERFPNPLVLAQADPKEIEPYISKIGLYRNKARFLNQCAKQLIEHFDGKVPRTRQELESLAGVGRKTANVVMSVGFGIPAFAVDTHVTRICKHHQICKQSASPLEIEKRVMEVLPPEEWLAAHQSMIYFGRAICHPKNPKCDQYPQLYHFPDNLK

SEQ ID NO: 189 - DNA, 654 bp, Streptococcus pyogenes
atgagaattggaaaagcaagattagcaaaagtcctgaccatcattggtcaaatgtttcctgaggctaagggagagttagactgggaaacaccttttcaattgttgattgcggtgattttatcagctcaaacgacagataaggccgtcaataaggtaactcctggactatggcagtcttatccagaaatagaagacttagcttttgctgaactttctgatgttgaaaatgctctgagaacgattggactctataaaaataaggccaaaaatatcattaaaactgctcaggctattcgtgatgattttaagggtcaagtgccaaaaacccacaaagagcttgaaagtttaccgggtgttggccgaaaaacagccaatgtggtgctggcagaggtttatggtgttccagctattgcggttgatactcatgtggctagagtctcaaagaggctcaatatttcatcgccagatgccgatgtcaagcagattgaagcagatttgatggctaaaattccaaagaaagattggattattactcaccatcgattgattttttttggacgctaccattgtttagccaaaaaaccaaaatgtgagatttgtcccgttcagtcttactgcaagtactatcaagatacttatggaaaatcgaaagcc

SEQ ID NO: 190 - protein, 218 aa, Streptococcus pyogenes
MRIGKARLAKVLTIIGQMFPEAKGELDWETPFQLLIAVILSAQTTDKAVNKVTPGLWQSYPEIEDLAFAELSDVENALRTIGLYKNKAKNIIKTAQAIRDDFKGQVPKTHKELESLPGVGRKTANVVLAEVYGVPAIAVDTHVARVSKRLNISSPDADVKQIEADLMAKIPKKDWIITHHRLIFFGRYHCLAKKPKCEICPVQSYCKYYQDTYGKSKA

SEQ ID NO: 191 - DNA, 207 bp, Streptococcus agalactiae
atgaaagttttattcgatgtgcagaatcttttgaaaaaatttggtatttatgtttatattggtaaacgtctttatgatatcgaagttatgaagattgaattgcaacgtctctacgataatggtctgataagtagagatgattatttaaaagcagaactgattttaagaagagagcacagactagaattggagaaggaaaataaaaaa

SEQ ID NO: 192 - protein, 69 aa, Streptococcus agalactiae
MKVLFDVQNLLKKFGIYVYIGKRLYDIEVMKIELQRLYDNGLISRDDYLKAELILRREHRLELEKENKK

SEQ ID NO: 193 - DNA, 219 bp, Streptococcus pyogenes
ttgctaaaatctacttatatgaaaacactatatgatgtgcaacaattgctaaaaaactttggcatttttgtttaccttggcaaacgtctttatgatattgaaatgatgaagattgaacttcagcgtctctatgatagcggcttattggataagagggattacttaaatgcggagttaattttgcgacgtgagcatagattagaattggaaaaagaagga

SEQ ID NO: 194 - protein, 73 aa, Streptococcus pyogenes
LLKSTYMKTLYDVQQLLKNFGIFVYLGKRLYDIEMMKIELQRLYDSGLLDKRDYLNAELILRREHRLELEKEG

SEQ ID NO: 195 - DNA, 966 bp, Streptococcus agalactiae
atgagtaagaaattattgggaattgacctcggaggaacgaccattaaatttggtatcttgacgcttgagggagaagtacaagaaaaatgggcaattgagaccaatactttagaaaacggaagacatatcgtttctgatatcgttgaatctctcaaacatcgtttgagcctctatggattaacaaaagatgactttctcggtatcggtatgggttctccaggagctgttgatagaactagtaaaacagtaacaggtgcttttaatctaaattgggctgatactcaagaagtaggttcagttattgaaaaagaagttggaattccattttttattgataacgatgctaatgttgcagcacttggtgaacgctgggtaggtgctggtgccaataatcccgacgttgttttcgtaaccctcggaacaggagtaggtggaggtgttatcgcagatggtaacctcatccatggtgttgcaggagcaggtggagaaattgggcatatgattgttgatccagaaaatggatttacgtgcacatgtggtaacaaaggctgccttgagacagttgcatcagcgacaggtgttgttagagtagcacgtcaactcgcagaacaatatgagggttcgtctgccattaaagcagcgattgacaacggtgatactgttacaagtaaagatatttttatagcagcagaagatggggataaatttgctaattctgttgttgaacgtgtatcacgttaccttggactggcagcagctaatatttcaaatattttaaaccctgattctgtggttattggtggcggtgtctcagcagcaggtgaatttttacgtagtcgcgttgagaaatactttgtcacatttgctttcccacaagttaaaaagtcaactaaaattaagattgctgaactaggtaatgatgctggtattattggtgcagcaagcttagccaatcaacaagcaagt

SEQ ID NO: 196 - protein, 322 aa, Streptococcus agalactiae
MSKKLLGIDLGGTTIKFGILTLEGEVQEKWAIETNTLENGRHIVSDIVESLKHRLSLYGLTKDDFLGIGMGSPGAVDRTSKTVTGAFNLNWADTQEVGSVIEKEVGIPFFIDNDANVAALGERWVGAGANNPDVVFVTLGTGVGGGVIADGNLIHGVAGAGGEIGHMIVDPENGFTCTCGNKGCLETVASATGVVRVARQLAEQYEGSSAIKAAIDNGDTVTSKDIFIAAEDGDKFANSVVERVSRYLGLAAANISNILNPDSVVIGGGVSAAGEFLRSRVEKYFVTFAFPQVKKSTKIKIAELGNDAGIIGAASLANQQAS

SEQ ID NO: 197 - DNA, 969 bp, Streptococcus pyogenes
atgagtcaaaaattactggggattgatttaggtggtaccaccattaaatttggaattttaacagcagcaggagaagtccaagaaaaatgggcaattgagactaatattttagaaggaggcaaacatattgtccctgatatcatcgcttccatcaaacatcgcttagacttgtatggtctaagcagtgctgactttgtgggaattggtatgggatcaccaggagcggttgaccgtgatactaatacagttactggggcattcaaccttaattggaaagaaacccaagaagtcggttccgttgttgaaaaagaattgggcattccttttgccattgacaatgatgccaatgtggctgcccttggtgaacgttgggtaggtgctggtgaaaataacccagatgtcgtcttcatgacacttggaacaggtgtcggtggaggcattattgctgatggtaacttgattcatggtgttgcaggagcaggtggtgaaatcggccacatgattgttgagccagaaaatggctttgcttgtacttgtggctcacacggctgtttggaaacagtagcttcagcaacaggagttgtcaaagtggcacgtttactggcagaagcctacgaaggggattcagccatcaaagcagctattgacaatggtgaaggtgttaccagtaaagacattttcatggcggctgaagcaggggattcctttgctgattctgttgtggaaaaggttggttactaccttggccttgcttcagcaaatatttccaatatcttgaatccagactcagtggttatcggtgggggtgtgtcagcagcaggagaatttctacgctcacgtattgaaaaatactttgtgaccttcactttcccacaagtgaggtattcaactaaaattaagattgcagaacttggcaatgatgctggaattatcggtgcagctagccttgctcgacaatttatcacaaaa

SEQ ID NO: 198 - protein, 323 aa, Streptococcus pyogenes
MSQKLLGIDLGGTTIKFGILTAAGEVQEKWAIETNILEGGKHIVPDIIASIKHRLDLYGLSSADFVGIGMGSPGAVDRDTNTVTGAFNLNWKETQEVGSVVEKELGIPFAIDNDANVAALGERWVGAGENNPDVVFMTLGTGVGGGIIADGNLIHGVAGAGGEIGHMIVEPENGFACTCGSHGCLETVASATGVVKVARLLAEAYEGDSAIKAAIDNGEGVTSKDIFMAAEAGDSFADSVVEKVGYYLGLASANISNILNPDSVVIGGGVSAAGEFLRSRIEKYFVTFTFPQVRYSTKIKIAELGNDAGIIGAASLARQFITK

SEQ ID NO: 199 - DNA, 378 bp, Streptococcus agalactiae
atggatatgtctgttattttaattattgttattcttctggcttttgttgcttgggcatcttggaattattggagggttcgtagggcagctaaatttttagataacgagtcttttcaaaaagaaatgtcacgaggacagttaattgatatccgagaagctggtgcttttcatagaaagcatattctcggagcacgtaacattccagcaagtcaatttaaagttgccttatcggctttgcgcaaagataaacctgtcctcttatatgacgcaagccgtggtcaatctattccaaggattgttttgttactcagaaaagaaggttttaatcaactttacgtgttaaaggacggtttcaattactggacgggtagagttaag

SEQ ID NO: 200 - protein, 126 aa, Streptococcus agalactiae
MDMSVILIIVILLAFVAWASWNYWRVRRAAKFLDNESFQKEMSRGQLIDIREAGAFHRKHILGARNIPASQFKVALSALRKDKPVLLYDASRGQSIPRIVLLLRKEGFNQLYVLKDGFNYWTGRVK

SEQ ID NO: 201 - DNA, 387 bp, Streptococcus pyogenes
atgtctccaatcacacttatcttatggttacttcttgtcggcattgttggttattatacatggaactatttctcttttcgaaaaatggcaaagcaggttgataacgagacttttaaagacgtgatgcgtcaaggtcaattgattgatttacgagagccagcggcttttagaactaagcatattttaggagctcgaaattttccagcgcaacaatttgatgctgctattaagggactacgcaaggacaaacctgttcttatttacgaaaatatgcgtccccagtaccgtgtgcctgcggtcaaaaaacttaaaaaagctggctttgaagacgtttatgtcttaaaagacggtattgattattgggatggcaaagttaaacaaacaacc

SEQ ID NO: 202 - protein, 129 aa, Streptococcus pyogenes
MSPITLILWLLLVGIVGYYTWNYFSFRKMAKQVDNETFKDVMRQGQLIDLREPAAFRTKHILGARNFPAQQFDAAIKGLRKDKPVLIYENMRPQYRVPAVKKLKKAGFEDVYVLKDGIDYWDGKVKQTT

SEQ ID NO: 203 - DNA, 1839 bp, Streptococcus agalactiae
atgacaaatttaagaacagatatccgtaacgttgcgatcattgcccacgttgaccacggtaaaacaactctcgttgatgaattattaaaacaatcacatactcttgatgagcgtaaagagcttgaagaacgtgcaatggattcaaatgatatcgaaaaagaacgtggtatcaccattcttgcaaaaaatacagccgtagcatacaacgatgttcgtatcaatattatggacacacctggtcacgcggactttggtggtgaagttgagcgtattatgaaaatggttgatggtgttgttttagtcgttgatgcctacgaaggaacaatgccacaaacacgttttgttttgaagaaagctcttgaacaaaacttaattccaatcgttgttgtaaataaaattgataagccgtcagctcgtccatcagaggttgttgatgaagttcttgaactatttattgagctcggtgctgatgatgatcaactagatttccctgttgtttatgcttcagctatcaatggaacatcttcaatgtcagatgatccttcagatcaagaaaaaacaatggcaccgatttttgatactatcattgatcacattccagccccagttgacaactcggaagaaccacttcaattccaagtttctcttcttgattacaatgattttgtaggacgtattggtattggacgtgttttccgcgggactgtcaaagttggagatcaagttactctttcaaaacttgatggtacaactaaaaacttccgcgtaacaaaactttttggtttctttggacttgaacgtaaagaaatccaagaggctaaagcgggtgatttaatcgctgtttctggtatggaagatatcttcgttggtgagacagtaactccgacagatgctattgaaccactaccagttttacgtattgacgagccaacacttcaaatgactttcttggtgaataattcaccatttgcaggtcgcgaaggtaaatggattacgtcacgtaaggttgaagaacgtcttttagcagaattacaaacagacgtttctttacgtgttgacccaacagattcgccagataaatggacggtttcagggcgtggagaattacatttatctatccttattgaaacaatgcgtcgtgagggatatgaacttcaagtatcacgtccagaagttatcatcaaagaaattgatggtgttcaatgcgagccgtttgagcgtgttcaaattgatactccagaagaatatcagggtgctattatccaaagtttgtcagagcgtaaaggtgatatgcttgatatgcagatggttggtaatggtcaaacgcgtttgattttcttgattcctgcacgtggtttgattggttattcaacagagtttctttcaatgacacgtggatatggtatcatgaatcatacttttgaccagtatctaccggttgttcaaggagaaattggtggtcgtcatcgtggtgccttggtttctattgaaaatggtaaagcaactacatattcaattatgcgtattgaagaacgtgggactatctttgtaaatccaggtatagaagtttatgaaggaatgattgttggtgagaattctcgtgataatgacctcggagtcaatattacaactgctaaacaaatgacaaatgtccgttcagcaactaaagatcaaactgcagtcatcaagacgcctcgtatccttactttagaagagtcacttgaatttttagcagatgatgagtacatggaagtaactcctgagtctattcgtcttcgtaaacaaattttaaataaagcagcacgtgacaaagctaataaaaagaaaaaatcagctgaa

SEQ ID NO: 204 - protein, 613 aa, Streptococcus agalactiae
MTNLRTDIRNVAIIAHVDHGKTTLVDELLKQSHTLDERKELEERAMDSNDIEKERGITILAKNTAVAYNDVRINIMDTPGHADFGGEVERIMKMVDGVVLVVDAYEGTMPQTRFVLKKALEQNLIPIVVVNKIDKPSARPSEVVDEVLELFIELGADDDQLDFPVVYASAINGTSSMSDDPSDQEKTMAPIFDTIIDHIPAPVDNSEEPLQFQVSLLDYNDFVGRIGIGRVFRGTVKVGDQVTLSKLDGTTKNFRVTKLFGFFGLERKEIQEAKAGDLIAVSGMEDIFVGETVTPTDAIEPLPVLRIDEPTLQMTFLVNNSPFAGREGKWITSRKVEERLLAELQTDVSLRVDPTDSPDKWTVSGRGELHLSILIETMRREGYELQVSRPEVIIKEIDGVQCEPFERVQIDTPEEYQGAIIQSLSERKGDMLDMQMVGNGQTRLIFLIPARGLIGYSTEFLSMTRGYGIMNHTFDQYLPVVQGEIGGRHRGALVSIENGKATTYSIMRIEERGTIFVNPGIEVYEGMIVGENSRDNDLGVNITTAKQMTNVRSATKDQTAVIKTPRILTLEESLEFLADDEYMEVTPESIRLRKQILNKAARDKANKKKKSAE

SEQ ID NO: 205 - DNA, 1839 bp, Streptococcus pyogenes
atgactaacttaagaaacgatatccgtaacgtagcgattattgcccacgttgaccacggaaaaacaacacttgtagatgaattattaaaacaatcccatactcttgatgagcgtaaagagcttcaagagcgtgccatggattccaatgaccttgaaaaagaacgtgggattacaatccttgcgaaaaatacggcagtagcctataacgatgttcgtattaacatcatggataccccaggacacgcggacttcggtggtgaagttgaacgtatcatgaaaatggttgacggggttgttcttgttgtggatgcctacgaaggaacaatgccccagacgcgtttcgtattgaaaaaagcacttgagcaaaaccttatcccgatcgttgtggtgaacaagattgacaaaccttcagctcgtccagcagaagttgtagatgaagtgcttgaattattcatcgaacttggtgccgatgatgagcaattggaattcccagttgtttacgcatcagctattaatggaacatcatcattatcagatgaccctgctgaccaagagcatactatggcaccgatctttgatacgattattgatcatattccagcgccagttgataattcagatgagcctttgcaattccaagtgtcacttttggactacaacgatttcgtaggtcgtatcggtatcggtcgtgttttccgtggtactgttaaagtgggtgaccaagtaactctttcaaaacttgatggtaccactaaaaacttccgtgttacaaaactgtttggtttcttcggtttggaacgtcgtgaaattcaagaagctaaagcaggtgacttgattgctgtttcaggtatggaagatatctttgttggagaaaccattacaccaactgactgtgtggaagctctgccaattcttcgtattgatgagccaacacttcagatgactttcttggtcaataactctccttttgcaggtcgtgaaggtaaatggatcacgtcacgtaaggttgaagaacgtcttttagcagaattgcaaacagacgtgtcacttcgtgttgacccaacagattcgccagataaatggacggtttcagggcgtggagaattgcatttatctatcctcattgaaaccatgcgccgtgaaggctatgaacttcaagtatcacgtccagaagttatcatcaaagaaattgatggtgtcaaatgtgaaccgtttgagcgtgttcaaattgatacaccagaagaatatcagggtgcaatcatccagtctctttcagaacgtaaaggggatatgcttgatatgcagatggttggtaatggtcaaacgcgtttgattttcttgattcctgcacgtggtttgattggttattcaacagagtttctttcaatgacacgtggatatggtatcatgaatcatacttttgatcagtatctaccggttgttcaaggagaaatcggtggccgtcatcgtggtgccttggtttctattgaaaatgggaaagcaacgacatattcaatcatgcgtattgaagaacgtggaactatctttgtcaatccaggtacagaagtttacgaagggatgattgttggtgaaaactcacgtgataacgaccttggtgttaacattacaacagctaagcaaatgacaaatgtccgttcagcgactaaagatcaaactgcagttatcaagacgcctcgtatcctaacgcttgaagaatcattagagttcttgaatgacgacgaatacatggaagtaacgccagaatctatccgcttgcgtaaacaaatcttgaataaagctgcgcgtgataaagctaataaaaagaaaaaatcagccgaa

SEQ ID NO: 206 - protein, 613 aa, Streptococcus pyogenes
MTNLRNDIRNVAIIAHVDHGKTTLVDELLKQSHTLDERKELQERAMDSNDLEKERGITILAKNTAVAYNDVRINIMDTPGHADFGGEVERIMKMVDGVVLVVDAYEGTMPQTRFVLKKALEQNLIPIVVVNKIDKPSARPAEVVDEVLELFIELGADDEQLEFPVVYASAINGTSSLSDDPADQEHTMAPIFDTIIDHIPAPVDNSDEPLQFQVSLLDYNDFVGRIGIGRVFRGTVKVGDQVTLSKLDGTTKNFRVTKLFGFFGLERREIQEAKAGDLIAVSGMEDIFVGETITPTDCVEALPILRIDEPTLQMTFLVNNSPFAGREGKWITSRKVEERLLAELQTDVSLRVDPTDSPDKWTVSGRGELHLSILIETMRREGYELQVSRPEVIIKEIDGVKCEPFERVQIDTPEEYQGAIIQSLSERKGDMLDMQMVGNGQTRLIFLIPARGLIGYSTEFLSMTRGYGIMNHTFDQYLPVVQGEIGGRHRGALVSIENGKATTYSIMRIEERGTIFVNPGTEVYEGMIVGENSRDNDLGVNITTAKQMTNVRSATKDQTAVIKTPRILTLEESLEFLNDDEYMEVTPESIRLRKQILNKAARDKANKKKKSAE

SEQ ID NO: 207 - DNA, 1365 bp, Streptococcus agalactiae
atgggacgagtaatgaaaacaataacaacatttgaaaataaaaaagttttagtccttggtttagcacgatctggagaagctgctgcacgtttgttagctaagttaggagcaatagtgacagttaatgatggcaaaccatttgatgaaaatccaacagcacagtctttgttggaagagggtattaaagtggtttgtggtagtcatcctttagaattgttagatgaggatttttgttacatgattaaaaatccaggaataccttataacaatcctatggtcaaaaaagcattagaaaaacaaatccctgttttgactgaagtggaattagcatacttagtttcagaatctcagctaataggtattacaggctctaacgggaaaacgacaacgacaacgatgattgcagaagtcttaaatgctggaggtcagagaggtttgttagctgggaatatcggctttcctgctagtgaagttgttcaggctgcgaatgataaagatactctagttatggaattatcaagttttcagctaatgggagttaaggaatttcgtcctcatattgcagtaattactaatttaatgccaactcatttagattatcatgggtcttttgaagattatgttgctgcaaaatggaatatccaaaatcaaatgtcttcatctgattttttggtacttaattttaatcaaggtatttctaaagagttagctaaaactactaaagcaacaatcgttcctttctctactacggaaaaagttgatggtgcttacgtacaagacaagcaacttttctataaaggggagaatattatgtcagtagatgacattggtgtcccaggaagccataacgtagagaatgctctagcaactattgcggttgctaaactggctggtatcagtaatcaagttattagagaaactttaagcaattttggaggtgttaaacaccgcttgcaatcactcggtaaggttcatggtattagtttctataacgacagcaagtcaactaatatattggcaactcaaaaagcattatctggctttgataatactaaagttatcctaattgcaggaggtcttgatcgcggtaatgagtttgatgaattgataccagatatcactggacttaaacatatggttgttttaggggaatcggcatctcgagtaaaacgtgctgcacaaaaagcaggagtaacttatagcgatgctttagatgttagagatgcggtacataaagcttatgaggtggcacaacagggcgatgttatcttgctaagtcctgcaaatgcatcatgggacatgtataagaatttcgaagtccgtggtgatgaattcattgatactttcgaaagtcttagaggagag

SEQ ID NO: 208 - protein, 455 aa, Streptococcus agalactiae
MGRVMKTITTFENKKVLVLGLARSGEAAARLLAKLGAIVTVNDGKPFDENPTAQSLLEEGIKVVCGSHPLELLDEDFCYMIKNPGIPYNNPMVKKALEKQIPVLTEVELAYLVSESQLIGITGSNGKTTTTTMIAEVLNAGGQRGLLAGNIGFPASEVVQAANDKDTLVMELSSFQLMGVKEFRPHIAVITNLMPTHLDYHGSFEDYVAAKWNIQNQMSSSDFLVLNFNQGISKELAKTTKATIVPFSTTEKVDGAYVQDKQLFYKGENIMSVDDIGVPGSHNVENALATIAVAKLAGISNQVIRETLSNFGGVKHRLQSLGKVHGISFYNDSKSTNILATQKALSGFDNTKVILIAGGLDRGNEFDELIPDITGLKHMVVLGESASRVKRAAQKAGVTYSDALDVRDAVHKAYEVAQQGDVILLSPANASWDMYKNFEVRGDEFIDTFESLRGE

SEQ ID NO: 209 - DNA, 1356 bp, Streptococcus pyogenes
atgaaagtgataagtaattttcaaaacaaaaaaatattaatattggggttagccaaatcgggcgaagcagcagcaaaattattgaccaaacttggtgctttagtgactgttaatgatagtaaaccatttgaccaaaatccagcggcacaagccttgttggaagaggggattaaggtcatttgtggtagccacccagtagaattattagatgagaactttgagtacatggttaaaaaccctgggattccttatgataatcctatggttaaacgcgcccttgcaaaggaaattcccatcttgactgaagtagaattggcttatttcgtatctgaagcgcctattatcgggattacaggatcaaacgggaagacaaccacaacgacaatgattgccgatgttttgaatgctggcgggcaatctgcactcttatctggaaacattggttatcctgcttcaaaagttgttcaaaaagcaattgctggtgatactttggtgatggaattgtcctcttttcaattagtgggagtgaatgcttttcgccctcatattgctgtcatcactaatttaatgccgactcacctggactatcatggcagttttgaggattatgttgctgctaaatggatgattcaagctcagatgacagaatcagactaccttattttaaatgctaatcaagagatttcagcaactctagctaagaccaccaaagcaacagtgattcctttttcaactcaaaaagtggttgatggagcttatctgaaggatggaatactctattttaaagaacaggcgattatagctgcaactgacttaggtgtcccaggtagccacaacattgaaaatgccctagcaactattgcagttgccaagttatctggtattgctgatgatattattgcccagtgcctttcacattttggaggcgttaaacatcgtttgcaacgggttggtcaaatcaaagatattaccttctacaatgacagtaagtcaaccaatattttagccactcaaaaagctttatcaggttttgataacagtcgcttgattttgattgctggcggtctagatcgtggcaatgaatttgacgatttggtgccagaccttttaggacttaagcagatgattattttgggagaatccgcagagcgtatgaagcgagctgctaacaaagcagaggtctcttatcttgaagctagaaatgtggcagaagcaacagagcttgcttttaagctggcccaaacaggcgatactatcttgcttagcccagccaatgctagctgggatatgtatcctaattttgaggttcgtggggatgaatttttggcaacctttgattgtttaagaggagatgcc

SEQ ID NO: 210 - protein, 452 aa, Streptococcus pyogenes
MKVISNFQNKKILILGLAKSGEAAAKLLTKLGALVTVNDSKPFDQNPAAQALLEEGIKVICGSHPVELLDENFEYMVKNPGIPYDNPMVKRALAKEIPILTEVELAYFVSEAPIIGITGSNGKTTTTTMIADVLNAGGQSALLSGNIGYPASKVVQKAIAGDTLVMELSSFQLVGVNAFRPHIAVITNLMPTHLDYHGSFEDYVAAKWMIQAQMTESDYLILNANQEISATLAKTTKATVIPFSTQKVVDGAYLKDGILYFKEQAIIAATDLGVPGSHNIENALATIAVAKLSGIADDIIAQCLSHFGGVKHRLQRVGQIKDITFYNDSKSTNILATQKALSGFDNSRLILIAGGLDRGNEFDDLVPDLLGLKQMIILGESAERMKRAANKAEVSYLEARNVAEATELAFKLAQTGDTILLSPANASWDMYPNFEVRGDEFLATFDCLRGDA

SEQ ID NO: 211 - DNA, 1074 bp, Streptococcus agalactiae
atggggaaaaaaattgtttttacaggtggtggtacggtaggtcatgtaacactaaacctaatattaatccccaaatttatcaaagatggttgggaagtacattatattggtgataaaaatggcatagaacatgaacaaattaatcagtctggacttgatatcacatttcactctatagctactgggaaactacgtcgctatttttcatggcaaaatatgttagatgtctttaaagtaggggttggcgttcttcaatcgattgctattattgctaaacttagaccccaagccttattttcaaaagggggatttgtttcagtacctcctgtagtagctgcacgcctattaaaagttcctgtttttgttcatgaatcagatttatcaatggggttagcaaataagattgcttataaatttgcgactattatgtatacgacttttgaacaatctaaagatttaatcaaaactaagcatattggtgctgtaacaaaagtcatggattgtaaaaagtcgtttgaaaatactgacttaactagtataaaagaagccttcgatccaaacctaaagaccttactatttattggaggatcagcaggtgcaaaagtattcaatgattttattactcaaacacctgagctggaagaaaaatataatgttatcaatatttcaggcgattcttctctcaatcgattgaagaagaacctttatcgcgtggattatgttacagacctttatcagcctttaatgaatttagcagatgtggttgttacacgaggtggctctaatactatttttgaattagtagctatgaaaaaacttcatcttattatccctcttggacgtgaagcgagccgaggtgaccaattagagaatgctgcttattttgaagaaaagggctacgcattgcagttaccagaatctgaattaaacataaatacacttgagaaacagataaatttattaatttctaacagtgagagttacgaaaaaaacatgtcacaatcatctgaaataaaatctcaagatgaattttatcaattattaattgatgatatggcaaaagtaacaaaagga

SEQ ID NO: 212 - protein, 358 aa, Streptococcus agalactiae
MGKKIVFTGGGTVGHVTLNLILIPKFIKDGWEVHYIGDKNGIEHEQINQSGLDITFHSIATGKLRRYFSWQNMLDVFKVGVGVLQSIAIIAKLRPQALFSKGGFVSVPPVVAARLLKVPVFVHESDLSMGLANKIAYKFATIMYTTFEQSKDLIKTKHIGAVTKVMDCKKSFENTDLTSIKEAFDPNLKTLLFIGGSAGAKVFNDFITQTPELEEKYNVINISGDSSLNRLKKNLYRVDYVTDLYQPLMNLADVVVTRGGSNTIFELVAMKKLHLIIPLGREASRGDQLENAAYFEEKGYALQLPESELNINTLEKQINLLISNSESYEKNMSQSSEIKSQDEFYQLLIDDMAKVTKG

SEQ ID NO: 213 - DNA, 1101 bp, Streptococcus pyogenes
ttgtttaagaggagatgcctaatgcctaagaagattttatttacaggtggtggaactgtaggtcatgtcaccttgaacctcattctcataccaaaatttatcaaggacggttgggaagtacattatattggtgataaaaatggcattgaacatacagaaattgaaaagtcaggccttgacgtgacctttcatgctatcgcgacaggcaagcttagacgctatttttcatggcaaaatctagctgatgtttttaaggttgcacttggcctcctacagtctctctttattgttgccaagcttcgccctcaagcccttttttccaaaggtggttttgtctcagtaccgccagttgtggctgctaaattgcttggtaaaccagtctttattcatgaatcagatcggtcaatgggactagcaaacaagattgcctacaaatttgcaactaccatgtataccacttttgagcaggaagaccagttgtctaaagttaaacaccttggagcggtgacaaaggttttcaaagatgccaaccaaatgcctgaatcaactcagttagaggcggtgaaagagtattttagtagagacctaaaaaccctcttgtttattggtggttcggcaggggcgcatgtgtttaatcagtttattagtgatcatccagaattgaagcaacgttataatatcatcaatattacaggagaccctcaccttaatgaattgagttctcatctgtatcgagtagattatgttaccgatctctaccaacctttgatggcgatggctgaccttgtagtgacaagagggggctctaatacactttttgagctactggcaatggctaagctacacctcatcgttcctcttggtaaagaagctagccgtggcgatcagttagaaaatgccacttattttgagaagaggggctacgctaaacaattacaggaacctgatttaactttgcataattttgatcaggcaatggctgatttgtttgaacatcaggctgattatgaggctactatgttggcaactaaggagattcagtcaccggacttcttttatgaccttttgagagctgatattagctccgcgattaaggagaag

SEQ ID NO: 214 - protein, 367 aa, Streptococcus pyogenes
LFKRRCLMPKKILFTGGGTVGHVTLNLILIPKFIKDGWEVHYIGDKNGIEHTEIEKSGLDVTFHAIATGKLRRYFSWQNLADVFKVALGLLQSLFIVAKLRPQALFSKGGFVSVPPVVAAKLLGKPVFIHESDRSMGLANKIAYKFATTMYTTFEQEDQLSKVKHLGAVTKVFKDANQMPESTQLEAVKEYFSRDLKTLLFIGGSAGAHVFNQFISDHPELKQRYNIINITGDPHLNELSSHLYRVDYVTDLYQPLMAMADLVVTRGGSNTLFELLAMAKLHLIVPLGKEASRGDQLENATYFEKRGYAKQLQEPDLTLHNFDQAMADLFEHQADYEATMLATKEIQSPDFFYDLLRADISSAIKEK

SEQ ID NO: 215 - DNA, 1134 bp, Streptococcus agalactiae
atgcctaagaagaaatcagataccccagaaaaagaagaagttgtcttaacggaatggcaaaagcgtaaccttgaatttttaaaaaaacgcaaagaagatgaagaagaacaaaaacgtattaacgaaaaattacgcttagataaaagaagtaaattaaatatttcttctcctgaagaacctcaaaatactactaaaattaagaagcttcattttccaaagatttcaagacctaagattgaaaagaaacagaaaaaagaaaaaatagtcaacagcttagccaaaactaatcgcattagaactgcacctatatttgtagtagcattcctagtcattttagtttccgttttcctactaactccttttagtaagcaaaaaacaataacagttagtggaaatcagcatacacctgatgatattttgatagagaaaacgaatattcaaaaaaacgattatttcttttctttaatttttaaacataaagctattgaacaacgtttagctgcagaagatgtatgggtaaaaacagctcagatgacttatcaatttcccaataagtttcatattcaagttcaagaaaataagattattgcatatgcacatacaaagcaaggatatcaacctgtcttggaaactggaaaaaaggctgatcctgtaaatagttcagagctaccaaagcacttcttaacaattaaccttgataaggaagatagtattaagctattaattaaagatttaaaggctttagaccctgatttaataagtgagattcaggtgataagtttagctgattctaaaacgacacctgacctcctgctgttagatatgcacgatggaaatagtattagaataccattatctaaatttaaagaaagacttcctttttacaaacaaattaagaagaaccttaaggaaccttctattgttgatatggaagtgggagtttacacaacaacaaataccattgaatcaacccctgttaaagcagaagatacaaaaaataaatcaactgataaaacacaaacacaaaatggtcaggttgcggaaaatagtcaaggacaaacaaataactcaaatactaatcaacaaggacaacagatagcaacagagcaggcacctaaccctcaaaatgttaat

SEQ ID NO: 216 - protein, 378 aa, Streptococcus agalactiae
MPKKKSDTPEKEEVVLTEWQKRNLEFLKKRKEDEEEQKRINEKLRLDKRSKLNISSPEEPQNTTKIKKLHFPKISRPKIEKKQKKEKIVNSLAKTNRIRTAPIFVVAFLVILVSVFLLTPFSKQKTITVSGNQHTPDDILIEKTNIQKNDYFFSLIFKHKAIEQRLAAEDVWVKTAQMTYQFPNKFHIQVQENKIIAYAHTKQGYQPVLETGKKADPVNSSELPKHFLTINLDKEDSIKLLIKDLKALDPDLISEIQVISLADSKTTPDLLLLDMHDGNSIRIPLSKFKERLPFYKQIKKNLKEPSIVDMEVGVYTTTNTIESTPVKAEDTKNKSTDKTQTQNGQVAENSQGQTNNSNTNQQGQQIATEQAPNPQNVN

SEQ ID NO: 217 - DNA, 1146 bp, Streptococcus pyogenes
atggcaaaagataaagagaaacaaagtgatgacaagctcgttttgacagagtggcaaaagcgtaacattgaatttttaaagaaaaagaagcagcaagctgaggaagaaaaaaaactcaaagagaaattattgagtgataaaaaagcgcagcagcaagctcaaaatgcttctgaagcggttgagcttaaaactgatgagaaaactgatagtcaggaaattgagtcagaaacgacgtcaaaacctaaaaaaaccaaaaaagttagacaacccaaggaaaaaagcgcgacacaaatcgcttttcaaaaatccttgcctgttcttttgggggcgctcttactcatggcggtgtctatttttatgatcactccttatagcaaaaagaaagagttttctgtaagaggaaaccatcaaacgaaccttgacgaattaatcaaagctagcaaagtcaaagcatctgactattggttaacgctgttaacttcgcctggtcagtatgaacgaccgattcttcgtactattccatgggtgaaatctgtacatctctcttaccaatttcctaatcactttctatttaacgttattgaatttgaaatcatcgcttatgcacaagttgaaaacggttttcagcctattttggagaatggaaaacgtgtggacaaggtcagggcatcagaactaccgaaatctttcttgattcttaatttaaaagatgagaaagcgatccaacagttagttaagcaattaacgacattacctaaaaaattagtcaagaatatcaagtcagtgtctcttgcaaattccaaaacgacagcggatttactacttattgaaatgcatgacggtaatgtagttagagtaccgcagtcacaactcacattgaaacttccctattatcaaaaattgaaaaaaaaccttgaaaatgatagtatagtggatatggaagtgggaatttatactacaacacaggagattgaaaatcaacctgaagttcctcttacgcctgaacaaaacgcagctgataaagaaggagataagcctggtgaacatcaggaacagacagacaatgattcagaaacgccagcaaatcagagtagtcctcagcaaacaccaccatccccagaaacggtcctcgaacaggcccatggc

SEQ ID NO: 218 - protein, 382 aa, Streptococcus pyogenes
MAKDKEKQSDDKLVLTEWQKRNIEFLKKKKQQAEEEKKLKEKLLSDKKAQQQAQNASEAVELKTDEKTDSQEIESETTSKPKKTKKVRQPKEKSATQIAFQKSLPVLLGALLLMAVSIFMITPYSKKKEFSVRGNHQTNLDELIKASKVKASDYWLTLLTSPGQYERPILRTIPWVKSVHLSYQFPNHFLFNVIEFEIIAYAQVENGFQPILENGKRVDKVRASELPKSFLILNLKDEKAIQQLVKQLTTLPKKLVKNIKSVSLANSKTTADLLLIEMHDGNVVRVPQSQLTLKLPYYQKLKKNLENDSIVDMEVGIYTTTQEIENQPEVPLTPEQNAADKEGDKPGEHQEQTDNDSETPANQSSPQQTPPSPETVLEQAHG

SEQ ID NO: 219 - DNA, 1371 bp, Streptococcus agalactiae
atggctagaaatggcttttttactggtttggatataggaacaagctcgattaaagttttagttgcagaatttattgcaaatgaaatgaatgtaattggggttagcaacgtccctagttccggtgtaaaagatggtataattattgatattgaggcagcagcaactgcaatcaaagaggcggtaaaacaagctgaggagaaagcaggcatcaccattgacaaaatcaatgttggattaccagcaaatcttctccaaattgaaccaactcaaggaatgattcctgttcctaatgaatcaaaagaaattaaggatgaagatgtcgaaagtgttgttaaatcagcattgactaaaagcattactcctgaaagagaagttatttcattgattccgcttgaattcattgtagatggtttccaagggattagagaccctagagggatgatggggattcgccttgagatgcgtggtcttatctatactggaccaacaactatccttcataatcttcgtaaaactgttgaacgagcaggtataaaagtagagcatgttgtgatcgcccctctagccttagcaaaatcagttctaaacgaaggtgaacgtgagtttggtgcaactgtgattgatatgggaggcggacaaacaacagtcgcttctatgcgtaatcaagaattgcaatatactaatatttattctgaaggtagcgattatgttaccaaagatatttctaaagtgctacgtacaacagtagaaatcgccgaagcattgaaattcaactttggacaagctaatgttgaagaagcaagtacttctgatacagttcaagttaatgttgttggtaacgaggaacctgttgaaattacagaaagctatctttcgcaaattatttcaggacgtattcgtcaaattttagaacatgtcaaacaagacttgggtagaggtcgtttacttgatttacctggtggtattattcttgttggaggtggtgcaattatgccaggagttgtcgaggttgctcaacaaatttttggaactagagttaaattgcacgttccaaaccaagtaggtattcgcaatccaatgtttgctaatgttattagtatcgttgattatgtaggaatgatgtcagaagttgacattatcgcacaacatgctgtaactggcgacgaaatgctaagacataaaccagtcgactttgattataaagaaaaaacaaatacaatgtcgacaatgccttattctgagccgttaacctcttctatggaagattctaatttagaaccaatccgagcaagagaaaacgctcaagagcctactgagcctaaagctaatattggtgagcgcatcagaggaatttttggaagtatgtttgac

SEQ ID NO: 220 - protein, 457 aa, Streptococcus agalactiae
MARNGFFTGLDIGTSSIKVLVAEFIANEMNVIGVSNVPSSGVKDGIIIDIEAAATAIKEAVKQAEEKAGITIDKINVGLPANLLQIEPTQGMIPVPNESKEIKDEDVESVVKSALTKSITPEREVISLIPLEFIVDGFQGIRDPRGMMGIRLEMRGLIYTGPTTILHNLRKTVERAGIKVEHVVIAPLALAKSVLNEGEREFGATVIDMGGGQTTVASMRNQELQYTNIYSEGSDYVTKDISKVLRTTVEIAEALKFNFGQANVEEASTSDTVQVNVVGNEEPVEITESYLSQIISGRIRQILEHVKQDLGRGRLLDLPGGIILVGGGAIMPGVVEVAQQIFGTRVKLHVPNQVGIRNPMFANVISIVDYVGMMSEVDIIAQHAVTGDEMLRHKPVDFDYKEKTNTMSTMPYSEPLTSSMEDSNLEPIRARENAQEPTEPKANIGERIRGIFGSMFD

SEQ ID NO: 221 - DNA, 1335 bp, Streptococcus pyogenes
ttggacattggaacaagctcgataaaagttttagtagcagaatttatttctggtgagatgaacgtcattggtgttagtaatgttccaagtaccggcgtaaaagatggcataataatcgatatagaggcagctgcgactgccatcaaaactgcggtagaacaagcagaagaaaaagcagggatgacaattgaaaaggttaatgttgggctaccggcaaaccttcttcaaattgaaccaacacaaggaatgattcctgtcccaagtgagtctaaagagataaaagatgaggatgttgatagcgttgttaaatcggctttaacaaaaagtatcacaccagaacgagaggttatctctttagttccagaagagttcattgtggatggctttcagggcattcgagatccacgtggtatgatggggattagattagagatgcgcgggcttatttatactggaccaagcaccattttacataatctgcgtaaaacggtagaaagagcaggcattaaagttgaaaacatcattatttctccgttagctatggctaaaaccattttaaacgaaggtgagcgcgagtttggagctactgtaattgatatgggaggtggacagacaactgtcgcttctatgcgagcacaagaattgcagtataccaatatatatgccgaaggcggcgaatacattactaaagatatatcaaaagtattaaaaacgtctttggctattgcagaagcacttaagtttaattttggtcaagcggagatatcagaagctagtataactgaaacagtaaaagttgatgtggtaggtagtgaagagcctgttgaggtaactgaacgttatttatctgaaattatttcagcgcgtattcgtcatattttagatcgtgtgaagcaagatttggaaagaggtcgtttactagacttaccaggaggcattgttttgattggtggcggtgcaatcatgcctggagtggtagaaattgcacaagaaatctttggagtaactgtaaagctccatgttccaaaccaagtcggtattagaaatccaatgttttcaaacgttatcagtttggtagaatatgttggtatgatgtctgaagtagacgttttagcacaaactgcagtttcaggagaagaacttttgcgacgcaagcctatcgatttcagtggccaagaatcttatttaccagattatgatgattcaagaagaccagaatcgaccattggctatgaacaacaagcgtcacaaacagcatatgattcacaagttccgagtgatcctaaacaaaaaatttcagaacgtgttcgtggcatatttgggagtatgtttgat

SEQ ID NO: 222 - protein, 445 aa, Streptococcus pyogenes
LDIGTSSIKVLVAEFISGEMNVIGVSNVPSTGVKDGIIIDIEAAATAIKTAVEQAEEKAGMTIEKVNVGLPANLLQIEPTQGMIPVPSESKEIKDEDVDSVVKSALTKSITPEREVISLVPEEFIVDGFQGIRDPRGMMGIRLEMRGLIYTGPSTILHNLRKTVERAGIKVENIIISPLAMAKTILNEGEREFGATVIDMGGGQTTVASMRAQELQYTNIYAEGGEYITKDISKVLKTSLAIAEALKFNFGQAEISEASITETVKVDVVGSEEPVEVTERYLSEIISARIRHILDRVKQDLERGRLLDLPGGIVLIGGGAIMPGVVEIAQEIFGVTVKLHVPNQVGIRNPMFSNVISLVEYVGMMSEVDVLAQTAVSGEELLRRKPIDFSGQESYLPDYDDSRRPESTIGYEQQASQTAYDSQVPSDPKQKISERVRGIFGSMFD

SEQ ID NO: 223 - DNA, 1278 bp, Streptococcus agalactiae
atggtattttcatttgatacagcatcagtacaaggtgcagttattaaagttattggtgttggaggcggtggcggtaacgctattaaccgcatgattgacgaaggtgtcgctggcgttgagtttattgcagcaaatactgatattcaagccttaagtagctcaaaagctgaaactgtcattcaacttggtccaaaattaactcgcggacttggtgcaggaggacaacctgaagttggtcgtaaagcagctgaagaaagtgaagaagttttaacagaagcacttactggcgctgatatggtatttatcacagcaggtatggggggcggatctggtacaggtgcggctccagttattgcacgtattgcaaagagtttaggagcacttacagtagcggtcatcacacgtccttttggctttgagggtaataaacgttctaacttcgctatcgaaggtattcaagaattaagagaacaagttgatacactgcttatcatttcaaataataatcttcttgaaattgtagataagaagacaccattgcttgaagctcttagtgaagcagataatgttttacgtcaaggtgttcaaggtattacggatttgattactaacccaggtttaattaaccttgactttgcagatgttaaaacagttatggcaaataaaggtaatgcactgatgggaattggtatcggttctggtgaggaacgtattactgaagctgctcgaaaagcaatttattcaccacttcttgaaacaacgattgatggagcagaagacgttattgtcaatgttaccggcggtatggatatgacacttactgaagcagaggaagcatcagagattgttagccaagcagcaggtaaaggtgtcaatatttggttaggtacttcaattgacatggatatgaaagacgaaatccgcgtaacagttgttgcaacaggtgtacgtaaagataaaactaatcaagtatctggttttacaacatcagctccaactaatcaagcaccttcagaacgtcaaagtacttcaaattcaaactttgatcgtcgtggcaactttgatatgacagagtctcgcgaaatgccaactcaacaaaatcagcctcatgcacaaaatcagcaacaaagttctgcttttggtaattgggaccttcgtcgtgataatatttcacgtccgacagaaggtgaacttgatagcaagttgtctatgtcaacgttttcagaaaatgatgatatggatgatgaacttgaaacacctccattctttaaaaaccgt

SEQ ID NO: 224 - protein, 426 aa, Streptococcus agalactiae
MVFSFDTASVQGAVIKVIGVGGGGGNAINRMIDEGVAGVEFIAANTDIQALSSSKAETVIQLGPKLTRGLGAGGQPEVGRKAAEESEEVLTEALTGADMVFITAGMGGGSGTGAAPVIARIAKSLGALTVAVITRPFGFEGNKRSNFAIEGIQELREQVDTLLIISNNNLLEIVDKKTPLLEALSEADNVLRQGVQGITDLITNPGLINLDFADVKTVMANKGNALMGIGIGSGEERITEAARKAIYSPLLETTIDGAEDVIVNVTGGMDMTLTEAEEASEIVSQAAGKGVNIWLGTSIDMDMKDEIRVTVVATGVRKDKTNQVSGFTTSAPTNQAPSERQSTSNSNFDRRGNFDMTESREMPTQQNQPHAQNQQQSSAFGNWDLRRDNISRPTEGELDSKLSMSTFSENDDMDDELETPPFFKNR

SEQ ID NO: 225 - DNA, 1317 bp, Streptococcus pyogenes
atggcattttcatttgatactgcatcaattcaaggtgcaattataaaagtaattggagtcggcggaggtggcggaaatgccattaatcgtatgattgatgaaggtgttgctggtgtcgagttcatcgcagcaaacacagacattcaggcattaagctcatcaaaagctgaaacggttattcaactaggccctaaattaactcgtggacttggtgctggaggacaacctgaagtaggacgtaaagctgctgaagaaagcgaagaaattttaacagaagctcttacaggagcggacatggtatttattactgccggtatgggtggtggctctgggacaggggctgcaccggttattgctcgtatcgctaaaagtttgggagccttgacagtagctgttgttactcgcccgtttggttttgaaggtaacaaacgtggtaattttgctattgaaggtatcgaagaactacgtgaacaagttgatactttgttaattatttcaaataataaccttcttgagattgttgataaaaagacacctttattagaagcacttagtgaagctgataatgttttacgccagggagttcaagggataaccgacttaattactagtcctggccttatcaatctcgattttgccgacgtgaaaacagttatggcaaataaagggaatgccttgatggggattgggattggctctggagaagagcgcattgttgaggcggcgcgtaaggcaatctattcacccctattagaaacgactattgatggtgcacaagacgttattgtgaacgttacaggaggtctcgacatgacacttacagaagctgaagaagcctctgaaattgttgggcaagctgctggtcaaggcgttaacatttggttaggaacatctattgatgatactatgaaagatgacatccgtgtgactgttgtagcaactggagtgcgccaagaaaaagccgaacaagtttcaggttttcgtcagcctaggacttttacccaaaccaacgcgcagcaagtagcgggtgcacaatatgcatcagatcaagcaaaacagtcggttcaaccagggtttgatcgtcgctcaaattttgattttgacatgggggagtctcgcgagataccaagtgcacaaaaggtaatttctaatcataatcaaaatcaaggttctgcttttggaaattgggatttgagacgtgataatatttctcgtccaacagaaggtgaattggataaccatcttaatatgtcaacgttctcagctaacgatgacagtgatgatgaattagaaacgcctccattctttaaaaaccgt

SEQ ID NO: 226 - protein, 439 aa, Streptococcus pyogenes
MAFSFDTASIQGAIIKVIGVGGGGGNAINRMIDEGVAGVEFIAANTDIQALSSSKAETVIQLGPKLTRGLGAGGQPEVGRKAAEESEEILTEALTGADMVFITAGMGGGSGTGAAPVIARIAKSLGALTVAVVTRPFGFEGNKRGNFAIEGIEELREQVDTLLIISNNNLLEIVDKKTPLLEALSEADNVLRQGVQGITDLITSPGLINLDFADVKTVMANKGNALMGIGIGSGEERIVEAARKAIYSPLLETTIDGAQDVIVNVTGGLDMTLTEAEEASEIVGQAAGQGVNIWLGTSIDDTMKDDIRVTVVATGVRQEKAEQVSGFRQPRTFTQTNAQQVAGAQYASDQAKQSVQPGFDRRSNFDFDMGESREIPSAQKVISNHNQNQGSAFGNWDLRRDNISRPTEGELDNHLNMSTFSANDDSDDELETPPFFKNR

SEQ ID NO: 227 - DNA, 672 bp, Streptococcus agalactiae
atgatgaatttacaagaaaataaaacagcgatttttgacaatgttagtaaattagcactaaaagcaggtcgcgctcatgaatcagttcatatcgtagctgtaacaaaatatgttaactgtcaaacaacagaagcgcttattagaacaggtgttaatcatatcggtgaaaatcgtgttgataaatttcttgaaaaatatcaagcattaaaagatgaaaagcttacatggcatctcattggtagtttacaacgtcgaaaagttaaagatgtcattaattatgttgattattttcatgctttagattctgttaagttagcagctgagattcaaaaacatgctcaaaaactaattaaatgttttctacaagttaatatatcacgagaagacagtaagcatggttttactattgagcaaatagatgatgcactgaacttaatttctcggtacgataaaattgaacttatcggcatcatgactatggctcccttaaaagcaactaaagaggaaatatcatcaatttttgaagagactgagagtcttaggaaaaggcttcaagctaggaacatagaacgaatgccgtttacagaattaagcatgggcatgagtagagattatgatattgctattcaaaatggatcaacatttgtaaggataggaacttcattctttaaa

SEQ ID NO: 228 - protein, 224 aa, Streptococcus agalactiae
MMNLQENKTAIFDNVSKLALKAGRAHESVHIVAVTKYVNCQTTEALIRTGVNHIGENRVDKFLEKYQALKDEKLTWHLIGSLQRRKVKDVINYVDYFHALDSVKLAAEIQKHAQKLIKCFLQVNISREDSKHGFTIEQIDDALNLISRYDKIELIGIMTMAPLKATKEEISSIFEETESLRKRLQARNIERMPFTELSMGMSRDYDIAIQNGSTFVRIGTSFFK

SEQ ID NO: 229 - DNA, 669 bp, Streptococcus pyogenes
atggatttactgacaaataaaaagaaaatttttgagactatccgcttatctacagaggcagcaaataggactaatgatagtgtttcagttattgctgtaacaaaatatgtggatagtacaattgcaggtcagcttatcgaagcaggaattgagcacattgccgaaaaccgtgttgataaatttcttgaaaagtatgatgcgttaaagtatatgccagtaaagtggcatttaattggtaccttacaacgtcgtaaagtcaaggaagttatcaattatgttgattattttcacgctctagattctgtgagattagctttggaaatcaacaagagagctgaccatcctgtgaagtgttttctacaagttaatatttctaaagaagagagtaaacatggttttaacatttctgagattgatgaagcgattggagaaataggtaagatggagaagatacagttagttggtttaatgactatggcaccagcaaatgccagtaaagaaagtattataactatttttcgacaagcaaatcaattaagaaaaaacttgcagttaaaaaaaagaaagaatatgccttttacagaattgagcatgggcatgagtaacgattatccaattgctattcaagaaggctcaacttttattcggattggtagagctttctttcac

SEQ ID NO: 230 - protein, 223 aa, Streptococcus pyogenes
MDLLTNKKKIFETIRLSTEAANRTNDSVSVIAVTKYVDSTIAGQLIEAGIEHIAENRVDKFLEKYDALKYMPVKWHLIGTLQRRKVKEVINYVDYFHALDSVRLALEINKRADHPVKCFLQVNISKEESKHGFNISEIDEAIGEIGKMEKIQLVGLMTMAPANASKESIITIFRQANQLRKNLQLKKRKNMPFTELSMGMSNDYPIAIQEGSTFIRIGRAFFH

SEQ ID NO: 231 - DNA, 615 bp, Streptococcus agalactiae
atggaggggaatatggcattaaaagatagatttgacaaaattatttcttattttgacactgacgatgtaagtgaaaatgaagtacacgaagtacaagagagaacttcagtgcaaagagattccagagcagctacagcacaggaagcttctcagcgtagtcatatgactaactccgcagaggaagagatgattggtagtcgtccgagaacttatacctatgatcctaatcgtcaggagagacaaagggtacagagagacaatgcttatcagcaagctactcctagggttcaaaataaagactcagttcgacaacagagagaacaagtaacaattgctctgaagtatccccgtaagtatgaggatgcacaagaaattgttgatttacttatcgttaatgaatgtgtcttgattgattttcaatatatgcttgatgcgcaagcacgacgttgcttggattatattgatggtgcaagtagagtattatatggttcattacaaaaggttgggagttcaatgtttctattaacaccagccaatgttatggttgatattgaggagatgaatattccaaagactggtcaagagacgagttttgattttgatatgaagagacga

SEQ ID NO: 232 - protein, 205 aa, Streptococcus agalactiae
MEGNMALKDRFDKIISYFDTDDVSENEVHEVQERTSVQRDSRAATAQEASQRSHMTNSAEEEMIGSRPRTYTYDPNRQERQRVQRDNAYQQATPRVQNKDSVRQQREQVTIALKYPRKYEDAQEIVDLLIVNECVLIDFQYMLDAQARRCLDYIDGASRVLYGSLQKVGSSMFLLTPANVMVDIEEMNIPKTGQETSFDFDMKRR

SEQ ID NO: 233 - DNA, 666 bp, Streptococcus pyogenes
atggagaataagatggcttttaaagatacatttaacaagatgatttcttattttgacacggatgaggttaacgaagttgaagaagatgttgcagcatcaactgataacgttattccaagatcacaacaatcagtcagagcaagtagtcatccaaaacaagaacctagaaacaatcacgtacaacaagatcatcaagcgagatcccaagaacagacaaggtcacaaatgcatccaaaacatggcacttctgaacgctattatcagcagtctcagccaaaagaaggccatgaaatggttgacagaagaaaacggatgagcacttctagtattgcaaatcgccgtgagcagtatcaacaatcaacttgttcagatcaaacaactattgccttaaagtatcctcgtaaatatgaggatgctcaagaaattgtggatcttttaatagttaatgaatgcgttttgattgattttcagtttatgctagatgctcaggctagacggtgtttagattttattgatggtgctagtaaagtgctctatggtagcttacaaaaggtcggctcttcaatgtacttactggctccgtcaaatgtatccgtcaatatagaagaaatgactatcccacatactacacaagatattggctttgattttgatatgaaaaggcgg

SEQ ID NO: 234 - protein, 222 aa, Streptococcus pyogenes
MENKMAFKDTFNKMISYFDTDEVNEVEEDVAASTDNVIPRSQQSVRASSHPKQEPRNNHVQQDHQARSQEQTRSQMHPKHGTSERYYQQSQPKEGHEMVDRRKRMSTSSIANRREQYQQSTCSDQTTIALKYPRKYEDAQEIVDLLIVNECVLIDFQFMLDAQARRCLDFIDGASKVLYGSLQKVGSSMYLLAPSNVSVNIEEMTIPHTTQDIGFDFDMKRR

SEQ ID NO: 235 - DNA, 786 bp, Streptococcus agalactiae
atgacgttagatgatatttatcagcattttcgaccagaagagtatgcgtttatccataaaatagaccatttagctcaatatgtcgaaaacacctattcgtttattaccactgaatttctaaatcctagggaatttaaaatactcgaaagtgttctagagaggcgaggtagtcattattacacttctggtcagtattttcaaacagaatatgttaaagtaataatagcaccggaatactatcagttagatatggctgattttaaccttagcctaattgaaataaagtataatgctaaatttaatcaccttacccatgctaaaattatgggaactttactgaattacttaggtgtaaaacgatcaattttaggggatatcctagttgaagaaggctgtgctcaggttttggtcgatagtcaaatgacaaatcaccttgttcattcagttacaaaaattggaactgctagtgtacaattagctgaagttcccttgtccaaacttctaactcccaaacaagatattcaaaaactaactgttattgcttccagtttacgtcttgataaaattttagcaacgattttaaagatttcacgaacacagtcgacgaaattgattgaggcagataaagtcaaggtcaattatgcaaccgtcaatcgagtttctgaacaattagtagagggggatttgattagtgttagaggatatggtcgatttacgttgaaccataacctagggttaactaaaaatcaaaaatataagttagaagtagacaaaatgatacataac

SEQ ID NO: 236 - protein, 262 aa, Streptococcus agalactiae
MTLDDIYQHFRPEEYAFIHKIDHLAQYVENTYSFITTEFLNPREFKILESVLERRGSHYYTSGQYFQTEYVKVIIAPEYYQLDMADFNLSLIEIKYNAKFNHLTHAKIMGTLLNYLGVKRSILGDILVEEGCAQVLVDSQMTNHLVHSVTKIGTASVQLAEVPLSKLLTPKQDIQKLTVIASSLRLDKILATILKISRTQSTKLIEADKVKVNYATVNRVSEQLVEGDLISVRGYGRFTLNHNLGLTKNQKYKLEVDKMIHN

SEQ ID NO: 237 - DNA, 789 bp, Streptococcus pyogenes
atggttagtcatagtaagatttatcagcattttcaccaagaagaatatccttttattgatagaatgtctgatatgattaatagagttgaagattactatcttttagaagttactgagtttttaaatcctagagaagtgatgattttaaaaagtttgattgctttaacagatctaaaaatgttcgtatcaacagattactacccaagcgaatatggtcgtgtcattattgcacctggttactatgacttagaacaaagtgattttcaaatagctttagtagagataagttatcaggcaaagtttaatcagttgacacatagtcaaattttaggaactttaattaatgaattaggagtaaagcgaaatttatttggagatgtttttgttgaaatgggatatgcccagctcatgattaagcgggagttattggattattttttaggaacaattactaaaatagctaaaactagtgtgaaattaagagaagttaactttgatcagttaattaggtctattgataacagccagaccctggatattctagtttctagttttcgattagatggtgtagttgctactatcttaaaaaaatctcgaacgcaagttatagcattaattgaagcaaataagattaaggtaaactatcgagttgctaataaagcttcagataatctagtcataggggatatggtgagtatcagaggtcacgggcgttttactcttttagcagataatggagtgaccaaacatggcaaacaaaaaataacactaagtaaaatgatacataaa

SEQ ID NO: 238 - protein, 263 aa, Streptococcus pyogenes
MVSHSKIYQHFHQEEYPFIDRMSDMINRVEDYYLLEVTEFLNPREVMILKSLIALTDLKMFVSTDYYPSEYGRVIIAPGYYDLEQSDFQIALVEISYQAKFNQLTHSQILGTLINELGVKRNLFGDVFVEMGYAQLMIKRELLDYFLGTITKIAKTSVKLREVNFDQLIRSIDNSQTLDILVSSFRLDGVVATILKKSRTQVIALIEANKIKVNYRVANKASDNLVIGDMVSIRGHGRFTLLADNGVTKHGKQKITLSKMIHK

SEQ ID NO: 239 - DNA, 768 bp, Streptococcus agalactiae
atgccacttacagcacttgaaattaaagataaaacattttcatcaaaatttcgcggttatagcgaagaagaagttaatgaatttttagagattgttgttgacgattacgaggacttgattagacgtaatcgtgagcaagagcaatacattaaagatttagaagagaaaatcgcttacttcaacgaaatgaaggaatcgttaagtcaatcagttattttagctcaagaaactgctgagcgtgtgaaaatttcagcacaggatgaagcatctaacctaatggggaaagctacatttgatgctcaacatttaattgatgaggctaaattaaaagcaaatcaaatccttcgagatgcgacagatgatgctaagcgtgttgctatagaaacagaagatttgaaacgtcaatcacgtgttttccaccaacgtttgctttctgagttagaagggcagctaaaattagctaactcatctgcttgggaagaattgttgaaaccaacagctatttatcttcaaaattctgatgcttctttcaaagaagttgttgaaaaagttcttgatgaagatgatgctttaccagtggtggatgacactgagtcatttgatgctactcgtcaattctcaccagatgaaatggaagaattacagcgtcgtgttgaagaaagtaacaaacaacttgaagagtcaggtttattagatactaataatttccaaatggaagaaccgatcaatttaggtgaaactcaaacttttaaattaaatattgaagat

SEQ ID NO: 240 - protein, 256 aa, Streptococcus agalactiae
MPLTALEIKDKTFSSKFRGYSEEEVNEFLEIVVDDYEDLIRRNREQEQYIKDLEEKIAYFNEMKESLSQSVILAQETAERVKISAQDEASNLMGKATFDAQHLIDEAKLKANQILRDATDDAKRVAIETEDLKRQSRVFHQRLLSELEGQLKLANSSAWEELLKPTAIYLQNSDASFKEVVEKVLDEDDALPVVDDTESFDATRQFSPDEMEELQRRVEESNKQLEESGLLDTNNFQMEEPINLGETQTFKLNIED

SEQ ID NO: 241 - DNA, 756 bp, Streptococcus pyogenes
atggcacttacaacgctagaaattaaagataaaacttttaagacaaaattccgaggatactgtgaagaagaagtcaatgaattccttgatattgttgttgatgattacgaagctcttgtacgtaaaaatcgtgataacgaagcaagaattaaagatcttgaagaaaaattatcttactttgatgaaatgaaagagtcacttagccagtctgtaatcttagctcaagaaacagctgaaaaagtgaaagcaacggctaatgcggaagcaacaaacttggttagtaaagcgacttatgatgctcagcatttattagatgaatctaaagctaaagccaatcaaatgttgcgtgatgcaactgatgaggctaagcgagttgcgattgaaacagaagaactaaagcgtcaaacacgtgtgttccaccaacgtttaatctcatctattgagtcacaattaagcttatcaaattcacctgaatgggatgaactgctacaaccgactgcaatctatcttcaaaattctgacgatgcttttaaggaagtcgtgaagaccgttcttaatgaagacattcctgaatctgatgatagtgcctcttttgatgcaacacgtcagtttactccagaagagttagaagaattgcaacgtcgtgttgatgaaagcaataaggagttagaggcttaccaacttgactctcaatctgattctacgactgagccagaggtaaatctcagtgaaacacaaacgtttaaattaaatatc

SEQ ID NO: 242 - protein, 252 aa, Streptococcus pyogenes
MALTTLEIKDKTFKTKFRGYCEEEVNEFLDIVVDDYEALVRKNRDNEARIKDLEEKLSYFDEMKESLSQSVILAQETAEKVKATANAEATNLVSKATYDAQHLLDESKAKANQMLRDATDEAKRVAIETEELKRQTRVFHQRLISSIESQLSLSNSPEWDELLQPTAIYLQNSDDAFKEVVKTVLNEDIPESDDSASFDATRQFTPEELEELQRRVDESNKELEAYQLDSQSDSTTEPEVNLSETQTFKLNI

SEQ ID NO: 243 - DNA, 2790 bp, Streptococcus agalactiae
atgaaattaaaagaaaccttgaatttaggacaaacagcttttccaatgcgtgcagggcttccaaataaggaacctcaatggcaagaagcatgggatcaagctgacatttataaaaaacgtcaagcattgaatgaaggaaaaccagcctttcaccttcatgacggacctccctatgctaatgggaatattcatgtaggacatgcactaaataaaatttcgaaagacattattgtacgttcaaaatcaatgtcaggttttcgagctccttatgtgcctggttgggatactcatggactcccaattgagcaagtattagctaaaaaaggggttaaacgtaaagaaatggacttggctgaataccttgaaatgtgtcgtgattatgctctcagccaagttgacaaacaacgtgatgattttaaacgtctgggcgtttctgccgattgggaaaatccttatattacactaacaccagattatgaagcagatcaagtacgtgttttcggtgctatggcagataaaggatatatctatcgtggtgctaaaccagtgtattggtcatggtcatcagagtctgcccttgctgaggctgaaatcgaatatcatgatattgattcgacatcactctactatgccaataaagttaaagatggtaagggaattcttgatacagatacctatatcgtcgtttggacgacaacaccatttactgtaacagcttcacgcggtttaacagtaggaccagatatggagtatgttgtagttgtaccagtaggtagtgagcgtaaataccttcttgcagaggttcttgtagatagtctcgctgctaagtttggctgggaaaactttgaaattgtgactcatcacactggtaaagaacttaatcacattgttacagaacatccatgggatacagaagtagaagagttggttatccttggagaccatgttacaacagattctggtacaggtattgtccacacggctcctggttttggtgaagatgactataacgttggtattgctaatggacttgatgttgtagttaccgtagatagtcgtggtttgatgatggaaaatgctggtcctgattttgaaggtcaattctatgacaaagtaacaccacttgtaaaagaaaaattgggagatcttcttttagccagcgaagttatcaaccactcatatccatttgactggcgtacgaaaaagccaatcatttggcgtgcggttccacaatggtttgcctctgtttcgaaattccgtcaagaaatcctcgatgaaattgaaaagacaaatttccaacctgagtggggtaaaaaacgtctttataacatgatccgtgaccgtggcgactgggtaatctcacgtcaacgtgcttggggtgttccacttccaattttttatgcagaagatggtacagctatcatgacaaaagaagtgactgatcacgttgcagatttatttgctgaatacggctcaatcgtttggtggcaacgtgatgctaaggaccttctaccagcaggttatactcatccaggttcacctaatggtctctttgagaaagaaacagacatcatggatgtttggtttgattctggttcatcatggaatggggtaatgaatgctcgtgaaaacctttcctatccagcagatctttatcttgaaggttctgatcaataccgtggttggttcaactcatcactaattacatcagttgctgttaatggtcacgctccatacaaagcagtcttatctcaaggttttgtacttgatggtaaaggtgagaaaatgtctaaatctctaggaaatacaattcttcctagtgatgttgaaaaacaatttggtgcggaaatcttgcgtctgtgggtaacttctgttgactcaagtaatgatgttcgtatttcaatggatatcttaaaacaaacatcagaaacttatcgtaagatcaggaatacattgcgtttcttgattgcaaatacttccgattttaatcctaaacaagatgcagtagcctatgaaaatttaggtgccgttgatcgttatatgactattaaatttaatcaagttgtggatacaatcaacaaagcttatgctgcttatgattttatggcaatttataaagctgtcgttaacttcgtaacagttgatctatcagcattttaccttgattttgcaaaagatgtggtttacattgaagcggctaacagtccagaacgacgtcgtatgcaaactgttttctatgatattttagttaaacttacaaaacttttgactccgattctaccacatactgctgaagaaatttggtcatacctcgaacatgaggaggaggagtttgttcaattagcagaaatgcctgttgcacagacattctctggtcaagaagaaattcttgaagagtggtcagcattcatgacgttacgaacacaagctcaaaaagctctcgaagaagcacgtaacgctaaagttattggtaaatctctagaagcacatttaacaatttatgctagtcaagaagtgaaaacgttattaacagcgttaaatagcgatattgcactcttgatgattgtctcacaattaacaattgctgatgaagcagacaaaccagctgactcagtatcatttgaaggtgttgcatttactgttgaacacgctgaaggtgaagtctgcgaacgctcacgccgtattgatccaaccacaaagatgcgttcgtatggtgtagctgtttgtgatgctagtgcagcaattattgagcaatattatcctgaagcagtagctcaaggttttgaagct

SEQ ID NO: 244 - protein, 930 aa, Streptococcus agalactiae
MKLKETLNLGQTAFPMRAGLPNKEPQWQEAWDQADIYKKRQALNEGKPAFHLHDGPPYANGNIHVGHALNKISKDIIVRSKSMSGFRAPYVPGWDTHGLPIEQVLAKKGVKRKEMDLAEYLEMCRDYALSQVDKQRDDFKRLGVSADWENPYITLTPDYEADQVRVFGAMADKGYIYRGAKPVYWSWSSESALAEAEIEYHDIDSTSLYYANKVKDGKGILDTDTYIVVWTTTPFTVTASRGLTVGPDMEYVVVVPVGSERKYLLAEVLVDSLAAKFGWENFEIVTHHTGKELNHIVTEHPWDTEVEELVILGDHVTTDSGTGIVHTAPGFGEDDYNVGIANGLDVVVTVDSRGLMMENAGPDFEGQFYDKVTPLVKEKLGDLLLASEVINHSYPFDWRTKKPIIWRAVPQWFASVSKFRQEILDEIEKTNFQPEWGKKRLYNMIRDRGDWVISRQRAWGVPLPIFYAEDGTAIMTKEVTDHVADLFAEYGSIVWWQRDAKDLLPAGYTHPGSPNGLFEKETDIMDVWFDSGSSWNGVMNARENLSYPADLYLEGSDQYRGWFNSSLITSVAVNGHAPYKAVLSQGFVLDGKGEKMSKSLGNTILPSDVEKQFGAEILRLWVTSVDSSNDVRISMDILKQTSETYRKIRNTLRFLIANTSDFNPKQDAVAYENLGAVDRYMTIKFNQVVDTINKAYAAYDFMAIYKAVVNFVTVDLSAFYLDFAKDVVYIEAANSPERRRMQTVFYDILVKLTKLLTPILPHTAEEIWSYLEHEEEEFVQLAEMPVAQTFSGQEEILEEWSAFMTLRTQAQKALEEARNAKVIGKSLEAHLTIYASQEVKTLLTALNSDIALLMIVSQLTIADEADKPADSVSFEGVAFTVEHAEGEVCERSRRIDPTTKMRSYGVAVCDASAAIIEQYYPEAVAQGFEA

SEQ ID NO: 245 - DNA, 2799 bp, Streptococcus pyogenes
atgaaattaaaagagacacttaatctaggaaaaacagcctttccaatgcgcgcaggtcttcctaataaagagccacaatggcaagcagcttgggaacaagcagagctttacaaaaaacgtcaagaattgaatgcaggtaagcctgcctttcatcttcatgatggacctccatacgctaacggcaatattcacgttgggcatgcccttaataaaatttcaaaagatatcattgtgcgttctaagtccatgtctggctttcaagcgccttatgtacctggttgggacacacacggccttccaatcgaacaagtcttggctaagcaaggaatcaaacgtaaggagatggatttagcagaataccttgagatgtgtcgtcaatacgctttaagtcaggttgataaacagcgagatgatttcaaacggttaggtgtttcggcagactgggaaaatccttatgtcactttggacccacagtttgaagctgatcaaattcgtgtttttggagcgatggctgaaaaaggttacatctatcgtggtgctaaacctgtttattggtcatggtcttcagaatcggccttggcagaggctgaaattgaataccatgacatcgattcaacctctttatactacgccaataaagttaaagatggtaaaggtatccttgatactaatacgtatatcgttgtttggaccacaacaccatttaccgttacagcatcacgcggtttgactgttggtcctgatatggattatcttgtggtgaaacctgctggttcagaccgtcaatatgttgtggcagaaggtcttttggatagccttgctggaaaatttggctgggaatcttttgaaactttagctagccataaaggagctgatttagagtacattgtgacagaacacccatgggatactgacgtagaagaattggttatccttggtgaccatgttacccttgagtcagggacagggattgtccacacagcaccaggttttggtgaggatgactacaatgttgggacaaaatacaaactggaagttgctgtgactgttgatgaacgtggcctaatgatggaaaatgcaggtccagatttccacggacaattttataacaaggtaacgccgattgtcattgataaacttggtgatcttttattggcacaagaagtgatcaatcactcttacccatttgactggcggacgaaaaaaccaatcatctggcgtgctgtaccgcaatggtttgcttctgtttctgatttccgtcaagatattttggatgaaattgaaaaaacaacctttcatccatcatggggtgaaacacgcctttacaatatgattcgtgatcgtggcgactgggttatttctcgtcaacgtgcttggggagttccgcttcctatcttctatgccgaagatggcacagctattatgactaaagaagtgacagatcatgtggctgatttgttccaagaaaatggatcaatcatttggtggcaaaaagaagctaaagacctattaccagagggcttcactcatccagggtcaccaaatggcgagtttacaaaagaaactgatatcatggacgtttggtttgactctggttcttcttggaatggagtcatgaatactaaagaaaatctttcctatccagcggatctatacttagaaggctctgaccagtatcgtggttggttcaattcatccttaattacatctgtggctgttaatgggcatgctccatataaggctattttatcgcaaggctttgttcttgatggtaagggcgaaaaaatgtctaaatcaaaaggcaatatcatttctcctaatgatgtggctaaacaatatggtgcagatattcttcgactttgggtagcttctgtggataccgataatgatgtccgtgtttctatggagatccttggtcaagtctctgaaacttaccgtaaaatccgtaacacccttcgcttcttgattgctaatacatctgatttcaaccctgctacggatacagtagcttatgcagatttaggaactgttgataagtacatgacaattgtctttaatcagttggtagcaacgattactgacgcttatgagcgttatgactttatggctatttacaaagcagtggtgaactttgttacggttgatttatcagccttctatcttgattttgctaaagacgttgtctatattgaagctgccaatagcttagaacgtcgtcgcatgcagacagtcttctatgatatcttggttaagattaccaagttattgacgccaatcttgcctcacactactgaagaaatctggtcttatctagagcatgagtcagaagcatttgttcaattggcagaaatgcctgtggcagaaaccttctcggctcaagaggatattttagaagcttggtcagctttcatgactttgcgtactcaagctcaaaaagctttggaagaagcgcgaaatgctaagattatcggtaaatcattggaagcccatttgaccatctacgctagtgaagaagtgaaaaccttattgactgctttagacagcgatattgctttgcttttgatcgtgtctcaattaaccattgctgacttggcagatgcgcctgcggatgcagtggcatttgaaggtgttgcctttatagtagaacatgccataggtgaagtttgtgagcgttcacgtcgcatcgacccaactactcgcatgcgttcttacaatgcatttgtctgtgatcacagcgctaaaatcattgaagaaaatttcccagaagctgtggctgaagggtttgaagagagtggcaaa

SEQ ID NO: 246 - protein, 933 aa, Streptococcus pyogenes
MKLKETLNLGKTAFPMRAGLPNKEPQWQAAWEQAELYKKRQELNAGKPAFHLHDGPPYANGNIHVGHALNKISKDIIVRSKSMSGFQAPYVPGWDTHGLPIEQVLAKQGIKRKEMDLAEYLEMCRQYALSQVDKQRDDFKRLGVSADWENPYVTLDPQFEADQIRVFGAMAEKGYIYRGAKPVYWSWSSESALAEAEIEYHDIDSTSLYYANKVKDGKGILDTNTYIVVWTTTPFTVTASRGLTVGPDMDYLVVKPAGSDRQYVVAEGLLDSLAGKFGWESFETLASHKGADLEYIVTEHPWDTDVEELVILGDHVTLESGTGIVHTAPGFGEDDYNVGTKYKLEVAVTVDERGLMMENAGPDFHGQFYNKVTPIVIDKLGDLLLAQEVINHSYPFDWRTKKPIIWRAVPQWFASVSDFRQDILDEIEKTTFHPSWGETRLYNMIRDRGDWVISRQRAWGVPLPIFYAEDGTAIMTKEVTDHVADLFQENGSIIWWQKEAKDLLPEGFTHPGSPNGEFTKETDIMDVWFDSGSSWNGVMNTKENLSYPADLYLEGSDQYRGWFNSSLITSVAVNGHAPYKAILSQGFVLDGKGEKMSKSKGNIISPNDVAKQYGADILRLWVASVDTDNDVRVSMEILGQVSETYRKIRNTLRFLIANTSDFNPATDTVAYADLGTVDKYMTIVFNQLVATITDAYERYDFMAIYKAVVNFVTVDLSAFYLDFAKDVVYIEAANSLERRRMQTVFYDILVKITKLLTPILPHTTEEIWSYLEHESEAFVQLAEMPVAETFSAQEDILEAWSAFMTLRTQAQKALEEARNAKIIGKSLEAHLTIYASEEVKTLLTALDSDIALLLIVSQLTIADLADAPADAVAFEGVAFIVEHAIGEVCERSRRIDPTTRMRSYNAFVCDHSAKIIEENFPEAVAEGFEESGK

SEQ ID NO: 247 - DNA, 300 bp, Streptococcus agalactiae
atgagactaattaatacaaccagtagtcatcctgaactagttcgaaatcaactccaaaatacagatgcaaaattagtggaagtctattcagctggcaacaccgatgtcgtttttacaaaagcacctaaacattatgaattattaatttcaaacaaatatcgtgctatcaaagatgaagaattagaagctattcgtgagttcttcttaaagcgtaaaatagatcaatctattattattcaagagcagatgaaatcactccatactgccaagttaattgaaatttcatatccaacaacagca

SEQ ID NO: 248 - protein, 100 aa, Streptococcus agalactiae
MRLINTTSSHPELVRNQLQNTDAKLVEVYSAGNTDVVFTKAPKHYELLISNKYRAIKDEELEAIREFFLKRKIDQSIIIQEQMKSLHTAKLIEISYPTTA

SEQ ID NO: 249 - DNA, 300 bp, Streptococcus pyogenes
atgagactcatcaataccactagcagtcacccagaactcatcaaaaatcagctaaaaaacaccgatgcctatttagtcgaagtatactcagcaggaaatacagatgtcatttttacccaagcaccaaaacattacgaactacttatttcaaataaataccgtgccatcaaggaggatgaacttgatatcattcgcgaattttttttaaaacgtaaaattgatcctaaaattgttattcctggacaatcaaaaacacttcacacgaataaccttattgaaatttcatttcaaacttctgta

SEQ ID NO: 250 - protein, 100 aa, Streptococcus pyogenes
MRLINTTSSHPELIKNQLKNTDAYLVEVYSAGNTDVIFTQAPKHYELLISNKYRAIKEDELDIIREFFLKRKIDPKIVIPGQSKTLHTNNLIEISFQTSV

SEQ ID NO: 251 - DNA, 453 bp, Streptococcus agalactiae
atgactaatcctactttcggtgaaaaaatagataatgtaaactataggtcacgatttggtgtctatgctattattccaaatccaactcatgataaaattattttagtacaggcacctaatggtgcttggtttcttccaggtggggaaattgaagaaaatgaaaatcacctagaagctttaactcgtgagttaattgaagaattaggttattccgcaacaattggccattactatggtcaagctgatgaatatttttactctagacaccgtgatacttactactataatcccgcctatatttatgaagttactgcctatcataaggatcaagcgccactagaagatttcaaccatctagcctggtttcctatccaagaagctaaagaaaagctaaaacgaggaagccatagatggggtgtccaagcttgggaaaaaaatcaccattctaggaaa

SEQ ID NO: 252 - protein, 151 aa, Streptococcus agalactiae
MTNPTFGEKIDNVNYRSRFGVYAIIPNPTHDKIILVQAPNGAWFLPGGEIEENENHLEALTRELIEELGYSATIGHYYGQADEYFYSRHRDTYYYNPAYIYEVTAYHKDQAPLEDFNHLAWFPIQEAKEKLKRGSHRWGVQAWEKNHHSRK

SEQ ID NO: 253 - DNA, 453 bp, Streptococcus pyogenes
atgatgattccaacatttggacataaaaatgcacataaagactatgtcacacgttacggtgtctatgctatcattcccaatcacgaacaaacaaaaattattcttgttcaagctcctaatggttcctggtttttacctggtggtgaaattgaagcaggtgaaggtcagcttcaggccctagagcgtgaactgattgaagaacttggtttttctgctactattggttcatattacggtcaggcagatgaatatttctactctcgccatcgtgatacccacttctaccatcctgcctatctttatgaagtaactgcatttcaagccgtttctaagcccttagaagattttaataacttaggttggttttctcctatcgaggcaattgctaaattaaaacgagagagccatcaatggggagtcaaggaatggcaaaaaaagcatcattctactaac

SEQ ID NO: 254 - protein, 151 aa, Streptococcus pyogenes
MMIPTFGHKNAHKDYVTRYGVYAIIPNHEQTKIILVQAPNGSWFLPGGEIEAGEGQLQALERELIEELGFSATIGSYYGQADEYFYSRHRDTHFYHPAYLYEVTAFQAVSKPLEDFNNLGWFSPIEAIAKLKRESHQWGVKEWQKKHHSTN

SEQ ID NO: 255 - DNA, 2259 bp, Streptococcus agalactiae
atgctctgtcaaaactgcaaactaaacgaatcaactattcatttgtatacaaatgttaatggaaaacaaaagcaagttgatctttgtcaaaattgctaccaaattattaaaactgaccctaataatccacttttttcaggtttaaatcatgtttcacatgcgcctggtggcatcaatcctttctttgatgatttctttggagatttaaataatttcagagcctttaatggccaagatttaccaaacactcctcctacacaatcaggaggaaaccgaggtggaggaaacggtaatggacgaaataataatcgcaaccaaactgcaactccttctcaagccaaagggattctagaagaatttggtatcaatgtcactgaaatagcccgccatggtgatattgaccctgttattggacgtgactcagaaattattcgtgttatcgaaatccttaatcgtcgtacaaaaaataatcctgtacttattggcgaacccggcgttgggaaaactgccgttgttgaaggacttgctcagaaaattgttgatggtaatgtgcctcataaacttcaaggcaaacaagttattcgtttggatgttgtgagtctagtacaaggaacgggcattcgtggtcaatttgaagaacgcatgcaaaagttgatggaagaaattcgtcaacgtcaagatgttattctattcatagatgaaattcacgaaatagttggagctggtacagctggcgaaggtagtatggatgcaggtaatattttaaaacctgcccttgcacgtggagaattacaactagtaggtgctactactctcaatgaatatcgtattatcgaaaaggacgctgccttagaacgccgtatgcaacctgtaaaagtcgatgagccttctgttgaagaaaccattactattttgaaaggtatccaaaaaaaatacgaagattatcatcatgtaaaatataataatgatgccatagaagcagctgcagtactatctaatcgttatatccaggaccgctttttacctgataaagcaatagacttattagatgaagctggttctaaaatgaacctaacactaaattttgttgatccaaaagaaattgatcaacgtctcattgaagcagaaaatttaaaagcgcaagcgactcgtgaagaagattacgaacgtgcagcttacttccgtgaccagattgcaaaatataaagaaatgcaacaacaaaaggtcgacgatcaagatacacctattattaccgaaaaaacaattgagcacatcattgaagaaaaaacgaatatccctgttggtgatttaaaagaaaaagaacaatctcaattaattaatctcgcagatgacttgaaacaacatgtgatcggccaggatgacgctgtcgttaagattgcaaaagctattcgtcgtaatcgagttggtcttggtagcccaaaccgtcctattggttcctttttatttgtaggaccaaccggcgttggtaaaactgaactttctaaacaactagcaattgagctctttggttcagctgatagtatgattcgttttgatatgtcagagtacatggaaaagcatgctgttgctaaattagtcggagcgcctccaggatacgtgggatacgaggaagctggacaattaactgaaaaggttcgtcgaaatccttactcgctcatccttctagatgaaattgaaaaagctcatcctgatgtcatgcatatgttcttgcaggtccttgatgacggtcgattaacagatggacaaggaagaactgttagttttaaagataccattatcatcatgacctcaaatgctggttctggtaaaactgaagcaagcgttggctttggtgcctcacgagaaggtagaacgaattccgtactaggtcaactaggtaacttcttcagccctgaatttatgaaccgctttgacggtattattgaattcaaggctttagataaagagaatctcctcaatatcgttgatattatgttatctgacgttaatgcacgtctcgccatcaatggtattcatctagatgtcactgataaagtgaaagaaaaattggttgatttaggttacgatcccaaaatgggagcacgtccattacgtcgtaccattcaagaacatattgaagatgctatcacagattactatcttgagaatccaagcgaaaaagaacttcgtgctattatgactagcaatggaaatatcataataaaatcttctaaaaaaactgaagaaagtacaaaaggt

SEQ ID NO: 256 - protein, 753 aa, Streptococcus agalactiae
MLCQNCKLNESTIHLYTNVNGKQKQVDLCQNCYQIIKTDPNNPLFSGLNHVSHAPGGINPFFDDFFGDLNNFRAFNGQDLPNTPPTQSGGNRGGGNGNGRNNNRNQTATPSQAKGILEEFGINVTEIARHGDIDPVIGRDSEIIRVIEILNRRTKNNPVLIGEPGVGKTAVVEGLAQKIVDGNVPHKLQGKQVIRLDVVSLVQGTGIRGQFEERMQKLMEEIRQRQDVILFIDEIHEIVGAGTAGEGSMDAGNILKPALARGELQLVGATTLNEYRIIEKDAALERRMQPVKVDEPSVEETITILKGIQKKYEDYHHVKYNNDAIEAAAVLSNRYIQDRFLPDKAIDLLDEAGSKMNLTLNFVDPKEIDQRLIEAENLKAQATREEDYERAAYFRDQIAKYKEMQQQKVDDQDTPIITEKTIEHIIEEKTNIPVGDLKEKEQSQLINLADDLKQHVIGQDDAVVKIAKAIRRNRVGLGSPNRPIGSFLFVGPTGVGKTELSKQLAIELFGSADSMIRFDMSEYMEKHAVAKLVGAPPGYVGYEEAGQLTEKVRRNPYSLILLDEIEKAHPDVMHMFLQVLDDGRLTDGQGRTVSFKDTIIIMTSNAGSGKTEASVGFGASREGRTNSVLGQLGNFFSPEFMNRFDGIIEFKALDKENLLNIVDIMLSDVNARLAINGIHLDVTDKVKEKLVDLGYDPKMGARPLRRTIQEHIEDAITDYYLENPSEKELRAIMTSNGNIIIKSSKKTEESTKG

SEQ ID NO: 257 - DNA, 2280 bp, Streptococcus pyogenes
atgctgtgtcaaaattgtaatttaaacgaatctactattcatctttatacaagtgttaatggaaaacaaagacaggttgatctctgtcaaaattgttatcaaatcatgaaatccgatcctgccaattctattttaaatggcctaaccccaggatatagagcacaagatagatccacaagtcctttctttgatgacttttttggtgatttgaataattttagagcttttggtaatcttccaaataccccacctactcaggcagggcaaaatggaaatggcggaggacgctatggtggtaactacaacggacaacgacctgctcagccacaaacaccaaatcagcaagcaaagggcttgttagaagagtttgggattaatgtcacagatattgcaagaaatggtaatattgatcctgttattggtcgtgacgaagagattacacgcgttatcgagatcctcaaccgccgtactaaaaataatcctgtgctaattggtgagcctggagttggtaaaactgctgttgtagaaggtttggctcaaaaaattattgatggtactgttcctcaaaaactccaaggcaagcaagtgattcgtcttgatgtggttagcctcgttcagggaacaggtatccgtggtcagtttgaagagcgcatgcaaaaattaatggaagaaattcgcaatcgcaaggatgtgattctctttattgatgaaattcatgagattgtcggtgctggttctgcaggagacggcaatatggatgctggtaatattttaaaaccagccttggcccgtggtgagttgcaactcgttggtgctactacattaaatgaataccgtattattgaaaaagacgctgccttagaacgacgtatgcaacccgttaaagttgatgaaccttctgttgaggaaaccatcacgattttaaaaggtatccaaccgaaatacgaagactatcatcatgtcaaatatagcccagccgctattgaagctgccgctcatttatctaaccgctatattcaagaccgttttcttcctgataaggctattgaccttctggacgaagctggttccaaaatgaatctaaccctcaactttgttgatcctaaagaaattgacaaacgtcttattgaagctgagaatctcaaggcgcaagctactcgagacgaagactatgaacgcgcagcttatttccgcgatcaaattacaaaatacaaagaaatgcaggctcaaaaagtcgatgagcaagatattcccatcattactgaaaaaaccattgaagctattgtagagcaaaaaactaatattccagttggggacttaaaagaaaaggaacagtctcaactcgtaaacttagccaatgatctgaaagcacacgtgatcgggcaagacgatgctgttgataaaatcgctaaggctattcgtcgtaaccgtgtgggattaggaactccaaatcgccctattggttctttcttattcgttggaccgactggggttggtaaaactgaattgtctaaacaactagccattgaactctttggttcgacaaacaatatgattcgctttgacatgtccgaatacatggaaaaacacgctgtcgccaaattagtcggggctcctccaggttatatcggctatgaagaagctggacagctaaccgaacaagttcgtcgcaatccatattcacttattctcttagatgaggtggaaaaagcccatcctgacgtcatgcacatgttcttacaagttcttgatgatggccgtttaacagatggtcaaggacgaacagtcagcttcaaggacaccattattatcatgacctctaatgccggaacaggtaaaagcgaagcttctgtcggatttggtgctgctagagaaggacggacaagttctgtccttggtgaattaagcaacttcttcagcccagagtttatgaatcgtttcgatggtattattgaattcaaagctttatctaaagagcatttgctgcatatcgttgatttaatgctggaagatgttaatgagcgcttaggctataatgggattcatcttgatgtgacacaaaaggtcaaagaaaaattagtagatttaggctatgatcctaaaatgggcgctcggccgctccgtcgtactattcaagattatatcgaagatgccattacagactattatttagaacacccaactgaaaaacagttacgtgcactgatgacaaacagtgaaaatatcacgattaaagctgttaaagagggagattcttttcttaacgaagagtctctcgat

SEQ ID NO: 258 - protein, 760 aa, Streptococcus pyogenes
MLCQNCNLNESTIHLYTSVNGKQRQVDLCQNCYQIMKSDPANSILNGLTPGYRAQDRSTSPFFDDFFGDLNNFRAFGNLPNTPPTQAGQNGNGGGRYGGNYNGQRPAQPQTPNQQAKGLLEEFGINVTDIARNGNIDPVIGRDEEITRVIEILNRRTKNNPVLIGEPGVGKTAVVEGLAQKIIDGTVPQKLQGKQVIRLDVVSLVQGTGIRGQFEERMQKLMEEIRNRKDVILFIDEIHEIVGAGSAGDGNMDAGNILKPALARGELQLVGATTLNEYRIIEKDAALERRMQPVKVDEPSVEETITILKGIQPKYEDYHHVKYSPAAIEAAAHLSNRYIQDRFLPDKAIDLLDEAGSKMNLTLNFVDPKEIDKRLIEAENLKAQATRDEDYERAAYFRDQITKYKEMQAQKVDEQDIPIITEKTIEAIVEQKTNIPVGDLKEKEQSQLVNLANDLKAHVIGQDDAVDKIAKAIRRNRVGLGTPNRPIGSFLFVGPTGVGKTELSKQLAIELFGSTNNMIRFDMSEYMEKHAVAKLVGAPPGYIGYEEAGQLTEQVRRNPYSLILLDEVEKAHPDVMHMFLQVLDDGRLTDGQGRTVSFKDTIIIMTSNAGTGKSEASVGFGAAREGRTSSVLGELSNFFSPEFMNRFDGIIEFKALSKEHLLHIVDLMLEDVNERLGYNGIHLDVTQKVKEKLVDLGYDPKMGARPLRRTIQDYIEDAITDYYLEHPTEKQLRALMTNSENITIKAVKEGDSFLNEESLD

SEQ ID NO: 259 - DNA, 696 bp, Streptococcus agalactiae
atgtcaatgaatttttcatttttaccacaatattggtcctattttaattatggtgtgatggtaaccattatgatttcaacatgtgttgttttttttggaactattataggtgtgttaattgctttagtaaagcgtactaatttacattttctcacaatattagctaatttctatgtatgggtatttcgtgggacaccgatggtagttcaaattatgattgctttcgcatggatgcattttaacaatttaccaacgattagctttggtgttttagatttagattttacacgacttttacctggtatcattatcatttccttaaatagtggtgcctatatttcggaaattgtacgtgcagggattgaggctgtaccatctggacaaatagaagcagcttactcgttggggattcgacctaaaaatacacttcgctatgttatcttaccccaagcttttaaaaatattttacctgctctagggaatgaatttattacaattattaaagatagtgctctccttcaaactattggtgtcatggaattatggaacggagcacaatcagttgtaacggctacttactcaccagttgcaccgttattatttgcagcattttactatttaatgttgacaacgattctctcagctttgttaaaacaaatggagaaatatcttgggaaaggggtaaaaatagatggt

SEQ ID NO: 260 - protein, 232 aa, Streptococcus agalactiae
MSMNFSFLPQYWSYFNYGVMVTIMISTCVVFFGTIIGVLIALVKRTNLHFLTILANFYVWVFRGTPMVVQIMIAFAWMHFNNLPTISFGVLDLDFTRLLPGIIIISLNSGAYISEIVRAGIEAVPSGQIEAAYSLGIRPKNTLRYVILPQAFKNILPALGNEFITIIKDSALLQTIGVMELWNGAQSVVTATYSPVAPLLFAAFYYLMLTTILSALLKQMEKYLGKGVKIDG

SEQ ID NO: 261 - DNA, 684 bp, Streptococcus pyogenes
atggatttgtcatttttgcccaaatactgggcctactttaactacggtgtacttgtcaccattatgatttcagtcagcgttgtcttttttggaacccttattggtgtcttggtaaccctgattaagcgtagtcatgtgaagccgttgacctgggtcgttaatctttacgtttggatctttcggggaacacctatggtggttcaaatcatgattgcctttgcttggatgcattttaacaatatgcctactattggttttggggttttagacttggacttttcaagactacttcctggaattattatcatttcattgaatagcggtgcttatatttcagaaattgttagagcaggtattgaggctgtaccaaaagggcaattagaagcagcttattcactaggtattcgtcctcaaaatgccatgcgttatgtgattttgcctcaggcctttaaaaatattttgccagccttaggaaatgaatttattaccattattaaggatagtgctcttttacaaaccattggagtgatggaactttggaatggtgcccaatcggtggtaacggctacttattctccaatttcccctttactggtggctgctttttactacttaatggtcacaacagtgatggcacagttattggcagtcttagaacgtcacatggcgcaaggaggtaatcat

SEQ ID NO: 262 - protein, 228 aa, Streptococcus pyogenes
MDLSFLPKYWAYFNYGVLVTIMISVSVVFFGTLIGVLVTLIKRSHVKPLTWVVNLYVWIFRGTPMVVQIMIAFAWMHFNNMPTIGFGVLDLDFSRLLPGIIIISLNSGAYISEIVRAGIEAVPKGQLEAAYSLGIRPQNAMRYVILPQAFKNILPALGNEFITIIKDSALLQTIGVMELWNGAQSVVTATYSPISPLLVAAFYYLMVTTVMAQLLAVLERHMAQGGNH

SEQ ID NO: 263 - DNA, 1701 bp, Streptococcus agalactiae
atgtctcatatgaattataaagagatttatcaagagtggttagaaaacgactcactcggtaaagatattaagtcagatttagaagctattaaaggcgatgaatctgaaattcaggatcgtttttacaaaacattagaatttggaacggcgggattgagaggtaaacttggagcaggaaccaatcgtatgaatacttatatggtggggaaagcagcacaagcattagctaatacgattattgatcatggccctgaagctattgcacgtggaattgcagttagttatgatgtccgttatcaatctaaggaatttgcagaattaacttgttccattatggcagcaaatggtattaagtcttatatttataaagggattcgcccaacaccaatgtgctcatatgctattcgtgctctaggatgtgtttcgggtgtgatgattactgctagtcataatcctcaagcttataatggttataaggcatattggaaagaaggatctcagattttagatgatattgctgatcaaattgccaatcatatggatgctataaccgattatcagcaaattaagcaaataccctttgaagaggctctggcaagtggttcggcaagttatatcgatgagagtattgaagaagcatataaaaaagaagtgcttggtttaactattaatgatactaatattgataagtcagtccgggtagtttatactcctttaaatggcgtaggaaatttacctgtgcgcgaagttttaagacgccgtggttttgaaaatgtttatgtggtacctgagcaggaaatgcccgatcctgattttacaacggttggctatccaaaccctgaagttcctaaagcatttgcctattcagaatctctaggaaagtcagttgatgcagatatcttacttgccacagatccagattgtgaccgagtagcattggaagtcaaagatagtaagggagaatatattttcttaaatggtaataagataggggcacttctttcctattatattttttcacaacgatgtgccttagggaatttgccacatcatcctgtattggtaaaatccattgtaactggtgatctatcaaaagttattgcagataaatataatattgaaactgttgaaactttaacaggatttaaaaatatttgtggaaaagctaatgaatatgatatctcaaaggataaaacttatctctttggctatgaagaaagtattggtttttgctatggcacttttgtacgtgataaagatgctgtgagtgcttcaatgatggtagtagaaatgactgcctattataaagaacgagggcaaacacttttagacgttttgcaaaccatttacgataaatttggctattacaacgagcgccaattttctcttgagttagagggtgctgaggggcaagaacgtattagtcgtattatggaggattttagacaggacccaatattacaagtaggtgagatgacattggagaattctattgatttcaaggatggttataaggattttccaaagcaaaattgtttaaaatattattttaatgagggttcatggtatgctttaaggccgtcagggacggaacctaagataaaatgttacctttatacgattggttgtacagaagcagatagtttatcgaaacttaatgcaattgagtcggcttgtcgtgctaaaatgaatagtactaaa

SEQ ID NO: 264 - protein, 567 aa, Streptococcus agalactiae
MSHMNYKEIYQEWLENDSLGKDIKSDLEAIKGDESEIQDRFYKTLEFGTAGLRGKLGAGTNRMNTYMVGKAAQALANTIIDHGPEAIARGIAVSYDVRYQSKEFAELTCSIMAANGIKSYIYKGIRPTPMCSYAIRALGCVSGVMITASHNPQAYNGYKAYWKEGSQILDDIADQIANHMDAITDYQQIKQIPFEEALASGSASYIDESIEEAYKKEVLGLTINDTNIDKSVRVVYTPLNGVGNLPVREVLRRRGFENVYVVPEQEMPDPDFTTVGYPNPEVPKAFAYSESLGKSVDADILLATDPDCDRVALEVKDSKGEYIFLNGNKIGALLSYYIFSQRCALGNLPHHPVLVKSIVTGDLSKVIADKYNIETVETLTGFKNICGKANEYDISKDKTYLFGYEESIGFCYGTFVRDKDAVSASMMVVEMTAYYKERGQTLLDVLQTIYDKFGYYNERQFSLELEGAEGQERISRIMEDFRQDPILQVGEMTLENSIDFKDGYKDFPKQNCLKYYFNEGSWYALRPSGTEPKIKCYLYTIGCTEADSLSKLNAIESACRAKMNSTK

SEQ ID NO: 265 - DNA, 1701 bp, Streptococcus pyogenes
atgagtaatatgacttacaacgaggtatatcaagaatggttgcacaataatgatcttagtgatgatattaaagcagatttagcagccataaaagacaatgaggctgagattcaagatcgtttttacaaaacacttgaatttggaacagcagggctaagaggaaaacttggagcaggcaccaatcgcatgaatacctatatggttggtaaggcagcacaagctttagctaatactattattgatcatggacctgaagcggttaaaaagggcattgcggttagttatgatgttcgctatcaatctagaacatttgcagaattaacatgctctattatggcagctaacggtattaaggcgtacctttataaagggattcggccaacaccaatgtgttcgtacgctattcgtgctttgggatgtatttctggtgttatgattacggctagtcacaatccccaagcttacaatggttacaaagcttattggcaagaaggttctcaaattttggatgacattgcggatcaaattgcacaacacatggctgcactaactcagtatcaggaaatcaaacaaatgccttttgaaaaggctctggacagtggacttgttacttatattgatgagagtattgaagaagcatataaaaaagaagtgcttggtttaacgattaatgatactgacattgataagtcagtccgagtagtctatacccctttaaatggtgttgggaatctaccagtgcgtgaggttttaagacgccgcggttttgaaaatgtttatgtggtacctgagcaggaaatgcccgatcctgattttacaacagttggctatcctaatcccgaagtccctaaaacttttgcatattcagaaaaattaggtaaggcagttgatgctgatattttgattgcaactgatccagattgtgaccgtgtggctttagaagttaaaaatgcagtcggtgactatgtttttctcaatggcaataaaatcggagcgcttttatcttactatatcttttcacaacgatttgacttaggcaatttaccggctaatcctgttttagtgaaatccattgtaacaggagacttgtcacgggctattgctagccattatggtattgaaaccgttgaaacattgactggttttaagaatatttgtggcaaggcaaacgaatatgatgtgacgaaacaaaaaaactacctgtttggttatgaagaaagtattggtttttgctatggcacttttgttcgtgacaaagacgctgttagcgcctctatgatgattgtagaaatggcagcttactacaagaaaaaagggcagaatttactagatgttttgcagactatttatgcgacatttgggtattataatgaacgtcaaattgccttggagcttgaggggatagaaggacaaaaacgcattgcgaggataatggaagatttcagacagacaccaatagctagtgttgcagagatggcgttagacaagacaattgattttattgatggctatcaagattttccaaagcaaaactgtctcaaattttatttggatgatggttcttggtatgcacttagaccatcaggaacagagcctaaaataaaattttatttatatactattggccaaacacaagaaaatagtgcaacaaaattagatgctattgaagcagcgtgtcgcacaaaaataaatcaggttaat

SEQ ID NO: 266 - protein, 567 aa, Streptococcus pyogenes
MSNMTYNEVYQEWLHNNDLSDDIKADLAAIKDNEAEIQDRFYKTLEFGTAGLRGKLGAGTNRMNTYMVGKAAQALANTIIDHGPEAVKKGIAVSYDVRYQSRTFAELTCSIMAANGIKAYLYKGIRPTPMCSYAIRALGCISGVMITASHNPQAYNGYKAYWQEGSQILDDIADQIAQHMAALTQYQEIKQMPFEKALDSGLVTYIDESIEEAYKKEVLGLTINDTDIDKSVRVVYTPLNGVGNLPVREVLRRRGFENVYVVPEQEMPDPDFTTVGYPNPEVPKTFAYSEKLGKAVDADILIATDPDCDRVALEVKNAVGDYVFLNGNKIGALLSYYIFSQRFDLGNLPANPVLVKSIVTGDLSRAIASHYGIETVETLTGFKNICGKANEYDVTKQKNYLFGYEESIGFCYGTFVRDKDAVSASMMIVEMAAYYKKKGQNLLDVLQTIYATFGYYNERQIALELEGIEGQKRIARIMEDFRQTPIASVAEMALDKTIDFIDGYQDFPKQNCLKFYLDDGSWYALRPSGTEPKIKFYLYTIGQTQENSATKLDAIEAACRTKINQVN

SEQ ID NO: 267 - DNA, 852 bp, Streptococcus agalactiae
atgactgaattaatagatggtaaagccttatcacaaaaaatgcaggctgagttagggcgaaaagttgaaaggttaaaggaacagcatggtatcatacctggtttagctgtaatccttgttggggataatccagctagccaagtgtacgttcgaaataaagaacgctctgcattagaagctggttttaaaagtgagactctacgattatctgaatccatttctcaagaagaactgattgatattatccatcaatacaatgaagataaaagtatccatggtattttagttcaacttccgttaccacaacatattaacgataaaaaaattattttagcaatagatcctaagaaagatgttgatggtttccacccaatgaatacgggtcatctttggtcaggacgaccgatgatggtaccttgtacgccagctggtattatggagatgtttagagagtaccatgtggatttagagggaaaacatgctgttatcatcggaaggtccaatattgttggtaagccaatggcacaacttctccttgataaaaacgcaacagttactttgacacattcaagaactcgaaacctttctgaggtaacaaaggaggctgatatccttattgttgcgattggtcaggggcactttgttacaaaagacttcgttaaagaaggtgctgtggtgattgatgttggtatgaatcgcgatgaaaatggtaaattgattggagacgttgtatttgaacaagtggcagaagttgctagtatgataacacctgttcctgggggcgtaggacctatgacgattacaatgcttttggaacaaacttatcaagcagctcttagaagtgtgagtcta

SEQ ID NO: 268 - protein, 284 aa, Streptococcus agalactiae
MTELIDGKALSQKMQAELGRKVERLKEQHGIIPGLAVILVGDNPASQVYVRNKERSALEAGFKSETLRLSESISQEELIDIIHQYNEDKSIHGILVQLPLPQHINDKKIILAIDPKKDVDGFHPMNTGHLWSGRPMMVPCTPAGIMEMFREYHVDLEGKHAVIIGRSNIVGKPMAQLLLDKNATVTLTHSRTRNLSEVTKEADILIVAIGQGHFVTKDFVKEGAVVIDVGMNRDENGKLIGDVVFEQVAEVASMITPVPGGVGPMTITMLLEQTYQAALRSVSL

SEQ ID NO: 269 - DNA, 858 bp, Streptococcus pyogenes
atgtcaatgacagaactaattgatggtaaagccttagctcaaaagatgcaacaagagttagcagctaaagtcaacaatctaaaacaaaaaaaaggaattgtaccaggcttagccgttattcttgtaggtgatgatcctgctagtcaggtgtatgtccgtaataaagagcgtgcagctcttactgtaggttttaaaagtgagaccgttagattatcagaattcatttgtcaagaagagcttattgcagtaatcgaacgttacaatgcagataacactattcatggtattttagtgcagctacccctgccaaatcatattaatgataaaaaaattattctcgccattgatcccaaaaaagatgtggatggttttcacccgatgaatacaggtcacctttggtcaggacgtcccttgatggttccttgtactccatcagggattatggaattgcttcgagaatataatgttaaccttgaaggtaaacatgccgtcattattggcagatcgaatatcgttggaaaaccaatggcacagctcttactggacaaaaatgcaacagtcacgttgacacattcaagaacacgtcaattagaagaagtatgtcgctgtgcagatgtgttgattgtggcaatcggacaaggtcatttcataacaaaacaatatataaaagatggtgcgatagtgattgatgtaggaatgaaccgtgatgataatggcaagctaattggagatgtggcctttgatgaggtggcagaagttgcagcgaaaatcacccctgtaccaggaggtgtcggtcctatgacgattgctatgttgctagagcaaacttatcaatctgctctccgtagtactcataaa

SEQ ID NO: 270 - protein, 286 aa, Streptococcus pyogenes
MSMTELIDGKALAQKMQQELAAKVNNLKQKKGIVPGLAVILVGDDPASQVYVRNKERAALTVGFKSETVRLSEFICQEELIAVIERYNADNTIHGILVQLPLPNHINDKKIILAIDPKKDVDGFHPMNTGHLWSGRPLMVPCTPSGIMELLREYNVNLEGKHAVIIGRSNIVGKPMAQLLLDKNATVTLTHSRTRQLEEVCRCADVLIVAIGQGHFITKQYIKDGAIVIDVGMNRDDNGKLIGDVAFDEVAEVAAKITPVPGGVGPMTIAMLLEQTYQSALRSTHK

SEQ ID NO: 271 - DNA, 834 bp, Streptococcus agalactiae
atgattgttggtgaacaagaagcgagggcgttaattaagccacgccctaaatcaagccataaaggtgattatggtagtgttcttctgataggaggtttttatccctatggaggtgctattataatggcagctttggcctgtgtcaaaactggtgcaggattagttactgtagcaacccaaagttgcaatatcccctctttgcatagtcaactaccagaggtaatggcgtttgatagtgatgattacaaatggttggaaaaatcaattgttcaaagtgatgttattgtaattggtcctggattaggagtatcagaatcatctcgaaaaattttgaaccagaccatggagaagattcaatcacatcaaagtgtcatccttgacggatcagccttgactctgttatcagaaggtgcgtttccgcaaacaaaggctaaaaatttagtgttgacacctcatcaaaaagaatgggagcgattgtcaggtatcgctgtatcgcaacagacaaaagaaaatacccaaaccgctcttaaatcttttcccaaagggacgattttagtcgctaagagttcgcatacgcgtatttttcaagatttagacgaaaaagaaattatagtaggaggtccttaccaggcgactggagggatgggggatactttgtgtggtatgattgcaggtatgttagcgcaatttaaagaagcctctcctctagataaggtatcagtgggagtttatctacattcggcaattgctcaaggattatctaaagaagcctatgttgttctaccgacaacgattagtgatgagattccaaaagaaatggctagactatctaaa

SEQ ID NO: 272 - protein, 278 aa, Streptococcus agalactiae
MIVGEQEARALIKPRPKSSHKGDYGSVLLIGGFYPYGGAIIMAALACVKTGAGLVTVATQSCNIPSLHSQLPEVMAFDSDDYKWLEKSIVQSDVIVIGPGLGVSESSRKILNQTMEKIQSHQSVILDGSALTLLSEGAFPQTKAKNLVLTPHQKEWERLSGIAVSQQTKENTQTALKSFPKGTILVAKSSHTRIFQDLDEKEIIVGGPYQATGGMGDTLCGMIAGMLAQFKEASPLDKVSVGVYLHSAIAQGLSKEAYVVLPTTISDEIPKEMARLSK

SEQ ID NO: 273 - DNA, 1338 bp, Streptococcus agalactiae
atgtcagactatttatccgtgtcgacactgactaagtatttaaaattaaaatttgacaaagacccttatttagagagggtttatttaactgggcaagtgtctaattttcgtcgtcgcccaaaccatcaatatttctctttaaaagatgataaatcagtcattcaggcgacaatgtggtcaggtcacttcaaaaaattgggttttgaattagaggaagggatgaaggttaatgtagttggccgtgttcaactttatgaaccaagcggctcctactctattattgttgaaaaagcagaaccggatggtataggagctcttgctatccaatttgaacaactaaagaagaaactctctcaagcaggttattttgatgatcgtcataagcaattaattcctcaatttgttagaaaaataggagttgtgactagtccaagtggagccgttattcgggatattattacaacagtatctcgtcgatttccaggagtggaaatattacttttccccacaaaagttcaaggagagggcgcagctcaggaaatagcacaaactattgctttagctaacgagaaaaaggatttggatctattaattgttggccgtgggggaggttctattgaggacttatgggcatttaatgaagaatgtgttgtagaagctatttttgaatctcgtcttcccgttatttctagtgtcggacatgaaactgatacaactttagcagattttgtagccgatcgcagagcagcaactccaactgcagcagctgagcttgctacaccggttactaaaattgatatcttgtcttggattactgaacgtgaaaatagaatgtatcagtctagccttcgtcttatcaggacaaaagaggagaggttgcaaaaatcaaagcaatcagttatttttaggcaaccagagcgtctatatgatggtttccttcaaaaattagataacctaaatcagcagttaacatattctatgcgtgataaactacaaacagtaagacaaaagcaaggtttgcttcatcaaaaactgcaaggcatagatttaaaacagcgtattcatatttaccaagagcgtgttgtgcaaagtagacgactattatcaagtacaatgactagtcagtatgacagcaagctagcacgttttgaaaaggctcaagatgcgcttatatcattggatagttctagaattgtagcgcgtggttacgctattatcgaaaaaaaccatactttagtatctactactaatggaataaatgaaggagatcatttgcaagttaagatgcaagatggtcttttagaagttgaggtgaaggatgtcagacaagaaaacatt

SEQ ID NO: 274 - protein, 446 aa, Streptococcus agalactiae
MSDYLSVSTLTKYLKLKFDKDPYLERVYLTGQVSNFRRRPNHQYFSLKDDKSVIQATMWSGHFKKLGFELEEGMKVNVVGRVQLYEPSGSYSIIVEKAEPDGIGALAIQFEQLKKKLSQAGYFDDRHKQLIPQFVRKIGVVTSPSGAVIRDIITTVSRRFPGVEILLFPTKVQGEGAAQEIAQTIALANEKKDLDLLIVGRGGGSIEDLWAFNEECVVEAIFESRLPVISSVGHETDTTLADFVADRRAATPTAAAELATPVTKIDILSWITERENRMYQSSLRLIRTKEERLQKSKQSVIFRQPERLYDGFLQKLDNLNQQLTYSMRDKLQTVRQKQGLLHQKLQGIDLKQRIHIYQERVVQSRRLLSSTMTSQYDSKLARFEKAQDALISLDSSRIVARGYAIIEKNHTLVSTTNGINEGDHLQVKMQDGLLEVEVKDVRQENI

SEQ ID NO: 275 - DNA, 1353 bp, Streptococcus pyogenes
gtgaaaggtggcttgatggcagattatttaaccgtcactcatttgacgaaatatttaaaattaaaatttgaccgtgacccttatttggaacgggtttatctgactggtcaagtgtccaattttcgaaaacgaccaactcatcaatatttttccttaaaagatgaaagtgctgtgattcaagccaccatgtgggcaggagtctataaaaaactaggattcgacctagaagaaggcatgaaaattaatgtaattgggcgagtccaactttatgaacctagtggctcttactctatcgtgattgaaaaggcagagccagatggtataggtgccttggctttgcagtttgaacaattaaagaaaaaattaacggcagaaggttattttgagcaaaaacacaagcagcccttgccacagtttgtatcaaaaattggggtcattacaagtcctagtggtgctgtgattcgagatattatcacaaccgtttcacggcgttttccaggggttgagattttattattcccaactaaagtacaaggtgatggagccgcccaagaagtagtggctaatattcgaagagccaatcaaagagaggatttggacttgctcattgtcggccgtggaggtggctcgatagaagacctttgggccttcaacgaggaaatagtggttcaggctatctttgaatcgcaacttccagtgatttcgagtgtgggtcatgaaacagacacgactttagcggattttgtggcagatcgcagagcagccacaccaacagcagcagcagagttagcaacgcctattacaaaaacagatcttatgtcttggatagtagagcggcaaaatcgttcctatcaggcctgcttgaggcggattaagcaacggcaagagtgggtggataaactctcgcaatctgttatttttaggcaaccagaacgattatatgatgcctacctgcaaaaaattgatcgccttagcatgaccctgatgaatacgatgaaagatcgtctgagttccgccaaagaaaacaaggttcagttggaccatgccttggccaatagtcaattacagacaaaaatcgagcgataccaagaccgtgttgctaccgctaagcgtttactgatggctaatatggctagtcaatatgatagtcagctggctcgctttgaaaaagcacaggatgctttgctatcactggatgccagccgaattatcgcccgtggttatgcaatgattgaaaaaaatcaagcactggtagcctctgtaagtcagataacaaagggtgatcagttaaccattaagatgcgtgatggacaattagatgtagaggtaaaagatgtcaaaaacgaaaacatt

SEQ ID NO: 276 - protein, 451 aa, Streptococcus pyogenes
VKGGLMADYLTVTHLTKYLKLKFDRDPYLERVYLTGQVSNFRKRPTHQYFSLKDESAVIQATMWAGVYKKLGFDLEEGMKINVIGRVQLYEPSGSYSIVIEKAEPDGIGALALQFEQLKKKLTAEGYFEQKHKQPLPQFVSKIGVITSPSGAVIRDIITTVSRRFPGVEILLFPTKVQGDGAAQEVVANIRRANQREDLDLLIVGRGGGSIEDLWAFNEEIVVQAIFESQLPVISSVGHETDTTLADFVADRRAATPTAAAELATPITKTDLMSWIVERQNRSYQACLRRIKQRQEWVDKLSQSVIFRQPERLYDAYLQKIDRLSMTLMNTMKDRLSSAKENKVQLDHALANSQLQTKIERYQDRVATAKRLLMANMASQYDSQLARFEKAQDALLSLDASRIIARGYAMIEKNQALVASVSQITKGDQLTIKMRDGQLDVEVKDVKNENI

SEQ ID NO: 277 - DNA, 213 bp, Streptococcus agalactiae
atgtcagacaagaaaacatttgaagaaaatttacaggaattagagacaattgtctcacgtttagaaacaggtgatgttgccttagaagatgccattgctgaatttcaaaaaggaatgcttatttcaaaagagttacaaagaactttaaaagaagctgaagagacgcttgtaaaagtgatgcaagctgacggaacggaagtagaaatggatact

SEQ ID NO: 278 - protein, 71 aa, Streptococcus agalactiae
MSDKKTFEENLQELETIVSRLETGDVALEDAIAEFQKGMLISKELQRTLKEAEETLVKVMQADGTEVEMDT

SEQ ID NO: 279 - DNA, 213 bp, Streptococcus pyogenes
atgtcaaaaacgaaaacatttgaagaaaatttacaagatttagagactattgtgaacaaacttgaaaatggggatgtccctttggaagaagctatttcagaatttcaaaaaggaatgcttctctcaaaagaacttcaaaagaccttacaagcggcagaaaaaacactcgtcaaagtgatgcaagctgatggcacagaagtagatatggatgat

SEQ ID NO: 280 - protein, 71 aa, Streptococcus pyogenes
MSKTKTFEENLQDLETIVNKLENGDVPLEEAISEFQKGMLLSKELQKTLQAAEKTLVKVMQADGTEVDMDD

SEQ ID NO: 281 - DNA, 873 bp, Streptococcus agalactiae
ttgatggttactattgaaaaaattgatgaagctattcatcgttattacaaacagacacatagtgtcgtttctcctgatttgattaaggctatcctctactcagttgatggaggtgggaaacgtattcgtccacgcatccttttagaaattttagagggatttggagttgaactaatagatggtcattatgatgtggctgctgctttggagatgattcacaccggctcattaatccatgatgatttaccggcgatggataatgatgattttcgtcgtggccgcttaacaaaccataaaaagtttgatgaagctacagcggttttagctggagattccctttttttagacccatttgatttagttgtaaaagctggttttaaagctgatgttactgttaggttaatagagttattgtctatgtctgcgggtagttttggcatggttggtggacaaatgttagatatgaagggagaaaacaaagttttatctattgacgatttaagcttgattcatattaataaaacgggacgcctgttagcttatccctttgttgcagcaggtattttagctgagaagtcggaagaagtaaaaggaaaactgcatcaagctggccttttaatcggtcatgcttttcaagtacgtgatgatattttagatgtgactgctagttttgaagaattggggaagacaccaaataaagacattgtagcagaaaagacaacttatccaaatttattgggtttggataagtcacaggaaatacttgatgatactttgaaaaaagctcaggcaatttttcaaaatctagagaaaaaagctaactttaatgctagaaaaataatagatataatagagggattacggttgaatggc

SEQ ID NO: 282 - protein, 291 aa, Streptococcus agalactiae
MMVTIEKIDEAIHRYYKQTHSVVSPDLIKAILYSVDGGGKRIRPRILLEILEGFGVELIDGHYDVAAALEMIHTGSLIHDDLPAMDNDDFRRGRLTNHKKFDEATAVLAGDSLFLDPFDLVVKAGFKADVTVRLIELLSMSAGSFGMVGGQMLDMKGENKVLSIDDLSLIHINKTGRLLAYPFVAAGILAEKSEEVKGKLHQAGLLIGHAFQVRDDILDVTASFEELGKTPNKDIVAEKTTYPNLLGLDKSQEILDDTLKKAQAIFQNLEKKANFNARKIIDIIEGLRLNG

SEQ ID NO: 283 - DNA, 870 bp, Streptococcus pyogenes
atggacaaattagctagaattgacgaagccattcgtcgctactataagacgactagtaacggtgtatctgaagagttgattgatgctatcttgtattctgttgacagtggtggcaagcgcattcgcccacttatcttattagagatgattgagggatttggggtatcgttacagaatgctcattttgatttggctgcagctcttgaaatgattcatacaggaagtctgattcacgatgatttgccagccatggataatgatgattaccgacgtggcagactgaccaatcacaaacaatttggagaagccacggccattttggcgggagacagcttatttttagacccctttgggttaatagctcaagctgaattaaatagtgaggttaaagtagccttaatccaagaactttccctagcttcaggaacttttggcatggttggtggtcagatgttagatatgaaaggggaaaatcaagcattaagtcttcctcagttgtcactgattcacctcaataaaaccggaaaattattagcttttccttttaaagcagcagctcttataacagaacaggctatgactgttcgtcaacaactagagcaagcgggaatgctcatcgggcacgcctttcagattagggatgatattttagacgtgacagctagctttgaagatcttggaaaaacgcctaaaaaggacttattcgcagaaaaagctacttatccaagtttactggggttagaagcctcttaccaactgctgacagagagtttagatcaggctttgacgatttttcagacactagaaagcgatgtaggctttaagcctcaaataattacaaaactgatagaagggttacgacttaatgcc

SEQ ID NO: 284 - protein, 290 aa, Streptococcus pyogenes
MDKLARIDEAIRRYYKTTSNGVSEELIDAILYSVDSGGKRIRPLILLEMIEGFGVSLQNAHFDLAAALEMIHTGSLIHDDLPAMDNDDYRRGRLTNHKQFGEATAILAGDSLFLDPFGLIAQAELNSEVKVALIQELSLASGTFGMVGGQMLDMKGENQALSLPQLSLIHLNKTGKLLAFPFKAAALITEQAMTVRQQLEQAGMLIGHAFQIRDDILDVTASFEDLGKTPKKDLFAEKATYPSLLGLEASYQLLTESLDQALTIFQTLESDVGFKPQIITKLIEGLRLNA

SEQ ID NO: 285 - DNA, 825 bp, Streptococcus agalactiae
atggctaaagagagggtagatgttcttgcctataaacagggactttttgatacacgagagcaagcgaaacgtggtgttatggcaggaatggtgattaacgttatcaatggagaacgttatgataaaccaggtgaaaaggttgcagacgatactgaattaaaactaaaaggtgaaaaactaaaatatgttagtagaggtggattgaaattagaaaaagctttacaagtttttgaaatttcagttgcagataagctaactatagatattggcgcctctacgggtggttttactgatgttatgctacaatcaggagcgcgtttagtttacgcagtagatgtaggaacaaatcaattagtttggaagttacgtcaggatcatcgtgttcgttctatggaacaatataattttaggtatgcccaaaaagaagatttcaaggagggactgcctgaatttgcatcgatagatgtctcatttatctctcttaatttgattttaccagctctaaaagaaattttagtggatggtggacaagtagtggcattaattaaaccacaatttgaagcaggtcgtgagcaaattggtaaaaatggtattgtcaaagacaagttggttcatgaaaaggttttgacaacagtgaccaatttcacgaaagattatggatatacggttaaacatcttgatttttcgcccattcaaggtggacatggaaatattgagtttttaatgcatttgcaaaagtgtcaagatccacaaaatcttgtgcttgaccaaatacaagatgttatagaaaaagcacataaggaatttaagaaaaatgaagaagag

SEQ ID NO: 286 - protein, 275 aa, Streptococcus agalactiae
MAKERVDVLAYKQGLFDTREQAKRGVMAGMVINVINGERYDKPGEKVADDTELKLKGEKLKYVSRGGLKLEKALQVFEISVADKLTIDIGASTGGFTDVMLQSGARLVYAVDVGTNQLVWKLRQDHRVRSMEQYNFRYAQKEDFKEGLPEFASIDVSFISLNLILPALKEILVDGGQVVALIKPQFEAGREQIGKNGIVKDKLVHEKVLTTVTNFTKDYGYTVKHLDFSPIQGGHGNIEFLMHLQKCQDPQNLVLDQIQDVIEKAHKEFKKNEEE

SEQ ID NO: 287 - DNA, 825 bp, Streptococcus pyogenes
atgcctaaagaaagagtagatgtgttagcctataagcaaggattatttgagaccagagagcaagctaagcgtggtgtcatggcaggcttagtggtctctgtgattaatggccaacgctatgacaagccaggtgacaaaattgacgatgggactgagttaaaacttaaaggtgaaaaactcaaatacgtcagtcgtggtggattaaaactggaaaaggggctgcacgtttttggtgtatcagttgctaatcaaattgggattgatattggcgcttcaacaggtggttttaccgatgttatgttacaagatggggccaaactagtctatgccgtcgacgttgggactaaccagttggtatggaaactcagacaagatccacgagtaagaagtatggaacagtataactttcgttatgctcagccagaagactttaatgagggacagcctgtatttgccagtattgatgtgtcctttatttctctcagcttgattttgccagccctgcataacgttttgtcagatcagggacaggttattgctctcattaaaccgcaatttgaagctgggcgcgagcagattggtaaaaaaggcatcgtcaaggacaaacagattcatgaaaaagtgattcaaaaggtcatggattttgcctcaggttacggatttacagttaagggacttgatttttctcctattcagggtggtcatggcaatatcgaatttttagctcatcttgctaagtcacagacacctgaaacgttagccccgcatttgattcagaaagttgttgccaaggcacataaggagtttgagaaacatgaaaaagag

SEQ ID NO: 288 - protein, 275 aa, Streptococcus pyogenes
MPKERVDVLAYKQGLFETREQAKRGVMAGLVVSVINGQRYDKPGDKIDDGTELKLKGEKLKYVSRGGLKLEKGLHVFGVSVANQIGIDIGASTGGFTDVMLQDGAKLVYAVDVGTNQLVWKLRQDPRVRSMEQYNFRYAQPEDFNEGQPVFASIDVSFISLSLILPALHNVLSDQGQVIALIKPQFEAGREQIGKKGIVKDKQIHEKVIQKVMDFASGYGFTVKGLDFSPIQGGHGNIEFLAHLAKSQTPETLAPHLIQKVVAKAHKEFEKHEKE

SEQ ID NO: 289 - DNA, 471 bp, Streptococcus agalactiae
atgaagaagagtgaacgtttaaatttaattaagcaaattgttcttaaccatgctgttgaaacacaacatgagttgttacgcagattggaagcttatggggtaactctaactcaagcaactatttcacgtgatatgaatgaaattggcattataaaagtgccatcagcaaaaggtcgctatatttacggtttgtcaaatgaaaacgaccctatctttacaactgctgtggcaaagcctattaaaacaagtattttatcaatatcagataagctactaggtttagagcaatttatcaatattaatgtcataccaggtaacagtcaattaattaaaaccttcataatgtcacattgtcaagaacatatttttagtttgacagctgacgataatagtctccttttgattgcaaaatcagaagcagatgctgatcacattcgtcaatcaatgattgcaatgttggagaaaaaagat

SEQ ID NO: 290 - protein, 157 aa, Streptococcus agalactiae
MKKSERLNLIKQIVLNHAVETQHELLRRLEAYGVTLTQATISRDMNEIGIIKVPSAKGRYIYGLSNENDPIFTTAVAKPIKTSILSISDKLLGLEQFININVIPGNSQLIKTFIMSHCQEHIFSLTADDNSLLLIAKSEADADHIRQSMIAMLEKKD

SEQ ID NO: 291 - DNA, 501 bp, Streptococcus pyogenes
ttgttgccaaggcacataaggagtttgagaaacatgaaaaagagtgaacgacttgaattaatcaaaaaaatggttttgacgcatccaattgagacgcaacatgacctcttaagattattggcagagcatgggttagaattaacccaggctactatttcaagagacatgaatgaaattggtatagtaaagattccttctggcagtggacgttacatctatggtctttctcaagatagtggaaaaaagatcgttcaaggacctagatcgataaagagcactattttagctgtatctgacaaaacaaaaggtttagaacaacacctctatttaaaagtcgtacctggcaatagtaaattaatcaaacgttatttattagcagatttttcaaaagctatttttagtcttattgctgatgatgatagtttattgttaattgcaaagtctccttcagaagcagatatgatacgccaagaaattttgctttggatgcagggtataacc

SEQ ID NO: 292 - protein, 167 aa, Streptococcus pyogenes
LLPRHIRSLRNMKKSERLELIKKMVLTHPIETQHDLLRLLAEHGLELTQATISRDMNEIGIVKIPSGSGRYIYGLSQDSGKKIVQGPRSIKSTILAVSDKTKGLEQHLYLKVVPGNSKLIKRYLLADFSKAIFSLIADDDSLLLIAKSPSEADMIRQEILLWMQGIT

SEQ ID NO: 293 - DNA, 123 bp, Streptococcus agalactiae
atggaagttttatcttccttacgtgaaaaagcagatttaatagctaacatcaatcgagataactctcctcctgaagccacttttaccaatggcttaaagccctctccgggattcgttgaaata

SEQ ID NO: 294 - protein, 41 aa, Streptococcus agalactiae
MEVLSSLREKADLIANINRDNSPPEATFTNGLKPSPGFVEI

SEQ ID NO: 295 - DNA, 1656 bp, Streptococcus agalactiae
atgcttttagaaatttctattaagaatttcgctattatcgaagaaatttcacttaattttgaaacaggaatgactgttttaactggtgagactggtgcagggaaatctatcattattgatgctatgaatatgatgttaggatcccgtgctagcgttgaagtgattcgccatggtgctaacaaagcagaaattgaaggatttttctctgttgaaaaaaatcaatcattagtccaattattggaagaaaatggcattgaattagcagatgaattaattattcgccgagaaatctttcaaaatgggcgcagcgttagtcgaattaatgggcaaatggtgaatttgtcaacactaaaagctgtggggcattatttggtagacatttatggtcagcatgaccaagaggaactaatgaaacctaacatgcacattctgatgttagatgaatttggtaatacagaatttaatgtcataaaagaacgttatcaaagtctttttgatgcttatcgtcagcttcgtaaacgcgtattggataagcaaaaaaatgaacaagagaataaatcacgtattgaaatgctagaatttcaaatagcagaaattgagtctgtagcccttaaatcagatgaagaccaaacgctactcaagcaacgtgataaattaatgaatcataagaatattgcagatactttgacaaatgcatatcttatgttagataacgaagagttttcaagtttatcgaatgttcgttctgcaatgaatgaccttatggctttagaagaatttgatcgagaatataaagatctttccaccaatctttcagaagcttactacgttattgaagaagttactaaacgtttaggtgacgttatcgatgatttagattttgacgctggtttactacaagaaattgaaaatagactagatgttattaacacaataacgcgaaaatatggcggtgatgtgaatgatgttttagactattttgataacattactaaagaatatagtctattgacaggtagtgaagagtcctcagatgctttagaaaaagaattaaagattttagaacacgatttgattgaatcagcaaatcaattaagtttagagcgccataagctagctaaacaattggaaaatgaaatcaaacaagaattaacagagctttatatggagaaagctgatttccaagttcaatttacaaaaggaaaatttaataaagaagggaacgaaatcgttgaattttatatttcaacgaatcccggagagggctttaagccattggtaaaagtggcttcaggaggagagttatctcgattgatgttagctattaaatctgctttttcacgtaaggaagataaaacttccattgtatttgatgaggtggatacaggagtttctggtcgcgtggcccaggctatcgctcaaaaaattcacaagattggtagtcatggacaagttttagcaatttctcatttagctcaggttattgcaatagcggattaccaatattttattgaaaaaatttccagtgactcttcaacagtttcaacggtaaggcttttaagctatgaagaacgtgtagaagaaatcgctaaaatgttggcaggaaacaatgtaacagacactgcacgtactcaagctaaagaattacttggtagt

SEQ ID NO: 296 - protein, 552 aa, Streptococcus agalactiae
MLLEISIKNFAIIEEISLNFETGMTVLTGETGAGKSIIIDAMNMMLGSRASVEVIRHGANKAEIEGFFSVEKNQSLVQLLEENGIELADELIIRREIFQNGRSVSRINGQMVNLSTLKAVGHYLVDIYGQHDQEELMKPNMHILMLDEFGNTEFNVIKERYQSLFDAYRQLRKRVLDKQKNEQENKSRIEMLEFQIAEIESVALKSDEDQTLLKQRDKLMNHKNIADTLTNAYLMLDNEEFSSLSNVRSAMNDLMALEEFDREYKDLSTNLSEAYYVIEEVTKRLGDVIDDLDFDAGLLQEIENRLDVINTITRKYGGDVNDVLDYFDNITKEYSLLTGSEESSDALEKELKILEHDLIESANQLSLERHKLAKQLENEIKQELTELYMEKADFQVQFTKGKFNKEGNEIVEFYISTNPGEGFKPLVKVASGGELSRLMLAIKSAFSRKEDKTSIVFDEVDTGVSGRVAQAIAQKIHKIGSHGQVLAISHLAQVIAIADYQYFIEKISSDSSTVSTVRLLSYEERVEEIAKMLAGNNVTDTARTQAKELLGS

SEQ ID NO: 297 - DNA, 1662 bp, Streptococcus pyogenes
gtgatgttattagaaatttctattaaaaattttgctattattgatgaaatttccctaaattttgaaaatggtatgacggttttgacgggtgaaactggagcaggaaagtctattatcattgatgctatgaatatgatgcttggtgcgcgtgctagtacagaagtgattcgtcgtggagctaataaagcagaaattgaggggttcttttcggtagatgctaccccagaactggttgcgtgtctggaatcatcaggtattgctatggaagaagaactgattattcgccgagatatctttgccaatggcagaagcgtgagccgcattaatggtcagatggttaacctagccaccttaaaacaggtcggacagtttttggtagatattcatgggcaacatgaccaagaagaattaatgcgaccacagctccaccagcaaattttggacgcttttggtgataaggcttttgagcaattgaaagagaattatcagcttatttttgatcgttataaaagcttgcgtcgccaggttattgacaaacaaaaaaatgaaaaggaacacaaagatcgtattgatatgttggcctttcagatagcagaaattgaagctgctgccttgagtcgaggtgaggacgaccggttaaatcaagaacgtgatcgcttaatgaaccacaaacaaattgctgataccctgaccaatgcctacgtcatgctagataatgacgatttttcaagtctatccaatattcgctctagcatgaatgacttactatcaattgagcagtttgattcagagtacaaagggatgtcgacttcgatttctgaagcctattatattcttgaagaagtgagcaagcaattatcagataccattgaccaactggattttgatggtgggcgattacaggaaattgaatttcgcttggatatactcaatagcttaactcgtaaatacggtggtaatgtgaatgatgtgcttgactactacgataatatcgtcaaagaataccagctattaacaggagatgacttgtcttcaggggatctagaggcagaattgaaaagcttggaaaaacaattggttgctgctgcttcggagttaagtgtctctcgccatcaattggcggagcaattagaagctgagattaaagctgaacttaaggaactttatatggaaaaagcagatttcaaagttcactttaccacatcaaaatttaatcgtgatggtaatgaaagcttggaattttacatctctactaatccaggcgaaggattcaagccccttgtcaaggtggcttctggaggagagttatcacgccttatgttagccatcaaggctgctatttctagaaaagaagataagacgagtattgtttttgatgaagtagatacaggtgtttctggtcgcgttgcgcaagccattgcccaaaaaatttataaaattgggcgacatgggcaagttctcgctatttcacacttacctcaagttattgctattgctgattatcagtattttatttctaaagaaagtaaagaagagtccaccgtttctaaggtaaggttattaactcctgaagaacgtgtggaagaaattgctagcatgattgcaggaacagatatgacacaagctgctcttacgcaggctcgtgaactacttgccaaacat

SEQ ID NO: 298 - protein, 554 aa, Streptococcus pyogenes
VMLLEISIKNFAIIDEISLNFENGMTVLTGETGAGKSIIIDAMNMMLGARASTEVIRRGANKAEIEGFFSVDATPELVACLESSGIAMEEELIIRRDIFANGRSVSRINGQMVNLATLKQVGQFLVDIHGQHDQEELMRPQLHQQILDAFGDKAFEQLKENYQLIFDRYKSLRRQVIDKQKNEKEHKDRIDMLAFQIAEIEAAALSRGEDDRLNQERDRLMNHKQIADTLTNAYVMLDNDDFSSLSNIRSSMNDLLSIEQFDSEYKGMSTSISEAYYILEEVSKQLSDTIDQLDFDGGRLQEIEFRLDILNSLTRKYGGNVNDVLDYYDNIVKEYQLLTGDDLSSGDLEAELKSLEKQLVAAASELSVSRHQLAEQLEAEIKAELKELYMEKADFKVHFTTSKFNRDGNESLEFYISTNPGEGFKPLVKVASGGELSRLMLAIKAAISRKEDKTSIVFDEVDTGVSGRVAQAIAQKIYKIGRHGQVLAISHLPQVIAIADYQYFISKESKEESTVSKVRLLTPEERVEEIASMIAGTDMTQAALTQARELLAKH

SEQ ID NO: 299 - DNA, 834 bp, Streptococcus agalactiae
atgagtaaaatcaaaattgtaacggattcttccattaccattgaaccagaacttattaaagagcttgacattacagttgttcccttgtcagttatgatagatggtaccttgtattcagacaatgacttaaaagcacaaggggaattcttgaacctaatgcgtggaagtaaggaattgccaaaaacaagtcaaccacctgtaggtgtttttgcagaaatttatgaaaaattaatgaatgaaggtgtggaacatatcattgcaattcatttaacgcatacactatcaggaactattgaagcatcacgccagggagctaatattgctggtgcagatgttacagttattgattctacttttacagaccagtgtcaaaaattccaggttgtagaagctgcgaaattagctaaagagggagctgatttagataccatcttggctcgtgtggaagaagtacgccagaagtcagaattatttattggcgtatcgacccttgaaaatttagtaaaaggtggtcgtattggacgtgtaacgggtcttctaagttcattgcttaatataaaagtaattatggagctaacaaaccatgaattagtaccgattgttaaaggtcgcggtctaaagaccttcagcaaatggttagataattttgttgaaagtgcccaaacacgaaaaattgctgaaattggcatctcctactgtggtaaagctgatatggctaataactttagagaaaaactagctgttctaggtgctcctatatccgttttagaaactggctcaatcatccaaactcatactggtgaggatgcatttgctgttatggttcgttatgaa

SEQ ID NO: 300 - protein, 278 aa, Streptococcus agalactiae
MSKIKIVTDSSITIEPELIKELDITVVPLSVMIDGTLYSDNDLKAQGEFLNLMRGSKELPKTSQPPVGVFAEIYEKLMNEGVEHIIAIHLTHTLSGTIEASRQGANIAGADVTVIDSTFTDQCQKFQVVEAAKLAKEGADLDTILARVEEVRQKSELFIGVSTLENLVKGGRIGRVTGLLSSLLNIKVIMELTNHELVPIVKGRGLKTFSKWLDNFVESAQTRKIAEIGISYCGKADMANNFREKLAVLGAPISVLETGSIIQTHTGEDAFAVMVRYE

SEQ ID NO: 301 - DNA, 849 bp, Streptococcus pyogenes
atggaaaaatacatgggaactataaaaattgttacagattcatcaataactattgaaccagaattaattaaagctttagatattactgtagtacctttatctgtcatgattgatagcaaattatattctgataatgatttaaaagaagaaggtcattttttgagccttatgaaggctagcaaatcccttcccaaaaccagtcagccaccggttggtctctttgctgaaacttacgaaaatttggtcaaaaaaggagtaactgacattgttgctattcacctctcaccagctttatcaggtactattgaagcttcccgtcagggggctgaaatcgctgaggcacctgttacagttttagattcaggatttactgatcaagccatgaaatttcaggtcgttgaggcagcaaagatggcaaaagcgggtgctagtttgaatgagattttggctgctgttcaagctatcaaatcaaaaacagagctctacattggtgtatctaccttagaaaatttagtaaaaggaggtcgtattggtcgtgtgacgggtgttttgagctcgctacttaatgtcaaagttgttatggcacttaaaaatgatgagttaaaaacgcttgtcaaaggtcgaggtaataaaacatttacgaaatggttagatagttacctcgctaaaaatagtcatcgcccgattgcagagatagctatttcttatgctggtgaagctagcctggcattaaccttaaaagaaagaatcgcagcttattacaaccactctatttcggttttagaaacaggctctatcatccaaacacatacaggagaaggagcttttgcggttatggttcgttatgaa

SEQ ID NO: 302 - protein, 283 aa, Streptococcus pyogenes
MEKYMGTIKIVTDSSITIEPELIKALDITVVPLSVMIDSKLYSDNDLKEEGHFLSLMKASKSLPKTSQPPVGLFAETYENLVKKGVTDIVAIHLSPALSGTIEASRQGAEIAEAPVTVLDSGFTDQAMKFQVVEAAKMAKAGASLNEILAAVQAIKSKTELYIGVSTLENLVKGGRIGRVTGVLSSLLNVKVVMALKNDELKTLVKGRGNKTFTKWLDSYLAKNSHRPIAEIAISYAGEASLALTLKERIAAYYNHSISVLETGSIIQTHTGEGAFAVMVRYE

SEQ ID NO: 303 - DNA, 867 bp, Streptococcus agalactiae
gtgaggatgcatttgctgttatggttcgttatgaataagaaaaaaatacttaccggactttctttttttctggtaagtcttcttttatcttttgggattttttccttgatcattccaaaatcaaatcctaaattaacaaaaaaagacttcctaacaaagaaagttatcccacttaactatgttgctcttggagattctctgaccgaaggtgtgggcgatacaacctctcaaggtggttttgttccactgctatcagaatcactccataatcgatactcttaccaagtgacttctgttaattatggtgtgtctgggaatactagtcaacaaattttaaaacgtatgacgacagatcctcaaatcgaaaaagatttagagaaagctgatttattgacgctaactgttggtggtaatgatgtcttggctgttattcgtaaagagctcagtcatttatcactaaattcctttgagaaaccagcagaagcatataaggaacgtttgaaagaaatccttgcaaaagcaagacaagataatcctaaattgcctatttatgttttaggcatttataatcctttttacctaaactttccacaattaactaaaatgcaaaccgttattgataattggaataaagctacaaaagaagtagttgatgcttcagaaaatgtttattttgtcccaattaatgaccgcctttataagggaataaatggtaaagagggtattacagagtcatcaaatagtcaggcaagtatcactaatgatgctctctttactggagaccattttcatcccaataatattggctatcaaatcatgtctaacgccgttatggagaaaataaatgaaacaagaaaaaactggccg

SEQ ID NO: 304 - protein, 289 aa, Streptococcus agalactiae
MRMHLLLWFVMNKKKILTGLSFFLVSLLLSFGIFSLIIPKSNPKLTKKDFLTKKVIPLNYVALGDSLTEGVGDTTSQGGFVPLLSESLHNRYSYQVTSVNYGVSGNTSQQILKRMTTDPQIEKDLEKADLLTLTVGGNDVLAVIRKELSHLSLNSFEKPAEAYKERLKEILAKARQDNPKLPIYVLGIYNPFYLNFPQLTKMQTVIDNWNKATKEVVDASENVYFVPINDRLYKGINGKEGITESSNSQASITNDALFTGDHFHPNNIGYQIMSNAVMEKINETRKNWP

SEQ ID NO: 305 - DNA, 858 bp, Streptococcus agalactiae
ttgcggttatggttcgttatgaataatcgtcatttatttagtgggatatttttctttgttattagtttatgtctggcctttttattgctaaatattattatccctaagtcaaattcacgtttgaaaaagagtgattttctgaaaaaagaacaagtagctatccaatatgttgctataggagattcattgacagaaggagtaggtgatctaactcatcaaggtggttttgttcctttgttaacgaatgatctcagtgaatattttaaggctaatgttaatcatcaaaattacggcgtatctggtgataccagtcaacaaattcttgataggatgataaaacaaaagcagatacagttatctttaaaaaaagcagatataatgacgttaaccgttggtggtaatgatgttatggcagttattcggaagaatttagcggatttgcaagtttctagttttagaaagccagctcgtcagtatcaaaaacgattaagacagattatcgagttagccagaaaagataataaagatcttcctatttttattttaggcatctataatccgttttatttgaattttccagaactaactgatatgcaaaaagtgattgatgactggaataccaaaactaaggaggttgttggagaatacgatcgtgtgtactttgtgccaataaatgacctcttgtataaagggataaatggacaagaaggaattgttcattcttcaggagatcaaactacaattgtcaatgatgccttgtttactggggaccattttcacccaaataatactggctatcaaatcatgtcaaatgcagtaatggagaaaattaaaaagcatgaaaaaaaaatcaaacct

SEQ ID NO: 306 - protein, 286 aa, Streptococcus agalactiae
LRLWFVMNNRHLFSGIFFFVISLCLAFLLLNIIIPKSNSRLKKSDFLKKEQVAIQYVAIGDSLTEGVGDLTHQGGFVPLLTNDLSEYFKANVNHQNYGVSGDTSQQILDRMIKQKQIQLSLKKADIMTLTVGGNDVMAVIRKNLADLQVSSFRKPARQYQKRLRQIIELARKDNKDLPIFILGIYNPFYLNFPELTDMQKVIDDWNTKTKEVVGEYDRVYFVPINDLLYKGINGQEGIVHSSGDQTTIVNDALFTGDHFHPNNTGYQIMSNAVMEKIKKHEKKIKP

SEQ ID NO: 307 - DNA, 600 bp, Streptococcus agalactiae
atgaaacaagaaaaaactggccgtaatttaaatttctggaaatgggcatttctcttattgttggcaattaacctttccttcacagcagtgattgcaagtcgcttaattcaagtacgtgagcctaatacaggaaaaatttcgactggggtacaagataaagtaaaagtaggtacttttacgaccaataagtcgcaactgaataagacaattgcactttatttaaaacaatatcaaactaagaagatgaattataagatttatgctgcttcatcttctatactatttgaaggctcttatcaattattaggttatgaagtgcctttatacatctattttgaaccttatcgtttaacaaatggcgctgttcaacttaaagtgacctcattttcagtaggaactcttccgcttccagaaaaagatgtgttacaatatataaaatcatcttataaattgccaaactttgtagatataaaacctaaaaaatcggttattaatattaatttgcaagatttaaaaaataaagaaggtatttatttgaaagcgactgcaattgatttagtaaacgataattttagtttcgatatttttaagaaaaagccc

SEQ ID NO: 308 - protein, 200 aa, Streptococcus agalactiae
MKQEKTGRNLNFWKWAFLLLLAINLSFTAVIASRLIQVREPNTGKISTGVQDKVKVGTFTTNKSQLNKTIALYLKQYQTKKMNYKIYAASSSILFEGSYQLLGYEVPLYIYFEPYRLTNGAVQLKVTSFSVGTLPLPEKDVLQYIKSSYKLPNFVDIKPKKSVININLQDLKNKEGIYLKATAIDLVNDNFSFDIFKKKP

SEQ ID NO: 309 - DNA, 585 bp, Streptococcus pyogenes
atgaaaaaaaaatcaaaccttaattggtggaagtggagcttcttatgtctgcttgcttttaataccgcctttttgatggttattgcaagtcgtctcattcaagtaagagaacctgagtcagaactgattgctaaaaaaccagttaaaaatatcaaaattggtacatttgttacaaccagagaacagcttaacgaaactgtagcaagttatcttaaagattatcagactgaaaaaatgtcttataaattttatgcgacatcttcttctattttgtttgaaggaacttatcaattattagggtatgaagtccctttatatatctattttcaacctcatcgtctagaaaatggagctgtccaactacaggtgatctctttttcagtgggaactctgccactcccagaaaaagatgttttgcagtatttgaaatcaagctacaaattgccaagctttgttaaagtgatgccaaatcaatcagctatcgttgttaatttacaagatatccaaaatgatgctaaggtttatttaaaagccaagaaaattgatttatttaatgatgaaatcagttttaacatctataagaaa

SEQ ID NO: 310 - protein, 195 aa, Streptococcus pyogenes
MKKKSNLNWWKWSFLCLLAFNTAFLMVIASRLIQVREPESELIAKKPVKNIKIGTFVTTREQLNETVASYLKDYQTEKMSYKFYATSSSILFEGTYQLLGYEVPLYIYFQPHRLENGAVQLQVISFSVGTLPLPEKDVLQYLKSSYKLPSFVKVMPNQSAIVVNLQDIQNDAKVYLKAKKIDLFNDEISFNIYKK

SEQ ID NO: 311 - DNA, 156 bp, Streptococcus agalactiae
  MISC_FEATURE (1)..(156): n = a, c, g, or t
atggctaacaaacaagatttaattgcaaaagtagcagaagctacagaattaactaaaaaagattcagcagcagcagtagatgcagtttttgcagctgtagcagattaccttgctgaaggtgaaaaagtacaattaatcggttnnnnnttaattaat

SEQ ID NO: 312 - protein, 52 aa, Streptococcus agalactiae
  MISC_FEATURE (1)..(52): Xaa = Any Amino Acid
MANKQDLIAKVAEATELTKKDSAAAVDAVFAAVADYLAEGEKVQLIGXXLIN

SEQ ID NO: 313 - DNA, 273 bp, Streptococcus pyogenes
atggctaacaaacaagatttaatcgcaaaggttgcagaagcaactgaattgactaaaaaagattcagcagcagcagttgatgccgtgttttctacaatcgaagctttccttgctgaaggtgaaaaagtacaattgatcggttttggtaacttcgaagtacgcgaacgtgcagctcgtaaaggtcgtaacccacaaactggtgcagaaattgaaattgcagcttcaaaagttccagccttcaaagctggtaaagctcttaaagacgctgttaaa

SEQ ID NO: 314 - protein, 91 aa, Streptococcus pyogenes
MANKQDLIAKVAEATELTKKDSAAAVDAVFSTIEAFLAEGEKVQLIGFGNFEVRERAARKGRNPQTGAEIEIAASKVPAFKAGKALKDAVK

SEQ ID NO: 315 - DNA, 1404 bp, Streptococcus agalactiae
ttggctactaaagtagatgtttcaaaagatggcttaacttatacagctacattacgtaaaggcttgaagtggtcagatggcagtaaacttactgcaaaggattttgtttattcatggcaacgtttagttgatcctaaaacagcttcacaatatgcttaccttgctgttgaagggcatgtgcttaatgccgataaaatcaacgaaggacaagagaaagacttgaataagctaggtgttaaggcggaaggcgatgacaaagttgttattactttatctagtccgtctccacaatttatctactaccttgcattcactaacttcatgccacaaaaacaagaagttgttgaaaaatatggaaaagattacgcaactacttcaaaaaatacagtttactcaggaccatatactgttgaaggttggaatggttcgaatggtactttcacgctgaagaaaaacaaaaattattgggacgctaaaaatgtaaaaacaaaagaagttcgcatccagactgttaaaaaaccagataccgccgttcaaatgtataaacgtggtgagttagatgcagctaatatctcaaatacttctgctatttatcaagctaataagaataataaagatgtcacagatgttctagaagcgaccactgcctatatggaatataatactactggttctgtgaaagggcttgataatgttaagattcgtcgcgccttaaacttagcaactaaccgtaaaggagttgttcaagcagccgttgatacaggctcaaaaccggcaattgcttttgcacctactggtttagccaaaacaccagatggaactgatttggcaaaatatgttgccccaggttatgaatataataaaactgaagcagcaaaactctttaaagaaggtttggctgaatcaggcttgactaagctaaaattaacaattacagcagatgctgatgctcctgctgccaaaaactctgttgactatatcaagtctacttgggaagctgctcttccaggacttactgttgaagaaaaatttgtaacctttaaacaacgcttagaagacagtagaaaacaaaactttgacatcgtagtttctctttggggtggggattatccagaaggatcaactttctacggcctctttaagtcagattcacaaaataacgatggaaaatttgctaacaaggactatgatgctgcttataacaaggcaatttctgaagatgcgatgaaaccagcagaatcagcgaaggactataaagaagcagagaaaattttatttgagcaaggtgcttataacccactctacttccgtagtggtaaaggtttacaaaatccaaaattaaaaggtgttattcgtaatactacaggtttgtcaatagactttacacatgcttataaaaataat

SEQ ID NO: 316 - protein, 468 aa, Streptococcus agalactiae
MATKVDVSKDGLTYTATLRKGLKWSDGSKLTAKDFVYSWQRLVDPKTASQYAYLAVEGHVLNADKINEGQEKDLNKLGVKAEGDDKVVITLSSPSPQFIYYLAFTNFMPQKQEVVEKYGKDYATTSKNTVYSGPYTVEGWNGSNGTFTLKKNKNYWDAKNVKTKEVRIQTVKKPDTAVQMYKRGELDAANISNTSAIYQANKNNKDVTDVLEATTAYMEYNTTGSVKGLDNVKIRRALNLATNRKGVVQAAVDTGSKPAIAFAPTGLAKTPDGTDLAKYVAPGYEYNKTEAAKLFKEGLAESGLTKLKLTITADADAPAAKNSVDYIKSTWEAALPGLTVEEKFVTFKQRLEDSRKQNFDIVVSLWGGDYPEGSTFYGLFKSDSQNNDGKFANKDYDAAYNKAISEDAMKPAESAKDYKEAEKILFEQGAYNPLYFRSGKGLQNPKLKGVIRNTTGLSIDFTHAYKNN

SEQ ID NO: 317 - DNA, 1977 bp, Streptococcus pyogenes
gtgacttttatgaagaaaagtaaatggttggcagctgtaagtgttgcgatcttgtcagtatccgctttggcagcttgtggtaataaaaatgcttcaggtggctcagaagctacaaaaacctacaagtacgtttttgttaacgatccaaaatcattggattatattttgactaatggcggtggaacgactgatgtgataacacaaatggttgatggtcttttggaaaacgatgagtatggtaatttagtaccatcacttgctaaagattggaaggtttcaaaagacggtctgacttatacttatactcttcgcgatggtgtctcttggtatacggctgatggtgaagaatatgccccagtaacagcagaagattttgtgactggtttgaagcacgcggttgacgataaatcagatgctctttacgttgttgaagattcaataaaaaacttaaaggcttaccaaaatggtgaagtagattttaaagaagttggtgtcaaagcccttgacgataaaactgttcagtatactttgaacaagcctgaaagctactggaattcaaaaacaacttatagtgtgcttttcccagttaatgcgaaatttttgaagtcaaaaggtaaagattttggtacaaccgatccatcatcaatccttgttaatggtgcttacttcttgagcgccttcacctcaaaatcatctatggaattccataaaaatgaaaactactgggatgctaagaatgttgggatagaatctgttaaattgacttactcagatggttcagacccaggttcgttctacaagaactttgacaagggtgagttcagcgttgcacgactttacccaaatgaccctacctacaaatcagctaagaaaaactatgctgataacattacttacggaatgttgactggagatatccgtcatttaacatggaatttgaaccgtacttctttcaaaaacactaagaaagaccctgcacaacaagatgccggtaagaaagctcttaacaacaaggattttcgtcaagctattcagtttgcttttgaccgagcgtcattccaagcacaaactgcaggtcaagatgccaaaacaaaagccttacgtaacatgcttgtcccaccaacatttgtgaccattggagaaagtgattttggttcagaagttgaaaaggaaatggcaaaacttggtgatgaatggaaagacgttaacttagctgatgctcaagatggtttctataatcctgaaaaagcaaaagctgagtttgcaaaagccaaagaagctttaacagctgaaggtgtaaccttcccagttcaattagattaccctgttgaccaagcaaacgcagcaactgttcaggaagcccagtctttcaaacaatctgttgaagcatctcttggtaaagagaatgtcattgtcaatgttcttgaaacagaaacatcaactcacgaagcccaaggcttctatgctgagaccccagaacaacaagactacgatatcatttcatcatggtggggaccagactatcaagatccacggacctaccttgacatcatgagtccagtaggtggtggatctgttatccaaaaacttggaatcaaagcaggtcaaaataaggatgttgtggcagctgcaggccttgatacctaccaaactcttcttgatgaagcagcagcaattacagacgacaacgatgcgcgctataaagcttacgcaaaagcacaagcctaccttacagataatgccgtagatattccagttgtggcattgggtggcactccacgagttactaaagccgttccatttagcgggggcttctcttgggcagggtctaaaggtcctctagcatataaaggaatgaaacttcaagacaaacctgtcacagtaaaacaatacgaaaaagcaaaagaaaaatggatgaaagcaaaggctaagtcaaatgcaaaatatgctgagaagttagctgatcacgttgaaaaa

SEQ ID NO: 318 - protein, 659 aa, Streptococcus agalactiae
VTFMKKSKWLAAVSVAILSVSALAACGNKNASGGSEATKTYKYVFVNDPKSLDYILTNGGGTTDVITQMVDGLLENDEYGNLVPSLAKDWKVSKDGLTYTYTLRDGVSWYTADGEEYAPVTAEDFVTGLKHAVDDKSDALYVVEDSIKNLKAYQNGEVDFKEVGVKALDDKTVQYTLNKPESYWNSKTTYSVLFPVNAKFLKSKGKDFGTTDPSSILVNGAYFLSAFTSKSSMEFHKNENYWDAKNVGIESVKLTYSDGSDPGSFYKNFDKGEFSVARLYPNDPTYKSAKKNYADNITYGMLTGDIRHLTWNLNRTSFKNTKKDPAQQDAGKKALNNKDFRQAIQFAFDRASFQAQTAGQDAKTKALRNMLVPPTFVTIGESDFGSEVEKEMAKLGDEWKDVNLADAQDGFYNPEKAKAEFAKAKEALTAEGVTFPVQLDYPVDQANAATVQEAQSFKQSVEASLGKENVIVNVLETETSTHEAQGFYAETPEQQDYDIISSWWGPDYQDPRTYLDIMSPVGGGSVIQKLGIKAGQNKDVVAAAGLDTYQTLLDEAAAITDDNDARYKAYAKAQAYLTDNAVDIPVVALGGTPRVTKAVPFSGGFSWAGSKGPLAYKGMKLQDKPVTVKQYEKAKEKWMKAKAKSNAKYAEKLADHVEK

SEQ ID NO: 319 - DNA, 948 bp, Streptococcus agalactiae
ttgctatttttagcaattctaagaaaaggaaatgatatgattaaatatattttaaagcgtgttgctattttgttagtaacgctatgggttgtcataaccctatcgttctttctgatgcagatccttccaggaacaccctacaataatccaaaactcactgaagaaatgatcgcattgcttaataaacagtatggtttagacaagcctgtatggcaacaatatttgacttacctttggaatgtacttcatggtgactttggaacgagttatcaatcagtgaatcagccagtatcacgtatgattagcttgagattaggagtttcagtacatctaggtgttcaggctctcgtatttggtgttttaggcggtattttggtaggagctatttcggcacgtcataagaatgataaagtcgatggtatcttaagtgttattgcaacgctagggatttctatgccttcatttatcattggtatcttattattagactattttggatttaagtggaacttgttgcctttatcaggttgggggactttctctcaaaccattttaccttctttagctctaggactccctacattagcatctgtttcacgcttcttccgtagtgaaatgattgaaactttaaattctgattatgtgcaactagctcgttcaaaaggtatgacaattcgtcaagtaactcgaaaacatgcttaccgtaattctatgattccaattttaactctaattggccctttggcggcgggtctgttaactggttctgcactaattgagcagattttctcgattccaggaattgggcagcagtttgttacttcgattccaacaaaagactatcctgttattatggggacaaccattgtttatgcagtaatgttgatggttgctatcttgataacagacgttgttattagtatcgtagacccacgtgttcgcttgcag

SEQ ID NO: 320 - protein, 316 aa, Streptococcus agalactiae
MLFLAILRKGNDMIKYILKRVAILLVTLWVVITLSFFLMQILPGTPYNNPKLTEEMIALLNKQYGLDKPVWQQYLTYLWNVLHGDFGTSYQSVNQPVSRMISLRLGVSVHLGVQALVFGVLGGILVGAISARHKNDKVDGILSVIATLGISMPSFIIGILLLDYFGFKWNLLPLSGWGTFSQTILPSLALGLPTLASVSRFFRSEMIETLNSDYVQLARSKGMTIRQVTRKHAYRNSMIPILTLIGPLAAGLLTGSALIEQIFSIPGIGQQFVTSIPTKDYPVIMGTTIVYAVMLMVAILITDVVISIVDPRVRLQ

SEQ ID NO: 321 - DNA, 1029 bp, Streptococcus agalactiae
atggcagataaaaacagaacatttaaacttgtaggtgcaggatcttctagcacacaagaaaaaattgaaaagcctgctctttcgtttatgcaagatgcgtggcgtcgcttgaaaaaaaacaaattagcagtagtttcactctatttattagctcttttacttactttttcgttagcctcaaatttatttgtaactcagaaggatgctaatgggtttgattcgaaaaaagtaactacatatcgcaacttaccacctaaattgagttcaaaccttcctttttggaatggtagcattaagtacgctggaaatacagaatctacagacgcttataagtctcaaaatgtccctgaaaaagttaagtatgctttaggtacagattctctagggagaagtgttgctaagcgcatcatcgtaggtattcggatttccttacttgtagctattgcagctacattcattgatttaattatcggtgttacatacggtcttgtttcaggttttgctggaggacgccttgatacattaatgcaacgtatcgtagaggtaatttcatcaattccaaacttagttatcgttacaatgttaggtttggtccttggtaacggtattacggctattattatctctattgcttttaccggatggacttctatgtctcgtcaggtaaggaatttaaccctatcatatcgagaaagagagtttgtgcttgctgcacgttcacttggggaaagtccaattaaaatagccttcaaacatattttacctaacatttctggtattatcattgtacaaattatgatgacaatcccaagtgctattatgtatgaagcggtactttcagcaatcaatttaggtgttaaaccaccgacagcttcattaggatcattgatttcagatgcacaagaaaatttacaatattatccatatcaagttatcttgccagctttagcattggtaatgatttcattggcatttattttgcttggtgatgggttgcgagatgcttttgatccaaaatctagcgatgaa

SEQ ID NO: 322 - protein, 343 aa, Streptococcus agalactiae
MADKNRTFKLVGAGSSSTQEKIEKPALSFMQDAWRRLKKNKLAVVSLYLLALLLTFSLASNLFVTQKDANGFDSKKVTTYRNLPPKLSSNLPFWNGSIKYAGNTESTDAYKSQNVPEKVKYALGTDSLGRSVAKRIIVGIRISLLVAIAATFIDLIIGVTYGLVSGFAGGRLDTLMQRIVEVISSIPNLVIVTMLGLVLGNGITAIIISIAFTGWTSMSRQVRNLTLSYREREFVLAARSLGESPIKIAFKHILPNISGIIIVQIMMTIPSAIMYEAVLSAINLGVKPPTASLGSLISDAQENLQYYPYQVILPALALVMISLAFILLGDGLRDAFDPKSSDE

SEQ ID NO: 323 - DNA, 924 bp, Streptococcus pyogenes
atggaatcgattgataaatctaaatttcgatttgttgagcgcgatagtgaagcctccgaagtgattgatacccctgcttattcttactggaaatcagtgtttcgtcagtttttttctaaaaaatctacagtctttatgctcgtaattttagtgacagtcttgatgatgagctttatttatccaatgtttgccaactacgactttaatgacgttagtaatatcaatgacttttcaaagcgttatatttggccaaatgcagagtactggtttggaaccgacaaaaatgggcaatctctgtttgatggtgtttggtatggggcacgtaattctattttaatctcagttatagcgacactaattaatatcaccattggggtagtgttaggagccatatggggagtttctaaagcatttgataaagttatgattgaaatttataacattatctcaaatatcccttctatgcttattatcattgttttgacctattcattaggtgcaggattttggaatttgattctagctttctgtatcactggatggattggtgtcgcctactccatccgtgttcaaatcttgcgttaccgtgatttagaatacaaccttgctagtcaaactttgggaacaccaatgtacaagattgctgttaagaacctcctgcctcaattggtttcagttatcatgactatgttgtcacaaatgctaccagtttatgtatcttctgaggccttcttatccttctttgggattggtttaccaaccaccactccaagtttaggacgttttattgctaattattcaagcaacttaacaacaaatgcctacctcttttggattcccttagtaacattgattttagtatcgttaccactatacattgtcggacaaaacttggctgatgccagtgacccacgttcacataga

SEQ ID NO: 324 - protein, 308 aa, Streptococcus pyogenes
MESIDKSKFRFVERDSEASEVIDTPAYSYWKSVFRQFFSKKSTVFMLVILVTVLMMSFIYPMFANYDFNDVSNINDFSKRYIWPNAEYWFGTDKNGQSLFDGVWYGARNSILISVIATLINITIGVVLGAIWGVSKAFDKVMIEIYNIISNIPSMLIIIVLTYSLGAGFWNLILAFCITGWIGVAYSIRVQILRYRDLEYNLASQTLGTPMYKIAVKNLLPQLVSVIMTMLSQMLPVYVSSEAFLSFFGIGLPTTTPSLGRFIANYSSNLTTNAYLFWIPLVTLILVSLPLYIVGQNLADASDPRSHR

SEQ ID NO: 325 - DNA, 1044 bp, Streptococcus agalactiae
atggaaaaagaaactattttaagtgttaataatcttcatgttgacttccacacatatgctggagaagtaaaagcaattcgtgatgtcaactttgaattaaaaaaaggtgagactcttgcaatcgttggtgaatctggttcaggaaaatctgtaactaccagaactttaattggtttaaatgctaaaaattcagagatatcagggaatgttcaatttaaggggcgtaaccttgttgaactatcagaagaagagtggactaaggtacgcgggaatgagatttctatgattttccaagaccctatgactagtttggatccaacgatgaaaattggcatgcaaatagcagaaccaatgatgattcatcaaaaaatttcaaaaaaggatgctttaaaattagctcttgagctaatgaaagatgtaggtatcccaaatgctgaagagcatattaatgattacccacatcagtggtctggaggaatgcgccaacgtgcggttatagcgattgctttagctgctgatcctgaaattcttattgctgatgaaccaacgactgctttagatgtaacaattcaagcacaaattttgaacttaatgaaaaaaattcaagcagaacgagactcctccattgttttcataactcatgacttaggggtcgttgcagggatggcagaccgtgtagcagttatgtatgcagggaaaattgttgaatttggaactgttgatgaagtcttttataatccacaacatccatatacttggggattattgaattcaatgccgacaaccgacacagaatcaggtagtttagagtcaattccgggaacaccaccagatttgttgaacccacctaaaggagatgcatttgcagctcgtaatgaatttgcattagatattgatcatgaagaagaaccaccgtacttcaaagtttcagaaacacatttcgctgctacatggcttttagatgaaagatcacctaaggtgcttcctccattaccgatccaaaaacgttgggaaaaatggaacgagattgaagggaggaaagcc

SEQ ID NO: 326 - protein, 348 aa, Streptococcus agalactiae
MEKETILSVNNLHVDFHTYAGEVKAIRDVNFELKKGETLAIVGESGSGKSVTTRTLIGLNAKNSEISGNVQFKGRNLVELSEEEWTKVRGNEISMIFQDPMTSLDPTMKIGMQIAEPMMIHQKISKKDALKLALELMKDVGIPNAEEHINDYPHQWSGGMRQRAVIAIALAADPEILIADEPTTALDVTIQAQILNLMKKIQAERDSSIVFITHDLGVVAGMADRVAVMYAGKIVEFGTVDEVFYNPQHPYTWGLLNSMPTTDTESGSLESIPGTPPDLLNPPKGDAFAARNEFALDIDHEEEPPYFKVSETHFAATWLLDERSPKVLPPLPIQKRWEKWNEIEGRKA

SEQ ID NO: 327 - DNA, 930 bp, Streptococcus agalactiae
atgactgaaaatcgaaaaaaattagttgaagtcaaaaatgtttctttgaccttcaataaaggaaaagctaatgaagtgagagcaattgataatgttagttttgacatttatgaaggtgaagtgtttggattagttggggaatctggatcaggaaagacaaccgttggacgttcaattttaaaactttatgatatttctgatggagaaattacctttaatggagaagtgatctcacatctgaaaggtaaagcattacatagttttcgtaaagacgctcagatgatttttcaggatcctcaggctagcttaaacggccgtatgaagattcgtgatatcgtagcagaaggtttagatatacataaattagctaaatcaaaatcagatcgtgatagtaaagttcaggccctattagatcttgtagggttaaataaagatcatttaacacgttatccgcatgaattttcaggtggacaacgacaacgtatcgggattgcacgtgctttagcagtagagcctaaatttatcattgctgatgaaccaatatctgccttagatgtttcaatccaagcacaagttgttaatttaatgcaaaaattgcaaagagaacaaggattgacttatttgtttatcgcacatgatttgtctatggtaaaatacatttcagatcgtatcggtgttatgcattgggggaaactgttagaagttggaacatctgatgatgtttataacaatccaatccacccttatacgaagagtctattatcagctattccagaaccagatccggagagtgaacgtcaacgtgttcaccagccgtataatccagctattgagcaagacggacaagaacgtcaaatgcacgagattacccctggtcattttgttttatctacaccccaagaagctgaagaatataaaaaacaaatatta

SEQ ID NO: 328 - protein, 310 aa, Streptococcus agalactiae
MTENRKKLVEVKNVSLTFNKGKANEVRAIDNVSFDIYEGEVFGLVGESGSGKTTVGRSILKLYDISDGEITFNGEVISHLKGKALHSFRKDAQMIFQDPQASLNGRMKIRDIVAEGLDIHKLAKSKSDRDSKVQALLDLVGLNKDHLTRYPHEFSGGQRQRIGIARALAVEPKFIIADEPISALDVSIQAQVVNLMQKLQREQGLTYLFIAHDLSMVKYISDRIGVMHWGKLLEVGTSDDVYNNPIHPYTKSLLSAIPEPDPESERQRVHQPYNPAIEQDGQERQMHEITPGHFVLSTPQEAEEYKKQIL

SEQ ID NO: 329 - DNA, 921 bp, Streptococcus pyogenes
atgtctgagaaattagtcgaagtaaaagacctagaaatttccttcggagaaggaaagaaaaaatttgttgcagttaaaaatgctaatttctttattaaaaaaggagaaaccttttctttagttggagaatctgggagtggtaaaacaacaattggtcgtgctattattggtttgaacgatactagttcaggtcaaattttatacgatgggaaagtaattaatggcagaaaatcaaaatcagaagccaatgagctcattcgtaaaattcaaatgattttccaagatcccgctgctagtttgaatgaacgggcaaccgttgactacatcatttcagaaggtctttataactttaatctgtttaaaacagaggaagaacgtaaagaaaaaattaagaacatgatggccgaagttggtttgctatcagagcatttgacgcgctaccctcatgaattttcaggaggtcaacgtcagcggatcggtatcgctagagccctagtaatgaaccctgaattcgttattgctgatgaaccgatttcagctttggacgtttccgttcgcgcacaggtcttgaatcttcttaaaagaatgcaagccgaaaaaggtttgacttatctcttcattgcccatgatctttcagtcgttcgctttatttcagatcgtattgcggttatccataaaggggttattgtagaagttgcagaaacagaagaactgtttaataacccaattcatccctacacccaatctttgttatcagccgtgcctatcccagatccaattttagagcgtcaaaaagaacttgttgtctatcatccagaccaacatgattatacattagataagccatcaatggttgaaatcaaaccaaatcactttgtttgggcaaaccaagcagaaattgaaaaatatcaaaaagaattg

SEQ ID NO: 330 - protein, 307 aa, Streptococcus pyogenes
MSEKLVEVKDLEISFGEGKKKFVAVKNANFFIKKGETFSLVGESGSGKTTIGRAIIGLNDTSSGQILYDGKVINGRKSKSEANELIRKIQMIFQDPAASLNERATVDYIISEGLYNFNLFKTEEERKEKIKNMMAEVGLLSEHLTRYPHEFSGGQRQRIGIARALVMNPEFVIADEPISALDVSVRAQVLNLLKRMQAEKGLTYLFIAHDLSVVRFISDRIAVIHKGVIVEVAETEELFNNPIHPYTQSLLSAVPIPDPILERQKELVVYHPDQHDYTLDKPSMVEIKPNHFVWANQAEIEKYQKEL

SEQ ID NO: 331 - DNA, 102 bp, Streptococcus agalactiae
atgacaaaaaacaataaatctgtcagcgagacagaaaagagcaaagctcaaacttttaatgagagtttgatcctggctcaggacgaacgctggcggcgtgcc

SEQ ID NO: 332 - protein, 34 aa, Streptococcus agalactiae
MTKNNKSVSETEKSKAQTFNESLILAQDERWRRA

SEQ ID NO: 333 - DNA, 141 bp, Streptococcus agalactiae
gtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggct

SEQ ID NO: 334 - protein, 47 aa, Streptococcus agalactiae
MTVTNQKGTANYVPAAAVIRRSRALSGFIGRKASAGGSLSLKLKAVA

SEQ ID NO: 335 - DNA, 120 bp, Streptococcus agalactiae
ttgtacgctttggaaactggaggacttgagtgcagaaggggagagtggaattccatgtgtagcggtgaaatgcgtagatatatggaggaacaccggtggcgaaagcggctctctggtctg

SEQ ID NO: 336 - protein, 40 aa, Streptococcus agalactiae
MYALETGGLECRRGEWNSMCSGEMRRYMEEHRWRKRLSGL

SEQ ID NO: 337 - DNA, 105 bp, Streptococcus agalactiae
gtggcgaaagcggctctctggtctgtaactgacgctgaggctcgaaagcgtggggagcaaacaggattagataccctggtagtccacgccgtaaacgatgagtgc

SEQ ID NO: 338 - protein, 35 aa, Streptococcus agalactiae
MAKAALWSVTDAEARKRGEQTGLDTLVVHAVNDEC

SEQ ID NO: 339 - DNA, 99 bp, Streptococcus agalactiae
gtgctaggtgttaggccctttccggggcttagtgccgcagctaacgcattaagcactccgcctggggagtacgaccgcaaggttgaaactcaaaggaat

SEQ ID NO: 340 - protein, 33 aa, Streptococcus agalactiae
MLGVRPFPGLSAAANALSTPPGEYDRKVETQRN

SEQ ID NO: 341 - DNA, 99 bp, Streptococcus agalactiae
ttgaaactcaaaggaattgacgggggcccgcacaagcggtggagcatgtggtttaattcgaagcaacgcgaagaaccttaccaggtcttgacatccttc

SEQ ID NO: 342 - protein, 33 aa, Streptococcus agalactiae
MKLKGIDGGPHKRWSMWFNSKQREEPYQVLTSF

SEQ ID NO: 343 - DNA, 159 bp, Streptococcus agalactiae
ttgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagc

SEQ ID NO: 344 - protein, 53 aa, Streptococcus agalactiae
MLVAIIKLGTLARLPVINRRKVGMTSNHHAPYDLGYTRATMVGTTSRKPVTAS

SEQ ID NO: 345 - DNA, 171 bp, Streptococcus agalactiae
ttgtttagttttgagaggtcttgtggggccttagctcagctgggagagcgcctgctttgcacgcaggaggtcagcggttcgatcccgctaggctccattgaatcgaaaggttcaaattgttcattgaaaattgaatatctatatcaaattccacgatctagaaatagattg

SEQ ID NO: 346 - protein, 57 aa, Streptococcus agalactiae
MFSFERSCGALAQLGERLLCTQEVSGSIPLGSIESKGSNCSLKIEYLYQIPRSRNRL

SEQ ID NO: 347 - DNA, 849 bp, Streptococcus agalactiae
atgaaaatttttgagaaagctcctgccaaacttaatttaggattagatattaaaggacgatgtgacgatggttatcatgaattagctatgattatggttagtattgatcttaatgactacgttaccatttctgagctaaaggaagattgtattgttatcgattctgatagtagcaaaatgcctttaaataatgataatgatgtgtttaaagctgcagatataatcaaaaatcaatatggtattaataaaggtgttcatattagattagaaaaatccattcctgtctgtgcaggactggggggtggttctactgatgctgctgctacaataagagctcttaatcgattatggaatcttcaaatggactatgacgaaatggttgctattggttttaaaattggtagtgatgttccttattgtcttggtgggggatgttcgttagtattaggtaaaggtgaaattgttaaacccttaccgacattgagaccatgttggatagttctggttaagccggattttggtatttcaactaaatccatttttagagatattgattgtaagtctataagtagagttgatattgatttattaaagtctgctattttgtcatcagattatcagttaatggtcaaatctatgggaaattcactcgaggatattacaattactaaaaatccagttataagtacaataaaagaacgtatgttaaattctggagccgatgttgcattaatgacaggaagtggaccaactgttttttcaatgtgttctacagagaaaaaagctgatcgtgtttttaatagtatgaaaggtttttgcaaagaagtttataaagttaggttgttgaga

SEQ ID NO: 348 - protein, 283 aa, Streptococcus agalactiae
MKIFEKAPAKLNLGLDIKGRCDDGYHELAMIMVSIDLNDYVTISELKEDCIVIDSDSSKMPLNNDNDVFKAADIIKNQYGINKGVHIRLEKSIPVCAGLGGGSTDAAATIRALNRLWNLQMDYDEMVAIGFKIGSDVPYCLGGGCSLVLGKGEIVKPLPTLRPCWIVLVKPDFGISTKSIFRDIDCKSISRVDIDLLKSAILSSDYQLMVKSMGNSLEDITITKNPVISTIKERMLNSGADVALMTGSGPTVFSMCSTEKKADRVFNSMKGFCKEVYKVRLLR

SEQ ID NO: 349 - DNA, 156 bp, Streptococcus pyogenes
atgatggatattggtataccgattggtagtgatgtgccttattgcttgctttcaggttgtgcccaagtcactggtaaaggtgaagtggtttgtcgcattttggggctgttatcgtcttgggtggttttggttaaaccagattttggtatctcgact

SEQ ID NO: 350 - protein, 52 aa, Streptococcus pyogenes
MMDIGIPIGSDVPYCLLSGCAQVTGKGEVVCRILGLLSSWVVLVKPDFGIST

SEQ ID NO: 351 - DNA, 441 bp, Streptococcus agalactiae
atgacagttttagaacaaaaattagaccatttagtgagtcaaatcttgcttaaagcagaaaatcaacatgaattattgtttggtacttgtcaaagtgatgttaaattgactaatacgcaagaacacattctgatgcttttatcacaagagcagttgacaaattctgatttagctaagaagttaaatattagtcaggcagctgtaactaaagcagtaaaaagtttaatttctcaggatatgttgaaagcgaataaagattctaaagatgctcgtattacttattttgagttatctgaacttgctaaacccattgcagatgaacacacacatcatcatgacaatacgttaggggtttacggaagattagtaaatcatttttcaaaggacgaaaaggtcgttttagaacgttttcttgatcttttctctagagaattagaaggg

SEQ ID NO: 352 - protein, 147 aa, Streptococcus agalactiae
MTVLEQKLDHLVSQILLKAENQHELLFGTCQSDVKLTNTQEHILMLLSQEQLTNSDLAKKLNISQAAVTKAVKSLISQDMLKANKDSKDARITYFELSELAKPIADEHTHHHDNTLGVYGRLVNHFSKDEKVVLERFLDLFSRELEG

SEQ ID NO: 353 - DNA, 441 bp, Streptococcus pyogenes
atggggattttagaaaaaaaacttgataacttagtaaatactattttattaaaagcagaaaatcagcatgagttattatttggagcttgtcaaagtgacgttaagcttactaatacgcaagaacatattttaatgttactatctcagcaacgtctcactaatacagatttggctaaggcattaaatattagtcaggcggcagtaactaaggctatcaagagtttggtcaaacaagacatgttagcaggaactaaggatacggttgatgctagggtgacttattttgaattaaccgagttagctaagcctattgcgtcagaacatacccatcatcatgatgaaaccttaaatgtttacaaccgtttattacaaaaattctccgcgaaagaattagagattgtagataagtttgtaacagtttttgctgaggaattagaaggg

SEQ ID NO: 354 - protein, 147 aa, Streptococcus pyogenes
MGILEKKLDNLVNTILLKAENQHELLFGACQSDVKLTNTQEHILMLLSQQRLTNTDLAKALNISQAAVTKAIKSLVKQDMLAGTKDTVDARVTYFELTELAKPIASEHTHHHDETLNVYNRLLQKFSAKELEIVDKFVTVFAEELEG

SEQ ID NO: 355 - DNA, 708 bp, Streptococcus agalactiae
atgcgatatattacagttagtggtcttacttttcagtacgatagcgatcctgtgctggaaggggttaattaccatttagacagtggggagtttgttaccttaacaggtgaaaatggggctgctaaatcaactttaataaaggctactttaggtattttaacgcccaaagtgggtacagttaatatctctaaagaaaacaaagaaggaaaaaaattacgtattgcctatttacctcaacagattgcaagttttaacgctggctttccatcgtcagtttatgaatttgtgaaatctggacgataccctagaaatggttggtttagaagactgactaaacatgatgaagaacatattagggttagtttagaagctgttggtatgtgggataatcgccataaaaagataggaagtttatctggcggtcaaaagcagagggctgtcattgctaggatgtttgcttctgatccagatatttttgtattggatgagccaacaactggtatggacgcagggactactgagaaattttatgagttaatgcatcataatgctcataagcatggtaagtctgttttgatgattactcacgatcctgatgaagtaaaggggtatgctgaccgaaatattcatcttgttaggaaccaatctttaccatggcgttgtttcaatgtccatacaaacgaaatggaggttgaatcagatgctact

SEQ ID NO: 356 - protein, 236 aa, Streptococcus agalactiae
MRYITVSGLTFQYDSDPVLEGVNYHLDSGEFVTLTGENGAAKSTLIKATLGILTPKVGTVNISKENKEGKKLRIAYLPQQIASFNAGFPSSVYEFVKSGRYPRNGWFRRLTKHDEEHIRVSLEAVGMWDNRHKKIGSLSGGQKQRAVIARMFASDPDIFVLDEPTTGMDAGTTEKFYELMHHNAHKHGKSVLMITHDPDEVKGYADRNIHLVRNQSLPWRCFNVHTNEMEVESDAT

SEQ ID NO: 357 - DNA, 717 bp, Streptococcus pyogenes
atgagatacatatcagtgaaaaatctctcctttcaatatgaaagtgagccagttttagaagggatcacttatcatttagatagtggagaatttgtcaccatgaccggtgaaaatggtgctgcaaagtcaaccttaataaaagcaaccttaggaattttacaaccaaaggctggacgagttactattgctaaaaaaaataaagacggtaaacaattaagaattgcttacttgccgcagcaagtagctagctttaacgctggttttccatccaccgtttacgagtttgtcaaatcaggtcgctacccacgtagtggttggtttagacatttgaacaaacacgatgaagagcatgtgcaagcaagcttagaagcagtcggcatgtgggaaaaccgtcataagagaattggtagtttatcaggtggtcaaaaacaacgtgtggttattgcccgtatgtttgcttctgaccctgatatttttgtgctagacgagccaacaacgggaatggatagcggtactactgataccttttatgaactgatgcaccacagtgcacatcaacatgggaaatccgttctgatgattacccatgacccagaagaagtgaaggcttatgctgatcggaacattcatttagtcagaaaccaaaaacttccttggcgttgtttcaacattcatgaagctgaaacagatgacgaaaaaggaggtcatggtcatgct

SEQ ID NO: 358 - protein, 239 aa, Streptococcus pyogenes
MRYISVKNLSFQYESEPVLEGITYHLDSGEFVTMTGENGAAKSTLIKATLGILQPKAGRVTIAKKNKDGKQLRIAYLPQQVASFNAGFPSTVYEFVKSGRYPRSGWFRHLNKHDEEHVQASLEAVGMWENRHKRIGSLSGGQKQRVVIARMFASDPDIFVLDEPTTGMDSGTTDTFYELMHHSAHQHGKSVLMITHDPEEVKAYADRNIHLVRNQKLPWRCFNIHEAETDDEKGGHGHA

SEQ ID NO: 359 - DNA, 117 bp, Streptococcus agalactiae
ttgtatacagtacgcaaatactctaatacaactgccgccaaagtaacaacgaaaatagttgaccatgtaggcgagatacctaaaacaacgcctaatgcaacaccggctaaggaaacg

SEQ ID NO: 360 - protein, 39 aa, Streptococcus agalactiae
MYTVRKYSNTTAAKVTTKIVDHVGEIPKTTPNATPAKET

SEQ ID NO: 361 - DNA, 843 bp, Streptococcus agalactiae
atgtccatacaaacgaaatggaggttgaatcagatgctacttgatatgctttcctatgattttatgcaacgagcgctcttagcagttgtggctattagtatttttgctccaattttaggcatcttcctaattttacgtcgtcagagtttgatgagtgatactttgagtcacgtttccttagccggtgttgcattaggcgttgttttaggtatctcgcctacatggtcaactattttcgttgttactttggcggcagttgtattagagtatttgcgtactgtatacaaacattatatggaaatatcaactgctatcctgatgtcgatggggttggctatatctttaatcgttatgagtaaagctcataatgttggtaatgtcagtcttgaacagtatttatttggttctattattactattgggaaggaacaagtgattgctttgtttgttattgcattaatcacttttattttaaccatcctatttattagaccaatgtatatattaacgtttgatgaggatacagcttttgtagatggattgcctgtgcgtacaatgtctattttgttcaatgttgttacaggtattgctattgcattaacaattcctgccgcaggtgctctattggtgtcaactattatggttttaccagctagtattgctatgcggttaggtcgaaattttaaaactgttatttttctgggtatgttaattggatttgtgggaatggtagctggtattttcctttcgtattattgggagacacctgctagtgcaacaataacgatgatttttattggcattttcctattagttagcttagtaggcttgcttcgcaaacgt

SEQ ID NO: 362 - protein, 281 aa, Streptococcus agalactiae
MSIQTKWRLNQMLLDMLSYDFMQRALLAVVAISIFAPILGIFLILRRQSLMSDTLSHVSLAGVALGVVLGISPTWSTIFVVTLAAVVLEYLRTVYKHYMEISTAILMSMGLAISLIVMSKAHNVGNVSLEQYLFGSIITIGKEQVIALFVIALITFILTILFIRPMYILTFDEDTAFVDGLPVRTMSILFNVVTGIAIALTIPAAGALLVSTIMVLPASIAMRLGRNFKTVIFLGMLIGFVGMVAGIFLSYYWETPASATITMIFIGIFLLVSLVGLLRKR

SEQ ID NO: 363 - DNA, 819 bp, Streptococcus pyogenes
atggtcatgcttgatattttattctatgatttcatgcaacgggcggtaatggcggtagttgccattagtatttttgctccgattttaggtattttccttattttacgtcgtcaaagtttgatgagcgatacccttagtcatgtttctttggctggggtagcgcttggggtagtccttggtatttcaccaaccatcactactattattgttgtggttttagctgctattttgttagaatacctgcgtgtagtttacaaacactacatggagatttcaacggcgattttgatgtcacttggcttggccctatctctgattattatgagtaagtcgcatagttcatcaagcatgagtttagaacaatacctttttggatcgatcatcacgattagtatggaacaagttgtcgccttgtttgctattgctgcgattattttaatcttgaccgttctcttcattagaccgatgtacattctgacctttgatgaagatactgcttttgtagatggtttgcccgttcgcttgatgtctgttctattcaatatcgtcactggggttgctattgctttgaccattccagcagcaggagcacttttggtttctaccattatggtcttgccagcaagtatcgcaatgagattgggtaaaaactttaaaacagttatcttactgggaattgtcatcggttttagcggtatgttatctggtattttcttatcttatttctttgaaacgccagctagtgccactattaccatgattttcattagtattttcctcttagttagtctaggtggaatgcttaaaaaacggttattt

SEQ ID NO: 364 - protein, 273 aa, Streptococcus pyogenes
MVMLDILFYDFMQRAVMAVVAISIFAPILGIFLILRRQSLMSDTLSHVSLAGVALGVVLGISPTITTIIVVVLAAILLEYLRVVYKHYMEISTAILMSLGLALSLIIMSKSHSSSSMSLEQYLFGSIITISMEQVVALFAIAAIILILTVLFIRPMYILTFDEDTAFVDGLPVRLMSVLFNIVTGVAIALTIPAAGALLVSTIMVLPASIAMRLGKNFKTVILLGIVIGFSGMLSGIFLSYFFETPASATITMIFISIFLLVSLGGMLKKRLF

SEQ ID NO: 365 - DNA, 501 bp, Streptococcus agalactiae
gtgactccaatatacgaaggaaataatttagtacctagccgagttgaacttcagtatgttggaattgataaacaaggaaaacttctagaaatcaaattaggcggcggcaaagaacaagttgatgaatacggcgtcacaactgttacattagaaaatacgtctccactcgcaaaaattgattacaaaactggtatgctaatcaaagaagatgggaaacaggcagaagaaggtgaagatccaaatagcgatgctgatgaaaacgaagcagctattgaaagtgcatctgatatagaagaaaatactaacactaatacttctgaatcagatacaaataatgtagctccccaaaatagaatcgtctacgttgcaaataagggtcgttcaaatacttattggtatagtttagaaaacataaaaaatgcaaataccgctaatatcgttcaaatgactgaacaagaagcgttaaatcaacacaaacatcacagcactactgaagcacaa

SEQ ID NO: 366 - protein, 167 aa, Streptococcus agalactiae
MTPIYEGNNLVPSRVELQYVGIDKQGKLLEIKLGGGKEQVDEYGVTTVTLENTSPLAKIDYKTGMLIKEDGKQAEEGEDPNSDADENEAAIESASDIEENTNTNTSESDTNNVAPQNRIVYVANKGRSNTYWYSLENIKNANTANIVQMTEQEALNQHKHHSTTEAQ

SEQ ID NO: 367 - DNA, 804 bp, Streptococcus pyogenes
atggatatgtctaaatcaaatcgtcgtacttggcaaggtttagttgttattttaatagctattctcaccacttttaccacaagtactgttacggcagccagaaaaattagaaatttccctgataccacggaaattttgttaggaacgaaggcgactgagacaccaggaatcttaccattcactggtagctaccaattagttttgggcgatcttgacaatctgcaaaggccaaccttcgcacacatccagctaaaagatcaagatgagcctaatattaaacgaaaaggacttaaattcaatcctcctggctggcataattacaaattgactgacgctaatggaaaaacaacttggttaatggaccgtggccatttagttggttaccaatttagcggcttaaatgacgagcctaaaaacctagttacaatgacaaaatatcttaatactggctttagtgacaaaaatcctttaggaatgctctattatgaaaatagattagatagctggttagctctacaccctaacttctggctagactataaagttactcctgtttatcataaaaatgagttagttcctcgccaagtagttctacagtatgttggaattgatgaaaatggagatctacttcaaattaagttaggtagtgaaaaagaaagtgtagacaactttggagtaacatcagttacattagataacgtatctcctttagctgaattggattaccaaacaggaatgatgctagattcaactcaaaacgaagaagatagtaatttagaaaccgaagagtttgaagaagcggct

SEQ ID NO: 368 - protein, 268 aa, Streptococcus pyogenes
MDMSKSNRRTWQGLVVILIAILTTFTTSTVTAARKIRNFPDTTEILLGTKATETPGILPFTGSYQLVLGDLDNLQRPTFAHIQLKDQDEPNIKRKGLKFNPPGWHNYKLTDANGKTTWLMDRGHLVGYQFSGLNDEPKNLVTMTKYLNTGFSDKNPLGMLYYENRLDSWLALHPNFWLDYKVTPVYHKNELVPRQVVLQYVGIDENGDLLQIKLGSEKESVDNFGVTSVTLDNVSPLAELDYQTGMMLDSTQNEEDSNLETEEFEEAA

SEQ ID NO: 369 - DNA, 1257 bp, Streptococcus agalactiae
atgaatatttttgatgaactcaaagaacgtggactcgtttttcagacaactgacgaagatgctttacgcaaagctcttgaagaaggttctgtctcttactatactggctacgatcctacggctgacagccttcatcttggacatttagttgctattttaacctctcgtcgcttacaacttgctggtcacaagccttatgcacttgtgggaggcgcaactggacttattggggacccttcatttaaagatgttgagcgcagtttacaaacaaagaaaactgtagttagttggggtaataaaatccgcggtcaattatctaattttctagagtttgaaacaggtgataacaaagctgtattggtaaataattatgattggttcagcaatattagtttcattgatttcttacgagatgttggtaaatattttactgtcaattatatgatgagtaaagaatctgttaaaaaacgtatcgaaacagggatttcctatactgaatttgcttatcaaattatgcaaggatatgacttttacgaattaaataagaactataatgtcactttgcaaattggtggttctgaccaatggggcaacatgactgctggaaccgaacttattagacgaaaatcaaatggtgtatctcatgttatgactgttccattgataacagattctacaggaaaaaaattcggaaaatctgaaggaaatgctgtttggcttgatgctgacaaaacctctccttatgaaatgtaccaattttggctcaatgttatggatgctgatgccgttcgcttccttaagatttttacattcctaagccttaaagaaatagaagatatacgtattcaattcgaggaagcacctcaccaacgcttagcacaaaaaacactagcacgtgaagttgtaactcttgttcatggtgaaaaagcttataaggaggccgttaatatcacggaacagctatttgctggcaatataaaaggattgtctgttaaagagctcaaacaaggtttacgtggagtaccaaattatcacgttcagacggaagataacctcaatatcatagaccttctagtcacttcaggagttgtcaattctaaacgtcaagctcgagaagatgtctccaatggagctatttatattaatggagatcgtattcaagatttagaatatactatctcagaaaatgataagcttgaaaatgaaattacagtcattcgtcgtggaaagaaaaaatactttgtattaaactttaaa

SEQ ID NO: 370 - protein, 419 aa, Streptococcus agalactiae
MNIFDELKERGLVFQTTDEDALRKALEEGSVSYYTGYDPTADSLHLGHLVAILTSRRLQLAGHKPYALVGGATGLIGDPSFKDVERSLQTKKTVVSWGNKIRGQLSNFLEFETGDNKAVLVNNYDWFSNISFIDFLRDVGKYFTVNYMMSKESVKKRIETGISYTEFAYQIMQGYDFYELNKNYNVTLQIGGSDQWGNMTAGTELIRRKSNGVSHVMTVPLITDSTGKKFGKSEGNAVWLDADKTSPYEMYQFWLNVMDADAVRFLKIFTFLSLKEIEDIRIQFEEAPHQRLAQKTLAREVVTLVHGEKAYKEAVNITEQLFAGNIKGLSVKELKQGLRGVPNYHVQTEDNLNIIDLLVTSGVVNSKRQAREDVSNGAIYINGDRIQDLEYTISENDKLENEITVIRRGKKKYFVLNFK

SEQ ID NO: 371 - DNA, 1254 bp, Streptococcus pyogenes
atgaatatttttgaagaactcaaagctcgtggcttggtctttcaaacgactgatgaacaagcccttgtcaaagcattaacagaagggcaagtatcctattataccggttatgatccaaccgctgacagccttcatctgggccatctagtggctatcttaacatctcgtcgcttgcaactagcagggcacaaaccttacgctcttgtggggggtgccacaggtttaattggtgatccttcctttaaagatgcagagcgcagccttcaaaccaaagaaacagttttggagtggagtgacaagattaaagggcagttgtctactttccttgattttgaaaatggtgataataaagcagagcttgtcaacaactacgactggttctcgcaaatcagctttattgacttcctccgtgatgtcggtaaatacttcaccgttaactacatgatgagtaaagactctgttaaaaaacgcattgaaacaggcatttcttacactgagtttgcttaccaaatcatgcagggctacgacttctacgaactcaatgacaagcataatgtaaccttacaaattggcggctctgaccagtggggtaatatgacagctggtactgaattgctccgcaaaaaggctgataaaactgggcacgtcatgactgtaccactcatcactgactcaaccgggaaaaaattcggtaaatcagaaggtaatgctgtctggcttgatgccgataagacgtctccttacgagatgtaccaattctggttaaatgtcatggatgatgatgcagtgcgtttcttgaaaatcttcaccttcttatctctagatgagattgcagaaattgaaactcaatttaatgccgctcgtcacgagcgtctcgctcaaaaaaccttggcacgcgaagtggttaccttggttcatggcgaagaagcttataaacaagctcttaacattaccgagcagttatttgctggaaacatcaaaaatctttctgccaatgaattaaaacaaggattgagcaatgtaccaaattatcacgttcaatcaatagacaatcataatattgtcgagattttagtagctgctaagatttccccatcaaaacgccaggcgcgtgaagacgtgcaaaatggagcaatctacattaacggagaccgcgttcaagatttagattaccaattaagtaatgatgataaaattgatgatcaattaaccgttattcgccgcggtaagaaaaaatacgctgttctcacttac

SEQ ID NO: 372 - protein, 418 aa, Streptococcus pyogenes
MNIFEELKARGLVFQTTDEQALVKALTEGQVSYYTGYDPTADSLHLGHLVAILTSRRLQLAGHKPYALVGGATGLIGDPSFKDAERSLQTKETVLEWSDKIKGQLSTFLDFENGDNKAELVNNYDWFSQISFIDFLRDVGKYFTVNYMMSKDSVKKRIETGISYTEFAYQIMQGYDFYELNDKHNVTLQIGGSDQWGNMTAGTELLRKKADKTGHVMTVPLITDSTGKKFGKSEGNAVWLDADKTSPYEMYQFWLNVMDDDAVRFLKIFTFLSLDEIAEIETQFNAARHERLAQKTLAREVVTLVHGEEAYKQALNITEQLFAGNIKNLSANELKQGLSNVPNYHVQSIDNHNIVEILVAAKISPSKRQAREDVQNGAIYINGDRVQDLDYQLSNDDKIDDQLTVIRRGKKKYAVLTY

SEQ ID NO: 373 - DNA, 2295 bp, Streptococcus agalactiae
atgtttaaaggtaataagaagttgaatagttctaaattaggtgattacacaccacttgaatttggttctatttttttaagaattgtaaagcttttatcagatttcatctatgttattattttactatttgttatgctcggagtaggacttgcagtagggtatcttgctagtcaagttgactctgttaaagtaccaagtaaaaatagtttagtgacacaagttaatacacttactagggtgtctaggttaacttattctgataaatcacaaatttcagagattgccactgatttacaacgtacaccagtggcaaaggatgctatatctgataatattaaaaaggctatcattgcaacagaggacgaaaatttcaatgaccataaaggtgtagttcccaaagccgtactacgtgctgcagcgggatctgttctggggtttggagagagtagcggtggttcaacgctgacacaacaattattaaagcagcaaattttgggagatgatccgtcatttaaacgcaaatcaaaagaaattatttatgctctagcattagagcgttacatggataaggattcgattttatcagattatttaaatgtatcaccgtttggtcgcaataacaaaggacagaatattgcaggtattgaagaagcagcacaagggatttttggagtttccgcaaaagatttaacaattcctcaggcagctttccttgcaggtttaccgcaaagtcctattgtatattctccttatactgcagatgcccagttgaaatcagataaagatcttagttttggtataaagcgccaaaaaaatgtgttatacaatatgtatagaacgagagctttaaccaaagatgagtacaaatcctacaaagattatgacatcaaaaaagattttatcaaacctgcagtggcgacaacaaatcatcatgattatctttactactcggcattatctgaagctcaaaaagtgatgtacaattacctcattaaaaaggataatgtttcagagcatgatttaaaaaatgatgagactagagcgacgtacagacaccgcgctattgaagagattcaacagggagggtatactattaaaactactatcaataaatctgtttatcaagccatgcaggatgctgcagctcaatacggagggttgttagatgatggtactggcaaggttcaaatgggaaatgtactaacggacaattctagtggtgctattataggatttattggtggtcgtaactatagtgagaatcaaaataaccatgcttttgatacggcacgctctccagggtcaagtattaaaccgatattaccttacggaattgctattgatcaagggatgttaggaagtggtagtgttctttcaaattatccaacgacatattcaagtggcgaaaagattatgcatgcggatgaagaaggtactgctatggttaaccttcaagagtcattggacatttcttggaacattccagctttctggacttacaagatgctacgagatcgaggcgttgatgtaaaaaactatatggagaaattagactatccaattgaaaactttggtatagaaagtttaccacttggtggtggtattgatacgtcagttgctcagcaaacaaacctttatcaaatgattgcaaatggtggtgtttatcataagcagtatatgatagaaagtatagaggatagtaatgggaaagtgatttataatcacgaaagtaaacctgtccgtgtcttttcgaaagcaacagctactatcttacagcagctattacatggaccaattaactccggaaagactacaacctttaaaaatcgcttacaaggtttaaatagtggtttagctggggtagattggattggaaaaacgggtactactaactcaacttctgatgtttggttgatgctttctacacctaaagtgactttaggtggatgggcaggacatgataataatgcctctttagcgaaattgacaggttacaataataatgctaattatatggctcacttggttaatgctattaataatgcagatggcaatacttttggtaagtcagaaaggtttagacttgatgatagcgttataaaagctaaagttcttaagtctacaggtttacagccaggtgtagtaacagtaaacggtcgtcgaatcactgttggaggtgaaagcacaacaagttattgggcaaaaaatggacctggaacgatgacctatcgttttgctattgggggaactgatagtgattatcaaaaagcttggtctactttgggtggaaaacga

SEQ ID NO: 374 - protein, 765 aa, Streptococcus agalactiae
MFKGNKKLNSSKLGDYTPLEFGSIFLRIVKLLSDFIYVIILLFVMLGVGLAVGYLASQVDSVKVPSKNSLVTQVNTLTRVSRLTYSDKSQISEIATDLQRTPVAKDAISDNIKKAIIATEDENFNDHKGVVPKAVLRAAAGSVLGFGESSGGSTLTQQLLKQQILGDDPSFKRKSKEIIYALALERYMDKDSILSDYLNVSPFGRNNKGQNIAGIEEAAQGIFGVSAKDLTIPQAAFLAGLPQSPIVYSPYTADAQLKSDKDLSFGIKRQKNVLYNMYRTRALTKDEYKSYKDYDIKKDFIKPAVATTNHHDYLYYSALSEAQKVMYNYLIKKDNVSEHDLKNDETRATYRHRAIEEIQQGGYTIKTTINKSVYQAMQDAAAQYGGLLDDGTGKVQMGNVLTDNSSGAIIGFIGGRNYSENQNNHAFDTARSPGSSIKPILPYGIAIDQGMLGSGSVLSNYPTTYSSGEKIMHADEEGTAMVNLQESLDISWNIPAFWTYKMLRDRGVDVKNYMEKLDYPIENFGIESLPLGGGIDTSVAQQTNLYQMIANGGVYHKQYMIESIEDSNGKVIYNHESKPVRVFSKATATILQQLLHGPINSGKTTTFKNRLQGLNSGLAGVDWIGKTGTTNSTSDVWLMLSTPKVTLGGWAGHDNNASLAKLTGYNNNANYMAHLVNAINNADGNTFGKSERFRLDDSVIKAKVLKSTGLQPGVVTVNGRRITVGGESTTSYWAKNGPGTMTYRFAIGGTDSDYQKAWSTLGGKR

SEQ ID NO: 375 - DNA, 2310 bp, Streptococcus pyogenes
atgaggtattttatggtgaaatggaacacgaaacaaaagcgtataagtcatcaaagattaggtctcttggatttggggccggtgctattacgtacgttgagactactgtctaactttttttatattgttatcttcctttttggaatgatgggatttggtatggcatttgggtatttggctagtcagattgaatctgttaaggtaccaagtaaagaaagtttagtcaaacaagttgaatcattaacgatgatttcgcaaatgaactattctgataatagtttaatttctactttagatacggatttacttcgaacaccagtagctaatgatgcgatttcagagaatatcaaaaaagctattgtatcaacagaagacgaacattttcaagaacataaaggtatcgtgccaaaagctgtttttcgggcaacattggcttctgtattgggatttggagaagctagtggaggttcgaccttaacacagcaattagtcaagcaacaagttttgggagacgatcccacatttaagcgcaagtctaaggagatcgtttacgctcttgccttagagcgttatatgtccaaagacaatatcttatgtgattatcttaatgtttcaccttttggccgtaacaacaagggtcaaaatattgctggtgttgaagaagctgcgcgtggcatttttggcgtttctgccaaagatttaacggtgccacaggcagcatttttggcgggtcttccgcagagtcctattgtttactctccttatttgtcaacgggacaactgaaatcagaaaaggacatggcttatggcatcaagcgtcagcaaaatgttctctttaacatgtaccgtacaggtgttctgtctaaaaaagaatacgaggactataaggcttatccgattcaaaaggattttattcaaccgggaagtgcaatagtaaataatcacgattacctttattacacggtgttagcggatgctaagaaagccatgtatagctatttgattaagcgagataaggtgtctagtcgtgacttgaaaaatgacgagactaaggctgcttatgaagagagagccttaacagaattgcaacagggtggctataccatcaccacaaccattaataagcctatttacaatgcgatgcagacagcggcagctcagtttggtggcttgttagatgatggcactggtacagttcaaatgggaaatgtcttgacagacaatgcgactggtgctgtgttaggttttgttggtggtagagattatgctctgaatcaaaataatcatgctttcaatacagttagatcgccaggttctagcattaaaccgataatcgcttatggtcctgctattgatcaaggtttaatggggagtgctagcgttttgtctaattacccaacaacttactcgagtggccaaaaaatcatgcatgctgatagtgaaggaacagccatgatgccacttcaagaggccctaaatacttcttggaacatcccagctttttggacacagaaattactgcgtgaaaaaggtgtcgatgtcgaaaattatatgacaaaaatgggttataagattgcagactactcgattgaaagtttacctctagggggcggtattgaagtctcggttgctcaacaaaccaatgcttaccaaatgctttcaaacaatggcttatatcaaaagcaatatattgtagataagattactgctagcgatggtacagtcgtttacaaacatgaaaataagccaattcgtattttttctgcagcaacagctacgattttacaagaattgttgagaggtccgattacttcaggcgctacgactactttcaagaaccgtttggcggctattaatccgtggcttgctaatgctgattggattggtaagaccggaacaactgagaattatacggatgtttggctagtcctgtctactccaaaagttactttaggcggttgggcaggacatgatgacaatacctcattagcgccattaacaggatataacaataattctaattatcttgcctatttagctaatgccattaatcaggccgatcccaatgttattggagtagggcaacgcttcaacttagatccaggagtcattaaggcgaatgtcttgaagtcaacaggtttacaaccaggaactgttaatgtcaatggacatactttttctgttggtggagaaatgaccaccagtctatggtcccaaaaaggaccgggggctatgacttaccgatttgctattggtggcacggatgccgattatcaaaaagcctgggggaacttcgggttcagaaaaaat

SEQ ID NO: 376 - protein, 770 aa, Streptococcus pyogenes
MRYFMVKWNTKQKRISHQRLGLLDLGPVLLRTLRLLSNFFYIVIFLFGMMGFGMAFGYLASQIESVKVPSKESLVKQVESLTMISQMNYSDNSLISTLDTDLLRTPVANDAISENIKKAIVSTEDEHFQEHKGIVPKAVFRATLASVLGFGEASGGSTLTQQLVKQQVLGDDPTFKRKSKEIVYALALERYMSKDNILCDYLNVSPFGRNNKGQNIAGVEEAARGIFGVSAKDLTVPQAAFLAGLPQSPIVYSPYLSTGQLKSEKDMAYGIKRQQNVLFNMYRTGVLSKKEYEDYKAYPIQKDFIQPGSAIVNNHDYLYYTVLADAKKAMYSYLIKRDKVSSRDLKNDETKAAYEERALTELQQGGYTITTTINKPIYNAMQTAAAQFGGLLDDGTGTVQMGNVLTDNATGAVLGFVGGRDYALNQNNHAFNTVRSPGSSIKPIIAYGPAIDQGLMGSASVLSNYPTTYSSGQKIMHADSEGTAMMPLQEALNTSWNIPAFWTQKLLREKGVDVENYMTKMGYKIADYSIESLPLGGGIEVSVAQQTNAYQMLSNNGLYQKQYIVDKITASDGTVVYKHENKPIRIFSAATATILQELLRGPITSGATTTFKNRLAAINPWLANADWIGKTGTTENYTDVWLVLSTPKVTLGGWAGHDDNTSLAPLTGYNNNSNYLAYLANAINQADPNVIGVGQRFNLDPGVIKANVLKSTGLQPGTVNVNGHTFSVGGEMTTSLWSQKGPGAMTYRFAIGGTDADYQKAWGNFGFRKN

SEQ ID NO: 377 - DNA, 3573 bp, Streptococcus agalactiae
ttggcaggacatgaagttcagtacggaaaacaccgtacacgtcgtagcttttcaagaattaaggaagttcttgatttaccaaacttaattgaaattcaaactgattcattccaagattttcttgatgctggcttgaaagaagtatttgaggatgtacttccaatttcaaactttacagatactatggatcttgaatttgttggttatgaattaaaagaacctaaatatactttggaagaagctcgtatccatgatgctagctactcagcacctatttttgttactttccgtttagttaataaagaaactggtgaaattaaaactcaagaagttttctttggtgattttccaattatgactgaaatgggtactttcatcatcaatggtggtgaacgtatcattgtttcacaattagtccgttctcctggtgtttactttaatgataaggtagataaaaatggaaaagttggttatgggtcaactgttatccctaaccgtggagcttggttggaacttgagacagacgcaaaagatattgcttatacacgtatcgaccgcacacgtaaaattccatttacaacactagtccgtgcacttggtttctctggagacgatgaaattgttgacatctttggtgacagtgaacttgttcgcaatactattgaaaaagacattcataaaaatccaagtgattctcgtacagatgaagcacttaaagaaatctatgaacgtcttcgtccaggtgaaccaaaaactgcagacagctcacgtagtcttttagttgcacgtttctttgatccacgtcgttatgacttagcggctgttggtcgttataagattaataaaaaactgaatcttaaaacacgcctattgaaccaaacaatcgctgaaaatttagttgatggtgaaacaggagagattcttgttgaagctggaaccgttatgacacgagatgtcattgattcaattgcagagcatatcgatggagacttaaacaagtttgtctacacaccaaatgattatgctgtagttactgaaccagttattcttcaaaaattcaaagttgttgctccaactgatccagaccgtgttgttactattgttggaaactcaaatcctgaagataaagttcgtgccttaactcctgcagatattttagcagagatgtcatacttcttaaaccttgcagagggtatcggtaaggtagatgacattgaccatttaggtaaccgtcgtattcgtgcagttggtgaattacttgcgaaccaattccgtatcggacttgctcgtatggaacgcaatgtccgcgaacgtatgtctgtacaagacaatgaagtcttgacacctcaacaaatcattaacattcgtccagtgactgccgccgttaaagaattctttggttcatcacagctgtcacaattcatggaccaacacaaccctctatcagaattgtcgcacaaacgccgtctctctgccttaggacctggtggtttgacacgtgaccgtgctggatatgaagttcgtgacgtgcactatacccactatgggcgcatgtgtccgattgaaacacctgaaggtccaaacattggtttgattaataacttatcttcatttggacacctcaataaatatggatttattcaaacaccatatcgtaaagtagatcgttctactggtgcggtaacgaacgaaattgtttggttgactgctgatgaagaagatgaatttacagttgcacaagccaactctaagcttaacgaagacggtacatttgcagaagaaatcgttatgggtcgtcatcaaggtaataaccaagagtttccttcaagcattgttgactttgttgacgtgtcacctaagcaagtagttgctgtcgcaacagcatgtattcctttcttggaaaatgatgactctaaccgtgccttgatgggtgccaacatgcaacgtcaggctgtgccattgattgatccaaaagcaccatatgttggtactggtatggagtatcaagcagcccacgattcaggtgcagctgtgattgctaaacatgatggtcgtgttattttttcagatgctgaaaaagttgaagtgcgtcgcgaagatggttctcttgatgtttatcatgttcaaaaattccgccgttcaaactcaggtactgcttataaccaacgtaccttagttaaagttggtgatctcgttgaaaaaggtgattttatcgccgacggaccatctatggaaaatggtgaaatggctcttggacaaaacccagttgttgcttatatgacttgggaaggttataacttcgaggatgccgttatcatgagtgagcgccttgtgaaagaagatgtctatacatctgttcacttggaagaattcgaatctgaaacgcgtgatacaaagcttgggcctgaagaaattactcgtgaaattccaaatgttggtgaagattcactacgtgatctcgatgaaatgggaattatccgcattggtgctgaggtaaaagaaggtgacattcttgttggtaaggtaacacctaagggtgaaaaggacttatctgctgaagaacgtctcttgcatgccatttttggtgataaatcacgtgaagttcgtgatacttcactacgtgtacctcacggtggcgatggagtagttcgtgacgttaaaatctttactcgtgcaaatggtgatgaattgcaatcaggtgttaatatgcttgtccgcgtttatatcgctcaaaaacgtaaaatcaaagtcggtgataagatggccggtcgtcacggaaacaaaggtgtcgtctcacgtattgttcctgttgaagatatgccttacttaccagatggaacgccagttgatatcatgttgaacccacttggggtgccatcacgtatgaatatcggacaagttatggagcttcatttaggtatggctgctcgtaatttaggtattcatattgcaacgccagtctttgatggggcttcttcagaagacctttgggaaactgttcaagaagcaggtatggattcagatgctaagactgttctttatgatggtcgtactggtgaaccattcgataaccgtgtgtcagttggtgtcatgtacatgatcaaacttcaccacatggttgatgataaacttcatgcccgttcagtaggaccatactcacttgttactcaacaaccacttggaggtaaagctcaatttggtggacaacgttttggtgagatggaggtttgggcgcttgaagcttatggtgcttcaaatgttcttcaagaaattttaacatacaaatctgatgatgttacaggacgtcttaaagcttatgaagctatcacaaaaggtaagccaattccaaaaccaggtgttccagaatcattccgtgttcttgtaaaagaattgcaatcacttggtcttgatatgcgtgtccttgatgaagatgacaacgaagttgaactccgtgatcttgatgaaggtgaagatgatgatgtgatgcacgttgatgaccttgaaaaagcacgtgtgaaacaagaagctgaagaaaaacaagctgaacaagtatctgaagtcgttcaagaagat

SEQ ID NO: 378 - protein, 1191 aa, Streptococcus agalactiae
MAGHEVQYGKHRTRRSFSRIKEVLDLPNLIEIQTDSFQDFLDAGLKEVFEDVLPISNFTDTMDLEFVGYELKEPKYTLEEARIHDASYSAPIFVTFRLVNKETGEIKTQEVFFGDFPIMTEMGTFIINGGERIIVSQLVRSPGVYFNDKVDKNGKVGYGSTVIPNRGAWLELETDAKDIAYTRIDRTRKIPFTTLVRALGFSGDDEIVDIFGDSELVRNTIEKDIHKNPSDSRTDEALKEIYERLRPGEPKTADSSRSLLVARFFDPRRYDLAAVGRYKINKKLNLKTRLLNQTIAENLVDGETGEILVEAGTVMTRDVIDSIAEHIDGDLNKFVYTPNDYAVVTEPVILQKFKVVAPTDPDRVVTIVGNSNPEDKVRALTPADILAEMSYFLNLAEGIGKVDDIDHLGNRRIRAVGELLANQFRIGLARMERNVRERMSVQDNEVLTPQQIINIRPVTAAVKEFFGSSQLSQFMDQHNPLSELSHKRRLSALGPGGLTRDRAGYEVRDVHYTHYGRMCPIETPEGPNIGLINNLSSFGHLNKYGFIQTPYRKVDRSTGAVTNEIVWLTADEEDEFTVAQANSKLNEDGTFAEEIVMGRHQGNNQEFPSSIVDFVDVSPKQVVAVATACIPFLENDDSNRALMGANMQRQAVPLIDPKAPYVGTGMEYQAAHDSGAAVIAKHDGRVIFSDAEKVEVRREDGSLDVYHVQKFRRSNSGTAYNQRTLVKVGDLVEKGDFIADGPSMENGEMALGQNPVVAYMTWEGYNFEDAVIMSERLVKEDVYTSVHLEEFESETRDTKLGPEEITREIPNVGEDSLRDLDEMGIIRIGAEVKEGDILVGKVTPKGEKDLSAEERLLHAIFGDKSREVRDTSLRVPHGGDGVVRDVKIFTRANGDELQSGVNMLVRVYIAQKRKIKVGDKMAGRHGNKGVVSRIVPVEDMPYLPDGTPVDIMLNPLGVPSRMNIGQVMELHLGMAARNLGIHIATPVFDGASSEDLWETVQEAGMDSDAKTVLYDGRTGEPFDNRVSVGVMYMIKLHHMVDDKLHARSVGPYSLVTQQPLGGKAQFGGQRFGEMEVWALEAYGASNVLQEILTYKSDDVTGRLKAYEAITKGKPIPKPGVPESFRVLVKELQSLGLDMRVLDEDDNEVELRDLDEGEDDDVMHVDDLEKARVKQEAEEKQAEQVSEVVQED

SEQ ID NO: 379 - DNA, 3564 bp, Streptococcus pyogenes
ttggcaggacatgaagttcgatacggaaaacaccgtacacgtcgtagcttttcaagaatcaaagaagttcttgatttaccaaatttgattgaaattcaaactgactcattccaagatttcctcgattcaggtttgaaagaagtatttgaagatgtacttcctatttcaaactttacggatactatggaacttgaatttgttggttacgaatttaaagaacctaaatatacccttgaagaagctcgtatccacgatgcaagttattctgcaccaatctttgttaccttccgtttggtcaataaagaaactggtgagattaaaactcaagaagtcttctttggtgatttcccaatcatgacggaaatgggtacctttattatcaatggtggtgaacgtatcatcgtttctcagttggtgcgttctccaggtgtttatttcaacgataaagttgataaaaacggtaaagttggttacggatcaacagtgattcctaaccgtggggcttggttggaattagagactgactcaaaagacattgcctacactcgtattgaccgtacccgtaagattccattcacaaccttggttcgtgcccttggtttctcaggtgatgatgaaattgttgatatctttggtgaaagcgaccttgttcgtaataccattgaaaaagacattcacaaaaatccaagtgattctcgtacagacgaagcccttaaagaaatttacgagcgtcttcgtccaggtgagccaaaaactgcagatagctctcgtagtcttttgattgcgcgtttctttgatgcacgtcgttacgatttggctgcggttggtcgttacaaagtgaacaaaaaacttaatatcaagactcgtcttttgaaccaaatcattgctgaaaaccttgtggatgctgaaactggcgaaattttggtagaagctggaactgagatgactcgtagcgtcatcgaatccatcgaagaacaccttgacggtgatttgaacaagtttgtttacacaccaaatgattacgctgtggttactgaaccagttgtccttcaaaagttcaaggttgtgtcaccaattgatcctgatcgtgtagtaactattgttggtaatgccaatccagatgataaggttcgtgcattgacacctgctgatattttggcagaaatgtcttacttcttgaaccttgctgaaggtcttggaaaagttgacgatattgaccacttgggtaaccgtcgtatccgtgccgttggtgaattgcttgccaaccaattccgcatcggtcttgctcgtatggagcgtaacgtgcgtgagcgtatgtctgttcaagacaacgatgtgttaacaccacaacaaatcatcaatatccgtcctgtcacagcagctgtcaaagaattcttcggttcgtctcagttgtcacagttcatggaccaacacaacccattgtcagagttgtctcacaaacgtcgtttatctgccttaggacctggtggtttgacacgtgaccgtgctggttatgaggttcgtgacgtgcattacacgcactatggccgtatgtgtccgattgaaacacctgaaggaccaaacattggtttgattaataacttgtcttcatttggacatcttaataaatatggtttcatccaaacaccttaccgtaaggttgaccgtgcgactggtacggtaactaacgagattgtttggttgactgccgacgaagaagacgaatacacagttgcacaggccaattcgaaactaaacgaagatggcacttttgctgaagaaatcgttatgggtcgtcaccaaggtaataaccaagaattttctgcaagtgttgttgatttcgttgacgtttcccctaaacaggtagttgctgttgcgacggcatgtattcctttcttggaaaacgatgactccaaccgtgccctcatgggtgccaacatgcaacgtcaggctgtgccattgattgatccaaaagcaccatatgttggtactggtatggaatatcaagctgcccatgactcaggcgctgcggtgattgctcagcaaaatggtaaagttgtcttttctgatgctgaaaaagtggaaatccgtcgtcaagatggctcgcttgatgtttaccacattaccaaattccgtcgttcaaactcaggaacagcctataaccaacgcacccttgttaaagtaggagacattgttgaaaaaggtgatttcatcgctgatggaccttctatggaaaatggtgaaatggctcttggacaaaacccagtcgttgcttacatgacttgggaaggttataactttgaggatgccgttatcatgagtgagcgccttgtgaaagaagatgtctacacatctgttcacttggaagaattcgaatctgaaacgcgtgatacaaaacttggccctgaagaaatcactcgggaaatcccaaatgttggtgaagaagccctcaaagaccttgacgaaatgggcattatccgtatcggtgctgaggttaaagaaggcgacatcttagtaggtaaagtcacacctaaaggtgaaaaagacctttctgctgaagaacgtttacttcacgccatctttggggataaatcgcgtgaagtgcgtgatacctcacttcgtgtccctcacggtggtgatggtatcgttcgtgatgtgaaaatctttacacgcgctaacggcgatgaattgcaatcaggtgttaatatgcttgtgcgtgtttacatcgctcaaaaacgtaaaatcaaggtcggagataaaatggccggtcgtcacggaaacaagggtgtcgtttcacgtattgtaccagttgaagacatgccataccttccagacggaacaccagttgacatcatgttgaaccctcttggggtgccatcacggatgaatattggtcaggttatggaacttcaccttggtatggctgctcgtaatcttggtattcacattgcaacacctgtctttgacggggcttcatcagaagacctttgggacactgttcgtgaagctggtatggatagcgatgctaagacggtcctttatgatggtcgcaccggtgaaccatttgacaaccgtgtatccgttggtgtcatgtatatgatcaaacttcaccacatggttgatgataaacttcatgcccgttctgtaggaccatactcacttgttacccaacagccacttggtggtaaagctcaatttggtggacaacgttttggtgagatggaggtttgggcccttgaagcttatggtgcatcaaatgttcttcaagaaatcttgacctacaagtcagatgacgtcacaggacgtttgaaagcctatgaagcgattactaaaggtaaaccaattccaaaaccaggtgtaccagaatccttccgtgttcttgtaaaagaattgcaatcgcttggtcttgatatgcgtgtgcttgacgaggatgataatgaagtggaacttcgtgatcttgatgaaggtgaagacgatgacattatgcatgttgacgatctcgagaaggcacgtgaaaaacaagctcaagaaactcaagaagtttctgaaacaactgacgaaaaa

SEQ ID NO: 380 - protein, 1188 aa, Streptococcus pyogenes
LAGHEVRYGKHRTRRSFSRIKEVLDLPNLIEIQTDSFQDFLDSGLKEVFEDVLPISNFTDTMELEFVGYEFKEPKYTLEEARIHDASYSAPIFVTFRLVNKETGEIKTQEVFFGDFPIMTEMGTFIINGGERIIVSQLVRSPGVYFNDKVDKNGKVGYGSTVIPNRGAWLELETDSKDIAYTRIDRTRKIPFTTLVRALGFSGDDEIVDIFGESDLVRNTIEKDIHKNPSDSRTDEALKEIYERLRPGEPKTADSSRSLLIARFFDARRYDLAAVGRYKVNKKLNIKTRLLNQIIAENLVDAETGEILVEAGTEMTRSVIESIEEHLDGDLNKFVYTPNDYAVVTEPVVLQKFKVVSPIDPDRVVTIVGNANPDDKVRALTPADILAEMSYFLNLAEGLGKVDDIDHLGNRRIRAVGELLANQFRIGLARMERNVRERMSVQDNDVLTPQQIINIRPVTAAVKEFFGSSQLSQFMDQHNPLSELSHKRRLSALGPGGLTRDRAGYEVRDVHYTHYGRMCPIETPEGPNIGLINNLSSFGHLNKYGFIQTPYRKVDRATGTVTNEIVWLTADEEDEYTVAQANSKLNEDGTFAEEIVMGRHQGNNQEFSASVVDFVDVSPKQVVAVATACIPFLENDDSNRALMGANMQRQAVPLIDPKAPYVGTGMEYQAAHDSGAAVIAQQNGKVVFSDAEKVEIRRQDGSLDVYHITKFRRSNSGTAYNQRTLVKVGDIVEKGDFIADGPSMENGEMALGQNPVVAYMTWEGYNFEDAVIMSERLVKEDVYTSVHLEEFESETRDTKLGPEEITREIPNVGEEALKDLDEMGIIRIGAEVKEGDILVGKVTPKGEKDLSAEERLLHAIFGDKSREVRDTSLRVPHGGDGIVRDVKIFTRANGDELQSGVNMLVRVYIAQKRKIKVGDKMAGRHGNKGVVSRIVPVEDMPYLPDGTPVDIMLNPLGVPSRMNIGQVMELHLGMAARNLGIHIATPVFDGASSEDLWDTVREAGMDSDAKTVLYDGRTGEPFDNRVSVGVMYMIKLHHMVDDKLHARSVGPYSLVTQQPLGGKAQFGGQRFGEMEVWALEAYGASNVLQEILTYKSDDVTGRLKAYEAITKGKPIPKPGVPESFRVLVKELQSLGLDMRVLDEDDNEVELRDLDEGEDDDIMHVDDLEKAREKQAQETQEVSETTDEK

SEQ ID NO: 381 - DNA, 3678 bp, Streptococcus agalactiae
atgatgataaatcgaagaaaggtaaaactagtggttgacgtaaatcgttttaaaagtatgcaaatcacattagcatcaccaagtaaggtccgttcatggtcttatggtgaagttaaaaaacctgaaacaatcaactaccgcacattgaaaccagaacgtgaaggactttttgatgaagttatttttggtccaacaaaagattgggaatgtgcgtgtggaaaatacaaacgtattcgttacaaaggaatcatttgtgaccgttgtggcgttgaagtaacccgtgcaaaagttcgtcgcgaacgtatgggacatatcgagttaaaagcaccagtatctcatatctggtatttcaaaggtatcccatcgcgtatggggctcacattggatatgagtcctcgtgcacttgaagaagttatttattttgcggcttatgttgttatcgatccaatggacacaccattagaaccgaagtcactccttactgagcgtgaataccgtgaaaaacttcaagagtacggttacggttcgtttgttgctaaaatgggtgctgaagccattcaagatcttcttaaacgcgttgatttagatgcagaaatcgcagttcttaaagaggagttgaaatcagcgacaggtcaaaaacgtgtgaaagcagttcgtcgtctggatgtgttagatgcctttaaaaaatctggaaataaaccagaatggatggttcttaacattttaccggttatcccaccggatcttcgtccgatggttcaattagatggtggtcgttttgcggcatcagacttgaatgacctttaccgccgtgttattaaccgtaacaatcgtttggcacgtttgttggaattaaatgctcctggcatcatcgttcaaaatgaaaaacgtatgttacaagaagctgttgatgcgcttatcgacaatggtcgtcgtggtcgtccaattaccggaccaggtagtcgtcctttgaaatcattaagccatatgcttaaaggtaaacaaggtcgtttccgccaaaacttgcttggtaaacgtgttgacttctctggacgttccgttattgctgttggtccaacactcaaaatgtaccaatgtggtgtaccacgtgaaatggctattgagctcttcaaaccttttgtaatgcgtgaaatcgttgctcgtgacctcgcagggaacgttaaagcagctaaacgtatggttgaacgtggggacgagcgtatttgggacatcttagaagaagttattaaagagcacccagtacttctaaaccgtgcacctactcttcacagattaggtatccaagcgtttgaacctgtccttattgatggtaaggcgcttcgtcttcacccacttgtatgtgaggcctacaatgctgactttgatggagaccaaatggccatccacgttccattgtctgaagaagcccaagcagaagctcgtcttttgatgcttgctgcagagcacatccttaaccctaaagatggtaagccagtcgtaacaccatctcaggacatggttttaggaaattactacctgactatggaagatgctggtcgtgaaggtgaaggcatgattttcaaagatcatgacgaagcagttatggcatatcaaaatggttatgttcatttacatacacgtgttggtatcgctgttgattcaatgccgaataagccttggacagaagagcaaaaacataaaatcatggttacaacagttggtaagattctcttcaacgatatcatgcctgaagatttaccgtacttaattgaacctaataatgcaaacttgacagaaaaaactccagataaatacttcttagagccaggtcaggatattcaagcagttattgataacttagagattaatattccctttaagaagaaaaatcttggtaatattatcgcagaaacttttaaacgtttccgtacaacagaaacttctgctttccttgaccgtttgaaggaccttggatattatcattcaacacttgctggtttgactgtgggtattgctgatatcccagttattgacaataaagctgagattattgatgcagctcaccacagagttgaagatatcaataaagccttccgtcgaggtttgatgactgaagaagatcgttatgttgctgttacaacaacatggcgtgaagctaaagaagcacttgaaaaacgtcttattgagacacaagatccaaagaaccctatcgttatgatgatggactcaggagctcgtggtaacatctcaaacttctcacaacttgccggtatgcgtggtttgatggctgctcctaacggacgtatcatggaattgccaatcttatcaaacttccgtgaaggtcttagtgttttggaaatgttcttctcaactcacggtgcgcgtaaaggtatgactgatacggcccttaagacagccgactcaggttaccttactcgtcgtttggttgacgttgcccaagatgttattattcgtgaagatgactgtggaacagaccgcggtttgacaatcacagcaattacagatggtaaagaggttactgagacacttgaagagcgtttgataggacgttatactaagaagtcaatcaaacatcctgagacaggtgaaattctcgttggtgcagataccttaattactgaagatatggctgctaaagttgttaaagcgggcgttgaggaagtaactatccgatcagtatttacatgtaacactcgccatggtgtttgtcgtcactgttacggtattaacttggcaacaggtgatgctgttgaggttggtgaagcagttggtactattgcagctcaatctatcggtgaaccagggacacagcttacaatgcgtaccttccataccggtggtgttgcttcaaatactgatattacacaaggtctcccacgtatccaagaaatctttgaagcacgtaaccctaaaggtgaggcagttattactgaagttaagggtgaagtcgttgcaattgaagaagactcttcaacacgtactaagaaagtattcgttaaaggtcagacaggtgagggagaatacgttgttccatttacagcacgtatgaaagttgaagttggtgatgaagtagctcgtggtgcggccttaactgaaggatctatccaaccaaaacgtctccttgaagttcgtgatactttatctgttgaaacgtacctacttgctgaagtacaaaaagtttaccgtagccaaggggtagaaatcggagataaacacgttgaggtaatggttcgtcaaatgctccgtaaagttcgtgtcatggatccaggagatacagatcttcttccaggtacacttatggatatttcagactttacagatgctaacaaagatattgttatttctggtggaatccctgcgacaagccgtcctgtccttatgggtattactaaggcttcccttgaaactaattcattcttatcagctgcatccttccaagaaacaacacgtgtccttacagatgctgctatccgtggtaagaaagatcacttacttggtcttaaagaaaatgttattatcggtaaaatcattccagcgggtactggtatggctcgttaccgtaatattgaaccacttgctgttaatgaagttgagattattgaaggaactcctgttgatgcagaagttacggaagtatcaacacctacaacagaagat

SEQ ID NO: 382 - protein, 1226 aa, Streptococcus agalactiae
MMINRRKVKLVVDVNRFKSMQITLASPSKVRSWSYGEVKKPETINYRTLKPEREGLFDEVIFGPTKDWECACGKYKRIRYKGIICDRCGVEVTRAKVRRERMGHIELKAPVSHIWYFKGIPSRMGLTLDMSPRALEEVIYFAAYVVIDPMDTPLEPKSLLTEREYREKLQEYGYGSFVAKMGAEAIQDLLKRVDLDAEIAVLKEELKSATGQKRVKAVRRLDVLDAFKKSGNKPEWMVLNILPVIPPDLRPMVQLDGGRFAASDLNDLYRRVINRNNRLARLLELNAPGIIVQNEKRMLQEAVDALIDNGRRGRPITGPGSRPLKSLSHMLKGKQGRFRQNLLGKRVDFSGRSVIAVGPTLKMYQCGVPREMAIELFKPFVMREIVARDLAGNVKAAKRMVERGDERIWDILEEVIKEHPVLLNRAPTLHRLGIQAFEPVLIDGKALRLHPLVCEAYNADFDGDQMAIHVPLSEEAQAEARLLMLAAEHILNPKDGKPVVTPSQDMVLGNYYLTMEDAGREGEGMIFKDHDEAVMAYQNGYVHLHTRVGIAVDSMPNKPWTEEQKHKIMVTTVGKILFNDIMPEDLPYLIEPNNANLTEKTPDKYFLEPGQDIQAVIDNLEINIPFKKKNLGNIIAETFKRFRTTETSAFLDRLKDLGYYHSTLAGLTVGIADIPVIDNKAEIIDAAHHRVEDINKAFRRGLMTEEDRYVAVTTTWREAKEALEKRLIETQDPKNPIVMMMDSGARGNISNFSQLAGMRGLMAAPNGRIMELPILSNFREGLSVLEMFFSTHGARKGMTDTALKTADSGYLTRRLVDVAQDVIIREDDCGTDRGLTITAITDGKEVTETLEERLIGRYTKKSIKHPETGEILVGADTLITEDMAAKVVKAGVEEVTIRSVFTCNTRHGVCRHCYGINLATGDAVEVGEAVGTIAAQSIGEPGTQLTMRTFHTGGVASNTDITQGLPRIQEIFEARNPKGEAVITEVKGEVVAIEEDSSTRTKKVFVKGQTGEGEYVVPFTARMKVEVGDEVARGAALTEGSIQPKRLLEVRDTLSVETYLLAEVQKVYRSQGVEIGDKHVEVMVRQMLRKVRVMDPGDTDLLPGTLMDISDFTDANKDIVISGGIPATSRPVLMGITKASLETNSFLSAASFQETTRVLTDAAIRGKKDHLLGLKENVIIGKIIPAGTGMARYRNIEPLAVNEVEIIEGTPVDAEVTEVSTPTTED

SEQ ID NO: 383 - DNA, 3639 bp, Streptococcus pyogenes
gtggttgacgtaaatcgttttaaaagtatgcaaatcacattagcctcaccaagtaaggtccgttcatggtcttatggtgaagttaaaaaacctgaaacaatcaactaccgtacattaaaaccagaacgtgaaggactctttgacgaagtcatctttggtccaacaaaagactgggaatgtgcgtgtggtaagtacaaacgtatccgttataaagggatcgtttgtgatcgctgtggggttgaggtaactcgtgctaaagtacgtcgtgaacgtatgggtcacattgagttaaaagctcctgtatcacatatctggtatttcaaagggattccatctcgtatgggattgactcttgatatgagtcctcgtgcccttgaagaagtgatctattttgcggcttatgtggtcattgatccaaaagatacaccgcttgaaccaaaatcattattaacagaacgtgaataccgtgaaaaactacaagagtatggtcatgggtcatttgtcgctaagatgggtgctgaagccattcaagatctcttgaaacgtgtggacttggcagctgaaatcgctgaattaaaagaagagttgaaatctgcttctggtcaaaaacggattaaagcagttcgtcgtttagacgtccttgatgcctttaacaaatctggaaataaaccagaatggatggttcttaacatcctgccggttattccaccagatcttcgtccgatggttcaattggatggtggtcgttttgcggcatcagacttgaatgacttgtaccgtcgtgtgattaaccgtaataaccgtttggcacgtttgttagaacttaatgcccctggcatcattgttcaaaatgaaaaacgaatgcttcaagaagccgttgatgctttgattgataatggtcgtcgtggtcgtccaatcactggaccaggaagtcgtccattgaaatcattgagccacatgcttaaaggtaaacaagggcgtttccgtcaaaacttgcttggtaaacgtgtagacttctctggacgttccgttatcgctgttggtccaacccttaaaatgtatcaatgtggtgtcccacgtgaaatggctatcgagctttttaaaccatttgtaatgcgcgaaattgttgccaaagaatatgctggtaacgttaaagccgctaaacgtatggttgaacgtggcgacgaacgcatctgggatatcttagaagaagttatcaaagaacacccagtcctacttaaccgcgcaccgactcttcacagacttggtattcaggcttttgaacccgttcttattgacggtaaggcacttcgtcttcacccacttgtgtgtgaggcctacaatgccgacttcgatggagaccaaatggccattcacgtgccactttcagaagaagcacaagctgaagctcgtcttttgatgcttgctgcagagcacatcttgaaccctaaagatggtaaaccagttgttactccatctcaggatatggttcttggtaactactatcttacgatggaagatgctggtcgcgaaggcgaaggtatgattttcaaggataaagacgaagctgtgatggcatatcgtaatggttatgctcatcttcatagtcgtgtgggtatcgctgttgacagcatgccaaacaaaccttggaaagacaatcaaagacataaaatcatggtgacaactgttggtaagattctctttaacgatatcatgccagaggaccttccttacctccaagagccaaacaatgccaacttgacagaaggaacacctgataaatacttccttgaacctggtcaagacatccaagaagtgattgatcgcttagacatcaatgtgccatttaagaagaaaaacctcggtaacatcattgcggaaaccttcaaacgtttccgtacaacagaaacatcagccttccttgaccgcttgaaagaccttggttactaccactcaacccttgctggtttgacagtgggtatcgctgacattcctgttattgataataaagctgaaatcattgatgctgctcaccatcgtgttgaagaaattaacaaagccttccgtcgtggtttgatgacagatgatgaccgttatgttgccgttacaacaacatggcgtgaagctaaagaagcccttgaaaaacgtctgattgaaacacaagatcctaagaacccaatcgttatgatgatggactcaggagctcgtggtaacatctcaaacttctcacagcttgctggtatgcgtggtttgatggctgctcctaacggacgcatcatggaacttcctatcttgtcaaacttccgtgaaggtttgagcgttttggaaatgttcttctcaacccacggtgcacgtaaagggatgaccgatacggcccttaaaacagccgactcaggttaccttactcgtcgtttggttgacgttgcccaagatgttatcattcgtgaggacgattgtggcactgatcgtggtcttcttatccgtgctattacagatggtaaagaagttaccgaaacgcttgaagagcgtcttcaaggtcgttacacacgtaaatcagtcaaacaccctgaaactggtgaagtcttgattggtgctgaccaattaatcactgaagacatggctcgtaagattgttgatgcaggtgttgaagaagtgaccattcgttctgtctttacctgtgcgactcgtcatggtgtctgccgtcactgttatggtatcaacttggcaactggtgatgctgttgaagtgggtgaagcagttggtactattgctgcccaatctatcggtgagcctggtactcagcttaccatgcgtaccttccacacgggtggtgtagcctcaaataccgatatcacccagggtcttcctcgtattcaagagatctttgaagcacgtaatcctaaaggggaagcggtcattactgaagtgaaagggaatgtcgtcgagattgaagaagatgcgtcaactcgtaccaagaaagtctacgttcaaggaaaaactggcatgggcgaatatgtcataccatttacagcacgtatgaaagttgaagttggcgacgaagttaatcgcggagctgcccttacagaagggtcaattcaaccgaaacgtctccttgaagtgcgtgataccttgtcagttgaaacgtaccttcttgcagaagtacaaaaagtttaccgtagccaaggggtagaaatcggagacaaacacgttgaggtaatggttcgccaaatgcttcgtaaagttcgtgtcatggatccaggtgatacagacctccttccaggtacacttatggatatttctgatttcacagatgctaacaaagatattgttatctctggtggtattcctgcgacatctcgtcctgttcttatgggtattactaaggcttcccttgaaaccaattccttcttatcagctgcatccttccaagaaacaactcgtgttcttacagatgctgctatccgtggtaaaaaagatcatcttcttggtcttaaagaaaatgttatcattggtaaaatcatcccagctggtactggtatggctcgttaccgtaacattgaaccacaagcgatgaatgagattgaagtgattgatcatacagaagtctcagcagaagccgtttttacagcagaagcagaa

SEQ ID NO: 384 - protein, 1213 aa, Streptococcus agalactiae
VVDVNRFKSMQITLASPSKVRSWSYGEVKKPETINYRTLKPEREGLFDEVIFGPTKDWECACGKYKRIRYKGIVCDRCGVEVTRAKVRRERMGHIELKAPVSHIWYFKGIPSRMGLTLDMSPRALEEVIYFAAYVVIDPKDTPLEPKSLLTEREYREKLQEYGHGSFVAKMGAEAIQDLLKRVDLAAEIAELKEELKSASGQKRIKAVRRLDVLDAFNKSGNKPEWMVLNILPVIPPDLRPMVQLDGGRFAASDLNDLYRRVINRNNRLARLLELNAPGIIVQNEKRMLQEAVDALIDNGRRGRPITGPGSRPLKSLSHMLKGKQGRFRQNLLGKRVDFSGRSVIAVGPTLKMYQCGVPREMAIELFKPFVMREIVAKEYAGNVKAAKRMVERGDERIWDILEEVIKEHPVLLNRAPTLHRLGIQAFEPVLIDGKALRLHPLVCEAYNADFDGDQMAIHVPLSEEAQAEARLLMLAAEHILNPKDGKPVVTPSQDMVLGNYYLTMEDAGREGEGMIFKDKDEAVMAYRNGYAHLHSRVGIAVDSMPNKPWKDNQRHKIMVTTVGKILFNDIMPEDLPYLQEPNNANLTEGTPDKYFLEPGQDIQEVIDRLDINVPFKKKNLGNIIAETFKRFRTTETSAFLDRLKDLGYYHSTLAGLTVGIADIPVIDNKAEIIDAAHHRVEEINKAFRRGLMTDDDRYVAVTTTWREAKEALEKRLIETQDPKNPIVMMMDSGARGNISNFSQLAGMRGLMAAPNGRIMELPILSNFREGLSVLEMFFSTHGARKGMTDTALKTADSGYLTRRLVDVAQDVIIREDDCGTDRGLLIRAITDGKEVTETLEERLQGRYTRKSVKHPETGEVLIGADQLITEDMARKIVDAGVEEVTIRSVFTCATRHGVCRHCYGINLATGDAVEVGEAVGTIAAQSIGEPGTQLTMRTFHTGGVASNTDITQGLPRIQEIFEARNPKGEAVITEVKGNVVEIEEDASTRTKKVYVQGKTGMGEYVIPFTARMKVEVGDEVNRGAALTEGSIQPKRLLEVRDTLSVETYLLAEVQKVYRSQGVEIGDKHVEVMVRQMLRKVRVMDPGDTDLLPGTLMDISDFTDANKDIVISGGIPATSRPVLMGITKASLETNSFLSAASFQETTRVLTDAAIRGKKDHLLGLKENVIIGKIIPAGTGMARYRNIEPQAMNEIEVIDHTEVSAEAVFTAEAE

SEQ ID NO: 385 - DNA, 363 bp, Streptococcus agalactiae
atgtatcaagttgtaaaaatgtttggtgattgggaaccatggtggtttattgaaggttgggaggaagatattactgaaattgctgagtatgataccttatcagaagctttgctctattttcaagaggagtgggataggggacaggaaaagtggccttattttcaaagtaagtctagtttgttggcaacgttttggagtataaaagaaaaacgttggtgtgaagaatgtgatgagtacctccaacagtatcattccttaatgttattgaaagaatggcaagaaattcctaaggaagaatctattgagcgatttgaagtatttaataagatagctgagttgccatcggcatgttctttaaatttg

SEQ ID NO: 386 - protein, 121 aa, Streptococcus agalactiae
MYQVVKMFGDWEPWWFIEGWEEDITEIAEYDTLSEALLYFQEEWDRGQEKWPYFQSKSSLLATFWSIKEKRWCEECDEYLQQYHSLMLLKEWQEIPKEESIERFEVFNKIAELPSACSLNL

SEQ ID NO: 387 - DNA, 363 bp, Streptococcus pyogenes
atgtatcaagtaattaaaatgtatggtgattgggagccttggtggttcatcgatggatggcaagacgatattatagatgagcaacaatttagtgactggcaagaagcgcttgattattttaatcaagaatggcagcgcatgaaagctatttttcctagttatcatagtcaaaagaatttgttagctactttttgggaaaaagaagataaaagatggtgcgaggactgtgacgaagatttgcagcagtttcattctcttttactccttaaaaataaagatattgtaccaagcaataattatatccctgaatttgaacaacgaaatgattcaccacaggtagcttatctttgcaagttaaacctt

SEQ ID NO: 388 - protein, 121 aa, Streptococcus pyogenes
MYQVIKMYGDWEPWWFIDGWQDDIIDEQQFSDWQEALDYFNQEWQRMKAIFPSYHSQKNLLATFWEKEDKRWCEDCDEDLQQFHSLLLLKNKDIVPSNNYIPEFEQRNDSPQVAYLCKLNL

SEQ ID NO: 389 - DNA, 969 bp, Streptococcus agalactiae
atggttcaatcattagcaaagcaagtcattcatcaggcagtagaagtaaatgctcaagatatttatatcattcccaaaggtgattgttatgaactctatatgcgtattgatgatgaaaggcggtttattgatgtttttgagtttaataggatggctagtcttattagtcactttaaatttgtggcaggcatgaacgttggagaaaaaagacgaagtcaattaggttcttgtgactatgaactgtcagagggaagactggtttcattacgactatcgagtgtgggagattatcgtggtcaagaatctttagttattcgtattttgtattcaggtcatcaggacttaaaatattggtttgataatataaagcaaatgaaggaagtactgggtataagagggctatatcttttttccggccctgtggggagtggtaaaacaactctcatgtatcaattagcttcagaagtatttaaaaataagcaaattatcacgattgaagatccggtagaaatcaagaatgacaagatgttacaactccaattgaatgaggatattggaatgacttatgatgctttaatcaaactgtctttacggcatcgtccagatattttaattatcggagagattagagatcaagcgacggcccgtgctgttattcgtgcaagtttaacgggagtgatggttttttctactattcatgctaaaagtattcccggagtctatgataggcttatagaattaggggttaactatcaagagttagaaaatagtctaaaattaatagcatatcaacgtttaattggaggaggaagcctaattgactttgagacaggtaattttaaaaaacactcatcagacaagtggaatagacaagtggatatcttggctgaagaaggacatatcagtaagaaacaggcacaagtcgaaaaaattatccctcaagaaacaacggaaagtagtccaactttt

SEQ ID NO: 390 - protein, 323 aa, Streptococcus agalactiae
MVQSLAKQVIHQAVEVNAQDIYIIPKGDCYELYMRIDDERRFIDVFEFNRMASLISHFKFVAGMNVGEKRRSQLGSCDYELSEGRLVSLRLSSVGDYRGQESLVIRILYSGHQDLKYWFDNIKQMKEVLGIRGLYLFSGPVGSGKTTLMYQLASEVFKNKQIITIEDPVEIKNDKMLQLQLNEDIGMTYDALIKLSLRHRPDILIIGEIRDQATARAVIRASLTGVMVFSTIHAKSIPGVYDRLIELGVNYQELENSLKLIAYQRLIGGGSLIDFETGNFKKHSSDKWNRQVDILAEEGHISKKQAQVEKIIPQETTESSPTF

SEQ ID NO: 391 - DNA, 936 bp, Streptococcus pyogenes
atggtacaagcattagcaaaagctattctagcaaaagctgaacaggttcatgcacaagatatttatattttgccaagagcagatcaatatgatctttttttacgaataggagatgaaaggagattagttgatgtttatcagagcgatcggatggctcctcttattagtcactttaaattcgttgcaggaatgatagttggtgaaaagagacgttgtcaggtgggttcatgtgattataagcttagtaaagataagcagttatctttgcgcttatctagcgtgggtgattatcgcgggcaagaaagcttagtgattcgtctgcttcatcatcaaaataaaagtgtacattattggtttgatggattgacaaaagtagccaatcaggttggcggtagagggttgtatttatttgcaggaccagttgggtctgggaagacaaccttgatgtaccagctgatttcgaattatcatcaagaagcacaggttattagtatagaagatcctgtagaaattaaaaatcaccaaattttacaattacaagtgaatgatgatattggtatgacttatgacaatttgatcaaactgtctttacgccatcgaccagatattttagttattggtgagattcgagatagtcaaacagcaagagccgttattagggctagtctaacaggtgccatggttttttcaacggttcacgctaaaagtatctcgggtgtttatgcaagattgttagaacttggtgtaacgaaagcagaactgtctaattgcttagcattaattgcttaccaaaggttacttaatggaggagcattgattgactctactcaaaacgaatttgaatattattcctcatcgaactggaatcaacaaattgatcagcttcttgaggcaggacatctcaatcccaagcaagctaagcttgaaaaaattatc

SEQ ID NO: 392 - protein, 312 aa, Streptococcus pyogenes
MVQALAKAILAKAEQVHAQDIYILPRADQYDLFLRIGDERRLVDVYQSDRMAPLISHFKFVAGMIVGEKRRCQVGSCDYKLSKDKQLSLRLSSVGDYRGQESLVIRLLHHQNKSVHYWFDGLTKVANQVGGRGLYLFAGPVGSGKTTLMYQLISNYHQEAQVISIEDPVEIKNHQILQLQVNDDIGMTYDNLIKLSLRHRPDILVIGEIRDSQTARAVIRASLTGAMVFSTVHAKSISGVYARLLELGVTKAELSNCLALIAYQRLLNGGALIDSTQNEFEYYSSSNWNQQIDQLLEAGHLNPKQAKLEKII

SEQ ID NO: 393 - DNA, 900 bp, Streptococcus agalactiae
atggtcaccttcttaaagaggagtaagttattgtctgattgttatacagatagtatgaataaggcattattagagggaaaagatttatcaaaaatgttaggagagttaggtttttctgacactgttatcacacaggttgcattagctgatttgcatggtaacatttcaaggagcctactaaagattgagtcttatttagctaatcttttgttagttagaaaaaaagtaatagaagtagctacttacccattgatattattgtcttttctggtgctaattatgattggccttaggaattatttaatgccccaattaggagaaaataattttgcaactagactgattacaaatgtgccgaatattttcttattacttttagcagttgtacttatttttagtttaatattttatattattcaaaagcgattgtcgcgcattaaagtagcttgttttttaacaacaattcccttagttggatcatatgttaagctttatttaactgcttactatgcccgtgagtggggaaatttattaagtcaaggtattgaattggaccaaattgttaaagtaatgcaaaatcagaaatccaaactttttagggaaataggatatgacatggaagaaggttttctatcaggtaaagcatttcaccaaaaagtattagactatccgtttttcttaactgagcttagtttaatgattgaatatggccaagttaaggcgaaattaggaacagagttagatatatatgctgatgagaagtgggaggatttttttacaaaattagctagagcgacccagttaatccaacccgttatttttatttttgtagctcttatcattgttatgatttatgcagcaatgctgttaccaatgtatcaaaatatggagatattatca

SEQ ID NO: 394 - protein, 300 aa, Streptococcus agalactiae
MVTFLKRSKLLSDCYTDSMNKALLEGKDLSKMLGELGFSDTVITQVALADLHGNISRSLLKIESYLANLLLVRKKVIEVATYPLILLSFLVLIMIGLRNYLMPQLGENNFATRLITNVPNIFLLLLAVVLIFSLIFYIIQKRLSRIKVACFLTTIPLVGSYVKLYLTAYYAREWGNLLSQGIELDQIVKVMQNQKSKLFREIGYDMEEGFLSGKAFHQKVLDYPFFLTELSLMIEYGQVKAKLGTELDIYADEKWEDFFTKLARATQLIQPVIFIFVALIIVMIYAAMLLPMYQNMEILS

SEQ ID NO: 395 - DNA, 1032 bp, Streptococcus pyogenes
ttgatcagcttcttgaggcaggacatctcaatcccaagcaagctaagcttgaaaaaattatctagtaaacatcagcataaattcattcaattactagctaatcttttatctacaggatttagcttcgcagaggttattgcttttttaaaaagaagccagttgcttcagctagattatgttcttaaaatggaagagtctttattaaaaggacaaggcttagcagatatgttgtcgggtttaggtttttcagatgctattcttactcaaattagtttagctgatagacacggtaatattgaaacaacattagtagcgattcaacattacttgaaccaaatggcaaggatcagacgaaaaactgttgaagttatcacctatcctcttattcttttactttttctttttgtgatgatgctagggttgagacgctatttagtccctcaattagaaactcaaaatcagataacttactttcttaaccattttcctgccttctttataggtttttgctcaggtcttattttgttgttcgggatggtatggctacgatggcgatctcaaagccgcttgaaactctatagtcggctaagccgttatccttttttaggtaaactgttaaaacaatacttaactagttattatgctagagaatggggtacgttaataggtcaaggtcttgatttgatgactattttagacattatggccattgagaaatcctcactaatgaaagaattagctgaggacatcagaatgagtctgcttgaagggcaagcctttcacattaaagtagctacctaccctttttttaaaaaagaattaagtttaatgattgaatacggtgaaatcaaatcgaaactgggggctgagttggaaatctatgcccaggaaagctgggaacaattttttagtcagctttatcaagtgacacaacttattcaaccagctatttttttagtagttgctgtgacaatcgtcatgatttatgcggcaatcctattaccaatttaccaaaatatgggaggtattttt

SEQ ID NO: 396 - protein, 344 aa, Streptococcus pyogenes
LISFLRQDISIPSKLSLKKLSSKHQHKFIQLLANLLSTGFSFAEVIAFLKRSQLLQLDYVLKMEESLLKGQGLADMLSGLGFSDAILTQISLADRHGNIETTLVAIQHYLNQMARIRRKTVEVITYPLILLLFLFVMMLGLRRYLVPQLETQNQITYFLNHFPAFFIGFCSGLILLFGMVWLRWRSQSRLKLYSRLSRYPFLGKLLKQYLTSYYAREWGTLIGQGLDLMTILDIMAIEKSSLMKELAEDIRMSLLEGQAFHIKVATYPFFKKELSLMIEYGEIKSKLGAELEIYAQESWEQFFSQLYQVTQLIQPAIFLVVAVTIVMIYAAILLPIYQNMGGIF

SEQ ID NO: 397 - DNA, 453 bp, Streptococcus agalactiae
atgaaaaatttattgttaaaatgtaaggataagaaggttaaagcatttacacttttagaatgtttggtagcattggttacaatcacaggagctttactagtttatcaaggactgacaaaattgttggctcaacagatagtagtgatgtcttcttccagtcagtctgaatgggtgttattaactcagcaactaaatgcagaatttgaaggcgctcatctggaatatttaagacagaacaaactttatttacgtaagcaagataagattgtaacctttggcaaatctaataaagatgatttccgtaagacaggttatgatggtcgaggttatcaaccaatggtttatgggttagacaattgtcaaatgagtcagaccaaaagtatggtaaaacttgttttttattttaaggacgggttaaaaaggacattttactatgattttaaagaagaaact

SEQ ID NO: 398 - protein, 151 aa, Streptococcus agalactiae
MKNLLLKCKDKKVKAFTLLECLVALVTITGALLVYQGLTKLLAQQIVVMSSSSQSEWVLLTQQLNAEFEGAHLEYLRQNKLYLRKQDKIVTFGKSNKDDFRKTGYDGRGYQPMVYGLDNCQMSQTKSMVKLVFYFKDGLKRTFYYDFKEET

SEQ ID NO: 399 - DNA, 432 bp, Streptococcus pyogenes
ttgagtaaacaattaagtaacataaaagcttttacccttctagaggcgttaatagccttactcgtgatatcagggtctttattggtttatcaaggtttgacccgaaccctccttaaacatagccattatctagcccgtcatgatcaagataattggctcttattttctcatcaattgcgagaggagttaagtggagcaaggttttacaaagtagctgataataaactatacgttgaaaaaggaaagaaagtactagcttttggccaatttaaaagtcatgattttcgaaaatcagctagtaatggaaaagggtatcaacccatgttatttggaatatcacgtagtcatattcacatagagcagtcacagatttgcattactttaaagtggaaaagtgggttagaaaggactttttattatgcctttcaagac

SEQ ID NO: 400 - protein, 144 aa, Streptococcus pyogenes
LSKQLSNIKAFTLLEALIALLVISGSLLVYQGLTRTLLKHSHYLARHDQDNWLLFSHQLREELSGARFYKVADNKLYVEKGKKVLAFGQFKSHDFRKSASNGKGYQPMLFGISRSHIHIEQSQICITLKWKSGLERTFYYAFQD

SEQ ID NO: 401 - DNA, 972 bp, Streptococcus agalactiae
atgaattttgaaaaaattgagacagcctatgagctgattttagaaaatatccaaacgattgagaaccaattaaaaactcatatttatgatgccttaattgaacagaactcttattaccttggttcaagttgtgatttagatatggttgtggtgaataaccaaaaattacgtcaacttgacttaagtcaagaagaatggcgtcgcactttccagttcatttttatcaaatctgcgcaaacagagcaattacaagctaatcatcagtttacgccagatagtattggttttatcttgttatttcttttggaagaattaacgagtcaagagacagtggatgtcttggaaattggaagtggaactgggaatttagctcagactctcctcaataacagctcgaaagagttaaattatatgggcattgaagttgatgatcttttgattgatctatcagcaagcattgctgaaattataggttctagtgcccaatttatccaagaggatgctgttagaccacaaattttgaaagaaagcgatgtaatcattagtgatttaccagttggctattatcctaatgatggtattgctaaacgatatgctgtatcaagttctaaagagcacacctatgctcaccatctattgatggagcaatctcttaaatatttgaaaaaagatggaatcgctatatttttagcacccgaaaaccttttaacaagtccacaaagtgatttgctgaaggagtggttaaaaggatatgcagatgtcattgccgttttaactctaccagaaactatttttggaagtcgtcaaaatgcgaaatctatatttgttctcaagaagcaagcagaacaaaaaccagaaacctttgtatatccgctgacagatttgcaaaatcgtgagaatatggcaaacttcattgaaaattttcaaaaatggagcagagaaaatagtcattactcaaaaaatatgataaaa

SEQ ID NO: 402 - protein, 324 aa, Streptococcus agalactiae
MNFEKIETAYELILENIQTIENQLKTHIYDALIEQNSYYLGSSCDLDMVVVNNQKLRQLDLSQEEWRRTFQFIFIKSAQTEQLQANHQFTPDSIGFILLFLLEELTSQETVDVLEIGSGTGNLAQTLLNNSSKELNYMGIEVDDLLIDLSASIAEIIGSSAQFIQEDAVRPQILKESDVIISDLPVGYYPNDGIAKRYAVSSSKEHTYAHHLLMEQSLKYLKKDGIAIFLAPENLLTSPQSDLLKEWLKGYADVIAVLTLPETIFGSRQNAKSIFVLKKQAEQKPETFVYPLTDLQNRENMANFIENFQKWSRENSHYSKNMIK

SEQ ID NO: 403 - DNA, 996 bp, Streptococcus pyogenes
gtgacacttcttttcatttcaagtgtaatttggtatgataaggttatgacttttgaaaaaattgaagaagcttatcagctgctcttagagaactgtcaactaattgaaaatgatctaaaaacacatatatacgatgccattgttgaacaaaactccttttatttaggggctgagggagctagtcctcaagttgctcaaaatagtgataaactgaaagccttgtgcctgacaaaagaagaatggcgtaaggcctaccagtttctttttattaaggcagctcagactgagcaactccaagccaaccatcagttcacaccagatgctattggcttcattctgctgtatcttttggaacaattgagtgataaagatagcttagaggtacttgagattggaagtggaacagggaacctagcccaaacccttctcaacaacacgagcaagagccttgattatgtagggattgaacttgatgatctcttgattgatctgtcagccagtattgctgagataatggattcttcagctcattttattcaagaagatgcggtaaggcctcaattactaaaagaaagtgacattgtcatcagtgacttaccagttggttattatcctaacgatgatattgccaaacggtacaaggtggctagttcagataagcatacctatgcccatcatttattaatggaacagtctttaaaatacttgaaaaaagacggttttgcgatttttctggcaccagtcaatttattgacgagccctcagagccagttgttgaaacagtggttaaaagattatgctcaggtggtgaccttgattacgctaccagattctatttttggtcatccctcaaatgccaagtccattattgtcttacaaaaacaaacagaccacccaatggaaacctttgtctatccaattcgggatttgaagcttgcagagaatattcatgattttatggaaaatttcaaaaaatggaaactgagtaatgtcaat

SEQ ID NO: 404 - protein, 332 aa, Streptococcus pyogenes
VTLLFISSVIWYDKVMTFEKIEEAYQLLLENCQLIENDLKTHIYDAIVEQNSFYLGAEGASPQVAQNSDKLKALCLTKEEWRKAYQFLFIKAAQTEQLQANHQFTPDAIGFILLYLLEQLSDKDSLEVLEIGSGTGNLAQTLLNNTSKSLDYVGIELDDLLIDLSASIAEIMDSSAHFIQEDAVRPQLLKESDIVISDLPVGYYPNDDIAKRYKVASSDKHTYAHHLLMEQSLKYLKKDGFAIFLAPVNLLTSPQSQLLKQWLKDYAQVVTLITLPDSIFGHPSNAKSIIVLQKQTDHPMETFVYPIRDLKLAENIHDFMENFKKWKLSNVN

SEQ ID NO: 405 - DNA, 1191 bp, Streptococcus agalactiae
atgtcaaaaacaatagcaattaatgctggaagttcaagtttgaaatggcaattatatgaaatgccagaggagaaagtagttgccaaagggattatcgaacgtattggtttgaaagattctatttcgactgtaaaatttgacgataaaaaagatgaacaaattttagatatcgtagatcatacccaagctgttaaaattcttttagaagatctaacaaaacatggtattatcaaagactttaatgaaattacaggtgttggtcatcgtgtcgttgctggtggtgaatattttaaagagtctgctttagtagatgataaagttgtagaacaggttgaagaattatcagctttagctccactccacaacccagcagctgcagcagggattcgtgcgtttagagaaatcttaccagatatcacgagtgtatgtgtatttgatacagccttccatacaacaatgcaacctcatacctacttatatccaatcccacaaaagtactatactgattataaagtacgtaaatacggtgcacacgggacaagccaccaatacgttgcacaagaagcagctaagcaattaggacgtcctttagaagaattaaaattaatcacagcacatgtgggtaatggtgtttctattacagcaaattatcatggacagtctattgatacatcaatgggattcacaccacttgcaggaccaatgatgggaacacgttcaggagacattgatcctgcgattatcccttatcttgtagctaatgatccagaattggaagatgcagcagctgttgttaatatgcttaacaaacaatcaggattgcttggagtatcaggaacttcaagtgatatgcgagatattgaagcaggtcttcaaagtaaagatccaaatgcagtgttagcctataatgtctttattgaccgtattaagaaatttattggacaatacttggcagtattaaatggcgcggatgctattatttttactgcaggtatgggagaaaatgcgccattaatgcgtcaagatgttatcgcaggattatcatggtttggcattgaacttgatccagaaaaaaatgtttttggttattttggagatatcacaaaaccagattcaaaagtgaaggttttagttattcctactgatgaagaattaatgattgcgcgtgacgttgagcgccttaaagctaaa

SEQ ID NO: 406 - protein, 397 aa, Streptococcus agalactiae
MSKTIAINAGSSSLKWQLYEMPEEKVVAKGIIERIGLKDSISTVKFDDKKDEQILDIVDHTQAVKILLEDLTKHGIIKDFNEITGVGHRVVAGGEYFKESALVDDKVVEQVEELSALAPLHNPAAAAGIRAFREILPDITSVCVFDTAFHTTMQPHTYLYPIPQKYYTDYKVRKYGAHGTSHQYVAQEAAKQLGRPLEELKLITAHVGNGVSITANYHGQSIDTSMGFTPLAGPMMGTRSGDIDPAIIPYLVANDPELEDAAAVVNMLNKQSGLLGVSGTSSDMRDIEAGLQSKDPNAVLAYNVFIDRIKKFIGQYLAVLNGADAIIFTAGMGENAPLMRQDVIAGLSWFGIELDPEKNVFGYFGDITKPDSKVKVLVIPTDEELMIARDVERLKAK

SEQ ID NO: 407 - DNA, 1194 bp, Streptococcus pyogenes
atgtcaaagacaattgcaattaatgcaggtagttctagtttaaaatggcaactttatcagatgccagaagaagcagtgttagcacaaggaattattgagcgtatcggtctcaaggattctatttcaacagttaagtacgatggcaaaaaagaagagcaaattcttgatattcacgatcatacagaagctgttaaaatcttattgaacgatttgattcactttggaatcattgcagcttatgatgaaattacaggagttggacaccgtgttgttgctggtggtgaacttttcaaagaatccgttgtggttaatgacaaagttcttgaacagattgaagaattatccgttttagctccacttcacaatcctggagcggcggcagggattcgtgccttccgtgatattttgccagatattaccagtgtttgtgtgtttgacacgtcatttcacactagcatggcaaagcatacttacctttacccaattcctcaaaaatattatacggactacaaggttcgtaaatatggggcgcatgggacaagtcataaatatgtagcgcaagaagctgctaaaatgcttggtcgtccattagaagaattaaaactaattactgctcatattggaaatggtgtctcaattacagctaattaccacggtaaatcagttgatacctcgatgggctttacaccacttgctggtcctatgatgggaacacgttctggtgacattgacccagctatcattccttatttaattgagcaagacccagagttaaaagacgctgctgacgttgttaatatgttaaacaaaaaatcaggtcttagtggggtgtcaggcatttctagtgatatgcgtgatatcgaggctggtttacaagaagataatccagatgctgttttagcttacaatatctttattgatcgcattaaaaaatgcattggtcaatattttgctgttttgaatggagcagatgctttggtctttacagctggtatgggtgaaaatgcaccattgatgcgtcaagatgttattggtggcttaacatggttcggaatggacattgatcctgagaaaaatgtttttggataccgtggtgacatttcaactcctgagtcaaaagtgaaggtgcttgttatctcaacagacgaagaattgtgcatcgcgcgtgacgttgaacgtttaaaaaatacaaaa

SEQ ID NO: 408 - protein, 398 aa, Streptococcus pyogenes
MSKTIAINAGSSSLKWQLYQMPEEAVLAQGIIERIGLKDSISTVKYDGKKEEQILDIHDHTEAVKILLNDLIHFGIIAAYDEITGVGHRVVAGGELFKESVVVNDKVLEQIEELSVLAPLHNPGAAAGIRAFRDILPDITSVCVFDTSFHTSMAKHTYLYPIPQKYYTDYKVRKYGAHGTSHKYVAQEAAKMLGRPLEELKLITAHIGNGVSITANYHGKSVDTSMGFTPLAGPMMGTRSGDIDPAIIPYLIEQDPELKDAADVVNMLNKKSGLSGVSGISSDMRDIEAGLQEDNPDAVLAYNIFIDRIKKCIGQYFAVLNGADALVFTAGMGENAPLMRQDVIGGLTWFGMDIDPEKNVFGYRGDISTPESKVKVLVISTDEELCIARDVERLKNTK

SEQ ID NO: 409 - DNA, 204 bp, Streptococcus agalactiae
atgaaaaattctctacaaaagttacgaaaatctaggaaattaagtcaagcagaacttgcagttgcacttggagttactaggcaaactattatttctctagaaaaagagaaatacacggcatctttggagctagcatttaagatagcgcgttattttgataaacaaattgaggaagtttttatttatacagaaagtgaaggagga

SEQ ID NO: 410 - protein, 68 aa, Streptococcus agalactiae
MKNSLQKLRKSRKLSQAELAVALGVTRQTIISLEKEKYTASLELAFKIARYFDKQIEEVFIYTESEGG

SEQ ID NO: 411 - DNA, 228 bp, Streptococcus pyogenes
atgaaggagatggcaatggaggttattcttaaaaatcggctcaaagaattacgagctagagatggaattaatcaaacggaaatggctaaactggcaggagtatcgaggcagaccatcagtctcattgagcgtaacgagtacaccccatcagttataattgccatgaaaattgcaaaggtatttcaggaaccagttgaagaggtgtttcgtctagtggaggtcgaggaa

SEQ ID NO: 412 - protein, 76 aa, Streptococcus pyogenes
MKEMAMEVILKNRLKELRARDGINQTEMAKLAGVSRQTISLIERNEYTPSVIIAMKIAKVFQEPVEEVFRLVEVEE

SEQ ID NO: 413 - DNA, 675 bp, Streptococcus agalactiae
ttggaggtttttgtgtcatttattattagaaaaggcaaaattttagctttgctaatagcatttttagttattaatcaacttgttcctatattggctgtgtggctcctaaagaatcactatcaaacgccttttactagtatattgttgattggcttagaattacttattattgctcttttcctttattatgccaaggttaaacaaataatcagatggaaagcattattgacaaggaaagcattagttactattctcttaggttggttatcattgagggttccacaaattattggttacctcattatgactatgcaaggggttaaagatacagcaaatcaaacagtaattatggaattaacaaagcaacttccactagctttgatgttaatttttgccataattggtgcccctattatggaagaaattatatttcgctatattatccctaaagaactttttgcgaaacatcaaaaatggggttttgtcatcggtactttagcttttgctcttattcattccccttctgatataggtagttttattatttatgctgggatgggtgctattttatcttttgtttattataaaactgagcacttagaatatagtataatgattcattttattaacaatgctcttgcttatagcgtgttaatcagtacaatgatgaataac

SEQ ID NO: 414 - protein, 225 aa, Streptococcus agalactiae
MEVFVSFIIRKGKILALLIAFLVINQLVPILAVWLLKNHYQTPFTSILLIGLELLIIALFLYYAKVKQIIRWKALLTRKALVTILLGWLSLRVPQIIGYLIMTMQGVKDTANQTVIMELTKQLPLALMLIFAIIGAPIMEEIIFRYIIPKELFAKHQKWGFVIGTLAFALIHSPSDIGSFIIYAGMGAILSFVYYKTEHLEYSIMIHFINNALAYSVLISTMMNN

SEQ ID NO: 415 - DNA, 693 bp, Streptococcus pyogenes
atgaaaggattcattaattatttaaaaatagcagtgctcattattctggctatggttttcaatgtccttccgatgattttattgcaaaagcaacacgatattcctatggtacttaattggggaattggtattttctacttggttattgttggaagtgtccttattgtattatggggtctttatcaagctaagcaagacacttttattaaacagcaaaaaatgagattggttgactggggttatttagcattattttggttaatcatccgtgtgatagctattgtaggtacccttgttaaccagctatggtctggtcaacaagtgagtgctaatgatgctgcaatacataccttagctagacttatcaaaggtggtttcccgctttatactgccctatttgtacttgtgatagcttttatcgctcctattatggaagaactagtctttagaggatttcctatgattgatctcttcaaaggaaaatcacttaaggtggcaggtttagtgacctctcttgtttttgctttaccacatgccaccaatagtgttgaatttatcatgtacagctgtatgggcatttttctctttgttgcctatcaaagacgaggaaacttaaaagatgctatcttgttacatatttttaataacttgattgaagtcattttgttaatgtcaataggcttaggagtcata

SEQ ID NO: 416 - protein, 231 aa, Streptococcus pyogenes
MKGFINYLKIAVLIILAMVFNVLPMILLQKQHDIPMVLNWGIGIFYLVIVGSVLIVLWGLYQAKQDTFIKQQKMRLVDWGYLALFWLIIRVIAIVGTLVNQLWSGQQVSANDAAIHTLARLIKGGFPLYTALFVLVIAFIAPIMEELVFRGFPMIDLFKGKSLKVAGLVTSLVFALPHATNSVEFIMYSCMGIFLFVAYQRRGNLKDAILLHIFNNLIEVILLMSIGLGVI

SEQ ID NO: 417 - DNA, 768 bp, Streptococcus agalactiae
atgaaaattggaattatcggcgtcggaaaaatggccagtgcaattattcaaggcctcaaacaaacccaacatgacattatcatatccggatcttgcttagagcgttcaaaagaaattgcagaaagacttgatgttacttacgccgaatctcatcagtcattaatcaatcaagctgatattatcatgttaggtattaaacctcaactatttgaaaaggttcttcttccacttgatatcacaaaaccaatcatctcaatggcagcaggaatctccttagcgcgtttaagccaattaactcgttctgatttaccattgattcgtattatgccaaatattaacgcacaaatacttcaaagttgcacagctatttgttacaacaatcatgtatcagatgagttacgacaattagccaaagaaattacggatagttttggaagtagctttgatatagcagaaaccaattttgataccttcactgctctagcaggttctagccctgcctatatctatctatttatagaagccttagctaaagcaggtgtaaaatatggatttccaaaagaacaagcactctctattgtaggacagactgtcttagcttctagtcaaaacctattacaaggacaaaatagcacctctgacttaatcgacaacatttgtagcccaggcggaactactattgctggccttttagacttagaaaaaaatggtctgacgcatagtgttatttctgccattgatgctactattgagaaagcaaaaaaactt

SEQ ID NO: 418 - protein, 256 aa, Streptococcus agalactiae
MKIGIIGVGKMASAIIQGLKQTQHDIIISGSCLERSKEIAERLDVTYAESHQSLINQADIIMLGIKPQLFEKVLLPLDITKPIISMAAGISLARLSQLTRSDLPLIRIMPNINAQILQSCTAICYNNHVSDELRQLAKEITDSFGSSFDIAETNFDTFTALAGSSPAYIYLFIEALAKAGVKYGFPKEQALSIVGQTVLASSQNLLQGQNSTSDLIDNICSPGGTTIAGLLDLEKNGLTHSVISAIDATIEKAKKL

SEQ ID NO: 419 - DNA, 768 bp, Streptococcus pyogenes
atgaaaattggcattattggtgttggcaaaatggctagcgctatcatcaaaggccttaaacaaacaccccatgaacttatcatttcaggatcatctttagaacggtccaaggaaattgcggagcagttagcactgccttatgctatgtcccaccaagaccttattgaccaggttgatcttgttattttaggcatcaagcctcaactatttgaaacggtactcaaaccgcttcacttcaaacagcctattatatctatggcagcaggcatttcccttcaacgactagcaacattcgtaggacaagaccttccgctgctacgtatcatgccaaacatgaatgcacaaattctccaaagcagtaccgctttaacgggaaatgctttggtgtcccaggaattacaagcacgtgttcgagacttaacagatagctttggtagcacatttgatattagtgaaaaggattttgacacctttaccgctttagcagggtcaagtcctgcctatatttatctctttattgaggctttggctaaggctggcgtcaagaatggcatacctaaagcaaaggcgctggagattgttactcaaacagtattggctagcgccagcaatctcaagaccagttctcaaagtccgcacgatttcattgacgctatttgtagccccggtggcacaactattgctggtctgatggagttagaacgccttggcctcacagctactgtcagctctgccattgacaaaaccatcgataaagctaaaagcttg

SEQ ID NO: 420 - protein, 256 aa, Streptococcus pyogenes
MKIGIIGVGKMASAIIKGLKQTPHELIISGSSLERSKEIAEQLALPYAMSHQDLIDQVDLVILGIKPQLFETVLKPLHFKQPIISMAAGISLQRLATFVGQDLPLLRIMPNMNAQILQSSTALTGNALVSQELQARVRDLTDSFGSTFDISEKDFDTFTALAGSSPAYIYLFIEALAKAGVKNGIPKAKALEIVTQTVLASASNLKTSSQSPHDFIDAICSPGGTTIAGLMELERLGLTATVSSAIDKTIDKAKSL

SEQ ID NO: 421 - DNA, 1065 bp, Streptococcus agalactiae
atgtcagatttatttaacaaaattaaaaccgtaactgagcttgatgggattgctggctatgaacacaatatccgcaacttccttcgtcaagaaataactcctttagttgatcaagttgagacagacggacttggtggaatttttggagttaaaaatactcatgagactaatgctcctaaagtcatggttgctgcccatatggatgaagtcggctttatggttagtcatattcagccagatggaacatttcgtgtacttgaggttggaggatggaatcccctagtagtcagctcacaacgctttaccctctacacacgttctggtgatgctattcctgttatatcaggctcagttcctcctcactttcttcgtggacaaagcggtggaacaacattacccaaaattagtgacattgtttttgatggaggattcacagataaaaatgaagctgaaagctttggcattgctcctggcgatatcattgttcctaaatctgaaaccattttaactgcaaatcaaaaacatattatgtcaaaagcttgggataatcgctatggtgtgcttatggtgaccgaattgctaaaaagcttaaaagatcaaagtcttagcaacacacttattgctggggcaaatgttcaagaagaagtcggacttcgtggcgcacatgtttcaacaactaaattcaacccagatatcttcttagctgtcgattgttccccagctggagatatttatggggaacaaggcaaaataggagagggaaccttaatccgtttttatgatcccggacatatcatgcttaaagatatgagagatttcttacttacaacagctgaagaagcaggtataaaataccaatattatgctgcaaatggtggtaccgatgctggggctgctcacctaaaaaatagtggtattccttctacaactatcggtgtctgtgcacgctacattcattctcatcaaacactctacgctatggatgattttctacaagcacaagcttaccttcaggccatcgttaacaaattagaccgctcgacggtggatattattaaaggttat

SEQ ID NO: 422 - protein, 355 aa, Streptococcus agalactiae
MSDLFNKIKTVTELDGIAGYEHNIRNFLRQEITPLVDQVETDGLGGIFGVKNTHETNAPKVMVAAHMDEVGFMVSHIQPDGTFRVLEVGGWNPLVVSSQRFTLYTRSGDAIPVISGSVPPHFLRGQSGGTTLPKISDIVFDGGFTDKNEAESFGIAPGDIIVPKSETILTANQKHIMSKAWDNRYGVLMVTELLKSLKDQSLSNTLIAGANVQEEVGLRGAHVSTTKFNPDIFLAVDCSPAGDIYGEQGKIGEGTLIRFYDPGHIMLKDMRDFLLTTAEEAGIKYQYYAANGGTDAGAAHLKNSGIPSTTIGVCARYIHSHQTLYAMDDFLQAQAYLQAIVNKLDRSTVDIIKGY

SEQ ID NO: 423 - DNA, 1065 bp, Streptococcus pyogenes
atgacagacttattctcaaaaatcaaagaagttaccgaactggatggcattgcgggctatgaacatagcgttcgtgactacctacgcaccaaaataaccccgctggttgaccgtgttgaaacagacgggcttggtggcatttttggtatcagagatagtaaagctgaaaaagccccccgtattttagtagctgcgcacatggacgaagtcggttttatggtcagtgatatcaaagttgacggaacgctacgcgtggttggtatcggtggttggaacccacttgttgtcagttcacaacggtttaccctttacacacgcactggccaagttattccccttatttcaggatcggtacctccccattttttacgtggggcaaatggctctgctagtctaccacatatcgaagatattgtgtttgatggtggctttacggataaggcagaagctgaaagatttggtattacaccgggtgatattattatccctcaatctgaaacgatcctaacagccaatcaaaaaaatattatttcaaaagcttgggacaatcgctatggcgttctcatgataacagaaatgcttgaagcgttaaaaggacaagaccttaacaacaccctaattgcaggtgctaacgttcaagaagaagttggtctgcgcggagcccacgtctcaaccaccaagttcgaccctgaactctttttcgcagtagattgttcgcctgctggtgatatttatggcaatcctggaacaatcggagatggtaccttgttgcgtttctacgacccaggccatgtcatgctcaaagatatgcgcgacttcttactgactactgctgaggaagctggtgtcaatttccaatactattgtggcaagggaggcacagatgcaggtgctgcacaccttcaaaatggtggtgtcccatcaacaaccatcggagtctgtgcacgctacattcactctcatcaaaccctctacgctatggatgatttcgtagaagcccaagccttcttacaagccattatcaaaaaactggatcgctcaaccgttgacttgattaaatgttac

SEQ ID NO: 424 - protein, 355 aa, Streptococcus pyogenes
MTDLFSKIKEVTELDGIAGYEHSVRDYLRTKITPLVDRVETDGLGGIFGIRDSKAEKAPRILVAAHMDEVGFMVSDIKVDGTLRVVGIGGWNPLVVSSQRFTLYTRTGQVIPLISGSVPPHFLRGANGSASLPHIEDIVFDGGFTDKAEAERFGITPGDIIIPQSETILTANQKNIISKAWDNRYGVLMITEMLEALKGQDLNNTLIAGANVQEEVGLRGAHVSTTKFDPELFFAVDCSPAGDIYGNPGTIGDGTLLRFYDPGHVMLKDMRDFLLTTAEEAGVNFQYYCGKGGTDAGAAHLQNGGVPSTTIGVCARYIHSHQTLYAMDDFVEAQAFLQAIIKKLDRSTVDLIKCY

SEQ ID NO: 425 - DNA, 90 bp, Streptococcus agalactiae
atggttaatcattcaaacagaaagaaaaaacatgaaagaaaaattattagtacctgctttaaattgtttgctaggtctactcttcctagg

SEQ ID NO: 426 - protein, 30 aa, Streptococcus agalactiae
MVNHSNRKKKHERKIISTCFKLFARSTLPR

SEQ ID NO: 427 - DNA, 318 bp, Streptococcus agalactiae
gtgtctaattccggggggtatggtataataacagttatgaaaaataaaaaaatcttatttgggactggccttgctggtgtgggtttactggcagctgctggttataccctaactaaaaaagtaacagattataaacgtcagcaaatcactcagaccttaagagaattttttagtcagatgggtgatattcaggtattttattttaatgaatttgaatctgatattaaaatgaccagtggtggtcttgtcttggaagatggcagaattttcgaattcatttatcgtcaaggtgttcttgattatgtggaggtgagcaaa

SEQ ID NO: 428 - protein, 106 aa, Streptococcus agalactiae
MSNSGGYGIITVMKNKKILFGTGLAGVGLLAAAGYTLTKKVTDYKRQQITQTLREFFSQMGDIQVFYFNEFESDIKMTSGGLVLEDGRIFEFIYRQGVLDYVEVSK

SEQ ID NO: 429 - DNA, 291 bp, Streptococcus pyogenes
atgagggatatgagtaaaaagaaaataggtatgatttcaggtatctttggatttagtttagctattggcctaggaatagttatcaaagattattgccaagacaggcagcgtcgacaaatgacaagggatttacgcacctttttttcacctttaggacaaatcgaagttttatatatcaatccttgtcaggtcaaacaagattatatttcaggtggggttgttatgtcaaacggcaaacagtaccaattcacctatcacagtcgacaaattagttttgaggaggacaaggga

SEQ ID NO: 430 - protein, 97 aa, Streptococcus pyogenes
MRDMSKKKIGMISGIFGFSLAIGLGIVIKDYCQDRQRRQMTRDLRTFFSPLGQIEVLYINPCQVKQDYISGGVVMSNGKQYQFTYHSRQISFEEDKG

SEQ ID NO: 431 - DNA, 321 bp, Streptococcus agalactiae
atgattttaccagaatcttatgaagaaatagcagcctatattgatagcactaagaaagttgttttcttttttacagcagattggtgtccagattgtcaatttatatatccagtaatgccatcaattgaaaaagatttctcagattttgtctttgtacgtgttaatcgtgatgactatatagaattagctcagcagtggaatatttttgggattccgagtttcgttgttgtggaaaatggtcaggaactgggtcgtttggttaataagaatcgcaaaacaaaggctgaaattactaaatttctcgctgaaattaactataaa

SEQ ID NO: 432 - protein, 107 aa, Streptococcus agalactiae
MILPESYEEIAAYIDSTKKVVFFFTADWCPDCQFIYPVMPSIEKDFSDFVFVRVNRDDYIELAQQWNIFGIPSFVVVENGQELGRLVNKNRKTKAEITKFLAEINYK

SEQ ID NO: 433 - DNA, 315 bp, Streptococcus pyogenes
atgatcagaccgacttcttatgagtcattagcgactcttattgaaaaagaagataagctggtgttattttttacggcagactggtgtccagactgtcaatttatttatcctattatgccagaaattgaagcagaacttacagatatgacttttgtttgtgttaatcgtgatcagtttatagaggtagcacaaaagtggaatatttttggtattcctagttttgtcgtgattgaaaaaggtcaggaagtagggcgtctggttaacaaaatgagaaagacaaaaactgagattatgcattttttagctgcttatcaa

SEQ ID NO: 434 - protein, 105 aa, Streptococcus pyogenes
MIRPTSYESLATLIEKEDKLVLFFTADWCPDCQFIYPIMPEIEAELTDMTFVCVNRDQFIEVAQKWNIFGIPSFVVIEKGQEVGRLVNKMRKTKTEIMHFLAAYQ

SEQ ID NO: 435 - DNA, 624 bp, Streptococcus agalactiae
atgatttttacttataatagagagcatgttggtgataccttaatggttattgttaaggatagtcaaggagctaagctagatgttgatcgtcgcggacaagtagcacgcgtctatctgcaagatagtaaagaaacagttgcttggaatatctttgaagtgtcaagtttaattgttattgagggagcaggtcaaataactttatctgatcaagatattaaaatccttaatgcagaactactgaaagaaggattcgaagactctcttgttaataatattgaacctacatttgttgtggcgcaaattaaagaaataattgatcatccagatagtgaccatttacatatctgtcaagcagaaatcaacgatgggaagacggtccaaatcgtttgtggggcacctaatgcttcagtaggtcttaaaacagttgcagctcttccaggagctatgatgccaaatggtagccttattttcccaggaaaacttcgtggagaagatagctttggaatgttatgtagtgctcgcgagttagctcttccaaatgctcctcaagtcagaggtatcattgaattatctgatcaggtaattgttggagagtctttcgacgccaataaacattggaaaaat

SEQ ID NO: 436 - protein, 208 aa, Streptococcus agalactiae
MIFTYNREHVGDTLMVIVKDSQGAKLDVDRRGQVARVYLQDSKETVAWNIFEVSSLIVIEGAGQITLSDQDIKILNAELLKEGFEDSLVNNIEPTFVVAQIKEIIDHPDSDHLHICQAEINDGKTVQIVCGAPNASVGLKTVAALPGAMMPNGSLIFPGKLRGEDSFGMLCSARELALPNAPQVRGIIELSDQVIVGESFDANKHWKN

SEQ ID NO: 437 - DNA, 624 bp, Streptococcus pyogenes
atgatttttgcatacaataaagaacaagttggcgatgtcttgatggttatcttacaagacaccaaagatatcaaacgtcaagtagaacgaaaaggcaaagtagcccgtgtttttgcagaagaaagcggcaaaacccttgcttggaatatctttgaagcgtcaagcttgattactattgaaggcaatggacagatttttttgacagacgagaaccttgcaagattaaatgcagagcttgctaaggaaggattttcagaaaggcttgaaccgattgtgggacctgtttttgtggttggtcaaattgttgagatggtggctcatccagatagcgaccatcttaatatctgccaagtggctattggtgaagatcaaacggttcaaatcgtagcgggcgcaccaaatgctgcgcttggtttaaaaacgattgttgccttaccaggtgctataatgccaaatggtagtctgattttcccaggaaaattgcgtggtgaagaaagttatggtatgatgtgctctcctcgtgagttagccttgccaaatgcaccgcaaaaacgtggcattattgaatttgatgagtcagctgtggtaggagaagcttttgacccagccaaacattggaaaggt

SEQ ID NO: 438 - protein, 208 aa, Streptococcus pyogenes
MIFAYNKEQVGDVLMVILQDTKDIKRQVERKGKVARVFAEESGKTLAWNIFEASSLITIEGNGQIFLTDENLARLNAELAKEGFSERLEPIVGPVFVVGQIVEMVAHPDSDHLNICQVAIGEDQTVQIVAGAPNAALGLKTIVALPGAIMPNGSLIFPGKLRGEESYGMMCSPRELALPNAPQKRGIIEFDESAVVGEAFDPAKHWKG

SEQ ID NO: 439 - DNA, 714 bp, Streptococcus agalactiae
atgacaaatgtaactagttataaagaaatgctggctaaaccttggggaaaaatacaatatgaaataacttttgctcaattaagccatatcaaaaatcagaacgttttagattttggagctggtttttgtctcaccgaacaacatctagcaaaagaaaacaatgtaactgctattgaacccaatcctaaactgctttacgataatcaaagtgacaatatttataaaatcctaggttcctacgaagcattaagagatttgcctgatcaaagctttgatactattatttgtcataatgttcttgaatatatagacaaacataatcatcctgcttattttgacgaattttctcgacttctaaaacccaatggagaactatctctcatcaaacataatataaccggtaaaatattacaatcagttatttttagcaatgatacctccactgcgatggaactcttaacaggagaagcaaactttaaaagtgccagttttgaccagggaaatatttataccttagaagaactaaaacaaaatacaaatttattagttgaacgttatcagggtattcgtaccttctattcattacaaccaaaccattttaaaactgaaactggttggctaaacaaaatgcttgctatcgagctaagtgttgctgacaaagctccttataaagatattgcttttttgcaacacatcacacttaaaaagtcattg

SEQ ID NO: 440 - protein, 238 aa, Streptococcus agalactiae
MTNVTSYKEMLAKPWGKIQYEITFAQLSHIKNQNVLDFGAGFCLTEQHLAKENNVTAIEPNPKLLYDNQSDNIYKILGSYEALRDLPDQSFDTIICHNVLEYIDKHNHPAYFDEFSRLLKPNGELSLIKHNITGKILQSVIFSNDTSTAMELLTGEANFKSASFDQGNIYTLEELKQNTNLLVERYQGIRTFYSLQPNHFKTETGWLNKMLAIELSVADKAPYKDIAFLQHITLKKSL

SEQ ID NO: 441 - DNA, 393 bp, Streptococcus agalactiae
atgtataataaagttattatgattgggcgtctaacagcaaagcctgagatggtaaaaacaccaactgacaagtcagtgacgcgtgcaactgttgctgttaatagacgctttaaaggaagtaatggtgagcgtgaagcagattttattaatgtggttatgtggggtcgtctagcggaaacccttgcgagctatgggacaaagggctctttaatttcaatagatggtgaattgcgtacgcgcaagtacgaaaaggatggtcaaacgcactatatcactgaagtattagcatcatcatttcagttgctagaaagccgtgcccaacgtgctatgcgtgaaaataacgtttctggtgatttgtcagatttagtattggaagaagaggagctccccttt

SEQ ID NO: 442 - protein, 131 aa, Streptococcus agalactiae
MYNKVIMIGRLTAKPEMVKTPTDKSVTRATVAVNRRFKGSNGEREADFINVVMWGRLAETLASYGTKGSLISIDGELRTRKYEKDGQTHYITEVLASSFQLLESRAQRAMRENNVSGDLSDLVLEEEELPF

SEQ ID NO: 443 - DNA, 393 bp, Streptococcus pyogenes
atgtataataaagtgatagcaatcggtcgtttggtagctaaaccagaattggtaaaaacagctacggataagcatgtagcacgtctctctttagctgttaatcgaagatttaaaaatgcttctggagagcgagaagctgattttatttcagttgttgtttggggaaagttagcagaaactctggtttcttatgctagcaaaggtagtttgatgtctattgatggcgaacttaggacccgcaagtatgataaagatgggcaagtgcattatgtgacagaagttctctgccaatcatttcaactgcttgaaagtcgtgctcagcgcgctatgagagaaaataatgttactaatgatctagttgatttagtcttagaagaagatactcttcccttt

SEQ ID NO: 444 - protein, 131 aa, Streptococcus pyogenes
MYNKVIAIGRLVAKPELVKTATDKHVARLSLAVNRRFKNASGEREADFISVVVWGKLAETLVSYASKGSLMSIDGELRTRKYDKDGQVHYVTEVLCQSFQLLESRAQRAMRENNVTNDLVDLVLEEDTLPF

SEQ ID NO: 445 - DNA, 726 bp, Streptococcus agalactiae
ttgcttttcacagaaagcaacctttttttattgaaaatagaaaggcaaacgattacaataaaggggatagaaagcaggtttaagatggaaaaagtcattatttttgatatggacggcgttattgttgattccgagtacacgtttttagataataagacagaaatgttacgtgaggagggtattgatacggacgtctcgtatcaataccagtacatggggactacttttgaattcatgtggcaagctatgaaagaggagtttggcttaccgaaaacagtaaaagagtatattgctgagatgaacagacgtcgacaagcgattgtggcgcgtgatggtgttaggcccatcaaaggagctcagcgactgattcattggttacaccaacatggctatcgcttagcagttgcgtcctcatctccaatggtagatattaagcgtaatctaaaagagttgggtgtgacagaatgctttgaatacatggttacaggagaagatgtatcgtcttctaaaccagcaccagatgtttttcttagagctgcagagcttttagatgtagaccctaaagtttgtatagttatagaagatacaagaaatgggagtttagctgctaaggcagcaggaatgtattgctttggctttgctaatcctgattatccaccgcaagatttatcaatggcagacaaggttatttcagattatcaagatatctatatttatcttccggag

SEQ ID NO: 446 - protein, 242 aa, Streptococcus agalactiae
MLFTESNLFLLKIERQTITIKGIESRFKMEKVIIFDMDGVIVDSEYTFLDNKTEMLREEGIDTDVSYQYQYMGTTFEFMWQAMKEEFGLPKTVKEYIAEMNRRRQAIVARDGVRPIKGAQRLIHWLHQHGYRLAVASSSPMVDIKRNLKELGVTECFEYMVTGEDVSSSKPAPDVFLRAAELLDVDPKVCIVIEDTRNGSLAAKAAGMYCFGFANPDYPPQDLSMADKVISDYQDIYIYLPE

SEQ ID NO: 447 - DNA, 654 bp, Streptococcus pyogenes
atgttgatgattaaaggaattatttttgatatggacggtgttttatttgatacagaacctttttatctgaggcgacgagaagatttttttaagacaaagggaattcccattgatcatttgaactctaaagattttattgggggcaatcttcaagaattatggaaagagttgttaggtaaaaatagggatgatgctatcgttaaggcaattacaactgactatgacgcttacaaacaagcgcataagcctccttatcaaaaactgttgattacagaagtgaactcttgtcttgaacagttggaaaaacaaggtattaaactggctgtggcatcaaactcgaagcgtcaggatgttttgttggcgttggagacaacgcaaataaaagattattttgaaataatcctagcgcgtgaagatgtttctagaggcaaaccttatccagatatttataataaagcagtacaaaaactaggattacaaaaaaaacaactgcttgtagtagaggacagccaaaaaggcattgctgccgccaaagcagccaatctgacagtttttgccattaccgactaccgatatggcattgatcagagtcaagctgatcacaagatagatcatttaggacaactgtgtgtaaaaatcggttgttttggatcg

SEQ ID NO: 448 - protein, 218 aa, Streptococcus pyogenes
MLMIKGIIFDMDGVLFDTEPFYLRRREDFFKTKGIPIDHLNSKDFIGGNLQELWKELLGKNRDDAIVKAITTDYDAYKQAHKPPYQKLLITEVNSCLEQLEKQGIKLAVASNSKRQDVLLALETTQIKDYFEIILAREDVSRGKPYPDIYNKAVQKLGLQKKQLLVVEDSQKGIAAAKAANLTVFAITDYRYGIDQSQADHKIDHLGQLCVKIGCFGS

SEQ ID NO: 449 - DNA, 102 bp, Streptococcus agalactiae
ttggtggacctctggttggatcaattgttggttttattggaggagttcatcgcttttttcaaggaagcttttcaggttctttctatattgtcagttcagttc

SEQ ID NO: 450 - protein, 34 aa, Streptococcus agalactiae
MVDLWLDQLLVLLEEFIAFFKEAFQVLSILSVQF

SEQ ID NO: 451 - DNA, 138 bp, Streptococcus agalactiae
gtggaacctaaactatttaaaatcatcattggaatgacaatcattttgacaagttcccatcctgtaaaaatgccaacaaatagcatctggatactttcggcaataatactaattaaaataacttggcttgttgaaggg

SEQ ID NO: 452 - protein, 46 aa, Streptococcus agalactiae
MEPKLFKIIIGMTIILTSSHPVKMPTNSIWILSAIILIKITWLVEG

SEQ ID NO: 453 - DNA, 1743 bp, Streptococcus agalactiae
atgttgatggtgttgttattccaaaggctaggaattattatgattttagcctttttattggtaaataatagttattttagacagttaattgaagagcggtctaaacgtgaaacggtagtccttgtcatcattttcggcttgtttgttattatatctaatataacaggaattgaaataaaaggggatcgaagtttggtcgagcgcccttttctaacaacgatttctcattctgactcacttgctaatacaaggactttagttattacaacggcaagtttggttggtggacctctggttggatcaattgttggttttattggaggagttcatcgcttttttcaaggaagcttttcaggttctttctatattgtcagttcagttctagtcggcattgttagcggaaagattggtgataagcttaaggaaaaccatctctacccttcaacaagccaagttattttaattagtattattgccgaaagtatccagatgctatttgttggcatttttacaggatgggaacttgtcaaaatgattgtcattccaatgatgattttaaatagtttaggttccacacttttccttgcgattttgaaaacttatttgtcaaatgaaagtcagttacgcgcagttcaaacgagagatgttcttgaattgactcgacagactctgccctaccttagacaaggtttgacaccgcaatctgctaggagcgtttgcgaaattataaagaggcatactaactttgatgctgtgggattaacagatcggtcaaacgtattagctcatattggtgttggccatgatcaccatattgcaggacaaccggtcaaaacagacttatctaaaagtgttatttttgatggcgaaccaagaattgcgcaagataaagcggcgatttcttgtccagatcacaactgtcagttaaattctgctattgtagttcctctaaaaataaatgataaaactgtgggtgccttaaaaatgtactttgcaggagataagacaatgtctgaggtggaggaaaacctagtccttggtttagcgcaaatattttcaggacaactggcaatggggataacagaggaacaaaataagttagccagtatggcagagataaaggctttacaagcacaaatcaaccctcatttcttctttaatgccattaacacaattagtgcattaatccgtattgattctgataaagcacgttatgcactgatgcagttaagtactttttttagaacaagtttgcagggtggtcaggatcgtgaggtaacgcttgagcaagaaaaatcacatgtggatgcttatatgaatgttgaaaaattacgtttccctgataaatatcagttatcttatgatattagtgcaccagaaaaaatgaagttaccaccttttggtttacaggtactggtagagaatgcagttcgacatgctttcaaagaacgtaagacggacaaccatatattggttcaaataaagccagatggtcattattattgtgtttctgttagtgacaatggacaaggaatctcagatactatcattgataaattaggtcaagaaacagttgcagagagtaagggtacaggtactgctctagttaatctaaataacaggctgaatttattatatggtagtgtaagttgccttcatttttcgagcgacaagaatggtacaaaagtttggtatcgaatacctaatagaataagggaggatgagcatgaaaattttaattct

SEQ ID NO: 454 - protein, 581 aa, Streptococcus agalactiae
MLMVLLFQRLGIIMILAFLLVNNSYFRQLIEERSKRETVVLVIIFGLFVIISNITGIEIKGDRSLVERPFLTTISHSDSLANTRTLVITTASLVGGPLVGSIVGFIGGVHRFFQGSFSGSFYIVSSVLVGIVSGKIGDKLKENHLYPSTSQVILISIIAESIQMLFVGIFTGWELVKMIVIPMMILNSLGSTLFLAILKTYLSNESQLRAVQTRDVLELTRQTLPYLRQGLTPQSARSVCEIIKRHTNFDAVGLTDRSNVLAHIGVGHDHHIAGQPVKTDLSKSVIFDGEPRIAQDKAAISCPDHNCQLNSAIVVPLKINDKTVGALKMYFAGDKTMSEVEENLVLGLAQIFSGQLAMGITEEQNKLASMAEIKALQAQINPHFFFNAINTISALIRIDSDKARYALMQLSTFFRTSLQGGQDREVTLEQEKSHVDAYMNVEKLRFPDKYQLSYDISAPEKMKLPPFGLQVLVENAVRHAFKERKTDNHILVQIKPDGHYYCVSVSDNGQGISDTIIDKLGQETVAESKGTGTALVNLNNRLNLLYGSVSCLHFSSDKNGTKVWYRIPNRIREDEHENFNS

SEQ ID NO: 455 - DNA, 723 bp, Streptococcus pyogenes
ttgacagaccttgcccaacagtttaatgcgctcttagatcaaattgatagcttgatggttgccgttgcggataaggaaaaggcgattgggcagtataggttacaagccttggctagtcagattaacccgcattttctctataacaccttggacactattatttggatggcagaatttaatgacagcaagcgcgtggtagaagtgaccaagtctctagctaagtattttcgtttggcccttaatcaggggaacgaatacattcgtttggcagatgaactggatcacgttagccaatacctctttattcaaaaacagcgctatggagacaagctaagttatgaagtgcaaggcttagatgtctacgcagactttgttattcctaagcttatcttacagcccttagtagaaaatgctatctaccatggcatcaaagaagtcgatcgcaagggcatgatcaaggttacggtatctgatacagctcagcatctgatgttgactgtttgggataatggtaaaggcattgaagactcttcactgaccaatagtcagagcttgttggctaggggaggtgtgggccttaaaaatgttgaccagcggttaaaacttcactatggtgaaggctaccacatgaccattcatagccagtcagaccagttcactgaaatacaattaagccttcctaaaatgcatgaattaatggcagacgacacacaggaaaacgag

SEQ ID NO: 456 - protein, 241 aa, Streptococcus pyogenes
LTDLAQQFNALLDQIDSLMVAVADKEKAIGQYRLQALASQINPHFLYNTLDTIIWMAEFNDSKRVVEVTKSLAKYFRLALNQGNEYIRLADELDHVSQYLFIQKQRYGDKLSYEVQGLDVYADFVIPKLILQPLVENAIYHGIKEVDRKGMIKVTVSDTAQHLMLTVWDNGKGIEDSSLTNSQSLLARGGVGLKNVDQRLKLHYGEGYHMTIHSQSDQFTEIQLSLPKMHELMADDTQENE

SEQ ID NO: 457 - DNA, 744 bp, Streptococcus agalactiae
atgagcatgaaaattttaattcttgatgatgaaatgtttgccagacaagaattatcgtttttagttgaacatagccaggaggttgacaaccctgagatttttcaggctgaggatatcagtgaagccgaaaaaatcttatttagacagcaaattgatttaatttttttagatatttcgcttagtgaagaaaatggctttactttggctaatcagttgagccaacttgcacatcccccacttgttgtttttgcgacagcttatgataactacgctgtgaaagcttttgaaagtaacgctgttgattatatcatgaaaccgtttgaacaacagcgcgttgatatggctctatcaaaagtgaagaaattgagccaactcaccactgcttcagatgtagagcaagcaatacctaaaaaagccagtgttgaattgttaaccttgacattatcagatcgcagtgttgttgttaaaatgcaagatattgttgcagctagtgttgaagatggcgaattaactgttagtacagttcagaaaacttacactattcggaagacactcaattggtttaagtcacgcgctgtagcaccatattttctccagattcatcgaaacacagtgattaatctagagatgattgaggaaattcaaccttggtttaatcatactttgttactaattatgtctaatggagagaaatttccagtaggtcgatcgtatttaaaagacctaaatgagcatttaaccatg

SEQ ID NO: 458 - protein, 248 aa, Streptococcus agalactiae
MSMKILILDDEMFARQELSFLVEHSQEVDNPEIFQAEDISEAEKILFRQQIDLIFLDISLSEENGFTLANQLSQLAHPPLVVFATAYDNYAVKAFESNAVDYIMKPFEQQRVDMALSKVKKLSQLTTASDVEQAIPKKASVELLTLTLSDRSVVVKMQDIVAASVEDGELTVSTVQKTYTIRKTLNWFKSRAVAPYFLQIHRNTVINLEMIEEIQPWFNHTLLLIMSNGEKFPVGRSYLKDLNEHLTM

SEQ ID NO: 459 - DNA, 738 bp, Streptococcus pyogenes
gtgtactcattgttaattgtagaagacgaataccttgtgcgccagggtattcgttctttggttgattttagccagttcaagattgatcgggtcaacgaagcagaaaatggccagttggcttgggacttgtttcagaaagagccttatgatattgttttgacggatatcaatatgcccaaattaaatgggattcaactagcagaactcattaaacaggaatccccccaaactcatctggtatttttgacgggctacgatgattttaactatgccttatctgctttgaaattaggggcagatgattacttgctcaaacccttttccaaggcagatgtagaagacatgttaggaaagctccggaaaaaattagaactttccaagaaaacagaaaccattcaggaattggttgagcagcctcaaaaagaagtatcagcaatagcaatggctattcatgagcggttggcagattctgatttgaccctaaaaagcttggctcagcagcttggttttagccctaattaccttagcgtcttgattaaaaaagagttagggatgccctttcaagattatctggtacaagaacggttgaaaaaagccaagcttctcttgttaaccagtaatcttaaaatctatgaaattgcagagcaggtcggttttgaggacatgaattatttttctcagcgctttaagcaactggtaggcgttaccccaagtcagtataaaaaaggaggccaggca

SEQ ID NO: 460 - protein, 246 aa, Streptococcus pyogenes
VYSLLIVEDEYLVRQGIRSLVDFSQFKIDRVNEAENGQLAWDLFQKEPYDIVLTDINMPKLNGIQLAELIKQESPQTHLVFLTGYDDFNYALSALKLGADDYLLKPFSKADVEDMLGKLRKKLELSKKTETIQELVEQPQKEVSAIAMAIHERLADSDLTLKSLAQQLGFSPNYLSVLIKKELGMPFQDYLVQERLKKAKLLLLTSNLKIYEIAEQVGFEDMNYFSQRFKQLVGVTPSQYKKGGQA

SEQ ID NO: 461 - DNA, 345 bp, Streptococcus agalactiae
gtgacactgagttctctgatagcaagtattaatcgtgcaacatatgctaccactaccaacataacaacagttgagattgtaataacagcaactagttgcaagccttcagcttttaggatatcaagattcgctgctactgatattcctgaggggacaaacataaaaccaatcatgcttatcatcaaagccccaaaagagtcaacccactctaccttgataattttagcagttagcaatacatacattagcaccaaaccaataaccgtcgttgggattggtagtgatttcggtaataacattgaaatcatttgtgaaactaatagaatagctgcatatattgacatt

SEQ ID NO: 462 - protein, 115 aa, Streptococcus agalactiae
MTLSSLIASINRATYATTTNITTVEIVITATSCKPSAFRISRFAATDIPEGTNIKPIMLIIKAPKESTHSTLIILAVSNTYISTKPITVVGIGSDFGNNIEIICETNRIAAYIDI

SEQ ID NO: 463 - DNA, 459 bp, Streptococcus agalactiae
gtgactatgaaacacaccagtaaagaaaccaaaacaaaagaagctccaatgtttattcaaatgtcaatatatgcagctattctattagtttcacaaatgatttcaatgttattaccgaaatcactaccaatcccaacgacggttattggtttggtgctaatgtatgtattgctaactgctaaaattatcaaggtagagtgggttgactcttttggggctttgatgataagcatgattggttttatgtttgtcccctcaggaatatcagtagcagcgaatcttgatatcctaaaagctgaaggcttgcaactagttgctgttattacaatctcaactgttgttatgttggtagtggtagcatatgttgcacgattaatacttgctatcagagaactcagtgtcacagatttatttaaaaagatattacctaaccactatagtaagaaagtagaggaaaaa

SEQ ID NO: 464 - protein, 153 aa, Streptococcus agalactiae
MTMKHTSKETKTKEAPMFIQMSIYAAILLVSQMISMLLPKSLPIPTTVIGLVLMYVLLTAKIIKVEWVDSFGALMISMIGFMFVPSGISVAANLDILKAEGLQLVAVITISTVVMLVVVAYVARLILAIRELSVTDLFKKILPNHYSKKVEEK

SEQ ID NO: 465 - DNA, 726 bp, Streptococcus agalactiae
atggaactcttaaaaacacccatctttggtatttgcttttctttaatactctatacgataggagaacatttatttaagaagagtaaaggtttcttccttttgcagcctcttttctttgcaatggttagtggtattgtcattctttggcttatgtcaaaaggtttaggaaccgatgttaagacattttatacacaagcttataaaccaggtggtgatttaatattttggtttttaaatccagcgacaattgcttttgcagttcctctctataagaaaaatgacgttgttaaaaaatattgggtagaaattctcagcagtttagtaatcggtatgattgtttcccttatacttatcgtcgctatttctaaaatggttgggcttagtcaagtcggaattgcttcaatgttgccacaagcagcaacaacagcaattgctcttccaataacagcagcaattggagggaacacagctgtgacagcaatggcgtgtatcttaaatgcagttattatttatgcattaggtaaaaaattagtgtcatttttccatttgaatgatagtaagattggtgcaggattaggtctagggacctctggtcatacagtcggagcagcctttgcattggaattgggagaactgcaaggtgcgatggcagctatagctgtggtggttatcggtttggtagttgatttggttattcctatctttagtcatttgattggtttgcta

SEQ ID NO: 466 - protein, 242 aa, Streptococcus agalactiae
MELLKTPIFGICFSLILYTIGEHLFKKSKGFFLLQPLFFAMVSGIVILWLMSKGLGTDVKTFYTQAYKPGGDLIFWFLNPATIAFAVPLYKKNDVVKKYWVEILSSLVIGMIVSLILIVAISKMVGLSQVGIASMLPQAATTAIALPITAAIGGNTAVTAMACILNAVIIYALGKKLVSFFHLNDSKIGAGLGLGTSGHTVGAAFALELGELQGAMAAIAVVVIGLVVDLVIPIFSHLIGLL

SEQ ID NO: 467 - DNA, 1626 bp, Streptococcus agalactiae
gtgactaaatatttgaagtacatctcttttgttgctttgtttctggcgagtatctttttagtagcttgtcaaaatcaaaattcacaaaccaaggagcgaacgcgaaaacaacgacccaaagatgaattggttgtttctatgggggcaaagcttcctcatgaattcgatccaaaggaccgttatggaatccataatgaaggtaatattactcatagcaccctattgaaacgttctcctgaactagatataaaaggagagcttgctaaaaaatataaaatctctaaggatggcttaacgtggtcgttcgacttaaatgatgattttaaattctccaatggtgagcctgttactgctgacgatgttaagtttacttatgatatgttgaaagcagatggaaaagcttgggatttgacctttattaagaatgttgaagtagttgggaaaaaccaggtaaatattcatttgactgaggcgcattcgacatttacagcacagttgacagaaatcccaatcgtccctaaaaaacattacaatgataagtataagagcaatcctatcggttcaggaccttacatggtgaaagaatataaggctggagaacaagcaatcttcgttcgaaatccctattggcacggtaaaaagccttattttaaaaagtggacttgggtattacttgatgaaaatacagcactagctgctttagaatctggtgatgttgacatgatttacgcaacgccagagcttgctagcaagaaagtcaaaggaacacgtcttctagatattgcttcaaacgacgttcgcggactgtcattgccttatgtgaagaaaggtgttgtgaaaaattcaccagacggttatccagtaggaaatgatgtcactagtgatccagcaatcagaaaagccttgactattggtttaaatagacaaaaagttctggatactgttttaaatggttatggtaaaccagcttattcaattattgatagaacaccattctggaatccaaaaacagcaattaaagataataaagtagctaaagctaagcaacttttgacaaaagctggatggaaagaacaagcagacggtagccgtaaaaaaggaaatcttaaatcggaatttgacctttactaccctactaatgatcaattacgagcaaacttagccgttgaagtagcggagcaagctaaagccttaggtattactattaaactcaaggctagtaactgggatgaaatggcaactaagtcacatgattcagccttactttatgcgggaggacgtcatcatgcgcagcaattttatgaatcacattacccaagtttagctggtaaaggttggaccaatattactttttataacaatcctactgtgactaagtaccttgacaaagcaatgacatctcctgaccttgataaagctaacaaatattggaagttagctcagtgggatggcaaaacaggtgcttccactcttggagatttaccaaatgtatggttggtgagtcttaaccatacttatattggtgataaacgtatcaatgtaggtaaacaaggtgtccatagtcatggtcatgattggtcattattgactaacattgctgaatggacttgggatgaatctgctaag

SEQ ID NO: 468 - protein, 542 aa, Streptococcus agalactiae
MTKYLKYISFVALFLASIFLVACQNQNSQTKERTRKQRPKDELVVSMGAKLPHEFDPKDRYGIHNEGNITHSTLLKRSPELDIKGELAKKYKISKDGLTWSFDLNDDFKFSNGEPVTADDVKFTYDMLKADGKAWDLTFIKNVEVVGKNQVNIHLTEAHSTFTAQLTEIPIVPKKHYNDKYKSNPIGSGPYMVKEYKAGEQAIFVRNPYWHGKKPYFKKWTWVLLDENTALAALESGDVDMIYATPELASKKVKGTRLLDIASNDVRGLSLPYVKKGVVKNSPDGYPVGNDVTSDPAIRKALTIGLNRQKVLDTVLNGYGKPAYSIIDRTPFWNPKTAIKDNKVAKAKQLLTKAGWKEQADGSRKKGNLKSEFDLYYPTNDQLRANLAVEVAEQAKALGITIKLKASNWDEMATKSHDSALLYAGGRHHAQQFYESHYPSLAGKGWTNITFYNNPTVTKYLDKAMTSPDLDKANKYWKLAQWDGKTGASTLGDLPNVWLVSLNHTYIGDKRINVGKQGVHSHGHDWSLLTNIAEWTWDESAK

SEQ ID NO: 469 - DNA, 129 bp, Streptococcus agalactiae
atgactggatcaaccggtgattgttttagtaaaataaaggtcaaaattgatactccaaaaacgagtgacaaacacctaagtatcttccagataactacagtggtaatatgtttcacagataaatctcct

SEQ ID NO: 470 - protein, 43 aa, Streptococcus agalactiae
MTGSTGDCFSKIKVKIDTPKTSDKHLSIFQITTVVICFTDKSP

SEQ ID NO: 471 - DNA, 861 bp, Streptococcus agalactiae
atggcaagtgtcaattatgacacgtcactaacccctgttcagtacaaagcgattgctcaccactatggtttggataagccagctccggtccagtattttatttggttaaaaaattttatacagggacatttagggacttcactagtttatcggcaacctgttattgatattattagatcacgggcaggtgcctctttcatacttatgggactctcctgggtcttatcgggtcttattggatttatcttaggaactttatcagctttccatcaagggaaattgcttgatcgaattgtaaggtggttttcttaccttcagatatcagtaccaactttttggattgggctcatttttttattaatcttttctgtccagctggggtggttcccgattggtatttcttccccgataggtactttgagtcaagatattacgttagctgatcgtattaagcaccttattttacctgttttcacgctaagtattctaggcattgccaatgtaactcttcatactagaactaaaatgatgtcggtactttctagtgaatatgtcttatttgccagagcgcgtggggaaacggaatggcaaatttttaaaaatcattgtcttagaaatgctatcgtaccagctattacactgcatttttcctattttggagaattgtttggaggatccgttcttgctgagcaagttttctcatatccaggactagggtctaccctaactgaagcaggacttaaaagtgatacaccgctacttctagctattgtgatgatagggacattatttgtttttgcgggcaatcttattgcggatattttaaacagcataatcaatccacagttaaggagaaaagta

SEQ ID NO: 472 - protein, 287 aa, Streptococcus agalactiae
MASVNYDTSLTPVQYKAIAHHYGLDKPAPVQYFIWLKNFIQGHLGTSLVYRQPVIDIIRSRAGASFILMGLSWVLSGLIGFILGTLSAFHQGKLLDRIVRWFSYLQISVPTFWIGLIFLLIFSVQLGWFPIGISSPIGTLSQDITLADRIKHLILPVFTLSILGIANVTLHTRTKMMSVLSSEYVLFARARGETEWQIFKNHCLRNAIVPAITLHFSYFGELFGGSVLAEQVFSYPGLGSTLTEAGLKSDTPLLLAIVMIGTLFVFAGNLIADILNSIINPQLRRKV

SEQ ID NO: 473 - DNA, 819 bp, Streptococcus agalactiae
atgatattgagacgtcgaactattgttttatggcaactgggtatcgccatttctctcattcttagtattctagccttaaatctttatttccatagtactcccttgcaaaccaatgcagctttacggaaccttgctccttcattaaaccatctttttgggacagatggtttaggtagggatatgtttgtcagaacgattaaaggactttatttctctctacaagtctgcttattaggtgcccttatgggggtcattctggcgacagtttttggagtgcttgcaggtttaggaaatagcattattgataaaataatagcatggttagttgatttgtttattggtatgcctcatttgatttttatgattctcatttcttttgttgttgggaaaggtgctcaaggggtcatcattgcaacggctgttacacattggccttctttagcaaggcttatccgcaatgaagtctatcatctaaagaataaagaatttgtccaactttctaaaagtatgggaaaaacgccttattatattgtgaggcatcatatcctgcctttgattgcttctcaaattttcattggttttatcctcttatttccacatgtcatcctacatgaagcatcaatgactttcttaggatttgggctctctgccgaacaaccttcggttggtatcattctgtcagaggcagctaagcatatctctcttggaaattggtggttggttatctttccaggactttatcttattttggttgtcaatgcatttgatactatcggagaatctttaaagaaactcttttaccctcaaactgatcatttt

SEQ ID NO: 474 - protein, 273 aa, Streptococcus agalactiae
MILRRRTIVLWQLGIAISLILSILALNLYFHSTPLQTNAALRNLAPSLNHLFGTDGLGRDMFVRTIKGLYFSLQVCLLGALMGVILATVFGVLAGLGNSIIDKIIAWLVDLFIGMPHLIFMILISFVVGKGAQGVIIATAVTHWPSLARLIRNEVYHLKNKEFVQLSKSMGKTPYYIVRHHILPLIASQIFIGFILLFPHVILHEASMTFLGFGLSAEQPSVGIILSEAAKHISLGNWWLVIFPGLYLILVVNAFDTIGESLKKLFYPQTDHF

SEQ ID NO: 475 - DNA, 801 bp, Streptococcus agalactiae
atgacagaaacattattaagcattaaagacctctccatcaccttcactcaatacggaagatttttaaaaccatttcaatcaacaccgatacaagcgctgaatttagaaattaaaaaaggtgagttattagctattataggtgctagtggttcagggaagagtttattagcacatgctattatggatattcttcctaaaaatgcatctgtaacaggagatatgatttatcgtggtcaatcactaaattctaaacgcattaaacagttgcgaggaaaagatattacgttgattccacaatcagttaattatttagatccatctacgaaagtcaaacatcaggtgcgcttaggtatctcagaaaattcaaaggctactcaagaaggattgtttcaacagtttggtttaaaagaaagtgatggtgacttgtatcctttccaactttctggcggaatgctccgacgtgttttgtttacaacgtgtattagtgataaggtttctttgattattgcggatgagcccacccctggattacatccagatgctctgcaaatggttttagaccaactacgctcctttgcagataaaggaataagcgttatatttatcactcatgatattgtagcagctagtcaaattgctgatcgtattactatttttaaagagggaaaagctattgaaacagctccagctagtttctttagcggaaatggagagcagttacaaacagaatttgctagaagtttatggcgctctctcccacagcaagaatttttgaaaggagttactcatgaccttagaggc

SEQ ID NO: 476 - protein, 267 aa, Streptococcus agalactiae
MTETLLSIKDLSITFTQYGRFLKPFQSTPIQALNLEIKKGELLAIIGASGSGKSLLAHAIMDILPKNASVTGDMIYRGQSLNSKRIKQLRGKDITLIPQSVNYLDPSTKVKHQVRLGISENSKATQEGLFQQFGLKESDGDLYPFQLSGGMLRRVLFTTCISDKVSLIIADEPTPGLHPDALQMVLDQLRSFADKGISVIFITHDIVAASQIADRITIFKEGKAIETAPASFFSGNGEQLQTEFARSLWRSLPQQEFLKGVTHDLRG

SEQ ID NO: 477 - DNA, 801 bp, Streptococcus pyogenes
atgacagaaacattattaagcattaaagacctctccatcaccttcactcaatacggaagatttttaaaaccatttcaatccacaccgatccaagcgctgaatttagaagttaaaaaaggtgagttattagctattataggtgctagtggttcaggcaagagtttattagcacatgctattatggatattcttcctaaaaatgcagctgtaacaggagatatgatttatcgtggtcaatcactaacttctaaacgcatcaaacagttgcgaggaaaagaaatgacgttgattccacaatccgttaattatttagatccatctatgaaagtcaagcatcaggtgcgcttgggtatctcagaaaatgctaaggctactcaagaaggattgtttcaacagtttggattaaaagaaagtgatggtgacttgtatcctttccaactttctggcggaatgctccgacgtgttttgtttacaacgtgtattagtgatacggtttctttgattattgcggatgagcccacccctggattacatccagatgctctgcaaatggttttagatcaactacgctcctttgcagataaaggaataagcgtcatatttatcacccatgatattgtagcagctagtcaaattgcggatcgtattactatttttaaagagggaaaagctattgaaacagccccagctagcttttttagcggaggtggggagcaattacaaacagaatttgcgagacgtttatggcgcacactccctcagcaagactttttgaaaggagttactcatgaccttagaggc

SEQ ID NO: 478 - protein, 267 aa, Streptococcus pyogenes
MTETLLSIKDLSITFTQYGRFLKPFQSTPIQALNLEVKKGELLAIIGASGSGKSLLAHAIMDILPKNAAVTGDMIYRGQSLTSKRIKQLRGKEMTLIPQSVNYLDPSMKVKHQVRLGISENAKATQEGLFQQFGLKESDGDLYPFQLSGGMLRRVLFTTCISDTVSLIIADEPTPGLHPDALQMVLDQLRSFADKGISVIFITHDIVAASQIADRITIFKEGKAIETAPASFFSGGGEQLQTEFARRLWRTLPQQDFLKGVTHDLRG

SEQ ID NO: 479 - DNA, 624 bp, Streptococcus agalactiae
atgaccttagaggctaaaaagcttggcttttatcataaaaaagatcaatggctttttaaggagattaatttagaggtagcacctggtcaagttttaggtatatttggacaaagtggttgtggaaaaactagtttatccagggtgcttgcaggttttttacatcctaaatctggtgaagtattagttgatggcagtaatttgcctagcaaagcatttagacctgtacaacttattcaacaacatcctgaaaaaacgatgaatcctttatggcctatgaaaaaaagtttggaagaagcctattacccaagtcgagatttactagatgcttttggaattcaagaaaaatggctaaatcgtcgacctagtgaactctcgggaggagaattacaacgcttttcgattgtgcgttcattacatccagagactaaataccttattgcagatgaaatgactactatgttggatagcattacacaagctagtgtatggaaaagcctgttggagattgtaaaggatagaaatttaggtctcatcgttattagtcatgatttcgctatgttagagaaactttgtaaccaatgctatatgattgaagagaatcgtatcgtatctttcaatggagat

SEQ ID NO: 480 - protein, 208 aa, Streptococcus agalactiae
MTLEAKKLGFYHKKDQWLFKEINLEVAPGQVLGIFGQSGCGKTSLSRVLAGFLHPKSGEVLVDGSNLPSKAFRPVQLIQQHPEKTMNPLWPMKKSLEEAYYPSRDLLDAFGIQEKWLNRRPSELSGGELQRFSIVRSLHPETKYLIADEMTTMLDSITQASVWKSLLEIVKDRNLGLIVISHDFAMLEKLCNQCYMIEENRIVSFNGD

SEQ ID NO: 481 - DNA, 624 bp, Streptococcus pyogenes
atgaccttagaggctaaaaagcttggcttttatcataaaaaagatcaatggctttttaaggagattgatttagaggtagcacctggtcaaatcttagggatatttggacaaagtgggtgtggaaaaacgagtttatccagagtgcttgctggttttttgcagcctaaatctggtgaagtattagttgatggcagtcatttgcctaacaaagcatttagacctgtacaacttatccaacaacatcctgaacaaaccatgaatcctttatggcctatgaaaaaaagtttggaagaagcctactatccaagtcaagatttgcgagatgcttttggcattcaagaaaaatggctaaagcgtcgtcctagtgaactctcgggaggggaattgcaacgcttttcgattgtgcgttcattacatccagagacgaaataccttattgcagatgaaatgactactatgttggatagcattacacaagctagtgtatggaaaagcctgttggagattgtaaaggatagaaatttaggtctcatcattattagtcatgagtttgatatgttagaaaaactttgtgacgcgtgctatatgattgaagagaatcgtactcaactgttcaagcatacc

SEQ ID NO: 482 - protein, 208 aa, Streptococcus pyogenes
MTLEAKKLGFYHKKDQWLFKEIDLEVAPGQILGIFGQSGCGKTSLSRVLAGFLQPKSGEVLVDGSHLPNKAFRPVQLIQQHPEQTMNPLWPMKKSLEEAYYPSQDLRDAFGIQEKWLKRRPSELSGGELQRFSIVRSLHPETKYLIADEMTTMLDSITQASVWKSLLEIVKDRNLGLIIISHEFDMLEKLCDACYMIEENRTQLFKHT

SEQ ID NO: 483 - DNA, 2028 bp, Streptococcus agalactiae
atggaacaatttaaacatgatgccaaagccttgttagaggcaattgggggtaaagaaaatattagtgcagtgacacattgtgctacacgcatgcgatttgttttgaatgacagtagtaaagctaaggtaaaggtaattgaggagttaccatcagtcaagggtacctttaccaatgctgggcaatttcaagtcattattggtaatgatgtccctattttttataatgcttttgtagccgtttctggtattgagggtgtgtctaaagaggcggcaaaatcggctgcccaaaaaaatcaaaaccctttacagcgtgtgttgacaatgctggctgaaatatttacaccgattattccagccattattgttggtggtctgatccttggttttcgtaatattttagatgccgttccatttgaatttttaggtcaaaaagttgttgatggtgtcaggcaagtagactcttctgggcatccaatttggaatactctagtagatgtttcaacgttttggagcggagtagactcttttttatggttaccaggtgaagctatatttcatttcttaccagttggtattgtatggtctgtgactcgtaagatggggactactcaaatcctcggtattgttctaggtatctgtctagtgtcgccacaattacttaatgcttattctgtagctagtacttcagcagcagacattgctaaaaattggtcttggaattttggttactttacagtacaaaaaattggttatcaagctcaagttattccagctctgttagctggtttgagcctgtcttacttagaaatcttctggagaaaacatattcctgaagttgtttcaatgatttttgtgccatttctatccttagttccagctattatcttggctcatactgtccttggacctattggttggacactaggtaaatggatttctgctatcgttcttattggattgactggtcctgtaaaatggctctttggtgctatttttggtgccctgtatgccccatttgttattactggtttgcaccacatgacaaatgctatcgatactcaactcatagcagatacaaaaacacatacaactggcctttggccgatgattgctctttcaaatattgctcagggttcagctgtactagcttattattttatgcatcgtcatgatgaaaaagaggctcaaatatcacttccagctgctatctcagcctaccttggtgttacagagccggcgctttttggtgtaaacgttaaatacatttatccatttgttgctggtatgattggttcaagtgtggcaggtcttttggcgacaacttttaatgtccaagctaactctattggtgtaggcggtcttccaggcttcctgtcaattaacgttaaatatatgggatatttctttatctgtatggcagtggctatctttattcctttatttttgacactattctttaaaaaatcaggtattttgacaaaaactgaagaggaaaaattagtacctgatgctgtcattgcttcaacaacagaaacaaaatcagcaaaagaaaaagctgtcgtatcaggtacaaagcttagtgtagtaagccctttatcaggtttagctaaaccactggatcaagctagtgatcctgtcttttcacaaggaattatggggaagggagtggttatcgatccaagtgatggagaactagtttcaccggtcgatgcgacagtttcagttcttttccctacgaaacatgctattggattgttaacatcagagggggttgagtttcttattcatattggtatggatactgttaatttagaaggaaaagggtttacctctcatgttgctcaaggtgacactgtaaaagtaggagataaactcattactttcgatattccaatgataaaagaagaaggatacattgtggaaactcctattctgattactaatcaacaagaattccgaccagaagaattgatagatttacccaaacagataaaacgtggacaagcattaatggttgccaagaaaatt

SEQ ID NO: 484 - protein, 676 aa, Streptococcus agalactiae
MEQFKHDAKALLEAIGGKENISAVTHCATRMRFVLNDSSKAKVKVIEELPSVKGTFTNAGQFQVIIGNDVPIFYNAFVAVSGIEGVSKEAAKSAAQKNQNPLQRVLTMLAEIFTPIIPAIIVGGLILGFRNILDAVPFEFLGQKVVDGVRQVDSSGHPIWNTLVDVSTFWSGVDSFLWLPGEAIFHFLPVGIVWSVTRKMGTTQILGIVLGICLVSPQLLNAYSVASTSAADIAKNWSWNFGYFTVQKIGYQAQVIPALLAGLSLSYLEIFWRKHIPEVVSMIFVPFLSLVPAIILAHTVLGPIGWTLGKWISAIVLIGLTGPVKWLFGAIFGALYAPFVITGLHHMTNAIDTQLIADTKTHTTGLWPMIALSNIAQGSAVLAYYFMHRHDEKEAQISLPAAISAYLGVTEPALFGVNVKYIYPFVAGMIGSSVAGLLATTFNVQANSIGVGGLPGFLSINVKYMGYFFICMAVAIFIPLFLTLFFKKSGILTKTEEEKLVPDAVIASTTETKSAKEKAVVSGTKLSVVSPLSGLAKPLDQASDPVFSQGIMGKGVVIDPSDGELVSPVDATVSVLFPTKHAIGLLTSEGVEFLIHIGMDTVNLEGKGFTSHVAQGDTVKVGDKLITFDIPMIKEEGYIVETPILITNQQEFRPEELIDLPKQIKRGQALMVAKKI

SEQ ID NO: 485 - DNA, 2022 bp, Streptococcus pyogenes
atgggaaaatttgaacaggatgctaagagtcttctaactgctattggtggtaaagaaaacatcaaggttgtcacacactgtgcaacgcgtatgcgttttgttttgaatgataataataaggcaaatgtcaaagagattgaaaaaatctctgtagttaaagggacatttaccaatgctgggcagtttcaggtaatcattggtaatgatgttccagttttttataatgactttacagctgtttctagtattgaaggggtgtctaaagaagctgccaaatcagcagctaaaagtaatcaaaatgccttacaacgggtgatgaccatgttggctgagattttcacacctattattccggcgattattgttggggggcttattttaggtttccgtaatattttggagagtgtgccttttgaatttcttgggcagcaggtcgaaaaagggaaattagtttttgatgcagctggggatcctgtttggaatacgattgtgagggtatctcctttctggtcaggggttaaccatttcttgtggttaccaggggaagctattttccacttcttaccagttgggattacttggtctgtgacgcgtaagatgggaaccactcaaattttagggattgtccttggtatctgtttggtgtcaccacaattattgaatgcctatgcggtggcaggaacgcctgctgctgagattgccaaaaactgggtttgggattttggtttctttaccattaatcgtattgggtatcaggcacaggttattccagcccttttagctggtctgtcccttgcttatcttgaaattttctggcgtaaacggattccagaagtggtttcaatgatttttgtgccattcctttctttgattccagctttgattttagcgcatacggtattggggccaatcggttggactattggtaaagggatttcctttgttgtgttagctggattgactggtcctgttaaatggctattcggtgctatctttggtgccttgtatgctccgctagttattactggtttacatcacatgacaaatgccattgatacccaattaattgctgatactgcaactcgtacaactggtttgtggccaatgattgctctttcaaatatcgctcaagggtcagccgtttttgcttactatttaatgaatcgtcatgaagaacgtgaggctgaaatatcgcttcctgcagcaatttctgcttaccttggggtaactgagcctgccttatttggggttaatgttaaatacgtttatccctttgtagccggaatgattggctcaggtattgcgggtctcttatcaacaacctttaatgttcaggcaaattctattggtgttggtggtttaccaggtttcatggctatcaatgtgaagtacatgattccattcttcatctgtatggcagtagccattgtggtgccgatgtttttaaccttctttttccgtaaatcacatatcatgactaagacagaagatgaagctaaactacctgagacacccgtttcggatgctcctgtagcaactgctccacataagactatgcaaggaacagttatcactttaacaagccctttaacgggtgaagttaaagcgttgtctgaagctgttgatcctgtctttgcacagggagttatgggccaaggtgctcttcttcaaccgacagaaggggtgttagtagcgccttgtgatgctgaagtatcggtcttgttcccaactaaacacgctatttgtttggtgacgactgaaggtttggaattattgatgcatattggcatggatacggttaacttagatggtcaaggatttgaagctttggtgaagcaaggtgatcaggttaaggctggacaaacattgattcaatttgatatagcagcaatttctgaagctggatacgccactgaaacgcctcttgtggtgactaatcaagatgtttttacggtaactgttgaaggtagtttaccgcgtcagattaaggttaatgataagttagcagtagcggtgaaaaag

SEQ ID NO: 486 - protein, 674 aa, Streptococcus pyogenes
MGKFEQDAKSLLTAIGGKENIKVVTHCATRMRFVLNDNNKANVKEIEKISVVKGTFTNAGQFQVIIGNDVPVFYNDFTAVSSIEGVSKEAAKSAAKSNQNALQRVMTMLAEIFTPIIPAIIVGGLILGFRNILESVPFEFLGQQVEKGKLVFDAAGDPVWNTIVRVSPFWSGVNHFLWLPGEAIFHFLPVGITWSVTRKMGTTQILGIVLGICLVSPQLLNAYAVAGTPAAEIAKNWVWDFGFFTINRIGYQAQVIPALLAGLSLAYLEIFWRKRIPEVVSMIFVPFLSLIPALILAHTVLGPIGWTIGKGISFVVLAGLTGPVKWLFGAIFGALYAPLVITGLHHMTNAIDTQLIADTATRTTGLWPMIALSNIAQGSAVFAYYLMNRHEEREAEISLPAAISAYLGVTEPALFGVNVKYVYPFVAGMIGSGIAGLLSTTFNVQANSIGVGGLPGFMAINVKYMIPFFICMAVAIVVPMFLTFFFRKSHIMTKTEDEAKLPETPVSDAPVATAPHKTMQGTVITLTSPLTGEVKALSEAVDPVFAQGVMGQGALLQPTEGVLVAPCDAEVSVLFPTKHAICLVTTEGLELLMHIGMDTVNLDGQGFEALVKQGDQVKAGQTLIQFDIAAISEAGYATETPLVVTNQDVFTVTVEGSLPRQIKVNDKLAVAVKK

SEQ ID NO: 487 - DNA, 1623 bp, Streptococcus agalactiae
atgacgattgataaacgtaaagttgtctatcaaatttatccaaaatcatacaaagacacaactggtaatggggttggtgatcttcgtggtattatcgaaaaattaccctatttagcagaacttggtattgatatggtttggctcaacccattttatccaagtccacaacgagataatggatatgatatctctgattatacagctattaaccctgattttggaacgatggacgattttgaagaaatgattgaggtgggacgtcaataccgtatagattttatgcttgatatggtgcttaatcattgttcaatagaacatgagtggtttaaaaaagcacttgcaggagatcgctactatcaagatttctttatcttacgtgataatccaacagattgggtatctaaatttggtggaaatgcttgggcaccatttggtgatacagggaagtattatcttcatctttttgatatcactcaagctgaccttaattggcgcaatgccgatgttcgcaaggaactttttaaagttgtcaatttttggcgtgataaaggggttaaaggttttcgatttgatgtgattaatttaattgggaaagatgagatacttgagaactgcccaattaatgatggaaaaccagcttatactgatcgtccaataacacatgattatctcaagatgttgaataatgctagttttggacaagatgattccttcatgacagttggtgaaatgtcttcaacgacaattgcaaattgcattctttacactgcaccagaacgtgaagagttatccatggcttttaattttcaccacctcaaagtagattataaagatgggcaaaagtggaccattatggcttttgattttcctgcattacgtgaccttttccatagttggggcgaagggatgagcgaaggaaatggttggaatgctttattctataataatcatgaccaaccgcgagcattaaatcgttttgtagacgtgaaacgttttcgaaatgaaggagcaaccatgttagcagcatctatccacttatcgcgtggtactccttatatatatatgggtgaagaaatcggaatgcttgatcccgattacagttctatggatgattatgtggatattgagagtttgaatgcctaccaaataatgcttgatgaaggcaagtcacaagaagaggcatttagcattattcgagcgaaatctcgagacaattctcgagtaccaatgcaatgggatgatagtacgaatgcaggtttttctgaaggcgctccatggttgaaagtaggaaaatcatataaagaaatcaatgtcgcaaaggagaaaacagggctgatatttactttctatcaagagttgataaggctacgtaaacaactgccaataatagctgacgggaattataaagcagctttcaaagataatgaaaaagtatatgcttttgaacgccatcttgataaggaaaaacttcttgttttaaataatttctttgctgagaaagttaagataaaattaccggagaattatctccaaggacaagttcttctatcaaattataaggatgttactcttgatgaaacggttactttgcaaccttatcaaactttagctatcttagtgtca

SEQ ID NO: 488 - protein, 541 aa, Streptococcus agalactiae
MTIDKRKVVYQIYPKSYKDTTGNGVGDLRGIIEKLPYLAELGIDMVWLNPFYPSPQRDNGYDISDYTAINPDFGTMDDFEEMIEVGRQYRIDFMLDMVLNHCSIEHEWFKKALAGDRYYQDFFILRDNPTDWVSKFGGNAWAPFGDTGKYYLHLFDITQADLNWRNADVRKELFKVVNFWRDKGVKGFRFDVINLIGKDEILENCPINDGKPAYTDRPITHDYLKMLNNASFGQDDSFMTVGEMSSTTIANCILYTAPEREELSMAFNFHHLKVDYKDGQKWTIMAFDFPALRDLFHSWGEGMSEGNGWNALFYNNHDQPRALNRFVDVKRFRNEGATMLAASIHLSRGTPYIYMGEEIGMLDPDYSSMDDYVDIESLNAYQIMLDEGKSQEEAFSIIRAKSRDNSRVPMQWDDSTNAGFSEGAPWLKVGKSYKEINVAKEKTGLIFTFYQELIRLRKQLPIIADGNYKAAFKDNEKVYAFERHLDKEKLLVLNNFFAEKVKIKLPENYLQGQVLLSNYKDVTLDETVTLQPYQTLAILVS

SEQ ID NO: 489 - DNA, 1626 bp, Streptococcus pyogenes
atgacaattgataaaaagaaagtcgtctatcaaatttacccaaaatcctataaggacacgactggaaatggtgtgggagacttgctagggatcattgataaattgccttacttacaagaactaggaatagatatgatttggttgaaccctttctaccctagtccacaacgagacaatggctatgatgtttcagattatacggcggtcaaccctgattttggaacaatggctgattttgaaaatttggtaaaagctgctaaggagcatcagattgagttaatgttggacatggttttgaatcactgttccacagaccacgagtggttccaaaaagctttagcaggagacccttattatcaggatttctttatcttgagagatcagccgactgattgggtttccaaatttggtgggaatgcttgggcgccttttggagatacaggcaaatactacttacacttgtttgatgtgacacaggctgacttgaattggcggaacccacatgttcgtgaggaattggctaaagtggttaatttttggcgagataaaggagtgaaggggttccgttttgatgtgattaacctgattgggaaagatgaagagctggtggattgtccggtcaatgatggtaagccagcttatacggatcgtcctattactcacacttatcttcatgatctcaatcaagccagttttggtcaggatgattcgtttatgacagtaggggaaatgtctgcaacgactattgacaactgtcttttatacacggctcccgaacgtgaggagctatccatggcttttaatttccaccatctaaaagttgattatgagaacggtcagaaatggactattatggcttttgattttgcagcgctgcgagacttattccatgcttggggtgaaggcatgagtcagggcaatgggtggaatgccttgttctacaataaccatgatcaaccacgtgccctgaatcgttttgttgatgtaacacatttccgaaacgaaggtgcgacgatgttagcagcttccatccatttgtcacgaggaacgccttacatttatatgggtgaggagattggcatgcttgatccagactttgatagtatggatgattatgtggatgtggaaagtctcaatgcttactcaagcttattagtctcaggtaaaagtgcagaagaagcctttgccattatcaaggccaagtcaagggacaatgccagaacaccaatgcaatgggatgctagtgaacatgctggctttacgactggtaagccttggttagaggttggcaaatcttatcgagacatcaatgtcgaaacagaaaaagagggacgtatttttcctttctaccaacgcttgattgctttgcggaaggaactccctattattgctgaaggggactatcgggctgcttttaaagatagtcaggctgtctatgcctttgaacgccatttaggtgaccagtgtttgcttgttctcaatcatttctatgctgatgaggtcgaactggaattacctccacgttatcaacatggacaggtcttaatcagcaactatgagaaagtttctatttgtgaaaaagtgatactgaaaccttatcagacacttgctatcttagctgataac

SEQ ID NO: 490 - protein, 542 aa, Streptococcus pyogenes
MTIDKKKVVYQIYPKSYKDTTGNGVGDLLGIIDKLPYLQELGIDMIWLNPFYPSPQRDNGYDVSDYTAVNPDFGTMADFENLVKAAKEHQIELMLDMVLNHCSTDHEWFQKALAGDPYYQDFFILRDQPTDWVSKFGGNAWAPFGDTGKYYLHLFDVTQADLNWRNPHVREELAKVVNFWRDKGVKGFRFDVINLIGKDEELVDCPVNDGKPAYTDRPITHTYLHDLNQASFGQDDSFMTVGEMSATTIDNCLLYTAPEREELSMAFNFHHLKVDYENGQKWTIMAFDFAALRDLFHAWGEGMSQGNGWNALFYNNHDQPRALNRFVDVTHFRNEGATMLAASIHLSRGTPYIYMGEEIGMLDPDFDSMDDYVDVESLNAYSSLLVSGKSAEEAFAIIKAKSRDNARTPMQWDASEHAGFTTGKPWLEVGKSYRDINVETEKEGRIFPFYQRLIALRKELPIIAEGDYRAAFKDSQAVYAFERHLGDQCLLVLNHFYADEVELELPPRYQHGQVLISNYEKVSICEKVILKPYQTLAILADN

SEQ ID NO: 491 - DNA, 144 bp, Streptococcus agalactiae
gtgctgcttgtggaaaggaatcttgctctagattttgcaatttctttcttttttctttactctataacaatagcccaaattcattcaattgatagtagtgccagattgggctcaaatgacctagaaaaatgtaaacggttacta

SEQ ID NO: 492 - protein, 48 aa, Streptococcus agalactiae
MLLVERNLALDFAISFFFLYSITIAQIHSIDSSARLGSNDLEKCKRLL

SEQ ID NO: 493 - DNA, 1917 bp, Streptococcus agalactiae
atggttgataataagactgttgtgataatgttggtatttttagctcggaaaaatctttccttgtatgagttaacagtgcaaacaaagttttcaataaaagttatcatagagcaaattaactatctcaatagttttttagcaaaaaatcacctaccagctattgctcactctgctggacgttatcagttattaggagatgaaaaagagcatgataaaattgtctccttattagaagctgagcaattttacctaacccaggaagaaagggtatgtctgatttacctttatagcttttgccgaagagagtttgtctccaatgtgcattatcaagattttttgaaagtaagtaagaatactactttatcagatatcaagatgctacgttctaaattagcaaaaagaggtatctcactcacttatacaagagcaaagggatatagtctagtaggagatgagatggataagcatcaagttgcttttcagatgataactcaactactagaatctcccattggtttttggtctttgaattatatcttgtcttcttggaaattcgctctctcatatgagaagttagaaaagacggtagaatatttctatgaatcttttcaactttctccaatacaagataggcttgagaaatctttatattttatcattttaatactgtgtcgttatcaaaggtcagtagatcgtgttttgcagggttctcctattgtttctgaacaattaaaagagttaacgactattattgtgactaatttaagtcaggatatttccttatctaaaccattagatcagaaagaaaaagattatattaccttgatcttatctggctgttttgaaggtgagggaactaaagatgatgatttctttgaagcattggcaaaagcaatcgttgatgagatggaaactgtttcacttcttaatttttccaataaagaagagttattacaaggtctgaagcgtcatattattccagcttatttccgattgaaatatggtttaactggcgatagtggttatacacaaaatattaaagagcattacagtgatttatttctattggttaaaaaggcactacgtcctttggaagagcaagtaggattaatacccgatagtgaaatttcttacttcgtgattcactttggaggctatcttagacaatcaggtggtacacaatcaatgtcttataaagctttgatactctgtccaaacggcgttagttcatccttagtgattaaggaaaaattgcgtggattatttcctcaaattcattttcatcgtgtctctaaaattgagcagctgaaactgattgacaatcaaacttacgatatggtcttttctactatatttgtagaaacaaaaaaacctaattatctagtttcgctgatgatgacagcagagcaagtacaacagctcaaagaactggttatttcagattttcccaaggcttgccttgacgatttccaacttgatcaattaatagcaactataaaaaaatacgctcatgttcattgtgaagaggaattaaaattggctttgaggacaatggtaaaacaagatatacttagaaaggatgtgaggcccttgttgcaccaacttataacagaggaaacttatcagacaagttctgaacaaatgaattggaaagaggcaattcgtttagcggcaaaacccttgttagcttctggaaaaattacggaaagttacccagaagctatgattgaaaaagtcgaagagtttggtccttttatcaatcttggtaaaggtattgctattccacatgccagaccagaagatggggtaaactctgtcggtatgtcaatgcttgttttggaacagccacgccgtacgcatgaaaactttctcttcatccttttgtgcccggacatcaattttgaaaagattcctttt

SEQ ID NO: 494 - protein, 639 aa, Streptococcus agalactiae
MVDNKTVVIMLVFLARKNLSLYELTVQTKFSIKVIIEQINYLNSFLAKNHLPAIAHSAGRYQLLGDEKEHDKIVSLLEAEQFYLTQEERVCLIYLYSFCRREFVSNVHYQDFLKVSKNTTLSDIKMLRSKLAKRGISLTYTRAKGYSLVGDEMDKHQVAFQMITQLLESPIGFWSLNYILSSWKFALSYEKLEKTVEYFYESFQLSPIQDRLEKSLYFIILILCRYQRSVDRVLQGSPIVSEQLKELTTIIVTNLSQDISLSKPLDQKEKDYITLILSGCFEGEGTKDDDFFEALAKAIVDEMETVSLLNFSNKEELLQGLKRHIIPAYFRLKYGLTGDSGYTQNIKEHYSDLFLLVKKALRPLEEQVGLIPDSEISYFVIHFGGYLRQSGGTQSMSYKALILCPNGVSSSLVIKEKLRGLFPQIHFHRVSKIEQLKLIDNQTYDMVFSTIFVETKKPNYLVSLMMTAEQVQQLKELVISDFPKACLDDFQLDQLIATIKKYAHVHCEEELKLALRTMVKQDILRKDVRPLLHQLITEETYQTSSEQMNWKEAIRLAAKPLLASGKITESYPEAMIEKVEEFGPFINLGKGIAIPHARPEDGVNSVGMSMLVLEQPRRTHENFLFILLCPDINFEKIPF

SEQ ID NO: 495 - DNA, 2160 bp, Streptococcus pyogenes
ttgagtccaattgcagtcaaaaatgacatgagacaattggactcaatttatcttgaaaatgaaaacgcttcattttatactgacattataggaggagatgacatgctatctcatgagctcatcagaaactatcaactcttttctaaatataaaggacattcactggaggcatttgaatccattttaaaggcaagcaaacgtcatatactggcagatattgctaaaatcaatgacacgttgtcactctatcagttaccccttattgctctggacaggcagctggtttatccgccagaccttactgaaaaggacttgttgaatcgcatgctacctaccttagacgactatctctttcaagatgagcgtctggatatgattatcatttacatcatgatggctaaagaatttatctccattaaccacttggaaagcttgttacggctcagcagaaattctgttattgctgatttaaacttggtgcgtgatcgggtacaagcttttcaggtaactttagcttacaatcgccaggatggttatttttttgaaggagaacccttagccttgcggcgtctcttagaatcagcggtcagttctcttttgcaagtcacatctggaccttgggtgttcagttacttattgcatgaacttggtttgcccgaccagaaaaaggtgatggcagcaacgttggaggaactgagcagggagaaccacttaacttttatttcggagaaattgagggatttgatttattttttctgccttctcgctcatcgaccattttcacggaacgtaagggctgaagcagtggatacttttcctttagcttcgccagctgttgaaacgatggtggaccagttattggtcaacttccccagtctaaccgaagaaaaatatttggttcaatctaggttacttggttgtatccaaggtgacttagagttagtctttcagcaacctatttatgacattatggaggaaatcatcaattcggtggcggttaacacgggattgtctatcaccgataccccagaacttcgtcagaacctatacagtcaccttttgccagcttattaccgactttactacgacattaacttgaccaatcctttgaaggaacaaatcaaacaagattatgaatctctcttttacttggtcaagcgcagcctttctcctctagaaaaacaattggggaaatcagttaatgaagatgaggttgcttattttaccattcattttgggagatggttgcaggcccctaagaagaggccaagcaatcagctggtagccttatctgtttgccctaatggcattagttcgtctctgatgttggaggcaaccttgaaggaactttttccacagctacagtttattaggattcaccagctggacaaaataaagttgttggatccagcatcctttgatttgattttttcaacagtagcttttgactgtgctaaacctgtttatgtgacgcaagctttgatgggacctgttgaaaaaatgatgttgaaaaagatggtctgtgatgactttcatcttcccttgtcagagcaattcgctttggatgatctgttgagtattattcataaacataccacgattactaataaagaaggacttgttagtgatttatcccgttacctgattggtaaccatttaacgattgaaaaaggaggtctaggactattggacttgttaacagcagattttattaggcaggctgatgctgtttcggattggcaggaagcgattcgtttggctgctcagcctttactagaacaccagatgattgaaacatcttatatcgatggcatgattgattcggtcaatgagcttggggcctatattgttttagcccctaaggtggctgttcctcatgcggcgcctgaaaaaggaacgcggcagttaggcatgtctctcttacaactaaaagaacctgtcagctttgatttgaagcaagaaggtgatccagacaagcaagtgcaattgatttttgttttgtctgctgtggattctagttcacatttgaaggctttgcaggaactgtcgttgattttagatgatgatgaacatattgagcaattaattgaggctaagaatactgaggaaataatgagtctgattagccatatgattgaaaaaggagacgaatcacatgat

SEQ ID NO: 496 - protein, 720 aa, Streptococcus pyogenes
LSPIAVKNDMRQLDSIYLENENASFYTDIIGGDDMLSHELIRNYQLFSKYKGHSLEAFESILKASKRHILADIAKINDTLSLYQLPLIALDRQLVYPPDLTEKDLLNRMLPTLDDYLFQDERLDMIIIYIMMAKEFISINHLESLLRLSRNSVIADLNLVRDRVQAFQVTLAYNRQDGYFFEGEPLALRRLLESAVSSLLQVTSGPWVFSYLLHELGLPDQKKVMAATLEELSRENHLTFISEKLRDLIYFFCLLAHRPFSRNVRAEAVDTFPLASPAVETMVDQLLVNFPSLTEEKYLVQSRLLGCIQGDLELVFQQPIYDIMEEIINSVAVNTGLSITDTPELRQNLYSHLLPAYYRLYYDINLTNPLKEQIKQDYESLFYLVKRSLSPLEKQLGKSVNEDEVAYFTIHFGRWLQAPKKRPSNQLVALSVCPNGISSSLMLEATLKELFPQLQFIRIHQLDKIKLLDPASFDLIFSTVAFDCAKPVYVTQALMGPVEKMMLKKMVCDDFHLPLSEQFALDDLLSIIHKHTTITNKEGLVSDLSRYLIGNHLTIEKGGLGLLDLLTADFIRQADAVSDWQEAIRLAAQPLLEHQMIETSYIDGMIDSVNELGAYIVLAPKVAVPHAAPEKGTRQLGMSLLQLKEPVSFDLKQEGDPDKQVQLIFVLSAVDSSSHLKALQELSLILDDDEHIEQLIEAKNTEEIMSLISHMIEKGDESHD

SEQ ID NO: 497 - DNA, 123 bp, Streptococcus agalactiae
ttggagaaagaggctaagcagatcattgatttaaaaaggaatcttttcaaaattgatgtccgggcacaaaaggatgaagagaaagttttcatgcgtacggcgtggctgttccaaaacaagcat

SEQ ID NO: 498 - protein, 41 aa, Streptococcus agalactiae
MEKEAKQIIDLKRNLFKIDVRAQKDEEKVFMRTAWLFQNKH

SEQ ID NO: 499 - DNA, 105 bp, Streptococcus pyogenes
ttggagaaagaggctaagcagatgattgatttaaaaaggaatcttttcaaaattgatgtccgggcacaaaaggatgaagagaaagttttcatgcgtacggcgtgg

SEQ ID NO: 500 - protein, 35 aa, Streptococcus pyogenes
LEKEAKQMIDLKRNLFKIDVRAQKDEEKVFMRTAW

SEQ ID NO: 501 - DNA, 1140 bp, Streptococcus agalactiae
gtgactacgatgattgattttattatttctattgatgattgcgcagttgaattggatagtcgtcaatcttggaaaattcgctaccccttatcaaccattctatttcttgtctttgtttgtcagttagctggcattgaaacctggaaggagatggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccattcctcagttattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctaggggacagattgaagttagagaatactgggtgtcttccgatatcaaatggttgtgtcaaaaccatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggc

SEQ ID NO: 502 - protein, 380 aa, Streptococcus agalactiae
MTTMIDFIISIDDCAVELDSRQSWKIRYPLSTILFLVFVCQLAGIETWKEMEDFIEMNEPLFATYVDLSEGCPSHDTLERVISLVNSDRLKELKVQFEQSLTSLDAVHQLISVDGKTIRGNRGKNQKPVHIVTAYDGGHHLSLGQVAVEEKSNEIVAIPQLLRTIDIRKSIVTIDAMGTQTAIVDTIIKGKADYCLAVKGNQETLYDDIALYFSDVNLLEELQENAQYYQTVEKSRGQIEVREYWVSSDIKWLCQNHPKWHKLRGIGMTRNTIDKDGQLSQENRYFIFSFKPDVLTFANCVRGHWQIESMHWLLDVVYHEDHHQTLDKRAAFNLNLIRKMCLYFLKVMVFPKKDLSYRRKQRYISVHLEDYLVQLFGERG

SEQ ID NO: 503 - DNA, 1140 bp, Streptococcus pyogenes
gtgactacgatgattgattttattatttctattgatgattgcgcagttgaattggatagtcgtcaatcttggaaaattcgctaccccttatcaaccattctatttcttgtcttcgtttgtcagttagctggcattgaaacctggaaggagatggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccattcctcagttattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctaggggacagattgaagttagagaatactgggtgtcttccgatatcaaatggttgtgtcaaaaccatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggc

SEQ ID NO: 504 - protein, 380 aa, Streptococcus pyogenes
VTTMIDFIISIDDCAVELDSRQSWKIRYPLSTILFLVFVCQLAGIETWKEMEDFIEMNEPLFATYVDLSEGCPSHDTLERVISLVNSDRLKELKVQFEQSLTSLDAVHQLISVDGKTIRGNRGKNQKPVHIVTAYDGGHHLSLGQVAVEEKSNEIVAIPQLLRTIDIRKSIVTIDAMGTQTAIVDTIIKGKADYCLAVKGNQETLYDDIALYFSDVNLLEELQENAQYYQTVEKSRGQIEVREYWVSSDIKWLCQNHPKWHKLRGIGMTRNTIDKDGQLSQENRYFIFSFKPDVLTFANCVRGHWQIESMHWLLDVVYHEDHHQTLDKRAAFNLNLIRKMCLYFLKVMVFPKKDLSYRRKQRYISVHLEDYLVQLFGERG

SEQ ID NO: 505 - DNA, 198 bp, Streptococcus agalactiae
gtggaacagcctatttatttattggatgaccccaaacaggaaatttatctcttattatgcatagcagctattgataatgaaacgcatttgaaagctctatcgcatttgacaacaatacttcgtgataataataatgttaaagctttgttagcttcacgtaggtatcaagatattgaaatgattataaaacaggaggat

SEQ ID NO: 506 - protein, 66 aa, Streptococcus agalactiae
MEQPIYLLDDPKQEIYLLLCIAAIDNETHLKALSHLTTILRDNNNVKALLASRRYQDIEMIIKQED

SEQ ID NO: 507 - DNA, 282 bp, Streptococcus agalactiae
atgttaagaattggaacagcatgtggatcaggtttaggttcaagttttatggtacaaatgaatattgagtctattttgaaggatttgggggtttctgatgttgaagttgaacattatgatttaggtggagcagatccaagtgcagcagatgtttggattgttggtcgtgatttggaggattcagctggtcacctgggggatgttcgtattttaaacagtatcattgatatggatgaattgagagaattagtgacaggtatttgccaagaaaaaggcttaatc

SEQ ID NO: 508 - protein, 94 aa, Streptococcus agalactiae
MLRIGTACGSGLGSSFMVQMNIESILKDLGVSDVEVEHYDLGGADPSAADVWIVGRDLEDSAGHLGDVRILNSIIDMDELRELVTGICQEKGLI

SEQ ID NO: 509 - DNA, 303 bp, Streptococcus pyogenes
ttgaaaaaggagacgaatcacatgattaaaattgtaacggtttgtggaaacggtattggtagtagcttgttacttcgcatgaaagtagaagctatcgcctctagtttgggtattgatgtggatgcagaatcctgtgattccaatgcggctgttggaaagggtgcagatttgtttgttaccgttaaagaatttaaagatatttttccagaggatgccaaggtttgtatcgttaaaagctataccaatcgtaaaaaaattgaagaagatttggttccggttctcaaggaaatgagtggcaaggaa

SEQ ID NO: 510 - protein, 101 aa, Streptococcus pyogenes
LKKETNHMIKIVTVCGNGIGSSLLLRMKVEAIASSLGIDVDAESCDSNAAVGKGADLFVTVKEFKDIFPEDAKVCIVKSYTNRKKIEEDLVPVLKEMSGKE

SEQ ID NO: 511 - DNA, 93 bp, Streptococcus agalactiae
atgacagtagtgccagtcacaatcatgactatcatactaaccaatccaccaacaaaacttgagataaaaccaatcaatactgcattaggtgca

SEQ ID NO: 512 - protein, 31 aa, Streptococcus agalactiae
MTVVPVTIMTIILTNPPTKLEIKPINTALGA

SEQ ID NO: 513 - DNA, 1353 bp, Streptococcus agalactiae
atgaaaggtctattggattttttagttaatattgccagcacgccagctattttagtcgccttgatagccattatcggtttagtactgcagaaaaaaggcgttcctgatattgtaaaaggtggaataaaaacatttgttggcttcttagtggtttctggaggtacagggatagtccaaaattccttgaatccatttggaaaaatgtttgaacatgcttttcatttggtgggggtagttcctaataatgaagccattgtagcagtagctcttacgaagtatggctcagcaactgctttgattatgttagcgggaatgatttttaatattttaattgctcgttttacaaaatttaaatatatttttctgacaggacatcatacattgtatatggcttgtatgattgctgttatttttgccgtagcaggctttacttcgttctcgctcatcctttttggaggtctagcgttagggattattatgagcgtatctcctgcatttgtgcaaaaatacatgattcaactgacaggtaatgataaggtggcacttgggcactttggttctttaggctattggttgagtggatttattggtggaattgttggagataaatcaaaatcaacagaagatattaaatttccaaagagtttatcatttttacgtgacagtaccgtaagtattactatctcaatggcaattatttaccttatcgttgcagtgtttgctggtgaggcttatattgcaaaagaaataagtaacggtgtcaatggtcttgtttatgccctccaactagctgggcaatttgcggcaggtgtattcgttattttagcaggtgtacgccttatcctaggtgaaattgtaccagcctttaagggaatctcagaaaaattggttccaaattcaaaaccagccttggattgtccaattgtttacccttatgcacctaatgcagtattgattggttttatctcaagttttgttggtggattggttagtatgatagtcatgattgtgactggcactactgtcattttaccaggggtcgttcctcatttcttctgtggggcaacggcaggtgttatcggtaatgcttctggtggtgtgagaggagcgactattggtgcatttgttcaaggtatcctcatcagtttcttgccgattttcttgatgcctgtactaggtggacttggtttcaaagggtcaacattctcagatgctgattttggtttgaccggtatcattcttggcgctcttaatcatgtcggcggtgcgatagctattgttattggtattgtagttatcttaattggactttttggcatttcatttgttggaaaatcaacccataaggaaggt

SEQ ID NO: 514 - protein, 451 aa, Streptococcus agalactiae
MKGLLDFLVNIASTPAILVALIAIIGLVLQKKGVPDIVKGGIKTFVGFLVVSGGTGIVQNSLNPFGKMFEHAFHLVGVVPNNEAIVAVALTKYGSATALIMLAGMIFNILIARFTKFKYIFLTGHHTLYMACMIAVIFAVAGFTSFSLILFGGLALGIIMSVSPAFVQKYMIQLTGNDKVALGHFGSLGYWLSGFIGGIVGDKSKSTEDIKFPKSLSFLRDSTVSITISMAIIYLIVAVFAGEAYIAKEISNGVNGLVYALQLAGQFAAGVFVILAGVRLILGEIVPAFKGISEKLVPNSKPALDCPIVYPYAPNAVLIGFISSFVGGLVSMIVMIVTGTTVILPGVVPHFFCGATAGVIGNASGGVRGATIGAFVQGILISFLPIFLMPVLGGLGFKGSTFSDADFGLTGIILGALNHVGGAIAIVIGIVVILIGLFGISFVGKSTHKEG

SEQ ID NO: 515 - DNA, 1233 bp, Streptococcus pyogenes
atggaagcattattatcatttattcgagatattttaaaagaacctgcatttttaatgggcttgattgcctttgcagggttggtggctttgaaaacacctgctcataaggtgttgacaggaaccttggggccgattttgggataccttatgcttgttgcaggggcgggtgttattgtgaccaatttggaccctcttgccaaactcattgagcacggttttagcatcactggcgtagtgccaaataacgaagccgtcacttctgtcgctcaaaagattctgggtgtggaaactatgtccatcttggtggttgggttattgctcaatttggcttttgctcgttttacccgcttcaaatacattttcttaacaggacatcacagcttctttatggcttgtctcttgtccgccgtgcttggagctgttggtttcaaaggaagtcttttgattatcttagatgggttcctcttgggagcttggtcagctatttcgccagccattggtcaacagtatactctgaaagtgactgacggagatgaaatcgctatgggacactttggtagtttgggctattacctttctgcctgggttggtagcaaggttggcaaagacagtaaagataccgaagaccttcagatttctgaaaaatggagtttcttgcgcaacaccaccatttcaacaggacttatcatggtgattttctacttggtggcaacagtggcttctgttttgaggaatgcttcagtagcagaagaattagcagcaggtcaaaacccatttatttttgccattaagagtggtcttacctttgcggttggtgtggcaattgtctacgccggtgttcgcatgattttggctgacttgattccagccttccaaggtattgctaacaaattaattccaaatgctattccagccgtggattgtgcggtattcttcccttatgcgccaaccgctgttatcatcggttttgcgtcaagtttcgttggtggcttacttgggatgttgattttaggagttgcaggtggtgtcctgattatcccaggtatggtgcctcatttcttctgcggtgcaacagcagagatttttggaaattcaacaggtggtcgtcgcggtgcgatgattggtgcttcgctaatggcttattactcgccttcttgccagccatgcttctacctgtacttggtaaacttggtttttcaaacacgacctttggagatgtggatttcggtgttt

SEQ ID NO: 516 - protein, 411 aa, Streptococcus pyogenes
MEALLSFIRDILKEPAFLMGLIAFAGLVALKTPAHKVLTGTLGPILGYLMLVAGAGVIVTNLDPLAKLIEHGFSITGVVPNNEAVTSVAQKILGVETMSILVVGLLLNLAFARFTRFKYIFLTGHHSFFMACLLSAVLGAVGFKGSLLIILDGFLLGAWSAISPAIGQQYTLKVTDGDEIAMGHFGSLGYYLSAWVGSKVGKDSKDTEDLQISEKWSFLRNTTISTGLIMVIFYLVATVASVLRNASVAEELAAGQNPFIFAIKSGLTFAVGVAIVYAGVRMILADLIPAFQGIANKLIPNAIPAVDCAVFFPYAPTAVIIGFASSFVGGLLGMLILGVAGGVLIIPGMVPHFFCGATAEIFGNSTGGRRGAMIGASLMAYYSPSCQPCFYLYLVNLVFQTRPLEMWISVF

SEQ ID NO: 517 - DNA, 855 bp, Streptococcus agalactiae
atgacatcaccagaagaaagatattcatctctaagacgatttgcaacggagattcgtttaaatactctagaaacgctaaaccatttaggattcggtcactatgggggtagtttatcaattgttgaggctttggctgttctgtatggtgatattatggatataaatcctgaaaaattcaaagaaagtgatcgggattatatggtcttatcaaaaggacatgctggtccagccttgtatagtacactctatttaaaaggtttttttgataaaacattccttcattcgctcaatacaaacggtaccaaactaccttcgcatcctgaccgcaatttaactcctggtatagatgtaacgacaggctcgttaggtcaaggcattagtattgcaacgggaattgcttatgctcaaaagattgagaattcaagctattatacttatactattgtaggtgatggtgaattaaatgaaggacaatgttgggaggctatacaatttgctgcgcatcatcaactgcaccatttaattgtttttgtagatgataataaaaaacaattagatggtttgacagctgatatttgtaatcctggagactttgttgctaaatttgaagcttttggatttgatgcagtacgtgtaaaaggagatgacattgaggcaattgacaaagctattaaaacttttcaagattcaaatagtgtcagaccaaaatgtattgttttagatagcatcaagggacaaggtgtgaaagagttggaggagttagcttctaatcatcatttacgaccagatttacaacaaaaaacaatgttagagcgagcgttgataagcttgagagaaagtttggaggtggtagaa

SEQ ID NO: 518 - protein, 285 aa, Streptococcus agalactiae
MTSPEERYSSLRRFATEIRLNTLETLNHLGFGHYGGSLSIVEALAVLYGDIMDINPEKFKESDRDYMVLSKGHAGPALYSTLYLKGFFDKTFLHSLNTNGTKLPSHPDRNLTPGIDVTTGSLGQGISIATGIAYAQKIENSSYYTYTIVGDGELNEGQCWEAIQFAAHHQLHHLIVFVDDNKKQLDGLTADICNPGDFVAKFEAFGFDAVRVKGDDIEAIDKAIKTFQDSNSVRPKCIVLDSIKGQGVKELEELASNHHLRPDLQQKTMLERALISLRESLEVVE

SEQ ID NO: 519 - DNA, 2187 bp, Streptococcus pyogenes
gtggccactgtgtcaacaggctctcttatattcatcgtcaaaaagaatccaccaatgatgtccaaactagtttttttctggcaaaatagagaaaaagaatttagggactttggaggattttctgaaaaaagcgtctatttttgtgatacaatagacaatagaaaacgtttaattttagttgtaataaacagagaggttttacttatgacatttgatgcaattgaccagttggcagtaaacactgtccgcaccctatcaatggatgccattcaagcggcaaattctggacacccaggacttccaatgggggcagcacctatggcctatgttctttggaatcacttcatgaacatcaatcccaaaacaagccgtaattggtcaaacagagaccgttttatcctatcagcaggtcatggaagtgccatgctttatagcttgttacacttagctggttatgatttatctgtagaagatttaaagaacttccgtcaatggggttctaaaacaccaggtcacccagaagtgaaccacacagacggtgtcgaagcaaccacaggacctcttggtcaagggatcgcaaatgccgttgggatggccatggcagaagctcatctagcagctaaatttaacaaaccaggctttgacatcgttgatcactacacatttgctttgaatggtgacggtgaccttatggaaggggtcagccaagaagcagcaagtatggcaggacatttaaaacttgggaaattggtcttgctatatgattcaaacgacatctctcttgatggtccaacctctatggctttcacagaagatgtgaaaggacgtttcgaagcttatggttggcaacatatccttgtgaaagatggaaatgatttagaagaaattgcagctgctattgaagcagctaaagctgaaactgagaaaccaaccatcatcgaagtcaaaaccattattggttttggtgccgaaaaacaaggaacttcagctgttcacggcgctcctcttggagcagaaggcattgcttttgccaaaaaagcttaccaatggactcatcaagattttgaagtgcctgctgaagtaacagagcgctttgctcaaggtcttcaagcgcgtggtgaaaaagcagaacaagcctggaatgacttgtttgcagcttatgaagcagaatatccagaattagcagcagaataccaaaaagcctttactaacgaagctgctcaagtagaacttgaagcgcacgaacttggtagttcaatggcgagtcgtgtatccagtcaacaagccatccaacaaatttcagaacaagtagcctctttctggggtgggtcagcagacctttcagcttcaaacaatactatggttaaggctgaaacagatttccaaccaggtcactacgaaggccgtaacatctggtttggcgttcgtgaatttgccatggctgcagccatgaacggtattgcccttcacggcgggacacgcgtttacggcggaaccttctttgtcttctcaaactatcttcttccagctgttcgtatggcagcgctccaaaacttgccaacagtttatgtcatgacacatgattctatcgctgtcggtgaagatgggccaacgcacgaaccaattgaacaattggcaagtgttcgctcaatgcctaacttgaacgttattcgtccagcagacggtaacgaaacaaatgctgcttggaaacgtgccattgctgaaacagatcgcccaaccatgcttgtattgacgcgtcaaaaccttccagtgcttgagggcacaaaagaattggcagaagatggtcttagcaaaggagcttatatcttgtcagaagccaaaggcgaccttgatggtatcttgattgcaacaggttcagaagtgaaactggcaatggatactcaagaagctcttgaagcagaaggcattcatgtgcgtgtcgtatctatgccatcacaaaatatctttgacgaacagtcagcagagtataaagaaagcatcctaccagcagctgtgactaaacgtctcgctatcgaagcaggttcaagctttggctgggcaaaatatgtcggcctatcaggaaaaacattgaccattgacacttggggtgcttcagctccaggaaatcgtatcttcgaagaatatggtttcactgtggcaaatgcaactgagttatacaaatcactc

SEQ ID NO: 520 - protein, 729 aa, Streptococcus pyogenes
VATVSTGSLIFIVKKNPPMMSKLVFFWQNREKEFRDFGGFSEKSVYFCDTIDNRKRLILVVINREVLLMTFDAIDQLAVNTVRTLSMDAIQAANSGHPGLPMGAAPMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALNGDGDLMEGVSQEAASMAGHLKLGKLVLLYDSNDISLDGPTSMAFTEDVKGRFEAYGWQHILVKDGNDLEEIAAAIEAAKAETEKPTIIEVKTIIGFGAEKQGTSAVHGAPLGAEGIAFAKKAYQWTHQDFEVPAEVTERFAQGLQARGEKAEQAWNDLFAAYEAEYPELAAEYQKAFTNEAAQVELEAHELGSSMASRVSSQQAIQQISEQVASFWGGSADLSASNNTMVKAETDFQPGHYEGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWKRAIAETDRPTMLVLTRQNLPVLEGTKELAEDGLSKGAYILSEAKGDLDGILIATGSEVKLAMDTQEALEAEGIHVRVVSMPSQNIFDEQSAEYKESILPAAVTKRLAIEAGSSFGWAKYVGLSGKTLTIDTWGASAPGNRIFEEYGFTVANATELYKSL

SEQ ID NO: 521 - DNA, 927 bp, Streptococcus agalactiae
atgagatgttcaaccaaagaaatgaggcttgtctatcgtgatttcctccttcaagctaatcaagaaaataaacaaattaccgttttagaagccgatttgtcgagttcaatgtcaacaaatgcactggcatcagaatttggaaaacgttatattaatctaggtattatggaggctgagatggtaggccttgcagcagggctcgccattaaaggttacaagccataccttcatacttttggtcctttcgcgtcaaggcgtgtctttgatcaagtattcttatcgttaggttactcacaattatcagctacgattattggctcagatgcaggaattagcgcagaaatgaatggcggaactcatatgccttttgaagagttaggtctactaaggttaattcccaaagcgactatttttgaggttagtgatgatattcagtttgaagcaattttaaaacaaacattaagtattgatggcctaaaatacattagaactattcgtaaggcccccactgcagtttatgagggacgcgaagatttttcaaagggttttatacaattacgccagggaaaagatattactcttgtagcaagtggtattatggtttctagagcgatagaagcagccgactacctcaaagaactagggattgaggcctcagttatcgacctttttaaaattaagccccttccagaagaactgaaaccattactgatagatcaatccattgtaactattgagaatcataaccgtattggcggtatcggaagtgcattatgcgaatggcttagtatggagaaagacactactgttagtcgtatgggtattgatgagcgatttggtcaggtaggtcagatggaatatttattagaggagtatggactcgctgttaaagatatagtacagcattgcaaatcaatttataaatca

SEQ ID NO: 522 - protein, 309 aa, Streptococcus agalactiae
MRCSTKEMRLVYRDFLLQANQENKQITVLEADLSSSMSTNALASEFGKRYINLGIMEAEMVGLAAGLAIKGYKPYLHTFGPFASRRVFDQVFLSLGYSQLSATIIGSDAGISAEMNGGTHMPFEELGLLRLIPKATIFEVSDDIQFEAILKQTLSIDGLKYIRTIRKAPTAVYEGREDFSKGFIQLRQGKDITLVASGIMVSRAIEAADYLKELGIEASVIDLFKIKPLPEELKPLLIDQSIVTIENHNRIGGIGSALCEWLSMEKDTTVSRMGIDERFGQVGQMEYLLEEYGLAVKDIVQHCKSIYKS

SEQ ID NO: 523 - DNA, 159 bp, Streptococcus agalactiae
atgctagataaaattaaaacaatacctttccaagctcgcataacgaccacccctttatttttagtaaggataaaataccacaagatacttatacaaaacttaaaaatttcagaaaataacaaaaaggcaactccaatgttgcctttttgttatgattta

SEQ ID NO: 524 - protein, 53 aa, Streptococcus agalactiae
MLDKIKTIPFQARITTTPLFLVRIKYHKILIQNLKISENNKKATPMLPFCYDL

SEQ ID NO: 525 - DNA, 1152 bp, Streptococcus agalactiae
ttgacaagtttatcgctaacattcctcttatcaaccaaatttaggatacttgaaagttactttcaaggtattgaaaatatgtatttttaccacaaggtaatggctgtattttcaatgattttgcttctattgcacaaaattggtcttggacaaggcggacatggaagtgagtttgcaaagactattggcagtgcgggattatatctttttctaagtattgtttttgtagcttatttcggaaattttttaaagtatgaaatttggcgttttattcatcgctttgtttatttagcttatattttgggattggtacatacttttatgattttaggagataggatactaggaaatactttactcagtttaatcgtattaggttatgctgtcattggggttatatctggattttatattattttcctatattctagaatgcgttttcgtcgtgtagggtacgttcaaaaggttactcatcttaaccatgatacaactgagattgaaatagcaatgaagcgtccttatcgatatgactatggacaatttactttttttaaaatttatcaagctggctttgaatcagcagctcatcctttctcgatatcaggtggtcatgatagagtgatatttttaactgttaaagcttcaggagattatacgaaatccatttacaaacagctaaaagttgggacaaaaatagccttagatagagcttatggtcatatgttatttgataaagacaagaaagaacaggtttggattgcaggaggtatcggcatcactcccttcatttcatttattagagaaaatagtattttgactaagagagttgacttcttttataccttttcaaatcaagacaatttgatttatcaagatatgttagaatcctatgctaaagccaatcctaattttaaacttcacttaaataatagtagcctcaaaggaagacttgattttagtcagtctgtttttgaaggacaaccaacaatatttatgtgtgggccaactagtatgacatctacttatgctaaggtctttcggcaaaaagatgcaaagtctcgtttagtctatgaaggattttcctttagagacagttggttatccatatttctattaaaaacttttgacaaagtttattctaatttgataaaa

SEQ ID NO: 526 - protein, 384 aa, Streptococcus agalactiae
MTSLSLTFLLSTKFRILESYFQGIENMYFYHKVMAVFSMILLLLHKIGLGQGGHGSEFAKTIGSAGLYLFLSIVFVAYFGNFLKYEIWRFIHRFVYLAYILGLVHTFMILGDRILGNTLLSLIVLGYAVIGVISGFYIIFLYSRMRFRRVGYVQKVTHLNHDTTEIEIAMKRPYRYDYGQFTFFKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLKGRLDFSQSVFEGQPTIFMCGPTSMTSTYAKVFRQKDAKSRLVYEGFSFRDSWLSIFLLKTFDKVYSNLIK

SEQ ID NO: 527 - DNA, 267 bp, Streptococcus agalactiae
atggcaatctcaaaagagaaaaaaaatgaaatcattgctcaatatgcacgacacgaaggtgatacaggatcagttgaagttcaagtagcagttcttacttgggaaatcaaccaccttaacgaccacatcaaacaacacaaaaaagaccacgctacttaccgtggattgatgaaaaaaattggtcaccgtcgtaacttattagcatacctacgtcgtacagatgttaaccgttaccgtgaattgattcaatcacttggacttcgtcgt

SEQ ID NO: 528 - protein, 89 aa, Streptococcus agalactiae
MAISKEKKNEIIAQYARHEGDTGSVEVQVAVLTWEINHLNDHIKQHKKDHATYRGLMKKIGHRRNLLAYLRRTDVNRYRELIQSLGLRR

SEQ ID NO: 529 - DNA, 267 bp, Streptococcus pyogenes
atggcaatctcaaaagagaaaaaaaatgaaatcattgctcaatatgcacgtcatgaaggcgatacaggttcagttgaagttcaagtagcagttcttacttgggaaatcaaccacttgaacagccacatcaaacaacacaaaaaagaccacgctacttaccgtggattgatgaaaaaaattggtcaccgtcgtaacttgttggcatacctacgtcgtacagatgttaaccgttaccgtgagttgatccaatctcttggacttcgtcgt

SEQ ID NO: 530 - protein, 89 aa, Streptococcus pyogenes
MAISKEKKNEIIAQYARHEGDTGSVEVQVAVLTWEINHLNSHIKQHKKDHATYRGLMKKIGHRRNLLAYLRRTDVNRYRELIQSLGLRR

SEQ ID NO: 531 - DNA, 2139 bp, Streptococcus agalactiae
atggagaataatatgtcaaaacaagtctttgaaatgatttttgctggaaaaaaattagttgttgaaactggccaagtggctaaacaagcaaatggatcagttgtcgttcgttatggagattctactgtactcacagcagcagttatgtctaagaaaatgtcaacaggtgattttttcccacttcaagtcaattacgaagaaaaaatgtatgctgctgggaaatttccgggtggctttaacaaacgtgaagggcgtccaagtacggatgctaccttaacagcacgtcttattgatagaccaatccgtccgatgtttgctgagggatttcgtaacgaagtacaggtcatcaatactgttctttcatttgatgaaaatgctagcgcaccaatggctgctatgtttggttcatcattagcattatcgatttccgatattcctttcaatgggccaattgctggagttcaagttgcttatgttgatggtaattttattattaatccgacagcacaagaacaagaggcttctgcgttagaattaacggttgcaggtactaaagaagcgattaacatggttgaatctggagcgaaagaactttcagaagaaatcatgctagaggctcttcttaaaggacatgaggctgtctgtgaattaatcgcctttcaagaagagattgttactgctattggtaaagaaaaagccgaggtagaacttcttcaagttgatccagaacttcaagcagaaattattgctactcataacatagctttacaggctgcagtacaagttgaagagaaaaaggctagagaagcagctacagaagcagttaaagaagtagttataggtgaatatgaggcacgttacgctgaacatgaagaatatgatcgcattatgcgtgatgttgctgaaattttagaacaaatggaacatgcagaagttcgtcgcctcattacagaagataagattcgtcctgatggacgtcgtgtggatgagattcgtccattagacgcagagattgattttttaccacaagttcatggatcaggtctctttacacgaggacaaacccaagcattatcagtattaacgttagcacctatgggtgaagcacaaatcattgatgggctaacaccagagtataagaaacgctttatgcaccactataacttcccacaatattcagttggtgagacgggacgttatggagctgcagggcgtcgtgaaattggtcacggtgctttaggagagcgtgcattagaacaagtccttccaagattggaggagtttccgtatgctatccgactagttgcagaagttttagaatcaaacggttcatcatctcaggcttctatatgtgctggaacgcttgctcttatggcaggtggtgtgcctataaaagctccagttgctggtattgccatggggctcatatcagatggaacaaactatacagtcctcactgatattcaaggattagaagaccattttggcgatatggactttaaagttgcgggtacacgtgaagggattacagcacttcaaatggatattaaaattgaaggtattacccctcaaattttggaagaagctcttgcgcaagctaaaaaagcacgctttgaaattcttgatgtccttcatggagctatcgcagagccacgtccacaattagcaccaacggcacctaagattgatatgataaaaatcgatgttgataagattaaagttgtcatcggtaaaggtggcgaaactatcgataaaatcatcgctgaaacaggtgttaagattgatattgatgaagaaggaaatgtatctatcttctctagtgatcaggctgctattgatcgtacgaaagacattattgcaagtttagtacgtgaagcaaaagtgggagaagtttaccatgctaaagtagttcgtatcgagaaattcggtgcctttgtcaacctctttgataaaacagatgcattggtacatatttcagaaattgcatggacacgtacagcaaatgtagctgatgttcttgaaattggtgaagaagttgatgtgaaagtcatcaaaattgatgataaagggcgagttgatgcttctatgaaagcattgttaccacgtcctccaaaagctgacaatcctaaaaaggaatct

SEQ ID NO: 532 - protein, 713 aa, Streptococcus agalactiae
MENNMSKQVFEMIFAGKKLVVETGQVAKQANGSVVVRYGDSTVLTAAVMSKKMSTGDFFPLQVNYEEKMYAAGKFPGGFNKREGRPSTDATLTARLIDRPIRPMFAEGFRNEVQVINTVLSFDENASAPMAAMFGSSLALSISDIPFNGPIAGVQVAYVDGNFIINPTAQEQEASALELTVAGTKEAINMVESGAKELSEEIMLEALLKGHEAVCELIAFQEEIVTAIGKEKAEVELLQVDPELQAEIIATHNIALQAAVQVEEKKAREAATEAVKEVVIGEYEARYAEHEEYDRIMRDVAEILEQMEHAEVRRLITEDKIRPDGRRVDEIRPLDAEIDFLPQVHGSGLFTRGQTQALSVLTLAPMGEAQIIDGLTPEYKKRFMHHYNFPQYSVGETGRYGAAGRREIGHGALGERALEQVLPRLEEFPYAIRLVAEVLESNGSSSQASICAGTLALMAGGVPIKAPVAGIAMGLISDGTNYTVLTDIQGLEDHFGDMDFKVAGTREGITALQMDIKIEGITPQILEEALAQAKKARFEILDVLHGAIAEPRPQLAPTAPKIDMIKIDVDKIKVVIGKGGETIDKIIAETGVKIDIDEEGNVSIFSSDQAAIDRTKDIIASLVREAKVGEVYHAKVVRIEKFGAFVNLFDKTDALVHISEIAWTRTANVADVLEIGEEVDVKVIKIDDKGRVDASMKALLPRPPKADNPKKES

SEQ ID NO: 533 - DNA, 2130 bp, Streptococcus pyogenes
atgtcaaaacaaacctttacaacaacatttgcagggaaaccccttgttgttgaagttggtcaagtcgctaagcaagccaatggggcaaccgttgttcgttatggcgactcaactgtcctgaccgcagctgttatgtctaagaaaatggcaacgggtgatttcttcccccttcaagttaattacgaagaaaaaatgtatgccgctggtaaattcccaggaggtttcatgaaacgtgagggacgcccttcaacagatgcgaccttgacagctcgcttgattgaccgcccgattcgtcccatgtttgccgaaggttttcgtaacgaagtacaagtgattaacactgtcctttcttatgatgaaaatgctagcgctccaatggcagcgatgtttggctcatctctggccttgtcaatctcagatattccatttaatggaccgattgcaggtgttcaagttggctatattgatggcgagttcatcattaacccagataaagaacagatggaagcatcactcttagaattaactgttgctggtagcaaagaagccatcaatatggttgagtctggtgccaaagaattatcagaagacatcatgcttgaggctcttttaaaaggtcaccaagctattcaagaattaattgccttccaagaacaaatcgtagcagttgttggtaaagaaaaagctgaggttgaactgttacaggttgatgtagacttacaagctgatattgtggctaagtacaatgctcaactgcaaaaagctgttcaagttgaagagaaaaaagcgcgtgaagcagccacagaagccgttaaagaaatggttaaggctgaatacgaagagcgttacgcagaagacgaaaacctagcaaccattatgcgtgacgtggcagaaatccttgaacaaatggagcatgctgaggtgcgccgcctcattacagaagacaagattcgtcctgatggtcgtaagattgacgaaattcgtccgcttgatgctgtggttgacttcttgccaaaagtacatggatcaggtctttttacgcgcggtcaaacgcaggccttgtcagttttgactttggcaccaatgggagaaactcaaatcattgatggtctggccccagagtacaaaaaacgctttttgcatcactacaatttcccgcaatattcagttggtgaaacgggtcgttacggagctgctggtcgtcgtgaaattggacacggtgccttaggtgaacgcgctcttgaacaagtcttgccaagcttagaagagtttccttatgctattcgtttagttgccgaagttctagaatctaacggttcgtcttctcaggcttctatctgtgctgggacccttgccctaatggctggtggtgtgccgattaaagcgcctgtggcagggattgccatgggtctcatttccgatgggacgaattatacagtcttgaccgatatccaaggtcttgaagaccactttggagatatggactttaaagtggcaggaactcgtgaagggattacagcccttcaaatggatattaagattgcaggaattacccctcaaatcctagaagaagctcttgcacaagctaaaaaagctcgctttgaaatccttgatgtgattgaagcaactatcgctgaaccacgtcctgagttagccccaactgcaccgaaaattgacaccatcaagattgacgtagacaaaatcaaagtggttatcggtaaaggtggcgaaactattgacaagattattgccgaaacgggtgtcaaaattgatattgatgacgaaggaaatgtctctatctactcaagtgaccaagctgccattgaccgcactaaagaaattattgcaggtcttgttcgtgaagctaaggtaggcgaagtttaccatgctaaggttgtccgtattgagaaatttggtgcctttgtcaacctctttgacaagacagatgctcttgttcacatttctgaaattgcctggacgagaacgaccaacgtgtcagatgtccttgaagtgggtgaagacgttgatgttaaggtcattaagattgatgagaagggtcgtgtggatgcctcaatgaaagctttgattccacgcccaccaaaaccagagaaaaaagaagaaaaacatgac

SEQ ID NO: 534 - protein, 710 aa, Streptococcus pyogenes
MSKQTFTTTFAGKPLVVEVGQVAKQANGATVVRYGDSTVLTAAVMSKKMATGDFFPLQVNYEEKMYAAGKFPGGFMKREGRPSTDATLTARLIDRPIRPMFAEGFRNEVQVINTVLSYDENASAPMAAMFGSSLALSISDIPFNGPIAGVQVGYIDGEFIINPDKEQMEASLLELTVAGSKEAINMVESGAKELSEDIMLEALLKGHQAIQELIAFQEQIVAVVGKEKAEVELLQVDVDLQADIVAKYNAQLQKAVQVEEKKAREAATEAVKEMVKAEYEERYAEDENLATIMRDVAEILEQMEHAEVRRLITEDKIRPDGRKIDEIRPLDAVVDFLPKVHGSGLFTRGQTQALSVLTLAPMGETQIIDGLAPEYKKRFLHHYNFPQYSVGETGRYGAAGRREIGHGALGERALEQVLPSLEEFPYAIRLVAEVLESNGSSSQASICAGTLALMAGGVPIKAPVAGIAMGLISDGTNYTVLTDIQGLEDHFGDMDFKVAGTREGITALQMDIKIAGITPQILEEALAQAKKARFEILDVIEATIAEPRPELAPTAPKIDTIKIDVDKIKVVIGKGGETIDKIIAETGVKIDIDDEGNVSIYSSDQAAIDRTKEIIAGLVREAKVGEVYHAKVVRIEKFGAFVNLFDKTDALVHISEIAWTRTTNVSDVLEVGEDVDVKVIKIDEKGRVDASMKALIPRPPKPEKKEEKHD

SEQ ID NO: 535 - DNA, 750 bp, Streptococcus agalactiae
atgacaagtacaaacgagttagacattagattgcgtgcttttatcaatgcaccggataattttttagatagtataggtcttgtgaatgccttgcaccactctacggtttgggcaagcaaggaaccctatgctattcaagtagatggtcaagaagttgttcctgtttttacggatattactgaccttaatcatttcaaagaggagcaagaaagtgctcgagatatgttttgggagagtcgtcgtagtttagacgttcttgatgaagctatttcacatggcttagcaggattggtctataatttaaaaaaagaaggcgattttgggaactcgactattttctactgtgaagatatggtgcaatttatgaataattacaccacaatcttaaatcagttgttaaatgaagataacattgttgccgatatcatggataaaacctacttggtacctgcctttgtccatccacgtgaagaaggtagttttgaccgtcttttccctacaatgtctacccccgaaggaaaaagttatgttccagtattctcaaaccttttaagttttgaaaaatggtataaccataatgattttggtggtgcttttaggaaagcacaaggagtaattttagcctggacgattgacgatatttataaaccgcgtaatggagaaaatgagattgatgatacctttggagtagccatcaatccatttgatgaacaacaagttttagttgattggtctgatgtagaaaacgat

SEQ ID NO: 536 - protein, 250 aa, Streptococcus agalactiae
MTSTNELDIRLRAFINAPDNFLDSIGLVNALHHSTVWASKEPYAIQVDGQEVVPVFTDITDLNHFKEEQESARDMFWESRRSLDVLDEAISHGLAGLVYNLKKEGDFGNSTIFYCEDMVQFMNNYTTILNQLLNEDNIVADIMDKTYLVPAFVHPREEGSFDRLFPTMSTPEGKSYVPVFSNLLSFEKWYNHNDFGGAFRKAQGVILAWTIDDIYKPRNGENEIDDTFGVAINPFDEQQVLVDWSDVEND

SEQ ID NO: 537 - DNA, 750 bp, Streptococcus pyogenes
atgactaaatcaaatgaattagatattcgcttaagagcttttatcaatgcgcctgataactttttggatagccttgcgcttgtcaacgctttccataattttcctgtctgggctgctaaagaaccctacgtgatagaagtcgaaggtgtcaaggttacccctgtttttaccgataaggaagatatggctcgctttaaagaagaacaaaagagtgctcaaagtcagtattggctggagcgttcagctcttgcagtgctagaagaagtcattacatctggtgcagcaggtcttatctttaaccttaagaaaaagggagattttgggaattctaccattttcaaaagcagtgatatgattcaatttatgaaccattacaccactgtgttaaatacgcttatgagtgatgacaatgtggcggcagatacgatggaaaaggtttaccttgttcctgcctttgtttatcctaaagataataaccattacgaccgcctttttcctaccatgtcaacgcctgaaggaaaaagctatgttcccgccttttcaaatcttcaaagctttgcgaaatggtacaaccaagacgattttggaggccttttcaggaaagctgaaggagtgattctgacttggacgattgatgatatttatcaaccaagaaatggtgaaaacgagcttgatgaaacgttcggtgtcgccatcaatccttttgatgaccaacaaattcttgttgattggtcagaattagataagtcg

SEQ ID NO: 538 - protein, 250 aa, Streptococcus pyogenes
MTKSNELDIRLRAFINAPDNFLDSLALVNAFHNFPVWAAKEPYVIEVEGVKVTPVFTDKEDMARFKEEQKSAQSQYWLERSALAVLEEVITSGAAGLIFNLKKKGDFGNSTIFKSSDMIQFMNHYTTVLNTLMSDDNVAADTMEKVYLVPAFVYPKDNNHYDRLFPTMSTPEGKSYVPAFSNLQSFAKWYNQDDFGGLFRKAEGVILTWTIDDIYQPRNGENELDETFGVAINPFDDQQILVDWSELDKS

SEQ ID NO: 539 - DNA, 594 bp, Streptococcus agalactiae
ttgaggataactatggggtggtggaaagaaagtatagctattgtcaaagaacaagatccagctgctcgtagttctctagaagttattttaacttatccaggaataaaagctcttgcagctcataggctatctcattttttatggaatcataattttaaattgttagcacgtatgcacagtcaattttggcgtttctggacacaaattgaaattcatcccggagcgacgatttcggaaggggtttttattgaccacggttcaggattggtcattggagaaactgccattgtagagaaaggtgctatgctataccatggggttacattgggtggcacaggtaaagacaaaggcaaacgacacccaaccatacgtaaaggagcgctaatttcagcacattctcaaatcattggtccaattgaggttggagaaaatgctaaagtcggtgctgcagcagttgtccttgcagatgtgccagcagacgtaacagtagttggtgttccagctaaagttgtccgtgtccatggtcaaaaggatgatcttcaaatccgaagtattgaacatgatcgagaagaaagttattattcgtccaaactt

SEQ ID NO: 540 - protein, 198 aa, Streptococcus agalactiae
MRITMGWWKESIAIVKEQDPAARSSLEVILTYPGIKALAAHRLSHFLWNHNFKLLARMHSQFWRFWTQIEIHPGATISEGVFIDHGSGLVIGETAIVEKGAMLYHGVTLGGTGKDKGKRHPTIRKGALISAHSQIIGPIEVGENAKVGAAAVVLADVPADVTVVGVPAKVVRVHGQKDDLQIRSIEHDREESYYSSKL

SEQ ID NO: 541 - DNA, 579 bp, Streptococcus pyogenes
atgggttggtggaaagaaagtatagctattgttaaagctctagacccagctgctcgtaatagtcttgaggttatcctaacttatccaggcatcaaagccctagctgctcatcgtttgtctcattttctttggcgacatcattttaaattactagccagaatgcatagccaattttggcgattttggacacaaattgaaatccatcctggagcacaaatcgctcctggagtcttcattgaccatggtgctggtcttgttattggagagacagcaattgttgaaaaaggtgtgatgctttatcatggggtgaccctaggtggaaccggaaaagattgtggcaagcgtcatccaacggttcgacaaggtgccttaatttcggcacatgcccaagtgattggacctattgacatcggagcaaatgctaaagtaggggcagcagctgttgtgttatcagatgttcctgaagacgtgacagttgtaggtgtgccagctaagatagtacgagtgcatgggcaaaaagataatcgtcaaattcaaagtttacaaaaacaacgagaggtctcttatcagttgtcaaaa

SEQ ID NO: 542 - protein, 193 aa, Streptococcus pyogenes
MGWWKESIAIVKALDPAARNSLEVILTYPGIKALAAHRLSHFLWRHHFKLLARMHSQFWRFWTQIEIHPGAQIAPGVFIDHGAGLVIGETAIVEKGVMLYHGVTLGGTGKDCGKRHPTVRQGALISAHAQVIGPIDIGANAKVGAAAVVLSDVPEDVTVVGVPAKIVRVHGQKDNRQIQSLQKQREVSYQLSK

SEQ ID NO: 543 - DNA, 180 bp, Streptococcus agalactiae
gtgaaggattatgtaacaactcaaatattatcaatcttaggtatactagcagcagcttgtttaagctatttaaagtttgcacaaggtaaccctctcttaggaattatttgggctgcttttgttttaatgtatgttgttcgtttgtataaagcttatcaaaaacagaaaaaggaaaaacca

SEQ ID NO: 544 - protein, 60 aa, Streptococcus agalactiae
MKDYVTTQILSILGILAAACLSYLKFAQGNPLLGIIWAAFVLMYVVRLYKAYQKQKKEKP

SEQ ID NO: 545 - DNA, 1341 bp, Streptococcus agalactiae
atgataaaaatttacgacactatgactcgcagtttacaagattttatacctctcaatgaaggtaaagtcaacatgtacgtctgtgggccaacagtttataactatatacacatcgggaatgcccgcagtgtagtagcttttgatactattcgtcgttattttgagtattgtggttaccaagtcaattatatttctaactttactgatgttgatgataaaattataaaaggtgcagctgaagcaggtatggatacaaaatccttttcagataagtttatttcagcatttatggaagatgttgctgcattaggtgtcaaacctgctacaaaaaatcctcgagttattgactatatggatgagattattgattttgttaaagttttagttgataaggaatttgcctatgaagctaatggagatgtttattttagagtaagtaaatcacatcattatgcaaaattagccaataaaactttggaagatttagagattggtgcaagtggtcgtgttgatggtgaaggagagattaaagagaatcctttagattttgcactttggaaatcagctaaatctggggaagtctcatgggaaagtccttgggggaaagggcgcccagggtggcatattgaatgttctgttatggcaactgagatccttggtgatactattgatatccatggtggaggagctgatttagaatttccacatcacacgaatgagattgcacaatctgaagctaaaacaggtaagacctttgcaaattactggatgcataatggttttgttaacgttgataacgagaaaatgtctaaatctcttggtaactttattactgttcacgatatgttgaagagcgttgacggacaagtaatacgttttttcttagcgacacaacagtatcgtaaacccgtgaatttcactgaaaaggccgttcatgatgcggaagttaaccttaaatatttaaaaaatactttcaacttaccaatccaagagaatgctaatgatgaagaattagagcaatttgtgaaagcatttcaaggagcgatggatgatgattttaatacagcaaacggtattactgttatctttgaaatggcaaaatggattaattcaggacactatacttcaagagttaaggaaacctttgctgaattattagaaatttttggtattgtattccaagaggaagttcttgatgctgatattgaatctttaatagaacaacgtcaagaagcacgagctaatcgtgattttgcaactgctgatcgtattagagatgaattagcaaaacaaggaattaaattgttagatactaaggatggcgtgaggtggactcgtgat

SEQ ID NO: 546 - protein, 447 aa, Streptococcus agalactiae
MIKIYDTMTRSLQDFIPLNEGKVNMYVCGPTVYNYIHIGNARSVVAFDTIRRYFEYCGYQVNYISNFTDVDDKIIKGAAEAGMDTKSFSDKFISAFMEDVAALGVKPATKNPRVIDYMDEIIDFVKVLVDKEFAYEANGDVYFRVSKSHHYAKLANKTLEDLEIGASGRVDGEGEIKENPLDFALWKSAKSGEVSWESPWGKGRPGWHIECSVMATEILGDTIDIHGGGADLEFPHHTNEIAQSEAKTGKTFANYWMHNGFVNVDNEKMSKSLGNFITVHDMLKSVDGQVIRFFLATQQYRKPVNFTEKAVHDAEVNLKYLKNTFNLPIQENANDEELEQFVKAFQGAMDDDFNTANGITVIFEMAKWINSGHYTSRVKETFAELLEIFGIVFQEEVLDADIESLIEQRQEARANRDFATADRIRDELAKQGIKLLDTKDGVRWTRD

SEQ ID NO: 547 - DNA, 1341 bp, Streptococcus pyogenes
atgattaaaatttatgataccatgacccgttcgctccgcaagtttgtacctttgactgaaaatacagtcaatatatacgtttgtggaccgacggtctataattatattcatattggaaatgctagatcagcggtcgcttttgacaccattcgacgttattttgagtatactggctatcaggtcaattacatttccaattttaccgatgtcgatgataaaattatcaaggctgctactcaagcaggtgtttctcctaaagaattgtcagatcgctttattgcagcttttatagaagataccaaggcacttggtgttaagccagccacacaaaatcctcgtgttatggattatatagcagaaatcatttcatttgttgaaagtctcattgaaaaagattttgcttacgaagcagatggagatgtgtatttccgcgtggaaaagtcagagcattatgccaagctagctaataaaaccctgtcagaacttgaagttggagccagtggtcgaacagatgctgagacagctttaaaagaaaatccactggactttgctctttggaaatcagctaaggcaggtgaggtttcttgggatagcccctgggggtttggtcgtccaggctggcacattgaatgttctgtgatggctactgaaattcttggtgataccattgatattcatggtggcggagctgatttggaatttcctcatcataccaatgaaattgcccaatctgaggccaaaacaggcaagacttttgctaactattggatgcacaatgggtttgtcactgttgataacgaaaaaatgtccaagtcactaggtaattttgtgaccgttcatgacatgttacaaaccgttgatggtcaggttttgcgattctttcttgcgacacaacagtaccgaaaaccaattaacttcactgaaaagactattcatgatgcggaaatcaatctgaagtatcttaaaaacaccttgcaacaaccgctgacagaaactgcagatgagcaagagctaaaacagtttgtaatagctttccaagacgctatggacgatgatttcaatacagcaaatgggattaccgtcgtatttgacatggccaagtggattaattctggctcctatacagaacctgttaaaagcgcttttgagaaaatgttagctgtttttggcattatctttgaagaagaggtgcttgaggttgacattgaagccttgattgccaagcgacaagaagcacgcgcgaatcgtgattttgccacagctgatgccattcgagatcagttagcagttcaaggcatcaagctgctagataccaaagatggtgtgaggtggctgcgtgac

SEQ ID NO: 548 - protein, 447 aa, Streptococcus pyogenes
MIKIYDTMTRSLRKFVPLTENTVNIYVCGPTVYNYIHIGNARSAVAFDTIRRYFEYTGYQVNYISNFTDVDDKIIKAATQAGVSPKELSDRFIAAFIEDTKALGVKPATQNPRVMDYIAEIISFVESLIEKDFAYEADGDVYFRVEKSEHYAKLANKTLSELEVGASGRTDAETALKENPLDFALWKSAKAGEVSWDSPWGFGRPGWHIECSVMATEILGDTIDIHGGGADLEFPHHTNEIAQSEAKTGKTFANYWMHNGFVTVDNEKMSKSLGNFVTVHDMLQTVDGQVLRFFLATQQYRKPINFTEKTIHDAEINLKYLKNTLQQPLTETADEQELKQFVIAFQDAMDDDFNTANGITVVFDMAKWINSGSYTEPVKSAFEKMLAVFGIIFEEEVLEVDIEALIAKRQEARANRDFATADAIRDQLAVQGIKLLDTKDGVRWLRD

SEQ ID NO: 549 - DNA, 384 bp, Streptococcus agalactiae
gtgattgatgttcgtttgattaatggtattgctttagcttttgaaggagatgcagtttattctttgtatatccgacgccatttaattatgcagggttttaccaaacctaatcagttacatcggaaagcaacccaatatgtttctgctaatgcccaagcattgttaattaatgccatgttagaagaaaatattttaactgatgaagagcagttaatttataaacgaggacgtaatgcgaatagtcatacaaaagctaaaaatgctgatattattacctatcgtatgtctacaggttttgaggctcttatggggtacttggatatgactggtcagataaagcgcttggaaactctaatacagtggtgtattgaaaccattgaaaaa

SEQ ID NO: 550 - protein, 128 aa, Streptococcus agalactiae
MIDVRLINGIALAFEGDAVYSLYIRRHLIMQGFTKPNQLHRKATQYVSANAQALLINAMLEENILTDEEQLIYKRGRNANSHTKAKNADIITYRMSTGFEALMGYLDMTGQIKRLETLIQWCIETIEK

SEQ ID NO: 551 - DNA, 411 bp, Streptococcus pyogenes
gtgactaatccagttgatgtgaatttgattaatggcattgccctagcctttgaaggggatgcggtttattcctactatgttcgtcgtcatctcatttttcaaggtaaaacgaaacctagccagctacaccgtttagcaacgagatatgtttctgctaaggcacaagccaacttgattcaggctatgttagaagcgcagctattgaccgaaaaagaagaagacatctataagcgtggtcgcaataccaatagccatactaaagctaagaatgccgatattattacctatcgtatgtcgacaggttttgaagccattatgggttatcttgatatgatgggccaaaaagagcggttagaagaattgatcagatggtgtattgagtatgtagaaaagcaacaattgatatcctca

SEQ ID NO: 552 - protein, 137 aa, Streptococcus pyogenes
VTNPVDVNLINGIALAFEGDAVYSYYVRRHLIFQGKTKPSQLHRLATRYVSAKAQANLIQAMLEAQLLTEKEEDIYKRGRNTNSHTKAKNADIITYRMSTGFEAIMGYLDMMGQKERLEELIRWCIEYVEKQQLISS

SEQ ID NO: 553 - DNA, 753 bp, Streptococcus agalactiae
atgactatgaaagataaacaatttaaagaagaatcaagtgaccttgtctatggcttacatgctgtgacagagagtttaagagctaatactggtaataaattatacttgcaagatgacttaagaggaaagaacgttgataaagtcaaagcactagcgactgaaaaaaaagtatccatttcctggactcctaaaaaaaccttatcagacatgacaaatggtggagttcaccaaggattcgttctaaaagtttcggaatttgcctatgcggatttatcagagataatgacaaaggcagagaatgaagaaaatcctctcattttaatccttgatggtctgaccgaccctcacaacctaggttctattctacgcacagctgatgcaaccaatgtaacaggtattatcatccccaaacatcgttctgttggagtgaccccagtggtttcaaagacatctacaggagctgttgaacatgttcctattgcaagggtaactaatctcagtcaaactttggatactttaaaagataaggagttctggatatttggcactgatatgaatgggacaccatcgcataagtggaataccaaaggtaaattagccctagttattggtaatgaaggaaaaggtatttctcataatatcaaaaagcaagtagatgaaatgattacaattcccatgaatggtcatgttcagagtttaaatgccagtgtcgcagccgctattttgatgtatgaagtatttagaaaccgccta

SEQ ID NO: 554 - protein, 251 aa, Streptococcus agalactiae
MTMKDKQFKEESSDLVYGLHAVTESLRANTGNKLYLQDDLRGKNVDKVKALATEKKVSISWTPKKTLSDMTNGGVHQGFVLKVSEFAYADLSEIMTKAENEENPLILILDGLTDPHNLGSILRTADATNVTGIIIPKHRSVGVTPVVSKTSTGAVEHVPIARVTNLSQTLDTLKDKEFWIFGTDMNGTPSHKWNTKGKLALVIGNEGKGISHNIKKQVDEMITIPMNGHVQSLNASVAAAILMYEVFRNRL

SEQ ID NO: 555 - DNA, 771 bp, Streptococcus pyogenes
ttgaagcattcatggtataataaactcatggaagataaagatactattgaaacaaacgatatcgtctatggtgttcatgccgttacagaaagccttcaagcaaatacaggaaataagctttatatccaagaggatttaagaggaaagaaagtggataacatcaaaagcttagcgacacaaaaaaaggtcgctatttcatggacgcctaaaaaaaccttgtcacaaatgactgatggagctgtgcatcaaggttttgttctgagagtatcagcttttgcctatactgatgttgatgagatcctcgaaatagcagagcaagaagcaaatcctttgattcttattttagatggtctgacagatcctcataatttaggatcgattttacggacagctgatgctacaaatgtatgtggagtgattattcctaaacatcgttctgttggtgtgactccagtggtttcaaagacgtctacaggtgctgttgaacatattccgatagcgagagtaactaaccttagtcaaactctagataaattgaaagcaagaggattctggatttttggcacagacatgaatggaacaccgtctgattgctggaacactaatggtaaacttgctttagtcattggtaacgaaggtaaaggcatctctaccaatatcaaaaagcaagttgatgaaatgattacgattcctatgaatggtcacgtacagagcttaaatgctagcgtagcggcagctattctcatgtatgaagttttccgaaataggcgc

SEQ ID NO: 556 - protein, 257 aa, Streptococcus pyogenes
LKHSWYNKLMEDKDTIETNDIVYGVHAVTESLQANTGNKLYIQEDLRGKKVDNIKSLATQKKVAISWTPKKTLSQMTDGAVHQGFVLRVSAFAYTDVDEILEIAEQEANPLILILDGLTDPHNLGSILRTADATNVCGVIIPKHRSVGVTPVVSKTSTGAVEHIPIARVTNLSQTLDKLKARGFWIFGTDMNGTPSDCWNTNGKLALVIGNEGKGISTNIKKQVDEMITIPMNGHVQSLNASVAAAILMYEVFRNRR

SEQ ID NO: 557 - DNA, 516 bp, Streptococcus agalactiae
atgaaaaaacattctatcttactcgttgatggctacaatatgattgctttttggaaagatactcgacagctttttaaaagcaatcgtttagaagaggcaagggaagtattacttagaaagctaaatcattacgcacatttcgaacacattgatattatttgtgtatttgatgcacagtatgttcctggtgtacgtcaacgttatgaccaatacaaaatatccgttatctttactgaggaggacgaaactgcggatagctatattgaacgagcagcggcagaacttaatcaatctgtgttaaatttagtctccgttgctaccagtgatttaaatgaacaatggactatattttctcagggtgctttacgtgtctcggctagagaattggaacagcgtgtagcgacagtaaaatcagatttggataagatgtccagtcaaatcgatttgagtacgccaaagttaaggccgtggaatgatgaacaactaggaaaactcaaggattttttagatggtatg

SEQ ID NO: 558 - protein, 172 aa, Streptococcus agalactiae
MKKHSILLVDGYNMIAFWKDTRQLFKSNRLEEAREVLLRKLNHYAHFEHIDIICVFDAQYVPGVRQRYDQYKISVIFTEEDETADSYIERAAAELNQSVLNLVSVATSDLNEQWTIFSQGALRVSARELEQRVATVKSDLDKMSSQIDLSTPKLRPWNDEQLGKLKDFLDGM

SEQ ID NO: 559 - DNA, 516 bp, Streptococcus pyogenes
atgaaaaaacggatattattagtagatgggtataatatgattgccttttggcaatcaacccgtcagttgtttaagacaaatcagcttgatcaggcacgtaacacacttttaacaaaacttaatcattatgcccattttgagaatattaatattatttgtgtttttgatgcccaatatgtaccggggttaaggcaacgatatgaccagtattatatctcagtggtatttacagaggaagacgaaacagcagatagctacattgagcgcatggcagcagagttaaatacggctatacatatggtagaagtagctacgagtgatttaaatgaacaatggacgattttttctcaaggagctcttcgtgtcactgcaagagaattagagcaaagagttcatactgtcaaagctgatttagataaaatgtctagagatattgatctcaaaacgcctaaactgcggccttttgaccaaggacagcttattcaattgaaggattttatgtctcagttagatcga

SEQ ID NO: 560 - protein, 172 aa, Streptococcus pyogenes
MKKRILLVDGYNMIAFWQSTRQLFKTNQLDQARNTLLTKLNHYAHFENINIICVFDAQYVPGLRQRYDQYYISVVFTEEDETADSYIERMAAELNTAIHMVEVATSDLNEQWTIFSQGALRVTARELEQRVHTVKADLDKMSRDIDLKTPKLRPFDQGQLIQLKDFMSQLDR

SEQ ID NO: 561 - DNA, 858 bp, Streptococcus agalactiae
atgacttttaaaatactaacggattcgacatcggatttagatgaaaagtgggctcaagagcacaatgtcgatattataggtttaaccattgaacttgatggaaagacttatgagacagtcggagacgaaaaaattactagtgacttcttgttggagcgtatgcaagagggagcaaagcctacaacaagccaaattaacgttggtcagtttgaagaagttttttcaacctatgcagaaaatgaccatgccttgttatatttagcgctatcttcacatttatcaggcacttaccagagtgcaactattgcgcgtgagatggtcttagacaaatatcctgatgctcaaattgagattgtggatacgatggcagcttcatgtggtgagggtgtcttagcgatgttagcaactaaagagcgacaagaaggtaaatctttagaagaagtgaaacaaaaaattgaatcacttctccctaaattaaacacatactttttagttgacgatctcaaccatttaatgcgtagtggtcgcttatcaaaaggtgcagctatcattggaagtgttgctaagattaaaccattacttaagttagatagtgagggtaaattagtaccatttgccaagacaaggggccgtaaaaaaggtattaaagagattgtgactcaggcaacaaaaacactatcttatagcactttaattattgcttatagtggagagaaagattcagctcaagttatgaaagaacagttattagcagatgagcgtattgaagaagttattattcgtccattagggccagttatttcagctcatgtgggctcaggtgctttagctctattctctttaggggaagaaaaccga

SEQ ID NO: 562 - protein, 286 aa, Streptococcus agalactiae
MTFKILTDSTSDLDEKWAQEHNVDIIGLTIELDGKTYETVGDEKITSDFLLERMQEGAKPTTSQINVGQFEEVFSTYAENDHALLYLALSSHLSGTYQSATIAREMVLDKYPDAQIEIVDTMAASCGEGVLAMLATKERQEGKSLEEVKQKIESLLPKLNTYFLVDDLNHLMRSGRLSKGAAIIGSVAKIKPLLKLDSEGKLVPFAKTRGRKKGIKEIVTQATKTLSYSTLIIAYSGEKDSAQVMKEQLLADERIEEVIIRPLGPVISAHVGSGALALFSLGEENR

SEQ ID NO: 563 - DNA, 858 bp, Streptococcus pyogenes
atgacctttacaataatgacagattcaaccgctgatttgaatcaaacctgggcagaagatcatgatattgtccttataggattaacgattttgtgcgatggagaggtttatgaaacggtcggtcctaaccgtattagtagtgattaccttttgaaaaagatgaaagctggcagtcatcctcaaaccagtcagattaatgtgggagagtttgagaaggtttttcgtgaacatgctaggaacaacaaagcactgctttatcttgctttttcttcggttttatcgggtacctatcaaagcgctctaatggcacgcgatcttgttcgagaagattatcccgatgcggtgattgaaattgttgataccttggctgctgcaggaggagaaggctatctaaccattttagcagcagaagccagagatagtggcaaaaatttactggagactaaagatattgttgaagcagtgatccctcgactgcgcacctatttcttagtagatgatctttttcatttgatgcgtggtgggcgtctgtcaaaaggttcagcttttctaggcagtttagccagtatcaaacctcttttgtggattgatgaggaagggaaattggtgcccattgcaaaaattcggggacgccaaaaagccatcaaagaaatggtggctcaagtggaaaaagatattgcggattcgacggttattgtctcttatacaagcgatcagggtagtgccgaaaagttacgagaagagctgctggcgcatgaaaatattagcgatgttcttatgatgccactaggaccagttatctcagctcacgttggtcctaacaccctggcagtttttgtgattgggcaaaattcccgt

SEQ ID NO: 564 - protein, 286 aa, Streptococcus pyogenes
MTFTIMTDSTADLNQTWAEDHDIVLIGLTILCDGEVYETVGPNRISSDYLLKKMKAGSHPQTSQINVGEFEKVFREHARNNKALLYLAFSSVLSGTYQSALMARDLVREDYPDAVIEIVDTLAAAGGEGYLTILAAEARDSGKNLLETKDIVEAVIPRLRTYFLVDDLFHLMRGGRLSKGSAFLGSLASIKPLLWIDEEGKLVPIAKIRGRQKAIKEMVAQVEKDIADSTVIVSYTSDQGSAEKLREELLAHENISDVLMMPLGPVISAHVGPNTLAVFVIGQNSR

SEQ ID NO: 565 - DNA, 201 bp, Streptococcus agalactiae
ttgttgatgaaagtttttggaaaatgtttttgttgctggcgcatttgccctcataggaataactattttattgatgcttttactaggaaggttgatattgctacttatttttcaaggggagatgatgcaattttagcagttataggaatatcattgatagctatgggaatttcagtgtactaccataagtataaggacaga

SEQ ID NO: 566 - protein, 67 aa, Streptococcus agalactiae
MLMKVFGKCFCCWRICPHRNNYFIDAFTRKVDIATYFSRGDDAILAVIGISLIAMGISVYYHKYKDR

SEQ ID NO: 567 - DNA, 543 bp, Streptococcus agalactiae
ttgtttaccccatttgtaaggccccggaacctttcaaatactctcgtggaccggaacatccacacctgtaaacaaaaacgaattcgtataggagaaatcatgaacaaaacaactttcatggctaaaccaggccaagttgaacgcaaatggtacgttgttgacgcagcagatgtacctcttggacgtctttctgcagtagttgctagcgtacttcgcggaaaaaacaaaccaactttcacaccacacactgatacaggtgactttgtgattgttatcaatgctgaaaaagttaaattaactggtaaaaaagcgtcagataaaatctactacactcactcaatgtatccaggtggtttgaaacaaatctcagcaggtgaacttcgttctaaaaatgctgttcgtttgattgaaaaatcagttaaaggcatgcttccacataacactcttggacgtgcacaaggtatgaaattgaaagtatttgttggcggtgagcatacacatgctgcacaacaaccagaagtacttgatatctcaggacttatc

SEQ ID NO: 568 - protein, 181 aa, Streptococcus agalactiae
MFTPFVRPRNLSNTLVDRNIHTCKQKRIRIGEIMNKTTFMAKPGQVERKWYVVDAADVPLGRLSAVVASVLRGKNKPTFTPHTDTGDFVIVINAEKVKLTGKKASDKIYYTHSMYPGGLKQISAGELRSKNAVRLIEKSVKGMLPHNTLGRAQGMKLKVFVGGEHTHAAQQPEVLDISGLI

SEQ ID NO: 569 - DNA, 549 bp, Streptococcus pyogenes
ttgtttaccccatttgaaaggccccggaaccttccaaataccttcgatgggacggaacacccatcaccttgtaaacaaatattacgaattcgtataggagaaatcatgaacaaaacaactttcatggctaaaccaggccaagttgaacgcaaatggtacgttgttgacgcagctgatgtgccacttggacgtctttctgcagtagttgctagcgtacttcgcggaaaaaacaaaccaactttcacaccacatactgatacaggtgattttgttatcgttatcaacgctgaaaaagttaaattaactggtaaaaaagcaactgataaagtttactacactcactcaatgtacccaggtggtttgaaatcaatcactgctggtgaacttcgctctaaaaacgcagttcgcttgattgaaaaatcagttaaaggcatgcttccacataacactcttggacgtgcacaaggtatgaaattgaaagtcttcgttggcggtgagcatactcacgcagcacaacaaccagaagtacttgacatctcaggacttatc

SEQ ID NO: 570 - protein, 183 aa, Streptococcus pyogenes
LFTPFERPRNLPNTFDGTEHPSPCKQILRIRIGEIMNKTTFMAKPGQVERKWYVVDAADVPLGRLSAVVASVLRGKNKPTFTPHTDTGDFVIVINAEKVKLTGKKATDKVYYTHSMYPGGLKSITAGELRSKNAVRLIEKSVKGMLPHNTLGRAQGMKLKVFVGGEHTHAAQQPEVLDISGLI

SEQ ID NO: 571 - DNA, 390 bp, Streptococcus agalactiae
atggcacaagcacaatatgcaggtactggtcgccgtaaaaacgctgttgcacgcgttcgtttggtcccaggtactggtaaaattacaatcaataaaaaagatgtagaagagtacatcccacacgcagaccttcgtcttgttatcaaccaacctttcgcagttacttcaactcaaggttcatacgatgtttttgttaacgttgtaggtggtggatatgcaggtcaatcaggtgcgatccgtcatggtatctcacgtgcacttttagaagttgacccagatttccgcgattcattgaaacgtgctggacttcttacacgtgacgcacgtatggttgaacgtaaaaaaccaggtcttaagaaagctcgtaaagctagtcagttctcaaagcgt

SEQ ID NO: 572 - protein, 130 aa, Streptococcus agalactiae
MAQAQYAGTGRRKNAVARVRLVPGTGKITINKKDVEEYIPHADLRLVINQPFAVTSTQGSYDVFVNVVGGGYAGQSGAIRHGISRALLEVDPDFRDSLKRAGLLTRDARMVERKKPGLKKARKASQFSKR

SEQ ID NO: 573 - DNA, 390 bp, Streptococcus pyogenes
atggcacaagcacaatatgcaggtactggccgtcgtaaaaacgctgttgcacgcgttcgtttggttccaggtactggtaaaatcactgttaacaaaaaagatgtagaagaatacatcccacatgctgacttacgtttgatcatcaaccaaccttttgcagttacatcaactgaaggttcatacgacgttttcgttaacgttgttggtggtggttacggtggacaatcaggtgcgatccgtcatggtatcgctcgtgcgcttcttcaagtagacccagacttccgcgattcattgaaacgcgctggccttcttacacgtgacgcacgtatggttgaacgtaaaaaaccaggtcttaagaaagctcgtaaagcttcacaattctcaaaacgt

SEQ ID NO: 574 - protein, 130 aa, Streptococcus pyogenes
MAQAQYAGTGRRKNAVARVRLVPGTGKITVNKKDVEEYIPHADLRLIINQPFAVTSTEGSYDVFVNVVGGGYGGQSGAIRHGIARALLQVDPDFRDSLKRAGLLTRDARMVERKKPGLKKARKASQFSKR

SEQ ID NO: 575 - DNA, 1152 bp, Streptococcus agalactiae
atgtccattcacaaatacccaagcaaaaaagccaaaaatggctatttgtattttgtcaaaatctatatggtcaaagacagtcaacgtgcagaccatatcaaacgtggctttcgtactcgaaaggaagccaaagactacgaagccagactcatttatcttaaggcttcaggaaagttggaagagttcatcaaaccaactcataaaacttataacgagatattcgagaaatggtatcaagcctatcaagatatggtagagccaacaactgcttcacgtactcttgatatgtttcgacttcacattctgccagttatgggagacttacccatcagcaaaatctcccctttagactgccagaacttcatcacagataaagcaaagacctttaagaatatcaagcaaatcaagtcctatactgggaaggtctttgattttgctatcaagatgaaactgcttaagcataaccctatggcagaaatcattatgccaaaacggaaaaagacacggatagaaaactattggacggttcaagaacttcaggagttcctagccattgtccttcaggaagagccttacaaacactatgcactatttagattactagcttacagtggcttaaggaaaggcgagctatacgctcttaagtgggcagatatagactttcaaactgagacactaagtgtcgataagagcttaggacgattagacggacaggcaatcgaaaaaggcactaaaaatgatttctcagtaagaaagattaagctagatagcgaaactatttctattctgcaagaatggaaatccatcagccaaaaagaaaaggcacaactagcagttgcacctctttctatcgagcaagattttctcttcacttattgtacacggtcaggctctattgagccactacatgcagactatatcaacaacgtcctatcacggattatcagaaaacacgggttaaagaaaatcagtcctcatggttttagacatactcatgctaccttgatgattgagattggagttgacccagtcaacacagcaaaaagactggggcatgcaagtagtcaaatgaccttagatacttacagtcattcgacaactactggagaagataggtcagtcaaacaatttgcggactatctaaaagcaaaa

SEQ ID NO: 576 - protein, 384 aa, Streptococcus agalactiae
MSIHKYPSKKAKNGYLYFVKIYMVKDSQRADHIKRGFRTRKEAKDYEARLIYLKASGKLEEFIKPTHKTYNEIFEKWYQAYQDMVEPTTASRTLDMFRLHILPVMGDLPISKISPLDCQNFITDKAKTFKNIKQIKSYTGKVFDFAIKMKLLKHNPMAEIIMPKRKKTRIENYWTVQELQEFLAIVLQEEPYKHYALFRLLAYSGLRKGELYALKWADIDFQTETLSVDKSLGRLDGQAIEKGTKNDFSVRKIKLDSETISILQEWKSISQKEKAQLAVAPLSIEQDFLFTYCTRSGSIEPLHADYINNVLSRIIRKHGLKKISPHGFRHTHATLMIEIGVDPVNTAKRLGHASSQMTLDTYSHSTTTGEDRSVKQFADYLKAK

SEQ ID NO: 577 - DNA, 1161 bp, Streptococcus pyogenes
atggaaaggtttatgatcatgaaaataacagaacataagaagaaaaacggtacaatcgtttatcgtgctagtatttatctaggcattgaccaaatgacaggtaagagagtaaaaacaagcatcacaggaagaacaagaaaagaagttaatcaaaaagccaagcacgcgcagtttgacttcctatctaatggatctacaattaaaagaaaagttgtgattaaaacatttaaagaacttagtcatttatggcttgaaacctataagttaacagtaaagcctcaaacttatgatgctactgttactagacttaatcgacatattatgccaactctgggcaatatgaaggttgataagataaccgctagtgatattcaaatgctgattaatagattatctaaatattacgtcaattatactgcggtacgttcagtcatccgaaaagttctccaacaaggagtattgctagggctaatagattataactcagcaagagatattatccttccaaggaagcagccaaacgctaagaaaaaagttaagtttattgatccgtctgatttgaaatcttttttagaacatttagaaactagtcaacacaaacgctataacctttactttgatgcagttctctaccaacttttattatccactggcttgaggataggcgaagcctgtgcattagagtggggagatattgacctagaaaatggtacaatagccattaataagacttacaataaaaatttgaagtttttgagtacagctaaaacccagtcaggcaatagagtgattagtgttgataaaaagacccttagaagcctaaagctctatcaaatgagacagcgacaattatttaatgaggttggtgcgcgtgtgtcggaggtagtgtttgccacaccaacacgaaagtattttaatgcttcggttagacaaagcgctttagatactaggtgtaaggaagcagggattgaacgctttacctttcacgcttttagacacactcacgctagtttattgctgaacgctggtattagttataaggaacttcagtaccgtctaggacatgcgaatatcagcatgactttggatacctatggccatctttctaagggcaaagaaaaagaagctgttttatattatgaaaaggctatgaataattta

SEQ ID NO: 578 - protein, 387 aa, Streptococcus pyogenes
MERFMIMKITEHKKKNGTIVYRASIYLGIDQMTGKRVKTSITGRTRKEVNQKAKHAQFDFLSNGSTIKRKVVIKTFKELSHLWLETYKLTVKPQTYDATVTRLNRHIMPTLGNMKVDKITASDIQMLINRLSKYYVNYTAVRSVIRKVLQQGVLLGLIDYNSARDIILPRKQPNAKKKVKFIDPSDLKSFLEHLETSQHKRYNLYFDAVLYQLLLSTGLRIGEACALEWGDIDLENGTIAINKTYNKNLKFLSTAKTQSGNRVISVDKKTLRSLKLYQMRQRQLFNEVGARVSEVVFATPTRKYFNASVRQSALDTRCKEAGIERFTFHAFRHTHASLLLNAGISYKELQYRLGHANISMTLDTYGHLSKGKEKEAVLYYEKAMNNL

SEQ ID NO: 579 - DNA, 474 bp, Streptococcus agalactiae
atgtacaatagactaaaagaactacgaaaagacaaagggttaactcaggctgatctagctaaagtcatcaatactaatcaatctcaatatggaaaatatgaaaacggaaaaactagtcttagcatagaaaattctaaaatattagctgattttttcggtgtatctatcccttacttactagggcttgataacaattcaaaaatagcaaattcaacaatcaaagatacaaatttattaagtttttttgaacaagtcaaaaaggatatgggtcaagattatttttctactcttgaaacccttgaaaaagttagcaaaaaaactcttttcaactctcccatacgtgacagacttgaggaaattaagcaagaaaaaatcaagcttaaccagaaaattgatgaacttgaagcagaggctaaaaatcttcgaaaaactcttgataaagaagtaaaagagagattagaacttttaaaaaaa

SEQ ID NO: 580 - protein, 158 aa, Streptococcus agalactiae
MYNRLKELRKDKGLTQADLAKVINTNQSQYGKYENGKTSLSIENSKILADFFGVSIPYLLGLDNNSKIANSTIKDTNLLSFFEQVKKDMGQDYFSTLETLEKVSKKTLFNSPIRDRLEEIKQEKIKLNQKIDELEAEAKNLRKTLDKEVKERLELLKK

SEQ ID NO: 581 - DNA, 216 bp, Streptococcus pyogenes
atgtatccgcgtattaggaatttgagagaagataacgatttcactcaaaagtttgttgcaaatttactttccttctctcatgcaaattatgcaaaaattgagagaggagaggttgccttaatggcagatgttcttgtgcagttttataaactctataacgtcagtattgattatttattagggcaaacagattatccgtatcgttttcataataaa

SEQ ID NO: 582 - protein, 72 aa, Streptococcus pyogenes
MYPRIRNLREDNDFTQKFVANLLSFSHANYAKIERGEVALMADVLVQFYKLYNVSIDYLLGQTDYPYRFHNK

SEQ ID NO: 583 - DNA, 303 bp, Streptococcus agalactiae
atggcttacacactagaagaacgagaaacgattgtccgttatgatgaaatggataactgttggtattttgagagtaatgttaggaaacacattactaaaatcatgaaaactattgatagttgtcagattttaggtcaagagaaagaagacgaccgcattatatggattcatgctaaattgacaaatcttgatgattatatggtttctccatttgttcgaaaacgagttaaacgtgaaatgactgaagaacaacgagaggaagcaagaaaaagaatggcaagattacattctaagtctgaaata

SEQ ID NO: 584 - protein, 101 aa, Streptococcus agalactiae
MAYTLEERETIVRYDEMDNCWYFESNVRKHITKIMKTIDSCQILGQEKEDDRIIWIHAKLTNLDDYMVSPFVRKRVKREMTEEQREEARKRMARLHSKSEI

SEQ ID NO: 585 - DNA, 276 bp, Streptococcus agalactiae
atgacagaaggatttaccattcagctccccaaagtaactgaaaagaagttactggctcgctatgacactatggttcaaaaagcaatagaaaaagcccttgaggacaaagagctatataagcctatggttcgtatggctggcttgtgccgttttttagatgtctcaacgacaactattgtcaaatggcaaaaggcaggcatgccacatatggttattgacggagtgactctgtacgataagcgcaaggtcgctcaatggctacaacaatttgaaaga

SEQ ID NO: 586 - protein, 92 aa, Streptococcus agalactiae
MTEGFTIQLPKVTEKKLLARYDTMVQKAIEKALEDKELYKPMVRMAGLCRFLDVSTTTIVKWQKAGMPHMVIDGVTLYDKRKVAQWLQQFER

SEQ ID NO: 587 - DNA, 249 bp, Streptococcus agalactiae
ttgaaagataggaaatttggcatggataaaaataatttagaagacttgacaggaaaaaagatacttagaaatggttttggtggtcttcgtttggaatatgggacaatctttcttgatgttggattgttcacttatattgtgctgatactatcaatatttttctttttagttgaacgttggtttttgggagctttaacttttgtgttgcatgttcccttgcttctacttgggatatggtgtggagagaga

(The sequence listing continues in the following parts.)

The invention claimed is:

1. An isolated or recombinant *S. agalactiae* polypeptide in substantially pure form comprising twelve or more consecutive amino acids from the amino acid sequence SEQ ID NO:3744.

2. The isolated or recombinant *S. agalactiae* polypeptide of claim 1 wherein the polypeptide comprises 20 consecutive amino acids from the amino acid sequence SEQ ID NO:3744.

3. The isolated or recombinant *S. agalactiae* polypeptide of claim 1 wherein the polypeptide comprises 50 consecutive amino acids from the amino acid sequence SEQ ID NO:3744.

4. The isolated or recombinant *S. agalactiae* polypeptide of claim 1 wherein the polypeptide comprises 70 consecutive amino acids from the amino acid sequence SEQ ID NO:3744.

5. The isolated or recombinant *S. agalactiae* polypeptide of claim 1 wherein the polypeptide comprises 100 consecutive amino acids from the amino acid sequence SEQ ID NO:3744.

6. The isolated or recombinant *S. agalactiae* polypeptide of any of claim 1, 2, 3, 4, or 5, wherein the polypeptide is a recombinant polypeptide.

7. The isolated or recombinant *S. agalactiae* polypeptide of any of claim 1, 2, 3, 4, or 5, wherein the polypeptide is a purified polypeptide.

8. A composition comprising:
an isolated or recombinant *S. agalactiae* polypeptide in substantially pure form comprising twelve or more consecutive amino acids from the amino acid sequence SEQ ID NO:3744; and
an adjuvant.

9. The composition of claim 8 wherein the polypeptide comprises 20 consecutive amino acids from the amino acid sequence SEQ ID NO:3744.

10. The composition of claim 8 wherein the polypeptide comprises 50 consecutive amino acids from the amino acid sequence SEQ ID NO:3744.

11. The composition of claim 8 wherein the polypeptide comprises 70 consecutive amino acids from the amino acid sequence SEQ ID NO:3744.

12. The composition of claim 8 wherein the polypeptide comprises 100 consecutive amino acids from the amino acid sequence SEQ ID NO:3744.

13. The composition of claim 8 wherein the polypeptide is a recombinant polypeptide.

14. The composition of claim 8, wherein the adjuvant comprises an aluminium salt.

15. The composition of claim 8 wherein the polypeptide is a purified polypeptide.

16. The composition of claim 14 wherein the aluminium salt is alum.

17. The composition of claim 16 wherein the polypeptide is a purified polypeptide.

18. The composition of claim 16 wherein the polypeptide is a recombinant polypeptide.

19. The composition of claim 14 wherein the polypeptide is a recombinant polypeptide.

20. The composition of claim 14 wherein the polypeptide is a purified polypeptide.

21. The composition of claim 8, wherein the adjuvant comprises squalene, polyoxyethylene sorbitan monooleate, and sorbitan trioleate.

22. The composition of claim 21 wherein the polypeptide is a purified polypeptide.

23. The composition of claim 21 wherein the polypeptide is a recombinant polypeptide.

24. An isolated or recombinant *S. agalactiae* polypeptide in substantially pure form which comprises the amino acid sequence SEQ ID NO:3744.

25. The isolated or recombinant *S. agalactiae* polypeptide of claim 24, wherein the polypeptide is a purified polypeptide.

26. The isolated or recombinant *S. agalactiae* polypeptide of claim 24, wherein the polypeptide is a recombinant polypeptide.

27. A composition comprising:
an isolated or recombinant *S. agalactiae* polypeptide comprising the amino acid sequence SEQ ID NO:3744; and
an adjuvant.

28. The composition of claim 27, wherein the polypeptide is a purified polypeptide.

29. The composition of claim 27, wherein the polypeptide is a recombinant polypeptide.

* * * * *